US008524251B2

(12) United States Patent
Fraser et al.

(10) Patent No.: US 8,524,251 B2
(45) Date of Patent: Sep. 3, 2013

(54) *NEISSERIA MENINGITIDIS* ANTIGENS AND COMPOSITIONS

(75) Inventors: Claire Fraser, Potomac, MD (US); Cesira Galeotti, Poggibonsi (IT); Guido Grandi, Segratf (IT); Erin Hickey, Palatine, IL (US); Vega Masignani, Siena (IT); Marirosa Mora, Siena (IT); Jeremy Petersen, Arlington, VA (US); Mariagrazia Pizza, Siena (IT); Rino Rappuoli, Vagliagli (IT); Giulio Ratti, Siena (IT); Vincenzo Scarlato, Colle Val D'Elsa (IT); Maria Scarselli, Siena (IT); Herve Tettelin, Gaithersburg, MD (US); J. Craig Venter, Potomac, MD (US)

(73) Assignees: J. Craig Venter Institute, Inc., Rockville, MD (US); Novartis AG, Basel (CH)

( * ) Notice: Subject to any disclaimer, the term of this patent is extended or adjusted under 35 U.S.C. 154(b) by 0 days.

(21) Appl. No.: 13/359,471

(22) Filed: Jan. 26, 2012

(65) Prior Publication Data

US 2012/0164166 A1    Jun. 28, 2012

Related U.S. Application Data

(60) Division of application No. 13/070,448, filed on Mar. 23, 2011, which is a division of application No. 12/013,047, filed on Jan. 11, 2008, now Pat. No. 7,988,979, which is a continuation of application No. 09/674,546, filed as application No. PCT/US99/09346 on Apr. 30, 1999, now Pat. No. 7,576,176.

(60) Provisional application No. 60/121,528, filed on Feb. 25, 1999, provisional application No. 60/103,796, filed on Oct. 9, 1998, provisional application No. 60/103,794, filed on Oct. 9, 1998, provisional application No. 60/103,749, filed on Oct. 9, 1998, provisional application No. 60/099,062, filed on Sep. 2, 1998, provisional application No. 60/098,994, filed on Sep. 2, 1998, provisional application No. 60/094,869, filed on Jul. 31, 1998, provisional application No. 60/083,758, filed on May 1, 1998.

(51) Int. Cl.
*A61K 39/095* (2006.01)
*A61K 39/02* (2006.01)
*A61K 38/00* (2006.01)
*C07K 1/00* (2006.01)

(52) U.S. Cl.
USPC ............ 424/250.1; 424/190.1; 424/234.1; 530/350; 530/300; 530/825; 530/801; 514/1.1

(58) Field of Classification Search
None
See application file for complete search history.

(56) References Cited

U.S. PATENT DOCUMENTS

| | | | |
|---|---|---|---|
| 5,514,581 A | 5/1996 | Ferrari et al. | |
| 5,550,213 A | 8/1996 | Anderson et al. | |
| 5,554,372 A | 9/1996 | Hunter | |
| 5,668,004 A | 9/1997 | O'Donnell | |
| 6,060,065 A | 5/2000 | Barney et al. | |
| 7,348,006 B2 | 3/2008 | Contorni et al. | |
| 7,576,176 B1 * | 8/2009 | Fraser et al. | 530/350 |
| 7,785,608 B2 | 8/2010 | Zlotnick et al. | |
| 7,862,827 B2 * | 1/2011 | Giuliani et al. | 424/250.1 |
| 2004/0033234 A1 | 2/2004 | Berinstein et al. | |
| 2004/0092711 A1 | 5/2004 | Arico | |
| 2004/0110670 A1 | 6/2004 | Arico et al. | |
| 2004/0167068 A1 | 8/2004 | Zlotnick et al. | |
| 2005/0222385 A1 | 10/2005 | Pizza | |
| 2006/0051840 A1 | 3/2006 | Arico et al. | |
| 2006/0171957 A1 | 8/2006 | Pizza | |
| 2006/0240045 A1 | 10/2006 | Berthet et al. | |
| 2006/0251670 A1 | 11/2006 | Comanducci et al. | |
| 2007/0026021 A1 | 2/2007 | Fraser et al. | |
| 2007/0082014 A1 | 4/2007 | Costantino | |
| 2008/0241180 A1 | 10/2008 | Contorni | |
| 2009/0285845 A1 | 11/2009 | Masignani et al. | |
| 2010/0267931 A1 | 10/2010 | Arico et al. | |

FOREIGN PATENT DOCUMENTS

| | | |
|---|---|---|
| EP | 0467714 | 1/1992 |
| EP | 0818465 A1 | 1/1998 |
| EP | 1790660 | 5/2007 |
| JP | 01-144977 A | 6/1989 |
| WO | WO-92/13871 A1 | 8/1992 |
| WO | WO-94/08013 A1 | 4/1994 |
| WO | WO-96/01901 A1 | 1/1996 |
| WO | WO-96/29412 A1 | 9/1996 |
| WO | WO-96/33276 A1 | 10/1996 |
| WO | WO-97/37044 A1 | 10/1997 |
| WO | WO-98/17805 | 4/1998 |
| WO | WO-99/57280 A | 11/1999 |
| WO | WO-00/22430 A2 | 4/2000 |
| WO | WO-00/66791 | 11/2000 |
| WO | WO-01/31019 | 5/2001 |
| WO | WO-01/52885 | 7/2001 |

(Continued)

OTHER PUBLICATIONS

Gomez et al. Vaccine 14: 1340-1346, 1996.*
Malorny et al. J. Bacteriol. 180: 1323-1330, 1998.*
Teerlink et al. J. Exp. Med. 166: 63-76, 1987, abstract.*
Forest et al. Gene 192: 165-169, 1997.*
Ala'Aldeen et al. Vaccine 12: 535-541, 1994, abstract.*
Cruse et al., Illustrated Dictionary of Immunology, 2nd Edn., CRC Press, pp. 46, 166 and 382, 2003.*
McGuiness et al. Mol. Microbiol. 7: 505-514, Feb. 1993.*
Greenspan et al., Nature Biotechnology 17:936-937, 1999.*
Skolnick et al. Trends in Biotechnology 18: 34-39, 2000.*

(Continued)

*Primary Examiner* — S. Devi
(74) *Attorney, Agent, or Firm* — Morrison & Foerster LLP

(57) ABSTRACT

The invention provides proteins from *Neisseria meningitidis*, including the amino acid sequences and the corresponding nucleotide sequences. The proteins are predicted to be useful antigens for vaccines and/or diagnostics.

7 Claims, 31 Drawing Sheets

(56) References Cited

FOREIGN PATENT DOCUMENTS

Figure 10:
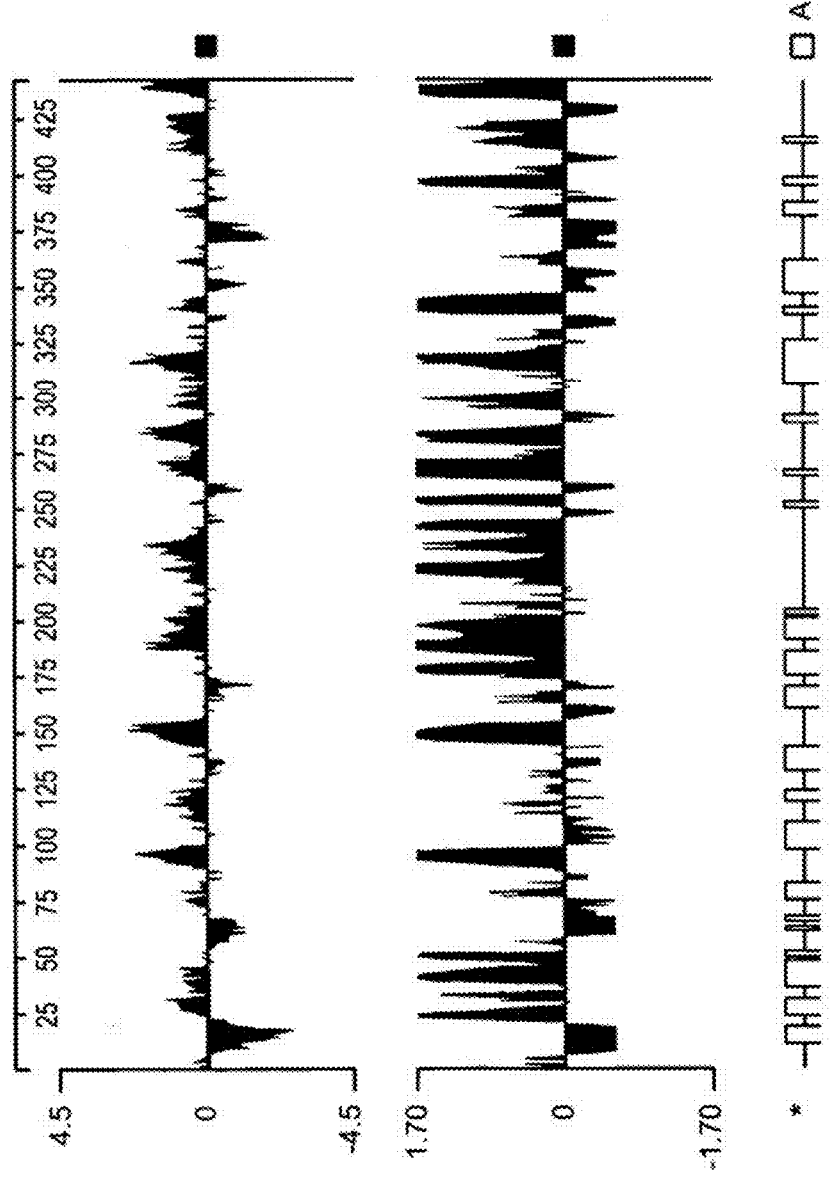

| | | |
|---|---|---|
| WO | WO-01/64920 A | 9/2001 |
| WO | WO-01/64922 A2 | 9/2001 |
| WO | WO-03/009869 A1 | 2/2003 |
| WO | WO-03/020756 A | 3/2003 |
| WO | WO-03/063766 | 8/2003 |
| WO | WO-2004/032958 A1 | 4/2004 |
| WO | WO-2004/048404 | 6/2004 |
| WO | WO-2006/024954 A2 | 3/2006 |
| WO | WO-2006/081259 | 8/2006 |
| WO | WO-2007/060548 A2 | 5/2007 |
| WO | WO-2009/104097 A2 | 8/2009 |
| WO | WO-2010/046715 A1 | 4/2010 |

OTHER PUBLICATIONS

Lucidarme et al., (Sep. 16, 2009) "Characterization of fHbp, nhba (gna2132), nadA, porA, sequence type (ST), and genomic presence of IS1301 in group B meningococcal ST269 clonal complex isolates from England and Wales" Journal of Clinical Microbiology, 47(11):3577-85.

Lucidarme et al., 2010 "Characterization of fHbp, nhba (gna2132), nadA, porA, and sequence type in group B meningococcal case isolates collected in England and Wales during Jan. 2008 and potential coverage of an investigational group B meningococcal vaccine" Clinical and Vaccine Immunology 17(6):919-929.

Masignani V. (Mar. 17, 2003). "Vaccination against *Neisseria meningitidis* using three variants of the lipoprotein GNA1870," J. Exp. Med. 197(6):789-799.

McAllister, C. F. And D. S. Stephens. (1993). "Analysis in *Neisseria meningitidis* and other *Neisseria* species of genes homologous to the FKBP immunophilin family," Molecular Microbiology 10(1)13-23.

McAllister, C. F. et al. (1993). "*Neisseria elongata* NRL FKBP Immunophilin Homolog Gene," Database Empro2 AC U001198.

McGuinness et al. (Mar. 1991). "Point mutation in meningococcal porA gene associated with increased endemic disease," Lancet 337:514-517.

Morley, S. et al. (Dec. 12, 2001). "Vaccine prevention of meningococcal disease, coming soon?" Vaccine 20(5-6):666-687.

Murphy et al., (2009) "Sequence diversity of the factor H binding protein vaccine candidate in epidemiologically relevant strains of serogroup B *Neisseria meningitidis*" J Infect Dis 200:379-389.

Nassif (2000). "A Furtive Pathogen Revealed," Science 287:1767-1768.

Notice of Opposition against European Patent EP 1645631, granted on Oct. 24, 2007. Opposition filed on Jul. 23, 2008. 20 pages.

Novartis (Oct. 9, 2008) "New Phase II data show Novartis investigational Meningitis B vaccine may also protect infants six months and older," Media Release, 4 pages.

Pajon et al., "Frequency of factor H-binding protein modular groups and susceptibility to cross-reactive bactericidal activity in invasive meningococcal isolates" Vaccine 28 (2010):2122-2129.

Parkhill, J. et al. (Mar. 2000). "Complete DNA Sequence of a Serogroup A Strain of *Neisseria meningitides* Z2491," Nature 404:502-505.

Parkhill, "Campylobacter jejuni genome sequence as the Sanger Centre," Post on BIOSCI/Bionet of May 8, 1998.

Patentees' Response to Opposition against European Patent EP 1645631, granted on Oct. 24, 2007. 13 pages.

Pizza et al. (2000). "Identification of Vaccine Candidates Against Serogroup B Meningococcus by Whole-Genome Sequencing," Science 287(5459):1816-1820.

Pizza et al. (2008) "Factor H-binding protein, a unique meningococcal vaccine antigen" Vaccine 26S:I46-8.

Poolman. (1995). "Development of a Meningococcal Vaccine," Infectious Agents and Disease 4:13-28.

Progress through the Sanger Institute FTP server (May 12, 2009), 15 pages.

PSORT analysis of 200 of the sequences disclosed in PCT/US99/09346 (Jan. 1, 2010), 209 pages.

PSORT analysis of SEQ ID Nos. 4 and 6, and of 'Contig295' 300mer (May 8, 2009), 5 pages.

PSORT prediction result for SEQ ID No. 2 (Mar. 30, 2010), 1 page.

Response to Communication, filed in EP Application No. 07075161. 5. Oct. 28, 2009.

Richard, M.E. (Oct. 25, 1997). "Applications of molecular microbiology to vaccinology," Lancet (North American Edition) 350(9086):1240-1244.

Rinaudo et al. (2009). "Vaccinology in the genome era", The Journal of Clinical Investigation, 119(9):2515-2525.

Rudinger et al. (Jun. 1976). Peptide Hormones. (Ed) JA Parsons, University Park Press. pp. 5-7.

Sambrook et al. (1989). Molecular Cloning, A Laboratory Manual. Second Edition, Cold Spring Harbor, pp. 17.1-17.44.

Sampson, B. and E. C. Gotschlich. (1992). "*Neisseria meningitidis* encodes an FK506—inhibitable rotamase," Proc. Natl. Acad. Sci. USA 89(4): 1164-1168.

Sanger Centre's "Projects" website as of Dec. 10, 1997 as retrievable via http://web.archive.org.

Scarselli et al. (Feb. 13, 2009). "Epitope Mapping of a Bactericidal Monoclonal Antibody against the Factor H Binding Protein of *Neisseria meningitides*," Journal of Molecular Biology 386(1):97-108.

Schneider et al. (Apr. 16, 2009) "*Neisseria meningitidis* recruits factor H using protein mimicry of host carbohydrates," Nature 458(7240):890-893.

Sequence for "Putative Lipoprotein [*Neisseria Meningitidis* Z2491]," NCBI Reference Sequence: YP_002342062.1, Mar. 30, 2000.

Serruto et al. (2009). "Genome-based approaches to develop vaccines against bacterial pathogens," Vaccine 27:3245-3250.

Smith C.J. et al. (1995). "Nucleotide sequence determination and genetic analysis of the Bacteroides plasmid, pBl143," Plasmid 34(3):211-222.

Supplemental Submissions in Opposition against European Patent EP 1645631, granted on Oct. 24, 2007. Opposition filed on May 25, 2010. 28 pages.

Supplementary Declaration by Dr. Julian Parkhill, dated May 10, 2010, submitted in opposition proceedings for EP1645631, 4 pages.

Telford et al. (2003). "Genomic and Proteomics in Vaccine Design", in New Bacterial Vaccines, edited by Ellis et al. Kleweur Academic/Plenum Publishers, USA. pp. 1-11.

Tettelin H et al. (Mar. 10, 2000). "Complete genome sequence of *Neisseria meningitidis* serogroup B strain MC58," Science 287(5459):789-799.

The printed output from the NCBI open reading frame finder (Oct. 20, 2008), 12 pages.

United States Office Action mailed on Feb. 11, 2009, for U.S. Appl. No. 10/181,600, filed on Jan. 17, 2001, 5 pages.

United States Office Action mailed on Jul. 24, 2008, for U.S. Appl. No. 10/181,600, filed on Jan. 17, 2001, 23 pages.

United States Office Action mailed on Jul. 7, 2009, for U.S. Appl. No. 10/181,600, filed on Jan. 17, 2001, 23 pages.

U.S. Appl. No. 60/098,685, "*Neisseria* Spp, Polypeptide, Gene Sequence and Uses Thereof," filed Sep. 1, 1998.

Welsch et al. (2004). "Protective Activity of Monclonal Antibodies to Genome-Derived *Neisserial* Antigen 1870, a *Neisseria meningitidis* Candidate Vaccine," The Journal of Immunology 172: 5606-5615.

Welsch et al. (Oct. 30, 2006) "A novel mechanism for complement-mediated killing of encapsulated *Neisseria meningitidis* elicited by monoclonal antibodies to factor H-binding protein (genome-derived *Neisserial* antigen 1870)" Molecular Immunology 44(1-3):256.

Welsch et al. (Apr. 1, 2008). "Complement-dependent synergistic bactericidal activity of antibodies against factor H-binding protein, a sparsely distributed meningococcal vaccine antigen," J Infect Dis 197(7):1053-1061.

Wong, C. Y. et al. (1997). "Cloning and characterization of two immunophilin-like genes, ilpA and fkpA, on a single 3.9-kilobase fragment of Aeromonas hydrophila genomic DNA," Journal of Bacteriology 179(11): 3397-3403.

You, Z. et al. (1997). "Rhizobium Etli Stomatin like Protein (slp) gene, complete cds.," Database Empro1 AC AF034831.

You, Z. et al. (1998). "A Stomatin-Like Protein Encoded by the slp Gene of Rhizobium Etli is Required for Nodulation Competitiveness on the Common Bean," Microbiology 144(9): 2619-2627.

Zhu et al. (2005) "Evaluation of recombinant lipidated P2086 protein as a vaccine candidate for group B *Neisseria meningitidis* in a murine nasal challenge model," Infect Immun 73(10):6838-45.

1997-11-17-NM_shotgun.dbs and 1997-12-15-NM.dbs, located at <ftp://ftp.sanger.ac.uk/pub/pathogens/nm/old data/>.

Baumler, A. J. et al. (1993). "Hypothetical 29.6 kD Protein in PCP 5' Region (ORF1)," Database Swissprot AC P31485.

Baumler, A. J. and K. Hantke (1992). "A Lipoprotein of Yersinia Enterocolitica Facilitates Ferrioxamine Uptake in *Escherichia Coli*," Journal of Bacteriology 174(3):1029-1035.

Beernink et al (Jul. 2006). "Rapid Genetic Grouping of Factor H-Binding Protein (Genome-Derived Neisserial Antigen 1870), a Promising Group B Meningococcal Vaccine Candidate," Clinical and Vaccine Immunology 13(7):758-763.

Beernink et al. (Jun. 2008). "Bactericidal antibody responses, induced by meningococcal recombinant chimeric factor H-binding protein vaccines," Infection and Immunity 76(6):2568-2575.

Beernink et al. (Sep. 2008). "Fine antigenic specificity and cooperative bactericidal activity of monoclonal antibodies directed at the meningococcal vaccine candidate factor h-binding protein," Infection and Immunity 76(9):4232-4240.

Bernfield L. et al. (Sep. 2002). "Identification of a novel vaccine candidate for group B *Neisseria meningitidis*," Thirteenth International Pathogenic *Neisseria* Conference, Norwegian Institute of Public Health, Oslo, Norway, pp. 116 and 124.

Blake et al. (1995). "Vaccines for Gonorrhoea: Where are We on the Curve?" Trends in Microbiology 3(12):469-474.

Boslego et al. (1991). "Gonorrhea Vaccines," Chapter 17 in Vaccines and Immunotherapy, Cryz S.J. (Ed.), Pergamon Press: New York, NY, pp. 211-223.

Burland, V. et al. (1994). "*Escherichia Coli* K-12 Chromosomal Region From 92.8 to 00.1 Minutes," Database Emprol AC U14003.

Campbell AM (1984). *Monoclonal Antibody Technology*. Elsevier Science Publishers, The Netherlands, Chapter 1, pp. 1-32.

Cannon (1989). "Conserved Lipoproteins of Pathogenic *Neisseria* Species Bearing the H.8 Epitope: Lipid-Modified Azurin and H.8 Outer Membrane Protein," Clinical Microbiology Reviews 2(Suppl.):S1-S4.

Cantini et al. (Mar. 2006). "Solution Structure of the Immunodominant Domain of Protective Antigen GNA 1870 of *Neisseria meningitidis*," Journal of Biological Chemistry 281(11):7220-7227.

Conlin, C. A. et al. (1992). "*Escherichia Coli* prlC Encodes an Endopeptidase and is Homologous to the *Salmonella typhimurium* opdA Gene," Journal of Bacteriology 174(18): 5881-5997.

Cowdery et al., (1996) "Bacterial DNA Induces NK Cells to Produce IFN-y In Vivo and Increases the Toxicity of Lipopolysaccharides," J. Immunol. 156:4570-4575.

Cox et al, "Adjuvants—a classification and review of their modes of action" Vaccine, 1997, 15(3):248-256.

Database accession No. NMB1994 (cf. XP2231040) (Tettelin et al.), uploaded Oct. 1, 2000.

Davis et al., (1998) "CpG DNA Is a Potent Enhancer of Specific Immunity in Mice Immunized with Recombinant Hepatitis B Surtace Antigen," J. Immunol, 160:870-876.

Declaration by Dr. Julian Parkhill dated Jun. 12, 2008, submitted in opposition proceedings for EP1645631, 2 pages.

Dempsey J.A. et al. (Nov. 1995). "The physical map of the chromosome of a serogroup a strain of *Neisseria meningitidis* shows complex rearrangement relative to the chromosomes of the two mapped strains of the closely related species *N. gonorrhoeae*," Journal of Bacteriology 177(22):6390-6400.

Dillard, J. P. et al. (1997) "A Peptidoglcan Hydrolase Similar to Bacteriophage Endolysins Acts as an Autolysin in *Neisseria gonorrhoeae*," Molecular Microbiology 25(5):893-907.

Farley J. et al. (Sep. 2002). "Characterization, cloning and expression of different subfamilies of the ORF 2086 gene from *Neisseria meningitidis*," Thirteenth International Pathogenic *Neisseria* Conference, Norwegian Institute of Public Health, Oslo, Norway, p. 124.

Feavers et al. (2009). "Meningococcal protein antigens and vaccines," Vaccine 275:B42-B50.

Fleischmann et al. (1995). "Whole-Genome Random Sequencing and Assembly of *Haemophilus influenzae* Rd," Science 269:496-501.

Fleischmann, R. D. et al. (1995). "Hypothetical Protein Hl0753," Database Swissprot AC P44861.

Fleischmann, R. D. et al. (1995). "Oligopeptidase A (EC 3.4.24.70)," Database Swissprot AC P44573.

Fletcher et al. (2004). "Vaccine Potential of the *Neisseria meningitidis* 2086 Lipoprotein," Infection and Immunity 72(4): 2088-2100.

Fontana et al. (2002). A genomic approach Abstract from the 13th International Pathogenic *Neisseria* Conference, Oslo, Norway, Sep. 1-6, 2002. p. 248.

Giuliani et al. (2006). "A universal vaccine for serogroup B meningococcus," PNAS 103(29):10834-10839.

Giuliani et al. (Feb. 2005). "The Region Comprising Amino Acids 100 to 255 of *Neisseria meningitidis* Lipoprotein GNA 1870 Elicits Bactericidal Antibodies," Infection and Immunity 73(2): 1151-1160.

Hacker, J. et al. (1993). "Immunophilins: structure-function relationship and possible role in microbial pathogenicity," Molecular Microbiology 10(3):445-456.

Hou et al. (2005) "Protective antibody responses elicited by a meningococcal outer membrane vesicle vaccine with overexpressed genome-derived neisserial antigen 1870," J Infect Dis 192(4):580-90.

Houghten et al. (1986) *New Approaches to Immunization*, Vaccines 86, Cold Spring Harbor Laboratory, p. 21-25.

Huang, M. et al. (1995). "A Stomatin-Like Protein Necessary for Mechanosensation in C. Elegans," Nature 378(6554):292-295.

Jacobsson et al. (2009). "Prevalence and sequence variations of the genes encoding the five antigens included in the novel 5CVMB vaccine covering group B meningococcal disease" Vaccine. 27:1579-1584.

JCVI-CMR website showing Z2491 Sanger sequence (http://cmr.jcvi.org/tigr-scripts/CMR/shared/Genomes.cgi and links). (2010).

Jiang et al., (2010) "Broad vaccine coverage predicted for a bivalent recombinant factor H binding protein based vaccine to prevent serogroup B meningococcal disease" Vaccine 28:6086-6093.

Koeberling et al. (2007). "Improved immunogenicity of a H44/76 group B outer membrane vesicle vaccine with over-expressed genome-derived Neisserial antigen 1870," Vaccine 25(10):1912-1920.

Kohara Y. (Aug. 12, 1994). "Caenorhabditis elegans cDNA clone yk26f2: 5' end, single read," Database accession No. D35881. Database EMBL [Online] EBI.

Lawrence, E. (1997). Henderson's Dictionary of Biological Terms, Eleventh Edition (1997). Longman Ltd. Defintion of "epitope," Cover pages, Table of Contents, and pp. 37 and 184.

Lommatzsch et al. (1997). "Outer membrane localization of murein hydrolases: MltA, a third lipoprotein lytic transglycosylase in *Escherichia coli*," Journal of Bacteriology 179(17):5465-5470.

* cited by examiner

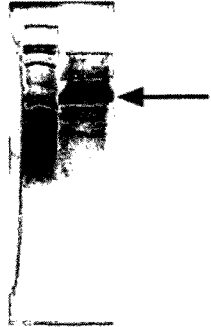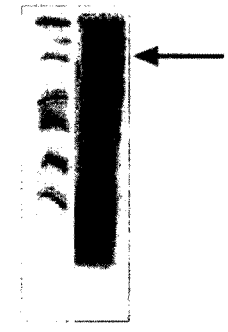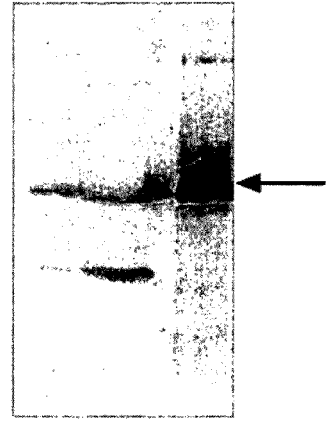
FIG. 1A
919 (46 kDa)
Purification
M1 919
FIG. 1B
919 (46 kDa)
Expression
M1 919
FIG. 1E
919 (46 kDa)
Western Blot
OMV TP PP
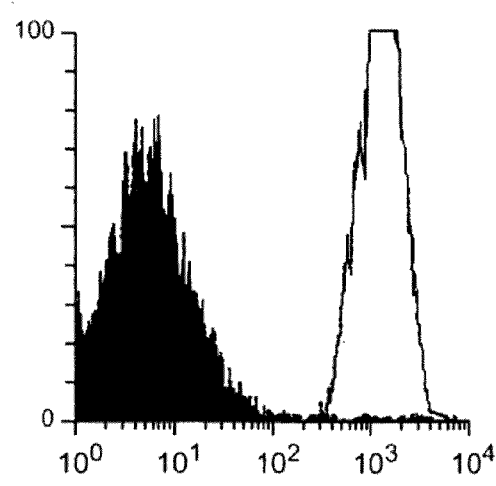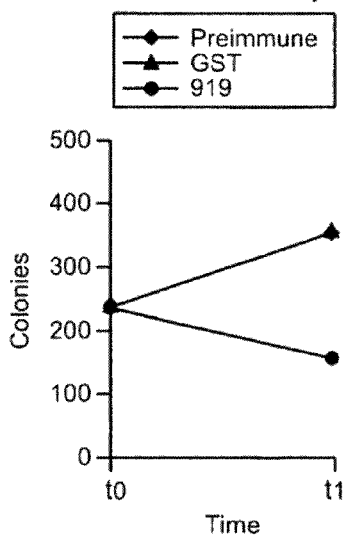
FIG. 1C
919 (46 kDa)
FACS
FIG. 1D
919 (46 kDa)
Bactericidal Assay
- Preimmune
- GST
- 919
FIG. 1F
919 (46 kDa)
ELISA assay: <u>positive</u>

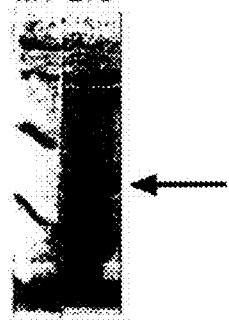
FIG. 2A
279 (10.5 kDa)
Purification
M1  279
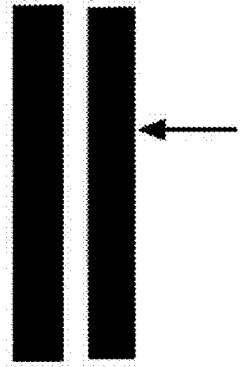
FIG. 2B
279 (10.5 kDa)
Western Blot
TP  OMV
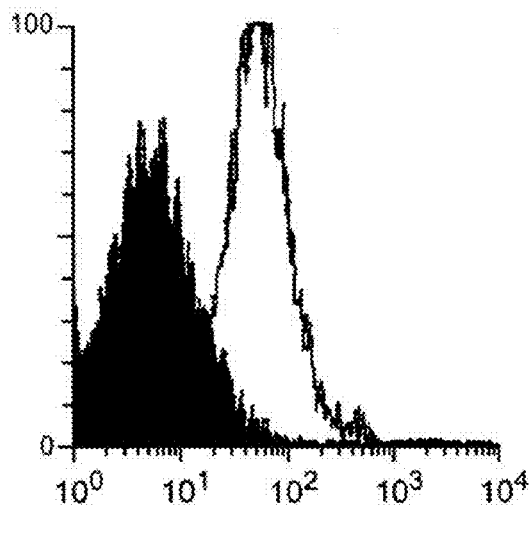
FIG. 2C
279 (10.5 kDa)
FACS
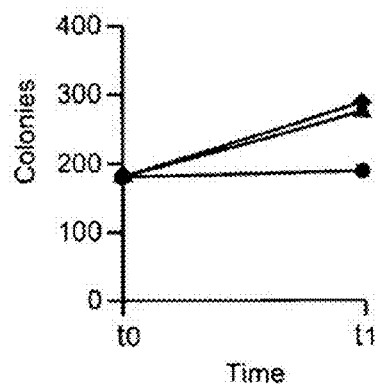
FIG. 2D
279 (10.5 kDa)
Bactericidal Assay
- Preimmune
- GST
- 279
FIG. 2E
279 (10.5 kDa)
ELISA assay: positive

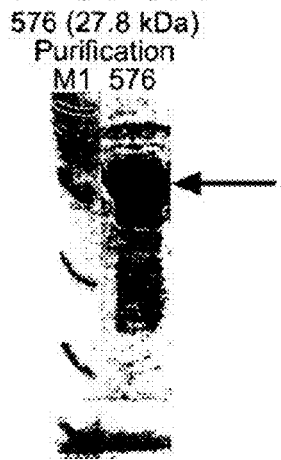
FIG. 3A
576 (27.8 kDa)
Purification
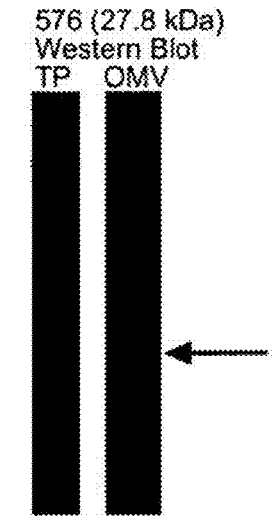
FIG. 3B
576 (27.8 kDa)
Western Blot
TP    OMV
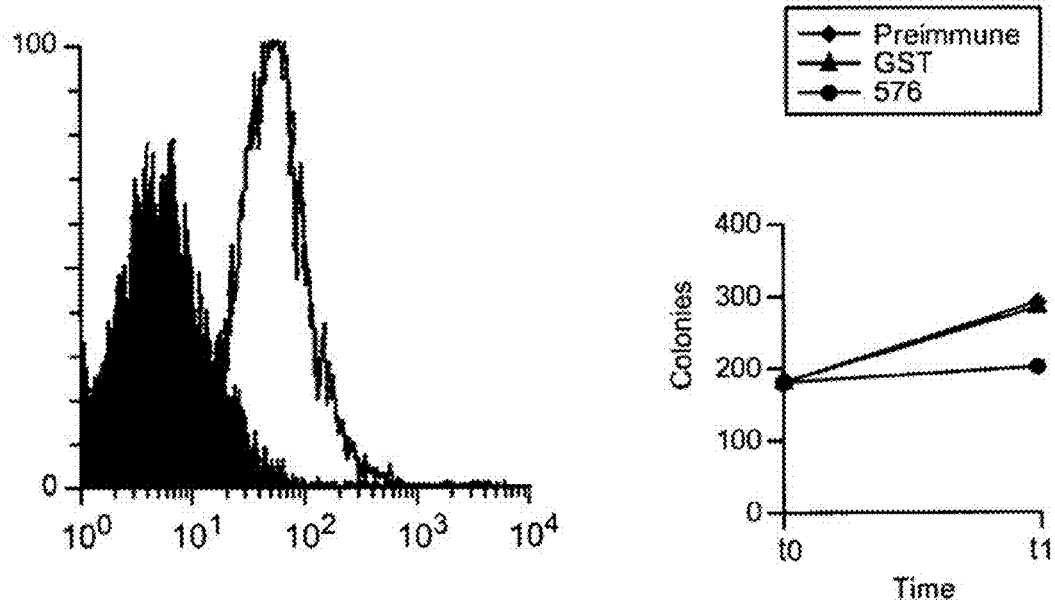
FIG. 3C
576 (27.8 kDa)
FACS
FIG. 3D
576 (27.8 kDa)
Bactericidal Assay
FIG. 3E
576 (27.8 kDa)
ELISA assay: positive

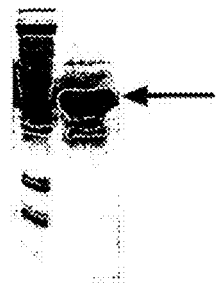
FIG. 4A
519 (33 kDa)
Purification
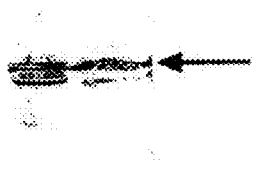
FIG. 4B
519 (33 kDa)
Western Blot
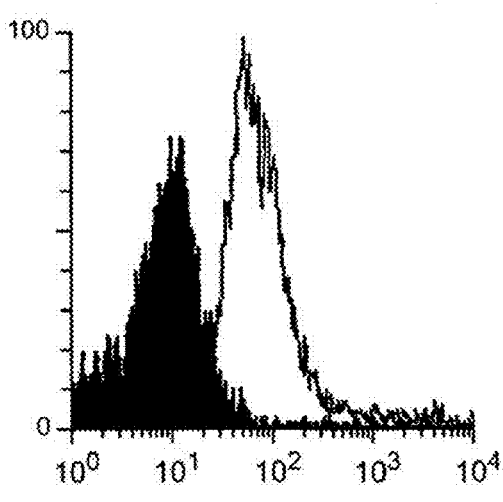
FIG. 4C
519 (33 kDa)
FACS
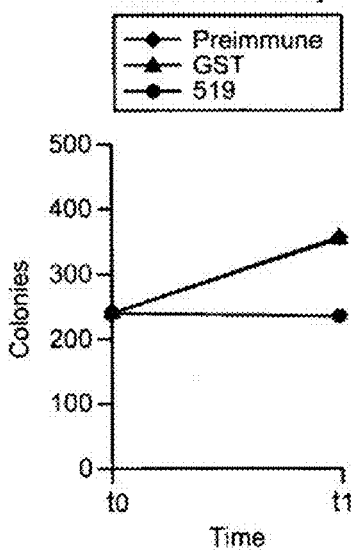
FIG. 4D
519 (33 kDa)
Bactericidal Assay
FIG. 4E
519 (33 kDa)
ELISA assay: positive

FIG. 5A
121 (40 kDa)
Purification
M1  121
FIG. 5B
121 (40 kDa)
Western Blot
TP     OMV
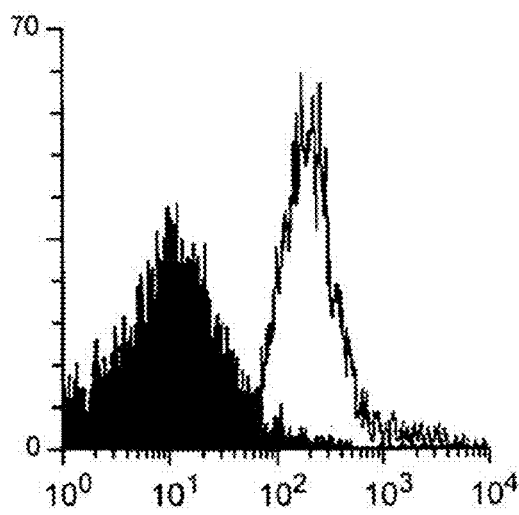
FIG. 5C
121 (40 kDa)
FACS
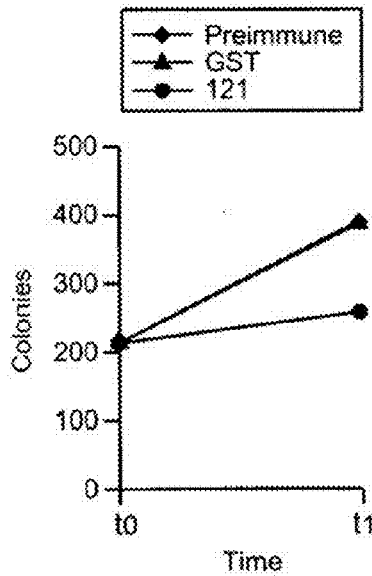
FIG. 5D
121 (40 kDa)
Bactericidal Assay
FIG. 5E
121 (40 kDa)
ELISA assay: positive

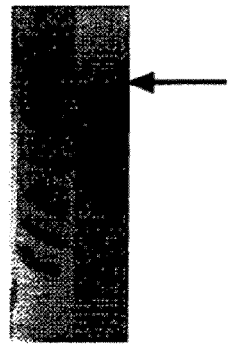
FIG. 6A
128 (101 kDa)
Purification
M1 128
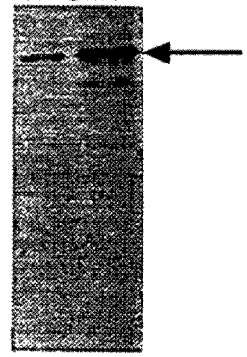
FIG. 6B
128 (101 kDa)
Western Blot
TP OMV
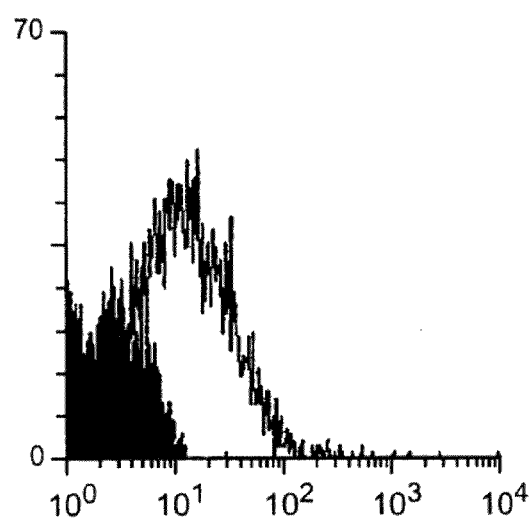
FIG. 6C
128 (101 kDa)
FACS
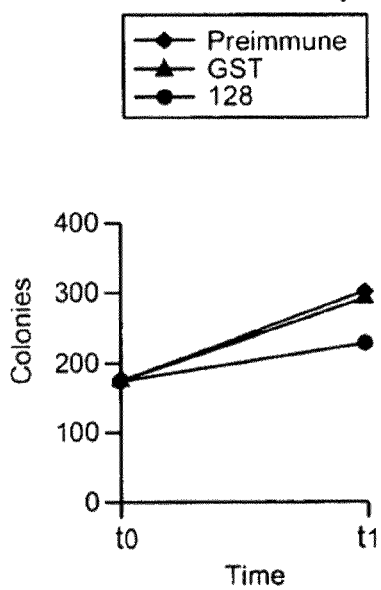
FIG. 6D
128 (101 kDa)
Bactericidal Assay
FIG. 6E
128 (101 kDa)
ELISA assay: positive

FIG. 7A
206 (17 kDa)
Purification
M1  206
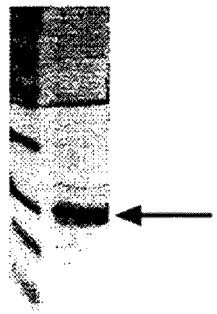
FIG. 7B
206 (17 kDa)
Western Blot
TP OMV
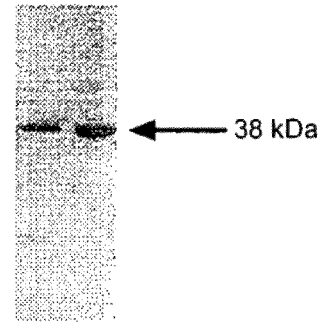
← 38 kDa
FIG. 7C
206 (17 kDa)
FACS
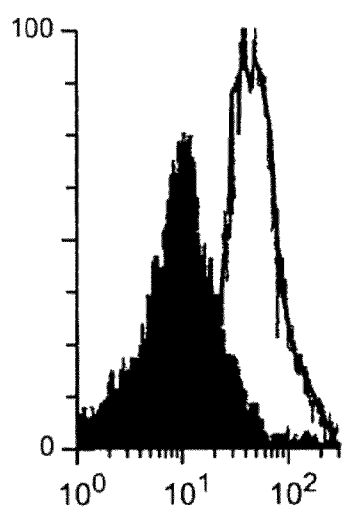
FIG. 7D
206 (17 kDa)
Bactericidal Assay
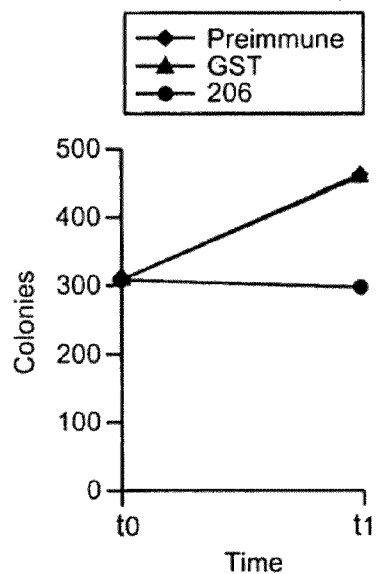
FIG. 7E
206 (17 kDa)
ELISA assay: <u>positive</u>

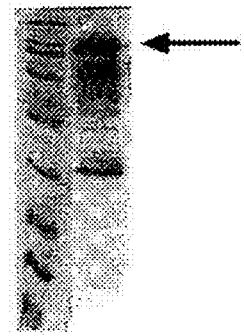
FIG. 8A
287 (78 kDa)
Purification
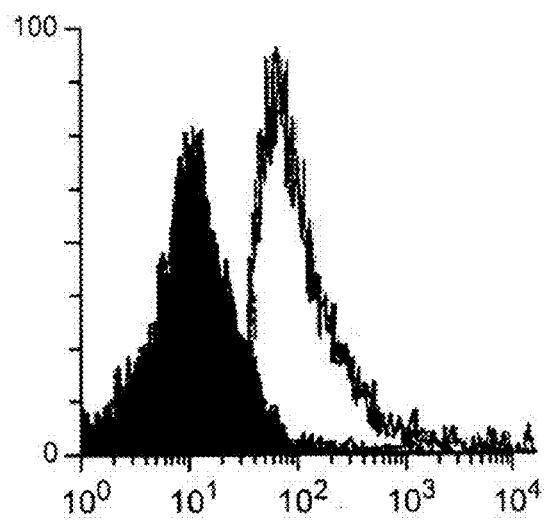
FIG. 8B
287 (78 kDa)
FACS
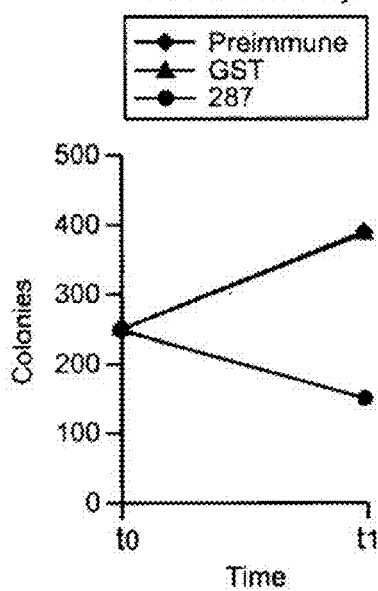
FIG. 8C
287 (78 kDa)
Bactericidal Assay
FIG. 8D
287 (78 kDa)
ELISA assay: positive

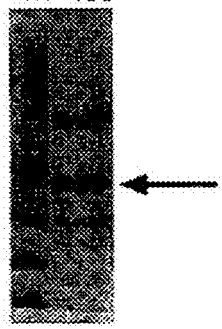
FIG. 9A
406 (33 kDa)
Purification
M1 406
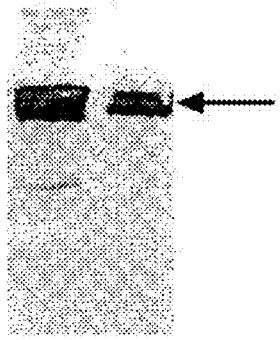
FIG. 9B
406 (33 kDa)
Western Blot
TP  OMV
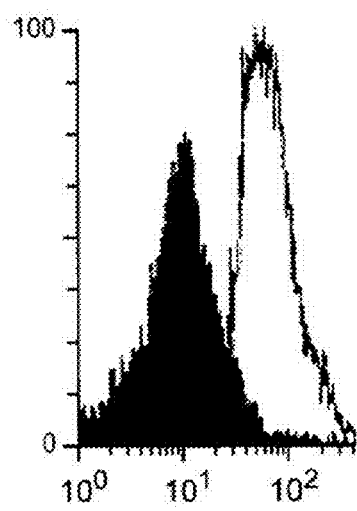
FIG. 9C
406 (33 kDa)
FACS
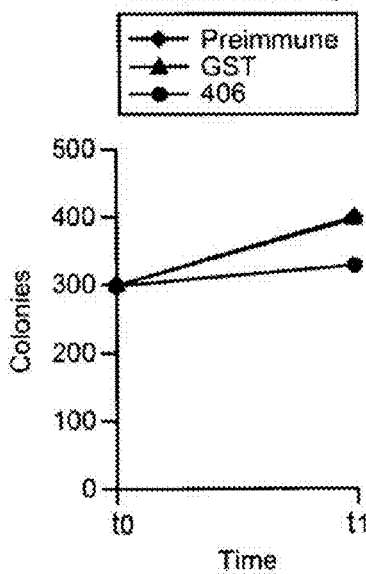
FIG. 9D
406 (33 kDa)
Bactericidal Assay
FIG. 9E
406 (33 kDa)
ELISA assay: positive

```
gnmzq09  121  YQILDSVTTVSAKARLVDSRNGKVLWSGSASIREGSNNSNSGLLGALVSAVVNQIANSLT
gnmzq31  121  YQILDSVTTVSAKARLVDSRNGKVLWSGSASIREGSNNSNSGLLGALVCAVVNQIANSLT
fal090   121  YQILDSVTTVSAKARLVDSRNGKELWSGSASIREGSNNSNSGLLGALVCAVVNQIANSLT
gnmzq32  121  YQILDSVTTVSAKARLVDSRNGKELWSGSASIREGSNNSNSGLLGALVCAVVNQIANSLT
gnmzq33  121  YQILDSVTTVSAKARLVDSRNGKELWSGSASIREGSNNSNSGLLGALVCAVVNQIANSLT
gnmzq01  121  YQILDSVTTVSAKARLVDSRNGKELWSGSASIREGSNNSNSGLLGALVCAVVNQIANSLT
gnmzq05  121  YQILDSVTTVSAKARLVDSRNGKELWSGSASIREGSNNSNSGLLGALVCAVVNQIANSLT
gnmzq08  121  YQILDSVTTVSAKARLVDSRNGKELWSGSASIREGSNNSNSGLLGALVCAVVNQIANSLT
gnmzq02  121  YQILDSVTTVSAKARLVDSRNGKELWSGSASIREGSNNSNSGLLGALVCAVVNQIANSLT
gnmzq03  121  YQILDSVTTVSAKARLVDSRNGKELWSGSASIREGSNNSNSGLLGALVCAVVNQIANSLT
gnmzq04  121  YQILDSVTTVSAKARLVDSRNGKELWSGSASIREGSNNSNSGLLGALVCAVVNQIANSLT
gnmzq07  121  YQILDSVTTVSAKARLVDSRNGKELWSGSASIREGSNNSNSGLLGALVCAVVNQIANSLT
gnmzq10  121  YQILDSVTTVSAKARLVDSRNGKELWSGSASIREGSNNSNSGLLGALVCAVVNQIANSLT
gnmzq11  121  YQILDSVTTVSAKARLVDSRNGKELWSGSASIREGSNNSNSGLLGALVCAVVNQIANSLT
gnmzq13  121  YQILDSVTTVSAKARLVDSRNGKELWSGSASIREGSNNSNSGLLGALVCAVVNQIANSLT
gnmzq15  121  YQILDSVTTVSAKARLVDSRNGKELWSGSASIREGSNNSNSGLLGALVCAVVNQIANSLT
gnmzq16  121  YQILDSVTTVSAKARLVDSRNGKELWSGSASIREGSNNSNSGLLGALVCAVVNQIANSLT
gnmzq17  121  YQILDSVTTVSAKARLVDSRNGKELWSGSASIREGSNNSNSGLLGALVCAVVNQIANSLT
gnmzq19  121  YQILDSVTTVSAKARLVDSRNGKELWSGSASIREGSNNSNSGLLGALVCAVVNQIANSLT
gnmzq21  121  YQILDSVTTVSAKARLVDSRNGKELWSGSASIREGSNNSNSGLLGALVCAVVNQIANSLT
gnmzq22  121  YQILDSVTTVSAKARLVDSRNGKELWSGSASIREGSNNSNSGLLGALVCAVVNQIANSLT
gnmzq23  121  YQILDSVTTVSAKARLVDSRNGKELWSGSASIREGSNNSNSGLLGALVCAVVNQIANSLT
gnmzq24  121  YQILDSVTTVSAKARLVDSRNGKELWSGSASIREGSNNSNSGLLGALVCAVVNQIANSLT
gnmzq25  121  YQILDSVTTVSAKARLVDSRNGKELWSGSASIREGSNNSNSGLLGALVCAVVNQIANSLT
gnmzq27  121  YQILDSVTTVSAKARLVDSRNGKELWSGSASIREGSNNSNSGLLGALVCAVVNQIANSLT
gnmzq28  121  YQILDSVTTVSAKARLVDSRNGKELWSGSASIREGSNNSNSGLLGALVCAVVNQIANSLT
gnmzq29  121  YQILDSVTTVSAKARLVDSRNGKELWSGSASIREGSNNSNSGLLGALVCAVVNQIANSLT
z2491    121  YQILDSVTTVSAKARLVDSRNGKELWSGSASIREGSNNSNSGLLGALVCAVVNQIANSLT
gnmzq14  121  YQILDSVTTVSAKARLVDSRNGKELWSGSASIREGSNNSNSGLLGALVCAVVNQIANSLT
gnmzq18  121  YQILDSVTTVSAKARLVDSRNGKELWSGSASIREGSNNSNSGLLGALVCAVVNQIANSLT
gnmzq26  121  YQILDSVTTVSAKARLVDSRNGKELWSGSASIREGSNNSNSGLLGALVCAVVNQIANSLT gnmzq09  181  DRGYQVSKTAAYNLLSPYSHNGILKGPRFVEEQPK*PEKLHQIFGNDAVLYITVTEYGTS
gnmzq31  181  DRGYQVSKNAAYDLLSPYSHNGILKGPRFVEEQPK*PEKLHQIFGNDAVLYITVTEYGTS
fal090   181  DRGYQVSKTAAYNLLSPYSRNGILKGPRFVEEQPK*PEKLHQIFGNDAVLYITVTEYGTS
gnmzq32  181  DRGYQVSKTAAYNLLSPYSRNGILKGPRFVEEQPK*PEKLHQIFGNDAVLYITVTEYGTS
gnmzq33  181  DRGYQVSKTAAYNLLSPYSRNGILKGPRFVEEQPK*PEKLHQIFGNDAVLYITVTEYGTS
gnmzq01  181  DRGYQVSKTAAYNLLSPYSHNGILKGPRFVEEQPK*PEKLHQIFGNDAVLYITVTEYGTS
gnmzq05  181  DRGYQVSKTAAYNLLSPYSHNGILKGPRFVEEQPK*PEKLHQIFGNDAVLYITVTEYGTS
gnmzq08  181  DRGYQVSKTAAYNLLSPYSHNGILKGPRFVEEQPK*PEKLHQIFGNDAVLYITVTEYGTS
gnmzq02  181  DRGYQVSKTAAYNLLSPYSHNGILKGPRFVEEQPK*PEKLHQIFGNDAVLYITVTEYGTS
gnmzq03  181  DRGYQVSKTAAYNLLSPYSHNGILKGPRFVEEQPK*PEKLHQIFGNDAVLYITVTEYGTS
gnmzq04  181  DRGYQVSKTAAYNLLSPYSHNGILKGPRFVEEQPK*PEKLHQIFGNDAVLYITVTEYGTS
gnmzq07  181  DRGYQVSKTAAYNLLSPYSHNGILKGPRFVEEQPK*PEKLHQIFGNDAVLYITVTEYGTS
gnmzq10  181  DRGYQVSKTAAYNLLSPYSHNGILKGPRFVEEQPK*PEKLHQIFGNDAVLYITVTEYGTS
gnmzq11  181  DRGYQVSKTAAYNLLSPYSHNGILKGPRFVEEQPK*PEKLHQIFGNDAVLYITVTEYGTS
gnmzq13  181  DRGYQVSKTAAYNLLSPYSHNGILKGPRFVEEQPK*PEKLHQIFGNDAVLYITVTEYGTS
gnmzq15  181  DRGYQVSKTAAYNLLSPYSHNGILKGPRFVEEQPK*PEKLHQIFGNDAVLYITVTEYGTS
gnmzq16  181  DRGYQVSKTAAYNLLSPYSHNGILKGPRFVEEQPK*PEKLHQIFGNDAVLYITVTEYGTS
gnmzq17  181  DRGYQVSKTAAYNLLSPYSHNGILKGPRFVEEQPK*PEKLHQIFGNDAVLYITVTEYGTS
gnmzq19  181  DRGYQVSKTAAYNLLSPYSHNGILKGPRFVEEQPK*PEKLHQIFGNDAVLYITVTEYGTS
gnmzq21  181  DRGYQVSKTAAYNLLSPYSHNGILKGPRFVEEQPK*PEKLHQIFGNDAVLYITVTEYGTS
gnmzq22  181  DRGYQVSKTAAYNLLSPYSHNGILKGPRFVEEQPK*PEKLHQIFGNDAVLYITVTEYGTS
gnmzq23  181  DRGYQVSKTAAYNLLSPYSHNGILKGPRFVEEQPK*PEKLHQIFGNDAVLYITVTEYGTS
gnmzq24  181  DRGYQVSKTAAYNLLSPYSHNGILKGPRFVEEQPK*PEKLHQIFGNDAVLYITVTEYGTS
gnmzq25  181  DRGYQVSKTAAYNLLSPYSHNGILKGPRFVEEQPK*PEKLHQIFGNDAVLYITVTEYGTS
gnmzq27  181  DRGYQVSKTAAYNLLSPYSHNGILKGPRFVEEQPK*PEKLHQIFGNDAVLYITVTEYGTS
gnmzq28  181  DRGYQVSKTAAYNLLSPYSHNGILKGPRFVEEQPK*PEKLHQIFGNDAVLYITVTEYGTS
gnmzq29  181  DRGYQVSKTAAYNLLSPYSHNGILKGPRFVEEQPK*PEKLHQIFGNDAVLYITVTEYGTS
z2491    181  DRGYQVSKTAAYNLLSPYSHNGILKGPRFVEEQPK*PEKLHQIFGNDAVLYITVTEYGTS
gnmzq14  181  DRGYQVSKTAAYNLLSPYSHNGILKGPRFVEEQPK*PEKLHQIFGNDAVLYITVTEYGTS
gnmzq18  181  DRGYQVSKTAAYNLLSPYSHNGILKGPRFVEEQPK*PEKLHQIFGNDAVLYITVTEYGTS
gnmzq26  181  DRGYQVSKTAAYNLLSPYSHNGILKGPRFVEEQPK*PEKLHQIFGNDAVLYITVTEYGTS
```

FIG. 20B

```
287_14    1   MFKRSVIAMACIFALSACGGGGGSPDVKSADTLSKPAAPVVSE..........KETEA
287_2     1   MFKRSVIAMACIFALSACGGGGGSPDVKSADTLSKPAAPVVSE..........KETEA
287_21    1   MFKRSVIAMACIFALSACGGGGGSPDVKSADTLSKPAAPVVSE..........KETEA
z2491     1   MFKRSVIAMACIFALSACGGGGGSPDVKSADTLSKPAAPVVSE..........KETEA
287_9     1   MFKRSVIAMACIVALSACGGGGGSPDVKSADTLSKPAAPVVTEDVGEEVLPKEKDEEA
fa1090    1   MFKRSVIAMACIFPLSACGGGGGSPDVKSADTPSKPAAPVVAENAGEGVLPKEKDEEA

287_14   50   KEDAPQAGSQGQGAPSAQGGQDMAAVSEENTGNGGAAATDKPKNEDEGAQNDMPQNAADT
287_2    50   KEDAPQAGSQGQGAPSAQGGQDMAAVSEENTGNGGAAATDKPKNEDEGAQNDMPQNAADT
287_21   50   KEDAPQAGSQGQGAPSAQGSQDMAAVSEENTGNGGAVTADNPKNEDEVAQNDMPQNAAGT
z2491    50   KEDAPQAGSQGQGAPSAQGSQDMAAVSEENTGNGGAVTADNPKNEDEVAQNDMPQNAAGT
287_9    61   VSGAPQADT..QDATAGKGGQDMAAVSAENTGNGGAATTDNPKNEDEGPQNDMPQNAADT
fa1090   61   AGGAPQADT..QDATAGKGSQDMAAVSAENTGNGGAATTDNPKNEDAGQNDMPQNAA..

287_14  110   DSLTPNHTPASNMPAGNMENQAPDAGESEQPANQPDMANTADGMQGDDPSAGGENAGNTA
287_2   110   DSLTPNHTPASNMPAGNMENQAPDAGESEQPANQPDMANTADGMQGDDPSAGGENAGNTA
287_21  110   DSSTPNHTPDPNMLAGNMENQAPDAGESSQPANQPDMANAADGMQGDDPSAGGQNAGNTA
z2491   110   DSSTPNHTPDPNMLAGNMENQATDAGESSQPANQPDMANAADGMQGDDPSAGGQNAGNTA
287_9   119   DSSTPNHTPAPNNPTRDMGNQAPDAGESAQPANQPDMANAADGMQGDDPSA.GENAGNTA
fa1090  117   ............................................................

287_14  170   ADGTNQAENNQTAGSQNEASSTNPSATRSGGDFGRTNVGNSVVIDGPSQNITLTHCKGDS
287_2   170   ADGTNQAENNQTAGSQNEASSTNPSATRSGGDFGRTNVGNSVVIDGPSQNITLTHCKGDS
287_21  170   ADGANQAGNNQAAGSSDPIPASNPAPARGGSNFGRVDLANGVLIDGPSQNITLTHCKGDS
z2491   170   ADGANQAGNNQAAGSSDPIPASNPAPARGGSNFGRVDLANGVLIDGPSQNITLTHCKGDS
287_9   178   DDAANQAENNQVGGSQNEASSTNPNATRGGSDFGRINVARGIKLDSGSENVTLTHCKDKV
fa1090  117   .ESANQTGNNQPAGSSDSAPASNEAPARGGSDFGRTNVGNSVVIDGPSQNITLTHCKGDS

287_14  230   GSGNNFLDEEVQLKSEFEKLSDADRISNYKKDGKNDGKNDKPVGLVADSVQMKGINQYII
287_2   230   GSGNNFLDEEVQLKSEFEKLSDADRISNYKKDGKNDGKNDKPVGLVADSVQMKGINQYII
287_21  230   GSGNNFLDEEVQLKSEFEKLSDADRISNYKK...DGKNDKPVGLVADSVQMKGINQYII
z2491   230   GSGNNFLDEEVQLKSEFEKLSDADRISNYKK...DGKNDKPVGLVADSVQMKGINQYII
287_9   238   CDRD.FLDEEAPPKSEFEKLSDEKINKKKK...DEQRENPVGLVADRVEKNGTNKYVI
fa1090  176   GNGDRLRDEEAPSKSEFEKLSDESKKPNKKK...DEQRENPVGLVADRVKKDSTRKYII

287_14  290   FYKPEP..TSFARFRSARSRRSLPAEMPLIPVNQADTLIVDGEAVSLTGHSGNIFAPEG
287_2   290   FYKPEP..TSFARFRSARSRRSLPAEMPLIPVNQADTLIVDGEAVSLTGHSGNIFAPEG
287_21  286   FYKPEP..TSFARFRSARSRRSLPAEMPLIPVNQADTLIVDGEAVSLTGHSGNIFAPEG
z2491   286   FYKPEP..TSFARFRSARSRRSLPAEMPLIPVNQADTLIVDGEAVSLTGHSGNIFAPEG
287_9   293   IIKDSASSSARFRRSARSRRSLPAEMPLIPVNQADTLIVDGEAVSLTGHSGNIFAPEG
fa1090  232   FYTDKPPT......RSARSRRSLPAESLPIPVNQADTLIVDGEAVSLTGHSGNIFAPEG

287_14  348   NYRYLTYGAEKLPGGSYALRVQGEPSKGEMLAGTAVYNGEVLHFHTENGRPSPSRGRFAA
287_2   348   NYRYLTYGAEKLPGGSYALRVQGEPSKGEMLAGTAVYNGEVLHFHTENGRPSPSRGRFAA
287_21  344   NYRYLTYGAEKLPGGSYALRVQGEPAKGEMLAGAAVYNGEVLHFHTENGRPYPTRGRFAA
z2491   344   NYRYLTYGAEKLPGGSYALRVQGEPAKGEMLAGAAVYNGEVLHFHTENGRPYPTRGRFAA
287_9   353   NYRYLTYGAEKLSGGSYALSVQGEPAKGEMLAGTAVYNGEVLHFHMENGRPSPSGGRFAA
fa1090  285   NYRYLTYGAEKLPGGSYALRVQGEPAKGEMLVGTAVYNGEVLHFHMENGRPYPSGGRFAA

287_14  408   KVDFGSKSVDGIIDSGDDLHMGTQKFAAIDGNGFKGTWTENGGGDVSGKFYGPAGEEVA
287_2   408   KVDFGSKSVDGIIDSGDDLHMGTQKFAAIDGNGFKGTWTENGGGDVSGKFYGPAGEEVA
287_21  404   KVDFGSKSVDGIIDSGDDLHMGTQKFAAIDGNGFKGTWTENGSGDVSGKFYGPAGEEVA
z2491   404   KVDFGSKSVDGIIDSGDDLHMGTQKFAAIDGNGFKGTWTENGSGDVSGKFYGPAGEEVA
287_9   413   KVDFGSKSVDGIIDSGDDLHMGTQKFKAVIDGNGFKGTWTENGGGDVSGRFYGPAGEEVA
fa1090  345   KVDFGSKSVDGIIDSGDDLHMGTQKFKAAIDGNGFKGTWTENGGGDVSGRFYGPAGEEVA
```

FIG. 21A

```
287_14   468  GKYSYRPTDAEKGGFGVFAGKKEQD·DVKSADTLSKPAAPVVSE............KETEA
287_2    468  GKYSYRPTDAEKGGFGVFAGKKEQD·DVKSADTLSKPAAPVVSE............KETEA
287_21   464  GKYSYRPTDAEKGGFGVFAGKKEQD·DVKSADTLSKPAAPVVSE............KETEA
z2491    464  GKYSYRPTDAEKGGFGVFAGKKEQD·DVKSADTLSKPAAPVVSE............KETEA
287_9    473  GKYSYRPTDAEKGGFGVFAGKKEQD·DVKSADTLSKPAAPVVTSDVGEEVLPKEKKDEBA
fal090   405  GKYSYRPTDAEKGGFGVFAGKKDRD·DVKSADTPSKPAAPVVAENAGEGVLPKEKKDEBA 287_14    50  KEDAPQAGSQGQGAPSAQGGQDMAAVSKENTGNGGAAATDKPKNEDEGAQNDMPQNAADT
287_2     50  KEDAPQAGSQGQGAPSAQGGQDMAAVSKENTGNGGAAATDKPKNEDEGAQNDMPQNAADT
287_21    50  KEDAPQAGSQGQGAPSAQGGQDMAAVSKENTGNGGAVTADNPKNEDEVAQNDMPQNAAGT
z2491     50  KEDAPQAGSQGQGAPSAQGGQDMAAVSKENTGNGGAVTADNPKNEDEVAQNDMPQNAAGT
287_9     61  VSGAPQADT..QDATAGKSGQDMAAVSAENTGNGGAATTDNPKNEDEGFQNDMPQNAADT
fal090    61  AGGAPQADT..QDATAGSBSQDMAAVSAENTGNGGAATTDNPKNEDAGAQNDMPQNAA..

287_14   110  DSLTPNHTPASNMPAGNMENQAPDAGESEQPANQPDMANTADGMQGDDPSAGGENAGNTA
287_2    110  DSLTPNHTPASNMPAGNMENQAPDAGESEQPANQPDMANTADGMQGDDPSAGGENAGNTA
287_21   110  DSSTPNHTPDPNMLAGNMENQATDAGESSQPANQPDMANAADGMQGDDPSAGGQNAGNTA
z2491    110  DSSTPNHTPDPNMLAGNMENQATDAGESSQPANQPDMANAADGMQGDDPSAGGQNAGNTA
287_9    119  DSSTPNHTPAPNMPTRDMGNQAPDAGESAQPANQPDMANAADGMQGDDPSA.GENAGNTA
fal090   117  ............................................................

287_14   170  AGGTNQAENNQTAGSQNPASSTNPSATNSGGDFGRTNVGNSVVIDGPSQNITLTHCKGDS
287_2    170  AGGTNQAENNQTAGSQNPASSTNPSATNSGGDFGRTNVGNSVVIDGPSQNITLTHCKGDS
287_21   170  AGGANQAGNNQAAGSSDPIPASNPAPANGGSNFGRVDLANGVLIDGPSQNITLTHCKGDS
z2491    170  AGGANQAGNNQAAGSSDPIPASNPAPANGGSNFGRVDLANGVLIDGPSQNITLTHCKGDS
287_9    178  DQAANQAENNQVGGSQNPASSTNPNATBGGSDFGRINVANGIKLDSGSENVTLTHCKNDV
fal090   117  .ESANQTGNNQPAGSSDSAPASNPAPANGGSDFGRTNVGNSVVIDGPSQNITLTHCKGDS 287_14   230  GSGNNFLDEEVQLKSEFEKLSDADKISNYKRDGKNDGKNDKFVGLVADSVQMKGINQVII
287_2    230  GSGNNFLDEEVQLKSEFEKLSDADKISNYKRDGKNDGKNDKFVGLVADSVQMKGINQVII
287_21   230  GSGNNFLDEEVQLKSEFEKLSDADKISMYKK....DGKNDKFVGLVADSVQMKGINQVII
z2491    230  GSGNNFLDEEVQLKSEFEKLSDADKISMYKK....DGKNDKFVGLVADSVQMKGINQVII
287_9    238  CDRD.NLDERAPPKSEPEKLSDEEKINWYKK....DEQRENFVGLVADRMEKNGTNKVI
fal090   176  GNGDKLLDERAPSKSEPEKLSBEEKIKRNYKK....DEQRENFVGLVADRVKKDGTNKII 287_14   290  FKNPKE..TGFARFRRSARSRRSLPAEMPLIPVNQADTLIVDGEAVSLTGHSGNIFAPEG
287_2    290  FKNPKE..TGFARFRRSARSRRSLPAEMPLIPVNQADTLIVDGEAVSLTGHSGNIFAPEG
287_21   286  FKNPKE..TGFARFRRSARSRRSLPAEMPLIPVNQADTLIVDGEAVSLTGHSGNIFAPEG
z2491    286  FKNPKE..TGFARFRRSARSRRSLPAEMPLIPVNQADTLIVDGEAVSLTGHSGNIFAPEG
287_9    293  IKNDMSASSS.ARFRRSARSRRSLPAEMPLIPVNQADTLIVDGEAVSLTGHSGNIFAPEG
fal090   232  FKTDBPT.......RSARSRRSLPAETPLIPVNQADTLIVDGEAVSLTGHSGNIFAPEG 287_14   348  NYRYLTYGAEKLPGGSYALRVQGEPSKGEMLAGTAVYNGEVLHFHTENGRPSPSRGRPAA
287_2    348  NYRYLTYGAEKLPGGSYALRVQGEPSKGEMLAGTAVYNGEVLHFHTENGRPSPSRGRPAA
287_21   344  NYRYLTYGAEKLPGGSYALRVQGEPAKGEMLAGAAVYNGEVLHFHTENGRPYPTRGRPAA
z2491    344  NYRYLTYGAEKLPGGSYALRVQGEPAKGEMLAGAAVYNGEVLHFHTENGRPYPTRGRPAA
287_9    353  NYRYLTYGAEKLPGGSYALSVQGEPAKGEMLAGTAVYNGEVLHFHMENGRPSPSGGRPAA
fal090   285  NYRYLTYGAEKLPGGSYALRVQGEPAKGEMLVGTAVYNGEVLHPHMENGRPYPSGGRPAA 287_14   408  KVDFGSKSVDGIIDSGDGLHMGTQKFKAAIDGNGFKGTWTENGGGDVSGKPYGPAGEEVA
287_2    408  KVDFGSKSVDGIIDSGDGLHMGTQKFKAAIDGNGFKGTWTENGGGDVSGKPYGPAGEEVA
287_21   404  KVDFGSKSVDGIIDSGDDLHMGTQKFKAAIDGNGFKGTWTENGSGDVSGKPYGPAGEEVA
z2491    404  KVDFGSKSVDGIIDSGDDLHMGTQKFKAAIDGNGFKGTWTENGSGDVSGKPYGPAGEEVA
287_9    413  KVDFGSKSVDGIIDSGDGLHMGTQKFKAVIDGNGFKGTWTENGGGDVSGRPYGPAGEEVA
fal090   345  KVDFGSKSVDGIIDSGDDLHMGTQKFKAAIDGNGFKGTWTENGGGDVSGRPYGPAGEEVA
```

FIG. 21B

```
z2491_519     1  MEFPIILLAAVVVFGFKSFVVIPQQEVHVVERLGRFHRALTAGLNILIPFIDRVAYRHSL
zv26_519      1  MEFPIILLAAVVVFGFKSFVVIPQQEVHVVERLGRFHRALTAGLNILIPFIDRVAYRHSL
zv22_519ass   1  MEFPIILLAAVVVFGFKSFVVIPQQEVHVVERLGRFHRALTAGLNILIPFIDRVAYRHSL
fa1090_519    1  MEFPIILLAAVAVFGFKSFVVIPQQEVHVVERLGRFHRALTAGLNILIPFIDRVAYRHSL
zv32_519      1  MEFPIILLAAVAVFGFKSFVVIPQQEVHVVERLGRFHRALTAGLNILIPFIDRVAYRHSL
zv11_519      1  MEFPIILLAAVAVFGFKSFVVIPQQEVHVVERLGRFHRALTAGLNILIPFIDRVAYRHSL
zv28_519      1  MEFPIILLAAVAVFGFKSFVVIPQQEVHVVERLGRFHRALTAGLNILIPFIDRVAYRHSL
zv96_519      1  MEFPIILLAAVAVFGFKSFVVIPQQEVHVVERLGRFHRALTAGLNILIPFIDRVAYRHSL
zv02_519      1  MEFPIILLVAVAVFGFKSFVVIPQQEVHVVERLGRFHRALTAGLNILIPFIDRVAYRHSL
zv03_519      1  MEFPIILLVAVAVFGFKSFVVIPQQEVHVVERLGRFHRALTAGLNILIPFIDRVAYRHSL
zv04_519      1  MEFPIILLVAVAVFGFKSFVVIPQQEVHVVERLGRFHRALTAGLNILIPFIDRVAYRHSL
zv05_519      1  MEFPIILLVAVAVFGFKSFVVIPQQEVHVVERLGRFHRALTAGLNILIPFIDRVAYRHSL
zv01_519      1  MEFPIILLVAVAVFGFKSFVVIPQQEVHVVERLGRFHRALTAGLNILIPFIDRVAYRHSL
zv07_519      1  MEFPIILLVAVAVFGFKSFVVIPQQEVHVVERLGRFHRALTAGLNILIPFIDRVAYRHSL
zv12_519      1  MEFPIILLVAVAVFGFKSFVVIPQQEVHVVERLGRFHRALTAGLNILIPFIDRVAYRHSL
zv18_519      1  MEFPIILLVAVAVFGFKSFVVIPQQEVHVVERLGRFHRALTAGLNILIPFIDRVAYRHSL
zv19_519      1  MEFPIILLVAVAVFGFKSFVVIPQQEVHVVERLGRFHRALTAGLNILIPFIDRVAYRHSL
zv21_519ass   1  MEFPIILLVAVAVFGFKSFVVIPQQEVHVVERLGRFHRALTAGLNILIPFIDRVAYRHSL
zv27_519      1  MEFPIILLVAVAVFGFKSFVVIPQQEVHVVERLGRFHRALTAGLNILIPFIDRVAYRHSL
zv20_519ass   1  MEFPIILLVAVAVFGFKSFVVIPQQEVHVVERLGRFHRALTAGLNILIPFIDRVAYRHSL
zv06_519ass   1  MEFPIILLVAVAVFGFKSFVVIPQQEVHVVERLGRFHRALTAGLNILIPFIDRVAYRHSL
zv29_519ass   1  MEFPIILLAAVAVFGFKSFVVIPQQEVHVVERLGRFHRALTAGLNILIPFIDRVAYRHSL z2491_519    61  KEIPLDVPSQVCITRDNTQLTVDGIIYFQVTDPKLASYGSSNYIMAITQLAQTTLRSVIG
zv26_519     61  KEIPLDVPSQVCITRDNTQLTVDGIIYFQVTDPKLASYGSSNYIMAITQLAQTTLRSVIG
zv22_519ass  61  KEIPLDVPSQVCITRDNTQLTVDGIIYFQVTDPKLASYGSSNYIMAITQLAQTTLRSVIG
fa1090_519   61  KEIPLDVPSQVCITRDNTQLTVDGIIYFQVTDPKLASYGSSNYIMAITQLAQTTLRSVIG
zv32_519     61  KEIPLDVPSQVCITRDNTQLTVDGIIYFQVTDPKLASYGSSNYIMAITQLAQTTLRSVIG
zv11_519     61  KEIPLDVPSQVCITRDNTQLTVDGIIYFQVTDPKLASYGSSNYIMAITQLAQTTLRSVIG
zv28_519     61  KEIPLDVPSQVCITRDNTQLTVDGIIYFQVTDPKLASYGSSNYIMAITQLAQTTLRSVIG
zv96_519     61  KEIPLDVPSQVCITRDNTQLTVDGIIYFQVTDPKLASYGSSNYIMAITQLAQTTLRSVIG
zv02_519     61  KEIPLDVPSQVCITRDNTQLTVDGIIYFQVTDPKLASYGSSNYIMAITQLAQTTLRSVIG
zv03_519     61  KEIPLDVPSQVCITRDNTQLTVDGIIYFQVTDPKLASYGSSNYIMAITQLAQTTLRSVIG
zv04_519     61  KEIPLDVPSQVCITRDNTQLTVDGIIYFQVTDPKLASYGSSNYIMAITQLAQTTLRSVIG
zv05_519     61  KEIPLDVPSQVCITRDNTQLTVDGIIYFQVTDPKLASYGSSNYIMAITQLAQTTLRSVIG
zv01_519     61  KEIPLDVPSQVCITRDNTQLTVDGIIYFQVTDPKLASYGSSNYIMAITQLAQTTLRSVIG
zv07_519     61  KEIPLDVPSQVCITRDNTQLTVDGIIYFQVTDPKLASYGSSNYIMAITQLAQTTLRSVIG
zv12_519     61  KEIPLDVPSQVCITRDNTQLTVDGIIYFQVTDPKLASYGSSNYIMAITQLAQTTLRSVIG
zv18_519     61  KEIPLDVPSQVCITRDNTQLTVDGIIYFQVTDPKLASYGSSNYIMAITQLAQTTLRSVIG
zv19_519     61  KEIPLDVPSQVCITRDNTQLTVDGIIYFQVTDPKLASYGSSNYIMAITQLAQTTLRSVIG
zv21_519ass  61  KEIPLDVPSQVCITRDNTQLTVDGIIYFQVTDPKLASYGSSNYIMAITQLAQTTLRSVIG
zv27_519     61  KEIPLDVPSQVCITRDNTQLTVDGIIYFQVTDPKLASYGSSNYIMAITQLAQTTLRSVIG
zv20_519ass  61  KEIPLDVPSQVCITRDNTQLTVDGIIYFQVTDPKLASYGSSNYIMAITQLAQTTLRSVIG
zv06_519ass  61  KEIPLDVPSQVCITRDNTQLTVDGIIYFQVTDPKLASYGSSNYIMAITQLAQTTLRSVIG
zv29_519ass  61  KEIPLDVPSQVCITRDNTQLTVDGIIYFQVTDPKLASYGSSNYIMAITQLAQTTLRSVIG z2491_519   121  RMELDKTFEERDEINSTVVSALDEAAGAWGVKVLRYEIKDLVPPQEILRSMQAQITAERE
zv26_519    121  RMELDKTFEERDEINSTVVAALDEAAGAWGVKVLRYEIKDLVPPQEILRSMQAQITAERE
zv22_519ass 121  RMELDKTFEERDEINSTVVSALDEAAGAWGVKVLRYEIKDLVPPQEILRSMQAQITAERE
fa1090_519  121  RMELDKTFEERDEINSTVVSALDEAAGAWGVKVLRYEIKDLVPPQEILRSMQAQITAERE
zv32_519    121  RMELDKTFEERDEINSTVVSALDEAAGAWGVKVLRYEIKDLVPPQEILRSMQAQITAERE
zv11_519    121  RMELDKTFEERDEINSTVVAALDEAAGAWGVKVLRYEIKDLVPPQEILRSMQAQITAERE
zv28_519    121  RMELDKTFEERDEINSTVVAALDEAAGAWGVKVLRYEIKDLVPPQEILRSMQAQITAERE
zv96_519    121  RMELDKTFEERDEINSTVVAALDEAAGAWGVKVLRYEIKDLVPPQEILRSMQAQITAERE
zv02_519    121  RMELDKTFEERDEINSTVVSALDEAAGAWGVKVLRYEIKDLVPPQEILRSMQAQITAERE
zv03_519    121  RMELDKTFEERDEINSTVVSALDEAAGAWGVKVLRYEIKDLVPPQEILRSMQAQITAERE
zv04_519    121  RMELDKTFEERDEINSTVVSALDEAAGAWGVKVLRYEIKDLVPPQEILRSMQAQITAERE
zv05_519    121  RMELDKTFEERDEINSTVVAALDEAAGAWGVKVLRYEIKDLVPPQEILRSMQAQITAERE
zv01_519    121  RMELDKTFEERDEINSTVVAALDEAAGAWGVKVLRYEIKDLVPPQEILRSMQAQITAERE
zv07_519    121  RMELDKTFEERDEINSTVVAALDEAAGAWGVKVLRYEIKDLVPPQEILRSMQAQITAERE
zv12_519    121  RMELDKTFEERDEINSTVVAALDEAAGAWGVKVLRYEIKDLVPPQEILRSMQAQITAERE
zv18_519    121  RMELDKTFEERDEINSTVVAALDEAAGAWGVKVLRYEIKDLVPPQEILRSMQAQITAERE
zv19_519    121  RMELDKTFEERDEINSTVVAALDEAAGAWGVKVLRYEIKDLVPPQEILRSMQAQITAERE
zv21_519ass 121  RMELDKTFEERDEINSTVVAALDEAAGAWGVKVLRYEIKDLVPPQEILRSMQAQITAERE
zv27_519    121  RMELDKTFEERDEINSTVVAALDEAAGAWGVKVLRYEIKDLVPPQEILRSMQAQITAERE
zv20_519ass 121  RMELDKTFEERDEINSTVVAALDEAAGAWGVKVLRYEIKDLVPPQEILRSMQAQITAERE
zv06_519ass 121  RMELDKTFEERDEINSTVFSALDEAAGAWGVKVLRYEIKDLVPPQEILRSMQAQITAERE
zv29_519ass 121  RMELDKTFEERDEINSTIVVSALDEAAGAWGVKVLRYEIKDLVPPQEILRSMQAQITAERE
```

FIG. 22A

```
z2491_519   181  KRARIAESEGRKIEQINLASGQREAEIQQSEGEAQAAVNASNAEKIARINRAKGEAESLR
xv26_519    181  KRARIAESEGRKIEQINLASGQREAEIQQSEGEAQAAVNASNAEKIARINRAKGEAESLR
zv22_519ass 181  KRARIAESEGRKIEQINLASGQREAEIQQSEGEAQAAVNASNAEKIARINRAKGEAESLR
fa1090_519  181  KRARIAESEGRKIEQINLASGQREAEIQQSEGEAQAAVNASNAEKIARINRAKGEAESLR
xv32_519    181  KRARIAESEGRKIEQINLASGQREAEIQQSEGEAQAAVNASNAEKIARINRAKGEAESLR
zv11_519    181  KRARIAESEGRKIEQINLASGQREAEIQQSEGEAQAAVNASNAEKIARINRAKGEAESLR
zv28_519    181  KRARIAESEGRKIEQINLASGQREAEIQQSEGEAQAAVNASNAEKIARINRAKGEAESLR
xv96_519    181  KRARIAESEGRKIEQINLASGQREAEIQQSEGEAQAAVNASNAEKIARINRAKGEAESLR
zv02_519    181  KRARIAESEGRKIEQINLASGQREAEIQQSEGEAQAAVNASNAEKIARINRAKGEAESLR
zv03_519    181  KRARIAESEGRKIEQINLASGQREAEIQQSEGEAQAAVNASNAEKIARINRAKGEAESLR
xv04_519    181  KRARIAESEGRKIEQINLASGQREAEIQQSEGEAQAAVNASNAEKIARINRAKGEAESLR
zv05_519    181  KRARIAESEGRKIEQINLASGQREAEIQQSEGEAQAAVNASNAEKIARINRAKGEAESLR
zv01_519    181  KRARIAESEGRKIEQINLASGQREAEIQQSEGEAQAAVNASNAEKIARINRAKGEAESLR
xv07_519    181  KRARIAESEGRKIEQINLASGQREAEIQQSEGEAQAAVNASNAEKIARINRAKGEAESLR
zv12_519    181  KRARIAESEGRKIEQINLASGQREAEIQQSEGEAQAAVNASNAEKIARINRAKGEAESLR
xv18_519    181  KRARIAESEGRKIEQINLASGQREAEIQQSEGEAQAAVNASNAEKIARINRAKGEAESLR
xv19_519    181  KRARIAESEGRKIEQINLASGQREAEIQQSEGEAQAAVNASNAEKIARINRAKGEAESLR
zv21_519ass 181  KRARIAESEGRKIEQINLASGQREAEIQQSEGEAQAAVNASNAEKIARINRAKGEAESLR
zv27_519    181  KRARIAESEGRKIEQINLASGQREAEIQQSEGEAQAAVNASNAEKIARINRAKGEAESLR
zv20_519ass 181  KRARIAESEGRKIEQINLASGQREAEIQQSEGEAQAAVNASNAEKIARINRAKGEAESLR
zv06_519ass 181  KRARIAESEGRKIEQINLASGQREAEIQQSEGEAQAAVNASNAEKIARINRAKGEAESLR
zv29_519ass 181  KRARIAESEGRKIEQINLASGQREPEIQQSEGEAQAAVNASNAEKIARINRAKGEAESLR z2491_519   241  LVAEANAEAIRQIAAALQTQGGADAVNLKIAEQYVAAFNNLAKESNTLIMPANVADIGSL
xv26_519    241  LVAEANAEAIRQIAAALQTQGGADAVNLKIAEQYVAAFNNLAKESNTLIMPANVADIGSL
zv22_519ass 241  LVAEANAEAIRQIAAALQTQGGADAVNLKIAEQYVAAFNNLAKESNTLIMPANVADIGSL
fa1090_519  241  LVAEANAEAIRQIAAALQTQGGADAVNLKIAEQYVAAFNNLAKESNTLIMPANVADIGSL
xv32_519    241  LVAEANAEAIRQIAAALQTQGGADAVNLKIAEQYVAAFNNLAKESNTLIMPANVADIGSL
zv11_519    241  LVAEANAEAIRQIAAALQTQGGADAVNLKIAEQYVAAFNNLAKESNTLIMPANVADIGSL
zv28_519    241  LVAEANAEAIRQIAAALQTQGGADAVNLKIAEQYVAAFNNLAKESNTLIMPANVADIGSL
xv96_519    241  LVAEANAEAIRQIAAALQTQGGADAVNLKIAEQYVAAFNNLAKESNTLIMPANVADIGSL
zv02_519    241  LVAEANAEAIRQIAAALQTQGGADAVNLKIAEQYVAAFNNLAKESNTLIMPANVADIGSL
zv03_519    241  LVAEANAEAIRQIAAALQTQGGADAVNLKIAEQYVAAFNNLAKESNTLIMPANVADIGSL
xv04_519    241  LVAEANAEAIRQIAAALQTQGGADAVNLKIAEQYVAAFNNLAKESNTLIMPANVADIGSL
zv05_519    241  LVAEANAEAIRQIAAALQTQGGADAVNLKIAEQYVAAFNNLAKESNTLIMPANVADIGSL
zv01_519    241  LVAEANAEAIRQIAAALQTQGGADAVNLKIAEQYVAAFNNLAKESNTLIMPANVADIGSL
xv07_519    241  LVAEANAEAIRQIAAALQTQGGADAVNLKIAEQYVAAFNNLAKESNTLIMPANVADIGSL
zv12_519    241  LVAEANAEAIRQIAAALQTQGGADAVNLKIAEQYVAAFNNLAKESNTLIMPANVADIGSL
xv18_519    241  LVAEANAEAIRQIAAALQTQGGADAVNLKIAEQYVAAFNNLAKESNTLIMPANVADIGSL
xv19_519    241  LVAEANAEAIRQIAAALQTQGGADAVNLKIAEQYVAAFNNLAKESNTLIMPANVADIGSL
zv21_519ass 241  LVAEANAEAIRQIAAALQTQGGADAVNLKIAEQYVAAFNNLAKESNTLIMPANVADIGSL
zv27_519    241  LVAEANAEAIRQIAAALQTQGGADAVNLKIAEQYVAAFNNLAKESNTLIMPANVADIGSL
zv20_519ass 241  LVAEANAEAIRQIAAALQTQGGADAVNLKIAEQYVAAFNNLAKESNTLIMPANVADIGSN
zv06_519ass 241  LVAEANAEAIRQIAAALQTQGGADAVNLKIAEQYVAAFNNLAKESNTLIMPANVADIGSL
zv29_519ass 241  LVAEANAEAIRQIAAALQTQGGADAVNLKIAEQYVAAFNNLAKESNTLIMPANVADIGSL z2491_519   301  ISAGMKIIDSSKTAE*TVVSALDEAAGAWGVKVLRYEIKDLVPPQEILRSMQAQITAERE
xv26_519    301  ISAGMKIIDSSKTAE*TVVSALDEAAGAWGVKVLRYEIKDLVPPQEILRSMQAQITAERE
zv22_519ass 301  ISAGMKIIDSSKTAE*TVVSALDEAAGAWGVKVLRYEIKDLVPPQEILRSMQAQITAERE
fa1090_519  301  ISAGMKIIDSSKTAE*TVVSALDEAAGAWGVKVLRYEIKDLVPPQEILRAMQAQITAERE
xv32_519    301  ISAGMKIIDSSKTAE*TVVSALDEAAGAWGVKVLRYEIKDLVPPQEILRSMQAQITAERE
zv11_519    301  ISAGMKIIDSSKTAE*TVVSALDEAAGAWGVKVLRYEIKDLVPPQEILRSMQAQITAERE
zv28_519    301  ISAGMKIIDSSKTAE*TVVAALDEAAGAWGVKVLRYEIKDLVPPQEILRSMQAQITAERE
xv96_519    301  ISAGMKIIDSSKTAE*TVVAALDEAAGAWGVKVLRYEIKDLVPPQEILRSMQAQITAERE
zv02_519    301  ISAGMKIIDSSKTAE*TVVSALDEAAGAWGVKVLRYEIKDLVPPQEILRSMQAQITAERE
zv03_519    301  ISAGMKIIDSSKTAE*TVVSALDEAAGAWGVKVLRYEIKDLVPPQEILRSMQAQITAERE
xv04_519    301  ISAGMKIIDSSKTAE*TVVSALDEAAGAWGVKVLRYEIKDLVPPQEILRSMQAQITAERE
zv05_519    301  ISAGMKIIDSSKTAE*TVVSALDEAAGAWGVKVLRYEIKDLVPPQEILRSMQAQITAERE
zv01_519    301  ISAGMKIIDSSKTAE*TVVAALDEAAGAWGVKVLRYEIKDLVPPQEILRSMQAQITAERE
xv07_519    301  ISAGMKIIDSSKTAE*TVVAALDEAAGAWGVKVLRYEIKDLVPPQEILRSMQAQITAERE
zv12_519    301  ISAGMKIIDSSKTAE*TVVAALDEAAGAWGVKVLRYEIKDLVPPQEILRSMQAQITAERE
xv18_519    301  ISAGMKIIDSSKTAE*TVVAALDEAAGAWGVKVLRYEIKDLVPPQEILRSMQAQITAERE
xv19_519    301  ISAGMKIIDSSKTAE*TVVAALDEAAGAWGVKVLRYEIKDLVPPQEILRSMQAQITAERE
zv21_519ass 301  ISAGMKIIDSSKTAE*TVVAALDEAAGAWGVKVLRYEIKDLVPPQEILRSMQAQITAERE
zv27_519    301  ISAGMKIIDSSKTAE*TVVAALDEAAGAWGVKVLRYEIKDLVPPQEILRSMQAQITAERE
zv20_519ass 301  ISAGMKIIDSSKTAE*TVVAALDEAAGAWGVKVLRYEIKDLVPPQEILRSMQAQITAERE
zv06_519ass 301  ISAGMKIIDSSKTAE*TVPSALDEAAGAWGVKVLRYEIKDLVPPQEILRSMQAQITAERK
zv29_519ass 301  ISAGMKIIDSNKTAN*IVVSALDEAAGAWGVKVLRYEIKDLVPPQEILRSMQAQITAERE
```

NEISSERIA MENINGITIDIS ANTIGENS AND COMPOSITIONS

RELATED APPLICATIONS

This application is a Divisional of U.S. patent application Ser. No. 13/070,448, filed Mar. 23, 2011, which is a Divisional of U.S. patent application Ser. No. 12/013,047 (Now U.S. Pat. No. 7,988,979), filed Jan. 11, 2008, which is continuation of U.S. patent application Ser. No. 09/674,546 (Now U.S. Pat. No. 7,576,176), filed Nov. 4, 2002, which is the National Stage of International Application No. PCT/US99/09346, filed Apr. 30, 1999, which claims the benefit under 35 U.S.C. §119(e) of U.S. Provisional Patent Nos. 60/121,528, filed Feb. 25, 1999, 60/103,796, filed Oct. 9, 1998, 60/103,794, filed Oct. 9, 1998, 60/103,749, filed Oct. 9, 1998, 60/099,062, filed Sep. 2, 1998, 60/098,994, filed Sep. 2, 1998, 60/094,869, filed Jul. 31, 1998, and 60/083,758, filed May 1, 1998. Each of the foregoing patent applications is incorporated by reference in their entirety.

SUBMISSION OF SEQUENCE LISTING ON ASCII TEXT FILE

The content of the following submission on ASCII text file is incorporated herein by reference in its entirety: a computer readable form (CRF) of the Sequence Listing (file name: 529552002013SeqList.txt, date recorded: Jan. 26, 2012, size: 6118 KB).

FIELD OF THE INVENTION

This invention relates to antigens from the bacterial species: *Neisseria meningitidis* and *Neisseria gonorrhoeae*.

BACKGROUND

*Neisseria meningitidis* is a non-motile, gram negative *diplococcus* human pathogen. It colonizes the pharynx, causing meningitis and, occasionally, septicaemia in the absence of meningitis. It is closely related to *N. gonorrhoea*, although one feature that clearly differentiates meningococcus from gonococcus is the presence of a polysaccharide capsule that is present in all pathogenic meningococci.

*N. meningitidis* causes both endemic and epidemic disease. In the United States the attack rate is 0.6-1 per 100,000 persons per year, and it can be much greater during outbreaks. (see Lieberman et al. (1996) Safety and Immunogenicity of a Serogroups A/C *Neisseria meningitidis* Oligosaccharide-Protein Conjugate Vaccine in Young Children. *JAMA* 275 (19):1499-1503; Schuchat et al (1997) *Bacterial Meningitis in the United States in* 1995. *N Engl J Med* 337(14):970-976). In developing countries, endemic disease rates are much higher and during epidemics incidence rates can reach 500 cases per 100,000 persons per year. Mortality is extremely high, at 10-20% in the United States, and much higher in developing countries. Following the introduction of the conjugate vaccine against *Haemophilus influenzae*, *N. meningitidis* is the major cause of bacterial meningitis at all ages in the United States (Schuchat et al (1997) supra).

Based on the organism's capsular polysaccharide, 12 serogroups of *N. meningitidis* have been identified. Group A is the pathogen most often implicated in epidemic disease in sub-Saharan Africa. Serogroups B and C are responsible for the vast majority of cases in the United States and in most developed countries. Serogroups W135 and Y are responsible for the rest of the cases in the United States and developed countries. The meningococcal vaccine currently in use is a tetravalent polysaccharide vaccine composed of serogroups A, C, Y and W135. Although efficacious in adolescents and adults, it induces a poor immune response and short duration of protection, and cannot be used in infants [eg. Morbidity and Mortality weekly report, Vol. 46, No. RR-5 (1997)]. This is because polysaccharides are T-cell independent antigens that induce a weak immune response that cannot be boosted by repeated immunization. Following the success of the vaccination against *H. influenzae*, conjugate vaccines against serogroups A and C have been developed and are at the final stage of clinical testing (Zollinger W D "New and Improved Vaccines Against Meningococcal Disease". In: *New Generation Vaccines*, supra, pp. 469-488; Lieberman et al (1996) supra; Costantino et al (1992) Development and phase I clinical testing of a conjugate vaccine against meningococcus A and C. *Vaccine* 10:691-698).

Meningococcus B (menB) remains a problem, however. This serotype currently is responsible for approximately 50% of total meningitis in the United States, Europe, and South America. The polysaccharide approach cannot be used because the menB capsular polysaccharide is a polymer of α(2-8)-linked N-acetyl neuraminic acid that is also present in mammalian tissue. This results in tolerance to the antigen; indeed, if an immune response were elicited, it would be anti-self, and therefore undesirable. In order to avoid induction of autoimmunity and to induce a protective immune response, the capsular polysaccharide has, for instance, been chemically modified substituting the N-acetyl groups with N-propionyl groups, leaving the specific antigenicity unaltered (Romero & Outschoorn (1994) Current status of Meningococcal group B vaccine candidates: capsular or non-capsular? *Clin Microbiol Rev* 7(4):559-575).

Alternative approaches to menB vaccines have used complex mixtures of outer membrane proteins (OMPs), containing either the OMPs alone, or OMPs enriched in porins, or deleted of the class 4 OMPs that are believed to induce antibodies that block bactericidal activity. This approach produces vaccines that are not well characterized. They are able to protect against the homologous strain, but are not effective at large where there are many antigenic variants of the outer membrane proteins. To overcome the antigenic variability, multivalent vaccines containing up to nine different porins have been constructed (eg. Poolman J T (1992) Development of a meningococcal vaccine. *Infect. Agents Dis.* 4:13-28). Additional proteins to be used in outer membrane vaccines have been the opa and opc proteins, but none of these approaches have been able to overcome the antigenic variability (eg. Ala'Aldeen & Borriello (1996) The meningococcal transferrin-binding proteins 1 and 2 are both surface exposed and generate bactericidal antibodies capable of killing homologous and heterologous strains. *Vaccine* 14(1):49-53).

A certain amount of sequence data is available for meningococcal and gonoccocal genes and proteins (eg. EP-A-0467714, WO96/29412), but this is by no means complete. The provision of further sequences could provide an opportunity to identify secreted or surface-exposed proteins that are presumed targets for the immune system and which are not antigenically variable. For instance, some of the identified proteins could be components of efficacious vaccines against meningococcus B, some could be components of vaccines against all meningococcal serotypes, and others could be components of vaccines against all pathogenic *Neisseriae* including *Neisseria meningitidis* or *Neisseria gonorrhoeae*.

Those sequences specific to *N. meningitidis* or *N. gonorrhoeae* that are more highly conserved are further preferred sequences.

It is thus an object of the invention is to provide Neisserial DNA sequences which encode proteins that are antigenic or immunogenic.

BRIEF DESCRIPTION OF THE DRAWINGS

FIG. 1 illustrates the products of (B) protein expression and (A) purification, (C) FACs analysis, (D) bactericidal assay, (E) western blot, and (F) ELISA assay of the predicted ORF 919 as cloned and expressed in *E. coli.*

FIG. 2 illustrates the products of (A) protein expression and purification, (B) western blot, (C) FACs analysis, (D) bactericidal assay, and (E) ELISA assay of the predicted ORF 279 as cloned and expressed in *E. coli.*

FIG. 3 illustrates the products of (A) protein expression and purification, (B) western blot, (C) FACs analysis, (D) bactericidal assay, and (E) ELISA assay of the predicted ORF 576-1 as cloned and expressed in *E. coli.*

FIG. 4 illustrates the products of (A) protein expression and purification, (B) western blot, (C) FACs analysis, (D) bactericidal assay, and (E) ELISA assay of the predicted ORF 519-1 as cloned and expressed in *E. coli.*

FIG. 5 illustrates the products of (A) protein expression and purification, (B) western blot, (C) FACs analysis, (D) bactericidal assay, and (E) ELISA assay of the predicted ORF 121-1 as cloned and expressed in *E. coli.*

FIG. 6 illustrates the products of (A) protein expression and purification, (B) western blot, (C) FACs analysis, (D) bactericidal assay, and (E) ELISA assay of the predicted ORF 128-1 as cloned and expressed in *E. coli.*

FIG. 7 illustrates the products of (A) protein expression and purification, (B) western blot, (C) FACs analysis, (D) bactericidal assay, and (E) ELISA assay of the predicted ORF 206 as cloned and expressed in *E. coli.*

FIG. 8 illustrates the products of (A) protein expression and purification, (B) FACs analysis, (C) bactericidal assay, and (D) ELISA assay of the predicted ORF 287 as cloned and expressed in *E. coli.*

FIG. 9 illustrates the products of (A) protein expression and purification, (B) western blot, (C) FACs analysis, (D) bactericidal assay, and (E) ELISA assay of the predicted ORF 406 as cloned and expressed in *E. coli.*

FIG. 10 illustrates the hydrophilicity plot, antigenic index and AMPHI regions of the products of protein expression the predicted ORF 919 as cloned and expressed in *E. coli.*

FIG. 11 illustrates the hydrophilicity plot, antigenic index and AMPHI regions of the products of protein expression the predicted ORF 279 as cloned and expressed in *E. coli.*

FIG. 12 illustrates the hydrophilicity plot, antigenic index and AMPHI regions of the products of protein expression the predicted ORF 576-1 as cloned and expressed in *E. coli.*

FIG. 13 illustrates the hydrophilicity plot, antigenic index and AMPHI regions of the products of protein expression the predicted ORF 519-1 as cloned and expressed in *E. coli.*

FIG. 14 illustrates the hydrophilicity plot, antigenic index and AMPHI regions of the products of protein expression the predicted ORF 121-1 as cloned and expressed in *E. coli.*

FIG. 15 illustrates the hydrophilicity plot, antigenic index and AMPHI regions of the products of protein expression the predicted ORF 128-1 as cloned and expressed in *E. coli.*

FIG. 16 illustrates the hydrophilicity plot, antigenic index and AMPHI regions of the products of protein expression the predicted ORF 206 as cloned and expressed in *E. coli.*

FIG. 17 illustrates the hydrophilicity plot, antigenic index and AMPHI regions of the products of protein expression the predicted ORF 287 as cloned and expressed in *E. coli.*

FIG. 18 illustrates the hydrophilicity plot, antigenic index and AMPHI regions of the products of protein expression the predicted ORF 406 as cloned and expressed in *E. coli.*

FIG. 19A-C shows an alignment comparison of amino acid sequences for ORF 225 for several strains of *Neisseria*. Dark shading indicates regions of homology, and gray shading indicates the conservation of amino acids with similar characteristics. The Figure demonstrates a high degree of conservation among the various strains, further confirming its utility as an antigen for both vaccines and diagnostics. The sequences in the Figure have the following SEQ ID NOs: FA1090 SEQ ID 3115; Z2491 SEQ ID 3116; ZO01__225 SEQ ID 3117; ZO02__225 SEQ ID 3118; ZO03__225 SEQ ID 3119; ZO04__225 SEQ ID 3120; ZO05__225 SEQ ID 3121; ZO06__225 SEQ ID 3122; ZO07__225 SEQ ID 3123; ZO08__225 SEQ ID 3124; ZO09__225 SEQ ID 3125; ZO10__225 SEQ ID 3126; ZO11__225 SEQ ID 3127; ZO12__225 SEQ ID 3128; ZO13__225 SEQ ID 3129; ZO14__225 SEQ ID 3130; ZO15__225 <SEQ ID 3131; ZO16__225 SEQ ID 3132; ZO17__225 SEQ ID 3133; ZO18__225 SEQ ID 3134; ZO19__225 SEQ ID 3135; ZO20__225 SEQ ID 3136; ZO21__225 SEQ ID 3137; ZO22__225 SEQ ID 3138; ZO23__225 SEQ ID 3139; ZO24__225 SEQ ID 3140; ZO25__225 SEQ ID 3141; ZO26__225 SEQ ID 3142; ZO27__225 SEQ ID 3143; ZO28__225 SEQ ID 3144; ZO29__225 SEQ ID 3145; ZO32__225 SEQ ID 3146; ZO33__225 SEQ ID 3147; and ZO96__225 SEQ ID 3148.

FIG. 20A-B shows an alignment comparison of amino acid sequences for ORF 235 for several strains of *Neisseria*. Dark shading indicates regions of homology, and gray shading indicates the conservation of amino acids with similar characteristics. The Figure demonstrates a high degree of conservation among the various strains, further confirming its utility as an antigen for both vaccines and diagnostics. The sequences in the Figure have the following SEQ ID NOs: FA1090 SEQ ID 3149; GNMZQ01 SEQ ID 3150; GNMZQ02 SEQ ID 3151; GNMZQ03 SEQ ID 31521; GNMZQ04 SEQ ID 3153; GNMZQ05 SEQ ID 3154; GNMZQ07 SEQ ID 3155; GNMZQ08 SEQ ID 3156; GNMZQ09 SEQ ID 3157; GNMZQ10 SEQ ID 3158; GNMZQ11 SEQ ID 3159; GNMZQ13 SEQ ID 3160; GNMZQ14 SEQ ID 3161; GNMZQ15 SEQ ID 3162; GNMZQ16 SEQ ID 3163; GNMZQ17 SEQ ID 3164; GNMZQ18 SEQ ID 3165; GNMZQ19 SEQ ID 3166; GNMZQ21 SEQ ID 3166; GNMZQ22 SEQ ID 3167; GNMZQ23 SEQ ID 3168; GNMZQ24 SEQ ID 3169; GNMZQ25 SEQ ID 3170; GNMZQ26 SEQ ID 3171; GNMZQ27 SEQ ID 3172; GNMZQ28 SEQ ID 3173; GNMZQ29 SEQ ID 3174; GNMZQ31 SEQ ID 3175; GNMZQ32 SEQ ID 3176; GNMZQ33 SEQ ID 3177; and Z2491 SEQ ID 3178.

FIG. 21A-B shows an alignment comparison of amino acid sequences for ORF 287 for several strains of *Neisseria*. Dark shading indicates regions of homology, and gray shading indicates the conservation of amino acids with similar characteristics. The Figure demonstrates a high degree of conservation among the various strains, further confirming its utility as an antigen for both vaccines and diagnostics. The sequences in the Figure have the following SEQ ID NOs: 287__14 SEQ ID 3179; 287__2 SEQ ID 3180; 287__21. SEQ ID 3181; 287__9 SEQ ID 3182; FA1090 SEQ ID 3183; and Z2491 SEQ ID 3184.

FIG. 22A-B shows an alignment comparison of amino acid sequences for ORF 519 for several strains of *Neisseria*. Dark shading indicates regions of homology, and gray shading indicates the conservation of amino acids with similar characteristics. The Figure demonstrates a high degree of conservation among the various strains, further confirming its utility as an antigen for both vaccines and diagnostics. The sequences in the Figure have the following SEQ ID NOs: FA1090_519 SEQ ID 3185; Z2491_519 SEQ ID 3186; ZV01_519 SEQ ID 3187; ZV02_519 SEQ ID 3188; ZV03_519 SEQ ID 3189; ZV04_519 SEQ ID 3190; ZV05_519 SEQ ID 3191; ZV06_519ASS SEQ ID 3192; ZV07_519 SEQ ID 3193; ZV11_519 SEQ ID 3194; ZV12_519 SEQ ID 3195; ZV18_519 SEQ ID 3196; ZV19_519 SEQ ID 3197; ZV20_519ASS SEQ ID 3198; ZV21_519ASS SEQ ID 3199; ZV22_519ASS SEQ ID 3200; ZV26_519 SEQ ID 3201; ZV27_519 SEQ ID 3202; ZV28_519 SEQ ID 3203; ZV29_519ASS SEQ ID 3204; ZV32_519 SEQ ID 3205; and ZV96_519 SEQ ID 3206.

Figure 23A:
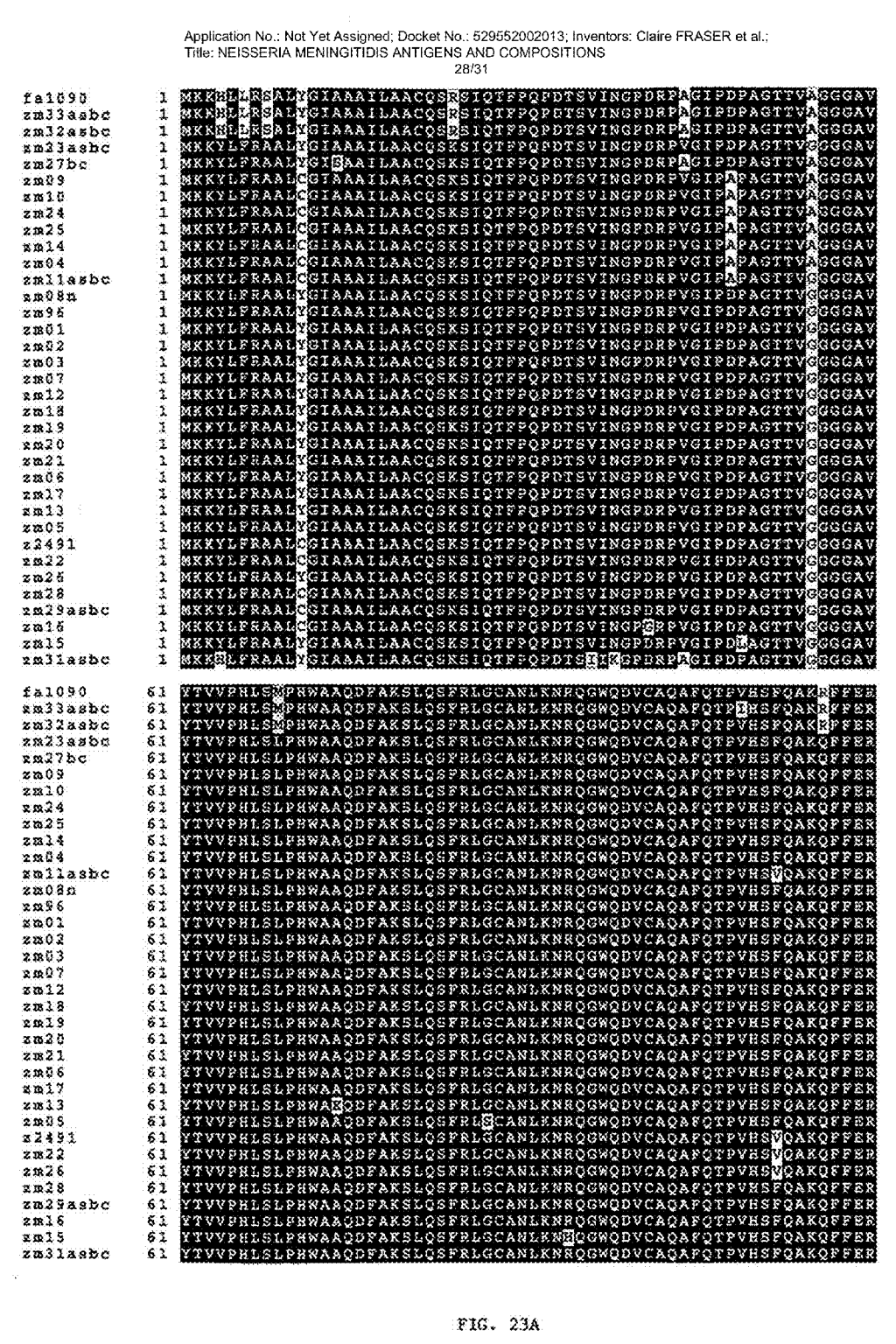
Figure 23B:
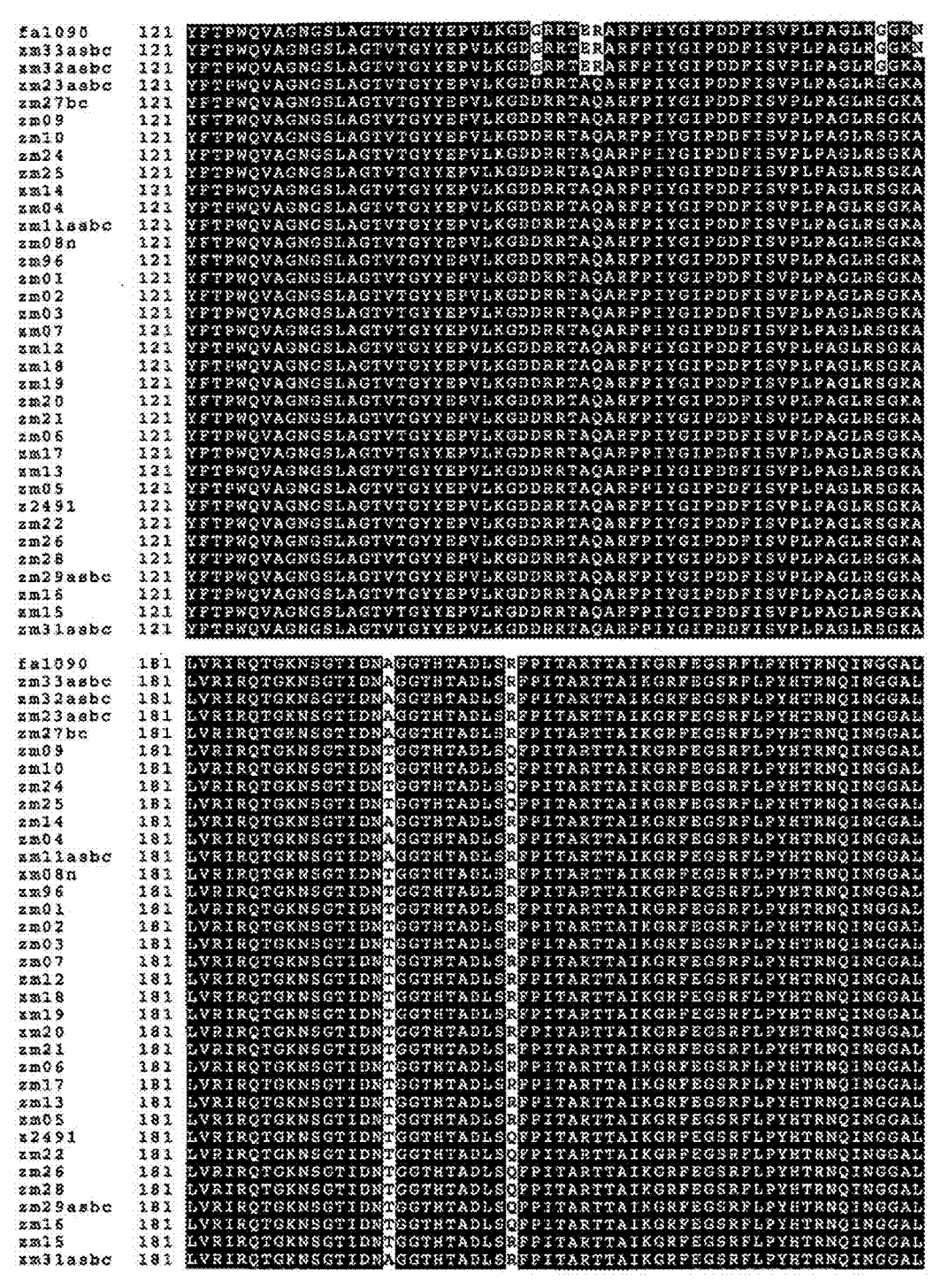
Figure 23C:
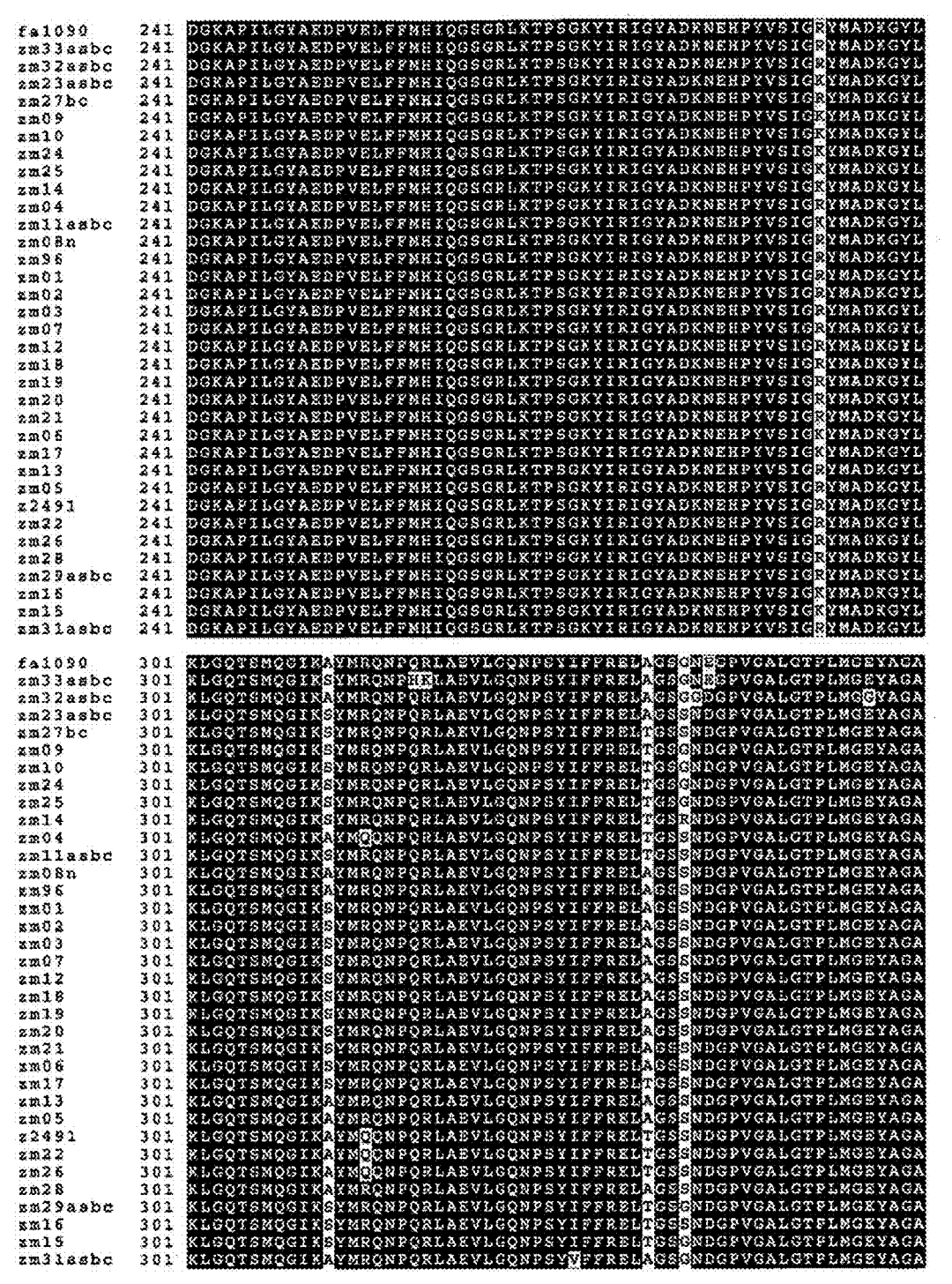
Figure 23D:
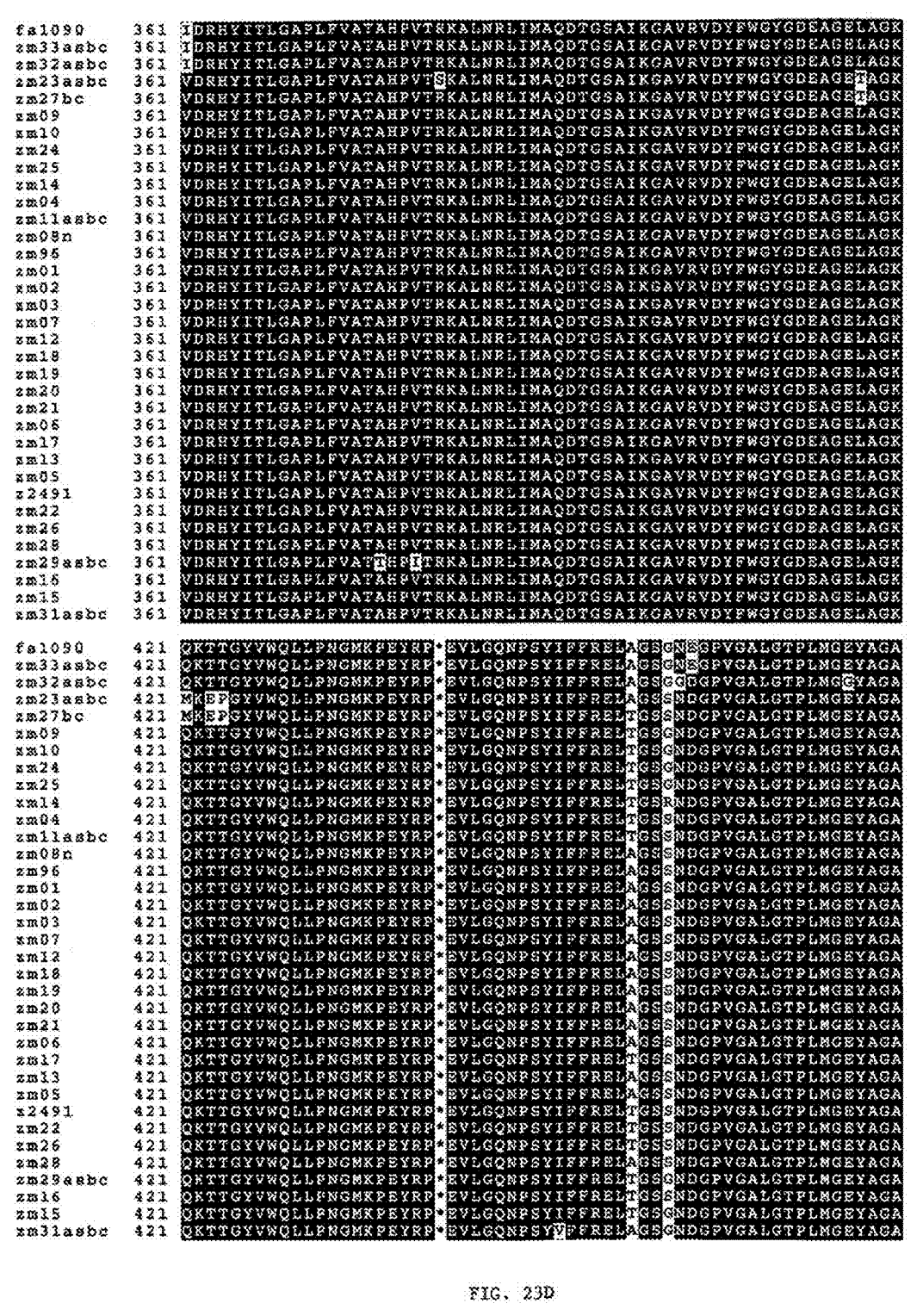

FIG. 23A-D shows an alignment comparison of amino acid sequences for ORF 919 for several strains of *Neisseria*. Dark shading indicates regions of homology, and gray shading indicates the conservation of amino acids with similar characteristics. The Figure demonstrates a high degree of conservation among the various strains, further confirming its utility as an antigen for both vaccines and diagnostics. The sequences in the Figure have the following SEQ ID NOs: FA1090 SEQ ID 3207; Z2491 <SEQ ID 3208; ZM01 SEQ ID 3209; ZM02 SEQ ID 3210; ZM03 SEQ ID 3211; ZM04 SEQ ID 3212; ZM05 SEQ ID 3213; ZM06 SEQ ID 3214; ZM07 SEQ ID 3215; ZM08N SEQ ID 3216; ZM09 SEQ ID 3217; ZM10 SEQ ID 3218; ZM11ASBC SEQ ID 3219; ZM12 SEQ ID 3220; ZM13 SEQ ID 3221; ZM14 SEQ ID 3222; ZM15 SEQ ID 3223; ZM16 SEQ ID 3224; ZM17 SEQ ID 3225; ZM18 SEQ ID 3226; ZM19 SEQ ID 3227; ZM20 SEQ ID 3228; ZM21 SEQ ID 3229; ZM22 SEQ ID 3230; ZM23ASBC SEQ ID 3231; ZM24 SEQ ID 3232; ZM25 SEQ ID 3233; ZM26 SEQ ID 3234; ZM27BC SEQ ID 3235; ZM28 SEQ ID 3236; ZM29ASBC SEQ ID 3237; ZM31ASBC SEQ ID 3238; ZM32ASBC SEQ ID 3239; ZM33ASBC SEQ ID 3240; ZM96 SEQ ID 3241.

THE INVENTION

The invention provides proteins comprising the *N. meningitidis* amino acid sequences and *N. gonorrhoeae* amino acid sequences disclosed in the examples.

It also provides proteins comprising sequences homologous (i.e., those having sequence identity) to the *N. meningitidis* amino acid sequences disclosed in the examples. Depending on the particular sequence, the degree of homology (sequence identity) is preferably greater than 50% (eg. 60%, 70%, 80%, 90%, 95%, 99% or more). These proteins include mutants and allelic variants of the sequences disclosed in the examples. Typically, 50% identity or more between two proteins is considered to be an indication of functional equivalence. Identity between proteins is preferably determined by the Smith-Waterman homology search algorithm as implemented in MPSRCH program (Oxford Molecular) using an affine gap search with parameters: gap penalty 12, gap extension penalty 1.

The invention further provides proteins comprising fragments of the *N. meningitidis* amino acid sequences and *N. gonorrhoeae* amino acid sequences disclosed in the examples. The fragments should comprise at least n consecutive amino acids from the sequences and, depending on the particular sequence, n is 7 or more (eg. 8, 10, 12, 14, 16, 18, 20 or more). Preferably the fragments comprise an epitope from the sequence.

The proteins of the invention can, of course, be prepared by various means (eg. recombinant expression, purification from cell culture, chemical synthesis etc.) and in various forms (eg. native, fusions etc.). They are preferably prepared in substantially pure or isolated form (i.e. substantially free from other *N. meningitidis* or *N. gonorrhoeae* host cell proteins)

According to a further aspect, the invention provides antibodies which bind to these proteins. These may be polyclonal or monoclonal and may be produced by any suitable means.

According to a further aspect, the invention provides nucleic acid comprising the *N. meningitidis* nucleotide sequences and *N. gonorrhoeae* nucleotide sequences disclosed in the examples.

According to a further aspect, the invention comprises nucleic acids having sequence identity of greater than 50% (e.g., 60%, 70%, 80%, 90%, 95%, 99% or more) to the nucleic acid sequences herein. Sequence identity is determined as above-discussed.

According to a further aspect, the invention comprises nucleic acid that hybridizes to the sequences provided herein. Conditions for hybridization are set forth herein.

Nucleic acid comprising fragments of these sequences are also provided. These should comprise at least n consecutive nucleotides from the *N. meningitidis* sequences or *N. gonorrhoeae* sequences and depending on the particular sequence, n is 10 or more (eg 12, 14, 15, 18, 20, 25, 30, 35, 40 or more).

According to a further aspect, the invention provides nucleic acid encoding the proteins and protein fragments of the invention.

It should also be appreciated that the invention provides nucleic acid comprising sequences complementary to those described above (eg. for antisense or probing purposes).

Nucleic acid according to the invention can, of course, be prepared in many ways (eg. by chemical synthesis, in part or in whole, from genomic or cDNA libraries, from the organism itself etc.) and can take various forms (eg. single stranded, double stranded, vectors, probes etc.).

In addition, the term "nucleic acid" includes DNA and RNA, and also their analogues, such as those containing modified backbones, and also protein nucleic acids (PNA) etc.

According to a further aspect, the invention provides vectors comprising nucleotide sequences of the invention (eg. expression vectors) and host cells transformed with such vectors.

According to a further aspect, the invention provides compositions comprising protein, antibody, and/or nucleic acid according to the invention. These compositions may be suitable as vaccines, for instance, or as diagnostic reagents or as immunogenic compositions.

The invention also provides nucleic acid, protein, or antibody according to the invention for use as medicaments (eg. as vaccines) or as diagnostic reagents. It also provides the use of nucleic acid, protein, or antibody according to the invention in the manufacture of (I) a medicament for treating or preventing infection due to Neisserial bacteria (ii) a diagnostic reagent for detecting the presence of Neisserial bacteria or of antibodies raised against Neisserial bacteria or (iii) for raising antibodies. Said Neisserial bacteria may be any species or strain (such as *N. gonorrhoeae*) but are preferably *N. meningitidis*, especially strain B or strain C.

The invention also provides a method of treating a patient, comprising administering to the patient a therapeutically effective amount of nucleic acid, protein, and/or antibody according to the invention.

According to further aspects, the invention provides various processes.

A process for producing proteins of the invention is provided, comprising the step of culturing a host cell according to the invention under conditions which induce protein expression.

A process for detecting polynucleotides of the invention is provided, comprising the steps of: (a) contacting a nucleic probe according to the invention with a biological sample under hybridizing conditions to form duplexes; and (b) detecting said duplexes.

A process for detecting proteins of the invention is provided, comprising the steps of: (a) contacting an antibody according to the invention with a biological sample under conditions suitable for the formation of an antibody-antigen complexes; and (b) detecting said complexes.

A summary of standard techniques and procedures which may be employed in order to perform the invention (eg. to utilize the disclosed sequences for vaccination or diagnostic purposes) is attached as an Appendix to the application. This summary is not a limitation on the invention but, rather, gives examples that may be used, but are not required.

Having now generally described the invention, the same will be more readily understood through reference to the following examples which are provided by way of illustration, and are not intended to be limiting of the present invention, unless specified.

Methodology—Summary of Standard Procedures and Techniques.

General

This invention provides *Neisseria meningitidis* menB nucleotide sequences, amino acid sequences encoded therein. With these disclosed sequences, nucleic acid probe assays and expression cassettes and vectors can be produced. The expression vectors can be transformed into host cells to produce proteins. The purified or isolated polypeptides (which may also be chemically synthesized) can be used to produce antibodies to detect menB proteins. Also, the host cells or extracts can be utilized for biological assays to isolate agonists or antagonists. In addition, with these sequences one can search to identify open reading frames and identify amino acid sequences. The proteins may also be used in immunogenic compositions, antigenic compositions and as vaccine components.

The practice of the present invention will employ, unless otherwise indicated, conventional techniques of molecular biology, microbiology, recombinant DNA, and immunology, which are within the skill of the art. Such techniques are explained fully in the literature e.g., Sambrook *Molecular Cloning; A Laboratory Manual, Second Edition* (1989); *DNA Cloning, Volumes I and ii* (D. N Glover ed. 1985); *Oligonucleotide Synthesis* (M. J. Gait ed, 1984); *Nucleic Acid Hybridization* (B. D. Hames & S. J. Higgins eds. 1984); *Transcription and Translation* (B. D. Hames & S. J. Higgins eds. 1984); *Animal Cell Culture* (R. I. Freshney ed. 1986); *Immobilized Cells and Enzymes* (IRL Press, 1986); B. Perbal, *A Practical Guide to Molecular Cloning* (1984); the *Methods in Enzymology* series (Academic Press, Inc.), especially volumes 154 & 155; *Gene Transfer Vectors for Mammalian Cells* (J. H. Miller and M. P. Calos eds. 1987, Cold Spring Harbor Laboratory); Mayer and Walker, eds. (1987), *Immunochemical Methods in Cell and Molecular Biology* (Academic Press, London); Scopes, (1987) *Protein Purification: Principles and Practice*, Second Edition (Springer-Verlag, N.Y.), and *Handbook of Experimental Immunology, Volumes I-IV* (D. M. Weir and C. C. Blackwell eds 1986).

Standard abbreviations for nucleotides and amino acids are used in this specification.

All publications, patents, and patent applications cited herein are incorporated in full by reference.

Expression Systems

The *Neisseria* menB nucleotide sequences can be expressed in a variety of different expression systems; for example those used with mammalian cells, plant cells, baculoviruses, bacteria, and yeast.

i. Mammalian Systems

Mammalian expression systems are known in the art. A mammalian promoter is any DNA sequence capable of binding mammalian RNA polymerase and initiating the downstream (3') transcription of a coding sequence (e.g., structural gene) into mRNA. A promoter will have a transcription initiating region, which is usually placed proximal to the 5' end of the coding sequence, and a TATA box, usually located 25-30 base pairs (bp) upstream of the transcription initiation site. The TATA box is thought to direct RNA polymerase II to begin RNA synthesis at the correct site. A mammalian promoter will also contain an upstream promoter element, usually located within 100 to 200 bp upstream of the TATA box. An upstream promoter element determines the rate at which transcription is initiated and can act in either orientation (Sambrook et al. (1989) "Expression of Cloned Genes in Mammalian Cells." In *Molecular Cloning: A Laboratory Manual, 2nd ed.*).

Mammalian viral genes are often highly expressed and have a broad host range; therefore sequences encoding mammalian viral genes provide particularly useful promoter sequences. Examples include the SV40 early promoter, mouse mammary tumor virus LTR promoter, adenovirus major late promoter (Ad MLP), and herpes simplex virus promoter. In addition, sequences derived from non-viral genes, such as the murine metallothionein gene, also provide useful promoter sequences. Expression may be either constitutive or regulated (inducible). Depending on the promoter selected, many promotes may be inducible using known substrates, such as the use of the mouse mammary tumor virus (MMTV) promoter with the glucocorticoid responsive element (GRE) that is induced by glucocorticoid in hormone-responsive transformed cells (see for example, U.S. Pat. No. 5,783,681).

The presence of an enhancer element (enhancer), combined with the promoter elements described above, will usually increase expression levels. An enhancer is a regulatory DNA sequence that can stimulate transcription up to 1000-fold when linked to homologous or heterologous promoters, with synthesis beginning at the normal RNA start site. Enhancers are also active when they are placed upstream or downstream from the transcription initiation site, in either normal or flipped orientation, or at a distance of more than 1000 nucleotides from the promoter (Maniatis et al. (1987) *Science* 236:1237; Alberts et al. (1989) *Molecular Biology of the Cell*, 2nd ed.). Enhancer elements derived from viruses may be particularly useful, because they usually have a broader host range. Examples include the SV40 early gene enhancer (Dijkema et al (1985) *EMBO J.* 4:761) and the enhancer/promoters derived from the long terminal repeat (LTR) of the Rous Sarcoma Virus (Gorman et al. (1982b) *Proc. Natl. Acad. Sci.* 79:6777) and from human cytomegalovirus (Boshart et al. (1985) *Cell* 41:521). Additionally, some enhancers are regulatable and become active only in the presence of an inducer, such as a hormone or metal ion (Sassone-Corsi and Borelli (1986) *Trends Genet.* 2:215; Maniatis et al. (1987) *Science* 236:1237).

A DNA molecule may be expressed intracellularly in mammalian cells. A promoter sequence may be directly linked with the DNA molecule, in which case the first amino acid at the N-terminus of the recombinant protein will always be a methionine, which is encoded by the ATG start codon. If desired, the N-terminus may be cleaved from the protein by in vitro incubation with cyanogen bromide.

Alternatively, foreign proteins can also be secreted from the cell into the growth media by creating chimeric DNA molecules that encode a fusion protein comprised of a leader sequence fragment that provides for secretion of the foreign protein in mammalian cells. Preferably, there are processing sites encoded between the leader fragment and the foreign gene that can be cleaved either in vivo or in vitro. The leader sequence fragment usually encodes a signal peptide comprised of hydrophobic amino acids which direct the secretion of the protein from the cell. The adenovirus tripartite leader is an example of a leader sequence that provides for secretion of a foreign protein in mammalian cells.

Usually, transcription termination and polyadenylation sequences recognized by mammalian cells are regulatory regions located 3' to the translation stop codon and thus, together with the promoter elements, flank the coding sequence. The 3' terminus of the mature mRNA is formed by site-specific post-transcriptional cleavage and polyadenylation (Birnstiel et al. (1985) *Cell* 41:349; Proudfoot and Whitelaw (1988) "Termination and 3' end processing of eukaryotic RNA. In *Transcription and splicing* (ed. B. D. Hames and D. M. Glover); Proudfoot (1989) *Trends Biochem. Sci.* 14:105). These sequences direct the transcription of an mRNA which can be translated into the polypeptide encoded by the DNA. Examples of transcription terminator/polyadenylation signals include those derived from SV40 (Sambrook et al (1989) "Expression of cloned genes in cultured mammalian cells." In *Molecular Cloning: A Laboratory Manual*).

Usually, the above described components, comprising a promoter, polyadenylation signal, and transcription termination sequence are put together into expression constructs. Enhancers, introns with functional splice donor and acceptor sites, and leader sequences may also be included in an expression construct, if desired. Expression constructs are often maintained in a replicon, such as an extrachromosomal element (e.g., plasmids) capable of stable maintenance in a host, such as mammalian cells or bacteria. Mammalian replication systems include those derived from animal viruses, which require trans-acting factors to replicate. For example, plasmids containing the replication systems of papovaviruses, such as SV40 (Gluzman (1981) *Cell* 23:175) or polyomavirus, replicate to extremely high copy number in the presence of the appropriate viral T antigen. Additional examples of mammalian replicons include those derived from bovine papillomavirus and Epstein-Barr virus. Additionally, the replicon may have two replication systems, thus allowing it to be maintained, for example, in mammalian cells for expression and in a prokaryotic host for cloning and amplification. Examples of such mammalian-bacteria shuttle vectors include pMT2 (Kaufman et al. (1989) *Mol. Cell. Biol.* 9:946) and pHEBO (Shimizu et al. (1986) *Mol. Cell. Biol.* 6:1074).

The transformation procedure used depends upon the host to be transformed. Methods for introduction of heterologous polynucleotides into mammalian cells are known in the art and include dextran-mediated transfection, calcium phosphate precipitation, polybrene mediated transfection, protoplast fusion, electroporation, encapsulation of the polynucleotide(s) in liposomes, and direct microinjection of the DNA into nuclei.

Mammalian cell lines available as hosts for expression are known in the art and include many immortalized cell lines available from the American Type Culture Collection (ATCC), including but not limited to, Chinese hamster ovary (CHO) cells, HeLa cells, baby hamster kidney (BHK) cells, monkey kidney cells (COS), human hepatocellular carcinoma cells (e.g., Hep G2), and a number of other cell lines.

ii. Plant Cellular Expression Systems

There are many plant cell culture and whole plant genetic expression systems known in the art. Exemplary plant cellular genetic expression systems include those described in patents, such as: U.S. Pat. Nos. 5,693,506; 5,659,122; and 5,608,143. Additional examples of genetic expression in plant cell culture has been described by Zenk, *Phytochemistry* 30:3861-3863 (1991). Descriptions of plant protein signal peptides may be found in addition to the references described above in Vaulcombe et al., *Mol. Gen. Genet.* 209:33-40 (1987); Chandler et al., *Plant Molecular Biology* 3:407-418 (1984); Rogers, *J. Biol. Chem.* 260:3731-3738 (1985); Rothstein et al., *Gene* 55:353-356 (1987); Whittier et al., *Nucleic Acids Research* 15:2515-2535 (1987); Wirsel et al., *Molecular Microbiology* 3:3-14 (1989); Yu et al., *Gene* 122:247-253 (1992). A description of the regulation of plant gene expression by the phytohormone, gibberellic acid and secreted enzymes induced by gibberellic acid can be found in R. L. Jones and J. MacMillin, Gibberellins: in: *Advanced Plant Physiology*,. Malcolm B. Wilkins, ed., 1984 Pitman Publishing Limited, London, pp. 21-52. References that describe other metabolically-regulated genes: Sheen, *Plant Cell*, 2:1027-1038 (1990); Maas et al., *EMBO J.* 9:3447-3452 (1990); Benkel and Hickey, *Proc. Natl. Acad. Sci.* 84:1337-1339 (1987)

Typically, using techniques known in the art, a desired polynucleotide sequence is inserted into an expression cassette comprising genetic regulatory elements designed for operation in plants. The expression cassette is inserted into a desired expression vector with companion sequences upstream and downstream from the expression cassette suitable for expression in a plant host. The companion sequences will be of plasmid or viral origin and provide necessary characteristics to the vector to permit the vectors to move DNA from an original cloning host, such as bacteria, to the desired plant host. The basic bacterial/plant vector construct will preferably provide a broad host range prokaryote replication origin; a prokaryote selectable marker; and, for *Agrobacterium* transformations, T DNA sequences for *Agrobacterium*-mediated transfer to plant chromosomes. Where the heterologous gene is not readily amenable to detection, the construct will preferably also have a selectable marker gene suitable for determining if a plant cell has been transformed. A general review of suitable markers, for example for the members of the grass family, is found in Wilmink and Dons, 1993, *Plant Mol. Biol. Reptr,* 11(2):165-185.

Sequences suitable for permitting integration of the heterologous sequence into the plant genome are also recommended. These might include transposon sequences and the like for homologous recombination as well as Ti sequences which permit random insertion of a heterologous expression cassette into a plant genome. Suitable prokaryote selectable markers include resistance toward antibiotics such as ampicillin or tetracycline. Other DNA sequences encoding additional functions may also be present in the vector, as is known in the art.

The nucleic acid molecules of the subject invention may be included into an expression cassette for expression of the protein(s) of interest. Usually, there will be only one expression cassette, although two or more are feasible. The recombinant expression cassette will contain in addition to the heterologous protein encoding sequence the following elements, a promoter region, plant 5' untranslated sequences, initiation codon depending upon whether or not the structural gene comes equipped with one, and a transcription and translation termination sequence. Unique restriction enzyme sites at the 5' and 3' ends of the cassette allow for easy insertion into a pre-existing vector.

A heterologous coding sequence may be for any protein relating to the present invention. The sequence encoding the protein of interest will encode a signal peptide which allows processing and translocation of the protein, as appropriate, and will usually lack any sequence which might result in the binding of the desired protein of the invention to a membrane. Since, for the most part, the transcriptional initiation region will be for a gene which is expressed and translocated during germination, by employing the signal peptide which provides for translocation, one may also provide for translocation of the protein of interest. In this way, the protein(s) of interest will be translocated from the cells in which they are expressed and may be efficiently harvested. Typically secretion in seeds are across the aleurone or scutellar epithelium layer into the endosperm of the seed. While it is not required that the protein be secreted from the cells in which the protein is produced, this facilitates the isolation and purification of the recombinant protein.

Since the ultimate expression of the desired gene product will be in a eucaryotic cell it is desirable to determine whether any portion of the cloned gene contains sequences which will be processed out as introns by the host's splicosome machinery. If so, site-directed mutagenesis of the "intron" region may be conducted to prevent losing a portion of the genetic message as a false intron code, Reed and Maniatis, *Cell* 41:95-105, 1985.

The vector can be microinjected directly into plant cells by use of micropipettes to mechanically transfer the recombinant DNA. Crossway, *Mol. Gen. Genet*, 202:179-185, 1985. The genetic material may also be transferred into the plant cell by using polyethylene glycol, Krens, et al., *Nature*, 296, 72-74, 1982. Another method of introduction of nucleic acid segments is high velocity ballistic penetration by small particles with the nucleic acid either within the matrix of small beads or particles, or on the surface, Klein, et al., *Nature*, 327, 70-73, 1987 and Knudsen and Muller, 1991, *Planta*, 185:330-336 teaching particle bombardment of barley endosperm to create transgenic barley. Yet another method of introduction would be fusion of protoplasts with other entities, either minicells, cells, lysosomes or other fusible lipid-surfaced bodies, Fraley, et al., *Proc. Natl. Acad. Sci. USA*, 79, 1859-1863, 1982.

The vector may also be introduced into the plant cells by electroporation. (Fromm et al., *Proc. Natl. Acad. Sci. USA* 82:5824, 1985). In this technique, plant protoplasts are electroporated in the presence of plasmids containing the gene construct. Electrical impulses of high field strength reversibly permeabilize biomembranes allowing the introduction of the plasmids. Electroporated plant protoplasts reform the cell wall, divide, and form plant callus.

All plants from which protoplasts can be isolated and cultured to give whole regenerated plants can be transformed by the present invention so that whole plants are recovered which contain the transferred gene. It is known that practically all plants can be regenerated from cultured cells or tissues, including but not limited to all major species of sugarcane, sugar beet, cotton, fruit and other trees, legumes and vegetables. Some suitable plants include, for example, species from the genera *Fragaria, Lotus, Medicago, Onobrychis, Trifolium, Trigonella, Vigna, Citrus, Linum, Geranium, Manihot, Daucus, Arabidopsis, Brassica, Raphanus, Sinapis, Atropa, Capsicum, Datura, Hyoscyamus, Lycopersion, Nicotiana, Solanum, Petunia, Digitalis, Majorana, Cichorium, Helianthus, Lactuca, Bromus, Asparagus, Antirrhinum, Hererocallis, Nemesia, Pelargonium, Panicum, Pennisetum, Ranunculus, Senecio, Salpiglossis, Cucumis, Browaalia, Glycine, Lolium, Zea, Triticum, Sorghum*, and *Datura*.

Means for regeneration vary from species to species of plants, but generally a suspension of transformed protoplasts containing copies of the heterologous gene is first provided. Callus tissue is formed and shoots may be induced from callus and subsequently rooted. Alternatively, embryo formation can be induced from the protoplast suspension. These embryos germinate as natural embryos to form plants. The culture media will generally contain various amino acids and hormones, such as auxin and cytokinins. It is also advantageous to add glutamic acid and proline to the medium, especially for such species as corn and alfalfa. Shoots and roots normally develop simultaneously. Efficient regeneration will depend on the medium, on the genotype, and on the history of the culture. If these three variables are controlled, then regeneration is fully reproducible and repeatable.

In some plant cell culture systems, the desired protein of the invention may be excreted or alternatively, the protein may be extracted from the whole plant. Where the desired protein of the invention is secreted into the medium, it may be collected. Alternatively, the embryos and embryoless-half seeds or other plant tissue may be mechanically disrupted to release any secreted protein between cells and tissues. The mixture may be suspended in a buffer solution to retrieve soluble proteins. Conventional protein isolation and purification methods will be then used to purify the recombinant protein. Parameters of time, temperature pH, oxygen, and volumes will be adjusted through routine methods to optimize expression and recovery of heterologous protein.

iii. Baculovirus Systems

The polynucleotide encoding the protein can also be inserted into a suitable insect expression vector, and is operably linked to the control elements within that vector. Vector construction employs techniques which are known in the art. Generally, the components of the expression system include a transfer vector, usually a bacterial plasmid, which contains both a fragment of the baculovirus genome, and a convenient restriction site for insertion of the heterologous gene or genes to be expressed; a wild type baculovirus with a sequence homologous to the baculovirus-specific fragment in the transfer vector (this allows for the homologous recombination of the heterologous gene in to the baculovirus genome); and appropriate insect host cells and growth media.

After inserting the DNA sequence encoding the protein into the transfer vector, the vector and the wild type viral genome are transfected into an insect host cell where the vector and viral genome are allowed to recombine. The packaged recombinant virus is expressed and recombinant plaques are identified and purified. Materials and methods for baculovirus/insect cell expression systems are commercially available in kit form from, inter alia, Invitrogen, San Diego Calif. ("MAXBAC™" kit). These techniques are generally known to those skilled in the art and fully described in Summers and Smith, *Texas Agricultural Experiment Station Bulletin No*. 1555 (1987) (hereinafter "Summers and Smith").

Prior to inserting the DNA sequence encoding the protein into the baculovirus genome, the above described components, comprising a promoter, leader (if desired), coding sequence of interest, and transcription termination sequence, are usually assembled into an intermediate transplacement construct (transfer vector). This construct may contain a single gene and operably linked regulatory elements; multiple genes, each with its owned set of operably linked regulatory elements; or multiple genes, regulated by the same set of regulatory elements. Intermediate transplacement constructs are often maintained in a replicon, such as an extrachromosomal element (e.g., plasmids) capable of stable maintenance in a host, such as a bacterium. The replicon will have a replication system, thus allowing it to be maintained in a suitable host for cloning and amplification.

Currently, the most commonly used transfer vector for introducing foreign genes into AcNPV is pAc373. Many other vectors, known to those of skill in the art, have also been designed. These include, for example, pVL985 (which alters the polyhedrin start codon from ATG to ATT, and which introduces a BamHI cloning site 32 basepairs downstream from the ATT; see Luckow and Summers, *Virology* (1989) 17:31.

The plasmid usually also contains the polyhedrin polyadenylation signal (Miller et al. (1988) *Ann. Rev. Microbiol.*, 42:177) and a prokaryotic ampicillin-resistance (amp) gene and origin of replication for selection and propagation in *E. coli*.

Baculovirus transfer vectors usually contain a baculovirus promoter. A baculovirus promoter is any DNA sequence capable of binding a baculovirus RNA polymerase and initiating the downstream (5' to 3') transcription of a coding sequence (e.g., structural gene) into mRNA. A promoter will have a transcription initiation region which is usually placed proximal to the 5' end of the coding sequence. This transcription initiation region usually includes an RNA polymerase binding site and a transcription initiation site. A baculovirus transfer vector may also have a second domain called an enhancer, which, if present, is usually distal to the structural gene. Expression may be either regulated or constitutive.

Structural genes, abundantly transcribed at late times in a viral infection cycle, provide particularly useful promoter sequences. Examples include sequences derived from the gene encoding the viral polyhedron protein, Friesen et al., (1986) "The Regulation of Baculovirus Gene Expression," in: *The Molecular Biology of Baculoviruses* (ed. Walter Doerfler); EPO Publ. Nos. 127 839 and 155 476; and the gene encoding the p10 protein, Vlak et al., (1988), *J. Gen. Virol.* 69:765.

DNA encoding suitable signal sequences can be derived from genes for secreted insect or baculovirus proteins, such as the baculovirus polyhedrin gene (Carbonell et al. (1988) *Gene*, 73:409). Alternatively, since the signals for mammalian cell posttranslational modifications (such as signal peptide cleavage, proteolytic cleavage, and phosphorylation) appear to be recognized by insect cells, and the signals required for secretion and nuclear accumulation also appear to be conserved between the invertebrate cells and vertebrate cells, leaders of non-insect origin, such as those derived from genes encoding human (alpha) α-interferon, Maeda et al., (1985), *Nature* 315:592; human gastrin-releasing peptide, Lebacq-Verheyden et al., (1988), *Molec. Cell. Biol.* 8:3129; human IL-2, Smith et al., (1985) *Proc. Nat'l Acad. Sci. USA*, 82:8404; mouse IL-3, (Miyajima et al., (1987) *Gene* 58:273; and human glucocerebrosidase, Martin et al. (1988) *DNA*, 7:99, can also be used to provide for secretion in insects.

A recombinant polypeptide or polyprotein may be expressed intracellularly or, if it is expressed with the proper regulatory sequences, it can be secreted. Good intracellular expression of nonfused foreign proteins usually requires heterologous genes that ideally have a short leader sequence containing suitable translation initiation signals preceding an ATG start signal. If desired, methionine at the N-terminus may be cleaved from the mature protein by in vitro incubation with cyanogen bromide.

Alternatively, recombinant polyproteins or proteins which are not naturally secreted can be secreted from the insect cell by creating chimeric DNA molecules that encode a fusion protein comprised of a leader sequence fragment that provides for secretion of the foreign protein in insects. The leader sequence fragment usually encodes a signal peptide comprised of hydrophobic amino acids which direct the translocation of the protein into the endoplasmic reticulum.

After insertion of the DNA sequence and/or the gene encoding the expression product precursor of the protein, an insect cell host is co-transformed with the heterologous DNA of the transfer vector and the genomic DNA of wild type baculovirus—usually by co-transfection. The promoter and transcription termination sequence of the construct will usually comprise a 2-5 kb section of the baculovirus genome. Methods for introducing heterologous DNA into the desired site in the baculovirus virus are known in the art. (See Summers and Smith supra; Ju et al. (1987); Smith et al., *Mol. Cell. Biol.* (1983) 3:2156; and Luckow and Summers (1989)). For example, the insertion can be into a gene such as the polyhedrin gene, by homologous double crossover recombination; insertion can also be into a restriction enzyme site engineered into the desired baculovirus gene. Miller et al., (1989), *Bioessays* 4:91. The DNA sequence, when cloned in place of the polyhedrin gene in the expression vector, is flanked both 5' and 3' by polyhedrin-specific sequences and is positioned downstream of the polyhedrin promoter.

The newly formed baculovirus expression vector is subsequently packaged into an infectious recombinant baculovirus. Homologous recombination occurs at low frequency (between about 1% and about 5%); thus, the majority of the virus produced after cotransfection is still wild-type virus. Therefore, a method is necessary to identify recombinant viruses. An advantage of the expression system is a visual screen allowing recombinant viruses to be distinguished. The polyhedrin protein, which is produced by the native virus, is produced at very high levels in the nuclei of infected cells at late times after viral infection. Accumulated polyhedrin protein forms occlusion bodies that also contain embedded particles. These occlusion bodies, up to 15 µm in size, are highly refractile, giving them a bright shiny appearance that is readily visualized under the light microscope. Cells infected with recombinant viruses lack occlusion bodies. To distinguish recombinant virus from wild-type virus, the transfection supernatant is plagued onto a monolayer of insect cells by techniques known to those skilled in the art. Namely, the plaques are screened under the light microscope for the presence (indicative of wild-type virus) or absence (indicative of recombinant virus) of occlusion bodies. *Current Protocols in Microbiology* Vol. 2 (Ausubel et al. eds) at 16.8 (Supp. 10, 1990); Summers and Smith, supra; Miller et al. (1989).

Recombinant baculovirus expression vectors have been developed for infection into several insect cells. For example, recombinant baculoviruses have been developed for, inter alia: *Aedes aegypti, Autographa californica, Bombyx mori, Drosophila melanogaster, Spodoptera frugiperda*, and *Trichoplusia ni* (PCT Pub. No. WO 89/046699; Carbonell et al., (1985) *J. Virol.* 56:153; Wright (1986) *Nature* 321:718; Smith et al., (1983) *Mol. Cell. Biol.* 3:2156; and see generally, Fraser, et al. (1989) In Vitro *Cell. Dev. Biol.* 25:225).

Cells and cell culture media are commercially available for both direct and fusion expression of heterologous polypeptides in a baculovirus/expression system; cell culture technology is generally known to those skilled in the art. See, e.g., Summers and Smith supra.

The modified insect cells may then be grown in an appropriate nutrient medium, which allows for stable maintenance of the plasmid(s) present in the modified insect host. Where the expression product gene is under inducible control, the host may be grown to high density, and expression induced. Alternatively, where expression is constitutive, the product will be continuously expressed into the medium and the nutrient medium must be continuously circulated, while removing the product of interest and augmenting depleted nutrients. The product may be purified by such techniques as chromatography, e.g., HPLC, affinity chromatography, ion exchange chromatography, etc.; electrophoresis; density gradient centrifugation; solvent extraction, or the like. As appropriate, the product may be further purified, as required, so as to remove substantially any insect proteins which are also secreted in the medium or result from lysis of insect cells, so as to provide a product which is at least substantially free of host debris, e.g., proteins, lipids and polysaccharides.

In order to obtain protein expression, recombinant host cells derived from the transformants are incubated under conditions which allow expression of the recombinant protein encoding sequence. These conditions will vary, dependent upon the host cell selected. However, the conditions are readily ascertainable to those of ordinary skill in the art, based upon what is known in the art.

iv. Bacterial Systems

Bacterial expression techniques are known in the art. A bacterial promoter is any DNA sequence capable of binding bacterial RNA polymerase and initiating the downstream (3') transcription of a coding sequence (e.g. structural gene) into mRNA. A promoter will have a transcription initiation region which is usually placed proximal to the 5' end of the coding sequence. This transcription initiation region usually includes an RNA polymerase binding site and a transcription initiation site. A bacterial promoter may also have a second domain called an operator, that may overlap an adjacent RNA polymerase binding site at which RNA synthesis begins. The operator permits negative regulated (inducible) transcription, as a gene repressor protein may bind the operator and thereby inhibit transcription of a specific gene. Constitutive expression may occur in the absence of negative regulatory elements, such as the operator. In addition, positive regulation may be achieved by a gene activator protein binding sequence, which, if present is usually proximal (5') to the RNA polymerase binding sequence. An example of a gene activator protein is the catabolite activator protein (CAP), which helps initiate transcription of the lac operon in *Escherichia coli* (*E. coli*) (Raibaud et al. (1984) *Annu. Rev. Genet.* 18:173). Regulated expression may therefore be either positive or negative, thereby either enhancing or reducing transcription.

Sequences encoding metabolic pathway enzymes provide particularly useful promoter sequences. Examples include promoter sequences derived from sugar metabolizing enzymes, such as galactose, lactose (lac) (Chang et al. (1977) *Nature* 198:1056), and maltose. Additional examples include promoter sequences derived from biosynthetic enzymes such as tryptophan (trp) (Goeddel et al. (1980) *Nuc. Acids Res.* 8:4057; Yelverton et al. (1981) *Nucl. Acids Res.* 9:731; U.S. Pat. No. 4,738,921; EPO Publ. Nos. 036 776 and 121 775). The beta-lactamase (bla) promoter system (Weissmann (1981) "The cloning of interferon and other mistakes." In *Interferon* 3 (ed. I. Gresser)), bacteriophage lambda PL (Shimatake et al. (1981) *Nature* 292:128) and T5 (U.S. Pat. No. 4,689,406) promoter systems also provide useful promoter sequences.

In addition, synthetic promoters which do not occur in nature also function as bacterial promoters. For example, transcription activation sequences of one bacterial or bacteriophage promoter may be joined with the operon sequences of another bacterial or bacteriophage promoter, creating a synthetic hybrid promoter (U.S. Pat. No. 4,551,433). For example, the tac promoter is a hybrid trp-lac promoter comprised of both trp promoter and lac operon sequences that is regulated by the lac repressor (Amann et al. (1983) *Gene* 25:167; de Boer et al. (1983) *Proc. Natl. Acad. Sci.* 80:21). Furthermore, a bacterial promoter can include naturally occurring promoters of non-bacterial origin that have the ability to bind bacterial RNA polymerase and initiate transcription. A naturally occurring promoter of non-bacterial origin can also be coupled with a compatible RNA polymerase to produce high levels of expression of some genes in prokaryotes. The bacteriophage T7 RNA polymerase/promoter system is an example of a coupled promoter system (Studier et al. (1986) *J. Mol. Biol.* 189:113; Tabor et al. (1985) *Proc Natl. Acad. Sci.* 82:1074). In addition, a hybrid promoter can also be comprised of a bacteriophage promoter and an *E. coli* operator region (EPO Publ. No. 267 851).

In addition to a functioning promoter sequence, an efficient ribosome binding site is also useful for the expression of foreign genes in prokaryotes. In *E. coli*, the ribosome binding site is called the Shine-Dalgarno (SD) sequence and includes an initiation codon (ATG) and a sequence 3-9 nucleotides in length located 3-11 nucleotides upstream of the initiation codon (Shine et al. (1975) *Nature* 254:34). The SD sequence is thought to promote binding of mRNA to the ribosome by the pairing of bases between the SD sequence and the 3' end of *E. coli* 16S rRNA (Steitz et al. (1979) "Genetic signals and nucleotide sequences in messenger RNA." In *Biological Regulation and Development: Gene Expression* (ed. R. F. Goldberger)). To express eukaryotic genes and prokaryotic genes with weak ribosome-binding site, it is often necessary to optimize the distance between the SD sequence and the ATG of the eukaryotic gene (Sambrook et al. (1989) "Expression of cloned genes in *Escherichia coli*." In *Molecular Cloning: A Laboratory Manual*).

A DNA molecule may be expressed intracellularly. A promoter sequence may be directly linked with the DNA molecule, in which case the first amino acid at the N-terminus will always be a methionine, which is encoded by the ATG start codon. If desired, methionine at the N-terminus may be cleaved from the protein by in vitro incubation with cyanogen bromide or by either in vivo or in vitro incubation with a bacterial methionine N-terminal peptidase (EPO Publ. No. 219 237).

Fusion proteins provide an alternative to direct expression. Usually, a DNA sequence encoding the N-terminal portion of an endogenous bacterial protein, or other stable protein, is fused to the 5' end of heterologous coding sequences. Upon expression, this construct will provide a fusion of the two amino acid sequences. For example, the bacteriophage lambda cell gene can be linked at the 5' terminus of a foreign gene and expressed in bacteria. The resulting fusion protein preferably retains a site for a processing enzyme (factor Xa) to cleave the bacteriophage protein from the foreign gene (Nagai et al. (1984) *Nature* 309:810). Fusion proteins can also be made with sequences from the lacZ (Jia et al. (1987) *Gene* 60:197), trpE (Allen et al. (1987) J. Biotechnol. 5:93; Makoff et al. (1989) *J. Gen. Microbiol.* 135:11), and Chey (EPO Publ. No. 324 647) genes. The DNA sequence at the junction of the two amino acid sequences may or may not encode a cleavable site. Another example is a ubiquitin fusion protein. Such a fusion protein is made with the ubiquitin region that preferably retains a site for a processing enzyme (e.g. ubiquitin specific processing-protease) to cleave the ubiquitin from the foreign protein. Through this method, native foreign protein can be isolated (Miller et al. (1989) *Bio/Technology* 7:698).

Alternatively, foreign proteins can also be secreted from the cell by creating chimeric DNA molecules that encode a fusion protein comprised of a signal peptide sequence fragment that provides for secretion of the foreign protein in bacteria (U.S. Pat. No. 4,336,336). The signal sequence fragment usually encodes a signal peptide comprised of hydrophobic amino acids which direct the secretion of the protein from the cell. The protein is either secreted into the growth media (gram-positive bacteria) or into the periplasmic space, located between the inner and outer membrane of the cell (gram-negative bacteria). Preferably there are processing sites, which can be cleaved either in vivo or in vitro encoded between the signal peptide fragment and the foreign gene.

DNA encoding suitable signal sequences can be derived from genes for secreted bacterial proteins, such as the *E. coli* outer membrane protein gene (ompA) (Masui et al. (1983), in: *Experimental Manipulation of Gene Expression*; Ghrayeb et al. (1984) *EMBO J.* 3:2437) and the *E. coli* alkaline phosphatase signal sequence (phoA) (Oka et al. (1985) *Proc. Natl. Acad. Sci.* 82:7212). As an additional example, the signal sequence of the alpha-amylase gene from various *Bacillus* strains can be used to secrete heterologous proteins from *B. subtilis* (Palva et al. (1982) *Proc. Natl. Acad. Sci. USA* 79:5582; EPO Publ. No. 244 042).

Usually, transcription termination sequences recognized by bacteria are regulatory regions located 3' to the translation stop codon, and thus together with the promoter flank the coding sequence. These sequences direct the transcription of an mRNA which can be translated into the polypeptide encoded by the DNA. Transcription termination sequences frequently include DNA sequences of about 50 nucleotides capable of forming stem loop structures that aid in terminating transcription. Examples include transcription termination sequences derived from genes with strong promoters, such as the trp gene in *E. coli* as well as other biosynthetic genes.

Usually, the above described components, comprising a promoter, signal sequence (if desired), coding sequence of interest, and transcription termination sequence, are put together into expression constructs. Expression constructs are often maintained in a replicon, such as an extrachromosomal element (e.g., plasmids) capable of stable maintenance in a host, such as bacteria. The replicon will have a replication system, thus allowing it to be maintained in a prokaryotic host either for expression or for cloning and amplification. In addition, a replicon may be either a high or low copy number plasmid. A high copy number plasmid will generally have a copy number ranging from about 5 to about 200, and usually about 10 to about 150. A host containing a high copy number plasmid will preferably contain at least about 10, and more preferably at least about 20 plasmids. Either a high or low copy number vector may be selected, depending upon the effect of the vector and the foreign protein on the host.

Alternatively, the expression constructs can be integrated into the bacterial genome with an integrating vector. Integrating vectors usually contain at least one sequence homologous to the bacterial chromosome that allows the vector to integrate. Integrations appear to result from recombinations between homologous DNA in the vector and the bacterial chromosome. For example, integrating vectors constructed with DNA from various *Bacillus* strains integrate into the *Bacillus* chromosome (EPO Publ. No. 127 328). Integrating vectors may also be comprised of bacteriophage or transposon sequences.

Usually, extrachromosomal and integrating expression constructs may contain selectable markers to allow for the selection of bacterial strains that have been transformed. Selectable markers can be expressed in the bacterial host and may include genes which render bacteria resistant to drugs such as ampicillin, chloramphenicol, erythromycin, kanamycin (neomycin), and tetracycline (Davies et al. (1978) *Annu. Rev. Microbiol.* 32:469). Selectable markers may also include biosynthetic genes, such as those in the histidine, tryptophan, and leucine biosynthetic pathways.

Alternatively, some of the above described components can be put together in transformation vectors. Transformation vectors are usually comprised of a selectable market that is either maintained in a replicon or developed into an integrating vector, as described above.

Expression and transformation vectors, either extra-chromosomal replicons or integrating vectors, have been developed for transformation into many bacteria. For example, expression vectors have been developed for, inter alia, the following bacteria: *Bacillus subtilis* (Palva et al. (1982) *Proc. Natl. Acad. Sci. USA* 79:5582; EPO Publ. Nos. 036 259 and 063 953; PCT Publ. No. WO 84/04541), *Escherichia coli* (Shimatake et al. (1981) *Nature* 292:128; Amann et al. (1985) *Gene* 40:183; Studier et al. (1986) *J. Mol. Biol.* 189:113; EPO Publ. Nos. 036 776, 136 829 and 136 907), *Streptococcus cremoris* (Powell et al. (1988) *Appl. Environ. Microbiol.* 54:655); *Streptococcus lividans* (Powell et al. (1988) *Appl. Environ. Microbiol.* 54:655), *Streptomyces lividans* (U.S. Pat. No. 4,745,056).

Methods of introducing exogenous DNA into bacterial hosts are well-known in the art, and usually include either the transformation of bacteria treated with $CaCl_2$ or other agents, such as divalent cations and DMSO. DNA can also be introduced into bacterial cells by electroporation. Transformation procedures usually vary with the bacterial species to be transformed. (See e.g., use of *Bacillus*: Masson et al. (1989) *FEMS Microbiol. Lett.* 60:273; Palva et al. (1982) *Proc. Natl. Acad. Sci. USA* 79:5582; EPO Publ. Nos. 036 259 and 063 953; PCT Publ. No. WO 84/04541; use of *Campylobacter*: Miller et al. (1988) *Proc. Natl. Acad. Sci.* 85:856; and Wang et al. (1990) *J. Bacteriol.* 172:949; use of *Escherichia coli*: Cohen et al. (1973) *Proc. Natl. Acad. Sci.* 69:2110; Dower et al. (1988) *Nucleic Acids Res.* 16:6127; Kushner (1978) "An improved method for transformation of *Escherichia coli* with ColE1-derived plasmids. In *Genetic Engineering: Proceedings of the International Symposium on Genetic Engineering* (eds. H. W. Boyer and S. Nicosia); Mandel et al. (1970) *J. Mol. Biol.* 53:159; Taketo (1988) *Biochim. Biophys. Acta* 949:318; use of *Lactobacillus*: Chassy et al. (1987) *FEMS Microbiol. Lett.* 44:173; use of *Pseudomonas*: Fiedler et al. (1988) *Anal. Biochem* 170:38; use of *Staphylococcus*: Augustin et al. (1990) *FEMS Microbiol. Lett.* 66:203; use of *Streptococcus*: Barany et al. (1980) *J. Bacteriol.* 144:698; Harlander (1987) "Transformation of *Streptococcus* lactis by electroporation, in: *Streptococcal Genetics* (ed. J. Ferretti and R. Curtiss III); Perry et al. (1981) *Infect. Immun.* 32:1295; Powell et al. (1988) *Appl. Environ. Microbiol.* 54:655; Somkuti et al. (1987) *Proc. 4th Evr. Cong. Biotechnology* 1:412.

v. Yeast Expression

Yeast expression systems are also known to one of ordinary skill in the art. A yeast promoter is any DNA sequence capable of binding yeast RNA polymerase and initiating the downstream (3') transcription of a coding sequence (e.g. structural gene) into mRNA. A promoter will have a transcription initiation region which is usually placed proximal to the 5' end of the coding sequence. This transcription initiation region usually includes an RNA polymerase binding site (the "TATA Box") and a transcription initiation site. A yeast promoter may also have a second domain called an upstream activator sequence (UAS), which, if present, is usually distal to the structural gene. The UAS permits regulated (inducible) expression. Constitutive expression occurs in the absence of a UAS. Regulated expression may be either positive or negative, thereby either enhancing or reducing transcription.

Yeast is a fermenting organism with an active metabolic pathway, therefore sequences encoding enzymes in the metabolic pathway provide particularly useful promoter sequences. Examples include alcohol dehydrogenase (ADH) (EPO Publ. No. 284 044), enolase, glucokinase, glucose-6-phosphate isomerase, glyceraldehyde-3-phosphate-dehydrogenase (GAP or GAPDH), hexokinase, phosphofructokinase, 3-phosphoglycerate mutase, and pyruvate kinase (PyK) (EPO Publ. No. 329 203). The yeast PHO5 gene, encoding acid phosphatase, also provides useful promoter sequences (Myanohara et al. (1983) *Proc. Natl. Acad. Sci. USA* 80:1).

In addition, synthetic promoters which do not occur in nature also function as yeast promoters. For example, UAS sequences of one yeast promoter may be joined with the transcription activation region of another yeast promoter, creating a synthetic hybrid promoter. Examples of such hybrid promoters include the ADH regulatory sequence linked to the GAP transcription activation region (U.S. Pat. Nos. 4,876,197 and 4,880,734). Other examples of hybrid promoters include promoters which consist of the regulatory sequences of either the ADH2, GAL4, GAL10, OR PHO5 genes, combined with the transcriptional activation region of a glycolytic enzyme gene such as GAP or PyK (EPO Publ. No. 164 556). Furthermore, a yeast promoter can include naturally occurring promoters of non-yeast origin that have the ability to bind yeast RNA polymerase and initiate transcription. Examples of such promoters include, inter alia, (Cohen et al. (1980) *Proc. Natl. Acad. Sci. USA* 77:1078; Henikoff et al. (1981) *Nature* 283:835; Hollenberg et al. (1981) *Curr. Topics Microbiol. Immunol.* 96:119; Hollenberg et al. (1979) "The Expression of Bacterial Antibiotic Resistance Genes in the Yeast *Saccharomyces cerevisiae*," in: *Plasmids of Medical, Environmental and Commercial Importance* (eds. K. N. Timmis and A. Puhler); Mercerau-Puigalon et al. (1980) *Gene* 11:163; Panthier et al. (1980) *Curr. Genet.* 2:109;).

A DNA molecule may be expressed intracellularly in yeast. A promoter sequence may be directly linked with the DNA molecule, in which case the first amino acid at the N-terminus of the recombinant protein will always be a methionine, which is encoded by the ATG start codon. If desired, methionine at the N-terminus may be cleaved from the protein by in vitro incubation with cyanogen bromide.

Fusion proteins provide an alternative for yeast expression systems, as well as in mammalian, plant, baculovirus, and bacterial expression systems. Usually, a DNA sequence encoding the N-terminal portion of an endogenous yeast protein, or other stable protein, is fused to the 5' end of heterologous coding sequences. Upon expression, this construct will provide a fusion of the two amino acid sequences. For example, the yeast or human superoxide dismutase (SOD) gene, can be linked at the 5' terminus of a foreign gene and expressed in yeast. The DNA sequence at the junction of the two amino acid sequences may or may not encode a cleavable site. See e.g., EPO Publ. No. 196056. Another example is a ubiquitin fusion protein. Such a fusion protein is made with the ubiquitin region that preferably retains a site for a processing enzyme (e.g. ubiquitin-specific processing protease) to cleave the ubiquitin from the foreign protein. Through this method, therefore, native foreign protein can be isolated (e.g., WO88/024066).

Alternatively, foreign proteins can also be secreted from the cell into the growth media by creating chimeric DNA molecules that encode a fusion protein comprised of a leader sequence fragment that provide for secretion in yeast of the foreign protein. Preferably, there are processing sites encoded between the leader fragment and the foreign gene that can be cleaved either in vivo or in vitro. The leader sequence fragment usually encodes a signal peptide comprised of hydrophobic amino acids which direct the secretion of the protein from the cell.

DNA encoding suitable signal sequences can be derived from genes for secreted yeast proteins, such as the yeast invertase gene (EPO Publ. No. 012 873; JPO Publ. No. 62:096,086) and the A-factor gene (U.S. Pat. No. 4,588,684). Alternatively, leaders of non-yeast origin, such as an interferon leader, exist that also provide for secretion in yeast (EPO Publ. No. 060 057).

A preferred class of secretion leaders are those that employ a fragment of the yeast alpha-factor gene, which contains both a "pre" signal sequence, and a "pro" region. The types of alpha-factor fragments that can be employed include the full-length pre-pro alpha factor leader (about 83 amino acid residues) as well as truncated alpha-factor leaders (usually about 25 to about 50 amino acid residues) (U.S. Pat. Nos. 4,546,083 and 4,870,008; EPO Publ. No. 324 274). Additional leaders employing an alpha-factor leader fragment that provides for secretion include hybrid alpha-factor leaders made with a presequence of a first yeast, but a pro-region from a second yeast alphafactor. (See e.g., PCT Publ. No. WO 89/02463.)

Usually, transcription termination sequences recognized by yeast are regulatory regions located 3' to the translation stop codon, and thus together with the promoter flank the coding sequence. These sequences direct the transcription of an mRNA which can be translated into the polypeptide encoded by the DNA. Examples of transcription terminator sequence and other yeast-recognized termination sequences, such as those coding for glycolytic enzymes.

Usually, the above described components, comprising a promoter, leader (if desired), coding sequence of interest, and transcription termination sequence, are put together into expression constructs. Expression constructs are often maintained in a replicon, such as an extrachromosomal element (e.g., plasmids) capable of stable maintenance in a host, such as yeast or bacteria. The replicon may have two replication systems, thus allowing it to be maintained, for example, in yeast for expression and in a prokaryotic host for cloning and amplification. Examples of such yeast-bacteria shuttle vectors include YEp24 (Botstein et al. (1979) *Gene* 8:17-24), pC1/1 (Brake et al. (1984) *Proc. Natl. Acad. Sci USA* 81:4642-4646), and YRp17 (Stinchcomb et al. (1982) *J. Mol. Biol.* 158:157). In addition, a replicon may be either a high or low copy number plasmid. A high copy number plasmid will generally have a copy number ranging from about 5 to about 200, and usually about 10 to about 150. A host containing a high copy number plasmid will preferably have at least about 10, and more preferably at least about 20. Enter a high or low copy number vector may be selected, depending upon the effect of the vector and the foreign protein on the host. See e.g., Brake et al., supra.

Alternatively, the expression constructs can be integrated into the yeast genome with an integrating vector. Integrating vectors usually contain at least one sequence homologous to a yeast chromosome that allows the vector to integrate, and preferably contain two homologous sequences flanking the expression construct. Integrations appear to result from recombinations between homologous DNA in the vector and the yeast chromosome (Orr-Weaver et al. (1983) *Methods in Enzymol.* 101:228-245). An integrating vector may be directed to a specific locus in yeast by selecting the appropriate homologous sequence for inclusion in the vector. See Orr-Weaver et al., supra. One or more expression construct may integrate, possibly affecting levels of recombinant protein produced (Rine et al. (1983) *Proc. Natl. Acad. Sci. USA* 80:6750). The chromosomal sequences included in the vector can occur either as a single segment in the vector, which results in the integration of the entire vector, or two segments homologous to adjacent segments in the chromosome and flanking the expression construct in the vector, which can result in the stable integration of only the expression construct.

Usually, extrachromosomal and integrating expression constructs may contain selectable markers to allow for the selection of yeast strains that have been transformed. Selectable markers may include biosynthetic genes that can be expressed in the yeast host, such as ADE2, HIS4, LEU2, TRP1, and ALG7, and the G418 resistance gene, which confer resistance in yeast cells to tunicamycin and G418, respectively. In addition, a suitable selectable marker may also provide yeast with the ability to grow in the presence of toxic compounds, such as metal. For example, the presence of CUP1 allows yeast to grow in the presence of copper ions (Butt et al. (1987) *Microbiol, Rev.* 51:351).

Alternatively, some of the above described components can be put together into transformation vectors. Transformation vectors are usually comprised of a selectable marker that is either maintained in a replicon or developed into an integrating vector, as described above.

Expression and transformation vectors, either extrachromosomal replicons or integrating vectors, have been developed for transformation into many yeasts. For example, expression vectors and methods of introducing exogenous DNA into yeast hosts have been developed for, inter alia, the following yeasts: *Candida albicans* (Kurtz, et al. (1986) *Mol. Cell. Biol.* 6:142); *Candida maltosa* (Kunze, et al. (1985) *J. Basic Microbiol.* 25:141); *Hansenula polymorpha* (Gleeson, et al. (1986) *J. Gen. Microbiol.* 132:3459; Roggenkamp et al. (1986) *Mol. Gen. Genet.* 202:302); *Kluyveromyces fragilis* (Das, et al. (1984) *J. Bacteriol.* 158:1165); *Kluyveromyces lactis* (De Louvencourt et al. (1983) *J. Bacteriol.* 154:737; Van den Berg et al. (1990) *Bio/Technology* 8:135); *Pichia guillerimondii* (Kunze et al. (1985) *J. Basic Microbiol.* 25:141); *Pichia pastoris* (Cregg, et al. (1985) *Mol. Cell. Biol.* 5:3376; U.S. Pat. Nos. 4,837,148 and 4,929,555); *Saccharomyces cerevisiae* (Hinnen et al. (1978) *Proc. Natl. Acad. Sci. USA* 75:1929; Ito et al. (1983) *J. Bacteriol.* 153:163); *Schizosaccharomyces pombe* (Beach and Nurse (1981) *Nature* 300:706); and *Yarrowia lipolytica* (Davidow, et al. (1985) *Curr. Genet.* 10:380471 Gaillardin, et al. (1985) *Curr. Genet.* 10:49).

Methods of introducing exogenous DNA into yeast hosts are well-known in the art, and usually include either the transformation of spheroplasts or of intact yeast cells treated with alkali cations. Transformation procedures usually vary with the yeast species to be transformed. See e.g., [Kurtz et al. (1986) *Mol. Cell. Biol.* 6:142; Kunze et al. (1985) *J. Basic Microbiol.* 25:141; *Candida*]; [Gleeson et al. (1986) *J. Gen. Microbiol.* 132:3459; Roggenkamp et al. (1986) *Mol. Gen. Genet.* 202:302; *Hansenula*]; [Das et al. (1984) *J. Bacteriol.* 158:1165; De Louvencourt et al. (1983) *J. Bacteriol.* 154: 1165; Van den Berg et al. (1990) *Bio/Technology* 8:135; *Kluyveromyces*]; [Cregg et al. (1985) *Mol. Cell. Biol.* 5:3376; Kunze et al. (1985) *J. Basic Microbiol.* 25:141; U.S. Pat. Nos. 4,837,148 and 4,929,555; *Pichia*]; [Hinnen et al. (1978) *Proc. Natl. Acad. Sci. USA* 75; 1929; Ito et al. (1983) *J. Bacteriol.* 153:163 *Saccharomyces*]; [Beach and Nurse (1981) *Nature* 300:706; *Schizosaccharomyces*]; [Davidow et al. (1985) *Curr. Genet.* 10:39; Gaillardin et al. (1985) *Curr. Genet.* 10:49; *Yarrowia*].

Definitions

A composition containing X is "substantially free of" Y when at least 85% by weight of the total X+Y in the composition is X. Preferably, X comprises at least about 90% by weight of the total of X+Y in the composition, more preferably at least about 95% or even 99% by weight.

A "conserved" *Neisseria* amino acid fragment or protein is one that is present in a particular Neisserial protein in at least x % of *Neisseria*. The value of x may be 50% or more, e.g., 66%, 75%, 80%, 90%, 95% or even 100% (i.e. the amino acid is found in the protein in question in all *Neisseria*). In order to determine whether an animo acid is "conserved" in a particular Neisserial protein, it is necessary to compare that amino acid residue in the sequences of the protein in question from a plurality of different *Neisseria* (a reference population). The reference population may include a number of different *Neisseria* species or may include a single species. The reference population may include a number of different serogroups of a particular species or a single serogroup. A preferred reference population consists of the 5 most common *Neisseria* The term "heterologous" refers to two biological components that are not found together in nature. The components may be host cells, genes, or regulatory regions, such as promoters. Although the heterologous components are not found together in nature, they can function together, as when a promoter heterologous to a gene is operably linked to the gene. Another example is where a Neisserial sequence is heterologous to a mouse host cell.

An "origin of replication" is a polynucleotide sequence that initiates and regulates replication of polynucleotides, such as an expression vector. The origin of replication behaves as an autonomous unit of polynucleotide replication within a cell, capable of replication under its own control. An origin of replication may be needed for a vector to replicate in a particular host cell. With certain origins of replication, an expression vector can be reproduced at a high copy number in the presence of the appropriate proteins within the cell. Examples of origins are the autonomously replicating sequences, which are effective in yeast; and the viral T-antigen, effective in COS-7 cells.

A "mutant" sequence is defined as a DNA, RNA or amino acid sequence differing from but having homology with the native or disclosed sequence. Depending on the particular sequence, the degree of homology (sequence identity) between the native or disclosed sequence and the mutant sequence is preferably greater than 50% (e.g., 60%, 70%, 80%, 90%, 95%, 99% or more) which is calculated as described above. As used herein, an "allelic variant" of a nucleic acid molecule, or region, for which nucleic acid sequence is provided herein is a nucleic acid molecule, or region, that occurs at essentially the same locus in the genome of another or second isolate, and that, due to natural variation caused by, for example, mutation or recombination, has a similar but not identical nucleic acid sequence. A coding region allelic variant typically encodes a protein having similar activity to that of the protein encoded by the gene to which it is being compared. An allelic variant can also comprise an alteration in the 5' or 3' untranslated regions of the gene, such as in regulatory control regions. (see, for example, U.S. Pat. No. 5,753,235).

Antibodies

As used herein, the term "antibody" refers to a polypeptide or group of polypeptides composed of at least one antibody combining site. An "antibody combining site" is the threedimensional binding space with an internal surface shape and charge distribution complementary to the features of an epitope of an antigen, which allows a binding of the antibody with the antigen. "Antibody" includes, for example, vertebrate antibodies, hybrid antibodies, chimeric antibodies, humanized antibodies, altered antibodies, univalent antibodies, Fab proteins, and single domain antibodies.

Antibodies against the proteins of the invention are useful for affinity chromatography, immunoassays, and distinguishing/identifying *Neisseria* menB proteins. Antibodies elicited against the proteins of the present invention bind to antigenic polypeptides or proteins or protein fragments that are present and specifically associated with strains of *Neisseria meningitidis* menB. In some instances, these antigens may be associated with specific strains, such as those antigens specific for the menB strains. The antibodies of the invention may be immobilized to a matrix and utilized in an immunoassay or on an affinity chromatography column, to enable the detection and/or separation of polypeptides, proteins or protein fragments or cells comprising such polypeptides, proteins or protein fragments. Alternatively, such polypeptides, proteins or protein fragments may be immobilized so as to detect antibodies bindably specific thereto.

Antibodies to the proteins of the invention, both polyclonal and monoclonal, may be prepared by conventional methods. In general, the protein is first used to immunize a suitable animal, preferably a mouse, rat, rabbit or goat. Rabbits and goats are preferred for the preparation of polyclonal sera due to the volume of serum obtainable, and the availability of labeled anti-rabbit and anti-goat antibodies. Immunization is generally performed by mixing or emulsifying the protein in saline, preferably in an adjuvant such as Freund's complete adjuvant, and injecting the mixture or emulsion parenterally (generally subcutaneously or intramuscularly). A dose of 50-200 μg/injection is typically sufficient. Immunization is generally boosted 2-6 weeks later with one or more injections of the protein in saline, preferably using Freund's incomplete adjuvant. One may alternatively generate antibodies by in vitro immunization using methods known in the art, which for the purposes of this invention is considered equivalent to in vivo immunization. Polyclonal antisera is obtained by bleeding the immunized animal into a glass or plastic container, incubating the blood at 25° C. for one hour, followed by incubating at 4° C. for 2-18 hours. The serum is recovered by centrifugation (e.g., 1,000 g for 10 minutes). About 20-50 ml per bleed may be obtained from rabbits.

Monoclonal antibodies are prepared using the standard method of Kohler & Milstein (*Nature* (1975) 256:495-96), or a modification thereof. Typically, a mouse or rat is immunized as described above. However, rather than bleeding the animal to extract serum, the spleen (and optionally several large lymph nodes) is removed and dissociated into single cells. If desired, the spleen cells may be screened (after removal of nonspecifically adherent cells) by applying a cell suspension to a plate or well coated with the protein antigen. B-cells that express membrane-bound immunoglobulin specific for the antigen bind to the plate, and are not rinsed away with the rest of the suspension. Resulting B-cells, or all dissociated spleen cells, are then induced to fuse with myeloma cells to form hybridomas, and are cultured in a selective medium (e.g., hypoxanthine, aminopterin, thymidine medium, "HAT"). The resulting hybridomas are plated by limiting dilution, and are assayed for the production of antibodies which bind specifically to the immunizing antigen (and which do not bind to unrelated antigens). The selected MAb-secreting hybridomas are then cultured either in vitro (e.g., in tissue culture bottles or hollow fiber reactors), or in vivo (as ascites in mice).

If desired, the antibodies (whether polyclonal or monoclonal) may be labeled using conventional techniques. Suitable labels include fluorophores, chromophores, radioactive atoms (particularly $^{32}$P and $^{125}$I), electron-dense reagents, enzymes, and ligands having specific binding partners. Enzymes are typically detected by their activity. For example, horseradish peroxidase is usually detected by its ability to convert 3,3',5,5'-tetramethylbenzidine (TMB) to a blue pigment, quantifiable with a spectrophotometer. "Specific binding partner" refers to a protein capable of binding a ligand molecule with high specificity, as for example in the case of an antigen and a monoclonal antibody specific therefor. Other specific binding partners include biotin and avidin or streptavidin, IgG and protein A, and the numerous receptor-ligand couples known in the art. It should be understood that the above description is not meant to categorize the various labels into distinct classes, as the same label may serve in several different modes. For example, $^{125}$I may serve as a radioactive label or as an electron-dense reagent. HRP may serve as enzyme or as antigen for a MAb. Further, one may combine various labels for desired effect. For example, MAbs and avidin also require labels in the practice of this invention: thus, one might label a MAb with biotin, and detect its presence with avidin labeled with $^{125}$I, or with an anti-biotin MAb labeled with HRP. Other permutations and possibilities will be readily apparent to those of ordinary skill in the art, and are considered as equivalents within the scope of the instant invention.

Antigens, immunogens, polypeptides, proteins or protein fragments of the present invention elicit formation of specific binding partner antibodies. These antigens, immunogens, polypeptides, proteins or protein fragments of the present invention comprise immunogenic compositions of the present invention. Such immunogenic compositions may further comprise or include adjuvants, carriers, or other compositions that promote or enhance or stabilize the antigens, polypeptides, proteins or protein fragments of the present invention. Such adjuvants and carriers will be readily apparent to those of ordinary skill in the art.

Pharmaceutical Compositions

Pharmaceutical compositions can comprise (include) either polypeptides, antibodies, or nucleic acid of the invention. The pharmaceutical compositions will comprise a therapeutically effective amount of either polypeptides, antibodies, or polynucleotides of the claimed invention.

The term "therapeutically effective amount" as used herein refers to an amount of a therapeutic agent to treat, ameliorate, or prevent a desired disease or condition, or to exhibit a detectable therapeutic or preventative effect. The effect can be detected by, for example, chemical markers or antigen levels. Therapeutic effects also include reduction in physical symptoms, such as decreased body temperature, when given to a patient that is febrile. The precise effective amount for a subject will depend upon the subject's size and health, the nature and extent of the condition, and the therapeutics or combination of therapeutics selected for administration. Thus, it is not useful to specify an exact effective amount in advance. However, the effective amount for a given situation can be determined by routine experimentation and is within the judgment of the clinician.

For purposes of the present invention, an effective dose will be from about 0.01 mg/kg to 50 mg/kg or 0.05 mg/kg to about 10 mg/kg of the DNA constructs in the individual to which it is administered.

A pharmaceutical composition can also contain a pharmaceutically acceptable carrier. The term "pharmaceutically acceptable carrier" refers to a carrier for administration of a therapeutic agent, such as antibodies or a polypeptide, genes, and other therapeutic agents. The term refers to any pharmaceutical carrier that does not itself induce the production of antibodies harmful to the individual receiving the composition, and which may be administered without undue toxicity. Suitable carriers may be large, slowly metabolized macromolecules such as proteins, polysaccharides, polylactic acids, polyglycolic acids, polymeric amino acids, amino acid copolymers, and inactive virus particles. Such carriers are well known to those of ordinary skill in the art.

Pharmaceutically acceptable salts can be used therein, for example, mineral acid salts such as hydrochlorides, hydrobromides, phosphates, sulfates, and the like; and the salts of organic acids such as acetates, propionates, malonates, benzoates, and the like. A thorough discussion of pharmaceutically acceptable excipients is available in Remington's Pharmaceutical Sciences (Mack Pub. Co., N.J. 1991).

Pharmaceutically acceptable carriers in therapeutic compositions may contain liquids such as water, saline, glycerol and ethanol. Additionally, auxiliary substances, such as wetting or emulsifying agents, pH buffering substances, and the like, may be present in such vehicles. Typically, the therapeutic compositions are prepared as injectables, either as liquid solutions or suspensions; solid forms suitable for solution in, or suspension in, liquid vehicles prior to injection may also be prepared. Liposomes are included within the definition of a pharmaceutically acceptable carrier.

Delivery Methods

Once formulated, the compositions of the invention can be administered directly to the subject. The subjects to be treated can be animals; in particular, human subjects can be treated.

Direct delivery of the compositions will generally be accomplished by injection, either subcutaneously, intraperitoneally, intravenously or intramuscularly or delivered to the interstitial space of a tissue. The compositions can also be administered into a lesion. Other modes of administration include oral and pulmonary administration, suppositories, and transdermal and transcutaneous applications, needles, and gene guns or hyposprays. Dosage treatment may be a single dose schedule or a multiple dose schedule.

Vaccines

Vaccines according to the invention may either be prophylactic (i.e., to prevent infection) or therapeutic (i.e., to treat disease after infection).

Such vaccines comprise immunizing antigen(s) or immunogen(s), immunogenic polypeptide, protein(s) or protein fragments, or nucleic acids (e.g., ribonucleic acid or deoxyribonucleic acid), usually in combination with "pharmaceutically acceptable carriers," which include any carrier that does not itself induce the production of antibodies harmful to the individual receiving the composition. Suitable carriers are typically large, slowly metabolized macromolecules such as proteins, polysaccharides, polylactic acids, polyglycolic acids, polymeric amino acids, amino acid copolymers, lipid aggregates (such as oil droplets or liposomes), and inactive virus particles. Such carriers are well known to those of ordinary skill in the art. Additionally, these carriers may function as immunostimulating agents ("adjuvants"). Furthermore, the immunogen or antigen may be conjugated to a bacterial toxoid, such as a toxoid from diphtheria, tetanus, cholera, H. pylori, etc. pathogens.

Preferred adjuvants to enhance effectiveness of the composition include, but are not limited to: (1) aluminum salts (alum), such as aluminum hydroxide, aluminum phosphate, aluminum sulfate, etc; (2) oil-in-water emulsion formulations (with or without other specific immunostimulating agents such as muramyl peptides (see below) or bacterial cell wall components), such as for example (a) MF59 (PCT Publ. No. WO 90/14837), containing 5% Squalene, 0.5% TWEEN 80™, and 0.5% SPAN 85™ (optionally containing various amounts of MTP-PE (see below), although not required) formulated into submicron particles using a microfluidizer such as Model 110Y microfluidizer (Microfluidics, Newton, Mass.), (b) SAF, containing 10% Squalane, 0.4% Tween 80, 5% PLURONIC™-blocked polymer L121, and thr-MDP (see below) either microfluidized into a submicron emulsion or vortexed to generate a larger particle size emulsion, and (c) RIBI™ adjuvant system (RAS), (Ribi Immunochem, Hamilton, Mont.) containing 2% Squalene, 0.2% TWEEN 80™, and one or more bacterial cell wall components from the group consisting of monophosphorylipid A (MPL), trehalose dimycolate (TDM), and cell wall skeleton (CWS), preferably MPL+CWS (DETOX™); (3) saponin adjuvants, such as STIMULON™ (Cambridge Bioscience, Worcester, Mass.) may be used or particles generated therefrom such as ISCOMs (immunostimulating complexes); (4) Complete Freund's Adjuvant (CFA) and Incomplete Freund's Adjuvant (IFA); (5) cytokines, such as interleukins (e.g., IL-1, IL-2, IL-4, IL-5, IL-6, IL-7, IL-12, etc.), interferons (e.g., gamma interferon), macrophage colony stimulating factor (M-CSF), tumor necrosis factor (TNF), etc; and (6) other substances that act as immunostimulating agents to enhance the effectiveness of the composition. Alum and MF59 are preferred.

As mentioned above, muramyl peptides include, but are not limited to, N-acetyl-muramyl-L-threonyl-D-isoglutamine (thr-MDP), N-acetyl-normuramyl-L-alanyl-D-isoglutamine (nor-MDP), N-acetylmuramyl-L-alanyl-D-isoglutaminyl-L-alanine-2-(1'-2'-dipalmitoyl-sn-glycero-3-huydroxyphosphoryloxy)-ethylamine (MTP-PE), etc.

The vaccine compositions comprising immunogenic compositions (e.g., which may include the antigen, pharmaceutically acceptable carrier, and adjuvant) typically will contain diluents, such as water, saline, glycerol, ethanol, etc. Additionally, auxiliary substances, such as wetting or emulsifying agents, pH buffering substances, and the like, may be present in such vehicles. Alternatively, vaccine compositions comprising immunogenic compositions may comprise an antigen, polypeptide, protein, protein fragment or nucleic acid in a pharmaceutically acceptable carrier.

More specifically, vaccines comprising immunogenic compositions comprise an immunologically effective amount of the immunogenic polypeptides, as well as any other of the above-mentioned components, as needed. By "immunologically effective amount", it is meant that the administration of that amount to an individual, either in a single dose or as part of a series, is effective for treatment or prevention. This amount varies depending upon the health and physical condition of the individual to be treated, the taxonomic group of individual to be treated (e.g., nonhuman primate, primate, etc.), the capacity of the individual's immune system to synthesize antibodies, the degree of protection desired, the formulation of the vaccine, the treating doctor's assessment of the medical situation, and other relevant factors. It is expected that the amount will fall in a relatively broad range that can be determined through routine trials.

Typically, the vaccine compositions or immunogenic compositions are prepared as injectables, either as liquid solutions or suspensions; solid forms suitable for solution in, or suspension in, liquid vehicles prior to injection may also be prepared. The preparation also may be emulsified or encapsulated in liposomes for enhanced adjuvant effect, as discussed above under pharmaceutically acceptable carriers.

The immunogenic compositions are conventionally administered parenterally, e.g., by injection, either subcutaneously or intramuscularly. Additional formulations suitable for other modes of administration include oral and pulmonary formulations, suppositories, and transdermal and transcutaneous applications. Dosage treatment may be a single dose schedule or a multiple dose schedule. The vaccine may be administered in conjunction with other immunoregulatory agents.

As an alternative to protein-based vaccines, DNA vaccination may be employed (e.g., Robinson & Torres (1997) *Seminars in Immunology* 9:271-283; Donnelly et al. (1997) *Annu Rev Immunol* 15:617-648).

Gene Delivery Vehicles

Gene therapy vehicles for delivery of constructs, including a coding sequence of a therapeutic of the invention, to be delivered to the mammal for expression in the mammal, can be administered either locally or systemically. These constructs can utilize viral or non-viral vector approaches in in vivo or ex vivo modality. Expression of such coding sequence can be induced using endogenous mammalian or heterologous promoters. Expression of the coding sequence in vivo can be either constitutive or regulated.

The invention includes gene delivery vehicles capable of expressing the contemplated nucleic acid sequences. The gene delivery vehicle is preferably a viral vector and, more preferably, a retroviral, adenoviral, adeno-associated viral (AAV), herpes viral, or alphavirus vector. The viral vector can also be an astrovirus, coronavirus, orthomyxovirus, papovavirus, paramyxovirus, parvovirus, picornavirus, poxvirus, or togavirus viral vector. See generally, Jolly (1994) *Cancer Gene Therapy* 1:51-64; Kimura (1994) *Human Gene Therapy* 5:845-852; Connelly (1995) *Human Gene Therapy* 6:185-193; and Kaplitt (1994) *Nature Genetics* 6:148-153.

Retroviral vectors are well known in the art, including B, C and D type retroviruses, xenotropic retroviruses (for example, NZB-X1, NZB-X2 and NZB9-1 (see O'Neill (1985) *J. Virol.* 53:160) polytropic retroviruses e.g., MCF and MCF-MLV (see Kelly (1983) *J. Virol.* 45:291), spumaviruses and lentiviruses. See RNA Tumor Viruses, Second Edition, Cold Spring Harbor Laboratory, 1985.

Portions of the retroviral gene therapy vector may be derived from different retroviruses. For example, retrovector LTRs may be derived from a Murine Sarcoma Virus, a tRNA binding site from a Rous Sarcoma Virus, a packaging signal from a Murine Leukemia Virus, and an origin of second strand synthesis from an Avian Leukosis Virus.

These recombinant retroviral vectors may be used to generate transduction competent retroviral vector particles by introducing them into appropriate packaging cell lines (see U.S. Pat. No. 5,591,624). Retrovirus vectors can be constructed for site-specific integration into host cell DNA by incorporation of a chimeric integrase enzyme into the retroviral particle (see WO96/37626). It is preferable that the recombinant viral vector is a replication defective recombinant virus.

Packaging cell lines suitable for use with the above-described retrovirus vectors are well known in the art, are readily prepared (see WO95/30763 and WO92/05266), and can be used to create producer cell lines (also termed vector cell lines or "VCLs") for the production of recombinant vector particles. Preferably, the packaging cell lines are made from human parent cells (e.g., HT1080 cells) or mink parent cell lines, which eliminates inactivation in human serum.

Preferred retroviruses for the construction of retroviral gene therapy vectors include Avian Leukosis Virus, Bovine Leukemia Virus, Murine Leukemia Virus, Mink-Cell Focus-Inducing Virus, Murine Sarcoma Virus, Reticuloendotheliosis Virus and Rous Sarcoma Virus. Particularly preferred Murine Leukemia Viruses include 4070A and 1504A (Hartley and Rowe (1976) *J Virol* 19:19-25), Abelson (ATCC No. VR-999), Friend (ATCC No. VR-245), Graffi, Gross (ATCC Nol VR-590), Kirsten, Harvey Sarcoma Virus and Rauscher (ATCC No. VR-998) and Moloney Murine Leukemia Virus (ATCC No. VR-190). Such retroviruses may be obtained from depositories or collections such as the American Type Culture Collection ("ATCC") or isolated from known sources using commonly available techniques.

Exemplary known retroviral gene therapy vectors employable in this invention include those described in patent applications GB2200651, EP0415731, EP0345242, EP0334301, WO89/02468; WO89/05349, WO89/09271, WO90/02806, WO90/07936, WO94/03622, WO93/25698, WO93/25234, WO93/11230, WO93/10218, WO91/02805, WO91/02825, WO95/07994, U.S. Pat. Nos. 5,219,740, 4,405,712, 4,861,719, 4,980,289, 4,777,127, 5,591,624. See also Vile (1993) *Cancer Res* 53:3860-3864; Vile (1993) *Cancer Res* 53:962-967; Ram (1993) *Cancer Res* 53 (1993) 83-88; Takamiya (1992) *J Neurosci Res* 33:493-503; Baba (1993) *J Neurosurg* 79:729-735; Mann (1983) *Cell* 33:153; Cane (1984) *Proc Natl Acad Sci* 81:6349; and Miller (1990) *Human Gene Therapy* 1.

Human adenoviral gene therapy vectors are also known in the art and employable in this invention. See, for example, Berkner (1988) *Biotechniques* 6:616 and Rosenfeld (1991) *Science* 252:431, and WO93/07283, WO93/06223, and WO93/07282. Exemplary known adenoviral gene therapy vectors employable in this invention include those described in the above referenced documents and in WO94/12649, WO93/03769, WO93/19191, WO94/28938, WO95/11984, WO95/00655, WO95/27071, WO95/29993, WO95/34671, WO96/05320, WO94/08026, WO94/11506, WO93/06223, WO94/24299, WO95/14102, WO95/24297, WO95/02697, WO94/28152, WO94/24299, WO95/09241, WO95/25807, WO95/05835, WO94/18922 and WO95/09654. Alternatively, administration of DNA linked to killed adenovirus as described in Curiel (1992) *Hum. Gene Ther.* 3:147-154 may be employed. The gene delivery vehicles of the invention also include adenovirus associated virus (AAV) vectors. Leading and preferred examples of such vectors for use in this invention are the AAV-2 based vectors disclosed in Srivastava, WO93/09239. Most preferred AAV vectors comprise the two AAV inverted terminal repeats in which the native D-sequences are modified by substitution of nucleotides, such that at least 5 native nucleotides and up to 18 native nucleotides, preferably at least 10 native nucleotides up to 18 native nucleotides, most preferably 10 native nucleotides are retained and the remaining nucleotides of the D-sequence are deleted or replaced with non-native nucleotides. The native D-sequences of the AAV inverted terminal repeats are sequences of 20 consecutive nucleotides in each AAV inverted terminal repeat (i.e., there is one sequence at each end) which are not involved in HP formation. The non-native replacement nucleotide may be any nucleotide other than the nucleotide found in the native D-sequence in the same position. Other employable exemplary AAV vectors are pWP-19, pWN-1, both of which are disclosed in Nahreini (1993) *Gene* 124:257-262. Another example of such an AAV vector is psub201 (see Samulski (1987) *J. Virol.* 61:3096). Another exemplary AAV vector is the Double-D ITR vector. Construction of the Double-D ITR vector is disclosed in U.S. Pat. No. 5,478,745. Still other vectors are those disclosed in Carter U.S. Pat. No. 4,797,368 and Muzyczka U.S. Pat. No. 5,139,941, Chartejee U.S. Pat. No. 5,474,935, and Kotin WO94/288157. Yet a further example of an AAV vector employable in this invention is SSV9AFABTKneo, which contains the AFP enhancer and albumin promoter and directs expression predominantly in the liver. Its structure and construction are disclosed in Su (1996) *Human Gene Therapy* 7:463-470. Additional AAV gene therapy vectors are described in U.S. Pat. Nos. 5,354,678, 5,173,414, 5,139,941, and 5,252,479.

The gene therapy vectors comprising sequences of the invention also include herpes vectors. Leading and preferred examples are herpes simplex virus vectors containing a sequence encoding a thymidine kinase polypeptide such as those disclosed in U.S. Pat. No. 5,288,641 and EP0176170 (Roizman). Additional exemplary herpes simplex virus vectors include HFEM/ICP6-LacZ disclosed in WO95/04139 (Wistar Institute), pHSVlac described in Geller (1988) *Science* 241:1667-1669 and in WO90/09441 and WO92/07945, HSV Us3::pgC-lacZ described in Fink (1992) *Human Gene Therapy* 3:11-19 and HSV 7134, 2 RH 105 and GAL4 described in EP 0453242 (Breakefield), and those deposited with the ATCC as accession numbers ATCC VR-977 and ATCC VR-260.

Also contemplated are alpha virus gene therapy vectors that can be employed in this invention. Preferred alpha virus vectors are Sindbis viruses vectors. Togaviruses, Semliki Forest virus (ATCC VR-67; ATCC VR-1247), Middleberg virus (ATCC VR-370), Ross River virus (ATCC VR-373; ATCC VR-1246), Venezuelan equine encephalitis virus (ATCC VR923; ATCC VR-1250; ATCC VR-1249; ATCC VR-532), and those described in U.S. Pat. Nos. 5,091,309, 5,217,879, and WO92/10578. More particularly, those alpha virus vectors described in U.S. Ser. No. 08/405,627, filed Mar. 15, 1995, WO94/21792, WO92/10578, WO95/07994, U.S. Pat. Nos. 5,091,309 and 5,217,879 are employable. Such alpha viruses may be obtained from depositories or collections such as the ATCC or isolated from known sources using commonly available techniques. Preferably, alphavirus vectors with reduced cytotoxicity are used (see U.S. Ser. No. 08/679,640).

DNA vector systems such as eukarytic layered expression systems are also useful for expressing the nucleic acids of the invention. See WO95/07994 for a detailed description of eukaryotic layered expression systems. Preferably, the eukaryotic layered expression systems of the invention are derived from alphavirus vectors and most preferably from Sindbis viral vectors.

Other viral vectors suitable for use in the present invention include those derived from poliovirus, for example ATCC VR-58 and those described in Evans, *Nature* 339 (1989) 385 and Sabin (1973) *J. Biol. Standardization* 1:115; rhinovirus, for example ATCC VR-1110 and those described in Arnold (1990) *J Cell Biochem* L401; pox viruses such as canary pox virus or vaccinia virus, for example ATCC VR-111 and ATCC VR-2010 and those described in Fisher-Hoch (1989) *Proc Natl Acad Sci* 86:317; Flexner (1989) *Ann NY Acad Sci* 569: 86, Flexner (1990) *Vaccine* 8:17; in U.S. Pat. Nos. 4,603,112 and 4,769,330 and WO89/01973; SV40 virus, for example ATCC VR-305 and those described in Mulligan (1979) *Nature* 277:108 and Madzak (1992) *J Gen Virol* 73:1533; influenza virus, for example ATCC VR-797 and recombinant influenza viruses made employing reverse genetics techniques as described in U.S. Pat. No. 5,166,057 and in Enami (1990) *Proc Natl Acad Sci* 87:3802-3805; Enami & Palese (1991) *J Virol* 65:2711-2713 and Luytjes (1989) *Cell* 59:110, (see also McMichael (1983) *NEJ Med* 309:13, and Yap (1978) *Nature* 273:238 and *Nature* (1979) 277:108); human immunodeficiency virus as described in EP-0386882 and in Buchschacher (1992) *J. Virol.* 66:2731; measles virus, for example ATCC VR-67 and VR-1247 and those described in EP-0440219; Aura virus, for example ATCC VR-368; Bebaru virus, for example ATCC VR-600 and ATCC VR-1240; Cabassou virus, for example ATCC VR-922; Chikungunya virus, for example ATCC VR-64 and ATCC VR-1241; Fort Morgan Virus, for example ATCC VR-924; Getah virus, for example ATCC VR-369 and ATCC VR-1243; Kyzylagach virus, for example ATCC VR-927; Mayaro virus, for example ATCC VR-66; Mucambo virus, for example ATCC VR-580 and ATCC VR-1244; Ndumu virus, for example ATCC VR-371; Pixuna virus, for example ATCC VR-372 and ATCC VR-1245; Tonate virus, for example ATCC VR-925; Triniti virus, for example ATCC VR-469; Una virus, for example ATCC VR-374; Whataroa virus, for example ATCC VR-926; Y-62-33 virus, for example ATCC VR-375; O'Nyong virus, Eastern encephalitis virus, for example ATCC VR-65 and ATCC VR-1242; Western encephalitis virus, for example ATCC VR-70, ATCC VR-1251, ATCC VR-622 and ATCC VR-1252; and coronavirus, for example ATCC VR-740 and those described in Hamre (1966) *Proc Soc Exp Biol Med* 121:190.

Delivery of the compositions of this invention into cells is not limited to the above mentioned viral vectors. Other delivery methods and media may be employed such as, for example, nucleic acid expression vectors, polycationic condensed DNA linked or unlinked to killed adenovirus alone, for example see U.S. Ser. No. 08/366,787, filed Dec. 30, 1994 and Curiel (1992) *Hum Gene Ther* 3:147-154 ligand linked DNA, for example see Wu (1989) *J Biol Chem* 264:16985-16987, eucaryotic cell delivery vehicles cells, for example see U.S. Ser. No. 08/240,030, filed May 9, 1994, and U.S. Ser. No. 08/404,796, deposition of photopolymerized hydrogel materials, hand-held gene transfer particle gun, as described in U.S. Pat. No. 5,149,655, ionizing radiation as described in U.S. Pat. No. 5,206,152 and in WO92/11033, nucleic charge neutralization or fusion with cell membranes. Additional approaches are described in Philip (1994) *Mol Cell Biol* 14:2411-2418 and in Woffendin (1994) *Proc Natl Acad Sci* 91:1581-1585.

Particle mediated gene transfer may be employed, for example see U.S. Ser. No. 60/023,867. Briefly, the sequence can be inserted into conventional vectors that contain conventional control sequences for high level expression, and then incubated with synthetic gene transfer molecules such as polymeric DNA-binding cations like polylysine, protamine, and albumin, linked to cell targeting ligands such as asialoorosomucoid, as described in Wu & Wu (1987) *J. Biol. Chem.* 262:4429-4432, insulin as described in Hucked (1990) *Biochem Pharmacol* 40:253-263, galactose as described in Plank (1992) *Bioconjugate Chem* 3:533-539, lactose or transferrin.

Naked DNA may also be employed to transform a host cell. Exemplary naked DNA introduction methods are described in WO 90/11092 and U.S. Pat. No. 5,580,859. Uptake efficiency may be improved using biodegradable latex beads. DNA coated latex beads are efficiently transported into cells after endocytosis initiation by the beads. The method may be improved further by treatment of the beads to increase hydrophobicity and thereby facilitate disruption of the endosome and release of the DNA into the cytoplasm.

Liposomes that can act as gene delivery vehicles are described in U.S. Pat. No. 5,422,120, WO95/13796, WO94/23697, WO91/14445 and EP-524,968. As described in U.S. Ser. No. 60/023,867, on non-viral delivery, the nucleic acid sequences encoding a polypeptide can be inserted into conventional vectors that contain conventional control sequences for high level expression, and then be incubated with synthetic gene transfer molecules such as polymeric DNA-binding cations like polylysine, protamine, and albumin, linked to cell targeting ligands such as asialoorosomucoid, insulin, galactose, lactose, or transferrin. Other delivery systems include the use of liposomes to encapsulate DNA comprising the gene under the control of a variety of tissue-specific or ubiquitously-active promoters. Further non-viral delivery suitable for use includes mechanical delivery systems such as the approach described in Woffendin et al (1994) *Proc. Natl. Acad. Sci. USA* 91(24):11581-11585. Moreover, the coding sequence and the product of expression of such can be delivered through deposition of photopolymerized hydrogel materials. Other conventional methods for gene delivery that can be used for delivery of the coding sequence include, for example, use of hand-held gene transfer particle gun, as described in U.S. Pat. No. 5,149,655; use of ionizing radiation for activating transferred gene, as described in U.S. Pat. No. 5,206,152 and WO92/11033.

Exemplary liposome and polycationic gene delivery vehicles are those described in U.S. Pat. Nos. 5,422,120 and 4,762,915; in WO 95/13796; WO94/23697; and WO91/14445; in EP-0524968; and in Stryer, Biochemistry, pages 236-240 (1975) W.H. Freeman, San Francisco; Szoka (1980) *Biochem Biophys Acta* 600:1; Bayer (1979) *Biochem Biophys Acta* 550:464; Rivnay (1987) *Meth Enzymol* 149:119; Wang (1987) *Proc Natl Acad Sci* 84:7851; Plant (1989) *Anal Biochem* 176:420.

A polynucleotide composition can comprises therapeutically effective amount of a gene therapy vehicle, as the term is defined above. For purposes of the present invention, an effective dose will be from about 0.01 mg/kg to 50 mg/kg or 0.05 mg/kg to about 10 mg/kg of the DNA constructs in the individual to which it is administered.

Delivery Methods

Once formulated, the polynucleotide compositions of the invention can be administered (1) directly to the subject; (2) delivered ex vivo, to cells derived from the subject; or (3) in vitro for expression of recombinant proteins. The subjects to be treated can be mammals or birds. Also, human subjects can be treated.

Direct delivery of the compositions will generally be accomplished by injection, either subcutaneously, intraperitoneally, intravenously or intramuscularly or delivered to the interstitial space of a tissue. The compositions can also be administered into a tumor or lesion. Other modes of administration include oral and pulmonary administration, suppositories, and transdermal applications, needles, and gene guns or hyposprays. Dosage treatment may be a single dose schedule or a multiple dose schedule.

Methods for the ex vivo delivery and reimplantation of transformed cells into a subject are known in the art and described in eg. WO93/14778. Examples of cells useful in ex vivo applications include, for example, stem cells, particularly hematopoetic, lymph cells, macrophages, dendritic cells, or tumor cells.

Generally, delivery of nucleic acids for both ex vivo and in vitro applications can be accomplished by the following procedures, for example, dextran-mediated transfection, calcium phosphate precipitation, polybrene mediated transfection, protoplast fusion, electroporation, encapsulation of the polynucleotide(s) in liposomes, and direct microinjection of the DNA into nuclei, all well known in the art.

Polynucleotide and Polypeptide Pharmaceutical Compositions

In addition to the pharmaceutically acceptable carriers and salts described above, the following additional agents can be used with polynucleotide and/or polypeptide compositions.

A. Polypeptides

One example are polypeptides which include, without limitation: asioloorosomucoid (ASOR); transferrin; asialoglycoproteins; antibodies; antibody fragments; ferritin; interleukins; interferons, granulocyte, macrophage colony stimulating factor (GM-CSF), granulocyte colony stimulating factor (G-CSF), macrophage colony stimulating factor (M-CSF), stem cell factor and erythropoietin. Viral antigens, such as envelope proteins, can also be used. Also, proteins from other invasive organisms, such as the 17 amino acid peptide from the circumsporozoite protein of *plasmodium falciparum* known as RII.

B. Hormones, Vitamins, Etc.

Other groups that can be included are, for example: hormones, steroids, androgens, estrogens, thyroid hormone, or vitamins, folic acid.

C. Polyalkylenes, Polysaccharides, Etc.

Also, polyalkylene glycol can be included with the desired polynucleotides or polypeptides. In a preferred embodiment, the polyalkylene glycol is polyethlylene glycol. In addition, mono-, di-, or polysaccarides can be included. In a preferred embodiment of this aspect, the polysaccharide is dextran or DEAE-dextran. Also, chitosan and poly(lactide-co-glycolide)

D. Lipids, and Liposomes

The desired polynucleotide or polypeptide can also be encapsulated in lipids or packaged in liposomes prior to delivery to the subject or to cells derived therefrom.

Lipid encapsulation is generally accomplished using liposomes which are able to stably bind or entrap and retain nucleic acid. The ratio of condensed polynucleotide or polypeptide to lipid preparation can vary but will generally be around 1:1 (mg DNA:micromoles lipid), or more of lipid. For a review of the use of liposomes as carriers for delivery of nucleic acids, see, Hug and Sleight (1991) *Biochim. Biophys. Acta.* 1097:1-17; Straubinger (1983) *Meth. Enzymol.* 101: 512-527.

Liposomal preparations for use in the present invention include cationic (positively charged), anionic (negatively charged) and neutral preparations. Cationic liposomes have been shown to mediate intracellular delivery of plasmid DNA (Felgner (1987) *Proc. Natl. Acad. Sci. USA* 84:7413-7416); mRNA (Malone (1989) *Proc. Natl. Acad. Sci. USA* 86:6077-6081); and purified transcription factors (Debs (1990) *J. Biol. Chem.* 265:10189-10192), in functional form.

Cationic liposomes are readily available. For example, N[1-2,3-dioleyloxy)propyl]-N,N,N-triethylammonium (DOTMA) liposomes are available under the trademark Lipofectin, from GIBCO BRL, Grand Island, N.Y. (See, also, Felgner supra). Other commercially available liposomes include transfectace (DDAB/DOPE) and DOTAP/DOPE (Boerhinger). Other cationic liposomes can be prepared from readily available materials using techniques well known in the art. See, eg. Szoka (1978) *Proc. Natl. Acad. Sci. USA* 75:4194-4198; WO90/11092 for a description of the synthesis of DOTAP (1,2-bis(oleoyloxy)-3-(trimethylammonio) propane) liposomes.

Similarly, anionic and neutral liposomes are readily available, such as from Avanti Polar Lipids (Birmingham, Ala.), or can be easily prepared using readily available materials. Such materials include phosphatidyl choline, cholesterol, phosphatidyl ethanolamine, dioleoylphosphatidyl choline (DOPC), dioleoylphosphatidyl glycerol (DOPG), dioleoylphoshatidyl ethanolamine (DOPE), among others. These materials can also be mixed with the DOTMA and DOTAP starting materials in appropriate ratios. Methods for making liposomes using these materials are well known in the art.

The liposomes can comprise multilammelar vesicles (MLVs), small unilamellar vesicles (SUVs), or large unilamellar vesicles (LUVs). The various liposome-nucleic acid complexes are prepared using methods known in the art. See eg. Straubinger (1983) *Meth. Immunol.* 101:512-527; Szoka (1978) *Proc. Natl. Acad. Sci. USA* 75:4194-4198; Papahadjopoulos (1975) *Biochim. Biophys. Acta* 394:483; Wilson (1979) *Cell* 17:77); Deamer & Bangham (1976) *Biochim. Biophys. Acta* 443:629; Ostro (1977) *Biochem. Biophys. Res. Commun.* 76:836; Fraley (1979) *Proc. Natl. Acad. Sci. USA* 76:3348); Enoch & Strittmatter (1979) *Proc. Natl. Acad. Sci. USA* 76:145; Fraley (1980) *J. Biol. Chem.* (1980) 255:10431; Szoka & Papahadjopoulos (1978) *Proc. Natl. Acad. Sci. USA* 75:145; and Schaefer-Ridder (1982) *Science* 215:166.

E. Lipoproteins

In addition, lipoproteins can be included with the polynucleotide or polypeptide to be delivered. Examples of lipoproteins to be utilized include: chylomicrons, HDL, IDL, LDL, and VLDL. Mutants, fragments, or fusions of these proteins can also be used. Also, modifications of naturally occurring lipoproteins can be used, such as acetylated LDL. These lipoproteins can target the delivery of polynucleotides to cells expressing lipoprotein receptors. Preferably, if lipoproteins are including with the polynucleotide to be delivered, no other targeting ligand is included in the composition.

Naturally occurring lipoproteins comprise a lipid and a protein portion. The protein portion are known as apoproteins. At the present, apoproteins A, B, C, D, and E have been isolated and identified. At least two of these contain several proteins, designated by Roman numerals, AI, AII, AIV; CI, CII, CIII.

A lipoprotein can comprise more than one apoprotein. For example, naturally occurring chylomicrons comprises of A, B, C, and E, over time these lipoproteins lose A and acquire C and E apoproteins. VLDL comprises A, B, C, and E apoproteins, LDL comprises apoprotein B; and HDL comprises apoproteins A, C, and E.

The amino acid of these apoproteins are known and are described in, for example, Breslow (1985) *Annu Rev. Biochem* 54:699; Law (1986) *Adv. Exp Med. Biol.* 151:162; Chen (1986) *J Biol Chem* 261:12918; Kane (1980) *Proc Natl Acad Sci USA* 77:2465; and Utermann (1984) *Hum Genet* 65:232.

Lipoproteins contain a variety of lipids including, triglycerides, cholesterol (free and esters), and phopholipids. The composition of the lipids varies in naturally occurring lipoproteins. For example, chylomicrons comprise mainly triglycerides. A more detailed description of the lipid content of naturally occurring lipoproteins can be found, for example, in *Meth. Enzymol.* 128 (1986). The composition of the lipids are chosen to aid in conformation of the apoprotein for receptor binding activity. The composition of lipids can also be chosen to facilitate hydrophobic interaction and association with the polynucleotide binding molecule.

Naturally occurring lipoproteins can be isolated from serum by ultracentrifugation, for instance. Such methods are described in *Meth. Enzymol.* (supra); Pitas (1980) *J. Biochem.* 255:5454-5460 and Mahey (1979) *J Clin. Invest* 64:743-750.

Lipoproteins can also be produced by in vitro or recombinant methods by expression of the apoprotein genes in a desired host cell. See, for example, Atkinson (1986) *Annu Rev Biophys Chem* 15:403 and Radding (1958) *Biochim Biophys Acta* 30: 443.

Lipoproteins can also be purchased from commercial suppliers, such as Biomedical Technologies, Inc., Stoughton, Mass., USA.

Further description of lipoproteins can be found in Zuckermann et al., PCT. Appln. No. US97/14465.

F. Polycationic Agents

Polycationic agents can be included, with or without lipoprotein, in a composition with the desired polynucleotide or polypeptide to be delivered.

Polycationic agents, typically, exhibit a net positive charge at physiological relevant pH and are capable of neutralizing the electrical charge of nucleic acids to facilitate delivery to a desired location. These agents have both in vitro, ex vivo, and in vivo applications. Polycationic agents can be used to deliver nucleic acids to a living subject either intramuscularly, subcutaneously, etc.

The following are examples of useful polypeptides as polycationic agents: polylysine, polyarginine, polyornithine, and protamine. Other examples include histones, protamines, human serum albumin, DNA binding proteins, non-histone chromosomal proteins, coat proteins from DNA viruses, such as (X174, transcriptional factors also contain domains that bind DNA and therefore may be useful as nucleic aid condensing agents. Briefly, transcriptional factors such as C/CEBP, c-jun, c-fos, AP-1, AP-2, AP-3, CPF, Prot-1, Sp-1, Oct-1, Oct-2, CREP, and TFIID contain basic domains that bind DNA sequences.

Organic polycationic agents include: spermine, spermidine, and purtrescine.

The dimensions and of the physical properties of a polycationic agent can be extrapolated from the list above, to construct other polypeptide polycationic agents or to produce synthetic polycationic agents.

Synthetic Polycationic Agents

Synthetic polycationic agents which are useful include, for example, DEAE-dextran, polybrene. LIPOFECTIN™, and LIPOFECTAMINE™ are monomers that form polycationic complexes when combined with polynucleotides or polypeptides.

Immunodiagnostic Assays

Neisserial antigens of the invention can be used in immunoassays to detect antibody levels (or, conversely, anti-Neisserial antibodies can be used to detect antigen levels). Immunoassays based on well defined, recombinant antigens can be developed to replace invasive diagnostics methods. Antibodies to Neisserial proteins within biological samples, including for example, blood or serum samples, can be detected. Design of the immunoassays is subject to a great deal of variation, and a variety of these are known in the art. Protocols for the immunoassay may be based, for example, upon competition, or direct reaction, or sandwich type assays. Protocols may also, for example, use solid supports, or may be by immunoprecipitation. Most assays involve the use of labeled antibody or polypeptide; the labels may be, for example, fluorescent, chemiluminescent, radioactive, or dye molecules. Assays which amplify the signals from the probe are also known; examples of which are assays which utilize biotin and avidin, and enzyme-labeled and mediated immunoassays, such as ELISA assays.

Kits suitable for immunodiagnosis and containing the appropriate labeled reagents are constructed by packaging the appropriate materials, including the compositions of the invention, in suitable containers, along with the remaining reagents and materials (for example, suitable buffers, salt solutions, etc.) required for the conduct of the assay, as well as suitable set of assay instructions.

Nucleic Acid Hybridisation

"Hybridization" refers to the association of two nucleic acid sequences to one another by hydrogen bonding. Typically, one sequence will be fixed to a solid support and the other will be free in solution. Then, the two sequences will be placed in contact with one another under conditions that favor hydrogen bonding. Factors that affect this bonding include: the type and volume of solvent; reaction temperature; time of hybridization; agitation; agents to block the non-specific attachment of the liquid phase sequence to the solid support (Denhardt's reagent or BLOTTO); concentration of the sequences; use of compounds to increase the rate of association of sequences (dextran sulfate or polyethylene glycol); and the stringency of the washing conditions following hybridization. See Sambrook et al. [supra] Volume 2, chapter 9, pages 9.47 to 9.57.

"Stringency" refers to conditions in a hybridization reaction that favor association of very similar sequences over sequences that differ. For example, the combination of temperature and salt concentration should be chosen that is approximately 120 to 200° C. below the calculated Tm of the hybrid under study. The temperature and salt conditions can often be determined empirically in preliminary experiments in which samples of genomic DNA immobilized on filters are hybridized to the sequence of interest and then washed under conditions of different stringencies. See Sambrook et al. at page 9.50.

Variables to consider when performing, for example, a Southern blot are (1) the complexity of the DNA being blotted and (2) the homology between the probe and the sequences being detected. The total amount of the fragment(s) to be studied can vary a magnitude of 10, from 0.1 to 1 μg for a plasmid or phage digest to $10^{-9}$ to $10^{-8}$ g for a single copy gene in a highly complex eukaryotic genome. For lower complexity polynucleotides, substantially shorter blotting, hybridization, and exposure times, a smaller amount of starting polynucleotides, and lower specific activity of probes can be used. For example, a single-copy yeast gene can be detected with an exposure time of only 1 hour starting with 1 μg of yeast DNA, blotting for two hours, and hybridizing for 4-8 hours with a probe of $10^8$ cpm/μg. For a single-copy mammalian gene a conservative approach would start with 10 μg of DNA, blot overnight, and hybridize overnight in the presence of 10% dextran sulfate using a probe of greater than $10^8$ cpm/μg, resulting in an exposure time of ~24 hours.

Several factors can affect the melting temperature (Tm) of a DNA-DNA hybrid between the probe and the fragment of interest, and consequently, the appropriate conditions for hybridization and washing. In many cases the probe is not 100% homologous to the fragment. Other commonly encountered variables include the length and total G+C content of the hybridizing sequences and the ionic strength and formamide content of the hybridization buffer. The effects of all of these factors can be approximated by a single equation:

$$Tm=81+16.6(\log_{10}Ci)+0.4[\%\ (G+C)]-0.6(\%\ \text{formamide})-600/n-1.5(\%\ \text{mismatch}).$$

where Ci is the salt concentration (monovalent ions) and n is the length of the hybrid in base pairs (slightly modified from Meinkoth & Wahl (1984) *Anal. Biochem.* 138: 267-284).

In designing a hybridization experiment, some factors affecting nucleic acid hybridization can be conveniently altered. The temperature of the hybridization and washes and the salt concentration during the washes are the simplest to adjust. As the temperature of the hybridization increases (ie. stringency), it becomes less likely for hybridization to occur between strands that are nonhomologous, and as a result, background decreases. If the radiolabeled probe is not completely homologous with the immobilized fragment (as is frequently the case in gene family and interspecies hybridization experiments), the hybridization temperature must be reduced, and background will increase. The temperature of the washes affects the intensity of the hybridizing band and the degree of background in a similar manner. The stringency of the washes is also increased with decreasing salt concentrations.

In general, convenient hybridization temperatures in the presence of 50% formamide are 42° C. for a probe with is 95% to 100% homologous to the target fragment, 37° C. for 90% to 95% homology, and 32° C. for 85% to 90% homology. For lower homologies, formamide content should be lowered and temperature adjusted accordingly, using the equation above. If the homology between the probe and the target fragment are not known, the simplest approach is to start with both hybridization and wash conditions which are nonstringent. If non-specific bands or high background are observed after autoradiography, the filter can be washed at high stringency and reexposed. If the time required for exposure makes this approach impractical, several hybridization and/or washing stringencies should be tested in parallel.

Nucleic Acid Probe Assays

Methods such as PCR, branched DNA probe assays, or blotting techniques utilizing nucleic acid probes according to the invention can determine the presence of cDNA or mRNA. A probe is said to "hybridize" with a sequence of the invention if it can form a duplex or double stranded complex, which is stable enough to be detected.

The nucleic acid probes will hybridize to the Neisserial nucleotide sequences of the invention (including both sense and antisense strands). Though many different nucleotide sequences will encode the amino acid sequence, the native Neisserial sequence is preferred because it is the actual sequence present in cells. mRNA represents a coding sequence and so a probe should be complementary to the coding sequence; single-stranded cDNA is complementary to mRNA, and so a cDNA probe should be complementary to the non-coding sequence.

The probe sequence need not be identical to the Neisserial sequence (or its complement)—some variation in the sequence and length can lead to increased assay sensitivity if the nucleic acid probe can form a duplex with target nucleotides, which can be detected. Also, the nucleic acid probe can include additional nucleotides to stabilize the formed duplex. Additional Neisserial sequence may also be helpful as a label to detect the formed duplex. For example, a non-complementary nucleotide sequence may be attached to the 5' end of the probe, with the remainder of the probe sequence being complementary to a Neisserial sequence. Alternatively, non-complementary bases or longer sequences can be interspersed into the probe, provided that the probe sequence has sufficient complementarity with the a Neisserial sequence in order to hybridize therewith and thereby form a duplex which can be detected.

The exact length and sequence of the probe will depend on the hybridization conditions, such as temperature, salt condition and the like. For example, for diagnostic applications, depending on the complexity of the analyte sequence, the nucleic acid probe typically contains at least 10-20 nucleotides, preferably 15-25, and more preferably at least 30 nucleotides, although it may be shorter than this. Short primers generally require cooler temperatures to form sufficiently stable hybrid complexes with the template.

Probes may be produced by synthetic procedures, such as the triester method of Matteucci et al. [*J. Am. Chem. Soc.* (1981) 103:3185], or according to Urdea et al. [*Proc. Natl. Acad. Sci. USA* (1983) 80: 7461], or using commercially available automated oligonucleotide synthesizers.

The chemical nature of the probe can be selected according to preference. For certain applications, DNA or RNA are appropriate. For other applications, modifications may be incorporated eg. backbone modifications, such as phosphorothioates or methylphosphonates, can be used to increase in vivo half-life, alter RNA affinity, increase nuclease resistance etc. [eg. see Agrawal & Iyer (1995) *Curr Opin Biotechnol* 6:12-19; Agrawal (1996) *TIBTECH* 14:376-387]; analogues such as peptide nucleic acids may also be used [eg. see Corey (1997) *TIBTECH* 15:224-229; Buchardt et al. (1993) *TIBTECH* 11:384-386].

One example of a nucleotide hybridization assay is described by Urdea et al. in international patent application WO92/02526 [see also U.S. Pat. No. 5,124,246].

Alternatively, the polymerase chain reaction (PCR) is another well-known means for detecting small amounts of target nucleic acids. The assay is described in: Mullis et al. [*Meth. Enzymol.* (1987) 155: 335-350]; U.S. Pat. Nos. 4,683,195; and 4,683,202. Two "primer" nucleotides hybridize with the target nucleic acids and are used to prime the reaction. The primers can comprise sequence that does not hybridize to the sequence of the amplification target (or its complement) to aid with duplex stability or, for example, to incorporate a convenient restriction site. Typically, such sequence will flank the desired Neisserial sequence.

A thermostable polymerase creates copies of target nucleic acids from the primers using the original target nucleic acids as a template. After a threshold amount of target nucleic acids are generated by the polymerase, they can be detected by more traditional methods, such as Southern blots. When using the Southern blot method, the labelled probe will hybridize to the Neisserial sequence (or its complement).

Also, mRNA or cDNA can be detected by traditional blotting techniques described in Sambrook et al [supra]. mRNA, or cDNA generated from mRNA using a polymerase enzyme, can be purified and separated using gel electrophoresis. The nucleic acids on the gel are then blotted onto a solid support, such as nitrocellulose. The solid support is exposed to a labelled probe and then washed to remove any unhybridized probe. Next, the duplexes containing the labeled probe are detected. Typically, the probe is labelled with a radioactive moiety.

EXAMPLES

The examples describe nucleic acid sequences which have been identified in *N. meningitidis*, and *N. gonorrhoeae* along with their respective and putative translation products. Not all of the nucleic acid sequences are complete ie. they encode less than the full-length wild-type protein.

The examples are generally in the following format:
a nucleotide sequence which has been identified in *N. meningitidis*
the putative translation product of said *N. meningitidis* sequence
a computer analysis of said translation product based on database comparisons
a corresponding nucleotide sequence identified from *N. gonorrhoeae*
the putative translation product of said *N. gonorrhoeae* sequence
a comparison of the percentage of identity between the translation product of the *N. meningitidis* sequence and the *N. gonorrhoeae* sequence
a description of the characteristics of the protein which indicates that it might be suitably antigenic or immunogenic.

Sequence comparisons were performed at NCBI (ncbi.nlm.nih.gov) using the algorithms BLAST, BLAST2, BLASTn, BLASTp, tBLASTn, BLASTx, & tBLASTx [eg. see also Altschul et al. (1997) Gapped BLAST and PSI-BLAST: a new generation of protein database search programs. *Nucleic Acids Research* 25:2289-3402]. Searches were performed against the following databases: non-redundant GenBank+EMBL+DDBJ+PDB sequences and non-redundant GenBank CDS translations+PDB+SwissProt+SP-update+PIR sequences.

Dots within nucleotide sequences represent nucleotides which have been arbitrarily introduced in order to maintain a reading frame. In the same way, double-underlined nucleotides were removed. Lower case letters represent ambiguities which arose during alignment of independent sequencing reactions (some of the nucleotide sequences in the examples are derived from combining the results of two or more experiments).

Nucleotide sequences were scanned in all six reading frames to predict the presence of hydrophobic domains using an algorithm based on the statistical studies of Esposti et al. [Critical evaluation of the hydropathy of membrane proteins (1990) *Eur J Biochem* 190:207-219]. These domains represent potential transmembrane regions or hydrophobic leader sequences.

Open reading frames were predicted from fragmented nucleotide sequences using the program ORFFINDER (NCBI).

Underlined amino acid sequences indicate possible transmembrane domains or leader sequences in the ORFs, as predicted by the PSORT algorithm (psort.nibb.ac.jp). Functional domains were also predicted using the MOTIFS program (GCG Wisconsin & PROSITE).

For each of the following examples: based on the presence of a putative leader sequence and/or several putative transmembrane domains (single-underlined) in the gonococcal protein, it is predicted that the proteins from *N. meningitidis* and *N. gonorrhoeae*, and their respective epitopes, could be useful antigens or immunogenic compositions for vaccines or diagnostics.

The standard techniques and procedures which may be employed in order to perform the invention (e.g. to utilize the disclosed sequences for vaccination or diagnostic purposes) were summarized above. This summary is not a limitation on the invention but, rather, gives examples that may be used, but are not required.

In particular, the following methods were used to express, purify and biochemically characterize the proteins of the invention.

Chromosomal DNA Preparation

*N. meningitidis* strain 2996 was grown to exponential phase in 100 ml of GC medium, harvested by centrifugation, and resuspended in 5 ml buffer (20% Sucrose, 50 mM Tris-HCl, 50 mM EDTA, pH 8.0). After 10 minutes incubation on ice, the bacteria were lysed by adding 10 ml lysis solution (50 mM NaCl, 1% Na-SARKOSYL™, 50 µg/ml Proteinase K), and the suspension was incubated at 37° C. for 2 hours. Two phenol extractions (equilibrated to pH 8) and one $CHCl_3$/isoamylalcohol (24:1) extraction were performed. DNA was precipitated by addition of 0.3M sodium acetate and 2 volumes ethanol, and was collected by centrifugation. The pellet was washed once with 70% ethanol and redissolved in 4.0 ml TE buffer (10 mM Tris-HCl, 1 mM EDTA, pH 8). The DNA concentration was measured by reading the OD at 260 nm.

Oligonucleotide Design

Synthetic oligonucleotide primers were designed on the basis of the coding sequence of each ORF, using (a) the meningococcus B sequence when available, or (b) the gonococcus/meningococcus A sequence, adapted to the codon preference usage of meningococcus as necessary. Any predicted signal peptides were omitted, by designing the 5' primers to sequence immediately downstream from the predicted leader sequence.

For most ORFs, the 5' primers included two restriction enzyme recognition sites (BamHI-NdeI, BamHI-NheI, EcoRI-NdeI or EcoRI-NheI), depending on the restriction pattern of the gene of interest. The 3' primers included a XhoI or a HindIII restriction site (table 1). This procedure was established in order to direct the cloning of each amplification product (corresponding to each ORF) into two different expression systems: pGEX-KG (using either BamHI-XhoI, BamHI-HindIII, EcoRI-XhoI, or EcoRI-HindIII), and pET21b+ (using either NdeI-XhoI, NheI-XhoI, NdeI-HindIII, or NheI-HindIII).

```
5'-end primer tail:
CGCGGATCCCATATG        (BamHI-NdeI)

CGCGGATCCGCTAGC        (BamHI-NheI)

CCGGAATTCTAGATATC      (EcoRI-NdeI)

CCGGAATTCTAGCTAGC      (EcoRI-NheI)

3'-end primer tail:
CCCGCTCGAG             (XhoI)

CCCGCTCGAG             (HindIII)
```

For cloning ORFs into the pGEX-His Vector, the 5' and 3' primers contained only one restriction enzyme site (EcoRI, KpnI or SalI for the 5' primers and PstI, XbaI, SphI or SalI for the 3' primers). Again restriction sites were chosen according to the particular restriction pattern of the gene (table 1).

```
5'-end primer tail:
(AAA) AAAGAATTC        (EcoRI)

(AAA) AAAGGATCC        (KpnI)

3'-end primer tail:
(AAA) AAACTGCAG        (PstI)

(AAA) AAATCTAGA        (XbaI)

5' or 3'-end primer tail:
AAAGCATGC              (SphI)

AAAAAAGAATCC           (PstI)
```

As well as containing the restriction enzyme recognition sequences, the primers included nucleotides which hybridized to the sequence to be amplified. The melting temperature depended on the number and type of hybridizing nucleotides in the whole primer, and was determined for each primer using the formulae:

$$Tm = 4(G+C) + 2(A+T) \text{ (tail excluded)}$$

$$T_m = 64.9 + 0.41(\% \ GC) - 600/N \text{ (whole primer)}$$

The melting temperature of the selected oligonucleotides were usually 65-70° C. for the whole oligo and 50-55° C. for the hybridising region alone.

Table 1 shows the forward and reverse primers used for each amplification. In certain cases, the sequences of the primer does not match exactly the sequence of the predicted ORF. This is because when initial amplifications were performed, the complete 5' and/or 3' sequences for some meningococcal B ORFs were not be known. However, the corresponding sequences had been identified in Gonococcus or in Meningococcus A. Hence, when the Meningococcus B sequence was incomplete or uncertain, Gonococcus or in Meningococcus A sequences were used as the basis for the primer design. These sequences were altered to take account of codon preference. It can be appreciated that, once the complete sequence is identified, this approach will no longer be necessary.

Oligonucleotides were synthesized using a Perkin Elmer 394 DNA/RNA SYNTHESIZER™, eluted from the columns in 2.0 ml NH$_4$OH, and deprotected by 5 hours incubation at 56° C. The oligos were precipitated by addition of 0.3M Na-Acetate and 2 volumes ethanol. The samples were centrifuged and the pellets resuspended in either 100 µl or 1.0 ml of water. The OD$_{260}$ was determined using a Perkin Elmer LAMBDA BIO™ spectophotometer and the concentration adjusted to 2-10 pmol/µl.

Amplification

The standard PCR protocol was as follows: 50-200 ng of genomic DNA was used as a template in the presence of 20-40 µM of each oligonucleotide primer, 400-800 µM dNTPs solution, 1×PCR buffer (including 1.5 mM MgCl$_2$), 2.5 units TaqI DNA polymerase (using Perkin-Elmer AMPLITAQ™, GIBCO Platinum, Pwo DNA polymerase, or Tahara Shuzo Taq polymerase). In some cases, PCR was optimised by the addition of 100 of DMSO or 500 of 2M Betaine.

After a hot start (adding the polymerase during a preliminary 3 minute incubation of the whole mix at 95° C.), each sample underwent a two-step amplification. The first 5 cycles were performed using the hybridization temperature that excluded the restriction enzyme tail of the primer (see above). This was followed by 30 cycles using the hybridization temperature calculated for the whole length oligos. The cycles were followed by a final 10 minute extension step at 72° C. The standard cycles were as follows:

|  | Denaturation | Hybridisation | Elongation |
| --- | --- | --- | --- |
| First 5 cycles | 30 seconds 95° C. | 30 seconds 50-55° C. | 30-60 seconds 72° C. |
| Last 30 cycles | 30 seconds 95° C. | 30 seconds 65-70° C. | 30-60 seconds 72° C. |

The elongation time varied according to the length of the ORF to be amplified. Amplifications were performed using either a 9600 or a 2400 Perkin Elmer GeneAmp PCR System. To check the results, 1/10 of the amplification volume was loaded onto a 1-1.5% (w/v) agarose gel and the size of each amplified fragment compared with a DNA molecular weight marker.

The amplified DNA was either loaded directly on a 1% agarose gel or first precipitated with ethanol and resuspended in a volume suitable to be loaded on a 1.0% agarose gel. The DNA fragment corresponding to the band of the correct size was purified using the Qiagen Gel Extraction Kit, following the manufacturer's protocol. DNA fragments were eluted in a volume of 30 µl or 50 µl of either H2O or 10 mM Tris, pH 8.5.

Digestion of PCR Fragments

The purified DNA corresponding to the amplified fragment was double-digested with the appropriate restriction enzymes for; cloning into pET-21b+ and expressing the protein as a C-terminus His-tagged fusion, for cloning into pGEX-KG and expressing the protein as a N-terminus GST-fusion, and for cloning into pGEX-His and expressing the protein as a N-terminus GST-his tagged fusion.

Each purified DNA fragment was incubated at 37° C. for 3 hours to overnight with 20 units of appropriate restriction enzyme (New England Biolabs) in a either 30 or 40 μl in the presence of suitable digestion buffer. Digested products were purified using the QIAquick PCR purification kit (following the manufacturer's instructions) and eluted in a final volume of 30 or 50 μl of either H2O or 10 mM Tris, pH 8.5. The DNA concentration was determined by quantitative agarose gel electrophoresis (1.0% gel) in the presence of a titrated molecular weight marker.

Digestion of the Cloning Vectors (pET22B, pGEX-KG, pTRC-His A, pET21b+, pGEX-KG, and pGEX-His)

The vector pGEX-His is a modified pGEX-2T vector carrying a region encoding six histidine residues upstream of the thrombin cleavage site and containing the multiple cloning site of the vector pTRC99 (Pharmacia). 10 μg plasmid was double-digested with 50 units of each restriction enzyme in 200 μl reaction volume in the presence of appropriate buffer by overnight incubation at 37° C. After loading the whole digestion on a 1% agarose gel, the band corresponding to the digested vector was purified from the gel using the Qiagen QIAquick Gel Extraction Kit and the DNA was eluted in 50 μl of 10 mM Tris-HCl, pH 8.5. The DNA concentration was evaluated by measuring $OD_{260}$ of the sample, and adjusted to 50 μl. 1 μl of plasmid was used for each cloning procedure.

10 μg plasmid was double-digested with 50 units of each restriction enzyme in 200 reaction volume in the presence of appropriate buffer by overnight incubation at 37° C. The digest was loaded onto a 1% agarose gel and the band corresponding to the digested vector purified using the Qiagen QIAquick Gel Extraction Kit. DNA was eluted in 50 μl of 10 mM Tris-HCl, pH 8.5. The DNA concentration was evaluated by measuring $OD_{260}$ and the concentration adjusted to 50 μg/μl. 1 μl of plasmid was used for each cloning procedure.

Cloning

For some ORFs, the fragments corresponding to each ORF, previously digested and purified, were ligated in both pET22b and pGEX-KG. In a final volume of 20 μl, a molar ratio of 3:1 fragment/vector was ligated using 0.5 μl of NEB T4 DNA ligase (400 units/μl), in the presence of the buffer supplied by the manufacturer. The reaction was incubated at room temperature for 3 hours. In some experiments, ligation was performed using the Boheringer "Rapid Ligation Kit", following the manufacturer's instructions.

In order to introduce the recombinant plasmid in a suitable strain, 100 μl E. coli DH5 competent cells were incubated with the ligase reaction solution for 40 minutes on ice, then at 37° C. for 3 minutes, then, after adding 800 μl LB broth, again at 37° C. for 20 minutes. The cells were then centrifuged at maximum speed in an Eppendorf microfuge and resuspended in approximately 200 μl of the supernatant. The suspension was then plated on LB ampicillin (100 mg/ml).

The screening of the recombinant clones was performed by growing 5 randomly-chosen colonies overnight at 37° C. in either 2 ml (pGEX or pTC clones) or 5 ml (pET clones) LB broth+100 μg/ml ampicillin. The cells were then pelletted and the DNA extracted using the Qiagen QIAprep Spin Miniprep Kit, following the manufacturer's instructions, to a final volume of 30 μl. 5 μl of each individual miniprep (approximately 1 g) were digested with either NdeI/XhoI or BamHI/XhoI and the whole digestion loaded onto a 1-1.5% agarose gel (depending on the expected insert size), in parallel with the molecular weight marker (1 Kb DNA Ladder, GIBCO). The screening of the positive clones was made on the base of the correct insert size.

For other ORFs, the fragments corresponding to each ORF, previously digested and purified, were ligated in both pET21b+ and pGEX-KG. A molar ratio of 3:1 fragment/vector was used in a final volume of 20 μl, that included 0.5 μl of T4 DNA ligase (400 units/μl, NEB) and ligation buffer supplied by the manufacturer. The reaction was performed at room temperature for 3 hours. In some experiments, ligation was performed using the Boheringer "Rapid Ligation Kit" and the manufacturer's protocol.

Recombinant plasmid was transformed into 100 μl of competent E. coli DH5 or HB101 by incubating the ligase reaction solution and bacteria for 40 minutes on ice then at 37° C. for 3 minutes. This was followed by addition of 800 μl LB broth and incubation at 37° C. for 20 minutes. The cells were then centrifuged at maximum speed in an Eppendorf microfuge, resuspended in approximately 200 μl of the supernatant, and plated on LB ampicillin (100 mg/ml) agar.

Screening for recombinant clones was performed by growing 5 randomly selected colonies overnight at 37° C. in either 2.0 ml (pGEX-KG clones) or 5.0 ml (pET clones) LB broth+100 μg/ml ampicillin. Cells were pelleted and plasmid DNA extracted using the Qiagen QIAprep Spin Miniprep Kit, following the manufacturer's instructions. Approximately 1 μg of each individual miniprep was digested with the appropriate restriction enzymes and the digest loaded onto a 1-1.5% agarose gel (depending on the expected insert size), in parallel with the molecular weight marker (1 kb DNA Ladder, GIBCO). Positive clones were selected on the basis of the size of the insert.

ORFs were cloned in PGEX-His, by doubly-digesting the PC product and ligating into similarly digested vector. After cloning, recombinant plasmids were transformed into the E. coli host W3110. Individual clones were grown overnight at 37° C. in LB broth with 50 μg/ml ampicillin.

Certain ORFs may be cloned into the pGEX-HIS vector using EcoRI-PstI cloning sites, or EcoRI-SalI, or SalI-PstI. After cloning, the recombinant plasmids may be introduced in the E. coli host W3110.

Expression

Each ORF cloned into the expression vector may then be transformed into the strain suitable for expression of the recombinant protein product. 1 μl of each construct was used to transform 30 μl of E. coli BL21 (pGEX vector), E. coli TOP 10 (pTRC vector) or E. coli BL21-DE3 (pET vector), as described above. In the case of the pGEX-His vector, the same E. coli strain (W3110) was used for initial cloning and expression. Single recombinant colonies were inoculated into 2 ml LB+Amp (100 μg/ml), incubated at 37° C. overnight, then diluted 1:30 in 20 ml of LB+Amp (100 μg/ml) in 100 ml flasks, making sure that the $OD_{600}$ ranged between 0.1 and 0.15. The flasks were incubated at 30° C. into gyratory water bath shakers until OD indicated exponential growth suitable for induction of expression (0.4-0.8 OD for pET and pTRC vectors; 0.8-10D for pGEX and pGEX-His vectors). For the pET, pTRC and pGEX-His vectors, the protein expression was induced by addiction of 1 mM IPTG, whereas in the case of pGEX system the final concentration of IPTG was 0.2 mM. After 3 hours incubation at 30° C., the final concentration of the sample was checked by OD. In order to check expression, 1 ml of each sample was removed, centrifuged in a microfuge, the pellet resuspended in PBS, and analysed by 12% SDS-PAGE with Coomassie Blue staining. The whole sample was centrifuged at 6000 g and the pellet resuspended in PBS for further use.

GST-Fusion Proteins Large-Scale Purification.

For some ORFs, a single colony was grown overnight at 37° C. on LB+Amp agar plate. The bacteria were inoculated into 20 ml of LB+Amp liquid culture in a water bath shaker and grown overnight. Bacteria were diluted 1:30 into 600 ml of fresh medium and allowed to grow at the optimal temperature (20-37° C.) to $OD_{550}$ 0.8-1. Protein expression was induced with 0.2 mM IPTG followed by three hours incubation. The culture was centrifuged at 8000 rpm at 4° C. The supernatant was discarded and the bacterial pellet was resuspended in 7.5 ml cold PBS. The cells were disrupted by sonication on ice for 30 sec at 40 W using a Branson sonifier B-15, frozen and thawed two times and centrifuged again. The supernatant was collected and mixed with 150 µl GLUTATHIONE-SEPHAROSE 4B™ resin (Pharmacia) (previously washed with PBS) and incubated at room temperature for 30 minutes. The sample was centrifuged at 700 g for 5 minutes at 4 C. The resin was washed twice with 10 ml cold PBS for 10 minutes, resuspended in 1 ml cold PBS, and loaded on a disposable column. The resin was washed twice with 2 ml cold PBS until the flow-through reached $OD_{280}$ of 0.02-0.06. The GST-fusion protein was eluted by addition of 700 µl cold Glutathione elution buffer (10 mM reduced glutathione, 50 mM Tris-HCl) and fractions collected until the $OD_{280}$ was 0.1. 21 µl of each fraction were loaded on a 12% SDS gel using either Biorad SDS-PAGE Molecular weight standard broad range (M1) (200, 116.25, 97.4, 66.2, 45, 31, 21.5, 14.4, 6.5 kDa) or Amersham Rainbow Marker (M") (220, 66, 46, 30, 21.5, 14.3 kDa) as standards. As the MW of GST is 26 kDa, this value must be added to the MW of each GST-fusion protein.

For other ORFs, for each clone to be purified as a GST-fusion, a single colony was streaked out and grown overnight at 37° C. on LB/Amp (100 µg/ml) agar plate. An isolated colony from this plate was inoculated into 20 ml of LB/Amp (100 µg/ml) liquid medium and grown overnight at 37° C. with shaking. The overnight culture was diluted 1:30 into 600 ml of LB/Amp (100 µg/ml) liquid medium and allowed to grow at the optimal temperature (20-37° C.) until the $OD_{550}$ reached 0.6-0.8. Recombinant protein expression was induced by addition of IPTG (final concentration 0.2 mM) and the culture incubated for a further 3 hours. The bacteria were harvested by centrifugation at 8000×g for 15 min at 4° C.

The bacterial pellet was resuspended in 7.5 ml cold PBS. Cells were disrupted by sonication on ice for 30 sec at 40 W using a Branson sonifier 450 and centrifuged at 13 000×g for 30 min at 4° C. The supernatant was collected and mixed with 150 µl GLUTATHIONE-SEPHAROSE 4B™ resin (Pharmacia), previously equilibrated with PBS, and incubated at room temperature with gentle agitation for 30 min. The batch-wise preparation was centrifuged at 700×g for 5 min at 4° C. and the supernatant discarded. The resin was washed twice (batchwise) with 10 ml cold PBS for 10 min, resuspended in 1 ml cold PBS, and loaded onto a disposable column. The resin continued to be washed twice with cold PBS, until the $OD_{280nm}$ of the flow-through reached 0.02-0.01. The GST-fusion protein was eluted by addition of 700 µl cold glutathione elution buffer (10 mM reduced glutathione, 50 mM Tris-HCl pH 8.0) and fractions collected, until the $OD_{280nm}$ of the eluate indicated all the recombinant protein was obtained. 20 µl aliquots of each elution fraction were analyzed by SDS-PAGE using a 12% gel. The molecular mass of the purified proteins was determined using either the Bio-Rad broad range molecular weight standard (M1) (200, 116, 97.4, 66.2, 45.0, 31.0, 21.5, 14.4, 6.5 kDa) or the Amersham Rainbow Marker (M2) (220, 66.2, 46.0, 30.0, 21.5, 14.3 kDa). The molecular weights of GST-fusion proteins are a combination of the 26 kDa GST protein and its fusion partner. Protein concentrations were estimated using the Bradford assay.

His-Fusion Soluble Proteins Large-Scale Purification.

For some ORFs, a single colony was grown overnight at 37° C. on a LB+Amp agar plate. The bacteria were inoculated into 20 ml of LB+Amp liquid culture and incubated overnight in a water bath shaker. Bacteria were diluted 1:30 into 600 ml fresh medium and allowed to grow at the optimal temperature (20-37° C.) to $OD_{550}$ 0.6-0.8. Protein expression was induced by addition of 1 mM IPTG and the culture further incubated for three hours. The culture was centrifuged at 8000 rpm at 4° C., the supernatant was discarded and the bacterial pellet was resuspended in 7.5 ml cold 10 mM imidazole buffer (300 mM NaCl, 50 mM phosphate buffer, 10 mM imidazole, pH 8). The cells were disrupted by sonication on ice for 30 sec at 40 W using a Branson sonifier B-15, frozen and thawed two times and centrifuged again. The supernatant was collected and mixed with 150 µl $Ni^{2+}$-resin (Pharmacia) (previously washed with 10 mM imidazole buffer) and incubated at room temperature with gentle agitation for 30 minutes. The sample was centrifuged at 700 g for 5 minutes at 4° C. The resin was washed twice with 10 ml cold 10 mM imidazole buffer for 10 minutes, resuspended in 1 ml cold 10 mM imidazole buffer and loaded on a disposable column. The resin was washed at 4° C. with 2 ml cold 10 mM imidazole buffer until the flow-through reached the $O.D_{280}$ of 0.02-0.06. The resin was washed with 2 ml cold 20 mM imidazole buffer (300 mM NaCl, 50 mM phosphate buffer, 20 mM imidazole, pH 8) until the flow-through reached the $O.D_{280}$ of 0.02-0.06. The His-fusion protein was eluted by addition of 700 µl cold 250 mM imidazole buffer (300 mM NaCl, 50 mM phosphate buffer, 250 mM imidazole, pH 8) and fractions collected until the $O.D_{280}$ was 0.1. 21 µl of each fraction were loaded on a 12% SDS gel.

His-Fusion Insoluble Proteins Large-Scale Purification.

A single colony was grown overnight at 37° C. on a LB+Amp agar plate. The bacteria were inoculated into 20 ml of LB+Amp liquid culture in a water bath shaker and grown overnight. Bacteria were diluted 1:30 into 600 ml fresh medium and let to grow at the optimal temperature (37° C.) to $O.D_{550}$ 0.6-0.8. Protein expression was induced by addition of 1 mM IPTG and the culture further incubated for three hours. The culture was centrifuged at 8000 rpm at 4° C. The supernatant was discarded and the bacterial pellet was resuspended in 7.5 ml buffer B (urea 8M, 10 mM Tris-HCl, 100 mM phosphate buffer, pH 8.8). The cells were disrupted by sonication on ice for 30 sec at 40 W using a Branson sonifier B-15, frozen and thawed twice and centrifuged again. The supernatant was stored at −20° C., while the pellets were resuspended in 2 ml guanidine buffer (6M guanidine hydrochloride, 100 mM phosphate buffer, 10 mM Tris-HCl, pH 7.5) and treated in a homogenizer for 10 cycles. The product was centrifuged at 13000 rpm for 40 minutes. The supernatant was mixed with 150 µl $Ni^{2+}$-resin (Pharmacia) (previously washed with buffer B) and incubated at room temperature with gentle agitation for 30 minutes. The sample was centrifuged at 700 g for 5 minutes at 4° C. The resin was washed twice with 10 ml buffer B for 10 minutes, resuspended in 1 ml buffer B, and loaded on a disposable column. The resin was washed at room temperature with 2 ml buffer B until the flow-through reached the $OD_{280}$ of 0.02-0.06. The resin was washed with 2 ml buffer C (urea 8M, 10 mM Tris-HCl, 100 mM phosphate buffer, pH 6.3) until the flow-through reached the $O.D_{280}$ of 0.02-0.06. The His-fusion protein was eluted by addition of 700 µl elution buffer (urea 8M, 10 mM Tris-HCl, 100 mM phosphate buffer, pH 4.5) and fractions collected until the $OD_{280}$ was 0.1. 21 µl of each fraction were loaded on a 12% SDS gel.

Purification of His-fusion Proteins.

For each clone to be purified as a His-fusion, a single colony was streaked out and grown overnight at 37° C. on LB/Amp (100 µg/ml) agar plate. An isolated colony from this plate was inoculated into 20 ml of LB/Amp (100 µg/ml) liquid medium and grown overnight at 37° C. with shaking. The overnight culture was diluted 1:30 into 600 ml of LB/Amp (100 µg/ml) liquid medium and allowed to grow at the optimal temperature (20-37° C.) until the $OD_{550}$ reached 0.6-0.8. Expression of recombinant protein was induced by addition of IPTG (final concentration 1.0 mM) and the culture incubated for a further 3 hours. The bacteria were harvested by centrifugation at 8000×g for 15 min at 4° C.

The bacterial pellet was resuspended in 7.5 ml either (i) cold buffer A (300 mM NaCl, 50 mM phosphate buffer, 10 mM imidazole, pH 8.0) for soluble proteins or (ii) buffer B (8M urea, 10 mM TrisHCl, 100 mM phosphate buffer, pH 8.8) for insoluble proteins. Cells were disrupted by sonication on ice four times for 30 sec at 40 W using a Branson sonifier 450 and centrifuged at 13 000×g for 30 min at 4° C. For insoluble proteins, pellets were resuspended in 2.0 ml buffer C (6M guanidine hydrochloride, 100 mM phosphate buffer, 10 mM Tris-HCl, pH 7.5) and treated with a Dounce homogenizer for 10 cycles. The homogenate was centrifuged at 13 000×g for 40 min and the supernatant retained.

Supernatants for both soluble and insoluble preparations were mixed with 150 µl $Ni^{2+}$-resin (previously equilibrated with either buffer A or buffer B, as appropriate) and incubated at room temperature with gentle agitation for 30 min. The resin was CHELATING SEPHAROSE FAST FLOW™ (Pharmacia), prepared according to the manufacturers protocol. The batch-wise preparation was centrifuged at 700×g for 5 min at 4° C. and the supernatant discarded. The resin was washed twice (batch-wise) with 10 ml buffer A or B for 10 min, resuspended in 1.0 ml buffer A or B and loaded onto a disposable column. The resin continued to be washed with either (i) buffer A at 4° C. or (ii) buffer B at room temperature, the $OD_{280nm}$ of the flow-through reached 0.02-0.01. The resin was further washed with either (i) cold buffer C (300 mM NaCl, 50 mM phosphate buffer, 20 mM imidazole, pH 8.0) or (ii) buffer D (8M urea, 10 mM Tris-HCl, 100 mM phosphate buffer, pH 6.3) until the $OD_{280nm}$ of the flow-through reached 0.02-0.01. The His-fusion protein was eluted by addition of 700 µl of either (1) cold elution buffer A (300 mM NaCl, 50 mM phosphate buffer, 250 mM imidazole, pH 8.0) or (ii) elution buffer B (8 M urea, 10 mM Tris-HCl, 100 mM phosphate buffer, pH 4.5) and fractions collected until the $O.D_{280nm}$ indicated all the recombinant protein was obtained. 20 µl aliquots of each elution fraction were analyzed by SDS-PAGE using a 12% gel. Protein concentrations were estimated using the Bradford assay.

His-Fusion Proteins Renaturation

In the cases where denaturation was required to solubilize proteins, a renaturation step was employed prior to immunization. Glycerol was added to the denatured fractions obtained above to a final concentration of 10% (v/v). The proteins were then diluted to 200 µg/ml using dialysis buffer I (10% (v/v) glycerol, 0.5M arginine, 50 mM phosphate buffer, 5 mM reduced glutathione, 0.5 mM oxidised glutathione, 2M urea, pH 8.8) and dialysed against the same buffer for 12-14 hours at 4° C. Further dialysis was performed with buffer II (10% (v/v) glycerol, 0.5M arginine, 50 mM phosphate buffer, 50 mM reduced glutathione, 5.0 mM oxidised glutathione, pH 8.8) for 12-14 hours at 4° C.

Alternatively, 10% glycerol was added to the denatured proteins. The proteins were then diluted to 20 µg/ml using dialysis buffer I (10% glycerol, 0.5M arginine, 50 mM phosphate buffer, 5 mM reduced glutathione, 0.5 mM oxidised glutathione, 2M urea, pH 8.8) and dialysed against the same buffer at 4° C. for 12-14 hours. The protein was further dialysed against dialysis buffer II (10% glycerol, 0.5M arginine, 50 mM phosphate buffer, 5 mM reduced glutathione, 0.5 mM oxidised glutathione, pH 8.8) for 12-14 hours at 4° C.

Protein concentration was evaluated using the formula:

$$\text{Protein (mg/ml)} = (1.55 \times OD_{280}) - (0.76 \times OD_{260})$$

Purification of Proteins

To analyse the solubility, pellets obtained from 3.0 ml cultures were resuspended in 500 µl buffer M1 (PBS pH 7.2). 25 µl of lysozyme (10 mg/ml) was added and the bacteria incubated for 15 min at 4° C. Cells were disrupted by sonication on ice four times for 30 sec at 40 W using a Branson sonifier 450 and centrifuged at 13 000×g for 30 min at 4° C. The supernatant was collected and the pellet resuspended in buffer M2 [8M urea, 0.5M NaCl, 20 mM imidazole and 0.1 M $NaH_2PO_4$] and incubated for 3 to 4 hours at 4° C. After centrifugation, the supernatant was collected and the pellet resuspended in buffer M3 [6M guanidinium-HCl, 0.5M NaCl, 20 mM imidazole and 0.1 M $NaH_2PO_4$] overnight at 4° C. The supernatants from all steps were analysed by SDS-PAGE. Some proteins were found to be soluble in PBS, others needed urea or guanidinium-HCl for solubilization.

For preparative scale purification, 500 ml cultures were induced and fusion proteins solubilized in either buffer M1, M2, or M3 using the procedure described above. Crude extracts were loaded onto a Ni-NTA superflow column (Qiagen) equilibrated with buffer M1, M2, or M3 depending on the solubilization buffer employed. Unbound material was eluted with the corresponding buffer containing 500 mM imidazole then dialysed against the same buffer in the absence of imidazole.

Mice Immunizations

20 µg of each purified protein are used to immunize mice intraperitoneally. In the case of some ORFs, Balb-C mice were immunised with $Al(OH)_3$ as adjuvant on days 1, 21 and 42, and immune response was monitored in samples taken on day 56. For other ORFs, CD1 mice could be immunised using the same protocol. For ORFs 25 and 40, CD1 mice were immunised using Freund's adjuvant, and the same immunisation protocol was used, except that the immune response was measured on day 42, rather than 56. Similarly, for still other ORFs, CD1 mice were immunised with Freund's adjuvant, but the immune response was measured on day 49. Alternatively, 20 µg of each purified protein was mixed with Freund's adjuvant and used to immunize CD1 mice intraperitoneally. For many of the proteins, the immunization was performed on days 1, 21 and 35, and immune response was monitored in samples taken on days 34 and 49. For some proteins, the third immunization was performed on day 28, rather than 35, and immune response was measured on days 20 and 42, rather than 34 and 49.

Elisa Assay (Sera Analysis)

The acapsulated MenB M7 strain was plated on chocolate agar plates and incubated overnight at 37° C. Bacterial colonies were collected from the agar plates using a sterile dracon swab and inoculated into 7 ml of Mueller-Hinton Broth (Difco) containing 0.25% Glucose. Bacterial growth was monitored every 30 minutes by following $OD_{620}$. The bacteria were let to grow until the OD reached the value of 0.3-0.4. The culture was centrifuged for 10 minutes at 10000 rpm. The supernatant was discarded and bacteria were washed once with PBS, resuspended in PBS containing 0.025% formaldehyde, and incubated for 2 hours at room temperature and then overnight at 4° C. with stirring. 100 µl bacterial cells were added to each well of a 96 well Greiner plate and incubated overnight at 4° C. The wells were then washed three times with PBT washing buffer (0.1% TWEEN-20™ in PBS). 200 µl of saturation buffer (2.7% Polyvinylpyrrolidone 10 in water) was added to each well and the plates incubated for 2 hours at 37° C. Wells were washed three times with PBT. 200 µl of diluted sera (Dilution buffer: 1% BSA, 0.1% TWEEN-20™, 0.1% $NaN_3$ in PBS) were added to each well and the plates incubated for 90 minutes at 37° C. Wells were washed three times with PBT. 100 µl of HRP-conjugated rabbit anti-mouse (Dako) serum diluted 1:2000 in dilution buffer were added to each well and the plates were incubated for 90 minutes at 37° C. Wells were washed three times with PBT buffer. 100 µl of substrate buffer for HRP (25 ml of citrate buffer pH5, 10 mg of O-phenildiamine and 10 µl of $H_2O$) were added to each well and the plates were left at room temperature for 20 minutes. 100 µl $H_2SO_4$ was added to each well and $OD_{490}$ was followed. The ELISA was considered positive when OD490 was 2.5 times the respective pre-immune sera.

Alternatively, The acapsulated MenB M7 strain was plated on chocolate agar plates and incubated overnight at 37° C. Bacterial colonies were collected from the agar plates using a sterile dracon swab and inoculated into Mueller-Hinton Broth (Difco) containing 0.25% Glucose. Bacterial growth was monitored every 30 minutes by following $OD_{620}$. The bacteria were let to grow until the OD reached the value of 0.3-0.4. The culture was centrifuged for 10 minutes at 10 000 rpm. The supernatant was discarded and bacteria were washed once with PBS, resuspended in PBS containing 0.025% formaldehyde, and incubated for 1 hour at 37° C. and then overnight at 4° C. with stirring. 100 µl bacterial cells were added to each well of a 96 well Greiner plate and incubated overnight at 4° C. The wells were then washed three times with PBT washing buffer (0.1% TWEEN-20™ in PBS). 200 µl of saturation buffer (2.7% Polyvinylpyrrolidone 10 in water) was added to each well and the plates incubated for 2 hours at 37° C. Wells were washed three times with PBT. 200 µl of diluted sera (Dilution buffer: 1% BSA, 0.1% TWEEN-20™, 0.1% $NaN_3$ in PBS) were added to each well and the plates incubated for 2 hours at 37° C. Wells were washed three times with PBT. 100 µl of HRP-conjugated rabbit anti-mouse (Dako) serum diluted 1:2000 in dilution buffer were added to each well and the plates were incubated for 90 minutes at 37° C. Wells were washed three times with PBT buffer. 100 µl of substrate buffer for HRP (25 ml of citrate buffer pH5, 10 mg of O-phenildiamine and 10 µl of $H_2O_2$) were added to each well and the plates were left at room temperature for 20 minutes. 100 µl $H_2SO_4$ was added to each well and $OD_{490}$ was followed. The ELISA titers were calculated arbitrarily as the dilution of sera which gave an $OD_{490}$ value of 0.4 above the level of preimmune sera. The ELISA was considered positive when the dilution of sera with $OD_{490}$ of 0.4 was higher than 1:400.

FACScan Bacteria Binding Assay Procedure.

The acapsulated MenB M7 strain was plated on chocolate agar plates and incubated overnight at 37° C. Bacterial colonies were collected from the agar plates using a sterile dracon swab and inoculated into 4 tubes containing 8 ml each Mueller-Hinton Broth (Difco) containing 0.25% glucose. Bacterial growth was monitored every 30 minutes by following $OD_{620}$. The bacteria were let to grow until the OD reached the value of 0.35-0.5. The culture was centrifuged for 10 minutes at 4000 rpm. The supernatant was discarded and the pellet was resuspended in blocking buffer (1% BSA, 0.4% $NaN_3$) and centrifuged for 5 minutes at 4000 rpm. Cells were resuspended in blocking buffer to reach $OD_{620}$ of 0.07. 100 µl bacterial cells were added to each well of a Costar 96 well plate. 100 µl of diluted (1:200) sera (in blocking buffer) were added to each well and plates incubated for 2 hours at 4° C. Cells were centrifuged for 5 minutes at 4000 rpm, the supernatant aspirated and cells washed by addition of 200 µl/well of blocking buffer in each well. 100 µl of R-Phicoerytrin conjugated $F(ab)_2$ goat anti-mouse, diluted 1:100, was added to each well and plates incubated for 1 hour at 4° C. Cells were spun down by centrifugation at 4000 rpm for 5 minutes and washed by addition of 200 µl/well of blocking buffer. The supernatant was aspirated and cells resuspended in 200 µl/well of PBS, 0.25% formaldehyde. Samples were transferred to FACScan tubes and read. The condition for FACScan setting were: FL1 on, FL2 and FL3 off; FSC-H Treshold: 92; FSC PMT Voltage: E 02; SSC PMT: 474; Amp. Gains 7.1; FL-2 PMT: 539. Compensation values: 0.

OMV Preparations

Bacteria were grown overnight on 5 GC plates, harvested with a loop and resuspended in 10 ml 20 mM Tris-HCl. Heat inactivation was performed at 56° C. for 30 minutes and the bacteria disrupted by sonication for 10' on ice (50% duty cycle, 50% output). Unbroken cells were removed by centrifugation at 5000 g for 10 minutes and the total cell envelope fraction recovered by centrifugation at 50000 g at 4° C. for 75 minutes. To extract cytoplasmic membrane proteins from the crude outer membranes, the whole fraction was resuspended in 2% sarkosyl (Sigma) and incubated at room temperature for 20 minutes. The suspension was centrifuged at 10000 g for 10 minutes to remove aggregates, and the supernatant further ultracentrifuged at 50000 g for 75 minutes to pellet the outer membranes. The outer membranes were resuspended in 10 mM Tris-HCl, pH8 and the protein concentration measured by the Bio-Rad Protein assay, using BSA as a standard.

Whole Extracts Preparation

Bacteria were grown overnight on a GC plate, harvested with a loop and resuspended in 1 ml of 20 mM Tris-HCl. Heat inactivation was performed at 56° C. for 30' minutes.

Western Blotting

Purified proteins (500 ng/lane), outer membrane vesicles (5 µg) and total cell extracts (25 µl) derived from MenB strain 2996 were loaded onto a 12% SDS-polyacrylamide gel and transferred to a nitrocellulose membrane. The transfer was performed for 2 hours at 150 mA at 4° C., using transfer buffer (0.3% Tris base, 1.44% glycine, 20% (v/v) methanol). The membrane was saturated by overnight incubation at 4° C. in saturation buffer (10% skimmed milk, 0.1% TRITON X100™ in PBS). The membrane was washed twice with washing buffer (3% skimmed milk, 0.1% TRITON X100™ in PBS) and incubated for 2 hours at 37° C. with mice sera diluted 1:200 in washing buffer. The membrane was washed twice and incubated for 90 minutes with a 1:2000 dilution of horseradish peroxidase labeled anti-mouse Ig. The membrane was washed twice with 0.1% TRITON X100™ in PBS and developed with the OPTI-4CN SUBSTRATE KIT™ (Bio-Rad). The reaction was stopped by adding water.

Bactericidal Assay

MC58 and 2996 strains were grown overnight at 37° C. on chocolate agar plates. 5-7 colonies were collected and used to inoculate 7 ml Mueller-Hinton broth. The suspension was incubated at 37° C. on a nutator and let to grow until $OD_{620}$ was in between 0.5-0.8. The culture was aliquoted into sterile 1.5 ml Eppendorf tubes and centrifuged for 20 minutes at maximum speed in a microfuge. The pellet was washed once in Gey's buffer (Gibco) and resuspended in the same buffer to an $OD_{620}$ of 0.5, diluted 1:20000 in Gey's buffer and stored at 25° C.

50 µl of Gey's buffer/1% BSA was added to each well of a 96-well tissue culture plate. 25 µl of diluted (1:100) mice sera (dilution buffer: Gey's buffer/0.2% BSA) were added to each well and the plate incubated at 4° C. 25 µl of the previously described bacterial suspension were added to each well. 25 µl of either heat-inactivated (56° C. water bath for 30 minutes) or normal baby rabbit complement were added to each well. Immediately after the addition of the baby rabbit complement, 22 µl of each sample/well were plated on Mueller-Hinton agar plates (time 0). The 96-well plate was incubated for 1 hour at 37° C. with rotation and then 22 µl of each sample/well were plated on Mueller-Hinton agar plates (time 1). After overnight incubation the colonies corresponding to time 0 and time 1 h were counted.

Gene Variability

The ORF4 and 919 genes were amplified by PCR on chromosomal DNA extracted from various *Neisseria* strains (see list of strains). The following oligonucleotides used as PCR primers were designed in the upstream and downstream regions of the genes:

```
                                            (SEQ ID NO: 3266)
    orf 4.1 (forward)  CGAATCCGGACGGCAGGACTC (SEQ ID NO: 3267)
    orf 4.3 (reverse)  GGCAGGGAATGGCGGATTAAAG (SEQ ID NO: 3268)
    919.1 (forward)    AAAATGCCTCTCCACGGCTG
    or (SEQ ID NO: 3269)
    CTGCGCCCTGTGTTAAAATCCCCT (SEQ ID NO: 3270)
    919.6 (reverse)    CAAATAAGAAAGGAATTTTG
    or (SEQ ID NO: 3271)
    GGTATCGCAAAACTTCGCCTTAATGCG
```

The PCR cycling conditions were:

| | |
|---|---|
| 1 cycle | 2 min. at 94° |
| 30 cycles | 30 sec. at 94° |
| | 30 sec. at ~54° or ~60° (in according to Tm of the primers) |
| | 40 sec. at 72° |
| 1 cycle | 7 min. at 72° |

The PCR products were purified from 1% agarose gel and sequenced using the following primers:

```
                                            (SEQ ID NO: 3272)
    orf 4.1  (forward)  CGAATCCGGACGGCAGGACTC (SEQ ID NO: 3273)
    orf 4.2  (forward)  CGACCGCGCCTTTGGGACTG (SEQ ID NO: 3274)
    orf 4.3  (reverse)  GGCAGGGAATGGCGGATTAAAG (SEQ ID NO: 3275)
    orf 4.4  (reverse)  TCTTTGAGTTTGATCCAACC (SEQ ID NO: 3276)
    919.1    (forward)  AAAATGCCTCTCCACGGCTG
    or (SEQ ID NO: 3277)
    CTGCGCCCTGTGTTAAAATCCCCT (SEQ ID NO: 3278)
    919.2    (forward)  ATCCTTCCGCCTCGGCTGCG (SEQ ID NO: 3279)
    919.3    (forward)  AAAACAGCGGCACAATCGAC (SEQ ID NO: 3280)
    919.4    (forward)  ATAAGGGCTACCTCAAACTC (SEQ ID NO: 3281)
    919.5    (forward)  GCGCGTGGATTATTTTTGGG (SEQ ID NO: 3282)
    919.6    (reverse)  CAAATAAGAAAGGAATTTTG
    or (SEQ ID NO: 3283)
    GGTATCGCAAAACTTCGCCTTAATGCG (SEQ ID NO: 3284)
    919.7    (reverse)  CCCAAGGTAATGTAGTGCCG (SEQ ID NO: 3285)
    919.8    (reverse)  TAAAAAAAAGTTCGACAGGG (SEQ ID NO: 3286)
    919.9    (reverse)  CCGTCCGCCTGTCGTCGCCC (SEQ ID NO: 3287)
    919.10   (reverse)  TCGTTCCGGCGGGGTCGGGG
```

All documents cited herein are incorporated by reference in their entireties.

The following Examples are presented to illustrate, not limit, the invention.

Example 1

Using the above-described procedures, the following oligonucleotide primers were employed in the polymerase chain reaction (PCR) assay in order to clone the ORFs as indicated:

TABLE 1

Oligonucleotides used for PCR for Examples 2-10

| ORF | Primer | Sequence | Restriction sites |
|---|---|---|---|
| 279 | Forward | CGCGGATCCCATATG-TTGCCTGCAATCACGATT <SEQ ID 3021> | BamHI-NdeI |
| | Reverse | CCCGCTCGAG-TTTAGAAGCGGGCGGCAA <SEQ ID 3022> | XhoI |
| 519 | Forward | CGCGGATCCCATATG-TTCAAATCCTTTGTCGTCA <SEQ ID 3023> | BamHI-NdeI |
| | Reverse | CCCGCTCGAG-TTTGGCGGTTTTGCTGC <SEQ ID 3024> | XhoI |

TABLE 1-continued

Oligonucleotides used for PCR for Examples 2-10

| ORF Primer | Sequence | Restriction sites |
|---|---|---|
| 576 Forward | CGCGGATCCCATATG-GCCGCCCCCGCATCT <SEQ ID 3025> | BamHI-NdeI |
| Reverse | CCCGCTCGAG-ATTTACTTTTTTGATGTCGAC <SEQ ID 3026> | XhoI |
| 919 Forward | CGCGGATCCCATATG-TGCCAAAGCAAGAGCATC <SEQ ID 3027> | BamHI-NdeI |
| Reverse | CCCGCTCGAG-CGGGCGGTATTCGGG <SEQ ID 3028> | XhoI |
| 121 Forward | CGCGGATCCCATATG-GAAACACAGCTTTACAT <SEQ ID 3029> | BamHI-NdeI |
| Reverse | CCCGCTCGAG-ATAATAATATCCCGCGCCC <SEQ ID 3030> | XhoI |
| 128 Forward | CGCGGATCCCATATG-ACTGACAACGCACT <SEQ ID 3031> | BamHI-NdeI |
| Reverse | CCCGCTCGAG-GACCGCGTTGTCGAAA <SEQ ID 3032> | XhoI |
| 206 Forward | CGCGGATCCCATATG-AAACACCGCCAACCGA <SEQ ID 3033> | BamHI-NdeI |
| Reverse | CCCGCTCGAG-TTCTGTAAAAAAGTATGTGC <SEQ ID 3034> | XhoI |
| 287 Forward | CCGGAATTCTAGCTAGC-CTTTCAGCCTGCGGG <SEQ ID 3035> | EcoRI-NheI |
| Reverse | CCCGCTCGAG-ATCCTGCTCTTTTTTGCC <SEQ ID 3036> | XhoI |
| 406 Forward | CGCGGATCCCATATG-TGCGGGACACTGACAG <SEQ ID 3037> | BamHI-NdeI |
| Reverse | CCCGCTCGAG-AGGTTGTCCTTGTCTATG <SEQ ID 3038> | XhoI |

Localization of the ORFs

The following DNA and amino acid sequences are identified by titles of the following form: [g, m, or a] [#].[seq or pep], where "g" means a sequence from N. gonorrhoeae, "m" means a sequence from N. meningitidis B, and "a" means a sequence from N. meningitidis A; "#" means the number of the sequence; "seq" means a DNA sequence, and "pep" means an amino acid sequence. For example, "g001.seq" refers to an N. gonorrhoeae DNA sequence, number 1. The presence of the suffix "-1" to these sequences indicates an additional sequence found for the same ORF, thus, data for an ORF having both an unsuffixed and a suffixed sequence designation applies to both such designated sequences. Further, open reading frames are identified as ORF #, where "#" means the number of the ORF, corresponding to the number of the sequence which encodes the ORF, and the ORF designations may be suffixed with ".ng" or ".a", indicating that the ORF corresponds to a N. gonorrhoeae sequence or a N. meningitidis A sequence, respectively. The word "partial" before a sequence indicates that the sequence may be partial or a complete ORF. Computer analysis was performed for the comparisons that follow between "g", "m", and "a" peptide sequences; and therein the "pep" suffix is implied where not expressly stated. Further, in the event of a conflict between the text immediately preceding and describing which sequences are being compared, and the designated sequences being compared, the designated sequence controls and is the actual sequence being compared ORF: contig:
279 gnm4.seq The following partial DNA sequence was identified in N. meningitidis <SEQ ID 3039>:

```
m279.seq
  1 ATAACGCGGA TTTGCGGCTG CTTGATTTCA ACGGTTTTCA GGGCTTCGGC

51 AAGTTTGTCG GCGGCGGGTT TCATCAGGCT GCAATGGGAA GGTACGGACA

101 CGGGCAGCGG CAGGGCGCGT TTGGCACCGG CTTCTTTGGC GGCAGCCATG

151 GCGCGTCCGA CGGCGGCGGC GTTGCCTGCA ATCACGATTT GTCCGGGTGA

201 GTTGAAGTTG ACGGCTTCGA CCACTTCGCT TTGGGCGGCT TCGGCACAAA
```

-continued

```
251 TGGCTTTAAC CTGCTCATCT TCCAAGCCGA GAATCGCCGC CATTGCGCCC

301 ACGCCTTGCG GTACGGCGGA CTGCATCAGT TCGGCGCGCA GGCGCACGAG

351 TTTGACCGCG TCGGCAAAAT TCAATGCGCC GGCGGCAACG AGTGCGGTGT

401 ATTCGCCGAG GCTGTGTCCG GCAACGGCGG CAGGCGTTTT GCCGCCCGCT

451 TCTAAATAG
```

This corresponds to the amino acid sequence <SEQ ID 3040; ORF 279>:

```
m279.pep
  1 ITRICGCLIS TVFRASASLS AAGFIRLQWE GTDTGSGRAR LAPASLAAAM

51 ARPTAAALPA ITICPGELKL TASTTSLWAA SAQMALTCSS SKPRIAAIAP

101 TPCGTADCIS SARRRTSLTA SAKFNAPAAT SAVYSPRLCP ATAAGVLPPA

151 SK*
```

The following partial DNA sequence was identified in *N. gonorrhoeae* <SEQ ID 3041>:

```
g279.seq
  1 atgacgcgga tttgcggctg cttgatttca acggttttga gtgtttcggc 51 aagtttgtcg gcggcgggtt tcatcaggct gcaatgggaa ggaacggata 101 ccggcagcgg cagggcgcgt ttggctccgg cttctttggc ggcagccatg 151 gtgcgtccga cggcggcggc gttgcctgca atcacgactt gtccgggcga 201 gttgaagttg acggcttcga ccacttcgcc ctgtgcggat tcggcacaaa 251 tctgcctgac ctgttcatct ccaaaccca aaatggccgc cattgcgcct 301 acgccttgcg gtacggcgga ctgcatcagt tcggcgcgca ggcggacgag 351 tttgacggca tcggcaaaat ccaatgcttc ggcggcgaca agcgcggtgt 401 attcgccgag gctgtgtccg gcaacggcgg caggcgtttt gccgcccact 451 tccaaatag
```

This corresponds to the amino acid sequence <SEQ ID 3042; ORF 279.ng>:

```
g279.pep
  1 MTRICGCLIS TVLSVSASLS AAGFIRLQWE GTDTGSGRAR LAPASLAAAM

51 VRPTAAALPA ITTCPGELKL TASTTSPCAD SAQICLTCSS SKPKMAAIAP

101 TPCGTADCIS SARRRTSLTA SAKSNASAAT SAVYSPRLCP ATAAGVLPPT

151 SK*
```

ORF 279 shows 89.5% identity over a 152 aa overlap with a predicted ORF (ORF 279.ng) from *N. gonorrhoeae*:

```
                   10        20        30        40        50        60
      m279.pep  ITRICGCLISTVFRASASLSAAGFIRLQWEGTDTGSGRARLAPASLAAAMARPTAAALPA
                :||||||||||: :||||||||||||||||||||||||||||||||||||:||||||||
         g279  MTRICGCLISTVLSVSASLSAAGFIRLQWEGTDTGSGRARLAPASLAAAMVRPTAAALPA
                   10        20        30        40        50        60
```

-continued

```
                 70        80        90        100       110       120
m279.pep ITICPGELKLTASTTSLWAASAQMALTCSSSKPRIAAIAPTPCGTADCISSARRRTSLTA
         || |||||||||||||  | |||: |||||||::||||||||||||||||||||||||
g279     ITTCPGELKLTASTTSPCADSAQICLTCSSSKPKMAAIAPTPCGTADCISSARRRTSLTA
                 70        80        90        100       110       120

130       140       150
m279.pep SAKFNAPAATSAVYSPRLCPATAAGVLPPASKX
         ||| || ||||||||||||||||||||||:|||
g279     SAKSNASAATSAVYSPRLCPATAAGVLPPTSKX
                130       140       150
```

The following partial DNA sequence was identified in *N. meningitidis* <SEQ ID 3043>:

```
a279.seq
  1 ATGACNCNGA TTTGCGGCTG CTTGATTTCA ACGGTTTNNA GGGCTTCGGC

51 GAGTTTGTCG GCGGCGGGTT TCATGAGGCT GCAATGGGAA GGTACNGACA

101 CNGGCAGCGG CAGGGCGCGT TTGGCGCCGG CTTCTTTGGC GGCAAGCATA

151 GCGCGCTCGA CGGCGGCGGC ATTGCCTGCA ATCACGACTT GTCCGGGCGA

201 GTTGAAGTTG ACGGCTTCAA CCACTTCATC CTGTGCGGAT TCGGCGCAAA

251 TTTGTTTTAC CTGTTCATCT TCCAAGCCGA GAATCGCCGC CATTGCGCCC

301 ACGCCTTGCG GTACGGCGGA CTGCATCAGT TCGGCGCGCA NGCGCACGAG

351 TTTGACCGCG TCGGCAAAAT CCAATGCGCC GGCGGCAACN AGTGCGGTGT

401 ATTCGCCGAN GCTGTGTCCG GCAACGGCGG CAGGCGTTTT GCCGCCCGCT

451 TCCGAATAG
```

This corresponds to the amino acid sequence <SEQ ID 3044; ORF 279.a>:

```
a279.pep
  1 MTXICGCLIS TVXRASASLS AAGFMRLQWE GTDTGSGRAR LAPASLAASI

51 ARSTAAALPA ITTCPGELKL TASTTSSCAD SAQICFTCSS SKPRIAAIAP

101 TPCGTADCIS SARXRTSLTA SAKSNAPAAT SAVYSPXLCP ATAAGVLPPA

151 SE*
``` m279/a279 ORFs 279 and 279.a showed a 88.2% identity in 152 aa overlap

```
                 10        20        30        40        50        60
m279.pep ITRICGCLISTVFRASASLSAAGFIRLQWEGTDTGSGRARLAPASLAAAMARPTAAALPA
         :| ||||||||| ||||||||||:|||||||||||||||||||||::|| |||||||
a279     MTXICGCLISTVXRASASLSAAGFMRLQWEGTDTGSGRARLAPASLAASIARSTAAALPA
                 10        20        30        40        50        60

70        80        90        100       110       120
m279.pep ITICPGELKLTASTTSLWAASAQMALTCSSSKPRIAAIAPTPCGTADCISSARRRTSLTA
         || |||||||||||||  | |||: :||||||||||||||||||||||||| ||||||
a279     ITTCPGELKLTASTTSSCADSAQICFTCSSSKPRIAAIAPTPCGTADCISSARXRTSLTA
                 70        80        90        100       110       120

130       140       150
m279.pep SAKFNAPAATSAVYSPRLCPATAAGVLPPASKX
         ||| |||||||||||| |||||||||||||:|
a279     SAKSNAPAATSAVYSPXLCPATAAGVLPPASEX
                130       140       150
```

519 and 519-1 gnm7.seq

The following partial DNA sequence was identified in *N. meningitidis* <SEQ ID 3045>:

```
m519.seq (partial)
  1...  TCCGTTATCG GGCGTATGGA GTTGGACAAA ACGTTTGAAG AACGCGACGA 51         AATCAACAGT ACTGTTGTTG CGGCTTTGGA CGAGGCGGCC GGGgCTTgGG

101         GTGTGAAGGT TTTGCGTTAT GAGATTAAAG ACTTGGTTCC GCCGCAAGAA

151         ATCCTTCGCT CAATGCAGGC GCAAATTACT GCCGAACGCG AAAAACGCGC

201         CCGTATCGCC GAATCCGAAG GTCGTAAAAT CGAACAAATC AACCTTGCCA

251         GTGGTCAGCG CGAAGCCGAA ATCCAACAAT CCGAAGGCGA GGCTCAGGCT

301         GCGGTCAATG CGTCAAATGC CGAGAAAATC GCCCGCATCA ACCGCGCCAA

351         AGGTGAAGCG GAATCCTTGC GCCTTGTTGC CGAAGCCAAT GCCGAAGCCA

401         TCCGTCAAAT TGCCGCCGCC CTTCAAACCC AAGGCGGTGC GGATGCGGTC

451         AATCTGAAGA TTGCGGAACA ATACGTCGCT GCGTTCAACA ATCTTGCCAA

501         AGAAAGCAAT ACGCTGATTA TGCCCGCCAA TGTTGCCGAC ATCGGCAGCC

551         TGATTTCTGC CGGTATGAAA ATTATCGACA GCAGCAAAAC CGCCAAaTAA
```

This corresponds to the amino acid sequence <SEQ ID 3046; ORF 519>:

```
m519.pep (partial)
  1...  SVIGRMELDK TFEERDEINS TVVAALDEAA GAWGVKVLRY EIKDLVPPQE

51         ILRSMQAQIT AEREKRARIA ESEGRKIEQI NLASGQREAE IQQSEGEAQA

101         AVNASNAEKI ARINRAKGEA ESLRLVAEAN AEAIRQIAAA LQTQGGADAV

151         NLKIAEQYVA AFNNLAKESN TLIMPANVAD IGSLISAGMK IIDSSKTAK*
```

The following partial DNA sequence was identified in N. gonorrhoeae <SEQ ID 3047>:

```
g519.seq
  1 atggaatttt tcattatctt gttggcagcc gtcgccgttt tcggcttcaa
 51 atcctttgtc gtcatccccc agcaggaagt ccacgttgtc gaaaggctcg
101 ggcgtttcca tcgcgccctg acggccggtt tgaatatttt gattcccttt
151 atcgaccgcg tcgcctaccg ccattcgctg aaagaaatcc ctttagacgt
201 acccagccag gtctgcatca cgcgcgataa tacgcaattg actgttgacg
251 gcatcatcta tttccaagta accgatccca aactcgcctc atacggttcg
301 agcaactaca ttatggcaat tacccagctt gcccaaacga cgctgcgttc
351 cgttatcggg cgtatggagt tggacaaaac gtttgaagaa cgcgacgaaa
401 tcaacagtac cgtcgtctcc gccctcgatg aagccgccgg ggcttggggt
451 gtgaaagtcc tccgttacga aatcaaggat ttggttccgc cgcaagaaat
501 ccttcgcgca atgcaggcac aaattaccgc cgaacgcgaa aaacgcgccc
551 gtattgccga atccgaaggc cgtaaaatcg aacaaatcaa ccttgccagt
601 ggtcagcgtg aagccgaaat ccaacaatcc gaaggcgagg ctcaggctgc
651 ggtcaatgcg tccaatgccg agaaaatcgc ccgcatcaac cgcgccaaag
701 gcgaagcgga atccctgcgc cttgttgccg aagccaatgc cgaagccaac
751 cgtcaaattg ccgccgccct tcaaacccaa agcggggcgg atgcggtcaa
801 tctgaagatt gcgggacaat acgttaccgc gttcaaaaat cttgccaaag
851 aagacaatac gcggattaag cccgccaagg ttgccgaaat cgggaaccct
```

```
901 aattttcggc ggcatgaaaa attttcgcca gaagcaaaaa cggccaaata 951 a
```

This corresponds to the amino acid sequence <SEQ ID 3048; ORF 519.ng>:

```
g519.pep
  1 MEFFIILLAA VAVFGFKSFV VIPQQEVHVV ERLGRFHRAL TAGLNILIPF

51 IDRVAYRHSL KEIPLDVPSQ VCITRDNTQL TVDGIIYFQV TDPKLASYGS

101 SNYIMAITQL AQTTLRSVIG RMELDKTFEE RDEINSTVVS ALDEAAGAWG

151 VKVLRYEIKD LVPPQEILRA MQAQITAERE KRARIAESEG RKIEQINLAS

201 GQREAEIQQS EGEAQAAVNA SNAEKIARIN RAKGEAESLR LVAEANAEAN

251 RQIAAALQTQ SGADAVNLKI AGQYVTAFKN LAKEDNTRIK PAKVAEIGNP

301 NFRRHEKFSP EAKTAK*
```

ORF 519 shows 87.5% identity over a 200 aa overlap with a predicted ORF (ORF 519.ng) from *N. gonorrhoeae*:

```
    m519/g519
                                                  10         20         30
          m519.pep                          SVIGRMELDKTFEERDEINSTVVAALDEAA
                                            ||||||||||||||||||||||||:|||||
             g519     YFQVTDPKLASYGSSNYIMAITQLAQTTLRSVIGRMELDKTFEERDEINSTVVSALDEAA
                         90        100       110       120       130       140

40         50         60         70         80         90
          m519.pep   GAWGVKVLRYEIKDLVPPQEILRSMQAQITAEREKRARIAESEGRKIEQINLASGQREAE
                     |||||||||||||||||||||||:|||||||||||||||||||||||||||||||||||
             g519   GAWGVKVLRYEIKDLVPPQEILRAMQAQITAEREKRARIAESEGRKIEQINLASGQREAE
                        150       160       170       180       190       200

100       110       120       130       140       150
          m519.pep   IQQSEGEAQAAVNASNAEKIARINRAKGEAESLRLVAEANAEAIRQIAAALQTQGGADAV
                     ||||||||||||||||||||||||||||||||||||||||||| ||||||||||:|||||
             g519   IQQSESEAQAAVNASNAEKIARINRAKGEAESLRLVAEANAEANRQIAAALQTQSGADAV
                        210       220       230       240       250       260

160       170       180       190       200
          m519.pep   NLKIAEQYVAAFNNLAKESNTLIMPANVADIGSL-ISAGMKIIDSSKTAK
                     ||||| |||:||:||||||:|| | ||:||:||:  :    |:   :||||
             g519   NLKIAGQYVTAFKNLAKEDNTRIKPAKVAEIGNPNFRRHEKFSPEAKTAK
                        270       280       290       300       310
```

The following partial DNA sequence was identified in *N. meningitidis* <SEQ ID 3049>:

```
a519.seq
  1 ATGGAATTTT TCATTATCTT GCTGGCAGCC GTCGTTGTTT TCGGCTTCAA

51 ATCCTTTGTT GTCATCCCAC AGCAGGAAGT CCACGTTGTC GAAAGGCTCG

101 GGCGTTTCCA TCGCGCCCTG ACGGCCGGTT TGAATATTTT GATTCCCTTT

151 ATCGACCGCG TCGCCTACCG CCATTCGCTG AAAGAAATCC CTTTAGACGT

201 ACCCAGCCAG GTCTGCATCA CGCGCGACAA TACGCAGCTG ACTGTTGACG

251 GTATCATCTA TTTCCAAGTA ACCGACCCCA AACTCGCCTC ATACGGTTCG

301 AGCAACTACA TTATGGCGAT TACCCAGCTT GCCCAAACGA CGCTGCGTTC

351 CGTTATCGGG CGTATGGAAT TGGACAAAAC GTTTGAAGAA CGCGACGAAA

401 TCAACAGCAC CGTCGTCTCC GCCCTCGATG AAGCCGCCGG AGCTTGGGGT

451 GTGAAGGTTT TGCGTTATGA GATTAAAGAC TTGGTTCCGC CGCAAGAAAT
```

```
501 CCTTCGCTCA ATGCAGGCGC AAATTACTGC TGAACGCGAA AAACGCGCCC

551 GTATCGCCGA ATCCGAAGGT CGTAAAATCG AACAAATCAA CCTTGCCAGT

601 GGTCAGCGCG AAGCCGAAAT CCAACAATCC GAAGGCGAGG CTCAGGCTGC

651 GGTCAATGCG TCAAATGCCG AGAAAATCGC CCGCATCAAC CGCGCCAAAG

701 GTGAAGCGGA ATCCTTGCGC CTTGTTGCCG AAGCCAATGC CGAAGCCATC

751 CGTCAAATTG CCGCCGCCCT TCAAACCCAA GGCGGTGCGG ATGCGGTCAA

801 TCTGAAGATT GCGGAACAAT ACGTCGCCGC GTTCAACAAT CTTGCCAAAG

851 AAAGCAATAC GCTGATTATG CCCGCCAATG TTGCCGACAT CGGCAGCCTG

901 ATTTCTGCCG GTATGAAAAT TATCGACAGC AGCAAAACCG CCAAATAA
```

This corresponds to the amino acid sequence <SEQ ID 3050; ORF 519.a>:

```
a519.pep

1   MEFFIILLAA VVVFGFKSFV VIPQQEVHVV ERLGRFHRAL TAGLNILIPF
   51   IDRVAYRHSL KEIPLDVPSQ VCITRDNTQL TVDGIIYFQV TDPKLASYGS
  101   SNYIMAITQL AQTTLRSVIG RMELDKTFEE RDEINSTVVS ALDEAAGAWG
  151   VKVLRYEIKD LVPPQEILRS MQAQITAERE KRARIAESEG RKIEQINLAS
  201   GQREAEIQQS EGEAQAAVNA SNAEKIARIN RAKGEAESLR LVAEANAEAI
  251   RQIAAALQTQ GGADAVNLKI AEQYVAAFNN LAKESNTLIM PANVADIGSL
  301   ISAGMKIIDS SKTAK* m519/a519  ORFs 519 and 519.a showed a 99.5% identity in 199 aa overlap 10         20         30
m519.pep                       SVIGRMELDKTFEERDEINSTVVAALDEAA
                               ||||||||||||||||||||||||:|||||
a519       YFQVTDPKLASYGSSNYIMAITQLAQTTLRSVIGRMELDKTFEERDEINSTVVSALDEAA
            90        100       110       120       130       140

40         50         60         70         80         90
m519.pep   GAWGVKVLRYEIKDLVPPQEILRSMQAQITAEREKRARIAESEGRKIEQINLASGQREAE
           ||||||||||||||||||||||||||||||||||||||||||||||||||||||||||||
a519       GAWGVKVLRYEIKDLVPPQEILRSMQAQITAEREKRARIAESEGRKIEQINLASGQREAE
            150       160       170       180       190       200

100       110       120       130       140       150
m519.pep   IQQSEGEAQAAVNASNAEKIARINRAKGEAESLRLVAEANAEAIRQIAAALQTQGGADAV
           ||||||||||||||||||||||||||||||||||||||||||||||||||||||||||||
a519       IQQSEGEAQAAVNASNAEKIARINRAKGEAESLRLVAEANAEAIRQIAAALQTQGGADAV
            210       220       230       240       250       260

160       170       180       190       200
m519.pep   NLKIAEQYVAAFNNLAKESNTLIMPANVADIGSLISAGMKIIDSSKTAKX
           ||||||||||||||||||||||||||||||||||||||||||||||||||
a519       NLKIAEQYVAAFNNLAKESNTLIMPANVADIGSLISAGMKIIDSSKTAKX
            270       280       290       300       310
```

Further work revealed the DNA sequence identified in *N. meningitidis* <SEQ ID 3051>:

```
m519-1.seq
   1 ATGGAATTTT TCATTATCTT GTTGGTAGCC GTCGCCGTTT TCGGTTTCAA

51 ATCCTTTGTT GTCATCCCAC AACAGGAAGT CCACGTTGTC GAAAGGCTGG

101 GGCGTTTCCA TCGCGCCCTG ACGGcCGGTT TGAATATTTT GATTCCCTTT

151 ATCGACCGCG TCGCCTACCG CCATTCGCTG AAAGAAATCC CTTTAGACGT

201 ACCCAGCCAG GTCTGCATCA CGCGCGACAA TACGCAGCTG ACTGTTGACG
```

```
251 GCATCATCTA TTTCCAAGTA ACCGACCCCA AACTCGCCTC ATACGGTTCG

301 AGCAACTACA TTATGGCGAT TACCCAGCTT GCCCAAACGA CGCTGCGTTC

351 CGTTATCGGG CGTATGGAGT TGGACAAAAC GTTTGAAGAA CGCGACGAAA

401 TCAACAGTAC TGTTGTTGCG GCTTTGGACG AGGCGGCCGG GGCTTGGGGT

451 GTGAAGGTTT TGCGTTATGA GATTAAAGAC TTGGTTCCGC CGCAAGAAAT

501 CCTTCGCTCA ATGCAGGCGC AAATTACTGC CGAACGCGAA AAACGCGCCC

551 GTATCGCCGA ATCCGAAGGT CGTAAAATCG AACAAATCAA CCTTGCCAGT

601 GGTCAGCGCG AAGCCGAAAT CCAACAATCC GAAGGCGAGG CTCAGGCTGC

651 GGTCAATGCG TCAAATGCCG AGAAAATCGC CCGCATCAAC CGCGCCAAAG

701 GTGAAGCGGA ATCCTTGCGC CTTGTTGCCG AAGCCAATGC CGAAGCCATC

751 CGTCAAATTG CCGCCGCCCT TCAAACCCAA GGCGGTGCGG ATGCGGTCAA

801 TCTGAAGATT GCGGAACAAT ACGTCGCTGC GTTCAACAAT CTTGCCAAAG

851 AAAGCAATAC GCTGATTATG CCCGCCAATG TTGCCGACAT CGGCAGCCTG

901 ATTTCTGCCG GTATGAAAAT TATCGACAGC AGCAAAACCG CCAAATAA
```

This corresponds to the amino acid sequence <SEQ ID 3052; ORF 519-1>:

```
m519-1.
    1  MEFFIILLVA VAVFGFKSFV VIPQQEVHVV ERLGRFHRAL TAGLNILIPF

51  IDRVAYRHSL KEIPLDVPSQ VCITRDNTQL TVDGIIYFQV TDPKLASYGS

101  SNYIMAITQL AQTTLRSVIG RMELDKTFEE RDEINSTVVA ALDEAAGAWG

151  VKVLRYEIKD LVPPQEILRS MQAQITAERE KRARIAESEG RKIEQINLAS

201  GQREAEIQQS EGEAQAAVNA SNAEKIARIN RAKGEAESLR LVAEANAEAI

251  RQIAAALQTQ GGADAVNLKI AEQYVAAFNN LAKESNTLIM PANVADIGSL

301  ISAGMKIIDS SKTAK*
```

The following partial DNA sequence was identified in *N. gonorrhoeae* <SEQ ID 3053>:

```
g519-1.seq
    1  ATGGAATTTT TCATTATCTT GTTGGCAGCC GTCGCCGTTT TCGGCTTCAA

51  ATCCTTTGTC GTCATCCCCC AGCAGGAAGT CCACGTTGTC GAAAGGCTCG

101  GGCGTTTCCA TCGCGCCCTG ACGGCCGGTT TGAATATTTT GATTCCCTTT

151  ATCGACCGCG TCGCCTACCG CCATTCGCTG AAAGAAATCC CTTTAGACGT

201  ACCCAGCCAG GTCTGCATCA CGCGCGATAA TACGCAATTG ACTGTTGACG

251  GCATCATCTA TTTCCAAGTA ACCGATCCCA AACTCGCCTC ATACGGTTCG

301  AGCAACTACA TTATGGCAAT TACCCAGCTT GCCCAAACGA CGCTGCGTTC

351  CGTTATCGGG CGTATGGAGT TGGACAAAAC GTTTGAAGAA CGCGACGAAA

401  TCAACAGTAC CGTCGTCTCC GCCCTCGATG AAGCCGCCGG GGCTTGGGGT

451  GTGAAAGTCC TCCGTTACGA AATCAAGGAT TTGGTTCCGC CGCAAGAAAT

501  CCTTCGCGCA ATGCAGGCAC AAATTACCGC CGAACGCGAA AAACGCGCCC

551  GTATTGCCGA ATCCGAAGGC CGTAAAATCG AACAAATCAA CCTTGCCAGT

601  GGTCAGCGTG AAGCCGAAAT CCAACAATCC GAAGGCGAGG CTCAGGCTGC
```

-continued

```
651  GGTCAATGCG TCCAATGCCG AGAAAATCGC CCGCATCAAC CGCGCCAAAG

701  GCGAAGCGGA ATCCCTGCGC CTTGTTGCCG AAGCCAATGC CGAAGCCATC

751  CGTCAAATTG CCGCCGCCCT TCAAACCCAA GGCGGGGCGG ATGCGGTCAA

801  TCTGAAGATT GCGGAACAAT ACGTAGCCGC GTTCAACAAT CTTGCCAAAG

851  AAAGCAATAC GCTGATTATG CCCGCCAATG TTGCCGACAT CGGCAGCCTG

901  ATTTCTGCCG GCATGAAAAT TATCGACAGC AGCAAAACCG CCAAATAA
```

This corresponds to the amino acid sequence <SEQ ID 3054; ORF 519-1.ng>:

```
g519-1.pep

1  MEFFIILLAA VAVFGFKSFV VIPQQEVHVV ERLGRFHRAL TAGLNILIPF

51  IDRVAYRHSL KEIPLDVPSQ VCITRDNTQL TVDGIIYFQV TDPKLASYGS

101  SNYIMAITQL AQTTLRSVIG RMELDKTFEE RDEINSTVVS ALDEAAGAWG

151  VKVLRYEIKD LVPPQEILRA MQAQITAERE KRARIAESEG RKIEQINLAS

201  GQREAEIQQS EGEAQAAVNA SNAEKIARIN RAKGEAESLR LVAEANAEAI

251  RQIAAALQTQ GGADAVNLKI AEQYVAAFNN LAKESNTLIM PANVADIGSL

301  ISAGMKIIDS SKTAK* m519-1/g519-1  99.0% identity in 315 aa overlap 10         20         30         40         50         60
g519-1.pep  MEFFIILLAAVAVFGFKSFVVIPQQEVHVVERLGRFHRALTAGLNILIPFIDRVAYRHSL
            ||||||||:|||||||||||||||||||||||||||||||||||||||||||||||||||
m519-1      MEFFIILLVAVAVFGFKSFVVIPQQEVHVVERLGRFHRALTAGLNILIPFIDRVAYRHSL
                    10         20         30         40         50         60

70         80         90        100        110        120
g519-1.pep  KEIPLDVPSQVCITRDNTQLTVDGIIYFQVTDPKLASYGSSNYIMAITQLAQTTLRSVIG
            ||||||||||||||||||||||||||||||||||||||||||||||||||||||||||||
m519-1      KEIPLDVPSQVCITRDNTQLTVDGIIYFQVTDPKLASYGSSNYIMAITQLAQTTLRSVIG
                    70         80         90        100        110        120

130        140        150        160        170        180
g519-1.pep  RMELDKTFEERDEINSTVVSALDEAAGAWGVKVLRYEIKDLVPPQEILRAMQAQITAERE
            |||||||||||||||||||:||||||||||||||||||||||||||||||:|||||||||
m519-1      RMELDKTFEERDEINSTVVAALDEAAGAWGVKVLRYEIKDLVPPQEILRSMQAQITAERE
                   130        140        150        160        170        180

190        200        210        220        230        240
g519-1.pep  KRARIAESEGRKIEQINLASGQREAEIQQSEGEAQAAVNASNAEKIARINRAKGEAESLR
            ||||||||||||||||||||||||||||||||||||||||||||||||||||||||||||
m519-1      KRARIAESEGRKIEQINLASGQREAEIQQSEGEAQAAVNASNAEKIARINRAKGEAESLR
                   190        200        210        220        230        240

250        260        270        280        290        300
g519-1.pep  LVAEANAEAIRQIAAALQTQGGADAVNLKIAEQYVAAFNNLAKESNTLIMPANVADIGSL
            ||||||||||||||||||||||||||||||||||||||||||||||||||||||||||||
m519-1      LVAEANAEAIRQIAAALQTQGGADAVNLKIAEQYVAAFNNLAKESNTLIMPANVADIGSL
                   250        260        270        280        290        300

310
g519-1.pep  ISAGMKIIDSSKTAKX
            ||||||||||||||||
m519-1      ISAGMKIIDSSKTAKX
                   310
```

The following DNA sequence was identified in *N. meningitidis* <SEQ ID 3055>:

```
a519-1.seq
     1  ATGGAATTTT TCATTATCTT GCTGGCAGCC GTCGTTGTTT TCGGCTTCAA

51  ATCCTTTGTT GTCATCCCAC AGCAGGAAGT CCACGTTGTC GAAAGGCTCG

101  GGCGTTTCCA TCGCGCCCTG ACGGCCGGTT TGAATATTTT GATTCCCTTT

151  ATCGACCGCG TCGCCTACCG CCATTCGCTG AAAGAAATCC CTTTAGACGT
```

```
201  ACCCAGCCAG GTCTGCATCA CGCGCGACAA TACGCAGCTG ACTGTTGACG

251  GTATCATCTA TTTCCAAGTA ACCGACCCCA AACTCGCCTC ATACGGTTCG

301  AGCAACTACA TTATGGCGAT TACCCAGCTT GCCCAAACGA CGCTGCGTTC

351  CGTTATCGGG CGTATGGAAT TGGACAAAAC GTTTGAAGAA CGCGACGAAA

401  TCAACAGCAC CGTCGTCTCC GCCCTCGATG AAGCCGCCGG AGCTTGGGGT

451  GTGAAGGTTT TGCGTTATGA GATTAAAGAC TTGGTTCCGC CGCAAGAAAT

501  CCTTCGCTCA ATGCAGGCGC AAATTACTGC TGAACGCGAA AAACGCGCCC

551  GTATCGCCGA ATCCGAAGGT CGTAAAATCG AACAAATCAA CCTTGCCAGT

601  GGTCAGCGCG AAGCCGAAAT CCAACAATCC GAAGGCGAGG CTCAGGCTGC

651  GGTCAATGCG TCAAATGCCG AGAAAATCGC CCGCATCAAC CGCGCCAAAG

701  GTGAAGCGGA ATCCTTGCGC CTTGTTGCCG AAGCCAATGC CGAAGCCATC

751  CGTCAAATTG CCGCCGCCCT TCAAACCCAA GGCGGTGCGG ATGCGGTCAA

801  TCTGAAGATT GCGGAACAAT ACGTCGCCGC GTTCAACAAT CTTGCCAAAG

851  AAAGCAATAC GCTGATTATG CCCGCCAATG TTGCCGACAT CGGCAGCCTG

901  ATTTCTGCCG GTATGAAAAT TATCGACAGC AGCAAAACCG CCAAATAA
```

This corresponds to the amino acid sequence <SEQ ID 3056; ORF 519-1.a>:

```
a519-1.pep.

1   MEFFIILLAA VVVFGFKSFV VIPQQEVHVV ERLGRFHRAL TAGLNILIPF

51   IDRVAYRHSL KEIPLDVPSQ VCITRDNTQL TVDGIIYFQV TDPKLASYGS

101   SNYIMAITQL AQTTLRSVIG RMELDKTFEE RDEINSTVVS ALDEAAGAWG

151   VKVLRYEIKD LVPPQEILRS MQAQITAERE KRARIAESEG RKIEQINLAS

201   GQREAEIQQS EGEAQAAVNA SNAEKIARIN RAKGEAESLR LVAEANAEAI

251   RQIAAALQTQ GGADAVNLKI AEQYVAAFNN LAKESNTLIM PANVADIGSL

301   ISAGMKIIDS SKTAK* m519-1/a519-1  ORFs 519-1 and 519-1.a showed a 99.0% identity in 315 aa overlap 10         20         30         40         50         60
a519-1.pep  MEFFIILLAAVVVFGFKSFVVIPQQEVHVVERLGRFHRALTAGLNILIPFIDRVAYRHSL
            |||||||:||:|||||||||||||||||||||||||||||||||||||||||||||||||
m519-1      MEFFIILLVAVAVFGFKSFVVIPQQEVHVVERLGRFHRALTAGLNILIPFIDRVAYRHSL
                  10         20         30         40         50         60

70         80         90        100        110        120
a519-1.pep  KEIPLDVPSQVCITRDNTQLTVDGIIYFQVTDPKLASYGSSNYIMAITQLAQTTLRSVIG
            ||||||||||||||||||||||||||||||||||||||||||||||||||||||||||||
m519-1      KEIPLDVPSQVCITRDNTQLTVDGIIYFQVTDPKLASYGSSNYIMAITQLAQTTLRSVIG
                  70         80         90        100        110        120

130        140        150        160        170        180
a519-1.pep  RMELDKTFEERDEINSTVVSALDEAAGAWGVKVLRYEIKDLVPPQEILRSMQAQITAERE
            ||||||||||||||||||||:|||||||||||||||||||||||||||||||||||||||
m519-1      RMELDKTFEERDEINSTVVAALDEAAGAWGVKVLRYEIKDLVPPQEILRSMQAQITAERE
                 130        140        150        160        170        180

190        200        210        220        230        240
a519-1.pep  KRARIAESEGRKIEQINLASGQREAEIQQSEGEAQAAVNASNAEKIARINRAKGEAESLR
            ||||||||||||||||||||||||||||||||||||||||||||||||||||||||||||
m519-1      KRARIAESEGRKIEQINLASGQREAEIQQSEGEAQAAVNASNAEKIARINRAKGEAESLR
                 190        200        210        220        230        240

250        260        270        280        290        300
a519-1.pep  LVAEANAEAIRQIAAALQTQGGADAVNLKIAEQYVAAFNNLAKESNTLIMPANVADIGSL
            ||||||||||||||||||||||||||||||||||||||||||||||||||||||||||||
m519-1      LVAEANAEAIRQIAAALQTQGGADAVNLKIAEQYVAAFNNLAKESNTLIMPANVADIGSL
                 250        260        270        280        290        300
```

```
                      310
a519-1.pep   ISAGMKIIDSSKTAKX
             ||||||||||||||||
m519-1       ISAGMKIIDSSKTAKX
                      310
```

576 and 576-1 gnm22.seq
The following partial DNA sequence was identified in *N. meningitidis* <SEQ ID 3057>:

```
m576.seq . . . (partial)
    1 . . . ATGCAGCAGG CAAGCTATGC GATGGGCGTG GACATCGGAC GCTCCCTGAA

51        GCAAATGAAG GAACAGGGCG CGGAAATCGA TTTGAAAGTC TTTACCGAAG

101        CCATGCAGGC AGTGTATGAC GGCAAAGAAA TCAAAATGAC CGAAGAGCAG

151        GCTCAGGAAG TCATGATGAA ATTCCTTCAG GAACAACAGG CTAAAGCCGT

201        AGAAAAACAC AAGGCGGACG CGAAGGCCAA TAAAGAAAAA GGCGAAGCCT

251        TTCTGAAAGA AAATGCCGCC AAAGACGGCG TGAAGACCAC TGCTTCCGGC

301        CTGCAATACA AAATCACCAA ACAGGGCGAA GGCAAACAGC CGACCAAAGA

351        CGACATCGTT ACCGTGGAAT ACGAAGGCCG CCTGATTGAC GGTACGGTAT

401        TCGACAGCAG CAAAGCCAAC GGCGGCCCGG TCACCTTCCC TTTGAGCCAA

451        GTGATTCCGG GTTGGACCGA AGgCGTACAG CTTCTGAAAG AAGGCGGCGA

501        AGCCACGTTC TACATCCCGT CCAACCTTGC CTACCGCGAA CAGGGTGCGG

551        GCGACAAAAT CGGTCCGAAC GCCACTTTGG TATTTGATGT GAAACTGGTC

601        AAAATCGGCG CACCCGAAAA CGCGCCCGCC AAGCAGCCGG CTCAAGTCGA

651        CATCAAAAAA GTAAATTAA
```

This corresponds to the amino acid sequence <SEQ ID 3058; ORF 576>:

```
m576.pep . . . (partial)
    1 . . . MQQASYAMGV DIGRSLKQMK EQGAEIDLKV FTEAMQAVYD GKEIKMTEEQ

51        AQEVMMKFLQ EQQAKAVEKH KADAKANKEK GEAFLKENAA KDGVKTTASG

101        LQYKITKQGE GKQPTKDDIV TVEYEGRLID GTVFDSSKAN GGPVTFPLSQ

151        VIPGWTEGVQ LLKEGGEATF YIPSNLAYRE QGAGDKIGPN ATLVFDVKLV

201        KIGAPENAPA KQPAQVDIKK VN*
```

The following partial DNA sequence was identified in *N. gonorrhoeae* <SEQ ID 3059>:

```
g576.seq . . . (partial)
    1 . . . atgggcgtgg acatcggacg ctccctgaaa caaatgaagg aacagggcgc 51        ggaaatcgat ttgaaagtct ttaccgatgc catgcaggca gtgtatgacg 101        gcaaagaaat caaaatgacc gaagagcagg cccaggaagt gatgatgaaa 151        ttcctgcagg agcagcaggc taaagccgta gaaaaacaca aggcggatgc 201        gaaggccaac aaagaaaaag gcgaagcctt cctgaaggaa aatgccgccg 251        aagacggcgt gaagaccact gcttccggtc tgcagtacaa aatcaccaaa 301        cagggtgaag gcaaacagcc gacaaaagac gacatcgtta ccgtggaata 351        cgaaggccgc ctgattgacg gtaccgtatt cgacagcagc aaagccaacg
```

-continued

```
401      gcggcccggc caccttccct ttgagccaag tgattccggg ttggaccgaa 451      ggcgtacggc ttctgaaaga aggcggcgaa gccacgttct acatcccgtc 501      caaccttgcc taccgcgaac agggtgcggg cgaaaaaatc ggtccgaacg 551      ccactttggt atttgacgtg aaactggtca aaatcggcgc acccgaaaac 601      gcgcccgcca agcagccgga tcaagtcgac atcaaaaaag taaattaa
```

This corresponds to the amino acid sequence <SEQ ID 3060; ORF 576.ng>:

```
g576.pep . . . (partial)
  1 . . . MGVDIGRSLK QMKEQGAEID LKVFTDAMQA VYDGKEIKMT EEQAQEVMMK

51      FLQEQQAKAV EKHKADAKAN KEKGEAFLKE NAAEDGVKTT ASGLQYKITK

101      QGEGKQPTKD DIVTVEYEGR LIDGTVFDSS KANGGPATFP LSQVIPGWTE

151      GVRLLKEGGE ATFYIPSNLA YREQGAGEKI GPNATLVFDV KLVKIGAPEN

201      APAKQPDQVD IKKVN*
```

Computer analysis of this amino acid sequence gave the following results:
Homology with a Predicted ORF from *N. gonorrhoeae*

```
   m576/g576 97.2% identity in 215 aa overlap 10         20         30         40         50         60
   m576.pep MQQASYAMGVDIGRSLKQMKEQGAEIDLKVFTEAMQAVYDGKEIKMTEEQAQEVMMKFLQ
                   ||||||||||||||||||||||:||||||||||||||||||||||||||||
   g576             MGVDIGRSLKQMKEQGAEIDLKVFTDAMQAVYDGKEIKMTEEQAQEVMMKFLQ
                           10         20         30         40         50

70         80         90        100        110        120
   m576.pep EQQAKAVEKHKADAKANKEKGEAFLKENAAKDGVKTTASGLQYKITKQGEGKQPTKDDIV
            ||||||||||||||||||||||||||||||:|||||||||||||||||||||||||||
   g576     EQQAKAVEKHKADAKANKEKGEAFLKENAAEDGVKTTASGLQYKITKQGEGKQPTKDDIV
                  60         70         80         90        100        110

130        140        150        160        170        180
   m576.pep TVEYEGRLIDGTVFDSSKANGGPVTFPLSQVIPGWTEGVQLLKEGGEATFYIPSNLAYRE
            ||||||||||||||||||||||:|||||||||||||||:|||||||||||||||||||
   g576     TVEYEGRLIDGTVFDSSKANGGPATFPLSQVIPGWTEGVRLLKEGGEATFYIPSNLAYRE
                 120        130        140        150        160        170

190        200        210        220
   m576.pep QGAGDKIGPNATLVFDVKLVKIGAPENAPAKQPAQVDIKKVNX
            ||||:|||||||||||||||||||||||||||| ||||||||
   g576     QGAGEKIGPNATLVFDVKLVKIGAPENAPAKQPDQVDIKKVNX
                 180        190        200        210
```

The following partial DNA sequence was identified in *N. meningitidis* <SEQ ID 3061>:

```
a576.seq
   1    ATGAACACCA TTTTCAAAAT CAGCGCACTG ACCCTTTCCG CCGCTTTGGC

51    ACTTTCCGCC TGCGGCAAAA AAGAAGCCGC CCCCGCATCT GCATCCGAAC

101    CTGCCGCCGC TTCTTCCGCG CAGGGCGACA CCTCTTCGAT CGGCAGCACG

151    ATGCAGCAGG CAAGCTATGC GATGGGCGTG GACATCGGAC GCTCCCTGAA

201    GCAAATGAAG GAACAGGGCG CGGAAATCGA TTTGAAAGTC TTTACCGAAG

251    CCATGCAGGC AGTGTATGAC GGCAAAGAAA TCAAAATGAC CGAAGAGCAG

301    GCTCAGGAAG TCATGATGAA ATTCCTTCAG GAACAACAGG CTAAAGCCGT

351    AGAAAAACAC AAGGCGGACG CGAAGGCCAA TAAAGAAAAA GGCGAAGCCT

401    TTCTGAAAGA AAATGCCGCC AAAGACGGCG TGAAGACCAC TGCTTCCGGC
```

-continued

```
451  CTGCAATACA AAATCACCAA ACAGGGCGAA GGCAAACAGC CGACCAAAGA

501  CGACATCGTT ACCGTGGAAT ACGAAGGCCG CCTGATTGAC GGTACGGTAT

551  TCGACAGCAG CAAAGCCAAC GGCGGCCCGG TCACCTTCCC TTTGAGCCAA

601  GTGATTCTGG GTTGGACCGA AGGCGTACAG CTTCTGAAAG AAGGCGGCGA

651  AGCCACGTTC TACATCCCGT CCAACCTTGC CTACCGCGAA CAGGGTGCGG

701  GCGACAAAAT CGGCCCGAAC GCCACTTTGG TATTTGATGT GAAACTGGTC

751  AAAATCGGCG CACCCGAAAA CGCGCCCGCC AAGCAGCCGG CTCAAGTCGA

801  CATCAAAAAA GTAAATTAA
```

15

This corresponds to the amino acid sequence <SEQ ID 3062; ORF 576.a>:

```
a576.pep

1   MNTIFKISAL TLSAALALSA CGKKEAAPAS ASEPAAASSA QGDTSSIGST

51   MQQASYAMGV DIGRSLKQMK EQGAEIDLKV FTEAMQAVYD GKEIKMTEEQ

101   AQEVMMKFLQ EQQAKAVEKH KADAKANKEK GEAFLKENAA KDGVKTTASG

151   LQYKITKQGE GKQPTKDDIV TVEYEGRLID GTVFDSSKAN GGPVTFPLSQ

201   VILGWTEGVQ LLKEGGEATF YIPSNLAYRE QGAGDKIGPN ATLVFDVKLV

251   KIGAPENAPA KQPAQVDIKK VN* m576/a576   99.5% identity in 222 aa overlap 10         20         30
m576.pep                    MQQASYAMGVDIGRSLKQMKEQGAEIDLKV
                            ||||||||||||||||||||||||||||||
a576        CGKKEAAPASASEPAAASSAQGDTSSIGSTMQQASYAMGVDIGRSLKQMKEQGAEIDLKV
                    30        40        50        60        70        80

40        50        60        70        80        90
m576.pep    FTEAMQAVYDGKEIKMTEEQAQEVMMKFLQEQQAKAVEKHKADAKANKEKGEAFLKENAA
            ||||||||||||||||||||||||||||||||||||||||||||||||||||||||||||
a576        FTEAMQAVYDGKEIKMTEEQAQEVMMKFLQEQQAKAVEKHKADAKANKEKGEAFLKENAA
                    90        100       110       120       130       140

100       110       120       130       140       150
m576.pep    KDGVKITASGLQYKITKQGEGKQPTKDDIVTVEYEGRLIDGTVFDSSKANGGPVTFPLSQ
            ||||||||||||||||||||||||||||||||||||||||||||||||||||||||||||
a576        KDGVKITASGLQYKITKQGEGKQPTKDDIVTVEYEGRLIDGTVFDSSKANGGPVTFPLSQ
                    150       160       170       180       190       200

160       170       180       190       200       210
m576.pep    VIPGWTEGVQLLKEGGEATFYIPSNLAYREQGAGDKIGPNATLVFDVKLVKIGAPENAPA
            || |||||||||||||||||||||||||||||||||||||||||||||||||||||||||
a576        VILGWTEGVQLLKEGGEATFYIPSNLAYREQGAGDKIGPNATLVFDVKLVKIGAPENAPA
                    210       220       230       240       250       260

220
m576.pep    KQPAQVDIKKVNX
            |||||||||||||
a576        KQPAQVDIKKVNX
                    270
```

The following partial DNA sequence was identified in N. meningitidis <SEQ ID 3063>:

```
m576-1.seq
     1   ATGAACACCA TTTTCAAAAT CAGCGCACTG ACCCTTTCCG CCGCTTTGGC

51   ACTTTCCGCC TGCGGCAAAA AAGAAGCCGC CCCCGCATCT GCATCCGAAC

101   CTGCCGCCGC TTCTTCCGCG CAGGGCGACA CCTCTTCGAT CGGCAGCACG

151   ATGCAGCAGG CAAGCTATGC GATGGGCGTG GACATCGGAC GCTCCCTGAA
```

```
201   GCAAATGAAG GAACAGGGCG CGGAAATCGA TTTGAAAGTC TTTACCGAAG

251   CCATGCAGGC AGTGTATGAC GGCAAAGAAA TCAAAATGAC CGAAGAGCAG

301   GCTCAGGAAG TCATGATGAA ATTCCTTCAG GAACAACAGG CTAAAGCCGT

351   AGAAAAACAC AAGGCGGACG CGAAGGCCAA TAAAGAAAAA GGCGAAGCCT

401   TTCTGAAAGA AAATGCCGCC AAAGACGGCG TGAAGACCAC TGCTTCCGGC

451   CTGCAATACA AAATCACCAA ACAGGGCGAA GGCAAACAGC CGACCAAAGA

501   CGACATCGTT ACCGTGGAAT ACGAAGGCCG CCTGATTGAC GGTACGGTAT

551   TCGACAGCAG CAAAGCCAAC GGCGGCCCGG TCACCTTCCC TTTGAGCCAA

601   GTGATTCCGG GTTGGACCGA AGGCGTACAG CTTCTGAAAG AAGGCGGCGA

651   AGCCACGTTC TACATCCCGT CCAACCTTGC CTACCGCGAA CAGGGTGCGG

701   GCGACAAAAT CGGTCCGAAC GCCACTTTGG TATTTGATGT GAAACTGGTC

751   AAAATCGGCG CACCCGAAAA CGCGCCCGCC AAGCAGCCGG CTCAAGTCGA

801   CATCAAAAAA GTAAATTAA
```

This corresponds to the amino acid sequence <SEQ ID 3064; ORF 576-1>:

```
m576-1.pep.
    1   MNTIFKISAL TLSAALALSA CGKKEAAPAS ASEPAAASSA QGDTSSIGST

51   MQQASYAMGV DIGRSLKQMK EQGAEIDLKV FTEAMQAVYD GKEIKMTEEQ

101   AQEVMMKFLQ EQQAKAVEKH KADAKANKEK GEAFLKENAA KDGVKTTASG

151   LQYKITKQGE GKQPTKDDIV TVEYEGRLID GTVFDSSKAN GGPVTFPLSQ

201   VIPGWTEGVQ LLKEGGEATF YIPSNLAYRE QGAGDKIGPN ATLVFDVKLV

251   KIGAPENAPA KQPAQVDIKK VN*
```

The following partial DNA sequence was identified in *N. gonorrhoeae* <SEQ ID 3065>:

```
g576-1.seq
    1   ATGAACACCA TTTTCAAAAT CAGCGCACTG ACCCTTTCCG CCGCTTTGGC

51   ACTTTCCGCC TGCGGCAAAA AAGAAGCCGC CCCCGCATCT GCATCCGAAC

101   CTGCCGCCGC TTCTGCCGCG CAGGGCGACA CCTCTTCAAT CGGCAGCACG

151   ATGCAGCAGG CAAGCTATGC AATGGGCGTG GACATCGGAC GCTCCCTGAA

201   ACAAATGAAG GAACAGGGCG CGGAAATCGA TTTGAAAGTC TTTACCGATG

251   CCATGCAGGC AGTGTATGAC GGCAAAGAAA TCAAAATGAC CGAAGAGCAG

301   GCCCAGGAAG TGATGATGAA ATTCCTGCAG GAGCAGCAGG CTAAAGCCGT

351   AGAAAAACAC AAGGCGGATG CGAAGGCCAA CAAAGAAAAA GGCGAAGCCT

401   TCCTGAAGGA AAATGCCGCC AAAGACGGCG TGAAGACCAC TGCTTCCGGT

451   CTGCAGTACA AAATCACCAA ACAGGGTGAA GGCAAACAGC CGACAAAAGA

501   CGACATCGTT ACCGTGGAAT ACGAAGGCCG CCTGATTGAC GGTACCGTAT

551   TCGACAGCAG CAAAGCCAAC GGCGGCCCGG CCACCTTCCC TTTGAGCCAA

601   GTGATTCCGG GTTGGACCGA AGGCGTACGG CTTCTGAAAG AAGGCGGCGA

651   AGCCACGTTC TACATCCCGT CCAACCTTGC CTACCGCGAA CAGGGTGCGG

701   GCGAAAAAAT CGGTCCGAAC GCCACTTTGG TATTTGACGT GAAACTGGTC
```

```
    751 AAAATCGGCG CACCCGAAAA CGCGCCCGCC AAGCAGCCGG ATCAAGTCGA

801 CATCAAAAAA GTAAATTAA
```

This corresponds to the amino acid sequence <SEQ ID 3066; ORF 576-1.ng>:

```
g576-1.pep

1 MNTIFKISAL TLSAALALSA CGKKEAAPAS ASEPAAASAA QGDTSSIGST

51 MQQASYAMGV DIGRSLKQMK EQGAEIDLKV FTDAMQAVYD GKEIKMTEEQ

101 AQEVMMKFLQ EQQAKAVEKH KADAKANKEK GEAFLKENAA KDGVKTTASG

151 LQYKITKQGE GKQPTKDDIV TVEYEGRLID GTVFDSSKAN GGPATFPLSQ

201 VIPGWTEGVR LLKEGGEATF YIPSNLAYRE QGAGEKIGPN ATLVFDVKLV

251 KIGAPENAPA KQPDQVDIKK VN* g576-1/m576-1 ORFa 576-1 and 567-1.a showed a 97.8% identity in 272 aa overlap 10         20         30         40         50         60
g576-1.pep    MNTIFKISALTLSAALALSACGKKEAAPASASEPAAASAAQGDTSSIGSTMQQASYAMGV
              ||||||||||||||||||||||||||||||||||||||:|||||||||||||||||||||
m576-1        MNTIFKISALTLSAALALSACGKKEAAPASASEPAAASSAQGDTSSIGSTMQQASYAMGV
                      10         20         30         40         50         60

70         80         90        100        110        120
g576-1.pep    DIGRSLKQMKEQGAEIDLKVFTDAMQAVYDGKEIKMTEEQAQEVMMKFLQEQQAKAVEKH
              |||||||||||||||||||||:||||||||||||||||||||||||||||||||||||||
m576-1        DIGRSLKQMKEQGAEIDLKVFTEAMQAVYDGKEIKMTEEQAQEVMMKFLQEQQAKAVEKH
                      70         80         90        100        110        120

130        140        150        160        170        180
g576-1.pep    KADAKANKEKGEAFLKENAAKDGVKTTASGLQYKITKQGEGKQPTKDDIVTVEYEGRLID
              ||||||||||||||||||||||||||||||||||||||||||||||||||||||||||||
m576-1        KADAKANKEKGEAFLKENAAKDGVKTTASGLQYKITKQGEGKQPTKDDIVTVEYEGRLID
                     130        140        150        160        170        180

190        200        210        220        230        240
g576-1.pep    GTVFDSSKANGGPATFPLSQVIPGWTEGVRLLKEGGEATFYIPSNLAYREQGAGEKIGPN
              |||||||||||:||||||||||||||||||:|||||||||||||||||||||||:|||||
m576-1        GTVFDSSKANGGPVTFPLSQVIPGWTEGVQLLKEGGEATFYIPSNLAYREQGAGDKIGPN
                     190        200        210        220        230        240

250        260        270
g576-1.pep    ATLVFDVKLVKIGAPENAPAKQPDQVDIKKVNX
              |||||||||||||||||||||||:||||||||
m576-1        ATLVFDVKLVKIGAPENAPAKQPAQVDIKKVNX
                     250        260        270
```

The following DNA sequence was identified in *N. meningitidis* <SEQ ID 3067>:

```
a576-1.seq
      1 ATGAACACCA TTTTCAAAAT CAGCGCACTG ACCCTTTCCG CCGCTTTGGC

51 ACTTTCCGCC TGCGGCAAAA AAGAAGCCGC CCCCGCATCT GCATCCGAAC

101 CTGCCGCCGC TTCTTCCGCG CAGGGCGACA CCTCTTCGAT CGGCAGCACG

151 ATGCAGCAGG CAAGCTATGC GATGGGCGTG ACATCGGAC GCTCCCTGAA

201 GCAAATGAAG GAACAGGGCG CGGAAATCGA TTTGAAAGTC TTTACCGAAG

251 CCATGCAGGC AGTGTATGAC GGCAAAGAAA TCAAAATGAC CGAAGAGCAG

301 GCTCAGGAAG TCATGATGAA ATTCCTTCAG GAACAACAGG CTAAAGCCGT

351 AGAAAAACAC AAGGCGGACG CGAAGGCCAA TAAAGAAAAA GGCGAAGCCT

401 TTCTGAAAGA AAATGCCGCC AAAGACGGCG TGAAGACCAC TGCTTCCGGC

451 CTGCAATACA AAATCACCAA ACAGGGCGAA GGCAAACAGC CGACCAAAGA

501 CGACATCGTT ACCGTGGAAT ACGAAGGCCG CCTGATTGAC GGTACGGTAT
```

-continued

```
551  TCGACAGCAG CAAAGCCAAC GGCGGCCCGG TCACCTTCCC TTTGAGCCAA

601  GTGATTCTGG GTTGGACCGA AGGCGTACAG CTTCTGAAAG AAGGCGGCGA

651  AGCCACGTTC TACATCCCGT CCAACCTTGC CTACCGCGAA CAGGGTGCGG

701  GCGACAAAAT CGGCCCGAAC GCCACTTTGG TATTTGATGT GAAACTGGTC

751  AAAATCGGCG CACCCGAAAA CGCGCCCGCC AAGCAGCCGG CTCAAGTCGA

801  CATCAAAAAA GTAAATTAA
```

This corresponds to the amino acid sequence <SEQ ID 3068; ORF 576-1.a>:

```
a576-1.pep

1  MNTIFKISAL TLSAALALSA CGKKEAAPAS ASEPAAASSA QGDTSSIGST

51  MQQASYAMGV DIGRSLKQMK EQGAEIDLKV FTEAMQAVYD GKEIKMTEEQ

101  AQEVMMKFLQ EQQAKAVEKH KADAKANKEK GEAFLKENAA KDGVKTTASG

151  LQYKITKQGE GKQPTKDDIV TVEYEGRLID GTVFDSSKAN GGPVTFPLSQ

201  VIPGWTEGVQ LLKEGGEATF YIPSNLAYRE QGAGDKIGPN ATLVFDVKLV

251  KIGAPENAPA KQPAQVDIKK VN* a576-1/m576-1 99.6% identity in 272 aa overlap
                  10        20        30        40        50        60
a576-1.pep MNTIFKISALTLSAALALSACGKKEAAPASASEPAAASSAQGDTSSIGSTMQQASYAMGV
           ||||||||||||||||||||||||||||||||||||||||||||||||||||||||||||
m576-1     MNTIFKISALTLSAALALSACGKKEAAPASASEPAAASSAQGDTSSIGSTMQQASYAMGV
                  10        20        30        40        50        60
                  70        80        90       100       110       120
a576-1.pep DIGRSLKQMKEQGAEIDLKVFTEAMQAVYDGKEIKMTEEQAQEVMMKFLQEQQAKAVEKH
           ||||||||||||||||||||||||||||||||||||||||||||||||||||||||||||
m576-1     DIGRSLKQMKEQGAEIDLKVFTEAMQAVYDGKEIKMTEEQAQEVMMKFLQEQQAKAVEKH
                  70        80        90       100       110       120
                 130       140       150       160       170       180
a576-1.pep KADAKANKEKGEAFLKENAAKDGVKTTASGLQYKITKQGEGKQPTKDDIVTVEYEGRLID
           ||||||||||||||||||||||||||||||||||||||||||||||||||||||||||||
m576-1     KADAKANKEKGEAFLKENAAKDGVKTTASGLQYKITKQGEGKQPTKDDIVTVEYEGRLID
                 130       140       150       160       170       180
                 190       200       210       220       230       240
a576-1.pep GTVFDSSKANGGPVTFPLSQVILGWTEGVQLLKEGGEATFYIPSNLAYREQGAGDKIGPN
           ||||||||||||||||||||||||| ||||||||||||||||||||||||||||||||||
m576-1     GTVFDSSKANGGPVTFPLSQVIPGWTEGVQLLKEGGEATFYIPSNLAYREQGAGDKIGPN
                 190       200       210       220       230       240
                 250       260       270
a576-1.pep ATLVFDVKLVKIGAPENAPAKQPAQVDIKKVNX
           ||||||||||||||||||||||||||||||||
m576-1     ATLVFDVKLVKIGAPENAPAKQPAQVDIKKVNX
                 250       260       270
```

919 gnm43.seq

The following partial DNA sequence was identified in N. meningitidis <SEQ ID 3069>:

```
m919.seq
    1  ATGAAAAAAT ACCTATTCCG CGCCGCCCTG TACGGCATCG CCGCCGCCAT

51  CCTCGCCGCC TGCCAAAGCA AGAGCATCCA AACCTTTCCG CAACCCGACA

101  CATCCGTCAT CAACGGCCCG GACCGGCCGG TCGGCATCCC CGACCCCGCC

151  GGAACGACGG TCGGCGGCCG CGGGGCCGTC TATACCGTTG TACCGCACCT

201  GTCCCTGCCC CACTGGGCGG CGCAGGATTT CGCCAAAAGC CTGCAATCCT

251  TCCGCCTCGG CTGCGCCAAT TTGAAAAACC GCCAAGGCTG GCAGGATGTG

301  TGCGCCCAAG CCTTTCAAAC CCCCGTCCAT TCCTTTCAGG CAAAACAGTT
```

```
 351 TTTTGAACGC TATTTCACGC CGTGGCAGGT TGCAGGCAAC GGAAGCCTTG

401 CCGGTACGGT TACCGGCTAT TACGAACCGG TGCTGAAGGG CGACGACAGG

451 CGGACGGCAC AAGCCCGCTT CCCGATTTAC GGTATTCCCG ACGATTTTAT

501 CTCCGTCCCC CTGCCTGCCG GTTTGCGGAG CGGAAAAGCC CTTGTCCGCA

551 TCAGGCAGAC GGGAAAAAAC AGCGGCACAA TCGACAATAC CGGCGGCACA

601 CATACCGCCG ACCTCTCCcG ATTCCCCATC ACCGCGCGCA CAACAGCAAT

651 CAAAGGCAGG TTTGAAGGAA GCCGCTTCCT CCCCTACCAC ACGCGCAACC

701 AAATCAACGG CGGCGCGCTT GACGGCAAAG CCCCGATACT CGGTTACGCC

751 GAAGACCCTG TCGAACTTTT TTTTATGCAC ATCCAAGGCT CGGGCCGTCT

801 GAAAACCCCG TCCGGCAAAT ACATCCGCAT CGGCTATGCC GACAAAAACG

851 AACATCCyTA CGTTTCCATC GGACGCTATA TGGCGGATAA GGGCTACCTC

901 AAACTCGGAC AAACCTCCAT GCAGGGCATT AAGTCTTATA TGCGGCAAAA

951 TCCGCAACGC CTCGCCGAAG TTTTGGGTCA AAACCCCAGC TATATCTTTT

1001 TCCGCGAGCT TGCCGGAAGC AGCAATGACG GCCCTGTCGG CGCACTGGGC

1051 ACGCCGCTGA TGGGGGAATA TGCCGGCGCA GTCGACCGGC ACTACATTAC

1101 CTTGGGTGCG CCCTTATTTG TCGCCACCGC CCATCCGGTT ACCCGCAAAG

1151 CCCTCAACCG CCTGATTATG GCGCAGGATA CCGGCAGCGC GATTAAAGGC

1201 GCGGTGCGCG TGGATTATTT TTGGGGATAC GGCGACGAAG CCGGCGAACT

1251 TGCCGGCAAA CAGAAAACCA CGGGATATGT CTGGCAGCTC CTACCCAACG

1301 GTATGAAGCC CGAATACCGc CCGTAA
```

This corresponds to the amino acid sequence <SEQ ID 3070; ORF 919>:

```
m919.pep
   1 MKKYLFRAAL YGIAAAILAA CQSKSIQTFP QPDTSVINGP DRPVGIPDPA

51 GTTVGGGGAV YTVVPHLSLP HWAAQDFAKS LQSFRLGCAN LKNRQGWQDV

101 CAQAFQTPVH SFQAKQFFER YFTPWQVAGN GSLAGTVTGY YEPVLKGDDR

151 RTAQARFPIY GIPDDFISVP LPAGLRSGKA LVRIRQTGKN SGTIDNTGGT

201 HTADLSRFPI TARTTAIKGR FEGSRFLPYH TRNQINGGAL DGKAPILGYA

251 EDPVELFFMH IQGSGRLKTP SGKYIRIGYA DKNEHPYVSI GRYMADKGYL

301 KLGQTSMQGI KSYMRQNPQR LAEVLGQNPS YIFFRELAGS SNDGPVGALG

351 TPLMGEYAGA VDRHYITLGA PLFVATAHPV TRKALNRLIM AQDTGSAIKG

401 AVRVDYFWGY GDEAGELAGK QKTTGYVWQL LPNGMKPEYR P*
```

The following partial DNA sequence was identified in *N. gonorrhoeae* <SEQ ID 3071>:

```
g919.seq
   1 ATGAAAAAAC ACCTGCTCCG CTCCGCCCTG TACGGcatCG CCGCCgccAT

51 CctcgCCGCC TGCCAAAgca gGAGCATCCA AACCTTTCCG CAACCCGACA

101 CATCCGTCAT CAACGGCCCG GACCGGCCGG CCGGCATCCC CGACCCCGCC

151 GGAACGACGG TTGCCGGCGG CGGGGCCGTC TATACCGTTG TGCCGCACCT

201 GTCCATGCCC CACTGGGCGG CGCaggATTT TGCCAAAAGC CTGCAATCCT
```

```
 251 TCCGCCTCGG CTGCGCCAAT TTGAAAAACC GCCAAGGCTG GCAGGATGTG

301 TGCGCCCAAG CCTTTCAAAC CCCCGTGCAT TCCTTTCAGG CAAAGcGgTT

351 TTTTGAACGC TATTTCACGC cgtGGCaggt tgcaggcaAC GGAAGcCTTG

401 Caggtacggt TACCGGCTAT TACGAACCGG TGCTGAAGGG CGACGGCAGG

451 CGGACGGAAC GGGCCCGCTT CCCGATTTAC GGTATTCCCG ACGATTTTAT

501 CTCCGTCCCG CTGCCTGCCG GTTTGCGGGG CGGAAAAAAC CTTGTCCGCA

551 TCAGGCAGac ggGGAAAAAC AGCGGCACGA TCGACAATGC CGGCGGCACG

601 CATACCGCCG ACCTCTCCCG ATTCCCCATC ACCGCGCGCA CAACGGcaat 651 caaaGGCAGG TTTGAaggAA GCCGCTTCCT CCCTTACCAC ACGCGCAACC 701 AAAtcaacGG CGGCgcgcTT GACGGCAAag cccCCATCCT CggttacgcC 751 GAagaccCcG tcgaacttTT TTTCATGCAC AtccaaggCT CGGGCCGCCT 801 GAAAACCCcg tccggcaaat acatCCGCAt cggaTacgcc gacAAAAACG 851 AACAtccgTa tgtttccatc ggACGctaTA TGGCGGACAA AGGCTACCTC 901 AAGctcgggc agACCTCGAT GCAGGgcatc aaagcCTATA TGCGGCAAAA

951 TCCGCAACGC CTCGCCGAAG TTTTGGGTCA AAACCCCAGC TATATCTTTT

1001 TCCGCGAGCT TGCCGGAAGC GGCAATGAGG GCCCCGTCGG CGCACTGGGC

1051 ACGCCACTGA TGGGGAATA CGCCGGCGCA ATCGACCGGC ACTACATTAC

1101 CTTGGGCGCG CCCTTATTTG TCGCCACCGC CCATCCGGTT ACCCGCAAAG

1151 CCCTCAACCG CCTGATTATG GCGCAGGATA CAGGCAGCGC GATCAAAGGC

1201 GCGGTGCGCG TGGATTATTT TTGGGGTTAC GGCGACGAAG CCGGCGAACT

1251 TGCCGGCAAA CAGAAAACCA CGGGATACGT CTGGCAGCTC CTGCCCAACG

1301 GCATGAAGCC CGAATACCGC CCGTGA
```

This corresponds to the amino acid sequence <SEQ ID 3072; ORF 919.ng>:

```
g919.pep
   1 MKKHLLRSAL YGIAAAILAA CQSRSIQTFP QPDTSVINGP DRPAGIPDPA

51 GTTVAGGGAV YTVVPHLSMP HWAAQDFAKS LQSFRLGCAN LKNRQGWQDV

101 CAQAFQTPVH SFQAKRFFER YFTPWQVAGN GSLAGTVTGY YEPVLKGDGR

151 RTERARFPIY GIPDDFISVP LPAGLRGGKN LVRIRQTGKN SGTIDNAGGT

201 HTADLSRFPI TARTTAIKGR FEGSRFLPYH TRNQINGGAL DGKAPILGYA

251 EDPVELFFMH IQGSGRLKTP SGKYIRIGYA DKNEHPYVSI GRYMADKGYL

301 KLGQTSMQGI KAYMRQNPQR LAEVLGQNPS YIFFRELAGS GNEGPVGALG

351 TPLMGEYAGA IDRHYITLGA PLFVATAHPV TRKALNRLIM AQDTGSAIKG

401 AVRVDYFWGY GDEAGELAGK QKTTGYVWQL LPNGMKPEYR P*
```

ORF 919 shows 95.9% identity over a 441 aa overlap with a predicted ORF (ORF 919.ng) from *N. gonorrhoeae*:

```
    m919/g919

10         20         30         40         50         60
    m919.pep MKKYLFRAALYGIAAAILAACQSKSIQTFPQPDTSVINGPDRPVGIPDPAGTTVGGGGAV
             |||:|:|:||||||||||||||:||||||||||||||||||||:|||||||||:||||
       g919  MKKHLLRSALYGIAAAILAACQSRSIQTFPQPDTSVINGPDRPAGIPDPAGTTVAGGGAV
                   10         20         30         40         50         60
```

-continued

```
                 70        80        90       100       110       120
m919.pep YTVVPHLSLPHWAAQDFAKSLQSFRLGCANLKNRQGWQDVCAQAFQTPVHSFQAKQFFER
         ||||||||:||||||||||||||||||||||||||||||||||||||||||||||:||||
g919     YTVVPHLSMPHWAAQDFAKSLQSFRLGCANLKNRQGWQDVCAQAFQTPVHSFQAKRFFER
                 70        80        90       100       110       120

130       140       150       160       170       180
m919.pep YFTPWQVAGNGSLAGTVTGYYEPVLKGDDRRTAQARFPIYGIPDDFISVPLPAGLRSGKA
         |||||||||||||||||||||||||||| ||| :||||||||||||||||||||||:||
g919     YFTPWQVAGNGSLAGTVTGYYEPVLKGDGRRTERARFPIYGIPDDFISVPLPAGLRGGKN
                130       140       150       160       170       180

190       200       210       220       230       240
m919.pep LVRIRQTGKNSGTIDNTGGTHTADLSRFPITARTTAIKGRFEGSRFLPYHTRNQINGGAL
         ||||||||||||||||:|||||||||||||||||||||||||||||||||||||||||||
g919     LVRIRQTGKNSGTIDNAGGTHTADLSRFPITARTTAIKGRFEGSRFLPYHTRNQINGGAL
                190       200       210       220       230       240

250       260       270       280       290       300
m919.pep DGKAPILGYAEDPVELFFMHIQGSGRLKTPSGKYIRIGYADKNEHPYVSIGRYMADKGYL
         ||||||||||||||||||||||||||||||||||||||||||||||||||||||||||||
g919     DGKAPILGYAEDPVELFFMHIQGSGRLKTPSGKYIRIGYADKNEHPYVSIGRYMADKGYL
                250       260       270       280       290       300

310       320       330       340       350       360
m919.pep KLGQTSMQGIKSYMRQNPQRLAEVLGQNPSYIFFRELAGSSNDGPVGALGTPLMGEYAGA
         |||||||||||:||||||||||||||||||||||||||||:|:|||||||||||||||||
g919     KLGQTSMQGIKAYMRQNPQRLAEVLGQNPSYIFFRELAGSGNEGPVGALGTPLMGEYAGA
                310       320       330       340       350       360

370       380       390       400       410       420
m919.pep VDRHYITLGAPLFVATAHPVTRKALNRLIMAQDTGSAIKGAVRVDYFWGYGDEAGELAGK
         :|||||||||||||||||||||||||||||||||||||||||||||||||||||||||||
g919     IDRHYITLGAPLFVATAHPVTRKALNRLIMAQDTGSAIKGAVRVDYFWGYGDEAGELAGK
                370       380       390       400       410       420

430       440
m919.pep QKTTGYVWQLLPNGMKPEYRPX
         |||||||||||||||||||||
g919     QKTTGYVWQLLPNGMKPEYRPX
                430       440
```

The following partial DNA sequence was identified in *N. meningitidis* <SEQ ID 3073>:

```
a919.seq
   1  ATGAAAAAAT ACCTATTCCG CGCCGCCCTG TGCGGCATCG CCGCCGCCAT

51  CCTCGCCGCC TGCCAAAGCA AGAGCATCCA AACCTTTCCG CAACCCGACA

101  CATCCGTCAT CAACGGCCCG GACCGGCCGG TCGGCATCCC CGACCCCGCC

151  GGAACGACGG TCGGCGGCGG CGGGGCCGTT TATACCGTTG TGCCGCACCT

201  GTCCCTGCCC CACTGGGCGG CGCAGGATTT CGCCAAAAGC CTGCAATCCT

251  TCCGCCTCGG CTGCGCCAAT TTGAAAAACC GCCAAGGCTG GCAGGATGTG

301  TGCGCCCAAG CCTTTCAAAC CCCCGTCCAT TCCGTTCAGG CAAAACAGTT

351  TTTTGAACGC TATTTCACGC CGTGGCAGGT TGCAGGCAAC GGAAGCCTTG

401  CCGGTACGGT TACCGGCTAT TACGAGCCGG TGCTGAAGGG CGACGACAGG

451  CGGACGGCAC AAGCCCGCTT CCCGATTTAC GGTATTCCCG ACGATTTTAT

501  CTCCGTCCCC CTGCCTGCCG GTTTGCGGAG CGGAAAAGCC CTTGTCCGCA

551  TCAGGCAGAC GGGAAAAAAC AGCGGCACAA TCGACAATAC CGGCGGCACA

601  CATACCGCCG ACCTCTCCCA ATTCCCCATC ACTGCGCGCA CAACGGCAAT

651  CAAAGGCAGG TTTGAAGGAA GCCGCTTCCT CCCCTACCAC ACGCGCAACC

701  AAATCAACGG CGGCGCGCTT GACGGCAAAG CCCCGATACT CGGTTACGCC

751  GAAGACCCCG TCGAACTTTT TTTTATGCAC ATCCAAGGCT CGGGCCGTCT

801  GAAAACCCCG TCCGGCAAAT ACATCCGCAT CGGCTATGCC GACAAAAACG

851  AACATCCCTA CGTTTCCATC GGACGCTATA TGGCGGACAA AGGCTACCTC

901  AAGCTCGGGC AGACCTCGAT GCAGGGCATC AAAGCCTATA TGCAGCAAAA
```

-continued

```
 951 CCCGCAACGC CTCGCCGAAG TTTTGGGGCA AAACCCCAGC TATATCTTTT
1001 TCCGAGAGCT ACCGGAAGC AGCAATGACG GCCCTGTCGG CGCACTGGGC
1051 ACGCCGCTGA TGGGCGAGTA CGCCGGCGCA GTCGACCGGC ACTACATTAC
1101 CTTGGGCGCG CCCTTATTTG TCGCCACCGC CCATCCGGTT ACCCGCAAAG
1151 CCCTCAACCG CCTGATTATG GCGCAGGATA CCGGCAGCGC GATTAAAGGC
1201 GCGGTGCGCG TGGATTATTT TTGGGGATAC GGCGACGAAG CCGGCGAACT
1251 TGCCGGCAAA CAGAAAACCA CGGGATATGT CTGGCAGCTT CTGCCCAACG
1301 GTATGAAGCC CGAATACCGC CCGTAA
```

This corresponds to the amino acid sequence <SEQ ID 3074; ORF 919.a>:

```
a919.pep
  1 MKKYLFRAAL CGIAAAILAA CQSKSIQTFP QPDTSVINGP DRPVGIPDPA
 51 GTTVGGGGAV YTVVPHLSLP HWAAQDFAKS LQSFRLGCAN LKNRQGWQDV
101 CAQAFQTPVH SVQAKQFFER YFTPWQVAGN GSLAGTVTGY YEPVLKGDDR
151 RTAQARFPIY GIPDDFISVP LPAGLRSGKA LVRIRQTGKN SGTIDNTGGT
201 HTADLSQFPI TARTTAIKGR FEGSRFLPYH TRNQINGGAL DGKAPILGYA
251 EDPVELFFMH IQGSGRLKTP SGKYIRIGYA DKNEHPYVSI GRYMADKGYL
301 KLGQTSMQGI KAYMQQNPQR LAEVLGQNPS YIFFRELTGS SNDGPVGALG
351 TPLMGEYAGA VDRHYITLGA PLFVATAHPV TRKALNRLIM AQDTGSAIKG
401 AVRVDYFWGY GDEAGELAGK QKTTGYVWQL LPNGMKPEYR P*
``` m919/a919 98.6% identity in 441 aa overlap

```
                10         20         30         40         50         60
m919.pep  MKKYLFRAALYGIAAAILAACQSKSIQTFPQPDTSVINGPDRPVGIPDPAGTTVGGGGAV
          ||||||||||  |||||||||||||||||||||||||||||||||||||||||||||||
a919      MKKYLFRAALCGIAAAILAACQSKSIQTFPQPDTSVINGPDRPVGIPDPAGTTVGGGGAV
                10         20         30         40         50         60

70         80         90        100        110        120
m919.pep  YTVVPHLSLPHWAAQDFAKSLQSFRLGCANLKNRQGWQDVCAQAFQTPVHSFQAKQFFER
          |||||||||||||||||||||||||||||||||||||||||||||||||||  ||||||
a919      YTVVPHLSLPHWAAQDFAKSLQSFRLGCANLKNRQGWQDVCAQAFQTPVHSVQAKQFFER
                70         80         90        100        110        120

130        140        150        160        170        180
m919.pep  YFTPWQVAGNGSLAGTVTGYYEPVLKGDDRRTAQARFPIYGIPDDFISVPLPAGLRSGKA
          ||||||||||||||||||||||||||||||||||||||||||||||||||||||||||||
a919      YFTPWQVAGNGSLAGTVTGYYEPVLKGDDRRTAQARFPIYGIPDDFISVPLPAGLRSGKA
               130        140        150        160        170        180

190        200        210        220        230        240
m919.pep  LVRIRQTGKNSGTIDNTGGTHTADLSRFPITARTTAIKGRFEGSRFLPYHTRNQINGGAL
          |||||||||||||||||||||||||:||||||||||||||||||||||||||||||||||
a919      LVRIRQTGKNSGTIDNTGGTHTADLSQFPITARTTAIKGRFEGSRFLPYHTRNQINGGAL
               190        200        210        220        230        240

250        260        270        280        290        300
m919.pep  DGKAPILGYAEDPVELFFMHIQGSGRLKTPSGKYIRIGYADKNEHPYVSIGRYMADKGYL
          ||||||||||||||||||||||||||||||||||||||||||||||||||||||||||||
a919      DGKAPILGYAEDPVELFFMHIQGSGRLKTPSGKYIRIGYADKNEHPYVSIGRYMADKGYL
               250        260        270        280        290        300

310        320        330        340        350        360
m919.pep  KLGQTSMQGIKSYMRQNPQRLAEVLGQNPSYIFFRELAGSSNDGPVGALGTPLMGEYAGA
          ||||||||||:||:|||||||||||||||||||||||:||||||||||||||||||||||
a919      KLGQTSMQGIKAYMQQNPQRLAEVLGQNPSYIFFRELTGSSNDGPVGALGTPLMGEYAGA
               310        320        330        340        350        360
```

```
                  370        380        390        400        410        420
m919.pep   VDRHYITLGAPLFVATAHPVTRKALNRLIMAQDTGSAIKGAVRVDYFWGYGDEAGELAGK
           ||||||||||||||||||||||||||||||||||||||||||||||||||||||||||||
a919       VDRHYITLGAPLFVATAHPVTRKALNRLIMAQDTGSAIKGAVRVDYFWGYGDEAGELAGK
                  370        380        390        400        410        420

430        440
m919.pep   QKTTGYVWQLLPNGMKPEYRPX
           ||||||||||||||||||||||
a919       QKTTGYVWQLLPNGMKPEYRPX
                  430        440
```

121 and 121-1
The following partial DNA sequence was identified in *N. meningitidis* <SEQ ID 3075>:

```
m121.seq
    1 ATGGAAACAC AGCTTTACAT CGGCATCATG TCGGGAACCA GCATGGACGG

51 GGCGGATGCC GTACTGATAC GGATGGACGG CGGCAAATGG CTGGGCGCGG

101 AAGGGCACGC CTTTACCCCC TACCCCGGCA GGTTACGCCG CCAATTGCTG

151 GATTTGCAGG ACACAGGCGC AGACGAACTG CACCGCAGCA GGATTTTGTC

201 GCAAGAACTC AGCCGCCTAT ATGCGCAAAC CGCCGCCGAA CTGCTGTGCA

251 GTCAAAACCT CGCACCGTCC GACATTACCG CCCTCGGCTG CCACGGGCAA

301 ACCGTCCGAC ACGCGCCGGA ACACGGTTAC AGCATACAGC TTGCCGATTT

351 GCCGCTGCTG GCGxxxxxxx xxxxxxxxxx xxxxxxxxxx xxxxxxxxxx 401 xxxxxxxxxx xxxxxxxxxx xxxxxxxxxx xxxxxxxxxx xxxxxxxxxx 451 xxxxxxxxxx xxxxxxxxxx xxxxxxxxxx xxxxxxxxxx xxxxxxxxxx 501 xxxxxxxxxx xxxxxxxxxx xxxxxxxxxx xxxxxxxxxx xxxxxxxxxx 551 xxxxxxxxxx xxxxxxxxxx xxxxxxxxxx xxxxxxxxxx xxxxxxxxxx 601 xxxxxxCAGC TTCCTTACGA CAAAAACGGT GCAAAGTCGG CACAAGGCAA

651 CATATTGCCG CAACTGCTCG ACAGGCTGCT CGCCCACCCG TATTTCGCAC

701 AACGCCACCC TAAAAGCACG GGGCGCGAAC TGTTTGCCAT AAATTGGCTC

751 GAAACCTACC TTGACGGCGG CGAAAACCGA TACGACGTAT TGCGGACGCT

801 TTCCCGTTTT ACCGCGCAAA CCGTTTGCGA CGCCGTCTCA CACGCAGCGG

851 CAGATGCCCG TCAAATGTAC ATTTGCGACG GCGGCATCCG CAATCCTGTT

901 TTAATGGCGG ATTTGGCAGA ATGTTTCGGC ACACGCGTTT CCCTGCACAG

951 CACCGCCGAC CTGAACCTCG ATCCGCAATG GGTGGAAGCC GCCGnATTTG

1001 CGTGGTTGGC GGCGTGTTGG ATTAATCGCA TTCCCGGTAG TCCGCACAAA

1051 GCAACCGGCG CATCCAAACC GTGTATTCTG AnCGCGGGAT ATTATTATTG

1101 A
```

This corresponds to the amino acid sequence <SEQ ID 3076; ORF 121>:

```
m121.pep
    1 METQLYIGIM SGTSMDGADA VLIRMDGGKW LGAEGHAFTP YPGRLRRQLL

51 DLQDTGADEL HRSRILSQEL SRLYAQTAAE LLCSQNLAPS DITALGCHGQ

101 TVRHAPEHGY SIQLADLPLL Axxxxxxxxx xxxxxxxxxx xxxxxxxxxx 151 xxxxxxxxxx xxxxxxxxxx xxxxxxxxxx xxxxxxxxxx xxxxxxxxxx
```

-continued

```
201 xxQLPYDKNG AKSAQGNILP QLLDRLLAHP YFAQRHPKST GRELFAINWL

251 ETYLDGGENR YDVLRTLSRF TAQTVCDAVS HAAADARQMY ICDGGIRNPV

301 LMADLAECFG TRVSLHSTAD LNLDPQWVEA AXFAWLAACW INRIPGSPHK

351 ATGASKPCIL XAGYYY*
```

The following partial DNA sequence was identified in *N. gonorrhoeae* <SEQ ID 3077>:

```
g121.seq
    1 ATGGAAACAC AGCTTTACAT CGGCATTATG TCGGGAACCA GTATGGACGG

51 GGCGGATGCC GTGCTGGTAC GGATGGACGG CGGCAAATGG CTGGGCGCGG

101 AAGGGCACGC CTTTACCCCC TACCCTGACC GGTTGCGCCG CAAATTGCTG

151 GATTTGCAGG ACACAGGCAC AGACGAACTG CACCGCAGCA GGATGTTGTC

201 GCAAGAACTC AGCCGCCTGT ACGCGCAAAC CGCCGCCGAA CTGCTGTGCA

251 GTCAAAACCT CGCTCCGTGC GACATTACCG CCCTCGGCTG CCACGGGCAA

301 ACCGTCCGAC ACGCGCCGGA ACACGGTtac AGCATACAGC TTGCCGATTT

351 GCCGCTGCTG GCGGAACTGa cgcggatttT TACCGTCggc gacttcCGCA

401 GCCGCGACCT TGCTGCCGGC GGacaAGGTG CGCCGCTCGT CCCCGCCTTT

451 CACGAAGCCC TGTTCCGCGA TGACAGGGAA ACACGCGTGG TACTGAACAT

501 CGGCGGGATT GCCAACATCA GCGTACTCCC CCCCGGCGCA CCCGCCTTCG

551 GCTTCGACAC AGGGCCGGGC AATATGCTGA TGGAcgcgtg gacgcaggca 601 cacTGGcagc TGCCTTACGA CAAAAacggt gcAAAGgcgg cacAAGGCAA 651 catatTGCcg cAACTGCTCG gcaggctGCT CGCCcaccCG TATTTCTCAC 701 AACCCcaccc aaAAAGCACG GGgcGCGaac TgtttgcccT AAattggctc 751 gaaacctAcc ttgacggcgg cgaaaaccga tacgacgtat tgcggacgct 801 ttcccgattc accgcgcaaA ccgTttggga cgccgtctca CACGCAGCGG

851 CAGATGCCCG TCAAATGTAC ATTTGCGGCG GCGGCATCCG CAATCCTGTT

901 TTAATGGCGG ATTTGGCAGA ATGTTTCGGC ACACGCGTTT CCCTGCACAG

951 CACCGCCGAA CTGAACCTCG ATCCTCAATG GGTGGAGGCG gccgCATTtg 1001 cgtggttggC GGCGTGTTGG ATTAACCGCA TTCCCGGTAG TCCGCACAAA

1051 GCGACCGGCG CATCCAAACC GTGTATTCTG GGCGCGGGAT ATTATTATTG

1101 A
```

This corresponds to the amino acid sequence <SEQ ID 3078; ORF 121.ng>:

```
g121.pep
    1 METQLYIGIM SGTSMDGADA VLVRMDGGKW LGAEGHAFTP YPDRLRRKLL

51 DLQDTGTDEL HRSRMLSQEL SRLYAQTAAE LLCSQNLAPC DITALGCHGQ

101 TVRHAPEHGY SIQLADLPLL AELTRIFTVG DFRSRDLAAG GQGAPLVPAF

151 HEALFRDDRE TRVVLNIGGI ANISVLPPGA PAFGFDTGPG NMLMDAWTQA

201 HWQLPYDKNG AKAAQGNILP QLLGRLLAHP YFSQPHPKST GRELFALNWL

251 ETYLDGGENR YDVLRTLSRF TAQTVWDAVS HAAADARQMY ICGGIRNPV
```

```
301  LMADLAECFG TRVSLHSTAE LNLDPQWVEA AAFAWLAACW INRIPGSPHK

351  ATGASKPCIL GAGYYY*
```

ORF 121 shows 73.5% identity over a 366 aa overlap with a predicted ORF (ORF121.ng) from *N. gonorrhoeae*:

```
m121/g121

10         20         30         40         50         60
    m121.pep  METQLYIGIMSGTSMDGADAVLIRMDGGKWLGAEGHAFTPYPGRLRRQLLDLQDTGADEL
              ||||||||||||||||||||||:||||||||||||||||| ||||:||||||||:|||
    g121      METQLYIGIMSGTSMDGADAVLVRMDGGKWLGAEGHAFTPYPDRLRRKLLDLQDTGTDEL
                    10         20         30         40         50         60

70         80         90        100        110        120
    m121.pep  HRSRILSQELSRLYAQTAAELLCSQNLAPSDITALGCHGQTVRHAPEHGYSIQLADLPLL
              ||||:||||||||||||||||||||||||| |||||||||||||||||||||||||||||
    g121      HRSRMLSQELSRLYAQTAAELLCSQNLAPCDITALGCHGQTVRHAPEHGYSIQLADLPLL
                    70         80         90        100        110        120

130        140        150        160        170        180
    m121.pep  AXXXXXXXXXXXXXXXXXXXXXXXXXXXXXXXXXXXXXXXXXXXXXXXXXXXXXXXXXX
              |  :    :                                            :
    g121      AELTRIFTVGDFRSRDLAAGGQGAPLVPAFHEALFRDDRETRVVLNIGGIANISVLPPGA
                   130        140        150        160        170        180

190        200        210        220        230        240
    m121.pep  XXXXXXXXXXXXXXXXXXXXXXXXQLPYDKNGAKSAQGNILPQLLDRLLAHPYFAQRHPKST
                   :          :        |||||||||||:||||||||||  |||||||:| |||||
    g121      PAFGFDTGPGNMLMDAWTQAHWQLPYDKNGAKAAQGNILPQLLGRLLAHPYFSQPHPKST
                   190        200        210        220        230        240

250        260        270        280        290        300
    m121.pep  GRELFAINWLETYLDGGENRYDVLRTLSRFTAQTVCDAVSHAAADARQMYICDGGIRNPV
              ||||||:|||||||||||||||||||||||||||| ||||||||||||||||| ||||||
    g121      GRELFALNWLETYLDGGENRYDVLRTLSRFTAQTVWDAVSHAAADARQMYICGGGIRNPV
                   250        260        270        280        290        300

310        320        330        340        350        360
    m121.pep  LMADLAECFGTRVSLHSTADLNLDPQWVEAAXFAWLAACWINRIPGSPHKATGASKPCIL
              ||||||||||||||||||||:|||||||||| ||||||||||||||||||||||||||||
    g121      LMADLAECFGTRVSLHSTAELNLDPQWVEAAAFAWLAACWINRIPGSPHKATGASKPCIL
                   310        320        330        340        350        360 m121.pep  XAGYYYX
               ||||||
    g121      GAGYYYX
```

The following partial DNA sequence was identified in *N. meningitidis* <SEQ ID 3079>:

```
a121.seq
    1  ATGGAAACAC AGCTTTACAT CGGCATCATG TCGGGAACCA GCATGGACGG

51  GGCGGATGCC GTACTGATAC GGATGGACGG CGGCAAATGG CTGGGCGCGG

101  AAGGGCACGC CTTTACCCCC TACCCCGGCA GGTTACGCCG CAAATTGCTG

151  GATTTGCAGG ACACAGGCGC GGACGAACTG CACCGCAGCA GGATGTTGTC

201  GCAAGAACTC AGCCGCCTGT ACGCGCAAAC CGCCGCCGAA CTGCTGTGCA

251  GTCAAAACCT CGCGCCGTCC GACATTACCG CCCTCGGCTG CCACGGGCAA

301  ACCGTCAGAC ACGCGCCGGA ACACAGTTAC AGCGTACAGC TTGCCGATTT

351  GCCGCTGCTG GCGGAACGGA CTCAGATTTT TACCGTCGGC GACTTCCGCA

401  GCCGCGACCT TGCGGCCGGC GGACAAGGCG CGCCGCTCGT CCCCGCCTTT

451  CACGAAGCCC TGTTCCGCGA CGACAGGGAA ACACGCGCGG TACTGAACAT

501  CGGCGGGATT GCCAACATCA GCGTACTCCC CCCCGACGCA CCCGCCTTCG

551  GCTTCGACAC AGGACCGGGC AATATGCTGA TGGACGCGTG GATGCAGGCA
```

-continued

```
 601  CACTGGCAGC TTCCTTACGA CAAAAACGGT GCAAAGGCGG CACAAGGCAA

651  CATATTGCCG CAACTGCTCG ACAGGCTGCT CGCCCACCCG TATTTCGCAC

701  AACCCCACCC TAAAAGCACG GGGCGCGAAC TGTTTGCCCT AAATTGGCTC

751  GAAACCTACC TTGACGGCGG CGAAAACCGA TACGACGTAT TGCGGACGCT

801  TTCCCGATTC ACCGCGCAAA CCGTTTTCGA CGCCGTCTCA CACGCAGCGG

851  CAGATGCCCG TCAAATGTAC ATTTGCGGCG GCGGCATCCG CAATCCTGTT

901  TTAATGGCGG ATTTGGCAGA ATGTTTCGGC ACACGCGTTT CCCTGCACAG

951  CACCGCCGAA CTGAACCTCG ATCCGCAATG GGTAGAAGCC GCCGCGTTCG

1001  CATGGATGGC GGCGTGTTGG GTCAACCGCA TTCCCGGTAG TCCGCACAAA

1051  GCAACCGGCG CATCCAAACC GTGTATTCTG GGCGCGGGAT ATTATTATTG

1101  A
```

This corresponds to the amino acid sequence <SEQ ID 3080; ORF 121.a>:

```
a121.pep

1  METQLYIGIM SGTSMDGADA VLIRMDGGKW LGAEGHAFTP YPGRLRRKLL

51  DLQDTGADEL HRSRMLSQEL SRLYAQTAAE LLCSQNLAPS DITALGCHGQ

101  TVRHAPEHSY SVQLADLPLL AERTQIFTVG DFRSRDLAAG GQGAPLVPAF

151  HEALFRDDRE TRAVLNIGGI ANISVLPPDA PAFGFDTGPG NMLMDAWMQA

201  HWQLPYDKNG AKAAQGNILP QLLDRLLAHP YFAQPHPKST GRELFALNWL

251  ETYLDGGENR YDVLRTLSRF TAQTVFDAVS HAAADARQMY ICGGGIRNPV

301  LMADLAECFG TRVSLHSTAE LNLDPQWVEA AARAWMAACW VNRIPGSPHK

351  ATGASKPCIL GAGYY* m121/a121     74.0% identity in 366 aa overlap 10         20         30         40         50         60
m121.pep     METQLYIGIMSGTSMDGADAVLIRMDGGKWLGAEGHAFTPYPGRLRRQLLDLQDTGADEL
             ||||||||||||||||||||||||||||||||||||||||||||||:||||||||||||
a121         METQLYIGIMSGTSMDGADAVLIRMDGGKWLGAEGHAFTPYPGRLRRKLLDLQDTGADEL
                    10         20         30         40         50         60

70         80         90        100        110        120
m121.pep     HRSRILSQELSRLYAQTAAELLCSQNLAPSDITALGCHGQTVRHAPEHGYSIQLADLPLL
             ||||:|||||||||||||||||||||||||||||||||||||||||||:||:|||||||
a121         HRSRMLSQELSRLYAQTAAELLCSQNLAPSDITALGCHGQTVRHAPEHSYSVQLADLPLL
                    70         80         90        100        110        120

130        140        150        160        170        180
m121.pep     AXXXXXXXXXXXXXXXXXXXXXXXXXXXXXXXXXXXXXXXXXXXXXXXXXXXXXXXXXXX
             | :        :                                       :
a121         AERTQIFTVGDFRSRDLAAGGQGAPLVPAFHEALFRDDRETRAVLNIGGIANISVLPPDA
                    130        140        150        160        170        180

190        200        210        220        230        240
m121.pep     XXXXXXXXXXXXXXXXXXXXXXXQLPYDKNGAKSAQGNILPQLLDRLLAHPYFAQRHPKST
                                    ||||||||||:|||||||||||||||||||||:|||||
a121         PAFGFDTGPGNMLMDAWMQAHWQLPYDKNGAKAAQGNILPQLLDRLLAHPYFAQPHPKST
                    190        200        210        220        230        240

250        260        270        280        290        300
m121.pep     GRELFAINWLETYLDGGENRYDVLRTLSRFTAQTVCDAVSHAAADARQMYICDGGIRNPV
             ||||||:|||||||||||||||||||||||||||||:|||||||||||||||| |||||
a121         GRELFALNWLETYLDGGENRYDVLRTLSRFTAQTVFDAVSHAAADARQMYICGGGIRNPV
                    250        260        270        280        290        300

310        320        330        340        350        360
m121.pep     LMADLAECFGTRVSLHSTADLNLDPQWVEAAXFAWLAACWINRIPGSPHKATGASKPCIL
             ||||||||||||||||||||:|||||||||| |||:||||:|||||||||||||||||||
a121         LMADLAECFGTRVSLHSTAELNLDPQWVEAAAFAWMAACWVNRIPGSPHKATGASKPCIL
                    310        320        330        340        350        360
```

```
m121.pep    XAGYYYX
            ||||||
a121        GAGYYYX
```

The following partial DNA sequence was identified in *N. meningitidis* <SEQ ID 3081>:

```
m121-1.seq
    1 ATGGAAACAC AGCTTTACAT CGGCATCATG TCGGGAACCA GCATGGACGG

51 GGCGGATGCC GTACTGATAC GGATGGACGG CGGCAAATGG CTGGGCGCGG

101 AAGGGCACGC CTTTACCCCC TACCCCGGCA GGTTACGCCG CCAATTGCTG

151 GATTTGCAGG ACACAGGCGC AGACGAACTG CACCGCAGCA GGATTTTGTC

201 GCAAGAACTC AGCCGCCTAT ATGCGCAAAC CGCCGCCGAA CTGCTGTGCA

251 GTCAAACCT CGCACCGTCC GACATTACCG CCCTCGGCTG CCACGGGCAA

301 ACCGTCCGAC ACGCGCCGGA ACACGGTTAC AGCATACAGC TTGCCGATTT

351 GCCGCTGCTG GCGGAACGGA CGCGGATTTT TACCGTCGGC GACTTCCGCA

401 GCCGCGACCT TGCGGCCGGC GGACAAGGCG CGCCACTCGT CCCCGCCTTT

451 CACGAAGCCC TGTTCCGCGA CAACAGGGAA ACACGCGCGG TACTGAACAT

501 CGGCGGGATT GCCAACATCA GCGTACTCCC CCCCGACGCA CCCGCCTTCG

551 GCTTCGACAC AGGGCCGGGC AATATGCTGA TGGACGCGTG GACGCAGGCA

601 CACTGGCAGC TTCCTTACGA CAAAAACGGT GCAAAGGCGG CACAAGGCAA

651 CATATTGCCG CAACTGCTCG ACAGGCTGCT CGCCCACCCG TATTTCGCAC

701 AACCCCACCC TAAAAGCACG GGGCGCGAAC TGTTTGCCCT AAATTGGCTC

751 GAAACCTACC TTGACGGCGG CGAAAACCGA TACGACGTAT TGCGGACGCT

801 TTCCCGTTTT ACCGCGCAAA CCGTTTGCGA CGCCGTCTCA CACGCAGCGG

851 CAGATGCCCG TCAAATGTAC ATTTGCGGCG GCGGCATCCG CAATCCTGTT

901 TTAATGGCGG ATTTGGCAGA ATGTTTCGGC ACACGCGTTT CCCTGCACAG

951 CACCGCCGAC CTGAACCTCG ATCCGCAATG GGTGGAAGCC GCCGNATTTG

1001 CGTGGTTGGC GGCGTGTTGG ATTAATCGCA TTCCCGGTAG TCCGCACAAA

1051 GCAACCGGCG CATCCAAACC GTGTATTCTG ANCGCGGGAT ATTATTATTG

1101 A
```

This corresponds to the amino acid sequence <SEQ ID 3082; ORF 121-1>:

```
m121-1.pep
      1 METQLYIGIM SGTSMDGADA VLIRMDGGKW LGAEGHAFTP YPGRLRRQLL

51 DLQDTGADEL HRSRILSQEL SRLYAQTAAE LLCSQNLAPS DITALGCHGQ

101 TVRHAPEHGY SIQLADLPLL AERTRIFTVG DFRSRDLAAG GQGAPLVPAF

151 HEALFRDNRE TRAVLNIGGI ANISVLPPDA PAFGFDTGPG NMLMDAWTQA

201 HWQLPYDKNG AKAAQGNILP QLLDRLLAHP YFAQPHPKST GRELFALNWL

251 ETYLDGGENR YDVLRTLSRF TAQTVCDAVS HAAADARQMY ICGGGIRNPV

301 LMADLAECFG TRVSLHSTAD LNLDPQWVEA AXFAWLAACW INRIPGSPHK

351 ATGASKPCIL XAGYYY*
```

-continued m121-1/g121 95.6% identity in 366 aa overlap

```
                    10        20        30        40        50        60
m121-1.pep  METQLYIGIMSGTSMDGADAVLIRMDGGKWLGAEGHAFTPYPGRLRRQLLDLQDTGADEL
            |||||||||||||||||||||:||||||||||||||||||:|||||||||:|||
g121        METQLYIGIMSGTSMDGADAVLVRMDGGKWLGAEGHAFTPYPDRLRRKLLDLQDTGTDEL
                    10        20        30        40        50        60

70        80        90       100       110       120
m121-1.pep  HRSRILSQELSRLYAQTAAELLCSQNLAPSDITALGCHGQTVRHAPEHGYSIQLADLPLL
            ||||:||||||||||||||||||||||||| ||||||||||||||||||||||||||||
g121        HRSRMLSQELSRLYAQTAAELLCSQNLAPCDITALGCHGQTVRHAPEHGYSIQLADLPLL
                    70        80        90       100       110       120

130       140       150       160       170       180
m121-1.pep  AERTRIFTVGDFRSRDLAAGGQGAPLVPAFHEALFRDNRETRAVLNIGGIANISVLPPDA
            || ||||||||||||||||||||||||||||||||||:||||:|||||||||||||| |
g121        AELTRIFTVGDFRSRDLAAGGQGAPLVPAFHEALFRDDRETRVVLNIGGIANISVLPPGA
                   130       140       150       160       170       180

190       200       210       220       230       240
m121-1.pep  PAFGFDTGPGNMLMDAWTQAHWQLPYDKNGAKAAQGNILPQLLDRLLAHPYFAQPHPKST
            |||||||||||||||||||||||||||||||||||||||||||||:|||||||:||||||
g121        PAFGFDTGPGNMLMDAWTQAHWQLPYDKNGAKAAQGNILPQLLGRLLAHPYFSQPHPKST
                   190       200       210       220       230       240

250       260       270       280       290       300
m121-1.pep  GRELFALNWLETYLDGGENRYDVLRTLSRFTAQTVCDAVSHAAADARQMYICGGGIRNPV
            |||||||||||||||||||||||||||||||||||:||||||||||||||||||||||
g121        GRELFALNWLETYLDGGENRYDVLRTLSRFTAQTVWDAVSHAAADARQMYICGGGIRNPV
                   250       260       270       280       290       300

310       320       330       340       350       360
m121-1.pep  LMADLAECGFTRVSLHSTADLNLDPQWVEAAXFAWLAACWINRIPGSPHKATGASKPCIL
            ||||||||||||||||||||:|||||||||||||||||||||||||||||||||||||||
g121        LMADLAECGFTRVSLHSTAELNLDPQWVEAAAFAWLAACWINRIPGSPHKATGASKPCIL
                   310       320       330       340       350       360 m121-1.pep  XAGYYYX
            ||||||
g121        GAGYYYX
```

The following partial DNA sequence was identified in *N. meningitidis* <SEQ ID 3083>:

```
a121-1.seq
   1  ATGGAAACAC AGCTTTACAT CGGCATCATG TCGGGAACCA GCATGGACGG

51  GGCGGATGCC GTACTGATAC GGATGGACGG CGGCAAATGG CTGGGCGCGG

101  AAGGGCACGC CTTTACCCCC TACCCCGGCA GGTTACGCCG CAAATTGCTG

151  GATTTGCAGG ACACAGGCGC GGACGAACTG CACCGCAGCA GGATGTTGTC

201  GCAAGAACTC AGCCGCCTGT ACGCGCAAAC CGCCGCCGAA CTGCTGTGCA

251  GTCAAAACCT CGCGCCGTCC GACATTACCG CCCTCGGCTG CCACGGGCAA

301  ACCGTCAGAC ACGCGCCGGA ACACAGTTAC AGCGTACAGC TTGCCGATTT

351  GCCGCTGCTG GCGGAACGGA CTCAGATTTT TACCGTCGGC GACTTCCGCA

401  GCCGCGACCT TGCGGCCGGC GGACAAGGCG CGCCGCTCGT CCCCGCCTTT

451  CACGAAGCCC TGTTCCGCGA CGACAGGGAA ACACGCGCGG TACTGAACAT

501  CGGCGGGATT GCCAACATCA GCGTACTCCC CCCCGACGCA CCCGCCTTCG

551  GCTTCGACAC AGGACCGGGC AATATGCTGA TGGACGCGTG GATGCAGGCA

601  CACTGGCAGC TTCCTTACGA CAAAAACGGT GCAAAGGCGG CACAAGGCAA

651  CATATTGCCG CAACTGCTCG ACAGGCTGCT CGCCCACCCG TATTTCGCAC

701  AACCCCACCC TAAAAGCACG GGGCGCGAAC TGTTTGCCCT AAATTGGCTC

751  GAAACCTACC TTGACGGCGG CGAAAACCGA TACGACGTAT TGCGGACGCT

801  TTCCCGATTC ACCGCGCAAA CCGTTTTCGA CGCCGTCTCA CACGCAGCGG

851  CAGATGCCCG TCAAATGTAC ATTTGCGGCG GCGGCATCCG CAATCCTGTT

901  TTAATGGCGG ATTTGGCAGA ATGTTTCGGC ACACGCGTTT CCCTGCACAG
```

```
 951  CACCGCCGAA CTGAACCTCG ATCCGCAATG GGTAGAAGCC GCCGCGTTCG

1001  CATGGATGGC GGCGTGTTGG GTCAACCGCA TTCCCGGTAG TCCGCACAAA

1051  GCAACCGGCG CATCCAAACC GTGTATTCTG GGCGCGGGAT ATTATTATTG

1101  A
```

This corresponds to the amino acid sequence <SEQ ID 3084; ORF 121-1.a>:

```
a121-1.pep

1   METQLYIGIM SGTSMDGADA VLIRMDGGKW LGAEGHAFTP YPGRLRRKLL

51   DLQDTGADEL HRSRMLSQEL SRLYAQTAAE LLCSQNLAPS DITALGCHGQ

101   TVRHAPEHSY SVQLADLPLL AERTQIFTVG DFRSRDLAAG GQGAPLVPAF

151   HEALFRDDRE TRAVLNIGGI ANISVLPPDA PAFGFDTGPG NMLMDAWMQA

201   HWQLPYDKNG AKAAQGNILP QLLDRLLAHP YFAQPHPKST FRELFALNWL

251   ETYLDGGENR YDVLRTLSRF TAWTVFDAVS HAAADARQMY ICGGGIRNPV

301   LMADLAECFG TRVSLHSTAE LNLDPQWVEA AAFAWMAACW VNRIPGSPHK

351   ATGASKPCIL GAGYYY* m121-1/a121-1  96.4% identity in 366 aa overlap 10        20        30        40        50        60
m121-1.pep  METQLYIGIMSGTSMDGADAVLIRMDGGKWLGAEGHAFTPYPGRLRRQLLDLQDTGADEL
            ||||||||||||||||||||||||||||||||||||||||||||||:||||||||||||
a121-1      METQLYIGIMSGTSMDGADAVLIRMDGGKWLGAEGHAFTPYPGRLRRKLLDLQDTGADEL
                    10        20        30        40        50        60

70        80        90       100       110       120
m121-1.pep  HRSRILSQELSRLYAQTAAELLCSQNLAPSDITALGCHGQTVRHAPEHGYSIQLADLPLL
            ||||:|||||||||||||||||||||||||||||||||||||||||||:|:||||||||
a121-1      HRSRMLSQELSRLYAQTAAELLCSQNLAPSDITALGCHGQTVRHAPEHSYSVQLADLPLL
                    70        80        90       100       110       120

130       140       150       160       170       180
m121-1.pep  AERTRIFTVGDFRSRDLAAGGQGAPLVPAFHEALFRDNRETRAVLNIGGIANISVLPPDA
            ||||:|||||||||||||||||||||||||||||||:|||||||||||||||||||||||
a121-1      AERTQIFTVGDFRSRDLAAGGQGAPLVPAFHEALFRDDRETRAVLNIGGIANISVLPPDA
                   130       140       150       160       170       180

190       200       210       220       230       240
m121-1.pep  PAFGFDTGPGNMLMDAWTQAHWQLPYDKNGAKAAQGNILPQLLDRLLAHPYFAQPHPKST
            |||||||||||||||||| |||||||||||||||||||||||||||||||||||||||||
a121-1      PAFGFDTGPGNMLMDAWMQAHWQLPYDKNGAKAAQGNILPQLLDRLLAHPYFAQPHPKST
                   190       200       210       220       230       240

250       260       270       280       290       300
m121-1.pep  GRELFALNWLETYLDGGENRYDVLRTLSRFTAQTVCDAVSHAAADARQMYICGGGIRNPV
            |||||||||||||||||||||||||||||||||| ||||||||||||||||||||||||
a121-1      GRELFALNWLETYLDGGENRYDVLRTLSRFTAQTVFDAVSHAAADARQMYICGGGIRNPV
                   250       260       270       280       290       300

310       320       330       340       350       360
m121-1.pep  LMADLAECFGTRVSLHSTADLNLDPQWVEAAXFAWLAACWINRIPGSPHKATGASKPCIL
            |||||||||||||||||||:|||||||||| |||:||||:||||||||||||||||||||
a121-1      LMADLAECFGTRVSLHSTAELNLDPQWVEAAAFAWMAACWVNRIPGSPHKATGASKPCIL
                   310       320       330       340       350       360 m121-1.pep  XAGYYYX
            ||||||
a121-1      GAGYYYX
```

128 and 128-1
The following partial DNA sequence was identified in *N. meningitidis* <SEQ ID 3085>:

```
m128.seq (partial)
     1 ATGACTGACA ACGCACTGCT CCATTTGGGC GAAGAACCCC GTTTTGATCA

51 AATCAAAACC GAAGACATCA AACCCGCCCT GCAAACCGCC ATCGCCGAAG

101 CGCGCGAACA AATCGCCGCC ATCAAAGCCC AAACGCACAC CGGCTGGGCA

151 AACACTGTCG AACCCCTGAC CGGCATCACC GAACGCGTCG GCAGGATTTG

201 GGGCGTGGTG TCGCACCTCA ACTGCGTCGC CGACACGCCC GAACTGCGCG

251 CCGTCTATAA CGAACTGATG CCCGAAATCA CCGTCTTCTT CACCGAAATC

301 GGACAAGACA TCGAGCTGTA CAACCGCTTC AAAACCATCA AAAATTCCCC

351 CGAATTCGAC ACCCTCTCCC CCGCACAAAA AACCAAACTC AACCAC

1 TACGCCAGCG AAAAACTGCG CGAAGCCAAA TACGCGTTCA GCGAAACCGA 51 wGTCAAAAAA TAyTTCCCyG TCGGCAAwGT ATTAAACGGA CTGTTCGCCC

101 AAmTCAAAAA ACTmTACGGC ATCGGATTTA CCGAAAAAAC yGTCCCCGTC

151 TGGCACAAAG ACGTGCGCTA TTkTGAATTG CAACAAAACG GCGAAmCCAT

201 AGGCGGCGTT TATATGGATT TGTACGCACG CGAAGGCAAA CGCGGCGGCG

251 CGTGGATGAA CGACTACAAA GGCCGCCGCC GTTTTTCAGA CGGCACGCTG

301 CAAyTGCCCA CCGCCTACCT CGTCTGCAAC TTCGCCCCAC CCGTCGGCGG

351 CAGGGAAGCC CGCyTGAGCC ACGACGAAAT CCTCATCCTC TTCCACGAAA

401 CCGGACACGG GCTGCACCAC CTGCTTACCC AAGTGGACGA ACTGGGCGTA

451 TCCGGCATCA ACGGCGTAkA ATGGGACGCG GTCGAACTGC CCAGCCAGTT

501 TATGGAAAAT TTCGTTTGGG AATACAATGT CTTGGCACAA mTGTCAGCCC

551 ACGAAGAAAC CGGcgTTCCC yTGCCGAAAG AACTCTTsGA CAAAwTGCTC

601 GCCGCCAAAA ACTTCCAAsG CGGCATGTTC yTsGTCCGGC AAwTGGAGTT

651 CGCCCTCTTT GATATGATGA TTTACAGCGA AGACGACGAA GGCCGTCTGA

701 AAAACTGGCA ACAGGTTTTA GACAGCGTGC GCAAAAAAGT CGCCGTCATC

751 CAGCCGCCCG AATACAACCG CTTCGCCTTG AGCTTCGGCC ACATCTTCGC

801 AGGCGGCTAT TCCGCAGCTn ATTACAGCTA CGCGTGGGCG GAAGTATTGA

851 GCGCGGACGC ATACGCCGCC TTTGAAGAAA GCGACGATGT CGCCGCCACA

901 GGCAAACGCT TTTGGCAGGA AATCCTCGCC GTCGGGGnAT CGCGCAGCGG 951 nGCAGAATCC TTCAAAGCCT TCCGCGGCCG CGAACCGAGC ATAGACGCAC

1001 TCTTGCGCCA CAGCGGTTTC GACAACGCGG TCTGA
```

This corresponds to the amino acid sequence <SEQ ID 3086; ORF 128>:

```
m128.pep (partial)
     1 MTDNALLHLG EEPRFDQIKT EDIKPALQTA IAEAREQIAA IKAQTHTGWA

51 NTVEPLTGIT ERVGRIWGVV SHLNCVADTP ELRAVYNELM PEITVFFTEI

101 GQDIELYNRF KTIKNSPEFD TLSPAQKTKL NH
//

1 YASEKLREAK YAFSETXVKK YFPVGXVLNG LFAQXKKLYG IGFTEKTVPV

51 WHKDVRYXEL QQNGEXIGGV YMDLYAREGK RGGAWMNDYK GRRRFSDGTL
```

```
101 QLPTAYLVCN FAPPVGGREA RLSHDEILIL FHETGHGLHH LLTQVDELGV

151 SGINGVXWDA VELPSQFMEN FVWEYNVLAQ XSAHEETGVP LPKELXDKXL

201 AAKNFQXGMF XVRQXEFALF DMMIYSEDDE GRLKNWQQVL DSVRKKVAVI

251 QPPEYNRFAL SFGHIFAGGY SAAXYSYAWA EVLSADAYAA FEESDDVAAT

301 GKRFWQEILA VGXSRSGAES FKAFRGREPS IDALLRHSGF DNAV*
```

The following partial DNA sequence was identified in *N. gonorrhoeae* <SEQ ID 3087>:

```
g128.seq
   1 atgattgaca acgCActgct ccacttgggc gaagaaccCC GTTTTaatca 51 aatccaaacc gaagACAtca AACCCGCCGT CCAAACCGCC ATCGCCGAAG

101 CGCGCGGACA AATCGCCGCC GTCAAAGCGC AAACGCACAC CGGCTGGGCG

151 AACACCGTCG AGCGTCTGAC CGGCATCACC GAACGCGTCG GCAGGATTTG

201 GGGCGTCGTG TCCCATCTCA ACTCCGTCGT CGACACGCCC GAACTGCGCG

251 CCGTCTATAA CGAACTGATG CCTGAAATCA CCGTCTTCTT CACCGAAATC

301 GGACAAGACA TCGAACTGTA CAACCGCTTC AAAACCATCA AAAATTCCCC

351 CGAATTTGCA ACGCTTTCCC CCGCACAAAA AACCAAGCTC GATCACGACC

401 TGCGCGATTT CGTATTGAGC GGCGCGGAAC TGCCGCCCGA ACGGCAGGCA

451 GAACTGGCAA AACTGCAAAC CGAAGGCGCG CAACTTTCCG CCAAATTCTC

501 CCAAAACGTC CTAGACGCGA CCGACGCGTT CGGCATTTAC TTTGACGATG

551 CCGCACCGCT TGCCGGCATT CCCGAAGACG CGCTCGCCAT GTTTGCCGCC

601 GCCGCGCAAA GCGAAGGCAA AACAGGTTAC AAAATCGGCT TGCAGATTCC

651 GCACTACCTT GCCGTTATCC AATACGCCGG CAACCGCGAA CTGCGCGAAC

701 AAATCTACCG CGCCTACGTT ACCCGTGCCA GCGAACTTTC AAACGACGGC

751 AAATTCGACA ACACCGCCAA CATCGACCGC ACGCTCGAAA ACGCATTGAA

801 AACCGccaaa cTGCTCGGCT TTAAAAATTA CGCCGAATTG TCGCTGGCAA

851 CCAAAATGGC GGACACGCCC GAACAGGTTT TAAACTTCCT GCACGACCTC

901 GCCCGCCGCG CCAAACCCTA CGCCGAAAAA GACCTCGCCG AAGTCAAAGC

951 CTTCGCCCGC GAACACCTCG GTCTCGCCGA CCCGCAGCCG TGGGACTTGA

1001 GCTACGCCGG CGAAAAACTG CGCGAAGCCA AATACGCATT CAGCGAAACC

1051 GAAGTCAAAA AATACTTCCC CGTCGGCAAA GTTCTGGCAG GCCTGTTCGC

1101 CCAAATCAAA AAACTCTACG GCATCGGATT CGCCGAAAAA ACCGTTCCCG

1151 TCTGGCACAA AGACGTGCGC TATTTTGAAT TGCAACAAAA CGGCAAAACC

1201 ATCGGCGGCG TTTATATGGA TTTGTACGCA CGCGAAGGCA AACGCGGCGG

1251 CGCGTGGATG AACGACtaca AAGGCCGCCG CCGCTTTGCC GACGgcacGC

1301 TGCAACTGCC CACCGCCTAC CTCGTCTGCA ACTTCGCCCC GCCCGTCGGC

1351 GGCAAAGAAG CGCGTTTAAG CCACGACGAA ATCCTCACCC TCTTCCACGA

1401 AacCGGCCAC GGACTGCACC ACCTGCTTAC CCAAGTGGAC GAACTGGGCG

1451 TGTCCGGCAT CAAcggcgtA GAATGGGACG CGGTCGAACT GCCCAGCCAG

1501 TTTATGGAAA ACTTCGTTTG GGAATACAAT GTATTGGCAC AAATGTCCGC

1551 CCACGAAGAA AccgGCGAGC CCCTGCCGAA AGAACTCTTC GACAAAATGC
```

-continued

```
1601  TcgcCGCCAA AAACTTCCAG CGCGGTATGT TCCTCGTCCG GCAAATGGAG

1651  TTCGCCCTCT TCGATATGAT GATTTACAGT GAAAGCGACG AATGCCGTCT

1701  GAAAAACTGG CAGCAGGTTT TAGACAGCGT GCGCAAAGAA GTcGCCGTCA

1751  TCCAACCGCC CGAATACAAC CGCTTCGCCA ACAGCTTCGG CCacatctTC

1801  GCcggcGGCT ATTCCGCAGG CTATTACAGC TACGCATGGG CCGAAGTCCt 1851  cAGCACCGAT GCCTACGCCG CCTTTGAAGA AAGcGACGac gtcGCCGCCA 1901  CAGGCAAACG CTTCTGGCAA GAAAtccttg ccgtcggcgg ctCCCGCAGC 1951  gcgGCGGAAT CCTTCAAAGC CTTCCGCGGA CGCGAACCGA GCATAGACGC 2001  ACTGCTGCGC CAaagcggtT TCGACAACGC gGCttgA
```

This corresponds to the amino acid sequence <SEQ ID 3088; ORF 128.ng>:

```
g128.pep
    1  MIDNALLHLG EEPRFNQIQT EDIKPAVQTA IAEARGQIAA VKAQTHTGWA

51  NTVERLTGIT ERVGRIWGVV SHLNSVVDTP ELRAVYNELM PEITVFFTEI

101  GQDIELYNRF KTIKNSPEFA TLSPAQKTKL DHDLRDFVLS GAELPPERQA

151  ELAKLQTEGA QLSAKFSQNV LDATDAFGIY FDDAAPLAGI PEDALAMFAA

201  AAQSEGKTGY KIGLQIPHYL AVIQYAGNRE LREQIYRAYV TRASELSNDG

251  KFDNTANIDR TLENALKTAK LLGFKNYAEL SLATKMADTP EQVLNFLHDL

301  ARRAKPYAEK DLAEVKAFAR EHLGLADPQP WDLSYAGEKL REAKYAFSET

351  EVKKYFPVGK VLAGLFAQIK KLYGIGFAEK TVPVWHKDVR YFELQQNGKT

401  IGGVYMDLYA REGKRGGAWM NDYKGRRRFA DGTLQLPTAY LVCNFAPPVG

451  GKEARLSHDE ILTLFHETGH GLHHLLTQVD ELGVSGINGV EWDAVELPSQ

501  FMENFVWEYN VLAQMSAHEE TGEPLPKELF DKMLAAKNFQ RGMFLVRQME

551  FALFDMMIYS ESDECRLKNW QQVLDSVRKE VAVIQPPEYN RFANSFGHIF

601  AGGYSAGYYS YAWAEVLSTD AYAAFEESDD VAATGKRFWQ EILAVGGSRS

651  AAESFKAFRG REPSIDALLR QSGFDNAA*
```

ORF 128 shows 91.7% identity over a 475 aa overlap with a predicted ORF (ORF 128.ng) from *N. gonorrhoeae*:

```
m128/g128
                   10         20         30         40         50         60
g128.pep   MIDNALLHLGEEPRFNQIQTEDIKPAVQTAIAEARGQIAAVKAQTHTGWANTVERLTGIT
           | ||||||||||||:||:|||||||:||||||||  ||||:|||||||||||| |||||
m128       MTDNALLHLGEEPRFDQIKTEDIKPALQTAIAEAREQIAAIKAQTHTGWANTVEPLTGIT
                   10         20         30         40         50         60

70         80         90        100        110        120
g128.pep   ERVGRIWGVVSHLNSVVDTPELRAVYNELMPEITVFFTEIGQDIELYNRFKTIKNSPEFA
           ||||||||||||||||:|||||||||||||||||||||||||||||||||||||||||||
m128       ERVGRIWGVVSHLNCVADTPELRAVYNELMPEITVFFTEIGQDIELYNRFKTIKNSPEFD
                   70         80         90        100        110        120

130        140        150        160        170        180
g128.pep   TLSPAQKTKLDHDLRDFVLSGAELPPERQAELAKLQTEGAQLSAKFSQNVLDATDAFGIY
           |||||||||||:|
m128       TLSPAQKTKLNH
                  130
                //
```

```
                              340         350         360
g128.pep                      YAGEKLREAKYAFSETEVKKYFPVGKVLAG
                              ||:||||||||||| |||||||| || |
m128                          YASEKLREAKYAFSETXVKKYFPVGXVLNG
                              10          20          30

370         380         390         400         410         420
g128.pep     LFAQIKKLYGIGFAEKTVPVWHKDVRYFELQQNGKTIGGVYMDLYAREGKRGGAWMNDYK
             ||||  ||||||||:||||||||||||||  ||||||::||||||||||||||||||||
m128         LFAQXKKLYGIGFTEKTVPVWHKDVRYXELQQNGEXIGGVYMDLYAREGKRGGAWMNDYK
             40          50          60          70          80          90

430         440         450         460         470         480
g128.pep     GRRRFADGTLQLPTAYLVCNFAPPVGGKEARLSHDEILTLFHETGHGLHHLLTQVDELGV
             |||||:|||||||||||||||||||||:|||||||||| |||||||||||||||||||||
m128         GRRRFSDGTLQLPTAYLVCNFAPPVGGREARLSHDEILILFHETGHGLHHLLTQVDELGV
             100         110         120         130         140         150

490         500         510         520         530         540
g128.pep     SGINGVEWDAVELPSQFMENFVWEYNVLAQMSAHEETGEPLPKELFDKMLAAKNFQRGMF
             ||||||  |||||||||||||||||||||||| |||||||| || ||||| ||||| |||
m128         SGINGVXWDAVELPSQFMENFVWEYNVLAQXSAHEETGVPLPKELXDKXLAAKNFQXGMF
             160         170         180         190         200         210

550         560         570         580         590         600
g128.pep     LVRQMEFALFDMMIYSESDECRLKNWQQVLDSVRKEVAVIQPPEYNRFANSFGHIFAGGY
             |||  ||||||||||||:|| ||||||||||||||:||||||||||||||| ||||||||
m128         XVRQXEFALFDMMIYSEDDEGRLKNWQQVLDSVRKKVAVIQPPEYNRFALSFGHIFAGGY
             220         230         240         250         260         270

610         620         630         640         650         660
g128.pep     SAGYYSYAWAEVLSTDAYAAFEESDDVAATGKRFWQEILAVGGSRSAAESFKAFRGREPS
             ||: |||||||||:|||||||||||||||||||||||||||||   |:|||||||||||
m128         SAAXYSYAWAEVLSADAYAAFEESDDVAATGKRFWQEILAVGXSRSGAESFKAFRGREPS
             280         290         300         310         320         330

670         679
g128.pep     IDALLRQSGFDNAAX
             ||||||:||||||:
m128         IDALLRHSGFDNAVX
             340
```

The following partial DNA sequence was identified in *N. meningitidis* <SEQ ID 3089>:

```
a128.seq
   1 ATGACTGACA ACGCACTGCT CCATTTGGGC GAAGAACCCC GTTTTGATCA

51 AATCAAAACC GAAGACATCA AACCCGCCCT GCAAACCGCC ATTGCCGAAG

101 CGCGCGAACA AATCGCCGCC ATCAAAGCCC AAACGCACAC CGGCTGGGCA

151 AACACTGTCG AACCCCTGAC CGGCATCACC GAACGCGTCG GCAGGATTTG

201 GGGCGTGGTG TCGCACCTCA ACTCCGTCAC CGACACGCCC GAACTGCGCG

251 CCGCCTACAA TGAATTAATG CCCGAAATTA CCGTCTTCTT CACCGAAATC

301 GGACAAGACA TCGAGCTGTA CAACCGCTTC AAAACCATCA AAAACTCCCC

351 CGAGTTCGAC ACCCTCTCCC ACGCGCAAAA AACCAAACTC AACCACGATC

401 TGCGCGATTT CGTCCTCAGC GGCGCGGAAC TGCCGCCCGA ACAGCAGGCA

451 GAATTGGCAA AACTGCAAAC CGAAGGCGCG CAACTTTCCG CCAAATTCTC

501 CCAAAACGTC CTAGACGCGA CCGACGCGTT CGGCATTTAC TTTGACGATG

551 CCGCACCGCT TGCCGGCATT CCCGAAGACG CGCTCGCCAT GTTTGCCGCT

601 GCCGCGCAAA GCGAAGGCAA AACAGGCTAC AAAATCGGTT TGCAGATTCC

651 GCACTACCTC GCCGTCATCC AATACGCCGA CAACCGCAAA CTGCGCGAAC

701 AAATCTACCG CGCCTACGTT ACCCGCGCCA GCGAGCTTTC AGACGACGGC

751 AAATTCGACA ACACCGCCAA CATCGACCGC ACGCTCGAAA ACGCCCTGCA

801 AACCGCCAAA CTGCTCGGCT TCAAAAACTA CGCCGAATTG TCGCTGGCAA
```

```
-continued
 851 CCAAAATGGC GGACACCCCC GAACAAGTTT TAAACTTCCT GCACGACCTC

901 GCCCGCCGCG CCAAACCCTA CGCCGAAAAA GACCTCGCCG AAGTCAAAGC

951 CTTCGCCCGC GAAAGCCTCG GCCTCGCCGA TTTGCAACCG TGGGACTTGG

1001 GCTACGCCGG CGAAAAACTG CGCGAAGCCA AATACGCATT CAGCGAAACC

1051 GAAGTCAAAA AATACTTCCC CGTCGGCAAA GTATTAAACG GACTGTTCGC

1101 CCAAATCAAA AAACTCTACG GCATCGGATT TACCGAAAAA ACCGTCCCCG

1151 TCTGGCACAA AGACGTGCGC TATTTTGAAT TGCAACAAAA CGGCGAAACC

1201 ATAGGCGGCG TTTATATGGA TTTGTACGCA CGCGAAGGCA AACGCGGCGG

1251 CGCGTGGATG AACGACTACA AAGGCCGCCG CCGTTTTTCA GACGGCACGC

1301 TGCAACTGCC CACCGCCTAC CTCGTCTGCA ACTTCACCCC GCCCGTCGGC

1351 GGCAAAGAAG CCCGCTTGAG CCATGACGAA ATCCTCACCC TCTTCCACGA

1401 AACCGGACAC GGCCTGCACC ACCTGCTTAC CCAAGTCGAC GAACTGGGCG

1451 TATCCGGCAT CAACGGCGTA GAATGGGACG CAGTCGAACT GCCCAGTCAG

1501 TTTATGGAAA ATTTCGTTTG GGAATACAAT GTCTTGGCGC AAATGTCCGC

1551 CCACGAAGAA ACCGGCGTTC CCATGACGAA AGAACTCTTC GACAAAATGC

1601 TCGCCGCCAA AAACTTCCAA CGCGGAATGT TCCTCGTCCG CCAAATGGAG

1651 TTCGCCCTCT TTGATATGAT GATTTACAGC GAAGACGACG AAGGCCGTCT

1701 GAAAAACTGG CAACAGGTTT TAGACAGCGT GCGCAAAGAA GTCGCCGTCG

1751 TCCGACCGCC CGAATACAAC CGCTTCGCCA ACAGCTTCGG CCACATCTTC

1801 GCAGGCGGCT ATTCCGCAGG CTATTACAGC TACGCGTGGG CGGAAGTATT

1851 GAGCGCGGAC GCATACGCCG CCTTTGAAGA AAGCGACGAT GTCGCCGCCA

1901 CAGGCAAACG CTTTTGGCAG GAAATCCTCG CCGTCGGCGG ATCGCGCAGC

1951 GCGGCAGAAT CCTTCAAAGC CTTCCGCGGA CGCGAACCGA GCATAGACGC

2001 ACTCTTGCGC CACAGCGGCT TCGACAACGC GGCTTGA
```

This corresponds to the amino acid sequence <SEQ ID 3090; ORF 128.a>:

```
a128.pep
   1 MTDNALLHLG EEPRFDQIKT EDIKPALQTA IAEAREQIAA IKAQTHTGWA

51 NTVEPLTGIT ERVGRIWGVV SHLNSVTDTP ELRAAYNELM PEITVFFTEI

101 GQDIELYNRF KTIKNSPEFD TLSHAQKTKL NHDLRDFVLS GAELPPEQQA

151 ELAKLQTEGA QLSAKFSQNV LDATDAFGIY FDDAAPLAGI PEDALAMFAA

201 AAQSEGKTGY KIGLQIPHYL AVIQYADNRK LREQIYRAYV TRASELSDDG

251 KFDNTANIDR TLENALQTAK LLGFKNYAEL SLATKMADTP EQVLNFLHDL

301 ARRAKPYAEK DLAEVKAFAR ESLGLADLQP WDLGYAGEKL REAKYAFSET

351 EVKKYFPVGK VLNGLFAQIK KLYGIGFTEK TVPVWHKDVR YFELQQNGET

401 IGGVYMDLYA REGKRGGAWM NDYKGRRRFS DGTLQLPTAY LVCNFTPPVG

451 GKEARLSHDE ILTLFHETGH GLHHLLTQVD ELGVSGINGV EWDAVELPSQ

501 FMENFVWEYN VLAQMSAHEE TGVPLPKELF DKMLAAKNFQ RGMFLVRQME

551 FALFDMMIYS EDDEGRLKNW QQVLDSVRKE VAVVRPPEYN RFANSFGHIF
```

```
-continued
601 AGGYSAGYYS YAWAEVLSAD AYAAFEESDD VAATGKRFWQ EILAVGGSRS

651 AAESFKAFRG REPSIDALLR HSGFDNAA*
``` m128/a128 66.0% identity in 677 aa overlap

```
                10         20         30         40         50         60
m128.pep   MTDNALLHLGEEPRFDQIKTEDIKPALQTAIAEAREQIAAIKAQTHTGWANTVEPLTGIT
           ||||||||||||||||||||||||||||||||||||||||||||||||||||||||||||
a128       MTDNALLHLGEEPRFDQIKTEDIKPALQTAIAEAREQIAAIKAQTHTGWANTVEPLTGIT
                10         20         30         40         50         60

70         80         90        100        110        120
m128.pep   ERVGRIWGVVSHLNCVADTPELRAVYNELMPEITVFFTEIGQDIELYNRFKTIKNSPEFD
           |||||||||||||| :|||||||||:||||||||||||||||||||||||||||||||||
a128       ERVGRIWGVVSHLNSVTDTPELRAAYNELMPEITVFFTEIGQDIELYNRFKTIKNSPEFD
                70         80         90        100        110        120

130
m128.pep   TLSPAQKTKLNH------------------------------------------------
           ||| ||||||||
a128       TLSHAQKTKLNHDLRDFVLSGAELPPEQQAELAKLQTEGAQLSAKFSQNVLDATDAFGIY
               130        140        150        160        170        180 m128.pep   ------------------------------------------------------------ a128       FDDAAPLAGIPEDALAMFAAAAQSEGKTGYKIGLQIPHYLAVIQYADNRKLREQIYRAYV
               190        200        210        220        230        240 m128.pep   ------------------------------------------------------------ a128       TRASELSDDGKFDNTANIDRTLENALQTAKLLGFKNYAELSLATKMADTPEQVLNFLHDL
               250        260        270        280        290        300

140        150
m128.pep   -------------------------------YASEKLREAKYAFSETXVKKYFPVGX
                                          ||:||||||||||||| ||||||||
a128       ARRAKPYAEKDLAEVKAFARESLGLADLQPWDLGYAGEKLREAKYAFSETEVKKYFPVGK
               310        320        330        340        350        360

160        170        180        190        200        210
m128.pep   VLNGLFAQXKKLYGIGFTEKTVPVWHKDVRYXELQQNGEXIGGVYMDLYAREGKRGGAWM
           |||||||| ||||||||||||||||||||||| ||||||||:||||||||||||||||||
a128       VLNGLFAQIKKLYGIGFTEKTVPVWHKDVRYFELQQNGETIGGVYMDLYAREGKRGGAWM
               370        380        390        400        410        420

220        230        240        250        260        270
m128.pep   NDYKGRRRFSDGTLQLPTAYLVCNFAPPVGGREARLSHDEILILFHETGHGLHHLLTQVD
           ||||||||||||||||||||||||||:|||||:||||||||||| ||||||||||||||
a128       NDYKGRRRFSDGTLQLPTAYLVCNFTPPVGGKEARLSHDEILTLFHETGHGLHHLLTQVD
               420        440        450        460        470        480

280        290        300        310        320        330
m128.pep   ELGVSGINGVXWDAVELPSQFMENFVWEYNVLAQXSAHEETGVPLPKELXDKXLAAKNFQ
           |||||||||| |||||||||||||||||||||| |||||||||||||| || |||||||
a128       ELGVSGINGVEWDAVELPSQFMENFVWEYNVLAQMSAHEETGVPLPKELFDKMLAAKNFQ
               490        500        510        520        530        540

340        350        360        370        380        390
m128.pep   XGMFXVRQXEFALFDMMIYSEDDEGRLKNWQQVLDSVRKKVAVIQPPEYNRFALSFGHIF
            ||| ||| |||||||||||||||||||||||||||||:|||::||||||||||:|||||
a128       RGMFLVRQMEFALFDMMIYSEDDEGRLKNWQQVLDSVRKEVAVVRPPEYNRFANSFGHIF
               550        560        570        580        590        600

400        410        420        430        440        450
m128.pep   AGGYSAAXYSYAWAEVLSADAYAAFEESDDVAATGKRFWQEILAVGXSRSGAESFKAFRG
           ||||||: |||||||||||||||||||||||||||||||||||||| |||:||||||||
a128       AGGYSAGYYSYAWAEVLSADAYAAFEESDDVAATGKRFWQEILAVGGSRSAAESFKAFRG
               610        620        630        640        650        660

460        470
m128.pep   REPSIDALLRHSGFDNAVX
           ||||||||||||||||||:
a128       REPSIDALLRHSGFDNAAX
               670
```

The following partial DNA sequence was identified in *N. meningitidis* <SEQ ID 3091>:

```
m128-1.seq
   1 ATGACTGACA ACGCACTGCT CCATTTGGGC GAAGAACCCC GTTTTGATCA
  51 AATCAAAACC GAAGACATCA AACCCGCCCT GCAAACCGCC ATCGCCGAAG
 101 CGCGCGAACA AATCGCCGCC ATCAAAGCCC AAACGCACAC CGGCTGGGCA
 151 AACACTGTCG AACCCCTGAC CGGCATCACC GAACGCGTCG GCAGGATTTG
 201 GGGCGTGGTG TCGCACCTCA ACTCCGTCGC CGACACGCCC GAACTGCGCG
 251 CCGTCTATAA CGAACTGATG CCCGAAATCA CCGTCTTCTT CACCGAAATC
 301 GGACAAGACA TCGAGCTGTA CAACCGCTTC AAAACCATCA AAAATTCCCC
 351 CGAATTCGAC ACCCTCTCCC CCGCACAAAA AACCAAACTC AACCACGATC
 401 TGCGCGATTT CGTCCTCAGC GGCGCGGAAC TGCCGCCCGA ACAGCAGGCA
 451 GAACTGGCAA AACTGCAAAC CGAAGGCGCG CAACTTTCCG CCAAATTCTC
 501 CCAAAACGTC CTAGACGCGA CCGACGCGTT CGGCATTTAC TTTGACGATG
 551 CCGCACCGCT TGCCGGCATT CCCGAAGACG CGCTCGCCAT GTTTGCCGCC
 601 GCCGCGCAAA GCGAAAGCAA AACAGGCTAC AAAATCGGCT TGCAGATTCC
 651 ACACTACCTC GCCGTCATCC AATACGCCGA CAACCGCGAA CTGCGCGAAC
 701 AAATCTACCG CGCCTACGTT ACCCGCGCCA GCGAACTTTC AGACGACGGC
 751 AAATTCGACA ACACCGCCAA CATCGACCGC ACGCTCGCAA ACGCCCTGCA
 801 AACCGCCAAA CTGCTCGGCT TCAAAAACTA CGCCGAATTG TCGCTGGCAA
 851 CCAAAATGGC GGACACGCCC GAACAAGTTT TAAACTTCCT GCACGACCTC
 901 GCCCGCCGCG CCAAACCCTA CGCCGAAAAA GACCTCGCCG AAGTCAAAGC
 951 CTTCGCCCGC GAAAGCCTGA ACCTCGCCGA TTTGCAACCG TGGGACTTGG
1001 GCTACGCCAG CGAAAAACTG CGCGAAGCCA AATACGCGTT CAGCGAAACC
1051 GAAGTCAAAA AATACTTCCC CGTCGGCAAA GTATTAAACG GACTGTTCGC
1101 CCAAATCAAA AAACTCTACG GCATCGGATT TACCGAAAAA ACCGTCCCCG
1151 TCTGGCACAA AGACGTGCGC TATTTTGAAT TGCAACAAAA CGGCGAAACC
1201 ATAGGCGGCG TTTATATGGA TTTGTACGCA CGCGAAGGCA AACGCGGCGG
1251 CGCGTGGATG AACGACTACA AAGGCCGCCG CCGTTTTTCA GACGGCACGC
1301 TGCAACTGCC CACCGCCTAC CTCGTCTGCA ACTTCGCCCC ACCCGTCGGC
1351 GGCAGGGAAG CCCGCCTGAG CCACGACGAA ATCCTCATCC TCTTCCACGA
1401 AACCGGACAC GGGCTGCACC ACCTGCTTAC CCAAGTGGAC GAACTGGGCG
1451 TATCCGGCAT CAACGGCGTA GAATGGGACG CGGTCGAACT GCCCAGCCAG
1501 TTTATGGAAA ATTTCGTTTG GGAATACAAT GTCTTGGCAC AAATGTCAGC
1551 CCACGAAGAA ACCGGCGTTC CCCTGCCGAA AGAACTCTTC GACAAAATGC
1601 TCGCCGCCAA AAACTTCCAA CGCGGCATGT TCCTCGTCCG GCAAATGGAG
1651 TTCGCCCTCT TTGATATGAT GATTTACAGC GAAGACGACG AAGGCCGTCT
1701 GAAAAACTGG CAACAGGTTT TAGACAGCGT GCGCAAAAAA GTCGCCGTCA
1751 TCCAGCCGCC CGAATACAAC CGCTTCGCCT TGAGCTTCGG CCACATCTTC
1801 GCAGGCGGCT ATTCCGCAGG CTATTACAGC TACGCGTGGG CGGAAGTATT
1851 GAGCGCGGAC GCATACGCCG CCTTTGAAGA AAGCGACGAT GTCGCCGCCA
1901 CAGGCAAACG CTTTTGGCAG GAAATCCTCG CCGTCGGCGG ATCGCGCAGC
```

```
1951  GCGGCAGAAT CCTTCAAAGC CTTCCGCGGC CGCGAACCGA GCATAGACGC

2001  ACTCTTGCGC CACAGCGGTT TCGACAACGC GGTCTGA
```

This corresponds to the amino acid sequence <SEQ ID 3092; ORF 128-1>:

```
m128-1.pep.
   1  MTDNALLHLG EEPRFDQIKT EDIKPALQTA IAEAREQIAA IKAQTHTGWA

51  NTVEPLTGIT ERVGRIWGVV SHLNSVADTP ELRAVYNELM PEITVFFTEI

101  GQDIELYNRF KTIKNSPEFD TLSPAQKTKL NHDLRDFVLS GAELPPEQQA

151  ELAKLQTEGA QLSAKFSQNV LDATDAFGIY FDDAAPLAGI PEDALAMFAA

201  AAQSESKTGY KIGLQIPHYL AVIQYADNRE LREQIYRAYV TRASELSDDG

251  KFDNTANIDR TLANALQTAK LLGFKNYAEL SLATKMADTP EQVLNFLHDL

301  ARRAKPYAEK DLAEVKAFAR ESLNLADLQP WDLGYASEKL REAKYAFSET

351  EVKKYFPVGK VLNGLFAQIK KLYGIGFTEK TVPVWHKDVR YFELQQNGET

401  IGGVYMDLYA REGKRGGAWM NDYKGRRRFS DGTLQLPTAY LVCNFAPPVG

451  GREARLSHDE ILILFHETGH GLHHLLTQVD ELGVSGINGV EWDAVELPSQ

501  FMENFVWEYN VLAQMSAHEE TGVPLPKELF DKMLAAKNFQ RGMFLVRQME

551  FALFDMMIYS EDDEGRLKNW QQVLDSVRKK VAVIQPPEYN RFALSFGHIF

601  AGGYSAGYYS YAWAEVLSAD AYAAFEESDD VAATGKRFWQ EILAVGGSRS

651  AAESFKAFRG REPSIDALLR HSGFDNAV*
```

The following partial DNA sequence was identified in *N. gonorrhoeae* <SEQ ID 3093>:

```
g128-1.seq (partial)
   1  ATGATTGACA ACGCACTGCT CCACTTGGGC GAAGAACCCC GTTTTAATCA

51  AATCAAAACC GAAGACATCA AACCCGCCGT CCAAACCGCC ATCGCCGAAG

101  CGCGCGGACA AATCGCCGCC GTCAAAGCGC AAACGCACAC CGGCTGGGCG

151  AACACCGTCG AGCGTCTGAC CGGCATCACC GAACGCGTCG GCAGGATTTG

201  GGGCGTCGTG TCCCATCTCA ACTCCGTCGT CGACACGCCC GAACTGCGCG

251  CCGTCTATAA CGAACTGATG CCTGAAATCA CCGTCTTCTT CACCGAAATC

301  GGACAAGACA TCGAACTGTA CAACCGCTTC AAAACCATCA AAAATTCCCC

351  CGAATTTGCA ACGCTTTCCC CCGCACAAAA AACCAAGCTC GATCACGACC

401  TGCGCGATTT CGTATTGAGC GGCGCGGAAC TGCCGCCCGA ACGGCAGGCA

451  GAACTGGCAA AACTGCAAAC CGAAGGCGCG CAACTTTCCG CCAAATTCTC

501  CCAAAACGTC CTAGACGCGA CCGACGCGTT CGGCATTTAC TTTGACGATG

551  CCGCACCGCT TGCCGGCATT CCCGAAGACG CGCTCGCCAT GTTTGCCGCC

601  GCCGCGCAAA GCGAAGGCAA AACAGGTTAC AAAATCGGCT TGCAGATTCC

651  GCACTACCTT GCCGTTATCC AATACGCCGG CAACCGCGAA CTGCGCGAAC

701  AAATCTACCG CGCCTACGTT ACCCGTGCCA GCGAACTTTC AAACGACGGC

751  AAATTCGACA ACACCGCCAA CATCGACCGC ACGCTCGAAA ACGCATTGAA

801  AACCGCCAAA CTGCTCGGCT TTAAAAATTA CGCCGAATTG TCGCTGGCAA

851  CCAAAATGGC GGACACGCCC GAACAGGTTT TAAACTTCCT GCACGACCTC
```

```
 901 GCCCGCCGCG CCAAACCCTA CGCCGAAAAA GACCTCGCCG AAGTCAAAGC

951 CTTCGCCCGC GAACACCTCG GTCTCGCCGA CCCGCAGCCG TGGGACTTGA

1001 GCTACGCCGG CGAAAAACTG CGCGAAGCCA AATACGCATT CAGCGAAACC

1051 GAAGTCAAAA AATACTTCCC CGTCGGCAAA GTTCTGGCAG CCTGTTCGC

1101 CCAAATCAAA AAACTCTACG GCATCGGATT CGCCGAAAAA ACCGTTCCCG

1151 TCTGGCACAA AGACGTGCGC TATTTTGAAT TGCAACAAAA CGGCAAAACC

1201 ATCGGCGGCG TTTATATGGA TTTGTACGCA CGCGAAGGCA AACGCGGCGG

1251 CGCGTGGATG AACGACTACA AGGCCGCCG CCGCTTTGCC GACGGCACGC

1301 TGCAACTGCC CACCGCCTAC CTCGTCTGCA ACTTCGCCCC GCCCGTCGGC

1351 GGCAAAGAAG CGCGTTTAAG CCACGACGAA ATCCTCACCC TCTTCCACGA

1401 AACCGGCCAC GGACTGCACC ACCTGCTTAC CCAAGTGGAC GAACTGGGCG

1451 TGTCCGGCAT CAACGGCGTA AAA
```

This corresponds to the amino acid sequence <SEQ ID 3094; ORF 128-1.ng>:

```
g128-1.pep (partial)

1  MIDNALLHLG EEPRFNQIKT EDIKPAVQTA IAEARGQIAA VKAQTHTGWA

51  NTVERLTGIT ERVGRIWGVV SHLNSVVDTP ELRAVYNELM PEITVFFTEI

101  GQDIELYNRF KTIKNSPEFA TLSPAQKTKL DHDLRDFVLS GAELPPERQA

151  ELAKLQTEGA QLSAKFSQNV LDATDAFGIY FDDAAPLAGI PEDALAMFAA

201  AAQSEGKTGY KIGLQIPHYL AVIQYAGNRE LREQIYRAYV TRASELSNDG

251  KFDNTANIDR TLENALKTAK LLGFKNYAEL SLATKMADTP EQVLNFLHDL

301  ARRAKPYAEK DLAEVKAFAR EHLGLADPQP WDLSYAGEKL REAKYAFSET

351  EVKKYFPVGK VLAGLFAQIK KLYGIGFAEK TVPVWHKDVR YFELQQNGKT

401  IGGVYMDLYA REGKRGGAWM NDYKGRRRFA DGTLQLPTAY LVCNFAPPVG

451  GKEARLSHDE ILTLFHETGH GLHHLLTQVD ELGVSGINGV K m128-1/g128-1  94.5% identity in 491 aa overlap 10         20         30         40         50         60
    g128-1.pep  MIDNALLHLGEEPRFNQIKTEDIKPAVQTAIAEARGQIAAVKAQTHTGWANTVERLTGIT
                |  ||||||||||||||||||:|||||||||||:|||||||  ||||:||||||||||| |||||
    m128-1      MTDNALLHLGEEPRFDQIKTEDIKPALQTAIAEAREQIAAIKAQTHTGWANTVEPLTGIT
                     10         20         30         40         50         60

70         80         90        100        110        120
    g128-1.pep  ERVGRIWGVVSHLNSVVDTPELRAVYNELMPEITVFFTEIGQDIELYNRFKTIKNSPEFA
                |||||||||||||||||:||||||||||||||||||||||||||||||||||||||||||
    m128-1      ERVGRIWGVVSHLNSVADTPELRAVYNELMPEITVFFTEIGQDIELYNRFKTIKNSPEFA
                     70         80         90        100        110        120

130        140        150        160        170        180
    g128-1.pep  TLSPAQKTKLDHDLRDFVLSGAELPPERQAELAKLQTEGAQLSAKFSQNVLDATDAFGIY
                ||||||||||:|||||||||||||||||:|||||||||||||||||||||||||||||||
    m128-1      TLSPAQKTKLNHDLRDFVLSGAELPPEQQAELAKLQTEGAQLSAKFSQNVLDATDAFGIY
                    130        140        150        160        170        180

190        200        210        220        230        240
    g128-1.pep  FDDAAPLAGIPEDALAMFAAAAQSEGKTGYKIGLQIPHYLAVIQYAGNRELREQIYRAYV
                ||||||||||||||||||||||||:|||||||||||||||||||||||  |||||||||||
    m128-1      FDDAAPLAGIPEDALAMFAAAAQSESKTGYKIGLQIPHYLAVIQYADNRELREQIYRAYV
                    190        200        210        220        230        240
```

-continued

```
                   250       260       270       280       290       300
g128-1.pep  TRASELSNDGKFDNTANIDRTLENALKTAKLLGFKNYAELSLATKMADTPEQVLNFLHDL
            |||||||:||||||||||||||| ||:|||||||||||||||||||||||||||||||||
m128-1      TRASELSDDGKFDNTANIDRTLANALQTAKLLGFKNYAELSLATKMADTPEQVLNFLHDL
                   250       260       270       280       290       300

310       320       330       340       350       360
g128-1.pep  ARRAKPYAEKDLAEVKAFAREHLGLADPQPWDLSYAGEKLREAKYAFSETEVKKYFPVGK
            ||||||||||||||||||||| |:||| |||||:||:|||||||||||||||||||||||
m128-1      ARRAKPYAEKDLAEVKAFARESLNLADLQPWDLGYASEKLREAKYAFSETEVKKYFPVGK
                   310       320       330       340       350       360

370       380       390       400       410       420
g128-1.pep  VLAGLFAQIKKLYGIGFAEKTVPVWHKDVRYFELQQNGKTIGGVYMDLYAREGKRGGAWM
            || ||||||||||||||:||||||||||||||||||||:|||||||||||||||||||||
m128-1      VLNGLFAQIKKLYGIGFTEKTVPVWHKDVRYFELQQNGETIGGVYMDLYAREGKRGGAWM
                   370       380       390       400       410       420

430       440       450       460       470       480
g128-1.pep  NDYKGRRRFADGTLQLPTAYLVCNFAPPVGGKEARLSHDEILTLFHETGHGLHHLLTQVD
            |||||||||:|||||||||||||||||||||:|||||||||| |||||||||||||||||
m128-1      NDYKGRRRFSDGTLQLPTAYLVCNFAPPVGGREARLSHDEILILFHETGHGLHHLLTQVD
                   430       440       450       460       470       480

490
g128-1.pep  ELGVSGINGVK
            ||||||||||:
m128-1      ELGVSGINGVEWDAVELPSQFMENFVWEYNVLAQMSAHEETGVPLPKELFDKMLAAKNFQ
                   490       500       510       520       530       540
```

The following partial DNA sequence was identified in *N. meningitidis* <SEQ ID 3095>:

```
a128-1.seq
   1  ATGACTGACA ACGCACTGCT CCATTTGGGC GAAGAACCCC GTTTTGATCA

51  AATCAAAACC GAAGACATCA AACCCGCCCT GCAAACCGCC ATTGCCGAAG

101  CGCGCGAACA AATCGCCGCC ATCAAAGCCC AAACGCACAC CGGCTGGGCA

151  AACACTGTCG AACCCCTGAC CGGCATCACC GAACGCGTCG GCAGGATTTG

201  GGGCGTGGTG TCGCACCTCA ACTCCGTCAC CGACACGCCC GAACTGCGCG

251  CCGCCTACAA TGAATTAATG CCCGAAATTA CCGTCTTCTT CACCGAAATC

301  GGACAAGACA TCGAGCTGTA CAACCGCTTC AAAACCATCA AAAACTCCCC

351  CGAGTTCGAC ACCCTCTCCC ACGCGCAAAA AACCAAACTC AACCACGATC

401  TGCGCGATTT CGTCCTCAGC GGCGCGGAAC TGCCGCCCGA ACAGCAGGCA

451  GAATTGGCAA AACTGCAAAC CGAAGGCGCG CAACTTTCCG CCAAATTCTC

501  CCAAAACGTC CTAGACGCGA CCGACGCGTT CGGCATTTAC TTTGACGATG

551  CCGCACCGCT TGCCGGCATT CCCGAAGACG CGCTCGCCAT GTTTGCCGCT

601  GCCGCGCAAA GCGAAGGCAA AACAGGCTAC AAAATCGGTT TGCAGATTCC

651  GCACTACCTC GCCGTCATCC AATACGCCGA CAACCGCAAA CTGCGCGAAC

701  AAATCTACCG CGCCTACGTT ACCCGCGCCA GCGAGCTTTC AGACGACGGC

751  AAATTCGACA ACACCGCCAA CATCGACCGC ACGCTCGAAA ACGCCCTGCA

801  AACCGCCAAA CTGCTCGGCT TCAAAAACTA CGCCGAATTG TCGCTGGCAA

851  CCAAAATGGC GGACACCCCC GAACAAGTTT TAAACTTCCT GCACGACCTC

901  GCCCGCCGCG CCAAACCCTA CGCCGAAAAA GACCTCGCCG AAGTCAAAGC

951  CTTCGCCCGC GAAAGCCTCG GCCTCGCCGA TTTGCAACCG TGGGACTTGG

1001  GCTACGCCGG CGAAAAACTG CGCGAAGCCA AATACGCATT CAGCGAAACC

1051  GAAGTCAAAA AATACTTCCC CGTCGGCAAA GTATTAAACG GACTGTTCGC
```

```
-continued
1101 CCAAATCAAA AAACTCTACG GCATCGGATT TACCGAAAAA ACCGTCCCCG

1151 TCTGGCACAA AGACGTGCGC TATTTTGAAT TGCAACAAAA CGGCGAAACC

1201 ATAGGCGGCG TTTATATGGA TTTGTACGCA CGCGAAGGCA AACGCGGCGG

1251 CGCGTGGATG AACGACTACA AAGGCCGCCG CCGTTTTTCA GACGGCACGC

1301 TGCAACTGCC CACCGCCTAC CTCGTCTGCA ACTTCACCCC GCCCGTCGGC

1351 GGCAAAGAAG CCCGCTTGAG CCATGACGAA ATCCTCACCC TCTTCCACGA

1401 AACCGGACAC GGCCTGCACC ACCTGCTTAC CCAAGTCGAC GAACTGGGCG

1451 TATCCGGCAT CAACGGCGTA GAATGGGACG CAGTCGAACT GCCCAGTCAG

1501 TTTATGGAAA ATTTCGTTTG GGAATACAAT GTCTTGGCGC AAATGTCCGC

1551 CCACGAAGAA ACCGGCGTTC CCCTGCCGAA AGAACTCTTC GACAAAATGC

1601 TCGCCGCCAA AAACTTCCAA CGCGGAATGT TCCTCGTCCG CCAAATGGAG

1651 TTCGCCCTCT TTGATATGAT GATTTACAGC GAAGACGACG AAGGCCGTCT

1701 GAAAAACTGG CAACAGGTTT TAGACAGCGT GCGCAAAGAA GTCGCCGTCG

1751 TCCGACCGCC CGAATACAAC CGCTTCGCCA ACAGCTTCGG CCACATCTTC

1801 GCAGGCGGCT ATTCCGCAGG CTATTACAGC TACGCGTGGG CGGAAGTATT

1851 GAGCGCGGAC GCATACGCCG CCTTTGAAGA AAGCGACGAT GTCGCCGCCA

1901 CAGGCAAACG CTTTTGGCAG GAAATCCTCG CCGTCGGCGG ATCGCGCAGC

1951 GCGGCAGAAT CCTTCAAAGC CTTCCGCGGA CGCGAACCGA GCATAGACGC

2001 ACTCTTGCGC CACAGCGGCT TCGACAACGC GGCTTGA
```

This corresponds to the amino acid sequence <SEQ ID 3096; ORF 128-1.a>:

```
a128-1.pep
    1 MTDNALLHLG EEPRFDQIKT EDIKPALQTA IAEAREQIAA IKAQTHTGWA

51 NTVEPLTGIT ERVGRIWGVV SHLNSVTDTP ELRAAYNELM PEITVFFTEI

101 GQDIELYNRF KTIKNSPEFD TLSHAQKTKL NHDLRDFVLS GAELPPEQQA

151 ELAKLQTEGA QLSAKFSQNV LDATDAFGIY FDDAAPLAGI PEDALAMFAA

201 AAQSEGKTGY KIGLQIPHYL AVIQYADNRK LREQIYRAYV TRASELSDDG

251 KFDNTANIDR TLENALQTAK LLGFKNYAEL SLATKMADTP EQVLNFLHDL

301 ARRAKPYAEK DLAEVKAFAR ESLGLADLQP WDLGYAGEKL REAKYAFSET

351 EVKKYFPVGK VLNGLFAQIK KLYGIGFTEK TVPVWHKDVR YFELQQNGET

401 IGGVYMDLYA REGKRGGAWM NDYKGRRRFS DGTLQLPTAY LVCNFTPPVG

451 GKEARLSHDE ILTLFHETGH GLHHLLTQVD ELGVSGINGV EWDAVELPSQ

501 FMENFVWEYN VLAQMSAHEE TGVPLPKELF DKMLAAKNFQ RGMFLVRQME

551 FALFDMMIYS EDDEGRLKNW QQVLDSVRKE VAVVRPPEYN RFANSFGHIF

601 AGGYSAGYYS YAWAEVLSAD AYAAFEESDD VAATGKRFWQ EILAVGGSRS

651 AAESFKAFRG REPSIDALLR HSGFDNAA*
``` m128-1/a128-1 97.8% identity in 677 aa overlap

```
                    10         20         30         40         50         60
a128-1.pep  MTDNALLHLGEEPRFDQIKTEDIKPALQTAIAEAREQIAAIKAQTHTGWANTVEPLTGIT
            ||||||||||||||||||||||||||||||||||||||||||||||||||||||||||||
m128-1      MTDNALLHLGEEPRFDQIKTEDIKPALQTAIAEAREQIAAIKAQTHTGWANTVEPLTGIT
                    10         20         30         40         50         60

70         80         90        100        110        120
a128-1.pep  ERVGRIWGVVSHLNSVTDTPELRAAYNELMPEITVFFTEIGQDIELYNRFKTIKNSPEFD
            ||||||||||||||||:|||||:|||||||||||||||||||||||||||||||||||||
m128-1      ERVGRIWGVVSHLNSVADTPELRAVYNELMPEITVFFTEIGQDIELYNRFKTIKNSPEFD
                    70         80         90        100        110        120

130        140        150        160        170        180
a128-1.pep  TLSHAQKTKLNHDLRDFVLSGAELPPEQQAELAKLQTEGAQLSAKFSQNVLDATDAFGIY
            ||| ||||||||||||||||||||||||||||||||||||||||||||||||||||||||
m128-1      TLSPAQKTKLNHDLRDFVLSGAELPPEQQAELAKLQTEGAQLSAKFSQNVLDATDAFGIY
                   130        140        150        160        170        180

190        200        210        220        230        240
a128-1.pep  FDDAAPLAGIPEDALAMFAAAAQSEGKTGYKIGLQIPHYLAVIQYADNRKLREQIYRAYV
            |||||||||||||||||||||||:||||||||||||||||||||||||:|||||||||||
m128-1      FDDAAPLAGIPEDALAMFAAAAQSESKTGYKIGLQIPHYLAVIQYADNRELREQIYRAYV
                   190        200        210        220        230        240

250        260        270        280        290        300
a128-1.pep  TRASELSDDGKFDNTANIDRTLENALQTAKLLGFKNYAELSLATKMADTPEQVLNFLHDL
            |||||||||||||||||||||| |||||||||||||||||||||||||||||||||||||
m128-1      TRASELSDDGKFDNTANIDRTLANALQTAKLLGFKNYAELSLATKMADTPEQVLNFLHDL
                   250        260        270        280        290        300

310        320        330        340        350        360
a128-1.pep  ARRAKPYAEKDLAEVKAFAREHLGLADPQPWDLSYAGEKLREAKYAFSETEVKKYFPVGK
            ||||||||||||||||||||||||:|||||||||||:|||||||||||||||||||||||
m128-1      ARRAKPYAEKDLAEVKAFAREHLNLADPQPWDLSYASEKLREAKYAFSETEVKKYFPVGK
                   310        320        330        340        350        360

370        380        390        400        410        420
a128-1.pep  VLNGLFAQIKKLYGIGFTEKTVPVWHKDVRYFELQQNGETIGGVYMDLYAREGKRGGAWM
            ||||||||||||||||||||||||||||||||||||||||||||||||||||||||||||
m128-1      VLNGLFAQIKKLYGIGFTEKTVPVWHKDVRYFELQQNGETIGGVYMDLYAREGKRGGAWM
                   370        380        390        400        410        420

430        440        450        460        470        480
a128-1.pep  NDYKGRRRFSDGTLQLPTAYLVCNFTPPVGGKEARLSHDEILTLFHETGHGLHHLLTQVD
            |||||||||||||||||||||||||||||:|||||:|||||||||| |||||||||||||
m128-1      NDYKGRRRFSDGTLQLPTAYLVCNFAPPVGGREARLSHDEILILFHETGHGLHHLLTQVD
                   430        440        450        460        470        480

490        500        510        520        530        540
a128-1.pep  ELGVSGINGVEWDAVELPSQFMENFVWEYNVLAQMSAHEETGVPLPKELFDKMLAAKNFQ
            ||||||||||||||||||||||||||||||||||||||||||||||||||||||||||||
m128-1      ELGVSGINGVEWDAVELPSQFMENFVWEYNVLAQMSAHEETGVPLPKELFDKMLAAKNFQ
                   490        500        510        520        530        540

550        560        570        580        590        600
a128-1.pep  RGMFLVRQMEFALFDMMIYSEDDEGRLKNWQQVLDSVRKEVAVVRPPEYNRFANSFGHIF
            |||||||||||||||||||||||||||||||||||||||:|||::|||||||||:|||||
m128-1      RGMFLVRQMEFALFDMMIYSEDDEGRLKNWQQVLDSVRKKVAVIQPPEYNRFALSFGHIF
                   550        560        570        580        590        600

610        620        630        640        650        660
a128-1.pep  AGGYSAGYYSYAWAEVLSADAYAAFEESDDVAATGKRFWQEILAVGGSRSAAESFKAFRG
            ||||||||||||||||||||||||||||||||||||||||||||||||||||||||||||
m128-1      AGGYSAGYYSYAWAEVLSADAYAAFEESDDVAATGKRFWQEILAVGGSRSAAESFKAFRG
                   610        620        630        640        650        660

670       679
a128-1.pep  REPSIDALLRHSGFDNAAX
            ||||||||||||||||||:
m128-1      REPSIDALLRHSGFDNAVX
                   670
```

206

The following partial DNA sequence was identified in *N. meningitidis* <SEQ ID 3097>:

```
m206.seq
  1 ATGTTTCCCC CCGACAAAAC CCTTTTCCTC TGTCTCAGCG CACTGCTCCT

51 CGCCTCATGC GGCACGACCT CCGGCAAACA CCGCCAACCG AAACCCAAAC

101 AGACAGTCCG GCAAATCCAA GCCGTCCGCA TCAGCCACAT CGACCGCACA

151 CAAGGCTCGC AGGAACTCAT GCTCCACAGC CTCGGACTCA TCGGCACGCC

201 CTACAAATGG GGCGGCAGCA GCACCGCAAC CGGCTTCGAT TGCAGCGGCA

251 TGATTCAATT CGTTTACAAr AACGCCCTCA ACGTCAAGCT GCCGCGCACC

301 GCCCGCGACA TGGCGGCGGC AAGCCGsAAA ATCCCCGAcA GCCGCyTCAA

351 GGCCGGCGAC CTCGTATTCT TCAACACCGG CGGCGCACAC CGCTACTCAC

401 ACGTCGGACT CTACATCGGC AACGGCGAAT TCATCCATGC CCCCAGCAGC

451 GGCAAAACCA TCAAAACCGA AAAACTCTCC ACACCGTTTT ACGCCAAAAA

501 CTACCTCGGC GCACATACTT TTTTTACAGA ATGA
```

This corresponds to the amino acid sequence <SEQ ID 3098; ORF 206>:

```
m206.pep . . .
  1 MFPPDKTLFL CLSALLLASC GTTSGKHRQP KPKQTVRQI QAVRISHIDRT

51 QGSQELMLHS LGLIGTPYKW GGSSTATGFD CSGMIQFVY KNALNVKLPRT

101 ARDMAAASRK IPDSRXKAGD LVFFNTGGAH RYSHVGLYI GNGEFIHAPSS

151 GKTIKTEKLS TPFYAKNYLG AHTFFTE*
```

35

The following partial DNA sequence was identified in *N. gonorrhoeae* <SEQ ID 3099>:

```
g206.seq.
  1 atgttttccc ccgacaaaac cctttttcctc tgtctcggcg cactgctcct 51 cgcctcatgc ggcacgacct ccggcaaaca ccgccaaccg aaacccaaac 101 agacagtccg gcaaatccaa gccgtccgca tcagccacat cggccgcaca 151 caaggctcgc aggaactcat gctccacagc ctcggactca tcggcacgcc 201 ctacaaatgg ggcggcagca gcaccgcaac cggcttcgac tgcagcggca 251 tgattcaatt ggtttacaaa aacgccctca acgtcaagct gccgcgcacc 301 gcccgcgaca tggcggcggc aagccgcaaa atccccgaca gccgcctcaa 351 ggccggcgac atcgtattct tcaacaccgg cggcgcacac cgctactcac 401 acgtcggact ctacatcggc aacggcgaat tcatccatgc ccccggcagc 451 ggcaaaacca tcaaaaccga aaaactctcc acaccgtttt acgccaaaaa 501 ctaccttgga gcgcatacgt ttttacaga atga
```

This corresponds to the amino acid sequence <SEQ ID 3100; ORF 206.ng>:

```
g206.pep
  1 MFSPDKTLFL CLGALLLASC GTTSGKHRQP KPKQTVRQIQ AVRISHIGRT

51 QGSQELMLHS LGLIGTPYKW GGSSTATGFD CSGMIQLVYK NALNVKLPRT
```

```
101 ARDMAAASRK IPDSRLKAGD IVFFNTGGAH RYSHVGLYIG NGEFIHAPGS

151 GKTIKTEKLS TPFYAKNYLG AHTFFTE*
```

ORF 206 shows 96.0% identity over a 177 aa overlap with a predicted ORF (ORF 206.ng) from N. gonorrhoeae:

```
m206/g206
                    10         20         30         40         50         60
      m206.pep MFPPDKTLFLCLSALLLASCGTTSGKHRQPKPKQTVRQIQAVRISHIDRTQGSQELMLHS
               || |||||||||:||||||||||||||||||||||||||||||||||| ||||||||||
         g206 MFSPDKTLFLCLGALLLASCGTTSGKHRQPKPKQTVRQIQAVRISHIGRTQGSQELMLHS
                    10         20         30         40         50         60

70         80         90        100        110        120
      m206.pep LGLIGTPYKWGGSSTATGFDCSGMIQFVYKNALNVKLPRTARDMAAASRKIPDSRXKAGD
               |||||||||||||||||||||||||||:||||||||||||||||||||||||||| ||||
         g206 LGLIGTPYKWGGSSTATGFDCSGMIQLVYKNALNVKLPRTARDMAAASRKIPDSRLKAGD
                    70         80         90        100        110        120

130        140        150        160        170
      m206.pep LVFFNTGGAHRYSHVGLYIGNGEFIHAPSSGKTIKTEKLSTPFYAKNYLGAHTFFTEX
               :|||||||||||||||||||||||||||:|||||||||||||||||||||||||||||
         g206 IVFFNTGGAHRYSHVGLYIGNGEFIHAPGSGKTIKTEKLSTPFYAKNYLGAHTFFTE
                   130        140        150        160        170
```

The following partial DNA sequence was identified in N. meningitidis <SEQ ID 3101>:

```
a206.seq
  1 ATGTTTCCCC CCGACAAAAC CCTTTTCCTC TGTCTCAGCG CACTGCTCCT

51 CGCCTCATGC GGCACGACCT CCGGCAAACA CCGCCAACCG AAACCCAAAC

101 AGACAGTCCG GCAAATCCAA GCCGTCCGCA TCAGCCACAT CGACCGCACA

151 CAAGGCTCGC AGGAACTCAT GCTCCACAGC CTCGGACTCA TCGGCACGCC

201 CTACAAATGG GGCGGCAGCA GCACCGCAAC CGGCTTCGAT TGCAGCGGCA

251 TGATTCAATT CGTTTACAAA AACGCCCTCA ACGTCAAGCT GCCGCGCACC

301 GCCCGCGACA TGGCGGCGGC AAGCCGCAAA ATCCCCGACA GCCGCCTTAA

351 GGCCGGCGAC CTCGTATTCT TCAACACCGG CGGCGCACAC CGCTACTCAC

401 ACGTCGGACT CTATATCGGC AACGGCGAAT TCATCCATGC CCCCAGCAGC

451 GGCAAAACCA TCAAAACCGA AAAACTCTCC ACACCGTTTT ACGCCAAAAA

501 CTACCTCGGC GCACATACTT TCTTTACAGA ATGA
```

This corresponds to the amino acid sequence <SEQ ID 3102; ORF 206.a>:

```
a206.pep
  1 MFPPDKTLFL CLSALLLASC GTTSGKHRQP KPKQTVRQIQ AVRISHIDRT

51 QGSQELMLHS LGLIGTPYKW GGSSTATGFD CSGMIQFVYK NALNVKLPRT

101 ARDMAAASRK IPDSRLKAGD LVFFNTGGAH RYSHVGLYIG NGEFIHAPSS

151 GKTIKTEKLS TPFYAKNYLG AHTFFTE*
``` m206/a206 99.4% identity in 177 aa overlap

```
                    10         20         30         40         50         60
      m206.pep MFPPDKTLFLCLSALLLASCGTTSGKHRQPKPKQTVRQIQAVRISHIDRTQGSQELMLHS
               ||||||||||||||||||||||||||||||||||||||||||||||||||||||||||||
         g206 MFPPDKTLFLCLSALLLASCGTTSGKHRQPKPKQTVRQIQAVRISHIDRTQGSQELMLHS
                    10         20         30         40         50         60
```

-continued

```
                   70        80        90       100       110       120
m206.pep LGLIGTPYKWGGSSTATGFDCSGMIQFVYKNALNVKLPRTARDMAAASRKIPDSRXKAGD
         |||||||||||||||||||||||||||||||||||||||||||||||||||||| ||||
g206     LGLIGTPYKWGGSSTATGFDCSGMIQFVYKNALNVKLPRTARDMAAASRKIPDSRLKAGD
                   70        80        90       100       110       120

130       140       150       160       170
m206.pep LVFFNTGGAHRYSHVGLYIGNGEFIHAPSSGKTIKTEKLSTPFYAKNYLGAHTFFTEX
         ||||||||||||||||||||||||||||||||||||||||||||||||||||||||||
g206     LVFFNTGGAHRYSHVGLYIGNGEFIHAPSSGKTIKTEKLSTPFYAKNYLGAHTFFTEX
                  130       140       150       160       170
```

287
The following partial DNA sequence was identified in *N. meningitidis* <SEQ ID 3103>:

```
m287.seq
   1 ATGTTTAAAC GCAGCGTAAT CGCAATGGCT TGTATTTTTG CCCTTTCAGC

51 CTGCGGGGGC GGCGGTGGCG GATCGCCCGA TGTCAAGTCG GCGGACACGC

101 TGTCAAAACC TGCCGCCCCT GTTGTTTCTG AAAAAGAGAC AGAGGCAAAG

151 GAAGATGCGC CACAGGCAGG TTCTCAAGGA CAGGGCGCGC CATCCGCACA

201 AGGCAGTCAA GATATGGCGG CGGTTTCGGA AGAAAATACA GGCAATGGCG

251 GTGCGGTAAC AGCGGATAAT CCCAAAAATG AAGACGAGGT GGCACAAAAT

301 GATATGCCGC AAAATGCCGC CGGTACAGAT AGTTCGACAC CGAATCACAC

351 CCCGGATCCG AATATGCTTG CCGGAAATAT GGAAAATCAA GCAACGGATG

401 CCGGGGAATC GTCTCAGCCG GCAAACCAAC CGGATATGGC AAATGCGGCG

451 GACGGAATGC AGGGGGACGA TCCGTCGGCA GGCGGGCAAA ATGCCGGCAA

501 TACGGCTGCC CAAGGTGCAA ATCAAGCCGG AAACAATCAA GCCGCCGGTT

551 CTTCAGATCC CATCCCCGCG TCAAACCCTG CACCTGCGAA TGGCGGTAGC

601 AATTTTGGAA GGGTTGATTT GGCTAATGGC GTTTTGATTG ACGGGCCGTC

651 GCAAAATATA ACGTTGACCC ACTGTAAAGG CGATTCTTGT AGTGGCAATA

701 ATTTCTTGGA TGAAGAAGTA CAGCTAAAAT CAGAATTTGA AAAATTAAGT

751 GATGCAGACA AAATAAGTAA TTACAAGAAA GATGGGAAGA ATGATAAATT

801 TGTCGGTTTG GTTGCCGATA GTGTGCAGAT GAAGGGAATC AATCAATATA

851 TTATCTTTTA TAAACCTAAA CCCACTTCAT TTGCGCGATT TAGGCGTTCT

901 GCACGGTCGA GGCGGTCGCT TCCGGCCGAG ATGCCGCTGA TTCCCGTCAA

951 TCAGGCGGAT ACGCTGATTG TCGATGGGGA AGCGGTCAGC CTGACGGGGC

1001 ATTCCGGCAA TATCTTCGCG CCCGAAGGGA ATTACCGGTA TCTGACTTAC

1051 GGGGCGGAAA AATTGCCCGG CGGATCGTAT GCCCTTCGTG TTCAAGGCGA

1101 ACCGGCAAAA GGCGAAATGC TTGCGGGCGC GGCCGTGTAC AACGGCGAAG

1151 TACTGCATTT CCATACGGAA AACGGCCGTC CGTACCCGAC CAGGGGCAGG

1201 TTTGCCGCAA AAGTCGATTT CGGCAGCAAA TCTGTGGACG GCATTATCGA

1251 CAGCGGCGAT GATTTGCATA TGGGTACGCA AAAATTCAAA GCCGCCATCG

1301 ATGGAAACGG CTTTAAGGGG ACTTGGACGG AAAATGGCAG CGGGGATGTT

1351 TCCGGAAAGT TTTACGGCCC GGCCGGCGAG GAAGTGGCGG GAAAATACAG

1401 CTATCGCCCG ACAGATGCGG AAAAGGGCGG ATTCGGCGTG TTTGCCGGCA

1451 AAAAAGAGCA GGATTGA
```

This corresponds to the amino acid sequence <SEQ ID 3104; ORF 287>:

```
m287.pep
  1 MFKRSVIAMA CIFALSACGG GGGGSPDVKS ADTLSKPAAP VVSEKETEAK

51 EDAPQAGSQG QGAPSAQGSQ DMAAVSEENT GNGGAVTADN PKNEDEVAQN

101 DMPQNAAGTD SSTPNHTPDP NMLAGNMENQ ATDAGESSQP ANQPDMANAA

151 DGMQGDDPSA GGQNAGNTAA QGANQAGNNQ AAGSSDPIPA SNPAPANGGS

201 NFGRVDLANG VLIDGPSQNI TLTHCKGDSC SGNNFLDEEV QLKSEFEKLS

251 DADKISNYKK DGKNDKFVGL VADSVQMKGI NQYIIFYKPK PTSFARFRRS

301 ARSRRSLPAE MPLIPVNQAD TLIVDGEAVS LTGHSGNIFA PEGNYRYLTY

351 GAEKLPGGSY ALRVQGEPAK GEMLAGAAVY NGEVLHFHTE NGRPYPTRGR

401 FAAKVDFGSK SVDGIIDSGD DLHMGTQKFK AAIDGNGFKG TWTENGSGDV

451 SGKFYGPAGE EVAGKYSYRP TDAEKGGFGV FAGKKEQD*
```

The following partial DNA sequence was identified in *N. gonorrhoeae* <SEQ ID 3105>:

```
g287.seq
    1 atgtttaaac gcagtgtgat tgcaatggct tgtattttc ccctttcagc 51 ctgtggggc ggcggtggcg gatcgcccga tgtcaagtcg gcggacacgc 101 cgtcaaaacc ggccgccccc gttgttgctg aaaatgccgg ggaagggtg 151 ctgccgaaag aaaagaaaga tgaggaggca gcgggcggtg cgccgcaagc 201 cgatacgcag gacgcaaccg ccggagaagg cagccaagat atggcggcag 251 tttcggcaga aaatacaggc aatggcggtg cggcaacaac ggacaacccc 301 aaaaatgaag acgcgggggc gcaaaatgat atgccgcaaa atgccgccga 351 atccgcaaat caaacaggga acaaccaacc cgccggttct tcagattccg 401 cccccgcgtc aaaccctgcc cctgcgaatg gcggtagcga ttttggaagg 451 acgaacgtgg gcaattctgt tgtgattgac ggaccgtcgc aaaatataac 501 gttgacccac tgtaaaggcg attcttgtaa tggtgataat ttattggatg 551 aagaagcacc gtcaaaatca gaatttgaaa aattaagtga tgaagaaaaa 601 attaagcgat ataaaaaaga cgagcaacgg gagaattttg tcggtttggt 651 tgctgacagg gtaaaaaagg atggaactaa caaatatatc atcttctata 701 cggacaaacc acctactcgt tctgcacggt cgaggaggtc gcttccggcc 751 gagattccgc tgattcccgt caatcaggcc gatacgctga ttgtggatgg 801 ggaagcggtc agcctgacgg ggcattccgg caatatcttc gcgcccgaag 851 ggaattaccg gtatctgact tacggggcgg aaaaattgcc cggcggatcg 901 tatgccctcc gtgtgcaagg cgaaccggca aaaggcgaaa tgcttgttgg 951 cacggccgtg tacaacggcg aagtgctgca tttccatatg gaaacggcc 1001 gtccgtaccc gtccggaggc aggtttgccg caaaagtcga tttcggcagc 1051 aaatctgtgg acggcattat cgacagcggc gatgatttgc atatgggtac 1101 gcaaaaattc aaagccgcca tcgatggaaa cggctttaag gggacttgga 1151 cggaaaatgg cggcggggat gtttccggaa ggttttacgg cccggccggc
```

-continued

```
1201 gaggaagtgg cgggaaaata cagctatcgc ccgacagatg ctgaaaaggg 1251 cggattcggc gtgtttgccg gcaaaaaaga tcgggattga
```

This corresponds to the amino acid sequence <SEQ ID 3106; ORF 287.ng>:

```
g287.pep.
  1 MFKRSVIAMA CIFPLSACGG GGGGSPDVKS ADTPSKPAAP VVAENAGEGV

51 LPKEKKDEEA AGGAPQADTQ DATAGEGSQD MAAVSAENTG NGGAATTDNP

101 KNEDAGAQND MPQNAAESAN QTGNNQPAGS SDSAPASNPA PANGGSDFGR

151 TNVGNSVVID GPSQNITLTH CKGDSCNGDN LLDEEAPSKS EFEKLSDEEK

201 IKRYKKDEQR ENFVGLVADR VKKDGTNKYI IFYTDKPPTR SARSRRSLPA

251 EIPLIPVNQA DTLIVDGEAV SLTGHSGNIF APEGNYRYLT YGAEKLPGGS

301 YALRVQGEPA KGEMLVGTAV YNGEVLHFHM ENGRPYPSGG RFAAKVDFGS

351 KSVDGIIDSG DDLHMGTQKF KAAIDGNGFK GTWTENGGGD VSGRFYGPAG

401 EEVAGKYSYR PTDAEKGGFG VFAGKKDRD*
``` m287/g287 70.1% identity in 499 aa overlap

```
                  10        20        30        40             49
m287.pep  MFKRSVIAMACIFALSACGGGGGGSPDVKSADTLSKPAAPVVSE----------KETEA
          ||||||||||||| ||||||||||||||||||| ||||||||:|          |: ||
g287      MFKRSVIAMACIFPLSACGGGGGGSPDVKSADTPSKPAAPVVAENAGEGVLPKEKKDEEA
                  10        20        30        40        50        60

50        60        70        80        90       100       109
m287.pep  KEDAPQAGSQGQGAPSAQGSQDMAAVSEENTGNGGAVTADNPKNEDEVAQNDMPQNAAGT
          ||||  :|    |  :::||||||||||  ||||||||:|:||||||   ||||||||
g287      AGGAPQADTQD--ATAGEGSQDMAAVSAENTGNGGAATTDNPKNEDAGAQNDMPQNAA--
                    70        80        90       100       110

110       120       130       140       150       160       169
m287.pep  DSSTPNHTPDPNMLAGNMENQATDAGESSQPANQPDMANAADGMQGDDPSAGGQNAGNTA g287      ------------------------------------------------------------

170       180       190       200       210       220       229
m287.pep  AQGANQAGNNQAAGSSDPIPASNPAPANGGSNFGRVDLANGVLIDGPSQNITLTHCKGDS
          ::||| :||||  ||||| |||||||||||||:|||   :::|::|||||||||||||||
g287      -ESANQTGNNQPAGSSDSAPASNPAPANGGSDFGRTNVGNSVVIDGPSQNITLTHCKGDS
                   120       130       140       150       160       170

230       240       250       260       270       280       289
m287.pep  CSGNNFLDEEVQLKSEFEKLSDADKISNYKKDGKNDKFVGLVADSVQMKGINQYIIFYKP
          |:|:|:||||:  ||||||||||  :||:  ||||  :  ::|||||||| |:    | |:|||||
g287      CNGDNLLDEEAPSKSEFEKLSDEEKIKRYKKDEQRENFVGLVADRVKKDGTNKYIIFYTD
                 180       190       200                 220       230

290       300       310       320       330       340       349
m287.pep  KPTSFARFRRSARSRRSLPAEMPLIPVNQADTLIVDGEAVSLTGHSGNIFAPEGNYRYLT
          ||   :      |||||||||||:|||||||||||||||||||||||||||||||||||
g287      KPPT-----RSARSRRSLPAEIPLIPVNQADTLIVDGEAVSLTGHSGNIFAPEGNYRYLT
                         240       250       260       270       280       290

350       360       370       380       390       400       409
m287.pep  YGAEKLPGGSYALRVQGEPAKGEMLAGAAVYNGEVLHFHTENGRPYPTRGRFAAKVDFGS
          |||||||||||||||||||||||||:|:|||||||||||:|||||||:||||||||||
g287      YGAEKLPGGSYALRVQGEPAKGEMLVGTAVYNGEVLHFHMENGRPYPSGGRFAAKVDFGS
                         300       310       320       330       340       350

410       420       430       440       450       460       469
m287.pep  KSVDGIIDSGDDLHMGTQKFKAAIDGNGFKGTWTENGSGDVSGKFYGPAGEEVAGKYSYR
          |||||||||||||||||||||||||||||||||||| :|||| :|||||||||||||||
g287      KSVDGIIDSGDDLHMGTQKFKAAIDGNGFKGTWTENGGGDVSGRFYGPAGEEVAGKYSYR
                         360       370       380       390       400       410
```

```
                470        480       489
m287.pep    PTDAEKGGFGVFAGKKEQDX
            |||||||||||||||::||
g287        PTDAEKGGFGVFAGKKDRDX
                420       430
```

The following partial DNA sequence was identified in *N. meningitidis* <SEQ ID 3107>:

```
a287.seq
   1 ATGTTTAAAC GCAGTGTGAT TGCAATGGCT TGTATTGTTG CCCTTTCAGC

51 CTGTGGGGGC GGCGGTGGCG GATCGCCCGA TGTTAAGTCG GCGGACACGC

101 TGTCAAAACC TGCCGCCCCT GTTGTTACTG AAGATGTCGG GGAAGAGGTG

151 CTGCCGAAAG AAAAGAAAGA TGAGGAGGCG GTGAGTGGTG CGCCGCAAGC

201 CGATACGCAG GACGCAACCG CCGGAAAAGG CGGTCAAGAT ATGGCGGCAG

251 TTTCGGCAGA AAATACAGGC AATGGCGGTG CGGCAACAAC GGATAATCCC

301 GAAAATAAAG ACGAGGGACC GCAAAATGAT ATGCCGCAAA ATGCCGCCGA

351 TACAGATAGT TCGACACCGA ATCACACCCC TGCACCGAAT ATGCCAACCA

401 GAGATATGGG AAACCAAGCA CCGGATGCCG GGAATCGGC ACAACCGGCA

451 AACCAACCGG ATATGGCAAA TGCGGCGGAC GGAATGCAGG GGACGATCC

501 GTCGGCAGGG GAAAATGCCG GCAATACGGC AGATCAAGCT GCAAATCAAG

551 CTGAAAACAA TCAAGTCGGC GGCTCTCAAA ATCCTGCCTC TTCAACCAAT

601 CCTAACGCCA CGAATGGCGG CAGCGATTTT GGAAGGATAA ATGTAGCTAA

651 TGGCATCAAG CTTGACAGCG GTTCGGAAAA TGTAACGTTG ACACATTGTA

701 AAGACAAAGT ATGCGATAGA GATTTCTTAG ATGAAGAAGC ACCACCAAAA

751 TCAGAATTTG AAAAATTAAG TGATGAAGAA AAAATTAATA AATATAAAAA

801 AGACGAGCAA CGAGAGAATT TTGTCGGTTT GGTTGCTGAC AGGGTAGAAA

851 AGAATGGAAC TAACAAATAT GTCATCATTT ATAAAGACAA GTCCGCTTCA

901 TCTTCATCTG CGCGATTCAG GCGTTCTGCA CGGTCGAGGC GGTCGCTTCC

951 GGCCGAGATG CCGCTGATTC CCGTCAATCA GGCGGATACG CTGATTGTCG

1001 ATGGGGAAGC GGTCAGCCTG ACGGGGCATT CCGGCAATAT CTTCGCGCCC

1051 GAAGGGAATT ACCGGTATCT GACTTACGGG GCGGAAAAAT TGTCCGGCGG

1101 ATCGTATGCC CTCAGTGTGC AAGGCGAACC GGCAAAAGGC GAAATGCTTG

1151 CGGGCACGGC CGTGTACAAC GGCGAAGTGC TGCATTTCCA TATGGAAAAC

1201 GGCCGTCCGT CCCCGTCCGG AGGCAGGTTT GCCGCAAAAG TCGATTTCGG

1251 CAGCAAATCT GTGGACGGCA TTATCGACAG CGGCGATGAT TTGCATATGG

1301 GTACGCAAAA ATTCAAAGCC GTTATCGATG AAACGGCTT TAAGGGGACT

1351 TGGACGGAAA ATGGCGGCGG GGATGTTTCC GGAAGGTTTT ACGGCCCGGC

1401 CGGCGAAGAA GTGGCGGGAA AATACAGCTA TCGCCCGACA GATGCGGAAA

1451 AGGGCGGATT CGGCGTGTTT GCCGGCAAAA AAGAGCAGGA TTGA
```

This corresponds to the amino acid sequence <SEQ ID 3108; ORF 287.a>:

```
a287.pep

1   MFKRSVIAMA CIVALSACGG GGGGSPDVKS ADTLSKPAPP VVTEDVGEEV

51   LPKEKKDEEA VSGAPQADTQ DATAGKGGQD MAAVSAENTG NGGAATTDNP

101   ENKDEGPQND MPQNAADTDS STPNHTPAPN MPTRDMGNQA PDAGESAQPA

151   NQPDMANAAD GMQGDDPSAG ENAGNTADQA ANQAENNQVG GSQNPASSTN

201   PNATNGGSDF GRINVANGIK LDSGSENVTL THCKDKVCDR DFLDEEAPPK

251   SEFEKLSDEE KINKYKKDEQ RENFVGLVAD RVEKNGTNKY VIIYKDKSAS

301   SSSARFRRSA RSRRSLPAEM PLIPVNQADT LIVDGEAVSL TGHSGNIFAP

351   EGNYRYLTYG AEKLSGGSYA LSVQGEPAKG EMLAGTAVYN GEVLHFHMEN

401   GRPSPSGGRF AAKVDFGSKS VDGIIDSGDD LHMGTQKFKA VIDGNGFKGT

451   WTENGGGDVS GRFYGPAGEE VAGKYSYRPT DAEKGGFGVF AGKKEQD* m287/a287   77.2% identity in 501 aa overlap 10         20         30         40         49
m287.pep  MFKRSVIAMACIFALSACGGGGGGSPDVKSADTLSKPAAPVVSE----------KETEA
          ||||||||||| ||||||||||||||||||||||||||||||:|          |: ||
a287      MFKRSVIAMACIVALSACGGGGGGSPDVKSADTLSKPAPPVVTEDVGEEVLPKEKKDEEA
                  10         20         30         40         50         60

50         60         70         80         90        100       109
m287.pep  KEDAPQAGSQGQGAPSAQGSQDMAAVSEENTGNGGAVTADNPKNEDEVAQNDMPQNAAGT
          ||||  :|   |    | :::|:|||||||  ||||||||:|:|||:|:||  ||||||| |
a287      VSGAPQADTQ--DATAGKGGQDMAAVSAENTGNGGAATTDNPENKDEGPQNDMPQNAADT
                  70         80         90        100        110

110        120        130        140        150        160       169
m287.pep  DSSTPNHTPDPNMLAGNMENQATDAGESSQPANQPDMANAADGMQGDDPSAGGQNAGNTA
          ||||||||| ||| : :|  ||| |||||:|||||||||||||||||||||| :||||||
a287      DSSTPNHTPAPNMPTRDMGNQAPDAGESAQPANQPDMANAADGMQGDDPSAG-ENAGNTA
                 120        130        140        150        160        170

170        180        190        200        210        220       229
m287.pep  AQGANQAGNNQAAGSSDPIPASNPAPANGGSNFGRVDLANGVLIDGPSQNITLTHCKGDS
          |:||||  |||::||::|    ::||   :||||:|||||::|||:  :|:   |:|:|||||||
a287      DQAANQAENNQVGGSQNPASSTNPNATNGGSDFGRINVANGIKLDSGSENVTLTHCKDKV
                 180        190        200        210        220        230

230        240        250        260        270        280       289
m287.pep  CSGNNFLDEEVQLKSEFEKLSDADKISNYKKDGKNDKFVGLVADSVQMKGINQYIIFYKP
          |:  :||||:  |||||||||:||::|||| :  ::|||||| |:  :| |:|:|:||
a287      CD-RDFLDEEAPPKSEFEKLSDEEKINKYKKDEQRENFVGLVADRVEKNGTNKYVIIYKD
                     240        250        260        270        280        290

290        300        310        320        330        340       349
m287.pep  KP--TSFARFRRSARSRRSLPAEMPLIPVNQADTLIVDGEAVSLTGHSGNIFAPEGNYRY
          |   :| ||||||||||||||||||||||||||||||||||||||||||||||||||||
a287      KSASSSSARFRRSARSRRSLPAEMPLIPVNQADTLIVDGEAVSLTGHSGNIFAPEGNYRY
                 300        310        320        330        340        350

350        360        370        380        390        400
m287.pep  LTYGAEKLPGGSYALRVQGEPAKGEMLAGAAVYNGEVLHFHTENGRPYPTRGRFAAKVDF
          ||||||||  ||||||  ||||||||||||||||:|||||||| |||||  |: ||||||||||
a287      LTYGAEKLSGGSYALSVQGEPAKGEMLAGTAVYNGEVLHFHMENGRPSPSGGRFAAKVDF
                 360        370        380        390        400        410

410        420        430        440        450        460
m287.pep  GSKSVDGIIDSGDDLHMGTQKFKAAIDGNGFKGTWTENGSGDVSGKFYGPAGEEVAGKYS
          ||||||||||||||||||||||||:|||||||||||||| |||||:|||||||||||||
a287      GSKSVDGIIDSGDDLHMGTQKFKAVIDGNGFKGTWTENGGGDVSGRFYGPAGEEVAGKYS
                 420        430        440        450        460        470

470        480       489
m287.pep  YRPTDAEKGGFGVFAGKKEQDX
          ||||||||||||||||||||||
a287      YRPTDAEKGGFGVFAGKKEQDX
                 480        490
```

406

The following partial DNA sequence was identified in N. meningitidis <SEQ ID 3109>:

```
m406.seq
   1 ATGCAAGCAC GGCTGCTGAT ACCTATTCTT TTTTCAGTTT TTATTTTATC

51 CGCCTGCGGG ACACTGACAG GTATTCCATC GCATGGCGGA GGTAAACGCT

101 TTGCGGTCGA ACAAGAACTT GTGGCCGCTT CTGCCAGAGC TGCCGTTAAA

151 GACATGGATT TACAGGCATT ACACGGACGA AAAGTTGCAT TGTACATTGC

201 CACTATGGGC GACCAAGGTT CAGGCAGTTT GACAGGGGGT CGCTACTCCA

251 TTGATGCACT GATTCGTGGC GAATACATAA ACAGCCCTGC CGTCCGTACC

301 GATTACACCT ATCCACGTTA CGAAACCACC GCTGAAACAA CATCAGGCGG

351 TTTGACAGGT TTAACCACTT CTTTATCTAC ACTTAATGCC CCTGCACTCT

401 CTCGCACCCA ATCAGACGGT AGCGGAAGTA AAAGCAGTCT GGGCTTAAAT

451 ATTGGCGGGA TGGGGGATTA TCGAAATGAA ACCTTGACGA CTAACCCGCG

501 CGACACTGCC TTTCTTTCCC ACTTGGTACA GACCGTATTT TTCCTGCGCG

551 GCATAGACGT TGTTTCTCCT GCCAATGCCG ATACAGATGT GTTTATTAAC

601 ATCGACGTAT TCGGAACGAT ACGCAACAGA ACCGAAATGC ACCTATACAA

651 TGCCGAAACA CTGAAAGCCC AAACAAAACT GGAATATTTC GCAGTAGACA

701 GAACCAATAA AAAATTGCTC ATCAAACCAA AAACCAATGC GTTTGAAGCT

751 GCCTATAAAG AAAATTACGC ATTGTGGATG GGGCCGTATA AAGTAAGCAA

801 AGGAATTAAA CCGACGGAAG GATTAATGGT CGATTTCTCC GATATCCGAC

851 CATACGGCAA TCATACGGGT AACTCCGCCC CATCCGTAGA GGCTGATAAC

901 AGTCATGAGG GGTATGGATA CAGCGATGAA GTAGTGCGAC AACATAGACA

951 AGGACAACCT TGA
```

This corresponds to the amino acid sequence <SEQ ID 3110; ORF 406>:

```
m406.pep
   1 MQARLLIPIL FSVFILSACG TLTGIPSHGG GKRFAVEQEL VAASARAAVK

51 DMDLQALHGR KVALYIATMG DQGSGSLTGG RYSIDALIRG EYINSPAVRT

101 DYTYPRYETT AETTSGGLTG LTTSLSTLNA PALSRTQSDG SGSKSSLGLN

151 IGGMGDYRNE TLTTNPRDTA FLSHLVQTVF FLRGIDVVSP ANADTDVFIN

201 IDVFGTIRNR TEMHLYNAET LKAQTKLEYF AVDRTNKKLL IKPKTNAFEA

251 AYKENYALWM GPYKVSKGIK PTEGLMVDFS DIRPYGNHTG NSAPSVEADN

301 SHEGYGYSDE VVRQHRQGQP *
```

The following partial DNA sequence was identified in N. gonorrhoeae <SEQ ID 3111>:

```
g406.seq
   1 ATGCGGGCAC GGCTGCTGAT ACCTATTCTT TTTTCAGTTT TTATTTTATC

51 CGCCTGCGGG ACACTGACAG GTATTCCATC GCATGGCGGA GGCAAACGCT

101 TCGCGGTCGA ACAAGAACTT GTGGCCGCTT CTGCCAGAGC TGCCGTTAAA

151 GACATGGATT TACAGGCATT ACACGGACGA AAAGTTGCAT TGTACATTGC

201 AACTATGGGC GACCAAGGTT CAGGCAGTTT GACAGGGGGT CGCTACTCCA
```

-continued

```
251 TTGATGCACT GATTCGCGGC GAATACATAA ACAGCCCTGC CGTCCGCACC

301 GATTACACCT ATCCGCGTTA CGAAACCACC GCTGAAACAA CATCAGGCGG

351 TTTGACGGGT TTAACCACTT CTTTATCTAC ACTTAATGCC CCTGCACTCT

401 CGCGCACCCA ATCAGACGGT AGCGGAAGTA GGAGCAGTCT GGGCTTAAAT

451 ATTGGCGGGA TGGGGGATTA TCGAAATGAA ACCTTGACGA CCAACCCGCG

501 CGACACTGCC TTTCTTTCCC ACTTGGTGCA GACCGTATTT TTCCTGCGCG

551 GCATAGACGT TGTTTCTCCT GCCAATGCCG ATACAGATGT GTTTATTAAC

601 ATCGACGTAT TCGGAACGAT ACGCAACAGA ACCGAAATGC ACCTATACAA

651 TGCCGAAACA CTGAAAGCCC AAACAAAACT GGAATATTTC GCAGTAGACA

701 GAACCAATAA AAAATTGCTC ATCAAACCCA AAACCAATGC GTTTGAAGCT

751 GCCTATAAAG AAAATTACGC ATTGTGGATG GGGCCGTATA AAGTAAGCAA

801 AGGAATCAAA CCGACGGAAG GATTGATGGT CGATTTCTCC CGATATCCAA

851 CATACGGCAA TCATACGGGT AACTCCGCCC CATCCGTAGA GGCTGATAAC

901 AGTCATGAGG GGTATGGATA CAGCGATGAA GCAGTGCGAC AACATAGACA

951 AGGGCAACCT TGA
```

This corresponds to the amino acid sequence <SEQ ID 3112; ORF 406>:

```
g406.pep
  1 MRARLLIPIL FSVFILSACG TLTGIPSHGG GKRFAVEQEL VAASARAAVK

51 DMDLQALHGR KVALYIATMG DQGSGSLTGG RYSIDALIRG EYINSPAVRT

101 DYTYPRYETT AETTSGGLTG LTTSLSTLNA PALSRTQSDG SGSRSSLGLN

151 IGGMGDYRNE TLTTNPRDTA FLSHLVQTVF FLRGIDVVSP ANADTDVFIN

201 IDVFGTIRNR TEMHLYNAET LKAQTKLEYF AVDRTNKKLL IKPKTNAFEA

251 AYKENYALWM GPYKVSKGIK PTEGLMVDFS DIQPYGNHTG NSAPSVEADN

301 SHEGYGYSDE AVRQHRQGQP *
```

ORF 406 shows 98.8% identity over a 320 aa overlap with a predicted ORF (ORF406.a) from *N. gonorrhoeae*:

```
g406/m406

10         20         30         40         50         60
     g406.pep  MRARLLIPILFSVFILSACGTLTGIPSHGGGKRFAVEQELVAASARAAVKDMDLQALHGR
               |:||||||||||||||||||||||||||||| |||||||||||||||||||||||||||||
     m406      MQARLLIPILFSVFILSACGTLTGIPSHGGGKRFAVEQELVAASARAAVKDMDLQALHGR
                 10         20         30         40         50         60

70         80         90        100        110        120
     g406.pep  KVALYIATMGDQGSGSLTGGRYSIDALIRGEYINSPAVRTDYTYPRYETTAETTSGGLTG
               ||||||||||||||||||||||||||||||||||||||||||||||||||||||||||||
     m406      KVALYIATMGDQGSGSLTGGRYSIDALIRGEYINSPAVRTDYTYPRYETTAETTSGGLTG
                 70         80         90        100        110        120

130        140        150        160        170        180
     g406.pep  LTTSLSTLNAPALSRTQSDGSGSRSSLGLNIGGMGDYRNETLTTNPRDTAFLSHLVQTVF
               |||||||||||||||||||||||:||||||||||||||||||||||||||||||||||||
     m406      LTTSLSTLNAPALSRTQSDGSGSKSSLGLNIGGMGDYRNETLTTNPRDTAFLSHLVQTVF
                130        140        150        160        170        180

190        200        210        220        230        240
     g406.pep  FLRGIDVVSPANADTDVFINIDVFGTIRNRTEMHLYNAETLKAQTKLEYFAVDRTNKKLL
               ||||||||||||||||||||||||||||||||||||||||||||||||||||||||||||
     m406      FLRGIDVVSPANADTDVFINIDVFGTIRNRTEMHLYNAETLKAQTKLEYFAVDRTNKKLL
                190        200        210        220        230        240
```

```
                250        260        270        280        290        300
g406.pep IKPKTNAFEAAYKENYALWMGPYKVSKGIKPTEGLMVDFSDIQPYGNHTGNSAPSVEADN
         ||||||||||||||||||||||||||||||||||||||:|||||||||||||||||||
m406     IKPKTNAFEAAYKENYALWMGPYKVSKGIKPTEGLMVDFSDIRPYGNHTGNSAPSVEADN
                250        260        270        280        290        300

310        320
g406.pep SHEGYGYSDEAVRQHRQGQPX
         ||||||||||:|||||||||
m406     SHEGYGYSDEVVRQHRQGQPX
                310        320
```

The following partial DNA sequence was identified in *N. meningitidis* <SEQ ID 3113>:

```
a406.seq.
   1 ATGCAAGCAC GGCTGCTGAT ACCTATTCTT TTTTCAGTTT TTATTTTATC

51 CGCCTGCGGG ACACTGACAG GTATTCCATC GCATGGCGGA GGTAAACGCT

101 TCGCGGTCGA ACAAGAACTT GTGGCCGCTT CTGCCAGAGC TGCCGTTAAA

151 GACATGGATT TACAGGCATT ACACGGACGA AAAGTTGCAT TGTACATTGC

201 AACTATGGGC GACCAAGGTT CAGGCAGTTT GACAGGGGGT CGCTACTCCA

251 TTGATGCACT GATTCGTGGC GAATACATAA ACAGCCCTGC CGTCCGTACC

301 GATTACACCT ATCCACGTTA CGAAACCACC GCTGAAACAA CATCAGGCGG

351 TTTGACAGGT TTAACCACTT CTTTATCTAC ACTTAATGCC CCTGCACTCT

401 CGCGCACCCA ATCAGACGGT AGCGGAAGTA AAAGCAGTCT GGGCTTAAAT

451 ATTGGCGGGA TGGGGGATTA TCGAAATGAA ACCTTGACGA CTAACCCGCG

501 CGACACTGCC TTTCTTTCCC ACTTGGTACA GACCGTATTT TTCCTGCGCG

551 GCATAGACGT TGTTTCTCCT GCCAATGCCG ATACGGATGT GTTTATTAAC

601 ATCGACGTAT TCGGAACGAT ACGCAACAGA ACCGAAATGC ACCTATACAA

651 TGCCGAAACA CTGAAAGCCC AAACAAAACT GGAATATTTC GCAGTAGACA

701 GAACCAATAA AAAATTGCTC ATCAAACCAA AACCAATGC GTTTGAAGCT

751 GCCTATAAAG AAAATTACGC ATTGTGGATG GGACCGTATA AAGTAAGCAA

801 AGGAATTAAA CCGACAGAAG GATTAATGGT CGATTTCTCC GATATCCAAC

851 CATACGGCAA TCATATGGGT AACTCTGCCC CATCCGTAGA GGCTGATAAC

901 AGTCATGAGG GGTATGGATA CAGCGATGAA GCAGTGCGAC GACATAGACA

951 AGGGCAACCT TGA
```

This corresponds to the amino acid sequence <SEQ ID 3114; ORF 406.a>:

```
a406.pep

1    MQARLLIPIL FSVFILSACG TLTGIPSHGG GKRFAVEQEL VAASARAAVK

51    DMDLQALHGR KVALYIATMG DQGSGSLTGG RYSIDALIRG EYINSPAVRT

101    DYTYPRYETT AETTSGGLTG LTTSLSTLNA PALSRTQSDG SGSKSSLGLN

151    IGGMGDYRNE TLTTNPRDTA FLSHLVQTVF FLRGIDVVSP ANADTDVFIN

201    IDVFGTIRNR TEMHLYNAET LKAQTKLEYF AVDRTNKKLL IKPKTNAFEA

251    AYKENYALWM GPYKVSKGIK PTEGLMVDFS DIQPYGNHMG NSAPSVEADN

301    SHEGYGYSDE AVRRHRQGQP *
```

```
m406/a406  98.8% identity in 320 aa overlap 10         20         30         40         50         60
m406.pep    MQARLLIPILFSVFILSACGTLTGIPSHGGGKRFAVEQELVAASARAAVKDMDLQALHGR
            ||||||||||||||||||||||||||||||||||||||||||||||||||||||||||||
a406        MQARLLIPILFSVFILSACGTLTGIPSHGGGKRFAVEQELVAASARAAVKDMDLQALHGR
                10         20         30         40         50         60

70         80         90        100        110        120
m406.pep    KVALYIATMGDQGSGSLTGGRYSIDALIRGEYINSPAVRTDYTYPRYETTAETTSGGLTG
            ||||||||||||||||||||||||||||||||||||||||||||||||||||||||||||
a406        KVALYIATMGDQGSGSLTGGRYSIDALIRGEYINSPAVRTDYTYPRYETTAETTSGGLTG
                70         80         90        100        110        120

130        140        150        160        170        180
m406.pep    LTTSLSTLNAPALSRTQSDGSGSKSSLGLNIGGMGDYRNETLTTNPRDTAFLSHLVQTVF
            |||||||||||||||||:||||||||||||||||||||||||||||||||||||||||||
a406        LTTSLSTLNAPALSRTQSDGSGSKSSLGLNIGGMGDYRNETLTTNPRDTAFLSHLVQTVF
               130        140        150        160        170        180

190        200        210        220        230        240
m406.pep    FLRGIDVVSPANADTDVFINIDVFGTIRNRTEMHLYNAETLKAQTKLEYFAVDRTNKKLL
            ||||||||||||||||||||||||||||||||||||||||||||||||||||||||||||
a406        FLRGIDVVSPANADTDVFINIDVFGTIRNRTEMHLYNAETLKAQTKLEYFAVDRTNKKLL
               190        200        210        220        230        240

250        260        270        280        290        300
m406.pep    IKPKTNAFEAAYKENYALWMGPYKVSKGIKPTEGLMVDFSDIRPYGNHTGNSAPSVEADN
            |||||||||||||||||||||||||||||||||||||||||:|||||  |||||||||||
a406        IKPKTNAFEAAYKENYALWMGPYKVSKGIKPTEGLMVDFSDIQPYGNHMGNSAPSVEADN
               250        260        270        280        290        300

310        320
m406.pep    SHEGYGYSDEVVRQHRQGQPX
            |||||||||:||:||||||||
a406        SHEGYGYSDEAVRRHRQGQPX
               310        320
```

Example 2

Expression of ORF 919

The primer described in Table 1 for ORF 919 was used to locate and clone ORF 919. The predicted gene 919 was cloned in pET vector and expressed in E. coli. The product of protein expression and purification was analyzed by SDS-PAGE. In panel A) is shown the analysis of 919-His fusion protein purification. Mice were immunized with the purified 919-His and sera were used for Western blot (panel B), FACS analysis (panel C), bactericidal assay (panel D), and ELISA assay (panel E). Symbols: Ml, molecular weight marker; PP, purified protein; TP, N. meningitidis total protein extract; OMV, N. meningitidis outer membrane vesicle preparation. Arrows indicate the position of the main recombinant protein product (A) and the N. meningitidis immunoreactive band (B). These experiments confirm that 919 is a surface-exposed protein and that it is a useful immunogen. The hydrophilicity plots, antigenic index, and amphipatic regions of ORF 919 are provided in FIG. 10. The AMPHI program is used to predict putative T-cell epitopes (Gao et al 1989, J. Immunol. 143: 3007; Roberts et al. 1996, AIDS Res Human Retroviruses 12:593; Quakyi et al. 1992, Scand J Immunol Suppl 11:9). The nucleic acid sequence of ORF 919 and the amino acid sequence encoded thereby is provided in Example 1.

Example 3

Expression of ORF 279

Figure 11:
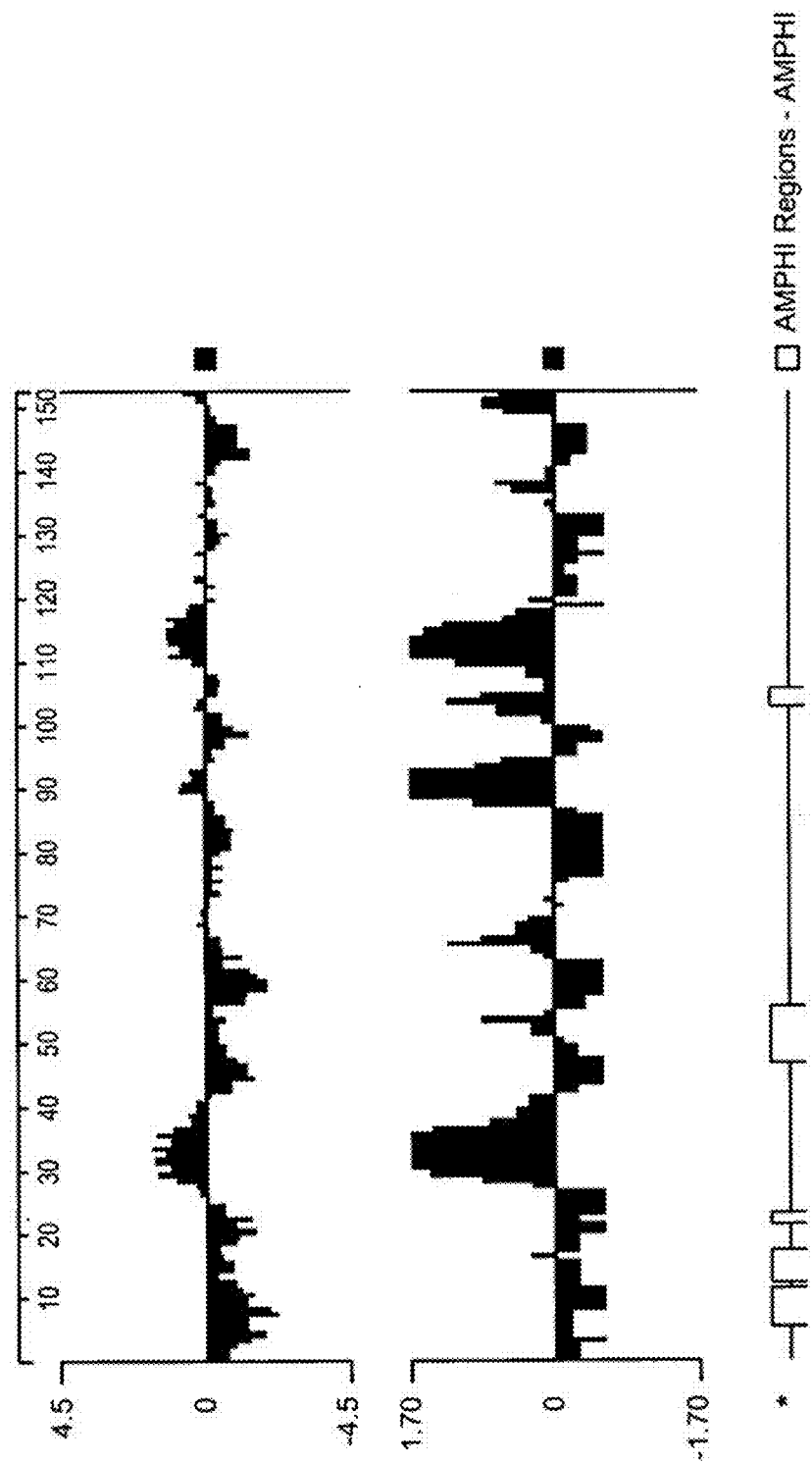

The primer described in Table 1 for ORF 279 was used to locate and clone ORF 279. The predicted gene 279 was cloned in pGex vector and expressed in E. coli. The product of protein expression and purification was analyzed by SDS-PAGE. In panel A) is shown the analysis of 279-GST purification. Mice were immunized with the purified 279-GST and sera were used for Western blot analysis (panel B), FACS analysis (panel C), bactericidal assay (panel D), and ELISA assay (panel E). Symbols: M1, molecular weight marker; TP, N. meningitidis total protein extract; OMV, N. meningitidis outer membrane vescicle preparation. Arrows indicate the position of the main recombinant protein product (A) and the N. meningitidis immunoreactive band (B). These experiments confirm that 279 is a surface-exposed protein and that it is a useful immunogen. The hydrophilicity plots, antigenic index, and amphipatic regions of ORF 279 are provided in FIG. 11. The AMPHI program is used to predict putative T-cell epitopes (Gao et al 1989, J. Immunol 143:3007; Roberts et al. 1996, AIDS Res Human Retroviruses 12:593; Quakyi et al. 1992, Scand J Immunol Suppl 11:9). The nucleic acid sequence of ORF 279 and the amino acid sequence encoded thereby is provided in Example 1.

Example 4

Expression of ORF 576 and 576-1

Figure 12:
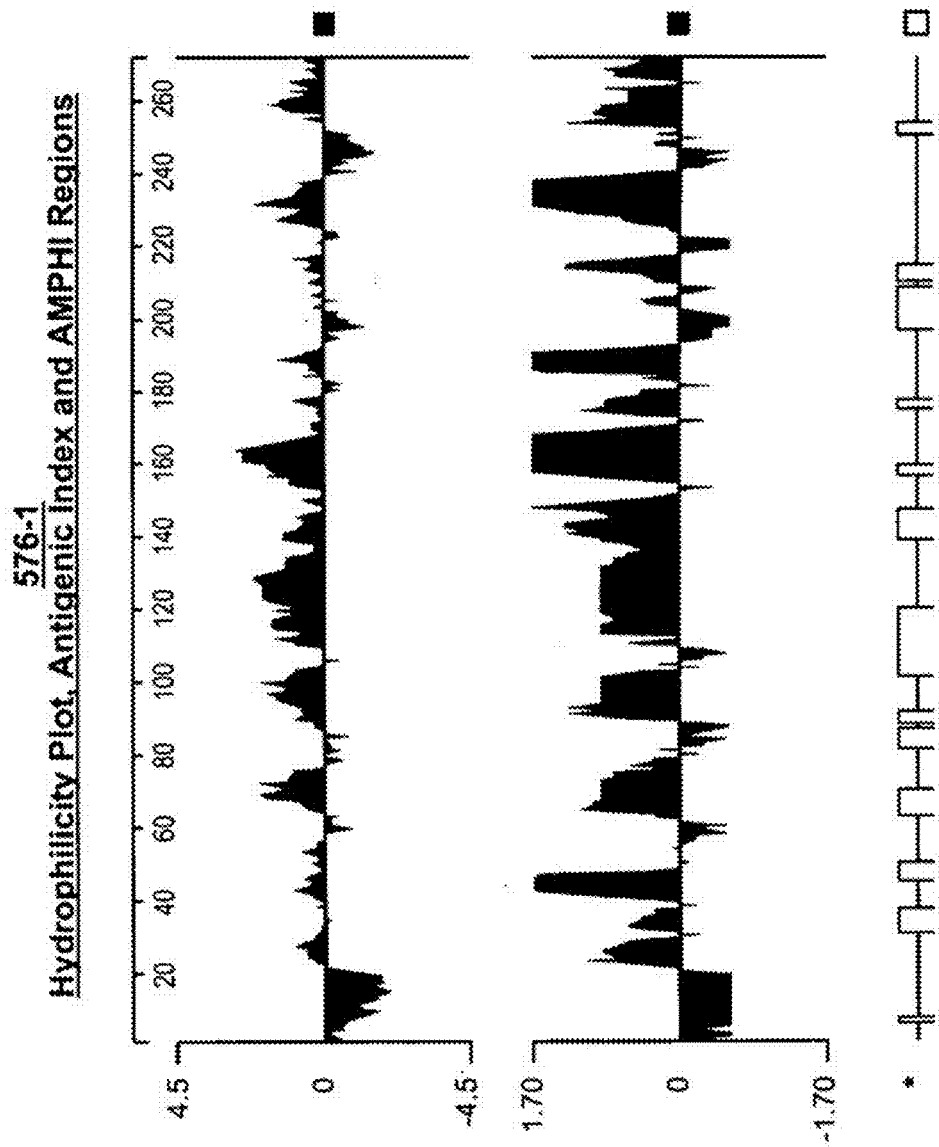

The primer described in Table 1 for ORF 576 was used to locate and clone ORF 576. The predicted gene 576 was cloned in pGex vector and expressed in E. coli. The product of protein purification was analyzed by SDS-PAGE. In panel A) is shown the analysis of 576-GST fusion protein purification. Mice were immunized with the purified 576-GST and sera were used for Western blot (panel B), FACS analysis (panel C), bactericidal assay (panel D), and ELISA assay (panel E). Symbols: M1, molecular weight marker; TP, N. meningitidis total protein extract; OMV, N. meningitidis outer membrane vescicle preparation. Arrows indicate the position of the main recombinant protein product (A) and the *N. meningitidis* immunoreactive band (B). These experiments confirm that ORF 576 is a surface-exposed protein and that it is a useful immunogen. The hydrophilicity plots, antigenic index, and amphipatic regions of ORF 576 are provided in FIG. 12. The AMPHI program is used to predict putative T-cell epitopes (Gao et al 1989, *J. Immunol* 143:3007; Roberts et al. 1996, *AIDS Res Human Retroviruses* 12:593; Quakyi et al. 1992, *Scand J Immunol Suppl* 11:9). The nucleic acid sequence of ORF 576 and the amino acid sequence encoded thereby is provided in Example 1.

Example 5

Expression of ORF 519 and 519-1

Figure 13:
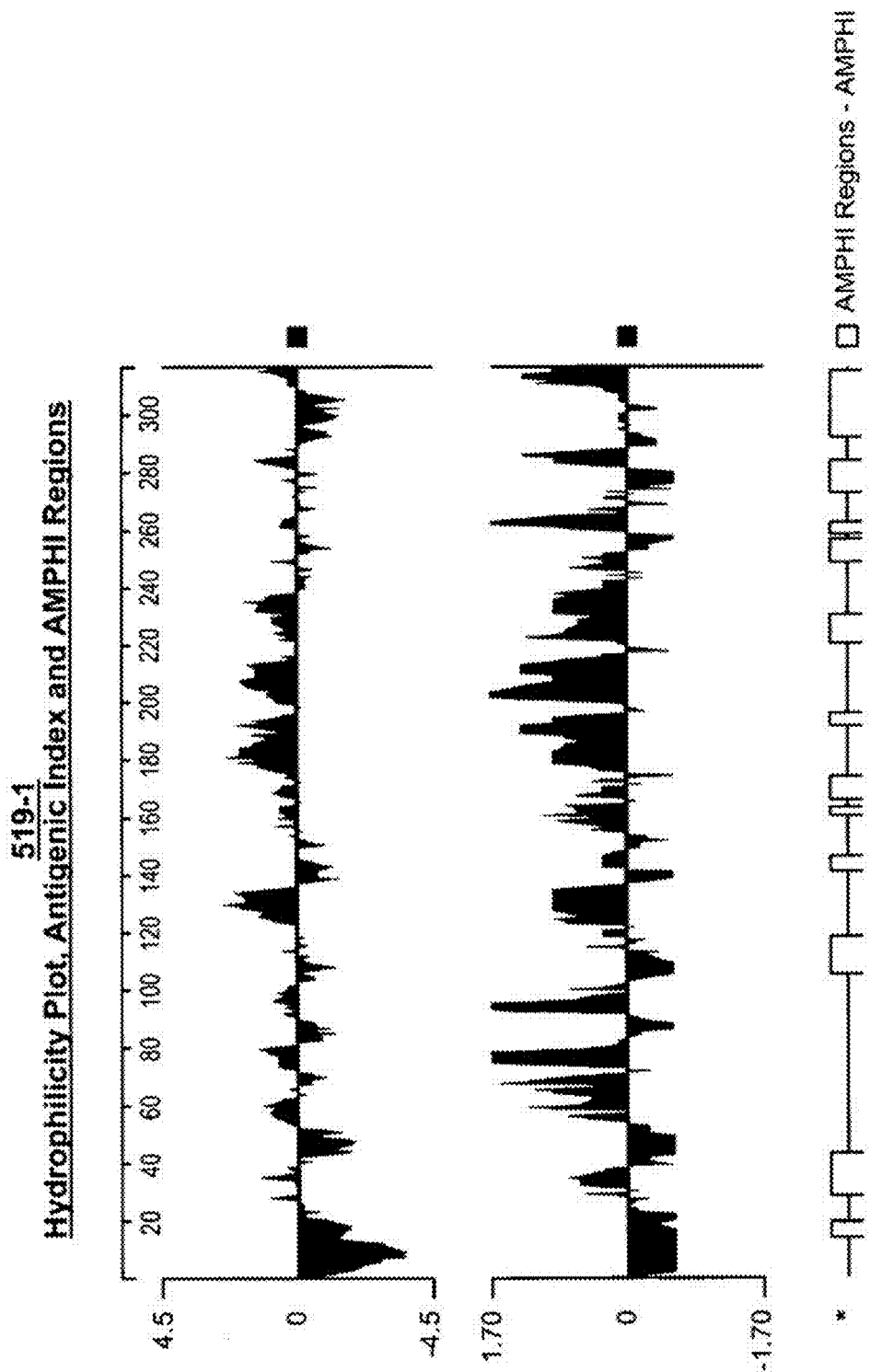

The primer described in Table 1 for ORF 519 was used to locate and clone ORF 519. The predicted gene 519 was cloned in pET vector and expressed in *E. coli*. The product of protein purification was analyzed by SDS-PAGE. In panel A) is shown the analysis of 519-His fusion protein purification. Mice were immunized with the purified 519-His and sera were used for Western blot (panel B), FACS analysis (panel C), bactericidal assay (panel D), and ELISA assay (panel E). Symbols: M1, molecular weight marker; TP, *N. meningitidis* total protein extract; OMV, *N. meningitidis* outer membrane vesicle preparation. Arrows indicate the position of the main recombinant protein product (A) and the *N. meningitidis* immunoreactive band (B). These experiments confirm that 519 is a surface-exposed protein and that it is a useful immunogen. The hydrophilicity plots, antigenic index, and amphipatic regions of ORF 519 are provided in FIG. 13. The AMPHI program is used to predict putative T-cell epitopes (Gao et al 1989, *J. Immunol* 143:3007; Roberts et al. 1996, *AIDS Res Human Retroviruses* 12:593; Quakyi et al. 1992, *Scand Immunol Suppl* 11:9). The nucleic acid sequence of ORF 519 and the amino acid sequence encoded thereby is provided in Example 1.

Example 6

Expression of ORF 121 and 121-1

Figure 14:
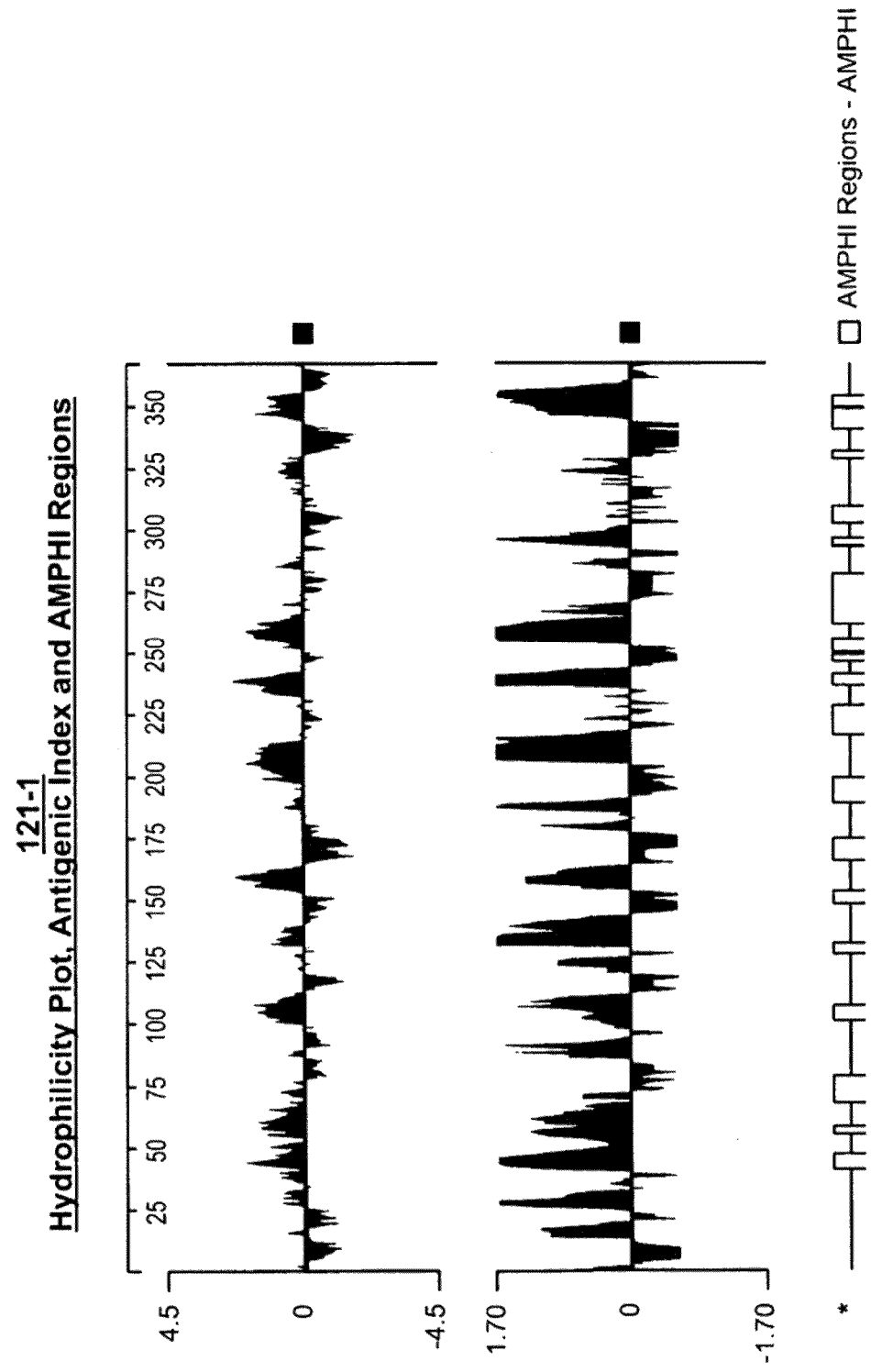

The primer described in Table 1 for ORF 121 was used to locate and clone ORF 121. The predicted gene 121 was cloned in pET vector and expressed in *E. coli*. The product of protein purification was analyzed by SDS-PAGE. In panel A) is shown the analysis of 121-His fusion protein purification. Mice were immunized with the purified 121-His and sera were used for Western blot analysis (panel B), FACS analysis (panel C), bactericidal assay (panel D), and ELISA assay (panel E). Results show that 121 is a surface-exposed protein. Symbols: M1, molecular weight marker; TP, *N. meningitidis* total protein extract; OMV, *N. meningitidis* outer membrane vescicle preparation. Arrows indicate the position of the main recombinant protein product (A) and the *N. meningitidis* immunoreactive band (B). These experiments confirm that 121 is a surface-exposed protein and that it is a useful immunogen. The hydrophilicity plots, antigenic index, and amphipatic regions of ORF 121 are provided in FIG. 14. The AMPHI program is used to predict putative T-cell epitopes (Gao et al 1989, *J. Immunol* 143:3007; Roberts et al. 1996, *AIDS Res Human Retroviruses* 12:593; Quakyi et al. 1992, *Scand J Immunol Suppl* 11:9). The nucleic acid sequence of ORF 121 and the amino acid sequence encoded thereby is provided in Example 1.

Example 7

Expression of ORF 128 and 128-1

Figure 15:
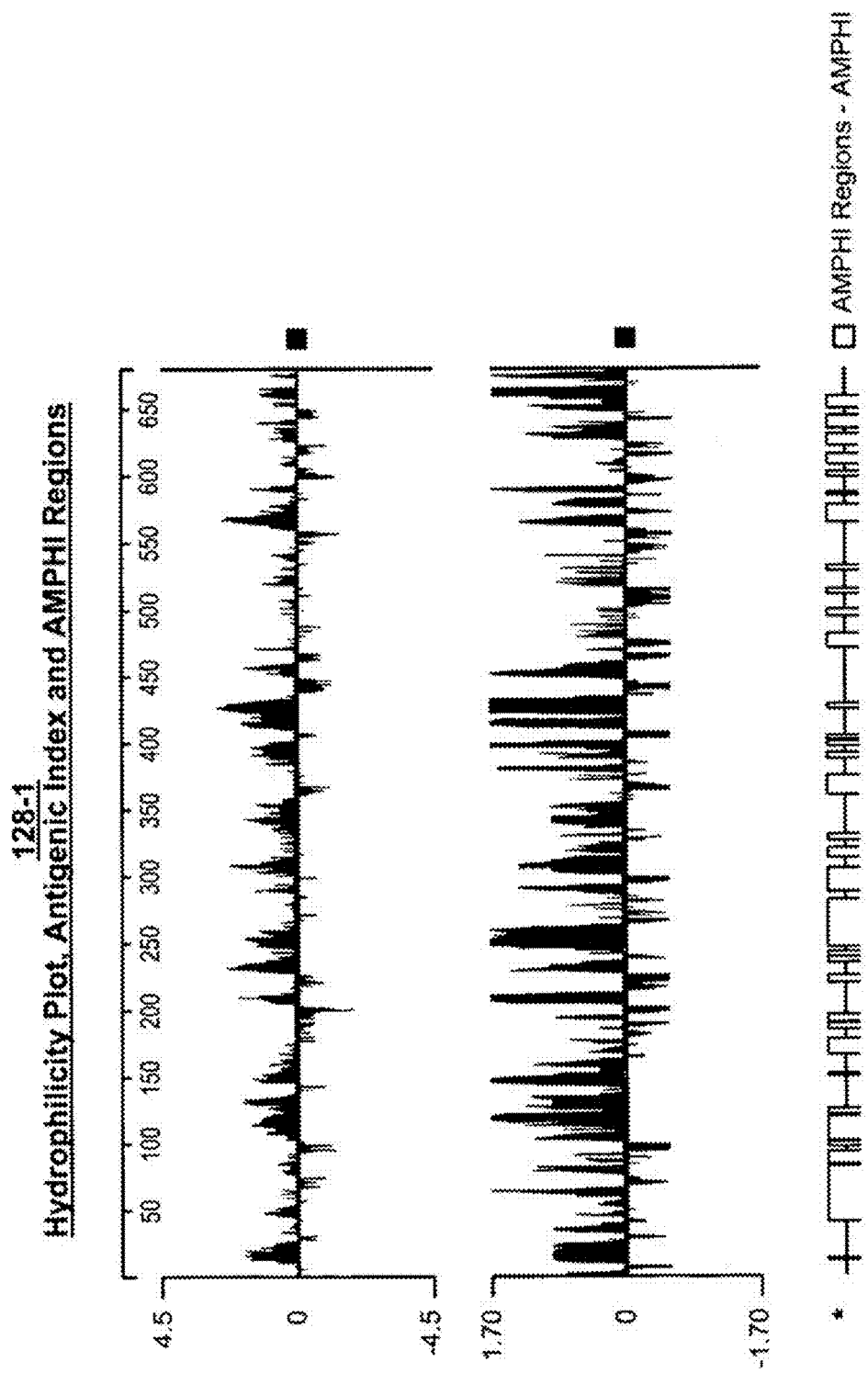

The primer described in Table 1 for ORF 128 was used to locate and clone ORF 128. The predicted gene 128 was cloned in pET vector and expressed in *E. coli*. The product of protein purification was analyzed by SDS-PAGE. In panel A) is shown the analysis of 128-His purification. Mice were immunized with the purified 128-His and sera were used for Western blot analysis (panel B), FACS analysis (panel C), bactericidal assay (panel D) and ELISA assay (panel E). Results show that 128 is a surface-exposed protein. Symbols: M1, molecular weight marker; TP, *N. meningitidis* total protein extract; OMV, *N. meningitidis* outer membrane vesicle preparation. Arrows indicate the position of the main recombinant protein product (A) and the *N. meningitidis* immunoreactive band (B). These experiments confirm that 128 is a surface-exposed protein and that it is a useful immunogen. The hydrophilicity plots, antigenic index, and amphipatic regions of ORF 128 are provided in FIG. 15. The AMPHI program is used to predict putative T-cell epitopes (Gao et al 1989, *J. Immunol* 143:3007; Roberts et al. 1996, *AIDS Res Human Retroviruses* 12:593; Quakyi et al. 1992, *Scand J Immunol Suppl* 11:9). The nucleic acid sequence of ORF 128 and the amino acid sequence encoded thereby is provided in Example 1.

Example 8

Expression of ORF 206

Figure 16:
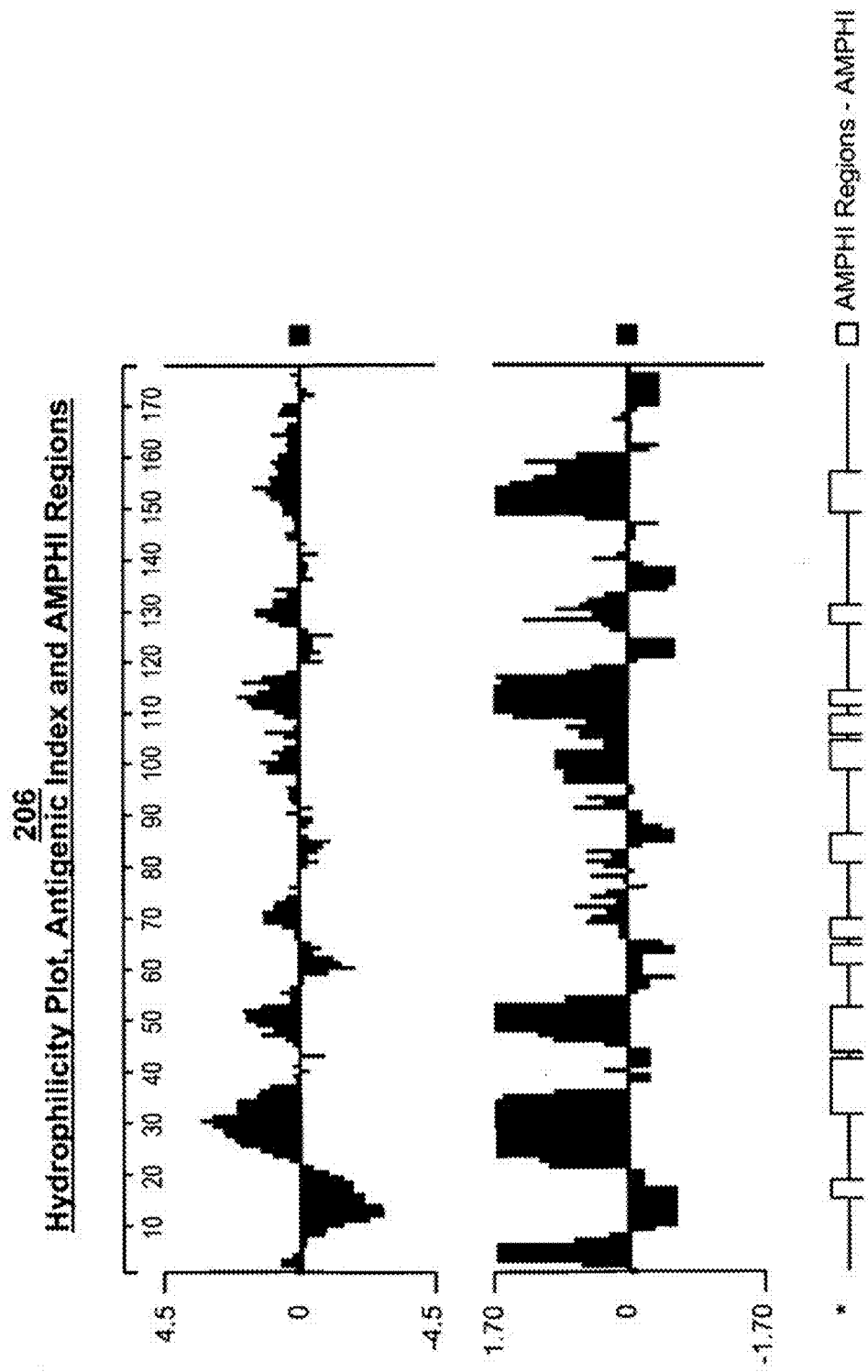

The primer described in Table 1 for ORF 206 was used to locate and clone ORF 206. The predicted gene 206 was cloned in pET vector and expressed in *E. coli*. The product of protein purification was analyzed by SDS-PAGE. In panel A) is shown the analysis of 206-His purification. Mice were immunized with the purified 206-His and sera were used for Western blot analysis (panel B). It is worthnoting that the immunoreactive band in protein extracts from meningococcus is 38 kDa instead of 17 kDa (panel A). To gain information on the nature of this antibody staining we expressed ORF 206 in *E. coli* without the His-tag and including the predicted leader peptide. Western blot analysis on total protein extracts from *E. coli* expressing this native form of the 206 protein showed a reactive band at a position of 38 kDa, as observed in meningococcus. We conclude that the 38 kDa band in panel B) is specific and that anti-206 antibodies, likely recognize a multimeric protein complex. In panel C is shown the FACS analysis, in panel D the bactericidal assay, and in panel E) the ELISA assay. Results show that 206 is a surface-exposed protein. Symbols: M1, molecular weight marker; TP, *N. meningitidis* total protein extract; OMV, *N. meningitidis* outer membrane vesicle preparation. Arrows indicate the position of the main recombinant protein product (A) and the *N. meningitidis* immunoreactive band (B). These experiments confirm that 206 is a surface-exposed protein and that it is a useful immunogen. The hydrophilicity plots, antigenic index, and amphipatic regions of ORF 519 are provided in FIG. 16. The AMPHI program is used to predict putative T-cell epitopes (Gao et al 1989, *J. Immunol* 143:3007; Roberts et al. 1996, *AIDS Res Human Retroviruses* 12:593; Quakyi et al. 1992, *Scand J Immunol Suppl* 11:9). The nucleic acid sequence of ORF 206 and the amino acid sequence encoded thereby is provided in Example 1.

Example 9

Expression of ORF 287

Figure 17:
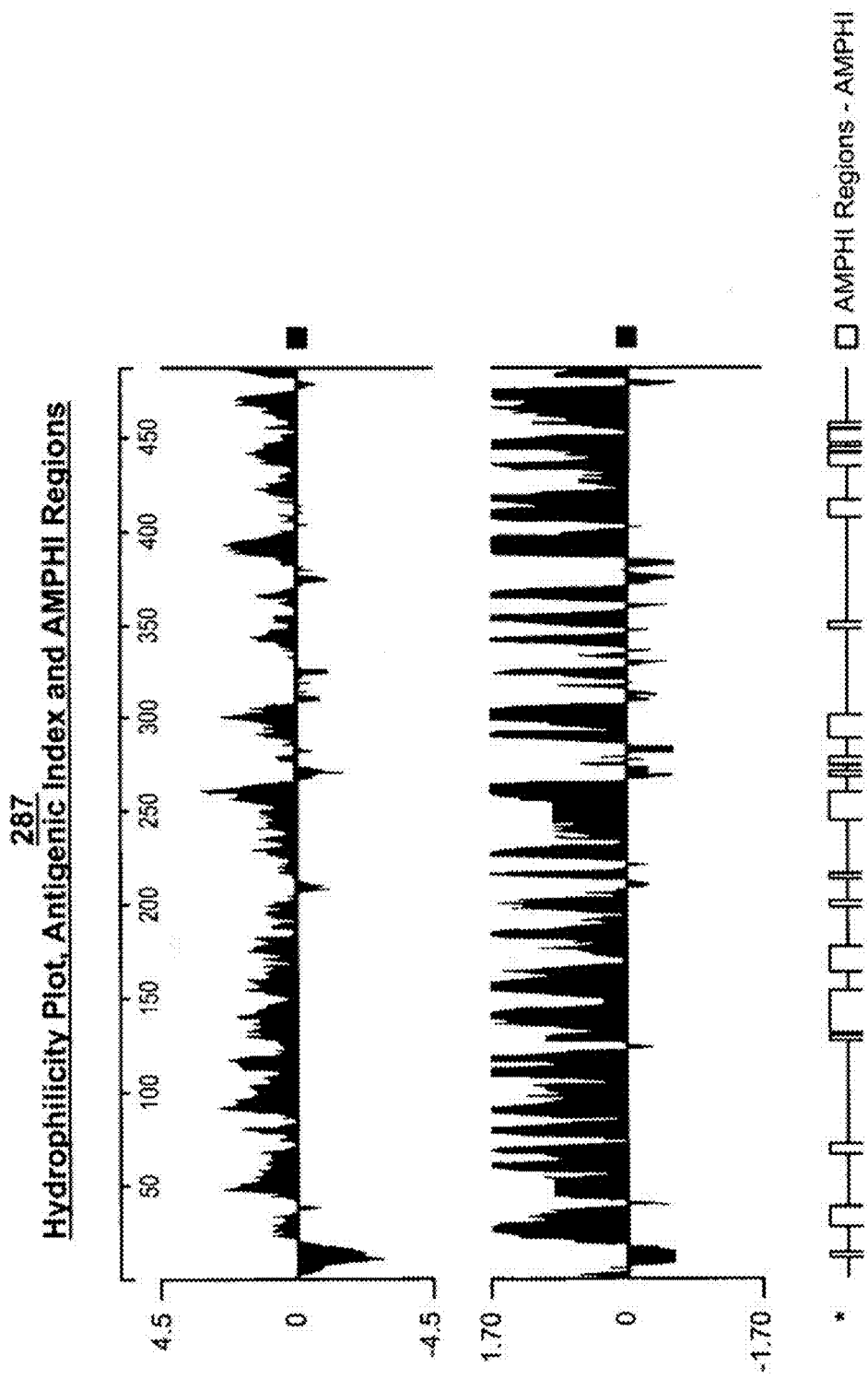

The primer described in Table 1 for ORF 287 was used to locate and clone ORF 287. The predicted gene 287 was cloned in pGex vector and expressed in *E. coli*. The product of protein purification was analyzed by SDS-PAGE. In panel A) is shown the analysis of 287-GST fusion protein purification. Mice were immunized with the purified 287-GST and sera were used for FACS analysis (panel B), bactericidal assay (panel C), and ELISA assay (panel D). Results show that 287 is a surface-exposed protein. Symbols: M1, molecular weight marker. Arrow indicates the position of the main recombinant protein product (A). These experiments confirm that 287 is a surface-exposed protein and that it is a useful immunogen. The hydrophilicity plots, antigenic index, and amphipatic regions of ORF 287 are provided in FIG. 17. The AMPHI program is used to predict putative T-cell epitopes (Gao et al 1989, *J. Immunol* 143:3007; Roberts et al. 1996, *AIDS Res Human Retroviruses* 12:593; Quakyi et al. 1992, *Scand J Immunol Suppl* 11:9). The nucleic acid sequence of ORF 287 and the amino acid sequence encoded thereby is provided in Example 1.

Example 10

Expression of ORF 406

Figure 18:
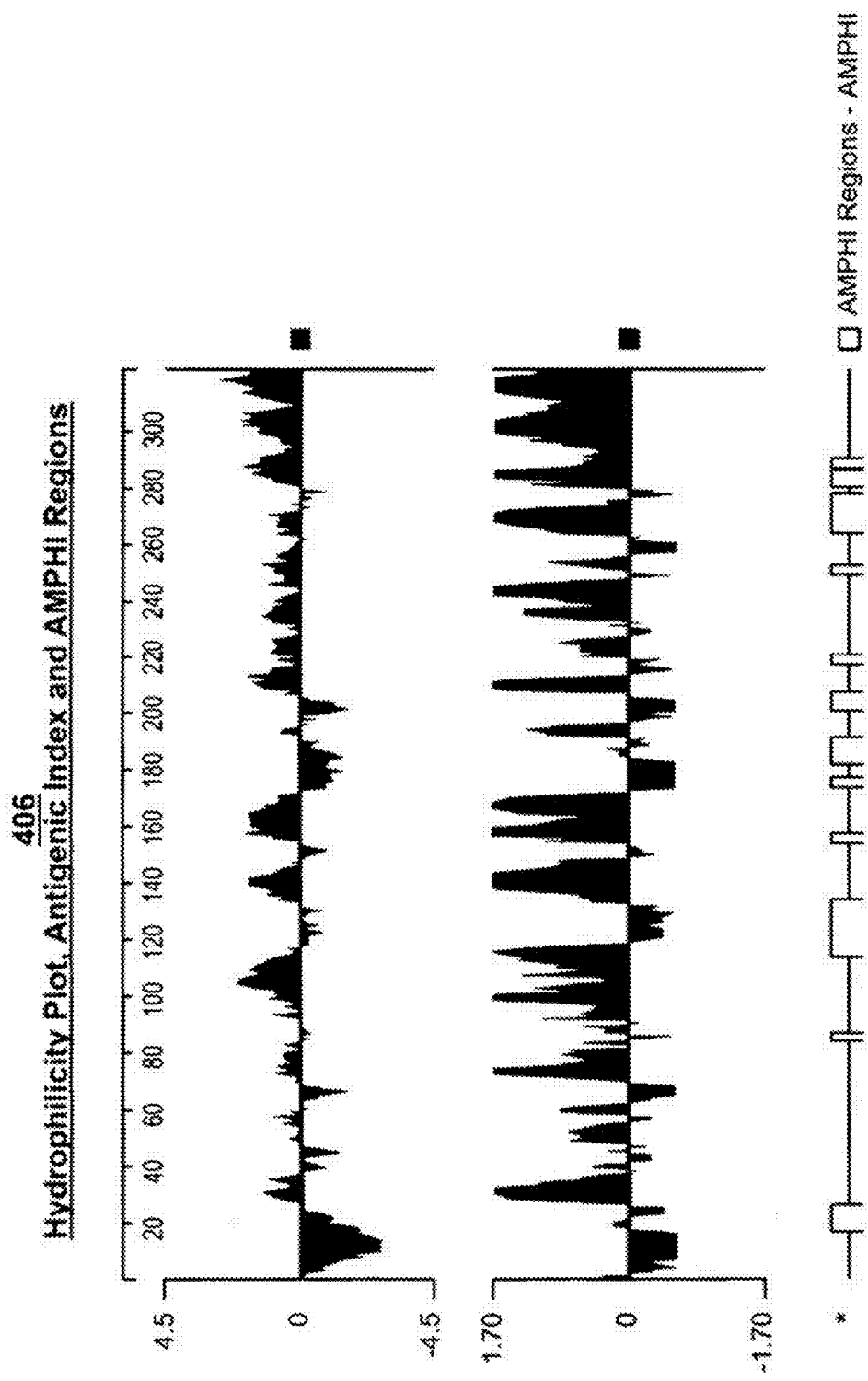

The primer described in Table 1 for ORF 406 was used to locate and clone ORF 406. The predicted gene 406 was cloned in pET vector and expressed in *E. coli*. The product of protein purification was analyzed by SDS-PAGE. In panel A) is shown the analysis of 406-His fusion protein purification. Mice were immunized with the purified 406-His and sera were used for Western blot analysis (panel B), FACS analysis (panel C), bactericidal assay (panel D), and ELISA assay (panel E). Results show that 406 is a surface-exposed protein. Symbols: M1, molecular weight marker; TP, *N. meningitidis* total protein extract; OMV, *N. meningitidis* outer membrane vescicle preparation. Arrows indicate the position of the main recombinant protein product (A) and the *N. meningitidis* immunoreactive band (B). These experiments confirm that 406 is a surface-exposed protein and that it is a useful immunogen. The hydrophilicity plots, antigenic index, and amphipatic regions of ORF 406 are provided in FIG. 18. The AMPHI program is used to predict putative T-cell epitopes (Gao et al 1989, *J. Immunol* 143:3007; Roberts et al. 1996, *AIDS Res Human Retroviruses* 12:593; Quakyi et al. 1992, *Scand J Immunol Suppl* 11:9). The nucleic acid sequence of ORF 406 and the amino acid sequence encoded thereby is provided in Example 1.

Example 11

Table 2 lists several *Neisseria* strains which were used to assess the conservation of the sequence of ORF 225 among different strains.

TABLE 2

225 gene variability: List of used *Neisseria* strains

| Identification Strains number | Source/reference |
|---|---|
| Group B | |
| zo01__225 NG6/88 | R. Moxon/Seiler et al., 1996 |
| zo02__225 BZ198 | R. Moxon/Seiler et al., 1996 |
| zo03__225 NG3/88 | R. Moxon/Seiler et al., 1996 |
| zo04__225 297-0 | R. Moxon/Seiler et al., 1996 |
| zo05__225 1000 | R. Moxon/Seiler et al., 1996 |
| zo06__225 BZ147 | R. Moxon/Seiler et al., 1996 |
| zo07__225 BZ169 | R. Moxon/Seiler et al., 1996 |
| zo08__225 528 | R. Moxon/Seiler et al., 1996 |
| zo09__225 NGP165 | R. Moxon/Seiler et al., 1996 |
| zo10__225 BZ133 | R. Moxon/Seiler et al., 1996 |
| zo11__225 NGE31 | R. Moxon/Seiler et al., 1996 |
| zo12__225 NGF26 | R. Moxon/Seiler et al., 1996 |
| zo13__225 NGE28 | R. Moxon/Seiler et al., 1996 |
| zo14__225 NGH38 | R. Moxon/Seiler et al., 1996 |
| zo15__225 SWZ107 | R. Moxon/Seiler et al., 1996 |
| zo16__225 NGH15 | R. Moxon/Seiler et al., 1996 |
| zo17__225 NGH36 | R. Moxon/Seiler et al., 1996 |
| zo18__225 BZ232 | R. Moxon/Seiler et al., 1996 |
| zo19__225 BZ83 | R. Moxon/Seiler et al., 1996 |
| zo20__225 44/76 | R. Moxon/Seiler et al., 1996 |
| zo21__225 MC58 | R. Moxon |
| zo96__225 2996 | Our collection |
| Group A | |
| zo22__225 205900 | R. Moxon |
| zo23__225 F6124 | R. Moxon |
| z2491 Z2491 | R. Moxon/Maiden et al., 1998 |
| Group C | |
| zo24__225 90/18311 | R. Moxon |
| zo25__225 93/4286 | R. Moxon |
| Others | |
| zo26__225 A22 (group W) | R. Moxon/Maiden et al., 1998 |
| zo27__225 E26 (group X) | R. Moxon/Maiden et al., 1998 |
| zo28__225 860800 (group Y) | R. Moxon/Maiden et al., 1998 |
| zo29__225 E32 (group Z) | R. Moxon/Maiden et al., 1998 |
| Gonococcus | |
| zo32__225 Ng F62 | R. Moxon/Maiden et al., 1998 |
| zo33__225 Ng SN4 | R. Moxon |
| fa1090 FA1090 | R. Moxon |

References:
Seiler A. et al., Mol. Microbiol., 1996, 19(4): 841-856.
Maiden et al., Proc. Natl. Acad. Sci. USA, 1998, 95: 3140-3145.

The amino acid sequences for each listed strain are as follows:

```
>FA1090
                                                         <SEQ ID 3115>
MDSFFKPAVWAVLWLMFAVRPALADELTNLLSSREQILRQFAEDEQPVLPVNRAPARRAG

NADELIGSAMGLNEQPVLPVNRAPARRAGNADELIGSAMGLLGIAYRYGGTSVSTGFDCS

GFMQHIFKRAMGINLPRTSAEQARMGAPVARSELQPGDMVFFRTLGGSRISHVGLYIGNN

RFIHAPRTGKNIEITSLSHKYWSGKYAFARRVKKNDPSRFLN*
```

Z2491

<SEQ ID 3116>

MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRVPARRAGNA

DELIGNAMGLNEQPVLPVNRAPARRAGNADELIGNAMGLLGIAYRYGGTSISTGFDCSGF

MQHIFKRAMGINLPRISAEQARMGTPVARSELQPGDMVFFRTLGGSRISHVGLYIGNNRF

IHAPRTGKNIEITSLSHKYWSGKYAFARRVKKNDPSRFLN*

ZO01_225

<SEQ ID 3117>

MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSISTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO02_225

<SEQ ID 3118>

MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSVSTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO03_225

<SEQ ID 3119>

MDSFFKPAVWAVLWLMFAVRLALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSVSTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO04_225

<SEQ ID 3120>

MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSVSTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO05_225

<SEQ ID 3121>

MDSFFKPAVWAVLWLMFAVRPALADELTNLLSSREQILRQFAEDEQPVLPINRAPARRAG

NADELIGSAMGLNEQPVLPVNRVPARRAGNADELIGSAMGLNEQPVLPVNRAPARRAGNA

DELIGNAMGLLGIAYRYGGTSISTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO06_225

<SEQ ID 3122>

MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSVSTGFDCSGFMQHIFKRAMGINLPRTSAEQARMGTPVAR

```
SELQPGDMVFFRTLGGSRISHVGLYIGNNRFIHAPRTGKNIEITSLSHKYWSGKYAFARR

VKKNDPSRFLN*

Z007_225
                                                    <SEQ ID 3123>
MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSVSTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

Z008_225
                                                    <SEQ ID 3124>
MDSFFKPAVWAVLWLMFAVRPALADELTNLLSSREQILRQFAEDEQPVLPINRAPARRAG

NADELIGSAMGLNEQPVLPVNRVPARRAGNADELIGSAMGLNEQPVLPVNRAPARRAGNA

DELIGNAMGLLGIAYRYGGTSISTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

Z009_225
                                                    <SEQ ID 3125>
MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSISTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

Z010_225
                                                    <SEQ ID 3126>
MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSVSTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

Z011_225
                                                    <SEQ ID 3127>
MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLNEQPVLPVNRAPARRAGNADELIGNAMGLLGIAYRYGGTSVSTGFDCSGF

MQHIFKRAMGINLPRTSAEQARMGTPVARSELQPGDMVFFRTLGGSRISHVGLYIGNNRF

IHAPRTGKNIEITSLSHKYWSGKYAFARRVKKNDPSRFLN*

Z012_225
                                                    <SEQ ID 3128>
MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSISTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

Z013_225
                                                    <SEQ ID 3129>
MDSFFKPAVWAVLWLMFAVRPALADELTNLLSSREQILRQFAEDEQPVLPVNRAPARRAG

NADELIGSAMGLNEQPVLPVNRVPARRAGNADELIGNAMGLNEQPVLPVNRAPARRAGNA
```

```
DELIGNAMGLLGIAYRYGGTSVSTGFDCSGFIQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO14_225
                                                       <SEQ ID 3130>
MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSVSTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO15_225
                                                       <SEQ ID 3131>
MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLLGIAYRYGGTSVSTGFDCS

GFMQHIFKRAMGINLPRTSAEQARMGTPVARSELQPGDMVFFRTLGGSRISHVGLYIGNN

RFIHAPRTGKNIEITSLSHKYWSGKYAFARRVKKNDPSRFLN*

ZO16_225
                                                       <SEQ ID 3132>
MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSVSTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO17_225
                                                       <SEQ ID 3133>
MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSVSTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO18_225
                                                       <SEQ ID 3134>
MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSVSTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO19_225
                                                       <SEQ ID 3135>
MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSVSTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*
```

ZO20_225
<SEQ ID 3136>
MDSFFKPAVWAVLWLMFAVRPALADELTNLLSSREQILRQFAEDEQPVLPINRAPARRAG
NADELIGSAMGLNEQPVLPINRAPARRAGNADELIGSAMGLNEQPVLPVNRVPARRAGNA
DELIGNAMGLNEQPVLPVNRAPARRAGNADELIGNAMGLLGIAYRYGGTSVSTGFDCSGF
MQHIFKRAMGINLPRTSAEQARMGTPVARSELQPGDMVFFRTLGGSRISHVGLYIGNNRF
IHAPRTGKNIEITSLSHKYWSGKYAFARRVKKNDPSRFLN*

ZO21_225
<SEQ ID 3137>
MDSFFKPAVWAVLWLMFAVRPALADELTNLLSSREQILRQFAEDEQPVLPINRAPARRAG
NADELIGSAMGLNEQPVLPVNRVPARRAGNADELIGNAMGLNEQPVLPVNRAPARRAGNA
DELIGNAMGLLGIAYRYGGTSVSTGFDCSGFMQHIFKRAMGINLPRTSAEQARMGTPVAR
SELQPGDMVFFRTLGGSRISHVGLYIGNNRFIHAPRTGKNIEITSLSHKYWSGKYAFARR
VKKNDPSRFLN*

ZO22_225
<SEQ ID 3138>
MDSFFKPAVWAVLWLMFAVRPALADELTNLLSSREQILRQFAEDEQPVLPINRAPARRAG
NADELIGSAMGLNEQPVLPVNRVPARRAGNADELIGNAMGLNEQPVLPVNRAPARRAGNA
DELIGNAMGLLGIAYRYGGTSISTGFDCSGFMQHIFKRAMGINLPRTSAEQARMGTPVAR
SELQPGDMVFFRTLGGSRISHVGLYIGNNRFIHAPRTGKNIEITSLSHKYWSGKYAFARR
VKKNDPSRFLN*

ZO23_225
<SEQ ID 3139>
MDSFFKPAVWAVLWLMFAVRPALADELTNLLSSREQILRQFAEDEQPVLPINRAPARRAG
NADELIGSAMGLNEQPVLPVNRVPARRAGNADELIGNAMGLNEQPVLPVNRAPARRAGNA
DELIGNAMGLLGIAYRYGGTSISTGFDCSGFMQHIFKRAMGINLPRTSAEQARMGTPVAR
SELQPGDMVFFRTLGGSRISHVGLYIGNNRFIHAPRTGKNIEITSLSHKYWSGKYAFARR
VKKNDPSRFLN*

ZO24_225
<SEQ ID 3140>
MDSFFKPAVWAVLWLMFAVRPALADELTNLLSSREQILRQFAEDEQPVLPINRAPARRAG
NADELIGSAMGLNEQPVLPVNRVPARRAGNADELIGNAMGLNEQPVLPVNRAPARRAGNA
DELIGNAMGLLGIAYRYGGTSISTGFDCSGFMQHIFKRAMGINLPRTSAEQARMGTPVAR
SELQPGDMVFFRTLGGSRISHVGLYIGNNRFIHAPRTGKNIEITSLSHKYWSGKYAFARR
VKKNDPSRFLN*

ZO25_225
<SEQ ID 3141>
MDSFFKPAVWAVLWLMFAVRPALADELTNLLSSREQILRQFAEDEQPVLPINRAPARRAG
NADELIGSAMGLNEQPVLPVNRVPARRAGNADELIGNAMGLNEQPVLPVNRAPARRAGNA
DELIGNAMGLLGIAYRYGGTSISTGFDCSGFMQHIFKRAMGINLPRTSAEQARMGTPVAR
SELQPGDMVFFRTLGGSRISHVGLYIGNNRFIHAPRTGKNIEITSLSHKYWSGKYAFARR
VKKNDPSRFLN*

ZO26_225
<SEQ ID 3142>
MDSFFKPAVWAVLWLMFAVRPALADELTNLLSSREQILRQFAEDEQPVLPINRAPARRAG
NADELIGSAMGLNEQPVLPVNRVPARRAGNADELIGNAMGLNEQPVLPVNRAPARRAGNA
DELIGNAMGLLGIAYRYGGTSISTGFDCSGFMQHIFKRAMGINLPRTSAEQARMGTPVAR

-continued

SELQPGDMVFFRTLGGSRISHVGLYIGNNRFIHAPRTGKNIEITSLSHKYWSGKYAFARR

VKKNDPSRFLN*

ZO27_225
<SEQ ID 3143>
MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSVSTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO28_225
<SEQ ID 3144>
MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSVSTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO29_225
<SEQ ID 3145>
MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSVSTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO32_225
<SEQ ID 3146>
MDSFFKPAVWAVLWLMFAVRPALADELTNLLSSREQILRQFAEDEQPVLPVNRAPARRAG

NADELIGSAMGLNEQPVLPVNRAPARRAGNADELIGSAMGLLGIAYRYGGTSVSTGFDCS

GFMQHIFKRAMGINLPRTSAEQARMGAPVARSELQPGDMVFFRTLGGSRISHVGLYIGNN

RFIHAPRTGKNIEITSLSHKYWSGKYAFARRVKKNDPSRFLN*

ZO33_225
<SEQ ID 3147>
MDSFFKPAVWAVLWLMFAVRSALADELTNLLSSREQILRQFAEDEQPVLPVNRAPARRAG

NADELIGSAMGLNEQPVLPVNRAPARRAGNADELIGSAMGLLGIAYRYGGTSVSTGFDCS

GFMQHIFKRAMGINLPRTSAEQARMGAPVARSELQPGDMVFFRTLGGSRISHVGLYIGNN

RFIHAPRTGKNIEITSLSHKYWSGKYAFARRIKKNDPSRFLN*

ZO96_225
<SEQ ID 3148>
MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSISTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

Figure 19A:
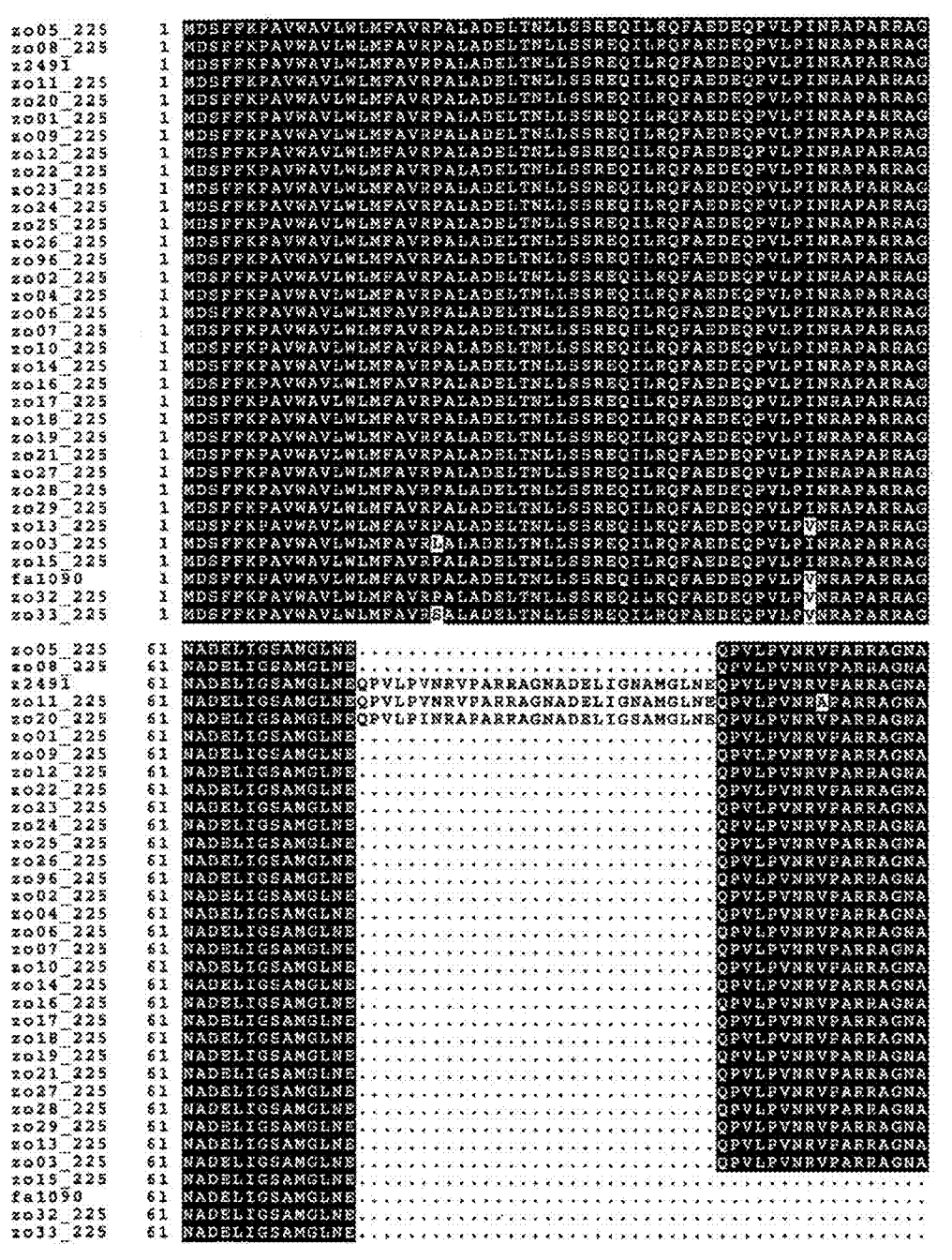
Figure 19B:
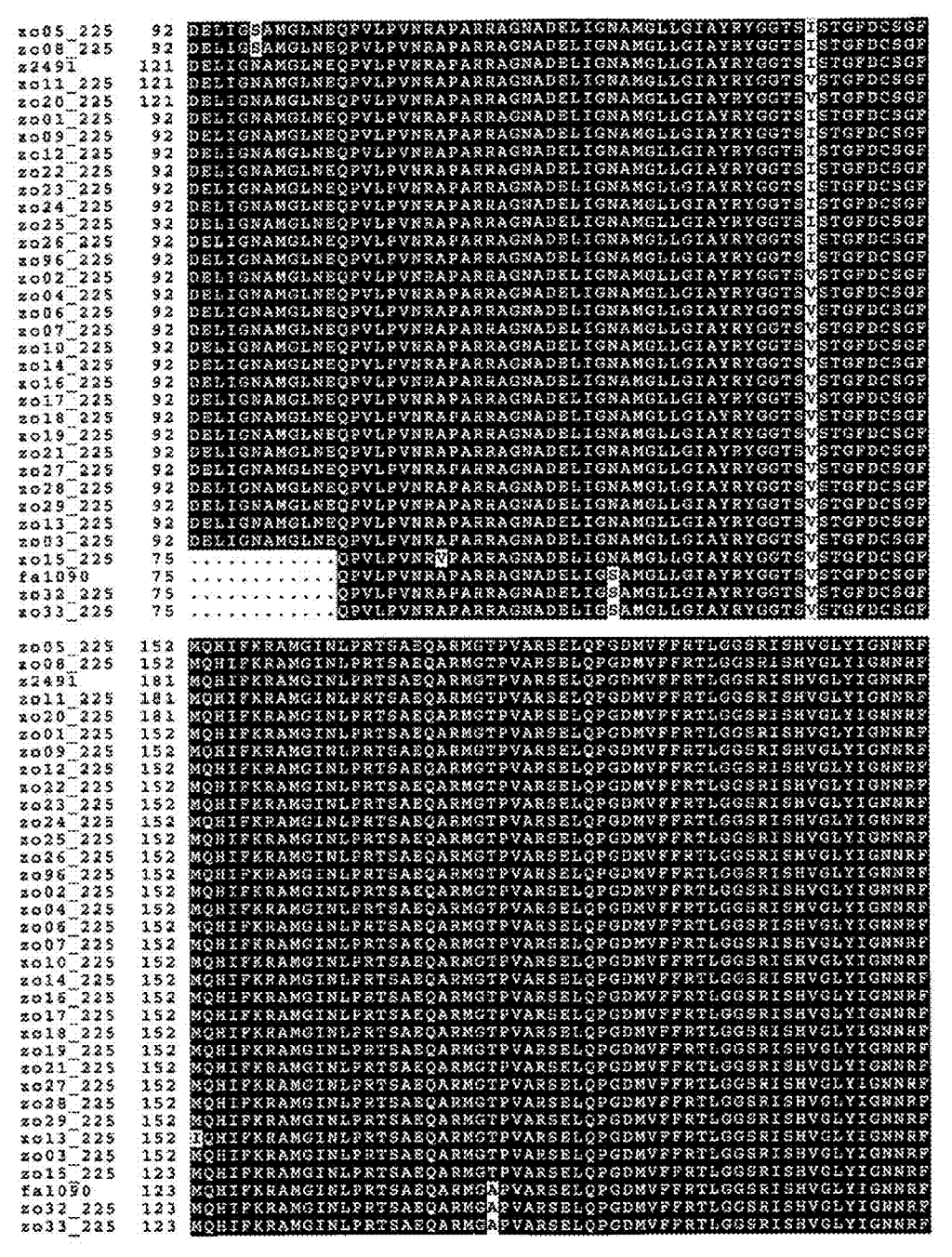
Figure 19C:
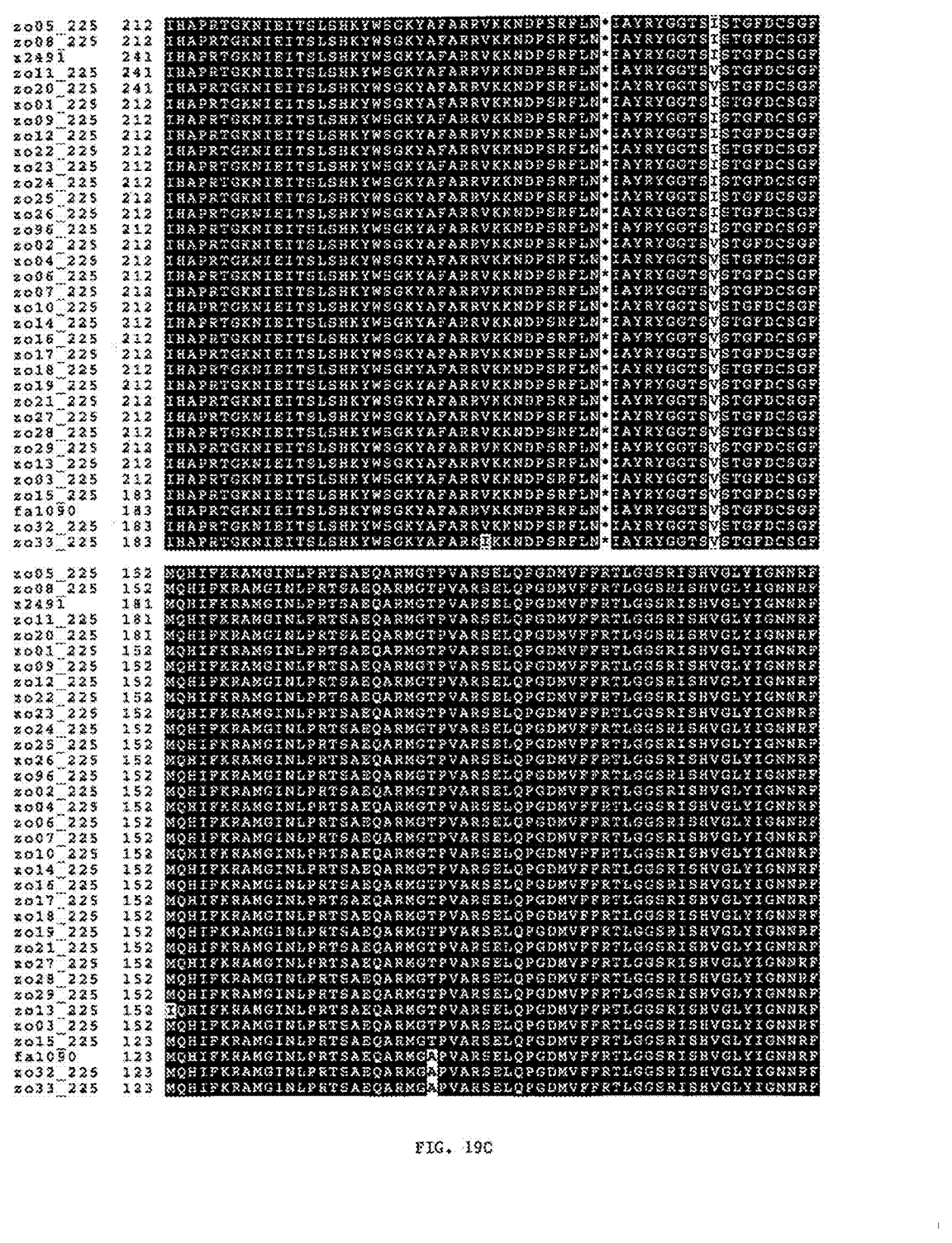

FIG. 19 shows the results of aligning the sequences of each of these strains. Dark shading indicates regions of homology, and gray shading indicates the conservation of amino acids with similar characteristics. As is readily discernible, there is significant conservation among the various strains of ORF 225, further confirming its utility as an antigen for both vaccines and diagnostics.

Example 12

Table 3 lists several *Neisseria* strains which were used to assess the conservation of the sequence of ORF 235 among different strains.

TABLE 3

235 gene variability: List of used *Neisseria* strains

| Identification Strains number | Reference |
|---|---|
| Group B | |
| gnmzq01 NG6/88 | Seiler et al., 1996 |
| gnmzq02 BZ198 | Seiler et al., 1996 |
| gnmzq03 NG3/88 | Seiler et al., 1996 |
| gnmzq04 1000 | Seiler et al., 1996 |
| gnmzq05 1000 | Seiler et al., 1996 |
| gnmzq07 BZ169 | Seiler et al., 1996 |
| gnmzq08 528 | Seiler et al., 1996 |
| gnmzq09 NGP165 | Seiler et al., 1996 |
| gnmzq10 BZ133 | Seiler et al., 1996 |
| gnmzq11 NGE31 | Seiler et al., 1996 |
| gnmzq13 NGE28 | Seiler et al., 1996 |
| gnmzq14 NGH38 | Seiler et al., 1996 |
| gnmzq15 SWZ107 | Seiler et al., 1996 |
| gnmzq16 NGH15 | Seiler et al., 1996 |

TABLE 3-continued 235 gene variability: List of used *Neisseria* strains

| Identification Strains number | Reference |
|---|---|
| gnmzq17 NGH36 | Seiler et al., 1996 |
| gnmzq18 BZ232 | Seiler et al., 1996 |
| gnmzq19 BZ83 | Seiler et al., 1996 |
| gnmzq21 MC58 | Virji et al., 1992 |
| Group A | |
| gnmzq22 205900 | Our collection |
| gnmzq23 F6124 | Our collection |
| z2491 Z2491 | Maiden et al., 1998 |
| Group C | |
| gnmzq24 90/18311 | Our collection |
| gnmzq25 93/4286 | Our collection |
| Others | |
| gnmzq26 A22 (group W) | Maiden et al., 1998 |
| gnmzq27 E26 (group X) | Maiden et al., 1998 |
| gnmzq28 860800 (group Y) | Maiden et al., 1998 |
| gnmzq29 E32 (group Z) | Maiden et al., 1998 |
| gnmzq31 *N. lactamica* | Our collection |
| Gonococcus | |
| gnmzq32 Ng F62 | Maiden et al., 1998 |
| gnmzq33 Ng SN4 | Our collection |
| fa1090 FA1090 | Dempsey et al. 1991 |

References:
Seiler A. et al., Mol. Microbiol., 1996, 19(4): 841-856.
Maiden R. et al., Proc. Natl. Acad. Sci. USA, 1998, 95: 3140-3145.
Virji M. et al., Mol. Microbiol., 1992, 6: 1271-1279
Dempsey J. F. et al., J. Bacteriol., 1991, 173: 5476-5486

The amino acid sequences for each listed strain are as follows:

```
FA1090
                                                  <SEQ ID 3149>
MKPLILGLAAVLALSACQVRKAPDLDYTSFKESKPASILVVPPLNESPDVNGTWGMLAST

AAPISEAGYYVFPAAVVEETFKENGLTNAADIHAVRPEKLHQIFGNDAVLYITVTEYGTS

YQILDSVTTVSAKARLVDSRNGKELWSGSASIREGSNNSNSGLLGALVGAVVNQIANSLT

DRGYQVSKTAAYNLLSPYSRNGILKGPRFVEEQPK*

GNMZQ01
                                                  <SEQ ID 3150>
MKPLILGLAAVLALSACQVQKAPDFDYTSFKESKPASILVVPPLNESPDVNGTWGVLAST

AAPLSEAGYYVFPAAVVEETFKENGLTNAADIHAVRPEKLHQIFGNDAVLYITVTEYGTS

YQILDSVTTVSAKARLVDSRNGKELWSGSASIREGSNNSNSGLLGALVSAVVNQIANNLT

DRGYQVSKTAAYNLLSPYSHNGILKGPRFVEEQPK*

GNMZQ02
                                                  <SEQ ID 3151>
MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVSAVVNQIANSLT

DRGYQVSKTAAYNLLSPYSHNGILKGPRFVEEQPK*

GNMZQ03
                                                  <SEQ ID 3152>
MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS
```

-continued

YQILDSVTTVSAKARLVDSRNGKELWSGSASIREGSNNSNSGLLGALVSAVVNQIANSLT

DRGYQVSKTAAYNLLSPYSHNGILKGPRFVEEQPK*

GNMZQ04                                                       <SEQ ID 3153>
MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVSAVVNQIANSLT

DRGYQVSKTAAYNLLSPYSHNGILKGPRFVEEQPK*

GNMZQ05                                                       <SEQ ID 3154>
MKPLILGLAAVLALSACQVQKAPDFDYTSFKESKPASILVVPPLNESPDVNGTWGVLAST

AAPLSEAGYYVFPAAVVEETFKENGLTNAADIHAVRPEKLHQIFGNDAVLYITVTEYGTS

YQILDSVTTVSAKARLVDSRNGKELWSGSASIREGSNNSNSGLLGALVSAVVNQIANNLT

DRGYQVSKTAAYNLLSPYSHNGILKGPRFVEEQPK*

GNMZQ07                                                       <SEQ ID 3155>
MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVSAVVNQIANSLT

DRGYQVSKTAAYNLLSPYSHNGILKGPRFVEEQPK*

GNMZQ08                                                       <SEQ ID 3156>
MKPLILGLAAVLALSACQVQKAPDFDYTSFKESKPASILVVPPLNESPDVNGTWGVLAST

AAPLSEAGYYVFPAAVVEETFKENGLTNAADIHAVRPEKLHQIFGNDAVLYITVTEYGTS

YQILDSVTTVSAKARLVDSRNGKELWSGSASIREGSNNSNSGLLGALVSAVVNQIANNLT

DRGYQVSKTAAYNLLSPYSHNGILKGPRFVEEQPK*

GNMZQ09                                                       <SEQ ID 3157>
MKPLILGLAAALVLSACQVQKAPDFDYTSFKESKPASILVVPPLNESPDVNGTWGMLAST

AEPLSEAGYYVFPAAVVEETFKQNGLTNAADIHAVQPEKLHQIFGNDAVLYITITEYGTS

YQILDSVTTVSARARLVDSRNGKVLWSGSASIREGSNNSNSGLLGALVSAVVNQIANSLT

DRGYQVSKTAAYNLLSPYSHNGILKGPRFVEEQPK*

GNMZQ10                                                       <SEQ ID 3158>
MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVSAVVNQIANSLT

DRGYQVSKTAAYNLLSPYSHNGILKGPRFVEEQPK*

GNMZQ11                                                       <SEQ ID 3159>
MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVSAVVNQIANSLT

DRGYQVSKTAAYNLLSPYSHNGILKGPRFVEEQPK*

GNMZQ13                                                       <SEQ ID 3160>
MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

-continued

```
YQILDSVTTVSAKARLVDSRNGKELWSGSASIREGSNNSNSGLLGALVSAVVNQIANSLT

DRGYQVSKTAAYNLLSPYSHNGILKGPRFVEEQPK*

GNMZQ14
                                                   <SEQ ID 3161>
MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVGAVVNQIANSLT

DRGYQVSKTAAYNLLSPYSHNGILKGPRFVEEQPK*

GNMZQ15
                                                   <SEQ ID 3162>
MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVSAVVNQIANSLT

DRGYQVSKTAAYNLLSPYSHNGILKGPRFVEEQPK*

GNMZQ16
                                                   <SEQ ID 3163>
MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVSAVVNQIANSLT

DRGYQVSKTAAYNLLSPYSHNGILKGPRFVEEQPK*

GNMZQ17
                                                   <SEQ ID 3164>
MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVSAVVNQIANSLT

DRGYQVSKTAAYNLLSPYSHNGILKGPRFVEEQPK*

GNMZQ18
                                                   <SEQ ID 3165>
MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVGAVVNQIANSLT

DRGYQVSKTAAYNLLSPYSHNGILKGPRFVEEQPK*

GNMZQ19
                                                   <SEQ ID 3166>
MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVSAVVNQIANSLT

DRGYQVSKTAAYNLLSPYSHNGILKGPRFVEEQPK*

GNMZQ21
                                                   <SEQ ID 3166>
MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVSAVVNQIANSLT

DRGYQVSKTAAYNLLSPYSHNGILKGPRFVEEQPK*

GNMZQ22
                                                   <SEQ ID 3167>
MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS
```

```
YQILDSVTTVSAKARLVDSRNGKELWSGSASIREGSNNSNSGLLGALVSAVVNQIANSLT

DRGYQVSKTAAYNLLSPYSHNGILKGPRFVEEQPK*

GNMZQ23
                                                    <SEQ ID 3168>
MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVSAVVNQIANSLT

DRGYQVSKTAAYNLLSPYSHNGILKGPRFVEEQPK*

GNMZQ24
                                                    <SEQ ID 3169>
MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVSAVVNQIANSLT

DRGYQVSKTAAYNLLSPYSHNGILKGPRFVEEQPK*

GNMZQ25
                                                    <SEQ ID 3170>
MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVSAVVNQIANSLT

DRGYQVSKTAAYNLLSPYSHNGILKGPRFVEEQPK*

GNMZQ26
                                                    <SEQ ID 3171>
MKPLILGLAAVLALSACQVQKAPDFDYTSFKESKPASILVVPPLNESPDVNGTWGMLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVGAVVNQIANSLT

DRGYQVSKTAAYNLLSPYSHNGILKGPRFVEEQPK*

GNMZQ27
                                                    <SEQ ID 3172>
MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVSAVVNQIANSLT

DRGYQVSKTAAYNLLSPYSHNGILKGPRFVEEQPK*

GNMZQ28
                                                    <SEQ ID 3173>
MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVSAVVNQIANSLT

DRGYQVSKTAAYNLLSPYSHNGILKGPRFVEEQPK*

GNMZQ29
                                                    <SEQ ID 3174>
MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVSAVVNQIANSLT

DRGYQVSKTAAYNLLSPYSHNGILKGPRFVEEQPK*

GNMZQ31
                                                    <SEQ ID 3175>
MKPLILGLAAVLALSACQVQKAPDFDYTAFKESKPASILVVPPLNESPDVNGTWGMLAST

AEPLSEAGYYVFPAAVVEETFKQNGLTNAADIHAVRPEKLHQIFGNDAVLYITITEYGTS
```

```
-continued
YQILDSVTTVSARARLVDSRNGKVLWSGSASIREGSNNSNSGLLGALVGAVVNQIANSLT

DRGYQVSKAAAYDLLSPYSHNGILKGPRFVEEQPK*

GNMZQ32
                                                        <SEQ ID 3176>
MKPLILGLAAVLALSACQVRKAPDLDYTSFKESKPASILVVPPLNESPDVNGTWGMLAST

AAPISEAGYYVFPAAVVEETFKENGLTNAADIHAVRPEKLHQIFGNDAVLYITVTEYGTS

YQILDSVTTVSAKARLVDSRNGKELWSGSASIREGSNNSNSGLLGALVGAVVNQIANSLT

DRGYQVSKTAAYNLLSPYSRNGILKGPRFVEEQPK*

GNMZQ33
                                                        <SEQ ID 3177>
MKPLILGLAAVLALSACQVRKAPDLDYTSFKESKPASILVVPPLNESPDVNGTWGMLAST

AAPISEAGYYVFPAAVVEETFKENGLTNAADIHAVRPEKLHQIFGNDAVLYITVTEYGTS

YQILDSVTTVSAKARLVDSRNGKELWSGSASIREGSNNSNSGLLGALVGAVVNQIANSLT

DRGYQVSKTAAYNLLSPYSRNGILKGPRFVEEQPK*

Z2491
                                                        <SEQ ID 3178>
MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVSAVVNQIANSLT

DRGYQVSKTAAYNLLSPYSHNGILKGPRFVEEQPK*
```

Figure 20A:
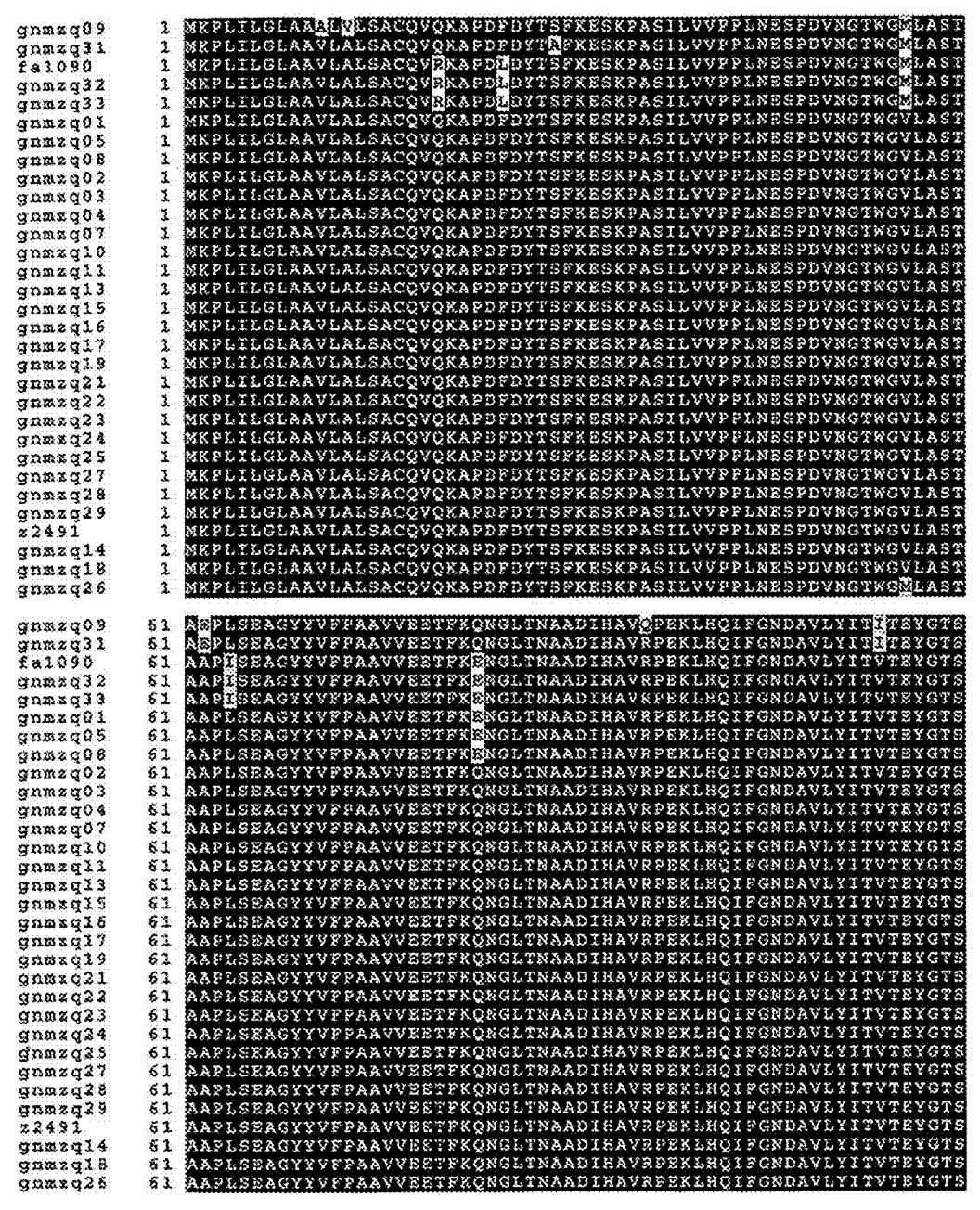

FIG. 20 shows the results of aligning the sequences of each of these strains. Dark shading indicates regions of homology, and gray shading indicates the conservation of amino acids with similar characteristics. As is readily discernible, there is significant conservation among the various strains of ORF 235, further confirming its utility as an antigen for both vaccines and diagnostics.

Example 13

Table 4 lists several *Neisseria* strains which were used to assess the conservation of the sequence of ORF 287 among different strains.

TABLE 4

287 gene variability: List of used *Neisseria* strains

| Identification Strains number | Reference |
|---|---|
| Group B | |
| 287_2 BZ198 | Seiler et al., 1996 |
| 287_9 NGP165 | Seiler et al., 1996 |
| 287_14 NGH38 | Seiler et al., 1996 |
| 287_21 MC58 | Virji et al., 1992 |
| Group A | |
| z2491 Z2491 | Maiden et al., 1998 |
| Gonococcus | |
| fa1090 FA1090 | Dempsey et al. 1991 |

References:
Seiler A. et al., Mol. Microbiol., 1996, 19(4): 841-856.
Maiden R. et al., Proc. Natl. Acad. Sci. USA, 1998, 95: 3140-3145.
Virji M. et al., Mol. Microbiol., 1992, 6: 1271-1279
Dempsey J. F. et al., J. Bacteriol., 1991, 173: 5476-5486

The amino acid sequences for each listed strain are as follows:

```
287_14
                                                        <SEQ ID 3179>
MFKRSVIAMACIFALSACGGGGGGSPDVKSADTLSKPAAPVVSEKETEAKEDAPQAGSQG

QGAPSAQGGQDMAAVSEENTGNGGAAATDKPKNEDEGAQNDMPQNAADTDSLTPNHTPAS

NMPAGNMENQAPDAGESEQPANQPDMANTADGMQGDDPSAGGENAGNTAAQGTNQAENNQ

TAGSQNPASSTNPSATNSGGDFGRTNVGNSVVIDGPSQNITLTHCKGDSCSGNNFLDEEV

QLKSEFEKLSDADKISNYKKDGKNDGKNDKFVGLVADSVQMKGINQYIIFYKPKPTSFAR

FRRSARSRRSLPAEMPLIPVNQADTLIVDGEAVSLTGHSGNIFAPEGNYRYLTYGAEKLP

GGSYALRVQGEPSKGEMLAGTAVYNGEVLHFHTENGRPSPSRGRFAAKVDFGSKSVDGII
```

-continued

DSGDGLHMGTQKFKAAIDGNGFKGTWTENGGGDVSGKFYGPAGEEVAGKYSYRPTDAEKG

GFGVFAGKKEQD*

287_2
<SEQ ID 3180>
MFKRSVIAMACIFALSACGGGGGGSPDVKSADTLSKPAAPVVSEKETEAKEDAPQAGSQG

QGAPSAQGGQDMAAVSEENTGNGGAAATDKPKNEDEGAQNDMPQNAADTDSLTPNHTPAS

NMPAGNMENQAPDAGESEQPANQPDMANTADGMQGDDPSAGGENAGNTAAQGTNQAENNQ

TAGSQNPASSTNPSATNSGGDFGRTNVGNSVVIDGPSQNITLTHCKGDSCSGNNFLDEEV

QLKSEFEKLSDADKISNYKKDGKNDGKNDKFVGLVADSVQMKGINQYIIFYKPKPTSFAR

FRRSARSRRSLPAEMPLIPVNQADTLIVDGEAVSLTGHSGNIFAPEGNYRYLTYGAEKLP

GGSYALRVQGEPSKGEMLAGTAVYNGEVLHFHTENGRPSPSRGRFAAKVDFGSKSVDGII

DSGDGLHMGTQKFKAAIDGNGFKGTWTENGGGDVSGKFYGPAGEEVAGKYSYRPTDAEKG

GFGVFAGKKEQD*

287_21.
<SEQ ID 3181>
MFKRSVIAMACIFALSACGGGGGGSPDVKSADTLSKPAAPVVSEKETEAKEDAPQAGSQG

QGAPSAQGSQDMAAVSEENTGNGGAVTADNPKNEDEVAQNDMPQNAAGTDSSTPNHTPDP

NMLAGNMENQATDAGESSQPANQPDMANAADGMQGDDPSAGGQNAGNTAAQGANQAGNNQ

AAGSSDPIPASNPAPANGGSNFGRVDLANGVLIDGPSQNITLTHCKGDSCSGNNFLDEEV

QLKSEFEKLSDADKISNYKKDGKNDKFVGLVADSVQMKGINQYIIFYKPKPTSFARFRRS

ARSRRSLPAEMPLIPVNQADTLIVDGEAVSLTGHSGNIFAPEGNYRYLTYGAEKLPGGSY

ALRVQGEPAKGEMLAGAAVYNGEVLHFHTENGRPYPTRGRFAAKVDFGSKSVDGIIDSGD

DLHMGTQKFKAAIDGNGFKGTWTENGSGDVSGKFYGPAGEEVAGKYSYRPTDAEKGGFGV

FAGKKEQD*

287_9
<SEQ ID 3182>
MFKRSVIAMACIVALSACGGGGGGSPDVKSADTLSKPAAPVVTEDVGEEVLPKEKKDEEA

VSGAPQADTQDATAGKGGQDMAAVSAENTGNGGAATTDNPENKDEGPQNDMPQNAADTDS

STPNHTPAPNMPTRDMGNQAPDAGESAQPANQPDMANAADGMQGDDPSAGENAGNTADQA

ANQAENNQVGGSQNPASSTNPNATNGGSDFGRINVANGIKLDSGSENVTLTHCKDKVCDR

DFLDEEAPPKSEFEKLSDEEKINKYKKDEQRENFVGLVADRVEKNGTNKYVIIYKDKSAS

SSSARFRRSARSRRSLPAEMPLIPVNQADTLIVDGEAVSLTGHSGNIFAPEGNYRYLTYG

AEKLSGGSYALSVQGEPAKGEMLAGTAVYNGEVLHFHMENGRPSPSGGRFAAKVDFGSKS

VDGIIDSGDDLHMGTQKFKAVIDGNGFKGTWTENGGGDVSGRFYGPAGEEVAGKYSYRPT

DAEKGGFGVFAGKKEQD*

FA1090
<SEQ ID 3183>
MFKRSVIAMACIFPLSACGGGGGGSPDVKSADTPSKPAAPVVAENAGEGVLPKEKKDEEA

AGGAPQADTQDATAGEGSQDMAAVSAENTGNGGAATTDNPKNEDAGAQNDMPQNAAESAN

QTGNNQPAGSSDSAPASNPAPANGGSDFGRTNVGNSVVIDGPSQNITLTHCKGDSCNGDN

LLDEEAPSKSEFEKLSDEEKIKRYKKDEQRENFVGLVADRVKKDGTNKYIIFYTDKPPTR

SARSRRSLPAEIPLIPVNQADTLIVDGEAVSLTGHSGNIFAPEGNYRYLTYGAEKLPGGS

YALRVQGEPAKGEMLVGTAVYNGEVLHFHMENGRPYPSGGRFAAKVDFGSKSVDGIIDSG

DDLHMGTQKFKAAIDGNGFKGTWTENGGGDVSGRFYGPAGEEVAGKYSYRPTDAEKGGFG

VFAGKKDRD*

-continued

Z2491
<SEQ ID 3184>
MFKRSVIAMACIFALSACGGGGGGSPDVKSADTLSKPAAPVVSEKETEAKEDAPQAGSQG

QGAPSAQGSQDMAAVSEENTGNGGAVTADNPKNEDEVAQNDMPQNAAGTDSSTPNHTPDP

NMLAGNMENQATDAGESSQPANQPDMANAADGMQGDDPSAGGQNAGNTAAQGANQAGNNQ

AAGSSDPIPASNPAPANGGSNFGRVDLANGVLIDGPSQNITLTHCKGDSCSGNNFLDEEV

QLKSEFEKLSDADKISNYKKDGKNDKFVGLVADSVQMKGINQYIIFYKPKPTSFARFRRS

ARSRRSLPAEMPLIPVNQADTLIVDGEAVSLTGHSGNIFAPEGNYRYLTYGAEKLPGGSY

ALRVQGEPAKGEMLAGAAVYNGEVLHFHTENGRPYPTRGRFAAKVDFGSKSVDGIIDSGD

DLHMGTQKFKAAIDGNGFKGTWTENGSGDVSGKFYGPAGEEVAGKYSYRPTDAEKGGFGV

FAGKKEQD*

FIG. 21 shows the results of aligning the sequences of each of these strains. Dark shading indicates regions of homology, and gray shading indicates the conservation of amino acids with similar characteristics. As is readily discernible, there is significant conservation among the various strains of ORF 225, further confirming its utility as an antigen for both vaccines and diagnostics.

Example 14

Table 5 lists several *Neisseria* strains which were used to assess the conservation of the sequence of ORF 519 among different strains.

TABLE 5

519 gene variability: List of used *Neisseria* strains

| Identification Strains number | Source/reference |
|---|---|
| Group B | |
| zv01__519 NG6/88 | R. Moxon/Seiler et al., 1996 |
| zv02__519 BZ198 | R. Moxon/Seiler et al., 1996 |
| zv03__519ass NG3/88 | R. Moxon/Seiler et al., 1996 |
| zv04__519 297-0 | R. Moxon/Seiler et al., 1996 |
| zv05__519 1000 | R. Moxon/Seiler et al., 1996 |
| zv06__519ass BZ147 | R. Moxon/Seiler et al., 1996 |
| zv07__519 BZ169 | R. Moxon/Seiler et al., 1996 |
| zv11__519 NGE31 | R. Moxon/Seiler et al., 1996 |

TABLE 5-continued 519 gene variability: List of used *Neisseria* strains

| Identification Strains number | Source/reference |
|---|---|
| zv12__519 NGF26 | R. Moxon/Seiler et al., 1996 |
| zv18__519 BZ232 | R. Moxon/Seiler et al., 1996 |
| zv19__519 BZ83 | R. Moxon/Seiler et al., 1996 |
| zv20__519ass 44/76 | R. Moxon/Seiler et al., 1996 |
| zv21__519ass MC58 | R. Moxon |
| zv96__519 2996 | Our collection |
| Group A | |
| zv22__519ass 205900 | R. Moxon |
| z2491__519 Z2491 | R. Moxon/Maiden et al., 1998 |
| Others | |
| zv26__519 A22 (group W) | R. Moxon/Maiden et al., 1998 |
| zv27__519 E26 (group X) | R. Moxon/Maiden et al., 1998 |
| zv28__519 860800 (group Y) | R. Moxon/Maiden et al., 1998 |
| zv29__519ass E32 (group Z) | R. Moxon/Maiden et al., 1998 |
| Gonococcus | |
| zv32__519 Ng F62 | R. Moxon/Maiden et al., 1998 |
| fa1090__519 FA1090 | R. Moxon |

References:
Seiler A. et al., Mol. Microbiol., 1996, 19(4): 841-856.
Maiden et al., Proc. Natl. Acad. Sci. USA, 1998, 95: 3140-3145.

The amino acid sequences for each listed strain are as follows:

FA1090_519
<SEQ ID 3185>
MEFFIILLAAVAVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVVSALDEAAGAWGVKVLRYEIKDLVPPQEILRAMQAQITAERE

KRARIAESEGRKIEQINLASGQREAEIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSSKTAK*

Z2491_519
<SEQ ID 3186>
MEFFIILLAAVVVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVVSALDEAAGAWGVKVLRYEIKDLVPPQEILRSMQAQITAERE

-continued

KRARIAESEGRKIEQINLASGQREAEIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSSKTAK*

ZV01_519
<SEQ ID 3187>
MEFFIILLVAVAVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVVAALDEAAGAWGVKVLRYEIKDLVPPQEILRSMQAQITAERE

KRARIAESEGRKIEQINLASGQREAEIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSSKTAK*

ZV02_519
<SEQ ID 3188>
MEFFIILLVAVAVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVVSALDEAAGAWGVKVLRYEIKDLVPPQEILRSMQAQITAERE

KRARIAESEGRKIEQINLASGQREAEIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSSKTAK*

ZV03_519
<SEQ ID 3189>
MEFFIILLVAVAVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVVSALDEAAGAWGVKVLRYEIKDLVPPQEILRSMQAQITAERE

KRARIAESEGRKIEQINLASGQREAEIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSSKTAK*

ZV04_519
<SEQ ID 3190>
MEFFIILLVAVAVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVVSALDEAAGAWGVKVLRYEIKDLVPPQEILRSMQAQITAERE

KRARIAESEGRKIEQINLASGQREAEIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSSKTAK*

ZV05_519
<SEQ ID 3191>
MEFFIILLVAVAVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVVSALDEAAGAWGVKVLRYEIKDLVPPQEILRSMQAQITAERE

KRARIAESEGRKIEQINLASGQREAEIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSSKTAK*

ZV06_519ASS
<SEQ ID 3192>
MEFFIILLVAVAVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVFSALDEAAGAWGVKVLRYEIKDLVPPQEILRSMQAQITAERK

KRARIAESEGRKIEQINLASGQREAEIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSSKTAK*

ZV07_519
<SEQ ID 3193>
MEFFIILLVAVAVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVVAALDEAAGAWGVKVLRYEIKDLVPPQEILRSMQAQITAERE

KRARIAESEGRKIEQINLASGQREAEIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSSKTAK*

ZV11_519
<SEQ ID 3194>
MEFFIILLAAVAVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVVAALDEAAGAWGVKVLRYEIKDLVPPQEILRSMQAQITAERE

KRARIAESEGRKIEQINLASGQREAEIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSSKTAK*

ZV12_519
<SEQ ID 3195>
MEFFIILLVAVAVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVVAALDEAAGAWGVKVLRYEIKDLVPPQEILRSMQAQITAERE

KRARIAESEGRKIEQINLASGQREAEIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSSKTAK*

ZV18_519
<SEQ ID 3196>
MEFFIILLVAVAVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVVAALDEAAGAWGVKVLRYEIKDLVPPQEILRSMQAQITAERE

KRARIAESEGRKIEQINLASGQREAEIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSSKTAK*

ZV19_519
<SEQ ID 3197>
MEFFIILLVAVAVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVVAALDEAAGAWGVKVLRYEIKDLVPPQEILRSMQAQITAERE

KRARIAESEGRKIEQINLASGQREAEIQQSEGEAQAAVNASNAEKIARINRAKGEAESLR

-continued

LVAEANAEAIRQIAAALQTQGGADAVNLKIAEQYVAAFNNLAKESNTLIMPANVADIGSL
ISAGMKIIDSSKTAK*

ZV20_519ASS
<SEQ ID 3198>
MEFFIILLVAVAVFGFKSFVVIPQQEVHVVERLGRFHRALTAGLNILIPFIDRVAYRHSL
KEIPLDVPSQVCITRDNTQLTVDGIIYFQVTDPKLASYGSSNYIMAITQLAQTTLRSVIG
RMELDKTFEERDEINSTVVAALDEAAGAWGVKVLRYEIKDLVPPQEILRSMQAQITAERE
KRARIAESEGRKIEQINLASGQREAEIQQSEGEAQAAVNASNAEKIARINRAKGEAESLR
LVAEANAEAIRQIAAALQTQGGADAVNLKIAEQYVAAFNNLAKESNTLIMPANVADIGSM
ISAGMKIIDSSKTAK*

ZV21_519ASS
<SEQ ID 3199>
MEFFIILLVAVAVFGFKSFVVIPQQEVHVVERLGRFHRALTAGLNILIPFIDRVAYRHSL
KEIPLDVPSQVCITRDNTQLTVDGIIYFQVTDPKLASYGSSNYIMAITQLAQTTLRSVIG
RMELDKTFEERDEINSTVVAALDEAAGAWGVKVLRYEIKDLVPPQEILRSMQAQITAERE
KRARIAESEGRKIEQINLASGQREAEIQQSEGEAQAAVNASNAEKIARINRAKGEAESLR
LVAEANAEAIRQIAAALQTQGGADAVNLKIAEQYVAAFNNLAKESNTLIMPANVADIGSL
ISAGMKIIDSSKTAK*

ZV22_519ASS
<SEQ ID 3200>
MEFFIILLAAVVVFGFKSFVVIPQQEVHVVERLGRFHRALTAGLNILIPFIDRVAYRHSL
KEIPLDVPSQVCITRDNTQLTVDGIIYFQVTDPKLASYGSSNYIMAITQLAQTTLRSVIG
RMELDKTFEERDEINSTVVSALDEAAGAWGVKVLRYEIKDLVPPQEILRSMQAQITAERE
KRARIAESEGRKIEQINLASGQREAKIQQSEGEAQAAVNASNAEKIARINRAKGEAESLR
LVAEANAEAIRQIAAALQTQGGADAVNLKIAEQYVAAFNNLAKESNTLIMPANVADIGSL
ISAGMKIIDSSKTAK*

ZV26_519
<SEQ ID 3201>
MEFFIILLAAVVVFGFKSFVVIPQQEVHVVERLGRFHRALTAGLNILIPFIDRVAYRHSL
KEIPLDVPSQVCITRDNTQLTVDGIIYFQVTDPKLASYGSSNYIMAITQLAQTTLRSVIG
RMELDKTFEERDEINSTVVAALDEAAGAWGVKVLRYEIKDLVPPQEILRSMQAQITAERE
KRARIAESEGRKIEQINLASGQREAEIQQSEGEAQAAVNASNAEKIARINRAKGEAESLR
LVAEANAEAIRQIAAALQTQGGADAVNLKIAEQYVAAFNNLAKESNTLIMPANVADIGSL
ISAGMKIIDSSKTAK*

ZV27_519
<SEQ ID 3202>
MEFFIILLVAVAVFGFKSFVVIPQQEVHVVERLGRFHRALTAGLNILIPFIDRVAYRHSL
KEIPLDVPSQVCITRDNTQLTVDGIIYFQVTDPKLASYGSSNYIMAITQLAQTTLRSVIG
RMELDKTFEERDEINSTVVAALDEAAGAWGVKVLRYEIKDLVPPQEILRSMQAQITAERE
KRARIAESEGRKIEQINLASGQREAEIQQSEGEAQAAVNASNAEKIARINRAKGEAESLR
LVAEANAEAIRQIAAALQTQGGADAVNLKIAEQYVAAFNNLAKESNTLIMPANVADIGSL
ISAGMKIIDSSKTAK*

ZV28_519
<SEQ ID 3203>
MEFFIILLAAVAVFGFKSFVVIPQQEVHVVERLGRFHRALTAGLNILIPFIDRVAYRHSL
KEIPLDVPSQVCITRDNTQLTVDGIIYFQVTDPKLASYGSSNYIMAITQLAQTTLRSVIG
RMELDKTFEERDEINSTVVAALDEAAGAWGVKVLRYEIKDLVPPQEILRSMQAQITAERE

-continued

KRARIAESEGRKIEQINLASGQREAEIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSSKTAK*

ZV29_519ASS
<SEQ ID 3204>
MEFFIILLAAVAVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSIVVSALDEAAGAWGVKVLRYEIKDLVPPQEILRSMQAQITAERE

KRARIAESEGRKIEQINLASGQREPEIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSNKTAK*

ZV32_519
<SEQ ID 3205>
MEFFIILLAAVAVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVVSALDEAAGAWGVKVLRYEIKDLVPPQEILRAMQAQITAERE

KRARIAESEGRKIEQINLASGQREAEIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSSKTAK*

ZV96_519
<SEQ ID 3206>
MEFFIILLAAVAVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVVAALDEAAGAWGVKVLRYEIKDLVPPQEILRSMQAQITAERE

KRARIAESEGRKIEQINLASGQREAEIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSSKTAK*

FIG. 22 shows the results of aligning the sequences of each of these strains. Dark shading indicates regions of homology, and gray shading indicates the conservation of amino acids with similar characteristics. As is readily discernible, there is significant conservation among the various strains of ORF 225, further confirming its utility as an antigen for both vaccines and diagnostics.

Example 15

Table 6 lists several *Neisseria* strains which were used to assess the conservation of the sequence of ORF 919 among different strains.

TABLE 6

919 gene variability: List of used *Neisseria* strains

| Identification Strains number | Source/reference |
|---|---|
| Group B | |
| zm01 NG6/88 | R. Moxon/Seiler et al., 1996 |
| zm02 BZ198 | R. Moxon/Seiler et al., 1996 |
| zm03 NG3/88 | R. Moxon/Seiler et al., 1996 |
| zm04 297-0 | R. Moxon/Seiler et al., 1996 |
| zm05 1000 | R. Moxon/Seiler et al., 1996 |
| zm06 BZ147 | R. Moxon/Seiler et al., 1996 |
| zm07 BZ169 | R. Moxon/Seiler et al., 1996 |
| zm08n 528 | R. Moxon/Seiler et al., 1996 |
| zm09 NGP165 | R. Moxon/Seiler et al., 1996 |
| zm10 BZ133 | R. Moxon/Seiler et al., 1996 |
| zm11asbc NGE31 | R. Moxon/Seiler et al., 1996 |
| zm12 NGF26 | R. Moxon/Seiler et al., 1996 |
| zm13 NGE28 | R. Moxon/Seiler et al., 1996 |
| zm14 NGH38 | R. Moxon/Seiler et al., 1996 |
| zm15 SWZ107 | R. Moxon/Seiler et al., 1996 |
| zm16 NGH15 | R. Moxon/Seiler et al., 1996 |
| zm17 NGH36 | R. Moxon/Seiler et al., 1996 |
| zm18 BZ232 | R. Moxon/Seiler et al., 1996 |
| zm19 BZ83 | R. Moxon/Seiler et al., 1996 |
| zm20 44/76 | R. Moxon/Seiler et al., 1996 |
| zm21 MC58 | R. Moxon |
| zm96 2996 | Our collection |
| Group A | |
| zm22 205900 | R. Moxon |
| zm23asbc F6124 | R. Moxon |
| z2491 Z2491 | R. Moxon/Maiden et al., 1998 |

TABLE 6-continued 919 gene variability: List of used *Neisseria* strains

| Identification Strains number | Source/reference |
|---|---|
| Group C | |
| zm24 90/18311 | R. Moxon |
| zm25 93/4286 | R. Moxon |
| Others | |
| zm26 A22 (group W) | R. Moxon/Maiden et al., 1998 |
| zm27bc E26 (group X) | R. Moxon/Maiden et al., 1998 |
| zm28 860800 (group Y) | R. Moxon/Maiden et al., 1998 |
| zm29asbc E32 (group Z) | R. Moxon/Maiden et al., 1998 |
| zm31asbc *N. lactamica* | R. Moxon |
| Gonococcus | |
| zm32asbc Ng F62 | R. Moxon/Maiden et al., 1998 |
| zm33asbc Ng SN4 | R. Moxon |
| fa1090 FA1090 | R. Moxon |

References:
Seiler A. et al., Mol. Microbiol., 1996, 19(4): 841-856.
Maiden et al., Proc. Natl. Acad. Sci. USA, 1998, 95: 3140-3145.

The amino acid sequences for each listed strain are as follows:

```
FA1090
                                                 <SEQ ID 3207>
MKKHLLRSALYGIAAAILAACQSRSIQTFPQPDTSVINGPDRPAGIPDPAGTTVAGGGAV

YTVVPHLSMPHWAAQDFAKSLQSFRLGCANLKNRQGWQDVCAQAFQTPVHSFQAKRFFER

YFTPWQVAGNGSLAGTVTGYYEPVLKGDGRRTERARFPIYGIPDDFISVPLPAGLRGGKN

LVRIRQTGKNSGTIDNAGGTHTADLSRFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKAYMRQNPQRLAEVLGQNPSYIFFRELAGSGNEGPVGALGTPLMGEYAGA

IDRHYITLGAPLFVATAHPVTRKALNRLIMAQDTGSAIKGAVRVDYFWGYGDEAGELAGK

QKTTGYVWQLLPNGMKPEYRP*

Z2491
                                                 <SEQ ID 3208>
MKKYLFRAALCGIAAAILAACQSKSIQTFPQPDTSVINGPDRPVGIPDPAGTTVGGGGAV

YTVVPHLSLPHWAAQDFAKSLQSFRLGCANLKNRQGWQDVCAQAFQTPVHSVQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSQFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKAYMQQNPQRLAEVLGQNPSYIFFRELTGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM01
                                                 <SEQ ID 3209>
MKKYLFRAALYGIAAAILAACQSKSIQTFPQPDTSVINGPDRPVGIPDPAGTTVGGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSRFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKSYMRQNPQRLAEVLGQNPSYIFFRELAGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM02
                                                 <SEQ ID 3210>
MKKYLFRAALYGIAAAILAACQSKSIQTFPQPDTSVINGPDRPVGIPDPAGTTVGGGGAV

YTVVPHLSLPHWAAQDFAKSLQSFRLGCANLKNRQGWQDVCAQAFQTPVHSFQAKQFFER
```

-continued

YFTPWQVAGNGSLAGTVTGYYEPVLKGDDRRTAQARFPIYGIPDDFISVPLPAGLRSGKA

LVRIRQTGKNSGTIDNTGGTHTADLSRFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKSYMRQNPQRLAEVLGQNPSYIFFRELAGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM03
<SEQ ID 3211>
MKKYLFRAALYGIAAAILAACQSKSIQTFPQPDTSVINGPDRPVGIPDPAGTTVGGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSRFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKSYMRQNPQRLAEVLGQNPSYIFFRELAGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM04
<SEQ ID 3212>
MKKYLFRAALCGIAAAILAACQSKSIQTFPQPDTSVINGPDRPVGIPAPAGTTVAGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNAGGTHTADLSRFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKAYMQQNPQRLAEVLGQNPSYIFFRELTGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM05
<SEQ ID 3213>
MKKYLFRAALYGIAAAILAACQSKSIQTFPQPDTSVINGPDRPVGIPDPAGTTVGGGGAV

YTVVPHLSLPHWAAQDFAKSLQSFRLSCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSRFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKAYMRQNPQRLAEVLGQNPSYIFFRELAGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM06
<SEQ ID 3214>
MKKYLFRAALYGIAAAILAACQSKSIQTFPQPDTSVINGPDRPVGIPDPAGTTVGGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSRFPITARTTAIKGRFEGSRFLPYHTRNQINGGAL

DGKAPILGYAEDPVELFFMHIQGSGRLKTPSGKYIRIGYADKNEHPYVSIGKYMADKGYL

KLGQTSMQGIKSYMRQNPQRLAEVLGQNPSYIFFRELAGSSNDGPVGALGTPLMGEYAGA

```
VDRHYITLGAPLFVATAHPVTRKALNRLIMAQDTGSAIKGAVRVDYFWGYGDEAGELAGK

QKTTGYVWQLLPNGMKPEYRP*

ZM07
                                                     <SEQ ID 3215>
MKKYLFRAALYGIAAAILAACQSKSIQTFPQPDTSVINGPDRPVGIPDPAGTTVGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSRFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKSYMRQNPQRLAEVLGQNPSYIFFRELAGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM08N
                                                     <SEQ ID 3216>
MKKYLFRAALYGIAAAILAACQSKSIQTFPQPDTSVINGPDRPVGIPDPAGTTVGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSRFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKAYMRQNPQRLAEVLGQNPSYIFFRELAGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM09
                                                     <SEQ ID 3217>
MKKYLFRAALCGIAAAILAACQSKSIQTFPQPDTSVINGPDRPVGIPAPAGTTVAGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSQFPITARTTAIKGRFEGSRFLPYHTRNQINGGAL

DGKAPILGYAEDPVELFFMHIQGSGRLKTPSGKYIRIGYADKNEHPYVSIGKYMADKGYL

KLGQTSMQGIKSYMRQNPQRLAEVLGQNPSYIFFRELTGSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM10
                                                     <SEQ ID 3218>
MKKYLFRAALCGIAAAILAACQSKSIQTFPQPDTSVINGPDRPVGIPAPAGTTVAGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSQFPITARTTAIKGRFEGSRFLPYHTRNQINGGAL

DGKAPILGYAEDPVELFFMHIQGSGRLKTPSGKYIRIGYADKNEHPYVSIGKYMADKGYL

KLGQTSMQGIKSYMRQNPQRLAEVLGQNPSYIFFRELTGSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM11ASBC
                                                     <SEQ ID 3219>
MKKYLFRAALCGIAAAILAACQSKSIQTFPQPDTSVINGPDRPVGIPAPAGTTVGGGGAV

YTVVPHLSLPHWAAQDFAKSLQSFRLGCANLKNRQGWQDVCAQAFQTPVHSVQAKQFFER
```

```
YFTPWQVAGNGSLAGTVTGYYEPVLKGDDRRTAQARFPIYGIPDDFISVPLPAGLRSGKA

LVRIRQTGKNSGTIDNAGGTHTADLSRFPITARTTAIKGRFEGSRFLPYHTRNQINGGAL

DGKAPILGYAEDPVELFFMHIQGSGRLKTPSGKYIRIGYADKNEHPYVSIGKYMADKGYL

KLGQTSMQGIKSYMRQNPQRLAEVLGQNPSYIFFRELTGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM12                                                <SEQ ID 3220>
MKKYLFRAALYGIAAAILAACQSKSIQTFPQPDTSVINGPDRPVGIPDPAGTTVGGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSRFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKSYMRQNPQRLAEVLGQNPSYIFFRELAGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM13                                                <SEQ ID 3221>
MKKYLFRAALYGIAAAILAACQSKSIQTFPQPDTSVINGPDRPVGIPDPAGTTVGGGGAV

YTVVPHLSLPHWAEQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSRFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKAYMRQNPQRLAEVLGQNPSYIFFRELAGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM14                                                <SEQ ID 3222>
MKKYLFRAALCGIAAAILAACQSKSIQTFPQPDTSVINGPDRPVGIPAPAGTTVAGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNAGGTHTADLSRFPITARTTAIKGRFEGSRFLPYHTRNQINGGAL

DGKAPILGYAEDPVELFFMHIQGSGRLKTPSGKYIRIGYADKNEHPYVSIGKYMADKGYL

KLGQTSMQGIKSYMRQNPQRLAEVLGQNPSYIFFRELTGSRNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM15                                                <SEQ ID 3223>
MKKYLFRAALYGIAAAILAACQSKSIQTFPQPDTSVINGPDRPVGIPDLAGTTVGGGGAV

YTVVPHLSLPHWAAQDFAKSLQSFRLGCANLKNHQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSRFPITARTTAIKGRFEGSRFLPYHTRNQINGGAL

DGKAPILGYAEDPVELFFMHIQGSGRLKTPSGKYIRIGYADKNEHPYVSIGKYMADKGYL

KLGQTSMQGIKSYMRQNPQRLAEVLGQNPSYIFFRELTGSNDGPVGALGTPLMGEYAGA
```

-continued

VDRHYITLGAPLFVATAHPVTRKALNRLIMAQDTGSAIKGAVRVDYFWGYGDEAGELAGK

QKTTGYVWQLLPNGMKPEYRP*

ZM16

<SEQ ID 3224>

MKKYLFRAALCGIAAAILAACQSKSIQTFPQPDTSVINGPGRPVGIPDPAGTTVGGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSQFPITARTTAIKGRFEGSRFLPYHTRNQINGGAL

DGKAPILGYAEDPVELFFMHIQSGRLKTPSGKYIRIGYADKNEHPYVSIGKYMADKGYL

KLGQTSMQGIKSYMRQNPQRLAEVLGQNPSYIFFRELTGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM17

<SEQ ID 3225>

MKKYLFRAALYGIAAAILAACQSKSIQTFPQPDTSVINGPDRPVGIPDPAGTTVGGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSRFPITARTTAIKGRFEGSRFLPYHTRNQINGGAL

DGKAPILGYAEDPVELFFMHIQSGRLKTPSGKYIRIGYADKNEHPYVSIGKYMADKGYL

KLGQTSMQGIKSYMRQNPQRLAEVLGQNPSYIFFRELTGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM18

<SEQ ID 3226>

MKKYLFRAALYGIAAAILAACQSKSIQTFPQPDTSVINGPDRPVGIPDPAGTTVGGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSRFPITARTTAIKGRFEGSRFLPYHTRNQINGGAL

DGKAPILGYAEDPVELFFMHIQSGRLKTPSGKYIRIGYADKNEHPYVSIGRYMADKGYL

KLGQTSMQGIKSYMRQNPQRLAEVLGQNPSYIFFRELAGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM19

<SEQ ID 3227>

MKKYLFRAALYGIAAAILAACQSKSIQTFPQPDTSVINGPDRPVGIPDPAGTTVGGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSRFPITARTTAIKGRFEGSRFLPYHTRNQINGGAL

DGKAPILGYAEDPVELFFMHIQSGRLKTPSGKYIRIGYADKNEHPYVSIGRYMADKGYL

KLGQTSMQGIKSYMRQNPQRLAEVLGQNPSYIFFRELAGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM20

<SEQ ID 3228>

MKKYLFRAALYGIAAAILAACQSKSIQTFPQPDTSVINGPDRPVGIPDPAGTTVGGGGAV

YTVVPHLSLPHWAAQDFAKSLQSFRLGCANLKNRQGWQDVCAQAFQTPVHSFQAKQFFER

```
YFTPWQVAGNGSLAGTVTGYYEPVLKGDDRRTAQARFPIYGIPDDFISVPLPAGLRSGKA

LVRIRQTGKNSGTIDNTGGTHTADLSRFPITARTTAIKGRFEGSRFLPYHTRNQINGGAL

DGKAPILGYAEDPVELFFMHIQSGRLKTPSGKYIRIGYADKNEHPYVSIGRYMADKGYL

KLGQTSMQGIKSYMRQNPQRLAEVLGQNPSYIFFRELAGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*
```

ZM21                                                                <SEQ ID 3229>
```
MKKYLFRAALYGIAAAILAACQSKSIQTFPQPDTSVINGPDRPVGIPDPAGTTVGGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSRFPITARTTAIKGRFEGSRFLPYHTRNQINGGAL

DGKAPILGYAEDPVELFFMHIQSGRLKTPSGKYIRIGYADKNEHPYVSIGRYMADKGYL

KLGQTSMQGIKSYMRQNPQRLAEVLGQNPSYIFFRELAGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*
```

ZM22                                                                <SEQ ID 3230>
```
MKKYLFRAALCGIAAAILAACQSKSIQTFPQPDTSVINGPDRPVGIPDPAGTTVGGGGAV

YTVVPHLSLPHWAAQDFAKSLQSFRLGCANLKNRQGWQDVCAQAFQTPVHSVQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSQFPITARTTAIKGRFEGSRFLPYHTRNQINGGAL

DGKAPILGYAEDPVELFFMHIQSGRLKTPSGKYIRIGYADKNEHPYVSIGRYMADKGYL

KLGQTSMQGIKAYMQQNPQRLAEVLGQNPSYIFFRELTGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*
```

ZM23ASBC                                                            <SEQ ID 3231>
```
MKKYLFRAALYGIAAAILAACQSKSIQTFPQPDTSVINGPDRPVGIPDPAGTTVGGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNAGGTHTADLSRFPITARTTAIKGRFEGSRFLPYHTRNQINGGAL

DGKAPILGYAEDPVELFFMHIQSGRLKTPSGKYIRIGYADKNEHPYVSIGKYMADKGYL

KLGQTSMQGIKSYMRQNPQRLAEVLGQNPSYIFFRELAGSSNDGPVGALGTPLMGEYAGA

VDRHYITLGAPLFVATAHPVTSKALNRLIMAQDTGSAIKGAVRVDYFWGYGDEAGETAGK

MKEPGYVWQLLPNGMKPEYRP*
```

ZM24                                                                <SEQ ID 3232>
```
MKKYLFRAALCGIAAAILAACQSKSIQTFPQPDTSVINGPDRPVGIPAPAGTTVAGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSQFPITARTTAIKGRFEGSRFLPYHTRNQINGGAL

DGKAPILGYAEDPVELFFMHIQSGRLKTPSGKYIRIGYADKNEHPYVSIGKYMADKGYL

KLGQTSMQGIKSYMRQNPQRLAEVLGQNPSYIFFRELTGSNDGPVGALGTPLMGEYAGA
```

-continued

VDRHYITLGAPLFVATAHPVTRKALNRLIMAQDTGSAIKGAVRVDYFWGYGDEAGELAGK

QKTTGYVWQLLPNGMKPEYRP*

ZM25                                                        <SEQ ID 3233>
MKKYLFRAALCGIAAAILAACQSKSIQTFPQPDTSVINGPDRPVGIPAPAGTTVAGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSQFPITARTTAIKGRFEGSRFLPYHTRNQINGGAL

DGKAPILGYAEDPVELFFMHIQGSGRLKTPSGKYIRIGYADKNEHPYVSIGKYMADKGYL

KLGQTSMQGIKSYMRQNPQRLAEVLGQNPSYIFFRELTGSGNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM26                                                        <SEQ ID 3234>
MKKYLFRAALYGIAAAILAACQSKSIQTFPQPDTSVINGPDRPVGIPDPAGTTVGGGGAV

YTVVPHLSLPHWAAQDFAKSLQSFRLGCANLKNRQGWQDVCAQAFQTPVHSVQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSQFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKAYMQQNPQRLAEVLGQNPSYIFFRELTGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM27BC                                                      <SEQ ID 3235>
MKKYLFRAALYGISAAILAACQSKSIQTFPQPDTSVINGPDRPAGIPDPAGTTVAGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNAGGTHTADLSRFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKSYMRQNPQRLAEVLGQNPSYIFFRELTGSSNDGPVGALGTPLMGEYAGA

VDRHYITLGAPLFVATAHPVTRKALNRLIMAQDTGSAIKGAVRVDYFWGYGDEAGETAGK

MKEPGYVWQLLPNGMKPEYRP*

ZM28                                                        <SEQ ID 3236>
MKKYLFRAALCGIAAAILAACQSKSIQTFPQPDTSVINGPDRPVGIPDPAGTTVGGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSQFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKAYMRQNPQRLAEVLGQNPSYIFFRELAGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM29ASBC                                                    <SEQ ID 3237>
MKKYLFRAALCGIAAAILAACQSKSIQTFPQPDTSVINGPDRPVGIPDPAGTTVGGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSQFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKSYMRQNPQRLAEVLGQNPSYIFFRELTGSGNDGPVGALGTPLMGEYAGA

VDRHYITLGAPLFVATTHPITRKALNRLIMAQDTGSAIKGAVRVDYFWGYGDEAGELAGK

QKTTGYVWQLLPNGMKPEYRP*

ZM31ASBC <SEQ ID 3238>
MKKHLFRAALYGIAAAILAACQSKSIQTFPQPDTSIIKGPDRPAGIPDPAGTTVGGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNAGGTHTADLSRFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKAYMRQNPQRLAEVLGQNPSYVFFRELAGSGNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM32ASBC <SEQ ID 3239>
MKKHLLRSALYGIAAAILAACQSRSIQTFPQPDTSVINGPDRPAGIPDPAGTTVAGGGAV

YTVVPHLSMPHWAAQDFAKSLQSFRLGCANLKNRQGWQDVCAQAFQTPVHSFQAKRFFER

YFTPWQVAGNGSLAGTVTGYYEPVLKGDGRRTERARFPIYGIPDDFISVPLPAGLRGGKA

LVRIRQTGKNSGTIDNAGGTHTADLSRFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKAYMRQNPQRLAEVLGQNPSYIFFRELAGSGGDGPVGALGTPLMGGYAGA

IDRHYITLGAPLFVATAHPVTRKALNRLIMAQDTGSAIKGAVRVDYFWGYGDEAGELAGK

QKTTGYVWQLLPNGMKPEYRP*

ZM33ASBC <SEQ ID 3240>
MKKHLLRSALYGIAAAILAACQSRSIQTFPQPDTSVINGPDRPAGIPDPAGTTVAGGGAV

YTVVPHLSMPHWAAQDFAKSLQSFRLGCANLKNRQGWQDVCAQAFQTPIHSFQAKRFFER

YFTPWQVAGNGSLAGTVTGYYEPVLKGDGRRTERARFPIYGIPDDFISVPLPAGLRGGKN

LVRIRQTGKNSGTIDNAGGTHTADLSRFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKSYMRQNPHKLAEVLGQNPSYIFFRELAGSGNEGPVGALGTPLMGEYAGA

IDRHYITLGAPLFVATAHPVTRKALNRLIMAQDTGSAIKGAVRVDYFWGYGDEAGELAGK

QKTTGYVWQLLPNGMKPEYRP*

ZM96 <SEQ ID 3241>
MKKYLFRAALYGIAAAILAACQSKSIQTFPQPDTSVINGPDRPVGIPDPAGTTVGGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSRFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKAYMRQNPQRLAEVLGQNPSYIFFRELAGSSNDGPVGALGTPLMGEYAGA

-continued
VDRHYITLGAPLFVATAHPVTRKALNRLIMAQDTGSAIKGAVRVDYFWGYGDEAGELAGK

QKTTGYVWQLLPNGMKPEYRP*

FIG. 23 shows the results of aligning the sequences of each of these strains. Dark shading indicates regions of homology, and gray shading indicates the conservation of amino acids with similar characteristics. As is readily discernible, there is significant conservation among the various strains of ORF 225, further confirming its utility as an antigen for both vaccines and diagnostics.

Example 16

Using the above-described procedures, the following oligonucleotide primers were employed in the polymerase chain reaction (PCR) assay in order to clone the ORFs as indicated:

TABLE 7

Oligonucleotides used for PCR to amplify complete or partial ORFs

| ORF | primer | Sequence | Restriction sites |
|---|---|---|---|
| 001 | Forward | CGCGGATCCCATATG-TGGATGGTGCTGGTCAT | BamHI-NdeI |
|  | Reverse | CCCGCTCGAG-TGCCGTCTTGTCCCAC | XhoI |
| 003 | Forward | CGCGGATCCCATATG-GTCGTATTCGTGGC | BamHI-NdeI |
|  | Reverse | CCCGCTCGAG-AAAATCATGAACACGCGC | XhoI |
| 005 | Forward | CGCGGATCCCATATG-GACAATATTGACATGT | BamHI-NdeI |
|  | Reverse | CCCGCTCGAG-CATCACATCCGCCCG | XhoI |
| 006 | Forward | CGCGGATCCCATATG-CTGCTGGTGCTGG | BamHI-NdeI |
|  | Reverse | CCCGCTCGAG-AGTTCCGGCTTTGATGT | XhoI |
| 007 | Forward | CGCGGATCCCATATG-GCCGACAACAGCATCAT | BamHI-NdeI |
|  | Reverse | CCCGCTCGAG-AAGGCGTTCATGATATAAG | XhoI |
| 008 | Forward | CGCGGATCCCATATG-AACAACAGACATTTTG | BamHI-NdeI |
|  | Reverse | CCCGCTCGAG-CCTGTCCGGTAAAAGAC | XhoI |
| 009 | Forward | CGCGGATCCCATATG-CCCCGCGCTGCT | BamHI-NdeI |
|  | Reverse | CCCGCTCGAG-TGGCTTTTGCCACGTTTT | XhoI |
| 011 | Forward | CGCGGATCCCATATG-AAGACACACCGCAAG | BamHI-NdeI |
|  | Reverse | CCCGCTCGAG-GGCGGTCAGTACGGT | XhoI |
| 012 | Forward | CGCGGATCCCATATG-CTCGCCCGTTGCC | BamHI-NdeI |
|  | Reverse | CCCGCTCGAG-AGCGGGGAAGAGGCAC | XhoI |
| 013 | Forward | CGCGGATCCCATATG-CCTTTGACCATGCT | BamHI-NdeI |
|  | Reverse | CCCGCTCGAG-CTGATTCGGCAAAAAATCT | XhoI |
| 018 | Forward | CGCGGATCCCATATG-CAGCAGAGGCAGTT | BamHI-NdeI |
|  | Reverse | CCCGCTCGAG-GACGAGGCGAACGCC | XhoI |
| 019 | Forward | AAAGAATTC-CTGCCAGCCGGCAAGACCCCGGC | Eco RI |
|  | Reverse | AAACTGCAG-TCAGCGGGCGGGACAATGCCCAT | Pst I |

TABLE 7-continued

Oligonucleotides used for PCR to amplify complete or partial ORFs

| ORF | primer | Sequence | Restriction sites |
|---|---|---|---|
| 023 | Forward | AAAGAATTC-AAAGAATATTCGGCATGGCAGGC | Eco RI |
|  | Reverse | AAACTGCAG-TTACCCCCAAATCACTTTAACTGA | Pst I |
| 025 | Forward | AAAGAATTC-TGCGCCACCCAACAGCCTGCTCC | Eco RI |
|  | Reverse | AAACTGCAG-TCAGAACGCGATATAGCTGTTCGG | Pst I |
| 031 | Forward | CGCGGATCCCATATG-GTCTCCCTTCGCTT | BamHI-NdeI |
|  | Reverse | CCCGCTCGAG-ATGTAAGACGGGGACAAC | XhoI |
| 032 | Forward | CGCGGATCCCATATG-CGGCGAAACGTGC | BamHI-NdeI |
|  | Reverse | CCCGCTCGAG-CTGGTTTTTGATATTTGTG | XhoI |
| 033 | Forward | CGCGGATCCCATATG-GCGGCGGCAGACA | BamHI-NdeI |
|  | Reverse | CCCGCTCGAG-ATTTGCCGCATCCCGAT | XhoI |
| 034 | Forward | CGCGGATCCCATATG-GCCGAAAACAGCTACGG | BamHI-NdeI |
|  | Reverse | CCCGCTCGAG-TTTGACGATTTGGTTCAATT | XhoI |
| 036 | Forward | CGCGGATCCCATATG-CTGAAGCCGTGCG | BamHI-NdeI |
|  | Reverse | CCCGCTCGAG-CCGGACTGCGTATCGG | XhoI |
| 038 | Forward | CGCGGATCCCATATG-ACCGATTTCCGCCA | BamHI-NdeI |
|  | Reverse | CCCGCTCGAG-TTCTACGCCGTACTGCC | XhoI |
| 039 | Forward | CGCGGATCCCATATG-CCGTCCGAACCGC | BamHI-NdeI |
|  | Reverse | CCCGCTCGAG-TAGGATGACGAGGTAGG | XhoI |
| 041 | Forward | CGCGGATCCCATATG-TTCGTGCGCGAACCGC | BamHI-NdeI |
|  | Reverse | CCCGCTCGAG-GCCCAAAAACTCTTTCAAA | XhoI |
| 042 | Forward | CGCGGATCCCATATG-ACGATGATTTGCTTGC | BamHI-NdeI |
|  | Reverse | CCCGCTCGAG-TTTGCAGCCTGCATTTGAC | XhoI |
| 043 | Forward | AAAAAAGGTACC-ATGGTTGTTTCAAATCAAATATC | Kpn I |
|  | Reverse | AAACTGCAG-TTATTGCGCTTCACCTTCCGCCGC | Pst I |
| 043a | Forward | AAAAAAGGTACC-GCAAAAGTGCATGGCGGCTTGGACGGTGC | Kpn I |
|  | Reverse | AAAAAACTGCAG-TTAATCCTGCAACACGAATTCGCCCGTCCG | Pst I |
| 044 | Forward | CGCGGATCCCATATG-CCGTCCGACTAGAG | BamHI-NdeI |
|  | Reverse | CCCGCTCGAG-ATGCGCTACGGTAGCCA | XhoI |
| 046 | Forward | AAAGAATTC-ATGTCGGCAATGCTCCCGACAAG | Eco RI |
|  | Reverse | AAACTGCAG-TCACTCGGCGACCCACACCGTGAA | Pst I |
| 047 | Forward | CGCGGATCCCATATG-GTCATCATACAGGCG | BamHI-NdeI |
|  | Reverse | CCCGCTCGAG-TCCGAAAAAGCCCATTTTG | XhoI |

TABLE 7-continued

Oligonucleotides used for PCR to amplify complete or partial ORFs

| ORF | primer | Sequence | Restriction sites |
|---|---|---|---|
| 048 | Forward | AAAGAATTC-ATGCTCAACAAAGGCGAAGAATTGCC | Eco RI |
|  | Reverse | AAACTGCAG-TCAAGATTCGACGGGATGATGCC | Pst I |
| 049 | Forward | AAAGAATTC-ATGCGGGCGCAGGCGTTTGATCAGCC | Eco RI |
|  | Reverse | AAACTGCAG-AAGGCGTATCTGAAAAAATGGCAG | Pst I |
| 050 | Forward | CGCGGATCCCATATG-GGCGCGGGCTGG | BamHI-NdeI |
|  | Reverse | CCCGCTCGAG-AATCGGGCCATCTTCGA | XhoI |
| 052 | Forward | AAAAAGAATTC-ATGGCTTTGGTGGCGGAGGAAAC | Eco RI |
|  | Reverse | AAAAAGTCGAC-TCAGGCGGCGTTTTTCACCTTCCT | Sal I |
| 052a | Forward | AAAAAGAATTC-GTGGCGGAGGAAACGGAAATATCCGC | Eco RI |
|  | Reverse | AAAAAACTGCAG-TTAGCTGTTTTTGGAAACGCCGTCCAACCC | Pst I |
| 073 | Forward | CGCGGATCCCATATG-TGTATGCCATATAAGAT | BamHI-NdeI |
|  | Reverse | CCCGCTCGAG-CACCGGATTGTCCGAC | XhoI |
| 075 | Forward | CGCGGATCCCATATG-CCGTCTTACTTCATC | BamHI-NdeI |
|  | Reverse | CCCGCTCGAG-ATCACCAATGCCGATTATTT | XhoI |
| 077a | Forward | AAAAAGAATTC-GGCGGCATTTTCATCGACACCTTCCT | Eco RI |
|  | Reverse | AAAAAACTGCAG-TCAGACGAACATCTGCACAAACGCAAT | Pst I |
| 080 | Forward | AAAGAATTC-GCGTCCGGGCTGGTTTGGTTTTACAATTC | Eco RI |
|  | Reverse | AAACTGCAG-CTATTCTTCGGATTCTTTTTCGGG | Pst I |
| 081 | Forward | AAAGAATTC-ATGAAACCACTGGACCTAAATTTCATCTG | Eco RI |
|  | Reverse | AAACTGCAG-TCACTTATCCTCCAATGCCTC | Pst I |
| 082 | Forward | AAAGAATTC-ATGTGGTTGTTGAAGTTGCCTGC | Eco RI |
|  | Reverse | AAACTGCAG-TTACGCGGATTCGGCAGTTGG | Pst I |
| 084 | Forward | AAAGAATTC-TATCACCCAGAATATGAATACGGCTACCG | Eco RI |
|  | Reverse | AAACTGCAG-TTATACTTGGGCGCAACATGA | Pst I |
| 085 | Forward | CGCGGATCCCATATG-GGTAAAGGGCAGGACT | BamHI-NdeI |
|  | Reverse | CCCGCTCGAG-CAAAGCCTTAAACGCTTCG | XhoI |
| 086 | Forward | AAAAAGGTACC-TATTTGGCATCAAAAGAAGGCGG | Kpn I |
|  | Reverse | AAACTGCAG-TTACTCCACCCGATAACCGCG | Pst I |
| 087 | Forward | AAAGAATTC-ATGGGCGGTAAAACCTTTATGC | Eco RI |
|  | Reverse | AAACTGCAG-TTACGCCGCACACGCAATCGC | Pst I |
| 087a | Forward | AAAAAGAATTC-AAGCTATTAGGCGTGCCGATTGTGATTCA | Eco RI |
|  | Reverse | AAAAAACTGCAG-TTACGCCTGCAAGATGCCCAGCTTGCC | Pst I |
| 088 | Forward | AAAAAGAATTC-ATGTTTTATGGCTCGCACATTTCAG | Eco RI |
|  | Reverse | AAAAAACTGCAG-TCAGCGGATTTTGAGGGTACTCAAACC | Pst I |

TABLE 7-continued

Oligonucleotides used for PCR to amplify complete or partial ORFs

| ORF | primer | Sequence | Restriction sites |
|---|---|---|---|
| 089 | Forward | CGCGGATCCCATATG-CCGCCCAAAATCAC | BamHI-NdeI |
|  | Reverse | CCCGCTCGAG-TGCGCATACCAAAGCCA | XhoI |
| 090 | Forward | CGCGGATCCCATATG-CGCATAGTCGAGCA | BamHI-NdeI |
|  | Reverse | CCCGCTCGAG-AGCAAAACGGCGGTACG | XhoI |
| 091 | Forward | AAAGAATTC-ATGGAAATACCCGTACCGCCGAGTCC | Eco RI |
|  | Reverse | AAACTGCAG-TCAGCGCAGGGGGTAGCCCAAGCC | Pst I |
| 092 | Forward | AAAGAATTC-ATGTTTTTTATTTCAATCCG | Eco RI |
|  | Reverse | AAACTGCAG-TCAAATCTGTTTCGACAATGC | Pst I |
| 093 | Forward | AAAGAATTC-ATGCAGAATTTTGGCAAAGTGGC | Eco RI |
|  | Reverse | AAACTGCAG-CTATGGCTCGTCATACCGGGC | Pst I |
| 094 | Forward | AAAGAATTC-ATGCCGTCACGGAAGCGCATCAACTC | Eco RI |
|  | Reverse | AAACTGCAG-TTATCCCGGCCATACCGCCGAACA | Pst I |
| 095 | Forward | AAAGAATTC-ATGTCCTTTCATTTGAACATGGACGG | Eco RI |
|  | Reverse | AAACTGCAG-TCAACGCCGCAGGCACTAACGCCC | Pst I |
| 096 | Forward | AAAGAATTC-ATGGCTCGTCATACCGGGCAGGG | Eco RI |
|  | Reverse | AAACTGCAG-TCAAAGGAAAAGGCCGTCTGAAAAGCG | Pst I |
| 097 | Forward | AAAGAATTC-ATGGACACTTCAAAACAAACACTGTTG | Eco RI |
|  | Reverse | AAACTGCAG-TCAGCCCAAATACCAGAATTTCAG | Pst I |
| 098 | Forward | AAAGAATTC-GATGAACGCAGCCCAGCATGGATACG | Eco RI |
|  | Reverse | AAACTGCAG-TTACGACATTCTGATTTGGCA | Pst I |
| 102 | Forward | AAAAAGAATTC-GGCCTGATGATTTTGGAAGTCAACAC | Eco RI |
|  | Reverse | AAAAAACTGCAG-TTATCCTTTAAATACGGGGACGAGTTC | Pst I |
| 105 | Forward | CGCGGATCCCATATG-TCCGCAAACGAATACG | BamHI-NdeI |
|  | Reverse | CCCGCTCGAG-GTGTTCTGCCAGTTTCAG | XhoI |
| 107 | Forward | AAAAAAGAATTC-CTGATGATTTTGGAAGTCAACACCCATTATCC | Eco RI |
|  | Reverse | AAAAAACTGCAG-TTATCCTTTAAATACGGGGACGAGTTC | Pst I |
| 107b | Forward | AAAAAAGAATTC-GATACCCAAGCCCCCGCCGGCACAAACTACTG | Eco RI |
|  | Reverse | AAAAAACTGCAG-TTACGCGTCGCCTTTAAAGTATTTGAGCAGGCTGGAGAC | Pst I |
| 108 | Forward | AAAGAATTC-ATGTTGCCGGGCTTCAACCG | Eco RI |
|  | Reverse | AAACTGCAG-TTAGCGGTACAGGTGTTTGAAGCA | Pst I |
| 108a | Forward | AAAAAGAATTC-GGTAACACATTCGGCAGCTTAGACGGTGG | Eco RI |
|  | Reverse | AAACTGCAG-TTAGCGGTACAGGTGTTTGAAGCA | Pst I |
| 109 | Forward | AAAGAATTC-ATGTATTATCGCCGGGTTATGGG | Eco RI |
|  | Reverse | AAACTGCAG-CTAGCCCAAAGATTTGAAGTGTTC | Pst I |

TABLE 7-continued

Oligonucleotides used for PCR to amplify complete or partial ORFs

| ORF | primer | Sequence | Restriction sites |
|---|---|---|---|
| 111 | Forward | CGCGGATCCCATATG-TGTTCGGAACAAACCGC | BamHI-NdeI |
|  | Reverse | CCCGCTCGAG-GCGGAGCAGTTTTTCAAA | XhoI |
| 114 | Forward | CGCGGATCCCATATG-GCTTCCATCACTTCGC | BamHI-NdeI |
|  | Reverse | CCCGCTCGAG-CATCCGCGAAATCGTC | XhoI |
| 117 | Forward | AAAAAAGGTACC-ATGGTCGAAGAACTGGAACTGCTG | Kpn I |
|  | Reverse | AAACTGCAG-TTAAAGCCGGGTAACGCTCAATAC | Pst I |
| 118 | Forward | AAAGTCGACATGTGTGAGTTCAAGGATATTATAAG | Sal I |
|  | Reverse | AAAGCATGC-CTATTTTTGTTGTAATAATCAAATC | Sph I |
| 121 | Forward | CGCGGATCCCATATG-GAAACACAGCTTTACAT | BamHI-NdeI |
|  | Reverse | CCCGCTCGAG-ATAATAATATCCCGCGCCC | XhoI |
| 122 | Forward | CGCGGATCCCATATG-GTCATGATTAAAATCCGCA | BamHI-NdeI |
|  | Reverse | CCCGCTCGAG-AATCTTGGTAGATTGGATTT | XhoI |
| 125 | Forward | AAAGAATTC-ATGTCGGGCAATGCCTCCTCTCC | Eco RI |
|  | Reverse | AAACTGCAG-TCACGCCGTTTCAAGACG | Pst I |
| 125a | Forward | AAAAAAGAATTC-ACGGCAGGCAGCACCGCCGCACAGGTTTC | Eco RI |
|  | Reverse | AAAAAACTGCAG-TTATTTTGCCACGTCGGTTTCTCCGGTGAACAACGC | Pst I |
| 126 | Forward | CGCGGATCCCATATG-CCGTCTGAAACCC | BamHI-NdeI |
|  | Reverse | CCCGCTCGAG-ATATTCCGCCGAATGCC | XhoI |
| 127 | Forward | AAAGAATTC-ATGGAAATATGGAATATGTTGGACACTTG | Eco RI |
|  | Reverse | AAACTGCAG-TTAAAGTGTTTCGGAGCCGGC | Pst I |
| 127a | Forward | AAAAAAGAATTC-AAGGAACTGATTATGTGTCTGTCGGG | Eco RI |
|  | Reverse | AAACTGCAG-TTAAAGTGTTTCGGAGCCGGC | Pst I |
| 128 | Forward | CGCGGATCCCATATG-ACTGACAACGCACT | BamHI-NdeI |
|  | Reverse | CCCGCTCGAG-GACCGCGTTGTCGAAA | XhoI |
| 130 | Forward | CGCGGATCCCATATG-AAACAACTCCGCGA | BamHI-NdeI |
|  | Reverse | CCCGCTCGAG-GAATTTTGCACCGGATTG | XhoI |
| 132 | Forward | AAAGAATTC-ATGGAACCCTTCAAAACCTTAATTTG | Eco RI |
|  | Reverse | AAAAACTGCAG-TCACCATGTCGGCATTTGAAAAAC | Pst I |
| 134 | Forward | CGCGGATCCCATATG-TCCCAAGAAATCCTC | BamHI-NdeI |
|  | Reverse | CCCGCTCGAG-CAGTTTGACCGAATGTTC | XhoI |
| 135 | Forward | CGCGGATCCCATATG-AAATACAAAAGAATCGTATT | BamHI-NdeI |
|  | Reverse | CCCGCTCGAG-AAATTCGGTCAGAAGCAGG | XhoI |

TABLE 7-continued

Oligonucleotides used for PCR to amplify complete or partial ORFs

| ORF | primer | Sequence | Restriction sites |
|---|---|---|---|
| 137 | Forward | AAAAAAGGTACC-ATGATTACCCATCCCCAATTCGATCC | Kpn I |
| | Reverse | AAAAAACTGCAG-TCAGTGCTGTTTTTTCATGCCGAA | Pst I |
| 137a | Forward | AAAAAAGAATTC-GGCCGCAAACACGGCATCGGCTTCCT | Eco RI |
| | Reverse | AAAAAACTGCAG-TTAAGCGGGATGACGCGGCAGCATACC | Pst I |
| 138 | Forward | AAAAAAGAATTC-AACTCAGGCGAAGGAGTGCTTGTGGC | Eco RI |
| | Reverse | AAAAAATCTAGA-TCAGTTTAGGGATAGCAGGCGTAC | Xba I |
| 141 | Forward | AAAGAATTC-ATGAGCTTCAAAACCGATGCCGAAATCGC | Eco RI |
| | Reverse | AAACTGCAG-TCAGAACAAGCCGTGAATCACGCC | Pst I |
| 142 | Forward | CGCGGATCCCATATG-CGTGCCGATTTCATG | BamHI-NdeI |
| | Reverse | CCCGCTCGAG-AAACTGCTGCACATGGG | XhoI |
| 143 | Forward | AAAAAAGAATTC-ATGCTCAGTTTCGGCTTTCTCGGCGTTCAGAC | Eco RI |
| | Reverse | AAAAAACTGCAG-TCAAACCCCGCCGTGTGTTTCTTTAAT | Pst I |
| 144 | Forward | AAAAAAGAATTC-GGTCTGATCGACGGGCGTGCCGTAAC | Eco RI |
| | Reverse | AAAAAATCTAGA-TCGGCATCGGCCGGCATATGTCCG | Xba I |
| 146 | Forward | AAAAAAGAATTC-CGCCAAGTCGTCATTGACCACGACAAAGTC | Eco RI |
| | Reverse | AAAAAACTGCAG-TTAGGCATCGGCAAATAGGAAACTGGG | Pst I |
| 147 | Forward | AAAAAAGAATTC-ACTGAGCAATCGGTGGATTTGGAAAC | Eco RI |
| | Reverse | AAAAAATCTAGA-TTAGGTAAAGCTGCGGCCCATTTGCGG | Xba I |
| 148 | Forward | AAAAAAGAATTC-ATGGCGTTAAAAACATCAAACTTGGAACACGC | Eco RI |
| | Reverse | AAAAAATCTAGA-TCAGCCCTTCATACAGCCTTCGTTTTG | Xba I |
| 149 | Forward | CGCGGATCCCATATG-CTGCTTGACAACAAAGT | BamHI-NdeI |
| | Reverse | CCCGCTCGAG-AAACTTCACGTTCACGCC | XhoI |
| 150 | Forward | CGCGGATCCCATATG-CAGAACACAAATCCG | BamHI-NdeI |
| | Reverse | CCCGCTCGAG-ATAAACATCACGCTGATAGC | XhoI |
| 151 | Forward | AAAAAAGAATTC-ATGAAACAAATCCGCAACATCGCCATCATCGC | Eco RI |
| | Reverse | AAAAAACTGCAG-TCAATCCAGCTTTTTAAAGTGGCGGCG | Pst I |
| 152 | Forward | AAAAAAGAATTC-ATGAAAAACAAAACCAAAGTCTGGGACCTCCC | Eco RI |
| | Reverse | AAAAAACTGCAG-TCAGGACAGGAGCAGGATGGCGGC | Pst I |
| 153 | Forward | AAAAAAGAATTC-ATGGCGTTTGCTTACGGTATGAC | Eco RI |
| | Reverse | AAAAAACTGCAG-TCAGTCATGTTTTTCCGTTTCATT | Pst I |
| 153a | Forward | AAAAAAGAATTC-CGGACTTCGGTATCGGTTCCCCAGCATTG | Eco RI |
| | Reverse | AAAAAACTGCAG-TTACGCCGACGAAATACTCAGACTTTTCGG | Pst I |

TABLE 7-continued

Oligonucleotides used for PCR to amplify complete or partial ORFs

| ORF | primer | Sequence | Restriction sites |
|---|---|---|---|
| 154 | Forward | CGCGGATCCCATATG-ACTGACAACAGCCC | BamHI-NdeI |
|  | Reverse | CCCGCTCGAG-TCGGCTTCCTTTCGGG | XhoI |
| 155 | Forward | AAAAAAGAATTC-ATGAAAATCGGTATCCCACGCGAGTC | Eco RI |
|  | Reverse | AAAAAACTGCAG-TTACCCTTTCTTAAACATATTCAGCAT | Pst I |
| 156 | Forward | AAAAAAGAATTC-GCACAGCAAAACGGTTTTGAAGC | Eco RI |
|  | Reverse | AAAAAACTGCAG-TCAAGCAGCCGCGACAAACAGCCC | Pst I |
| 157 | Forward | CGCGGATCCCATATG-AGGAACGAGGAAAAAC | BamHI-NdeI |
|  | Reverse | CCCGCTCGAG-AAAACACAATATCCCCGC | XhoI |
| 158 | Forward | AAAAAAGAATTC-GCGGAGCAGTTGGCGATGGCAAATTCTGC | Eco RI |
|  | Reverse | AAAAAATCTAGA-TTATCCACAGAGATTGTTTCCCAGTTC | Xba I |
| 160 | Forward | CGCGGATCCCATATG-GACATTCTGGACAAAC | BamHI-NdeI |
|  | Reverse | CCCGCTCGAG-TTTTTGCCCGCCTTCTTT | XhoI |
| 163 | Forward | AAAAAAGGTACC-ACCGTGCCGGATCAGGTGCAGATGTG | Kpn I |
|  | Reverse | AAAAAATCTAGA-TTACTCTGCCAATTCCACCTGCTCGTG | Xba I |
| 163a | Forward | AAAAAAGAATTC-CGGCTGGTGCAGATAATGAGCCAGAC | Eco RI |
|  | Reverse | AAAAAATCTAGA-TTACTCTGCCAATTCCACCTGCTCGTG | Xba I |
| 164 | Forward | CGCGGATCCCATATG-AACCGGACTTATGCC | BamHI-NdeI |
|  | Reverse | CCCGCTCGAG-TTTGTTTCCGTCAAACTGC | XhoI |
| 165 | Forward | CGCGGATCCGCTAGC-GCTGAAGCGACAGACG | BamHI-NheI |
|  | Reverse | CCCGCTCGAG-AATATCCAATACTTTCGCG | XhoI |
| 206 | Forward | CGCGGATCCCATATG-AAACACCGCCAACCGA | BamHI-NdeI |
|  | Reverse | CCCGCTCGAG-TTCTGTAAAAAAGTATGTGC | XhoI |
| 209 | Forward | CGCGGATCCCATATG-CTGCGGCATTTAGGA | BamHI-NdeI |
|  | Reverse | CCCGCTCGAG-TACCCCTGAAGGCAAC | XhoI |
| 211 | Forward | AAAAAAGAATTC-ATGTTGCGGGTTGCTGCTGC | Eco RI |
|  | Reverse | AAAAAACTGCAG-CTATCCTGCGGATTGGCATTGAAA | Pst I |
| 212 | Forward | CGCGGATCCCATATG-GACAATCTCGTATGG | BamHI-NdeI |
|  | Reverse | CCCGCTCGAG-AGGGGTTAGATCCTTCC | XhoI |
| 215 | Forward | CGCGGATCCCATATG-GCATGGTTGGGTCGT | BamHI-NdeI |
|  | Reverse | CCCGCTCGAG-CATATCTTTTGTATCATAAATC | XhoI |
| 216 | Forward | CGCGGATCCCATATG-GCAATGGCAGAAAACG | BamHI-NdeI |
|  | Reverse | CCCGCTCGAG-TACAATCCGTGCCGCC | XhoI |

TABLE 7-continued

Oligonucleotides used for PCR to amplify complete or partial ORFs

| ORF | primer | Sequence | Restriction sites |
|---|---|---|---|
| 217 | Forward | CGCGGATCCCATATG-GCGGATGACGGTGTG | BamHI-NdeI |
|  | Reverse | CCCGCTCGAG-ACCCCGAATATCGAATCC | XhoI |
| 218 | Forward | CGCGGATCCCATATG-GTCGCGGTCGATC | BamHI-NdeI |
|  | Reverse | CCCGCTCGAG-TAACTCATAGAATCCTGC | XhoI |
| 219 | Forward | CGCGGATCCGCTAGC-ACGGCAAGGTTAAG | BamHI-NheI |
|  | Reverse | CCCGCTCGAG-TTTAAACCATCTCCTCAAAAC | XhoI |
| 223 | Forward | CGCGGATCCCATATG-GAATTCAGGCACCAAGTA | BamHI-NdeI |
|  | Reverse | CCCGCTCGAG-GGCTTCCCGCGTGTC | XhoI |
| 225 | Forward | CGCGGATCCCATATG-GACGAGTTGACCAACC | BamHI-NdeI |
|  | Reverse | CCCGCTCGAG-GTTCAGAAAGCGGGAC | XhoI |
| 226 | Forward | AAAGAATTC-CTTGCGATTATCGTGCGCACGCG | Eco RI |
|  | Reverse | AAACTGCAG-TCAAAATCCCAAAACGGGGAT | Pst I |
| 228 | Forward | CGCGGATCCCATATG-TCGCAAGAAGCCAAACAG | BamHI-NdeI |
|  | Reverse | CCCGCTCGAG-TTTGGCGGCATCTTTCAT | XhoI |
| 229 | Forward | CGCGGATCCCATATG-CAAGAGGTTTTGCCC | BamHI-NdeI |
|  | Reverse | CCCGCTCGAG-ACACAATATAGCGGATGAAC | XhoI |
| 230 | Forward | CGCGGATCCCATATG-CATCCGGGTGCCGAC | BamHI-NdeI |
|  | Reverse | CCCGCTCGAG-AAGTTTGGCGGCTTCGG | XhoI |
| 232 | Forward | AAAAAGAATTC-ATGTACGCTAAAAAGGCGGTTTGGG | Eco RI |
|  | Reverse | AAAAACTGCAG-TCAAGGTTTTTTCCTGATTGCCGCCGC | Pst I |
| 232a | Forward | AAAAAGAATTC-GCCAAGGCTGCCGATACACAAATTGA | Eco RI |
|  | Reverse | AAAAACTGCAG-TTAAACATTGTCGTTGCCGCCCAGATG | Pst I |
| 233 | Forward | CGCGGATCCCATATG-GCGGACAAACCCAAG | BamHI-NdeI |
|  | Reverse | CCCGCTCGAG-GACGGCATTGAGCAG | XhoI |
| 234 | Forward | CGCGGATCCCATATG-GCCGTTTCACTGACCG | BamHI-NdeI |
|  | Reverse | GCCCAAGCTT-ACGGTTGGATTGCCATG | Hind III |
| 235 | Forward | CGCGGATCCCATATG-GCCTGCCAAGTTCAAA | BamHI-NdeI |
|  | Reverse | CCCGCTCGAG-TTTGGGCTGCTCTTC | XhoI |
| 236 | Forward | CGCGGATCCCATATG-GCGCGTTTCGCCTT | BamHI-NdeI |
|  | Reverse | CCCGCTCGAG-ATGGGTCGCGCGCCGT | XhoI |

TABLE 7-continued

Oligonucleotides used for PCR to amplify complete or partial ORFs

| ORF | primer | Sequence | Restriction sites |
|---|---|---|---|
| 238 | Forward | CGCGGATCCGCTAGC-AACGGTTTGGATGCCCG | BamHI-NheI |
|  | Reverse | CCCGCTCGAG-TTTGTCTAAGTTCCTGATATG | XhoI |
| 239 | Forward | CCGGAATTCTACATATG-CTCCACCATAAAGGTATTG | EcoRI-NdeI |
|  | Reverse | CCCGCTCGAG-TGGTGAAGAGCGGTTTAG | XhoI |
| 240 | Forward | CGCGGATCCCATATG-GACGTTGGACGATTTC | BamHI-NdeI |
|  | Reverse | CCCGCTCGAG-AAACGCCATTACCCGATG | XhoI |
| 241 | Forward | CCGGAATTCTACATATG-CCAACACGTCCAACT | EcoRI-NdeI |
|  | Reverse | CCCGCTCGAG-GAATGCGCCTGTAATTAATC | XhoI |
| 242 | Forward | CGCGGATCCCATATG-ATCGGCAAACTTGTTG | BamHI-NdeI |
|  | Reverse | GCCCAAGCTT-ACCGATACGGTCGCAG | HindIII |
| 243 | Forward | CGCGGATCCCATATG-ACGATTTTTCGATGCTGC | BamHI-NdeI |
|  | Reverse | CCCGCTCGAG-CGACTTGGTTACCGCG | XhoI |
| 244 | Forward | CGCGGATCCCATATG-CCGTCTGAAGCCC | BamHI-NdeI |
|  | Reverse | CCCGCTCGAG-TTTTTTCGGTAGGGGATTT | XhoI |
| 246 | Forward | CGCGGATCCCATATG-GACATCGGCAGTGC | BamHI-NdeI |
|  | Reverse | CCCGCTCGAG-CCCGCGCTGCTGGAG | XhoI |
| 247 | Forward | CGCGGATCCCATATG-GTCGGATCGAGTTAC | BamHI-NdeI |
|  | Reverse | CCCGCTCGAG-AAGTGTTCTGTTTGCGCA | XhoI |
| 248 | Forward | CGCGGATCCCATATG-CGCAAACAGAACACT | BamHI-NdeI |
|  | Reverse | CCCGCTCGAG-CTCATCATTATTGCTAACA | XhoI |
| 249 | Forward | CGCGGATCCCATATG-AAGAATAATGATTGCTTC | BamHI-NdeI |
|  | Reverse | CCCGCTCGAG-TTCCCGACCTCCGAC | XhoI |
| 251 | Forward | CGCGGATCCCATATG-CGTGCTGCGGTAGT | BamHI-NdeI |
|  | Reverse | CCCGCTCGAG-TACGAAAGCCGGTCGTG | XhoI |
| 253 | Forward | AAAAAAGAATTC-ATGATTGACAGGAACCGTATGCTGCG | Eco RI |
|  | Reverse | AAAAAACTGCAG-TTATTGGTCTTTCAAACGCCCTTCCTG | Pst I |
| 253a | Forward | AAAAAAGAATTC-AAAATCCTTTTGAAAACAAGCGAAAACGG | Eco RI |
|  | Reverse | AAAAAACTGCAG-TTATTGGTCTTTCAAACGCCCTTCCTG | Pst I |
| 254 | Forward | AAAAAAGAATTC-ATGTATACAGGCGAACGCTTCAATAC | Eco RI |
|  | Reverse | AAAAAATCTAGA-TCAGATTACGTAACCGTACACGCTGAC | Xba I |

TABLE 7-continued

Oligonucleotides used for PCR to amplify complete or partial ORFs

| ORF | primer | Sequence | Restriction sites |
|---|---|---|---|
| 255 | Forward | CGCGGATCCCATATG-GCCGCGTTGCGTTAC | BamHI-NdeI |
|  | Reverse | CCCGCTCGAG-ATCCGCAATACCGACCAG | XhoI |
| 256 | Forward | CGCGGATCCGCTAGC-TTTTAACACCGCCGGAC | BamHI-NheI |
|  | Reverse | CCCGCTCGAG-ACGCCTGTTTGTGCGG | XhoI |
| 257 | Forward | CGCGGATCCCATATG-GCGGTTTCTTTCCTG | BamHI-NdeI |
|  | Reverse | CCCGCTCGAG-GCGCGTGAATATCGCG | XhoI |
| 258 | Forward | AAAAAAGAATTC-GATTATTTCTGGTGGATTGTTGCGTTCAG | Eco RI |
|  | Reverse | AAAAAACTGCAG-CTACGCATAAGTTTTTACCGTTTTTGG | Pst I |
| 258a | Forward | AAAAAAGAATTC-GCGAAGGCGGTGGCGCAAGGCGA | Eco RI |
|  | Reverse | AAAAAACTGCAG-CTACGCATAAGTTTTTACCGTTTTTGG | Pst I |
| 259 | Forward | CGCGGATCCCATATG-GAAGAGCTGCCTCCG | BamHI-NdeI |
|  | Reverse | CCCGCTCGAG-GGCTTTTCCGGCGTTT | XhoI |
| 260 | Forward | CGCGGATCCCATATG-GGTGCGGGTATGGT | BamHI-NdeI |
|  | Reverse | CCCGCTCGAG-AACAGGGCGACACCCT | XhoI |
| 261 | Forward | AAAAAAGAATTC-CAAGATACAGCTCGGGCATTCGC | Eco RI |
|  | Reverse | AAAAAACTGCAG-TCAAACCAACAAGCCTTGGTCACT | Pst I |
| 263 | Forward | CGCGGATCCCATATG-GCACGTTTAACCGTA | BamHI-NdeI |
|  | Reverse | CCCGCTCGAG-GGCGTAAGCCTGCAATT | XhoI |
| 264 | Forward | AAAAAAGGTACC-GCCGACGCAGTGGTCAAGGCAGAA | Kpn I |
|  | Reverse | AAACTGCAG-TCAGCCGGCGGTCAATACCGCCCG | Pst I |
| 265 | Forward | AAAAAAGAATTC-GCGGAGGTCAAGAGAAGGTGTTTG | Eco RI |
|  | Reverse | AAAAAACTGCAG-TTACGAATACGTCGTCAAAATGGG | Pst I |
| 266 | Forward | AAAGAATTC-CTCATCTTTGCCAACGCCCCCTTC | Eco RI |
|  | Reverse | AAACTGCAG-CTATTCCCTGTTGCGCGTGTGCCA | Pst I |
| 267 | Forward | AAAGAATTC-TTCTTCCGATTCGATGTTAATCG | Eco RI |
|  | Reverse | AAACTGCAG-TTAGTAAAAACCTTTCTGCTTGGC | Pst I |
| 269 | Forward | AAAGAATTC-TGCAAACCTTGCGCCACGTGCCC | Eco RI |
|  | Reverse | AAACTGCAG-TTACGAAGACCGCAACGAAAGGCAGAG | Pst I |
| 269a | Forward | AAAAAAGAATTC-GACTTTATCCAAAACACGGCTTCGCC | Eco RI |
|  | Reverse | AAACTGCAG-TTACGAAGACCGCAACGAAAGGCAGAG | Pst I |
| 270 | Forward | AAAGAATTC-GCCGTCAAGCTCGTTTTGTTGCAATG | Eco RI |
|  | Reverse | AAACTGCAG-TTATTCGGCGGTAAATGCCGTCTG | Pst I |
| 271 | Forward | CGCGGATCCCATATG-CCTGTGTGCAGCTCGAC | BamHI-NdeI |
|  | Reverse | CCCGCTCGAG-TCCCAGCCCCGTGGAG | XhoI |

TABLE 7-continued

Oligonucleotides used for PCR to amplify complete or partial ORFs

| ORF | primer | Sequence | Restriction sites |
|---|---|---|---|
| 272 | Forward | AAAGAATTC-ATGACCGCAAAGGAAGAACTGTTCGC | Eco RI |
|  | Reverse | AAACTGCAG-TCAGAGCAGTTCCAAATCGGGGCT | Pst I |
| 273 | Forward | AAAGAATTC-ATGAGTCTTCAGGCGGTATTTATATACCC | Eco RI |
|  | Reverse | AAACTGCAG-TTACGCGTAAGAAAAAACTGC | Pst I |
| 274 | Forward | CGCGGATCCCATATG-ACAGATTTGGTTACGGAC | BamHI-NdeI |
|  | Reverse | CCCGCTCGAG-TTTGCTTTCAGTATTATTGAA | XhoI |
| 276 | Forward | AAAAAGAATTC-ATGATTTTGCCGTCGTCCATCACGATGATGCG | Eco RI |
|  | Reverse | AAAAACTGCAG-CTACACCACCATCGGCGAATTTATGGC | Pst I |
| 277 | Forward | AAAAAGAATTC-ATGCCCCGCTTTGAGGACAAGCTCGTAGG | Eco RI |
|  | Reverse | AAAAACTGCAG-TCATAAGCCATGCTTACCTTCCAACAA | Pst I |
| 277a | Forward | AAAAAGAATTC-GGGGCGGCGGCTGGGTTGGACGTAGG | Eco RI |
|  | Reverse | AAAAACTGCAG-TCATAAGCCATGCTTACCTTCCAACAA | Pst I |
| 278 | Forward | AAAAAGGTACC-GTCAAAGTTGTATTAATCGGGCCTTTGCC | Kpn I |
|  | Reverse | AAAAACTGCAG-TCATTCAACCATATCAAATCTGCC | Pst I |
| 278a | Forward | AAAAAGAATTC-AAAACTCTCCTAATTCGTCATAGTCG | Eco RI |
|  | Reverse | AAAAACTGCAG-TCATTCAACCATATCAAATCTGCC | Pst I |
| 279 | Forward | CGCGGATCCCATATG-TTGCCTGCAATCACGATT | BamHI-NdeI |
|  | Reverse | CCCGCTCGAG-TTTAGAAGCGGGCGGCAA | XhoI |
| 280 | Forward | AAAAAGGTACC-GCCCCCCTGCCGGTTGTAACCAG | Kpn I |
|  | Reverse | AAAAACTGCAG-TTATTGCTTCATCGCGTTGGTCAAGGC | Pst I |
| 281 | Forward | AAAAAGAATTC-GCACCCGTCGGCGTATTCCTCGTCATGCG | Eco RI |
|  | Reverse | AAAAATCTAGA-GGTCAGAATGCCGCCTTCTTTGCCGAG | Xba I |
| 281a | Forward | AAAAAGAATTC-TCCTACCACATCGAAATTCCTTCCGG | Eco RI |
|  | Reverse | AAAAATCTAGA-GGTCAGAATGCCGCCTTCTTTGCCGAG | Xba I |
| 282 | Forward | AAAAAGAATTC-CTTTACCTTGACCTGACCAACGGGCACAG | Eco RI |
|  | Reverse | AAAAACTGCAG-TCAACCTGCCAGTTGCGGGAATATCGT | Pst I |
| 283 | Forward | CGCGGATCCCATATG-GCCGTCTTTACTTGGAAG | BamHI-NdeI |
|  | Reverse | CCCGCTCGAG-ACGGCAGTATTTGTTTACG | XhoI |
| 284 | Forward | CGCGGATCCCATATG-TTTGCCTGCAAAAGAATCG | BamHI-NdeI |
|  | Reverse | CCCGCTCGAG-CCGACTTTGCAAAAACTG | XhoI |
| 286 | Forward | CGCGGATCCCATATG-GCCGACCTTTCCGAAAA | BamHI-NdeI |
|  | Reverse | CCCGCTCGAG-GAAGCGCGTTCCCAAG | XhoI |
| 287 | Forward | CCGGAATTCTAGCTAGC-CTTTCAGCCTGCGGG | EcoRI-NheI |
|  | Reverse | CCCGCTCGAG-ATCCTGCTCTTTTTTGCC | XhoI |

TABLE 7-continued

Oligonucleotides used for PCR to amplify complete or partial ORFs

| ORF | primer | Sequence | Restriction sites |
|---|---|---|---|
| 288 | Forward | CGCGGATCCCATATG-CACACCGGACAGG | BamHI-NdeI |
|  | Reverse | CCCGCTCGAG-CGTATCAAAGACTTGCGT | XhoI |
| 290 | Forward | CGCGGATCCCATATG-GCGGTTTGGGCGGA | BamHI-NdeI |
|  | Reverse | CCCGCTCGAG-TCGGCGCGGCGGGC | XhoI |
| 292 | Forward | CGCGGATCCCATATG-TGCGGGCAAACGCCC | BamHI-NdeI |
|  | Reverse | CCCGCTCGAG-TTGATTTTTGCGGATGATTT | XhoI |
| 294 | Forward | AAAAAAGAATTC-GTCTGGTCGATTCGGGTTGTCAGAAC | Eco RI |
|  | Reverse | AAAAAACTGCAG-TTACCAGCTGATATAAACATCGCTTT | Pst I |
| 295 | Forward | CGCGGATCCCATATG-AACCGGCCGGCCTCC | BamHI-NdeI |
|  | Reverse | CCCGCTCGAG-CGATATTTGATTCCGTTGC | XhoI |
| 297 | Forward | AAAAAAGAATTC-GCATACATTGCTTCGACAGAGAG | Eco RI |
|  | Reverse | AAAAAACTGCAG-TCAATCCGATTGCGACACGGT | Pst I |
| 298 | Forward | AAAAAAGAATTC-CTGATTGCCGTGTGGTTCAGCCAAAACCC | Eco RI |
|  | Reverse | AAAAAACTGCAG-TCATGGCTGTGTACTTGATGGTTGCGT | Pst I |
| 299 | Forward | CGCGGATCCGCTAGC-CTACCTGTCGCCTCCG | BamHI-NheI |
|  | Reverse | CCCGCTCGAG-TTGCCTGATTGCAGCGG | XhoI |
| 302 | Forward | AAAAAAGAATTC-ATGAGTCAAACCGATACGCAACG | Eco RI |
|  | Reverse | AAAAAACTGCAG-TTAAGGTGCGGGATAGAATGTGGGCGC | Pst I |
| 305 | Forward | AAAAAAGGTACC-GAATTTTTACCGATTTCCAGCACCGGA | Kpn I |
|  | Reverse | AAAAAACTGCAG-TCATTCCCAACTTATCCAGCCTGACAG | Pst I |
| 305a | Forward | AAAAAAGGTACC-TCCCGTTCGGGCAGTACGATTATGGG | Kpn I |
|  | Reverse | AAAAAACTGCAG-TTACAAACCGACATCATGCAGGGTGAA | Pst I |
| 306 | Forward | CGCGGATCCCATATG-TTTATGAACAAATTTCCC | BamHI-NdeI |
|  | Reverse | CCCGCTCGAG-CCGCATCGGCAGAC | XhoI |
| 308 | Forward | CGCGGATCCCATATG-TTAAATCGGGTATTTTATC | BamHI-NdeI |
|  | Reverse | CCCGCTCGAG-ATCCGCCATTCCCTGC | XhoI |
| 311 | Forward | AAAAAAGGTACC-ATGTTCAGTTTTGGCTGGTGTTT | Kpn I |
|  | Reverse | AAACTGCAG-ATGTTCATATTCCCTGCCTTCGGC | Pst I |
| 312 | Forward | AAAAAAGGTACC-ATGAGTATCCCATCCGGCGAAATT | Kpn I |
|  | Reverse | AAACTGCAG-TCAGTTTTTCATCGATTGAACCGG | Pst I |
| 313 | Forward | AAAAAAGAATTC-ATGGACGACCCGCGCACCTACGGATC | Eco RI |
|  | Reverse | AAAAAACTGCAG-TCAGCGGCTGCCGCCGATTTTGCT | Pst I |
| 401 | Forward | CGCGGATCCCATATG-AAGGCGGCAACACAGC | BamHI-NdeI |
|  | Reverse | CCCGCTCGAG-CCTTACGTTTTTCAAAGCC | XhoI |

TABLE 7-continued

Oligonucleotides used for PCR to amplify complete or partial ORFs

| ORF | primer | Sequence | Restriction sites |
|---|---|---|---|
| 402 | Forward | AAAAAAGAATTC-GTGCCTCAGGCATTTTCATTTACCCTTGC | Eco RI |
|  | Reverse | AAAAAATCTAGA-TTAAATCCCTCTGCCGTATTTGTATTC | Xba I |
| 402a | Forward | AAAAAAGAATTC-AGGCTGATTGAAAACAAACACGG | Eco RI |
|  | Reverse | AAAAAATCTAGA-TTAAATCCCTCTGCCGTATTTGTATTC | Xba I |
| 406 | Forward | CGCGGATCCCATATG-TGCGGGACACTGACAG | BamHI-NdeI |
|  | Reverse | CCCGCTCGAG-AGGTTGTCCTTGTCTATG | XhoI |
| 501 | Forward | CGCGGATCCCATATG-GCAGGCGGAGATGGC | BamHI-NdeI |
|  | Reverse | CCCGCTCGAG-GGTGTGATGTTCACCC | XhoI |
| 502 | Forward | CGCGGATCCCATATG-GTAGACGCGCTTAAGCA | BamHI-NdeI |
|  | Reverse | CCCGCTCGAG-AGCTGCATGGCGGCG | XhoI |
| 503 | Forward | CGCGGATCCCATATG-TGTTCGGGGAAAGGCG | BamHI-NdeI |
|  | Reverse | CCCGCTCGAG-CCGCGCATTCCTCGCA | XhoI |
| 504 | Forward | CGCGGATCCCATATG-AGCGATATTGAAGTGACG | BamHI-NdeI |
|  | Reverse | GCCCAAGCTT-TGATTCAAGTCCTTGCCG | HindIII |
| 505 | Forward | CGCGGATCCCATATG-TTTCGTTTACAATTCAGG | BamHI-NdeI |
|  | Reverse | CCCGCTCGAG-CGGCGTTTTATAGCGG | XhoI |
| 510 | Forward | CGCGGATCCCATATG-CCTTCGCGGACAC | BamHI-NdeI |
|  | Reverse | CCCGCTCGAG-GCGCACTGGCAGCG | XhoI |
| 512 | Forward | CGCGGATCCCATATG-GGACATGAAGTAACGGT | BamHI-NdeI |
|  | Reverse | CCCGCTCGAG-AGGAATAGCCTTTGACG | XhoI |
| 515 | Forward | CGCGGATCCCATATG-GAGGAAATAGCCTTCGA | BamHI-NdeI |
|  | Reverse | CCCGCTCGAG-AAATGCCGCAAAGCATC | XhoI |
| 516 | Forward | CGCGGATCCCATATG-TGTACGTTGATGTTGTGG | BamHI-NdeI |
|  | Reverse | CCCGCTCGAG-TTTGCGGGCGGCATC | XhoI |
| 517 | Forward | CGCGGATCCCATATG-GGTAAAGGTGTGGAAATA | BamHI-NdeI |
|  | Reverse | CCCGCTCGAG-GTGCGCCCAGCCGT | XhoI |
| 518 | Forward | AAAGAATTC-GCTTTTTTACTGCTCCGACCGGAAGG | Eco RI |
|  | Reverse | AAACTGCAG-TCAAATTTCAGACTCTGCCAC | Pst I |
| 519 | Forward | CGCGGATCCCATATG-TTCAAATCCTTTGTCGTCA | BamHI-NdeI |
|  | Reverse | CCCGCTCGAG-TTTGGCGGTTTTGCTGC | XhoI |

TABLE 7-continued

Oligonucleotides used for PCR to amplify complete or partial ORFs

| ORF | primer | Sequence | Restriction sites |
|---|---|---|---|
| 520 | Forward | CGCGGATCCCATATG-CCTGCGCTTCTTTCA | BamHI-NdeI |
|  | Reverse | CCCGCTCGAG-ATATTTACATTTCAGTCGGC | XhoI |
| 521 | Forward | CGCGGATCCCATATG-GCCAAAATCTATACCTGC | BamHI-NdeI |
|  | Reverse | CCCGCTCGAG-CATACGCCCCAGTTCC | XhoI |
| 522 | Forward | CGCGGATCCCATATG-ACTGAGCCGAAACAC | BamHI-NdeI |
|  | Reverse | GCCCAAGCTT-TTCTGATTTCAAATCGGCA | HindIII |
| 523 | Forward | CGCGGATCCCATATG-GCTCTGCTTTCCGCG | BamHI-NdeI |
|  | Reverse | CCCGCTCGAG-AGGGTGTGTGATAATAAGAAG | XhoI |
| 525 | Forward | CGCGGATCCCATATG-GCCGAAATGGTTCAAATC | BamHI-NdeI |
|  | Reverse | CCCGCTCGAG-GCCCGTGCATATCATAAA | XhoI |
| 527 | Forward | AAAGAATTC-TTCCCTCAATGTTGCCGTTTTCG | Eco RI |
|  | Reverse | AAACTGCAG-TTATGCTAAACTCGAAACAAATTC | Pst I |
| 529 | Forward | CGCGGATCCGCTAGC-TGCTCCGGCAGCAAAAC | BamHI-NheI |
|  | Reverse | GCCCAAGCTT-ACGCAGTTCGGAATGGAG | HindIII |
| 530 | Forward | CGCGGATCCCATATG-AGTGCGAGCGCGG | BamHI-NdeI |
|  | Reverse | CCCGCTCGAG-ACGACCGACTGATTCCG | XhoI |
| 531 | Forward | AAAAAAGAATTC-TATGCCGCCGCCTACCAAATCTACGG | Eco RI |
|  | Reverse | AAAAAACTGCAG-TTAAAACAGCGCCGTGCCGACGACAAG | Pst I |
| 532 | Forward | AAAAAAGAATTC-ATGAGCGGTCAGTTGGGCAAAGGTGC | Eco RI |
|  | Reverse | AAAAAACTGCAG-TCAGTGTTCCAAGTGGTCGGTATCAAA | Pst I |
| 532a | Forward | AAAAAAGAATTC-TTGGGTGTCGCGTTTGAGCCGGAAGT | Eco RI |
|  | Reverse | AAAAAACTGCAG-TCAGTGTTCCAAGTGGTCGGTATCAAA | Pst I |
| 535 | Forward | AAAGAATTC-ATGCCCTTTCCCGTTTTCAGAC | Eco RI |
|  | Reverse | AAACTGCAG-TCAGACGACCCCGCCTTCCCC | Pst I |
| 537 | Forward | CGCGGATCCCATATG-CATACCCAAAACCAATCC | BamHI-NdeI |
|  | Reverse | CCCGCTCGAG-ATCCTGCAAATAAGGGTT | XhoI |
| 538 | Forward | CGCGGATCCCATATG-GTCGAGCTGGTCAAAGC | BamHI-NdeI |
|  | Reverse | CCCGCTCGAG-TGGCATTTCGGTTTCGTC | XhoI |
| 539 | Forward | CGCGGATCCGCTAGC-GAGGATTTGCAGGAAA | BamHI-NheI |
|  | Reverse | CCCGCTCGAG-TACCAATGTCGGCAAATC | XhoI |
| 542 | Forward | AAAGAATTC-ATGCCGTCTGAAACCGTGTC | Eco RI |
|  | Reverse | AAACTGCAG-TTACCGCGAACCGGTCAGGAT | Pst I |

TABLE 7-continued

Oligonucleotides used for PCR to amplify complete or partial ORFs

| ORF | primer | Sequence | Restriction sites |
|---|---|---|---|
| 543 | Forward | AAAAAAGAATTC-GCCTTCGATGGCGACGTTGTAGGTAC | Eco RI |
| | Reverse | AAAAAATCTAGA-TTAATGAAGAAGAACATATTGGAATTTTGG | Xba I |
| 543a | Forward | AAAAAAGAATTC-GGCAAAACTCGTCATGAATTTGC | Eco RI |
| | Reverse | AAAAAATCTAGA-TTAATGAAGAAGAACATATTGGAATTTTGG | Xba I |
| 544 | Forward | AAAGAATTC-GCGCCCGCCTTCTCCCTGCCCGACCTGCACGG | Eco RI |
| | Reverse | AAACTGCAG-CTATTGCGCCACGCGCGTATCGAT | Pst I |
| 544a | Forward | AAAAAAGAATTC-GCAAATGACTATAAAAACAAAAACTTCCAAGTACTTGC | Eco RI |
| | Reverse | AAACTGCAG-CTATTGCGCCACGCGCGTATCGAT | Pst I |
| 547 | Forward | AAAGAATTC-ATGTTCGTAGATAACGGATTTAATAAAAC | Eco RI |
| | Reverse | AAACTGCAG-TTAACAACAAAAAACAAACCGCTT | Pst I |
| 548 | Forward | AAAGAATTC-GCCTGCAAACCTCAAGACAACAGTGCGGC | Eco RI |
| | Reverse | AAACTGCAG-TCAGAGCAGGGTCCTTACATCGGC | Pst I |
| 550 | Forward | AAAAAAGTCGAC-ATGATAACGGACAGGTTTCATCTCTTTCATTTTCC | Sal I |
| | Reverse | AAACTGCAG-TTACGCAAACGCTGCAAAATCCCC | Pst I |
| 550a | Forward | AAAAAAGAATTC-GTAAATCACGCCTTTGGAGTCGCAAACGG | Eco RI |
| | Reverse | AAACTGCAG-TTACGCAAACGCTGCAAAATCCCC | Pst I |
| 552 | Forward | AAAAAAGAATTC-TTGGCGCGTTGGCTGGATAC | Eco RI |
| | Reverse | AAACTGCAG-TTATTTCTGATGCCTTTTCCCAAC | Pst I |
| 554 | Forward | CGCGGATCCCATATG-TCGCCCGCGCCCAAC | BamHI-NdeI |
| | Reverse | CCCGCTCGAG-CTGCCCTGTCAGACAC | XhoI |
| 556 | Forward | AAAGAATTC-GCGGGCGGTTTTGTTTGGACATCCCG | Eco RI |
| | Reverse | AAACTGCAG-TTAACGGTGCGGACGTTTCTGACC | Pst I |
| 557 | Forward | CGCGGATCCCATATG-TGCGGTTTCCACCTGAA | BamHI-NdeI |
| | Reverse | CCCGCTCGAG-TTCCGCCTTCAGAAAGG | XhoI |
| 558 | Forward | AAAGAATTC-GAGCTTTATATGTTTCAACAGGGGACGGC | Eco RI |
| | Reverse | AAACTGCAG-CTAAACAATGCCGTCTGAAAGTGGAGA | Pst I |
| 558a | Forward | AAAAAAGAATTC-ATTAGATTCTATCGCCATAAACAGACGGG | Eco RI |
| | Reverse | AAAAAACTGCAG-CTAAACAATGCCGTCTGAAAGTGGAGA | Pst I |
| 560 | Forward | AAAAAAGAATTC-TCGCCTTTCCGGGACGGGGCGCACAAGATGGC | Eco RI |
| | Reverse | AAAAAACTGCAG-TCATGCGGTTTCAGACGGCATTTTGGC | Pst I |
| 561 | Forward | CCGGAATTCTACATATG-ATACTGCCAGCCCGT | EcoRI-NdeI |
| | Reverse | CCCGCTCGAG-TTTCAAGCTTTCTTCAGATG | XhoI |

TABLE 7-continued

Oligonucleotides used for PCR to amplify complete or partial ORFs

| ORF | primer | Sequence | Restriction sites |
|---|---|---|---|
| 562 | Forward | CGCGGATCCCATATG-GCAAGCCCGTCGAG | BamHI-NdeI |
| | Reverse | CCCGCTCGAG-AGACCAACTCCAACTCGT | XhoI |
| 565 | Forward | CGCGGATCCCATATG-AAGTCGAGCGCGAAATAC | BamHI-NdeI |
| | Reverse | CCCGCTCGAG-GGCATTGATCGGCGGC | XhoI |
| 566 | Forward | CGCGGATCCCATATG-GTCGGTGGCGAAGAGG | BamHI-NdeI |
| | Reverse | CCCGCTCGAG-CGCATGGGCGAAGTCA | XhoI |
| 567 | Forward | CCGGAATTCTACATATG-AGTGCGAACATCCTTG | EcoRI-NdeI |
| | Reverse | CCCGCTCGAG-TTTCCCCGACACCCTCG | XhoI |
| 568 | Forward | CGCGGATCCCATATG-CTCAGGGTCAGACC | BamHI-NdeI |
| | Reverse | CCCGCTCGAG-CGGCGCGGCGTTCAG | XhoI |
| 569 | Forward | AAAAAAGAATTC-CTGATTGCCTTGTGGGAATATGCCCG | Eco RI |
| | Reverse | AAAAAACTGCAG-TTATGCATAGACGCTGATAACGGCAAT | Pst I |
| 570 | Forward | CGCGGATCCCATATG-GACACCTTCCAAAAAATCG | BamHI-NdeI |
| | Reverse | CCCGCTCGAG-GCGGGCGTTCATTTCTTT | XhoI |
| 571 | Forward | AAAAAAGAATTC-ATGGGTATTGCCGGCGCCGTAAATGTTTTGAACCC | Eco RI |
| | Reverse | AAAAAACTGCAG-TTATGGCCGACGCGCGGCTACCTGACG | Pst I |
| 572 | Forward | CGCGGATCCCATATG-GCGCAAAAAGGCAAACC | BamHI-NdeI |
| | Reverse | CCCGCTCGAG-GCGCAGTGTGCCGATA | XhoI |
| 573 | Forward | CGCGGATCCCATATG-CCCTGTTTGTGCCG | BamHI-NdeI |
| | Reverse | CCCGCTCGAG-GACGGTGTCATTTCGCC | XhoI |
| 574 | Forward | CGCGGATCCCATATG-TGGTTTGCCGCCCGC | BamHI-NdeI |
| | Reverse | CCCGCTCGAG-AACTTCGATTTTATTCGGG | XhoI |
| 575 | Forward | CGCGGATCCCATATG-GTTTCGGGCGAGG | BamHI-NdeI |
| | Reverse | CCCGCTCGAG-CATTCCGAATCTGAACAG | XhoI |
| 576 | Forward | CGCGGATCCCATATG-GCCGCCCCCGCATCT | BamHI-NdeI |
| | Reverse | CCCGCTCGAG-ATTTACTTTTTTGATGTCGAC | XhoI |
| 577 | Forward | CGCGGATCCCATATG-GAAAGGAACGGTGTATTT | BamHI-NdeI |
| | Reverse | CCCGCTCGAG-AGGCTGTTTGGTAGATTCG | XhoI |
| 578 | Forward | CGCGGATCCCATATG-AGAAGGTTCGTACAG | BamHI-NdeI |
| | Reverse | CCCGCTCGAG-GCCAACGCCTCCACG | XhoI |

TABLE 7-continued

Oligonucleotides used for PCR to amplify complete or partial ORFs

| ORF | primer | Sequence | Restriction sites |
|---|---|---|---|
| 579 | Forward | CGCGGATCCCATATG-AGATTGGGCGTTTCCAC | BamHI-NdeI |
|  | Reverse | CCCGCTCGAG-AGAATTGATGATGTGTATGT | XhoI |
| 580 | Forward | CGCGGATCCCATATG-AGGCAGACTTCGCCGA | BamHI-NdeI |
|  | Reverse | CCCGCTCGAG-CACTTCCCCCGAAGTG | XhoI |
| 581 | Forward | CGCGGATCCCATATG-CACTTCGCCCAGC | BamHI-NdeI |
|  | Reverse | CCCGCTCGAG-CGCCGTTTGGCTTTGG | XhoI |
| 582 | Forward | AAAAAAGAATTC-TTTGGAGAGACCGCGCTGCAATGCGC | Eco RI |
|  | Reverse | AAAAAATCTAGA-TCAGATGCCGTCCCAGTCGTTGAA | Xba I |
| 583 | Forward | AAAAAAGAATTC-ACTGCCGGCAATCGACTGCATAATCG | Eco RI |
|  | Reverse | AAAAAACTGCAG-TTAACGGAGGTCAATATGATGAAATTG | Pst I |
| 584 | Forward | AAAAAAGAATTC-GCGGCTGAAGCATTGAATTACAATATTGTC | Eco RI |
|  | Reverse | AAAAAACTGCAG-TCAGAACTGAACCGTCCCATTGACGCT | Pst I |
| 585 | Forward | AAAAAAGGTACC-TCTTTCTGGCTGGTGCAGAACACCCTTGC | Eco RI |
|  | Reverse | AAAAAACTGCAG-TCAGTTCGCACTTTTTTCTGTTTTGGA | Pst I |
| 586 | Forward | CGCGGATCCCATATG-GCAGCCCATCTCG | BamHI-NdeI |
|  | Reverse | CCCGCTCGAG-TTTCAGCGAATCAAGTTTC | XhoI |
| 587 | Forward | CGCGGATCCCATATG-GACCTGCCCTTGACGA | BamHI-NdeI |
|  | Reverse | CCCGCTCGAG-AAATGTATGCTGTACGCC | XhoI |
| 588 | Forward | AAAAAAGAATTC-GCCGTCCTGACTTCCTATCAAGAACCAGG | Eco RI |
|  | Reverse | AAAAAACTGCAG-TTATTTGTTTTTGGGCAGTTTCACTTC | Pst I |
| 589 | Forward | AAAAAAGAATTC-ATGCAACAAAAAATCCGTTTCCAAATCGAAGG | Eco RI |
|  | Reverse | AAAAAACTGCAG-CTAATCGATTTTTACCCGTTTCAGGCG | Pst I |
| 590 | Forward | AAAAAAGAATTC-ATGAAAAAACCTTTGATTTCAGTTGCGGC | Eco RI |
|  | Reverse | AAAAAACTGCAG-TTACTGCTGCGGCTCTGAAACCAT | Pst I |
| 591 | Forward | AAAAAAGAATTC-CACTACATCGTTGCCAGATTGTGCGG | Eco RI |
|  | Reverse | AAAAAACTGCAG-CTAACCGAGCAGCCGGGTAACGTCGTT | Pst I |
| 592a | Forward | AAAAAAGAATTC-CGCGATTACACCGCCAAGCTGAAAATGGG | Eco RI |
|  | Reverse | AAAAAACTGCAG-TTACCAAACGTCGGATTTGATACG | Pst I |
| 593 | Forward | CGCGGATCCGCTAGC-CTTGAACTGAACGGACTC | BamHI-NheI |
|  | Reverse | CCCGCTCGAG-GCGGAAGCGGACGATT | XhoI |
| 594a | Forward | AAAAAAGAATTC-GGTAAGTTCGCCGTTCAGGCCTTTCA | Eco RI |
|  | Reverse | AAAAAACTGCAG-TTACGCCGCCGTTTCCTGACACTCGCG | Pst I |
| 595 | Forward | AAAAAAGAATTC-TGCCAGCCGCCGGAGGCGGAGAAAGC | Eco RI |
|  | Reverse | AAAAAACTGCAG-TTATTTCAAGCCGAGTATGCCGCG | Pst I |

TABLE 7-continued

Oligonucleotides used for PCR to amplify complete or partial ORFs

| ORF | primer | Sequence | Restriction sites |
|---|---|---|---|
| 596 | Forward | CGCGGATCCCATATG-TCCCAACAATACGTC | BamHI-NdeI |
|  | Reverse | CCCGCTCGAG-ACGCGTTACCGGTTTGT | XhoI |
| 597 | Forward | CGCGGATCCCATATG-CTGCTTCATGTCAGC | BamHI-NdeI |
|  | Reverse | GCCCAAGCTT-ACGTATCCAGCTCGAAG | HindIII |
| 601 | Forward | CGCGGATCCCATATG-ATATGTTCCCAACCGGCAAT | BamHI-NdeI |
|  | Reverse | CCCGCTCGAG-AAAACAATCCTCAGGCAC | XhoI |
| 602 | Forward | CGCGGATCCGCTAGC-TTGCTCCATCAATGC | BamHI-NheI |
|  | Reverse | CCCGCTCGAG-ATGCAGCTGCTAAAAGCG | XhoI |
| 603 | Forward | AAAAAAGAATTC-CTGTCCTCGCGTAGGCGGGGACGGGG | Eco RI |
|  | Reverse | AAAAAACTGCAG-CTACAAGATGCCGGCAAGTTCGGC | Pst I |
| 604 | Forward | CGCGGATCCGCTAGC-CCCGAAGCGCACTT | BamHI-NheI |
|  | Reverse | CCCGCTCGAG-GACGGCATCTGCACGG | XhoI |
| 606a | Forward | AAAAAAGAATTC-CGCGAATACCGCGCCGATGCGGGCGC | Eco RI |
|  | Reverse | AAAAAACTGCAG-TTAAAGCGATTTGAGGCGGGCGATACG | Pst I |
| 607 | Forward | AAAAAAGAATTC-ATGCTGCTCGACCTCAACCGCTTTTC | Eco RI |
|  | Reverse | AAAAAACTGCAG-TCAGACGGCCTTATGCGATCTGAC | Pst I |
| 608 | Forward | AAAAAAGAATTC-ATGTCCGCCCTCCTCCCCATCATCAACCG | Eco RI |
|  | Reverse | AAAAAACTGCAG-TTAGTCTATCCAAATGTCGCGTTC | Pst I |
| 609 | Forward | CGCGGATCCCATATG-GTTGTGGATAGACTCG | BamHI-NdeI |
|  | Reverse | CCCGCTCGAG-CTGGATTATGATGTCTGTC | XhoI |
| 610 | Forward | CGCGGATCCCATATG-ATTGGAGGGCTTATGCA | BamHI-NdeI |
|  | Reverse | CCCGCTCGAG-ACGCTTCAACATCTTTGCC | XhoI |
| 611 | Forward | CGCGGATCCCATATG-CCGTCTCAAAACGGG | BamHI-NdeI |
|  | Reverse | CCCGCTCGAG-AACGACTTTGAACGCGCAA | XhoI |
| 613 | Forward | CGCGGATCCCATATG-TCGCGTTCGAGCCG3 | BamHI-NdeI |
|  | Reverse | CCCGCTCGAG-AGCCTGTAAAATAAGCGGC | XhoI |
| 614 | Forward | CGCGGATCCCATATG-TCCGTCGTGAGCGGC | BamHI-NdeI |
|  | Reverse | CCCGCTCGAG-CCATACTGCGGCGTTC | XhoI |
| 616 | Forward | AAAAAAGAATTC-ATGTCAAACACAATCAAATGGTTGTCGG | Eco RI |
|  | Reverse | AAAAAATCTAGA-TTAGTCCGGGCGGCAGGCAGCTCG | Xba I |
| 619a | Forward | AAAAAAGAATTC-GGGCTTCTCGCCGCCTCGCTTGC | Eco RI |
|  | Reverse | AAAAAACTGCAG-TCATTTTTTGTGTTTTAAAACGAGATA | Pst I |

TABLE 7-continued

Oligonucleotides used for PCR to amplify complete or partial ORFs

| ORF | primer | Sequence | Restriction sites |
|---|---|---|---|
| 622 | Forward | CGC<u>GGATCCCATATG</u>-GCCGCCCTGCCTAAAG | BamHI-NdeI |
| | Reverse | CCCG<u>CTCGAG</u>-TTTGTCCAAATGATAAATCTG | XhoI |
| 624 | Forward | CGC<u>GGATCCCATATG</u>-TCCCCGCGCTTTTACCG | BamHI-NdeI |
| | Reverse | CCCG<u>CTCGAG</u>-AGATTCGGGCCTGCGC | XhoI |
| 625 | Forward | CGC<u>GGATCCCATATG</u>-TTTGCAACCAGGAAAATG | BamHI-NdeI |
| | Reverse | CCCG<u>CTCGAG</u>-CGGCAAAATTACCGCCTT | XhoI |
| 627a | Forward | AAAAAA<u>GAATTC</u>-AAAGCAGGCGAGGCAGGCGCGCTGGG | Eco RI |
| | Reverse | AAAAAA<u>CTGCAG</u>-TTACGAATGAAACAGGGTACCCGTCATCAAGGC | Pst I |
| 628 | Forward | AAAAAA<u>GGTACC</u>-GCCTTACAAACATGGATTTTGCGTTC | Kpn I |
| | Reverse | AAAAAA<u>CTGCAG</u>-CTACGCACCTGAAGCGCTGGCAAA | Pst I |
| 629a | Forward | AAAAAA<u>GAATTC</u>-GCCACCTTTATCGCGTATGAAAACGA | Eco RI |
| | Reverse | AAAAAA<u>CTGCAG</u>-TTACAACACCGCCGTCCGGTTCAAACC | Pst I |
| 630a | Forward | AAAAAA<u>GAATTC</u>-GCGGCTTTGGGTATTCTTTCGG | Eco RI |
| | Reverse | AAAAAA<u>CTGCAG</u>-TTAGGAGACTTCGCCAATGGAGCCGGG | Pst I |
| 635 | Forward | AAAAAA<u>GAATTC</u>-ATGACCCAGCGACGGGTCGGCAAGCAAAACCG | Eco RI |
| | Reverse | AAAAAA<u>CTGCAG</u>-TTAATCCACTATAATCCTGTTGCT | Pst I |
| 638 | Forward | AAAAAA<u>GAATTC</u>-ATGATTGGCGAAAAGTTTATCGTAGTTGG | Eco RI |
| | Reverse | AAAAAA<u>CTGCAG</u>-TCACGAACCGATTATGCTGATCGG | Pst I |
| 639 | Forward | CGC<u>GGATCCCATATG</u>-ATGCTTTATTTTGTTCG | BamHI-NdeI |
| | Reverse | CCCG<u>CTCGAG</u>-ATCGCGGCTGCCGAC | XhoI |
| 642 | Forward | CGC<u>GGATCCCATATG</u>-CGGTATCCGCCGCAAT | BamHI-NdeI |
| | Reverse | CCCG<u>CTCGAG</u>-AGGATTGCGGGCATTA | XhoI |
| 643 | Forward | CGC<u>GGATCCCATATG</u>-GCTTCGCCGTCGGCAG | BamHI-NdeI |
| | Reverse | CCCG<u>CTCGAG</u>-AACCGAAAAACAGACCGC | XhoI |
| 644 | Forward | AAAAAA<u>GAATTC</u>-ATGCCGTCTGAAAGGTCGGCGGATTGTTGCCC | Eco RI |
| | Reverse | AAAAAA<u>TCTAGA</u>-CTACCCGCAATATCGGCAGTCCAATAT | Pst I |
| 645 | Forward | AAAAAA<u>GAATTC</u>-GTGGAACAGAGCAACACGTTAAATCG | Eco RI |
| | Reverse | AAAAAA<u>CTGCAG</u>-CTACGAGGAAACCGAAGACCAGGCCGC | Pst I |
| 647 | Forward | AAAAAA<u>GAATTC</u>-ATGCAAAGGCTCGCCGCAGACGG | Eco RI |
| | Reverse | AAAAAA<u>CTGCAG</u>-TTAGATTATCAGGGATATCCGGTAGAA | Pst I |
| 648 | Forward | AAAAAA<u>GAATTC</u>-ATGAACAGGCGCGACGCGCGGATCGAACG | Eco RI |
| | Reverse | AAAAAA<u>CTGCAG</u>-TCAAGCTGTGTGCTGATTGAATGCGAC | Pst I |

TABLE 7-continued

Oligonucleotides used for PCR to amplify complete or partial ORFs

| ORF | primer | Sequence | Restriction sites |
|---|---|---|---|
| 649 | Forward | AAAAAAGAATTC-GGTACGTCAGAACCCGCCCACCG | Eco RI |
|  | Reverse | AAAAAACTGCAG-TTAACGGCGGAAACTGCCGCCGTC | Pst I |
| 650 | Forward | AAAAAAGAATTC-ATGTCCAAACTCAAAACCATCGC | Eco RI |
|  | Reverse | AAAAAACTGCAG-TCAGACGGCATGGCGGTCTGTTTT | Pst I |
| 652 | Forward | AAAAAAGGTACC-GCTGCCGAAGACTCAGGCCTGCCGCTTTACCG | Kpn I |
|  | Reverse | AAAAAACTGCAG-TTATTTGCCCAGTTGGTAGAATGCGGC | Pst I |
| 653 | Forward | AAAAAAGAATTC-GCGGCTTTGCCGGTAATTTTCATCGG | Eco RI |
|  | Reverse | AAAAAACTGCAG-CTATGCCGGTCTGGTTGCCGGCGGCGA | Pst I |
| 656a | Forward | AAAAAAGAATTC-CGGCCGACGTCGTTGCGTCCTAAGTC | Eco RI |
|  | Reverse | AAAAAACTGCAG-CTACGATTTCGGCGATTTCCACATCGT | Pst I |
| 657 | Forward | AAAAAAGAATTC-GCAGAATTTGCCGACCGCCATTTGTGCGC | Eco RI |
|  | Reverse | AAAAAACTGCAG-TTATAGGGACTGATGCAGTTTTTTTGC | Pst I |
| 658 | Forward | CGCGGATCCCATATG-GTGTCCGGAATTGTG | BamHI-NdeI |
|  | Reverse | CCCGCTCGAG-GGCAGAATGTTTACCGTT | XhoI |
| 661 | Forward | AAAAAAGAATTC-ATGCACATCGGCGGCTATTTTATCGACAACCC | Eco RI |
|  | Reverse | AAAAAACTGCAG-TCACGACGTGTCTGTTCGCCGTCGGGC | Pst I |
| 663 | Forward | CGCGGATCCCATATG-TGTATCGAGATGAAATT | BamHI-NdeI |
|  | Reverse | CCCGCTCGAG-GTAAAAATCGGGCTGC | XhoI |
| 664 | Forward | CGCGGATCCCATATG-GCGGCTGGCGCGGT | BamHI-NdeI |
|  | Reverse | CCCGCTCGAG-AAATCGAGTTTTACACCAC | XhoI |
| 665 | Forward | AAAAAAGAATTC-ATGAAATGGGACGAAACGCGCTTCGG | Eco RI |
|  | Reverse | AAAAAACTGCAG-TCAATCCAAAATTTTGCCGACGATTTC | Pst I |
| 666 | Forward | AAAAAAGAATTC-AACTCAGGCGAAGGAGTGCTTGTGGC | Eco RI |
|  | Reverse | AAAAAATCTAGA-TCAGTTTAGGGATAGCAGGCGTAC | Xba I |
| 667 | Forward | AAAAAAGAATTC-CCGCATCCGTTTGATTTCCATTTCGTATTCGTCCG | Eco RI |
|  | Reverse | AAAAAACTGCAG-TTAATGACACAATAGGCGCAAGTC | Pst I |
| 669 | Forward | AAAAAAGAATTC-ATGCGCCGCATCATTAAAAAACACCAGCC | Eco RI |
|  | Reverse | AAAAAACTGCAG-TTACAGTATCCGTTTGATGTCGGC | Pst I |
| 670a | Forward | AAAAAAGAATTC-AAAACGCTTCGGGCGTTTCGTCTTC | Eco RI |
|  | Reverse | AAAAAACTGCAG-TTAGGAGCTTTTGGAACGCGTCGGACTGGC | Pst I |
| 671 | Forward | CGCGGATCCCATATG-ACCAGCAGGGTAAC | BamHI-NdeI |
|  | Reverse | CCCGCTCGAG-AGCAACTATAAAAACGCAAG | XhoI |

TABLE 7-continued

Oligonucleotides used for PCR to amplify complete or partial ORFs

| ORF | primer | Sequence | Restriction sites |
|---|---|---|---|
| 672 | Forward | CGCGGATCCCATATG-AGGAAAATCCGCACC | BamHI-NdeI |
|  | Reverse | CCCGCTCGAG-ACGGGATAGGCGGTTG | XhoI |
| 673 | Forward | AAAAAGAATTC-ATGGATATTGAAACCTTCCTTGCAGG | Eco RI |
|  | Reverse | AAAAACTGCAG-CTACAAACCCAGCTCGCGCAGGAA | Pst I |
| 674 | Forward | AAAAAGAATTC-ATGAAAACAGCCCGCCGCCGTTCCCG | Eco RI |
|  | Reverse | AAAAACTGCAG-TCAACGGCGTTTGGGCTCGTCGGG | Pst I |
| 675 | Forward | CGCGGATCCCATATG-AACACCATCGCCCC | BamHI-NdeI |
|  | Reverse | CCCGCTCGAG-TTCTTCGTCTTCAAACTGT | XhoI |
| 677a | Forward | AAAAAGAATTC-AGACGGCATTCCCGATCAGTCGATTTTGA | Eco RI |
|  | Reverse | AAAAACTGCAG-TTACGTATGCGCGAAATCGACCGCCGC | Pst I |
| 680 | Forward | CGCGGATCCGCTAGC-ACGAAGGGCAGTTCGG | BamHI-NheI |
|  | Reverse | CCCGCTCGAG-CATCAAAAACCTGCCGC | XhoI |
| 681 | Forward | AAAAAGAATTC-ATGACGACGCCGATGGCAATCAGTGC | Eco RI |
|  | Reverse | AAAAACTGCAG-TTACCGTCTTCCGCAAAAACAGC | Pst I |
| 683 | Forward | CGCGGATCCCATATG-TGCAGCACACCGGACAA | BamHI-NdeI |
|  | Reverse | CCCGCTCGAG-GAGTTTTTTTCCGCATACG | XhoI |
| 684 | Forward | CGCGGATCCCATATG-TGCGGTACTGTGCAAAG | BamHI-NdeI |
|  | Reverse | CCCGCTCGAG-CTCGACCATCTGTTGCG | XhoI |
| 685 | Forward | CGCGGATCCCATATG-TGTTTGCTTAATAATAAACATT | BamHI-NdeI |
|  | Reverse | CCCGCTCGAG-CTTTTTCCCCGCCGCA | XhoI |
| 686 | Forward | CGCGGATCCCATATG-TGCGGCGGTTCGGAAG | BamHI-NdeI |
|  | Reverse | CCCGCTCGAG-CATTCCGATTCTGATGAAG | XhoI |
| 687 | Forward | CGCGGATCCCATATG-TGCGACAGCAAAGTCCA | BamHI-NdeI |
|  | Reverse | CCCGCTCGAG-CTGCGCGGCTTTTTGTT | XhoI |
| 690 | Forward | CGCGGATCCCATATG-TGTTCTCCGAGCAAAGAC | BamHI-NdeI |
|  | Reverse | CCCGCTCGAG-TATTCGCCCCGTGTTTGG | XhoI |
| 691 | Forward | CGCGGATCCCATATG-GCCACGGCTTATATCCC | BamHI-NdeI |
|  | Reverse | CCCGCTCGAG-TTTGAGGCAGGAAGAAAG | XhoI |
| 694 | Forward | CGCGGATCCCATATG-TTGGTTTCCGCATCCGG | BamHI-NdeI |
|  | Reverse | CCCGCTCGAG-TCTGCGTCGGTGCGGT | XhoI |

TABLE 7-continued

Oligonucleotides used for PCR to amplify complete or partial ORFs

| ORF | primer | Sequence | Restriction sites |
|---|---|---|---|
| 695 | Forward | CGCGGATCCCATATG-TTGCCTCAAACTCGTCCG | BamHI-NdeI |
|  | Reverse | CCCGCTCGAG-TCGTTTGCGCACGGCT | XhoI |
| 696 | Forward | CGCGGATCCCATATG-TTGGGTTGCCGGCAGG | BamHI-NdeI |
|  | Reverse | CCCGCTCGAG-TTGATTGCCGCAATGATG | XhoI |
| 700a | Forward | AAAAAAGAATTC-GCATCGACAGACGGTGTGTCGTGGAC | Eco RI |
|  | Reverse | AAAAAACTGCAG-TTACGCTACCGGCACGACTTCCAAACC | Pst I |
| 701 | Forward | CGCGGATCCCATATG-AAGACTTGTTTGGATACTTC | BamHI-NdeI |
|  | Reverse | CCCGCTCGAG-TGCCGACAACAGCCTC | XhoI |
| 702 | Forward | AAAAAAGAATTC-ATGCCGTGTTCCAAAGCCAGTTGGATTTC | Eco RI |
|  | Reverse | AAAAAACTGCAG-TTAACCCCATTCCACCCGGAGAACCGA | Pst I |
| 703 | Forward | CGCGGATCCGCTAGC-CAAACGCTGGCAACCG | BamHI-NheI |
|  | Reverse | CCCGCTCGAG-TTTTGCAGGTTTGATGTTTG | XhoI |
| 704a | Forward | AAAAAAGAATTC-GCTTCTACCGGTACGCTGGCGCG | Eco RI |
|  | Reverse | AAAAAACTGCAG-TTAGTTTTGCCGGATAATATGGCGGGTGCG | Pst I |
| 707 | Forward | CGCGGATCCGCTAGC-GAAATTATTAACGATGCAGA | BamHI-NheI |
|  | Reverse | CCCGCTCGAG-GAAACTGTAATTCAAGTTGA | XhoI |
| 708 | Forward | CGCGGATCCGCTAGC-CCTTTTAAGCCATCCAAAA | BamHI-NheI |
|  | Reverse | CCCGCTCGAG-TTGACCGGTGAGGACG | XhoI |
| 710 | Forward | CGCGGATCCCATATG-GAAACCCACGAAAAAATC | BamHI-NdeI |
|  | Reverse | CCCGCTCGAG-AACGGTTTCGGTCAG | XhoI |
| 714 | Forward | CGCGGATCCCATATG-AGCTATCAAGACATCTT | BamHI-NdeI |
|  | Reverse | CCCGCTCGAG-GCGGTAGGTAAATCGGAT | XhoI |
| 716 | Forward | CGCGGATCCCATATG-GCCAACAAACCGGCAAG | BamHI-NdeI |
|  | Reverse | CCCGCTCGAG-TTTAGAACCGCATTTGCC | XhoI |
| 718 | Forward | CGCGGATCCCATATG-GAGCCGATAATGGCAAA | BamHI-NdeI |
|  | Reverse | CCCGCTCGAG-GGCGCGGGCATGGTCTTGTCC | XhoI |
| 720 | Forward | CGCGGATCCCATATG-AGCGGATGGCATACC | BamHI-NdeI |
|  | Reverse | CCCGCTCGAG-TTTTGCATAGCTGTTGACCA | XhoI |
| 723 | Forward | CGCGGATCCCATATG-CGACCCAAGCCCC | BamHI-NdeI |
|  | Reverse | CCCGCTCGAG-AATGCGAATCCGCCGCC | XhoI |

TABLE 7-continued

Oligonucleotides used for PCR to amplify complete or partial ORFs

| ORF | primer | Sequence | Restriction sites |
|---|---|---|---|
| 725 | Forward | CGCGGATCCCATATG-GTGCGCACGGTTAAA | BamHI-NdeI |
|  | Reverse | CCCGCTCGAG-TTGCTTATCCTTAAGGGTTA | XhoI |
| 726 | Forward | CGCGGATCCCATATG-ACCATCTATTTCAAAAAC | BamHI-NdeI |
|  | Reverse | CCCGCTCGAG-GCCGATGTTTAGCGTCC | XhoI |
| 728 | Forward | CGCGGATCCCATATG-TTTTGGCTGGGAACGGG | BamHI-NdeI |
|  | Reverse | CCCGCTCGAG-GTGAGAAAGGTCGCGC | XhoI |
| 729 | Forward | CGCGGATCCCATATG-TGCACCATGATTCCCCA | BamHI-NdeI |
|  | Reverse | GCCCAAGCTT-TTTGTCGGTTTGGGTATC | HindIII |
| 731 | Forward | CGCGGATCCGCTAGC-GCCGTGCCGGAGG | BamHI-NheI |
|  | Reverse | CCCGCTCGAG-ACGGGCGCGGCAG | XhoI |
| 732 | Forward | CCGGAATTCTACATATG-TCGAAACCTGTTTTTAAGAA | EcoRI-NdeI |
|  | Reverse | CCCGCTCGAG-CTTCTTATCTTTTTTATCTTTC | XhoI |
| 733 | Forward | CGCGGATCCCATATG-GCCTGCGGCGGCAA | BamHI-NdeI |
|  | Reverse | CCCGCTCGAG-TCGCTTGCCTCCTTTAC | XhoI |
| 734 | Forward | CGCGGATCCCATATG-GCCGATACTTACGGCTAT | BamHI-NdeI |
|  | Reverse | CCCGCTCGAG-TTTGAGATTTTGAATCAAAGAG | XhoI |
| 735 | Forward | CGCGGATCCCATATG-AAGCAGCAGGCGGTCA | BamHI-NdeI |
|  | Reverse | CCCGCTCGAG-ATTTCCGTAGCCGAGGG | XhoI |
| 737 | Forward | CGCGGATCCCATATG-CACCACGACGGACACG | BamHI-NdeI |
|  | Reverse | CCCGCTCGAG-GTCGTCGCGGCGGGA | XhoI |
| 739 | Forward | CGCGGATCCCATATG-GCAAAAAAACCGAACA | BamHI-NdeI |
|  | Reverse | CCCGCTCGAG-GAAGAGTTTGTCAGAATT | XhoI |
| 740 | Forward | CGCGGATCCCATATG-GCCAATCCGCCCGAAG | BamHI-NdeI |
|  | Reverse | CCCGCTCGAG-AAACGCGCCAAAATAGTG | XhoI |
| 741 | Forward | CGCGGATCCCATATG-TGCAGCAGCGGAGGG | BamHI-NdeI |
|  | Reverse | CCCGCTCGAG-TTGCTTGGCGGCAAGGC | XhoI |
| 743 | Forward | CGCGGATCCCATATG-GACGGTGTTGTGCCTGTT | BamHI-NdeI |
|  | Reverse | CCCGCTCGAG-CTTACGGATCAAATTGACG | XhoI |
| 745 | Forward | CGCGGATCCCATATG-TTTTGGCAACTGACCG | BamHI-NdeI |
|  | Reverse | CCCGCTCGAG-CAAATCAGATGCCTTTAGG | XhoI |

TABLE 7-continued

Oligonucleotides used for PCR to amplify complete or partial ORFs

| ORF | primer | Sequence | Restriction sites |
|---|---|---|---|
| 746 | Forward | CGCGGATCCCATATG-TCCGAAAACAAACAAAAC | BamHI-NdeI |
|  | Reverse | CCCGCTCGAG-TTCATTCGTTACCTGACC | XhoI |
| 747 | Forward | CCGGAATTCTAGCTAGC-CTGACCCCTTGGG | EcoRI-NheI |
|  | Reverse | GCCCAAGCTT-TTTTGATTTTAATTGACTATAGAAC | HindIII |
| 749 | Forward | CGCGGATCCCATATG-TGCCAGCCGCCG | BamHI-NdeI |
|  | Reverse | CCCGCTCGAG-TTTCAAGCCGAGTATGC | XhoI |
| 750 | Forward | CGCGGATCCCATATG-TGTTCGCCCGAACCTG | BamHI-NdeI |
|  | Reverse | CCCGCTCGAG-CTTTTTCCCCGCCGCAA | XhoI |
| 758 | Forward | CGCGGATCCCATATG-AACAATCTGACCGTGTT | BamHI-NdeI |
|  | Reverse | CCCGCTCGAG-TGGCTCAATCCTTTCTGC | XhoI |
| 759 | Forward | CGCGGATCCGCTAGC-CGCTTCACACACACCAC | BamHI-NheI |
|  | Reverse | CCCGCTCGAG-CCAGTTGTAGCCTATTTTG | XhoI |
| 763 | Forward | CGCGGATCCCATATG-CTGCCTGAAGCATGGCG | BamHI-NdeI |
|  | Reverse | CCCGCTCGAG-TTCCGCAAATACCGTTTCC | XhoI |
| 764 | Forward | CGCGGATCCCATATG-TTTTTCTCCGCCCTGA | BamHI-NdeI |
|  | Reverse | CCCGCTCGAG-TCGCTCCCTAAAGCTTTC | XhoI |
| 765 | Forward | CGCGGATCCCATATG-TTAAGATGCCGTCCG | BamHI-NdeI |
|  | Reverse | CCCGCTCGAG-ACGCCGACGTTTTTTATTAA | XhoI |
| 767 | Forward | CGCGGATCCCATATG-CTGACGGAAGGGGAAG | BamHI-NdeI |
|  | Reverse | CCCGCTCGAG-TTTCTGTACAGCAGGGG | XhoI |
| 768 | Forward | CGCGGATCCCATATG-GCCCCGCAAAAACCCG | BamHI-NdeI |
|  | Reverse | CCCGCTCGAG-TTTCATCCCTTTTTTGAGC | XhoI |
| 770 | Forward | CGCGGATCCCATATG-TGCGGCAGCGGCGAA | BamHI-NdeI |
|  | Reverse | CCCGCTCGAG-GCGTTTGTCGAGATTTTC | XhoI |
| 771 | Forward | CGCGGATCCCATATG-TCCGTATATCGCACCTTC | BamHI-NdeI |
|  | Reverse | CCCGCTCGAG-CGGTTCTTTAGGTTTGAG | XhoI |
| 772 | Forward | CGCGGATCCCATATG-TTTGCGGCGTTGGTGG | BamHI-NdeI |
|  | Reverse | CCCGCTCGAG-CAATGCCGACATCAAACG | XhoI |
| 774 | Forward | CGCGGATCCCATATG-TCCGTTTCACCCGTTCC | BamHI-NdeI |
|  | Reverse | CCCGCTCGAG-TCGTTTGCGCACGGCT | XhoI |

TABLE 7-continued

Oligonucleotides used for PCR to amplify complete or partial ORFs

| ORF | primer | Sequence | Restriction sites |
|---|---|---|---|
| 790 | Forward | CGCGGATCCCATATG-GCAAGAAGGTCAAAAAC | BamHI-NdeI |
|  | Reverse | CCCGCTCGAG-GGCGTTGTTCGGATTTCG | XhoI |
| 900 | Forward | CGCGGATCCCATATG-CCGTCTGAAATGCCG | BamHI-NdeI |
|  | Reverse | CCCGCTCGAG-ATATGGAAAAGTCTGTTGTC | XhoI |
| 901 | Forward | CGCGGATCCCATATG-CCCGATTTTTCGATG | BamHI-NdeI |
|  | Reverse | CCCGCTCGAG-AAAATGGAACAATACCAGG | XhoI |
| 902 | Forward 2 | CCGGAATTCTACATATG-TTGCACTTTCAAAGGATAATC | EcoRI-NdeI |
|  | Reverse | CCCGCTCGAG-AAAAATGTACAATGGCGTAC | XhoI |
| 903 | Forward | CCGGAATTCTAGCTAGC-CAGCGTCAGCAGCACAT | EcoRI-NheI |
|  | Reverse | CCCGCTCGAG-GAAACTGTAATTCAAGTTGAA | XhoI |
| 904 | Forward | AAAAAGGTACC-ATGATGCAGCACAATCGTTTC | Kpn I |
|  | Reverse | AAACTGCAG-TTAATATCGATAGGTTATATG | Pst I |
| 904a | Forward | AAAAAGAATTC-CGGCTCGGCATTGTGCAGATGTTGCA | Eco RI |
|  | Reverse | AAACTGCAG-TTAATATCGATAGGTTATATG | Pst I |
| 905 | Forward | CGCGGATCCCATATG-AACAAAATATACCGCATC | BamHI-NdeI |
|  | Reverse | CCCGCTCGAG-CCACTGATAACCGACAGAT | XhoI |
| 907 | Forward | CGCGGATCCCATATG-GGCGCGCAACGTGAG | BamHI-NdeI |
|  | Reverse | CCCGCTCGAG-ACGCCACTGCCAGCG | XhoI |
| 908 | Forward | AAAGAATTC-GCAGAGTTAGTAGGCGTTAATAAAAATAC | Eco RI |
|  | Reverse | AAACTGCAG-TTAATATGGTTTTGTCGTTCG | Pst I |
| 909 | Forward | CGCGGATCCCATATG-TGCGCGTGGGAAACTTAT | BamHI-NdeI |
|  | Reverse | CCCGCTCGAG-TCGGTTTTGAAACTTTGGTTTT | XhoI |
| 910 | Forward | AAAGAATTC-GCATTTGCCGGCGACTCTGCCGAGCG | Eco RI |
|  | Reverse | AAACTGCAG-TCAGCGATCGAGCTGCTCTTT | Pst I |
| 911 | Forward | AAAGAATTC-GCTTTCCGCGTGGCCGGCGGTGC | Eco RI |
|  | Reverse | AAAAAACTGCAG-GTCGACTTATTCGGCGGCTTTTTCCGC | Pst I |
| 912 | Forward | AAAAAAGAATTC-CAAATCCGTCAAAACGCCACTCAAGTATTGAG | Eco RI |
|  | Reverse | AAAAAACTGCAG-TTACAGTCCGTCCACGCCTTTCGC | Pst I |
| 913 | Forward | CGCGGATCCCATATG-GAAACCCGCCCCGC | BamHI-NdeI |
|  | Reverse | CCCGCTCGAG-AGGTTGTGTTCCAGGTTG | XhoI |
| 915 | Forward | CGCGGATCCCATATG-TGCCGGCAGGCGGAA | BamHI-NdeI |
|  | Reverse | CCCGCTCGAG-TTTGAAAATATAGGTATCAGG | XhoI |

TABLE 7-continued

Oligonucleotides used for PCR to amplify complete or partial ORFs

| ORF | primer | Sequence | Restriction sites |
|---|---|---|---|
| 914 | Forward | AAAGAATTC-GACAGAATCGGCGATTTGGAAGCACG | Eco RI |
|  | Reverse | AAACTGCAG-CTATATGCGCGGCAGGACGCTCAACGG | Pst I |
| 916 | Forward | CGCGGATCCCATATG-GCAATGATGGCGGCTG | BamHI-NdeI |
|  | Reverse | CCCGCTCGAG-TTTGGCGGCATCTTTCAT | XhoI |
| 917 | Forward | AAAAAGAATTC-CCTGCCGAAAAACCGGCACCGGC | Eco RI |
|  | Reverse | AAAAACTGCAG-TTATTTCCCCGCCTTCACATCCTG | Pst I |
| 919 | Forward | CGCGGATCCCATATG-TGCCAAAGCAAGAGCATC | BamHI-NdeI |
|  | Reverse | CCCGCTCGAG-CGGGCGGTATTCGGG | XhoI |
| 920 | Forward | CGCGGATCCCATATG-CACCGCGTCTGGGTC | BamHI-NdeI |
|  | Reverse | CCCGCTCGAG-ATGGTGCGAATGACCGA | XhoI |
| 921 | Forward | AAAAAGAATTC-TTGACGGAAATCCCCGTGAATCC | Eco RI |
|  | Reverse | AAAAACTGCAG-TCATTTCAAGGGCTGCATCTTCAT | Pst I |
| 922 | Forward. 2 | CGCGGATCCGCTAGC-TGTACGGCGATGGAGGC | BamHI-NheI |
|  | Reverse | CCCGCTCGAG-CAATCCCGGGCCGCC | XhoI |
| 923 | Forward | CGCGGATCCCATATG-TGTTACGCAATATTGTCCC | BamHI-NheI |
|  | Reverse | CCCGCTCGAG-GGACAAGGCGACGAAG | XhoI |
| 925 | Forward | CGCGGATCCCATATG-AAACAAATGCTTTTAGCCG | BamHI-NdeI |
|  | Reverse | CCCGCTCGAG-GCCGTTGCATTTGATTTC | XhoI |
| 926 | Forward | CGCGGATCCCATATG-TGCGCGCAATTACCTC | BamHI-NdeI |
|  | Reverse | CCCGCTCGAG-TCTCGTGCGCGCCG | XhoI |
| 927 | Forward | CGCGGATCCCATATG-TGCAGCCCCGCAGC | BamHI-NdeI |
|  | Reverse | CCCGCTCGAG-GTTTTTTGCTGACGTAGT | XhoI |
| 929a | Forward | AAAAAGAATTC-CGCGGTTTGCTCAAAACAGGGCTGGG | Eco RI |
|  | Reverse | AAAAATCTAGA-TTAAGAAAGACGGAAACTACTGCC | Xba I |
| 931 | Forward | AAAAAGAATTC-GCAACCCATGTTTTGATGGAAAC | Eco RI |
|  | Reverse | AAAAACTGCAG-TTACTGCCCGACAACAACGCGACG | Pst I |
| 935 | Forward | AAAAAGAATTC-GCGGATGCGCCCGCGATTTTGGATGACAAGGC | Eco RI |
|  | Reverse | AAAAACTGCAG-TCAAAACCGCCAATCCGCCGACAC | Pst I |
| 936 | Forward | CGCGGATCCCATATG-GCCGCCGTCGGCGC | BamHI-NdeI |
|  | Reverse | CCCGCTCGAG-GCGTTGGACGTAGTTTTG | XhoI |
| 937 | Forward | AAAAAGAATTC-CCGGTTTACATTCAAACCGGCGCAAC | Eco RI |
|  | Reverse | AAAAACTGCAG-TTAAAATGTATGCTGTACGCCAAA | Pst I |

TABLE 7-continued

Oligonucleotides used for PCR to amplify complete or partial ORFs

| ORF | primer | Sequence | Restriction sites |
|---|---|---|---|
| 939a | Forward | AAAAAAGAATTC-GGTTCGGCAGCTGTGATGAAACC | Eco RI |
| | Reverse | AAAAAACTGCAG-TTAACGCAAACCTTGGATAAAGTTGGC | Pst I |
| 950 | Forward | CGCGGATCCCATATG-GCCAACAAACCGGCAAG | BamHI-NdeI |
| | Reverse | CCCGCTCGAG-TTTAGAACCGCATTTGCC | XhoI |
| 953 | Forward | CGCGGATCCCATATG-GCCACCTACAAAGTGGAC | BamHI-NdeI |
| | Reverse | CCCGCTCGAG-TTGTTTGGCTGCCTCGAT | XhoI |
| 957 | Forward | CGCGGATCCCATATG-TTTTGGCTGGGAACGGG | BamHI-NdeI |
| | Reverse | CCCGCTCGAG-GTGAGAAAGGTCGCGC | XhoI |
| 958 | Forward | CGCGGATCCCATATG-GCCGATGCCGTTGCG | BamHI-NdeI |
| | Reverse | GCCCAAGCTT-GGGTCGTTTGTTGCGTC | HindIII |
| 959 | Forward | CGCGGATCCCATATG-CACCACGACGGACACG | BamHI-NdeI |
| | Reverse | CCCGCTCGAG-GTCGTCGCGGCGGGA | XhoI |
| 961 | Forward | CGCGGATCCCATATG-GCCACAAGCGACGACG | BamHI-NdeI |
| | Reverse | CCCGCTCGAG-CCACTCGTAATTGACGC | XhoI |
| 972 | Forward | AAAAAAGAATTC-TTGACTAACAGGGGGGAGCGAAATTAAAAAC | Eco RI |
| | Reverse | AAAAAATCTAGA-TTAAAAATAATCATAATCTACATTTTG | Xba I |
| 973 | Forward | AAAAAAGAATTC-ATGGACGGCGCACAACCGAAAAC | Eco RI |
| | Reverse | AAAAAACTGCAG-TTACTTCACGCGGGTCGCCATCAGCGT | Pst I |
| 982 | Forward | CGCGGATCCCATATG-GCAGCAAAAGACGTAC | BamHI-NdeI |
| | Reverse | CCCGCTCGAG-CATCATGCCGCCCATCC | XhoI |
| 983 | Forward | CGCGGATCCCATATG-TTAGCTGTTGCAACAACAC | BamHI-NdeI |
| | Reverse | CCCGCTCGAG-GAACCGGTAGCCTACG | XhoI |
| 987 | Forward | CGCGGATCCCATATG-CCCCCACTGGAAGAAC | BamHI-NdeI |
| | Reverse | CCCGCTCGAG-TAATAAACCTTCTATGGGC | XhoI |
| 988 | Forward | CGCGGATCCCATATG-TCTTTAAATTTACGGGAAAAG | BamHI-NdeI |
| | Reverse | GCCCAAGCTT-TGATTTGCCTTTCCGTTTT | HindIII |
| 989 | Forward | CCGGAATTCTACATATG-GTCCACGCATCCGGCTA | EcoRI-NdeI |
| | Reverse | CCCGCTCGAG-TTTGAATTTGTAGGTGTATTGC | XhoI |
| 990 | Forward 2 | CGCGGATCCGCTAGC-TTCAGAGCTCAGCTT | BamHI-NheI |
| | Reverse | CCCGCTCGAG-AAACAGCCATTTGAGCGA | XhoI |

TABLE 7-continued

Oligonucleotides used for PCR to amplify complete or partial ORFs

| ORF | primer | Sequence | Restriction sites |
|---|---|---|---|
| 992 | Forward | CGC<u>GGATCCCATATG</u>-GACGCGCCCGCCCG | BamHI-NdeI |
|  | Reverse | CCCG<u>CTCGAG</u>-CCAAATGCCCAACCATTC | XhoI |
| 993 | Forward | CGC<u>GGATCCCATATG</u>-GCAATGCTGATTGAAATCA | BamHI-NdeI |
|  | Reverse | CCCG<u>CTCGAG</u>-GAACACATCGCGCCCG | XhoI |
| 996 | Forward | CGC<u>GGATCCCATATG</u>-TGCGGCAGAAAATCCGC | BamHI-NdeI |
|  | Reverse | CCCG<u>CTCGAG</u>-TCTAAACCCTGTTTTCTC | XhoI |
| 997 | Forward | CCG<u>GAATTCTAGCTAGC</u>-CGGCACGCCGACGTT | EcoRI-NheI |
|  | Reverse | CCCG<u>CTCGAG</u>-GACGGCATCGCTCAGG | XhoI |

Underlined sequences indicate restriction recognition sites.

The following DNA and amino acid sequences are identified by titles of the following form: [g, m, or a] [#].[seq or pep], where "g" means a sequence from *N. gonorrhoeae*, "m" means a sequence from *N. meningitidis* B, and "a" means a sequence from *N. meningitidis* A; "#" means the number of the sequence; "seq" means a DNA sequence, and "pep" means an amino acid sequence. For example, "g001.seq" refers to an *N. gonorrohoeae* DNA sequence, number 1. The presence of the suffix "-1" to these sequences indicates an additional sequence found for the same ORF. Further, open reading frames are identified as ORF #, where "#" means the number of the ORF, corresponding to the number of the sequence which encodes the ORF, and the ORF designations may be suffixed with ".ng" or ".a", indicating that the ORF corresponds to a *N. gonorrhoeae* sequence or a *N. meningitidis* A sequence, respectively. Computer analysis was performed for the comparisons that follow between "g", "m", and "a" peptide sequences; and therein the "pep" suffix is implied where not expressly stated.

The following partial DNA sequence was identified in *N. gonorrhoeae* <SEQ ID 1>:

```
g001.seq
  1 ATGCTGCCGC AGGGGAAGGC GGCGCGGAGG GTGTCGGCGA ACGAGGTGTC
 51 CGGCAGGGCT TGCGCCCGGA TGGTGCTGGT CATCTGCCAG ACGCTGCCGA
101 AACGCGATAC TTTAAACGGC TCGGGTACGC ATACTTTACC GGTTTGGGCG
151 ATTTTGCCGA GGTCGTTGCG CAGCAAATCG ACAATCATCA CGTTTTCGGC
201 GCGGTTTTTC GGGTCGGTTT GTAACTCGGC GGCGCGGCGT TCGTCTTGTC
251 CGTCGCCCAA AATCGGCGCG GTGCCTTTCA TCGGTTCGGT GCTGATGGTG
301 CCGTCTGAAG CGATGTTGAG GAAGAGTTCG GGCGAGAAAC ACAGCGTCCA
351 CGCGGATTGC CCGGCTTCAT CGGGCAGGTG GGACAATACG GCATAG
```

This corresponds to the amino acid sequence <SEQ ID 2; ORF 001.ng>:

```
g001.pep
  1 MLPQGKAARR VSANEVSGRA CARMVLVICQ TLPKRDTLNG SGTHTLPVWA
 51 ILPRSLRSKS TIITFSARFF GSVCNSAARR SSCPSPKIGA VPFIGSVLMV
101 PSEAMLRKSS GEKHSVHADC PASSGRWDNT A*
```

The following partial DNA sequence was identified in *N. meningitidis* <SEQ ID 3>:

```
m001.seq
    1 ATGCTGCCGC AGGGGAAGGC GGCGCGGAGG ATGTCGGCGA ACGAGGTGTG

51 CGGcAssCTT ss.GCTTGGA yGGTGCTGGT CATCTGCCAA ACGCTGCCGA

101 AACGCGATAC TTTAAACGGT TCGGGTACGC ATACTGTGCC GGTTTGGGCG

151 ATTTTGCCGA GATCGTTACG CAGCAAATCG ACAATCATCA CGTTTTCGGC

201 GCGGTTTTTC GGGTCTGCTT GCAACTCGGC GGCGCGGCGT TCGTCTTGTC

251 CGTCGCCCAA AATCGGCGCG GTGCCTTTCA TCGGTTCGGT GCTGATGGTG

301 CCGTCCGAAC CGATTTTGAG GAAGAGTTCG GGCGAGAAAC ACAGCGTCCA

351 CGCGGATTGC CCCTCCGCAT CGGGCAGGTG GGACAAGACG GCATAG
```

This corresponds to the amino acid sequence <SEQ ID 4; ORF 001>:

```
m001.pep
    1  MLPQGKAARR MSANEVCGXL XAWXVLVICQ TLPKRDTLNG SGTHTVPVWA

51  ILPRSLRSKS TIITFSARFF GSACNSAARR SSCPSPKIGA VPFIGSVLMV

101  PSEPILRKSS GEKHSVHADC PSASGRWDKT A*
```

The following partial DNA sequence was identified in *N. meningitidis* <SEQ ID 5>:

```
a001.seq
    1 ATGCTGCCGC AGGGGAAGGC GGCGCGGAGG ATGTCGGCGA ACGAGGTGTG

51 CGGCAAGGCT TGGGCTTGGA TGGTGCTGGT CATCTGCCAA ACGCTGCCGA

101 AACGCGATAC TTTAAACGGT TCGGGTACGC ATACTGTGCC GGTTTGGGCG

151 ATTTTGCCGA GGTCGTTACG CAGCAAATCG ACAATCATCA CGTTTTCGGC

201 GCGGTTTTTC GGGTCTGCTT GCAACTCGGC GGCGCGGCGT TCGTCTTGTC

251 CGTCGCCCAA AATCGGCGCG GTGCCTTTCA TCGGTTCGGT GCTGATGGTG

301 CCGTCCGAAC CGATTTTGAG GAAGAGTTCG GGCGAGAAAC ACAGCGTCCA

351 CGCGGATTGC CCTTGTGCAT CGGGCAGGTG GGACAAAACG GCATAG
                                                    45
```

This corresponds to the amino acid sequence <SEQ ID 6; ORF 001.a>:

```
a001.pep
    1  MLPQGKAARR MSANEVCGKA WAWMVLVICQ TLPKRDTLNG SGTHTVPVWA

51  ILPRSLRSKS TIITFSARFF GSACNSAARR SSCPSPKIGA VPFIGSVLMV

101  PSEPILRKSS GEKHSVHADC PCASGRWDKT A* m001/a001   96.2% identity over a 131 aa overlap 10         20         30         40         50         60
m001.pep   MLPQGKAARRMSANEVCGXLXAWXVLVICQTLPKRDTLNGSGTHTVPVWAILPRSLRSKS
           ||||||||||||||||||| ||  |||||||||||||||||||||||||||||||||||
a001.pep   MLPQGKAARRMSANEVCGKAWAWMVLVICQTLPKRDTLNGSGTHTVPVWAILPRSLRSKS
                   10         20         30         40         50         60

70         80         90        100        110        120
m001.pep   TIITFSARFFGSACNSAARRSSCPSPKIGAVPFIGSVLMVPSEPILRKSSGEKHSVHADC
           ||||||||||||||||||||||||||||||||||||||||||||||||||||||||||||
a001.pep   TIITFSARFFGSACNSAARRSSCPSPKIGAVPFIGSVLMVPSEPILRKSSGEKHSVHADC
                   70         80         90        100        110        120
```

```
               130
m001.pep   PSASGRWDKTAX
           | |||||||||||
a001.pep   PCASGRWDKTAX
               130
```

Computer analysis of this amino acid sequence gave the following results:

Homology with a Predicted ORF from *N. Gonorrhoeae*
ORF 001 shows 89.3% identity over a 131 aa overlap with a predicted ORF (ORF 001.ng) from *N. gonorrhoeae*:

```
m001/g001
                 10        20        30        40        50        60
m001.pep   MLPQGKAARRMSANEVCGXLXAWXVLVICQTLPKRDTLNGSGTHTVPVWAILPRSLRSKS
           ||||||||||:|||||  |   ||||||||||||||||||||:||||||||||||||||
g001       MLPQGKAARRVSANEVSGRACARMVLVICQTLPKRDTLNGSGTHTLPVWAILPRSLRSKS
                 10        20        30        40        50        60

70        80        90       100       110       120
m001.pep   TIITFSARFFGSACNSAARRSSCPSPKIGAVPFIGSVLMVPSEPILRKSSGEKHSVHADC
           |||||||||||||:||||||||||||||||||||||||||||||:||||||||||||||
g001       TIITFSARFFGSVCNSAARRSSCPSPKIGAVPFIGSVLMVPSEAMLRKSSGEKHSVHADC
                 70        80        90       100       110       120

130
m001.pep   PSASGRWDKTAX
           |::|||||:|||
g001       PASSGRWDNTAX
                130
```

The following partial DNA sequence was identified in *N. gonorrhoeae* <SEQ ID 7>:

```
g003.seq
     1  ATGGTCGTAT TCGTGGCTGA AGGCGTATTC GGTCGCGCTG TTTTGGGTCA

51  CTTGGTATTG CTCTTCGGTC AGGGTGCGTT TGAGTTCGGC GTCACTCGGT

101  TTTTTATACG TTGCCGCGTC GAAGCCTTTG CCTTGCGGTG CGGCTTTGGT

151  TTTGCCCGGC AGCGGTTCGT CGGCTTTGCG GATGTCGATG TGGCAGTAGC

201  CGTTGGGGTT TTTAATCAGG TAGTCCTGAT GGTATTCCTC GGCGTCGTAG

251  AAGTTTTTCA GCGGTTCGTT TTCAACAACG AGGGGCAGTT GGTATTTTTG

301  CTGCTCGCGT TTGAGGGCGG CGGCGATGAC GGCTTTTTCG GCGGGGTCGG

351  TGTAGTACAC GCCGCTGCGG TATTGCGTGC CGGTGTCGTT ACCCTGTTTG

401  TTGAGGCTGG TCGGATCAAC GACGCGGAAA TAATATTGCA GGATGTCGTC

451  CAGgCTGagt TTGTCGGCAT CGTaggtcac tTTGACGGTC TCGGCATGAC

501  CCGTATGGCG GTaggacact tctTCgtanc TcGGGtTTTC CGTGttGCCG

551  TTGGCgttac cGGATACCGC gtcaACCACG CCGTcgatgc gttggaAATa 601  ggCTTCCAAg ccccaaaagc agccgccggc gaagtaaatg gtgcccgtgt 651  tcatgattGC TGa
```

This corresponds to the amino acid sequence <SEQ ID 8; ORF 003.ng>:

```
g003.pep
     1  MVVFVAEGVF GRAVLGHLVL LFGQGAFEFG VTRFFIRCRV EAFALRCGFG

51  FARQRFVGFA DVDVAVAVGV FNQVVLMVFL GVVEVFQRFV FNNEGQLVFL

101  LLAFEGGGDD GFFGGVGVVH AAAVLRAGVV TLFVEAGRIN DAEIILQDVV
```

-continued

```
151 QAEFVGIVGH FDGLGMTRMA VGHFFVRVFR VAVGVTGYRV NHAVDALEIG

201 FQAPKAAAGE VNGARVHDC
```

The following partial DNA sequence was identified in *N. meningitidis* <SEQ ID 9>:

```
m003.sq
    1 ATGGTCGTAT TCGTGGCTGA AGGCATATTC GGTCGCGCTG TTTTGGGTAA

51 CTTGsTATTG CTCTTCGGTC AGGGTGCGTT TGAGTTCGGC GTCACTCGGT

101 TTTTTATACG TTGCCGCGTC GAAGCCTTTG CCTTGCGGGG CGGTCTTGGT

151 TTTGCCCGGC AGCGGTTCGT CAGCkTTGCG GATGTCGATG TGGCAGTAGC

201 CGTTGGGGTT TTTAATCAAG TAGTCCTGAT GGTATTCCTC GGCATCGTAG

251 AAGTTTTtCA GCGGCTCGTT TTCAACAACG AGGGGCAGTT GGTATTTTTG

301 CTGCTCGCGT TTGAGGGCGk CGGCGATGAC GGCTTTTTCG kCGGGGTCGG

351 TGTAGTACAC GCCGCTGCGG TATTGCGTAC CGGTGTCGTT GCCCTGTTTG

401 TTGAGGCTGG TCGGATCAAC GACGCGGAAG AAATATTGCA GGATGTCGTC

451 TAGGCTGAGT TTGTCGGCAT CGTAGGTCAC TTTGACGGTT TCGGCGTGGC

501 CCGTATGGCG GTAGGACACG TCTTCATAGC TCGGATTTTT CGTGTTGCCG

551 TTGGCGTAGC CGGATACCGC GTCAACCACG CCGTCGATGC GTTGGAAATA

601 GGCTTCCAAG CCCCAGAAGC AGCg.CCGGC GAGGTAAATG GTGCGCGTGT

651 TCATGATTTT TGA
```

This corresponds to the amino acid sequence <SEQ ID 10; ORF 003>:

```
m003.pep Length: 221
    1 MVVFVAEGIF GRAVLGNLXL LFGQGAFEFG VTRFFIRCRV EAFALRGGLG

51 FARQRFVSXA DVDVAVAVGV FNQVVLMVFL GIVEVFQRLV FNNEGQLVFL

101 LLAFEGXGDD GFFXGVGVVH AAAVLRTGVV ALFVEAGRIN DAEEILQDVV

151 *AEFVGIVGH FDGFGVARMA VGHVFIARIF RVAVGVAGYR VNHAVDALEI

201 GFQAPEAAXG EVNGARVHDF *
```

The following partial DNA sequence was identified in *N. meningitidis* <SEQ ID 11>:

```
a003.seq
    1 ATGGTCGTAT TCGTGGCTGA AGGCATATTC GGTCGCGCTG TTTTGGGTAA

51 CTTGGTATTG CTCTTCGGTC AGGGTGCGTT TGAGTTCGGC GTCACTCGGT

101 TTTTTATACG TTGCCGCGTC GAAGCCTTTG CCTTGCGGTG CGGTCTTGGT

151 TTTGCCCGGC AGCGGTTCGT CGGCTTTGCG GATATCGATG TGGCAGTAGC

201 CGTTGGGGTT TTTAATCAAG TAGTCCTGAT GGTATTCCTC GGCATCGTAG

251 AAGTTTTTCA GCGGCTCGTT TTCAACAACG AGGGGCAGTT GGTATTTTTG

301 CTGCTCGCGT TTGAGGGCGG CGGCGATGAC GGCTTTTTCG GCGGGGTCGG

351 TGTAGTACAC GCCGCTGCGG TATTGCGTAC CGGTGTCGTT GCCCTGTTTG

401 TTGAGGCTGG TCGGATCAAC GACGCGGAAG AAATATTGCA GGATGTCGTC

451 TAGGCTGAGT TTGTCGGCAT CGTAGGTCAC TTTGACGGTT TCGGCGTGGC
```

```
-continued
501  CCGTATGGCG GTAGGACACG TCTTCATAGC TCGGATTTTT CGTGTTGCCG

551  TTGGCGTAGC CGGATACCGC GTCAACCACG CCGTCGATGC GTTGGAAATA

601  GGCTTCCAAG CCCCAGAAGC AGCCGCCGGC GAGGTAGATG GTGCGCGTGT

651  TCATGATTTT TGA
```

This corresponds to the amino acid sequence <SEQ ID 12; ORF 003.a>:

```
a003.pep
  1  MVVFVAEGIF GRAVLGNLVL LFGQGAFEFG VTRFFIRCRV EAFALRCGLG

51  FARQRFVGFA DIDVAVAVGV FNQVVLMVFL GIVEVFQRLV FNNEGQLVFL

101  LLAFEGGGDD GFFGGVGVVH AAAVLRTGVV ALFVEAGRIN DAEEILQDVV

151  *AEFVGIVGH FDGFGVARMA VGHVFIARIF RVAVGVAGYR VNHAVDALEI

201  GFQAPEAAAG EVDGARVHDF *
``` m003/a003 95.9% identity over a 220 aa overlap

```
                  10         20         30         40         50         60
   m003.pep  MVVFVAEGIFGRAVLGNLXLLFGQGAFEFGVTRFFIRCRVEAFALRGGLGFARQRFVSXA
             ||||||||||||||||| : |||||||||||||||||||||||||| : ||||||||| : |
   a003      MVVFVAEGIFGRAVLGNLVLLFGQGAFEFGVTRFFIRCRVEAFALRCGLGFARQRFVGFA
                  10         20         30         40         50         60

70         80         90        100        110        120
   m003.pep  DVDVAVAVGVFNQVVLMVFLGIVEVFQRLVFNNEGQLVFLLLAFEGXDDGFFXGVGVVH
             | : ||||||||||||||||||||||||||||||||||||||||||| |||||| |||||
   a003      DIDVAVAVGVFNQVVLMVFLGIVEVFQRLVFNNEGQLVFLLLAFEGGDDGFFGGVGVVH
                  70         80         90        100        110        120

130        140        150        160        170        180
   m003.pep  AAAVLRTGVVALFVEAGRINDAEEILQDVVXAEFVGIVGHFDGFGVARMAVGHVFIARIF
             ||||||||||||||||||||||||||||||||||||||||||||||||||||||||||
   a003      AAAVLRTGVVALFVEAGRINDAEEILQDVVXAEFVGIVGHFDGFGVARMAVGHVFIARIF
                 130        140        150        160        170        180

190        200        210        220
   m003.pep  RVAVGVAGYRVNHAVDALEIGFQAPEAAXGEVNGARVHDFX
             |||||||||||||||||||||||||||| ||| : ||||||||
   a003      RVAVGVAGYRVNHAVDALEIGFQAPEAAXGEVDGARVHDFX
                 190        200        210        220
```

Computer analysis of this amino acid sequence gave the following results:

Homology with a Predicted ORF from *N. Gonorrhoeae*

ORF 003 shows 88.6% identity over a 219 aa overlap with a predicted ORF (ORF 003.ng) from *N. gonorrhoeae*:

```
m003/g003
                  10         20         30         40         50         60
   m003.pep  MVVFVAEGIFGRAVLGNLXLLFGQGAFEFGVTRFFIRCRVEAFALRGGLGFARQRFVSXA
             |||||||| : ||||||| : | ||||||||||||||||||||||||| : |||||||| : |
   g003      MVVFVAEGVFGRAVLGHLVLLFGQGAFEFGVTRFFIRCRVEAFALRCGFGFARQRFVGFA
                  10         20         30         40         50         60

70         80         90        100        110        120
   m003.pep  DVDVAVAVGVFNQVVLMVFLGIVEVFQRLVFNNEGQLVFLLLAFEGXDDGFFXGVGVVH
             ||||||||||||||||||| : |||||| : ||||||||||||||||| |||||| |||||
   g003      DVDVAVAVGVFNQVVLMVFLGVVEVFQRFVFNNEGQLVFLLLAFEGGDDGFFGGVGVVH
                  70         80         90        100        110        120

130        140        150        160        170        180
   m003.pep  AAAVLRTGVVALFVEAGRINDAEEILQDVVXAEFVGIVGHFDGFGVARMAVGHVFIARIF
             |||||| : ||| : ||||||||||||| |||||| ||||||||||||| : | : : ||||||  | : |
   g003      AAAVLRAGVVTLFVEAGRINDAEIILQDVVQAEFVGIVGHFDGLGMTRMAVGHFFV-RVF
                 130        140        150        160        170        180
```

```
                        190       200       210       220
m003.pep     RVAVGVAGYRVNHAVDALEIGFQAPEAAXGEVNGARVHDFX
             ||||||:||||||||||||||||||:||  ||||||||||
g003         RVAVGVTGYRVNHAVDALEIGFQAPKAAAGEVNGARVHDC
                        190       200       210
```

The following partial DNA sequence was identified in *N. gonorrhoeae* <SEQ ID 13>:

```
g004.seq
    1 ATGgtagAAC GGCATATCCA GCATTTGCGG AACGGTCATC TTCATTTGAT

51 GCGCCCATGC CAACAagtga gccaAAtgtT CGGCGGCAGG GCCTacgatT

101 TCCGCGCCGA TAAagcggcc gGTGgctTTT tcgGCataca ggcgcaTatg 151 gCCTTTGTTT ACCAgcatca cgcggctgcg accttgaTTT TTGAACGATA 201 CTTCGCCgaT GACAAATTCG TCGGCTTGGT ATTGCGCGGC AACCTGCGCG 251 TATTTCAAAC CGACAAAGCC GATTTGCgga ctggtaaACA CCACGCCAAT 301 GGTgctgcgg cGCAAACCGC TGCCGATATt cgGgtagcgg ccccgcgtta 351 ttgcccggca atcttacctt ggtcggcggc ttcatGCAGC AGGGGCagtt 401 ggttggacgc gtcgcccgca ataAAGATAT GCGGAATgct ggtCTGCATg 451 gtCAGCGGAT CGGCAACGGG tacgccgcgc gcgtctttgT CGATATTGAT 501 GTTTTCCAAA CCGATATtgT CAACGTTCGG ACGGCgACCT ACGGCTGCCA

551 ACATATATTC GGCAACAAAT ACGCCTTTTT CGCCATCCTG CTCCCAATGG

601 ACTtctACAT TGCCGTCTGC GTCGAGTTTG ACCTCGGTTT TAGCATCCAG

651 ATGCAGTTTC AATtctTCTC CGAACACGGC TTTCGCCTCG TCTGAAACAA

701 CGGGGTCGGA AATGCCGCCG ATGATTCCGC CCAAACCGAA AATTTCAACT

751 TTCACACCCA AACGGTGCAA TGCCTGA
```

This corresponds to the amino acid sequence <SEQ ID 14; ORF 004.ng>:

```
g004.pep
    1 MVERHIQHLR NGHLHLMRPC QQVSQMFGGR AYDFRADKAA GGFFGIQAHM

51 AFVYQHHAAA TLIFERYFAD DKFVGLVLRG NLRVFQTDKA DLRTGKHHAN

101 GAAAQTAADI RVAAPRYCPA ILPWSAASCS RGSWLDASPA IKICGMLVCM
                                          ―――――――――――――――
  151 VSGSATGTPR ASLSILMFSK PILSTFGRRP TAANIYSATN TPFSPSCSQW
      ―

201 TSTLPSASSL TSVLASRCSF NSSPNTAFAS SETTGSEMPP MIPPKPKIST

251 FTPKRCNA*
```

The following partial DNA sequence was identified in *N. meningitidis* <SEQ ID 15>:

```
m004.seq
    1 ATGGTAGAAC GGCATATCCA GCATTTGCGG AACGGTCATC TTCATTTGAT

51 GTGCCCAAGC CAACAGGTGC GCCAAATGTT CGGCGGCAGG GCCTACGATT

101 TCCGCGCCGA TAAAGCGGCC GGTGGCTTTT TCGGCATACA GGCGCATATG

151 GCCTTTGTTC ACCAGCATCA CGCGGCTGCG GCCTTGGTTT TTGAACGATA

201 CTTCGCCGAT GACAAATTCG TCGGCTTGGT ATTGCGCGGC AACCTGCGCG

251 TATTTCAGAC CGACAAAGCC GATTTGCGGA CTGGTAAACA CCACGCCGAT
```

```
-continued
301  GGTGCTGCGC CGCAAACCGC CGCCGATATT CGGGTAGCGG CCGCGTTATC

351  GCCGGCAATC TTGCCTTGGT CGGCAGCTTC ATGCAGCAGA GGCAGTTGGT

401  TGGACGCATC GCCTGCGATG AAGATATGCG GAATACTGGT CTGCATGGTC

451  AGCGGGTCGG CAACAGGTAC GCCGCGCGCA TCTTTTTCGA TATTGATATT

501  TTCCAAACCG ATATTGTCAA CGTTCGGACG GCGGCCCACG GCTGCCAGCA

551  TATATTCGGC AACAAATACG CCTTTTTCGC CATCCTGCTC CCAATGGACT

601  TCTACATTGC CGTCTGCATC GAGTTTGACC TCGGTTTTAG CATCCAGATG

651  CAGTTTCAAT TCTTCGCCGA ACACGGCGTT CGCCTCGTCT GAAACGACGG

701  GGTCGGAAAT GCCGCCGATG ATTCCGCCCA AACCGAAAAT TTCAACTTTC

751  ACGCCCAAAC GGTGCAATGC CTGA
```

This corresponds to the amino acid sequence <SEQ ID 16; ORF 004>:

```
m004.pep
  1  MVERHIQHLR NGHLHLMCPS QQVRQMFGGR AYDFRADKAA GGFFGIQAHM

51  AFVHQHHAAA ALVFERYFAD DKFVGLVLRG NLRVFQTDKA DLRTGKHHAD

101  GAAPQTAADI RVAAALSPAI LPWSAASCSR GSWLDASPAM KICGILVCMV

151  SGSATGTPRA SFSILIFSKP ILSTFGRRPT AASIYSATNT PFSPSCSQWT

201  STLPSASSLT SVLASRCSFN SSPNTAFASS ETTGSEMPPM IPPKPKISTF

251  TPKRCNA*
```

The following partial DNA sequence was identified in *N. meningitidis* <SEQ ID 17>:

```
a004.seq
  1  ATGGTAGAAC GGCATATCCA GCATTTGCGG AACGGTCATC TTCATTTGAT

51  GTGCCCAAGC CAACAGGTGC GCCAAATGTT CGGCGGCCGG ACCTACGATT

101  TCTGCGCCGA TGAAGCGGCC GGTGGCTTTT TCGGCATACA GGCGCATATG

151  GCCTTTGTTT ACCAGCATCA CGCGGCTGCG GCCTTGGTTT TTGAACGATA

201  CTTCGCCGAT GACAAATTCG TCGGCTTGGT ATTGCGCGGC AACCTGCGCG

251  TATTTCAAAC CGACAAAGCC GATTTGCGGA CTGGTGAACA CTACGCCGAT

301  GGTGCTGCGG CGCAAACCGC CGCCGATATT CGGGTAGCGG CCGCGTTATC

351  GCCGGCAATC TTGCCTTGGT CGGCGGCTTC ATGCAGCAGG GGCAGTTGGT

401  TGGACGCGTC GCCCGCAATA AAGATATGCG GAATACTGGT CTGCATAGTC

451  AGCGGATCGG CAACGGGTAC GCCGCGCGCA TCTTTTTCGA TATTGATGTT

501  TTCCAAACCG ATATTGTCAA CGTTCGGACG GCGGCCTACG GCTGCCAGCA

551  TATATTCGGC AACAAATACG CCTTTTTCGC CATCCTGCTC CCAATGGACT

601  TCTACATTGC CGTCTGCGTC GAGTTTGGCC TCGGTTTTAG CATCCAAATG

651  CAGTTTCAAT TCTTCACCGA ACACGGCTTT CGCCTCGTCT GAAACGACGG

701  GGTCGGAAAT GCCGCCGATG ATGCCACCCA AACCGAAAAT TTCAACTTTC

751  ACGCCCAAAC GGTGCAATGC CTGA
```

This corresponds to the amino acid sequence <SEQ ID 18; ORF 004.a>:

```
a004.pep
    1 MVERHIQHLR NGHLHLMCPS QQVRQMFGGR TYDFCADEAA GGFFGIQAHM

51 AFVYQHHAAA ALVFERYFAD DKFVGLVLRG NLRVFQTDKA DLRTGEHYAD

101 GAAAQTAADI RVAAALSPAI LPWSAASCSR GSWLDASPAI KICGILVCIV

151 SGSATGTPRA SFSILMFSKP ILSTFGRRPT AASIYSATNT PFSPSCSQWT

201 STLPSASSLA SVLASKCSFN SSPNTAFASS ETTGSEMPPM MPPKPKISTF

251 TPKRCNA*
``` m004/a004 94.9% identity over a 257 aa overlap

```
                    10         20         30         40         50         60
   m004.pep MVERHIQHLRNGHLHLMCPSQQVRQMFGGRAYDFRADKAAGGFFGIQAHMAFVHQHHAAA
            ||||||||||||||||||||||||||||||:|||  ||:||||||||||||||:||||||
       a004 MVERHIQHLRNGHLHLMCPSQQVRQMFGGRTYDFCADEAAGGFFGIQAHMAFVYQHHAAA
                    10         20         30         40         50         60

70         80         90        100        110        120
   m004.pep ALVFERYFADDKFVGLVLRGNLRVFQTDKADLRTGKHHADGAAPQTAADIRVAAALSPAI
            ||||||||||||||||||||||||||||||||||||:|:|||| ||||||||||||||||
       a004 ALVFERYFADDKFVGLVLRGNLRVFQTDKADLRTGEHYADGAAAQTAADIRVAAALSPAI
                    70         80         90        100        110        120

130        140        150        160        170        180
   m004.pep LPWSAASCSRGSWLDASPAMKICGILVCMVSGSATGTPRASFSILIFSKPILSTFGRRPT
            |||||||||||||||||||:|||||||||:||||||||||||||||:|||||||||||||
       a004 LPWSAASCSRGSWLDASPAIKICGILVCIVSGSATGTPRASFSILMFSKPILSTFGRRPT
                   130        140        150        160        170        180

190        200        210        220        230        240
   m004.pep AASIYSATNTPFSPSCSQWTSTLPSASSLTSVLASRCSFNSSPNTAFASSETTGSEMPPM
            |||||||||||||||||||||||||||||||:||||:|||||||||||||||||||||||
       a004 AASIYSATNTPFSPSCSQWTSTLPSASSLASVLASKCSFNSSPNTAFASSETTGSEMPPM
                   190        200        210        220        230        240

250
   m004.pep IPPKPKISTFTPKRCNAX
            :|||||||||||||||||
       a004 MPPKPKISTFTPKRCNAX
                   250
```

Computer analysis of this amino acid sequence gave the following results:

Homology with a Predicted ORF from *N. Gonorrhoeae*

ORF 004 shows 93.4% identity over a 258 aa overlap with a predicted ORF (ORF 004.ng) from *N. gonorrhoeae*:

```
   m004/g004
                    10         20         30         40         50         60
   m004.pep MVERHIQHLRNGHLHLMCPSQQVRQMFGGRAYDFRADKAAGGFFGIQAHMAFVHQHHAAA
            |||||||||||||||| |||  |||||||||||||||||||||||||||||||:||||||
       g004 MVERHIQHLRNGHLHLMRPCQQVSQMFGGRAYDFRADKAAGGFFGIQAHMAFVYQHHAAA
                    10         20         30         40         50         60

70         80         90        100        110        120
   m004.pep ALVFERYFADDKFVGLVLRGNLRVFQTDKADLRIGKHHADGAAPQTAADIRVAAA-LSPA
            :|:|||||||||||||||||||||||||||||||:|||||| ||||||||||||    ||
       g004 TLIFERYFADDKFVGLVLRGNLRVFQTDKADLRTGKHHANGAAAQTAADIRVAAPRYCPA
                    70         80         90        100        110        120

120        130        140        150        160        170        179
   m004.pep ILPQSAASCSRGSWLDASPAMKICGILVCMVSGSATGTPRASFSILIFSKPILSTFGRRP
            |||:||||||||||||||||:||||:|||||||||||||||||:||:|||||||||||||
       g004 ILPWSAASCSRGSWLDASPAIKICGMLVCMVSGSATGTPRASLSILMFSKPILSTFGRRP
                   130        140        150        160        170        180

180        190        200        210        220        230        239
   m004.pep TAASIYSATNTPFSPSCSQWTSTLPSASSLTVLASRCSFNSSPNTAFASSETTGSEMPP
            |||:|||||||||||||||||||||||||||:||||||||||||||||||||||||:|||
       g004 TAANIYSATNTPFSPSCSQWTSTLPSASSLTSVLASRCSFNSSPNTAFASSETTGSEMPP
                   190        200        210        220        230        240
```

```
                    240        250
m004.pep    MIPPKPKISTFTPKRCNAX
            ||||||||||||||||||
g004        MIPPKPKISTFTPKRCNA
                       250
```

The following partial DNA sequence was identified in *N. gonorrhoeae* <SEQ ID 19>:

```
g005.seq
    1 ATGGGGATGG ACAATATTGA TATGTTCATG CCTGAACAAG AGGAAATCCA

51 ATCAATGTGG AAAGAAATTT TACTGAATTA CGGTATTTTC CTGCTCGAAC

101 TGCTTACCGT GTTCGGCGCA ATTGCGCTGA TTGTGTTGGC TATCGTACAG

151 AGTAAGAAAC AGTCGGAAAG CGGCAGTGTC GTACTGACAG ATTTTTCGGA

201 AAATTATAAA AAACAGCGGC AATCGTTTGA AACATTCTTT TTAAGCGAGG

251 AAGAGACAAA ACATCAGGAA AAAAAGAAA AGAAAAAGGA AAAGGCGGAA

301 GCCAAAGCAG AGAAAAAGCG TTTGAAGGAG GGCGGGGAGA AATCTGCCGA

351 AACGCAAAAA TCCCGCCTTT TTGTGTTGGA TTTTGACGGC GATTTGTATG

401 CACACGCCGT AGAATCCTTG CGTCATGAGA TTACGGCGGT GCTTTTGATT

451 GCCAAGCCTG AAGATGAGGT TCTGCTCAGA TTGGAAAGTC CGGGCGGCGT

501 GGTTCACGGT TACGGTTTGG CGGCTTCGCA GCTTAGGCGT TTGCGCGAAC

551 GCAATATTCC GCTGAccgtc gccgTCGATA AGGTCGCGGC AAGCGgcggc 601 tatatgatgg cgtgtgtgGC GGATAAAATT GTTTCCGCtc cgtttgcggt 651 catcggttcg gtgggtgtgg tgGcggaagt gcCGAATATC CAccgCctGT

701 TGAAAAAACA TGATATTGAT GTGGATGTGA TGACGGCGGG CGAATTTAAG

751 CGCACGGTTA CTTTTATGGG TGAAAATACG GAAAAGGGCA AACAGAAATT

801 CCGGCAGGAA CTGGAGGAAA CGCATCAGTT GTTCAAGCAG TTTGTCAGTG

851 AAAACCGCCC CGGGTTGGAT ATTGAAAAAA TAGCGACGGG CGAGCATTGG

901 TTCGGCCGGC AGGCGTTGGC GTTGAACTTG ATTGACGAGA TTTCGACCAG

951 TGATGATTTG TTGTTGAAAG CGTTTGAAAA CAAACAGGtt aTCGAAGTGA

1001 AATATCAGGA GAAGCGAAGC CTGATCCAGC GCATTGGTTT GCAGGCGGAA

1051 GCTTCCGTTG AAAAGTTGTT TGCCAAACTT GTCAACCGGC GAGCGGATGT

1101 GATGTAG
```

This corresponds to the amino acid sequence <SEQ ID 20; ORF 005.ng>:

```
g005.pep
    1 MGMDNIDMFM PEQEEIQSMW KEILLNYGIF LLELLTVFGA IALIVLAIVQ

51 SKKQSESGSV VLTDFSENYK KQRQSFETFF LSEEETKHQE KKEKKKEKAE

101 AKAEKKRLKE GGEKSAETQK SRLFVLDFDG DLYAHAVESL RHEITAVLLI

151 AKPEDEVLLR LESPGGVVHG YGLAASQLRR LRERNIPLTV AVDKVAASGG

201 YMMACVADKI VSAPFAVIGS VGVVAEVPNI HRLLKKHDID VDVMTAGEFK

251 RTVTFMGENT EKGKQKFRQE LEETHQLFKQ FVSENRPGLD IEKIATGEHW

301 FGRQALALNL IDEISTSDDL LLKAFENKQV IEVKYQEKRS LIQRIGLQAE

351 ASVEKLFAKL VNRRADVM*
```

The following partial DNA sequence was identified in *N. meningitidis* <SEQ ID 21>:

```
m005.seq
   1 ATGGACAATA TTGACATGTT CATGCCTGAA CAAGAGGAAA TCCAATCAAT
  51 GTGGAAAGAA ATTTTACTGA ATTACGGTAT TTTCCTGCTC GAACTGCTTA
 101 CCGTGTTCGG CGCAATTGCG CTGATTGTGT TGGCTATCGT ACAGAGTAAG
 151 AAACAGTCGG AwAGCGGCAG TGTCGTACTG ACGGATTTTT CGGAAAATTA
 201 TAAAAAACAG CGGCAATCGT TTGAAGCATT CTTTTTAAGC GGGGAAGAGG
 251 CACAACATCA GGAAAAAGAG GAAAAGAAAA AGGAAAAGGC GGAAGCCAAA
 301 GCAGAGAAAA A.CGTTTGAA GGAGGGTGGG GAGAAATCTG CCGAAACGCA
 351 nAAATCACGC CTTTTTGTGT TGGANNNNNN NNNNNNNNNN NNNNNNNNNN
 401 NNNNNNNNNN NNNNNNNNNN NNNNNNNNNN NNNNNNNNNN NNNNNNNNNN
 451 NNNNNNNNNN NNNNNNNNNN NNNNNNNNNN NNNNNNNNNN NNNNNNNNNN
 501 NNNNNNNNNN NNNNNNNNNN NNNNNNNNNN NNNNNNNNNN NNNNNNNNNN
 551 NNNNNNNNNN NNNNNNNNNN NNNNNNNNNN NNGCGAGCGG CGGTTATATG
 601 ATGGCGTGTG TGGCGGATAA AATTGCTTCC GCTCCGTTTG CGATTGTCGG
 651 TTCGGTGGGT GTGGTGGCGG AAGTACCGAA TATCCACCGC CTGTTGAAAA
 701 AACATGATAT TGATGTGGAT GTGATGACGG CGGGCGAATT TAAGCGCACG
 751 GTTACTTTTA TGGGTGAAAA TACGGAAAAG GGCAAACAGA AATTCCGACA
 801 GGAACTGGAG GAAACGCATC AGTTGTTCAA GCAGTTTGTC AGCGAGAACC
 851 GCCCTCAATT GGATATTGAG GAAGTGGCAA CGGGCGAGCA TTGGTTCGGT
 901 CGGCAGGCGT TGGCGTTGAA CTTGATTGAC GAGATTTCGA CCAGTGATGA
 951 TTTGTTGTTG AAAGCGTTTG AAAACAAACA GGTTATCGAA GTGAAATATC
1001 AGGAGAAGCA AAGCCTGATC CAGCGCATTG GTTTGCAGGC GGAAGCTTCT
1051 GTTGAAAAGT TGTTTGCCAA ACTTGTCAAC CGGCGGGCGG ATGTGATGT A
1101 G
```

This corresponds to the amino acid sequence <SEQ ID 22; ORF 005>:

```
m005.pep
   1 MDNIDMFMPE QEEIQSMWKE ILLNYGIFLL ELLTVFGAIA LIVLAIVQSK
  51 KQSXSGSVVL TDFSENYKKQ RQSFEAFFLS GEEAQHQEKE EKKKEKAEAK
 101 AEKXRLKEGG EKSAETXKSR LFVLXXXXXX XXXXXXXXXX XXXXXXXXXX
 151 XXXXXXXXXX XXXXXXXXXX XXXXXXXXXX XXXXXXXXXX XXXXASGGYM
 201 MACVADKIAS APFAIVGSVG VVAEVPNIHR LLKKHDIDVD VMTAGEFKRT
 251 VTFMGENTEK GKQKFRQELE ETHQLFKQFV SENRPQLDIE EVATGEHWFG
 301 RQALALNLID EISTSDDLLL KAFENKQVIE VKYQEKQSLI QRIGLQAEAS
 351 VEKLFAKLVN RRADVM*
```

The following partial DNA sequence was identified in *N. meningitidis* <SEQ ID 23>:

```
a005.seq
   1 ATGGACAATA TTGACATGTT CATGCCTGAA CAAGAGGAAA TCCAATCAAT
  51 GTGGAAAGAA ATTTTACTGA ATTACGGTAT TTTCCTGCTC GAACTGCTTA
 101 CCGTGTTCGG CGCAATTGCG CTGATTGTGT TGGCTATCGT ACAGAGTAAG
 151 AAACAGTCGG AAAGCGGCAG TGTCGTACTG ACGGATTTTT CGGAAAATTA
 201 TAAAAAACAG CGGCAATCGT TTGAAGCATT CTTTTTAAGC GGGGAAGAGG
 251 CAAAACATCA GGAAAAAGAG GAAAAGAAAA AGGAAAAGGC GGAAGCCAAA
 301 GCAGAGAAAA AGCGTTTGAA GGAGGGTGGG GAGAAATCTT CCGAAACGCA
 351 AAAATCCCGC CTTTTTGTGT TGGATTTTGA CGGCGATTTG TATGCACACG
 401 CCGTAGAATC CTTGCGTCAT GAGATTACGG CGGTGCTTTT GATTGCCAAG
 451 CCTGAAGATG AGGTTCTGCT TAGATTGGAA AGTCCGGGCG GCGTGGTTCA
 501 CGGTTACGGT TTGGCGGCTT CGCAGCTTAG GCGTTTGCGC GAACGCAATA
 551 TTCCGCTGAC CGTCGCCGTC GATAAGGTGG CGGCGAGCGG TGGTTATATG
 601 ATGGCGTGTG TGGCGGATAA AATTGTTTCC GCTCCGTTTG CGATTGTCGG
 651 TTCGGTGGGT GTTGTAGCGG AAGTACCGAA TATCCACCGC CTGTTGAAAA
 701 AACATGATAT TGATGTGGAT GTGATGACGG CGGGCGAATT TAAGCGCACG
 751 GTTACTTTTA TGGGTGAAAA TACGGAAAAG GGCAAACAGA AATTCCGACA
 801 GGAACTGGAG GAAACGCATC AGTTGTTCAA GCAGTTTGTC AGCGAGAACC
 851 GCCCTCAATT GGATATTGAG GAAGTGGCAA CGGGCGAGCA TTGGTTCGGT
 901 CGGCAGGCGT TGGCGTTGAA CTTGATTGAC GAGATTTCGA CCAGTGATGA
 951 TTTGTTGTTG AAAGCGTTTG AAAACAAACA GGTTATCGAA GTGAAATATC
1001 AGGAGAAGCA AAGCCTGATC CAGCGCATTG GTTTGCAGGC GGAAGCTTCT
1051 GTTGAAAAGT TGTTTGCCAA ACTTGTCAAC CGGCGGGCGG ATGTGATGTA
1101 G
```

This corresponds to the amino acid sequence <SEQ ID 24; ORF 005.a>:

```
a005.pep
   1 MDNIDMFMPE QEEIQSMWKE ILLNYGIFLL ELLTVFGAIA LIVLAIVQSK
  51 KQSESGSVVL TDFSENYKKQ RQSFEAFFLS GEEAKHQEKE EKKKEKAEAK
 101 AEKKRLKEGG EKSSETQKSR LFVLDFDGDL YAHAVESLRH EITAVLLIAK
 151 PEDEVLLRLE SPGGVVHGYG LAASQLRRLR ERNIPLTVAV DKVAASGGYM
 201 MACVADKIVS APFAIVGSVG VVAEVPNIHR LLKKHDIDVD VMTAGEFKRT
 251 VTFMGENTEK GKQKFRQELE ETHQLFKQFV SENRPQLDIE EVATGEHWFG
 301 RQALALNLID EISTSDDLLL KAFENKQVIE VKYQEKQSLI QRIGLQAEAS
 351 VEKLFAKLVN RRADVM*
``` m005/a005 79.2% identity over a 366 aa overlap

```
                 10        20        30        40        50        60
m005.pep  MDNIDMFMPEQEEIQSMWKEILLNYGIFLLELLTVFGAIALIVLAIVQSKKQSXSGSVVL
          ||||||||||||||||||||||||||||||||||||||||||||||||||||| ||||||
a005      MDNIDMFMPEQEEIQSMWKEILLNYGIFLLELLTVFGAIALIVLAIVQSKKQSESGSVVL
                 10        20        30        40        50        60

70        80        90       100       110       120
m005.pep  TDFSENYKKQRQSFEAFFLSGEEAQHQEKEEKKKEKAEAKAEKXRLKEGGEKSAETXKSR
          |||||||||||||||||||||||||:|||||||||||||||||:|||||||||:|| |||
a005      TDFSENYKKQRQSFEAFFLSGEEAKHQEKEEKKKEKAEAKAEKKRLKEGGEKSSETQKSR
                 70        80        90       100       110       120

130       140       150       160       170       180
m005.pep  LFVLXXXXXXXXXXXXXXXXXXXXXXXXXXXXXXXXXXXXXXXXXXXXXXXXXXXXXXXX
          ||||                                  :
a005      LFVLDFDGDLYAHAVESLRHEITAVLLIAKPEDEVLLRLESPGGVVHGYGLAASQLRRLR
                130       140       150       160       170       180

190       200       210       220       230       240
m005.pep  XXXXXXXXXXXXXXASGGYMMACVADKIASAPFAIVGSVGVVAEVPNIHRLLKKHDIDVD
                :     ||||||||||||:||||||||||||||||||||||||||||||||||
a005      ERNIPLTVAVDKVAASGGYMMACVADKIVSAPFAIVGSVGVVAEVPNIHRLLKKHDIDVD
                190       200       210       220       230       240

250       260       270       280       290       300
m005.pep  VMTAGEFKRTVTFMGENTEKGKQKFRQELEETHQLFKQFVSENRPQLDIEEVATGEHWFG
          ||||||||||||||||||||||||||||||||||||||||||||||||||||||||||||
a005      VMTAGEFKRTVTFMGENTEKGKQKFRQELEETHQLFKQFVSENRPQLDIEEVATGEHWFG
                250       260       270       280       290       300

310       320       330       340       350       360
m005.pep  RQALALNLIDEISTSDDLLLKAFENKQVIEVKYQEKQSLIQRIGLQAEASVEKLFAKLVN
          ||||||||||||||||||||||||||||:|||||:|||||||||||||||||||||||||
a005      RQALALNLIDEISTSDDLLLKAFENKQVIEVKYQEKQSLIQRIGLQAEASVEKLFAKLVN
                310       320       330       340       350       360 m005.pep  RRADVMX
          |||||||
a005      RRADVMX
```

Computer analysis of this amino acid sequence gave the following results:
Homology with a Predicted ORF from *N. Gonorrhoeae*
ORF 005 shows 77.0% identity over a 366 aa overlap with a predicted ORF (ORF 005.ng) from *N. gonorrhoeae*:

```
m005/g005
                   10        20        30        40        50
m005.pep    MDNIDMFMPEQEEIQSMWKEILLNYGIFLLELLTVFGAIALIVLAIVQSKKQSXSGSV
            ||||||||||||||||||||||||||||||||||||||||||||||||||||| ||||
g005      MGMDNIDMFMPEQEEIQSMWKEILLNYGIFLLELLTVFGAIALIVLAIVQSKKQSESGSV
              10        20        30        40        50        60

60        70        80        90       100       110
m005.pep  VLTDFSENYKKQRQSFEAFFLSGEEAQHQEKEEKKKEKAEAKAEKKRLKEGGEKSAETXK
          ||||||||||||||||||||:||||  ||::||||:|||||||||||||||||||||| |
g005      VLTDFSENYKKQRQSFETFFLSEEETKHQEKKEKKKEKAEAKAEKKRLKEGGEKSAETQK
                 70        80        90       100       110       120

120       130       140       150       160       170
m005.pep  SRLFVLXXXXXXXXXXXXXXXXXXXXXXXXXXXXXXXXXXXXXXXXXXXXXXXXXXXXXX
          ||||||                              :
g005      SRLFVLDFDGDLYAHAVESLRHEITAVLLIAKPEDEVLLRLESPGGVVHGYGLAASQLRR
                130       140       150       160       170       180

180       190       200       210       220       230
m005.pep  XXXXXXXXXXXXXXXXASGGYMMACVADKIASAPFAIVGSVGVVAEVPNIHRLLKKHDID
                :     ||||||||||||:|:||||||||:|||||||||||||||||||||||
g005      LRERNIPLTVAVDKVAASGGYMMACVADKIVSAPFAVIGSVGVVAEVPNIHRLLKKHDID
                190       200       210       220       230       240

240       250       260       270       280       290
m005.pep  VDVMTAGEFKRTVTFMGENTEKGKQKFRQELEETHQLFKQFVSENRPQLDIEEVATGEHW
          ||||||||||||||||||||||||||||||||||||||||||||||||||||::||||||
g005      VDVMTAGEFKRTVTFMGENTEKGKQKFRQELEETHQLFKQFVSENRPQLDIEKIATGEHW
                250       260       270       280       290       300

300       310       320       330       340       350
m005.pep  FGRQALALNLIDEISTSDDLLLKAFENKQVIEVKYQEKQSLIQRIGLQAEASVEKLFAKL
          ||||||||||||||||||||||||||||||||||||:|||||||||||||||||||||||
g005      FGRQALALNLIDEISTSDDLLLKAFENKQVIEVKYQEKRSLIQRIGLQAEASVEKLFAKL
                310       320       330       340       350       360
```

```
                  360
m005.pep     VNRRADVMX
             |||||||||
g005         VNRRADVMX
```

The following partial DNA sequence was identified in *N. gonorrhoeae* <SEQ ID 25>:

```
g006.seq
    1 ATGCTGCTGG TGCTggaatt ttggttCGGc gtGtCGGCGG TGGGCatact 51 tgCGTTGTTT TTATGGCttt TGCCACGTTT TGCCGCCATC AGCGAAAACC 101 TGTATTTCCG CCTGAACAAC AGCTTGGAAC gcgACAACCA CTTTATCCGA

151 AAAGGCGACG AGCGGCAGCT GTACCGCCAT TACGGACTGG TTTCGCGCCT

201 GCGTGTGCTG ATTTCCAACC GCGAAGCCTT CGGCTATCTC TGCGTCGGCG

251 CGGCGATGGG TATTTTGTTC GGCTTTGCTT TTGTGATGAT GACGCTCAAA

301 GGCTACGGCA GCGCGGGGCA TATTTATTCG GTCGGCACTT ATCTGTGGAT

351 GTTTGCCATG AGTTTGGACG ATGTGCCGCG ATTGGTCGAA CAATATTCCA

401 ATTTGAAAGA CATCGGACAA CGGATAGAGT GGTCGGAACG GAACATCAAA

451 GCCGGAACTT GA
```

This corresponds to the amino acid sequence <SEQ ID 26; ORF 006.ng>:

```
g006.pep
    1 MLLVLEFWFG VSAVGILALF LWLLPRFAAI SENLYFRLNN SLERDNHFIR

51 KGDERQLYRH YGLVSRLRVL ISNREAFGYL CVGAAMGILF GFAFVMMTLK

101 GYGSAGHIYS VGTYLWMFAM SLDDVPRLVE QYSNLKDIGQ RIEWSERNIK

151 AGT*
```

The following partial DNA sequence was identified in *N. meningitidis* <SEQ ID 27>:

```
m006.seq
    1 ATGCTGCTGG TGCTGGAATT TTGGGTCGGC GTGTCGGCGG TGGGCATACT

51 TGCGTTGTTT TTATGGCTTT TGCCACGTTT TGCCGCCATC AGCGAAAACC

101 TGTATTTCCG CCTGAACAAC AGCTTGGAAC GCGACAACCA CTTTATCCGA

151 AAAGGCGACC GGCGGCAGCT GTACCGCCAT TACGGACTGC TTGCGCGCCT

201 GCGTGTGCTG ATTTCCAACC GCGAAGCCTT CGGCTATCTC TGCGTCGGCA

251 CGGCGATGGG TATTTTGTTC GGCTTTGCTT TTGTGATGAT GACGCTCAAA

301 GGCTACAGCA GCGCGGGGCA TGTCTATTCG GTCGGCACTT ATCTGTGGAT

351 GTTTGCCATG AGTTTGGACG ACGTGCCGCG ATTGGTCGAA CAATATTCCA

401 ATTTGAAAGA CATCGGACAA CGGATAGAGT GGTCGGAACG GAACATCAAA

451 GCCGGAACTTGA
```

This corresponds to the amino acid sequence <SEQ ID 28; ORF 006>:

```
m006.pep
    1 MLLVLEFWVG VSAVGILALF LWLLPRFAAI SENLYFRLNN SLERDNHFIR

51 KGDRRQLYRH YGLLARLRVL ISNREAFGYL CVGTAMGILF GFAFVMMTLK

101 GYSSAGHVYS VGTYLWMFAM SLDDVPRLVE QYSNLKDIGQ RIEWSERNIK

151 AGT*
```

The following partial DNA sequence was identified in *N. meningitidis* <SEQ ID 29>:

```
a006.seq
    1 ATGCTGCTGG TGCTGGAATT TTGGGTCGGC GTGTCGGCGG TGGGCATACT

51 TGCGTTGTTT TTATGGCTTT TGCCACGTTT TGCCGCCATC AGCGAAAACC

101 TGTATTTCCG CCTGAAGAAC AGCTTGGAAC GCGACAACCA CTTTATCCGA

151 AAAGGCGACG AGCGGCAGCT GGACCGCCAT TACGGACTGC TTGCGCGCCT

201 GCGTGTGCTG ATTTCCAACC GCGAAGCCTT CGGCTATCTC TGCGTCGGCA

251 CGGCGATGGG TATTTTGTTC GGCTTTGCTT TTGTGATGAT GACGCTCAAA

301 GGCTACAGCA GCGCGGGGCA TGTCTATTCG GTCGGCACTT ATCTGTGGAT

351 GTTTGCCATA AGTTTGGACG ACGTGCCGCG ATTGGTCGAA CAATATTCCA

401 ATTTGAAAGA CATCGGACAA CGGATAGAGT GGTCGAAACG GAACATCAAA

451 GCCGGAACTT GA
```

This corresponds to the amino acid sequence <SEQ ID 30; ORF 006.a>:

```
a006.pep
    1 MLLVLEFWVG VSAVGILALF LWLLPRFAAI SENLYFRLKN SLERDNHFIR

51 KGDERQLDRH YGLLARLRVL ISNREAFGYL CVGTAMGILF GFAFVMMTLK

101 GYSSAGHVYS VGTYLWMFAI SLDDVPRLVE QYSNLKDIGQ RIEWSKRNIK

151 AGT*
``` m006/a006 96.7% identity over a 153 aa overlap

```
                  10         20         30         40         50         60
m006.pep  MLLVLEFWVGVSAVGILALFLWLLPRFAAISENLYFRLNNSLERDNHFIRKGDRRQLYRH
          ||||||||||||||||||||||||||||||||||||||:|||||||||:|||||:|||||
a006      MLLVLEFWVGVSAVGILALFLWLLPRFAAISENLYFRLKNSLERDNGFIRKGDERQLDRH
                  10         20         30         40         50         60

70         80         90        100        110        120
m006.pep  YGLLARLRVLISNREAFGYLCVGTAMGILFGFAFVMMTLKGYSSAGHVYSVGTYLWMFAM
          |||||||||||||||||||||||||||||||||||||||||||||||||||||||||||:
a006      YGLLARLRVLISNREAFGYLCVGTAMGILFGFAFVMMTLKGYSSAGHVYSVGTYLWMFAI
                  70         80         90        100        110        120

130        140        150
m006.pep  SLDDVPRLVEQYSNLKDIGQRIEWSERNIKAGTX
          |||||||||||||||||||||||||:|||||||
a006      SLDDVPRLVEQYSNLKDIGQRIEWSKRNIKAGTX
                 130        140        150
```

Computer analysis of this amino acid sequence gave the following results:
Homology with a Predicted ORF from *N. Gonorrhoeae*
ORF 006 shows 95.4% identity over a 153 aa overlap with a predicted ORF (ORF 006.ng) from *N. gonorrhoeae*:

```
m006/g006

10         20         30         40         50         60
    m006.pep  MLLVLEFWVGVSAVGILALFLWLLPRFAAISENLYFRLNNSLERDNHFIRKGDRRQLYRH
              ||||||||| ||||||||||||||||||||||||||||||||||||||||||||:||||||
        g006  MLLVLEFWFGVSAVGILALFLWLLPRFAAISENLYFRLNNSLERDNHFIRKGDERQLYRH
                     10         20         30         40         50         60

70         80         90        100        110        120
    m006.pep  YGLLARLRVLISNREAFGYLCVGTAMGILFGFAFVMMTLKGYSSAGHVYSVGTYLWMFAM
              |||::||||||||||||||||||||:|||||||||||||||||||:||||:|||||||||
        g006  YGLVSRLRVLISNREAFGYLCVGAAMGILFGFAFVMMTLKGYGSAGHIYSVGTYLWMFAM
                     70         80         90        100        110        120

130        140        150
    m006.pep  SLDDVPRLVEQYSNLKDIGQRIEWSERNIKAGTX
              |||||||||||||||||||||||||||||||||
        g118  SLDDVPRLVEQYSNLKDIGQRIEWSERNIKAGT
                    130        140        150
```

The following partial DNA sequence was identified in *N. gonorrhoeae* <SEQ ID 31>:

```
g006-1.seq
    1 ATGTGGAAAA TGTTGAAACA CATAGCCAAA ACCCACCGCA AGCGATTGAT

51 TGGCACATTT TCCCCGGTCG GACTGGAAAA CCTTTTGATG CTGGGGTATC

101 CGGTGTTTGG CGGCTGGGCG ATTAATGCCG TGATTGCGGG GAGGGTGTGG

151 CAGGCGTTGC TGTACGCTTT GGTTGTATTT TTGATGTGGC TGGTCGGTGC

201 GGCACGGCGG ATTGCCGATA CGCGCACGTT TACGCGGATT TATACCGAAA

251 TCGCCGTGCC GGTTGTGTTG GAACAACGGC AGCGGCAAGT CCCGCATTCA

301 GCGGTAACTG CACGGGTTGC CCTGTCGCGT GAATTTGTCA GCTTTTTTGA

351 AGAACACCTG CCGATTGCCG CGACATCCGT CGTATCCATA TTCGGCGCGT

401 GCATCATGCT GCTGGTGCTG GAATTTTGGG TCGGCGTGTC GGCGGTGGGC

451 ATACTTGCGT TGTTTTTATG GCTTTTGCCA CGTTTTGCCG CCATCAGCGA

501 AAACCTGTAT TTCCGCCTGA ACAACAGCTT GGAACGCGAC AACCACTTTA

551 TCCGAAAAGG CGACGAGCGG CAGCTGTACC GCCATTACGG ACTGGTTTCG

601 CGCCTGCGTG TGCTGATTTC CAACCGCGAA GCCTTCGGCT ATCTCTGCGT

651 CGGCGCGGCG ATGGGTATTT TGTTCGGCTT TGCTTTTGTG ATGATGACGC

701 TCAAAGGCTA CGGCAGCGCG GGGCATATTT ATTCGGTCGG CACTTATCTG

751 TGGATGTTTG CCATGAGTTT GGACGATGTG CCGCGATTGG TCGAACAATA

801 TTCCAATTTG AAAGACATCG GACAACGGAT AGAGTGGTCG GAACGGAACA

851 TCAAAGCCGG AACTTGA
```

This corresponds to the amino acid sequence <SEQ ID 32; ORF 006-1.ng>:

```
g006-1.pep
    1 MWKMLKHIAK THRKRLIGTF SPVGLENLLM LGYPVFGGWA INAVIAGRVW

51 QALLYALVVF LMWLVGAARR IADTRTFTRI YTEIAVPVVL EQRQRQVPHS

101 AVTARVALSR EFVSFFEEHL PIAATSVVSI FGACIMLLVL EFWVGSAVG
```

```
-continued
151 ILALFLWLLP RFAAISENLY FRLNNSLERD NHFIRKGDER QLYRHYGLVS

201 RLRVLISNRE AFGYLCVGAA MGILFGFAFV MMTLKGYGSA GHIYSVGTYL

251 WMFAMSLDDV PRLVEQYSNL KDIGQRIEWS ERNIKAGT*
```

The following partial DNA sequence was identified in *N. meningitidis* <SEQ ID 33>:

```
m006-1.seq
    1 ATGTGGAAAA TGTTGAAACA CATAGCCCAA ACCCACCGCA AGCGATTGAT

51 TGGCACATTT TCCCTGGTCG GACTGGAAAA CCTTTTGATG CTGGTGTATC

101 CGGTGTTTGG CGGCCGGGCG ATCAATGCCG TGATTGCGGG GGAGGTGTGG

151 CAGGCGTTGC TGTACGCTTT GGTTGTGCTT TTGATGTGGC TGGTCGGTGC

201 GGTGCGGCGG ATTGCCGATA CGCACGTT TACGCGGATT TATACCGAAA

251 TCGCCGTGCC GGTCGTGTTG GAACAGCGGC AGCGACAAGT CCCGCATTCG

301 GCGGTAACTG CGCGGGTTGC CCTGTCGCGT GAGTTTGTCA GCTTTTTTGA

351 AGAACACCTG CCGATTGCCG CGACATCCGT CGTATCCATA TTCGGCGCGT

401 GCATCATGCT GCTGGTGCTG GAATTTTGGG TCGGCGTGTC GGCGGTGGGC

451 ATACTTGCGT TGTTTTTATG GCTTTTGCCA CGTTTTGCCG CCATCAGCGA

501 AAACCTGTAT TTCCGCCTGA ACAACAGCTT GGAACGCGAC AACCACTTTA

551 TCCGAAAAGG CGACCGGCGG CAGCTGTACC GCCATTACGG ACTGCTTGCG

601 CGCCTGCGTG TGCTGATTTC CAACCGCGAA GCCTTCGGCT ATCTCTGCGT

651 CGGCACGGCG ATGGGTATTT TGTTCGGCTT TGCTTTTGTG ATGATGACGC

701 TCAAAGGCTA CAGCAGCGCG GGGCATGTCT ATTCGGTCGG CACTTATCTG

751 TGGATGTTTG CCATGAGTTT GGACGACGTG CCGCGATTGG TCGAACAATA

801 TTCCAATTTG AAAGACATCG GACAACGGAT AGAGTGGTCG GAACGGAACA

851 TCAAAGCCGG AACTTGA
                                                            40
```

This corresponds to the amino acid sequence <SEQ ID 34; ORF 006-1>:

```
m006-1.pep
    1 MWKMLKHIAQ THRKRLIGTF SLVGLENLLM LVYPVFGGRA INAVIAGEVW

51 QALLYALVVL LMWLVGAVRR IADTRTFTRI YTEIAVPVVL EQRQRQVPHS

101 AVTARVALSR EFVSFFEEHL PIAATSVVSI FGACIMLLVL EFWVGVSAVG

151 ILALFLWLLP RFAAISENLY FRLNNSLERD NHFIRKGDRR QLYRHYGLLA

201 RLRVLISNRE AFGYLCVGTA MGILFGFAFV MMTLKGYSSA GHVYSVGTYL

251 WMFAMSLDDV PRLVEQYSNL KDIGQRIEWS ERNIKAGT*
                                                            55
``` m006-1/g006-1 95.5% identity in 288 aa overlap

```
                   10         20         30         40         50         60
m006-1.pep   MWKMLKHIAQTHRKRLIGTFSLVGLENLLMLVYPVFGGRAINAVIAGEVWQALLYALVVL
             ||||||||||:||||||||||| |||||||||||:||| |||||||||:||||||||||:
g006-1       MWKMLKHIAKTHRKRLIGTFSPVGLENLLMLGYPVFGGWAINAVIAGRVWQALLYALVVF
                   10         20         30         40         50         60

70         80         90        100        110        120
m006-1.pep   LMWLVGAVRRIADTRTFTRIYTEIAVPVVLEQRQRQVPHSAVTARVALSREFVSFFEEHL
             ||||||||:|||||||||||||||||||||||||||||||||||||||||||||||||||
g006-1       LMWLVGAARRIADTRTFTRIYTEIAVPVVLEQRQRQVPHSAVTARVALSREFVSFFEEHL
                   70         80         90        100        110        120
```

```
                    130         140         150         160         170         180
m006-1.pep   PIAATSVVSIFGACIMLLVLEFWVGVSAVGILALFLWLLPRFAAISENLYFRLNNSLERD
             ||||||||||||||||||||||||||||||||||||||||||||||||||||||||||||
g006-1       PIAATSVVSIFGACIMLLVLEFWVGVSAVGILALFLWLLPRFAAISENLYFRLNNSLERD
                    130         140         150         160         170         180

190         200         210         220         230         240
m006-1.pep   NHFIRKGDRRQLYRHYGLLARLRVLISNREAFGYLCVGTAMGILFGFAFVMMTLKGYSSA
             |||||||||:|||||||::|||||||||||||||||:|||||||||||||||||||||:||
g006-1       NHFIRKGDERQLYRHYGLVSRLRVLISNREAFGYLCVGAAMGILFGFAFVMMTLKGYGSA
                    190         200         210         220         230         240

250         260         270         280         289
m006-1.pep   GHVYSVGTYLWMFAMSLDDVPRLVEQYSNLKDIGQRIEWSERNIKAGTX
             ||:||||||||||||||||||||||||||||||||||||||||||||||
g006-1       GHIYSVGTYLWMFAMSLDDVPRLVEQYSNLKDIGQRIEWSERNIKAGTX
                    250         260         270         280
```

The following partial DNA sequence was identified in *N. meningitidis* <SEQ ID 35>:

```
a006-1.seq(partial)
   1  ..AGCCAAAACC ACCGCAAGCG ATTGATTGGC ACATTTTTTC TGGTCGGACT

51    GGAAAACCTT TTGATGCTGG TGTATCCGGT GTTTGGCGGC TGGGCGATTA

101    ATGCCGTGAT TGCGGGGCAG GCGTGGCAGG CGTTGCTGTA CGCTTTGGTT

151    GTGCTTTTGA TGTGGCTGGT CGGTGCGGCG CGGCGGATTG CCGATACGCG

201    CACGTTTACG CGGATTTATA CCGAAATCGC CGTGCCGGTT GTGTTGGAAC

251    AGCGGCAGCG GCAAGTCCCG CATTCGGCGG TAACTGCGCG GGTTGCCCTG

301    TCGCGTGAGT TTGTCAGCTT TTTTGAAGAA CACCTGCCGA TTGCCGCGAC

351    ATCCGTCGTA TCCATATTCG GCGCGTGCAT CATGCTGCTG GTGCTGGAAT

401    TTTGGGTCGG CGTGTCGGCG GTGGGCATAC TTGCGTTGTT TTTATGGCTT

451    TTGCCACGTT TTGCCGCCAT CAGCGAAAAC CTGTATTTCC GCCTGAAGAA

501    CAGCTTGGAA CGCGACAACC ACTTTATCCG AAAAGGCGAC GAGCGGCAGC

551    TGGACCGCCA TTACGGACTG CTTGCGCGCC TGCGTGTGCT GATTTCCAAC

601    CGCGAAGCCT TCGGCTATCT CTGCGTCGGC ACGGCGATGG GTATTTTGTT

651    CGGCTTTGCT TTTGTGATGA TGACGCTCAA AGGCTACAGC AGCGCGGGGC

701    ATGTCTATTC GGTCGGCACT TATCTGTGGA TGTTTGCCAT AAGTTTGGAC

751    GACGTGCCGC GATTGGTCGA ACAATATTCC AATTTGAAAG ACATCGGACA

801    ACGGATAGAG TGGTCGAAAC GGAACATCAA AGCCGGAACT TGA
```

This corresponds to the amino acid sequence <SEQ ID 36; ORF 006-1.a>:

```
a006-1.pep (partial)

1  ..SQNHRKRLIG TFFLVGLENL LMLVYPVFGG WAINAVIAGQ AWQALLYALV

51    VLLMWLVGAA RRIADTRTFT RIYTEIAVPV VLEQRQRQVP HSAVTARVAL

101    SREFVSFFEE HLPIAATSVV SIFGACIMLL VLEFWVGVSA VGILALFLWL

151    LPRFAAISEN LYFRLKNSLE RDNHFIRKGD ERQLDRHYGL LARLRVLISN

201    REAFGYLCVG TAMGILFGFA FVMMTLKGYS SAGHVYSVGT YLWMFAISLD

251    DVPRLVEQYS NLKDIGQRIE WSKRNIKAGT *
```

-continued

```
a006-1/m006-1 95.7% identity in 280 aa overlap 10        20        30        40        50
    a006-1.pep         SQNHRKRLIGTFFLVGLENLLMLVYPVFGGWAINAVIAGQAWQALLYALVVL
                       :|:|||||||| ||||||||||||||||||| ||||| ||||||||||||
    m006-1      MWKMLKHIAQTHRKRLIGTFSLVGLENLLMLVYPVFGGRAINAVIAGEVWQALLYALVVL
                         10        20        30        40        50        60

60        70        80        90       100       110
    a006-1.pep   LMWLVGAARRIADTRTFTRIYTEIAVPVVLEQRQRQVPHSAVTARVALSREFVSFFEEHL
                 ||||||| :|||||||||||||||||||||||||||||||||||||||||||||||||||
    m006-1       LMWLVGAVRRIADTRTFTRIYTEIAVPVVLEQRQRQVPHSAVTARVALSREFVSFFEEHL
                         70        80        90       100       110       120

120       130       140       150       160       170
    a006-1.pep   PIAATSVVSIFGACIMLLVLEFWVGVSAVGILALFLWLLPRFAAISENLYFRLKNSLERD
                 ||||||||||||||||||||||||||||||||||||||||||||||||||||||:|||||
    m006-1       PIAATSVVSIFGACIMLLVLEFWVGVSAVGILALFLWLLPRFAAISENLYFRLNNSLERD
                        130       140       150       160       170       180

180       190       200       210       220       230
    a006-1.pep   NHFIRKGDERQLDRHYGLLARLRVLISNREAFGYLCVGTAMGILFGFAFVMMTLKGYSSA
                 |||||||||:||| ||||||||||||||||||||||||||||||||||||||||||||||
    m006-1       NHFIRKGDRRQLYRHYGLLARLRVLISNREAFGYLCVGTAMGILFGFAFVMMTLKGYSSA
                        190       200       210       220       230       240

240       250       260       270       280
    a006-1.pep   GHVYSVGTYLWMFAISLDDVPRLVEQYSNLKDIGQRIEWSKRNIKAGTX
                 |||||||||||||:|||||||||||||||||||||||||:|||||||||
    m006-1       GHVYSVGTYLWMFAMSLDDVPRLVEQYSNLKDIGQRIEWSERNIKAGTX
                        250       260       270       280
```

The following partial DNA sequence was identified in *N. gonorrhoeae* <SEQ ID 37>:

```
g007.seq
    1  atgaACACAA CCCGACTGCC GACCGCCTTC ATCTTGTGCT GCCTCTGcgC

51  CGCcGCTTCT GCCGccgaca acAGCatcat gaCaAAAGGG CAAAAAGTGT

101  ACGAATCcAa ctGCATCGCC TGCCACGGCA AGAAAGGGGA AGGGCGCGGC

151  ACTGCGtTTC CTccgctTTT CCggtcgGac tgtattatga acaAACCGCa 201  cgTCCtgctg cacagcatgg tcaaaggcAt cgacgggaca ttcaaagtgg 251  agcggcaaaa cctacgacgg atttatgCcc gcaaccgcca tcagcgATGC

301  GGACATTGCC GCCGTCGCCA CTTATATCAT GAACGCCTTT GA
```

This corresponds to the amino acid sequence <SEQ ID 38; ORF 007.ng>:

```
g007.pep
    1  MNTTRLPTAF ILCCLCAAAS AADNSIMTKG QKVYESNCIA CHGKKGEGRG

51  TAFPPLFRSD CIMNKPHVLL HSMVKGIDGT FKVERQNLRR IYARNRHQRC

101  GHCRRRHLYH ERL*
```

The following partial DNA sequence was identified in *N. meningitidis* <SEQ ID 39>:

```
m007.seq
    1  ATGAACACAA CCCGACTGCC GACCGCCCTC GTCTTGGGCT GCTTCTGCGC

51  CGCCGCTTCT GCCGCCGACA ACAGCATCAT GACAAAAGGG CAAAAAGTGT

101  ACGAATCCAA CTGCGTCGCC TGCCACGGCA AAAAGGGCGA AGGCCGCGGA

151  ACCATGTTTC CGCCGCTCTA CCGCTCCGAC TTCATCATGA AAAAACCGCA

201  GGTGCTGCTG CACAGCATGG TCAAAGGCAT CAACGGTACA ATCAAAGTC.

251  AACGGCAAAA CCTACAACGG ATTCATGCCC GCAACCGCCA TCAGCGATGC

301  GGACATTGCC GCCGTCGCCA CTTATATCAT GAACGCCTTT GA
```

This corresponds to the amino acid sequence <SEQ ID 40; ORF 007>:

```
m007.pep
    1  MNTTRLPTAL VLGCFCAAAS AADNSIMTKG QKVYESNCVA CHGKKGEGRG

51  TMFPPLYRSD FIMKKPQVLL HSMVKGINGT IKVXRQNLQR IHARNRHQRC

101  GHCRRRHLYH ERL*
```

The following partial DNA sequence was identified in *N. meningitidis* <SEQ ID 41>:

```
a007.seq
    1  ATGAACACAA CCCGACTGCC GACCGCCCTC GTCTTGGGCT GCCTCTGCGC

51  CGCCGCTTCT GCCGCCGACA ACAGCATCAT GACAAAAGGG CAAAAAGTGT

101  ACGAATCCAA CTGCGTCGCC TGCCACGGCA AAAAGGGCGA AGGCCGCGGA

151  ACCATGTTTC CGCCGCTCTA CCGCTCCGAC TTCATCATGA AAAAACCGCA

201  GGTGCTGCTG CACAGCATGG TCAAAGGCAT CAACGGTACA ATCAAAGTC.

251  AACGGCAAAA CCTACAACGG ATTCATGCCC GCCACTGCCA TCAGCGATGC

301  GGACATTGCC GCCGTCGCCA CTTATATCAT GAACGCCTTT GA
```

This corresponds to the amino acid sequence <SEQ ID 42; ORF 007.a>:

```
a007.pep
    1  MNTTRLPTAL VLGCLCAAAS AADNSIMTKG QKVYESNCVA CHGKKGEGRG

51  TMFPPLYRSD FIMKKPQVLL HSMVKGINGT IKVXRQNLQR IHARHCHQRC

101  GHCRRRHLYH ERL*
``` m007/a007 97.3% identity over a 113 aa overlap

```
                 10         20         30         40         50         60
   m007.pep  MNTTRLPTALVLGCFCAAASAADNSIMTKGQKVYESNCVACHGKKGEGRGTMFPPLYRSD
             ||||||||||||||:|||||||||||||||||||||||||||||||||||||||||||||
   a007      MNTTRLPTALVLGCLCAAASAADNSIMTKGQKVYESNCVACHGKKGEGRGTMFPPLYRSD
                 10         20         30         40         50         60

70         80         90        100        110
   m007.pep  FIMKKPQVLLHSMVKGINGTIKVXRQNLQRIHARNRHQRCGHCRRRHLYHERLX
             |||||||||||||||||||||||||||||||||||:|||||||||||||||||
   a007      FIMKKPQVLLHSMVKGINGTIKVXRQNLQRIHARHCHQRCGHCRRRHLYHERLX
                 70         80         90        100        110
```

Computer analysis of this amino acid sequence gave the following results:
Homology with a Predicted ORF from *N. gonorrhoeae*
ORF 007 shows 86.7% identity over a 113 aa overlap with a predicted ORF (ORF 007.ng) from *N. gonorrhoeae*:

```
   m007/g007

10         20         30         40         50         60
   m007.pep  MNTTRLPTALVLGCFCAAASAADNSIMTKGQKVYESNCVACHGKKGEGRGTMFPPLYRSD
             |||||||||::| |:|||||||||||||||||||||:|||||||||||| ||||:|||
   g007      MNTTRLPTAFILCCLCAAASAADNSIMTKGQKVYESNCIACHGKKGEGRGTAFPPLFRSD
                 10         20         30         40         50         60

70         80         90        100        110
   m007.pep  FIMKKPQVLLHSMVKGINGTIKVXRQNLQRIHARNRHQRCGHCRRRHLYHERLX
              |:||:||||||||||:|:|| ||||:||:|||||||||||||||||||||
   g007      CIMNKPHVLLHSMVKGIDGTFKVERQNLRRIYARNRHQRCGHCRRRHLYHERL
                 70         80         90        100        110
```

The following partial DNA sequence was identified in *N. gonorrhoeae* <SEQ ID 43>:

```
g007-1.seq (partial)
    1 ATGAACACAA CCCGACTGCC GACCGCCTTC ATCTTGTGCT GCCTCTGCGC

51 CGCCGCTTCT GCCGCCGACA ACAGCATCAT GACAAAAGGG CAAAAAGTGT

101 ACGAATCCAA CTGCATCGCC TGCCACGGCA AGAAAGGGGA AGGGCGCGGC

151 ACTGCGTTTC CTCCGCTTTT CCGGTCGGAC TATATTATGA ACAAACCGCA

201 CGTCCTGCTG CACAGCATGG TCAAAGGCAT CAACGGTACA ATCAAAGTCA

251 ACGGCAAAAC CTACAACGGA TTCATGCCCG CAACCGCCAT CAGCGATGCG

301 GACATTGCCG CCGTCGCCAC TTATATCATG AACGCCTTTG ACAACGGCGG

351 CGGAAGCGTT ACCGAAAAAG ACGTAAAACA GGCAAAAGGC AAAAAAAAC.
```

This corresponds to the amino acid sequence <SEQ ID 44; ORF 007-1.ng>:

```
g007-1.pep (partial)
    1 MNTTRLPTAF ILCCLCAAAS AADNSIMTKG QKVYESNCIA CHGKKGEGRG

51 TAFPPLFRSD YIMNKPHVLL HSMVKGINGT IKVNGKTYNG FMPATAISDA

101 DIAAVATYIM NAFDNGGGSV TEKDVKQAKGKKN...
```

The following partial DNA sequence was identified in *N. meningitidis* <SEQ ID 45>:

```
m007-1.seq
    1 ATGAACACAA CCCGACTGCC GACCGCCCTC GTCTTGGGCT GCTTCTGCGC

51 CGCCGCTTCT GCCGCCGACA ACAGCATCAT GACAAAAGGG CAAAAAGTGT

101 ACGAATCCAA CTGCGTCGCC TGCCACGGCA AAAAGGGCGA AGGCCGCGGA

151 ACCATGTTTC CGCCGCTCTA CCGCTCCGAC TTCATCATGA AAAAACCGCA

201 GGTGCTGCTG CACAGCATGG TCAAAGGCAT CAACGGTACA ATCAAAGTCA

251 ACGGCAAAAC CTACAACGGA TTCATGCCCG CAACCGCCAT CAGCGATGCG

301 GACATTGCCG CCGTCGCCAC TTATATCATG AACGCCTTTG ACAACGGCGG

351 CGGAAGCGTT ACCGAAAAAG ACGTAAAACA GGCAAAAAGC AAAAAAAACT

401 AA
```

This corresponds to the amino acid sequence <SEQ ID 46; ORF 007-1>

```
m007-1.pep
    1 MNTTRLPTAL VLGCFCAAAS AADNSIMTKG QKVYESNCVA CHGKKGEGRG

51 TMFPPLYRSD FIMKKPQVLL HSMVKGINGT IKVNGKTYNG FMPATAISDA

101 DIAAVATYIM NAFDNGGGSV TEKDVKQAKS KKN*
``` m007-1/g007-1 91.7% identity in 133 aa overlap

```
                     10         20         30         40         50         60
    m007-1.pep  MNTTRLPTALVLGCFCAAASAADNSIMTKGQKVYESNCVACHGKKGEGRGTMFPPLYRSD
                ||||||||::| |:|||||||||||||||||||||||||:|||||||||||| ||||:|||
    g007-1      MNTTRLPTAFILCCLCAAASAADNSIMTKGQKVYESNCIACHGKKGEGRGTAFPPLFRSD
                     10         20         30         40         50         60
```

```
              70        80        90       100       110       120
m007-1.pep  FIMKKPQVLLHSMVKGINGTIKVNGKTYNGFMPATAISDADIAAVATYIMNAFDNGGGSV
            :||:||:|||||||||||||||||||||||||||||||||||||||||||||||||||
g007-1      YIMNKPHVLLHSMVKGINGTIKVNGKTYNGFMPATAISDADIAAVATYIMNAFDNGGGSV
              70        80        90       100       110       120
             130
m007-1.pep  TEKDVKQAKSKKNX
            ||||||||||:|||
g007-1      TEKDVKQAKGKKN
             130
```

The following partial DNA sequence was identified in *N. meningitidis* <SEQ ID 47>:

```
a007-1.seq (partial)
    1 ATGAACACAA CCCGACTGCC GACCGCCCTC GTCTTGGGCT GCCTCTGCGC

51 CGCCGCTTCT GCCGCCGACA ACAGCATCAT GACAAAAGGG CAAAAAGTGT

101 ACGAATCCAA CTGCGTCGCC TGCCACGGCA AAAGGGCGA AGGCCGCGGA

151 ACCATGTTTC CGCCGCTCTA CCGCTCCGAC TTCATCATGA AAAAACCGCA

201 GGTGCTGCTG CACAGCATGG TCAAAGGCAT CAACGGTACA ATCAAAGTCA

251 ACGGCAAAAC CTACAACGGA TTCATGCCCG CCACTGCCAT CAGCGATGCG

301 GACATTGCCG CCGTCGCCAC TTATATCATG AACGCCTTTG ACAACGGCGG

351 CGGAAGCGTT ACCGAAAAAG ACGTAAAACA GGCAAAAAAC AAAAA..
```

This corresponds to the amino acid sequence <SEQ ID 48; ORF 007-1.a>:

```
a007-1.pep (partial)
    1 MNTTRLPTAL VLGCLCAAAS AADNSIMTKG QKVYESNCVA CHGKKGEGRG

51 TMFPPLYRSD FIMKKPQVLL HSMVKGINGT IKVNGKTYNG FMPATAISDA

101 DIAAVATYIM NAFDNGGGSV TEKDVKQAKN KK..
``` m007-1/a007-1 98.5% identity in 132 aa overlap

```
              10        20        30        40        50        60
m007-1.pep  MNTTRLPTALVLGCFCAAASAADNSIMTKGQKVYESNCVACHGKKGEGRGTMFPPLYRSD
            ||||||||||||||:|||||||||||||||||||||||||||||||||||||||||||||
a007-1      MNTTRLPTALVLGCLCAAASAADNSIMTKGQKVYESNCVACHGKKGEGRGTMFPPLYRSD
              10        20        30        40        50        60
              70        80        90       100       110       120
m007-1.pep  FIMKKPQVLLHSMVKGINGTIKVNGKTYNGFMPATAISDADIAAVATYIMNAFDNGGGSV
            ||||||||||||||||||||||||||||||||||||||||||||||||||||||||||||
a007-1      FIMKKPQVLLHSMVKGINGTIKVNGKTYNGFMPATAISDADIAAVATYIMNAFDNGGGSV
              70        80        90       100       110       120
             130
m007-1.pep  TEKDVKQAKSKKNX
            ||||||||||:||
a007-1      TEKDVKQAKNKK
             130
```

The following partial DNA sequence was identified in *N. gonorrhoeae* <SEQ ID 49>:

```
g008.seq
    1 ATGAACAACA GACATTTTGC CGTCAtcgCC TTGGGCAGCA ACCTTGACAA

51 CCCCGCACAA CAAATacgcg gcgcattaga cgcgctctcg tcccatcctg 101 acatccggct tgaaCaggtt tcctcactgt aTatgaccgc acctgtcggt
```

```
-continued
151   tacgAcaaTC agcccgATTT CATCaatgcc gTCTgcaccg TTTCCACCAC

201   CtTGGACGGC ATTGcccTGC TTGCCgaACT CAAccgTATC GAAGCCGATT

251   TCGGACGCGA aCGCAGTTTC CGCAATGCAC CGCGCACATT GGATTTGGAC

301   ATTATCGACT TTGACGGCAT CTCCAGCGAC GACCCCCGCC TTACCCTGCC

351   GCATCCGCGC GCGCACGAAC GCAGTTTCGT CATACGCCCT TTGGCAGAAA

401   TCCTCCCTGA TTTTATTTTG GGAAAATACG GAAAGGTTGT CGAATTGTCA

451   AAACGGCTGG GCAATCAAGG CATCCGTCTT TTACCGGACA GGTAA
```

This corresponds to the amino acid sequence <SEQ ID 50; ORF 008.ng>:

```
g008.pep
  1   MNNRHFAVIA LGSNLDNPAQ QIRGALDALS SHPDIRLEQV SSLYMTAPVG

51   YDNQPDFINA VCTVSTTLDG IALLAELNRI EADFGRERSF RNAPRTLDLD

101   IIDFDGISSD DPRLTLPHPR AHERSFVIRP LAEILPDFIL GKYGKVVELS

151   KRLGNQGIRL LPDR*
```

The following partial DNA sequence was identified in *N. meningitidis* <SEQ ID 51>:

```
m008.seq
  1   ATGAACAACA GACATTTTGC CGTCATCGCC CTGGGCAGTA ATCTTGAAAA

51   CCCTGCTCAA CAGGTACGCG CCGCATTGGA CACGCTGTCG TCCCATCCTG

101   ACATCCGTCT TAAACAGGCT TCCTCACTGT ATATGACCGC GCCCGTCGGT

151   TACGACAATC AGCCCGATTT TGTCAATGCC GTCTGCACCG TTTCCACCAC

201   TCTGGACGGC ATTGCCyTGC TTGCCGAACT CAACCGTATC GAGGCTGATT

251   TCGGACGCGA ACGCAGCTTC CGCAACGCGC CGCGCACATT GkATTTGGAC

301   ATTATCGACT TTGACGGCAT CTCCAGCGAC GACACsCGAC TcACCtTGCC

351   GCATCCGCGC GCGCACGAAC GCAGTTTCGT CATCCGCCCT TTGGCAGAAA

401   TCCTCCCTGA TTTTGTTTTA GGAAAACACG GAAAGGTTGC CGAATTGTCA

451   AAACGGyTGG GCAATCAAGG TATCCGTCTT TTACCGGACA GGTAATT
```

This corresponds to the amino acid sequence <SEQ ID 52; ORF 008>:

```
m008.pep
  1   MNNRHFAVIA LGSNLENPAQ QVRAALDTLS SHPDIRLKQAS SLYMTAPVG

51   YDNQPDFVNA VCTVSTTLDG IALLAELNRI EADFGRERSFR NAPRTLXLD

101   IIDFDGISSD DTRLTLPHPR AHERSFVIRP LAEILPDFVLG KHGKVAELS

151   KRLGNQGIRL LPDR*
```

The following partial DNA sequence was identified in *N. meningitidis* <SEQ ID 53>:

```
a008.seq
  1   ATGAACAACA GACATTTTGC CGTCATCGCC CTGGGCAGTA ATCTTGAAAA

51   CCCTGCCCAA CAGGTACGCG CCGCATTGGA CACGCTGTCG TCCCATCCTG

101   ACATCCGTCT TAAACAGGCT TCCTCACTGT ATATGACCGC GCCCGTCGGT
```

```
151  TACGACAATC AGCCCGATTT CGTCAATGCC GTCTGCACCG TTTCCACCAC

201  CTTGGACGGC ATTGCCCTGC TTGCCGAACT CAACCGTATC GAAGCCGATT

251  TCGGACGCGA ACGCAGCTTC CGCAACGCGC CGCGCACATT GGATTTGGAC

301  ATTATCGACT TTGACGGCAT CTCCAGCGAC GACCCCGAC TCACCCTGCC

351  GCATCCGCGC GCGCACGAAC GCAGTTTCGT CATACGCCCT TTGGCAGAAA

401  TCCTCCCTGA TTTTATTTTG GGAAAACACG GAAAGGTTGC CGAATTGTCA

451  AAACGGCTGG GCAATCAAGG CATCCGTCTT TTACCGGATA AGTAA
```

This corresponds to the amino acid sequence <SEQ ID 54; ORF 008.a>:

```
a008.pep
   1  MNNRHFAVIA LGSNLENPAQ QVRAALDTLS SHPDIRLKQA SSLYMTAPVG

51  YDNQPDFVNA VCTVSTTLDG IALLAELNRI EADFGRERSF RNAPRTLDLD

101  IIDFDGISSD PRLTLPHPRA HERSFVIRPL LAEILPDFIL GKHGKVAELS

151  KRLGNQGIRL LPDK*
``` m008/a008 97.6% identity over a 164 aa overlap

```
                10         20         30         40         50         60
    m008.pep    MNNRHFAVIALGSNLENPAQQVRAALDTLSSHPDIRLKQASSLYMTAPVGYDNQPDFVNA
                ||||||||||||||||||||||||||||||||||||||||||||||||||||||||||||
    a008        MNNRHFAVIALGSNLENPAQQVRAALDTLSSHPDIRLKQASSLYMTAPVGYDNQPDFVNA
                10         20         30         40         50         60

70         80         90        100        110        120
    m008.pep    VCTVSTTLDGIALLAELNRIEADFGRERSFRNAPRTLXLDIIDFDGISSDDTRLTLPHPR
                |||||||||||||||||||||||||||||||||||||||| ||||||||||| |||||||
    a008        VCTVSTTLDGIALLAELNRIEADFGRERSFRNAPRTLDLDIIDFDGISSDDPRLTLPHPR
                70         80         90        100        110        120

130        140        150        160
    m008.pep   AHERSFVIRPLAEILPDFVLGKHGKVAELSKRLGNQGIRLLPDRX
               |||||||||||||||||||:||||||||||||||||||||||:|
    a008       AHERSFVIRPLAEILPDFILGKHGKVAELSKRLGNQGIRLLPDKX
               130        140        150        160
```

Computer analysis of this amino acid sequence gave the following results:

Homology with a Predicted ORF from *N. gonorrhoeae*

ORF 008 shows 92.7% identity over a 164 aa overlap with a predicted ORF (ORF008.ng) from *N. gonorrhoeae*:

```
    m008/g008

10         20         30         40         50         60
    m008.pep    MNNRHFAVIALGSNLENPAQQVRAALDTLSSHPDIRLKQASSLYMTAPVGYDNQPDFVNA
                ||||||||||||||:|||||:|:|||:||||||:|||||:|:||||||||||||||||:||
    g008        MNNRHFAVIALGSNLDNPAQQIRGALDALSSHPDIRLEQVSSLYMTAPVGYDNQPDFINA
                10         20         30         40         50         60

70         80         90        100        110        120
    m008.pep    VCTVSTTLDGIALLAELNRIEADFGRERSFRNAPRTLXLDIIDFDGISSDDTRLTLPHPR
                |||||||||||||||||||||||||||||||||||||| |||||||||||| ||||||||
    g008        VCTVSTTLDGIALLAELNRIEADFGRERSFRNAPRTLDLDIIDFDGISSDDPRLTLPHPR
                70         80         90        100        110        120

130        140        150        160
    m008.pep   AHERSFVIRPLAEILPDFVLGKHGKVAELSKRLGNQGIRLLPDRX
              |||||||||||||||||:|||:|||:||||||||||||||||||
    g008       AHERSFVIRPLAEILPDFILGKYGKVVELSKRLGNQGIRLLPDRX
               130        140        150        160
```

The following partial DNA sequence was identified in *N. gonorrhoeae* <SEQ ID 55>:

```
g009.seq
    1  ATGCCCCGCG CTGCCGTAGC CTTTGAGCGT CATCATCACA AAAGCAAAGC

51  CGAACAAAAT ACCCATCGCC GCGCCGACGC AGAGATAGCC GAAGGCTTCG

101  CGGTTGGAAA TCAGCACACG CAGGCGCGAA ACCAGTCCGT AATGGCGGTA

151  CAGCTGCCGC TCGTCGCCTT TTCGGATAAA GTGGTTGTcg cGTTCCAAGC

201  TGTTGTTCAG GCGGAAATAC AGGTTTTCGC TGATGGCGGC AAAACGTGGC

251  AaaaGCCATA A
```

This corresponds to the amino acid sequence <SEQ ID 56; ORF 009.ng>:

```
g009.pep
    1  MPRAAVAFER HHHKSKAEQN THRRADAEIA EGFAVGNQHT QARNQSVMAV

51  QLPLVAFSDK VVVAFQAVVQ AEIQVFADGG KTWQKP*
```

The following partial DNA sequence was identified in *N. meningitidis* <SEQ ID 57>:

```
m009.seq
    1  ATGCCCCGCG CTGCTGTAGC CTTTGAGCGT CATCATCACA AAAGCAAAGC

51  CGAACAAAAT ACCCATCGCC GTGCCGACGC AGAGATAGCC GAAGGCTTCG

101  CGGTTGGAAA TCAGCACACG CAGGCGCGCA AGCAGTCCGT AATGGCGGTA

151  CAGCTGCCGC CGGTCGCCTT TTCGGATAAA GTGGTTGTCG CGTTCCAAGC

201  TGTTGTTCAG GCGGAAATAC AGGTTTTCGC TGATGGCGGC AAAACGTGGC

251  AAAAGCCATA A
```

This corresponds to the amino acid sequence <SEQ ID 58; ORF 009>:

```
m009.pep
    1  MPRAAVAFER HHHKSKAEQN THRRADAEIA EGFAVGNQHT QARKQSVMAV

51  QLPPVAFSDK VVVAFQAVVQ AEIQVFADGG KTWQKP*
```

Computer analysis of this amino acid sequence gave the following results:
Homology with a Predicted ORF from *N. gonorrhoeae*
ORF 009 shows 97.7% identity over a 86 aa overlap with a predicted ORF (ORF 009.ng) from *N. gonorrhoeae*:

```
    m009/g009
                       10         20         30         40         50         60
     m009.pep  MPRAAVAFERHHHKSKAEQNTHRRADAEIAEGFAVGNQHTQARKQSVMAVQLPPVAFSDK
               ||||||||||||||||||||||||||||||||||||||||||:||||||||| ||||||
         g009  MPRAAVAFERHHHKSKAEQNTHRRADAEIAEGFAVGNQHTQARNQSVMAVQLPLVAFSDK
                       10         20         30         40         50         60
                       70         80
     m009.pep  VVVAFQAVVQAEIQVFADGGKTWQKPX
               |||||||||||||||||||||||||||
         g009  VVVAFQAVVQAEIQVFADGGKTWQKPX
                       70         80
```

The following partial DNA sequence was identified in *N. meningitidis* <SEQ ID 59>:

```
a009.seq
    1 ATGCCCCGCG CTGCTGTAGC CTTTGAGCGT CATCATCACA AAAGCAAAGC

51 CGAACAAAAT ACCCATCGCC GTGCCGACGC AGAGATAGCC GAAGGCTTCG

101 CGGTTGGAAA TCAGCACACG CAGGCGCGCA AGCAGTCCGT AATGGCGGTC

151 CAGCTGCCGC TCGTCGCCTT TTCGGATAAA GTGGTTGTCG CGTTCCAAGC

201 TGTTCTTCAG GCGGAAATAC AGGTTTTCGC TGATGGCGGC AAAACGTGGC

251 AAAAGCCATA A
```

This corresponds to the amino acid sequence <SEQ ID 60; ORF 009.a>:

```
a009.pep
    1 MPRAAVAFER HHHKSKAEQN THRRADAEIA EGFAVGNQHT QARKQSVMAV

51 QLPLVAFSDK VVVAFQAVLQ AEIQVFADGG KTWQKP*
``` m005/a009 97.7% identity over a 86 aa overlap

```
                  10        20        30        40        50        60
    m009.pep MPRAAVAFERHHHKSKAEQNTHRRADAEIAEGFAVGNQHTQARKQSVMAVQLPPVAFSDK
             |||||||||||||||||||||||||||||||||||||||||||||||||| ||||||
    a009     MPRAAVAFERHHHKSKAEQNTHRRADAEIAEGFAVGNQHTQARKQSVMAVQLPLVAFSDK
                  10        20        30        40        50        60

70        80
    m009.pep VVVAFQAVVQAEIQVFADGGKTWQKPX
             ||||||||:||||||||||||||||||
    a009     VVVAFQAVLQAEIQVFADGGKTWQKPX
                  70        80
```

The following partial DNA sequence was identified in *N. gonorrhoeae* <SEQ ID 61>:

```
g010.seq
    1 ATGGGTTTTC CTGTTCGCAA GTTTGATGCC GTGATTGTCG GCGGTGGCGG

51 TGCAGGTTTA CGTGCAGCCC TCCAATTATC CAAATCCGGT TTGAATTGTG

101 CCGTTTTGTC TAAAGTGTTC CCGACCCGCT CGCATACCGT AGCGGCGCAG

151 GGCGGTATTT CCGCCTCTCT GGGTAATGTG CAGGAGGACC GTTGGGACTG

201 GCACATGTAC GATACCGTGA AGGTTCCGA CTGGCTGGGC GACCAAGATG

251 CGATTGAGTT TATGTGTCGC GCTGCGCCTG AAGCGGTGAT TGAGTTGGAA

301 CACATGGGTA TGCCTTTTGA CCGCGTTGAA AGCGGCAAAA TTTATCAGCG

351 TCCTTTCGGC GGACATACTG CCGAACATGG TAAACGTGCG GTAGAACGTG

401 CATGTGCGGT TGCCGACCGT ACCGGTCATG CGATGTTGCA TACTTTGTAC

451 CAACAAAACG TCCGTGCCAA TACACAATTC TTTGTGGAAT GGACGGCGCA

501 AGATTTGATT CGTGATGAAA ACGGCGATGT CGTCGGCGTA ACCGCCATGG

551 AAATGGAAAC GGGCGAAGTT TATATTTTCC ACGCCAAGGC CGTGATGTTT

601 GCTACCGGTG GCGGCGGTCG TATTTATGCT TCTTCTACCA ATGCTTATAT

651 GAATACCGGT GACGGTTTGG GCATTTGCGC CCGTGCGGGC ATTCCGTTGG

701 AAGATATGGA ATTCTGGCAA TTCCACCCGA CCGGCGTGGC GGGTGCGGGC

751 GTGTTGATTA CCGAAGGCGT ACGCGGCGAG GGCGGTATTC TGTTGAacgc
```

-continued
```
 801 cgacggcgaA cgcTTTATGG AAcgctatgc GCcgACCGta aAagaCTTGG

851 CTTCTCGCga cgtGGTTTCA CgcgcGatgG CGatggaAAt ctatgaaggt 901 cgcggctgTG GtaaAAAcaA agaCCacgtC TTACTGAAAA TCGACcAtAt 951 cggtGCAGAA AAAATTATGG AAAAACTGCC GGGCATCCGC GAGATTTCCA 1001 TTCagtttgc cGGTATCGAT CCGATTAAAG ACCCGATTcc ggttgTGCCG 1051 ACTACCCACT ATATGATGGG CGGCATTCcg aCCAATTATC ACGGTGAAGT

1101 TGTTGTTCCG CAAGGCGACG AGTACGAAGT ACCTGTAAAA GGCCTGTATG

1151 CCGCAGGTGA GTGCGCCTGT GCTTCCGTAC ACGGTGCGAA CCGTTTGGGT

1201 ACGAACTCCC TGCTGGACTT GGTGGTGTTC cgcccaaccc cccggtga
```

This corresponds to the amino acid sequence <SEQ ID 62; ORF 010.ng>:

```
g010.pep
   1 MGFPVRKFDA VIVGGGGAGL RAALQLSKSG LNCAVLSKVF PTRSHTVAAQ

51 GGISASLGNV QEDRWDWHMY DTVKGSDWLG DQDAIEFMCR AAPEAVIELE

101 HMGMPFDRVE SGKIYQRPFG GHTAEHGKRA VERACAVADR TGHAMLHTLY

151 QQNVRANTQF FVEWTAQDLI RDENGDVVGV TAMEMETGEV YIFHAKAVMF

201 ATGGGGRIYA SSTNAYMNTG DGLGICARAG IPLEDMEFWQ FHPTGVAGAG

251 VLITEGVRGE GGILLNADGE RFMERYAPTV KDLASRDVVS RAMAMEIYEG

301 RGCGKNKDHV LLKIDHIGAE KIMEKLPGIR EISIQFAGID PIKDPIPVVP

351 TTHYMMGGIP TNYHGEVVVP QGDEYEVPVK GLYAAGECAC ASVHGANRLG

401 TNSLLDLVVF RPTPR*
```

The following partial DNA sequence was identified in *N. meningitidis* <SEQ ID 63>:

```
m010.seq (PARTIAL)
   1 ..nTCCAATTAT CCAAATCCGG TCTGAATTGT GCCGTTTTGT CTAAAGTGTT 51    CCCGACCCGT TCGCATACCG TAGCGGCGCA GGGCGGTATT TCCGCCTCTn

101    TGGGTAATGT GCAGGAAGAC CGTTGGGACT GGCACATGTA CGATACCGTG

151    AAAGGTTCCG ACTGGTTGGG CGACCAAGAT GCGATTGAGT TTATGTGCCG

201    CGCCGCGCCT GAAGCCGTAA TTGAGTTGGA ACACATGGGT ATGCCTTTTG

251    ACCGTGTGGA AAGCGGTAAA ATTTATCAGC GTCCTTTCGG CGGCCATACT

301    GCCGAACACG GTAAACGCGC GGTAGAACGC GyCTGTGCGG TTGCCGACCG

351    TACAGGTCAT GCGATGCTGC ATACTTTGTA CCAACAAAAC GTCCGTGCCA

401    ATACGCAATT CTTTGTGGAA TGGACGGCAC AAGATTTGAT TCGTGATGAA

451    AACGGCGATG TCGTCGGCGT AACCGCCATG GAAATGGAAA CCGGCGAAgT

501    TTATATTTTC CACGCTAAAG CTGTGATGTT TGCTACCGGC GGCGGCGGTC

551    GTATTTATGC GTCTTCTACC AATGCCTATA TGAATACCGG CGATGGTTTG

601    GGTATTTGTG CGCGTGCAGG TATCCCGTTG GAAGACATGG AATTCTGGCA

651    ATTCCAGCCG ACCGGCGTGG CGGGTGCGGG CGTGTTGATT ACCGAA....
```

This corresponds to the amino acid sequence <SEQ ID 64; ORF 010>:

```
m010.pep (PARTIAL)
    1  ..XQLSKSGLNC AVLSKVFPTR SHTVAAQGGI SASXGNVQED RWDWHMYDTV

51    KGSDWLGDQD AIEFMCRAAP EAVIELEHMG MPFDRVESGK IYQRPFGGHT

101    AEHGKRAVER XCAVADRTGH AMLHTLYQQN VRANTQFFVE WTAQDLIRDE

151    NGDVVGVTAM EMETGEVYIF HAKAVMFATG GGGRIYASST NAYMNTGDGL

201    GICARAGIPL EDMEFWQFQP TGVAGAGVLI TE...
```

The following partial DNA sequence was identified in *N. meningitidis* <SEQ ID 65>:

```
a010.seq
     1 ATGGGCTTTC CTGTTCGCAA GTTTGATGCC GTGATTGTCG GCGGTGGTGG

51 TGCAGGTTTA CGCGCANCCC TCCAATTATC CAAATCCGGT CTGAATTGTG

101 CCGTTTTGTC TAAAGTGTTC CCGACCCGTT CGCATACCGT AGCGGCGCAG

151 GGCGGTATTT CCGCCTCTCT GGGTAATGTG CAGGAAGACC GTTGGGACTG

201 GCACATGTAC GATACCGTGA AAGGTTCCGA CTGGTTGGGC GACCAAGATG

251 CGATTGAGTT TATGTGCCGC GCCGCGCCTG AAGCCGTAAT TGAGTTGGAA

301 CACATGGGTA TGCCTTTTGA CCGTGTGGAA AGCGGTAAAA TTTATCAGCG

351 TCCTTTCGGC GGCCATACTG CCGAACACGG TAAACGCGCG GTAGAACGCG

401 CCTGTGCNGT TGCCGACCGT ACAGGTCATG CGATGCTGCA TACTTTGTAC

451 CAACAAAATG TCCGTGCCAA TACGCAATTC TTTGTGGAAT GGACGGCACA

501 AGATTTGATT CGTGATGAAA ACGGCGATGT CGTCGGCGTA ACCGCCATGG

551 AAATGGAAAC CGGCGAAGTT TATATTTTCC ACGCTAAAGC TGTGATGTTT

601 GCTACCGGCG GCGGCGGCCG TATTTATGCG TCTTCTACCA ATGCCTATAT

651 GAATACCGGC GATGGTTTGG GTATTTGTGC GCGTGCAGGT ATCCCGTTGG

701 AAGACATGGA ATTCTGGCAA TTCCACCCGA CCGGCGTGGC AGGTGCGGGC

751 GTGTTGATTA CCGAAGGCGT ACGCGGCGAG GGCGGTATTC TGTTGAATGC

801 CGACGGCGAA CGCTTTATGG AACGCTATGC GCCGACCGTA AAAGACTTGG

851 CTTCTCGCGA CGTTGTTTCC CGCGCGATGG CGATGGAAAT CTACGAAGGT

901 CGCGGCTGCG GTAAAAACAA AGACCATGTC TTACTGAAAA TCGACCATAT

951 CGGCGCAGAA AAAATTATGG AAAAACTGCC GGGCATCCGC GAGATTTCCA

1001 TTCAGTTCGC CGGTATCGAT CCGATTAAAG ACCCGATTCC CGTTGTGCCG

1051 ACTACCCACT ATATGATGGG CGGTATTCCG ACCAACTACC ATGGCGAAGT

1101 TGTCGTTCCT CAAGGCGACG AATACGAAGT GCCTGTAAAA GGTCTGTATG

1151 CGGCAGGTGA GTGCGCCTGT GCTTCCGTAC ACGGTGCGAA CCGCTTGGGT

1201 ACGAACTCCC TGCTGGACTT AGTGGTATTC GGTAAAGCTG CCGGCGACAG

1251 CATGATTAAA TTCATCAAAG AGCAAAGCGA CTGGAAACCT TTGCCTGCTA

1301 ATGCCGGCGA ACTGACCCGC CAACGTATCG AGCGTTTGGA CAATCAAACT

1351 GATGGTGAAA ACGTTGATGC ATTGCGCCGC GAACTGCAAC GCTCCGTACA

1401 ATTGCACGCC GGCGTGTTCC GTACTGATGA GATTCTGAGC AAAGGCGTTC

1451 GAGAAGTCAT GGCGATTGCC GAGCGTGTGA AACGTACCGA AATCAAAGAC
```

```
                        -continued
1501  AAGAGCAAAG TGTGGAATAC CGCGCGTATC GAGGCTTTGG AATTGGATAA

1551  CCTAATTGAA GTGGCGAAAG CGACTTTGGT GTCTGCCGAA GCACGTAAAG

1601  AATCACGCGG TGCGCACGCT TCAGACGACC ATCCTGAGCG CGATGATGAA

1651  AACTGGATGA AACATACGCT GTACCATTCA GATGCCAATA CCTTGTCCTA

1701  CAAACCGGTG CACACCAAGC CTTTGAGCGT GGAATACATC AAACCGGCCA

1751  AGCGCGTTTA TTGA
```

This corresponds to the amino acid sequence <SEQ ID 66; ORF 010.a>:

```
a010.pep
    1  MGFPVRKFDA VIVGGGGAGL RAXLQLSKSG LNCAVLSKVF PTRSHTVAAQ

51  GGISASLGNV QEDRWDWHMY DTVKGSDWLG DQDAIEFMCR AAPEAVIELE

101  HMGMPFDRVE SGKIYQRPFG GHTAEHGKRA VERACAVADR TGHAMLHTLY

151  QQNVRANTQF FVEWTAQDLI RDENGDVVGV TAMEMETGEV YIFHAKAVMF

201  ATGGGGRIYA SSTNAYMNTG DGLGICARAG IPLEDMEFWQ FHPTGVAGAG

251  VLITEGVRGE GGILLNADGE RFMERYAPTV KDLASRDVVS RAMAMEIYEG

301  RGCGKNKDHV LLKIDHIGAE KIMEKLPGIR EISIQFAGID PIKDPIPVVP

351  TTHYMMGGIP TNYHGEVVVP QGDEYEVPVK GLYAAGECAC ASVHGANRLG

401  TNSLLDLVVF GKAAGDSMIK FIKEQSDWKP LPANAGELTR QRIERLDNQT

451  DGENVDALRR ELQRSVQLHA GVFRTDEILS KGVREVMAIA ERVKRTEIKD

501  KSKVWNTARI EALELDNLIE VAKATLVSAE ARKESRGAHA SDDHPERDDE

551  NWMKHTLYHS DANTLSYKPV HTKPLSVEYI KPAKRVY*
``` m010/a010 98.7% identity over a 231 aa overlap

```
                      10        20        30
m010.pep              XQLSKSGLNCAVLSKVFPTRSHTVAAQGGISASXGNV
                      ||||||||||||||||||||||||||||||||| |||
a010       MGFPVRKFDAVIVGGGGAGLRAXLQLSKSGLNCAVLSKVFPTRSHTVAAQGGISASLGNV
                    10        20        30        40        50        60

40        50        60        70        80        90
m010.pep   QEDRWDWHMYDTVKGSDWLGDQDAIEFMCRAAPEAVIELEHMGMPFDRVESGKIYQRPFG
           ||||||||||||||||||||||||||||||||||||||||||||||||||||||||||||
a010       QEDRWDWHMYDTVKGSDWLGDQDAIEFMCRAAPEAVIELEHMGMPFDRVESGKIYQRPFG
                    70        80        90       100       110       120

100       110       120       130       140       150
m010.pep   GHTAEHGKRAVERXCAVADRTGHAMLHTLYQQNVRANTQFFVEWTAQDLIRDENGDVVGV
           |||||||||||||| |||||||||||||||||||||||||||||||||||||||||||||
a010       GHTAEHGKRAVERACAVADRTGHAMLHTLYQQNVRANTQFFVEWTAQDLIRDENGDVVGV
                   130       140       150       160       170       180

160       170       180       190       200       210
m010.pep   TAMEMETGEVYIFHAKAVMFATGGGGRIYASSTNAYMNTGDGLGICARAGIPLEDMEFWQ
           ||||||||||||||||||||||||||||||||||||||||||||||||||||||||||||
a010       TAMEMETGEVYIFHAKAVMFATGGGGRIYASSTNAYMNTGDGLGICARAGIPLEDMEFWQ
                   190       200       210       220       230       240

220       230
m010.pep   FQPTGVAGAGVLITE
           |:|||||||||||||
a010       FHPTGVAGAGVLITEGVRGEGGILLNADGERFMERYAPTVKDLASRDVVSRAMAMEIYEG
                   250       260       270       280       290       300
```

Computer analysis of this amino acid sequence gave the following results:
Homology with a Predicted ORF from *N. gonorrhoeae*
ORF 010 shows 98.7% identity over a 231 aa overlap with a predicted ORF (ORF 010.ng) from *N. gonorrhoeae*:

```
m010.pep/g010.pep
                                  10        20        30
    m010.pep                      XQLSKSGLNCAVLSKVFPTRSHTVAAQGGISASXGNV
                                  |||||||||||||||||||||||||||||||| |||
    a010      MGFPVRKFDAVIVGGGAGLRAXLQLSKSGLNCAVLSKVFPTRSHTVAAQGGISASLGNV
                      10        20        30        40        50        60

40        50        60        70        80        90
    m010.pep  QEDRWDWHMYDTVKGSDWLGDQDAIEFMCRAAPEAVIELEHMGMPFDRVESGKIYQRPFG
              ||||||||||||||||||||||||||||||||||||||||||||||||||||||||||||
    a010      QEDRWDWHMYDTVKGSDWLGDQDAIEFMCRAAPEAVIELEHMGMPFDRVESGKIYQRPFG
                      70        80        90       100       110       120

100       110       120       130       140       150
    m010.pep  GHTAEHGKRAVERXCAVADRTGHAMLHTLYQQNVRANTQFFVEWTAQDLIRDENGDVVGV
              ||||||||||||| ||||||||||||||||||||||||||||||||||||||||||||||
    a010      GHTAEHGKRAVERACAVADRTGHAMLHTLYQQNVRANTQFFVEWTAQDLIRDENGDVVGV
                     130       140       150       160       170       180

160       170       180       190       200       210
    m010.pep  TAMEMETGEVYIFHAKAVMFATGGGGRIYASSTNAYMNTGDGLGICARAGIPLEDMEFWQ
              ||||||||||||||||||||||||||||||||||||||||||||||||||||||||||||
    a010      TAMEMETGEVYIFHAKAVMFATGGGGRIYASSTNAYMNTGDGLGICARAGIPLEDMEFWQ
                     190       200       210       220       230       240

220       230
    m010.pep  FQPTGVAGAGVLITE
              |:|||||||||||||
    a010      FHPTGVAGAGVLITEGVRGEGGILLNADGERFMERYAPTVKDLASRDVVSRAMAMEIYEG
                     250       260       270       280       290       300
```

The following partial DNA sequence was identified in *N. gonorrhoeae* <SEQ ID 67>:

```
g010-1.seq..
    1 ATGGGTTTTC CTGTTCGCAA GTTTGATGCC GTGATTGTCG GCGGTGGCGG

51 TGCAGGTTTA CGTGCAGCCC TCCAATTATC CAAATCCGGT TTGAATTGTG

101 CCGTTTTGTC TAAAGTGTTC CCGACCCGCT CGCATACCGT AGCGGCGCAG

151 GGCGGTATTT CCGCCTCTCT GGGTAATGTG CAGGAGGACC GTTGGGACTG

201 GCACATGTAC GATACCGTGA AAGGTTCCGA CTGGCTGGGC GACCAAGATG

251 CGATTGAGTT TATGTGTCGC GCTGCGCCTG AAGCGGTGAT TGAGTTGGAA

301 CACATGGGTA TGCCTTTTGA CCGCGTTGAA AGCGGCAAAA TTTATCAGCG

351 TCCTTTCGGC GGACATACTG CCGAACATGG TAAACGTGCG GTAGAACGTG

401 CATGTGCGGT TGCCGACCGT ACCGGTCATG CGATGTTGCA TACTTTGTAC

451 CAACAAAACG TCCGTGCCAA TACACAATTC TTTGTGGAAT GGACGGCGCA

501 AGATTTGATT CGTGATGAAA ACGGCGATGT CGTCGGCGTA ACCGCCATGG

551 AAATGGAAAC GGGCGAAGTT TATATTTTCC ACGCCAAGGC CGTGATGTTT

601 GCTACCGGTG GCGGCGGTCG TATTTATGCT TCTTCTACCA ATGCTTATAT

651 GAATACCGGT GACGGTTTGG GCATTTGCGC CCGTGCGGGC ATTCCGTTGG

701 AAGATATGGA ATTCTGGCAA TTCCACCCGA CCGGCGTGGC GGGTGCGGGC

751 GTGTTGATTA CCGAAGGCGT ACGCGGCGAG GGCGGTATTC TGTTGAACGC

801 CGACGGCGAA CGCTTTATGG AACGCTATGC GCCGACCGTA AAAGACTTGG

851 CTTCTCGCGA CGTGGTTTCA CGCGCGATGG CGATGGAAAT CTATGAAGGT

901 CGCGGCTGTG GTAAAAACAA AGACCACGTC TTACTGAAAA TCGACCATAT
```

```
 951 CGGTGCAGAA AAAATTATGG AAAAACTGCC GGGCATCCGC GAGATTTCCA

1001 TTCAGTTTGC CGGTATCGAT CCGATTAAAG ACCCGATTCC GGTTGTGCCG

1051 ACTACCCACT ATATGATGGG CGGCATTCCG ACCAATTATC ACGGTGAAGT

1101 TGTTGTTCCG CAAGGCGACG AGTACGAAGT ACCTGTAAAA GGCCTGTATG

1151 CCGCAGGTGA GTGCGCCTGT GCTTCCGTAC ACGGTGCGAA CCGTTTGGGT

1201 ACGAACTCCC TGCTGGACTT GGTGGTGTTC cgcccaaccc cccggtga
```

This corresponds to the amino acid sequence <SEQ ID 68; ORF 010-1.ng>:

```
g010-1.pep
    1 MGFPVRKFDA VIVGGGGAGL RAALQLSKSG LNCAVLSKVF PTRSHTVAAQ

51 GGISASLGNV QEDRWDWHMY DTVKGSDWLG DQDAIEFMCR AAPEAVIELE

101 HMGMPFDRVE SGKIYQRPFG GHTAEHGKRA VERACAVADR TGHAMLHTLY

151 QQNVRANTQF FVEWTAQDLI RDENGDVVGV TAMEMETGEV YIFHAKAVMF

201 ATGGGGRIYA SSTNAYMNTG DGLGICARAG IPLEDMEFWQ FHPTGVAGAG

251 VLITEGVRGE GGILLNADGE RFMERYAPTV KDLASRDVVS RAMAMEIYEG

301 RGCGKNKDHV LLKIDHIGAE KIMEKLPGIR EISIQFAGID PIKDPIPVVP

351 TTHYMMGGIP TNYHGEVVVP QGDEYEVPVK GLYAAGECAC ASVHGANRLG

401 TNSLLDLVVF RPTPR* g010-1/P10444
sp|P10444|DHSA_ECOLI SUCCINATE DEHYDROGENASE FLAVOPROTEIN SUBUNIT
gnl|PID|d101527.0 (D90711) Succinate dehydrogenase, flavoprotein [Escherichia coli] gi|1786942
(AE000175) succinate dehydrogenase flavoprotein subunit [Escherichia coli] Length = 588
Score = 1073 (495.6 bits), Expect = 6.7e-169, Sum P(2) = 6.7e-169
Identities = 191/303 (63%), Positives = 238/303 (78%)
Query:     1 MGFPVRKFDAVIVXXXXXXXXXXXXXSKSGLNCAVLSKVFPTRSHTVAAQGGISASLGNV  60

M  PVR+FDAV++             S+SG  CA+LSKVFPTRSHTV+AQGGI+ +LGN

Sbjct:     1 MKLPVREFDAVVIGAGGAGMRAALQISQSGQTCALLSKVFPTRSHTVSAQGGITVALGNT  60

Query:    61 QEDRWDWHMYDTVKGSDWLGDQDAIEFMCRAAPEAVIELEHMGMPFDRVESGKIYQRPFG 120

ED W+WHMYDTVKGSD++GDQDAIE+MC+  PEA++ELEHMG+PF R++ G+IYQRPFG

Sbjct:    61 HEDNWEWHMYDTVKGSDYIGDQDAIEYMCKTGPEAILELEHMGLPFSRLDDGRIYQRPFG 120

Query:   121 GHTAEHGKRAVERACAVADRTGHAMLHTLYQQNVRANTQFFVEWTAQDLIRDENGDVVGV 180

G +    G    R A ADRTGHA+LHTLYQQN++  +T  F EW A DL+++++G VVG

Sbjct:   121 GQSKNFGGEQAARTAAAADRTGHALLHTLYQQNLKNHTTIFSEWYALDLVKNQDGAVVGC 180

Query:   181 TAMEMETGEVYIFHAKAVMFATGGGGRIYASSTNAYMNTGDGLGICARAGIPLEDMEFWQ 240

TA+ +ETGEV  F A+A + ATGG GRIY S+TNA++NTGDG+G+  RAG+P++DME WQ

Sbjct:   181 TALCIETGEVVYFKARATVLATGGAGRIYQSTTNAHINTGDGVGMAIRAGVPVQDMEMWQ 240

Query:   241 FHPTGVAGAGVLITEGVRGEGGILLNADGERFMERYAPTVKDLASRDVVSRAMAMEIYEG 300

FHPTG+AGAGVL+TEG RGEGG LLN  GERFMERYAP  KDLA RDVV+R++ +EI EG

Sbjct:   241 FHPTGIAGAGVLVTEGCRGEGGYLLNKHGERFMERYAPNAKDLAGRDVVARSIMIEIREG 300

Query:   301 RGC 303

RGC

Sbjct:   301 RGC 303
```

```
-continued
Score = 249 (115.0 bits), Expect = 6.7e-169, Sum P(2) = 6.7e-169
Identities = 53/102 (51%), Positives = 62/102 (60%)
Query:  309 HVLLKIDHIGAEKIMEKLPGIREISIQFAGXXXXXXXXXXXXXTTHYMMGGIPTNYHGEVV 368
                H  LK+DH+G E +  +LPGI E+S  FA             T HYMMGGIPT   G+ +
Sbjct:  310 HAKLKLDHLGKEVLESRLPGILELSRTFAHVDPVKEPIPVIPTCHYMMGGIPTKVTGQAL 369

Query:  369 VPQGDEYEVPVKGLYAAGECACASVHGANRLGTNSLLDLVVF 410
                +V V GL+A GE AC SVHGANRLG NSLLDLVVF
Sbjct:  370 TVNEKGEDVVVPGLFAVGEIACVSVHGANRLGGNSLLDLVVF 411
```

The following partial DNA sequence was identified in *N. meningitidis* <SEQ ID 69>:

```
m010-1.seg..
   1  ATGGGTTTTC CTGTTCGCAA GTTTGATGCC GTGATTGTCG GCGGTGGTGG
  51  TGCAGGTTTA CGCGCAGCCC TCCAATTATC CAAATCCGGT CTGAATTGTG
 101  CCGTTTTGTC TAAAGTGTTC CCGACCCGTT CGCATACCGT AGCGGCGCAg
 151  GGCGGTATTT CCGCCTCTCT GGGTAATGTG CAGGAAGACC GTTGGGACTG
 201  GCACATGTAC GATACCGTGA AAGGTTCCGA CTGGTTGGGC GACCAAGATG
 251  CGATTGAGTT TATGTGCCGC GCCGCGCCTG AAGCCGTAAT TGAGTTGGAA
 301  CACATGGGTA TGCCTTTTGA CCGTGTGGAA AGCGGTAAAA TTTATCAGCG
 351  TCCTTTCGGC GGCCATACTG CCGAACACGG TAAACGCGCG GTAGAACGCG
 401  CCTGTGCGGT TGCCGACCGT ACAGGTCATG CGATGCTGCA TACTTTGTAC
 451  CAACAAAACG TCCGTGCCAA TACGCAATTC TTTGTGGAAT GGACGGCACA
 501  AGATTTGATT CGTGATGAAA ACGGCGATGT CGTCGGCGTA ACCGCCATGG
 551  AAATGGAAAC CGGCGAAGTT TATATTTTCC ACGCTAAAGC TGTGATGTTT
 601  GCTACCGGCG GCGGCGGTCG TATTTATGCG TCTTCTACCA ATGCCTATAT
 651  GAATACCGGC GATGGTTTGG GTATTTGTGC GCGTGCAGGT ATCCCGTTGG
 701  AAGACATGGA ATTCTGGCAA TTCCACCCGA CCGGCGTGGC GGGTGCGGGC
 751  GTGTTGATTA CCGAAGGCGT ACGCGGCGAG GGCGGTATTC TGTTGAATGC
 801  CGACGGCGAA CGCTTTATGG AACGCTATGC GCCGACCGTA AAAGACTTGG
 851  CTTCTCGCGA CGTTGTTTCC CGCGCGATGG CGATGGAAAT CTACGAAGGT
 901  CGCGGCTGCG GTAAAAACAA AGACCATGTC TTACTGAAAA TCGACCATAT
 951  CGGCGCAGAA AAAATTATGG AAAAACTGCC GGGCATCCGC GAGATTTCCA
1001  TTCAGTTCGC CGGTATCGAT CCGATTAAAG ACCCGATTCC CGTTGTGCCG
1051  ACTACCCACT ATATGATGGG CGGCATTCCG ACCAATTACC ACGGCGAAGT
1101  TGTCGTTCCG CAAGGTGAAG ATTACGAAGT GCCTGTAAAA GGTCTGTATG
1151  CGGCAGGTGA GTGCGCTTGT GCTTCCGTAC ACGGTGCGAA CCGCTTGGGT
1201  ACCAATTACC TGTTGGACTT GGTGGTATTC GGTAAAGCTG CCGGCGACAG
1251  CATGATTAAA TTCATCAAAG AGCAAAGCGA CTGGAAACCT TTGCCTGCTA
1301  ATGCAGGTGA GTTGACCCGC CAACGTATCG AGCGTTTGGA CAACCAAACC
1351  GATGGTGAAA ACGTTGATGC ATTGCGTCGC GAACTGCAAC GCTCTGTACA
1401  ACTGCACGCC GGCGTGTTCC GTACTGATGA GATTCTGAGC AAAGGCGTTC
1451  GAGAAGTCAT GGCGATTGCC GAGCGTGTGA AACGTACCGA AATCAAAGAC
```

```
-continued
1501 AAGAGCAAAG TGTGGAATAC CGCGCGTATC GAGGCTTTGG AATTGGATAA

1551 CCTGATTGAA GTGGCGAAAG CGACTTTGGT GTCTGCCGAA GCACGTAAAG

1601 AATCACGCGG TGCGCACGCT TCAGACGACC ATCCTGAGCG CGATGATGAA

1651 AACTGGATGA ACATACGCT GTACCATTCA GATATCAATA CCTTGTCCTA

1701 CAAACCGGTG CACACCAAGC CTTTGAGCGT GGAATACATC AAACCGGCCA

1751 AGCGCGTTTA TTGATGA
```

This corresponds to the amino acid sequence <SEQ ID 70; ORF 010-1>:

```
m010-1.pep...

1  MGFPVRKFDA VIVGGGGAGL RAALQLSKSG LNCAVLSKVF PTRSHTVAAQ
         51  GGISASLGNV QEDRWDWHMY DTVKGSDWLG DQDAIEFMCR AAPEAVIELE
        101  HHGMPFDRVE SGKIYQRPFG GHTAEHGKRA VERACAVADR TGHAMLHTLY
        151  QQNVRANTQF FVEWTAQDLI RDENGDVVGV TAMEMETGEV YIFHAKAVMF
        201  ATGGGGRIYA SSTNAYMNTG DGLGICARAG IPLEDMEFWQ FHPTGVAGAG
        251  VLITEGVRGE GGILLNADGE RFMERYAPTV KDLASRDVVS RAMAMEITEG
        301  RGCGKNKDHV LLKIDGIGAE KIMEKLPGIR EISIQFAGID PIKDPIPVVP
        351  TTHYMMGGIP TNYHGEVVVP QGDEYEVPVK GLYAAGECAC ASVHGANRLG
        401  TNSLLDLVVF GKAAGDSMIK FIKEQSDWKP LPANAGELTR QRIERLDNQT
        451  DGENVDALRR ELQRSVQLHA GVFRTDEILS KGVREVMAIA ERVKRTEIKD
        501  KSKVWNTARI EALELDNLIE VAKATLVSAE ARKESRGAHA SDDHPERDDE
        551  NWMKHTLYHS DANTLSYKPV HTKPLSVEYI KPAKRVY* m010-1/g010-1   99.5% identity in 410 aa overlap 10          20         30         40         50         60
m010-1.pep     MGFPVRKFDAVIVGGGGAGLRAALQLSKSGLNCAVLSKVFPTRSHTVAAQGGISASLGNV
               ||||||||||||||||||||||||||||||||||||||||||||||||||||||||||||
a010-1         MGFPVRKFDAVIVGGGGAGLRAALQLSKSGLNCAVLSKVFPTRSHTVAAQGGISASLGNV
                        10         20         30         40         50         60

70         80         90        100        110        120
m010-1.pep     QEDRWDWHMYDTVKGSDWLGDQDAIEFMCRAAPEAVIELEHMGMPFDRVESGKIYQRPFG
               ||||||||||||||||||||||||||||||||||||||||||||||||||||||||||||
g010-1         QEDRWDWHMYDTVKGSDWLGDQDAIEFMCRAAPEAVIELEHMGMPFDRVESGKIYQRPFG
                        70         80         90        100        110        120

130        140        150        160        170        180
m010-1.pep     GHTAEHGKRAVERACAVADRTGHAMLHTLYQQNVRANTQFFVEWTAQDLIRDENGDVVGV
               ||||||||||||||||||||||||||||||||||||||||||||||||||||||||||||
g010-1         GHTAEHGKRAVERACAVADRTGHAMLHTLYQQNVRANTQFFVEWTAQDLIRDENGDVVGV
                       130        140        150        160        170        180

190        200        210        220        230        240
m010-1.pep     TAMEMETGEVYIFHAKAVMFATGGGGRIYASSTNAYMNTGDGLGICARAGIPLEDMEFWQ
               ||||||||||||||||||||||||||||||||||||||||||||||||||||||||||||
g010-1         TAMEMETGEVYIFHAKAVMFATGGGGRIYASSTNAYMNTGDGLGICARAGIPLEDMEFWQ
                       190        200        210        220        230        240

250        260        270        280        290        300
m010-1.pep     FHPTGVAGAGVLITEGVRGEGGILLNADGERFMERYAPTVKDLASRDVVSRAMAMEIYEG
               ||||||||||||||||||||||||||||||||||||||||||||||||||||||||||||
g010-1         FHPTGVAGAGVLITEGVRGEGGILLNADGERFMERYAPTVKDLASRDVVSRAMAMEIYEG
                       250        260        270        280        290        300

310        320        330        340        350        360
m010-1.pep     RGCGKNKDHVLLKIDHIGAEKIMEKLPGIREISIQFAGIDPIKDPIPVVPTTHYMMGGIP
               ||||||||||||||||||||||||||||||||||||||||||||||||||||||||||||
g010-1         RGCGKNKDHVLLKIDHIGAEKIMEKLPGIREISIQFAGIDPIKDPIPVVPTTHYMMGGIP
                       310        320        330        340        350        360
```

-continued

```
             370        380        390        400        410        420
m010-1.pep   TNYHGEVVVPQGEDYEVPVKGLYAAGECACASVHGANRLGTNSLLDLVVFGKAAGDSMIK
             ||||||||||||::|||||||||||||||||||||||||||||||||||||||:
g010-1       TNYHGEVVVPQGDEYEVPVKGLYAAGECACASVHGANRLGTNSLLDLVVFRPTPRX
             370        380        390        400        410

430        440        450        460        470        480
m010-1.pep   FIKEQSDWKPLPANAGELTRQRIERLDNQTDGENVDALRRELQRSVQLHAGVFRTDEILS
```

The following partial DNA sequence was identified in *N. meningitidis* <SEQ ID 71>:

```
a010-1.seq..
   1 ATGGGCTTTC CTGTTCGCAA GTTTGATGCC GTGATTGTCG GCGGTGGTGG

51 TGCAGGTTTA CGCGCANCCC TCCAATTATC CAAATCCGGT CTGAATTGTG

101 CCGTTTTGTC TAAAGTGTTC CCGACCCGTT CGCATACCGT AGCGGCGCAG

151 GGCGGTATTT CCGCCTCTCT GGGTAATGTG CAGGAAGACC GTTGGGACTG

201 GCACATGTAC GATACCGTGA AAGGTTCCGA CTGGTTGGGC GACCAAGATG

251 CGATTGAGTT TATGTGCCGC GCCGCGCCTG AAGCCGTAAT TGAGTTGGAA

301 CACATGGGTA TGCCTTTTGA CCGTGTGGAA AGCGGTAAAA TTTATCAGCG

351 TCCTTTCGGC GGCCATACTG CCGAACACGG TAAACGCGCG GTAGAACGCG

401 CCTGTGCNGT TGCCGACCGT ACAGGTCATG CGATGCTGCA TACTTTGTAC

451 CAACAAAATG TCCGTGCCAA TACGCAATTC TTTGTGGAAT GGACGGCACA

501 AGATTTGATT CGTGATGAAA ACGGCGATGT CGTCGGCGTA ACCGCCATGG

551 AAATGGAAAC CGGCGAAGTT TATATTTTCC ACGCTAAAGC TGTGATGTTT

601 GCTACCGGCG GCGGCGGCCG TATTTATGCG TCTTCTACCA ATGCCTATAT

651 GAATACCGGC GATGGTTTGG GTATTTGTGC GCGTGCAGGT ATCCCGTTGG

701 AAGACATGGA ATTCTGGCAA TTCCACCCGA CCGGCGTGGC AGGTGCGGGC

751 GTGTTGATTA CCGAAGGCGT ACGGCGCGAG GGCGGTATTC TGTTGAATGC

801 CGACGGCGAA CGCTTTATGG AACGCTATGC GCCGACCGTA AAAGACTTGG

851 CTTCTCGCGA CGTTGTTTCC CGCGCGATGG CGATGGAAAT CTACGAAGGT

901 CGCGGCTGCG GTAAAAACAA AGACCATGTC TTACTGAAAA TCGACCATAT

951 CGGCGCAGAA AAAATTATGG AAAAACTGCC GGGCATCCGC GAGATTTCCA

1001 TTCAGTTCGC CGGTATCGAT CCGATTAAAG ACCCGATTCC CGTTGTGCCG

1051 ACTACCCACT ATATGATGGG CGGTATTCCG ACCAACTACC ATGGCGAAGT

1101 TGTCGTTCCT CAAGGCGACG AATACGAAGT GCCTGTAAAA GGTCTGTATG

1151 CGGCAGGTGA GTGCGCCTGT GCTTCCGTAC ACGGTGCGAA CCGCTTGGGT

1201 ACGAACTCCC TGCTGGACTT AGTGGTATTC GGTAAAGCTG CCGGCGACAG

1251 CATGATTAAA TTCATCAAAG AGCAAAGCGA CTGGAAACCT TTGCCTGCTA

1301 ATGCCGGCGA ACTGACCCGC CAACGTATCG AGCGTTTGGA CAATCAAACT

1351 GATGGTGAAA ACGTTGATGC ATTGCGCCGC GAACTGCAAC GCTCCGTACA

1401 ATTGCACGCC GGCGTGTTCC GTACTGATGA GATTCTGAGC AAAGGCGTTC

1451 GAGAAGTCAT GGCGATTGCC GAGCGTGTGA AACGTACCGA AATCAAAGAC

1501 AAGAGCAAAG TGTGGAATAC CGCGCGTATC GAGGCTTTGG AATTGGATAA

1551 CCTAATTGAA GTGGCGAAAG CGACTTTGGT GTCTGCCGAA GCACGTAAAG
```

```
-continued
1601 AATCACGCGG TGCGCACGCT TCAGACGACC ATCCTGAGCG CGATGATGAA

1651 AACTGGATGA AACATACGCT GTACCATTCA GATGCCAATA CCTTGTCCTA

1701 CAAACCGGTG CACACCAAGC CTTTGAGCGT GGAATACATC AAACCGGCCA

1751 AGCGCGTTTA TTGA
```

This corresponds to the amino acid sequence <SEQ ID 72; ORF 010-1.a>:

```
a010-1.pep...

1  MGFPVRKFDA VIVGGGGAGL RAXLQLSKSG LNCAVLSKVF PTRSHTVAAQ
    51  GGISASLGNV QEDRWDWHMY DTVKGSDWLG DQDAIEFMCR AAPEAVIELE
   101  HHGMPFDRVE SGKIYQRPFG GHTAEHGKRA VERACAVADR TGHAMLHTLY
   151  QQNVRANTQF FVEWTAQDLI RDENGDVVGV TAMEMETGEV YIFHAKAVMF
   201  ATGGGGRIYA SSTNAYMNTG DGLGICARAG IPLEDMEFWQ FHPTGVAGAG
   251  VLITEGVRGE GGILLNADGE RFMERYAPTV KDLASRDVVS RAMAMEITEG
   301  RGCGKNKDHV LLKIDGIGAE KIMEKLPGIR EISIQFAGID PIKDPIPVVP
   351  TTHYMMGGIP TNYHGEVVVP QGDEYEVPVK GLYAAGECAC ASVHGANRLG
   401  TNSLLDLVVF GKAAGDSMIK FIKEQSDWKP LPANAGELTR QRIERLDNQT
   451  DGENVDALRR ELQRSVQLHA GVFRTDEILS KGVREVMAIA ERVKRTEIKD
   501  KSKVWNTARI EALELDNLIE VAKATLVSAE ARKESRGAHA SDDHPERDDE
   551  NWMKHTLYHS DANTLSYKPV HTKPLSVEYI KPAKRVY* m010-1/a010-1  99.3% identity in 587 aa overlap 10         20         30         40         50         60
a010-1.pep     MGFPVRKFDAVIVGGGGAGLRAXLQLSKSGLNCAVLSKVFPTRSHTVAAQGGISASLGNV
               ||||||||||||||||||||| ||||||||||||||||||||||||||||||||||||||
a010-1         MGFPVRKFDAVIVGGGGAGLRAALQLSKSGLNCAVLSKVFPTRSHTVAAQGGISASLGNV
                       10         20         30         40         50         60

70         80         90        100        110        120
a010-1.pep     QEDRWDWHMYDTVKGSDWLGDQDAIEFMCRAAPEAVIELEHMGMPFDRVESGKIYQRPFG
               ||||||||||||||||||||||||||||||||||||||||||||||||||||||||||||
m010-1         QEDRWDWHMYDTVKGSDWLGDQDAIEFMCRAAPEAVIELEHMGMPFDRVESGKIYQRPFG
                       70         80         90        100        110        120

130        140        150        160        170        180
a010-1.pep     GHTAEHGKRAVERACAVADRTGHAMLHTLYQQNVRANTQFFVEWTAQDLIRDENGDVVGV
               ||||||||||||||||||||||||||||||||||||||||||||||||||||||||||||
m010-1         GHTAEHGKRAVERACAVADRTGHAMLHTLYQQNVRANTQFFVEWTAQDLIRDENGDVVGV
                      130        140        150        160        170        180

190        200        210        220        230        240
a010-1.pep     TAMEMETGEVYIFHAKAVMFATGGGGRIYASSTNAYMNTGDGLGICARAGIPLEDMEFWQ
               ||||||||||||||||||||||||||||||||||||||||||||||||||||||||||||
m010-1         TAMEMETGEVYIFHAKAVMFATGGGGRIYASSTNAYMNTGDGLGICARAGIPLEDMEFWQ
                      190        200        210        220        230        240

250        260        270        280        290        300
a010-1.pep     FHPTGVAGAGVLITEGVRGEGGILLNADGERFMERYAPTVKDLASRDVVSRAMAMEIYEG
               ||||||||||||||||||||||||||||||||||||||||||||||||||||||||||||
m010-1         FHPTGVAGAGVLITEGVRGEGGILLNADGERFMERYAPTVKDLASRDVVSRAMAMEIYEG
                      250        260        270        280        290        300

310        320        330        340        350        360
a010-1.pep     RGCGKNKDHVLLKIDHIGAEKIMEKLPGIREISIQFAGIDPIKDPIPVVPTTHYMMGGIP
               ||||||||||||||||||||||||||||||||||||||||||||||||||||||||||||
m010-1         RGCGKNKDHVLLKIDHIGAEKIMEKLPGIREISIQFAGIDPIKDPIPVVPTTHYMMGGIP
                      310        320        330        340        350        360

370        380        390        400        410        420
a010-1.pep     TNYHGEVVVPQGDEYEVPVKGLYAAGECACASVHGANRLGTNSLLDLVVFGKAAGDSMIK
               ||||||||||:: |||||||||||||||||||||||||||||||||||||||||||||||
m010-1         TNYHGEVVVPQGDEYEVPVKGLYAAGECACASVHGANRLGTNSLLDLVVFGKAAGDSMIK
                      370        380        390        400        410        420
```

```
                     430        440        450        460        470        480
a010-1.pep    FIKEQSDWKPLPANAGELTRQRIERLDNQTDGENVDALRRELQRSVQLHAGVFRTDEILS
              ||||||||||||||||||||||||||||||||||||||||||||||||||||||||||||
m010-1        FIKEQSDWKPLPANAGELTRQRIERLDNQTDGENVDALRRELQRSVQLHAGVFRTDEILS
                     430        440        450        460        470        480

490        500        510        520        530        540
a010-1.pep    KGVREVMAIAERVKRTEIKDKSKVWNTARIEALELDNLIEVAKATLVSAEARKESRGAHA
              ||||||||||||||||||||||||||||||||||||||||||||||||||||||||||||
m010-1        KGVREVMAIAERVKRTEIKDKSKVWNTARIEALELDNLIEVAKATLVSAEARKESRGAHA
                     490        500        510        520        530        540

550        560        570        580
a010-1.pep    SDDHPERDDENWMKHTLYHSDANTLSYKPVHTKPLSVEYIKPAKRVYX
              |||||||||||||||||||| |||||||||||||||||||||||||||
m010-1        SDDHPERDDENWMKHTLYHSDINTLSYKPVHTKPLSVEYIKPAKRVYX
                     550        560        570        580
```

The following partial DNA sequence was identified in *N. gonorrhoeae* <SEQ ID 73>:

```
g011.seq
  1 ATGAAGACAC ACCGCAAGAC CTGCTCTGCG GTGTGTTTTG CTTTTCAGAC

51 GGCATCGAAA CCCGCCGTTT CCATCCGACA TCCCAGCGAG GACATCATGA

101 GCCTGAAAAC CCGCCTTACC GAAGATATGA AAACCGCGAT GCGCGCCAAA

151 GATCAAGTTT CCCTCGGCAC CATCCGCCTC ATCAATGCCG CCGTCAAACA

201 GTTTGAAGTA GACGAACGCA CCGAAGCCGA CGATGCCAAA ATCACCGCCA

251 TCCTGACCAA AATGGTCAAA CAGCGCAAAG ACGGCGCGAA AATCTACACT

301 GAAGCCGGCC GTCAGGATTT GGCAGACAAA GAAAACGCCG AAATCGACGT

351 GCTGCACCGC TACCTGCCGC AAATGCTCTC CGCCGGCGAA ATCCGCACCG

401 CCGTCGAAGC AGCCGTTGCC GAAACCGGCG CGGCAGGTAT GGCGGATATG

451 GGCAAAGTGA TGGTCGTATT GAAAAcccGC CTCGCCGGCA AAGccgATAT

501 GGGCGAAGTC AACAAAATCT TGAAAAccGt aCTGACCGCC tga
```

This corresponds to the amino acid sequence <SEQ ID 74; ORF 011.ng>:

```
g011.pepr
  1 MKTHRKTCSA VCFAFQTASK PAVSIRHPSE DIMSLKTRLT EDMKTAMRAK

51 DQVSLGTIRL INAAVKQFEV DERTEADDAK ITAILTKMVK QRKDGAKIYT

101 EAGRQDLADK ENAEIDVLHR YLPQMLSAGE IRTAVEAAVA ETGAAGMADM

151 GKVMVVLKTR LAGKADMGEV NKILKTVLTA *
                                                      50
```

The following partial DNA sequence was identified in *N. meningitidis* <SEQ ID 75>:

```
m011.seq (partial)
  1 ATGAGGACAC ACCGCAAGAC CTGCTCTGCG GTGTGTTTTG CTTTTCAGAC

51 GGCATCGAAA CCCGCCGTTT CCATCCGACA TCCCAGCGAG GACATCATGA

101 GCCTGAAAAT CCGCCTTACC GAAGACATGA AAACCGCGAT GCGCGCCAAA

151 GACCAAGTTT CCCTCGGCAC CATCCGCCTC ATCAACGCCG CCGTCAAACA

201 GTTTGAAGTG GACGAACGCA CCGAAGCCGA CGATGCCAAA ATCACCGCCA

251 TCCTGACCAA AATGGTCAAA CAGCGAAAAG ACAGCGCGAA AATCTACACT

301 GAAGCCGGCC GTCAGGATTT GGCAGACAAA GAAAACGCCG AAATCGAGGT
```

```
351 ACTGCACCGC TACCTTCCCC AAATGCTTTC CGCCGGCGAA ATCCGTACCG

401 AGGTCGAAGC TGCCGTTGCC GAAACCGGCG CGGCAGGTAT GGCGGATATG

451 GGTAAAGTCA TGGGGCTGCT GAAAACCCGC CTCGCAGGTA AAGCCGA...
```

This corresponds to the amino acid sequence <SEQ ID 76; ORF 011>:

```
m011.pep (partial)
    1 MRTHRKTCSA VCFAFQTASK PAVSIRHPSE DIMSLKIRLT EDMKTAMRAK

51 DQVSLGTIRL INAAVKQFEV DERTEADDAK ITAILTKMVK QRKDSAKIYT

101 EAGRQDLADK ENAEIEVLHR YLPQMLSAGE IRTEVEAAVA ETGAAGMADM

151 GKVMGLLKTR LAGKA.....
```

Computer analysis of this amino acid sequence gave the following results:

Homology with a Predicted ORF from *N. gonorrhoeae*
ORF 011 shows 95.8% identity over a 165 aa overlap with a predicted ORF (ORF 011.ng) from *N. gonorrhoeae*:

```
m011/g011
                      10         20         30         40         50         60
    m011.pep  MRTHRKTCSAVCFAFQTASKPAVSIRHPSEDIMSLKIRLTEDMKTAMRAKDQVSLGTIRL
              |:||||||||||||||||||||||||||||||||| ||||||||||||||||||||||||
    g011      MKTHRKTCSAVCFAFQTASKPAVSIRHPSEDIMSLKTRLTEDMKTAMRAKDQVSLGTIRL
                      10         20         30         40         50         60
                      70         80         90        100        110        120
    m011.pep  INAAVKQFEVDERTEADDAKITAILTKMVKQRKDSAKIYTEAGRQDLADKENAEIEVLHR
              ||||||||||||||||||||||||||||||||||||:||||||||||||||||||:||||
    g011      INAAVKQFEVDERTEADDAKITAILTKMVKQRKDGAKIYTEAGRQDLADKENAEIDVLHR
                      70         80         90        100        110        120
                     130        140        150        160
    m011.pep  YLPQMLSAGEIRTEVEAAVAETGAAGMADMGKVMGLLKTRLAGKA
              |||||||||||||:|||||||||||||||||| :||||||||||
    g011      YLPQMLSAGEIRTAVEAAVAETGAAGMADMGKVMVVLKTRLAGKADMGEVNKILKTVLTA
                     130        140        150        160        170        180
    g011      X
```

The following partial DNA sequence was identified in *N. gonorrhoeae* <SEQ ID 77>:

```
g012.seq
    1 ATGCTCGCCC GTCGCTATTT TTTCAATATC CAACCCGGGG CGGTTTTCAC

51 TGACAAACTG CTTGAACAAC TGATGCGTTT CCTCCAGTTC CTGCCGGAAT

101 TTCTGTTTGC CCTTTTCCGT ATTTTCACCC ATAAAAGTAA CCGTGCGCTT

151 AAATTCGCCC GCCGTCATCA CATCCACATC AATATCATGT TTTTTCAACa 201 gGcggTGGAT ATTCGgcact tccgCcacca cacccaccga accgatgacc 251 gcaaacggaG CGGAAACAAT TTTATCCGCc acacacgcca tcatatagcc 301 gcCGCTTGCC GCGACCTTAT CGAcggcgac ggTCAGCGGA ATATTGCGTT

351 CGCGCAAACG CCTAAGCTGC GAAGCCGCCA AACCGTAACC GTGAACCACG

401 CCGCCCGGAC TTTCCAATCT GAGCAGAACC TCATCTTCAG GCTTGGCAAT

451 CAAAAGCACC GCCGTAATCT CATGACGCAA GGATTCTACG GCGTGTGCAT

501 ACAAATCGCC GTCAAAATCC AACACAAAAA GGCGGGATTT TTGCGTTTCG

551 GCAGATTTCT CCCCGCCCTC CTTCAAACGC TTTTTCTCTG CTTTGGCTTC
```

```
601 CGCCTTTTCC TTTTTCTTTT CTTTTTTTTC CTGATGTTTT GTCTCTTCCT

651 CGCTTAA
```

This corresponds to the amino acid sequence <SEQ ID 78; ORF 012.ng>:

```
g012.pep
  1 MLARRYFFNI QPGAVFTDKL LEQLMRFLQF LPEFLFALFR IFTHKSNRAL

51 KFARRHHIHI NIMFFQQAVD IRHFRHHTHR TDDRKRSGNN FIRHTRHHIA

101 AACRDLIDGD GQRNIAFAQT PKLRSRQTVT VNHAARTFQS EQNLIFRLGN

151 QKHRRNLMTQ GFYGVCIQIA VKIQHKKAGF LRFGRFLPAL LQTLFLCFGF

201 RLFLFLFFFF LMFCLFLA*
```

The following partial DNA sequence was identified in *N. meningitidis* <SEQ ID 79>:

```
m012.seq
  1 ATGCTCGCCC GTTGCCACTT CCTCAATATC CAATTGAGGG CGGTTCTCGC

51 TGACAAACTG CTTGAACAAC TGATGCGTTT CCTCCAGTTC CTGTCGGAAT

101 TTCTGTTTGC CCTTTTCCGT ATTTTCACCC ATAAAAGTAA CCGTGCGCTT

151 AAATTCGCCC GCCGTCATCA CATCCACATC AATATCATGT TTTTTCAACA

201 GGCGGTGGAT ATTCGGTACT TCCGCCACCA CACCCACCGA ACCGACAATC

251 GCAAACGGAG CGGAAGCAAT TTTATCCGCC ACACACGCCA TCATATAACC

301 GCCGCTCGCn nnnnnnnnnn nnnnnnnnnn nnnnnnnnnn nnnnnnnnnn 351 nnnnnnnnnn nnnnnnnnnn nnnnnnnnnn nnnnnnnnnn nnnnnnnnnn 401 nnnnnnnnnn nnnnnnnnnn nnnnnnnnnn nnnnnnnnnn nnnnnnnnnn 451 nnnnnnnnnn nnnnnnnnnn nnnnnnnnnn nnnnnnnnnn nnnnnnnnnn 501 nnnnnnnnnn nnnnnnnnnC AACACAAAAA GGCGTGATTT nTGCGTTTCG 551 GCAGATTTCT CCCCACCCTC CTTCAAACGT TTTTCcTCTG CTTTGGCTTC

601 CGCCTTTTCC TTTTTCTTTT CCTCTTTTTC CTGATGTTGT GCCTCTTCCC

651 CGCTTAA
```

This corresponds to the amino acid sequence <SEQ ID 80; ORF 012>:

```
m012.pep
  1 MLARCHFLNI QLRAVLADKL LEQLMRFLQF LSEFLFALFR IFTHKSNRAL

51 KFARRHHIHI NIMFFQQAVD IRYFRHHTHR TDNRKRSGSN FIRHTRHHIT

101 AARXXXXXXX XXXXXXXXXX XXXXXXXXXX XXXXXXXXXX XXXXXXXXXX

151 XXXXXXXXXX XXXXXXXXXX XXXQHKKA*F XRFGRFLPTL LQTFFLCFGF

201 RLFLFLFLFF LMLCLFPA*
```

The following partial DNA sequence was identified in *N. meningitidis* <SEQ ID 81>:

```
a012.seq
  1 ATGCTCGCCC GTTGCCACTT CCTCAATATC CAATTGAGGG CGGTTCTCGC

51 TGACAAACTG CTTGAACAAC TGATGCGTTT CCTCCAGTTC CTGTCGGAAT
```

```
101  TTCTGTTTGC CCTTTTCCGT ATTTTCACCC ATAAAAGTAA CCGTGCGCTT

151  AAATTCGCCC GCCGTCATCA CATCCACATC AATATCATGT TTTTTCAACA

201  GGCGGTGGAT ATTCGGTACT TCCGCTACAA CACCCACCGA ACCGACAATC

251  GCAAACGGAG CGGAAACAAT TTTATCCGCC ACACACGCCA TCATATAACC

301  ACCGCTCGCC GCCACCTTAT CGACGGCGAC GGTCAGCGGA ATATTGCGTT

351  CGCGCAAACG CCTAAGCTGC GAAGCCGCCA AACCGTAACC GTGAACCACG

401  CCGCCCGGAC TTTCCAATCT AAGCAGAACC TCATCTTCAG GCTTGGCAAT

451  CAAAAGCACC GCCGTAATCT CATGACGCAA GGATTCTACG GCGTGTGCAT

501  ACAAATCGCC GTCAAAATCC AACACAAAAA GGCGGGATTT TTGCGTTTCG

551  GAAGATTTCT CCCCACCCTC CTTCAAACGC TTTTTCTCTG CTTTGGCTTC

601  CGCCTTTTCC TTTTTCTTTT CCTCTTTTTC CTGATGTTTT GCCTCTTCCC

651  CGCTTAA
```

This corresponds to the amino acid sequence <SEQ ID 82; ORF 012.a>:

```
a012.pep.
  1  MLARCHFLNI QLRAVLADKL LEQLMRFLQF LSEFLFALFR IFTHKSNRAL

51  KFARRHHIHI NIMFFQQAVD IRYFRYNTHR TDNRKRSGNN FIRHTRHHIT

101  TARRHLIDGD GQRNIAFAQT PKLRSRQTVT VNHAARTFQS KQNLIFRLGN

151  QKHRRNLMTQ GFYGVCIQIA VKIQHKKAGF LRFGRFLPTL LQTLFLCFGF

201  RLFLFLFLFF LMFCLFPA*
``` m012/a012 64.2% identity over a 218 aa overlap

```
                  10         20         30         40         50         60
     m012.pep   MLARCHFLNIQLRAVLADKLLEQLMRFLQFLSEFLFALFRIFTHKSNRALKFARRHHIHI
                ||||||||||||||||||||||||||||||||||||||||||||||||||||||||||||
         a012   MLARCHFLNIQLRAVLADKLLEQLMRFLQFLSEFLFALFRIFTHKSNRALKFARRHHIHI
                  10         20         30         40         50         60

70         80         90        100        110        120
     m012.pep   NIMFFQQAVDIRYFRHHTHRTDNRKRSGSNFIRHTRHHITAARXXXXXXXXXXXXXXXXX
                |||||||||||||||::||||||||||||:||||||||||:||                :
         a012   NIMFFQQAVDIRYFRYNTHRTDNRKRSGNNFIRHTRHHITTARRHLIDGDGQRNIAFAQT
                  70         80         90        100        110        120

130        140        150        160        170        180
     m012.pep   XXXXXXXXXXXXXXXXXXXXXXXXXXXXXXXXXXXXXXXXXXXXXXXXXXXQHKKAXF
                 : :         :                               :        ||||  |
         a012   PKLRSRQTVTVNHAARTFQSKQNLIFRLGNQKHRRNLMTQGFYGVCIQIAVKIQHKKAGF
                 130        140        150        160        170        180

190        200        210        200
     m012.pep   XRFGRFLPTLLQTFFLCFGFRLFLFLFLFFLMLCLFPAX
                ||||||||||||:|||||||||||||||||||:||||||
         a012   LRFGRFLPTLLQTLFLCFGFRLFLFLFLFFLMFCLFPAX
                 190        200        210
```

Computer analysis of this amino acid sequence gave the following results:
Homology with a Predicted ORF from *N. gonorrhoeae*
ORF 012 shows 58.7% identity over a 218 aa overlap with a predicted ORF (ORF 012.ng) from *N. gonorrhoeae*:

```
m012/g012

10        20        30        40        50        60
    m012.pep  MLARCHFLNIQLRAVLADKLLEQLMRFLQFLSEFLFALFRIFTHKSNRALKFARRHHIHI
              ||||  : | : |||   || : : ||||||||||||  ||||||||||||||||||||||||
    g012      MLARRYFFNIQPGAVFTDKLLEQLMRFLQFLPEFLFALFRIFTHKSNRALKFARRHHIHI
                  10        20        30        40        50        60

70        80        90       100       110       120
    m012.pep  NIMFFQQAVDIRYFRHHTHRTDNRKRSGSNFIRHTRHHITAARXXXXXXXXXXXXXXXXX
              |||||||||||| : ||||||||| : ||||| : ||||||||| : ||                  :
    g012      NIMFFQQAVDIRHFRHHTHRTDDRKRSGNNFIRHTRHHIAAACRDLIDGDGQRNIAFAQT
                  70        80        90       100       110       120

130       140       150       160       170       180
    m012.pep  XXXXXXXXXXXXXXXXXXXXXXXXXXXXXXXXXXXXXXXXXXXXXXXXXQHKKAXF
               :   :                    :             :                      |||||  |
    g012      PKLRSRQTVTVNHAARTFQSEQNLIFRLGNQKHRRNLMTQGFYGVCIQIAVKIQHKKAGF
                 130       140       150       160       170       180

190       200       210      219
    m012.pep  XRFGRFLPTLLQTFFLCFGFRLFLFLFLFFLMLCLFPAX
              |||||||| : ||||  : |||||||||||||| : |||| ||| ||
    g012      LRFGRFLPALLQTLFLCFGFRLFLFLFFFLMFCLFLAX
                 190       200       210
```

The following partial DNA sequence was identified in *N. meningitidis* <SEQ ID 83>:

```
m012-1.seq
  1 ATGCTCGCCC GTTGCCACTT CCTCAATATC CAATTGAGGG CGGTTCTCGC

51 TGACAAACTG CTTGAACAAC TGATGCGTTT CCTCCAGTTC CTGTCGGAAT

101 TTCTGTTTGC CCTTTTCCGT ATTTTCACCC ATAAAAGTAA CCGTGCGCTT

151 AAATTCGCCC GCCGTCATCA CATCCACATC AATATCATGT TTTTTCAACA

201 GGCGGTGGAT ATTCGGTACT TCCGCCACCA CACCCACCGA ACCGACAATC

251 GCAAACGGAG CGGAAGCAAT TTTATCCGCC ACACACGCCA TCATATAACC

301 GCCGCTCGCC GCCACCTTAT CGACGGCGAC GGTCAGCGGA ATATTGCGTT

351 CGCGCAAACG CyTAAGCTGC GAAGCCGCCA AACCGTAACC GTGAACCACG

401 CCGCCCGGAC TTTCCAATCT GAGCAGAACC TCATCTTCAG GCTTGGCAAT

451 CAAAAGCACC GCCGTAATCT CATGACGCAA GGATTCTACG GCGTGTGCAT

501 ACAAATCGCC GTCAAAATCC AACACAAAAA GGCGGGATTT TTGCGTTTCG

551 GCAGATTTCT CCCCACCCTC CTTCAAACGC TTTTTCTCTG CTTTGGCTTC

601 CGCCTTTTCC TTTTTCTTTT CCTCTTTTTC CTGATGTTTT GCCTCTTCCC

651 CGCTTAA
```

This corresponds to the amino acid sequence <SEQ ID 84; ORF 012-1>:

```
m012-1.pep

1 MLARCHFLNI QLRAVLADKL LEQLMRFLQF LSEFLFALFR IFTHKSNRAL

51 KFARRHHIHI NIMFFQQAVD IRYFRHHTHR TDNRKRSGSN FIRHTRHHIT

101 AARRHLIDGD GQRNIAFAQT XKLRSRQTVT VNHAARTFQS EQNLIFRLGN
```

-continued
```
    151 QKHRRNLMTQ GFYGVCIQIA VKIQHKKAGF LRFGRFLPTL LQTLFLCFGF

201 RLFLFLFLFF LMFCLFPA*
``` m012-1/g012 91.7% identity in 218 aa overlap

```
                     10         20         30         40         50         60
m012-1.pep   MLARCHFLNIQLRAVLADKLLEQLMRFLQFLSEFLFALFRIFTHKSNRALKFARRHHIHI
             ||||  :|:|||   ||::|||||||||||||| ||||||||||||||||||||||||||
g012         MLARRYFFNIQPGAVFTDKLLEQLMRFLQFLPEFLFALFRIFTHKSNRALKFARRHHIHI
                     10         20         30         40         50         60

70         80         90        100        110        120
m012-1.pep   NIMFFQQAVDIRYFRHHTHRTDNRKRSGSNFIRHTRHHITAARRHLIDGDGQRNIAFAQT
             |||||||||||:|||||||||||:|||||:||||||||||    |:|| ||||||||||
g012         NIMFFQQAVDIRHFRHHTHRTDDRKRSGNNFIRHTRHHIAAACRDLIDGDGQRNIAFAQT
                     70         80         90        100        110        120

130        140        150        160        170        180
m012-1.pep   XKLRSRQTVTVNHAARTFQSEQNLIFRLGNQKHRRNLMTQGFYGVCIQIAVKIQHKKAGF
              ||||||||||||||||||||||||||||||||||||||||||||||||||||||||||
g012         PKLRSRQTVTVNHAARTFQSEQNLIFRLGNQKHRRNLMTQGFYGVCIQIAVKIQHKKAGF
                    130        140        150        160        170        180

190        200        210   219
m012-1.pep   LRFGRFLPTLLQTLFLCFGFRLFLFLFLFFLMFCLPAX
             ||||||||:||||||||||||||||||:|||||||| ||
g012         LRFGRFLPALLQTLFLCFGFRLFLFLFFFFLMFCLFLAX
                    190        200        210
```

The following partial DNA sequence was identified in *N. meningitidis* <SEQ ID 85>:

```
a012-1.seq
   1 ATGCTCGCCC GTTGCCACTT CCTCAATATC CAATTGAGGG CGGTTCTCGC

51 TGACAAACTG CTTGAACAAC TGATGCGTTT CCTCCAGTTC CTGTCGGAAT

101 TTCTGTTTGC CCTTTTCCGT ATTTTCACCC ATAAAAGTAA CCGTGCGCTT

151 AAATTCGCCC GCCGTCATCA CATCCACATC AATATCATGT TTTTTCAACA

201 GGCGGTGGAT ATTCGGTACT TCCGCTACAA CACCCACCGA ACCGACAATC

251 GCAAACGGAG CGGAAACAAT TTTATCCGCC ACACACGCCA TCATATAACC

301 ACCGCTCGCC GCCACCTTAT CGACGGCGAC GGTCAGCGGA ATATTGCGTT

351 CGCGCAAACG CCTAAGCTGC GAAGCCGCCA AACCGTAACC GTGAACCACG

401 CCGCCCGGAC TTTCCAATCT AAGCAGAACC TCATCTTCAG GCTTGGCAAT

451 CAAAAGCACC GCCGTAATCT CATGACGCAA GGATTCTACG GCGTGTGCAT

501 ACAAATCGCC GTCAAAATCC AACACAAAAA GGCGGGATTT TTGCGTTTCG

551 GAAGATTTCT CCCCACCCTC CTTCAAACGC TTTTTCTCTG CTTTGGCTTC

601 CGCCTTTTCC TTTTTCTTTT CCTCTTTTTC CTGATGTTTT GCCTCTTCCC

651 CGCTTAA
```

This corresponds to the amino acid sequence <SEQ ID 86; ORF 012-1.a>:

```
a012-1.pep

1 MLARCHFLNI QLRAVLADKL LEQLMRFLQF LSEFLFALFR IFTHKSNRAL

51 KFARRHHIHI NIMFFQQAVD IRYFRYNTHR TDNRKRSGNN FIRHTRHHIT

101 TARRHLIDGD GQRNIAFAQT PKLRSRQTVT VNHAARTFQS KQNLIFRLGN

151 QKHRRNLMTQ GFYGVCIQIA VKIQHKKAGF LRFGRFLPTL LQTLFLCFGF
```

-continued

```
    201 RLFLFLFLFF LMFCLFPA* a012-1/m012-1 97.2% identity in 218 aa overlap 10         20         30         40         50         60
   a012-1.pep MLARCHFLNIQLRAVLADKLLEQLMRFLQFLSEFLFALFRIFTHKSNRALKFARRHHIHI
              ||||||||||||||||||||||||||||||||||||||||||||||||||||||||||||
   m012-1     MLARCHFLNIQLRAVLADKLLEQLMRFLQFLSEFLFALFRIFTHKSNRALKFARRHHIHI
                      10         20         30         40         50         60

70         80         90        100        110        120
   a012-1.pep NIMFFQQAVDIRYFRYNTHRTDNRKRSGNNFIRHTRHHITTARRHLIDGDGQRNIAFAQT
              ||||||||||||||||::||||||||||||||:|||||||||||:|||||||||||||||
   m012-1     NIMFFQQAVDIRYFRHHTHRTDNRKRSGSNFIRHTRHHITAARRHLIDGDGQRNIAFAQT
                      70         80         90        100        110        120

130        140        150        160        170        180
   a012-1.pep PKLRSRQTVTVNHAARTFQSKQNLIFRLGNQKHRRNLMTQGFYGVCIQIAVKIQHKKAGF
              ||||||||||||||||||||:|||||||||||||||||||||||||||||||||||||||
   m012-1     XKLRSRQTVTVNHAARTFQSEQNLIFRLGNQKHRRNLMTQGFYGVCIQIAVKIQHKKAGF
                     130        140        150        160        170        180

190        200        210    219
   a012-1.pep LRFGRFLPTLLQTLFLCFGFRLFLFLFLFFLMFCLFPAX
              |||||||||||||||||||||||||||||||||||||||
   m012-1     LRFGRFLPTLLQTLFLCFGFRLFLFLFLFFLMFCLFPAX
                     190        200        210
```

The following partial DNA sequence was identified in *N. gonorrhoeae* <SEQ ID 87>:

```
g013.seq
   1 aTgcctttga ccatgctgtg cagcaGGAcg tGCGGTTtgt tcataataca 51 gtCcgaccGG AAAagcggAG GAAaCGCAGT GCCGCGCCCT TCCCCTTTCT 101 TGCCGTGGCA GGCGATGCag tTgGATTCGT ACACTTTTTG CCCTTTtGtc 151 atgatGCTgt tgtcggCGGC AGAAGCgGCG GcgCAGAGGC AGCACAAGAT 201 GAAGGCGGTC GGCAGTCGGG TTGTGTtcat tGgcgTTTCC cctaatgttt 251 tgaaaccttg ttttttgatt Ttgcctttac ggggtgaaaa gttttttTtgg 301 cccaaatccg gaatttag
```

This corresponds to the amino acid sequence <SEQ ID 88; ORF 013.ng:

```
g013.pep
   1 MPLTMLCSRT CGLFIIQSDR KSGGNAVPRP SPFLPWQAMQ LDSYTFCPFV

51 MMLLSAAEAA AQRQHKMKAV GSRVVFIGVS PNVLKPCFLI LPLRGEKFFW

101 PKSGI*
```

The following partial DNA sequence was identified in *N. meningitidis* <SEQ ID 89>:

```
m013.seq
   1 ATGCCTTTGA CCATGCTGTG CAGCAGCACC TGCGGTTTTT TCATGATGAA

51 GTCGGAGCGG TAGAGCGGCG GAAACATGGT TCCGCGGCCT TCGCCCTTTT

101 TGCCGTGGCA GGCGACGCAG TTGGATTCGT ACACTTTTTG CCCTTTTGTC

151 ATGATGCTGT TGTCGGCGGC AGAAGCGGCG GCGCAGAAGC AGCCCAAGAC

201 GAGGGCGGTC GGCAGTCGGG TTGTGTTCAT TGGTGTTTCC TTCATGTTTG

251 AAACCTTGTT GTTGATTTTG CGTAGCGGGT GAAAGATTTT TTTGCCGAAT

301 CAGTAG
```

This corresponds to the amino acid sequence <SEQ ID 90; ORF 013>:

```
m013.pep
  1 MPLTMLCSST CGFFMMKSER XSGGNMVPRP SPFLPWQATQ LDSYTFCPFV

51 MMLLSAAEAA AQKQPKTRAV GSRVVFIGVS FMFETLLLIL RSGXKIFLPN

101 Q*
```

The following partial DNA sequence was identified in *N. meningitidis* <SEQ ID 91>:

```
a013.seq
  1 ATGCCTTTGA CCATGCTGTG CAGCAGCACC TGCGGTTTTT TCATGATGAA

51 GTCGGAGCGG TAGAGCGGCG GAAACATGGT TCCGCGGCCT TCGCCCTTTT

101 TGCCGTGGCA GGCGACGCAG TTGGATTCGT ACACTTTTTG CCCTTTTGTC

151 ATGATGCTGT TGTCGGCGGC AGAAGCGGCG GCGCAGAGGC AGCCCAAGAC

201 GAGGGCGGTC GGCAGTCGGG TTGTGTTCAT GGTGTTTCC TTAATGTTTG

251 AAACCTTGTT GTTGATTTTG CGTAGCGGGT GAAAGATTTT CTTGCCGAAT

301 CGGTAG
```

This corresponds to the amino acid sequence <SEQ ID 92; ORF 013.a>:

```
a013.pep
  1 MPLTMLCSST CGFFMMKSER *SGGNMVPRP SPFLPWQATQ LDSYTFCPFV

51 MMLLSAAEAA AQRQPKTRAV GSRVVFIGVS LMFETLLLIL RSG*KIFLPN

101 R*
``` m013/a013 97.0% identity over a 101 aa overlap

```
                    10         20         30         40         50         60
    m013.pep MPLTMLCSSTCGFFMMKSERXSGGNMVPRPSPFLPWQATQLDSYTFCPFVMMLLSAAEAA
             ||||||||||||||||||||||||||||||||||||||||||||||||||||||||||||
    a013     MPLTMLCSSTCGFFMMKSERXSGGNMVPRPSPFLPWQATQLDSYTFCPFVMMLLSAAEAA
                    10         20         30         40         50         60
                    70         80         90        100
    m013.pep AQKQPKTRAVGSRVVFIGVSFMFETLLLILRSGXKIFLPNQX
             ||:|||||||||||||||||:|||||||||||||||||||:|
    a013     AQRQPKTRAVGSRVVFIGVSLMFETLLLILRSGXKIFLPNRX
                    70         80         90        100
```

Computer analysis of this amino acid sequence gave the following results:
Homology with a Predicted ORF from *N. gonorrhoeae*
ORF 013 shows 73.3% identity over a 101 aa overlap with a predicted ORF (ORF 013.ng) from *N. gonorrhoeae*:

```
    m013/g013

10         20         30         40         50         60
    m013.pep MPLTMLCSSTCGFFMMKSERXSGGNMVPRPSPFLPWQATQLDSYTFCPFVMMLLSAAEAA
             ||||||||| |||:|:::|:| |||| |||||||||||||| ||||||||||||||||||
    g013     MPLTMLCSRTCGLFIIQSDRKSGGNAVPRPSPFLPWQAMQLDSYTFCPFVMMLLSAAEAA
                    10         20         30         40         50         60
                    70         80         90        100
    m013.pep AQKQPKTRAVGSRVVFIGVSF-MFETLLLILR-SGXKIFLPNQX
             ||:| |:||||||||||||| ::: :|||   | |:| |:
    g013     AQRQHKMKAVGSRVVFIGVSPNVLKPCFLILPLRGEKFFWPKSGIX
                    70         80         90        100
```

The following partial DNA sequence was identified in *N. gonorrhoeae* <SEQ ID 93>:

```
g015.seq
    1 ATGCAGTATC TGATTGTCAA ATACAGCCAT CAAATCTTCG TTACCATCAC

51 CATTTTGGTA TTCAACATCC GTTTTTTCCT ACTTTGGAAA AATCCAGAAA

101 AGCCCTTGGT CGGCTTTTGG AAAGCACTGC CCCACCTCAA CGACACGATG

151 CTGCTGTTTA CGGGATTGTG GCTGATGAAG ATTACCCATT TCTCCCCGTT

201 CAACGCGCCT TGGCTCGGCA CAAAAATCCT GCTCCTGTTC GCCTACATCG

251 CACTGGGCAT GGTAATGATG CGCGCCCGTC CGCGTTCGAC CAAGTTCTAC

301 ACCGTTTACC TGCTCGCTAT GTGTTGCATC GCCTGCATCG TTTACCTTGC

351 CAAAACCAAA GTCCTGCCAT TCTGA
```

This corresponds to the amino acid sequence <SEQ ID 94; ORF 015.ng>:

```
g015.pep
    1 MQYLIVKYSH QIFVTITILV FNIRFFLLWK NPEKPLVGFW KALPHLNDTM

51 LLFTGLWLMK ITHFSPFNAP WLGTKILLLF AYIALGMVMM RARPRSTKFY

101 TVYLLAMCCI ACIVYLAKTK VLPF*
```

The following partial DNA sequence was identified in *N. meningitidis* <SEQ ID 95>:

```
m015.seq (partial)
    1 . . . AAAATCAGAA AAGCCTTGGC GGGCTTTTGG AAGGCACTGC CCCACCTTAA

51         CGACACCAT GCTGCTGTTTA CGGGATTGTG GCTGATGAAA ATTACCCATT

101         TCTCCCCGT TCAACGCGCCT TGGCTCGGTA CAAAAATCCT GCTTCTGCTC

151         GCCTATATC GCATTGGGTAT GATGATGATG CGCGCCCGTC CGCGTTCGAC

201         CAAGTTCTA CACCGTTTACC TGCTCGCCAT GTGTTGCGTC GCCTGCATCG

251         TTTACCTTG CCAAAACCAAA GTCCTGCCTT TCTGA
```

This corresponds to the amino acid sequence <SEQ ID 96; ORF 015:

```
m015.pep (partial)
    1 . . . KIRKALAGFW KALPHLNDTM LLFTGLWLMK ITHFSPFNAP WLGTKILLLL

51         AYIALGMMMM RARPRSTKFY TVYLLAMCCV ACIVYLAKTK VLPF*
```

The following partial DNA sequence was identified in *N. meningitidis* <SEQ ID 97>:

```
a015.seq
    1 ATGCAGTATC TGATTGTCAA ATACAGCCAT CAAATCTTCG TTACCATCAC

51 CATTTTGGTA TTCAACATCC GTGTTTTCNT ACTTTGGAAA AATCCAGAAA

101 AGCCCTTGGC GGGCTTTTGG AAGGCACTGC CCCACCTTAA CGACACCATG

151 CTGCTGTTTA CGGGATTGTG GCTGATGAAA ATTACCCATT TCTCCCCGTT

201 CAACGCGCCT TGGCTCGGTA CAAAAATCCT GCTTCTGCTC GCCTATATCG

251 CATTGGGTAT GATGATGATG CGCGCCCGTC CGCGTTCGAC CAAGTTCTAC
```

```
-continued
301 ACCGTTTACC TGCTCGCCAT GTGTTGCCTC ACCTGCATCG TTTACCTTGC

351 CAAAACCAAA GTCCTGCCTT TCTGA
```

This corresponds to the amino acid sequence <SEQ ID 98; ORF 015.a>:

```
a015.pep
  1 MQYLIVKYSH QIFVTITILV FNIRVFXLWK NPEKPLAGFW KALPHLNDTM

51 LLFTGLWLMK ITHFSPFNAP WLGTKILLLL AYIALGMMMM RARPRSTKFY

101 TVYLLAMCCL TCIVYLAKTK VLPF*
``` m015/a015 96.7% identity over a 91 aa overlap

```
                                       10         20         30
       m015.pep                        KIRKALAGFWKALPHLNDTMLLFTGLWLMKITH
                                       ||||||||||||||||||||||||||||||||
       a015     LIVKYSHQIFVTITILVFNIRVFXLWKNPEKPLAGFWKALPHLNDTMLLFTGLWLMKITH
                         10        20        30        40        50        60
                40        50        60        70        80        90
       m015.pep FSPFNAPWLGTKILLLLAYIALGMMMMRARPRSTKFYTVYLLAMCCVACIVYLAKTKVLP
               |||||||||||||||||||||||||||||||||||||||||||||::|||||||||||||
       a015    FSPFNAPWLGTKILLLLAYIALGMMMMRARPRSTKFYTVYLLAMCCLTCIVYLAKTKVLP
                        70        80        90       100       110       120
       m015.pep FX
                ||
       a015     FX
```

Computer analysis of this amino acid sequence gave the following results:

Homology with a Predicted ORF from *N. gonorrhoeae*

ORF 015 shows 94.5% identity over a 91 aa overlap with a predicted ORF (ORF 015.ng) from *N. gonorrhoeae*:

```
       m015/g015
                                       10         20         30
       m015.pep                        KIRKALAGFWKALPHLNDTMLLFTGLWLMKITH
                                       ||:|||||||||||||||||||||||||||||
       g015     LIVKYSHQIFVTITILVFNIRFFLLWKNPEKPLVGFWKALPHLNDTMLLFTGLWLMKITH
                         10        20        30        40        50        60
                40        50        60        70        80        90
       m015.pep FSPFNAPWLGTKILLLLAYIALGMMMMRARPRSTKFYTVYLLAMCCVACIVYLAKTKVLP
               ||||||||||||||:|||||||:|||||||||||||||||||||||:|||||||||||||
       g015    FSPFNAPWLGTKILLLFAYIALGMVMMRARPRSTKFYTVYLLAMCCIACIVYLAKTKVLP
                        70        80        90       100       110       120
       m015.pep FX
                ||
       g015     FX
```

The following partial DNA sequence was identified in *N. gonorrhoeae* <SEQ ID 99>:

```
g018.seq
  1 atGCAGCAGG GGCagttggt tggacgcgtc gcccgcaata AAGATATGCG

51 GAATgctggt CTGCATggtC AGCGGATCGG CAACGGGtac gccgcgcgcg 101 tctttgTCGA TATTGATGTT TTCCAAACCG ATATtgTCAA CGTTCGGACG 151 GCgACCTACG GCTGCCAACA TATATTCGGC AACAAATACG CCTTTTTCGC 201 CATCCTGCTC CCAATGGACT tctACATTGC CGTCTGCGTC GAGTTTGACC 251 TCGGTTTTAG CATCCAGATG CAGTTTCAAT tctTCTCCGA ACACGGCTTT

301 CGCCTCGTCT GA
```

This corresponds to the amino acid sequence <SEQ ID 100; ORF 018.ng>:

```
g018.pep
  1 MQQGQLVGRV ARNKDMRNAG LHGQRIGNGY AARVFVDIDV FQTDIVNVRT

51 ATYGCQHIFG NKYAFFAILL PMDFYIAVCV EFDLGFSIQM QFQFFSEHGF

101 RLV*
```

The following partial DNA sequence was identified in *N. meningitidis* <SEQ ID 101>:

```
m018.seq
  1 ATGCAGCAGA GGCAGTTGGT TGGACGCATC GCCTGCGATG AAGATATGCG

51 GAATACTGGT CTGCATGGTC AGCGGGTCGG CAACAGGTAC GCCGCGCGCA

101 TCTTTTTCGA TATTGATATT TTCCAAACCG ATATTGTCAA CGTTCGGACG

151 GCGGCCCACG GCTGCCAGCA TATATTCGGC AACAAATACG CCTTTTTCGC

201 CATCCTGCTC CCAATGGACT TCTACATTGC CGTCTGCATC GAGTTTGACC

251 TCGGTTTTAG CATCCAGATG CAGTTTCAAT TCTTCGCCGA ACACGGCGTT

301 CGCCTCGTCT GA
```

This corresponds to the amino acid sequence <SEQ ID 102; ORF 018>:

```
m018.pepr
  1 MQQRQLVGRI ACDEDMRNTG LHGQRVGNRY AARIFFDIDI FQTDIVNVRT

51 AAHGCQHIFG NKYAFFAILL PMDFYIAVCI EDLGFSIQM QFQFFAEHGV

101 RLV*
```

The following partial DNA sequence was identified in *N. meningitidis* <SEQ ID 103>:

```
a018.seq
  1 ATGCAGCAGG GGCAGTTGGT TGGACGCGTC GCCCGCAATA AAGATATGCG

51 GAATACTGGT CTGCATAGTC AGCGGATCGG CAACGGGTAC GCCGCGCGCA

101 TCTTTTTCGA TATTGATGTT TTCCAAACCG ATATTGTCAA CGTTCGGACG

151 GCGGCCTACG GCTGCCAGCA TATATTCGGC AACAAATACG CCTTTTTCGC

201 CATCCTGCTC CCAATGGACT TCTACATTGC CGTCTGCGTC GAGTTTGGCC

251 TCGGTTTTAG CATCCAAATG CAGTTTCAAT TCTTCACCGA ACACGGCTTT

301 CGCCTCGTCT GA
```

This corresponds to the amino acid sequence <SEQ ID 104; ORF 018.a>.

```
a018.pep
  1 MQQGQLVGRV ARNKDMRNTG LHSQRIGNGY AARIFFDIDV FQTDIVNVRT

51 AAYGCQHIFG NKYAFFAILL PMDFYIAVCV EFGLGFSIQM QFQFFTEHGF

101 RLV*
``` m018/a018 86.4% identity over a 103 aa overlap

```
                    10        20        30        40        50        60
    m018.pep  MQQRQLVGRIACDEDMRNTGLHGQRVGNRYAARIFFDIDIFQTDIVNVRTAAHGCQHIFG
              ||| ||||||: ::||||||:|||:|| ||||||:| |||:|||||||||||::|||||||
    a018      MQQGQLVGRVARNKDMRNTGLHSQRIGNGYAARIFFDIDVFQTDIVNVRTAAYGCQHIFG
                    10        20        30        40        50        60

70        80        90       100
    m018.pep  NKYAFFAILLPMDFYIAVCIEFDLGFSIQMQFQFFAEHGVRLVX
              |||||||||||||||||||:|| ||||||||||||:||| ||||
    a018      NKYAFFAILLPMDFYIAVCVEFGLGFSIQMQFQFFTEHGFRLVX
                    70        80        90       100
```

Computer analysis of this amino acid sequence gave the following results:

Homology with a Predicted ORF from *N. gonorrhoeae*
ORF 018 shows 84.5% identity over a 103 aa overlap with a predicted ORF (ORF 018.ng) from *N. gonorrhoeae*:

```
    m018/g018

10        20        30        40        50        60
    m018.pep  MQQRQLVGRIACDEDMRNTGLHGQRVGNRYAARIFFDIDIFQTDIVNVRTAAHGCQHIFG
              ||| ||||||: ::||||:||||||:|| ||||:| |||:|||||||||||::|||||||
    g018      MQQGQLVGRVARNKDMRNAGLHGQRIGNGYAARVFVDIDVFQTDIVNVRTATYGCQHIFG
                    10        20        30        40        50        60

70        80        90       100
    m018.pep  NKYAFFAILLPMDFYIAVCIEFDLGFSIQMQFQFFAEHGVRLVX
              |||||||||||||||||||:|||||||||||||||||:||| ||||
    g018      NKYAFFAILLPMDFYIAVCVEFDLGFSIQMQFQFFSEHGFRLVX
                    70        80        90       100
```

The following partial DNA sequence was identified in *N. gonorrhoeae* <SEQ ID 105>:

```
g019.seq (partial)
  1 . . . ctgctggcgg ccctggtgct tgccgcgtgt tcttcgACAA ACAcacTGCC 51       AGCCGGCAAG ACCCCGGCAG ACAATATAGA AActgcCgAC CTTTCGGCAA 101       GCGTTCCCAC ccgcCCTGCC GAACCGGAAG GAAAAACGCT GGCAGATTAC

151       GGCGGCTACC CGTCCGCACT GGATGCAGTG AAACAGAACA ACGATGCGGC

201       AGCCGCCGCC TATTTGGAAA AcgcaggagA cagCGcgatg gcGGAAAatg 251       tccgcaagga gtgGCTGa
```

This corresponds to the amino acid sequence <SEQ ID 106; ORF 019.ng>:

```
g019.pep (partial)
 1 . . . LLAALVLAAC SSTNTLPAGK TPADNIETAD LSASVPTRPA EPEGKTLADY

51       GGYPSALDAV KQNNDAAAAA YLENAGDSAM AENVRKEWL*
```

The following partial DNA sequence was identified in *N. meningitidis* <SEQ ID 107>:

```
m019.seq.(partial)
  1 ATGTACCTAC CCTCTATGAA GCATTCCCTG CCGCTGCTGG CGGCCCTGGT

51 GCTTGCCGCG TGTTCTTCGA CAAACACACT GCCAGCCGGC AAGACCCCGG

101 CAGACAATAT AGAAACTGCC GACCTTTCGG CAAGCGTTCC CACCCGCCCT
```

```
-continued
 151 GCCGAACCCG AAAGAAAAAC GCTGGCAGAT TACGGCGGCT ACCCGTCCGC

201 ACTGGATGCA GTGAAACAGA AAAACGATGC CGCCGTCGCC GCCTATTTGG

251 AAAACGCCGG CGACAGCGCG ATGGCGGAAA ATGTCCGCAA CGAGTGGCTG

301 AAGTCTTTGG GCGCACGCAG ACAGTGGACG CTGTTTGCAC AGGAATACGC

351 CAAACTCGAA CCGGCAGGGC GCGCCCAAGA AGTCGAATGC TACGCCGATT

401 CGAGCCGCAA CGACTATACG CGTGCCGCTG AACTGGTCAA AAATACGGGC

451 AAACTGCCTT CGGGCTGCAC CAAACTGTTG GAACAGGCAG CCGCATCCGG

501 CTTGTTGGAC GGCAACGACG CCTGGAGGCG CGTGCGCGGA CTGCTGGCCG

551 GCCGCCAAAC CACAGACGCA CGCAACCTTG CCGCCGCATT GGGCAGCCCG

601 TTTGACGGCG GTACACAAGG TTCGCGCGAA TATGCCCTGT TGAACGTCAT

651 CGGCAAAGAA GCACGCAAAT CGCCGAATGC CGCCGCCCTG CTGTCCGAAA

701 TGGAAAGCGG TTTAAGCCTC GAACAACGCA GTTTCGCGTG GGGCGTATTG

751 GGGCATTATC AGTCGCAAAA CCTCAATGTG CCTGCCGCCT TGGACTATTA

801 CGGCAAGGTT GCCGACCGCC GCCAACTGAC CGACGACCAA ATCGAGTGGT

851 ACGCCCGCGC CGCCTTGCGC GCCCGACGTT GGGACGAGCT GGCCTCCGTT

901 ATCTCGCATA TGCCCGAAAA ACTGCAAAAA AGCCCGACCT GGCTCTACTG

951 GCTGGCACGC AGCCGCGCCG CAACGGGCAA CACGCAAGAG GCGGAAAAAC

1001 TTTACAAACA GGCGGCAGCG ACGGGCAGGA ATTTTTATGC GGTGCTGGCA

1051 GGGGAAGAAT TGGGTCGGAA AATCGATACG CGCAACAATG TGCCCGATGC

1101 CGGCAAAAAC AGCGTCCGCC GCATGGCGGA AGACGGTGCA GTCAAACGCG

1151 CACTGGTACT GTTCCAAAAC AGCCAATCTG CCGGTGATGC AAAAATGCGC

1201 CGTCAGGCTC AGGCGGAATG GCGTTTTGCC ACACGCGGCT TTGACGAAGA

1251 CAAGCTGCTG ACCGCCGCGC AAACCGCGTT CGACCACGGT TTTTACGATA

1301 TGGCGGTCAA CAGCGCGGAA CGCACCGACC GCAAACTCAA CTACACCTTG

1351 CGCTATATTT CGCCGTTTAA AGACACGGTA ATCCGCCACG CGCAAAATGT

1401 TAATGTCGAT CCGGCTTGGG TTTATGGGCT GATTCGTCAG GAAAGCCGCT

1451 TCGTTATAGG CGCGCAATCC CGCGTAGGCG CGCAGGGGCT GATGCAGGTT

1501 ATGCCTGCCA CCGCGCGCGA AATCGCCGGC AAAATCGGTA TGGATGCCGC

1551 ACAACTTTAC ACCGCCGACG GG . . .
```

This corresponds to the amino acid sequence <SEQ ID 108; ORF 019>:

```
m019.pep (partial)
  1 MYLPSMKHSL PLLAALVLAA CSSTNTLPAG KTPADNIETA DLSASVPTRP

51 AEPERKTLAD YGGYPSALDA VKQKNDAAVA AYLENAGDSA MAENVRNEWL

101 KSLGARRQWT LFAQEYAKLE PAGRAQEVEC YADSSRNDYT RAAELVKNTG

151 KLPSGCTKLL EQAAASGLLD GNDAWRRVRG LLAGRQTTDA RNLAAALGSP

201 FDGGTQGSRE YALLNVIGKE ARKSPNAAAL LSEMESGLSL EQRSFAWGVL

251 GHYQSQNLNV PAALDYYGKV ADRRQLTDDQ IEWYARAALR ARRWDELASV

301 ISHMPEKLQK SPTWLYWLAR SRAATGNTQE AEKLYKQAAA TGRNFYAVLA

351 GEELGRKIDT RNNVPDAGKN SVRRMAEDGA VKRALVLFQN SQSAGDAKMR
```

-continued

```
401 RQAQAEWRFA TRGFDEDKLL TAAQTAFDHG FYDMAVNSAE RTDRKLNYTL

451 RYISPFKDTV IRHAQNVNVD PAWVYGLIRQ ESRFVIGAQS RVGAQGLMQV

501 MPATAREIAG KIGMDAAQLY TADG . . .
```

The following partial DNA sequence was identified in *N. meningitidis* <SEQ ID 109>:

```
a019.seq
    1 ATGTACCCAC CCTCTCTGAA GCATTCCCTG CCGCTGCTGG TGGNCCTGGT

51 GCTTGCCGCG TGTTCTTNGA CAAACACACT GTCAGCCGAC AAGACCCCGG

101 CAGACAATAT AGAAACTGCC GACCTTTCGG CAAGCGTTCC CACCNGCCCT

151 GCCGAACCCG AANGAAAAAC GTNGGCAGAT TACGGCGGCT ACCCGTCCGC

201 ACTGGATGCA GTGAAACAGA AAACGATGC CGCCGTCGCC GCCTATTTGG

251 AAAACGCCGG CGACAGCGCG ATGGCGGAAA ATGTCCGCAA CGAGTGGCTG

301 AAGTCTTTGG GCGCGCGCAG ACAGTGGACG CTGTNTGCAC ANGAATATGC

351 NAAACTCGAA CCGGCANGGC GCGCCCAAGA AGTCGAATGC TACGCCGATT

401 CGAGCCGCAA CGACTATACG CGTGCCGCCG AACTGGTCAA AAATACGGGC

451 AAACTGCCTT CGGGCTGCAC CAAACTGTTG AACAGGCAG CCGCATCCGG

501 CTTGTTGGAC GGCAACGACG CCTGGAGGCG CGTGCGCGGA CTGCTGGCCG

551 GCCGCCAAAC CACAGACGCA CGCAACCTTG CCGCCGCATT GGGCAGCCCG

601 TTTGACGGCG GTACACAAGG TTCGCGCGAA TATGCCCTGT TGAACGTCAT

651 CGGCAAAGAA GCACGCAAAT CGCCGAATGC CGCCGCCCTG CTGTCCGAAA

701 TGGAAAGCGG TTTAAGCCTC GAACAACGCA GTTTCGCGTG GGGCGTATTG

751 GGGCATTATC AGTCGCAAAA CCTCAATGTG CCTGCCGCCT TGGACTATTA

801 NGGCAAGGTT GCCGACCGCC GCCAACTGAC CGACGACCAA ATCGAGTGGT

851 ACGCCCGCGC CGCNNTNNGC NNNCGNNGTT NGNANGANNT GGCNNCCGNN

901 ANCNCGNNNN TGCNNGANAA ACNNNNNNAN AGNCNNANNT NGNTNNANTG

951 NNTGGCACGC AGCCGCGCCG CNACGGGCAA CACGCAANAN GCGGANAAAC

1001 TNTACAAACA GGCGGCAGCA NCGGGCANGA ATTTTTATGC NGTGCTGNCN

1051 GGGGAAGAGT TGGGGCGCAN AATCGATACG CGCAACAATG TGCCCGATGC

1101 CGGCAAAANC AGCGTCCTCC GTATGGCGGA AGACGGCGCG ATTAAGCGCG

1151 CGCTGGTGCT GTTCCGAAAC AGCCGAACCG CCGGCGATGC GAAAATGCGC

1201 CGTCNGGCTC AGGCGGAATG GCGTTTCGCC ACACGCGGCT TCGATGAAGA

1251 CAAGCTGCTG ACCGCCGCGC AAACCGCGTT CGACCACGGT TTTTACGATA

1301 TGGCGGTCAA CAGCGCGGAA CGCACCGACC GCAAACTCAA CTACACCTTG

1351 CGCTACATTT CGNNNNNTNA NGACACGGTA ATCCGCCACG CGCAAAATGT

1401 TAATGTCGAT CCGGCGTGGG TTTACGGGCT GATTCGTCAG GAAAGCCGCT

1451 TCGTTATGGG CGCGCAATCC CGCGTAGGCG CGCAGGGGCT GATGCAGGTT

1501 ATGCCTGCCA CCGCGCGCGA AATCGCCGGC AAAATCGGTA TGGATGCCGC

1551 ACAACTTTAC ACCGCCGACG GCAATATCCG TATGGGGACG TGGTATATGG

1601 CGGACACCAA ACGCCGCCTG CAAAACAACG AAGTCCTCGC CACCGCAGGC

1651 TATAACGCCG GTCCCGGCAG GGCGCGCCGA TGGCAGGCGG ACACGCGGCT
```

-continued
```
1701 CGAAGGCGCG GTATATGCCG AAACCATCCC GTTTTCCGAA ACGCGCGACT

1751 ATGTCAAAAA AGTGATGGCC AATGCCGCCT ACTACGCCTC CCTCTTCGGC

1801 GCGCCGCACA TCCCGCTCAA ACAGCGTATG GGCATTGTCC CCGCCCGCTG

1851 A
```

This corresponds to the amino acid sequence <SEQ ID 110; ORF 019.a>:

```
a019.pep
  1 MYPPSLKHSL PLLVXLVLAA CSXTNTLSAD KTPADNIETA DLSASVPTXP

51 AEPEXKTXAD YGGYPSALDA VKQKNDAAVA AYLENAGDSA MAENVRNEWL

101 KSLGARRQWT LXAXEYAKLE PAXRAQEVEC YADSSRNDYT RAAELVKNTG

151 KLPSGCTKLL EQAAASGLLD GNDAWRRVRG LLAGRQTTDA RNLAAALGSP

201 FDGGTQGSRE YALLNVIGKE ARKSPNAAAL LSEMESGLSL EQRSFAWGVL

251 GHYQSQNLNV PAALDYXGKV ADRRQLTDDQ IEWYARAAXX XRXXXXXAXX

301 XXXXXXKXXX XXXXXXXXAR SRAATGNTQX AXKLYKQAAA XGXNFYAVLX

351 GEELGRXIDT RNNVPDAGKX SVLRMAEDGA IKRALVLFRN SRTAGDAKMR

401 RXAQAEWRFA TRGFDEDKLL TAAQTAFDHG FYDMAVNSAE RTDRKLNYTL

451 RYISXXXDTV IRHAQNVNVD PAWVYGLIRQ ESRFVMGAQS RVGAQGLMQV

501 MPATAREIAG KIGMDAAQLY TADGNIRMGT WYMADTKRRL QNNEVLATAG

551 YNAGPGRARR WQADTPLEGA VYAETIPFSE TRDYVKKVMA NAAYYASLFG

601 APHIPLKQRM GIVPAR*
``` m019/a019 88.9% identity over a 524 aa overlap

```
                  10         20         30         40         50         60
m019.pep  MYLPSMKHSLPLLAALVLAACSSTNTLPAGKTPADNIETADLSASVPTRPAEPERKTLAD
          || ||:|||||||:|||||||||| |  ||||||||||||||||||||| ||||| || ||
a019      MYPPSLKHSLPLLVXLVLAACSXTNTLSADKTPADNIETADLSASVPTXPAEPEXKTXAD
                  10         20         30         40         50         60

70         80         90        100        110        120
m019.pep  YGGYPSALDAVKQKNDAAVAAYLENAGDSAMAENVRNEWLKSLGARRQWTLFAQEYAKLE
          |||||||||||||||||||||||||||||||||||||||||||||||||| | ||||||
a019      YGGYPSALDAVKQKNDAAVAAYLENAGDSAMAENVRNEWLKSLGARRQWTLXAXEYAKLE
                  70         80         90        100        110        120

130        140        150        160        170        180
m019.pep  PAGRAQEVECYADSSRNDYTRAAELVKNTGKLPSGCTKLLEQAAASGLLDGNDAWRRVRG
          || |||||||||||||||||||||||||||||||||||||||||||||||||||||||||
a019      PAXRAQEVECYADSSRNDYTRAAELVKNTGKLPSGCTKLLEQAAASGLLDGNDAWRRVRG
                 130        140        150        160        170        180

190        200        210        220        230        240
m019.pep  LLAGRQTTDARNLAAALGSPFDGGTQGSREYALLNVIGKEARKSPNAAALLSEMESGLSL
          ||||||||||||||||||||||||||||||||||||||||||||||||||||||||||||
a019      LLAGRQTTDARNLAAALGSPFDGGTQGSREYALLNVIGKEARKSPNAAALLSEMESGLSL
                 190        200        210        220        230        240

250        260        270        280        290        300
m019.pep  EQRSFAWGVLGHYQSQNLNVPAALDYYGKVADRRQLTDDQIEWYARAALRARRWDELASV
          ||||||||||||||||||||||||||| ||||||||||||||||||||  |    |
a019      EQRSFAWGVLGHYQSQNLNVPAALDYXGKVADRRQLTDDQIEWYARAAXXXRXXXXXAXX
                 250        260        270        280        290        300

310        320        330        340        350        360
m019.pep  ISHMPEKLQKSPTWLYWLARSRAATGNTQEAEKLYKQAAATGRNFYAVLAGEELGRKIDT
          |    :        |||||||||||| | ||||||||:| |||||| |||||||||| ||
a019      XXXXXXKXXXXXXXXXXXXARSRAATGNTQXAXKLYKQAAAXGXNFYAVLXGEELGRXIDT
                 310        320        330        340        350        360
```

-continued

```
                 370        380        390        400        410        420
   m019.pep   RNNVPDAGKNSVRRMAEDGAVKRALVLFQNSQSAGDAKMRRQAQAEWRFATRGFDEDKLL
              |||||||||  || ||||||||:||||||:||::||||||| ||||||||||||||||||
       a019   RNNVPDAGKXSVLRMAEDGAIKRALVLFRNSRTAGDAKMRRXAQAEWRFATRGFDEDKLL
                 370        380        390        400        410        420

430        440        450        460        470        480
   m019.pep   TAAQTAFDHGFYDMAVNSAERTDRKLNYTLRYISPFKDTVIRHAQNVNVDPAWVYGLIRQ
              ||||||||||||||||||||||||||||||||||||  ||||||||||||||||||||||
       a019   TAAQTAFDHGFYDMAVNSAERTDRKLNYTLRYISXXXDTVIRHAQNVNVDPAWVYGLIRQ
                 430        440        450        460        470        480

490        500        510        520
   m019.pep   ESRFVIGAQSRVGAQGLMQVMPATAREIAGKIGMDAAQLYTADG
              |||||:||||||||||||||||||||||||||||||||||||||
       a019   ESRFVMGAQSRVGAQGLMQVMPATAREIAGKIGMDAAQLYTADGNIRMGTWYMADTKRRL
                 490        500        510        520        530        540 a019   QNNEVLATAGYNAGPGRARRWQADTPLEGAVYAETIPFSETRDYVKKVMANAAYYASLFG
                 550        560        570        580        590        600
```

Computer analysis of this amino acid sequence gave the following results:

Homology with a Predicted ORF from *N. gonorrhoeae*

ORF 019 shows 95.5% identity over a 89 aa overlap with a predicted ORF (ORF 019.ng) from *N. gonorrhoeae*:

```
g019/m019
                                  10        20        30        40        49
   g019.pep              LLAALVLAACSSTNTLPAGKTPADNIETADLSASVPTRPAEPEGKTLAD
                         ||||||||||||||||||||||||||||||||||||||||||||| ||||
       m019   MYLPSMKHSLPLLAALVLAACSSTNTLPAGKTPADNIETADLSASVPTRPAEPERKTLAD
                    10        20        30        40        50        60

50        60        70        80        89
   g019.pep   YGGYPSALDAVKQNNDAAAAAYLENAGDSAMAENVRKEWL
              |||||||||||||:||||:||||||||||||||||||:|||
       m019   YGGYPSALDAVKQKNDAAVAAYLENAGDSAMAENVRNEWLKSLGARRQWTLFAQEYAKLE
                    70        80        90        100       110       120
```

The following partial DNA sequence was identified in *N. gonorrhoeae* <SEQ ID 111>:

```
g023.seq
  1 ATGGTAGAAC GTAAATTGAC CGGTGCCCAT TACGGTTTGC GCGATTGGGT

51 AATGCAGCGT GCGACTGCGG TTATTATGTT GATTTATACC GTTGCACTTT

101 TAGTGGTTCT ATTTGCCCTG CCTAAAGAAT ATCCGGCATG GCAGGCATTT

151 TTTAGTCAAG CTTGGGTAAA AGTATTTACC CAAGTGAGCT TTATCGCCGT

201 ATTCTTGCAC GCTTGGGTGG GTATCCGCGA TTTGTGGATG GACTATATCA

251 AACCCTTCGG CGTGCGTTTG TTTTTGCAGG TTGCCACCAT TGtctGGCTG

301 GTCGGCTGCC TCGTGTATTC AGTTAAAGTG ATTTGGGGGT AA
```

This corresponds to the amino acid sequence <SEQ ID 112; ORF 023.ng>:

```
g023.pep
  1 MVERKLTGAH YGLRDWVMQR ATAVIMLIYT VALLVVLFAL PKEYPAWQAF

51 FSQAWVKVFT QVSFIAVFLH AWVGIRDLWM DYIKPFGVRL FLQVATIVWL

101 VGCLVYSVKV IWG*
```

The following partial DNA sequence was identified in *N. meningitidis* <SEQ ID 113>:

```
m023.seq
  1 ATGGTAGAAC GTAAATTGAC CGGTGCCCAT TACGGTTTGC GCGATTGGGT

51 GATGCAACGT GCGACTGCGG TTATTATGTT GATTTATACC GTTGCACTTT

101 TAGTGGTTCT ATTTTCCCTG CCTAAAGAAT ATTCGGCATG GCAGGCATTT

151 TTTAGTCAAA CTTGGGTAAA AGTATTTACC CAAGTGAGCT TCATCGCCGT

201 ATTCTTGCAC GCTTGGGTGG GTATCCGCGA TTTGTGGATG GACTATATCA

251 AACCCTTCGG CGTGCGTTTG TTTTTGCAGG TTGCCACCAT CGTTTGGCTG

301 GTCGGCTGTC TCGTGTATTC AGTTAAAGTG ATTTGGGGGT AA
```

This corresponds to the amino acid sequence <SEQ ID 114; ORF 023>:

```
m023.pep
  1 MVERKLTGAH YGLRDWVMQR ATAVIMLIYT VALLVVLFSL PKEYSAWQAF

51 FSQTWVKVFT QVSFIAVFLH AWVGIRDLWM DYIKPFGVRL FLQVATIVWL

101 VGCLVYSVKV IWG*
```

The following partial DNA sequence was identified in *N. meningitidis* <SEQ ID 115>:

```
a023.seq
  1 ATGGTAGAAC GTAAATTGAC CGGTGCCCAT TACGGTTTGC GGGATTGGGC

51 GATGCAACGT GCGACCGCGG TTATTATGTT GATTTATACC GTTGCACTTT

101 TAGTGGTTCT ATTTGCTCTG CCTAAAGAAT ATTCGGCATG GCAGGCATTT

151 TTTAGTCAAA CTTGGGTAAA AGTATTTACC CAAGTGAGCT TCATCGCCGT

201 ATTCTTGCAC GCTTGGGTGG GTATCCGCGA TTTGTGGATG GACTATATNA

251 AACCCTTCGG CGTGCGTTTG TTTTTGCAGG TTGCCACCAT CGTCTGGCTG

301 GTCGGCTGCT TGGTGTATTC AATTAAAGTA ATTTGGGGGT AA
```

This corresponds to the amino acid sequence <SEQ ID 116; ORF 023.a>:

```
a023.pep
  1 MVERKLTGAH YGLRDWAMQR ATAVIMLIYT VALLVVLFAL PKEYSAWQAF

51 FSQTWVKVFT QVSFIAVFLH AWVGIRDLWM DYXKPFGVRL FLQVATIVWL

101 VGCLVYSIKV IWG*
``` m023/a023 96.5% identity over a 113 aa overlap

```
                   10        20        30        40        50        60
m023.pep   MVERKLTGAHYGLRDWVMQRATAVIMLIYTVALLVVLFSLPKEYSAWQAFFSQTWVKVFT
           ||||||||||||||||:|||||||||||||||||||||:|||||||||||||||||||||
a023       MVERKLTGAHYGLRDWAMQRATAVIMLIYTVALLVVLFALPKEYSAWQAFFSQTWVKVFT
                   10        20        30        40        50        60

70        80        90       100       110
m023.pep   QVSFIAVFLHAWVGIRDLWMDYIKPFGVRLFLQVATIVWLVGCLVYSVKVIWGX
           |||||||||||||||||||||| |||||||||||||||||||||||||:||||||
a023       QVSFIAVFLHAWVGIRDLWMDYXKPFGVRLFLQVATIVWLVGCLVYSIKVIWGX
                   70        80        90       100       110
```

Computer analysis of this amino acid sequence gave the following results:
Homology with a Predicted ORF from *N. gonorrhoeae*
ORF 023 shows 97.3% identity over a 113 aa overlap with a predicted ORF (ORF 023.ng) from *N. gonorrhoeae*:

```
g023/m023
                  10        20        30        40        50        60
    g023.pep  MVERKLTGAHYGLRDWVMQRATAVIMLIYTVALLVVLFALPKEYPAWQAFFSQAWVKVFT
              ||||||||||||||||||||||||||||||||||||:|||| ||||||||:||||||
    m023      MVERKLTGAHYGLRDWVMQRATAVIMLIYTVALLVVLFSLPKEYSAWQAFFSQTWVKVFT
                  10        20        30        40        50        60
                  70        80        90       100       110
    g023.pep  QVSFIAVFLHAWVGIRDLWMDYIKPFGVRLFLQVATIVWLVGCLVYSVKVIWGX
              |||||||||||||||||||||||||||||||||||||||||||||||||||||
    m023      QVSFIAVFLHAWVGIRDLWMDYIKPFGVRLFLQVATIVWLVGCLVYSVKVIWGX
                  70        80        90       100       110
```

20

The following partial DNA sequence was identified in *N. gonorrhoeae* <SEQ ID 117>:

```
g025.seq
    1 ATGTTGAAAC AAAcgACACT TTTGGCAGCT TGTACCGCCG TTGCCGCTCT
   51 GTTGGGCGGT TGcgCCACCC AACAGCCTGC TccTGTCATT GCAGGCAATT
  101 CAGGTATGCA GACCGTATCG TCTGCGCCGG TTTACAATCC TTATGGCGCA
  151 ACGCCGTACA ATGCCGCTCC TGCCGCCAac gatgcGCCgT ATGTGCCGCC
  201 CGTGCAAact gcgccggttT ATTCGCCTCC TGCTTATGTT CCGCcgtCTG
  251 CACCTGCCGT TTCGGgtaca tatgtTCCTT CTTACGCACC CgtcgACATC
  301 aacgCGGCGa cgCataCTAT TGTGCGTGGC GACACgGtgt acaACATTTc
  351 caaAcgCtac CATATCTCTC AAGACGATTT CCGTGCGTGG AACGGCATGA
  401 CCGACAATAC GTTGAGCATC GGTCAGATTG TTAAAGTCAA ACCGGCaggA
  451 TATGCCGCAC CGAAAACCGC AGCCGTAGAA AGCAGGCCCG CCGTACCGGC
  501 TGCCGCGCAA ACCCCTGTGA AACCCGCCGC gcaACCGCCC GTTCAGTCCG
  551 CGCCGCAACC TGCCGCGCCC GCTGCGGAAA ATAAAGCGGT TCCCGCCCCC
  601 GCGCCCGCCC CGCAATCTCC TGCCGCTTCG CCTTCCGGCA CGCGTTCGGT
  651 CGGCGGCATT GTTTGGCAGC GTCCGACCCA AGGTAAAGTG GTTGCCGATT
  701 TCGGCGGCGG CAACAAGGGT GTCGATATTG CCGGCAATGC CGGACAACCC
  751 GTTTTGGCGG CGGCTGACGG CAAAGTGGTT TATGCCGGTT CAGGTTTGAG
  801 GGGATACGGA AACTTGGTCA TCATCCAGCA CAATTCCTCT TTCCTGACCG
  851 CGTACGGGCA CAACCAAAAA TTGCTGGTCG GCGAAGGTCA GCAGGTCAAA
  901 CGCGGTCAGC AGGTTGCTTT GATGGGTAAT ACCGATGCTT CCAGAACGCA
  951 GCTTCATTTC GAGGTGCGTC AAAACGGCAA ACCGGTTAAC CCGAACAGCT
 1001 ATATCGCGTT CTGA
```

This corresponds to the amino acid sequence <SEQ ID 118; ORF 025.ng>:

```
g025.pep
    1 MLKQTTLLAA CTAVAALLGG CATQQPAPVI AGNSGMQTVS SAPVYNPYGA
   51 TPYNAAPAAN DAPYVPPVQT APVYSPPAYV PPSAPAVSGT YVPSYAPVDI
```

```
101 NAATHTIVRG DTVYNISKRY HISQDDFRAW NGMTDNTLSI GQIVKVKPAG

151 YAAPKTAAVE SRPAVPAAAQ TPVKPAAQPP VQSAPQPAAP AAENKAVPAP

201 APAPQSPAAS PSGTRSVGGI VWQRPTQGKV VADFGGGNKG VDIAGNAGQP

251 VLAAADGKVV YAGSGLRGYG NLVIIQHNSS FLTAYGHNQK LLVGEGQQVK

301 RGQQVALMGN TDASRTQLHF EVRQNGKPVN PNSYIAF*
```

The following partial DNA sequence was identified in *N. meningitidis* <SEQ ID 119>:

```
m025.seq1 (partial)
   1 ...GTGCCGCCGG TGCAAAGCGC GCCGGTTTAT ACGCCTCCTG CTTATGTTCC
  51    GCCGTCTGCA CCTGCCGTTT CGGGTACATA CGTTCCTTCT TACGCACCCG
 101    TCGACATCAA CGCGGCGACG CATACTATTG TGCGCGGCGA CACGGTGTAC
 151    AACATTTCCA AACGCTACCA TATCTCTCAA GACGATTTCC GTGCGTGGAA
 201    CGGCATGACC GACAATACGT TGAGCATCGG TCAGATTGTT AAAGTCAAAC
 251    CGGCAGGATA TGCCGCACCG AAAGCCGCAG CCGTAAAAAG CAGGCCCGCC
 301    GTACCGGCTG CCGCGCAACC GCCCGTACAG TCCGCACCCG TCGACATTAA
 351    CGCGGCGACG CATACTATTG TGCGCGGCGA CACGGTGTAC AACATTTCCA
 401    AACGCTACCA TATCTCTCAA GACGATTTCC GTGCGTGGAA CGGCATGACC
 451    GACAATATGT TGAGCATCGG TCAGATTGTT AAAGTCAAAC CGGCAGGATA
 501    TGCCGCACCG AAAACCGCAG CCGTAGAAAG CAGGCCCGCC GTACCGGCTG
 551    CCGTGCAAAC CCCTGTGAAA CCCGCCGCGC AACCGCCTGT GCAGTCCGCG
 601    CCGCAACCTG CCGCGCCCGC TGCGGAAAAT AAAGCGGTTC CCGCGCCCGC
 651    CCCGCAATCT CCTGCCGCTT CGCCTTCCGG CACGCGTTCG GTCGGCGGCA
 701    TTGTTTGGCA GCGTCCGACG CAAGGTAAAG TGGTTGCCGA TTTCGGCGGC
 751    AACAACAAGG GTGTCGATAT TGCCGGTAAT GCGGGACAGC CCGTTTTGGC
 801    GGCGGCTGAC GGCAAAGTGG TTTATGCCGG TTCAGGTTTG AGGGGATACG
 851    GAAACTTGGT CATCATCCAG CATAATTCTT CTTTCCTGAC CGCATACGGG
 901    CACAACCAAA AATTGCTGGT CGGCGAGGGG CAGCAGGTCA AACGCGGTCA
 951    GCAGGTTGCT TTGATGGGCA ATACCGATGC TTCCAGAACG CAGCTTCATT
1001    TCGAGGTGCG TCAAAACGGC AAACCGGTTA ACCCGAACAG CTATATCGCG
1051    TTCTGA
```

This corresponds to the amino acid sequence <SEQ ID 110; ORF 025>:

```
m025.pep (partial)
  1 ...VPPVQSAPVY TPPAYVPPSA PAVSGTYVPS YAPVDINAAT HTIVRGDTVY
 51    NISKRYHISQ DDFRAWNGMT DNTLSIGQIV KVKPAGYAAP KAAAVKSRPA
101    VPAAAQPPVQ SAPVDINAAT HTIVRGDTVY NISKRYHISQ DDFRAWNGMT
151    DNMLSIGQIV KVKPAGYAAP KTAAVESRPA VPAAVQTPVK PAAQPPVQSA
201    PQPAAPAAEN KAVPAPAPQS PAASPSGTRS VGGIVWQRPT QGKVVADFGG
251    NNKGVDIAGN AGQPVLAAAD GKVVYAGSGL RGYGNLVIIQ HNSSFLTAYG
```

-continued

```
301    HNQKLLVGEG QQVKRGQQVA LMGNTDASRT QLHFEVRQNG KPVNPNSYIA

351    F*
```

The following partial DNA sequence was identified in *N. meningitidis* <SEQ ID 111>:

```
a025.seq
   1 ATGTTGACAC CAACAACACT TTAGGTAGCT TGTACCGCCC TTGCCGCTCA

51 GTTGGGCGGA TGCCCCACCC AACACCCTTC TCCTGTCATT GCAGGCAATT

101 CAGGTATGCA GACCGTACCG TCTGCGCCGG TTTACAATCC TTATGGCGCA

151 ACGCCGTACA ATGCCGCTCC TGCCGCCAAC GATGCGCCGT ATGTGCCGCC

201 GGTGCAAAGC GCGCCGGTTT ATANGCCTCC TGCTTATGTT CCGCCGTCTG

251 CACCTGCCGT TTCGGGTACA TACGTTCCTT CTTACGCANC CGTCGACATC

301 AACGCGGCGA CGCATACTAT TGTGCGCGGC GACACCGTGT ACAAGATTTC

351 CAAATGCTAC CATATCTCTC AAGACGATTT CCGTGCGTGG AACGGCATGA

401 CCGACAATAC GTTGAGCATC GGTCAGATTG TTAAAGTCAA ACCGGCAGGA

451 TATGCCGCAC CGAAAGCCGC AGCCGTAAAA AGCAGGCCCG CCGTACCGGC

501 TGCCGCGCAA CCGCTCGTAC AGTCCGCACC CGTCGACATC AACGCGGCGA

551 CGCATACTAT TGTGCGCGGC GACACGGTGT ACAACATTTC CAAACGCTAC

601 CATATCTCTC AAGACGATTT CCGTGCGTGG AACGGCATGA CCGACAATAC

651 GTTGAGCATC GGTCAGATTG TTAAAGTCAA ACCGGCAGGA TATGCCGCAC

701 CGAAAGCCGC AGCCGTAAAA AGCAGGCCCG CCGTACCGGC TGCCGTGCAA

751 ACCCCTGTGA AACCCGCCGC GCAACCGCCT GTGCAGTCCG CGCCGCAACC

801 TGCCGCGCCC GCTGCGGAAA ATAAAGCGGT TCCCGCGCCC GCCCCGCAAT

851 CTCCTGCCGC TTCGCCTTCC GGCACGCGTT CGGTCGGCGG CATTGTTTGG

901 CAGCGTCCGA CGCAAGGTAA AGTGGTTGCC GATTTCGGCG GCAACAACAA

951 GGGTGTCGAT ATTGCAGGAA ATGCGGGACA GCCCGTTTTG GCGGCGGCTG

1001 ACGGCAAAGT GGTTTATGCA GGTTCCGGTT TGAGGGGATA CGGCAATTTG

1051 GTCATCATCC AGCATAATTC TTCCTTCCTG ACCGCATACG GCACAACCA

1101 AAAATTGCTG GTCGGCGAAG GCCAGCAGGT CAAACGCGGG CAGCAGGTCG

1151 CTTTGATGGG CAATACCGAG GCTTCTAGAA CGCAGCTTCA TTTCGAGGTG

1201 CGGCAAAACG GCAAACCGGT TAATCCGAAC AGCTATATCG CGTTCTGA
```

This corresponds to the amino acid sequence <SEQ ID 112; ORF 025.a>:

```
a025.pep
   1 MLTPTTL*VA CTALAAQLGG CPTQHPSPVI AGNSGMQTVP SAPVYNPYGA

51 TPYNAAPAAN DAPYVPPVQS APVYXPPAYV PPSAPAVSGT YVPSYAXVDI

101 NAATHTIVRG DTVYKISKCY HISQDDFRAW NGMTDNTLSI GQIVKVKPAG

151 YAAPKAAAVK SRPAVPAAAQ PLVQSAPVDI NAATHTIVRG DTVYNISKRY

201 HISQDDFRAW NGMTDNTLSI GQIVKVKPAG YAAPKAAAVK SRPAVPAAVQ

251 TPVKPAAQPP VQSAPQPAAP AAENKAVPAP APQSPAASPS GTRSVGGIVW

301 QRPTQGKVVA DFGGNNKGVD IAGNAGQPVL AAADGKVVYA GSGLRGYGNL
```

```
351 VIIQHNSSFL TAYGHNQKLL VGEGQQVKRG QQVALMGNTE ASRTQLHFEV

401 RQNGKPVNPN SYIAF*
``` m025/a025 97.4% identity over a 351 aa overlap

```
                                    10         20         30
m025.pep                    VPPVQSAPVYTPPAYVPPSAPAVSGTYVPS
                            |||||||||:||||||||||||||||||||
a025     GMQTVPSAPVYNPYGATPYNAAPAANDAPYVPPVQSAPVYXPPAYVPPSAPAVSGTYVPS
              40         50         60         70         80         90

40         50         60         70         80         90
m025.pep YAPVDINAATHTIVRGDTVYNISKRYHISQDDFRAWNGMTDNTLSIGQIVKVKPAGYAAP
         || ||||||||||||||||||:||| ||||||||||||||||||||||||||||||||||
a025     YAXVDINAATHTIVRGDTVYKISKCYHISQDDFRAWNGMTDNTLSIGQIVKVKPAGYAAP
             100        110        120        130        140        150

100        110        120        130        140        150
m025.pep KAAAVKSRPAVPAAAQPPVQSAPVDINAATHTIVRGDTVYNISKRYHISQDDFRAWNGMT
         |||||||||||||||| |||||||||||||||||||||||||||||||||||||||||||
a025     KAAAVKSRPAVPAAAQPLVQSAPVDINAATHTIVRGDTVYNISKRYHISQDDFRAWNGMT
             160        170        180        190        200        210

160        170        180        190        200        210
m025.pep DNMLSIGQIVKVKPAGYAAPKTAAVESRPAVPAAVQTPVKPAAQPPVQSAPQPAAPAAEN
         || ||||||||||||||||||:|||:||||||||||||||||||||||||||||||||||
a025     DNTLSIGQIVKVKPAGYAAPKAAAVKSRPAVPAAVQTPVKPAAQPPVQSAPQPAAPAAEN
             220        230        240        250        260        270

220        230        240        250        260        270
m025.pep KAVPAPAPQSPAASPSGTRSVGGIVWQRPTQGKVVADFGGNNKGVDIAGNAGQPVLAAAD
         ||||||||||||||||||||||||||||||||||||||||||||||||||||||||||||
a025     KAVPAPAPQSPAASPSGTRSVGGIVWQRPTQGKVVADFGGNNKGVDIAGNAGQPVLAAAD
             280        290        300        310        320        330

280        290        300        310        320        330
m025.pep GKVVYAGSGLRGYGNLVIIQHNSSFLTAYGHNQKLLVGEGQQVKRGQQVALMGNTDASRT
         |||||||||||||||||||||||||||||||||||||||||||||||||||||||:||||
a025     GKVVYAGSGLRGYGNLVIIQHNSSFLTAYGHNQKLLVGEGQQVKRGQQVALMGNTEASRT
             340        350        360        370        380        390

340        350
m025.pep QLHFEVRQNGKPVNPNSYIAFX
         ||||||||||||||||||||||
a025     QLHFEVRQNGKPVNPNSYIAFX
             400        410
```

Computer analysis of this amino acid sequence gave the following results:

Homology with a Predicted ORF from *N. gonorrhoeae* ORF 025 shows 75.6% identity over a 353 aa overlap with a predicted ORF (ORF 025.ng) from *N. gonorrhoeae*:

```
m025/g025

10         20         30
m025.pep                    VPPVQSAPVYTPPAYVPPSAPAVSGTYVPS
                            |||||:||||:|||||||||||||||||||
g025     GMQTVSSAPVYNPYGATPYNAAPAANDAPYVPPVQTAPVYSPPAYVPPSAPAVSGTYVPS
              40         50         60         70         80         90

40         50         60         70         80         90
m025.pep YAPVDINAATHTIVRGDTVYNISKRYHISQDDFRAWNGMTDNTLSIGQIVKVKPAGYAAP
         ||||||||||||||||||||||||||||||||||||||||||||||||||||||||||||
g025     YAPVDINAATHTIVRGDTVYNISKRYHISQDDFRAWNGMTDNTLSIGQIVKVKPAGYAAP
             100        110        120        130        140        150

100        110        120        130        140        150
m025.pep KAAAVKSRPAVPAAAQPPVQSAPVDINAATHTIVRGDTVYNISKRYHISQDDFRAWNGMT
         |
g025     K-----------------------------------------------------------

160        170        180        190        200        210
m025.pep DNMLSIGQIVKVKPAGYAAPKTAAVESRPAVPAAVQTPVKPAAQPPVQSAPQPAAPAAEN
                             ||||||||||:||||||||||||||||||||||||||||
g025     --------------------TAAVESRPAVPAAAQTPVKPAAQPPVQSAPQPAAPAAEN
                             160        170        180        190
```

```
                 220        230        240        250        260
m025.pep    KAVPAPAP--QSPAASPSGTRSVGGIVWQRPTQGKVVADFGGNNKGVDIAGNAGQPVLAA
            ||||||||  ||||||||||||||||||||||||||||||||:|||||||||||||||||
g025        KAVPAPAPAPQSPAASPSGTRSVGGIVWQRPTQGKVVADFGGGNKGVDIAGNAGQPVLAA
                 200        210        220        230        240        250

270        280        290        300        310        320
m025.pep    ADGKVVYAGSGLRGYGNLVIIQHNSSFLTAYGHNQKLLVGEGQQVKRGQQVALMGNTDAS
            ||||||||||||||||||||||||||||||||||||||||||||||||||||||||||||
g025        ADGKVVYAGSGLRGYGNLVIIQHNSSFLTAYGHNQKLLVGEGQQVKRGQQVALMGNTDAS
                 260        270        280        290        300        310

330        340        350
m025.pep    RTQLHFEVRQNGKPVNPNSYIAFX
            ||||||||||||||||||||||||
g025        RTQLHFEVRQNGKPVNPNSYIAFX
                 320        330
```

The following partial DNA sequence was identified in *N. gonorrhoeae* <SEQ ID 113>:

```
g031.seq
  1 ATGGTGTCCC TCCGCTTCAG ATTCGGCAAC CACTTTAAAC GCCGACATTC

51 TGACAATTTC CTTTTCCGCC AGCCAAATAT CATGCGTATC TTTCGGTTCG

101 GGCTTGTTGG GCATGGCAAC CTTCAACAGC CGCGCCATCA CAGGAATCGT

151 CGTTCCCTGA ATCAGCAGCG ACAGCACCAC CACGGCAAAC GCCACATCAA

201 ACAGCAGGTG CGAATTGGGA ACGCCCATCA CCAGCGGCAT CATCGCCAGC

251 GAAATCGGTA CGGCTCCTCG CAAGCCCAAC CAACTGATAT ACGCCTTTTC

301 ACGCAGGCTG TAATTGAATT TCCACAAACC GCCGAACACT GCCAGCGGAC

351 GCGCGACCAG CATCAGGAAC GCCGCAATCG CCAAGGCTTC CGCCGCCCTG

401 TCCAACACGC CGGCGGGAGA AACCAGCAGA CCGAGCATGA CGAACAAAGT

451 TGCCTGCGCC AGCCAAGCCA AACCGTCCAT CACACGCAAA ACGTGTTCCG

501 TcgcACGGTT GCGCTGGTTA CCGACAATGA TGCCGGCAAG GTAAACCGCC

551 AAAAAGCCGC TGCCGCCTAT GGTATTGGTA ACGCAAACA CAAGCAGCCC

601 GCCCGACACA ATCATCAGCG CGTACAGACC TTCCGtacac acctccaatt 651 cccaatcaac gtcatagctg tctcccgtgt taaaatgttc ttcacttcag 701 aatcccccc ttcttcccag cccgaaacct tcatgtgtta naccctgggg 751 tgccccaacg gatttagtaa cctcccaatg actctgcttg tcgccccctt 801 cgcccgcttt ctccttccgg gaaaacttgt tgtccccgtc ttacattaa
```

This corresponds to the amino acid sequence <SEQ ID 114; ORF 031.ng>:

```
g031.pep
  1 MVSLRFRFGN HFKRRHSDNF LFRQPNIMRI FRFGLVGHGN LQQPRHHRNR

51 RSLNQQRQHH HGKRHIKQQV RIGNAHHQRH HRQRNRYGSS QAQPTDIRLF

101 TQAVIEFPQT AEHCQRTRDQ HQERRNRQGF RRPVQHAGGR NQQTEHDEQS

151 CLRQPSQTVH HTQNVFRRTV ALVTDNDAGK VNRQKAAAAY GIGKRKHKQP

201 ARHNHQRVQT FRTHLQFPIN VIAVSRVKMF FTSESPPSSQ PETFMCXTLG

251 CPNGFSNLPM TLLVAPFARF LLPGKLVVPV LH*
```

The following partial DNA sequence was identified in *N. meningitidis* <SEQ ID 115>:

```
m031.seq (partial)
  1 ...CGCCTGAAGC ACGGTGTCGG ACTGCATTTC TATTCGGCTA TACGCCTTTT

51    CACGCAGGCT GTAATTGAAT TTCCACAAAC CGCCGAACAC TGCCGACGGA

101    CGCGCGACCA GCATCAGGAA CGCCGCAATC GCCAAgGCTT CCGCCGCCCT

151    GTCCAACACG TTGGCAGGAG AAACCAGCAG CAAAGGCATT CCCAAACGTG

201    CGGACAAAGT GGTCGAAACC ACGCTCAGAA ACAACAGTGC GCCACCCGGC

251    AG...
```

This corresponds to the amino acid sequence <SEQ ID 116; ORF 031>:

```
m031.pep (partial)
  1 ...RLKHGVGLHF YSAIRLFTQA VIEFPQTAEH CRRTRDQHQE RRNRQGFRRP

51    VQHVGRRNQQ QRHSQTCGQS GRNHAQKQQC ATRQ....
```

The following partial DNA sequence was identified in *N. meningitidis* <SEQ ID 117>:

```
a031.seq
  1 ATACGCCTTT TCACGCAGGC TGTAATTGAA TTTCCACAAA CCGCCGAACA

51 CTGCCGGCGG ACGCGCGACC AGCATCAGGA ACGCCGCAAT CGCCAAGGCT

101 TCCGCCGCCC CGTCCAACAC GTTGGCAGGA GAAACCAGCA GCAAAGGCAT

151 TCCCAAACGT GCGGACAAAG TGGTCGAAAC CACGCTCAGA AACAACAGTG

201 CGCCACCCGG CAG
```

This corresponds to the amino acid sequence <SEQ ID 118; ORF 031.a>:

```
a031.pep (partial)
  1 IRLFTQAVIE FPQTAEHCRR TRDQHQERRN RQGFRRPVQH VGRRNQQQRH

51 SQTCGQSGRN HAQKQQCATR Q
``` m031/a031 100.0% identity over a 71 aa overlap

```
                    10        20        30        40        50        60
m031.pep RLKHGVGLHFYSAIRLFTQAVIEFPQTAEHCRRTRDQHQERRNRQGFRRPVQHVGRRNQQ
                       ||||||||||||||||||||||||||||||||||||||||||||||
a031                   IRLFTQAVIEFPQTAEHCRRTRDQHQERRNRQGFRRPVQHVGRRNQQ
                               10        20        30        40

70        80
m031.pep QRHSQTCGQSGRNHAQKQQCATRQ
         ||||||||||||||||||||||||
a031     QRHSQTCGQSGRNHAQKQQCATRQ
          50        60        70
```

Computer analysis of this amino acid sequence gave the following results:
Homology with a Predicted ORF from *N. gonorrhoeae*
ORF 031 shows 60.0% identity over a 85 aa overlap with a predicted ORF (ORF 031.ng) from *N. gonorrhoeae*:

```
    m031/g031

10        20        30
         m031.pep                         RLKHGVGLHFYSAIRLFTQAVIEFPQTAEH
                                          | ::|  :      : ||||||||||||||
         g031     NQQRQHHHGKRHIKQQVRIGNAHHQRHHRQRNRYGSSQAQPTDIRLFTQAVIEFPQTAEH
                          60        70        80        90       100       110
                       40        50        60        70        80
         m031.pep  CRRTRDQHQERRNRQGFRRPVQHVGRRNQQQRHS-QTCGQSGRNHAQKQQCATRQ
                   |:||||||||||||||||||||||||:| ||||  :|: |:|  ::   : ::: | :  |:
         g031      CQRTRDQHQERRNRQGFRRPVQHAGGRNQQTEHDEQSCLRQPSQTVHHTQNVFRRTVALV
                          120       130       140       150       160       170
         g031      TDNDAGKVNRQKAAAAYGIGKRKHKQPARHNHQRVQTFRTHLQFPINVIAVSRVKMFFTS
                          180       190       200       210       220       230
```

The following partial DNA sequence was identified in *N. gonorrhoeae* <SEQ ID 119>:

```
g032.seq
   1 ATGCGGCGAA ACGTGCCTGC CGTCGCCGTA TTGCGCCGCC CACGATTCGA

51 GGCGTTTTTG GATTTGGCGT TGGCTCAGGC GCGTGCCGTT CCTGCCGGTA

101 AACAGGGCTT TGCCGTCCGA TGCCGTCTGA CGCAGCGGCA GATAGTTTTT

151 CAAGGCTTCC ACGCTTTTGC CGGTCAGCGG AACCTGACGC TGCTTGCGCC

201 CTTTGCCGGT AACGTGTACC CACGCTTCGT CCAAATATAC ATCATCTGCA

251 TTCAAGCCGT GTATCTCGCT CACGCGCAAA CCGCTGCCGT ACATCAGCTC

301 GAACAGCGCG TGGTCGCGCA CCGCCAGCGG GTCGCCGCCG TCCACGGGCA

351 AATCCAACAT CCGGTTCAGC CATTCCTGCG GCAGGGCTTT GGGTACGCGC

401 TCGGGCTGCT TCGGCGGTTT GATGTCGGCG GTCGGGTCGG CGCGCATCAG

451 CCCGCGTTTG ACCAGCCAGG CGCAATACTG CCGCCACGCC GACAGCTTGC

501 GCGCCAGCGT CCGACCGTCC AAACCGCGCT GCGACAGCCG CCGCAACGCC

551 GccgTAAAAT CGCGCCGCGA CAAGTCCTGC GGCACGCcgc ctgcaTCTTC

601 AGACGGCATT TGTGCCAACA GTGCAAACAG TTCTTCCAAA TCGCGCCGGT

651 ATGCCGCAAC CGTGTGCTCC GACTTGCCCT CGCGCACGAT GTTTTCCAAA

701 TAAGCGTCAA AATacgccgC AAACccgTCC AAAACCATAA CCGTCCCACA

751 CAAATATCAA AAAACCAGTG A
```

This corresponds to the amino acid sequence <SEQ ID 110; ORF 032.ng>:

```
g032.pep
   1 MRRNVPAVAV LRRPRFEAFL DLALAQARAV PAGKQGFAVR CRLTQRQIVF

51 QGFHAFAGQR NLTLLAPFAG NVYPRFVQIY IICIQAVYLA HAQTAAVHQL

101 EQRVVAHRQR VAAVHGQIQH PVQPFLRQGF GYALGLLRRF DVGGRVGAHQ

151 PAFDQPGAIL PPRRQLARQR PTVQTALRQP PQRRRKIAPR QVLRHAACIF
```

```
201 RRHLCQQCKQ FFQIAPVCRN RVLRLALAHD VFQISVKIRR KPVQNHNRPT

251 QISKNQ*
```

The following partial DNA sequence was identified in *N. meningitidis* <SEQ ID 111>:

```
m032.seq (partial)
  1 ATGCGGCGAA ACGTGCmTGC mGTCGCCGTT kTGCGCCGCC CATTGCGCCA

51 AACGTTTTTG GATTTGGCGT TGGCTCAGGC GCGTGCCGTT CCTGCCGGTA

101 AACAGGGCTT TGCCGTCCGA TGCCGTCTGA CGCAGCGGCA GATAGTTTTT

151 CAGGGCTTCC ACGCTTTTGC CGACCAGCGG CACCTGCCGC TgTT.GCGCC

201 CTTTGCCGAT AAcGTGTACC CACGCyTCGT CCAAATAGAC ATCATCTGCA

251 TTCAAGCCGT GTATCTCGCT CACGCGCAAA CCGCTGCCGT ACATCAGTTC

301 GAACAGGGCG TGGTCGCGCA CCGCCAGCGG GTCGCCGCCG TCCACGGGCA

351 AATCCAGCAT CCGGTTCAGC CATTCCTGCG GCAGGGCTTT GGGTACGCGC

401 TCGGGCTGCT TCGGCGGTTT GATGTCGGCG GTCGGGTCGG CGTGCATCAG

451 GCCGCGCTTT ACCAGCCAAA CGCAATACTG CCGCCAAGAC GAAAGCTTGC

501 GAGCCAGCGT CCGTTCCCCC AAACCGCG...
```

This corresponds to the amino acid sequence <SEQ ID 112; ORF 032>:

```
m032.pep (partial)
  1 MRRNVXAVAV XRRPLRQTFL DLALAQARAV PAGKQGFAVR CRLTQRQIVF

51 QGFHAFADQR HLPLXAPFAD NVYPRXVQID IICIQAVYLA HAQTAAVHQF

101 EQGVVAHRQR VAAVHGQIQH PVQPFLRQGF GYALGLLRRF DVGGRVGVHQ

151 AALYQPNAIL PPRRKLASQR PFPQTA . . .
```

The following partial DNA sequence was identified in *N. meningitidis* <SEQ ID 113>:

```
a032.seq
  1 ATGCGGCGAA ACGTGCCTGC CGTCGCCGTT TTGCGCCGCC CATTGCGCCA

51 AACGTTTTTG GATTTGGCGT TGGCTCAGGC GCGTGCCGTT CCTGCCGGTA

101 AACAGGGCTT TGCCGTCCGA TGCCGTCTGA CGCAGCGGCA GATAGTTTTT

151 CAGGGCTTCC ACGCTTTTGC CGGTCAGCGG AACCTGCCGC TGCTTGCGTC

201 CTTTGCCGGT AACGTGTACC CACGCCTCGT CCAAATATAC ATCATCTGCA

251 TTCAAGCCGT GTATCTCGCT CACGCGCAAA CCGCTGCCGT ACATCAGTTC

301 GAACAGCGCG TGATCGCGCA CCGCCAGCGG GTCGCCGCCG TCCACGGGCA

351 AATCCAGCAT CCGGTTCAGC CATTCCTGCG GCAGGGCTTT GGGTACGCGC

401 TCGGGCTGCT TCGGCGGTTT GATGTCGGCG GTCGGGTCGG TATGCAGCAG

451 ACCGCGTTTG ACCAGCCAGG CGCAATACTG CCGCCAAGAC GACAGCTTGC

501 GCGCCAGCGT CCGCGCATTC AAACCGCGCT GCGACAGCCG CCGCAACGCC

551 GCCGTAAAAT CGCGCTGCGA CAAGCCCTGC GGCACGCCGC CTGCATCTTC

601 AGACGGCATT TGTGCCAACA GCGCAAACAG TTCTTCCAAA TCGCGCCGGT

651 ATGCCGCCAC CGTGTGCTCC GACTTGCCCT CGCGCACGAT GTTTTCCAAA
```

```
-continued
701 TAAGCGTCAA AATGCGCCGC AAACCCGTCC AAAACCATAA CCGCCCCACA

751 CAAATATCAA AAAAACAGTG A
```

This corresponds to the amino acid sequence <SEQ ID 114; ORF 032.a>:

```
a032.pep
  1 MRRNVPAVAV LRRPLRQTFL DLALAQARAV PAGKQGFAVR CRLTQRQIVF

51 QGFHAFAGQR NLPLLASFAG NVYPRLVQIY IICIQAVYLA HAQTAAVHQF

101 EQRVIAHRQR VAAVHGQIQH PVQPFLRQGF GYALGLLRRF DVGGRVGMQQ

151 TAFDQPGAIL PPRRQLARQR PRIQTALRQP PQRRRKIALR QALRHAACIF

201 RRHLCQQRKQ FFQIAPVCRH RVLRLALAHD VFQISVKMRR KPVQNHNRPT

251 QISKKQ*
``` m032/a032 88.1% identity over a 176 aa overlap

```
                    10         20         30         40         50         60
  m032.pep  MRRNVXAVAVXRRPLRQTFLDLALAQARAVPAGKQGFAVRCRLTQRQIVFQGFHAFADQR
            |||||  ||||  ||| ||||||||||||||||||||||||||||||||||||||||| ||
  a032      MRRNVPAVAVLRRPLRQTFLDLALAQARAVPAGKQGFAVRCRLTQRQIVFQGFHAFAGQR
                    10         20         30         40         50         60

70         80         90        100        110        120
  m032.pep  HLPLXAPFADNVYPRXVQIDIICIQAVYLAHAQTAAVHQFEQGVVAHRQRVAAVHGQIQH
            :|||  |  || ||||| |||  |||||||||||||||||||:||||||||||||||||
  a032      NLPLLASFAGNVYPRLVQIYIICIQAVYLAHAQTAAVHQFEQRVIAHRQRVAAVHGQIQH
                    70         80         90        100        110        120

130        140        150        160        170
  m032.pep  PVQPFLRQGFGYALGLLRRFDVGGRVGVHQAALYQPNAILPPRRKLASQRPFPQTA
            ||||||||||||||||||||||||||||::|:|: ||:||||||:|| ||| |||
  a032      PVQPFLRQGFGYALGLLRRFDVGGRVGMQQTAFDQPGAILPPRRQLARQRPRIQTALRQP
                   130        140        150        160        170        180 a032      PQRRRKIALRQALRHAACIFRRHLCQQRKQFFQIAPVCRHRVLRLALAHDVFQISVKMRR
                   190        200        210        220        230        240
```

Computer analysis of this amino acid sequence gave the following results:

Homology with a Predicted ORF from *N. gonorrhoeae*
ORF 032 shows 86.4% identity over a 176 aa overlap with a predicted ORF (ORF 032.ng) from *N. gonorrhoeae*:

```
  m032/g032

10         20         30         40         50         60
  m032.pep  MRRNVXAVAVXRRPLRQTFLDLALAQARAVPAGKQGFAVRCRLTQRQIVFQGFHAFADQR
            |||||  ||||  |||  ::|||||||||||||||||||||||||||||||||||| ||
  g032      MRRNVPAVAVLRRPRFEAFLDLALAQARAVPAGKQGFAVRCRLTQRQIVFQGFHAFAGQR
                    10         20         30         40         50         60

70         80         90        100        110        120
  m032.pep  HLPLXAPFADNVYPRXVQIDIICIQAVYLAHAQTAAVHQFEQGVVAHRQRVAAVHGQIQH
            :|  |||| ||||| |||  |||||||||||||||||:|| ||||||||||||||||||
  g032      NLTLLAPFAGNVYPRFVQIYIICIQAVYLAHAQTAAVHQLEQRVVAHRQRVAAVHGQIQH
                    70         80         90        100        110        120

130        140        150        160        170
  m032.pep  PVQPFLRQGFGYALGLLRRFDVGGRVGVHQAALYQPNAILPPRRKLASQRPFPQTA
            ||||||||||||||||||||||||||||::|| |: ||:||||||:|| ||| |||
  g032      PVQPFLRQGFGYALGLLRRFDVGGRVGAHQPAFDQPGAILPPRRQLARQRPTVQTALRQP
                   130        140        150        160        170        180 g032      PQRRRKIAPRQVLRHAACIFRRHLCQQCKQFFQIAPVCNRVLRLALAHDVFQISVKIRR
                   190        200        210        220        230        240
```

The following partial DNA sequence was identified in *N. gonorrhoeae* <SEQ ID 115>:

```
g033.seq
     1 ATGGCGGCGG CGGACAAACT CTTGGGCGGC GACCGCCGCA GCGTCGCCAT

51 CATCGGAGAC GGCGCGATGA CGGCGGGGCA GGCGTTTGAA GCCTTGAATT

101 GCGCGGGCGA TATGGATGTG GATTTGCTGG TCGTCCTCAA CGACAACGAA

151 ATGTCGATTT CCCCCAACGT CGGCGCGTTG CCCAAATATC TTGCCAGCAA

201 CGTCGTGCGC GATATGCACG GACTGTTGAG TACCGTCAAA GCGCAAAcgg

251 GCAAGGTATT AGACAAAATA CCCGGCGCGA TGGagtTTGC CCAAAAAGTC

301 GAACAcaaaA TCAAAACCCT TGCCGAAGAA GCCGAACACG CCAAACAGTC

351 GCTGTCGCTG TTTGAAAATT TCGGCTTCCG CTACACCGGC CCCGTGGACG

401 GACACAACGT CGAGAATCTG GTGGACGTAT TGAAAGACTT GCGCAGCCGC

451 AAAGGCCCTC AGTTGCTGCA CGTCATCACC AAAAAGGGCA ACGGCTACAA

501 ACTCGCCGAA AACGACCCCg tcaAATACCA CGCCGTCGCc aACCTGCCta

551 AAGAAGGCGG GGCGCAAATg ccGTCTGAAA AAGAACCCAA GCCCGCCgCc 601 aaaccgACCT ATACCCAAGT ATTCGGCAAA TGGCTGTGCG ACCGGGCGGC

651 GGCAGATTCC CGACTGGTTG CGATTACCCC CGCCATGCGC GAGGGCAGCG

701 GACTGGTGGA GTTTGAACAA CGATTCCCCG ACCGCTATTT CGATGTCGGC

751 ATCGCCGAGC AGCACGCCGT tacCTTTGCC GGCGGTTTGG CGTGCGAAGG

801 CATGAAGCCC GTCGTGGCGA TTTATTCCAC CTTTTTACAA CGCGCCTACG

851 ACCAACTGGT GCACGACATC GCCCTGCAAA ACCTGCCCGT TTTGTTTGCC

901 GTCGACCGTG CGGGCATCGT CGGCGCGGAC GGTCCGACCC ATGCCGGCTT

951 GTACGATTTG AGCTTCTTGC GCTGTGTGCC GAACATGATT GTTGCCGCGC

1001 CGAGCGATGA AAACGAATGC CGCCTGCTGC TTTCGACCTG CTATCAGGCG

1051 GATGCGCCCG CCGCCGTCCG CTATCCGCGC GGCACGGGTA CGGGCGCGCC

1101 GGTTTCAGAC GGCATGGAAA CCGTGGAAAT CGGCAAGGGC ATTATCCGCC

1151 GCGAAGGTGA GAAAACCGCC TTcatTGCCT TCGGCAGTAT GGTCGCCACC

1201 GCATTGGCGG TTGCCGAAAA ACTGAACGCC ACCGTCGCCG ATATGCGCTt 1251 cgtcaaacCG ATAGACGAAG AGTTGATTGT CCGCCTTGCC CGAAGCCAcg 1301 accGCATCGT TACCCTTGAA GAAAACGCCG AACAGGGCGG CGCAGGCGGC

1351 GCGGTCTTGG AAGTGTTGGC GAAACACGGC ATCTGCAAAC CCGTTTTGCT

1401 TTTGGGCGTT GCCGATACCG TAACCGAACA CGGCGATCCG AAAAAACTTT

1451 TGGACGATTT GGGTTTGAGT GCCGAAGCGG TGGAACGCCG GGTGCGCGAG

1501 TGGCTGCCGG ACCGTGATGC GGCAAATTAA
```

This corresponds to the amino acid sequence <SEQ ID 116; ORF 033.ng>:

```
g033.pep
    1 MAAADKLLGG DRRSVAIIGD GAMTAGQAFE ALNCAGDMDV DLLVVLNDNE

51 MSISPNVGAL PKYLASNVVR DMHGLLSTVK AQTGKVLDKI PGAMEFAQKV

101 EHKIKTLAEE AEHAKQSLSL FENFGFRYTG PVDGHNVENL VDVLKDLRSR

151 KGPQLLHVIT KKGNGYKLAE NDPVKYHAVA NLPKEGGAQM PSEKEPKPAA
```

```
201 KPTYTQVFGK WLCDRAAADS RLVAITPAMR EGSGLVEFEQ RFPDRYFDVG

251 IAEQHAVTFA GGLACEGMKP VVAIYSTFLQ RAYDQLVHDI ALQNLPVLFA

301 VDRAGIVGAD GPTHAGLYDL SFLRCVPNMI VAAPSDENEC RLLLSTCYQA

351 DAPAAVRYPR GTGTGAPVSD GMETVEIGKG IIRREGEKTA FIAFGSMVAT

401 ALAVAEKLNA TVADMRFVKP IDEELIVRLA RSHDRIVTLE ENAEQGGAGG

451 AVLEVLAKHG ICKPVLLLGV ADTVTEHGDP KKLLDDLGLS AEAVERRVRE

501 WLPDRDAAN*
```

The following partial DNA sequence was identified in *N. meningitidis* <SEQ ID 117>:

```
m033.seq
   1 ATGGCGGCGG CAGACAAACT CTTGGGCAGC GACCGCCGCA GCGTCGCCAT

51 CATCGGCGAC GGCGCGATGA CGGCGGGGCA GGCGTTTGAA GCCTTGAATT

101 GCGCaG.CGA TATGGATGTr GATTTGCTrG TCGTCCTCAA CGACAACGAA

151 ATGTCGATTT CCCCCAACGT CGGCGCGCTG CCGAAATACC TTGCCAGCAA

201 CGTCGTGCGC GATATGCACG GCCTGTTGAG TACCGTCAAA GCGCAAACGG

251 GCAAGGTATT AGACAAAATA CCCGGCGCGA TGGAGTTTGC CCAAAAAGTC

301 GAACACAAAA TCAAAACCCT TGCCGAAGAA GCCGAACACG CCAAACAGTC

351 GCTGTCTTTG TTTGAAAACT TCGGCTTCCG CTACACCGGC CCCGTGGACG

401 GACACAACGT CGAAAATCTG GTGGACGTAT TGAAAGACTT GCGCAGCCGC

451 AAAGGCCCTC AGTTGCTGCA CGTCATCACC AAAAAGGGCA ACGGCTACAA

501 ACTCGCCGAA AACGACCCCG TCAAATACCA CGCCGTCGCC AACCTGCCTA

551 AAGAAAGCGC GGCGCAAATG CCGTCTGAAA AAGAACCCAA GCCCGCCGCC

601 AAACCGACCT ATACCCAAGT GTTCGGCAAA TGGCTGTGCG ACCGGGCGGC

651 GGCAGATTCC CGACTGGTTG CGATTACCCC CGCCATGCGC GAGGGCAGCG

701 GCTTGGTTGA GTTTGAACAA CGATTCCCCG ACCGCTATTT CGATGTCGGC

751 ATCGCCGAGC AGCACGCCGT TACCTTTGCC GGCGGTTTGG CTTGCGAAGG

801 GATGAAGCCC GTCGTGGCGA TTTATTCCAC CTTTTTACAA CGCGCCTACG

851 ACCAACTGGT GCACGACATC GCCCTGCAAA ACCTACCCGT TTTGTTTGCC

901 GTCGACCGCG CGGGCATCGT CGGCGCGGAC GGCCCGACCC ATGCCGGTCT

951 GTACGATTTG AGCTTTTTGC GCTGCGTGCC GAACATGATT GTCGCCGCGC

1001 CGAGCGATGA AAACGAATGC CGCCTGTTGC TTTCGACCTG CTATCAGGCA

1051 GACGCGCCCG CCGCCGTCCG CTATCCGCGC GGCACGGGTA CGGGCGCGCC

1101 GGTTTCAGAC GGCATGGAAA CCGTGGAAAT CGGCAAGGGC ATTATCCGCC

1151 GCGAAGGTGA GAAAACCGCA TTCATTGCCT TCGGCAGTAT GGTCGCCCCC

1201 GCATTGGCGG TTGCCGAAAA ACTGAACGCC ACCGTCGCCG ATATGCGCTT

1251 CGTCAAACCG ATAGACGAAG AGTTGATTGT CCGCCTTGCC CGAAGCCACG

1301 ACCGCATCGT TACCCTTGAA GAAAACGCCG AACAGGGCGG CGCAGGCGGC

1351 GCGGTGCTGG AAGTATTGGC GAAACACGGC ATCTGCAAAC CCGTTTTGCT

1401 TTTGGGCGTT GCCGATACCG TAACCGGACA CGGCGATCCG AAAAAACTTT
```

```
1451 TAGACGATTT GGGCTTGAGT GCCGAAGCGG TGGAACGGCG TGTGCGCGCG

1501 TGGCTGTCGG ATCGGATGC GGCAAATTAA
```

This corresponds to the amino acid sequence <SEQ ID 118; ORF 033>:

```
m033.pep
   1 MAAADKLLGS DRRSVAIIGD GAMTAGQAFE ALNCAXDMDV DLLVVLNDNE

51 MSISPNVGAL PKYLASNVVR DMHGLLSTVK AQTGKVLDKI PGAMEFAQKV

101 EHKIKTLAEE AEHAKQSLSL FENFGFRYTG PVDGHNVENL VDVLKDLRSR

151 KGPQLLHVIT KKGNGYKLAE NDPVKYHAVA NLPKESAAQM PSEKEPKPAA

201 KPTYTQVFGK WLCDRAAADS RLVAITPAMR EGSGLVEFEQ RFPDRYFDVG

251 IAEQHAVTFA GGLACEGMKP VVAIYSTFLQ RAYDQLVHDI ALQNLPVLFA

301 VDRAGIVGAD GPTHAGLYDL SFLRCVPNMI VAAPSDENEC RLLLSTCYQA

351 DAPAAVRYPR GTGTGAPVSD GMETVEIGKG IIRREGEKTA FIAFGSMVAP

401 ALAVAEKLNA TVADMRFVKP IDEELIVRLA RSHDRIVTLE ENAEQGGAGG

451 AVLEVLAKHG ICKPVLLLGV ADTVTGHGDP KKLLDDLGLS AEAVERRVRA

501 WLSDRDAAN*
```

The following partial DNA sequence was identified in *N. meningitidis* <SEQ ID 119>:

```
a033.seq
     1 ATGGCGGCGG CGGACAAACA GTTGGGCAGC GACCGCCGCA GCGTCGCCAT

51 CATCGGCGAC GGCGCGATGA CGGCGGGTCA GGCGTTTGAA GCCTTGAACT

101 GCGCGGGCGA TATGGATGTG GATTTGCTGG TCGTCCTCAA CGACAACGAA

151 ATGTCGATTT CCCCCAACGT CGGTGCGTTG CCCAAATACC TTGCCAGCAA

201 CGTCGTGCGC GATATGCACG GACTGTTGAG TACCGTCAAA GCGCAAACGG

251 GCAAGGTATT AGACAAAATA CCCGGCGCGA TGGAGTTTGC CCAAAAAGTC

301 GAACATAAAA TCAAAACCCT TGCCGAAGAA GCCGAACACG CCAAACAGTC

351 ACTGTCTTTG TTTGAAAACT TCGGCTTCCG CTATACCGGC CCCGTGGACG

401 GACACAACGT CGAAAATCTG GTCGATGTAT TGGAAGACCT GCGCGGACGC

451 AAAGGCCCGC AGCTTCTGCA CGTCATCACC AAAAAGGGCA ACGGCTACAA

501 ACTCGCCGAA AACGATCCCG TCAAATACCA CGCCGTCGCC AACCTGCCTA

551 AAGAAAGCGC GGCGCAAATG CCGTCTGAAA AGAACCCAA GCCCGCCGCC

601 AAACCGACCT ATACCCAAGT GTTCGGCAAA TGGCTGTGCG ACCGGGCGGC

651 GGCAGATTCC CGACTGGTTG CGATTACCCC CGCCATGCGC GAGGGCAGCG

701 GCTTGGTTGA GTTTGAACAA CGATTCCCCG ACCGCTATTT CGATGTCGGC

751 ATCGCCGAGC AGCACGCCGT TACCTTTGCC GGCGGTTTGG CTTGCGAAGG

801 GATGAAGCCC GTCGTGGCGA TTTATTCCAC CTTTTTACAA CGCGCCTACG

851 ACCAACTGGT GCACGACATC GCCCTGCAAA ACCTGCCCGT TTTGTTTGCC

901 GTCGACCGCG CGGGCATCGT CGGCGCGGAC GGCCCGACCC ATGCCGGTTT

951 GTACGATTTA AGCTTTTTGC GCTGCATTCC GAATATGATT GTCGCCGCGC

1001 CGAGCGATGA AAATGAATGC CGCCTGCTGC TTTCGACCTG CTATCAGGCA
```

```
1051 GACGCGCCCG CCGCCGTCCG CTATCCGCGC GGCACGGGTA CGGGCGTGCC

1101 GGTTTCAGAC GGCATGGAAA CCGTGGAAAT CGGCAAGGGC ATTATCCGCC

1151 GCGAAGGTGA GAAAACCGCA TTCATTGCCT TCGGCAGTAT GGTCGCCCCT

1201 GCATTGGCGG TCGCCGGAAA ACTGAACGCC ACCGTCGCCG ATATGCGCTT

1251 CGTCAAACCG ATAGACGAAG AGTTGATTGT CCGCCTTGCC CGAAGCCACG

1301 ACCGCATCGT TACCCTTGAA GAAAACGCCG AACAGGGCGG CGCAGGCAGC

1351 GCGGTGCTGG AAGTGTTGGC GAAACACGGC ATCTGCAAAC CCGTCTTGCT

1401 TTTGGGCGTT GCCGATACCG TAACCGGACA CGGCGATCCG AAAAAACTTT

1451 TAGACGATTT GGGCTTGAGT GCCGAAGCGG TGGAACGGCG TGTGCGCGCG

1501 TGGCTGTCGG ATCGGGATGC GGCAAATTAA
```

This corresponds to the amino acid sequence <SEQ ID 120; ORF 033.a>:

```
a033.pep
  1 MAAADKQLGS DRRSVAIIGD GAMTAGQAFE ALNCAGDMDV DLLVVLNDNE

51 MSISPNVGAL PKYLASNVVR DMHGLLSTVK AQTGKVLDKI PGAMEFAQKV

101 EHKIKTLAEE AEHAKQSLSL FENFGFRYTG PVDGHNVENL VDVLEDLRGR

151 KGPQLLHVIT KKGNGYKLAE NDPVKYHAVA NLPKESAAQM PSEKEPKPAA

201 KPTYTQVFGK WLCDRAAADS RLVAITPAMR EGSGLVEFEQ RFPDRYFDVG

251 IAEQHAVTFA GGLACEGMKP VVAIYSTFLQ RAYDQLVHDI ALQNLPVLFA

301 VDRAGIVGAD GPTHAGLYDL SFLRCIPNMI VAAPSDENEC RLLLSTCYQA

351 DAPAAVRYPR GTGTGVPVSD GMETVEIGKG IIRREGEKTA FIAFGSMVAP

401 ALAVAGKLNA TVADMRFVKP IDEELIVRLA RSHDRIVTLE ENAEQGGAGS

451 AVLEVLAKHG ICKPVLLLGV ADTVTGHGDP KKLLDDLGLS AEAVERRVRA

501 WLSDRDAAN*
``` m033/a033 98.4% identity over a 509 aa overlap

```
                 10         20         30         40         50         60
m033.pep MAAADKLLGSDRRSVAIIGDGAMTAGQAFEALNCAXDMDVDLLVVLNDNEMSISPNVGAL
         ||||||  ||||||||||||||||||||||||||| ||||||||||||||||||||||||
a033     MAAADKQLGSDRRSVAIIGDGAMTAGQAFEALNCAGDMDVDLLVVLNDNEMSISPNVGAL
                 10         20         30         40         50         60

70         80         90        100        110        120
m033.pep PKYLASNVVRDMHGLLSTVKAQTGKVLDKIPGAMEFAQKVEHKIKTLAEEAEHAKQSLSL
         ||||||||||||||||||||||||||||||||||||||||||||||||||||||||||||
a033     PKYLASNVVRDMHGLLSTVKAQTGKVLDKIPGAMEFAQKVEHKIKTLAEEAEHAKQSLSL
                 70         80         90        100        110        120

130        140        150        160        170        180
m033.pep FENFGFRYTGPVDGHNVENLVDVLKDLRSRKGPQLLHVITKKGNGYKLAENDPVKYHAVA
         ||||||||||||||||||||||||:|||:|||||||||||||||||||||||||||||||
a033     FENFGFRYTGPVDGHNVENLVDVLEDLRGRKGPQLLHVITKKGNGYKLAENDPVKYHAVA
                130        140        150        160        170        180

190        200        210        220        230        240
m033.pep NLPKESAAQMPSEKEPKPAAKPTYTQVFGKWLCDRAAADSRLVAITPAMREGSGLVEFEQ
         ||||||||||||||||||||||||||||||||||||||||||||||||||||||||||||
a033     NLPKESAAQMPSEKEPKPAAKPTYTQVFGKWLCDRAAADSRLVAITPAMREGSGLVEFEQ
                190        200        210        220        230        240

250        260        270        280        290        300
m033.pep RFPDRYFDVGIAEQHAVTFAGGLACEGMKPVVAIYSTFLQRAYDQLVHDIALQNLPVLFA
         ||||||||||||||||||||||||||||||||||||||||||||||||||||||||||||
a033     RFPDRYFDVGIAEQHAVTFAGGLACEGMKPVVAIYSTFLQRAYDQLVHDIALQNLPVLFA
                250        260        270        280        290        300
```

```
                       310        320        330        340        350        360
m033.pep  VDRAGIVGADGPTHAGLYDLSFLRCVPNMIVAAPSDENECRLLLSTCYQADAPAAVRYPR
          ||||||||||||||||||||||||:|||||||||||||||||||||||||||||||||||
a033      VDRAGIVGADGPTHAGLYDLSFLRCIPNMIVAAPSDENECRLLLSTCYQADAPAAVRYPR
                       310        320        330        340        350        360

370        380        390        400        410        420
m033.pep  GTGTGAPVSDGMETVEIGKGIIRREGEKTAFIAFGSMVAPALAVAEKLNATVADMRFVKP
          |||||:||||||||||||||||||||||||||||||||||||||||| |||||||||||
a033      GTGTGVPVSDGMETVEIGKGIIRREGEKTAFIAFGSMVAPALAVAGKLNATVADMRFVKP
                       370        380        390        400        410        420

430        440        450        460        470        480
m033.pep  IDEELIVRLARSHDRIVTLEENAEQGGAGGAVLEVLAKHGICKPVLLLGVADTVTGHGDP
          ||||||||||||||||||||||||||||||:|||||||||||||||||||||||||||||
a033      IDEELIVRLARSHDRIVTLEENAEQGGAGSAVLEVLAKHGICKPVLLLGVADTVTGHGDP
                       430        440        450        460        470        480

490        500        510
m033.pep  KKLLDDLGLSAEAVERRVRAWLSDRDAANX
          |||||||||||||||||||||||||||||
a033      KKLLDDLGLSAEAVERRVRAWLSDRDAANX
                       490        500        510
```

Computer analysis of this amino acid sequence gave the following results:

Homology with a Predicted ORF from *N. gonorrhoeae*

ORF 033 shows 98.4% identity over a 509 aa overlap with a predicted ORF (ORF 033.ng) from *N. gonorrhoeae*:

```
m033/g033 m033.pep  MAAADKLLGSDRRSVAIIGDGAMTAGQAFEALNCAXDMDVDLLVVLNDNEMSISPNVGAL  60
          ||||||||:||||||||||||||||||||||||||| ||||||||||||||||||||||
g033      MAAADKLLGGDRRSVAIIGDGAMTAGQAFEALNCAGDMDVDLLVVLNDNEMSISPNVGAL  60 m033.pep  PKYLASNVVRDMHGLLSTVKAQTGKVLDKIPGAMEFAQKVEHKIKTLAEEAEHAKQSLSL  120
          ||||||||||||||||||||||||||||||||||||||||||||||||||||||||||||
g033      PKYLASNVVRDMHGLLSTVKAQTGKVLDKIPGAMEFAQKVEHKIKTLAEEAEHAKQSLSL  120 m033.pep  FENFGFRYTGPVDGHNVENLVDVLKDLRSRKGPQLLHVITKKGNGYKLAENDPVKYHAVA  180
          ||||||||||||||||||||||||||||||||||||||||||||||||||||||||||||
g033      FENFGFRYTGPVDGHNVENLVDVLKDLRSRKGPQLLHVITKKGNGYKLAENDPVKYHAVA  180 m033.pep  NLPKESAAQMPSEKEPKPAAKPTYTQVFGKWLCDRAAADSRLVAITPAMREGSGLVEFEQ  240
          |||||::|||||||||||||||||||||||||||||||||||||||||||||||||||||
g033      NLPKEGGAQMPSEKEPKPAAKPTYTQVFGKWLCDRAAADSRLVAITPAMREGSGLVEFEQ  240 m033.pep  RFPDRYFDVGIAEQHAVTFAGGLACEGMKPVVAIYSTFLQRAYDQLVHDIALQNLPVLFA  300
          ||||||||||||||||||||||||||||||||||||||||||||||||||||||||||||
g033      RFPDRYFDVGIAEQHAVTFAGGLACEGMKPVVAIYSTFLQRAYDQLVHDIALQNLPVLFA  300 m033.pep  VDRAGIVGADGPTHAGLYDLSFLRCVPNMIVAAPSDENECRLLLSTCYQADAPAAVRYPR  360
          ||||||||||||||||||||||||||||||||||||||||||||||||||||||||||||
g033      VDRAGIVGADGPTHAGLYDLSFLRCVPNMIVAAPSDENECRLLLSTCYQADAPAAVRYPR  360 m033.pep  GTGTGAPVSDGMETVEIGKGIIRREGEKTAFIAFGSMVAPALAVAEKLNATVADMRFVKP  420
          ||||||||||||||||||||||||||||||||||||||| ||||||||||||||||||||
g033      GTGTGAPVSDGMETVEIGKGIIRREGEKTAFIAFGSMVATALAVAEKLNATVADMRFVKP  420 m033.pep  IDEELIVRLARSHDRIVTLEENAEQGGAGGAVLEVLAKHGICKPVLLLGVADTVTGHGDP  480
          ||||||||||||||||||||||||||||||||||||||||||||||||||||||||| ||
g033      IDEELIVRLARSHDRIVTLEENAEQGGAGGAVLEVLAKHGICKPVLLLGVADTVTEHGDP  480 m033.pep  KKLLDDLGLSAEAVERRVRAWLSDRDAANX                                510
          |||||||||||||||||||| || ||||||
g033      KKLLDDLGLSAEAVERRVREWLPDRDAANX                                510
```

The following partial DNA sequence was identified in *N. gonorrhoeae* <SEQ ID 121>:

```
g034.seq
   1  ATGAGCCGTT  TATGGTTTTT  TGCCGTAAAA  AACATTATAA  TCCGCCTTAT

51  TTACCTATTG  CCCAAGGAGA  CACAAATGGC  ACTCGTATCC  ATGCGCCAAC

101  TGCTTGACCA  CGCCGCCGAA  AACAGCTACG  GCCTGCCCGC  GTTCAACGTC

151  AACAACCTCG  AACAAATGCG  CGCCATTATG  GAAGCCGCCG  ACCAAGTCAA

201  CGCGCCCGTC  ATCGTACAGG  CGAGCGCAGG  TGCGCGCAAA  TACGcggGCG
```

-continued
```
 251 CGCCGTTTTT GCGCCACCTG ATTCTGGCGG CAGTCGAAGA ATTTCCGCAC

301 ATCCCCGTCG TGATGCACCA AGACCACGGC GCATCGCCCG ACGTgtgCCA

351 ACGCTCCATC CAACTGGGCT TCTCCTCCGT GATGATGGAC GGCTCTTTGC

401 TCGAAGACGG CAAAACCCCT TCTTCTTACG AATACAACGT CAACGCCACC

451 CGTACCGTCG TCAACTTCTC CCACGCCTGC GGCGTGTCCG TCGAAGGCGA

501 AATCGGCGTA TTGGGCAACC TCGAAACCGG CGAAGCAGGC GAAGAAGACG

551 GAGTGGGCGC GGCAGGCAAA CTCTCACACG ACCAAATGCT CACCAGCGTT

601 GAAGATGCCG TGCGTTTCGT TAAAGATACC GGCGTTGACG CATTGGCGAT

651 TGCCGTCGGC ACCAGCCACG GCGCATACAA ATTCACCCGT CCGCCCACAG

701 GCGACGTATT GCGTATCGAC CGCATCAAGG AAATCCACCA AGCCCTGCCC

751 AATACACACA TCGTGATGCA CGgctCCAGC TCCGTTCCGC AAGAatgGCT

801 GAAAGTCATC AACGAATACG GCGGCAATAT CGGCGAAACC TACGGCGTGC

851 CGGTTGAAGA AATCGTCGAA GGCATCAAAC ACGGCGTGCG CAAAGTCAAC

901 ATCGATACCG ACCTGCGCCT CGCTTCCACC GGCGCGGGTAC GCCGCTACCT

951 TGCCGAAAAC CCGTCCGACT TTGATCCGCG CAAATACTTG GGCAAAACCA

1001 TTGAAGCGAT GAAGCAAATC TGCCTCGACC GTTATCTTGC GTTCGGTTGC

1051 GAAGGTCAGG CAGGCAAAAT CAAACCTGTT TCGTTGGAAA AAATGGCAAG

1101 CCCTTATCCC AAGGGCGAAT TGAACCAAAT CGTCAAATAA
```

This corresponds to the amino acid sequence <SEQ ID 122; ORF 034.ng>:

```
g034.pep
  1 MSRLWFFAVK NIIIRLIYLL PKETOMALVS MRQLLDHAAE NSYGLPAFNV

51 NNLEQMRAIM EAADQVNAPV IVQASAGARK YAGAPFLRHL ILAAVEEFPH

101 IPVVMHQDHG ASPDVCQRSI QLGFSSVMMD GSLLEDGKTP SSYEYNVNAT

151 RTVVNFSHAC GVSVEGEIGV LGNLETGEAG EEDGVGAAGK LSHDQMLTSV

201 EDAVRFVKDT GVDALAIAVG TSHGAYKFTR PPTGDVLRID RIKEIHQALP

251 NTHIVMHGSS SVPQEWLKVI NEYGGNIGET YGVPVEEIVE GIKHGVRKVN

301 IDTDLRLAST GAVRRYLAEN PSDFDPRKYL GKTIEAMKQI CLDRYLAFGC

351 EGQAGKIKPV SLEKMASRYA KGELNQIVK*
```

The following partial DNA sequence was identified in *N. meningitidis* <SEQ ID 123>:

```
m034.seq (partial)
  1 ATGAGCTGTT TATGGTTTTT TGCTGTAAAA AACATTATAA TCCGCCTTAT

51 TTACCTATTG CCCAAGGAGA CACAAATGGC ACTCGTATCC ATGCGCCAAC

101 TGCTTGATCA TGCTGCCGAA wACAGCTACG GCyTGCCGGC GTTCAACGTC

151 AACAACCTCG wACAGATGCG CGCCATCATG GAGGCTGCAG ACCAAGTCGA

201 CGCCCCCGTC ATCGTACAGG CGAGTGCCGG TGCGCGCAAA TATGCGGGTG

251 CGCCGTTTTT ACGCCACCTG ATTTTGGCGG CTGTCGAAGT ATTTCCACAC

301 ATCCCCGTCG TCATGCACCA AGACCACGGC GCATCACCCG ACGTGTGCCA

351 ACGCTCCATC CAACTGGGCT TCTCCTCTGT AATGATGGAC GGCTCGCTGA
```

```
401 TGGAAGACGG CAAAACCCCT TCTTCTTACG AATACAACGT CAACGCCACA

451 CGTACCGTGG TTAACTTCTC CCACGCTTGC GGCGTATCCG TTGAAGGCGA

501 AATCGGCGTA TTGGGCAACC TCGAAACCGG CGATGCAGGC GAAGAAGACG

551 GTGTAGGCGC AGTGGGCAAA CTTTCCCACG ACCAAATGCT GACCAGCGTC

601 GAAGATGCCG TATGTTTCGT TAAAGATACC GGCGTTGACG CATTGGCTAT

651 TGCCGTCGGC ACCAGCCACG GCGCATACAA ATTCACCCGT CCGCCCACAG

701 GCGATGTATT ACGTATCGAC CGCATCAAAG AAATCCACCA AGCCCTGCCC

751 AATACACACA TCGTGATGCA C . . .
```

This corresponds to the amino acid sequence <SEQ ID 124; ORF 034>:

```
m034.pep (partial)
  1 MSCLWFFAVK NIIIRLIYLL PKETQMALVS MRQLLDHAAE XSYGLPAFNV

51 NNLXQMRAIM EAADQVDAPV IVQASAGARK YAGAPFLRHL ILAAVEVFPH

101 IPVVMHQDHG ASPDVCQRSI QLGFSSVMMD GSLMEDGKTP SSYEYNVNAT

151 RTVVNFSHAC GVSVEGEIGV LGNLETGDAG EEDGVGAVGK LSHDQMLTSV

201 EDAVCFVKDT GVDALAIAVG TSHGAYKFTR PPTGDVLRID RIKEIHQALP

251 NTHIVMH . . .
```

The following partial DNA sequence was identified in *N. meningitidis* <SEQ ID 125>:

```
a034.seq
    1 ATGAGCCGTT TATGGTTTTT TGCCGCAAAA AACATTATAA TCCGCCTTAT

51 TTACCTATTG CCCAAGGAGA CACAAATGGC ACTCGTATCC ATGCGCCAAC

101 TGCTTGATCA TGCTGCCGAA AACAGCTACG GCCTGCCCGC GTTCAACGTC

151 AACAACCTCG AACAAATGCG CGCCATTATG GAAGCCGCCG ACCAAGTCAA

201 CGCGCCCGTC ATCGTACAGG CGAGCGCAGG TGCGCGCAAA TACGCGGGCG

251 CGCCGTTTTT GCGCCACCTG ATTTTGGCGG CTGTCGAAGA ATTTCCGCAC

301 ATCCCCGTCG TGATGCACCA AGACCACGGC GCATCGCCCG ACGTGTGCCA

351 ACGCTCCATC CAACTGGGCT TTTCCTCCGT GATGATGGAC GGCTCGCTGA

401 TGGAAGACGG CAAAACCCCT CTTCTTATG AATACAACGT CAACGCCACC

451 CGTACCGTGG TTAATTTCTC CCACGCCTGC GGCGTATCCG TTGAAGGCGA

501 AATCGGCGTA TTGGGCAACC TCGAAACTGG CGAAGCCGGC GAAGAAGACG

551 GTGTAGGCGC AGTGGGCAAA CTTTCCCACG ACCAAATGCT CACCAGCGTC

601 GAAGATGCCG TGCGTTTCGT TAAAGATACC GGCGTTGACG CATTGGCGAT

651 TGCCGTCGGC ACCAGCCACG GCGCGTACAA ATTCACCCGT CCGCCCACAG

701 GCGACGTGTT GCGTATCGAC CGCATCAAAG AAATCCACCA AGCCCTGCCC

751 AATACACACA TCGTGATGCA CGGCTCCAGC TCCGTTCCGC AAGAATGGCT

801 GAAAGTCATC AACGAATACG GCGGCAATAT CGGCGAAACC TACGGCGTGC

851 CGGTTGAAGA AATCGTCGAA GGCATCAAAC ACGGCGTGCG TAAAGTCAAC

901 ATCGATACCG ACTTGCGCCT TGCTTCCACC GGCGCGGTAC GCCGCTACCT

951 TGCCGAAAAC CCGTCCGACT TCGATCCGCG CAAATATTTG AGCAAAACCA
```

```
-continued
1001  TTGAAGCGAT GAAGCAAATC TGCCTCGACC GCTACCTCGC GTTCGGTTGC

1051  GAAGGTCAGG CAGGCAAAAT CAAACCGGTT TCCTTGGAAA AATGGCAAA

1101  CCGTTATGCC AAGGGCGAAT TGAACCAAAT CGTCAAATAA
```

This corresponds to the amino acid sequence <SEQ ID 126; ORF 034.a>:

```
a034.pep
    1 MSRLWFFAAK NIIIRLIYLL PKETQMALVS MRQLLDHAAE NSYGLPAFNV

51 NNLEQMRAIM EAADQVNAPV IVQASAGARK YAGAPFLRHL ILAAVEEFPH

101 IPVVMHQDHG ASPDVCQRSI QLGFSSVMMD GSLMEDGKTP SSYEYNVNAT

151 RTVVNFSHAC GVSVEGEIGV LGNLETGEAG EEDGVGAVGK LSHDQMLTSV

201 EDAVRFVKDT GVDALAIAVG TSHGAYKFTR PPTGDVLRID RIKEIHQALP

251 NTHIVMHGSS SVPQEWLKVI NEYGGNIGET YGVPVEEIVE GIKHGVRKVN

301 IDTDLRLAST GAVRRYLAEN PSDFDPRKYL SKTIEAMKQI CLDRYLAFGC

351 EGQAGKIKPV SLEKMANRYA KGELNQIVK*
``` m034/a034 96.9% identity over a 257 aa overlap

```
                  10         20         30         40         50         60
       m034.pep   MSCLWFFAVKNIIIRLIYLLPKETQMALVSMRQLLDHAAEXSYGLPAFNVNNLXQMRAIM
                  || |||||:||||||||||||||||||||||||||||||| |||||||||||| ||||||
           a034   MSRLWFFAAKNIIIRLIYLLPKETQMALVSMRQLLDHAAENSYGLPAFNVNNLEQMRAIM
                          10         20         30         40         50         60

70         80         90        100        110        120
       m034.pep   EAADQVDAPVIVQASAGARKYAGAPFLRHLILAAVEVFPHIPVVMHQDHGASPDVCQRSI
                  ||||||:|||||||||||||||||||||||||||||||| ||||||||||||||||||||
           a034   EAADQVNAPVIVQASAGARKYAGAPFLRHLILAAVEEFPHIPVVMHQDHGASPDVCQRSI
                          70         80         90        100        110        120

130        140        150        160        170        180
       m034.pep   QLGFSSVMMDGSLMEDGKTPSSYEYNVNATRTVVNFSHACGVSVEGEIGVLGNLETGDAG
                  ||||||||||||||||||||||||||||||||||||||||||||||||||||||||||:||
           a034   QLGFSSVMMDGSLMEDGKTPSSYEYNVNATRTVVNFSHACGVSVEGEIGVLGNLETGEAG
                         130        140        150        160        170        180

190        200        210        220        230        240
       m034.pep   EEDGVGAVGKLSHDQMLTSVEDAVCFKKDTGVDALAIAVGTSHGAYKFTRPPTGDVLRID
                  ||||||||||||||||||||||||  |||||||||||||||||||||||||||||||||
           a034   EEDGVGAVGKLSHDQMLTSVEDAVRFVKDTGVDALAIAVGTSHGAYKFTRPPTGDVLRID
                         190        200        210        220        230        240

250
       m034.pep   RIKEIHQALPNTHIVMH
                  |||||||||||||||||
           a034   RIKEIHQALPNTHIVMHGSSSVPQEWLKVINEYGGNIGETYGVPVEEIVEGIKHGVRKVN
                         250        260        270        280        290        300
```

Computer analysis of this amino acid sequence gave the following results:

Homology with a Predicted ORF from *N. gonorrhoeae*

ORF 034 shows 96.5% identity over a 257 aa overlap with a predicted ORF (ORF 034.ng) from *N. gonorrhoeae*:

```
       m034/g034 m034.pep   MSCLWFFAVKNIIIRLIYLLPKETQMALVSMRQLLDHAAEXSYGLPAFNVNNLXQMRAIM   60
                  || |||||||||||||||||||||||||||||||||||| |||||||||||| ||||||
           g034   MSRLWFFAVKNIIIRLIYLLPKETQMALVSMRQLLDHAAENSYGLPAFNVNNLEQMRAIM   60
```

```
    m034.pep   EAADQVDAPVIVQASAGARKYAGAPFLRHLILAAVEVFPHIPVVMHQDHGASPDVCQRSI  120
               ||||||:||||||||||||||||||||||||||||||| |||||||||||||||||||
    g034       EAADQVNAPVIVQASAGARKYAGAPFLRHLILAAVEEFPHIPVVMHQDHGASPDVCQRSI  120
    m034.pep   QLGFSSVMMDGSLMEDGKTPSSYEYNVNATRTVVNFSHACGVSVEGEIGVLGNLETGDAG  180
               ||||||||||||:|||||||||||||||||||||||||||||||||||||||||||||:||
    g034       QLGFSSVMMDGSLLEDGKTPSSYEYNVNATRTVVNFSHACGVSVEGEIGVLGNLETGEAG  180
    m034.pep   EEDGVGAVGKLSHDQMLTSVEDAVCFVKDTGVDALAIAVGTSHGAYKFTRPPTGDVLRID  240
               |||||||:|||||||||||||||||| |||||||||||||||||||||||||||||||
    g034       EEDGVGAAGKLSHDQMLTSVEDAVRFVKDTGVDALAIAVGTSHGAYKFTRPPTGDVLRID  240
    m034.pep   RIKEIHQALPNTHIVMH                                             257
               |||||||||||||||||
    g034       RIKEIHQALPNTHIVMHGSSSVPQEWLKVINEYGGNIGETYGVPVEEIVEGIKHGVRKVN  300
```

The following partial DNA sequence was identified in *N. gonorrhoeae* <SEQ ID 127>:

```
g036.seq
   1 ATGCTGAAGC CGTGTTTGGT ATACAGTGCC TGTGCGGCGG cgttgcCTGC

51 GCGGACTTCG AGCAGCAGGC GTTGCGTGCC TTCGGGCAGA TGTGCGTACC

101 AATATTCGAG CAGGGCGGAC GCAACGCCCC GTCGGCGGCA TTCGGGCGCG

151 GTGGCAATCA GGTGCAGTTC GGATTCGTCG GCAGGTTCT GCCAAACGAT

201 AAAGGCGGCA ATCCTGCCGT CTTTTTCCGC AAGGAAAACC TGTTCGGACG

251 GCGAAACAAG CGCGGACTCA AATTGGCGTT GCGTCCACGC GGACGGGTTG

301 CAGACGGTAT CGAGCGCGGC CAGTGCGGCG CAGTCGGACG GTGAGGCTGG

351 GCGGATGTTC ATGTTCGTGC CTTCCGTTCC GCCTGTTCTT TGGCAGTCAG

401 GGCGATTTTG TTGCGGACGT AGAGCAGTTC GGCGTGTGCC GCGCCAGTTG

451 CGGGATAGCC GCCGCCGAGG GCGAGCGCGA GAAAATCGGC GGCGGTCGGC

501 ATATCGGGTT TGCCTGAGAA GGGCGGACGG TTTTCCAGTG CGAACGCACT

551 GCCGATGCCG TCTGAAAAGA CGTACCCCTC GGGGAGGGCA ATGTCTGCCG

601 CCCTACCGAC TTGATAATCG CTCAAACGGC GGCGGTTCAG CGTGTCGAAC

651 CACGCATAAA ACACTTCGCC CATACGCGCG TCCGCAGCGG CGAGTATGCA

701 GCTTTGCGGC GGCGGCAGCG AGGCGGCGGC ATCGAGCGTG GGGATGCCGA

751 TTAAAGGCGT GTCGAACGGC GTTGCCAAAC CTTGCGCCAC GCCGATGCCG

801 ATACGCAGTC CGGTAA
```

This corresponds to the amino acid sequence <SEQ ID 128; ORF 036.ng>:

```
g036.pep
   1 MLKPCLVYSA CAAALPARTS SSRRCVPSGR CAYQYSSRAD ATPRRHSGA

51 VAIRCSSDSS GRFCQTIKAA ILPSFSARKT CSDGETSADS NWRCVHADGL

101 QTVSSAASAA QSDGEAGRMF MFVPSVPPVL WQSGRFCCGR RAVRRVPRQL

151 RDSRRRGRAR ENRRRSAYRV CLRRADGFPV RTHCRCRLKR RTPRGGQCLP

201 PYRLDNRSNG GGSACRTTHK TLRPYARPQR RVCSFAAAAA RRRHRAWGCR

251 LKACRTALPN LAPRRCRYAV R*
```

The following partial DNA sequence was identified in *N. meningitidis* <SEQ ID 129>:

```
m036.seq
   1 ATGCTGAAGC CGTGCGCCGT GTACAGTGCC TGTGCGGCGG TGTTGCCTGC

51 ACGGACTTCG AGCAGCAGGC GTTGCGTGTC TTCGGGCAGA TGTGTGAACC

101 AATATTCGAG CAGGGCGGAC GCAATTCCTT GGCGGCGGCA TTCGGGCGCG

151 GTGGCAATCA GGTGCAGTTC GGATTCGTCG GGCAGGTTCT GCCAAACGAT

201 AAAGGCGGCA ATCCCg.CGT CTTTTTCCGC AAGGAAAACC TGTTCGGACG

251 GCGAAACCAG TGCGGACTCA AATTGGCGTT GCGTCCATGC GGACGGGTTG

301 CAGACGGCAT CGAGTGCGGC CAGCTCCTCA CAATCGGCAC AAACGGCACG

351 GCGGATGTTC ACGGGCGCGC TCTCCGTTCG GCCTGTTCTT TGGCAGTCAG

401 GGCGATTTTG TTGCGGACGT AGAGCAAACC GGCGTGTGCG GCATGGACGG

451 CAGGATAACC GCCCTTGGCT GCCAATGCGA GAAAGTCGGC GGCAGTCGGC

501 ATATCCGGTC TGCCTGAGAA CGGCGGAGCT TCTTCCAGCG CGAACGCGCT

551 GCCTATGCCG TCTGAAAAGG CGCATCCCTC CGGCAGCCGG ATGTCTGCCG

601 CCCGCCCGAC CTGATAATCG CTCAAACGGT GGCAGTTCAG CGTATCGAAC

651 CATGCATAAA ACACTTCGCC CATACGAGCG TCCGTAGCGG CAAGGATGCA

701 GCTTTGCGGC GGCGGCAGCG AGGCGGCGGC ATCGAGCGAG GGTACGCCGA

751 TTAAGGGGGT ATCAAACGGC GTTGCCAAAC CCTGAGCTAC ACCGATGCCG

801 ATACGCAGTC CGGTAA
```

This corresponds to the amino acid sequence <SEQ ID 130; ORF 036>:

```
m036.pep
   1 MLKPCAVYSA CAAVLPARTS SSRRCVSSGR CVNQYSSRAD AIPWRRHSGA

51 VAIRCSSDSS GRFCQTIKAA IPXSFSARKT CSDGETSADS NWRCVHADGL

101 QTASSAASSS QSAQTARRMF TGALSVRPVL WQSGRFCCGR RANRRVRHGR

151 QDNRPWLPMR ESRRQSAYPV CLRTAELLPA RTRCLCRLKR RIPPAAGCLP

201 PARPDNRSNG GSSAYRTMHK TLRPYERP*R QGCSFAAAAA RRRHRARVRR

251 LRGYQTALPN PELHRCRYAV R*
```

The following partial DNA sequence was identified in *N. meningitidis* <SEQ ID 131>:

```
a036.seq
   1 ATGCTGAAGC CGTGCGCCGT GTACAGTGCC TGTGCGGCGG TGTTGCCTGC

51 ACGGACTTCG AGCAGCAGGC GTTGCGTGTC TTCGGGCAGA TGTGTGAACC

101 AATATTCGAG CAGGGCGGAC GCAATTCCTT GGCGGCGGCA TTCGGGCGCG

151 GTGGCAATCA GGTGCAGTTC GGATTCGTCG GGCAGGTTCT GCCAAACGAT

201 AAAGGCGGCA ATCCCGCCGT CTTTTTCCGC AAGGAAAACC TGTTCGGACG

251 GCGAAACCAG TGCGGACTCA AATTGGCGTT GCGTCCACGC GGACGGGTTG

301 CAGACGGCAT CGAGCGCGGC GAGTGCGGCG CAATCGGCAT AAACGGCGCG

351 GCGGATGTTC ACAGGCGCGC CCTCCGTTCC GCCTGTTCTT TGGCAGTCAA

401 GGCGATTTTG TTGCGGACGT AGAGCAGCTC GGCGTGTGCC GCAGCGACGG
```

-continued

```
451 CGGGAAAACC GCCTTCAGCC GCCAGATTGA GGAAGTCGGC GGCGGTCGGC

501 ATATCGGGTT TGCCTGAGAA GGGCGGACGG TTTTCCAGCG CGAACGCATT

551 GCCGATGCCG TCTGAAAAGG CGCATCCTTC CGGCAGCCGG ATGTCTGCCG

601 CCCGACCGAC CTGATAATCG CTCAAACGGC GGCGGTTCAG CGTGTCGAAC

651 CATGCATAAA ACACTTCGCC CATACGTGCG TCCGCAGCGG CAAGGATGCA

701 GCTTTGCGGC GGCGGCAGCG AGGCGGCGGC ATCGAGCGAG GGTACGCCGA

751 TTAAAGGAGT ATCAAACGGC GTTGCCAAAC CTTGCGCCAC GCCGATGCCG

801 ATACGCAGTC CGTAA
```

This corresponds to the amino acid sequence <SEQ ID 132; ORF 036.a>:

```
a036.pep
  1 MLKPCAVYSA CAAVLPARTS SSRRCVSSGR CVNQYSSRAD AIPWRRHSGA

51 VAIRCSSDSS GRFCQTIKAA IPPSFSARKT CSDGETSADS NWRCVHADGL

101 QTASSAASAA QSA*TARRMF TGAPSVPPVL WQSRRFCCGR RAARRVPQRR

151 RENRLQPPD* GSRRRSAYRV CLRRADGFPA RTHCRCRLKR RILPAAGCLP

201 PDRPDNRSNG GGSACRTMHK TLRPYVRPQR QGCSFAAAAA RRRHRARVRR

251 LKEYQTALPN LAPRRCRYAV P*
``` m036/a036 85.6% identity over a 270 aa overlap

```
                  10         20         30         40         50         60
      m036.pep    MLKPCAVYSACAAVLPARTSSSRRCVSSGRCVNQYSSRADAIPWRRHSGAVAIRCSSDSS
                  ||||||||||||||||||||||||||||||||||||||||||||||||||||||||||||
      a036        MLKPCAVYSACAAVLPARTSSSRRCVSSGRCVNQYSSRADAIPWRRHSGAVAIRCSSDSS
                  10         20         30         40         50         60

70         80         90        100        110        120
      m036.pep    GRFCQTIKAAIPXSFSARKTCSDGETSADSNWRCVHADGLQTASSAASSSQSAQTARRMF
                  ||||||||||| |||||||||||||||||||||||||||||||||||::|||  ||||||
      a036        GRFCQTIKAAIPPSFSARKTCSDGETSADSNWRCVHADGLQTASSAASAAQSAXTARRMF
                  70         80         90        100        110        120

130        140        150        160        170        180
      m036.pep    TGALSVRPVLWQSGRFCCGRRANRRVRHGRQDNRPWLPMRESRRQSAYPVCLRTAELLPA
                  ||| || |||||| |||||||||| ||| :|::||    | |||:||| |||| |: :||
      a036        TGAPSVPPVLWQSRRFCCGRRAARRVPQRRRENRLQPPDXGSRRRSAYRVCLRRADGFPA
                 130        140        150        160        170        180

190        200        210        220        230        240
      m036.pep    RTRCLCRLKRRIPPAAGCLPPARPDNRSNGGSSAYRTMHKTLRPYERPXRQGCSFAAAAA
                  ||:| |||||||| |||||||||:||||||||| || |||||||||||| || ||||||||
      a036        RTHCRCRLKRRILPAAGCLPPDRPDNRSNGGGSACRTMHKTLRPYVRPQRQGCSFAAAAA
                 190        200        210        220        230        240

250        260        270
      m036.pep    RRRHRARVRRLRGYQTALPNPELHRCYAVRX
                  |||||||||||: |||||||   :||||||
      a036        RRRHRARVRRLKEYQTALPNLAPRRCRYAVPX
                 250        260        270
```

Computer analysis of this amino acid sequence gave the following results:
Homology with a Predicted ORF from *N. gonorrhoeae*
ORF 036 shows 74.9% identity over a 271 aa overlap with a predicted ORF (ORF 036.ng) from *N. gonorrhoeae*:

```
m036/g036

10        20        30        40        50        60
    m036.pep  MLKPCAVYSACAAVLPARTSSSRRCVSSGRCVNQYSSRADAIPWRRHSGAVAIRCSSDSS
              ||||| ||||||||:||||||||||| ||||:|||||||| | ||||||||||||||||
       g036   MLKPCLVYSACAAALPARTSSSRRCVPSGRCAYQYSSRADATPRRRHSGAVAIRCSSDSS
                  10        20        30        40        50        60

70        80        90       100       110       120
    m036.pep  GRFCQTIKAAIPXSFSARKTCSDGETSADSNWRCVHADGLQTASSAASSSQSAQTARRMF
              |||||||||||  ||||||||||||||||||||||||||||||:|||::||   | |||
       g036   GRFCQTIKAAILPSFSARKTCSDGETSADSNWRCVHADGLQTVSSAASAAQSDGEAGRMF
                  70        80        90       100       110       120

130       140       150       160       170       180
    m036.pep  TGALSVRPVLWQSGRFCCGRRANRRVRHGRQDNRPWLPMRESRRQSAYPVCLRTAELLPA
              :  || |||||||||||||||||| :  :|:|      ||:||:||| |||| |: :|:
       g036   MFVPSVPPVLWQSGRFCCGRRAVRRVPRQLRDSRRRGRARENRRRSAYRVCLRRADGFPV
                 130       140       150       160       170       180

190       200       210       220       230       240
    m036.pep  RTRCLCRLKRRIPPAAGCLPPARPDNRSNGGSSAYRTMHKTLRPYERPXRQGCSFAAAAA
              ||:| |||||| | :: |||| ||||||||:|| || |||||||| || |:||||||||
       g036   RTHCRCRLKRRTPRGGQCLPPYRLDNRSNGGGSACRTTHKTLRPYARPQRRVCSFAAAAA
                 190       200       210       220       230       240

250       260       270
    m036.pep  RRRHRARVRRLRGYQTALPNPELHRCRYAVRX
              ||||||   ||::  ||||| :||||||||||
       g036   RRRHRAWGCRLKACRTALPNLAPRRCRYAVRX
                 250       260       270
```

The following partial DNA sequence was identified in *N. meningitidis* <SEQ ID 133>:

```
m036-1.seq
   1 ATGCTGAAGC CGTGCGCCGT GTACAGTGCC TGTGCGGCGG TGTTGCCTGC

51 ACGGACTTCG AGCAGCAGGC GTTGCGTGTC TTCGGGCAGA TGTGTGAACC

101 AATATTCGAG CAGGGCGGAC GCAATTCCTT GGCGGCGGCA TTCGGGCGCG

151 GTGGCAATCA GGTGCAGTTC GGATTCGTCG GCAGGTTCT GCCAAACGAT

201 AAAGGCGGCA ATCCCGCCGT CTTTTTCCGC AAGGAAAACC TGTTCGGACG

251 GCGAAACCAG TGCGGACTCA AATTGGCGTT GCGTCCATGC GGACGGGTTG

301 CAGACGGCAT CGAGTGCGGC CAGCTCCTCA CAATCGGCAC AAACGGCACG

351 GCGGATGTTC ACGGGCGCGC TCTCCGTTCG GCCTGTTCTT GGCAGTCAG

401 GGCGATTTTG TTGCGGACGT AGAGCAAACC GGCGTGTGCG CATGGACGG

451 CAGGATAACC GCCCTTGGCT GCCAATGCGA GAAAGTCGGC GGCAGTCGGC

501 ATATCCGGTC TGCCTGAGAA CGGCGGAGCT TCTTCCAGCC GAACGCGCT

551 GCCTATGCCG TCTGAAAAGG CGCATCCCTC CGGCAGCCGG ATGTCTGCCG

601 CCCGCCCGAC CTGATAATCG CTCAAACGGT GGCAGTTCAG CGTATCGAAC

651 CATGCATAAA ACACTTCGCC CATACGAGCG TCCGTAG
```

This corresponds to the amino acid sequence <SEQ ID 134; ORF 0036-1>:

```
m036-1.pep
   1 MLKPCAVYSA CAAVLPARTS SSRRCVSSGR CVNQYSSRAD AIPWRRHSGA

51 VAIRCSSDSS GRFCQTIKAA IPPSFSARKT CSDGETSADS NWRCVHADGL
```

-continued

```
101 QTASSAASSS QSAQTARRMF TGALSVRPVL WQSGRFCCGR RANRRVRHGR

151 QDNRPWLPMR ESRRQSAYPV CLRTAELLPA RTRCLCRLKR RIPPAAGCLP

201 PARPDNRSNG GSSAYRTMHK TLRPYERP*
``` m036-1/g036 76.8% identity in 228 aa overlap

```
                     10         20         30         40         50         60
  m036-1.pep MLKPCAVYSACAAVLPARTSSSRRCVSSGRCVNQYSSRADAIPWRRHSGAVAIRCSSDSS
             ||||| |||||||:||||||||||| ||||: ||||||||| | ||||||||||||||||
       g036  MLKPCLVYSACAAALPARTSSSRRCVPSGRCAYQYSSRADATPRRRHSGAVAIRCSSDSS
                     10         20         30         40         50         60

70         80         90        100        110        120
  m036-1.pep GRFCQTIKAAIPPSFSARKTCSDGETSADSNWRCVHADGLQTASSAASSSQSAQTARRMF
             ||||||||||| |||||||||||||||||||||||||||||||::|| | |||
       g036  GRFCQTIKAAILPSFSARKTCSDGETSADSNWRCVHADGLQTVSSAASAAQSDGEAGRMF
                     70         80         90        100        110        120

130        140        150        160        170        180
  m036-1.pep TGALSVRPVLWQSGRFCCGRRANRRVRHGRQDNRPWLPMRESRRQSAYPVCLRTAELLPA
              : || |||||||||||||||||| ||| :  :|:|  ||:|||| |||| |: :|:
       g036  MFVPSVPPVLWQSGRFCCGRRAVRRVPRQLRDSRRRGRARENRRRSAYRVCLRRADGFPV
                    130        140        150        160        170        180

190        200        210        220        229
  m036-1.pep RTRCLCRLKRRIPPAAGCLPPARPDNRSNGGSSAYRTMHKTLRPYERPX
             ||:| ||||||  ::  |||| | ||||||||:|  || |||||||| ||
       g036  RTHCRCRLKRRTPRGGQCLPPYRLDNRSNGGGSACRTTHKTLRPYARPQRRVCSFAAAAA
                    190        200        210        220        230        240 g036  RRRHRAWGCRLKACRTALPNLAPRRCRYAVRX
                    250        260        270
```

The following partial DNA sequence was identified in *N. gonorrhoeae* <SEQ ID 135>:

```
g038.seq
  1 ATGACTGATT TCCGCCAAGA TTTCCTCAAA TTCTCCCTCG CCCAAAATGT

51 TTTGAAATTC GGCGAATTTA CCACCAAAGC CGGACGGCGG TCGCCCTATT

101 TCTTCAATGC CGGCCTCTTC AACGACGGCG CGTCCACGCT GCAACTGGCA

151 AAATTCTATG CACAATCCAT CATTGAAAGC GGCATCCGAT TCGATATGCT

201 GTTCGGCCCC GCCTACAAAG GCATTATTTT GGCGGCGGCA ACCGCGATGA

251 TGCTGGCGGA AAAAGGCGTG AACGTCCCGT TTGCCTACAA CCGCAAAGAA

301 GCCAAAGACC GCGGCGAAGG CGGCGTGTTG GTCGGCGCGC CGCTTAAAGG

351 GCGCGTGCTG ATTATCGACG ACGTGATTTC CGCCGGCACA TCCGTACGCG

401 AATCAATCAA ACTGATTGAA GCGGAGGGTG CAACCCCCGC CGGTGTCGCC

451 ATCGCGCTCG ACCGCATGGA AAAAGGCACG GGTAAATTGT CCGCCGTTCA

501 GGAAGTGGAA AAACAATACG GCCTGCCCGT CGCCCCCATC GCCAGCCTGA

551 ACGATTTGTT TATCCTGTTG CAAAACAACC CCGAATTCGG ACAGTTCCTC

601 GAACCCGTCC GCACCTACCG CCGGCAGTAC GGCGTAGAAT AA
```

This corresponds to the amino acid sequence <SEQ ID 136; ORF 038.ng>:

```
g038.pep
  1 MTDFRQDFLK FSLAQNVLKF GEFTTKAGRR SPYFFNAGLF NDGASTLQLA

51 KFYAQSIIES GIRFDMLFGP AYKGIILAAA TAMMLAEKGV NVPFAYNRKE

101 AKDRGEGGVL VGAPLKGRVL IIDDVISAGT SVRESIKLIE AEGATPAGVA
```

```
151 IALDRMEKGT GKLSAVQEVE KQYGLPVAPI ASLNDLFILL QNNPEFGQFL

201 EPVRTYRRQY GVE*
```

The following partial DNA sequence was identified in *N. meningitidis* <SEQ ID 137>:

```
m038.seq
  1 ATGACCGATT TCCGCCAAGA TTTCCTCAAA TTCTCCCTCG CCCAAAATGT

51 TTTGAAATTC GGCGAATTTA CCACCAAGGC AGGACGGCGG TCGCCCTATT

101 TCTTCAATGC CGGCCTCTTT AACGACGGCT TGTCCACGCT GCAACTGGCA

151 AAATTTTACG CACAATCCAT CATTGAAAGC GGCATCCGAT TCGATATGCT

201 GTTCGGTCCC GCCTACAAAG GCATTATTTT GGCGGCGGCA ACCGCGATGA

251 TGCTGGCGGA AAAAGGCGTG AACGTCCCGT TGCCTACAA CCGCAAAGAA

301 GCCAAAGACC ACGGCGAAGG CGGCGTGTTG GTCGGCGCGC CGCTTAAAGG

351 GCGCGTGCTG ATTATCGACG ACGTGATTTC CGCCGGCACA TCCGTACGCG

401 AATCGATCAA ACTGATTGAA GCGGAGGGTG CAACCCCcGC CGGTGTCGCC

451 ATCGCGCTCG ATCGCATGGA AAAAGGCACG GGTGAATTGA GCGCGGTTCA

501 GGAAGTGGAr AAACAATACG GkCTGCCCGT CGCCCCCATC GCCAGCCTGA

551 ACGATTTGTT TATTCTGTTG CAAAACAACC CCGAATTCGG ACAGTTCCTC

601 GAACCCGTCC GAGCCTACCG TCGGCAGTAC GGCGTAGAAT AA
```

This corresponds to the amino acid sequence <SEQ ID 138; ORF 038>:

```
m038.pep
    1 MTDFRQDFLK FSLAQNVLKF GEFTTKAGRR SPYFFNAGLF NDGLSTLQLA

51 KFYAQSIIES GIRFDMLFGP AYKGIILAAA TAMMLAEKGV NVPFAYNRKE

101 AKDHGEGGVL VGAPLKGRVL IIDDVISAGT SVRESIKLIE AEGATPAGVA

151 IALDRMEKGT GELSAVQEVE KQYGLPVAPI ASLNDLFILL QNNPEFGQFL

201 EPVRAYRRQY GVE*
```

The following partial DNA sequence was identified in *N. meningitidis* <SEQ ID 139>:

```
a038.seq
  1 ATGACCGATT TCCGCCAAGA TTTCCTCAAA TTCTCCCTCG CCCAAAATGT

51 TTTGAAATTC GGCGAATTCA CCACCAAAGC CGGACGGCGG TCGCCCTATT

101 TCTTCAATGC CGGCCTCTTT AACGACGGCT TGTCCACGCT GCAACTGGCA

151 AAATTTTACG CACAATCCAT CATTGAAAGC GGCATCCGAT TCGATATGCT

201 GTTCGGCCCC GCCTACAAAG GCATTATTTT GGCGGCGGCA ACCGCGATGA

251 TGCTGGCGGA AAAAGGCGTG AACGTCCCGT TGCCTACAA CCGCAAAGAA

301 GCCAAAGACC ACGGCGAAGG CGGCGTGTTG GTCGGCGCGC CGCTTAAAGG

351 GCGCGTGCTG ATTATCGACG ACGTGATTTC CGCCGGCACA TCCGTACGCG

401 AATCGATCAA ACTGATTGAA GCGGAGGGTG CAACCCCCGC CGGTGTCGCC

451 ATCGCGCTCG ACCGCATGGA AAAAGGCACG GGTGAATTGA GCGCGGTTCA

501 GGAAGTGGAA AAACAATACG GCCTGCCCGT CGCCCCCATC GCCAGCCTGA
```

```
-continued
551 ACGATTTGTT TATTCTGTTG CAAAACAACC CCGAATTCGG ACAGTTCCTC

601 GAACCCGTCC GAGCCTACCG TCGGCAGTAC GGCGTAGAAT AA
```

This corresponds to the amino acid sequence <SEQ ID 140; ORF 038.a>:

```
a038.pep
  1 MTDFRQDFLK FSLAQNVLKF GEFTTKAGRR SPYFFNAGLF NDGLSTLQLA

51 KFYAQSIIES GIRFDMLFGP AYKGIILAAA TAMMLAEKGV NVPFAYNRKE

101 AKDHGEGGVL VGAPLKGRVL IIDDVISAGT SVRESIKLIE AEGATPAGVA

151 IALDRMEKGT GELSAVQEVE KQYGLPVAPI ASLNDLFILL QNNPEFGQFL

201 EPVRAYRRQY GVE*
``` m038/a038 100.0% identity over a 213 aa overlap

```
                 10         20         30         40         50         60
     m038.pep    MTDFRQDFLKFSLAQNVLKFGEFTTKAGRRSPYFFNAGLFNDGLSTLQLAKFYAQSIIES
                 ||||||||||||||||||||||||||||||||||||||||||||||||||||||||||||
     a038        MTDFRQDFLKFSLAQNVLKFGEFTTKAGRRSPYFFNAGLFNDGLSTLQLAKFYAQSIIES
                 10         20         30         40         50         60
                 70         80         90        100        110        120
     m038.pep    GIRFDMLFGPAYKGIILAAATAMMLAEKGVNVPFAYNRKEAKDHGEGGVLVGAPLKGRVL
                 ||||||||||||||||||||||||||||||||||||||||||||||||||||||||||||
     a038        GIRFDMLFGPAYKGIILAAATAMMLAEKGVNVPFAYNRKEAKDHGEGGVLVGAPLKGRVL
                 70         80         90        100        110        120
                130        140        150        160        170        180
     m038.pep    IIDDVISAGTSVRESIKLIEAEGATPAGVAIALDRMEKGTGELSAVQEVEKQYGLPVAPI
                 ||||||||||||||||||||||||||||||||||||||||||||||||||||||||||||
     a038        IIDDVISAGTSVRESIKLIEAEGATPAGVAIALDRMEKGTGELSAVQEVEKQYGLPVAPI
                130        140        150        160        170        180
                190        200        210
     m038.pep   ASLNDLFILLQNNPEFGQFLEPVRAYRRQYGVEX
                ||||||||||||||||||||||||||||||||||
     a038       ASLNDLFILLQNNPEFGQFLEPVRAYRRQYGVEX
                190        200        210
```

Computer analysis of this amino acid sequence gave the following results:

Homology with a Predicted ORF from *N. gonorrhoeae*

ORF 038 shows 98.1% identity over a 213 aa overlap with a predicted ORF (ORF 038.ng) from *N. gonorrhoeae*:

m038/g038

```
                 10         20         30         40         50         60
     m038.pep    MTDFRQDFLKFSLAQNVLKFGEFTTKAGRRSPYFFNAGLFNDGLSTLQLAKFYAQSIIES
                 |||||||||||||||||||||||||||||||||||||||||| |||||||||||||||||
     g038        MTDFRQDFLKFSLAQNVLKFGEFTTKAGRRSPYFFNAGLFNDGASTLQLAKFYAQSIIES
                 10         20         30         40         50         60
                 70         80         90        100        110        120
     m038.pep    GIRFDMLFGPAYKGIILAAATAMMLAEKGVNVPFAYNRKEAKDHGEGGVLVGAPLKGRVL
                 |||||||||||||||||||||||||||||||||||||||||:||||||||||||||||||
     g038        GIRFDMLFGPAYKGIILAAATAMMLAEKGVNVPFAYNRKEAKDRGEGGVLVGAPLKGRVL
                 70         80         90        100        110        120
                130        140        150        160        170        180
     m038.pep    IIDDVISAGTSVRESIKLIEAEGATPAGVAIALDRMEKGTGELSAVQEVEKQYGLPVAPI
                 |||||||||||||||||||||||||||||||||||||||||:||||||||||||||||||
     g038        IIDDVISAGTSVRESIKLIEAEGATPAGVAIALDRMEKGTGKLSAVQEVEKQYGLPVAPI
                130        140        150        160        170        180
```

```
                      190        200       210
m038.pep   ASLNDLFILLQNNPEFGQFLEPVRAYRRQYGVEX
           ||||||||||||||||||||||||:|||||||||
g038       ASLNDLFILLQNNPEFGQFLEPVRTYRRQYGVEX
                      190        200       210
```

The following partial DNA sequence was identified in *N. gonorrhoeae* <SEQ ID 141>:

```
g039.seq
    1 ATGCCGTCCG AACCACCTGC CGCTTCAGAC GGCATCAAAC CGACACACAC

51 CGAGAAAACA TCATGCCCGC CTGTTTCTGT CCGCACTGCA AAACCCGCCT

101 CTGGGTCAAA GAAAcccagC TCAAcgtCgC ccaagGCTTC GTCGTCTgcc 151 aaAAAtgcga agGGCTgttt aaAgccaaaG accAtctggc aaGcacGAAA 201 gaacctatat tcaacgattg gcccgaagct gtttcgggat TcaaaCTCGg 251 TCcaccgcaT cggcacgcac gccattagca aGAaacagat gtcccgcgac 301 gaaatCgccg atatcctcaa cggcggtaca acCCTGCACG ATACGCCGCC 351 CGCAACCGCC GCTGCCGCac ctGCCGCCGC ACCGCaggTT TCCGTACCGC

401 CCGCCCGTCA GGAAGGGCTC AACTGGACTA TTGCAACCCT GTTCGCACTT

451 ATCGTCCTCA TTATGCAGCT TTCCTACCTC TTCATCCTAT GA
```

This corresponds to the amino acid sequence <SEQ ID 142; ORF 039.ng>:

```
g039.pep
    1 MPSEPPAASD GIKPTHTEKT SCPPVSVRTA KPASGSKKPS STSPKASSSA

51 KNAKGCLKPK TIWQARKNLY STIGPKLFRD VKLVHRIGTH AISKKQMSRD

101 EIADILNGGT TLHDTPPATA AAAPAAAPQV SVPPARQEGL NWTIATLFAL

151 IVLIMQLSYL FIL*
```

The following partial DNA sequence was identified in *N. meningitidis* <SEQ ID 143>:

```
m039.seq
    1 ATGCCGTCCG AACCGCCTTA CGCCTCAGAC GGCATCAAAC CTGACACACA

51 CGAGGAAATA CCATGCCCGC CTGTTTCTGC CCCCACTGCA AAACCCGTCT

101 CTGGGTCAAA GAAACCCAAC TCAATGTCGC CGnnnnnnnn nnnnnnnnnn 151 nnnnnnnnnn nnnnnnnnnn nnnnnnnnnn nnnnnnnnnn nnnnnnnnnn 201 nnnnnnnnnn nnnnnnnnnn nnnnnnnnnn nnnnnnCCC GAGGCTGTTT

251 CGGATGTCAA ACTCGTTCAC CGTATCGGCA CGCGCGCCAT CGGCAAGAAA

301 CAGATTTCCC GTGACGAAAT CGCCGGCATC CTCAACGGCG GTACAACCCA

351 GCCCGATATT CCGCCCGCAA CCGCCGCCAC CCCTGCTGCC GCACCGCAGG

401 TTACCGTACC GCCCGCCGCG CCCGCCCGTC AGGATGGGTT CAACTGGACG

451 ATTGCAACCC TGTTTGCCCT TATCGTCCTC ATTATGCAGC TTTCCTACCT

501 CGTCATCCTA TGA
```

This corresponds to the amino acid sequence <SEQ ID 144; ORF 039>:

```
m039.pep
    1 MPSEPPYASD GIKPDTHEEI PCPPVSAPTA KPVSGSKKPN SMSPXXXXXX

51 XXXXXXXXXX XXXXXXXXXX XXXXXXXXXP EAVSDVKLVH RIGTRAIGKK

101 QISRDEIAGI LNGGTTQPDI PPATAATPAA APQVTVPPAA PARQDGFNWT

151 IATLFALIVL IMQLSYLVIL *
```

The following partial DNA sequence was identified in *N. meningitidis* <SEQ ID 145>:

```
a039.seq
    1 ATGCCGTCTG AACCGCCTTA CGCCTCAGAC GGCATCAAAC CTGACACACA

51 CGAGGAAATA CCATGCCCGC CTGTTTCTGC CCCCACTGCA AAACCCGTCT

101 CTGGGTCAAA GAAACCCAAC TCAATGTCGC CCAAGGCTTC GTCGTCTGCC

151 AAAAATGCGA AGGAATGTTT AAAGCCAAAG ACCATCTGGC AAGCACGAAA

201 GAACCCATAT TCAACGATT. TGCCCGAAGC TGTTTCGGAT GTCAAACTCG

251 TTCACCGCAT CGGCACGAGC GCCATCGGCA AGAAACAGAT TTCCCGTGAC

301 GAAATCGCCG GCATCCTCAA CGGCGGCACA ACCCAGCCCG ATATTCCGCC

351 CGCAACCGCC GCCACCCCTG CTGCCGCACC GCAGGTTACC GTACCGCCCG

401 CCGCGCCCGC CCGTCAGGAT GGGTTCAACT GGACGATTGC AACCCTGTTT

451 GCCCTTATCG TCCTCATTAT GCAGCTTTCC TACCTCGTCA TCCTATGA
```

This corresponds to the amino acid sequence <SEQ ID 146; ORF 039.a>:

```
a039.pep
    1 MPSEPPYASD GIKPDTHEEI PCPPVSAPTA KPVSGSKKPN SMSPKASSSA

51 KNAKECLKPK TIWQARKNPY STIXPEAVSD VKLVHRIGTS AIGKKQISRD

101 EIAGILNGGT TQPDIPPATA ATPAAAPQVT VPPAAPARQD GFNWTIATLF

151 ALIVLIMQLS YLVIL*
``` m039/a039 79.4% identity over a 170 aa overlap

```
                    10        20        30        40        50        60
m039.pep    MPSEPPYASDGIKPDTHEEIPCPPVSAPTAKPVSGSKKPNSMSPXXXXXXXXXXXXXXXX
            ||||||||||||||||||||||||||||||||||||||||||||
a039        MPSEPPYASDGIKPDTHEEIPCPPVSAPTAKPVSGSKKPNSMSPKASSSAKNAKECLKPK
                    10        20        30        40        50        60

70        80        90       100       110       120
m039.pep    XXXXXXXXXXXXXXXXXXXPEAVSDVKLVHRIGTRAIGKKQISRDEIAGILNGGTTQPDI
            :          : |     |||||||||||||| ||||||||||||||||||||||||
a039        TIWQARKNPYSTIX-----PEAVSDVKLVHRIGTSAIGKKQISRDEIAGILNGGTTQPDI
                    70             80        90       100       110

130       140       150       160       170
m039.pep    PPATAATPAAAPQVTVPPAAPARQDGFNWTIATLFALIVLIMQLSYLVILX
            |||||||||||||||||||||||||||||||||||||||||||||||||||
a039        PPATAATPAAAPQVTVPPAAPARQDGFNWTIATLFALIVLIMQLSYLVILX
              120       130       140       150       160
```

Computer analysis of this amino acid sequence gave the following results:
Homology with a Predicted ORF from *N. gonorrhoeae*
ORF 039 shows 60.8% identity over a 171 aa overlap with a predicted ORF (ORF 039.ng) from *N. gonorrhoeae*:

```
m039/g039

10        20        30        40        50        60
   m039.pep MPSEPPYASDGIKPDTHEEIPCPPVSAPTAKPVSGSKKPNSMSPXXXXXXXXXXXXXXXX
            ||||||  |||||||   |:  |||||:  ||||:|||||||:|| ||
       g039 MPSEPPAASDGIKPTHTEKTSCPPVSVRTAKPASGSKKPSSTSPKASSSAKNAKGCLKPK
                  10        20        30        40        50        60

70        80        90       100       110       120
   m039.pep XXXXXXXXXXXXXXXXXXXXPEAVSDVKLVHRIGTRAIGKKQISRDEIAGILNGGTTQPDI
            :         :      |:  ||||||||||:||:|||:|||||| ||||||| |
       g039 TIWQARKNLYSTIG-----PKLFRDVKLVHRIGTHAISKKQMSRDEIADILNGGTTLHDT
                  70        80        90       100       110

130       140       150       160       170
   m039.pep PPATAAT-PAAAPQVTVPPAAPARQDGFNWTIATLFALIVLIMQLSYLVILX
            ||||||:  |||||||:||||   ||:|:||||||||||||||||||| |||
       g039 PPATAAAAPAAAPQVSVPPA---RQEGLNWTIATLFALIVLIMQLSYLFILX
                 120       130       140       150       160
```

The following partial DNA sequence was identified in *N. gonorrhoeae* <SEQ ID 147>:

```
g040.seq
    1 ATGAACGCGC CCGACAGCTT TGTCGCCCAC TTCCGCGAAG CCGCCCCTA

51 CATCCGCCAA ATGCGCGGCA CGACACTGGT CGCCGGCATA GAcggCCGCC

101 TGCTCGAAGG CGGCACCTTA AATAAGCTCG CCGCCGACAT CGGGCTGTTG

151 TCGCAACTGG GCATCCGACT CGTCCTCATC CACGGCGCGT ACCACTTCCT

201 CGAccgCCTC GCCGCCGCGC AAGgccGCAC GCCGCATTAT TGCCGgggtt 251 tGCGCGTTAC CGACGaAACc tcGctcgGAC AGGCGCAGCA GtttGCCGGC 301 AccgTCCGCA GCCGTTTTGA agcCGCATTG tgcggcagCG tttcaggatt 351 cgcgCGCGCG CCTTCCGTCC CGCTCGTAtc gggcaacttc ctgacCGCCC 401 GTCcgatggg cgtgattgac ggaACCGata tggaatacgc ggggttatc 451 cgcaaaaccg ACACCGCCGC CCTCCGTTTC CAACTCGACG CGGGCAATAT

501 CGTCTGGATG CCGCCGCTCG GGCATTCCTA CGGCGGCAAA ACCTTCAATC

551 TCGATATGGT GCAGGCCGCC GCTTCCGTCG CCGTCTCGCT TCAGGCCGAA

601 AAACTCGTTT ACCTGACCCT TTCAGACGGC ATTTCCCGCC CCGACGGCAC

651 GCTCGCCGAA ACCCTCTCGG CACAGGAAGC GCAATCGCTG GCGGAACACG

701 CCGCCAGCGA AACCCGACGA CTGATTTCGT CCGCCGTTGC CGCGCTCGAA

751 GGCGGCGTGC ATCGCGTCCA AATCCTCAAC GGGGCCGCCG ACGGCAGCCT

801 GCTGCAAGAA CTCTTCACCC GCAACGGCAT CGGCACGTCC ATTGCCAAAG

851 AAGCCTTCGT CTCCATCCGG CAGGCGCACA GCGGCGACAT CCCGCACATC

901 GCCGCACTCA TCCGCCCGCT GGAAGAACAG GGCGTCCTAT TGCACCGCAG

951 CCGCGAATAC CTCGAAAACC ACATTTCCGA ATTTTCCATC CTCGAACACG

1001 ACGGCGACCT GTACGGCTGT GCCGCACTCA AAACCTTTGC CGAAGCCGAT

1051 TGCGGCGAAA TCGCCTGCCT TGCCGTCTCG CCGCAGGCAC AGGACGGCGg 1101 ctACGGCGAA CGCCTGCTTG CCCACATTAT CGATAAGGCG CGCGGCATAG

1151 GCATAAGCAG GCTGTTCGCA CTGTCCACAA ATACCGGCGA ATGGTTTGCC

1201 GAACGCGGCT TTCAGACGGC ATCGGAAGAC GAGCTGCCCG AAACGCGGCG
```

```
1251 CAAAGACTAC CGCAGCAACG GACGAAACCC GCATATTCTG GTGCGTCGCC

1301 TGCACCGCTG A
```

This corresponds to the amino acid sequence <SEQ ID 148; ORF 040.ng>:

```
g040.pep 1
   1 MNAPDSFVAH FREAAPYIRQ MRGTTLVAGI DGRLLEGGTL NKLAADIGLL

51 SQLGIRLVLI HGAYHFLDRL AAAQGRTPHY CRGLRVTDET SLGQAQQFAG

101 TVRSRFEAAL CGSVSGFARA PSVPLVSGNF LTARPMGVID GTDMEYAGVI

151 RKTDTAALRF QLDAGNIVWM PPLGHSYGGK TFNLDMVQAA ASVAVSLQAE

201 KLVYLTLSDG ISRPDGTLAE TLSAQEAQSL AEHAASETRR LISSAVAALE

251 GGVHRVQILN GAADGSLLQE LFTRNGIGTS IAKEAFVSIR QAHSGDIPHI

301 AALIRPLEEQ GVLLHRSREY LENHISEFSI LEHDGDLYGC AALKTFAEAD

351 CGEIACLAVS PQAQDGGYGE RLLAHIIDKA RGIGISRLFA LSTNTGEWFA

401 ERGFQTASED ELPETRRKDY RSNGRNPHIL VRRLHR*
```

The following partial DNA sequence was identified in *N. meningitidis* <SEQ ID 149>:

```
m040.seq
    1 ATGAGCGCGC CCGACCTCTT TGTCGCCCAC TTCCGCGAAG CCGTCCCCTA

51 CATCCGCCAA ATGCGCGGCA AAACGCTGGT CGCCGGCATA GACGACCGCC

101 TGCTCGAAGG TGATACCTTA AACAAGCTCG CCGCCGACAT CGGGCTGTTG

151 TCGCAACTGG GCATCAGGCT CGTCCTCATC CACGGCGCGC GCCACTTCCT

201 CGACCGCCAC GCCGCCGCTC AAGGCCGCAC GCCGCATTAT TGCCGGGGCT

251 TGCGCGTTAC CGACGAAACC TCGCTCGAAC AGGCGCAgCA GTTTGCCGGC

301 ACCGTCCGCA GCCGTTTTGA AGCCGCATTG TGCGGCAGCG TTTCCGGGTT

351 CGCGCGCGCG CCTTCCGTCC CGCTCGTATC GGGCAACTTC CTGACCGCCC

401 GTCCGATAGG TGTGATTGAC GGAACCGATA TGGAATACGC GGGCGTTATC

451 CGCAAAACCG ACACCGCCGC CCTCCGTTTC CAACTCGACG CGGGCAATAT

501 CGTCTGGCTG CCGCCGCTCG GACATTCCTA CAGCGGCAAG ACCTTCTATC

551 TCGATATGCT TCAAACCGCC GCCTCCGCCG CCGTCTCGCT TCAGGCCGAA

601 AAACTCGTTT ACCTGACCCT TTCAGACGGC ATTTCCCGCC CGACGGCAC

651 GCTCGCCGAA ACCCTCTCGG CACAGGAAGC GCAATCGCTG GCGGAACACG

701 CCGGCGGGCA AACGCGACGG CTGATTTCGT CCGCCGAACT CTTCACCCGC

751 AACGGCATCG GCACGTCCAT GCCAAAGAA GCCTTCGTCT CCATCCGGCA 801 rGCGCAywgG G.CGACATCC CGCACATCGC CGCCCTCATC CGCCCGCTGG 851 AAGAACAGGG CATCCTGCTG CACCGCAs.c GCGAATACCT CGAAAACCAC

901 ATTTCCGAAT TTTCCATCCT GAACACGAC GGCAACCTGT ACGGTTGCGC

951 CGCCCTGAAA ACCTTTGCCG AAGCCGATTG CGGCGAAATC GCCTGCCTTG

1001 CCGTCTCGCC GCag.cACAG GACGGCGGCT ACGGCGAACG CnTGCTTGCC

1051 CACATTATCG ATAAGGCGCG CGGCATAGGC ATAAGCAGGC TGTTCGCACT

1101 GTCCACAAAT ACCGGCGAAT GGTTTGCCGA ACGCGGCTTT CAGACGGCAT
```

-continued

```
1151 CGGAAGACGA GTTGCCCGAA ACGCGGCGCA AAGACTACCG CAGCAACGGA

1201 CGGAACTCGC ATATTCTGGT ACGTCGCCTG CACCGCTGA
```

This corresponds to the amino acid sequence <SEQ ID 150; ORF 040>:

```
m040.pep
  1 MSAPDLFVAH FREAVPYIRQ MRGKTLVAGI DDRLLEGDTL NKLAADIGLL

51 SQLGIRLVLI HGARHFLDRH AAAQGRTPHY CRGLRVTDET SLEQAQQFAG

101 TVRSRFEAAL CGSVSGFARA PSVPLVSGNF LTARPIGVID GTDMEYAGVI

151 RKTDTAALRF QLDAGNIVWL PPLGHSYSGK TFYLDMLQTA ASAAVSLQAE

201 KLVYLTLSDG ISRPDGTLAE TLSAQEAQSL AEHAGGQTRR LISSAELFTR

251 NGIGTSIAKE AFVSIRQAHX XDIPHIAALI RPLEEQGILL HRXREYLENH

301 ISEFSILEHD GNLYGCAALK TFAEADCGEI ACLAVSPQXQ DGGYGERXLA

351 HIIDKARGIG ISRLFALSTN TGEWFAERGF QTASEDELPE TRRKDYRSNG

401 RNSHILVRRL HR*
```

The following partial DNA sequence was identified in *N. meningitidis* <SEQ ID 151>:

```
a040.seq
    1 ATGATCGTGC CCGACCTCTT TGTCGCCCAC TTCCGCGAAG CCGCCCCCTA

51 CATCCGCCAA ATGCGCGGCA AAACGCTGGT CGCCGGCATA GACGACCGCC

101 TGCTCGAAGG TGATACCTTA AACAAGTTCG CCGCCGACAT CGGGCTTTTG

151 TCGCAACTGG GCATCAGGCT CGTCCTCATC CACGGCGCGC GCCACTTCCT

201 CGACCGCCAC GCCGCCGCGC AAGGCCGCAC GCCGCATTAT TGCCGGGGCT

251 TGCGCGTTAC CGACGAAACC TCGCTCGAAC AGGCGCAGCA GTTTGCCGGC

301 ACCGTCCGCA GCCGTTTTGA AGCCGCATTG TGCGGCAGCG TTTCCGGGTT

351 CGCGCGCGCG CCTTCCGTCC CGCTCGTATC GGGCAACTTC CTGACCGCCC

401 GTCCGATAGG TGTGATTGAC GGAACCGATA TGGAATACGC GGGCGTTATC

451 CGCAAAACCG ACACCGCCGC CCTCCGTTTC CAACTCGACG CGGGCAATAT

501 CGTCTGGCTG CCGCCGCTCG GACATTCCTA CAGCGGCAAG ACCTTCCATC

551 TCGATATGCT TCAAACCGCC GCCTCCGTCG CCGTCTCGCT TCAGGCCGAA

601 AAACTCGTTT ACCTGACCCT TTCAGACGGC ATTTCCCGCC CGACGGCAC

651 GCTCGCCGTA ACCCTCTCGG CACAGGAAGC GCAATCGCTG GCGGAACACG

701 CCGGCGGCGA AACGCGACGG CTGATTTCGT CCGCCGTTGC CGCGCTCGAA

751 GGCGGCGTGC ATCGCGTCCA AATCCTCAAC GGAGCCGCCG ACGGCAGCCT

801 GCTGCAAGAA CTCTTCACCC GCAACGGCAT CGGCACGTCC ATTGCCAAAG

851 AAGCCTTCGT CTCCATCCGG CAGGCGCACA GCGGCGACAT CCCGCACATT

901 GCCGCCCTCA TCCGCCCGCT GGAAGAACAG GGCATCCTGC TGCACCGCAG

951 CCGCGAATAC CTCGAAAACC ACATTTCCGA ATTTTCCATC CTCGAACACG

1001 ACGGCAACCT GTACGGTTGC GCCGCCCTGA AAACCTTTGC CGAAGCCGAT

1051 TGCGGCGAAA TCGCCTGCCT TGCCGTCTCG CCGCAGGCAC AGGACGGCGG

1101 CTACGGCGAA CGCCTGCTTG CCCACATTAT CGATAAGGCG CGCGGCATAG
```

```
1151  GCATAAGCAG GCTGTTCGCA CTGTCCACAA ATACCGGCGA ATGGTTTGCC

1201  GAACGCGGCT TTCAGACGGC ATCGGAAGAC GAGTTGCCCG AAACGCGGCG

1251  CAAAGACTAC CGCAGCAACG GACGGAACTC GCATATTCTG GTGCGTCGCC

1301  TGCACCGCTG A
```

This corresponds to the amino acid sequence <SEQ ID 152; ORF 040.a>:

```
a040.pep

1  MIVPDLFVAH FREAAPYIRQ MRGKTLVAGI DDRLLEGDTL NKFAADIGLL

51  SQLGIRLVLI HGARGFLDRH AAAQGRTPHY CRGLRVTDET SLEQAQQFAG

101  TVESRFEAAL CGSVSGFARA PSVPLVSGNF LTARPIGVID GTDMEYAGVI

151  RKTDTAALRF QLDAGNIVWL PPLGHSYSGK TFHLDMLQTA ASVAVSLQAE

201  KLVYLTLSDG ISRPDGTLAV TLSAQEAQSL AEHAGGETRR LISSAVAALE

251  GGVHRVQILN GAADGSLLQE LFTRNGIGTS IAKEAFVSIR QAHSGDIPHI

301  AALIRPLEEQ GILLHRSREY LENHISEFSI LEHDGNLYGC AALKTFAEAD

351  CGEIACLAVS PQAQDGGYGE RLLAHIIDKA RGIGISRLFA LSTNTGEWFA

401  ERGFQTASED ELPETRRKDY RSNGRNSHIL VRRLHR* m040/a040 91.5% identity in 436 aa overlap 10         20         30         40         50         60
m040.pep  MSAPDLFVAHFREAVPYIRQMRGKTLVAGIDDRLLEGDTLNKLAADIGLLSQLGIRLVLI
          | :||||||||||:||||||||||||||||||||||||||||:|||||||||||||||||
a040      MIVPDLFVAHFREAAPYIRQMRGKTLVAGIDDRLLEGDTLNKFAADIGLLSQLGIRLVLI
                 10         20         30         40         50         60

70         80         90        100        110        120
m040.pep  HGARHFLDRHAAAQGRTPHYCRGLRVTDETSLEQAQQFAGTVRSRFEAALCGSVSGFARA
          ||||||||||||||||||||||||||||||||||||||||||||||||||||||||||||
a040      HGARHFLDRHAAAQGRTPHYCRGLRVTDETSLEQAQQFAGTVRSRFEAALCGSVSGFARA
                 70         80         90        100        110        120

130        140        150        160        170        180
m040.pep  PSVPLVSGNFLTARPIGVIDGTDMEYAGVIRKTDTAALRFQLDAGNIVWLPPLGHSYSGK
          ||||||||||||||||||||||||||||||||||||||||||||||||||||||||||||
a040      PSVPLVSGNFLTARPIGVIDGTDMEYAGVIRKTDTAALRFQLDAGNIVWLPPLGHSYSGK
                130        140        150        160        170        180

190        200        210        220        230        240
m040.pep  TFYLDMLQTAASAAVSLQAEKLVYLTLSDGISRPDGTLAETLSAQEAQSLAEHAGGQTRR
          ||:|||||||||:|||||||||||||||||||||||||||| ||||||||||||||:|||
a040      TFHLDMLQTAASVAVSLQAEKLVYLTLSDGISRPDGTLAVTLSAQEAQSLAEHAGGETRR
                190        200        210        220        230        240

250        260        270
m040.pep  LISSA---------------------ELFTRNGIGTSIAKEAFVSIRQAHXXDIPHI
          |||||                     |||||||||||||||||||||||||  |||||
a040      LISSAVAALEGGVHRVQILNGAADGSLLQELFTRNGIGTSIAKEAFVSIRQAHSGDIPHI
                250        260        270        280        290        300

280        290        300        310        320        330
m040.pep  AALIRPLEEQGILLHRXREYLENHISEFSILEHDGNLYGCAALKTFAEADCGEIACLAVS
          ||||||||||||||||| ||||||||||||||||||||||||||||||||||||||||||
a040      AALIRPLEEQGILLHRSREYLENHISEFSILEHDGNLYGCAALKTFAEADCGEIACLAVS
                310        320        330        340        350        360

340        350        360        370        380        390
m040.pep  PQXQDGGYGERXLAHIIDKARGIGISRLFALSTNTGEWFAERGFQTASEDELPETRRKDY
          || |||||||| ||||||||||||||||||||||||||||||||||||||||||||||||
a040      PQAQDGGYGERLLAHIIDKARGIGISRLFALSTNTGEWFAERGFQTASEDELPETRRKDY
                370        380        390        400        410        420
```

```
                   400        410
                                   -continued
    m040.pep    RSNGRNSHILVRRLHRX
                |||||||||||||||||
    a040        RSNGRNSHILVRRLHRX
                        430
```

Computer analysis of this amino acid sequence gave the following results:

Homology with a Predicted ORF from *N. gonorrhoeae*

ORF 040 shows 88.3% identity over a 436 aa overlap with a predicted ORF (ORF 040.ng) from *N. gonorrhoeae*:

```
m040/g040 m040.pep    MSAPDLFVAHFREAVPYIRQMRGKTLVAGIDDRLLEGDTLNKLAADIGLLSQLGIRLVLI    60
            |:||| |||||||||:|||||||| |||||||| ||||| |||||||||||||||||||
g040        MNAPDSFVAHFREAAPYIRQMRGTTLVAGIDGRLLEGGTLNKLAADIGLLSQLGIRLVLI    60
m0404.pep   HGARHFLDRHAAAQGRTPHYCRGLRVTDETSLEQAQQFAGTVRSRFEAALCGSVSGFARA   120
            ||| ||||| ||||||||||||||||||||||| |||||||||||||||||||||||||
g040        HGAYHFLDRLAAAQGRTPHYCRGLRVTDETSLGQAQQFAGTVRSRFEAALCGSVSGFARA   120
m040.pep    PSVPLVSGNFLTARPIGVIDGTDMEYAGVIRKTDTAALRFQLDAGNIVWLPPLGHSYSGK   180
            ||||||||||||||:|||||||||||||||||||||||||||||||||:||||||:||
g040        PSVPLVSGNFLTARPMGVIDGTDMEYAGVIRKTDTAALRFQLDAGNIVWMPPLGHSYGGK   180
m040.pep    TFYLDMLQTAASAAVSLQAEKLVYLTLSDGISRPDGTLAETLSAQEAQSLAEHAGGQTRR   240
            || |||:|:|||:||||||||||||||||||||||||||||||||||||||||::·|||
g040        TFNLDMVQAAASVAVSLQAEKLVYLTLSDGISRPDGTLAETLSAQEAQSLAEHAASETRR   240
m040.pep    LISSA----------------------ELFTRNGIGTSIAKEAFVSIRQAHXXDIPHI   276
            |||||                      ||||||||||||||||||||||||  |||||
g040        LISSAVAALEGGVHRVQILNGAADGSLLQELFTRNGIGTSIAKEAFVSIRQAHSGDIPHI   300
m040.pep    AALIRPLEEQGILLHRXREYLENHISEFSILEHDGNLYGCAALKTFAEADCGEIACLAVS   336
            ||||||||||:|||| |||||||||||||||||||:||||||||||||||||||||||
g040        AALIRPLEEQGVLLHRSREYLENHISEFSILEHDGDLYGCAALKTFAEADCGEIACLAVS   360
m040.pep    PQXQDGGYGERXLAHIIDKARGIGISRLFALSTNTGEWFAERGFQTASEDELPETRRKDY   396
            || |||||||| ||||||||||||||||||||||||||||||||||||||||||||||
g040        PQAQDGGYGERLLAHIIDKARGIGISRLFALSTNTGEWFAERGFQTASEDELPETRRKDY   420
m040.pep    RSNGRNSHILVRRLHRX   413
            |||||| ||||||||||
g040        RSNGRNPHILVRRLHRX   437
```

The following partial DNA sequence was identified in *N. gonorrhoeae* <SEQ ID 153>:

```
g041.seq
  1 ATGAGTTCGC CCAAACACAT CGGCTTGCAG GCGGCAGCA ACGGCGGCCT

51 GATTACCGCC GCCGCCTTCG TGCGCGAACC GCAAAGCATC GGTGCGCTGG

101 TGTGCGAAGT ACCGCTGACC GATATGATCC GTTATCCGCT GCTGTCCGCC

151 GGTTCAAGTT GGACGGACGA ATACGGCAAT CCGCAGAAAT ACGAAGCCTG

201 CAAACGCCGG CTGGGCGAAT TGTCGCCGTA TCACAATCTT TCAGACGGCA

251 TCGATTATCC GCCCGCACTC ATTACCACCA GCCTCAGCGA CGACCGCGTC

301 CATCCCGCCC ACGCGCTCAA ATTCTACGCC AAACTGCGCG AAACCTCGCC

351 GCAATCTTGG CTCTACTCGC CTGACGGCGG CGGCCATACC GGCAACGGCA

401 CCCAACGCGA ATCCGCCGAC AAACTCGCCT GCGTGTTGCT GTTTTTGAAA

451 GAATTTTTGG GATAA
```

This corresponds to the amino acid sequence <SEQ ID 154; ORF 041.ng>:

```
g041.pep
    1 MSSPKHIGLQ GGSNGGLITA AAFVREPQSI GALVCEVPLT DMIRYPLLSA

51 GSSWTDEYGN PQKYEACKRR LGELSPYHNL SDGIDYPPAL ITTSLSDDRV

101 HPAHALKFYA KLRETSPQSW LYSPDGGGHT GNGTQRESAD KLACVLLFLK

151 EFLG*
```

The following partial DNA sequence was identified in *N. meningitidis* <SEQ ID 155>:

```
m041.seq
    1 ATCAGTTCGC CCGAACACAT CGGCTTGCAG GGCGGCAGCA ACGGCGGACT

51 GATTACTGCC GCCGCCTTCG TGCGCGAACC GCAAAGCATC GGCGCGCTGG

101 TGTGCGAAGT GCCGCTGACC GACATGATCC GTTATCCGCT GCTCTCCGCC

151 GGTTCAAGCT GGACAGACGA ATACGGCAAT CCGCAAAAAT ACGAAGTCTG

201 CAAACGCCGG TTGGGCGAAT TGTCGCCGTA TCACAATCTT TCAGACGGCA

251 TCGATTATCC GCCCGCGCTC ATTACCACCA GCCTGTCCGA CGATCGCGTC

301 CATCCCGCCC ACGCGCTCAA GTTCTACGCC AAACTGCGCG AAACCTCCGC

351 GCAATCTTGG CTCTACTCGC CTGACGGCGG CGGCCATACC GGCAACGGCA

401 CCCAACGCGA ATCCGCCGAC GAACTCGCCT GCGTCTTGCT GTTTTTGAAA

451 GAGTTTTTGG GCTAA
```

This corresponds to the amino acid sequence <SEQ ID 156; ORF 041>:

```
m041.pep
    1 ISSPEHIGLQ GGSNGGLITA AAFVREPQSI GALVCEVPLT MIRYPLLSAD

51 GSSWTDEYGN PQKYEVCKRR LGELSPYHNL SDGIDYPPAL ITTSLSDDRV

101 HPAHALKFYA KLRETSAQSW LYSPDGGGHT GNGTQRESAD ELACVLLFLK

151 EFLG*
```

The following partial DNA sequence was identified in *N. meningitidis* <SEQ ID 157>:

```
a041.seq
    1 ATCAGTTCGC CCGAACACAT CGGCTTGCAG GGCGGCAGCA ACGGCGGACT

51 GATTACTGCC GCCGCCTTCG TGCGCGAACC GCAAAGCATA GGCGCGCTGG

101 TGTGCGAAGT GCCGCTGACC GACATGATCC GTTATCCGCT GCTCTCCGCC

151 GGTTCAAGCT GGACAGACGA ATACGGCAAT CCGCAAAAAT ACGAAGTCTG

201 CAAACGCCGG TTGGGCGAAT TGTCGCCGTA TCACAATCTT TCAGACGGCA

251 TCGATTATCC GCCCGCGCTC ATTACCACCA GCCTGTCCGA CGATCGCGTC

301 CATCCCGCCC ACGCGCTCAA GTTCTACGCC AAACTGCGCG AAACCTCGCC

351 GCAATCTTGG CTCTACTCGC CTGACGGCGG CGGCCATACC GGCAACGGCA

401 CGCAGCGCGA AGCCGCCGAC GAACTCGCCT GCGTGTTGCT GTTTTTGAAA

451 GAGTTTTTGG GCTAA
```

This corresponds to the amino acid sequence <SEQ ID 158; ORF 041.a>:

```
a041.pep
  1 ISSPEHIGLQ GGSNGGLITA AAFVREPQSI GALVCEVPLT DMIRYPLLSA

51 GSSWTDEYGN PQKYEVCKRR LGELSPYHNL SDGIDYPPAL ITTSLSDDRV

101 HPAHALKFYA KLRETSPQSW LYSPDGGGHT GNGTQREAAD ELACVLLFLK

151 EFLG*
``` m041/a041 98.7% identity over a 154 aa overlap

```
                    10         20         30         40         50         60
       m041.pep ISSPEHIGLQGGSNGGLITAAAFVREPQSIGALVCEVPLTDMIRYPLLSAGSSWTDEYGN
                ||||||||||||||||||||||||||||||||||||||||||||||||||||||||||||
       a041     ISSPEHIGLQGGSNGGLITAAAFVREPQSIGALVCEVPLTDMIRYPLLSAGSSWTDEYGN
                    10         20         30         40         50         60
                    70         80         90        100        110        120
       m041.pep PQKYEVCKRRLGELSPYHNLSDGIDYPPALITTSLSDDRVHPAHALKFYAKLRETSAQSW
                |||||||||||||||||||||||||||||||||||||||||||||||||||||||| |||
       a041     PQKYEVCKRRLGELSPYHNLSDGIDYPPALITTSLSDDRVHPAHALKFYAKLRETSPQSW
                    70         80         90        100        110        120
                   130        140        150
       m041.pep LYSPDGGGHTGNGTQRESADELACVLLFLKEFLGX
                ||||||||||||||||||||:||||||||||||||
       a041     LYSPDGGGHTGNGTQREAADELACVLLFLKEFLGX
                   130        140        150
```

Computer analysis of this amino acid sequence gave the following results:

Homology with a Predicted ORF from *N. gonorrhoeae*

ORF 041 shows 96.8% identity over a 154 aa overlap with a predicted ORF (ORF 041.ng) from *N. gonorrhoeae*:

```
       m041/g041
                    10         20         30         40         50         60
       m041.pep ISSPEHIGLQGGSNGGLITAAAFVREPQSIGALVCEVPLTDMIRYPLLSAGSSWTDEYGN
                :|||:|||||||||||||||||||||||||||||||||||||||||||||||||||||||
       g041     MSSPKHIGLQGGSNGGLITAAAFVREPQSIGALVCEVPLTDMIRYPLLSAGSSWTDEYGN
                    10         20         30         40         50         60
                    70         80         90        100        110        120
       m041.pep PQKYEVCKRRLGELSPYHNLSDGIDYPPALITTSLSDDRVHPAHALKFYAKLRETSAQSW
                |||||:||||||||||||||||||||||||||||||||||||||||||||||||| |||
       g041     PQKYEACKRRLGELSPYHNLSDGIDYPPALITTSLSDDRVHPAHALKFYAKLRETSPQSW
                    70         80         90        100        110        120
                   130        140        150
       m041.pep LYSPDGGGHTGNGTQRESADELACVLLFLKEFLGX
                |||||||||||||||||||||:|||||||||||||
       g041     LYSPDGGGHTGNGTQRESADKLACVLLFLKEFLGX
                   130        140        150
```

The following partial DNA sequence was identified in *N. gonorrhoeae* <SEQ ID 159>:

```
g041-1.seq
  1 ATGAAATCCT ACCCCGACCC CTACCGCCAT TTTGAAAACC TCGATTCCGC

51 CGAAACGCAA AACTTCGCTG CTGAAGCGAA TGCCGAAACG CGCGCGCGTT

101 TTTTAAACAA CGACAAGGCG CGCGCACTTT CAGACGGCAT TTTGAATCAA

151 ATGCAGGACA CGCGGCAGAT TCCGTTTTGT CAGGAACACC GCGCGCGGAT

201 GTACCATTTC CATCAGAATG CGGAATATCC GAAGGGCGTG TACCGCATGT

251 GTACGGCGGC GACCTACCGT TCCGGCTATC CCGAGTGGAA AATCCTGTTT

301 TCGGTGGCGG ATTTCGATGA GTTGCTCGGC GACGATGTGT ATTTGGGCGG
```

-continued

```
 351 CGTGTCGCAC TTGGTGGAGC AGCCCAACCG CGCGCTGCTG ACTTTGAACA
 401 AATCGGGCGG CGATACGGCG TATACGCTGG AAGTGGATTT GGAAGCAGGG
 451 GAATTGGTAG AGGGCGGTTT TCACTTTCCG GCAGGCAAAA ACCATGTGTC
 501 GTGGCGCGAT GAAAACAGCG TGTGGGTGTG TCCGGCTTGG GACGAACGCC
 551 AGTTGACCGA ATCGGGCTAT CCGCGCGAAG TGTGGCTGGT GGAACGCGGC
 601 AAGAGTTTCG AGGAAAGCCT GCCGGCGTAC CAAATCGATA AAGGCGCGAT
 651 GATGGTAAAC GCGTGGCGTT ACCTCGATCC GCAGGGTTCG CCGATTGATT
 701 TGATTGAAGC GTCGGACGGT TTTTACACCA AGACGTATTT GCAGGTGTCG
 751 TCCGAAGGCG GGGCGAAACC GTTGAACCTG CCTAATGATT GCGATGTGGT
 801 CGGCTATCTG GCGGGACATC TTTTGCTGAC GCTGCGCAAG GACTGGCACC
 851 GCGCGAACCA AAGCTATCCG AGTGGCGCGT TGGTGGCGGT GAAACTGAAT
 901 CGGGGCGAAC TCGGGCGGC GCAGCTTTTG TTTGCGCCCG ATGAAACGCA
 951 GGCATTGGAA AGCGTGGAAA CGACCAAGCG TTTTGTGGTG GCAAGCCTGC
1001 TGGAGAATGT ACAAGGCCGT CTGAAAGCGT GGCGGTTTGC CGACAGCAAA
1051 TGGCAGGAAG CCGAGTTGCC GCACCTGCCC TCGGGCGCGT TGGAAATGAC
1101 CGACCAACCG TGGGGCGGCG ACGTGGTTTA TCTTGCCGCC AGCGATTTCA
1151 CCACGCCGCT GACGCTGTTT GCGCTGGATT TGAACGTGAT GGAACTGACC
1201 GTCATGCGCC TCCAGCCGCA GCAGTTTGTT TCAGACGGCA TCGAAGTGCG
1251 GCAGTTTTGG GCGGTGTCGT CCGACGGCGA ACGCATTCCT TATTTCCACG
1301 TCGGCAAAAA CGCCGCGCCC GACACGCCGA CCTTAGTCTA TGCTTACGGA
1351 GGTTTCGGCA TTCCTGAATT GCCGCATTAT CTGGGCAGCG TCGGCAAATA
1401 TTGGCTGGAA GAGGGCAATG CCTTTGTATT GGCAAACATC CGCGGCGGCG
1451 GAGAATTCGG CCCGCGCTGG CATCAGGCGG CGCAGGGAAT CAGCAAACAC
1501 AAAAGCGTTG ATGATTTGTT GGCAGTCGTG CGTGATTTGT CCGAACGCGG
1551 CATGAGTTCG CCCAAACACA TCGGCTTGCA GGGCGGCAGC AACGGCGGCC
1601 TGATTACCGC CGCCGCCTTC GTGCGCGAAC CGCAAAGCAT CGGTGCGCTG
1651 GTGTGCGAAG TACCGCTGAC CGATATGATC CGTTATCCGC TGCTGTCCGC
1701 CGGTTCAAGT TGGACGGACG AATACGGCAA TCCGCAGAAA TACGAAGCCT
1751 GCAAACGCCG GCTGGGCGAA TTGTCGCCGT ATCACAATCT TTCAGACGGC
1801 ATCGATTATC CGCCCGCACT CATTACCACC AGCCTCAGCG ACGACCGCGT
1851 CCATCCCGCC CACGCGCTCA AATTCTACGC CAAACTGCGC GAAACCTCGC
1901 CGCAATCTTG GCTCTACTCG CCTGACGGCG GCGGCCATAC CGGCAACGGC
1951 ACCCAACGCG AATCCGCCGA CAAACTCGCC TGCGTGTTGC TGTTTTTGAA
2001 AGAATTTTTG GGATAA
```

This corresponds to the amino acid sequence <SEQ ID 160; ORF 041-1.>:

```
g041-1.pep
   1 MKSYPDPYRH FENLDSAETQ NFAAEANAET RARFLNNDKA RALSDGILNQ

51 MQDTRQIPFC QEHRARMYHF HQNAEYPKGV YRMCTAATYR SGYPEWKILF

101 SVADFDELLG DDVYLGGVSH LVEQPNRALL TLNKSGGDTA YTLEVDLEAG
```

-continued

```
151 ELVEGGFHFP AGKNHVSWRD ENSVWVCPAW DERQLTESGY PREVWLVERG

201 KSFEESLPAY QIDKGAMMVN AWRYLDPQGS PIDLIEASDG FYTKTYLQVS

251 SEGGAKPLNL PNDCDVVGYL AGHLLLTLRK DWHRANQSYP SGALVAVKLN

301 RGELGAAQLL FAPDETQALE SVETTKRFVV ASLLENVQGR LKAWRFADSK

351 WQEAELPHLP SGALEMTDQP WGGDVVYLAA SDFTTPLTLF ALDLNVMELT

401 VMRLQPQQFV SDGIEVRQFW AVSSDGERIP YFHVGKNAAP DTPTLVYAYG

451 GFGIPELPHY LGSVGKYWLE EGNAFVLANI RGGGEFGPRW HQAAQGISKH

501 KSVDDLLAVV RDLSERGMSS PKHIGLQGGS NGGLITAAAF VREPQSIGAL

551 VCEVPLTDMI RYPLLSAGSS WTDEYGNPQK YEACKRRLGE LSPYHNLSDG

601 IDYPPALITT SLSDDRVHPA HALKFYAKLR ETSPQSWLYS PDGGGHTGNG

651 TQRESADKLA CVLLFLKEFL G*
```

The following partial DNA sequence was identified in *N. meningitidis* <SEQ ID 161>:

```
m041-1.seq
   1 ATGAAATCCT ACCCCGACCC CTACCGCCAT TTTGAAAACC TCGATTCCGC

51 CGAAACGCAA AACTTCGCTG CTGAAGCGAA TGCCGAAACG CGCGCGCGTT

101 TTTTAGAAAA CGACAAGGCG CGCGCGCTTT CAGACGGCAT TTTGGCGCAG

151 TTGCAGGACA CGCGGCAGAT TCCGTTTTGT CAGGAACACC GCGCGCGGAT

201 GTACCATTTC CATCAGGACG CGGAGTATCC GAAGGGCGTG TACCGCGTGT

251 GTACCGCGGC GACGTATCGT TCCGGCTATC CCGAGTGGAA AATCCTGTTT

301 TCGGTGGCGG ATTTCGACGA ATTGCTTGGC GACGATGTGT ATTTGGGCGG

351 CGTGTCGCAC TTGGTGGAAC AGCCCAACCG CGCGTTGTTA ACACTGAGCA

401 AATTGGGCAG CGATACGGCG TACACGCTGG AAGTGGATTT GGAAGCAGGG

451 GAGTTGGTCG AAGGCGGTTT TCACTTTCCG GCAGGCAAAA ACCATGTGTC

501 GTGGCGCGAT GAAAACAGCG TGTGGGTGTG TCCGGCTTGG AACGAACGCC

551 AGTTGACCCA ATCGGGCTAT CCGCGCGAAG TATGGCTGGT GGAACGCGGC

601 AAGAGTTTCG AGGAAAGCCT GCCTGTGTAT CAAATCGGCG AAGACGGCAT

651 GATGGTGAAC GCGTGGCGTT ATCTCGATCC GCAGGGTTCG CCGATTGATT

701 TGATTGAAGC GTCGGACGGT TTTTACACCA AAACCTATTT GCGGGTCTCA

751 GCCGAAGGCG AGGCGAAACC GTTAAACCTG CCCAACGATT GCGACGTGGT

801 CGGCTATCTG GCGGGGCATC TTTTGCTGAC GCTGCGCAAG GACTGGAACC

851 GCGCGAACCA AAGCTATCCG AGCGGCGCGC TGGTGGCGGT GAAGCTGAAT

901 CGGGGCGAAC TCGGGGCGGC GCAGCTTTTG TTTGCGCCCG ATGAAACGCA

951 GGCATTGGAA AGCGTGGAAA CGACCAAGCG TTTTGTGGTG GCGAGCCTGT

1001 TGGAGAACGT ACAAGGCCGT CTGAAAGCAT GGCGGTTTGC CGACGGCAAA

1051 TGGCAGGAAG TCGAATTGCC GCGCCTGCCT TCGGGCGCGT TGGAAATGAC

1101 CGACCAACCT TGGGGCGGCG ACGTGGTTTA CCTTGCCGCC AGCGATTTCA

1151 CCACGCCGCT GACGCTGTTT GCGCTGGATT TGAACGTGAT GGAACTGACC

1201 GTCATGCGCC GCCAGCCGCA GCAGTTTGAT TCAGACGGCA TTAACGTGCA

1251 GCAGTTTTGG ACGACTTCGG CTGACGGCGA GCGCATTCCT TATTTCCACG
```

```
1301 TCGGCAAAAA CGCCGCGCCC GACATGCCGA CGCTGGTCTA TGCCTACGGC

1351 GGTTTCGGCA TTCCCGAATT GCCGCATTAT CTGGGCAGCA TTGGCAAATA

1401 TTGGCTGGAA GAGGGCAATG CCTTTGTATT GGCGAACATC CGCGGCGGCG

1451 GCGAGTTCGG CCCGCGCTGG CATCAGGCGG CGCAGGGAAT CAGCAAACAT

1501 AAAAGCGTTG ATGATTTATT GGCAGTCGTG CGCGATTTGT CCGAACGCGG

1551 TATCAGTTCG CCCGAACACA TCGGCTTGCA GGGCGGCAGC AACGGCGGAC

1601 TGATTACTGC CGCCGCCTTC GTGCGCGAAC CGCAAAGCAT CGGCGCGCTG

1651 GTGTGCGAAG TGCCGCTGAC CGACATGATC CGTTATCCGC TGCTCTCCGC

1701 CGGTTCAAGC TGGACAGACG AATACGGCAA TCCGCAAAAA TACGAAGTCT

1751 GCAAACGCCG GTTGGGCGAA TTGTCGCCGT ATCACAATCT TTCAGACGGC

1801 ATCGATTATC CGCCCGCGCT CATTACCACC AGCCTGTCCG ACGATCGCGT

1851 CCATCCCGCC CACGCGCTCA AGTTCTACGC CAAACTGCGC GAAACCTCCG

1901 CGCAATCTTG GCTCTACTCG CCTGACGGCG GCGGCCATAC CGGCAACGGC

1951 ACCCAACGCG AATCCGCCGA CGAACTCGCC TGCGTCTTGC TGTTTTTGAA

2001 AGAGTTTTTG GGCTAA
```

This corresponds to the amino acid sequence <SEQ ID 162; ORF 041-1>:

```
m041-1.pep

1 MKSYPDPYRH FENLDSAETQ NFAAEANAET RARFLENDKA RALSDGILAQ

51 LQDTRQIPFC QEHRARMYHF HQDAEYPKGV YRVCTAATYR SGYPEWKILF

101 SVADFDELLG DDVYLGGVSH LVEQPNRALL TLSKLGSDTA YTLEVDLEAG

151 ELVEGGFHFP AGKNHVSWRD ENSVWVCPAW NERQLTQSGY PREVWLVERG

201 KSFEESLPVY QIGEDGMMVN AWRYLDPQGS PIDLIEASDG FYTKTYLRVS

251 AEGEAKPLNL PNDCDVVGYL AGHLLLTLRK DWNRANQSYP SGALVAVKLN

301 RGELGAAQLL FAPDETQALE SVETTKRFVV ASLLENVQGR LKAWRFADGK

351 WQEVELPRLP SGALEMTDQP WGGDVVYLAA SDFTTPLTLF ALDLNVMELT

401 VMRRQPQQFD SDGINVQQFW TTSADGERIP YFHVGKNAAP DMPTLVYAYG

451 GFGIPELPHY LGSIGKYWLE EGNAFVLANI RGGGEFGPRW HQAAQGISKH

501 KSVDDLLAVV RDLSERGISS PEHIGLQGGS NGGLITAAAF VREPQSIGAL

551 VCEVPLTDMI RYPLLSAGSS WTDEYGNPQK YEVCKRRLGE LSPYHNLSDG

601 IDYPPALITT SLSDDRVHPA HALKFYAKLR ETSAQSWLYS PDGGGHTGNG

651 TQRESADELA CVLLFLKEFL G* m041-1/g041-1 94.6% identity in 671 aa overlap 10         20         30         40         50         60
m041-1.pep  MKSYPDPYRHFENLDSAETQNFAAEANAETRARFLENDKARALSDGILAQLQDTRQIPFC
            ||||||||||||||||||||||||||||||||||||:||||||||||||:|:||||||||
g041-1      MKSYPDPYRHFENLDSAETQNFAAEANAETRARFLNNDKARALSDGILNQMQDTRQIPFC
                 10         20         30         40         50         60

70         80         90        100        110        120
m041-1.pep  QEHRARMYHFHQDAEYPKGVYRVCTAATYRSGYPEWKILFSVADFDELLGDDVYLGGVSH
            ||||||||||:|||||||||||:|||||||||||||||||||||||||||||||||||||
g041-1      QEHRARMYHFHQNAEYPKGVYRMCTAATYRSGYPEWKILFSVADFDELLGDDVYLGGVSH
                 70         80         90        100        110        120
```

```
                     130       140       150       160       170       180
m041-1.pep  LVEQPNRALLTLSKLGSDTAYTLEVDLEAGELVEGGFHFPAGKNHVSWRDENSVWVCPAW
            ||||||||||||:|  |:||||||||||||||||||||||||||||||||||||||||||
g041-1      LVEQPNRALLTLNKSGGDTAYTLEVDLEAGELVEGGFHFPAGKNHVSWRDENSVWVCPAW
                     130       140       150       160       170       180

190       200       210       220       230       240
m041-1.pep  NERQLTQSGYPREVWLVERGKSFEESLPVYQIGEDGMMVNAWRYLDPQGSPIDLIEASDG
            :||||:|||||||||||||||||||||||:||| : :|||||||||||||||||||||||
g041-1      DERQLTESGYPREVWLVERGKSFEESLPAYQIDKGAMMVNAWRYLDPQGSPIDLIEASDG
                     190       200       210       220       230       240

250       260       270       280       290       300
m041-1.pep  FYTKTYLRVSAEGEAKPLNLPNDCDVVGYLAGHLLLTLRKDWNRANQSYPSGALVAVKLN
            |||||||:||::||:|||||||||||||||||||||||||||||:||||||||||||||
g041-1      FYTKTYLQVSSEGGAKPLNLPNDCDVVGYLAGHLLLTLRKDWHRANQSYPSGALVAVKLN
                     250       260       270       280       290       300

310       320       330       340       350       360
m041-1.pep  RGELGAAQLLFAPDETQALESVETTKRFVVASLLENVQGRLKAWRFADGKWQEVELPRLP
            |||||||||||||||||||||||||||||||||||||||||||||||:||||:|||:||
g041-1      RGELGAAQLLFAPDETQALESVETTKRFVVASLLENVQGRLKAWRFADSKWQEAELPHLP
                     310       320       330       340       350       360

370       380       390       400       410       420
m041-1.pep  SGALEMTDQPWGGDVVYLAASDFTTPLTLFALDLNVMELTVMRRQPQQFDSDGINVQQFW
            |||||||||||||||||||||||||||||||||||||||||||:||||:|:|||:|||
g041-1      SGALEMTDQPWGGDVVYLAASDFTTPLTLFALDLNVMELTVMRLQPQQFVSDGIEVRQFW
                     370       380       390       400       410       420

430       440       450       460       470       480
m041-1.pep  TTSADGERIPYFHVGKNAAPDMPTLVYAYGGFGIPELPHYLGSIGKYWLEEGNAFVLANI
            ::|:|||||||||||||||||:||||||||||||||||||||||:|||||||||||||||
g041-1      AVSSDGERIPYFHVGKNAAPDTPTLVYAYGGFGIPELPHYLGSVGKYWLEEGNAFVLANI
                     430       440       450       460       470       480

490       500       510       520       530       540
m041-1.pep  RGGGEFGPRWHQAAQGISKHKSVDDLLAVVRDLSERGISSPEHIGLQGGSNGGLITAAAF
            ||||||||||||||||||||||||||||||||||||||:||||:||||||||||||||||
g041-1      RGGGEFGPRWHQAAQGISKHKSVDDLLAVVRDLSERGMSSPKHIGLQGGSNGGLITAAAF
                     490       500       510       520       530       540

550       560       570       580       590       600
m041-1.pep  VREPQSIGALVCEVPLTDMIRYPLLSAGSSWTDEYGNPQKYEVCKRRLGELSPYHNLSDG
            ||||||||||||||||||||||||||||||||||||||||||:||||||||||||||||
g041-1      VREPQSIGALVCEVPLTDMIRYPLLSAGSSWTDEYGNPQKYEACKRRLGELSPYHNLSDG
                     550       560       570       580       590       600

610       620       630       640       650       660
m041-1.pep  IDYPPALITTSLSDDRVHPAHALKFYAKLRETSAQSWLYSPDGGGHTGNGTQRESADELA
            |||||||||||||||||||||||||||||||| ||||||||||||||||||||||:||
g041-1      IDYPPALITTSLSDDRVHPAHALKFYAKLRETSPQSWLYSPDGGGHTGNGTQRESADKLA
                     610       620       630       640       650       660

670
m041-1.pep  CVLLFLKEFLGX
            ||||||||||||
g041-1      CVLLFLKEFLGX
                     670 m041-1/P55577
sp|P55577|Y4NA_RHISN PROBABLE PEPTIDASE Y4NA > gi|2182536 (AE000086) Y4nA [Rhizobium sp.
NGR234] Length = 726
Score = 370 bits (940), Expect = e-101
Indentities = 217/682 (31%), Positives = 331/682 (47%), Gaps = 22/682 (3%)

Query:   2 KSYPDPYRHFENLDSAETQNFAAEANAETRARFLENDKARALSDGILAQLQDTRQIPFCQ  61
             K  DP  +  +D +   +    N  T + ++ +         L   LQ T  +I
Sbjct:  42 KDASDPRAYLNEIDGDKAMTWVEAHNLATSTVDKLSKDPRYSEYQADALTILQATDRIASPS 101

Query:  62 EHRARMY-HFHQDAEYPKGVYRVCTAATYRSGYPEWKILFSVADFDELLGDDVYLGGVSH 120
             R  M  +F QD + +G++R  T  +YRSG P+W+    V   +     G     G
Sbjct: 102 FARDGMIDNFWQDGTHVQGLWRRTTWESYRSGNPQWRTILDVDALSKAEGKTWVFEGGDC 161

Query: 121 LVEQPNRALLTLSKLGSDTAYTLEVDLEAGELVEGGFHFPAGKNHVSWRDENSVWVCPAW 180
             L   N  L+  S  G  D    E D+  GE V+   GF  P GK  V+W DEN+++V  W
Sbjct: 162 LPPTSNLCLIRLSDGGKDADVVREFDIAKGEFVKEGFVLPEGKQSVTWVDENTIYVTREW 221

Query: 181 NERQLTQSGYPREVWLVERGKSFEESLPVYQ------IGEDGMM--VNAWRYLDPQGSPI 232
              ++T SGY     +V+RG+S ++++     +    E G++   ++     +D
Sbjct: 222 TPGEVTSSGYAYVTKVVKRGQSLDQAVEIFRGQKKDVSAERGVLRDIDGKYVMDTSYRGL 281

Query: 233 DLIEASDGFYTKTYLRVSAEGEAKPLNLPNDCDVVGYLAGHLLLTLRKDWNRANQS-YPS 291
            D          FY +   +  L LP   GY    G   +   L+ DW A +     +
Sbjct: 282 DFFNTELAFYPNGH----PDTRKVVLPLPTTAVFSGYYKGQAIYWLKSDWTSAKGTVFHN 337

Query: 292 GALVAVKLNRGELGAAQL----LFAPDETQALESVETTKRFVVASLLENVQGRLKAWRFA 347
            GA++A    L      A++    LF P+E Q++     TK +V S+L NV    ++++ F
Sbjct: 338 GAIIAFDLKAALADPARVEPLVLFMPNEHQSVAGTTQTKNRLVLSILSNVTSEVRSPDFG 397

Query: 348 DGKWQEVELPRLPSGALEMTDQPWGGDVVYLAASDFTTPLTLFALDLNVMELTVMRRQPQ 407
             G W   +L + L +T   D +++ + F P TLF D   ++ +    P
Sbjct: 398 KGGWSSFKLALPENSTLSLTSSDDESDQLVFSEGFLEPSTLFCADAATGQVEKITSPA 457
```

-continued

```
Query: 408 QFDSDGINVQQFWTTSADGERIPYFHVGKNAAP---DMPTLVYAYGGFGIPELPHYLGSI 464
           +FD+ G+  QQFW TS DG ++PYF V +         PT++YAYGGF IP  P Y   +
Sbjct: 458 RFDAGGLQAQQFWATSKDGTKVPYFLVARKDVKLDGTNPTILYAYGGFQIPMQPSYSAVL 517

Query: 465 GKYWLEEGNAFVLANIRGGGEFGPRWHQAAQGISKHKSVDDLLAVVRDLSERGISSPEHI 524
           GK WLE+G A+ LANIRGGGEFGP+WH A    ++ +  DD  AV +DL  + ++S  H+
Sbjct: 518 GKLWLEKGGAYALANIRGGGEFGPKWHDAGLKTNRQRVYDDFQAVAQDLIAKKVTSTPHL 577

Query: 525 GLQGGSNGGLITAAAFVREPQSIGALVCEVPLTDMIRYPLLSAGSSWTDEYGNPQKYEVC 584
           G+ GGWSNGGL+    ++ P    A+V +VPL DM+ +   +SAG+SW  EYG+P    V
Sbjct: 578 GIMGGSNGGLLMGVQMIQRPDLWNAVVIQVPLLDMVNFTRMSAGASWQAEYGSPDD-PVE 636

Query: 585 KRRLGELSPYHNLSDGIDYPPALITTSLSDDRVHPAHALKFYAKLRETSAQSWLYSPDGG 644
              L  +SPYHN   G+ YP      TS  DDRV P HA K  A   +     + Y    G
Sbjct: 637 GAFLRSISPYHNVKAGVAYPEPFFETSTKDDRVGPVHARKMAALFEDMGLPFYYYENIEG 696

Query: 645 GHTGNGTQRESADELACVLLFL                                        666
           GH      +E A      +++
Sbjct: 697 GHAAAANLQEHARRYALEYIYM                                        718
```

The following partial DNA sequence was identified in *N. meningitidis* <SEQ ID 163>:

```
a041-1.seq
   1 ATGAAATCCT ACCCCGACCC CTACCGCCAT TTTGAAAACC TCGATTCCGC
  51 CGAAACGCAA AACTTCGCTG CTGAAGCGAA TGCCGAAACG CGCGCGCGTT
 101 TTTTAAACAA CGACAAGGCA CGCGCATTGT CTGACGGCAT TTTGGCGCAG
 151 TTGCAGGACA CGCGGCAAAT TCCGTTTTGT CAGGAACACC GCGCGCGGAT
 201 GTACCATTTC CATCAAGATG CGGAATATCC GAAAGGCGTG TACCGCGTGT
 251 GTACCGCGGC GACTTACCGT TCGGGCTATC CTGAGTGGAA AATCCTGTTT
 301 TCGGTGGCGG ATTTCGACGA ATTGCTCGGT GACGATGTAT ATCTAGGCGG
 351 CGTGTCGCAC CTGGTGGAAC AGCCCAACCG CGCGTTGTTA ACACTGAGCA
 401 AATCGGGCGG CGATACCGCG TACACGCTGG AAGTGGATTT GGAAGCAGGG
 451 GAGTTGGTAG AAGGCGGTTT TCACTTTCCG GCAGGCAAAA ACCATGTGTC
 501 GTGGCGCGAT GAAAACAGCG TGTGGGTGTG TCCGGCTTGG GACGAACGCC
 551 AGTTGACCGA ATCGGGCTAT CCGCGCGAGG TGTGGCTGGT GGAACGCGGC
 601 AAGAGTTTCG AGGAAAGCCT GCCGGTGTAC CAAATTGCTG AAGACGGCAT
 651 GATGGTGAAC GCGTGGCGTT ACCTCGATCC GCAGGGTTCG CCGATTGATT
 701 TGATTGAAGC GTCTGACGGT TTTTACACCA AAACCTATTT GCAGGTCTCA
 751 GCCGAAGGCG AAGCGAAACC GTTAAACCTG CCCAACGATT GCGACGTAGT
 801 CGGCTATCTG GCCGGACATC TTTTGCTGAC CTTGCGTAAA GACTGGCACC
 851 GCGCGAACCA AAGCTATCCG AGTGGCGCAT TGGTAGCAGT AAAATTAAAC
 901 CGCGGCGAAT TGGGCGCGGC GCAGCTTTTG TTTGCGCCCA ATGAAACGCA
 951 GGCATTGGAA AGCGTGGAAA CGACCAAGCG TTTTGTCGTG GCGAGCCTGC
1001 TGGAAAACGT ACAGGGTCGT CTGAAAGCGT GGCGTTTTAC TGATGGCAAA
1051 TGGCAGGAAA CCGAGTTGCC GCGCCTGCCT TCGGGCGCGT TGGAAATGAC
1101 CGACCAACCG TGGGGGGGCG ACGTAGTTTA CCTTGCCGCC AGCGATTTCA
1151 CCACGCCGCT GACGCTGTTT GCATTGGATT TGAACGTGAT GGAACTGACC
1201 GTCATGCGCC GCCAGCCGCA GCAGTTTGAT TCAGACGGCA TTAACGTGCA
1251 GCAGTTTTGG ACGACTTCGG CTGACGGCGA GCGCATTCCT TATTTCCACG
1301 TCGGCAAAAA CGCCGCGCCC GACATGCCGA CGCTGGTCTA TGCCTACGGC
1351 GGTTTCGGCA TTCCCGAATT GCCGCATTAT CTGGGCAGCA TTGGCAAATA
1401 TTGGCTGGAA GAGGGCAATG CCTTTGTATT GGCGAACATC CGCGGCGGCG
```

-continued

```
1451 GCGAGTTCGG CCCGCGCTGG CATCAGGCGG CGCAGGGAAT CAGCAAACAT

1501 AAAAGCGTTG ATGATTTATT GGCAGTCGTG AGCGATTTGT CCGAACGCGG

1551 TATCAGTTCG CCCGAACACA TCGGCTTGCA GGGCGGCAGC AACGGCGGAC

1601 TGATTACTGC CGCCGCCTTC GTGCGCGAAC CGCAAAGCAT AGGCGCGCTG

1651 GTGTGCGAAG TGCCGCTGAC CGACATGATC CGTTATCCGC TGCTCTCCGC

1701 CGGTTCAAGC TGGACAGACG AATACGGCAA TCCGCAAAAA TACGAAGTCT

1751 GCAAACGCCG GTTGGGCGAA TTGTCGCCGT ATCACAATCT TTCAGACGGC

1801 ATCGATTATC CGCGCGCGTT CATTACCACC AGCCTGTCCG ACGATCGCGT

1851 CCATCCCGCC CACGCGCTCA AGTTCTACGC CAAACTGCGC GAAACCTCGC

1901 CGCAATCTTG GCTCTACTCG CCTGACGGCG GCGGCCATAC CGGCAACGGC

1951 ACGCAGCGCG AAGCCGCCGA CGAACTCGCC TGCGTGTTGC TGTTTTTGAA

2001 AGAGTTTTTG GGCTAA
```

This corresponds to the amino acid sequence <SEQ ID 164; ORF 041-1.a>:

```
a041-1.pep

1 MKSYPDPYRH FENLDSAETQ NFAAEANAET RARFLNNDKA RALSDGILAQ

51 LQDTRQIPFC QEHRARMYHF HQDAEYPKGV YRVCTAATYR SGYPEWKILF

101 SVADFDELLG DDVYLGGVSH LVEQPNRALL TLSKSGGDTA YTLEVDLEAG

151 ELVEGGFHFP AGKNHVSWRD ENSVWVCPAW DERQLTESGY PREVWLVERG

201 KSFEESLPVY QIAEDGMMVN AWRYLDPQGS PIDLIEASDG FYTKTYLQVS

251 AEGEAKPLNL PNDCDVVGYL AGHLLLTLRK DWHRANQSYP SGALVAVKLN

301 RGELGAAQLL FAPNETQALE SVETTKRFVV ASLLENVQGR LKAWRFTDGK

351 WQETELPRLP SGALEMTDQP WGGDVVYLAA SDFTTPLTLF ALDLNVMELT

401 VMRRQPQQFD SDGINVQQFW TTSADGERIP YFHVGKNAAP DMPTLVYAYG

451 GFGIPELPHY LGSIGKYWLE EGNAFVLANI RGGGEFGPRW HQAAQGISKH

501 KSVDDLLAVV SDLSERGISS PEHIGLQGGS NGGLITAAAF VREPQSIGAL

551 VCEVPLTDMI RYPLLSAGSS WTDEYGNPQK YEVCKRRLGE LSPYHNLSDG

601 IDYPPALITT SLSDDRVHPA HALKFYAKLR ETSPQSWLYS PDGGGHTGNG

651 TQREAADELA CVLLFLKEFL G* a041-1/m041-1  97.9% identity in 671 aa overlap 10         20         30         40         50         60
    m041-1.pep  MKSYPDPYRHFENLDSAETQNFAAEANAETRARFLNNDKARALSDGILAQLQDTRQIPFC
                ||||||||||||||||||||||||||||||||||||:|||||||||||||||||||||||
    m041-1      MKSYPDPYRHFENLDSAETQNFAAEANAETRARFLENDKARALSDGILAQLQDTRQIPFC
                     10         20         30         40         50         60

70         80         90        100        110        120
    m041-1.pep  QEHRARMYHFHQDAEYPKGVYRVCTAATYRSGYPEWKILFSVADFDELLGDDVYLGGVSH
                ||||||||||||||||||||||||||||||||||||||||||||||||||||||||||||
    m041-1      QEHRARMYHFHQDAEYPKGVYRVCTAATYRSGYPEWKILFSVADFDELLGDDVYLGGVSH
                     70         80         90        100        110        120

130        140        150        160        170        180
    m041-1.pep  LVEQPNRALLTLSKSGGDTAYTLEVDLEAGELVEGGFHFPAGKNHVSWRDENSVWVCPAW
                ||||||||||||| |:||||||||||||||||||||||||||||||||||||||||||||
    m041-1      LVEQPNRALLTLSKLGSDTAYTLEVDLEAGELVEGGFHFPAGKNHVSWRDENSVWVCPAW
                    130        140        150        160        170        180

190        200        210        220        230        240
    m041-1.pep  DERQLTESGYPREVWLVERGKSFEESLPVYQIAEDGMMVNAWRYLDPQGSPIDLIEASDG
                :|||| :|||||||||||||||||||||||||||:|||||||||||||||||||||||||
    m041-1      NERQLTQSGYPREVWLVERGKSFEESLPVYQIGEDGMMVNAWRYLDPQGSPIDLIEASDG
                    190        200        210        220        230        240
```

```
               250        260        270        280        290        300
m041-1.pep  FYTKTYLQVSAEGEAKPLNLPNDCDVVGYLAGHLLLTLRKDWHRANQSYPSGALVAVKLN
            ||||||:|||||||||||||||||||||||||||||||||:|||||||||||||||||||
m041-1      FYTKTYLRVSAEGEAKPLNLPNDCDVVGYLAGHLLLTLRKDWNRANQSYPSGALVAVKLN
               250        260        270        280        290        300

310        320        330        340        350        360
m041-1.pep  RGELGAAQLLFAPNETQALESVETTKRFVVASLLENVQGRLKAWRFTDGKWQETELPRLP
            |||||||||||||:||||||||||||||||||||||||||||||:||||:|||||||||
m041-1      RGELGAAQLLFAPDETQALESVETTKRFVVASLLENVQGRLKAWRFADGKWQEVELPRLP
               310        320        330        340        350        360

370        380        390        400        410        420
m041-1.pep  SGALEMTDQPWGGDVVYLAASDFTTPLTLFALDLNVMELTVMRRQPQQFDSDGINVQQFW
            ||||||||||||||||||||||||||||||||||||||||||||||||||||||||||||
m041-1      SGALEMTDQPWGGDVVYLAASDFTTPLTLFALDLNVMELTVMRRQPQQFDSDGINVQQFW
               370        380        390        400        410        420

430        440        450        460        470        480
m041-1.pep  TTSADGERIPYFHVGKNAAPDMPTLVYAYGGFGIPELPHYLGSIGKYWLEEGNAFVLANI
            ||||||||||||||||||||||||||||||||||||||||||||||||||||||||||||
m041-1      TTSADGERIPYFHVGKNAAPDMPTLVYAYGGFGIPELPHYLGSIGKYWLEEGNAFVLANI
               430        440        450        460        470        480

490        500        510        520        530        540
m041-1.pep  RGGGEFGPRWHQAAQGISKHKSVDDLLAVVSDLSERGISSPEHIGLQGGSNGGLITAAAF
            |||||||||||||||||||||||||||||||| |||||||||||||||||||||||||||
m041-1      RGGGEFGPRWHQAAQGISKHKSVDDLLAVVRDLSERGISSPEHIGLQGGSNGGLITAAAF
               490        500        510        520        530        540

550        560        570        580        590        600
m041-1.pep  VREPQSIGALVCEVPLTDMIRYPLLSAGSSWTDEYGNPQKYEVCKRRLGELSPYHNLSDG
            ||||||||||||||||||||||||||||||||||||||||||||||||||||||||||||
m041-1      VREPQSIGALVCEVPLTDMIRYPLLSAGSSWTDEYGNPQKYEVCKRRLGELSPYHNLSDG
               550        560        570        580        590        600

610        620        630        640        650        660
m041-1.pep  IDYPPALITTSLSDDRVHPAHALKFYAKLRETSPQSWLYSPDGGHTGNGTQREAADELA
            ||||||||||||||||||||||||||||||||||||||||||||||||||||:||||
m041-1      IDYPPALITTSLSDDRVHPAHALKFYAKLRETSAQSWLYSPDGGHTGNGTQRESADELA
               610        620        630        640        650        660

670
m041-1.pep  CVLLFLKEFLGX
            ||||||||||||
m041-1      CVLLFLKEFLGX
               670
```

The following partial DNA sequence was identified in *N. gonorrhoeae* <SEQ ID 165>:

```
g042.seq
  1  ATGACGATGA TTTGCTTGCG CTTCCAagcG TTCGTGCCGC ATACCAGCGC

51  GTTATCCAAC ACTTCCACGG CAGCCGGCCC TTCCTGCCCG ATGGCGGCGG

101  TGCGGTCGAT GATGAAAATC CAGCCGGGGT TTTTCTCTTT GATGTATTCG

151  AAGGAAACGG GCTGCCCGTG CCCTTCGTTG CGTAAAGATT CGTCCACGGG

201  CGGCAGGCCG ATGTCGCCGT GTATCCAACT TGCCAACCGC GATTGCGTGC

251  CGAAGGCGGA CACCTTGTTG CCTGTAACCG ACAGCACCAG CCCGCGTCCT

301  TTGCCTTTGG cggCTTCGCG CTTTTGGGCG AACAGCGCGT CAATCTGCGC

351  ATTCAATTCC GCCACGCGCG CTTCCTTACC GAAAATCCGC GACAGGGTCT

401  CCATCTGCTT CTCGCCGCTG GTGCGGATAT TGCCGTTGTC CACCGTCAAA

451  TCTATGgtgG TCGCGTTTTT CGCCAACTGT TCATACGCTT CCGCACCCGG

501  CCCGCCGGTA ATGACAAACT GCGGATTGTG GCGGTGCAGG GATTCGCAAT

551  CGGGCTCAAA CAGCGTCCCC ACCGTTGCCG CCTTGTCAAA TGCAGGCTGC

601  AAATAG
```

This corresponds to the amino acid sequence <SEQ ID 166; ORF 042.ng>:

```
g042.pep
  1 MTMICLRFQA FVPHTSALSN TSTAAGPSCP MAAVRSMMKI QPGFFSLMYS

51 KETGCPCPSL RKDSSTGGRP MSPCIQLANR DCVPKADTLL PVTDSTSPRP

101 LPLAASRFWA NSASICAFNS ATRASLPKIR DRVSICFSPL VRILPLSTVK

151 SMVVAFFANC SYASAPGPPV MTNCGLWRCR DSQSGSNSVP TVAALSNAGC

201 K*
```

The following partial DNA sequence was identified in *N. meningitidis* <SEQ ID 167>:

```
m042.seq
  1 ATGACGATGA TTTGCTTGCG CTTCCAAGCG TTCGTGCCGC GTACCAGCGC

51 GTTATCCAmT ACTTCGACAG CCGcCGGCCy TTCyTGCCCG ATGGCGGCGG

101 TACGGTCGAT GATGAAAATC CAATCGGGGT TTTTCTCTTT GATGTATTCG

151 AAGGAAACAG GCTGCCCGTG CACCTTGTTG CGTAAAGATT CGTCTACAGG

201 CGGTAGGCCG ATGTCGCCGT GTATCCAACT TGCCAACCGC GACTGCGTGC

251 CGAAGGCGGA CACCTTGTTG CCCGTAACCG ACAGCACCAG CCCGCGTCCT

301 TTGCCTTTGG CGGCTTCGCG CGTTTGGGCG AACAGCGCGT CAATCTGCGC

351 CTTCAATTCC GCCGCGCGCG CTTCCTTGCC GAAAATCCGC GCCAAGGTCT

401 CCATCTGCTT TTCGCCGCTG GTGCGGATAT TGCCGTTGTC CACCGTCAGA

451 TCTATGGTGG TCGCGTTTTT CGCTAACTGT TCATACGCTT CCGCGCCCGG

501 CCCGCCGGTA ATGACAAGCT GAGGATTGTA GCGGTGCAGG GCTTCGTAAT

551 CGGGCTCGAA CAGCGTCCCC ACCGTTGCCG CCTTGTCAAA TGCAGGCTGC

601 AAATAA
```

This corresponds to the amino acid sequence <SEQ ID 168; ORF 042>:

```
m042.pep
  1 MTMICLRFQA FVPRTSALSX TSTAAGXSCP MAAVRSMMKI QSGFFSLMYS

51 KETGCPCPSL RKDSSTGGRP MSPCIQLANR DCVPKADTLL PVTDSTSPRP

101 LPLAASRVWA NSASICAFNS AARASLPKIR AKVSICFSPL VRILPLSTVR

151 SMVVAFFANC SYASAPGPPV MTSXGLXRCR ASXSGSNSVP TVAALSNAGC

201 K*
```

The following partial DNA sequence was identified in *N. meningitidis* <SEQ ID 169>:

```
a042.seq
  1 ATGACGATGA TTTGCTTGCG CTTCCAAGCG TTCGTGCCGC GTACCAGCGC

51 GTTATCCAAT ACTTCGACAG CCGCCGGCCC TTCCTGCCCG ATGGCGGCGG

101 TACGGTCGAT GATGAAAATC CAATCGGGGT TTTTCTCTTT GATGTATTCG

151 AAGGAAACAG GCTGCCCGTG CACCTTGTTG CGTAAAGATT CGTCTACAGG

201 CGGTAGGCCG ATGTCGCCGT GTATCCAACT TGCCAACCGC GACTGCGTGC

251 CGAAGGCGGA CACCTTGTTG CCCGTAACCG ACAGCACCAG CCCGCGTCCT
```

-continued

```
301 TTGCCTTTGG CGGCTTCGCG CGTTTGGGCG AACAGCGCGT CAATCTGCGC

351 CTTCAATTCC GCCGCGCGCG CTTCCTTGCC GAAAATCCGC GCCAAGGTCT

401 CCATCTGCTT TTCGCCGCTG GTGCGGATAT TGCCGTTGTC CACCGTCAGA

451 TCTATGGTGG TCGCGTTTTT CGCCAACTGT TCATACGCTT CCGCGCCCGG

501 CCCGCCGGTA ATGACAAGCT GAGGATTGTA GCGGTGCAGG GCTTCGTAAT

551 CGGGCTCGAA CAGCGTCCCC ACCGTTGCCG CCTTGTCAAA TGCAGGCTGC

601 AAATAA
```

This corresponds to the amino acid sequence <SEQ ID 170; ORF 042.a>:

```
a042.pep
  1 MTMICLRFQA FVPRTSALSN TSTAAGPSCP MAAVRSMMKI QSGFFSLMYS

51 KETGCPCPSL RKDSSTGGRP MSPCIQLANR DCVPKADTLL PVTDSTSPRP

101 LPLAASRVWA NSASICAFNS AARASLPKIR AKVSICFSPL VRILPLSTVR

151 SMVVAFFANC SYASAPGPPV MTS*GL*RCR AS*SGSNSVP TVAALSNAGC

201 K*
``` m042/a042 99.0% identity over a 201 aa overlap

```
                  10         20         30         40         50         60
    m042.pep  MTMICLRFQAFVPRTSALSXTSTAAGXSCPMAAVRSMMKIQSGFFSLMYSKETGCPCPSL
              |||||||||||||||||||| ||||| |||||||||||||||||||||||||||||||||
        a042  MTMICLRFQAFVPRTSALSNTSTAAGPSCPMAAVRSMMKIQSGFFSLMYSKETGCPCPSL
                  10         20         30         40         50         60

70         80         90        100        110        120
    m042.pep  RKDSSTGGRPMSPCIQLANRDCVPKADTLLPVTDSTSPRPLPLAASRVWANSASICAFNS
              ||||||||||||||||||||||||||||||||||||||||||||||||||||||||||||
        a042  RKDSSTGGRPMSPCIQLANRDCVPKADTLLPVTDSTSPRPLPLAASRVWANSASICAFNS
                  70         80         90        100        110        120

130        140        150        160        170        180
    m042.pep  AARASLPKIRAKVSICFSPLVRILPLSTVRSMVVAFFANCSYASAPGPPVMTSXGLXRCR
              ||||||||||||||||||||||||||||||||||||||||||||||||||||||||||||
        a042  AARASLPKIRAKVSICFSPLVRILPLSTVRSMVVAFFANCSYASAPGPPVMTSXGLXRCR
                 130        140        150        160        170        180

190        200
    m042.pep  ASXSGSNSVPTVAALSNAGCKX
              ||||||||||||||||||||||
        a042  ASXSGSNSVPTVAALSNAGCKX
                 190        200
```

Computer analysis of this amino acid sequence gave the following results:

Homology with a Predicted ORF from *N. gonorrhoeae*

ORF 042 shows 93.0% identity over a 201 aa overlap with a predicted ORF (ORF 042.ng) from *N. gonorrhoeae*:

```
    m042/g042

10         20         30         40         50         60
    m042.pep  MTMICLRFQAFVPRTSALSXTSTAAGXSCPMAAVRSMMKIQSGFFSLMYSKETGCPCPSL
              ||||||||||||| ||||| ||||| ||||||||||||||| ||||||||||||||||||
        g042  MTMICLRFQAFVPHTSALSNTSTAAGPSCPMAAVRSMMKIQPGFFSLMYSKETGCPCPSL
                  10         20         30         40         50         60

70         80         90        100        110        120
    m042.pep  RKDSSTGGRPMSPCIQLANRDCVPKADTLLPVTDSTSPRPLPLAASRVWANSASICAFNS
              |||||||||||||||||||||||||||||||||||||||||||||||| |||||||||||
        g042  RKDSSTGGRPMSPCIQLANRDCVPKADTLLPVTDSTSPRPLPLAASRFWANSASICAFNS
                  70         80         90        100        110        120
```

```
                   130       140       150       160       170       180
m042.pep   AARASLPKIRAKVSICFSPLVRILPLSTVRSMVVAFFANCSYASAPGPPVMTSXGLXRCR
           |:|||||||| :||||||||||||||||:|||||||||||||||||||||||: || |||
g042       ATRASLPKIRDRVSICFSPLVRILPLSTVKSMVVAFFANCSYASAPGPPVMTNCGLWRCR
                   130       140       150       160       170       180

190       200
m042.pep   ASXSGSNSVPTVAALSNAGCKX
            |||||||||||||||||||||
g042       DSQSGSNSVPTVAALSNAGCKX
                   190       200
```

The following partial DNA sequence was identified in *N. meningitidis* <SEQ ID 171>:

```
m042-1.seq
  1  ATGACGATGA TTTGCTTGCG CTTCCAAGCG TTCGTGCCGC GTACCAGCGC

51  GTTATCCAAT ACTTCGACAG CCGCCGGCCC TTCCTGCCCG ATGGCGGCGG

101  TACGGTCGAT GATGAAAATC CAATCGGGGT TTTTCTCTTT GATGTATTCG

151  AAGGAAACAG GCTGCCCGTG CACCTTGTTG CGTAAAGATT CGTCTACAGG

201  CGGTAGGCCG ATGTCGCCGT GTATCCAACT TGCCAACCGC GACTGCGTGC

251  CGAAGGCGGA CACCTTGTTG CCCGTAACCG ACAGCACCAG CCCGCGTCCT

301  TTGCCTTTGG CGGCTTCGCG CGTTTGGGCG AACAGCGCGT CAATCTGCGC

351  CTTCAATTCC GCCGCGCGCG CTTCCTTGCC GAAAATCCGC GCCAAGGTCT

401  CCATCTGCTT TTCGCCGCTG GTGCGGATAT TGCCGTTGTC CACCGTCAGA

451  TCTATGGTGG TCGCGTTTTT CGCTAACTGT TCATACGCTT CCGCGCCCGG

501  CCCGCCGGTA A
```

This corresponds to the amino acid sequence <SEQ ID 172; ORF 042-1>:

```
m042-1.pep

1  MTMICLRFQA FVPRTSALSN TSTAAGPSCP MAAVRSMMKI QSGFFSLMYS

51  KETGCPCPSL RKDSSTGGRP MSPCIQLANR DCVPKADTLL PVTDSTSPRP

101  LPLAASRVWA NSASICAFNS AARASLPKIR AKVSICFSPL VRILPLSTVR

151  SMVVAFFANC SYASAPGPPV MTS*
``` m042-1/g042 95.4% identity in 173 aa overlap

```
                   10         20         30         40         50         60
m042-1.pep MTMICLRFQAFVPRTSALSNTSTAAGPSCPMAAVRSMMKIQSGFFSLMYSKETGCPCPSL
           |||||||||||||:|||||||||||||||||||||||||| |||||||||||||||||||
g042       MTMICLRFQAFVPHTSALSNTSTAAGPSCPMAAVRSMMKIQPGFFSLMYSKETGCPCPSL
                   10         20         30         40         50         60

70         80         90        100        110        120
m042-1.pep RKDSSTGGRPMSPCIQLANRDCVPKADTLLPVTDSTSPRPLPLAASRVWANSASICAFNS
           ||||||||||||||||||||||||||||||||||||||||||||||| ||||||||||||
g042       RKDSSTGGRPMSPCIQLANRDCVPKADTLLPVTDSTSPRPLPLAASRFWANSASICAFNS
                   70         80         90        100        110        120

130        140        150        160        170
m042-1.pep AARASLPKIRAKVSICFSPLVRILPLSTVRSMVVAFFANCSYASAPGPPVMTSX
           |:||||||| :||||||||||||||||:||||||||||||||||||||||||:
g042       ATRASLPKIRDRVSICFSPLVRILPLSTVKSMVVAFFANCSYASAPGPPVMTNCGLWRCR
                130        140        150        160        170        180 g042       DSQSGSNSVPTVAALSNAGCKX
                190        200
```

The following partial DNA sequence was identified in *N. meningitidis* <SEQ ID 173>:

```
a042-1.seq
  1  ATGACGATGA TTTGCTTGCG CTTCCAAGCG TTCGTGCCGC GTACCAGCGC

51  GTTATCCAAT ACTTCGACAG CCGCCGGCCC TTCCTGCCCG ATGGCGGCGG

101  TACGGTCGAT GATGAAAATC AATCGGGGT TTTTCTCTTT GATGTATTCG

151  AAGGAAACAG GCTGCCCGTG CACCTTGTTG CGTAAAGATT CGTCTACAGG

201  CGGTAGGCCG ATGTCGCCGT GTATCCAACT TGCCAACCGC GACTGCGTGC

251  CGAAGGCGGA CACCTTGTTG CCCGTAACCG ACAGCACCAG CCCGCGTCCT

301  TTGCCTTTGG CGGCTTCGCG CGTTTGGGCG AACAGCGCGT CAATCTGCGC

351  CTTCAATTCC GCCGCGCGCG CTTCCTTGCC GAAAATCCGC GCCAAGGTCT

401  CCATCTGCTT TTCGCCGCTG GTGCGGATAT TGCCGTTGTC CACCGTCAGA

451  TCTATGGTGG TCGCGTTTTT CGCCAACTGT TCATACGCTT CCGCGCCCGG

501  CCCGCCGGTA A
```

This corresponds to the amino acid sequence <SEQ ID 174; ORF 042-1.a>:

```
a042-1.pep
    1  MTMICLRFQA FVPRTSALSN TSTAAGPSCP MAAVRSMMKI QSGFFSLMYS

51  KETGCPCPSL RKDSSTGGRP MSPCIQLANR DCVPKADTLL PVTDSTSPRP

101  LPLAASRVWA NSASICAFNS AARASLPKIR AKVSICFSPL VRILPLSTVR

151  SMVVAFFANC SYASAPGPPV MTS* m042-1/a042-1  100.0% identity in 173 aa overlap
                  10         20         30         40         50         60
m042-1.pep  MTMICLRFQAFVPRTSALSNTSTAAGPSCPMAAVRSMMKIQSGFFSLMYSKETGCPCPSL
            ||||||||||||||||||||||||||||||||||||||||||||||||||||||||||||
a042-1      MTMICLRFQAFVPRTSALSNTSTAAGPSCPMAAVRSMMKIQSGFFSLMYSKETGCPCPSL
                  10         20         30         40         50         60
                  70         80         90        100        110        120
m042-1.pep  RKDSSTGGRPMSPCIQLANRDCVPKADTLLPVTDSTSPRPLPLAASRVWANSASICAFNS
            ||||||||||||||||||||||||||||||||||||||||||||||||||||||||||||
a042-1      RKDSSTGGRPMSPCIQLANRDCVPKADTLLPVTDSTSPRPLPLAASRVWANSASICAFNS
                  70         80         90        100        110        120
                 130        140        150        160        170
m042-1.pep  AARASLPKIRAKVSICFSPLVRILPLSTVRSMVVAFFANCSYASAPGPPVMTSX
            |||||||||||||||||||||||||||||||||||||||||||||||||||||
a042-1      AARASLPKIRAKVSICFSPLVRILPLSTVRSMVVAFFANCSYASAPGPPVMTSX
                 130        140        150        160        170
```

The following partial DNA sequence was identified in *N. gonorrhoeae* <SEQ ID 175>:

```
g043.seq
  1  ATGGTTGTTT CAAATCAAAA TATCTATGCC GTCGGCCCAT CAGCACTTTT

51  TCACATCCGA AGGCAAAAAT CCGTAATGCC GCCTGAACGC TTCgttgaAC

101  CGTCCCGCGT ggcggtagcc gcAAAAGTGC ATcGCGGCTT GGATGGTGCT

151  GCCCGATTCG ATGAGGGcga gcGCGTGTTC CAGCCGCAGG CGGCGCAGGC

201  GTCCGGCGAC GGTTTCGCCG GTTTGCGCTT TGAAATAGCG TTTCAGGTAG

251  CATTCGTTCA GCCCGACGCG GCGGGCGATT CGGCGATGG TCAGCGGGCG

301  GGCGAATTCG CTGTTCAAAA TATCGGCGGC TTCGTCTATG CGCCGGCGGC

351  GGTAGCCGTT GTCGTGGCGG CGGAAGGTGA AGCGTAA
```

This corresponds to the amino acid sequence <SEQ ID 176; ORF 043.ng>:

```
g043.pep
  1  MVVSNQNIYA VGPSALFHIR RQKSVMPPER FVEPSRVAVA AKVHRGLDGA

51  ARFDEGERVF QPQAAQASGD GFAGLRFEIA FQVAFVQPDA AGDFGDGQRA

101  GEFAVQNIGG FVYAPAAVAV VVAAEGEA*
```

The following partial DNA sequence was identified in N. meningitidis <SEQ ID 177>:

```
m043.seq
  1  ATGGTTGTTT CAAATCAAAA TATCTATGCC GCCGGCCCCT CAGCACTTCT

51  TCACATCCGA AGGCAAAAAT CCGTAATGCC GTCTGAACGC TTCGTTGAAC

101  CGTCCCGCGT GGCGGTAGCC GCAAAAGTGC ATGGCGGCTT GGACGGTGCT

151  GCCGGATTCG ATGAGGGCGA GCGCGTGTTC CAGCCGCAGG CGGCGCAgGC

201  ATCCGGCGAC GGTTTCGCCG GTTTGCGCTT TGAAATAGCG TTTCAGGTAG

251  CATTCGTTCA GTCCGACGCG GCGGGCGATT TCGGCGATGG TCAGCGGACG

301  GGCGAATTCG TGTTGCAGGA TGTCGGCGGC TTCGTCTATG CGCCGACGGC

351  GGTAACCGTT GTCGTGGCGG CGGAAGGTGA AGCGCAATAA
```

This corresponds to the amino acid sequence <SEQ ID 178; ORF 043>:

```
m043.pep
  1  MVVSNQNIYA AGPSALLHIR RQKSVMPSER FVEPSRVAVA AKVHGGLDGA

51  AGFDEGERVF QPQAAQASGD GFAGLRFEIA FQVAFVQSDA AGDFGDGQRT

101  GEFVLQDVGG FVYAPTAVTV VVAAEGEAQ*
```

Computer analysis of the amino acid sequences gave the following results:
Homology with a Predicted ORF from N. meningitidis menA with menB
ORF 043 shows 89.8% identity over a 128 aa overlap with a predicted ORF (ORF043.a) from N. gonorrhoeae:

```
   m043/g043
                    10         20         30         40         50         60
      m043.pep  MVVSNQNIYAAGPSALLHIRRQKSVMPSERFVEPSRVAVAAKVHGGLDGAAGFDEGERVF
                ||||||||||:|||||:|||||||||||| ||||||||||||||| |||||| |||||||
      g043      MVVSNQNIYAVGPSALFHIRRQKSVMPPERFVEPSRVAVAAKVHRGLDGAARFDEGERVF
                    10         20         30         40         50         60
                    70         80         90        100        110        120
      m043.pep  QPQAAQASGDGFAGLRFEIAFQVAFVQSDAAGDFGDGQRTGEFVLQDVGGFVYAPTAVTV
                |||||||||||||||||||||||||||| ||||||||||:|||::|::||||||:||:|
      g043      QPQAAQASGDGFAGLRFEIAFQVAFVQPDAAGDFGDGQRAGEFAVQNIGGFVYAPAAVAV
                    70         80         90        100        110        120
                   130
      m043.pep  VVAAEGEAQX
                |||||||||
      g043      VVAAEGEAXX
                   130
```

The following partial DNA sequence was identified in *N. meningitidis* <SEQ ID 179>:

```
a043.seq
  1 ATGGTTGTTT CAAATCAAAA TATCTATGCC GCCGGCCCCT CAGCACTTCT

51 TCACATCCGA AGGCAAAAAT CCGTAATGCC GTCTGAACGC TTCGTTGAAC

101 CGTCCCGCGT GGCGGTAGCC GCAAAAGTGC ATGGCGGCTT GGACGGTGCT

151 GCCGGATTCG ATGAGGGCGA GCGCGTGTTC CAGCCGCAGG CGGCGCAGGC

201 ATCCGGCGAC GGTTTCGCCG GTTTGCGCTT TGAAATAGCG TTTCAGGTAG

251 CATTCGTTCA GTCCGACGCG GCGGGCGATT TCGGCGATGG TCAGCGGACG

301 GGCGAATTCG TGTTGCAGGA TGTCGGCGGC TTCGTCTATG CGCCGACGGC

351 GGTAACCGTT GTCGTGGCGG CGGAAGGTGA AGCGCAATAA
```

This corresponds to the amino acid sequence <SEQ ID 180; ORF 043.a>:

```
a043.pep
     1  MVVSNQNIYA AGPSALLHIR RQKSVMPSER FVEPSRVAVA AKVHGGLDGA

51  AGFDEGERVF QPQAAQASGD GFAGLRFEIA FQVAFVQSDA AGDFGDGQRT

101  GEFVLQDVGG FVYAPTAVTV VVAAEGEAQ* m043/a043   100.0% identity in 129 aa overlap
                  10         20         30         40         50         60
   m043.pep  MVVSNQNIYAAGPSALLHIRRQKSVMPSERFVEPSRVAVAAKVHGGLDGAAGFDEGERVF
             ||||||||||||||||||||||||||||||||||||||||||||||||||||||||||||
   a043      MVVSNQNIYAAGPSALLHIRRQKSVMPSERFVEPSRVAVAAKVHGGLDGAAGFDEGERVF
                  10         20         30         40         50         60
                  70         80         90        100        110        120
   m043.pep  QPQAAQASGDGFAGLRFEIAFQVAFVQSDAAGDFGDGQRTGEFVLQDVGGFVYAPTAVTV
             ||||||||||||||||||||||||||||||||||||||||||||||||||||||||||||
   a043      QPQAAQASGDGFAGLRFEIAFQVAFVQSDAAGDFGDGQRTGEFVLQDVGGFVYAPTAVTV
                  70         80         90        100        110        120
                 130
   m043.pep  VVAAEGEAQX
             ||||||||||
   a043      VVAAEGEAQX
                 130
```

The following partial DNA sequence was identified in *N. gonorrhoeae* <SEQ ID 181>:

```
g044.seq
  1 ATGCTGCCCG ACCAGAGCGT CGAGTTCTTG CCACAAGTCG TCGTTTTTGA

51 CGGGCTGTTT GGCGGCGGTT TTCCAGCCGT TGCGCTTCCA ACCGTGTATC

101 CAGTTTTCCA TGCCGTTTTT GACGTATTGC GAGTCGGTGC AGATGATGAC

151 GGTGCAGCGG CGTTTGAGCG ATTTCAGCCC TTCGATAACG GCGGTCAGCT

201 CCATGCGGTT GTTGGTGGTT TGCGCTTCGC CGCCGAAAAG TTCTTTTTCG

251 CGGCTGCCGT AGCGCATTAA
```

This corresponds to the amino acid sequence <SEQ ID 182; ORF 044.ng>:

```
g044.pep
  1 MLPDQSVEFL PQVVVFDGLF GGGFPAVALP TVYPVFHAVF DVLRVGADDD

51 GAAAFERFQP FDNGGQLHAV VGGLRFAAEK FFFAAAVAH*
```

The following partial DNA sequence was identified in *N. meningitidis* <SEQ ID 183>:

```
m044.seq
    1 ATGCCGTCCG ACTAGAGCGT CGAGTTCTTT CCAGAAGTCG TCGTTTTTGA

51 CGGGCTGTTT GGAGGCGGTT TTCCAGCCGT TGCGCTTCCA ACCGTGTATC

101 CAGTTTTCCA TGCCATTTTT GACGTATTGC GAGTCGGTGC AGATGATGAC

151 GGTGCAGCGG CGTTTGAGCG ATTTCAGTCC TTCGATGACG GCAGTCAGTT

201 CCATGCGGTT GTTGGTGGTT TGCGCTTCGC CGCCGAAAAG TTCTTTTTCG

251 TGGCTACCGT AGCGCAyTAa
```

This corresponds to the amino acid sequence <SEQ ID 184; ORF 044>:

```
m044.pep
  1 MPSDXSVEFF PEVVVFDGLF GGGFPAVALP TVYPVFHAIF DVLRVGADDD

51 GAAAFERFQS FDDGSQFHAV VGGLRFAAEK FFFVATVAH*
```

The following partial DNA sequence was identified in *N. meningitidis* <SEQ ID 185>:

```
a044.seq
    1 GTGCCGTCCG ACCAGCGCGT CGAGTTCTTT CCACAAGTCG TCGTTTTTGA

51 CGGGCTGTTT GGCGGCGGTT TTCCAGCCGT TGCGCTTCCA ACCGTGTATC

101 CAGTTTTCCA TGCCGTTTTT GACGTATTGC GAGTCGGTGC AGATGATGAC

151 GGTGCAGCGG CGTTTGAGCG ATTTCAGTCC TTCGATGACG GCGGTCAGTT

201 CCATACGGTT GTTGGTGGTT TGCGCTTCGC CGCCGAAAAG TTCTTTTTCG

251 TGGCTGCCGT AGCGCATTAA
```

This corresponds to the amino acid sequence <SEQ ID 186; ORF 044.a>:

```
a044.pep
  1 VPSDQRVEFF PQVVVFDGLF GGGFPAVALP TVYPVFHAVF DVLRVGADDD

51 GAAAFERFQS FDDGGQFHTV VGGLRFAAEK FFFVAAVAH*
``` m044/a044 91.0% identity over a 89 aa overlap

```
                    10        20        30        40        50        60
m044.pep    MPSDXSVEFFPEVVVFDGLFGGGFPAVALPTVYPVFHAIFDVLRVGADDDGAAAFERFQS
            :|||  |||||:||||||||||||||||||||||||||:|||||||||||||||||||||
a044        VPSDQRVEFFPQVVVFDGLFGGGFPAVALPTVYPVFHAVFDVLRVGADDDGAAAFERFQS
                    10        20        30        40        50        60

70        80        90
m044.pep    FDDGSQFHAVVGGLRFAAEKFFFVATVAHX
            ||||:|||:||||||||||||||||:||||
a044        FDDGGQFHTVVGGLRFAAEKFFFVAAVAHX
                    70        80        90
```

Computer analysis of this amino acid sequence gave the following results:

Homology with a Predicted ORF from *N. gonorrhoeae*

ORF 044 shows 86.5% identity over a 89 aa overlap with a predicted ORF (ORF 044.ng) from *N. gonorrhoeae*:

```
m044/g044
                     10        20        30        40        50        60
  m044.pep   MPSDXSVEFFPEVVVFDGLFGGGFPAVALPTVYPVFHAIFDVLRVGADDDGAAAFERFQS
             |  | ||||:|:||||||||||||||||||||||||:||||||||||||||||||||||
  g044       MLPDQSVEFLPQVVVFDGLFGGGFPAVALPTVYPVFHAVFDVLRVGADDDGAAAFERFQP
                     10        20        30        40        50        60

70        80        90
  m044.pep   FDDGSQFHAVVGGLRFAAEKFFFVATVAHX
             ||:|:|:|||||||||||||||:|:||||
  g044       FDNGGQLHAVVGGLRFAAEKFFFAAAVAHX
                     70        80        90
```

The following partial DNA sequence was identified in *N. gonorrhoeae* <SEQ ID 187>:

```
g046.seq
    1 ATGTCGGCAA TGCTGCGTCC GACAAGCAGC CCGCCGCgcc gCGCCTGTAT

51 GATGACCATC CGCACGCGGT CGTCTGCAAA ACGTAAAACC TGCAATGCGC

101 CCGGGCAGTC TATCAGGCCG GCAAGCTGTT CGGTAACGAG CTGTTCGGGG

151 CTGATGGTTT CGGTTATGCC gaATATGGAA AGGCTGCCGt TTTcGTTGTT

201 TTCGAGCTTG GGGCTGAGGT ATTCGAGGTA TtcgctGGAA CGGACGCGCG

251 CGATGCGGCC GGGGATGTTG AACAGGTCGG CGGCAACTTT GCAGGCGACG

301 ATGTTGGTTT CGTCGCTGCG GGagaGCGCG AGcagcaagt cggcatcttC

351 CgcgccggcG Cgttataatg tgAAGGGGGA TGCGccgttg ccgaAAACGG

401 TTTGGacatc gaggcggctg CCTGTTTCCT GCAATGCTTT TTCGTCGATG

451 TCGATAAcgg TTACGTCGTT GTTGGTGATG GCGGCAAGGT TTTGCGCGAC

501 GGTAGAACCT ACCTGCCCGT TGCCTAAAAT GAGGATTTTC ACGGTATGGG

551 TCGCCGGGTG A
```

This corresponds to the amino acid sequence <SEQ ID 188; ORF 046.ng>:

```
g046.pep
    1 MSAMLRPTSS PPRRACMMTI RTRSSAKRKT CNAPGQSIRP ASCSVTSCSG

51 LMVSVMPNME RLPFSLFSSL GLRYSRYSLE RTRAMRPGML NRSAATLQAT

101 MLVSSLRESA SSKSASSAPA RYNVKGDAPL PKTVWTSRRL PVSCNAFSSM

151 SITVTSLLVM AARFCATVEP TCPLPKMRIF TVWVAG*
```

The following partial DNA sequence was identified in *N. meningitidis* <SEQ ID 189>:

```
m046.seg
    1 ATGTCGGCAA TGCTGCGTCC GACAAGCAsT CCGC.r.sGC gCGcCTGTAT

51 GATGACCATC CGCACGCGGT CGTCTGCAAA ACGTAAAACC TGCAATGCGC

101 CCGGGCAGTC TATCAGGCCG GCAAGCTGTT CGGTAACGAG CTGTTCGGGG

151 CTGATGGTTT CGGTTATGCC GAATATGGAA AGGCTGCCGT TTTCGTTGTT

201 TTCGAGCTTG GGGCTGAGGT ATTCGAGGTA TTCGCTGGAA CGGACGCGCG
```

```
251 CGATGCGGCC GGGGATGTTG AACAGGTCGG CGGCAACTTT GCAGGCGACG

301 ATGTTGGTTT CGTCGCTGCG GGAGAGCGCG AGCAGCAAGT CGGCATCTTC

351 CGCGCCGGCG CGTTCTAATG TGAAGGGGGA TGCGCCGTTG CCGAAAACGG

401 TTTGGACATC GAGGCGGCTG CCTGTTTCCT GCAATGCTTT TCGTCGATG

451 TCGATAACGG TTACGTCGTT GTTGGGTATG GCGGCAAGGT TTTGTGCGAC

501 GGTAGAACCT ACCTGTCCGT TGCCTAAAAT GAGGATTTTC ACGGTGTGGG

551 TCGCCGAGTG A
```

This corresponds to the amino acid sequence <SEQ ID 190; ORF 046>:

```
m046.pep
  1 MSAMLRPTSX PXXRACMMTI RTRSSAKRKT CNAPGQSIRP ASCSVTSCSG

51 LMVSVMPNME RLPFSLFSSL GLRYSRYSLE RTRAMRPGML NRSAATLQAT

101 MLVSSLRESA SSKSASSAPA RSNVKGDAPL PKTVWTSRRL PVSCNAFSSM

151 SITVTSLLGM AARFCATVEP TCPLPKMRIF TVWVAE*
```

The following partial DNA sequence was identified in *N. meningitidis* <SEQ ID 191>:

```
a046.seq
  1 ATGTCGGCAA TGCTGCGTCC GACAAGCAGT CCGCCGCGCC GCGCCTGTAT

51 GATGACCATC CGCACGCGGT CGTCTGCAAA ACGTAAAACC TGCAATGCGC

101 CCGGGCAGTC TATCAGGCCG GCAAGCTGTT CGGTAACGAG CTGTTCGGGG

151 CTGATGGTTT CGGTTATGCC GAATATGGAA AGGCTGCCGT TTTCGTTGTT

201 TTCGAGCTTG GGGCTGAGGT ATTCGAGGTA TTCGCTGGAA CGGACGCGCG

251 CGATGCGGCC GGGGATGTTG AACAGGTCGG CGGCAACTTT GCAGGCGACG

301 ATGTTGGTTT CGTCGCTGCG GGAGAGCGCG AGCAGCAAGT CGGCATCTTC

351 CGCGCCGGCG CGTTCTAATG TGAAGGGGGA TGCGCCGTTG CCGAAAACGG

401 TTTGGACATC GAGGCGGCTG CCTGTTTCCT GCAATGCTTT TCGTCGATG

451 TCGATAACGG TTACGTCGTT GTTGGGTATG GCGGCAAGGT TTTGTGCGAC

501 GGTAGAACCT ACCTGTCCGT TGCCTAAAAT GAGGATTTTC ACGGTGTGGG

551 TCGCCGAGTG A
```

This corresponds to the amino acid sequence <SEQ ID 192; ORF 046.a>:

```
a046.pep
  1 MSAMLRPTSS PPRRACMMTI RTRSSAKRKT CNAPGQSIRP ASCSVTSCSG

51 LMVSVMPNME RLPFSLFSSL GLRYSRYSLE RTRAMRPGML NRSAATLQAT

101 MLVSSLRESA SSKSASSAPA RSNVKGDAPL PKTVWTSRRL PVSCNAFSSM

151 SITVTSLLGM AARFCATVEP TCPLPKMRIF TVWVAE*
``` m046/a046 98.4% identity over a 186 aa overlap

```
                10         20         30         40         50         60
m046.pep  MSAMLRPTSXPXXRACMMTIRTRSSAKRKTCNAPGQSIRPASCSVTSCSGLMVSVMPNME
          ||||||||| |  ||||||||||||||||||||||||||||||||||||||||||||||
a046      MSAMLRPTSSPPRRACMMTIRTRSSAKRKTCNAPGQSIRPASCSVTSCSGLMVSVMPNME
                10         20         30         40         50         60

70         80         90        100        110        120
m046.pep  RLPFSLFSSLGLRYSRYSLERTRAMRPGMLNRSAATLQATMLVSSLRESASSKSASSAPA
          ||||||||||||||||||||||||||||||||||||||||||||||||||||||||||||
a046      RLPFSLFSSLGLRYSRYSLERTRAMRPGMLNRSAATLQATMLVSSLRESASSKSASSAPA
                70         80         90        100        110        120

130        140        150        160        170        180
m046.pep  RSNVKGDAPLPKTVWTSRRLPVSCNAFSSMSITVTSLLGMAARFCATVEPTCPLPKMRIF
          ||||||||||||||||||||||||||||||||||||||||||||||||||||||||||||
a046      RSNVKGDAPLPKTVWTSRRLPVSCNAFSSMSITVTSLLGMAARFCATVEPTCPLPKMRIF
               130        140        150        160        170        180 m046.pep  TVWVAEX
          |||||||
a046      TVWVAEX
```

Computer analysis of this amino acid sequence gave the following results:

Homology with a Predicted ORF from *N. gonorrhoeae*
ORF 046 shows 97.3% identity over a 185 aa overlap with a predicted ORF (ORF 046.ng) from *N. gonorrhoeae*:

```
m046/g046
                10         20         30         40         50         60
m046.pep  MSAMLRPTSXPXXRACMMTIRTRSSAKRKTCNAPGQSIRPASCSVTSCSGLMVSVMPNME
          ||||||||| |  ||||||||||||||||||||||||||||||||||||||||||||||
g046      MSAMLRPTSSPPRRACMMTIRTRSSAKRKTCNAPGQSIRPASCSVTSCSGLMVSVMPNME
                10         20         30         40         50         60

70         80         90        100        110        120
m046.pep  RLPFSLFSSLGLRYSRYSLERTRAMRPGMLNRSAATLQATMLVSSLRESASSKSASSAPA
          ||||||||||||||||||||||||||||||||||||||||||||||||||||||||||||
g046      RLPFSLFSSLGLRYSRYSLERTRAMRPGMLNRSAATLQATMLVSSLRESASSKSASSAPA
                70         80         90        100        110        120

130        140        150        160        170        180
m046.pep  RSNVKGDAPLPKTVWTSRRLPVSCNAFSSMSITVTSLLGMAARFCATVEPTCPLPKMRIF
          | ||||||||||||||||||||||||||||||||||||||| ||||||||||||||||||
g046      RYNVKGDAPLPKTVWTSRRLPVSCNAFSSMSITVTSLLVMAARFCATVEPTCPLPKMRIF
               130        140        150        160        170        180 m046.pep  TVWVAEX
          |||||
g046      TVWVAGX
```

The following partial DNA sequence was identified in *N. gonorrhoeae* <SEQ ID 193>:

```
g047.seq
    1 ATGGTCATCA TACAGGCGcg gcGCGGCGGG CTGCTTGTCG GACGCAGCAT

51 TGCCGACATC GCCCAAGATT TGCCCGACGG GGCCGACTGC CAAATCTGCG

101 CCGTTTACCG CAACAACCGC CTCATCGTCC CCGCGCCGCA AACCGTCATC

151 ATCGAAGGCG ACGAAATCCT GTTTGCCGCC GCCGCCGAAA ACATCGGGGC

201 GGTCATACCc gaATTGCGCC CCAAAGAAAC CAGCACCCGC CGCATCATGA

251 TTGCCGGCGG CGGCAACATc tgctACCGCC TCGCCAAGCA GCTCGAACAC

301 GCATAcaacG TCAAAATCAT CGAATGCCGG CCGCGCcgtg ccgaATGGAT

351 AGCCGAAAAC ctcgAcaaCA CCCTCGTCCT GCAAGGTTCG Gcaaccgacg 401 aAaccctgct cgAcaacgaa tacatcgacg aaatcgaCGT ATTCTGCGCC 451 CTGACCAACG ACGACGAAAG CAACATTAtg tCCGCCCTTT TGGCGAAAAA
```

-continued

```
501 CCTcggcgCG AAGCgcgtca tcggCATCGT CAACCGCTCA AGCTACGTCG

551 ATTTGCTCGA AGGCAACAAA ATCGACATCG TCGTCTCCCC CCACCTCATC

601 ACCATCGGCT CGATACTCGC CCACATCCGG CGCGGCGACA TCGTTGCCGT

651 CCACCTCATC CGGCGCGGCA CGGCGGAAGC CATCGAAGTC GTCGCGCACG

701 GCGACAAAAA AACTTCCGCC ATCATCGGCA GGCGCATCAG CGGCATCAAA

751 TGGCCCGAAG GCTGCCACAT TGCCGCCGTC GTCCGCGCCG GAACCGGCGA

801 AACCATTATG GGACACCATA CCGAAACCGT CATCCAAGAC GGTGACCACA

851 TCATCTTTTT CGTCTCGCGC CGGCGCATCC TGAACGAACT GGAGAAACTC

901 ATCCAAGTCA AATGGGCTT TTTCGGATAA
```

This corresponds to the amino acid sequence <SEQ ID 194; ORF 047.ng>:

```
g047.pep
  1 MVIIQARRGG LLVGRSIADI AQDLPDGADC QICAVYRNNR LIVPAPQTVI

51 IEGDEILFAA AAENIGAVIP ELRPKETSTR RIMIAGGGNI CYRLAKQLEH

101 AYNVKIIECR PRRAEWIAEN LDNTLVLQGS ATDETLLDNE YIDEIDVFCA

151 LTNDDESNIM SALLAKNLGA KRVIGIVNRS SYVDLLEGNK IDIVVSPHLI

201 TIGSILAHIR RGDIVAVHPI RRGTAEAIEV VAHGDKKTSA IIGRRISGIK

251 WPEGCHIAAV VRAGTGETIM GHHTETVIQD GDHIIFFVSR RRILNELEKL

301 IQVKMGFFG*
```

The following partial DNA sequence was identified in *N. meningitidis* <SEQ ID 195>:

```
m047.seq
  1 ATGGTCATCA TACAGgCGcG C..syGCGGA sTGCTTGTCG GACGCAGCAT

51 TGCCGACATC GCCCAAGATT TGCCCGACGG GGCCGACTGC CAAATCTGCG

101 CCGTTTACCG CAACAACCGC CTCATCGTCC CCGCGCCGCA AACCGTCATC

151 ATCGAAGGCG ACGAAATCCT ATTTGCCGCC GCCGCCGAAA ACATCGGCGC

201 GGTCATACCC GAATTGCGCC CCAAAGAAAC CCAAAGAAAC CAGCcCmgmm

251 GcATCATGAT TkCCGGCGGC GGCAACATCG GCTACCGTCT CGCCAAGCAG

301 CTCGAACACG CATACAACGT yAAAATCATC GAATGCCGGC CGCGCCGTGC

351 CGAATGGATA GCCGAAAACC TCGACAACAC CCTCGTCyTG CAAGGTTCGG

401 CAACCGACGA AACCCTGCTC GACAACGAAT ACATCGACGA AATCGACGTA

451 TTCTGCGCCC TGACCAACGA CGACGAAAGC AACATTATGT CCGCCCTTTT

501 GGCGAaAAAC CTCGGCGCGA AGCGCGTCAT CGGCATCGTC AACCGCTCAA

551 GCTACGTCGA TTTGCTCGAA GGCAACAAAA TCGACATCGT CGTCTCCCCC

601 CACCTCATCA CCATCGGCTC GATACTCGCC CACATCCGGC GCGGCGACAT

651 CGTTGCCGTC CACCCCATCC GGCGCGGCAC GGCGGAAGCC ATCGAAGTCG

701 TCGCACACGG CGACAAAAAA ACTTCCGCCA TCATCGGCAG GCGCATCAGC

751 GGCATCAAAT GGCCCGAAGG CTGCCACATT GCCGCCGTCG TCCGCGCCGG

801 AACCGGCGAA ACCATTATGG GACACCATAC CGAAACCGTC ATCCAAGACG
```

-continued
```
851 GCGACCACAT CATCTTTTTC GTCTCGCGCC GGCGCATCCT GAACGAACTG

901 GAAAAACTCA TCCAGGTCAA AATGGGCTTT TTCGGATAA
```

This corresponds to the amino acid sequence <SEQ ID 196; ORF 047>:

```
m047.pep
    1 MVIIQARXXG XLVGRSIADI AQDLPDGADC QICAVYRNNR LIVPAPQTVI

51 IEGDEILFAA AAENIGAVIP ELRPKETQRN QPXXIMIXGG GNIGYRLAKQ

101 LEHAYNVKII ECRPRRAEWI AENLDNTLVL QGSATDETLL DNEYIDEIDV

151 FCALTNDDES NIMSALLAKN LGAKRVIGIV NRSSYVDLLE GNKIDIVVSP

201 HLITIGSILA HIRRGDIVAV HPIRRGTAEA IEVVAHGDKK TSAIIGRRIS

251 GIKWPEGCHI AAVVRAGTGE TIMGHHTETV IQDGDHIIFF VSRRRILNEL

301 EKLIQVKMGF FG*
```

The following partial DNA sequence was identified in *N. meningitidis* <SEQ ID 197>:

```
a047.seq
    1 ATGGTCATCA TACAGGCGCG GCGCGGCGGA CTGCTTGTCG GACGCAGCAT

51 TGCCGACATC GCCCAAGATT TGCCCGACGG GGCCGACTGC CAAATCTGCG

101 CCGTTTACCG CAACAACCGC CTCATCGTCC CCGCGCCGCA AACCGTCATC

151 ATCGAAGGCG ACGAAATCCT ATTTGCCGCC GCCGCCGAAA ACATCGGCGC

201 GGTCATACCC GAATTGCGCC CCAAAGAAAC CAGCACCCGC CGCATCATGA

251 TTGCCGGCGG CGGCAACATC GGCTACCGTC TCGCCAAGCA GCTCGAACAC

301 GCATACAACG TCAAAATCAT CGAATGCCGG CCGCGCCGTG CCGAATGGAT

351 AGCCGAAAAC CTCGACAACA CCCTCGTCCT GCAAGGTTCG GCAACCGACG

401 AAACCCTGCT CGACAACGAA TACATCGACG AAATCGACGT ATTCTGCGCC

451 CTGACCAACG ACGACGAAAG CAACATTATG TCCGCCCTTT TGGCGAAAAA

501 CCTCGGCGCG AAGCGCGTCA TCGGCATCGT CAACCGCTCA AGCTACGTCG

551 ATTTGCTCGA AGGCAACAAA ATCGACATCG TCGTCTCCCC CCACCTCATC

601 ACCATCGGCT CGATACTCGC CCACATCCGG CGCGGCGACA TCGTTGCCGT

651 CCACCTCATC CGGCGCGGCA CGGCGGAAGC CATCGAAGTC GTCGCACACG

701 GCGACAAAAA AACTTCCGCC ATCATCGGCA GGCGCATCAG CGGCATCAAA

751 TGGCCCGAAG GCTGCCACAT TGCCGCCGTC GTCCGCGCCG GAACCGGCGA

801 AACCATTATG GGACACCATA CCGAAACCGT CATCCAAGAC GGCGACCACA

851 TCATCTTTTT CGTCTCGCGC CGGCGCATCC TGAACGAACT GGAAAAACTC

901 ATCCAAGTCA AATGGGCTT TTTCGGATAA
```

This corresponds to the amino acid sequence <SEQ ID 198; ORF 047.a>:

```
a047.pep
    1 MVIIQARRGG LLVGRSIADI AQDLPDGADC QICAVYRNNR LIVPAPQTVI

51 IEGDEILFAA AAENIGAVIP ELRPKETSTR RIMIAGGGNI GYRLAKQLEH

101 AYNVKIIECR PRRAEWIAEN LDNTLVLQGS ATDETLLDNE YIDEIDVFCA
```

-continued
```
151 LTNDDESNIM SALLAKNLGA KRVIGIVNRS SYVDLLEGNK ID<u>IVVSPHLI</u>

201 <u>TIGSILAHIR</u> RGDIVAVHPI RRGTAEAIEV VAHGDKKTSA IIGRRISGIK

251 WPEGCHIAAV VRAGTGETIM GHHTETVIQD GDHIIFFVSR RRILNELEKL

301 IQVKMGFFG*
``` m047/a047 96.5% identity over a 312 aa overlap

```
                10        20        30        40        50        60
m047.pep MVIIQARXXGXLVGRSIADIAQDLPDGADCQICAVYRNNRLIVPAPQTVIIEGDEILFAA
         |||||||  |||||||||||||||||||||||||||||||||||||||||||||||
a047     MVIIQARRGGXLVGRSIADIAQDLPDGADCQICAVYRNNRLIVPAPQTVIIEGDEILFAA
                10        20        30        40        50        60

70        80        90       100       110       120
m047.pep AAENIGAVIPELRPKETQRNQPXXIMIXGGGNIGYRLAKQLEHAYNVKIIECRPRRAEWI
         ||||||||||||||||||:  :   ||| ||||||||||||||||||||||||||||||
a047     AAENIGAVIPELRPKETSTRR---IMIAGGGNIGYRLAKQLEHAYNVKIIECRPRRAEWI
                70        80        90       100       110

130       140       150       160       170       180
m047.pep AENLDNTLVLQGSATDETLLDNEYIDEIDVFCALTNDDESNIMSALLAKNLGAKRVIGIV
         ||||||||||||||||||||||||||||||||||||||||||||||||||||||||||||
a047     AENLDNTLVLQGSATDETLLDNEYIDEIDVFCALTNDDESNIMSALLAKNLGAKRVIGIV
               120       130       140       150       160       170

190       200       210       220       230       240
m047.pep NRSSYVDLLEGNKIDIVVSPHLITIGSILAHIRRGDIVAVHPIRRGTAEAIEVVAHGDKK
         ||||||||||||||||||||||||||||||||||||||||||||||||||||||||||||
a047     NRSSYVDLLEGNKIDIVVSPHLITIGSILAHIRRGDIVAVHPIRRGTAEAIEVVAHGDKK
               180       190       200       210       220       230

250       260       270       280       290       300
m047.pep TSAIIGRRISGIKWPEGCHIAAVVRAGTGETIMGHHTETVIQDGDHIIFFVSRRILNEL
         |||||||||||||||||||||||||||||||||||||||||||||||||||||||||||
a047     TSAIIGRRISGIKWPEGCHIAAVVRAGTGETIMGHHTETVIQDGDHIIFFVSRRILNEL
               240       250       260       270       280       290

310
m047.pep EKLIQVKMGFFGX
         |||||||||||||
a047     EKLIQVKMGFFGX
               300       310
```

Computer analysis of this amino acid sequence gave the following results:

Homology with a Predicted ORF from N. gonorrhoeae

ORF 047 shows 96.2% identity over a 312 aa overlap with a predicted ORF (ORF 047.ng) from N. gonorrhoeae:

```
m047/g045 m047.pep MVIIQARXXGXLVGRSIADIAQDLPDGADCQICAVYRNNRLIVPAPQTVIIEGDEILFAA   60
         |||||||  | |||||||||||||||||||||||||||||||||||||||||||||||
g047     MVIIQARRGGLLVGRSIADIAQDLPDGADCQICAVYRNNRLIVPAPQTVIIEGDEILFAA   60 m047.pep AAENIGAVIPELRPKETQRNQPXXIMIXGGGNIGYRLAKQLEHAYNVKIIECRPRRAEWI  120
         ||||||||||||||||||:  :   ||| |||| ||||||||||||||||||||||||||
g047     AAENIGAVIPELRPKETSTRR---IMIAGGGNICYRLAKQLEHAYNVKIIECRPRRAEWI  117 m047.pep AENLDNTLVLQGSATDETLLDNEYIDEIDVFCALTNDDESNIMSALLAKNLGAKRVIGIV  180
         ||||||||||||||||||||||||||||||||||||||||||||||||||||||||||||
g047     AENLDNTLVLQGSATDETLLDNEYIDEIDVFCALTNDDESNIMSALLAKNLGAKRVIGIV  177 m047.pep NRSSYVDLLEGNKIDIVVSPHLITIGSILAHIRRGDIVAVHPIRRGTAEAIEVVAHGDKK  240
         ||||||||||||||||||||||||||||||||||||||||||||||||||||||||||||
g047     NRSSYVDLLEGNKIDIVVSPHLITIGSILAHIRRGDIVAVHPIRRGTAEAIEVVAHGDKK  237 m047.pep TSAIIGRRISGIKWPEGCHIAAVVRAGTGETIMGHHTETVIQDGDHIIFFVSRRILNEL  300
         |||||||||||||||||||||||||||||||||||||||||||||||||||||||||||
g047     TSAIIGRRISGIKWPEGCHIAAVVRAGTGETIMGHHTETVIQDGDHIIFFVSRRILNEL  297 m047.pep EKLIQVKMGFFGX                                                313
         |||||||||||||
g047     EKLIQVKMGFFGX                                                310
```

The following partial DNA sequence was identified in *N. gonorrhoeae* <SEQ ID 199>:

```
g048.seq
    1 ATGCTCGACA AAGGCGAGGA GTTGCCCGTC GATTTCACCA ACCGCCTGAT

51 TTACTACGTc ggcCCcgTCG ATCCGGTCGG CGATGAAGTC GTCGGTCCCG

101 CAGGTCCGAC CACAGCCACC CGCATGGACA AATTTACCCG CCAAATGCTC

151 AAACAAACCG GCCTCTTGGG CATGATCGGC AAATCCGagc gcgGcgcggc 201 cacctGCGAA GCcatCGCCG ACAACAAGGC CGTGTACCTC ATGGCAGTCG

251 GCGGCGCGGC ATACCTCGTG GCAAAAGCCA TCAAATCTTC CAAAGTCTTG

301 GCGTTCCCCG AATTGGGTAT GGAAGCCGTT TACGAATTTG AAGTCAAAGA

351 TATGCCCGTA ACCGTCGCCG TGGACAGCAA AGGCGAATCC ATCCACGCCA

401 CCGCCCCGCG CAAATGGCAG GCGAAAATCG GCATCATCCC CGTCGAGTCT

451 TGA
```

This corresponds to the amino acid sequence <SEQ ID 200; ORF 048.ng>:

```
g048.pep
    1 MLDKGEELPV DFTNRLIYYV GPVDPVGDEV VGPAGPTTAT RMDKFTRQML

51 KQTGLLGMIG KSERGAATCE AIADNKAVYL MAVGGAAYLV AKAIKSSKVL

101 AFPELGMEAV YEFEVKDMPV TVAVDSKGES IHATAPRKWQ AKIGIIPVES

151 *
```

The following partial DNA sequence was identified in *N. meningitidis* <SEQ ID 201>:

```
m048.seq
    1 ATGCTCAACA AAGGCGAAGA ATTGCCCGTC GATTTCACCA ACCGCCTGAT

51 TTACTACGTC GGCCCCGTCG ATCCGGTCGG CGATGAAGTC GTCGGTCCGG

101 CAGGTCCGAC CACAGCCACC CGCATGGACA AATTCACCCG CCAAATGCTC

151 GAACAAACCG ACCTCTTGGG CATGATCGGC AAATCCGAGC GCGGCGTGGC

201 CACCTGCGAA GCCATCGCCG ACAACAAAGC CGTGTACCTC ATGGCAGTCG

251 GCGGCGCGGC GTATCTCGTG GCAAAAGCCA TCAAATCTTC CAAAGTCTTG

301 GCGTTCCCCG AATTGGGCAT GGAAGCCATT TACGAATTTG AAGTCAAAGA

351 CATGCCCGTA ACCGTCGCCG TAGATAGCAA AGGCGAATCC ATCCACGCCA

401 CCGCCCCGCG CAAATGGCAG GCGAAAATCG GCATCATCCC CGTCGAATCT

451 TGA
```

This corresponds to the amino acid sequence <SEQ ID 202; ORF 048>:

```
m048.pep
    1 MLNKGEELPV DFTNRLIYYV GPVDPVGDEV VGPAGPTTAT RMDKFTRQML

51 EQTDLLGMIG KSERGVATCE AIADNKAVYL MAVGGAAYLV AKAIKSSKVL

101 AFPELGMEAI YEFEVKDMPV TVAVDSKGES IHATAPRKWQ AKIGIIPVES

151 *
```

The following partial DNA sequence was identified in *N. meningitidis* <SEQ ID 203>:

```
a048.seq
   1 ATGCTCGACA AAGGCGAAGA ATTGCCCGTC GATTTCACCA ACCGCCTGAT

51 TTACTACGTC GGCCCCGTCG ATCCGGTCGG CGACGAAATC GTCGGCCCAG

101 CAGGTCCGAC CACCGCCACC CGCATGGACA AATTCACCCG CCAAATGCTC

151 GAACAAACCG ACCTCTTGGG CATGATCGGC AAATCCGAGC GCGGCGCGGC

201 CACCTGCGAA GCCATCGCCG ACAACAAAGC CGTGTACCTC ATGGCAGTCG

251 GCGGCGCGGC GTATCTCGTG GCAAAAGCCA TCAAATCTTC CAAAGTCTTG

301 GCGTTCCCCG AATTGGGCAT GGAAGCCATT TACGAATTTG AAGTCAAAGA

351 CATGCCCGTA ACCGTCGCCG TAGACAGCAA AGGCGAATCC ATCCACGCCA

401 CCGCCCCGCC CCAATGGCAG GCGAAAATCG GCATCATCCC CGTCAAATCT

451 TGA
```

This corresponds to the amino acid sequence <SEQ ID 204; ORF 048.a>:

```
a048.pep
   1 MLDKGEELPV DFTNRLIYYV GPVDPVGDEI VGPAGPTTAT RMDKFTRQML

51 EQTDLLGMIG KSERGAATCE AIADNKAVYL MAVGGAAYLV AKAIKSSKVL

101 AFPELGMEAI YEFEVKDMPV TVAVDSKGES IHATAPPQWQ AKIGIIPVKS

151 *
``` m048/a048 96.0% identity over a 150 aa overlap

```
                    10         20         30         40         50         60
    m048.pep MLNKGEELPVDFTNRLIYYVGPVDPVGDEVVGPAGPTTATRMDKFTRQMLEQTDLLGMIG
             ||:||||||||||||||||||||||||||:|||||||||||||||||||||||||||||
        a048 MLDKGEELPVDFTNRLIYYVGPVDPVGDEIVGPAGPTTATRMDKFTRQMLEQTDLLGMIG
                    10         20         30         40         50         60

70         80         90        100        110        120
    m048.pep KSERGVATCEAIADNKAVYLMAVGGAAYLVAKAIKSSKVLAFPELGMEAIYEFEVKDMPV
             |||||:||||||||||||||||||||||||||||||||||||||||||||||||||||
        a048 KSERGAATCEAIADNKAVYLMAVGGAAYLVAKAIKSSKVLAFPELGMEAIYEFEVKDMPV
                    70         80         90        100        110        120

130        140        150
    m048.pep TVAVDSKGESIHATAPRKWQAKIGIIPVESX
             ||||||||||||||||||:||||||||:||
        a048 TVAVDSKGESIHATAPPQWQAKIGIIPVKSX
                   130        140        150
```

Computer analysis of this amino acid sequence gave the following results:

Homology with a Predicted ORF from *N. gonorrhoeae*

ORF 048 shows 96.4% identity over a 150 aa overlap with a predicted ORF (ORF 048.ng) from *N. gonorrhoeae*:

```
m048/g048

10         20         30         40         50         60
    m048.pep MLNKGEELPVDFTNRLIYYVGPVDPVGDEVVGPAGPTTATRMDKFTRQMLEQTDLLGMIG
             ||:|||||||||||||||||||||||||||||||||||||||||||||||:||||||||
        g048 MLDKGEELPVDFTNRLIYYVGPVDPVGDEVVGPAGPTTATRMDKFTRQMLKQTDLLGMIG
                    10         20         30         40         50         60
```

```
                    70         80         90        100        110        120
m048.pep   KSERGVATCEAIADNKAVYLMAVGGAAYLVAKAIKSSKVLAFPELGMEAIYEFEVKDMPV
           |||||:||||||||||||||||||||||||||||||||||||||||||:||||||||||
g048       KSERGAATCEAIADNKAVYLMAVGGAAYLVAKAIKSSKVLAFPELGMEAVYEFEVKDMPV
                    70         80         90        100        110        120

130        140        150
m048.pep   TVAVDSKGESIHATAPRKWQAKIGIIPVESX
           ||||||||||||||||||||||||||||||
g048       TVAVDSKGESIHATAPRKWQAKIGIIPVESX
                    130        140        150
```

The following partial DNA sequence was identified in *N. gonorrhoeae* <SEQ ID 205>:

```
g049.seq
    1 ATGCGGGCGC AGGCGTTTGA TCAACCGTTC GGTCAGCTCC TGTTCGGACA

51 GGCAGAACAC TTCGCGCCGG TTGACGGCTT TCGGGTTCAG GATATTGATT

101 TGGACGGGCA TCAACGCCTC TTCCGCACCG CCTTCGCCGT TTTCCGCAAC

151 CCCGTCTGCC GCCGTACCGG ATTCTGCCGC ATCGGCGTTT TCCCCGCCCT

201 CAATCTGTGC GGTTTCAAAT TCGGCACTGT CTTTTTTGGC ATCGAACCGG

251 ATTCTCCGCC GCGATTCGAT GTGTTTTTCC GAAAccggca tTTGCAGGGA

301 AGCCTgcgcg TTGAGCCAGT TTTCCTGAAG GACGATCATC GGGTCGGTTT

351 CGACTTCCTC GCCGCAATCG GCAACGGCgc tGTTGTGTTC TTCCTGCCAT

401 TTCTTCAGAT ACGCCTTTAA
```

This corresponds to the amino acid sequence <SEQ ID 206; ORF 049.ng>:

```
g049.pep
    1 MRAQAFDQPF GQLLFGQAEH FAPVDGFRVQ DIDLDGHQRL FRTAFAVFRN

51 PVCRRTGFCR IGVFPALNLC GFKFGTVFFG IEPDSPPRFD VFFRNRHLQG

101 SLRVEPVFLK DDHRVGFDFL AAIGNGAVVF FLPFLQIRL*
```

The following partial DNA sequence was identified in *N. meningitidis* <SEQ ID 207>:

```
m049.seq (partial)
    1 ATGCGGGCGC AGGCGTTTGA TCAGCCGTTC GGTCAGCTCC TGTTCGGACA

51 GGCAGAACAC TTCGCGCCGG TTGACGGCTT TCGGGTTCAG GATATTGATT

101 TGGACGGGCA TCAACGTTTC TTCCGCATCG TTTTCCCCGT TTTCCGAAAC

151 CGCCGGCTCA TTCGTGCCGG ATTCTGCCTC GTCGGCGTTT TCCCCGCTTT

201 CAATCTGTCC GGTTTCAAAT TCGACACTGT CTTTTTTGGT ATCAAACCGG

251 ATTCTCCGCC GCGATTCGAT GTGTTTTTCC GAAACCGACA TTTGCAGGGA

301 AGCCTGCGCG TTGAGCCAGT TTTCCTGAAG GACGATCATC GGGTCGGTTT

351 CGACTTCCTC GCCGCAATCG GCAACGGCGG CATTGTGTTC CTCCTGCCAT

401 TTTTTCAGAT ACGCCTT...
```

This corresponds to the amino acid sequence <SEQ ID 208; ORF 049>:

```
m049.pep (partial)
    1 MRAQAFDQPF GQLLFGQAEH FAPVDGFRVQ DIDLDGHQRF FRIVFPVFRN
```

```
 51 RRLIRAGFCL VGVFPAFNLS GFKFDTVFFG IKPDSPPRFD VFFRNRHLQG

101 SLRVEPVFLK DDHRVGFDFL AAIGNGGIVF LLPFFQIRL...
```

The following partial DNA sequence was identified in *N. meningitidis* <SEQ ID 209>:

```
a049.seq
   1 ATGCGGGCGC AGGCGTTTGA TCAGCCGTTC GGTCAGCTCC TGTTCGGACA

51 GGCAGAACAC TTCGCGCCGG TTGACGGCTT TCGGGTTCAG AATATTGATT

101 TGGACGGGCA TCAACGCTTC TTCCGCACCG CCTTCGCCGT TTTCCGCAAC

151 CCCGTCTGCC GCCGTACCCG ATTCTGCCGC ATCGGCGTTT TCCCCGCCTT

201 CAATCTGTCC GGTTTCAAAT TCGGCACTGT CTTTTTTGGC ATCAAACCGG

251 ATTCTCCGCC GCGATTCGAT GTGTTTTTCC GAAACCGACA TTTGCAGGGA

301 AGCCTGCGCG TTGAGCCAGT TTTCCTGAAG GACGATCATC GGGTCGGTTT

351 CGACTTCCTC GCCGCAATCG GCAACGGCGG CATTGTGTTC CTCCTGCCAT

401 TTTTTCAGAT ACGCCTT
```

This corresponds to the amino acid sequence <SEQ ID 210; ORF 049.a>:

```
a049.pep
   1 MRAQAFDQPF GQLLFGQAEH FAPVDGFRVQ NIDLDGHQRF FRTAFAVFRN

51 PVCRRTRFCR IGVFPAFNLS GFKFGTVFFG IKPDSPPRFD VFFRNRHLQG

101 SLRVEPVFLK DDHRVGFDFL AAIGNGGIVF LLPFFQIRL
``` m049/a049 90.6% identity over a 139 aa overlap

```
                    10         20         30         40         50         60
    m049.pep MRAQAFDQPFGQLLFGQAEHFAPVDGFRVQDIDLDGHQRFFRIVFPVFRNRRLIRAGFCL
             ||||||||||||||||||||||||||||||:|||||||||| :|||| |:||
    a049     MRAQAFDQPFGQLLFGQAEHFAPVDGFRVQNIDLDGHQRFFRTAFAVFRNPVCRRTRFCR
                    10         20         30         40         50         60

70         80         90        100        110        120
    m049.pep VGVFPAFNLSGFKFDTVFFGIKPDSPPRFDVFFRNRHLQGSLRVEPVFLKDDHRVGFDFL
             :|||||||||| ||||||||||||||||||||||||||||||||||||||||||||||||
    a049     IGVFPAFNLSGFKFGTVFFGIKPDSPPRFDVFFRNRHLQGSLRVEPVFLKDDHRVGFDFL
                    70         80         90        100        110        120

130      139
    m049.pep AAIGNGGIVFLLPFFQIRL
             |||||||||||||||||||
    a049     AAIGNGGIVFLLPFFQIRL
                   130
```

Computer analysis of this amino acid sequence gave the following results:
Homology with a Predicted ORF from *N. gonorrhoeae*
ORF 049 shows 86.3% identity over a 139 aa overlap with a predicted ORF (ORF 049.ng) from *N. gonorrhoeae*:

```
m049/g049

10         20         30         40         50         60
    m049.pep MRAQAFDQPFGQLLFGQAEHFAPVDGFRVQDIDLDGHQRFFRIVFPVFRNRRLIRAGFCL
             ||||||||||||||||||||||||||||||||||||||||:||  :|   ||||   |:|||
    g049     MRAQAFDQPFGQLLFGQAEHFAPVDGFRVQDIDLDGHQRLFRTAFAVFRNPVCRRTGFCR
                    10         20         30         40         50         60
```

```
                70        80        90       100       110       120
m049.pep  VGVFPAFNLSGFKFDTVFFGIKPDSPPRFDVFFRNRHLQGSLRVEPVFLKDDHRVGFDFL
          :||||| :||  ||||  ||||||| :|||||||||||||||||||||||||||||||
g049      IGVFPALNLCGFKFGTVFFGIEPDSPPRFDVFFRNRHLQGSLRVEPVFLKDDHRVGFDFL
                70        80        90       100       110       120

130       139
m049.pep  AAIGNGGIVFLLPFFQIRL
          |||||| ::|| |||:||||
g049      AAIGNGAVVFFLPFLQIRLX
               130       140
```

The following partial DNA sequence was identified in *N. gonorrhoeae* <SEQ ID 211>:

```
g050.seq
   1 atgggcgCGG GCTGGTGTCC TCCCGGCATC TTGGGCATCG GCATCGGCGg 51 cacgcccGAA AAAGccgtgt TGATGGcaaA AGAATCCCTG ATGAGCCACA 101 TCGAcatCca aGaATTGCAG GAAAAAGCCG CGTccggggc ggaattgtcc 151 accaccgaAG ccCTGCGCCT cGAACTCTTT GAAAAGGTCA ACGCGCTGGG

201 CATCGGCGCG CAAGGCTTGG GCGGTCTGAC CACCGTGTTG GACGTGAAAA

251 TCCTCGATTA CCCGACCCAT GCCGCCTCCA AACCGATTGC CATGATTCCC

301 AACTGTGCcg ccacCCGcca cgtcgAATTT GAATTGgACG GCTCAGGtcc

351 TGTCGAactc acgccGCcgc gtgtCGAAGA CTGA
```

This corresponds to the amino acid sequence <SEQ ID 212; ORF 050.ng>:

```
g050.pep
   1 MGAGWCPPGI LGIGIGGTPE KAVLMAKESL MSHIDIQELQ EKAASGAELS

51 TTEALRLELF EKVNALGIGA QGLGGLTTVL DVKILDYPTH AASKPIAMIP

101 NCAATRHVEF ELDGSGPVEL TPPRVED*
```

The following partial DNA sequence was identified in *N. meningitidis* <SEQ ID 213>:

```
m050.seq
   1 ATGGGCGCGG GCTGGTGTCC TCCCGGCATC TTGGGTATCG GCATCGGCGG

51 C..agCCgAA AAAGCCGTGC TGATGGCAAA AGAGTCCCTG ATGAGCCACA

101 TCGACATTCA AGAATTGCAG GAAAAGGCCG CGTCCGGCGC GgAATTGTCC

151 ACCACCGAAG CCCTGCGCCT CGAACTCTTT GAAAAAGTCA ACGCGCTGGG

201 CATCGGCGCA CAAGGCTTGG GCGGACTGAC CACCGTGTTG GACGTGAAAA

251 TCCTCGATTA TCCGACCCAC GCCGCCTCCA AACCGATTGC CATGATTCCG

301 AACTGCGCCG CCACCCGCCA CGTCGAATTT GAATTGGACG GCTCAGGCCC

351 TGTCGAACTC ACGCCGCCGC GCGTCGAAGA TGGCCCGATT TGA
```

This corresponds to the amino acid sequence <SEQ ID 214; ORF 050>:

```
m050.pep
   1 MGAGWCPPGI LGIGIGGXAE KAVLMAKESL MSHIDIQELQ EKAASGAELS

51 TTEALRLELF EKVNALGIGA QGLGGLTTVL DVKILDYPTH AASKPIAMIP

101 NCAATRHVEF ELDGSGPVEL TPPRVEDGPI *
```

The following partial DNA sequence was identified in *N. meningitidis* <SEQ ID 215>:

```
a050.seq
   1 ATGGGCGCGG GCTGGTGTCC TCCCGGCATC TTGGGCATCG GCATCGGCGG

51 TACGCCCGAA AAAGCCGTGT TGATGGCGAA AGAATCCCTG ATGAGCCACA

101 TCGACATCCA AGAATTGCAG GAAAAAGCCG CGTCCGGCGC GGAATTGTCC

151 ACCACCGAAG CCCTGCGCCT CGAACTCTTT GAAAAAGTCA ACGCGCTAGG

201 CATCGGCGCG CAAGGCTTGG GCGGTCTGAC CACCGTGTTG GACGTGAAAA

251 TCCTCGATTA CCCGACCCAC GCCGCCTCCA AACCGATTGC CATGATTCCG

301 AACTGCGCCG CCACCCGCCA CGTCGAATTT GAATTGGACG GCTCAGGCCC

351 TGTCGAACTC ACGCCGCCGC GCGTCGAAGA CTGGCCC
```

This corresponds to the amino acid sequence <SEQ ID 216; ORF 050.a>:

```
a050.pep
   1 MGAGWCPPGI LGIGIGGTPE KAVLMAKESL MSHIDIQELQ EKAASGAELS

51 TTEALRLELF EKVNALGIGA QGLGGLTTVL DVKILDYPTH AASKPIAMIP

101 NCAATRHVEF ELDGSGPVEL TPPRVEDWP
``` m050/a050 97.7% identity over a 129 aa overlap

```
                    10        20        30        40        50        60
m050.pep    MGAGWCPPGILGIGIGGXAEKAVLMAKESLMSHIDIQELQEKAASGAELSTTEALRLELF
            |||||||||||||||||: |||||||||||||||||||||||||||||||||||||||||
a050        MGAGWCPPGILGIGIGGTPEKAVLMAKESLMSHIDIQELQEKAASGAELSTTEALRLELF
                    10        20        30        40        50        60
                    70        80        90       100       110       120
m050.pep    EKVNALGIGAQGLGGLTTVLDVKILDYPTHAASKPIAMIPNCAATRHVEFELDGSGPVEL
            ||||||||||||||||||||||||||||||||||||||||||||||||||||||||||||
a050        EKVNALGIGAQGLGGLTTVLDVKILDYPTHAASKPIAMIPNCAATRHVEFELDGSGPVEL
                    70        80        90       100       110       120
                   130
m050.pep    TPPRVEDGPIX
            ||||||| |
a050        TPPRVEDWP
```

Computer analysis of this amino acid sequence gave the following results:

Homology with a Predicted ORF from *N. gonorrhoeae*

ORF 050 shows 98.4% identity over a 127 aa overlap with a predicted ORF (ORF 050.ng) from *N. gonorrhoeae*:

```
m050/g050

10        20        30        40        50        60
m050.pep    MGAGWCPPGILGIGIGGXAEKAVLMAKESLMSHIDIQELQEKAASGAELSTTEALRLELF
            |||||||||||||||||: |||||||||||||||||||||||||||||||||||||||||
g050        MGAGWCPPGILGIGIGGTPEKAVLMAKESLMSHIDIQELQEKAASGAELSTTEALRLELF
                    10        20        30        40        50        60
                    70        80        90       100       110       120
m050.pep    EKVNALGIGAQGLGGLTTVLDVKILDYPTHAASKPIAMIPNCAATRHVEFELDGSGPVEL
            ||||||||||||||||||||||||||||||||||||||||||||||||||||||||||||
g050        EKVNALGIGAQGLGGLTTVLDVKILDYPTHAASKPIAMIPNCAATRHVEFELDGSGPVEL
                    70        80        90       100       110       120
                   130
m050.pep    TPPRVEDGPIX
            |||||||
g050        TPPRVEDX
```

The following partial DNA sequence was identified in *N. gonorrhoeae* <SEQ ID 217>:

```
g050-1.seq
   1 ATGACCGTTA TCAAGCAAGA AGACTTTATT CAAAGTATCT GCGATGCCTT

51 CCAATTCATC AGCTACTACC ATCCAAAAGA CTACATCGAC GCGCTTTATA

101 AGGCGTGGCA GAAGGAAGAA AATCCCGCCG CCAAAGACGC GATGACGCAG

151 ATTTTGGTCA ACAGCCGTAT GTGTGCCGAA ACAACCGCC CCATCTGCCA

201 AGACACAGGT ATCGCAACCG TCTTCCTCAA AGTCGGTATG GATGTGCAAT

251 GGGATGCGGA CATGAGCGTG GAAAAGATGG TTAACGAAGG CGTACGCCGC

301 GCCTACACTT GGGAAGGCAA CACCCTGCGC GCTTCCGTCC TCGCCGATCC

351 GGCCGGCAAA CGCCAAAACA CCAAAGACAA CACCCCCGCC GTCATCCACA

401 TGAGCATCGT GCCGGGCGGT AAAGTCGAAG TAACCTGCGC GGCAAAAGGC

451 GGCGGCTCTG AAAACAAATC CAAACTCGCT ATGCTCAACC CTTCCGACAA

501 CATCGTCGAT TGGGTATTGA AAACCATCCC GACGATGGGC GCGGGCTGGT

551 GTCCTCCCGG CATCTTGGGC ATCGGCATCG GCGGCAcgcC CGAAAAAGCC

601 GTGTTGATGG cgaAAGAATC CCTGATGAGC ACATCGACA TCCAAGAATT

651 GCAGGAAAAA GCCGCGTCCG GCGCGGAATT GTCCACCACC GAAGCCCTGC

701 GCCTCGAACT CTTTGAAAAG GTCAACGCGC TGGGCATCGG CGCGCAAGGC

751 TTGGGCGGTC TGACCACCGT GTTGGACGTG AAAATCCTCG ATTACCCGAC

801 CCATGCCGCC TCCAAACCGA TTGCCATGAT TCCCAACTGT GCCGCCACCC

851 GCCACGTCGA ATTTGAATTG GACGGCTCAG GTCCTGTCGA ACTCACGCCG

901 CCGCGCGTCG AAGACTGACC CGATCTGACT TACAGCCCCG ACAACGGCAA

951 ACGCGTCGAT GTCGATAAGC TGACCAAAGA AGAAGTGGCA AGCTGGAAAA

1001 CCGGCGACGT ATTGCTGTTG AACGGCAAAA TCCTCACCGG CCGCGATGCC

1051 GCGCACAAAC GCCTCGTCAA TATGCTCGAC AAAGGCGAGG AGTTGCCCGT

1101 CGATTTCACC AACCGCCTGA TTTACTACGT CGGCCCCGTC GATCCGGTCG

1151 GCGATGAAGT CGTCGGTCCC GCAGGTCCGA CCACAGCCAC CCGCATGGAC

1201 AAATTTACCC GCCAAATGCT CAAACAAACC GGCCTCTTGG GCATGATCGG

1251 CAAATCCGAG CGCGGCGCGG CCACCTGCGA AGCCATCGCC GACAACAAGG

1301 CCGTGTACCT CATGGCAGTC GGCGGCGCGG CATACCTCGT GGCAAAAGCC

1351 ATCAAATCTT CCAAAGTCTT GGCGTTCCCC GAATTGGGTA TGGAAGCCGT

1401 TTACGAATTT GAAGTCAAAG ATATGCCCGT AACCGTCGCC GTGGACAGCA

1451 AAGGCGAATC CATCCACGCC ACCGCCCCGC GCAAATGGCA GGCGAAAATC

1501 GGCATCATCC CCGTCGAGTC TTGA
```

This corresponds to the amino acid sequence <SEQ ID 218; ORF 050-1.ng>:

```
g050-1.pep
     1    MTVIKQEDFI QSICDAFQFI SYYHPKDYID ALYKAWQKEE NPAAKDAMTQ

51    ILVNSRMCAE NNRPICQDTG IATVFLKVGM DVQWDADMSV EKMVNEGVRR

101    AYTWEGNTLR ASVLADPAGK RQNTKDNTPA VIHMSIVPGG KVEVTCAAKG

151    GGSENKSKLA MLNPSDNIVD WVLKTIPTMG AGWCPPGILG IGIGGTPEKA
```

```
    201  VLMAKESLMS HIDIQELQEK AASGAELSTT EALRLELFEK VNALGIGAQG

251  LGGLTTVLDV KILDYPTHAA SKPIAMIPNC AATRHVEFEL DGSGPVELTP

301  PRVED*PDLT YSPDNGKRVD VDKLTKEEVA SWKTGDVLLL NGKILTGRDA

351  AHKRLVNMLD KGEELPVDFT NRLIYYVGPV DPVGDEVVGP AGPTTATRMD

401  KFTRQMLKQT GLLGMIGKSE RGAATCEAIA DNKAVYLMAV GGAAYLVAKA

451  IKSSKVLAFP ELGMEAVYEF EVKDMPVTVA VDSKGESIHA TAPRKWQAKI

501  GIIPVES* g050-1/p14407
 sp|P14407|FUMB_ECOLI FUMARATE HYDRATASE CLASS I, ANAEROBIC (FUMARASE)
 >gi|280063|pir||B44511 fumarate hydratase (EC 4.2.1.2) fumB, iron-dependent-Escherichia coli
 >gi|146048 (M27058) anaerobic class I fumarase (EC 4.2.1.2) [Escherichia coli] Length = 548
  Score = 172 bits (432), Expect = 4e-42
  Identities = 138/488 (28%), Positives = 216/488 (43%), Gaps = 22/488 (4%)
 Query:  11 QSICDAFQFISYYHPKDYIDALYKAWQKEENPAAKDAMTQILVNSRMCAENNRPICQDTG  70
               Q+ DA  +  H K     L+    E +   K   Q LNS + A+     P CQDTG
 Sbjct:  53 QAFHDASFMLRPAHQKQVAAILHDPEASEND---KYVALQFLRNSEIAAKGVLPTCQDTG 109
 Query:  71 IATVFLKVGMDVQWDADMSVEKMVNEGVRRAYTWEGNTLRASVLADPAGKRQNTKDNTPA 130
               A +  KG V W     E+ +++GV  Y E N   + A    K NT  N PA
 Sbjct: 110 TAIIVGKKGQRV-WTGGGD-EETLSKGVYNTYI-EDNLRYSQNAALDMYKEVNTGTNLPA 166
 Query: 131 VIHMSIVPGGKVEVTCAAKGGGSENKSKL-----AMLNPSDNIVDWVLKTIPTMGAGWCP 185
                I +  VG + + C AKGGGS NK+ L     A+L P + +++++ + T+G    CP
 Sbjct: 167 QIDLYAVDGDEYKFLCVAKGGGSANKTYLYQETKALLTPG-KLKNFLVEKMRTLGTAACP 225
 Query: 186 PXXXXXXXXXTPEKAVLMAKESLMSHIDIQELQEKAASGAELSTTEALRLELFEKVNXXX 245
              P        T  + L  + +H   EL + +        L  EL E+
 Sbjct: 226 PYHIAFVIGGTSAETNLKTVKLASAHY-YDELPTEGNEHGQAFRDVQLEQELLEEAQKLG 284
 Query: 246 XXXXXXXXXTTVLDVKILDYPTHAASKPIAMIPNCAATRHVEFELDGSG----PVELTPP 301
                       D++++    P H AS P+ M   +C+A R+++ +++  G          +E P
 Sbjct: 285 LGAQFGGKYFAH-DIRVIRLPRHGASCPVGMGVSCSADRNIKAKINREGIWIEKLEHNPG 343
 Query: 302 RVEDXPDLTYSPDNGKRVDVDKLTKE---EVASWKTGDVLLLNGKILTGRDAAHKRLVNM 358
              +           +VD+++  KE   +++ +     L L G I+  GRD AH +L  +
 Sbjct: 344 QYIPQELRQAGEGEAVKVDLNRPMKEILAQLSQYPVSTRLSLTGTIIVGRDIAHAKLKEL 403
 Query: 359 LDKGEELPVDFTNRLIYYXXXXXXXXXXXXXXXXXXXTTATRMDKFTRQMLKQTGLLGMIGK 418
              +D G+ELP + IYY                   TTA RMD +      G + K
 Sbjct: 404 IDAGKELPQYIKDHPIYYAGPAKTPAGYPSGSLGPTTAGRMDSYVDLLQSHGGSMIMLAK 463
 Query: 419 SERGAATCEAIADNKAVYLMAVGG-AAYLVAKAIKSSKVLAFPELGMEAVYEFEVKDMPV 477
                R   +A  +   YL ++GG AA L  ++IK +  +A+PELGMEA+++  EV+D P
 Sbjct: 464 GNRSQQVTDACHKHGGFYLGSIGGPAAVLAQQSIKHLECVAYPELGMEAIWKIEVEDFPA 523
 Query: 478 TVAVDSKG                                                   485
              + VD KG
 Sbjct: 524 FILVDDKG                                                   531
```

The following partial DNA sequence was identified in *N. meningitidis* <SEQ ID 219>:

```
m050-1.seq
    1 ATGACCGTCA TCAAACAGGA AGACTTTATC CAAAGCATTT GCGATGCCTT

51 CCAATTCATC AGCTACTATC ATCCCAAAGA CTACATCGAC GCGCTTTATA

101 AGGCGTGGCA GAAGGAAGAA ATCCTGCCG CCAAAGACGC GATGACGCAG

151 ATTTTGGTCA ACAGCCGTAT GTGTGCGGAA ACAACCGCC CCATCTGCCA

201 AGACACAGGT ATCGCAACCG TCTTCCTCAA AGTCGGTATG AACGTCCAAT

251 GGGATGCGGA CATGAGCGTG GAAGAGATGG TTAACGAAGG CGTACGCCGC

301 GCCTACACTT GGGAAGGCAA TACGCTGCGC GCTTCCGTCC TCGCCGATCC

351 GGCCGGCAAA CGCCAAAACA CCAAAGACAA CACCCCCGCC GTCATCCATA

401 TGAGCATCGT GCCGGGCGGT AAAGTCGAAG TAACCTGCGC GGCAAAAGGC

451 GGCGGCTCTG AAAACAAATC CAAACTCGCC ATGCTCAATC CTTCCGACAA

501 CATCGTCGAT TGGGTATTGA AAACCATCCC GACCATGGGC GCGGGCTGGT

551 GTCCTCCCGG CATCTTGGGT ATCGGCATCG GCGGCACGCC CGAAAAAGCC
```

-continued

```
 601 GTGCTGATGG CAAAAGAGTC CCTGATGAGC CACATCGACA TTCAAGAATT
 651 GCAGGAAAAG CCGCGTCCG GCGCGGAATT GTCCACCACC GAAGCCCTGC
 701 GCCTCGAACT CTTTGAAAAA GTCAACGCGC TGGGCATCGG CGCACAAGGC
 751 TTGGGCGGAC TGACCACCGT GTTGGACGTG AAAATCCTCG ATTATCCGAC
 801 CCACGCCGCC TCCAAACCGA TTGCCATGAT TCCGAACTGC GCCGCCACCC
 851 GCCACGTCGA ATTTGAATTG GACGGCTCAG GCCCTGTCGA ACTCACGCCG
 901 CCGCGCGTCG AAGACTGGCC CGATTTGACT TACAGCCCCG ACAACGGCAA
 951 ACGCGTCGAT GTCGACAAGC TGACCAAAGA AGAAGTGGCA AGCTGGAAAA
1001 CCGGCGACGT ATTGCTGTTG AACGGCAAAA TCCTCACCGG CCGCGATGCC
1051 GCACACAAAC GCCTCGTCGA TATGCTCAAC AAAGGCGAAG AATTGCCCGT
1101 CGATTTCACC AACCGCCTGA TTTACTACGT CGGCCCCGTC GATCCGGTCG
1151 GCGATGAAGT CGTCGGTCCG GCAGGTCCGA CCACAGCCAC CCGCATGGAC
1201 AAATTCACCC GCCAAATGCT CGAACAAACC GACCTCTTGG GCATGATCGG
1251 CAAATCCGAG CGCGGCGTGG CCACCTGCGA AGCCATCGCC GACAACAAAG
1301 CCGTGTACCT CATGGCAGTC GGCGGCGCGG CGTATCTCGT GGCAAAAGCC
1351 ATCAAATCTT CCAAAGTCTT GGCGTTCCCC GAATTGGGCA TGGAAGCCAT
1401 TTACGAATTT GAAGTCAAAG ACATGCCCGT AACCGTCGCC GTAGATAGCA
1451 AAGGCGAATC CATCCACGCC ACCGCCCCGC GCAAATGGCA GGCGAAAATC
1501 GGCATCATCC CCGTCGAATC TTGA
```

This corresponds to the amino acid sequence <SEQ ID 220; ORF 050-1>:

```
m050-1.pep

1   MTVIKQEDFI QSICDAFQFI SYYHPKDYID ALYKAWQKEE NPAAKDAMTQ
    51   ILVNSRMCAE NNRPICQDTG IATVFLKVGM NVQWDADMSV EKMVNEGVRR
   101   AYTWEGNTLR ASVLADPAGK RQNTKDNTPA VIHMSIVPGG KVEVTCAAKG
   151   GGSENKSKLA MLNPSDNIVD WVLKTIPTMG AGWCPPGILG IGIGGTPEKA
   201   VLMAKESLMS HIDIQELQEK AASGAELSTT EALRLELFEK VNALGIGAQG
   251   LGGLTTVLDV KILDYPTHAA SKPIAMIPNC AATRHVEFEL DGSGPVELTP
   301   PRVEDWPDLT YSPDNGKRVD VDKLTKEEVA SWKTGDVLLL NGKILTGRDA
   351   AHKRLVDMLN KGEELPVDFT NRLIYYVGPV DPVGDEVVGP AGPTTATRMD
   401   KFTRQMLEQT DLLGMIGKSE RGVATCEAIA DNKAVYLMAV GGAAYLVAKA
   451   IKSSKVLAFP ELGMEAIYEF EVKDMPVTVA VDSKGESIHA TAPRKWQAKI
   501   GIIPVES* m050-1/g050-1 98.2% identity in 507 aa overlap 10         20         30         40         50         60
m050-1.pep MTVIKQEDFIQSICDAFQFISYYHPKDYIDALYKAWQKEENPAAKDAMTQILVNSRMCAE
           ||||||||||||||||||||||||||||||||||||||||||||||||||||||||||||
g050-1     MTVIKQEDFIQSICDAFQFISYYHPKDYIDALYKAWQKEENPAAKDAMTQILVNSRMCAE
                   10         20         30         40         50         60

70         80         90        100        110        120
m050-1.pep NNRPICQDTGIATVFLKVGMNVQWDADMSVEEMVNEGVRRAYTWEGNTLRASVLADPAGK
           |||||||||||||||||||:||||||||||:|||||||||||||||||||||||||||||
g050-1     NNRPICQDTGIATVFLKVGMDVQWDADMSVEKMVNEGVRRAYTWEGNTLRASVLADPAGK
                   70         80         90        100        110        120
```

-continued

```
                    130       140       150       160       170       180
m050-1.pep RQNTKDNTPAVIHMSIVPGGKVEVTCAAKGGGSENKSKLAMLNPSDNIVDWVLKTIPTMG
           ||||||||||||||||||||||||||||||||||||||||||||||||||||||||||||
g050-1     RQNTKDNTPAVIHMSIVPGGKVEVTCAAKGGGSENKSKLAMLNPSDNIVDWVLKTIPTMG
                    130       140       150       160       170       180

190       200       210       220       230       240
m050-1.pep AGWCPPGILGIGIGGTPEKAVLMAKESLMSHIDIQELQEKAASGAELSTTEALRLELFEK
           ||||||||||||||||||||||||||||||||||||||||||||||||||||||||||||
g050-1     AGWCPPGILGIGIGGTPEKAVLMAKESLMSHIDIQELQEKAASGAELSTTEALRLELFEK
                    190       200       210       220       230       240

250       260       270       280       290       300
m050-1.pep VNALGIGAQGLGGLTTVLDVKILDYPTHAASKPIAMIPNCAATRHVEFELDGSGPVELTP
           ||||||||||||||||||||||||||||||||||||||||||||||||||||||||||||
g050-1     VNALGIGAQGLGGLTTVLDVKILDYPTHAASKPIAMIPNCAATRHVEFELDGSGPVELTP
                    250       260       270       280       290       300

310       320       330       340       350       360
m050-1.pep PRVEDWPDLTYSPDNGKRVDVDKLTKEEVASWKTGDVLLLNGKILTGRDAAHKRLVDMLN
           ||||| ||||||||||||||||||||||||||||||||||||||||||||||||||:||:
g050-1     PRVEDXPDLTYSPDNGKRVDVDKLTKEEVASWKTGDVLLLNGKILTGRDAAHKRLVNMLD
                    310       320       330       340       350       360

370       380       390       400       410       420
m050-1.pep KGEELPVDFTNRLIYYVGPVDPVGDEVVGPAGPTTATRMDKFTRQMLEQTDLLGMIGKSE
           ||||||||||||||||||||||||||||||||||||||||||||||:|| |||||||||
g050-1     KGEELPVDFTNRLIYYVGPVDPVGDEVVGPAGPTTATRMDKFTRQMLKQTGLLGMIGKSE
                    370       380       390       400       410       420

430       440       450       460       470       480
m050-1.pep RGVATCEAIADNKAVYLMAVGGAAYLVAKAIKSSKVLAFPELGMEAIYEFEVKDMPVTVA
           ||:||||||||||||||||||||||||||||||||||||||||||:||||||||||||||
g050-1     RGAATCEAIADNKAVYLMAVGGAAYLVAKAIKSSKVLAFPELGMEAVYEFEVKDMPVTVA
                    430       440       450       460       470       480

490       500
m050-1.pep VDSKGESIHATAPRKWQAKIGIIPVESX
           ||||||||||||||||||||||||||||
g050-1     VDSKGESIHATAPRKWQAKIGIIPVESX
                    490       500
```

The following partial DNA sequence was identified in *N. meningitidis* <SEQ ID 221>:

```
a050-1.seq
   1 ATGACCGTCA TCAAACAGGA AGACTTTATC CAAAGCATTT GCGATGCCTT

51 CCAATTCATC AGCTACTACC ATCCCAAAGA CTACATCGAC GCGCTTTATA

101 AGGCGTGGCA GAAGGAAGAA AACCCCGCCG CCAAAGACGC GATGACGCAG

151 ATTTTGGTCA ACAGCCGCAT GTGTGCCGAA AACAACCGCC CCATCTGCCA

201 AGATACCGGT ATCGCGACCG TGTTTTTGAA AGTCGGTATG GATGTGCAAT

251 GGGATGCAGA CATGAGCGTC GAAGAGATGG TTAACGAAGG CGTGCGCCGC

301 GCCTACACTT GGGAAGGCAA TACGCTGCGC GCTTCCGTTC TCGCCGACCC

351 CGCCGGCAAA CGCCAAAATA CCAAAGACAA CACGCCCGCC GTCATCCATA

401 TGAGCATCGT GCCGGGCGAC AAAGTCGAAG TAACCTGCGC GGCAAAAGGC

451 GGCGGTTCTG AAAACAAATC CAAACTCGCC ATGCTCAACC CTTCCGACAA

501 CATCGTCGAT TGGGTATTGA AAACCATTCC GACCATGGGC GCGGGCTGGT

551 GTCCTCCCGG CATCTTGGGC ATCGGCATCG GCGGTACGCC CGAAAAAGCC

601 GTGTTGATGG CGAAAGAATC CCTGATGAGC CACATCGACA TCCAAGAATT

651 GCAGGAAAAA GCCGCGTCCG GCGCGGAATT GTCCACCACC GAAGCCCTGC

701 GCCTCGAACT CTTTGAAAAA GTCAACGCGC TAGGCATCGG CGCGCAAGGC

751 TTGGGCGGTC TGACCACCGT GTTGGACGTG AAAATCCTCG ATTACCCGAC

801 CCACGCCGCC TCCAAACCGA TTGCCATGAT TCCGAACTGC GCCGCCACCC

851 GCCACGTCGA ATTTGAATTG GACGGCTCAG GCCCTGTCGA ACTCACGCCG

901 CCGCGCGTCG AAGACTGGCC CGATTTGACT TACAGCCCCG ACAACGGCAA
```

```
 951 ACGCGTCGAT GTCGACAAGC TGACCAAAGA AGAAGTGGCA AGCTGGAAAA

1001 CCGGCGACGT ATTGCTGTTG AACGGCAAAA TCCTCACCGG CCGCGATGCC

1051 GCACACAAAC GCCTCGTCGA TATGCTCGAC AAAGGCGAAG AATTGCCCGT

1101 CGATTTCACC AACCGCCTGA TTTACTACGT CGGCCCCGTC GATCCGGTCG

1151 GCGACGAAAT CGTCGGCCCA GCAGGTCCGA CCACCGCCAC CCGCATGGAC

1201 AAATTCACCC GCCAAATGCT CGAACAAACC GACCTCTTGG GCATGATCGG

1251 CAAATCCGAG CGCGGCGCGG CCACCTGCGA AGCCATCGCC GACAACAAAG

1301 CCGTGTACCT CATGGCAGTC GGCGGCGCGG CGTATCTCGT GGCAAAAGCC

1351 ATCAAATCTT CCAAAGTCTT GGCGTTCCCC GAATTGGGCA TGGAAGCCAT

1401 TTACGAATTT GAAGTCAAAG ACATGCCCGT AACCGTCGCC GTAGACAGCA

1451 AAGGCGAATC CATCCACGCC ACCGCCCCGC CCCAATGGCA GGCGAAAATC

1501 GGCATCATCC CCGTCAAATC TTGA
```

This corresponds to the amino acid sequence <SEQ ID 222; ORF 050-1.a>:

```
a050-1.pep

1 MTVIKQEDFI QSICDAFQFI SYYHPKDYID ALYKAWQKEE NPAAKDAMTQ

51 ILVNSRMCAE NNRPICQDTG IATVFLKVGM DVQWDADMSV EEMVNEGVRR

101 AYTWEGNTLR ASVLADPAGK RQNTKDNTPA VIHMSIVPGD KVEVTCAAKG

151 GGSENKSKLA MLNPSDNIVD WVLKTIPTMG AGWCPPCILG IGIGGTPEKA

201 VLMAKESLMS HIDIQELQEK AASGAELSTT EALRLELFEK VNALGIGAQG

251 LGGLTTVLDV KILDYPTHAA SKPIAMIPNC AATRHVEFEL DGSGPVELTP

301 PRVEDWPDLT YSPDNGKRVD VDKLTKEEVA SWKTGDVLLL NGKILTGRDA

351 AHKRLVDMLD KGEELPVDFT NRLIYYVGPV DPVGDEIVGP AGPTTATRMD

401 KFTRQMLEQT DLLGMIGKSE RGAATCEAIA DNKAVYLMAV GGAAYLVAKA

451 IKSSVKLAFP ELGMEAIYEF EVKDMPVTVA VDSKGESIHA TAPPQWQAKI

501 GIIPVKS* a050-1/m050-1 98.4% identity in 507 aa overlap 10         20         30         40         50         60
a050-1.pep  MTVIKQEDFIQSICDAFQFISYYHPKDYIDALYKAWQKEENPAAKDAMTQILVNSRMCAE
            ||||||||||:||||||||||||||||||||||||||||| ||||||||||||||||||
m050-1      MTVIKQEDFIQSICDAFQFISYYHPKDYIDALYKAWQKEENPAAKDAMTQILVNSRMCAE
                    10         20         30         40         50         60

70         80         90        100        110        120
a050-1.pep  NNRPICQDTGIATVFLKVGMDVQWDADMSVEEMVNEGVRRAYTWEGNTLRASVLADPAGK
            |||||||||||||||||||||:||||||||||||||||||||||||||||||||||||||
m050-1      NNRPICQDTGIATVFLKVGMNVQWDADMSVEEMVNEGVRRAYTWEGNTLRASVLADPAGK
                    70         80         90        100        110        120

130        140        150        160        170        180
a050-1.pep  RQNTKDNTPAVIHMSIVPGDKVEVTCAAKGGGSENKSKLAMLNPSDNIVDWVLKTIPTMG
            |||||||||||||||||||| |||||||||||||||||||||||||||||||||||||||
m050-1      RQNTKDNTPAVIHMSIVPGGKVEVTCAAKGGGSENKSKLAMLNPSDNIVDWVLKTIPTMG
                   130        140        150        160        170        180

190        200        210        220        230        240
a050-1.pep  AGWCPPGILGIGIGGTPEKAVLMAKESLMSHIDIQELQEKAASGAELSTTEALRLELFEK
            ||||||| |||||||||||||||||||||||||||||||||||||||||||||||||||
m050-1      AGWCPPGILGIGIGGTPEKAVLMAKESLMSHIDIQELQEKAASGAELSTTEALRLELFEK
                   190        200        210        220        230        240

250        260        270        280        290        300
a050-1.pep  VNALGIGAQGLGGLTTVLDVKILDYPTHAASKPIAMIPNCAATRHVEFELDGSGPVELTP
            ||||||||||||||||||| ||||||||||||||||||||||||||||||||||||||||
m050-1      VNALGIGAQGLGGLTTVLDVKILDYPTHAASKPIAMIPNCAATRHVEFELDGSGPVELTP
                   250        260        270        280        290        300
```

```
                 310        320        330        340        350        360
a050-1.pep  PRVEDWPDLTYSPDNGKRVDVDKLTKEEVASWKTGDVLLLNGKILTGRDAAHKRLVDMLD
            ||||||||||||||||||| |||||||||||||||||||||||||||||||||||||||:
m050-1      PRVEDWPDLTYSPDNGKRVDVDKLTKEEVASWKTGDVLLLNGKILTGRDAAHKRLVDMLN
                 310        320        330        340        350        360

370        380        390        400        410        420
a050-1.pep  KGEELPVDFTNRLIYYVGPVDPVGDEIVGPAGPTTATRMDKFTRQMLEQTDLLGMIGKSE
            |||||||||||||||||||||||||||:||||||||||||||||||||||||||||||||
m050-1      KGEELPVDFTNRLIYYVGPVDPVGDEVVGPAGPTTATRMDKFTRQMLEQTDLLGMIGKSE
                 370        380        390        400        410        420

430        440        450        460        470        480
a050-1.pep  RGAATCEAIADNKAVYLMAVGGAAYLVAKAIKSSKVLAFPELGMEAIYEFEVKDMPVTVA
            ||:|||||||||||||||||||||||||||||||||||||||||||||||||||||||||
m050-1      RGVATCEAIADNKAVYLMAVGGAAYLVAKAIKSSKVLAFPELGMEAIYEFEVKDMPVTVA
                 430        440        450        460        470        480

490        500
a050-1.pep  VDSKGESIHATAPPQWQAKIGIIPVKSX
            |||||||||||||:|||||||||:||
m050-1      VDSKGESIHATAPRKWQAKIGIIPVESX
                 490        500
```

The following partial DNA sequence was identified in *N. gonorrhoeae* <SEQ ID 223>:

```
g052.seq
   1 ATGGCTTTGG TGGCGGAGGA AACGGAAATA TCCGCGCCGT GTTTCAAAGG

51 CTGCGAGCCG ACGGGCGACA GCAGGCTGTT GTCCACCACC AAGAGCGCGC

101 CGATGCCGTG CGCCAATTCC GCCAAGGCTT CCAAGTCGGC CACTTCGCCC

151 AAGGGGTTGG ACGGCGTTTC CAAAAACAGC AGTTTGGTGT GGCTTTGAC

201 GGCGGCTTTC CATTCATTTA TATCAGTCGG CGACACGCGG CTCACTCCGA

251 TGCCGAATTT GGTAACGATG TTATTGATAA AGCCGACGGT CGTGCCGAAC

301 AGGCTGCGGC TGGAAACCAC ATGGTCGCCC GCCTGCAGGA AGGTGAAAAA

351 CGCCGCCTGA
```

This corresponds to the amino acid sequence <SEQ ID 224; ORF 052.ng>:

```
g052.pep
   1 MALVAEETEI SAPCFKGCEP TGDSRLLSTT KSAPMPCANS AKASKSATSP

51 KGLDGVSKNS SLVLALTAAF HSFISVGDTR LTPMPNLVTM LLIKPTVVPN

101 RLRLETTWSP ACRKVKNAA*
```

The following partial DNA sequence was identified in *N. meningitidis* <SEQ ID 225>:

```
m052.seq
   1 ATGGCTTTGG TGGCGGAGGA AACGGAAATA TCCGCGCCGT GTTTCAAAGG

51 CTGCGAGCCG ACGGGCGACA GCAGGCTGTT GTCCACCACC AAGAGCGCGC

101 CGATGCCGTG CGCCAATTCC GCCAAGGCTT CCAAGTCGGC CACTTCGCCC

151 AAGGGGTTGG ACGGCGTTTC CAAAAACAGC AGTTTGGTGT GGCTTTGAC

201 GGCGGCTTTC CATTCATTTA TATCAGTCGG CGACACGCGG CTCACTCCGA

251 TGCCGAATTT GGTAACGATG TTATTGATAA AGCCGACGGT CGTGCCGAAC

301 AGGCTGCGGC TGGAAACCAC ATGGTCGCCC GCCTGCAGGA AGGTGAAAAA

351 CGCCGCCTGA
```

This corresponds to the amino acid sequence <SEQ ID 226; ORF 052>:

```
m052.pep
    1 MALVAEETEI SAPCFKGCEP TGDSRLLSTT KSAPMPCANS AKASKSATSP

51 KGLDGVSKNS SLVLALTAAF HSFISVGDTR LTPMPNLVTM LLIKPTVVPN

101 RLRLETTWSP ACRKVKNAA*
```

The following partial DNA sequence was identified in *N. meningitidis* <SEQ ID 227>:

```
a052.seq
    1 ATGGCTTTGG TCGCGGAGGA AACGGAAATA TCCGCGCCGT GTTTCAAAGG

51 CTGAGAGCCG ACAGGCGACA GCAGGCTGTT GTCCACCACC AAGAGCGCGC

101 CGATGCCGTG CGCCAATTCC GCCAAGGCTT CCAAGTCGGC CACTTCTCCC

151 AAGGGATTGG ACGGCGTTTC CAAAAACAGC AGTTTGGTGT TGGCTTTGAC

201 GGCGGCTTTC CATTCGTTTA TATCAGTCGG CGACACGTGA CTCACTTCGA

251 TGCCGAATTT GGTAACGATG TTATTGATAA AGCCGACGGT CGTGCCGAAC

301 AGGCTGCGGC TGGAAATCAC ATGGTCGCCC GCCTGCAAAA AGGTGAAAAA

351 CGCCGCCTGA
```

This corresponds to the amino acid sequence <SEQ ID 228; ORF 052.a>:

```
a052.pep
    1 MALVAEETEI SAPCFKG*EP TGDSRLLSTT KSAPMPCANS AKASKSATSP

51 KGLDGVSKNS SLVLALTAAF HSFISVGDT* LTSMPNLVTM LLIKPTVVPN

101 RLRLEITWSP ACKKVKNAA*
``` m052/a052 95.8% identity over a 119 aa overlap

```
                    10         20         30         40         50         60
    m052.pep MALVAEETEISAPCFKGCEPTGDSRLLSTTKSAPMPCANSAKASKSATSPKGLDGVSKNS
             |||||||||||||||||| |||||||||||||||||||||||||||||||||||||||||
    a052     MALVAEETEISAPCFKGXEPTGDSRLLSTTKSAPMPCANSAKASKSATSPKGLDGVSKNS
                    10         20         30         40         50         60

70         80         90        100        110        120
    m052.pep SLVLALTAAFHSFISVGDTRLTPMPNLVTMLLIKPTVVPNRLRLETTWSPACRKVKNAAX
             ||||||||||||||||||| || |||||||||||||||||||||||| |||||:||||||
    a052     SLVLALTAAFHSFISVGDTXLTSMPNLVTMLLIKPTVVPNRLRLEITWSPACKKVKNAAX
                    70         80         90        100        110        120
```

Computer analysis of this amino acid sequence gave the following results:
Homology with a Predicted ORF from *N. gonorrhoeae*
ORF 052 shows 95.8% identity over a 119 aa overlap with a predicted ORF (ORF 052.ng) from *N. gonorrhoeae*:

```
    m052/g052

10         20         30         40         50         60
    m052.pep MALVAEETEISAPCFKGCEPTGDSRLLSTTKSAPMPCANSAKASKSATSPKGLDGVSKNS
             ||||||||||||||||||||||||||||||||||||||||||||||||||||||||||||
    g052     MALVAEETEISAPCFKGCEPTGDSRLLSTTKSAPMPCANSAKASKSATSPKGLDGVSKNS
                    10         20         30         40         50         60
```

```
                     70         80         90        100        110        120
m052.pep   SLVLALTAAFHSFISVGDTWLTSMPNLATMLLIKPTVVPNRLRLEITWSPACKKVKNAAX
           |||||||||||||||||||| ||  ||||:|||||||||||||||| ||||||:||||||
g052       SLVLALTAAFHSFISVGDTRLTPMPNLVTMLLIKPTVVPNRLRLETTWSPACRKVKNAAX
                     70         80         90        100        110        120
```

The following partial DNA sequence was identified in *N. gonorrhoeae* <SEQ ID 229>:

```
g073.seq
   1 ATGTGTATGC CATACGCAAT AAGGGTTTCA GACGGCATCT GCCGCATTTT

51 TCCGCCGATG CCGTCTGAAA CACGCAATCA GCGCGCGAGT GCCTGTTTCA

101 AATCGTCAAT CAAATCGCCA ACATATTCCA AACCGACCGA CAGGCGCACC

151 AGTCCGGGGC GGatacCGGC GGCGAGTTTT TCTTCGGGCT GCATCCTGCC

201 GTGCGTGGTT GTCCACGGAT TGGTGATGGT CGAGCGCACG TCGCCGAGGT

251 TGGCGGTACG GGAAAAGAGT TCCACGACTT TCCACGCGGC TGCTTGGTCG

301 GCGACTTCAA AACCGATGAC GATGCCGCCG CCGTTTTGCT GTTTGCGGAT

351 AAGCTCCGCC TGCGGATGGT CGGGCAATCC GGTGTAG
```

This corresponds to the amino acid sequence <SEQ ID 230; ORF 073.ng>:

```
g073.pep
   1 MCMPYAIRVS DGICRIFPPM PSETRNQRAS ACFKSSIKSP TYSKPTDRRT

51 SPGRIPAASF SSGCILPCVV VHGLVMVERT SPRLAVREKS STTFHAAAWS

101 ATSKPMTMPP PFCCLRISSA CGWSGNPV*
```

The following partial DNA sequence was identified in *N. meningitidis* <SEQ ID 231>:

```
m073.seq
   1 ATGTGTATGC CATATAAGAT AAGGGTTTCA GACGGCATCT GCTGTCCAAT

51 GCCGTCTGAA ACACGCAATC AGCGTGCGAG TGCCTGTTTC AAATCGTCAA

101 TCAAATCGCC AACATATTCC AAACCGACCG ACAGGCGCAC CAATCCGGGG

151 CGGATGTTGG CGGCGAGTTT TTCTTCGGGC TGCATCCTGC CGTGCGTGGT

201 TGTCCACGGG TGGGTAATGG TCGAGCGCAC GTCACCGAGG TTGGCGGTGC

251 GGGAAAAGAG TTCCACGCCG TCCACAACTT TCCACGCCGC TTCTTGATCG

301 GCAACTTCAA AGCCGATGAC GATGCCGCCG CCGTTTTGCT GTTTGCGGAT

351 AAGCGCCGCC TGAGGATGGT CGGACAATCC GGTGTAG
```

This corresponds to the amino acid sequence <SEQ ID 232; ORF 073>:

```
m073.pep
   1 MCMPYKIRVS DGICCPMPSE TRNQRASACF KSSIKSPTYS KPTDRRTNPG

51 RMLAASFSSG CILPCVVVHG WVMVERTSPR LAVREKSSTP STTFHAASXS

101 ATSKPMTMPP PFCCLRISAA XGWSDNPV*
```

The following partial DNA sequence was identified in *N. meningitidis* <SEQ ID 233>:

```
a073.seq
   1 ACGTGTATGT CATATAAGAT AAGGGTTTCA GACGGCATTT GCGGTGTTTT

51 TCCGCCGATG CCGTCTGAA. CACGCAATCA GCGCGCGAGT GCCTGTTTCA

101 AATCGTCAAT CAAATCGCCA ACATATTCCA AACCGACCGA CAGGCGCACC

151 AATCCGGGGC GGATGTTGGC GGCGAGTTTT TCTTCGGGCT GCATCCTGCC

201 GTGCGTGGTT GTCCACGGAT GGGTAATGGT CGAGCGCACG TCGCCGAGGT

251 TGGCGGTACG GGAGAAAAGT TCGACGCCGT CCACGACTTT CCACGCGGCT

301 GCTTGGTCGG CGACTTCAAA GCCGATGACG ATGCCGCCGC CGTTTTGCTG

351 TTTGCGGATA AGCTCCGCCT GAGGATGGTC GGGTAATCCG GTGTAA
```

This corresponds to the amino acid sequence <SEQ ID 234; ORF 073.a>:

```
a073.pep
   1 TCMSYKIRVS DGICGVFPPM PSEXRNQRAS ACFKSSIKSP TYSKPTDRRT

51 NPGRMLAASF SSGCILPCVV VHGWVMVERT SPRLAVREKS STPSTTFHAA

101 AWSATSKPMT MPPPFCCLRI SSA*GWSGNP V*
``` m073/a073 92.3% identity over a 130 aa overlap

```
                   10             20          30          40          50
m073.pep   MCMPYKIRVSDGICC---PMPSETRNQRASACFKSSIKSPTYSKPTDRRTNPGRMLAASF
            || ||||||||||     |||||:||||||||||||||||||||||||||||||||||||
a073       TCMSYKIRVSDGICGVFPPMPSEXRNQRASACFKSSIKSPTYSKPTDRRTNPGRMLAASF
                   10          20          30          40          50          60

60          70          80          90         100         110
m073.pep   SSGCILPCVVVHGWVMVERTSPRLAVREKSSTPSTTFHAASXSATSKPMTMPPPFCCLRI
           ||||||||||||||||||||||||||||||||||||||||: ||||||||||||||||||
a073       SSGCILPCVVVHGWVMVERTSPRLAVREKSSTPSTTFHAAAWSATSKPMTMPPPFCCLRI
                   70          80          90         100         110         120

120       129
m073.pep   SAAXGWSDNPVX
           |:||||| ||||
a073       SSAXGWSGNPVX
                  130
```

Computer analysis of this amino acid sequence gave the following results:

Homology with a Predicted ORF from *N. gonorrhoeae*

ORF 073 shows 87.0% identity over a 131 aa overlap with a predicted ORF (ORF 073.ng) from *N. gonorrhoeae*:

```
m073/g073

10             20          30          40          50
m073.pep   MCMPYKIRVSDGICC---PMPSETRNQRASACFKSSIKSPTYSKPTDRRTNPGRMLAASF
           ||||| ||||||||     ||||||||||||||||||||||||||||||:|||: ||||
g073       TCMSYAIRVSDGICRIFPPMPSETRNQRASACFKSSIKSPTYSKPTDRRTSPGRIPAASF
                   10          20          30          40          50          60

60          70          80          90         100         110
m073.pep   SSGCILPCVVVHGWVMVERTSPRLAVREKSSTPSTTFHAASXSATSKPMTMPPPFCCLRI
           ||||||||||||||||||||||||||||||   |||||: ||||||||||||||||||
g073       SSGCILPCVVVHGWVMVERTSPRLAVREKSST---TFHAAAWSATSKPMTMPPPFCCLRI
                   70          80          90         100         110
```

```
             120       129
m073.pep  SAAXGWSDNPVX
          |:|  |||  ||||
g073      SSACGWSGNPVX
             120
```

The following partial DNA sequence was identified in *N. gonorrhoeae* <SEQ ID 235>:

```
g075.seq
   1 ATGCCGCCTT ACTTCATCAC CCTCTTAACG ATGGAAAATA CAAAAAGCGC

51 GGCGAAAACG CCCACTACAA TCCAACCGGC TTCCATACCG TCCGCTTTTG

101 CGGCTTCCAA AGCGTTTTTT GCCGTTTCGG GCAACGCTGC GTTTGCCTGT

151 GCCGCCAAAG CCAGCGGGGC GGCTGTTACA ACAGCCAGTT TTGCGCCGTA

201 TTTACGGCAG GTGTTAATAA ATTTCATGAT ATTTTCCTTT ACGAAATTTT

251 TAAAAAATG TGTTTGCGGG CTTTGTGAAG GTTTTAGAGA CCGCCTGCCG

301 GGCCTCTTAA ACTTAATCTT CTTTTTCGTA GAATCCGAAA ATTACAAATT

351 CCCCGCCTAT CTCTTCCAAT GCCGAGCTAA AAGCGTCTTC ATAGCTGTCA

401 TATTTACCGG CTGA
```

This corresponds to the amino acid sequence <SEQ ID 236; ORF 075.ng>:

```
g075.pep
   1 MPPYFITLLT MENTKSAAKT PTTIQPASIP SAFAASKAFF AVSGNAAFAC

51 AAKASGAAVT TASFAPYLRQ VLINFMIFSF TKFLKKCVCG LCEGFRDRLP

101 GLLNLIFFFV ESENYKFPAY LFQCRAKSVF IAVIFTG*
```

The following partial DNA sequence was identified in *N. meningitidis* <SEQ ID 237>:

```
m075.seq
   1 ATGCCGTCTT ACTTCATCAC TCTCTTAACG ATGGAAAATA CAAAAAGCGC

51 GGCGAAAATG CCCACTACAA TCCAACCGGC TTCCATACCG TCCGCTTTTG

101 CGGCTTCCAA AGCGTTTTTT GCCGTATCGG GCAACGTTGC ATTTGCATGT

151 GCGGCCAAAG CCAGGGGAGC AGCTGTTACA ACAGCCAGTT TTGCGCCGTA

201 TTTACGGCAG GTGTTAATAA ATTTCATGAT ATTTTCCTTC AAAAAGTGTT

251 TGGCGGTAAT GGATGGAGCG TTTTTCAGAC GACCGCCGAA CATCCGAAAA

301 TCAGTCTTTC AAAAATCCGA ATACGACAAA TTCGTATTGG TTGCCGATTT

351 CTTCCAAACC TGCGTTAATC GCTTCTTCGA AGTCGTAGAA ATAATCGGCA

401 TTGGTGATTA A
```

This corresponds to the amino acid sequence <SEQ ID 238; ORF 075>:

```
m075.pep
   1 MPSYFITLLT MENTKSAAKM PTTIQPASIP SAFAASKAFF AVSGNVAFAC

51 AAKARGAAVT TASFAPYLRQ VLINFMIFSF KKCLAVMDGA FFRRPPNIRK

101 SVFQKSEYDK FVLVADFFQT CVNRFFEVVE IIGIGD*
```

Computer analysis of this amino acid sequence gave the following results:
Homology with a Predicted ORF from *N. gonorrhoeae*
ORF 075 shows 65.7% identity over a 137 aa overlap with a predicted ORF (ORF 075.ng) from *N. gonorrhoeae*:

```
    m075/g075

10        20        30        40        50        60
      m075.pep MPSYFITLLTMENTKSAAKMPTTIQPASIPSAFAASKAFFAVSGNVAFACAAKARGAAVT
               ||  ||||||||||||||| ||||||||||||||||||||||||:|||||||||  |||||
          g075 MPPYFITLLTMENTKSAAKTPTTIQPASIPSAFAASKAFFAVSGNAAFACAAKASGAAVT
                      10        20        30        40        50        60

70        80        90       100       110
      m075.pep TASFAPYLRQVLINFMIFSF----KKCLAVMDGAFFRRPPNIRKSVFQKSEYDKFVLVAD
               ||||||||||||||||||||    |||:  : :|  | |::  :|   |  |::: : |
          g075 TASFAPYLRQVLINFMIFSFTKFLKKCVCGLCEGFRDRLPGLLNLIFFFVESENYKFPAY
                      70        80        90       100       110       120

120       130
      m075.pep FFQTCVNRFFEVVEIIGIGDX
               :||   ::    | :|  : |
          g075 LFQCRAKSVFIAVIFTGX
                     130
```

The following partial DNA sequence was identified in *N. meningitidis* <SEQ ID 239>:

```
a075.seq
   1 ATGCCGTCTT ACTTCATCAC TCTCTTAACG ATGGAAAAGA CAAAAGCGC

51 GGCGAAAACG CCCACTACAA TCCAACCGGC TTCCATACCG TCCGCTTTTG

101 CGGCTTCCAA AGCGTTTTTT GCTGTATCGG GCAACGTTGC ATTTGCATGT

151 GCGGCCAAAG CCAGGGGAGC AGCTGTTACA ACAGCCAGTT TTGCGCCGTA

201 TTTACGGCAG GTGTTAATAA ATTTCATGAT ATTTTCCTTC AAAAGTGTT

251 TGGCGGTAAT GGATGGAGCG TTTTTCAGAC GACCGCCGAA CATCCGAAAA

301 TCAGTCTTTC AAAAATCCGA ATACGACAAA TTCGTATTGG TTGCCGATTT

351 CTTCCAAACC TGCGTTAATC GCTTCTTCGA AGTCGTAGAA ATAATCGGCA

401 TTGGTGATTA A
```

This corresponds to the amino acid sequence <SEQ ID 240; ORF 075.a>:

```
a075.pep
   1 MPSYFITLLT MEKTKSAAKT PTTIQPASIP SAFAASKAFF AVSGNVAFAC

51 AAKARGAAVT TASFAPYLRQ VLINFMIFSF KKCLAVMDGA FFRRPPNIRK

101 SVFQKSEYDK FVLVADFFQT CVNRFFEVVE IIGIGD*
``` m075/a075 98.5% identity over a 136 aa overlap

```
                      10        20        30        40        50        60
      m075.pep MPSYFITLLTMENTKSAAKMPTTIQPASIPSAFAASKAFFAVSGNVAFACAAKARGAAVT
               ||||||||||||:||||| |||||||||||||||||||||||||||||||||||||||||
          a075 MPSYFITLLTMEKTKSAAKTPTTIQPASIPSAFAASKAFFAVSGNVAFACAAKARGAAVT
                      10        20        30        40        50        60

70        80        90       100       110       120
      m075.pep TASFAPYLRQVLINFMIFSFKKCLAVMDGAFFRRPPNIRKSVFQKSEYDKFVLVADFFQT
               ||||||||||||||||||||||||||||||||||||||||||||||||||||||||||||
          a075 TASFAPYLRQVLINFMIFSFKKCLAVMDGAFFRRPPNIRKSVFQKSEYDKFVLVADFFQT
                      70        80        90       100       110       120
```

-continued

```
                        130
m075.pep    CVNRFFEVVEIIGIGDX
            |||||||||||||||||
a075        CVNRFFEVVEIIGIGDX
                        130
```

The following partial DNA sequence was identified in *N. gonorrhoeae* <SEQ ID 241>:

```
g080.seq
   1 ATGTGGGATA ATGCCGAAGC GATGGAACGG CTGACGCGCT GGCTGCTTGT

51 CATGATGGCG ATGCTGCTTG CTGCGTCCGG GCTGGTTTGG TTTTACAATT

101 CGAATCATCT GCCCGTCAAG CAGGTGTCGC TGAAGGGCAA CCTGGTTTAT

151 TCCGATAAGA AGGCATTGGG CAGTTTGGCG AAAGAATACA TCCATGGGAA

201 TATTTTGAGG ACGGACATCA ATGGCGCACA GGAAGCCTAC CGCCGGTATC

251 CGTGGATTGC GTCGGTCATG GTGCGCCGCC GTTTTCCCGA TACGGTTGAG

301 GTCGTCCTGA CCGAGCGCAA GCCGGTTGCA CGTTGGGGCG ACCATGCCTT

351 GGTGGACGGC GAAGGCAATG TTTTTGAAGC CCGCTTGGAC AGACCCGGAA

401 TGCCGGTATT CAGAGGCGCG GAAGGAACGT CTGCCGAAAT GCTCCGCCGT

451 TATGACGAAT TTTCGACTGT TTTGGCAAAA CAGGGTTTGG GCATCAAAGA

501 GATGACCTAT ACGGCACGTT CGGCGTGGAA TGTCGTTTTG GACAACGGCA

551 TCACCGTCAG GCTCGGACGG GAAAAcgaGA TGAAACGCCT CCgGCTTTTT

601 ACcgAAGCGT GGCAGCATCT gttgcGTAAG AATAAAAATC GGTTATCCTA

651 TGTGGATATG Aggtataagg acggatttTC agtcccccat gctCCCGACG

701 GTTTACCCGA AAAAGAATcc gAAGAATatt gggaacaggt ttgggacata 751 ttacggcctg gcgtcggaaa cggttcgacg caaatttcaa tcagttatAA 801 GGGCAGacga acaatggaac AGcagtaa
```

This corresponds to the amino acid sequence <SEQ ID 242; ORF 080.ng>:

```
g080.pep
   1 MWDNAEAMER LTRWLLVMMA MLLAASGLVW FYNSNHLPVK QVSLKGNLVY

51 SDKKALGSLA KEYIHGNILR TDINGAQEAY RRYPWIASVM VRRRFPDTVE

101 VVLTERKPVA RWGDHALVDG EGNVFEARLD RPGMPVFRGA EGTSAEMLRR

151 YDEFSTVLAK QGLGIKEMTY TARSAWNVVL DNGITVRLGR ENEMKRLRLF

201 TEAWQHLLRK NKNRLSYVDM RYKDGFSVPH APDGLPEKES EEYWEQVWDI

251 LRPGVGNGST QISISYKGRR TMEQQ*
```

The following partial DNA sequence was identified in *N. meningitidis* <SEQ ID 243>:

```
m080.seq
   1 ATGTGGGATA ATGCCGAAGC GATGGAACGG CTGACGCGCT GGCTGCTTGT

51 CATGATGGCG ATGCTGCTTG CTGCGTCCGG GCTGGTTTGG TTTTACAATT

101 CGAATCATCT GCCCGTCAAG CAGGTGTCGC TGAAGGGCAA CCTGGTTTAT

151 TCCGATAAGA AGACATTGGG CAGTTTGGCG AAAGAATACA TCCATGGGAA
```

```
201 TATTTTGAGG ACGGACATCA ATGGCGCACA GGAGGCCTAC CGCCGGTATC

251 CGTGGATTGC GTCGGTCATG GTGCGCCGCC GTTTTCCCGA CACGGTTGAG

301 GTCGTCCTGA CCGAGCGCAA GCCGGTCGCG CGTTGGGGCG ACCATGCCTT

351 GGTGGACGGC GAAGGCAATG TTTTTGAAGC CCGCTTGGAC AGACCCGGAA

401 TGCCGGTATT CAGAGGCGCG GAAGGAACGT CTGCCGAAAT GCTCCGCCGT

451 TATGACGAAT TTTCGACTGT TTTGGCAAAA CAGGGTTTGG GCATCAAAGA

501 GATGACCTAT ACGGCACGTT CGGCGTGGAT TGTCGTTTTG GACAACGGCA

551 TCACCGTCAG GCTCGGACGG GAAAACGAGA TGAAACGCCT CCGGCTTTTT

601 ACCGAAGCGT GGCAGCATCT GTTGCGTAAA AATAAAAATC GGTTATCCTA

651 TGTGGATATG AGGTATAAGG ACGGATTTTC AGTCCGCTAT GCTTCCGACG

701 GTTTACCCGA AAAGAATCC GAAGAATAG
```

This corresponds to the amino acid sequence <SEQ ID 2441; ORF 080>:

```
m080.pep
  1 MWDNAEAMER LTRWLLVMMA MLLAASGLVW FYNSNHLPVK QVSLKGNLVY

51 SDKKTLGSLA KEYIHGNILR TDINGAQEAY RRYPWIASVM VRRRFPDTVE

101 VVLTERKPVA RWGDHALVDG EGNVFEARLD RPGMPVFRGA EGTSAEMLRR

151 YDEFSTVLAK QGLGIKEMTY TARSAWIVVL DNGITVRLGR ENEMKRLRLF

201 TEAWQHLLRK NKNRLSYVDM RYKDGFSVRY ASDGLPEKES EE*
```

Computer analysis of this amino acid sequence gave the following results:
Homology with a Predicted ORF from *N. gonorrhoeae*
ORF 080 shows 97.9% identity over a 242 aa overlap with a predicted ORF (ORF 080.ng) from *N. gonorrhoeae*:

```
m080/g080
                      10         20         30         40         50         60
    m080.pep  MWDNAEAMERLTRWLLVMMAMLLAASGLVWFYNSNHLPVKQVSLKGNLVYSDKKTLGSLA
              ||||||||||||||||||||||||||||||||||||||||||||||||||:|||||
    080       MWDNAEAMERLTRWLLVMMAMLLAASGLVWFYNSNHLPVKQVSLKGNLVYSDKKALGSLA
                      10         20         30         40         50         60

70         80         90        100        110        120
    m080.pep  KEYIHGNILRTDINGAQEAYRRYPWIASVMVRRRFPDTVEVVLTERKPVARWGDHALVDG
              ||||||||||||||||||||||||||||||||||||||||||||||||||||||||||||
    080       KEYIHGNILRTDINGAQEAYRRYPWIASVMVRRRFPDTVEVVLTERKPVARWGDHALVDG
                      70         80         90        100        110        120

130        140        150        160        170        180
    m080.pep  EGNVFEARLDRPGMPVFRGAEGTSAEMLRRYDEFSTVLAKQGLGIKEMTYTARSAWIVVL
              |||||||||||||||||||||||||||||||||||||||||||||||||||||||| |||
    080       EGNVFEARLDRPGMPVFRGAEGTSAEMLRRYDEFSTVLAKQGLGIKEMTYTARSAWNVVL
                     130        140        150        160        170        180

190        200        210        220        230        240
    m080.pep  DNGITVRLGRENEMKRLRLFTEAWQHLLRKNKNRLSYVDMRYKDGFSVRYASDGLPEKES
              ||||||||||||||||||||||||||||||||||||||||||||||||:| |||||||||
    080       DNGITVRLGRENEMKRLRLFTEAWQHLLRKNKNRLSYVDMRYKDGFSVPHAPDGLPEKES
                     190        200        210        220        230        240 m080.pep  EEX
              ||
    080       EEYWEQVWDILRPGVGNGSTQISISYKGRRTMEQQX
                            250        260        270
```

The following partial DNA sequence was identified in *N. meningitidis* <SEQ ID 245>:

```
a080.seq
     1  ATGTGGGATA ATGCCGAAGC GATGGAACGG CTGACGCGCT GGCTGCTTGT

51  CATGATGGCG ATGCTGCTTG CTGCGTCCGG GCTGGTTTGG TTTTACAATT

101  CGAATCATCT GCCCGTCAAG CAGGTGTCGC TGAAGGGCAA CCTAGTTTAT

151  TCCGATAAGA AAGCATTGGG CAGTTTGGCG AAAGAATACA TCCATGGGAA

201  TATTTTGAGG ACGGACATCA ATGGCGCACA GGAGGCCTAC CGCCGGTATC

251  CGTGGATTGC GTCGGTCATG GTGCGCCGCC GTTTTCCCGA CACGGTTGAG

301  GTCGTCCTGA CCGAGCGCAA GCCGGTCGCG CGTTGGGGCG ACCATGCCTT

351  GGTGGACGGC GAAGGCAATG TTTTTGAAGC CCGTTTGGAC AGACCCGGAA

401  TGCCGGTATT CAGAGGCGCG GAAGGAACGT CTGCCGAAAT GCTCCGCCGT

451  TATGACGAAT TTTCGACTGT TTTGGCAAAA CAGGGTTTGG GCATCAAAGA

501  GATGACCTAT ACGGCACGTT CGGCGTGGAT TGTCGTTTTG GACAACGGCA

551  TCACCGTCAG GCTCGGACGG GAAAACGAGA TGAAACGCCT CCGGCTTTTT

601  ACCGAAGCGT GGCAACATCT GTTGCGTAAA AATAAAAATC GGTTATCCTA

651  TGTGGATATG AGGTATAAGG ACGGATTTTC AGTCCGCTAT GCTCCCGACG

701  GTTTACCCGA AAAAGAATCC GAAGAATAG
```

This corresponds to the amino acid sequence <SEQ ID 246; ORF 080.a>:

```
a080.pep
     1  MWDNAEAMER LTRWLLVMMA MLLAASGLVW FYNSNHLPVK QVSLKGNLVY

51  SDKKALGSLA KEYIHGNILR TDINGAQEAY RRYPWIASVM VRRRFPDTVE

101  VVLTERKPVA RWGDHALVDG EGNVFEARLD RPGMPVFRGA EGTSAEMLRR

151  YDEFSTVLAK QGLGIKEMTY TARSAWIVVL DNGITVRLGR ENEMKRLRLF

201  TEAWQHLLRK NKNRLSYVDM RYKDGFSVRY APDGLPEKES EE*
``` m080/a080 99.2% identity over a 242 aa overlap

```
                     10        20        30        40        50        60
m080.pep    MWDNAEAMERLTRWLLVMMAMLLAASGLVWFYNSNHLPVKQVSLKGNLVYSDKKTLGSLA
            ||||||||||||||||||||||||||||||||||||||||||||||||||||||:|||||
a080        MWDNAEAMERLTRWLLVMMAMLLAASGLVWFYNSNHLPVKQVSLKGNLVYSDKKALGSLA
                     10        20        30        40        50        60

70        80        90       100       110       120
m080.pep    KEYIHGNILRTDINGAQEAYRRYPWIASVMVRRRFPDTVEVVLTERKPVARWGDHALVDG
            ||||||||||||||||||||||||||||||||||||||||||||||||||||||||||||
a080        KEYIHGNILRTDINGAQEAYRRYPWIASVMVRRRFPDTVEVVLTERKPVARWGDHALVDG
                     70        80        90       100       110       120

130       140       150       160       170       180
m080.pep    EGNVFEARLDRPGMPVFRGAEGTSAEMLRRYDEFSTVLAKQGLGIKEMTYTARSAWIVVL
            ||||||||||||||||||||||||||||||||||||||||||||||||||||||||||||
a080        EGNVFEARLDRPGMPVFRGAEGTSAEMLRRYDEFSTVLAKQGLGIKEMTYTARSAWIVVL
                    130       140       150       160       170       180

190       200       210       220       230       240
m080.pep    DNGITVRLGRENEMKRLRLFTEAWQHLLRKNKNRLSYVDMRYKDGFSVRYASDGLPEKES
            |||||||||||||||||||||||||||||||||||||||||||||||||||| |||||||
a080        DNGITVRLGRENEMKRLRLFTEAWQHLLRKNKNRLSYVDMRYKDGFSVRYAPDGLPEKES
                    190       200       210       220       230       240 m080.pep    EEX
            |||
a080        EEX
```

The following partial DNA sequence was identified in *N. gonorrhoeae* <SEQ ID 247>:

```
g081.seq
   1 ATGAAACCAC TGGACCTAAA TTTCATCTGC CAAGGCTTCA AGCTTCCGAT
  51 GCCGTCTGAA AACAAACCCG TGTCGCGCAT CGTAACCGAC AGCCGCGATA
 101 TTCGGGAAGG CGATGTGTTT TTCGCATTGG CGGGCGGGCG GTTTGACGCG
 151 CATGATTTTG TTGGAGGCGT ATTGTCTGCG GGCGCGGCGG CGGTTGTGGT
 201 TTCGCGCGAA GATTGCGCGG CTTTGGGCGG CGCGTTGAAA GTCGATGACA
 251 CGCTTGCCGC GTTGCAAACG TTGGCGAAGG CGTGGCGCGA TAATGTGAAC
 301 CCGTTTGTGT TCGGCATTAC CGGTTCGGGC GGCAAGACGA CGGTGAAGGA
 351 GATGCTGGCT GCGGTATTGC GCCGCCGTTT CGGCGATGAT GCCGTTTCGG
 401 CGACGGCAGG CAACTTCAAC AACCACAtcg gaTTGCCGCT GACTTTATTG
 451 AAATtaaAcg aAAAACACCG CTATGCCGTG ATTGAAATGG GCATGAACCA
 501 TTTTGGcgaa ctggcggtTt taacgcaaaT CGCCAAACCC GATGCCGCTT
 551 TGGtcaACAA CGCCCTGCGC GCCCATGTCG GATGCGGTTt cgacggagtg
 601 GGCGATATTG CCAAAGcgaa aagcGAGATT TatgcagGct tATGTTCAGA
 651 CGGCATGGCA CTGATTCCTC AAGAAGATGC CAATATGGCT GTCTTCAAAA
 701 CGGCAACGTT TAATTTGAAT ACGTGCACTT TCGGCGTCGA TAGCGGCGAT
 751 GTCCGCGCGG AAAATATCGT GCTGAAACCT TTGTCGTGCG AATTTGATTT
 801 GGTGTGCGGC GACGAGCGCA CTGCCGTGGT GCTGCCTGTT CCCGGCCGCC
 851 ACAATGTCCA CAACGCCGCC GCTGCCGCCG CGCTGGCTTT GGCTGCCGGT
 901 TTGAGTTTGA ACGATGTGGC GGAAGGTTTG CAAGGCTTCA GCAACATCAA
 951 AGGCCGTCTG AACGTCAAAG CCGGCATCAA GGGCGCAACC CTGATTGACG
1001 ATACTTATAA TGCAATCCCC GACAGTATGA AAGCCGCGGT TGACGTGTTG
1051 GCGCGTATGC CTGCGCCGCG CATTTTCGTG ATGGGCGATA TGGGCGAACT
1101 GGGCGAGGAc gaAGCCGCCG CCATGCACGC CGAAgtcgGC GCGTACGCCC
1151 GCGACCAAGG CATCGAAGCG GCTTATTTTG TCGGCGACAA CAGCGTCGAA
1201 GCGGcggaAA AATTTGGCGC GGACGGTTTG TGGTTCGCCG CCAAAGACCC
1251 GTTGATTCAA GTGTTGAGCC ACGATTTGCC CGAACGCGCC ACCGTGTTGG
1301 TGAAAGGTTC GCGCTTTATG CAGAtggAAG AAGTGGTCGA GGCATTGGAG
1351 GATAAGTga
```

This corresponds to the amino acid sequence <SEQ ID 248; ORF 081.ng>:

```
g081.pep
   1 MKPLDLNFIC QALKLPMPSE NKPVSRIVTD SRDIREGDVF FALAGGRFDA
  51 HDFVGGVLSA GAAAVVVSRE DCAALGGALK VDDTLAALQT LAKAWRDNVN
 101 PFVFGITGSG GKTTVKEMLA AVLRRRFGDD AVSATAGNFN NHIGLPLTLL
 151 KLNEKHRYAV IEMGMNHFGE LAVLTQIAKP DAALVNNALR AHVGCGFDGV
 201 GDIAKAKSEI YAGLCSDGMA LIPQEDANMA VFKTATFNLN TCTFGVDSGD
 251 VRAENIVLKP LSCEFDLVCG DERTAVVLPV PGRHNVHNAA AAAALALAAG
 301 LSLNDVAEGL QGFSNIKGRL NVKAGIKGAT LIDDTYNANP DSMKAAVDVL
```

```
-continued
351 ARMPAPRIFV MGDMGELGED EAAAMHAEVG AYARDQGIEA AYFVGDNSVE

401 AAEKFGADGL WFAAKDPLIQ VLSHDLPERA TVLVKGSRFM QMEEVVEALE

451 DK*
```

The following partial DNA sequence was identified in *N. meningitidis* <SEQ ID 249>:

```
m081.seq
    1 ATGAAACCAC TGGACCTAAA TTTCATCTGC CAAGCCCTCA AGCTTCCGAT

51 GCCGTCTGAA AGCAAACCCG TGTCGCGCAT CGTAACCGAC AGCCGCGACA

101 TCCGCGCGGG CGATGTGTTT TTCGCATTGG CGGGCGAGCG GTTTGACGCG

151 CATGATTTTG TTGAAGACGT ATTGGCTGCT GGTGCGGCGG CGGTTGTGGT

201 TTCGCGCGAA GATTGTGCTG CAATGGATGG CGCGTTGAAA GTCGATGACA

251 CGCTTGCCGC ATTGCAAACG CTGGCAAAGG CGTGGCGTGA AAATGTGAAT

301 CCGTTTGTGT TCGGCATTAC CGGTTCGGGC GGCAAGACGA CGGTGAAGGA

351 AATGCTGGCT GCGGTATTGC GCCgCCGTTT CGGCGATGAT GCCGTGTTGG

401 CGACGGCAGG CAACTTCAAC AACCATATCG GATTGCCGCT GACTTTGTTG

451 AAGTTAAACG AAAAACACCG CTATGCCGTG ATTGAAATGG CATGAACCA

501 TTTCGGCGAA CTGGCGGTTT TAACGCAmAT CGCCAAACCA AATGCCGCAT

551 TGGTCAACAA CGCCATGCGC GCCCATGTCG GCTGCGGTTT CGACGGAGTG

601 GGCGATATTG CCAAAGCGAA AAGCGAGATT TACCAAGGTT TATGTTCAGA

651 CGGCATTGCA CTGATTCCTC AAGAAGATGC CAATATGGCT GTCTTCAAAA

701 CGGCAACGCT TAATTTGAAT ACGCGCACTT TCGGCATCGA TAGCGGCGAT

751 GTTCACGCGG AAAATATTGT GCTGAAACCG TTGTCGTGCG AATTTGATTT

801 GGTGTGCGGC GATGAGCGCG CCGCCGTGGT GCTGCCTGTT CCCGGCCGCC

851 ACAATGTCCA CAACGCCGCC GCTGCCGCCG CGCTGGCTTT GGCTGCGGGT

901 TTGAGTTTGA ACGATGTGGC GGAAGGTTTG AAAGGCTTCA GCAATATCAA

951 AGGCCGTCTG AACGTCAAAT CCGGAATCAA GGGCGCAACC CTGATTGACG

1001 ATACTTATAA TGCGAACCCT GACAGCATGA AAGCTGCGAT TGACGTGTTG

1051 GCGCGTATGC CTGCGCCGCG TATTTTCGTG ATGGGCGATA TGGGCGAACT

1101 GGGCGAACTG GGCGAGGACG AAGCCGCCGC TATGCACGCC GAAGTCGGCG

1151 CGTATGCCCG CGACCAAGGC ATCGAAGCGG CTTATTTTGT CGGCGACAAC

1201 AGCGTCGAAG CGGCGGAAAA ATTTGGCGCG GACGGTTTGT GGTTCGCCGC

1251 CAAAGACCCG TTGATTCAAG TGTTGCGCCA CGATTTGCCC GAACGCGCCA

1301 CCGTGTTGGT GAAAGGTTCG CGCTTTATGC AGATGGAAGA AGTGGTCGAG

1351 GCATTGGAGG ATAAGTGA
```

This corresponds to the amino acid sequence <SEQ ID 250; ORF 081>:

```
m081.pep
    1 MKPLDLNFIC QALKLPMPSE SKPVSRIVTD SRDIRAGDVF FALAGERFDA

51 HDFVEDVLAA GAAAVVVSRE DCAAMDGALK VDDTLAALQT LAKAWRENVN

101 PFVFGITGSG GKTTVKEMLA AVLRRRFGDD AVLATAGNFN NHIGLPLTLL
```

```
                              -continued
151  KLNEKHRYAV  IEMGMNHFGE  LAVLTXIAKP  NAALVNNAMR  AHVGCGFDGV

201  GDIAKAKSEI  YQGLCSDGIA  LIPQEDANMA  VFKTATLNLN  TRTFGIDSGD

251  VHAENIVLKP  LSCEFDLVCG  DERAAVVLPV  PGRHNVHNAA  AAAALALAAG

301  LSLNDVAEGL  KGFSNIKGRL  NVKSGIKGAT  LIDDTYNANP  DSMKAAIDVL

351  ARMPAPRIFV  MGDMGELGEL  GEDEAAAMHA  EVGAYARDQG  IEAAYFVGDN

401  SVEAAEKFGA  DGLWFAAKDP  LIQVLRHDLP  ERATVLVKGS  RFMQMEEVVE

451  ALEDK*
```

Computer analysis of this amino acid sequence gave the following results:

Homology with a Predicted ORF from *N. gonorrhoeae*
ORF 081 shows 94.1% identity over a 455 aa overlap with a predicted ORF (ORF 081.ng) from *N. gonorrhoeae*:

```
    m081/g081

10         20         30         40         50         60
    m081.pep  MKPLDLNFICQALKLPMPSESKPVSRIVTDSRDIRAGDVFFALAGERFDAHDFVEDVLAA
              ||||||||||||||||||||:||||||||||||| |||||||| ||||||||| ||:|
    g081      MKPLDLNFICQALKLPMPSENKPVSRIVTDSRDIREGDVFFALAGGRFDAHDFVGGVLSA
                  10         20         30         40         50         60

70         80         90        100        110        120
    m081.pep  GAAAVVVSREDCAAMDGALKVDDTLAALQTLAKAWRENVNPFVFGITGSGGKTTVKEMLA
              |||||||||||||:|  |||||||||||||||||||:|||||||||||||||||||||||
    g081      GAAAVVVSREDCAALGGALKVDDTLAALQTLAKAWRDNVNPFVFGITGSGGKTTVKEMLA
                  70         80         90        100        110        120

130        140        150        160        170        180
    m081.pep  AVLRRRFGDDAVLATAGNFNNHIGLPLTLLKLNEKHRYAVIEMGMNHFGELAVLTXIAKP
              ||||||||||||  ||||||||||||||||||||||||||||||||||||||||| ||||
    g081      AVLRRRFGDDAVSATAGNFNNHIGLPLTLLKLNEKHRYAVIEMGMNHFGELAVLTQIAKP
                 130        140        150        160        170        180

190        200        210        220        230        240
    m081.pep  NAALVNNAMRAHVGCGFDGVGDIAKAKSEIYQGLCSDGIALIPQEDANMAVFKTATLNLN
              :||||||:|||||||||||||||||||||||||| |||||:||||||||||||||||||
    g081      DAALVNNALRAHVGCGFDGVGDIAKAKSEIYAGLCSDGMALIPQEDANMAVFKTATFNLN
                 190        200        210        220        230        240

190        200        210        220        230        240
    m081.pep  TRTFGIDSGDVHAENIVLKPLSCEFDLVCGDERAAVVLPVPGRHNVHNAAAAAALALAAG
              | |||:|||||| ||||||||||||||||||||: |||||||||||||||||||||||||
    g081      TCTFGVDSGDVRAENIVLKPLSCEFDLVCGDERTAVVLPVPGRHNVHNAAAAAALALAAG
                 190        200        210        220        230        240

310        320        330        340        350        360
    m081.pep  LSLNDVAEGLKGFSNIKGRLNVKSGIKGATLIDDTYNANPDSMKAAIDVLARMPAPRIFV
              ||||||||||:||||||||||||| |||||||||||||||||||||:|||||||||||||
    g081      LSLNDVAEGLQGFSNIKGRLNVKAGIKGATLIDDTYNANPDSMKAAVDVLARMPAPRIFV
                 310        320        330        340        350        360

370        380        390        400        410        420
    m081.pep  MGDMGELGELGEDEAAAMHAEVGAYARDQGIEAAYFVGDNSVEAAEKFGADGLWFAAKDP
              |||||||||   |||||||||||||||||||||||||||||||||||||||||||||||
    g081      MGDMGELGE---DEAAAMHAEVGAYARDQGIEAAYFVGDNSVEAAEKFGADGLWFAAKDP
                 370        380        390        400        410        420

430        440        450
    m081.pep  LIQVLRHDLPERATVLVKGSRFMQMEEVVEALEDKX
              |||||  |||||||||||||||||||||||||||||
    g081      LIQVLSHDLPERATVLVKGSRFMQMEEVVEALEDKX
                 430        440        450
```

The following partial DNA sequence was identified in *N. meningitidis* <SEQ ID 251>:

```
    a081.seq
      1  ATGAAACCAC  TGGACCTAAA  TTTCATCTGC  CAAGCCCTCA  AGCTTCCGAT

51  GCCGTCTGAA  AGCAAACCCG  TGTCGCGCAT  CGTAACCGAC  AGCCGCGACA

101  TCCGCGCGGG  CGATGTGTTT  TTCGCATTGG  CGGGCGGGCG  GTTTGATGCG

151  CATGATTTTG  TTGAAGACGT  ATTGGCTGCG  GGTGCGGCGG  CGGTTGTGGT
```

```
 201  TTCGCGCGAA GATTGCGTTG CAATGGATGG CGCGTTGAAA GTCGATGACA

251  CGCTTACCGC GTTGCAAATG TTGGCGAAGG CGTGGCGCGA GAATGTGAAC

301  CCGTTTGTGT TCGGTATTAC CGGCTCGGGC GGCAAGACGA CGGTGAAGGA

351  AATGTTGGCT GCGGTATTGC GCCGCCGTTT CGGCGATAAT GCCGTTTTGG

401  CGACGGCAGG CAACTTCAAC AACCACATCG GATTGCCGTT GACTTTGTTG

451  AAATTAAACG AAAAACACCG CTATGCCGTG ATTGAAATGG GTATGAACCA

501  TTTTGGCGAA CTGGCGGTTT TGACACAAAT CGCCAAACCC GATGCCGCAT

551  TGGTCAACAA CGCCATGCGC GCCCATGTCG GCTGCGGTTT CGACGGAGTG

601  GGCGATATTG CCAAAGCGAA AAGCGAGATT TATCAAGGCT TATGTTCAGA

651  CGGCATGGCG CTGATTCCTC AAGAAGATGC CAATATGGCT GTCTTCAAAA

701  CGGCAACGCT TAATTTGAAT ACGCGCACTT TCGGCATCGA TAGCGGCGAT

751  GTCCACGCGG AAAATATCGT GCTGAAACCG TTGTCGTGCG AATTTGATTT

801  GGTGTGCGGC AACGAGTGCG CAGCCGTGGT TCTGCCCGTT CCCGGCCGCC

851  ACAATGTCCA CAACGCCGCC GCCGCCGCCG CGCTGTCTTT GGCTGCAGGT

901  TTGAGTTTGA ACGATGTGGC GGAAGGTTTG AAAGGCTTCA GCAATATCAA

951  AGGCCGTCTG AACGTCAAAT CCGGAATCAA GGGCGCAACC CTGATTGACG

1001  ATACTTATAA TGCGAACCCT GACAGCATGA AAGCTGCGGT TGACGTGTTG

1051  GCGCGTATGC CTGCGCCGCG TATTTCGTG ATGGGCGATA TGGGCGAACT

1101  GGGTGAGGAC GAAGCCGCCG CCATGCACGC CGAAGTCGGC GCGTACGCCC

1151  GCGACCAAGG CATCGAAGCG GCTTATTTTG TCGGCGACAA CAGCGTCGAA

1201  GCGGCGGAAA AATTTGGCGC GGACGGTTTG TGGTTCGCCG CCAAAGACCC

1251  GTTGATTCAA GTGTTGCGCC ACGATTTGCC CGAACGCGCC ACCGTGTTGG

1301  TGAAAGGTTC GCGCTTTATG CAGATGGAAG AAGTGGTCGA GGCATTGGAG

1351  GATAAGTGA
```

This corresponds to the amino acid sequence <SEQ ID 252; ORF 081.a>:

```
a081.pep
   1  MKPLDLNFIC QALKLPMPSE SKPVSRIVTD SRDIRAGDVF FALAGGRFDA

51  HDFVEDVLAA GAAAVVVSRE DCVAMDGALK VDDTLTALQM LAKAWRENVN

101  PFVFGITGSG GKTTVKEMLA AVLRRRFGDN AVLATAGNFN NHIGLPLTLL

151  KLNEKHRYAV IEMGMNHFGE LAVLTQIAKP DAALVNNAMR AHVGCGFDGV

201  GDIAKAKSEI YQGLCSDGMA LIPQEDANMA VFKTATLNLN TRTFGIDSGD

251  VHAENIVLKP LSCEFDLVCG NECAAVVLPV PGRHNVHNAA AAALSLAAG

301  LSLNDVAEGL KGFSNIKGRL NVKSGIKGAT LIDDTYNANP DSMKAAVDVL

351  ARMPAPRIFV MGDMGELGED EAAAMHAEVG AYARDQGIEA AYFVGDNSVE

401  AAEKFGADGL WFAAKDPLIQ VLRHDLPERA TVLVKGSRFM QMEEVVEALE

451  DK*
``` m081/a081 96.7% identity over a 455 aa overlap

```
                   10         20         30         40         50         60
m081.pep   MKPLDLNFICQALKLPMPSESKPVSRIVTDSRDIRAGDVFFALAGERFDAHDFVEDVLAA
           ||||||||||||||||||||||||||||||||||||||||| ||||||||||||||||||
a081       MKPLDLNFICQALKLPMPSESKPVSRIVTDSRDIRAGDVFFALAGGRFDAHDFVEDVLAA
                   10         20         30         40         50         60

70         80         90        100        110        120
m081.pep   GAAAVVVSREDCAAMDGALKVDDTLAALQTLAKAWRENVNPFVFGITGSGGKTTVKEMLA
           ||||||||||||:|||||||||||||:||| |||||||||||||||||||||||||||||
a081       GAAAVVVSREDCVAMDGALKVDDTLTALQMLAKAWRENVNPFVFGITGSGGKTTVKEMLA
                   70         80         90        100        110        120

130        140        150        160        170        180
m081.pep   AVLRRRFGDDAVLATAGNFNNHIGLPLTLLKLNEKHRYAVIEMGMNGFGELAVLTXIAKP
           |||||||||:|||||||||||||||||||||||||||||||||||| ||||||||| |||
a081       AVLRRRFGDNAVLATAGNFNNHIGLPLTLLKLNEKHRYAVIEMGMNHFGELAVLTQIAKP
                   130        140        150        160        170        180

190        200        210        220        230        240
m081.pep   NAALVNNAMRAHVGCGFDGVGDIAKAKSEIYQGLCSDGIALIPQEDANMAVFKTATLNLN
           :||||||||||||||||||||||||||||||||||||:|||||||||||||||||||||
a081       DAALVNNAMRAHVGCGFDGVGDIAKAKSEIYQGLCSDGMALIPQEDANMAVFKTATLNLN
                   190        200        210        220        230        240

250        260        270        280        290        300
m081.pep   TRTFGIDSGDVHAENIVLKPLSCEFDLVCGDERAAVVLPVPGRHNVHNAAAAAALALAAG
           ||||||||||||||||||||||||||||||:| |||||||||||||||||||||:||||
a081       TRTFGIDSGDVHAENIVLKPLSCEFDLVCGNECAAVVLPVPGRHNVHNAAAAAALSLAAG
                   250        260        270        280        290        300

310        320        330        340        350        360
m081.pep   LSLNDVAEGLKGFSNIKGRLNVKSGIKGATLIDDTYNANPDSMKAAIDVLARMPAPRIFV
           ||||||||||||||||||||||||||||||||||||||||||||||:|||||||||||||
a081       LSLNDVAEGLKGFSNIKGRLNVKSGIKGATLIDDTYNANPDSMKAAVDVLARMPAPRIFV
                   310        320        330        340        350        360

370        380        390        400        410        420
m081.pep   MGDMGELGELGEDEAAAMHAEVGAYARDQGIEAAYFVGDNSVEAAEKFGADGLWFAAKDP
           ||||||||||   |||||||||||||||||||||||||||||||||||||||||||||||
a081       MGDMGELGE---DEAAAMHAEVGAYARDQGIEAAYFVGDNSVEAAEKFGADGLWFAAKDP
                   370        380        390        400        410

430        440        450
m081.pep   LIQVLRHDLPERATVLVKGSRFMQMEEVVEALEDKX
           |||||||||||||||||||||||||||||||||||
a081       LIQVLRHDLPERATVLVKGSRFMQMEEVVEALEDKX
                   420        430        440        450
```

The following partial DNA sequence was identified in *N. gonorrhoeae* <SEQ ID 253>:

```
g082.seq
    1   aTGTGGTTGT TGAAGTTGCC TGCCGTCGCC GAAACGGCAT CATCGCCGAA
   51   ACGGCGGCGC AATACCGCAG CCAGCATCTC CTTCACCGTC GTCTTGCCGC
  101   CCGAACCGGT AATGCCGAAC ACAAACGGGT TCACATTATC GCGCCACGCC
  151   TTCGCCAACG TTTGCAACGC GGCAAGCGTG TCATCGACTT TCAACGCGCC
  201   GCCCAAAGCC GCGCAATCTT CGCGCGAAAC CACAACCGCC GCCGCGCCCG
  251   CAGACAATAC GCCTCCAACA AAATCATGCG CGTCAAACCG CCCGCCCGCC
  301   AATGCGAAAA ACACATCGCC TTCCCGAATA TCGCGGCTGT CGGTTACGAT
  351   GCGCGACACG GGTTTGTTTT CAGACGGCAT CGGAAGCTTG AGGGCTTGGC
  401   AGATGAAATT TAGGTCCAGT GGTTTCATAT TTGCTTTCGT TAATATTCGG
  451   GCGGCGGACA CATCGGTAGC GGCTGATTTT TTTATCGCCT GTTTTGCTGT
  501   GGTAAAACAC AGATTATTTT CCCATTCTCA TTCGGCATTT TTTCTGTACG
  551   TATCATTTTT TAGACGTATT TTTAGCCGAT TGCCTTTTC CCGCATACCA
  601   CGGCGCGGGG TCGTCGGACT GTCTGTCGAT AAAGGCAAGG TTATTGCCTT
  651   CGCCCGGCAC ATCGGGGACA TTCCCCCAAA AATCATAGCC GTCATCGGGC
  701   AACTCGTCGG TTTCGATACC CGTCCAACTG CCGAATCCGC GTAA
```

This corresponds to the amino acid sequence <SEQ ID 254; ORF 082.ng>:

```
g082.pep
    1 MWLLKLPAVA ETASSPKRRR NTAASISFTV VLPPEPVMPN TNGFTLSRHA

51 FANVCNAASV SSTFNAPPKA AQSSRETTTA AAPADNTPPT KSCASNRPPA

101 NAKNTSPSRI SRLSVTMRDT GLFSDGIGSL RAWQMKFRSS GFIFAFVNIR

151 AADTSVAADF FIACFAVVKH RLFSHSHSAF FLYVSFFRRI FSRFAFSRIP

201 RRGVVGLSVD KGKVIAFARH IGDIPPKIIA VIGQLVGFDT RPTAESA*
```

The following partial DNA sequence was identified in *N. meningitidis* <SEQ ID 255>:

```
m082.seq
    1 ATGnnGTTGT TGAAGTTGCC TGCCGTCGCC AACACGGCAT CATCGCCGAA

51 ACGGcGGCGC AATACCGCAG CCAGCATTTC CTTCACCGTC GTCTTGCCGC

101 CCGAACCGGT AATGCCGAAC ACAAACGGAT TCACATTTTC ACGCCACGCC

151 TTTGCCAGCG TTTGCAATGC GGCAAGCGTG TCATCGACTT TCAACGCGCC

201 ATCCATTGCA GCACAATCTT CGCGCGAAAC CACAACCGCC GCCGCACCAG

251 CAGCCAATAC GTCTTCAACA AAATCATGCG CGTCAAACCG CTCGCCCGCC

301 AATGCGAAAA ACACATCGCC CGCGCGGATG TCGCGGCTGT CGGTTACGAT

351 GCGCGACACG GGTTTGCTTT CAGACGGCAT CGGAAGCTTG AGGGCTTGGC

401 AGATGAAATT TAGGTCCAGT GGTTTCATAT TTACTTTCGT TAATATTCGG

451 GCGGCGGACA CATCGGTAGC GGCTGATTTT TTTATCGCCT GTTTTGCTGT

501 GGTAAAACAC AGATTATTTT CCCATTCTCA TTCGGsATTT TTTCTGTACG

551 TATCATTTTT TAGACGTATT TTTAGTCGAT TTGCCTTTTC CCGCATACCA

601 CGGCGCGGGG TCGTCGGGCA GTCCGTCGAT AAAGGCAAGG TTATTGCCTT

651 CGCCCTGCAC ATCGGGAACA TTCCCCCAAA AATCATAGCC GTCATCGGGC

701 AACTCGTCGG TTTCGATACC CGTCCAACTG CCGAATCCGC GTAA
```

This corresponds to the amino acid sequence <SEQ ID 256; ORF 082>:

```
m082.pep
    1 MXLLKLPAVA NTASSPKRRR NTAASISFTV VLPPEPVMPN TNGFTFSRHA

51 FASVCNAASV SSTFNAPSIA AQSSRETTTA AAPAANTSST KSCASNRSPA

101 NAKNTSPARM SRLSVTMRDT GLLSDGIGSL RAWQMKFRSS GFIFTFVNIR

151 AADTSVAADF FIACFAVVKH RLFSHSHSXF FLYVSFFRRI FSRFAFSRIP

201 RRGVVGQSVD KGKVIAFALH IGNIPPKIIA VIGQLVGFDT RPTAESA*
```

Computer analysis of this amino acid sequence gave the following results:
Homology with a Predicted ORF from *N. gonorrhoeae*
ORF 082 shows 92.7% identity over a 247 aa overlap with a predicted ORF (ORF 082.ng) from *N. gonorrhoeae*:

```
    m082/g082

10         20         30         40         50         60
    m082.pep  MXLLKLPAVANTASSPKRRRNTAASISFTVVLPPEPVMPNTNGFTFSRHAFASVCNAASV
              |||||||:||||||:|||||||||||||||||||||||||||||:|||||:||||||
    g082      MWLLKLPAVAETASSPKRRRNTAASISFTVVLPPEPVMPNTNGFTLSRHAFANVCNAASV
                  10         20         30         40         50         60

70         80         90        100        110        120
    m082.pep  SSTFNAPSIAAQSSRETTTAAAPAANTSSTKSCASNRSPANAKNTSPARMSRLSVTMRDT
              ||||||| ||||||||||||||  ||||||||| |||||||||:|:|||||||||||
    g082      SSTFNAPPKAAQSSRETTTAAAPADNTPPTKSCASNRPPANAKNTSPSRISRLSVTMRDT
                  70         80         90        100        110        120

130        140        150        600        170        180
    m082.pep  GLLSDGIGSLRAWQMKFRSSGFIFTFVNIRAADTSVAADFFIACFAVVKHRLFSHSHSXF
              ||:|||||||||||||||||||:||||||||||||||||||||||||||||||||| |
    g082      GLFSDGIGSLRAWQMKFRSSGFIFAFVNIRAADTSVAADFFIACFAVVKHRLFSHSHSAF
                 130        140        150        600        170        180

190        200        210        220        230        240
    m082.pep  FLYVSFFRRIFSRFAFSRIPRRGVVGQSVDKGKVIAFALHIGNIPPKIIAVIGQLVGFDT
              |||||||||||||||||||||||||   |||||||||| |||:|||||||||||||||
    g082      FLYVSFFRRIFSRFAFSRIPRRGVVGLSVDKGKVIAFARHIGDIPPKIIAVIGQLVGFDT
                 190        200        210        220        230        240 m082.pep  RPTAESAX
              ||||||||
    g082      RPTAESAX
```

The following partial DNA sequence was identified in *N. meningitidis* <SEQ ID 257>:

```
    a082.seq
      1  ATGTGGTTGT TGAAGTTGCC TGCCGTCGCC AAAACGGCAT TATCGCCGAA

51  ACGGCGGCGC AATACCGCAG CCAACATTTC CTTCACCGTC GTCTTGCCGC

101  CCGAGCCGGT AATACCGAAC ACAAACGGGT TCACATTCTC GCGCCACGCC

151  TTCGCCAACA TTTGCAACGC GGTAAGCGTG TCATCGACTT TCAACGCGCC

201  ATCCATTGCA ACGCAATCTT CGCGCGAAAC CACAACCGCC GCCGCACCCG

251  CAGCCAATAC GTCTTCAACA AAATCATGCG CATCAAACCG CCCGCCCGCC

301  AATGCGAAAA ACACATCGCC CGCGCGGATG TCGCGGCTGT CGGTTACGAT

351  GCGCGACACG GGTTTGCTTT CAGACGGCAT CGGAAGCTTG AGGGCTTGGC

401  AGATGAAATT TAGGTCCAGT GGTTTCATAT TTACTTTCGT TAATATTCGG

451  GCGGCGGACA CATCGGTAGC GGCTGATTTT TTTATCGCCT GTTTTGCTGT

501  GGTAAAACAC AGATTATTTT CCCATTCTCA TTCGGCATTT TTTCTGTACG

551  TATCATTTTT TAGACGTATT TTTAGTCGAT TTGCCTTTTC CCGCATACCA

601  CGGCGCGGGG TCGTCGGGCA GTCCGTCGAT AAAGGCAAGG TTATTGCCTT

651  CGCCCTGCAC ATCGGGAACA TTCCCCCAAA AATCATAGCC GTCATCGGGC

701  AACTCGTCGG TTTCGATACC CGTCCAACTG CCGAATCCGC GTAA
```

This corresponds to the amino acid sequence <SEQ ID 258; ORF 082.a>:

```
    a082.pep
      1  MWLLKLPAVA KTALSPKRRR NTAANISFTV VLPPEPVIPN TNGFTFSRHA

51  FANICNAVSV SSTFNAPSIA TQSSRETTTA AAPAANTSST KSCASNRPPA
```

-continued

```
101 NAKNTSPARM SRLSVTMRDT GLLSDGIGSL RAWQMKFRSS GFIFTFVNIR

151 AADTSVAADF FIACFAVVKH RLFSHSHSAF FLYVSFFRRI FSRFAFSRIP

201 RRGVVGQSVD KGKVIAFALH IGNIPPKIIA VIGQLVGFDT RPTAESA*
``` m082/a082 95.5% identity over a 247 aa overlap

```
                    10         20         30         40         50         60
m082.pep  MXLLKLPAVANTASSPKRRRNTAASISFTVVLPPEPVMPNTNGFTFSRHAFASVCNAASV
          ||||||||:|| |||||||||||:||||||||||||:||||||||||||::|||:||
a082      MWLLKLPAVAKTALSPKRRRNTAANISFTVVLPPEPVIPNTNGFTFSRHAFANICNAVSV
                    10         20         30         40         50         60
                    70         80         90        100        110        120
m082.pep  SSTFNAPSIAAQSSRETTTAAAPAANTSSTKSCASNRSPANAKNTSPARMSRLSVTMRDT
          |||||||||:||| ||||||||:||||||||||||||||:||||||||||||||||||
a082      SSTFNAPSIATQSSRETTTAAAPAANTSSTKSCASNRPPANAKNTSPARMSRLSVTMRDT
                    70         80         90        100        110        120
                   130        140        150        160        170        180
m082.pep  GLLSDGIGSLRAWQMKFRSSGFIFTFVNIRAADTSVAADFFIACFAVVKHRLFSHSHSXF
          ||||||||||||||||||||||||||||||||||||||||||||||||||||||||||
a082      GLLSDGIGSLRAWQMKFRSSGFIFTFVNIRAADTSVAADFFIACFAVVKHRLFSHSHSAF
                   130        140        150        160        170        180
                   190        200        210        220        230        240
m082.pep  FLYVSFFRRIFSRFAFSRIPRRGVVGQSVDKGKVIAFALHIGNIPPKIIAVIGQLVGFDT
          ||||||||||||||||||||||||||||||||||||||||||||||||||||||||||
a082      FLYVSFFRRIFSRFAFSRIPRRGVVGQSVDKGKVIAFALHIGNIPPKIIAVIGQLVGFDT
                   190        200        210        220        230        240
m082.pep  RPTAESAX
          ||||||||
a082      RPTAESAX
```

The following partial DNA sequence was identified in *N. gonorrhoeae* <SEQ ID 259>:

```
g084.seq
    1 ATGAAacaAT CCGcccgaat aAAAAATATG GATCAGACAT TAAAAAATAc 51 attgggcatt tGCGCGcttt tagcctTTTG TTTTggcgcG gccaTCGCAT

101 CAGGTTATCA CTTGGAATAT GAATACGGCT ACCGTTATTC TGCCGTGGGC

151 GCTTTGGCTT CGGTTGTATT TTTATTATTA TTGGCACGCG GCTTCCCGCG

201 CGTTTCTTCA GTTGTTTTAC TGATTTACGT CGGCACAACC GCCCTATATT

251 TGCCGGTCGG CTGGCTGTAT GGTGCGCCTT CTTATCAGAT AGTCGGTTCG

301 ATATTGGAAA GCAATCCTGC CGAGGCGCGT GAATTTGTCG GCAATCTTCC

351 CGGGTCGCTT TATTTTGTGC AGGCATTATT TTTCATTTTT GGCTTGACAG

401 TTTGGAAATA TTGTGTATCT GTGGGGGTAT TTGCTGACGT AAAAAACTAT

451 AAACGTCGCA GCAAAATATG GCTGACCATA TTATTGACTT TGATTTTGTC

501 CTGCGCGGTG ATGGAGAAAA TCGccggcga taaAGATTGG CGAGaacctg 551 atgccggcct gttgttgaat ATTTTcgacc tgtattaCga cttggctttc 601 cgcgccggca cAATATGCCG CCAAGCGCGC CCAcattttg gaagCagcaa 651 aaaaaacatC AACATGGCAt atccaccaac ttacacccaa aTAtaa
```

This corresponds to the amino acid sequence <SEQ ID 260; ORF 084.ng>:

```
g084.pep
  1 MKQSARIKNM DQILKNTLGI CALLAFCFGA AIASGYHLEY EYGYRYSAVG

51 ALASVVFLLL LARGFPRVSS VVLLIYVGTT ALYLPVGWLY GAPSYQIVGS
```

```
101 ILESNPAEAR EFVGNLPGSL YFVQALFFIF GLTVWKYCVS VGVFADVKNY

151 KRRSKIWLTI LLTLILSCAV MEKIAGDKDW REPDAGLLLN IFDLYYDLAF

201 RAGTICRQAR PHFGSSKKSV NMAYPPTCAQ V*
```

The following partial DNA sequence was identified in *N. meningitidis* <SEQ ID 261>:

```
m084.seq
  1 ATGAAACAAT CCGCCcGAAT AAAa.ATATG AATCAGACAT TACTTTATAC

51 ATTGGGCATT TGCGCGCTTT TAACCTTTnn nnnnnnnnnn nnnnnnnnnn 101 nnnnnTATCA CCCnGAATAT GAATACGGCT ACCGTTATTC TGCCGTGGGT

151 GCTTTGGCTT CGGTTGTATT TTTATTATTA TTGGCACGCG GTTTCCCGCG

201 CGTTTCTTCA GTTGTTTTAC TGATTTACGT CGGCACAACC GCCCTATATT

251 TGCCGGTCGG CTGGCTGTAT GGTGCGCCGT CTTATCAGAT AGTCGGTTCG

301 ATATTGGAAA GCAATCCTGC CGAGGCGCGT GAATTTGTCG GCAATCTTCC

351 CGGGTCGCTT TATTTTGTGC AGGCATTATT TTTCATTTTT GGCTTGACAG

401 TTTGGAAATA TTGTGTATCG GGGGGGGTAT TTGCTGACGT AAAAAACTAT

451 AAACGCCGCA GCAAAATATG GCTGACTATA TTATTGACTT TGATTTTGTC

501 CTGCGCGGTG ATGGATAAAA TCGCCAGCGA TAAAGATTTG CGAGAACCTG

551 ATGCCGGCCT GTTGTTGAAT ATTTTCGACC TGTATTACGA TTTGGCT.TC

601 CGCGCCGGCA CAATATGCCG CCAAGCGCGC CCACATTTTG GAAGCAGCAA

651 AAAAAGCGTC AACATGGCAT ATCCGTCATG TTGCGCCCAA GTATAA
```

This corresponds to the amino acid sequence <SEQ ID 262; ORF 084>:

```
m084.pep
  1 MKQSARIKXM NQTLLYTLGI CALLTFXXXX XXXXXYHPEY EYGYRYSAVG

51 ALASVVFLLL LARGFPRVSS VVLLIYVGTT ALYLPVGWLY GAPSYQIVGS

101 ILESNPAEAR EFVGNLPGSL YFVQALFFIF GLTVWKYCVS GGVFADVKNY

151 KRRSKIWLTI LLTLILSCAV MDKIASDKDL REPDAGLLLN IFDLYYDLAX

201 RAGTICRQAR PHFGSSKKSV NMAYPSCCAQ V*
```

Computer analysis of this amino acid sequence gave the following results:

Homology with a Predicted ORF from *N. gonorrhoeae*

ORF 084 shows 90.5% identity over a 231 aa overlap with a predicted ORF (ORF 084.ng) from *N. gonorrhoeae*:

```
m084/g084

10         20         30         40         50
       m084.pep  MKQSARIKXMNQTLLYTLGICALLTF---------YHPEYEYGYRYSAVGALASVVFLLL
                 ||||||||:||| ||||||||:|       || ||||||||||||||||||||||||
       g084      MKQSARIKNMDQTLKNTLGICALLAFCFGAAIASGYHLEYEYGYRYSAVGALASVVFLLL
                    10         20         30         40         50         60

60         70         80         90        100        110
       m084.pep  LARGFPRVSSVVLLIYVGTTALYLPVGWLYGAPSYQIVGSILESNPAEAREFVGNLPGSL
                 ||||||||||||||||||||||||||||||||||||||||||||||||||||||||||||
       g084      LARGFPRVSSVVLLIYVGTTALYLPVGWLYGAPSYQIVGSILESNPAEAREFVGNLPGSL
                    70         80         90        100        110        120
```

-continued

```
                120       130       140       150       160       170
m084.pep   YFVQALFFIFGLTVWKYCVSGGVFADVKNYKRRSKIWLTILLTLILSCAVMDKIASDKDL
           |||||||||||||||||||| |||||||||||||||||||||||||||||||:|||:|||
g084       YFVQALFFIFGLTVWKYCVSVGVFADVKNYKRRSKIWLTILLTLILSCAVMEKIAGDKDW
                  130       140       150       160       170       180

180       190       200       210       220
m084.pep   REPDAGLLLNIFDLYYDLAXRAGTICRQARPHFGSSKKSVNMAYPSCCAQVX
           ||||||||||||||||||| ||||||||||||||||||||||||   |||||
g084       REPDAGLLLNIFDLYYDLAFRAGTICRQARPHFGSSKKSVNMAYPPTCAQVX
                  190       200       210       220       230
```

The following partial DNA sequence was identified in *N. meningitidis* <SEQ ID 263>:

```
a084.seq
  1ATGAAACAAT CCGCCCGAAT AAAAAATATG GATCAGACAT TAAAAAATAC

51ATTGGGCATT TGCGCGCTTT TAGCCTTTTG TTTTGGCGCG GCCATCGCAT

101CAGGTTATCA CTTGGAATAT GAATACGGCT ACCGTTATTC TGCCGTGGGT

151GCTTTGGCTT CGGTTGTATT TTTATTATTA TTGGCACGCG GTTTCCCGCG

201CGTTTCTTCA GTTGTTTTAC TGATTTACGT CGGCACAACC GCCCTATATT

251TGCCGGTCGG CTGGCTGTAT GGTGCGCCGT CTTATCAGAT AGTCGGTTCG

301ATATTGGAAA GCAATCCTGC CGAGGCGCGT GAATTTGTCG GCAATCTTCC

351CGGGTCGCTT TATTTTGTGC AGGCATTATT TTTCATTTTT GGCTTGACAG

401TTTGGAGATA TTGTGTATCG GGGGGGGTAT TTGCTGACGT AAAAAACTAT

451AAACGCCGCA GCAAAATATG GCTGACTATA TTATTGACTT TGATTTTGTC

501CTGCGCGGTG ATGGATAAAA TCGCCAGCGA TAAAGATTTG CGAGAACCTG

551ATGCCGGCCT GTTGTTGAAT ATTTTCGACC TGTATTACGA TTTGGCTTCC

601.GCGCCGGCA CAATATGCCG CCAAGCGCGC CCACATTTTG GAAGCAGCAA

651AAAAAGCGTC AACATGGCAT ATCCGTCATG TTGCGCCCAA GTATAA
```

This corresponds to the amino acid sequence <SEQ ID 264; ORF 084.a>:

```
a084.pep
  1MKQSARIKNM DQTLKNTLGI CALLAFCFGA AIASGYHLEY EYGYRYSAVG

51ALASVVFLLL LARGFPRVSS VVLLIYVGTT ALYLPVGWLY GAPSYQIVGS

101ILESNPAEAR EFVGNLPGSL YFVQALFFIF GLTVWRYCVS GGVFADVKNY

151KRRSKIWLTI LLTLILSCAV MDKIASDKDL REPDAGLLLN IFDLYYDLAS

201XAGTICRQAR PHFGSSKKSV NMAYPSCCAQ V*
``` m084/a084 92.2% identity over a 231 aa overlap

```
                   10        20        30        40        50        60
m084.pep   MKQSARIKXMNQTLLYTLGICALLTFXXXXXXXXXYHPEYEYGYRYSAVGALASVVFLLL
           |||||||| |:|||  ||||||||:|         || ||||||||||||||||||||||
a084       MKQSARIKNMDQTLKNTLGICALLAFCFGAAIASGYHLEYEYGYRYSAVGALASVVFLLL
                   10        20        30        40        50        60

70        80        90       100       110       120
m084.pep   LARGFPRVSSVVLLIYVGTTALYLPVGWLYGAPSYQIVGSILESNPAEAREFVGNLPGSL
           |||||||| |:|||  ||||||||:|         || ||||||||||||||||||||||
a084       LARGFPRVSSVVLLIYVGTTALYLPVGWLYGAPSYQIVGSILESNPAEAREFVGNLPGSL
                   70        80        90       100       110       120
```

```
                130       140       150       160       170       180
m084.pep YFVQALFFIFGLTVWKYCVSGGVFADVKNYKRRSKIWLTILLTLILSCAVMDKIASDKDL
         ||||||||||||||:||||||||||||||||||||||||||||||||||||||||||||
a084     YFVQALFFIFGLTVWRYCVSGGVFADVKNYKRRSKIWLTILLTLILSCAVMDKIASDKDL
                130       140       150       160       170       180

190       200       210       220       230
m084.pep REPDAGLLLNIFDLYYDLAXRAGTICRQARPHFGSSKKSVNMAYPSCCAQVX
         |||||||||||||||||||| ||||||||||||||||||||||||||||||
a084     REPDAGLLLNIFDLYYDLASXAGTICRQARPHFGSSKKSVNMAYPSCCAQVX
                190       200       210       220       230
```

The following partial DNA sequence was identified in *N. gonorrhoeae* <SEQ ID 265>:

```
g085.seq
   1 ATGGGCAAAG GGCAGGACTT CACGCCCCTG CGCGACGCGT TGAAAGATAA

51 GGCAAAAGGC GTGTTCCTGA TCGGCGTCGA TGCGCCGCAA ATCCGCCGCG

101 ATTTGGACGG CTGCGGCTTG AACCTGACCG ACTGCGTCAC TTTGGAAGAG

151 GCGGTTCAGA CGGCATACGC CCAAGCCGAA GCGGGCGATA TTGTCTTGCT

201 CAGCCCCGCC TGCGCGAGTT TCGATATGTT TAAAGGCTAC GCGCACCGTT

251 CGGAAGTGTT tatCGAAGCG TTTAAGGCTT TGTGA
```

This corresponds to the amino acid sequence <SEQ ID 266; ORF 085.ng>:

```
g085.pep
  1 MGKGQDFTPL RDALKDKAKG VFLIGVDAPQ IRRDLDGCGL NLTDCVTLEE

51 AVQTAYAQAE AGDIVLLSPA CASFDMFKGY AHRSEVFIEA FKAL*
```

The following partial DNA sequence was identified in *N. meningitidis* <SEQ ID 267>:

```
m085.seq
   1 ATGGGTAAAG GGCAGGACTT CACGCCCCTG CGCGATGCAC TGGTAGGCAA

51 GGCAAAAGGC GTGTTCTTGA TTGGTGTCGA TGCGCCGCAA ATCCGCCGCG

101 ATTTGGACGG CTGCGGCTTG AATATGACCG ACTGCGCCAC TTTGGGAGAA

151 GCCGTTCAGA CGGCATATGC CCAAGCCGAA GCAGGCGATA TTGTGTTGCT

201 CAGCCCCGCC TGCGCGAGCT TTGATATGTT CAAAGGCTAC GCGCACCGTT

251 CGGAAGTGTT TATCGAAGCG TTTAAGGCTT TGTGA
```

This corresponds to the amino acid sequence <SEQ ID 268; ORF 085>:

```
m085.pep
  1 MGKGQDFTPL RDALVGKAKG VFLIGVDAPQ IRRDLDGCGL NMTDCATLGE

51 AVQTAYAQAE AGDIVLLSPA CASFDMFKGY AHRSEVFIEA FKAL*
```

Computer analysis of this amino acid sequence gave the following results:
Homology with a Predicted ORF from *N. gonorrhoeae*
ORF 085 shows 94.7% identity over a 94 aa overlap with a predicted ORF (ORF 085.ng) from *N. gonorrhoeae*:

```
m085/g085

10        20        30        40        50        60
    m085.pep  MGKGQDFTPLRDALVGKAKGVFLIGVDAPQIRRDLDGCGLNMTDCATLGEAVQTAYAQAE
              ||||||||||||| |||||||||||||||||||||||||||:|||:|| |||||||||||
        g085  MGKGQDFTPLRDALKDKAKGVFLIGVDAPQIRRDLDGCGLNLTDCVTLEEAVQTAYAQAE
                  10        20        30        40        50        60

70        80        90
    m085.pep  AGDIVLLSPACASFDMFKGYAHRSEVFIEAFKALX
              ||||||||||||||||||||||||||||||||||
        g085  AGDIVLLSPACASFDMFKGYAHRSEVFIEAFKALX
                  70        80        90
```

The following partial DNA sequence was identified in *N. meningitidis* <SEQ ID 269>:

```
a085.seq
   1 ATGGGCAAAG GGCAGGACTT CACGCCCCTG CGCGACGCGC TTGCCGGCAA

51 GGCAAAAGGC GTGTTCCTGA TCGGTGTCGA TGCGCCGCAA ATCCGCCGCG

101 ATTTGGACGG CTGCGATCTG AATATGACCG ACTGCGCCAC TTTGGAAGAA

151 GCGGTTCAGA AGGCATATGC CCAAGCCGAA GCGGGCGATA TCGTGCTGCT

201 CAGCCCCGCC TGCGCGAGTT TCGATATGTT TAAAGGCTAC GCGCACCGTT

251 CGGAAGTGTT TATCGGGGCG TTTAAGGCTT GTGA
```

This corresponds to the amino acid sequence <SEQ ID 270; ORF 085.a>:

```
a085.pep
  1 MGKGQDFTPL RDALAGKAKG VFLIGVDAPQ IRRDLDGCDL NMTDCATLEE

51 AVQKAYAQAE AGDIVLLSPA CASFDMFKGY AHRSEVFIGA FKAL*
``` m085/a085 94.7% identity over a 94 aa overlap

```
                  10        20        30        40        50        60
    m085.pep  MGKGQDFTPLRDALVGKAKGVFLIGVDAPQIRRDLDGCGLNMTDCATLGEAVQTAYAQAE
              |||||||||||||:|||||||||||||||||||||||| ||||||||| ||||| |||||
        a085  MGKGQDFTPLRDALAGKAKGVFLIGVDAPQIRRDLDGCDLNMTDCATLEEAVQKAYAQAE
                  10        20        30        40        50        60

70        80        90
    m085.pep  AGDIVLLSPACASFDMFKGYAHRSEVFIEAFKALX
              |||||||||||||||||||||||||||| |||||
        a085  AGDIVLLSPACASFDMFKGYAHRSEVFIGAFKALX
                  70        80        90
```

The following partial DNA sequence was identified in *N. gonorrhoeae* <SEQ ID 271>:

```
g086.seq
   1 ATGGTGGTGC TGATGACGGC GTTCGGCCTG CTGATGATTT ATTCGGCTTC

51 TGTGTATTTG GCATCGAAGG AAGGCGGCGA TCAGTTTTTC TATTTGACCA

101 GGCAGGCGGG GTTCGTCGTT GCCGGCCTTA TAGCGAGCGG TTTTTTATGG

151 TTTCTTTGCA GGATGAGGAC ATGGCGGCGG CTTGTGCCGT GGATTTTTGC
```

```
 201 CTTATCCGGC CTGTTGCTGG TAGCCGTATT GATTGCCGGG CGCGAAATCA

251 ATGGCGCGAC CCGTTGGATA CCTTTGGGTC CGTTGAATTT CCAGCCGACC

301 GAGCTGTTCA AGCTGGCAGT CATCCTTTAT TTGGCAAGCC TGTTCACGCG

351 CCGTGAAGAA GTGTTGCGCA GCATGGAAAG TTTGGGTTGG CAGTCGATTT

401 GGCGGGGGAC GGCCAACCTG ATTATGTCCG CCACCAATCC GCAGGCACGT

451 CGTGAAACAT TAGAAATGTA CGgcCGTTTC CGGGCGATCA TCCTGCCGAT

501 TATGCTGGTG GCGTTCGGTT TGGTGCTGAT AATGGTACAG CCGGATTTCG

551 GTTCGTTTGT CGTCATTACC GTCATTACCG TTGGAATGCT GTTTCTGGCA

601 GGATTGCCGT GGAAATATTT TTTTGTCCTG GTAGGCAGCG TCTTGGGTGG

651 GATGGTGCTG ATGATTACCG CCGCTCCCTA CCGTGTGCAG CGGGTAGTGG

701 CATTTTTGGA CCCGTGGAAA GACCCGCAGG GTGCCGGCTA CCAGCTTACC

751 CACTCTCTGA TGGCAATCGG GCGCGGAGAG TGGTTCGGTA TGGGTTTGGG

801 TGCGAGTTTG AGCAAACGCG GCTTTCTGCC GGAAGCGCAT ACCGATTTTA

851 TTTTTGCCAT CATCGCTGAA GAATTCGGCT TCTTCGGGAT GTGCGTGCTG

901 ATATTCTGTT ACGGCTGGCT GGTGGTGCGG GCGTTTTCCA TCGGCAAGCA

951 GTCGCGCGAT TTGGGtttgA CTTTCAACGC CTATATCGCT TCGGGTATCG

1001 GCATTTGGAT CGGTATCCAA AGTTTCTTCA ATATCGGTGT GAACATCGGT

1051 GCTTTGCCGA CCAAAGGTCT GACGctgCcg tTGATGTCCT ATGGcggTTC

1101 GTCAGTCTTT TTCATGCTGA TCAGCATGAT GCTGCTGTTG CGTATCGATT

1151 ATGATTACCG CCAGAAAATG CGCGGTTACC GGGTGGAGTA AA
```

This corresponds to the amino acid sequence <SEQ ID 272; ORF 086.ng>:

```
g086.pep
  1MVVLMTAFGL LMIYSASVYL ASKEGGDQFF YLTRQAGFVV AGLIASGFLW

51FLCRMRTWRR LVPWIFALSG LLLVAVLIAG REINGATRWI PLGPLNFQPT

101ELFKLAVILY LASLFTRREE VLRSMESLGW QSIWRGTANL IMSATNPQAR

151RETLEMYGRF RAIILPIMLV AFGLVLIMVQ PDFGSFVVIT VITVGMLFLA

201GLPWKYFFVL VGSVLGGMVL MITAAPYRVQ RVVAFLDPWK DPQGAGYQLT

251HSLMAIGRGE WFGMGLGASL SKRGFLPEAH TDFIFAIIAE EFGFFGMCVL

301IFCYGWLVVR AFSIGKQSRD LGLTFNAYIA SGIGIWIGIQ SFFNIGVNIG

351ALPTKGLTLP LMSYGGSSVF FMLISMMLLL RIDYENRQKM RGYRVE*
```

The following partial DNA sequence was identified in N. meningitidis <SEQ ID 273>:

```
m086.seq
   1 ATGGTGGTGC TGATGACGGC GTTCAGCCTG CTGATGATTT ATTCGGCTTC

51 TGTGTATTTG GCATCAAAAG AAGGCGGCGA TCAGTTTTTC TATTTGACCA

101 GACAGGCGGG GTTCGTCGTT GCCGGCTTGA TAGCGAGCGG TTTGTTATGG

151 TTTCTTTGCA GGATGAGGAC ATGGCGGCGG CTTGTGCCGT GGATTTTTGC

201 CCTATCCGGC CTGTTGCTGG TAGTCGTATT GATTGCCGGG CGCGAAATCA

251 ATGGCGCGAC CCGTTGGATA CCTTTGGGTC CGTTGAATTT CCAGCCGACc
```

-continued
```
 301 GAGCTGTTCA AGCtGGCGGT CATCCTTTAT TTGGCAAGCC TGTTCACGCG

351 CCGTGAAGAA GTGTTGcGCA GCATGGAAAG TTTGGGTTGG CAGTCGATTT

401 GGCGGGGGAC GGCCAATCTG ATCATGTCCG CCACCAATCC GCAGrCACGT

451 CGTGAaACAT TAGAAATGTA CGGCCGTwTC CGGGCGATCA TCCTGCCGAT

501 TATGCTGGTG GCGTTCGGTT TGGTGCTGAT AATGGTACAG CCGGATTTCG

551 GTTCGTTTGT CGTCATTACC GTCATTGCCG TTGGAATGCT GTTTTTGGCA

601 GGATTGCCGT GGAAATATTT TTTCGTCCTG GTAGGCAGCG TCTTGGGCGG

651 GATGGTGCTG ATGATTACCG CCGCTCCCTA CCGTGTGCAG CGGGTAGTGG

701 CATTTTTGGA CCCGTGGAAA GACCCGCAGG GTGCCGGCTA CCAGCTTACC

751 CACTCTCTGA TGGCAATCGG GCGCGGAGAG TGGTTCGGTA TGGGTTTGGG

801 TGCGAGTTTG AGCAAACGCG GCTTTCTGCC GGAAGCGCAT ACCGATTTTA

851 TTTTTGCCAT CATCGCCGAA GAATTCGGTT TCTTCGGTAT GTGCGTGCTG

901 ATATTCTGTT ACGGCTGGCT GGTGGTGCGG GCGTTTTCCA TCGGCAAGCA

951 GTCGCGCGAT TTGGGTTTGA CTTTCAACGC CTATATCGCT TCGGGTATCG

1001 GCATTTGGAT CGGkrTCCAA AGTTTCTTCA ATATCGGTGT GAACATCGGT

1051 GCTTTGCCGA mCAAAgGyCT GACGCyGCCG Tg.AtGTCCw ATGGCGGTTC

1101 GTCAGTCTTT TTCATGCTGA TCAGCATGAT GCTGCTGTkG CGTATAGATT

1151 ATGAAAACCG CCGGAAAATG CGCGGTTATC GGGTGGAGTA A
```

This corresponds to the amino acid sequence <SEQ ID 274; ORF 086>:

```
m086.pep
  1MVVLMTAFSL LMIYSASVYL ASKEGGDQFF YLTRQAGFVV AGLIASGLLW

51FLCRMRTWRR LVPWIFALSG LLLVVVLIAG REINGATRWI PLGPLNFQPT

101ELFKLAVILY LASLFTRREE VLRSMESLGW QSIWRGTANL IMSATNPQXR

151RETLEMYGRX RAIILPIMLV AFGLVLIMVQ PDFGSFVVIT VIAVGMLFLA

201GLPWKYFFVL VGSVLGGMVL MITAAPYRVQ RVVAFLDPWK DPQGAGYQLT

251HSLMAIGRGE WFGMGLGASL SKRGFLPEAH TDFIFAIIAE EFGFFGMCVL

301IFCYGWLVVR AFSIGKQSRD LGLTFNAYIA SGIGIWIGXQ SFFNIGVNIG

351ALPXKGLTXP XMSXGGSSVF FMLISMMLLX RIDYENRRKM RGYRVE*
```

Computer analysis of this amino acid sequence gave the following results:

Homology with a Predicted ORF from *N. gonorrhoeae*

ORF 086 shows 96.7% identity over a 396 aa overlap with a predicted ORF (ORF 086.ng) from *N. gonorrhoeae*:

```
    m086/g086

10         20         30         40         50         60
    m086.pep MVVLMTAFSLLMIYSASVYLASKEGGDQFFYLTRQAGFVVAGLIASGLLWFLCRMRTWRR
             ||||||||:||||||||||||||||||||||||||||||||||||||:||||||||||||
    g086     MVVLMTAFGLLMIYSASVYLASKEGGDQFFYLTRQAGFVVAGLIASGFLWFLCRMRTWRR
                 10         20         30         40         50         60

70         80         90        100        110        120
    m086.pep LVPWIFALSGLLLVVVLIAGREINGATRWIPLGPLNFQPTELFKLAVILYLASLFTRREE
             |||||||||||||:||||||||||||||||||||||||||||||||||||||||||||||
    g086     LVPWIFALSGLLLVAVLIAGREINGATRWIPLGPLNFQPTELFKLAVILYLASLFTRREE
                 70         80         90        100        110        120
```

-continued

```
                130       140       150       160       170       180
m086.pep VLRSMESLGWQSIWRGTANLIMSATNPQXRRETLEMYGRXRAIILPIMLVAFGLVLIMVQ
         |||||||||||||||||||||||||||| |||||||||| ||||||||||||||||||||
g086     VLRSMESLGWQSIWRGTANLIMSATNPQARRETLEMYGRFRAIILPIMLVAFGLVLIMVQ
                130       140       150       160       170       180

190       200       210       220       230       240
m086.pep PDFGSFVVITVIAVGMLFLAGLPWKYFFVLVGSVLGGMVLMITAAPYRVQRVVAFLDPWK
         ||||||||||||:|||||||||||||||||||||||||||||||||||||||||||||||
g086     PDFGSFVVITVITVGMLFLAGLPWKYFFVLVGSVLGGMVLMITAAPYRVQRVVAFLDPWK
                190       200       210       220       230       240

250       260       270       280       290       300
m086.pep DPQGAGYQLTHSLMAIGRGEWFGMGLGASLSKRGFLPEAHTDFIFAIIAEEFGFFGMCVL
         ||||||||||||||||||||||||||||||||||||||||||||||||||||||||||||
g086     DPQGAGYQLTHSLMAIGRGEWFGMGLGASLSKRGFLPEAHTDFIFAIIAEEFGFFGMCVL
                250       260       270       280       290       300

310       320       330       340       350       360
m086.pep IFCYGWLVVRAFSIGKQSRDLGLTFNAYIASGIGIWIGXQSFFNIGVNIGALPXKGLTXP
         |||||||||||||||||||||||||||||||||||||| ||||||||||||||:|||| |
g086     IFCYGWLVVRAFSIGKQSRDLGLTFNAYIASGIGIWIGIQSFFNIGVNIGALPTKGLTLP
                310       320       330       340       350       360

370       380       390
m086.pep XMSXGGSSVFFMLISMMLLXRIDYENRRKMRGYRVEX
          || ||||||||||||||| |||||||:|||||||||
g086     LMSYGGSSVFFMLISMMLLLRIDYENRQKMRGYRVEX
                370       380       390
```

The following partial DNA sequence was identified in *N. meningitidis* <SEQ ID 275>:

```
a086.seq
   1 ATGGTGGTGC TGATGACGGC GTTCAGCCTG CTGATGATTT ATTCGGCTTC

51 TGTGTATTTG GCATCAAAAG AAGGCGGCGA TCAGTTTTTC TATTTGACCA

101 GACAGGCGGG GTTCGTCGTT GCCGGCTTGA TAGCGAGCGG TTTGTTATGG

151 TTTCTTTGCA GGATGAGGAC ATGGCGGCGG CTTGTGCCGT GGATTTTTGC

201 CCTATCCGGC CTGTTGCTGG TAGTCGTATT GATTGCCGGG CGCGAAATCA

251 ATGGCGCGAC CCGTTGGATA CCTTTGGGTC CGTTGAATTT CCAGCCGACC

301 GAGCTGTTCA AGCTGGCGGT CATCCTTTAT TTGGCAAGCC TGTTCACGCG

351 CCGTGAAGAA GTGTTGCGCA GCATGGAAAG TTTGGGTTGG CAGTCGATTT

401 GGCGGGGGAC GGCCAATCTG ATCATGTCCG CCACCAATCC GCAGGCACGT

451 CGTGAAACAT TAGAAATGTA CGGCCGTTTC CGGGCGATCA TCCTGCCGAT

501 TATGCTGGTG GCGTTCGGTT TGGTGCTGAT AATGGTACAG CCGGATTTCG

551 GTTCGTTTGT CGTCATTACC GTCATTGCCG TTGGAATGCT GTTTTTGGCA

601 GGATTGCCGT GGAAATATTT TTTCGTCCTG GTAGGCAGCG TCTTGGGCGG

651 GATGGTGCTG ATGATTACCG CCGCTCCCTA CCGTGTGCAG CGGGTAGTGG

701 CATTTTTGGA CCCGTGGAAA GACCCGCAGG GTGCCGGCTA CCAGCTTACC

751 CACTCTCTGA TGGCAATCGG GCGCGGAGAG TGGTTCGGTA TGGGTTTGGG

801 TGCGAGTTTG AGCAAACGCG GCTTTCTGCC GGAAGCGCAT ACCGATTTTA

851 TTTTTGCCAT CATCGCCGAA GAATTCGGTT TCTTCGGTAT GTGCGTGCTG

901 ATATTCTGTT ACGGCTGGCT GGTGGTGCGG GCGTTTTCCA TCGGCAAGCA

951 GTCGCGCGAT TTGGGTTTGA CTTTCAACGC CTATATCGCT TCGGGTATCG

1001 GCATTTGGAT CGGTATCCAA AGTTTCTTCA ATATCGGTGT GAACATCGGT

1051 GCTTTGCCGA CCAAAGGTCT GACGCTGCCG TTGATGTCCT ATGGCGGTTC

1101 GTCAGTCTTT TTCATGCTGA TCAGCATGAT GCTGCTGTTG CGTATAGATT

1151 ATGAAAACCG CCGGAAAATG CGCGGTTACC GGGTGGAGTA A
```

This corresponds to the amino acid sequence <SEQ ID 276; ORF 086.a>:

```
a086.pep
    1 MVVLMTAFSL LMIYSASVYL ASKEGGDQFF YLTRQAGFVV AGLIASGLLW

51 FLCRMRTWRR LVPWIFALSG LLLVVVLIAG REINGATRWI PLGPLNFQPT

101 ELFKLAVILY LASLFTRREE VLRSMESLGW QSIWRGTANL IMSATNPQAR

151 RETLEMYGRF RAIILPIMLV AFGLVLIMVQ PDFGSFVVIT VIAVGMLFLA

201 GLPWKYFFVL VGSVLGGMVL MITAAPYRVQ RVVAFLDPWK DPQGAGYQLT

251 HSLMAIGRGE WFGMGLGASL SKRGFLPEAH TDFIFAIIAE EFGFFGMCVL

301 IFCYGWLVVR AFSIGKQSRD LGLTFNAYIA SGIGIWIGIQ SFFNIGVNIG

351 ALPTKGLTLP LMSYGGSSVF FMLISMMLLL RIDYENRRKM RGYRVE*
``` m086/a086 98.0% identity over a 396 aa overlap

```
                   10         20         30         40         50         60
    m086.pep   MVVLMTAFSLLMIYSASVYLASKEGGDQFFYLTRQAGFVVAGLIASGLLWFLCRMRTWRR
               ||||||||||||||||||||||||||||||||||||||||||||||||||||||||||||
    a086       MVVLMTAFSLLMIYSASVYLASKEGGDQFFYLTRQAGFVVAGLIASGLLWFLCRMRTWRR
                   10         20         30         40         50         60
                   70         80         90        100        110        120
    m086.pep   LVPWIFALSGLLLVVVLIAGREINGATRWIPLGPLNFQPTELFKLAVILYLASLFTRREE
               ||||||||||||||||||||||||||||||||||||||||||||||||||||||||||||
    a086       LVPWIFALSGLLLVVVLIAGREINGATRWIPLGPLNFQPTELFKLAVILYLASLFTRREE
                   70         80         90        100        110        120
                  130        140        150        160        170        180
    m086.pep   VLRSMESLGWQSIWRGTANLIMSATNPQXRRETLEMYGRXRAIILPIMLVAFGLVLIMVQ
               |||||||||||||||||||||||||||| ||||||||| |||||||||||||||||||||
    a086       VLRSMESLGWQSIWRGTANLIMSATNPQARRETLEMYGRXRAIILPIMLVAFGLVLIMVQ
                  130        140        150        160        170        180
                  190        200        210        220        230        240
    m086.pep   PDFGSFVVITVIAVGMLFLAGLPWKYFFVLVGSVLGGMVLMITAAPYRVQRVVAFLDPWK
               ||||||||||||||||||||||||||||||||||||||||||||||||||||||||||||
    a086       PDFGSFVVITVIAVGMLFLAGLPWKYFFVLVGSVLGGMVLMITAAPYRVQRVVAFLDPWK
                  190        200        210        220        230        240
                  250        260        270        280        290        300
    m086.pep   DPQGAGYQLTHSLMAIGRGEWFGMGLGASLSKRGFLPEAHTDFIFAIIAEEFGFFGMCVL
               ||||||||||||||||||||||||||||||||||||||||||||||||||||||||||||
    a086       DPQGAGYQLTHSLMAIGRGEWFGMGLGASLSKRGFLPEAHTDFIFAIIAEEFGFFGMCVL
                  250        260        270        280        290        300
                  310        320        330        340        350        360
    m086.pep   IFCYGWLVVRAFSIGKQSRDLGLTFNAYIASGIGIWIGXQSFFNIGVNIGALPXKGLTXP
               |||||||||||||||||||||||||||||||||||||| ||||||||||||||| |||| |
    a086       IFCYGWLVVRAFSIGKQSRDLGLTFNAYIASGIGIWIGIQSFFNIGVNIGALPTKGLTLP
                  310        320        330        340        350        360
                  370        380        390
    m086.pep   XMSXGGSSVFFMLISMMLLXRIDYENRRKMRGYRVEX
                ||  ||||||||||||||| ||||||||||||||||
    a086       LMSYGGSSVFFMLISMMLLLRIDYENRRKMRGYRVEX
                  370        380        390
```

The following partial DNA sequence was identified in *N. gonorrhoeae* <SEQ ID 277>:

```
g087.seq
    1 ATGGGCGGTA AAACCTTTAT GCTGATGGCG GGCGGAACGG GCGGACACAT

51 TTTCCCAGCT CTGGCTGTGG CGGATTCATT GCGCGTGCGC GGTCATCATG

101 TAATTTGGCT GGGCAGCAAG GATTCGATGG AAGAGCGCAT CGTGCCGCAA

151 TACGGCATAC GCTTGGAAAC GCTGGCGATT AAAGGAATAC GCGGCAACGG
```

```
 201 CATCAAACGC AAGCTGATGC TTCCGTTTAC TCTGTACAAA ACCGTCCGCG

251 AAGCGCAGCG GATTATCCGC AAACACCGTG TCGAGTGCGT CATCGGCTTC

301 GGCGGTTTTG TTACCTTTCC CGGCGGTCTG GCGGCGAAAC TCTTGGGCGT

351 GCCGATTGTG ATTCACGAGC AAAACGCCGT GGCAGGCTTG TCCAACCGCC

401 AccTGTCGCg ctGGGCGAAA CGGGTGTTGT ACGCTTTTCC GAAAGCGTTC

451 AGCCACGAAG GCGGTTTGGT CGGCAACCCC GTCCGCGCCG ATATTAGCAA

501 CCTGCCCGTG CCTGCCGAAC GCTTCCAAGG GCGCGAAGGC CGTCTGAAAA

551 TTTTGGTGGT CGGCGGCAGT TTGGGTGCGG ACGTTTTGAA CAAAACCGTA

601 CCGCAGGCGT TGGCACTGCT GCCTGAAGAG GTGCGCCCGC AGATGTACCA

651 CCAGTCGGGG CGTAACAAGC TGGGCAATCT TCAGGCGGAT TATGACGCGT

701 TGGGCGTGAA AGCGGAATGC GTGGAATTTA TTACCGACAT GGTGTCCGCC

751 TACCGTGATG CCGATTTGGT GATTTGCCGT GCCGGCGCGC TGACGATTGC

801 CGAGTTGACG GCGGCGGGGC TGGGCGCGTT GTTAGTGCCG TATCCTCACG

851 CCGTTGATGA CCATCAAACC GCCAACGCGC GTTTCATGGT GCAGGCAGAA

901 GCGGGGCTGC TGTTGCCGCA AACCCAGTTG ACGGCGGAAA AACTCGCCGA

951 AATCCTCGGC AGCCTCAACC GCGAAAAATG CCTCAAATGG GCGGAAAACG

1001 CCCGTACGTT GGCATTGCCG CACAGCGCGG ATGACGTTGC CGAAGCCGCG

1051 ATTGCGTGTG CGGCGTAAA
```

This corresponds to the amino acid sequence <SEQ ID 278; ORF 087.ng>:

```
g087.pep
   1 MGGKTFMLMA GGTGGHIFPA LAVADSLRVR GHHVIWLGSK DSMEERIVPQ

51 YGIRLETLAI KGIRGNGIKR KLMLPFTLYK TVREAQRIIR KHRVECVIGF

101 GGFVTFPGGL AAKLLGVPIV IHEQNAVAGL SNRHLSRWAK RVLYAFPKAF

151 SHEGGLVGNP VRADISNLPV PAERFQGREG RLKILVVGGS LGADVLNKTV

201 PQALALLPEE VRPQMYHQSG RNKLGNLQAD YDALGVKAEC VEFITDMVSA

251 YRDADLVICR AGALTIAELT AAGLGALLVP YPHAVDDHQT ANARFMVQAE

301 AGLLLPQTQL TAEKLAEILG SLNREKCLKW AENARTLALP HSADDVAEAA

351 IACAA*
```

The following partial DNA sequence was identified in *N. meningitidis* <SEQ ID 279>:

```
m087.seq
   1 ATGGGCGGTA AAACCTTTAT GCTGAwkkCG GCGGAACGG GCGGACATAT

51 TTTCCCCGCG CTGGCGGTGG CGGATTCATT GCGCGCGCGC GGCCATCATG

101 TGATTTGGCT GGGCAGCAAG GATTCGATGG AAGAGCGTAT CGTGCCGCAA

151 TACGGCATAC GCTTGGAAAC GCTGGCGATT AAAGGCGTGC GCGGCAACGG

201 CATCAAACGC AAACTGATGC TGCCGGTTAC TTTGTATCAA ACCGTCCGCG

251 AAGCGCAGCG GATTATCCGC AAACACCGTG TCGAGTGCGT CATCGGCTTC

301 GGCGGCTTCG TTACCTTCCC CGGCGGTTTG GCGGCGAAGC TATTArGCGT

351 GCCGATTGTG ATTCACGAGC AAAACGCCGT GGCAGGTTTG TCCAACCGCC
```

```
 401 ACCTGTCGCG CTGGGCGAAG CGGGTGTTGT ACGCTTTTCC GAAAGCGTTC

451 AGCCACGAAG GCGGCTTGGT CGGCAACCCC GTCCGCGCCG ATATTAGCAA

501 CCTGCCCGTG CCTGCCGAAC GCTTCCAAGG GCGTGAAGGC CGTCTGAAAA

551 TTTTGGTGGT CGGCGGCAGT TTGGGCGCGG ACGTTTTGAA CAAAACCGTA

601 CCGCATGCAT TGGCTTTGCT GCCCGACAAT GCGCGTCCGC ATATGTACCA

651 CCAATCGGGA CGGGGCAAGC TGGGCATCTT GCAGGCGnnn nnnnnnnnnn 701 nnnnnnnnnn nnnnnnnnnn nnnnnnnnnn nnnnnnnnnn nnnnnnnnnn 751 nnnGCGGGAT TGGGTGCGTT GTTAGTGCCG TATCCTCACG CGGTTGACGA

801 TCACCAAACC GCCAACGCGC GTTTTATGGT GCAGGCGGAG GCGGGATTGC

851 TGTTGCCGCA AACCCAGTTG ACGGCGGAAA AACTCGCCGA GATTCTCGGC

901 GGCTTAAACC GCGAAAAATG CCTCAAATGG GCAGAAAACG CCCGTACGTT

951 GGCACTGCCG CACAGTGCGG ACGACGTGGC GGAAGCCGCG ATTGCGTGTG

1001 CGGCGTAA
```

This corresponds to the amino acid sequence <SEQ ID 280; ORF 087>:

```
m087.pep
   1 MGGKTFMLXX GGTGGHIFPA LAVADSLRAR GHHVIWLGSK DSMEERIVPQ

51 YGIRLETLAI KGVRGNGIKR KLMLPVTLYQ TVREAQRIIR KHRVECVIGF

101 GGFVTFPGGL AAKLLXVPIV IHEQNAVAGL SNRHLSRWAK RVLYAFPKAF

151 SHEGGLVGNP VRADISNLPV PAERFQGREG RLKILVVGGS LGADVLNKTV

201 PHALALLPDN ARPHMYHQSG RGKLGILQAX XXXXXXXXXX XXXXXXXXXX

251 XAGLGALLVP YPHAVDDHQT ANARFMVQAE AGLLLPQTQL TAEKLAEILG

301 GLNREKCLKW AENARTLALP HSADDVAEAA IACAA*
```

Computer analysis of this amino acid sequence gave the following results:

Homology with a Predicted ORF from *N. gonorrhoeae*

ORF 087 shows 83.9% identity over a 355 aa overlap with a predicted ORF (ORF 087.ng) from *N. gonorrhoeae*:

```
   m087/g087
                    10         20         30         40         50         60
       m087.pep    MGGKTFMLXXGGTGGHIFPALAVADSLRARGHHVIWLGSKDSMEERIVPQYGIRLETLAI
                   ||||||||  |||||||||||||||||||:||||||||||||||||||||||||||||||
          g087    MGGKTFMLMAGGTGGHIFPALAVADSLRVRGHHVIWLGSKDSMEERIVPQYGIRLETLAI
                    10         20         30         40         50         60

70         80         90        100        110        120
       m087.pep    KGVRGNGIKRKLMLPVTLYQTVREAQRIIRKHRVECVIGFGGFVTFPGGLAAKLLXVPIV
                   ||:|||||||||||||:|||   |||||||||||||||||||||||||||||||| ||||
          g087    KGIRGNGIKRKLMLPFTLYKTVREAQRIIRKHRVECVIGFGGFVTFPGGLAAKLLGVPIV
                    70         80         90        100        110        120

130        140        150        160        170        180
       m087.pep    IHEQNAVAGLSNRHLSRWAKRVLYAFPKAFSHEGGLVGNPVRADISNLPVPAERFQGREG
                   ||||||||||||||||||||||||||||||||||||||||||||||||||||||||||||
          g087    IHEQNAVAGLSNRHLSRWAKRVLYAFPKAFSHEGGLVGNPVRADISNLPVPAERFQGREG
                   130        140        150        160        170        180

190        200        210        220        229
       m087.pep    RLKILVVGGSLGADVLNKTVPHALALLPDNARPHMYHQSGRGKLGILQA-----------
                   |||||||||||||||||||||:||||||:::||:|||||||:|||||:|| |||
          g087    RLKILVVGGSLGADVLNKTVPQALALLPEEVRPQMYHQSGRNKLGNLQADYDALGVKAEC
                   190        200        210        220        230        240
```

-continued

```
                                     230       240       250
m087.pep   ------------------------------AGLGALLVPYPHAVDDHQTANARFMVQAE
                                         ||||||||||||||||||||||||||||
g087       VEFITDMVSAYRDADLVICRAGALTIAELTAAGLGALLVPYPHAVDDHQTANARFMVQAE
                  250       260       270       280       290       300

260       270       280       290       300       310
m087.pep   AGLLLPQTQLTAEKLAEILGGLNREKCLKWAENARTLALPHSADDVAEAAIACAAX
           |||||||||||||||||||:||||||||||||||||||||||||||||||||||||
g087       AGLLLPQTQLTAEKLAEILGSLNREKCLKWAENARTLALPHSADDVAEAAIACAAX
                  310       320       330       340       350
```

The following partial DNA sequence was identified in *N. meningitidis* <SEQ ID 281>:

```
a087.seq
     1  ATGGGCGGTA AAACCTTTAT GCTGATGGCG GGCGGAACGG GCGGACATAT

51  TTTCCCCGCG CTGGCGGTGG CGGATTCATT GCGCGCGCGC GGCCATCATG

101  TAATTTGGCT GGGCAGCAAG GATTCGATGG AAGAGCGCAT CGTGCCGCAA

151  TACGACATCC TGCTCGAAAC GCTGGCGATT AAAGGCGTGC GCGGCAACGG

201  CATCAAACGC AAGCTGATGC TGCCGTTTAC TTTGTATCAA ACTGTCCGCG

251  AAGCGCAGCA GATTATCCGC AAACACCGTG TCGAGTGCGT CATCGGCTTC

301  GGCGGCTTCG TTACCTTTCC CGGCGGTTTG GCGGCGAAGT TATTAGGCGT

351  GCCGATTGTG ATTCACGAGC AAAACGCCGT GGCAGGTTTG TCCAACCGCC

401  ACCTGTCGCG CTGGGCGAAG CGGGTGTTGT ACGCTTTTCC GAAAGCGTTC

451  AGCCACGAAG GCGGCTTGGT CGGCAACCCC GTCCGCGCCG ATATTAGCAA

501  CCTGCCCGTG CCTGCCGAAC GCTTCCAAGG GCGTGAAGGC CGTCTGAAAA

551  TTTTGGTGGT CGGCGGCAGT TTGGGCGCGG ACGTTTTGAA CAAAACCGTA

601  CCGCAGGCAT TGGCTTTGCT GCCCGACAAT GCGCGTCCGC AGATGTACCA

651  CCAATCGGGA CGGGGCAAGC TGGGCAGCTT GCAGGCGGAT TACGACGCGC

701  TGGGCGTGCA AGCGGAATGC GTGGAATTTA TTACCGATAT GGTGTCCGCC

751  TACCGCGATG CCGATTTGGT GATTTGCCGT GCCGGCGCGC TGACGATTGC

801  CGAGTTGACG GCGGCGGGAT TGGGTGCGTT GTTAGTGCCG TATCCTCACG

851  CCGTTGATGA CCATCAAACC GCCAACGCGC GTTTTATGGT GCAGGCGGAG

901  GCGGGATTGC TGTTGCCGCA AACCCAGTTG ACGGCGGAAA AACTCGCCGA

951  GATTCTCGGC GGCTTAAACC GCGAAAAATG CCTCAAATGG GCAGAAAACG

1001  CCCGTACGTT GGCACTGCCG CACAGTGCGG ACGACGTTGC CGAAGCCGCG

1051  ATTGCGTGTG CGGCGTAA
```

This corresponds to the amino acid sequence <SEQ ID 282; ORF 087.a>:

```
a087.pep
     1  MGGKTFMLMA GGTGGHIFPA LAVADSLRAR GHHVIWLGSK DSMEERIVPQ

51  YDILLETLAI KGVRGNGIKR KLMLPFTLYQ TVREAQQIIR KHRVECVIGF

101  GGFVTFPGGL AAKLLGVPIV IHEQNAVAGL SNRHLSRWAK RVLYAFPKAF

151  SHEGGLVGNP VRADISNLPV PAERFQGREG RLKILVVGGS LGADVLNKTV

201  PQALALLPDN ARPQMYHQSG RGKLGSLQAD YDALGVQAEC VEFITDMVSA

251  YRDADLVICR AGALTIAELT AAGLGALLVP YPHAVDDHQT ANARFMVQAE
```

```
301  AGLLLPQTQL TAEKLAEILG GLNREKCLKW AENARTLALP HSADDVAEAA

351  IACAA*
``` m087/a087 85.4% identity over a 355 aa overlap

```
                 10         20         30         40         50         60
m087.pep  MGGKTFMLXXGGTGGHIFPALAVADSLRARGHHVIWLGSKDSMEERIVPQYGIRLETLAI
          ||||||||  ||||||||||||||||||||||||||||||||||||||| | ||||||
a087      MGGKTFMLMAGGTGGHIFPALAVADSLRARGHHVIWLGSKDSMEERIVPQYDILLETLAI
                 10         20         30         40         50         60
                 70         80         90        100        110        120
m087.pep  KGVRGNGIKRKLMLPVTLYQTVREAQRIIRKHRVECVIGFGGFVTFPGGLAAKLLXVPIV
          |||||||||||||||| :|||||||||:||||||||||||||||||||||||||| |||
a087      KGVRGNGIKRKLMLPFTLYQTVREAQQIIRKHRVECVIGFGGFVTFPGGLAAKLLGVPIV
                 70         80         90        100        110        120
                130        140        150        160        170        180
m087.pep  IHEQNAVAGLSNRHLSRWAKRVLYAFPKAFSHEGGLVGNPVRADISNLPVPAERFQGREG
          ||||||||||||||||||||||||||||||||||||||||||||||||||||||||||||
a087      IHEQNAVAGLSNRHLSRWAKRVLYAFPKAFSHEGGLVGNPVRADISNLPVPAERFQGREG
                130        140        150        160        170        180
                190        200        210        220        230        240
m087.pep  RLKILVVGGSLGADVLNKTVPHALALLPDNARPHMYHQSGRGKLGILQAXXXXXXXXXXX
          |||||||||||||||||||||| |||||||||| ||||||||||| | |||   |||
a087      RLKILVVGGSLGADVLNKTVPQALALLPDNARPQMYHQSGRGKLGSLQADYDALGVQAEC
                190        200        210        220        230        240
                                                 250        260        270        280
m087.pep  XX------------------XXXXXXXXXAGLGALLVPYPHAVDDHQTANARFMVQAE
           :          :         |||||||||||||||||||||||||
a087      VEFITDMVSAYRDADLVICRAGALTIAELTAAGLGALLVPYPHAVDDHQTANARFMVQAE
                250        260        270        280        290        300
                290        300        310        320        330
m087.pep  AGLLLPQTQLTAEKLAEILGGLNREKCLKWAENARTLALPHSADDVAEAAIACAAX
          |||||||||||||||||||||||||||||||||||||||||||||||||||||||
a087      AGLLLPQTQLTAEKLAEILGGLNREKCLKWAENARTLALPHSADDVAEAAIACAAX
                310        320        330        340        350
```

The following partial DNA sequence was identified in *N. gonorrhoeae* <SEQ ID 283>:

```
g088.seq
   1 ATGTTTTTAT GGCTCGCACA TTTCAGCAAC TGGTTAACCG GTCTGAATAT

51 TTTTCAATAC ACCACATTCC GCGCCGTTAT GGCGGCGTTG ACCGCCTTGG

101 CGTTTTCCCT GATGTTCGGC CGTGGACGA TACGCAGGCT GACCGCGCTC

151 AAATGCGGGC AGGCAGTGCG TACCGACGGC CCGCAAACCC ACCTCGTCAA

201 AAACGGCACG CCGACGATGG GCGGTTCGCT GATTCTGACC GCCATTACCG

251 TGTCCACCCT GTTGTGGGGC AACTGGGCGA ACCCGTATAT CTGGATTCTC

301 TTGGGCGTAC TGCTTGCCAC CGGTGCGCTC GGTTTTTACG ACGACTGGCG

351 CAAAGTCGTT TATAAAGACC CCAACGGCGT GTCCGCCAAA TTCAAAATGG

401 TGTGGCAGTC AAGCGTTGCC GTTatcgcCG GTttggcaTT GTTTTACctt 451 gCcgcCAATT CCGCCAACAA TATTTTGATT GTCCCGtttT TCAAACAAAT 501 CGCCCTGCCG CTGGGCGTGG TCGGCTTttt gGtgttgTCT TACCTGACCA 551 TCGTCGGCAC ATCCAACGCC GTCAACCTCA CcgaCGGCTT GGACGGCCTT 601 GCCGCCttcc cgttcgtcct cgttgccgcC GGGCTCGCCA ttttcgccTA

651 CGTCAGCGGA CACTACCAAT TTTCCCAATA CCTCCAGCTT CCCTATGTCG

701 CCGGCGCGAA CGAAGTCGCT ATATTCTGCA CCGCCATGTG CGGCGCGTGC
```

```
 751 CTCGGATTTT TGTGGTTCAA CGCCTATCCC GCGCAAGTCT TTATGGGCGA

801 TGTCGGCGCG CTGGCATTGG GTGCCGCGCT CGGTaccGtt gCCGTcaTcg 851 tCCGCCAAGA ATTTGTcctc gtcattaTGG GCGGTCTGTT cgtcgtagaa 901 gccgtgTCCG TTATGCTTCa tgtcggCTGG TACAAGAAAA Ccaaaaaacg 951 CATCTTcCTg acgGcaccga ttcatcacca ttaCCaactt cgatgCTGGa 1001 aagaaacgca agtcgtcgtc CGTTtCTGGA TTAtTAccat cgtcgtggtt 1051 tTgataggtt tGagtacccT caAAattcgc ggaaactatg ccgTCCGAAC 1101 ACCTTTCAGA CGGCATTTGA ACGCGCAATA A
                                                        15
```

This corresponds to the amino acid sequence <SEQ ID 284; ORF 088.ng>:

```
g088.pep
   1 MFLWLAHFSN WLTGLNIFQY TTFRAVMAAL TALAFSLMFG PWTIRRLTAL

51 KCGQAVRTDG PQTHLVKNGT PTMGGSLILT AITVSTLLWG NWANPYIWIL

101 LGVLLATGAL GFYDDWRKVV YKDPNGVSAK FKMVWQSSVA VIAGLALFYL

151 AANSANNILI VPFFKQIALP LGVVGFLVLS YLTIVGTSNA VNLTDGLDGL

201 AAFPFVLVAA GLAIFAYVSG HYQFSQYLQL PYVAGANEVA IFCTAMCGAC

251 LGFLWFNAYP AQVFMGDVGA LALGAALGTV AVIVRQEFVL VIMGGLFVVE

301 AVSVMLHVGW YKKTKKRIFL TAPIHHHYQL RCWKETQVVV RFWIITIVVV

351 LIGLSTLKIR GNYAVRTPFR RHLNAQ*
```

The following partial DNA sequence was identified in *N. meningitidis* <SEQ ID 285>:

```
m088.seq
   1 ATGTTTTTAT GGCTCGCACA TTTCAGCAnC TGGTTAACCG GTCTGAATnn 51 nnnnnnnnnn nnnnnnnnnn nnnnnnnnnn nnnnnnnnnn nnnnnnnnnn 101 nnnnnnnnnn nnnnnnnnnn nnnnnnnnnn nnnnnnnnnn nnnnnnnnnn 151 nnnnnnnnnn nnnnnnnnnn nnnnnnnnnn nnnnnnnnnn nnnnnnnnnn 201 nnnnnnnnnn nnnnnnnnnn nnnnnnnnnn nnnnnnnnnn nnnnnnnnnn 251 nnnnnnnnnn nnnnnnnnnn nnnnnnnnnn nnnnnnnnnn nnnnnnnnnn 301 nnnnnnnnnn nnnnnnnnnn nnnnnnnnnn nnnnnnnnnn nnnnnnnnnn 351 nnnnnnnnnn nnnnnnnnnn nnnnnnnnnn nnnnnnnnnn nnnnnnnnnn 401 nnnnnnnnnn nnnnnnnnnn nnnnnnnnnn nnnnnnnnnn nnnnnnnnnn 451 nnnnnnnnnn nnnnnnnnnn nnnnnnnnnn nnnnnnnnnn nnnnnnnnnn 501 nnnnnnnnnn nnnGGCGTGG TCGGCTTTTT GGTGTTGTCT TACCTGACCA

551 TCGTCGGCAC ATCCAATGCC GTCAACCTCA CCGACGGCTT GGACGGCCTT

601 GCGACCTTCC CCGTCGTCCT CGTTGCCGCC GGCCTCGCCA TCTTCGCCTA

651 TGCCAGCGGC CACTCACAAT TTGCCCAATA CCTGCAATTA CCTTACGTTG

701 CCGGCGCAAA CGAAGTGGTG ATTTTCTGTA CCGCCATGTG CGGCGCGTGC

751 CTCGGTTTCT TGTGGTTTAA CGCCTATCCC GCGCAAGTCT TATGGGCGA

801 TGTCGGTGCA TTGGCATTGG GTGCCGCGCT CGGTACCGTC GCCGTTATCG

851 TCCGCCAAGA GTTTGTCCTC GTCATTATGG GCGGATTATT TGTCGTAGAA
```

```
-continued
 901  GCCGTATCCG TTATGCTTCA GGTTGGCTGG TATAAGAAAA CCAAAAAACG
 951  CATCTTCCTG ATGGCGCCCA TCCATCACCA CTACGAACAA AAAGGCTGGA
1001  AAGAAACCCA AGTCGTCGTC CGCTTTTGGA TTATTACCAT CGTCTTGGTG
1051  TTGATCGGTT TGAGTACCCT CAAAATCCGC TGAACCTATG CCGTCTGAAC
1101  ATCTTTCAGA CGGCATTTGA ACGCGCAATA A 1  MFLWLAHFSN WLTGLNIFQY TTFRAVMAAL TALAFSLMFG PWTIRRLTAL
  51  KCGQAVRTDG PQTHLVKNGT PTMGGSLILT AITVSTLLWG NWANPYIWIL
 101  LGVLLATGAL GFYDDWRKVV YKDPNGVSAK FKMVWQSSVA VIAGLALFYL
 151  AANSANNILI VPFFKQIALP LGVVGFLVLS YLTIVGTSNA VNLTDGLDGL
 201  AAFPFVLVAA GLAIFAYVSG HYQFSQYLQL PYVAGANEVA IFCTAMCGAC
 251  LGFLWFNAYP AQVFMGDVGA LALGAALGTV AVIVRQEFVL VIMGGLFVVE
 301  AVSVMLHVGW YKKTKKRIFL TAPIHHHYQL RCWKETQVVV RFWIITIVVV
 351  LIGLSTLKIR GNYAVRTPFR RHLNAQ*
```

This corresponds to the amino acid sequence <SEQ ID 286; ORF 088>:

```
m088.pep
   1  MFLWLAHFSX WLTGLNXXXX XXXXXXXXXX XXXXXXXXXX XXXXXXXXXX
  51  XXXXXXXXXX XXXXXXXXXX XXXXXXXXXX XXXXXXXXXX XXXXXXXXXX
 101  XXXXXXXXXX XXXXXXXXXX XXXXXXXXXX XXXXXXXXXX XXXXXXXXXX
 151  XXXXXXXXXX XXXXXXXXXX XGVVGFLVLS YLTIVGTSNA VNLTDGLDGL
 201  ATFPVVLVAA GLAIFAYASG HSQFAQYLQL PYVAGANEVV IFCTAMCGAC
 251  LGFLWFNAYP AQVFMGDVGA LALGAALGTV AVIVRQEFVL VIMGGLFVVE
 301  AVSVMLQVGW YKKTKKRIFL MAPIHHHYEQ KGWKETQVVV RFWIITIVLV
 351  LIGLSTLKIR XTYAVXTSFR RHLNAQ*
```

Computer analysis of this amino acid sequence gave the following results:

Homology with a Predicted ORF from *N. gonorrhoeae*

ORF 088 shows 91.7% identity over a 205 aa overlap with a predicted ORF (ORF 088.ng) from *N. gonorrhoeae*:

```
m088/g088

10         20         30
   m088.pep                GVVGFLVLSYLTIVGTSNAVNLTDGLDGLA
                           ||||||||||||||||||||||||||||||
       g088  IAGLALFYLAANSANNILIVPFFKQIALPLGVVGFLVLSYLTIVGTSNAVNLTDGLDGLA
                 150       160       170       180       190       200

40         50         60         70         80         90
   m088.pep  TFPVVLVAAGLAIFAYASGHSQFAQYLQLPYVAGANEVVIFCTAMCGACLGFLWFNAYPA
              :|| ||||||||||||||:||| ||:||||||||||||||:|||||||||||||||||||
       g088  AFPFVLVAAGLAIFAYVSGHYQFSQYLQLPYVAGANEVAIFCTAMCGACLGFLWFNAYPA
                 210       220       230       240       250       260

100        110        120        130        140        150
   m088.pep  QVFMGDVGALALGAALGTVAVIVRQEFVLVIMGGLFVVEAVSVMLQVGWYKKTKKRIFLM
             ||||||||||||||||||||||||||||||||||||||||||||||:|||||||||||
       g088  QVFMGDVGALALGAALGTVAVIVRQEFVLVIMGGLFVVEAVSVMLHVGWYKKTKKRIFLT
                 270       280       290       300       310       320
```

-continued

```
                    160        170        180        190        200
m088.pep     APIHHHYEQKGWKETQVVVRFWIITIVLVLIGLSTLKIRXTYAVXTSFRRHLNAQX
             |||||||: : |||||||||||||||:||||||||||| :||| | |||||||||
g088         APIHHHYQLRCWKETQVVVRFWIITIVVVLIGLSTLKIRGNYAVRTPFRRHLNAQX
                   330        340        350        360        370
```

The following partial DNA sequence was identified in *N. meningitidis* <SEQ ID 287>:

```
a088.seq
   1 ATGTTTTTAT GGCTCGCACA TTTCAGCAAC TGGTTAACCG GTCTGAATAT

51 TTTTCAATAC ACCACATTCC GCGCCGTCAT GGCGGCGTTG ACCGCCTTGG

101 CGTTTTCCCT GATGTTCGGC CCGTGGACGA TACGCAGGCT GACCGCGCTC

151 AAATGCGGGC AGGCAGTGCG TACCGACGGT CCGCAAACCC ACCTCGTCAA

201 AAACGGCACG CCGACGATGG GCGGTTCGCT GATTCTGACC GCCATTACCG

251 TGTCCACCCT GTTGTGGGGC AACTGGGCAA ACCCGTATAT CTGGATTCTC

301 TTGGGCGTAT TGCTCGCCAC GGGCGCACTC GGTTTTTACG ACGACTGGCG

351 CAAAGTCGTC TATAAAGACC CCAACGGCGT GTCCGCCAAA TTCAAAATGG

401 TGTGGCAGTC AAGCGTTGCC ATTATCGCCG GTTTGGCATT GTTTTACCTT

451 GCCGCCAATT CCGCCAACAA TATTTTGATT GTCCCGTTCT TCAAACAAAT

501 CGCCCTGCCG CTGGGCGTGG TCGGCTTTTT GGTGTTGTCT TACCTGACCA

551 TCGTCGGCAC ATCCAATGCC GTCAACCTCA CCGACGGCTT GGACGGCCTT

601 GCGACCTTCC CCGTCGTCCT CGTTGCCGCC GGCCTCGCCA TCTTCGCCTA

651 TGCCAGCGGC CACTCACAAT TTGCCCAATA CCTGCAATTA CCTTACGTTG

701 CCGGCGCAAA CGAAGTGGTG ATTTTCTGTA CCGCCATGTG CGGCGCGTGC

751 CTCGGTTTCT TGTGGTTTAA CGCCTATCCC GCGCAAGTCT TTATGGGCGA

801 TGTCGGTGCA TTGGCATTGG GTGCCGCGCT CGGTACCGTC GCCGTCATCG

851 TCCGCCAAGA GTTTGTCCTC GTCATTATGG GCGGATTATT TGTCGTAGAA

901 GCCGTATCCG TTATGCTTCA GGTCGGCTGG TATAAGAAAA CCAAAAAACG

951 CATCTTCCTG ATGGCGCCCA TCCATCACCA CTACGAACAA AAAGGCTGGA

1001 AAGAAACCCA AGTCGTCGTC CGCTTTTGGA TTATTACCAT CGTCTTGGTG

1051 TTGATCGGTT TGAGTACCCT CAAAATCCGC TGAACCTATG CCGTCTGAAC

1101 ACCTTTCAGA CGGCATTTGA ACGCGCAATA A
```

This corresponds to the amino acid sequence <SEQ ID 288; ORF 088.a>:

```
a088.pep
   1 MFLWLAHFSN WLTGLNIFQY TTFRAVMAAL TALAFSLMFG PWTIRRLTAL

51 KCGQAVRTDG PQTHLVKNGT PTMGGSLILT AITVSTLLWG NWANPYIWIL

101 LGVLLATGAL GFYDDWRKVV YKDPNGVSAK FKMVWQSSVA IIAGLALFYL

151 AANSANNILI VPFFKQIALP LGVVGFLVLS YLTIVGTSNA VNLTDGLDGL

201 ATFPVVLVAA GLAIFAYASG HSQFAQYLQL PYVAGANEVV IFCTAMCGAC

251 LGFLWFNAYP AQVFMGDVGA LALGAALGTV AVIVRQEFVL VIMGGLFVVE

301 AVSVMLQVGW YKKTKKRIFL MAPIHHHYEQ KGWKETQVVV RFWIITIVLV

351 LIGLSTLKIR *TYAV*TPFR RHLNAQ*
``` m088/a088 99.5% identity over a 205 aa overlap

```
                150       160       170       180       190       200
m088.pep  XXXXXXXXXXXXXXXXXXXXXXXXXXXXXXXGVVGFLVLSYLTIVGTSNAVNLTDGLDGLA
                                         ||||||||||||||||||||||||||||||
a088      IAGLALFYLAANSANNILIVPFFKQIALPLGVVGFLVLSYLTIVGTSNAVNLTDGLDGLA
                150       160       170       180       190       200

210       220       230       240       250       260
m088.pep  TFPVVLVAAGLAIFAYASGHSQFAQYLQLPYVAGANEVVIFCTAMCGACLGFLWFNAYPA
          ||||||||||||||||||||||||||||||||||||||||||||||||||||||||||||
a088      TFPVVLVAAGLAIFAYASGHSQFAQYLQLPYVAGANEVVIFCTAMCGACLGFLWFNAYPA
                210       220       230       240       250       260

270       280       290       300       310       320
m088.pep  QVFMGDVGALALGAALGTVAVIVRQEFVLVIMGGLFVVEAVSVMLQVGWYKKTKKRIFLM
          ||||||||||||||||||||||||||||||||||||||||||||||||||||||||||||
a088      QVFMGDVGALALGAALGTVAVIVRQEFVLVIMGGLFVVEAVSVMLQVGWYKKTKKRIFLM
                270       280       290       300       310       320

330       340       350       360       370
m088.pep  APIHHHYEQKGWKETQVVVRFWIITIVLVLIGLSTLKIRXTYAVXTSFRRHLNAQX
          |||||||||||||||||||||||||||||||||||||||||||||| |||||||||
a088      APIHHHYEQKGWKETQVVVRFWIITIVLVLIGLSTLKIRXTYAVXTPFRRHLNAQX
                330       340       350       360       370
```

The following partial DNA sequence was identified in *N. gonorrhoeae* <SEQ ID 289>:

```
g089.seq
    1 ATGCCGCCCA AAATCACGAA GAGCGGGTTT TGCAAACCGG CAATCGCGGC

51 GGCGGTCGCG CCGACATTCG TGCCTTTGCT GTCGTCGATG AATACCACGC

101 CGTTTTTCTC GCCGATTTTT TCCACACGGT GCGGCAAGCC TTGGAAGGTT

151 TTGACGTGTT CCAGCAATGC TTCGCGCGGC AAACCGACGG CCTCGCACAA

201 AGCCACGGCA GCCATAACGT TGGCGGCGTT GTGCAAACCT TGCAGCGGGA

251 TGTCTTGCGT AGAAATCAAA TCTTCATTGC CTTGTTTTAA ACAGCCCGTC

301 CCGCGTTCCA ACCAAAAATC GGCTTCGTGT TCCAAGGAAA ACCGTTTCAC

351 TTCACGCCCT GCCCGTTTCA TGGCGCGGCA GAACACGTCG TCCGCATTCA

401 AAACCTGCAC TCCATCGCCA CGGAAAATCT CGGCTTTGGT ATGCGCGTAG
```

This corresponds to the amino acid sequence <SEQ ID 290; ORF 089.ng>:

```
g089.pep
    1 MPPKITKSGF CKPAIAAAVA PTFVPLLSSM NTTPFFSPIF STRCGKPWKV

51 LTCSSNASRG KPTASHKATA AITLAALCKP CSGMSCVEIK SSLPCFKQPV

101 PRSNQKSASC SKENRFTSRP ARFMARQNTS SAFKTCTPSP RKISALVCA*
```

The following partial DNA sequence was identified in *N. meningitidis* <SEQ ID 291>:

```
m089.seq
    1 ATGCCGCCCA AAATCACkAw GAGCGGATTT TGCAAACCGG CAATCGCGGC

51 GGCAGTCGCG CCGACATTCG TGCCTTTGCT GTCGTCGATA ACACCACGC

101 CGTTTTTCTC GCCGATTTTT TCCACGCGGT GCGGCAGGCC TTGGAAGGTT

151 TTGACGTGTT CGAGCAATGC TTCGCGCGAC AAACCGATGG CCTCACACAA

201 AGCCACkGCA GCCATGACGT TAGCGGCGTT GTGCAkACCT TGCAACGGwA

251 TGTCTTGCGT GACAATCAAA TCTTCATTGC CTTGTTTCAG GCGGCCTGTC
```

```
301 TCGCGTTCCA ACCAGAAATC AGCTTCGTGT TCCAACGAAA ACCATTTTAC

351 CTCGCGCCCG GCACGCTTCA TCGCGCGGCA GAACGCATCG TCCGCATTCA

401 AAACCTGCAC GCCGTCGCCA CGGAAAATCT TGGCTTTGGT ATGCGCATAG
```

This corresponds to the amino acid sequence <SEQ ID 292; ORF 089>:

```
m089.pep
   1 MPPKITXSGF CKPAIAAAVA PTFVPLLSSI NTTPFFSPIF STRCGRPWKV

51 LTCSSNASRD KPMASHKATA AMTLAALCXP CNGMSCVTIK SSLPCFRRPV

101 SRSNQKSASC SNENHFTSRP ARFIARQNAS SAFKTCTPSP RKILALVCA*
```

Computer analysis of this amino acid sequence gave the following results:

Homology with a Predicted ORF from *N. gonorrhoeae*
ORF 089 shows 88.6% identity over a 149 aa overlap with a predicted ORF (ORF 089.ng) from *N. gonorrhoeae*:

```
m089/g089

10         20         30         40         50         60
    m089.pep  MPPKITXSGFCKPAIAAAVAPTFVPLLSSINTTPFFSPIFSTRCGRPWKVLTCSSNASRD
              ||||||  ||||||||||||||||||||||:|||||||||||||||:|||||||||||||
        g089  MPPKITKSGFCKPAIAAAVAPTFVPLLSSMNTTPFFSPIFSTRCGKPWKVLTCSSNASRG
                    10         20         30         40         50         60

70         80         90        100        110        120
    m089.pep  KPMASHKATAAMTLAALCXPCNGMSCVTIKSSLPCFRRPVSRSNQKSASCSNENHFTSRP
              || |||||||:|||||| ||:|||| |||||||||::|| ||||||||||:||:|||||
        g089  KPTASHKATAAITLAALCKPCSGMSCVEIKSSLPCFKQPVPRSNQKSASCSKENRFTSRP
                    70         80         90        100        110        120

130        140        150
    m089.pep  ARFIARQNASSAFKTCTPSPRKILALVCAX
              |||:||||:||||||||||||||| |||||
        g089  ARFMARQNTSSAFKTCTPSPRKISALVCAX
                   130        140        150
```

The following partial DNA sequence was identified in *N. meningitidis* <SEQ ID 293>:

```
a089.seq
   1 ATGCCGCCTA AAATCACGAA GAGCGGATTT TGCAAACCGG CAATCGCGGC

51 GGCGGTCGCA CCGACGTTCG TGCCTTTGCT GTCGTCGATG AACACCACGC

101 CATTTTTCTC GCCGATTTTT TCCACGCGGT GCGGCAGGCC TTGAAAGGTT

151 TTGACGTGTT CGAGCAATGC TTCGCGCGGC AAACCGACGG CTTCGCACAA

201 GGCAACGGCA GCCATCACGT TAGTGGCGTT GTGCAAGCCT TGCAGCGGAA

251 TATCTTGCGT GGCAATCAAA TCTTCATTGC CTTGTTTCAG GCGACCTGTC

301 TCACGTTCCA ACCAAAAATC GGCTTCGTAT CCAACGAAA ACCATTTCAC

351 CTCGCGCCCG GCGCGCTTCA TCGCACGACA GAACGCATCG TCCGCATTCA

401 AAACCTGCAC ACCGTCGCCA CGGAAAATCT TGGCTTTGGT ATGCGCGTAG
```

This corresponds to the amino acid sequence <SEQ ID 294; ORF 089.a>:

```
a089.pep
    1 MPPKITKSGF CKPAIAAAVA PTFVPLLSSM NTTPFFSPIF STRCGRP*KV

51 LTCSSNASRG KPTASHKATA AITLVALCKP CSGISCVAIK SSLPCFRRPV

101 SRSNQKSASY SNENHFTSRP ARFIARQNAS SAFKTCTPSP RKILALVCA*
``` m089/a089 91.9% identity over a 149 aa overlap

```
                  10         20         30         40         50         60
    m089.pep  MPPKITXSGFCKPAIAAAVAPTFVPLLSSINTTPFFSPIFSTRCGRPWKVLTCSSNASRD
              ||||||  |||||||||||||||||||||||:||||||||||||||||  ||||||||||
    a089      MPPKITKSGFCKPAIAAAVAPTFVPLLSSMNTTPFFSPIFSTRCGRPXKVLTCSSNASRG
                  10         20         30         40         50         60

70         80         90        100        110        120
    m089.pep  KPMASHKATAAMTLAALCXPCNGMSCVTIKSSLPCFRRPVSRSNQKSASCSNENHFTSRP
              ||  |||||||||:||:|||  ||:|:|||:||||||||||||||||||||  ||||||||
    a089      KPTASHKATAAITLVALCKPCSGISCVAIKSSLPCFRRPVSRSNQKSASYSNENHFTSRP
                  70         80         90        100        110        120

130        140        150
    m089.pep  ARFIARQNASSAFKTCTPSPRKILALVCAX
              |||||||||||||||||||||||||||||
    a089      ARFIARQNASSAFKTCTPSPRKILALVCAX
                 130        140        150
```

The following partial DNA sequence was identified in *N. gonorrhoeae* <SEQ ID 295>:

```
g090.seq
    1 ATGCGCGTAG TCGAGCAAAT CGTCGTAGCG GTCGAGATGG TCTTCGGAAA

51 TGTTCATCAC CGTCGCCGCA GTCGGGCGCA GGCTTTCGGT GTTTTCCAGT

101 TGGAAGCTGG AAAGCTCcca CACCCACACG TCCGCCTTTT TGCCTTCgcg 151 ctgCAATtct gcctccaaga cgggcgtacc gatATTGCCC GCAATGAcgg 201 tatccagccc gcacttgatg CAGAGatagc ggaccaggct ggttaccgTG 251 GTTttgccgt tgctgCcggt aatcgCaatc accttgtcgC CGCGGCGGtt 301 cAcaaTGTCc gccaGCAATt ggATGTCGCC TAgCACGCGC .ccgccgTTT 351 TGCttga
```

This corresponds to the amino acid sequence <SEQ ID 296; ORF 090.ng>:

```
g090.pep
    1 MRVVEQIVVA VEMVFGNVHH RRRSRAQAFG VFQLEAGKLP HPHVRLFAFA

51 LQFCLQDGRT DIARNDGIQP ALDAEIADQA GYRGFAVAAG NRNHLVAAAV

101 HNVRQQLDVA XHAXRRFA*
```

The following partial DNA sequence was identified in *N. meningitidis* <SEQ ID 297>:

```
m090.seq.
    1 ATGCGCATAG TCGAGCAAGT CGTCGTAGCG GTCGAGATGG TCTTCGGAAA

51 TGTTCAGCAC CGTCGCCGCA GTCGGACGCA GGCTTTCGGT GTTTTCCAGT

101 TGGAAGCTGG AAAGCTCCAA CACCCACACG TCCGCCTTTT TGCCTTCGCG

151 CTGCCATTCC GCCTCCAAAA CCGGCGTGCC GATATTGCCC GCGATAACGG
```

-continued
```
201 TATCCAGCCC GCACTTGATA CAGAGATAGC CGACCAGGCT CGTTACCGTG

251 GTTTTGCCGT TGCTGCCGGT AATCGCAATT ACCTTGTCGT CCCGGCGGTT

301 CACAATGTCC GCCAGCAATT CGATGTCGCC AACACGCGT .CCGCCGTTT

351 TGCTTGA
```

This corresponds to the amino acid sequence <SEQ ID 298; ORF 090>:

```
m090.pep
    1 MRIVEQVVVA VEMVFGNVQH RRRSRTQAFG VFQLEAGKLQ HPHVRLFAFA

51 LPFRLQNRRA DIARDNGIQP ALDTEIADQA RYRGFAVAAG NRNYLVVPAV

101 HNVRQQFDVA QHAXRRFA*
```

Computer analysis of this amino acid sequence gave the following results:
Homology with a Predicted ORF from *N. gonorrhoeae*
ORF 090 shows 83.9% identity over a 118 aa overlap with a predicted ORF (ORF 090.ng) from *N. gonorrhoeae*:

```
m090/g090
                     10         20         30         40         50         60
   m090.pep   MRIVEQVVVAVEMVFGNVQHRRRSRTQAFGVFQLEAGKLQHPHVRLFAFALPFRLQNRRA
              ||:|||:||||||||||||:||||||:||||||||||||| |||||||||| | ||: |:
   g090       MRVVEQIVVAVEMVFGNVHHRRRSRAQAFGVFQLEAGKLPHPHVRLFAFALQFCLQDGRT
                     10         20         30         40         50         60

70         80         90        100        110        119
   m090.pep   DIARDNGIQPALDTEIADQARYRGFAVAAGNRNYLVVPAVHNVRQQFDVAQHAXRRFAX
              ||||::||||||:|||||  |||||||||||||||:||: ||||||||:||| |||||||||
   g090       DIARNDGIQPALDAEIADQAGYRGFAVAAGNRNHLVAAAVHNVRQQLDVAXHAXRRFAX
                     70         80         90        100        110
```

The following partial DNA sequence was identified in *N. meningitidis* <SEQ ID 299>:

```
a090.seq
    1 ATGCGCGTAG TCGAGCAAGT CGTCGTAGCG GTCGAGATGG TCTTCGGAAA

51 TGTTCAGCAC TGTCGCCGCA GTCGGGCGCA GGCTTTCGGT GTTTTCCAGT

101 TGGAAACTGG AAAGCTCCAA CACCCACACG TCCGCCTTTT TGCCTTCGCG

151 CTGCAATTCC GCCTCCAAAA CCGGCGCGCC GATATTGCCC GCGATAACGG

201 TATCCAGCCC ACACTTGATG CAGAGATAGC CGACCAGGCT CGTTACCGTG

251 GTTTTGCCGT TGCTGCCGGT AATCGCAATC ACCTTGTCGC CGCGGCGGTT

301 CACAATGTCC GCCAGCAATT CGATGTCGCC AACACGCGT C.CGCCGTTT

351 CGCTTAA
```

This corresponds to the amino acid sequence <SEQ ID 300; ORF 090.a>:

```
a090.pep
    1 MRVVEQVVVA VEMVFGNVQH CRRSRAQAFG VFQLETGKLQ HPHVRLFAFA

51 LQFRLQNRRA DIARDNGIQP TLDAEIADQA RYRGFAVAAG NRNHLVAAAV

101 HNVRQQFDVA QHAXRRFA*
``` m09/a090 91.5% identity over a 117 aa overlap

```
                 10        20        30        40        50        60
m090.pep   MRIVEQVVVAVEMVFGNVQHRRRSRTQAFGVFQLEAGKLQHPHVRLFAFALPFRLQNRRA
           ||:|||||||||||||||| ||||:|||||||||:||||||||||||||| ||||||||
a090       MRVVEQVVVAVEMVFGNVQHCRRSRAQAFGVFQLETGKLQHPHVRLFAFALQFRLQNRRA
                 10        20        30        40        50        60

70        80        90       100       110    119
m090.pep   DIARDNGIQPALDTEIADQARYRGFAVAAGNRNYLVVPAVHNVRQQFDVAQHAXRRFAX
           ||||||||||:||:|||||||||||||||||||||:|:||||||||||||||||||||
a090       DIARDNGIQPTLDAEIADQARYRGFAVAAGNRNHLVAAAVHNVRQQFDVAQHAXRRFAX
                 70        80        90       100       110
```

The following partial DNA sequence was identified in *N. gonorrhoeae* g090-1.seq This sequence contains multiple stop codons (not shown)

This corresponds to the amino acid sequence <ORF 090-1.ng>:

g090-1.pep (not shown)

The following partial DNA sequence was identified in *N. meningitidis* <SEQ ID 2>:

```
m090-1.seq
   1 ATGACGGCGT TTGCATTTCA GACGGCATCA CAAAGCCTTA AACGCTTCGA
  51 TAAACACTTC CGAACGGTGC GCGTAGCCTT TGAACATATC AAAGCTCGCG
 101 CAGGCGGGGC TGAGCAACAC AATATCGCCT GCTTCGGCTT GGGCATATGC
 151 CGTCTGAACG GCTTCTCCCA AAGTGGCGCA GTCGGTCATA TTCAAGCCGC
 201 AGCCGTCCAA ATCGCGGCGG ATTTGCGGCG CATCGACACC AATCAAGAAC
 251 ACGCCTTTTG CCTTGCCTAC CAGTGCATCG CGCAGGGGCG TGAAGTCCTG
 301 CCCTTTACCC ATGCCGCCCA AAATCACGAA GAGCGGATTT GCAAACCGG
 351 CAATCGCGGC GGCAGTCGCG CCGACATTCG TGCCTTTGCT GTCGTCGATA
 401 AACACCACGC CGTTTTTCTC GCCGATTTTT TCCACGCGGT GCGGCAGGCC
 451 TTGGAAGGTT TGACGTGTT CGAGCAATGC TTCGCGCGAC AAACCGATGG
 501 CCTCACACAA AGCCACGGCA GCCATGACGT TAGCGGCGTT GTGCAGACCT
 551 TGCAACGGAA TGTCTTGCGT GACAATCAAA TCTTCATTGC CTTGTTTCAG
 601 GCGGCCTGTC TCGCGTTCCA ACCAGAAATC AGCTTCGTGT TCCAACGAAA
 651 ACCATTTTAC CTCGCGCCCG GCACGCTTCA TCGCGCGGCA GAACGCATCG
 701 TCCGCATTCA AAACCTGCAC GCCGTCGCCA CGGAAAATCT TGGCTTTGGT
 751 ATGCGCATAG TCGAGCAAGT CGTCGTAGCG GTCGAGATGG TCTTCGGAAA
 801 TGTTCAGCAC CGTCGCCGCA GTCGGACGCA GGCTTTCGGT GTTTTCCAGT
 851 TGGAAGCTGG AAAGCTCCAA CACCCACACG TCCGCCTTTT TGCCTTCGCG
 901 CTGCCATTCC GCCTCCAAAA CCGGCGTGCC GATATTGCCC GCGATAACGG
 951 TATCCAGCCC GCACTTGATA CAGAGATAGC CGACCAGGCT CGTTACCGTG
1001 GTTTTGCCGT TGCTGCCGGT AATCGCAATT ACCTTGTCGT CCCGGCGGTT
1051 CACAATGTCC GCCAGCAATT CGATGTCGCC CAACACGCGT CCGCCGTTTT
1101 GCTTGAACGC CTCAATATCC GGCTGCCGCT CGCTGATGCC GGGACTGAGA
1151 GCCAGAATAT CGAAACCGTT GTCCAGCGCA TCTTTCAGAC GGCCCGTGTA
1201 AAACACCAAC CCGTCAAACA TCTTACCGAT TTGCGACACG CGTTCCGGCT
1251 TCAGCTCCGC ATCATACGCA GCAACCTCCG CGCCGTTTTT GCGCAGGTAG
1301 GCAATCATGG AAATACCCGT ACCGCCGAGT CCGGCGACGA GGATTTTTTT
1351 GTTTTGAAAA GTCATTTTGG TTTGTCCTAA
```

This corresponds to the amino acid sequence <SEQ ID 3; ORF 090-1>:

```
m090-1.pep
    1 MTAFAFQTAS QSLKRFDKHF RTVRVAFEHI KARAGGAEQH NIACFGLGIC

51 RLNGFSQSGA VGHIQAAAVQ IAADLRRIDT NQEHAFCLAY QCIAQGREVL

101 PFTHAAQNHE ERILQTGNRG GSRADIRAFA VVDKHHAVFL ADFFHAVRQA

151 LEGFDVFEQC FARQTDGLTQ SHGSHDVSGV VQTLQRNVLR DNQIFIALFQ

201 AACLAFQPEI SFVFQRKPFY LAPGTLHRAA ERIVRIQNLH AVATENLGFG

251 MRIVEQVVVA VEMVFGNVQH RRRSRTQAFG VFQLEAGKLQ HPHVRLFAFA

301 LPFRLQNRRA DIARDNGIQP ALDTEIADQA RYRGFAVAAG NRNYLVVPAV

351 HNVRQQFDVA QHASAVLLER LNIRLPLADA GTESQNIETV VQRIFQTARV

401 KHQPVKHLTD LRHAFRLQLR IIRSNLRAVF AQVGNHGNTR TAESGDEDFF

451 VLKSHFGLS*
```

The following partial DNA sequence was identified in *N. gonorrhoeae* <SEQ ID 303>:

```
g091.seq
    1 ATGGAAATAC CCGTGCCGCC AAGTCCGGCG ACGAGGATTT TTTTGTTTGA

51 AAGTCATTTT GGTTTTGTCC TAAAACAAAT CATATTGGGC AGGAGACGTC

101 CGCCCTTGCC CAAGCCGCTT TCAGACGGCA TCGCGAGCCG ATTAATAACC

151 CGCCTTCAGG CGTTGGTCAT TGTCGCAGCT GTTTTGGTCT CCGTTTTGAC

201 AAGCCTTGCC AAGCCATTGT TGAGCGAGCC CAAGGTCTTG GCGCACGCCG

251 CGTCCATCGT AATACATCAA GCCCAAATTG TATTGGGCTT GGGCATCCCC

301 TTGTTCTGA
```

This corresponds to the amino acid sequence <SEQ ID 304; ORF 091.ng>:

```
g091.pep
    1 MEIPVPPSPA TRIFLFESHF GFVLKQIILG RRRPPLPKPL SDGIASRLIT

51 RLQALVIVAA VLVSVLTSLA KPLLSERKVL AHAASIVIHQ AQIVLGLGIP

101 LF*
```

The following partial DNA sequence was identified in *N. meningitidis* <SEQ ID 305>:

```
m091.seq
    1 ATGGAAATAC CCGTACCGCC GAGTCCGGCG ACGAGGATTT TTTTGTTTGA

51 AAAGTCATT TTGGTTTGTCC TAAAACAAAT CATATTGAGC AGGAGATGTC

101 CGCCCCTGC CCAAGCCGCTT TCAGACGGCA TCGCGAGCTG TTCAATAACC

151 CGCCTTCAG GCGTTGGTCAT TGTCGCAGCC GTCTTGGTCT CCGTTTTGAC

201 AAGCCTTGC CAAACCATTCT TGTGCAAGGG CGCGGTCTTG GCGCACGCCG

251 CGTCTTTCG GCATACATCAC GCCCAAATTG TTTTGGGCTT GGGCTACCCC

301 CTGCGC...
```

This corresponds to the amino acid sequence <SEQ ID 306; ORF 091>:

```
m091.pep
    1 MEIPVPPSPA TRIFLFEKSF WFVLKQIILS RRCPPLPKPL SDGIASCSIT

51 RLQALVIVAA VLVSVLTSLA KPFLCKGAVL AHAASFGIHH ACIVLGLGYP

101 LR.
```

Computer analysis of this amino acid sequence gave the following results:
Homology with a Predicted ORF from *N. gonorrhoeae*
ORF 091 shows 84.2% identity over a 101 aa overlap with a predicted ORF (ORF 091.ng) from *N. gonorrhoeae*:

```
    m091/g091

10         20         30         40         50         60
    m091.pep    MEIPVPPSPATRIFLFEKSFWFVLKQIILSRRCPPLPKPLSDGIASCSITRLQALVIVAA
                |||||||||||||||||:|||||||||:||||||||||||||||||||||||||||||||
    g091        MEIPVPPSPATRIFLFESHFGFVLKQIILGRRRPPLPKPLSDGIASRLITRLQALVIVAA
                        10         20         30         40         50         60

70         80         90        100
    m091.pep    VLVSVLTSLAKPFLCKGAVLAHAASFGIHHAQIVLGLGYPLR
                ||||||||||||:|  : |||||||: ||:|||||||| ||
    g091        VLVSVLTSLAKPLLSERKVLAHAASIVIHQAQIVLGLGIPLFX
                        70         80         90        100
```

The following partial DNA sequence was identified in *N. meningitidis* <SEQ ID 307>:

```
a091.seq
    1 ATGGAAATAC CCGTGCCGCC AAGTCCGGCG ACGAGGATTT TTTTGTTTTG

51 GAAATCATTT TGGTTTGTCC TAAAACAAAT CATATTGAGC AGGGGATGTC

101 TGATCCTGCT CAAGCCGCTT TCAGACGGCA TCGCGAGCTG TTCAATAACC

151 CGCTTTCAGG CGTTGGTCAT TGTCGCAGCT GTCTTGGTAT CCGTTTTGAC

201 AAGCCTTGCC AAGCCATTCT TGTGCAAGGG CGCGGTCTTG GCGCACGCCG

251 CGTCTTTCGG CATACATCAC GCCCAAATTG TTTTGGGC
```

This corresponds to the amino acid sequence <SEQ ID 308; ORF 091.a>:

```
a091.pep.
    1 MEIPVPPSPA TRIFLFWKSF WFVLKQIILS RGCLILLKPL SDGIASCSIT

51 RFQALVIVAA VLVSVLTSLA KPFLCKGAVL AHAASFGIHH AQIVLG
``` m091/a091 93.8% identity over a 96 aa overlap

```
                        10         20         30         40         50         60
    m091.pep    MEIPVPPSPATRIFLFEKSFWFVLKQIILSRRCPPLPKPLSDGIASCSITRLQALVIVAA
                ||||||||||||||||| ||||||||||||| |  ||||||||||||||||:||||||||
    a091        MEIPVPPSPATRIFLFWKSFWFVLKQIILSRGCLILLKPLSDGIASCSITRFQALVIVAA
                        10         20         30         40         50         60

70         80         90        100
    m091.pep    VLVSVLTSLAKPFLCKGAVLAHAASFGIHHAQIVLGLGYPLR
                |||||||||||||||||||||||||||||||||||||
    a091        VLVSVLTSLAKPFLCKGAVLAHAASFGIHHAQIVLG
                        70         80         90
```

The following partial DNA sequence was identified in *N. gonorrhoeae* <SEQ ID 309>:

```
g092.seq
    1 ATGTTTTTTA TTTCAATCCG CTATATATTT GTCAGAAAAC TATGGTGCGC

51 AAACGGTCAG ACCTTTAAAA TAACGCCTTT ACGCACTAAA AACCAACCGG

101 AACGCAACAT TATGATGAAA AATCGAGTAA GCAACATCCA TTTTGTCGGT

151 ATCGGCGGCG TCGGCATGAG CGGTATCGCC GAAGTCTTGC ACAATTTGGG

201 CTTTAAAGTT TCCGGTTCGG ATCAGGCGCG AAATGCCGCT ACCGAGCATT

251 TGAGCAGCCT GGGCATTCAA GTTTATCCCG GCCATACCGC AGAACACGTT

301 AACGGTgcgg ATGTCGTCGT TGCCTCTACC GCCGTCAAGA AAGAAaatcC

351 CGAAGTtgtc gcTGCGTTGG AGCGGCAAAT TCCCGTTATT CCGCGCGCCT

401 TGATGCTGGC AGAGCTGATG CGCTTCCGTG ACGgcatcgc cattgccggT

451 ACGCACGGCA AAACCACGAC CACCAGCCTG ACCGCCTCCA TCCTCGGCGC

501 GGCAGGACTC GACCCCACTT TCGTTATCGG CGGCAAACTC AACGCCGCAG

551 GCACCAACGC CCGCTTGGGC AAAGGCGAAT ACATCGTTGC CGAAGCCGAC

601 GAATCCGATG CCTCTTTCCT ACATCTGACC CCGATTATGT CCGTCGTTAC

651 CAATATCGAC GAAGACCATA TGGATACCTA CGGGCACAGC GTCGAAAAAC

701 TGCATCAGGC GTTTATCGAT TTCATCCACC GTATGCCCTT CTACGGCAAA

751 GCCTTTTTGT GTGTTGACAG CGAACACGTC CGCGCGATTT GCCCAAAGT

801 GAGCAAACCT TATGCTACTT ACGGTTTGGA CGATACCGCC GACATCTACG

851 CCACCGACAT CGAAAACGTC GGCGCGCAAA TGAAATTCAC CGTCCATGTT

901 CAAATGAAAG ACATGAGCA GGGGTCGTTT GAAGTCGTGC TGAATATGCC

951 CGGCAGACAC AACGTGCTGA ACGCATTGGC AGCCATCGGc gtggcGCTgg 1001 aagtcGgCGC ATcggttgAA GCGAtcCAAA AaggCTTGCT CGGCTTTGAA 1051 GGCGTCGGCC GCCGCTTCCA AAAATAcggc gacatCAagt tgccaaacgg 1101 cggGaccgCT TTgctGGTGG ACGATTAcgg ACACCACCCC GTCGAAATGG 1151 CGGcaaccct tgccgcTGCA CGCGGCGCGT ATCCGGAAAA acgtTTGGTG 1201 CtcgCCTTCC AGCCGCACCG CTATACCCGC ACGCGCGATT TGTTTGAAGA 1251 CTTTACCAAA GTACTCAATA CCGTTGatgC GCTGGTACTG ACCGAAGTTT 1301 AtgccgccgG CGAAGAGCCG GTTGCCGCCG CCGactcCCG CGCCTTGGCG 1351 CGTGCTATCC GCGTATTGGG CAAACTTGAG CCGATTTACT GCGAAAatgt 1401 cgccgACCTG CCGCAAATGC TGATGAATGT TTTACAGGAT Ggcgatgttg 1451 tgttgAATAT GggTgcggga agcatcaacc gcgttccttc cgcgctgttg 1501 gaattgtcga AACAGAtttq A
```

This corresponds to the amino acid sequence <SEQ ID 310; ORF 092.ng>:

```
g092.pep
    1 MFFISIRYIF VRKLWCANGQ TFKITPLRTK NQPERNIMMK NRVSNIHFVG

51 IGGVGMSGIA EVLHNLGFKV SGSDQARNAA TEHLSSLGIQ VYPGHTAEHV

101 NGADVVVAST AVKKENPEVV AALERQIPVI PRALMLAELM RFRDGIAIAG

151 THGKTTTTSL TASILGAAGL DPTFVIGGKL NAAGTNARLG KGEYIVAEAD
```

-continued

```
201 ESDASFLHLT PIMSVVTNID EDHMDTYGHS VEKLHQAFID FIHRMPFYGK

251 AFLCVDSEHV RAILPKVSKP YATYGLDDTA DIYATDIENV GAQMKFTVHV

301 QMKGHEQGSF EVVLNMPGRH NVLNALAAIG VALEVGASVE AIQKGLLGFE

351 GVGRRFQKYG DIKLPNGGTA LLVDDYGHHP VEMAATLAAA RGAYPEKRLV

401 LAFQPHRYTR TRDLFEDFTK VLNTVDALVL TEVYAAGEEP VAAADSRALA

451 RAIRVLGKLE PIYCENVADL PQMLMNVLQD GDVVLNMGAG SINRVPSALL

501 ELSKOI*
```

The following partial DNA sequence was identified in *N. meningitidis* <SEQ ID 311>:

```
m092.seg
   1 ATGTTTTTTA TTTCAATCCG CTATATATTT GTCAGAAAAC TATGGCGCGC

51 AAACGGTCAG CCCTTTAAAA TAACGCCTTT ACGCATCGAA AATCCACCGG

101 AACGCAACAT TATGATGAAA AATCGAGTTA CCAACATCCA TTTTGTCGGT

151 ATCGGCGGCG TCGGCATGAG CGGCATCGCC GAAGTCTTGC ACAATTTGGG

201 CTTTAAAGTT TCCGGTTCGG ATCAgGCGCG AAATGCCGCT ACCGAGCATT

251 TGGGCAGCCT GGGCATTCAA GTTTATCCCG GCCATACCGC CGAACACGTT

301 AACGGTGCGG ATGTCGTCGT TACCTCTACC GCCGTCAAAA AAGAAAATCC

351 CGAAGTTGTC GCTGCGTTGG AGCAGCAAAT TCCCGTTATT CCGCGCGCCC

401 TGATGTTGGC GGAGTTGATG CGCTTCCGTG ACGGCATCGC CATTGCCGGC

451 ACGCACGGCA AAACCACGAC CACCAGCCTG ACCGCCTCCA TCCTCGGCGC

501 GGCAGGACTT GACCCGACTT TCGTTATCGG CGGCAAACTC AACGCCGCAG

551 GCACTAACGC CCGCTTGGGC AAAGGCGAAT ACATCGTTGC CGAAGCCGAC

601 GAGTCGGATG CATCCTTTCT GCACCTGACA CCGATTATGT CCGTCGTTAC

651 CAATATCGAC GAAGACCATA TGGATACCTA CGGGCACAGC GTCGAAAAAC

701 TGCATCAGGC GTTTATCGAT TTCATCCACC GTATGCCCTT CTACGGCAAA

751 GCCTTTTTGT GTATTGACAG CGAACACGTC CGCGCGATTT TGCCCAAAGT

801 GAGCAAACCT TATGCTACTT ACGGTTTGGA CGATACCGCC GACATCTACG

851 CCACCGACAT CGAAAACGTC GGCGCGCAAA TGAAATTCAC CGTCCATGTT

901 CAAATGAAAG GACATGAGCA GGGGTCGTTT GAAGTCGTGC TGAATATGCC

951 CGGCAGACAC AACGTGCTGA ACGCATTGGC AGCCATCGGC GTGGCGCTGG

1001 AAGTCGGCGC ATCGGTTGAA GCGATCCAAA AAGGCTTGCT CGGCTTTGAA

1051 GGCGTCGGCC GCCGCTTCCA AAAATACGGC GACATCAAGT TGCCAAACGG

1101 CGGGACCGCG CTCTTGGTGG ACGACTACGG ACACCACCCC GTCGAAATGG

1151 CGGCGACCCT TGCCGCCGCA CGCGGCGCGT ATCTGGAAAA ACGTTTGGTA

1201 CTCGCCTTCC AGCCGCACCG CTATACCCGC ACGCGCGATT TGTTTGAAGA

1251 CTTTACCAAA GTCCTCAATA CCGTTGACGC GCTGGTGCTG ACCGAAGTTT

1301 ATGCCGCCGG TGAAGAGCCG ATTGCCGCCG CCGATTCCCG CGCTCTTGCC

1351 CGCGCCATCC GCGTGTTGGG CAAACTCGAG CCGATTTACT GCGAAAACGT

1401 TGCCGATCTG CCCGAAATGC TGTTGAACGT TTTGCAGGAC GGCGACATCG
```

-continued
```
1451 TGTTGAATAT GGGCGCGGGA AGCATCAACC GCGTCCCCGC CGCGCTGCTG

1501 GCATTGTCGA AACAGATTTG A
```

This corresponds to the amino acid sequence <SEQ ID 312; ORF 092>:

```
m092.pep
   1 MFFISIRYIF VRKLWRANGQ PFKITPLRIE NPPERNIMMK NRVTNIHFVG

51 IGGVGMSGIA EVLHNLGFKV SGSDQARNAA TEHLGSLGIQ VYPGHTAEHV

101 NGADVVVTST AVKKENPEVV AALEQQIPVI PRALMLAELM RFRDGIAIAG

151 THGKTTTTSL TASILGAAGL DPTFVIGGKL NAAGTNARLG KGEYIVAEAD

201 ESDASFLHLT PIMSVVTNID EDHMDTYGHS VEKLHQAFID FIHRMPFYGK

251 AFLCIDSEHV RAILPKVSKP YATYGLDDTA DIYATDIENV GAQMKFTVHV

301 QMKGHEQGSF EVVLNMPGRH NVLNALAAIG VALEVGASVE AIQKGLLGFE

351 GVGRRFQKYG DIKLPNGGTA LLVDDYGHHP VEMAATLAAA RGAYLEKRLV

401 LAFQPHRYTR TRDLFEDFTK VLNTVDALVL TEVYAAGEEP IAAADSRALA

451 RAIRVLGKLE PIYCENVADL PEMLLNVLQD GDIVLNMGAG SINRVPAALL

501 ALSKQI*
```

Computer analysis of this amino acid sequence gave the following results:

Homology with a Predicted ORF from *N. gonorrhoeae*

ORF 092 shows 96.6% identity over a 506 aa overlap with a predicted ORF (ORF 092.ng) from *N. gonorrhoeae*:

```
m092/g092

10         20         30         40         50         60
         m092.pep   MFFISIRYIFVRKLWRANGQPFKITPLRIENPPERNIMMKNRVTNIHFVGIGGVGMSGIA
                    |||||||||||||| |||| ||||||| :| ||||||||||:|||||||||||||||||
             g092   MFFISIRYIFVRKLWCANGQTFKITPLRTKNQPERNIMMKNRVSNIHFVGIGGVGMSGIA
                        10         20         30         40         50         60

70         80         90        100        110        120
         m092.pep   EVLHNLGFKVSGSDQARNAATEHLGSLGIQVYPGHTAEHVNGADVVVTSTAVKKENPEVV
                    |||||||||||||||||||||||||:|||||||||||||||||||||:||||||||||
             g092   EVLHNLGFKVSGSDQARNAATEHLSSLGIQVYPGHTAEHVNGADVVVASTAVKKENPEVV
                        70         80         90        100        110        120

130        140        150        160        170        180
         m092.pep   AALEQQIPVIPRALMLAELMRFRDGIAIAGTHGKTTTTSLTASILGAAGLDPTFVIGGKL
                    ||||:|||||||||||||||||||||||||||||||||||||||||||||||||||||
             g092   AALERQIPVIPRALMLAELMRFRDGIAIAGTHGKTTTTSLTASILGAAGLDPTFVIGGKL
                       130        140        150        160        170        180

190        200        210        220        230        240
         m092.pep   NAAGTNARLGKGEYIVAEADESDASFLHLTPIMSVVTNIDEDHMDTYGHSVEKLHQAFID
                    ||||||||||||||||||||||||||||||||||||||||||||||||||||||||||
             g092   NAAGTNARLGKGEYIVAEADESDASFLHLTPIMSVVTNIDEDHMDTYGHSVEKLHQAFID
                       190        200        210        220        230        240

250        260        270        280        290        300
         m092.pep   FIHRMPFYGKAFLCIDSEHVRAILPKVSKPYATYGLDDTADIYATDIENVGAQMKFTVHV
                    ||||||||||||| :|||||||||||||||||||||||||||||||||||||||||||
             g092   FIHRMPFYGKAFLCVDSEHVRAILPKVSKPYATYGLDDTADIYATDIENVGAQMKFTVHV
                       250        260        270        280        290        300

310        320        330        340        350        360
         m092.pep   QMKGHEQGSFEVVLNMPGRHNVLNALAAIGVALEVGASVEAIQKGLLGFEGVGRRFQKYG
                    ||||||||||||||||||||||||||||||||||||||||||||||||||||||||||
             g092   QMKGHEQGSFEVVLNMPGRHNVLNALAAIGVALEVGASVEAIQKGLLGFEGVGRRFQKYG
                       310        320        330        340        350        360

370        380        390        400        410        420
         m092.pep   DIKLPNGGTALLVDDYGHHPVEMAATLAAARGAYLEKRLVLAFQPHRYTRTRDLFEDFTK
                    ||||||||||||||||||||||||||||||||| |||||||||||||||||||||||||
             g092   DIKLPNGGTALLVDDYGHHPVEMAATLAAARGAYPEKRLVLAFQPHRYTRTRDLFEDFTK
                       370        380        390        400        410        420
```

-continued

```
                   430        440        450        460        470        480
m092.pep    VLNTVDALVLTEVYAAGEEPIAAADSRALARAIRVLGKLEPIYCENVADLPEMLLNVLQD
            |||||||||||||||||||:||||||||||||||||||||||||||||||||:||:|||||
g092        VLNTVDALVLTEVYAAGEEPVAAADSRALARAIRVLGKLEPIYCENVADLPQMLMNVLQD
                   430        440        450        460        470        480

490        500
m092.pep    GDIVLNMGAGSINRVPAALLALSKQIX
            ||:|||||||||||||:||| ||||||
g092        GDVVLNMGAGSINRVPSALLELSKQIX
                   490        500
```

The following partial DNA sequence was identified in *N. meningitidis* <SEQ ID 313>:

```
a092.seq
   1 ATGTTTTTTA TTTCAATCCG CTATATATTT GTCAGAAAAC TATGGCGCGC

51 AAACGGTCAG CCCTTTAAAA TAACGCCTTT ACGCATCGAA AATCCACCGG

101 AACGCAACAT TATGATGAAA AATCGAGTGA CCAACATCCA TTTTGTCGGT

151 ATCGGCGGCG TCGGCATGAG CGGTATCGCC GAAGTCTTGC ACAATTTGGG

201 TTTTAAAGTT TCCGGTTCGG ATCAGGCGCG AAATGCCGCT ACCGAGCATT

251 TGGGCAGCCT GGGCATTCAA GTTTATCCCG GCCATACCGC AGAACACGTT

301 AACGGTGCGG ATGTCGTCGT TACCTCTACC GCCGTCAAAA AAGAAAATCC

351 CGAAGTTGTC GCTGCGTTGG AGCAGCAAAT TCCCGTTATT CCGCGCGCCC

401 TGATGTTGGC GGAGTTGATG CGCTTCCGTG ACGGCATCGC CATTGCCGGC

451 ACGCACGGCA AAACCACGAC CACCAGCCTG ACCGCCTCCA TCCTCGGCGC

501 GGCAGGACTT GACCCGACTT TCGTTATCGG CGGCAAACTC AACGCCGCAG

551 GCACCAACGC CCGCTTGGGC AAAGGCGAAT ACATCGTTGC CGAAGCCGAC

601 GAGTCGGATG CATCCTTTCT GCACCTGACA CCGATTATGT CCGTCGTTAC

651 CAATATCGAC GAAGACCATA TGGATACCTA CGGGCACAGT GTTGAGAAGC

701 TGCATCAGGC GTTTATCGAT TTCATCCACC GTATGCCCTT CTACGGCAAA

751 GCCTTTTTGT GTATTGACAG CGAACACGTC CGCGCGATTT TGCCCAAAGT

801 GAGCAAACCT TATGCTACTT ACGGTTTGGA CGATACCGCC GACATCTACG

851 CCACCGACAT CGAAAACGTC GGCGCGCAAA TGAAATTCAC CGTCCATGTT

901 CAAATGAAAG GACATGAGCA GGGGTCGTTT GAAGTCGTGC TGAATATGCC

951 CGGCAGACAC AACGTGCTGA ACGCATTGGC AGCCATCGGC GTGGCGCTGG

1001 AAGTCGGCGC ATCGGTTGAA GCGATCCAAA AAGGCTTGCT CGGCTTTGAA

1051 GGTGTCGGCC GCCGCTTCCA AAAATACGGC GACATCAAGT TGCCAAACGG

1101 TGGAACCGCG CTCTTGGTGG ACGACTACGG ACACCACCCC GTCGAAATGG

1151 CGGCGACCCT TTCCGCCGCA CGCGGCGCGT ATCCGGAAAA ACGTTTGGTA

1201 CTCGCCTTCC AGCCGCACCG CTATACCCGC ACGCGCGATT TGTTTGAAGA

1251 CTTTACCAAA GTCCTCAATA CCGTTGACGC GCTGGTGCTG ACCGAAGTTT

1301 ATGCCGCCGG TGAAGAGCCG ATTGCCGCCG CTGATTCCCG CGCTCTTGCC

1351 CGCGCCATCC GCGTGTTGGG CAAACTCGAG CCGATTTACT GCGAAAACGT

1401 TGCCGATCTG CCCGAAATGC TGTTGAACGT TTTGCAGGAC GGCGACATCG

1451 TGTTGAATAT GGGTGCGGGA AGCATCAACC GCGTCCCCGC CGCGCTGCTG

1501 GAATTGTCGA AACAGATTTG A
```

This corresponds to the amino acid sequence <SEQ ID 314; ORF 092.a>:

```
a092.pep
    1 MFFISIRYIF VRKLWRANGQ PFKITPLRIE NPPERNIMMK NRVTNIHFVG

51 IGGVGMSGIA EVLHNLGFKV SGSDQARNAA TEHLGSLGIQ VYPGHTAEHV

101 NGADVVVTST AVKKENPEVV AALEQQIPVI PRALMLAELM RFRDGIAIAG

151 THGKTTTTSL TASILGAAGL DPTFVIGGKL NAAGTNARLG KGEYIVAEAD

201 ESDASFLHLT PIMSVVTNID EDHMDTYGHS VEKLHQAFID FIHRMPFYGK

251 AFLCIDSEHV RAILPKVSKP YATYGLDDTA DIYATDIENV GAQMKFTVHV

301 QMKGHEQGSF EVVLNMPGRH NVLNALAAIG VALEVGASVE AIQKGLLGFE

351 GVGRRFQKYG DIKLPNGGTA LLVDDYGHHP VEMAATLSAA RGAYPEKRLV

401 LAFQPHRYTR TRDLFEDFTK VLNTVDALVL TEVYAAGEEP IAAADSRALA

451 RAIRVLGKLE PIYCENVADL PEMLLNVLQD GDIVLNMGAG SINRVPAALL

501 ELSKQI*
``` m092/a092 99.4% identity over a 506 aa overlap

```
                 10         20         30         40         50         60
m092.pep  MFFISIRYIFVRKLWRANGQPFKITPLRIENPPERNIMMKNRVTNIHFVGIGGVGMSGIA
          ||||||||||||||||||||||||||||||||||||||||||||||||||||||||||||
a092      MFFISIRYIFVRKLWRANGQPFKITPLRIENPPERNIMMKNRVTNIHFVGIGGVGMSGIA
                 10         20         30         40         50         60

70         80         90        100        110        120
m092.pep  EVLHNLGFKVSGSDQARNAATEHLGSLGIQVYPGHTAEHVNGADVVVTSTAVKKENPEVV
          ||||||||||||||||||||||||||||||||||||||||||||||||||||||||||||
a092      EVLHNLGFKVSGSDQARNAATEHLGSLGIQVYPGHTAEHVNGADVVVTSTAVKKENPEVV
                 70         80         90        100        110        120

130        140        150        160        170        180
m092.pep  AALEQQIPVIPRALMLAELMRFRDGIAIAGTHGKTTTTSLTASILGAAGLDPTFVIGGKL
          ||||||||||||||||||||||||||||||||||||||||||||||||||||||||||||
a092      AALEQQIPVIPRALMLAELMRFRDGIAIAGTHGKTTTTSLTASILGAAGLDPTFVIGGKL
                130        140        150        160        170        180

190        200        210        220        230        240
m092.pep  NAAGTNARLGFGEYIVAEADESDASFLHLTPIMSVVTNIDEDHMDTYGHSVEKLHQAFID
          |||||||||| |||||||||||||||||||||||||||||||||||||||||||||||||
a092      NAAGTNARLGKGEYIVAEADESDASFLHLTPIMSVVTNIDEDHMDTYGHSVEKLHQAFID
                190        200        210        220        230        240

250        260        270        280        290        300
m092.pep  FIHRMPFYGKAFLCIDSEHVRAILPKVSKPYATYGLDDTADIYATDIENVGAQMKFTVHV
          ||||||||||||||||||||||||||||||||||||||||||||||||||||||||||||
a092      FIHRMPFYGKAFLCIDSEHVRAILPKVSKPYATYGLDDTADIYATDIENVGAQMKFTVHV
                250        260        270        280        290        300

310        320        330        340        350        360
m092.pep  QMKGHEQGSFEVVLNMPGRHNVLNALAAIGVALEVGASVEAIQKGLLGFEGVGRRFQKYG
          ||||||||||||||||||||||||||||||||||||||||||||||||||||||||||||
a092      QMKGHEQGSFEVVLNMPGRHNVLNALAAIGVALEVGASVEAIQKGLLGFEGVGRRFQKYG
                310        320        330        340        350        360

370        380        390        400        410        420
m092.pep  DIKLPNGGTALLVDDYGHHPVEMAATLAAARGAYLEKRLVLAFQPHRYTRTRDLFEDFTK
          |||||||||||||||||||||||||||||:|||||| |||||||||||||||||||||||
a092      DIKLPNGGTALLVDDYGHHPVEMAATLSAARGAYPEKRLVLAFQPHRYTRTRDLFEDFTK
                370        380        390        400        410        420

430        440        450        460        470        480
m092.pep  VLNTVDALVLTEVYAAGEEPIAAADSRALARAIRVLGKLEPIYCENVADLPEMLLNVLQD
          ||||||||||||||||||||||||||||||||||||||||||||||||||||||||||||
a092      VLNTVDALVLTEVYAAGEEPIAAADSRALARAIRVLGKLEPIYCENVADLPEMLLNVLQD
                430        440        450        460        470        480
```

-continued

```
              490        500
m092.pep  GDIVLNMGAGSINRVPAALLALSKQIX
          ||||||||||||||||||| ||||||
a092      GDIVLNMGAGSINRVPAALLELSKQIX
              490        500
```

The following partial DNA sequence was identified in *N. gonorrhoeae* <SEQ ID 315>:

```
g093.seq
   1 aTGCAGAATt ttgGCAAAGT ggccgtATTG ATGGGtggtT TTTCCAGCGA

51 ACGAGAaatc tcgcTGGACA GCgGTACCGC CATTTTGAAC GCCTTAAAAA

101 GCAAAGGCAT AGACGCATAC GCCTTCGACC CTAAGGAAAC GCCGTTATCC

151 GAACTGAAGG AGCGGGGCTT TCAGACGGCA TTCAACATCC TTCACGGTAC

201 TTACGGCGAA GACGGGGCTG TTCAGGGTGC ATTGGAACTG TTGGGCATTC

251 CCTATACCGG CAGCGGTGTC GCCGCCTCCG CCATCGGCAT GGACAAATAC

301 CGCTGCAAAC TGATTTGGCA GGCATTGGGA TTACCCGTTC CCGAGTTCGC

351 CGTACTGTAC GATGATACCG ATTTCGATGC CGTCGAAGAA AAATTGGGTC

401 TGCCGATGTT TGTGAAGCCG GCGGCCGAAG GCAGCAGCGt cggcgtggta 451 aAAGTCAAAG AAAaaggccg TCTGAAAAGC GTTtacgaag aatTGAaaCA 501 CCTTcagggg cgaAAtcatt gccgAacgTT TTATCGGCGG CGGCGAATAT

551 TCCTGCCCCG TCCTGAACGG CAAAGGGCTG CCCGGCATAC ACATCATCCC

601 CGCAACCGAG TTTTACGAct acgaagccaa GtacaaCCGA GACGAcacca 651 tttaTCAATG TCCTTCGGAA GATTTGACCG AAGCCGAAGA AAGCCTGATG

701 CGCGAACTGG CGGTTCGCGG CGCACAGGCA ATCGGTGCGG AAGGCTGCGT

751 GCGCGTCGAT TTCCTCAAAG ATACCGACGG CAAACTCTAT CTGTTGGAAA

801 TCAACACCCT GCCCGGTATG ACCGGCCATA G
```

This corresponds to the amino acid sequence <SEQ ID 316; ORF 093.ng>:

```
g093.pep
   1 MQNFGKVAVL MGGFSSEREI SLDSGTAILN ALKSKGIDAY AFDPKETPLS

51 ELKERGFQTA FNILHGTYGE DGAVQGALEL LGIPYTGSGV AASAIGMDKY

101 RCKLIWQALG LPVPEFAVLY DDTDFDAVEE KLGLPMFVKP AAEGSSVGVV

151 KVKEKGRLKS VYEELKHLQG RNHCRTFYRR RRIFLPRPER QRAARHTHHP

201 RNRVLRLRSQ VQPRRHHLSM SFGRFDRSRR KPDARTGGSR RTGNRCGRLR

251 ARRFPQRYRR QTLSVGNQHP ARYDRP*
```

The following partial DNA sequence was identified in *N. meningitidis* <SEQ ID 317>:

```
m093.seq
   1 ATGCAGAATT TGGCAAAGT GGCCGTATTG ATGGGCGGTT TTTCCAGCGA

51 ACGAGAAATC TCGCTGGACA GCGGCACCGC CATTTTGAAT GCTTTAAAAA

101 GCAAAGGCAT AGACGCATAC GCCTTCGATC CTAAAGAAAC CCCATTGTCT

151 GAATTGAAGG CACAAGGTTT TCAGACGGCA TTCAACATCC TTCACGGTAC
```

```
201 TTACGGCrAA GACGGGGCGG TTCAGGGTGC ATTGGAACTG TTGGGCATTC

251 CCTATACCGG CAGCGGTGTC GCCGCATCCG CCATCGGCAT GGACAAATAC

301 CGCTGCAAAC TGATTTGGCA GGCATTGGGA TTGCCCGTTC CCGAGTTCGC

351 CGTCCTGCAC GACGACACTG ATTTCGATGC CGTCGAAGAA AAATTGGGCC

401 TGCCGATGTT TGTGAAACCG GCGGCCGAAG GCAGCAGCGT AGGCGTGGTA

451 AAAGTCAAAG GAAAGGCCG TCTGAAAAGC GTTTACGAAG AATTGAAACA

501 CCTTCAGGG. CGAAATCATT GCCGAACGTT TTATCGGCGG CGGCGAATAT

551 TCCTGCCCCG TCCTGAACGG CAAAGGGCTG CCCGGCATAC ACATCATTCC

601 CGCAACCGAG TTTTACGACT ACGAAGCCAA GTACAACCGC GACGACACCA

651 TTTATCAATG TCCTTCGGAA GATTTGACCG AAGCCGAAGA AAGCCTGATG

701 CGCGAACTGG CGGTTCGCGG CGCGCAGGCA ATCGGTGCGG AAGGCTGCGT

751 GCGCGTCGAT TTCCTCAAAG ATACCGACGG CAAACTCTAT CTGTTGGAAA

801 TCAACACCCT GCCCGGTATG ACGAGCCATA G
```

This corresponds to the amino acid sequence <SEQ ID 318; ORF 093>:

```
m093.pep
   1 MQNFGKVAVL MGGFSSEREI SLDSGTAILN ALKSKGIDAY AFDPKETPLS

51 ELKAQGFQTA FNILHGTYGX DGAVQGALEL LGIPYTGSGV AASAIGMDKY

101 RCKLIWQALG LPVPEFAVLH DDTDFDAVEE KLGLPMFVKP AAEGSSVGVV

151 KVKGKGRLKS VYEELKHLQX RNHCRTFYRR RRIFLPRPER QRAARHTHHS

201 RNRVLRLRSQ VQPRRHHLSM SFGRFDRSRR KPDARTGGSR RAGNRCGRLR

251 ARRFPQRYRR QTLSVGNQHP ARYDEP*
```

Computer analysis of this amino acid sequence gave the following results:

Homology with a Predicted ORF from *N. gonorrhoeae*

ORF 093 shows 96.7% identity over a 276 aa overlap with a predicted ORF (ORF 093.ng) from *N. gonorrhoeae*:

```
m093/g093
                        10         20         30         40         50         60
         m093.pep  MQNFGKVAVLMGGFSSEREISLDSGTAILNALKSKGIDAYAFDPKETPLSELKAQGFQTA
                   ||||||||||||||||||||||||||||||||||||||||||||||||||||| :|||||
             g093  MQNFGKVAVLMGGFSSEREISLDSGTAILNALKSKGIDAYAFDPKETPLSELKERGFQTA
                        10         20         30         40         50         60

70         80         90        100        110        120
         m093.pep  FNILHGTYGXDGAVQGALELLGIPYTGSGVAASAIGMDKYRCKLIWQALGLPVPEFAVLH
                   ||||||||| ||||||||||||||||||||||||||||||||||||||||||||||||:
             g093  FNILHGTYGEDGAVQGALELLGIPYTGSGVAASAIGMDKYRCKLIWQALGLPVPEFAVLY
                        70         80         90        100        110        120

130        140        150        160        170        180
         m093.pep  DDTDFDAVEEKLGLPMFVKPAAEGSSVGVVKVKGKGRLKSVYEELKHLQXRNHCRTFYRR
                   |||||||||||||||||||||||||||||||| ||||||||||||||||| |||||||||
             g093  DDTDFDAVEEKLGLPMFVKPAAEGSSVGVVKVKEKGRLKSVYEELKHLQGRNHCRTFYRR
                       130        140        150        160        170        180

190        200        210        220        230        240
         m093.pep  RRIFLPRPERQRAARHTHHSRNRVLRLRSQVQPRRHHLSMSFGRFDRSRRKPDARTGGSR
                   |||||||||||||||||||| |||||||||||||||||||||||||||||||||||||||
             g093  RRIFLPRPERQRAARHTHHPRNRVLRLRSQVQPRRHHLSMSFGRFDRSRRKPDARTGGSR
                       190        200        210        220        230        240
```

-continued

```
                    250        260        270
m093.pep    RAGNRCGRLRARRFPQRYRRQTLSVGNQHPARYDEPX
            |:||||||||||||||||||||||||||||||||:||
g093        RTGNRCGRLRARRFPQRYRRQTLSVGNQHPARYDRPX
                    250        260        270
```

The following partial DNA sequence was identified in *N. meningitidis* <SEQ ID 319>:

```
a093.seq
    1 ATGCAGAATT TTGGCAAAGT GGCCGTATTG ATGGGCGGTT TTTCCAGCGA

51 ACGAGAAATC TCGCTGGACA GCGGCACCGC CATTTTGAAT GCTTTAAAAA

101 GCAAAGGCAT AGACGCATAC GCCTTCGATC CCAAGGAAAC CCCATTGTCT

151 GAATTGAAGG CACAAGGTTT TCAGACGGCA TTCAACATCC TTCACGGTAC

201 TTACGGCGAA GACGGGGCTG TTCAGGGTGC ATTGGAACTG TTGGGCATTC

251 CCTATACCGG CAGCGGTGTC GCCGCATCCG CCATCGGCAT GGACAAATAC

301 CGCTGCAAAC TGATTTGGCA GGCATTGGGA TTGCCCGTTC CCGAGTTCGC

351 CGTCCTGCAC GACGACACTG ATTTCGATGC CGTCGAAGAA AAATTGGGCC

401 TGCCGATGTT TGTGAAACCG GCGGCCGAAG GCAGCAGCGT AGGCGTGGTA

451 AAAGTCAAAG GAAAAGGCCG TCTGAAAAGC GTTTACGAAG AATTGAAACA

501 CTTTCAGGG. CGAAATCATT GCCGAACGGT TTATCGGCGG CGGCGAATAT

551 TCCTGCCCTG TGTTGAACGG CAAAGGCCTG CCCGGCATAC ACATCATCCC

601 CGCGACCGAG TTTTATGACT ACGAAGCCAA GTACAACCGC AACGACACCA

651 TTTATCAATG TCCTTCGGAA GATCTGACCG AAGCCGAAGA AAGCCTGATG

701 CGCGAACTGG CGGTTCGCGG CGCGCAGGCA ATCGGTGCGG AAGGCTGCGT

751 GCGCGTCGAT TTCCTCAAAG ATACCGACGG CAAACTCTAT CTGTTGGAAA

801 TCAACACCCT GCCCGGTATG ACCGGCCATA G
```

This corresponds to the amino acid sequence <SEQ ID 320; ORF 093.a>:

```
a093.pep
    1 MQNFGKVAVL MGGFSSEREI SLDSGTAILN ALKSKGIDAY AFDPKETPLS

51 ELKAQGFQTA FNILHGTYGE DGAVQGALEL LGIPYTGSGV AASAIGMDKY

101 RCKLIWQALG LPVPEFAVLH DDTDFDAVEE KLGLPMFVKP AAEGSSVGVV

151 KVKGKGRLKS VYEELKHFQX RNHCRTVYRR RRIFLPCVER QRPARHTHHP

201 RDRVL*LRSQ VQPQRHHLSM SFGRSDRSRR KPDARTGGSR RAGNRCGRLR

251 ARRFPQRYRR QTLSVGNQHP ARYDRP*
``` m093/a093 95.7% identity over a 276 aa overlap

```
                  10         20         30         40         50         60
m093.pep    MQNFGKVAVLMGGFSSEREISLDSGTAILNALKSKGIDAYAFDPKETPLSELKAQGFQTA
            ||||||||||||||||||||||||||||||||||||||||||||||||||||||||||||
a093        MQNFGKVAVLMGGFSSEREISLDSGTAILNALKSKGIDAYAFDPKETPLSELKAQGFQTA
                  10         20         30         40         50         60
```

```
                   70         80         90        100        110        120
m093.pep   FNILHGTYGXDGAVQGALELLGIPYTGSGVAASAIGMDKYRCKLIWQALGLPVPEFAVLH
           |||||||||| ||||||||||||||||||||||||||||||||||||||||||||||||
a093       FNILHGTYGEDGAVQGALELLGIPYTGSGVAASAIGMDKYRCKLIWQALGLPVPEFAVLH
                   70         80         90        100        110        120

130        140        150        160        170        180
m093.pep   DDTDFDAVEEKLGLPMFVKPAAEGSSVGVVKVKGKGRLKSVYEELKHLQXRNHCRTFYRR
           |||||||||||||||||||||||||||||||||||||||||||||||:||||||||| |||
a093       DDTDFDAVEEKLGLPMFVKPAAEGSSVGVVKVKGKGRLKSVYEELKHFQXRNHCRTVYRR
                  130        140        150        160        170        180

190        200        210        220        230        240
m093.pep   RRIFLPRPERQRAARHTHHSRNRVLRLRSQVQPRRHHLSMSFGRFDRSRRKPDARTGGSR
           |||||| |||| |||||| :||| ||||||||:|||||||||| ||||||||||||||||
a093       RRIFLPCVERQRPARHTHHPRDRVLXLRSQVQPQRHHLSMSFGRSDRSRRKPDARTGGSR
                  190        200        210        220        230        240

250        260        270
m093.pep   RAGNRCGRLRARRFPQRYRRQTLSVGNQHPARYDEPX
           |||||||||||||||||||||||||||||||||:||
a093       RAGNRCGRLRARRFPQRYRRQTLSVGNQHPARYDRPX
                  250        260        270
```

The following partial DNA sequence was identified in *N. gonorrhoeae* <SEQ ID 321>:

```
g094.seq
     1  ATGTATTCGC CTTTGCCCAA GCGGGCGTTG GTGCCTGCGG CGTTGAGTTT

51  GCCGCCGATA ACGAAAGTGG GGTCGAGTCC TGCCGCGCCG AGGATGGAGG

101  CGGTCAGGCT GGTGGTCGTG GTTTTGCCGT GCGTAccggc aatggcgatg 151  cCGTCACGGA AGCGCATCAG CTCTGCCAGC ATCAAGGCGC GCGGAATAAC 201  GGGAATTTGC CGCTCCAACG CAgcgacaAC TTCGGgattT TCTTTCTTGA 251  CGGCGGTAGA GGCAACGACG ACATccgcAC CGTTAACGTG TTCTGCGGTA

301  TGGCCGGGAT AA
```

This corresponds to the amino acid sequence <SEQ ID 322; ORF 094.ng>:

```
g094.pep
     1  MYSPLPKRAL VPAALSLPPI TKVGSSPAAP RMEAVRLVVV VLPCVPAMAM

51  PSRKRISSAS IKARGITGIC RSNAATTSGF SFLTAVEATT TSAPLTCSAV

101  WPG*
```

The following partial DNA sequence was identified in *N. meningitidis* <SEQ ID 323>:

```
m094.seq
     1  ATGTATTCGC CTTTGCCCAA GCGGGCGTTA GTGCCTGCGG CGTTGAGTTT

51  GCCGCCGATA ACGAAAGTCG GGTCAAGTCC TGCCGCGCCG AGGATGGAGG

101  CGGTCAGGCT GGTGGTCGTG GTTTTGCCGT GCGTGCCGGC AATGGCGATG

151  CCGTCACGGA AGCGCATCAA CTCCGCCAAC ATCAGGGCGC GCGGAATAAC

201  GGGAATTTGC TGCTCCAACG CAGCGACAAC TTCGGGATTT TCTTTTTTGA

251  CGGCGGTAGA GGTAACGACG ACATCCGCAC CGTTAACGTG TTCGGCGGTA

301  TGGCCGGGAT AA
```

This corresponds to the amino acid sequence <SEQ ID 324; ORF 094>:

```
m094.pep
    1  MYSPLPKRAL VPAALSLPPI TKVGSSPAAP RMEAVRLVVV VLPCVPAMAM

51  PSRKRINSAN IRARGITGIC CSNAATTSGF SFLTAVEVTT TSAPLTCSAV

101  WPG*
```

Computer analysis of this amino acid sequence gave the following results:
Homology with a Predicted ORF from *N. gonorrhoeae*
ORF 094 shows 95.1% identity over a 103 aa overlap with a predicted ORF (ORF 094.ng) from *N. gonorrhoeae*:

```
m094/g094

10         20         30         40         50         60
    m094.pep  MYSPLPKRALVPAALSLPPITKVGSSPAAPRMEAVRLVVVVLPCVPAMAMPSRKRINSAN
              ||||||||||||||||||||||||||||||||||||||||||||||||||||||||:||:
    g094      MYSPLPKRALVPAALSLPPITKVGSSPAAPRMEAVRLVVVVLPCVPAMAMPSRKRISSAS
                    10         20         30         40         50         60

70         80         90        100
    m094.pep  IRARGITGICCSNAATTSGFSFLTAVEVTTTSAPLTCSAVWPGX
              |:||||||||  |||||||||||||||:|||||||||||||||
    g094      IKARGITGICRSNAATTSGFSFLTAVEATTTSAPLTCSAVWPGX
                    70         80         90        100
```

The following partial DNA sequence was identified in *N. meningitidis* <SEQ ID 325>:

```
a094.seq
    1  ATGTATTCGC CTTTGCCCAA GCGGGCGTTG GTGCCTGCGG CGTTGAGTTT

51  GCCGCCGATA ACGAAAGTCG GGTCAAGTCC TGCCGCGCCG AGGATGGAGG

101  CGGTCAGGCT GGTGGTCGTG GTTTTGCCGT GCGTGCCGGC AATGGCGATG

151  CCGTCACGGA AGCGCATCAA CTCCGCCAAC ATCAGGGCGC GCGGAATAAC

201  GGGAATTTGC TGCTCCAACG CAGCGACAAC TTCGGGATTT TCTTTTTTGA

251  CGGCGGTAGA GGTAACGACG ACATCCGCAC CGTTAACGTG TTCTGCGGTA

301  TGGCCGGGAT AA
```

This corresponds to the amino acid sequence <SEQ ID 326; ORF 094.a>:

```
a094.pep
    1  MYSPLPKRAL VPAALSLPPI TKVGSSPAAP RMEAVRLVVV VLPCVPAMAM

51  PSRKRINSAN IRARGITGIC CSNAATTSGF SFLTAVEVTT TSAPLTCSAV

101  WPG*
``` m094/a094 100.0% identity over a 103 aa overlap

```
                    10         20         30         40         50         60
    m094.pep  MYSPLPKRALVPAALSLPPITKVGSSPAAPRMEAVRLVVVVLPCVPAMAMPSRKRINSAN
              ||||||||||||||||||||||||||||||||||||||||||||||||||||||||||||
    a094      MYSPLPKRALVPAALSLPPITKVGSSPAAPRMEAVRLVVVVLPCVPAMAMPSRKRINSAN
                    10         20         30         40         50         60

70         80         90        100
    m094.pep  IRARGITGICCSNAATTSGFSFLTAVEVTTTSAPLTCSAVWPGX
              |||||||||||||||||||||||||||||||||||||||||||
    a094      IRARGITGICCSNAATTSGFSFLTAVEVTTTSAPLTCSAVWPGX
                    70         80         90        100
```

The following partial DNA sequence was identified in *N. gonorrhoeae* <SEQ ID 327>:

```
g095.seq
    1 ATGTCCTTTC ATTTGAACAT GGACGGTGAA TTTCATTTGC GCGCCGACGT

51 TTTCGATGTC GGTGGCGTAG ATGTCGGCGG TATCGTCCAA ACCGTAAGTA

101 GCATAAGGTT TGCTCACTTT GGGCAAAATC GCGCGGACGT GTTCGCTGTC

151 AACACACAAA AAGGCTTTGC CGTAGAAGGG CATACGGTGG ATGAAATCGA

201 TAAACGCCTG ATGCAGTTTT TCGACGCTGT GCCCGTAGGT ATCCATATGG

251 TCTTCGTCGA TATTGGTAAC GACGGACATA ATCGGGGTCA GTGTAGGAAA

301 GAGGCATCGG ATCGTCGGCT TCGGCAACGA TGTATTCGCC TTTGCCCAAG

351 CGGGCGTTGG TGCCTGCGGC GTTGA
```

This corresponds to the amino acid sequence <SEQ ID 328; ORF 095.ng>:

```
g095.pep
    1 MSFHLNMDGE FHLRADVFDV GGVDVGGIVQ TVSSIRFAHF GQNRADVFAV

51 NTQKGFAVEG HTVDEIDKRL MQFFDAVPVG IHMVFVDIGN DGHNRGQCRK

101 EASDRRLRQR CIRLCPSGRW CLRR*
```

The following partial DNA sequence was identified in *N. meningitidis* <SEQ ID 329>:

```
m095.seq
    1 ATGTCCTTTC ATTTGAACAT GGACGGTGAA TTTCATTTGC GCGCCGACGT

51 TTTCGATGTC GGTGGCGTAG ATGTCGGCGG TATCGTCCAA ACCGTAAGTA

101 GCATAAGGTT TGCTCACTTT GGGCAAAATC GCGCGGACGT GTTCGCTGTC

151 AATACACAAA AAGGCTTTGC CGTAGAAGGG CATACGGTGG ATGAAATCGA

201 TAAACGCCTG ATGCAGTTTT TCGACGCTGT GCCCGTAGGT ATCCATATGG

251 TCTTCGTCGA TATTGGTAAC GACGGACATA ATCGGTGTCA GTGCAGAAAG

301 GATGCATCCG ACCGTCGGCT TCGGCAACGA TGTATTCGCC TTTGCCCAAG

351 CGGGCGTTAG TGCCTGCGGC GTTGA
```

This corresponds to the amino acid sequence <SEQ ID 330; ORF 095>:

```
m095.pep
    1 MSFHLNMDGE FHLRADVFDV GGVDVGGIVQ TVSSIRFAHF GQNRADVFAV

51 NTQKGFAVEG HTVDEIDKRL MQFFDAVPVG IHMVFVDIGN DGHNRCQCRK

101 DASDRRLRQR CIRLCPSGRX CLRR*
```

Computer analysis of this amino acid sequence gave the following results:
Homology with a Predicted ORF from *N. gonorrhoeae*
ORF 095 shows 97.6% identity over a 124 aa overlap with a predicted ORF (ORF 095.ng) from *N. gonorrhoeae*:

```
m095/g095

10         20         30         40         50         60
   m095.pep    MSFHLNMDGEFHLRADVFDVGGVDVGGIVQTVSSIRFAHFGQNRADVFAVNTQKGFAVEG
               ||||||||||||||||||||||||||||||||||||||||||||||||||||||||||||
   g095        MSFHLNMDGEFHLRADVFDVGGVDVGGIVQTVSSIRFAHFGQNRADVFAVNTQKGFAVEG
                   10         20         30         40         50         60
                   70         80         90        100        110        120
   m095.pep    HTVDEIDKRLMQFFDAVPVGIHMVFVDIGNDGHNRCQCRKDASDRRLRQRCIRLCPSGRX
               ||||||||||||||||||||||||||||||||||||| |||:||||||||||||||||||
   g095        HTVDEIDKRLMQFFDAVPVGIHMVFVDIGNDGHNRGQCRKEASDRRLRQRCIRLCPSGRW
                   70         80         90        100        110        120
   m095.pep    CLRRX
               |||||
   g095        CLRRX
```

The following partial DNA sequence was identified in *N. meningitidis* <SEQ ID 331>:

```
a095.seq
   1  ATGTCCTTTC ATTTGAACAT GGACGGTGAA TTTCATTTGC GCGCCGACGT

51  TTTCGATGTC GGTGGCGTAG ATGTCGGCGG TATCGTCCAA ACCGTAAGTA

101  GCATAAGGTT TGCTCACTTT GGGCAAAATC GCGCGGACGT GTTCGCTGTC

151  AATACACAAA AAGGCTTTGC CGTAGAAGGG CATACGGTGG ATGAAATCGA

201  TAAACGCCTG ATGCAGCTTC TCAACACTGT GCCCGTAGGT ATCCATATGG

251  TCTTCGTCGA TATTGGTAAC GACGGACATA ATCGGTGTCA GTGCAGAAAG

301  GATGCATCCG ACCGTCGGCT TCGGCAACGA TGTATTCGCC TTTGCCCAAG

351  CGGGCGTTGG TGCCTGCGGC GTTGA
```

This corresponds to the amino acid sequence <SEQ ID 332; ORF 095.a>:

```
a095.pep

1   MSFHLNMDGE FHLRADVFDV GGVDVGGIVQ TVSSIRFAHF GQNRADVFAV

51   NTQKGFAVEG HTVDEIDKRL MQLLNTVPVG IHMVFVDIGN DGHNRCQCRK

101   DASDRRLRQR CIRLCPSGRW CLRR* m095/a095    96.0% identity in 124 aa overlap 10         20         30         40         50         60
   m095.pep    MSFHLNMDGEFHLRADVFDVGGVDVGGIVQTVSSIRFAHFGQNRADVFAVNTQKGFAVEG
               ||||||||||||||||||||||||||||||||||||||||||||||||||||||||||||
   a095        MSFHLNMDGEFHLRADVFDVGGVDVGGIVQTVSSIRFAHFGQNRADVFAVNTQKGFAVEG
                   10         20         30         40         50         60

70         80         90        100        110        120
   m095.pep    HTVDEIDKRLMQFFDAVPVGIHMVFVDIGNDGHNRCQCRKDASDRRLRQRCIRLCPSGRX
               |||||||||||::::|||||||||||||||||||||||||||||||||||||||||||||
   a095        HTVDEIDKRLMQLLNTVPVGIHMVFVDIGNDGHNRCQCRKDASDRRLRQRCIRLCPSGRW
                   70         80         90        100        110        120 m095.pep    CLRRX
               |||||
   a095        CLRRX
```

The following partial DNA sequence was identified in *N. gonorrhoeae* <SEQ ID 333>:

```
g096.seq
    1 ATGGCCGGTC ATACCGGGCA GGGTGTTGAT TTCCAACAGA TAGAGTTTGC

51 CGTCGGTATC TTTGAGGAAA TCGACGCGCA CGCAGCCTTC CGCACCGATT

101 GCCTGTGCGC CGCGAACCGC CAGTTCGCGC ATCAGGCTTT CTTCGGCTTC

151 GGTCAAATCT TCCGAAGGAC ATTGAtaaat ggtgTCGTCT CGGttgtaCt 201 tggcttcgta gTCGTAAAAC TCGGTTGCGG GGATGATGTG TATGCCGGGC

251 AGCCCTTTGC CGTTCAGGAC GGGGCAGGAA TATTCGCCGC CGCCGATAAA

301 AcgtTcggca atgaTTtcgc ccctgAAGGT GttTCAattc ttcgtaAACG

351 CTTTTCAGAc ggcctTTTC TTTGA
```

This corresponds to the amino acid sequence <SEQ ID 334; ORF 096.ng>:

```
g096.pep
    1 MAGHTGQGVD FQQIEFAVGI FEEIDAHAAF RTDCLCAANR QFAHQAFFGF

51 GQIFRRTLIN GVVSVVLGFV VVKLGCGDDV YAGQPFAVQD GAGIFAAADK

101 TFGNDFAPEG VSILRKRFSD GLFL*
```

The following partial DNA sequence was identified in *N. meningitidis* <SEQ ID 335>:

```
m096.seq
    1 ATGGCTCGTC ATACCGGGCA GGGTGTTGAT TTCCAACAGA TAGAGTTTGC

51 CGTCGGTATC TTTGAGGAAA TCGACGCGCA CGCAGCCTTC CGCACCGATT

101 GCCTGCGCGC CGCGAACCGC CAGTTCGCGC ATCAGGCTTT CTTCGGCTTC

151 GGTCAAATCT TCCGAAGGAC ATTGATAAAT GGTGTCGTCG CGGTTGTACT

201 TGGCTTCGTA GTCGTAAAAC TCGGTTGCGG GAATGATGTG TATGCCGGGC

251 AGCCCTTTGC CGTTCAGGAC GGGGCAGGAA TATTCGCCGC CGCCGATAAA

301 ACGTTCGGCA ATGATTTCGC CC.TGAAGGT GTTTCAATTC TTCGTAAACG

351 CTTTTCAGAC GGCCTTTTCC TTTGA
```

This corresponds to the amino acid sequence <SEQ ID 336; ORF 096>:

```
m096.pep
    1 MARHTGQGVD FQQIEFAVGI FEEIDAHAAF RTDCLRAANR QFAHQAFFGF

51 GQIFRRTLIN GVVAVVLGFV VVKLGCGNDV YAGQPFAVQD GAGIFAAADK

101 TFGNDFAXEG VSILRKRFSD GLFL*
```

```
m096/g096  96.0% identity in 124 aa overlap 10         20         30         40         50         60
m096.pep  MARHTGQGVDFQQIEFAVGIFEEIDAHAAFRTDCLRAANRQFAHQAFFGFGQIFRRTLIN
          || ||||||||||||||||||||||||||||||| ||||||||||||||||||||||||||
g096      MAGHTGQGVDFQQIEFAVGIFEEIDAHAAFRTDCLCAANRQFAHQAFFGFGQIFRRTLIN
                 10         20         30         40         50         60

70         80         90        100        110        120
m096.pep  GVVAVVLGFVVVKLGCGNDVYAGQPFAVQDGAGIFAAADKTFGNDFAXEGVSILRKRFSD
          |||:|||||||||||||:||||||||||||||||||||||||||||| |||||||||||
g096      GVVSVVLGFVVVKLGCGDDVYAGQPFAVQDGAGIFAAADKTFGNDFAPEGVSILRKRFSD
                 70         80         90        100        110        120
```

```
m096.pep    GLFLX
            |||||
g096        GLFLX
```

The following partial DNA sequence was identified in *N. meningitidis* <SEQ ID 337>:

```
a096.seq
    1  ATGGCCGGTC ATACCGGGCA GGGTGTTGAT TTCCAACAGA TAGAGTTTGC

51  CGTCGGTATC TTTGAGGAAA TCGACGCGCA CGCAGCCTTC CGCACCGATT

101  GCCTGCGCGC CGCGAACCGC CAGTTCGCGC ATCAGGCTTT CTTCGGCTTC

151  GGTCAGATCT TCCGAAGGAC ATTGATAAAT GGTGTCGTTG CGGTTGTACT

201  TGGCTTCGTA GTCATAAAAC TCGGTCGCGG GGATGATGTG TATGCCGGGC

251  AGGCCTTTGC CGTTCAACAC AGGGCAGGAA TATTCGCCGC CGCCGATAAA

301  CCGTTCGGCA ATGATTTCGC CCT.GAAAGT GTTTCAATTC TTCGTAAACG

351  CTTTTCAGAC GGCCTTTTCC TTTGA
```

This corresponds to the amino acid sequence <SEQ ID 338; ORF 096.ng>:

```
a096.pep
    1  MAGHTGQGVD FQQIEFAVGI FEEIDAHAAF RTDCLRAANR QFAHQAFFGF

51  GQIFRRTLIN GVVAVVLGFV VIKLGRGDDV YAGQAFAVQH RAGIFAAADK

101  PFGNDFAXES VSILRKRFSD GLFL* m096/a096    92.7% identity in 124 aa overlap 10         20         30         40         50         60
m096.pep     MARHTGQGVDFQQIEFAVGIFEEIDAHAAFRTDCLRAANRQFAHQAFFGFGQIFRRTLIN
             || ||||||||||||||||||||||||||||||||||||||||||||||||||||||||
a096         MAGHTGQGVDFQQIEFAVGIFEEIDAHAAFRTDCLRAANRQFAHQAFFGFGQIFRRTLIN
                     10         20         30         40         50         60

70         80         90        100        110        120
m096.pep     GVVAVVLGFVVVKLGCGNDVYAGQPFAVQDGAGIFAAADKTFGNDFAXEGVSILRKRFSD
             |||||||||||:||| |:|||||| |||| |||||||||| |||||||||:|||||||||
a096         GVVAVVLGFVVIKLGRGDDVYAGQAFAVQHRAGIFAAADKPFGNDFAXESVSILRKRFSD
                     70         80         90        100        110        120 m096.pep     GLFLX
             |||||
a096         GLFLX
```

The following partial DNA sequence was identified in *N. gonorrhoeae* <SEQ ID 339>:

```
g097.seq
    1  ATGGATATTT CAAAACAAAC ATTGCTGGAT AGGGTTTTTA ACCTGAAGGC

51  AAACGGTACG ACGGTACGTA CCGAGTTGAT GGCGGGTTTG ACGACCTTTT

101  TGACGATGTG CTACATCGTT ATCGTCAATC CCCTGATTTT GGGCGAGACC

151  GGAATGGATA TGGGGGCGGT ATTCGTCGCT ACCTGTATCG CATCCGCCAT

201  CGGCTGTTTT GTCATGGGTT TTATCGGCAA CTATCCGATT GCGCTTGCCC

251  CGGGGATGGG GCTGAATGCC TATTTCACCT TTGCCGTCGT TAAGGGTATG

301  GGCGTGCCTT GGCAGGTGGC GTTGGGTGCG GTGTTCATTT CCGGTCTGAT

351  TTTCATCCTG TTCAGCTTTT TTAAAGTCAG GGAAATGCTG GTCAACGCAC
```

-continued

```
 401  TGCCTATGGG TTTGAAAATG TCGATTGCCG CCGGTATCGG TTTGTTTTTG

451  GCACTGATTT CCCTGAAAGG CGCAGGCATT ATCGTTGCCA ATCCGGCAAC

501  CTTGGTCGGC TTGGGCGATA TTCATCAGCC CAGCGCACTG TTGGCATTGT

551  TCGGTTTTGT CATGGTGGTC GTATTGGGGT ATTTCCGCGT TCAAGGCGCA

601  ATCATCATCA CCATTCTGAC GATTACCGTC ATTGCCAGCC TGATGGGTTT

651  GAACGAGTTT CACGGCGTGG TCGGCGAAGT ACCGGGCATT GCGCCGACCT

701  TTATGCAGAT GGATTTTAAA GGTCTGTTTA CCGTCAGCAT GGTCAGCGTG

751  ATTTTCGTCT TCTTCTTGGT CGATTTGTTC GACAGTACCG GAACGCTGGT

801  CGGCGTATCC CACCGTGCCG GACTGCTGGT GGACGGTAAG CTGCCCCGCC

851  TGAAACGCGC ACTGCTTGCA GACTCTACCG CCATTGTGGC AGGTGCGGCT

901  TTGGGTACTT CTTCAACCAC GCCTTATGTG GAAAGCGCGG CGGGCGTATC

951  GGCAGGCGGA CGGACCGGCC TGACGGCGGT TACCGTCGGC GTATTGATGC

1001  TGGCGTGTCT GATGTTCTCC CCATTGGCGA AAAGTGTTCC GGTATTTGCC

1051  ACCGCGCCCG CACTGCTTTA TGTCGGCACG CAGATGCTCC GCAGTGCGAG

1101  GGACATTGAT TGGGACGATA TGACTGAAGC CGCGCCCGCG TTCCTGACCA

1151  TTGTCTTCAT GCCGTTTACC TATTCGATTG CAGACGGCAT CGCCTTCGGC

1201  TTCATCAGCT ATGCCGTGGT CAAACTTTTG TGTCGCCGGA CTGGGGACGT

1251  GCCGCCTATG GTATGGGTTG TTGCCGTATT GTGGGCATTG AAATTCTGGT

1301  ATTTGGGCTG A
```

This corresponds to the amino acid sequence <SEQ ID 340; ORF 097.ng>:

```
g097.pep
    1  MDISKQTLLD RVFNLKANGT TVRTELMAGL TTFLTMCYIV IVNPLILGET

51  GMDMGAVFVA TCIASAIGCF VMGFIGNYPI ALAPGMGLNA YFTFAVVKGM

101  GVPWQVALGA VFISGLIFIL FSFFKVREML VNALPMGLKM SIAAGIGLFL

151  ALISLKGAGI IVANPATLVG LGDIHQPSAL LALFGFVMVV VLGYFRVQGA

201  IIITILTITV IASLMGLNEF HGVVGEVPGI APTFMQMDFK GLFTVSMVSV

251  IFVFFLVDLF DSTGTLVGVS HRAGLLVDGK LPRLKRALLA DSTAIVAGAA

301  LGTSSTTPYV ESAAGVSAGG RTGLTAVTVG VLMLACLMFS PLAKSVPVFA

351  TAPALLYVGT QMLRSARDID WDDMTEAAPA FLTIVFMPFT YSIADGIAFG

401  FISYAVVKLL CRRTGDVPPM VWVVAVLWAL KFWYLG*
```

The following partial DNA sequence was identified in *N. meningitidis* <SEQ ID 341>:

```
m097.seq
    1  ATGGACACTT CAAAACAAAC ACTGTTGGAC GGGATTTTTA AGCTGAAGGC

51  AAACGGTACk ACGGTGCGTA CCGAGTTGAT GGCGGGTTTG ACAACTTTTT

101  TGACGATGTG CTACATCGTT ATCGTCAACC CTCyGATTTT GGGCGAGACC

151  GGCATGGATA TGGGGGCGGT ATTCGTCGCT ACCTGTATCG CGTCTGCCAT

201  CGGCTGTTTT GTTATGGGTT TTGTCGGCAA CTATCCGATT GCACTCGCAC

251  CGGGGATGGG GCTGAATGCC TATTTCACCT TTGCCGTCGT TAAGGGTATG
```

```
 301 GGCGTGCCTT GGCAGGTTGC GTTGGGTGCG GTGTTCATCT CCGGTCTGAT

351 TTTTATCCTG TTCAGCTTTT TTAAAGTCAG GGAAATGCTG GTCAACGCAC

401 TGCCTATGGG TTTGAAAATG TCGATTGCTG CCGGTATCGG TTTGTTTTTG

451 GCACTGATTT CCCTGAAAGG CGCAGGCATT ATCGTTGCCA ATCCGGCAAC

501 CTTGGTCGGT TTGGGCGATA TTCATCAGCC GTCCGCGTTG TTGGCATTGT

551 TCGGTTTTGC TATGGTGGTC GTATTGGGAC ATTTCCGCGT TCAAGGCGCA

601 ATCATCATCA CCATCTTGAC CATTACCGTC ATTGCCAGCC TGATGGGTTT

651 GAATGAATTT CACGGCATCA TCGGCGAAGT ACCGAGCATT GCGCCGACTT

701 TTATGCAGAT GGATTTTGAA GGCCTGTTTA CCGTCAGCAT GGTCAGTGTG

751 ATTTTCGTCT TCTTCTTGGT CGATCTATTT GACAGTACCG GAACGCTGGT

801 CGGCATATCC CACCGTGCCG GGCTGCTGGT GGACGGTAAG CTGCCCCGCC

851 TGAAACGCGC ACTGCTTGCA GACTCTACCG CCATTGTGGC AGGTGCGGCT

901 TTGGGTACTT CTTCCACCAC GCCTTATGTG GAAAGCGCGG CGGGCGTATC

951 GGCAGGCGGA CGGACCGGCC TGACGGCGGT TACCGTCGGC GTATTGATGC

1001 TCGCCTGCCT GATGTTTTCA CCTTTGGCGA AAAGTGTTCC CGCTTTTGCC

1051 ACCGCGCCCG CCCTGCTTTA TGTCGGCACG CAGATGCTCC GCAGTGCGAG

1101 GGATATTGAT TGGGACGATA TGACGGAAGC CGCACCTGCG TTCCTGACCA

1151 TTGTTTTCAT GCCGTTTACT TATTCGATTG CAGACGGCAT CGCTTTCGGC

1201 TTCATCAGTT ATGCCGTGGT TAAACTTTTA TGCCGCCGCA CCAAAGACGT

1251 TCCGCCTATG GTATGGATTG TTGCCGTATT GTGGGCACTG AAATTCTGGT

1301 ATTTGGGCTG A
```

This corresponds to the amino acid sequence <SEQ ID 342; ORF 097>:

```
m097.pep
   1 MDTSKQTLLD GIFKLKANGT TVRTELMAGL TTFLTMCYIV IVNPXILGET

51 GMDMGAVFVA TCIASAIGCF VMGFVGNYPI ALAPGMGLNA YFTFAVVKGM

101 GVPWQVALGA VFISGLIFIL FSFFKVREML VNALPMGLKM SIAAGIGLFL

151 ALISLKGAGI IVANPATLVG LGDIHQPSAL LALFGFAMVV VLGHFRVQGA

201 IIITILTITV IASLMGLNEF HGIIGEVPSI APTFMQMDFE GLFTVSMVSV

251 IFVFFLVDLF DSTGTLVGIS HRAGLLVDGK LPRLKRALLA DSTAIVAGAA

301 LGTSSTTPYV ESAAGVSAGG RTGLTAVTVG VLMLACLMFS PLAKSVPAFA

351 TAPALLYVGT QMLRSARDID WDDMTEAAPA FLTIVFMPFT YSIADGIAFG

401 FISYAVVKLL CRRTKDVPPM VWIVAVLWAL KFWYLG*
```

Computer analysis of this amino acid sequence gave the following results:
Homology with a Predicted ORF from *N. gonorrhoeae*
ORF 097 shows 96.3% identity over a 436 aa overlap with a predicted ORF (ORF 097.ng) from *N. gonorrhoeae*:

```
m097/g097

10        20        30        40        50        60
    m097.pep  MDTSKQTLLDGIFKLKANGTTVRTELMAGLTTFLTMCYIVIVNPXILGETGMDMGAVFVA
              || ||||||| :|:|||||||||||||||||||||||||| |||||||||||||||||
    g097      MDISKQTLLDRVFNLKANGTTVRTELMAGLTTFLTMCYIVIVNPLILGETGMDMGAVFVA
                      10        20        30        40        50        60

70        80        90       100       110       120
    m097.pep  TCIASAIGCFVMGFVGNYPIALAPGMGLNAYFTFAVVKGMGVPWQVALGAVFISGLIFIL
              ||||||||||||||:|||||||||||||||||||||||||||||||||||||||||||||
    g097      TCIASAIGCFVMGFIGNYPIALAPGMGLNAYFTFAVVKGMGVPWQVALGAVFISGLIFIL
                      70        80        90       100       110       120

130       140       150       160       170       180
    m097.pep  FSFFKVREMLVNALPMGLKMSIAAGIGLFLALISLKGAGIIVANPATLVGLGDIHQPSAL
              ||||||||||||||||||||||||||||||||||||||||||||||||||||||||||||
    g097      FSFFKVREMLVNALPMGLKMSIAAGIGLFLALISLKGAGIIVANPATLVGLGDIHQPSAL
                     130       140       150       160       170       180

190       200       210       220       230       240
    m097.pep  LALFGFAMVVLGHFRVQGAIIITLTITVIASLMGLNEFHGIIGEVPSIAPTFMQMDFE
              ||||||:||||||:||||||||||||||||||||||||||||::||||:|||||||||:
    g097      LALFGFVMVVVLGYFRVQGAIIITLTITVIASLMGLNEFHGVVGEVPGIAPTFMQMDFK
                     190       200       210       220       230       240

250       260       270       280       290       300
    m097.pep  GLFTVSMVSVIFVFFLVDLFDSTGTLVGISHRAGLLVDGKLPRLKRALLADSTAIVAGAA
              ||||||||||||||||||||||||||||||:|||||||||||||||||||||||||||||
    g097      GLFTVSMVSVIFVFFLVDLFDSTGTLVGVSHRAGLLVDGKLPRLKRALLADSTAIVAGAA
                     250       260       270       280       290       300

310       320       330       340       350       360
    m097.pep  LGTSSTTPYVESAAGVSAGGRTGLTAVTVGVLMLACLMFSPLAKSVPAFATAPALLYVGT
              ||||||||||||||||||||||||||||||||||||||||||||||||:|||||||||||
    g097      LGTSSTTPYVESAAGVSAGGRTGLTAVTVGVLMLACLMFSPLAKSVPVFATAPALLYVGT
                     310       320       330       340       350       360

370       380       390       400       410       420
    m097.pep  QMLRSARDIDWDDMTEAAPAFLTIVFMPFTYSIADGIAFGFISYAVVKLLCRRTKDVPPM
              ||||||||||||||||||||||||||||||||||||||||||||||||||||||| ||||
    g097      QMLRSARDIDWDDMTEAAPAFLTIVFMPFTYSIADGIAFGFISYAVVKLLCRRTGDVPPM
                     370       380       390       400       410       420

430
    m097.pep  VWIVAVLWALKFWYLGX
              ||:||||||||||||||
    g097      VWVVAVLWALKFWYLGX
                     430
```

The following partial DNA sequence was identified in *N. meningitidis* <SEQ ID 343>

```
a097.seq
    1 ATGGACACTT CAAAACAAAC ACTGTTGGAC GGGATTTTTA AGCTGAAGGC

51 AAACGGTACG ACGGTGCGTA CCGAGTTGAT GGCGGGTTTG ACAACTTTTT

101 TGACGATGTG CTACATCGTT ATCGTCAACC CTCTGATTTT GGGCGAGACC

151 GGCATGGATA TGGGGGCGGT ATTCGTCGCT ACCTGTATCG CGTCTGCCAT

201 CGGCTGTTTT GTTATGGGTT TTGTCGGCAA CTATCCGATT GCACTCGCAC

251 CGGGGATGGG GCTGAATGCC TATTTCACCT TTGCCGTCGT TAAGGGTATG

301 GGCGTGCCTT GGCAGGTTGC GTTGGGTGCG GTGTTCATCT CCGGTCTGAT

351 TTTCATCCTG TTCAGCTTTT TTAAAGTCAG GGAAATGCTG GTCAACGCAC

401 TGCCTATGGG TTTGAAAATG TCGATTGCTG CCGGTATCGG TTTGTTTTTG
```

-continued

```
 451 GCACTGATTT CCCTGAAAGG CGCAGGCATT ATCGTTGCCA ATCCGGCAAC

501 CTTGGTCGGC TTGGGCGATA TTCATCAGCC GTCCGCGTTG TTGGCACTGT

551 TCGGTTTTGC CATGGTGGTC GTATTGGGAC ATTTCCGCGT TCAAGGCGCA

601 ATCATCATCA CCATTTTGAC GATTACCGTC ATTGCCAGCC TGATGGGTTT

651 GAACGAATTT CACGGCATCA TCGGCGAAGT GCCGAGCATT GCGCCGACTT

701 TTATGCAGAT GGATTTTAAA GGGTTGTTTA CCGTCAGCAT GGTCAGCGTG

751 ATTTTCGTCT TTTTCCTAGT CGATCTGTTC GACAGTACCG GAACACTGGT

801 CGGTGTATCG CATCGTGCCG GACTGCTGGT GGACGGTAAG CTGCCCCGCC

851 TGAAACGCGC ACTGCTTGCA GACTCTACCG CTATTGTGGC AGGTGCGGCT

901 TTGGGTACTT CTTCAACCAC GCCTTATGTG GAAAGTGCGG CGGGCGTATC

951 GGCAGGCGGG CGGACAGGTC TGACGGCGGT TACCGTCGGC GTATTGATGC

1001 TCGCCTGCCT GATGTTTTCA CCTTTGGCGA AAAGTGTTCC CGCTTTTGCC

1051 ACCGCGCCCG CCCTGCTTTA TGTCGGCACG CAGATGCTCC GCAGTGCGAG

1101 GGACATCGAT TGGGACGATA TGACGGAAGC CGCACCCGCA TTCCTGACCA

1151 TTGTCTTCAT GCCGTTTACC TATTCGATTG CAGACGGCAT CGCTTTCGGC

1201 TTCATCAGTT ATGCCGTGGT TAAACTTTTA TGCCGCCGCA CCAAAGACGT

1251 TCCGCCTATG GTATGGATTG TTGCCGTATT GTGGGCACTG AAATTCTGGT

1301 ATTTGGGCTG A
```

This corresponds to the amino acid sequence <SEQ ID 344; ORF 097.a>:

```
a097.pep

1  MDTSKQTLLD GIFKLKANGT TVRTELMAGL TTFLTMCYIV IVNPLILGET

51  GMDMGAVFVA TCIASAIGCF VMGFVGNYPI ALAPGMGLNA YFTFAVVKGM

101  GVPWQVALGA VFISGLIFIL FSFFKVREML VNALPMGLKM SIAAGIGLFL

151  ALISLKGAGI IVANPATLVG LFGIHQPSAL LALFGFAMVV VLGHFRVQGA

201  IIITILTITV IASLMGLNEF HGIIGEVPSI APTFMQMDFK GLFTVSMVSV

251  IFVFFLVDLF DSTGTLVGVS HRAGLLVDGK LPRLKRALLA DSTAIVAGAA

301  LGTSSTTPYV ESAAGVSAGG RTGLTAVTVG VLMLACLMFS PLAKSVPAFA

351  TAPALLYVGT QMLRSARDID WDDMTEAAPA FLTIVFMPFT YSIADGIAFG

401  FISYAVVKLL CRRTKDVPPM VWIVAVLWAL KFWYLG* m097/a097   99.3% identity in 436 aa overlap 10         20         30         40         50         60
   m097.pep  MDTSKQTLLDGIFKLKANGTTVRTELMAGLTTFLTMCYIVIVNPXILGETGMDMGAVFVA
             |||||||||||||||||||||||||||||||||||||||||||| ||||||||||||||
       a097  MDTSKQTLLDGIFKLKANGTTVRTELMAGLTTFLTMCYIVIVNPLILGETGMDMGAVFVA
                    10         20         30         40         50         60

70         80         90        100        110        120
   m097.pep  TCIASAIGCFVMGFVGNYPIALAPGMGLNAYFTFAVVKGMGVPWQVALGAVFISGLIFIL
             ||||||||||||||||||||||||||||||||||||||||||||||||||||||||||||
       a097  TCIASAIGCFVMGFVGNYPIALAPGMGLNAYFTFAVVKGMGVPWQVALGAVFISGLIFIL
                    70         80         90        100        110        120

130        140        150        160        170        180
   m097.pep  FSFFKVREMLVNALPMGLKMSIAAGIGLFLALISLKGAGIIVANPATLVGLGDIHQPSAL
             ||||||||||||||||||||||||||||||||||||||||||||||||||||||||||||
       a097  FSFFKVREMLVNALPMGLKMSIAAGIGLFLALISLKGAGIIVANPATLVGLGDIHQPSAL
                   130        140        150        160        170        180
```

```
              190       200       210       220       230       240
m097.pep    LALFGFAMVVVLGHFRVQGAIIITILTITVIASLMGLNEFHGIIGEVPSIAPTFMQMDFE
            ||||||||||||||||||||||||||||||||||||||||||||||||||||||||||:
a097        LALFGFAMVVVLGHFRVQGAIIITILTITVIASLMGLNEFHGIIGEVPSIAPTFMQMDFK
              190       200       210       220       230       240

250       260       270       280       290       300
m097.pep    GLFTVSMVSVIFVFFLVDLFDSTGTLVGISHRAGLLVDGKLPRLKRALLADSTAIVAGAA
            ||||||||||||||||||||||||||||||:|||||||||||||||||||||||||||||
a097        GLFTVSMVSVIFVFFLVDLFDSTGTLVGVSHRAGLLVDGKLPRLKRALLADSTAIVAGAA
              250       260       270       280       290       300

310       320       330       340       350       360
m097.pep    LGTSSTTPYVESAAGVSAGGRTGLTAVTVGVLMLACLMFSPLAKSVPAFATAPALLYVGT
            ||||||||||||||||||||||||||||||||||||||||||||||||||||||||||||
a097        LGTSSTTPYVESAAGVSAGGRTGLTAVTVGVLMLACLMFSPLAKSVPAFATAPALLYVGT
              310       320       330       340       350       360

370       380       390       400       410       420
m097.pep    QMLRSARDIDWDDMTEAAPAFLTIVFMPFTYSIADGIAFGFISYAVVKLLCRRTKDVPPM
            |||||||||||||||||||||||||||||||||||||||||||||||||||||| |||||
a097        QMLRSARDIDWDDMTEAAPAFLTIVFMPFTYSIADGIAFGFISYAVVKLLCRRT GDVPPM
              370       380       390       400       410       420

430
m097.pep    VWIVAVLWALKFWYLGX
            |||||||||||||||||
a097        VWIVAVLWALKFWYLGX
              430
```

The following partial DNA sequence was identified in *N. gonorrhoeae* <SEQ ID 345>:

```
g098.seq
    1  ATGACCGCCG ACGGTCTCTT CGTCGCTTTC AACTTCAATA CGTTTGCCGT

51  TGTGCGAATA TTGATACCAG TACAGCAGGA TGCTGCCCAG GCTGGCGATC

101  AGTTTGTCGG CGATGTCGCG CGCTTCGCTG TCGGGATGGC TTTCGCGTTC

151  GGGATGAACG CAGCCGAGCA TGGACACGCC GGTACGCATC ACGTCCATCG

201  GATGGGTATG TGCAGGCAGG CTTTCCAAAA CTTTAATCAC ACGGATAGGC

251  AGGCCGCGCA TGGATTTGAG CTTGGTTTTA TAAGCGGCCA GCTCGAATTT

301  GTTGGGCAGA TGGCCGTGAA TCAGCAAGTG TGCGACTTCT TCAAACTCGC

351  ATTTTTGTGC CAAATTAGAA TGTCGTAA
```

This corresponds to the amino acid sequence <SEQ ID 346; ORF 098.ng>:

```
g098.pep
    1  MTADGLFVAF NFNTFAVVRI LIPVQQDAAQ AGDQFVGDVA RFAVGMAFAF

51  GMNAAEHGHA GTHHVHRMGM CRQAFQNFNH TDRQAAHGFE LGFISGQLEF

101  VGQMAVNQQV CDFFKLAFLC QIRMS*
```

The following partial DNA sequence was identified in *N. meningitidis* <SEQ ID 347>:

```
m098.seq
    1  ATGACCGCCG ATGGTCTCTT CGTCGCTTTC AACCTCAATG CGTTTGCCGT

51  TGTGCGAATA TTGATACCAG TACAAGAGGA TGCTGCCGAG GCTGGCGATC

101  AGTTTGTCGG CGATGTCGCG CGCTTCACTT TCCGGATGGC TTTCACGTTC

151  AGGATGAACG CAGCCCAGCA TGGATACGCC GGTACGCATT ACGTCCATCG

201  GATGGGTATG TGCAGGCAGG CTTTCCAAAA CTTTAATCAC ACGGATAGGC
```

-continued

```
251  AGGCCGCGCA TGGATTTGAG CTTGGTTTTA TAAGCGGCCA GCTCGAATTT

301  GTTGGGCAGA TGGCCGTGAA TCAGCAGGTG GGCGACTTCT TCAAACTCGC

351  ATTTTTGTGC CAAATCAGAA TGTCGTAA
```

This corresponds to the amino acid sequence <SEQ ID 348; ORF 098>:

```
m098.pep.
  1  MTADGLFVAF NLNAFAVVRI LIPVCEDAAE AGDQFVGDVA RFTFRMAFTF

51  RMNAAQHGYA GTHYVHRMGM CRQAFQNFNH TDRQAAHGFE LGFISGQLEF

101  VGQMAVNQQV GDFFKLAFLC QIRMS*
```

Computer analysis of this amino acid sequence gave the following results:

Homology with a Predicted ORF from *N. gonorrhoeae*
ORF 098 shows 89.6% identity over a 125 aa overlap with a predicted ORF (ORF 098.ng) from *N. gonorrhoeae*:

```
m098/g098
                   10         20         30         40         50         60
    m098.pep   MTADGLFVAFNLNAFAVVRILIPVQEDAAEAGDQFVGDVARFTFRMAFTFRMNAAQHGYA
               ||||||||||:|:||||||||||:|||:|||||||||||||:  |||:|||||:||:|
    g098       MTADGLFVAFNFNTFAVVRILIPVQQDAAQAGDQFVGDVARFAVGMAFAFGMNAAEHGHA
                   10         20         30         40         50         60

70         80         90        100        110        120
    m098.pep   GTHYVHRMGMCRQAFQNFNHTDRQAAHGFELGFISGQLEFVGQMAVNQQVGDFFKLAFLC
               |||:||||||||||||||||||||||||||||||||||||||||||||||| ||||||||
    g098       GTHHVHRMGMCRQAFQNFNHTDRQAAHGFELGFISGQLEFVGQMAVNQQVCDFFKLAFLC
                   70         80         90        100        110        120 m098.pep   QIRMSX
               ||||||
    g098       QIRMSX
```

The following partial DNA sequence was identified in *N. meningitidis* <SEQ ID 349>:

```
a098.seq
  1  ATGACCGCCG ATGGTCTCTT CGTCGCTTTC AACCTCAATG CGTTTGCCGT

51  TGTGCGAATA TTGATACCAG TACAAGAGGA TGCTGCCGAG GCTGGCGATC

101  AGTTTGTCGG CGATGTCGCG CGCTTCACTT TCCGGATGGC TTTCACGTTC

151  AGGATGAACG CAGCCCAGCA TGGATACGCC GGTACGCATT ACGTCCATCG

201  GATGGGTATG TGCAGGCAGG CTTTCCAAAA CTTTAATCAC ACGGATAGGC

251  AGGCCGCGCA TGGATTTGAG CTTGGTTTTA TAAGCGGCCA GCTCGAATTT

301  GTTGGGCAGA TGGCCGTGAA TCAGCAGGTG GGCGACTTCT TCAAACTCGC

351  ATTTTTGTGC CAAATCAGAA TGTCGTAA
```

This corresponds to the amino acid sequence <SEQ ID 350; ORF 098.a>:

```
a098.pep
            1   MTADGLFVAF NLNAFAVVRI LIPVQEDAAE AGDQFVGDVA RFTFRMAFTF
           51   RMNAAQHGYA GTHYVHRMGM CRQAFQNFNH TDRQAAHGFE LGFISGQLEF
          101   VGQMAVNQQV GDFFKLAFLC QIRMS* m098/a098   100.0% identity in 125 aa overlap
                      10         20         30         40         50         60
  m098.pep    MTADGLFVAFNLNAFAVVRILIPVQEDAAEAGDQFVGDVARFTFRMAFTFRMNAAQHGYA
               ||||||||||||||||||||||||||||||||||||||||||||||||||||||||||||
  a098        MTADGLFVAFNLNAFAVVRILIPVQEDAAEAGDQFVGDVARFTFRMAFTFRMNAAQHGYA
                      10         20         30         40         50         60
                      70         80         90        100        110        120
  m098.pep    GTHYVHRMGMCRQAFQNFNHTDRQAAHGFELGFISGQLEFVGQMAVNQQVGDFFKLAFLC
               ||||||||||||||||||||||||||||||||||||||||||||||||||||||||||||
  a098        GTHYVHRMGMCRQAFQNFNHTDRQAAHGFELGFISGQLEFVGQMAVNQQVGDFFKLAFLC
                      70         80         90        100        110        120 m098.pep    QIRMSX
               ||||||
  a098        QIRMSX
```

The following partial DNA sequence was identified in *N. gonorrhoeae* <SEQ ID 351>:

```
g099.seq
    1 ATGCTGGGAC GCGCGTCCAT GATGCGCCTG CCCGATATTG TCGGCGTGGA
   51 GCTGACGGGC AAACGGCAGG CGGGCATTAC TGCCACAGAC ATCGTGTTGG
  101 CACTGACCGA ATTCTTGCGT AAAGAGCGCG TGGTCGGGGC GTTTGTCGAA
  151 TTTTTCGGCG AGGGCGCGAG AAGCCTGTCT ATCGGCGACC GCGCGACCAT
  201 TTCCAACATG ACGCCGGAGT TCGGCGCGAC TGCCGCCATG TTCGCCATCG
  251 ACGCGCAAAC TATTGATTAT TTGAAACTGA CCGGACGTGA CGACGCGCAG
  301 GTGAAATTGG TGGAAACCTA CGCCAAAACC GCAGGCTTAT GGGCAGGTGG
  351 CTTGAAAACC GCCGTTTATC CGCGCGTTTT GAAATTTGAT TTGAGCAGCG
  401 TAACGCGCAA TATGGCAGGC CCGAGCAACC CGCACGCGCG TTTTGCCACC
  451 GCCGATTTGG CGGCGAAAGG GCTGGCGAAG CCTTACGAAG AGCCTTCAGA
  501 CGGCCAAATG CCTGACGGTG CAGTGATTAT TGCCGCGATT ACTTCGTGTA
  551 CCAATACTTC CAACCCGCGC AACGTTGTCG CCGCCGCACT GTTGGCACGC
  601 AATGCCAACC GCCTCGGCTT GAAACGCAAA CCTTGGGTGA AATCTTCGTT
  651 TGCCCCGGGT TCAAAAGTAG CCGGAATCTA TTTGAAAGAA GCAGGCTTGT
  701 TGCCCGAAAT GGAAAAACTC GGCTTCGGTA TCGTCGCCTT CGCATGTACC
  751 ACCTGTAACG GCATGAgcgG CGCGCTcgaC CCGAAAATCC AACAAGAAAT
  801 CATCGACCGC GAtttgtacg cCACCGCCGT ATTGTCAGGC AACCGCAACT
  851 TCGACGGCCG TATCCATCCG TATGCGAAAC AGGCTTTCCT CGCTTCGCCT
  901 CCTTTGGTCG TTGCCTACGC ATTGGCAGGT AGCATCCGTT TCGATATTGA
  951 AAACGACGTA CTCGGCGTTG CAGACGGCCG CGAAATCCGC CTGAAAGATA
 1001 TCTGGCCGAC AGACGAAGAA ATCGATGCCA TCGTTGCCGA ATATGTGAAA
 1051 CCGCAACAAT TCCGCGACAT TTATATCCCG ATGTCCGACA CCGGCACAGC
 1101 GCAAAAAGCA CCAAGCCCGC TGTACGACTG GCGACCGATG TCCACCTACA
```

-continued

```
1151 TCCGCCGTCC GCCCTATTGG GAAGGCGCAC TGGCAGGGGA ACGTACATTA

1201 AGAGGTATGC GTCCGCCGGC GATTTTGCCC GACAACATCA CCACCGACCA

1251 CATCTCgcca tCCAATGCGA TTTTGGCCGG cagTGCcgca ggtgaATATT

1301 TGGCGAAAAT GGGTTTGCCT GAAGAagaCT TCAACTCTTA CGCAACCCAC

1351 CGCGGCGACC ACTTGACCGC CCAACGCGCA ACCTTCGCCA ATCCGAAACT

1401 GTTTAACGAA ATGGTGAGAA ACGAAGACGG CAGCGTACGC CAAGGTtcgt 1451 tggcacgcgT tgaacCAGAA GGCCAAACCA TGCGCATGTG GGAAGCCATC

1501 GAAACCTATA TGAACCGCAA ACAGCCGCTT ATCATCATTG CCGGTGCGGA

1551 CTATGGTCAA GGCTCAAGCC GCGACTGGGC GGCGAAGGGC GTGCGGCTGG

1601 CGGGTGTGGA AGCCATCGCC GCCGAAGGTT TCGAGCGCAT CCACCGCACC

1651 AACCTCATCG GCATGGGCGT CTTGCCGCTG CAATTCAAAC CCGGCACCAA

1701 CCGCCATACC CTGCAACTGG ACGGTACGGA AACCTACGAC GTTGTCGGCG

1751 AACGCACACC GCGCTGCGGC CTGACCCTCG TGATTCACCG TAAAAACGGA

1801 GAAACCGTCG AAGTTCCGGT TACCTGCCGC CCCGATACCG CAGAAGAAGC

1851 ATTGGTATAT GAAGCCGGCG GCGTATTGCA ACGGTTTGCA CAGGACTTTT

1901 TGGAAGGGAA CGCGGCTTAG
```

This corresponds to the amino acid sequence <SEQ ID 352; ORF 099.ng>:

```
g099.pep
    1 MLGRASMMRL PDIVGVELTG KRQAGITATD IVLALTEFLR KERVVGAFVE

51 FFGEGARSLS IGDRATISNM TPEFGATAAM FAIDAQTIDY LKLTGRDDAQ

101 VKLVETYAKT AGLWAGGLKT AVYPRVLKFD LSSVTRNMAG PSNPHARFAT

151 ADLAAKGLAK PYEEPSDGQM PDGAVIIAAI TSCTNTSNPR NVVAAALLAR

201 NANRLGLKRK PWVKSSFAPG SKVAGIYLKE AGLLPEMEKL GFGIVAFACT

251 TCNGMSGALD PKIQQEIIDR DLYATAVLSG NRNFDGRIHP YAKQAFLASP

301 PLVVAYALAG SIRFDIENDV LGVADGREIR LKDIWPTDEE IDAIVAEYVK

351 PQQFRDIYIP MSDTGTAQKA PSPLYDWRPM STYIRRPPYW EGALAGERTL

401 RGMRPPAILP DNITTDHISP SNAILAGSAA GEYLAKMGLP EEDFNSYATH

451 RGDHLTAQRA TFANPKLFNE MVRNEDGSVR QGSLARVEPE GQTMRMWEAI

501 ETYMNRKQPL IIIAGADYGQ GSSRDWAAKG VRLAGVEAIA AEGFERIHRT

551 NLIGMGVLPL QFKPGTNRHT LQLDGTETYD VVGERTPRCG LTLVIHRKNG

601 ETVEVPVTCR PDTAEEALVY EAGGVLQRFA QDFLEGNAA*
```

The following partial DNA sequence was identified in *N. meningitidis* <SEQ ID 353>:

```
m099.seq
    1 ATGCTGGGAC GCGCGTCCAT GATGCGCCTG CCCGATATTG TCGGCGTTGA

51 GCTGAACGGC AAACGGCAGG CGGGCATTAC GGCGACGGAT ATTGTGTTGG

101 CACTGACCGA GTTTCTGCGC AAAGAACGCG TGGTCGGGGC GTTTGTCGAA

151 TTCTTCGGCG AGGGCGCGAG AAGCCTGTCT ATCGGCGACC GCGCGACCAT

201 TTCCAACATG ACGCCGGAGT TCGGCGCGAC TGCCGCGATG TTCGCTATTG
```

-continued

```
 251 ATGAGCAAAC CATTGATTAT TTGAAACTGA CCGGACGCGA CGACGCGCAG

301 GTGAAATTGG TGGAAACCTA CGCCAAAACC GCAGGCTTGT GGGCAGATGC

351 CTTGAAAACC GCCGTTTATC CTCGCGTTTT GAAATTTGAT TTGAGCAGCG

401 TAACGCGCAA TATGGCAGGC CCAAGTAACC CGCATGCCCG TTTTGCGACC

451 GCCGATTTGG CGGCGAAAGG GCTGGCGAAG CCTTACGAAG AGCCTTCGGA

501 CGGCCAAATG CCCGACGGCT CGGTCATCAT CGCCGCGATT ACCAGTTGCA

551 CCAACACTTC CAACCCGCGC AACGTTGTTG CCGCCGCGCT CTTGGCACGC

601 AATGCCAACC GTCTCGGCTT GAAACGCAAA CCTTGGGTGA ATCTTCGTT

651 TGCCCCGGGT TCAAAAGTAG CCGAAATCTA TTTGAAAGAA GCGGGCCTGT

701 TGCCCGAAAT GGAAAAACTC GGCTTCGGTA TCGTCGCCTT CGCCTGCACC

751 ACCTGCAACG GCATGAGTGG CGCGCTGGAT CCGAAAATCC AGAAAGAAAT

801 CATCGACCGC GATTTGTACG CCACCGCCGT ATTATCAGGC AACCGCAACT

851 TCGACGGCCG TATCCACCCG TATGCGAAAC AGGCTTTCCT CGCTTCGCCT

901 CCGTTGGTCG TTGCCTACGC GCTGGCAGGC AGTATCCGTT TCGATATTGA

951 AAACGACGTA CTCGGCGTTG CAGACGGCAA GGAAATCCGC CTGAAAGACA

1001 TTTGGCCTGC CGATGAAGAA ATCGATGCCG TCGTTGCCGA ATATGTGAAA

1051 CCGCAGCAGT TCCGCGATGT GTATGTACCG ATGTTCGACA CCGGCACAGC

1101 GCAAAAAGCA CCCAGTCCGC TGTACGATTG GCGTCCGATG TCCACCTACA

1151 TCCGCCGTCC GCCTTACTGG GAAGGCGCGC TGGCAGGGGA ACGCACATTA

1201 AGAGGTATGC GTCCGCTGGC GATTTTGCCC GACAACATCA CCACCGACCA

1251 CCTCTCGCCG TCCAATGCGA TTTTGGCCGT CAGTGCCGCA GGCGAGTATT

1301 TGGCGAAAAT GGGTTTGCCT GAAGAAGACT TCAACTCTTA CGCAACCCAC

1351 CGCGGCGACC ACTTGACCGC CCAACGCGCT ACCTTCGCCA ATCCGAAACT

1401 GTTTAACGAA ATGGTGAAAA ACGAAGACGG CAGCGTGCGC CAAGGCTCGT

1451 TCGCCCGCGT CGAACCCGAA GGCGAAACCA TGCGCATGTG GAAGCCATC

1501 GAAACCTATA TGAACCGCAA ACAGCCGCTC ATCATCATTG CCGGTGCGGA

1551 CTATGGTCAA GGCTCAAGCC GCGACTGGGC TGCAAAAGGC GTACGCCTCG

1601 CCGGCGTAGA AGCGATTGTT GCCGAAGGCT TCGAGCGTAT CCACCGCACC

1651 AACCTTATCG GCATGGGCGT GTTGCCGCTG CAGTTCAAAC CCGACACCAA

1701 CCGCCATACC CTGCAACTGG ACGGTACGGA AACCTACGAC GTGGTCGGCG

1751 AACGCACACC GCGCTGCGAC CTGACCCTCG TGATTCACCG TAAAAACGGC

1801 GAAACCGTTG AAGTTCCCGT TACCTGCTGC CTCGATACTG CAGAAGAAGT

1851 ATTGGTATAT GAAGCCGGCG GCGTGTTGCA ACGGTTTGCA CAGGATTTTT

1901 TGGAAGGGAA CGCGGCTTAG
```

This corresponds to the amino acid sequence <SEQ ID 354; ORF 099>:

```
m099.pep
   1 MLGRASMMRL PDIVGVELNG KRQAGITATD IVLALTEFLR KERVVGAFVE

51 FFGEGARSLS IGDRATISNM TPEFGATAAM FAIDEQTIDY LKLTGRDDAQ

101 VKLVETYAKT AGLWADALKT AVYPRVLKFD LSSVTRNMAG PSNPHARFAT
```

```
151 ADLAAKGLAK PYEEPSDGQM PDGSVIIAAI TSCTNTSNPR NVVAAALLAR

201 NANRLGLKRK PWVKSSFAPG SKVAEIYLKE AGLLPEMEKL GFGIVAFACT

251 TCNGMSGALD PKIQKEIIDR DLYATAVLSG NRNFDGRIHP YAKQAFLASP

301 PLVVAYALAG SIRFDIENDV LGVADGKEIR LKDIWPADEE IDAVVAEYVK

351 PQQFRDVYVP MFDTGTAQKA PSPLYDWRPM STYIRRPPYW EGALAGERTL

401 RGMRPLAILP DNITTDHLSP SNAILAVSAA GEYLAKMGLP EEDFNSYATH

451 RGDHLTAQRA TFANPKLFNE MVKNEDGSVR QGSFARVEPE GETMRMWEAI

501 ETYMNRKQPL IIIAGADYGQ GSSRDWAAKG VRLAGVEAIV AEGFERIHRT

551 NLIGMGVLPL QFKPDTNRHT LQLDGTETYD VVGERTPRCD LTLVIHRKNG

601 ETVEVPVTCC LDTAEEVLVY EAGGVLQRFA QDFLEGNAA*
```

Computer analysis of this amino acid sequence gave the following results:

Homology with a Predicted ORF from *N. gonorrhoeae*

ORF 099 shows 96.2% identity over a 639 aa overlap with a predicted ORF (ORF 099.ng) from *N. gonorrhoeae*:

```
m099/g099

10         20         30         40         50         60
m099.pep   MLGRASMMRLPDIVGVELNGKRQAGITATDIVLALTEFLRKERVVGAFVEFFGEGARSLS
           ||||||||||||||||||||:|||||||||||||||||||||||||||||||||||||||
g099       MLGRASMMRLPDIVGVELTGKRQAGITATDIVLALTEFLRKERVVGAFVEFFGEGARSLS
                   10         20         30         40         50         60

70         80         90        100        110        120
m099.pep   IGDRATISNMTPEFGATAAMFAIDEQTIDYLKLTGRDDAQVKLVETYAKTAGLWADALKT
           ||||||||||||||||||||||||:||||||||||||||||||||||||||||||:|||
g099       IGDRATISNMTPEFGATAAMFAIDAQTIDYLKLTGRDDAQVKLVETYAKTAGLWAGGLKT
                   70         80         90        100        110        120

130        140        150        160        170        180
m099.pep   AVYPRVLKFDLSSVTRNMAGPSNPHARFATADLAAKGLAKPYEEPSDGQMPDGSVIIAAI
           ||||||||||||||||||||||||||||||||||||||||||||||||||||||:|||||
g099       AVYPRVLKFDLSSVTRNMAGPSNPHARFATADLAAKGLAKPYEEPSDGQMPDGAVIIAAI
                  130        140        150        160        170        180

190        200        210        220        230        240
m099.pep   TSCTNTSNPRNVVAAALLARNANRLGLKRKPWVKSSFAPGSKVAEIYLKEAGLLPEMEKL
           |||||||||||||||||||||||||||||||||||||||||||| ||||||||||||||
g099       TSCTNTSNPRNVVAAALLARNANRLGLKRKPWVKSSFAPGSKVAGIYLKEAGLLPEMEKL
                  190        200        210        220        230        240

250        260        270        280        290        300
m099.pep   GFGIVAFACTTCNGMSGALDPKIQKEIIDRDLYATAVLSGNRNFDGRIHPYAKQAFLASP
           |||||||||||||||||||||||:|||||||||||||||||||||||||||||||||||
g099       GFGIVAFACTTCNGMSGALDPKIQQEIIDRDLYATAVLSGNRNFDGRIHPYAKQAFLASP
                  250        260        270        280        290        300

310        320        330        340        350        360
m099.pep   PLVVAYALAGSIRFDIENDVLGVADGKEIRLKDIWPADEEIDAVVAEYVKPQQFRDVYVP
           ||||||||||||||||||||||||||:||||||||||:||||||:|||||||||:|:|
g099       PLVVAYALAGSIRFDIENDVLGVADGREIRLKDIWPTDEEIDAIVAEYVKPQQFRDIYIP
                  310        320        330        340        350        360

370        380        390        400        410        420
m099.pep   MFDTGTAQKAPSPLYDWRPMSTYIRRPPYWEGALAGERTLRGMRPLAILPDNITTDHLSP
           | |||||||||||||||||||||||||||||||||||||||||||:|||||||||||:||
g099       MSDTGTAQKAPSPLYDWRPMSTYIRRPPYWEGALAGERTLRGMRPPAILPDNITTDHISP
                  370        380        390        400        410        420

430        440        450        460        470        480
m099.pep   SNAILAVSAAGEYLAKMGLPEEDFNSYATHRGDHLTAQRATFANPKLFNEMVKNEDGSVR
           ||||||:|||||||||||||||||||||||||||||||||||||||||||||:|||||||
g099       SNAILAGSAAGEYLAKMGLPEEDFNSYATHRGDHLTAQRATFANPKLFNEMVRNEDGSVR
                  430        440        450        460        470        480
```

-continued

```
                  490       500       510       520       530       540
m099.pep   QGSFARVEPEGETMRMWEAIETYMNRKQPLIIIAGADYGQGSSRDWAAKGVRLAGVEAIV
           |||:|||||||:|||||||||||||||||||||||||||||||||||||||||||||||:
g099       QGSLARVEPEGQTMRMWEAIETYMNRKQPLIIIAGADYGQGSSRDWAAKGVRLAGVEAIA
                  490       500       510       520       530       540
                  550       560       570       580       590       600
m099.pep   AEGFERIHRTNLIGMGVLPLQFKPDTNRHTLQLDGTETYDVVGERTPRCDLTLVIHRKNG
           |||||||||||||||||||||||| |||||||||||||||||||||||| ||||||||||
g099       AEGFERIHRTNLIGMGVLPLQFKPGTNRHTLQLDGTETYDVVGERTPRCGLTLVIHRKNG
                  550       560       570       580       590       600

610       620       630       640
m099.pep   ETVEVPVTCCLDTAEEVLVYEAGGVLQRFAQDFLEGNAAX
           |||||||||  |||||:|||||||||||||||||||||||
g099       ETVEVPVTCRPDTAEEALVYEAGGVLQRFAQDFLEGNAAX
                  610       620       630       640
```

The following partial DNA sequence was identified in *N. meningitidis* <SEQ ID 355>:

a099.seq
1 ATGCTGGGAC GCGCGTCCAT GATGCGCCTG CCCGATATTG TCGGCGTTGA

51 GCTGAACGGC AAACGGAAGG CGGGCATTAC GGCGACGGAT ATTGTGTTGG

101 CACTGACCGA GTTTCTGCGC AAAGAACGCG TGGTCGGGGC GTTTGTCGAA

151 TTCTTCGGCG AGGGCGCGAG AAGCCTGTCT ATCGGCGACC GCGCGACCAT

201 TTCCAACATG ACGCCGGAGT TCGGCGCGAC TGCCGCGATG TTCGCTATTG

251 ATGAGCAAAC CATTGATTAT TTGAAACTGA CCGGACGCGA CGACGCGCAG

301 GTGAAATTGG TGGAAACCTA CGCCAAAACC GCAGGCTTGT GGGCAGATGC

351 CTTGAAAACC GCCGTTTATC CGCGCGTTTT GAAATTTGAT TTGAGCAGCG

401 TAACGCGCAA TATGGCAGGC CCGAGCAACC CGCACGCGCG TTTTGCGACC

451 GCCGATTTGG CCGGCAAAGG CTTGGCTAAA CCTTACGAAG AGCCTTCAGA

501 CGGCCAAATG CCTGACGGTG CAGTGATTAT TGCCGCGATT ACTTCCTGTA

551 CCAATACTTC CAATCCGCGC AACGTTGTCG CCGCCGCGCT GTTGGCACGC

601 AATGCCAACC GCCTCGGCTT GCAACGCAAA CCTTGGGTGA AATCTTCGTT

651 TGCCCCGGGT TCAAAAGTAG CCGAAATCTA TTTGAAAGAA GCAGATCTGC

701 TGCCCGAAAT GGAAAAACTC GGCTTCGGTA TCGTTGCCTT CGCATGTACC

751 ACCTGTAACG GCATGAGCGG CGCGCTGGAT CCGAAAATCC AGAAAGAAAT

801 CATCGACCGC GATTTGTACG CCACCGCCGT ATTGTCAGGC AACCGCAACT

851 TTGACGGCCG TATCCATCCG TATGCGAAAC AGGCTTTCCT CGCTTCGCCT

901 CCGTTGGTCG TTGCCTACGC GCTGGCAGGC AGCATCCGTT TCGATATTGA

951 AAACGACGTA CTCGGCGTTG CAGACGGCAA AGAAATCCGC CTGAAAGACA

1001 TTTGGCCTAC CGATGAAGAA ATCGATGCCA TCGTTGCCGA ATATGTGAAA

1051 CCGCAGCAAT TTCGCGACGT TTATATCCCG ATGTTCGACA CCGGCACAGC

1101 GCAAAAAGCA CCAAGCCCGC TGTACGACTG GCGTCCAATG TCTACCTATA

1151 TCCGCCGCCC ACCTTACTGG GAAGGCGCAC TGGCAGGGGA ACGCACATTA

1201 AGCGGTATGC GTCCGCTGGC GATTTTGCCC GACAACATCA CCACCGACCA

1251 TCTCTCGCCA TCCAATGCGA TTTTGGCAAG CAGTGCCGCA GGCGAATATT

1301 TGGCAAAAAT GGGTTTGCCT GAAGAAGACT TCAACTCTTA CGCAACCCAC

1351 CGTGGCGACC ACTTGACCGC CCAACGCGCA ACCTTCGCCA ATCCGAAACT

-continued

```
1401 GTTTAACGAA ATGGTGAGAA ACGAAGACGG CAGCGTACGC CAAGGTTCGC

1451 TGGCACGCGT TGAACCCGAA GGCCAAACCA TGCGCATGTG GGAAGCCATC

1501 GAAACCTATA TGAACCGCAA ACAGCCGCTC ATCATCATTG CCGGCGCGGA

1551 CTACGGTCAA GGCTCAAGCC GCGACTGGGC TGCAAAAGGC GTACGCCTCG

1601 CCGGCGTGGA AGCGATTGTT GCCGAAGGCT TCGAGCGTAT CCACCGCACC

1651 AACTTGATCG GTATGGGCGT GTTGCCGCTG CAGTTCAAAC CGGGTACCAA

1701 CCGCCACACC CTGCAACTGG ACGGTACGGA AACCTACGAC GTTGTCGGCG

1751 AACGCACACC GCGCTGCGAC CTGACCCTTG TGATTCACCG TAAAAACGGC

1801 GAGACCGTCG AAGTCCCCAT TACCTGCCGC CTCGATACCG CAGAAGAAGT

1851 GTTGGTATAT GAAGCCGGTG GCGTATTGCA ACGGTTTGCA CAGGATTTTT

1901 TGGAAGGGAA CGCGGCTTAG
```

This corresponds to the amino acid sequence <SEQ ID 356; ORF 099.a>:

```
a099.pep

1 MLGRASMMRL PDIVGVELNG KRKAGITATD IVLALTEFLR KERVVGAFVE

51 FFGEGARSLS IGDRATISNM TPEFGATAAM FAIDEQTIDY LKLTGRDDAQ

101 VKLVETYAKT AGLWADALKT AVYPRVLKFD LSSVTRNMAG PSNPHARFAT

151 ADLAGKGLAK PYEEPSDGQM PDGAVIIAAI TSCTNTSNPR NVVAAALLAR

201 NANRLGLQRK PWVKSSFAPG SKVAEIYLKE ADLLPEMEKL GFGIVAFACT

251 TCNGMSGALD PKIQKEIIDR DLYATAVLSG NRNFDGRIHP YAKQAFLASP

301 PLVVAYALAG SIRFDIENDV LGVADGKEIR LKDIWPTDEE IDAIVAEYVK

351 PQQFRDVYIP MFDTGTAQKA PSPLYDWRPM STYIRRPPYW EGALAGERTL

401 SGMRPLAILP DNITTDHLSP SNAILASSAA GEYLAKMGLP EEDFNSYATH

451 RGDHLTAQRA TFANPKLFNE MVRNEDGSVR QGSLARVEPE GQTMRMWEAI

501 ETYMNRKQPL IIIAGADYGQ GSSRDWAAKG VRLAGVEAIV AEGFERIHRT

551 NLIGMGVLPL QFKPGTNRHT LQLDGTETYD VVGERTPRCD LTLVIHRKNG

601 ETVEVPITCR LDTAEEVLVY EAGGVLQRFA QDFLEGNAA*
``` m099/a099 97.5% identity in 639 aa overlap

```
                    10         20         30         40         50         60
m099.pep    MLGRASMMRLPDIVGVELNGKRQAGITATDIVLALTEFLRKERVVGAFVEFFGEGARSLS
            ||||||||||||||||||||||:|||||||||||||||||||||||||||||||||||||
a099        MLGRASMMRLPDIVGVELNGKRKAGITATDIVLALTEFLRKERVVGAFVEFFGEGARSLS
                    10         20         30         40         50         60

70         80         90        100        110        120
m099.pep    IGDRATISNMTPEFGATAAMFAIDEQTIDYLKLTGRDDAQVKLVETYAKTAGLWADALKT
            ||||||||||||||||||||||||||||||||||||||||||||||||||||||||||||
a099        IGDRATISNMTPEFGATAAMFAIDEQTIDYLKLTGRDDAQVKLVETYAKTAGLWADALKT
                    70         80         90        100        110        120

130        140        150        160        170        180
m099.pep    AVYPRVLKFDLSSVTRNMAGPSNPHARFATADLAAKGLAKPYEEPSDGQMPDGSVIIAAI
            |||||||||||||||||||||||||||||||||||:|||||||||||||||||:||||||
a099        AVYPRVLKFDLSSVTRNMAGPSNPHARFATADLAGKGLAKPYEEPSDGQMPDGAVIIAAI
                   130        140        150        160        170        180

190        200        210        220        230        240
m099.pep    TSCTNTSNPRNVVAAALLARNANRLGLRKPWVKSSFAPGSKVAEIYLKEAGLLPEMEKL
            ||||||||||||||||||||||||||:|||||||||||||||||||||||| ||||||||
a099        TSCTNTSNPRNVVAAALLARNANRLGLQRKPWVKSSFAPGSKVAEIYLKEADLLPEMEKL
                   190        200        210        220        230        240
```

```
              250        260        270        280        290        300
m099.pep  GFGIVAFACTTCNGMSGALDPKIQKEIIDRDLYATAVLSGNRNFDGRIHPYAKQAFLASP
          ||||||||||||||||||||||||||||||||||||||||||||||||||||||||||||
a099      GFGIVAFACTTCNGMSGALDPKIQKEIIDRDLYATAVLSGNRNFDGRIHPYAKQAFLASP
              250        260        270        280        290        300

310        320        330        340        350        360
m099.pep  PLVVAYALAGSIRFDIENDVLGVADGKEIRLKDIWPADEEIDAVVAEYVKPQQFRDVYVP
          |||||||||||||||||||||||||||||||||||||:||||||:||||||||||||:|
a099      PLVVAYALAGSIRFDIENDVLGVADGKEIRLKDIWPTDEEIDAIVAEYVKPQQFRDVYIP
              310        320        330        340        350        360

370        380        390        400        410        420
m099.pep  MFDTGTAQKAPSPLYDWRPMSTYIRRPPYWEGALAGERTLRGMRPLAILPDNITTDHLSP
          ||||||||||||||||||||||||||||||||||||||| ||||||||||||||||||||
a099      MFDTGTAQKAPSPLYDWRPMSTYIRRPPYWEGALAGERTLSGMRPLAILPDNITTDHLSP
              370        380        390        400        410        420

430        440        450        460        470        480
m099.pep  SNAILAVSAAGEYLAKMGLPEEDFNSYATHRGDHLTAQRATFANPKLFNEMVKNEDGSVR
          ||||| ||||||||||||||||||||||||||||||||||||||||||||||:|||||||
a099      SNAILASSAAGEYLAKMGLPEEDFNSYATHRGDHLTAQRATFANPKLFNEMVRNEDGSVR
              430        440        450        460        470        480

490        500        510        520        530        540
m099.pep  QGSFARVEPEGETMRMWEAIETYMNRKQPLIIIAGADYGQGSSRDWAAKGVRLAGVEAIV
          |||:||||||||:|||||||||||||||||||||||||||||||||||||||||||||||
a099      QGSLARVEPEGQTMRMWEAIETYMNRKQPLIIIAGADYGQGSSRDWAAKGVRLAGVEAIV
              490        500        510        520        530        540

550        560        570        580        590        600
m099.pep  AEGFERIHRTNLIGMGVLPLQFKPDTNRHTLQLDGTETYDVVGERTPRCDLTLVIHRKNG
          |||||||||||||||||||||||||||| |||||||||||||||||||||||||||||||
a099      AEGFERIHRTNLIGMGVLPLQFKPGTNRHTLQLDGTETYDVVGERTPRCDLTLVIHRKNG
              550        560        570        580        590        600

610        620        630        640
m099.pep  ETVEVPVTCCLDTAEEVLVYEAGGVLQRFAQDFLEGNAAX
          ||||||:|| ||||||||||||||||||||||||||||||
a099      ETVEVPITCRLDTAEEVLVYEAGGVLQRFAQDFLEGNAAX
              610        620        630        640
```

The following partial DNA sequence was identified in *N. gonorrhoeae* <SEQ ID 357>:

```
g102.seq
   1 AtgtCCGCCA AAactccgtc gctcttcggc ggcgcgatga Ttatcgccgg 51 gaaggttatc ggcgcAGgta tgttccccaa ccccaccgcc aacttggggg 101 acgggttaat aggctcgctg attgtgctgc tgtacacctg gtttccattc 151 tcctccggcg ccctcatgat tttggaagtc aacacccata acCCccgagg 201 ggcaAGtttt gacaccATGg tcAAagacct gctcgGaCGc ggctggaaca 251 tcatcaacgg catcgccgtc gctttggTCc tatacggctc gacctacgcg 301 tacattttag tcggcggtga cctGACCGCC AAAGGCAtcg GCAgCGCAGT 351 AGGCGGCAAA ATTTCgctca CCGTCGGACA actcgtcttc tTCGGCATCC

401 TCGCCTTTTG CGTATGGGCA TCCGCACGCT TGGTCGACCG CTTTACCGGC

451 GTCCTCATCG GCGGCATGGT ATTAACCTTT ATTTGGGCAA CCGGCGGCCT

501 GGTTGCCGAT GCCAAACCGT CCGTCCTCTT CGACACCCAA GCCCCGTCG

551 GCACCGGCTA CTGGATTTAC GCCGCCACCG CCCTGCCCGT CTGCCTCGCT

601 TCCTTCGGCT CCACGGCAA CGTTTCCAGC CTGCTCAAAT ACTTTAAAGG

651 CGACGcgcCc aaagtGgCGA aATCcatctg gGcaggtaca ttggTTGCCt 701 tggtaattta cgtccTCTgg caaaccgcca tCcaaagcaa ccTGCcgcgc 751 aacgagttcg cCCCcgtgat tgccgccgag aggcaactCT CCGTCCTgaa 801 tgaaaccccTG tccaaattcg cccaaaccgg cgatatggat aAaatattgt 851 ccctattTcc ctacatggca atcgccacct cctttttagg cgTAACctta
```

-continued

```
 901 ggcctgtttg acaacatcgc cgacatcttc aaatggaacg acagtatgtc
 951 cgggcggggc accaaaaccg tcgcgctgaa cttcctgccg CCCCtgattt
1001 cctggctgct cctccccacc ggcttcttta ccgccattgg tgcgtccggc
1051 ctggcggcaa ccgtctggga ccaagGcatc atccccgcca tgctgctcta
1101 cgtttccccc caaaaaattG gcGcaggcaa gacttataAa gtttaCGGCG
1151 gcttgtggct gatgttagtc ttcctttcg gcatcgccaa catcgccgca
1201 CAGGTATTGA GccaAatgGa ACtcgtCccc GTATTTAAAG GATAA
```

This corresponds to the amino acid sequence <SEQ ID 358; ORF 102.ng>:

```
g102.pep
  1 MSAKTPSLFG GAMIIAGKVI GAGMFPNPTA NLGDGLIGSL IVLLYTWFPF
 51 SSGALMILEV NTHNPRGASF DTMVKDLLGR GWNIINGIAV ALVLYGSTYA
101 YILVGGDLTA KGIGSAVGGK ISLTVGQLVF FGILAFCVWA SARLVDRFTG
151 VLIGGMVLTF IWATGGLVAD AKPSVLFDTQ APVGTGYWIY AATALPVCLA
201 SFGFHGNVSS LLKYFKGDAP KVAKSIWAGT LVALVIYVLW QTAIQSNLPR
251 NEFAPVIAAE RQLSVLNETL SKFAQTGDMD KILSLFPYMA IATSFLGVTL
301 GLFDNIADIF KWNDSMSGRG TKTVALNFLP PLISWLLLPT GFFTAIGASG
351 LAATVWDQGI IPAMLLYVSP QKIGAGKTYK VYGGLWLMLV FLFGIANIAA
401 QVLSQMELVP VFKG*
```

The following partial DNA sequence was identified in *N. meningitidis* <SEQ ID 359>:

```
m102.seq
   1 ATGCCCAACA AAACCCCTTC ACTGTTCGGC GGCGCGATGA TTATCGCCGG
  51 CACGGTCATC GGCGCAGGCA TGCTCGCCAA CCCGACCGCC ACATCCGGCG
 101 TATGGTTTAC CGGCTCGCTG GCCGTGTTGC TGTACACCTG GTTTTCTATG
 151 CTTTCCAGCG GCCTGATGAT TTTGGAAGTC AACACCCATT ATCCGCACGG
 201 CGCAAGTTTC GACACGATGG TCAAAGACCT GCTCGGACGC GGCTGGAACA
 251 TCATCAACGG CATCGCCGTC GCCTTCGTTT TATACCTGCT TACTTACGCT
 301 TATATCTTCG TCGGCGGCGA CCTGACCGCC AAAGGCTTAG GCAGCGCGGC
 351 AGGCGGCGAC GTTTCACTCA CCGTCGGACA ACTCGTCTTC TTCGGCATCC
 401 TCGCCTTTTG CGTATGGGCA TCCGCACGCT TGGTCGACCG CTTCACCGGC
 451 GTCCTTATCG GCGGCATGGT ATTGACCTTT ATTTGGGCGG CCGGCGGGCT
 501 GATTGCCGAT GCCAAGCCGT CCGTCCTCTT CGATACCCAA GCCCCCGCCG
 551 GCACAAACTA CTGGATTTAC GCCGCCACCG CCCTGCCCGT CTGCCTCGCT
 601 TCCTTCGGCT TCCACGGCAA CGTCTCCAGC CTGCTCAAAT ACTTTAAAGG
 651 CGACGCGCCC AAAGTGGCTA AATCCATCTG GACGGGCACA CTGATTGCGC
 701 TGGTAATTTA CGTCCTCTGG CAAACCGCCA TCCAAGGCAA CCTGCCGCGC
 751 AACGAGTTCG CCCCCGTCAT CGCCGCCGAA GGGCAAGTCT CCGTCCTCAT
 801 CGAAACCCTG TCCAAATTCG CCCAAACCGG CAATATGGAC AAAATATTGT
 851 CCCTGTTTTC CTATATGGCG ATCGCCACCT CGTTTTTAGG CGTAACGCTC
```

```
 901 GGACTCTTCG ACTACATCGC CGACATCTTC AAATGGAACG ACAGCATCTC

951 CGGCCGCACC AAAACCGCCG CGCTGACCTT CCTGCCGCCC CTGATTTCCT

1001 GCCTGCTCTT CCCCACCGGC TTCGTTACCG CCATCGGCTA CGTCGGCCTG

1051 GCGGCAACCG TCTGGACAGG CATCATCCCC GCCATGCTGC TCTACCGTTC

1101 GCGCAAAAAA TTCGGCGCAG GCAAAACCTA TAAAGTTTAC GGCGGCTTGT

1151 GGCTGATGGT TTGGGTCTTC CTTTTCGGCA TCGTCAACAT CGCCGCACAG

1201 GTATTGAGCC AAATGGAACT CGTCCCCGTA TTTAAAGGAT AA
```

This corresponds to the amino acid sequence <SEQ ID 360; ORF 102>:

```
m102.pep..

1 MPNKTPSLFG GAMIIAGTVI GAGMLANPTA TSGVWFTGSL AVLLYTWFSM

51 LSSGLMILEV NTHYPHGASF DTMVKDLLGR GWNIINGIAV AFVLYLLTYA

101 YIFVGGDLTA KGLGSAAGGD VSLTVGQLVF FGILAFCVWA SARLVDRFTG

151 VLIGGMVLTF IWAAGGLIAD AKPSVLFDTQ APAGTNYWIY AATALPVCLA

201 SFGFHGNVSS LLKYFKGDAP KVAKSIWTGT LIALVIYVLW QTAIQGNLPR

251 NEFAPVIAAE GQVSVLIETL SKFAQTGNMD KILSLFSYMA IATSFLGVTL

301 GLFDYIADIF KWNDSISGRT KTAALTFLPP LISCLLFPTG FVTAIGYVGL

351 AATVWTGIIP AMLLYRSRKK FGAGKTYKVY GGLWLMVWVF LFGIVNIAAQ

401 VLSQMELVPV FKG* m102/g102   86.0% identity in 415 aa overlap 10        20        30        40        50        60
m102.pep   MPNKTPSLFGGAMIIAGTVIGAGMLANPTATSGVWFTGSLAVLLYTWFSMLSSGLMILEV
           | |||||||||||| |||||| |||||: ||||: | : ||| |||||| : |::||||||
g102       MSAKTPSLFGGAMIIAGKVIGAGMFPNPTANLGDGLIGSLIVLLYTWFPFSSGALMILEV
                   10        20        30        40        50        60

70        80        90       100       110       120
m102.pep   NTHYPHGASFDTMVKDLLGRGWNIINGIAVAFVLYLLTYAYIFVGGDLTAKGLGSAAGGD
           ||| :||||||||||||||||||||||||||:||| |||||:|||||||||||:|||:||
g102       NTHNPRGASFDTMVKDLLGRGWNIINGIAVALVLYGSTYAYILVGGDLTAKGIGSAVGGK
                   70        80        90       100       110       120

130       140       150       160       170       180
m102.pep   VSLTVGQLVFFGILAFCVWASARLVDRFTGVLIGGMVLTFIWAAGGLIADAKPSVLFDTQ
           :|||||||||||||||||||||||||||||||||||||||||||:|||:||||||||||
g102       ISLTVGQLVFFGILAFCVWASARLVDRFTGVLIGGMVLTFIWATGGLVADAKPSVLFDTQ
                   130       140       150       160       170       180

190       200       210       220       230       240
m102.pep   APAGTNYWIYAATALPVCLASFGFHGNVSSLLKYFKGDAPKVAKSIWTGTLIALVIYVLW
           || :||||||||||||||||||||||||||||||||||||||||||||:|||:|||||||
g102       APVGTGYWIYAATALPVCLASFGFHGNVSSLLKYFKGDAPKVAKSIWAGTLVALVIYVLW
                   190       200       210       220       230       240

250       260       270       280       290       300
m102.pep   QTAIQGNLPRNEFAPVIAAEGQVSVLIETLSKFAQTGNMDKILSLFSYMAIATSFLGVTL
           ||||| :||||||||||||||: :|||||: |||||||||:|||||||||| |||||||||
g102       QTAIQSNLPRNEFAPVIAAERQLSVLNETLSKFAQTGDMDKILSLFPYMAIATSFLGVTL
                   250       260       270       280       290       300

310       320       330       340       350
m102.pep   GLFDYIADIFKWNDSISGR-TKTAALTFLPPLISCLLFPTGFVTAIGYVGLAATVWT-GI
           ||||:||||||||||:|||||||| :|||:||||| |:|||| |||| |||||||||| ||
g102       GLFDNIADIFKWNDSMSGRGTKTVALNFLPPLISWLLPTGFFTAIGASGLAATVWDQGI
                   310       320       330       340       350       360
```

-continued

```
                360         370         380         390         400         410
m102.pep    IPAMLLYRSRKKFGAGKTYKVYGGLWLMVWVFLFGIVNIAAQVLSQMELVPVFKGX
            ||||||| | :|:|||||||||||||||: ||||||:|||||||||||||||||||
g102        IPAMLLYVSPQKIGAGKTYKVYGGLWLML-VFLFGIANIAAQVLSQMELVPVFKGX
                        370         380         390         400         410
```

The following partial DNA sequence was identified in *N. meningitidis* <SEQ ID 361>:

```
a102.seq
   1 ATGCCCACCA AAACCCCTTC ACTGTTCGGC GGCGCGATGA TTATCGCCGG

51 CACGNTCATC GGCGCAGGTA TGCTCGCCAA CCTGACCGCC ACATCCGGCG

101 TATGGTTTAC CGGCTCGCTG GCCGTGTTGC TGTACACCTG GTTTTCCATG

151 CTCTCCAGCG GCCTGATGAT TTTGGAAGTC AACACCCACT ACCCCCACGG

201 CGCGANCTTC GACACCATGG TTAAAGACCT GCTCGGACGG AGCTGGAACA

251 TCATCAACGG CATCGCCGTC GCCTTCGTTT TATACCTGCT TACTTACGCT

301 TATATCTTCG TCGGCGGCGA CCTGACCGCC AAAGGCTTAG GCAGCGCGGC

351 AGGCGGCAAT GTTTCACTCA CCGTCGGACA ACTCGTCTTC TTCGGCATTC

401 TCGCCTTTTG CGTATGGGCA TCCGCACGCT TGGTCGACCG ATTCACCAGC

451 GTCCTCATCG GCGGCATGGT ATTAACCTTT ATTTGGGCAA CCGGCGGCCT

501 GATTGCCGAT GCCAAACTGC CCGTCCTCTT CGACACCCAA GCCCCTACCG

551 GCACCAACTA CTGGATTTAT GTCGCCACCG CCCTGCCCGT CTGCCTTGCG

601 TCATTCGGTT TCCACGGCAA CGTCTCCAGC CTGCTCAAAT ACTTTAAAGG

651 CGACGCGCCC AAAGTGGCTA AATCCATCTG GACGGGCACA CTGATTGCGC

701 TGGTAATTTA CGTCCTCTGG CAAACCGCCA TCCAANGCAA CCTGCCGCGC

751 AACGAGTTCG CCCCCGTGAT TGCCGCCGAA GGGCAAGTCT CCGTCNTGAT

801 TGAAACCCTG TCCAAATTCG CCCAAACCGG CAATATGGAC AAAATATTGT

851 CCCTGTTTTC CTATATGGCG ATCGCCACCT CGTTTTTAGG CGTAACGCTC

901 GGACTCTTCG ACTACATCGC CGACATCTTC AAATGGAACG ACAGCGTGTC

951 CGGCCGCACC AAAACCGCCG CGCTGACCTT CCTGCCGCCT NTAATTTCCT

1001 GCCTGCTCTT CCCCACCGGC TTTGTTACCG CCATCGGNTA CGTCGGCCTG

1051 GCGGCAACCG TCTGGACAGG CATCATCCCC GCCATGCTGC TNTACCGTTC

1101 GCGCAAAAAA TTCGGCGCAG GCAAAACCTA TAAAGTTTAC GGCGGCTTGT

1151 GGCTGATGGT TTGGGTCTTC CTTTTCGGCA TCNTCAACAT CGCCGCACAN

1201 GTATTGAGCC AAATGGAACT CGTCCCCGTA TTTAAAGGAT AA

1202
```

This corresponds to the amino acid sequence <SEQ ID 362; ORF 102.a>:

```
a102.pep

1  MPTKTPSLFG GAMIIAGTXI GAGMLANPTA TSGVWFTGSL AVLLYTWFSM

51  LSSGLMILEV NTHYPHGAXF DTMVKDLLGR SWNIINGIAV AFVLYLLTYA

101  YIFVGGDLTA KGLGSAAGGN VSLTVGQLVF FGILAFCVWA SARLVDRFTS

151  VLIGGMVLTF IWATGGLIAD AKLPVLFDTQ APTGTNYWIY VATALPVCLA
```

```
201 SFGFHGNVSS LLKYFKGDAP KVAKSIWTGT LIALVIYVLW QTAIQXNLPR

251 NEFAPVIAAE GQVSVXIETL SKFAQTGNMD KILSLFSYMA IATSFLGVTL

301 GLFDYIADIF KWNDSVSGRT KTAALTFLPP XISCLLFPTG FVTAIGYVGL

351 AATVWTGIIP AMLLYRSRKK FGAGKTYKVY GGLWLMVWVF LFGIXNIAAX

401 VLSQMELVPV FKG*
``` m102/a102 95.9% identity in 413 aa overlap

```
                  10         20         30         40         50         60
m102.pep  MPNKTPSLFGGAMIIAGTVIGAGMLANPTATSGVWFTGSLAVLLYTWFSMLSSGLMILEV
          ||:||||||||||||||||| |||||||||||||||||||||||||||||||||||||||
a102      MPTKTPSLFGGAMIIAGTXIGAGMLANPTATSGVWFTGSLAVLLYTWFSMLSSGLMILEV
                  10         20         30         40         50         60

70         80         90        100        110        120
m102.pep  NTHYPHGASFDTMVKDLLGRGWNIINGIAVAFVLYLLTYAYIFVGGDLTAKGLGSAAGGD
          ||||||||:||||||||||||:|||||||||||||||||||||||||||||||||||||:
a102      NTHYPHGAXFDTMVKDLLGRSWNIINGIAVAFVLYLLTYAYIFVGGDLTAKGLGSAAGGN
                  70         80         90        100        110        120

130        140        150        160        170        180
m102.pep  VSLTVGQLVFFGILAFCVWASARLVDRFTGVLIGGMVLTFIWAAGGLIADAKPSVLFDTQ
          |||||||||||||||||||||||||||||:|||||||||||||:|||||||||| |||||
a102      VSLTVGQLVFFGILAFCVWASARLVDRFTSVLIGGMVLTFIWATGGLIADAKLPVLFDTQ
                 130        140        150        160        170        180

190        200        210        220        230        240
m102.pep  APAGTNYWIYAATALPVCLASFGFHGNVSSLLKYFKGDAPKVAKSIWTGTLIALVIYVLW
          ||:||||||:||||||||||||||||||||||||||||||||||||||||||||||||||
a102      APTGTNYWIYVATALPVCLASFGFHGNVSSLLKYFKGDAPKVAKSIWTGTLIALVIYVLW
                 190        200        210        220        230        240

250        260        270        280        290        300
m102.pep  QTAIQGNLPRNEFAPVIAAEGQVSVLIETLSKFAQTGNMDKILSLFSYMAIATSFLGVTL
          |||||:||||||||||||||||||||:|||||||||||||||||||||||||||||||||
a102      QTAIQXNLPRNEFAPVIAAEGQVSVXIETLSKFAQTGNMDKILSLFSYMAIATSFLGVTL
                 250        260        270        280        290        300

310        320        330        340        350        360
m102.pep  GLFDYIADIFKWNDSISGRTKTAALTFLPPLISCLLFPTGFVTAIGYVGLAATVWTGIIP
          ||||||||||||||||:||||||||||||||| |||||||||||||||||||||||||||
a102      GLFDYIADIFKWNDSVSGRTKTAALTFLPPXISCLLFPTGFVTAIGYVGLAATVWTGIIP
                 310        320        330        340        350        360

370        380        390        400        410
m102.pep  AMLLYRSRKKFGAGKTYKVYGGLWLMVWVFLFGIVNIAAQVLSQMELVPVFKGX
          ||||||||||||||||||||||||||||||||||| |||| |||||||||||||
a102      AMLLYRSRKKFGAGKTYKVYGGLWLMVWVFLFGIXNIAAXVLSQMELVPVFKGX
                 370        380        390        400        410
```

The following partial DNA sequence was identified in *N. gonorrhoeae* <SEQ ID 363>:

```
g105.seq
  1 Atgtccgcag aaaCATACAc acAAAtcggc tGGgtaggct taggGcaaat 51 gGgtctgcct atgGTAACGC GGCTCTTGGA CGGCGGCATC GAAGTCGGCG 101 TATACAACCG CTCGCCCGAC AAAACTGCCC CCATCTCcgc CAAAGGAGCA 151 AAAGTTTACG GCagcACCGC CGAACTCGTC CGCGCCTGCC CCGTCATTTT

201 CCTGATGGTT TCCGACTATG CCGCCGTGTG CGACATCCTG AACGGAGTCC

251 GCGACGGATT GGCCGGCAAA ATCATCGTCA ACATGAGCAC CATCTCCCCG

301 ACCGAAAACC TCGCCGTCAA AGCACTTGTC GAAGCCGCAG GCGGACAGTT

351 TGCCGAAGCA CCCGTTTCCG GATCGGTCGG ACCCGCCACC AACGGCACAC

401 TGCTGATTCT GTTCGGCGGC AGCGAAGCCG TTTTAAACCC GCTGCAAAAA

451 ATATTTTCCC TTGTCGGCAA AAAACCTTC CATTTCGGCG ATGTCGGCAA

501 AGGCTCGGGC GCGAAACTCG TCTTGAACTC GCTCTTAGGC ATTTTCGGCG
```

```
-continued
551 AAGCGTACAG CGAAGCGATG CTGATGGCGC GGCAGTTCGG CATCGATACC

601 GACACCATCG TCGAAGCCAT CGGCGGCTCG GCAATGGACT CGCCTATGTT

651 TCAAACAAAA AAATCACTAT GGGCAAACCG TGAGTTCCCC CCTGCCTTTG

701 CACTCAAACA CGCTTCCAAA GAcctTAACC TCGccgtcAA AGAGCTTGAA

751 CAGGCAGGCA ACACCCTGCC CGCCGTCGAA ACCGTTGCTG CCAGCTACCG

801 CAAAGCAGTT GAAGCCGGCT ACGGCGAACA GGACGTTTCC GGCGTTTACC

851 TGAAATTGGC AGAACACTGA
```

This corresponds to the amino acid sequence <SEQ ID 364; ORF 105.ng>:

```
g105.pep
  1 MSAETYTQIG WVGLGQMGLP MVTRLLDGGI EVGVYNRSPD KTAPISAKGA

51 KVYGSTAELV RACPVIFLMV SDYAAVCDIL NGVRDGLAGK IIVNMSTISP

101 TENLAVKALV EAAGGQFAEA PVSGSVGPAT NGTLLILFGG SEAVLNPLQK

151 IFSLVGKKTF HFGDVGKGSG AKLVLNSLLG IFGEAYSEAM LMARQFGIDT

201 DTIVEAIGGS AMDSPMFQTK KSLWANREFP PAFALKHASK DLNLAVKELE

251 QAGNTLPAVE TVAASYRKAV EAGYGEQDVS GVYLKLAEH
```

The following partial DNA sequence was identified in *N. meningitidis* <SEQ ID 365>:

```
m105.seq
  1 ATGTCCGCAA ACGAATACGC ACAAATCGGC TGGaTAGGCT TAGGGCAAAT

51 GGGTCTGCCT ATGGTAACGC GGCTCTTGGA CGGCGGCATC GAAGTCGGCG

101 TATACAACCG CTCGCCCGAC AAAACTGCCC CCATCTCCGC CAAAGGCGCA

151 AAAGTTTACG GCAACACCGC CGAACTCGTC CGCGACTATC CCGTCATTTT

201 CCTGATGGTT TCCGACTATG CCGCCGTGTG CGACATCCTG AACGGAGTCC

251 GCGACGGATT GGCCGGCAAm ATCATCGTCA ACATGAGCAC CATCTCCCCG

301 ACCGAAAaGC TCGCCGTCAA AGCACTTGTC GAAGCGCAGm GaCAGTTTGC

351 CGAAGCACCC GTTTCCGGAT CGGTCGGGCC CGCCACCAAC GGCACGCTGC

401 TGATTCTGTT CGGCGGCAGC GAAcCGtTTT AAACCCGCTG CAAAAAATAT

451 TTTCCCTCGT CGGCAAAAAA ACCTTCCATT TCGGCGATGT CGGCAAAGGT

501 TCGGGCGCGA AACTCGTCTT GAACTCGCTC TTGGGCATTT TCGGCGAaCG

551 TAcAGCGAAs GmTgCTGATG GCGCGGCAGT TCGGCATCGA TACCGACACC

601 ATCGTCGAAG CCATCGGsGA CTCGGCAATG GACTCGCCCA TGTTCCAAAC

651 CAAAAAATCC CTGTGGGCAA ACCGCGAATT CCCGmCCGmC TTCGCCCTCA

701 AACACGCCTC CAAAGACCTC AACCTCGCCG TCAAAGAGCT TGAACAGGCA

751 GGCAACACCC TGCCCGCCGT CGAAACCGTT GCTGCCAGCT ACCGCAAAGC

801 AGTCGAAGCC GGCTACGGGA CACAGGACGT TTCCGGCGTT TACCTGAAAC

851 TGGCAGAACA CTGA
```

This corresponds to the amino acid sequence <SEQ ID 366; ORF 105>:

```
m105.pep
  1 MSANEYAQIG WIGLGQMGLP MVTRLLDGGI EVGVYNRSPD KTAPISAKGA

51 KVYGNTAELV RDYPVIFLMV SDYAAVCDIL NGVRDGLAGX IIVNMSTISP

101 TEKLAVKALV EAQRQFAEAP VSGSVGPATN GTLLILFGGS EPFXTRCKKY

151 FPSSAKKPSI SAMSAKVRAR NSSXTRSWAF SANVQRXXLM ARQFGIDTDT

201 IVEAIGDSAM DSPMFQTKKS LWANREFPXX FALKHASKDL NLAVKELEQA

251 GNTLPAVETV AASYRKAVEA GYGTQDVSGV YLKLAEH
```

Computer analysis of this amino acid sequence gave the following results:
Homology with a Predicted ORF from *N. gonorrhoeae*
ORF 105 shows 79.9% identity over a 289 aa overlap with a predicted ORF (ORF 105.ng) from *N. gonorrhoeae*:

```
m105/g105

10         20         30         40         50         60
   g105.pep MSAETYTQIGWVGLGQMGLPMVTRLLDGGIEVGVYNRSPDKTAPISAKGAKVYGSTAELV
            |||: |:||||:||||||||||||||||||||||||||||||||||||||:|||| 
   m105     MSANEYAQIGWIGLGQMGLPMVTRLLDGGIEVGVYNRSPDKTAPISAKGAKVYGNTAELV
                  10         20         30         40         50         60

70         80         90        100        110        120
   g105.pep RACPVIFLMVSDYAAVCDILNGVRDGLAGKIIVNMSTISPTENLAVKALVEAAGGQFAEA
            |  |||||||||||||||||||||||||| ||||||||||:|||||||||    ||||
   m105     RDYPVIFLMVSDYAAVCDILNGVRDGLAGXIIVNMSTISPTEKLAVKALVEAQR-QFAEA
                  70         80         90        100        110

130        140        150        160        170        180
   g105.pep PVSGSVGPATNGTLLILFGGSEAVLNPLQKIFSLVGKKTFHFGDVGKGSGAKLVLNSLLG
            ||||||||||||||||||||| : :|| | :|| : : :: |: :
   m105     PVSGSVGPATNGTLLILFGGSEPFXTRCKKYGPSSAKKP-SISAMSAKVRARNSSXTRSW
               120        130        140        150        160        170

190        200        210        220        230        240
   g105.pep IFGEAYSEAMLMARQFGIDTDTIVEAIGGSAMDSPMFQTKKSLWANREFPPAFALKHASK
            |:  :: ||||||||||||||||| |||||||||||||||||||||||  |||||||
   m105     AFSANVQRXXLMARQFGIDTDTIVEAIGDSAMDSPMFQTKKSLWANREFPXXFALKHASK
                  180        190        200        210        220        230

250        260        270        280  289
   g105.pep DLNLAVKELEQAGNTLPAVETVAASYRKAVEAGYGEQDVSGVYLKLAEH
            ||||||||||||||||||||||||||||||||||| ||||||||||||
   m105     DLNLAVKELEQAGNTLPAVETVAASYRKAVEAGYGTQDVSGVYLKLAEH
               240        250        260        270        280
```

The following partial DNA sequence was identified in *N. meningitidis* <SEQ ID 367>:

```
a105.seq
  1 ATGTCCGCAA ACGAATACAC ACAAATCGGC TGGATAGGCT TAGGGCAAAT

51 GGGTCTGCCT ATGGTAACGC GGCTCTTGGA CGGCGGCATC GAAGTCGGCG

101 TATACAACCG CTCGCCCGAC AAAACTGCCC CCATCTCCGC CAAAGGCGCA

151 AAAGTTTACG GCAACACCGC CGAACTCGTC CGCGACTATC CCGTCATTTT

201 CCTGATGGTT TCCGACTATG CCGCCGTGTG CGACATCCTG AACGGAGTCC

251 GCGACGGATT GGCCGGCAAA ATCATCGTCA ACATGAGCAC CATCTCCCCG

301 ACCGAAAACC TCGCCGTCAA AGCACTTGTC GAAGCCGCAG GCGGACAGTT

351 TGCCGAAGCA CCCGTTTCCG GATCGGTCGG GCCCGCCACC AACGGCACGC

401 TGCTGATTCT GTTCGGCGGC AGCGAAGCCG TTTTAAACCC GCTGCAAAAA
```

-continued

```
451 ATATTTTCCC TCGTCGGCAA AAAAACCTTC CATTTCGGCG ATGTCGGCAA

501 AGGTTCGGGC GCGAAACTCG TCTTGAACTC GCTCTTGGGC ATTTTCGGCG

551 AAGCGTACAG CGAAGCGATG CTGATGGCGC GGCAGTTCGG CATCGATACC

601 GACACCATCG TCGAAGCCAT CGGCGGCTCG GCAATGGACT CGCCCATGTT

651 CCAAACCAAA AAATCCCTGT GGGCAAACCG CGAATTCCCA CCCGCCTTCG

701 CCCTCAAACA CGCCTCCAAA GACCTCAACC TCGCCGTCAA AGAGCTTGAA

751 CAGGCAGGCA ACACCCTGCC CGCCGTCGAA ACCGTTGCTG CCAGCTACCG

801 CAAAGCAGTC GAAGCCGGCT ACGGCGAACA GGACGTTTCC GGCGTTTACC

851 TGAAATTGGC AGAACACTGA
```

This corresponds to the amino acid sequence <SEQ ID 368; ORF 105.a>:

```
a105.pep
     1 MSANEYTQIG WIGLGQMGLP MVTRLLDGGI EVGVYNRSPD KTAPISAKGA

51 KVYGNTAELV RDYPVIFLMV SDYAAVCDIL NGVRDGLAGK IIVNMSTISP

101 TENLAVKALV EAAGGQFAEA PVSGSVGPAT NGTLLILFGG SEAVLNPLQK

151 IFSLVGKKTF HFGDVGKGSG AKLVLNSLLG IFGEAYSEAM LMARQFGIDT

201 DTIVEAIGGS AMDSPMFQTK KSLWANREFP PAFALKHASK DLNLAVKELE

251 QAGNTLPAVE TVAASYRKAV EAGYGEQDVS GVYLKLAEH*
``` m105/a105  96.5% identity in 289 aa overlap

```
                  10         20         30         40         50         60
m105.pep    MSANEYAQIGWIGLGQMGLPMVTRLLDGGIEVGVYNRSPDKTAPISAKGAKVYGNTAELV
            ||||||:|||||||||||||||||||||||||||||||||||||||||||||||||||||
a105        MSANEYTQIGWIGLGQMGLPMVTRLLDGGIEVGVYNRSPDKTAPISAKGAKVYGNTAELV
                  10         20         30         40         50         60

70         80         90        100        110        119
m105.pep    RDYPVIFLMVSDYAAVCDILNGVRDGLAGKIIVNMSTISPTENLAVKALVEAAG-QFAEA
            ||||||||||||||||||||||||||||||||||||||||||||||||||||||| |||||
a105        RDYPVIFLMVSDYAAVCDILNGVRDGLAGKIIVNMSTISPTENLAVKALVEAAGGQFAEA
                  70         80         90        100        110        120

120        130        140        150        160        170        179
m105.pep    PVSGSVGPATNGTLLILFGGSEAVLNPLQKIFSLVGKKTFHFGDVGKGSGAKLVLNSLLG
            ||||||||||||||||||||||||||||||||||||||||||||||||||||||||||||
a105        PVSGSVGPATNGTLLILFGGSEAVLNPLQKIFSLVGKKTFHFGDVGKGSGAKLVLNSLLG
                 130        140        150        160        170        180

180        190        200        210        220        230
m105.pep    IFGDV-QRXMLMARQFGIDTDTIVEAIGDSAMDSPMFQTKKSLWANREFPXAFALKHASK
            |||::  :: ||||||||||||||||| |||||||||||||||||||||| |||||||||
a105        IFGEAYSEAMLMARQFGIDTDTIVEAIGGSAMDSPMFQTKKSLWANREFPPAFALKHASK
                 190        200        210        220        230        240

240        250        260        270        280
m105.pep    DLNLAVKELEQAGNTLPAVETVAASYRKAVEAGYGEQDVSGVYLKLAEHX
            ||||||||||||||||||||||||||||||||||||||||||||||||||
a105        DLNLAVKELEQAGNTLPAVETVAASYRKAVEAGYGEQDVSGVYLKLAEHX
                 250        260        270        280        290
```

The following partial DNA sequence was identified in *N. gonorrhoeae* <SEQ ID 369>:

```
g105-1.seq
    1 ATGTCCGCAG AAACATACAC ACAAATCGGC TGGGTAGGCT TAGGGCAAAT

51 GGGTCTGCCT ATGGTAACGC GGCTCTTGGA CGGCGGCATC GAAGTCGGCG

101 TATACAACCG CTCGCCCGAC AAAACTGCCC CCATCTCCGC CAAAGGAGCA
```

-continued

```
151 AAAGTTTACG GCAGCACCGC CGAACTCGTC CGCGCCTGCC CCGTCATTTT

201 CCTGATGGTT TCCGACTATG CCGCCGTGTG CGACATCCTG AACGGAGTCC

251 GCGACGGATT GGCCGGCAAA ATCATCGTCA ACATGAGCAC CATCTCCCCG

301 ACCGAAAACC TCGCCGTCAA AGCACTTGTC GAAGCCGCAG GCGGACAGTT

351 TGCCGAAGCA CCCGTTTCCG GATCGGTCGG ACCCGCCACC AACGGCACAC

401 TGCTGATTCT GTTCGGCGGC AGCGAAGCCG TTTTAAACCC GCTGCAAAAA

451 ATATTTTCCC TTGTCGGCAA AAAAACCTTC CATTTCGGCG ATGTCGGCAA

501 AGGCTCGGGC GCGAAACTCG TCTTGAACTC GCTCTTAGGC ATTTTCGGCG

551 AAGCGTACAG CGAAGCGATG CTGATGGCGC GGCAGTTCGG CATCGATACC

601 GACACCATCG TCGAAGCCAT CGGCGGCTCG GCAATGGACT CGCCTATGTT

651 TCAAACAAAA AAATCACTAT GGGCAAACCG TGAGTTCCCC CCTGCCTTTG

701 CACTCAAACA CGCTTCCAAA GACCTTAACC TCGCCGTCAA AGAGCTTGAA

751 CAGGCAGGCA ACACCCTGCC CGCCGTCGAA ACCGTTGCTG CCAGCTACCG

801 CAAAGCAGTT GAAGCCGGCT ACGGCGAACA GGACGTTTCC GGCGTTTACC

851 TGAAATTGGC AGAACACTGA
```

This corresponds to the amino acid sequence <SEQ ID 370; ORF 105-1.ng>:

```
g105-1.pep
  1 MSAETYTQIG WVGLGQMGLP MVTRLLDGGI EVGVYNRSPD KTAPISAKGA

51 KVYGSTAELV RACPVIFLMV SDYAAVCDIL NGVRDGLAGK IIVNMSTISP

101 TENLAVKALV EAAGGQFAEA PVSGSVGPAT NGTLLILFGG SEAVLNPLQK

151 IFSLVGKKTF HFGDVGKGSG AKLVLNSLLG IFGEAYSEAM LMARQFGIDT

201 DTIVEAIGGS AMDSPMFQTK KSLWANREFP PAFALKHASK DLNLAVKELE

251 QAGNTLPAVE TVAASYRKAV EAGYGEQDVS GVYLKLAEH*
```

The following partial DNA sequence was identified in *N. meningitidis* <SEQ ID 371>:

```
m105-1.seq
  1 ATGTCCGCAA ACGAATACGC ACAAATCGGC TGGATAGGCT TAGGGCAAAT

51 GGGTCTGCCT ATGGTAACGC GGCTCTTGGA CGGCGGCATC GAAGTCGGCG

101 TATACAACCG CTCGCCCGAC AAAACTGCCC CCATCTCCGC CAAAGGCGCA

151 AAAGTTTACG GCAACACCGC CGAACTCGTC CGCGACTATC CCGTCATTTT

201 CCTGATGGTT TCCGACTATG CCGCCGTGTG CGACATCCTG AACGGAGTCC

251 GCGACGGATT GGCCGGCAAA ATCATCGTCA ACATGAGCAC CATCTCCCCG

301 ACCGAAAACC TCGCCGTCAA AGCACTTGTC GAAGCCGCAG GCGGACAGTT

351 TGCCGAAGCA CCCGTTTCCG GATCGGTCGG GCCCGCCACC AACGGCACGC

401 TGCTGATTCT GTTCGGCGGC AGCGAAGCcG TTTTAAACCC GCTGCAAAAA

451 ATATTTTCCC TCGTCGGCAA AAAAACCTTC CATTTCGGCG ATGTCGGCAA

501 AGGTTCGGGC GCGAAACTCG TCTTGAACTC GCTCTTGGGC ATTTTCGGCG

551 AAGCGTACAG CGAAnCGATG CTGATGGCGC GGCAGTTCGG CATCGATACC

601 GACACCATCG TCGAAGCCAT CGGsGACTCG GCAATGGACT CGCCCATGTT
```

```
651 CCAAACCAAA AAATCCCTGT GGGCAAACCG CGAATTCCCG CCCGCCTTCG

701 CCCTCAAACA CGCCTCCAAA GACCTCAACC TCGCCGTCAA AGAGCTTGAA

751 CAGGCAGGCA ACACCCTGCC CGCCGTCGAA ACCGTTGCTG CCAGCTACCG

801 CAAAGCAGTC GAAGCCGGCT ACGGCGAACA GGACGTTTCC GGCGTTTACC

851 TGAAACTGGC AGAACACTGA
```

This corresponds to the amino acid sequence <SEQ ID 372; ORF 105-1>:

```
m105-1.pep

1   MSANEYAQIG WIGLGQMGLP MVTRLLDGGI EVGVYNRSPD KTAPISAKGA

51   KVYGNTAELV RDYPVIFLMV SDYAAVCDIL NGVRDGLAGK IIVNMSTISP

101   TENLAVKALV EAAGGQFAEA PVSGSVGPAT NGTLLILFGG SEAVLNPLQK

151   IFSLVGKKTF HFGDVGKGSG AKLVLNSLLG IFGEAYSEXM LMARQFGIDT

201   DTIVEAIGDS AMDSPMFQTK KSLWANREFP PAFALKHASK DLNLAVKELE

251   QAGNTLPAVE TVAASYRKAV EAGYGEQDVS GVYLKLAEH* mA05-1/g105-1  96.9% identity in 289 aa overlap 10         20         30         40         50         60
m105-1.pep   MSANEYAQIGWIGLGQMGLPMVTRLLDGGIEVGVYNRSPDKTAPISAKGAKVYGNTAELV
             |||: |:||||:||||||||||||||||||||||||||||||||||||||||:|||||
g105-1       MSAETYTQIGWVGLGQMGLPMVTRLLDGGIEVGVYNRSPDKTAPISAKGAKVYGSTAELV
                    10         20         30         40         50         60

70         80         90        100        110        120
m105-1.pep   RDYPVIFLMVSDYAAVCDILNGVRDGLAGKIIVNMSTISPTENLAVKALVEAAGGQFAEA
             |  ||||||||||||||||||||||||||||||||||||||||||||||||||||||||
g105-1       RACPVIFLMVSDYAAVCDILNGVRDGLAGKIIVNMSTISPTENLAVKALVEAAGGQFAEA
                    70         80         90        100        110        120

130        140        150        160        170        180
m105-1.pep   PVSGSVGPATNGTLLILFGGSEAVLNPLQKIFSLVGKKTFHFGDVGKGSGAKLVLNSLLG
             ||||||||||||||||||||||||||||||||||||||||||||||||||||||||||||
g105-1       PVSGSVGPATNGTLLILFGGSEAVLNPLQKIFSLVGKKTFHFGDVGKGSGAKLVLNSLLG
                   130        140        150        160        170        180

190        200        210        220        230        240
m105-1.pep   IFGEAYSEXMLMARQFGIDTDTIVEAIGDSAMDSPMFQTKKSLWANREFPPAFALKHASK
             ||||||||  ||||||||||||||||||| ||||||||||||||||||||||||||||||
g105-1       IFGEAYSEAMLMARQFGIDTDTIVEAIGGSAMDSPMFQTKKSLWANREFPPAFALKHASK
                   190        200        210        220        230        240

250        260        270        280        290
m105-1.pep   DLNLAVKELEQAGNTLPAVETVAASYRKAVEAGYGEQDVSGVYLKLAEHX
             ||||||||||||||||||||||||||||||||||||||||||||||||||
g105-1       DLNLAVKELEQAGNTLPAVETVAASYRKAVEAGYGEQDVSGVYLKLAEHX
                   250        260        270        280        290
```

The following partial DNA sequence was identified in N. meningitidis <SEQ ID 373>:

```
a105-1.seq
   1 ATGTCCGCAA ACGAATACAC ACAAATCGGC TGGATAGGCT TAGGGCAAAT

51 GGGTCTGCCT ATGGTAACGC GGCTCTTGGA CGGCGGCATC GAAGTCGGCG

101 TATACAACCG CTCGCCCGAC AAAACTGCCC CCATCTCCGC CAAAGGCGCA

151 AAAGTTTACG GCAACACCGC CGAACTCGTC CGCGACTATC CCGTCATTTT

201 CCTGATGGTT TCCGACTATG CCGCCGTGTG CGACATCCTG AACGGAGTCC

251 GCGACGGATT GGCCGGCAAA ATCATCGTCA ACATGAGCAC CATCTCCCCG

301 ACCGAAAACC TCGCCGTCAA AGCACTTGTC GAAGCCGCAG GCGGACAGTT
```

```
-continued
351 TGCCGAAGCA CCCGTTTCCG GATCGGTCGG GCCCGCCACC AACGGCACGC

401 TGCTGATTCT GTTCGGCGGC AGCGAAGCCG TTTTAAACCC GCTGCAAAAA

451 ATATTTTCCC TCGTCGGCAA AAAAACCTTC CATTTCGGCG ATGTCGGCAA

501 AGGTTCGGGC GCGAAACTCG TCTTGAACTC GCTCTTGGGC ATTTTCGGCG

551 AAGCGTACAG CGAAGCGATG CTGATGGCGC GGCAGTTCGG CATCGATACC

601 GACACCATCG TCGAAGCCAT CGGCGGCTCG GCAATGGACT CGCCCATGTT

651 CCAAACCAAA AAATCCCTGT GGGCAAACCG CGAATTCCCA CCCGCCTTCG

701 CCCTCAAACA CGCCTCCAAA GACCTCAACC TCGCCGTCAA AGAGCTTGAA

751 CAGGCAGGCA ACACCCTGCC CGCCGTCGAA ACCGTTGCTG CCAGCTACCG

801 CAAAGCAGTC GAAGCCGGCT ACGGCGAACA GGACGTTTCC GGCGTTTACC

851 TGAAATTGGC AGAACACTGA
```

This corresponds to the amino acid sequence <SEQ ID 374; ORF 105-1.a>:

```
a105-1.pep

1 MSANEYTQIG WIGLGQMGLP MVTRLLDGGI EVGVYNRSPD KTAPISAKGA

51 KVYGNTAELV RDYPVIFLMV SDYAAVCDIL NGVRDGLAGK IIVNMSTISP

101 TENLAVKALV EAAGGQFAEA PVSGSVGPAT NGTLLILFGG SEAVLNPLQK

151 IFSLVGKKTF HFGDVGKGSG AKLVLNSLLG IFGEAYSEAM LMARQFGIDT

201 DTIVEAIGGS AMDSPMFQTK KSLWANREFP PAFALKHASK DLNLAVKELE

251 QAGNTLPAVE TVAASYRKAV EAGYGEQDVS GVYLKLAEH* a105-1/m105-1  99.0% identity in 289 aa overlap 10         20         30         40         50         60
a105-1.pep  MSANEYAQIGWIGLGQMGLPMVTRLLDGGIEVGVYNRSPDKTAPISAKGAKVYGNTAELV
            ||||||:|||||||||||||||||||||||||||||||||||||||||||||||||||||
m105-1      MSANEYTQIGWIGLGQMGLPMVTRLLDGGIEVGVYNRSPDKTAPISAKGAKVYGNTAELV
                   10         20         30         40         50         60

70         80         90        100        110        120
a105-1.pep  RDYPVIFLMVSDYAAVCDILNGVRDGLAGKIIVNMSTISPTENLAVKALVEAAGGQFAEA
            ||||||||||||||||||||||||||||||||||||||||||||||||||||||||||||
m105-1      RDYPVIFLMVSDYAAVCDILNGVRDGLAGKIIVNMSTISPTENLAVKALVEAAGGQFAEA
                   70         80         90        100        110        120

130        140        150        160        170        180
a105-1.pep  PVSGSVGPATNGTLLILFGGSEAVLNPLQKIFSLVGKKTFHFGDVGKGSGAKKVLNSLLG
            |||||||||||||||||||||||||||||||||||||||||||||||||||| |||||||
m105-1      PVSGSVGPATNGTLLILFGGSEAVLNPLQKIFSLVGKKTFHFGDVGKGSGAKLVLNSLLG
                  130        140        150        160        170        180

190        200        210        220        230        240
a105-1.pep  IFGEAYSEAMLMARQFGIDTDTIVEAIGGSAMDSPMFQTKKSLWANREFPPAFALKHASK
            ||||||||| ||||||||||||||||||:|||||||||||||||||||||||||||||||
m105-1      IFGEAYSEXMLMARQFGIDTDTIVEAIGDSAMDSPMFQTKKSLWANREFPPAFALKHASK
                  190        200        210        220        230        240

250        260        270        280        290
a105-1.pep  DLNLAVKELEQAGNTLPAVETVAASYRKAVEAGYGEQDVSGVYLKLAEHX
            ||||||||||||||||||||||||||||||||||||||||||||||||||
m105-1      DLNLAVKELEQAGNTLPAVETVAASYRKAVEAGYGEQDVSGVYLKLAEHX
                  250        260        270        280        290
```

The following partial DNA sequence was identified in *N. gonorrhoeae* <SEQ ID 375>:

```
g107.seq
    1 ATGGTATTAA CCTTTATTTG GGCAACCGGC GGCCTGGTTG CCGATGCCAA
```

```
-continued
 51 ACCGTCCGTC CTCTTCGACA CCCAAGCCCC CGTCGGCACC GGCTACTGGA

101 TTTACGCCGC CACCGCCCTG CCCGTCTGCC TCGCTTCCTT CGGCTTCCAC

151 GGCAACGTTT CCAGCCTGCT CAAATACTTT AAAGGCGACG cgCcaaagt

201 GgCGAaATCc atctggGcag gtacattggT TGCCttggta atttacgtcc

251 TCTggcaaac cgccatCcaa agcaaccTGC cgcgcaacga gttcgcCCCc 301 gtgattgccg ccgagaggca actCTCCGTC CTgaatgaaa cccTGtccaa 351 attcgcccaa accggcgata tggataAaat attgtcccta tttccctaca 401 tggcaatcgc cacctccttt ttaggcgTAA Ccttaggcct gtttgacaac 451 atcgccggac atcttcaaat ggaacgacag tatgtccggg cggcaccaaa 501 accgtcgcgc tga
```

This corresponds to the amino acid sequence <SEQ ID 376; ORF 107.ng>:

```
g107.pep
  1 MVLTFIWATG GLVADAKPSV LFDTQAPVGT GYWIYAATAL PVCLASFGFH

51 GNVSSLLKYF KGDAPKVAKS IWAGTLVALV IYVLWQTAIQ SNLPRNEFAP

101 VIAAERQLSV LNETLSKFAQ TGDMDKILSL FPYMAIATSF LGVTLGLFDN

151 IAGHLQMERQ YVRAAPKPSR *
```

The following partial DNA sequence was identified in *N. meningitidis* <SEQ ID 377>:

```
m107.seq
  1 ATGGTATTGA CCTTTATTTG GGCGGCCGGC GGGCTGATTG CCGATGCCAA

51 GCCGTCCGTC CTCTTCGATA CCCAAGCCCC CGCCGGCACA AACTACTGGA

101 TTTACGCCGs CACCGCCCTG CCCGTCTGCC TCGCTTCCTT CGGCTTCCAC

151 GGCAACGTCT CCAGCCTGCT CAAATACTTT AAAGGCGACG CGCCCAAAGT

201 GGCTAAATCC ATCTGGACGG GCACACTGAT TGCGCTGGTA ATTTACGTCC

251 TCTGGCAAAC CGCCATCCAA GGCAACCTGC CGCGCAACGA GTTCGCCCCC

301 GTCATCGCCG CCGAAGGGCA AGTCTCCGTC CTCATCGAAA CCCTGTCCAA

351 ATTCGCCCAA ACCGGCAATA TGGACAAAAT ATTGTCCCTG TTTTCCTATA

401 TGGCGATCGC CACCTCGTTT TTAGGCGTAA CGCTCGGACT CTTCGACTAC

451 ATCGCCCATC TTCAAATGGA ACGACAGCAT CTCCGGgCCG CACCAAAACC

501 GCCGCGCTGA
```

This corresponds to the amino acid sequence <SEQ ID 378; ORF 107>:

```
m107.pep . . .
    1 MVLTFIWAAG GLIADAKPSV LFDTQAPAGT NYWIYAXTAL PVCLASFGFH

51 GNVSSLLKYF KGDAPKVAKS IWTGTLIALV IYVLWQTAIQ GNLPRNEFAP

101 VIAAEGQVSV LIETLSKFAQ TGNMDKILSL FSYMAIATSF LGVTLGLFDY

151 IAHLQMERQH LRAAPKPPR*
```

Computer analysis of this amino acid sequence gave the following results:
Homology with a Predicted ORF from *N. gonorrhoeae*
ORF 107 shows 89.4% identity over a 170 aa overlap with a predicted ORF (ORF 107.ng) from *N. gonorrhoeae*:

```
m107/g107

10         20         30         40         50         60
  m107.pep  MVLTFIWAAGGLIADAKPSVLFDTQAPAGTNYWIYAXTALPVCLASFGFHGNVSSLLKYF
            ||||||||:|||:||||||||||||||:||:||||| ||||||||||||||||||||||||
  g107      MVLTFIWATGGLVADAKPSVLFDTQAPVGTGYWIYAATALPVCLASFGFHGNVSSLLKYF
                  10         20         30         40         50         60

70         80         90        100        110        120
  m107.pep  KGDAPKVAKSIWTGTLIALVIYVLWQTAIQGNLPRNEFAPVIAAEGQVSVLIETLSKFAQ
            |||||||||||:|||:|||||||||||||:|||||||||||||| |:||| ||||||||
  g107      KGDAPKVAKSIWAGTLVALVIYVLWQTAIQSNLPRNEFAPVIAAERQLSVLNETLSKFAQ
                  70         80         90        100        110        120

130        140        150        160        170
  m107.pep  TGNMDKILSLFSYMAIATSFLGVTLGLFDYIA-HLQMERQHLRAAPKPPR
            ||:||||||||  ||||||||||||||||| || |||||||::|||||| |
  g107      TGGMDKILSLFPYMAIATSFLGVTLGLFDNIAGHLQMERQYVRAAPKPPR
                 130        140        150        160        170
```

The following partial DNA sequence was identified in *N. meningitidis* <SEQ ID 379>:

```
a107.seq
   1 ATGGTATTAA CCTTTATTTG GGCAACCGGC GGCCTGATTG CCGATGCCAA

51 ACTGCCCGTC CTCTTCGACA CCCAAGCCCC TACCGGCACC AACTACTGGA

101 TTTATGTCGC CACCGCCCTG CCCGTCTGCC TTGCGTCATT CGGTTTCCAC

151 GGCAACGTCT CCAGCCTGCT CAAATACTTT AAAGGCGACG CGCCCAAAGT

201 GGCTAAATCC ATCTGGACGG GCACACTGAT TGCGCTGGTA ATTTACGTCC

251 TCTGGCAAAC CGCCATCCAA GGCAACCTGC CGCGCAACGA GTTCGCCCCC

301 GTGATTGCCG CCGAAGGGCA AGTCTCCGTC CTGATTGAAA CCCTGTCCAA

351 ATTCGCCCAA ACCGGCAATA TGGACAAAAT ATTGTCCCTG TTTTCCTATA

401 TGGCGATCGC CACCTCGTTT TTAGGCGTAA CGCTCGGACT CTTCGACTAC

451 ATCGCCGACA TCTTCAAATG GAACGACAGC GTGTCCGGCC GCACCAAAAC

501 CGCCGCGCTG ACCTTCCTGC CGCCTCTAAT TTCCTGCCTG CTCTTCGACA

551 CCGGCTTTGT TACCGCCATC GGCTACGTCG GCCTGGCGGC AACCGTCTGG

601 ACAGGCATCA TCCCCGCCAT GCTGCTCTAC CGTTCGCGCA AAAAATTCGG

651 CGCAGGCAAA ACCTATAAAG TTTACGGCGG CTTGTGGCTG ATGGTTTGGG

701 TCTTCCTTTT CGGCATCGTC AACATCGCCG CACAGGTATT GAGCCAAATG

751 GAACTCGTCC CCGTATTTAA AGGATAA
```

This corresponds to the amino acid sequence <SEQ ID 380; ORF 107.a>:

```
a107.pep

1 MVLTFIWATG GLIADAKLPV LFDTQAPTGT NYWIYVATAL PVCLASFGFH

51 GNVSSLLKYF KGDAPKVAKS IWTGTLIALV IYVLWQTAIQ GNLPRNEFAP

101 VIAAEGQVSV LIETLSKFAQ TGNMDKILSL FSYMAIATSF LGVTLGLFDY

151 IADIFKWNDS VSGRTKTAAL TFLPPLISCL LFPTGFVTAI GYVGLAATVW
```

-continued
```
    201 TGIIPAMLLY RSRKKFGAGK TYKVYGGLWL MVWVFLFGIV NIAAQVLSQM

251 ELVPVFKG*
``` m107/a107  94.8% identity in 154 aa overlap

```
                 10         20         30         40         50         60
    m107.pep  MVLTFIWAAGGLIADAKPSVLFDTQAPAGTNYWIYAXTALPVCLASFGFHGNVSSLLKYF
              ||||||| :||||||||| |||||||||:||||||| : ||||||||||||||||||||
    a107      MVLTFIWATGGLIADAKLPVLFDTQAPTGTNYWIYVATALPVCLASFGFHGNVSSLLKYF
                 10         20         30         40         50         60

70         80         90        100        110        120
    m107.pep  KGDAPKVAKSIWTGTLIALVIYVLWQTAIQGNLPRNEFAPVIAAEGQVSVLIETLSKFAQ
              ||||||||||||||||||||||||||||||||||||||||||||||||||||||||||||
    a107      KGDAPKVAKSIWTGTLIALVIYVLWQTAIQGNLPRNEFAPVIAAEGQVSVLIETLSKFAQ
                 70         80         90        100        110        120

130        140        150        160        170
    m107.pep  TGNMDKILSLFSYMAIATSFLGVTLGLFDYIAHLQMERQHLRAAPKPPRX
              |||||||||||||||||||||||||||||||| :
    a107      TGNMDKILSLFSYMAIATSFLGVTLGLFDYIADIFKWNDSVSGRTKTAALTFLPPLISCL
                130        140        150        160        170        180 a107      LFPTGFVTAIGYVGLAATVWTGIIPAMLLYRSRKKFGAGKTYKVYGGLWLMVWVFLFGIV
                190        200        210        220        230        240
```

The following partial DNA sequence was identified in *N. gonorrhoeae* <SEQ ID 381>:

```
g108.seq
    1 ATGttgccgg gCTTCAACCG GATATTCAaa cggTTTGCTC CAACACTCGG

51 AAcggCGCAT AAAACGCCgc ccTTCGCGTT ATCCCGAACG GGGCGGCTAA

101 TCAGATCCTA TCGCCATAAA AGGCGGGGTT TCAACCGAAA AGGAATTGAG

151 ATGAATAAAA CCTTGTCTAT TTTGCCGGCG GCAATCTTAC TCGGCGGGTG

201 CGCCGCCGGC GGCAACACAT TCGGCAGCTT AGACGGCGGC ACGGGTATGG

251 GTGGCAGCAT CGTCAAAATG ACGGTAGAAA gccAATGCCG TGCGGAATTG

301 GACAGGCGCA GCGAATGGCG TTTGACCGCG CTGGCGATGA GTGCCGAAAA

351 ACAGGCGGAA TGGGAAAACA AGATTTGCGG CTGCGCTACC GAAGAAGCAC

401 CTAACCAGCT GACCGGCAAC GATGTGATGC AGATGCTGAa ccagtccacG

451 CGCaatcagg cacTtgccgc CCtgaccgTC AAAacggtTT CcgcctgcTT

501 CAaacgcctg tACCGCTAa
```

This corresponds to the amino acid sequence <SEQ ID 382; ORF 108.ng>:

```
g108.pep
    1 MLPGFNRIFK RFAPTLGTAH KTPPFALSRT GRLIRSYRHK RRGFNRKGIE

51 MNKTLSILPA AILLGGCAAG GNTFGSLDGG TGMGGSIVKM TVESQCRAEL

101 DRRSEWRLTA LAMSAEKQAE WENKICGCAT EEAPNQLTGN DVMQMLNQST

151 RNQALAALTV KTVSACFKRL YR*
```

The following partial DNA sequence was identified in *N. meningitidis* <SEQ ID 383>:

```
m108.seq
    1 ATGTTGCCGG GCTTCAACCG GATATTCAAA CGGTTTGTTC CAACACTCGG

51 AACGGCGCAT AAAACGCCGC CCTTCGCGTT ATCCCGAACG GGGCGGCTAA

101 TCAGATTCTA TCGCCATAAA AGGCGGGGTT TCAACCGAAA AGGAATTGAG
```

-continued

```
151 ATGAATAAAA CCTTGTCTAT TTTGCCGGTG GCAATCTTAC TCGGCGGCTG

201 CGCCGCCGGA GGCGGTAACA CATTCGGCAG CTTAGACGGT GGCACAGGCA

251 TGGGCGGCAG CATCGTCAAA ATGGCGGTTG GGAGCCAATG CCGTGCGGAA

301 TTGGACAAAC GCAGCGAATG GCGTTTGACC GCGCTGGCGA TGAGTGCCGA

351 AAAACAGGCG GAGTGGGAAA ACAAGATTTG CGCTTGCGTC GCCCAAGAAG

401 CACCCGAACG GATGACCGGC AACGATGTGA TGCAGATGCT GGCTCCGTCC

451 ACGCGCAATC AGGCACTTGC CGCCCTGACC GCCAAAACGG TTTCCGCCTG

501 CTTCAAACAC CTGTACCGCT AA
```

This corresponds to the amino acid sequence <SEQ ID 384; ORF 108>:

```
m108.pep
  1 MLPGFNRIFK RFVPTLGTAH KTPPFALSRT GRLIRFYRHK RRGFNRKGIE

51 MNKTLSILPV AILLGGCAAG GGNTFGSLDG GTGMGGSIVK MAVGSQCRAE

101 LDKRSEWRLT ALAMSAEKQA EWENKICACV AQEAPERMTG NDVMQMLAPS

151 TRNQALAALT AKTVSACFKH LYR*
```

Computer analysis of this amino acid sequence gave the following results:

Homology with a Predicted ORF from *N. gonorrhoeae*
ORF 108 shows 89.6% identity over a 173 aa overlap with a predicted ORF (ORF 108.ng) from *N. gonorrhoeae*:

```
m108/g108

10         20         30         40         50         60
m108.pep    MLPGFNRIFKRFVPTLGTAHKTPPFALSRTGRLIRFYRHKRRGFNRKGIEMNKTLSILPV
            ||||||||||:|||||||||||||||||||| ||||||||||||||||||||||||||:
g108        MLPGFNRIFKRFAPTLGTAHKTPPFALSRTGRLIRSYRHKRRGFNRKGIEMNKTLSILPA
                    10         20         30         40         50         60
                    70         80         90        100        110        120
m108.pep    AILLGGCAAGGGNTFGSLDGGTGMGGSIVKMAVGSQCRAELDKRSEWRLTALAMSAEKQA
            ||||||||||| |||||||||||||||||||:| ||||||||:|||||||||||||||
g108        AILLGGCAAGG-NTFGSLDGGTGMGGSIVKMTVESQCRAELDRRSEWRLTALAMSAEKQA
                    70         80         90        100        110
                   130        140        150        160        170
m108.pep    EWENKICACVAQEAPERMTGNDVMQMLAPSTRNQALAALTAKTVSACFKHLYRX
            ||||||:|:::||:::|||||||||||| ||||||||||:||||||||:|||
g108        EWENKICGCATEEAPNQLTGNDVMQMLNQSTRNQALAALTVKTVSACFKRLYRX
                   120        130        140        150        160        170
```

The following partial DNA sequence was identified in *N. meningitidis* <SEQ ID 385>:

```
a108.seq
  1 ATGTTGCCGG GCTTCAACCG GATATTCAAA CGGTTTGTTC CAACACTCGG

51 AACGGCGCAT AAAACGCCGC CCTTCGCGTT ATCCCGAACG GGGCGGCTAA

101 TCAGATTCTA TCGCCATAAA AGGCGGGGTT TCAACCGAAA AGGAATTGAG

151 ATGAATAAAA CCTTGTCTAT TTTGCCGGTG GCAATCTTAC TCGGCGGCTG

201 CGCCGCCGGG GGCGGTAACA CATTCGGCAG CTTAGACGGC GGCACAGGTA

251 TGGGCGGCAG CATCGTCAAA ATGGCGGTAG AAAGCCAATG CCGTGCGGAA

301 TTGAACAAAC GCAGCGAATG GCGTTTGACC GCGCTGGCGA TGAGTGCCGA
```

-continued
```
351 AAAACAGGCG GAATGGGAAA ACAAGATTTG CGCTTGCGTC GCCCAAGAAG

401 CACCCAACCA GCTGACCGGC AACGATGTGA TGCAGATGCT GGATCCGTCC

451 ACGCGCAATC AGGCACTTGC CGCCCTGACC GCCAAAACGG TTTCCGCCTG

501 CTTCAAACAC CTGTACCGCT AA
```

This corresponds to the amino acid sequence <SEQ ID 386; ORF 108.a>:

```
a108.pep
      1  MLPGFNRIFK RFVPTLGTAH KTPPFALSRT GRLIRFYRHK RRGFNRKGIE

51  MNKTLSILPV AILLGGCAAG GGNTFGSLDG GTGMGGSIVK MAVESQCRAE

101  LNKRSEWRLT ALAMSAEKQA EWENKICACV AQEAPNQLTG NDVMQMLDPS

151  TRNQALAALT AKTVSACFKH LYR* m108/a108  96.5% identity in 173 aa overlap 10         20         30         40         50         60
m108.pep  MLPGFNRIFKRFVPTLGTAHKTPPFALSRTGRLIRFYRHKRRGFNRKGIEMNKTLSILPV
          ||||||||||||||||||||||||||||||||||||||||||||||||||||||||||||
a108      MLPGFNRIFKRFVPTLGTAHKTPPFALSRTGRLIRFYRHKRRGFNRKGIEMNKTLSILPV
                  10         20         30         40         50         60

70         80         90        100        110        120
m108.pep  AILLGGCAAGGGNTFGSLDGGTGMGGSIVKMAVGSQCRAELDKRSEWRLTALAMSAEKQA
          ||||||||||||||||||||||||||||||||||||  :|||||||||||||||||||||
a108      AILLGGCAAGGGNTFGSLDGGTGMGGSIVKMAVESQCRAELNKRSEWRLTALAMSAEKQA
                  70         80         90        100        110        120

130        140        150        160        170
m108.pep  EWENKICACVAQEAPERMTGNDVMQMLAPSTRNQALAALTAKTVSACFKHLYRX
          ||||||||||||||:::||||||||||||| |||||||||||||||||||||||
a108      EWENKICACVAQEAPNQLTGNDVMQMLDPSTRNQALAALTAKTVSACFKHLYRX
                 130        140        150        160        170
```

The following partial DNA sequence was identified in *N. gonorrhoeae* <SEQ ID 387>:

```
g109.seq
  1 ATGTATTATC GCCGGGTTGT GGGGCTATCC GATGGACTTG GCGATTTGGC

51 AGCCGGTATT GATCGTAGGC GTATGCTTAC CGCTTTTGGA AGCGGGCATG

101 GAAATGACGC GCAAAGGCAA AACCACCCAA TCCGCCGCCA TCGTGGTGTT

151 CTCTTCCGTC TGGTCAATCC GGTTTTCGGC TGGGCGTTGA CGATGCTGTT

201 GGATAATTTG GCTTAATCG GCTGCAAAGA ACGCAGCGCG CAATTAGGTT

251 TTGTCGGACG AGTATTGATA CCCGCAGTAG GTTTCTTAAT CTTGTGTGTG

301 GCGATGGGTG CGGTCGGGAT GCTGCCCGGT ATCCCTCCGT TTTTGGAGCA

351 GTTCAAATCT TTGGGCTAG
```

This corresponds to the amino acid sequence <SEQ ID 388; ORF 109.ng>:

```
g109.pep
  1 MYYRRVVGLS DGLGDLAAGI DRRRMLTAFG SGHGNDAQRQ NHPIRRHRGV

51 LFRLVNPVFG WALTMLLDNL GLIGCKERSA QLGFVGRVLI PAVGFLILCV

101 AMGAVGMLPG IPPFLEQFKS LG
```

The following partial DNA sequence was identified in *N. meningitidis* <SEQ ID 389>:

```
m109.seq
   1 ATGTATTATC GCCGGGTTAT GGGGCTATCC GATGGACTTG GCGATTTGGC

51 AGCCGGTATT GAGCGTAGCC TTGGTCGTAG GCGTATACTT ACCGCTTTTG

101 GAAGCGGGCA TGGAAATGAC GCGCAAAGGC AAAACCACCC AATCCGCCGC

151 CATCGTGGTG TTCTCTTCCG CCTTGTCAAT CCGGTTTTCG GCTGGGCGTT

201 GACGATGCTG TTGGATAATT TGGGCTTAAT CGGCTGCAAA GAGCGCAGTG

251 CGCAATTAGG TTTCGCCGGA CGCGTGTTGA TACCCGCAGT AGGTTTCTTG

301 ATCTTGTGTG TGGCGATGGG TGCGGTCGGG ATGCTGCCCG GTATCCCGCC

351 GTTTTTGGAA CACTTCAAAT CTTTGGGCTA G
```

This corresponds to the amino acid sequence <SEQ ID 4; ORF 109>:

```
m109.pep
   1 MYYRRVMGLS DGLGDLAAGI ERSLGRRRIL TAFGSGHGND AQRQNHPIRR

51 HRGVLFRLVN PVFGWALTML LDNLGLIGCK ERSAQLGFAG RVLIPAVGFL

101 ILCVAMGAVG MLPGIPPFLE HFKSLG*
```

Computer analysis of this amino acid sequence gave the following results:

Homology with a Predicted ORF from *N. gonorrhoeae*
ORF 109 shows 92.9% identity over a 126 aa overlap with a predicted ORF (ORF 109.ng) from *N. gonorrhoeae*:

```
m109/g109

10         20         30         40         50         60
    m109.pep  MYYRRVMGLSDGLGDLAAGIERSLGRRRILTAFGSGHGNDAQRQNHPIRRHRGVLFRLVN
              ||||||:|||||||||||||:|    ||:||||||||||||||||||||||||||||||
    g109      MYYRRVVGLSDGLGDLAAGIDR----RRMLTAFGSGHGNDAQRQNHPIRRHRGVLFRLVN
                  10         20             30         40         50

70         80         90        100        110        120
    m109.pep  PVFGWALTMLLDNLGLIGCKERSAQLGFAGRVLIPAVGFLILCVAMGAVGMLPGIPPFLE
              ||||||||||||||||||||||||||||||:|||||||||||||||||||||||||||||
    g109      PVFGWALTMLLDNLGLIGCKERSAQLGFVGRVLIPAVGFLILCVAMGAVGMLPGIPPFLE
                  60         70         80         90        100        110 m109.pep  HFKSLGX
              :|||||
    g109      QFKSLGX
                 120
```

The following partial DNA sequence was identified in *N. meningitidis* <SEQ ID 391>:

```
a109.seq
   1 ATGTATTATC GCCGGGTTGT GGGGCTATCC GATGGACTTG GCGATTTGGC

51 AGCCGGTATT GAGCGTAGCC TTGGTCGTAG GCGTATACTT ACCGCTTTTG

101 GAAGCGGGCA TGGAAATGAC GCGCAAAGGC AAAACCACCC AATCCGCCGC

151 CACCGTGGTG TTCTCTTCCG CTTGGTCAAT CCGGTTTTCG GCTGGGCGTT

201 GACGATGCTG TTGGATAATT TGGGCTTAAT CGGCTGCAAA GAGCGCAGCG

251 CGCAATTAGG TTTCACCGGA CGCGTATTGA TACCCGTAGT AGGTTTCTTG
```

```
-continued
301 ATCTTGTGTG TGGCGATGGG TGCGGTCGGG ATGCTGCCCG GTATCCCGCC

351 GTTTTTGGAG CACTTCAAAT CTTTGGGCTA G
```

This corresponds to the amino acid sequence <SEQ ID 392; ORF 109>:

```
a109.pep

1 MYYRRVVGLS DGLGDLAAGI ERSLGRRRIL TAFGSGHGND AQRQNHPIRR
    51 HRGVLFRLVN PVFGWALTML LDNLGLIGCK ERSAQLGFTG RVLIPVVGFL
   101 ILCVAMGAVG MLPGIPPFLE HFKSLG* m109/a109 97.6% identity in 126 aa overlap 10         20         30         40         50         60
m109.pep   MYYRRVMGLSDGLGDLAAGIERSLGRRRILTAFGSGHGNDAQRQNHPIRRHRGVLFRLVN
           ||||||:|||||||||||||||||||||||||||||||||||||||||||||||||||||
a109       MYYRRVVGLSDGLGDLAAGIERSLGRRRILTAFGSGHGNDAQRQNHPIRRHRGVLFRLVN
                 10         20         30         40         50         60

70         80         90        100        110        120
m109.pep   PVFGWALTMLLDNLGLIGCKERSAQLGFAGRVLIPAVGFLILCVAMGAVGMLPGIPPFLE
           |||||||||||||||||||||||||||||:||||||:|||||||||||||||||||||||
a109       PVFGWALTMLLDNLGLIGCKERSAQLGFTGRVLIPVVGFLILCVAMGAVGMLPGIPPFLE
                 70         80         90        100        110        120 m109.pep   HFKSLGX
           |||||||
a109       HFKSLGX
```

The following partial DNA sequence was identified in *N. gonorrhoeae* <SEQ ID 393>:

```
g111.seq
    1 ATGCCGTCTG AAACACGCCT GCCGAACCTT ATCCGCGCCT TGATATTTGC

51 CCTGGGTTTC ATCTTCCTGA ACGCCTGTTC GGaacaaacC GCGCAaaccg

101 TTACCCTGCA AGGCGAAACG ATGGGTACGA CCtATACCGT CAAATACCTT

151 TCAAATAATC GGGACAAACT CCCCTCCCCT GCCAAAATAC AAAAGCGCAT

201 TGATGATGCG CTTAAAGAAG TCAACCGGCA GATGtccaCC TACCAGACCG

251 ATTCCGAAAT CAGCCGGTTt atacagacan atgctggaga gctcttcgcg 301 tntcatgcag nttctataac tgattccgcc gaagactgtc tgcctaatac 351 gcctatctca tcggcgctct ga
```

This corresponds to the amino acid sequence <SEQ ID 394; ORF 111.ng>:

```
g111.pep
    1 MPSETRLPNL IRALIFALGF IFLNACSEQT AQTVTLQGET MGTTYTVKYL

51 SNNRDKLPSP AKIQKRIDDA LKEVNRQMST YQTDSEISRF IQTAGELFAH

101 ASITDSAEDC LPNTPISSAL *
```

The following partial DNA sequence was identified in *N. meningitidis* <SEQ ID 395>:

```
m111.seq
    1 ATGCCGTCTG AAACACGCCT GCCGAACTTT ATCCGCGTCT TGATATTTGC
```

-continued

```
  51 CCTGGGTTTC ATCTTCCTGA ACGCCTGTTC GGAACAAACC GCGCAAACCG

101 TTACCCTGCA AGGCGAAACG ATGGGCACGA CCTATAyCGT CAAATACCTT

151 TCAAATAATC GGGACAAACT CCCCTCACCT GCCGAAATAC AwAAACGCAT

201 CGATGACGCG CTTAAAGAAk TCAACCGGyA GATGTCCACC TATCAGCCCG

251 ACTCCGAAAT CAGCCGGTTC AACCAACACA CAGCCGGCAA GCCCCTCCGC

301 ATTTCAAGCG ACTTCGCACA CGTTACTGCC GAAGCCGTCC GCCTGAACCG

351 CCTGACACAC GGCGCGCTGG ACGTAACCGT CGGCCCCTTG GTCAACCTTT

401 GGGGATTCGG CCCCGACAAA TCCGTTACCC GTGAACCGTC GCCGGAACAA

451 ATCAAACAGG CGGCATCTTA TACGGGCATA GACAAAATCA TTTTGAAACA

501 AGGCAAAGAT TACGCTTCCT TGAGCAAAAC CCACCCCAAG GCCTATTTGG

551 ATTTATCTTC GATTGCCAAA GGCTTCGGCG TTGATAAAGT TGCGGGCGAA

601 CTGGAAAAAT ACGGCATTCA AAATTATCTG GTCGAAATCG GCGGCGAGTT

651 GCACGGCAAA GGCAAAAACG CGCGCGGCGA ACCGTGGCGC ATCGGTATCG

701 AGCAGCCCAA TATCGTCCAA GGCGGCAATA CGCAGATTAT CGTCCCGCTG

751 AACAACCGTT CGCTTGCCAC TTCCGGCGAT TACCGTATTT CCACGTCGA

801 TAAAAACGGC AAACGCCTCT CCCATATCAT CAACCCGAAC AACAAACGAC

851 CCATCAGCCA CAACCTCGCC TCCATCAGCG TGGTCGCAGA CAGTGCGATG

901 ACGGCGGACG GCTTGTCCAC AGGATTATTC GTATTGGGCG AAACCGAAGC

951 CTTAAAGCTG GCAGAGCGCG AAAAACTCGC TGTTTTCCTG ATTGTCAGGG

1001 ATAAAGGCGG cTACCGCACC GCCATGTCTT CCGAATTTGA AAAACTGcTC

1051 CGCTAA
```

This corresponds to the amino acid sequence <SEQ ID 396; ORF 111>:

```
m111.pep
  1 MPSETRLPNF IRVLIFALGF IFLNACSEQT AQTVTLQGET MGTTYXVKYL

51 SNNRDKLPSP AEIXKRIDDA LKEXNRXMST YQPDSEISRF NQHTAGKPLR

101 ISSDFAHVTA EAVRLNRLTH GALDVTVGPL VNLWGFGPDK SVTREPSPEQ

151 IKQAASYTGI DKIILKQGKD YASLSKTHPK AYLDLSSIAK GFGVDKVAGE

201 LEKYGIQNYL VEIGGELHGK GKNARGEPWR IGIEQPNIVQ GGNTQIIVPL

251 NNRSLATSGD YRIFHVDKNG KRLSHIINPN NKRPISHNLA SISVVADSAM

301 TADGLSTGLF VLGETEALKL AEREKLAVFL IVRDKGGYRT AMSSEFEKLL

351 R*
```

ORF 111 shows 88.7% identity over a 97 aa overlap with a predicted ORF (ORF 111.ng) from *N. gonorrhoeae*:

```
    m111.pep/g111.pep 10         20         30         40         50         60
         m111.pep MPSETRLPNFIRVLIFALGFIFLNACSEQTAQTVTLQGETMGTTYXVKYLSNNRDKLPSP
                  ||||||||||:||:||||||||||||||||||||||||||||||||:|||||||||||||
         g111     MPSETRLPNLIRALIFALGFIFLNACSEQTAQTVTLQGETMGTTYTVKYLSNNRDKLPSP
                      10         20         30         40         50         60
```

-continued

```
                  70        80        90        100       110       120
m111.pep  AEIXKRIDDALKEXNRXMSTYQPDSEISRFNQHTAGKPLRISSDFAHVTAEAVRLNRLTH
          |:| ||||||||| || ||||| ||||||| | :||:
g111      AKIQKRIDDALKEVNRQMSTYQTDSEISRFIQTXAGELFAXHAXSITDSAEDCLPNTPIS
                  70        80        90        100       110       120
                   130       140       150       160       170       180
m111.pep   GALDVTVGPLVNLWGFGPDKSVTREPSPEQIKQAASYTGIDKIILKQGKDYASLSKTHPK g111       SALX
```

The following partial DNA sequence was identified in *N. meningitidis* <SEQ ID 397>:

```
a111.seq
   1 ATGCCGTCTG AAACACGCCT GCCGAACTTT ATCCGCACCT TGATATTTGC

51 CCTGAGTTTT ATCTTCCTGA ACGCCTGTTC GGAACAAACC GCGCAAACCG

101 TTACCCTGCA AGGTGAAACG ATGGGCACGA CCTATACCGT CAAATACCTT

151 TCAAATAATC GGGACAAACT CCCCTCACCT GCCGAAATAC AAAAGCGCAT

201 CGATGACGCG CTTAAAGAAG TCAACCGGCA GATGTCCACC TATCAGCCCG

251 ACTCCGAAAT CAGCCGGTTC AACCAACACA CAGCCGGCAA GCCCCTCCGC

301 ATTTCAAGCG ACTTCGCACA CGTTACTGCC GAAGCCGTCC ACCTGAACCG

351 CCTGACACAC GGCGCGCTGG ACGTAACCGT CGGCCCCTTG GTCAACCTTT

401 GGGGATTCGG CCCCGACAAA TCCGTTACCC GTGAACCGTC GCCGGAACAA

451 ATCAAACAAG CAGCATCTTA TACGGGCATA GACAAAATCA TTTTGAAACA

501 AGGCAAAGAT TACGCTTCCT TGAGCAAAAC CCACCCCAAG GCCTATTTGG

551 ATTTATCTTC GATTGCCAAA GGCTTCGGCG TTGATAAAGT TGCGGGCGAA

601 CTGGAAAAAT ACGGCATTCA AAATTATCTG GTCGAAATCG GCGGCGAGTT

651 GCACGGCAAA GGCAAAAACG CGCGCGGCGA ACCTTGGCGC ATCGGCATCG

701 AACAGCCCAA CATCGTCCAA GGCGGCAATA CGCAGATTAT CGTCCCGCTG

751 AACAACCGTT CGCTTGCCAC TTCCGGCGAT TACCGTATTT TCCACGTCGA

801 TAAAAGCGGC AAACGCCTCT CCCATATCAT TAATCCGAAC AACAAACGAC

851 CCATCAGCCA CAACCTCGCC TCCATCAGCG TGGTCGCAGA CAGTGCGATG

901 ACGGCGGACG GCTTGTCCAC AGGATTATTC GTATTGGGCG AAACCGAAGC

951 CTTAAAGCTG GCAGAGCGCG AAAAACTCGC TGTTTTCCTG ATTGTCAGGG

1001 ATAAAGGCGG CTACCGCACC GCCATGTCTT CCGAATTTGA AAAACTGCTC

1051 CGCTAA
```

This corresponds to the amino acid sequence <SEQ ID 398; ORF 111.a>:

```
a111•pep

1 MPSETRLPNF IRTLIFALSF IFLNACSEQT AQTVTLQGET MGTTYTVKYL

51 SNNRDKLPSP AEIQKRIDDA LKEVNRQMST YQPDSEISRF NQHTAGKPLR

101 ISSDFAHVTA EAVHLNRLTH GALDVTVGPL VNLWGFGPDK SVTREPSPEQ

151 IKQAASYTGI DKIILKQGKD YASLSKTHPK AYLDLSSIAK GFGVDKVAGE

201 LEKYGIQNYL VEIGGELHGK GKNARGEPWR IGIEQPNIVQ GGNTQIIVPL

251 NNRSLATSGD YRIFHVDKSG KRLSHIINPN NKRPISHNLA SISVVADSAM
```

```
301 TADGLSTGLF VLGETEALKL AEREKLAVFL IVRDKGGYRT AMSSEFEKLL

351 R*
``` m111/a111  97.7% identity in 351 aa overlap

```
                 10        20        30        40        50        60
m111.pep   MPSETRLPNFIRVLIFALGFIFLNACSEQTAQTVTLQGETMGTTYXVKYLSNNRDKLPSP
           ||||||||||:||||:||||||||||||||||||||||||||:|||||||||||||
a111       MPSETRLPNFIRTLIFALSFIFLNACSEQTAQTVTLQGETMGTTYTVKYLSNNRDKLPSP
                 10        20        30        40        50        60

70        80        90       100       110       120
m111.pep   AEIXKRIDDALKEXNRXMSTYQPDSEISRFNQHTAGKPLRISSDFAHVTAEAVRLNRLTH
           ||| ||||||||| || |||||||||||||||||||||||||||||||||||:||||||
a111       AEIQKRIDDALKEVNRQMSTYQPDSEISRFNQHTAGKPLRISSDFAHVTAEAVHLNRLTH
                 70        80        90       100       110       120

130       140       150       160       170       180
m111.pep   GALDVTVGPLVNLWGFGPDKSVTREPSPEQIKQAASYTGIDKIILKQGKDYASLSKTHPK
           ||||||||||||||||||||||||||||||||||||||||||||||||||||||||||||
a111       GALDVTVGPLVNLWGFGPDKSVTREPSPEQIKQAASYTGIDKIILKQGKDYASLSKTHPK
                130       140       150       160       170       180

190       200       210       220       230       240
m111.pep   AYLDLSSIAKGFGVDKVAGELEKYGIQNYLVEIGGELHGKGKNARGEPWRIGIEQPNIVQ
           ||||||||||||||||||||||||||||||||||||||||||||||||||||||||||||
a111       AYLDLSSIAKGFGVDKVAGELEKYGIQNYLVEIGGELHGKGKNARGEPWRIGIEQPNIVQ
                190       200       210       220       230       240

250       260       270       280       290       300
m111.pep   GGNTQIIVPLNNRSLATSGDYRIFHVDKNGKRLSHIINPNNKRPISHNLASISVVADSAM
           ||||||||||||||||||||||||||||||:|||||||||||||||||||||||||||||
a111       GGNTQIIVPLNNRSLATSGDYRIFHVDKSGKRLSHIINPNNKRPISHNLASISVVADSAM
                250       260       270       280       290       300

310       320       330       340       350
m111.pep   TADGLSTGLFVLGETEALKLAEREKLAVFLIVRDKGGYRTAMSSEFEKLLRX
           |||||||||||||||||||||||||||||||||||||||||||||||||||
a111       TADGLSTGLFVLGETEALKLAEREKLAVFLIVRDKGGYRTAMSSEFEKLLRX
                310       320       330       340       350
```

The following partial DNA sequence was identified in *N. gonorrhoeae* <SEQ ID 399>:

```
g111-1.seq
   1 ATGCCGTCTG AAACACGCCT GCCGAACCTT ATCCGCGCCT TGATATTTGC

51 CCTGGGTTTC ATCTTCCTGA ACGCCTGTTC GGAACAAACC GCGCAAacCG

101 TTACCCTGCA AGGCGAAACG ATGGGTACGA CCTATACCGT CAAATACCTT

151 TCAAATAATC GGGACAAACT CCCCTCCCCT GCCAAAATAC AAAAGCGCAT

201 TGATGATGCG CTTAAAGAAG TCAACCGGCA GATGTCCACC TACCAGACCG

251 ATTCCGAAAT CAGCCGGTTC AACCAACACA CAGCCGGCAA GCCCCTCCGC

301 ATTTCAAGCG ATTTCGCACA CGTTACCGCC GAAGCCGTCC GCCTGAACCG

351 CCTGACTCAC GGCGCACTGG ACGTAACCGT CGGCCCTTTG GTCAACCTTT

401 GGGGGTTCGG CCCCGACAAA TCCGTTACCC GTGAACCGTC GCCGGAACAA

451 ATCAAACAGG CGGCATCTTA TACGGGCATA GACAAAATCA TTTTGCAACA

501 AGGCAAAGAT TACGCTTCCT TGAGCAAAAC CCACCCCAAA GCCTATTTGG

551 ATTTATCTTC GATTGCCAAA GGCTTCGGCG TTGATAAAGT TGCGGGCGAA

601 CTGGAAAAAT ACGGCATTCA AAATTATCTG GTCGAAATCG GCggcGAGTT

651 GCACGGCAAA GGCAAAAATG CGCACGGCGA ACCGTGGCGC ATCGGTATAG

701 AGCAACCCAA TATcatccaa ggcggcaata cgcAGattat cgtcccgctg 751 aaCaaccgtt cgcttgccac ttccggcgAT taccgtaTTT tccacgtcgA 801 TAAAAACGGC Aaacgccttt cccacATCAT CAATCCCAAC AACAAACGAC
```

-continued
```
 851 CCATCAGcCA CAAcctcgcc tcCATCAgCg TGGTCTCAGA CAGTGCAATG

901 ACGGCGGACG GTTTATCCAC AGGATTATTT GTTTTAGGCG AAACCGAAGC

951 CTTAAGGCTG GCAGAACAAG AAAAACTCGC TGTTTTCCTA ATTGTCCGGG

1001 ATAAGGACGG CTACCGCACC GCCATGTCTT CCGAATTTGC CAAGCTGCTC

1051 CGCTAA
```

This corresponds to the amino acid sequence <SEQ ID 400; ORF 111-1.ng>:

```
g111-1.pep
   1 MPSETRLPNL IRALIFALGF IFLNACSEQT AQTVTLQGET MGTTYTVKYL

51 SNNRDKLPSP AKIQKRIDDA LKEVNRQMST YQTDSEISRF NQHTAGKPLR

101 ISSDFAHVTA EAVRLNRLTH GALDVTVGPL VNLWGFGPDK SVTREPSPEQ

151 IKQAASYTGI DKIILQQGKD YASLSKTHPK AYLDLSSIAK GFGVDKVAGE

201 LEKYGIQNYL VEIGGELHGK GKNAHGEPWR IGIEQPNIIQ GGNTQIIVPL

251 NNRSLATSGD YRIFHVDKNG KRLSHIINPN NKRPISHNLA SISVVSDSAM

301 TADGLSTGLF VLGETEALRL AEQEKLAVFL IVRDKDGYRT AMSSEFAKLL

351 R*
```

The following partial DNA sequence was identified in *N. meningitidis* <SEQ ID 401>:

```
m111-1.seq
   1 ATGCCGTCTG AAACACGCCT GCCGAACTTT ATCCGCGTCT TGATATTTGC

51 CCTGGGTTTC ATCTTCCTGA ACGCCTGTTC GGAACAAACC GCGCAAACCG

101 TTACCCTGCA AGGCGAAACG ATGGGCACGA CCTATACCGT CAAATACCTT

151 TCAAATAATC GGGACAAACT CCCCTCACCT GCCGAAATAC AAAAACGCAT

201 CGATGACGCG CTTAAAGAAG TCAACCGGCA GATGTCCACC TATCAGCCCG

251 ACTCCGAAAT CAGCCGGTTC AACCAACACA CAGCCGGCAA GCCCCTCCGC

301 ATTTCAAGCG ACTTCGCACA CGTTACTGCC GAAGCCGTCC GCCTGAACCG

351 CCTGACACAC GGCGCGCTGG ACGTAACCGT CGGCCCCTTG GTCAACCTTT

401 GGGGATTCGG CCCCGACAAA TCCGTTACCC GTGAACCGTC GCCGGAACAA

451 ATCAAACAGG CGGCATCTTA TACGGGCATA GACAAAATCA TTTTGAAACA

501 AGGCAAAGAT TACGCTTCCT TGAGCAAAAC CCACCCCAAG GCCTATTTGG

551 ATTTATCTTC GATTGCCAAA GGCTTCGGCG TTGATAAAGT TGCGGGCGAA

601 CTGGAAAAAT ACGGCATTCA AAATTATCTG GTCGAAATCG GCGGCGAGTT

651 GCACGGCAAA GGCAAAAACG CGCGCGGCGA ACCGTGGCGC ATCGGTATCG

701 AGCAGCCCAA TATCGTCCAA GGCGGCAATA CGCAGATTAT CGTCCCGCTG

751 AACAACCGTT CGCTTGCCAC TTCCGGCGAT TACCGTATTT CCACGTCGA

801 TAAAAACGGC AAACGCCTCT CCCATATCAT CAACCCGAAC AACAAACGAC

851 CCATCAGCCA CAACCTCGCC TCCATCAGCG TGGTCGCAGA CAGTGCGATG

901 ACGGCGGACG GCTTGTCCAC AGGATTATTC GTATTGGGCG AAACCGAAGC

951 CTTAAAGCTG GCAGAGCGCG AAAAACTCGC TGTTTTCCTG ATTGTCAGGG
```

```
1001 ATAAAGGCG GCTACCGCACC GCCATGTCTT CCGAATTTGA AAAACTGCTC

1051 CGCTAA
```

This corresponds to the amino acid sequence <SEQ ID
402; ORF 111-1>:

```
m111-1.pep

1 MPSETRLPNF IRTLIFALSF IFLNACSEQT AQTVTLQGET MGTTYTVKYL

51 SNNRDKLPSP AEIQKRIDDA LKEVNRQMST YQPDSEISRF NQHTAGKPLR

101 ISSDFAHVTA EAVRLNRLTH GALDVTVGPL VNLWGFGPDK SVTREPSPEQ

151 IKQAASYTGI DKIILKQGKD YASLSKTHPK AYLDLSSIAK GFGVDKVAGE

201 LEKYGIQNYL VEIGGELHGK GKNARGEPWR IGIEQPNIVQ GGNTQIIVPL

251 NNRSLATSGD YRIFHVDKNG KRLSHIINPN NKRPISHNLA SISVVADSAM

301 TADGLSTGLF VLGETEALKL AEREKLAVFL IVRDKGGYRT AMSSEFEKLL

351 R* m111-1/g111-1  96.6% identity in 351 aa overlap 10         20         30         40         50         60
m111-1.pep MPSETRLPNFIRVLIFALGFIFLNACSEQTAQTVTLQGETMGTTYTVKYLSNNRDKLPSP
           ||||||||||:||:||||||||||||||||||||||||||||||||||||||||||||||
g111-1     MPSETRLPNLIRALIFALGFIFLNACSEQTAQTVTLQGETMGTTYTVKYLSNNRDKLPSP
                   10         20         30         40         50         60

70         80         90        100        110        120
m111-1.pep AEIQKRIDDALKEVNRQMSTYQPDSEISRFNQHTAGKPLRISSDFAHVTAEAVRLNRLTH
           |:|||||||||||||||||||||:||||||||||||||||||||||||||||||||||||
g111-1     AKIQKRIDDALKEVNRQMSTYQTDSEISRFNQHTAGKPLRISSDFAHVTAEAVRLNRLTH
                   70         80         90        100        110        120

130        140        150        160        170        180
m111-1.pep GALDVTVGPLVNLWGFGPDKSVTREPSPEQIKQAASYTGIDKIILKQGKDYASLSKTHPK
           ||||||||||||||||||||||||||||||||||||||||||||:|||||||||||||||
g111-1     GALDVTVGPLVNLWGFGPDKSVTREPSPEQIKQAASYTGIDKIILQQGKDYASLSKTHPK
                  130        140        150        160        170        180

190        200        210        220        230        240
m111-1.pep AYLDLSSIAKGFGVDKVAGELEKYGIQNYLVEIGGELHGKGKNARGEPWRIGIEQPNIVQ
           ||||||||||||||||||||||||||||||||||||||||||:||||||||||||||:|
g111-1     AYLDLSSIAKGFGVDKVAGELEKYGIQNYLVEIGGELHGKGKNAHGEPWRIGIEQPNIIQ
                  190        200        210        220        230        240

250        260        270        280        290        300
m111-1.pep GGNTQIIVPLNNRSLATSGDYRIFHVDKNGKRLSHIINPNNKRPISHNLASISVVADSAM
           |||||||||||||||||||||||||||||||||||||||||||||||||||||||:|||
g111-1     GGNTQIIVPLNNRSLATSGDYRIFHVDKNGKRLSHIINPNNKRPISHNLASISVVSDSAM
                  250        260        270        280        290        300

310        320        330        340        350
m111-1.pep TADGLSTGLFVLGETEALKLAEREKLAVFLIVRDKGGYRTAMSSEFEKLLRX
           ||||||||||||||||||:|||:|||||||||||||| ||||||||:||||
g111-1     TADGLSTGLFVLGETEALRLAEQEKLAVFLIVRDKDGYRTAMSSEFAKLLRX
                  310        320        330        340        350 g111-1/p44550
sp|P44550|YOJL_HAEIN HYPOTHETICAL LIPOPROTEIN HI0172 PRECURSOR >gi|1074292|pir||C64144
hypothetical protein HI0172 - Haemophilus influenzae (strain Rd KW20) > gi|1573128 (U32702)
lipoprotein, putative [Haemophilus influenzae Rd] Length = 346
Score = 349 bits (885), Expect = 2e - 95
Identities = 177/328 (53%), Positives = 240/328 (72%), Gaps = 4/328 (1%)

Query:  23  LNACSEQTAQTVTLQGETMGTTYXVKYLSNNRDKLPSPAEIXKRIDDALKEXNRXMSTYQ  82
            L AC ++T + ++L G+TMGTTY VKYL +      S +  + I+ LK+ N  MSTY+
Sbjct:  17  LAACQKET-KVISLSGKTMGTTYHVKYLDDGSITATS-EKTHEEIEAILKDVNAKMSTYK  74

Query:  83  PDSEISRFNQHT-AGKPLRISSDFAHVTAEAVRLNRLTHGALDVTVGPLVNLWGFGPDKS 141
            DSE+SRFNQ+T    P+ IS+DFA V AEA+RLN++T GALDVTVGP+VNLWGFGP+K
Sbjct:  75  KDSELSRFNQNTQVNTPIEISADFAKVLAEAIRLNKVTEGALDVTVGPVVNLWGFGPEKR 134

Query: 142  VTREPSPEQIKQAASYTGIDKIILKQGKDYASLSKTHPKAYLDLSSIAKGFGVDKVAGEL 201
            ++P+PEQ+  ++  GIDKI L   K+ A+LSK  P+ Y+DLSSIAKGFGV+ VA +L
Sbjct: 135  PEKQPTPEQLAERQAWVGIDKITLDTNKEKATLSKALPQVYVDLSSIAKGFGVDQVAEKL 194

Query: 202  EKYGIQNYLVEIGGELHGKGKNARGEPWRIGIEQPNIVQGGNTQIIVPLNNRSLATSGDY 261
            E+   QNY+VEIGGE+  KGKN  G+PW+I IE+P     +  ++ LNN  +A+SGDY
Sbjct: 195  EQLNAQNYMVEIGGEIRAKGKNIEGKPWQIAIEKPTTTGERAVEAVIGLNNMGMASSGDY 254
```

```
Query:  262  RIFHVDKNGKRLSHIINPNNKRPISHNLASISVVADSAMTADGLSTGLFVLGETEALKLA  321
             RI+   ++NGKR +H I+P      PI H+LASI+V+A ++MTADGLSTGLFVLGE +AL++A
Sbjct:  255  RIY-FEENGKRFAHEIDPKTGYPIQHHLASITVLAPTSMTADGLSTGLFVLGEDKALEVA  313

Query:  322  EREKLAVFLIVRDKGGYRTAMSSEFEKL  349
             E+  LAV+LI+R   G+ T  SS F+KL
Sbjct:  314  EKNNLAVYLIIRTDNGFVTKSSSAFKKL  341
```

The following partial DNA sequence was identified in *N. meningitidis* <SEQ ID 403>:

```
a111-1.seq
   1 ATGCCGTCTG AAACACGCCT GCCGAACTTT ATCCGCACCT TGATATTTGC

51 CCTGAGTTTT ATCTTCCTGA ACGCCTGTTC GGAACAAACC GCGCAAACCG

101 TTACCCTGCA AGGTGAAACG ATGGGCACGA CCTATACCGT CAAATACCTT

151 TCAAATAATC GGGACAAACT CCCCTCACCT GCCGAAATAC AAAAGCGCAT

201 CGATGACGCG CTTAAAGAAG TCAACCGGCA GATGTCCACC TATCAGCCCG

251 ACTCCGAAAT CAGCCGGTTC AACCAACACA CAGCCGGCAA GCCCCTCCGC

301 ATTTCAAGCG ACTTCGCACA CGTTACTGCC GAAGCCGTCC ACCTGAACCG

351 CCTGACACAC GGCGCGCTGG ACGTAACCGT CGGCCCCTTG GTCAACCTTT

401 GGGGATTCGG CCCCGACAAA TCCGTTACCC GTGAACCGTC GCCGGAACAA

451 ATCAAACAAG CAGCATCTTA TACGGGCATA GACAAAATCA TTTTGAAACA

501 AGGCAAAGAT TACGCTTCCT TGAGCAAAAC CCACCCCAAG GCCTATTTGG

551 ATTTATCTTC GATTGCCAAA GGCTTCGGCG TTGATAAAGT TGCGGGCGAA

601 CTGGAAAAAT ACGGCATTCA AAATTATCTG GTCGAAATCG GCGGCGAGTT

651 GCACGGCAAA GGCAAAAACG CGCGCGGCGA ACCTTGGCGC ATCGGCATCG

701 AACAGCCCAA CATCGTCCAA GGCGGCAATA CGCAGATTAT CGTCCCGCTG

751 AACAACCGTT CGCTTGCCAC TTCCGGCGAT TACCGTATTT CCACGTCGA

801 TAAAAGCGGC AAACGCCTCT CCCATATCAT TAATCCGAAC AACAAACGAC

851 CCATCAGCCA CAACCTCGCC TCCATCAGCG TGGTCGCAGA CAGTGCGATG

901 ACGGCGGACG GCTTGTCCAC AGGATTATTC GTATTGGGCG AAACCGAAGC

951 CTTAAAGCTG GCAGAGCGCG AAAAACTCGC TGTTTTCCTG ATTGTCAGGG

1001 ATAAAGGCGG CTACCGCACC GCCATGTCTT CCGAATTTGA AAAACTGCTC

1051 CGCTAA
```

This corresponds to the amino acid sequence <SEQ ID 404; ORF 111-1.a>:

```
a111-1.pep
    1  MPSETRLPNF IRTLIFALSF IFLNACSEQT AQTVTLQGET MGTTYTVKYL

51  SNNRDKLPSP AEIQKRIDDA LKEVNRQMST YQPDSEISRF NQHTAGKPLR

101  ISSDFAHVTA EAVHLNRLTH GALDVTVGPL VNLWGFGPDK SVTREPSPEQ

151  IKQAASYTGI DKIILKQGKD YASLSKTHPK AYLDLSSIAK GFGVDKVAGE

201  LEKYGIQNYL VEIGGELHGK GKNARGEPWR IGIEQPNIVQ GGNTQIIVPL

251  NNRSLATSGD YRIPHVDKSG KRLSHIINPN NKRPISHNLA SISVVADSAM

301  TADGLSTGLF VLGETEALKL AEREKLAVFL IVRDKGGYRT AMSSEFEKLL

351  R*
```

-continued a111-1/m111-1 98.9% identity in 351 aa overlap

```
                  10        20        30        40        50        60
a111-1.pep  MPSETRLPNFIRTLIFALSFIFLNACSEQTAQTVTLQGETMGTTYTVKYLSNNRDKLPSP
            ||||||||||||:|||||:|||||||||||||||||||||||||||||||||||||||||
m111-1      MPSETRLPNFIRVLIFALGFIFLNACSEQTAQTVTLQGETMGTTYTVKYLSNNRDKLPSP
                  10        20        30        40        50        60

70        80        90       100       110       120
a111-1.pep  AEIQKRIDDALKEVNRQMSTYQPDSEISRFNQHTAGKPLRISSDFAHVTAEAVHLNRLTH
            |||||||||||||||||||||||||||||||||||||||||||||||||||||:||||||
m111-1      AEIQKRIDDALKEVNRQMSTYQPDSEISRFNQHTAGKPLRISSDFAHVTAEAVRLNRLTH
                  70        80        90       100       110       120

130       140       150       160       170       180
a111-1.pep  GALDVTVGPLVNLWGFGPDKSVTREPSPEQIKQAASYTGIDKIILKQGKDYASLSKTHPK
            ||||||||||||||||||||||||||||||||||||||||||||||||||||||||||||
m111-1      GALDVTVGPLVNLWGFGPDKSVTREPSPEQIKQAASYTGIDKIILKQGKDYASLSKTHPK
                 130       140       150       160       170       180

190       200       210       220       230       240
a111-1.pep  AYLDLSSIAKGFGVDKVAGELEKYGIQNYLVEIGGELHGKGKNARGEPWRIGIEQPNIVQ
            ||||||||||||||||||||||||||||||||||||||||||||||||||||||||||||
m111-1      AYLDLSSIAKGFGVDKVAGELEKYGIQNYLVEIGGELHGKGKNARGEPWRIGIEQPNIVQ
                 190       200       210       220       230       240

250       260       270       280       290       300
a111-1.pep  GGNTQIIVPLNNRSLATSGDYRIFHVDKSGKRLSHIINPNNKRPISHNLASISVVADSAM
            |||||||||||||||||||||||||||||||:||||||||||||||||||||||||||||
m111-1      GGNTQIIVPLNNRSLATSGDYRIFHVDKNGKRLSHIINPNNKRPISHNLASISVVADSAM
                 250       260       270       280       290       300

310       320       330       340       350
a111-1.pep  TADGLSTGLFVLGETEALKLAEREKLAVFLIVRDKGGYRTAMSSEFEKLLRX
            ||||||||||||||||||||||||||||||||||||||||||||||||||||
m111-1      TADGLSTGLFVLGETEALKLAEREKLAVFLIVRDKGGYRTAMSSEFEKLLRX
                 310       320       330       340       350
```

The following partial DNA sequence was identified in *N. gonorrhoeae* <SEQ ID 405>:

```
g114.seq
  1  ATGGCTTCCA TCACTTCGCC GCTGCACGGGG CGCAGCAGG AATGCAGCAA

51  GACTTTTTTA TGTCCGCCGG GCGGGACGAGT ATGGGGCGG TCAATGTCGG

101  TAACGGTAGG TTTGTTTTGT GTTTCCATTAA CTTAACAAT ATCTGTCGAA

151  TACGGTCAAA GCGGCTATTT TACCAGAGCCG CCGAATGTA AAACAGGGTG

201  TCAGGGCATC AGCCCGAGCT GCCTGAACGAA CGGACGGTT TGCGAGGTAA

251  CGATAAAATG GTCGAGCAGC GAAACATCAAC CAGCGACAT GGCCTGTGCC

301  AGCCGCCTTG TGAACATGAT GTCTTCCTGCG AAGGTTCAG GCGAGCCGCC

351  CGGATGGTTG TGCGCGATAA TCAGGCTGTCG GCATATTCG TCCAATGCCA

401  GTTTGACGAT TTCGCGGATG TAA
```

This corresponds to the amino acid sequence <SEQ ID 406; ORF 114.ng>:

```
g114.pep
  1  MASITSPLHG AQQECSKTFL CPPGGTSMGR SMSVTVGLFC VSINLTISVE

51  YGQSGYFTRA AECKTGCQGI SPSCLNERTV CEVTIKWSSS ETSTSDMACA

101  SRLVNMMSSC EGSGEPPGWL CAIIRLSAYS SNASLTISRM *
```

The following partial DNA sequence was identified in *N. meningitidis* <SEQ ID 407>:

```
m114.seq
  1 ATGGCTTCCA TCACTTCGCC GCTGCACGGG GCGCACAGAG AATGCAGCAA

51 GACTTTTTTA TGTCCACCGG GCGGGACGAG TATAGGGCGG TCAATGTCGG

101 TAACGGTAGG TTTGTTTTGT GTTTCCATTA ACTTAACAAT ATCTGTTGAA

151 TACGGTTGAA GCGGCTATTT TATCAGAGCC GCCGCATGTA AAACAGAGTG

201 TCAGGGCATC AACCCGAGCT GTCTGAACGA ACAGACGCTT TGCGAkGTAA

251 CGATAAAATG GTCGAGCAGC GACACATCGA CCAGCGACAT TGCCTGTGCC

301 AGCCGCCTTG TGAACATGAT GTCTTCCTGC GAArGTTCsG GCGAGCCGcC

351 CGgATGGTTG TGCGCAATAA TCAGGCTGTC GGCATATTCG TCCAATGCCA

401 GTTTGACGAT TTCGCGGATG TAA
```

This corresponds to the amino acid sequence <SEQ ID 408; ORF 114>:

```
m114.pep

1 MASITSPLHG AHRECSKTFL CPPGGTSIGR SMSVTVGLFC VSINLTISVE
    51 YGXSGYFIRA AACKTECQGI NPSCLNEQTL CXVTIKWSSS DTSTSDIACA
   101 SRLVNMMSSC EXSGEPPGWL CAIIRLSAYS SNASLTISRM * m114/g114  90.0%   identity over a 140 aa overlap 10        20        30        40        50        60
m114.pep  MASITSPLHGAHRECSKTFLCPPGGTSIGRSMSVTVGLFCVSINLTISVEYGXSGYFIRA
          ||||||||||::||||||||||||||||:||||||||||||||||||||||||  |||  ||
g114      MASITSPLHGAQQECSKTFLCPPGGTSMGRSMSVTVGLFCVSINLTISVEYGQSGYFTRA
                  10        20        30        40        50        60

70        80        90       100       110       120
m114.pep  AACKTECQGINPSCLNEQTLCXVTIKWSSSDTSTSDIACASRLVNMMSSCEXSGEPPGWL
          |  |||  ||||:||||||:|:|  |||||||||:|||||:|||||||||||||||:  ||||||||
g114      AECKTGCQGISPSCLNERTVCEVTIKWSSSETSTSDMACASRLVNMMSSCEGSGEPPGWL
                  70        80        90       100       110       120

130       140
m114.pep  CAIIRLSAYSSNASLTISRMX
          |||||||||||||||||||||
g114      CAIIRLSAYSSNASLTISRMX
                 130       140
```

The following partial DNA sequence was identified in *N. gonorrhoeae* <SEQ ID 409>:

```
a114.seq
  1 ATGCCGGAGG CAAGCATCGC CTCCATCACT TCGCCGCTGC ACGGGGCGCA

51 ACAGGAATGC AGCAAGACTT TTTTATGTCC GCCGGGCGGG ACGAGTATGG

101 GGCGGTCAAT GTCGGTAACG GTAGGTTTGT TTTGTGTTTC CATTAACTTA

151 ACGATATCTG TCGAATACGG TTGAAGCGGC TATTTTATCA GAGCCGCCGC

201 ATGTAAAACA GGGTGTCAGG GCATCAGCCC GAGCTGCCTG AACGAACGGA

251 CGGTTTGCGC CGTTACGATA AAATGGTCGA GCAGCGACAC ATCGACCAGC

301 GACATTGCCT GTGCCAGCCG CCTTGTGAAC ATGATGTCTT CCTGCGAAGG

351 TTCGGGCGAG CCGCCCGGAT GGTTGTGCGC GATAATCAGG CTGTCGGCAT

401 ATTCGTCCAA TGCCAGTTTG ACAATTTCAC GGATGTAA
```

This corresponds to the amino acid sequence <SEQ ID 410; ORF 114.a>:

```
a114.pep

1 MPEASIASIT SPLHGAQQEC SKTFLCPPGG TSMGRSMSVT VGLFCVSINL

51 TISVEYG*SG YFIRAAACKT GCQGISPSCL NERTVCAVTI KWSSSDTSTS

101 DIACASRLVN MMSSCEGSGE PPGWLCAIIR LSAYSSNASL TISRM* m114/a114 92.9% identity in 140 aa overlap 10         20         30         40         50
    m114.pep        MASITSPLHGAHRECSKTFLCPPGGTSIGRSMSVTVGLFCVSINLTISVEYGXSG
                    :||||||||||::|||||||||||||:||||||||||||||||||||||||||
    a114       MPEASIASITSPLHGAQQECSKTFLCPPGGTSMGRSMSVTVGLFCVSINLTISVEYGXSG
                   10         20         30         40         50         60

60         70         80         90        100        110
    m114.pep   YFIRAAACKTECQGINPSCLNEQTLCXVTIKWSSSDTSTSDIACASRLVNMMSSCEXSGE
               ||||||||||  ||||:||||||:|:| |||||||||||||||||||||||||||  |||
    a114       YFIRAAACKTGCQGISPSCLNERTVCAVTIKWSSSDTSTSDIACASRLVNMMSSCEGSGE
                   70         80         90        100        110        120

120        130        140
    m114.pep   PPGWLCAIIRLSAYSSNASLTISRMX
               ||||||||||||||||||||||||||
    a114       PPGWLCAIIRLSAYSSNASLTISRMX
                   130        140
```

The following partial DNA sequence was identified in *N. gonorrhoeae* <SEQ ID 411>:

```
g117.seq
    1 atggtcgacg aactcgacCT GCTGCCCGAT GCCGTCGCCG CCACCCTGCT

51 TGCCGACATC GGACGCTACG TCCCCGATTG GAACCTATTG GTTTCCGAGC

101 GCTGCAACAG CACCGTCGCC GAGCTGGTCA AAGGTGtgga CGAAGTGCAG

151 AAACTTACCC ACTTCGCCCG GGTGGACAGC CTCGCCACGC CGGAAGAACG

201 CGCACAGCAA GCGAAACCA TGCGGAAAAT GCTGCTGGCg atggttaccg

251 Acatccgcgt cgtaTTAATC AAACTGGCGA TGCGTacgcg cacCCTGcta 301 ttTTTaaGCA ACGCCCCCGA CAGCCCTGAA AAACgcgccG TCgccaaAga 351 aacccTCGAC ATCTTCGCCC CGCTCGCCAA CCGCTTGGGC GTGTGGCAGC

401 TCAAATGGCA GCTCGAAGAT TTGGGCTTCC GCCATCAAGA ACCCGAAAAA

451 TACCGCGAAA TCGCCCTGCT TTTGGACGAA AAACGCACCG AACGCCTCGA

501 ATACATCGAA AACTTCCTCG ATATCCTGCG TACGGAACTC AAAAAATACA

551 ATATCCACTT TGAAGTCGCC GGCCGTCCGA AACACATCTA CTCCATTTAC

601 AAAAAAATGG TGAAGAAAAA ACTCAGCTTC GACGgccTGT TCGACATCCG

651 CGCCGTGCGG ATTCTGGTCG ATACCGTCCC CGaGTGTTAC ACCACGCTGG 701 gcaTCGTCCA CAGCCTCTGG CAGCCCATTC CCGGCGagtt CGAcgactAC 751 ATCGCCAACC CCAAAGgcaA CGgttATAAA AGtTTGCACA CCGTCATCGT 801 cggcccGGAa gacaaaggtg tggaaGtgCA AATCCGCACC TTCGAtatGC 851 accAATTCaa CgaatTcggT gtcgccgCCC ACTGGCGtta caaagaaggc 901 ggcaaaggcg attccGCCtA cgaacaaAAA ATcgccTggt TGCgccaACT

951 CTTGGACTGG CGCGAAAATA TGGCGGAAAG CGGCAAGGAA GACCTCGCCG

1001 CCGCCTTCAA AACCGAGCTT TTCAACGACA CGATTTATGT TTTGACCCCG
```

```
1051 CACGGCAAAG TCCTCTCTCT GCCAACGGGC GCAACCCCCA TCGACTTCGC

1101 CTACGCCCTG CACAGCAGCA TcggCGACCG CTGCCGGGGC GCGAAAGTCG

1151 AaggGCAGAT TGTGCCGCTG TCCACCCCGC TCGAAAACGG ACAGCGCGTC

1201 GAAATcatta cCGCcaaAGA AGGGCATCCT TCCGTCAACT GGCTTTACGA

1251 AGGctgGGtc aAATCCGGCA AGGCCATCGG caaAATCCGC GCCTAcatCC

1301 GCCAGcaaAa cgCcgaCACC GTGCGCGAAG AAGGCCGTGT CCAACTCGAC

1351 AAGCAGCTTG CCAAACTCAC GCCCAAACCC AACCTGCAAG AGCTTgccga 1401 aaATCTCGGC tacaaAAAGC cagaagacct ctacacCGCc gtcggacaag 1451 gcgaaatttc caaccgcgcc atCcaaaaag cctgcggcac GCTgaacgaa 1501 ccgccccCCG TGCCCGTCAG CGCAACCACC ATCGTCAAAC AGTCCAAAAT

1551 CAAAAAAGGT GGCAAAACCG GCGTGCTCAT CGACGGCGAA GACGGCTTGA

1601 TGACCACGCT TGCCAAATGC TGCAAACCCG CGCCGCCCGA CGATATTGCC

1651 GGCTTCGTTA CCCGCGAGCG CGGCATTTCC GTCCACCGCA AAACCTGCCC

1701 CTCTTTCCGA CACCTTGCCG AACACGCGCC CGAAAAAGTA CTGGACGCAA

1751 GTTGGGCGGC GTTGCAGGAA GGGCAAGTGT TCGCCGTCGA TATCGAAATC

1801 CGCGCCCAAG ACCGCTCCGG GCTTTTGCGC GACGTATCCG ACGCGCTCGC

1851 CCGCCACAAA CTCAACGTTA CCGCCGTGCA AACCCAGTCC CGCGACTTGG

1901 AAGCCAGCAT GAGGTTCACG CTCGAAGTCA AACAAGtCAA CGacCTCCCG

1951 CGCGTCCTCG CCGGCCTCGG CGATGTCAAA GGCGTATTGA GCGTTACCCG

2001 GCTTTAA
```

This corresponds to the amino acid sequence <SEQ ID 412; ORF 117.ng>:

```
g117.pep
  1 MVDELDLLPD AVAATLLADI GRYVPDWNLL VSERCNSTVA ELVKGVDEVQ

51 KLTHFARVDS LATPEERAQQ AETMRKMLLA MVTDIRVVLI KLAMRTRTLL

101 FLSNAPDSPE KRAVAKETLD IFAPLANRLG VWQLKWQLED LGFRHQEPEK

151 YREIALLLDE KRTERLEYIE NFLDILRTEL KKYNIHFEVA GRPKHIYSIY

201 KKMVKKKLSF DGLFDIRAVR ILVDTVPECY TTLGIVHSLW QPIPGEFDDY

251 IANPKGNGYK SLHTVIVGPE DKGVEVQIRT FDMHQFNEFG VAAHWRYKEG

301 GKGDSAYEQK IAWLRQLLDW RENMAESGKE DLAAAFKTEL FNDTIYVLTP

351 HGKVLSLPTG ATPIDFAYAL HSSIGDRCRG AKVEGQIVPL STPLENGQRV

401 EIITAKEGHP SVNWLYEGWV KSGKAIGKIR AYIRQQNADT VREEGRVQLD

451 KQLAKLTPKP NLQELAENLG YKKPEDLYTA VGQGEISNRA IQKACGTLNE

501 PPPVPVSATT IVKQSKIKKG GKTGVLIDGE DGLMTTLAKC CKPAPPDDIA

551 GFVTRERGIS VHRKTCPSFR HLAEHAPEKV LDASWAALQE GQVFAVDIEI

601 RAQDRSGLLR DVSDALARHK LNVTAVQTQS RDLEASMRFT LEVKQVNDLP

651 RVLAGLGDVK GVLSVTRL*
```

The following partial DNA sequence was identified in *N. meningitidis* <SEQ ID 413>:

```
m117.seq (partial)
   1 . . . GTGAAACTCA AGAAATACAA TGTCCATTTC GAAGTCGCCG GCCGTGCGAA
  51       ACACATCTAC TCCATTTACA AAAAAATGGT GAAGAAAAAA CTCAGCTTCG
 101       ACGGCCTCTT TGACATCCGC GCCGTGCGAA TTCTGGTTGA TATCGTCCAC
 151       GAGTGTTACA CCACGCTGGG TATCGTCCAC AGCCTCTGGC AGCCCATTCC
 201       CGGCGAGTTC GACGACTACA TCGCCAATCC CAAAGGCAAC GGCTATAAAA
 251       GTTTGCACAC CGTCATCGTC GGCAAGGAAG ACAAAGGCGT GGAAGTACAA
 301       ATCCGCACCT TCGATATGCA CCAATTCAAC GAATTCGGTG TCGCCGCCCA
 351       CTGgCGTTAC AAAGAGGGCG GCAAGGGCGA TTCCGCCTAC GAACAGAAAA
 401       TCGCCTGGTT GCGCCAACTC TTGGACTGGC GCGAAAACAT GGCGGAAAGC
 451       GGCAAGGAAG ACCTCGCCGC CGCCTTCAAA ACCGAGCTTT TCAACGACAC
 501       GATTTATGTT TTGACCCCGC ACGGCAAAGT CCTCTCCCTG CCCACGGGCG
 551       CGACCCCCAT CGACTTCGCC TACGCCCTGC ACAGCAGCAT CGGCGACCGT
 601       TGCCGCGGTG CGAAAGTCGA AGGGCAGATT GTGCCGCTGT CCACCCCGCT
 651       CGAAAACGGA CAGCGCGTCG AAATCATTAC CGCCAAAGAA GGGCATCCTT
 701       CCGTCAACTG GCTTTACGAA GGCTGGGTCA AATCCAACAA GGCAATCGGC
 751       AAAATCCGCG CCTACATCCG CCAGCAAAAC GCCGACACCG TGCGCGAAGA
 801       AGGCCGCGTC CAACTCGACA AACAGCTTGC CAAACTCACG CCCAAACCCA
 851       ACCTGCAAGA GCTTGCCGAA AATCTCGGCT ACAAAAAGCC AGAAGACCTC
 901       TACACCGCCG TCGGACAAGG CGAAATTTCC AACCGCGCCA TCCAAAAAGC
 951       CTGCGGCACg CTGAACGAAC CGGCGACCGT ACCCGTCAGC GAAACCACCA
1001       TCGTCAAACA GTCCAAAATC AAAAAAGGCG GCAAAAACGG CGTGCTCATC
1051       GACGGCGAAG ACGGTCTGAT GACCACGCTT GCCAAATGCT GCAAACCCGC
1101       GCCGCCCGAC GATATTATCG GCTTCGTTAC CCGCGAGCGC GgCATTTCAG
1151       TGCACCGCAA AwyyTkCyCG TCTTTCCAAC ACCTCGCCGA ACACGCGCCC
1201       GAwAAAGTGC TGGACGCAAG CTGGGCGGCA TTGCAGGAAG GACAAGTATT
1251       CGCCGTCGAT ATCGAAATCC GCGCCCAAGA CCGCTCCGGG CTTTTGCGCG
1301       ACGTATCCGA CGCGCTCGCC CGCCACAAAC TCAACGTTAC CGCCGTGCAA
1351       ACCCAGTCCC GCGACTTGGA AGCCAGCATG AGGTTCACGC TCGAAGTCAA
1401       ACAAGTCAAC GACCTCCCGC GCGTCCTCGC CAGCCTCGGC GACGTCAAAG
1451       GCGTATTGAG CGTTACCCGG CTTTAA
```

This corresponds to the amino acid sequence <SEQ ID 414; ORF 117>:

```
m117.pep (partial)
  1 . . . VKLKKYNVHF EVAGRPKHIY SIYKKMVKKK LSFDGLFDIR AVRILVDTVP
 51       ECYTTLGIVH SLWQPIPGEF DDYIANPKGN GYKSLHTVIV GPEDKGVEVQ
101       IRTFDMHQFN EFGVAAHWRY KEGGKGDSAY EQKIAWLRQL LDWRENMAES
151       GKEDLAAAFK TELFNDTIYV LTPHGKVLSL PTGATPIDFA YALHSSIGDR
201       CRGAKVEGQI VPLSTPLENG QRVEIITAKE GHPSVNWLYE GWVKSNKAIG
```

```
-continued
251     KIRAYIRQQN ADTVREEGRV QLDKQLAKLT PKPNLQELAE NLGYKKPEDL

301     YTAVGQGEIS NRAIQKACGT LNEPPPVPVS ETTIVKQSKI KKGGKNGVLI

351     DGEDGLMTTL AKCCKPAPPD DIIGFVTRER GISVHRKXXX SFQHLAEHAP

401     XKVLDASWAA LQEGQVFAVD IEIRAQDRSG LLRDVSDALA RHKLNVTAVQ

451     TQSRDLEASM RFTLEVKQVN DLPRVLASLG DVKGVLSVTR L*
```

Computer analysis of this amino acid sequence gave the following results:

Homology with a Predicted ORF from *N. gonorrhoeae*

ORF 117 shows 97.6% identity over a 490 aa overlap with a predicted ORF (ORF 117.ng) from *N. gonorrhoeae*:

```
m117/g117
                                    10         20         30
m117.pep                    VKLKKYNVHFEVAGRPKHIYSIYKKMVKKKL
                            :||||:||||||||||||||||||||||||
g117    EKYREIALLLDEKRTERLEYIENFLDILRTELKKYNIHFEVAGRPKHIYSIYKKMVKKKL
        150       160       170       180       190       200

40         50         60         70         80         90
m117.pep SFDGLFDIRAVRILVDTVPECYTTLGIVHSLWQPIPGEFDDYIANPKGNGYKSLHTVIVG
         ||||||||||||||||||||||||||||||||||||||||||||||||||||||||||||
g117     SFDGLFDIRAVRILVDTVPECYTTLGIVHSLWQPIPGEFDDYIANPKGNGYKSLHTVIVG
         210       220       230       240       250       260

100        110        120        130        140        150
m117.pep PEDKGVEVQIRTFDMHQFNEFGVAAHWRYKEGGKGDSAYEQKIAWLRQLLDWRENMAESG
         ||||||||||||||||||||||||||||||||||||||||||||||||||||||||||||
g117     PEDKGVEVQIRTFDMHQFNEFGVAAHWRYKEGGKGDSAYEQKIAWLRQLLDWRENMAESG
         270       280       290       300       310       320

160        170        180        190        200        210
m117.pep KEDLAAAFKTELFNDTIYVLTPHGKVLSLPTGATPIDFAYALHSSIGDRCRGAKVEGQIV
         ||||||||||||||||||||||||||||||||||||||||||||||||||||||||||||
g117     KEDLAAAFKTELFNDTIYVLTPHGKVLSLPTGATPIDFAYALHSSIGDRCRGAKVEGQIV
         330       340       350       360       370       380

220        230        240        250        260        270
m117.pep PLSTPLENGQRVEIITAKEGHPSVNWLYEGWVKSNKAIGKIRAYIRQQNADTVREEGRVQ
         |||||||||||||||||||||||||||||||||:||||||||||||||||||||||||||
g117     PLSTPLENGQRVEIITAKEGHPSVNWLYEGWVKSGKAIGKIRAYIRQQNADTVREEGRVQ
         390       400       410       420       430       440

280        290        300        310        320        330
m117.pep LDKQLAKLTPKPNLQELAENLGYKKPEDLYTAVGQGEISNRAIQKACGTLNEPPPVPVSE
         ||||||||||||||||||||||||||||||||||||||||||||||||||||||||||||
g117     LDKQLAKLTPKPNLQELAENLGYKKPEDLYTAVGQGEISNRAIQKACGTLNEPPPVPVSA
         450       460       470       480       490       500

340        350        360        370        380        390
m117.pep TTIVKQSKIKKGGKNGVLIDGEDGLMTTLAKCCKPAPPDDIIGFVTRERGISVHRKXXXS
         |||||||||||||:|||||||||||||||||||||||||| ||||||||||||||||: |
g117     TTIVKQSKIKKGGKTGVLIDGEDGLMTTLAKCCKPAPPDDIAGFVTRERGISVHRKTCPS
         510       520       530       540       550       560

400        410        420        430        440        450
m117.pep FQHLAEHAPXKVLDASWAALQEGQVFAVDIEIRAQDRSGLLRDVSDALARHKLNVTAVQT
         |:||||||| ||||||||||||||||||||||||||||||||||||||||||||||||||
g117     FRHLAEHAPEKVLDASWAALQEGQVFAVDIEIRAQDRSGLLRDVSDALARHKLNVTAVQT
         570       580       590       600       610       620

460        470        480        490
m117.pep QSRDLEASMRFTLEVKQVNDLPRVLASLGDVKGVLSVTRLX
         ||||||||||||||||||||||||||||:|||||||||||
g117     QSRDLEASMRFTLEVKQVNDLPRVLAGLGDVKGVLSVTRLX
         630       640       650       660
```

The following partial DNA sequence was identified in *N. meningitidis* <SEQ ID 415>:

```
a117.seq
   1 ATGGTTCATG AACTCGACCT GCTCCCCGAT GCCGTCGCCG CCACCCTGCT
  51 TGCCGACATC GGACGCTACG TCCCCGACTG GAACCTATTG GTTTCCGAAC
 101 GCTGCAACAG TACCGTCGCC GAGCTGGTCA AAGGTGTGGA CGAAGTGCAG
 151 AAACTCACCC ACTTCGCCCG GGTGGACAGC CTCGCCACGC CGGAAGAACG
 201 CGCCCAGCAG GCAGAAACTA TGCGGAAAAT GCTGCTGGCG ATGGTTACCG
 251 ACATCCGCGT CGTGTTAATC AAACTGGCGA TGCGTACGCG CACCCTGCAA
 301 TTTTTAAGCA ACGCCCCCGA CAGCCCCGAA AAACGCGCCG TCGCCAAAGA
 351 AACCCTCGAC ATCTTCGCCC CGCTCGCCAA CCGTTTGGGC GTGTGGCAGC
 401 TCAAATGGCA GCTCGAAGAT TTGGGCTTCC GCCATCAAGA ACCCGAAAAA
 451 TACCGCGAAA TCGCCCTGCT TTTGGACGAA AAACGCACCG AACGCCTCGA
 501 ATACATCGAA AACTTCCTTA ATATCCTGCG TACGGAACTC AAAAAATACA
 551 ATATCCACTT TGAAGTCGCC GGCCGTCCGA AACACATCTA CTCCATTTAC
 601 AAAAAAATGG TGAAGAAAAA ACTCAGCTTC GACGGGTTGT TCGACATCCG
 651 CGCCGTGCGG ATTCTGGTTG ATACCGTCCC CGAGTGTTAC ACCACACTGG
 701 GCATTGTCCA CAGCCTCTGG CAGCCCATTC CCGGCGAGTT CGACGACTAC
 751 ATCGCCAACC CGAAAGGCAA CGGCTATAAA AGTTTGCACA CCGTCATCGT
 801 CGGCAAGGAA GACAAAGGCG TGGAAGTGCA AATCCGCACC TTCGATATGC
 851 ACCAATTCAA CGAATTCGGT GTCGCCGCGC ACTGGCGTTA CAAAGAGGGC
 901 GGCAAAGGCG ATTCCGCCTA CGAACAAAAA ATCGCCTGGT TACGCCAACT
 951 TTTGGACTGG CGCGAAAACA TGGCGGAAAG CGGCAAGGAA GACCTCGCCG
1001 CCGCCTTCAA AACCGAGCTT TTCAACGACA CGATTTATGT TTTGACCCCG
1051 CACGGCAAAG TCCTCTCCCT GCCCACAGGC GCGACCCCCA TCGACTTCGC
1101 CTACGCCCTG CACAGCAGCA TCGGCGACCG TTGCCGCGGT GCGAAAGTCG
1151 AAGGGCAGAT TGTGCCGCTG TCCACCCCGC TCGAAAACGG ACAGCGTGTC
1201 GAAATCATTA CCGCCAAAGA AGGGCATCCT TCCGTCAACT GGCTTTACGA
1251 AGGCTGGGTC AAATCCAACA AGGCAATCGG CAAAATCCGC GCCTACATCC
1301 GCCAGCAAAA CGCCGACACC GTGCGCGAAG AAGGCCGCGT CCAACTCGAC
1351 AAACAGCTTG CCAAACTCAC GCCCAAACCC AACCTGCAAG AGCTTGCCGA
1401 AAATCTCGGC TACAAAAAGC CAGAAGACCT CTACACCGCC GTCGGACAAG
1451 GCGAAATTTC CAACCGCGCC ATCCAAAAAG CCTGCGGCAC GCTGAACGAA
1501 CCGCCGCCCG TACCCGTCAG CGAAACCACC ATCGTCAAAC AGTCCAAAAT
1551 CAAAAAAGGC GGCAAAAACG GCGTGCTCAT CGACGGCGAA GACGGTCTGA
1601 TGACCACGCT TGCCAAATGC TGCAAACCCG CGCCGCCCGA CGACATTGTC
1651 GGCTTCGTTA CCCGCGATCG CGGCATTTCG GTACACCGCA AAACCTGCCC
1701 CTCTTTCCGA CACCTCGCCG AACACGCGCC CGAAAAAGTA CTGGACGCAA
1751 GTTGGGCGGC GTTGCAGGAA GGACAAGTGT TCGCCGTCGA TATCGAAATC
1801 CGCGCCCAAG ACCGCTCCGG GCTTTTGCGC GACGTATCCG ACGCGCTCGC
1851 CCGCCACAAA CTCAACGTTA CCGCCGTGCA AACCCAGTCC CGCGACTTGG
1901 AAGCCAGCAT GAGGTTCACG CTCGAAGTCA AACAAGTTAC CGACCTCCCA
```

```
1951 CGCGTCCTCG CCAGCCTCGG CGACGTCAAA GGCGTATTGA GCGTTACCCG

2001 GCTTTAA
```

This corresponds to the amino acid sequence <SEQ ID 416; ORF 117.a>:

```
a117.pep

1 MVHELDLLPD AVAATLLADI GRYVPDWNLL VSERCNSTVA ELVKGVDEVQ

51 KLTHFARVDS LATPEERAQQ AETMRKMLLA MVTDIRVVLI KLAMRTRTLQ

101 FLSNAPDSPE KRAVAKETLD IFAPLANRLG VWQLKWQLED LGFRHQEPEK

151 YREIALLLDE KRTERLEYIE NFLNILRTEL KKYNIHFEVA GRPKHIYSIY

201 KKMVKKKLSF DGLFDIRAVR ILVDTVPECY TTLGIVHSLW QPIPGEFDDY

251 IANPKGNGYK SLHTVIVGPE DKGVEVQIRT FDMHQFNEFG VAAHWRYKEG

301 GKGDSAYEQK IAWLRQLLDW RENMAESGKE DLAAAFKTEL FNDTIYVLTP

351 HGKVLSLPTG ATPIDFAYAL HSSIGDRCRG AKVEGQIVPL STPLENGQRV

401 EIITAKEGHP SVNWLYEGWV KSNKAIGKIR AYIRQQNADT VREEGRVQLD

451 KQLAKLTPKP NLQELAENLG YKKPEDLYTA VGQGEISNRA IQKACGTLNE

501 PPPVPVSETT IVKQSKIKKG GKNGVLIDGE DGLMTTLAKC CKPAPPDDIV

551 GFVTRDRGIS VHRKTCPSFR HLAEHAPEKV LDASWAALQE GQVFAVDIEI

601 RAQDRSGLLR DVSDALARHK LNVTAVQTQS RDLEASMRFT LEVKQVTDLP

651 RVLASLGDVK GVLSVTRL* m117/a117 98.0% identity in 490 aa overlap
                       10         20         30
  m114.pep             VKLKKYNVHFEVAGRPKHIYSIYKKMVKKKL
                       :||||:|||||||||||||||||||||||||
  a114    EKYREIALLLDEKRTERLEYIENFLNILRTELKKYNIHFEVAGRPKHIYSIYKKMVKKKL
              150        160        170        180        190        200

40         50         60         70         80         90
  m117.pep  SFDGLFDIRAVRILVDTVPECYTTLGIVHSLWQPIPGEFDDYIANPKGNGYKSLHTVIVG
             ||||||||||||||||||||||||||||||||||||||||||||||||||||||||||||
  a117      SFDGLFDIRAVRILVDTVPECYTTLGIVHSLWQPIPGEFDDYIANPKGNGYKSLHTVIVG
              210        220        230        240        250        260

100        110        120        130        140        150
  m117.pep  PEDKGVEVQIRTFDMHQFNEFGVAAHWRYKEGGKGDSAYEQKIAWLRQLLDWRENMAESG
             ||||||||||||||||||||||||||||||||||||||||||||||||||||||||||||
  a117      PEDKGVEVQIRTFDMHQFNEFGVAAHWRYKEGGKGDSAYEQKIAWLRQLLDWRENMAESG
              270        280        290        300        310        320

160        170        180        190        200        210
  m117.pep  KEDLAAAFKTELFNDTIYVLTPHGKVLSLPTGATPIDFAYALHSSIGDRCRGAKVEGQIV
             ||||||||||||||||||||||||||||||||||||||||||||||||||||||||||||
  a117      KEDLAAAFKTELFNDTIYVLTPHGKVLSLPTGATPIDFAYALHSSIGDRCRGAKVEGQIV
              330        340        350        360        370        380

220        230        240        250        260        270
  m117.pep  PLSTPLENGQRVEIITAKEGHPSVNWLYEGWVKSNKAIGKIRAYIRQQNADTVREEGRVQ
             ||||||||||||||||||||||||||||||||||||||||||||||||||||||||||||
  a117      PLSTPLENGQRVEIITAKEGHPSVNWLYEGWVKSNKAIGKIRAYIRQQNADTVREEGRVQ
              390        400        410        420        430        440

280        290        300        310        320        330
  m117.pep  LDKQLAKLTPKPNLQELAENLGYKKPEDLYTAVGQGEISNRAIQKACGTLNEPPPVPVSE
             ||||||||||||||||||||||||||||||||||||||||||||||||||||||||||||
  a117      LDKQLAKLTPKPNLQELAENLGYKKPEDLYTAVGQGEISNRAIQKACGTLNEPPPVPVSE
              450        460        470        480        490        500
```

```
                340       350       360       370       380       390
m117.pep    TTIVKQSKIKKGGKNGVLIDGEDGLMTTLAKCCKPAPPDDIIGFVTRERGISVHRKXXXS
            ||||||||||||||||||||||||||||||||||||||||:|||||:||||||||:  |
a117        TTIVKQSKIKKGGKNGVLIDGEDGLMTTLAKCCKPAPPDDIVGFVTRDRGISVHRKTCPS
                510       520       530       540       550       560

400       410       420       430       440       450
m117.pep    FQHLAEHAPXKVLDASWAALQEGQVFAVDIEIRAQDRSGLLRDVSDALARHKLNVTAVQT
            |:|||||| ||||||||||||||||||||||||||||||||||||||||||||||||||
a117        FRHLAEHAPEKVLDASWAALQEGQVFAVDIEIRAQDRSGLLRDVSDALARHKLNVTAVQT
                570       580       590       600       610       620

460       470       480       490
m117.pep    QSRDLEASMRFTLEVKQVNDLPRVLASLGDVKGVLSVTRLX
            ||||||||||||||||||:|||||||||||||||||||||
a117        QSRDLEASMRFTLEVKQVTDLPRVLASLGDVKGVLSVTRLX
                630       640       650       660
```

The following partial DNA sequence was identified in *N. gonorrhoeae* <SEQ ID 417>:

```
g117-1.seq
   1 ATGACCGCCA TCAGCCCGAT TCAAGACACG CAAAGCGCGA CCCTGCAAGA
  51 ATTGCGCGAA TGGTTCGACA GCTACTGCGC CGCTCTGCCG GACAACGATA
 101 AAAACCTCAT CGGTACCGCA TGGTCGCTGG CGCAGGAACA TTATCCTGCC
 151 GATGCCGCCA CGCCGTATGG CGAGCCGCTG CCCGACCACT TCCTCGGCGC
 201 GGCGCAAATG GTCGACGAAC TCGACCTGCT GCCCGATGCC GTCGCCGCCA
 251 CCCTGCTTGC CGACATCGGA CGCTACGTCC CCGATTGGAA CCTATTGGTT
 301 TCCGAGCGCT GCAACAGCAC CGTCGCCGAG CTGGTCAAAG GTGTGGACGA
 351 AGTGCAGAAA CTTACCCACT TCGCCCGGGT GGACAGCCTC GCCACGCCGG
 401 AAGAACGCGC ACAGCAAGCG GAAACCATGC GGAAAATGCT GCTGGCGATG
 451 GTTACCGACA TCCGCGTCGT ATTAATCAAA CTGGCGATGC GTACGCGCAC
 501 CCTGCAATTT TTAAGCAACG CCCCCGACAG CCCTGAAAAA CGCGCCGTCG
 551 CCAAAGAAAC CCTCGACATC TTCGCCCCGC TCGCCAACCG CTTGGGCGTG
 601 TGGCAGCTCA AATGGCAGCT CGAAGATTTG GGCTTCCGCC ATCAAGAACC
 651 CGAAAAATAC CGCGAAATCG CCCTGCTTTT GGACGAAAAA CGCACCGAAC
 701 GCCTCGAATA CATCGAAAAC TTCCTCGATA TCCTGCGTAC GGAACTCAAA
 751 AAATACAATA TCCACTTTGA AGTCGCCGGC CGTCCGAAAC ACATCTACTC
 801 CATTTACAAA AAAATGGTGA AGAAAAAACT CAGCTTCGAC GGCCTGTTCG
 851 ACATCCGCGC CGTGCGGATT CTGGTCGATA CCGTCCCCGA GTGTTACACC
 901 ACGCTGGGCA TCGTCCACAG CCTCTGGCAG CCCATTCCCG GCGagttCGA
 951 cgactACATC GCCAACCCCA AAGgcaACGg ttATAAAAGt TTGCACACCG
1001 TCATCGTCgg cccGGAagaa aaaggtgtgg aagtgcAAAT CCGCACCTTC
1051 GATATGCacc AATTCaaCga ATTCGGTGTC GCCGCCCACT GGCGTTACAA
1101 AGAAGGCGGC AAAGGCGATT CCGCCTACGA ACAAAAAATC GCCTGGTTGC
1151 GCCAACTCTT GGACTGGCGC GAAAATATGG CGGAAAGCGG CAAGGAAGAC
1201 CTCGCCGCCG CCTTCAAAAC CGAGCTTTTC AACGACACGA TTTATGTTTT
1251 GACCCCGCAC GGCAAAGTCC TCTCTCTGCC AACGGGCGCA ACCCCCATCG
1301 ACTTCGCCTA CGCCCTGCAC AGCAGCATCG GCGACCGCTG CCGGGGCGCG
```

-continued
```
1351 AAAGTCGAAG GGCAGATTGT GCCGCTGTCC ACCCCGCTCG AAAACGGACA

1401 GCGCGTCGAA ATCATTACCG CCAAAGAAGG CATCCTTCC GTCAACTGGC

1451 TTTACGAAGG CTGGGTCAAA TCCGGCAAGG CCATCGGCAA AATCCGCGCC

1501 TACATCCGCC AGCAAAACGC CGACACCGTG CGCGAAGAAG GCCGTGTCCA

1551 ACTCGACAAG CAGCTTGCCA AACTCACGCC CAAACCCAAC CTGCAAGAGC

1601 TTGCCGAAAA TCTCGGCTAC AAAAAGCCAG AAGACCTCTA CACCGCCGTC

1651 GGACAAGGCG AAATTTCCAA CCGCGCCATC CAAAAAGCCT GCGGCACGCT

1701 GAACGAACCG CCGCCCGTGC CCGTCAGCGC AACCACCATC GTCAAACAGT

1751 CCAAAATCAA AAAGGTGGC AAAACCGGCG TGCTCATCGA CGGCGAAGAC

1801 GGCTTGATGA CCACGCTTGC CAAATGCTGC AAACCCGCGC CGCCCGACGA

1851 TATTGCCGGC TTCGTTACCC GCGAGCGCGG CATTTCCGTC CACCGCAAAA

1901 CCTGCCCCTC TTTCCGACAC CTTGCCGAAC ACGCGCCCGA AAAAGTACTG

1951 GACGCAAGTT GGGCGGCGTT GCAGGAAGGG CAAGTGTTCG CCGTCGATAT

2001 CGAAATCCGC GCCCAAGACC GCTCCGGGCT TTTGCGCGAC GTATCCGACG

2051 CGCTCGCCCG CCACAAACTC AACGTTACCG CCGTGCAAAC CCAGTCCCGC

2101 GACTTGGAAG CCAGCATGAG GTTCACGCTC GAAGTCAAAC AAGTCAACGA

2151 CCTCCCGCGC GTCCTCGCCG GCCTCGGCGA TGTCAAAGGC GTATTGAGCG

2201 TTACCCGGCT TAA
```

This corresponds to the amino acid sequence <SEQ ID 418; ORF 117-1.ng>:

```
g117-1.pep
  1 MTAISPIQDT QSATLQELRE WFDSYCAALP DNDKNLIGTA WSLAQEHYPA

51 DAATPYGEPL PDHFLGAAQM VDELDLLPDA VAATLLADIG RYVPDWNLLV

101 SERCNSTVAE LVKGVDEVQK LTHFARVDSL ATPEERAQQA ETMRKMLLAM

151 VTDIRVVLIK LAMRTRTLQF LSNAPDSPEK RAVAKETLDI FAPLANRLGV

201 WQLKWQLEDL GFRHQEPEKY REIALLLDEK RTERLEYIEN FLDILRTELK

251 KYNIHFEVAG RPKHIYSIYK KMVKKKLSFD GLFDIRAVRI LVDTVPECYT

301 TLGIVHSLWQ PIPGEFDDYI ANPKGNGYKS LHTVIVGPEE KGVEVQIRTF

351 DMHQFNEFGV AAHWRYKEGG KGDSAYEQKI AWLRQLLDWR ENMAESGKED

401 LAAAFKTELF NDTIYVLTPH GKVLSLPTGA TPIDFAYALH SSIGDRCRGA

451 KVEGQIVPLS TPLENGQRVE IITAKEGHPS VNWLYEGWVK SGKAIGKIRA

501 YIRQQNADTV REEGRVQLDK QLAKLTPKPN LQELAENLGY KKPEDLYTAV

551 GQGEISNRAI QKACGTLNEP PPVPVSATTI VKQSKIKKGG KTGVLIDGED

601 GLMTTLAKCC KPAPPDDIAG FVTRERGISV HRKTCPSFRH LAEHAPEKVL

651 DASWAALQEG QVFAVDIEIR AQDRSGLLRD VSDALARHKL NVTAVQTQSR

701 DLEASMRFTL EVKQVNDLPR VLAGLGDVKG VLSVTRL*
```

The following partial DNA sequence was identified in *N. meningitidis* <SEQ ID 419>:

```
m117-1.seq
    1 ATGACCGCCA TCAGCCCGAT TCAAGACACG CAAAGCGCGA CTCTGCAAGA
```

-continued

```
  51 ATTGCGCGAA TGGTTCGACA GCTACTGCGC CGCTCTGCCG GACAACGATA
 101 AAAACCTCAT CGGTACCGCA TGGTTGCTGG CGCAGGAACA TTACCCCGCC
 151 GATGCCGCCA CGCCGTATGG CGAGCCGCTG CCCGACCACT TCCTCGGCGC
 201 GGCGCAAATG GTTCATGAAC TCGACCTGCT CCCCGATGCC GTCGCCGCCA
 251 CCCTGCTTGC CGACATCGGA CGCTACGTCC CCGACTGGAA CCTATTGGTT
 301 TCCGAACGCT GCAACAGTAC CGTCGCCGAG CTGGTCAAAG GTGTGGACGA
 351 AGTGCAGAAA CTCACCCACT TCGCCCGGGT GGACAGCCTC GCCACGCCGG
 401 AAGAACGCGC CCAGCAGGCA GAAACTATGC GGAAAATGCT GCTGGCGATG
 451 GTTACCGACA TCCGCGTCGT GTTAATCAAA CTGGCGATGC GTACGCGCAC
 501 CCTGCAATTT TTAAGCAACG CCCCCGACAG CCCCGAAAAA CGCGCCGTCG
 551 CCAAAGAAAC CCTCGACATC TTCGCCCCGC TCGCCAACCG TTTGGGCGTG
 601 TGGCAGCTCA AATGGCAGCT CGAAGATTTG GGCTTCCGCC ATCAAAAGCC
 651 CGAAAAATAC CGCGAAATCG CGCTGCTTTT GGACGAAAAA CGCACCGAAC
 701 GCCTCGAATA CATCGAAAAC TTCCTCAACA TCCTGCGCGG TGAACTCAAG
 751 AAATACAATG TCCATTTCGA AGTCGCCGGC CGCCCGAAAC ACATCTACTC
 801 CATTTACAAA AAAATGGTGA AGAAAAAACT CAGCTTCGAC GGCCTCTTTG
 851 ACATCCGCGC CGTGCGAATT CTGGTTGATA CCGTCCCCGA GTGTTACACC
 901 ACGCTGGGTA TCGTCCACAG CCTCTGGCAG CCCATTCCCG GCGAGTTCGA
 951 CGACTACATC GCCAATCCCA AAGGCAACGG CTATAAAAGT TTGCACACCG
1001 TCATCGTCGG CCCGGAAGAC AAAGGCGTGG AAGTACAAAT CCGCACCTTC
1051 GATATGCACC AATTCAACGA ATTCGGTGTC GCCGCCCACT GGCGTTACAA
1101 AGAGGGCGGC AAGGGCGATT CCGCCTACGA ACAGAAAATC GCCTGGTTGC
1151 GCCAACTCTT GGACTGGCGC GAAAACATGG CGGAAAGCGG CAAGGAAGAC
1201 CTCGCCGCCG CCTTCAAAAC CGAGCTTTTC AACGACACGA TTTATGTTTT
1251 GACCCCGCAC GGCAAAGTCC TCTCCCTGCC CACGGGCGCG ACCCCCATCG
1301 ACTTCGCCTA CGCCCTGCAC AGCAGCATCG GCGACCGTTG CCGCGGTGCG
1351 AAAGTCGAAG GCAGATTGT GCCGCTGTCC ACCCCGCTCG AAAACGGACA
1401 GCGCGTCGAA ATCATTACCG CCAAAGAAGG GCATCCTTCC GTCAACTGGC
1451 TTTACGAAGG CTGGGTCAAA TCCAACAAGG CAATCGGCAA AATCCGCGCC
1501 TACATCCGCC AGCAAAACGC CGACACCGTG CGCGAAGAAG GCCGCGTCCA
1551 ACTCGACAAA CAGCTTGCCA AACTCACGCC CAAACCCAAC CTGCAAGAGC
1601 TTGCCGAAAA TCTCGGCTAC AAAAAGCCAG AAGACCTCTA CACCGCCGTC
1651 GGACAAGGCG AAATTTCCAA CCGCGCCATC CAAAAGCCT GCGGCACGCT
1701 GAACGAACCG CCGCCCGTAC CCGTCAGCGA ACCACCATC GTCAAACAGT
1751 CCAAAATCAA AAAAGGCGGC AAAAACGGCG TGCTCATCGA CGGCGAAGAC
1801 GGTCTGATGA CCACGCTTGC CAAATGCTGC AAACCCGCGC CGCCCGACGA
1851 TATTATCGGC TTCGTTACCC GCGAGCGCGG CATTTCAGTG CACCGCAAAA
1901 CCTGCCCGTC TTTCCAACAC CTCGCCGAAC ACGCGCCCGA AAAAGTGCTG
1951 GACGCAAGCT GGGCGGCATT GCAGGAAGGA CAAGTATTCG CCGTCGATAT
2001 CGAAATCCGC GCCCAAGACC GCTCCGGGCT TTTGCGCGAC GTATCCGACG
2051 CGCTCGCCCG CCACAAACTC AACGTTACCG CCGTGCAAAC CCAGTCCCGC
```

-continued

```
2101 GACTTGGAAG CCAGCATGAG GTTCACGCTC GAAGTCAAAC AAGTCAACGA
2151 CCTCCCGCGC GTCCTCGCCA GCCTCGGCGA CGTCAAAGGC GTATTGAGCG
2201 TTACCCGGCT TTAA
```

This corresponds to the amino acid sequence <SEQ ID 420; ORF 117-1>:

```
m117-1.pep

1 MTAISPIQDT QSATLQELRE WFDSYCAALP DNDKNLIGTA WLLAQEHYPA

51 DAATPYGEPL PDHFLGAAQM VHELDLLPDA VAATLLADIG RYVPDWNLLV

101 SERCNSTVAE LVKGVDEVQK LTHFARVDSL ATPEERAQQA ETMRKMLLAM

151 VTDIRVVLIK LAMRTRTLQF LSNAPDSPEK RAVAKETLDI FAPLANRLGV

201 WQLKWQLEDL GFRHQKPEKY REIALLLDEK RTERLEYIEN FLNILRGELK

251 KYNVHFEVAG RPKHIYSIYK KMVKKKLSFD GLFDIRAVRI LVDTVPECYT

301 TLGIVHSLWQ PIPGEFDDYI ANPKGNGYKS LHTVIVGPED KGVEVQIRTF

351 DMHQFNEFGV AAHWRYKEGG KGDSAYEQKI AWLRQLLDWR ENMAESGKED

401 LAAAFKTELF NDTIYVLTPH GKVLSLPTGA TPIDFAYALH SSIGDRCRGA

451 KVEGQIVPLS TPLENGQRVE IITAKEGHPS VNWLYEGWVK SNKAIGKIRA

501 YIRQQNADTV REEGRVQLDK QLAKLTPKPN LQELAENLGY KKPEDLYTAV

551 GQGEISNRAI QKACGTLNEP PPVPVSETTI VKQSKIKKGG KNGVLIDGED

601 GLMTTLAKCC KPAPPDDIIG FVTRERGISV HRKTCPSFQH LAEHAPEKVL

651 DASWAALQEG QVFAVDIEIR AQDRSGLLRD VSDALARHKL NVTAVQTQSR

701 DLEASMRFTL EVKQVNDLPR VLASLGDVKG VLSVTRL* m117-1/g117-1 98.2% identity in 737 aa overlap
                 10        20        30        40        50        60
m117-1.pep MTAISPIQDTQSATLQELREWFDSYCAALPDNDKNLIGTAWLLAQEHYPADAATPYGEPL
           ||||||||||||||||||||||||||||||||||||||| ||||||||||||||||||||
g117-1     MTAISPIQDTQSATLQELREWFDSYCAALPDNDKNLIGTAWSLAQEHYPADAATPYGEPL
                 10        20        30        40        50        60

70        80        90       100       110       120
m117-1.pep PDHFLGAAQMVHELDLLPDAVAATLLADIGRYVPDWNLLVSERCNSTVAELVKGVDEVQK
           |||||||||| |||||||||||||||||||||||||||||||||||||||||||||||||
g117-1     PDHFLGAAQMVDELDLLPDAVAATLLADIGRYVPDWNLLVSERCNSTVAELVKGVDEVQK
                 70        80        90       100       110       120

130       140       150       160       170       180
m117-1.pep LTHFARVDSLATPEERAQQAETMRKMLLAMVTDIRVVLIKLAMRTRTLQFLSNAPDSPEK
           ||||||||||||||||||||||||||||||||||||||||||||||||||||||||||||
g117-1     LTHFARVDSLATPEERAQQAETMRKMLLAMVTDIRVVLIKLAMRTRTLQFLSNAPDSPEK
                130       140       150       160       170       180

190       200       210       220       230       240
m117-1.pep RAVAKETLDIFAPLANRLGVWQLKWQLEDLGFRHQKPEKYREIALLLDEKRTERLEYIEN
           |||||||||||||||||||||||||||||||||||:||||||||||||||||||||||||
g117-1     RAVAKETLDIFAPLANRLGVWQLKWQLEDLGFRHQEPEKYREIALLLDEKRTERLEYIEN
                190       200       210       220       230       240

250       260       270       280       290       300
m117-1.pep FLNILRGELKKYNVHFEVAGRPKHIYSIYKKMVKKKLSFDGLFDIRAVRILVDTVPECYT
           ||:||| ||||||:||||||||||||||||||||||||||||||||||||||||||||||
g117-1     FLDILRTELKKYNIHFEVAGRPKHIYSIYKKMVKKKLSFDGLFDIRAVRILVDTVPECYT
                250       260       270       280       290       300
```

```
                310        320        330        340        350        360
m117-1.pep  TLGIVHSLWQPIPGEFDDYIANPKGNGYKSLHTVIVGPEDKGVEVQIRTFDMHQFNEFGV
            ||||||||||||||||||||||||||||||||||||:|||||||||||||||||||||||
g117-1      TLGIVHSLWQPIPGEFDDYIANPKGNGYKSLHTVIVGPEEKGVEVQIRTFDMHQFNEFGV
                310        320        330        340        350        360

370        380        390        400        410        420
m117-1.pep  AAHWRYKEGGKGDSAYEQKIAWLRQLLDWRENMAESGKEDLAAAFKTELFNDTIYVLTPH
            ||||||||||||||||||||||||||||||||||||||||||||||||||||||||||||
g117-1      AAHWRYKEGGKGDSAYEQKIAWLRQLLDWRENMAESGKEDLAAAFKTELFNDTIYVLTPH
                370        380        390        400        410        420

430        440        450        460        470        480
m117-1.pep  GKVLSLPTGATPIDFAYALHSSIGDRCRGAKVEGQIVPLSTPLENGQRVEIITAKEGHPS
            ||||||||||||||||||||||||||||||||||||||||||||||||||||||||||||
g117-1      GKVLSLPTGATPIDFAYALHSSIGDRCRGAKVEGQIVPLSTPLENGQRVEIITAKEGHPS
                430        440        450        460        470        480

490        500        510        520        530        540
m117-1.pep  VNWLYEGWVKSNKAIGKIRAYIRQQNADTVREEGRVQLDKQLAKLTPKPNLQELAENLGY
            |||||||||||:||||||||||||||||||||||||||||||||||||||||||||||||
g117-1      VNWLYEGWVKSGKAIGKIRAYIRQQNADTVREEGRVQLDKQLAKLTPKPNLQELAENLGY
                490        500        510        520        530        540

550        560        570        580        590        600
m117-1.pep  KKPEDLYTAVGQGEISNRAIQKACGTLNEPPPVPVSETTIVKQSKIKKGGKNGVLIDGED
            |||||||||||| ||||||||||||||||||||||||| |||||||||||||:|||||||
g117-1      KKPEDLYTAVGQGEISNRAIQKACGTLNEPPPVPVSATTIVKQSKIKKGGKTGVLIDGED
                550        560        570        580        590        600

610        620        630        640        650        660
m117-1.pep  GLMTTLAKCCKPAPPDDIIGFVTRERGISVHRKTCPSFQHLAEHAPEKVLDASWAALQEG
            ||||||||||||||||||:|||||||||||||||||||:|||||||||||||||||||||
g117-1      GLMTTLAKCCKPAPPDDIAGFVTRERGISVHRKTCPSFRHLAEHAPEKVLDASWAALQEG
                610        620        630        640        650        660

670        680        690        700        710        720
m117-1.pep  QVFAVDIEIRAQDRSGLLRDVSDALARHKLNVTAVQTQSRDLEASMRFTLEVKQVNDLPR
            ||||||||||||||||||||||||||||||||||||||||||||||||||||||||||||
g117-1      QVFAVDIEIRAQDRSGLLRDVSDALARHKLNVTAVQTQSRDLEASMRFTLEVKQVNDLPR
                670        680        690        700        710        720

730
m117-1.pep  VLASLGDVKGVLSVTRLX
            |||:||||||||||||||
g117-1      VLAGLGDVKGVLSVTRLX
                730 m117-1/RelA
sp|P55133|RELA_VIBSS GTP PYROPHOSPHOKINASE (ATP:GTP 3'-PYROPHOSPHOTRANSFERASE) (PPGPP SYNTHETASEI)
>gi|537617 (U13769) ppGpp synthetase I [Vibrio sp.] Length = 744 Score = 536 bits (1366),
Expect = e-151 Identities = 288/685 (42%), Positives = 432/685 (63%), Gaps = 31/685 (4%)

Query:  74  LDLLPDAVAATLLADI---GRYVPDWNLLVSERCNSTVAELVKGVDEVQKLTHFARVDSL  130
            L + D+ALL +    G Y D   + E  T+  LV+GV+++  ++    ++  S
Sbjct:  68  LSMDADTLIAALLYPLVEGGCYSTD---ALKEEYSGTILHLVQGVQMCAIS---QLKST  121

Query: 131  ATPEERAQQAETMRKMLLAMVTDIRVVLIKLAMRTRTLQFLSNAPDSPEKRAVAKETLDI  190
            A    +AQ +  +R+MLL+MV D R V+IKLA R    L+ +   PD   +RA A+E  +I
Sbjct: 122  AEETAQAAQVDNIRRMLLSMVDDFRCVVIKLAERICNLREVKDQPDEV--RRAAAQECANI  180

Query: 191  FAPLANRLGVWQLKWQLEDLGFRHQKPEKYREIALLLDEKRTERLEYIENFLNILRGELK  250
            +APLANRLG+ QLKW++ED  FR Q P+ Y++IA  L E+R  +YI +F++  L    +K
Sbjct: 181  YAPLANRLGIGQLKWEIEDYAFRYQHPDTYKQIAKQLSERRIDREDYITHFVDDLSDAMK  240

Query: 251  KYNVHFEVAGRPKHIYSIYKKMVKKKLSFDGLFDIRAVRILVDTVPECYTTLGIVHSLWQ  310
            N+   EV GRPKHIYSI++KM KK  L  FD  LFD+RAVRI+  +   +CY   LG+VH+  +
Sbjct: 241  ASNIRAEVGRPKHIYSIWRKMQKKSLEFDELFDVRAVRIVAEELQDCYAALGVVHTKYR  300

Query: 311  PIPGEFDDYIANPKGNGYKSLHTVIVGPEDKGVEVQIRTFDMHQFNEFGVAAHWRYKEG-  369
              +P  EFDDY+ANPK NGY+S+HTV++GPE K  +E+QIRT  MH+  +E GVAAHW+YKEG
Sbjct: 301  HLPKEFDDYVANPKPNGYQSIHTVVLGPEGKTIEIQIRTKQMHEESELGVAAHWYKEGT  360

Query: 370  --GKGDSAYEQKIAWLRQLLDWRENMAESGKEDLAAAFKTELFNDTIYVLTPHGKVLSLP  427
                 G    SAY++KI WLR+LL W+E M ++SG  ++     ++F+D +Y    TP G  V+ LP
Sbjct: 361  ASGGAQSAYDEKINWLRKLLAWQEEMSDSG--EMLDELRSQVFDDRVYAFTPKGDVVDLP  418

Query: 428  TGATPIDFAYALHSSIGDRCRGAKVEGQIVPLSTPLENGQRVEIITAKEGHPSVNWLYE-  486
            + ATP+DFAY +HS +G RC GAKVEG+IVP   +  L+ G  +VEIIT KE +PS  +WL +
Sbjct: 419  SNATPLDFAYHIHSEVGHRCIGAKVEGRIVPFTYHLQMGDQVEIITQKEPNPSRDWLNPN  478

Query: 487  -GWVKSNKAIGKIRAYIRQQNADTVREEGRVQLDKQLAKL--TPKPNLQELAENLGYKKP  543
             G+V S++  K+ A+  R+Q+  D    G+    L+ +L K+   T K       A+    K P
Sbjct: 479  LGFVTSSRARAKVHAWFRKQDRDKNIIAGKEILEAELVKIHATLKDAQYYAAKRFNVKSP  538
```

-continued

```
Query: 544  EDLYTAVGQGEIS-NRAIQKACGTLNEPPPVPVSETTIVKQSKI--------KKGGKNGV  594
            E+LY  +G G++  N+ I       +N+P       +   + K S+         KK  ++ V
Sbjct: 539  EELYAGIGSGDLRINQVINHINALVNKPTAEEEDQQLLEKLSEASNKQATSHKKPQRDAV  598

Query: 595  LIDGEDGLMTTLAKCCKPAPPDDIIGFVTRERGISVHRKTCPSFQHLAEHAPEKVLDASW  654
            +++G D LMT LA+CC+P P DDI GFVT+ RGISVHR  C    + L  HAPE+++D  W
Sbjct: 599  VVEGVDNLMTHLARCCQPIPGDDIQGFVTQGRGISVHRMDCEQLEELRHHAPERIIDTVW  658

Query: 655  AALQEGQVFAVDIEIRAQDRSGLLRDVSDALARHKLNVTAVQTQ--SRDLEASMRFTLEV  712
                 G  + + + + A +R+GLL+++++ L    K+ V  ++++    +    + M F LE+
Sbjct: 659  GGGFVGN-YTITVRVTASERNGLLKELTNTLMNEKVKVAGMKSRVDYKKQMSIMDFELEL  717

Query: 713  KQVNDLPRVLASLGDVKGVLSVTRL                                    737
              +  L RVL  +  VK V    RL
Sbjct: 718  TDLEVLGRVLKRIEQVKDVAEAKRL                                    742
```

The following partial DNA sequence was identified in *N. meningitidis* <SEQ ID 421>:

```
a117-1.seq
   1 ATGACCGCCA TCAGCCCGAT TCAAGACACG CAAAGCGCGA CTCTGCAAGA

51 ATTGCGCGAA TGGTTCGACA GCTACTGCAC CGCGCTGCCG AACAACGATA

101 AAAAACTTGT CTTAGCCGCC CGTTCGCTGG CGGAAGCACA TTACCCCGCC

151 GATGCCGCCA CGCCGTATGG CGAACCGCTG CCCGACCACT TCCTCGGCGC

201 GGCGCAAATG GTTCATGAAC TCGACCTGCT CCCCGATGCC GTCGCCGCCA

251 CCCTGCTTGC CGACATCGGA CGCTACGTCC CCGACTGGAA CCTATTGGTT

301 TCCGAACGCT GCAACAGTAC CGTCGCCGAG CTGGTCAAAG GTGTGGACGA

351 AGTGCAGAAA CTCACCCACT TCGCCCGGGT GGACAGCCTC GCCACGCCGG

401 AAGAACGCGC CCAGCAGGCA GAAACTATGC GGAAAATGCT GCTGGCGATG

451 GTTACCGACA TCCGCGTCGT GTTAATCAAA CTGGCGATGC GTACGCGCAC

501 CCTGCAATTT TTAAGCAACG CCCCCGACAG CCCCGAAAAA CGCGCCGTCG

551 CCAAAGAAAC CCTCGACATC TTCGCCCCGC TCGCCAACCG TTTGGGCGTG

601 TGGCAGCTCA AATGGCAGCT CGAAGATTTG GGCTTCCGCC ATCAAGAACC

651 CGAAAAATAC CGCGAAATCG CCCTGCTTTT GGACGAAAAA CGCACCGAAC

701 GCCTCGAATA CATCGAAAAC TTCCTTAATA TCCTGCGTAC GGAACTCAAA

751 AAATACAATA TCCACTTTGA AGTCGCCGGC CGTCCGAAAC ACATCTACTC

801 CATTTACAAA AAAATGGTGA AGAAAAAACT CAGCTTCGAC GGGTTGTTCG

851 ACATCCGCGC CGTGCGGATT CTGGTTGATA CCGTCCCCGA GTGTTACACC

901 ACACTGGGCA TTGTCCACAG CCTCTGGCAG CCCATTCCCG GCGAGTTCGA

951 CGACTACATC GCCAACCCGA AAGGCAACGG CTATAAAAGT TTGCACACCG

1001 TCATCGTCGG CCCGGAAGAC AAAGGCGTGG AAGTGCAAAT CCGCACCTTC

1051 GATATGCACC AATTCAACGA ATTCGGTGTC GCCGCGCACT GGCGTTACAA

1101 AGAGGGCGGC AAAGGCGATT CCGCCTACGA ACAAAAAATC GCCTGGTTAC

1151 GCCAACTTTT GGACTGGCGC GAAAACATGG CGGAAAGCGG CAAGGAAGAC

1201 CTCGCCGCCG CCTTCAAAAC CGAGCTTTTC AACGACACGA TTTATGTTTT

1251 GACCCCGCAC GGCAAAGTCC TCTCCCTGCC CACAGGCGCG ACCCCCATCG

1301 ACTTCGCCTA CGCCCTGCAC AGCAGCATCG GCGACCGTTG CCGCGGTGCG

1351 AAAGTCGAAG GGCAGATTGT GCCGCTGTCC ACCCCGCTCG AAAACGGACA

1401 GCGTGTCGAA ATCATTACCG CCAAAGAAGG GCATCCTTCC GTCAACTGGC

1451 TTTACGAAGG CTGGGTCAAA TCCAACAAGG CAATCGGCAA AATCCGCGCC
```

```
-continued
1501 TACATCCGCC AGCAAAACGC CGACACCGTG CGCGAAGAAG GCCGCGTCCA

1551 ACTCGACAAA CAGCTTGCCA AACTCACGCC CAAACCCAAC CTGCAAGAGC

1601 TTGCCGAAAA TCTCGGCTAC AAAAAGCCAG AAGACCTCTA CACCGCCGTC

1651 GGACAAGGCG AAATTTCCAA CCGCGCCATC CAAAAAGCCT GCGGCACGCT

1701 GAACGAACCG CCGCCCGTAC CCGTCAGCGA AACCACCATC GTCAAACAGT

1751 CCAAAATCAA AAAGGCGGC AAAAACGGCG TGCTCATCGA CGGCGAAGAC

1801 GGTCTGATGA CCACGCTTGC CAAATGCTGC AAACCCGCGC CGCCCGACGA

1851 CATTGTCGGC TTCGTTACCC GCGATCGCGG CATTTCGGTA CACCGCAAAA

1901 CCTGCCCCTC TTTCCGACAC CTCGCCGAAC ACGCGCCCGA AAAAGTACTG

1951 GACGCAAGTT GGGCGGCGTT GCAGGAAGGA CAAGTGTTCG CCGTCGATAT

2001 CGAAATCCGC GCCCAAGACC GCTCCGGGCT TTTGCGCGAC GTATCCGACG

2051 CGCTCGCCCG CCACAAACTC AACGTTACCG CCGTGCAAAC CCAGTCCCGC

2101 GACTTGGAAG CCAGCATGAG GTTCACGCTC GAAGTCAAAC AAGTTACCGA

2151 CCTCCCACGC GTCCTCGCCA GCCTCGGCGA CGTCAAAGGC GTATTGAGCG

2201 TTACCCGGCT TTAA
```

This corresponds to the amino acid sequence <SEQ ID 422; ORF 117-1.a>:

```
a117-1.pep
      1 MTAISPIQDT QSATLQELRE WFDSYCTALP NNDKKLVLAA RSLAEAHYPA

51 DAATPYGEPL PDHFLGAAQM VHELDLLPDA VAATLLADIG RYVPDWNLLV

101 SERCNSTVAE LVKGVDEVQK LTHFARVDSL ATPEERAQQA ETMRKMLLAM

151 VTDIRVVLIK LAMRTRTLQF LSNAPDSPEK RAVAKETLDI FAPLANRLGV

201 WQLKWQLEDL GFRHQEPEKY REIALLLDEK RTERLEYIEN FLNILRTELK

251 KYNIHFEVAG RPKHIYSIYK KMVKKKLSFD GLFDIRAVRI LVDTVPECYT

301 TLGIVHSLWQ PIPGEFDDYI ANPKGNGYKS LHTVIVGPED KGVEVQIRTF

351 DMHQFNEFGV AAHWRYKEGG KGDSAYEQKI AWLRQLLDWR ENMAESGKED

401 LAAAFKTELF NDTIYVLTPH GKVLSLPTGA TPIDFAYALH SSIGDRCRGA

451 KVEGQIVPLS TPLENGQRVE IITAKEGHPS VNWLYEGWVK SNKAIGKIRA

501 YIRQQNADTV REEGRVQLDK QLAKLTPKPN LQELAENLGY KKPEDLYTAV

551 GQGEISNRAI QKACGTLNEP PPVPVSETTI VKQSIKKGG KNGVLIDGED

601 GLMTTLAKCC KPAPPDDIVG FVTRDRGISV HRKTCPSFRH LAEHAPEKVL

651 DASWAALQEG QVFAVDIEIR AQDRSGLLRD VSDALARHKL NVTAVQTQSR

701 DLEASMRFTL EVKQVNDLPR VLASLGDVKG VLSVTRL* a117-1/m117-1 97.7% identity in 737 aa overlap
                  10         20         30         40         50         60
m117-1.pep MTAISPIQDTQSATLQELREWFDSYCAALPDNDKNLIGTAWLLAQEHYPADAATPYGEPL
           ||||||||||||||||||||||||||:|||:|||:|: :|  ||: ||||||||||||||
a117-1     MTAISPIQDTQSATLQELREWFDSYCTALPNNDKKLVLAARSLAEAHYPADAATPYGEPL
                  10         20         30         40         50         60

70         80         90        100        110        120
m117-1.pep PDHFLGAAQMVHELDLLPDAVAATLLADIGRYVPDWNLLVSERCNSTVAELVKGVDEVQK
           ||||||||||||||||||||||||||||||||||||||||||||||||||||||||||||
a117-1     PDHFLGAAQMVHELDLLPDAVAATLLADIGRYVPDWNLLVSERCNSTVAELVKGVDEVQK
                  70         80         90        100        110        120
```

```
            130       140       150       160       170       180
m117-1.pep  LTHFARVDSLATPEERAQQAETMRKMLLAMVTDIRVVLIKLAMRTRTLQFLSNAPDSPEK
            ||||||||||||||||||||||||||||||||||||||||||||||||||||||||||||
a117-1      LTHFARVDSLATPEERAQQAETMRKMLLAMVTDIRVVLIKLAMRTRTLQFLSNAPDSPEK
            130       140       150       160       170       180

190       200       210       220       230       240
m117-1.pep  RAVAKETLDIFAPLANRLGVWQLKWQLEDLGFRHQKPEKYREIALLLDEKRTERLEYIEN
            |||||||||||||||||||||||||||||||||||:||||||||||||||||||||||||
a117-1      RAVAKETLDIFAPLANRLGVWQLKWQLEDLGFRHQEPEKYREIALLLDEKRTERLEYIEN
            190       200       210       220       230       240

250       260       270       280       290       300
m117-1.pep  FLNILRGELKKYNVHFEVAGRPKHIYSIYKKMVKKKLSFDGLFDIRAVRILVDTVPECYT
            ||||||  ||||||:|||||||||||||||||||||||||||||||||||||||||||||
a117-1      FLNILRTELKKYNIHFEVAGRPKHIYSIYKKMVKKKLSFDGLFDIRAVRILVDTVPECYT
            250       260       270       280       290       300

310       320       330       340       350       360
m117-1.pep  TLGIVHSLWQPIPGEFDDYIANPKGNGYKSLHTVIVGPEDKGVEVQIRTFDMHQFNEFGV
            ||||||||||||||||||||||||||||||||||||||||||||||||||||||||||||
a117-1      TLGIVHSLWQPIPGEFDDYIANPKGNGYKSLHTVIVGPEDKGVEVQIRTFDMHQFNEFGV
            310       320       330       340       350       360

370       380       390       400       410       420
m117-1.pep  AAHWRYKEGGKGDSAYEQKIAWLRQLLDWRENMAESGKEDLAAAFKTELFNDTIYVLTPH
            ||||||||||||||||||||||||||||||||||||||||||||||||||||||||||||
a117-1      AAHWRYKEGGKGDSAYEQKIAWLRQLLDWRENMAESGKEDLAAAFKTELFNDTIYVLTPH
            370       380       390       400       410       420

430       440       450       460       470       480
m117-1.pep  GKVLSLPTGATPIDFAYALHSSIGDRCRGAKVEGQIVPLSTPLENGQRVEIITAKEGHPS
            ||||||||||||||||||||||||||||||||||||||||||||||||||||||||||||
a117-1      GKVLSLPTGATPIDFAYALHSSIGDRCRGAKVEGQIVPLSTPLENGQRVEIITAKEGHPS
            430       440       450       460       470       480

490       500       510       520       530       540
m117-1.pep  VNWLYEGWVKSNKAIGKIRAYIRQQNADTVREEGRVQLDKQLAKLTPKPNLQELAENLGY
            ||||||||||||||||||||||||||||||||||||||||||||||||||||||||||||
a117-1      VNWLYEGWVKSNKAIGKIRAYIRQQNADTVREEGRVQLDKQLAKLTPKPNLQELAENLGY
            490       500       510       520       530       540

550       560       570       580       590       600
m117-1.pep  KKPEDLYTAVGQGEISNRAIQKACGTLNEPPPVPVSETTIVKQSKIKKGGKNGVLIDGED
            ||||||||||||||||||||||||||||||||||||||||||||||||||||||||||||
a117-1      KKPEDLYTAVGQGEISNRAIQKACGTLNEPPPVPVSETTIVKQSKIKKGGKNGVLIDGED
            550       560       570       580       590       600

610       620       630       640       650       660
m117-1.pep  GLMTTLAKCCKPAPPDDIIGFVTRERGISVHRKTCPSFQHLAEHAPEKVLDASWAALQEG
            |||||||||||||||||||:||||:|||||||||||||:|||||||||||||||||||||
a117-1      GLMTTLAKCCKPAPPDDIVGFVTRDRGISVHRKTCPSFRHLAEHAPEKVLDASWAALQEG
            610       620       630       640       650       660

670       680       690       700       710       720
m117-1.pep  QVFAVDIEIRAQDRSGLLRDVSDALARHKLNVTAVQTQSRDLEASMRFTLEVKQVNDLPR
            |||||||||||||||||||||||||||||||||||||||||||||||||||||||:||||
a117-1      QVFAVDIEIRAQDRSGLLRDVSDALARHKLNVTAVQTQSRDLEASMRFTLEVKQVTDLPR
            670       680       690       700       710       720

730
m117-1.pep  VLASLGDVKGVLSVTRLX
            ||||||||||||||||||
a117-1      VLASLGDVKGVLSVTRLX
            730
```

The following partial DNA sequence was identified in *N. gonorrhoeae* <SEQ ID 423>:

```
g118.seq
   1  ATGTGCGAGT TCAAGGATTT TAGAAGAAAC ATCCCTTGTT TTGAAGAGTA

51  TGACGAAAAT TCATTTATTG GCAAATGGTA TGATGACGGG GTGTGGGATG
```

```
-continued
101  ATGAAGAATA TTGGAAGCTG GAGAATGATT TAATcgaGGT TAGGAGAAAA

151  TATCCTTATC CGATGGATAT ACCAAGGGAT ATTGTGATTG GAATCGGTAC

201  CATTATTGAT TTTTTAATGG TTCCAAATTG GGAGCTTTTT GAAATTAAAG

251  CTTCCCCTTG GTTGCCTGAT AGCGTGGGAA TTCATGAACG TTATGAAGA

301  TTCACAACGA TGCTCCGTTA TATTTTTACC GAGAAAGACA TAGTCAACGT

351  GCGATTTGAT TATTACAaCA AAAAATAG
```

This corresponds to the amino acid sequence <SEQ ID 424; ORF 118.ng>:

```
g118.pep
  1  MCEFKDFRRN IPCFEEYDEN SFIGKWYDDG VWDDEEYWKL ENDLIEVRRK

51  YPYPMDIPRD IVIGIGTIID FLMVPNWELF EIKASPWLPD SVGIHERYER

101  FTTMLRYIFT EKDIVNVRFD YYNKK*
```

The following partial DNA sequence was identified in *N. meningitidis* <SEQ ID 425>:

```
m118.seq
  1  ATGTGTGAGT TCAAGGATAT TATAAGAAAC GTTCCTTATT TTGAGGGGTA

51  TGACGAAAAT TCATTTATTG GCAAATGGTA TGATGACGGG GTGTGGGATG

101  ATGAAGAATA TTGGAAGTTG GAGAATGATT TAATCGAGGT TAGAAAAAAA

151  TATCCTTATC CGATGGACAT ACCAAGATAT GTTGTCATTG GAATCGGTAC

201  CATTATTGAT TTCTTAATGG TTCCAAATTG GAAACTTTTT GAAATTAAAG

251  CTTCCCCTTG GTTGCCTGAT AGTGTGGGAA TTCATGAACG TTATGAAGA

301  TTCACAACGA TGCTCCGTTA TATTTTTACC GAGAAAGACA TAGTCAACGT

351  GCGATTTGAT TATTACAACA AAAAATAG
```

This corresponds to the amino acid sequence <SEQ ID 426; ORF 118>:

```
m118.pep
  1  MCEFKDIIRN VPYFEGYDEN SFIGKWYDDG VWDDEEYWKL ENDLIEVRKK

51  YPYPMDIPRY VVIGIGTIID FLMVPNWKLF EIKASPWLPD SVGIHERYER

101  FTTMLRYIFT EKDIVNVRFD YYNKK*
```

Computer analysis of this amino acid sequence gave the following results:

Homology with a Predicted ORF from *N. gonorrhoeae*
ORF 118 shows 92.8% identity over a 125 aa overlap with a predicted ORF (ORF 118.ng) from *N. gonorrhoeae*:

```
    m118/g118
                    10         20         30         40         50         60
    m118.pep    MCEFKDIIRNVPYFEGYDENSFIGKWYDDGVWDDEEYWKLENDLIEVRKKYPYPMDIPRY
                ||||||: ||:| || ||||||||||||||||||||||||||||||||:|||||||||
    g118        MCEFKDFRRNIPCFEEYDENSFIGKWYDDGVWDDEEYWKLENDLIEVRRKYPYPMDIPRD
                    10         20         30         40         50         60
```

```
                  70         80         90        100        110        120
m118.pep  VVIGIGTIIDFLMVPNWKLFEIKASPWLPDSVGIHERYERFTTMLRYIFTEKDIVNVRFD
          :||||||||||||||:||||||||||||||||||||||||||||||||||||||||||||
g118      IVIGIGTIIDFLMVPNWELFEIKASPWLPDSVGIHERYERFTTMLRYIFTEKDIVNVRFD
                  70         80         90        100        110        120 m118.pep  YYNKKX
          ||||||
g118      YYNKKX
```

The following partial DNA sequence was identified in *N. meningitidis* <SEQ ID 427>:

```
a118.seq
  1  ATGTGTGAGT TCAAGGATTT TAGAAGAAAC ATCCCTTGTT TGAAGAGTA

51  TGACGAAAAT TCATTTATTG GCAAATGGTA TGATGACGGG GTGTGGGATG

101  ATGAAGAATA TTGGAAATTG GAGAATGATT TAATCGAGGT TAGAAAAAAA

151  TATCCTTATC CGATGGATAT ACCAAGGGAT ATTGTGATTG GAATCGGTAC

201  CATTATTGAT TTTTTAATGG TTCCAAATTG GGAGCTTTTT GAAATTAAAG

251  CTTCCCCTTG GTTGCCTGAT AGTGTGGGAA TTCATGAACG TTATGAAAGA

301  TTCACAACGA TGCTCCGTTA TATTTTTACC GAGAAAGACA TAGTCAACGT

351  GCGATTTGAT TATTACAACA AAAAATAG
```

This corresponds to the amino acid sequence <SEQ ID 428; ORF 118.a>:

```
a118.pep

1  MCEFKDFRRN IPCFEEYDEN SFIGKWYDDG VWDDEEYWKL ENDLIEVRKK
   51  YPYPMDIPRD IVIGIGTIID FLMVPNWELF EIKASPWLPD SVGIHERYER
  101  FTTMLRYIFT EKDIVNVRFD YYNKK* m118/a118  93.6% identity in 125 aa overlap
```

```
                  10         20         30         40         50         60
m118.pep  MCEFKDIIRNVPYFEGYDENSFIGKWYDDGVWDDEEYWKLENDLIEVRKKYPYPMDIPRY
          ||||||:||:|||||||||||||||||||||||||||||||||||||||||||||||||
a118      MCEFKDFRRNIPCFEEYDENSFIGKWYDDGVWDDEEYWKLENDLIEVRKKYPYPMDIPRD
                  10         20         30         40         50         60
                  70         80         90        100        110        120
m118.pep  VVIGIGTIIDFLMVPNWKLFEIKASPWLPDSVGIHERYERFTTMLRYIFTEKDIVNVRFD
          :||||||||||||||:||||||||||||||||||||||||||||||||||||||||||||
a118      IVIGIGTIIDFLMVPNWELFEIKASPWLPDSVGIHERYERFTTMLRYIFTEKDIVNVRFD
                  70         80         90        100        110        120 m118.pep  YYNKKX
          ||||||
a118      YYNKKX
```

The following partial DNA sequence was identified in *N. gonorrhoeae* <SEQ ID 429>:

```
g120.seq
  1  ATGATGAAGA CTTTTAAAAA TATATTTTCC GCCGCCATTT TGTCCGCCGC

51  CCTGCCGTGC GCGTATGCGG CAAGGCTACC CCAATCCGCC GTGCTGCACT

101  ATTCCGGCAG CTACGGCATT CCCGCCACGA TGACATTTGA ACGCAGCGGC

151  AATGCTTACA AAATCGTTTC GACGATTAAA GTGCCGCTAT ACAATATCCG
```

-continued

```
201 TTTCGAATCC GGCGGTACGG TTGTCGGCAA TACCCTGCAC CCTGCCTACT

251 ATAAAGACAT ACGCAGGGGC AAACTGTATG CGGAAGCCAA ATTCGCCGAC

301 GGCAGCGTAA CCTACGGCAA AGCGGGCGAG AGCAAAACCG AGCAAAGCCC

351 CAAGGCTATG GATTTGTTCA CGCTTGCCTG GCAGTTGGCG GCAAATGACG

401 CGAAACTCCC CCCGGGTCTG AAAATCACCA ACGGCAAAAA ACTTTATTCC

451 GTCGGCGGCC TGAATAAGGC GGGTACGGGA AAATACAGCA Taggcggcgt 501 gGAAACCGAA GTCGTCAAAT ATCGGGTGCG GCGCGGCGAC GATACGGTAA

551 CGTATTTCTT CGCACCGTCC CTGAACAATA TTCCGGCACA AATCGGCTAT

601 ACCGAcgaCG GCAAAACCTA TACGCTGAAG CTCAAATCGG TGCAGATCAA

651 CGGACAGGCC GCCAAACCGT AA
```

This corresponds to the amino acid sequence <SEQ ID 430; ORF 120.ng>:

```
g120.pep
  1 MMKTFKNIFS AAILSAALPC AYAARLPQSA VLHYSGSYGI PATMTFERSG

51 NAYKIVSTIK VPLYNIRFES GGTVVGNTLH PAYYKDIRRG KLYAEAKFAD

101 GSVTYGKAGE SKTEQSPKAM DLFTLAWQLA ANDAKLPPGL KITNGKKLYS

151 VGGLNKAGTG KYSIGGVETE VVKYRVRRGD DTVTYFFAPS LNNIPAQIGY

201 TDDGKTYTLK LKSVQINGQA AKP*
```

The following partial DNA sequence was identified in *N. meningitidis* <SEQ ID 431>:

```
m120.seq
  1 ATGATGAAGA CTTTTAAAAA TATATTTTCC GCCGCCATTT TGTCCGCCGC

51 CCTGCCGTGC GCGTATGCGG CAGGGCTGCC CCAATCCGCC GTGCTGmACT

101 ATTCCGGCAG CTACGGCATT CCCGCCACGA TGACATTTGA ACGCAGCGGC

151 AATGCTTACA AAATCGTTTC GACGATTAAA GTGCCGCTAT ACAATATCCG

201 TTTCGAGTCC GGCGGTACGG TTGTCGGCAA TACCCTGCAC CCTACCTACT

251 ATAGAGACAT ACGCAGGGGC AAACTGTATG CGGAAGCcAA ATTCGCCGAC

301 GGCAGCGTAA CTTACGGCAA AGCGGGCGAG AGCAAAACCG AGCAAAGCCC

351 CAAGGCTATG GATTTGTTCA CGCTTGCCTG GCAGTTGGCG GCAAATGACG

401 CGAAACTCCC CCCGGGGCTG AAAATCACCA ACGGCAAAAA ACTTTATTCC

451 GTCGGCGGTT TGAATAAGGC GGGTACAGGA AAATACAGCA TAGGCGGCGT

501 GGAAACCGAA GTCGTCAAAT ATCGGGTGCG GCGCGGCGAC GATGCGGTAA

551 TGTATTTCTT CGCACCGTCC CTGAACAATA TTCCGGCACA AATCGGCTAT

601 ACCGACGACG GCAAAACCTA TACGCTGAAA CTCAAATCGG TGCAGATCAA

651 CGGCCAGGCA GCCAAACCG
```

This corresponds to the amino acid sequence <SEQ ID 432; ORF 120>:

```
m120.pep
  1 MMKTFKNIFS AAILSAALPC AYAAGLPQSA VLXYSGSYGI PATMTFERSG

51 NAYKIVSTIK VPLYNIRFES GGTVVGNTLH PTYYRDIRRG KLYAEAKFAD
```

```
101  GSVTYGKAGE SKTEQSPKAM DLFTLAWQLA ANDAKLPPGL KITNGKKLYS

151  VGGLNKAGTG KYSIGGVETE VVKYRVRRGD DAVMYFFAPS LNNIPAQIGY

201  TDDGKTYTLK LKSVQINGQA AKP
```

Computer analysis of this amino acid sequence gave the following results:

Homology with a Predicted ORF from *N. gonorrhoeae*

ORF 120 shows 97.3% identity over a 223 aa overlap with a predicted ORF (ORF 120.ng) from *N. gonorrhoeae*:

```
m120/g120

10         20         30         40         50         60
m120.pep  MMKTFKNIFSAAILSAALPCAYAAGLPQSAVLXYSGSYGIPATMTFERSGNAYKIVSTIK
          ||||||||||||||||||||||| ||||||| ||||||||||||||||||||||||||||
g120      MMKTFKNIFSAAILSAALPCAYAARLPQSAVLHYSGSYGIPATMTFERSGNAYKIVSTIK
                  10         20         30         40         50         60

70         80         90        100        110        120
m120.pep  VPLYNIRFESGGTVVGNTLHPTYYRDIRRGKLYAEAKFADGSVTYGKAGESKTEQSPKAM
          ||||||||||||||||||||||| :|| :|||||||||||||||||||||||||||||||
g120      VPLYNIRFESGGTVVGNTLHPAYYKDIRRGKLYAEAKFADGSVTYGKAGESKTEQSPKAM
                  70         80         90        100        110        120

130        140        150        160        170        180
m120.pep  DLFTLAWQLAANDAKLPPGLKITNGKKLYSVGGLNKAGTGKYSIFFVETEVVKYRVRRGD
          ||||||||||||||||||||||||||||||||||||||||||||||||||||||||||||
g120      DLFTLAWQLAANDAKLPPGLKITNGKKLYSVGGLNKAGTGKYSIFFVETEVVKYRVRRGD
                 130        140        150        160        170        180

190        200        210        220
m120.pep  DAVMYFFAPSLNNIPAQIGYTDDGKTYTLKLKSVQINGQAAKP
          |:||||||||||||||||||||||||||||||||||||||||
g120      DTVTYFFAPSLNNIPAQIGYTDDGKTYTLKLKSVQINGQAAKPX
                 190        200        210        220
```

The following partial DNA sequence was identified in *N. meningitidis* <SEQ ID 433>:

```
a120.seq
  1  ATGATGAAGA CTTTTAAAAA TATATTTTCC GCCGCCATTT TGTCCGCCGC

51  CCTGCCGTGC GCGTATGCGG CAGGGCTGCC CCAATCCGCC GTGCTGCACT

101  ATTCCGGCAG CTACGGCATT CCCGCCACGA TGACATTTGA ACGCAGCGGC

151  AATGCTTACA AAATCGTTTC GACGATTAAA GTGCCGCTAT ACAATATCCG

201  TTTCGAGTCC GGCGGTACGG TTGTCGGCAA TACCCTGCAC CCTACCTACT

251  ATAGAGACAT ACGCAGGGGC AAACTGTATG CGGAAGCCAA ATTCGCCGAC

301  GGCAGCGTAA CCTACGGCAA AGCGGGCGAG AGCAAAACCG AGCAAAGCCC

351  CAAGGCTATG GATTTGTTCA CGCTTGCCTG GCAGTTGGCG GCAAATGACG

401  CGAAACTCCC CCCGGGGCTG AAAATCACCA ACGGCAAAAA ACTTTATTCC

451  GTCGGCGGTT TGAATAAGGC GGGTACAGGA AAATACAGCA TAGGCGGCGT

501  GGAAACCGAA GTCGTCAAAT ATCGGGTGCG GCGCGGCGAC GATGCGGTAA

551  TGTATTTCTT CGCACCGTCC CTGAACAATA TTCCGGCACA AATCGGCTAT

601  ACCGACGACG GCAAAACCTA TACGCTGAAA CTCAAATCGG TGCAGATCAA

651  CGGCCAGGCA GCCAAACCGT AA
```

This corresponds to the amino acid sequence <SEQ ID 434; ORF 120.a>:

```
a120.pep

1 MMKTFKNIFS AAILSAALPC AYAAGLPQSA VLHYSGSYGI PATMTFERSG

51 NAYKIVSTIK VPLYNIRFES GGTVVGNTLH PTYYRDIRRG KLYAEAKFAD

101 GSVTYGKAGE SKTEQSPKAM DLFTLAWQLA ANDAKLPPGL KITNGKKLYS

151 VGGLNKAGTG KYSIGGVETE VVKYRVRRGD DAVMYFFAPS LNNIPAQIGY

201 TDDGKTYTLK LKSVQINGQA AKP* m120/a120  99.6% identity in 223 aa overlap 10        20        30        40        50        60
m120.pep  MMKTFKNIFSAAILSAALPCAYAAGLPQSAVLXYSGSYGIPATMTFERSGNAYKIVSTIK
          ||||||||||||||||||||||||||||||| ||||||||||||||||||||||||||||
a120      MMKTFKNIFSAAILSAALPCAYAAGLPQSAVLHYSGSYGIPATMTFERSGNAYKIVSTIK
                  10        20        30        40        50        60

70        80        90       100       110       120
m120.pep  VPLYNIRFESGGTVVGNTLHPTYYRDIRRGKLYAEAKFADGSVTYGKAGESKTEQSPKAM
          ||||||||||||||||||||||||||||||||||||||||||||||||||||||||||||
a120      VPLYNIRFESGGTVVGNTLHPTYYRDIRRGKLYAEAKFADGSVTYGKAGESKTEQSPKAM
                  70        80        90       100       110       120

130       140       150       160       170       180
m120.pep  DLFTLAWQLAANDAKLPPGLKITNGKKLYSVGGLNKAGTGKYSIGGVETEVVKYRVRRGD
          ||||||||||||||||||||||||||||||||||||||||||||||||||||||||||||
a120      DLFTLAWQLAANDAKLPPGLKITNGKKLYSVGGLNKAGTGKYSIGGVETEVVKYRVRRGD
                 130       140       150       160       170       180

190       200       210       220
m120.pep  DAVMYFFAPSLNNIPAQIGYTDDGKTYTLKLKSVQINGQAKPX
          ||||||||||||||||||||||||||||||||||||||||||
a120      DAVMYFFAPSLNNIPAQIGYTDDGKTYTLKLKSVQINGQAKPX
                 190       200       210       220
```

The following partial DNA sequence was identified in *N. gonorrhoeae* <SEQ ID 435>:

```
g121.seq
    1 ATGGAAACAC AGCTTTACAT CGGCATTATG TCGGGAACCA GTATGGACGG

51 GGCGGATGCC GTGCTGGTAC GGATGGACGG CGGCAAATGG CTGGGCGCGG

101 AAGGGCACGC CTTTACCCCC TACCCTGACC GGTTGCGCCG CAAATTGCTG

151 GATTTGCAGG ACACAGGCAC AGACGAACTG CACCGCAGCA GGATGTTGTC

201 GCAAGAACTC AGCCGCCTGT ACGCGCAAAC CGCCGCCGAA CTGCTGTGCA

251 GTCAAAACCT CGCTCCGTGC GACATTACCG CCCTCGGCTG CCACGGGCAA

301 ACCGTCCGAC ACGCGCCGGA ACACGGTtac AGCATACAGC TTGCCGATTT

351 GCCGCTGCTG GCGGAACTGa cgcggatttT TACCGTCggc gacttcCGCA

401 GCCGCGACCT TGCTGCCGGC GGacaAGGTG CGCCGCTCGT CCCCGCCTTT

451 CACGAAGCCC TGTTCCGCGA TGACAGGGAA ACACGCGTGG TACTGAACAT

501 CGGCGGGATT GCCAACATCA GCGTACTCCC CCCCGGCGCA CCCGCCTTCG

551 GCTTCGACAC AGGGCCGGGC AATATGCTGA TGGAcgcgtg gacgcaggca 601 cacTGGcagc TGCCTTACGA CAAAAacggt gcAAAGgcgg cacAAGGCAA 651 catatTGCcg cAACTGCTCG gcaggctGCT CGCCcaccCG TATTTCTCAC 701 AACCCcaccc aaAAAGCACG GGgcGCGaac TgtttgcccT AAattggctc 751 gaaacctAcc ttgacggcgg cgaaaaccga tacgacgtat tgcggacgct 801 ttcccgattc accgcgcaaA ccgTttggga cgccgtctca CACGCAGCGG
```

-continued

```
 851 CAGATGCCCG TCAAATGTAC ATTTGCGGCG GCGGCATCCG CAATCCTGTT

901 TTAATGGCGG ATTTGGCAGA ATGTTTCGGC ACACGCGTTT CCCTGCACAG

951 CACCGCCGAA CTGAACCTCG ATCCTCAATG GGTGGAGGCG gccgCATTtg 1001 cgtggttggC GGCGTGTTGG ATTAACCGCA TTCCCGGTAG TCCGCACAAA

1051 GCGACCGGCG CATCCAAACC GTGTATTCTG GGCGCGGGAT ATTATTATTG

1101 A
```

This corresponds to the amino acid sequence <SEQ ID 436; ORF 121.ng>:

```
g121.pep
   1 METQLYIGIM SGTSMDGADA VLVRMDGGKW LGAEGHAFTP YPDRLRRKLL

51 DLQDTGTDEL HRSRMLSQEL SRLYAQTAAE LLCSQNLAPC DITALGCHGQ

101 TVRHAPEHGY SIQLADLPLL AELTRIFTVG DFRSRDLAAG GQGAPLVPAF

151 HEALFRDDRE TRVVLNIGGI ANISVLPPGA PAFGFDTGPG NMLMDAWTQA

201 HWQLPYDKNG AKAAQGNILP QLLGRLLAHP YFSQPHPKST GRELFALNWL

251 ETYLDGGENR YDVLRTLSRF TAQTVWDAVS HAAADARQMY ICGGGIRNPV

301 LMADLAECFG TRVSLHSTAE LNLDPQWVEA AAFAWLAACW INRIPGSPHK

351 ATGASKPCIL GAGYYY*
```

The following partial DNA sequence was identified in *N. meningitidis* <SEQ ID 437>:

```
m121.seq
   1 ATGGAAACAC AGCTTTACAT CGGCATCATG TCGGGAACCA GCATGGACGG

51 GGCGGATGCC GTACTGATAC GGATGGACGG CGGCAAATGG CTGGGCGCGG

101 AAGGGCACGC CTTTACCCCC TACCCCGGCA GGTTACGCCG CCAATTGCTG

151 GATTTGCAGG ACACAGGCGC AGACGAACTG CACCGCAGCA GGATTTTGTC

201 GCAAGAACTC AGCCGCCTAT ATGCGCAAAC CGCCGCCGAA CTGCTGTGCA

251 GTCAAAACCT CGCACCGTCC GACATTACCG CCCTCGGCTG CCACGGGCAA

301 ACCGTCCGAC ACGCGCCGGA ACACGGTTAC AGCATACAGC TTGCCGATTT

351 GCCGCTGCTG GCGxxxxxxx xxxxxxxxxx xxxxxxxxxx xxxxxxxxxx 401 xxxxxxxxxx xxxxxxxxxx xxxxxxxxxx xxxxxxxxxx xxxxxxxxxx 451 xxxxxxxxxx xxxxxxxxxx xxxxxxxxxx xxxxxxxxxx xxxxxxxxxx 501 xxxxxxxxxx xxxxxxxxxx xxxxxxxxxx xxxxxxxxxx xxxxxxxxxx 551 xxxxxxxxxx xxxxxxxxxx xxxxxxxxxx xxxxxxxxxx xxxxxxxxxx 601 xxxxxxCAGC TTCCTTACGA CAAAAACGGT GCAAAGTCGG CACAAGGCAA

651 CATATTGCCG CAACTGCTCG ACAGGCTGCT CGCCCACCCG TATTTCGCAC

701 AACGCCACCC TAAAAGCACG GGGCGCGAAC TGTTTGCCAT AAATTGGCTC

751 GAAACCTACC TTGACGGCGG CGAAAACCGA TACGACGTAT TGCGGACGCT

801 TTCCCGTTTT ACCGCGCAAA CCGTTTGCGA CGCCGTCTCA CACGCAGCGG

851 CAGATGCCCG TCAAATGTAC ATTTGCGACG GCGGCATCCG CAATCCTGTT

901 TTAATGGCGG ATTTGGCAGA ATGTTTCGGC ACACGCGTTT CCCTGCACAG

951 CACCGCCGAC CTGAACCTCG ATCCGCAATG GGTGGAAGCC GCCGnATTTG
```

```
1001  CGTGGTTGGC GGCGTGTTGG ATTAATCGCA TTCCCGGTAG TCCGCACAAA

1051  GCAACCGGCG CATCCAAACC GTGTATTCTG AnCGCGGGAT ATTATTATTG

1101  A
```

This corresponds to the amino acid sequence <SEQ ID 438; ORF 121>:

```
m121.pep
    1  METQLYIGIM SGTSMDGADA VLIRMDGGKW LGAEGHAFTP YPGRLRRQLL

51  DLQDTGADEL HRSRILSQEL SRLYAQTAAE LLCSQNLAPS DITALGCHGQ

101  TVRHAPEHGY SIQLADLPLL Axxxxxxxxx xxxxxxxxxx xxxxxxxxxx 151  xxxxxxxxxx xxxxxxxxxx xxxxxxxxxx xxxxxxxxxx xxxxxxxxxx 201  xxQLPYDKNG AKSAQGNILP QLLDRLLAHP YFAQRHPKST GRELFAINWL

251  ETYLDGGENR YDVLRTLSRF TAQTVCDAVS HAAADARQMY ICDGGIRNPV

301  LMADLAECFG TRVSLHSTAD LNLDPQWVEA AXFAWLAACW INRIPGSPHK

351  ATGASKPCIL XAGYYY*
```

Computer analysis of the amino acid sequences gave the following results:

Homology with a Predicted ORF from *N. meningitidis* menA with menB

ORF 121 shows 73.5% identity over a 366 aa overlap with a predicted ORF (ORF121.ng) from *N. gonorrhoeae*:

```
    m121/g121
                     10         20         30         40         50         60
       m121.pep   METQLYIGIMSGTSMDGADAVLIRMDGGKWLGAEGHAFTPYPGRLRRQLLDLQDTGADEL
                  ||||||||||||||||||||||:|||||||||||||||||| ||||:||||||||:|||
           g121   METQLYIGIMSGTSMDGADAVLVRMDGGKWLGAEGHAFTPYPDRLRRKLLDLQDTGTDEL
                     10         20         30         40         50         60

70         80         90        100        110        120
       m121.pep   HRSRILSQELSRLYAQTAAELLCSQNLAPSDITALGCHGQTVRHAPEHGYSIQLADLPLL
                  ||||:||||||||||||||||||||||||| |||||||||||||||||||||||||||||
           g121   HRSRMLSQELSRLYAQTAAELLCSQNLAPCDITALGCHGQTVRHAPEHGYSIQLADLPLL
                     70         80         90        100        110        120

130        140        150        160        170        180
       m121.pep   AXXXXXXXXXXXXXXXXXXXXXXXXXXXXXXXXXXXXXXXXXXXXXXXXXXXXXXXXXXX
                  | :    :                                          :
           g121   AELTRIFTVGDFRSRDLAAGGQGAPLVPAFHEALFRDDRETRVVLNIGGIANISVLPPGA
                    130        140        150        160        170        180

190        200        210        220        230        240
       m121.pep   XXXXXXXXXXXXXXXXXXXXXXXXQLPYDKNGAKSAQGNILPQLLDRLLAHPYFAQRHPKST
                                :          ||||||||||:|||||||||| |||||||:|  |||||
           g121   PAFGFDTGPGNMLMDAWTQAHWQLPYDKNGAKAAQGNILPQLLGRLLAHPYFSQPHPKST
                    190        200        210        220        230        240

250        260        270        280        290        300
       m121.pep   GRELFAINWLETYLDGGENRYDVLRTLSRFTAQTVCDAVSHAAADARQMYICDGGIRNPV
                  ||||||:||||||||||||||||||||||||||||| |||||||||||||||| ||||||
           g121   GRELFALNWLETYLDGGENRYDVLRTLSRFTAQTVWDAVSHAAADARQMYICGGGIRNPV
                    250        260        270        280        290        300

310        320        330        340        350        360
       m121.pep   LMADLAECFGTRVSLHSTADLNLDPQWVEAAXFAWLAACWINRIPGSPHKATGASKPCIL
                  |||||||||||||||||||:||||||||||||  |||||||||||||||||||||||||||
           g121   LMADLAECFGTRVSLHSTAELNLDPQWVEAAAFAWLAACWINRIPGSPHKATGASKPCIL
                    310        320        330        340        350        360
```

-continued

```
m121.pep   XAGYYYX
            ||||||
g121       GAGYYYX
```

The following partial DNA sequence was identified in *N. meningitidis* <SEQ ID 439>:

```
a121.seq
   1 ATGGAAACAC AGCTTTACAT CGGCATCATG TCGGGAACCA GCATGGACGG
  51 GGCGGATGCC GTACTGATAC GGATGGACGG CGGCAAATGG CTGGGCGCGG
 101 AAGGGCACGC CTTTACCCCC TACCCCGGCA GGTTACGCCG CAAATTGCTG
 151 GATTTGCAGG ACACAGGCGC GGACGAACTG CACCGCAGCA GGATGTTGTC
 201 GCAAGAACTC AGCCGCCTGT ACGCGCAAAC CGCCGCCGAA CTGCTGTGCA
 251 GTCAAAACCT CGCGCCGTCC GACATTACCG CCCTCGGCTG CCACGGGCAA
 301 ACCGTCAGAC ACGCGCCGGA ACACAGTTAC AGCGTACAGC TTGCCGATTT
 351 GCCGCTGCTG GCGGAACGGA CTCAGATTTT TACCGTCGGC GACTTCCGCA
 401 GCCGCGACCT TGCGGCCGGC GGACAAGGCG CGCCGCTCGT CCCCGCCTTT
 451 CACGAAGCCC TGTTCCGCGA CGACAGGGAA ACACGCGCGG TACTGAACAT
 501 CGGCGGGATT GCCAACATCA GCGTACTCCC CCCCGACGCA CCCGCCTTCG
 551 GCTTCGACAC AGGACCGGGC AATATGCTGA TGGACGCGTG GATGCAGGCA
 601 CACTGGCAGC TTCCTTACGA CAAAAACGGT GCAAAGGCGG CACAAGGCAA
 651 CATATTGCCG CAACTGCTCG ACAGGCTGCT CGCCCACCCG TATTTCGCAC
 701 AACCCCACCC TAAAAGCACG GGGCGCGAAC TGTTTGCCCT AAATTGGCTC
 751 GAAACCTACC TTGACGGCGG CGAAAACCGA TACGACGTAT TGCGGACGCT
 801 TTCCCGATTC ACCGCGCAAA CCGTTTTCGA CGCCGTCTCA CACGCAGCGG
 851 CAGATGCCCG TCAAATGTAC ATTTGCGGCG GCGGCATCCG CAATCCTGTT
 901 TTAATGGCGG ATTTGGCAGA ATGTTTCGGC ACACGCGTTT CCCTGCACAG
 951 CACCGCCGAA CTGAACCTCG ATCCGCAATG GGTAGAAGCC GCCGCGTTCG
1001 CATGGATGGC GGCGTGTTGG GTCAACCGCA TTCCCGGTAG TCCGCACAAA
1051 GCAACCGGCG CATCCAAACC GTGTATTCTG GGCGCGGGAT ATTATTATTG
1101 A
```

This corresponds to the amino acid sequence <SEQ ID 440; ORF 121.a>:

```
a121.pep
  1 METQLYIGIM SGTSMDGADA VLIRMDGGKW LGAEGHAFTP YPGRLRRKLL
 51 DLQDTGADEL HRSRMLSQEL SRLYAQTAAE LLCSQNLAPS DITALGCHGQ
101 TVRHAPEHSY SVQLADLPLL AERTQIFTVG DFRSRDLAAG GQGAPLVPAF
151 HEALFRDDRE TRAVLNIGGI ANISVLPPDA PAFGFDTGPG NMLMDAWMQA
201 HWQLPYDKNG AKAAQGNILP QLLDRLLAHP YFAQPHPKST GRELFALNWL
251 ETYLDGGENR YDVLRTLSRF TAQTVFDAVS HAAADARQMY ICGGGIRNPV
```

-continued

```
301  LMADLAECFG TRVSLHSTAE LNLDPQWVEA AAFAWMAACW VNRIPGSPHK

351  ATGASKPCIL GAGYYY*
``` m121/a121  74.0% identity in 366 aa overlap

```
                    10        20        30        40        50        60
m121.pep    METQLYIGIMSGTSMDGADAVLIRMDGGKWLGAEGHAFTPYPGRLRRQLLDLQDTGADEL
            |||||||||||||||||||||||||||||||||||||||||||||||:||||||||||||
a121        METQLYIGIMSGTSMDGADAVLIRMDGGKWLGAEGHAFTPYPGRLRRKLLDLQDTGADEL
                    10        20        30        40        50        60

70        80        90       100       110       120
m121.pep    HRSRILSQELSRLYAQTAAELLCSQNLAPSDITALGCHGQTVRHAPEHGYSIQLADLPLL
            ||||:||||||||||||||||||||||||||||||||||||||||||||:||:||||||||
a121        HRSRMLSQELSRLYAQTAAELLCSQNLAPSDITALGCHGQTVRHAPEHSYSVQLADLPLL
                    70        80        90       100       110       120

130       140       150       160       170       180
m121.pep    AXXXXXXXXXXXXXXXXXXXXXXXXXXXXXXXXXXXXXXXXXXXXXXXXXXXXXXXXXXX
            |  :   :                                :
a121        AERTQIFTVGDFRSRDLAAGGQGAPLVPAFHEALFRDDRETRAVLNIGGIANISVLPPDA
                   130       140       150       160       170       180

190       200       210       220       230       240
m121.pep    XXXXXXXXXXXXXXXXXXXXXXQLPYDKNGAKSAQGNILPQLLDRLLAHPYFAQRHPKST
                  :               ||||||||||:||||||||||||||||||||| |||||
a121        PAFGFDTGPGNMLMDAWMQAHWQLPYDKNGAKAAQGNILPQLLDRLLAHPYFAQPHPKST
                   190       200       210       220       230       240

250       260       270       280       290       300
m121.pep    GRELFAINWLETYLDGGENRYDVLRTLSRFTAQTVCDAVSHAAADARQMYICDGGIRNPV
            ||||||:|||||||||||||||||||||||||||| |||||||||||||||| |||||||
a121        GRELFALNWLETYLDGGENRYDVLRTLSRFTAQTVFDAVSHAAADARQMYICGGGIRNPV
                   250       260       270       280       290       300

310       320       330       340       350       360
m121.pep    LMADLAECFGTRVSLHSTADLNLDPQWVEAAXFAWLAACWINRIPGSPHKATGASKPCIL
            |||||||||||||||||||:||||||||||| |||:||||:|||||||||||||||||||
a121        LMADLAECFGTRVSLHSTAELNLDPQWVEAAAFAWMAACWVNRIPGSPHKATGASKPCIL
                   310       320       330       340       350       360 m121.pep    XAGYYYX
             ||||||
a121        GAGYYYX
```

The following partial DNA sequence was identified in *N. meningitidis* <SEQ ID 441>:

```
m121-1.seq
   1  ATGGAAACAC AGCTTTACAT CGGCATCATG TCGGGAACCA GCATGGACGG

51  GGCGGATGCC GTACTGATAC GGATGGACGG CGGCAAATGG CTGGGCGCGG

101  AAGGGCACGC CTTTACCCCC TACCCCGGCA GGTTACGCCG CCAATTGCTG

151  GATTTGCAGG ACACAGGCGC AGACGAACTG CACCGCAGCA GGATTTTGTC

201  GCAAGAACTC AGCCGCCTAT ATGCGCAAAC CGCCGCCGAA CTGCTGTGCA

251  GTCAAAACCT CGCACCGTCC GACATTACCG CCCTCGGCTG CCACGGGCAA

301  ACCGTCCGAC ACGCGCCGGA ACACGGTTAC AGCATACAGC TTGCCGATTT

351  GCCGCTGCTG GCGGAACGGA CGCGGATTTT TACCGTCGGC GACTTCCGCA

401  GCCGCGACCT TGCGGCCGGC GGACAAGGCG CGCCACTCGT CCCCGCCTTT

451  CACGAAGCCC TGTTCCGCGA CAACAGGGAA ACACGCGCGG TACTGAACAT

501  CGGCGGGATT GCCAACATCA GCGTACTCCC CCCCGACGCA CCCGCCTTCG

551  GCTTCGACAC AGGGCCGGGC AATATGCTGA TGGACGCGTG GACGCAGGCA

601  CACTGGCAGC TTCCTTACGA CAAAAACGGT GCAAAGGCGG CACAAGGCAA

651  CATATTGCCG CAACTGCTCG ACAGGCTGCT CGCCCACCCG TATTTCGCAC

701  AACCCCACCC TAAAAGCACG GGGCGCGAAC TGTTTGCCCT AAATTGGCTC

751  GAAACCTACC TTGACGGCGG CGAAAACCGA TACGACGTAT TGCGGACGCT
```

```
-continued
 801 TTCCCGTTTT ACCGCGCAAA CCGTTTGCGA CGCCGTCTCA CACGCAGCGG

851 CAGATGCCCG TCAAATGTAC ATTTGCGGCG GCGGCATCCG CAATCCTGTT

901 TTAATGGCGG ATTTGGCAGA ATGTTTCGGC ACACGCGTTT CCCTGCACAG

951 CACCGCCGAC CTGAACCTCG ATCCGCAATG GGTGGAAGCC GCCGNATTTG

1001 CGTGGTTGGC GGCGTGTTGG ATTAATCGCA TTCCCGGTAG TCCGCACAAA

1051 GCAACCGGCG CATCCAAACC GTGTATTCTG ANCGCGGGAT ATTATTATTG

1101 A
```

This corresponds to the amino acid sequence <SEQ ID 442; ORF 121-1>:

```
m121-1.pep

1 METQLYIGIM SGTSMDGADA VLIRMDGGKW LGAEGHAFTP YPGRLRRQLL

51 DLQDTGADEL HRSRILSQEL SRLYAQTAAE LLCSQNLAPS DITALGCHGQ

101 TVRHAPEHGY SIQLADLPLL AERTRIFTVG DFRSRDLAAG GQGAPLVPAF

151 HEALFRDNRE TRAVLNIGGI ANISVLPPDA PAFGFDTGPG NMLMDAWTQA

201 HWQLPYDKNG AKAAQGNILP QLLDRLLAHP YFAQPHPKST GRELFALNWL

251 ETYLDGGENR YDVLRTLSRF TAQTVCDAVS HAAADARQMY ICGGGIRNPV

301 LMADLAECFG TRVSLHSTAD LNLDPQWVEA AXFAWLAACW INRIPGSPHK

351 ATGASKPCIL XAGYYY* m121-1/g121   95.6% identity in 366 aa overlap 10         20         30         40         50         60
m121-1.pep   METQLYIGIMSGTSMDGADAVLIRMDGGKWLGAEGHAFTPYPGRLRRQLLDLQDTGADEL
             |||||||||||||||||||||:||||||||||||||||||||| ||||:||||||:|||
g121         METQLYIGIMSGTSMDGADAVLVRMDGGKWLGAEGHAFTPYPDRLRRKLLDLQDTGTDEL
                    10         20         30         40         50         60

70         80         90        100        110        120
m121-1.pep   HRSRILSQELSRLYAQTAAELLCSQNLAPSDITALGCHGQTVRHAPEHGYSIQLADLPLL
             ||||:||||||||||||||||||||||||| |||||||||||||||||||||||||||||
g121         HRSRMLSQELSRLYAQTAAELLCSQNLAPCDITALGCHGQTVRHAPEHGYSIQLADLPLL
                    70         80         90        100        110        120

130        140        150        160        170        180
m121-1.pep   AERTRIFTVGDFRSRDLAAGGQGAPLVPAFHEALFRDNRETRAVLNIGGIANISVLPPDA
             || ||||||||||||||||||||||||||||||||||:||||:|||||||||||||| |
g121         AELTRIFTVGDFRSRDLAAGGQGAPLVPAFHEALFRDDRETRVVLNIGGIANISVLPPGA
                   130        140        150        160        170        180

190        200        210        220        230        240
m121-1.pep   PAFGFDTGPGNMLMDAWTQAHWWLPYDKNGAKAAQGNILPQLLDRLLAHPYFAQPHPKST
             |||||||||||||||||||||| |||||||||||||||||| ||:|||||||:||||||
g121         PAFGFDTGPGNMLMDAWTQAHWQLPYDKNGAKAAQGNILPQLLGRLLAHPYFSQPHPKST
                   190        200        210        220        230        240

250        260        270        280        290        300
m121-1.pep   GRELFALNWLETYLDGGENRYDVLRTLSRFTAQTVCDAVSHAAADARQMYICGGGIRNPV
             ||||||||||||||||||||||||||||||||||| ||||||||||||||||||||||||
g121         GRELFALNWLETYLDGGENRYDVLRTLSRFTAQTVWDAVSHAAADARQMYICGGGIRNPV
                   250        260        270        280        290        300

310        320        330        340        350        360
m121-1.pep   LMADLAECFGTRVSLHSTADLNLDPQWVEAAXFAWLAACWINRIPGSPHKATGASKPCIL
             |||||||||||||||||||:|||||||||||||||||||||||||||||||||||||||
g121         LMADLAECFGTRVSLHSTAELNLDPQWVEAAAFAWLAACWINRIPGSPHKATGASKPCIL
                   310        320        330        340        350        360 m121-1.pep   XAGYYYX
             ||||||
g121         GAGYYYX
```

The following partial DNA sequence was identified in *N. meningitidis* <SEQ ID 443>:

```
a121-1.seq
   1 ATGGAAACAC AGCTTTACAT CGGCATCATG TCGGGAACCA GCATGGACGG

51 GGCGGATGCC GTACTGATAC GGATGGACGG CGGCAAATGG CTGGGCGCGG

101 AAGGGCACGC CTTTACCCCC TACCCCGGCA GGTTACGCCG CAAATTGCTG

151 GATTTGCAGG ACACAGGCGC GGACGAACTG CACCGCAGCA GGATGTTGTC

201 GCAAGAACTC AGCCGCCTGT ACGCGCAAAC CGCCGCCGAA CTGCTGTGCA

251 GTCAAAACCT CGCGCCGTCC GACATTACCG CCCTCGGCTG CCACGGGCAA

301 ACCGTCAGAC ACGCGCCGGA ACACAGTTAC AGCGTACAGC TTGCCGATTT

351 GCCGCTGCTG GCGGAACGGA CTCAGATTTT TACCGTCGGC GACTTCCGCA

401 GCCGCGACCT TGCGGCCGGC GGACAAGGCG CGCCGCTCGT CCCCGCCTTT

451 CACGAAGCCC TGTTCCGCGA CGACAGGGAA ACACGCGCGG TACTGAACAT

501 CGGCGGGATT GCCAACATCA GCGTACTCCC CCCCGACGCA CCCGCCTTCG

551 GCTTCGACAC AGGACCGGGC AATATGCTGA TGGACGCGTG GATGCAGGCA

601 CACTGGCAGC TTCCTTACGA CAAAAACGGT GCAAAGGCGG CACAAGGCAA

651 CATATTGCCG CAACTGCTCG ACAGGCTGCT CGCCCACCCG TATTTCGCAC

701 AACCCCACCC TAAAAGCACG GGGCGCGAAC TGTTTGCCCT AAATTGGCTC

751 GAAACCTACC TTGACGGCGG CGAAAACCGA TACGACGTAT TGCGGACGCT

801 TTCCCGATTC ACCGCGCAAA CCGTTTTCGA CGCCGTCTCA CACGCAGCGG

851 CAGATGCCCG TCAAATGTAC ATTTGCGGCG GCGGCATCCG CAATCCTGTT

901 TTAATGGCGG ATTTGGCAGA ATGTTTCGGC ACACGCGTTT CCCTGCACAG

951 CACCGCCGAA CTGAACCTCG ATCCGCAATG GGTAGAAGCC GCCGCGTTCG

1001 CATGGATGGC GGCGTGTTGG GTCAACCGCA TTCCCGGTAG TCCGCACAAA

1051 GCAACCGGCG CATCCAAACC GTGTATTCTG GGCGCGGGAT ATTATTATTG

1101 A
```

This corresponds to the amino acid sequence <SEQ ID 444; ORF 121-1.a>:

```
a114.pep

1 METQLYIGIM SGTSMDGADA VLIRMDGGKW LGAEGHAFTP YPGRLRRKLL

51 DLQDTGADEL HRSRMLSQEL SRLYAQTAAE LLCSQNLAPS DITALGCHGQ

101 TVRHAPEHSY SVQLADLPLL AERTQIFTVG DFRSRDLAAG GQGAPLVPAF

151 HEALFRDDRE TRAVLNIGGI ANISVLPPDA PAFGFDTGPG NMLMDAWMQA

201 HWQLPYDKNG AKAAQGNILP QLLDRLLAHP YFAQPHPKST GRELFALNWL

251 ETYLDGGENR YDVLRTLSRF TAQTVFDAVS HAAADARQMY ICGGGIRNPV

301 LMADLARCFG TRVSLHSTAE LNLDPQWVEA AAFAWMAACW VNRIPGSPHK

351 ATGASKPCIL GAGYYY*
```

```
m121-1/a121-1 96.4% identity in 366 aa overlap 10        20        30        40        50        60
m121-1.pep  METQLYIGIMSGTSMDGADAVLIRMDGGKWLGAEGHAFTPYPGRLRRQLLDLQDTGADEL
            |||||||||||||||||||||||||||||||||||||||||||||||:||||||||||||
a121-1      METQLYIGIMSGTSMDGADAVLIRMDGGKWLGAEGHAFTPYPGRLRRKLLDLQDTGADEL
                    10        20        30        40        50        60
```

```
              70         80         90        100        110        120
m114.pep  HRSRILSQELSRLYAQTAAELLCSQNLAPSDITALGCHGQTVRHAPEHGYSIQLADLPLL
          ||||:||||||||||||||||||||||||||||||||||||||||:||:|||||||||
a121-1    HRSRMLSQELSRLYAQTAAELLCSQNLAPSDITALGCHGQTVRHAPEHSYSVQLADLPLL
              70         80         90        100        110        120

130        140        150        160        170        180
m114.pep  AERTRIFTVGDFRSRDLAAGGQGAPLVPAFHEALFRDNRETRAVLNIGGIANISVLPPDA
          ||||:|||||||||||||||||||||||||||||||:|||||||||||||||||||||
a121-1    AERTQIFTVGDFRSRDLAAGGQGAPLVPAFHEALFRDDRETRAVLNIGGIANISVLPPDA
             130        140        150        160        170        180

190        200        210        220        230        240
m114.pep  PAFGFDTGPGNMLMDAWTQAHWQLPYDKNGAKAAQGNILPQLLDRLLAHPYFAQPHPKST
          |||||||||||||||||| |||||||||||||||||||||||||||||||||||||||
a121-1    PAFGFDTGPGNMLMDAWMQAHWQLPYDKNGAKAAQGNILPQLLDRLLAHPYFAQPHPKST
             190        200        210        220        230        240

250        260        270        280        290        300
m114.pep  GRELFALNWLETYLDGGENRYDVLRTLSRFTAQTVCDAVSHAAADARQMYICGGIRNPV
          ||||||||||||||||||||||||||||||||||||| |||||||||||||||||||||
a121-1    GRELFALNWLETYLDGGENRYDVLRTLSRFTAQTVFDAVSHAAADARQMYICGGIRNPV
             250        260        270        280        290        300

310        320        330        340        350        360
m114.pep  LMADLAECFGTRVSLHSTADLNLDPQWVEAAXFAWLAACWINRIPGSPHKATGASKPCIL
          ||||||||||||||||||||:|||||||||| |||:||||:|||||||||||||||||
a121-1    LMADLAECFGTRVSLHSTAELNLDPQWVEAAAFAWMAACWVNRIPGSPHKATGASKPCIL
             310        320        330        340        350        360 m114.pep  XAGYYYX
          ||||||
a121-1    GAGYYYX
```

The following partial DNA sequence was identified in *N. gonorrhoeae* <SEQ ID 445>:

```
g122.seq
    1 ATGGCTTTAC TGAGCATCCG CAAGCTGCAC AAACAATACG GCAGCGTAAC

51 CGCCATCCAA TCCTTAGACT TGGACTTGGA AAAAGGCGAA GtcatCGTAC

101 TGCTGGGCCC gTccggctgc ggCAAATCCA CCCTcctgcg ctgcgtcaaC

151 GGTTTGGAGC CGCACCAagg cgGCAGCATC GTGATGGACG GTgtcgGCGA

201 ATTCggcAAA GACGTTTCCT GGCAAACCGC CCGGCAAAAa gtcggtatgg 251 tctttcaaag taacgAactg Tttgcccaca tgaccgtcat cgAaaacatc 301 ttcttAggcC CGGTAAagga aCAAAAcCgc gaccgtgccg aagcaGAGGC 351 gCAAGCCGGC AAactGttgg aacgcgTCGG actgctAGAC CGCAAAAACG

401 CCTATCCGCG CGAACTTTCC GGCGGTCAGA ACAGCGCAT CGCCATTGTC

451 CGCGCCCTGT GCCTGAATCC GGAAGTCATC CTGCTGGACG AAATCACCGC

501 CGCACTTGAC CCCGAAATGG TGCGCGAAGT CTTGGAAGTG GTTTTGGAAC

551 TCGCCCGCGA AGGGATGAGT ATGCTCATCG TAACCCACGA AATGGGGTTC

601 GCACGCAAAG TTGCCGACCG CATCGTCTTT ATGGACAAAG GCGGCATCGT

651 CGAATCGTCC GACCCCGAAA CCTTTTTTTC CGCACCAAAA AGCGAACGCG

701 CCCGCCAATT TCTGGCAGGT ATGGACTACT GA
```

This corresponds to the amino acid sequence <SEQ ID 446; ORF 122.ng>:

```
g122.pep
    1 MALLSIRKLH KQYGSVTAIQ SLDLDLEKGE VIVLLGPSGC GKSTLLRCVN

51 GLEPHQGGSI VMDGVGEFGK DVSWQTARQK VGMVFQSNEL FAHMTVIENI

101 FLGPVKEQNR DRAEAEAQAG KLLERVGLLD RKNAYPRELS GGQKQRIAIV

151 RALCLNPEVI LLDEITAALD PEMVREVLEV VLELAREGMS MLIVTHEMGF

201 ARKVADRIVF MDKGGIVESS DPETFFSAPK SERARQFLAG MDY*
```

The following partial DNA sequence was identified in *N. meningitidis* <SEQ ID 447>:

```
m122.seq
    1 GTTGTCATGA TTAAAATCCG CAATATCCAT AAGACCTTTG GCGAAAACAC

51 TATTTTGCGC GGCATCGATT TGGATGTGTG CAAAGGGCAG GTGGTCGTCA

101 TCCTCGGGcC TTCCGGCTCA GGCAAAACGA CGTTTCTGCG ATGCCTAAAC

151 GCGTTGGAAA TGCCCGAAGA CGGACAAATC GAGTTCGACA ACGAGCGACC

201 GCTGAAAATC GATTTTTCTA AAAACCAAG CAAACACGAT ATTTTGGCAC

251 TGCGCCGCAA ATCAkGCATG GTGTTTCAAC AATACAAyCT CTTTCCGCAC

301 AAAACCGCCT TGGAAAACGT AATGGAAGGA CCGGTTGCCG TACAgGGCAA

351 GCCTGCCGCC CAAGCGCGCG AAGAGGCTCT GAAACTGCTG GAAAAAGTCG

401 GCTTGGGCGA CAAAGTGGAT TTGTATCCCT ACCAGCTTTC CGGCGGTCAG

451 CAGCAGCGCG TCGGCATTGC CCGCGCATTG GCGATTCAGC CTGAACTGAT

501 GCTGTTTGAC GAACCGACTT CCGCGCTCGA TCCTGAATTG GTGCAAGATG

551 TTTTGGATmC CATGAAGGAA TTGGCGCAAG AAGGCTGGAC CATGGTTGTC

601 GTTACGCATG AAATCAAGTT CGCCTTAGAA GTGGCAACCA CCGwCGTCGT

651 GATGGACrGC GGCGTTATTG TCAACAAGG CAGCCCGCAA GATTTGTTCG

701 ACCACCCCAA ACACGAACGG ACGCGGAGAT TTTTAAGCCA AATCCAATCT

751 ACCAAGATTT GA
```

This corresponds to the amino acid sequence <SEQ ID 448; ORF 122>:

```
m122.pep
    1 VVMIKIRNIH KTFGENTILR GIDLDVCKGQ VVVILGPSGS GKTTFLRCLN

51 ALEMPEDGQI EFDNERPLKI DFSKKPSKHD ILALRRKSXM VFQQYNLFPH

101 KTALENVMEG PVAVQGKPAA QAREEALKLL EKVGLGDKVD LYPYQLSGGQ

151 QQRVGIARAL AIQPELMLFD EPTSALDPEL VQDVLDXMKE LAQEGWTMVV

201 VTHEIKFALE VATTXVVMDX GVIVEQGSPQ DLFDHPKHER TRRFLSQIQS

251 TKI*
```

Computer analysis of this amino acid sequence gave the following results:
Homology with a Predicted ORF from *N. gonorrhoeae*
ORF 122 shows 47.2% identity over a 246 aa overlap with a predicted ORF (ORF 122.ng) from *N. gonorrhoeae*:

```
m122/g122

10        20        30        40        50        60
    m122.pep  VVMIKIRNIHKTFGENTILRGIDLDVCKGQVVVILGPSGSGKTTFLRCLNALEMPEDGQI
              :::::||::||  :|   |  ::::|||:  ||:|:|:||||  ||:|||:|:||  : |:|
    g122      MALLSIRKLHKQYGSVTAIQSLDLDLEKGEVIVLLGPSGCGKSTLLRCVNGLEPHQGGSI
                      10        20        30        40        50        60

70        80        90       100       110       120
    m122.pep  EFDNERPLKIDFSKKPSKHDILALRRKSXMVFQQYNLFPHKTALENVMEGPVAVQGKPAA
              :|:   :  | |:: :        |:|  ||||: :|| |  |::||::  |||  |:: |
    g122      VMDGVGEFGKDVSWQTA-------RQKVGMVFQSNELFAHMTVIENIFLGPVKEQNRDRA
                      70        80        90       100       110

130       140       150       160       170       180
    m122.pep  QAREEALKLLEKVGLGDKVDLYPYQLSGGQQQRVGIARALAIQPELMLFDEPTSALDPEL
              :|:  :|   ||||:|||   |: :  ||  :|||||||:|:::|:|||   ::||::|:||  |:|||||:
    g122      EAEAQAGKLLERVGLLDRKNAYPRELSGGQKQRIAIVRALCLNPEVILLDEITAALDPEM
                     120       130       140       150       160       170

190       200       210       220       230       240
    m122.pep  VQDVLDXMKELAQEGWTMVVVTHEIKFALEVATTXVVMDXGVIVEQGSPQDLFDHPKHER
              |::||:   :   |||:||   :|::||||:  ||  :|||      |||   |||:::|:   :|:  ||  ||
    g122      VREVLEVVLELAREGMSMLIVTHEMGFARKVADRIVFMDKGGIVESSDPETFFSAPKSER
                     180       190       200       210       220       230

250
    m122.pep  TRRFLSQIQSTKIX
              :|:|||:
    g122      ARQFLAGMDYX
                     240
```

The following partial DNA sequence was identified in *N. meningitidis* <SEQ ID 449>:

```
a122.seq
    1  GTTGTCATGA TTAAAATCCG CAATATCCAT AAGACCTTCG GCAAAAATAC

51  CATTTTGCGC GGCATCAATT TGGATGTGTG CAAAGGGCAG GTGGTCGTCA

101  TCCTCGGGCC TTCCGGCTCA GGCAAAACGA CGTTTCTGCG ATGCCTAAAC

151  GCGTTGGAAA TGCCCGAAGA CGGACAAATC GAGTTCGACA ACGAGCGACC

201  GCTGAAAATC GATTTTTCTA AAAAACCAAG CAAACACGAT ATTTTGGCAC

251  TGCGCCGCAA ATCAGGCATG GTGTTTCAAC AATACAACCT CTTTCCGCAC

301  AAAACCGCCT TGGAAAACGT GATGGAAGGA CCGGTTGCCG TACAGGGCAA

351  GCCTGCCGCC CAAGCGCGCG AAGAGGCTCT GAAACTGCTG GAAAAAGTCG

401  GCTTGGGCGA CAAAGTGGAT TTGTATCCCT ACCAGCTTTC CGGCGGTCAG

451  CAGCAGCGCG TCGGCATTGC CCGAGCATTG GCGATTCAGC CCGAGCTGAT

501  GTTGTTTGAC GAACCCACTT CCGCGCTTGA CCCCGAGTTG GTGCAAGACG

551  TGTTGAACGC CATGAAGGAA TTGGCGCGGG AAGGTTGGAC GATGGTCGTC

601  GTTACCCACG AAATCAAGTT CGCGCTGGAA GTTGCCACGA CCGTTGTCGT

651  GATGGACGGC GGCGTTATCG TAGAGCAGGG CAGCCCGAAA GAGTTGTTCG

701  ACCACCCCAA ACACGAACGG ACGCGGAGAT TTTTAAGCCA AATCCAATCT

751  ACCAAGATTT GA
```

This corresponds to the amino acid sequence <SEQ ID 450; ORF 122.a>:

```
a122.pep
    1 VVMIKIRNIH KTFGKNTILR GINLDVCKGQ VVVILGPSGS GKTTFLRCLN

51 ALEMPEDGQI EFDNERPLKI DFSKKPSKHD ILALRRKSGM VFQQYNLFPH

101 KTALENVMEG PVAVQGKPAA QAREEALKLL EKVGLGDKVD LYPYQLSGGQ

151 QQRVGIARAL AIQPELMLFD EPTSALDPEL VQDVLNAMKE LAREGWTMVV

201 VTHEIKFALE VATTVVVMDG GVIVEQGSPK ELFDHPKHER TRRFLSQIQS

251 TKI*
``` m122/a122 96.0% identity in 253 aa overlap

```
                      10         20         30         40         50         60
   m122.pep   VVMIKIRNIHKTFGENTILRGIDLDVCKGQVVVILGPSGSGKTTFLRCLNALEMPEDGQI
              ||||||||||||||||:|||||||:|||||||||||||||||||||||||||||||||||
       a122   VVMIKIRNIHKTFGKNTILRGINLDVCKGQVVVILGPSGSGKTTFLRCLNALEMPEDGQI
                      10         20         30         40         50         60

70         80         90        100        110        120
   m122.pep   EFDNERPLKIDFSKKPSKHDILALRRKSXMVFQQYNLFPHKTALENVMEGPVAVQGKPAA
              |||||||||||||||||||||||||||| |||||||||||||||||||||||||||||||
       a122   EFDNERPLKIDFSKKPSKHDILALRRKSGMVFQQYNLFPHKTALENVMEGPVAVQGKPAA
                      70         80         90        100        110        120

130        140        150        160        170        180
   m122.pep   QAREEALKLLEKVGLGDKVDLYPYQLSGGQQQRVGIARALAIQPELMLFDEPTSALDPEL
              ||||||||||||||||||||||||||||||||||||||||||||||||||||||||||||
       a122   QAREEALKLLEKVGLGDKVDLYPYQLSGGQQQRVGIARALAIQPELMLFDEPTSALDPEL
                     130        140        150        160        170        180

190        200        210        220        230        240
   m122.pep   VQDVLDXMKELAQEGWTMVVVTHEIKFALEVATTXVVMDXGVIVEQGSPQDLFDHPKHER
              |||||:|||||:||||||||||||||||||||||| ||||| |||||||||::|||||||
       a122   VQDVLNAMKELAREGWTMVVVTHEIKFALEVATTVVVMDGGVIVEQGSPKELFDHPKHER
                     190        200        210        220        230        240

250
   m122.pep   TRRFLSQIQSTKIX
              ||||||||||||||
       a122   TRRFLSQIQSTKIX
                     250
```

The following partial DNA sequence was identified in *N. gonorrhoeae* <SEQ ID 451>:

```
g122-1.seq
    1 ATGATTAAAA TCCGCAATAT CCATAAGACC TTTGGCGAAA ACACCATTTT

51 GCGCGGCATC GATTTGGATG TGGGCAAAGG CAGGTGGTC GTCATCCTCG

101 GGCCTTCCGG CTCGGGTAAA ACAACATTTC TGCGCTGCCT AAACGCGTTG

151 GAAATGCCCG AAGACGGACA AATCGAGTTC GACAACGCGC GGCCGTTACG

201 CATTGATTTT TCCAAAAAAA CAAGCAAACA CGATATTTTG GCACTGCGCC

251 GCAAGTCCGG AATGGTATTC CAACAATACA ACCTCTTCCC GCATAAAACC

301 GTGTTGGAAA ACGTGATGGA AGGGCCGGTT GCCGTACAGG GCAAGCCTGC

351 CGCCCAAGCG CGCGAAGAGG CTTTGAAACT GCTGGAAAAA GTCGGCTTGG

401 GCGATAAAGT GGATTTGTAT CCCTACCAGC TTTCCGGCGG TCAGCAGCAG

451 CGTGTCGGTA TCGCCCGCGC ACTGGCGATT CAGCCTGAAT TGATGCTGTT

501 TGACGAACCC ACTTCCGCGC TGGACCCCGA GTTGGTGCAA GACGTGTTGG
```

-continued

```
551 ACGCCATGAA GGAATTGGCG CGGGAAGGTT GGACGATGGT CGTCGTTACC

601 CACGAAATCA AGTTCACGCT GGAAGTTGCC ACGAACGTCG TCGTGATGGA

651 CGGCGGCGTT ATCGTAGAGC AGGGCAGCCC GAAAGAGTTG TTCGACCACC

701 TCAAACACGA ACGGACGCGG AGATTTTTAA GCCAAATCCA ATCTGCCAAG

751 ATTTGA
```

This corresponds to the amino acid sequence <SEQ ID 452; ORF 122-1.ng>:

```
g122-1.pep
    1 MIKIRNIHKT FGENTILRGI DLDVGKGQVV VILGPSGSGK TTFLRCLNAL

51 EMPEDGQIEF DNARPLRIDF SKKTSKHDIL ALRRKSGMVF QQYNLFPHKT

101 VLENVMEGPV AVQGKPAAQA REEALKLLEK VGLGDKVDLY PYQLSGGQQQ

151 RVGIARALAI QPELMLFDEP TSALDPELVQ DVLDAMKELA REGWTMVVVT

201 HEIKFTLEVA TNVVVMDGGV IVEQGSPKEL FDHLKHERTR RFLSQIQSAK

251 I*
```

The following partial DNA sequence was identified in *N. meningitidis* <SEQ ID 453>:

```
m122-1.seq
    1 ATGATTAAAA TCCGCAATAT CCATAAGACC TTTGGCGAAA ACACTATTTT

51 GCGCGGCATC GATTTGGATG TGTGCAAAGG GCAGGTGGTC GTCATCCTCG

101 GGCCTTCCGG CTCAGGCAAA ACGACGTTTC TGCGATGCCT AAACGCGTTG

151 GAAATGCCCG AAGACGGACA AATCGAGTTC GACAACGAGC GACCGCTGAA

201 AATCGATTTT TCTAAAAAAC CAAGCAAACA CGATATTTTG GCACTGCGCC

251 GCAAATCAGG CATGGTGTTT CAACAATACA ACCTCTTTCC GCACAAAACC

301 GCCTTGGAAA ACGTAATGGA AGGACCGGTT GCCGTACAGG GCAAGCCTGC

351 CGCCCAAGCG CGCGAAGAGG CTCTGAAACT GCTGGAAAAA GTCGGCTTGG

401 GCGACAAAGT GGATTTGTAT CCCTACCAGC TTTCCGGCGG TCAGCAGCAG

451 CGCGTCGGCA TTGCCCGCGC ATTGGCGATT CAGCCTGAAC TGATGCTGTT

501 TGACGAACCG ACTTCCGCGC TCGATCCTGA ATTGGTGCAA GATGTTTTGG

551 ATACCATGAA GGAATTGGCG CAAGAAGGCT GGACCATGGT TGTCGTTACG

601 CATGAAATCA AGTTCGCCTT AGAAGTGGCA ACCACCGTCG TCGTGATGGA

651 CGGCGGCGTT ATTGTCGAAC AAGGCAGCCC GCAAGATTTG TTCGACCACC

701 CCAAACACGA ACGGACGCGG AGATTTTTAA GCCAAATCCA ATCTACCAAG

751 ATTTGA
```

This corresponds to the amino acid sequence <SEQ ID 454; ORF 122-1>:

```
m122-1.pep
    1 MIKIRNIHKT FGENTILRGI DLDVCKGQVV VILGPSGSGK TTFLRCLNAL

51 EMPEDGQIEF DNERPLKIDF SKKPSKHDIL ALRRKSGMVF QQYNLFPHKT

101 ALENVMEGPV AVQGKPAAQA REEALKLLEK VGLGDKVDLY PYQLSGGQQQ
```

```
151 RVGIARALAI QPELMLFDEP TSALDPELVQ DVLDTMKELA QEGWTMVVVT

201 HEIKFALEVA TTVVVMDGGV IVEQGSPQDL FDHPKHERTR RFLSQIQSTK

251 I*
``` m122-1/g122-1  94.8% identity in 251 aa overlap

```
                      10         20         30         40         50         60
m122-1.pep   MIKIRNIHKTFGENTILRGIDLDVCKGQVVVILGPSGSGKTTFLRCLNALEMPEDGQIEF
             ||||||||||||||||||||||||| ||||||||||||||||||||||||||||||||||
g122-1       MIKIRNIHKTFGENTILRGIDLDVGKGQVVVILGPSGSGKTTFLRCLNALEMPEDGQIEF
                      10         20         30         40         50         60

70         80         90        100        110        120
m122-1.pep   DNERPLKIDFSKKPSKHDILALRRKSGMVFQQYNLFPHKTALENVMEGPVAVQGKPAAQA
             || |||:|||||| |||||||||||||||||||||||||||| :||||||||||||||||
g122-1       DNARPLRIDFSKKTSKHDILALRRKSGMVFQQYNLFPHKTVLENVMEGPVAVQGKPAAQA
                      70         80         90        100        110        120

130        140        150        160        170        180
m122-1.pep   REEALKLLEKVGLGDKVDLYPYQLSGGQQQRVGIARALAIQPELMLFDEPTSALDPELVQ
             ||||||||||||||||||||||||||||||||||||||||||||||||||||||||||||
g122-1       REEALKLLEKVGLGDKVDLYPYQLSGGQQQRVGIARALAIQPELMLFDEPTSALDPELVQ
                     130        140        150        160        170        180

190        200        210        220        230        240
m122-1.pep   DVLDTMKELAQEGWTMVVVTHEIKFALEVATTVVVMDGGVIVEQGSPQDLFDHPKHERTR
             ||||:|||||:||||||||||||||:||||| |||||||||||||||::||||:|||||
g122-1       DVLDAMKELAREGWTMVVVTHEIKFTLEVATNVVVMDGGVIVEQGSPKELFDHLKHERTR
                     190        200        210        220        230        240

250
m122-1.pep   RFLSQIQSTKIX
             |||||||||:|||
g122-1       RFLSQIQSAKIX
                     250
```

The following partial DNA sequence was identified in *N. meningitidis* <SEQ ID 455>:

```
a122-1.seq
    1 ATGATTAAAA TCCGCAATAT CCATAAGACC TTCGGCAAAA ATACCATTTT

51 GCGCGGCATC AATTTGGATG TGTGCAAAGG GCAGGTGGTC GTCATCCTCG

101 GGCCTTCCGG CTCAGGCAAA ACGACGTTTC TGCGATGCCT AAACGCGTTG

151 GAAATGCCCG AAGACGGACA ATCGAGTTC GACAACGAGC GACCGCTGAA

201 AATCGATTTT TCTAAAAAAC CAAGCAAACA CGATATTTTG GCACTGCGCC

251 GCAAATCAGG CATGGTGTTT CAACAATACA ACCTCTTTCC GCACAAAACC

301 GCCTTGGAAA ACGTGATGGA AGGACCGGTT GCCGTACAGG GCAAGCCTGC

351 CGCCCAAGCG CGCGAAGAGG CTCTGAAACT GCTGGAAAAA GTCGGCTTGG

401 GCGACAAAGT GGATTTGTAT CCCTACCAGC TTTCCGGCGG TCAGCAGCAG

451 CGCGTCGGCA TTGCCCGAGC ATTGGCGATT CAGCCCGAGC TGATGTTGTT

501 TGACGAACCC ACTTCCGCGC TTGACCCCGA GTTGGTGCAA GACGTGTTGA

551 ACGCCATGAA GGAATTGGCG CGGGAAGGTT GGACGATGGT CGTCGTTACC

601 CACGAAATCA AGTTCGCGCT GGAAGTTGCC ACGACCGTTG TCGTGATGGA

651 CGGCGGCGTT ATCGTAGAGC AGGGCAGCCC GAAAGAGTTG TTCGACCACC

701 CCAAACACGA ACGGACGCGG AGATTTTTAA GCCAAATCCA ATCTACCAAG

751 ATTTGA
```

This corresponds to the amino acid sequence <SEQ ID 456; ORF 122-1.a>:

```
a122-1.pep

1 MIKIRNIHKT FGENTILRGI NLDVCKGQVV VILGPSGSGK TTFLRCLNAL

51 EMPEDGQIEF DNERPLKIDF SKKPSKHDIL ALRRKSGMVF QQYNLFPHKT

101 ALENVMEGPV AVQGKPAAQA REEALKLLEK VGLGDKVDLY PYQLSGGQQQ

151 RVGIARALAI QPELMLFDEP TSALDPELVQ DVLDTMKELA REGWTMVVVT

201 HEIKFALEVA TTVVVMDGGV IVEQGSPKEL FDHPKHERTR RFLSQIQSTK

251 I* a122-1/m122-1  97.2% identity in 251 aa overlap 10         20         30         40         50         60
a122-1.pep   MIKIRNIHKTFGKNTILRGINLDVCKGQVVVILGPSGSGKTTFLRCLNALEMPEDGQIEF
             ||||||||||||:|||||||:|||||||||||||||||||||||||||||||||||||||
m122-1       MIKIRNIHKTFGENTILRGIDLDVGKGQVVVILGPSGSGKTTFLRCLNALEMPEDGQIEF
                    10         20         30         40         50         60

70         80         90        100        110        120
a122-1.pep   DNERPLKIDFSKKPSKHDILALRRKSGMVFQQYNLFPHKTALENVMEGPVAVQGKPAAQA
             ||||||||||||||||||||||||||||||||||||||||||||||||||||||||||||
m122-1       DNERPLKIDFSKKPSKHDILALRRKSGMVFQQYNLFPHKTALENVMEGPVAVQGKPAAQA
                    70         80         90        100        110        120

130        140        150        160        170        180
a122-1.pep   REEALKLLEKVGLGDKVDLYPYQLSGGQQQRVGIARALAIQPELMLFDEPTSALDPELVQ
             ||||||||||||||||||||||||||||||||||||||||||||||||||||||||||||
m122-1       REEALKLLEKVGLGDKVDLYPYQLSGGQQQRVGIARALAIQPELMLFDEPTSALDPELVQ
                   130        140        150        160        170        180

190        200        210        220        230        240
a122-1.pep   DVLNAMKELAREGWTMVVVTHEIKFALEVATTVVVMDGGVIVEQGSPKELFDHPKHERTR
             |||::|||||:|||||||||||||||||||||||||||||||||||::||||||||||||
m122-1       DVLDTMKELAQEGWTMVVVTHEIKFALEVATTVVVMDGGVIVEQGSPQDLFDHPKHERTR
                   190        200        210        220        230        240

250
a122-1.pep   RFLSQIQSTKIX
             ||||||||||||
m122-1       RFLSQIQSTKIX
                   250
```

The following partial DNA sequence was identified in *N. gonorrhoeae* <SEQ ID 457>:

```
g125.seq.
    1 ATGTCGGGCA ATGCCTCCTC TCCTTCATCT TCCGCCGCCA TCGGGCTGGT

51 TTGGTTCGGC GCGGCGGTAT CGATTGCCGA AATCAGCACG GGTACGCTGC

101 TCGCCCCCTT GGGCTGGCAG CGCGGTCTGG CGGCCCTGCT TTTGGGTCAT

151 GCCGTCGGCG GCGCGCTGTT TTTTGCGGCG GCGTATATCG GCGCACTGAC

201 CGGACGCAGC TCGATGGAAA GTGTGCGCCT GTCGTTCGGC AAATGCGGTT

251 CAGTGCTGTT TTCCGTGGCG AATATGCTGC AACTGGCCGG CTGGACGGCG

301 GTGATGATTT ACGTCGGCGC AacggTCAGC TCCGCTTTGG GCAAAGTGTT

351 GTGGGACggc gaATCCTTTG TCTGGTGGGC ATTGGCAAAC GGCGCACTGA

401 TCGTGCTGTG GCTGGTTTTC GGCGCACGCA GAACGGGCGG GCTGAAAACC

451 GTTTCGATGC TGCTGATGCT GCTTGCCGTG TTGTGGTTGA GCGTCGAAGT

501 GTTCGCTTCG TCCGGCACAA ACGCCGCGCC CGCCGTTTCA GACGGCATGA

551 CCTTCGGAAC GGCAGTCGAA CTGTCCGCCG TCATGCCGCT TTCCTGGCTG

601 CCGCTGGCCG CCGACTACAC GCGCCAAGCA CGCCGCCCGT TTGCGGCAAC

651 CCTGACGGCA ACGCTCGCCT ATACGCTGAC GGGCTGCTGG ATGTATGCCT
```

-continued

```
 701 TGGGTTTGGC GGCGGCTCTG TTTACCGGAG AAACCGACGT GGCGAAAATC

751 CTGTTGGGCG CGGGCTTGGG CATAACGGGC ATTCTGGCAG TCGTCCTCTC

801 CACCGTTACC ACAACGTTTC TCGATACCTA TTCCGCCGGC GCGAGTGCGA

851 ACAACATTTC CGCGCGTTTT GCGGAAATAC CCGTCGCTGT CGGCGTTACC

901 CTGatccgca ccgtgcttgc cgtcatgctg cccgttaccg aatataaaaa 951 cttcctgctg cttatccgct cggtatttgg gccgatggcg ggtggttttg 1001 attgccgaCT TTTttgtctt AAAACGGCGT GA
```

This corresponds to the amino acid sequence <SEQ ID 458; ORF 125.ng>:

The following partial DNA sequence was identified in *N. meningitidis* <SEQ ID 459>:

```
m125.seq
    1 ATGTCGGGCA ATGCCTCCTC TCCTTCATCT TCCTCCGCCA TCGGGCTGAT

51 TTGGTTCGGC GCGGCGGTAT CGATTGCCGA AATCAGCACG GGTACGCTGC

101 TTGCGCCTTT GGGCTGGCAG CGCGGTCTGG CGGCTCTACT TTTGGGTCAT

151 GCCGTCGGCG GCGCGCTGTT TTTTGCGGCG GCGTATATCG GCGCACTGAC

201 CGGACGCAGC TCGATGGAAA GCGTGCGCCT GTCGTTCGGC AAACGCGGTT

251 CAGTGCTGTT TTCCGTGGCG AATATGCTGC AACTGGCCGG CTGGACGGCG

301 GTGATGATTT ACGCCGGCGC AACGGTCAGC TCCGCTTTGG GCAAAGTGTT

351 GTGGGACGGC GAATCTTTTG TCTGGTGGGC ATTGGCAAAC GGCGCGCTGA

401 TTGTGCTGTG GCTGGTTTTC GGCGCACGCA AAACAGGCGG GCTGAAAACC

451 GTTTCGATGC TGCTGATGCT GTTGGCGGTT CTGTGGCTGA GTGCCGAAGT

501 CTTTTCCACG GCAGGCAGCA CCGCCGCACA GGTTTCAGAC GGCATGAGTT

551 TCGGAACGGC AGTCGAGCTG TCCGCCGTGA TGCCGCTTTC CTGGCTGCCG

601 CTTGCCGCCG ACTACACGCG CCACGCGCGC CGCCCGTTTG CGGCAACCCT

651 GACGGCAACG CTCGCCTACA CGCTGACCGG CTGCTGGATG TATGCCTTGG

701 GTTTGGCAGC GGCGTTGTTC ACCGGAGAAA CCGACGTGGC AAAAATCCTG

751 CTGGGCGCAr GTTTGgGTGC GGCAGGCATT TTGGCGGTCG TCCTCTCCAC

801 CGTTACCACA ACGTTTCTCG ATGCCTATTC CGCCGGCGCG AGTGCGAACA

851 ACATTTCCGC GCGTTTTGCG GAAACACCCG TCGCTGTCrG CGTTACCCTG

901 ATCGGCACGG TACTTGCCGT CATGCTGCCC GTTACCGAAT ATGAAAACTT

951 CCTGCTGCTT ATCGGCTCGG TATTTGCGCC GATGGCGGgC GGTTTTGATT

1001 GCCGACTTTT TCGTCTTGAA ACGGCGTGA
```

This corresponds to the amino acid sequence <SEQ ID 460; ORF 125>:

```
m125.pep
    1 MSGNASSPSS SSAIGLIWFG AAVSIAEIST GTLLAPLGWQ RGLAALLLGH

51 AVGGALFFAA AYIGALTGRS SMESVRLSFG KRGSVLFSVA NMLQLAGWTA

101 VMIYAGATVS SALGKVLWDG ESFVWWALAN GALIVLWLVF GARKTGGLKT

151 VSMLLMLLAV LWLSAEVFST AGSTAAQVSD GMSFGTAVEL SAVMPLSWLP

201 LAADYTRHAR RPFAATLTAT LAYTLTGCWM YALGLAAALF TGETDVAKIL
```

```
251  LGAXLGAAGI LAVVLSTVTT TFLDAYSAGA SANNISARFA ETPVAVXVTL

301  IGTVLAVMLP VTEYENFLLL IGSVFAPMAG GFDCRLFRLE TA*
```

Computer analysis of this amino acid sequence gave the following results:
Homology with a Predicted ORF from *N. gonorrhoeae*
ORF 125 shows 92.1% identity over a 343 aa overlap with a predicted ORF (ORF 125.ng) from *N. gonorrhoeae*:

```
m125/g125
                       10         20         30         40         50         60
m125.pep    MSGNASSPSSSSAIGLIWFGAAVSIAEISTGTLLAPLGWQRGLAALLLGHAVGGALFFAA
            ||||||||||:||||:||||||||||||||||||||||||||||||||||||||||||||
g125        MSGNASSPSSSAAIGLVWFGAAVSIAEISTGTLLAPLGWQRGLAALLLGHAVGGALFFAA
                       10         20         30         40         50         60

70         80         90        100        110        120
m125.pep    AYIGALTGRSSMESVRLSFGKRGSVLFSVANMLQLAGWTAVMIYAGATVSSALGKVLWDG
            |||||||||||||||||||||||| |||||||||||||||||||:|||||||||||||||
g125        AYIGALTGRSSMESVRLSFGKCGSVLFSVANMLQLAGWTAVMIYVGATVSSALGKVLWDG
                       70         80         90        100        110        120

130        140        150        160        170        179
m125.pep    ESFVWWALANGALIVLWLVFGARKTGGLKTVSMLLMLLAVLWLSAEVFSTAGSTAAQ-VS
            |||||||||||||||||||||||:||||||||||||||||||||:|||:::|::||  ||
g125        ESFVWWALANGALIVLWLVFGARRTGGLKTVSMLLMLLAVLWLSVEVFASSGTNAAPAVS
                      130        140        150        160        170        180

180        190        200        210        220        230        239
m125.pep    DGMSFGTAVELSAVMPLSWLPLAADYTRHARRPFAATLTATLAYTLTGCWMYALGLAAAL
            |||:||||||||||||||||||||||||:|||||||||||||||||||||||||||||||
g125        DGMTFGTAVELSAVMPLSWLPLAADYTRQARRPFAATLTATLAYTLTGCWMYALGLAAAL
                      190        200        210        220        230        240

240        250        260        270        280        290        299
m125.pep    FTGETDVAKILLGAXLGAAGILAVVLSTVTTTFLDAYSAGASANNISARFAETPVAVXVT
            |||||||||||||| ||:||||||||||||||:||||||||||||||||||| |||| ||
g125        FTGETDVAKILLGAGLGITGILAVVLSTVTTTFLDTYSAGASANNISARFAEIPVAVGVT
                      250        260        270        280        290        300

300        310        320        330        340
m125.pep    LIGTVLAVMLPVTEYENFLLLIGSVFAPMAGGFDCRLFRLETAX
            || ||||||||||||:|||||| |||:||||||||||||:|||
g125        LIRTVLAVMLPVTEYKNFLLLIRSVFGPMAGGFDCRLFCLKTAX
                      310        320        330        340
```

The following partial DNA sequence was identified in *N. meningitidis* <SEQ ID 461>:

```
a125.seq
    1 ATGTCGGGCA ATGCCTCCTC TCCTTCATCT TCCGCCGCCA TCGGGCTGAT

51 TTGGTTCGGC GCGGCGGTAT CGATTGCCGA AATCAGCACG GGTACACTGC

101 TTGCGCCTTT GGGCTGGCAG CGCGGTCTGG CGGCTCTGCT TTTGGGTCAT

151 GCCGTCGGCG GCGCGCTGTT TTTTGCGGCG GCGTATATCG GCGCACTGAC

201 CGGACGCAGC TCGATGGAAA GCGTGCGCCT GTCGTTCGGC AAACGCGGTT

251 CAGTGCTGTT TTCCGTGGCG AATATGCTGC AACTGGCCGG CTGGACGGCG

301 GTGATGATTT ACGCCGGCGC AACGGTCAGC TCCGCTTTGG GCAAAGTGTT

351 GTGGGACGGC GAATCTTTTG TCTGGTGGGC ATTGGCAAAC GGCGCGCTGA

401 TTGTGCTGTG GCTGGTTTTC GGCGCACGCA AAACAGGCGG GCTGAAAACC

451 GTTTCGATGC TGCTGATGCT GTTGGCGGTT CTGTGGCTGA GTGCCGAAGT
```

```
-continued
 501 CTTTTCCACG GCAGGCAGCA CCGCCGCACA GGTTTCAGAC GGCATGAGTT

551 TCGGAACGGC AGTCGAGCTG TCCGCCGTGA TGCCGCTTTC TTGGCTGCCG

601 CTGGCCGCCG ACTACACGCG CCACGCGCGC CGCCCGTTTG CGGCAACCCT

651 GACGGCAACG CTCGCCTACA CGCTGACCGG CTGCTGGATG TATGCCTTGG

701 GTTTGGCAGC GGCGTTGTTC ACCGGAGAAA CCGACGTGGC AAAAATCCTG

751 CTGGGCGCAG GTTTGGGTGC GGCAGGCATT TTGGCGGTCG TCCTGTCGAC

801 CGTTACCACC ACTTTTCTCG ATGCCTACTC CGCCGGCGTA AGTGCCAACA

851 ATATTTCCGC CAAACTTTCG GAAATACCCA TCGCCGTTGC CGTCGCCGTT

901 GTCGGCACAC TGCTTGCCGT CCTCCTGCCC GTTACCGAAT ATGAAAACTT

951 CCTGCTGCTT ATCGGCTCGG TATTTGCGCC GATGGCG.GC GGTTTTGATT

1001 GCCGACTTTT TCGTCTTGAA ACGGCGTGA
```

This corresponds to the amino acid sequence <SEQ ID 462; ORF 125.a>:

```
a125.pep.
   1 MSGNASSPSS SAAIGLIWFG AAVSIAEIST GTLLAPLGWQ RGLAALLLGH

51 AVGGALFFAA AYIGALTGRS SMESVRLSFG KRGSVLFSVA NMLQLAGWTA

101 VMIYAGATVS SALGKVLWDG ESFVWWALAN GALIVLWLVF GARKTGGLKT

151 VSMLLMLLAV LWLSAEVFST AGSTAAQVSD GMSFGTAVEL SAVMPLSWLP

201 LAADYTRHAR RPFAATLTAT LAYTLTGCWM YALGLAAALF TGETDVAKIL

251 LGAGLGAAGI LAVVLSTVTT TFLDAYSAGV SANNISAKLS EIPIAVAVAV

301 VGTLLAVLLP VTEYENFLLL IGSVFAPMAX GFDCRLFRLE TA*
``` m125/a125 95.6% identity in 342 aa overlap

```
                 10         20         30         40         50         60
m125.pep  MSGNASSPSSSSAIGLIWFGAAVSIAEISTGTLLAPLGWQRGLAALLLGHAVGGALFFAA
          ||||||||||:||||||||||||||||||||||||||||||||||||||||||||||||
a125      MSGNASSPSSSAAIGLIWFGAAVSIAEISTGTLLAPLGWQRGLAALLLGHAVGGALFFAA
                 10         20         30         40         50         60

70         80         90        100        110        120
m125.pep  AYIGALTGRSSMESVRLSFGKRGSVLFSVANMLQLAGWTAVMIYAGATVSSALGKVLWDG
          ||||||||||||||||||||||||||||||||||||||||||||||||||||||||||||
a125      AYIGALTGRSSMESVRLSFGKRGSVLFSVANMLQLAGWTAVMIYAGATVSSALGKVLWDG
                 70         80         90        100        110        120

130        140        150        160        170        180
m125.pep  ESFVWWALANGALIVLWLVFGARKTGGLKTVSMLLMLLAVLWLSAEVFSTAGSTAAQVSD
          ||||||||||||||||||||||||||||||||||||||||||||||||||||||||||||
a125      ESFVWWALANGALIVLWLVFGARKTGGLKTVSMLLMLLAVLWLSAEVFSTAGSTAAQVSD
                130        140        150        160        170        180

190        200        210        220        230        240
m125.pep  GMSFGTAVELSAVMPLSWLPLAADYTRHARRPFAATLTATLAYTLTGCWMYALGLAAALF
          ||||||||||||||||||||||||||||||||||||||||||||||||||||||||||||
a125      GMSFGTAVELSAVMPLSWLPLAADYTRHARRPFAATLTATLAYTLTGCWMYALGLAAALF
                190        200        210        220        230        240

250        260        270        280        290        300
m125.pep  TGETDVAKILLGAXLGAAGILAVVLSTVTTTFLDAYSAGASANNISARFAETPVAVXVTL
          |||||||||||| ||||||||||||||||||||||||||:|||||||| |:||  |::
a125      TGETDVAKILLGAGLGAAGILAVVLSTVTTTFLDAYSAGVSANNISAKLSEIPIAVAVAV
                250        260        270        280        290        300
```

```
                 310       320       330       340
m125.pep  IGTVLAVMLPVTEYENFLLLIGSVFAPMAGGFDCRLFRLETAX
          :||:|||:|||||||||||||||||| |||||||||||||||
a125      VGTLLAVLLPVTEYENFLLLIGSVFAPMAXGFDCRLFRLETAX
                 310       320       330       340
```

The following partial DNA sequence was identified in *N. gonorrhoeae* <SEQ ID 463>:

```
g126.seq
    1 AtgccgtcTG AAaccCcaaa ggcACGCCGC CGGCTTTCAG ACGGCATCGC

51 GTCCGACAAC CATACCAAAG AATCCATCAT GCTCACCctg tacggcGAAA

101 CTTTCCCTTC GCGGCTGCTg ctcggcacgG cggcctacCC GACCCCTGAA

151 ATCCTCAAAC AATCCGTCCG AACCGCCCGG CCCGCGATGA ttaccGTCTC

201 GCTGCGCCGC ACGGGATGCG GCGGCGAGGC GCACGGTCAG GGGTTTTGGT

251 CGCTGCTTCA AGAAACCGGC GTTCCCGTCC TGCCGAACAC GGCAGGCTGC

301 CAAAGCGTGC AGGAAGCGGT AACGACGGCG CAAATGGCGC GCGAAGTGTT

351 TGAAACCGAT TGGATAAAAT TGGAACTCAT CGGCGACGAC GACACCTTGC

401 AGCCGGACGT GTTCCAACTC GTCGAAGCGG CGGAAATCCT GATTAAAGAC

451 GGCTTCAAAG TGCTGCCTTA TTGCACCGAA GACCTGATTG CCTGCCGCCG

501 CCTGCTCGAT GCGGGCTGTC AGGCGTTGAT GCCGTGGGCG GCTCCCATCG

551 GCACGGGTTT GGGGGCGGTT CACGCCTATG CGCTCAAAAT CCTGCGCGAA

601 CGCCTGCCCG ACACGCCGCT GATTATCGAC GCGGGCTTGG GTTTGCCTTC

651 CCAAGCGGCA CAAGTGATGG AATGGGGTTT TGACGGCGTA TTGTTAAACA

701 CCGCCGTTTC CCGCAGCGGC GACCCCGTCA ACATGGCGCG CGCCTTCGCA

751 CTCGCCGTCG AATCCGGACG GCTGGCATTT GAAGCCGGGC CGGTCGAAGC

801 GCGAACCAAA GCCCAAGCCA GCACGCCGAC AGTCGGACAA CCGTTTTGGC

851 ATTCGGCGGA ATATTGA
```

This corresponds to the amino acid sequence <SEQ ID 464; ORF 126.ng>:

```
g126.pep
    1 MPSETPKARR RLSDGIASDN HTKESIMLTL YGETFPSRLL LGTAAYPTPE

51 ILKQSVRTAR PAMITVSLRR TGCGGEAHGQ GFWSLLQETG VPVLPNTAGC

101 QSVQEAVTTA QMAREVFETD WIKLELIGDD DTLQPDVFQL VEAAEILIKD

151 GFKVLPYCTE DLIACRRLLD AGCQALMPWA APIGTGLGAV HAYALKILRE

201 RLPDTPLIID AGLGLPSQAA QVMEWGFDGV LLNTAVSRSG DPVNMARAFA

251 LAVESGRLAF EAGPVEARTK AQASTPTVGQ PFWHSAEY*
```

The following partial DNA sequence was identified in *N. meningitidis* <SEQ ID 465>:

```
m126.seq. (partial)
    1 ..CACTATACAA AGGAACCCAT TATGCTCACC CTATACGGCG AAACTTTCCC

51    CTCGCGGCTG CTGCTCGGCA CGGCTGCCTA CCCGACCCCC GAAATCCTCA

101    AACAATCCAT CCAAACCGCC CAGCCTGCGA TGATTACCGT CTCGCTGCGC
```

-continued

```
 151     CGCGCGGGAA GCGGCGGCGA GGCGCACGGT CAGGGGTTTT GGTCGCTGCT

201     TCAAGAAACC GGCGTTCCCG TCCTGCCGAA CACGGCAGGC TGCCAAAGCG

251     TGCAGGAAGC GGTAACGACG GCGCAAATGG CGCGCGAAGT GTTTGAAACC

301     GATTGGATAA AATTGGAACT CATCGGAGAT GACGACACCT TGCAGCCGGA

351     TGTGTTCCAG CTTGTCGAAG CGGCGGAAAT CCTGATTAAA GACGGCTTCA

401     AAGTGCTGCC TTATTGCACC GAAGACCTGA TTGCCTGCCG CCGCCTGCTC

451     GACGCGGGCT GTCAGGCGTT GATGCCGTGG GCGGCGGCGA TCGGCACGGG

501     TTTGGGCGCG GTTCACGCCT ACGCGTTGAA CGTCCTGCGC GAACGCCTGC

551     CCGACACGCC GCTGATTATC GACGCGGGCT TGGGTTTGCC CTCACAGGCG

601     GCACAAGTGA TGGAATGGGG CTTTGACGGC GTGCTTTTGA ATACTGCCGT

651     TTCCCGCAGC GGCGATCCGG TCAATATGGC ACGCGCCTTC GCACTCGCCG

701     TCGAATCCGG ACGGCTGGCA TTTGAAGCCG GACCGGTCGA AGCACGCGAC

751     AAAGCGCAAG CCAGCACGCC GACAGTCGGA CAACCGTTTT GGCATTCGGC

801     GGAATATTGA
```

This corresponds to the amino acid sequence <SEQ ID 466; ORF 126>:

```
m126.pep (partial)
   1     ..HYTKEPIMLT LYGETFPSRL LLGTAAYPTP EILKQSIQTA QPAMITVSLR

51     RAGSGGEAHG QGFWSLLQET GVPVLPNTAG CQSVQEAVTT AQMAREVFET

101     DWIKLELIGD DDTLQPDVFQ LVEAAEILIK DGFKVLPYCT EDLIACRRLL

151     DAGCQALMPW AAPIGTGLGA VHAYALNVLR ERLPDTPLII DAGLGLPSQA

201     AQVMEWGFDG VLLNTAVSRS GDPVNMARAF ALAVESGRLA FEAGPVEARD

251     KAQASTPTVG QPFWHSAEY*
```

Computer analysis of this amino acid sequence gave the following results:
Homology with a Predicted ORF from *N. gonorrhoeae*
ORF 126 shows 95.9% identity over a 269 aa overlap with a predicted ORF (ORF 126.ng) from *N. gonorrhoeae*:

```
m126/g126
                                  10         20         30         40
      m126.pep             HYTKEPIMLTLYGETFPSRLLLGTAAYPTPEILKQSIQTAQ
                         ::|||  |||||||||||||||||||||||||||||||::||:
      g126     MPSETPKARRRLSDGIASDNHTKESIMLTLYGETFPSRLLLGTAAYPTPEILKQSVRTAR
                   10         20         30         40         50         60

50         60         70         80         90        100
      m126.pep  PAMITVSLRRAGSGGEAHGQGFWSLLQETGVPVLPNTAGCQSVQEAVTTAQMAREVFETD
                |||||||||:| |||||||||||||||||||||||||||||||||||||||||||||||
      g126      PAMITVSLRRTGCGGEAHGQGFWSLLQETGVPVLPNTAGCQSVQEAVTTAQMAREVFETD
                    70         80         90        100        110        120

110        120        130        140        150        160
      m126.pep  WIKLELIGDDDTLQPDVFQLVEAAEILIKDGFKVLPYCTEDLIACRRLLDAGCQALMPWA
                ||||||||||||||||||||||||||||||||||||||||||||||||||||||||||||
      g126      WIKLELIGDDDTLQPDVFQLVEAAEILIKDGFKVLPYCTEDLIACRRLLDAGCQALMPWA
                   130        140        150        160        170        180

170        180        190        200        210        220
      m126.pep  APIGTGLGAVHAYALNVLRERLPDTPLIIDAGLGLPSQAAQVMEWGFDGVLLNTAVSRSG
                ||||||||||||||||::|||||||||||||||||||||||||||||||||||||||||
      g126      APIGTGLGAVHAYALKILRERLPDTPLIIDAGLGLPSQAAQVMEWGFDGVLLNTAVSRSG
                   190        200        210        220        230        240
```

-continued

```
                230        240        250        260        270
m126.pep   DPVNMARAFALAVESGRLAFEAGPVEARDKAQASTPTVGQPFWHSAEYX
           ||||||||||||||||||||||||||||| ||||||||||||||||||
g126       DPVNMARAFALAVESGRLAFEAGPVEARTKAQASTPTVGQPFWHSAEYX
                  250        260        270        280
```

The following partial DNA sequence was identified in *N. meningitidis* <SEQ ID 467>:

```
a126.seq
   1  TTGTTAATCC ACTATACAAA GGAACCCATT ATGCTCACCC TGTACAGCGA

51  AACTTTCCCT TCGCGGCTGC TGCTCGGCAC AGCCGCCTAC CCGACCCCTG

101  AAATCCTCAA ACAATCCGTC CGAACCGCCC GGCCCGCGAT GATTACCGTC

151  TCGCTGCGCC GCGCGGGATG CGGCGGCGAG CGCACGGTC AGGGGTTTTG

201  GTCGCTGCTT CAAGAAACCG GCGTTCCCGT CCTGCCGAAC ACGGCAGGCT

251  GCCAAAGCGT GCAGGAAGCG GTAACGACGG CGCAAATGGC GCGCGAAGTG

301  TTTGAAACCG ATTGGATTAA ACTCGAACTC ATCGGCGACG ACGACACCTT

351  GCAGCCGGAT GTGTTCCAAC TTGTCGAAGC GGCGGAAATC CTGATTAAAG

401  ACGGCTTCAA AGTGCTGCCT TATTGCACCG AAGACCTGAT TGCCTGCCGC

451  CGCCTGCTCG ACGCGGGCTG TCAGGCGTTG ATGCCGTGGG CGGCCCCGAT

501  CGGCACGGGT TTGGGCGCGG TTCACGCCTA CGCGTTGAAC GTCCTGCGCG

551  AACGCCTGCC CGACACGCCG CTGATTATCG ACGCGGGCTT GGGTTTGCCC

601  TCACAGGCGG CACAAGTGAT GGAATGGGGC TTTGACGGCG TGCTTTTGAA

651  TACTGCCGTT TCCCGCAGCG GCGATCCGGT CAATATGGCA CGCGCCTTCG

701  CACTCGCCGT CGAATCCGGA CGGCTGGCAT TTGAAGCCGG ACCGGTCGAA

751  GCACGCGACA AAGCGCAAGC CAGCACGCCG ACAGTCGGAC AACCGTTTTG

801  GCATTCGGCG GAATATTGA
```

This corresponds to the amino acid sequence <SEQ ID 468; ORF 126.a>:

```
a126.pep
   1    LLIHYTKEPI MLTLYSETFP SRLLLGTAAY PTPEILKQSV RTARPAMITV

51    SLRRAGCGGE AHGQGFWSLL QETGVPVLPN TAGCQSVQEA VTTAQMAREV

101    FETDWIKLEL IGDDDTLQPD VFQLVEAAEI LIKDGFKVLP YCTEDLIACR

151    RLLDAGCQAL MPWAAPIGTG LGAVHAYALN VLRERLPDTP LIIDAGLGLP

201    SQAAQVMEWG FDGVLLNTAV SRSGDPVNMA RAFALAVESG RLAFEAGPVE

251    ARDKAQASTP TVGQPFWHSA EY*
``` m126/a126 98.1% identity in 269 aa overlap

```
                  10         20         30         40         50
m126.pep   HYTKEPIMLTLYGETFPSRLLLGTAAYPTPEILKQSIQTAPAMITVSLRRAGSGGE
           |||||||||||:|||||||||||||||||||||||::||:||||||||||| |||
a126       LLIHYTKEPIMLTLYSETFPSRLLLGTAAYPTPEILKQSVRTARPAMITVSLRRAGCGGE
              10         20         30         40         50         60
```

```
                  60         70         80         90        100        110
m126.pep  AHGQGFWSLLQETGVPVLPNTAGCQSVQEAVTTAQMAREVFETDWIKLELIGDDDTLQPD
          ||||||||||||||||||||||||||||||||||||||||||||||||||||||||||||
a126      AHGQGFWSLLQETGVPVLPNTAGCQSVQEAVTTAQMAREVFETDWIKLELIGDDDTLQPD
                  70         80         90        100        110        120

120        130        140        150        160        170
m126.pep  VFQLVEAAEILIKDGFKVLPYCTEDLIACRRLLDAGCQALMPWAAPIGTGLGAVHAYALN
          ||||||||||||||||||||||||||||||||||||||||||||||||||||||||||||
a126      VFQLVEAAEILIKDGFKVLPYCTEDLIACRRLLDAGCQALMPWAAPIGTGLGAVHAYALN
                 130        140        150        160        170        180

180        190        200        210        220        230
m126.pep  VLRERLPDTPLIIDAGLGLPSQAAQVMEWGFDGVLLNTAVSRSGDPVNMARAFALAVESG
          ||||||||||||||||||||||||||||||||||||||||||||||||||||||||||||
a126      VLRERLPDTPLIIDAGLGLPSQAAQVMEWGFDGVLLNTAVSRSGDPVNMARAFALAVESG
                 190        200        210        220        230        240

240        250        260        270
m126.pep  RLAFEAGPVEARDKAQASTPTVGQPFWHSAEYX
          |||||||||||||||||||||||||||||||||
a126      RLAFEAGPVEARDKAQASTPTVGQPFWHSAEYX
                 250        260        270
```

The following partial DNA sequence was identified in *N. gonorrhoeae* <SEQ ID 469>:

```
g126-1.seq
    1  ATGCTCACCC TGTACGGCGA AACTTTCCCT TCGCGGCTGC TGCTCGGCAC

51  GGCCGCCTAC CCGACCCCTG AAATCCTCAA ACAATCCGTC CGAACCGCCC

101  GGCCCGCGAT GATTACCGTC TCGCTGCGCC GCACGGGATG CGGCGGCGAG

151  GCGCACGGTC AGGGGTTTTG GTCGCTGCTT CAAGAAACCG GCGTTCCCGT

201  CCTGCCGAAC ACGGCAGGCT GCCAAAGCGT GCAGGAAGCG GTAACGACGG

251  CGCAAATGGC GCGCGAAGTG TTTGAAACCG ATTGGATAAA ATTGGAACTC

301  ATCGGCGACG ACGACACCTT GCAGCCGGAC GTGTTCCAAC TCGTCGAAGC

351  GGCGGAAATC CTGATTAAAG ACGGCTTCAA AGTGCTGCCT TATTGCACCG

401  AAGACCTGAT TGCCTGCCGC CGCCTGCTCG ATGCGGGCTG TCAGGCGTTG

451  ATGCCGTGGG CGGCTCCCAT CGGCACGGGT TTGGGGGCGG TTCACGCCTA

501  TGCGCTCAAA ATCCTGCGCG AACGCCTGCC CGACACGCCG CTGATTATCG

551  ACGCGGGCTT GGGTTTGCCT TCCCAAGCGG CACAAGTGAT GGAATGGGGT

601  TTTGACGGCG TATTGTTAAA CACCGCCGTT TCCCGCAGCG GCGACCCCGT

651  CAACATGGCG CGCGCCTTCG CACTCGCCGT CGAATCCGGA CGGCTGGCAT

701  TTGAAGCCGG GCCGGTCGAA GCGCGAACCA AAGCCCAAGC CAGCACGCCG

751  ACAGTCGGAC AACCGTTTTG GCATTCGGCG GAATATTGA
```

This corresponds to the amino acid sequence <SEQ ID 470; ORF 126-1.ng>:

```
g126-1.pep.
    1  MLTLYGETFP SRLLLGTAAY PTPEILKQSV RTARPAMITV SLRRTGCGGE

51  AHGQGFWSLL QETGVPVLPN TAGCQSVQEA VTTAQMAREV FETDWIKLEL

101  IGDDDTLQPD VFQLVEAAEI LIKDGFKVLP YCTEDLIACR RLLDAGCQAL

151  MPWAAPIGTG LGAVHAYALK ILRERLPDTP LIIDAGLGLP SQAAQVMEWG

201  FDGVLLNTAV SRSGDPVNMA RAFALAVESG RLAFEAGPVE ARTKAQASTP

251  TVGQPFWHSA EY*
```

The following partial DNA sequence was identified in *N. meningitidis* <SEQ ID 471>:

```
m126-1.seq
    1 ATGCTCACCC TATACGGCGA AACTTTCCCC TCGCGGCTGC TGCTCGGCAC

51 GGCTGCCTAC CCGACCCCCG AAATCCTCAA ACAATCCATC CAAACCGCCC

101 AGCCTGCGAT GATTACCGTC TCGCTGCGCC GCGCGGGAAG CGGCGGCGAG

151 GCGCACGGTC AGGGGTTTTG GTCGCTGCTT CAAGAAACCG GCGTTCCCGT

201 CCTGCCGAAC ACGGCAGGCT GCCAAAGCGT GCAGGAAGCG GTAACGACGG

251 CGCAAATGGC GCGCGAAGTG TTTGAAACCG ATTGGATAAA ATTGGAACTC

301 ATCGGAGATG ACGACACCTT GCAGCCGGAT GTGTTCCAGC TTGTCGAAGC

351 GGCGGAAATC CTGATTAAAG ACGGCTTCAA AGTGCTGCCT TATTGCACCG

401 AAGACCTGAT TGCCTGCCGC CGCCTGCTCG ACGCGGGCTG TCAGGCGTTG

451 ATGCCGTGGG CGGCCCCGAT CGGCACGGGT TTGGGCGCGG TTCACGCCTA

501 CGCGTTGAAC GTCCTGCGCG AACGCCTGCC CGACACGCCG CTGATTATCG

551 ACGCGGGCTT GGGTTTGCCC TCACAGGCGG CACAAGTGAT GGAATGGGGC

601 TTTGACGGCG TGCTTTTGAA TACTGCCGTT TCCCGCAGCG GCGATCCGGT

651 CAATATGGCA CGCGCCTTCG CACTCGCCGT CGAATCCGGA CGGCTGGCAT

701 TTGAAGCCGG ACCGGTCGAA GCACGCGACA AAGCGCAAGC CAGCACGCCG

751 ACAGTCGGAC AACCGTTTTG GCATTCGGCG GAATATTGA
```

This corresponds to the amino acid sequence <SEQ ID 5; ORF 126-1>:

```
m126-1.pep
    1 MLTLYGETFP SRLLLGTAAY PTPEILKQSI QTAQPAMITV SLRRAGSGGE

51 AHGQGFWSLL QETGVPVLPN TAGCQSVQEA VTTAQMAREV FETDWIKLEL

101 IGDDDTLQPD VFQLVEAAEI LIKDGFKVLP YCTEDLIACR RLLDAGCQAL

151 MPWAAPIGTG LGAVHAYALN VLRERLPDTP LIIDAGLGLP SQAAQVMEWG

201 FDGVLLNTAV SRSGDPVNMA RAFALAVESG RLAFEAGPVE ARDKAQASTP

251 TVGQPFWHSA EY* m126-1/g126-1  96.9% identity in 262 aa overlap 10         20         30         40         50         60
     m126-1.pep   MLTLYGETFPSRLLLGTAAYPTPEILKQSIQTAQPAMITVSLRRAGSGGEAHGQGFWSLL
                  ||||||||||||||||||||||||||||||::||:||||||||||||:|||||||||||
         g126-1   MLTLYGETFPSRLLLGTAAYPTPEILKQSVRTARPAMITVSLRRTGCGGEAHGQGFWSLL
                    10         20         30         40         50         60

70         80         90        100        110        120
     m126-1.pep   QETGVPVLPNTAGCQSVQEAVTTAQMAREVFETDWIKLELIGDDDTLQPDVFQLVEAAEI
                  ||||||||||||||||||||||||||||||||||||||||||||||||||||||||||||
         g126-1   QETGVPVLPNTAGCQSVQEAVTTAQMAREVFETDWIKLELIGDDDTLQPDVFQLVEAAEI
                    70         80         90        100        110        120

130        140        150        160        170        180
     m126-1.pep   LIKDGFKVLPYCTEDLIACRRLLDAGCQALMPWAAPIGTGLGAVHAYALNVLRERLPDTP
                  |||||||||||||||||||||||||||||||||||||||||||||||||::||||||||
         g126-1   LIKDGFKVLPYCTEDLIACRRLLDAGCQALMPWAAPIGTGLGAVHAYALKILRERLPDTP
                   130        140        150        160        170        180

190        200        210        220        230        240
     m126-1.pep   LIIDAGLGLPSQAAQVMEWGFDGVLLNTAVSRSGDPVNMARAFALAVESGRLAFEAGPVE
                  ||||||||||||||||||||||||||||||||||||||||||||||||||||||||||||
         g126-1   LIIDAGLGLPSQAAQVMEWGFDGVLLNTAVSRSGDPVNMARAFALAVESGRLAFEAGPVE
                   190        200        210        220        230        240
```

```
                    -continued
                    250        260
m126-1.pep  ARDKAQASTPTVGQPFWHSAEYX
            || |||||||||||||||||||||
g126-1      ARTKAQASTPTVGQPFWHSAEYX
                    250        260
```

The following partial DNA sequence was identified in *N. meningitidis* <SEQ ID 473>:

```
a126-1.seq
   1  ATGCTCACCC TGTACAGCGA AACTTTCCCT TCGCGGCTGC TGCTCGGCAC

51  AGCCGCCTAC CCGACCCCTG AAATCCTCAA ACAATCCGTC CGAACCGCCC

101  GGCCCGCGAT GATTACCGTC TCGCTGCGCC GCGCGGGATG CGGCGGCGAG

151  GCGCACGGTC AGGGGTTTTG GTCGCTGCTT CAAGAAACCG GCGTTCCCGT

201  CCTGCCGAAC ACGGCAGGCT GCCAAAGCGT GCAGGAAGCG GTAACGACGG

251  CGCAAATGGC GCGCGAAGTG TTTGAAACCG ATTGGATTAA ACTCGAACTC

301  ATCGGCGACG ACGACACCTT GCAGCCGGAT GTGTTCCAAC TTGTCGAAGC

351  GGCGGAAATC CTGATTAAAG ACGGCTTCAA AGTGCTGCCT TATTGCACCG

401  AAGACCTGAT TGCCTGCCGC CGCCTGCTCG ACGCGGGCTG TCAGGCGTTG

451  ATGCCGTGGG CGGCCCCGAT CGGCACGGGT TTGGGCGCGG TTCACGCCTA

501  CGCGTTGAAC GTCCTGCGCG AACGCCTGCC CGACACGCCC CTGATTATCG

551  ACGCGGGCTT GGGTTTGCCC TCACAGGCGG CACAAGTGAT GGAATGGGGC

601  TTTGACGGCG TGCTTTTGAA TACTGCCGTT TCCCGCAGCG GCGATCCGGT

651  CAATATGGCA CGCGCCTTCG CACTCGCCGT CGAATCCGGA CGGCTGGCAT

701  TTGAAGCCGG ACCGGTCGAA GCACGCGACA AAGCGCAAGC CAGCACGCCG

751  ACAGTCGGAC AACCGTTTTG GCATTCGGCG GAATATTGA
```

This corresponds to the amino acid sequence <SEQ ID 474; ORF 126-1.a>:

```
a126-1.pep

1  MLTLYGETFP SRLLLGTAAY PTPEILKQSV RTAQPAMITV SLRRAGSGGE

51  AHGQGFWSLL QETGVPVLPN TAGCQSVQEA VTTAQMAREV FETDWIKLEL

101  IGDDDTLQPD VFQLVEAAEI LIKDGFKVLP YCTEDLIACR RLLDAGCQAL

151  MPWAAPIGTG LGAVHAYALN VLRERLPDTP LIIDAGLGLP SQAAQVMEWG

201  FDGVLLNTAV SRSGDPVNMA RAFALAVESG RLAFEAGPVE ARDKAQASTP

251  TVGQPFWHSA EY* a126-1/m126-1  98.1% identity in 262 aa overlap 10         20         30         40         50         60
    a126-1.pep  MLTLYSETFPSRLLLGTAAYPTPEILKQSVRTARPAMITVSLRRAGCGGEAHGQGFWSLL
                |||||:||||||||||||||||||||||||::||:||||||||||| ||||||||||||
    m126-1      MLTLYGETFPSRLLLGTAAYPTPEILKQSIQTAQPAMITVSLRRTGSGGEAHGQGFWSLL
                        10         20         30         40         50         60

70         80         90        100        110        120
    a126-1.pep  QETGVPVLPNTAGCQSVQEAVTTAQMAREVFETDWIKLELIGDDDTLQPDVFQLVEAAEI
                ||||||||||||||||||||||||||||||||||||||||||||||||||||||||||||
    m126-1      QETGVPVLPNTAGCQSVQEAVTTAQMAREVFETDWIKLELIGDDDTLQPDVFQLVEAAEI
                        70         80         90        100        110        120
```

```
                     130        140        150        160        170        180
a126-1.pep    LIKDGFKVLPYCTEDLIACRRLLDAGCQALMPWAAPIGTGLGAVHAYALNVLRERLPDTP
              ||||||||||||||||||||||||||||||||||||||||||||||||||||||||||||
m126-1        LIKDGFKVLPYCTEDLIACRRLLDAGCQALMPWAAPIGTGLGAVHAYALNVLRERLPDTP
                     130        140        150        160        170        180

190        200        210        220        230        240
a126-1.pep    LIIDAGLGLPSQAAQVMEWGFDGVLLNTAVSRSGDPVNMARAFALAVESGRLAFEAGPVE
              ||||||||||||||||||||||||||||||||||||||||||||||||||||||||||||
m126-1        LIIDAGLGLPSQAAQVMEWGFDGVLLNTAVSRSGDPVNMARAFALAVESGRLAFEAGPVE
                     190        200        210        220        230        240

250        260
a126-1.pep    ARDKAQASTPTVGQPFWHSAEYX
              |||||||||||||||||||||||
m126-1        ARDKAQASTPTVGQPFWHSAEYX
                     250        260
```

The following partial DNA sequence was identified in *N. gonorrhoeae* <SEQ ID 475>:

```
g127.seq
   1  ATGGAAATAT GGAATATGTT GAACACTTGG CCCGATGCCG TCCCGATACG

51  CGCGGAGGCG GCCGAATCCG TGGCGGCGGT CGCGGCTTTG CTGCTGGCGC

101  GCGCCCTTCT GTTGAATATC CACTTCAGAC GGCATCCGGA TTTCGGCATC

151  GAAAGCAAGC GGCGGTTTTT GGTTGCCAGC CGCAATATAA CGCTGCTTTT

201  GGTGCTGTTT TCGCTGGCAT TTATCTGGTC GGCGCAAATT CAAACGCTGG

251  CTTTGTCGAT GTTTGCGGTG GCGGCGGCGG TCGTCGTGGC GACAAAAGAA

301  CTGATTATGT GTCTGTCGGG CAGTATTTTA aggtctGCCA CCCAGCAATA

351  CTCGGTCGGC GACTATATCG AAATCAACGG CCTGCGCGGG CGCGTGGTCG

401  ACATCAATCT GTTGAACACG CTGATGATGC AGGTCGGTCC GAACCCCTTG

451  GTCGGACAGC TTGCGGGAAC CACCGTTTCT TTCCCCAACA GCCTGTTGTT

501  GAGCCACCCC GTGCGCCGCG ACAATATTTT GGGCGACTAT GTCATCCATA

551  CGGTCGAAAT CCCCGTTCCC ATCCATTTGG ATTCGGATGA AGCCGTATGC

601  CGTCTGAAAG CCGTACTCGA GCCCTTGTGC GCGCCCTACA TCCCCGCCAT

651  TCAGCGGTAT TTGGAAAACG TGCAGGCGGA AAAACTGTTT ATCACGCCCG

701  CCGCCAGGCC GCGCGTTACC CGCGTACCGT ACGACGACAA GGCATACCGC

751  ATCATCGTCC GCTTCGCCTC CCCCGTTTCA AAGCGGCTGG AAATCCAACA

801  GGCGGTTATG GACGAATTTT TGCGCGTACA ATACCGCCTG TTAAATCATC

851  CCGCCGcfct cccrAAACAC TTTAA
                                                    50
```

This corresponds to the amino acid sequence <SEQ ID 476; ORF 127.ng>:

```
g127.pep
   1  MEIWNMLNTW PDAVPIRAEA AESVAAVAAL LLARALLLNI HFRRHPDFGI

51  ESKRRFLVAS RNITLLLVLF SLAFIWSAQI QTLALSMFAV AAAVVVATKE

101  LIMCLSGSIL RSATQQYSVG DYIEINGLRG RVVDINLLNT LMMQVGPNPL

151  VGQLAGTTVS FPNSLLLSHP VRRDNILGDY VIHTVEIPVP IHLDSDEAVC

201  RLKAVLEPLC APYIPAIQRY LENVQAEKLF ITPAARPRVT RVPYDDKAYR

251  IIVRFASPVS KRLEIQQAVM DEFLRVQYRL LNHPAGSETL *
```

The following partial DNA sequence was identified in *N. meningitidis* <SEQ ID 477>:

```
m127.seq
    1 ATGGAAATAT GGAATATGTT GGACACTTGG CTCGGTGCCG TCCCGATACG

51 TGCGGAGGCG GTCGAATCCG TGGCGGCGGT TGCGGCTTTG CTGCTGGCGC

101 GCGCCCTTCT GTTGAATATC CACTTCAAAC GGCATCCGGA TTTCGGCATC

151 GAAAGCAAGC GGCGGTTTTT GGTTGCCAGC CGCAATATAA CGCTGCTTTT

201 GGTGCTGTTT TCGCTGGCAT TTATCTGGTC GGCGCAAATC CAAACGCTGG

251 CTTTGTCGAT GTTTGCGGTG GCGGCGGCGG TCGTCGTGGC GACGAAGGAA

301 CTGATTATGT GTCTGTCGGG CAGTATTTTA AGGTCTGCCA CCCAGCAATA

351 CTCGGTCGGC GACTATATCG AAATCAACGG CCTGCGCGGG CGCGTGGTCG

401 ACATCAACCT GTTGAACACG CTGATGATGC AGGTCGGTCC GAACCCCTTG

451 GTCGGACAGC TTGCGGGAAC CACCGTTTCT TTCCCCAACA GCCTGTTGTT

501 GAGCCACCCC GTGCGCCGCG ACAATATTTT GGGCGACTAT GTCATCCATA

551 CGGTCGAAAT CCCCGTTCCC ATCCATTTGG ATTCGGATGA AGCCGTATGC

601 CGTCTGAAAG CCGTACTCGA GCCCTTGTGC GCGCCCTACA TCCCCGCCAT

651 CCAACGGsAT TTGGAAAACG TGCAGGCGGA AAAACTGTTT ATCACGCCCG

701 CCGCCAGACC GCGCGTTACC CGCGTGCCGT ACGATGACAA GGCATACCGC

751 ATCATCGTCC GCTTCGCTTC CCCCGTTTCA AGCGGCTGG AAATCCAACA

801 GGCGGTTATG GACGAATTTT TGCGCGTACA ATACCGCCTG TTAAATCACC

851 CCGCCGGCTC CGAAACACTT TAA
```

This corresponds to the amino acid sequence <SEQ ID 478; ORF 127>:

```
m127.pep
    1 MEIWNMLDTW LGAVPIRAEA VESVAAVAAL LLARALLLNI HFKRHPDFGI

51 ESKRRFLVAS RNITLLLVLF SLAFIWSAQI QTLALSMFAV AAAVVVATKE

101 LIMCLSGSIL RSATQQYSVG DYIEINGLRG RVVDINLLNT LMMQVGPNPL

151 VGQLAGTTVS FPNSLLLSHP VRRDNILGDY VIHTVEIPVP IHLDSDEAVC

201 RLKAVLEPLC APYIPAIQRX LENVQAEKLF ITPAARPRVT RVPYDDKAYR

251 IIVRFASPVS KRLEIQQAVM DEFLRVQYRL LNHPAGSETL *
```

Computer analysis of this amino acid sequence gave the following results:
Homology with a Predicted ORF from *N. gonorrhoeae*
ORF 127 shows 97.9% identity over a 290 aa overlap with a predicted ORF (ORF 127.ng) from *N. gonorrhoeae*:

```
m127/g127
                     10         20         30         40         50         60
     m127.pep   MEIWNMLDTWLGAVPIRAEAVESVAAVAALLLARALLLNIHFKRHPDFGIESKRRFLVAS
                |||||||:|| ||||||||:||||||||||||||||||||:||||||||||||||||||
        g127   MEIWNMLNTWPDAVPIRAEAAESVAAVAALLLARALLLNIHFRRHPDFGIESKRRFLVAS
                     10         20         30         40         50         60
```

-continued

```
             70        80        90       100       110       120
m127.pep  RNITLLLVLFSLAFIWSAQIQTLALSMFAVAAAVVVATKELIMCLSGSILRSATQQYSVG
          ||||||||||||||||||||||||||||||||||||||||||||||||||||||||||||
g127      RNITLLLVLFSLAFIWSAQIQTLALSMFAVAAAVVVATKELIMCLSGSILRSATQQYSVG
             70        80        90       100       110       120
            130       140       150       160       170       180
m127.pep  DYIEINGLRGRVVDINLLNTLMMQVGPNPLVGQLAGTTVSFPNSLLLSHPVRRDNILGDY
          ||||||||||||||||||||||||||||||||||||||||||||||||||||||||||||
g127      DYIEINGLRGRVVDINLLNTLMMQVGPNPLVGQLAGTTVSFPNSLLLSHPVRRDNILGDY
            130       140       150       160       170       180
            190       200       210       220       230       240
m127.pep  VIHTVEIPVPIHLDSDEAVCRLKAVLEPLCAPYIPAIQRXLENVQAEKLFITPAARPRVT
          ||||||||||||||||||||||||||||||||||||||| ||||||||||||||||||||
g127      VIHTVEIPVPIHLDSDEAVCRLKAVLEPLCAPYIPAIQRYLENVQAEKLFITPAARPRVT
            190       200       210       220       230       240
            250       260       270       280       290
m127.pep  RVPYDDKAYRIIVRFASPVSKRLEIQQAVMDEFLRVQYRLLNHPAGSETLX
          |||||||||||||||||||||||||||||||||||||||||||||||||||
g127      RVPYDDKAYRIIVRFASPVSKRLEIQQAVMDEFLRVQYRLLNHPAGSETLX
            250       260       270       280       290
```

The following partial DNA sequence was identified in *N. meningitidis* <SEQ ID 479>:

```
a127.seq
   1  ATGGAAATAT GGAATATGTT GGACACTTGG CTCGGTGCCG TCCCGATACG
  51  TGCGGAGGCG GTCGAATCCG TGGCGGTGGT CGCGGCTTTG CTGCTGGCGC
 101  GCGCCCTTCT GTTGAATATC CACTTCAAAC GGCATCCGGA TTTCGGCATC
 151  GAAAGCAAGC GGCGGTTTTT GGTTGCCAGC CGCAATATAA CGCTGCTTTT
 201  GGTGCTGTTT TCGCTGGCAT TTATCTGGTC GGCGCAAATC CAAACGCTGG
 251  CTTTGTCGAT GTTTGCGGTG GCGGCGGCGG TCGTCGTGGC GACGAAGGAA
 301  CTGATTATGT GTCTGTCGGG CAGCATTTTA AGGTCTGCCA CCCAGCAATA
 351  CTCGGTCGGC GACTATATCG AAATCAACGG CCTGCGCGGG CGCGTGGTCG
 401  ACATCAACCT GTTGAACACG CTGATGATGC AGGTCGGTCC GAACCCCTTG
 451  GTCGGACAGC TTGCGGGAAC CACCGTTTCT TTCCCCAACA GCCTGTTGTT
 501  GAGCCACCCC GTGCGCCGCG ACAATATTTT GGGCGACTAC GTCATCCATA
 551  CGGTCGAAAT CCCGGTTCCC ATCCATTTGG ATTCGGATGA AGCCGTATGC
 601  CGTCTGAAAG CCGTACTCGA GCCCTTGTGC GCGCCCTACA TCCCCGCCAT
 651  CCAACGGCAT TTGGAAAACG TGCAGGCGGA AAAACTGTTT ATCACGCCCG
 701  CCGCCAAACC GCGCGTTACC CGCGTGCCGT ACGATGACAA GGCATACCGC
 751  ATCATCGTCC GCTTCGCCTC CCCCGTTTCA AAGCGGCTGG AAATCCAACA
 801  GGCGGTTATG GACGAATTTT TGCGCGTACA ATACCGCCTG TTAAATTACC
 851  CCGCCGGCTC CGAAACACTT TAA
```

This corresponds to the amino acid sequence <SEQ ID 480; ORF 127.a>:

```
a127.pep.
   1  MEIWNMLDTW LGAVPIRAEA VESVAVVAAL LLARALLLNI HFKRHPDFGI
  51  ESKRRFLVAS RNITLLLVLF SLAFIWSAQI QTLALSMFAV AAAVVVATKE
 101  LIMCLSGSIL RSATQQYSVG DYIEINGLRG RVVDINLLNT LMMQVGPNPL
```

```
151 VGQLAGTTVS FPNSLLLSHP VRRDNILGDY VIHTVEIPVP IHLDSDEAVC

201 RLKAVLEPLC APYIPAIQRH LENVQAEKLF ITPAAKPRVT RVPYDDKAYR

251 IIVRFASPVS KRLEIQQAVM DEFLRVQYRL LNYPAGSETL *
``` m127/a127 98.6% identity in 290 aa overlap

```
                 10         20         30         40         50         60
 m127.pep  MEIWNMLDTWLGAVPIRAEAVESVAAVAALLLARALLLNIHFKRHPDFGIESKRRFLVAS
           ||||||||||||||||||||||:|||||||||||||||||||||||||||||||||||||
 a127      MEIWNMLDTWLGAVPIRAEAVESVAVVAALLLARALLLNIHFKRHPDFGIESKRRFLVAS
                 10         20         30         40         50         60

70         80         90        100        110        120
 m127.pep  RNITLLLVLFSLAFIWSAQIQTLALSMFAVAAAVVVATKELIMCLSGSILRSATQQYSVG
           ||||||||||||||||||||||||||||||||||||||||||||||||||||||||||||
 a127      RNITLLLVLFSLAFIWSAQIQTLALSMFAVAAAVVVATKELIMCLSGSILRSATQQYSVG
                 70         80         90        100        110        120

130        140        150        160        170        180
 m127.pep  DYIEINGLRGRVVDINLLNTLMMQVGPNPLVGQLAGTTVSFPNSLLLSHPVRRDNILGDY
           ||||||||||||||||||||||||||||||||||||||||||||||||||||||||||||
 a127      DYIEINGLRGRVVDINLLNTLMMQVGPNPLVGQLAGTTVSFPNSLLLSHPVRRDNILGDY
                130        140        150        160        170        180

190        200        210        220        230        240
 m127.pep  VIHTVEIPVPIHLDSDEAVCRLKAVLEPLCAPYIPAIQRXLENVQAEKLFITPAARPRVT
           |||||||||||||||||||||||||||||||||||||| |||||||||||||||:||||
 a127      VIHTVEIPVPIHLDSDEAVCRLKAVLEPLCAPYIPAIQRHLENVQAEKLFITPAAKPRVT
                190        200        210        220        230        240

250        260        270        280        290
 m127.pep  RVPYDDKAYRIIVRFASPVSKRLEIQQAVMDEFLRVQYRLLNHPAGSETLX
           |||||||||||||||||||||||||||||||||||||||||:|||||||||
 a127      RVPYDDKAYRIIVRFASPVSKRLEIQQAVMDEFLRVQYRLLNYPAGSETLX
                250        260        270        280        290
```

The following partial DNA sequence was identified in *N. gonorrhoeae* <SEQ ID 481>:

```
g128.seq
    1 atgattgaca acgCActgct ccacttgggc gaagaaccCC GTTTTaatca 51 aatccaaacc gaagACAtca AACCCGCCGT CCAAACCGCC ATCGCCGAAG

101 CGCGCGGACA AATCGCCGCC GTCAAAGCGC AAACGCACAC CGGCTGGGCG

151 AACACCGTCG AGCGTCTGAC CGGCATCACC GAACGCGTCG GCAGGATTTG

201 GGGCGTCGTG TCCCATCTCA ACTCCGTCGT CGACACGCCC GAACTGCGCG

251 CCGTCTATAA CGAACTGATG CCTGAAATCA CCGTCTTCTT CACCGAAATC

301 GGACAAGACA TCGAACTGTA CAACCGCTTC AAAACCATCA AAAATTCCCC

351 CGAATTTGCA ACGCTTTCCC CCGCACAAAA AACCAAGCTC GATCACGACC

401 TGCGCGATTT CGTATTGAGC GGCGCGGAAC TGCCGCCCGA ACGGCAGGCA

451 GAACTGGCAA AACTGCAAAC CGAAGGCGCG CAACTTTCCG CCAAATTCTC

501 CCAAAACGTC CTAGACGCGA CCGACGCGTT CGGCATTTAC TTTGACGATG

551 CCGCACCGCT TGCCGGCATT CCCGAAGACG CGCTCGCCAT GTTTGCCGCC

601 GCCGCGCAAA GCGAAGGCAA AACAGGTTAC AAAATCGGCT TGCAGATTCC

651 GCACTACCTT GCCGTTATCC AATACGCCGG CAACCGCGAA CTGCGCGAAC

701 AAATCTACCG CGCCTACGTT ACCCGTGCCA GCGAACTTTC AAACGACGGC

751 AAATTCGACA ACACCGCCAA CATCGACCGC ACGCTCGAAA ACGCATTGAA

801 AACCGCcaaa cTGCTCGGCT TTAAAAATTA CGCCGAATTG TCGCTGGCAA

851 CCAAAATGGC GGACACGCCC GAACAGGTTT TAAACTTCCT GCACGACCTC
```

```
-continued
 901 GCCCGCCGCG CCAAACCCTA CGCCGAAAAA GACCTCGCCG AAGTCAAAGC

951 CTTCGCCCGC GAACACCTCG GTCTCGCCGA CCCGCAGCCG TGGGACTTGA

1001 GCTACGCCGG CGAAAAACTG CGCGAAGCCA AATACGCATT CAGCGAAACC

1051 GAAGTCAAAA AATACTTCCC CGTCGGCAAA GTTCTGGCAG GCCTGTTCGC

1101 CCAAATCAAA AAACTCTACG GCATCGGATT CGCCGAAAAA ACCGTTCCCG

1151 TCTGGCACAA AGACGTGCGC TATTTTGAAT TGCAACAAAA CGGCAAAACC

1201 ATCGGCGGCG TTTATATGGA TTTGTACGCA CGCGAAGGCA AACGCGGCGG

1251 CGCGTGGATG AACGACtaca AAGGCCGCCG CCGCTTTGCC GACGgcacGC

1301 TGCAACTGCC CACCGCCTAC CTCGTCTGCA ACTTCGCCCC GCCCGTCGGC

1351 GGCAAGAAG CGCGTTTAAG CCACGACGAA ATCCTCACCC TCTTCCACGA

1401 AacCGGCCAC GGACTGCACC ACCTGCTTAC CCAAGTGGAC GAACTGGGCG

1451 TGTCCGGCAT CAAcggcgtA GAATGGGACG CGGTCGAACT GCCCAGCCAG

1501 TTTATGGAAA ACTTCGTTTG GGAATACAAT GTATTGGCAC AAATGTCCGC

1551 CCACGAAGAA AccgGCGAGC CCCTGCCGAA AGAACTCTTC GACAAAATGC

1601 TcgcCGCCAA AAACTTCCAG CGCGGTATGT TCCTCGTCCG GCAAATGGAG

1651 TTCGCCCTCT TCGATATGAT GATTTACAGT GAAAGCGACG AATGCCGTCT

1701 GAAAAACTGG CAGCAGGTTT TAGACAGCGT GCGCAAAGAA GTcGCCGTCA

1751 TCCAACCGCC CGAATACAAC CGCTTCGCCA ACAGCTTCGG CCacatctTC

1801 GCcggcGGCT ATTCCGCAGG CTATTACAGC TACGCATGGG CCGAAGTCCt 1851 cAGCACCGAT GCCTACGCCG CCTTTGAAGA AAGcGACGac gtcGCCGCCA 1901 CAGGCAAACG CTTCTGGCAA GAAAtccttg ccgtcggcgg ctCCCGCAGC 1951 gcgGCGGAAT CCTTCAAAGC CTTCCGCGGA CGCGAACCGA GCATAGACGC 2001 ACTGCTGCGC CAaagcggtT TCGACAACGC gGCttgA
```

This corresponds to the amino acid sequence <SEQ ID 482; ORF 128.ng>:

```
g128.pep
   1 MIDNALLHLG EEPRFNQIQT EDIKPAVQTA IAEARGQIAA VKAQTHTGWA

51 NTVERLTGIT ERVGRIWGVV SHLNSVVDTP ELRAVYNELM PEITVFFTEI

101 GQDIELYNRF KTIKNSPEFA TLSPAQKTKL DHDLRDFVLS GAELPPERQA

151 ELAKLQTEGA QLSAKFSQNV LDATDAFGIY FDDAAPLAGI PEDALAMFAA

201 AAQSEGKTGY KIGLQIPHYL AVIQYAGNRE LREQIYRAYV TRASELSNDG

251 KFDNTANIDR TLENALKTAK LLGFKNYAEL SLATKMADTP EQVLNFLHDL

301 ARRAKPYAEK DLAEVKAFAR EHLGLADPQP WDLSYAGEKL REAKYAFSET

351 EVKKYFPVGK VLAGLFAQIK KLYGIGFAEK TVPVWHKDVR YFELQQNGKT

401 IGGVYMDLYA REGKRGGAWM NDYKGRRRFA DGTLQLPTAY LVCNFAPPVG

451 GKEARLSHDE ILTLFHETGH GLHHLLTQVD ELGVSGINGV EWDAVELPSQ

501 FMENFVWEYN VLAQMSAHEE TGEPLPKELF DKMLAAKNFQ RGMFLVRQME

551 FALFDMMIYS ESDECRLKNW QQVLDSVRKE VAVIQPPEYN RFANSFGHIF

601 AGGYSAGYYS YAWAEVLSTD AYAAFEESDD VAATGKRFWQ EILAVGGSRS

651 AAESFKAFRG REPSIDALLR QSGFDNAA*
```

The following partial DNA sequence was identified in *N. meningitidis* <SEQ ID 483>:

```
m128.seq (partial)
    1 ATGACTGACA ACGCACTGCT CCATTTGGGC GAAGAACCCC GTTTTGATCA

51 AATCAAAACC GAAGACATCA AACCCGCCCT GCAAACCGCC ATCGCCGAAG

101 CGCGCGAACA AATCGCCGCC ATCAAAGCCC AAACGCACAC CGGCTGGGCA

151 AACACTGTCG AACCCCTGAC CGGCATCACC GAACGCGTCG GCAGGATTTG

201 GGGCGTGGTG TCGCACCTCA ACTGCGTCGC CGACACGCCC GAACTGCGCG

251 CCGTCTATAA CGAACTGATG CCCGAAATCA CCGTCTTCTT CACCGAAATC

301 GGACAAGACA TCGAGCTGTA CAACCGCTTC AAAACCATCA AAAATTCCCC

351 CGAATTCGAC ACCCTCTCCC CCGCACAAAA AACCAAACTC AACCAC

1 TACGCCAGCG AAAAACTGCG CGAAGCCAAA TACGCGTTCA GCGAAACCGA 51 wGTCAAAAAA TAyTTCCCyG TCGGCAAwGT ATTAAACGGA CTGTTCGCCC

101 AAmTCAAAAA ACTmTACGGC ATCGGATTTA CCGAAAAAAC yGTCCCCGTC

151 TGGCACAAAG ACGTGCGCTA TTkTGAATTG CAACAAAACG GCGAAmCCAT

201 AGGCGGCGTT TATATGGATT TGTACGCACG CGAAGGCAAA CGCGGCGGCG

251 CGTGGATGAA CGACTACAAA GGCCGCCGCC GTTTTTCAGA CGGCACGCTG

301 CAAyTGCCCA CCGCCTACCT CGTCTGCAAC TTCGCCCCAC CCGTCGGCGG

351 CAGGGAAGCC CGCyTGAGCC ACGACGAAAT CCTCATCCTC TTCCACGAAA

401 CCGGACACGG GCTGCACCAC CTGCTTACCC AAGTGGACGA ACTGGGCGTA

451 TCCGGCATCA ACGGCGTAkA ATGGGACGCG GTCGAACTGC CCAGCCAGTT

501 TATGGAAAAT TTCGTTTGGG AATACAATGT CTTGGCACAA mTGTCAGCCC

551 ACGAAGAAAC CGGcgTTCCC yTGCCGAAAG AACTCTTsGA CAAAwTGCTC

601 GCCGCCAAAA ACTTCCAAsG CGGCATGTTC yTsGTCCGGC AAwTGGAGTT

651 CGCCCTCTTT GATATGATGA TTTACAGCGA AGACGACGAA GGCCGTCTGA

701 AAAACTGGCA ACAGGTTTTA GACAGCGTGC GCAAAAAAGT CGCCGTCATC

751 CAGCCGCCCG AATACAACCG CTTCGCCTTG AGCTTCGGCC ACATCTTCGC

801 AGGCGGCTAT TCCGCAGCTn ATTACAGCTA CGCGTGGGCG GAAGTATTGA

851 GCGCGGACGC ATACGCCGCC TTTGAAGAAA GCGACGATGT CGCCGCCACA

901 GGCAAACGCT TTTGGCAGGA AATCCTCGCC GTCGGGGnAT CGCGCAGCGG 951 nGCAGAATCC TTCAAAGCCT TCCGCGGCCG CGAACCGAGC ATAGACGCAC

1001 TCTTGCGCCA CAGCGGTTTC GACAACGCGG TCTGA
```

This corresponds to the amino acid sequence <SEQ ID 484; ORF 128>.

```
m128.pep (partial)
    1 MTDNALLHLG EEPRFDQIKT EDIKPALQTA IAEAREQIAA IKAQTHTGWA

51 NTVEPLTGIT ERVGRIWGVV SHLNCVADTP ELRAVYNELM PEITVFFTEI

101 GQDIELYNRF KTIKNSPEFD TLSPAQKTKL NH
//

1 YASEKLREAK YAFSETXVKK YFPVGXVLNG LFAQXKKLYG IGFTEKTVPV

51 WHKDVRYXEL QQNGEXIGGV YMDLYAREGK RGGAWMNDYK GRRRFSDGTL
```

-continued

```
101 QLPTAYLVCN FAPPVGGREA RLSHDEILIL FHETGHGLHH LLTQVDELGV

151 SGINGVXWDA VELPSQFMEN FVWEYNVLAQ XSAHEETGVP LPKELXDKXL

201 AAKNFQXGMF XVRQXEFALF DMMIYSEDDE GRLKNWQQVL DSVRKKVAVI

251 QPPEYNRFAL SFGHIFAGGY SAAXYSYAWA EVLSADAYAA FEESDDVAAT

301 GKRFWQEILA VGXSRSGAES FKAFRGREPS IDALLRHSGF DNAV*
```

Computer analysis of this amino acid sequence gave the following results:

Homology with a Predicted ORF from *N. gonorrhoeae*

ORF 128 shows 91.7% identity over a 475 aa overlap with a predicted ORF (ORF 128.ng) from *N. gonorrhoeae*:

```
m128/g128
                10        20        30        40        50        60
g128.pep   MIDNALLHLGEEPRFNQIQTEDIKPAVQTAIAEARGQIAAVKAQTHTGWANTVERLTGIT
           | ||||||||||||:|||||||:|||||||| ||||:|||||||||||||| |||||
m128       MTDNALLHLGEEPRFDQIKTEDIKPALQTAIAEAREQIAAIKAQTHTGWANTVEPLTGIT
                10        20        30        40        50        60

70        80        90       100       110       120
g128.pep   ERVGRIWGVVSHLNSVVDTPELRAVYNELMPEITVFFTEIGQDIELYNRFKTIKNSPEFA
           |||||||||||||||:|:||||||||||||||||||||||||||||||||||||||||
m128       ERVGRIWGVVSHLNCVADTPELRAVYNELMPEITVFFTEIGQDIELYNRFKTIKNSPEFD
                70        80        90       100       110       120

130       140       150       160       170       180
g128.pep   TLSPAQKTKLDHDLRDFVLSGAELPPERQAELAKLQTEGAQLSAKFSQNVLDATDAFGIY
           ||||||||||:|
m128       TLSPAQKTKLNH
               130
                //

340       350       360
g128.pep                                    YAGEKLREAKYAFSETEVKKYFPVGKVLAG
                                             ||:||||||||||| ||||||||| || |
    m128                                    YASEKLREAKYAFSETXVKKYFPVGXVLNG
                                                10        20        30

370       380       390       400       410       420
g128.pep   LFAQIKKLYGIGFAEKTVPVWHKDVRYFELQQNGKTIGGVYMDLYAREGKRGGAWMNDYK
           ||||  ||||||||| ||||||||||||:|||||||  ||||||||||||||||||||||||
m128       LFAQXKKLYGIGFTEKTVPVWHKDVRYXELQQNGEXIGGVYMDLYAREGKRGGAWMNDYK
                40        50        60        70        80        90

430       440       450       460       470       480
g128.pep   GRRRFADGTLQLPTAYLVCNFAPPVGGKEARLSHDEILTLFHETGHGLHHLLTQVDELGV
           |||||:|||||||||||||||||||||||:|||||||||||||||||||||||||||||
m128       GRRRFSDGTLQLPTAYLVCNFAPPVGGREARLSHDEILILFHETGHGLHHLLTQVDELGV
               100       110       120       130       140       150

490       500       510       520       530       540
g128.pep   SGINGVEWDAVELPSQFMENFVWEYNVLAQMSAHEETGEPLPKELFDKMLAAKNFQRGMF
           ||||||  |||||||||||||||||||||||| |||||||| ||||||| |||||||  |||
m128       SGINGVXWDAVELPSQFMENFVWEYNVLAQXSAHEETGVPLPKELXDKXLAAKNFQXGMF
               160       170       180       190       200       210

550       560       570       580       590       600
g128.pep   LVRQMEFALFDMMIYSESDECRLKNWQQVLDSVRKEVAVIQPPEYNRFANSFGHIFAGGY
           ||| |||||||||||||||::||||||||||||||||:||||||||||||||: |||||||||
m128       XVRQXEFALFDMMIYSEDDEGRLKNWQQVLDSVRKKVAVIQPPEYNRFALSFGHIFAGGY
               220       230       240       250       260       270

610       620       630       640       650       660
g128.pep   SAGYYSYAWAEVLSTDAYAAFEESDDVAATGKRFWQEILAVGGSRSAAESFKAFRGREPS
           ||:|||||||||||:||||||||||||||||||||||||||| |||:||||||||||||||
m128       SAAXYSYAWAEVLSADAYAAFEESDDVAATGKRFWQEILAVGXSRSGAESFKAFRGREPS
               280       290       300       310       320       330

670       679
g128.pep   IDALLRQSGFDNAAX
           ||||||:|||||:
m128       IDALLRHSGFDNAVX
               340
```

The following partial DNA sequence was identified in *N. meningitidis* <SEQ ID 485>:

```
a128.seq
   1 ATGACTGACA ACGCACTGCT CCATTTGGGC GAAGAACCCC GTTTTGATCA
  51 AATCAAAACC GAAGACATCA AACCCGCCCT GCAAACCGCC ATTGCCGAAG
 101 CGCGCGAACA AATCGCCGCC ATCAAAGCCC AAACGCACAC CGGCTGGGCA
 151 AACACTGTCG AACCCCTGAC CGGCATCACC GAACGCGTCG GCAGGATTTG
 201 GGGCGTGGTG TCGCACCTCA ACTCCGTCAC CGACACGCCC GAACTGCGCG
 251 CCGCCTACAA TGAATTAATG CCCGAAATTA CCGTCTTCTT CACCGAAATC
 301 GGACAAGACA TCGAGCTGTA CAACCGCTTC AAAACCATCA AAAACTCCCC
 351 CGAGTTCGAC ACCCTCTCCC ACGCGCAAAA AACCAAACTC AACCACGATC
 401 TGCGCGATTT CGTCCTCAGC GGCGCGGAAC TGCCGCCCGA ACAGCAGGCA
 451 GAATTGGCAA AACTGCAAAC CGAAGGCGCG CAACTTTCCG CCAAATTCTC
 501 CCAAAACGTC CTAGACGCGA CCGACGCGTT CGGCATTTAC TTTGACGATG
 551 CCGCACCGCT TGCCGGCATT CCCGAAGACG CGCTCGCCAT GTTTGCCGCT
 601 GCCGCGCAAA GCGAAGGCAA AACAGGCTAC AAAATCGGTT TGCAGATTCC
 651 GCACTACCTC GCCGTCATCC AATACGCCGA CAACCGCAAA CTGCGCGAAC
 701 AAATCTACCG CGCCTACGTT ACCCGCGCCA GCGAGCTTTC AGACGACGGC
 751 AAATTCGACA ACACCGCCAA CATCGACCGC ACGCTCGAAA ACGCCCTGCA
 801 AACCGCCAAA CTGCTCGGCT TCAAAAACTA CGCCGAATTG TCGCTGGCAA
 851 CCAAAATGGC GGACACCCCC GAACAAGTTT TAAACTTCCT GCACGACCTC
 901 GCCCGCCGCG CCAAACCCTA CGCCGAAAAA GACCTCGCCG AAGTCAAAGC
 951 CTTCGCCCGC GAAAGCCTCG GCCTCGCCGA TTTGCAACCG TGGGACTTGG
1001 GCTACGCCGG CGAAAAACTG CGCGAAGCCA AATACGCATT CAGCGAAACC
1051 GAAGTCAAAA AATACTTCCC CGTCGGCAAA GTATTAAACG GACTGTTCGC
1101 CCAAATCAAA AAACTCTACG GCATCGGATT TACCGAAAAA ACCGTCCCCG
1151 TCTGGCACAA AGACGTGCGC TATTTTGAAT TGCAACAAAA CGGCGAAACC
1201 ATAGGCGGCG TTTATATGGA TTTGTACGCA CGCGAAGGCA AACGCGGCGG
1251 CGCGTGGATG AACGACTACA AAGGCCGCCG CCGTTTTTCA GACGGCACGC
1301 TGCAACTGCC CACCGCCTAC CTCGTCTGCA ACTTCACCCC GCCCGTCGGC
1351 GGCAAAGAAG CCCGCTTGAG CCATGACGAA ATCCTCACCC TCTTCCACGA
1401 AACCGGACAC GGCCTGCACC ACCTGCTTAC CCAAGTCGAC GAACTGGGCG
1451 TATCCGGCAT CAACGGCGTA GAATGGGACG CAGTCGAACT GCCCAGTCAG
1501 TTTATGGAAA ATTTCGTTTG GGAATACAAT GTCTTGGCGC AAATGTCCGC
1551 CCACGAAGAA ACCGGCGTTC CCATGACGAA AGAACTCTTC GACAAAATGC
1601 TCGCCGCCAA AAACTTCCAA CGCGGAATGT TCCTCGTCCG CCAAATGGAG
1651 TTCGCCCTCT TTGATATGAT GATTTACAGC GAAGACGACG AAGGCCGTCT
1701 GAAAAACTGG CAACAGGTTT TAGACAGCGT GCGCAAAGAA GTCGCCGTCG
1751 TCCGACCGCC CGAATACAAC CGCTTCGCCA ACAGCTTCGG CCACATCTTC
1801 GCAGGCGGCT ATTCCGCAGG CTATTACAGC TACGCGTGGG CGGAAGTATT
1851 GAGCGCGGAC GCATACGCCG CCTTTGAAGA AAGCGACGAT GTCGCCGCCA
1901 CAGGCAAACG CTTTTGGCAG GAAATCCTCG CCGTCGGCGG ATCGCGCAGC
```

-continued

```
1951 GCGGCAGAAT CCTTCAAAGC CTTCCGCGGA CGCGAACCGA GCATAGACGC

2001 ACTCTTGCGC CACAGCGGCT TCGACAACGC GGCTTGA
```

This corresponds to the amino acid sequence <SEQ ID 486; ORF 128.a>:

```
a128.pep
   1 MTDNALLHLG EEPRFDQIKT EDIKPALQTA IAEAREQIAA IKAQTHTGWA

51 NTVEPLTGIT ERVGRIWGVV SHLNSVTDTP ELRAAYNELM PEITVFFTEI

101 GQDIELYNRF KTIKNSPEFD TLSHAQKTKL NHDLRDFVLS GAELPPEQQA

151 ELAKLQTEGA QLSAKFSQNV LDATDAFGIY FDDAAPLAGI PEDALAMFAA

201 AAQSEGKTGY KIGLQIPHYL AVIQYADNRK LREQIYRAYV TRASELSDDG

251 KFDNTANIDR TLENALQTAK LLGFKNYAEL SLATKMADTP EQVLNFLHDL

301 ARRAKPYAEK DLAEVKAFAR ESLGLADLQP WDLGYAGEKL REAKYAFSET

351 EVKKYFPVGK VLNGLFAQIK KLYGIGFTEK TVPVWHKDVR YFELQQNGET

401 IGGVYMDLYA REGKRGGAWM NDYKGRRRFS DGTLQLPTAY LVCNFTPPVG

451 GKEARLSHDE ILTLFHETGH GLHHLLTQVD ELGVSGINGV EWDAVELPSQ

501 FMENFVWEYN VLAQMSAHEE TGVPLPKELF DKMLAAKNFQ RGMFLVRQME

551 FALFDMMIYS EDDEGRLKNW QQVLDSVRKE VAVVRPPEYN RFANSFGHIF

601 AGGYSAGYYS YAWAEVLSAD AYAAFEESDD VAATGKRFWQ EILAVGGSRS

651 AAESFKAFRG REPSIDALLR HSGFDNAA*
``` m128/a128 66.0% identity in 677 aa overlap

```
                  10         20         30         40         50         60
  m128.pep  MTDNALLHLGEEPRFDQIKTEDIKPALQTAIAEAREQIAAIKAQTHTGWANTVEPLTGIT
            ||||||||||||||||||||||||||||||||||||||||||||||||||||||||||||
  a128      MTDNALLHLGEEPRFDQIKTEDIKPALQTAIAEAREQIAAIKAQTHTGWANTVEPLTGIT
                  10         20         30         40         50         60

70         80         90        100        100        120
  m128.pep  ERVGRIWGVVSHLNCVADTPELRAVYNELMPEITVFFTEIGQDIELYNRFKTINKSPEFD
            ||||||||||||||| :|||||| :|||||||||||||||||||||||||||| |||||
  a128      ERVGRIWGVVSHLNSVTDTPELRAAYNELMPEITVFFTEIGQDIELYNRFKTIKNSPEFD
                  70         80         90        100        110        120

130
  m128.pep  TLSPAQKTKLNH------------------------------------------------
            ||| ||||||||
  a128      TLSHAQKTKLNHDLRDFVLSGAELPPEQQAELAKLQTEGAQLSAKFSQNVLDATDAFGIY
                 130        140        150        160        170        180 m128.pep  ------------------------------------------------------------
  a128      FDDAAPLAGIPEDALAMFAAAQSEGKTGYKIGLQIPHYLAVIQYADNRKLREQIYRAYV
                 190        200        210        220        230        240 m128.pep  ------------------------------------------------------------
  a128      TRASELSDDGKFDNTANIDRTLENALQTAKLLGFKNYAELSLATKMADTPEQVLNFLHDL
                 250        260        270        280        290        300

140        150
  m128.pep  --------------------------------YASEKLREAKYAFSETXVKKYFPVGX
                                            ||:||||||||||||| ||||||||
  a128      ARRAKPYAEKDLAEVKAFARESLGLADLQPWDLGYAGEKLREAKYAFSETEVKKYFPVGK
                 310        320        330        340        350        360

160        170        180        190        200        210
  m128.pep  VLNGLFAQXKKLYGIGFTEKTVPVWHKDVRYXELQQNGEXIGGVYMDLYAREGKRGGAWM
            ||||||||| ||||||||||||||||||||| |||||||  ||||||||||| ||||||
  a128      VLNGLFAQIKKLYGIGFTEKTVPVWHKDVRYFELQQNGETIGGVYMDLYAREGYRGGAWM
                 370        380        390        400        410        420
```

-continued

```
                220        230        240        250        260        270
m128.pep   NDYKGRRRFSDGTLQLPTAYLVCNFAPPVGGREARLSHDEILILFHETGHGLHHLLTQVD
           ||||||||||||||||||||||||||||:|||||:||||||||||:||||||||||||||
a128       NDYKGRRRFSDGTLQLPTAYLVCNFTPPVGGKEARLSHDEILTLFHETGHGLHHLLTQVD
                430        440        450        460        470        480

280        230        240        250        260        270
m128.pep   ELGVSGINGVXWDAVELPSQFMENFVWEYNVLAQXSAHEETGVPLPKELXDKXLAAKNFQ
           ||||||||||| ||||||||||||||||||||||| |||||||||||||| || |||||||
a128       ELGVSGINGVEWDAVELPSQFMENFVWEYNVLAQMSAHEETGVPLPKELFDKMLAAKNFQ
                490        500        510        520        530        540

340        350        360        370        380        390
m128.pep   XGMFXVRQXEFALFDMMIYSEDDEGRLKNWQQVLDSVRKKVAVIQPPEYNRFALSFGHIF
           ||| ||| |||||||||||||||||||||||||||||||:|||::||||||||| ||||||
a128       RGMFLVRQMEFALFDMMIYSEDDEGRLKNWQQVLDSVRKEVAVVRPPEYNRFANSFGHIF
                550        560        570        580        590        600

400        410        420        430        440        450
m128.pep   AGGYSAAXYSYAWAEVLSADAYAAFEESDDVAATGKRFWQEILAVGXSRSGAESFKAFRG
           |||||:||||||||||||||||||||||||||||||||||||||| |||:|||||||||
a128       AGGYSAGYYSYAWAEVLSADAYAAFEESDDVAATGKRFWQEILAVGGSRSAAESFKAFRG
                610        620        630        640        650        660

460        470
m128.pep   REPSIDALLRHSGFDNAVX
           ||||||||||||||||||:|
a128       REPSIDALLRHSGFDNAAX
                670
```

The following partial DNA sequence was identified in *N. gonorrhoeae* <SEQ ID 487>:

```
g128-1.seq (partial)
   1 ATGATTGACA ACGCACTGCT CCACTTGGGC GAAGAACCCC GTTTTAATCA
  51 AATCAAAACC GAAGACATCA AACCCGCCGT CCAAACCGCC ATCGCCGAAG
 101 CGCGCGGACA AATCGCCGCC GTCAAAGCGC AAACGCACAC CGGCTGGGCG
 151 AACACCGTCG AGCGTCTGAC CGGCATCACC GAACGCGTCG GCAGGATTTG
 201 GGGCGTCGTG TCCCATCTCA ACTCCGTCGT CGACACGCCC GAACTGCGCG
 251 CCGTCTATAA CGAACTGATG CCTGAAATCA CCGTCTTCTT CACCGAAATC
 301 GGACAAGACA TCGAACTGTA CAACCGCTTC AAAACCATCA AAAATTCCCC
 351 CGAATTTGCA ACGCTTTCCC CCGCACAAAA AACCAAGCTC GATCACGACC
 401 TGCGCGATTT CGTATTGAGC GGCGCGGAAC TGCCGCCCGA ACGGCAGGCA
 451 GAACTGGCAA AACTGCAAAC CGAAGGCGCG CAACTTTCCG CCAAATTCTC
 501 CCAAAACGTC CTAGACGCGA CCGACGCGTT CGGCATTTAC TTTGACGATG
 551 CCGCACCGCT TGCCGGCATT CCCGAAGACG CGCTCGCCAT GTTTGCCGCC
 601 GCCGCGCAAA GCGAAGGCAA AACAGGTTAC AAAATCGGCT TGCAGATTCC
 651 GCACTACCTT GCCGTTATCC AATACGCCGG CAACCGCGAA CTGCGCGAAC
 701 AAATCTACCG CGCCTACGTT ACCCGTGCCA GCGAACTTTC AAACGACGGC
 751 AAATTCGACA ACACCGCCAA CATCGACCGC ACGCTCGAAA ACGCATTGAA
 801 AACCGCCAAA CTGCTCGGCT TTAAAAATTA CGCCGAATTG TCGCTGGCAA
 851 CCAAAATGGC GGACACGCCC GAACAGGTTT TAAACTTCCT GCACGACCTC
 901 GCCCGCCGCG CCAAACCCTA CGCCGAAAAA GACCTCGCCG AAGTCAAAGC
 951 CTTCGCCCGC GAACACCTCG GTCTCGCCGA CCCGCAGCCG TGGGACTTGA
1001 GCTACGCCGG CGAAAAACTG CGCGAAGCCA ATACGCATT CAGCGAAACC
1051 GAAGTCAAAA ATACTTCCC CGTCGGCAAA GTTCTGGCAG GCCTGTTCGC
1101 CCAAATCAAA AAACTCTACG GCATCGGATT CGCCGAAAAA ACCGTTCCCG
1151 TCTGGCACAA AGACGTGCGC TATTTTGAAT TGCAACAAAA CGGCAAAACC
```

-continued

```
1201 ATCGGCGGCG TTTATATGGA TTTGTACGCA CGCGAAGGCA AACGCGGCGG

1251 CGCGTGGATG AACGACTACA AAGGCCGCCG CCGCTTTGCC GACGGCACGC

1301 TGCAACTGCC CACCGCCTAC CTCGTCTGCA ACTTCGCCCC GCCCGTCGGC

1351 GGCAAAGAAG CGCGTTTAAG CCACGACGAA ATCCTCACCC TCTTCCACGA

1401 AACCGGCCAC GGACTGCACC ACCTGCTTAC CCAAGTGGAC GAACTGGGCG

1451 TGTCCGGCAT CAACGGCGTA AAA
```

This corresponds to the amino acid sequence <SEQ ID 488; ORF 128-1.ng>:

```
g128-1.pep.(partial)
   1 MIDNALLHLG EEPRFNQIKT EDIKPAVQTA IAEARGQIAA VKAQTHTGWA

51 NTVERLTGIT ERVGRIWGVV SHLNSVVDTP ELRAVYNELM PEITVFFTEI

101 GQDIELYNRF KTIKNSPEFA TLSPAQKTKL DHDLRDFVLS GAELPPERQA

151 ELAKLQTEGA QLSAKFSQNV LDATDAFGIY FDDAAPLAGI PEDALAMFAA

201 AAQSEGKTGY KIGLQIPHYL AVIQYAGNRE LREQIYRAYV TRASELSNDG

251 KFDNTANIDR TLENALKTAK LLGFKNYAEL SLATKMADTP EQVLNFLHDL

301 ARRAKPYAEK DLAEVKAFAR EHLGLADPQP WDLSYAGEKL REAKYAFSET

351 EVKKYFPVGK VLAGLFAQIK KLYGIGFAEK TVPVWHKDVR YFELQQNGKT

401 IGGVYMDLYA REGKRGGAWM NDYKGRRRFA DGTLQLPTAY LVCNFAPPVG

451 GKEARLSHDE ILTLFHETGH GLHHLLTQVD ELGVSGINGV K
```

The following partial DNA sequence was identified in *N. meningitidis* <SEQ ID 489>:

```
m128-1.seq
   1 ATGACTGACA ACGCACTGCT CCATTTGGGC GAAGAACCCC GTTTTGATCA

51 AATCAAAACC GAAGACATCA AACCCGCCCT GCAAACCGCC ATCGCCGAAG

101 CGCGCGAACA AATCGCCGCC ATCAAAGCCC AAACGCACAC CGGCTGGGCA

151 AACACTGTCG AACCCCTGAC CGGCATCACC GAACGCGTCG GCAGGATTTG

201 GGGCGTGGTG TCGCACCTCA ACTCCGTCGC CGACACGCCC GAACTGCGCG

251 CCGTCTATAA CGAACTGATG CCCGAAATCA CCGTCTTCTT CACCGAAATC

301 GGACAAGACA TCGAGCTGTA CAACCGCTTC AAAACCATCA AAAATTCCCC

351 CGAATTCGAC ACCCTCTCCC CCGCACAAAA AACCAAACTC AACCACGATC

401 TGCGCGATTT CGTCCTCAGC GGCGCGGAAC TGCCGCCCGA ACAGCAGGCA

451 GAACTGGCAA AACTGCAAAC CGAAGGCGCG CAACTTTCCG CCAAATTCTC

501 CCAAAACGTC CTAGACGCGA CCGACGCGTT CGGCATTTAC TTTGACGATG

551 CCGCACCGCT TGCCGGCATT CCCGAAGACG CGCTCGCCAT GTTTGCCGCC

601 GCCGCGCAAA GCGAAAGCAA AACAGGCTAC AAAATCGGCT TGCAGATTCC

651 ACACTACCTC GCCGTCATCC AATACGCCGA CAACCGCGAA CTGCGCGAAC

701 AAATCTACCG CGCCTACGTT ACCCGCGCCA GCGAACTTTC AGACGACGGC

751 AAATTCGACA ACACCGCCAA CATCGACCGC ACGCTCGCAA ACGCCCTGCA

801 AACCGCCAAA CTGCTCGGCT TCAAAAACTA CGCCGAATTG TCGCTGGCAA

851 CCAAAATGGC GGACACGCCC GAACAAGTTT TAAACTTCCT GCACGACCTC
```

```
 901 GCCCGCCGCG CCAAACCCTA CGCCGAAAAA GACCTCGCCG AAGTCAAAGC

951 CTTCGCCCGC GAAAGCCTGA ACCTCGCCGA TTTGCAACCG TGGGACTTGG

1001 GCTACGCCAG CGAAAAACTG CGCGAAGCCA AATACGCGTT CAGCGAAACC

1051 GAAGTCAAAA AATACTTCCC CGTCGGCAAA GTATTAAACG GACTGTTCGC

1101 CCAAATCAAA AAACTCTACG GCATCGGATT TACCGAAAAA ACCGTCCCCG

1151 TCTGGCACAA AGACGTGCGC TATTTTGAAT TGCAACAAAA CGGCGAAACC

1201 ATAGGCGGCG TTTATATGGA TTTGTACGCA CGCGAAGGCA AACGCGGCGG

1251 CGCGTGGATG AACGACTACA AAGGCCGCCG CCGTTTTTCA GACGGCACGC

1301 TGCAACTGCC CACCGCCTAC CTCGTCTGCA ACTTCGCCCC ACCCGTCGGC

1351 GGCAGGGAAG CCCGCCTGAG CCACGACGAA ATCCTCATCC TCTTCCACGA

1401 AACCGGACAC GGGCTGCACC ACCTGCTTAC CCAAGTGGAC GAACTGGGCG

1451 TATCCGGCAT CAACGGCGTA GAATGGGACG CGGTCGAACT GCCCAGCCAG

1501 TTTATGGAAA ATTTCGTTTG GGAATACAAT GTCTTGGCAC AAATGTCAGC

1551 CCACGAAGAA ACCGGCGTTC CCCTGCCGAA AGAACTCTTC GACAAAATGC

1601 TCGCCGCCAA AAACTTCCAA CGCGGCATGT TCCTCGTCCG GCAAATGGAG

1651 TTCGCCCTCT TTGATATGAT GATTTACAGC GAAGACGACG AAGGCCGTCT

1701 GAAAAACTGG CAACAGGTTT TAGACAGCGT GCGCAAAAAA GTCGCCGTCA

1751 TCCAGCCGCC CGAATACAAC CGCTTCGCCT TGAGCTTCGG CCACATCTTC

1801 GCAGGCGGCT ATTCCGCAGG CTATTACAGC TACGCGTGGG CGGAAGTATT

1851 GAGCGCGGAC GCATACGCCG CCTTTGAAGA AAGCGACGAT GTCGCCGCCA

1901 CAGGCAAACG CTTTTGGCAG GAAATCCTCG CCGTCGGCGG ATCGCGCAGC

1951 GCGGCAGAAT CCTTCAAAGC CTTCCGCGGC CGCGAACCGA GCATAGACGC

2001 ACTCTTGCGC CACAGCGGTT TCGACAACGC GGTCTGA
```

This corresponds to the amino acid sequence <SEQ ID 490; ORF 128-1>:

```
m128-1.pep.

1 MTDNALLHLG EEPRFDQIKT EDIKPALQTA IAEAREQIAA IKAQTHTGWA
  51 NTVEPLTGIT ERVGRIWGVV SHLNSVADTP ELRAVYNELM PEITVFFTEI
 101 GQDIELYNRF KTIKNSPEFD TLSPAQKTKL NHDLRDFVLS GAELPPEQQA
 151 ELAKLQTEGA QLSAKFSQNV LDATDAFGIY FDDAAPLAGI PEDALAMFAA
 201 AAQSESKTGY KIGLQIPHYL AVIQYADNRE LREQIYRAYV TRASELSDDG
 251 KFDNTANIDR TLANALQTAK LLGFKNYAEL SLATKMADTP EQVLNFLHDL
 301 ARRAKPYAEK DLAEVKAFAR ESLNLADLQP WDLGYASEKL REAKYAFSET
 351 EVKKYFPVGH VLNGLFAQIK KLYGIGFTEK TVPVWHKDVR YFELQQNGET
 401 IGGVYMDLYA REGKRGGAWM NDYKGRRRFS DGTLQLPTAY LVCNFAPPVG
 451 GREARLSHDE ILILFHETGH GLHHLLTQVD ELGVSGINGV EWDAVELPSQ
 501 FMENFVWEYN VLAQMSAHEE TGVPLPKELF DKMLAAKNFQ RGMFLVRQME
 551 FALFDMMIYS EDDEGRLKNW QQVLDSVRKK VAVIQPPEYN RFALSFGHIF
 601 AGGYSAGYYS YAWAEVLSAD AYAAFEESDD VAATGKRFWQ EILAVGGSRS
 651 AAESFKAFRG REPSIDALLR HSGFDNAV*
```

```
m128-1/g128-1 94.5% identity in 491 aa overlap 10         20         30         40         50         60
g128-1.pep  MIDNALLHLGEEPRFNQIKTEDIKPAVQTAIAEARGQIAAVKAQTHTGWANTVERLTGIT
            |  ||||||||||||||:|||||||||:||||||  ||||:||||||||||||| ||||
m128-1      MTDNALLHLGEEPRFDQIKTEDIKPALQTAIAEAREQIAAIKAQTHTGWANTVEPLTGIT
                  10         20         30         40         50         60

70         80         90        100        110        120
g128-1.pep  ERVGRIWGVVSHLNSVVDTPELRAVYNELMPEITVFFTEIGQDIELYNRFKTIKNSPEFA
            |||||||||||||||:||||||||||||||||||||||||||||||||||||||||||
m128-1      ERVGRIWGVVSHLNSVADTPELRAVYNELMPEITVFFTEIGQDIELYNRFKTIKNSPEFD
                  70         80         90        100        110        120

130        140        150        160        170        180
g128-1.pep  TLSPAQKTKLDHDLRDFVLSGAELPPERQAELAKLQTEGAQLSAKFSQNVLDATDAFGIY
            ||||||||||:|||||||||||||||:|||||||||||||||||||||||||||||||
m128-1      TLSPAQKTKLNHDLRDFVLSGAELPPEQQAELAKLQTEGAQLSAKFSQNVLDATDAFGIY
                 130        140        150        160        170        180

190        200        210        220        230        240
g128-1.pep  FDDAAPLAGIPEDALAMFAAAAQSEGKTGYKIGLQIPHYLAVIQYAGNRELREQIYRAYV
            ||||||||||||||||||||||||:||||||||||||||||||||||:|||||||||||
m128-1      FDDAAPLAGIPEDALAMFAAAAQSESKTGYKIGLQIPHYLAVIQYADNRELREQIYRAYV
                 190        200        210        220        230        240

250        260        270        280        290        300
g128-1.pep  TRASELSNDGKFDNTANIDRTLENALKTAKLLGFKNYAELSLATKMADTPEQVLNFLHDL
            |||||||:|||||||||||||| |||:|||||||||||||||||||||||||||||||
m128-1      TRASELSDDGKFDNTANIDRTLANALQTAKLLGFKNYAELSLATKMADTPEQVLNFLHDL
                 250        260        270        280        290        300

310        320        330        340        350        360
g128-1.pep  ARRAKPYAEKDLAEVKAFAREHLGLADPQPWDLSYAGEKLREAKYAFSETEVKKYFPVGK
            |||||||||||||||||||||:|||  |||||:||||:|||||||||||||||||||||
m128-1      ARRAKPYAEKDLAEVKAFARESLNLADLQPWDLGYASEKLREAKYAFSETEVKKYFPVGK
                 310        320        330        340        350        360

370        380        390        400        410        420
g128-1.pep  VLAGLFAQIKKLYGIGFAEKTVPVWHKDVRYFELQQNGKTIGGVYMDLYAREGKRGGAWM
            || |||||||||||||||:|||||||||||||||||||:|||||||||||||||||||
m128-1      VLNGLFAQIKKLYGIGFTEKTVPVWHKDVRYFELQQNGETIGGVYMDLYAREGKRGGAWM
                 370        380        390        400        410        420

430        440        450        460        470        480
g128-1.pep  NDYKGRRRFADGTLQLPTAYLVCNFAPPVGGKEARLSHDEILTLFHETGHGLHHLLTQVD
            |||||||||:|||||||||||||||||||||:|||||||||:|||||||||||||||||
m128-1      NDYKGRRRFSDGTLQLPTAYLVCNFAPPVGGREARLSHDEILILFHETGHGLHHLLTQVD
                 430        440        450        460        470        480

490
g128-1.pep  ELGVSGINGVK
            ||||||||||:
m128-1      ELGVSGINGVEWDAVELPSQFMENFVWEYNVLAQMSAHEETGVPLPKELFDKMLAAKNFQ
                 490        500        510        520        530        540
```

The following partial DNA sequence was identified in *N. meningitidis* <SEQ ID 491>:

```
a128-1.seq
   1 ATGACTGACA ACGCACTGCT CCATTTGGGC GAAGAACCCC GTTTTGATCA

51 AATCAAAACC GAAGACATCA AACCCGCCCT GCAAACCGCC ATTGCCGAAG

101 CGCGCGAACA AATCGCCGCC ATCAAAGCCC AAACGCACAC CGGCTGGGCA

151 AACACTGTCG AACCCCTGAC CGGCATCACC GAACGCGTCG GCAGGATTTG

201 GGGCGTGGTG TCGCACCTCA ACTCCGTCAC CGACACGCCC GAACTGCGCG

251 CCGCCTACAA TGAATTAATG CCCGAAATTA CCGTCTTCTT CACCGAAATC

301 GGACAAGACA TCGAGCTGTA CAACCGCTTC AAACCATCA AAAACTCCCC

351 CGAGTTCGAC ACCCTCTCCC ACGCGCAAAA AACCAAACTC AACCACGATC
```

-continued

```
 401 TGCGCGATTT CGTCCTCAGC GGCGCGGAAC TGCCGCCCGA ACAGCAGGCA
 451 GAATTGGCAA AACTGCAAAC CGAAGGCGCG CAACTTTCCG CCAAATTCTC
 501 CCAAAACGTC CTAGACGCGA CCGACGCGTT CGGCATTTAC TTTGACGATG
 551 CCGCACCGCT TGCCGGCATT CCCGAAGACG CGCTCGCCAT GTTTGCCGCT
 601 GCCGCGCAAA GCGAAGGCAA AACAGGCTAC AAAATCGGTT TGCAGATTCC
 651 GCACTACCTC GCCGTCATCC AATACGCCGA CAACCGCAAA CTGCGCGAAC
 701 AAATCTACCG CGCCTACGTT ACCCGCGCCA GCGAGCTTTC AGACGACGGC
 751 AAATTCGACA ACACCGCCAA CATCGACCGC ACGCTCGAAA ACGCCCTGCA
 801 AACCGCCAAA CTGCTCGGCT TCAAAAACTA CGCCGAATTG TCGCTGGCAA
 851 CCAAAATGGC GGACACCCCC GAACAAGTTT AAACTTCCT GCACGACCTC
 901 GCCCGCCGCG CCAAACCCTA CGCCGAAAAA GACCTCGCCG AAGTCAAAGC
 951 CTTCGCCCGC GAAAGCCTCG GCCTCGCCGA TTTGCAACCG TGGGACTTGG
1001 GCTACGCCGG CGAAAAACTG CGCGAAGCCA AATACGCATT CAGCGAAACC
1051 GAAGTCAAAA AATACTTCCC CGTCGGCAAA GTATTAAACG GACTGTTCGC
1101 CCAAATCAAA AAACTCTACG GCATCGGATT TACCGAAAAA ACCGTCCCCG
1151 TCTGGCACAA AGACGTGCGC TATTTTGAAT GCAACAAAA CGGCGAAACC
1201 ATAGGCGGCG TTTATATGGA TTTGTACGCA CGCGAAGGCA AACGCGGCGG
1251 CGCGTGGATG AACGACTACA AAGGCCGCCG CCGTTTTTCA GACGGCACGC
1301 TGCAACTGCC CACCGCCTAC CTCGTCTGCA ACTTCACCCC GCCCGTCGGC
1351 GGCAAAGAAG CCCGCTTGAG CCATGACGAA ATCCTCACCC TCTTCCACGA
1401 AACCGGACAC GGCCTGCACC ACCTGCTTAC CCAAGTCGAC GAACTGGGCG
1451 TATCCGGCAT CAACGGCGTA GAATGGGACG CAGTCGAACT GCCCAGTCAG
1501 TTTATGGAAA ATTTCGTTTG GGAATACAAT GTCTTGGCGC AAATGTCCGC
1551 CCACGAAGAA ACCGGCGTTC CCCTGCCGAA AGAACTCTTC GACAAAATGC
1601 TCGCCGCCAA AAACTTCCAA CGCGGAATGT TCCTCGTCCG CCAAATGGAG
1651 TTCGCCCTCT TTGATATGAT GATTTACAGC GAAGACGACG AAGGCCGTCT
1701 GAAAAACTGG CAACAGGTTT TAGACAGCGT GCGCAAAGAA GTCGCCGTCG
1751 TCCGACCGCC CGAATACAAC CGCTTCGCCA ACAGCTTCGG CCACATCTTC
1801 GCAGGCGGCT ATTCCGCAGG CTATTACAGC TACGCGTGGG CGGAAGTATT
1851 GAGCGCGGAC GCATACGCCG CCTTTGAAGA AAGCGACGAT GTCGCCGCCA
1901 CAGGCAAACG CTTTTGGCAG GAAATCCTCG CCGTCGGCGG ATCGCGCAGC
1951 GCGGCAGAAT CCTTCAAAGC CTTCCGCGGA CGCGAACCGA GCATAGACGC
2001 ACTCTTGCGC CACAGCGGCT TCGACAACGC GGCTTGA
```

This corresponds to the amino acid sequence <SEQ ID 492; ORF 128-1.a>:

```
a128-1.pep.
    1 MTDNALLHLG EEPRFDQIKT EDIKPALQTA IAEAREQIAA IKAQTHTGWA
   51 NTVEPLTGIT ERVGRIWGVV SHLNSVADTP ELRAVYNELM PEITVFFTEI
  101 GQDIELYNRF KTIKNSPEFD TLSPAQKTKL NHDLRDFVLS GAELPPEQQA
  151 ELAKLQTEGA QLSAKFSQNV LDATDAFGIY FDDAAPLAGI PEDALAMFAA
```

-continued

```
201 AAQSESKTGY KIGLQIPHYL AVIQYADNRE LREQIYRAYV TRASELSDDG

251 KFDNTANIDR TLANALQTAK LLGFKNYAEL SLATKMADTP EQVLNFLHDL

301 ARRAKPYAEK DLAEVKAFAR ESLNLADLQP WDLGYASEKL REAKYAFSET

351 EVKKYFPVGH VLNGLFAQIK KLYGIGFTEK TVPVWHKDVR YFELQQNGET

401 IGGVYMDLYA REGKRGGAWM NDYKGRRRFS DGTLQLPTAY LVCNFAPPVG

451 GREARLSHDE ILILFHETGH GLHHLLTQVD ELGVSGINGV EWDAVELPSQ

501 FMENFVWEYN VLAQMSAHEE TGVPLPKELF DKMLAAKNFQ RGMFLVRQME

551 FALFDMMIYS EDDEGRLKNW QQVLDSVRKK VAVIQPPEYN RFALSFGHIF

601 AGGYSAGYYS YAWAEVLSAD AYAAFEESDD VAATGKRFWQ EILAVGGSRS

651 AAESFKAFRG REPSIDALLR HSGFDNAV*
``` m128-1/a128-1 97.8% identity in 677 aa overlap

```
                   10         20         30         40         50         60
a128-1.pep. MTDNALLHLGEEPRFDQIKTEDIKPALQTAIAEAREQIAAIKAQTHTGWANTVEPLTGIT
            ||||||||||||||||||||||||||||||||||||||||||||||||||||||||||||
m128-1      MTDNALLHLGEEPRFDQIKTEDIKPALQTAIAEAREQIAAIKAQTHTGWANTVEPLTGIT
                   10         20         30         40         50         60

70         80         90        100        110        120
a128-1.pep. ERVGRIWGVVSHLNSVTDTPELRAAYNELMPEITVFFTEIGQDIELYNRFKTIKNSPEFD
            ||||||||||||||||||:|||||:|||||||||||||||||||||||||||||||||||
m128-1      ERVGRIWGVVSHLNSVADTPELRAVYNELMPEITVFFTEIGQDIELYNRFKTIKNSPEFD
                   70         80         90        100        110        120

130        140        150        160        170        180
a128-1.pep. TLSHAQKTKLNHDLRDFVLSGAELPPEQQAELAKLQTEGAQLSAKFSQNVLDATDAFGIY
            |||:||||||||||||||||||||||||||||||||||||||||||||||||||||||||
m128-1      TLSPAQKTKLNHDLRDFVLSGAELPPEQQAELAKLQTEGAQLSAKFSQNVLDATDAFGIY
                  130        140        150        160        170        180

190        200        210        220        230        240
a128-1.pep. FDDAAPLAGIPEDALAMFAAAAQSEGKTGYKIGLQIPHYLAVIQYADNRKLREQIYRAYV
            |||||||||||||||||||||||||:|||||||||||||||||||||||:||||||||||
m128-1      FDDAAPLAGIPEDALAMFAAAAQSESKTGYKIGLQIPHYLAVIQYADNRELREQIYRAYV
                  190        200        210        220        230        240

250        260        270        280        290        300
a128-1.pep. TRASELSDDGKFDNTANIDRTLENALQTAKLLGFKNYAELSLATKMADTPEQVLNFLHDL
            |||||||||||||||||||||||:||||||||||||||||||||||||||||||||||||
m128-1      TRASELSDDGKFDNTANIDRTLANALQTAKLLGFKNYAELSLATKMADTPEQVLNFLHDL
                  250        260        270        280        290        300

310        320        330        340        350        360
a128-1.pep. ARRAKPYAEKDLAEVKAFARESLGLADLQPWDLGYAGEKLREAKYAFSETEVKKYFPVGK
            ||||||||||||||||||||||:|||||||||||||:|||||||||||||||||||||||
m128-1      ARRAKPYAEKDLAEVKAFARESLNLADLQPWDLGYASEKLREAKYAFSETEVKKYFPVGK
                  310        320        330        340        350        360

370        380        390        400        410        420
a128-1.pep. VLNGLFAQIKKLYGIGFTEKTVPVWHKDVRYFELQQNGETIGGVYMDLYAREGKRGGAWM
            ||||||||||||||||||||||||||||||||||||||||||||||||||||||||||||
m128-1      VLNGLFAQIKKLYGIGFTEKTVPVWHKDVRYFELQQNGETIGGVYMDLYAREGKRGGAWM
                  370        380        390        400        410        420

430        440        450        460        470        480
a128-1.pep. NDYKGRRRFSDGTLQLPTAYLVCNFTPPVGGKEARLSHDEILTLFHETGHGLHHLLTQVD
            ||||||||||||||||||||||||:||||||:||||||||||||||||||||||||||||
m128-1      NDYKGRRRFSDGTLQLPTAYLVCNFAPPVGGREARLSHDEILTLFHETGHGLHHLLTQVD
                  430        440        450        460        470        480

490        500        510        520        530        540
a128-1.pep  ELGVSGINGVEWDAVELPSQFMENFVWEYNVLAQMSAHEETGVPLPKELFDKMLAAKNFQ
            ||||||||||||||||||||||||||||||||||||||||||||||||||||||||||||
m128-1      ELGVSGINGVEWDAVELPSQFMENFVWEYNVLAQMSAHEETGVPLPKELFDKMLAAKNFQ
                  490        500        510        520        530        540
```

```
                  550        560        570        580        590        600
a128-1.pep RGMFLVRQMEFALFDMMIYSEDDEGRLKNWQQVLDSVRKEVAVVRPPEYNRFANSFGHIF
           ||||||||||||||||||||||||||||||||||||::||::||||||||||| |||||
m128-1     RGMFLVRQMEFALFDMMIYSEDDEGRLKNWQQVLDSVRKKVAVIQPPEYNRFALSFGHIF
                  550        560        570        580        590        600

610        620        630        640        650        660
a128-1.pep AGGYSAGYYSYAWAEVLSADAYAAFEESDDVAATGKRFWQEILAVGGSRSAAESFKAFRG
           ||||||||||||||||||||||||||||||||||||||||||||||||||||||||||||
m128-1     AGGYSAGYYSYAWAEVLSADAYAAFEESDDVAATGKRFWQEILAVGGSRSAAESFKAFRG
                  610        620        630        640        650        660

670    679
a128-1.pep REPSIDALLRHSGFDNAAX
           |||||||||||||||||:
m128-1     REPSIDALLRHSGFDNAVX
                  670 a128-1/P44573 sp|P44573|OPDA_HAELIN OLIGOPEPTIDASE A >gi|1075082|pir||C64055 oligopeptidase A (prlC) homolog -
Haemophilus influenzae (strain Rd KW20)
>gi|1573174 (U32706) oligopeptidase A (prlC) [Haemophilus influenzae Rd] Length = 681
Score = 591 bits (1507), Expect = e-168
Identities = 309/677 (45%), Positives = 415/677 (60%), Gaps = 4/677 (0%)
 Query:   4 NALLHLGEEPRFDQIKTEDIKPALQTXXXXXXXXXXXXXXXXTHTGWANTVEPLTGITERV  63
            N LL+    P F QIK E I+PA++                  H  W N + PLT +R+
 Sbjct:   5 NPLLNIQGLPPFSQIKPEHIRPAVEKLIQDCRNTIEQVLKQPHFTWENFILPLTETNDRL  64
 Query:  64 GRIWGVVSHLNSVTDTPELRAAYNELMPEITVFFTEIGQDIELYNRFKTIKNSPEFDTLS 123
            R W  VSHLNSV ++  ELR AY   +P ++ + T +GQ    LYN +  +KNS  EF  S
 Sbjct:  65 NRAWSPVSHLNSVKNSTELREAYQTCLPLLSEYSTWVGQHKGLYNAYLALKNSAEFADYS 124
 Query: 124 HAQKTKLNHDLRDFVLSGAELPPEQQAELAKLQTEGAQLSAKFSQNVLDATDAFGIYFDD 183
             AQK + + LRDF LSG L  E+Q   ++    ++L+++FS NVLDAT +    ++
 Sbjct: 125 IAQKKAIENSLRDFELSGIGLSEEKQQRYGEIVARLSELNSQFSNNVLDATMGWEKLIEN 184
 Query: 184 AAPLAGIPEDALAMFAAAAQSEGKTGYKIGLQIPHYLAVIQYADNRKLREQIYRAYVTRA 243
             A LAG+PE AL    +A+S+G GY+  L+IP YL V+ y +NR LRE++YRAY TRA
 Sbjct: 185 EAELAGLPESALQAAQQSAESKGLKGYRFTLEIPSYLPVMTYCENRALREEMYRAYATRA 244
 Query: 244 SELSDD-GKFDNTANIDRTLENALQTAKLLGFKNYAELSLATKMADTPEQVLNFLHDLAR 302
            SE    + GK+DN+ ++  L   ++ AKLLGF Y ELSLATKMA+ P+QVL+FL  LA
 Sbjct: 245 SEQGPNAGKWDNSKVMEEILTLRVELAKLLGFNTYTELSLATKMAENPQQVLDFLDHLAE 304
 Query: 303 RAKPYAEKDLAEVKAFARESLGLADLQPWDLGYAGEKLREAKYAFSETEVKKYFPVGKVL 362
            RAKP   EK+L E+K +   + G+ +L PWD+G+  EK ++  YA ++  E++ YFP  +V+
 Sbjct: 305 RAKPQGEKELQELKGYCEKEFGVTELAPWDIGFYSEKQKQHLYAINDEELRPYFPENRVI 364
 Query: 363 NGLFAQIKKLYGIGFTE-KTVPVWHKDVRYFEL-QQNGETIGGVYMDLYAREGKRGGAWM 420
            +GLF  IK+++  i     E K V  WHKDVR+F+L  +N +   G  Y+DLYARE  KRGGAWM
 Sbjct: 365 SGLFELIKRIFNIRAVERKGVDTWHKDVRFFDLIDENDQLRGSFYLDLYAREHKRGGAWM 480
 Query: 421 NDYKGRRRFSDGTLQLPTAYLVCNFTPPVGGKEARLSHDEIXXXXXXXXXXXXXXXXQVD 480
            +D  GR+R  DG+++  P AYL CNF  P+G K A  +H+E+                Q+D
 Sbjct: 425 DDCIGRKRKLDGSIETPVAYLTCNFNAPIGNKPALFTHNEVTTLFHEFGHGIHHMLTQID 484
 Query: 481 ELGVSGINGVEWDAVELPSQFMENFVWEYNVLAQMSAHEETGVPLPKELFDKMLAAKNFQ 540
                V+GINGV WDAVELPSQFMEN+ WE   LA +S H ETG PLPKE   ++L AKNFQ
 Sbjct: 485 VSDVAGINGVPWDAVELPSQFMENWCWEEEALAFISGHYETGEPLPKEKLTQLLKAKNFQ 544
 Query: 541 RGMFLVRQMEFALFDMMIYSEDDEGRLKNWQQVLDSVRKEVAVVRPPEYNRFANSFGHIF 600
             MF++RQ+EF +FD +   D +       L SV+ +VAV++   ++ R  +SF HIF
 Sbjct: 545 AAMPILRQLEFGIFDFRLHHTEDAEKTNQILDTLKSVKSQVAVIKGVDWARAPHSFSHIF 604
 Query: 601 XXXXXXXXXXXWAEVLSADAYAAFEESDDV-AATGKRFWQEILAVGGSRSAAESFKAFR 659
                       WAEVLSADAY+ FEE     TGK F  EIL GGS   E FK FR
 Sbjct: 605 AGGYAAGYYSYLWAEVLSADAYSRFEEEGIFNPITGKSFLDEILTRGGSEEPMELFKRFR 664
 Query: 660 GREPSIDALLRHSGFDN 676
            GREP +DALLRH G N
 Sbjct: 665 GREPQLDALLRHKGIMN 681
```

55

The following partial DNA sequence was identified in *N. gonorrhoeae* <SEQ ID 493>:

```
g129.seq
  1 ATGCTTTCAC CTCCTCGGCG TAAAACGGCG GCACATCAAT CAAGCCGTCT

51 TTCATTTGCG TGCGGAAAAA ATGCGGCGTG TTGCCGTGAT CAAAATCAAT

101 ATCGTGCAGC ATCCAGCCCA AATCGCGGTT TGCCTCGCTT TCCGATAACG

151 CCGACGGCGG CAGCGGTTCA CCCTTATCCG CGCTTTCGCC ATTTGCCCTT
```

-continued

```
201 TCAGGCTGCG GGCATAGGGG CGGAACAGGC GGCGGTCGAA TCCTGTTTCA

251 TCCGGACAAA CGCGTTGGCA GTCGGAAAAT CCGGCCGGCC GTGTCAAATA

301 ATGCGTTACT TTGGCCGGGT CTTGTCCTTT GTAAGCGGCG GTCTTTTTTT

351 GCGCGCCATC CGCATCTGTT TGGGCGCATG GCAAACGGCG GCTGCCGTAC

401 AATCAAAATG TTTGGCGATT TCATGCAGAC AGGCATCCGG ATGCCGCCCG

451 ACATATCGAG CCGGTTTTTG CCTATCCGAT TTGGCGGCAT TTAGGCCGGT

501 AACTTGA
```

This corresponds to the amino acid sequence <SEQ ID 494; ORF 129.ng>:

```
g129.pep
  1 MLSPPRRKTA AHQSSRLSFA CGKNAACCRD QNQYRAASSP NRGLPRFPIT

51 PTAAAVHPYP RFRHLPFQAA GIGAEQAAVE SCFIRTNALA VGKSGRPCQI

101 MRYFGRVLSF VSGGLFLRAI RICLGAWQTA AAVQSKCLAI SCRQASGCRP

151 TYRAGFCLSD LAAFRPVT*
```

The following partial DNA sequence was identified in *N. meningitidis* <SEQ ID 495>:

```
m129.seq (partial)
  1 ..TATCTGCGCT TTCACTATTT GCCCTTTCAG GCTGCGGGCA TAGGGACGGA

51   ACAGGTAGCG GTCAAATCCT GTTTCATCCA AATAAACACG TTGGTAGTCG

101   GAAAATTCGG CCGGCTGTGT CAAATAATGC GTTACTTTGG CCGGGTCTTG

151   TTCTTTGTAA GTGGTGGTCT TTTTTTGCGC GTTATCCCCA TCTGTTTGAG

201   TGCATAGCAA ATGGTGGCTG CCGTACAATC AAAATGTTTG GCGATTTCAT

251   GCAGATAGGC ATCCGGGTGT TGCCCAACAT ATTGAGCCGG TTTTTGCCTA

301   TCCGATTTGA CGGCATTTAG ACCGGTAACT TGA
```

This corresponds to the amino acid sequence <SEQ ID 496; ORF 129>:

```
m129.pep (partial)
  1 ..YLRFHYLPFQ AAGIGTEQVA VKSCFIQINT LVVGKFGRLC QIMRYFGRVL

51   FFVSGGLFLR VIPICLSAXQ MVAAVQSKCL AISCRXASGC CPTYXAGFCL

101   SDLTAFRPVT *
```

Computer analysis of this amino acid sequence gave the following results:
Homology with a Predicted ORF from *N. gonorrhoeae*
ORF 129 shows 79.1% identity over a 110 aa overlap with a predicted ORF (ORF 129.ng) from *N. gonorrhoeae*:

```
m129/g129

10         20         30
    m129.pep                YLRFHYLPFQAAGIGTEQVAVKSCFIQINT
                            ||::|||||||||:||:||:||||: |:
    g129        RDQNQYRAASSPNRGLPRFPITPTAAAVHPYPRFRHLPFQAAGIGAEQAAVESCFIRTNA
                    30         40         50         60         70         80
```

```
                    40         50         60         70         80         90
m129.pep    LVVGKFGRLCQIMRYFGRVLFFVSGGLFLRVIPICLSAXQMVAAVQSKCLAISCRXASGC
            |:|||  || |||||||||||| ||||||||||:| |||:| | :||||||||||||| ||||
g129        LAVGKSGRPCQIMRYFGRVLSFVSGGLFLRAIRICLGAWQTAAAVQSKCLAISCRQASGC
                    90        100        110        120        130        140

100        110
m129.pep    CPTYXAGFCLSDLTAFRPVTX
            ||| |||||||||:|||||||
g129        RPTYRAGFCLSDLAAFRPVTX
                   150        160
```

The following partial DNA sequence was identified in *N. meningitidis* <SEQ ID 497>:

```
a129.seq (partial)
  1 TATCTGCGCT TTCACTATTT GCCCTTTCAG GCTGCGGGCA TAGGGACGGA
 51 ACAGGTAGCG GTCAAATCCT GTTTCATCCA AATAAACACG TTGGTAGTCG
101 GAAAATTCGG CCAGCTGTGT CAAATAATGC GTTACTTTGG CCGGGTCTTG
151 TTCTTTGTAA GTGGTGGTCT TTTTTTGCGC GTTATCCCCA TCTGTTTGAG
201 TGCATAGCAA ATGGTGGCTG CCGTACAATC AAAATGTTTG GCGATTTCAT
251 GCAGATAGGC ATCCTGGTGT TGCCCAACAT ATTGAGCCGG TTTTTGCCTA
301 TCCGATTTGA CGGCATTTAG ACCGGTAACT TGA
```

This corresponds to the amino acid sequence <SEQ ID 498; ORF 129.a>:

```
a129.pep (partial)
  1 YLRFHYLPFQ AAGIGTEQVA VKSCFIQINT LVVGKFGQLC QIMRYFGRVL
 51 FFVSGGLFLR VIPICLSA*Q MVAAVQSKCL AISCR*ASWC CPTY*AGFCL
101 SDLTAFRPVT *
``` m129/a129 98.2% identity in 110 aa overlap

```
                    10         20         30         40         50         60
m129-1.pep  YLRFHYLPFQAAGIGTEQVAVKSCFIQINTLVVGKFGRLCQIMRYFGRVLFFVSGGLFLR
            |||||||||||||||||||||||||||||||||||||:||||||||||||||||||||||
a129        YLRFHYLPFQAAGIGTEQVAVKSCFIQINTLVVGKFGQLCQIMRYFGRVLFFVSGGLFLR
                    10         20         30         40         50         60

70         80         90        100        110
m129-1.pep  VIPICLSAXQMVAAVQSKCLAISCRXASGCCPTYXAGFCLSDLTAFRPVTX
            |||||||||||||||||||||||||||||| ||||||:|||||||||||||
a129        VIPICLSAXQMVAAVQSKCLAISCRXASWCCPTYXACFCLSDLTAFRPVTX
                    70         80         90        100        110
```

The following partial DNA sequence was identified in *N. gonorrhoeae* <SEQ ID 499>:

```
g130.seq
  1 ATGAAACAAC TCCGCGACAA CAAAGCCCAA GGCTCTGCAC TGTTTACCCT
 51 TGTGAGCGGT ATCGTTATTG TTATTGCAGT CCTTTATTTC CTGATTAAGC
101 TGGCGGGCAG TGGATCGTTC GGCGATGTCG ATGCCACTAC GGAAGCGGCA
151 ACGCAGACCC GCATCCAGCC TGTCGGACAA TTGACGATGG GTGACGGCAT
201 CCCCGTCGGC GAACGCCAAG GCGAACAGAT TTTCGGCAAA ATCTGTATCC
251 AATGCCACGC GGCGGACAGC AATGTGCCGA ACGCTCCGAA ACTGGAACAC
```

-continued

```
301 AACGGCGACT GGGCGCCGCG TATCGCGCAA GGCTTCGATA CCTTGTTCCA

351 ACACGCGCTG AACGGCTTTA ACGCCATGCC TGCCAAAGGC GGTGCGGCAG

401 ACCTGACCGA TCAGGAACTC AAACGGGCGA TTACCTACAT GGCGAATAAA

451 AGCGGCGGTT CTTTCCCGAA TCCTGATGAG GCTGCGCCTG CCGACAATGC

501 CGCTTCAGGA ACAGCTTCTG CTCCTGCCGA TAGTGCAGCT CCGGCAGAAG

551 CGAAGGCAGA AGACAAGGGT GCGGCAGCCC CTGCGGTCGG CGTTGACGGT

601 AAAAAAGTCT TCGAAGCAAC CTGTCAGGTG TGCCACGGCG GTTCGATTCC

651 CGGTATTCCC GGCATAGGCA AAAAGACGA TTGGGCACCG CGTATCAAAA

701 AAGGCAAAGA AACCTTGCAC AAACATGCCC TTGAAGGCTT TAACGCGATG

751 CCGGCCAAAG GCGGCAATGC AGGTTTGAGC GATGACGAAG TCAAAGCGGC

801 TGTTGACTAT ATGGCAAACC AATCCGGTGC AAAATTCTAA
```

This corresponds to the amino acid sequence <SEQ ID 500; ORF 130.ng>:

```
g130.pep
   1 MKQLRDNKAQ GSALFTLVSG IVIVIAVLYF LIKLAGSGSF GDVDATTEAA

51 TQTRIQPVGQ LTMGDGIPVG ERQGEQIFGK ICIQCHAADS NVPNAPKLEH

101 NGDWAPRIAQ GFDTLFQHAL NGFNAMPAKG GAADLTDQEL KRAITYMANK

151 SGGSFPNPDE AAPADNAASG TASAPADSAA PAEAKAEDKG AAAPAVGVDG

201 KKVFEATCQV CHGGSIPGIP GIGKKDDWAP RIKKGKETLH KHALEGFNAM

251 PAKGGNAGLS DDEVKAAVDY MANQSGAKF*
```

The following partial DNA sequence was identified in *N. meningitidis* <SEQ ID 501>:

```
m130.seq (partial)
   1 ..GGCGAACAGA TTTTCGGCAA AATCTGTATC CAATGCCACG CGGCGGACAG 51   CAATGTGCCG AACGCTCCGA AACTGGAACA CAACGGCGAT TrGGCACCGC 101   GTATCGgCAA GGCTTCGATA CCTTGTTCCA ACACGCGCTG AACGGCTTTA

151   ACGCCATGCC TGCAAAAGGC GGTGCGGCAG ACCTGACCGA TCAGGAACTT

201   AAACGGGCGA TTACTTACAT GGCGAACAAA AGCGGCGGTT CTTTCCCGAA

251   TCCTGATGAG GCTGCGCCTG CCGACAATGC CGCTTCAGGA ACAGCTTCTG

301   CTCCTGCCGA TAGTGCAGCT CCGGCAGAAG CGAAGGCAGA AGACAAGGGT

351   GCGGCAcCCC TGCGGTCGGC GTTGACGGTA AAAAGTCTT CGAAGCAACC

401   TGTCAGGTGT GCCACGGCGG TTCGATTCCC GGTATTCCCG GCATAGGCAA

451   AAAAGACGAT TGGGCACCGC GTATCAAAAA AGGCAAAGAA ACCTTGCACA

501   AACACGCCCT TGAAGGCTTT AACGCGATGC CTGCCAAArG CGgCAATGCA

551   GGTTTGAGCG ATGACGAAgT CAAAGCGGCT GTTGACTATA TGGCAAACCA

601   ATCCGGTGCA AAATTCTAA
```

This corresponds to the amino acid sequence <SEQ ID 502; ORF 130>:

```
m130.pep (partial)
   1 ..GEQIFGKICI QCHAADSNVP NAPKLEHNGD XAPRIQGFDT LFQHALNGFN
```

-continued

```
 51    AMPAKGGAAD LTDQELKRAI TYMANKSGGS FPNPDEAAPA DNAASGTASA

101    PADSAAPAEA KAEDKGAAPA VGVDGKKVFE ATCQVCHGGS IPGIPGIGKK

151    DDWAPRIKKG KETLHKHALE GFNAMPAKXG NAGLSDDEVK AAVDYMANQS

201    GAKF*
```

Computer analysis of this amino acid sequence gave the following results:
Homology with a Predicted ORF from *N. gonorrhoeae*
ORF 130 shows 98.1% identity over a 206 aa overlap with a predicted ORF (ORF 130.ng) from *N. gonorrhoeae*:

```
   m130/g130
                                                    10        20        30
       m130.pep                                GEQIFGKICIQCHAADSNVPNAPKLEHNGD
                                               |||||||||||||||||||||||||||||
           g130    DATTEAATQTRIQPVGQLTMGDGIPVGERQGEQIFGKICIQCHAADSNVPNAPKLEHNGD
                       50        60        70        80        90       100
                        40        50        60        70        80        89
       m130.pep    XAPRI-QGFDTLFQHALNGFNAMPAKGGAADLTDQELKRAITYMANKSGGSFPNPDEAAP
                   ||||  |||||||||||||||||||||||||||||||||||||||||||||||||||||
           g130    WAPRIAQGFDTLFQHALNGFNAMPAKGGAADLTDQELKRAITYMANKSGGSFPNPDEAAP
                      110       120       130       140       150       160
                    90       100       110       120       130       140
       m130.pep    ADNAASGTASAPADSAAPAEAKAEDKGAA-PAVGVDGKKVFEATCQVCHGGSIPGIPGIG
                   |||||||||||||||||||||||||||||  |||||||||||||||||||||||||||||
           g130    ADNAASGTASAPADSAAPAEAKAEDKGAAAPAVGVDGKKVFEATCQVCHGGSIPGIPGIG
                      170       180       190       200       210       220
                   150       160       170       180       190       200
       m130.pep    KKDDWAPRIKKGKETLHKHALEGFNAMPAKXGNAGLSDDEVKAAVDYMANQSGAKFX
                   ||||||||||||||||||||||||||||||  |||||||||||||||||||||||||
           g130    KKDDWAPRIKKGKETLHKHALEGFNAMPAKGGNAGLSDDEVKAAVDYMANQSGAKFX
                      230       240       250       260       270       280
```

The following partial DNA sequence was identified in *N. meningitidis* <SEQ ID 503>:

```
a130.seq
    1 ATGAAACAAC TCCGCGACAA CAAAGCCCAA GGCTCTGCAC TGTTTACCCT

51 TGTGAGCGGT ATCGTTATTG TTATTGCAGT CCTTTATTTC CTGATTAAGC

101 TGGCGGGCAG CGGCTCGTTC GGCGATGTCG ATGCCACTAC GGAAGCAGCA

151 ACGCAGACCC GTATCCAGCC TGTCGGACAA TTGACGATGG GCGACGGCAT

201 CCCCGTCGGC GAACGCCAAG GCGAACAGAT TTTCGGCAAA ATCTGTATCC

251 AATGCCACGC GGCGGACAGC AATGTGCCGA ACGCTCCGAA ACTGGAACAC

301 AACGGCGATT GGGCGCCGCG TATCGCGCAA GGCTTCGATA CCTTGTTCCA

351 ACACGCGCTG AACGGCTTTA ACGCCATGCC TGCCAAAGGC GGTGCGGTAG

401 ACCTGACCGA TCAGGAACTC AAACGGGCGA TTACTTACAT GGCGAACAAA

451 AGCGGCGGTT CTTTCCCGAA TCCTGATGAG CTGCGCCTG CCGACAATGC

501 CGCTTCAGGA ACAGCTTCTG CTCCTGCCGA TAGTGCAGCT CCGGCAGAAG

551 CGAAGGCAGA AGACAAGGGT GCGGCAGCCC CTGCGGTCGG CGTTGACGGT

601 AAAAAGTCT TCGAAGCAAC CTGTCAGGTG TGCCACGGCG GTTCGATTCC

651 CGGTATTCCC GGCATAGGCA AAAAAGACGA TTGGGCACCG CGTATCAAAA

701 AAGGCAAAGA AACCTTGCAC AAACACGCCC TTGAAGGCTT TAACGCGATG
```

```
-continued
751 CCTGCCAAAG GCGGCAATGC AGGTTTGAGC GATGACGAAG TCAAAGCGGC

801 TGTTGACTAT ATGGCAAACC AATCCGGTGC AAAATTCTAA
```

This corresponds to the amino acid sequence <SEQ ID 504; ORF 130.a>:

```
a130.pep
  1 MKQLRDNKAQ GSALFTLVSG IVIVIAVLYF LIKLAGSGSF GDVDATTEAA

51 TQTRIQPVGQ LTMGDGIPVG ERQGEQIFGK ICIQCHAADS NVPNAPKLEH

101 NGDWAPRIAQ GFDTLFQHAL NGFNAMPAKG GAVDLTDQEL KRAITYMANK

151 SGGSFPNPDE AAPADNAASG TASAPADSAA PAEAKAEDKG AAAPAVGVDG

201 KKVFEATCQV CHGGSIPGIP GIGKKDDWAP RIKKGKETLH KHALEGFNAM

251 PAKGGNAGLS DDEVKAAVDY MANQSGAKF*
``` m130/a130 97.6% identity in 206 aa overlap

```
                                            10         20         30
    m130.pep                         GEQIFGKICIQCHAADSNVPNAPKLEHNGD
                                     ||||||||||||||||||||||||||||||
    a130     DATTEAATQTRIQPVGQLTMGDGIPVGERQGEQIFGKICIQCHAADSNVPNAPKLEHNGD
                 50        60        70        80        90        100

40        50        60        70        80        89
    m130.pep XAPRI-QGFDTLFQHALNGFNAMPAKGGAADLTDQELKRAITYMANKSGGSFPNPDEAAP
             ||||  ||||||||||||||||||||||||:|||||||||||||||||||||||||||||
    a130     WAPRIAQGFDTLFQHALNGFNAMPAKGGAVDLTDQELKRAITYMANKSGGSFPNPDEAAP
                 110       120       130       140       150       160

90       100       110       120       130       140
    m130.pep ADNAASGTASAPADSAAPAEAKAEDKGAA-PAVGVDGKKVFEATCQVCHGGSIPGIPGIG
             |||||||||||||||||||||||||||||| |||||||||||||||||||||||||||||
    a130     ADNAASGTASAPADSAAPAEAKAEDKGAAAPAVGVDGKKVFEATCQVCHGGSIPGIPGIG
                 170       180       190       200       210       220

150       160       170       180       190       200
    m130.pep KKDDWAPRIKKGKETLHKHALEGFNAMPAKXGNAGLSDDEVKAAVDYMANQSGAKFX
             |||||||||||||||||||||||||||||| |||||||||||||||||||||||||
    a130     KKDDWAPRIKKGKETLHKHALEGFNAMPAKGGNAGLSDDEVKAAVDYMANQSGAKFX
                 230       240       250       260       270       280
```

The following partial DNA sequence was identified in *N. gonorrhoeae* <SEQ ID 505>:

```
g132.seq
  1 ATGGAAGCCT TCAAAACCCT AATTTGGATT ATTAATATTA TTTCCGCTTT

51 GGCCGTCATC GTGTTAGTAT TGCTCCAACA CGGCAAAGGC GCGGATGCCG

101 GCGCGACCTT CGGATCGGGA AGCGGCAGCG CGCAAGGCGT ATTCGGCTCT

151 GCCGGCAACG CCAACTTcct CAgccGCTCG AccGccGTTG CAGCAACAtt 201 tttcttTGca acctgcAtgg gctatggTgt atattcacac CCACACGACA 251 AAACACGGTT TGGACTtcag caacataCGA CAGACTCAGC AagcACCCAA 301 ACCcgtAAGC AATACCGAAC CTTCTGCCCC TGTTCCTCAG CAGCAGAAAT 351 AACagtTTTT CAAATgccga caTGgtga
```

This corresponds to the amino acid sequence <SEQ ID 506; ORF 132.ng>:

```
g132.pep
  1 MEAFKTLIWI INIISALAVI VLVLLQHGKG ADAGATFGSG SGSAQGVFGS
```

-continued

```
 51 AGNANFLSRS TAVAATFFFA TCMGYGVYSH PHDKTRFGLQ QHTTDSASTQ

101 TRKQYRTFCP CSSAAEITVF QMPTW*
```

The following partial DNA sequence was identified in *N. meningitidis* <SEQ ID 507>:

```
m132.seq (partial)
   1 ATGGAACCCT TCAAAACCTT AATTTGGATT GTTAATTTAA TTTCCGCTTT

51 GGCCGTCTTC GTGTTAGTAT TGCTCCAACA CGGCAAAGGC GCGGATGCCG

101 GCGCGACTTT CGGA...
```

This corresponds to the amino acid sequence <SEQ ID 508; ORF 132>:

```
m132.pep (partial)
 1  MEPFKTLIWI VNLISALAVF VLVLLQHGKG ADAGATFG...
```

Computer analysis of this amino acid sequence gave the following results:

Homology with a Predicted ORF from *N. gonorrhoeae*

ORF 132 shows 89.5% identity over a 38 aa overlap with a predicted ORF (ORF 132.ng) from *N. gonorrhoeae*:

```
              m132/g132

10         20         30
     m132.pep  MEPFKTLIWIVNLISALAVFVLVLLQHGKGADAGATFG
               || ||||||||:|:|||||:||||||||||||||||||
     g132      MEAFKTLIWIINIISALAVIVLVLLQHGKGADAGATFGSGSGSAQGVFGSAGNANFLSRS
                     10         20         30         40         50         60
```

The following partial DNA sequence was identified in *N. meningitidis* <SEQ ID 509>:

```
a132.seq
   1 ATGGAAGCCT TCAAAACCCT AATTTGGATT GTTAATATAA TTTCCGCTTT

51 GGCCGTCATC GTGTTAGTAT TGCTCCAACA CGGCAAAGGC GCGGATGCCG

101 GCGCGACTTT CGGATCGGGA AGCGGCAGCG CGCAAGGCGT ATTCGGCTCT

151 GCCGGCAACG CTAACTTCCT CAGCCGCTCG ACCGCCGTTG CAGCAACATT

201 TTTCTTTGCA ACCTGCATGg GCTATGGTGT ATATTCACAC CCACACGACA

251 AAACACGGTT TGGACTTCAG CAACGTACAA CAAACTCAGC AAGCACCCAA

301 ACCCGTAAGC AATACCGAAC CTTCTGCCCC TGTTCCTCAG CAGCAGAAAT

351 AACAGTTTTT CAAATGCCGA CATGGTGA
```

This corresponds to the amino acid sequence <SEQ ID 510; ORF 132.a>:

```
a132.pep
   1 MEAFKTLIWI VNIISALAVI VLVLLQHGKG ADAGATFGSG SGSAQGVFGS

51 AGNANFLSRS TAVAATFFFA TCMGYGVYSH PHDKTRFGLQ QRTTNSASTQ

101 TRKQYRTFCP CSSAAEITVF QMPTW*
``` m132/a132 92.1% identity in 38 aa overlap

```
                   10        20        30
    m132.pep  MEPFKTLIWIVNLISALAVFVLVLLQHGKGADAGATFG
              || |||||||||:||||||:||||||||||||||||||
    a132      MEAFKTLIWIINIISALAVIVLVLLQHGKGADAGATFGSGSGSAQGVFGSAGNANFLSRS
                   10        20        30        40        50        60
```

The following partial DNA sequence was identified in *N. gonorrhoeae* <SEQ ID 511>:

```
g134.seq
    1 ATGTCCCAAG AAATCCTCGA CCAAGTGCGC CGCCGCCGCA CGTTTGCCAT

51 CATCTCCCAC CCCGATGCGG GTAAAACCAC GCTGACCGAA AAACTGCTGC

101 TGTTTTCGGG CGCGATTCAA AGCGCAGGCA CGGTGAAAGG TAAGAAAACC

151 GGCAAATTCG CCACCTCCGA CTGGATGGAC ATCGAGAAGC AGCGCGGCAT

201 TTCCGTGGCA TCAAGCGTGA TGCAGTTCGA CTACAAAGAC CACACCGTCA

251 ACCTCTTGGA CACGCCGGGA CACCAAGACT TCTCCGAAGA CACCTACCGC

301 GTTTTAACCG CAGTGGACAG CGCCTTGATG GTCATCGACG CGGCAAAAGG

351 CGTGGAAGCG CAAACCATCA AACTCTTGAA CGTCTGCCGC CTGCGCGATA

401 CGCCGATTGT TACCTTCATG AACAAATACG ACCGCGAAGT GCGCGATTCT

451 TTGGAACTCT TGGACGAAGT GGAAGACATC CTGCAAATCC GCTGCGCGCC

501 CGTTACCTGG CCGATCGGTA TGGGCAAAAA CTTCAAGGGC GTGTACCACA

551 TCCTGAACGA CGAAATCTAT CTCTTTGAAG CGGGCGGCGA ACGCCTGCCG

601 CACGAGTTCG ACATCATCAA AGGCATAAAC AATCCCGAAT GGAACAACG

651 CTTTCCGTTG GAAATCCAGC AGTTGCGCGA CGAAATCGAA TTGGTGCAGG

701 CGGCTTCCAA CGAATTTAAT CTCGacgaAT TTCTCGccgG CGAACTCACG

751 CCAGTGTTCT TCGGCTCTGC GATTAACAAC TTCGGCATTC AGGAAATCCT

801 CAATTCATTG ATTGACTGGG CACCCGCACC GAAACCGCGC GACGCGACCA

851 TGCGCATGGT CGGGCCGGAC GAGCCGAAAT TTTCCGGATT TATCTTTAAA

901 ATCCAAGCCA ATATGGACCC GAAACACCGC GACCGTATCG CCTTCTTGCG

951 CGTCTGCTCC GGTAAATTCG AGCGCGGCAT GAAGATGAAA CACCTGCGTA

1001 TCAACCGCGA AATCGCCGCC TCCAGCGTAG TAACCTTCAT GTCGCACGAC

1051 CGCGAACTGG CGGAAGAAGC CTACGCCGGC GACATCATCG GCATCCCGAA

1101 CCACGGCAAC ATCCAAATCG GCGACAGCTT CTCCGAAGGC AACAACTGG

1151 CGTTTACCGG CATCCCATTC TTCGCGCCCG AACTGTTCCG CAGCGTCCGC

1201 ATCAAAAACC CGCTGAAAAT CAAACAACTG CAAAAAGGTT TGCAACAACT

1251 CGGCGAAGAA GGTGCGGTTC AAGTATTCAA ACCGATGAGC GGCGCGGATT

1301 TGATTTTGGG TGCGGTCGGC GTGTTGCAGT TTGAAGTCGT AACCTCACGC

1351 CTCGCCAACG AATACGGCGT GGAAGCCGTG TTCGACAGCG CATCCATCTG

1401 GTCGGCGCGC TGGGTATCGT GCGACGACAA GAAAAAACTG GCGGAATTTG

1451 AAAAAGCCAA CGCAGGCAAC CTCGCCATCG ACGCAGGCGG CAACCTCGCC

1501 TACCTCGCCC CCAACCGCGT GAATTTGGGG TTGACGCAAG AACGCTGGCC

1551 GGACATCGTG TTCCACGAAA CGCGCGAACA TTCGGTCAAA CTCTAA
```

This corresponds to the amino acid sequence <SEQ ID 512; ORF 134.ng>:

```
g134.pep.
   1 MSQEILDQVR RRRTFAIISH PDAGKTTLTE KLLLFSGAIQ SAGTVKGKKT

51 GKFATSDWMD IEKQRGISVA SSVMQFDYKD HTVNLLDTPG HQDFSEDTYR

101 VLTAVDSALM VIDAAKGVEA QTIKLLNVCR LRDTPIVTFM NKYDREVRDS

151 LELLDEVEDI LQIRCAPVTW PIGMGKNFKG VYHILNDEIY LFEAGGERLP

201 HEFDIIKGIN NPELEQRFPL EIQQLRDEIE LVQAASNEFN LDEFLAGELT

251 PVFFGSAINN FGIQEILNSL IDWAPAPKPR DATMRMVGPD EPKFSGFIFK

301 IQANMDPKHR DRIAFLRVCS GKFERGMKMK HLRINREIAA SSVVTFMSHD

351 RELAEEAYAG DIIGIPNHGN IQIGDSFSEG EQLAFTGIPF FAPELFRSVR

401 IKNPLKIKQL QKGLQQLGEE GAVQVFKPMS GADLILGAVG VLQFEVVISR

451 LANEYGVEAV FDSASIWSAR WVSCDDKKKL AEFEKANAGN LAIDAGGNLA

501 YLAPNRVNLG LTQERWPDIV FHETREHSVK L*
```

The following partial DNA sequence was identified in *N. meningitidis* <SEQ ID 513>:

```
m134.seq
    1 ATGTCCCAAG AAATCCTCGA CCAAGTGCGC CGCCGCCGCA CGTTTGCCAT

51 CATCTCCCAC CCTGACGCAG GTAAAACCAC GTTGACTGAA AAACTCTTGC

101 TGTTTTCGGG CGCGATTCAG AGCGCGGGTA CGGTAAAAGG CAAGAAAACC

151 GGCAAATTCG CCACTTCCGA CTGGATGGAA ATCGAGAAGC AGCGCGGCAT

201 TTCCGTGGCA TCAAGTGTGA TGCAGTTCGA TTACAAAGAC CACACCGTCA

251 ACCTCTTGGA CACGCCGGGA CACCAAGACT TCTCCGAAGA CACCTACCGC

301 GTTTTAACCG CCGTGGACAG CGCATTAATG GTCATCGACG CGGCAAAAGG

351 CGTGGAAGCG CAAACCATCA AGCTCTTAAA CGTCTGCCGC CTGCGCGATA

401 CACCGATTGT TACGTTTATG AACAAATACG ACCGCGAAGT GCGCGATTCC

451 CTGGAACTTT TGGACGAAGT GGAAACATTT TTAAAAATCC GCTGCGCGCC

501 CGTTACCTGG CCGATCGGTA TGGGCAAAAA CTTCAAGGGC GTGTACCACA

551 TCCTGAACGA TGAAATTTAT CTCTTTGAAG CTGGCGGCGA ACGCCTGCCG

601 CACGAGTTCG ACATCATCAA AGGCATCGAT AATCCTGAAT TGGAACAACG

651 CTTTCCGTTG GAAATCCAGC AGTTGCGCGA CGAAATCGAA TTGGTGCAGG

701 CGGCTTCCAA CGAGTTTAAT CTCGACGAAT TCCTCGCCGG CGAACTCACG

751 CCCGTATTCT TCGGCTCTGC GATTAACAAC TTCGGTATTC AGGAAATCCT

801 CAATTCATTG ATTGACTGGG CGCCCGCGCC GAAACCGCGC GACGCGACCG

851 TACGTATGGT CGAGCCGGAC GAGCCGAAGT TTTCCGGATT TATCTTCAAA

901 ATCCAAGCCA ATATGGACCC GAAACACCGC GACCGTATTG CCTTCTTGCG

951 CGTCTGCTCC GGCAAATTCG AGCGCGGCAT GAAGATGAAA CACCTGCGTA

1001 TCAACCGCGA AATCGCCGCC TCCAGCGTGG TTACCTTCAT GTCGCACGAC

1051 CGCGAGCTGG TTGAAGAAGC CTACGCCGGC GACATTATCG GCATCCCGAA

1101 CCACGGCAAC ATCCAAATCG GCGACAGCTT CTCCGAAGGC GAACAACTGG

1151 CGTTCACCGG CATCCCATTC TTCGCACCCG AACTGTTCCG CAGCGTACGC
```

```
-continued
1201 ATCAAAAACC CGCTGAAAAT CAAACAACTG CAAAAAGGCT TGCAACAGCT

1251 CGGCGAAGAA GGCGCGGTGC AGGTGTTCAA ACCGATGAGC GGCGCGGATT

1301 TGATTTTGGG CGCGGTCGGC GTGTTGCAGT TTGAAGTCGT TACCTCGCGC

1351 CTCGCCAACG AATACGGCGT AGAAGCCGTG TTCGACAGCG CATCCATCTG

1401 GTCGGCGCGC TGGGTATCGT GCGACGACAA GAAAAAACTG GCTGAATTTG

1451 AAAAAGCCAA CGCGGGCAAC CTCGCCATCG ACGCAGGCGG CAACCTCGCC

1501 TACCTCGCGC CCAACCGCGT GAATTTGGGA CTCACGCAAG AACGTTGGCC

1551 GGACATCGTG TTCCACGAAA CACGCGAACA TTCGGTCAAA CTGTAA
```

This corresponds to the amino acid sequence <SEQ ID 514; ORF 134>:

```
m134.pep
   1 MSQEILDQVR RRRTFAIISH PDAGKTTLTE KLLLFSGAIQ SAGTVKGKKT

51 GKFATSDWME IEKQRGISVA SSVMQFDYKD HTVNLLDTPG HQDFSEDTYR

101 VLTAVDSALM VIDAAKGVEA QTIKLLNVCR LRDTPIVTFM NKYDREVRDS

151 LELLDEVENI LKIRCAPVTW PIGMGKNFKG VYHILNDEIY LFEAGGERLP

201 HEFDIIKGID NPELEQRFPL EIQQLRDEIE LVQAASNEFN LDEFLAGELT

251 PVFFGSAINN FGIQEILNSL IDWAPAPKPR DATVRMVEPD EPKFSGFIFK

301 IQANMDPKHR DRIAFLRVCS GKFERGMKMK HLRINREIAA SSVVTFMSHD

351 RELVEEAYAG DIIGIPNHGN IQIGDSFSEG EQLAFTGIPF FAPELFRSVR

401 IKNPLKIKQL QKGLQQLGEE GAVQVFKPMS GADLILGAVG VLQFEVVTSR

451 LANEYGVEAV FDSASIWSAR WVSCDDKKKL AEFEKANAGN LAIDAGGNLA

501 YLAPNRVNLG LTQERWPDIV FHETREHSVK L*
```

Computer analysis of this amino acid sequence gave the following results:
Homology with a Predicted ORF from *N. gonorrhoeae*
ORF 134 shows 98.7% identity over a 531 aa overlap with a predicted ORF (ORF 134.ng) from *N. gonorrhoeae*:

```
m134/g134
                    10         20         30         40         50         60
     m134.pep  MSQEILDQVRRRRTFAIISHPDAGKTTLTEKLLLFSGAIQSAGTVKGKKTGKFATSDWME
               ||||||||||||||||||||||||||||||||||||||||||||||||||||||||||:
     g134      MSQEILDQVRRRRTFAIISHPDAGKTTLTEKLLLFSGAIQSAGTVKGKKTGKFATSDWMD
                    10         20         30         40         50         60

70         80         90        100        110        120
     m134.pep  IEKQRGISVASSVMQFDYKDHTVNLLDTPGHQDFSEDTYRVLTAVDSALMVIDAAKGVEA
               ||||||||||||||||||||||||||||||||||||||||||||||||||||||||||||
     g134      IEKQRGISVASSVMQFDYKDHTVNLLDTPGHQDFSEDTYRVLTAVDSALMVIDAAKGVEA
                    70         80         90        100        110        120

130        140        150        160        170        180
     m134.pep  QTIKLLNVCRLRDTPIVTFMNKYDREVRDSLELLDEVENILKIRCAPVTWPIGMGKNFKG
               |||||||||||||||||||||||||||||||||||||||:|:||||||||||||||||||
     g134      QTIKLLNVCRLRDTPIVTFMNKYDREVRDSLELLDEVEDILQIRCAPVTWPIGMGKNFKG
                   130        140        150        160        170        180

190        200        210        220        230        240
     m134.pep  VYHILNDEIYLFEAGGERLPHEFDIIKGIDNPELEQRFPLEIQQLRDEIELVQAASNEFN
               ||||||||||||||||||||||||||||||:|||||||||||||||||||||||||||||
     g134      VYHILNDEIYLFEAGGERLPHEFDIIKGINNPELEQRFPLEIQQLRDEIELVQAASNEFN
                   190        200        210        220        230        240
```

-continued

```
                    250       260       270       280       290       300
m134.pep     LDEFLAGELTPVFFGSAINNFGIQEILNSLIDWAPAPKPRDATVRMVEPDEPKFSGFIFK
             |||||||||||||||||||||||||||||||||||||||||||:||| ||||||||||||
g134         LDEFLAGELTPVFFGSAINNFGIQEILNSLIDWAPAPKPRDATMRMVGPDEPKFSGFIFK
                    250       260       270       280       290       300
                    310       320       330       340       350       360
m134.pep     IQANMDPKHRDRIAFLRVCSGKFERGMKMKHLRINREIAASSVVTFMSHDRELVEEAYAG
             |||||||||||||||||||||||||||||||||||||||||||||||||||||:||||||
g134         IQANMDPKHRDRIAFLRVCSGKFERGMKMKHLRINREIAASSVVTFMSHDRELAEEAYAG
                    310       320       330       340       350       360
                    370       380       390       400       410       420
m134.pep     DIIGIPNHGNIQIGDSFSEGEQLAFTGIPFFAPELFRSVRIKNPLKIKQLQKGLQQLGEE
             ||||||||||||||||||||||||||||||||||||||||||||||||||||||||||||
g134         DIIGIPNHGNIQIGDSFSEGEQLAFTGIPFFAPELFRSVRIKNPLKIKQLQKGLQQLGEE
                    370       380       390       400       410       420
                    430       440       450       460       470       480
m134.pep     GAVQVFKPMSGADLILGAVGVLQFEVVTSRLANEYGVEAVFDSASIWSARWVSCDDKKKL
             ||||||||||||||||||||||||||||||||||||||||||||||||||||||||||||
g134         GAVQVFKPMSGADLILGAVGVLQFEVVTSRLANEYGVEAVFDSASIWSARWVSCDDKKKL
                    430       440       450       460       470       480
                    490       500       510       520       530
m134.pep     AEFEKANAGNLAIDAGGNLAYLAPNRVNLGLTQERWPDIVFHETREHSVKLX
             ||||||||||||||||||||||||||||||||||||||||||||||||||||
g134         AEFEKANAGNLAIDAGGNLAYLAPNRVNLGLTQERWPDIVFHETREHSVKLX
                    490       500       510       520       530
```

The following partial DNA sequence was identified in *N. meningitidis* <SEQ ID 515>:

```
a134.seq
   1 ATGTCCCAAG AAATCCTCGA CCAAGTGCGC CGCCGCCGCA CGTTTGCCAT
  51 CATCTCCCAC CCTGACGCAG GTAAAACCAC GTTGACTGAA AAACTCTTGC
 101 TGTTTTCAGG TGCGATTCAA AGCGCGGGTA CGGTAAAAGG CAAGAAAACC
 151 GGCAAATTCG CCACCTCCGA CTGGATGGAC ATCGAGAAGC AGCGCGGCAT
 201 TTCCGTGGCA TCAAGCGTGA TGCAGTTCGA CTATAAAGAC CACACCGTCA
 251 ACCTTTTGGA CACGCCGGGA CACCAAGACT TCTCCGAAGA CACCTACCGC
 301 GTTTTGACCG CCGTCGATAG TGCCTTGATG GTCATCGACG CGGCAAAAGG
 351 CGTGGAAGCG CAAACCATCA AACTCTTGAA CGTCTGCCGC CTGCGCAATA
 401 CGCCGATTGT TACGTTCATG AACAAATACG ACCGCGAAGT GCGCGATTCC
 451 CTGGAATTGC TGGACGAAGT GGAAAACATC CTGCAAATCC GCTGCGCGCC
 501 CGTAACCTGG CCGATCGGCA TGGGCAAAAA CTTCAAAGGC GTGTACCACA
 551 TCCTGAACGA CGAAATCTAT CTCTTTGAAG CGGGCGGCGA ACGCTTGCCG
 601 CACGAGTTCG ACATCATCAA AGGCATCGAT AATCCCGAAT TGGAACAACG
 651 CTTTCCGTTA GAAATACAGC AGTTGCGCGA CGAAATCGAA TTGGTGCAGG
 701 CGGCTTCCAA CGAGTTCAAT CTCGACGAAT TCCTCGCCGG CGAACTCACG
 751 CCCGTATTCT TCGGCTCTGC GATTAACAAC TTCGGTATTC AGGAAATCCT
 801 CAATTCATTG ATTGAATGGG CGCCCGCGCC GAAACCACGC GATGCGACCG
 851 TGCGTATGGT CGAGCCGGAC GAGCCGAAGT TTTCCGGATT TATCTTCAAA
 901 ATCCAAGCCA ATATGGACCC GAAACACCGC GACCGTATTG CCTTCTTGCG
 951 CGTCTGCTCC GGCAAATTCG AGCGCGGCAT GAAAATGAAA CACCTGCGTA
1001 TCAACCGCGA AATCGCCGCC TCCAGCGTGG TAACCTTCAT GTCCCACGAC
1051 CGCGAGCTGG TTGAAGAAGC CTACGCCGGC GACATTATCG GTATCCCAAA
1101 CCACGGCAAC ATCCAAATCG GCGACAGCTT CTCCGAAGGC GAACAACTGA
```

-continued

```
1151 CGTTTACCGG CATCCCATTC TTCGCGCCCG AACTGTTCCG CAGCGTTCGC

1201 ATCAAAAACC CGCTGAAAAT CAAGCAACTG CAAAAAGGTT TGCAACAGCT

1251 TGGCGAAGAA GGTGCGGTGC AGGTGTTCAA ACCAATGAGC GGCGCGGATT

1301 TGATTTTGGG CGCGGTCGGC GTGTTGCAGT TTGAAGTCGT TACCTCGCGC

1351 CTTGCCAACG AATACGGCGT GGAAGCCGTG TTCGACAACG CATCCATCTG

1401 GTCGGCGCGC TGGGTATCGT GCGACGACAA GAAAAAACTG GCGGAATTTG

1451 AAAAAGCCAA CGCGGGCAAC CTCGCCATCG ACGCGGGCGG CAACCTCGCC

1501 TACCTCGCGC CTAACCGCGT GAATCTGGGA CTCACGCAAG AACGCTGGCC

1551 GGACATCGTG TTCCACGAAA CGCGCGAGCA TTCGGTCAAA CTTTAA
```

This corresponds to the amino acid sequence <SEQ ID 516; ORF 134.a>:

```
a134.pep
  1 MSQEILDQVR RRRTFAIISH PDAGKTTLTE KLLLFSGAIQ SAGTVKGKKT

51 GKFATSDWMD IEKQRGISVA SSVMQFDYKD HTVNLLDTPG HQDFSEDTYR

101 VLTAVDSALM VIDAAKGVEA QTIKLLNVCR LRNTPIVTFM NKYDREVRDS

151 LELLDEVENI LQIRCAPVTW PIGMGKNFKG VYHILNDEIY LFEAGGERLP

201 HEFDIIKGID NPELEQRFPL EIQQLRDEIE LVQAASNEFN LDEFLAGELT

251 PVFFGSAINN FGIQEILNSL IEWAPAPKPR DATVRMVEPD EPKFSGFIFK

301 IQANMDPKHR DRIAFLRVCS GKFERGMKMK HLRINREIAA SSVVTFMSHD

351 RELVEEAYAG DIIGIPNHGN IQIGDSFSEG EQLTFTGIPF FAPELFRSVR

401 IKNPLKIKQL QKGLQQLGEE GAVQVFKPMS GADLILGAVG VLQFEVVTSR

451 LANEYGVEAV FDNASIWSAR WVSCDDKKKL AEFEKANAGN LAIDAGGNLA

501 YLAPNRVNLG LTQERWPDIV FHETREHSVK L*
``` m134/a134 98.9% identity in 531 aa overlap

```
                 10         20         30         40         50         60
m134.pep  MSQEILDQVRRRRTFAIISHPDAGKTTLTEKLLLFSGAIQSAGTVKGKKTGKFATSDWME
          ||||||||||||||||||||||||||||||||||||||||||||||||||||||||||||:
a134      MSQEILDQVRRRRTFAIISHPDAGKTTLTEKLLLFSGAIQSAGTVKGKKTGKFATSDWMD
                 10         20         30         40         50         60

70         80         90        100        110        120
m134.pep  IEKQRGISVASSVMQFDYKDHTVNLLDTPGHQDFSEDTYRVLTAVDSALMVIDAAKGVEA
          ||||||||||||||||||||||||||||||||||||||||||||||||||||||||||||
a134      IEKQRGISVASSVMQFDYKDHTVNLLDTPGHQDFSEDTYRVLTAVDSALMVIDAAKGVEA
                 70         80         90        100        110        120

130        140        150        160        170        180
m134.pep  QTIKLLNVCRLRDTPIVTFMNKYDREVRDSLELLDEVENILKIRCAPVTWPIGMGKNFKG
          |||||||||||:||||||||||||||||||||||||||||:|||||||||||||||||||
a134      QTIKLLNVCRLRNTPIVTFMNKYDREVRDSLELLDEVENILQIRCAPVTWPIGMGKNFKG
                130        140        150        160        170        180

190        200        210        220        230        240
m134.pep  VYHILNDEIYLFEAGGERLPHEFDIIKGIDNPELEQRFPLEIQQLRDEIELVQAASNEFN
          ||||||||||||||||||||||||||||||||||||||||||||||||||||||||||||
a134      VYHILNDEIYLFEAGGERLPHEFDIIKGIDNPELEQRFPLEIQQLRDEIELVQAASNEFN
                190        200        210        220        230        240

250        260        270        280        290        300
m134.pep  LDEFLAGELTPVFFGSAINNFGIQEILNSLIDWAPAPKPRDATVRMVEPDEPKFSGFIFK
          |||||||||||||||||||||||||||||||:||||||||||||||||||||||||||||
a134      LDEFLAGELTPVFFGSAINNFGIQEILNSLIEWAPAPKPRDATVRMVEPDEPKFSGFIFK
                250        260        270        280        290        300
```

```
              310        320        330        340        350        360
m134.pep   IQANMDPKHRDRIAFLRVCSGKFERGMKMKHLRINREIAASSVVTFMSHDRELVEEAYAG
           ||||||||||||||||||||||||||||||||||||||||||||||||||||||||||||
a134       IQANMDPKHRDRIAFLRVCSGKFERGMKMKHLRINREIAASSVVTFMSHDRELVEEAYAG
              310        320        330        340        350        360

370        380        390        400        410        420
m134.pep   DIIGIPNHGNIQIGDSFSEGEQLAFTGIPFFAPELFRSVRIKNPLKIKQLQKGLQQLGEE
           ||||||||||||||||||||||||||:|||||||||||||||||||||||||||||||||
a134       DIIGIPNHGNIQIGDSFSEGEQLTFTGIPFFAPELFRSVRIKNPLKIKQLQKGLQQLGEE
              370        380        390        400        410        420

430        440        450        460        470        480
m134.pep   GAVQVFKPMSGADLILGAVGVLQFEVVTSRLANEYGVEAVFDSASIWSARWVSCDDKKKL
           |||||||||||||||||||||||||||||||||||||||||:||||||||||||||||||
a134       GAVQVFKPMSGADLILGAVGVLQFEVVTSRLANEYGVEAVFDNASIWSARWVSCDDKKKL
              430        440        450        460        470        480

490        500        510        520        530
m134.pep   AEFEKANAGNLAIDAGGNLAYLAPNRVNLGLTQERWPDIVFHETREHSVKLX
           ||||||||||||||||||||||||||||||||||||||||||||||||||||
a134       AEFEKANAGNLAIDAGGNLAYLAPNRVNLGLTQERWPDIVFHETREHSVKLX
              490        500        510        520        530
```

The following partial DNA sequence was identified in *N. gonorrhoeae* <SEQ ID 517>:

```
g135.seq
   1 ATGAAATACA AAAGAATCGT ATTTAAAGTC GGCACATCTT CGATTACCCG

51 TTCGGAcgGC AGCCTCTCGC GCGGCAAAAT CCAAACCATC ACCCGCCAGC

101 TTGCCGCATT GCATCATGCG GGACACGAGC TGGTCTTGGT GTCTTCCGGC

151 GCGGTTGCTG CAGGGTTCGG CGCGCTGGGT TTCAAAAAAC GTCCGGTCAA

201 AATCGCCGAC AAACAGGCTT CCGCCGCCGT CGGGCAGGGG CTGCTGATGG

251 AAGAATATAC GGCAAACCTG TCTTCAGACG GCATCGTGTC CGCACAAATC

301 CTGCTCAGCC GTGCCGACTT TGCCGACAAA CGCCGCTACC AAAATGCCGG

351 CGGCGCACTT TCCGTGCTGC TGCAACGCCG CGCGATTCCC ATCATCAATG

401 AAAACGACAC GGTTTCGGTT GAGGAGTTGA AAATCGGCGA CAACGACACA

451 TTGAGTGCGC AAGTGGCGGC GATGATACAG GCAGACCTCT TGGTGCTGCT

501 GACCGACATA GACGGTCTTT ACACCGGCAA CCCGAACAGC AATCCCGATG

551 CCGTACGGCT GGACAAAATC GAACACATCA ACCATGAAAT CATCGAAATG

601 GCGGGCGGCT CGGGTTCGGC AAACGGCACG GGCGGTATGC TGACCAAAAT

651 CAAAGCGGCA ACCATCGCCG CCGAATCCGG CGTACCGGTG TATATCTGTT

701 CCTCACTCAA ACCCGATTCA TTGGCCGAAG CCGCCGAACA TCAGGCGGAC

751 GGCTCGTTTT TCGTcccCcg tgCCAAAGGT TTGCGGACAC AGAAGCAATG

801 GctggCGTTC TATTCcgaaa gcggGGgcag cgttTAtgtg gacgaaagtg 851 cggaacacgc tTtgtccgaa caagggaaag cctgCTGA
```

This corresponds to the amino acid sequence <SEQ ID 518; ORF 135.ng>:

```
g135.pep
   1 MKYKRIVFKV GTSSITRSDG SLSRGKIQTI TRQLAALHHA GHELVLVSSG

51 AVAAGFGALG FKKRPVKIAD KQASAAVGQG LLMEEYTANL SSDGIVSAQI

101 LLSRADFADK RRYQNAGGAL SVLLQRRAIP IINENDTVSV EELKIGDNDT
```

```
-continued
151 LSAQVAAMIQ ADLLVLLTDI DGLYTGNPNS NPDAVRLDKI EHINHEIIEM

201 AGGSGSANGT GGMLTKIKAA TIAAESGVPV YICSSLKPDS LAEAAEHQAD

251 GSFFVPRAKG LRTQKQWLAF YSESGGSVYV DESAEHALSE QGKAC*
```

The following partial DNA sequence was identified in *N. meningitidis* <SEQ ID 519>:

```
m135.seq.
   1 ATGAAATACA AAAGAATCGT ATTTAAAGTC GGCACATCTT CGATTACCCA

51 TTCGGACGGC AGTCTCTCGC GCGGCAAAAT CCAAACCATC ACCTGCCAGC

101 TTGCCGCATT GCATCATGCG GGACACGAGC TGGTCTTGGT GTCTTCCGGC

151 GCGGTTGCGG CAGGGTTCGG TGCGCTGGGT TTCAAAAAAC GTCCGGTCAA

201 AATCGCCGAC AAACAGGCTT CCGCCGCCGT CGGGCAGGGG CTGCTGATGG

251 AAGAATATAC GGCAAACCTG TCTTCAGACG GCATCGTGTC CGCGCAAATC

301 CTGCTCAGCC GCGCCGACTT TGCCGACAAA CGCCGCTACC AAAATGCCGG

351 CGGCGCACTT TCCGTGCTGC TGCAACGCCG CGCCGTCCCC ATCATCAATG

401 AAAACGATAC GGTTTCGGTT GAGGAATTGA AAATCGGCGA CAACGACACA

451 TTGAGTGCGC AAGTGGCGGC GATGATACAG GCAGACCTCT TGGTGCTGCT

501 GACCGACATA GACGGTCTTT ACACGGGCAA CCCGAACAGC AATCCCGATG

551 CCGTACGGCT GGACAAAATC GAACACATCA ACCATGAAAT CATCGAAATG

601 GCGGGCGGCT CGGGTTCGGC AAACGGCACG GGCGGTATGC TGACCAAAAT

651 CAAAGCGGCA ACCATCGCCG CCGAATCCGG CGTACCGGTG TATATCTGTT

701 CCTCGCTCAA ACCCGATGCA CTTGCCGAAG CTGCCGAACA TCAGGCGGAC

751 GGCTCGTTTT TCGTCCCCCG TGCCAAAGGT TTGCGGACGC AGAAGCAATG

801 GCTGGCGTTC TATTCCGAAA GCCGGGGCAG CGTTTATGTG GACGAAGGTG

851 CGGAACACGC TTTGTCCGAA CAGGGGAAAA GCCTGCTGAT GTCGGGCATT

901 GCCGGAATCG AAGGGCATTT TTCCCGTATG GACACCGTAA CCGTGTACAG

951 CAAGGCAACC AAACAGCCCC TGGGCAAAGG GCGCGTCCTG TTCGGCTCTG

1001 CCGCCGCCGA AGACCTGCTC AAATCGCGTA AGGCGAAAGG CGTGTTCATC

1051 CATCGGGACG ACTGGATTTC CATCACGCCC GAAATACGCC TGCTTCTGAC

1101 CGAATTTTAG
```

This corresponds to the amino acid sequence <SEQ ID 520; ORF 135>:

```
m135.pep
   1 MKYKRIVFKV GTSSITHSDG SLSRGKIQTI TCQLAALHHA GHELVLVSSG

51 AVAAGFGALG FKKRPVKIAD KQASAAVGQG LLMEEYTANL SSDGIVSAQI

101 LLSRADFADK RRYQNAGGAL SVLLQRRAVP IINENDTVSV EELKIGDNDT

151 LSAQVAAMIQ ADLLVLLTDI DGLYTGNPNS NPDAVRLDKI EHINHEIIEM

201 AGGSGSANGT GGMLTKIKAA TIAAESGVPV YICSSLKPDA LAEAAEHQAD

251 GSFFVPRAKG LRTQKQWLAF YSESRGSVYV DEGAEHALSE QGKSLLMSGI

301 AGIEGHFSRM DTVTVYSKAT KQPLGKGRVL FGSAAAEDLL KSRKAKGVFI

351 HRDDWISITP EIRLLLTEF*
```

Computer analysis of this amino acid sequence gave the following results:
Homology with a Predicted ORF from *N. gonorrhoeae*
ORF 135 shows 97.6% identity over a 294 aa overlap with a predicted ORF (ORF 135.ng) from *N. gonorrhoeae*:

```
m135/g135

10         20         30         40         50         60
   m135.pep  MKYKRIVFKVGTSSITHSDGSLSRGKIQTITCQLAALHHAGHELVLVSSGAVAAGFGALG
             ||||||||||||||:||||||||||||||| ||||||||||||||||||||||||||||
   g135      MKYKRIVFKVGTSSITRSDGSLSRGKIQTITRQLAALHHAGHELVLVSSGAVAAGFGALG
                    10         20         30         40         50         60
                    70         80         90        100        110        120
   m135.pep  FKKRPVKIADKQASAAVGQGLLMEEYTANLSSDGIVSAQILLSRADFADKRRYQNAGGAL
             ||||||||||||||||||||||||||||||||||||||||||||||||||||||||||||
   g135      FKKRPVKIADKQASAAVGQGLLMEEYTANLSSDGIVSAQILLSRADFADKRRYQNAGGAL
                    70         80         90        100        110        120
                   130        140        150        160        170        180
   m135.pep  SVLLQRRAVPIINENDTVSVEELKIGDNDTLSAQVAAMIQADLLVLLTDIDGLYTGNPNS
             ||||||||:|||||||||||||||||||||||||||||||||||||||||||||||||||
   g135      SVLLQRRAIPIINENDTVSVEELKIGDNDTLSAQVAAMIQADLLVLLTDIDGLYTGNPNS
                   130        140        150        160        170        180
                   190        200        210        220        230        240
   m135.pep  NPDAVRLDKIEHINHEIIEMAGGSGSANGTGGMLTKIKAATIAAESGVPVYICSSLKPDA
             |||||||||||||||||||||||||||||||||||||||||||||||||||||||||||:
   g135      NPDAVRLDKIEHINHEIIEMAGGSGSANGTGGMLTKIKAATIAAESGVPVYICSSLKPDS
                   190        200        210        220        230        240
                   250        260        270        280        290        300
   m135.pep  LAEAAEHQADGSFFVPRAKGLRTQKQWLAFYSESRGSVYVDEGAEHALSEQGKSLLMSGI
             |||||||||||||||||||||||||||||||||||:|||||||:||||||||||
   g135      LAEAAEHQADGSFFVPRAKGLRTQKQWLAFYSESGGSVYVDESAEHALSEQGKACX
                   250        260        270        280        290
                   310        320        330        340        350        360
   m135.pep  AGIEGHFSRMDTVTVYSKATKQPLGKGRVLFGSAAAEDLLKSRKAKGVFIHRDDWISITP
```

The following partial DNA sequence was identified in *N. meningitidis* <SEQ ID 521>:

```
a135.seq
   1 ATGAAATACA AAAGAATCGT ATTTAAAGTC GGCACATCTT CGATTACCCA

51 TTCGGACGGC AGTCTCTCGC GCGGCAAAAT CCAAACCATC ACCCGCCAGC

101 TTGCCGCATT GCATCATGCG GGACACGAGC TGGTCTTGGT GTCTTCCGGC

151 GCGGTTGCGG CAGGGTTCGG TGCGCTGGGT TTCAAAAAAC GTCCGGTCAA

201 AATCGCCGAC AAACAGGCTT CCGCCGCCGT CGGGCAGGGG CTGCTGATGG

251 AAGAATATAC GGCAAACCTG TCTTCAGACG GCATCGTGTC CGCACAAATC

301 CTGCTCAGCC GCGCCGACTT TGCCGACAAA CGCCGCTACC AAAATGCCGG

351 CGGCGCACTT TCCGTGCTGC TGCAACGCCG CGCCGTCCCC ATCATCAATG

401 AAAACGATAC GGTTTCGGTT GAGGAATTGA AAATCGGCGA CAACGACACA

451 TTGAGTGCGC AAGTGGCGGC GATGATACAG GCAGACCTCT TGGTGCTGCT

501 GACCGACATA GACGGTCTTT ACACCGGCAA CCCGAACAGC AATCCCGATG

551 CCGTACGGCT GGACAAAATC GAACACATCA ACCATGAAAT CATCGAAATG

601 GCGGGCGGCT CGGGTTCGGC AAACGGCACA GGCGGTATGC TGACTAAAAT

651 CAAAGCGGCG ACGATTGCGA CCGAGTCCGG CGTACCGGTC TATATCTGTT

701 CCTCGCTCAA ACCCGATGCA CTTGCCGAAG CGGCAGATAA TCAGGCGGAC

751 GGCTCGTTTT TCGTCCCCCG TGCCAAAGGT TTGCGGACGC AGAAGCAATG

801 GCTGGCGTTC TATTCCGAAA GCAGGGGCGG CGTTTATGTG GACGAAGGTG
```

```
 851 CGGAACACGC TTTGTCCGAA CAGGGAAAAA GCCTGCTGAT GTCGGCATT

901 GCCGGAATCG AAGGGCATTT TTCCCGTATG GACACCGTAA CCGTGTACAG

951 CAAGGCAACC AAACAGCCTT TGGGCAAAGG GCGAGTCCTG TTCGGCTCTG

1001 CCGCCGCCGA AGACCTGCTC AAATTGCGTA AGGCGAAAGG CGTGTTCATC

1051 CATCGGGACG ACTGGATTTC CATCACGCCC GAAATACGCC TGCTTCTGAC

1101 CGAATTTTAG
```

This corresponds to the amino acid sequence <SEQ ID 522; ORF 135.a>:

```
a135.pep
  1 MKYKRIVFKV GTSSITHSDG SLSRGKIQTI TRQLAALHHA GHELVLVSSG

51 AVAAGFGALG FKKRPVKIAD KQASAAVGQG LLMEEYTANL SSDGIVSAQI

101 LLSRADFADK RRYQNAGGAL SVLLQRRAVP IINENDTVSV EELKIGDNDT

151 LSAQVAAMIQ ADLLVLLTDI DGLYTGNPNS NPDAVRLDKI EHINHEIIEM

201 AGGSGSANGT GGMLTKIKAA TIATESGVPV YICSSLKPDA LAEAADNQAD

251 GSFFVPRAKG LRTQKQWLAF YSESRGGVYV DEGAEHALSE QGKSLLMSGI

301 AGIEGHFSRM DTVTVYSKAT KQPLGKGRVL FGSAAAEDLL KLRKAKGVFI

351 HRDDWISITP EIRLLLTEF*
``` m135/a135 98.4% identity in 369 aa overlap

```
                 10         20         30         40         50         60
m135.pep  MKYKRIVFKVGTSSITHSDGSLSRGKIQTITCQLAALHHAGHELVLVSSGAVAAGFGALG
          ||||||||||||||||||||||||||||||| |||||||||||||||||||||||||||
a135      MKYKRIVFKVGTSSITHSDGSLSRGKIQTITRQLAALHHAGHELVLVSSGAVAAGFGALC
                 10         20         30         40         50         60

70         80         90        100        110        120
m135.pep  FKKRPVKIADKQASAAVGQGLIMEEYTANLSSDGIVSAQILLSRADFADKRRYQNAGGAL
          ||||||||||||||||||||||||||||||||||||||||||||||||||||||||||||
a135      FKKRPVKIADKQASAAVGQGLIMEEYTANLSSDGIVSAQILLSRADFADKRRYQNAGGAL
                 70         80         90        100        110        120

130        140        150        160        170        180
m135.pep  SVLLQRRAVPIINENDTVSVEELKIGDNDTLSAQVAAMIQADLLVLLTDIDGLYTGNPNS
          ||||||||||||||||||||||||||||||||||||||||||||||||||||||||||||
a135      SVLLQRRAVPIINENDTVSVEELKIGDNDTLSAQVAAMIQADLLVLLTDIDGLYTGNPNS
                130        140        150        160        170        180

190        200        210        220        230        240
m135.pep  NPDAVRLDKIEHINHEIIEMAGGSGSANGTGGMLTKIKAATIAAESGVPVYICSSLKPDA
          |||||||||||||||||||||||||||||||||||||||||||:||||||||||||||||
a135      NPDAVRLDKIEHINHEIIEMAGGSGSANGTGGMLTKIKAATIATESGVPVYICSSLKPDA
                190        200        210        220        230        240

250        260        270        280        290        300
m135.pep  LAEAAEHQADGSFFVPRAKGLRTQKQWLAFYSESRGSVYVDEGAEHALSEQGKSLLMSGI
          |||||::|||||||||||||||||||||||||||||:|||||||||||||||||||||||
a135      LAEAADNQADGSFFVPRAKGLRTQKQWLAFYSESRGGVYVDEGAEHALSEQGKSLLMSGI
                250        260        270        280        290        300

310        320        330        340        350        360
m135.pep  AGIEGHFSRMDTVTVYSKATKQPLGKGRVLFGSAAEDLLKSRAKAKGVFIHRDDWISITP
          ||||||||||||||||||||||||||||||||||| ||||| |||||||||||||||||
a135      AGIEGHFSRMDTVTVYSKATKQPLGKGRVLFGSAAAEDLLKLRKAKGVFIHRDDWISITP
                310        320        330        340        350        360

370
m135.pep  EIRLLLTEFX
          ||||||||||
a135      EIRLLLTEFX
                370
```

The following partial DNA sequence was identified in *N. gonorrhoeae* <SEQ ID 523>:

```
g136.seq
    1 ATGGAAATCC GGTTTCAGAC AGCATTTTTA CGTTTGGTTC AGatgaAAAC

51 AAACGCTtca aTTCTtaccg caACACGCCT TGTATTTCCT GccgCTGCCG

101 CACGGACAGG GATCGTTCCT GCCGgtTTTT TCCCCTTCCC TGCGGACGGT

151 TTGCGGTTTG TTGATGACCG CCTGCCAGTA GCGGTAGATG TCtgccagcg 201 cgTAAGGCag tTCGGAcgca agttccgcca gctcgccttc ggTGAATTGC 251 AGgcggataa cgccgttttC CTCTTCGTCg taaatgccgc ccactgccat 301 cacgGGGTAA AACAGCTCTT CAAACGCTTC ATCATCGGCG GCTTCAAACC

351 AATCGGTCGG CACAATGTCC AAACCGTAAA GATAGGCGTT GCACCAAGTG

401 TAAAAATCGC TGCCGCCCTC GCCGTCGTCG TAGAGCCACA AATCGGGCAG

451 CTTTTTATCC GACATCGCGG CGGTTGTTTC CATCGCCATT GCCAAAACCA

501 GCCGTTCGAT TTCGGAACGT TCGGCGGCGG TAAATTGCGA TTCGTCGCCC

551 AACACTTCGG GCAGCCAGTC GAGCGGTGCC AATTTGTCCG GCCCGCTCAA

601 CAGCGCCGTC ATAAAACCTT GAACCTCGTC GCAACGCATC GTGTTGCCTT

651 GTTCGCTTTT GGCATCCAAT AA
```

This corresponds to the amino acid sequence <SEQ ID 524; ORF 136.ng>:

```
g136.pep
    1 MEIRFQTAFL RLVQMKTNAS ILTATRLVFP AAAARTGIVP AGFFPFPADG

51 LRFVDDRLPV AVDVCQRVRQ FGRKFRQLAF GELQADNAVF LFVVNAAHCH

101 HGVKQLFKRF IIGGFKPIGR HNVQTVKIGV APSVKIAAAL AVVVEPQIGQ

151 LFIRHRGGCF HRHCQNQPFD FGTFGGGKLR FVAQHFGQPV ERCQFVRPAQ

201 QRRHKTLNLV ATHRVALFAF GIQ*
```
                                                40

The following partial DNA sequence was identified in *N. meningitidis* <SEQ ID 525>:

```
m136.seq
    1 ATGGAAACAA ACGCTTCAAT TCTTACCGCA ACACGCCTTG TATTTCTGC

51 CGCTGCCGCA CGGACAGGGA TCGTTCCTGC CTGTTTTTTC GCCTTCCCTG

101 CGGACGGTTT GCGGTTTGTT GATGACTGCC TGCCAGTAGC GGTAGATATC

151 CGCCAATGCA TAAGGCAACT CGGATTCCAG TTCCGCCAGC TCGCCTTCTG

201 TGAATTGCAG ACGGATAGCG CCGTTTTCCT CTTCGTCGTA AATACCGCCC

251 AATGCCATGA TGGGATAAAA CAACTCTTCA AACGCTTCAT CATCGACGGC

301 TTCAAACCAA TCGGTCGGCA CAATATCCAA ACCGTAAAGA TAAGCATTGC

351 ACCATGTGTA AAAATCGCTG CCGCCGTCTT CGTTTTCATA CAGCCACAAA

401 TCGGGCAGTT TTTTATCCGA CATCGCGGCG GTTGTTTCCA TCGCCATTGC

451 CAAAACCAGC CGTTCGATTT CGGAACGTTC GGCGGCGGTA AATTGCGATT

501 CGTCGCCCAA CACTTCGGGC AGCCAGTCGA GCGGTGTCAA TTTGTCCGGC

551 CCGCTCAACA GCGCCGTCAT AAAACCTTGA ACCTCGTCGC AACGCATCGT

601 GTTGCCTTGT TCGCTTTTGG CATCCAACAA TTCGCTCAAC CGCCGTTTGG
```

-continued
```
651 ATGCTTCGGT AAATTTTCGG GAATCCATCA TTTTCCTTTT CAAATGGGTT

701 TTGCGCCCTA TTATCGCCGC AATGCCGTCT GA
```

This corresponds to the amino acid sequence <SEQ ID 526; ORF 136>:

```
m136.pep
  1 METNASILTA TRLVFSAAAA RTGIVPACFF AFPADGLRFV DDCLPVAVDI

51 RQCIRQLGFQ FRQLAFCELQ TDSAVFLFVV NTAQCHDGIK QLFKRFIIDG

101 FKPIGRHNIQ TVKISIAPCV KIAAAVFVFI QPQIGQFFIR HRGGCFHRHC

151 QNQPFDFGTF GGGKLRFVAQ HFGQPVERCQ FVRPAQQRRH KTLNLVATHR

201 VALFAFGIQQ FAQPPFGCFG KFSGIHHFPF QMGFAPYYRR NAV*
```

Computer analysis of this amino acid sequence gave the following results:

Homology with a Predicted ORF from *N. gonorrhoeae*
ORF 136 shows 85.6% identity over a 209 aa overlap with a predicted ORF (ORF 136.ng) from *N. gonorrhoeae*:

```
m136/g136
                         10         20         30         40
   m136.pep          METNASILTATRLVFSAAAARTGIVPACFFAFPADGLRFVDDCLPV
                     |:||||||||||||| |||||||||| || ||||||||||| |||
   g136    MEIRFQTAFLRLVQMKTNASILTATRLVFPAAAARTGIVPAGFFPFPADGLRFVDDRLPV
                10         20         30         40         50         60
               50         60         70         80         90        100
   m136.pep AVDIRQCIRQLGFQFRQLAFCELQTDSAVFLFVVNTAQCHDGIKQLFKRFIIDGFKPIGR
            |||: | :||:| :|||||| |||:|:|||||||:||| |: |||||||:|| |||||
   g136    AVDVCQRVRQFGRKFRQLAFGELQADNAVFLFVVNAAHCHHGVKQLFKRFITGGFKPIGR
               70         80         90        100        110        120
              110        120        130        140        150        160
   m136.pep HNIQTVKISIAPCVKIAAAVFVFIQPGIGQFFIRHRGGCFHRHCQNQPFDFGTFGGGKLR
            ||:|||||::|| ||||||: | :::|||||||||||||||||||||||||||||||||
   g136    HNVQTVKIGVAPSVKIAAALAVVVEPQIGQLFIRHRGGCFHRHCQNQPFDFGTFGGGKLR
               130        140        150        160        170        180
              170        180        190        200        210        220
   m136.pep FVAQHFGQPVERCQFVRPAQQRRHKTLNLVATHRVALFAFGIQQFAQPPFGCFGKFSGIH
            ||||||||||||||||||||||||||||||||||||||||||||
   g136    FVAQHFGQPVERCQFVRPAQQRRHKTLNLVATHRVALFAFGIQX
               190        200        210        220
              230        240
   m136.pep HFPFQMGFAPYYRRNAVX
```

The following partial DNA sequence was identified in *N. meningitidis* <SEQ ID 527>:

```
a136.seq
  1 ATGGAAACAA ACGCTTCAAT TCTTACCGCA ACACGCCTTG TATTTCTGC

51 CGCTGCCGCA CGGACAGGGA TCGTTCCTGC CTGTTTTTTC GCCTTCCCTG

101 CGGACGGTTT GCGGCTTGTT GATGACCGCC TGCCAGTAGC GGTAGATATC

151 CGCCAATGCA TAAGGCAACT CGGATTCCAG TTCCGCCAGC TCGCCTTCTG

201 TGAATTGCAG ACGGATAGTG CCGTTGTCCT CTTCGTCGTA AATACCGCCC

251 AATGCCATGA TGGGATAAAA CAACTCTTCA AACGCTTCAT CATCGACGGC

301 TTCAAACCAA TCGGTCGGCA CAATATCCAA ACCGTAAAGA TAAGCATTGC

351 ACCATGTGTA AAAATCGCTG CCGCCGTCTT CGTTTTCATA CAGCCACAAA

401 TCGGGCAGTT TTTTATCCGA CATCGCGGCG GTTGTTTCCA TCGCCATTGC

451 CAAAACCAGC CGTTCGATTT CGGAACGTTC GGCGGCGGTA AATTGCGATT
```

-continued

```
501 CGTCGCCCAA CACTTCGGGC AGCCAGTCGA GCGGTGTCAA TTTGTCCGGC

551 CCGCTCAACA GCGCCGTCAT AAAACCTTGA ACCTCGTCGC AACGCATCGT

601 GTTGCCTTGT TCGCTTTTGG CATCCAACAA TTCGCTCAAC CGCCGTTTGG

651 ATGCTTCGGT AAATTTTCGG GAATCCATCA TTTTCCTTTT CCAATGGGTT

701 TTGCGCCCTA TTATAGTGGA TTAAATTTAA ATCAGGACAA GGCGACGAAG

751 CCGCAGACAG TACAAATAGT ACGGCAAGGC GAGGCAACGC CGTACTGGTT

801 TAAATTTAAT CCACTATATC GCCGCAATGC CGTCTGA
```

This corresponds to the amino acid sequence <SEQ ID 528; ORF 136.a>:

```
a136.pep
  1 METNASILTA TRLVFSAAAA RTGIVPACFF AFPADGLRLV DDRLPVAVDI

51 RQCIRQLGFQ FRQLAFCELQ TDSAVVLFVV NTAQCHDGIK QLFKRFIIDG

101 FKPIGRHNIQ TVKISIAPCV KIAAAVFVFI QPQIGQFFIR HRGGCFHRHC

151 QNQPFDFGTF GGGKLRFVAQ HFGQPVERCQ FVRPAQQRRH KTLNLVATHR

201 VALFAFGIQQ FAQPPFGCFG KFSGIHHFPF PMGFAPYYSG LNLNQDKATK

251 PQTVQIVRQG EATPYWFKFN PLYRRNAV*
``` m136/a136 98.3% identity in 238 aa overlap

```
                10         20         30         40         50         60
   m136.pep METNASILTATRLVFSAAAARTGIVPACFFAFPADGLRFVDDCLPVAVDIRQCIRQLGFQ
            ||||||||||||||||||||||||||||||||||||||:|||||||||||||||||||||
   a136     METNASILTATRLVFSAAAARTGIVPACFFAFPADGLRLVDDRLPVAVDIRQCIRQLGFQ
                10         20         30         40         50         60

70         80         90        100        110        120
   m136.pep FRQLAFCELQTDSAVFLFVVNTAQCHDGIKQLFKRFIIDGFKPIGRHNIQTVKISIAPCV
            ||||||||||||||| ||||||||||||||||||||||||||||||||||||||||||||
   a136     FRQLAFCELQTDSAVVLFVVNTAQCHDGIKQLFKRFIIDGFKPIGRHNIQTVKISIAPCV
                70         80         90        100        110        120

130        140        150        160        170        180
   m136.pep KIAAAVFVFIQPQIGQFFIRHRGGCFHRHCQNQPFDFGTFGGGKLRFVAQHFGQPVERCQ
            ||||||||||||||||||||||||||||||||||||||||||||||||||||||||||||
   a136     KIAAAVFVFIQPQIGQFFIRHRGGCFHRHCQNQPFDFGTFGGGKLRFVAQHFGQPVERCQ
               130        140        150        160        170        180

190        200        210        220        230        240
   m136.pep FVRPAQQRRHKTLNLVATHRVALFAFGIQQFAQPPFGCFGKFSGIHHFPFQMGFAPYYRR
            |||||||||||||||||||||||||||||||||||||||||||||||||| ||||||
   a136     FVRPAQQRRHKTLNLVATHRVALFAFGIQQFAQPPFGCFGKFSGIHHFPFPMGFAPYYSG
               190        200        210        220        230        240 m136.pep NAVX a136     LNLNQDKATKPQTVQIVRQGEATPYWFKFNPLYRRNAVX
               250        260        270
```

The following partial DNA sequence was identified in *N. gonorrhoeae* <SEQ ID 529>:

```
g137.seq
  1 ATGATTATCC ATCACcaaTT CGATCCCGTC CTCATCAGTA TCGGCCCGCT

51 TGCCGTCCGC TGGTATGCCT TAAGCTACAT CCTCGGATTT ATTCTTTTTA

101 CCTTTCTCGG CAGAAGGCGC ATCGCGCAAG GCTTGTCCGT TTTTACCAAA

151 GAATCGCTCG ACGACTTCCT GACATGGGGC ATTTTGGGCG TGATTTTGGG

201 CGGACGCTTG GGCTATGTCC TGTTTTACAA ATTCTCCGAC TACCTCGCCC

251 ATCCGCTTGA TATTTTCAAG GTATGGGAAG GCGGAATGTC GTTCCACGGC
```

-continued

```
301 GGCTTTTTGG GTGTAGTTAT TGCCATATGG TTGTTCAGCC GCAAGCACGG

351 CATCGGCTTC CTCAAACTGA TGGACACGGT CGCGCCGCTC GTTCCGCTGG

401 GTCTCGCTTC GGGACGTATC GGCAACTTTA TCAACGGCGA ACTTTGGGGA

451 CGCATTACCG ACATTAACGC ATTTTGGGCA ATGGGCTTCC CGCAAGCGCA

501 TTACGAAGAT GCCGAAGCCG CCGCGCACAA TCCGCTTTGG GCAGAATGGC

551 TGCAACAATA CGGTATGCTG CCGCGTCATC CCTCGCAGCT TTATCAGTTT

601 GCCCTTGAAG GCATCTGCCT GTTCGCCGTC GTTTGGCTGT TTTCCAAAAA

651 ACCGCGCCCG ACCGGGCAGA CTGCCGCGCT TTTTCTCGGC GGCTACGGCG

701 TGTTCCGCTT TATTGCCGAA TTTGCGCGCC AACCCGACGA CTATCTCGGG

751 CTGCTGACCT TGGGGCTGTC GATGGGGCAA TGGTTGAGCG TCCCGATGAT

801 TGTTTTGGGT ATCGTCGGCT TTGTCCGGTT CGGCATGAAA AAACAGCACT

851 GA
```

This corresponds to the amino acid sequence <SEQ ID 530; ORF 137.ng>:

```
g137.pep
  1 MIIHHQFDPV LISIGPLAVR WYALSYILGF ILFTFLGRRR IAQGLSVFTK

51 ESLDDFLTWG ILGVILGGRL GYVLFYKFSD YLAHPLDIFK VWEGGMSFHG

101 GFLGVVIAIW LFSRKHGIGF LKLMDTVAPL VPLGLASGRI GNFINGELWG

151 RITDINAFWA MGFPQAHYED AEAAAHNPLW AEWLQQYGML PRHPSQLYQF

201 ALEGICLFAV VWLFSKKPRP TGQTAALFLG GYGVFRFIAE FARQPDDYLG

251 LLTLGLSMGQ WLSVPMIVLG IVGFVRFGMK KQH*
```

The following partial DNA sequence was identified in *N. meningitidis* <SEQ ID 531>:

```
m137.seq
  1 ATGATTACCC ATCCCCAATT CGATCCCGTC CTTATCAGTA TCGGCCCGCT

51 TGCCGTCCGC TGGTATGCCC TAAGCTACAT CCTCGGATTT ATTCTTTTA

101 CCTTTCTCGG CAGAAGGCGC ATCGCGCAAG GCTTGTCCGT TTTTACCAAA

151 GAATCGCTCG ACGACTTCCT GACATGGGGC ATTTTGGGCG TAATTTTGGG

201 CGGGCGTTTG GGTTACGTCC TGTTTTACAA GTTTTCCGAC TACCTCGCCC

251 ATCCGCTTGA TATTTTCAAG GTATGGGAAG GCGGAATGTC GTTCCACGGC

301 GGCTTTTTGG GTGTAGTTAT TGCCATACGG TTGTTCGGCC GCAAACACGG

351 CATCGGCTTC CTCAAACTGA TGGATACGGT CGCACCGCTC GTTCCGCTGG

401 GTCTCGCTTC GGGACGTATC GGCAACTTCA TCAACGGCGA ACTTTGGGGA

451 CGCGTTACCG ACATCAACGC ATTTTGGGCA ATGGGCTTCC CGCAGGCGCG

501 TTACGAAGAT GCCGAAGCCG CCGCGCACAA TCCGCTTTGG GCAGAATGGC

551 TGCAACAATA CGGTATGCTG CCGCGTCATC CCTCGCAGCT TTATCAGTTT

601 GCACTTGAAG GCATCTGCCT GTTCACCGTC ATTTGGCTGT TCTCTAAAAA

651 ACAGCGGTCG ACCGGACAAG TCGCCTCGCT CTTCCTCGGC GGCTACGGCA

701 TATTCCGCTT CATTGCCGAA TTCGCACGCC AACCCGACGA CTATCTCGGG

751 CTGCTGACCT TGGGGCTGTC GATGGGGCAA TGGTTGAGCG TCCCGATGAT
```

-continued

```
801 TGTTTTGGGT ATCGTCGGCT TTGTCCGGTT CGGCATGAAA AAACAGCACT

851 GA
```

This corresponds to the amino acid sequence <SEQ ID 532; ORF 137>:

```
m137.pep
   1 MITHPQFDPV LISIGPLAVR WYALSYILGF ILFTFLGRRR IAQGLSVFTK

51 ESLDDFLTWG ILGVILGGRL GYVLFYKFSD YLAHPLDIFK VWEGGMSFHG

101 GFLGVVIAIR LFGRKHGIGF LKLMDTVAPL VPLGLASGRI GNFINGELWG

151 RVTDINAFWA MGFPQARYED AEAAAHNPLW AEWLQQYGML PRHPSQLYQF

201 ALEGICLFTV IWLFSKKQRS TGQVASLFLG GYGIFRFIAE FARQPDDYLG

251 LLTLGLSMGQ WLSVPMIVLG IVGFVRFGMK KQH*
                                         20
```

Computer analysis of this amino acid sequence gave the following results:

Homology with a Predicted ORF from *N. gonorrhoeae*
ORF 137 shows 95.4% identity over a 283 aa overlap with a predicted ORF (ORF 137.ng) from *N. gonorrhoeae*:

```
m137/g137
                     10         20         30         40         50         60
   m137.pep  MITHPQFDPVLISIGPLAVRWYALSYILGFILFTFLGRRRIAQGLSVFTKESLDDFLTWG
             || | ||||||||||||||||||||||||||||||||||||||||||||||||||||||
   g137      MIIHHQFDPVLISIGPLAVRWYALSYILGFILFTFLGRRRIAQGLSVFTKESLDDFLTWG
                     10         20         30         40         50         60

70         80         90        100        110        120
   m137.pep  ILGVILGGRLGYVLFYKFSDYLAHPLDIFKVWEGGMSFHGGFLGVVIAIRLFGRKHGIGF
             |||||||||||||||||||||||||||||||||||||||| |||||| ||:||||||||
   g133      ILGVILGGRLGYVLFYKFSDYLAHPLDIFKVWEGGMSFHGGFLGVVIAIWLFSRKHGIGF
                     70         80         90        100        110        120

130        140        150        160        170        180
   m137.pep  LKLMDTVAPLVPLGLASGRIGNFINGELWGRVTDINAFWAMGFPQARYEDAEAAAHNPLW
             ||||||||||||||||||||||||||||||||:|||||||||| |||:||||||||||||
   g137      LKLMDTVAPLVPLGLASGRIGNFINGELWGRITDINAFWAMGFPQAHYEDAEAAAHNPLW
                    130        140        150        160        170        180

190        200        210        220        230        240
   m137.pep  AEWLQQYGMLPRHPSQLYQFALEGICLFTVIWLFSKKQRSTGQVASLFLGGYGIFRFIAE
             ||||||||||||||||||||||||||:|||||| || :|:||||||:||||||:||||||
   g137      AEWLQQYGMLPRHPSQLYQFALEGICLFAVVWLFSKKPRPTGQTAALFLGGYGVFRFIAE
                    190        200        210        220        230        240

250        260        270        280
   m137.pep  FARQPDDYLGLLTLGLSMGQWLSVPMIVLGIVGFVRFGMKKQHX
             ||||||||||||||||||||||||||||||||||||||||||||
   g137      FARQPDDYLGLLTLGLSMGQWLSVPMIVLGIVGFVRFGMKKQHX
                    250        260        270        280
```

The following partial DNA sequence was identified in *N. meningitidis* <SEQ ID 533>:

```
a137.seq
   1 ATGATTACCC ATCCCCAATT CGACCCCGTC CTTATCAGTA TCGGCCCGCT

51 TGCCGTCCGC TGGTATGCCC TAAGCTACAT CCTCGGATTT ATTCTTTTTA

101 CCTTTCTCGG CAGAAGGCGC ATCGCGCAAG GCTTGTCCGT TTTTACCAAA

151 GAATCGCTCG ACGACTTCCT GACATGGGGC ATTTTGGGCG TAATTTTGGG

201 CGGGCGTTTG GGTTACGTCC TGTTTTACAA GTTTTCCGAC TACCTCGCCC

251 ATCCGCTTGA TATTTTCAAG GTATGGGAAG GCGGAATGTC GTTCCACGGC

301 GGCTTTTTGG GTGTAGTTAT TGCCATATGG TTGTTCGGTC GCAAACACGG
```

-continued

```
351 CATCGGCTTC CTCAAACTGA TGGACACGGT CGCACCGCTC GTTCCACTGG

401 GTCTCGCTTC GGGACGTATC GGCAACTTCA TCAACGGCGA ACTTTGGGGA

451 CGCGTTACCG ACATCAACGC ATTTTGGGCA ATGGGCTTCC CGCAGGCGCG

501 TTACGAAGAC CTCGAAGCCG CCGCGCACAA TCCGCTTTGG GCAGAATGGC

551 TGCAACAATA CGGTATGCTG CCGCGTCATC CCTCGCAGCT TTATCAGTTT

601 GCACTTGAAG GCATCTGCCT GTTCGCCGTC GTTTGGCTGT TCTCTAAAAA

651 ACAGCGGCCG ACCGGACAAG TCGCCTCACT CTTCCTCGGC GGCTACGGCA

701 TATTCCGCTT CATTGCCGAA TTTGCACGCC AACCCGACGA CTATCTCGGG

751 CTGCTGACCT TGGGGCTGTC GATGGGGCAA TGGTTGAGCG TCCCGATGAT

801 TGTTTTGGGT ATCGTCGGCT TTGTCCGGTT CGGCATGAAA AAACAGCACT

851 GA
```

This corresponds to the amino acid sequence <SEQ ID 534; ORF 137.a>:

```
a137.pep
  1 MITHPQFDPV LISIGPLAVR WYALSYILGF ILFTFLGRRR IAQGLSVFTK

51 ESLDDFLTWG ILGVILGGRL GYVLFYKFSD YLAHPLDIFK VWEGGMSFHG

101 GFLGVVIAIW LFGRKHGIGF LKLMDTVAPL VPLGLASGRI GNFINGELWG

151 RVTDINAFWA MGFPQARYED LEAAAHNPLW AEWLQQYGML PRHPSQLYQF

201 ALEGICLFAV VWLFSKKQRP TGQVASLFLG GYGIFRFIAE FARQPDDYLG

251 LLTLGLSMGQ WLSVPMIVLG IVGFVRFGMK KQH*
``` m137/a137 98.2% identity in 283 aa overlap

```
                 10         20         30         40         50         60
  m137.pep MITHPQFDPVLISIGPLAVRWYALSYILGFILFTFLGRRRIAQGLSVFTKESLDDFLTWG
           ||||||||||||||||||||||||||||||||||||||||||||||||||||||||||||
  a137     MIIHPQFDPVLISIGPLAVRWYALSYILGFILFTFLGRRRIAQGLSVFTKESLDDFLTWG
                 10         20         30         40         50         60

70         80         90        100        110        120
  m137.pep ILGVILGGRLGYVLFYKFSDYLAHPLDIFKVWEGGMSFHGGFLGVVIAIRLFGRKHGIGF
           |||||||||||||||||||||||||||||||||||||||||||||||| |||||||||||
  a137     ILGVILGGRLGYVLFYKFSDYLAHPLDIFKVWEGGMSFHGGFLGVVIAIWLFGRKHGIGF
                 70         80         90        100        110        120

130        140        150        160        170        180
  m137.pep LKLMDTVAPLVPLGLASGRIGNFINGELWGRVTDINAFWAMGFPQARYEDAEAAAHNPLW
           ||||||||||||||||||||||||||||||||||||||||||||||||| ||||||||||
  a137     LKLMDTVAPLVPLGLASGRIGNFINGELWGRVTDINAFWAMGFPQARYEDLEAAAHNPLW
                130        140        150        160        170        180

190        200        210        220        230        240
  m137.pep AEWLQQYGMLPRHPSQLYQFALEGICLFTVIWLFSKKQRSTGQVASLFLGGYGIFRFIAE
           |||||||||||||||||||||||||||||:|:||||||| ||||||||||||||||||||
  a137     AEWLQQYGMLPRHPSQLYQFALEGICLFAVVWLFSKKQRPTGQVASLFLGGYGIFRFIAE
                190        200        210        220        230        240

250        260        270        280
  m137.pep FARQPDDYLGLLTLGLSMGQWLSVPMIVLGIVGFVRFGMKKQHX
           |||||||||||||||||||||||||||||||||||||||||||
  a137     FARQPDDYLGLLTLGLSMGQWLSVPMIVLGIVGFVRFGMKKQHX
                250        260        270        280
```

The following partial DNA sequence was identified in *N. gonorrhoeae* <SEQ ID 535>:

```
g138.seq
  1 ATGGAGTTTG AAAACATTAT TTCCGCCGCc gaCAAGGCGC GTATCCTTGC
```

```
 51 CGAAGCACTG CCTTACAtcc gccgGTTTTC CGGTTCGGTC GCCGTCATCA

101 AGTATGGCGG CAACGCGATG ACCGAACCTG CCTTGAAAGA AGGGTTTGCC

151 CGCGATGTCG TGCTGCTGAA GCTGGTCGGC ATTCATCCCG TCATCGTTCA

201 CGGCGGCGGG CCGCAGATCA ATGCGATGCT TGAAAAAGTC GGCAAAAAGG

251 GCGAATTTGT CCAAGGAATG CGCGTTACCG ACAAAGAGAC GATGGATATT

301 GTCGAAATGG TATTGGGCGG GCACGTCAAC AAGGAAATCG TGTCGATGAT

351 TAACACATAT GGAGGGCACG CGGTCGGCGT GAGCGGGCGC GACGACCATT

401 TCATTAAGGC GAAGAAACTT TTGGTCGATA CGCCCGAACA GAATAGCGTG

451 GACATCGGAC AGGTCGGTAC GGTGGAAAGC ATCGATACCG GTTTGGTTAA

501 AGGGCTGATA GAACGCGGCT GCATTCCCGT CGTCGCCCCC GTCGGCGTAG

551 GTGAAAAAGG CGAAGCGTTC AACATCAACG CCGATTTGGT GGCAGGCAAA

601 TTGGCGGAAG AATTGAACGC CGAAAAACTC TTGATGATGA CGAAtatcgc 651 cgGTGTGATG GACAAAACGG GCAATCTGCT GACCAAACTC acgCCGAAAC

701 GGATTGATGG GCTGATTGCC GACGGCACGC TGTATGGCGG TATGCTGCCG

751 AAAATCGCTT CTGCGGTCGA AGCcgccgtc aACGGTGTGA AAGCCACGCA

801 CATCATCGAC GGCAGGTTGC CCAACGCGCT TTTGCTGGAA ATCTTTACCG

851 ATGCCGGTAT CGGGTCGATG ATTTTAGGCA GAGGGAAGA TGCCTGA
```

This corresponds to the amino acid sequence <SEQ ID 536; ORF 138.ng>:

```
g138.pep
  1 MEFENIISAA DKARILAEAL PYIRRFSGSV AVIKYGGNAM TEPALKEGFA

51 RDVVLLKLVG IHPVIVHGGG PQINAMLEKV GKKGEFVQGM RVTDKETMDI

101 VEMVLGGHVN KEIVSMINTY GGHAVGVSGR DDHFIKAKKL LVDTPEQNSV

151 DIGQVGTVES IDTGLVKGLI ERGCIPVVAP VGVGEKGEAF NINADLVAGK

201 LAEELNAEKL LMMTNIAGVM DKTGNLLTKL TPKRIDGLIA DGTLYGGMLP

251 KIASAVEAAV NGVKATHIID GRLPNALLLE IFTDAGIGSM ILGRGEDA*
```

The following partial DNA sequence was identified in *N. meningitidis* <SEQ ID 537>:

```
m138.seq
  1 ATGGAGTCTG AAAACATTAT TTCCGCCGCC GACAAGGCGC GTATCCTTGC

51 CGAAGCGCTG CCTTACATCC GCCGGTTTTC CGGTTCGGTC GCCGTCATCA

101 AATACGGCGG CAACGCGATG ACCGAACCTG CCTTGAAAGA AGGGTTTGCC

151 CGCGATGTCG TGCTGCTGAA GCTGGTCGGC ATTCATCCCG TCATCGTTCA

201 CGGCGGCGGG CCGCAGATCA ATGCGATGCT TGAAAAAGTC GGCAAAAAGG

251 GTGAGTTTGT CCAAGGAATG CGCGTTACCG ACAAAGAGGC GATGGATATT

301 GTCGAAATGG TGTTGGGCGG GCATGTCAAT AAAGAAATCG TGTCGATGAT

351 TAACACATAT GGCGGACACG CGGTCGGCGT AAGCGGACGC GACGACCATT

401 TCATTAAGGC GAAGAAACTT TTGATCGATA CGCCCGAACA GAATGGCGTG

451 GACATCGGAC AGGTCGGTAC GGTGGAAAGC ATCGATACCG GTTTGGTTAA

501 AGGGCTGATA GAACGTGGCT GCATTCCCGT CGTCGCCCCC GTCGGCGTAG
```

```
-continued
551 GTGAAAAAGG CGAAGCGTTC AACATCAACG CCGATTTGGT AGCAGGCAAA

601 TTGGCGGAAG AATTGAACGC CGAAAAACTC TTGATGATGA CGAATATCGC

651 CGGTGTGATG GACAAAACGG GCAATCTGCT GACCAAACTC ACGCCGAAAC

701 GGATTGATGA ACTGATTGCC GACGGCACGC TGTATGGCGG TATGCTGCCG

751 AAAATCGCTT CTGCGGTCGA AGCCGCCGTC AACGGTGTGA AGCCACGCA

801 TATCATCGAC GGCAGGTTGC CCAACGCGCT TTTGCTGGAA ATCTTTACCG

851 ATGCCGGTAT CGGTTCGATG ATTTTGGGCG GTGGGGAAGA TGCCTGA
```

This corresponds to the amino acid sequence <SEQ ID 538; ORF 138>:

```
m138.pep
  1 MESENIISAA DKARILAEAL PYIRRFSGSV AVIKYGGNAM TEPALKEGFA

51 RDVVLLKLVG IHPVIVHGGG PQINAMLEKV GKKGEFVQGM RVTDKEAMDI

101 VEMVLGGHVN KEIVSMINTY GGHAVGVSGR DDHFIKAKKL LIDTPEQNGV

151 DIGQVGTVES IDTGLVKGLI ERGCIPVVAP VGVGEKGEAF NINADLVAGK

201 LAEELNAEKL LMMTNIAGVM DKTGNLLTKL TPKRIDELIA DGTLYGGMLP

251 KIASAVEAAV NGVKATHIID GRLPNALLLE IFTDAGIGSM ILGGGEDA*
```

Computer analysis of this amino acid sequence gave the following results:
Homology with a Predicted ORF from *N. gonorrhoeae*
ORF 138 shows 98.0% identity over a 298 aa overlap with a predicted ORF (ORF 138.ng) from *N. gonorrhoeae*:

```
m138/g138
                   10         20         30         40         50         60
   m138.pep  MESENIISAADKARILAEALPYIRRFSGSVAVIKYGGNAMTEPALKEGFARDVVLLKLVG
             ||:|||||||||||||||||||||||||||||||||||||||||||||||||||||||||
       g138  MEFENIISAADKARILAEALPYIRRFSGSVAVIKYGGNAMTEPALKEGFARDVVLLKLVG
                   10         20         30         40         50         60
                   70         80         90        100        110        120
   m138.pep  IHPVIVHGGGPQINAMLEKVGKKGEFVQGMRVTDKEAMDIVEMVLGGHVNKEIVSMINTY
             |||||||||||||||||||||||||||||||||||||:||||||||||||||||||||||
       g138  IHPVIVHGGGPQINAMLEKVGKKGEFVQGMRVTDKETMDIVEMVLGGHVNKEIVSMINTY
                   70         80         90        100        110        120
                  130        140        150        160        170        180
   m138.pep  GGHAVGVSGRDDHFIKAKKLLIDTPEQNGVDIGQVGTVESIDTGLVKGLIERGCIPVVAP
             |||||||||||||||||||||:||||||:|||||||||||||||||||||||||||||||
       g138  GGHAVGVSGRDDHFIKAKKLLVDTPEQNSVDIGQVGTVESIDTGLVKGLIERGCIPVVAP
                  130        140        159        160        170        180
                  190        200        210        220        230        240
   m138.pep  VGVGEKGEAFNINADLVAGKLAEELNAEKLLMMTNIAGVMDKTGNLLTKLTPKRIDELIA
             ||||||||||||||||||||||||||||||||||||||||||||||||||||||||| ||
       g138  VGVGEKGEAFNINADLVAGKLAEELNAEKLLMMTNIAGVMDKTGNLLTKLTPKRIDGLIA
                  190        200        210        220        230        240
                  250        260        270        280        290        299
   m138.pep  DGTLYGGMLPKIASAVEAAVNGVKATHIIDGRLPNALLLEIFTDAGIGSMILGGGEDAX
             |||||||||||||||||||||||||||||||||||||||||||||||||||| ||||||
       g138  DGTLYGGMLPKIASAVEAAVNGVKATHIIDGRLPNALLLEIFTDAGIGSMILGRGEDAX
                  250        260        270        280        290
```

The following partial DNA sequence was identified in *N. meningitidis* <SEQ ID 539>:

```
a138.seq
  1  ATGGAGTCTG AAAACATTAT TTCCGCCGCC GACAAGGCGC GTATCCTTGC
```

-continued

```
 51 CGAAGCGCTG CCTTACATCC GCCGGTTTTC CGGTTCGGTC GCCGTCATCA

101 AATACGGCGG CAACGCGATG ACCGAACCTG CCTTGAAAGA AGGGTTTGCC

151 CGCGATGTCG TGCTGCTGAA GCTGGTCGGC ATTCATCCCG TCATCGTTCA

201 CGGCGGCGGG CCGCAGATCA ATGCGATGCT TGAAAAAGTC GGCAAAAAGG

251 GTGAGTTTGT CCAAGGAATG CGCGTTACCG ACAAAGAGGC GATGGATATT

301 GTCGAAATGG TGTTGGGCGG GCATGTCAAT AAAGAAATCG TGTCGATGAT

351 TAACACATAT GGCGGACACG CGGTCGGCGT AAGCGGACGC GACGACCATT

401 TCATTAAGGC GAAGAAACTT TTGATCGATA CGCCCGAACA GAATGGCGTG

451 GACATCGGAC AGGTCGGTAC GGTGGAAAGC ATCGATACCG GTTTGGTTAA

501 AGGGCTGATA AACGTGGCT GCATTCCCGT CGTCGCCCCC GTCGGCGTAG

551 GTGAAAAAGG CGAAGCGTTC AACATCAACG CCGATTTGGT AGCAGGCAAA

601 TTGGCGGAAG AATTGAACGC CGAAAAACTC TTGATGATGA CGAATATCGC

651 CGGTGTGATG GACAAAACGG GCAATCTGCT GACCAAACTC ACGCCGAAAC

701 GGATTGATGA ACTGATTGCC GACGGCACGC TGTATGGCGG TATGCTGCCG

751 AAAATCGCTT CTGCGGTCGA AGCCGCCGTC AACGGCGTGA AGCCACGCA

801 TATCATCGAC GGCAGGGTGC CCAACGCGCT TTTGCTGGAA ATCTTTACCG

851 ATGCCGGTAT CGGTTCGATG ATTTTGGGCG GTGGGGAAGA TGCCTGA
```

This corresponds to the amino acid sequence <SEQ ID 540; ORF 138.a>:

```
a138.pep
  1 MESENIISAA DKARILAEAL PYIRRFSGSV AVIKYGGNAM TEPALKEGFA

51 RDVVLLKLVG IHPVIVHGGG PQINAMLEKV GKKGEFVQGM RVTDKEAMDI

101 VEMVLGGHVN KEIVSMINTY GGHAVGVSGR DDHFIKAKKL LIDTPEQNGV

151 DIGQVGTVES IDTGLVKGLI ERGCIPVVAP VGVGEKGEAF NINADLVAGK

201 LAEELNAEKL LMMTNIAGVM DKTGNLLTKL TPKRIDELIA DGTLYGGMLP

251 KIASAVEAAV NGVKATHIID GRVPNALLLE IFTDAGIGSM ILGGGEDA*
``` m138/a138 99.7% identity in 298 aa overlap

```
                  10         20         30         40         50         60
m138.pep  MESENIISAADKARILAEALPYIRRFSGSVAVIKYGGNAMTEPALKEGFARDVVLLKLVG
          ||||||||||||||||||||||||||||||||||||||||||||||||||||||||||||
g138      MESENIISAADKARILAEALPYIRRFSGSVAVIKYGGNAMTEPALKEGFARDVVLLKLVG
                  10         20         30         40         50         60

70         80         90        100        110        120
m138.pep  IHPVIVHGGGPQINAMLEKVGKKGEFVQGMRVTDKEAMDIVEMVLGGHVNKEIVSMINTY
          ||||||||||||||||||||||||||||||||||||||||||||||||||||||||||||
g138      IHPVIVHGGGPQINAMLEKVGKKGEFVQGMRVTDKEAMDIVEMVLGGHVNKEIVSMINTY
                  70         80         90        100        110        120

130        140        150        160        170        180
m138.pep  GGHAVGVSGRDDHFIKAKKLLIDTPEQNGVDIGQVGTVESIDTGLVKGLIERGCIPVVAP
          ||||||||||||||||||||||||||||||||||||||||||||||||||||||||||||
g138      GGHAVGVSGRDDHFIKAKKLLIDTPEQNGVDIGQVGTVESIDTGLVKGLIERGCIPVVAP
                 130        140        159        160        170        180

190        200        210        220        230        240
m138.pep  VGVGEKGEAFNINADLVAGKLAEELNAEKLLMMTNIAGVMDKTGNLLTKLTPKRIDELIA
          |||||||||||||||||||||||||||||||||||||||||||||||||||||||||| 
g138      VGVGEKGEAFNINADLVAGKLAEELNAEKLLMMTNIAGVMDKTGNLLTKLTPKRIDGLIA
                 190        200        210        220        230        240
```

-continued

```
                  250        260        270        280        290      299
m138.pep  DGTLYGGMLPKIASAVEAAVNGVKATHIIDGRLPNALLLEIFTDAGIGSMILGGGEDAX
          ||||||||||||||||||||||||||||||||||:|||||||||||||||||||||||
g138      DGTLYGGMLPKIASAVEAAVNGVKATHIIDGRVPNALLLEIFTDAGIGSMILGGGEDAX
                  250        260        270        280        290
```

The following partial DNA sequence was identified in *N. gonorrhoeae* <SEQ ID 541>:

```
g139.seq
   1 ATGCGAACCA CCTCAACCTT CCCTACAAAA ACTTTCAAAC CGGCTGCCAT

51 GGCGTTAGCT GTTGCAACAA CACTTTCTGC CTGCTTAggc ggcggcggag 101 gcGGCACTTC TGCTCCCGAC TTTAATGCAG GCGGCACCGG TATCGGCAGC

151 AACAGCAGGG CAACGATAGC GGAATCAGCA GCAGTATCTT ACGCCGGTAT

201 AAAAAACGAA ATGTGCAAAG ACAGAAGCAT GCTCTGTGCC GGTCGGGATG

251 ACGTTGCGGT TACAGACAGG GATGCCAAAA TCAAAGCCCC CCGAATCTGC

301 ATACCGGAGA CTTTTCAAAC CCAAATGACC AATATTAAGA ATATGATCAA

351 CCTCAAACCT GCAATTGAAG CAGGCTATAC AGGACGCGGG GTAGAGGTAG

401 GTATCGTCGA TACAGGCGAA TCCGTCGGCA GCATATCCTT TCCCGAACTG

451 TATGGCAGAA AAGAACACGG CTATAACGAA AATTACAAAA ACAAATTACA

501 AAAACTATAC GGCGTATATG CGGAAGGAAG CGCCTGA
```

This corresponds to the amino acid sequence <SEQ ID 542; ORF 138.ng>:

```
g139.pep
   1 MRTTSTFPTK TFKPAAMALA VATTLSACLG GGGGGTSAPD FNAGGTGIGS

51 NSRATIAESA AVSYAGIKNE MCKDRSMLCA GRDDVAVTDR DAKIKAPRIC

101 IPETFQTQMT NIKNMINLKP AIEAGYTGRG VEVGIVDTGE SVGSISFPEL

151 YGRKEHGYNE NYKNKLQKLY GVYAEGSA*
```

The following partial DNA sequence was identified in *N. meningitidis* <SEQ ID 543>:

```
m139.seq
   1 ATGCGAACGA CCCCAACCTT CCCTACAAAA ACTTTCAAAC CGACTGCCAT

51 GGCGTTAGCT GTTGCAACAA CACTTTCTGC CTGCTTAGGC GGCGGCGGAG

101 GCGGCACTTC TGCGCCCGAC TTCAATGCAG GCGGTACCGG TATCGGCAGC

151 AACAGCAGAG CAACAACAGC GAAATCAGCA GCAGTATCTT ACGCCGGTAT

201 CAAGAACGAA ATGTGCAAAG ACAGAAGCAT GCTCTGTGCC GGTCGGGATG

251 ACGTTGCGGT TACAGACAGG GATGCCAAAA TCAATGCCCC CCCCCGAATC

301 TGCATACCGG AGACTTTCCA AACCCAAATG ACGCATtACA AGAATTTGAT

351 CAACCTCAAA CCTGCAATTG AAGCAGGCTA TACAGGACGC GGGGTAGAGG

401 TAGGTATCGT CGACACAGGC GAATCCGTCG GCAGCATATC CTTTCCCGAA

451 CTGTATGGCA GAAAAGAACA CGGCTATAAC GAAAATTACG AAAAACTATA

501 CGGCGTATAT GCGGAAGGAA GCGCCTGA
```

This corresponds to the amino acid sequence <SEQ ID 544; ORF 138>:

```
m139.pep
    1 MRTTPTFPTK TFKPTAMALA VATTLSACLG GGGGGTSAPD FNAGGTGIGS

51 NSRATTAKSA AVSYAGIKNE MCKDRSMLCA GRDDVAVTDR DAKINAPPRI

101 CIPETFQTQM THYKNLINLK PAIEAGYTGR GVEVGIVDTG ESVGSISFPE

151 LYGRKEHGYN ENYEKLYGVY AEGSA*
```

Computer analysis of this amino acid sequence gave the following results:

Homology with a Predicted ORF from *N. gonorrhoeae*
ORF 138 shows 92.2% identity over a 179 aa overlap with a predicted ORF (ORF 138.ng) from *N. gonorrhoeae*:

```
    m139/g139
                      10         20         30         40         50         60
      m139.pep  MRTTPTFPTKTFKPTAMALAVATTLSACLGGGGGGTSAPDFNAGGTGIGSNSRATTAKSA
                |||||||  ||||||:||||||||||||||||||||||||||||||||||||||||:|||
          g139  MRTTSTFPTKTFKPAAMALAVATTLSACLGGGGGGTSAPDFNAGGTGIGSNSRATIAESA
                      10         20         30         40         50         60

70         80         90        100        110        120
      m139.pep  AVSYAGIKNEMCKDRSMLCAGRDDVAVTDRDAKINAPPRICIPETFQTQMTHYKNLINLK
                ||||||||||||||||||||||||||||||||||:|||| |||||||||||:  ||:||||
          g139  AVSYAGIKNEMCKDRSMLCAGRDDVAVTDRDAKIKAP-RICIPETFQTQMTNIKNMINLK
                      70         80         90        100        110

130        140        150        160        170
      m139.pep   PAIEAGYTGRGVEVGIVDTGESVGSISFPELYGRKEHGYNENY----EKLYGVYAEGSAX
                 ||||||||||||||||||||||||||||||||||||||||||||    :|||||||||||
          g139   PAIEAGYTGRGVEVGIVDTGESVGSISFPELYGRKEHGYNENYKNLQKLYGVYAEGSAX
                     120        130        140        150        160        170
```

The following partial DNA sequence was identified in *N. meningitidis* <SEQ ID 545>:

```
a139.seq
    1 ATGCGAACGA CCCCAACCTT CCCTACAAAA ACTTTCAAAC CGGCTGCCAT

51 GGCGTTAGCT GTTGCAACAA CACTTTCTGC CTGCTTAGGC GGCGGCGGAG

101 GCGGCACTTC TGCGCCCGAC TTCAATGCAG GCGGCACCGG TATCGGCAGC

151 AACAGCAGGG CAACAACAGC GAAATCAGCA GCAATATCTT ACGCCGGTAT

201 CAAGAACGAA ATGTGCAAAG ACAGAAGCAT GCTCTGTGCC GGTCGGGATG

251 ACGTTGCGGT TACAGACAGG GATGCCAAAA TCAATGCCCC CCCCCGAATC

301 TGCATACCGG AGACTTTACA AACCCAAATG ACGCAT.ACA AGAATTTGAT

351 CAACCTCAAA CCTGCAATTG AAGCAGGCTA TACAGGACGC GGGGTAGAGG

401 TAGGTATCGT CGACACAGGC GAATCCGTCG GCAGCATATC CTTTCCCGAA

451 CTGTATGGCA GAAAAGAACA CGGCTATAAC GAAAATTAC. AAAAACTATA

501 CGGCGTATAT GCGGAAGGAA GCGCCTGA
```

This corresponds to the amino acid sequence <SEQ ID 546; ORF 139.a>:

```
a139.pep
    1 MRTTPTFPTK TFKPAAMALA VATTLSACLG GGGGGTSAPD FNAGGTGIGS

51 NSRATTAKSA AISYAGIKNE MCKDRSMLCA GRDDVAVTDR DAKINAPPRI
```

-continued
```
101 CIPETLQTQM THXKNLINLK PAIEAGYTGR GVEVGIVDTG ESVGSISFPE

151 LYGRKEHGYN ENYXKLYGVY AEGSA*
```

5 m139/a139 97.1% identity in 175 aa overlap

```
                 10        20        30        40        50        60
    m139.pep MRTTPTFPTKTFKPTAMALAVATTLSACLGGGGGGTSAPDFNAGGTGIGSNSRATTAKSA
             |||||||||||||:||||||||||||||||||||||||||||||||||||||||||||||
        a139 MRTTPTFPTKTFKPAAMALAVATTLSACLGGGGGGTSAPDFNAGGTGIGSNSRATTAKSA
                 10        20        30        40        50        60

70        80        90       100       110       120
    m139.pep AVSYAGIKNEMCKDRSMLCAGRDDVAVTDRDAKINAPPRICIPETFQTQMTHYKNLINLK
             |:||||||||||||||||||||||||||||||||||||||||||:||||| ||||||||
        a139 AISYAGIKNEMCKDRSMLCAGRDDVAVTDRDAKINAPPRICIPETLQTQMTHXKNLINLK
                 70        80        90       100       110       120

130       140       150       160       170
    m139.pep PAIEAGYTGRGVEVGIVDTGESVGSISFPELYGRKEHGYNENYEKLYGVYAEGSAX
             |||||||||||||||||||||||||||||||||||||||||||| ||||||||||
        a139 PAIEAGYTGRGVEVGIVDTGESVGSISFPELYGRKEHGYNENYXKLYGVYAEGSAX
                130       140       150       160       170
```

The following partial DNA sequence was identified in *N. gonorrhoeae* <SEQ ID 547>:

```
g140.seq
   1 Atgtcggcac gCGGCAAGGG GGCAGgctat ctcAACAGTA CCGGACGACa

51 TGTTCCCTTC CTGAGTGCCG CCAAAATCGG GCAGGATTAT TCTTTCTTCA

101 AAAATATCAA AACCGACGGC GGTCTGCTGG CTTCCCTCGA CAGCGTCGAA

151 AAAACAGCGG GCAGTGAAGG CGACACGCCG TCCTATTATG TCCGTCGCGG

201 CAATGCGGCA CGGACTGCTT CGGCAGCGGC ACATTCCGCG CCCGCCGGTC

251 TGAAACACGC CGTAGAACAG GGCGGCAGCA ATCTGGAAAA CCTGATGGTC

301 GAGCTGGATG CCTCCGAATC ATCCGCAACA CCCGAGACGG TTGAAACTGC

351 GGTCGCCGAC CGCACAGATA TGCCGGGCAT CCGCCTACGG CGCACAACTT

401 TCCGCACAGC GGCAGCCGTA CAGCATGCGA ATACCGCCGA CGGCGTACGc 451 aTCTTcaaCA GTCTCGCCGC TAccgTCTAt GccgACAGTG CCGCCGCCCA 501 TGccgATATG CAGGGACGCC GCCTGAAAGC CGTATCGGAC GGGTTGGACC

551 ACAACGGTAC GGGTCTGCGC GTCATCGCGC AAACCCAACA GGACGGTGGA

601 ACGTGGGAAC AGGGCGGTGT CGAAGGCAAA ATGCGCGGCA GTACCCAAAC

651 TATCGGCATT GCCGCGAAAA CCGGCGAAAA TACGACAGCA GCCGCCACAC

701 TGGGCATAGG ACGCAGCACA TGGAGCGAAA ACAGTGCAAA TGCAAAAACC

751 GACAGCATTA GTCTGTTTGC AGGCATACGG CACGATGTGG GCGATATCGG

801 CTATCTCAAA GGCCTGTTCT CctaCGGACG CTACAAAAAC AGCATCAGCC

851 GCAGCACCGG TGCGGATGAA TATGCGGAAG CAGCGTCAA CGGCACGCTG

901 ATGCAGCTGG GCGCACTGGG TGGTGTCAAC GTTCCGTTTG CCGCAACGGG

951 AGATTTGACG GTTGAAGGCG GTCTGCGCCA CGACCTGCTC AAACAGGATG

1001 CATTCGCCGA AAAAGGCagt GCTTTGGGCT GGAGCGGCAA CAGCCTCACT

1051 GAAGGCACAC TGGTCGGACT CGCGGGTCTG AAACTGTCGC AACCCTTGAG

1101 CGATAAAGCC GTCCTGTCTG CGACGGCGGG CGTGGAACGC GACCTGAACG

1151 GACGCGACTA CGCGGTAACG GGCGGCTTTA CCGGCGCGGC TGCAGCAACC

1201 GGCAAGACGG GTGCACGCAA TATGCCGCAC ACCCGCCGGG TTGCCGGTCT
```

-continued

```
1251 GGGGGTGGAT GTCGAATTCG GCAACGGCTG GAACGGCTTG GCACGTTACA

1301 GCTACACCGG TTCCAAACAG TACGGCAACC ACAGCGGACA AATCGGCGTA

1351 GGCTACCGGT TCTGA
```

This corresponds to the amino acid sequence <SEQ ID 548; ORF 140.ng>:

```
g140.pep
   1 MSARGKGAGY LNSTGRHVPF LSAAKIGQDY SFFKNIKTDG GLLASLDSVE

51 KTAGSEGDTP SYYVRRGNAA RTASAAAHSA PAGLKHAVEQ GGSNLENLMV

101 ELDASESSAT PETVETAVAD RTDMPGIRLR RTTFRTAAAV QHANTADGVR

151 IFNSLAATVY ADSAAAHADM QGRRLKAVSD GLDHNGTGLR VIAQTQQDGG

201 TWEQGGVEGK MRGSTQTIGI AAKTGENTTA AATLGIGRST WSENSANAKT

251 DSISLFAGIR HDVGDIGYLK GLFSYGRYKN SISRSTGADE YAEGSVNGTL

301 MQLGALGGVN VPFAATGDLT VEGGLRHDLL KQDAFAEKGS ALGWSGNSLT

351 EGTLVGLAGL KLSQPLSDKA VLSATAGVER DLNGRDYAVT GGFTGAAAAT

401 GKTGARNMPH TRRVAGLGVD VEFGNGWNGL ARYSYTGSKQ YGNHSGQIGV

451 GYRF*
```

The following partial DNA sequence was identified in N. meningitidis <SEQ ID 549>:

```
m140.seq
   1 ATGTCGGCAC GCGGCAAGGG GGCAGGCTAT CTCAACAGTA CCGGACGACG

51 TGTTCCCTTC CTGAGTGCCG CCAAAATCGG GCAGGATTAT TCTTTCTTCA

101 CAAACATCGA AACCGACGGC GGCCTGCTGG CTTCCCTCGA CAGCGTCGAA

151 AAAACAGCGG GCAGTGAAGG CGACACGCTG TCCTATTATG TCCGTCGCGG

201 CAATGCGGCA CGGACTGCTT CGGCAGCGGC ACATTCCGCG CCCGCCGGTC

251 TGAAACACGC CGTAGAACAG GGCGGCAGCA ATCTGGAAAA CCTGATGGTC

301 GAACTGGATG CCTCCGAATC ATCCGCAACA CCCGAGACGG TTGAAACTGC

351 GGCAGCCGAC CGCACAGATA TGCCGGGCAT CCGCCCCTAC GGCGCAACTT

401 TCCGCGCAGC GGCAGCCGTA CAGCATGCGA ATGCCGCCGA CGGTGTACGC

451 ATCTTCAACA GTCTCGCCGC TACCGTCTAT GCCGACAGTA CCGCCGCCCA

501 TGCCGATATG CAGGGACGCC GCCTGAAAGC CGTATCGGAC GGGTTGGACC

551 ACAACGGCAC GGGTCTGCGC GTCATCGCGC AAACCCAACA GGACGGTGGA

601 ACGTGGGAAC AGGGCGGTGT TGAAGGCAAA ATGCGCGGCA GTACCCAAAC

651 CGTCGGCATT GCCGCGAAAA CCGGCGAAAA TACGACAGCA GCCGCCACAC

701 TGGGCATGGG ACGCAGCACA TGGAGCGAAA ACAGTGCAAA TGCAAAAACC

751 GACAGCATTA GTCTGTTTGC AGGCATACGG CACGATGCGG GCGATATCGG

801 CTATCTCAAA GGCCTGTTCT CCTACGGACG CTACAAAAAC AGCATCAGCC

851 GCAGCACCGG TGCGGACGAA CATGCGGAAG GCAGCGTCAA CGGCACGCTG

901 ATGCAGCTGG GCGCACTGGG CGGTGTCAAC GTTCCGTTTG CCGCAACGGG

951 AGATTTGACG GTCGAAGGCG GTCTGCGCTA CGACCTGCTC AAACAGGATG

1001 CATTCGCCGA AAAGGCAGT GCTTTGGGCT GGAGCGGCAA CAGCCTCACT
```

-continued

```
1051 GAAGGCACGC TGGTCGGACT CGCGGGTCTG AAGCTGTCGC AACCCTTGAG

1101 CGATAAAGCC GTCCTGTTTG CAACGGCGGG CGTGGAACGC GACCTGAACG

1151 GACGCGACTA CACGGTAACG GGCGGCTTTA CCGGCGCGAC TGCAGCAACC

1201 GGCAAGACGG GGGCACGCAA TATGCCGCAC ACCCGTCTGG TTGCCGGCCT

1251 GGGCGCGGAT GTCGAATTCG GCAACGGCTG GAACGGCTTG GCACGTTACA

1301 GCTACGCCGG TTCCAAACAG TACGGCAACC ACAGCGGACG AGTCGGCGTA

1351 GGCTACCGGT TCTGA
```

This corresponds to the amino acid sequence <SEQ ID 550; ORF 140>:

```
m140.pep
   1 MSARGKGAGY LNSTGRRVPF LSAAKIGQDY SFFTNIETDG GLLASLDSVE

51 KTAGSEGDTL SYYVRRGNAA RTASAAAHSA PAGLKHAVEQ GGSNLENLMV

101 ELDASESSAT PETVETAAAD RTDMPGIRPY GATFRAAAAV QHANAADGVR

151 IFNSLAATVY ADSTAAHADM QGRRLKAVSD GLDHNGTGLR VIAQTQQDGG

201 TWEQGGVEGK MRGSTQTVGI AAKTGENTTA AATLGMGRST WSENSANAKT

251 DSISLFAGIR HDAGDIGYLK GLFSYGRYKN SISRSTGADE HAEGSVNGTL

301 MQLGALGGVN VPFAATGDLT VEGGLRYDLL KQDAFAEKGS ALGWSGNSLT

351 EGTLVGLAGL KLSQPLSDKA VLFATAGVER DLNGRDYTVT GGFTGATAAT

401 GKTGARNMPH TRLVAGLGAD VEFGNGWNGL ARYSYAGSKQ YGNHSGRVGV

451 GYRF*
```

Computer analysis of this amino acid sequence gave the following results:

Homology with a Predicted ORF from *N. gonorrhoeae*

ORF 140 shows 94.5% identity over a 454 aa overlap with a predicted ORF (ORF 140.ng) from *N. gonorrhoeae*:

```
m140/g140

10         20         30         40         50         60
m140.pep    MSARGKGAGYLNSTGRRVPFLSAAKIGQDYSFFTNIETDGGLLASLDSVEKTAGSEGDTL
            ||||||||||||||||:||||||||||||||| ||:|||||||||||||||||||||||
g140        MSARGKGAGYLNSTGRHVPFLSAAKIGQDYSFFKNIKTDGGLLASLDSVEKTAGSEGDTP
                    10         20         30         40         50         60

70         80         90        100        110        120
m140.pep    SYYVRRGNAARTASAAAHSAPAGLKHAVEQGGSNLENLMVELDASESSATPETVETAAAD
            |||||||||||||||||||||||||||||||||||||||||||||||||||||||||:||
g140        SYYVRRGNAARTASAAAHSAPAGLKHAVEQGGSNLENLMVELDASESSATPETVETAVAD
                    70         80         90        100        110        120

130        140        150        160        170        180
m140.pep    RTDMPGIRPYGATFRAAAAVQHANAADGVRIFNSLAATVYADSTAAHADMQGRRLKAVSD
            ||||||||   :|||:||||||||||:|||||||||||||||||:||||||||||||||
g140        RTDMPGIRLRRTTFRTAAAVQHANTADGVRIFNSLAATVYADSAAAHADMQGRRLKAVSD
                   130        140        150        160        170        180

190        200        210        220        230        240
m140.pep    GLDHNGTGLRVIAQTQQDGGTWEQGGVEGKMRGSTQTVGIAAKTGENTTAAATLGMGRST
            ||||||||||||||||||||||||||||||||||||||:|||||||||||||:||| |||
g140        GLDHNGTGLRVIAQTQQDGGTWEQGGVEGKMRGSTQTIGIAAKTGENTTAAATLGIGRST
                   190        200        210        220        230        240

250        260        270        280        290        300
m140.pep    WSENSANAKTDSISLFAGIRHDAGDIGYLKGLFSYGRYKNSISRSTGADEHAEGSVNGTL
            ||||||||||||||||||||||:|||||||||||||||||||||||||||:|||||||||
g140        WSENSANAKTDSISLFAGIRHDVGDIGYLKGLFSYGRYKNSISRSTGADEYAEGSVNGTL
                   250        260        270        280        290        300
```

```
                 310         320         330         340         350         360
m140.pep MQLGALGGVNVPFAATGDLTVEGGLRYDLLKQDAFAEKGSALGWSGNSLTEGTLVGLAGL
         |||||||||||||||||||||||||:||||||||||||||||||||||||||||||||||
g140     MQLGALGGVNVPFAATGDLTVEGGLRHDLLKQDAFAEKGSALGWSGNSLTEGTLVGLAGL
                 310         320         330         340         350         360
                 370         380         390         400         410         420
m140.pep KLSQPLSDKVALFATAGVERDLNGRDYTVTGGFTGATAATGKTGARNMPHTRLVAGLGAD
         ||||||||||| |||||||||||||||||:||||||:|||||||||||||||| ||||:|
g140     KLSQPLSDKAVLSATAGVERDLNGRDYAVTGGFTGAAAATGKTGARNMPHTRRVAGLGVD
                 370         380         390         400         410         420
                 430         440         450
m140.pep VEFGNGWNGLARYSYAGSKQYGNHSGRVGVGYRFX
         ||||||||||||||:|||||||||||::|||||||
g140     VEFGNGWNGLARYSYTGSKQYGNHSGQIGVGYRFX
                 430         440         450
```

15

The following partial DNA sequence was identified in *N. meningitidis* <SEQ ID 551>:

```
a140.seq
    1 ATGTCGGCAG GCGGTAAGGG GGCAGGCTAT CTCAACCGTA CCGGACAACG

51 TGTTCCCTTC CTGAGTGCCG CCAAAATCGG GCGGGATTAT TCTTTCTTCA

101 CAAACATCGA AACCGACGGC GGTCTGCTGG CTTCCCTCGA CAGCGTCGAA

151 AAAACAGCGG GTAGTGAAGG CGACACGCTG TCCTATTATG TCCGTCGCGG

201 CAATGCGGCA CGGACTGCTT CGGCAGCGGC ACATTCCGCG CCCGCCGGTC

251 TGAAACACGC CGTAGAACAG GGCGGCAGCA ATCTGGAAAA CCTGATGGTC

301 GAACTGGATG CCTCCGAATC ATCCGCAACA CCCGAGACGG TTGAAACTGC

351 GGCCGCCGAC CGCACAGATA TGCCGGGCAT CCGCCCCTAC GGCGCAACTT

401 TCCGCGCAGC GGCAGCCGTA CAGCATGCGA ATGCCGCCGA CGGTGTACGC

451 ATCTTCAACA ATCTCGCCGC TACCGTCTAT GCCGACAGTA CCGCCGCCCA

501 TGCCGATATG CAGGGACGCC GCCTGAAAGC CGTATCGGAC GGGTTGGACC

551 ACAACGCTAC GGGTCTGCGC GTCATCGCGC AAACCCAACA GGACGGTGGA

601 ACGTGGGAAC AGGGCGGTGT TGAAGGCAAA ATGCGCGGCA GTACCCAAAC

651 CGTCGGCATT GCCGCGAAAA CCGGCGAAAA TACGACAGCA GCCGCCACAC

701 TGGGCATGGG ACACAGCACA TGGAGCGAAA ACAGTGCAAA TGCAAAAACC

751 GACAGCATTA GTCTGTTTGC AGGCATACGG CACGATGCGG GCGATATCGG

801 CTATCTCAAA GGCCTGTTCT CCTACGGACG CTACAAAAAC AGCATCAGCC

851 GCAGCACCGG TGCGGACGAA CATGCGGAAG CAGCGTCAA CGGCACGCTG

901 ATGCAGCTGG GCGCACTGGG CGGTGTCAAC GTTCCGTTTG CCGCAACGGG

951 AGATTTGACG GTCGAAGGCG GTCTGCGCTA CGACCTGCTC AAACAGGATG

1001 CATTCGCCGA AAAAGGCAGT GCTTTGGGCT GGAGCGGCAA CAGCATCACT

1051 GAAGGCACAC TGGTCGGACT CGCGGGTCTG AAGCTGTCGC AACCCTTGAG

1101 CGATAAAGCC GTCCTGTTTG CAACGGCGGG CGTGGAACGC GACCTGAACG

1151 GACGCGACTA CACGGTAACG GGCGGCTTTA CCGGCGCGAC TGCAGCAACC

1201 GGCAAGACGG GGGCACGCAA TATGCCGCAC ACCCGCCTGG TTGCCGGTCT

1251 GGGCGCGGAT GTCGAATTCG GCAACGGCTG GAACGGCTTG GCACGTTACA

1301 GCTACGCCGG TTCCAAACAG TACGGCAACC ACAGCGGACG AGTCGGCGTA

1351 GGCTACCGGT TCTGA
```

This corresponds to the amino acid sequence <SEQ ID 552; ORF 140.a>:

```
a140.pep
    1 MSAGGKGAGY LNRTGQRVPF LSAAKIGRDY SFFTNIETDG GLLASLDSVE

51 KTAGSEGDTL SYYVRRGNAA RTASAAAHSA PAGLKHAVEQ GGSNLENLMV

101 ELDASESSAT PETVETAAAD RTDMPGIRPY GATFRAAAAV QHANAADGVR

151 IFNNLAATVY ADSTAAHADM QGRRLKAVSD GLDHNATGLR VIAQTQQDGG

201 TWEQGGVEGK MRGSTQTVGI AAKTGENTTA AATLGMGHST WSENSANAKT

251 DSISLFAGIR HDAGDIGYLK GLFSYGRYKN SISRSTGADE HAEGSVNGTL

301 MQLGALGGVN VPFAATGDLT VEGGLRYDLL KQDAFAEKGS ALGWSGNSIT

351 EGTLVGLAGL KLSQPLSDKA VLFATAGVER DLNGRDYTVT GGFTGATAAT

401 GKTGARNMPH TRLVAGLGAD VEFGNGWNGL ARYSYAGSKQ YGNHSGRVGV

451 GYRF*
``` m140/a140 98.2% identity in 454 aa overlap

```
                  10         20         30         40         50         60
m140.pep  MSARGKGAGYLNSTGRRVPFLSAAKIGQDYSFFTNIETDGGLLASLDSVEKTAGSEGDTL
          |||  ||||||||| ::||||||||||:||||||||||||||||||||||||||||||||
a140      MSAGGKGAGYLNRTGQRVPFLSAAKIGRDYSFFTNIETDGGLLASLDSVEKTAGSEGDTL
                  10         20         30         40         50         60

70         80         90        100        110        120
m140.pep  SYYVRRGNAARTASAAAHSAPAGLKHAVEQGGSNLENLMVELDASESSATPETVETAAAD
          ||||||||||||||||||||||||||||||||||||||||||||||||||||||||||||
a140      SYYVRRGNAARTASAAAHSAPAGLKHAVEQGGSNLENLMVELDASESSATPETVETAAAD
                  70         80         90        100        110        120

130        140        150        160        170        180
m140.pep  RTDMPGIRPYGATFRAAAAVQHANAADGVRIFNSLAATVYADSTAAHADMQGRRLKAVSD
          |||||||||||||||||||||||||||||||||:||||||||||||||||||||||||||
a140      RTDMPGIRPYGATFRAAAAVQHANAADGVRIFNNLAATVYADSTAAHADMQGRRLKAVSD
                 130        140        150        160        170        180

190        200        210        220        230        240
m140.pep  GLDHNGTGLRVIAQTQQDGGTWEQGGVEGKMRGSTQTVGIAAKTGENTTAAATLGMGRST
          |||||:||||||||||||||||||||||||||||||||||||||||||||||||||||:||
a140      GLDHNATGLRVIAQTQQDGGTWEQGGVEGKMRGSTQTVGIAAKTGENTTAAATLGMGHST
                 190        200        210        220        230        240

250        260        270        280        290        300
m140.pep  WSENSANAKTDSISLFAGIRHDAGDIGYLKGLFSYGRYKNSISRSTGADEHAEGSVNGTL
          ||||||||||||||||||||||||||||||||||||||||||||||||||||||||||||
a140      WSENSANAKTDSISLFAGIRHDAGDIGYLKGLFSYGRYKNSISRSTGADEHAEGSVNGTL
                 250        260        270        280        290        300

310        320        330        340        350        360
m140.pep  MQLGALGGVNVPFAATGDLTVEGGLRYDLLKQDAFAEKGSALGWSGNSLTEGTLVGLAGL
          |||||||||||||||||||||||||||||||||||||||||||||||||:||||||||||
a140      MQLGALGGVNVPFAATGDLTVEGGLRYDLLKQDAFAEKGSALGWSGNSITEGTLVGLAGL
                 310        320        330        340        350        360

370        380        390        400        410        420
m140.pep  KLSQPLSDKAVLFATAGVERDLNGRDYTVTGGFTGATAATGKTGARNMPHTRLVAGLGAD
          ||||||||||||||||||||||||||||||||||||||||||||||||||||||||||||
a140      KLSQPLSDKAVLFATAGVERDLNGRDYTVTGGFTGATAATGKTGARNMPHTRLVAGLGAD
                 370        380        390        400        410        420

430        440        450
m140.pep  VEFGNGWNGLARYSYAGSKQYGNHSGRVGVGYRFX
          |||||||||||||||||||||||||||||||||||
a140      VEFGNGWNGLARYSYAGSKQYGNHSGRVGVGYRFX
                 430        440        450
```

The following partial DNA sequence was identified in *N. gonorrhoeae* <SEQ ID 553>:

```
g141.seq
    1 atgagcttca aAAccgATGC CGAAACCGCC CAATCCTCCA CCATGCGCCC
   51 GATTGGCGAA ATTGCCGCCA AGCTGGGTTT GAACGTTGAC AACATTGAGC
  101 CTTACGGTCA TTACAAAGCC AAAATCAATC CTGCCGAAGC GTTCAAGCTG
  151 CCGCAAAAAC AAGGCAGGCT GATTTTGGTT ACCGCCATCA ACCCGACTCC
  201 GGCGGGCGAA GGCAAAACCA CCGTAACCAT CGGTTTGGCG GACGCATTGC
  251 GCCATATCGG CAAAGACTCT GTGATTGCTT TGCGCGAGCC TTCTTTGGGT
  301 CCGGTGTTCG GCGTGAAAGG CGGCGCGGCA GGCGGCGGCT ACGCGCAAGT
  351 TTTGCCGATG GAAGACATCA ACCTGCACTT CACCGGCGAC TTCCACGCCA
  401 TCGGTGCGGC GAATAACCTC CTCGCCGCCA TGCTCGACAA CCATATCTAC
  451 CAAGGTAACG AGTTGAACAT CGACCCCAAA CGCGTGCTGT GGCGGCGCGT
  501 GGTCGATATG AACGACCGCC AGTTGCGCAA CATCATCGAC GGTATGGGCA
  551 AGCCTGTtga cggCGTGATG CGtcccGACG GCTTCGACAT CACCGTCGCC
  601 TCCGAAGTGa tggcgGTATT CTGCCTTGCC AAAGACATCA GCGATTTGAA
  651 AGAGCGTTtt gGCAATATTC TCGTCGCCTA CGCCAAAGAC GGCAGCCCCG
  701 TTTACGCCAA AGATTTGAAG CACACGGCG CGATGGCGGC ATTGCTAAAA
  751 GATGCGATTA AGCCCAATTT GGTGCAAACC ATCGAAGGCA CTCCGGCCTT
  801 TGTACACGGC GGCCCGTTCG CCAACATCGC CCACGGCTGC AACTCCGTTA
  851 CCGCAACCCG TCTGGCGAAA CACCTTGCCG ATTACGCCGT AACCGAAGCA
  901 GGCTTCGGCG CGGACTTGGG TGCGGAAAAA TTCTGCGACA TCAAATGCCG
  951 CCTTGCCGGT TTGAAACCTG ATGCGGCAGT CGTCGTGGCG ACTGTCCGCG
 1001 CCCTGAAATA CAACGGCGGC GTGGAACGCG CCAACCTTGG TGAAGAAAAC
 1051 CTCGAAGCCT TGGCAAAAGG TTTGCCCAAC CTGTTGAAAC ACATTTCCAA
 1101 CCTGAAAAAC GTATTCGGAC TGCCCGTCGT CGTTGCGCTC AACCGCTTCG
 1151 TGTCCGACTC CGATGCCGAG TTGGCGATGA TTGAAAAAGC CTGTGCCGAA
 1201 CACGGCGTTG AAGTTTCCCT GACCGAAGTG TGGGGCAAAG GCGGCGCGGG
 1251 CGGCGCGGAT TGGCGCGCA AGTCGTCAA TGCCATCGAC AACCAACCTA
 1301 ATAACTTCGG TTTCGCCTAC GATGTCGAGT TGGGCATCAA AGACAAAATC
 1351 CGTGCGATTG CCCAAAAAGT GTACGGCGCG GAAGATGTCG ATTTCAGCGC
 1401 GGAAGCGTCT GCCGAAATCG CCTCGCTGGA AAAACTGGGC TTGGACAAAA
 1451 TGCCGATCTG CATGGCGAAA ACCCAATATT CATTGAGCGA CAACGCCAAA
 1501 CTCTTGGGCT GCCCCGAAGG CTTCCGCATC GCCGTACGCG GTATCACTGT
 1551 TTCCGCCGGC GCGGGCTTCA TCGTTGCGTT GTGCGGCAAT ATGATGAAAA
 1601 TGCCGGGCCT GCCGAAAGTT CCGGCTGCCG AGAAAATCGA TGTGGACGAA
 1651 CACGGCGTGA TTCACGGCTT GTTCTGA
```

This corresponds to the amino acid sequence <SEQ ID 554; ORF 141.ng>:

```
g141.pep
    1 MSFKTDAETA QSSTMRPIGE IAAKLGLNVD NIEPYGHYKA KINPAEAFKL
```

-continued

```
 51 PQKQGRLILV TAINPTPAGE GKTTVTIGLA DALRHIGKDS VIALREPSLG

101 PVFGVKGGAA GGGYAQVLPM EDINLHFTGD FHAIGAANNL LAAMLDNHIY

151 QGNELNIDPK RVLWRRVVDM NDRQLRNIID GMGKPVDGVM RPDGFDITVA

201 SEVMAVFCLA KDISDLKERF GNILVAYAKD GSPVYAKDLK AHGAMAALLK

251 DAIKPNLVQT IEGTPAFVHG GPFANIAHGC NSVTATRLAK HLADYAVTEA

301 GFGADLGAEK FCDIKCRLAG LKPDAAVVVA TVRALKYNGG VERANLGEEN

351 LEALAKGLPN LLKHISNLKN VFGLPVVVAL NRFVSDSDAE LAMIEKACAE

401 HGVEVSLTEV WGKGGAGGAD LARKVVNAID NQPNNFGFAY DVELGIKDKI

451 RAIAQKVYGA EDVDFSAEAS AEIASLEKLG LDKMPICMAK TQYSLSDNAK

501 LLGCPEGFRI AVRGITVSAG AGFIVALCGN MMKMPGLPKV PAAEKIDVDE

551 HGVIHGLF*
```

The following partial DNA sequence was identified in *N. meningitidis* <SEQ ID 555>:

```
m141.seq
   1 ATGAGCTTCA AAACCGATGC CGAAATCGCC CAATCCTCCA CCATGCGCCC

51 GATTGGCGAA ATTGCCGCCA AGCTTGGTCT GAATGCCGAC AACATTGAGC

101 CTTACGGTCA TTACAAGGCG AAAATCAATC CTGCCGAAGC GTTCAAACTG

151 CCGCAAAAAC AGGGCAGGCT GATTTTGGTT ACCGCCATCA ACCCGACTCC

201 GGCGGGCGAA GGCAAAACCA CCGTAACCAT CGGTTTGGCG GACGCGTTGC

251 GCCACATCGG CAAAGATGCC GTGATTGCCC TGCGCGAACC TTCTCTGGGG

301 CCGGTGTTCG GCGTGAAAGG CGGCGCGGCA GGCGGCGGCT ATGCCCAAGT

351 TTTGCCGATG GAAGACATCA ACCTGCACTT CACCGGAGAT TTTCACGCCA

401 TCGGTGCGGC AAATAATCTG CTTGCCGCGA TGCTCGACAA CCATATCTAC

451 CAAGGCAACG AGTTGAACAT CGACCCCAAA CGCGTGCTGT GGCGGCGCGT

501 GGTCGATATG AACGACCGCC AGTTGCGCAA CATCATCGAC GGCATGGGTA

551 AACCCGTTGA CGGCGTGATG CGTCCTGACG GTTTCGATAT TACCGTTGCT

601 TCCGAAGTGA TGGCGGTATT CTGTCTTGCC AAAGACATCA GCGATTTGAA

651 AGAGCGTTTG GGCAACATCC TTGTCGCCTA CGCCAAAGAC GGCAGCCCCG

701 TTTACGCCAA AGATTTGAAA GCGAATGGCG CGATGGCGGC ATTGCTTAAA

751 GATGCGATTA AGCCCAACTT GGTGCAAACC ATCGAAGGCA CGCCCGCCTT

801 CGTACACGGC GGCCCGTTCG CCAACATCGC CCACGGCTGC AACTCCGTAA

851 CCGCAACCCG TCTGGCGAAA CACCTTGCCG ATTACGCCGT AACCGAAGCA

901 GGCTTCGGCG CGGACTTGGG CGCGGAAAAA TTCTGCGACA TCAAATGCCG

951 CCTTGCCGGT TTGAAACCTG ATGCGGCTGT TGTCGTGGCG ACTGTCCGCG

1001 CGTTGAAATA TAACGGCGGC GTGGAACGCG CCAACCTCGG CGAAGAAAAT

1051 TTAGACGCTT TGGAAAAAGG TTTGCCCAAC CTGCTGAAAC ACATTTCCAA

1101 CCTGAAAAAC GTATTCGGAC TGCCCGTCGT CGTTGCGCTC AACCGCTTCG

1151 TGTCCGACGC CGATGCCGAG TTGGCGATGA TTGAAAAAGC CTGTGCCGAA

1201 CACGGCGTTG AAGTTTCCCT GACCGAAGTG TGGGGCAAAG GTGGTGCGGG

1251 CGGCGCGGAT TTGGCGCGCA AAGTCGTCAA CGCCATTGAA AGTCAAACCA
```

-continued

```
1301 ATAACTTCGG TTTCGCCTAC GATGTCGAGT TGGGCATCAA AGACAAAATC

1351 CGTGCGATTG CCCAAAAAGT GTACGGCGCG GAAGATGTTG ATTTCAGCGC

1401 GGAAGCGTCT GCCGAAATCG CTTCACTGGA AAAACTGGGC TTGGACAAAA

1451 TGCCGATCTG CATGGCGAAA ACCCAATACT CTTTGAGCGA CAACGCCAAA

1501 CTGTTGGGCT GCCCCGAAGA CTTCCGCATC GCCGTGCGCG GCATCACCGT

1551 TTCCGCAGGC GCAGGTTTCA TCGTCGCCCT GTGCGGCAAC ATGATGAAAA

1601 TGCCCGGCCT GCCCAAAGTT CCGGCTGCCG AGAAAATCGA TGTGGACGCA

1651 GAAGGCGTGA TTCACGGCTT GTTCTGA
```

This corresponds to the amino acid sequence <SEQ ID 556; ORF 141>:

```
m141.pep
    1 MSFKTDAEIA QSSTMRPIGE IAAKLGLNAD NIEPYGHYKA KINPAEAFKL

51 PQKQGRLILV TAINPTPAGE GKTTVTIGLA DALRHIGKDA VIALREPSLG

101 PVFGVKGGAA GGGYAQVLPM EDINLHFTGD FHAIGAANNL LAAMLDNHIY

151 QGNELNIDPK RVLWRRVVDM NDRQLRNIID GMGKPVDGVM RPDGFDITVA

201 SEVMAVFCLA KDISDLKERL GNILVAYAKD GSPVYAKDLK ANGAMAALLK

251 DAIKPNLVQT IEGTPAFVHG GPFANIAHGC NSVTATRLAK HLADYAVTEA

301 GFGADLGAEK FCDIKCRLAG LKPDAAVVVA TVRALKYNGG VERANLGEEN

351 LDALEKGLPN LLKHISNLKN VFGLPVVVAL NRFVSDADAE LAMIEKACAE

401 HGVEVSLTEV WGKGGAGGAD LARKVVNAIE SQTNNFGFAY DVELGIKDKI

451 RAIAQKVYGA EDVDFSAEAS AEIASLEKLG LDKMPICMAK TQYSLSDNAK

501 LLGCPEDFRI AVRGITVSAG AGFIVALCGN MMKMPGLPKV PAAEKIDVDA

551 EGVIHGLF*
```

Computer analysis of this amino acid sequence gave the following results:

Homology with a Predicted ORF from *N. gonorrhoeae*

ORF 141 shows 97.5% identity over a 558 aa overlap with a predicted ORF (ORF 141.ng) from *N. gonorrhoeae*:

```
m141/g141

10         20         30         40         50         60
     m141.pep  MSFKTDAEIAQSSTMRPIGEIAAKLGLNADNIEPYGHYKAKINPAEAFKLPQKQGRLILV
               ||||||||| |||||||||||||||||||:||||||||||||||||||||||||||||||
         g141  MSFKTDAETAQSSTMRPIGEIAAKLGLNVDNIEPYGHYKAKINPAEAFKLPQKQGRLILV
                    10         20         30         40         50         60

70         80         90        100        110        120
     m141.pep  TAINPTPAGEGKTTVTIGLADALRHIGKDAVIALREPSLGPVFGVKGGAAGGGYAQVLPM
               |||||||||||||||||||||||||||||:||||||||||||||||||||||||||||||
         g141  TAINPTPAGEGKTTVTIGLADALRHIGKDSVIALREPSLGPVFGVKGGAAGGGYAQVLPM
                    70         80         90        100        110        120

130        140        150        160        170        180
     m141.pep  EDINLHFTGDFHAIGAANNLLAAMLDNHIYQGNELNIDPKRVLWRRVVDMNDRQLRNIID
               ||||||||||||||||||||||||||||||||||||||||||||||||||||||||||||
         g141  EDINLHFTGDFHAIGAANNLLAAMLDNHIYQGNELNIDPKRVLWRRVVDMNDRQLRNIID
                   130        140        150        160        170        180

190        200        210        220        230        240
     m141.pep  GMGKPVDGVMRPDGFDITVASEVMAVFCLAKDISDLKERLGNILVAYAKDGSPVYAKDLK
               |||||||||||||||||||||||||||||||||||||||:||||||||||||||||||||
         g141  GMGKPVDGVMRPDGFDITVASEVMAVFCLAKDISDLKERFGNILVAYAKDGSPVYAKDLK
                   190        200        210        220        230        240
```

-continued

```
                    250       260       270       280       290       300
m141.pep   ANGAMAALLKDAIKPNLVQTIEGTPAFVHGGPFANIAHGCNSVTATRLAKHLADYAVTEA
           |:||||||||||||||||||||||||||||||||||||||||||||||||||||||||||
g141       AHGAMAALLKDAIKPNLVQTIEGTPAFVHGGPFANIAHGCNSVTATRLAKHLADYAVTEA
                    250       260       270       280       290       300

310       320       330       340       350       360
m141.pep   GFGADLGAEKFCDIKCRLAGLKPDAAVVVATVRALKYNGGVERANLGEENLDALEKGLPN
           |||||||||||||||||||||||||||||||||||||||||||||||||||:|| |||||
g141       GFGADLGAEKFCDIKCRLAGLKPDAAVVVATVRALKYNGGVERANLGEENLEALAKGLPN
                    310       320       330       340       350       360

370       380       390       400       410       420
m141.pep   LLKHISNLKNVFGLPVVVALNRFVSDADAELAMIEKACAEHGVEVSLTEVWGKGGAGGAD
           ||||||||||||||||||||||||||||:|||||||||||||||||||||||||||||||
g141       LLKHISNLKNVFGLPVVVALNRFVSDADSELAMIEKACAEHGVEVSLTEVWGKGGAGGAD
                    370       380       390       400       410       420

430       440       450       460       470       480
m141.pep   LARKVVNAIESQTNNFGFAYDVELGIKDKIRAIAQKVYGAEDVDFSAEASAEIASLEKLG
           |||||||||::| |||||||||||||||||||||||||||||||||||||||||||||||
g141       LARKVVNAIDNQPNNFGFAYDVELGIKDKIRAIAQKVYGAEDVDFSAEASAEIASLEKLG
                    430       440       450       460       470       480

490       500       510       520       530       540
m141.pep   LDKMPICMAKTQYSLSDNAKLLGCPEDFRIAVRGITVSAGAGFIVALCGNMMKMPGLPKV
           |||||||||||||||||||||||||| |||||||||||||||||||||||||||||||||
g141       LDKMPICMAKTQYSLSDNAKLLGCPEGFRIAVRGITVSAGAGFIVALCGNMMKMPGLPKV
                    490       500       510       520       530       540

550      559
m141.pep   PAAEKIDVDAEGVIHGLFX
           ||||||||| :||||||||
g141       PAAEKIDVDEHGVIHGLFX
                    550      559
```

The following partial DNA sequence was identified in *N. meningitidis* <SEQ ID 557>:

```
a141.seq
   1 ATGAGTTTCA AAACCGATGC CGAAATCGCC CAATCCTCCA CCATGCGCCC

51 GATTGGCGAA ATTGCCGCCA AGCTGGGTTT GAACGTTGAC AACATTGAGC

101 CTTACGGTCA TTACAAAGCC AAAATCAATC CTGCCGAAGC GTTCAAACTG

151 CCGCAAAAAC AGGGCAGGCT GATTTTGGTT ACCGCCATCA ACCCGACTCC

201 GGCGGGCGAA GGTAAAACCA CCGTAACCAT CGGTTTGGCG GACGCATTGC

251 GCCATATCGG CAAAGACTCT GTGATTGCTT TGCGCGAGCC TTCTTTGGGT

301 CCGGTGTTCG GCGTGAAAGG CGGCGCGGCA GGCGGCGGCT ATGCCCAAGT

351 TTTGCCGATG GAAGACATCA ACCTGCACTT CACCGGAGAT TTTCACGCCA

401 TCGGTGCGGC AAATAATCTG CTTGCCGCGA TGCTCGACAA CCATATCTAC

451 CAAGGCAACG AGTTGAACAT CGACCCCAAA CGCGTGCTGT GGCGGCGCGT

501 GGTCGATATG AACGACCGCC AGTTGCGCAA CATCATCGAC GGCATGGGCA

551 AGCCTGTTGA CGGCGTGATG CGTCCTGACG GTTTCGATAT TACCGTTGCT

601 TCCGAAGTGA TGGCGGTATT CTGTCTTGCC AAAGACATCA GCGATTTGAA

651 AGAGCGTTTG GGCAACATCC TTGTCGCCTA CGCCAAAGAC GGCAGCCCCG

701 TTTACGCCAA AGATTTGAAA GCGAATGGCG CGATGGCGGC ATTGCTTAAA

751 GATGCGATTA AGCCCAACTT GGTGCAAACC ATCGAAGGCA CGCCCGCCTT

801 CGTACACGGC GGCCCGTTCG CCAACATCGC CCACGGCTGC AACTCCGTAA

851 CCGCAACCCG TCTGGCGAAA CACCTTGCCG ATTACGCCGT AACCGAAGCA

901 GGCTTCGGCG CGGACTTGGG CGCGGAAAAA TTCTGCGACA TCAAATGCCG

951 CCTTGCCGGT TTGAAACCTG ATGCGGCTGT TGTCGTGGCG ACTGTCCGCG

1001 CGTTGAAATA TAACGGCGGC GTGGAACGCG CCAACCTCGG CGAAGAAAAT
```

-continued

```
1051 TTAGACGCTT TGGAAAAAGG TTTGCCCAAC CTGCTGAAAC ACATTTCCAA

1101 CCTGAAAAAC GTATTCGGAC TGCCCGTCGT CGTTGCGCTC AACCGCTTCG

1151 TGTCCGACTC CGATGCCGAG TTGGCGATGA TTGAAAAAGC CTGTGCCGAA

1201 CACGGCGTTG AAGTTTCCCT GACCGAAGTG TGGGGCAAAG GTGGTGCGGG

1251 CGGCGCGGAT TTGGCGCGCA AAGTCGTCAA CGCCATTGAA AGTCAAACCA

1301 ATAACTTCGG TTTCGCCTAC GATGTCGAGT TGGGCATCAA AGACAAAATC

1351 CGTGCGATTG CCCAAAAAGT GTACGGCGCG GAAGATGTTG ATTTCAGCGC

1401 GGAAGCGTCT GCCGAAATCG CTTCACTGGA AAAACTGGGC TTGGACAAAA

1451 TGCCGATCTG CATGGCGAAA ACCCAATACT CTTTGAGCGA CAACGCCAAA

1501 CTGTTGGGCT GCCCCGAAGA CTTCCGCATC GCCGTGCGCG GCATCACCGT

1551 TTCCGCAGGC GCAGGTTTCA TCGTCGCCCT GTGCGGCAAC ATGATGAAAA

1601 TGCCCGGCCT GCCCAAAGTT CCGGCTGCCG AGAAAATCGA TGTGGACGCA

1651 GAAGGCGTGA TTCACGGCTT GTTCTGA
```

This corresponds to the amino acid sequence <SEQ ID 558; ORF 141.a>:

```
a141.pep
   1 MSFKTDAEIA QSSTMRPIGE IAAKLGLNVD NIEPYGHYKA KINPAEAFKL

51 PQKQGRLILV TAINPTPAGE GKTTVTIGLA DALRHIGKDS VIALREPSLG

101 PVFGVKGGAA GGGYAQVLPM EDINLHFTGD FHAIGAANNL LAAMLDNHIY

151 QGNELNIDPK RVLWRRVVDM NDRQLRNIID GMGKPVDGVM RPDGFDITVA

201 SEVMAVFCLA KDISDLKERL GNILVAYAKD GSPVYAKDLK ANGAMAALLK

251 DAIKPNLVQT IEGTPAFVHG GPFANIAHGC NSVTATRLAK HLADYAVTEA

301 GFGADLGAEK FCDIKCRLAG LKPDAAVVVA TVRALKYNGG VERANLGEEN

351 LDALEKGLPN LLKHISNLKN VFGLPVVVAL NRFVSDSDAE LAMIEKACAE

401 HGVEVSLTEV WGKGGAGGAD LARKVVNAIE SQTNNFGFAY DVELGIKDKI

451 RAIAQKVYGA EDVDFSAEAS AEIASLEKLG LDKMPICMAK TQYSLSDNAK

501 LLGCPEDFRI AVRGITVSAG AGFIVALCGN MMKMPGLPKV PAAEKIDVDA

551 EGVIHGLF*
``` m141/a141 99.5% identity in 558 aa overlap

```
                10         20         30         40         50         60
m141.pep  MSFKTDAEIAQSSTMRPIGEIAAKLGLNADNIEPYGHYKAKINPAEAFKLPQKQGRLILV
          |||||||||||||||||||||||||||||:||||||||||||||||||||||||||||||
a141      MSFKTDAEIAQSSTMRPIGEIAAKLGLNVDNIEPYGHYKAKINPAEAFKLPQKQGRLILV
                10         20         30         40         50         60

70         80         90        100        110        120
m141.pep  TAINPTPAGEGKTTVTIGLADALRHIGKDAVIALREPSLGPVFGVKGGAAGGGYAQVLPM
          |||||||||||||||||||||||||||||:||||||||||||||||||||||||||||||
a141      TAINPTPAGEGKTTVTIGLADALRHIGKDSVIALREPSLGPVFGVKGGAAGGGYAQVLPM
                70         80         90        100        110        120

130        140        150        160        170        180
m141.pep  EDINLHFTGDFHAIGAANNLLAAMLDNHIYQGNELNIDPKRVLWRRVVDMNDRQLRNIID
          ||||||||||||||||||||||||||||||||||||||||||||||||||||||||||||
a141      EDINLHFTGDFHAIGAANNLLAAMLDNHIYQGNELNIDPKRVLWRRVVDMNDRQLRNIID
               130        140        150        160        170        180
```

```
                  190        200        210        220        230        240
m141.pep  GMGKPVDGVMRPDGFDITVASEVMAVFCLAKDISDLKERLGNILVAYAKDGSPVYAKDLK
          ||||||||||||||||||||||||||||||||||||||||||||||||||||||||||||
a141      GMGKPVDGVMRPDGFDITVASEVMAVFCLAKDISDLKERLGNILVAYAKDGSPVYAKDLK
                  190        200        210        220        230        240

250        260        270        280        290        300
m141.pep  ANGAMAALLKDAIKPNLVQTIEGTPAFVHGGPFANIAHGCNSVTATRLAKHLADYAVTEA
          ||||||||||||||||||||||||||||||||||||||||||||||||||||||||||||
a141      ANGAMAALLKDAIKPNLVQTIEGTPAFVHGGPFANIAHGCNSVTATRLAKHLADYAVTEA
                  250        260        270        280        290        300

310        320        330        340        350        360
m141.pep  GFGADLGAEKFCDIKCRLAGLKPDAAVVVATVRALKYNGGVERANLGEENLDALEKGLPN
          ||||||||||||||||||||||||||||||||||||||||||||||||||||||||||||
a141      GFGADLGAEKFCDIKCRLAGLKPDAAVVVATVRALKYNGGVERANLGEENLDALEKGLPN
                  310        320        330        340        350        360

370        380        390        400        410        420
m141.pep  LLKHISNLKNVFGLPVVVALNRFVSDADAELAMIEKACAEHGVEVSLTEVWGKGGAGGAD
          |||||||||||||||||||||||||||||||:||||||||||||||||||||||||||||
a141      LLKHISNLKNVFGLPVVVALNRFVSDADSELAMIEKACAEHGVEVSLTEVWGKGGAGGAD
                  370        380        390        400        410        420

430        440        450        460        470        480
m141.pep  LARKVVNAIESQTNNFGFAYDVELGIKDKIRAIAQKVYGAEDVDFSAEASAEIASLEKLG
          ||||||||||||||||||||||||||||||||||||||||||||||||||||||||||||
a141      LARKVVNAIESQTNNFGFAYDVELGIKDKIRAIAQKVYGAEDVDFSAEASAEIASLEKLG
                  430        440        450        460        470        480

490        500        510        520        530        540
m141.pep  LDKMPICMAKTQYSLSDNAKLLGCPEDFRIAVRGITVSAGAGFIVALCGNMMKMPGLPKV
          ||||||||||||||||||||||||||||||||||||||||||||||||||||||||||||
a141      LDKMPICMAKTQYSLSDNAKLLGCPEDFRIAVRGITVSAGAGFIVALCGNMMKMPGLPKV
                  490        500        510        520        530        540

550        559
m141.pep  PAAEKIDVDAEGVIHGLFX
          |||||||||||||||||||
a141      PAAEKIDVDAEGVIHGLFX
                  550
```

The following partial DNA sequence was identified in *N. gonorrhoeae* <SEQ ID 559>:

```
g142.seq
    1 ATGCGTGCCG ATTTCATGTT TGCCGACAAT ATGCCCGTGC AGGTGCGCCA

51 ACGCGCCTTC TATTTCAAGT TGTCCCGTTT TGCCGCGATG CCAAATATGG

101 TAGGCAAACC GCTCTTCGGG CGACAGGCCG GTCAGCCCGG CAAAATGTTC

151 GGCAACATCC TGATGTTCGT CCGCCAGCAT ATTGATGCAG AGgCTGCCGT

201 TTTCCGACAG GATcggaATG AttcgCGCAC TCCGGTTTAT GCACAGCATC

251 ACGGTCGGCG GCTCGTCGGT AACCGGCGCA ACCGCCGTCA TTGTAATGCC

301 GTAACGCCCT GCCGCACCGT CTGTCGTGAT GACATGAACG CCTGCCGCAC

351 AGGATGCCAT CGCATCACGG AACGAAGTTT GAAAAGTTTT CTGCAAATCC

401 GCCATTTTTC CCCTTTAAAC CGTCCCCTAT ATAAGAATGC TGCACACAAG

451 GCATCCCCCC ATGTGCAGCA GTTCTGA
```

This corresponds to the amino acid sequence <SEQ ID 560; ORF 142.ng>:

```
g142.pep
    1 MRADFMFADN MPVQVRQRAF YFKLSRFAAM PNMVGKPLFG RQAGQPGKMF

51 GNILMFVRQH IDAEAAVFRQ DRNDSRTPVY AQHHGRRLVG NRRNRRHCNA

101 VTPCRTVCRD DMNACRTGCH RITERSLKSF LQIRHFSPLN RPLYKNAAHK

151 ASPHVQQF*
```

The following partial DNA sequence was identified in *N. meningitidis* <SEQ ID 561>:

```
m142.seq
    1 ATGCGTGCCG ATTTCATGTT TGCCGACAAT ATGCCCGTGC AGGTGCGCCA
   51 ACGCGCCCTC TATTTCAAGT TGTCCCGTTT TGCCGCGATG CCAGATGTGG
  101 TAGGCAAACC GCTCTTCGGG CGACAGGCCG GTCAGCCCGG CAAAATGTTC
  151 GGCAACATCC TGATGTTCGT CCGCCAGCGT ATTGATGCAG AGGCTGCCGT
  201 TTTCCGACAG GATCGGAATG ATTCGCGCAC TCCGGTTGAT GCACAGCATC
  251 ACGGTCGGCG GCTCGTCGGT AACCGGCGCG ACCGCCGTCA TTGTAATGCC
  301 GTAACGCCCT GCCGCACCGT CTGTCGTGAT GACATGAACG CCTGCCGCGC
  351 AAGATGCCAT CGCATCACGG AACGAAGTTT GAAAATTTTT CTGCAAATCC
  401 GCCATTTTTC CCCTTTAAAC TGTCCCCTAT ATAAGAATGC TGCACACAAG
  451 GCATCCCCcC ATGTGCAGCA GTTTTGA
```

This corresponds to the amino acid sequence <SEQ ID 562; ORF 142>:

```
m142.pep
    1 MRADFMFADN MPVQVRQRAL YFKLSRFAAM PDVVGKPLFG RQAGQPGKMF
   51 GNILMFVRQR IDAEAAVFRQ DRNDSRTPVD AQHHGRRLVG NRRDRRHCNA
  101 VTPCRTVCRD DMNACRARCH RITERSLKIF LQIRHFSPLN CPLYKNAAHK
  151 ASPHVQQF*
```

Computer analysis of this amino acid sequence gave the following results:
Homology with a Predicted ORF from *N. gonorrhoeae*
ORF 142 shows 93.7% identity over a 158 aa overlap with a predicted ORF (ORF 142.ng) from *N. gonorrhoeae*:

```
m142/g142
                  10         20         30         40         50         60
m142.pep  MRADFMFADNMPVQVRQRALYFKLSRFAAMPDVVGKPLFGRQAGQPGKMFGNILMFVRQR
          ||||||||||||||||||||:|||||||||||::||||||||||||||||||||||||:
g142      MRADFMFADNMPVQVRQRAFYFKLSRFAAMPNMVGKPLFGRQAGQPGKMFGNILMFVRQH
                  10         20         30         40         50         60
                  70         80         90        100        110        120
m142.pep  IDAEAAVFRQDRNDSRTPVDAQHHGRRLVGNRRDRRHCNAVTPCRTVCRDDMNACRARCH
          |||||||||||||||||||| ||||||||||||||:|||||||||||||||||||||: ||
g142      IDAEAAVFRQDRNDSRTPVYAQHHGRRLVGNRRNRHCNAVTPCRTVCRDDMNACRTGCH
                  70         80         90        100        110        120
                 130        140        150        159
m142.pep  RITERSLKIFLQIRHFSPLNCPLYKNAAHKASPHVQQFX
          |||||||| |||||||||||| ||||||||||||||||
g142      RITERSLKSFLQIRHFSPLNRPLYKNAAHKASPHVQQFX
                 130        140        150
```

The following partial DNA sequence was identified in *N. meningitidis* <SEQ ID 563>:

```
    1 ATGCGTGCCG ATTTCATGTT TGCCGACAAT ATGCCCGTGC AGGTGCGCCA
   51 ACGCGCCCTC TATTTCAAGT TGTCCCGTTT TGCCGCGATG CCAGATGTGG
  101 TAGGCAAACC GCTCTTCGGG CGACAGGCCG GTCAGCCCGG CAAAATGTTC
  151 GGCAACATCC TGATGTTCGT CCGCCAGCGT ATTGATGCAG AGGCTGCCGT
  201 TTTCCGACAG GATCGGAATG ATTCGCGCAC TCCGGTTGAT GCACAGCATC
```

-continued

```
251 ACGGTCGGCG GCTCGTCCGT AACCGGCGCA ACCGCCGTCA TTGTAATGCC

301 GTAACGCCCT GCCGCACCGT CTGTCGTGAT GACATGAACG CCTGCCGCAC

351 AGGATGCCAT CGCATCACGG AACGAAGTTT GAAAAGTTTT CTGCAAATCC

401 GCCATTTTTC CCCTTTAAAC TGTCCCCTAT ATAAGAATGC TGCACACAAG

451 GCACCCCCCA TGTGCAGCAG TTCTGATTCA AAAAGCCGTC GGTCGGACAT

501 TTCCGCGCGT TACGGCGTAT TACGAGTTCA ACGCATCCTC GATTTTGGCA

551 AGTTCTGCCA ACAGGTCTTT AAGCAGCAGC ATTTTCTCGC GGCCCAGCAC

601 TTCCTCGATA GCGTCGTAAC GCTCGTCCAC TTCTTCGCCG ATTTCCTCAT

651 ACAGCTTCTC GCCCTCGGCA GTCAGCTTCA GAAAAACACG TCGTTGGTCG

701 TTGGAAGGTT TCAGGCGGAC AACCAAACCC GCTTTTTCAA GGCGGGTCAG

751 GATACCGGTC AGGCTGGGGC GCAAAATGCA CGCCTGATTC GCCAAATCTT

801 GAAAGTCCAG CGTGCCGTTT TCCGCCAAAA GACGGATAAT CCGCCATTGC

851 TGATCGGTAA TATTCGCCTG ATTCAGAATA GGCCTGAATT GGGTCATCAG

901 GGCTTCCCTT GCCTGTATCA GACCGATATT GATAGACGCA TGTTTTGA
```

This corresponds to the amino acid sequence <SEQ ID 564; ORF 142.a>:

```
a142.pep
  1 MRADFMFADN MPVQVRQRAL YFKLSRFAAM PDVVGKPLFG RQAGQPGKMF

51 GNILMFVRQR IDAEAAVFRQ DRNDSRTPVD AQHHGRRLVR NRRNRRHCNA

101 VTPCRTVCRD DMNACRTGCH RITERSLKSF LQIRHFSPLN CPLYKNAAHK

151 APPMCSSSDS KSRRSDISAR YGVLRVQRIL DFGKFCQQVF KQQHFLAAQH

201 FLDSVVTLVH FFADFLIQLL ALGSQLQKNT SLVVGRFQAD NQTRFFKAGQ

251 DTGQAGAQNA RLIRQILKVQ RAVFRQKTDN PPLLIGNIRL IQNRPELGHQ

301 GFPCLYQTD IDRRMF*
``` m142/a142 96.1% identity in 153 aa overlap

```
                 10        20        30        40        50        60
m142.pep  MRADFMFADNMPVQVRQRALYFKLSRFAAMPDVVGKPLFGRQAGQPGKMFGNILMFVRQR
          ||||||||||||||||||||||||||||||||||||||||||||||||||||||||||||
a142      MRADFMFADNMPVQVRQRALYFKLSRFAAMPDVVGKPLFGRQAGQPGKMFGNILMFVRQR
                 10        20        30        40        50        60

70        80        90       100       110       120
m142.pep  IDAEAAVFRQDRNDSRTPVDAQHHGRRLVGNRRDRRHCNAVTPCRTVCRDDMNACRARCH
          |||||||||||||||||||||||||||||| |||:||||||||||||||||||||||: ||
a142      IDAEAAVFRQDRNDSRTPVDAQHHGRRLVRNRRNRRHCNAVTPCRTVCRDDMNACRTGCH
                 70        80        90       100       110       120

130       140       150    159
m142.pep  RITERSLKIFLQIRHFSPLNCPLYKNAAHKASPHVQQFX
          ||||||||| |||||||||||||||||||||||       |
a142      RITERSLKSFLQIRHFSPLNCPLYKNAAHKAPPMCSSSDSKSRRSDISARYGVLRVQRIL
                130       140       150       160       170       180 a142      DFGKFCQQVFKQQHFLAAQHFLDSVVTLVHFFADFLIQLLALGSQLQKNTSLVVGRFQAD
                190       200       210       220       230       240
```

The following partial DNA sequence was identified in *N. gonorrhoeae* <SEQ ID 565>:

```
g143.seq
  1 ATGTTGAGCT TCGGCTATCT CGGCGTTCAG ACGGCCTTTA CCCTGCAAAG
```

-continued

```
 51 CTCGCAGATG AGCCGCATTT TTCAAACGCT AGGCGCAGAC CCGCACAATT
101 TGGGCTGGTT TTTCATCCTG CCGCCGCTGG CGGGGATGCT GGTTCAGCCG
151 ATAGTGgGCT ACTACTCAGA CCGCACTTGG AAGCCGCGCT GGGCGGCCG
201 CCGCCTGCCG TATCTGCTTT ACGGCACGCT GATTGCGGTC ATCGTGATGA
251 TTTTGATGCC GAACTCGGGC AGCTTCGGTT TCGGCTATGC GTCGCTGGCG
301 GCCTTGTCGT TCGGCGCGCT GATGATTGCG CTGTTGGACG TGTCGTCGAA
351 TATGGCGATG CAGCCGTTTA AGATGATGGT CGGCGATATG GTCAACGAGG
401 AGCAGAAAAG CTACGCCTAC GGGATTCAAA GTTTCTTAGC GAATACGGAC
451 GCGGTTGTGG CAGCGATTCT GCCGTTTGTG TTcgcgtata TCGGTTTGGC
501 GAACACTGCC GAGAAAGGCG TTGTGCCACA AACCGTGGTC GTAGCATTCT
551 ATGTGGGTGC GGCGTTACTG ATTATTACCA GTGCGTTCAC AATCTCCAAA
601 GTCAAAGAAT ACGACCCGGA AACCTACGCC CGTTACCACG GCATCGATGT
651 CGCCGCGAAT CAGGAAAAAG CCAACTGGTT CGAACTCTTA AAAACCGCGC
701 CTAAAGTGTT TTGGACGGTT ACTCCGGTAC AGTTTTTCTG CTGGTTCGCC
751 TTCCGGTATA TGTGGACTTA CTCGGCAGGC GCGATTGCAG AAAACGTCTG
801 GCACACTACC GATGCGTCTT CCGTAGGCCA TCAGGAGGCG GGCAACCGGT
851 ACGGCGTTTT GGCGGCGGTG TAGTCGGTTG CGGCGGTGAT TTGTTCGTTT
901 ATTCTGGCAA AAGTACCGAA TAAATACCAT AAGGCGGGTT ATTTCGGCTG
951 TTTGGCTTTG GGCGCGCTCG GTTTCTTCTC TATCTTCTTC ATCTACAATC
1001 AATACGCACT CATCCTGTCT TATATCTTAA TCGGCATCGC TTGGGCGGGC
1051 ATTATCACTT ATCCGCTGAC GATTGTGGCC AACGCTTTGT CGGGCAAACA
1101 CATGGATACT TATTTGGGCC TGTttaacgg ctctgtCTGT ATGCcgcaaa
1151 tcgTcgctTC GctgttgAGT TTCGTGCTTT TCCCGATGCT GGGCGGCCAT
1201 CAGGCAACCA TGTTCTTGGT TGCAGGCGCA GTCTTGCTGC TGGGAGCCTT
1251 CTCAGTCTGT CTGATTAAAG AGATCCACGG CGGGGTTTGA
```

This corresponds to the amino acid sequence <SEQ ID 566; ORF 143.ng>:

```
g143.pep
  1 MLSFGYLGVQ TAFTLQSSQM SRIFQTLGAD PHNLGWFFIL PPLAGMLVQP

51 IVGYYSDRTW KPRLGGRRLP YLLYGTLIAV IVMILMPNSG SFGFGYASLA

101 ALSFGALMIA LLDVSSNMAM QPFKMMVGDM VNEEQKSYAY GIQSFLANTD

151 AVVAAILPFV FAYIGLANTA EKGVVPQTVV VAFYVGAALL IITSAFTISK

201 VKEYDPETYA RYHGIDVAAN QEKANWFELL KTAPKVFWTV TPVQFFCWFA

251 FRYMWTYSAG AIAENVWHTT DASSVGHQEA GNRYGVLAAV *SVAAVICSF

301 ILAKVPNKYH KAGYFGCLAL GALGFFSIFF IYNQYALILS YILIGIAWAG

351 IITYPLTIVA NALSGKHMDT YLGLFNGSVC MPQIVASLLS FVLFPMLGGH

401 QATMFLVAGA VLLLGAFSVC LIKEIHGGV*
```

The following partial DNA sequence was identified in *N. meningitidis* <SEQ ID 567>:

```
m143.seq
    1 ATGCTCAGTT TCGGCTTTCT CGGCGTTCAG ACGGCCTTTA CCCTGCAAAG

51 CTCGCAAATG AGCCGCATTT TTCAAACGCT A

Computer analysis of this amino acid sequence gave the following results:
Homology with a Predicted ORF from *N. gonorrhoeae*

```
m143/g143  93.9% identity in 429 aa overlap
                    10        20        30        40        50        60
m143.pep   MLSFGFLGVQTAFTLQSSQMSRIFQTLGADPHNLGWFFILPPLAGMLVQPIVGHYSDRTW
           |||||:||||||||||||||||||||||||||||||||||||||||||||||:||||||
g143       MLSFGYLGVQTAFTLQSSQMSRIFQTLGADPHNLGWFFILPPLAGMLVQPIVGYYSDRTW
                    10        20        30        40        50        60
                    70        80        90       100       110       120
m143.pep   KPRLGGRRLPYLLYGTLIAVIVMILMPNSGSFGFGYASLAALSFGALMIALLDVSSNMAM
           ||||||||||||||||||||||||||||||||||||||||||||||||||||||||||||
g143       KPRLGGRRLPYLLYGTLIAVIVMILMPNSGSFGFGYASLAALSFGALMIALLDVSSNMAM
                    70        80        90       100       110       120
                   130       140       150       160       170       180
m143.pep   QPFKMMVGDMVNEEQKGYAYGIQSFLANTGAVVAAILPFVFAYIGLANTAEKGVVPQTVV
           ||||||||||||||||:||||||||||| |||||||||||||||||||||||||||||||
g143       QPFKMMVGDMVNEEQKSYAYGIQSFLANTDAVVAAILPFVFAYIGLANTAEKGVVPQTVV
                   130       140       150       160       170       180
                   190       200       210       220       230       240
m143.pep   VAFYVGAALLVITSAFTIFKVKEYDPETYARYHGIDVAANQEKANWIELLKTAPKAFWTV
           ||||||||||:||||||| |||||||||||||||||||||||||||:||||||||:||||
g143       VAFYVGAALLIITSAFTISKVKEYDPETYARYHGIDVAANQEKANWFELLKTAPKVFWTV
                   190       200       210       220       230       240
                   250       260       270       280       290       300
m143.pep   TLVQFFCWFAFQYMWTYSAGAIAENVWHTTDASSVGYQEAGNWYGVLAAVQSVAAVICSF
           | |||||||||:||||||||||||||||||||||:||||| |||||||| |||||||||
g143       TPVQFFCWFAFRYMWTYSAGAIAENVWHTTDASSVGHQEAGNRYGVLAAVXSVAAVICSF
                   250       260       270       280       290       300
                   310       320       330       340       350       360
m143.pep   VLAKVPNKYHKAGYFGCLALGALGFFSVFFIGNQYALVLSYTLIGIAWAGIITYPLTIVT
           :|||||||||||||||||||||||||||:||| ||||| :||| |||||||| |||||||:
g143       ILAKVPNKYHKAGYFGCLALGALGFFSIFFIYNQYALILSYILIGIAWAGIITYPLTIVA
                   310       320       330       340       350       360
                   370       380       390       400       410       420
m143.pep   NALSGKHMGTYLGLFNGSICMPQIVASLLSFVLFPMLGGLQATMFLVGGVVLLLGAFSVF
           |||||||| ||||||||||:||||||||||||||||||| |||||:|:|||||||||||
g143       NALSGKHMDTYLGLFNGSVCMPQIVASLLSFVLFPMLGGHQATMFLVAGAVLLLGAFSVF
                   370       380       390       400       410       420
                   430
m143.pep   LIKETHGGVX
           |||| |||||
g143       LIKEIHGGVX
                   430
```

The following partial DNA sequence was identified in *N. meningitidis* <SEQ ID 569>:

```
a143.seq
   1 ATGCTCAGTT TCGGCTTTCT CGGCGTTCAG ACGGCCTTTA CCCTGCAAAG

51 CTCGCAGATG AGCCGCATCT TCCAGACGCT CGGTGCCGAT CCGCACAGCC

101 TCGGCTGGTT CTTTATCCTG CCGCCGCTGG CGGGGATGCT GGTGCAGCCG

151 ATTGTCGGCC ATTACTCCGA CCGCACTTGG AAGCCGCGTT TGGGCGGCCG

201 CCGTCTGCCG TATCTGCTTT ATGGCACGCT GATTGCGGTT ATTGTGATGA

251 TTTTGATGCC GAACTCGGGC AGCTTCGGTT TCGGCTATGC GTCGCTGGCG

301 GCTTTGTCGT TCGGCGCGCT GATGATTGCG CTGTTAGACG TGTCGTCAAA

351 TATGGCGATG CAGCCGTTTA AGATGATGGT CGGCGACATG GTCAACGAGG

401 AGCAGAAAGG CTACGCCTAC GGGATTCAAA GTTTCTTAGC GAATACGGGC

451 GCGGTCGTGG CGGCGATTCT GCCGTTTGTG TTTGCGTATA TCGGTTTGGC

501 GAACACCGCC GAGAAAGGCG TTGTGCCGCA GACCGTGGTC GTGGCGTTTT

551 ATGTGGGTGC GGCGTTGCTG GTGATTACCA GCGCGTTCAC GATTTTCAAA
```

```
 601 GTGAAGGAAT ACAATCCGGA AACCTACGCC CGTTACCACG GCATCGATGT
 651 CGCCGCGAAT CAGGAAAAAG CCAACTGGAT CGAACTCTTG AAAACCGCGC
 701 CTAAGGCGTT TTGGACGGTT ACTTTGGTGC AATTCTTCTG CTGGTTCGCC
 751 TTCCAATATA TGTGGACTTA CTCGGCAGGC GCGATTGCGG AAAACGTCTG
 801 GCACACCACC GATGCGTCTT CCGTAGGTTA TCAGGAGGCG GGTAACTGGT
 851 ACGGCGTTTT GGCGGCGGTG CAGTCGGTTG CGGCGGTGAT TTGTTCGTTT
 901 GTATTGGCGA AAGTGCCGAA TAAATACCAT AAGGCGGGTT ATTTCGGCTG
 951 TTTGGCTTTG GGCGCGCTCG GCTTTTTCTC CGTTTTCTTC ATCGGCAACC
1001 AATACGCGCT GGTGTTGTCT TATACCTTAA TCGGCATCGC TTGGGCGGGC
1051 ATTATCACTT ATCCGCTGAC GATTGTGACC AACGCCTTGT CGGGCAAGCA
1101 TATGGGCACT TACTTGGGCC TGTTTAACGG CTCTATCTGT ATGCCGCAAA
1151 TCGTCGCTTC GCTGTTGAGT TTCGTGCTTT TCCCTATGCT GGGCGGCTTG
1201 CAGGCCACTA TGTTCTTGGT AGGGGGCGTC GTCCTGCTGC TGGGCGCGTT
1251 TTCCGTGTTC CTGATTAAAG AAACACACGG CGGGGTTTGA
```

This corresponds to the amino acid sequence <SEQ ID 570; ORF 143.a>:

```
a143.pep

1 MLSFGFLGVQ TAFTLQSSQM SRIFQYLGAD PHSLGWFFIL PPLAGMLVQP

51 IVGHYSDRTW KPRLGGRRLP YLLYGTLIAV IVMILMPNSG SFGFGYASLA

101 ALSFGALMIA LLDVSSNMAM QPFKMMVGDM VNEEQKGYAY GIOQSLANTG

151 AVVAAILPFV FAYIGLANTA EKGVVPQTVV VAFYVGAALL VITSAFTIFK

201 VKEYNPETYA RYHGIDVAAN QEKANWIELL KTAPKAFWTV TLVQFFCWFA

251 FQYMWTYSAG AIAENVWHTT DASSVGYQEA GNWYGVLAAV QSVAAVICSF

301 VLAKVPNKYH KAGYFGCLAL GALGFFSVFF IGNQYALVLS YTLIGIAWAG

351 IITYPLTIVT NALSGKHMGT YLGLFNGSIC MPQIVASLLS FVLFPMLGGL

401 QATMFLVGGV VLLGAFSVF LIKETHGGV* m143/a143   99.5% identity in 429 aa overlap 10         20         30         40         50         60
          m143.pep MLSFGFLGVQTAFTLQSSQMSRIFQTLGADPHNLGWFFILPPLAGMLVQPIVGHYSDRTW
                   ||||||||||||||||||||||||:||||||||||||||||||||||||||||||||||
          a143    MLSFGFLGVQTAFTLQSSQMSRIFQTLGADPHSLGWFFILPPLAGMLVQPIVGHYSDRTW
                  10         20         30         40         50         60

70         80         90        100        110        120
          m143.pep KPRLGGRRLPYLLYGTLIAVIVMILMPNSGSFGFGYASLAALSFGALMIALLDVSSNMAM
                   ||||||||||||||||||||||||||||||||||||||||||||||||||||||||||
          a143    KPRLGGRRLPYLLYGTLIAVIVMILMPNSGSFGFGYASLAALSFGALMIALLDVSSNMAM
                  70         80         90        100        110        120

130        140        150        160        170        180
          m143.pep QPFKMMVGDMVNEEQKGYAYGIQSFLANTGAVVAAILPFVFAYIGLANTAEKGVVPQTVV
                   ||||||||||||||||||||||||||||||||||||||||||||||||||||||||||
          a143    QPFKMMVGDMVNEEQKGYAYGIQSFLANTGAVVAAILPFVFAYIGLANTAEKGVVPQTVV
                 130        140        150        160        170        180

190        200        210        220        230        240
          m143.pep VAFYVGAALLVITSAFTIFKVKEYDPETYARYHGIDVAANQEKANWIELLKTAPKAFWTV
                   |||||||||||||||||||||||:||||||||||||||||||||||||||||||||||
          a143    VAFYVGAALLVITSAFTIFKVKEYNPETYARYHGIDVAANQEKANWIELLKTAPKAFWTV
                 190        200        210        220        230        240

250        260        270        280        290        300
          m143.pep TLVQFFCWFAFQYMWTYSAGAIAENVWHTTDASSVGYQEAGNWYGVLAAVQSVAAVICSF
                   ||||||||||||||||||||||||||||||||||||||||||||||||||||||||||
          a143    TLVQFFCWFAFQYMWTYSAGAIAENVWHTTDASSVGYQEAGNWYGVLAAVQSVAAVICSF
                 250        260        270        280        290        300
```

-continued

```
              310        320        330        340        350        360
m143.pep  VLAKVPNKYHKAGYFGCLALGALGFFSVFFIGNQYALVLSYTLIGIAWAGIITYPLTIVT
          ||||||||||||||||||||||||||||||||||||||||||||||||||||||||||||
a143      VLAKVPNKYHKAGYFGCLALGALGFFSVFFIGNQYALVLSYTLIGIAWAGIITYPLTIVT
              310        320        330        340        350        360

370        380        390        400        410        420
m143.pep  NALSGKHMGTYLGLFNGSICMPQIVASLLSFVLFPMLGGLQATMFLVGGVVLLLGAFSVF
          ||||||||||||||||||||||||||||||||||||||||||||||||||||||||||||
a143      NALSGKHMGTYLGLFNGSICMPQIVASLLSFVLFPMLGGLQATMFLVGGVVLLLGAFSVF
              370        380        390        400        410        420

430
m143.pep  LIKETHGGVX
          ||||||||||
a143      LIKETHGGVX
              430
```

The following partial DNA sequence was identified in *N. gonorrhoeae* <SEQ ID 571>:

```
g144.seq
  1 ATGAGCGATA CCCCCGCTAC CCGCGATTTC GGCCTGATCG ACGGGCGGGC

51 CGTAACCGGC TATGTGCTGT CCAACCGGCG TGGTACGTGC GTCTTCGTGC

101 TGGACTTGGG CGGGATTGTG CAGGAATTTT CCGTTTTGGC AGACGGCGTG

151 CGCGAAAACC CCGTGGTGTC GTTCGACGAT GCGGCTTCCT ATGCGGACAA

201 TCCGTTTCAG ATTAACAAGC AGATAGGGCG CGTGGCCGGA CGCATCCGCG

251 GTGCGGCGTT CGACATCAAC GGTAGGACTT ACCGCGTGGA GGCCAACGAA

301 GGCAGGAACG CGCTGCACGG CGGTTCGCAC GGGCTGGCCG TTACCcgtTT

351 CAACGCGGTG GCGGCAGACG GccgacggTt atCCCAACGA TTTGGatatT

401 TCctaccgCT TGGACGAGGA CGGCCGGCTT ACCGTtaccT ATCGCGCCAC

451 CGCgctCGGC GACACGGTGT TCGACCCGAC GCTGCACATT TACTGGCGGC

501 TGGACGCGGG CCTGCACGAT GCGGTTCTGC ATATTCCGCA GGGCGGACAT

551 ATTCCGGCCG ATGCCGAAAA ACTGCCCGTC TTAACGGTTT CAGACGGCCT

601 CGAAGTATTT GA
```

This corresponds to the amino acid sequence <SEQ ID 572; ORF 144.ng>:

```
g144.pep
  1 MSDTPATRDF GLIDGRAVTG YVLSNRRGTC VFVLDLGGIV QEFSVLADGV

51 RENPVVSFDD AASYADNPFQ INKQIGRVAG RIRGAAFDIN GRTYRVEANE

101 GRNALHGGSH GLAVTRFNAV AADGRRLSQR FGYFLPLGRG RPAYRYLSRH

151 RARRHGVRPD AAHLLAAGRG PARCGSAYSA GRTYSGRCRK TARLNGFRRP

201 RSI*
```

The following partial DNA sequence was identified in *N. meningitidis* <SEQ ID 573>:

```
m144.seq
  1 ATGAGCGATA CCCCCGCTAC CCGCGATTTC GGTCTGATCG ACGGGCGTGC

51 CGTAACCGGC TATGTGCTGT CCAACCGGCG TGGTACGCGT GTCTGCGTGC

101 TGGACTTGGG CGGGATTGTG CAGGAATTTT CCGTTTTGGC AGACGGCGTG

151 CGCGAAAACC TCGTGGTGTC GTTCGATGAT GCGGCTTCCT ATGCGGACAA
```

-continued

```
201 TCCGTTTCAG ATTAACAAAC AGATAGGGCG CGTGGCCGGA CGCATCCGCG

251 GTGCGGCGTT CGACATCAAC GGCAGGACTT ACCGCGTGGA GGCCAACGAA

301 GGCAGGAACG CGCTGCACGG CGGTTCGCAC GGGCTGGCCG TTACCCGTTT

351 CAACGCGGTG GCGGCAGACG GCCGTTCGGT GGTGCTGCGC AGCCGCCTGg

401 CAACAGTCGG CCGACGGTTA TCCCAACGAT TTGGATTTGG ATATTTCCTA

451 CCGCTTGGAC GAGGACGACC GGCTTACCGT TAcCTATCGC GCCACCGCGC

501 TCGGCGACAC GGTGTTCGAC CCGACGCTGC ACATTTACTG GCGGCTGGAC

551 GCGGGCCTGC ACGATGCGGT TCTGCATATT CCGCAGGGCG GACATATGCC

601 GGCCGATGCC GAAAAACTGC CCGTCTCAAC GGTTTCAGAC GACCTCGAAG

651 TATTTGA
```

This corresponds to the amino acid sequence <SEQ ID 574; ORF 144>:

```
m144.pep
  1 MSDTPATRDF GLIDGRAVTG YVLSNRRGTR VCVLDLGGIV QEFSVLADGV

51 RENLVVSFDD AASYADNPFQ INKQIGRVAG RIRGAAFDIN GRTYRVEANE

101 GRNALHGGSH GLAVTRFNAV AADGRSVVLR SRLATVGRRL SQRFGFGYFL

151 PLGRGRPAYR YLSRHRARRH GVRPDAAHLL AAGRGPARCG SAYSAGRTYA

201 GRCRKTARLN GFRRPRSI*
```

Computer analysis of this amino acid sequence gave the following results:
Homology with a Predicted ORF from *N. gonorrhoeae*

```
   m144/g144  91.3% identity in 218 aa overlap 10         20         30         40         50         60
   m144.pep  MSDTPATRDFFLIDGRAVTGYVLSNRRGTRVCVLDLGGIVQEFSVLADGVRENLVVSFDD
             ||||||||||||||||||||||||||||| | ||||||||||||||||||||| ||||||
   g144      MSDTPATRDFFLIDGRAVTGYVLSNRRGTCVFVLDLGGIVQEFSVLADGVRENPVVSFDD
                    10         20         30         40         50         60

70         80         90        100        110        120
   m144.pep  AASYADNPFQINKQIGRVAGRIRGAAFDINGRTYRVEANEGRNALHGGSHGLAVTRFNAV
             ||||||||||||||||||||||||||||||||||||||||||||||||||||||||||||
   g144      AASYADNPFQINKQIGRVAGRIRGAAFDINGRTYRVEANEGRNALHGGSHGLAVTRFNAV
                    70         80         90        100        110        120

130        140        150        160        170        180
   m144.pep  AADGRSVVLRSRLATVGRRLSQRFGFGYFLPLGRGRPAYRYLSRHRARRHGVRPDAAHLL
             |||             ||||||||| |||||||||||||||||||||||||||||||||
   g144      AAD-------------GRRLSQRFG--YFLPLGRGRPAYRYLSRHRARRHGVRPDAAHLL
                                     130        140        150        160

190        200        210        219
   m144.pep  AAGRGPARCGSAYSAGRTYAGRCRKTARLNGFRRPRSIX
             |||||||||||||||||||||:|||||||||||||||||
   g144      AAGRGPARCGSAYSAGRTYSGRCRKTARLNGFRRPRSIX
                   170        180        190        200
```

The following partial DNA sequence was identified in *N. meningitidis* <SEQ ID 575>:

```
a144.seq
  1 ATGAGCGATA CCCCCGCTAC CCGCGATTTC GGCCTGATCG ACGGGCGTGC

51 CGTAACCGGC TATGTGCTGT CCAACCGGCG TGGTACGCGT GTCTGCGTGC

101 TGGACTTGGG CGGGATTGTG CAGGAATTTT CCGTTTTGGC AGACGGCGTG

151 CGCGAAAACC TCGTGGTGTC GTTCGACGAT GCGGCTTCCT ATGCGGACAA
```

-continued

```
201 TCCGTTTCAG ATTAACAAGC AGATAGGGCG CGTGGCCGGA CGCATCCGCG

251 GTGCGGCGTT CGACATCAAC GGCAGGACTT ACCGCGTGGA GGCCAACGAA

301 GGCAGGAACG CGCTGCACGG CGGTTCGCAC GGGCTGGCCG TTACCCGTTT

351 CAACGCGGTG GCGGCAGACG GCCGTTCGGT GGTGCTGCGC AGCCGCCTG.

401 CAACAGTCGG CCGACGGTTA TCCCAACGAT TTGGATTTGG ATATTTCCTA

451 CCGCTTGGAC GAGGACGACC GGCTTACCGT TACCTATCGC GCCACCGCGC

501 TCGGCGACAC GGTGTTCGAC CCGACGCTGC ACATTTACTG GCGGCTGGAC

551 GCGGGCCTGC ACGATGCGGT TCTGCATATT CCGCAGGGCG GACATATTCC

601 GGCCGATGCC GAAAAACTGC CCGTCTCAAC GGTTTCAGAC GACCTCGAAG

651 TATTTGA
```

This corresponds to the amino acid sequence <SEQ ID 576; ORF 144.a>:

```
a144.pep

1 MSDTPATRDF GLIDGRAVTG YVLSNRRGTR VCVLDLGGIV QEFSVLADGV

51 RENLVVSFDD AASYADNPFQ INKQIGRVAG RIRGAAFDIN GRTYRVEANE

101 GRNALHGGSH GLAVTRFNAV AADGRSVVLR SRLXTVGRRL SQRFGFGYFL

151 PLGRGRPAYR YLSRHRARRH GVRPDAAHLL AAGRGPARCG SAYSAGRTYS

201 GRCRKTARLN GFRRPRSI* m144/a144 99.1% identity in 218 aa overlap 10         20         30         40         50         60
m144.pep MSDTPATRDFGLIDGRAVTGYVLSNRRGTRVCVLDLGGIVQEFSVLADGVRENLVVSFDD
         ||||||||||||||||||||||||||||||||||||||||||||||||||||||||||||
a144     MSDTPATRDFGLIDGRAVTGYVLSNRRGTRVCVLDLGGIVQEFSVLADGVRENLVVSFDD
                10         20         30         40         50         60

70         80         90        100        110        120
m144.pep AASYADNPFQINKQIGRVAGRIRGAAFDINGRTYRVEANEGRNALHGGSHGLAVTRFNAV
         ||||||||||||||||||||||||||||||||||||||||||||||||||||||||||||
a144     AASYADNPFQINKQIGRVAGRIRGAAFDINGRTYRVEANEGRNALHGGSHGLAVTRFNAV
                70         80         90        100        110        120

130        140        150        160        170        180
m144.pep AADGRSVVLRSRLATVGRRLSQRFGFGYFLPLGRGRPAYRYLSRHRARRHGVRPDAAHLL
         ||||||||||||| ||||||||||||||||||||||||||||||||||||||||||||||
a144     AADGRSVVLRSRLXTVGRRLSQRFGFGYFLPLGRGRPAYRYLSRHRARRHGVRPDAAHLL
               130        140        150        160        170        180

190        200        210    219
m144.pep AAGRGPARCGSAYSAGRTYAGRCRKTARLNGFRRPRSIX
         |||||||||||||||||||||:|||||||||||||||||
a144     AAGRGPARCGSAYSAGRTYSGRCRKTARLNGFRRPRSIX
               190        200        210    219
```

The following partial DNA sequence was identified in *N. gonorrhoeae* <SEQ ID 577>:

```
g146.seq
  1 ATGAAGCAAA TCCCCCTCCG CCTTCTCCAG GTCGTCATTG ACCACGACAA

51 AGTCGAACAA TACGGACTGT TCGATTTCAT GCCTTGCCTT CGACAGCCTC

101 CTTTGGATAa ctTCCCGACT GTCCGTCCCG CGCcctTTGA GGCGCGCGGC

151 AAGCACGTCG AAAGAAGGCG GCAGGATAAA GATACCGACA GCTTCCGGCA

201 GCGCGTTGCG AACCTGCGCC GCGCCCTGAA CGTCGATTTC CAAAATCACG

251 TCATAGCCTG CCGCCGCCAA CGCATTCACG CCCTCCGTGC TTGTGCCGTA
```

-continued

```
301 ATAGTTGCCG AATACGTCTG CGTATTCCAA AAAAGCCTCC TGCGCGATAA

351 GCGATTCAAA CTCTTCTTTG GAAACAAAGT GATAATGTAC GCCGTTTGCT

401 TCGCCTTCAC GCGGCGGGCG CGTCGTATGC GACACGGAAA CGCGCAAACC

451 GTTATGGTTT GCCAACAGCC GCGACACCAG CGTGGTTTTG CCCGTGCCGG

501 AAGCGGCCGA AATGATAAAG ATGTTGCCTT TTCGATAAGC GGACATATTT

551 TTTACCTGTA TATTTTCCAA CCGATTGTAT CACAACGGAC ACCCTATTTC

601 ATATTTGCCG ATGCCCATAT TTTGCCGCTA TTGTTTTGA
```

This corresponds to the amino acid sequence <SEQ ID 578; ORF 146.ng>:

```
g146.pep
  1 MKQIPLRLLQ VVIDHDKVEQ YGLFDFMPCL RQPPLDNFPT VRPAPFEARG

51 KHVERRRQDK DTDSFRQRVA NLRRALNVDF QNHVIACRRQ RIHALRACAV

101 IVAEYVCVFQ KSLLRDKRFK LFFGNKVIMY AVCFAFTRRA RRMRHGNAQT

151 VMVCQQPRHQ RGFARAGSGR NDKDVAFSIS GHIFYLYIFQ PIVSQRTPYF

201 IFADAHILPL LF*
```

The following partial DNA sequence was identified in *N. meningitidis* <SEQ ID 579>:

```
m146.seq
  1 ATGGCGCAAA TCCTCCTCCG CTCGCGCCAA GTCGTCATTG ACCACGACAA

51 AGTCAAACAA TACGGACTGC TCGATTTCAT GCCTTGCCTT CGACAGCCTC

101 CTTTGGATAA CTTCCCGACT GTCCGTCCCG CGTCCGTTGA GGCGCGCGGC

151 AAGTACGTCG AAAGAAGGCG GCAGGATAAA GATGCCGACG GCTTCGGGCA

201 GCGCGTCGCG AACCTGCGCC GCGCCCTGAA CGTCGATTTC CAAAATCACG

251 TCATAGCCTG CCGCCGCCAA CGCATTCACA CCCTCCGCGC CTGTGCCGTA

301 ATAGTTGCCA AATACGTCGG CGTATTCCAA AAAAGCTTCC TGCGCGATAA

351 GCGACTCAAA CTCTTCTTTG GAAACAAAGT GATAATGTAC GCCGTTTGCT

401 TCGCCTTCAC GCGGCGGGCG CGTCGTGTGC GACACGGAAA CGCGCAAACC

451 GTTATGGTTT GCCAACAGCC GCGACACCAG CGTGGTTTTG CCCGTGCCGG

501 AAGCGGCCGA AATGATAAAG ATGTTGCCTT TTCGATAAGC GGACATATTT

551 TTTACCTGTA TATTTTCCAG CCGATTGTAT CACAATGGAC ACCCAGTTTC

601 CTATTTGCCG ATGCCCATAT TTTGCCGCTA TTGTTTTGA
```

This corresponds to the amino acid sequence <SEQ ID 580; ORF 146>:

```
m146.pep
  1 MAQILLRSRQ VVIDHDKVKQ YGLLDFMPCL RQPPLDNFPT VRPASVEARG

51 KYVERRRQDK DADGFGQRVA NLRRALNVDF QNHVIACRRQ RIHTLRACAV

101 IVAKYVGVFQ KSFLRDKRLK LFFGNKVIMY AVCFAFTRRA RRVRHGNAQT

151 VMVCQQPRHQ RGFARAGSGR NDKDVAFSIS GHIFYLYIFQ PIVSQWTPSF

201 LFADAHILPL LF*
```

Computer analysis of this amino acid sequence gave the following results:
Homology with a Predicted ORF from *N. gonorrhoeae*

```
m146/g146  90.1% identity in 212 aa overlap
                    10         20         30         40         50         60
m146.pep   MAQILLRSRQVVIDHDKVKQYGLLDFMPCLRQPPLDNFPTVRPASVEARGKYVERRRQDK
           | || ||  ||||||| :||||:|||||||||||||||||||||||  ||||| :|||||||||
g146       MKQIPLRLLQVVIDHDEVKQYGLFDFMPCLRQPPLDNFPTVRPAPFEARGKHVERRRQDK
                    10         20         30         40         50         60
                    70         80         90        100        110        120
m146.pep   DADGFGQRVANLRRALNVDFQNHVIACRRQRIHTLRACAVIVAKYVGVFQKSFLRDKRLK
           |:|:| |||||||||||||||||||||||||||| :|||||||||:|| |||||:||||| :|
g146       DTDSFRQRVANLRRALNVDFQNHVIACRRQRIHALRACAVIVAEHYVCVFQKSLLRDKRFK
                    70         80         90        100        110        120
                   130        140        150        160        170        180
m146.pep   LFFGNKVIMYAVCFAFTRRARRVRHGNAQTVMVCQQPRHQRGFARAGSGRNDKDVAFSIS
           |||||||||||||||||||||||:||||||||||||||||||||||||||||||||||||
g146       LFFGNKVIMYAVCFAFTRRARRMRHGNAQTVMVCQQPRHQRGFARAGSGRNDKDVAFSIS
                   130        140        150        160        170        180
                   190        200        210
m146.pep   GHIFYLYIFQPIVSQWTPSFLFADAHILPLLFX
           |||||||||||||| || |:|||||||||||||
g146       GHIFYLYIFQPIVSQRTPYFIFADAHILPLLFX
                   190        200        210
                   250        260        270        280        290        300
m146.pep   TLVQFFCWFAFQYMWTYSAGAIAENVWHTTDASSVGYQEAGNWYGVLAAVQSVAAVICSF
           | |||||||||:||||||||||||||||||||||||:||||| |||||||| |||||||||
g146       TPVQFFCWFAFRYMWTYSAGAIAENVWHTTDASSVGHQEAGNRYGVLAAVXSVAAVICSF
                   250        260        270        280        290        300
```

The following partial DNA sequence was identified in *N. meningitidis* <SEQ ID 581>:

```
a146.seq
  1 ATGGCGCAAA TCCTCCTCCG CCCGCGCCAA GTCATCATTG ACCACGACAA

51 AATCGAACAA TACGGACTGT TCGATTTCAT GCCTTGCCTT CGACAGCCTC

101 CTTTGGATAA CTTCCCGACT GTCCGTCCCG CGTCCGTTGA GACGCGCAGC

151 AAGCACATCG AAAGACGGCG GCAGGATAAA GATGCCGACG GCTTCGGGCA

201 GCGCATCTCG AACCTGAGCC GCGCCCTGAA CGTCGATTTC CAAAATCACG

251 TCATAACCTG CCGCCGCCAA CGCATTCACA CCCTCCGCGC TTGTGCCGTA

301 ATAGTTGCCG AACACGTCCG CGTATTCCAA AAAGCCTCC TGCGCGATAA

351 GCGACTCAAA CTCTTCTTTG GAAACAAAGT GATAATGTAC GCCGTTTGCT

401 TCGCCTTCAC GCGGCGGACG CGTCGTGTGC GACACGGAAA CGCGCAAACC

451 GTTATGGTTT GCCAACAGCC GCGACACCAG CGTGGTTTTG CCCGTGCCGG

501 AAGCGGCCGA AATGATAAAG ATGTTGCCTT TTCGATAAGC GGACATATTT

551 TTTACCTGTA TATTTTCCAG CCGATTGTAT CACAACGGAC ACCCGGTTTC

601 CTATTTGCCG ATGCCCATAT TTTGCCGCTA TTGTTTTGA
```

This corresponds to the amino acid sequence <SEQ ID 582; ORF 146.a>:

```
a143.pep
    1 MAQILLRPRQ VIIDHDKIEQ YGLFDFMPCL RQPPLDNFPT VRPASVETRS

51 KHIERRRQDK DADGFGQRIS NLSRALNVDF QNHVITCRRQ RIHTLRACAV

101 IVAEHVRVFQ KSLLRDKRLK LFFGNKVIMY AVCFAFTRRT RRVRHGNAQT
```

```
151 VMVCQQPRHQ RGFARAGSGR NDKDVAFSIS GHIFYLYIFQ PIVSQRTPGF

201 LFADAHILPL LF*
``` m146/a146   90.6% identity in 212 aa overlap

```
                 10         20         30         40         50         60
   m146.pep  MAQILLRSRQVVIDHDKVKQYGLLDFMPCLRQPPLDNFPTVRPASVEARGKYVERRRQDK
             ||||||| |||:||||::|||||||||||||||||||||||||||:|:|::||||||
   a146      MAQILLRPRQVIIDHDKIEQYGLFDFMPCLRQPPLDNFPTVRPASVETRSKHIERRRQDK
                 10         20         30         40         50         60

70         80         90        100        110        120
   m146.pep  DADGFGQRVANLRRALNVDFQNHVIACRRQRIHTLRACAVIVAKYVGVFQKSFLRDKRLK
             ||||||||||::|| ||||||||||:||||||||||||||||::| |||||:|||||||
   a146      DADGFGQRVISLRSALNVDFQNHVITCRRQRIHTLRACAVIVAEHVRVFQKSLLRDKRLK
                 70         80         90        100        110        120

130        140        150        160        170        180
   m146.pep  LFFGNKVIMYAVCFAFTRRARRVRHGNAQTVMVCQQPRHQRGFARAGSGRNDKDVAFSIS
             ||||||||||||||||||||:|||||||||||||||||||||||||||||||||||||
   a146      LFFGNKVIMYAVCFAFTRRTRRVRHGNAQTVMVCQQPRHQRGFARAGSGRNDKDVAFSIS
                130        140        150        160        170        180

190        200        210
   m146.pep  GHIFYLYIFQPIVSQWTPSFLFADAHILPLLFX
             ||||||||||||||| ||:|||||||||||||
   a146      GHIFYLYIFQPIVSQRTPGFLFADAHILPLLFX
                190        200        210
```

The following partial DNA sequence was identified in *N. gonorrhoeae* <SEQ ID 583>:

```
g147.seq (partial)
  1  ..ATGCGACGAG AAGCCAAAAT GGCACAAATC ACACTCAAAC CCATTGTTTT

51    ATCAATTCTT TTAATCAACA CACCCCTCCT CGCCCAAGCG CATGAAACTG

101    AGCAATCGGT GGGCTTGGAA ACGGTCAGCG TCGTCGGCAA AAGCCGTCCG

151    CGCGCGACTT CGGGGCTGCT GCACACTTCG ACCGCCTCCG ACAAAATCAT

201    CTCCGGCGAT ACTTTGCGCC AAAAAGCCGT CAACTTGGGC GACGCTTTGG

251    ACGGCGTACC GGGCATCCAC GCTTCGCAAT ACGGCGGCGG CGCATCCGCT

301    CCCGTTATTC GCGGTCAAAC GGGCAGACGG ATTAAAGTAT TGAACCATCA

351    CGGCGAAACG GGCGATATGG CGGACTTTTC TCCCGATCAC GCCATTATGG

401    TAGATACCGC CTTGTCGCAA CAGGTTGAAA TCCTGCGCGG GCCGGTTACG

451    CTCTTGTACA GCTCGGgcaa tgtggccgGG GCTGGtcaat gttgccgatg 501    gAAAAAtccc ccaaaaAAtg cc..
```

This corresponds to the amino acid sequence <SEQ ID 584; ORF 147.ng>:

```
g147.pep (partial)
  1  . . . MRREAKMAQI TLKPIVLSIL LINTPLLAQA HETEQSVGLE TVSVVGKSRP

51        RATSGLLHTS TASDKIISGD TLRQKAVNLG DALDGVPGIH ASQYGGGASA

101        PVIRGQTGRR IKVLNHHGET GDMADFSPDH AIMVDTALSQ QVEILRGPVT

151        LLYSSGNVAG AGQCCRWKNP PKNA . . .
```

The following partial DNA sequence was identified in *N. meningitidis* <SEQ ID 585>:

```
m147.seq (partial)
  1  . . . CCGCATAAAA CTGAGCAATC GGTGGATTTG GAAACGGTCA GCGTCGTCGG

51        CAAAAGCCGT CCGCGCGCCA CGTCGGGGCT GTTGCACACT TCGACCGCCT
```

-continued

```
 101   CCGACAAAAT CATCTCCGGC GATACCTTGC GCCAAAAAGC CGTCAACTTG
 151   GGCGACGCTT TAGACGGCGT ACCGGGCATC CACGCTTCGC AATACGGCGG
 201   CGGCGCGTCT GCTCCCGTCA TTCGCGGTCA ACAGGCAGG CGGATTAAAG
 251   TGTTGAACCA TCACGGCGAA ACAGGCGATA TGGCGGATTT TTCGCCCGAT
 301   CACGCCATTA TGGTAGATAC CGCCTTGTCG CAACAGGTCG AAATCCTGCG
 351   CGGGCCGGTT ACGCTCTTGT ACAGCTCGGG CAATGTGGCG GGCTGGTCG
 401   ATGTTGCCGA TGGCAAAATC CCCGAAAAAA TGCCTGAAAA CGGCGTATCG
 451   GGCGAACTCG GATTGCGTTT GAGCAGCGGC AATCTGGAAA AACTCACGTC
 501   CGGCGGCATC AATATCGGTT TGGGCAAAAA CTTTGTATTG CACACGGAAG
 551   GGCTGTACCG CAAATCGGGG GATTACGCCG TACCGCGTTA CCGCAATCTG
 601   AAACGCCTGC CCGACAGCCA CGCCGATTCG CAAACGGGCA GCATCGGGCT
 651   GTCTTGGGTT GGCGAAAAAG GTTTTATCGG CGTAGCGTAC AGCGACCGTC
 701   GCGACCAATA TGGTCTGCCT GCCCACAGCC ACGAATACGA TGATTGCCAC
 751   GCCGACATCA TCTGGCAAAA GAGCTTGATT AACAAACGCT ATTTACAGCT
 801   TTATCCGCAC CTGTTGACCG AAGAAGACAT CGATTACGAC AATCCGGGCT
 851   TGAGCTGCGG CTTCCACGAC GACGATAATG CACACGCACA CACCCACAGC
 901   GGCAGACCGT GGATAGACCT GCGCAACAAA CGCTACGAAC TCCGTGCCGA
 951   ATGGAAGCAA CCGTTCCCCG GTTTTGAAGC CCTGCGCGTA CACCTGAACC
1001   GCAACGACTA CCGCCACGAC GAAAAAGCAG GCGATGCAGT CGAAAACTTT
1051   TTTAACAACC AAACGCAAAA CGGCGGCATC GAGTTGCGCC AACAACCGAT
1101   AGGTCGTCTG AAAGGCAGCT GGGGCGTGCA ATATTTACAA CAAAAATCCA
1151   GTGCTTTATC TGCCATATCC GAAGCGGTTA ACAACCGAT GCTGCTTGAC
1201   AACAAAGTGC AACATTACAG CTTTTTCGGT GTAGAACAGG CAAACTGGGA
1251   CAACTTCACG CTTGAAGGAG GCGTACGCGT GGAAAAACAA AAAGCCTCCA
1301   TTCAGTACGA CAAAGCATTG ATTGATCGGG AAAACTACTA CAACCACCCC
1351   CTGCCCGACC TCGGCGCGCA CCGCCAAACC GCCCGCTCAT TCGCACTTTC
1401   GGGCAACTGG TATTTCACGC CACAACACAA ACTCAGCCTG ACCGCCTCCC
1451   ATCAGGAACG CCTGCCGTCA ACGCAAGAGC TGTACGCACA CGGCAAACAC
1501   GTCGCCACCA ACACCTTTGA AGTCGGCAAC AAACACCTCA ACAAAGAGCG
1551   TTCCAACAAT ATCGAACTCG CGCTGGGCTA CGAAGGCGAC CGCTGGCAAT
1601   ACAATCTGGC ACTCTACCGC AACCGCTTCG GTAACTACAT TTACGCCCAA
1651   ACCTTAAACG ACGGACGCGG CCCCAAATCC ATCGAAGACG ACAGCGAAAT
1701   GAAGCTCGTG CGCTACAACC AATCCGGCGC CGACTTCTAC GGCGCGGAAG
1751   GCGAAATCTA CTTCAAACCG ACACCGCGCT ACCGCATCGG CGTTTCCGGC
1801   GACTATGTAC GAGGCCGTCT GAAAAACCTG CCTTCCCTAC CCGGCAGAGA
1851   AGATGCCTAC GGCAACCGTC CTTTCATCGC ACAGGACGAC CAAAATGCCC
1901   CCCGTGTTCC GGCTGCGCGC CTCGGCTTCC ACCTGAAAGC CTCGCTGACC
1951   GACCGTATCG ATGCCAATTT GGACTACTAC CGCGTGTTCG CCCAAAACAA
2001   ACTCGCCCGC TACGAAACGC GCACGCCCGG ACACCATATG CTCAACCTCG
2051   GCGCAAACTA CCGCCGCAAT ACGCGCTATG GCGAGTGGAA TTGGTACGTC
```

```
-continued
2101        AAAGCCGACA ACCTGCTCAA CCAATCCGTT TACGCCCACA GCAGCTTTCT

2151        CTCTGATACG CCGCAAATGG GCCGCAGCTT TACCGGCGGC GTGAACGTGA

2201        AGTTTTAA
```

This corresponds to the amino acid sequence <SEQ ID 586; ORF 147>:

```
m147.pep (partial)
  1 . . .  PHKTEQSVDL ETVSVVGKSR PRATSGLLHT STASDKIISG DTLRQKAVNL

51        GDALDGVPGI HASQYGGGAS APVIRGQTGR RIKVLNHHGE TGDMADFSPD

101        HAIMVDTALS QQVEILRGPV TLLYSSGNVA GLVDVADGKI PEKMPENGVS

151        GELGLRLSSG NLEKLTSGGI NIGLGKNFVL HTEGLYRKSG DYAVPRYRNL

201        KRLPDSHADS QTGSIGLSWV GEKGFIGVAY SDRRDQYGLP AHSHEYDDCH

251        ADIIWQKSLI NKRYLQLYPH LLTEEDIDYD NPGLSCGFHD DDNAHAHTHS

301        GRPWIDLRNK RYELRAEWKQ PFPGFEALRV HLNRNDYRHD EKAGDAVENF

351        FNNQTQNARI ELRHQPIGRL KGSWGVQYLQ QKSSALSAIS EAVKQPMLLD

401        NKVQHYSFFG VEQANWDNFT LEGGVRVEKQ KASIQYDKAL IDRENYYNHP

451        LPDLGAHRQT ARSFALSGNW YFTPQHKLSL TASHQERLPS TQELYAHGKH

501        VATNTFEVGN KHLNKERSNN IELALGYEGD RWQYNLALYR NRFGNYIYAQ

551        TLNDGRGPKS IEDDSEMKLV RYNQSGADFY GAEGEIYFKP TPRYRIGVSG

601        DYVRGRLKNL PSLPGREDAY GNRPFIAQDD QNAPRVPAAR LGFHLKASLT

651        DRIDANLDYY RVFAQNKLAR YETRTPGHHM LNLGANYRRN TRYGEWNWYV

701        KADNLLNQSV YAHSSFLSDT PQMGRSFTGG VNVKF*
```

Computer analysis of this amino acid sequence gave the following results:
Homology with a Predicted ORF from *N. gonorrhoeae*

```
    m147/g147 92.3% identity in 142 aa overlap 10        20        30
    m147.pep                     PHKTEQSVDLETVSVVGKSRPRATSGLLHTS
                                 |:|||| ||||||||||||||||||||||||
    g147     MRREAKMAQITLKPIVLSILLINTPLLAQAHETEQSVGLETVSVVGKSRPRATSGLLHTS
                     10        20        30        40        50        60

40        50        60        70        80        90
    m147.pep TASDKIISGDTLRQKAVNLGDALDGVPGIHASQYGGGASAPVIRGQTGRRIKVLNHHGET
             ||||||||||||||||||||||||||||||||||||||||||||||||||||||||||||
    g147     TASDKIISGDTLRQKAVNLGDALDGVPGIHASQYGGGASAPVIRGQTGRRIKVLNHHGET
                     70        80        90       100       110       120

100       110       120       130       140       150
    m147.pep GDMADFSPDHAIMVDTALSQQVEILRGPVTLLYSSGNVAGLVDVADGKIPEKMPENGVSG
             ||||||||||||||||||||||||||||||||||||||||  :      |   |   |
    g147     GDMADFSPDHAIMVDTALSQQVEILRGPVTLLYSSGNVAGAGQCCRWKNPPKNA
```

The following partial DNA sequence was identified in *N. meningitidis* <SEQ ID 587>:

```
a147.seq
  1 ATGCGACGAG AAGCCAAAAT GGCACAAACT ACACTCAAAC CCATTGTTTT

51 ATCAATTCTT TTAATCAACA CACCCCTCCT CTCCCAAGCG CATGGAACTG

101 AGCAATCAGT GGGCTTGGAA ACGGTCAGCG TCGTCGGCAA AAGCCGTCCG

151 CGCGCCACTT CGGGGCTGCT GCACACTTCT ACCGCCTCCG ACAAAATCAT
```

-continued

```
 201 CAGCGGCGAC ACCTTGCGAC AAAAAGCCGT CAACTTGGGT GATGCTTTAG
 251 ACGGCGTACC GGGCATTCAT GCCTCGCAAT ACGGCGGCGG CGCATCCGCT
 301 CCCGTTATTC GCGGTCAAAC AGGCAGACGG ATTAAAGTGT TGAACCATCA
 351 CGGCGAAACG GGCGACATGG CGGACTTCTC TCCAGACCAT GCAATCATGG
 401 TGGACAGCGC CTTGTCGCAA CAGGTCGAAA TCCTGCGCGG TCCGGTTACG
 451 CTCTTGTACA GCTCGGGCAA TGTGGCGGGG CTGGTCGATG TTGCCGATGG
 501 CAAAATCCCC GAAAAATGC CTGAAAACGG CGTATCGGGC GAACTCGGAT
 551 TGCGTTTGAG CAGCGGCAAT CTGGAAAAAC TCACGTCCGG CGGCATCAAT
 601 ATCGGTTTGG GCAAAAACTT TGTATTGCAC ACGGAAGGGC TGTACCGCAA
 651 ATCGGGGGAT TACGCCGTAC CGCGTTACCG CAATCTGAAA CGCCTGCCCG
 701 ACAGCCACGC CGATTCGCAA ACGGGCAGCA TCGGGCTGTC TTGGGTTGGC
 751 GAAAAAGGCT TTATCGGCGC AGCATACAGC GACCGTCGCG ACCAATATGG
 801 TCTGCCTGCC CACAGCCACG AATACGATGA TTGCCACGCC GACATCATCT
 851 GGCAAAAGAG TTTGATTAAC AAACGCTATT GCAGCTTTA TCCGCACCTG
 901 TTGACCGAAG AAGACATCGA TTACGACAAT CCGGGCTTGA GCTGCGGCTT
 951 TCACGACGAC GATGATGCAC ACGCCCATGC CCACAACGGC AAACCTTGGA
1001 TAGACCTGCG CAACAAACGC TACGAACTCC GCGCCGAATG GAAGCAACCG
1051 TTCCCCGGTT TTGAAGCCCT GCGCGTACAC CTGAACCGCA ACGACTACCG
1101 CCACGACGAA AAAGCAGGCG ATGCAGTAGA AACTTTTTT AACAACCAAA
1151 CGCAAAACGC CCGTATCGAG TTGCGCCACC AACCCATAGG CCGTCTGAAA
1201 GGCAGCTGGG GCGTGCAATA TTTGGGACAA AAATCCAGTG CTTTATCTGC
1251 CACATCCGAA GCGGTCAAAC AACCGATGCT GCTTGACAAT AAAGTGCAAC
1301 ATTACAGCTT TTTCGGTGTA GAACAGGCAA ACTGGGACAA CTTCACGCTT
1351 GAAGGCGGCG TACGCGTGGA AAAACAAAAA GCCTCCATCC GCTACGACAA
1401 AGCATTGATT GATCGGGAAA ACTACTACAA CCATCCCCTG CCCGACCTCG
1451 GCGCGCACCG CCAAACCGCC CGCTCATTCG CACTTTCGGG CAACTGGTAT
1501 TTCACGCCAC AACACAAACT CAGCCTGACC GCCTCCCATC AGGAACGCCT
1551 GCCGTCAACG CAAGAGCTGT ACGCACACGG CAAACACGTC GCCACCAACA
1601 CCTTTGAAGT CGGCAACAAA CACCTCAACA AAGAGCGTTC CAACAATATC
1651 GAACTCGCGC TGGGCTACGA AGGCGACCGC TGGCAATACA ATCTGGCACT
1701 CTACCGCAAC CGCTTCGGCA ACTACATTTA CGCCCAAACC TTAAACGACG
1751 GACGCGGCCC CAAATCCATC GAAGACGACA GCGAAATGAA GCTCGTGCGC
1801 TACAACCAAT CCGGTGCGGA CTTCTACGGC GCGGAAGGCG AAATCTACTT
1851 CAAACCGACA CCGCGCTACC GCATCGGCGT TTCCGGCGAC TATGTACGAG
1901 GCCGTCTGAA AAACCTGCCT TCCCTACCCG GCAGGGAAGA CGCCTACGGC
1951 AACCGCCCAC TCATTGCCCA AGCCGACCAA AACGCCCCTC GCGTTCCGGC
2001 TGCGCGCCTC GGCGTCCACC TGAAAGCCTC GCTGACCGAC CGCATCGATG
2051 CCAATTTGGA CTACTACCGC GTGTTCGCCC AAAACAAACT CGCCCGCTAC
2101 GAAACGCGCA CGCCCGGACA CCATATGCTC AACCTCGGCG CAAACTACCG
2151 CCGCAATACG CGCTATGGCG AGTGGAATTG GTACGTCAAA GCCGACAACC
```

```
-continued
2201 TGCTCAACCA ATCCGTTTAC GCCCACAGCA GCTTCCTCTC TGATACGCCG

2251 CAAATGGGCC GCAGCTTTAC CGGCGGCGTG AACGTGAAGT TTTAA
```

This corresponds to the amino acid sequence <SEQ ID 588; ORF 147.a>:

```
a147.pep

1 MRREAKMAQT TLKPIVLSIL LINTPLLSQA HGTEQSVGLE TVSVVGKSRP

51 RATSGLLHTS TASDKIISGD TLRQKAVNLG DALDGVPGIH ASQYGGGASA

101 PVIRGQTGRR IKVLNHHGET GDMADFSPDH AIMVDSALSQ QVEILRGPVT

151 LLYSSGNVAG LVDVADGKIP EKMPENGVSG ELGLRLSSGN LEKLTSGGIN

201 IGLGKNFVLH TEGLYRKSGD YAVPRYRNLK RLPDSHADSQ TGSIGLSWVG

251 EKGFIGAAYS DRRDQYGLPA HSHEYDDCHA DIIWQKSLIN KRYLQLYPHL

301 LTEEDIDYDN PGLSCGFHDD DDAHAHAHNG KPWIDLRNKR YELRAEWKQP

351 FPGFEALRVH LNRNDYRHDE KAGDAVENFF NNQTQNARIE LRHQPIGRLK

401 GSWGVQYLGQ KSSALSATSE AVKQPMLLDN KVQHYSFFGV EQANWDNFTL

451 EGGVRVEKQK ASIRYDKALI DRENYYNHPL PDLGAHRQTA RSFALSGNWY

501 FTPQHKLSLT ASHQERLPST QELYAHGKHV ATNTFEVGNK HLNKERSNNI

551 ELALGYEGDR WQYNLALYRN RFGNYIYAQT LNDGRGPKSI EDDSEMKLVR

601 YNQSGADFYG AEGEIYFKPT PRYRIGVSGD YVRGRLKNLP SLPGREDAYG

651 NRPLIAQADQ NAPRVPAARL GVHLKASLTD RIDANLDYYR VFAQNKLARY

701 ETRTPGHHML NLGANYRRNT RYGEWNWYVK ADNLLNQSVY AHSSFLSDTP

751 QMGRSFTGGV NVKF* m147/a147 98.1% identity in 734 aa overlap
                                   10        20        30
    m147.pep                       PHKTEQSVDLETVSVVGKSRPRATSGLLHTS
                                   | |||||  |||||||||||||||||||||||
    a147      MRREAKMAQTTLKPIVLSILLINTPLLSQAHGTEQSVGLETVSVVGKSRPRATSGLLHTS
                       10        20        30        40        50        60
                     40        50        60        70        80        90
    m147.pep   TASDKIISGDTLRQKAVNLGDALDGVPGIHASQYGGGASAPVIRGQTGRRIKVLNHHGET
               ||||||||||||||||||||||||||||||||||||||||||||||||||||||||||||
    a147       TASDKIISGDTLRQKAVNLGDALDGVPGIHASQYGGGASAPVIRGQTGRRIKVLNHHGET
                       70        80        90       100       110       120
                    100       110       120       130       140       150
    m147.pep   GDMADFSPDHAIMVDTALSQQVEILRGPVTLLYSSGNVAGLVDVADGKIPEKMPENGVSG
               |||||||||||||||:|||||||||||||||||||||||||||||||||||||||||||
    a147       GDMADFSPDHAIMVDSALSQQVEILRGPVTLLYSSGNVAGLVDVADGKIPEKMPENGVSG
                      130       140       150       160       170       180
                    160       170       180       190       200       210
    m147.pep   ELGLRLSSGNLEKLTSGGINIGLGKNFVLHTEGLYRKSGDYAVPRYRNLKRLPDSHADSQ
               ||||||||||||||||||||||||||||||||||||||||||||||||||||||||||||
    a147       ELGLRLSSGNLEKLTSGGINIGLGKNFVLHTEGLYRKSGDYAVPRYRNLKRLPDSHADSQ
                      190       200       210       220       230       240
                    220       230       240       250       260       270
    m147.pep   TGSIGLSWVGEKGFIGVAYSDRRDQYGLPAHSHEYDDCHADIIWQKSLINKRYLQLYPHL
               ||||||||||||||||:|||||||||||||||||||||||||||||||||||||||||||
    a147       TGSIGLSWVGEKGFIGAAYSDRRDQYGLPAHSHEYDDCHADIIWQKSLINKRYLQLYPHL
                      250       260       270       280       290       300
                    280       290       300       310       320       330
    m147.pep   LTEEDIDYDNPGLSCGFHDDDNAHAHTHSGRPWIDLRNKRYELRAEWKQPFPGFEALRVH
               ||||||||||||||||||||||:||||:|:|:||||||||||||||||||||||||||||
    a147       LTEEDIDYDNPGLSCGFHDDDDAHAHAHNGKPWIDLRNKRYELRAEWKQPFPGFEALRVH
                      310       320       330       340       350       360
                    340       350       360       370       380       390
    m147.pep   LNRNDYRHDEKAGDAVENFFNNQTQNARIELRHQPIGRLKGSWGVQYLQQKSSALSAISE
               |||||||||||||||||||||||||||||||||||||||||||||||||| ||||||| ||
    a147       LNRNDYRHDEKAGDAVENFFNNQTQNARIELRHQPIGRLKGSWGVQYLGQKSSALSATSE
                      370       380       390       400       410       420
```

-continued

```
              400        410        420        430        440        450
m147.pep  AVKQPMLLDNKVQHYSFFGVEQANWDNFTLEGGVRVEKQKASIQYDKALIDRENYYNHPL
          ||||||||||||||||||||||||||||||||||||||:|||||||||||||||||||
a147      AVKQPMLLDNKVQHYSFFGVEQANWDNFTLEGGVRVEKQKASIRYDKALIDRENYYNHPL
              430        440        450        460        470        480

460        470        480        490        500        510
m147.pep  PDLGAHRQTARSFALSGNWYFTPQHKLSLTASHQERLPSTQELYAHGKHVATNTFEVGNK
          ||||||||||||||||||||||||||||||||||||||||:|||||||||||||||||||
a147      PDLGAHRQTARSFALSGNWYFTPQHKLSLTASHQERLPSTQELYAHGKHVATNTFEVGNK
              490        500        510        520        530        540

520        530        540        550        560        570
m147.pep  HLNKERSNNIELALGYEGDRWQYNLALYRNRFGNYIYAQTLNDGRGPKSIEDDSEMKLVR
          ||||||||||||||||||||||||||||||||||||||||||||||||||||||||||||
a147      HLNKERSNNIELALGYEGDRWQYNLALYRNRFGNYIYAQTLNDGRGPKSIEDDSEMKLVR
              550        560        570        580        590        600

580        590        600        610        620        630
m147.pep  YNQSGADFYGAEGEIYFKPTPRYRIGVSGDYVRGRLKNLPSLPGREDAYGNRPFIAQDDQ
          |||||||||||||||||||||||||||||||||||||||||||||||||||:|||  ||
a147      YNQSGADFYGAEGEIYFKPTPRYRIGVSGDYVRGRLKNLPSLPGREDAYGNRPLIAQADQ
              610        620        630        640        650        660

640        650        660        670        680        690
m147.pep  NAPRVPAARLGFHLKASLTDRIDANLDYYRVFAQNKLARYETRTPGHHMLNLGANYRRNT
          |||||||||||| |||||||||||||||||||||||||||||||||||||||||||||||
a147      NAPRVPAARLGVHLKASLTDRIDANLDYYRVFAQNKLARYETRTPGHHMLNLGANYRRNT
              670        680        690        700        710        720

700        710        720        730
m147.pep  RYGEWNWYVKADNLLNQSVYAHSSFLSDTPQMGRSFTGGVNVKFX
          ||||||||||| ||||||||||||||||||||||||||||||||
a147      RYGEWNWYVKADNLLNQSVYAHSSFLSDTPQMGRSFTGGVNVKFX
              730        740        750        760
```

The following partial DNA sequence was identified in *N. gonorrhoeae* <SEQ ID 589>:

```
g148.seq
  1  ATGGCGTTAA AAACATCAAA CTTGGAACAC GCAATGctgg ttcaTCCCGA

51  AgctATgagt gtcggcgCGC TTGccgAcaa AATCCGCAAA AtcgaAAact 101  gGCCGCAAAA AGgcaTCTTA TTCCACGACA TCACGCCCGT CCTGCAAAGT

151  GCGGAATACT TCCGCCTTTT GGTCGATTTG CTGGTTTACC GCTATATGGA

201  TCAGAAAATC GACATCGTTG CCGGCTTGGA CGCGCGCGGC TTCATTATCG

251  GCGCGGCACT CGCCTACCAG CTCAaCGtcg gctTCGTCCC CATCCGCAAA

301  AAAGGCAAGC TGCCTTTTGA AACCGTATCG CAAAGCTAcg cgcTCGAATA

351  CGGGGAAGCT GCGGTGGAAA TCCACACCGa tgccgTCAAA CCCGGTTCGC

401  GCGTCCTGCT GGTCGATGAT TTGGTTGCCA CGGGCGGCAC AATGCTTGCC

451  GGGCTGGAAC TGATCCGCAA ACTCGGCGGG GAAATTGTCG AAgccgccgC

501  CATTTTGGAA TTTACCGACC TTCAAGGCGG CAAGAATATC CGCGCAAGTG

551  GCGCGCCCTT ATTTACCCTG CTTCAAAACG AAGGCTGCAT GAAAGGCTGA
```

This corresponds to the amino acid sequence <SEQ ID 590; ORF 148.ng>:

```
g148.pep
  1  MALKTSNLEH AMLVHPEAMS VGALADKIRK IENWPQKGIL FHDITPVLQS

51  AEYFRLLVDL LVYRYMDQKI DIVAGLDARG FIIGAALAYQ LNVGFVPIRK

101  KGKLPFETVS QSYALEYGEA AVEIHTDAVK PGSRVLLVDD LVATGGTMLA

151  GLELIRKLGG EIVEAAAILE FTDLQGGKNI RASGAPLFTL LQNEGCMKG*
```

The following partial DNA sequence was identified in *N. meningitidis* <SEQ ID 591>:

```
m148.seq
  1 ATGGCGTTAA AAACATCAAA CTTGGAACAC GCAATGCTGG TTCATCCCGA

51 AGCTATGAGT GTCGGCGCGC TTGCCGACAA AATCCGCAAA ATCGAAAACT

101 GGCCGCAAAA AGGCATCTTA TTCCACGACA TCACGCCCGT CCTTCAAAGC

151 GCGGAATACT TCCGCCTTTT GGTTGATTTA TTGGTTTACC GCTATATGGA

201 TCAGAAAATC GACATCGTTG CCGGTTTGGA CGCGCGCGGC TTCATTATCG

251 GCGCGGCACT CGCCTACCAG CTCAACGTCG GTTTCGTCCC CATCCGCAAA

301 AAAGGCAAGC TGCCTTTTGA AACCGTATCG CAAAGCTACG CGCTCGAATA

351 CGGGGAAGCT GCGGTGGAAA TCCACACCGA TGCCGTCAAA CTCGGTTCGC

401 GCGTGCTGCT GGTCGATGAT TTGATTGCCA CGGGCGGCAC GATGCTTGCC

451 GGACTGGAAC TGATCCGCAA ACTCGGCGGA GAAATTGTCG AAGCCGCCGC

501 CATTTTGGAA TTTACCGACC TTCAAGGCGG CAAGAATATC CGTGCAAGCG

551 GCGCGCCCTT ATTTACCCTG CTTCAAAACG AAGGCTGTAT GAAGGGCTGA
```

This corresponds to the amino acid sequence <SEQ ID 592; ORF 148>:

```
m148.pep
  1 MALKTSNLEH AMLVHPEAMS VGALADKIRK IENWPQKGIL FHDITPVLQS

51 AEYFRLLVDL LVYRYMDQKI DIVAGLDARG FIIGAALAYQ LNVGFVPIRK

101 KGKLPFETVS QSYALEYGEA AVEIHTDAVK LGSRVLLVDD LIATGGTMLA

151 GLELIRKLGG EIVEAAAILE FTDLQGGKNI RASGAPLFTL LQNEGCMKG*
```

Computer analysis of this amino acid sequence gave the following results:
Homology with a Predicted ORF from *N. gonorrhoeae*

```
m148/g148 99.0% identity in 199 aa overlap 10        20        30        40        50        60
m148.pep MALKTSNLEHAMLVHPEAMSVGALADKIRKIENWPQKGILFHDITPVLQSAEYFRLLVDL
         ||||||||||||||||||||||||||||||||||||||||||||||||||||||||||||
g148     MALKTSNLEHAMLVHPEAMSVGALADKIRKIENWPQKGILFHDITPVLQSAEYFRLLVDL
              10        20        30        40        50        60

70        80        90       100       110       120
m148.pep LVYRYMDQKIDIVAGLDARGFIIGAALAYQLNVGFVPIRKKGKLPFETVSQSYALEYGEA
         ||||||||||||||||||||||||||||||||||||||||||||||||||||||||||||
g148     LVYRYMDQKIDIVAGLDARGFIIGAALAYQLNVGFVPIRKKGKLPFETVSQSYALEYGEA
              70        80        90       100       110       120

130       140       150       160       170       180
m148.pep AVEIHTDAVKLGSRVLLVDDLIATGGTMLAGLELIRKLGGEIVEAAAILEFTDLQGGKNI
         ||||||||||| |||||||||:||||||||||||||||||||||||||||||||||||||
g148     AVEIHTDAVKPGSRVLLVDDLVATGGTMLAGLELIRKLGGEIVEAAAILEFTDLQGGKNI
             130       140       150       160       170       180

190       200
m148.pep RASGAPLFTLLQNEGCMKGX
         ||||||||||||||||||||
g148     RASGAPLFTLLQNEGCMKGX
             190       200
```

The following partial DNA sequence was identified in *N. meningitidis* <SEQ ID 593>:

```
a148.seq
  1 ATGGCGTTAA AAACATCAAA CTTGGAACAC GCAATGCTGG TTCATCCCGA
```

```
 51 AGCTATGAGT GTCGGTGCGC TTGCCGACAA AATCCGCAAA ATCGAAAACT

101 GGCCGCAAAA AGGCATCTTA TTCCACGACA TCACGCCCGT CCTGCAAAGC

151 GCGGAATACT TCCGACTTTT GGTTGATTTA TTGGTTTACC GCTATATGGA

201 TCAGAAAATC GACATCGTTG CCGGTTTGGA CGCGCGCGGC TTCATTATCG

251 GCGCGGCACT CGCCTACCAG CTCAACGTCG GTTTCGTCCC CATCCGCAAA

301 AAAGGCAAGC TGCCTTTTGA AACCGTATCG CAAAGCTACG CGCTCGAATA

351 CGGGGAAGCT GCGGTGGAAA TCCACACCGA TGCCGTCAAA CTCGGTTCGC

401 GCGTGCTGCT GGTCGATGAT TTGGTTGCCA CGGGCGGCAC GATGCTTGCC

451 GGACTGGAGC TGATCCGCAA ACTCGGCGGG GAAATTGTCG AAGCCGCCGC

501 CATTTTGGAA TTTACCGACC TTCAAGGCGG CAAGAATATC CGTGCAAGCG

551 GCGCGCCCTT ATTTACCCTG CTTCAAAACG AAGGCTGTAT GAAGGGCTGA
```

This corresponds to the amino acid sequence <SEQ ID 594; ORF 148.a>:

```
a148.pep

1 MALKTSNLEH AMLVHPEAMS VGALADKIRK IENWPQKGIL FHDITPVLQS

51 AEYFRLLVDL LVYRYMDQKI DIVAGLDARG FIIGAALAYQ LNVGFVPIRK

101 KGKLPFETVS QSYALEYGEA AVEIHTDAVK LGSRVLLVDD LVATGGTMLA

151 GLELIRKLGG EIVEAAAILE FTDLQGGKNI RASGAPLFTL LQNEGCMKG* m148/a148 99.5% identity in 199 aa overlap 10         20         30         40         50         60
   m148.pep MALKTSNLEHAMLVHPEAMSVGALADKIRKIENWPQKGILFHDITPVLQSAEYFRLLVDL
            ||||||||||||||||||||||||||||||||||||||||||||||||||||||||||||
       a148 MALKTSNLEHAMLVHPEAMSVGALADKIRKIENWPQKGILFHDITPVLQSAEYFRLLVDL
                   10         20         30         40         50         60
                   70         80         90        100        110        120
   m148.pep LVYRYMDQKIDIVAGLDARGFIIGAALAYQLNVGFVPIRKKGKLPFETVSQSYALEYGEA
            ||||||||||||||||||||||||||||||||||||||||||||||||||||||||||||
       a148 LVYRYMDQKIDIVAGLDARGFIIGAALAYQLNVGFVPIRKKGKLPFETVSQSYALEYGEA
                   70         80         90        100        110        120
                  130        140        150        160        170        180
   m148.pep AVEIHTDAVKLGSRVLLVDDLIATGGTMLAGLELIRKLGGEIVEAAAILEFTDLQGGKNI
            |||||||||||||||||||||:||||||||||||||||||||||||||||||||||||||
       a148 AVEIHTDAVKLGSRVLLVDDLVATGGTMLAGLELIRKLGGEIVEAAAILEFTDLQGGKNI
                  130        140        150        160        170        180
                  190        200
   m148.pep RASGAPLFTLLQNEGCMKGX
            ||||||||||||||||||||
       a148 RASGAPLFTLLQNEGCMKGX
                  190        200
```

The following partial DNA sequence was identified in N. gonorrhoeae <SEQ ID 595>:

```
g149.seq
  1 ATGTTGATTG ACAACAATGT CCGCCATTAC AGCTTTTTCG GTGTAGAACA

51 GGCAAATTGG GACAACTTCA CGCTTGAAGG CGGCGTACGC GTGGAAAAAC

101 AAAAAGCCTC CATCCGGTAC GACAAAGCAT TGATTGATCG AGAAAACTAC

151 TACAACCAGC CCTGCCCGA CCTCGGCGCG CACCGCCAAA CCGCCCGCTC

201 GTTCGCACTT TCGGGCAACT GGTATTTCAC GCCACACCAC AAACTCAGCC

251 TGACCGCCTC CCATCAGGAa cgCCTGCCGT CAACGCaagA actGtACgca
```

-continued

```
 301 cacggcAAGC ACGtcgccac CAACACCTTT GAagtcggca acaaACACCT

351 CAACAAAGaG CgttccaacA atatcgaACT CGCGCTGGgc tAcaaaggcg 401 accGCTGGCA ATACAATCTG GCAGCCTACC GCAACCGAtT CGGCAACTAC 451 ATTTACGCCC AAACCTTAaa cgacggacgC GGCCCCAAAT CCATCgaaga 501 cgacagcgaA ATGaagcTCG TGCGCTACAA CCAATCCGGT GCCGACTTCT 551 ACGgcgcggA aggcgaaatc tACTTcaaaC CGAcACCGCG CTACCGCATC 601 GGTGTTTCCG GCGACTatgt acgaggccgT CTGAAAAACC TGCCGTCCCT 651 ACCCGGCAGG gaagatccCT AcggcAAACG TCccttcaTC GCACAAGCCG 701 ACCAAAACGC CCCCCGCATT ccggctGCGC GCCTCGGCTT CCACCTGAAA

751 ACCTCGCTAA CCGACCGTAT CGATGCCAAT TTGGACTACT ACCGCGTGTT

801 CGCCCAAAAC AAACTCGCCC GCTACGAAAC GCGTACGCCC GGACACCATA

851 TGCTCAACCT CGGTGCAAAC TACCGCCGCA ATACGCGCTA TGGCGAGTGG

901 AATTGGTACG TCAAAGCCGA CAACCTGCtc aACcaatCcg tTTACGCCCa 951 cAGCAGCTTC CTCTCTGATA CGCCGCAAAt gGGCCGCAGC TTtgccgGCg 1001 gcgtaAACGT GaAGTTttaA
```

This corresponds to the amino acid sequence <SEQ ID 596; ORF 149.ng>:

```
g149.pep
   1  MLIDNNVRHY SFFGVEQANW DNFTLEGGVR VEKQKASIRY DKALIDRENY

51  YNQPLPDLGA HRQTARSFAL SGNWYFTPHH KLSLTASHQE RLPSTQELYA

101  HGKHVATNTF EVGNKHLNKE RSNNIELALG YKGDRWQYNL AAYRNRFGNY

151  IYAQTLNDGR GPKSIEDDSE MKLVRYNQSG ADFYGAEGEI YFKPTPRYRI

201  GVSGDYVRGR LKNLPSLPGR EDPYGKRPFI AQADQNAPRI PAARLGFHLK

251  TSLTDRIDAN LDYYRVFAQN KLARYETRTP GHHMLNLGAN YRRNTRYGEW

301  NWYVKADNLL NQSVYAHSSF LSDTPQMGRS FAGGVNVKF*
```

The following partial DNA sequence was identified in *N. meningitidis* <SEQ ID 597>:

```
m149.seq
   1 ATGCTGCTTG ACAACAAAGT GCAACATTAC AGCTTTTTCG GTGTAGAACA

51 GGCAAACTGG GACAACTTCA CGCTTGAAGG AGGCGTACGC GTGGAAAAAC

101 AAAAAGCCTC CATTCAGTAC GACAAAGCAT TGATTGATCG GGAAAACTAC

151 TACAACCACC CCCTGCCCGA CCTCGGCGCG CACCGCCAAA CCGCCCGCTC

201 ATTCGCACTT TCGGGCAACT GGTATTTCAC GCCACAACAC AAACTCAGCC

251 TGACCGCCTC CCATCAGGAA CGCCTGCCGT CAACGCAAGA GCTGTACGCA

301 CACGGCAAAC ACGTCGCCAC CAACACCTTT GAAGTCGGCA ACAAACACCT

351 CAACAAAGAG CGTTCCAACA ATATCGAACT CGCGCTGGGC TACGAAGGCG

401 ACCGCTGGCA ATACAATCTG GCACTCTACC GCAACCGCTT CGGTAACTAC

451 ATTTACGCCC AAACCTTAAA CGACGGACGC GGCCCCAAAT CCATCGAAGA

501 CGACAGCGAA ATGAAGCTCG TGCGCTACAA CCAATCCGGC GCCGACTTCT

551 ACGGCGCGGA AGGCGAAATC TACTTCAAAC CGACACCGCG CTACCGCATC
```

```
-continued
 601 GGCGTTTCCG GCGACTATGT ACGAGGCCGT CTGAAAAACC TGCCTTCCCT

651 ACCCGGCAGA GAAGATGCCT ACGGCAACCG TCCTTTCATC GCACAGGACG

701 ACCAAAATGC CCCCCGTGTT CCGGCTGCGC GCCTCGGCTT CCACCTGAAA

751 GCCTCGCTGA CCGACCGTAT CGATGCCAAT TTGGACTACT ACCGCGTGTT

801 CGCCCAAAAC AAACTCGCCC GCTACGAAAC GCGCACGCCC GGACACCATA

851 TGCTCAACCT CGGCGCAAAC TACCGCCGCA ATACGCGCTA TGGCGAGTGG

901 AATTGGTACG TCAAAGCCGA CAACCTGCTC AACCAATCCG TTTACGCCCA

951 CAGCAGCTTT CTCTCTGATA CGCCGCAAAT GGGCCGCAGC TTTACCGGCG

1001 GCGTGAACG TGAAGTTTTA A
```

This corresponds to the amino acid sequence <SEQ ID 598; ORF 149>:

```
m149.pep
  1 MLLDNKVQHY SFFGVEQANW DNFTLEGGVR VEKQKASIQY DKALIDRENY

51 YNHPLPDLGA HRQTARSFAL SGNWYFTPQH KLSLTASHQE RLPSTQELYA

101 HGKHVATNTF EVGNKHLNKE RSNNIELALG YEGDRWQYNL ALYRNRFGNY

151 IYAQTLNDGR GPKSIEDDSE MKLVRYNQSG ADFYGAEGEI YFKPTPRYRI

201 GVSGDYVRGR LKNLPSLPGR EDAYGNRPFI AQDDQNAPRV PAARLGFHLK

251 ASLTDRIDAN LDYYRVFAQN KLARYETRTP GHHMLNLGAN YRRNTRYGEW

301 NWYVKADNLL NQSVYAHSSF LSDTPQMGRS FTGGVNVKF*
```

Computer analysis of this amino acid sequence gave the following results:
Homology with a Predicted ORF from *N. gonorrhoeae*
ORF 149 shows 95.9% identity over a 339 aa overlap with a predicted ORF (ORF 149.ng) from *N. gonorrhoeae*:

```
m149/g149
                   10         20         30         40         50         60
    m149.pep MLLDNKVQHYSFFGVEQANWDNFTLEGGVRVEKQKASIQYDKALIDRENYYNHPLPDLGA
             ||:||:|:||||||||||||||||||||||||||||:|||||||||||||:||||||
        g149 MLIDNNVRHYSFFGVEQANWDNFTLEGGVRVEKQKASIRYDKALIDRENYYNQPLPDLGA
                   10         20         30         40         50         60

70         80         90        100        110        120
    m149.pep HRQTARSFALSGNWYFTPQHKLSLTASHQERLPSTQELYAHGKHVATNTFEVGNKHLNKE
             ||||||||||||||||||||:|||||||||||||||||||||||||||||||||||||||
        g149 HRQTARSFALSGNWYFTPHHKLSLTASHQERLPSTQELYAHGKHVATNTFEVGNKHLNKE
                   70         80         90        100        110        120

130        140        150        160        170        180
    m149.pep RSNNIELALGYEGDRWQYNLALYRNRFGNYIYAQTLNDGRGPKSIEDDSEMKLVRYNQSG
             |||||||||||:||||||||||:|||||||||||||||||||||||||||||||||||||
        g149 RSNNIELALGYKGDRWQYNLAAYRNRFGNYIYAQTLNDGRGPKSIEDDSEMKLVRYNQSG
                  130        140        150        160        170        180

190        200        210        220        230        240
    m149.pep ADFYGAEGEIYFKPTPRYRIGVSGDYVRGRLKNLPSLPGREDAYGNRPFIAQDDQNAPRV
             |||||||||||||||||||||||||||||||||||||||||||:||||||:|||||||:
        g149 ADFYGAEGEIYFKPTPRYRIGVSGDYVRGRLKNLPSLPGREDPYGKRPFIAQADONAPRI
                  190        200        210        220        230        240

250        260        270        280        290        300
    m149.pep PAARLGFHLKASLTDRIDANLDYYRVFAQNKLARYETRTPGHHMLNLGANYRRNTRYGEW
             ||||||||||:|||||||||||||||||||||||||||||||||||||||||||||||||
        g149 PAARLGFHLKTSLTDRIDANLDYYRVFAQNKLARYETRTPGHHMLNLGANYRRNTRYGEW
                  250        260        270        280        290        300

310        320        330        340
    m149.pep NWYVKADNLLNQSVYAHSSFLSDTPQMGRSFTGGVNVKFX
             |||||||||||||||||||||||||||||||:|||||||
        g149 NWYVKADNLLNQSVYAHSSFLSDTPQMGRSFAGGVNVKFX
                  310        320        330        340
```

The following partial DNA sequence was identified in *N. meningitidis* <SEQ ID 599>:

```
a149.seq
   1 ATGCTGCTTG ACAATAAAGT GCAACATTAC AGCTTTTTCG GTGTAGAACA

51 GGCAAACTGG GACAACTTCA CGCTTGAAGG CGGCGTACGC GTGGAAAAAC

101 AAAAAGCCTC CATCCGCTAC GACAAAGCAT TGATTGATCG GGAAAACTAC

151 TACAACCATC CCCTGCCCGA CCTCGGCGCG CACCGCCAAA CCGCCCGCTC

201 ATTCGCACTT TCGGGCAACT GGTATTTCAC GCCACAACAC AAACTCAGCC

251 TGACCGCCTC CCATCAGGAA CGCCTGCCGT CAACGCAAGA GCTGTACGCA

301 CACGGCAAAC ACGTCGCCAC CAACACCTTT GAAGTCGGCA ACAAACACCT

351 CAACAAAGAG CGTTCCAACA ATATCGAACT CGCGCTGGGC TACGAAGGCG

401 ACCGCTGGCA ATACAATCTG GCACTCTACC GCAACCGCTT CGGCAACTAC

451 ATTTACGCCC AAACCTTAAA CGACGGACGC GGCCCCAAAT CCATCGAAGA

501 CGACAGCGAA ATGAAGCTCG TGCGCTACAA CCAATCCGGT GCGGACTTCT

551 ACGGCGCGGA AGGCGAAATC TACTTCAAAC CGACACCGCG CTACCGCATC

601 GGCGTTTCCG GCGACTATGT ACGAGGCCGT CTGAAAAACC TGCCTTCCCT

651 ACCCGGCAGG GAAGACGCCT ACGGCAACCG CCCACTCATT GCCCAAGCCG

701 ACCAAAACGC CCCTCGCGTT CCGGCTGCGC GCCTCGGCGT CCACCTGAAA

751 GCCTCGCTGA CCGACCGCAT CGATGCCAAT TTGGACTACT ACCGCGTGTT

801 CGCCCAAAAC AAACTCGCCC GCTACGAAAC GCGCACGCCC GGACACCATA

851 TGCTCAACCT CGGCGCAAAC TACCGCCGCA ATACGCGCTA TGGCGAGTGG

901 AATTGGTACG TCAAAGCCGA CAACCTGCTC AACCAATCCG TTTACGCCCA

951 CAGCAGCTTC CTCTCTGATA CGCCGCAAAT GGGCCGCAGC TTTACCGGCG

1001 GCGTGAACGT GAAGTTTTAA
```

This corresponds to the amino acid sequence <SEQ ID 600; ORF 149.a>:

```
a149.pep
  1   MLLDNKVQHY SFFGVEQANW DNFTLEGGVR VEKQKASIRY DKALIDRENY

51   YNHPLPDLGA HRQTARSFAL SGNWYFTPQH KLSLTASHQE RLPSTQELYA

101   HGKHVATNTF EVGNKHLNKE RSNNIELALG YEGDRWQYNL ALYRNRFGNY

151   IYAQTLNDGR GPKSIEDDSE MKLVRYNQSG ADFYGAEGEI YFKPTPRYRI

201   GVSGDYVRGR LKNLPSLPGR EDAYGNRPLI AQADQNAPRV PAARLGVHLK

251   ASLTDRIDAN LDYYRVFAQN KLARYETRTP GHHMLNLGAN YRRNTRYGEW

301   NWYVKADNLL NQSVYAHSSF LSDTPQMGRS FTGGVNVKF*
``` m149/a149 98.8% identity in 339 aa overlap

```
                    10        20        30        40        50        60
m149.pep  MLLDNKVQHYSFFGVEQANWDNFTLEGGVRVEKQKASIQYDKALIDRENYYNHPLPDLGA
          ||||||||||||||||||||||||||||||||||||||:|||||||||||||||||||||
a149      MLLDNKVQHYSFFGVEQANWDNFTLEGGVRVEKQKASIRYDKALIDRENYYNHPLPDLGA
                    10        20        30        40        50        60

70        80        90       100       110       120
m149.pep  HRQTARSFALSGNWYFTPQHKLSLTASHQERLPSTQELYAHGKHVATNTFEVGNKHLNKE
          ||||||||||||||||||||||||||||||||||||||||||||||||||||||||||||
a149      HRQTARSFALSGNWYFTPQHKLSLTASHQERLPSTQELYAHGKHVATNTFEVGNKHLNKE
                    70        80        90       100       110       120
```

-continued

```
              130        140        150        160        170        180
m149.pep RSNNIELALGYEGDRWQYNLALYRNRFGNYIYAQTLNDGRGPKSIEDDSEMKLVRYNQSG
         ||||||||||||||||||||||||||||||||||||||||||||||||||||||||||||
a149     RSNNIELALGYEGDRWQYNLALYRNRFGNYIYAQTLNDGRGPKSIEDDSEMKLVRYNQSG
              130        140        150        160        170        180

190        200        210        220        230        240
m149.pep ADFYGAEGEIYFKPTPRYRIGVSGDYVRGRLKNLPSLPGREDAYGNRPFIAQDDQNAPRV
         |||||||||||||||||||||||||||||||||||||||||||||||:|||  ||||||||
a149     ADFYGAEGEIYFKPTPRYRIGVSGDYVRGRLKNLPSLPGREDAYGNRPLIAQADQNAPRV
              190        200        210        220        230        240

250        260        270        280        290        300
m149.pep PAARLGFHLKASLTDRIDANLDYYRVFAQNKLARYETRTPGHHMLNLGANYRRNTRYGEW
         ||||||  ||||||||||||||||||||||||||||||||||||||||||||||||||||
a149     PAARLGVHLKASLTDRIDANLDYYRVFAQNKLARYETRTPGHHMLNLGANYRRNTRYGEW
              250        260        270        280        290        300

310        320        330        340
m149.pep NWYVKADNLLNQSVYAHSSFLSDTPQMGRSFTGGVNVKFX
         ||||||||||||||||||||||||||||||||||||||||
a149     NWYVKADNLLNQSVYAHSSFLSDTPQMGRSFTGGVNVKFX
              310        320        330        340
```

The following partial DNA sequence was identified in *N. gonorrhoeae* <SEQ ID 601>:

```
g149-1.seq
    1 ATGGCACAAA TCACACTCAA ACCCATTGTT TTATCAATTC TTTTAATCAA

51 CACACCCCTC CTCGCCCAAG CGCATGAAAC TGAGCAATCG GTGGGCTTGG

101 AAACGGTCAG CGTCGTCGGC AAAAGCCGTC CGCGCGCGAC TTCGGGGCTG

151 CTGCACACTT CGACCGCCTC CGACAAAATC ATCTCCGGCG ATACTTTGCG

201 CCAAAAAGCC GTCAACTTGG GCGACGCTTT GGACGGCGTA CCGGGCATCC

251 ACGCTTCGCA ATACGGCGGC GGCGCATCCG CTCCCGTTAT TCGCGGTCAA

301 ACGGGCAGAC GGATTAAAGT ATTGAACCAT CACGGCGAAA CGGGCGATAT

351 GGCGGACTTT TCTCCCGATC ACGCCATTAT GGTAGATACC GCCTTGTCGC

401 AACAGGTTGA AATCCTGCGC GGGCCGGTTA CGCTCTTGTA CAGCTCGGGC

451 AATGTGGCGG GGCTGGTCGA TGTTGCCGAT GGAAAAATCC CCGAAAAAAT

501 GCCTGAAAAC GGCGTATCGG GCGaagccgG ATTGCGTTTG AGCAGCGGCA

551 ATTTAGAAAA ACTGACATCC GCAGGCATCA ATATCGGACT GGGCAAAAAC

601 TTCGTGCTGC ATACCGAAGG CTTGTACCGC AAATCGGGCG ATTACGCCGT

651 ACCGCGTTAC CGCAATCTGA AACGCCTGCC CGACAGCCAT GCCGATTCGC

701 AAACGGGCAG CATCGGGCTG TCTTGGGTGG GCGAAAAAGG CTTTATCGGC

751 GCAGCATACA GCGACCGTCG CGACCGCTAC GGCCTGCCTG CCCACAGCCA

801 CGAATACGAT GATTGCCACG CCGACATCAT CTGGCAAAAG AGTTTGATCA

851 ACAAACGCTA TTTGCAGCTT TATCCGCACT TGTTGACCGA AGAAGACATC

901 GATTACGACA ATCCGGGCTT GAGCTGCGGC TTCCACGACG GCGACGGTGC

951 ACACGCACAC ACCCACAACG GCAAACCGTG GATAGACCTG CGCAACAAAC

1001 GCTACGAACT CCGCGCCGAA TGGAAGCAGC CATTCCCCGG TTTTGAAGCC

1051 CTGCGCGTAC ATCTGAACCG CAATGACTAC CACCACGACG AAAAAGCAGG

1101 CGATGCAGTA GAAAACTTCT TCAACAACAA AACACACAAC GCCCGTATCG

1151 AGTTGCGCCA CCAACCCATA GGCCGTCTGA AAGGCAGCTG GGGCGTGCAA

1201 TATTTGGGAC AAAAATCCAG CGCGCTTTCC GCCATTCCCG AAACCGTCCA

1251 ACAACCGATG TTGATTGACA ACAATGTCCG CCATTACAGC TTTTTCGGTG
```

-continued
```
1301 TAGAACAGGC AAATTGGGAC AACTTCACGC TTGAAGGCGG CGTACGCGTG

1351 GAAAAACAAA AAGCCTCCAT CCGGTACGAC AAAGCATTGA TTGATCGAGA

1401 AAACTACTAC AACCAGCCCC TGCCCGACCT CGGCGCGCAC CGCCAAACCG

1451 CCCGCTCGTT CGCACTTTCG GGCAACTGGT ATTTCACGCC ACACCACAAA

1501 CTCAGCCTGA CCGCCTCCCA TCAGGAACGC CTGCCGTCAA CGCAAGAACT

1551 GTACGCACAC GGCAAGCACG TCGCCACCAA CACCTTTGAA GTCGGCAACA

1601 AACACCTCAA CAAAGAGCGT TCCAACAATA TCGAACTCGC GCTGGGCTAC

1651 GAAGGCGACC GCTGGCAATA CAATCTGGCA GCCTACCGCA ACCGATTCGG

1701 CAACTACATT TACGCCCAAA CCTTAAACGA CGGACGCGGC CCCAAATCCA

1751 TCGAAGACGA CAGCGAAATG AAGCTCGTGC GCTACAACCA ATCCGGTGCC

1801 GACTTCTACG GCGCGGAAGG CGAAATCTAC TTCAAACCGA CACCGCGCTA

1851 CCGCATCGGT GTTTCCGGCG ACTATGTACG AGGCCGTCTG AAAAACCTGC

1901 CGTCCCTACC CGGCAGGGAA GATCCCTACG GCAAACGTCC CTTCATCGCA

1951 CAAGCCGACC AAAACGCCCC CCGCATTCCG GCTGCGCGCC TCGGCTTCCA

2001 CCTGAAAACC TCGCTAACCG ACCGTATCGA TGCCAATTTG GACTACTACC

2051 GCGTGTTCGC CCAAAACAAA CTCGCCCGCT ACGAAACGCG TACGCCCGGA

2101 CACCATATGC TCAACCTCGG TGCAAACTAC CGCCGCAATA CGCGCTATGG

2151 CGAGTGGAAT TGGTACGTCA AGCCGACAA CCTGCTCAAC CAATCCGTTT

2201 ACGCCCACAG CAGCTTCCTC TCTGATACGC CGCAAATGGG CCGCAGCTTT

2251 ACCGGCGGCG TAAACGTGAA GTTTTAA
```

This corresponds to the amino acid sequence <SEQ ID 602; ORF 149-1.ng>:

```
g149-1.pep
   1 MAQITLKPIV LSILLINTPL LAQAHETEQS VGLETVSVVG KSRPRATSGL

51 LHTSTASDKI ISGDTLRQKA VNLGDALDGV PGIHASQYGG GASAPVIRGQ

101 TGRRIKVLNH HGETGDMADF SPDHAIMVDT ALSQQVEILR GPVTLLYSSG

151 NVAGLVDVAD GKIPEKMPEN GVSGEAGLRL SSGNLEKLTS AGINIGLGKN

201 FVLHTEGLYR KSGDYAVPRY RNLKRLPDSH ADSQTGSIGL SWVGEKGFIG

251 AAYSDRRDRY GLPAHSHEYD DCHADIIWQK SLINKRYLQL YPHLLTEEDI

301 DYDNPGLSCG FHDGDGAHAH THNGKPWIDL RNKRYELRAE WKQPFPGFEA

351 LRVHLNRNDY HHDEKAGDAV ENFFNNKTHN ARIELRHQPI GRLKGSWGVQ

401 YLGQKSSALS AIPETVQQPM LIDNNVRHYS FFGVEQANWD NFTLEGGVRV

451 EKQKASIRYD KALIDRENYY NQPLPDLGAH RQTARSFALS GNWYFTPHHK

501 LSLTASHQER LPSTQELYAH GKHVATNTFE VGNKHLNKER SNNIELALGY

551 EGDRWQYNLA AYRNRFGNYI YAQTLNDGRG PKSIEDDSEM KLVRYNQSGA

601 DFYGAEGEIY FKPTPRYRIG VSGDYVRGRL KNLPSLPGRE DPYGKRPFIA

651 QADQNAPRIP AARLGFHLKT SLTDRIDANL DYYRVFAQNK LARYETRTPG

701 HHMLNLGANY RRNTRYGEWN WYVKADNLLN QSVYAHSSFL SDTPQMGRSF

751 TGGVNVKF*
```

The following partial DNA sequence was identified in *N. meningitidis* <SEQ ID 603>:

```
m149-1.seq
   1 ATGGCACAAA CTACACTCAA ACCCATTGTT TTATCAATTC TTTTAATCAA

51 CACACCCCTC CTCGCCCAAG CGCATGAAAC TGAGCAATCG GTGGATTTGG

101 AAACGGTCAG CGTCGTCGGC AAAAGCCGTC CGCGCGCCAC GTCGGGGCTG

151 TTGCACACTT CGACCGCCTC CGACAAAATC ATCTCCGGCG ATACCTTGCG

201 CCAAAAAGCC GTCAACTTGG GCGACGCTTT AGACGGCGTA CCGGGCATCC

251 ACGCTTCGCA ATACGGCGGC GGCGCGTCTG CTCCCGTCAT TCGCGGTCAA

301 ACAGGCAGGC GGATTAAAGT GTTGAACCAT CACGGCGAAA CAGGCGATAT

351 GGCGGATTTT TCGCCCGATC ACGCCATTAT GGTAGATACC GCCTTGTCGC

401 AACAGGTCGA AATCCTGCGC GGGCCGGTTA CGCTCTTGTA CAGCTCGGGC

451 AATGTGGCGG GGCTGGTCGA TGTTGCCGAT GGCAAAATCC CCGAAAAAAT

501 GCCTGAAAAC GGCGTATCGG GCGAACTCGG ATTGCGTTTG AGCAGCGGCA

551 ATCTGGAAAA ACTCACGTCC GGCGGCATCA ATATCGGTTT GGGCAAAAAC

601 TTTGTATTGC ACACGGAAGG GCTGTACCGC AAATCGGGGG ATTACGCCGT

651 ACCGCGTTAC CGCAATCTGA AACGCCTGCC CGACAGCCAC GCCGATTCGC

701 AAACGGGCAG CATCGGGCTG TCTTGGGTTG GCGAAAAAGG TTTTATCGGC

751 GTAGCGTACA GCGACCGTCG CGACCAATAT GGTCTGCCTG CCCACAGCCA

801 CGAATACGAT GATTGCCACG CCGACATCAT CTGGCAAAAG AGCTTGATTA

851 ACAAACGCTA TTTACAGCTT TATCCGCACC TGTTGACCGA AGAAGACATC

901 GATTACGACA ATCCGGGCTT GAGCTGCGGC TTCCACGACG ACGATAATGC

951 ACACGCACAC ACCCACAGCG GCAGACCGTG GATAGACCTG CGCAACAAAC

1001 GCTACGAACT CCGTGCCGAA TGGAAGCAAC CGTTCCCCGG TTTTGAAGCC

1051 CTGCGCGTAC ACCTGAACCG CAACGACTAC CGCCACGACG AAAAAGCAGG

1101 CGATGCAGTC GAAAACTTTT TTAACAACCA AACGCAAAAC GCCCGCATCG

1151 AGTTGCGCCA CCAACCCATA GGTCGTCTGA AAGGCAGCTG GGGCGTGCAA

1201 TATTTACAAC AAAAATCCAG TGCTTTATCT GCCATATCCG AAGCGGTTAA

1251 ACAACCGATG CTGCTTGACA ACAAAGTGCA ACATTACAGC TTTTTCGGTG

1301 TAGAACAGGC AAACTGGGAC AACTTCACGC TTGAAGGAGG CGTACGCGTG

1351 GAAAAACAAA AAGCCTCCAT TCAGTACGAC AAAGCATTGA TTGATCGGGA

1401 AAACTACTAC AACCACCCCC TGCCCGACCT CGGCGCGCAC CGCCAAACCG

1451 CCCGCTCATT CGCACTTTCG GGCAACTGGT ATTTCACGCC ACAACACAAA

1501 CTCAGCCTGA CCGCCTCCCA TCAGGAACGC CTGCCGTCAA CGCAAGAGCT

1551 GTACGCACAC GGCAAACACG TCGCCACCAA CACCTTTGAA GTCGGCAACA

1601 AACACCTCAA CAAAGAGCGT TCCAACAATA TCGAACTCGC GCTGGGCTAC

1651 GAAGGCGACC GCTGGCAATA CAATCTGGCA CTCTACCGCA ACCGCTTCGG

1701 TAACTACATT TACGCCCAAA CCTTAAACGA CGGACGCGGC CCCAAATCCA

1751 TCGAAGACGA CAGCGAAATG AAGCTCGTGC GCTACAACCA ATCCGGCGCC

1801 GACTTCTACG GCGCGGAAGG CGAAATCTAC TTCAAACCGA CACCGCGCTA

1851 CCGCATCGGC GTTTCCGGCG ACTATGTACG AGGCCGTCTG AAAAACCTGC

1901 CTTCCCTACC CGGCAGAGAA GATGCCTACG GCAACCGTCC TTTCATCGCA
```

```
-continued
1951 CAGGACGACC AAAATGCCCC CCGTGTTCCG GCTGCGCGCC TCGGCTTCCA

2001 CCTGAAAGCC TCGCTGACCG ACCGTATCGA TGCCAATTTG GACTACTACC

2051 GCGTGTTCGC CCAAAACAAA CTCGCCCGCT ACGAAACGCG CACGCCCGGA

2101 CACCATATGC TCAACCTCGG CGCAAACTAC CGCCGCAATA CGCGCTATGG

2151 CGAGTGGAAT TGGTACGTCA AGCCGACAA CCTGCTCAAC CAATCCGTTT

2201 ACGCCCACAG CAGCTTTCTC TCTGATACGC CGCAAATGGG CCGCAGCTTT

2251 ACCGGCGGCG TGAACGTGAA GTTTTAA
```

This corresponds to the amino acid sequence <SEQ ID 604; ORF 149-1>:

```
m149-1.pep

1   MAQTTLKPIV LSILLINTPL LAQAHETEQS VDLETVSVVG KSRPRATSGL

51   LHTSTASDKI ISGDTLRQKA VNLGDALDGV PGIHASQYGG GASAPVIRGQ

101   TGRRIKVLNH HGETGDMADF SPDHAIMVDT ALSQQVEILR GPVTLLYSSG

151   NVAGLVDVAD GKIPEKMPEN GVSGELGLRL SSGNLEKLTS GGINIGLGKN

201   FVLHTEGLYR KSGDYAVPRY RNLKRLPDSH ADSQTGSIGL SWVGEKGFIG

251   VAYSDRRDQY GLPAHSHEYD DCHADIIWQK SLINKRYLQL YPHLLTEEDI

301   DYDNPGLSCG FHDDDNAHAH THSGRPWIDL RNKRYELRAE WKQPFPGFEA

351   LRVHLNRNDY RHDEKAGDAV ENFFNNQTQN ARIELRHQPI GRLKGSWGVQ

401   YLQQKSSALS AISEAVKQPM LLDNKVQHYS FFGVEQANWD NFTLEGGVRV

451   EKQKASIQYD KALIDRENYY NHPLPDLGAH RQTARSFALS GNWYFTPQHK

501   LSLTASHQER LPSTQELYAH GKHVATNTFE VGNKHLNKER SNNIELALGY

551   EGDRWQYNLA LYRNRFGNYI YAQTLNDGRG PKSIEDDSEM KLVRYNQSGA

601   DFYGAEGEIY FKPTPRYRIG VSGDYVRGRL KNLPSLPGRE DAYGNRPFIA

651   QDDQNAPRVP AARLGFHLKA SLTDRIDANL DYYRVFAQNK LARYETRTPG

701   HHMLNLGANY RRNTRYGEWN WYVKADNLLN QSVYAHSSFL SDTPQMGRSF

751   TGGVNVKF* m149-1/g149-1  96.2% identity in 758 aa overlap 10         20         30         40         50         60
m149-1.pep    MAQTTLKPIVLSILLINTPLLAQAHETEQSVDLETVSVVGKSRPRATSGLLHTSTASDKI
              |||  ||||||||||||||||||||||||| ||||||||||||||||||||||||||||||
g149-1        MAQITLKPIVLSILLINTPLLAQAHETEQSVGLETVSVVGKSRPRATSGLLHTSTASDKI
                  10         20         30         40         50         60

70         80         90        100        110        120
m149-1.pep    ISGDTLRQKAVNLGDALDGVPGIHASQYGGGASAPVIRGQTGRRIKVLNHHGETGDMADF
              ||||||||||||||||||||||||||||||||||||||||||||||||||||||||||||
g149-1        ISGDTLRQKAVNLGDALDGVPGIHASQYGGGASAPVIRGQTGRRIKVLNHHGETGDMADF
                  70         80         90        100        110        120

130        140        150        160        170        180
m149-1.pep    SPDHAIMVDTALSQQVEILRGPVTLLYSSGNVAGLVDVADGKIPEKMPENGVSGELGLRL
              ||||||||||||||||||||||||||||||||||||||||||||||||||||||||||||
g149-1        SPDHAIMVDTALSQQVEILRGPVTLLYSSGNVAGLVDVADGKIPEKMPENGVSGELGLRL
                 130        140        150        160        170        180

190        200        210        220        230        240
m149-1.pep    SSGNLEKLTSGGINIGLGKNFVLHTEGLYRKSGDYAVPRYRNLKRLPDSHADSQTGSIGL
              |||||||||||:||||||||||||||||||||||||||||||||||||||||||||||||
g149-1        SSGNLEKLTSAGINIGLGKNFVLHTEGLYRKSGDYAVPRYRNLKRLPDSHADSQTGSIGL
                 190        200        210        220        230        240
```

-continued

```
                       250       260       270       280       290       300
m149-1.pep      SWVGEKGFIGVAYSDRRDQYGLPAHSHEYDDCHADIIWQKSLINKRYLQLYPHLLTEEDI
                ||||||||||:|||||||:|||||||||||||||||||||||||||||||||||||||||
g149-1          SWVGEKGFIGAAYSDRRDRYGLPAHSHEYDDCHADIIWQKSLINKRYLQLYPHLLTEEDI
                       250       260       270       280       290       300

310       320       330       340       350       360
m149-1.pep      DYDNPGLSCGFHDDDNAHAHTHSGRPWIDLRNKRYELRAEWKQPFPGFEALRVHLNRNDY
                ||||||||||||| |:||||||:|:|||||||||||||||||||||||||||||||||||
g149-1          DYDNPGLSCGFHDGDGAHAHTHNGKPWIDLRNKRYELRAEWKQPFPGFEALRVHLNRNDY
                       310       320       330       340       350       360

370       380       390       400       410       420
m149-1.pep      RHDEKAGDAVENFFNNQTQNARIELRHQPIGRLKGSWGVQYLQQKSSALSAISEAVKQPM
                :||||||||||||||||:|:||||||||||||||||||||||| ||||||||| |:|:|||
g149-1          HHDEKAGDAVENFFNNKTHNARIELRHQPIGRLKGSWGVQYLGQKSSALSAIPETVQQPM
                       370       380       390       400       410       420

430       440       450       460       470       480
m149-1.pep      LLDNKVQHYSFFGVEQANWDNFTLEGGVRVEKQKASIQYDKALIDRENYYNHPLPDLGAH
                |:||:|:|||||||||||||||||||||||||||||||:||||||||||||:||||||||
g149-1          LIDNNVRHYSFFGVEQANWDNFTLEGGVRVEKQKASIRYDKALIDRENYYNOPLPDLGAH
                       430       440       450       460       470       480

490       500       510       520       530       540
m149-1.pep      RQTARSFALSGNWYFTPQHKLSLTASHQERLPSTQELYAHGKHVATNTFEVGNKHLNKER
                |||||||||||||||||:||||||||||||||||||||||||||||||||||||||||||
g149-1          RQTARSFALSGNWYFTPHHKLSLTASHQERLPSTQELYAHGKHVATNTFEVGNKHLNKER
                       490       500       510       520       530       540

550       560       570       580       590       600
m149-1.pep      SNNIELALGYEGDRWQYNLALYRNRFGNYIYAQTLNDGRGPKSIEDDSEMKLVRYNQSGA
                |||||||||||||||||||| |||||||||||||||||||||||||||||||||||||||
g149-1          SNNIELALGYEGDRWQYNLAAYRNRFGNYIYAQTLNDGRGPKSIEDDSEMKLVRYNQSGA
                       550       560       570       580       590       600

610       620       630       640       650       660
m149-1.pep      DFYGAEGEIYFKPTPRYRIGVSGDYVRGRLKNLPSLPGREDAYGNRPFIAQDDQNAPRVP
                ||||||||||||||||||||||||||||||||||||||||| ||:|||||| ||||||:|
g149-1          DFYGAEGEIYFKPTPRYRIGVSGDYVRGRLKNLPSLPGREDPYGKRPFIAQADQNAPRIP
                       610       620       630       640       650       660

670       680       690       700       710       720
m149-1.pep      AARLGFHLKASLTDRIDANLDYYRVFAQNKLARYETRTPGHHMLNLGANYRRNTRYGEWN
                |||||||||:||||||||||||||||||||||||||||||||||||||||||||||||||
g149-1          AARLGFHLKTSLTDRIDANLDYYRVFAQNKLARYETRTPGHHMLNLGANYRRNTRYGEWN
                       670       680       690       700       710       720

730       740       750      759
m149-1.pep      WYVKADNLLNQSVYAHSSFLSDTPQMGRSFTGGVNVKFX
                |||||||||||||||||||||||||||||||||||||||
g149-1          WYVKADNLLNQSVYAHSSFLSDTPQMGRSFTGGVNVKFX
                       730       740       750
```

The following partial DNA sequence was identified in *N. meningitidis* <SEQ ID 605>:

```
a149-1.seq
   1 ATGGCACAAA CTACACTCAA ACCCATTGTT TTATCAATTC TTTTAATCAA

51 CACACCCCTC CTCTCCCAAG CGCATGGAAC TGAGCAATCA GTGGGCTTGG

101 AAACGGTCAG CGTCGTCGGC AAAAGCCGTC CGCGCGCCAC TTCGGGGCTG

151 CTGCACACTT CTACCGCCTC CGACAAAATC ATCAGCGGCG ACACCTTGCG

201 ACAAAAAGCC GTCAACTTGG GTGATGCTTT AGACGGCGTA CCGGGCATTC

251 ATGCCTCGCA ATACGGCGGC GGCGCATCCG CTCCCGTTAT TCGCGGTCAA

301 ACAGGCAGAC GGATTAAAGT GTTGAACCAT CACGGCGAAA CGGGCGACAT

351 GGCGGACTTC TCTCCAGACC ATGCAATCAT GGTGGACAGC GCCTTGTCGC

401 AACAGGTCGA AATCCTGCGC GGTCCGGTTA CGCTCTTGTA CAGCTCGGGC

451 AATGTGGCGG GGCTGGTCGA TGTTGCCGAT GGCAAAATCC CCGAAAAAAT

501 GCCTGAAAAC GGCGTATCGG GCGAACTCGG ATTGCGTTTG AGCAGCGGCA

551 ATCTGGAAAA ACTCACGTCC GGCGGCATCA ATATCGGTTT GGGCAAAAAC
```

```
 601 TTTGTATTGC ACACGGAAGG GCTGTACCGC AAATCGGGGG ATTACGCCGT
 651 ACCGCGTTAC CGCAATCTGA AACGCCTGCC CGACAGCCAC GCCGATTCGC
 701 AAACGGGCAG CATCGGGCTG TCTTGGGTTG GCGAAAAAGG CTTTATCGGC
 751 GCAGCATACA GCGACCGTCG CGACCAATAT GGTCTGCCTG CCCACAGCCA
 801 CGAATACGAT GATTGCCACG CCGACATCAT CTGGCAAAAG AGTTTGATTA
 851 ACAAACGCTA TTTGCAGCTT TATCCGCACC TGTTGACCGA AGAAGACATC
 901 GATTACGACA ATCCGGGCTT GAGCTGCGGC TTTCACGACG ACGATGATGC
 951 ACACGCCCAT GCCCACAACG GCAAACCTTG GATAGACCTG CGCAACAAAC
1001 GCTACGAACT CCGCGCCGAA TGGAAGCAAC CGTTCCCCGG TTTTGAAGCC
1051 CTGCGCGTAC ACCTGAACCG CAACGACTAC CGCCACGACG AAAAAGCAGG
1101 CGATGCAGTA GAAAACTTTT TTAACAACCA AACGCAAAAC GCCCGTATCG
1151 AGTTGCGCCA CCAACCCATA GGCCGTCTGA AAGGCAGCTG GGGCGTGCAA
1201 TATTTGGGAC AAAAATCCAG TGCTTTATCT GCCACATCCG AAGCGGTCAA
1251 ACAACCGATG CTGCTTGACA ATAAAGTGCA ACATTACAGC TTTTTCGGTG
1301 TAGAACAGGC AAACTGGGAC AACTTCACGC TTGAAGGCGG CGTACGCGTG
1351 GAAAACAAA AAGCCTCCAT CCGCTACGAC AAAGCATTGA TTGATCGGGA
1401 AAACTACTAC AACCATCCCC TGCCCGACCT CGGCGCGCAC CGCCAAACCG
1451 CCCGCTCATT CGCACTTTCG GGCAACTGGT ATTTCACGCC ACAACACAAA
1501 CTCAGCCTGA CCGCCTCCCA TCAGGAACGC CTGCCGTCAA CGCAAGAGCT
1551 GTACGCACAC GGCAAACACG TCGCCACCAA CACCTTTGAA GTCGGCAACA
1601 AACACCTCAA CAAAGAGCGT TCCAACAATA TCGAACTCGC GCTGGGCTAC
1651 GAAGGCGACC GCTGGCAATA CAATCTGGCA CTCTACCGCA ACCGCTTCGG
1701 CAACTACATT TACGCCCAAA CCTTAAACGA CGGACGCGGC CCCAAATCCA
1751 TCGAAGACGA CAGCGAAATG AAGCTCGTGC GCTACAACCA ATCCGGTGCG
1801 GACTTCTACG GCGCGGAAGG CGAAATCTAC TTCAAACCGA CACCGCGCTA
1851 CCGCATCGGC GTTTCCGGCG ACTATGTACG AGGCCGTCTG AAAAACCTGC
1901 CTTCCCTACC CGGCAGGGAA GACGCCTACG GCAACCGCCC ACTCATTGCC
1951 CAAGCCGACC AAAACGCCCC TCGCGTTCCG GCTGCGCGCC TCGGCGTCCA
2001 CCTGAAAGCC TCGCTGACCG ACCGCATCGA TGCCAATTTG GACTACTACC
2051 GCGTGTTCGC CCAAAACAAA CTCGCCCGCT ACGAAACGCG CACGCCCGGA
2101 CACCATATGC TCAACCTCGG CGCAAACTAC CGCCGCAATA CGCGCTATGG
2151 CGAGTGGAAT TGGTACGTCA AAGCCGACAA CCTGCTCAAC CAATCCGTTT
2201 ACGCCCACAG CAGCTTCCTC TCTGATACGC CGCAAATGGG CCGCAGCTTT
2251 ACCGGCGGCG TGAACGTGAA GTTTTAA
```

This corresponds to the amino acid sequence <SEQ ID 606; ORF 149-1.a>:

```
a149-1.pep

1 MAQTTLKPIV LSILLINTPL LSQAHGTEQS VGLETVSVVG KSRPRATSGL

51 LHTSTASDKI ISGDTLRQKA VNLGDALDGV PGIHASQYGG GASAPVIRGQ
```

-continued

```
101 TGRRIKVLNH HGETGDMADF SPDHAIMVDS ALSQQVEILR GPVTLLYSSG

151 NVAGLVDVAD GKIPEKMPEN GVSGELGLRL SSGNLEKLTS GGINIGLGKN

201 FVLHTEGLYR KSGDYAVPRY RNLKRLPDSH ADSQTGSIGL SWVGEKGFIG

251 AAYSDRRDQY GLPAHSHEYD DCHADIIWQK SLINKRYLQL YPHLLTEEDI

301 DYDNPGLSCG FHDDDDAHAH AHNGKPWIDL RNKRYELRAE WKQPFPGFEA

351 LRVHLNRNDY RHDEKAGDAV ENFFNNQTQN ARIELRHQPI GRLKGSWGVQ

401 YLGQKSSALS ATSEAVKQPM LLDNKVQHYS FFGVEQANWD NFTLEGGVRV

451 EKQKASIRYD KALIDRENYY NHPLPDLGAH RQTARSFALS GNWYFTPQHK

501 LSLTASHQER LPSTQELYAH GKHVATNTFE VGNKHLNKER SNNIELALGY

551 EGDRWQYNLA LYRNRFGNYI YAQTLNDGRG PKSIEDDSEM KLVRYNQSGA

601 DFYGAEGEIY FKPTPRYRIG VSGDYVRGRL KNLPSLPGRE DAYGNRPLIA

651 QADQNAPRVP AARLGVHLKA SLTDRIDANL DYYRVFAQNK LARYETRTPG

701 HHMLNLGANY RRNTRYGEWN WYVKADNLLN QSVYAHSSFL SDTPQMGRSF

751 TGGVNVKF*
``` a149-1/m149-1 98.0% identity in 758 aa overlap

```
                  10         20         30         40         50         60
a149-1.pep  MAQTTLKPIVLSILLINTPLLSQAHGTEQSVDLETVSVVGKSRPRATSGLLHTSTASDKI
            |||||||||||||||||||||||:|||     |||||  |||||||||||||||||||||
m149-1      MAQTTLKPIVLSILLINTPLLAQAHETEQSVGLETVSVVGKSRPRATSGLLHTSTASDKI
                  10         20         30         40         50         60

70         80         90        100        110        120
a149-1.pep  ISGDTLRQKAVNLGDALDGVPGIHASQYGGGASAPVIRGQTGRRIKVLNHHGETGDMADF
            ||||||||||||||||||||||||||||||||||||||||||||||||||||||||||||
m149-1      ISGDTLRQKAVNLGDALDGVPGIHASQYGGGASAPVIRGQTGRRIKVLNHHGETGDMADF
                  70         80         90        100        110        120

130        140        150        160        170        180
a149-1.pep  SPDHAIMVDSALSQQVEILRGPVTLLYSSGNVAGLVDVADGKIPEKMPENGVSGELGLRL
            |||||||||:||||||||||||||||||||||||||||||||||||||||||||||||||
m149-1      SPDHAIMVDTALSQQVEILRGPVTLLYSSGNVAGLVDVADGKIPEKMPENGVSGELGLRL
                 130        140        150        160        170        180

190        200        210        220        230        240
a149-1.pep  SSGNLEKLTSGGINIGLGKNFVLHTEGLYRKSGDYAVPRYRNLKRLPDSHADSQTGSIGL
            ||||||||||||||||||||||||||||||||||||||||||||||||||||||||||||
m149-1      SSGNLEKLTSGGINIGLGKNFVLHTEGLYRKSGDYAVPRYRNLKRLPDSHADSQTGSIGL
                 190        200        210        220        230        240

250        260        270        280        290        300
a149-1.pep  SWVGEKGFIGAAYSDRRDQYGLPAHSHEYDDCHADIIWQKSLINKRYLQLYPHLLTEEDI
            ||||||||||| :|||||||||||||||||||||||||||||||||||||||||||||||
m149-1      SWVGEKGFIGVAYSDRRDQYGLPAHSHEYDDCHADIIWQKSLINKRYLQLYPHLLTEEDI
                 250        260        270        280        290        300

310        320        330        340        350        360
a149-1.pep  DYDNPGLSCGFHDDDDAHAHAHNGKPWIDLRNKRYELRAEWKQPFPGFEALRVHLNRNDY
            ||||||||||||||:||||:|:|:||||||||||||||||||||||||||||||||||||
m149-1      DYDNPGLSCGFHDDDGAHAHTHSGRPWIDLRNKRYELRAEWKQPFPGFEALRVHLNRNDY
                 310        320        330        340        350        360

370        380        390        400        410        420
a149-1.pep  RHDEKAGDAVENFFNNQTQNARIELRHQPIGRLKGSWGVQYLGQKSSALSATSEAVKQPM
            ||||||||||||||||||||||||||||||||||||||||| |||||||| |||||||||
m149-1      RHDEKAGDAVENFFNNQTQNARIELRHQPIGRLKGSWGVQYLQQKSSALSAISEAVKQPM
                 370        380        390        400        410        420

430        440        450        460        470        480
a149-1.pep  LLDNKVQHYSFFGVEQANWDNFTLEGGVRVEKQKASIRYDKALIDRENYYNHPLPDLGAH
            |||||||||||||||||||||||||||||||||||||:||||||||||||||||||||||
m149-1      LLDNKVQHYSFFGVEQANWDNFTLEGGVRVEKQKASIQYDKALIDRENYYNHPLPDLGAH
                 430        440        450        460        470        480

490        500        510        520        530        540
a149-1.pep  RQTARSFALSGNWYFTPQHKLSLTASHQERLPSTQELYAHGKHVATNTFEVGNKHLNKER
            ||||||||||||||||||||||||||||||||||||||||||||||||||||||||||||
m149-1      RQTARSFALSGNWYFTPQHKLSLTASHQERLPSTQELYAHGKHVATNTFEVGNKHLNKER
                 490        500        510        520        530        540
```

```
                   550        560        570        580        590        600
a149-1.pep  SNNIELALGYEGDRWQYNLALYRNRFGNYIYAQTLNDGRGPKSIEDDSEMKLVRYNQSGA
            ||||||||||||||||||||| ||||||||||||||||||||||||||||||||||||
m149-1      SNNIELALGYEGDRWQYNLAAYRNRFGNYIYAQTLNDGRGPKSIEDDSEMKLVRYNQSGA
                   550        560        570        580        590        600

610        620        630        640        650        660
a149-1.pep  DFYGAEGEIYFKPTPRYRIGVSGDYVRGRLKNLPSLPGREDPYGKRPLIAQADQNAPRVP
            ||||||||||||||||||||||||||||||||||||||||||||||| ||| ||||||||
m149-1      DFYGAEGEIYFKPTPRYRIGVSGDYVRGRLKNLPSLPGREDPYGKRPFIAQDDQNAPRVP
                   610        620        630        640        650        660

670        680        690        700        710        720
a149-1.pep  AARLGVHLKASLTDRIDANLDYYRVFAQNKLARYETRTPGHHMLNLGANYRRNTRYGEWN
            ||||| ||||||||||||||||||||||||||||||||||||||||||||||||||||||
m149-1      AARLGFHLKASLTDRIDANLDYYRVFAQNKLARYETRTPGHHMLNLGANYRRNTRYGEWN
                   670        680        690        700        710        720

730        740        750     759
a149-1.pep  WYVKADNLLNQSVYAHSSFLSDTPQMGRSFTGGVNVKFX
            |||||||||||||||||||||||||||||||||||||||
m149-1      WYVKADNLLNQSVYAHSSFLSDTPQMGRSFTGGVNVKFX
                   730        740        750
```

The following partial DNA sequence was identified in *N. gonorrhoeae* <SEQ ID 607>:

```
g150.seq (partial)
   1  ..TACTGCAAGG CAGACCCCTT TCCCGCCGCC CTGCTGGCCA ATCAGAAAAT

51    CACCGCCCGC CAATCCGATA AAGACGTGCG CCACATCGAA ATCGATTTGA

101    GCGGTTCGGA TTTGCACTAC CTCCCGGGCG ACGCGCTCGG CGTTTGGTTT

151    GACAACGATC CGGCACTGGT CGGGGAAATC CTAGACCTGC TCGGCATCAA

201    TCCGGCAACG GAAATACAGG CGGGCGGAAA AACCCTGCCG GTTGCCTCCG

251    CACTGTTATC CCATTTCGAA CTCACGCAAA ACACCCCCGC CTTTGTCAAA

301    GGCTATGCCA CGTTCGCCGA TAATGACGAA CTCGACCGTA TTGCTGCCGA

351    CAACGCCGTT TTGCAAGGCT TTGTGCAAAG CACGCCGATT GCCGGTGTGC

401    TGCACCGCTT CCCGGCAAAA CTGACGGCGG AACAATTCGC CGGCCTGCTG

451    CGCCCGCTTG CGCCGCGCCT GTATTCGATT TCCTCGTCGC AGGCGGAAGC

501    GGGGGACGAA GTGCACCTGA CCGTCGGCGC AGTGCGTTTC GAACACGAAG

551    GGCGCGCCAG GCGGGCGGC GCATCGGGTT TCTTTGCCGA CCGGCTGGAA

601    GAGGACGGCA CGGTGCGCGT GTTTGCGGAA CGCAACGACG GCTTCAGGCT

651    GCCCGAAGAC AGCCGCAAGC CGATTGTGAT GATCGGCTCC GGTACCGGCG

701    TCGCACCGTT CCGCGCCTTC GTCCAACAAC GTGCCGCAGA AAATGCGGAA

751    GGCAGAAACT GGCTGATTTT CGGCAATCCG CATTTTGCCG CCGACTTCCT

801    CTATCAGACC GAATGGCAGC AGTTTGCCAA AGACGGCTTC CTGCACAGAT

851    ATGACTTCGC CTGGTCGCGC GATCAGGAAG AAAAAATCTA TGTGCAGGAC

901    AAAATCCGCG AACAGGCGGA AGGACTTTGG CAATGGCTGC AGGAAGGCGC

951    GCATATCTAT GTGTGCGGCG ATGCGGCAAA AATGGCAAAA GAAGTGGAAG

1001    CCGCCTTGCT GGATGTGATT ATCGGGGCAG GGCATTCGGA CGAAGACGGC

1051    GCAGAAGGAT ATTTGGATAT GCTGCGCGAA GAAAAACGCT ATCAGCGTGA

1101    TGTTTATTGA
```

This corresponds to the amino acid sequence <SEQ ID 608; ORF 150.ng>:

```
g150.pep (partial)
    1 ..YCKADPFPAA LLANQKITAR QSDKDVRHIE IDLSGSDLHY LPGDALGVWF

51   DNDPALVGEI LDLLGINPAT EIQAGGKTLP VASALLSHFE LTQNTPAFVK

101   GYATFADNDE LDRIAADNAV LQGFVQSTPI AGVLHRFPAK LTAEQFAGLL

151   RPLAPRLYSI SSSQAEAGDE VHLTVGAVRF EHEGRARAGG ASGFFADRLE

201   EDGTVRVFAE RNDGFRLPED SRKPIVMIGS GTGVAPFRAF VQQRAAENAE

251   GRNWLIFGNP HFAADFLYQT EWQQFAKDGF LHRYDFAWSR DQEEKIYVQD

301   KIREQAEGLW QWLQEGAHIY VCGDAAKMAK EVEAALLDVI IGAGHSDEDG

351   AEGYLDMLRE EKRYQRDVY*
```

The following partial DNA sequence was identified in *N. meningitidis* <SEQ ID 609>:

```
m150.seq
    1 ATGCAGAACA CAAATCCGCC ATTACCGCCT CTGCCGCCCG AAATCACGCA

51 GCTCCTGTCG GGGCTGGACG CGGCACAATG GGCGTGGCTG TCCGGCTACG

101 CTTGGGCAAA AGCAGGAAAC GGGGCATCTG CAGGACTGCC CGCGCTTCAG

151 ACGGCATTGC CGGCGGCAGA ACCTTTTTCC GTAACCGTCC TTTCCGCCTC

201 GCAAACCGGC AATGCGAAAT CCGTTGCCGA CAAAGCGGCG GACAGCCTGG

251 AAGCCGCCGG CATCCAAGTC AGTCGCGCCG AACTGAAAGA CTATAAGGCG

301 AAAAACATCG CCGGCGAACG CCGCCTGCTG CTGGTTACCT CCACCCAAGG

351 CGAAGGCGAA CCGCCGAAAG AAGCCGTCGT GCTGCACAAA CTGCTGAACG

401 GCAAAAAAGC CCCGAAATTG GACAAACTCC AATTTGCCGT ACTGGGTTTG

451 GGCGACAGTT CCTATCCGAA TTTCTGTCAG GCAGGTAAAG ATTTCGACCG

501 GCGTTTTGAA GAATTGGGCG CAAAACGGCT GCTCGAACGC GTTGATGCGG

551 ATTTGGACTT TACCGCCTCC GCAAACGCCT GGACAGATAA TATCGCCGCA

601 CTCTTAAAAG AAGAAGCCGC AAAAAACCGG GCAACGCCCG CGCCGCAGAC

651 AACGCCCCCC GCCGGCCTTC AGACGGCACC GGATGGCAGG TACTGCAAGG

701 CAGCCCCCTT TCCCGCCGCC CTGCTGGCCA ATCAGAAAAT CACCGCCCGC

751 CAATCCGATA AGACGTGCG CCACATCGAA ATCGATTTGA GCGGTTCGGA

801 TTTGCACTAC CTCCCGGGCG ACGCGCTCGG CGTTTGGTTT GACAACGATC

851 CGGCACTGGT CAGGGAAATC CTAGACCTGC TCGGCATCGA TCCGGCAACG

901 GAAATACAGG CGGGCGGAAA GATGATGCCG GTTGCGCGCG CACTTTCATC

951 TCATTTCGAA CTCACGCAAA ACACTCCGGC TTTCGTCAAA GGCTATGCCG

1001 CGTTCGCCCA TTATGAAGAA CTCGATAAAA TCATTGCCGA TAACGCCGTT

1051 TTGCAGGATT TCGTGCAAAA CACGCCTATT GTCGATGTGC TGCACCGCTT

1101 CCCGGCAAGC CTGACGGCAG AACAATTCAT CCGTTTACTG CGTCCGCTTG

1151 CACCCCGTTT GTATTCGATT TCTTCAGCAC AGGCGGAAGT GGGCGATGAA

1201 GTGCATTTAA CTGTCGGCGT GGTTCGTTTT GAACACGAAG CCGCGCCAG

1251 AACGGGCGGC GCATCGGGTT TCCTTGCCGA CCGGCTGGAA GAGGACGGCA

1301 CGGTGCGCGT GTTTGTGGAA CGCAACGACG GCTTCAGGCT GCCCGAAGAC
```

-continued

```
1351 AGCCGCAAGC CGATTGTGAT GATCGGCTCG GGCACCGGCG TCGCACCGTT

1401 CCGCGCTTTC GTCCAACAAC GTGCCGCAGA AAATGCGGAA GGCAAAAACT

1451 GGCTGATTTT CGGCAATCCG CATTTTGCCC GTGATTTTCT CTATCAAACC

1501 GAATGGCAGC AGTTTGCCAA AGACGGCTTC CTGCACAGGT ACGATTTCGC

1551 CTGGTCCCGC GATCAGGAAG AAAAAATCTA TGTGCAGGAC AAAATCCGCG

1601 AACAGGCGGA AGGACTTTGG CAATGGCTGC AGGAAGGCGC GCATATCTAT

1651 GTGTGCGGCG ATGCGGCAAA AATGGCAAAA GACGTGGAAG CCGCCTTGCT

1701 GGATGTGATT ATCGGGGCAG GACATTTGGA CGAAGAGGGC GCAGAAGAAT

1751 ATTTGGATAT GCTGCGCGAA GAAAAACGCT ATCAGCGTGA TGTTTATTGA
```

This corresponds to the amino acid sequence <SEQ ID 610; ORF 150>:

```
m150.pep
    1 MQNTNPPLPP LPPEITQLLS GLDAAQWAWL SGYAWAKAGN GASAGLPALQ

51 TALPAAEPFS VTVLSASQTG NAKSVADKAA DSLEAAGIQV SRAELKDYKA

101 KNIAGERRLL LVTSTQGEGE PPKEAVVLHK LLNGKKAPKL DKLQFAVLGL

151 GDSSYPNFCQ AGKDFDRRFE ELGAKRLLER VDADLDFTAS ANAWTDNIAA

201 LLKEEAAKNR ATPAPQTTPP AGLQTAPDGR YCKAAPFPAA LLANQKITAR

251 QSDKDVRHIE IDLSGSDLHY LPGDALGVWF DNDPALVREI LDLLGIDPAT

301 EIQAGGKMMP VARALSSHFE LTQNTPAFVK GYAAFAHYEE LDKIIADNAV

351 LQDFVQNTPI VDVLHRFPAS LTAEQFIRLL RPLAPRLYSI SSAQAEVGDE

401 VHLTVGVVRF EHEGRARTGG ASGFLADRLE EDGTVRVFVE RNDGFRLPED

451 SRKPIVMIGS GTGVAPFRAF VQQRAAENAE GKNWLIFGNP HFARDFLYQT

501 EWQQFAKDGF LHRYDFAWSR DQEEKIYVQD KIREQAEGLW QWLQEGAHIY

551 VCGDAAKMAK DVEAALLDVI IGAGHLDEEG AEEYLDMLRE EKRYQRDVY*
                                                          40
```

Computer analysis of this amino acid sequence gave the following results:

Homology with a Predicted ORF from *N. gonorrhoeae*

ORF 150 shows 91.3% identity over a 369 aa overlap with a predicted ORF (ORF 150.ng) from *N. gonorrhoeae*:

```
   m150/g150

210        220        230        240        250        260
   m150.pep  LLKEEAAKNRATPAPQTTPPAGLQTAPDGRYCKAAPFPAALLANQKITARQSDKDVRHIE
                                        |||  ||||||||||||||||||||||||||||
   g150                                 YCKADPFPAALLANQKITARQSDKDVRHIE
                                                 10        20        30

270        280        290        300        310        320
   m150.pep  IDLSGSDLHYLPGDALGVWFDNDPALVREILDLLGIDPATEIQAGGKMMPVARALSSHFE
             ||||||||||||||||||||||||||||:|||||||:|||||||||:|||: |||:||||
   g150      IDLSGSDLHYLPGDALGVWFDNDPALVGEILDLLGINPATEIQAGGKTLPVSALLSHFE
                       40         50        60        70        80        90

330        340        350        360        370        380
   m150.pep  LTQNTPAFVKGYAAFAHYEELDKIIADNAVLQDFVQNTPIVDVLHRFPASLTAEQFIRLL
             ||||||||||||:||  :|||:| |||||||  :|||: |||||||:||||| |||:|||
   g150      LTQNTPAFVKGYATFADNDELDRIAADNAVLQGFVQSTPIAGVLHRFPAKLTAEQFAGLL
                      100       110       120       130       140       150

390        400        410        420        430        440
   m150.pep  RPLAPRLYSISSAQAEVGDEVHLTVGVVRFEHEGRARTGGASGFLADRLEEDGTVRVFVE
             ||||||||||:|||:|||||||||||||:|||||||:||||||:||||||||||||||:|
   g150      RPLAPRLYSISSSQAEAGDEVHLTVGVARFEHEGRARAGGASGFFADRLEEDGTVRVFAE
                      160       170       180       190       200       210
```

-continued

```
              450        460        470        480        490        500
m150.pep RNDGFRLPEDSRKPIVMIGSGTGVAPFRAFVQQRAAENAEGKNWLIFGNPHFARDFLYQT
         ||||||||||||||||||||||||||||||||||||||||:|||||||||||| |||||
g150     RNDGFRLPEDSRKPIVMIGSGTGVAPFRAFVQQRAAENAEGRNWLIFGNPHFAADFLYQT
              220        230        240        250        260        270

510        520        530        540        550        560
m150.pep EWQQFAKDGFLHRYDFAWSRDQEEKIYVQDKIREQAEGLWQWLQEGAHIYVCGDAAKMAK
         ||||||||||||||||||||||||||||||||||||||||||||||||||||||||||||
g150     EWQQFAKDGFLHRYDFAWSRDQEEKIYVQDKIREQAEGLWQWLQEGAHIYVCGDAAKMAK
              280        290        300        310        320        330

570        580        590        600
m150.pep DVEAALLDVIIGAGHLDEEGAEEYLDMLREEKRYQRDVYX
         :|||||||||||||| ||:|||||||||||||||||||||
g150     EVEAALLDVIIGAGHSDEDGAEGYLDMLREEKRYQRDVYX
              340        350        360        370
```

The following partial DNA sequence was identified in *N. meningitidis* <SEQ ID 611>:

```
a150.seq
    1 ATGCAGAACA CAAATCCGCC ATTACCGCCT ATGCCGCCCG AAATCACGCA

51 GCTCCTGTCG GGGCTGGACG CGGCACAATG GGCGTGGCTG TCCGGCTACG

101 CTTGGGCAAA AGCAGGAAAC GGGGCATCTG CAGGACTGCC CGCGCTTCAG

151 ACGGCATTGC CGACGGCAGA ACCTTTTTCC GTAACCGTCC TTTCCGCCTC

201 GCAAACCGGC AATGCGAAAT CCGTTGCCGA CAAAGCGGCG GACAGCCTGG

251 AAGCCGCCGG CATCCAAGTC AGTCGCGCCG AACTGAAAGA CTATAAGGCG

301 AAAAACATCG CCGGCGAACG CCGCCTGCTG CTGGTTACCT CCACCCAAGG

351 CGAAGGCGAA CCGCCGGAAG AAGCCGTCGT GCTGCACAAA CTGCTGAACG

401 GCAAAAAAGC CCCGAAATTG GACAAACTCC AATTTGCCGT ACTGGGTTTG

451 GGCGACAGCT CCTATCCGAA TTTCTGCCGG GCGGGCAAAG ATTTCGACAA

501 ACGTTTTGAA GAATTGGGCG CAAAACGCCT GCTCGAACGC GTTGATGCGG

551 ATTTGGACTT TGCCGCCGCC GCAGACGGAT GGACAGATAA TATCGCCGCA

601 CTCTTAAAAG AAGAAGCCGC AAAAAACCGG GCAACGCCCG CGCCGCAGAC

651 AACGCCCCCC GCCGGCCTTC AGACGGCACC GGATGGCAGG TACTGCAAGG

701 CAGACCCCTT TGCCGCCGCC CTGCTGGCCA ATCAGAAAAT CACCGCCCGC

751 CAATCCGATA AAGACGTGCG CCACATCGAA ATCGATTTGA GCGGTTCGGA

801 TTTGCACTAC CTCCCGGGCG ACGCGCTCGG CGTTTGGTTT GACAACGATC

851 CGGCACTGGT CAGGGAAATC CTAGACCTGC TCGGCATCGA TCAGGCAACG

901 GAAATACAGG CGGGCGGAAA AACCCTGCCG GTTGCCTCCG CACTGTTATC

951 CCATTTTGAA CTCACGCAAA ACACCCCCGC CTTTGTCAAA GGCTATGCCC

1001 CGTTCGCCGA TGATGACGAA CTCGACCGTA TTGCTGCCGA CAACGCCGTT

1051 TTGCAAGGCT TTGTGCAAAG CACGCCGATT GCCGATGTGC TGCACCGCTT

1101 CCCGGCAAAA CTGACAGCGG AACAATTCGC CGGCCTACTG CGCCCGCTTG

1151 CGCCGCGCCT GTATTCGATT TCCTCGTCGC AGGCGGAAGT GGGGGACGAA

1201 GTGCACCTGA CCGTCGGCGC GGTGCGTTTC GAACACGAAG GCGCGCCAG

1251 GGCGGGCGGC GCATCGGGTT TCCTTGCCGA CCGGCTGGAA GAGGACGGCA

1301 CGGTGCGCGT GTTTGTGGAA CGCAACGACG GCTTCAGGCT GCCCGAAGAC

1351 AGCCGCAAGC CGATTGTGAT GATCGGCTCG GGCACCGGCG TCGCACCGTT

1401 CCGCGCTTTC GTCCAACAAC GTGCCGCAGA AAATGCGGAA GGCAAAAACT
```

```
-continued
1451 GGCTGTTTTT CGGCAATCCG CATTTTGCCC GTGATTTTCT CTATCAAACC

1501 GAATGGCAGC AGTTTGCCAA AGACGGCTTC CTGCACAGAT ACGATTTCGC

1551 CTGGTCGCGC GATCAGGAAG AAAAAATCTA TGTGCAGGAC AAAATCCGCG

1601 AACAGGCGGA AGGACTTTGG CAATGGCTGC AGGAAGGCGC GCATATCTAT

1651 GTGTGCGGCG ATGCGGCAAA AATGGCAAAA GACGTGGAAG CCGCCTTGCT

1701 GGATGTGATT ATCGGGGCAG ACATTTGGA CGAAGAGGGC GCAGAAGAAT

1751 ATTTGGATAT GCTGCGCGAA GAAAAACGCT ATCAGCGTGA TGTTTATTGA
```

This corresponds to the amino acid sequence <SEQ ID 612; ORF 150.a>:

```
a150.pep

1 MQNTNPPLPP MPPEITQLLS GLDAAQWAWL SGYAWAKAGN GASAGLPALQ

51 TALPTAEPFS VTVLSASQTG NAKSVADKAA DSLEAAGIQV SRAELKDYKA

101 KNIAGERRLL LVTSTQGEGE PPEEAVVLHK LLNGKKAPKL DKLQFAVLGL

151 GDSSYPNFCR AGKDFDKRFE ELGAKRLLER VDADLDFAAA ADGWTDNIAA

201 LLKEEAAKNR ATPAPQTTPP AGLQTAPDGR YCKADPFPAA LLANQKITAR

251 QSDKDVRHIE IDLSGSDLHY LPGDALGVWF DNDPALVREI LDLLGIDQAT

301 EIQAGGKTLP VASALLSHFE LTQNTPAFVK GYAPFADDDE LDRIAADNAV

351 LQGFVQSTPI ADVLHRFPAK LTAEQFAGLL RPLAPRLYSI SSSQAEVGDE

401 VHLTVGAVRF EHEGRARAGG ASGFLADRLE EDGTVRVFVE RNDGFRLPED

451 SRKPIVMIGS GTGVAPFRAF VQQRAAENAE GKNWLFFGNP HFARDFLYQT

501 EWQQFAKDGF LHRYDFAWSR DQEEKIYVQD KIREQAEGLW QWLQEGAHIY

551 VCGDAAKMAK DVEAALLDVI IGAGHLDEEG AEEYLDMLRE EKRYQRDVY* m150/a150 94.8% identity in 599 aa overlap 10         20         30         40         50         60
m150.pep  MQNTNPPLPPLPPEITQLLSGLDAAQWAWLSGYAWAKAGNGASAGLPALQTALPAAEPFS
          ||||||||||:|||||||||||||||||||||||||||||||||||||||||||:|||||
a150      MQNTNPPLPPMPPEITQLLSGLDAAQWAWLSGYAWAKAGNGASAGLPALQTALPTAEPFS
                   10         20         30         40         50         60

70         80         90        100        110        120
m150.pep  VTVLSASQTGNAKSVADKAADSLEAAGIQVSRAELKDYKAKNIAGERRLLLVTSTQGEGE
          ||||||||||||||||||||||||||||||||||||||||||||||||||||||||||||
a150      VTVLSASQTGNAKSVADKAADSLEAAGIQVSRAELKDYKAKNIAGERRLLLVTSTQGEGE
                   70         80         90        100        110        120

130        140        150        160        170        180
m150.pep  PPKEAVVLHKLLNGKKAPKLDKLQFAVLGLGDSSYPNFCQAGKDFDRRFEELGAKRLLER
          ||:|||||||||||||||||||||||||||||||||||||:||||||:||||||||||||
a150      PPEEAVVLHKLLNGKKAPKLDKLQFAVLGLGDSSYPNFCRAGKDFDKRFEELGAKRLLER
                  130        140        150        160        170        180

190        200        210        220        230        240
m150.pep  VDADLDFTASANAWTDNIAALLKEEAAKNRATPAPQTTPPAGLQTAPDGRYCKAAPFPAA
          |||||||:|:|::|||||||||||||||||||||||||||||||||||||||| |||||
a150      VDADLDFAAAADGWTDNIAALLKEEAAKNRATPAPQTTPPAGLQTAPDGRYCKADPFPAA
                  190        200        210        220        230        240

250        260        270        280        290        300
m150.pep  LLANQKITARQSDKDVRHIEIDLSGSDLHYLPGDALGVWFDNDPALVREILDLLGIDPAT
          ||||||||||||||||||||||||||||||||||||||||||||||||||||||||| ||
a150      LLANQKITARQSDKDVRHIEIDLSGSDLHYLPGDALGVWFDNDPALVREILDLLGIDQAT
                  250        260        270        280        290        300

310        320        330        340        350        360
m150.pep  EIQAGGKMMPVARALSSHFELTQNTPAFVKGYAAFAHYEELDKIIADNAVLQDFVQNTPI
          |||||||:|||   || ||||||||||||||||  :|||:| ||||||||| |||:|||
a150      EIQAGGKTLPVASALLSHFELTQNTPAFVKGYAPFADDDELDRIAADNAVLQGFVQSTPI
                  310        320        330        340        350        360
```

-continued

```
                 370        380        390        400        410        420
m150.pep VDVLHRFPASLTAEQFIRLLRPLAPRLYSISSAQAEVGDEVHLTVGVVRFEHEGRARTGG
         :||||||||:|||  ||  ||||||||||||||:||||||||||:|||||||||||:||
a150     ADVLHRFPAKLTAEQFAGLLRPLAPRLYSISSSQAEVGDEVHLTVGAVRFEHEGRARAGG
                 370        380        390        400        410        420

430        440        450        460        470        480
m150.pep ASGFLADRLEEDGTVRVFVERNDGFRLPEDSRKPIVMIGSGTGVAPFRAFVQQRAAENAE
         ||||||||||||||||||||||||||||||||||||||||||||||||||||||||||||
a150     ASGFLADRLEEDGTVRVFVERNDGFRLPEDSRKPIVMIGSGTGVAPFRAFVQQRAAENAE
                 430        440        450        460        470        480

490        500        510        520        530        540
m150.pep GKNWLIFGNPHFARDFLYQTEWQQFAKDGFLHRYDFAWSRDQEEKIYVQDKIREQAEGLW
         |||||:||||||||||||||||||||||||||||||||||||||||||||||||||||||
a150     GKNWLFFGNPHFARDFLYQTEWQQFAKDGFLHRYDFAWSRDQEEKIYVQDKIREQAEGLW
                 490        500        510        520        530        540

550        560        570        580        590        600
m150.pep QWLQEGAHIYVCGDAAKMAKDVEAALLDVIIGAGHLDEEGAEEYLDMLREEKRYQRDVYX
         ||||||||||||||||||||||||||||||||||||||||||||||||||||||||||||
a150     QWLQEGAHIYVCGDAAKMAKDVEAALLDVIIGAGHLDEEGAEEYLDMLREEKRYQRDVYX
                 550        560        570        580        590        600
```

The following partial DNA sequence was identified in *N. gonorrhoeae* <SEQ ID 613>:

```
g151.seq
    1 ATGAAACAAA TCCGCAACAT CGCCATCATC GCACACGTCG ACCACGGCAA

51 AACCACATTG GTCGACCAAC TGCTGCGCCA ATCCGGCACA TTCCGCGCCA

101 ACCAGCAGGT TGACGAGCGC GTGATGGACA GCAACGACCT TGAAAAAGAA

151 CGCGGCATCA CCATCCTCGC CAAAAACACC GCCATCGATT ACGAAGGCTG

201 CCACATCAAT ATCGTCGACA CGCCGGGACA CGCCGACTTC GGCGGCGAAG

251 TGGAGCGCGT TTTGGGGATG GTGGATTGCG TCGTCTTGTT GGTGGACGCA

301 CAGGAAGGTC CGATGCCGCA AACCCGTTTC GTGACCAAAA AAGCCTTGGC

351 TTTGGGGCTG AAACCGATTG TCGTCATCAA CAAAATCGAC AAACCGTCCG

401 CCCGTCCGAG CTGGGTTATC GACCAGACTT TCGAGTTGTT CGACAACTTG

451 GGTGCGACCG ACGAGCAGTT GGATTTCCCG ATTGTTTACG CTTCAGGTTT

501 GAGCGGCTTT GCCAAGCTGG AAGAAAccga CGAGAGCAGC GATATGCGCC

551 CGCtgttcgA CACCATCCTA AAATACAcgc ctgCACCGAG CGGCAGCGCG

601 GACGAGCCGC TGCAACTGCA AATTTCCCAA CTCGACTACG ACAACTACAC

651 CGGCCGCCTC GGTATCGGTC GTATCTTGAA CGGACGCATC AAACCCGGCC

701 AAACCGTTGC CGTGATGAAC CACGAGCAGC AAATCGCCCA AGGCCGCATC

751 AACCAGCTTT TGGGTTTCAA AGGCTTGGAA CGCGTGCCGC TTGAAGAAGC

801 CGAAGCCGGC GACATTGTGA TTATTTCCGG TATCGAAGAC ATCGGCATCG

851 GCGTAACCAT CACCGACAAA GACAACCCCA AAGGCCTGCC GATGTTGAGC

901 GTGGACGAAC CGACGCTGAC GATGGACTTT ATGGTAAACA CCAGCCCGCT

951 CGCAGGTACA GAAGGCAAAT TCGTGACCAG CCGCCAAATC CGCGACCGCC

1001 TGCAAAAAGA ATTGCTGACC AACGTTGCCC TGCGCGTGGA AGACACCGCC

1051 GatgCCGACG TGTTCCGCGT ATCcgGGCGC GGCGAACTGC ACCTGACGAT

1101 TTTGCTGGAA AATATGCGCC GCGAAGGCTA CGAACTCGCC GTCGGCAAGC

1151 CGCGCGTCGT GTACCGAGAC ATCGACGGTC AAAAATGCGA ACCTTATGAA

1201 AACCTGACTG TGGACGTACc cgacgacAAC CAAGGCGCGG TAATGGAAGA

1251 ACTCGGCCGC CGCCGTGGCG AACTGACCAA TATGGAAAGC GACGGCAACG
```

-continued

```
1301 GacgCACCCG CCTCGAATAC CATATTCCAG CGCGCGGCTT GATCGGTTTC

1351 CAAGGCGAAT TCATGACCCT GACGCGCGGC GTCGGGCTGA TGAgccacGT

1401 GTTcgacgac tacgcgcccg tcaAACCCGA TATGCCCGGC CGCCACAACG

1451 GCGTactggt GtcccaAGAG CAGGGCGAGG CGGTTGCTTA CGCCTTGTGG

1501 AATCTTGAAG ACCGCGGCCG TATGTTCGTA TCGCCCAACG ACAAAATCTA

1551 CGAAGGTATG ATTATCGGCA TCCACAGCCG CGACAACGAT TTGGTGGTCA

1601 ACCCGCTCAA AGGCAAAAAA CTCACCAATA TCCGTGCCAG CGGTACCGAC

1651 GAAGCGGTGC GCCTGACCAC GCCGATCAAA CTGAcgcTGG AAGGCGCGGT

1701 CGAGTTTATC GACGATGACG AGCTGGTGGA AATCACGCCG CAAtccatcc 1751 gcctgcgcat gcgttacctG AGCGaattgg aacgccgccg tcaTTTTAAA 1801 AagctgGATT AA
```

This corresponds to the amino acid sequence <SEQ ID 614; ORF 151.ng>:

```
g151.pep
  1 MKQIRNIAII AHVDHGKTTL VDQLLRQSGT FRANQQVDER VMDSNDLEKE

51 RGITILAKNT AIDYEGCHIN IVDTPGHADF GGEVERVLGM VDCVVLLVDA

101 QEGPMPQTRF VTKKALALGL KPIVVINKID KPSARPSWVI DQTFELFDNL

151 GATDEQLDFP IVYASGLSGF AKLEETDESS DMRPLFDTIL KYTPAPSGSA

201 DEPLQLQISQ LDYDNYTGRL GIGRILNGRI KPGQTVAVMN HEQQIAQGRI

251 NQLLGFKGLE RVPLEEAEAG DIVIISGIED IGIGVTITDK DNPKGLPMLS

301 VDEPTLTMDF MVNTSPLAGT EGKFVTSRQI RDRLQKELLT NVALRVEDTA

351 DADVFRVSGR GELHLTILLE NMRREGYELA VGKPRVVYRD IDGQKCEPYE

401 NLTVDVPDDN QGAVMEELGR RRGELTNMES DGNGRTRLEY HIPARGLIGF

451 QGEFMTLTRG VGLMSHVFDD YAPVKPDMPG RHNGVLVSQE QGEAVAYALW

501 NLEDRGRMFV SPNDKIYEGM IIGIHSRDND LVVNPLKGKK LTNIRASGTD

551 EAVRLTTPIK LTLEGAVEFI DDDELVEITP QSIRLRMRYL SELERRRHFK

601 KLD*
```

The following partial DNA sequence was identified in *N. meningitidis* <SEQ ID 615>:

```
m151.seq
  1 ATGAAACAAA TCCGCAACAT CGCCATCATC GCCCACGTCG ACCACGGCAA

51 AACCACATTG GTCGACCAAC TGCTGCGCCA ATCCGGCACA TTCCGCGCCA

101 ACCAGCAGGT TGACGAGCGC GTGATGGACA GCAACGACCT TGAAAAGAA

151 CGCGGCATCA CCATCCTCGC CAAAAACACC GCCATCGATT ACGAAGGCTA

201 CCACATCAAT ATCGTCGACA CGCCGGGACA CGCCGACTTC GGCGGCGAAG

251 TAGAGCGCGT TTTGGGGATG GTGGACTGCG TCGTCTTGTT GGTGGACGCG

301 CAGGAAGGCC CGATGCCGCA AACCCGTTTC GTGACCAAAA AAGCCTTGGC

351 TTTGGGGCTG AAACCGATTG TCGTCATCAA CAAAATCGAC AAGCCGTCCG

401 CTCGTCCGAG CTGGGTTATC GACCAAACTT TCGAGCTGTT CGACAACTTG

451 GGCGCGACCG ACGAGCAGTT GGATTTCCCG ATTGTTTACG CTTCAGGGTT
```

```
 501 GAGCGGTTTC GCCAAATTGG AAGAAACCGA CGAGAGCAAC GACATGCGTC

551 CGCTGTTCGA TACTATCTTA AAATATACGC CTGCACCGAG CGGCAGCGCG

601 GACGAAACGC TGCAACTGCA AATTTCCCAA CTCGACTACG ACAACTACAC

651 CGGCCGCCTC GGTATCGGTC GTATCTTGAA CGGACGCATC AAACCCGGCC

701 AAACCGTTGC CGTCATGAAC CACGATCAGC AAATCGCCCA AGGCCGCATC

751 AACCAGCTTT TGGGTTTCAA AGGTTTGGAA CGCGTGCCGC TTGAAGAAGC

801 CGAAGCCGGC GACATCGTGA TTATTTCCGG TATCGAAGAC ATCGGTATCG

851 GCGTAACCAT CACCGACAAA GACAATCCCA AAGGCCTACC GATGTTGAGC

901 GTGGACGAAC CGACGCTGAC GATGGACTTT ATGGTCAACA CCAGCCCGCT

951 GGCGGGTACG GAAGGCAAAT TCGTAACCAG CCGCCAAATC CGCGACCGCC

1001 TGCAAAAAGA ATTGCTGACC AACGTCGCCC TGCGCGTGGA AGATACCGCC

1051 GATGCCGACG TGTTCCGCGT ATCCGGGCGC GGCGAGCTGC ACCTGACCAT

1101 TTTGCTGGAA ACATGCGCC GCGAAGGCTA CGAACTCGCC GTCGGCAAAC

1151 CGCGCGTCGT GTACCGCGAC ATCGACGGTC AAAAATGCGA ACCGTATGAA

1201 AACCTGACCG TGGATGTACC CGACGACAAC CAAGGCGCGG TAATGGAAGA

1251 ACTCGGCCGC CGCCGTGGCG AACTGACTAA TATGGAAAGC GACGGCAACG

1301 GACGCACCCG CCTCGAATAC CATATTCCAG CGCGCGGCTT GATCGGTTTC

1351 CAAGGCGAAT TTATGACCCT GACGCGCGGG GTCGGGCTGA TGAGCCACGT

1401 GTTCGACGAT TACGCGCCCG TCAAACCCGA TATGCCCGGC CGCCACAACG

1451 GCGTGCTGGT GTCCCAAGAG CAGGGCGAGG CAGTCGCTTA CGCCTTGTGG

1501 AATCTGGAAG ACCGCGGCCG TATGTTCGTA TCGCCCAACG ACAAAATCTA

1551 CGAAGGCATG ATTATCGGCA TCCACAGTCG CGACAACGAT TTGGTGGTCA

1601 ACCCGCTCAA AGGCAAAAAA CTTACCAACA TCCGTGCCAG CGGGTACCGAC

1651 GAAGCCGTTC GCCTGACCAC GCCAATCAAG CTGACGCTGG AAGGTGCGGT

1701 TGAGTTTATC GACGATGACG AACTCGTTGA AATCACGCCG CAATCCATCC

1751 GTCTGCGCAA GCGTTACTTG AGCGAATTGG AACGCCGCCG CCACTTTAAA

1801 AAGCTGGATT GA
```

This corresponds to the amino acid sequence <SEQ ID 45 616; ORF 151>:

```
m151.pep
   1 MKQIRNIAII AHVDHGKTTL VDQLLRQSGT FRANQQVDER VMDSNDLEKE

51 RGITILAKNT AIDYEGYHIN IVDTPGHADF GGEVERVLGM VDCVVLLVDA

101 QEGPMPQTRF VTKKALALGL KPIVVINKID KPSARPSWVI DQTFELFDNL

151 GATDEQLDFP IVYASGLSGF AKLEETDESN DMRPLFDTIL KYTPAPSGSA

201 DETLQLQISQ LDYDNYTGRL GIGRILNGRI KPGQTVAVMN HDQQIAQGRI

251 NQLLGFKGLE RVPLEEAEAG DIVIISGIED IGIGVTITDK DNPKGLPMLS

301 VDEPTLTMDF MVNTSPLAGT EGKFVTSRQI RDRLQKELLT NVALRVEDTA

351 DADVFRVSGR GELHLTILLE NMRREGYELA VGKPRVVYRD IDGQKCEPYE

401 NLTVDVPDDN QGAVMEELGR RGELTNMES DGNGRTRLEY HIPARGLIGF

451 QGEFMTLTRG VGLMSHVFDD YAPVKPDMPG RHNGVLVSQE QGEAVAYALW
```

-continued

```
501 NLEDRGRMFV SPNDKIYEGM IIGIHSRDND LVVNPLKGKK LTNIRASGTD

551 EAVRLTTPIK LTLEGAVEFI DDDELVEITP QSIRLRKRYL SELERRRHFK

601 KLD*
```

Computer analysis of this amino acid sequence gave the following results:

Homology with a Predicted ORF from *N. gonorrhoeae*
ORF 151 shows 99.2% identity over a 603 aa overlap with a predicted ORF (ORF 151.ng) from *N. gonorrhoeae*:

```
m151/g151

10         20         30         40         50         60
m151.pep  MKQIRNIAIIAHVDHGKTTLVDQLLRQSGTFRANQQVDERVMDSNDLEKERGITILAKNT
          ||||||||||||||||||||||||||||||||||||||||||||||||||||||||||||
g151      MKQIRNIAIIAHVDHGKTTLVDQLLRQSGTFRANQQVDERVMDSNDLEKERGITILAKNT
                  10         20         30         40         50         60

70         80         90        100        110        120
m151.pep  AIDYEGYHINIVDTPGHADFGGEVERVLGMVDCVVLLVDAQEGPMPQTRFVTKKALALGL
          |||||  |||||||||||||||||||||||||||||||||||||||||||||||||||||
g151      AIDYEGCHINIVDTPGHADFGGEVERVLGMVDCVVLLVDAQEGPMPQTRFVTKKALALGL
                  70         80         90        100        110        120

130        140        150        160        170        180
m151.pep  KPIVVINKIDKPSARPSWVIDQTFELFDNLGATDEQLDFPIVYASGLSGFAKLEETDESN
          |||||||||||||||||||||||||||||||||||||||||||||||||||||||||||:
a151      KPIVVINKIDKPSARPSWVIDQTFELFDNLGATDEQLDFPIVYASGLSGFAKLEETDESS
                 130        140        150        160        170        180

190        200        210        220        230        240
m151.pep  DMRPLFDTILKYTPAPSGSADETLQLQISQLDYDNYTGRLGIGRILNGRIKPGQTVAVMN
          ||||||||||||||||||||||||| |||||||||||||||||||||||||||||||||
g151      DMRPLFDTILKYTPAPSGSADEPLQLQISQLDYDNYTGRLGIGRILNGRIKPGQTVAVMN
                 190        200        210        220        230        240

250        260        270        280        290        300
m151.pep  HDQQIAQGRINQLLGFKGLERVPLEEAEAGDIVIISGIEDIGIGVTITDKDNPKGLPMLS
          |:||||||||||||||||||||||||||||||||||||||||||||||||||||||||||
g151      HEQQIAQGRINQLLGFKGLERVPLEEAEAGDIVIISGIEDIGIGVTITDKDNPKGLPMLS
                 250        260        270        280        290        300

310        320        330        340        350        360
m151.pep  VDEPTLTMDFMVNTSPLAGTEGKFVTSRQIRDRLQKELLTNVALRVEDTADADVFRVSGR
          ||||||||||||||||||||||||||||||||||||||||||||||||||||||||||||
g151      VDEPTLTMDFMVNTSPLAGTEGKFVTSRQIRDRLQKELLTNVALRVEDTADADVFRVSGR
                 310        320        330        340        350        360

370        380        390        400        410        420
m151.pep  GELHLTILLENMRREGYELAVGKPRVVYRDIDGQKCEPYENLTVDVPDDNQGAVMEELGR
          ||||||||||||||||||||||||||||||||||||||||||||||||||||||||||||
g151      GELHLTILLENMRREGYELAVGKPRVVYRDIDGQKCEPYENLTVDVPDDNQGAVMEELGR
                 370        380        390        400        410        420

430        440        450        460        470        480
m151.pep  RRGELTNMESDGNGRTRLEYHIPARGLIGFQGEFMTLTRGVGLMSHVFDDYAPVKPDMPG
          ||||||||||||||||||||||||||||||||||||||||||||||||||||||||||||
g151      RRGELTNMESDGNGRTRLEYHIPARGLIGFQGEFMTLTRGVGLMSHVFDDYAPVKPDMPG
                 430        440        450        460        470        480

490        500        510        520        530        540
m151.pep  RHNGVLVSQEQGEAVAYALWNLEDRGRMFVSPNDKIYEGMIIGIHSRDNDLVVNPLKGKK
          ||||||||||||||||||||||||||||||||||||||||||||||||||||||||||||
g151      RHNGVLVSQEQGEAVAYALWNLEDRGRMFVSPNDKIYEGMIIGIHSRDNDLVVNPLKGKK
                 490        500        510        520        530        540

550        560        570        580        590        600
m151.pep  LTNIRASGTDEAVRLTTPIKLTLEGAVEFIDDDELVEITPQSIRLRKRYLSELERRRHFK
          |||||||||||||||||||||||||||||||||||||||||||||| |||||||||||||
g151      LTNIRASGTDEAVRLTTPIKLTLEGAVEFIDDDELVEITPQSIRLRMRYLSELERRRHFK
                 550        560        570        580        590        600 m151.pep  KLDX
          ||||
g151      KLDX
```

The following partial DNA sequence was identified in *N. meningitidis* <SEQ ID 617>:

```
a151.seq
   1  ATGAAACAAA TCCGCAACAT CGCCATCATC GCCCACGTCG ACCACGGCAA
```

-continued

```
  51 AACCACATTG GTCGACCAAC TGCTGCGCCA ATCCGGCACA TTCCGCGCCA

101 ACCAGCAGGT TGACGAGCGC GTGATGGACA GCAACGACCT TGAAAAAGAA

151 CGCGGCATCA CCATCCTCGC CAAAAACACC GCCATCGATT ACGAAGGCTA

201 CCACATCAAT ATCGTCGACA CGCCGGGACA CGCCGACTTC GGCGGCGAAG

251 TAGAGCGAGT TTTGGGGATG GTGGACTGCG TCGTCTTGTT GGTGGACGCG

301 CAGGAAGGCC CGATGCCGCA AACCCGTTTC GTGACCAAAA AAGCCTTGGC

351 TTTGGGGCTG AAACCGATTG TCGTCATCAA TAAAATCGAC AAACCGTCCG

401 CCCGTCCGAG CTGGGTCATC GACCAAACTT TCGAGCTGTT CGACAACTTG

451 GGCGCGACCG ACGAGCAGTT GGATTTCCCG ATTGTTTATG CTTCCGGTCT

501 GTCCGGTTTC GCCAAATTGG AAGAAACCGA CGAGAGCAAC GACATGCGTC

551 CGCTGTTCGA TACTATCTTA AAATATACGC CTGCACCGAG CGGCAGCGCG

601 GACGAAACGC TGCAACTGCA AATTTCCCAA CTCGACTACG ACAACTACAC

651 CGGCCGCCTC GGTATCGGTC GTATCTTGAA CGGACGTATC AAGCCCGGTC

701 AAGTTGTTGC CGTCATGAAC CACGATCAAC AAATCGCCCA AGGCCGCATC

751 AACCAGCTTT TGGGTTTCAA AGGTTTAGAA CGCGTGCCGC TTGAAGAAGC

801 CGAAGCCGGC GACATCGTGA TTATTTCCGG TATTGAAGAC ATCGGCATCG

851 GCGTAACCAT CACCGACAAA GACAACCCCA AAGGCCTGCC GATGTTGAGC

901 GTGGACGAAC CGACGCTGAC GATGGACTTT ATGGTCAACA CCAGCCCGTT

951 GGCAGGTACG GAAGGCAAAT TCGTAACCAG CCGCCAAATC CGCGACCGCC

1001 TGCAAAAAGA ATTGCTGACC AACGTCGCCC TGCGCGTGGA AGATACCGCC

1051 GATGCCGACG TGTTCCGCGT ATCCGGGCGC GGCGAGCTGC ACCTGACCAT

1101 TTTGCTGGAA ACATGCGCC GCGAAGGCTA CGAACTCGCC GTCGGCAAAC

1151 CGCGCGTCGT GTACCGCGAC ATCGACGGTC AAAAATGCGA ACCGTATGAA

1201 AACCTGACCG TGGACGTACC CGACGACAAC CAAGGCGCGG TAATGGAAGA

1251 ACTCGGCCGC CGCCGTGGCG AACTGACTAA TATGGAAAGC GACGGCAACG

1301 GACGCACCCG CCTCGAATAC CATATTCCAG CGCGCGGCTT GATCGGCTTC

1351 CAAGGCGAAT TTATGACCCT GACGCGCGGG GTCGGGCTGA TGAGCCACGT

1401 GTTCGACGAT TACGCGCCCG TCAAACCCGA TATGCCTGGC CGCCACAACG

1451 GCGTGCTGGT GTCCCAAGAG CAGGGCGAGG CAGTCGCTTA CGCCTTGTGG

1501 AATCTGGAAG ACCGCGGCCG TATGTTCGTA TCGCCCAACG ACAAAATCTA

1551 CGAAGGTATG ATTATCGGCA TCCACAGTCG CGACAACGAT TTGGTGGTCA

1601 ACCCGCTCAA AGGCAAAAAA CTTACCAACA TCCGTGCCAG CGGTACCGAC

1651 GAAGCCGTTC GCCTGACCAC GCCGATTAAG CTGACGCTGG AAGGTGCGGT

1701 CGAGTTTATC GACGATGATG AGCTGGTAGA AATCACGCCG CAATCCATCC

1751 GTCTGCGCAA GCGTTACTTG AGCGAATTGG AACGCCGCCG CCATTTCAAA

1801 AAGCTAGATT GA
```

This corresponds to the amino acid sequence <SEQ ID 618; ORF 151.a>:

a151.pep

```
  1 MKQIRNIAII AHVDHGKTTL VDQLLRQSGT FRANQQVDER VMDSNDLEKE
```

-continued

```
 51 RGITILAKNT AIDYEGYHIN IVDTPGHADF GGEVERVLGM VDCVVLLVDA

101 QEGPMPQTRF VTKKALALGL KPIVVINKID KPSARPSWVI DQTFELFDNL

151 GATDEQLDFP IVYASGLSGF AKLEETDESN DMRPLFDTIL KYTPAPSGSA

201 DETLQLQISQ LDYDNYTGRL GIGRILNGRI KPGQVVAVMN HDQQIAQGRI

251 NQLLGFKGLE RVPLEEAEAG DIVIISGIED IGIGVTITDK DNPKGLPMLS

301 VDEPTLTMDF MVNTSPLAGT EGKFVTSRQI RDRLQKELLT NVALRVEDTA

351 DADVFRVSGR GELHLTILLE NMRREGYELA VGKPRVVYRD IDGQKCEPYE

401 NLTVDVPDDN QGAVMEELGR RRGELTNMES DGNGRTRLEY HIPARGLIGF

451 QGEFMTLTRG VGLMSHVFDD YAPVKPDMPG RHNGVLVSQE QGEAVAYALW

501 NLEDRGRMFV SPNDKIYEGM IIGIHSRDND LVVNPLKGKK LTNIRASGTD

551 EAVRLTTPIK LTLEGAVEFI DDDELVEITP QSIRLRKRYL SELERRRHFK

601 KLD*
``` m151/a151 99.8% identity in 603 aa overlap

```
                    10         20         30         40         50         60
m151.pep MKQIRNIAIIAHVDHGKTTLVDQLLRQSGTFRANQQVDERVMDSNDLEKERGITILAKNT
         ||||||||||||||||||||||||||||||||||||||||||||||||||||||||||||
a151     MKQIRNIAIIAHVDHGKTTLVDQLLRQSGTFRANQQVDERVMDSNDLEKERGITILAKNT
                 10         20         30         40         50         60

70         80         90        100        110        120
m151.pep AIDYEGYHINIVDTPGHADFGGEVERVLGMVDCVVLLVDAQEGPMPQTRFVTKKALALGL
         ||||||||||||||||||||||||||||||||||||||||||||||||||||||||||||
a151     AIDYEGYHINIVDTPGHADFGGEVERVLGMVDCVVLLVDAQEGPMPQTRFVTKKALALGL
                 70         80         90        100        110        120

130        140        150        160        170        180
m151.pep KPIVVINKIDKPSARPSWVIDQTFELFDNLGATDEQLDFPIVYASGLSGFAKLEETDESN
         ||||||||||||||||||||||||||||||||||||||||||||||||||||||||||||
a151     KPIVVINKIDKPSARPSWVIDQTFELFDNLGATDEQLDFPIVYASGLSGFAKLEETDESN
                130        140        150        160        170        180

190        200        210        220        230        240
m151.pep DMRPLFDTILKYTPAPSGSADETLQLQISQLDYDNYTGRLGIGRILNGRIKPGQTVAVMN
         |||||||||||||||||||||||||||||||||||||||||||||||||||||:||||
a151     DMRPLFDTILKYTPAPSGSADETLQLQISQLDYDNYTGRLGIGRILNGRIKPGQVVAVMN
                190        200        210        220        230        240

250        260        270        280        290        300
m151.pep HDQQIAQGRINQLLGFKGLERVPLEEAEAGDVIISGIEDIGIGVTITDKDNPKGLPMLS
         ||||||||||||||||||||||||||||||||||||||||||||||||||||||||||||
a151     HDQQIAQGRINQLLGFKGLERVPLEEAEAGDVIISGIEDIGIGVTITDKDNPKGLPMLS
                250        260        270        280        290        300

310        320        330        340        350        360
m151.pep VDEPTLTMDFMVNTSPLAGTEGKFVTSRQIRDRLQKELLTNVALRVEDTADADVFRVSGR
         ||||||||||||||||||||||||||||||||||||||||||||||||||||||||||||
a151     VDEPTLTMDFMVNTSPLAGTEGKFVTSRQIRDRLQKELLTNVALRVEDTADADVFRVSGR
                310        320        330        340        350        360

370        380        390        400        410        420
m151.pep GELHLTILLENMRREGYELAVGKPRVVYRDIDGQKCEPYENLTVDVPDDNQGAVMEELGR
         ||||||||||||||||||||||||||||||||||||||||||||||||||||||||||||
a151     GELHLTILLENMRREGYELAVGKPRVVYRDIDGQKCEPYENLTVDVPDDNQGAVMEELGR
                370        380        390        400        410        420

430        440        450        460        470        480
m151.pep RRGELTNMESDGNGRTRLEYHIPARGLIGFQGEFMTLTRGVGLMSHVFDDYAPVKPDMPG
         ||||||||||||||||||||||||||||||||||||||||||||||||||||||||||||
a151     RRGELTNMESDGNGRTRLEYHIPARGLIGFQGEFMTLTRGVGLMSHVFDDYAPVKPDMPG
                430        440        450        460        470        480

490        500        510        520        530        540
m151.pep RHNGVLVSQEQGEAVAYALWNLEDRGRMFVSPNDKIYEGMIIGIHSRDNDLVVNPLKGKK
         ||||||||||||||||||||||||||||||||||||||||||||||||||||||||||||
a151     RHNGVLVSQEQGEAVAYALWNLEDRGRMFVSPNDKIYEGMIIGIHSRDNDLVVNPLKGKK
                490        500        510        520        530        540

550        560        570        580        590        600
m151.pep LTNIRASGTDEAVRLTTPIKLTLEGAVEFIDDDELVEITPQSIRLRKRYLSELERRRHFK
         ||||||||||||||||||||||||||||||||||||||||||||||||||||||||||||
a151     LTNIRASGTDEAVRLTTPIKLTLEGAVEFIDDDELVEITPQSIRLRKRYLSELERRRHFK
                550        560        570        580        590        600 m151.pep KLDX
         ||||
a151     KLDX
```

The following partial DNA sequence was identified in *N. gonorrhoeae* <SEQ ID 619>:

```
g152.seq
    1 ATGAAAAaca aAACCaaagt ctgGGacttc cCcacccgcc ttTTCCactG

51 GctgcttgCC gCATCCctgc CCTTTATGTG gtatagCGCA AAAGCCGGCG

101 GcgataTGCT GcaatgGCAC ACGCGCGTCG GGCTGCTCGT CCTTTTCCTG

151 CTCGTATTCC GCCTCTGCTG GGGCATTTGG GGCAgcgATA CCGCCCGTTT

201 CTCccgTtTC GTCCGAGGTT GGGCAGGTAT ACGCGGCTAT CTGAAAAAcg 251 gCATTCCCGA ACAtatcCAG CCCGGACACA ACCCCTTGGG CGCACTgatg 301 gtcGTTGCGC TTTTGgccgc cgtcTCATTT CAagtcggcA CGGGGCTTTT 351 Tgccgccaat gaaaacacct tcagcaCCAa cggctacctc aaccatttgg 401 tttccgaaca tacgGGCAGC CTTATACGGA AAATCCACCT CAACTTTTTC

451 AAGCTGCTCG CCGTTTTTTC CGCAGTCCAC ATCGCCGCCG TCGCCGCATA

501 CCGCATATTC AAAAAGAAAA ACCTCGTCCG CCCGATGATA ACCGGCTTCA

551 AATACATCGA AGGCAAAACC TCAATCCGCT TGCCGGCAA AGCCGCGCTT

601 GCCGCCGCAT TATCGGTTGC CGCGCTTGCC GCAGCCGCCA TCCTGCTCCT

651 GTCCTGA
```

This corresponds to the amino acid sequence <SEQ ID 620; ORF 152.ng>:

```
g152.pep
    1 MKNKTKVWDF PTRLFHWLLA ASLPFMWYSA KAGGDMLQWH TRVGLLVLFL

51 LVFRLCWGIW GSDTARFSRF VRGWAGIRGY LKNGIPEHIQ PGHNPLGALM

101 VVALLAAVSF QVGTGLFAAN ENTFSTNGYL NHLVSEHTGS LIRKIHLNFF

151 KLLAVFSAVH IAAVAAYRIF KKKNLVRPMI TGFKYIEGKT SIRFAGKAAL

201 AAALSVAALA AAILLLS*
```

40

The following partial DNA sequence was identified in *N. meningitidis* <SEQ ID 621>:

```
m152.seq
    1 ATGAAAAACA AAACCAAAGT CTGGGACCTC CCCACCCGCC TTTTCCACTG

51 GCTGCTTGCC GCGTCCCTGC CCTTTATGTG GTATAGCGCG AAAGCCGGCG

101 GCGATATGCT GCAATGGCAC ACGCGCGTCG GGCTGTTCGT CCTTTTCCTG

151 CTCGTATTTC GCCTCTGCTG GGGCATTTGG GGCAGCGATA CCGCCCGTTT

201 TTCCCGTTTC GTCCAAGGCT GGGCAGGCAT ACGCGGCTAT CTGAAAAACG

251 GTATTCCCGA ACACATCCAG CCCGGACACA ACCCCTTGGG CGCACTGATG

301 GTCGTTGCGC TTTTGGCCGC CGTGTCCTTC CAAGTCGGCA CCGGGCTTTT

351 TGCCGCCGAT GAAAACACCT TCAGCACCAA CGGCTACCTC AACCATTTGG

401 TTTCCGAACA TACGGGCAGC CTTATGCGGA AAATCCACCT CAACTTTTTC

451 AAGCTGCTCG CCGTTTTTTC TGCAATCCAC ATCGCCGCCG TCGCCGCATA

501 CCGCGTATTC AAAAAGAAAA ACCTCATCCT CCCGATGATA ACCGGCTTCA

551 AATACATCGA AGGCAAAACC TCAATCCGCT TGCAGGCAA AGCCGCGCTT
```

-continued
```
601  GCCGCCGCAT TATCGGTTGC CTCGCTTGCC GCAGCCGCCA TCCTGCTCCT

651  GTCCTGA
```

This corresponds to the amino acid sequence <SEQ ID 622; ORF 152>:

```
m152.pep
    1  MKNKTKVWDL PTRLFHWLLA ASLPFMWYSA KAGGDMLQWH TRVGLFVLFL

51  LVFRLCWGIW GSDTARFSRF VQGWAGIRGY LKNGIPEHIQ PGHNPLGALM

101  VVALLAAVSF QVGTGLFAAD ENTFSTNGYL NHLVSEHTGS LMRKIHLNFF

151  KLLAVFSAIH IAAVAAYRVF KKKNLILPMI TGFKYIEGKT SIRFAGKAAL

201  AAALSVASLA AAAILLLS*
```

Computer analysis of this amino acid sequence gave the following results:
Homology with a Predicted ORF from *N. gonorrhoeae*
ORF 152 shows 95.4% identity over a 218 aa overlap with a predicted ORF (ORF 152.ng) from *N. gonorrhoeae*:

```
m152/g152

10         20         30         40         50         60
m152.pep  MKNKTKVWDLPTRLFHWLLAASLPFMWYSAKAGGDMLQWHTRVGLFVLFLLVFRLCWGIW
          ||||||||||:|||||||||||||||||||||||||||||||||:|||||||||||||||
g152      MKNKTKVWDFPTRLFHWLLAASLPFMWYSAKAGGDMLQWHTRVGLLVLFLLVFRLCWGIW
                    10         20         30         40         50         60

70         80         90        100        110        120
m152.pep  GSDTARFSRFVQGWAGIRGYLKNGIPEHIQPGHNPLGALMVVALLAAVSFQVGTGLFAAD
          ||||||||||:|||||||||||||||||||||||||||||||||||||||||||||||:
g152      GSDTARFSRFVRGWAGIRGYLKNGIPEHIQPGHNPLGALMVVALLAAVSFQVGTGLFAAN
                    70         80         90        100        110        120

130        140        150        160        170        180
m152.pep  ENTFSTNGYLNHLVSEHTGSLMRKIHLNFFKLLAVFSAIHIAAVAAYRVFKKKNLILPMI
          |||||||||||||||||||||:|||||||||||||||:||||||||||:||||||:|||
g152      ENTFSTNGYLNHLVSEHTGSLIRKIHLNFFKLLAVFSAVHIAAVAAYRIFKKKNLVRPMI
                   130        140        150        160        170        180

190        200        210    219
m152.pep  TGFKYIEGKTSIRFAGKAALAAALSVASLAAAAILLLSX
          |||||||||||||||||||||||||:|||||||||||||
g152      TGFKYIEGKTSIRFAGKAALAAALSVAALAAAAILLLSX
                   190        200        210
```

The following partial DNA sequence was identified in *N. meningitidis* <SEQ ID 623>:

```
a152.seq
    1  ATGAAAAACA AAACCAAAGT CTGGGACTTC CCCACCCGCC TTTTCCACTG

51  GCTGCTTGCC GCATCCCTAC CCTTTATGTG GTATAGCGCG AAAACCGGCG

101  GCGATATGCT GCAATGGCAC ACGCGCGTCG GGCTGTTTAT CCTTTTCCTG

151  CTCGTATTCC GCCTCTGCTG GGGCATTTGG GGCAGCGATA CCGCCCGTTT

201  CTCCCGTTTC GTCCGCGGAT GGTCGGGTAT CAGAGAGTAT ATGAAAAACG

251  GTATTCCCGA ACACGTCCAA CCCGGACACA ACCCCTTGGG CGCACTGATG

301  GTCGTTGCGC TTTTGGCCGC CGTGTCGTTC CAAGTCGGCA CAGGGCTTTT

351  TGCCGCCGAT GTAAACACCT TCAGCACCAA CGGCTACCTC AACCATTTGG

401  TTTCCGAACA TACGGGCAGC CTTATGCGGA AAATCCATCT CAACTTTTTC

451  AAACTGCTCG CCGTTTTTTC CGCAGTCCAC ATCGCCGNCG TCGCCGCATA

501  CCGCGTGTTC AAAAAGAAAA ACCTCGTCCT CCCGATGATA ACCGGCTTCA
```

-continued

```
551  AATACATCGA AGGCAAAACC TCAATCCGCT TTGCCGGCAA AGCCGCGCTT
601  GCCGCCGCAT TATCGGTTGC CGCGCTTGCC GCAGCCGCCA TCCTGCTCCT
651  GTCCTGA
```

This corresponds to the amino acid sequence <SEQ ID 624; ORF 152.a>:

```
a152.pep
   1  MKNKTKVWDF PTRLFHWLLA ASLPFMWYSA KTGGDMLQWH TRVGLFILFL
  51  LVFRLCWGIW GSDTARFSRF VRGWSGIREY MKNGIPEHVQ PGHNPLGALM
 101  VVALLAAVSF QVGTGLFAAD VNTFSTNGYL NHLVSEHTGS LMRKIHLNFF
 151  KLLAVFSAVH IAXVAAYRVF KKKNLVLPMI TGFKYIEGKT SIRFAGKAAL
 201  AAALSVAALA AAAILLLS*
``` m152/a152 94.0% identity in 218 aa overlap

```
                10         20         30         40         50         60
m152.pep  MKNKTKVWDLPTRLFHWLLAASLPFMWYSAKAGGDMLQWHTRVGLFVLFLLVFRLCWGIW
          |||||||||:|||||||||||||||||||:||||||||||||||:||||||||||||||
a152      MKNKTKVWDFPTRLFHWLLAASLPFMWYSAKTGGDMLQWHTRVGLFILFLLVFRLCWGIW
                10         20         30         40         50         60

70         80         90        100        110        120
m152.pep  GSDTARFSRFVQGWAGIRGYLKNGIPEHIQPGHNPLGALMVVALLAAVSFQVGTGLFAAD
          ||||||||||:||:|||  |:||||||:||||||||||||||||||||||||||||||
a152      GSDTARFSRFVRGWSGIREYMKNGIPEHVQPGHNPLGALMVVALLAAVSFQVGTGLFAAD
                70         80         90        100        110        120

130        140        150        160        170        180
m152.pep  ENTFSTNGYLNHLVSEHTGSLMRKIHLNFFKLLAVFSAIHIAAVAAYRVFKKKNLILPMI
           |||||||||||||||||||||||||||||||||||||:||| |||||||||||||:||||
a152      VNTFSTNGYLNHLVSEHTGSLMRKIHLNFFKLLAVFSAVHIAXVAAYRVFKKKNLVLPMI
               130        140        150        160        170        180

190        200        210    219
m152.pep  TGFKYIEGKTSIRFAGKAALAAALSVASLAAAAILLLSX
          |||||||||||||||||||||||||||:|||||||||||
a152      TGFKYIEGKTSIRFAGKAALAAALSVAALAAAAILLLSX
               190        200        210
```

The following partial DNA sequence was identified in *N. gonorrhoeae* <SEQ ID 625>:

```
g153.seq
   1  atggggtttg cttaCAgtat gacgtatatc gaggtCGGGa taccggaggc
  51  ggcatccgtc ctttCgctGC CCGAGATgat gcgcctgatG GTGTTtCagg
 101  attATGGTTT TttggcCGAA GTGATGTTTG TGctgaCTTT cGGCGcgcCG
 151  GTTCTGTTtC TGCTGCTGTG CCTGTATGTC TATGCCGCGC TGATACGGAA
 201  ACAGGCGTAT CCTGCGCTGC GTTTGGCAAC GCGTGTGATG GTGCGCTTGA
 251  GGCAGGCGAT GATGGTGGAT GTGTTTTTTG TTTCCACTCT GGTGGCGTAT
 301  ATCAAGCTCT CGTCTGTGGC AAAGGTTCGC TTCGGGCCGG CGTTTTATCT
 351  GATGTTCGCG CTGTCGGTTA TGCTGATTCG GACTTCGGTA TCGGTTCCCC
 401  AGCATTGGGT GTATTTCCAA ATCGGGCGGC TGACGGGGAA TAATGCGGTT
 451  CAGACGGCAT CGGAAGGCAA AACCTGTTGC AGCCGCTGCC TGTATTTccg
 501  cgacAGTgcc gaatccCCCT GCGGGGTGTg cgGCGcggaA CTgtacggcg
 551  gacggccgaa aagtCTGAGt atttCgtCGG CGTTTCTgac ggcggcggTT
 601  GTTTTGTATT TCCctgCcaa TATCctgccg attaTGAttt cgtccAATCc
```

-continued

```
 651 tgccgccacg GAGGcCAACA CCATCTTTAG CGGCATCGCT TATATGTGGG

701 ACGagggcgA CAGGCTGATT GCGGCGGTTA TTTTCAGCGC GAGTATTTTG

751 GTGCCGGTGC TGAAGATTGC GGCAATGTCG GTTTTGATTG CGGCGGCACG

801 GTTCGCTTTG CCGGCGGGCG CAAAGAAATT GTCGCACCTC tacCGCATCA

851 CCGAAGCGGT CGGCCGCTGG TCGATGATTG ATATTTTTGT GATTATTATT

901 TTGATGTGTT CGTTCCacaC TTATGCCGCG CGCGTCATTC CGGGCAGTGC

951 GGCAGTCTAT TTCTGCCTGG TCGTGATTTT GACGATGCTG TCCGCCTATT

1001 ATTTCGACCC GCGCCTGCTT TGGGACAAAC GCGCTTCAGA CGGCATTGCT

1051 TTCAACGAAA CGGAAAAATA TGACTGA
```

This corresponds to the amino acid sequence <SEQ ID 626; ORF 153.ng>:

```
g153.pep
   1 MGFAYSMTYI EVGIPEAASV LSLPEMMRLM VFQDYGFLAE VMFVLTFGAP

51 VLFLLLCLYV YAALIRKQAY PALRLATRVM VRLRQAMMVD VFFVSTLVAY

101 IKLSSVAKVR FGPAFYLMFA LSVMLIRTSV SVPQHWVYFQ IGRLTGNNAV

151 QTASEGKTCC SRCLYFRDSA ESPCGVCGAE LYGGRPKSLS ISSAFLTAAV

201 VLYFPANILP IMISSNPAAT EANTIFSGIA YMWDEGDRLI AAVIFSASIL

251 VPVLKIAAMS VLIAAARFAL PAGAKKLSHL YRITEAVGRW SMIDIFVIII

301 LMCSFHTYAA RVIPGSAAVY FCLVVILTML SAYYFDPRLL WDKRASDGIA

351 FNETEKYD*
```

The following partial DNA sequence was identified in *N. meningitidis* <SEQ ID 627>:

```
m153.seq
   1 ATGGCGTTTG CTTACGGTAT GACGTATATC GAGGTCGGGA TACCGGGTGC

51 GGCATCCGTC CTTTCGCTGC CCGAGATGAT GCGCCTGATG GTGTTTCAGG

101 ATTATGGTTT TTTGGCCGAA GTGATGTTTG TGCTGACTTT CGGCGCGCCG

151 GTTCTGTTTC TGCTGCTGTG CCTGTATGTC TATGCCGCGC TGATACGGAA

201 ACAGGCGTAT CCTGCGCTGC GTTTGGCAAC GCGTGTGATG GTGCGCTTGA

251 GACAGGCGAT GATGGTGGAT GTGTTTTTTG TTTCCACTTT GGTGGCGTAT

301 ATCAAGCTCT CGTCTGTGGC AGAGGTTCGC TTCGGGCCGG CGTTTTATCT

351 GATGTTCGCG CTGTCAGTTA TGCTGATTCG GACTTCGGTA TCGGTTCCCC

401 AGCATTGGGT GTATTTTCAA ATCGGGCGGC TGACGGGGGA TAATGCGGTT

451 CAGACGGCAT CGGAAGGTAA AACCTGTTGC AGCCGCTGCC TGTATTTCCG

501 CGACAGTGCC GAATCCCCCT GCGGCGTGTG CGGTGCGGAA CTGTACCGCC

551 GACGGCCGAA AAGTCTGAGT ATTTCGTCGG CGTTTCTGAC GGCGGCGGTT

601 ATTTTGTATT TCCCTGCCAA TATCCTGCCG ATTATGATTT CGTCCAATCC

651 TGCCGCCACG GAGGTCAATA CCATCCTTAA CGGCATCGCT TATATGTGGG

701 ACGAGGGCGA CAGGCTGATT GCGGCGGTTA TTTTCAGCGC GAGTATTTTG

751 GTGCCGGTAC TGAAGATTGC GGCAATGTCG GTTTTGATTG CGTCCGCCCG

801 CTTCGCTTTG CCAACGGGTG CAAAGAAATT GTCGCACCTC TACCGCATCA
```

-continued
```
 851 CCGAAGCGGT CGGCCGCTGG TCGATGATTG ATATTTTTGT GATTATTATT

901 TTGATGTGTT CGTTCCACAC TTATGCCGCG CGCGTCATTC CGGGCAGTGC

951 GGCAGTCTAT TTCTGCCTGG TCGTGATTCT GACGATGCTG TCCGCCTATT

1001 ATTTCGACCC GCGCCTGCTT TGGGACAAAC GCGCTTCAGA CGGCATTGCT

1051 TTCAATGAAA CGGAAAAACA TGACTGA
```

This corresponds to the amino acid sequence <SEQ ID 628; ORF 153>:

```
m153.pep

1 MAFAYGMTYI EVGIPGAASV LSLPEMMRLM VFQDYGFLAE VMFVLTFGAP

51 VLFLLLCLYV YAALIRKQAY PALRLATRVM VRLRQAMMVD VFFVSTLVAY

101 IKLSSVAEVR FGPAFYLMFA LSVMLIRTSV SVPQHWVYFQ IGRLTGDNAV

151 QTASEGKTCC SRCLYFRDSA ESPCGVCGAE LYRRRPKSLS ISSAFLTAAV

201 ILYFPANILP IMISSNPAAT EVNTILNGIA YMWDEGDRLI AAVIFSASIL

251 VPVLKIAAMS VLIASARFAL PTGAKKLSHL YRITEAVGRW SMIDIFVIII

301 LMCSFHTYAA RVIPGSAAVY FCLVVILTML SAYYFDPRLL WDKRASDGIA

351 FNETEKHD* m153/g153 96.1% identity in 358 aa overlap 10         20         30         40         50         60
m153.pep MAFAYGMTYIEVGIPGAASVLSLPEMMRLMVFQDYGFLAEVMFVLTFGAPVLFLLLCLYV
         |:|||:||||||||||| ||||||||||||||||||||||||||||||||||||||||||
g153     MGFAYSMTYIEVGIPEAASVLSLPEMMRLMVFQDYGFLAEVMFVLTFGAPVLFLLLCLYV
                 10         20         30         40         50         60
                 70         80         90        100        110        120
m153.pep YAALIRKQAYPALRLATRVMVRLRQAMMVDVFFVSTLVAYIKLSSVAEVRFGPAFYLMFA
         ||||||||||||||||||||||||||||||||||||||||||||:|||||||||||||||
g153     YAALIRKQAYPALRLATRVMVRLRQAMMVDVFFVSTLVAYIKLSSVAKVRFGPAFYLMFA
                 70         80         90        100        110        120
                130        140        150        160        170        180
m153.pep LSVMLIRTSVSVPQHWVYFQIGRLTGDNAVQTASEGKTCCSRCLYFRDSAESPCGVCGAE
         ||||||||||||||||||||||||||:|||||||||||||||||||||||||||||||||
g153     LSVMLIRTSVSVPQHWVYFQIGRLTGNNAVQTASEGKTCCSRCLYFRDSAESPCGVCGAE
                130        140        150        160        170        180
                190        200        210        220        230        240
m153.pep LYRRRPKSLSISSAFLTAAVILYFPANILPIMISSNPAATEVNTILNGIAYMWDEGDRLI
         ||  ||||||||||||||||:|||||||||||||||||||||::|||:||||||||||||
g153     LYGGRPKSLSISSAFLTAAVVLYFPANILPIMISSNPAATEANTIFSGIAYMWDEGDRLI
                190        200        210        220        230        240
                250        260        270        280        290        300
m153.pep AAVIFSASILVPVLKIAAMSVLIASARFALPTGAKKLSHLYRITEAVGRWSMIDIFVIII
         ||||||||||||||||||||||||:||||||:||||||||||||||||||||||||||||
g153     AAVIFSASILVPVLKIAAMSVLIAAARFALPAGAKKLSHLYRITEAVGRWSMIDIFVIII
                250        260        270        280        290        300
                310        320        330        340        350       359
m153.pep LMCSFHTYAARVIPGSAAVYFCLVVILTMLSAYYFDPRLLWDKRASDGIAFNETEKHDX
         ||||||||||||||||||||||||||||||||||||||||||||||||||||||||:||
g153     LMCSFHTYAARVIPGSAAVYFCLVVILTMLSAYYFDPRLLWDKRASDGIAFNETEKYDX
                310        320        330        340        350
```

The following partial DNA sequence was identified in *N. meningitidis* <SEQ ID 629>:

```
a153.seq
    1 ATGGCGTTTG CTTACGGTAT GACGTATATC GAGGTCGGGA TACCGGGTGC

51 GGCATCCGTC CTTTCGCTGC CGAGATGAT GCGCCTGATG GTGTTTCAGG

101 ATTATGGTTT TTTGGCCGAA GTGATGTTTG TGCTGACCTT CGGCGCGCCG
```

-continued

```
 151 GTTCTGTTTC TGCTGCTGTG CCTGTATGTC TATGCCGCGC TGATACGGAA

201 ACAGGCGTAT CCTGCGCTGC GTTTGGCAAC GCGTGTGATG GTGCGCTTGA

251 GACAGGCGAT GATGGTGGAT GTGTTTTTTG TTTCCACTTT GGTGGCGTAT

301 ATCAAGCTCT CGTCTGTGGC AGAGGTTCGC TTCGGATCGG CGTTTTATCT

351 GATGTTCGCG CTGTCGGTTA TGCTGATTCG GACTTCGGTA TCGGTTCCCC

401 AGCATTGGGT GTATTTTCAA ATCGGGCGGC TGACGGGGGA TAATGCGGTT

451 CAGACGGCAT CGGAAGGTAA AACCTGTTGC AGCCGCTGCC TGTATTTCCG

501 CGACAGTGCC GAATCCCCCT GCGGCGTGTG CGGTGCGGAA CTGTACCGCC

551 GACGGCCGAA AAGTCTGAGT ATTTCGTCGG CGTTTCTGAC GGCGGCGGTT

601 ATTTTGTATT TCCCTGCCAA TATCCTGCCG ATTATGATTT CGTCCAATCC

651 TGCCGCCACG GAGGTCAATA CCATCCTTAA CGGCATCGCT TATATGTGGG

701 ACGAGGGCGA CAGGCTGATT GCGGCGGTTA TTTTCAGCGC GAGTATTTTG

751 GTGCCGGTAC TGAAGATTGC GGCAATGTCG GTTTTGATTG CGTCCGCCCG

801 CTTCGCTTTG CCAACGGGTG CAAAGAAATT GTCGCACCTC TACCGCATCA

851 CCGAAGCGGT CGGCCGCTGG TCGATGATTG ATATTTTTGT GATTATTATT

901 TTGATGTGTT CGTTCCACAC TTATGCCGCG CGCGTCATTC CGGGCAGTGC

951 GGCAGTCTAT TTCTGCCTGG TCGTGATTCT GACGATGCTG TCCGCCTATT

1001 ATTTCGACCC GCGCCTGCTT TGGGACAAAC GCGCTTCAGA CGGCATTGCT

1051 TTCAATGAAA CGGAAAAACA TGACTGA
```

This corresponds to the amino acid sequence <SEQ ID 630; ORF 153.a>:

```
a153.pep
    1 MAFAYGMTYI EVGIPGAASV LSLPEMMRLM VFQDYGFLAE VMFVLTFGAP

51 VLFLLLCLYV YAALIRKQAY PALRLATRVM VRLRQAMMVD VFFVSTLVAY

101 IKLSSVAEVR FGSAFYLMFA LSVMLIRTSV SVPQHWVYFQ IGRLTGDNAV

151 QTASEGKTCC SRCLYFRDSA ESPCGVCGAE LYRRRPKSLS ISSAFLTAAV

201 ILYFPANILP IMISSNPAAT EVNTILNGIA YMWDEGDRLI AAVIFSASIL

251 VPVLKIAAMS VLIASARFAL PTGAKKLSHL YRITEAVGRW SMIDIFVIII

301 LMCSFHTYAA RVIPGSAAVY FCLVVILTML SAYYFDPRLL WDKRASDGIA

351 FNETEKHD*
``` m153/a153 99.7% identity in 358 aa overlap

```
                 10         20         30         40         50         60
m153.pep MAFAYGMTYIEVGIPGAASVLSLPEMMRLMVFQDYGFLAEVMFVLTFGAPVLFLLLCLYV
         ||||||||||||||||||||||||||||||||||||||||||||||||||||||||||||
a153     MAFAYGMTYIEVGIPGAASVLSLPEMMRLMVFQDYGFLAEVMFVLTFGAPVLFLLLCLYV
                 10         20         30         40         50         60

70         80         90        100        110        120
m153.pep YAALIRKQAYPALRLATRVMVRLRQAMMVDVFFVSTLVAYIKLSSVAEVRFGPAFYLMFA
         ||||||||||||||||||||||||||||||||||||||||||||||||||||| ||||||
a153     YAALIRKQAYPALRLATRVMVRLRQAMMVDVFFVSTLVAYIKLSSVAEVRFGSAFYLMFA
                 70         80         90        100        110        120

130        140        150        160        170        180
m153.pep LSVMLIRTSVSVPQHWVYFQIGRLTGDNAVQTASEGKTCCSRCLYFRDSAESPCGVCGAE
         ||||||||||||||||||||||||||||||||||||||||||||||||||||||||||||
a153     LSVMLIRTSVSVPQHWVYFQIGRLTGDNAVQTASEGKTCCSRCLYFRDSAESPCGVCGAE
                130        140        150        160        170        180
```

```
                  190        200        210        220        230        240
m153.pep  LYRRRPKSLSISSAFLTAAVILYFPANILPIMISSNPAATEVNTILNGIAYMWDEGDRLI
          ||||||||||||||||||||||||||||||||||||||||||||||||||||||||||||
a153      LYRRRPKSLSISSAFLTAAVILYFPANILPIMISSNPAATEVNTILNGIAYMWDEGDRLI
                  190        200        210        220        230        240
                  250        260        270        280        290        300
m153.pep  AAVIFSASILVPVLKIAAMSVLIASARFALPTGAKKLSHLYRITEAVGRWSMIDIFVIII
          ||||||||||||||||||||||||||||||||||||||||||||||||||||||||||||
a153      AAVIFSASILVPVLKIAAMSVLIASARFALPTGAKKLSHLYRITEAVGRWSMIDIFVIII
                  250        260        270        280        290        300
                  310        320        330        340        350        359
m153.pep  LMCSFHTYAARVIPGSAAVYFCLVVILTMLSAYYFDPRLLWDKRASDGIAFNETEKHDX
          |||||||||||||||||||||||||||||||||||||||||||||||||||||||||
a153      LMCSFHTYAARVIPGSAAVYFCLVVILTMLSAYYFDPRLLWDKRASDGIAFNETEKHDX
                  310        320        330        340        350
```

15

The following partial DNA sequence was identified in *N. gonorrhoeae* <SEQ ID 631>:

```
g154.seq
    1 ATGACTGACA ACAGCCCTCC TCCAAACGGA CACGCTCAAG CACGCGTCCG

51 CAAAAACAAC accttcctCT CCGCCGTCTG GCTGGTCCCG CTGATCGCGC

101 TGATTGCCGG CGGCTGGCTT TGGGTTAAGG AAATCCGCAA CAGGGGGCCT

151 GTGGTTACGC TCTTGATGGA CAGCGCGGAA GGCATCGAAG TCAACAATAC

201 GGTCATTAAG GTATTGAGCA TCGATGTCGG ACGCGTTACC CGAATCAAAC

251 TGCGCGACGA CCAAAAAGGC GTGGAAGTTA CTGCCCAACT CAATGCGGAC

301 GTATCCGGCC TCATCCGCAG CGATACCCAG TTTTGGGTGG TCAAGCCGCG

351 TATCGACCAA AGCGGCgtAA CCGGTTTGGG TACGCTGCTT TCGGGTTCGT

401 ACATCGCTTT TACACCCGGC AAAAGCGGCG AGGCAAAAGA CGTGTTCCAA

451 GTGCAGGACA TTCCGCCCGT TACCGCCATC GGGCAAAgcg GGCTGCGCTT

501 GAATTTGATT GGTAAAAACG AccgCATCCT CAACGTcaaC AGCCCTGTTT

551 TGTATGAAAA CTTTATGGTC GGGCAAATCG AAAGCGCGCA TTTCGAcccG

601 TCCGACCAAA GCGTGCATTA CACCATCTTC ATCCAAAGCC CCAACGACAA

651 ACTGATTCAT TCCGCCAGCC GTTTTTGGCT GGAAAGCGGC ATCAATATCG

701 AAACCACAGG CAGCGGCATC AAACTCAATT CCGCCCCTCT GCCTGCCCTG

751 CTGTCAGGCG CGATTTCATT TGATTCGCCG AAAACCAAAA ACAGTAAAAA

801 CGTCAAAAGC GAGGACAGCT TCACGCTTTA CGACAGCCGC AGCGAAATCG

851 CCAACCTGCC TGACGACCGC TCGCTGTACT ACACCGCGTT TTTCAAACAA

901 TCCGTGCGCG GACTGACCGT cggTTCGCCT GTCgaATACA AAGGGCtgaA

951 TGTCggCATG GTTTCCGATG TCCCTTATTT TGACCGCAAt gacagCCTGC

1001 ACCtgtTTGA aaacggctgg aTTcccGtac gCATCCGCAT cgagccTTCC

1051 CGTTTGGAAA TCAATGCCGA CGAGCAAAGC AAAGAGCATT GGAAACAACA

1101 ATTCCAGACG GCCTTAAACA AAGGCCTGAC CGCCACCATC TCCAGCAACA

1151 ACCTGCTGAC CGGCGGCAAA ATGATTGAGT TGAACGATCA GCCTTCCGCC

1201 TCGCCCAAGC TGCGACCGCA TACCGTTTAT GCAGGCGATA CCGTCATCGC

1251 CACACGGGGC GGCGGTTTGG ATGACTTGCA GGTCAAATTG GCGGATTTGC

1301 TGGACAaatT CAACAATCTG CCATTggata aAACCGTTGC CGAATTGAAC

1351 GGCTCGCTCG CCGAACTCAA GTCCGCACTC AAATCCGCCA ATGCCGCCCT

1401 AAGCTCCATT GacaAACTGG TCGgcaaTCC GCAGACGCAA AACATCCCGA
```

-continued

```
1451  ACGAACTGAA CCAAACTCTG AAAGAGTTGC GCATAACCCT GCAAGGCGTA

1501  TCGcctCAAT CGCCTATCTa cgGAgacgta caAAATAcgc tgCaAAGTTT

1551  GGACAAAACC TTAAAagacg TtcaACCCGT CATTAACACT TTGAaAGAAa 1601  aacCCaaCgc actGATTTtc aacaACAGCA GCAAAGAccc tATCCCGAAA

1651  GGAAGCCGAT AA
```

This corresponds to the amino acid sequence <SEQ IS 632; ORF 154.ng>:

```
g154.pep
    1  MTDNSPPPNG HAQARVRKNN TFLSAVWLVP LIALIAGGWL WVKEIRNRGP

51  VVTLLMDSAE GIEVNNTVIK VLSIDVGRVT RIKLRDDQKG VEVTAQLNAD

101  VSGLIRSDTQ FWVVKPRIDQ SGVTGLGTLL SGSYIAFTPG KSGEAKDVFQ

151  VQDIPPVTAI GQSGLRLNLI GKNDRILNVN SPVLYENFMV GQIESAHFDP

201  SDQSVHYTIF IQSPNDKLIH SASRFWLESG INIETTGSGI KLNSAPLPAL

251  LSGAISFDSP KTKNSKNVKS EDSFTLYDSR SEIANLPDDR SLYYTAFFKQ

301  SVRGLTVGSP VEYKGLNVGM VSDVPYFDRN DSLHLFENGW IPVRIRIEPS

351  RLEINADEQS KEHWKQQFQT ALNKGLTATI SSNNLLTGGK MIELNDQPSA

401  SPKLRPHTVY AGDTVIATRG GGLDDLQVKL ADLLDKFNNL PLDKTVAELN

451  GSLAELKSAL KSANAALSSI DKLVGNPQTQ NIPNELNQTL KELRITLQGV

501  SPQSPIYGDV QNTLQSLDKT LKDVQPVINT LKEKPNALIF NNSSKDPIPK

551  GSR*
```

The following partial DNA sequence was identified in *N. meningitidis* <SEQ ID 633>:

```
m154.seq
    1  ATGACTGACA ACAGCCCTCC TCCAAACGGA CACGCCCAAG CACGCGTCCG

51  CAAAAACAAC ACCTTCCTCT CTGCCGTCTG GCTGGTTCCG CTGATCGCGC

101  TGATTGCCGG CGGCTGGCTT TGGGTTAAGG AAATCCGCAA CAGGGGGCCT

151  GTGGTTACGC TCTTGATGGA CAGCGCGGAA GGCATTGAGG TCAACAATAC

201  GGTCATCAAA GTATTGAGCA TCGATGTCGG ACGCGTTACC CGAATCAAAC

251  TGCGCGACGA CCAAAAGGC GTGGAAGTAA CCGCCCAACT CAATGCGGAC

301  GTATCCGGCC TCATCCGCAG CGATACCCAG TTTTGGGTGG TCAAGCCGCG

351  TATCGACCAA AGCGGCGTAA CCGGTTTGGG TACGCTGCTT TCGGGTTCGT

401  ACATCGCCTT TACACCCGGC AAAAGCGACG AGGCAAAAGA CGTGTTCCAA

451  GTGCAGGACA TTCCGCCCGT TACCGCCATC GGGCAAAGCG GGCTGCGCTT

501  GAATTTGATT GGTAAAAACG ACCGCATCCT CAACGTCAAC AGCCCTGTTT

551  TGTATGAAAA TTTTATGGTC GGGCAAGTCG AAAGCGCGCA TTTCGACCCG

601  TCCGACCAAA GCGTGCATTA CACCATCTTC ATCCAAAGCC CCAACGACAA

651  ACTGATTCAT TCCGCCAGCC GTTTTTGGCT GGAAAGCGGC ATCAATATCG

701  AAACCACAGG CAGCGGCATC AAACTCAATT CCGCCCCTCT GCCTGCCCTG

751  CTGTCGGGCG CGATTTCATT TGATTCGCCG AAAACCAAAA ACAGTAAAAA

801  CGTCAAAAGC GAAGACAGCT TCACGCTTTA CGACAGCCGC AGCGAAGTCG
```

-continued

```
 851 CCAACCTGCC TGACGACCGC TCGCTGTACT ACACCGCGTT TTTCAAACAA
 901 TCCGTGCGCG GCCTGACCGT CGGTTCGCCC GTCGAGTACA AAGGGCTGAA
 951 TGTCGGCGTG GTTTCCGACG TTCCTTATTT CGACCGCAAC GACAGCCTGC
1001 ACCTGTTTGA AAACGGCTGG ATACCCGTAC GCATCCGCAT TGAACCTTCC
1051 CGTTTGGAAA TCAATGCCGA CGAACAAAGC AAAGAACATT GGAAACAACA
1101 ATTTCAGACG GCCTTAAACA AAGGCCTGAC CGCCACCATC TCCAGCAACA
1151 ACCTGCTGAC CGGAAGCAAA ATGATTGAGT TGAACGATCA GCCTTCCGCA
1201 TCACCTAAGC TGCGACCGCA TACCGTTTAT GCAGGCGATA CCGTTATCGC
1251 GACCCAGGGC GGCGGTTTGG ACGATTTGCA GGTCAAATTG GCGGATTTGC
1301 TGGACAAGTT CGACAAACTG CCTTTAGATA AGACGGTTGC CGAATTGAAC
1351 GGTTCGCTTG CCGAGCTCAA ATCCACACTC AAATCTGCCA ATGCCGCCCT
1401 AAGCTCCATC GACAAACTGG TCGGCAAACC GCAGACACAA AACATTCCGA
1451 ACGAACTGAA CCAAACCCTG AAAGAGTTGC GCACAACCCT GCAAGGCGTA
1501 TCGCCGCAAT CGCCTATCTA CGGCGACGTA CAAAATACGC TGCAAAGTTT
1551 GGACAAAACT TTAAAAGACG TTCAACCCGT GATTAATACT TTGAAAGAAA
1601 AACCCAACGC GCTGATTTTC AACAGCAGCA GCAAAGACCC TATCCCGAAA
1651 GGAAGCCGAT AA
```

This corresponds to the amino acid sequence <SEQ ID 634 ORF 154.a>:

```
m154.pep

1 MTDNSPPPNG HAQARVRKNN TFLSAVWLVP LIALIAGGWL WVKEIRNRGP
 51 VVTLLMDSAE GIEVNNTVIK VLSIDVGRVT RIKLRDDQKG VEVTAQLNAD
101 VSGLIRSDTQ FWVVKPRIDQ SGVTGLGTLL SGSYIAFTPG KSDEAKDVFQ
151 VQDIPPVTAI GQSGLRLNLI GKNDRILNVN SPVLYENFMV GQVESAHFDP
201 SDQSVHYTIF IQSPNDKLIH SASRFWLESG INIETTGSGI KLNSAPLPAL
251 LSGAISFDSP KTKNSKNVKS EDSFTLYDSR SEVANLPDDR SLYYTAFFKQ
301 SVRGLTVGSP VEYKGLNVGV VSDVPYFDRN DSLHLFENGW IPVRIRIEPS
351 RLEINADEQS KEHWKQQFQT ALNKGLTATI SSNNLLTGSK MIELNDQPSA
401 SPKLRPHTVY AGDTVIATQG GGLDDLQVKL ADLLDKFDKL PLDKTVAELN
451 GSLAELKSTL KSANAALSSI DKLVGKPQTQ NIPNELNQTL KELRTTLQGV
501 SPQSPIYGDV QNTLQSLDKT LKDVQPVINT LKEKPNALIF NSSSKDPIPK
551 GSR* m154/g154 97.8% identity in 553 aa overlap 10         20         30         40         50         60
m154.pep MTDNSPPPNGHAQARVRKNNTFLSAVWLVPLIALIAGGWLWVKEIRNRGPVVTLLMDSAE
         ||||||||||||||||||||||||||||||||||||||||||||||||||||||||||||
g154     MTDNSPPPNGHAQARVRKNNTFLSAVWLVPLIALIAGGWLWVKEIRNRGPVVTLLMDSAE
                 10         20         30         40         50         60

70         80         90        100        110        120
m154.pep GIEVNNTVIKVLSIDVGRVTRIKLRDDQKGVEVTAQLNADVSGLIRSDTQFWVVKPRIDQ
         ||||||||||||||||||||||||||||||||||||||||||||||||||||||||||||
g154     GIEVNNTVIKVLSIDVGRVTRIKLRDDQKGVEVTAQLNADVSGLIRSDTQFWVVKPRIDQ
                 70         80         90        100        110        120
```

```
              130        140        150        160        170        180
m154.pep  SGVTGLGTLLSGSYIAFTPGKSDEAKDVFQVQDIPPVTAIGQSGLRLNLIGKNDRILNVN
          |||||||||||||||||||||| |||||||||||||||||||||||||||||||||||
g154      SGVTGLGTLLSGSYIAFTPGKSGEAKDVFQVQDIPPVTAIGQSGLRLNLIGKNDRILNVN
              130        140        150        160        170        180

190        200        210        220        230        240
m154.pep  SPVLYENFMVGQVESAHFDPSDQSVHYTIFIQSPNDKLIHSASRFWLESGINIETTGSGI
          |||||||||||| :||||||||||||||||||||||||||||||||||||||||||||||
g154      SPVLYENFMVGQIESAHFDPSDQSVHYTIFIQSPNDKLIHSASRFWLESGINIETTGSGI
              190        200        210        220        230        240

250        260        270        280        290        300
m154.pep  KLNSAPLPALLSGAISFDSPKTKNSKNVKSEDSFTLYDSRSEVANLPDDRSLYYTAFFKQ
          |||||||||||||||||||||||||||||||||||||||||:||||||||||||||||||
g154      KLNSAPLPALLSGAISFDSPKTKNSKNVKSEDSFTLYDSRSEIANLPDDRSLYYTAFFKQ
              250        260        270        280        290        300

310        320        330        340        350        360
m154.pep  SVRGLTVGSPVEYKGLNVGVVSDVPYFDRNDSLHLFENGWIPVRIRIEPSRLEINADEQS
          |||||||||||||||||||||:||||||||||||||||||||||||||||||||||||||
g154      SVRGLTVGSPVEYKGLNVGMVSDVPYFDRNDSLHLFENGWIPVRIRIEPSRLEINADEQS
              310        320        330        340        350        360

370        380        390        400        410        420
m154.pep  KEHWKQQFQTALNKGLTATISSNNLLTGSKMIELNDQPSASPKLRPHTVYAGDTVIATQG
          ||||||||||||||||||||||||||||| ||||||||||||||||||||||||||||:|
g154      KEHWKQQFQTALNKGLTATISSNNLLTGGKMIELNDQPSASPKLRPHTVYAGDTVIATRG
              370        380        390        400        410        420

430        440        450        460        470        480
m154.pep  GGLDDLQVKLADLLDKFDKLPLDKTVAELNGSLAELKSTLKSANAALSSIDKLVGKPQTQ
          ||||||||||||||||| ::|||||||||||||||||:||||||||||||||||| :|||
g154      GGLDDLQVKLADLLDKFNNLPLDKTVAELNGSLAELKSALKSANAALSSIDKLVGNPQTQ
              430        440        450        460        470        480

490        500        510        520        530        540
m154.pep  NIPNELNQTLKELRTTLQGVSPQSPIYGDVQNTLQSLDKTLKDVQPVINTLKEKPNALIF
          ||||||||||||||| ||||||||||||||||||||||||||||||||||||||||||||
g154      NIPNELNQTLKELRITLQGVSPQSPIYGDVQNTLQSLDKTLKDVQPVINTLKEKPNALIF
              490        500        510        520        530        540

550
m154.pep  NSSSKDPIPKGSRX
          |:||||||||||||
g154      NNSSKDPIPKGSRX
              550
```

The following partial DNA sequence was identified in *N. meningitidis* <SEQ ID 635>:

```
a154.seq
      1 ATGACTGACA ACAGCCCTCC TCCAAACGGA CACGCCCAAG CACGCGTCCG

51 CAAAAACAAC ACCTTCCTCT CTGCCGTCTG GCTGGTTCCG CTGATCGCGC

101 TGATTGCCGG CGGCTGGCTT TGGGTTAAGG AAATCCGCAA CAGGGGGCCT

151 GTGGTTACGC TCTTGATGGA CAGCGCGGAA GGCATTGAGG TCAACAATAC

201 GGTCATCAAA GTATTGAGCA TCGATGTCGG ACGCGTTACC CGAATCAAAC

251 TGCGCGACGA CCAAAAAGGC GTGGAAGTAA CCGCCCAACT CAATGCGGAC

301 GTATCCGGCC TCATCCGCAG CGATACCCAG TTTTGGGTGG TCAAGCCGCG

351 TATCGACCAA AGCGGCGTAA CCGGTTTGGG TACGCTGCTT TCGGGTTCGT

401 ACATCGCCTT TACACCCGGC AAAAGCGACG AGGCAAAAGA CGTGTTCCAA

451 GTGCAGGACA TTCCGCCCGT TACCGCCATC GGGCAAAGCG GGCTGCGCTT

501 GAATTTGATT GGTAAAAACG ACCGCATCCT CAACGTCAAC AGCCCTGTTT

551 TGTATGAAAA CTTTATGGTC GGGCAAGTCG AAAGCGCGCA TTTCGACCCG

601 TCCGACCAAA GCGTGCATTA CACCATCTTC ATCCAAAGCC CCAACGACAA

651 ACTGATTCAT TCCGCCAGCC GTTTCTGGCT GGAAAGCGGC ATCAATATCG

701 AAACCACAGG CAGCGGCATC AAACTCAATT CCGCCCCTCT GCCTGCCCTG

751 CTGTCGGGCG CGATTTCATT TGATTCGCCG AAAACCAAAA ACAGTAAAAA
```

```
-continued
 801 CGTCAAAAGC GAAGACAGCT TCACGCTTTA CGACAGCCGC AGCGAAGTCG

851 CCAACCTGCC TGATGACCGT TCGCTGTACT ACACCGCGTT TTTCAAACAA

901 TCCGTGCGCG GACTGACCGT CGGTTCGCCT GTCGAGTACA AAGGGCTGAA

951 TGTCGGCGTG GTTTCCGATG TTCCTTATTT CGACCGCAAC GACAGCCTGC

1001 ACCTGTTTGA AAACGGCTGG ATTCCCGTAC GCATCCGTAT TGAGCCTTCC

1051 CGTTTGGAAA TCAATGCCGA CGAACAAAGC AAAGAACATT GGAAACAACA

1101 ATTTCAGACG GCCTTAAACA AAGGCCTGAC CGCCACCATC TCCAGCAACA

1151 ACCTGCTGAC CGGCAGCAAA ATGATTGAGT TGAACGATCA GCCTTCCGCC

1201 TCGCCCAAGC TGCGACCGCA TACCGTTTAT GCAGGCGATA CCGTTATCGC

1251 GACCCAGGGC GGCGGTTTGG ACGATTTGCA GGTCAAATTG GCGGATTTGC

1301 TGGACAAGTT CGACAAACTG CCTTTAGATA AGACGGTTGC CGAATTGAAC

1351 GGTTCGCTTG CCGAGCTCAA ATCCACACTC AAATCTGCCA ATGCCGCCCT

1401 AAGCTCCATC GACAAACTGG TCGGCAAACC GCAGACACAA AACATTCCGA

1451 ACGAACTGAA CCAAACCCTG AAAGAGTTGC GCACAACCCT GCAAGGCGTA

1501 TCGCCTCAAT CGCCTATCTA CGGCGACGTA CAAAATACGC TGCAAAGTTT

1551 GGACAAAACC TTAAAAGACG TTCAACCCGT CATTAACACT TTGAAAGAAA

1601 AACCCAACGC GCTGATTTTC AACAGCAGCA GCAAAGACCC TATCCCGAAA

1651 GGAAGCCGAT AA
```

This corresponds to the amino acid sequence <SEQ ID 636; ORF 154.a>:

```
a154.pep
   1 MTDNSPPPNG HAQARVRKNN TFLSAVWLVP LIALIAGGWL WVKEIRNRGP

51 VVTLLMDSAE GIEVNNTVIK VLSIDVGRVT RIKLRDDQKG VEVTAQLNAD

101 VSGLIRSDTQ FWVVKPRIDQ SGVTGLGTLL SGSYIAFTPG KSDEAKDVFQ

151 VQDIPPVTAI GQSGLRLNLI GKNDRILNVN SPVLYENFMV GQVESAHFDP

201 SDQSVHYTIF IQSPNDKLIH SASRFWLESG INIETTGSGI KLNSAPLPAL

251 LSGAISFDSP KTKNSKNVKS EDSFTLYDSR SEVANLPDDR SLYYTAFFKQ

301 SVRGLTVGSP VEYKGLNVGV VSDVPYFDRN DSLHLFENGW IPVRIRIEPS

351 RLEINADEQS KEHWKQQFQT ALNKGLTATI SSNNLLTGSK MIELNDQPSA

401 SPKLRPHTVY AGDTVIATQG GGLDDLQVKL ADLLDKFDKL PLDKTVAELN

451 GSLAELKSTL KSANAALSSI DKLVGKPQTQ NIPNELNQTL KELRTTLQGV

501 SPQSPIYGDV QNTLQSLDKT LKDVQPVINT LKEKPNALIF NSSSKDPIPK

551 GSR*
``` m154/a154 100.0% identity in 553 aa overlap

```
                   10         20         30         40         50         60
    m154.pep MTDNSPPPNGHAQARVRKNNTFLSAVWLVPLIALIAGGWLWVKEIRNRGPVVTLLMDSAE
            ||||||||||||||||||||||||||||||||||||||||||||||||||||||||||||
    a154    MTDNSPPPNGHAQARVRKNNTFLSAVWLVPLIALIAGGWLWVKEIRNRGPVVTLLMDSAE
                   10         20         30         40         50         60

70         80         90        100        110        120
    m154.pep GIEVNNTVIKVLSIDVGRVTRIKLRDDQKGVEVTAQLNADVSGLIRSDTQFWVVKPRIDQ
            ||||||||||||||||||||||||||||||||||||||||||||||||||||||||||||
    a154    GIEVNNTVIKVLSIDVGRVTRIKLRDDQKGVEVTAQLNADVSGLIRSDTQFWVVKPRIDQ
                   70         80         90        100        110        120
```

```
                  130        140        150        160        170        180
m154.pep  SGVTGLGTLLSGSYIAFTPGKSDEAKDVFQVQDIPPVTAIGQSGLRLNLIGKNDRILNVN
          ||||||||||||||||||||||||||||||||||||||||||||||||||||||||||
a154      SGVTGLGTLLSGSYIAFTPGKSDEAKDVFQVQDIPPVTAIGQSGLRLNLIGKNDRILNVN
                  130        140        150        160        170        180

190        200        210        220        230        240
m154.pep  SPVLYENFMVGQVESAHFDPSDQSVHYTIFIQSPNDKLIHSASRFWLESGINIETTGSGI
          ||||||||||||||||||||||||||||||||||||||||||||||||||||||||||
a154      SPVLYENFMVGQVESAHFDPSDQSVHYTIFIQSPNDKLIHSASRFWLESGINIETTGSGI
                  190        200        210        220        230        240

250        260        270        280        290        300
m154.pep  KLNSAPLPALLSGAISFDSPKTKNSKNVKSEDSFTLYDSRSEVANLPDDRSLYYTAFFKQ
          ||||||||||||||||||||||||||||||||||||||||||||||||||||||||||
a154      KLNSAPLPALLSGAISFDSPKTKNSKNVKSEDSFTLYDSRSEVANLPDDRSLYYTAFFKQ
                  250        260        270        280        290        300

310        320        330        340        350        360
m154.pep  SVRGLTVGSPVEYKGLNVGVVSDVPYFDRNDSLHLFENGWIPVRIRIEPSRLEINADEQS
          ||||||||||||||||||||||||||||||||||||||||||||||||||||||||||
a154      SVRGLTVGSPVEYKGLNVGVVSDVPYFDRNDSLHLFENGWIPVRIRIEPSRLEINADEQS
                  310        320        330        340        350        360

370        380        390        400        410        420
m154.pep  KEHWKQQFQTALNKGLTATISSNNLLTGSKMIELNDQPSASPKLRPHTVYAGDTVIATQG
          ||||||||||||||||||||||||||||||||||||||||||||||||||||||||||
a154      KEHWKQQFQTALNKGLTATISSNNLLTGSKMIELNDQPSASPKLRPHTVYAGDTVIATQG
                  370        380        390        400        410        420

430        440        450        460        470        480
m154.pep  GGLDDLQVKLADLLDKFDKLPLDKTVAELNGSLAELKSTLKSANAALSSIDKLVGKPQTQ
          ||||||||||||||||||||||||||||||||||||||||||||||||||||||||||
a154      GGLDDLQVKLADLLDKFDKLPLDKTVAELNGSLAELKSTLKSANAALSSIDKLVGKPQTQ
                  430        440        450        460        470        480

490        500        510        520        530        540
m154.pep  NIPNELNQTLKELRTTLQGVSPQSPIYGDVQNTLQSLDKTLKDVQPVINTLKEKPNALIF
          ||||||||||||||||||||||||||||||||||||||||||||||||||||||||||
a154      NIPNELNQTLKELRTTLQGVSPQSPIYGDVQNTLQSLDKTLKDVQPVINTLKEKPNALIF
                  490        500        510        520        530        540

550
m154.pep  NSSSKDPIPKGSRX
          ||||||||||||||
a154      NSSSKDPIPKGSRX
                  550
```

The following partial DNA sequence was identified in *N. gonorrhoeae* <SEQ ID 637>:

```
g155.seq
    1  atGAAaatcg GtatcCCACG CGAGTCAtta tcCGGCGAAA cccgcgtagc 51  ctgcAcgccc gCCACCGTTG CCctgctggg caAactAGGC TTTGAAACCG 101  TTGtcgaAAG CGGTGCAggt TTGGCGGCAA GTTTggaCGA TGCCGCTTAC

151  CAAACAGCAG GCGCAACCGT TGCCGACAAA GCGGCGGTTT GGGCCTGCCC

201  TTTAATTTAT AAGGTCAACG CGCCGTCCGA AGGCGAGCTG CCGCTGCTCA

251  AAGAAGGTCA AACCATCGTC AGCTTCCTGT GGCCGCGCCA AAACGAGGCT

301  TTGGTCGAGG CCTTGCGCGC CAAGAAAGTC AACGCGCTGG CGATGGACAT

351  GGTTCCCCGC ATTTCCCGCG CTCAGGCCTT GGACGCTTTG TCTTCAATGG

401  CAAACATCAG CGGCTACCGC GCCGTGATTG AAGCCGCCAA CGCCTTCGGC

451  CGTTTCTTCA CCGGTCAAAT CACTGCCGCC GGCAAAGTGC CGCCTGCGCA

501  GGTTTTGGTG ATTGGCGCCG GTGTGGCGGG TTTGGCGGCA ATCGGTACGG

551  CAAATTCGCT CGGCGCAGTG GTGCGCGCGT TCGATACCCG CTTGGAAGTG

601  GCGGAACAAA TCGAATCGAT GGGCGGTAAG TTcctGAAAC TCGACTTCCT

651  GCAAGAATCG GGCGGCAGCG GAGACGgctA CGCCAAAGTG ATGAGCGACG

701  AATTTATCGC CGCCGAAATG AAGCTCTTTG CCGAACAGGC GAAAGAAGTG

751  GACATCATCA TCACCACCGC CGCCATTCCG GGCAAACCCG CTCCCAAGCT
```

-continued

```
 801 GATTACCAAA GAAATGGTGG AAAGCATGAA ATCCGGATCC GTCATCGTCG
 851 ATTTGGCGGC GACGGGCGGC AACTGCGAAC TCACCCGACC GGGCGAATTG
 901 TCCGTAACCG GCAACGGCGT GAAAATCATC GGCTACACCG ACATGGCAAA
 951 CCGCCTTGCC GGACAGTCTT CCCAGCTTTA CGCCACCAAC TTGGTGAACC
1001 TGACCAAGCT GTTAAGCCCG AACAAAGAcg gcgaAATCAC GCTGGACTTC

1051 GAAGacgtGA TTATCCGCAA TATGACCGTT ACCCGcgacg gcgaaATCAC
1101 CTTCCCGCCT CCGccgaTTc aggtTTCcgc ccggccgCAG CAAAcgccgt
1151 ctgaAAAagc cgcGCCTGCC GCCAagcccg AgccGaaacc tgttCCcctg
1201 tggaAAAaac tcgCGCCCGC CGCcatcgCC GCCGTATTGG tgctgtgGgt
1251 cggCgcggtc gcacccgcag CATTCTTGAA CCACTTTATC GTCTTCGTCC
1301 TCGCCTGCGT CATCGGCTAC CATGTCGTTT GgaacgTCAG CCACTCGCTG
1351 CACACACCGC TGAtgtcggt aaccaaCgcc atctccGGCA tcatggtcgt
1401 cggCGCGCTG CTGCAAATCG GTCAGGGcaa cggcttcgtT TCgctGCTGT
1451 CGTTTGTTGC CATCCTGATT GCCGGCATCA ATATCTTCGG CGGCTTTGCG

1501 GTTACACGGC GTATGCTGAA TATGTTTAAG AAAGGGTAA
```

This corresponds to the amino acid sequence <SEQ ID 638; ORF 155.ng>:

```
g155.pep
  1 MKIGIPRESL SGETRVACTP ATVALLGKLG FETVVESGAG LAASLDDAAY
 51 QTAGATVADK AAVWACPLIY KVNAPSEGEL PLLKEGQTIV SFLWPRQNEA
101 LVEALRAKKV NALAMDMVPR ISRAQALDAL SSMANISGYR AVIEAANAFG

151 RFFTGQITAA GKVPPAQVLV IGAGVAGLAA IGTANSLGAV VRAFDTRLEV

201 AEQIESMGGK FLKLDFLQES GGSGDGYAKV MSDEFIAAEM KLFAEQAKEV

251 DIIITTAAIP GKPAPKLITK EMVESMKSGS VIVDLAATGG NCELTRPGEL

301 SVTGNGVKII GYTDMANRLA GQSSQLYATN LVNLTKLLSP NKDGEITLDF

351 EDVIIRNMTV TRDGEITFPP PPIQVSARPQ QTPSEKAAPA AKPEPKPVPL

401 WKKLAPAAIA AVLVLWVGAV APAAFLNHFI VFVLACVIGY HVVWNVSHSL

451 HTPLMSVTNA ISGIMVVGAL LQIGQGNGFV SLLSFVAILI AGINIFGGFA

501 VTRRMLNMFK KG*
```

The following partial DNA sequence was identified in *N. meningitidis* <SEQ ID 639>:

```
m155.seq
  1 ATGAAAATCG GTATCCCACG CGAGTCATTA TCCGGCGAAA CCCGCGTCGC
 51 CTGTACGCCC GCCACCGTCG CCCTGCTGGG CAAACTGGGC TTTGAAACCG
101 TTGTCGAAAG CGGTGCAGGT TTGGCGGCAA GTTTGGACGA TGCCGCTTAC
151 CAAACAGCAG GCGCAACCGT TGCCGACAAA GCGGCGGTTT GGGTCTGCCC
201 TTTGATTTAT AAGGTCAACG CGCCGTCCGA ACAGGAACTG CCGCTTTTGA
251 ACGAAGGTCA AACCATCGTC AGCTTCCTGT GGCCGCGCCA AAACGAGGCT
301 TTGGTCGAAG CCTTGCGCGC CAAGAAAGTG AACGCGCTGG CGATGGATAT
351 GGTGCCCCGC ATTTCGCGCG CGCAGGCTTT GGACGCTTTG TCTTCGATGG
```

```
-continued
 401 CAAACATCAG CGGCTACCGC GCCGTAATTG AAGCCGCCAA CGCCTTCGGC

451 CGTTTCTTCA CCGGTCAAAT TACCGCCGCC GGCAAAGTGC CGCCCGCGCA

501 GGTTTTGGTG ATTGGTGCAG GTGTGGCAGG TTTGGCGGCG ATCGGTACGG

551 CAAACTCGCT CGGCGCAGTG GTACGCGCGT TCGATACCCG CTTGGAAGTG

601 GCGGAACAAA TCGAATCGAT GGGCGGCAAG TTCCTGAAAC TCGACTTCCC

651 ACAAGAATCG GGCGGCAGCG GAGACGGCTA CGCCAAAGTG ATGAGCGACG

701 AATTTATCGC AGCCGAGATG AAGCTCTTTG CCGAGCAGGC GAAAGAAGTG

751 GACATCATCA TCACCACCGC CGCCATTCCG GGCAAACCCG CGCCCAAGCT

801 GATTACCAAA GAAATGGTGG AAAGCATGAA ATCCGGCTCC GTCATCGTCG

851 ATTTGGCGGC GGCGACGGGC GGCAACTGCG AACTCACCCG CCCGGGCGAA

901 TTGTCCGTAA CCGGCAACGG CGTGAAAATC ATCGGCTACA CCGACATGGC

951 AAACCGCCTT GCCGGACAGT CTTCCCAGCT TTACGCCACC AACTTGGTCA

1001 ACCTGACCAA GCTGTTAAGC CCGAACAAAG ACGGCGAAAT CACGTTGGAC

1051 TTCGAAGACG TGATTATCCG CAACATGACC GTTACCCACG ACGGCGAAAT

1101 CACCTTCCCG CCTCCGCCGA TTCAAGTTTC CGCCCAGCCG CAGCAAACGC

1151 CGTCTGAAAA AGCCGTGCCT GCCGCCAAGC CCGAGCCAAA ACCCGTTCCC

1201 CTGTGGAAAA AACTCGCGCC CGCCGTCATC GCCGCCGTCT TGGTACTGTG

1251 GGTCGGCGCG GTCGCACCCG CAGCATTCCT GAACCACTTT ATCGTGTTCG

1301 TTCTCGCCTG CGTCATCGGC TACTACGTCG TCTGGAACGT CAGCCACTCG

1351 CTGCACACAC CGCTGATGTC GGTAACCAAC GCCATCTCCG GCATCATCGT

1401 CGTCGGCGCG CTGCTGCAAA TCGGTCAGGG CAACGGCTTC GTTTCGCTGC

1451 TGTCGTTTGT TGCCATCCTG ATTGCCGGCA TCAACATCTT CGGCGGCTTT

1501 GCGGTAACAC GGCGTATGCT GAATATGTTT AAGAAAGGGT AA
```

This corresponds to the amino acid sequence <SEQ ID 640; ORF 155>:

```
m155.pep
   1 MKIGIPRESL SGETRVACTP ATVALLGKLG FETVVESGAG LAASLDDAAY

51 QTAGATVADK AAVWVCPLIY KVNAPSEQEL PLLNEGQTIV SFLWPRQNEA

101 LVEALRAKKV NALAMDMVPR ISRAQALDAL SSMANISGYR AVIEAANAFG

151 RFFTGQITAA GKVPPAQVLV IGAGVAGLAA IGTANSLGAV VRAFDTRLEV

201 AEQIESMGGK FLKLDFPQES GGSGDGYAKV MSDEFIAAEM KLFAEQAKEV

251 DIIITTAAIP GKPAPKLITK EMVESMKSGS VIVDLAAATG GNCELTRPGE

301 LSVTGNGVKI IGYTDMANRL AGQSSQLYAT NLVNLTKLLS PNKDGEITLD

351 FEDVIIRNMT VTHDGEITFP PPIQVSAQP QQTPSEKAVP AAKPEPKPVP

401 LWKKLAPAVI AAVLVLWVGA VAPAAFLNHF IVFVLACVIG YYVVWNVSHS

451 LHTPLMSVTN AISGIIVVGA LLQIGQGNGF VSLLSFVAIL IAGINIFGGF

501 AVTRRMLNMF KKG*
```

Computer analysis of this amino acid sequence gave the following results:
Homology with a Predicted ORF from *N. gonorrhoeae*
ORF 155 shows 97.9% identity over a 513 aa overlap with a predicted ORF (ORF 155.ng) from *N. gonorrhoeae*:

```
m155/g155 97.9% identity in 513 aa overlap 10         20         30         40         50         60
m155.pep MKIGIPRESLSGETRVACTPATVALLGKLGFETVVESGAGLAASLDDAAYQTAGATVADK
         ||||||||||||||||||||||||||||||||||||||||||||||||||||||||||||
g155     MKIGIPRESLSGETRVACTPATVALLGKLGFETVVESGAGLAASLDDAAYQTAGATVADK
                10         20         30         40         50         60

70         80         90        100        110        120
m155.pep AAVWVCPLIYKVNAPSEQELPLLNEGQTIVSFLWPRQNEALVEALRAKKVNALAMDMVPR
         ||||:||||||||||||| ||||:||||||||||||||||||||||||||||||||||||
g155     AAVWACPLIYKVNAPSEGELPLLKEGQTIVSFLWPRQNEALVEALRAKKVNALAMDMVPR
                70         80         90        100        110        120

130        140        150        160        170        180
m155.pep ISRAQALDALSSMANISGYRAVIEAANAFGRFFTGQITAAGKVPPAQVLVIGAGVAGLAA
         ||||||||||||||||||||||||||||||||||||||||||||||||||||||||||||
g155     ISRAQALDALSSMANISGYRAVIEAANAFGRFFTGQITAAGKVPPAQVLVIGAGVAGLAA
               130        140        150        160        170        180

190        200        210        220        230        240
m155.pep IGTANSLGAVVRAFDTRLEVAEQIESMGGKFLKLDFPQESGGSGDGYAKVMSDEFIAAEM
         |||||||||||||||||||||||||||||||||||| |||||||||||||||||||||||
g155     IGTANSLGAVVRAFDTRLEVAEQIESMGGKFLKLDFLQESGGSGDGYAKVMSDEFIAAEM
               190        200        210        220        230        240

250        260        270        280        290        300
m155.pep KLFAEQAKEVDIIITTAAIPGKPAPKLITKEMVESMKSGSVIVDLAAATGGNCELTRPGE
         |||||||||||||||||||||||||||||||||||||||||||||| |||||||||||||
g155     KLFAEQAKEVDIIITTAAIPGKPAPKLITKEMVESMKSGSVIVDLAA-TGGNCELTRPGE
               250        260        270        280        290

310        320        330        340        350        360
m155.pep LSVTGNGVKIIGYTDMANRLAGQSSQLYATNLVNLTKLLSPNKDGEITLDFEDVIIRNMT
         ||||||||||||||||||||||||||||||||||| ||||||||||||||||||||||||
g155     LSVTGNGVKIIGYTDMANRLAGQSSQLYATNLVLLTKLLSPNKDGEITLDFEDVIIRNMT
            300        310        320        330        340        350

370        380        390        400        410        420
m155.pep VTHDGEITFPPPPIQVSAQPQQTPSEKAVPAAKPEPKPVPLWKKLAPAVIAAVLVLWVGA
         ||:||||||||||||||||:||||||||| ||||||||||||||||||||:|||||||||
g155     VTRDGEITFPPPPIQVSARPQQTPSEKAAPAAKPEPKPVPLWKKLAPAAIAAVLVLWVGA
            360        370        380        390        400        410

430        440        450        460        470        480
m155.pep VAPAAFLNHFIVFVLACVIGYYVVWNVSHSLHTPLMSVTNAISGIIVVGALLQIGQGNGF
         |||||||||||||||||||||:||||||||||||||||||||||:|||||||||||||||
g155     VAPAAFLNHFIVFVLACVIGYHVVWNVSHSLHTPLMSVTNAISGIMVVGALLQIGQGNGF
            420        430        440        450        460        470

490        500        510
m155.pep VSLLSFVAILIAGINIFGGFAVTRRMLNMFKKGX
         ||||||||||||||||||||||||||||||||||
g155     VSLLSFVAILIAGINIFGGFAVTRRMLNMFKKGX
            480        490        500        510
```

The following partial DNA sequence was identified in *N. meningitidis* <SEQ ID 641>:

```
a155.seq
    1 ATGAAAATCG GTATCCCACG TGAGTCATTA TCCGGCGAAA CCCGCGTCGC

51 CTGTACGCCC GCCACCGTCG CCCTGCTGGG CAAACTGGGC TTTGAAACCG

101 TTGTCGAAAG CGGCGCAGGT TTGGCGGCAA GTTTGGACGA TGCCGCTTAC

151 CAAGCAGCAG GCGCAACCGT TGCCGACAAA GCAGCGGTTT GGGCATACCC

201 TTTAATTTAT AAGGTTAACG CGCCGTCCGA AGACGAGCTG CCGCTGCTCA

251 AAGAAGGACA GACCATCGTC AGCTTCCTGT GGCCGCGCCA AAACGAGGCT

301 TTGGTCGAAG CCTTGCGCGC CAAGAAAGTG AACGCGCTGG CAATGGACAT

351 GGTGCCCCGC ATTTCGCGCG CGCAGGCTTT GGACGNTTTG TCTTNGATGG

401 CAAACATCAG CGGCTACCGC GCCGTGATTG AAGCCGCCAA CGCCTTCGGC
```

```
-continued
 451 CGTTTNTTCA CCGGCCAAAT TACTGCCGCA GGCAAAGTGC CGCCCGCGCA

501 GGTTTTGGTG ATTGGTGCAG GTGTGGCAGG TTTGGCGGCG ATCGGTACGG

551 CAAACTCGCT CGGCGCAGTG GTACGCGTGT TCGATACCCG CCTG.AAGTG

601 GCGGAACAAT TAGAATCGAT GGGCGGCAAG TTCCTGAAAC TCGACTTCCC

651 GCAAGAATCG GGCGGCAGCG GCGACGGCTA CGCCAAAGTG ATGAGCGACG

701 AATTTATCGC CGCCGAGATG AAGCTTTTTG CCGAGCAGGC GAAAGAAGTG

751 GACATCATCA TCACCACCGC CGCCATTCCG GGCAAACCCG CGCCCAAGCN

801 NNTNANCAAA GAAATGGTCG AAAGCATGAA ACCCGGCTCC GTCATCGTCG

851 ATTTGGCGGC GGCGACGGGC GGCAACTGCG AACTCACCAA ACAGGGCGAA

901 TTGTTCGTAA CCGGCAACGG CGTGAAAATC ATCGGCTACA CCGACATGGC

951 AAACCGCCTT GCCGGACAGT CTTCGCAGCT TTACGCCACC AACTTGGTCA

1001 ACCTGACCAA GCTGTTAAGC CCGAACAAAG ACGGCGAAAT CACGCTGGAC

1051 TTCGAAGACG TGATTATCCG CAACATGACC GTTACCCGCG ACGGCGAAAT

1101 CACCTTCCCG CCTCCGCCGA TTCAAGTTTC CGCCCAACCG CAGCAAACGC

1151 CGTCTGAAAA AGCCGCGCCT GCCGCCAAGC CGAACCGAA ACCCGTTCCC

1201 CTGTGGAAAA AACTCGCGCC CGCCNTNATC GCCGCCGTGT TGGTACTGTG

1251 GGTCGGCGCG GTCGCACCCG CAGCATTCCT GAACCACTTT ATCGTCTTCG

1301 TCCTCGCCTG CGTCATCGGC TACTATGTCG TTTGGAACGT CAGCCACTCG

1351 CTGCACACAC CGCTGATGTC GGTGACCAAC GCCATTTCCG GCATCATCGT

1401 CGTCGGCGCG CTGCTGCAAA TCGGTCAGGG CAACGGCTTC GTTTCGCTGC

1451 TGTCGTTTGT TGCCATCCTG ATTGCCAGCA TCAACATCTT CGGCGGCTTC

1501 TTTGTAACGC GGCGGATGCT GAATATGTTT AGGAAAGGGT AA
```

This corresponds to the amino acid sequence <SEQ ID
642; ORF 155.a>:

```
a155.pep

1 MKIGIPRESL SGETRVACTP ATVALLGKLG FETVVESGAG LAASLDDAAY

51 QAAGATVADK AAVWAYPLIY KVNAPSEDEL PLLKEGQTIV SFLWPRQNEA

101 LVEALRAKKV NALAMDMVPR ISRAQALDXL SXMANISGYR AVIEAANAFG

151 RXFTGQITAA GKVPPAQVLV IGAGVAGLAA IGTANSLGAV VRVFDTRLXV

201 AEQLESMCCK FLKLDFPQES CCSCDCYAKV MSDEFIAAEM KLFAEQAKEV

251 DIIITTAAIP GKPAPKXXXK EMVESMKPGS VIVDLAAATG GNCELTKQGE

301 LFVTGNGVKI IGYTDMANRL AGQSSQLYAT NLVNLTKLLS PNKDGEITLD

351 FEDVIIRNMT VTRDGEITFP PPIQVSAQP QQTPSEKAAP AAKPEPKPVP

401 LWKKLAPAXI AAVLVLWVGA VAPAAFLNHF IVFVLACVIG YYVVWNVSHS

451 LHTPLMSVTN AISGIIVVGA LLQIGQGNGF VSLLSFVAIL IASINIFGGF

501 FVTRRMLNMF RKG* m155/a155 95.3% identity in 513 aa overlap 10        20        30        40        50        60
  m155.pep MKIGIPRESLSGETRVACTPATVALLGKLGFETVVESGAGLAASLDDAAYQTAGATVADK
           |||||||||||||||||||||||||||||||||||||||||||||||||:|||||||||
  a155     MKIGIPRESLSGETRVACTPATVALLGKLGFETVVESGAGLAASLDDAAYQAAGATVADK
                 10        20        30        40        50        60
```

-continued

```
              70         80         90        100        110        120
m155.pep  AAVWVCPLIYKVNAPSEQELPLLNEGQTIVSFLWPRQNEALVEALRAKKVNALAMDMVPR
          ||||:||||||||||||:|||||:||||||||||||||||||||||||||||||||||||
a155      AAVWAYPLIYKVNAPSEDELPLLKEGQTIVSFLWPRQNEALVEALRAKKVNALAMDMVPR
              70         80         90        100        110        120

130        140        150        160        170        180
m155.pep  ISRAQALDALSSMANISGYRAVIEAANAFGRFFTGQITAAGKVPPAQVLVIGAGVAGLAA
          ||||||||| || ||||||||||||||||||||| |||||||||||||||||||||||||
a155      ISRAQALDXLSXMANISGYRAVIEAANAFGRXFTGQITAAGKVPPAQVLVIGAGVAGLAA
             130        140        150        160        170        180

190        200        210        220        230        240
m155.pep  IGTANSLGAVVRAFDTRLEVAEQIESMGGKFLKLDFPQESGGSGDGYAKVMSDEFIAAEM
          ||||||||||||:|||||||||:|||||||||||||||||||||||||||||||||||||
a155      IGTANSLGAVVRVFDTRLXVAEQLESMGGKFLKLDFPQESGGSGDGYAKVMSDEFIAAEM
             190        200        210        220        230        240

250        260        270        280        290        300
m155.pep  KLFAEQAKEVDIIITTAAIPGKPAPKLITKEMVESMKSGSVIVDLAAATGGNCELTRPGE
          |||||||||||||||||||||||||||:|||||||||:||||||||||||||||| ||
a155      KLFAEQAKEVDIIITTAAIPGKPAPKXXXKEMVESMKPGSVIVDLAAATGGNCELTKQGE
             250        260        270        280        290        300

310        320        330        340        350        360
m155.pep  LSVTGNGVKIIGYTDMANRLAGQSSQLYATNLVNLTKLLSPNKDGEITLDFEDVIIRNMT
          | ||||||||||||||||||||||||||||||||||||||||||||||||||||||||||
a155      LFVTGNGVKIIGYTDMANRLAGQSSQLYATNLVNLTKLLSPNKDGEITLDFEDVIIRNMT
             310        320        330        340        350        360

370        380        390        400        410        420
m155.pep  VTHDGEITFPPPPIQVSAQPQQTPSEKAVPAAKPEPKPVPLWKKLAPAVIAAVLVLWVGA
          ||:||||||||||||||||||||||||||:||||||||||||||||||||| ||||||||
a155      VTRDGEITFPPPPIQVSAQPQQTPSEKAAPAAKPEPKPVPLWKKLAPAXIAAVLVLWVGA
             370        380        390        400        410        420

430        440        450        460        470        480
m155.pep  VAPAAFLNHFIVFVLACVIGYYVVWNVSHSLHTPLMSVTNAISGIIVVGALLQIGQGNGF
          ||||||||||||||||||||||||||||||||||||||||||||||||||||||||||||
g155      VAPAAFLNHFIVFVLACVIGYYVVWNVSHSLHTPLMSVTNAISGIIVVGALLQIGQGNGF
             430        440        450        460        470        480

490        500        510
m155.pep  VSLLSFVAILIAGINIFGGFAVTRRMLNMFKKGX
          |||||||||||:|||||||| ||||||||:|||
a155      VSLLSFVAILIASINIFGGFFVTRRMLNMFRKGX
             490        500        510
```

The following partial DNA sequence was identified in *N. gonorrhoeae* <SEQ ID 643>:

```
g156.seq
   1  ATGACTTTCG CCTATTGGTG CATTCTGATT GCCTGCCTAT TGCCGCTTTT

51  TTGTGCGGCG TATGCCAAAA AAGCGGGCGG ATTCCGGTTT AAAGACAACC

101  ACAATCCTCG CGGTTTTCTG GCACATACGC AAGGCGCAGC CGCCCGTGCC

151  CACGCCGCGC AGCAAAACGG TTTTGAAGCC TTTGCACCGT TTGCCGCCGC

201  CGTTTTGACG GCACACGCAA CCGGCAATGC CGGACAAGCA ACCGTCAACA

251  CGCTTGCCGG ATTGTTCATC CTGTTCCGCC TCGCCTTTAT CTGGTGCTAC

301  ATCGCAGACA AAGCAGCATT GCGCTCGCTG ATGTGGGCGG GCGGATTTGC

351  CTGCACCGTC GGACTGTTTG TCGCGGCTGC TTGA
```

This corresponds to the amino acid sequence <SEQ ID 644; ORF 156.ng>:

```
g156.pep
   1  MTFAYWCILI ACLLPLFCAA YAKKAGGFRF KDNHNPRGFL AHTQGAAARA

51  HAAQQNGFEA FAPFAAAVLT AHATGNAGQA TVNTLAGLFI LFRLAFIWCY

101  IADKAALRSL MWAGGFACTV GLFVAAA*
```

The following partial DNA sequence was identified in *N. meningitidis* <SEQ ID 645>:

```
m156.seq.
    1 ATGACTTTCG CCTATTGGTG TATTCTGATT GCCTGCCTAT TGCCGCTTTT

51 TTGTGCGGCG TATGCCAAAA AAGCGGGCGG ATTCCGGTTT AAAGACAACC

101 ACAATCCGCG CGGTTTTCTA GCGCACACGC AAGGCGCAGC CGCCCGTGCC

151 CACGCCGCAC AGCAAAACGG TTTTGAAGCC TTTGCACCGT TTGCCGCCGC

201 CGTTTTGACG GCACACGCAA CCGGCAATGC GGCGCAATCG ACCATCAACA

251 CGCTTGCCTG CCTGTTCATC CTGTTCCGCC TCGCCTTTAT CTGGTGCTAT

301 ATCGCCGACA AAGCCGCTAT GCGCTCACTG ATGTGGGCAG GCGGATTTGC

351 CTGCACCGTC GGGCTGTTTG TCGCGGCTGC TTGA
```

This corresponds to the amino acid sequence <SEQ ID 646; ORF 156>:

```
m156.pep
    1 MTFAYWCILI ACLLPLFCAA YAKKAGGFRF KDNHNPRGFL AHTQGAAARA

51 HAAQQNGFEA FAPFAAAVLT AHATGNAAQS TINTLACLFI LFRLAFIWCY

101 IADKAAMRSL MWAGGFACTV GLFVAAA*
```

Computer analysis of this amino acid sequence gave the following results:
Homology with a Predicted ORF from *N. gonorrhoeae*

```
    m156/g156 96.1% identity in 127 aa overlap 10         20         30         40         50         60
    m156.pep MTFAYWCILIACLLPLFCAAYAKKAGGFRFKDNHNPRGFLAHTQGAAARAHAAQQNGFEA
             ||||||||||||||||| ||||||||||||||||||||||||||||||||||||||||||
    g156     MTFAYWCILIACLLPLFCAAYAKKAGGFRFKDNHNPRGFLAHTQGAAARAHAAQQNGFEA
                   10         20         30         40         50         60
                   70         80         90        100        110        120
    m156.pep FAPFAAAVLTAHATGNAAQSTINTLACLFILFRLAFIWCYIADKAAMRSLMWAGGFACTV
             |||||||||||||||||||:|:|:||||||||||||||||||||:|||||||||||||||
    g156     FAPFAAAVLTAHATGNAGQATVNTLAGLFILFRLAFIWCYIADKAALRSLMWAGGFACTV
                   70         80         90        100        110        120
    m156.pep GLFVAAAX
             ||||||||
    g156     GLFVAAAX
```

The following partial DNA sequence was identified in *N. meningitidis* <SEQ ID 647>:

```
a156.seq
    1 ATGACTTTCG CCTATTGGTG TATTCTGATT GCCTACCTAT TGCCGCTTTT

51 TTGTGCGGCG TATGCCAAAA AAGCGGGCGG ATTCCGGTTT AAAGACAACC

101 ACAATCCGCG CGATTTTCTG GCGCGCACGC AAGGCACAGC CGCCCGTGCC

151 CACGCCGCGC AGCAAAACGG TTTTGAAGCC TTTGCACCGT TTGCAGCCGC

201 CGTTTTGACG GCACACGCAA CCGGCAATGC CGGACAAGCA ACCGTCAACA

251 CGCTTGCCGG CCTGTTCATC CTGTTCCGCC TCGCCTTTAT CTGGTGCTAC

301 ATCGCAGACA AAGCAGCATT ACGCTCGCTG ATGTGGGTGG GCGGATTTGT

351 CTGCACCGTC GGGCTGTTTG TCGTGGCTGC TTGA
```

This corresponds to the amino acid sequence <SEQ ID 648; ORF 156.a>:

```
a156.pep

1 MTFAYWCILI AYLLPLFCAA YAKKAGGFRF KDNHNPRDFL ARTQGTAARA

51 HAAQQNGFEA FAPFAAAVLT AHATGNAGQA TVNTLAGLFI LFRLAFIWCY

101 IADKAALRSL MWVGGFVCTV GLFVVAA* m156/a156 90.6% identity in 127 aa overlap 10         20         30         40         50         60
m156.pep  MTFAYWCILIACLLPLFCAAYAKKAGGFRFKDNHNPRGFLAHTQGAAARAHAAQQNGFEA
          ||||||||||  ||||||||||||||||||||||||| |||:||||||||||||||||||
a156      MTFAYWCILIAYLLPLFCAAYAKKAGGFRFKDNHNPRDFLARTQGTAARAHAAQQNGFEA
                  10         20         30         40         50         60

70         80         90        100        110        120
m156.pep  FAPFAAAVLTAHATGNAAQSTINTLACLFILFRLAFIWCYIADKAAMRSLMWAGGFACTV
          ||||||||||||||||||:|:|||| ||||||||||||||||||::|||||:|||:|||
a156      FAPFAAAVLTAHATGNAGQATVNTLAGLFILFRLAFIWCYIADKAALRSLMWVGGFVCTV
                  70         80         90        100        110        120 m156.pep  GLFVAAAX
          ||||:|||
a156      GLFVVAAX
```

The following partial DNA sequence was identified in *N. gonorrhoeae* <SEQ ID 649>:

```
g157.seq
      1 atgaggaacg aggAAAAACg cgccctgcgc cgcgaattgC gCgGgcggcg 51 ttcgcAAATg GGgcgagacg tGCGggCGGC GGCGgCgatA Aaaatcaacc 101 gcctgctcaa aCGTtatatc AAGCGCggtc gGaAaatcgG CGTGTATTgg 151 cCGATGGGCA AGGAATTGcg TTTGGGCGgc tTtgtcCGCG CGGCGCAAAA 201 ACGCgGCGCA AAactctatc tgccttATAT CGAACCGCAC ACGCGGCGGA

251 TGTGGTTTAC GCCGTATCCT GAACGCGGAA TGGAACGGGA ACGCAAGCGC

301 GGTAGGGCGA AGCTGCATGT CCCTCAGTTT GCAGGGCGCA AAATCCGCGT

351 GCACGGTTTG TCGGTATTGC TCGTCCCGCT TGTCGGCATA GACCGCGAAG

401 GCTACCGTTT GGGGCAGGCA GGCGGCTATT ACGATGCGAC GCTTTCGGCG

451 ATGAAATACC GTTTGCAGGC GAAAACCGTG GGCGTGGGCT TTGCCTGCCA

501 GTTGGTGGAC AGGCTCCCAC GCGAGGCGCA CGACCTGCCG CTGGACGGTT

551 TTGTATCGGA AGCGGGGATA TTGTGTTTTT AG
```

This corresponds to the amino acid sequence <SEQ ID 650; ORF 157.ng>:

```
g157.pep
      1 MRNEEKRALR RELRGRRSQM GRDVRAAAAI KINRLLKRYI KRGRKIGVYW

51 PMGKELRLGG FVRAAQKRGA KLYLPYIEPH TRRMWFTPYP ERGMERERKR

101 GRAKLHVPQF AGRKIRVHGL SVLLVPLVGI DREGYRLGQA GGYYDATLSA

151 MKYRLQAKTV GVGFACQLVD RLPREAHDLP LDGFVSEAGI LCF*
```

The following partial DNA sequence was identified in *N. meningitidis* <SEQ ID 651>:

```
m157.seq
      1 ATGAGGAACG AGGAAAAACG CGCCCTGCGC CGCGAATTGC GCGGGCGGCG
```

-continued

```
 51 TTCGCAAATG GGGCGGGACG TGCGGGCGGC GGCAACGGTA AAAATCAACC

101 ACCTGCTCAA ACGTTATATT AAAAAAGGGC GGAAAATCGG CGTGTATTGG

151 CCGATGGGCA AGGAATTGCG TTTGGACGGC TTTGTCCGCG CGGCGCAAAA

201 ACGCGGTGCG GAACTCTACC TGCCTTATAT CGAACCGCGT TCGCGGCGGA

251 TGTGGTTTAC GCCGTATCCT GCCGATGGAG TAAAACAAGA ACGCAAGCGC

301 GGTAGGGCGA AGCTGCATGT CCCTCAGTTT GCAGGTCGGA AAAAGCGTGT

351 GCATGATTTG AACCTCCTGC TTGTGCCAGT GGTCGGTATG GACAGGCTGG

401 GCTACCGCTT GGGACAGGCA GGCGGCTATT ACGATGCGAC GCTTTCAGCG

451 ATGAAATACC GTTTGCAGGC AAAAACCGTG GGCGTGGGCT TTGCCTGCCA

501 GTTGGTGGAC AGGCTGCCGG TCGAGGCGCA CGACCGGTCT TTGGACGGTT

551 TTGTGTCGGA GGCGGGGATA TTGTGTTTTT AG
```

This corresponds to the amino acid sequence <SEQ ID 652; ORF 157>:

```
m157.pep
  1 MRNEEKRALR RELRGRRSQM GRDVRAAATV KINHLLKRYI KKGRKIGVYW

51 PMGKELRLDG FVRAAQKRGA ELYLPYIEPR SRRMWFTPYP ADGVKQERKR

101 GRAKLHVPQF AGRKKRVHDL NLLLVPVVGM DRLGYRLGQA GGYYDATLSA

151 MKYRLQAKTV GVGFACQLVD RLPVEAHDRS LDGFVSEAGI LCF*
```

Computer analysis of this amino acid sequence gave the following results:
Homology with a Predicted ORF from *N. gonorrhoeae*

```
m157/g157 88.1% identity in 193 aa overlap 10         20         30         40         50         60
m157.pep MRNEEKRALRRELRGRRSQMGRDVRAAATVKINHLLKRYIKKGRKIGVYWPMGKELRLDG
         ||||||||||||||||||||||||||||::|||:||||||:|||||||||||||||| |
g157     MRNEEKRALRRELRGRRSQMGRDVRAAAAIKINRLLKRYIKRGRKIGVYWPMGKELRLGG
                  10         20         30         40         50         60

70         80         90        100        110        120
m157.pep FVRAAQKRGAELYLPYIEPRSRRMWFTPYPADGVKQERKRGRAKLHVPQFAGRKKRVHDL
         ||||||||||:|||||||||::|||||||||  |:::|||||||||||||||||| ||| |
g157     FVRAAQKRGAKLYLPYIEPHTRRMWFTPYPERGMERERKRGRAKLHVPQFAGRKIRVHGL
                  70         80         90        100        110        120

130        140        150        160        170        180
m157.pep NLLLVPVVGMDRLGYRLGQAGGYYDATLSAMKYRLQAKTVGVGFACQLVDRLPVEAHDRS
         ::||||:||:|| |||||||||||||||||||||||||||||||||||||||||||||||| ||||
g157     SVLLVPLVGIDREGYRLGQAGGYYDATLSAMKYRLQAKTVGVGFACQLVDRLPREAHDLP
                 130        140        150        160        170        180

190
m157.pep LDGFVSEAGILCFX
         ||||||||||||||
g157     LDGFVSEAGILCFX
                 190
```

The following partial DNA sequence was identified in *N. meningitidis* <SEQ ID 653>:

```
a157.seq
  1 ATGAGGAACG AGGAAAAACA CGCCTTGCGC CGAGAGTTGC GCCGCGCCCG

51 CGCGCAGATG GGGCATCAAG GGCGGTTGGC GGCGGGGCAA ACGATTAACC

101 GCCTGCTCAA ACGTTATATC AAGCGTGGTC GGAAAATCGG CGTGTATTGG

151 CCGATGGGCA AGGAATTGCG TTTGGACGGC TTTGTCCGCG CGGCGCAAAA
```

```
201  ACGCGGTGCA AAACTTTATC TGCCTTATAT CGAACCGCGT TCGCGGCGGA

251  TGTGGTTTAC GCCGTATCCT GAAAGCGGAA TGGAACGGGA GCGCATACGG

301  GGCAGGGCGA AGTTGAACGT GCCGCAGTTT GCAGGGCGCA AAATCCGCGT

351  GCACGGTTTG TCGGTATTGC TCGTCCCGCT TGTCGGCATA GACCGCGAGG

401  GCTACCGCTT AGGACAGGCA GGCGGCTATT ACGATGCGAC GCTTGCGGCG

451  ATGAAATACC GTTTGCAGGC AAAAACCGTG GGCGTGGGCT TTGCCTGCCA

501  GTTTGTGGAC AGGCTGCCGC GCGAACCGCA CGATCTGCTG CTGGACGGTT

551  TTGTGTCGGA GGCGGGGATA TTGTGCTTTT AG
```
                                                          15

This corresponds to the amino acid sequence <SEQ ID 654; ORF 157.a>:

```
a157.pep

1  MRNEEKHALR RELRRARAQM GHQGRLAAGQ TINRLLKRYI KRGRKIGVYW

51  PMGKELRLDG FVRAAQKRGA KLYLPYIEPR SRRMWFTPYP ESGMERERIR

101  GRAKLNVPQF AGRKIRVHGL SVLLVPLVGI DREGYRLGQA GGYYDATLAA

151  MKYRLQAKTV GVGFACQFVD RLPREPHDLL LDGFVSEAGI LCF* m157/a157 82.4% identity in 193 aa overlap 10         20         30         40         50         60
m157.pep  MRNEEKRALRRELRGRRSQMGRDVRAAATVKINHLLKRYIKKGRKIGVYWPMGKELRLDG
          ||||||:||||||  |:|||::  ||   ||:|||||||||:||||||||||||||||||
a157      MRNEEKHALRRELRRARAQMGHQGRLAAGQTINRLLKRYIKRGRKIGVYWPMGKELRLDG
                  10         20         30         40         50         60

70         80         90        100        110        120
m157.pep  FVRAAQKRGAELYLPYIEPRSRRMWFTPYPADGVKQERKRGRAKLHVPQFAGRKKRVHDL
          |||||||||| :|||||||||||||||||||  :|::: ||||||:|||||||| |||
a157      FVRAAQKRGAKLYLPYIEPRSRRMWFTPYPESGMERERIRGRAKLNVPQFAGRKIRVHGL
                  70         80         90        100        110        120

130        140        150        160        170        180
m157.pep  NLLLVPVVGMDRLGYRLGQAGGYYDATLSAMKYRLQAKTVGVGFACQLVDRLPVEAHDRS
          ::||||:||:|| ||||||||||||||||:|||||||||||||||||:| ||| | ||
a157      SVLLVPLVGIDREGYRLGQAGGYYDATLAAMKYRLQAKTVGVGFACQFVDRLPREPHDLL
                 130        140        150        160        170        180

190
m157.pep  LDGFVSEAGILCFX
          ||||||||||||||
a157      LDGFVSEAGILCFX
                 190
```

The following partial DNA sequence was identified in *N. gonorrhoeae* <SEQ ID 655>:

```
g158.seq
    1  ATGAAAACCA ATTCAGAAGA ACTGACCGTA TTTGTTCAAG TGGTGGAAAG

51  CGGCAGCTTC AGCCGTGCGG CGgagcAGTT GGAGAtggCA AATTCTGCCG

101  TAAGCCGCAT CGTCAAACGG CTGGAGGAAA AGTTGGGCGT GAAcCTGCtc 151  aACCGCACCA CGCGGCAACT CAATCTGACG GAAGAAGGCG CGCAATATTT

201  CCGCCGCGCG CAGAGAATCC TGCAAGAAAT GGCAGCGGCG GAAACCGAAA

251  TGCTGGCAGT GCACGAAGTA CCGCAAGGCG TGTTGCGCGT GGATTCCGCG

301  ATGCcgatgg TGCTGCATCT GCTGGCGCCG CTGGCAGCAA AATTCAACGA

351  ACGCTATCCG CATATCcgaC TTTCGCTCGT TCTTCCGAa ggctatatca 401  atctGattGA Acgcaaagtc gAtatTGCCT TACGGGCCGG AGAATTGGAC 451  GATTCCGGGC TGCGTGCACG CCATCTGTTT GACAGCCACT TCCGCGtagt
```

-continued

```
501 cgCCAGTCCT GAATATTTAG CAAAACACGG CACGCCACAA TCTGCAGAAG 551 atcTTGCCAA CCATCAATGT TTAGGCTTCA CAGAACCCGG TTCTCTAAAT 601 ACATGGGCGG TTTTAGAtgC GCAGGGAAAT CCCTATAAAA TTTCACCGCA 651 CTTTACCGCC AGCAGCGGTG AAATCTTACG CTCGTTGTGC CTTTCAAGtt 701 gCGGTATTGC TTGCTTATCA GATTTTTTGG TTGACAACGA CATCACTGAA 751 GGAAAGTTAA TTCCcctatt cgCCGAACAA ACCTCCAATA AAACACACCC

801 CTTTAATGCT GTTTATTACA GCGATAAAGC CGTCAACCTC CGCTTACGCG

851 TATTTTTGGA TTTTTTAGTG AAGGAACTGG GAAAAAATAT GAATAGAACG

901 AATACCAAAT AA
```

This corresponds to the amino acid sequence <SEQ ID 656; ORF 158.ng>:

```
g158.pep
   1 MKTNSEELTV FVQVVESGSF SRAAEQLEMA NSAVSRIVKR LEEKLGVNLL

51 NRTTRQLNLT EEGAQYFRRA QRILQEMAAA ETEMLAVHEV PQGVLRVDSA

101 MPMVLHLLAP LAAKFNERYP HIRLSLVSSE GYINLIERKV DIALRAGELD

151 DSGLRARHLF DSHFRVVASP EYLAKHGTPQ SAEDLANHQC LGFTEPGSLN

201 TWAVLDAQGN PYKISPHFTA SSGEILRSLC LSSCGIACLS DFLVDNDITE

251 GKLIPLFAEQ TSNKTHPFNA VYYSDKAVNL RLRVFLDFLV KELGKNMNRT

301 NTK*
```

The following partial DNA sequence was identified in *N. meningitidis* <SEQ ID 657>:

```
m158.seq
   1 ATGAAAACCA ATTCAGAAGA ACTGACCGTA TTTGTTCAAG TGGTGGAAAG

51 CGGCAGCTTC AGCCGTGCGG CGGAGCAGTT GGCGATGGCA AATTCTGCCG

101 TAAGCCGCAT CGTCAAACGG CTGGAGGAAA AGTTGGGTGT GAACCTGCTC

151 AACCGCACCA CGCGGCAACT CAGTCTGACG GAAGAAGGCG CGCAATATTT

201 CCGCCGCGCG CAGAGAATCC TGCAAGAAAT GGCAGCGGCG GAAACCGAAA

251 TGCTGGCAGT GCACGAAATA CCGCAAGGCG TGTTGAGCGT GGATTCCGCG

301 ATGCCGATGG TGCTGCATCT GCTGGCGCCG CTGGCAGCAA AATTCAACGA

351 ACGCTATCCG CATATCCGAC TTTCGCTCGT TTCTTCCGAA GGCTATATCA

401 ATCTGATTGA ACGCAAAGTC GATATTGCCT TACGGGCCGG AGAATTGGAC

451 GATTCCGGGC TGCGTGCACG CCATCTGTTT GACAGCCGCT TCCGCGTAAT

501 CGCCAGTCCT GAATACCTGG CAAAACACGG CACGCCGCAA TCTACAGAAG

551 AGCTTGCCGG CCACCAATGT TTAGGCTTCA CCGAACCCGG TTCTCTAAAT

601 ACATGGGCGG TTTTAGATGC GCAGGGAAAT CCCTATAAGA TTTCACCGCA

651 CTTTACCGCC AGCAGCGGTG AAATCTTACG CTCGTTGTGC CTTTCAGGTT

701 GCGGTATTGT TTGCTTATCA GATTTTTTGG TTGACAACGA CATCGCTGAA

751 GGAAAGTTAA TTCCCCTGCT CGCCGAACAA ACCTCCGATA AAACACACCC

801 CTTTAATGCT GTTTATTACA GCGATAAAGC CGTCAATCTC CGCTTACGCG

851 TATTTTTGGA TTTTTTAGTG GAGGAACTGG GAAACAATCT CTGTGGATAA
```

This corresponds to the amino acid sequence <SEQ ID 658; ORF 158>:

```
m158.pep
   1 MKTNSEELTV FVQVVESGSF SRAAEQLAMA NSAVSRIVKR LEEKLGVNLL

51 NRTTRQLSLT EEGAQYFRRA QRILQEMAAA ETEMLAVHEI PQGVLSVDSA

101 MPMVLHLLAP LAAKFNERYP HIRLSLVSSE GYINLIERKV DIALRAGELD

151 DSGLRARHLF DSRFRVIASP EYLAKHGTPQ STEELAGHQC LGFTEPGSLN

201 TWAVLDAQGN PYKISPHFTA SSGEILRSLC LSGCGIVCLS DFLVDNDIAE

251 GKLIPLLAEQ TSDKTHPFNA VYYSDKAVNL RLRVFLDFLV EELGNNLCG*
```

Computer analysis of this amino acid sequence gave the following results:
Homology with a Predicted ORF from *N. gonorrhoeae*

```
    m158/g158  94.3% identity in 297 aa overlap 10         20         30         40         50         60
    m158.pep  MKTNSEELTVFVQVVESGSFSRAAEQLAMANSAVSRIVKRLEEKLGVNLLNRTTRQLSLT
              ||||||||||||||||||||||||||||| ||||||||||||||||||||||||||:||
    g158      MKTNSEELTVFVQVVESGSFSRAAEQLEMANSAVSRIVKRLEEKLGVNLLNRTTRQLNLT
                  10         20         30         40         50         60

70         80         90        100        110        120
    m158.pep  EECAQYFRRAQRILQEMAAAETEMLAVHEIPQCVLSVDSAMPMVLHLLAPLAAKFNERYP
              ||||||||||||||||||||||||||||||:|||| |||||||||||||||||||||||
    g158      EEGAQYFRRAQRILQEMAAAETEMLAVHEVPQGVLRVDSAMPMVLHLLAPLAAKFNERYP
                  70         80         90        100        110        120

130        140        150        160        170        180
    m158.pep  HIRLSLVSSEGYINLIERKVDIALRAGELDDSGLRARHLFDSRFRVIASPEYLAKHGTPQ
              ||||||||||||||||||||||||||||||||||||||||||:|||:||||||||||||
    g158      HIRLSLVSSEGYINLIERKVDIALRAGELDDSGLRARHLFDSHFRVVASPEYLAKHGTPQ
                 130        140        150        160        170        180

190        200        210        220        230        240
    m158.pep  STEELAGHQCLGFTEPGSLNTWAVLDAQGNPYKISPHFTASSGEILRSLCLSGCGIVCLS
              |:|:||:||||||||||||||||||||||||||||||||||||||||||||:|||:|||
    g158      SAEDLANHQCLGFTEPGSLNTWAVLDAQGNPYKISPHFTASSGEILRSLCLSSCGIACLS
                 190        200        210        220        230        240

250        260        270        280        290        300
    m158.pep  DFLVDNDIAEGKLIPLLAEQTSDKTHPFNAVYYSDKAVNLRLRVFLDFLVEELGNNLCGX
              ||||||||:|||||||:||||:||||||||||||||||||||||||||||:|||:|:
    g158      DFLVDNDITEGKLIPLFAEQTSNKTHPFNAVYYSDKAVNLRLRVFLDFLVKELGKNMNRT
                 250        260        270        280        290        300 g158      NTKX
```

The following partial DNA sequence was identified in *N. meningitidis* <SEQ ID 659>:

```
a158.seq
   1 ATGAAAACCA ATTCAGAAGA ACTGACCGTA TTTGTTCAAG TGGTGGAAAG

51 CGGCAGCTTC AGCCGTGCGG CGGAGCAGTT GGCGATGGCA AATTCTGCCG

101 TAAGCCGCAT CGTCAAACGG CTGGAGGAAA AGTTGGGTGT GAACCTGCTC

151 AACCGCACCA CGCGGCAACT CAGTCTGACG GAAGAAGGCG CGCAATATTT

201 CCGCCGCGCG CAGAGAATCC TGCAAGAAAT GGCAGCGGCG GAAACCGAAA

251 TGCTGGCAGT GCACGAAATA CCGCAAGGCG TGTTGCGCGT GGATTCCGCG

301 ATGCCGATGG TGCTGCATCT GCTGGCGCCG CTGGCAGCAA AATTCAACGA

351 ACGCTATCCG CATATCCGAC TTTCGCTCGT TTCTTCCGAA GGCTATATCA

401 ATCTGATTGA ACGCAAAGTC GATATTGCCT TACGGGCCGG AGAATTGGAC

451 GATTCCGGGC TGCGTGCACG CCATCTGTTT GACAGCCGCT TCCGCGTAAT

501 CGCCAGTCCT GAATACCTGG CAAAACACGG CACGCCGCAA TCTACAGAAG
```

-continued

```
551 AGCTTGCCGG CCACCAATGT TTAGGCTTCA CCGAACCCGG TTCTCTAAAT

601 ACATGGGCGG TTTTAGATGC GCAGGGAAAT CCCTATAAGA TTTCACCGCA

651 CTTTACCGCC AGCAGCGGTG AAATCTTACG CTCGTTGTGC CTTTCAGGTT

701 GCGGTATTGC TTGCTTATCA GATTTTTTGG TTGACAACGA CATCGCTGAA

751 GGAAAGTTAA TTCCCCTGCT CGCCGAACAA ACCTCCAATA AAACGCACCC

801 CTTTAATGCT GTTTATTACA GCGATAAAGC CGTCAACCTC CGCTTACGCG

851 TATTTTTGGA TTTTTTAGTG GAGGAACTGG GAAACAATCT CTGTGGATAA
```

This corresponds to the amino acid sequence <SEQ ID 660; ORF 158.a>:

```
a158.pep
    1 MKTNSEELTV FVQVVESCSF SRAAEQLAMA NSAVSRIVKR LEEKLCVNLL

51 NRTTRQLSLT EEGAQYFRRA QRILQEMAAA ETEMLAVHEI PQGVLRVDSA

101 MPMVLHLLAP LAAKFNERYP HIRLSLVSSE GYINLIERKV DIALRAGELD

151 DSGLRARHLF DSRFRVIASP EYLAKHGTPQ STEELAGHQC LGFTEPGSLN

201 TWAVLDAQGN PYKISPHFTA SSGEILRSLC LSGGGIACLS DFLVDNDIAE

251 GKLIPLLAEQ TSNKTHPFNA VYYSDKAVNL RLRVFLDFLV EELGNNLCG* m158/a158 99.0% identity in 299 aa overlap
                  10        20        30        40        50        60
         m158.pep MKTNSEELTVFVQVVESGSFSRAAEQLAMANSAVSRIVKRLEEKLGVNLLNRTTRQLSLT
                 ||||||||||||||||||||||||||||||||||||||||||||||||||||||||||||
         a158    MKTNSEELTVFVQVVESGSFSRAAEQLAMANSAVSRIVKRLEEKLGVNLLNRTTRQLSLT
                  10        20        30        40        50        60
                  70        80        90       100       110       120
         m158.pep EEGAQYFRRAQRILQEMAAAETEMLAVHEIPQGVLSVDSAMPMVLHLLAPLAAKFNERYP
                 |||||||||||||||||||||||||||||||||||:||||||||||||||||||||||||
         a158    EEGAQYFRRAQRILQEMAAAETEMLAVHEIPQGVLRVDSAMPMVLHLLAPLAAKFNERYP
                  70        80        90       100       110       120
                 130       140       150       160       170       180
         m158.pep HIRLSLVSSEGYINLIERKVDIALRAGELDDSGLRARHLFDSRFRVIASPEYLAKHGTPQ
                 ||||||||||||||||||||||||||||||||||||||||||||||||||||||||||||
         a158    HIRLSLVSSEGYINLIERKVDIALRAGELDDSGLRARHLFDSRFRVIASPEYLAKHGTPQ
                 130       140       150       160       170       180
                 190       200       210       220       230       240
         m158.pep STEELAGHQCLGFTEPGSLNTWAVLDAQGNPYKISPHFTASSGEILRSLCLSGCGIVCLS
                 |||||||||||||||||||||||||||||||||||||||||||||||||||||:|||
         a158    STEELAGHQCLGFTEPGSLNTWAVLDAQGNPYKISPHFTASSGEILRSLCLSGCGIACLS
                 190       200       210       220       230       240
                 250       260       270       280       290       300
         m158.pep DFLVDNDIAEGKLIPLLAEQTSDKTHPFNAVYYSDKAVNLRLRVFLDFLVEELGNNLCGX
                 ||||||||||||||||||||:|||||||||||||||||||||||||||||||||||||||
         a158    DFLVDNDIAEGKLIPLLAEQTSNKTHPFNAVYYSDKAVNLRLRVFLDFLVEELGNNLCGX
                 250       260       270       280       290       300
```

The following partial DNA sequence was identified in *N. gonorrhoeae* <SEQ ID 661>:

```
g160.seq
    1 ATGGAcattc tgGACAAact ggtcgatCTC GCccaATTGA CGGGCAGTGC

51 GGATGTGCAG TgcctTTTGG GCGGACAATG gcATGaaacc TTGCAACGCG

101 AAGGGCTGGT ACACATTGTT ACGGCGGGCA GCGGTTATCT CTGCATCGAC

151 GGCGAAACTT CCCCGCGTCC GGTCGGCACG GGCGATATTG TATTTTTCCC

201 GCGCGGCTTG GGTCATGTGT TGAGCCACGA CGGAAAATAC GGAGAAAGTT

251 TACAACCGGA CATACGACAA AACGGCACAT TTATGGTCAA ACAGTGCGGC
```

-continued

```
301 AACGGGCTGG ATATGAGCCT GTTTTGCGCC CGTTTCCGCT ACGACACCCA

351 CGCCGATTTG ATGAACGGGC TGCCGGAAAC CGTTTTTCTG AACATTGCCC

401 ATCCAAGTTT GCAGTATGTG GTTTCAATGC TGCAACTGGA AAGCGAAAAA

451 CCTTTGACGG GGACGGTTTC CGTGGTCAAC GCATTACCGT CCGTCCTGCT

501 GGTGCTTATC CTGCGCGCCT ATCTCGAACA GGATAAGGAT GTCGAACTCT

551 CGGGCGTATT GAAAGGTTGG CAGGACAAAC GTTTGGGACA TTTGATCCAA

601 AAGGTGATAG ACAAACCGGA AGACGAATGG AATATTGACA AAATGGTTGC

651 CGCCGCCAAT ATGTCGCGCG CGCAACTGAT GCGCCGCTTC AAAAGCCAAG

701 TCGGACTCAG CCCGCACGCC TTTGTGAACC ATATCCGCCT GCAAAAAGGC

751 GCATTGCTGC TGAAGAAAAC CCCGGATTCG GTTTTGGAGG TCGCGCTGTC

801 GGTGGGCTTT CAGTCGGAAA CGCATTTCGG CAAGGCGTTC AAACGGCAAT

851 ATCACGTTTC GCCGGGGCAA TACCGGAAAG AAGGCGGGCA AAAATAA
```

This corresponds to the amino acid sequence <SEQ ID 662; ORF 160.ng>:

```
g160.pep
   1 MDILDKLVDL AQLTGSADVQ CLLGGQWHET LQREGLVHIV TAGSGYLCID

51 GETSPRPVGT GDIVFFPRGL GHVLSHDGKY GESLQPDIRQ NGTFMVKQCG

101 NGLDMSLFCA RFRYDTHADL MNGLPETVFL NIAHPSLQYV VSMLQLESEK

151 PLTGTVSVVN ALPSVLLVLI LRAYLEQDKD VELSGVLKGW QDKRLGHLIQ

201 KVIDKPEDEW NIDKMVAAAN MSRAQLMRRF KSQVGLSPHA FVNHIRLQKG

251 ALLLKKTPDS VLEVALSVGF QSETHFGKAF KRQYHVSPGQ YRKEGGQK*
```

The following partial DNA sequence was identified in N. meningitidis <SEQ ID 663>:

```
m160.seq
   1 ATGGACATTC TGGACAAACT GGTCGATTTC GCCCAATTGA CGGGCAGTGT

51 GGATGTGCAG TGCCTTTTGG GCGGACAATG GTCGGTACGG CATGAAACCT

101 TGCAACGCGA AGGATTGGTA CACATTGTTA CATCGGGCAG CGGCTATCTC

151 TGCATCGACG GCGAAACTTC CCCGCGTCCG GTCAGTACAG GGGATATTGT

201 ATTTTTCCCG CGCGGCTTGG GTCATGTGTT GAGCCACGAC GGAAAATGCG

251 GAGAAAGTTT ACAACCGGAT ATGCGGCAGC ACGGTGCGTT TACGGTCAAG

301 CAGTGCGGCA ACGGACAGGA TATGAGCCTG TTTTGCGCCC GTTTCCGCTA

351 CGACACCCAC GCCGATTTGA TGAACGGGCT GCCTGAAACC GTTTTTCTGA

401 ACATTGCCCA TCCGAGTTTA CAGTATGTGG TTTCAATGCT GCAACTGGAA

451 AGCAAAAAAC CTTTGACGGG GACGGTTTCC ATGGTCAACG CATTGTCGTC

501 CGTCCTGCTG GTGCTTATCC TGCGCGCCTA TCTCGAACAG GATAAGGATG

551 TCGAACTCTC GGGCGTATTG AAAGGTTGGC AGGACAAACG TTTGGGACAT

601 TTAATCCAAA AGGTGATAGA CAAACCGGAA GACGAATGGA ATGTCGACAA

651 AATGGTGGCG GCTGCCAATA TGTCGCGCGC GCAACTGATG CGCCGTTTCA

701 AAAGCCGGGT CGGACTCAGC CCGCACGCCT TTGTGAACCA TATCCGCCTG

751 CAAAAAGGCG CGTTGCTGCT GAAAAAAAAC CCGGATTCGG TTTTGTCGGT
```

-continued
```
801 CGCACTGTCG GTAGGCTTTC AGTCGGAAAC GCACTTCGGC AAGGCGTTCA

851 AACGGCAATA TCACGTTTCG CCGGGTCAAT ACCGGAAAGA AggCGGGCAA

901 AAATAA
```

This corresponds to the amino acid sequence <SEQ ID 664; ORF 160>:

```
m160.pep
   1 MDILDKLVDF AQLTGSVDVQ CLLGGQWSVR HETLQREGLV HIVTSGSGYL

51 CIDGETSPRP VSTGDIVFFP RGLGHVLSHD GKCGESLQPD MRQHGAFTVK

101 QCGNGQDMSL FCARFRYDTH ADLMNGLPET VFLNIAHPSL QYVVSMLQLE

151 SKKPLTGTVS MVNALSSVLL VLILRAYLEQ DKDVELSGVL KGWQDKRLGH

201 LIQKVIDKPE DEWNVDKMVA AANMSRAQLM RRFKSRVGLS PHAFVNHIRL

251 QKGALLLKKN PDSVLSVALS VGFQSETHFG KAFKRQYHVS PGQYRKEGGQ

301 K*
```

Computer analysis of this amino acid sequence gave the following results:
Homology with a Predicted ORF from *N. gonorrhoeae*

```
    m160/g160    93.4% identity in 301 aa overlap 10         20         30         40         50         60
        m160.pep    MDILDKLVDFAQLTGSVDVQCLLGGQWSVRHETLQREGLVHIVTSGSGYLCIDGETSPRP
                    ||||||||||:||||||:||||||||||   ||||||||||||:||||||||||||||||
        g160        MDILDKLVDLAQLTGSADVQCLLGGQW---HETLQREGLVHIVTAGSGYLCIDGETSPRP
                         10         20         30            40         50

70         80         90        100        110        120
        m160.pep    VSTGDIVFFPRGLGHVLSHDGKCGESLQPDMRQHGAFTVKQCGNGQDMSLFCARFRYDTH
                    :|||||||||||||||||||||:||||||||| : : |:|:|||||:|||||||||||||
        g160        VGTGDIVFFPRGLGHVLSHDGKYGESLQPDIRONGTFMVKQCGNGLDMSLFCARFRYDTH
                         60         70         80         90        100        110

130        140        150        160        170        180
        m160.pep    ADLMNGLPETVFLNIAHPSLQYVVSMLQLESKKPLTGTVSMVNALSSVLLVLILRAYLEQ
                    ||||||||||||||||||||||||||||||:|||||||||:||||:||||||||||||||
        g160        ADLMNGLPETVFLNIAHPSLQYVVSMLQLESEKPLTGTVSVVNALPSVLLVLILRAYLEQ
                        120        130        140        150        160        170

190        200        210        220        230        240
        m160.pep    DKDVELSGVLKGWQDKRLGHLIQKVIDKPEDEWNVDKMVAAANMSRAQLMRRFKSRVGLS
                    ||||||||||||||||||||||||||||||||||:|||||||||||||||||||:||||
        g160        DKDVELSGVLKGWQDKRLGHLIQKVIDKPEDEWNIDKMVAAANMSRAQLMRRFKSQVGLS
                        180        190        200        210        220        230

250        260        270        280        290        300
        m160.pep    PHAFVNHIRLQKGALLLKKNPDSVLSVALSVGFQSETHFGKAFKRQYHVSPGQYRKEGGQ
                    ||||||||||||||||||||:|||||:|||||||||||||||||||||||||||||||||
        g160        PHAFVNHIRLQKGALLLKKTPDSVLEVALSVGFQSETHFGKAFKRQYHVSPGQYRKEGGQ
                        240        250        260        270        280        290 m160.pep    KX
                    ||
        g160        KX
```

The following partial DNA sequence was identified in *N. meningitidis* <SEQ ID 665>:

```
a160.seq
   1 ATGGACATTC TGGACAAACT GGTCGATTTC GCCCAATTGA CGGGCAGTGT

51 GGATGTGCAG TGCCTTTTGG GCGGACAATG GTCGGTACGG CATGAAACCT

101 TGCAACGCGA AGGATTGGTA CACATTGTTA CATCGGGCAG CGGCTATCTC

151 TGCATCGACG GCGAAACTTC CCCGCGTCCG GTCAGTACAG GGGATATTGT

201 ATTTTTCCCG CGCGGCTTGG GTCATGTGTT GAGCCACGAC GGAAAATGCG
```

```
251 GAGAAAGTTT ACAACCGGAT ATGCGGCAGC ACGGTGCGTT TACGGTCAAG

301 CAGTGCGGCA ACGGACAGGA TATGAGCCTG TTTTGCGCCC GTTTCCGCTA

351 CGACACCCAC GCCGATTTGA TGAACGGGCT GCCTGAAACC GTTTTTCTGA

401 ACATTGCCCA TCCGAGTTTA CAGTATGTGG TTTCAATGCT GCAACTGGAA

451 AGCAAAAAAC CTTTGACGGG GACGGTTTCC ATGGTCAACG CATTGTCGTC

501 CGTCCTGCTG GTGCTTATCC TGCGCGCCTA TCTCGAACAG GATAAGGATG

551 TCGAACTCTC GGGCGTATTG AAAGGTTGGC AGGACAAACG TTTGGGACAT

601 TTAATCCAAA AGGTGATAGA CAAACCGGAA GACGAATGGA ATGTCGACAA

651 AATGGTGGCG GCTGCCAATA TGTCGCGCGC GCAACTGATG CGCCGTTTCA

701 AAAGCCGGGT CGGACTCAGC CCGCACGCCT TTGTGAACCA TATCCGCCTG

751 CAAAAAGGCG CGTTGCTGCT GAAAAAAAAC CCGGATTCGG TTTTGTCGGT

801 CGCACTGTCG GTAGGCTTTC AGTCGGAAAC GCACTTCGGC AAGGCGTTCA

851 AACGGCAATA TCACGTTTCG CCGGGTCAAT ACCGGAAAGA AGGCGGGCAA

901 AAATAA
```

This corresponds to the amino acid sequence <SEQ ID NO: 666; ORF 160.a>:

```
a160.pep

1 MDILDKLVDF AQLTGSVDVQ CLLGGQWSVR HETLQREGLV HIVTSGSGYL

51 CIDGETSPRP VSTGDIVFFP RGLGHVLSHD GKCGESLQPD MRQHGAFTVK

101 QCGNGQDMSL FCARFRYDTH ADLMNGLPET VFLNIAHPSL QYVVSMLQLE

151 SKKPLTGTVS MVNALSSVLL VLILRAYLEQ DKDVELSGVL KGWQDKRLGH

201 LIQKVIDKPE DEWNVDKMVA AANMSRAQLM RRFKSRVGLS PHAFVNHIRL

251 QKGALLLKKN PDSVLSVALS VGFQSETHFG KAFKRQYHVS PGQYRKEGGQ

301 K* m160/a160   100.0% identity in 301 aa overlap 10        20        30        40        50        60
m160.pep    MDILDKLVDFAQLTGSVDVQCLLGGQWSVRHETLQREGLVHIVTSGSGYLCIDGETSPRP
            ||||||||||||||||||||||||||||||||||||||||||||||||||||||||||||
g160        MDILDKLVDFAQLTGSVDVQCLLGGQWSVRHETLQREGLVHIVTSGSGYLCIDGETSPRP
                    10        20        30        40        50        60

70        80        90       100       110       120
m160.pep    VSTGDIVFFPRGLGHVLSHDGKCGESLQPDMRQHGAFTVKQCGNGQDMSLFCARFRYDTH
            ||||||||||||||||||||||||||||||||||||||||||||||||||||||||||||
a160        VSTGDIVFFPRGLGHVLSHDGKCGESLQPDMRQHGAFTVKQCGNGQDMSLFCARFRYDTH
                    70        80        90       100       110       120

130       140       150       160       170       180
m160.pep    ADLMNGLPETVFLNIAHPSLQYVVSMLQLESKKPLTGTVSMVNALSSVLLVLILRAYLEQ
            ||||||||||||||||||||||||||||||||||||||||||||||||||||||||||||
a160        ADLMNGLPETVFLNIAHPSLQYVVSMLQLESKKPLTGTVSMVNALSSVLLVLILRAYLEQ
                   130       140       150       160       170       180

190       200       210       220       230       240
m160.pep    DKDVELSGVLKGWQDKRLGHLIQKVIDKPEDEWNVDKMVAAANMSRAQLMRRFKSRVGLS
            ||||||||||||||||||||||||||||||||||||||||||||||||||||||||||||
a160        DKDVELSGVLKGWQDKRLGHLIQKVIDKPEDEWNVDKMVAAANMSRAQLMRRFKSRVGLS
                   190       200       210       220       230       240

250       260       270       280       290       300
m160.pep    PHAFVNHIRLQKGALLLKKNPDSVLSVALSVGFQSETHFGKAFKRQYHVSPGQYRKEGGQ
            ||||||||||||||||||||||||||||||||||||||||||||||||||||||||||||
a160        PHAFVNHIRLQKGALLLKKNPDSVLSVALSVGFQSETHFGKAFKRQYHVSPGQYRKEGGQ
                   250       260       270       280       290       300 m160.pep    KX
            ||
a160        KX
```

The following partial DNA sequence was identified in *N. gonorrhoeae* <SEQ ID 667>:

```
g161.seq
    1 ATGGATACCG CAAAAAAGA CATTTTAGGA TCGGGCTGGA TGCTGGTGGC

51 GGCGGCCTGC TTCACCGTTA TGAACGTATT GATTAAAGAG GCATCGGCAA

101 AATTTGCCCT CGGCAGCGGC GAATTGGTCT TTTGGCGCAT GCTGTTTTCA

151 ACCGTTACGC TCGGTGCTGC CGCCGTATTG CGGCGCGACA CCTTCCGCAC

201 GCCCCATTGG AAAAACCACT TAAACCGCAG TATGGTCGGG ACGGGGGCGA

251 TGCTGCTGCT GTTTTACGCG GTAACGCATC TGCCTTTGAC AACCGGCGTT

301 ACCCTGAGTT ACACCTCGTC GATTTTTttg GCGGTATTTT CCTTCCTGAT

351 TTTGAAAGAA CGGATTTCCG TTTACACGCA GGCGGTGCTG CTCCTTGGTT

401 TTGCCGGCGT GGTATTGCTG CTTAATCCCT CGTTCCGCAG CGGTCAGGAA

451 CCGGCGGCAC TCGCCGGGCT GGCGGGCGGC GCGATGTCCG GCTGGGCGTA

501 TTTGAAAGTG CGCGAACTGT CTTTGGCGGG CGAACCCGGC TGGCGCGTCG

551 TGTTTTACCT TTCCGCAACC GGCGTGGCGA TGTCGTCggt ttgggcgacg

601 Ctgaccggct ggCACAcccT GTCCTTTcca tcggcagttt ATCtgtCGGG

651 CATCGGCGTG tccgcgCtgA TTGCCCAaCT GtcgatgAcg cGCGcctaca 701 aaGTCGGCGA CAAATTCACG GTTGCCTCGC tttcctaTAt gaccgtcGTC 751 TTTTCCGCCC TGTCTGCCGC ATTTTTTCTg ggcgaagagc ttttctggCA 801 GGAAATACTC GGTATGTGCA TCATTATcct CAGCGGCATT TTGAGCAGCA

851 TCCGCCCCAT TGCCTTCAAA CAGCGGCTGC AAGCCCTCTT CCGCCAAAGA

901 TAA
```

35

This corresponds to the amino acid sequence <SEQ ID 668; ORF 161.ng>:

```
g161.pep
    1 MDTAKKDILG SGWMLVAAAC FTVMNVLIKE ASAKFALGSG ELVFWRMLFS

51 TVTLGAAAVL RRDTFRTPHW KNHLNRSMVG TGAMLLLFYA VTHLPLTTGV

101 TLSYTSSIFL AVFSFLILKE RISVYTQAVL LLGFAGVVLL LNPSFRSGQE

151 PAALAGLAGG AMSGWAYLKV RELSLAGEPG WRVVFYLSAT GVAMSSVWAT

201 LTGWHTLSFP SAVYLSGIGV SALIAQLSMT RAYKVGDKFT VASLSYMTVV

251 FSALSAAFFL GEELFWQEIL GMCIIILSGI LSSIRPIAFK QRLQALFRQR

301 *
```

The following partial DNA sequence was identified in *N. meningitidis* <SEQ ID 669>:

```
m161.seq
    1 ATGGATACCG CAAAAAAGA CATTTTAGGA TCGGGCTGGA TGCTGGTGGC

51 GGCGGCCTGC TTTACCATTA TGAACGTATT GATTAAAGAG GCATCGGCAA

101 AATTTGCCCT CGGCAGCGGC GAATTGGTCT TTTGGCGCAT GCTGTTTTCA

151 ACCGTTGCGC TCGGGGCTGC CGCCGTATTG CGTCGGGACA mCTTCCGCAC

201 GCCCCATTGG AAAAACCACT TAAACCGCAG TATGGTCGGG ACGGGGGCGA

251 TGCTGCTGCT GTTTTACGCG GTAACGCATC TGCCTTTGGC CACTGGCGTT
```

```
-continued
301 ACCCTGAGTT ACACCTCGTC GATTTTTTTG GCGGTATTTT CCTTCCTGAT

351 TTTGAAAGAA CGGATTTCCG TTTACACGCA GGCGGTGCTG CTCCTTGGTT

401 TTGCCGGCGT GGTATTGCTG CTTAATCCCT CGTTCCGCAG CGGTCAGGAA

451 ACGGCGGCAC TCGCCGGGCT GGCGGGCGGC GCGATGTCCG GCTGGGCGTA

501 TTTGAAAGTG CGCGAACTGT CTTTGGCGGG CGAACCCGGC TGGCGCGTCG

551 TGTTTTACCT TTCCGTGACA GGTGTGGCGA TGTCGTCGGT TTGGGCGACG

601 CTGACCGGCT GGCACACCCT GTCCTTTCCA TCGGCAGTTT ATCTGTCGTG

651 CATCGGCGTG TCCGCGCTGA TTGCCCAACT GTCGATGACG CGCGCCTACA

701 AAGTCGGCGA CAAATTCACG GTTGCCTCGC TTTCCTATAT GACCGTCGTT

751 TTTTCCGCTC TGTCTGCCGC ATTTTTTCTG GGCGAAGAGC TTTTCTGGCA

801 GGAAATACTC GGTATGTGCA TCATCATCCT CAGCGGTATT TTGAGCAGCA

851 TCCGCCCCAC TGCCTTCAAA CAGCGGCTGC AATCCCTGTT CCGCCAAAGA

901 TAA
```

This corresponds to the amino acid sequence <SEQ ID 670; ORF 161>:

```
m161.pep
  1 MDTAKKDILG SGWMLVAAAC FTIMNVLIKE ASAKFALGSG ELVFWRMLFS

51 TVALGAAAVL RRDXFRTPHW KNHLNRSMVG TGAMLLLFYA VTHLPLATGV

101 TLSYTSSIFL AVFSFLILKE RISVYTQAVL LLGFAGVVLL LNPSFRSGQE

151 TAALAGLAGG AMSGWAYLKV RELSLAGEPG WRVVFYLSVT GVAMSSVWAT

201 LTGWHTLSFP SAVYLSCIGV SALIAQLSMT RAYKVGDKFT VASLSYMTVV

251 FSALSAAFFL GEELFWQEIL GMCIIILSGI LSSIRPTAFK QRLQSLFRQR

301 *
```

Computer analysis of this amino acid sequence gave the following results:

Homology with a Predicted ORF from *N. gonorrhoeae*

```
    m161/g161    97.0% identity in 300 aa overlap 10         20         30         40         50         60
        m161.pep  MDTAKKDILGSGWMLVAAACFTIMNVLIKEASAKFALGSGELVFWRMLFSTVALGAAAVL
                  |||||||||||||||||||||||:|||||||||||||||||||||||||||:||||||
        g161      MDTAKKDILGSGWMLVAAACFTVMNVLIKEASAKFALGSGELVFWRMLFSTVTLGAAAVL
                      10         20         30         40         50         60

70         80         90        100        110        120
        m161.pep  RRDXFRTPHWKNHLNRSMVGTGAMLLLFYAVTHLPLATGVTLSYTSSIFLAVFSFLILKE
                  |||:||||||||||||||||||||||||||||||||||:|||||||||||||||||||
        g161      RRDTFRTPHWKNHLNRSMVGTGAMLLLFYAVTHLPLTTGVTLSYTSSIFLAVFSFLILKE
                      70         80         90        100        110        120

130        140        150        160        170        180
        m161.pep  RISVYTQAVLLLGFAGVVLLLNPSFRSGQETAALAGLAGGAMSGWAYLKVRELSLAGEPG
                  ||||||||||||||||||||||||||||||:|||||||||||||||||||||||||||
        g161      RISVYTQAVLLLGFAGVVLLLNPSFRSGQEPAALAGLAGGAMSGWAYLKVRELSLAGEPG
                     130        140        150        160        170        180

190        200        210        220        230        240
        m161.pep  WRVVFYLSVTGVAMSSVWATLTGWHTLSFPSAVYLSCIGVSALIAQLSMTRAYKVGDKFT
                  ||||||||:|||||||||||||||||||||||||||:|||||||||||||||||||||
        g161      WRVVFYLSATGVAMSSVWATLTGWHTLSFPSAVYLSGIGVSALIAQLSMTRAYKVGDKFT
                     190        200        210        220        230        240

250        260        270        280        290        300
        m161.pep  VASLSYMTVVFSALSAAFFLGEELFWQEILGMCIIILSGILSSIRPTAFKQRLQSLFRQR
                  |||||||||||||||||||||||||||||||||||||||||||:||||||||:||||
        g161      VASLSYMTVVFSALSAAFFLGEELFWQEILGMCIIILSGILSSIRPIAFKQRLQALFRQR
                     250        260        270        280        290        300
```

```
m161.pep   X
           |
g161       X
```

The following partial DNA sequence was identified in *N. meningitidis* <SEQ ID 671>:

```
a161.seq
  1 ATGGATACCG CAAAAAAGA CATTTTAGGA TCGGGCTGGA TGCTGGTGGC

51 GGCGGCCTGC TTTACCATTA TGAACGTATT GATTAAAGAG GCATCGGCAA

101 AATTTGCCCT CGGCAGCGGC GAATTGGTCT TTTGGCGCAT GCTGTTTTCA

151 ACCGTTGCGC TCGGGGCTGC CGCCGTATTG CGTCGGGACA CCTTCCGCAC

201 GCCCCATTGG AAAAACCACT TAAACCGCAG TATGGTCGGG ACGGGGGCGA

251 TGCTGCTGCT GTTTTACGCG GTAACGCATC TGCCTTTGGC CACCGGCGTT

301 ACCCTGAGTT ACACCTCGTC GATTTTTTTG GCGGTATTTT CCTTCCTGAT

351 TTTGAAAGAA CGGATTTCCG TTTACACGCA GGCGGTGCTG CTCCTTGGTT

401 TTGCCGGCGT GGTATTGCTG CTTAATCCCT CGTTCCGCAG CGGTCAGGAA

451 ACGGCGGCAC TCGCCGGGCT GGCGGGCGGC GCGATGTCCG GCTGGGCGTA

501 TTTGAAAGTG CGCGAACTGT CTTTGGCGGG CGAACCCGGC TGGCGCGTCG

551 TGTTTTACCT TTCCGTGACA GGTGTGGCGA TGTCATCGGT TTGGGCGACG

601 CTGACCGGCT GGCACACCCT GTCCTTTCCA TCGGCAGTTT ATCTGTCGTG

651 CATCGGCGTG TCCGCGCTGA TTGCCCAACT GTCGATGACG CGCGCCTACA

701 AAGTCGGCGA CAAATTCACG GTTGCCTCGC TTTCCTATAT GACCGTCGTT

751 TTTTCCGCTC TGTCTGCCGC ATTTTTTCTG GCCGAAGAGC TTTTCTGGCA

801 GGAAATACTC GGTATGTGCA TCATCATCCT CAGCGGTATT TTGAGCAGCA

851 TCCGCCCCAC TGCCTTCAAA CAGCGGCTGC AATCCCTGTT CCGCCAAAGA

901 TAA
```

This corresponds to the amino acid sequence <SEQ ID 672; ORF 161.a>:

```
a161.pep

1 MDTAKKDILG SGWMLVAAAC FTIMNVLIKE ASAKFALGSG ELVFWRMLFS

51 TVALGAAAVL RRDTFRTPHW KNHLNRSMVG TGAMLLLFYA VTHLPLATGV

101 TLSYTSSIFL AVFSFLILKE RISVYTQAVL LLGFAGVVLL LNPSFRSGQE

151 TAALAGLAGG AMSGWAYLKV RELSLAGEPG WRVVFYLSVT GVAMSSVWAT

201 LTGWHTLSFP SAVYLSCIGV SALIAQLSMT RAYKVGDKFT VASLSYMTVV

251 FSALSAAFFL AEELFWQEIL GMCIIILSGI LSSIRPTAFK QRLQSLFRQR

301 * m161/a161    99.3% identity in 300 aa overlap
                   10         20         30         40         50         60
m161.pep   MDTAKKDILGSGWMLVAAACFTIMNVLIKEASAKFALGSGELVFWRMLFSTVALGAAAVL
           ||||||||||||||||||||||||||||||||||||||||||||||||||||||||||||
a161       MDTAKKDILGSGWMLVAAACFTIMNVLIKEASAKFALGSGELVFWRMLFSTVALGAAAVL
                   10         20         30         40         50         60
```

```
                    70        80        90       100       110       120
m161.pep   RRDXFRTPHWKNHLNRSMVGTGAMLLLFYAVTHLPLATGVTLSYTSSIFLAVFSFLILKE
           |||:||||||||||||||||||||||||||||||||||||||||||||||||||||||||
a161       RRDTFRTPHWKNHLNRSMVGTGAMLLLFYAVTHLPLATGVTLSYTSSIFLAVFSFLILKE
                    70        80        90       100       110       120

130       140       150       160       170       180
m161.pep   RISVYTQAVLLLGFAGVVLLLNPSFRSGQETAALAGLAGGAMSGWAYLKVRELSLAGEPG
           ||||||||||||||||||||||||||||||||||||||||||||||||||||||||||||
a161       RISVYTQAVLLLGFAGVVLLLNPSFRSGQETAALAGLAGGAMSGWAYLKVRELSLAGEPG
                   130       140       150       160       170       180

190       200       210       220       230       240
m161.pep   WRVVFYLSVTGVAMSSVWATLTGWHTLSFPSAVYLSCIGVSALIAQLSMTRAYKVGDKFT
           ||||||||||||||||||||||||||||||||||||||||||||||||||||||||||||
a161       WRVVFYLSVTGVAMSSVWATLTGWHTLSFPSAVYLSCIGVSALIAQLSMTRAYKVGDKFT
                   190       200       210       220       230       240

250       260       270       280       290       300
m161.pep   VASLSYMTVVFSALSAAFFLGEELFWQEILGMCIIILSGILSSIRPTAFKQRLQSLFRQR
           |||||||||||||||||||||||:||||||||||||||||||||||||||||||||||||
a161       VASLSYMTVVFSALSAAFFLAEELFWQEILGMCIIILSGILSSIRPTAFKQRLQSLFRQR
                   250       260       270       280       290       300 m161.pep   X
           |
a161       X
```

The following partial DNA sequence was identified in *N. gonorrhoeae* <SEQ ID 673>:

```
g163.seq
   1 ATGGTTATTT TGACGACTTT GTTTTTTGTG TGTGTTTTGG TGGTATTGGT

51 TTTAACCGTG CCGGATCAGG TGCAGATGTG gctCGACCGG GCAAAAGAAG

101 TCATTTTTAC CGAGTTCAGC TGGTTTTATG TTTTAACGTT TTCCATTTTt 151 ctgGGTTTtc tgctGATACT CTCGGTCAGC GGTTTGGGAA ACATcagGCT

201 AGGACGGGAT GAAGATGTGC CGGAATTCGG CTTCCTGTCG TGGCTGGCGA

251 TGCTGTTTGC GGCCGGGATG GGCGTGGGCC TGATGTTTTT CGGCGTGGCA

301 GAGCCGTTGA TGCATTATTT TTCGGACATT ACGGTCGGCG CGCCGGAACA

351 CAGGCAGCAG CAGGCATTGC TGCACACGGT GTTCCATTGG GGCGTTCACG

401 CCTGGTCGGT GTACGGTACG ATTGCATTGG CTTTGGCTTA TTTCGGTTTC

451 CGCTACAAAC TGCCGCTTGC CCTGCGTTCT TGTTTTTACC CCCTGTTGAA

501 AGAAAAAATT TCCGGAAGGT TCGGCGATGC CATTGATATT ATGGCGTTGC

551 TTGCTACTTT TTTCGGCATC ATCACCACAT TGGGGTTCGG GGCTTCGCAA

601 CTGGGCGCCG GATTGCAGGA AATGGGCTGG ATTGCCGAAA ACAGCTTCGG

651 CGTGCAGGTC TTGATTATCG CCGCCGTAAT GTCCCTCGCC GTCGTTTCGG

701 CAATATCCGG CGTGGGGAAG GGCGTGAAGG TGTTGAGCGA GTTGAACCTG

751 GGCCTTGCGT TTTTGCTGCT GTTTTTTGTT TTGGCGGCGG ACCCCACTGT

801 TTACCTGTTG TCGGCATTCG GCGACAACAT AGGGAACTAC CTCGGAAATC

851 TGGTGCGCCT CAGTTTGAAA ACTTATGCGT ACGAACGGGA ACACAAGCCG

901 TGGTTTGAAT CTTGGACGGT GCTTTATTGG GCGTGGTGGT GTTCTTGGgc 951 gcCGTTTGTG GGTTTGTTTA TCGCGCGCAT TTCAAAGGGg cgcaccatCc 1001 gcgagtttgt CTTCGGGGTT TTGCTCATCC CCGGCCTGTT CGGCGTTTTG

1051 TGGTTTACCG TCTTCGGCAA TACGGCGATT TGGCTGAATG ACGGGGTTGC

1101 GGGGGGAATG CTCGAAAAGA TGACCTCCTC TCCGGAAACG CTGCTTTTTA

1151 AATTCTTTAA TTACCTCCCC CTGCCCGAAC TGACGAGCAT CGTCAGCCTG
```

-continued

```
1201 CTGGTCATTT CCCTGTTTTT TGTAACTTCT GCCGACTCCG GGATTTATGT

1251 CCTGAACAAT ATTACCTCTC GGGACAAAGG CTTGAGCGCG CCACGGTGGC

1301 AGGCGGTTAT GTGGGGCGTG CTGatgtcTG CCGTTGCCGT TTTGCTGATG

1351 CGCTCGGGCG GACTCGGCAA CCTGCAGTCT ATGACCCTGA TTGTTTCCCT

1401 GCCGTTTGCC CTGCTGATGC TGATAATGTG TTTCAGCCTG TGGAAAGGCT

1451 TGAGTGCGGA TAAGAAATAT TTTGAGACCC GGGTCAACCC TACCAGTGTA

1501 TTTTGGACGG GCGGCAAGTG GAAAGAACGG CTGGTGCGGA TAATGAGCCA

1551 GACGCAGGAG CAGGATATTT TAAAATTCCT CAAACATACC GCATCGCCCG

1601 CTATGCACGA GTTGCAACGG GAGCTTTCGG AAGAATACGG CTTGAGCGTC

1651 CGGGTCGATA AGATGTTTCA TCAGGACGAG CCCGCAATCG AGTTCGTCAT

1701 TCGGAAAGAG ACGATGCGCG ATTTTATGTA CGGGATTAAG TCTGTCGGGC

1751 AGGATGTATC CGACCAGTTG ATTAACGACG GCAAGCTGCC GCATATCCGG

1801 CACCAGACAA CTTACAAACC CTACGCTTAT TTTTTCGACG GGCGCGTCGG

1851 GTACGATGTG CAGTATATGA ACAAGGACGA GCTGATTGCC GACATTTTGA

1901 AAAACTACGA ACGTTATTTG ATGTTGTTGG ATGATGTCGG TCAGGAACTG

1951 ATGGCGCACG AGCAGGTGGA ATTGGCAGAG TAA
```

This corresponds to the amino acid sequence <SEQ ID 674; ORF 163.ng>:

```
g163.pep
  1  MVILTTLFFV CVLVVLVLTV PDQVQMWLDR AKEVIFTEFS WFYVLTFSIF

51  LGFLLILSVS GLGNIRLGRD EDVPEFGFLS WLAMLFAAGM GVGLMFFGVA

101  EPLMHYFSDI TVGAPEHRQQ QALLHTVFHW GVHAWSVYGT IALALAYFGF

151  RYKLPLALRS CFYPLLKEKI SGRFGDAIDI MALLATFFGI ITTLGFGASQ

201  LGAGLQEMGW IAENSFGVQV LIIAAVMSLA VVSAISGVGK GVKVLSELNL

251  GLAFLLLFFV LAADPTVYLL SAFGDNIGNY LGNLVRLSLK TYAYEREHKP

301  WFESWTVLYW AWWCSWAPFV GLFIARISKG RTIREFVFGV LLIPGLFGVL

351  WFTVFGNTAI WLNDGVAGGM LEKMTSSPET LLFKFFNYLP LPELTSIVSL

401  LVISLFFVTS ADSGIYVLNN ITSRDKGLSA PRWQAVMWGV LMSAVAVLLM

451  RSGGLGNLQS MTLIVSLPFA LLMLIMCFSL WKGLSADKKY FETRVNPTSV

501  FWTGGKWKER LVRIMSQTQE QDILKFLKHT ASPAMHELQR ELSEEYGLSV

551  RVDKMFHQDE PAIEFVIRKE TMRDFMYGIK SVGQDVSDQL INDGKLPHIR

601  HQTTYKPYAY FFDGRVGYDV QYMNKDELIA DILKNYERYL MLLDDVGQEL

651  MAHEQVELAE *
```

The following partial DNA sequence was identified in *N. meningitidis* <SEQ ID 675>:

```
m163.seq
  1 ATGGTTATTT TGACGACTTT GTTTTTTGTG TGTGTTTTGG TGGTATTGGT

51 TTTAACCGTG CCGGATCAGG TGCAGATGTG GCTCGATCGG GCAAAAGAAG

101 TCATTTTTAC CGAGTTCAGC TGGTTTTATG TTTTAACGTT TTCCATTTTT

151 CTGGGTTTCC TGCTGATACT CTCGGTCAGC AGTTTGGGAA ACATCAGGCT
```

-continued

```
 201 CGGACGGGAT GAAGATGTGC CGGAATTCGG CTTCCTGTCG TGGCTGGCGA
 251 TGCTGTTTGC GGCCGGGATG GGCGTGGGTC TGATGTTTTT CGGCGTGGCA
 301 GAGCCGTTGA TGCATTATTT TTCGGACATT ACGGCCGGCA CGCCGGAACA
 351 CAGGCAGCAG CAGGCATTGC TGCACACGGT GTTCCATTGG GGCGTTCACG
 401 CTTGGTCGGT GTACGGTACG ATTGCATTGG CTTTGGCTTA TTTCGGTTTC
 451 CGCTACAAGC TGCCGCTTGC CCTGCGTTCT TGTTTTTACC CCCTGTTGAA
 501 AGAAAAAATT TCCGGAAGGT TCGGCGATGC CATTGATATT ATGGCGTTGC
 551 TTGCTACTTT TTTCGGCATC ATCACCACAT TGGGGTTCGG GGCTTCGCAA
 601 CTGGGCGCCG GATTGCAGGA AATGGGCTGG ATTGCCGAAA ACAGCTTCAG
 651 CGTGCAGGTT TTGATTATCG CCGCCGTCAT GTCCCTCGCC GTCGTTTCGG
 701 CAATATCCGG CGTGGGGAAG GGCGTGAAGG TGTTGAGCGA GTTGAACCTG
 751 GGCCTTGCGT TTTTGCTGCT GTTTTTTGTT TTGGCGGCGG GACCCACTGT
 801 TTACCTGTTG TCGGCATTCG GCGACAACAT AGGGAACTAC CTCGGAAATC
 851 TGGTGCGCCT CAGTTTTAAA ACTTATGCGT ACGAACGGGA ACACAAGCCG
 901 TGGTTTGAAT CTTGGACGGT GCTTTATTGG GCGTGGTGGT GTTCTTGGGC
 951 GCCGTTTGTG GGTTTGTTTA TCGCGCGCAT TTCAAAGGGG CGCACCATCC
1001 GCGAGTTTGT CTTCGGGGTT TTGCTCATCC CCGGCCTGTT CGGCGTTTTG
1051 TGGTTTACCG TCTTCGGCAA TACGGCGATT TGGCTGAATG ACGGGGTTGC
1101 GGGGGGAATG CTCGAAAAGA TGACCTCCTC TCCGGAAACG CTGCTTTTTA
1151 AATTCTTTAA TTACCTCCCC CTGCCCGAAT TGACGAGCAT CGTCAGCCTG
1201 CTGGTCATTT CTCTGTTTTT TGTAACTTCT GCCGATTCCG GGATTTATGT
1251 CCTGAACAAT ATTACCTCTC GGGACAAAGG CTTGAGCGCG CCACGGTGGC
1301 AGGCGGTTAT GTGGGCGTG CTGATGTCTG CCGTTGCCGT TTTGCTGATG
1351 CGCTCGGGCG GACTCGGCAA CCTGCAGTCT ATGACCCTGA TTGTTTCCCT
1401 GCCGTTTGCC CTGCTGATGC TGATAATGTG TTTCAGCCTG TGGAAAGGCT
1451 TGAGTGCGGA TAAGAAATAT TTTGAGACCC GGGTTAACCC TACCAGTGTA
1501 TTTTGGACGG GCGGCAAGTG GAAAGAACGG CTGGTGCAGA TAATGAGCCA
1551 GACGCAGGAG CAGGATATTT TAAAATTCCT CAAACAGACT GCATCGCCCG
1601 CTATGCACGA GTTGCAACGG GAGCTTTCGG AAGAATACGG CTTGAGCGTC
1651 CGGGTCGATA AAATGTTTCA TCGGGACGAG CCCGCAATCG AGTTCGTCAT
1701 TCGGAAAGAG ACGATGCGCG ATTTTATGTA CGGGATTAAG TCTGTCGGGC
1751 AGGATGTATC CGACCAGTTG ATTAACGACG GCAAGCTGCC GCATATCCGG
1801 CATCAGACAA CTTACAAACC CTACGCTTAT TTTTTCGACG GGCGCGTCGG
1851 GTACGATGTG CAGTATATGA ACAAGGACGA GCTGATTGCC GACATTTTGA
1901 AAAACTACGA ACGTTATTTG ATGTTGTTGG ATGATGTCGG TCAGGAACTG
1951 ATGGCGCACG AGCAGGTGGA ATTGGCAGAG TAA
```

This corresponds to the amino acid sequence <SEQ ID 
676; ORF 163>:

```
m163.pep
   1 MVILTTLFFV CVLVVLVLTV PDQVQMWLDR AKEVIFTEFS WFYVLTFSIF
```

-continued

```
 51  LGFLLILSVS SLGNIRLGRD EDVPEFGFLS WLAMLFAAGM GVGLMFFGVA

101  EPLMHYFSDI TAGTPEHRQQ QALLHTVFHW GVHAWSVYGT IALALAYFGF

151  RYKLPLALRS CFYPLLKEKI SGRFGDAIDI MALLATFFGI ITTLGFGASQ

201  LGAGLQEMGW IAENSFSVQV LIIAAVMSLA VVSAISGVGK GVKVLSELNL

251  GLAFLLLFFV LAAGPTVYLL SAFGDNIGNY LGNLVRLSFK TYAYEREHKP

301  WFESWTVLYW AWWCSWAPFV GLFIARISKG RTIREFVFGV LLIPGLFGVL

351  WFTVFGNTAI WLNDGVAGGM LEKMTSSPET LLFKFFNYLP LPELTSIVSL

401  LVISLFFVTS ADSGIYVLNN ITSRDKGLSA PRWQAVMWGV LMSAVAVLLM.

451  RSGGLGNLQS MTLIVSLPFA LLMLIMCFSL WKGLSADKKY FETRVNPTSV

501  FWTGGKWKER LVQIMSQTQE QDILKFLKQT ASPAMHELQR ELSEEYGLSV

551  RVDKMFHRDE PAIEFVIRKE TMRDFMYGIK SVGQDVSDQL INDGKLPHIR

601  HQTTYKPYAY FFDGRVGYDV QYMNKDELIA DILKNYERYL MLLDDVGQEL

651  MAHEQVELAE *
```

Computer analysis of this amino acid sequence gave the following results:

Homology with a Predicted ORF from *N. gonorrhoeae*

```
   m163/g163    98.6% identity in 660 aa overlap 10         20         30         40         50         60
   m163.pep    MVILTTLFFVCVLVVLVLTVPDQVQMWLDRAKEVIFTEFSWFYVLTFSIFLGFLLILSVS
               ||||||||||||||||||||||||||||||||||||||||||||||||||||||||||||
   g163        MVILTTLFFVCVLVVLVLTVPDQVQMWLDRAKEVIFTEFSWFYVLTFSIFLGFLLILSVS
                       10         20         30         40         50         60

70         80         90        100        110        120
   m163.pep    SLGNIRLGRDEDVPEFGFLSWLAMLFAAGMGVGLMFFGVAEPLMHYFSDITAGTPEHRQQ
               :|||||||||||||||||||||||||||||||||||||||||||||||||||:|:||||
   g163        GLGNIRLGRDEDVPEFGFLSWLAMLFAAGMGVGLMFFGVAEPLMHYFSDITVGAPEHRQQ
                       70         80         90        100        110        120

130        140        150        160        170        180
   m163.pep    QALLHTVFHWGVHAWSVYGTIALALAYFGFRYKLPLALRSCFYPLLKEKISGRFGDAIDI
               ||||||||||||||||||||||||||||||||||||||||||||||||||||||||||||
   g163        QALLHTVFHWGVHAWSVYGTIALALAYFGFRYKLPLALRSCFYPLLKEKISGRFGDAIDI
                      130        140        150        160        170        180

190        200        210        220        230        240
   m163.pep    MALLATFFGIITTLGFGASQLGAGLQEMGWIAENSFSVQVLIIAAVMSLAVVSAISGVGK
               |||||||||||||||||||||||||||||||||||||||:||||||||||||||||||||
   g163        MALLATFFGIITTLGFGASQLGAGLQEMGWIAENSFGVQVLIIAAVMSLAVVSAISGVGK
                      190        200        210        220        230        240

250        260        270        280        290        300
   m163.pep    GVKVLSELNLGLAFLLLFFVLAAGPTVYLLSAFGDNIGNYLGNLVRLSFKTYAYEREHKP
               |||||||||||||||||||||||| |||||||||||||||||||||||:|||||||||||
   g163        GVKVLSELNLGLAFLLLFFVLAADPTVYLLSAFGDNIGNYLGNLVRLSLKTYAYEREHKP
                      250        260        270        280        290        300

310        320        330        340        350        360
   m163.pep    WFESWTVLYWAWWCSWAPFVGLFIARISKGRTIREFVFGVLLIPGLFGVLWFTVFGNTAI
               ||||||||||||||||||||||||||||||||||||||||||||||||||||||||||||
   g163        WFESWTVLYWAWWCSWAPFVGLFIARISKGRTIREFVFGVLLIPGLFGVLWFTVFGNTAI
                      310        320        330        340        350        360

370        380        390        400        410        420
   m163.pep    WLNDGVAGGMLEKMTSSPETLLFKFFNYLPLPELTSIVSLLVISLFFVTSADSGIYVLNN
               ||||||||||||||||||||||||||||||||||||||||||||||||||||||||||||
   g163        WLNDGVAGGMLEKMTSSPETLLFKFFNYLPLPELTSIVSLLVISLFFVTSADSGIYVLNN
                      370        380        390        400        410        420

430        440        450        460        470        480
   m163.pep    ITSRDKGLSAPRWQAVMWGVLMSAVAVLLMRSGGLGNLQSMTLIVSLPFALLMLIMCFSL
               ||||||||||||||||||||||||||||||||||||||||||||||||||||||||||||
   g163        ITSRDKGLSAPRWQAVMWGVLMSAVAVLLMRSGGLGNLQSMTLIVSLPFALLMLIMCFSL
                      430        440        450        460        470        480
```

-continued

```
                     490       500       510       520       530       540
m163.pep    WKGLSADKKYFETRVNPTSVFWTGGKWKERLVQIMSQTQEQDILKFLKQTASPAMHELQR
            ||||||||||||||||||||||||||||||||:|||||||||||||||:|||||||||||
g163        WKGLSADKKYFETRVNPTSVFWTGGKWKERLVRIMSQTQEQDILKFLKHTASPAMHELQR
                     490       500       510       520       530       540
                     550       560       570       580       590       600
m163.pep    ELSEEYGLSVRVDKMFHRDEPAIEFVIRKETMRDFMYGIKSVGQDVSDQLINDGKLPHIR
            |||||||||||||||||:||||||||||||||||||||||||||||||||||||||||||
g163        ELSEEYGLSVRVDKMFHQDEPAIEFVIRKETMRDFMYGIKSVGQDVSDQLINDGKLPHIR
                     550       560       570       580       590       600
                     610       620       630       640       650       660
m163.pep    HQTTYKPYAYFFDGRVGYDVQYMNKDELIADILKNYERYLMLLDVGQELMAHEQVELAE
            |||||||||||||||||||||||||||||||||||||||||||||||||||||||||||
g163        HQTTYKPYAYFFDGRVGYDVQYMNKDELIADILKNYERYLMLLDVGQELMAHEQVELAE
                     610       620       630       640       650       660
m163.pep    X
            |
g163        X
```

The following partial DNA sequence was identified in *N. meningitidis* <SEQ ID 677>:

```
a163.seq
   1 ATGGTTATTT TGACGACTTT GTTTTTTGTG TGTGTTTTGG TGGTATTGGT

51 TTTAACCGTG CCGGATCAGG TGCAGATGTG GCTCGATCGG GCAAAAGAAG

101 TCATTTTTAC CGAGTTCAGC TGGTTTTATG TTTTAACGTT TTCCATTTTT

151 CTGGGTTTCC TGCTGATACT CTCGGTCAGC AGTTTGGGAA ACATCAGGCT

201 CGGACGGGAT GAAGATGTGC CGGAATTCGG CTTCCTGTCG TGGCTGGCGA

251 TGCTGTTTGC GGCCGGGATG GGCGTGGGTC TGATGTTTTT CGGCGTGGCA

301 GAGCCGTTGA TGCATTATTT TTCGGACATT ACGGCCGGCA CGCCGGAACA

351 CAGGCAGCAG CAGGCATTGC TGCACACGGT GTTCCATTGG GGCGTTCACG

401 CTTGGTCGGT GTACGGTACG ATTGCATTGG CTTTGGCTTA TTTCGGTTTC

451 CGCTACAAGC TGCCGCTTGC CCTGCGTTCT TGTTTTTACC CCCTGTTGAA

501 AGAAAAAATT TCCGGAAGGT TCGGCGATGC CATTGATATT ATGGCGTTGC

551 TTGCTACTTT TTTCGGCATC ATCACCACAT TGGGGTTCGG GGCTTCGCAA

601 CTGGGCGCCG GATTGCAGGA AATAGGCTGG ATTGCCGAAA ACAGCTTCAG

651 CGTGCAGGTT TTGATTATCG CCGCCGTCAT GTCCCTCGCC GTCGTTTCGG

701 CAATATCCGG CGTGGGGAAG GGTGTGAAGG TGTTGAGCGA GTTGAACCTG

751 GGTCTTGCGT TTTTGCTGCT GTTTTTTGTT TTGGCGGCGG GTCCCACTGT

801 TTACCTGTTG TCGGCATTCG GCGACAACAT AGGGAACTAC CTCGGAAATC

851 TGGTGCGCCT CAGTTTTAAA ACTTATGCGT ACGAACGGGA ACACAAGCCG

901 TGGTTTGAAT CTTGGACGGT GCTTTATTGG GCGTGGTGGT GTTCTTGGGC

951 GCCGTTTGTG GGTTTGTTTA TCGCGCGCAT TTCAAAGGGG CGCACCATCC

1001 GCGAGTTTGT CTTCGGGGTT TTGCTCATCC CCGGCCTGTT CGGCGTTTTG

1051 TGGTTTACCG TCTTCGGCAA TACGGCGATT TGGCTGAATG ACGGGGTTGC

1101 GGGGGGAGTG CTCGAAAAGA TGACCTCCTC TCCGGAAACG CTGCTTTTTA

1151 AATTCTTTAA TTACCTCCCC CTGCCCGAAT TGACGAGCAT CGTCAGCCTG

1201 CTGGTCATTT CTCTGTTTTT TGTAACTTCT GCCGATTCCG GGATTTATGT

1251 CCTGAACAAT ATTACCTCTC GGGACAAAGG CTTGAGCGCG CCACGGTGGC

1301 AGGCGGTTAT GTGGGGCGTG CTGATGTCTG CCGTTGCCGT TTTGCTGATG
```

```
-continued
1351 CGCTCGGGCG GACTCGGCAA CCTGCAGTCT ATGACCCTGA TTGTTTCCCT

1401 GCCGTTTGCC CTGCTGATGC TGATAATGTG TTTCAGCCTG TGGAAAGGAT

1451 TGAGTGCGGA TAAGAAATAT TTTGAGACCC GGGTTAACCC TACCAGTGTA

1501 TTTTGGACGG GCGGCAAGTG GAAAGAACGG CTGGTGCAGA TAATGAGCCA

1551 GACGCAGGAG CAGGATATTT TAAAATTCCT CAAACATACC GCATCGCCCG

1601 CTATGCACGA GTTACAACGG GAGCTTTCGG AAGAATACGG CTTGAGCGTC

1651 CGGGTCGATA AGATGTTTCA TCAGGACGAG CCCGCAATCG AGTTCGTCAT

1701 TCGGAAAGAG ACGATGCGCG ATTTTATGTA CGGGATTAAG TCTGTCGGGC

1751 AGGATGTATC CGACCAGTTG ATTAACGACG GCAAGCTGCC GCATATCCGG

1801 CATCAGACAA CTTACAAACC CTACGCTTAT TTTTTCGACG GGCGCGTCGG

1851 GTACGATGTG CAGTATATGA ACAAGGACGA GCTGATTGCC GACATTTTGA

1901 AAAACTACGA ACGTTATTTG ATGTTGTTGG ATGATGTCGG TCAGGAACTG

1951 ATGGCGCACG AGCAGGTGGA ATTGGCAGAG TAA
```

This corresponds to the amino acid sequence <SEQ ID 678; ORF 163.a>:

```
a163.pep

1 MVILTTLFFV CVLVVLVLTV PDQVQMWLDR AKEVIFTEFS WFYVLTFSIF

51 LGFLLILSVS SLGNIRLGRD EDVPEFGFLS WLAMLFAAGM GVGLMFFGVA

101 EPLMHYFSDI TAGTPEHRQQ QALLHTVFHW GVHAWSVYGT IALALAYFGF

151 RYKLPLALRS CFYPLLKEKI SGRFGDAIDI MALLATFFGI ITTLGFGASQ

201 LGAGLQEIGW IAENSFSVQV LIIAAVMSLA VVSAISGVGK GVKVLSELNL

251 GLAFLLLFFV LAAGPTVYLL SAFGDNIGNY LGNLVRLSFK TYAYEREHKP

301 WFESWTVLYW AWWCSWAPFV GLFIARISKG RTIREFVFGV LLIPGLFGVL

351 WFTVFGNTAI WLNDGVAGGV LEKMTSSPET LLFKFFNYLP LPELTSIVSL

401 LVISLFFVTS ADSGIYVLNN ITSRDKGLSA PRWQAVMWGV LMSAVAVLLM

451 RSGGLGNLQS MTLIVSLPFA LLMLIMCFSL WKGLSADKKY FETRVNPTSV

501 FWTGGKWKER LVQIMSQTQE QDILKFLKHT ASPAMHELQR ELSEEYGLSV

551 RVDKMFHQDE PAIEFVIRKE TMRDFMYGIK SVGQDVSDQL INDGKLPHIR

601 HQTTYKPYAY FFDGRVGYDV QYMNKDELIA DILKNYERYL MLLDDVGQEL

651 MAHEQVELAE * m163/a163     99.4% identity in 660 aa overlap
                      10         20         30         40         50         60
        m163.pep    MVILTTLFFVCVLVVLVLTVPDQVQMWLDRAKEVIFTEFSWFYVLTFSIFLGFLLILSVS
                    ||||||||||||||||||||||||||||||||||||||||||||||||||||||||||||
        a163        MVILTTLFFVCVLVVLVLTVPDQVQMWLDRAKEVIFTEFSWFYVLTFSIFLGFLLILSVS
                      10         20         30         40         50         60

70         80         90        100        110        120
        m163.pep    SLGNIRLGRDEDVPEFGFLSWLAMLFAAGMGVGLMFFGVAEPLMHYFSDITAGTPEHRQQ
                    ||||||||||||||||||||||||||||||||||||||||||||||||||||||||||||
        a163        SLGNIRLGRDEDVPEFGFLSWLAMLFAAGMGVGLMFFGVAEPLMHYFSDITAGTPEHRQQ
                      70         80         90        100        110        120

130        140        150        160        170        180
        m163.pep    QALLHTVFHWGVHAWSVYGTIALALAYFGFRYKLPLALRSCFYPLLKEKISGRFGDAIDI
                    ||||||||||||||||||||||||||||||||||||||||||||||||||||||||||||
        a163        QALLHTVFHWGVHAWSVYGTIALALAYFGFRYKLPLALRSCFYPLLKEKISGRFGDAIDI
                     130        140        150        160        170        180
```

```
                              -continued
                190       200       210       220       230       240
  m163.pep  MALLATFFGIITTLGFGASQLGAGLQEMGWIAENSFSVQVLIIAAVMSLAVVSAISGVGK
            ||||||||||||||||||||||||||:|||||||||||||||||||||||||||||||||
  a163      MALLATFFGIITTLGFGASQLGAGLQEIGWIAENSFSVQVLIIAAVMSLAVVSAISGVGK
                190       200       210       220       230       240

250       260       270       280       290       300
  m163.pep  GVKVLSELNLGLAFLLLFFVLAAGPTVYLLSAFGDNIGNYLGNLVRLSFKTYAYEREHKP
            ||||||||||||||||||||||||||||||||||||||||||||||||||||||||||||
  a163      GVKVLSELNLGLAFLLLFFVLAAGPTVYLLSAFGDNIGNYLGNLVRLSFKTYAYEREHKP
                250       260       270       280       290       300

310       320       330       340       350       360
  m163.pep  WFESWTVLYWAWWCSWAPFVGLFIARISKGRTIREFVFGVLLIPGLFGVLWFTVFGNTAI
            ||||||||||||||||||||||||||||||||||||||||||||||||||||||||||||
  a163      WFESWTVLYWAWWCSWAPFVGLFIARISKGRTIREFVFGVLLIPGLFGVLWFTVFGNTAI
                310       320       330       340       350       360

370       380       390       400       410       420
  m163.pep  WLNDGVAGGMLEKMTSSPETLLFKFFNYLPLPELTSIVSLLVISLFFVTSADSGIYVLNN
            |||||||||:||||||||||||||||||||||||||||||||||||||||||||||||||
  a163      WLNDGVAGGVLEKMTSSPETLLFKFFNYLPLPELTSIVSLLVISLFFVTSADSGIYVLNN
                370       380       390       400       410       420

430       440       450       460       470       480
  m163.pep  ITSRDKGLSAPRWQAVMWGVLMSAVAVLLMRSGGLGNLQSMTLIVSLPFALLMLIMCFSL
            ||||||||||||||||||||||||||||||||||||||||||||||||||||||||||||
  a163      ITSRDKGLSAPRWQAVMWGVLMSAVAVLLMRSGGLGNLQSMTLIVSLPFALLMLIMCFSL
                430       440       450       460       470       480

490       500       510       520       530       540
  m163.pep  WKGLSADKKYFETRVNPTSVFWTGGKWKERLVQIMSQTQEQDILKFLKQTASPAMHELQR
            |||||||||||||||||||||||||||||||||||||||||||||||:||||||||||||
  a163      WKGLSADKKYFETRVNPTSVFWTGGKWKERLVQIMSQTQEQDILKFLKHTASPAMHELQR
                490       500       510       520       530       540

550       560       570       580       590       600
  m163.pep  ELSEEYGLSVRVDKMFHRDEPAIEFVIRKETMRDFMYGIKSVGQDVSDQLINDGKLPHIR
            ||||||||||||||||||||:|||||||||||||||||||||||||||||||||||||||
  a163      ELSEEYGLSVRVDKMFHQDEPAIEFVIRKETMRDFMYGIKSVGQDVSDQLINDGKLPHIR
                550       560       570       580       590       600

610       620       630       640       650       660
  m163.pep  HQTTYKPYAYFFDGRVGYDVQYMNKDELIADILKNYERYLMLLDDVGQELMAHEQVELAE
            ||||||||||||||||||||||||||||||||||||||||||||||||||||||||||||
  a163      HQTTYKPYAYFFDGRVGYDVQYMNKDELIADILKNYERYLMLLDDVGQELMAHEQVELAE
                610       620       630       640       650       660 m163.pep  X
            |
  a163      X
```

The following partial DNA sequence was identified in *N. gonorrhoeae* <SEQ ID 679>:

```
g164.seq (partial)
   1 ...  ATGAACACAT TTTTGAAAAA CAGCGAATAC GCGTATATCC TGAACGACTG

51       CAAGGCGCGC TTCCTGTTCG CCTCGGCCGG CCTGTCAAAA GAATTGGCGG

101       GCCTGAAGGC GCAAACGCCC GTCGAAAAAA TCATTTGGAC GGACAAAAGC

151       CGGCCGGCCG GCGAAACGGC GGAAGGCGAT GCCTTTTTTG AAAACGTGCG

201       CCGCTTCCCC GAAAAACCCG ACTTGGGCCG CCAACCCCGG ATAAATGATT

251       TGGCACACAT CATCTACACC TCCGGCACGA CGGGGCATCC CAAAGGCGCG

301       CTAATCAGTT ACGCCAACCT GTTCGCCAAC CTGAACGGCA TCGAACGCAT

351       CTTtaaAATT TCCAAACGCG ACCGCTTTAT CGTTTTCctg ccgatgTTCC

401       ACAGCTTCAC GCTGACGGCT ATGGTGCTGC TGCCGATTTA TATGGCGTGT

451       TCGATTATTT TGGTCAAAtc cgttttCCCc ttttccaacG TTTTGAAACA

501       GGCCCTGCTC AAACGCGCAA CCGTGTTTTT GGGCGTACCC GCGATTTACA

551       CCGCGATGAG CAAGGCAAAA ATCCCTTGGT ATTTCAGATG GTTCAACCGC

601       ATCCGCCTGT TTATCAGCGG CGGCGCGCCT TTGGCGGAAC AAACCATCCT

651       CGATTTTAAA GCCAAGTTCC CCCGCGCCAA ATTGCTGGAA GGCTACGGAC
```

```
-continued
 701     TGAGCGAAGC CTCGCCCGTC GTCGCCGTCA ATACGCCCGA ACGGCAAAAA
 751     GCCCGCAGCG TCGGCATCCC CCTGCCCGGT TTGGAAGCCA AAGCCGTCGA
 801     TGAAGAATTG GTCGAAGTGC CGCGCGGCGA AGTGGGCGAA CTGATCGTCA
 851     GGGGCGGTTC GGTGATGCGG GGCTACCTCA ATATGCCTGC CGCCACCGAT
 901     GAAACCATCG TCAACGGCTG GTTGAAAACG GGCGATTTCG TTACCATAGA
 951     CGAGGACGGC TTTATCTTTA TCGTCGACCG CAAAAAAGAT TTGATTATTT
1001     CCAAAGGTCA AAACGTCTAT CCGCGCGAGA TCGAAGAAGA AATCCACAAA
1051     CTCGATGCCG TCGAAGCCGC CGCCGTCATC GGCGTGAAAG ACCGTTATGC
1101     CGACGAGGAA ATCGTCGCCT TCGTCCAATT GAAGGAAGGT ATGGATTTGG
1151     GCGAGGACGA aatccgccgc caccTGCGTA CCGTGCTGGC AAATTTCAAA
1201     ATCCCCAAAC AGATCCACTT TAAAGACGGG CTGCCGCGCA ACGCTACGGG
1251     CAAAGTATTG AAACGGGTGC TGAAGGAGCA GTTTGAAGGA AACAAATGA
```

This corresponds to the amino acid sequence <SEQ ID 680; ORF 164.ng>:

```
g164.pep (partial)
  1   . . . MNTFLKNSEY AYILNDCKAR FLFASAGLSK ELAGLKAQTP VEKIIWTDKS
 51         RPAGETAEGD AFFENVRRFP EKPDLGRQPR INDLAHIIYT SGTTGHPKGA
101         LISYANLFAN LNGIERIFKI SKRDRFIVFL PMFHSFTLTA MVLLPIYMAC
151         SIILVKSVFP FSNVLKQALL KRATVFLGVP AIYTAMSKAK IPWYFRWFNR
201         IRLFISGGAP LAEQTILDFK AKFPRAKLLE GYGLSEASPV VAVNTPERQK
251         ARSVGIPLPG LEAKAVDEEL VEVPRGEVGE LIVRGGSVMR GYLNMPAATD
301         ETIVNGWLKT GDFVTIDEDG FIFIVDRKKD LIISKGQNVY PREIEEEIHK
351         LDAVEAAAVI GVKDRYADEE IVAFVQLKEG MDLGEDEIRR HLRTVLANFK
401         IPKQIHFKDG LPRNATGKVL KRVLKEQFEG NK*
```

The following partial DNA sequence was identified in *N. meningitidis* <SEQ ID 681>:

```
m164.seq
  1 ATGAACCGGA CTTATGCCAA TTTCTACGAA ATGCTCGCCG CCGCCTGCCG
 51 CAAAAACGGA AACGGCACGG CAGTGTTCGA CGGCAAGGAA AAAACCGCCT
101 ACCGCGCGCT CAAGCAGGAG GCCGAAGCCG TCGCGGCGTA TCTGCAAAAT
151 ATCGGCGTGA AGTTCGGCGA CACGGTCGCG CTGGCGGTTT CCAATTCCAC
201 AGAATTTATT ACCGCCTATT TCGCCATCTC CGCCATCGGC GCGGTCGCCG
251 TACCGATGAA CACATTTTTG AAAAACAGCG AATACGCGTA TATCCTGAAC
301 GACTGCAAGG CGCGCTTCCT GTTCGCCTCG GCCGGCCTGT CAAAAGAATT
351 GGCGGGCTTG AAGGCGCAAA CGCCCGTCGA AAAAATCATT TGGACGGACA
401 AAAGCCGTCC GACCGGCGAA ACGGCGGAAG GCGATGCCTT TTTTGAAGAC
451 GTGCGCCGCT TCCCCGAAAA ACCCGACTTG GCCGCCAAC CCCGGATAAA
501 TGATTTGGCA CACATCATCT ACACCTCCGG CACGACGGGG CATCCCAAAG
551 GCGCGCTAAT CAGTTACGCC AACCTGTTCG CCAACCTGAA CGGCATCGAA
601 CGCATCTTTA AAATTTCCAA GCGCGACCGC TTTATCGTTT TCCTGCCGAT
```

-continued

```
 651 GTTCCACAGC TTCACGCTGA CGGCTATGGT GCTGCTGCCG ATTTATATGG

701 CGTGTTCGAT TATTTTGGTC AAATCCGTTT TTCCGTTTTC CAACGTTTTG

751 AAACAGACAC TGCTCAAACG CGCGACCGTG TTTTTGGGCG TACCCGCGAT

801 TTACACCGCG ATGAGCAAGG CGAAAATCCC TTGGTATTTC AGATGGTTCA

851 ACCGCATTCG CCTGTTTATC AGCGGCGGCG CGCCTTTGGC GGAACAAACC

901 ATCCTCGATT TCAAAGCCAA GTTCCCCCGC GCCAAATTGC TGGAAGGCTA

951 CGGACTGAGC GAAGCCTCTC CCGTCGTCGC CGTCAATACG CCCGAGAGGC

1001 AAAAAGCCCG CAGCGTCGGC ATCCCCCTGC CCGGTTTGGA AGCCAAAGCC

1051 GTCGATGAAG AATTGGTCGA AGTGCCGCGC GGCGAAGTGG GCGAACTGAT

1101 CGTCAGGGGC GGTTCGGTGA TGCGGGGCTA CCTCAATATG CCTGCCGCCA

1151 CCGATGAAAC CATCGTCAAC GGCTGGTTGA AAACGGGCGA TTTCGTTACC

1201 ATAGACGAAG ACGGCTTTAT CTTTATCGTC GACCGCAAAA AAGATTTGAT

1251 TATTTCCAAA GGTCAAAATG TCTATCCGCG CGAGATTGAA GAAGAAATCT

1301 ACAAACTCGA TGCCGTCGAA GCCGCCGCCG TCATCGGCGT GAAAGACCGT

1351 TATGCCGACG AGGAAATCGT CGCCTTCGTC CAATTGAAGG AAGGTATGGA

1401 TTTGGGCGAG AACGAAATCC GCCGCCACCT GCGTACCGTG CTGGCAAATT

1451 TCAAAATCCC CAAACAAATC CACTTTAAAG ACGGGCTGCC GCGCAACGCT

1501 ACGGGCAAGG TATTGAAACG GGTGTTGAAG GAGCAGTTTG ACGGAAACAA

1551 ATGA
```

This corresponds to the amino acid sequence <SEQ ID 682; ORF 164>:

```
m164.pep
  1 MNRTYANFYE MLAAACRKNG NGTAVFDGKE KTAYRALKQE AEAVAAYLQN

51 IGVKFGDTVA LAVSNSTEFI TAYFAISAIG AVAVPMNTFL KNSEYAYILN

101 DCKARFLFAS AGLSKELAGL KAQTPVEKII WTDKSRPTGE TAEGDAFFED

151 VRRFPEKPDL GRQPRINDLA HIIYTSGTTG HPKGALISYA NLFANLNGIE

201 RIFKISKRDR FIVFLPMFHS FTLTAMVLLP IYMACSIILV KSVFPFSNVL

251 KQTLLKRATV FLGVPAIYTA MSKAKIPWYF RWFNRIRLFI SGGAPLAEQT

301 ILDFKAKFPR AKLLEGYGLS EASPVVAVNT PERQKARSVG IPLPGLEAKA

351 VDEELVEVPR GEVGELIVRG GSVMRGYLNM PAATDETIVN GWLKTGDFVT

401 IDEDGFIFIV DRKKDLIISK GQNVYPREIE EEIYKLDAVE AAAVIGVKDR

451 YADEEIVAFV QLKEGMDLGE NEIRRHLRTV LANFKIPKQI HFKDGLPRNA

501 TGKVLKRVLK EQFDGNK*
```

Computer analysis of this amino acid sequence gave the following results:
Homology with a Predicted ORF from *N. gonorrhoeae* m164/g164 98.6% identity in 432 aa overlap

```
                60         70         80         90        100        110
    m164.pep GDTVALAVSNSTEFITAYFAISAIGAVAVPMNTFLKNSEYAYILNDCKARFLFASAGLSK
                                        ||||||||||||||||||||||||||||||
        g164                            MNTFLKNSEYAYILNDCKARFLFASAGLSK
                                                10        20        30
```

-continued

```
            120        130        140        150        160        170
m164.pep ELACLKAQTPVEKIIWTDKSRPTCETAECDAFFEDVRRFPEKPDLCRQPRINDLAHIIYT
         ||||||||||||||||||||:|||||||||||:||||||||||||||||||||||||||||
g164     ELAGLKAQTPVEKIIWTDKSRPAGETAEGDAFFENVRRFPEKPDLGRQPRINDLAHIIYT
                 40         50         60         70         80         90

180        190        200        210        220        230
m164.pep SGTTGHPKGALISYANLFANLNGIERIFKISKRDRFIVFLPMFHSFTLTAMVLLPIYMAC
         ||||||||||||||||||||||||||||||||||||||||||||||||||||||||||||
g164     SGTTGHPKGALISYANLFANLNGIERIFKISKRDRFIVFLPMFHSFTLTAMVLLPIYMAC
                100        110        120        130        140        150

240        250        260        270        280        290
m164.pep SIILVKSVFPFSNVLKQTLLKRATVFLGVPAIYTAMSKAKIPWYFRWFNRIRLFISGGAP
         ||||||||||||||||:|||||||||||||||||||||||||||||||||||||||||||
g164     SIILVKSVFPFSNVLKQALLKRATVFLGVPAIYTAMSKAKIPWYFRWFNRIRLFISGGAP
                160        170        180        190        200        210

300        310        320        330        340        350
m164.pep LAEQTILDFKAKFPRAKLLEGYGLSEASPVVAVNTPERQKARSVGIPLPGLEAKAVDEEL
         ||||||||||||||||||||||||||||||||||||||||||||||||||||||||||||
g164     LAEQTILDFKAKFPRAKLLEGYGLSEASPVVAVNTPERQKARSVGIPLPGLEAKAVDEEL
                220        230        240        250        260        270

360        370        380        390        400        410
m164.pep VEVPRGEVGELIVRGGSVMRGYLNMPAATDETIVNGWLKTGDFVTIDEDGFIFIVDRKKD
         ||||||||||||||||||||||||||||||||||||||||||||||||||||||||||||
g164     VEVPRGEVGELIVRGGSVMRGYLNMPAATDETIVNGWLKTGDFVTIDEDGFIFIVDRKKD
                280        290        300        310        320        330

420        430        440        450        460        470
m164.pep LIISKGQNVYPREIEEEIYKLDAVEAAAVIGVKDRYADEEIVAFVQLKEGMDLGENEIRR
         ||||||||||||||||||:|||||||||||||||||||||||||||||||||||||:||||
g164     LIISKGQNVYPREIEEEIHKLDAVEAAAVIGVKDRYADEEIVAFVQLKEGMDLGEDEIRR
                340        350        360        370        380        390

480        490        500        510
m164.pep HLRTVLANFKIPKQIHFKDGLPRNATGKVLKRVLKEQFDGNKX
         |||||||||||||||||||||||||||||||||||||||:||||
g164     HLRTVLANFKIPKQIHFKDGLPRNATGKVLKRVLKEQFEGNKX
                400        410        420        430
```

The following partial DNA sequence was identified in *N. meningitidis* <SEQ ID 683>:

```
a164.seq
   1 ATGAACCGGA CTTATGCCAA TTTCTACGAA ATGCTGACCG CCGCCTGCCG

51 CAAAAACGGC AACGGCACGG CAGTGTTCGA CGGCAAGGAA AAAACCGCCT

101 ACCGCGCGCT CAAGCAGGAA GCCGAAGCCG TTGCGGCGTA TCTGCAAAAT

151 ATCGGCGTGA AGTTCGGCGA CACGGTCGCG CTGGCGGTTT CCAATTCCAC

201 GGAATTTATT ACCGCCTATT TCGCCGTATC CGCCATCGGC GCGGTTGCCG

251 TACCGATGAA CACATTTTTG AAAAACAGCG AATACGCGTA TATCCTGAAC

301 GACTGCAAGG CGCGCTTCCT GTTCGCCTCG GCCGGCCTGT CAAAAGAATT

351 GGCGGGCTTG AAGGCGCAAA CGCCCGTCGA AAAAATCATT TGGACGGGCC

401 AAAGCCGTCC GGACGGCGAA ATGGCGGAAG GCGATGCCTT TTTTGAAGAC

451 GTGCGCCGCT TCCCCGAAAA ACCCGACTTG GGCCGCCAAC CCCGGATAAA

501 TGATTTGGCA CACATCATCT ACACCTCCGG CACGACGGGG CATCCCAAAG

551 GTGCGCTAAT CAGCTACGCC AACCTGTTCG CCAACCTGAA CGGCATCGAA

601 CGCATCTTTA AAATCTCCAA GCGCGACCGC TTTATCGTTT TCCTGCCGAT

651 GTTCCACAGC TTCACGCTGA CGGCTATGGT GCTGCTGCCG ATTTATATGG

701 CGTGTTCGAT TATTTTGGTC AAATCCGTTT TCCCCTTTTC CAACGTTTTG

751 AAACAGGCAC TGCTCAAACG CGCGACCGTG TTTTTGGGCG TGCCCGCGAT

801 TTACACCGCG ATGAGCAAGA CGAAAATCCC TTGGTATTTC AGATGGTTCA

851 ACCGCATCCG CCTGTTTATC AGCGGCGGAG CACCTTTGGC GGAACAAACC

901 ATCCTCGATT TCAAAGCCAA GTTCCCCCGC GCCAAATTGC TGGAAGGCTA
```

-continued

```
 951 CGGACTGAGC GAAGCCTCGC CCGTCGTCGC CGTCAATACG CCCGAGAGGC

1001 AAAAAGCCCG CAGCGTCGGC ATCCCCCTGC CCGGTTTGGA AGTCAAAGCC

1051 GTCGATGAAG AATTGGTCGA AGTGCCGCGC GGCGAAGTGG GCGAACTGAT

1101 CGTCAGGGGC GGTTCGGTGA TGCGGGGCTA CCTCAATATG CCTGCCGCCA

1151 CCGATGAAAC CATCGTCAAC GGCTGGTTGA AAACGGGCGA TTTCGTTACC

1201 ATAGACGAAG ACGGCTTTAT CTTTATCGTC GACCGCAAAA AGATTTGAT

1251 TATTTCCAAA GGTCAAAATG TCTATCCGCG CGAAATCGAA GAAGAAATCT

1301 ACAAACTCGA TGCCGTCGAA GCCGCCGCCG TCATCGGCGT GAAAGACCGT

1351 TATGCCGACG AGGAAATCGT CGCCTTCGTC CAATTGAAGG AAGGTATGGA

1401 TTTGGGCGAG AACGAAATCC GCCGCCACCT GCGTACCGTG CTGGCAAATT

1451 TCAAAATCCC CAAACAAATC CACTTTAAAG ACGGGCTGCC GCGCAACGCT

1501 ACGGGCAAGG TATTGAAACG GGTGTTGAAG GAGCAGTTTG ACGGAAACAA

1551 ATGA
```

This corresponds to the amino acid sequence <SEQ ID 684; ORF 164.a>:

```
a164.pep

1 MNRTYANFYE MLTAACRKNG NGTAVFDGKE KTAYRALKQE AEAVAAYLQN

51 IGVKFGDTVA LAVSNSTEFI TAYFAVSAIG AVAVPMNTFL KNSEYAYILN

101 DCKARFLFAS AGLSKELAGL KAQTPVEKII WTGQSRPDGE MAEGDAFFED

151 VRRFPEKPDL GRQPRINDLA HITYTSGTTG HPKGALISYA NLFANLNGIE

201 RIFKISKRDR FIVFLPMFHS FTLTAMVLLP IYMACSIILV KSVFPFSNVL

251 KQALLKRATV FLGVPAIYTA MSKTKIPWYF RWFNRIRLFI SGGAPLAEQT

301 ILDFKAKFPR AKLLEGYGLS EASPVVAVNT PERQKARSVG IPLPGLEVKA

351 VDEELVEVPR GEVGELIVRG GSVMRGYLNM PAATDETIVN GWLKTGDFVT

401 IDEDGFIFIV DRKKDLIISK GQNVYPREIE EEIYKLDAVE AAAVIGVKDR

451 YADEEIVAFV QLKEGMDLGE NEIRRHLRTV LANFKIPKQI HFKDGLPRNA

501 TGKVLKRVLK EQFDGNK*
```

```
m164/a164    98.3% identity in 517 aa overlap 10         20         30         40         50         60
m164.pep  MNRTYANFYEMLAAACRKNGNGTAVFDGKEKTAYRALKQEAEAVAAYLQNIGVKFGDTVA
          |||||||||||:||||||||||||||||||||||||||||||||||||||||||||||||
a164      MNRTYANFYEMLTAACRKNGNGTAVFDGKEKTAYRALKQEAEAVAAYLQNIGVKFGDTVA
                 10         20         30         40         50         60

70         80         90        100        110        120
m164.pep  LAVSNSTEFITAYFAISAIGAVAVPMNTFLKNSEYAYILNDCKARFLFASAGLSKELAGL
          ||||||||||||||||:|||||||||||||||||||||||||||||||||||||||||||
a164      LAVSNSTEFITAYFAVSAIGAVAVPMNTFLKNSEYAYILNDCKARFLFASAGLSKELAGL
                 70         80         90        100        110        120

130        140        150        160        170        180
m164.pep  KAQTPVEKIIWTDKSRPTGETAEGDAFFEDVRRFPEKPDLGRQPRINDLAHITYTSGTTG
          ||||||||||||:||:||  |||||||||||||||||||||||||||||||||||||||
a164      KAQTPVEKIIWTGQSPRDGEMAEGDAFFEDVRRFPEKPDLGRQPRINDLAHIIYTSGTTG
                130        140        150        160        170        180

190        200        210        220        230        240
m164.pep  HPKGALISYANLFANLNGIERIFKISKRDRFIVFLPMFHSFTLTAMVLLPIYMACSIILV
          ||||||||||||||||||||||||||||||||||||||||||||||||||||||||||||
a164      HPKGALISYANLFANLNGIERIFKISKRDRFIVFLPMFHSFTLTAMVLLPIYMACSIILV
                190        200        210        220        230        240
```

```
                    250       260       270       280       290       300
m164.pep    KSVFPFSNVLKQTLLKRATVFLGVPAIYTAMSKAKIPWYFRWFNRIRLFISGGAPLAEQT
            ||||||||||||:||||||||||||||||||:||||||||||||||||||||||||||||
a164        KSVFPFSNVLKQALLKRATVFLGVPAIYTAMSKTKIPWYFRWFNRIRLFISGGAPLAEQT
                    250       260       270       280       290       300

310       320       330       340       350       360
m164.pep    ILDFKAKFPRAKLLEGYGLSEASPVVAVNTPERQKARSVGIPLPGLEAKAVDEELVEVPR
            ||||||||||||||||||||||||||||||||||||||||||||||:|||||||||||||
a164        ILDFKAKFPRAKLLEGYGLSEASPVVAVNTPERQKARSVGIPLPGLEVKAVDEELVEVPR
                    310       320       330       340       350       360

370       380       390       400       410       420
m164.pep    GEVGELIVRGGSVMRGYLNMPAATDETIVNGWLKTGDFVTIDEDGFIFIVDRKKDLIISK
            ||||||||||||||||||||||||||||||||||||||||||||||||||||||||||||
a164        GEVGELIVRGGSVMRGYLNMPAATDETIVNGWLKTGDFVTIDEDGFIFIVDRKKDLIISK
                    370       380       390       400       410       420

430       440       450       460       470       480
m164.pep    GQNVYPREIEEEIYKLDAVEAAAVIGVKDRYADEEIVAFVQLKEGMDLGENEIRRHLRTV
            ||||||||||||||||||||||||||||||||||||||||||||||||||||||||||||
a164        GQNVYPREIEEEIYKLDAVEAAAVIGVKDRYADEEIVAFVQLKEGMDLGENEIRRHLRTV
                    430       440       450       460       470       480

490       500       510
m164.pep    LANFKIPKQIHFKDGLPRNATGKVLKRVLKEQFDGNKX
            |||||||||||||||||||||||||||||||||||||
a164        LANFKIPKQIHFKDGLPRNATGKVLKRVLKEQFDGNKX
                    490       500       510
```

The following partial DNA sequence was identified in *N. gonorrhoeae* <SEQ ID 685>:

```
g165.seq
   1 ATGGCTGAAG CGACAGACGT TGTCTTGGTG GGCGGCGGCA TTATGAGCGC

51 GACTTTGGGC GTTTTGCTCA AGAACTCGA ACCGTCTTGG GAAATCACCC

101 TGATTGAACG CTTGGAagat gTGGCGTTGG AATCGTCAAA cGCGTGGAAC

151 AACGcCGgca CGGGGCATTC CGcGCTGTGc GAATTGAACT AtgcgccGCT

201 GGGtgcggac ggcgtcatCA ATCCGGCGCg cgCCCTGAAT ATTGCCGAAC

251 AGTTTCATGT CAGCCGCCAG TTTTGGGcga cgctgGTCGC GGAAGGCAAG

301 TTGGAagaCA ATTCCTTCAT CAATGCcgtg ccgcatatGT Ctttggtgat 351 gAacgaagac cactgCCgtt acCTGCAAAA ACGCTATGAT GTGTTTAAAA

401 CGCAGAAACT TTTTGAAAAT ATGGAATTTT CCACCGATCG GAACAAAATT

451 TCCGATTGGG CtccgCTGAT TATGCGCGGC CGGgacgaaA ACCAACCCGT

501 CGCCGCCAAC TATTCCGCCG Aaggcacgga tgtcgATTTC GGACGGCTGA

551 CGCGCCAGAT GGTGAAATAT TTGCAGGGCA AGGGCGTAAA AACCGAGTTC

601 AACCGCCACG TCGAAGACAT CAAACGCGAA TCCGACGGCG CGTGGGTGCT

651 CAAAACCGCC GATACCCGCA ACCCAGACTG GCAGCTCACC CTCCGCACCC

701 GCTTCCTCTT CCTCGGCGCG GGCGGCGGCG CACTGACCCT GCTGCAAAAA

751 TCCGGCATCC CCGAAGGCAA AGGCTACGGC GGCTTACCCG TGTCCGGCCT

801 GTTCTTCCGC AACAGCAACC CCGAAACCGC CGAACAACAC AACGCCAAAG

851 TGTACGGGCA GGCTTCCGTC GGCGCGCCGC CGATGTCCGT CCCGCACCTC

901 GACACACGCA ACGTAGACGG CAAACGACAC CTTATGTTCG GTCCTTACGC

951 AGGTTTCCGT TCCAACTTCC TCAAGCAAGG CTCGTTTATG GATTTGCCGC

1001 TGTCCATCCA TATGGACAAC CTCTATCCTA TGCTGCGCGC CGGCTGGGCG

1051 AATATGCCGC TGACCAAATA CcTGCTGGGC gAaTTGCgtt aa
```

This corresponds to the amino acid sequence <SEQ ID 686; ORF 165.ng>:

```
g165.pep
  1  MAEATDVVLV GGGIMSATLG VLLKELEPSW EITLIERLED VALESSNAWN

51  NAGTGHSALC ELNYAPLGAD GVINPARALN IAEQFHVSRQ FWATLVAEGK

101  LEDNSFINAV PHMSLVMNED HCRYLQKRYD VFKTQKLFEN MEFSTDRNKI

151  SDWAPLIMRG RDENQPVAAN YSAEGTDVDF GRLTRQMVKY LQGKGVKTEF

201  NRHVEDIKRE SDGAWVLKTA DTRNPDWQLT LRTRFLFLGA GGGALTLLQK

251  SGIPEGKGYG GLPVSGLFFR NSNPETAEQH NAKVYGQASV GAPPMSVPHL

301  DTRNVDGKRH LMFGPYAGFR SNFLKQGSFM DLPLSIHMDN LYPMLRAGWA

351  NMPLTKYLLG ELR*
```

The following partial DNA sequence was identified in *N. meningitidis* <SEQ ID 687>:

```
m165.seq (partial)
   1  ATGGCTGAAG CGACAGACGT TGTCTTGGTG GCGGCGGCA TTATGAGCGC

51  GACTTTGGGC GTTTTGCTCA AGAACTCGA ACCGTCTTGG GAAATCACCC

101  TGATTGAACG CTTGGAAGAT GTGGCGTTGG AATCGTCAAA CGCGTGGAAC

151  AACGCCGGCA CGGGGCATTC CGCGCTGTGC GAATTGAACT ATGCGCCGTT

201  GGGTGCAAAT GGGATTATCG ATCCGGCGCG CGCCCTCAAT ATTGCCGAAC

251  AGTTTCATGT CAGCCGCCAG TTTTGGGCGA CGCTGGTCGC GGAAGGCAAG

301  TTGGAAGACA ATTCCTTCAT CAATGCCGTG CCGCATATGT CTTTGGTGAT

351  GAATGAAGAC CATTGTTCTT ATCTTCAAAA ACGTTATGAC GCGTTTAAAA

401  CCCAAAAACT TTTTGAAAAT ATGGAATTTT CCACCGATCG GAACAAAATT

451  TCCGATTGGG CTCCGCTGAT GATGCGCGGC CGGGACGAAA ACCAACCCGT

501  CGCCGCCAAC TACTCCGCCG AAGgTACGGA TGTCGATTTC GGACGGCTGA

551  CGCGCCAAAT GGTGAAATAT TTGCAGGGCA AGGGCGTAAA AACCGAGTTC

601  AACCGCCACG TCGAAGACAT CAAACGCGAA TCCGACGGCG CGTGGGTGCT

651  CAAAACCGCC GATACCCGCA ACCCCGACGG GCAGCTCACC CTCCGTACCC

701  GCTTCCTCTT CCTCGGCGCG GGCGGCGGCG CGCTGACCCT GCTGCAAAAA

751  TCCGGCATCC CCGAAGGCAA AGGCTACGGC GGCTTCCCCG TGTCCGGCCT

801  GTTCTTCCGC AACAGCAACC CCGAAACCGC CGAACAACAC AACGCCAAAG

851  TGTACGGGCA GGCTTCCGTC GGCGCGCCGC CGATGTCCGT CCCGCACCTC

901  GACACACGCA ACGTGGACGG CAAACGCCAC CTTATGTTCG GCCCTTACGC

951  AGGCTTCCGT TCCAACTTCC TCAAGCAAGG CTCGCTTATG GATTTGCCGC

1001  TGTCCATCCA TATGGACAAC CTCTATCCTA TGCTGTGCGC CGGCTGGGCG

1051  AATATGCCGC TGACCAAA . . .
```

This corresponds to the amino acid sequence <SEQ ID 688; ORF 165>:

```
m165.pep (partial)
  1  MAEATDVVLV GGGIMSATLG VLLKELEPSW EITLIERLED VALESSNAWN

51  NAGTGHSALC ELNYAPLGAN GIIDPARALN IAEQFHVSRQ FWATLVAEGK
```

-continued

```
101  LEDNSFINAV PHMSLVMNED HCSYLQKRYD AFKTQKLFEN MEFSTDRNKI

151  SDWAPLMMRG RDENQPVAAN YSAEGTDVDF GRLTRQMVKY LQGKGVKTEF

201  NRHVEDIKRE SDGAWVLKTA DTRNPDGQLT LRTRFLFLGA GGGALTLLQK

251  SGIPEGKGYG GFPVSGLFFR NSNPETAEQH NAKVYGQASV GAPPMSVPHL

301  DTRNVDGKRH LMFGPYAGFR SNFLKQGSLM DLPLSIHMDN LYPMLCAGWA

351  NMPLTK . . .
```

Computer analysis of this amino acid sequence gave the following results:

Homology with a Predicted ORF from *N. gonorrhoeae*

```
    m165/g165    97.2% identity in 356 aa overlap 10         20         30         40         50         60
      m165.pep  MAEATDVVLVGGGIMSATLGVLLKELEPSWEITLIERLEDVALESSNAWNNAGTGHSALC
                ||||||||||||||||||||||||||||||||||||||||||||||||||||||||||||
          g165  MAEATDVVLVGGGIMSATLGVLLKELEPSWEITLIERLEDVALESSNAWNNAGTGHSALC
                        10         20         30         40         50         60

70         80         90        100        110        120
      m165.pep  ELNYAPLGANGIIDPARALNIAEQFHVSRQFWATLVAEGKLEDNSFINAVPHMSLVMNED
                ||||||||||:|:||||||||||||||||||||||||||||||||||||||||||||||
          g165  ELNYAPLGADGVINPARALNIAEQFHVSRQFWATLVAEGKLEDNSFINAVPHMSLVMNED
                        70         80         90        100        110       120

130        140        150        160        170        180
      m165.pep  HCSYLQKRYDAFKTQKLFENMEFSTDRNKISDWAPLMMRGRDENQPVAANYSAEGTDVDF
                ||:|||||||:|||||||||||||||||||||||||:|||||||||||||||||||||||
          g165  HCRYLQKRYDVFKTQKLFENMEFSTDRNKISDWAPLIMRGRDENQPVAANYSAEGTDVDF
                       130        140        150        160        170        180

190        200        210        220        230        240
      m165.pep  GRLTRQMVKYLQGKGVKTEFNRHVEDIKRESDGAWVLKTADTRNPDGQLTLRTRFLFLGA
                |||||||||||||||||||||||||||||||||||||||||||||:||||||||||||||
          g165  GRLTRQMVKYLQGKGVKTEFNRHVEDIKRESDGAWVLKTADTRNPDWQLTLRTRFLFLGA
                       190        200        210        220        230        240

250        260        270        280        290        300
      m165.pep  GGGALTLLQKSGIPEGKGYGGFPVSGLFFRNSNPETAEQHNAKVYGQASVGAPPMSVPHL
                ||||||||||||||||||||||:|||||||||||||||||||||||||||||||||||||
          g165  GGGALTLLQKSGIPEGKGYGGLPVSGLFFRNSNPETAEQHNAKVYGQASVGAPPMSVPHL
                       250        260        270        280        290        300

310        320        330        340        350
      m165.pep  DTRNVDGKRHLMFGPYAGFRSNFLKQGSLMDLPLSIHMDNLYPMLCAGWANMPLTK
                |||||||||||||||||||||||||||||:||||||||||||||||:|||||||||
          g165  DTRNVDGKRHLMFGPYAGFRSNFLKQGSFMDLPLSIHMDNLYPMLRAGWANMPLTKYLLG
                       310        320        330        340        350        360 g165  ELRX
```

The following partial DNA sequence was identified in *N. meningitidis* <SEQ ID 689>:

```
a165.seq
  1 ATGGCTGAAG CGACAGACGT TGTCTTGGTG GGCGGCGGCA TTATGAGCGC

51 GACTTTGGGC GTTTTGCTCA AAGAACTCGA ACCGTCTTGG GAAATCACCC

101 TGATTGAACG CTTGGAAGAT GTGGCGTTGG AATCGTCAAA CGCGTGGAAC

151 AACGCCGGCA CGGGGCATTC CGCGCTGTGC GAATTGAACT ATGCGCCGTT

201 GGGTGCAAAT GGGATTATCG ATCCGGCGCG CGCCCTCAAT ATTGCCGAAC

251 AGTTTCATGT CAGCCGCCAG TTTTGGGCGA CGTTGGTCGC GGAAGGCAAG

301 TTGGAAGACA ATTCCTTCAT CAATGCCGTG CCGCATATGT CTTTGGTGAT

351 GAATGAAGAC CATTGTTCTT ATCTTCAAAA ACGTTATGAC GCGTTTAAAA

401 CCCAAAAACT TTTTGAAAAT ATGGAATTTT CCACCGATCG GAACAAAATT

451 TCCGATTGGG CTCCGCTGAT GATGCGCGGC CGGGACGAAA ACCAACCCGT
```

-continued

```
 501 CGCCGCCAAC TACTCCGCCG AAGGCACGGA TGTCGATTTC GGACGGCTGA

551 CGCGCCAAAT GGTGAAATAT TTGCAGGGCA AGGGCGTAAA AACCGAGTTC

601 AACCGCCACG TCGAAGACAT CAAACGCGAA TCCGACGGCG CGTGGGTGCT

651 CAAAACCGCC GATACCCGCA ACCCGACGG GCAGCTCACC CTCCGTACCC

701 GCTTCCTCTT CCTCGGCGCG GGCGGCGGCG CGCTGACCCT GCTGCAAAAA

751 TCCGGCATCC CCGAAGGCAA AGGCTACGGT GGCTTTCCCG TGTCCGGCCT

801 GTTCTTCCGC AACAGCAACC CCGAAACCGC CGAACAACAC AACGCCAAAG

851 TGTACGGGCA GGCTTCCGTC GGCGCGCCGC CGATGTCCGT CCCGCACCTC

901 GACACACGCA ACGTGGACGG CAAACGCCAC CTTATGTTCG GCCCTTACGC

951 AGGCTTCCGT TCCAACTTCC TCAAGCAAGG CTCACTTATG GATTTGCCGC

1001 TGTCCATCCA TATGGACAAC CTCTATCCTA TGCTGCGCGC CGGCTGGGCG

1051 AATATGCCGC TGACCAAATA CCTGCTGGGC GAATTGCGTA AAACCAAAGA

1101 AGAACGCTTC GCCTCCCTGC TGGAATACTA CCCCGAGGCA AACCCCGACG

1151 ACTGGGAACT CATCACCGCA GGGCAACGCG TTCAAATCAT TAAAAAAGAC

1201 TCCGAAAAAG GCGGCGTGTT GCAGTTTGGT ACGGAGATTG TCGCACACGC

1251 CGACGGCTCG CTCGCCGCAT TGCTGGGCGC GTCGCCGGGC GCATCGACCG

1301 CCGTGCCGCT GATGATCCGG CTGATGCACC AATGCTTCCC CGAACGCACC

1351 CCGTCTTGGG AAGGCCGTCT GAAAGAGCTG GTACCGGGTT ACGGCATCAA

1401 GTTGAACGAA AACCCCGAAA GGGCGGATGA AATTATCGCC TATACCGCGA

1451 AAGTGTTGGA TATTTAA
```

This corresponds to the amino acid sequence <SEQ ID 690; ORF 165.a>:

```
a165.pep

1 MAEATDVVLV GGGIMSATLG VLLKELEPSW EITLIERLED VALESSNAWN

51 NAGTGHSALC ELNYAPLGAN GIIDPARALN IAEQFHVSRQ FWATLVAEGK

101 LEDNSFINAV PHMSLVMNED HCSYLQKRYD AFKTQKLFEN MEFSTDRNKI

151 SDWAPLMMRG RDENQPVAAN YSAEGTDVDF GRLTRQMVKY LQGKGVKTEF

201 NRHVEDIKRE SDGAWVLKTA DTRNPDGQLT LRTRFLFLGA GGGALTLLQK

251 SGIPEGKGYG GFPVSGLFFR NSNPETAEQH NAKVYGQASV GAPPMSVPHL

301 DTRNVDGKRH LMFGPYAGFR SNFLKQGSLM DLPLSIHMDN LYPMLRAGWA

351 NMPLTKYLLG ELRKTKEERF ASLLEYYPEA NPDDWELITA GQRVQIIKKD

401 SEKGGVLQFG TEIVAHADGS LAALLGASPG ASTAVPLMIR LMHQCFPERT

451 PSWEGRLKEL VPGYGIKLNE NPERADEIIA YTAKVLDI* m165/a165 99.7% identity in 365 aa overlap 10         20         30         40         50         60
   m165.pep  MAEATDVVLVGGGIMSATLGVLLKELEPSWEITLIERLEDVALESSNAWNNAGTGHSALC
             ||||||||||||||||||||||||||||||||||||||||||||||||||||||||||||
   a165      MAEATDVVLVGGGIMSATLGVLLKELEPSWEITLIERLEDVALESSNAWNNAGTGHSALC
                  10         20         30         40         50         60

70         80         90        100        110        120
   m165.pep  ELNYAPLGANGIIDPARALNIAEQFHVSRQFWATLVAEGKLEDNSFINAVPHMSLVMNED
             ||||||||||||||||||||||||||||||||||||||||||||||||||||||||||||
   a165      ELNYAPLGANGIIDPARALNIAEQFHVSRQFWATLVAEGKLEDNSFINAVPHMSLVMNED
                  70         80         90        100        110        120
```

-continued

```
              130        140        150        160        170        180
m165.pep   HCSYLQKRYDAFKTQKLFENMEFSTDRNKISDWARLMMRGRDENQPVAANYSAEGTDVDF
           ||||||||||||||||||||||||||||||||||||||||||||||||||||||||||||
a165       HCSYLQKRYDAFKTQKLFENMEFSTDRNKISDWARLMMRGRDENQPVAANYSAEGTDVDF
              130        140        150        160        170        180

190        200        210        220        230        240
m165.pep   GRLTRQMVKYLQGKGVKTEFNRHVEDIKRESDGAWVLKTADTRNPDGQLTLRTRFLFLGA
           ||||||||||||||||||||||||||||||||||||||||||||||||||||||||||||
a165       GRLTRQMVKYLQGKGVKTEFNRHVEDIKRESDGAWVLKTADTRNPDGQLTLRTRFLFLGA
              190        200        210        220        230        240

250        260        270        280        290        300
m165.pep   GGGALTLLQKSGIPEGKGYGGFPVSGLFFRNSNPETAEQHNAKVYGQASVGAPPMSVPHL
           ||||||||||||||||||||||||||||||||||||||||||||||||||||||||||||
a165       GGGALTLLQKSGIPEGKGYGGFPVSGLFFRNSNPETAEQHNAKVYGQASVGAPPMSVPHL
              250        260        270        280        290        300

310        320        330        340        350
m165.pep   DTRNVDGKRHLMFGPYAGFRSNFLKQGSLMDLPLSIHMDNLYPMLRAGWANMPLTK
           ||||||||||||||||||||||||||||||||||||||||||||||||||||||||
a165       DTRNVDGKRHLMFGPYAGFRSNFLKQGSLMDLPLSIHMDNLYPMLRAGWANMPLTKYLLG
              310        320        330        340        350        360 a165       ELRKTKEERFASLLEYYPEANPDDWELITAGQRVQIIKKDSEKGGVLQFGTEIVAHADGS
              370        380        390        400        410        420
```

The following partial DNA sequence was identified in *N. gonorrhoeae* <SEQ ID 691>:

```
g165-1.seq
   1 ATGGCTGAAG CGACAGACGT TGTCTTGGTG GCGGCGGCA TTATGAGCGC

51 GACTTTGGGC GTTTTGCTCA AGAACTCGA ACCGTCTTGG GAAATCACCC

101 TGATTGAACG CTTGGAagat gTGGCGTTGG AATCGTCAAA cGCGTGGAAC

151 AACGcCGgca CGGGGCATTC CGcGCTGTGc GAATTGAACT AtgcgccGCT

201 GGGtgcggac ggcgtcatCA ATCCGGCGCg cgCCCTGAAT ATTGCCGAAC

251 AGTTTCATGT CAGCCGCCAG TTTTGGGcga cgctggTCGC GGAAGGCAAG

301 TTGGAAGACA ATTCCTTCAT CAATGCCGTG CCGCATATGT CTTTGGTGAT

351 GAACGAAGAC CACTGCCGTT ACCTGCAAAA ACGCTATGAT GTGTTTAAAA

401 CGCAGAAACT TTTTGAAAAT ATGGAATTTT CCACCGATCG GAACAAAATT

451 TCCGATTGGG CtccgCTGAT TATGCGCGGC CGGGACGAAA ACCAACCCGT

501 CGCCGCCAAC TATTCCGCCG AAGGCACGGA TGTCGATTTC GGACGGCTGA

551 CGCGCCAGAT GGTGAAATAT TTGCAGGGCA AGGGCGTAAA AACCGAGTTC

601 AACCGCCACG TCGAAGACAT CAAACGCGAA TCCGACGGCG CGTGGGTGCT

651 CAAAACCGCC GATACCCGCA ACCCAGACTG GCAGCTCACC CTCCGCACCC

701 GCTTCCTCTT CCTCGGCGCG GGCGGCGGCG CACTGACCCT GCTGCAAAAA

751 TCCGGCATCC CCGAAGGCAA AGGCTACGGC GGCTTACCCG TGTCCGGCCT

801 GTTCTTCCGC AACAGCAACC CCGAAACCGC CGAACAACAC AACGCCAAAG

851 TGTACGGGCA GGCTTCCGTC GGCGCGCCGC CGATGTCCGT CCCGCACCTC

901 GACACACGCA ACGTAGACGG CAAACGACAC CTTATGTTCG GTCCTTACGC

951 AGGTTTCCGT TCCAACTTCC TCAAGCAAGG CTCGTTTATG GATTTGCCGC

1001 TGTCCATCCA TATGGACAAC CTCTATCCTA TGCTGCGCGC CGGCTGGGCG

1051 AATATGCCGC TGACCAAATA CCTGCTGGGC GAATTGCGTA AAACCAAAGA

1101 AGAACGCTtt gCCTCCCTGC TGgaatacta cccGaggcag acccGACGAc 1151 tggtactcat cacgcaggnc acGCGTcata tcattanata tgactCgaaa 1201 ctgcgcgtgc tgcagttgta cgagattgtg ccaCGCGacg ctcgctcgcg
```

-continued

```
1251 cattctggag cgtcgcggcg catcacgctn tgcgctgata tccgctgatg 1301 acactgctcc gaGCGcgccc gtcttggaaa gtgtctga
```

This corresponds to the amino acid sequence <SEQ ID 692; ORF 165-1.ng>:

```
g165-1.pep
  1 MAEATDVVLV GGGIMSATLG VLLKELEPSW EITLIERLED VALESSNAWN

51 NAGTGHSALC ELNYAPLGAD GVINPARALN IAEQFHVSRQ FWATLVAEGK

101 LEDNSFINAV PHMSLVMNED HCRYLQKRYD VFKTQKLFEN MEFSTDRNKI

151 SDWAPLIMRG RDENQPVAAN YSAEGTDVDF GRLTRQMVKY LQGKGVKTEF

201 NRHVEDIKRE SDGAWVLKTA DTRNPDWQLT LRTRFLFLGA GGGALTLLQK

251 SGIPEGKGYG GLPVSGLFFR NSNPETAEQH NAKVYGQASV GAPPMSVPHL

301 DTRNVDGKRH LMFGPYAGFR SNFLKQGSFM DLPLSIHMDN LYPMLRAGWA

351 NMPLTKYLLG ELRKTKEERF ASLLEYYPRQ TRRLVLITQX TRHIIXYDSK

401 LRVLQLYEIV PRDARSRILE RRGASRXALI SADDTAPSAP VLESV*
```

The following partial DNA sequence was identified in *N. meningitidis* <SEQ ID 693>:

```
m165-1.seq
   1 ATGGCTGAAG CGACAGACGT TGTCTTGGTG GGCGGCGGCA TTATGAGCGC

51 GACTTTGGGC GTTTTGCTCA AAGAACTCGA ACCGTCTTGG GAAATCACCC

101 TGATTGAACG CTTGGAAGAT GTGGCGTTGG AATCGTCAAA CGCGTGGAAC

151 AACGCCGGCA CGGGGCATTC CGCGCTGTGC GAATTGAACT ATGCGCCGTT

201 GGGTGCAAAT GGGATTATCG ATCCGGCGCG CGCCCTCAAT ATTGCCGAAC

251 AGTTTCATGT CAGCCGCCAG TTTTGGGCGA CGCTGGTCGC GGAAGGCAAG

301 TTGGAAGACA ATTCCTTCAT CAATGCCGTG CCGCATATGT CTTTGGTGAT

351 GAATGAAGAC CATTGTTCTT ATCTTCAAAA ACGTTATGAC GCGTTTAAAA

401 CCCAAAAACT TTTTGAAAAT ATGGAATTTT CCACCGATCG GAACAAAATT

451 TCCGATTGGG CTCCGCTGAT GATGCGCGGC CGGGACGAAA ACCAACCCGT

501 CGCCGCCAAC TACTCCGCCG AAGGTACGGA TGTCGATTTC GGACGGCTGA

551 CGCGCCAAAT GGTGAAATAT TTGCAGGGCA AGGGCGTAAA AACCGAGTTC

601 AACCGCCACG TCGAAGACAT CAAACGCGAA TCCGACGGCG CGTGGGTGCT

651 CAAAACCGCC GATACCCGCA ACCCCGACGG CAGCTCACC CTCCGTACCC

701 GCTTCCTCTT CCTCGGCGCG GCGGCGGCG CGCTGACCCT GCTGCAAAAA

751 TCCGGCATCC CCGAAGGCAA AGGCTACGGC GGCTTCCCCG TGTCCGGCCT

801 GTTCTTCCGC AACAGCAACC CCGAAACCGC CGAACAACAC AACGCCAAAG

851 TGTACGGGCA GGCTTCCGTC GGCGCGCCGC CGATGTCCGT CCCGCACCTC

901 GACACACGCA ACGTGGACGG CAAACGCCAC CTTATGTTCG GCCCTTACGC

951 AGGCTTCCGT TCCAACTTCC TCAAGCAAGG CTCGCTTATG GATTTGCCGC

1001 TGTCCATCCA TATGGACAAC CTCTATCCTA TGCTGTGCGC CGGCTGGGCG

1051 AATATGCCGC TGACCAAATA CCTGCTGGGC GAATTGCGTA AAACCAAAGA

1101 AGAACGCTTC GCCTCCCTGC TGGAATACTA CCCCGAGGCA AACCCCGACG
```

-continued

```
1151 ACTGGGAACT CATCACCGCA GGGCAACGCG TCCAAATCAT TAAAAAAGAC

1201 TCCGAAAAAG GCGGCGTGCT CCAGTTTGGT ACGGAGATTG TCGCCCACGC

1251 CGACGGCTCA CTCGCCGCAT TGCTGGGCGC GTCGCCGGGC GCATCGACCG

1301 CTGTGCCGCT GATGATCCGG CTGATGCACC AATGCTTCCC CGAGCGCGCC

1351 CCGTCTTGGG AAGACCGTCT GAAAGAGCTG GTACCGGGTT ACGGCATCAA

1401 GTTGAACGAA AACCCTGAAA GGGCGGATGA AATTATCGCC TATACCGCGA

1451 AAGTATTGGA TATTTAA
```

This corresponds to the amino acid sequence <SEQ ID 694; ORF 165-1>:

```
m165-1.PEP

1 MAEATDVVLV GGGIMSATLG VLLKELEPSW EITLIERLED VALESSNAWN

51 NAGTGHSALC ELNYAPLGAN GIIDPARALN IAEQFHVSRQ FWATLVAEGK

101 LEDNSFINAV PHMSLVMNED HCSYLQKRYD AFKTQKLFEN MEFSTDRNKI

151 SDWAPLMMRG RDENQPVAAN YSAEGTDVDF GRLTRQMVKY LQGKGVKTEF

201 NRHVEDIKRE SDGAWVLKTA DTRNPDGQLT LRTRFLFLGA GGGALTLLQK

251 SGIPEGKGYG GFPVSGLFFR NSNPETAEQH NAKVYGQASV GAPPMSVPHL

301 DTRNVDGKRH LMFGPYAGFR SNFLKQGSLM DLPLSIHMDN LYPMLCAGWA

351 NMPLTKYLLG ELRKTKEERF ASLLEYYPEA NPDDWELITA GQRVQIIKKD

401 SEKGGVLQFG TEIVAHADGS LAALLGASPG ASTAVPLMIR LMHQCFPERA

451 PSWEDRLKEL VPGYGIKLINE NPERADEIIA YTAKVLDI*
``` m165-1/g165-1 89.7% identity in 428 aa overlap

```
                 10         20         30         40         50         60
m165-1.pep  MAEATDVVLVGGGIMSATLGVLLKELEPSWEITLIERLEDVALESSNAWNNAGTGHSALC
            ||||||||||||||||||||||||||||||||||||||||||||||||||||||||||||
g165-1      MAEATDVVLVGGGIMSATLGVLLKELEPSWEITLIERLEDVALESSNAWNNAGTGHSALC
                 10         20         30         40         50         60

70         80         90        100        110        120
m165-1.PEP  ELNYAPLGANGIIDPARALNIAEQFHVSRQFWATLVAEGKLEDNSKINAVPHMSLVMNED
            ||||||||||:|:|:|||||||||||||||||||||||||||||||:||||||||||||
g165-1      ELNYAPLGADGVINPARALNIAEQFHVSRQFWATLVAEGKLEDNSFINAVPHMSLVMNED
                 70         80         90        100        110        120

130        140        150        160        170        180
m165-1.pep  HCSYLQKRYDAFKTQKLFENMEFSTDRNKISDWAPLMMRGRDENQPVAANYSAEGTDVDF
            ||:||||||| |||||||||||||||||||||||||:|||||||||||||||||||||||
g165-1      HCRYLQKRYDVFKTQKLFENMEFSTDRNKISDWAPLIMRGRDENQPVAANYSAEGTDVDF
                130        140        150        160        170        180

190        200        210        220        230        240
m165-1.pep  GRLTRQMVKYLQGKGVKTEFNRHVEDIKRESDGAWVLKTADTRNPDGQLTLRTRFLFLGA
            |||||||||||||||||||||||||||||||||||||||||||||:|||||||||||||
g165-1      GRLTRQMVKYLQGKGVKTEFNRHVEDIKRESDGAWVLKTADTRNPDWQLTLRTRFLFLGA
                190        200        210        220        230        240

250        260        270        280        290        300
m165-1.pep  GGGALTLLQKSGIPEGKGYGGFPVSGLFFRNSNPETAEQHNAKVYGQASVGAPPMSVPHL
            |||||||||||||||||||||:||||||||||||||||||||||||||||||||||||||
g165-1      GGGALTLLQKSGIPEGKGYGGLPVSGLFFRNSNPETAEQHNAKVYGQASVGAPPMSVPHL
                250        260        270        280        290        300

310        320        330        340        350        360
m165-1.pep  DTRNVDGKRHLMFGPYAGFRSNFLKQGSLMDLPLSIHMDNLYPMLCAGWANMPLTKYLLG
            ||||||||||||||||||||||||||||:|||||||||||||||:|||||||||||||||
g165-1      DTRNVDGKRHLMFGPYAGFRSNFLKQGSFMDLPLSIHMDNLYPMLRAGWANMPLTKYLLG
                310        320        330        340        350        360

370        380        390        400        410        420
m165-1.pep  ELRKTKEERFASLLEYYPEANPDDWELITAGQRVQIIKKDSEKGGVLQFGTEIVAHADGS
            ||||||||||||||||:: ||| |:|| || |||:  :   |:
g165-1      ELRKTKEERFASLLEYYRR-QTRRLVLITQXTR-HIIXYDS-KLRVLQLYEIVPRDARSR
                370        380        390        400        410        420
```

```
                       430       440       450       460       470       480
m165-1.pep  LAALLGASPGASTAVPLMIRLMHQCFPERAPSWEDRLKELVPGYGIKLNENPERADEIIA
            :   |||
g165-1      ILERRGASRXALISADDTAPSAPVLESVX
            420       430       440
```

The following partial DNA sequence was identified in *N. meningitidis* <SEQ ID 695>:

```
a165-1.seq
   1 ATGGCTGAAG CGACAGACGT TGTCTTGGTG GGCGGCGGCA TTATGAGCGC

51 GACTTTGGGC GTTTTGCTCA AGAACTCGA  ACCGTCTTGG GAAATCACCC

101 TGATTGAACG CTTGGAAGAT GTGGCGTTGG AATCGTCAAA CGCGTGGAAC

151 AACGCCGGCA CGGGGCATTC CGCGCTGTGC GAATTGAACT ATGCGCCGTT

201 GGGTGCAAAT GGGATTATCG ATCCGGCGCG CGCCCTCAAT ATTGCCGAAC

251 AGTTTCATGT CAGCCGCCAG TTTTGGGCGA CGTTGGTCGC GGAAGGCAAG

301 TTGGAAGACA ATTCCTTCAT CAATGCCGTG CCGCATATGT CTTTGGTGAT

351 GAATGAAGAC CATTGTTCTT ATCTTCAAAA ACGTTATGAC GCGTTTAAAA

401 CCCAAAAACT TTTTGAAAAT ATGGAATTTT CCACCGATCG GAACAAAATT

451 TCCGATTGGG CTCCGCTGAT GATGCGCGGC CGGGACGAAA ACCAACCCGT

501 CGCCGCCAAC TACTCCGCCG AAGGCACGGA TGTCGATTTC GGACGGCTGA

551 CGCGCCAAAT GGTGAAATAT TTGCAGGGCA AGGGCGTAAA AACCGAGTTC

601 AACCGCCACG TCGAAGACAT CAAACGCGAA TCCGACGGCG CGTGGGTGCT

651 CAAAACCGCC GATACCCGCA ACCCCGACGG GCAGCTCACC CTCCGTACCC

701 GCTTCCTCTT CCTCGGCGCG GGCGGCGGCG CGCTGACCCT GCTGCAAAAA

751 TCCGGCATCC CCGAAGGCAA AGGCTACGGT GGCTTTCCCG TGTCCGGCCT

801 GTTCTTCCGC AACAGCAACC CCGAAACCGC CGAACAACAC AACGCCAAAG

851 TGTACGGGCA GGCTTCCGTC GGCGCGCCGC CGATGTCCGT CCCGCACCTC

901 GACACACGCA ACGTGGACGG CAAACGCCAC CTTATGTTCG GCCCTTACGC

951 AGGCTTCCGT TCCAACTTCC TCAAGCAAGG CTCACTTATG GATTTGCCGC

1001 TGTCCATCCA TATGGACAAC CTCTATCCTA TGCTGCGCGC CGGCTGGGCG

1051 AATATGCCGC TGACCAAATA CCTGCTGGGC GAATTGCGTA AAACCAAAGA

1101 AGAACGCTTC GCCTCCCTGC TGGAATACTA CCCCGAGGCA AACCCCGACG

1151 ACTGGGAACT CATCACCGCA GGGCAACGCG TTCAAATCAT TAAAAAAGAC

1201 TCCGAAAAAG GCGGCGTGTT GCAGTTTGGT ACGGAGATTG TCGCACACGC

1251 CGACGGCTCG CTCGCCGCAT TGCTGGGCGC GTCGCCGGGC GCATCGACCG

1301 CCGTGCCGCT GATGATCCGG CTGATGCACC AATGCTTCCC CGAACGCACC

1351 CCGTCTTGGG AAGGCCGTCT GAAAGAGCTG GTACCGGGTT ACGGCATCAA

1401 GTTGAACGAA AACCCCGAAA GGGCGGATGA AATTATCGCC TATACCGCGA

1451 AAGTGTTGGA TATTTAA
```

This corresponds to the amino acid sequence <SEQ ID 696; ORF 165-1.a>:

```
a165-1.pep

1  MAEATDVVLV GGGIMSATLG VLLKELEPSW EITLIERLED VALESSNAWN

51  NAGTGHSALC ELNYAPLGAN GIIDPARALN IAEQFHVSRQ FWATLVAEGK

101  LEDNSFINAV PHMSLVMNED HCSYLQKRYD AFKTQKLFEN MEFSTDRNKI

151  SDWAPLMMRG RDENQPVAAN YSAEGTDVDF GRLTRQMVKY LQGKGVKTEF

201  NRHVEDIKRE SDGAWVLKTA DTRNPDGQLT LRTRFLFLGA GGGALTLLQK

251  SGIPEGKGYG GFPVSGLFFR NSNPETAEQH NAKVYGQASV GAPPMSVPHL

301  DTRNVDGKRH LMFGPYAGFR SNFLKQGSLM DLPLSIHMDN LYPMLRAGWA

351  NMPLTKYLLG ELRKTKEERF ASLLEYYPEA NPDDWELITA GQRVQIIKKD

401  SEKGGVLQFG TEIVAHADGS LAALLGASPG ASTAVPLMIR LMHQCFPERT

451  PSWEGRLKEL VPGYGIKLNE NPERADEIIA YTAKVLDI*
``` a165-1/m165-1  99.4% identity in 488 aa overlap

```
                        10         20         30         40         50         60
a165-1.pep  MAEATDVVLVGGGIMSATLGVLLKELEPSWEITLIERLEDVALESSNAWNNAGTGHSALC
            ||||||||||||||||||||||||||||||||||||||||||||||||||||||||||||
m165-1      MAEATDVVLVGGGIMSATLGVLLKELEPSWEITLIERLEDVALESSNAWNNAGTGHSALC
                    10         20         30         40         50         60
                        70         80         90        100        110        120
a165-1.pep  ELNYAPLGANGIIDPARALNIAEQFHVSRQFWATLVAEGKLEDNSFINAVPHMSLVMNED
            ||||||||||||||||||||||||||||||||||||||||||||||||||||||||||||
m165-1      ELNYAPLGANGIIDPARALNIAEQFHVSRQFWATLVAEGKLEDNSFINAVPHMSLVMNED
                    70         80         90        100        110        120
                       130        140        150        160        170        180
a165-1.pep  HCSYLQKRYDAFKTQKLFENMEFSTDRNKISDWAPLMMRGRDENQPVAANYSAEGTDVDF
            ||||||||||||||||||||||||||||||||||||||||||||||||||||||||||||
m165-1      HCSYLQKRYDAFKTQKLFENMEFSTDRNKISDWAPLMMRGRDENQPVAANYSAEGTDVDF
                   130        140        150        160        170        180
                       190        200        210        220        230        240
a165-1.pep  GRLTRQMVKYLQGKGVKTEFNRHVEDIKRESDGAWVLKTADTRNPDGQLTLRTRFLFLGA
            ||||||||||||||||||||||||||||||||||||||||||||||||||||||||||||
m165-1      GRLTRQMVKYLQGKGVKTEFNRHVEDIKRESDGAWVLKTADTRNPDGQLTLRTRFLFLGA
                   190        200        210        220        230        240
                       250        260        270        280        290        300
a165-1.pep  GGGALTLLQKSGIPEGKGYGGFPVSGLFFRNSNPETAEQHNAKVYGQASVGAPPMSVPHL
            ||||||||||||||||||||||||||||||||||||||||||||||||||||||||||||
m165-1      GGGALTLLQKSGIPEGKGYGGFPVSGLFFRNSNPETAEQHNAKVYGQASVGAPPMSVPHL
                   250        260        270        280        290        300
                       310        320        330        340        350        360
a165-1.pep  DTRNVDGKRHLMFGPYAGFRSNFLKQGSLMDLPLSIHMDNLYPMLRAGWANMPLTKYLLG
            |||||||||||||||||||||||||||||||||||||||||||||| |||||||||||||
m165-1      DTRNVDGKRHLMFGPYAGFRSNFLKQGLSMDLPLSIHMDNLYPMLCAGWANMPLTKYLLG
                   310        320        330        340        350        360
                       370        380        390        400        410        420
a165-1.pep  ELRKTKEERFASLLEYYPEANPDDWELITAGQRVQIIKKDSEKGGVLQFGTEIVAHADGS
            ||||||||||||||||||||||||||||||||||||||||||||||||||||||||||||
m165-1      ELRKTKEERFASLLEYYPEANPDDWELITAGQRVQIIKKDSEKGGVLQFGTEIVAHADGS
                   370        380        390        400        410        420
                       430        440        450        460        470        480
a165-1.pep  LAALLGASPGASTAVPLMIRLMHQCFPERTPSWEGRLKELVPGYGIKLNENPERADEIIA
            |||||||||||||||||||||||||||||:||||||||||||||||||||||||||||||
m165-1      LAALLGASPGASTAVPLMIRLMHQCFPERAPSWEDRLKELVPGYGIKLNENPERADEIIA
                   430        440        450        460        470        480
                       489
a165-1.pep  YTAKVLDIX
            |||||||||
m165-1      YTAKVLDIX
``` a165-1/p33940
 sp|P33940|YOJH_ECOLI HYPOTHETICAL 60.2 KD PROTEIN IN ECO-ALKB INTERGENIC
REGION >gi|1736851|gln|PID|d1016718 (D90850) ORF_ID:o372#5; similar to
[SwissProt Accession Number P33940] [Escherichia coli] >gi|1788539 (AE000310)
f548; This 548 aa ORF is 100 pct identical to 490 residues of
YOJH_ECOLI SW: P33940 (492 aa) but contains 56 additional N-ter aa; 100 pct
identical to GB: ECOHU49_33
ACCESSION: U00008 (490 aa) but contains 58 aditional N-term resi... Length = 548
 Score = 458 bits (1167), Expect = e-128
 Identities = 233/490 (47%), Positives = 303/490 (61%), Gaps = 5/490 (1%)

```
Query:   3  EATDVVLVGGGIMSATLGVLLKELEPSWEITLIERLEDVALESSNAWNNAGTGHSALCEL   62
            + TDV+L+GGGIMSATLG  L+ELEP W +T++ERLE VA ESSN WNNAGTGHSAL EL
Sbjct:  30  QETDVLLIGGGIMSATLGTYLRELEPEWSMTMVERLEGVAQESSNGWNNAGTGHSALMEL   89

Query:  63  NYAPLGANGIIDPARALNIAEQFHVSRQFWATLVAEGKLED-NSFINAVPHMSLVMNEDH   121
            NY P  A+G I   +A+ I E F +SRQFWA  V  G L    SFIN VPHMS V ED+
Sbjct:  90  NYTPQNADGSISIEKAVAINEAFQISRQFWAHQVERGVLRTPRSFINTVPHMSFVWGEDN   149

Query: 122  CSYLQKRYDAFKTQKLFENMEFSTDRNKISDWAPLMMRGRDENQPVAANYSAEGTDVDFG   181
            ++L+ RY A +   LF  M +S D  +I +WAPL+M GRD  Q VAA  +  GTDV++G
Sbjct: 150  VNFLRARYAALQQSSLFRGMRYSEDHAQIKEWAPLVMEGRDPQQKVAATRTEIGTDVNYG   209

Query: 182  RLTRQMVKYLQGKG-VKTEFNRHVEDIKRESDGAWVLKTADTRNPDGQLTXXXXXXXXXX   240
            +TRQ++  LQ K    + +  V  +KR  D    W +   AD +N    Q
Sbjct: 210  EITRQLIASLQKKSNFSLQLSSEVRALKRNDDNTWTVTVADLKNGTAQ-NIRAKFVFIGA   268

Query: 241  XXXXXXXXQKSGIPEGKGYGGFPVSGLFFRNSNPETAEQHNAKVYGQASVGAPPMSVPHL   300
                    Q+SGIPE K Y GFPV G F + NP+   H AKVYG+ASVGAPPMSVPH+
Sbjct: 269  GGAALKLLQESGIPEAKDYAGFPVGGQFLVSENPDVVNHHLAKVYGKASVGAPPMSVPHI   328

Query: 301  DTRNVDGKRHLMFGPYAGFRSNFLKQGSLMDLPLSIHMDNLYPMLRAGWANMPLTKYLLG   360
            DTR +DGKR ++FGP+A F +  FLK GSL DL S     N+ PM+   G  N   L KYL+
Sbjct: 329  DTRVLDGKRVVLFGPFATFSTKFLKNGSLWDLMSSTTTSNVMPMMHVGLDNFDLVKYLVS   388

Query: 361  ELRKTKEERFASLLEYYPEANPDDWELITAGQRVQIIKKDSEKGGVLQFGTEIVXXXXXX   420
            ++  ++E+RF +L EYYP+A   +DW L  AGQRVQIIK+D+EDGGVL+ GTE+V
Sbjct: 389  QVMLSEEDRFEALKEYYPQAKKEDWRLWQAGQRVQIIKRDAEKGGVLRLGTEVVSDQQGT   448

Query: 421  XXXXXXXXXXXXXXVPLMIRLMHQCFPER--TPSWEGRLKELVPGYGIKLNENPERADEI   478
                          P+M+ L+ + F +R  +P W+  LK +VP YG KLN +    +
Sbjct: 449  IAALLGASPGASTAAPIMLNLLEKVFGDRVSSPQWQATLKAIVPSYGRKLNGDVAATERE   508

Query: 479  IAYTAKVLDI                                                    488
            + YT++VL +
Sbjct: 509  LQYTSEVLGL                                                    518
```

The following partial DNA sequence was identified in *N. gonorrhoeae* <SEQ ID 697>:

```
g204.seq
  1  atggcggcgg cggaaataaa acgcccctc gctgtcgatt tccagcacat 51  agcgtccgtt ctgcacggcg gcatagccgc ttttgcctgc ctgatagggt 101  tgcaggcgg aatgcgaaat caggtaatca gtcagtttgc cgccgtcttc 151  ggcgatattg cccaccagtt tggcaaacaa ggtatggcac acgccgtttt 201  ccgcccagcc cgaaggcgcg tcctttccgt cggtttccat acatttgccg 251  acgacggctt ccaagtcgtt gggatgcttt ccggtcagcc ggacggcgtt 301  ttgttccggc aagcctttaa tcggataact gatttgtttt ttgccgtcgt 351  tggttttgcc ttcgctactt tgtcccaaag ccaaaccggc aatcgccgta 401  ttgtcgatgt atttgacttt gaaaaccggt tcggcgcgc tttgtgccgc 451  attttgcggc tgttccgccg tattttcgga tttgccgcag gcggcaagca 501  gcaggcagcc gcccaacacg gcaaaaggta ttttcagcat tccgcactcc 551  tgatggtttc aaaatgccgt ctgaaatgcc gtctgaaacg tggcaggcgg 601  aggttcggac ggcattgggt ttatttcaac gggcggatgc cgaccgcatc 651  gcgtacttta tccaacaatt cgcgcgcttc tttgcgcgct ttttgcgcgc 701  ctgcctgcaa aatctcttcg atttgcgaag gattagaggt caatgcgttg 751  tag
```

This corresponds to the amino acid sequence <SEQ ID 698; ORF 204.ng>:

```
g204.pep
  1  MAAAEIKRPL AVDFQHIASV LHGGIAAFAC LIGLQGGMRN QVISQFAAVF

51  GDIAHQFGKQ GMAHAVFRPA RRRVLSVGFH TFADDGFQVV GMLSGQPDGV

101  LFRQAFNRIT DLFFAVVGFA FATLSQSQTG NRRIVDVFDF ENRFRRALCR
```

-continued
```
151 ILRLFRRIFG FAAGGKQQAA AQHGKRYFQH SALLMVSKCR LKCRLKRGRR

201 RFGRHWVYFN GRMPTASRTL SNNSRASLRA FCAPACKISS ICEGLEVNAL

251 *
```

The following partial DNA sequence was identified in *N. meningitidis* <SEQ ID 699>:

```
m204.seq
  1 ATGGCGGCGG CGGAAATAAA ACGCCCCTTC GCTGTCGATT TCCAGCACAT

51 AGCGTCCGTT CTGCACGGCG GCATAGCCGC TTTTGCCTGC CTGATAGGGT

101 TGCAGGGCGG CATGCGAAAC TAGGTAATCC GTCAGTTTGC CGCCGTCTTC

151 GGCGATATTG CCCACCAGTT TGGCAAACAA GGTATGGCAC ACGCCGTTTT

201 CTGCCCAACC TGCCGGACTG TCCTTATCAT CGGTTTCCAT ACATTTGCCG

251 CTGACGGCTT CCAAGTCGCC GGGATGCTTG CCGATCAGTC GGATAACATT

301 TTGTTCCGGC AAGCCTTTAA TCGGATAACT GATTTGTTTT TTGCCGTCGT

351 TGGTTTTGCC TTCGCTGCTT TGTCCCAAAT CCAAACCGGC AATCGCCGTA

401 TTGTCGATAT ATATGACTTT GAAAACCGGT TTCGGCGCGC TTTGTACCGC

451 GTTTTGCGGC TGTACCGCCG TATTTwCGGA TTTGCCGCaC GGCaArGCAG

501 CAGGCAGCCG CCCAATACGG CAAAArAwGT wTTCAGCATT CCACAyTCCT

551 GATGGTTTCA AAATGCCGTC TGAAACGCGG CAGGCGGAGG TTCGGACGGC

601 ATCGGGTTCA TTTCAACGGG CGGATGcCGA CCGCATCgGT ACTTTGTCCA

651 ATAATTCGCG TGCTTCTTTA CGCGCTTTCG CCGCGCCTGC CTGCAAAATC

701 TCTTCGATTT GCGAAGGGTC GGCGGTCAGC TCGTTGTAG
```

This corresponds to the amino acid sequence <SEQ ID 700; ORF 204 >:

```
m204.pep
  1 MAAAEIKRPF AVDFQHIASV LHGGIAAFAC LIGLQGGMRN *VIRQFAAVF

51 GDIAHQFGKQ GMAHAVFCPT CRTVLIIGFH TFAADGFQVA GMLADQSDNI

101 LFRQAFNRIT DLFFAVVGFA FAALSQIQTG NRRIVDIYDF ENRFRRALYR

151 VLRLYRRIXG FAATAXQQAA AQYGKXXXQH STXLMVSKCR LKRGRRRFGR

201 HRVHFNGRMP TASGTLSNNS RASLRAFAAP ACKISSICEG SAVSSL*
```

Computer analysis of this amino acid sequence gave the following results:
Homology with a Predicted ORF from *N. gonorrhoeae*
ORF 204 shows 82.0% identity over a 250 aa overlap with a predicted ORF (ORF 204.ng) from *N. gonorrhoeae*:

```
m204/g204
                  10         20         30         40         50         60
    m204.pep   MAAAEIKRPFAVDFQHIASVLHGGIAAFACLIGLQGGMRNXVIRQFAAVFGDIAHQFGKQ
               ||||||||:||||||||||||||||||||||||||||| || ||||||||||||||||||
    g204       MAAAEIKRPLAVDFQHIASVLHGGIAAFACLIGLQGGMRNQVISQFAAVFGDIAHQFGKQ
                  10         20         30         40         50         60

70         80         90        100        110        120
    m204.pep   GMAHAVFCPTCRTVLIIGFHTFAADGFQVAGMLADQSDNILFRQAFNRITDLFFAVVGFA
               |||||||  |: | ||:||||| |||||:|||:||| | |::|||||||||||||||||
    g204       GMAHAVFRPARRRVLSVGFHTFADDGFQVVGMLSGQPDGVLFRQARNRITDLFFAVVGFA
                  70         80         90        100        110        120
```

-continued

```
                130       140       150       160       170       180
m204.pep    FAALSQIQTGNRRIVDIYDFENRFRRALYRVLRLYRRIXGFAATAXQQAAAQYGKXXXQH
            ||:|||  |||||||||::|||||||||| |:|||:||| ||||  : |||||| ||    ||
g204        FATLSQSQTGNRRIVDVFDFENRFRRALCRILRLFRRIFGFAAGGKQQAAAQHGKRYFQH
                130       140       150       160       170       180

190       200       210       220       230
m204.pep    STXLMVSKCRLK----RGRRRFGRHRVHFNGRMPTASGTLSNNSRASLRAFAAPACKISS
            |: ||||||||||    |||||||||| |:|||||||||| ||||||||||||| |||||||||
g204        SALLMVSKCRLKCRLKRGRRRFGRHWVYFNGRMPTASRTLSNNSRASLRAFCAPACKISS
                190       200       210       220       230       240

240
m204.pep    ICEGSAVSSLX
            ||||   |::|
g204        ICEGLEVNAL
                250
```

The following partial DNA sequence was identified in *N. meningitidis* <SEQ ID 701>:

```
a204.seq
   1  ATGGCGGCGG CGGAAATAAA ACGCCCCCTC GCTGTCGATT TCCAGCACAT

51  AGCGTCCGTT CTGCACGGCG GCATAGCCGC TTTTGCCTGC CTGATAGGGT

101  TGCAGGGCGG AATGCGAAAT CAGGTAATCC GTCAGTTTGC CGCCGTCTTC

151  GGCGATATTG CCCACCAGTT TGGCAAACAA GGTATGGCAC ACGCCGTTTG

201  CCGGTCAGCC CGAAGGCGCG CCCTTTCCGT CGGTTTCCAT ACATTTGCCG

251  ACGACGGCTT CCAAGTCGTT GGGATGCTTG CCGGTCAGCC GGACGACGTT

301  TTGTTCCGGC AAGCCTTT.. .......... .......... ..........

351  .......... .......... .......... .......... ..........

401  .......... .......... .......... .......... ..........

451  .......... .......... .......... .......... ..........

501  .......... .......... .......... .......... ..........

551  .......... .......... .......... ......AAGAG GTTCGGACGG

601  CATTGGGTTT ATTTCAACGG GCGGATACCG ACCGCATCAC GTACTTTGCC

651  CAATAATTCG CGTGCTTCTT TACGCGCTTT TGCGCGCCT GCCTGCAAAA

701  TCTCTTCGAT TGCGAAGGG TCGGCGGTCA GCTCGTTGTA G
```

This corresponds to the amino acid sequence <SEQ ID 702; ORF 204.a>:

```
a204.pep
   1  MAAAEIKRPL AVDFQHIASV LHGGIAAFAC LIGLQGGMRN QVIRQFAAVF

51  GDIAHQFGKQ GMAHAVCRPA RRRALSVGFH TFADDGFQVV GMLAGQPDDV

101  LFRQAF.... .......... .......... .......... ..........

151  .......... .......... .......... .......... .....KRFGR

201  HWVYFNGRIP TASRTLPNNS RASLRAFCAP ACKISSICEG SAVSSL*
``` m204/a204 54.5% identity in 246 aa overlap

```
                10        20        30        40        50        60
m204.pep    MAAAEIKRPFAVDFQHIASVLHGGIAAFACLIGLQGGMRNXVIRQFAAVFGDIAHQFGKQ
            ||||||||:|||||||||||||||||||||||||||||| |||||||||||||||||||||
a204        MAAAEIKRPLAVDFQHIASVLHGGIAAFACLIGLQGGMRNQVIRQFAAVFGDIAHQFGKQ
                10        20        30        40        50        60
```

-continued

```
                  70         80         90        100        110        120
m204.pep  GMAHAVFCPTCRTVLIIGFHTFAADGFQVAGMLADQSDNILFRQAFNRITDLFFAVVGFA
          ||||||  |:  | :| :|||||| |||||:|||| | |::||||||||||||||||||
a204      GMAHAVCRPARRRALSVGFHTFADDGFQVVGMLAGQPDGVLFRQAR--------------
                  70         80         90        100

130        140        150        160        170        180
m204.pep  FAALSQIQTGNRRIVDIYDFENRFRRALYRVLRLYRRIXGFAATAXQQAAAQYGKXXXQH
a204      ------------------------------------------------------------

190        200        210        220        230        240
m204.pep  STXLMVSKCRLKRGRRRFGRHRVHFNGRMPTASGTLSNNSRASLRAFAAPACKISSICEG
           :||||  |:||||:|||| || |||||||||| |||||||||||
a204      ---------------KRFGRHWVYFNGRIPTASRTLPNNSRASLRAFCAPACKISSICEG
                         110        120        130        140        150 m204.pep  SAVSSLX
          |||||||
a204      SAVSSLX
```

The following partial DNA sequence was identified in *N. gonorrhoeae* <SEQ ID 703>:

```
g205.seq
  1 atgctgaaaa tacctttttgc cgtgttgggc ggctgcctgc tgcttgccgc 51 ctgcggcaaa tccgaaaata cggcggaaca gccgcaaaat gcggcacaaa 101 gcgcgccgaa accggttttc aaagtcaaat acatcgacaa tacggcgatt 151 gccggtttgg ctttgggaca agtagcgaa ggcaaaacca acgacggcaa 201 aaaacaaatc agttatccga ttaaaggctt gccggaacaa aacgccgtcc 251 ggctgaccgg aaagcatccc aacgacttgg aagccgtcgt cggcaaatgt 301 atggaaaccg acgaaagga cgcgccttcg ggctgggcgg aaaacggcgt 351 gtgccatacc ttgtttgcca aactggtggg caatatcgcc gaagacggcg 401 gcaaactgac tgattacctg atttcgcatt ccgccctgca accctatcag 451 gcaggcaaaa gcggctatgc cgccgtgcag aacggacgct atgtgctgga 501 aatcgacagc gagggggcgt tttatttccg ccgccgccat tattga
```

This corresponds to the amino acid sequence <SEQ ID 704; ORF 205.ng>:

```
g205.pep
  1 MLKIPFAVLG GCLLLAACGK SENTAEQPQN AAQSAPKPVF KVKYIDNTAI

51 AGLALGQSSE GKTNDGKKQI SYPIKGLPEQ NAVRLTGKHP NDLEAVVGKC

101 METDGKDAPS GWAENGVCHT LFAKLVGNIA EDGGKLTDYL ISHSALQPYQ

151 AGKSGYAAVQ NGRYVLEIDS EGAFYFRRRH Y
```

The following partial DNA sequence was identified in *N. meningitidis* <SEQ ID 705>:

```
m205.seq
  1 ATGCTGAAwA CwTyTTTTGC CGTATTGGGC GGCTGCCTGC TGCyTtGCCG 51 tGCGGCAAAT CCGwAAATAC GGCGGTACAG CCGCAAAACG CGGTACAAAG

101 CGCGCCGAAA CCGGTTTTCA AGTCATATA TATCGACAAT ACGGCGATTG

151 CCGGTTTGGA TTTGGGACAA AGCAGCGAAG GCAAAACCAA CGACGGCAAA

201 AAACAAATCA GTTATCCGAT TAAAGGCTTG CCGGAACAAA ATGTTATCCG

251 ACTGATCGGC AAGCATCCCG GCGACTTGGA AGCCGTCAGC GGCAAATGTA
```

-continued

```
301 TGGAAACCGA TGATAAGGAC AGTCCGGCAG GTTGGGCAGA AAACGGCGTG

351 TGCCATACCT TGTTTGCCAA ACTGGTGGGC AATATCGCCG AAGACGGCGG

401 CAAACTGACG GATTACCTAG TTTCGCATGC CGCCCTGCAA CCCTATCAGG

451 CAGGCAAAAG CGGCTATGCC GCCGTGCAGA ACGGACGCTA TGTGCTGGAA

501 ATCGACAGCG AAGGGGCGTT TTATTTCCGC CGCCGCCATT ATTGA
```

This corresponds to the amino acid sequence <SEQ ID 706; ORF 205>:

```
m205.pep
  1 MLXTXFAVLG GCLLXCRCGK SXNTAVQPQN AVQSAPKPVF KVIYIDNTAI

51 AGLDLGQSSE GKTNDGKKQI SYPIKGLPEQ NVIRLIGKHP GDLEAVSGKC

101 METDDKDSPA GWAENGVCHT LFAKLVGNIA EDGGKLTDYL VSHAALQPYQ

151 AGKSGYAAVQ NGRYVLEIDS EGAFYFRRRH Y*
```

Computer analysis of this amino acid sequence gave the following results:
Homology with a Predicted ORF from *N. gonorrhoeae*
ORF 205 shows 88.4% identity over a 181 aa overlap with a predicted ORF (ORF 205.ng) from *N. gonorrhoeae*:

```
m205/g205

10         20         30         40         50         60
m205.pep  MLXTXFAVLGGCLLXCRCGKSXNTAVQPQNAVQSAPKPVFKVIYIDNTAIAGLDLGQSSE
          ||  |||||||||    ||| |||  |||||:|||||||||| |||||||||||  |||||
g205      MLKIPFAVLGGCLLLAACGKSENTAEQPQNAAQSAPKPVFKVKYIDNTAIAGLALGQSSE
                 10         20         30         40         50         60

70         80         90        100        110        120
m205.pep  GKTNDGKKQISYPIKGLPEQNVIRLIGKHPGDLEAVSGKCMETDDKDSPAGWAENGVCHT
          ||||||||||||||||||||||::||  ||||:|||| |||||||:||||:||||||||||
g205      GKTNDGKKQISYPIKGLPEQNAVRLTGKHPNDLEAVVGKCMETDGKDAPSGWAENGVCHT
                 70         80         90        100        110        120

130        140        150        160        170        180
m205.pep  LFAKLVGNIAEDGGKLTDYLVSHAALQPYQAGKSGYAAVQNGRYVLEIDSEGAFYFRRRH
          ||||||||||||||||||||:||:||||||||||||||||||||||||||||||||||||
g205      LFAKLVGNIAEDGGKLTDYLISHSALQPYQAGKSGYAAVQNGRYVLEIDSEGAFYFRRRH
                130        140        150        160        170        180 m205.pep  YX
          |
g205      Y
```

The following partial DNA sequence was identified in *N. meningitidis* <SEQ ID 707>:

```
a205.seq (partial)
  1 TCCGAACCTC TTAAAGGCTT GCCGGAACAA AACGTCGTCC GGCTGACCGG

51 CAAGCATCCC AACGACTTGG AAGCCGTCGT CGGCAAATGT ATGGAAACCG

101 ACGGAAAGGG CGCGCCTTCG GGCTGGGCGG CAAACGGCGT GTGCCATACC

151 TTGTTTGCCA AACTGGTGGG CAATATCGCC GAAGACGGCG GCAAACTGAC

201 GGATTACCTG ATTTCGCATT CCGCCCTGCA ACCCTATCAG GCAGGCAAAA

251 GCGGCTATGC CGCCGTGCAG AACGGACGCT ATGTGCTGGA AATCGACAGC

301 GAGGGGGCGT TTTATTTCCG CCGCCGCCAT TATTGA
```

This corresponds to the amino acid sequence <SEQ ID 708; ORF 205.a>:

```
a205.pep (partial)
  1 SEPLKGLPEQ NVVRLTGKHP NDLEAVVGKC METDGKGAPS GWAANGVCHT

51 LFAKLVGNIA EDGGKLTDYL ISHSALQPYQ AGKSGYAAVQ NGRYVLEIDS

101 EGAFYFRRRH Y*
``` m205/a205 88.3% identity in 111 aa overlap

```
                    50         60         70         80         90        100
    m205.pep    KVIYIDNTAIAGLDLGQSSEGKTNDGKKQISYPIKGLPEQNVIRLIGKHPGDLEAVSGKC
                           | :|||||||||:|| ||||:||||| |||
    a205                                SEPLKGLPEQNVVRLTGKHPNDLEAVVGKC
                                        10         20         30
                   110        120        130        140        150        160
    m205.pep    METDDKDSPAGWAENGVCHTLFAKLVGNIAEDGGKLTDYLVSHAALQPYQAGKSGYAAVQ
                ||||   | :|:||| |||||||||||||||||||||||||:||:|||||||||||||||
    a205        METDGKGAPSGWAANGVCHTLFAKLVGNIAEDGGKLTDYLISHSALQPYQAGKSGYAAVQ
                   40         50         60         70         80         90
                   170        180
    m205.pep    NGRYVLEIDSEGAFYFRRRHYX
                ||||||||||||||||||||||
    a205        NGRYVLEIDSEGAFYFRRRHYX
                   100        110
```

The following partial DNA sequence was identified in *N. gonorrhoeae* <SEQ ID 709>:

```
g205-1.seq (partial)
   1 ATGCTGAAAA TAcCTTTTGC CGTGTTGGGC GGCTGCCTGC TGCTTGCCGC

51 CTGCGGCAAA TCCGAAAATA CGGCGGAACA GCCGCAAAAT GCGGCACAAA

101 GCGCGCCGAA ACCGGTTTTC AAAGTCAAAT ACATCGACAA TACGGCGATT

151 GCCGGTTTGG CTTTGGGACA AGTAGCGAA  GGCAAAACCA ACGACGGCAA

201 AAAACAAATC AGTTATCCGA TTAAAGGCTT GCCGGAACAA AACGCCGTCC

251 GGCTGACCGG AAAGCATCCC AACGACTTGG AAGCCGTCGT CGGCAAATGT

301 ATGGAAACCG ACGGAAAGGA CGCGCCTTCG GGCTGGGCGG AAAACGGCGT

351 GTGCCATACC TTGTTTGCCA AACTGGTGGG CAATATCGCC GAAGACGGCG

401 GCAAACTGAC TGATTACCTG ATTTCGCATT CCGCCCTGCA ACCCTATCAG

451 GCAGGCAAAA GCGGCTATGC CGCCGTGCAG AACGGACGCT ATGTGCTGGA

501 AATCGACAGC GAGGGGGCGT TTTA
```

This corresponds to the amino acid sequence <SEQ ID 710; ORF 205-1.ng>:

```
g205-1.pep (partial).
  1 MLKIPFAVLG GCLLLAACGK SENTAEQPQN AAQSAPKPVF KVKYIDNTAI

51 AGLALGQSSE GKTNDGKKQI SYPIKGLPEQ NAVRLTGKHP NDLEAVVGKC

101 METDGKDAPS GWAENGVCHT LFAKLVGNIA EDGGKLTDYL ISHSALQPYQ

151 AGKSGYAAVQ NGRYVLEIDS EGAF
```

The following partial DNA sequence was identified in *N. meningitidis* <SEQ ID 711>:

```
m205-1.seq . . .
   1 ATGCTGAAAA CATCTTTTGC CGTATTGGGC GGCTGCCTGC TGCTTGCCGC

51 CTGCGGCAAA TCCGAAAATA CGGCGGAACA GCCGCAAAAC GCGGTACAAA

101 GCGCGCCGAA ACCGGTTTTC AAAGTCAAAT ATATCGACAA TACGGCGATT

151 GCCGGTTTGG ATTTGGGACA AAGCAGCGAA GGCAAAACCA ACGACGGCAA

201 AAAACAAATC AGTTATCCGA TTAAAGGCTT GCCGGAACAA AATGTTATCC

251 GACTGATCGG CAAGCATCCC GGCGACTTGG AAGCCGTCAG CGGCAAATGT

301 ATGGAAACCG ATGATAAGGA CAGTCCGGCA GGTTGGGCAG AAAACGGCGT

351 GTGCCATACC TTGTTTGCCA AACTGGTGGG CAATATCGCC GAAGACGGCG

401 GCAAACTGAC GGATTACCTA GTTTCGCATG CCGCCCTGCA ACCCTATCAG

451 GCAGGCAAAA GCGGCTATGC CGCCGTGCAG AACGGACGCT ATGTGCTGGA

501 AATCGACAGC GAAGGGCGT TTTATTTCCG CCGCCGCCAT TATTGA
```

This corresponds to the amino acid sequence <SEQ ID 712; ORF 205-1>:

```
m205-1.pep

1   MLKTSFAVLG GCLLLAACGK SENTAEQPQN AVQSAPKPVF KVKYIDNTAI

51   AGLDLGQSSE GKTNDGKKQI SYPIKGLPEQ NVIRLIGKHP GDLEAVSGKC

101   METDDKDSPA GWAENGVCHT LFAKLVGNIA EDGGKLTDYL VSHAALQPYQ

151   AGKSGYAAVQ NGRYVLEIDS EGAFYFRRRH Y* m205/g205-1 92.0% identity in 174 aa overlap 10         20         30         40         50         60
       g205-1.pep  MLKIPFAVLGGCLLLAACGKSENTAEQPQNAAQSAPKPVFKVKYIDNTAIAGLALGQSSE
                   |||  ||||||||||||||||||||||||||||:|||||||||||||||||||   ||||||
       m205-1      MLKTSFAVLGGCLLLAACGKSENTAEQPQNAVQSAPKPVFKVKYIDNTAIAGLDLGQSSE
                      10         20         30         40         50         60

70         80         90        100        110        120
       g205-1.pep  GKTNDGKKQISYPIKGLPEQNAVRLTGKHPNDLEAVVGKCMETDGKDAPSGWAENGVCHT
                   ||||||||||||||||||||||::||  ||||:||||| |||||| ||:|:||||||||||
       m205-1      GKTNDGKKQISYPIKGLPEQNVIRLIGKHPGDLEAVSGKCMETDDKDSPAGWAENGVCHT
                      70         80         90        100        110        120

130        140        150        160        170
       g205-1.pep  LFAKLVGNIAEDGGKLTDYLISHSALPYQAGKSGYAAVQNGRYVLEIDSEGAF
                   ||||||||||||||||||||:|:|||||||||||||||||||||||||||||||
       m205-1      LFAKLVGNIAEDGGKLTDYLVSHAALQPYQAGKSGYAAVQNGRYVLEIDSEGAFYFRRRH
                     130        140        150        160        170        180
```

The following partial DNA sequence was identified in *N. meningitidis* <SEQ ID 713>:

```
a205-1.seq (partial)
   1 CCTCTTAAAG GCTTGCCGGA ACAAAACGTC GTCCGGCTGA CCGGCAAGCA

51 TCCCAACGAC TTGGAAGCCG TCGTCGGCAA ATGTATGGAA ACCGACGGAA

101 AGGGCGCGCC TTCGGGCTGG GCGGCAAACG GCGTGTGCCA TACCTTGTTT

151 GCCAAACTGG TGGGCAATAT CGCCGAAGAC GGCGGCAAAC TGACGGATTA

201 CCTGATTTCG CATTCCGCCC TGCAACCCTA TCAGGCAGGC AAAAGCGGCT

251 ATGCCGCCGT GCAGAACGGA CGCTATGTGC TGGAAATCGA CAGCGAGGGG

301 GCGTTTTATT TCCGCCGCCG CCATTATTGA
```

This corresponds to the amino acid sequence <SEQ ID 714; ORF 205-1.a>:

```
a205-1.pep (partial)
     1  PLKGLPEQNV VRLTGKHPND LEAVVGKCME TDGKGAPSGW AANGVCHTLF

51  AKLVGNIAED GGKLTDYLIS HSALQPYQAG KSGYAAVQNG RYVLEIDSEG

101  AFYFRRRHY* m205-1/a205-1  89.0% identity in 109 aa overlap 50         60         70         80         90        100
  m205-1.pep   KYIDNTAIAGLDLGQSSEGKTNDGKKQISYPIKGLPEQNVIRLIGKHPGDLEAVSGKCME
                                              |:||||||||:|| ||||:||||| |||||
  a205-1                                      PLKGLPEQNVVRLTGKHPNDLEAVVGKCME
                                                       10         20         30

110        120        130        140        150        160
  m205-1.pep   TDDKDSPAGWAENGVCHTLFAKLVGNIAEDGGKLTDYLVSHAALQPYQAGKSGYAAVQNG
               || | :|:||| |||||||||||||||||||||||||||:|:||||||||||||||||||
  a205-1       TDGKGAPSGWAANGVCHTLFAKLVGNIAEDGGKLTDYLISHSALQPYQAGKSGYAAVQNG
                        40         50         60         70         80         90

170        180
  m205-1.pep   RYVLEIDSEGAFYFRRRHYX
               ||||||||||||||||||||
  a205-1       RYVLEIDSEGAFYFRRRHYX
                       100        110
```

The following partial DNA sequence was identified in *N. gonorrhoeae* <SEQ ID 715>:

```
g206.seq
    1 atgttttccc ccgacaaaac ccttttcctc tgtctcggcg cactgctcct 51 cgcctcatgc ggcacgacct ccggcaaaca ccgccaaccg aaacccaaac 101 agacagtccg gcaaatccaa gccgtccgca tcagccacat cggccgcaca 151 caaggctcgc aggaactcat gctccacagc ctcggactca tcggcacgcc 201 ctacaaatgg ggcggcagca gcaccgcaac cggcttcgac tgcagcggca 251 tgattcaatt ggtttacaaa aacgccctca acgtcaagct gccgcgcacc 301 gcccgcgaca tggcggcggc aagccgcaaa atccccgaca gccgcctcaa 351 ggccggcgac atcgtattct caacaccgg cggcgcacac cgctactcac 401 acgtcggact ctacatcggc aacggcgaat tcatccatgc ccccggcagc 451 ggcaaaacca tcaaaaccga aaaactctcc acaccgtttt acgccaaaaa 501 ctaccttgga gcgcatacgt ttttacaga atga
```

This corresponds to the amino acid sequence <SEQ ID 716; ORF 206.ng>:

```
g206.pep
    1 MFSPDKTLFL CLGALLLASC GTTSGKHRQP KPKQTVRQIQ AVRISHIGRT

51 QGSQELMLHS LGLIGTPYKW GGSSTATGFD CSGMIQLVYK NALNVKLPRT

101 ARDMAAASRK IPDSRLKAGD IVFFNTGGAH RYSHVGLYIG NGEFIHAPGS

151 GKTIKTEKLS TPFYAKNYLG AHTFFTE*
```

The following partial DNA sequence was identified in *N. meningitidis* <SEQ ID 717>:

```
m206.seq
    1 ATGTTTCCCC CGACAAAAC CCTTTTCCTC TGTCTCAGCG CACTGCTCCT
```

-continued
```
 51 CGCCTCATGC GGCACGACCT CCGGCAAACA CCGCCAACCG AAACCCAAAC

101 AGACAGTCCG GCAAATCCAA GCCGTCCGCA TCAGCCACAT CGACCGCACA

151 CAAGGCTCGC AGGAACTCAT GCTCCACAGC CTCGGACTCA TCGGCACGCC

201 CTACAAATGG GGCGGCAGCA GCACCGCAAC CGGCTTCGAT TGCAGCGGCA

251 TGATTCAATT CGTTTACAAr AACGCCCTCA ACGTCAAGCT GCCGCGCACC

301 GCCCGCGACA TGGCGGCGGC AAGCCGsAAA ATCCCCGAcA GCCGCyTCAA

351 GGCCGGCGAC CTCGTATTCT TCAACACCGG CGGCGCACAC CGCTACTCAC

401 ACGTCGGACT CTACATCGGC AACGGCGAAT TCATCCATGC CCCCAGCAGC

451 GGCAAAACCA TCAAAACCGA AAAACTCTCC ACACCGTTTT ACGCCAAAAA

501 CTACCTCGGC GCACATACTT TTTTTACAGA ATGA
```

This corresponds to the amino acid sequence <SEQ ID 718; ORF 206>:

```
m206.pep . . .
   1 MFPPDKTLFL CLSALLLASC GTTSGKHRQP KPKQTVRQIQ AVRISHIDRT

51 QGSQELMLHS LGLIGTPYKW GGSSTATGFD CSGMIQFVYK NALNVKLPRT

101 ARDMAAASRK IPDSRXKAGD LVFFNTGGAH RYSHVGLYIG NGEFIHAPSS

151 GKTIKTEKLS TPFYAKNYLG AHTFFTE*
```

Computer analysis of this amino acid sequence gave the following results:
Homology with a Predicted ORF from *N. gonorrhoeae*
ORF 206 shows 96.0% identity over a 177 aa overlap with a predicted ORF (ORF 206.ng) from *N. gonorrhoeae*:

```
    m206/g206
                        10         20         30         40         50         60
        m206.pep    MFPPDKTLFLCLSALLLASCGTTSGKHRQPKPKQTVRQIQAVRISHIDRTQGSQELMLHS
                    || |||||||||:|||||||||||||||||||||||||||||||| ||||||||||||
        g206        MFSPDKTLFLCLGALLLASCGTTSGKHRQPKPKQTVRQIQAVRISHIGRTQGSQELMLHS
                        10         20         30         40         50         60
                        70         80         90        100        110        120
        m206.pep    LGLIGTPYKWGGSSTATGFDCSGMIQFVYKNALNVKLPRTARDMAAASRKIPDSRXKAGD
                    |||||||||||||||||||||||||||:||||||||||||||||||||||||||||||||
        g206        LGLIGTPYKWGGSSTATGFDCSGMIQLVYKNALNVKLPRTARDMAAASRKIPDSRLKAGD
                        70         80         90        100        110        120
                       130        140        150        160        170
        m206.pep    LVFFNTGGAHRYSHVGLYIGNGEFIHAPSSGKTIKTEKLSTPFYAKNYLGAHTFFTEX
                    :||||||||||||||||||||||||||||:||||||||||||||||||||||||||||
        g206        IVFFNTGGAHRYSHVGLYIGNGEFIHAPGSGKTIKTEKLSTPFYAKNYLGAHTFFTE
                       130        140        150        160        170
```

The following partial DNA sequence was identified in *N. meningitidis* <SEQ ID 719>:

```
a206.seq
   1 ATGTTTCCCC CCGACAAAAC CCTTTTCCTC TGTCTCAGCG CACTGCTCCT

51 CGCCTCATGC GGCACGACCT CCGGCAAACA CCGCCAACCG AAACCCAAAC

101 AGACAGTCCG GCAAATCCAA GCCGTCCGCA TCAGCCACAT CGACCGCACA

151 CAAGGCTCGC AGGAACTCAT GCTCCACAGC CTCGGACTCA TCGGCACGCC

201 CTACAAATGG GGCGGCAGCA GCACCGCAAC CGGCTTCGAT TGCAGCGGCA

251 TGATTCAATT CGTTTACAAA AACGCCCTCA ACGTCAAGCT GCCGCGCACC
```

```
-continued
301 GCCCGCGACA TGGCGGCGGC AAGCCGCAAA ATCCCCGACA GCCGCCTTAA

351 GGCCGGCGAC CTCGTATTCT TCAACACCGG CGGCGCACAC CGCTACTCAC

401 ACGTCGGACT CTATATCGGC AACGGCGAAT TCATCCATGC CCCCAGCAGC

451 GGCAAAACCA TCAAAACCGA AAAACTCTCC ACACCGTTTT ACGCCAAAAA

501 CTACCTCGGC GCACATACTT TCTTTACAGA ATGA
```

This corresponds to the amino acid sequence <SEQ ID 720; ORF 206.a>:

```
a206.pep
  1 MFPPDKTLFL CLSALLLASC GTTSGKHRQP KPKQTVRQIQ AVRISHIDRT

51 QGSQELMLHS LGLIGTPYKW GGSSTATGFD CSGMIQFVYK NALNVKLPRT

101 ARDMAAASRK IPDSRLKAGD LVFFNTGGAH RYSHVGLYIG NGEFIHAPSS

151 GKTIKTEKLS TPFYAKNYLG AHTFFTE*
``` m206/a206 99.4% identity in 177 aa overlap

```
                  10         20         30         40         50         60
   m206.pep MFPPDKTLFLCLSALLLASCGTTSGKHRQPKPKQTVRQIQAVRISHIDRTQGSQELMLHS
            ||||||||||||||||||||||||||||||||||||||||||||||||||||||||||||
   a206     MFPPDKTLFLCLSALLLASCGTTSGKHRQPKPKQTVRQIQAVRISHIDRTQGSQELMLHS
                  10         20         30         40         50         60

70         80         90        100        110        120
   m206.pep LGLIGTPYKWGGSSTATGFDCSGMIQFVYKNALNVKLPRTARDMAAASRKIPDSRXKAGD
            |||||||||||||||||||||||||||||||||||||||||||||||||||||||| |||
   a206     LGLIGTPYKWGGSSTATGFDCSGMIQFVYKNALNVKLPRTARDMAAASRKIPDSRLKAGD
                  70         80         90        100        110        120

130        140        150        160        170
   m206.pep LVFFNTGGAHRYSHVGLYIGNGEFIHAPSSGKTIKTEKLSTPFYAKNYLGAHTFFTEX
            |||||||||||||||||||||||||||||||||||||||||||||||||||||||||
   a206     LVFFNTGGAHRYSHVGLYIGNGEFIHAPSSGKTIKTEKLSTPFYAKNYLGAHTFFTEX
                 130        140        150        160        170
```

The following partial DNA sequence was identified in *N. gonorrhoeae* <SEQ ID 721>:

```
g209.seq
  1 atgctgcggc atttaggaaa cgacttcgcc ttgggcgcgt tgttttttcga 51 tgctgcggtt gatgtgccac tgctgggcga tggtcaggag gttgttgacc 101 acccagtaga gaaccaaacc ggcagggaag aagaagaaca tgacggagaa 151 aaccaacggc atgattttca tcattttcgc ctgcatcggg tcggtcggcg 201 gcgggttcag ataggtttgg gcgaacatcg ttgccgccat aatgatgggc 251 aggatgtagt aggggtcggc gcggctgagg tcggtaatcc agcccagcca 301 aggtgcctgg cgcaattcta cggaggcgaa caatgcccag tacaagccga 351 tgaagacggg gatttgcaac agcataggca gacagccgcc cagcgggttg 401 atttcctcgt cttcgaaaag ctgcatcatc gcttgctgtt cgccatacg 451 gtcgtcgccg tattttcctt tgatggtctg cagttcgggt gcggcggcac 501 gcattttcgc catcgaacgg taggaggcgt tggtcaatgg atacagtacg 551 gcttttgacga tgatggtcaa aacgacgatt gcccagcccc agttgccgat 601 aatgttgtgc agttggttca ggagccagaa gagcggcgat gcgaaccagt 651 gtactttacc gtagtctttt gccagttgca ggttgtcggc gatgtttgcg
```

```
-continued
701 ataacggatg tggtttgcgg accggcatac aggttgaccg ccattttcgg 751 ttttggcccc cgggttggga tagcggttaa
```

This corresponds to the amino acid sequence <SEQ ID 722; ORF 209.ng>:

```
g209.pep
   1 MLRHLGNDFA LGALFFDAAV DVPLLGDGQE VVDHPVENQT GREEEEHDGE

51 NQRHDFHHFR LHRVGRRRVQ IGLGEHRCRH NDGQDVVGVG AAEVGNPAQP

101 RCLAQFYGGE QCPVQADEDG DLQQHRQTAA QRVDFLVFEK LHHRLLLRHT

151 VVAVFFFDGL QFGCGGTHFR HRTVGGVGQW IQYGFDDDGQ NDDCPAPVAD

201 NVVQLVQEPE ERRCEPVYFT VVFCQLQVVG DVCDNGCGLR TGIQVDRHFR

251 FWPPGWDSG*
```

The following partial DNA sequence was identified in *N. meningitidis* <SEQ ID 723>:

```
m209.seq
   1 ATGCTGCGGC ATTTAGGAAA CGACTTCGCC TTGGgGCGTT GTTTTTCGAT

51 GCTGCGGTTG ATGTGCCATT GCTGGGCGAT GGTCAGGAGG TTGTTGACTA

10 CCCAGTACAA TACCAGACCG GCAGGGAAGA AGAAGAACAT GACGGAGAAA

151 ACCAACGGCA TGATTTTCAT CATTTTCGCC TGCATCGGGT CGGTCGGCGG

201 CGGGTTCAGA TAAGTTTGGG CGAACATCGT TGCCGCCATA ATGATGGGCA

251 GGATGTAGTA GGGGTCGGCG CGGCTGAGGT CGGTAATCCA ACCCAGCCAA

301 GGTGCCTGGC GCAATTCTAC GGAGGCGAAC AATGCCCAAT ACAATCCGAT

351 GAAGACGGGG ATTTGCAACA GCATAGGCAG GCAGCCGCCC AGCGGGTTGA

401 TTTTCTCGTC TGTGTAAAGC TGCATCATCG CCTGTTGTTG CGCCATACGG

451 TCGTCGCCGT ATTTCTCTTT GATGGCTTGC AGTTTGGGTG CGGCGGCACG

501 CATTTTCGCC ATAGAGCGGT AAGAGGCGTT GGTCAATGGA TACAGTACGG

551 CTTTGACGAT GATGGTTAAA ACGATAATCG CCCAGCCCCA GTTGCCGATG

601 ATGTTGTGCA GTTGGTTCAG GAGCCAGAAG AGCGGGGAGG CGAACCAGTG

651 TACTTTGCCG TAGTCTTTGG CCAGTTGCAG GTTGTCGGCG ATGTTTGCGA

701 TGACGGATGT GGTCTGCGGG CCGGCGTAGA GGTTGATGGA GGCTTCGgTT

751 TCGCGCCGTT TTGGATGGCG GCTAAAGGCA CGCTGACGCT GGTGCTGTAC

801 AGCTTGTCGT TGCGGCGTTT GATGTCGATG TTGCACTCGC CTGCGGCGCA

851 AACGCTTTGT CTGCCTTTAG GTTGGAGAAT CCAGGTGGAC ATGAAGTGGT

901 GTTCAATCAT GCCGAGCCAG CCGGTCGGGG TTTTGCGGAT GTATTCGGCC

951 TCGGATTTGC CGGATTTGGC ATCGTCGTCC AAGTCGGAAA AGCTGACTTT

1001 TTGGAAGTTG CCTTCAGGGG TATAA
```

This corresponds to the amino acid sequence <SEQ ID 724; ORF 209>:

```
m209.pep
   1 MLRHLGNDFA LGALFFDAAV DVPLLGDGQE VVDYPVQYQT GREEEEHDGE

51 NQRHDFHHFR LHRVGRRRVQ ISLGEHRCRH NDGQDVVGVG AAEVGNPTQP
```

```
101 RCLAQFYGGE QCPIQSDEDG DLQQHRQAAA QRVDFLVCVK LHHRLLLRHT

151 VVAVFLFDGL QFGCGGTHFR HRAVRGVGQW IQYGFDDDG* NDNRPAPVAD

201 DVVQLVQEPE ERGGEPVYFA VVFGQLQVVG DVCDDGCGLR AGVEVDGGFG

251 FAPFWMAAKG TLTLVLYSLS LRRLMSMLHS PAAQTLCLPL GWRIQVDMKW

301 CSIMPSQPVG VLRMYSASDL PDLASSSKSE KLTFWKLPSG V*
```

Computer analysis of this amino acid sequence gave the following results:

Homology with a Predicted ORF from *N. gonorrhoeae*
ORF 209 shows 88.5% identity over a 253 aa overlap with a predicted ORF (ORF 209.ng) from *N. gonorrhoeae*:

```
m209/g209
                   10         20         30         40         50         60
    m209.pep  MLRHLGNDFALGALFFDAAVDVPLLGDGQEVVDYPVQYQTGREEEEHDGENQRHDFHHFR
              ||||||||||||||||||||||||||||||:||: ||||||||||||||||||||||||
    g209      MLRHLGNDFALGALFFDAAVDVPLLGDGQEVVDHPVENQTGREEEEHDGENQRHDFHHFR
                   10         20         30         40         50         60

70         80         90        100        110        120
    m209.pep  LHRVGRRRVQISLGEHRCRHNDGQDVVGVGAAEVGNPTQPRCLAQFYGGEQCPIQSDEDG
              ||||||||||||:|||||||||||||||||||||||:||||||||||||||||:|:||||
    g209      LHRVGRRRVQIGLGEHRCRHNDGQDVVGVGAAEVGNPAQPRCLAQFYGGEQCPVQADEDG
                   70         80         90        100        110        120

130        140        150        160        170        180
    m209.pep  DLQQHRQAAAQRVDFLVCVKLHHRLLLRHTVVAVFLFDGLQFGCGGTHFRHRAVRGVGQW
              |||||||:|||||||||||  ||||||||||||||||:|||||||||||||||:| |||||
    g209      DLQQHRQTAAQRVDFLVFEKLHHRLLLRHTVVAVFFDGLQFGCGGTHFRHRTVGGVGQW
                  130        140        150        160        170        180

190        200        210        220        230        240
    m209.pep  IQYGFDDDGXNDNRPAPVADDVVQLVQEPEERGGEPVYFAVVFGQLQVVGDVCDDGCGLR
              ||||||||| ||: ||||||:|||||||||||:|||:|||| |||||||||||:|||||
    g209      IQYGRDDDGQNDDCPAPVADNVVQLVQEPEERCEPVYFTVVFCQLQVVGDVCDNGCGLR
                  190        200        210        220        230        240

250        260        270        280        290        299
    m209.pep  AGVEVDGGFGF-APFWMAAKGTLTLVLYSLSLRRLMSMLHSPAAQTLCLPLGWRIQVDMK
              :|::|| | | |
    g209      TGIQVDRHFRFWPPGWDSG
                  250
```

The following partial DNA sequence was identified in *N. meningitidis* <SEQ ID 725>:

```
a209.seq
  1 ATGCTGCGGC ATTTAGGAAA CGACTTCGCC TTGGGCGCGT TGTTTTTCGA

51 TGCTGCGGTT GATGTGCCAT TGCTGGGCGA TGGTCAGGAG GTTGTTGATC

101 ACCCAGTACA ATACCAGACC GGCAGGGAAG AAGAAGAACA TGACGGAGAA

151 AACCAAAGGC ATGATTTTCA TCATTTTCGC CTGCATCGGG TCGGTCGGCG

201 GCGGGTTCAG ATAGGTTTGG GCGAACATCG TTGCCGCCAT AATGATGGGC

251 AGGATGTAGT AGGGGTCGGC GCGGCTGAGG TCGGTAATCC AACCCAGCCA

301 AGGTGCCTGG CGCAATTCTA CGGAGGCGAA CAATGCCCAA TACAATCCGA

351 TGAAGACGGG GATTTGCAAC AGCATAGGCA GGCAGCCGCC CAGCGGGTTG

401 ATTTTCTCGT CTGTGTAAAG CTGCATCATG GCTTGTTGCT GCGCCATACG

451 GTCGTCGCCG TATTTCTCTT TGATGGCTTG CAGTTTGGGC GCGGCGGCAC

501 GCATTTTCGC CATCGAACGG TAAGAGGCGT TGGTCAATGG ATACAGTACG

551 GCTTTGACGA TGATGGTTAA AACGATAATC GCCCAGCCCC AGTTGCCGAT

601 GATGTTGTGC AGTTGGTTCA AAAGCCAAAA GAGGGGGGAG GCGAACCAGT

651 GTACTTTGCC GTAGTCTTTG GCCAGTTGCA GGTTGTCGGC GATGTTTGCG
```

-continued

```
 701 ATAACGGATG TGGTCTGTGG GCCGGCGTAG AGGTTGATGG AGGCTTCGGT

751 TTCGCACCGT TTTGGATAGC GGCTAAAGGC ACGCTGACGC TGGTGCTGTA

801 CAGCTTGTCG TTGCGGCGTT TGATGTCGAT ACGGCAGTCG CCAGCGGCGC

851 AAACGCTTTG TCCGCCTTTG GGTTGGAGGA TCCAGGTGGA CATGAAGTGG

901 TGTTCAATCA TGCCGAGCCA GCCGGTCGGG GTTTTGCGGA TGTATTCGGC

951 CTCGGATTTG CCGGATTTGG CATCGTCGTC AAGTCGGAG AAGCTGACTT

1001 TTTGGAAGTT GCCTTCAGGG GTATAA
```

This corresponds to the amino acid sequence <SEQ ID 726; ORF 209.a>:

```
a209.pep
  1 MLRHLGNDFA LGALFFDAAV DVPLLGDGQE VVDHPVQYQT GREEEEHDGE

51 NQRHDFHHFR LHRVGRRRVQ IGLGEHRCRH NDGQDVVGVG AAEVGNPTQP

101 RCLAQFYGGE QCPIQSDEDG DLQQHRQAAA QRVDFLVCVK LHHGLLLRHT

151 VVAVFLFDGL QFGRGGTHFR HRTVRGVGQW IQYGFDDDG* NDNRPAPVAD

201 DVVQLVQKPK EGGGEPVYFA VVFGQLQVVG DVCDNGCGLW AGVEVDGGFG

251 FAPFWIAAKG TLTLVLYSLS LRRLMSIRQS PAAQTLCPPL GWRIQVDMKW

301 CSIMPSQPVG VLRMYSASDL PDLASSSKSE KLTFWKLPSG V*
``` m209/a209 95.6% identity in 341 aa overlap

```
                  10        20        30        40        50        60
m209.pep  MLRHLGNDFALGALFFDAAVDVPLLGDGQEVVDYPVQYQTGREEEEHDGENQRHDFHHFR
          ||||||||||||||||||||||||||||||:|||||||||||||||||||||||||||||
a209      MLRHLGNDFALGALFFDAAVDVPLLGDGQEVVDHPVQYQTGREEEEHDGENQRHDFHHFR
                  10        20        30        40        50        60

70        80        90       100       110       120
m209.pep  LHRVGRRRVQISLGEHRCRHNDGQDVVGVGAAEVGNPTQPRCLAQFYGGEQCPIQSDEDG
          ||||||||||:|||||||||||||||||||||||||||||||||||||||||||||||||
a209      LHRVGRRRVQIGLGEHRCRHNDGQDVVGVGAAEVGNPTQPRCLAQFYGGEQCPIQSDEDG
                  70        80        90       100       110       120

130       140       150       160       170       180
m209.pep  DLQQHRQAAAQRVDFLVCVKLHHRLLLRHTVVAVFLFDGLQFGCGGTHFRHRAVRGVGQW
          ||||||||||||||||||||||||:||||||||||||||||||:||||||||:|||||||
a209      DLQQHRQAAAQRVDFLVCVKLHHGLLLRHTVVAVFLFDGLQFGRGGTHFRHRTVRGVGQW
                 130       140       150       160       170       180

190       200       210       220       230       240
m209.pep  IQYGFDDDGXNDNRPAPVADDVVQLVQEPEERGGEPVYFAVVFGQLQVVGDVCDDGCGLR
          |||||:||||||||||||||||||||::|:||||||||||||||||||||||||:|||:
a209      IQYGRDDDGXNDNRPAPVADDVVQLVQKPKEGGGEPVYFAVVFGQLQVVGDVCDNGCGLW
                 190       200       210       220       230       240

250       260       270       280       290       300
m209.pep  AGVEVDGGFGFAPFWMAAKGTLTLVLYSLSLRRLMSMLHSPAAQTLCLPLGWRIQVDMKW
          |||||||||||:||||:||||||||||||||||||||:::||||||||:|||||||||||
a209      AGVEVDGGFGRAPFWIAAKGTLTLVLYSLSLRRLMSIRQSPAAQTLCPPLGWRIQVDMKW
                 250       260       270       280       290       300

310       320       330       340
m209.pep  CSIMPSQPVGVLRMYSASDLPDLASSSKSEKLTFWKLPSGVX
          |||||||||||||||||||||||||||||||||||||||||
a209      CSIMPSQPVGVLRMYSASDLPDLASSSKSEKLTFWKLPSGVX
                 310       320       330       340
```

The following partial DNA sequence was identified in *N. gonorrhoeae* <SEQ ID 727>:

```
g211.seq
  1 atgttgcgga ttgctgctgc caatcagttg ggcggtcgaa atggtgcggc 51 ggtgggaaac ggggtcgata agtttgggcg tggtgctgat aatcaggttg
```

-continued

```
101 agtttttgga aggaaacctg attgtagtcg gcgcgtccgg gcgtgccgct 151 gtaacggtag ccgtggcgca attcgagcgt gcgtttgttg tccttcagcg 201 agaagttacc ttctttggcg aagatgatgt tgtcgccgcc gttttttgtcc 251 tgttcgcgca ggaacaggtt tttcatgatg ccggattcgg tgtcaaaggt 301 ttcgacgaaa taaaccctgc cgttgcgctt gcccaagtta ttgaactcgc 351 cggcttccac caaagacaat tcctgcttct gcttcaaaat ttcggcatat 401 tcgcggctgc gcagctctgc ccacggtatc acccaaagct gcatgacggc 451 aatcaggatg gcaaacggca cggcaaactg catgacgggg cgtatccact 501 gtttcaacgc caatccgcag gatag
```

This corresponds to the amino acid sequence <SEQ ID 728; ORF 211.ng>:

```
g211.pep
  1 MLRIAAANQL GGRNGAAVGN GVDKFGRGAD NQVEFLEGNL IVVGASGRAA

51 VTVAVAQFER AFVVLQREVT FFGEDDVVAA VFVLFAQEQV FHDAGFGVKG

101 FDEINPAVAL AQVIELAGFH QRQFLLLLQN FGIFAAAQLC PRYHPKLHDG

151 NQDGKRHGKL HDGAYPLFQR QSAG*
```

The following partial DNA sequence was identified in N. meningitidis <SEQ ID 729>:

```
m211.seq
  1 ATGTTGCGGG TTGCTGCTGC CAATCAGTTG GGCGGTCGGA ATGGTACGGC

51 GGTGGGAAAC GGGGTCGATG AGTTTGGGCG TGGTGCTGAT AATCAGGTTG

101 AGTTTTTGGA AGGAAACCTG ATTGTAGTCG GCGCGTCCGG GCGTGCCGCT

151 GTAACGGTAG CCGTGGCGCA ATTCGAGCGT GCGTTTGTTG TCGTTCAGCG

201 AGAAGTTACC TTCTTTGGCG AAGATGATGT TGTCGCCGCC GTTTTTGTCC

251 TGTTCGCGCA GGAACAGGTT TTTCATGATG CCGGATTCGG TATCGAAGGT

301 TTCGACAAAA TAAACCCTGC CGTTGCGCTT GCCCAAACTG TTGAACTCGC

351 CTGCCTCCAC CAAAGACAAT TCCTGCTTCT GCTTCAGGAT TTCAGCGTAT

401 TCGCGGCTGC GTAGCTCTGC CCACGGTATC ACCCAAAGCT GCATGACGGC

451 AACCAAAACG GCAAACGGCA CGGCAAACTG CATCACCGGG CGTATCCATT

501 GTTTCAATGC CAATCCGCAg GATAG
```

This corresponds to the amino acid sequence <SEQ ID 730; ORF 211>:

```
m211.pep
  1 MLRVAAANQL GGRNGTAVGN GVDEFGRGAD NQVEFLEGNL IVVGASGRAA

51 VTVAVAQFER AFVVVQREVT FFGEDDVVAA VFVLFAQEQV FHDAGFGIEG

101 FDKINPAVAL AQTVELACLH QRQFLLLLQD FSVFAAAXLC PRYHPKLHDG

151 NQNGKRHGKL HHRAYPLFQC QSAG*
```

Computer analysis of this amino acid sequence gave the following results:
Homology with a Predicted ORF from *N. gonorrhoeae*
ORF 211 shows 89.1% identity over a 174 aa overlap with a predicted ORF (ORF 211.ng) from *N. gonorrhoeae*:

```
m211/g211
                 10        20        30        40        50        60
    m211.pep MLRVAAANQLGGRNGTAVGNGVDEFGRGADNQVEFLEGNLIVVGASGRAAVTVAVAQFER
             |||:||||||||||||:|||||||:|||||||||||||||||||||||||||||||||||
    g211     MLRIAAANQLGGRNGAAVGNGVDKFGRGADNQVEFLEGNLIVVGASGRAAVTVAVAQFER
                 10        20        30        40        50        60

70        80        90       100       110       120
    m211.pep AFVVVQREVTFFGEDDVVAAVFVLFAQEQVFHDAGFGIEGFDKINPAVALAQTVELACLH
             ||||:|||||||||||||||||||||||||||||||::|||:||||||||||:::|||:|
    g211     AFVVLQREVTFFGEDDVVAAVFVLFAQEQVFHDAGFGVKGFDEINPAVALAQVIELAGFH
                 70        80        90       100       110       120

130       140       150       160       170
    m211.pep QRQFLLLLQDFSVFAAAXLCPRYHPKLHDGNQNGKRHGKLHHRAYPLFQCQSAGX
             ||||||||||:|::|||| ||||||||||||||||||:|||||| |||||| ||||
    g211     QRQFLLLLQNFGIFAAAQLCPRYHPKLHDGNQNGKRHGKLHDGAYPLFQRQSAGX
                130       140       150       160       170
```

The following partial DNA sequence was identified in *N. meningitidis* <SEQ ID 731>:

```
a211.seq
  1 ATGTTGCGGG TTGCTGCTGC CAATCAGTTG GGCGGTCGGA ATGGTACGGC

51 GGTGGGAAAC GGGGTCGATG AGTTTGGGCG TGGTGCTGAT AATCAGGTTG

101 AGTTTTTGGA AGGAAACCTG ATTGTAGTCG GCGCGTCCGG GCGTGCCGCT

151 GTAACGGTAG CCGTGGCGCA ATTCGAGCGT GCGTTTGTTG TCGTTCAGCG

201 AGAAGTTACT TTCTTTGGCG AAGATGATGT TGTCGCCGCC GTTTTTGTCC

251 TGTTCGCGCA GGAACAGGTT TTTCATGATG CCGGATTCGG TATCGAAGGT

301 TTCGACAAAA TAAACCCTGC CGTTGCGCTT GCCCAAACTG TTGAACCCGC

351 CTGCCTCCAC CAAAGACAAT TCCTGCTTCT GCTTCAGGAT TTCAGCGTAT

401 TCGCGGCTGC GTAGCTCTGC CCACGGTATC ACCCAAAGCT GCATGACGGC

451 AACCAAAACG GCAAACGGCA CGGCAAACTG CATCACCGGG CGTATCCATT

501 GTTTCAATGC CAATCCGCAG GATAG
```

This corresponds to the amino acid sequence <SEQ ID 732; ORF 211.a>:

```
a211.pep
  1 MLRVAAANQL GGRNGTAVGN GVDEFGRGAD NQVEFLEGNL IVVGASGRAA

51 VTVAVAQFER AFVVVQREVT FFGEDDVVAA VFVLFAQEQV FHDAGFGIEG

101 FDKINPAVAL AQTVEPACLH QRQFLLLLQD FSVFAAA*LC PRYHPKLHDG

151 NQNGKRHGKL HHRAYPLFQC QSAG*
``` m211/a211 99.4% identity in 174 aa overlap

```
                 10        20        30        40        50        60
    m211.pep MLRVAAANQLGGRNGTAVGNGVDEFGRGADNQVEFLEGNLIVVGASGRAAVTVAVAQFER
             ||||||||||||||||||||||||||||||||||||:|||||||||||||||||||||||
    a211     MLRVAAANQLGGRNGTAVGNGVDEFGRGADNQVERLEGNLIVVGASGRAAVTVAVAQFER
                 10        20        30        40        50        60
```

```
               70         80         90        100        110        120
m211.pep   AFVVVQREVTFFGEDDVVAAVFVLFAQEQVFHDAGFGIEGFDKINPAVALAQTVELACLH
           ||||||||||||||||||||||||||||||||||||||||||||||||||||||||||||
a211       AFVVVQREVTFFGEDDVVAAVFVLFAQEQVFHDAGFGIEGFDKINPAVALAQTVEPACLH
               70         80         90        100        110        120

130        140        150        160        170
m211.pep   QRQFLLLLQDFSVFAAAXLCPRYHPKLHDGNQNGKRHGKLHHRAYPLFQCQSAGX
           ||||||||||||||||||||||||||||||||||||||||||||||||||||||
a211       QRQFLLLLQDFSVFAAAXLCPRYHPKLHDGNQNGKRHGKLHHRAYPLFQCQSAGX
              130        140        150        160        170
```

The following partial DNA sequence was identified in *N. gonorrhoeae* <SEQ ID 733>:

```
g212.seq (partial)
   1 atggacaatc tcgtatggga cggcattccc gacatccgca cactcgacca
  51 aaccatccgc aaacacgcac acccgctcaa cctgattgtc tgcctccccg
 101 ataatcagat tcccgatttt caaaccgcac aagatgcttc ggactcggaa
 151 tgccgtctga agcaccgttt ggatcaggca acccagtgcc tccagttcga
 201 cagcatcaac ctcatcgaac acatcctgcc cgatgtccgc ttctggctgg
 251 ttccccttc  acgcacccgc cgcctgcacg aacacttcca ccacatttcc
 301 tggcagaccg aagccatccc gcaaaccgaa agcaagtccg acaaaccctg
 351 gtttgcactt ccacaaacat ccgaacggaa aaaccggaa cacgtcctcg
 401 tcatcggtgc aggcattgcc ggcgcatcga ccgcccacgc cttagcatca
 451 cacggcattt ccgttaccgt attggaagcc cgaaaagccg ctcaagccgc
 501 cagcggcaac cggcaagggc tgctttacgc caaaatctcg ccgcacgaca
 551 ccggacagac cgaactgctg cttgccggct acggctacac caaacgcctg
 601 ctcggacaca tcctgcccga ctccgacact tggggcggca acggcatcat
 651 ccacctcaat tacagccgca ccgaacaaca acgcaatcac gaattgggtt
 701 tgcaaaaaca ccataaccac ctctaccgca gcatcacgtc tgcagaagcc
 751 gaaaaaatcg ccggcatccc gctgaacacg ccctacgccg aaccattatg
 801 cggactctac tggcaacacg gcgtatggct caatccgccc gcattcgtcc
 851 gcaccctcct cagccatccg ctgatcgaac tatatgaaaa cacaacgtta
 901 accggcattt cccacgacgg agaaaagtgg attgcaagca cgccaaacgg
 951 cacatttacc gccacacaca tcatctactg caccggcgcg cacagcccct
1001 gcctgcccga aaccaacctc gccgccctac ccctcaggca aatacgcgga
1051 caaaccggcc tcacaccgtc caccccgttt tccgaacaac tgcgttgcgc
1101 cgtttcaggc gaaagctaca tcagcccgtc gtggcacgga ctgcactgct
1151 acggcgcgag ttttattccc aacagcagca ataccggatg gaacgaagcc
1201 gaagaagcct caaaccgcca agcattggca caccttaacc ccgcccttgc
1251 cgaatcattg ttt...
```

This corresponds to the amino acid sequence <SEQ ID 734; ORF 212.ng>:

```
g212.pep (partial)
   1 MDNLVWDGIP DIRTLDQTIR KHAHPLNLIV CLPDNQIPDF QTAQDASDSE
  51 CRLKHRLDQA TQCLQFDSIN LIEHILPDVR FWLVPPSRTR RLHEHFHHIS
```

```
-continued
101 WQTEAIPQTE SKSDKPWFAL PQTSERKKPE HVLVIGAGIA GASTAHALAS

151 HGISVTVLEA RKAAQAASGN RQGLLYAKIS PHDTGQTELL LAGYGYTKRL

201 LGHILPDSDT WGGNGIIHLN YSRTEQQRNH ELGLQKHHNH LYRSITSAEA

251 EKIAGIPLNT PYAEPLCGLY WQHGVWLNPP AFVRTLLSHP LIELYENTTL

301 TGISHDGEKW IASTPNGTFT ATHIIYCTGA HSPCLPETNL AALPLRQIRG

351 QTGLTPSTPF SEQLRCAVSG ESYISPSWHG LHCYGASFIP NSSNTGWNEA

401 EEASNRQALA HLNPALAESL F...
```

The following partial DNA sequence was identified in *N. meningitidis* <SEQ ID 735>:

```
m212.seq
   1 ATGGACAATC TCGTATGGGA CGGCATTCCC GACATCCGCA CACTCGACCA

51 AGCCATCCGC AAACACGCAC CCCCGCTCAA CCTGATTATC TGCCTCCCCG

101 ATAATCAGAT TCCCGATTTT CAAACCGCAC AAGATGCTTC GGACGCGGAA

151 TGCCGTCTGA AGCACCGTTT GGATCAGGCA ATGCAGTGCC TCCAGTTCGA

201 CAGCATCAAC CTCATCGAAC ACATCCTGCC CGATGTCCGC TTCTGGCTGG

251 TTCCCCCTTC ACGCAATCAC CACCTGCACG AACATTTCCA CCACATTTCC

301 TGGCAGACCG AAGCCATCCC GCAAACCGAA AGCAAGCCCG ACAAACCCTG

351 GTTTGCACTT CCACAAACAT CCGAACGGCA AAAACCGGAA CACATCCTCG

401 TTATCGGCGC GGGCATATCC GGCGCGGCAA CCGCCCACGC CTTAGCATCA

451 CACGGCATTT CCGTTACCGT ATTGGAAGCC CGAAAAGCCG CCCAAGCCGC

501 CAGCGGCAAC CGCCAAGGGC TGCTCTACGC CAAAATCTCG CCGCACGACA

551 CCGAACAGAC CGAACTTTTG CTTGCCGGCT ACGGCTACAC CAAACGCCTG

601 CTCGGACACA TCCTGCCCGA ATCCGAAACC TGGGGCGGCA ACGGCATCAT

651 CCACCTCAAT TACAGCCGCA CCGAACAACA ACGCAATCAC GAATTGGGTT

701 TGCAAAAACA CCATAACCAC CTCTACCGCA GCATCACATC TGCAGAAGCC

751 GAAAAAATCG CCGGTATCCC ACTGTCCGTC CCATACGACC ACCCTTCATG

801 CGGACTCTAC TGGCAACACG GCGTATGGCT CAATCCACCC GCATTCGTCC

851 GCACCCTCCT CAACCATCCG CTCATTGGAC TACACGAAGA CACACCCTTG

901 ACCGACATTT CCCACGACGG GGaAAAGTGG ATTGCAAGCA CGCCAAACGG

951 CACATTTACC GCCACACACA TCATCTACTG CACCGGTGCG AACAGCCCCT

1001 ACCTACCCGA AACCAACCTC GCCGCCCTGC CTCTCAGGCA AATACGCGGA

1051 CAAACCGGCC TCACACCGTC CACCCCGTTT TCCGAACAAC TGCGTTGCGC

1101 CGTTTCAGGC GAAAGCTACA TCAGCCCGTC GTGGCACGGA CTGCACTGCT

1151 ACGGCGCGAG TTTTATTCCC AACAGCAGCC ATACCGGATG GAACGAAGCC

1201 GAAGAAGCCT CAAACCGCCA AGCATTGGCA CACCTTAACC CCGCCCTTTC

1251 CGAATCATTG TTTGCCGCCA ACCCAAACCC CCAAAAACAC CAAGGGCACG

1301 CCGCCATACG CTGCGACAGC CCCGACCACC TTCCCCTAGT CGGCGCACTC

1351 GGCGACATTG CCGCCATGCG GCAGACCTAC ACCAAACTCG CGCTGGACAA

1401 AAACTACCGC ATCGACACCC CATGCCCATA CCTGCCTAAT GCCTACGTCA

1451 ACACCGCGCA CGGCACCCGC GGACTCGCCA CCGCCCCCAT CTGCGCCGCC
```

```
1501 GmCAwTGCAG CCCAAATCsT AGGCyTGCCC CATCCCTTTT yAcAAcGCCT 1551 gCGCCACGCC cTAcACCCCA ACCGCACCAT CATCCGCGCC ATCGTCAGAA

1601 GGAAGGATCT AACCCCTTAA
```

This corresponds to the amino acid sequence <SEQ ID 736; ORF 212>:

```
m212.pep
   1 MDNLVWDGIP DIRTLDQAIR KHAPPLNLII CLPDNQIPDF QTAQDASDAE

51 CRLKHRLDQA MQCLQFDSIN LIEHILPDVR FWLVPPSRTH HLHEHFHHIS

101 WQTEAIPQTE SKPDKPWFAL PQTSERQKPE HILVIGAGIS GAATAHALAS

151 HGISVTVLEA RKAAQAASGN RQGLLYAKIS PHDTEQTELL LAGYGYTKRL

201 LGHILPESET WGGNGIIHLN YSRTEQQRNH ELGLQKHHNH LYRSITSAEA

251 EKIAGIPLSV PYDHPSCGLY WQHGVWLNPP AFVRTLLNHP LIGLHEDTPL

301 TDISHDGEKW IASTPNGTFT ATHIIYCTGA NSPYLPETNL AALPLRQIRG

351 QTGLTPSTPF SEQLRCAVSG ESYISPSWHG LHCYGASFIP NSSHTGWNEA

401 EEASNRQALA HLNPALSESL FAANPNPQKH QGHAAIRCDS PDHLPLVGAL

451 GDIAAMRQTY TKLALDKNYR IDTPCPYLPN AYVNTAHGTR GLATAPICAA

501 XXAAQIXGLP HPFXQRLRHA LHPNRTIIRA IVRRKDLTP*
```

Computer analysis of this amino acid sequence gave the following results:

Homology with a Predicted ORF from *N. gonorrhoeae*

ORF 212 shows 92.9% identity over a 421 aa overlap with a predicted ORF (ORF 212.ng) from *N. gonorrhoeae*:

```
    m212/g212
                        10         20         30         40         50         60
         m212.pep  MDNLVWDGIPDIRTLDQAIRKHAPPLNLIICLPDNQIPDFQTAQDASDAECRLKHRLDQA
                   ||||||||||||||||||:|||| |||||:||||||||||||||||||:|||||||||||
         g212      MDNLVWDGIPDIRTLDQTIRKHAHPLNLIVCLPDNQIPDFQTAQDASDSECRLKHRLDQA
                        10         20         30         40         50         60

70         80         90        100        110        120
         m212.pep  MQCLQFDSINLIEHILPDVRFWLVPPSRTHHLHEHFHHISWQTEAIPQTESKPDKPWFAL
                   |||||||||||||||||||||||||||||::|||||||||||||||||||||| |||||||
         g212      TQCLQFDSINLIEHILPDVRFWLVPPSRTRRLHEHFHHISWQTEAIPQTESKSDKPWFAL
                        70         80         90        100        110        120

130        140        150        160        170        180
         m212.pep  PQTSERQKPEHILVIGAGISGAATAHALASHGISVTVLEARKAAQAASGNRQGLLYAKIS
                   ||||||:||||:|||||||:||:|||||||||||||||||||||||||||||||||||||
         g212      PQTSERKKPEHVLVIGAGIAGASTAHALASHGISVTVLEARKAAQAASGNRQGLLYAKIS
                       130        140        150        160        170        180

190        200        210        220        230        240
         m212.pep  PHDTEQTELLLAGYGYTKRLLGHILPESETWGGNGIIHLNYSRTEQQRNHELGLQKHHNH
                   ||||  ||||||||||||||||||||||:|:|||||||||||||||||||||||||||||
         g212      PHDTGQTELLLAGYGYTKRLLGHILPDSDTWGGNGIIHLNYSRTEQQRNHELGLQKHHNH
                       190        200        210        220        230        240

250        260        270        280        290        300
         m212.pep  LYRSITSAEAEKIAGIPLSVPYDHPSCGLYWQHGVWLNPPAFVRTLLNHPLIGLHEDTPL
                   ||||||||||||||||||||::|| :|||||||||||||||||||||:||||| :|:|| |
         g212      LYRSITSAEAEKIAGIPLNTPYAEPLCGLYWQHGVWLNPPAFVRTLLSHPLIELYENTTL
                       250        260        270        280        290        300

310        320        330        340        350        360
         m212.pep  TDISHDGEKWIASTPNGTFTATHIIYCTGANSPYLPETNLAALPLRQIRGQTGLTPSTPF
                   | ||||||||||||||||||||||||||||:|| |||||||||||||||||||||||||||
         g212      TGISHDGEKWIASTPNGTFTATHIIYCTGAHSPCLPETNLAALPLRQIRGQTGLTPSTPF
                       310        320        330        340        350        360

370        380        390        400        410        420
         m212.pep  SEQLRCAVSGESYISPSWHGLHCYGASFIPNSSHTGWNEAEEASNRQALAHLNPALSESL
                   |||||||||||||||||||||||||||||||||:||||||||||||||||||||||:|||
         g212      SEQLRCAVSGESYISPSWHGLHCYGASFIPNSSNTGWNEAEEASNRQALAHLNPALAESL
                       370        380        390        400        410        420
```

```
                        430        440        450        460        470        480
m212.pep       FAANPNPQKHQGHAAIRCDSPDHLPLVGALGDIAAMRQTYTKLALDKNYRIDTPCPYLPN
               |
g212           F
```

The following partial DNA sequence was identified in *N. meningitidis* <SEQ ID 737>:

```
a212.seq
   1 ATGGACAATC TCGCATGGAA CGGCATTCCC GACATCCGCA CACTCGACCA

51 AACCATCCGC AAACACGCAC ACCCGCTCAA CCTGATTGTC TGCCTCCCCG

101 ATAATCAGAT TCCCAATTTT CAAACCGCAC AAGATGCTTC GGACGCGGAA

151 TGCCGTCTGA AGCACCGTTT GGATCAGGCA ACCCAGTGCC TCCAGTTCGA

201 CAGCATCAAC CTGATTGAAC ACATCCTGCC CGATGTCCGC TTCTGGCTGG

251 TTCCCCCTTC ACGCACCCGC CGCCTGCACG AACACTTCCA CCACATTTCC

301 TGGCAGACCG AAGCCATCCC GCAAACCGAA AGTAAGCCCG ACAAACCCTG

351 GTTTGCACTT CCACAAACAT CCGAACGGCA AAAACCGGAA CACATCCTCG

401 TTATCGGAGC GGGCATATCC GGCGCGGCAA CCGCCCACGC CTTAGCATCA

451 TACGGCATTT CCGTTACCGT ATTGGAAGCC CGAAAAGCCG CCCAAGCCGC

501 CAGCGGCAAC CGCCAAGGGC TGCTCTACGC CAAAATCTCG CCGCACGACA

551 CCGAACAAAC CGAACTGCTG CTTGCCGGCT ACGGCTACAC CAAACGCCTG

601 CTCGGACATA TCCTGCCCGA ATCCGAAACC TGGGGCGGCA ACGGCATCAT

651 CCACCTCAAT TACAGCCGCA CCGAACAACA ACGCAATCAC GAATTGGGTT

701 TGCAAAAACA CCATAACCAC CTCTACCGCA GCATCACGCA GGCAGAAGCC

751 GAAAAAATCG CCGGCATCCC TCTGAACACG CCCTACGCCG AACCATTATG

801 CGGACTGTTT TGGCAGTACG GCGTATGGCT CAATCCTCCC ACATTCGTCC

851 GCGCCCTCCT CAGCCATCCG CTCATTGGAC TACACGAAGA CACACCGTTA

901 ACCGACATTT CCCACGACGG GGAAAAGTGG ATTGCAAGCA CGCCAAACGG

951 CACATTTACC GCCACACACA TCATCTACTG CACCGGTGCG AACAGCCCCT

1001 ACCTACCCGA AACAACCTC GCCACCCTGC CCCTCAGGCA AATACGCGGA

1051 CAAACCGGCC TCACACCGTC CACCCCGTTT TCCGAACAAC TGCGTTGCGC

1101 CGTTTCAGGC GAAAGCTACA TCAGCCCGTC GTGGCACGGA CTGCACTGCT

1151 ACGGCGCGAG TTTTATTCCC AACAGCAGCC ATACCGGATG GAACGAAGCC

1201 GAAGAAGCCT CAAACCGCCA AGCATTGGCA CACCTTAACC CCGCCCTTTC

1251 CGAATCATTG TTTGCCGCCA ACCCAAACCC CCAAAAACAC CAAGGGCACG

1301 CCGCCATACG CTGCGACAGC CCCGACCACC TTCCCCTAGT CGGCGCACTC

1351 GGCGACATTG CCGCTATGCA ACAAACTTAC GCCAAACTCG CGCTGGACAA

1401 AAACTATCGC ATCGATGCCC CCTGCCCGTA CCTGCCCAAT GCCTACGCCA

1451 ACACCGCCCA CGGCACACGC GGGCTTGCCA CCGCCCCCAT CTGCGCCGCC

1501 GCCGTTGCAG CCGAAATCCT AGGCTTGCCC CATCCCCTCT CAAAACGCCT

1551 GCGCCACGCC CTACACCCCA ACCGCGCCAT CATCCGCGCC ATCGTCAGAA

1601 GGAAGGATCT AACCCCTTAA
```

This corresponds to the amino acid sequence <SEQ ID 738; ORF 212.a>:

```
a212.pep
  1 MDNLAWNGIP DIRTLDQTIR KHAHPLNLIV CLPDNQIPNF QTAQDASDAE

51 CRLKHRLDQA TQCLQFDSIN LIEHILPDVR FWLVPPSRTR RLHEHFHHIS

101 WQTEAIPQTE SKPDKPWFAL PQTSERQKPE HILVIGAGIS GAATAHALAS

151 YGISVTVLEA RKAAQAASGN RQGLLYAKIS PHDTEQTELL LAGYGYTKRL

201 LGHILPESET WGGNGIIHLN YSRTEQQRNH ELGLQKHHNH LYRSITQAEA

251 EKIAGIPLNT PYAEPLCGLF WQYGVWLNPP TFVRALLSHP LIGLHEDTPL

301 TDISHDGEKW IASTPNGTFT ATHIIYCTGA NSPYLPETNL ATLPLRQIRG

351 QTGLTPSTPF SEQLRCAVSG ESYISPSWHG LHCYGASFIP NSSHTGWNEA

401 EEASNRQALA HLNPALSESL FAANPNPQKH QGHAAIRCDS PDHLPLVGAL

451 GDIAAMQQTY AKLALDKNYR IDAPCPYLPN AYANTAHGTR GLATAPICAA

501 AVAAEILGLP HPLSKRLRHA LHPNRAIIRA IVRRKDLTP*
``` m212/a212 93.7% identity in 539 aa overlap

```
                    10         20         30         40         50         60
   m212.pep  MDNLVWDGIPDIRTLDQAIRKHAPPLNLIICLPDNQIPDFQTAQDASDAECRLKHRLDQA
             ||||:|:|||||||||||:|||||||||||:||||||||||||||||||:|||||||||
   a212      MDNLAWNGIPDIRTLDQTIRKHAHPLNLIVCLPDNQIPNFQTAQDASDSECRLKHRLDQA
                    10         20         30         40         50         60

70         80         90        100        110        120
   m212.pep  MQCLQFDSINLIEHILPDVRFWLVPPSRTHHLHEHFHHISWQTEAIPQTESKPDPWFAL
             |||||||||||||||||||||||||||||::|||||||||||||||||||||||:||||
   a212      TQCLQFDSINLIEHILPDVRFWLVPPSRTRRLHEHFHHISWQTEAIPQTESKPDKPWFAL
                    70         80         90        100        110        120

130        140        150        160        170        180
   m212.pep  PQTSERQKPEHILVIGAGISGAATAHALASHGISVTVLEARKAAQAASGNRQGLLYAKIS
             ||||||||||||||||||||||||||||||:|||||||||||||||||||||||||||||
   a212      PQTSERQKPEHILVIGAGISGAATAHALASYGISVTVLEARKAAQAASGNRQGLLYAKIS
                   130        140        150        160        170        180

190        200        210        220        230        240
   m212.pep  PHDTEQTELLLAGYGYTKRLLGHILPESETWGGNGIIHLNYSRTEQQRNHELGLQKHHNH
             ||||||||||||||||||||||||||||||||||||||||||||||||||||||||||||
   a212      PHDTEQTELLLAGYGYTKRLLGHILPESETWGGNGIIHLNYSRTEQQRNHELGLQKHHNH
                   190        200        210        220        230        240

250        260        270        280        290        300
   m212.pep  LYRSITSAEAEKIAGIPLSVPYDHPSCGLYWQHGVWLNPPAFVRTLLNHPLIGLHEDTPL
             ||||||:||||||||||||:::|||:||:|||||||||:|||:|:|||||||||||
   a212      LYRSITQAEAEKIAGIPLNTPYAEPLCGLFWQYGVWLNPPTFVRALLSHPLIGLHEDTPL
                   250        260        270        280        290        300

310        320        330        340        350        360
   m212.pep  TDISHDGEKWIASTPNGTFTATHIIYCTGANSPYLPETNLAALPLRQIRGQTGLTPSTPF
             ||||||||||||||||||||||||||||||||||||||||:|||||||||||||||||||
   a212      TDISHDGEKWIASTPNGTFTATHIIYCTGANSPYLPETNLATLPLRQIRGQTGLTPSTPF
                   310        320        330        340        350        360

370        380        390        400        410        420
   m212.pep  SEQLRCAVSGESYISPSWHGLHCYGASFIPNSSHTGWNEAEEASNRQALAHLNPALSESL
             ||||||||||||||||||||||||||||||||||||||||||||||||||||||||||||
   a212      SEQLRCAVSGESYISPSWHGLHCYGASFIPNSSHTGWNEAEEASNRQALAHLNPALSESL
                   370        380        390        400        410        420

430        440        450        460        470        480
   m212.pep  FAANPNPQKHQGHAAIRCDSPDHLPLVGALGDIAAMRQTYTKLALDKNYRIDTPCPYLPN
             |||||||||||||||||||||||||||||||||||:|||:||||||||||:|||||||
   a212      FAANPNPQKHQGHAAIRCDSPDHLPLVGALGDIAAMQQTYAKLALDKNYRIDAPCPYLPN
                   430        440        450        460        470        480

490        500        510        520        530        540
   m212.pep  AYVNTAHGTRGLATAPICAAXXAAQIXGLPHPFXQRLRHALHPNRTIIRIAVRRKDLTPX
             ||:||||||||||||||||| ||:||||| ::|||||||||||||:|||:|||||||||
   a212      AYANTAHGTRGLATAPICAAAVAAEILGLPHPLSKRLRHALHPNRAIIRAIVRRKDLTPX
                   490        500        510        520        530        540
```

The following partial DNA sequence was identified in *N. gonorrhoeae* <SEQ ID 739>:

```
g214.seq
   1 atgatacaaa agatatgtaa gctatttgtt ttaattgtaa tttttgcaac 51 ttctcccgct tttgcccttc aaagcgacag cagacggccc atccaaatcg 101 aagccgacca aggttcgctc gatcaagcca accaaaggac cacatttagc 151 ggcaatgtca tcatcagaca gggtacgctc aacatttccg cctcgtgtgt 201 caacgtcaca cgcggcaggc aaaggcggcg aatccgtgag ggcggaaggt 251 tcgcccgtcc gcttcagcca aacgttggac gggggcaaag ggacggtgcg 301 cggtcaggca acaacgtta cctattcctc cgcaggaagc actgtcgttc 351 tgaccggcaa tgccaaagtg cagcgcggcg gcgacgttgc cgaaggtgcg 401 gtcattacct acaacaccaa aaccgaagtc tataccatca acggcagcac 451 gaaatcgggt gcgaaatccg cttccaaaac cggcagggtc agcgtcgtca 501 tccagccttc aagcacacaa aaaaccgaat aaccccgatg ccgtctgaaa 551 cggaaacgca gttcagacgg catttgccga ccgaaatgcc gagaagagat 601 tattga
```

This corresponds to the amino acid sequence <SEQ ID 740; ORF 214.ng>:

```
g214.pep
   1 MIQKICKLFV LIVIFATSPA FALQSDSRRP IQIEADQGSL DQANQRTTFS

51 GNVIIRQGTL NISASCVNVT RGRQRRRIRE GGRFARPLQP NVGRGQRDGA

101 RSGKQRYLFL RRKHCRSDRQ CQSAARRRRC RRCGHYLQHQ NRSLYHQRQH

151 EIGCEIRFQN RQGQRRHPAF KHTKNRITPM PSETETQFRR HLPTEMPRRD

201 Y
```

The following partial DNA sequence was identified in *N. meningitidis* <SEQ ID 741>:

```
m214.seq (partial)
   1 ATGATACAAA AGATATGTAA GCTATTTGTT TTAATAGCAT TTTTTTCGGC

51 GTCCCCCGCT TTTGCCCTTC AAAGCGACAG CAGGCAGCCT ATTCAGATTG

101 AGGCCGACCA AGGTTCGCTC GATCAAGCCA ACCAAAGCAC CACATTCAGC

151 GGAAACGTCG TCATCAGACA GGGTACGCTC AATATTTCCG CCGCCCGCGT

201 CAATGTTACA CGCGGCGGCA AAGGCGGCGA ATCCGTGAGG GCGGAAGGTT

251 CGCCAGTCCG CTTCAGCCAG ACATTGGACG GCGGCAAAGG CACGGTGCGC

301 GGACAGGCAA ACAACGTTGC TTATTCATCT GCAGGCAGCA CCGTAGTCTT

351 AACCGGTAAT GCCAAAGTAC AGCGCGGCGG CGATGTCGCC GAAGGTGCGG

401 TGATTACATA CAACACCAAA ACCGAAGTCT ATACCATCAG CGGCAGCACA

451 AAATT...
```

This corresponds to the amino acid sequence <SEQ ID 742; ORF 214>:

```
m214.pep (partial)
   1 MICKICKLFV LIAFFSASPA FALQSDSRQP IQIEADQGSL DQANQSTTFS
```

-continued
```
 51 GNVVIRQGTL NISAARVNVT RGRQRRRIRE GGRFASPLQP DIGRRQRHGA

101 RTGKQRCLFI CRQHRSLNR* CQSTARRRCR RRCGDYIQHQ NRSLYHQRQH

151 KI...
```

Computer analysis of this amino acid sequence gave the following results:
Homology with a Predicted ORF from *N. gonorrhoeae*
ORF 214 shows 80.3% identity over a 152 aa overlap with a predicted ORF (ORF 214.ng) from *N. gonorrhoeae*:

```
    m214/g214

10         20         30         40         50         60
    m214.pep MIQKICKLFVLIAFFSASPAFALQSDSRQPIQIEADQGSLDQANQSTTFSGNVVIRQGTL
             ||||||||||::|::||||||||||||:||||||||||||| |||||||:||||||
    g214     MIQKICKLFVLIVIFATSPAFALQSDSRRPIQIEADQGSLDQANQRTTFSGNVIIRQGTL
                    10         20         30         40         50         60

70         80         90        100        110        120
    m214.pep NISAARVNVTRGRQRRRIREGGRFASPLQPDIGRRQRHGARTGKQRCLFICRQHRSLNRX
             ||||: |||||||||||||||||| ||::|| || |||:|||| ||: :|    :|
    g214     NISASCVNVTRGRQRRRIREGGRFARPLQPNVGRGQRDGARSGKQRYLFLRRKHCRSDRQ
                    70         80         90        100        110        120

130        140        150
    m214.pep CQSTARRRCRRRCGDYIQHQNRSLYHQRQHKI
             |||:||||  ||||  |:|||||||||||:|
    g214     CQSAARRRCRRRCGHYLQHQNRSLYHQRQHEIGCEIRFQNRQGQRRHPAFKHTKNRITPM
                   130        140        150        160        170        180 g214     PSETETQFRRHLPTEMPRRDY
                   190        200
```

The following partial DNA sequence was identified in *N. meningitidis* <SEQ ID 743>:

```
a214.seq
   1 ATGATACAAA AGATATGTAA GCTATTTGTT TTAATAGCAT TTTTTTCGGC

51 GTCCCCCGCT TTTGCCCTTC AAAGCGACAG CAGGCAGCCT ATTCAGATTG

101 AGGCCGACCA AGGTTCGCTC GATCAAGCCA ACCAAAGCAC CACATTCAGC

151 GGAAACGTCG TCATCAGACA GGGTACGCTC AATATTTCCG CCGCCCGCGT

201 CAATGTTACA CGCGGC.GGC AAAGGCGGCG AATCCGTGAG GCGGAAGGT

251 TCGCCAGTCC GCTTCAGCCA GACATTGGAC GGCGGCAAAG GCACGGTGCG

301 CGGACAGGCA ACAACGTTG CTTATTCATC TGCAGGCAGC ACCGTAGTCT

351 TAACCGGTAA TGCCAAAGTA CAGCGCGGCG GCGATGTCGC CGAAGGTGCG

401 GTGATTACAT ACAACACCAA AACCGAAGTC TATACCATCA GCGGCAGCAC

451 AAAATCCGGC GCAAAATCCG CTTCCAAATC CGGCAGGGTC AGCGTCGTTA

501 TCCAGCCTTC GAGTACGCAA AAATCCGAAT AATCCCAATG CCGTCTGAAA

551 CATAAACCTG GTTCGGACGG CATTTGCCGA CCGAAATATT GAAGAGATAT

601 TTATGA
```

This corresponds to the amino acid sequence <SEQ ID 744; ORF 214.a>:

```
a214.pep
   1 MIQKICKLFV LIAFFSASPA FALQSDSRQP IQIEADQGSL DQANQSTTFS

51 GNVVIRQGTL NISAARVNVT RGXQRRRIRE GGRFASPLQP DIGRRQRHGA

101 RTGKQRCLFI CRQHRSLNR* CQSTARRRCR RCGDYIQHQ NRSLYHQRQH
```

-continued

```
151 KIRRKIRFQI RQGQRRYPAF EYAKIRIIPM PSET*TWFGR HLPTEILKRY

201 L*
``` m214/a214 99.3% identity in 152 aa overlap

```
                  10        20        30        40        50        60
   m214.pep MIQKICKLFVLIAFFSASPAFALQSDSRQPIQIEADQGSLDQANQSTTFSGNVVIRQGTL
            ||||||||||||||||||||||||||||||||||||||||||||||||||||||||||||
   a214     MIQKICKLFVLIAFFSASPAFALQSDSRQPIQIEADQGSLDQANQSTTFSGNVVIRQGTL
                  10        20        30        40        50        60

70        80        90       100       110       120
   m214.pep NISAARVNVTRGRQRRRIREGGRFASPLQPDIGRRQRHGARTGKQRCLFICRQHRSLNRX
            ||||||||||| ||||||||||||||||||||||||||||||||||||||||||||||||
   a214     NISAARVNVTRGXQRRRIREGGRFASPLQPDIGRRQRHGARTGKQRCLFICRQHRSLNRX
                  70        80        90       100       110       120

130       140       150
   m214.pep CQSTARRRCRRRCGDYIQHQNRSLYHQRQHKI
            |||||||||||||||||||||||||||||||||
   a214     CQSTARRRCRRRCGDYIQHQNRSLYHQRQHKIRRKIRFQIRQGQRRYPAFEYAKIRIIPM
                 130       140       150       160       170       180 a214     PSETXTWFGRHLPTEILKRYLX
                 190       200
```

The following partial DNA sequence was identified in *N. gonorrhoeae* <SEQ ID 745>:

```
g214-1.seq
   1 ATGATACAAA AGATATGTAA GCTATTTGTT TTAATTGTAA TTTTTGCAAC

51 TTCTCCCGCT TTTGCCCTTC AAAGCGACAG CAGACGGCCC ATCCAAATCG

101 AAGCCGACCA AGGTTCGCTC GATCAAGCCA ACCAAAGTAC CACATTTAGC

151 GGCAATGTCA TCATCAGACA GGGTACGCTC AACATTTCCG CCTCGCGCGT

201 CAACGTCACA CGCGGCGGCA AAGGCGGCGA ATCCGTGAGG GCGGAAGGTT

251 CGCCCGTCCG CTTCAGCCAA ACGTTGGACG GGGGCAAAGG GACGGTGCGC

301 GGTCAGGCAA ACAACGTTAC CTATTCCTCC GCAGGAAGCA CCGTCGTTCT

351 GACCGGCAAT GCCAAAGTGC AGCGCGGCGG CGACGTTGCC GAAGGTGCGG

401 TCATTACCTA CAACACCAAA ACCGAAGTCT ATACCATCAA CGGCAGCACG

451 AAATCGGGTG CGAAATCCGC TTCCAAAACC GGCAGGGTCA GCGTCGTCAT

501 CCAGCCTTCA AGCACACAAA AAACCGAATA A
```

This corresponds to the amino acid sequence <SEQ ID 746; ORF 214-1.ng>:

```
g214-1.pep
   1 MIQKICKLFV LIVIFATSPA FALQSDSRRP IQIEADQGSL DQANQSTTFS

51 GNVIIRQGTL NISASRVNVT RGGKGGESVR AEGSPVRFSQ TLDGGKGTVR

101 GQANNVTYSS AGSTVVLTGN AKVQRGGDVA EGAVITYNTK TEVYTINGST

151 KSGAKSASKT GRVSVVIQPS STQKTE*
```

The following partial DNA sequence was identified in *N. meningitidis* <SEQ ID 747>:

```
m214-1.seq
   1 ATGATACAAA AGATATGTAA GCTATTTGTT TTAATAGCAT TTTTTTCGGC

51 GTCCCCCGCT TTTGCCCTTC AAAGCGACAG CAGGCAGCCT ATTCAGATTG
```

-continued

```
101 AGGCCGACCA AGGTTCGCTC GATCAAGCCA ACCAAAGCAC CACATTCAGC

151 GGAAACGTCG TCATCAGACA GGGTACGCTC AATATTTCCG CCGCCCGCGT

201 CAATGTTACA CGCGGCGGCA AAGGCGGCGA ATCCGTGAGG GCGGAAGGTT

251 CGCCAGTCCG CTTCAGCCAG ACATTGGACG GCGGCAAAGG CACGGTGCGC

301 GGACAGGCAA ACAACGTTGC TTATTCATCT GCAGGCAGCA CCGTAGTCTT

351 AACCGGTAAT GCCAAAGTAC AGCGCGGCGG CGATGTCGCC GAAGGTGCGG

401 TGATTACATA CAACACCAAA ACCGAAGTCT ATACCATCAG CGGCAGCACA

451 AAATCCGGCG CAAAATCCGC TTCCAAATCC GGCAGGGTCA GCGTCGTTAT

501 CCAGCCTTCG AGTACGCAAA AATCCGAATA A
```

This corresponds to the amino acid sequence <SEQ ID 748; ORF 214-1>:

```
m214-1.pep

1   MIQKICKLFV LIAFFSASPA FALQSDSRQP IQIEADQGSL DQANASTTFS

51   GNVVIRQGTL NISAARVNVT RGGKGGESVR AEGSPVRFSQ TLDGGKGTVR

101   GQANNVAYSS AGSTVVLTGN AKVQRGGDVA EGAVITYNTK TEVYTISGST

151   KSGAKSASKS GRVSVVIQPS STQKSE* m214-1/g214-1  93.8% identity in 176 aa overlap 10        20        30        40        50        60
m214-1.pep    MIQKICKLFVLIAFFSASPAFALQSDSRQPIQIEADQGSLDQANQSTTFSGNVVIRQGTL
              ||||||||||::|::||||||||||||||:||||||||||||||||||||||:|||||
g214-1        MIQKICKLFVLIVIFATSPAFALQSDSRRPIQIEADQGSLDQANQSTTFSGNVIIRQGTL
                  10        20        30        40        50        60

70        80        90       100       110       120
m214-1.pep    NISAARVNVTRGGKGGESVRAEGSPVRFSQTLDGGKGTVRGQANNVAYSSAGSTVVLTGN
              ||||:|||||||||||||||||||||||||||||||||||||||:|||||||||||||
g214-1        NISASRVNVTRGGKGGESVRAEGSPVRFSQTLDGGKGTVRGQANNVTYSSAGSTVVLTGN
                  70        80        90       100       110       120

130       140       150       160       170
m214-1.pep    AKVQRGGDVAEGAVITYNTKTEVYTISGSTKSGAKSASKSGRVSVVIQPSSTQKSEX
              ||||||||||||||||||||||||||||:||||||||||:|||||||||||||:||
g214-1        AKVQRGGDVAEGAVITYNTKTEVYTINGSTKSGAKSASKTGRVSVVIQPSSTQKTEX
                 130       140       150       160       170 g214-1/p38685
sp|P38685|YHBN_ECOLI 17.3 KD PROTEIN IN MURA-RPON INTERGENIC REGION PRECURSOR (ORF185)
>gi|551336 (U12684) orf185 [Escherichia coli] >gi|606139 (U18997_ ORF_o185 [Escherichia coli]
>gi|1789592 (AE0000399) orf, hypothetical protein [Escherichia coli] Length = 185
Score = 97.1 bits (238), Expect = 6e-20
Identities = 57/126 (45%), Positives = 74/126 (58%), Gaps = 3/126 (2%)
    Query:  19  PAFALQSDSRQPIQIEADQGSLDQANQSTTFSGNVVIRQGTLNISAARVNVTR--GGKGG  76
                PAFA+  D+ QPI IE+DQ SLD    TF+GNV++ QGT+ I+A +V VTR  G +G
    Sbjct:  24  PAFAVTGDTDQPIHIESDQQSLDMQGNVVTFTGNVIVTQGTIKINADKVVVTRPGGEQGK  83

Query:  77  ESVRAEGSPVRFSQTLDGGKGTVRGQANNVAYSSAGSTVVLTGNAKVQRGGDVAEGAVIT 136
                E +   GP F Q  D GK  VG A+ + Y  A   VVLTGNA+Q+       +G  IT
    Sbjct:  84  EVIDGYGKPATFYQMQDNGK-PVEGHASQMHYELAKDFVVLTGNAYLQQVDSNIKGDKIT 142

Query: 137  YNTKTE 142
                Y  K +
    Sbjct: 143  YLVKEQ 148
```

The following partial DNA sequence was identified in *N. meningitidis* <SEQ ID 749>:

```
a214-1.seq
    1 ATGATACAAA AGATATGTAA GCTATTTGTT TTAATAGCAT TTTTTTCGGC

51 GTCCCCCGCT TTTGCCCTTC AAAGCGACAG CAGGCAGCCT ATTCAGATTG

101 AGGCCGACCA AGGTTCGCTC GATCAAGCCA ACCAAAGCAC CACATTCAGC
```

-continued

```
151 GGAAACGTCG TCATCAGACA GGGTACGCTC AATATTTCCG CCGCCCGCGT

201 CAATGTTACA CGCGGCGGCA AAGGCGGCGA ATCCGTGAGG GCGGAAGGTT

251 CGCCAGTCCG CTTCAGCCAG ACATTGGACG GCGGCAAAGG CACGGTGCGC

301 GGACAGGCAA ACAACGTTGC TTATTCATCT GCAGGCAGCA CCGTAGTCTT

351 AACCGGTAAT GCCAAAGTAC AGCGCGGCGG CGATGTCGCC GAAGGTGCGG

401 TGATTACATA CAACACCAAA ACCGAAGTCT ATACCATCAG CGGCAGCACA

451 AAATCCGGCG CAAAATCCGC TTCCAAATCC GGCAGGGTCA GCGTCGTTAT

501 CCAGCCTTCG AGTACGCAAA AATCCGAATA A
```

This corresponds to the amino acid sequence <SEQ ID 750; ORF 214-1.a>:

```
a214-1.pep

1  MIQKICKLFV LIAFFSASPA FALQSDSRQP IQIEADQGSL DQANQSTTFS

51  GNVVIRQGTL NISAARVNVT RGGKGGESVR AEGSPVRFSQ TLDGGKGTVR

101  GQANNVAYSS AGSTVVLTGN AKVQRGGDVA EGAVITYNTK TEVYTISGST

151  KSGAKSASKS GRVSVVIQPS STQKSE* a214-1/m214-1   100.0% identity in 176 aa overlap 10         20         30         40         50         60
a214-1.pep   MIQKICKLFVLIAFFSASPAFALQSDSRQPIQIEADQGSLDQANQSTTFSGNVVIRQGTL
             ||||||||||||||||||||||||||||||||||||||||||||||||||||||||||||
m214-1       MIQKICKLFVLIAFFSASPAFALQSDSRQPIQIEADQGSLDQANQSTTFSGNVVIRQGTL
                  10         20         30         40         50         60

70         80         90        100        110        120
a214-1.pep   NISAARVNVTRGGKGGESVRAEGSPVRFSQTLDGGKGTVRGQANNVAYSSAGSTVVLTGN
             ||||||||||||||||||||||||||||||||||||||||||||||||||||||||||||
m214-1       NISAARVNVTRGGKGGESVRAEGSPVRFSQTLDGGKGTVRGQANNVAYSSAGSTVVLTGN
                  70         80         90        100        110        120

130        140        150        160        170
a214-1.pep   AKVQRGGDVAEGAVITYNTKTEVYTISGSTKSGAKSASKSGRVSVVIQPSSTQKSEX
             |||||||||||||||||||||||||||||||||||||||||||||||||||||||||
m214-1       ARVQRGGDVAEGAVITYNTKTEVYTISGSTKSGAKSASKSGRVSVVIQPSSTQKSEX
                 130        140        150        160        170
```

The following partial DNA sequence was identified in *N. gonorrhoeae* <SEQ ID 751>:

```
g215.seq
    1 atgaaagtaa gatggcggta cggaattgcg ttcccattga tattggcggt 51 tgccttgggc agcctgtcgg catggttggg ccgtatcagc gaagtcgaaa 101 tcgaggaagt caggctcaat cccgacgaac ctcaatacac aatggacggc 151 ttggacggaa ggcggtttga cgaacaggga tacttgaaag aacatttgag 201 cgcgaaaggt gcgaaacagt ttcccgaaaa cagcgacatc cattttgatt 251 cgccgcatct cgtgttcttc caagaaggca ggctgttgta cgaagtcggc 301 agcgatgaag ccgtttacca taccgaaaac aaacaggttc tttttaaaaa 351 caacgttgtg ctgaccaaaa ccgccgacgg caggcggcag gcgggtaaag 401 tcgaaaccga aaaactgcac gtcgataccg aatctcaata tgcccaaacc 451 gatacgcctg tcagtttcca atatggcgcg tcgcacggtc aggcgggcgg 501 tatgacctac aaccacaaaa caggcatgtt gaacttctca tctaaagtga 551 aaaccacaat ttataataca aaaaatatat aa
```

This corresponds to the amino acid sequence <SEQ ID 752; ORF 215.ng>:

```
g215.pep
    1 MKVRWRYGIA FPLILAVALG SLSAWLGRIS EVEIEEVRLN PDEPQYTMDG

51 LDGRRFDEQG YLKEHLSAKG AKQFPENSDI HFDSPHLVFF QEGRLLYEVG

101 SDEAVYHTEN KQVLFKNNVV LTKTADGRRQ AGKVETEKLH VDTESQYAQT

151 DTPVSFQYGA SHGQAGGMTY NHKTGMLNFS SKVKAAIYDT KDM*
```

The following partial DNA sequence was identified in *N. meningitidis* <SEQ ID 753>:

```
m215.seq (partial)
    1 ..AGCCTGTCGG CATGGTTGGG TCGTATCAGC GAAGTCGAGA TTGAAGAAGT

51   CAGGCTCAAT CCCGACGAAC CGCAATACAC AATGGACAGC TTGGACGGCA

101   GGCGGTTTGA CGAACAGGGA TACTTGAAAG AACATTTGAG CGCGAAGGGC

151   GCGAAACAGT TTCCGGAAAG CAGCGACATC CATTTTGATT CGCCGCATCT

201   CGTGTTCTTC CAAGAAGGCA GGTTGTTGTA CGAAGTCGGC AGCGACGAAG

251   CCGTTTACCA TACCGAAAAC AAACAGGTTC TTTTTAAAAA CAACGTTGTG

301   CTGACCAAAA CCGCCGACGG CAAACGGCAG GCGGGTAAAG TTGAAGCCGA

351   AAAGCTGCAC GTCGATACCG AATCTCAATA TGCCCAAACC GATACGCCTG

401   CAGTTTCCA ATATGGTGCA TCGCACGGTC AGGCGGGCGG CATGACTTAC

451   GACCACAwwA CAGGCATGTT GAACTTCTCA TCTAAAGTGA AAGCCACGAT

501   TTATGATACA AAAGATATGT AA
```

This corresponds to the amino acid sequence <SEQ ID 754; ORF 215>:

```
m215.pep (partial)
    1 ..SLSAWLGRIS EVEIEEVRLN PDEPQYTMDS LDGRRFDEQG YLKEHLSAKG

51   AKQFPESSDI HFDSPHLVFF QEGRLLYEVG SDEAVYHTEN KQVLFKNNVV

101   LTKTADGKRQ AGKVEAEKLH VDTESQYAQT DTPVSFQYGA SHGQAGGMTY

151   DHXTGMLNFS SKVKATIYDT KDM*
```

Computer analysis of this amino acid sequence gave the following results:

Homology with a Predicted ORF from *N. gonorrhoeae*

ORF 215 shows 96.0% identity over a 173 aa overlap with a predicted ORF (ORF 215.ng) from *N. gonorrhoeae*:

```
m215/g215

10        20        30        40
m215.pep                          SLSAWLGRISEVEIEEVRLNPDEPQYTMDSLDGRRFDEQG
                                  |||||||||||||||||||||||||||||:||||||||||
g215          MKVRWRYGIAFPLILAVALGSLSAWLGRISEVEIEEVRLNPDEPQYTMDGLDGRRFDEQG
                      10        20        30        40        50        60

50        60        70        80        90       100
m215.pep      YLKEHLSAKGAKQFPESSDIHFDSPHLVFFQEGRLLYEVGSDEAVYHTENKQVLFKNNVV
              ||||||||||||||||:|||||||||||||||||||||||||||||||||||||||||||
g215          YLKEHLSAKGAKQFPENSDIHFDSPHLVFFQEGRLLYEVGSDEAVYHTENKQVLFKNNVV
                      70        80        90       100       110       120
```

-continued

```
                 110         120         130         140         150         160
m215.pep LTKTADGKRQAGKVEAEKLHVDTESQYAQTDTPVSFQYGASHGQAGGMTYDHXTGMLNFS
         |||||||:|||||||:||||||||||||||||||||||||||||||||||:| |||||||
g215     LTKTADGRRQAGKVETEKLHVDTESQYAQTDTPVSFQYGASHGQAGGMTYNHXTGMLNFS
                 130         140         150         160         170         180

170
m215.pep SKVKATIYDTKDMX
         |||||:||||||||
g215     SKVKAAIYDTKDMX
                 190
```

The following partial DNA sequence was identified in *N. meningitidis* <SEQ ID 755>:

```
a215.seq
    1 ATGAAAGTAA GATGGCGGTA CGGAATTGCG TTCCCATTGA TATTGGCGGT

51 TGCCTTGGGC AGCCTGTCGG CATGGTTGGG ACGCATCAGC GAAGTCGAGA

101 TTGAAGAAGT CAGGCTCAAT CCCGACGAAC CGCAATACAC AATGGACGGA

151 TTGGATGGCA GGCGGTTTGA CGAACAGGGA TACTTGAAAG AACATTTGAG

201 TTCGAAGGGC GCGAAACAGT TTCCCGAAAG CAGCGACATT CATTTCGACT

251 CACCGCATCT CGTGTTCTTC CAAGAAGGCA GGTTGTTGTA CGAAGTCGGC

301 AGCGATGAAG CCGTTTACCA TACCGAAAAC AAACAGGTTC TTTTTAAAAA

351 CAACGTTGTG CTGACCAAAA CCGCCGACGG CAAACGGCAG GCGGGTAAAG

401 TTGAAGCCGA AAAGCTGCAC GTCGATACCG AATCTCAATA TGCCCAAACC

451 GATACGCCTG TCAGTTTCCA ATATGGTGCA TCGCACGGTC AGGCGGGCGG

501 CATGACTTAC GACCACAAAA CAGGCATGTT GAACTTCTCA TCTAAAGTGA

551 AAGCCACGAT TTATGATACA AAAGATATGT AA
```

This corresponds to the amino acid sequence <SEQ ID 756; ORF 215.a>:

```
a215.pep
    1 MKVRWRYGIA FPLILAVALG SLSAWLGRIS EVEIEEVRLN PDEPQYTMDG

51 LDGRRFDEQG YLKEHLSSKG AKQFPESSDI HFDSPHLVFF QEGRLLYEVG

101 SDEAVYHTEN KQVLFKNNVV LTKTADGKRQ AGKVEAEKLH VDTESQYAQT

151 DTPVSFQYGA SHGQAGGMTY DHKTGMLNFS SKVKATIYDT KDM*
```

(In a215.pep, residues 1–23, "MKVRWRYGIA FPLILAVALG SLS", are underlined.)

m215/a215 98.3% identity in 173 aa overlap

```
                                              10         20         30         40
m215.pep                        SLSAWLGRISEVEIEEVRLNPDEPQYTMDSLDGRRFDEQG
                                |||||||||||||||||||||||||||||:||||||||||
a215        MKVRWRYGIAFPLILAVALGSLSAWLGRISEVEIEEVRLNPDEPQYTMDGLDGRRFDEQG
                    10         20         30         40         50         60

50         60         70         80         90        100
m215.pep    YLKEHLSAKGAKQFPESSDIHFDSPHLVFFQEGRLLYEVGSDEAVYHTENKQVLFKNNVV
            |||||||:||||||||||||||||||||||||||||||||||||||||||||||||||||
a215        YLKEHLSSKGAKQRPESSDIHFDSPHLVFFQEGRLLYEVGSDEAVYHTENKQVLFKNNVV
                    70         80         90        100        110        120

110        120        130        140        150        160
m215.pep    LTKTADGKRQAGKVEAEKLHVDTESQYAQTDTPVSFQYGASHGQAGGMTYDHXTGMLNFS
            |||||||||||||||||||||||||||||||||||||||||||||||||||| |||||||
a215        LTKTADGKRQAGKVEAEKLHVDTESQYAQTDTPVSFQYGASHGQAGGMTYDHKTGMLNFS
                   130        140        150        160        170        180
```

```
                    170
m215.pep    SKVKATIYDTKDMX
            ||||||||||||||
a215        SKVKATIYDTKDMX
                    190
```

The following partial DNA sequence was identified in *N. gonorrhoeae* <SEQ ID 757>:

```
g216.seq (partial)
   1 ...  atgatatcga tttcgagctc ggtacccagc gacgaaatca ccgccatcat 51       ccccgcactc aaacgcaaag acattaccct cgtctgcatc accgcccgcc 101       ccgattcaac catggcgcgc catgccgata tccacatcac cgcatcggtt 151       tcgcaagaag cctgcccgtt ggggcttgcc ccgaccacca gcaccaccgc 201       cgttatggct ttgggcgacg cgttggcggt cgtcctgctg cgcgcccgcg 251       cgttcacgcc cgacgacttc gccttgatcc accctgccgg cagcctcggc 301       aaacgcctgc ttttgcgcgt tgccgacatt atgcacaaag gcggcggcct 351       gcccgccgtc cgactcggca cgcccttgaa aggagccatc gtcagcatga 401       gcgagaaagg tttgggcatg tgggcgggaa cggacgggca aaggctgtct 451       gaaaggcctt tttactga
```

This corresponds to the amino acid sequence <SEQ ID 758; ORF 216.ng>:

```
g216.pep (partial)
   1 ...  MISISSSVPS DEITAIIPAL KRKDITLVCI TARPDSTMAR HADIHITASV

51       SQEACPLGLA PTTSTTAVMA LGDALAVVLL RARAFTPDDF ALIHPAGSLG

101       KRLLLRVADI MHKGGGLPAV RLGTPLKGAI VSMSEKGLGM WAGTDGQRLS

151       ERPFY*
```

The following partial DNA sequence was identified in *N. meningitidis* <SEQ ID 759>:

```
m216.seq
   1 ATGGCAATGG CAGAAAACGG AAAATATCTC GACTGGGCAC GCGAAGTGTT

51 GCACGCCGAA GCGGAAGGCT TGCGCGAAAT TGCAGCGGAA TTGsACAAAA

101 ACTTCGTCCT TGCGGCAGAC GCGTTGTTGC ACTGCAAGGG CAGGGTCGTT

151 ATCACGGGCA TGGTCAAGTC GGGACATATC GGGCGCAAAA TGGCGGCAAC

201 TATGGCCTCG ACCGGCACGC CTGCGTTTTT CGTCCACCCT GCGGAAGCGG

251 CACACGgCGA TTTGGGTATG ATTGTGGACA rCGACGTGGT CGTCGCGATT

301 TCCAATTCCG GCGAAAGCGA CGAAATCGCC GCCATCATCC CCGCACTCAA

351 ACGCAAAGAC ATCACGCTTG TCTGCATCAC CGCCCGCCCC GATTCAACCA

401 TGGCGCGCCA TGCCGACATC CACATCACGG CGTCGGTTTC CAAAGAAGCC

451 TGCCCGCTGG GGCTTGCCCC GACCACCAGC ACCACCGCCG TCATGGCTTT

501 GGGCGATGCG TTGGCGGTCG TCCtGCTGCG CgcACGCGCG TTCACGCCCG

551 ACGATTTCGC CTTGAGCCAT CCTGCCGGCA GCCTCGGCAA ACGCCTACTT

601 TTGCGCGTTG CCGACATTAT GCACAAAGGC GGCGGCCTGC CTGCCGTCCG

651 ACTCGGCACG CCCTTGAAAG AAGCCATCGT CAGCATGAGT GAAAAGGGC
```

-continued

```
701  TGGGCATGTT GGCGGTAACG GACGGGCAAG GCCGTCTGAA AGGCGTATTC

751  ACCGACGGCG ATTTGCGCCG CCTGTTTCAA GAATGCGACA ATTTTACCGG

801  TCTTTCGATA GACGAAGTCA TGCATACGCA TCCTAAAACC ATCTCCGCCG

851  AACGTCTCGC CACCGAAGCC CTGAAAGTCA TGCAGGCAAA CCATGTGAAC

901  GGGCTTCTGG TTACCGATGC AGATGGCGTG CTGATCGGCG CGCTGAATAT

951  GCACGACCTG CTGGCGGCAC GGATTGTATA G
```

This corresponds to the amino acid sequence <SEQ ID 760; ORF 216>:

```
m216.pep
   1  MAMAENGKYL DWAREVLHAE AEGLREIAAE LXKNFVLAAD ALLHCKGRVV

51  ITGMVKSGHI GRKMAATMAS TGTPAFFVHP AEAAHGDLGM IVDXDVVVAI

101  SNSGESDEIA AIIPALKRKD ITLVCITARP DSTMARHADI HITASVSKEA

151  CPLGLAPTTS TTAVMALGDA LAVVLLRARA FTPDDFALSH PAGSLGKRLL

201  LRVADIMHKG GGLPAVRLGT PLKEAIVSMS EKGLGMLAVT DGQGRLKGVF

251  TDGDLRRLFQ ECDNFTGLSI DEVMHTHPKT ISAERLATEA LKVMQANHVN

301  GLLVTDADGV LIGALNMHDL LAARIV*
```

Computer analysis of this amino acid sequence gave the following results:
Homology with a Predicted ORF from *N. gonorrhoeae*
ORF 216 shows 91.8% identity over a 147 aa overlap with a predicted ORF (ORF 216.ng) from *N. gonorrhoeae*:

```
m216/g216
                    70         80         90        100        110        120
    m216.pep TMASTGTPAFFVHPAEAAHGDLGMIVDXDVVVAISNSGESDEIAAIIPALKRKDITLVCI
                 :::||:|   ||||:|||||:||||||||||||
    g216                                 MISISSSVPSDEITAIIPALKRKDITLVCI
                                                 10         20         30
                   130        140        150        160        170        180
    m216.pep TARPDSTMARHADIHITASVSKEACPLGLAPTTSTTAVMALGDALAVVLLRARAFTPDDF
             |||||||||||||||||||||:|||||||||||||||||||||||||||||||||||||
    g216     TARPDSTMARHADIHITASVSQEACPLGLAPTTSTTAVMALGDALAVVLLRARAFTPDDF
                     40         50         60         70         80         90
                   190        200        210        220        230        240
    m216.pep ALSHPAGSLGKRLLLRVADIMHKGGGLPAVRLGTPLKEAIVSMSEKGLGMLAVTDGQGRL
             ||  ||||||||||||||||||||||||||||||||| |||||||||| | ||||
    g216     ALIHPAGSLGKRLLLRVADIMHKGGGLPAVRLGTPLKGAIVSMSEKGLGMWAGTDGQRLS
                    100        110        120        130        140        150
```

The following partial DNA sequence was identified in *N. meningitidis* <SEQ ID 761>:

```
a216.seq
   1  ATGGCGATGG CAGGAAACGA AAAATATCTT GATTGGGCAC GCGAAGTGTT

51  GCACACCGAA GCGGAAGGCT TGCGCGAAAT TGCGGCGGAT TTGGACGAAA

101  ACTTCGCCCT TGCGGCGGAC GCGTTGTTGC ACTGCAAAGG CAGGGTCGTT

151  ATCACGGGCA TGGGCAAGTC GGGACATATC GGGCGCAAAA TGGCGGCAAC

201  CATGGCCTCG ACCGGCACGC CCGCGTTTTT CGTCCACCCT GCGGAAGCGG

251  CACACGGCGA TTTGGGCATG ATTGTGGACA ACGACGTGGT CGTCGCGATT

301  TCCAATTCCG GTGAAAGCGA CGAAATCGCC GCCATCATCC CCGCGCTCAA
```

-continued

```
351  ACGCAAAGAT ATCACGCTTG TCTGCATCAC CGCCCGCCCC GATTCAACCA

401  TGGCGCGCCA TGCCGACATC CACATCACGG CGTCGGTTTC CAAAGAAGCC

451  TGCCCGCTGG GGCTTGCCCC GACCACCAGC ACCACCGCCG TTATGGCTTT

501  GGGCGATGCG TTGGCGGTTG TCCTGCTGCG CGCCCGCGCG TTCACGCCCG

551  ACGACTTCGC CTTGAGCCAC CCTGCCGGCA GCCTCGGCAA ACGCCTACTT

601  TTGCGCGTTG CCGACATTAT GCACAAAGGC GGCGGCCTGC CTGCCGTCCG

651  ACTCGGCACG CCCTTGAAAG AAGCCATCGT CAGCATGAGT GAAAAAGGGC

701  TGGGCATGTT GGCGGTAACG GACGGGCAAG GCCGTCTGAA AGGCGTATTC

751  ACCGACGGCG ATTTGCGCCG CCTGTTTCAA GAATGCGACA ATTTTACCGG

801  TCTTTCGATA GACGAAGTCA TGCATACGCA TCCTAAAACC ATCTCCGCCG

851  AACGTCTCGC CACCGAAGCC CTGAAAGTCA TGCAGGCAAA CCATGTGAAC

901  GGGCTTCTGG TTACCGATGC AGATGGCGTG CTGATCGGCG CGCTGAATAT

951  GCACGACCTT TTGGCGGCGC GGATTGTATA G
```

This corresponds to the amino acid sequence <SEQ ID 25 762; ORF 216.a>:

```
a216.pep
  1  MAMAGNEKYL DWAREVLHTE AEGLREIAAD LDENFALAAD ALLHCKGRVV

51  ITGMGKSGHI GRKMAATMAS TGTPAFFVHP AEAAHGDLGM IVDNDVVVAI

101  SNSGESDEIA AIIPALKRKD ITLVCITARP DSTMARHADI HITASVSKEA

151  CPLGLAPTTS TTAVMALGDA LAVVLLRARA FTPDDFALSH PAGSLGKRLL

201  LRVADIMHKG GGLPAVRLGT PLKEAIVSMS EKGLGMLAVT DGQGRLKGVF

251  TDGDLRRLFQ ECDNFTGLSI DEVMHTHPKT ISAERLATEA LKVMQANHVN

301  GLLVTDADGV LIGALNMHDL LAARIV*
``` m216/a216 971% identity in 326 aa overlap

```
                10         20         30         40         50         60
m216.pep MAMAENGKYLDWAREVLHAEAEGLREIAAELXKNFVLAADALLHCKGRVVITGMVKSGHI
         ||||  | |||||||||||| |||||||||| | :||:||||||||||||||||| |||||
a216     MAMAGNEKYLDWAREVLHTEAEGLREIAADLDENFALAADALLHCKGRVVITGMGKSGHI
                10         20         30         40         50         60

70         80         90        100        110        120
m216.pep GRKMAATMASTGTPAFFVHPAEAAHGDLGMIVDXDVVVAISNSGESDEIAAIIPALKRKD
         ||||||||||||||||||||||||||||||||| ||||||||||||||||||||||||||
a216     GRKMAATMASTGTPAFFVHPAEAAHGDLGMIVDNDVVVAISNSGESDEIAAIIPALKRKD
                70         80         90        100        110        120

130        140        150        160        170        180
m216.pep ITLVCITARPDSTMARHADIHITASVSKEACPLGLAPTTSTTAVMALGDALAVVLLRARA
         ||||||||||||||||||||||||||||||||||||||||||||||||||||||||||||
a216     ITLVCITARPDSTMARHADIHITASVSKEACPLGLAPTTSTTAVMALGDALAVVLLRARA
               130        140        150        160        170        180

190        200        210        220        230        240
m216.pep FTPDDFALSHPAGSLGKRLLLRVADIMHKGGGLPAVRLGTPLKEAIVSMSEKGLGMLAVT
         ||||||||||||||||||||||||||||||||||||||||||||||||||||||||||||
a216     FTPDDFALSHPAGSLGKRLLLRVADIMHKGGGLPAVRLGTPLKEAIVSMSEKGLGMLAVT
               190        200        210        220        230        240

250        260        270        280        290        300
m216.pep DGQGRLKGVFTDGDLRRLFQECDNFTGLSIDEVMHTHPKTISAERLATEALKVMQANHVN
         ||||||||||||||||||||||||||||||||||||||||||||||||||||||||||||
a216     DGQGRLKGVFTDGDLRRLFQECDNFTGLSIDEVMHTHPKTISAERLATEALKVMQANHVN
               250        260        270        280        290        300
```

```
              310        320
m216.pep  GLLVTDADGVLIGALNMHDLLAARIVX
          ||||||||||||||||||||||||||
    a216  GLLVTDADGVLIGALNMHDLLAARIVX
              310        320
```

The following partial DNA sequence was identified in *N. gonorrhoeae* <SEQ ID 763>:

```
g217.seq
    1  atggcggatg acggtttgtt gcggcaactg tccgaaaaac ccagccaaag 51  tgctctcttc ctgccatttg acccattcgt tttcgaggtt ttggactgcc 101  ttttggtcat cgggcccggc ttgaaacaat gtttcaagca aatcccggca 151  acgcgccacc cattcgccga ccgtcgcagg ttgccgccat atccgggcaa 201  tatccgacag ggtttcgagg aaggcggcaa aacgtccgaa catggcggtt 251  tgattcacgt cggcatacca cgcgctgaca tcctgccaca tcgggttgcc 301  gccttcgggc agcatccagc ccaatatcat acggtctgcc gcctgcttcc 351  aggtaaacag ctgatccgtg ccgccgcgca tttctccgtc aatccccaa 401  tggacgttca aatcggcaac catatcgtgc aaaagcggca aatcgtcccc 451  ggtcagtccg aaacggcgca acacgggcgc ggtttccaaa agcgcgagca 501  ctttgccgac ttcaaaacgg ctttccagca agtcggacac gcactccaac 551  gcataaaaaa acggttgccg gcggctgatt ttcacgtccg aaacggaata 601  cggcaatgcc tgcgcgccgg gttgcgcctg tccgaacacg gcttccataa 651  aaggcgtata gggttcgata ttcggggtta a
```

This corresponds to the amino acid sequence <SEQ ID 764; ORF 217.ng>:

```
g217.pep..
    1  MADDGLLRQL SEKPSQSALF LPFDPFVFEV LDCLLVIGPG LKQCFKQIPA

51  TRHPFADRRR LPPYPGNIRQ GFEEGGKTSE HGGLIHVGIP RADILPHRVA

101  AFGQHPAQYH TVCRLLPGKQ LIRAAAHFSV QSPMDVQIGN HIVQKRQIVP

151  GQSETAQHGR GFQKREHFAD FKTAFQQVGH ALQRIKKRLP AADFHVRNGI

201  RQCLRAGLRL SEHGFHKRRI GFDIRG*
```

The following partial DNA sequence was identified in *N. meningitidis* <SEQ ID 765>:

```
m217.seq
    1  ATGGCGGATG ACGGTGTGCG GCGGCAACTG TCCGGAAAAT TGCGCCAATT

51  CGGTTTCCGC CTrCCATTTG ACCCATTCGT TTTCAAGGTT TTGGACTGAC

101  TTTTGGTCAT CGGCTTCAGC TTGGAACAAT GTTTCAAGCA AATCCCGGCA

151  ACGCGCCACC CATTCGCCGA CCGTTGCGGG CTGCCGCCAT ATCCGTACAA

201  TATCCGTCAG GGTTTCGAGG AAGGCGGCAA AACGTCCGAA CATGGCGGTT

251  TGATTCACGT CGGCATACCA CGCGCTGACA TCCTGCCACA TCGGATTGCC

301  GCCTTTGGGC AGCATCCAGC CCAATATCAT GCGTTCTACC GCCTGCTTCC

351  AGGTGAACAG CTGATCCGTG CCGCCGCGCA TTTCTCCGTC AAACCCCAG

401  TGGACGTTCA AATCGGCAAC CATGTCGTGC AAAAGCGGTA AATCGTCCTC
```

-continued

```
451 AGTCAGTCCG AAACGGCGCA ACACGGGCGC GGTTTCTAAA AGCACAAGCA

501 CTTTATCGAC TTCAAATCGG CTTTCCAACA AGTCGAACAG GCATGACAAA

551 GCATGAAACA GCGGTTGGCG GCGGCTGATT TTCACGTCTG ACACGGAATA

601 CGGCAATGCC TGCGCACCgG GCtGCGCCTG TCCGAACACG GCTTCGATAA

651 AAGGCGTATA GGATTCGATA TTCGGGGTTA A
```

This corresponds to the amino acid sequence <SEQ ID 766; ORF 217>:

```
m217.pep
   1 MADDGVRRQL SGKLRQFGFR LPFDPFVFKV LDXLLVIGFS LEQCFKQIPA

51 TRHPFADRCG LPPYPYNIRQ GFEEGGKTSE HGGLIHVGIP RADILPHRIA

101 AFGQHPAQYH AFYRLLPGEQ LIRAAAHFSV QTPVDVQIGN HVVQKRXIVL

151 SQSETAQHGR GFXKHKHFID FKSAFQQVEQ AXQSMKQRLA AADFHVXHGI

201 RQCLRTGLRL SEHGFDKRRI GFDIRG*
```

Computer analysis of this amino acid sequence gave the following results:

Homology with a Predicted ORF from *N. gonorrhoeae*
ORF 217 shows 80.5% identity over a 226 aa overlap with a predicted ORF (ORF 217.ng) from *N. gonorrhoeae*:

```
   m217/g217
                  10         20         30         40         50         60
   m217.pep MADDGVRRQLSGKLRQFGFRLPFDPFVFKVLDXLLVIGFSLEQCFKQIPATRHPFADRCG
            |||||:||||  |   |::|||||||||:||| ||||| :|:|||||||||||||||
   g217     MADDGLLRQLSGKPSQSALFLPFDPFVFEVLDCLLVIGPGLKQCFKQIPATRHPFADRRR
                  10         20         30         40         50         60

70         80         90        100        110        120
   m217.pep LPPYPYNIRQGFEEGGKTSEHGGLIHVGIPRADILPHRIAAFGQHPAQYHAFYRLLPGEQ
            ||||| |||||||||||||||||||||||||||||||||:||||||||||: |||||:|
   g217     LPPGPYNIRQGFEEGGKTSEHGGLIHVGIPRADILPHRVAAFGQHPAQYHTVCRLLPGKQ
                  70         80         90        100        110        120

130        140        150        160        170        180
   m217.pep LIRAAAHFSVQTPVDVQIGNHVVQKRXIVLSQSETAQHGRGFXKHKHFIDFKSAFQQVEQ
            ||||||||||:|:|||||||||:|||:|| ||:||||||||||| |:|| |||:||||| :
   g217     LIRAAAHFSVQSPMDVQIGNHIVQKRQIVPGQSETAQHGRGFQKREHFADFKTAFQQVGH
                 130        140        150        160        170        180

190        200        210        220
   m217.pep AXQSMKQRLAAADFHVXHGIRQCLRTGLRLSEHGFDKRRIGFDIRGX
            |  |:|:|| |||||| :|||||||:||||||||||| ||||||||
   g217     ALQRIKQRLPAADFHVRNGIRQCLRAGLRLSEHGFHKRRIGFDIRG
                 190        200        210        220
```

The following partial DNA sequence was identified in *N. meningitidis* <SEQ ID 767>:

```
a217.seq
   1 GTGGCGGATG ACGGTGTGCA GCGGCAACTG TCCGGAAAAT TGCGCCAATT

51 CGGTTTCCGC CTGCCATTTG ACCCATTCGT TTTCGAGGCT TTGGACTGCC

101 TTTTGGTCAT CGCCTTCGAC TTGGAACAAT GTTTCAAGCA AATCCCGGCA

151 ACGCGCCACC CATTCGTCAA CCGTCGCAGG TTGCCGCCAT ATCCGTACAA

201 TATCCGTCAG GGTTTCGAGG AAGGCGGCAA AACGTCCGAA CAGGGCGGTT

251 TGGTTCACGT CGGCATACCA CGCGCTGACC CCCTGCCACA TCGGATTGCC

301 GCCTTCGGGC AGCATCCAGC CCAATATCAT GCGTTCTACC GCCTGCTTCC
```

-continued

```
351  AGGTGAACAG CTGATCCGTG CCGCCGCGCA TTTCTCCGTC CAAACCCCAG

401  CGGACGTTCA AATCGGCAAC CATGTCGTGC AAAAGCGGCA AATCGTCCTC

451  AGTCAGTCCG AAATGGCGCA ACACGGGCGC GGTTTCTAAA AGCACAAGCA

501  CTTTATCGAC TTCAAATCGG CTTTCCAACA AGTCGAACAG GCATGACAAA

551  GCATGAAACA GCGGTTGTCG GCGGCTGATT TTCACATCCG AAACGGAATA

601  CGGCAATGCC TGCGCGCCGG GCTGCGCCTG TCCGAACACG GCTTCGATAA

651  AAGGCGTATA GGATTCGATA TTCGGGGTTA A
```

This corresponds to the amino acid sequence <SEQ ID 768; ORF 217.a>:

```
a217.pep
   1 VADDGVQRQL SGKLRQFGFR LPFDPFVFEA LDCLLVIAFD LEQCFKQIPA

51 TRHPFVNRRR LPPYPYNIRQ GFEEGGKTSE QGGLVHVGIP RADPLPHRIA

101 AFGQHPAQYH AFYRLLPGEQ LIRAAAHFSV QTPADVQIGN HVVQKRQIVL

151 SQSEMAQHGR GF*KHKHFID FKSAFQQVEQ A*QSMKQRLS AADFHIRNGI

201 RQCLRAGLRL SEHGFDKRRI GFDIRG*
``` m217/a217 90.1% identity in 226 aa overlap

```
                 10         20         30         40         50         60
m217.pep  MADDGVRRQLSGKLRQFGFRLPFDPFVFKVLDXLLVIGFSLEQCFKQIPATRHPFADRCG
          :||||:||||||||||||||||||||::||  ||||:|:||||||||||||||||::|
a217      VADDGVQRQLSGKLRQFGFRLPFDPPFVFEALDCLLVIAFDLEQCFKQIPATRHPFVNRRR
                 10         20         30         40         50         60

70         80         90        100        110        120
m217.pep  LPPYPYNIRQGFEEGGKTSEHGGLIHVGIPRADILPHRIAAFGQHPAQYHAFYRLLPGEQ
          ||||||||||||||||||||:|||:||||||| ||||||||||||||||||||||||||
a217      LPPYPYNIRQGFEEGGKTSEQGGLVHVGIPRADPLPHRIAAFGQHPAQYHAFYRLLPGEQ
                 70         80         90        100        110        120

130        140        150        160        170        180
m217.pep  LIRAAAHFSVQTPVDVQIGNHVVQKRXIVLSQSETAQHGRGFXKHKHFIDFKSAFQQVEQ
          ||||||||||||:||||||||||||||  ||||||  ||||||||||||||||||||||
a217      LIRAAAHFSVQTPADVQIGNHVVQKRQIVLSQSEMAQHGRGFXKHKHFIDFKSAFQQVEQ
                130        140        150        160        170        180

190        200        210        220
m217.pep  AXQSMKQRLAAADFHVXHGIRQCLRTGLRLSEHGFDKRRIGFDIRGX
          ||||||||||: :|||||:|||||||:|||||||||||||||||||
a217      AXQSMKQRLSAADFHIRNGIRQCLRAGLRLSEHGFDKRRIGFDIRGX
                190        200        210        220
```

The following partial DNA sequence was identified in *N. gonorrhoeae* <SEQ ID 769>:

```
g218.seq
   1 atggttgcgg tggatcctta tacggcaaaa gtggtcaaca ccatgccgcg 51 caatcagggt tggtatcaca ctatggatga aatccacggc gatatgatgc 101 tcggtgcggc aggcgattat cttttggaaa cggcagcttc actgaccatt 151 attatggttg tcagcggctt gtacctttgg tgggcgaaac agcgcggcat 201 taaagcgatg ctgctgccgc caaaaagcag ggcgcgttct tggtggcgga 251 atctgcacgg cgcgtttgga acttgggtgt cgttgatttt actgttgttc 301 tgcctgtcgg gtattgcttg ggcaggtatt tggggcggca aattcgtgca 351 ggcttggaat cagttcccgg ccggcaaatg gggtgtcgaa ccgaaccccg 401 tttcaatcgt gccgacccac ggcgaggtat tgaatgacgg caaggttaag
```

-continued

```
451  gaagtgccgt ggattttgga gcttatgcct atgcctgtct cagggacgac
501  tgtgggtgaa acggcatta accccaccga gcccaataac attggaaacc
551  gtcgaccgtt tcgcgcggga aatcggtttc aaagggcgtt atcagttgaa
601  tttgcccaaa ggcgaggacg gggtatggac tttgtcgcag gattctatga
651  gttatga
```

This corresponds to the amino acid sequence <SEQ ID 770; ORF 218.ng>:

```
g218.pep
  1  MVAVDPYTAK VVNTMPRNQG WYHTMDEIHG DMMLGAAGDY LLETAASLTI
 51  IMVVSGLYLW WAKQRGIKAM LLPPKSRARS WWRNLHGAFG TWVSLILLLF
101  CLSGIAWAGI WGGKFVQAWN QFPAGKWGVE PNPVSIVPTH GEVLNDGKVK
151  EVPWILELMP MPVSGTTVGE NGINPTEPNN IGNRRPFRAG NRFQRALSVE
201  FAQRRGRGMD FVAGFYEL*
```

The following partial DNA sequence was identified in *N. meningitidis* <SEQ ID 771>:

```
m218.seq
  1  ATGGTCGCGG TCGATCCTTA TACGGCAAAA GTGGTCAGTA CCATGCCGCG
 51  CAATCAGGGT TGGTATTACA CGATGGATGA AATCCACAGC GATATGATGC
101  TCGGTGCGGC AGGCGATTAT CTTTTGGAAA CGGCAGCTTC ACTGACCATT
151  ATTATGGTTG TCAGCGGCTT GTACCTTTGG TGGGTGAAAC GGCGCGGCAT
201  CAAGGCGATG CTGCTGCCGT CAAAAGGCAr GGCGCGTTCT TGGTGGCGGA
251  ATCTGCACGG CACGTTTGGA ACTTGGGTGT CGTTGATTTT GCTGTTGTTC
301  TGCCTGTCGG GTATTGCTTG GGCGGGTATT TGGGGCGGCA AGTTCGTACA
351  GGCTTGGAGT CAGTTCCCTG CCGGTAAATG GGGTGTCGAA CCGAACCCCG
401  TTTCAGTCGT GCCGACCCAC GGCGAGGTAT TGAATGACGG CAAGGTTAAG
451  GAAGTGCCGT GGGTTTTGGA GCTTACGCCT ATGCCTGTTT CAGGGACGaC
501  yGtgGGCAAA GACGGCATTA ACCCTGACGA GCCGATGACA TTGGAAACCG
551  TCGACCGCTT TGCGCGGnGA AATCGGTTTC AAAGGGCGTT ATCAGTTGAA
601  TTTGCCCAAA GGCGAGGACG GCGTATGGAC TTTGTCGCAG GATTCTATGA
651  GTTA
```

This corresponds to the amino acid sequence <SEQ ID 772; ORF 218>:

```
m218.pep
  1 MVAVDPYTAK VVSTMPRNQG WYYTMDEIHS DMMLGAAGDY LLETAASLTI
 51 IMVVSGLYLW WVKRRGIKAM LLPSKGXARS WWRNLHGTFG TWVSLILLLF
101 CLSGIAWAGI WGGKFVQAWS QFPAGKWGVE PNPVSVVPTH GEVLNDGKVK
151 EVPWVLELTP MPVSGTTVGK DGINPDEPMT LETVDRFARX NRFQRALSVE
201 FAQRRGRRMD FVAGFYEL
```

Computer analysis of this amino acid sequence gave the following results:
Homology with a Predicted ORF from *N. gonorrhoeae*
ORF 218 shows 87.2% identity over a 218 aa overlap with a predicted ORF (ORF 218.ng) from *N. gonorrhoeae*:

```
m218/g218
                  10         20         30         40         50         60
    m218.pep   MVAVDPYTAKVVSTMPRNQGWYYTMDEIHSDMMLGAAGDYLLETAASLTIIMVVSGLYLW
               |||||||||||:|||||||||:||||||:|||||||||||||||||||||||||||||||
    g218       MVAVDPYTAKVVNTMPRNQGWYHTMDEIHGDMMLGAAGDYLLETAASLTIIMVVSGLYLW
                  10         20         30         40         50         60

70        80         90        100        110        120
    m218.pep   WVKRRGIKAMLLPSKGXARSWWRNLHGTFGTWVSLILLLFCLSGIAWAGIWGGKFVQAWS
               |:|:|||||||||| |: |||||||||||:|||||||||||||||||||||||||||||:
    g218       WAKQRGIKAMLLPPKSRARSWWRNLHGAFGTWVSLILLLFCLSGIAWAGIWGGKFVQAWN
                  70         80         90        100        110        120

130        140        150        160        170        180
    m218.pep   QFPAGKWGVEPNPVSVVPTHGEVLNDGKVKEVPWVLELTPMPVSGTTVGKDGINPDEPMT
               |||||||||||||||:|||||||||||||||||:|||||||||||||||::|||| ||:
    g218       QFPAGKWGVEPNPVSIVPTHGEVLNDGKVKEVPWILELTPMPVSGTTVGENGINPTEPNN
                 130        140        150        160        170        180

190        200        210
    m218.pep   LETVDRFARXNRFQRALSVEFAQRRGRRMDFVAGFYEL
               : :   |    |||||||||||||||| ||||||||||
    g218       IGNRRPFRAGNRFQRALSVEFAQRRGRGMDFVAGFYEL
                 190        200        210
```

The following partial DNA sequence was identified in *N. meningitidis* <SEQ ID 773>:

```
a218.seq
  1 ATGGTCGCGG TCGATCCTTA TACGGCAAAA GTGGTCAGTA CCATGCCGCG

51 CAATCAGGGT TGGTATTACG CGATGGATGA AATCCACAGC GATATGATGC

101 TCGGTTCGAC AGGTGATTAT CTTTTGGAAA CGGCTGCATC GCTGACGATT

151 ATCATGATAA TCAGCGGTTT GTACCTTTGG TGGGTGAAAC GGCGCGGCAT

201 CAAGGCGATG CTGCTGCCGC CAAAAGGCAG GGCGCGTTCT TGGTGGCGGA

251 ATCTGCACGG CGCGTTTGGA ACTTGGGTGT CGTTGATTTT ACTGTTGTTC

301 TGCCTGTCGG GTATTGCTTG GGCAGGTATT TGGGGCGGCA AGTTCGTGCA

351 GGCTTGGAGT CAGTTCCCGG CAGGCAAATG GGGTGTCGAA CCGAACCCTG

401 TTTCAGTCGT GCCGACCCAC GGCGAGGTAT TGAATGACGG CAAGGTTAAG

451 GAAGTGCCGT GGGTTTTGGA GCTTACGCCT ATGCCTGTTT CAGGGACGAC

501 TGTGGGCAAA GACGGTATTA ACCCTGACGA GCCGATGACA TTGGAAACCG

551 TCGACCGTTT TGCGCGG.GA AATCGGTTTC AAAGGGCGTT ATCAGCTGAA

601 TTTGCCCAAA GGCGAGGACG GCGTATGGAC TTTGTCGCAG GATTCTATGA

651 GTTA
```

This corresponds to the amino acid sequence <SEQ ID 774; ORF 218.a>:

```
a218.pep
  1 MVAVDPYTAK VVSTMPRNQG WYYAMDEIHS DMMLGSTGDY LLETAASLTI

51 IMIISGLYLW WVKRRGIKAM LLPPKGRARS WWRNLHGAFG TWVSLILLLF

101 CLSGIAWAGI WGGKFVQAWS QFPAGKWGVE PNPVSVVPTH GEVLNDGKVK
```

```
151 EVPWVLELTP MPVSGTTVGK DGINPDEPMT LETVDRFARX NRFQRALSAE

201 FAQRRGRRMD FVAGFYEL
``` m218/a218 95.9% identity in 218 aa overlap

```
                 10         20         30         40         50         60
m218.pep  MVAVDPYTAKVVSTMPRNQGWYYTMDEIHSDMMLGAAGDYLLETAASLTIIMVVSGLYGW
          ||||||||||||||||||||||||:|||||||||::||||||||||||||:::|||||
a218      MVAVDPYTAKVVSTMPRNQGWYYAMDEIHSDMMLGSTGDYLLETAASLTIIMIISGLYGW
                 10         20         30         40         50         60

70         80         90        100        110        120
m218.pep  WVKRRGIKAMLLPSKGXARSWWRNLHGTFGTWVSLILLLFCLSGIAWAGIWGGKFVQAWS
          |||||||||||| ||  ||||||||||:|||||||||||||||||||||||||||||||
a218      WVKRRGIKAMLLPPKGRARSWWRNLHGAFGTWVSLILLLFCLSGIAWAGIWGGKFVQAWS
                 70         80         90        100        110        120

130        140        150        160        170        180
m218.pep  QFPAGKWGVEPNPVSVVPTHGEVLNDGKVKEVPWVLELTPMPVSGTTVGKDGINPDEPMT
          ||||||||||||||||||||||||||||||||||||||||||||||||||||||||||||
a218      QFPAGKWGVEPNPVSVVPTHGEVLNDGKVKEVPWVLELTPMPVSGTTVGKDGINPDEPMT
                130        140        150        160        170        180

190        200        210
m218.pep  LETVDRFARXNRFQRALSVEFAQRRGRRMDFVAGFYEL
          |||||||||||||||||||:|||||||||||||||||
a218      LETVDRFARXNRFQRALSAEFAQRRGRRMDFVAGFYEL
                190        200        210
```

The following partial DNA sequence was identified in *N. gonorrhoeae* <SEQ ID 775>:

```
g219.seq
   1 atgacggcaa ggttaaggaa gtgccgtgga ttttggagct tatgcctatg
  51 cctgtctcag ggacgactgt gggtgaaaac ggcattaacc ccaccgagcc
 101 caataacatt ggaaaccgtc gaccgtttcg cgcgggaaat cggtttcaaa
 151 gggcgttatc agttgaattt gcccaaaggc gaggacgggg tatggacttt
 201 gtcgcaggat tctatgagtt atgacatgat cagcccgttt gccgaccgca
 251 cggtacatat cgaccagtac agcggcgaga ttcttgccga catccgtttt
 301 gacgattaca acccgttcgg caaatttatg gcggcaagca ttgcgctgca
 351 tatggggact ttgggctggt ggagcgtgtt ggcgaacgtc gtgttctgcc
 401 ttgccgtgat ttttatcggc atcagcggct gcgtgatgtg gtggaaacgc
 451 cgtccgtccg gcgtggcggg cattgttcct ccggcgcaaa aaatcaaact
 501 gcccgtctgg tgggcgatgg cattgccgct gctgttgatt gcactgcttt
 551 tcccgaccgc gctgcttgcc attgccgtga tttggctgtt ggataccttg
 601 ctgctgtcgc ggattcctgt gttgaggaaa tggtttaaat ga
```

This corresponds to the amino acid sequence <SEQ ID 776; ORF 219.ng>:

```
g219.pep
   1 MTARLRKCRG FWSLCLCLSQ GRLWVKTALT PPSPITLETV DRFAREIGFK

51 GRYQLNLPKG EDGVWTLSQD SMSYDMISPF ADRTVHIDQY SGEILADIRF

101 DDYNPFGKFM AASIALHMGT LGWWSVLANV VFCLAVIFIG ISGCVMWWKR

151 RPSGVAGIVP PAQKIKLPVW WAMALPLLLI ALLFPTALLA IAVIWLLDTL

201 LLSRIPVLRK WFK*
```

The following partial DNA sequence was identified in *N. meningitidis* <SEQ ID 777>:

```
m219.seq
  1 ATGACGGCAA GGTTAAGGAA GTGCCGTGGG TTTTGGAGCT TACGCCTATG

51 CCTGTTTCAG GGACGaCyGt gGGCAAAGAC GGCATTAACC CTGACGAGCC

101 GATGACATTG GAAACCGTCG ACCGCTTTGC GCGGnGAAAT C

The following partial DNA sequence was identified in *N. meningitidis* <SEQ ID 779>:

```
a219.seq
  1 ATGACGGCAA GGTTAAGGAA GTGCCGTGGG TTTTGGAGCT TACGCCTATG

51 CCTGTTTCAG GGACGACTGT GGGCAAAGAC GGTATTAACC CTGACGAGCC

101 GATGACATTG GAAACCGTCG ACCGTTTTGC GCGG.GAAAT CGGTTTCAAA

151 GGGCGTTATC AGCTGAATTT GCCCAAAGGC GAGGACGGCG TATGGACTTT

201 GTCGCAGGAT TCTATGAGTT ACGACATGAT CAGCCCGTTT GCTGACCGCA

251 CGGTGCATAT CGACCAGTAC AGCGGCAAGA TTCTTGCCGA CATCCGTTTT

301 GACGATTACA ACCCGTTCGG CAAATTTATG GCGGCAAGCA TTGCGCTGCA

351 TATGGGGACT TTGGGCTGGT GGAGCGTGTT GGCGAACGTT TTGTTCTGCC

401 TTGCCGTGAT TTTTATCGGC ATCAGCGGCT GCGTGATGTG GTGGAAACGC

451 CGTCCGTCCG GCGCGGTGGG CATGGTTCCG CCGGCGCAAA AAATCAAGCT

501 GCCCGTCTGG TGGGCAATGG CGGTGCCGCT GCTGCTGATT GCATTGCTTT

551 TCCCGACCGC GTTGCTTGCC ATTGCCGTGA TTTGGCTGTT GGATACGCTG

601 CTGTTGTCGC GGATTCCTGT TTTGAGGAGA TGGTTTAAAT GA
```

This corresponds to the amino acid sequence <SEQ ID 780; ORF 219.a>:

```
a219.pep
  1 MTARLRKCRG FWSLRLCLFQ GRLWAKTVLT LTSR*HWKPS TVLRXEIGFK

51 GRYQLNLPKG EDGVWTLSQD SMSYDMISPF ADRTVHIDQY SGKILADIRF

101 DDYNPFGKFM AASIALHMGT LGWWSVLANV LFCLAVIFIG ISGCVMWWKR

151 RPSGAVGMVP PAQKIKLPVW WAMAVPLLLI ALLFPTALLA IAVIWLLDTL

201 LLSRIPVLRR WFK*
``` m219/a219 94.8% identity in 213 aa overlap

```
                   10        20        30        40        50        60
m219.pep   MTARLRKCRGFWSLRLCLFQGRXWAKTALTLTSRXHWKPSTALRGEIGFKGRYQLNLPKG
           |||||||||||||||||||||| ||||:|||||||||||||:|| |||||||||||||||
a219       MTARLRKCRGFWSLRLCLFQGRLWAKTVLTLTSRXHWKPSTVLRXEIGFKGRYQLNLPKG
                   10        20        30        40        50        60

70        80        90       100       110       120
m219.pep   EDGVWTLSQDSMSYDMISPFADRTVHIDQYSGKILADIRFDDYNPFGKFMAASIALHMGT
           ||||||||||||||||||||||||||||||||||||||||||||||||||||||||||||
a219       EDGVWTLSQDSMSYDMISPFADRTVHIDQYSGKILADIRFDDYNPFGKFMAASIALHMGT
                   70        80        90       100       110       120

130       140       150       160       170       180
m219.pep   LGWWSVLANVLFCLAVIFIGISGCVMWWKRRPTGAVGIVPPAQKVKLPVWWMMALPLLAI
           ||||||||||||||||||||||||||||||||:||||:||||||:|||||| ||:||| |
a219       LGWWSVLANVLFCLAVIFIGISGCVMWWKRRPSGAVGMVPPAQKIKLPVWWAMAVPLLLI
                  130       140       150       160       170       180

190       200       210
m219.pep   ALLFPTSLLAIAVIWLLDTLLLSRIPVLRRWFKX
           ||||||:|||||||||||||||||||||||||||
a219       ALLFPTALLAIAVIWLLDTLLLSRIPVLRRWFKX
                  190       200       210
```

The following partial DNA sequence was identified in *N. gonorrhoeae* <SEQ ID 781>:

```
g221.seq
1 atgcacgacc acggcgccat ggatcgccgc ctccccgctt tcggaagtct
```

```
-continued
 51 gatgcggcga gccgtaaatc adatcgacgc tgacggattt gaaccctgcc 101 tcacgggcgg catcgatgac ttctttggtt tcttcgtagc tttggatgcg 151 gttgactgcc gcctgcactt tggggtcgaa atcctgaatg ccgacgctca 201 tgcggttgaa gccgagtctg ccgagcatga ggacggtgtc gcggctgact 251 ttgcgcgggt cgatttcgat ggaatattcg ccggacggta tcagttcgaa 301 atgtttgcgg atcatgcgga agacacgttc gatctgttcg tcgctcaaaa 351 aggtcggcgt gccgccgccg aagtgcagtt gggcaagctg gtgccgtccg 401 ttcagatgtg gagcgagcag ttccatttct ttttcaagat attcgatgta 451 ggtatcggcg cggcttttgt ctttggtgat gattttgttg cagccgcagt 501 agtagcagat ggtgttgcaa acggaatgt gaatgtaaag ggaaagcggt 551 ttgtttaa
```

This corresponds to the amino acid sequence <SEQ ID 782; ORF 221.ng>:

```
g221.pep
  1 MHDHGAMDRR LPAFGSLMRR AVNXIDADGF EPCLTGGIDD FFGFFVALDA

51 VDCRLHFGVE ILNADAHAVE AESAEHEDGV AADFARVDFD GIFAGRYQFE

101 MFADHAEDTF DLFVAQKGRR AAAEVQLGKL VPSVQMWSEQ FHFFFKIFDV

151 GIGAAFVFGD DFVAAAVVAD GVAKRNVNVK GKRFV*
```

The following partial DNA sequence was identified in *N. meningitidis* <SEQ ID 783>:

```
m221.seq
  1 ATGGyGGTTT TGATGcwcmg AAGTCTGGTG CGGCAGGCCG TAAATCAAAT

51 CGACGCTGAC GGATTTGAAC CCGCTTCGC GCGCCGCATC GATGACTTCT

101 TTGGTTTCTT CGTAACTTTG GATGCGGTTG ACCGCCGCCT GCACTTTGGG

151 GTCGAAATCC TGAATGCCGA TGCTCATGCG GTTGAAGCCG AGTCTGCCGA

201 GCATGAGGAC GGTGTCGCGG CTGACTTTGC GCGGGTCGAT TTCGATGGAG

251 TATTCGCCGG TGGGGATTAA CTCGAAATGT TTGCGTATCA TGCGGAAGAC

301 ACGTTCGATC TGTTCGTCGC TCAAAAAGGt GCGTGCcCCG CCGAAGTGCA

351 GTTGGGCAAG CTGGTGCCGT CCGTTCAGAT GTGGAGCGAG CAGTTCCATT

401 TCTTTTTCAA GATATTCGAT GTAGGCATCG GCGCGGCTTT TGTCTTTGGT

451 GATGATTTTG TTGCAGCCGC AGTAGTAGCA GATGGTGTTG CAGAACGGAA

501 TGTGAATGTA AAGGGAAAGC GGTTTGTTTA A
```

This corresponds to the amino acid sequence <SEQ ID 784; ORF 221>:

```
m221.pep
  1 MXVLMXRSLV RQAVNQIDAD GFEPRFARRI DDFFGFFVTL DAVDRRLHFG

51 VEILNADAHA VEAESAEHED GVAADFARVD FDGVFAGGDX LEMFAYHAED

101 TFDLFVAQKG ACPAEVQLGK LVPSVQMWSE QFHFFFKIFD VGIGAAFVFG

151 DDFVAAAVVA DGVAERNVNV KGKRFV*
```

Computer analysis of this amino acid sequence gave the following results:
Homology with a Predicted ORF from *N. gonorrhoeae*
ORF 221 shows 87.6% identity over a 170 aa overlap with a predicted ORF (ORF 221.ng) from *N. gonorrhoeae*:

```
m221/g221

10        20        30        40        50
    m221.pep        MXVLMXRSLVRQAVNQIDADGFEPRFARRIDDFFGFFVTLDAVDRRLHFGVE
                    ||:|:||| |||||||| :: ||||||||||:||||| |||||||
    g221     MHDHGAMDRRLPAFGSLMRRAVNXIDADGFEPCLTGGIDDFFGFFVALDAVDCRLHFGVE
                10        20        30        40        50        60

60        70        80        90       100       110
    m221.pep   ILNADAHAVEAESAEHEDGVAADFARVDFDGVFAGGDXLEMFAYHAEDTFDLFVAQKGA-
               ||||||||||||||||||||||||||||||||:|||   :||||||||||||||||||
    g221       ILNADAHAVEAESAEHEDGVAADFARVDFDGIFAGRYQFEMFADHAEDTFDLFVAQKGRR
                  70        80        90       100       110       120

120       130       140       150       160       170
    m221.pep   CPAEVQLGKLVPSVQMWSEQFHFFFKIFDVGIGAAFVFGDDGVAAAVVADGVAERNVNVK
               |||||||||||||||||||||||||||||||||||||||||||||||||||:||||||
    g221       AAAEVQLGKLVPSVQMWSEQFHFFFKIFDVGIGAAFVFGDDGVAAAVVADGVAKRNVNVK
                 130       140       150       160       170       180 m221.pep   GKRFVX
               ||||||
    g221       GKRFVX
```

25

The following partial DNA sequence was identified in *N. meningitidis* <SEQ ID 785>:

```
a221.seq
  1 ATGGTGGTTT TGATGCTCCG AAGTCTGGTG CGGCAGGCCG TAAATCAAAT

51 CGACGCTGAC GGATTTGAAC CCCGCTTCGC GCGCCGCATC GATGACTTCT

101 TTGGTTTCTT CGTAACTTTG GATGCGGTTG ACCGCCGCCT GCACTTTGGG

151 GTCGAAATCC TGAATGCCGA TGCTCATGCG GTTGAAGCCG AGTCTGCCGA

201 GCATGAGGAC GGTGTCGCGG CTGACTTTGC GCGGGTCGAT TTCGATGGAG

251 TATTCGCCGG TGGGGATTAA CTCGAAATGT TTGCGTATCA TGCGGAAGAC

301 ACGTTCGATT TGGTCGTCGC TCAAAAAGGT CGGCGTGCCG CCGCCGAAGT

351 GCAGTTGGGC AAGCTGGTGC CGTCCGTTCA GATGTGGAGC GAGCAGTTCC

401 ATTTCTTTTT CAAGAAATTC GATGTAGGCA TCGGCGCGGC TTTTGTCTTT

451 GGTGATGATT TTGTTGCAGC CGCAGTAGTA GCAGATGGTG TTGCAGAACG

501 GAATGTGAAT GTAAAGGGAA AGCGGTTTGT TTAA
```

This corresponds to the amino acid sequence <SEQ ID 786; ORF 221.a>:

```
a221.pep
  1 MVVLMLRSLV RQAVNQIDAD GFEPRFARRI DDFFGFFVTL DAVDRRLHFG

51 VEILNADAHA VEAESAEHED GVAADFARVD FDGVFAGGD* LEMFAYHAED

101 TFDLVVAQKG RRAAAEVQLG KLVPSVQMWS EQFHFFFKKF DVGIGAAFVF

151 GDDFVAAAVV ADGVAERNVN VKGKRFV*
``` m221/a221 95.5% identity in 177 aa overlap

```
                10         20         30         40         50         60
m221.pep    MXVLMXRSLVRQAVNQIDADGFEPRFARRIDDFFGFFVTLDAVDRRLHFGVEILNADAHA
            | |||  ||||||||||||||||||||||||||||||||||||||||||||||||||||
a221        MVVLMLRSLVRQAVNQIDADGFEPRFARRIDDFFGFFVTLDAVDRRLHFGVEILNADAHA
                10         20         30         40         50         60

70         80         90        100        110        119
m221.pep    VEAESAEHEDGVAADFARVDFDGVFAGGDXLEMFAYHAEDTFDLFVAQKGA-CPAEVQLG
            |||||||||||||||||||||||||||||||||||||||||||| |||||  ||||||
a221        VEAESAEHEDGVAADFARVDFDGVFAGGDXLEMFAYHAEDTFDLVVAQKGRRAAAEVQLG
                70         80         90        100        110        120

120        130        140        150        160        170
m221.pep    KLVPSVQMWSEQFHFFFKIFDVGIGAAFVFGDDFVAAAVVADGVAERNVNVKGKRFVX
            ||||||||||||||||||| ||||||||||||||||||||||||||||||||||||||
a221        KLVPSVQMWSEQFHFFFKKFDVGIGAAFVFGDDFVAAAVVADGVAERNVNVKGKRFVX
               130        140        150        160        170
```

The following partial DNA sequence was identified in *N. gonorrhoeae* <SEQ ID 787>:

```
g223.seq
  1 atggaattca ggcaccaggt agtggtagtt ggtgtcgaac catttggtca
 51 tttcgatggc gaattggtct tgttgccgc gcgccagttg gaagaattgt
101 tccaaaggca ggttttggct atcgaagccg aaacgggcgg gaatcgcgcc
151 cgtggatact tgcaggtcga ggatgtgatg gtagaaagtg aaatcacgta
201 cagcaacgta atcagcgtta ggagcagctt ggtgtttcca gtttttctcg
251 cgcaggtctt tggcaacgtc gagcagctct tgttcactga tctctttgcg
301 ccagtatttt tcttgggcga atttcaattc acggaaggcg ccgacacgcg
351 ggaagcctga
```

This corresponds to the amino acid sequence <SEQ ID 788; ORF 223.ng>:

```
g223.pep..
  1 MEFRHQVVVV GVEPFGHFDG ELVFVAARQL EELFQRQVLA IEAETGGNRA
 51 RGYLQVEDVM VESEITYSNV ISVRSSLVFP VFLAQVFGNV EQLLFTDLFA
101 PVFFLGEFQF TEGADTREA*
```

The following partial DNA sequence was identified in *N. meningitidis* <SEQ ID 789>:

```
m223.seq
  1 GTGGAATTCA GGCACCAAGT AGTGGTAGTT GGTGTCGAAC CATTTGGTCA
 51 TTTCGATAGC GAATTGGTCT TGTTACCGC GCGCCAGTTG GAAGAATTGT
101 TCCAAAGACA GGTTTTGGCT GTCGAAGCCG AAGCGGGCGG GAATCGCGCC
151 GGTGGCGACT TGCAGGTCGA GGATGTGGTC GTAGAAAGTG AAATCsCTAC
201 GGCAACGAAA TCGGCGTTGG CAGCGACCTG GTGTTTCCAG TTTTTCTCGC
251 GCAAGTCTTT AGCAACAGCC AGCAATTCTT GCTCGCTGAT TTCTTTGCGC
301 CAGTATTTTT CTTGTGCGAA TTTCAATTCG CGGAAGGCGC CGACACGCGG
351 GAAGCCTGA
```

This corresponds to the amino acid sequence <SEQ ID 790; ORF 223>:

```
m223.pep
    1 VEFRHQVVVV GVEPFGHFDS ELVFVTARQL EELFQRQVLA VEAEAGGNRA

51 GGDLQVEDVV VESEIXYGNE IGVGSDLVFP VFLAQVFSNS QQFLLADFFA

101 PVFFLCEFQF AEGADTREA*
```

Computer analysis of this amino acid sequence gave the following results:

Homology with a Predicted ORF from *N. gonorrhoeae*
ORF 223 shows 80.7% identity over a 119 aa overlap with a predicted ORF (ORF 223.ng) from *N. gonorrhoeae*:

```
    m223/g223

10         20         30         40         50         60
    m223.pep  VEFRHQVVVVGVEPFGHFDSELVFVTARQLEELFQRQVLAVEAEAGGNRAGGDLQVEDVV
              :||||||||||||||||||:|||||:|||||||||||||||:|||:||||  |  ||||||:
    g223      MEFRHQVVVVGVEPFGHFDGELVFVAARQLEELFQRQVLAIEAETGGNRARGYLQVEDVM
                    10         20         30         40         50         60

70         80         90        100        110        119
    m223.pep  VESEIXYGNEIGVGSDLVFPVFLAQVFSNSQQFLLADFFAPVFFLCEFQFAEGADTREAX
              |||||:|:|  |:|  |:|||||||||||||:  :|:|::|:||||||  ||||:||||||||
    g223      VESEITYSNVISVRSSLVFPVFLAQVFGNVEQLLFTDLFAPVFFLGEFQFTEGADTREAX
                    70         80         90        100        110        120
```

The following partial DNA sequence was identified in *N. meningitidis* <SEQ ID 791>:

```
a223.seq
    1 GTGGAATTCA GGCACCAAGT AGTGGTAGTT GGTGTCGAAC CATTTGGTCA

51 TTTCGATAGC GAATTGGTCT TGTTACCGC GCGCCAGTTG AAGAATTGT

101 TCCAAAGATA GGTTTTGGCT GTCGAAGCCG AAGCGGGCGG GAATCGCGCC

151 GGTGGCGACT TGCAGGTCGA GGATGTGGTC GTAGAAAGTG AAATCGCCTA

201 CGGCAACGTA ATCGGCGTTG GCAGCGGCCT GGTGTTTCCA GTTTTTCTCG

251 CGCAAGTCTT TAGCAACAGC CAGCAATTCT TGCTCGCTGA TTTCTTTGCG

301 CCAGTATTTT TCTTGTGCGA ATTTCAATTC GCGGAAGGCA CCGACACGCG

351 GGAAGCCTGA
```

This corresponds to the amino acid sequence <SEQ ID 792; ORF 223.a>:

```
a223.pep
    1 VEFRHQVVVV GVEPFGHFDS ELVFVTARQL EELFQR*VLA VEAEAGGNRA

51 GGDLQVEDVV VESEIAYGNV IGVGSGLVFP VFLAQVFSNS QQFLLADFFA

101 PVFFLCEFQF AEGTDTREA*
``` m223/a223 95.8% identity in 119 aa overlap

```
                    10         20         30         40         70         60
    m223.pep  VEFRHQVVVVGVEPFGHFDSELVFVTARQLEELFQRQVLAVEAEAGGNRAGGDLQVEDVV
              ||||||||||||||||||||||||||||||||||||| ||||||||||||||||||||||
    a223      VEFRHQVVVVGVEPFGHFDSELVFVTARQLEELFQRXVLAVEAEAGGNRAGGDLQVEDVV
                    10         20         30         40         70         60
```

```
                70         80         90        100        110        120
m223.pep  VESEIXYGNEIGVGSDLVFPVFLAQVFSNSQQFLLADFFAPVFFLCEFQFAEGADTREAX
          ||||| ||| ||||| ||||||||||||||||||||||||||||||||||||||:||||||
a223      VESEIAYGNVIGVGSGLVFPVFLAQVFSNSQQFLLADFFAPVFFLCEFQFAEGTDTREAX
                70         80         90        100        110        120
```

The following partial DNA sequence was identified in *N. gonorrhoeae* <SEQ ID 793>:

```
g225.seq
    1 atggattctt ttttcaaacc ggcagtttgg gcggttttgt ggctgatgtt
   51 tgccgtccgc cccgcccttg ccgacgagtt gaccaacctg ctcagcagcc
  101 gcgagcagat tctcagacag tttgccgaag acgaacagcc cgttttaccc
  151 gtcaaccgag cccccgcccg gcgggcgggc aatgccgacg aactcatcgg
  201 cggcgcgatg gggcttaacg aacagcccgt tgtacgcgtc aaccgagccn
  251 ccgcccggcg ggcgggcaat gccgacaaac tcatcggcag cgcgatgcgg
  301 cttttgggta ttgcctaccg ctacggcggc acatcggtgt ctaccggttt
  351 tgactgcagc ggattcatgc agcacatctt caaacgcgcc atgggcatca
  401 acctgccgcg cacgtcggcg aacaggcgc ggatgggcgc acccgttgcc
  451 cgaagcgaat gcagcccgg ggatatggtg tttttccgca cgctcggcgg
  501 cagccgcatt tcccatgtcg gactttatat cggcaacaac cgcttcatcc
  551 acgcgccgcg cacggggaaa aatatcgaaa tcaccagcct gagccacaaa
  601 tattggagcg gcaaatatgc gttcgcccgc cgggtcaaga aaacgaccc
  651 gtcacgcttt ctgaactga
```

This corresponds to the amino acid sequence <SEQ ID 794; ORF 225.ng>:

```
g225.pep
    1 MDSFFKPAVW AVLWLMFAVR PALADELTNL LSSREQILRQ FAEDEQPVLP
   51 VNRAPARRAG NADELIGGAM GLNEQPVVRV NRAXARRAGN ADKLIGSAMR
  101 LLGIAYRYGG TSVSTGFDCS GFMQHIFKRA MGINLPRTSA EQARMGAPVA
  151 RSELQPGDMV FFRTLGGSRI SHVGLYIGNN RFIHAPRTGK NIEITSLSHK
  201 YWSGKYAFAR RVKKNDPSRF LN*
```

The following partial DNA sequence was identified in *N. meningitidis* <SEQ ID 795>:

```
m225.seq (partial)
    1 ..TTTTCAAACC CGGCAGTTTG GCGGTTTTG TGGCTGAwGT TTGCCGTCCG
   51    CCCCGCCCTT GCCGACGAGT TGACCAACCT GCTCAGCAGC CGCGAGCAGA
  101    TTCTCAGACA GTTTGCCGAA GACGAACAGC CCGTTTTACC CATCAACCGA
  151    GCCCCCGCCC GGCGGGCGGG CAATGCCGAC GAACTCATCG GCAGCGCGAT
  201    GGGGCTTAAC GAACAGCCCG TTTTACCCGT CAACCGAGTC CCCGCCCGGC
  251    GGGCGGGCAA TGCCGACGAA CTCATCGGCA ACGCGATGGG GCTTAACGAA
  301    CAGCCCGTTT TACCCGTCAA CCGAGCCCCC GGCGGGCGGG CGGGCAATGC
  351    CGACGAACTC ATCGGCAACG CGATGGGACT TTTGGGTATT GCCTACCGCT
  401    ACGGCGGCAC ATCGGTTTCT ACCGGTTTTG ACTGCAGCGG CTTCATGCAG
```

-continued

```
451  CACATCTTCA AACGCGCCAT GGGCATCAAC CTGCCGCGCA CGTCGGCAGA

501  ACAGGCACGG ATGGGTACGC CGGTTGCCCG AAGCGAATTG CAGCCCGGAG

551  ATATGGTGTT TTTCCGCACG CTCGGCGGCA GCCGCATTTC CCATGTCGGA

601  CTTTATATCG GCAACAACCG CTTCATCCAC GCGCCGCGCA CGGGGAAAAA

651  TATCGAAATC ACCAGCCTGA GCCACAAATA TTGGAGCGGC AAATACGCGT

701  TCGCCCGCCG GGTCAAGAAA AACGACCCGT CCCGCTTTCT GAACTGA
```

This corresponds to the amino acid sequence <SEQ ID 796; ORF 225>:

```
m225.pep (partial)
  1 ..FSNPAVWAVL WLXFAVRPAL ADELTNLLSS REQILRQFAE DEQPVLPINR

51   APARRAGNAD ELIGSAMGLN EQPVLPVNRV PARRAGNADE LIGNAMGLNE

101   QPVLPVNRAP ARRAGNADEL IGNAMGLLGI AYRYGGTSVS TGFDCSGFMQ

151   HIFKRAMGIN LPRTSAEQAR MGTPVARSEL QPGDMVFFRT LGGSRISHVG

201   LYIGNNRFIH APRTGKNIEI TSLSHKYWSG KYAFARRVKK NDPSRFLN*
                                                         25
```

Computer analysis of this amino acid sequence gave the following results:
Homology with a Predicted ORF from *N. gonorrhoeae*
ORF 225 shows 83.5% identity over a 248 aa overlap with a predicted ORF (ORF 225.ng) from *N. gonorrhoeae*:

```
   m225/g225
                        10         20         30         40         50
    m225.pep    FSNPAVWAVLWLXFAVRPALADELTNLLSSREQILRQFAEDEQPVLPINRAPARRAG
                   |:||||||||| |||||||||||||||||||||||||:||||||||
    g225        MDSFFKPAVWAVLWLMFAVRPALADELTNLLSSREQILRQFAEDEQPVLPVNRAPARRAG
                         10         20         30         40         50         60

60         70         80         90        100        110
    m225.pep    NADELIGSAMGLNEQPVLPVNRVPARRAGNADELIGNAMGLNEQPVLPVNRAPARRAGNA
                |||||||                              :||||||||||: |||| |||||||
    g225        NADELIG--------------------------GAMGLNEQPVVRVNRAXARRAGNA
                                                         70         80         90

120        130        140        150        160        170
    m225.pep    DELIGNAMGLLGIAYRYGGTSVSTGFDCSGFMQHIFKRAMGINLPRTSAEQARMGTPVAR
                |:|||:|| ||||||||||||||||||||||||||||||||||||||||||||:||||
    g225        DKLIGSAMRLLGIAYRYGGTSVSTGFDCSGFMQHIFKRAMGINLPRTSAEQARMGAPVAR
                        100        110        120        130        140        150

180        190        200        210        210        230
    m225.pep    SELQPGDMVFFRTLGGSRISHVGLYIGNNRFIHAPRTGKNIEITSLSHKYWSGKYAFARR
                ||||||||||||||||||||||||||||||||||||||||||||||||||||||||||||
    g225        SELQPGDMVFFRTLGGSRISHVGLYIGNNRFIHAPRTGKNIEITSLSHKYWSGKYAFARR
                        160        170        180        190        200        210

240        249
    m225.pep    VKKNDPSRFLNX
                ||||||||||||
    g225        VKKNDPSRFLN
                        220
```

The following partial DNA sequence was identified in *N. meningitidis* <SEQ ID 797>:

```
a225.seq
  1 ATGGATTCTT TTTTCAAACC GGCAGTTTGG GCGGTTTTGT GGCTGATGTT

51 TGCCGTCCGC CCCGCCCTTG CCGACGAGTT GACCAACCTG CTCAGCAGCC

101 GCGAGCAGAT TCTCAGACAG TTTGCCGAAG ACGAACAGCC CGTTTTACCC

151 ATCAACCGAN CCCCCGCCCG GCGGGCGGGC AATGCCGACG AACTCATCGG
```

```
201 CAGCGCGATG GGGCTTAACG AACAGCCCGT TTTACCCGTC AACCGANTCC

251 CCGCCCGGCG GCGGGCAAT GCCGACNAAC TCATCGGCAA CGCGATGGGG

301 CTTAACGAAC AGCCCGTTTT ACCCGTCAAC CGAGTCCCCG CCCGGCGGGC

351 GGGCAATGCC GACGAACTCA TCGGCAACGC GATGGGGCTT AACGAACAGC

401 CCGTTTTACC CGTCAACCGA GCCCCGCCC GGCGGGCGGG CAATGCCGAC

451 GAACTCATCG GCAACGCGAT GGGACTTTTG GGTATTGCCT ACCGCTACGG

501 CGGCACATCG ATTTCTACCG GTTTTGACTG CAGCGGCTTC ATGCAGCACA

551 TCTTCAAACG CGCCATGGGC ATCAACCTGC CGCGCACGTC GGCAGAACAG

601 GCGCGGATGG GTACGCCGGT TGCCCGAAGC GAATTGCAGC CGGGGATAT

651 GGTGTNTTTC CGCACGCTCG GCGGCAGCCG CATTTCCCAT GTCGGACTTT

701 ATATCGGCAA CAACCGCTTC ATCCACGCGC CGCGCACGGG GAAAAATATC

751 GAAATCACCA GCCTGAGCCA CAAATATTGG AGCGGCAAAT ACGCGTTCGC

801 CCGCCGGGTC AAGAAAAACG ACCCGTCCCG CTTTCTGAAC TGA
```

This corresponds to the amino acid sequence <SEQ ID 798; ORF 225.a>:

```
a225.pep
  1 MDSFFKPAVW AVLWLMFAVR PALADELTNL LSSREQILRQ FAEDEQPVLP

51 INRXPARRAG NADELIGSAM GLNEQPVLPV NRXPARRAGN ADXLIGNAMG

101 LNEQPVLPVN RVPARRAGNA DELIGNAMGL NEQPVLPVNR APARRAGNAD

151 ELIGNAMGLL GIAYRYGGTS ISTGFDCSGF MQHIFKRAMG INLPRTSAEQ

201 ARMGTPVARS ELQPGDMVXF RTLGGSRISH VGLYIGNNRF IHAPRTGKNI

251 EITSLSHKYW SGKYAFARRV KKNDPSRFLN *
``` m225/a225 87.4% identity in 277 aa overlap

```
                  10         20         30         40         50
   m225.pep    FSNPAVWAVLWLXFAVRPALADELTNLLSSREQILRQFAEDEQPVLPINRAPARRAG
               | :||||||||| ||||||||||||||||||||||||||||||||||||  |||||
       a225    MDSFFKPAVWAVLWLMFAVRPALADELTNLLSSREQILRQFAEDEQPVLPVNRXPARRAG
                        10         20         30         40         50         60

60         70        79                                     80
   m225.pep    NADELIGSAMGLNEQPVLPVNR---------------------------VPARRAGNA
               ||||||||||||||||||||||                           |||||||||
       a225    NADELIGSAMGLNEQPVLPVNRXPARRAGNADXLIGNAMGLNEQPVLPVNRVPARRAGNA
                       70         80         90        100        110        120

90        100        110        120        130        140
   m225.pep    DELIGNAMGLNEQPVLPVNRAPARRAGNADELIGNAMGLLGIAYRYGGTSVSTGFDCSGF
               |||||||||||||||||||||||||||||||||||||||||||||||||:|||||||||
       a225    DELIGNAMGLNEQPVLPVNRAPARRAGNADELIGNAMGLLGIAYRYGGTSISTGFDCSGF
                       130        140        150        160        170        180

150        160        170        180        190        200
   m225.pep    MQHIFKRAMGINLPRTSAEQARMGTPVARSELQPGDMVFFRTLGGSRISHVGLYIGNNRF
               |||||||||||||||||||||||||||||||||||||| |||||||||||||||||||||
       a225    MQHIFKRAMGINLPRTSAEQARMGTPVARSELQPGDMVXFRTLGGSRISHVGLYIGNNRF
                       190        200        210        220        230        240

210        220        230        240    249
   m225.pep    IHAPRTGKNIEITSLSHKYWSGKYAFARRVKKNDPSRFLNX
               ||||||||||||||||||||||||||||||||||||||||
       a225    IHAPRTGKNIEITSLSHKYWSGKYAFARRVKKNDPSRFLNX
                       250        260        270        280
```

The following partial DNA sequence was identified in *N. gonorrhoeae* <SEQ ID 799>:

```
g225-1.seq
   1 atgattctt ttttcaaacc ggcagtttgg gcggttttgt ggctgatgtt 51 tgccgtccgc cccgcccttg ccgacgagtt gaccaacctg ctcagcagcc 101 gcgagcagat tctcagacag tttgccgaag acgaacagcc cgttttaccc 151 gtcaaccgag ccccgcccg gcgggcgggc aatgccgacg aactcatcgg 201 cggcgcgatg gggcttaacg aacagcccgt tgtacgcgtc aaccgagccn 251 ccgcccggcg ggcgggcaat gccgacaaac tcatcggcag cgcgatgcgg 301 cttttgggta ttgcctaccg ctacggcggc acatcggtgt ctaccggttt 351 tgactgcagc ggattcatgc agcacatctt caaacgcgcc atgggcatca 401 acctgccgcg cacgtcggcg aacaggcgc ggatgggcgc acccgttgcc 451 cgaagcgaat tgcagcccgg ggatatggtg ttttccgca cgctcggcgg 501 cagccgcatt tcccatgtcg gactttatat cggcaacaac cgcttcatcc 551 acgcgccgcg cacggggaaa aatatcgaaa tcaccagcct gagccacaaa 601 tattggagcg gcaaatatgc gttcgcccgc cgggtcaaga aaaacgaccc 651 gtcacgcttt ctgaactga
```

This corresponds to the amino acid sequence <SEQ ID 800; ORF 225-1.ng>:

```
g225-1.pep
   1 MDSFFKPAVW AVLWLMFAVR PALADELTNL LSSREQILRQ FAEDEQPVLP

51 VNRAPARRAG NADELIGGAM GLNEQPVVRV NRAXARRAGN ADKLIGSAMR

101 LLGIAYRYGG TSVSTGFDCS GFMQHIFKRA MGINLPRTSA EQARMGAPVA

151 RSELQPGDMV FFRTLGGSRI SHVGLYIGNN RFIHAPRTGK NIEITSLSHK

201 YWSGKYAFAR RVKKNDPSRF LN*
```

40

The following partial DNA sequence was identified in *N. meningitidis* <SEQ ID 801>:

```
m225-1.seq
   1 ATGGATTCTT TTTTCAAACC GGCAGTTTGG GCGGTTTTGT GGCTGATGTT

51 TGCCGTCCGC CCCGCCCTTG CCGACGAGTT GACCAACyTG CTCAGCAGCC

101 GCGAGCAGAT TCTCAGACAG TTTGCCGAAG ACGAACAGCC CGTTTTACCC

151 ATCAACCGAG CCCCGCCCG GCGGGCGGGC AATGCCGACG AACTCATCGG

201 CAGCGCGATG GGGCTTAACG AACAGCCCGT TTTACCCGTC AACCGAGTCC

251 CCGCCCGGCG GGCGGGCAAT GCCGACGAAC TCATCGGCAA CGCGATGGGG

301 CTTAACGAAC AGCCCGTTTT ACCCGTCAAC CGAGCCCCCG CCCGGCGGGC

351 GGGCAATGCC GACGAACTCA TCGGCAACGC GATGGGACTT TGGGTATTG

401 CCTACCGCTA CGGCGGCACA TCGGTTTCTA CCGGTTTTGA CTGCAGCGGC

451 TTCATGCAGC ACATCTTCAA ACGCGCCATG GCATCAACC TGCCGCGCAC

501 GTCGGCAGAA CAGGCACGGA TGGGTACGCC GGTTGCCCGA AGCGAATTGC

551 AGCCCGGAGA TATGGTGTTT TTCCGCACGC TCGGCGGCAG CCGCATTTCC

601 CATGTCGGAC TTTATATCGG CAACAACCGC TTCATCCACG CGCCGCGCAC
```

```
-continued
651 GGGGAAAAAT ATCGAAATCA CCAGCCTGAG CCACAAATAT TGGAGCGGCA

701 AATACGCGTT CGCCCGCCGG GTCAAGAAAA ACGACCCGTC CCGCTTTCTG

751 AACTGA
```

This corresponds to the amino acid sequence <SEQ ID 802; ORF 217>:

```
m225-1.pep
      1 MDSFFKPAVW AVLWLMFAVR PALADELTNL LSSREQILRQ FAEDEQPVLP

51 INRAPARRAG NADELIGSAM GLNEQPVLPV NRVPARRAGN ADELIGNAMG

101 LNEQPVLPVN RAPARRAGNA DELIGNAMGL LGIAYRYGGT SVSTGFDCSG

151 FMQHIFKRAM GINLPRTSAE QARMGTPVAR SELQPGDMVF FRTLGGSRIS

201 HVGLYIGNNR FIHAPRTGKN IEITSLSHKY WSGKYAFARR VKKNDPSRFL

251 N* m225-1/g225-1 84.9% identity in 251 aa overlap 10         20         30         40         50         60
m225-1. pep  MDSFFKPAVWAVLWLMFAVRPALADELTNLLSSREQILRQFAEDEQPVLPINRAPARRAG
             ||||||||||||||||||||||||||||||||||||||||||||||||:||||||||||
g225-1       MDSFFKPAVWAVLWLMFAVRPALADELTNLLSSREQILRQFAEDEQPVLPVNRAPARRAG
              10         20         30         40         50         60

70         80         90        100        110        120
m225-1. pep  NADELIGSAMGLNEQPVLPVNRVPARRAGNADELIGNAMGLNEQPVLPVNRAPARRAGNA
             ||||                            |||:||||||||: |||| ||||||||
g225-1       NADE---------------------------LIGGAMGLNEQPVVRVNRAXARRAGNA
                                                   70         80         90

130        140        150        160        170        180
m225-1. pep  DELIGNAMGLLGIAYRYGGTSVSTGFDCSGFMQHIFKRAMGINLPRTSAEQARMGTPVAR
             |:|||:||  ||||||||||||||||||||||||||||||||||||||||||||:||||
g225-1       DKLIGSAMRLLGIAYRYGGTSVSTGFDCSGFMQHIFKRAMGINLPRTSAEQARMGAPVAR
              100        110        120        130        140        150

190        200        210        220        230        240
m225-1. pep  SELQPGDMVFFRTLGGSRISHVGLYIGNNRFIHAPRTGKNIEITSLSHKYWSGKYAFARR
             ||||||||||||||||||||||||||||||||||||||||||||||||||||||||||||
g225-1       SELQPGDMVFFRTLGGSRISHVGLYIGNNRFIHAPRTGKNIEITSLSHKYWSGKYAFARR
              160        170        180        190        200        210

250
m225-1. pep  VKKNDPSRFLNX
             ||||||||||||
g225-1       VKKNDPSRFLNX
              220
```

The following partial DNA sequence was identified in *N. meningitidis* <SEQ ID 803>:

```
a225-1.seq
   1 ATGGATTCTT TTTCAAACC GGCAGTTTGG GCGGTTTTGT GGCTGATGTT

51 TGCCGTCCGC CCCGCCCTTG CCGACGAGTT GACCAACCTG CTCAGCAGCC

101 GCGAGCAGAT TCTCAGACAG TTTGCCGAAG ACGAACAGCC CGTTTTACCC

151 ATCAACCGAN CCCCCGCCCG GCGGGCGGGC AATGCCGACG AACTCATCGG

201 CAGCGCGATG GGGCTTAACG AACAGCCCGT TTTACCCGTC AACCGANTCC

251 CCGCCCGGCG GCGGGCAAT GCCGACNAAC TCATCGGCAA CGCGATGGGG

301 CTTAACGAAC AGCCCGTTTT ACCCGTCAAC CGAGTCCCCG CCCGGCGGGC

351 GGGCAATGCC GACGAACTCA TCGGCAACGC GATGGGGCTT AACGAACAGC

401 CCGTTTTACC CGTCAACCGA GCCCCGCCC GGCGGGCGGG CAATGCCGAC

451 GAACTCATCG GCAACGCGAT GGGACTTTTG GGTATTGCCT ACCGCTACGG
```

-continued

```
501 CGGCACATCG ATTTCTACCG GTTTTGACTG CAGCGGCTTC ATGCAGCACA

551 TCTTCAAACG CGCCATGGGC ATCAACCTGC CGCGCACGTC GGCAGAACAG

601 GCGCGGATGG GTACGCCGGT TGCCCGAAGC GAATTGCAGC CCGGGGATAT

651 GGTGTNTTTC CGCACGCTCG GCGGCAGCCG CATTTCCCAT GTCGGACTTT

701 ATATCGGCAA CAACCGCTTC ATCCACGCGC CGCGCACGGG GAAAAATATC

751 GAAATCACCA GCCTGAGCCA CAAATATTGG AGCGGCAAAT ACGCGTTCGC

801 CCGCCGGGTC AAGAAAAACG ACCCGTCCCG CTTTCTGAAC TGA
```

This corresponds to the amino acid sequence <SEQ ID 804; ORF 225-1.a>:

```
a225-1.pep

1 MDSFFKPAVW AVLWLMFAVR PALADELTNL LSSREQILRQ FAEDEQPVLP

51 INRXPARRAG NADELIGSAM GLNEQPVLPV NRXPARRAGN ADXLIGNAMG

101 LNEQPVLPVN RVPARRAGNA DELIGNAMGL NEQPVLPVNR APARRAGNAD

151 ELIGNAMGLL GIAYRYGGTS ISTGFDCSGF MQHIFKRAMG INLPRTSAEQ

201 ARMGTPVARS ELQPGDMVXF RTLGGSRISH VGLYIGNNRF IHAPRTGKNI

251 EITSLSHKYW SGKYAFARRV KKNDPSRFLN * a225-1/m225-1 88.6% identity in 280 aa overlap 10         20         30         40         50         60
a225-1. pep  MDSFFKPAVWAVLWLMFAVRPALADELTNLLSSREQILRQFAEDEQPVLPINRXPARRAG
             |||||||||||||||||||||||||||||||||||||||||||||||||| ||||||
m225-1       MDSFFKPAVWAVLWLMFAVRPALADELTNLLSSREQILRQFAEDEQPVLPINRAPARRAG
                  10         20         30         40         50         60

70         80         90        100        110        120
a225-1. pep  NADELIGSAMGLNEQPVLPVNRXPARRAGNADXLIGNAMGLNEQPVLPVNRVPARRAGNA
             ||||||||||||||||                             |||||||||||||||
m225-1       NADELIGSAMGLNEQP-----------------------------VLPVNRVPARRAGNA
                  70                                        80         90

130        140        150        160        170        180
a225-1. pep  DELIGNAMGLNEQPVLPVNRAPARRAGNADELIGNAMGLLGIAYRYGGTSISTGFDCSGF
             ||||||||||||||||||||||||||||||||||||||||||||||||:||||||||||
m225-1       DELIGNAMGLNEQPVLPVNRAPARRAGNADELIGNAMGLLGIAYRYGGTSVSTGFDCSGF
                 100        110        120        130        140        150

190        200        210        220        230        240
a225-1. pep  MQHIFKRAMGINLPRTSAEQARMGTPVARSELQPGDMVXFRTLGGSRISHVGLYIGNNRF
             ||||||||||||||||||||||||||||||||||||||| ||||||||||||||||||||
m225-1       MQHIFKRAMGINLPRTSAEQARMGTPVARSELQPGDMVFFRTLGGSRISHVGLYIGNNRF
                 160        170        180        190        200        210

250        260        270        280
a225-1. pep  IHAPRTGKNIEITSLSHKYWSGKYAFARRVKKNDPSRFLNX
             ||||||||||||||||||||||||||||||||||||||||
m225-1       IHAPRTGKNIEITSLSHKYWSGKYAFARRVKKNDPSRFLNX
                 220        230        240        250
```

The following partial DNA sequence was identified in *N. gonorrhoeae* <SEQ ID 805>:

```
g226.seq
    1 ATGAGCGAAA TCCTCAGGCA GCCCAGCGTT CTGCTTTTCC TCACGCTTGC

51 CGTGTACGCG CTTGCGATTA TCGTGCGCAC GCGCACGGGC AATATCTTCT

101 GCAACCCCGT ACTCGTCAGC ACTATCGTGC TGATTGCCTA CCTGAAAATC

151 CTCGGTATCG ATTATGCGGT GTACCACAAC GCCGCGCAAT TCATTGATTT

201 TCGGCTGAAA cccGccgtCG TCGTGCTTGC CGTGCCGCTC TACCAAAACC
```

```
-continued
251 GCCGTAAAAT CTTCAACCAG TGGCTGCCCG TCATCGTTTC GCAGCTTGCG

301 GGCAGCGTTA cggGCATTGT tacggggATG TATTTTgccg cttggctcgg 351 gccggatacc caattctcct tcccgcctcg tcttcaatat ctgttattta 401 caccctctgg aatcccaatt cacaccctgt atgcgcgggt tctcccgcca 451 tttctgttgc ctccgcctct cctgccgcgc ctcggcccgc atacattgcg 501 ccggttcaca atacttccaa aaaaactacg gccgtttaag ccctcctcc 551 cagttgtggt cctttctcct Ccgggcctcg cccctcccct cttataa
```

This corresponds to the amino acid sequence <SEQ ID 806; ORF 226.ng>:

```
g226.pep
  1 MSEILRQPSV LLFLTLAVYA LAIIVRTRTG NIFCNPVLVS TIVLIAYLKI

51 LGIDYAVYHN AAQFIDFRLK PAVVVLAVPL YQNRRKIFNQ WLPVIVSQLA

101 GSVTGIVTGM YFAAWLGPDT QFSFPPRLQY LLFTPSGIPI HTLYARVLPP

151 FLLPPPLLPR LGPHTLRRFT ILPKKLRPFK PLLPVVVLSP PGLAPPLL*
```

The following partial DNA sequence was identified in *N. meningitidis* <SEQ ID 807>:

```
m226.seq
  1 ATGAACGAAA TCCTCAGGCA GCCCAGCGTT CTGCTTTTCC TCACGCTTGC

51 CGTGTACGCG CTTGCGATTA TCGtGCGCAC GCGCACGGGC AATATCTTCT

101 GCAACCCCGT ACTCGTCAGC ACTATCGTGC TGATTGCCTA CCTGAAAATC

151 CTCGGTATCG ATTATGCGGT GTACCACAAC GCCGCGCAAT TCATTGATTT

201 TTGGCTGAAA CCCGCCGTCG TCGTGCTTGC CGTGCCGCTC TACCAAAACC

251 GCCGTAAAAT CTTCAACCAG TGGCTGCCCG TCATCGTTTC ACAGCTTGCG

301 GGCAGCGTTA CGGGCATTGT TACAGGGATG TATTTTGCCA AATGGCTGGG

351 CGCGGAACGC GAAGTCGTCC TCTCGCTCGC GTCCAAATCT GTTACCAACC

401 CCATCGCTAT TGAAATCACC CGCTCCATCG GCGGCATTCC CGCCATTACC

451 GCCGCCACCG TCATCATTGC CGGTCTGGTC GGACAGATTG CCGGTTACAA

501 AATGCTGAAG AACACGGTCG TCATGCCCTC GTCCGTGGGT ATGTCGCTCG

551 GCACGGCTTC GCACGCGATG GGGATTGCCG CCTCGCTCGA ACGCAGCCGC

601 CGTATGGCGG CATACGCGGG GCTGGGGCTG ACGTTCAACG GCGTACTGAC

651 CGCGCTGATT GCGCCGCTGC TCATCCCCGT TTTGGGATTT TGA
```

This corresponds to the amino acid sequence <SEQ ID 808; ORF 226>:

```
m226.pep
  1 MNEILRQPSV LLFLTLAVYA LAIIVRTRTG NIFCNPVLVS TIVLIAYLKI

51 LGIDYAVYHN AAQFIDFWLK PAVVVLAVPL YQNRRKIFNQ WLPVIVSQLA

101 GSVTGIVTGM YFAKWLGAER EVVLSLASKS VTNPIAIEIT RSIGGIPAIT

151 AATVIIAGLV GQIAGYKMLK NTVVMPSSVG MSLGTASHAM GIAASLERSR

201 RMAAYAGLGL TFNGVLTALI APLLIPVLGF *
```

Computer analysis of this amino acid sequence gave the following results:
Homology with a Predicted ORF from *N. gonorrhoeae*
ORF 226 shows 94.2% identity over a 121 aa overlap with a predicted ORF (ORF 226.ng) from *N. gonorrhoeae*:

```
    m226/g226

10         20         30         40         50         60
    m226 pep  MNEILRQPSVLLFLTLAVYALAIIVRTRTGNIFCNPVLVSTIVLIAYLKILGIDYAVYHN
              |:||||||||||||||||||||||||||||||||||||||||||||||||||||||||||
    g226      MSEILRQPSVLLFLTLAVYALAIIVRTRTGNIFCNPVLVSTIVLIAYLKILGIDYAVYHN
                  10         20         30         40         50         60

70         80         90        100        110        120
    m226 pep  AAQFIDFWLKPAVVVLAVPLYQNRRKIFNQWLPVIVSQLAGSVTGIVTGMYFAKWLGAER
              ||||||| ||||||||||||||||||||||||||||||||||||||||||||| ||| :
    g226      AAQFIDFRLKPAVVVLAVPLYQNRRKIFNQWLPVIVSQLAGSVTGIVTGMYFAAWLGPDT
                  70         80         90        100        110        120

130        140        150        160        170        180
    m226 pep  EVVLSLASKSVTNPIAIEITRSIGGIPAITAATVIIAGLVGQIAGYKMLKNTVVMPSSVG
              :
    g226      QFSFPPRLQYLLFTPSGIPIHTLYARVLPPFLLPPPLLPRLGPHTLRRFTILPKKLRPFK
                 130        140        150        160        170        180
```

The following partial DNA sequence was identified in *N. meningitidis* <SEQ ID 809>:

```
a226.seq
   1 ATGAACGAAA TCCTCAGGCA GCCGAGCATC CTGCTTTTCC TCACGCTTGC

51 CGTGTACGCG CTTGCGATTA TCGTGCGCAC GCGCACGGGT AATATCTTCT

101 GCAACCCCGT ACTCGTCAGC ACTATCGTGC TGATTGCCTA CCTGAAAATC

151 CTCGGTATCG ATTATGCGGT GTACCACAAC GCCGCGCAGT TTATCGATTT

201 CTGGCTCAAG CCCGCCGTCG TCGTGCTTGC CGTGCCGCTC TACCAAAACC

251 GCCGTAAAAT CTTCAACCAA TGGCTGCCCG TCATCGTTTC GCAGCTTGCG

301 GGCAGCGTTA CGGGCATTGT TACGGGGATG TATTTTGCCA AATGGCTGGG

351 CGCGGAACGC GAAGTCGTCC TCTCGCTCGC GTCCAAATCT GTTACCAATC

401 CTATCGCCAT CGAAATCACC CGCTCCATCG GCGGCATTCC CGCCATTACC

451 GCCGCCACCG TCATCATTGC CGGCCTGGTC GGACAGATTG CCGGTTACAA

501 AATGTTGAAA ACACGGTCG TTATGCCCTC ATCTGTCGGA ATGTCGCTCG

551 GCACGGCTTC GCACGCGATG GGCATTGCCG CCTCGCTCGA ACGCAGCCGC

601 CGCATGGCGG CATACGCGGG GCTGGGGCTG ACGTTCAACG GCGTACTGAC

651 CGCGCTGATT GCGCCGCTGC TTATCCCCGT TTTGGGATTT TGA
```

This corresponds to the amino acid sequence <SEQ ID 810; ORF 226.a>:

```
a226.pep
   1 MNEILRQPSI LLFLTLAVYA LAIIVRTRTG NIFCNPVLVS TIVLIAYLKI

51 LGIDYAVYHN AAQFIDFWLK PAVVVLAVPL YQNRRKIFNQ WLPVIVSQLA

101 GSVTGIVTGM YFAKWLGAER EVVLSLASKS VTNPIAIEIT RSIGGIPAIT

151 AATVIIAGLV GQIAGYKMLK NTVVMPSSVG MSLGTASHAM GIAASLERSR

201 RMAAYAGLGL TFNGVLTALI APLLIPVLGF *
``` m226/a226 99.6% identity in 230 aa overlap

```
              10        20        30        40        50        60
m226.pep MNEILRQPSVLLFLTLAVYALAIIVRTRTGNIFCNPVLVSTIVLIAYLKILGIDYAVYHN
         |||||||||:||||||||||||||||||||||||||||||||||||||||||||||||||
a226     MNEILRQPSILLFLTLAVYALAIIVRTRTGNIFCNPVLVSTIVLIAYLKILGIDYAVYHN
              10        20        30        40        50        60

70        80        90       100       110       120
m226.pep AAQFIDFWLKPAVVVLAVPLYQNRRKIFNQWLPVIVSQLAGSVTGIVTGMYFAKWLGAER
         ||||||||||||||||||||||||||||||||||||||||||||||||||||||||||||
a226     AAQFIDFWLKPAVVVLAVPLYQNRRKIFNQWLPVIVSQLAGSVTGIVTGMYFAKWLGAER
              70        80        90       100       110       120

130       140       150       160       170       180
m226.pep EVVLSLASKSVTNPIAIEITRSIGGIPAITAATVIIAGLVGQIAGYKMLKNTVVMPSSVG
         ||||||||||||||||||||||||||||||||||||||||||||||||||||||||||||
a226     EVVLSLASKSVTNPIAIEITRSIGGIPAITAATVIIAGLVGQIAGYKMLKNTVVMPSSVG
             130       140       150       160       170       180

190       200       210       220       230
m226.pep MSLGTASHAMGIAASLERSRRMAAYAGLGLTFNGVLTALIAPLLIPVLGFX
         ||||||||||||||||||||||||||||||||||||||||||||||||||
a226     MSLGTASHAMGIAASLERSRRMAAYAGLGLTFNGVLTALIAPLLIPVLGFX
             190       200       210       220       230
```

The following partial DNA sequence was identified in *N. gonorrhoeae* <SEQ ID 811>:

```
g227.seq
   1 atgaacatca tccgcgcgct cctcatcatc ctcggctgcc tcgccgccgg 51 cgaaaccgcc gttttcctag caggcatcaa actgcccggc agcatcgtcg 101 gcatgggcgt gctgtttgcg cttttgcagg cgggttggct caaaacgtct 151 tggctgcaac agcttaccga cgcgctgatg gcaaacctga cgctgttcct 201 cgtgccgccc tgcgtggcgg tcatcagcta tttggatttg attgccgacg 251 attggttttc gatactggtt ccgcctccg ccagcacttt gtgcgtactg 301 ctggttacgg gcaaggttca ccgctggata cggagcatta tctga
                                                         40
```

This corresponds to the amino acid sequence <SEQ ID 812; ORF 227.ng>:

```
g227.pep
   1 MNIIRALLII LGCLAAGETA VFLAGIKLPG SIVGMGVLFA LLQAGWLKTS

51 WLQQLTDALM ANLTLFLVPP CVAVISYLDL IADDWFSILV SASASTLCVL

101 LVTGKVHRWI RSII*
                                                         50
```

The following partial DNA sequence was identified in *N. meningitidis* <SEQ ID 813>:

```
m227.seq (partial)
   1 ..ACGTCTTkGC TGCAACAGCT TACCGACGCG CTGATGTCGA ACCTGACGCT 51    GTtCCTCGTG CCgCC.TGCG TGGCGGTCAT CAGCTATTTG GATTTGATTG 101    CCGACGATTG GTTTTCGATA CTGGTTTCCG CCTCCGCCAG cACTTTGTGC

151    GTACTGCTGG TTACGGGCAA AGTCCACCGG TGGATACGGG GTATTATCCG

201    ATGA
```

This corresponds to the amino acid sequence <SEQ ID 814; ORF 227>:

```
m227.pep (partial)
   1  ..TSXLQQLTDA LMSNLTLFLV PPCVAVISYL DLIADDWFSI LVSASASTLC

51     VLLVTGKVHR WIRGIIR*
```

Computer analysis of this amino acid sequence gave the following results:
Homology with a Predicted ORF from *N. gonorrhoeae*
ORF 227 shows 95.5% identity over a 66 aa overlap with a predicted ORF (ORF 227.ng) from *N. gonorrhoeae*:

```
   m227/g227

10         20         30
      m227.pep                          TSXLQQLTDALMSNLTLFLVPPCVAVISYL
                                        || |||||||||:||||||||||||||||
      g227      TAVFLAGIKLPGSIVGMGVLFALLQAGWLKTSWLQQLTDALMANLTLFLVPPCVAVISYL
                 20        30        40        50        60        70        60

40        50        60
      m227.pep  DLIADDWFSILVSASASTLCVLLVTGKVHRWIRGIIRX
                ||||||||||||||||||||||||||||||||||:|||
      g227      DLIADDWFSILVSASASTLCVLLVTGKVHRWIRSIIX
                 80        90       100       110
```

The following partial DNA sequence was identified in *N. meningitidis* <SEQ ID 815>:

```
a227.seq
   1  ATGAACATCA TCCGCGCGCT CCTCATCATC CTCGGCTGCC TCGCCACCGG

51  CGAAACCGCC GTTTTCCTAG CAGGCATCAA ACTGCCCGGC AGCATCGTCG

101  GCATGGGCGT ACTGTTTGCG CTTTTGCAGG CGGGTTGGGT CAAAACGTCT

151  TGGCTGCAAC AGCTTACCGA CGCGCTGATG GCGAATCTGA CGTTGTTTCT

201  CGTGCCGCCC TGCGTGGCGG TCATCAGCTA TTTGGATTTG ATTGCCGACG

251  ATTGGTTTTC GATACTGGTT TCCGCCTCCG CCAGCACTTT GTGCGTACTG

301  CTGGTTACAG GCAAGGTTCA CCGCTGGATA CGGAGCATTA TCTGA
```

This corresponds to the amino acid sequence <SEQ ID 816; ORF 227.a>:

```
a227.pep
   1  MNIIRALLII LGCLATGETA VFLAGIKLPG SIVGMGVLFA LLQAGWVKTS

51  WLQQLTDALM ANLTLFLVPP CVAVISYLDL IADDWFSILV SASASTLCVL

101  LVTGKVHRWI RSII*
``` m227/a227 95.5% identity in 66 aa overlap

```
                                              10         20         30
      m227.pep                          TSXLQQLTDALMSNLTLFLVPPCVAVISYL
                                        || |||||||||:||||||||||||||||
      a227      TAVFLAGIKLPGSIVGMGVLFALLQAGWVKTSWLQQLTDALMANLTLFLVPPCVAVISYL
                 20        30        40        50        60        70        60

40        50        60
      m227.pep  DLIADDWFSILVSASASTLCVLLVTGKVHRWIRGIIRX
                ||||||||||||||||||||||||||||||||||:|||
      a227      DLIADDWFSILVSASASTLCVLLVTGKVHRWIRSIIX
                 80        90       100       110
```

The following partial DNA sequence was identified in *N. meningitidis* <SEQ ID 817>:

```
m228.seq
    1 ATGAAAAAAT TATTGATTGC CGCAATGATG GCGGCTGCCT TGGCAGCTTG

51 TTCGCAAGAA GCCAAACAGG AGGTTAAGGA AGCGGTTCAA GCCGTTGAGT

101 CCGATGTTAA AGACACTGCG GCTTCTGCCG CCGAGTCTGC CGCTTCTGCC

151 GTCGAAGAAG CGAAAGACCA AGTCAAAGAT GCTGCGGCTG ATGCAAAGGC

201 AAGTGCCGAG GAAGCTGTAA CTGAAGCCAA AGAAGCTGTA ACTGAAGCAG

251 CTAAAGATAC TTTGAACAAA GCTGCCGACG CGACTCAGGA AGCGGCAGAC

301 AAAATGAAAG ATGCCGCCAA ATAA
```

This corresponds to the amino acid sequence <SEQ ID 818; ORF 228>:

```
m228.pep
    1 MKKLLIAAMM AAALAACSQE AKQEVKEAVQ AVESDVKDTA ASAAESAASA

51 VEEAKDQVKD AAADAKASAE EAVTEAKEAV TEAAKDTLNK AADATQEAAD

101 KMKDAAK*
```

Computer analysis of this amino acid sequence gave the following results:
The following partial DNA sequence was identified in *N. meningitidis* <SEQ ID 819>:

```
a228.seq
    1 ATGAAAAAAT TATTGATTGC CGCAATGATG GCGGCTGCCT TGGCAGCTTG

51 TTCGCAAGAA GCCAAACAGG AGGTTAAGGA AGCGGTTCAA GCCGTTGAGT

101 CCGATGTTAA AGACACTGCG GCTTCTGCCG CCGAGTCTGC CGCTTCTGCC

151 GTCGAAGAAG CGAAAGACCA AGTCAAAGAT GCTGCGGCTG ATGCAAAGGC

201 AAGTGCCGAG GAAGCTGTAA CTGAAGCCAA AGAAGCTGTA ACTGAAGCAG

251 CTAAAGATAC TTTGAACAAA GCTGCCGACG CGACTCAGGA AGCGGCAGAC

301 AAAATGAAAG ATGCCGCCAA ATAA
```

This corresponds to the amino acid sequence <SEQ ID 820; ORF 228.a>:

```
a228.pep
    1 MKKLLIAAMM AAALAACSQE AKQEVKEAVQ AVESDVKDTA ASAAESAASA

51 VEEAKDQVKD AAADAKASAE EAVTEAKEAV TEAAKDTLNK AADATQEAAD

101 KMKDAAK*
``` m228/a228 100.0% identity in 107 aa overlap

```
                   10         20         30         40         50         60
       m228.pep  MKKLLIAAMMAAALAACSQEAKQEVKEAVQAVESDVKDTAASAAESAASAVEEAKDQVKD
                 ||||||||||||||||||||||||||||||||||||||||||||||||||||||||||||
           a228  MKKLLIAAMMAAALAACSQEAKQEVKEAVQAVESDVKDTAASAAESAASAVEEAKDQVKD
                   10         20         30         40         50         60

70         80         90        100
       m228.pep  AAADAKASAEEAVTEAKEAVTEAAKDTLNKAADATQEAADKMKDAAKX
                 |||||||||||||||||||||||||||||||||||||||||||||||
           a228  AAADAKASAEEAVTEAKEAVTEAAKDTLNKAADATQEAADKMKDAAKX
                   70         80         90        100
```

The following partial DNA sequence was identified in *N. gonorrhoeae* <SEQ ID 821>:

```
g229.seq
   1 atggctgccg tatcgggcgg cggtgcggtc ttcctgataa tgcttccaca 51 tattgcccgc gttcagcgtc agccgccagc gttcgcccaa gcgtcgggag 101 aaatcggcat tgaagccgcc ggcgaaattg tatcggctgc cgcccaagag 151 gttttgcccg acaaacggca cggtgccgaa cgagcgcgtt accgaacggt 201 tttgatggcc gaacgacagg cgcaggttct gttcgctgaa atctttgtta 251 tcccaataat gcacgccgcg gctgatgccg ccgtagagga aatgatgccc 301 gcccgcattg atttcgcgcg acacgcccaa gccgtagcgc aaaccgtgtg 351 ccttttgcgg caggctgtcg gcggttttcg tccagcttct gcccgcaaat 401 tcaatcgttt tttcggacga agcgttgttt atagcggatt aacaaaaatc 451 aggacaaggc ggcgggccgc aggcagtacg gatggtacgg aaccggttcg 501 cccggtgctt ggacgcctta gggaaccgtt ccctttgagc cggggcgggg 551 caacccgtac cggttttgt tcatccgcca tattgtgttg a
```

This corresponds to the amino acid sequence <SEQ ID 822; ORF 229.ng>:

```
g229.pep
   1 MAAVSGGGAV FLIMLPHIAR VQRQPPAFAQ ASGEIGIEAA GEIVSAAAQE

51 VLPDKRHGAE RARYRTVLMA ERQAQVLFAE IFVIPIMHAA ADAAVEEMMP

101 ARIDFARHAQ AVAQTVCLLR QAVGGFRPAS ARKFNRFFGR SVVYSGLTKI

151 RTRRRAAGST DGTEPVRPVL GRLREPFPLS RGGATRTGFC SSAILC*
```

The following partial DNA sequence was identified in *N. meningitidis* <SEQ ID 823>:

```
m229.seq (partial)
   1 ..GCTCAAGCGT TGGGAGAAAT CGGCATTGAA GCCGCCGACG AAATTGTATC

51    GGCTGCCGCC TAAGAGGTTT TGCTCGACAA ACGGCACGAT GCCGAACGAG

101    CGCGTTACCG AACGGTTTTT ATAGCCGAAC GACAGGCGCA GGCTCTGTTC

151    GCTGAAATCT TTGTTATCCC AATAATGCAC GCCGCCGCCG CTGATGCCGC

201    CGTAGAGGAA ATGATGCCTG CCCGCATTGA TTTCGCGCGA CACGCCTAAG

251    CCCTAGCGCA AACCGTGTGC CTTTTGCGGC AGGCTGTCGG CGGTTTTCGT

301    CCAGCTTCTG CCCGCAAATT CAATCGTTTT TTCGGACGAA GCGTTGTTTA

351    TAGCGGATTA ACAAAAATCA GGACAAGGCA ACGAAGCCGC AGACAGTACA

401    AATAGTACGG AACCGATTCA CTTGGTGCTT CAGCACcTTA GAGAATCGTT

451    CTCTTTTTTG TTCATCCGCT ATATTGTGTT GA
```

This corresponds to the amino acid sequence <SEQ ID 824; ORF 229>:

```
m229.pep (partial)
   1 ..AQALGEIGIE AADEIVSAAA XEVLLDKRHD AERARYRTVF IAERQAQALF

51    AEIFVIPIMH AAAADAAVEE MMPARIDFAR HAXALAQTVC LLRQAVGGFR
```

-continued
```
101    PASARKFNRF FGRSVVYSGL TKIRTRQRSA DSTNSTEPIH LVLQHLRESR

151    SLFCSSAILC *
```

Computer analysis of this amino acid sequence gave the following results:
Homology with a Predicted ORF from N. gonorrhoeae
ORF 229 shows 80.5% identity over a 169 aa overlap with a predicted ORF (ORF 229.ng) from N. gonorrhoeae:

```
   m229/g209

10        20        30
       m229.pep                        AQALGEIGIEAADEIVSAAAXEVLLDKRHDAE
                                       ||| |||||||| |||||||| ||| |||| ||
       g229     MAAVSGGGAVFLIMLPHIARVQRQPPAFAQASGEIGIEAAGEIVSAAAQEVLPDKRHGAE
                         10        20        30        40        50        60

40        50        60        70        80        90
       m229.pep   RARYRTVFIAERQAQALFAEIFVIPIMHAAAADAAVEEMMPARIDFARHAXALAQTVCLL
                  ||||||::|||||:||||||||||||||||| |||||||||||||||||| |:|||||||
       g229       RARYRTVLMAERQAQVLFAEIFVIPIMHAAA-DAAVEEMMPARIDFARHAQAVAQTVCLL
                         70        80        90        100       110

100       110       120       130       140
       m229.pep   RQAVGGFRPASARKFNRFFGRSVVYSGLTKIRTRQRSADSTNSTEPIHLVLQHLRE----
                  ||||||||||||||||||||||||||||||||||||:|:| ||::|||:: || :|||
       g229       RQAVGGFRPASARKFNRFFGRSVVYSGLTKIRTRRRAAGSTDGTEPVRPVLGRLREPFPL
                         120       130       140       150       160       170

150       160
       m229.pep   -----SRSLFCSSAILCX
                       :|: |||||||||
       g229       SRGGATRTGFCSSAILC
                         180       190
```

The following partial DNA sequence was identified in N. meningitidis <SEQ ID 825>:

```
a229.seq (partial)
   1   ATGGCTGTCG TATCGGGCGG CGGTGCGGTC TTCCTGATAA CGCTTCCACA

51   TATTGCCCAC GTTCAGCGTC AGCCGCCA.. GTTCGCTCAA GCGTCGGGAG

101   AAATCGGCAT TGAAGCCGCC GACGAAATTG TATCGGCTGC CGCCTAAGAG

151   GTTTTGCTCG ATAAACGGCA CGATGCCGAA TGAGCGCGTT ACTGAACGGT

201   TTTTATAGCC GAGCGACAGG CGCAGGCTCT GTTCGCTGAA ATCTTTGTTA

251   TCCTAATAGT GCACGCCGCC GCCGCTGATG TCTCCGTAGA GGAAATGATG

301   CCCGCCCGCA TTGATTTCGC GCGACACGCC CAAGCCGTAG CGCAAACCGT

351   GTGCCTTTTG CGGCAGGCTG TCGGCGGTTT TCGTCCAGCT TCTGCCTGCA

401   AATTCAATCG TTTTTTCGGA CGAAGCGTTG TTTATAGCGG ATTAACAAAA

451   ATCAGGACAA GGCGACGAAG CGCAGACAGT ACAGATAGTA CGGAACCGAT

501   TCACTTGGTG CTTCAGCACC TTAGAGAATC GTCTCTTTGA GCTAAGGCGA

551   GGCAACGCCG TACTGGTTTT TGTTCATCCA CTATA
```

This corresponds to the amino acid sequence <SEQ ID 826; ORF 229.a>:

```
a229.pep (partial)
   1   MAVVSGGGAV FLITLPHIAH VQRQPPXFAQ ASGEIGIEAA DEIVSAAA*E

51   VLLDKRHDAE *ARY*TVFIA ERQAQALFAE IFVILIVHAA AADVSVEEMM

101   PARIDFARHA QAVAQTVCLL RQAVGGFRPA SACKFNRFFG RSVVYSGLTK

151   IRTRRRSADS TDSTEPIHLV LQHLRESSL* AKARQRRTGF CSSTI
``` m229/a229 85.6% identity in 167 aa overlap

```
                            10        20        30
m229.pep                    AQALCEICIEAADEIVSAAAXEVLLDKRHDAE
                            |||  ||||||||||||||||||||||||||||
a229      MAVVSGGGAVFLITLPHIAHVQRQPPXFAQASGEIGIEAADEIVSAAAXEVLLDKRHDAE
                 10        20        30        40        50        60

40        50        60        70        80
m229.pep  RARYRTVFIAERQAQALFAEIFVIPIMHAAAADAAVEEMMPARIDFARHAXALAQTVCLL
          |||  ||||||||||||||||||||| :||||| ::|||||||||||||| :|||||||
a229      XARYXTVFIAERQAQALFAEIFVILIVHAAAADVSVEEMMPARIDFARHAQAVAQTVCLL
                 70        80        90        100       110       120

100       110       120       130       140       149
m229.pep  RQAVGGFRPASARKFNRFFGRSVVYSGLTKIRTRQRSADSTNSTEPIHLVLQHLRES---
          ||||||||||||| |||||||||||||||||||| ||||| ||||||||||||||||
a229      RQAVGGFRPASACKFNRFFGRSVVYSGLTKIRTRRRSADSTDSTEPIHLVLQHLRESSLX
                 130       140       150       160       170       180

150       160
m229.pep  ------RSLFCSSAILCX
                |: ||||:|
a229      AKARQRRTGFCSSTI
                 190
```

The following partial DNA sequence was identified in *N. gonorrhoeae* <SEQ ID 827>:

```
g230.seq
    1 atgttccatt ccatcgaaaa atacagaaca cccgcccaag tcttattagg 51 cctgattgca ttaacttttg tcggcttcgg cgtcagcacg gtttcccatc 101 cgggcgccga ctacatcgtc caagtgggcg acgaaaaaat cagcgagcac 151 tcaatcaaca acgccatgca gaacgagcag gcggacggcg gcagcccttg 201 gcgcgacgcg gtgttccaat ccctgctgca acgcgcctac ctgaaacagg 251 gcgcgaagct gatgggcatt tcggtttctt ccgaacaaat caagcagatg 301 attgtggacg atcccaattt ccacgacgca acggcaaat tcagtcacgc 351 gcttttgagt caatacctgt cgcaacgcca tatgtctgaa gaccagtttg 401 tcgaagaaat ccgcgatcag tttgccttgc agaatttggt aagcctcgtc 451 caaaacggcg tattggtcgg cgacgcgcag gcggaacagc tgatcaggct 501 gacgcaggtc aaccgcacca tccgttcgca cactttcaac cccgacgagt 551 tcatcgccca agtcaaagcg tctgaagccg atttgcagaa attttataat 601 gcgaacaaaa aagactatct gctgccgcag gcggtcaaat ggaatatgt 651 cgccttgaat ctgaaggatt ttgcagacaa gcagaccgtc agtgaaacgg 701 aagtgaaaaa tgcgtttgaa gagcgcgtgg cgcgtttgcc ggcacatgaa 751 gccaaacctt ctttcgagca ggaaaaagcc gccgtcgaaa acgaattgaa 801 aatgaaaaag gcggttgccg acttcaacaa ggcaaaagaa aagctgggcg 851 acgatgcgtt caatcatccc tcctcgcttg ccgaagccgc caaaaacagc 901 ggtttgaaag tggaaaccca agaaacttgg ctgagcaggc aggacgcaca 951 aatgtccggc atgcccgaaa acctaatcaa tgccgtattc agcgacgacg 1001 tattgaagaa aaaacacaat tccgaagtgc tgaccatcaa cagcgaaacc 1051 gcgtgggtcg tccgcgccaa agaagtccgc gaagaaaaaa acctactgtt 1101 tgaagaagcc aaagatgcgg tgcgtcaggc ctatatccgt accgaagccg 1151 ccaaactttt gaaaacaatg taa
```

This corresponds to the amino acid sequence <SEQ ID 828; ORF 230.ng>:

```
g230.pep
   1 MFHSIEKYRT PAQVLLGLIA LTFVGFGVST VSHPGADYIV QVGDEKISEH

51 SINNAMQNEQ ADGGSPWRDA VFQSLLQRAY LKQGAKLMGI SVSSEQIKQM

101 IVDDPNFHDA NGKFSHALLS QYLSQRHMSE DQFVEEIRDQ FALQNLVSLV

151 QNGVLVGDAQ AEQLIRLTQV NRTIRSHTFN PDEFIAQVKA SEADLQKFYN

201 ANKKDYLLPQ AVKLEYVALN LKDFADKQTV SETEVKNAFE ERVARLPAHE

251 AKPSFEQEKA AVENELKMKK AVADFNKAKE KLGDDAFNHP SSLAEAAKNS

301 GLKVETQETW LSRQDAQMSG MPENLINAVF SDDVLKKKHN SEVLTINSET

351 AWVVRAKEVR EEKNLLFEEA KDAVRQAYIR TEAAKLLKTM *
```

The following partial DNA sequence was identified in *N. meningitidis* <SEQ ID 829>:

```
m230.seq (partial)
    1 ATGTTCCATT CCATCGAAAA ATACAGAACG CCCGCCCAAG TCCTTTTGGG

51 CCTGATTGCA TTAACCTTCG TCGGCTTCGG GGTCAGCACG GTATCCCATC

101 CGGGTGCCGA CTACATCGTC CAAGTGGGCG ACGAAAAAaT CAGCGACCAC

151 TCCATCAACA ACGCCATACA GAACGAACAG GCGGACGGCG GCGGCCCTTC

201 GCc.GACGCG GTGTTCCAAT CCCTGCTGCA ACGCGCCTAC CTGAAACAGG

251 GCGCGAAGCT GATGGGCATT TCGGTTTCTT CCGAACAAAT CAAGCAAATT

301 ATCGTGGACG ATCCCAATTT CCACGACGCA ACGGCAAAT TCGACCACGC

351 GCTTTTAAAC CGCTACCTTT CCCAACGCCA TATGTCTGAA GACCAGTTTG

401 TCGAAGAAAT CCGCGATCAG TTTGCCTTGC AGAATTTGGT AAACCTCGTC

451 CAAAACGGCG TATTGGTCGG CGACGCGCAG GCGGAACAGC TGATCAGGCT

501 GACACAGGTC AACCGCACCA TCCGTTCGCA CACTTTCAAC CCCGACGAGT

551 TCATCGCCCA AGTCAAAGTG TCTGAAGCCG ATTTGCAGAA ATTTTATAAT

601 GCGAACAAAA AAGACTATCT GCTGCCGCAG gCGGTCAAAT TGGAATATGT

651 CGCCTTGAAT CTGAAGGATT TTGCAGACAA GCAGACCGTC AGTGAAACGg

701 AAGTGAAAAA TGCATTTGAA GAGCGCGTGG CGCGTTTGCC GGCAAATGAA

751 GCCAAACCTT CTTTCGAGCA GGAAAAAGCC GCCGTCGAAA ACGAATTGAA

801 AATGAAAAAG GCGGTTGCCG ACTTCAACAA GGCAAAAGAA AAATTGGGCG

851 ACGATGC.GT cAACCATCCT TCyTCGCTTG CCGAAGCCGC CAAAAACAGC

901 GGTTTGAAAG TCGAAACCCA AGAAACTTGG CTGAGTAGGC AGGACGCGCA

951 AATGTCCGGT ATGCCCGAAA ACCTGATCAA TGCCGTATTC AGCGACGACG

1001 TATTGAAGAA AAAACACAAT TCCGAAGTGC TGACCATCAA CAGCGAAACC

1051 GCGTGGGTCG TCCGCGCCAA AGAAGTCCGC GAAGAGAAAA CCCTGCCGTT

1101 TGCCGAAGCC AAAGACGCGG TACGTCAGGC TTATATCCGT ACCGAAGCCG

1151 CCAAACTT.. ...
```

This corresponds to the amino acid sequence <SEQ ID 830; ORF 230>:

```
m230.pep (partial)
   1 MFHSIEKYRT PAQVLLGLIA LTFVGFGVST VSHPGADYIV QVGDEKISDH

51 SINNAIQNEQ ADGGGPSPDA VFQSLLQRAY LKQGAKLMGI SVSSEQIKQI

101 IVDDPNFHDA NGKFDHALLN RYLSQRHMSE DQFVEEIRDQ FALQNLVNLV

151 QNGVLVGDAQ AEQLIRLTQV NRTIRSHTFN PDEFIAQVKV SEADLQKFYN

201 ANKKDYLLPQ AVKLEYVALN LKDFADKQTV SETEVKNAFE ERVARLPANE

251 AKPSFEQEKA AVENELKMKK AVADFNKAKE KLGDDAVNHP SSLAEAAKNS

301 GLKVETQETW LSRQDAQMSG MPENLINAVF SDDVLKKKHN SEVLTINSET

351 AWVVRAKEVR EEKTLPFAEA KDAVRQAYIR TEAAKL....
```

Computer analysis of this amino acid sequence gave the following results:

Homology with a Predicted ORF from *N. gonorrhoeae*

ORF 230 shows 95.9% identity over a 386 aa overlap with a predicted ORF (ORF 230.ng) from *N. gonorrhoeae*:

```
    m230/g230
                      10        20        30        40        50        60
    m230.pep  MFHSIEKYRTPAQVLLGLIALTFVGFGVSTVSHPGADYIVQVGDEKISDHSINNAIQNEQ
              ||||||||||||||||||||||||||||||||||||||||||||||||:||||||:||||
    g230      MFHSIEKYRTPAQVLLGLIALTFVGFGVSTVSHPGADYIVQVGDEKISEHSINNAMQNEQ
                      10        20        30        40        50        60

70        80        90       100       110       120
    m230.pep  ADGGGPSPDAVFQSLLQRAYLKQGAKLMGISVSSEQIKQIIVDDPNFHDANGKFDHALLN
              ||||:|||||||||||||||||||||||||||||||||||:|||||||||||||:||||:
    g230      ADGGSPWRDAVFQSLLQRAYLKQGAKLMGISVSSEQIKQMIVDDPNFHDANGKFSHALLS
                      70        80        90       100       110       120

130       140       150       160       170       180
    m230.pep  RYLSQRHMSEDQFVEEIRDQFALQNLVNLVQNGVLVGDAQAEQLIRLTQVNRTIRSHTFN
              :||||||||||||||||||||||||||||:||||||||||||||||||||||||||||||
    g230      QYLSQRHMSEDQFVEEIRDQFALQNLVSLVQNGVLVGDAQAEQLIRLTQVNRTIRSHTFN
                     130       140       150       160       170       180

190       200       210       220       230       240
    m230.pep  PDEFIAQVKVSEADLQKFYNANKKDYLLPQAVKLEYVALNLKDFADKQTVSETEVKNAFE
              ||||||||||:|||||||||||||||||||||||||||||||||||||||||||||||||
    g230      PDEFIAQVKASEADLQKFYNANKKDYLLPQAVKLEYVALNLKDFADKQTVSETEVKNAFE
                     190       200       210       220       230       240

250       260       270       280       290       300
    m230.pep  ERVARLPANEAKPSFEQEKAAVENELKMKKAVADFNKAKEKLGDDAVNHPSSLAEAAKNS
              ||||||||:|||||||||||||||||||||||||||||||||||||| ||||||||||||
    g230      ERVARLPAHEAKPSFEQEKAAVENELKMKKAVADFNKAKEKLGDDAFNHPSSLAEAAKNS
                     250       260       270       280       290       300

310       320       330       340       350       360
    m230.pep  GLKVETQETWLSRQDAQMSGMPENLINAVFSDDVLKKKHNSEVLTINSETAWVVRAKEVR
              ||||||||||||||||||||||||||||||||||||||||||||||||||||||||||||
    g230      GLKVETQETWLSRQDAQMSGMPENLINAVFSDDVLKKKHNSEVLTINSETAWVVRAKEVR
                     310       320       330       340       350       360

370       380
    m230.pep  EEKTLPFAEAKDAVRQAYIRTEAAKL
              |||:| |||||||||||||||||||
    g230      EEKNLLFEEAKDAVRQAYIRTEAAKLLKTM
                     370       380       390
```

The following partial DNA sequence was identified in *N. meningitidis* <SEQ ID 831>:

```
a230.seq (partial)
   1 ATGTTCCATT CCATCGAAAA ATACAGAACG CCCGCCCAAG TCCTTTTGGG

51 CCTGATTGCA TTAACCTTCG TCGGCTTCGG GGTCAGCACG GTATCCCATC

101 CGGGTGCCGA CTACATCGTC CAAGTGGGCG ACGAAAAAAT CAGCGACCAC
```

```
151 TCCATCAACA ACGCCATACA GAACGAACAG GCGGACGGCG GCGGCCCTTC

201 GCGCGACGCG GTGTTCCAAT CCCTGCTACA ACGCGCCTAC CTGAAACAGG

251 GCGCGAAGCT GATGGGCATT TCGGTTTCTT CCGAACAAAT CAAGCAGATT

301 ATCGTGGACG ATCCCAATTT CCACGACGCA AACGGCAAAT CGACCACGC

351 GCTTTTAAAC CGCTACCTTT CCCAACGTCA TATGTCTGAA GACCAGTTTG

401 TCGAAGAAAT CCGCGATCAG TTTGCCTTGC AGAATTTGGT AAACCTCGTC

451 CAAAACGGCG TATTGGTCGG CGACGCGCAG GCGGAACAGC TGATCAGGCT

501 GACGCAGGTC AACCGCACCA TCCGTTCGCA CACTTTCAAC CCCGACGAAT

551 TCATCGCCCA AGTCAAAGTG TCTGAAGCCG ATTTGCAGAA GTTTTATAAC

601 GCAAACAAAA AAGACTACCT GCTTCCCAAA GCGGTCAAAT TGGAATATGT

651 CGCCTTGAAT CTGAAAGACT TTGCAGACAA ACAGACCGTC AGCGAAACAG

701 AAGTGAAAAA TGCGTTTGAA GAGCGCGTGG CGCGTTTGCC GGCAAATGAA

751 GCCAAACCTT CTTTCGAGCA GGAAAAAGCC GCCGTCGAAA ACGAATTGAA

801 AATGAAAAAG GCGGTTGCCG ACTTCAATAA GGCAAAAGAA AAGCTGGGCG

851 ATGACGCGTT CAACCATCCT TCCTCGCTTG CCGAAGCCGC CAAAAACAGC

901 GGTTTGAAAG TCGAAACCCA GAAACTTGG CTGAGCAGGC AGGATGCGCA

951 AATGTCCGGT ATGCCCGAAA ACCTGATCAA TGCCGTATTC AGCGACGACG

1001 TATTGAAGAA AAAACACAAT TCCGAAGTGC TGACCATCAA CAGCGAAACC

1051 GCGTGGGTCG TCCGCGCCAA AGAAGTCCGC GAAGAGAAAA CCCTGCCGTT

1101 TGCCGAAGCC AAAGACGCGG TACGTCAGGC TTATATCCGT ACCGAAGCCG

1151 CCAAACTT
```

This corresponds to the amino acid sequence <SEQ ID 832; ORF 230.a>:

```
a230.pep (partial)
  1 MFHSIEKYRT PAQVLLGLIA LTFVGFGVST VSHPGADYIV QVGDEKISDH

51 SINNAIQNEQ ADGGGPSRDA VFQSLLQRAY LKQGAKLMGI SVSSEQIKQI

101 IVDDPNFHDA NGKFDHALLN RYLSQRHMSE DQFVEEIRDQ FALQNLVNLV

151 QNGVLVGDAQ AEQLIRLTQV NRTIRSHTFN PDEFIAQVKV SEADLQKFYN

201 ANKKDYLLPK AVKLEYVALN LKDFADKQTV SETEVKNAFE ERVARLPANE

251 AKPSFEQEKA AVENELKMKK AVADFNKAKE KLGDDAFNHP SSLAEAAKNS

301 GLKVETQETW LSRQDAQMSG MPENLINAVF SDDVLKKKHN SEVLTINSET

351 AWVVRAKEVR EEKTLPFAEA KDAVRQAYIR TEAAKL
``` m230/a230 99.2% identity in 386 aa overlap

```
                   10         20         30         40         50         60
    m230.pep  MFHSIEKYRTPAQVLLGLIALTFVGFGVSTVSHPGADYIVQVGDEKISDHSINNAIQNEQ
              ||||||||||||||||||||||||||||||||||||||||||||||||||||||||||||
    A230      MFHSIEKYRTPAQVLLGLIALTFVGFGVSTVSHPGADYIVQVGDEKISDHSINNAIQNEQ
                   10         20         30         40         50         60

70         80         90        100        110        120
    m230.pep  ADGGGPSPDAVFQSLLQRAYLKQGAKLMGISVSSEQIKQIIVDDPNFHDANGKFDHALLN
              ||||||| ||||||||||||||||||||||||||||||||||||||||||||||||||||
    a230      ADGGGPSRDAVFQSLLQRAYLKQGAKLMGISVSSEQIKQIIVDDPNFHDANGKFDHALLN
                   70         80         90        100        110        120
```

```
              130       140       150       160       170       180
m230.pep  RYLSQRHMSEDQFVEEIRDQFALQNLVNLVQNGVLVGDAQAEQLIRLTQVNRTIRSHTFN
          ||||||||||||||||||||||||||||||||||||||||||||||||||||||||||||
a230      RYLSQRHMSEDQFVEEIRDQFALQNLVNLVQNGVLVGDAQAEQLIRLTQVNRTIRSHTFN
              130       140       150       160       170       180

190       200       210       220       230       240
m230.pep  PDEFIAQVKVSEADLQKFYNANKKDYLLPQAVKLEYVALNLKDFADKQTVSETEVKNAFE
          |||||||||||||||||||||||||||||||:||||||||||||||||||||||||||||
a230      PDEFIAQVKVSEADLQKFYNANKKDYLLPKAVKLEYVALNLKDFADKQTVSETEVKNAFE
              190       200       210       220       230       240

250       260       270       280       290       300
m230.pep  ERVARLPANEAKPSFEQEKAAVENELKMKKAVADFNKAKEKLGDDAVNHPSSLAEAAKNS
          ||||||||||||||||||||||||||||||||||||||||||||| ||||||||||||||
a230      ERVARLPANEAKPSFEQEKAAVENELKMKKAVADFNKAKEKLGDDAFNHPSSLAEAAKNS
              250       260       270       280       290       300

310       320       330       340       350       360
m230.pep  GLKVETQETWLSRQDAQMSGMPENLINAVFSDDVLKKKHNSEVLTINSETAWVVRAKEVR
          ||||||||||||||||||||||||||||||||||||||||||||||||||||||||||||
a230      GLKVETQETWLSRQDAQMSGMPENLINAVFSDDVLKKKHNSEVLTINSETAWVVRAKEVR
              310       320       330       340       350       360

370       380
m230.pep  EEKTLPFAEAKDAVRQAYIRTEAAKL
          ||||||||||||||||||||||||||
a230      EEKTLPFAEAKDAVRQAYIRTEAAKL
```

The following partial DNA sequence was identified in *N. gonorrhoeae* <SEQ ID 833>:

```
g230-1.seq
    1 ATGTTCCATT CCATCGAAAA ATACAGAACA CCCGCCCAAG TCTTATTAGG

51 CCTGATTGCA TTAACTTTTG TCGGCTTCGG CGTCAGCACG GTTTCCCATC

101 CGGGCGCCGA CTACATCGTC CAAGTGGGCG ACGAAAAAAT CAGCGAGCAC

151 TCAATCAACA ACGCCATGCA GAACGAGCAG GCGGACGGCG GCAGCCCTTG

201 GCGCGACGCG GTGTTCCAAT CCCTGCTGCA ACGCGCCTAC CTGAAACAGG

251 GCGCGAAGCT GATGGGCATT TCGGTTTCTT CCGAACAAAT CAAGCAGATG

301 ATTGTGGACG ATCCCAATTT CCACGACGCA AACGGCAAAT TCAGTCACGC

351 GCTTTTGAGT CAATACCTGT CGCAACGCCA TATGTCTGAA GACCAGTTTG

401 TCGAAGAAAT CCGCGATCAG TTTGCCTTGC AGAATTTGGT AAGCCTCGTC

451 CAAAACGGCG TATTGGTCGG CGACGCGCAG GCGGAACAGC TGATCAGGCT

501 GACGCAGGTC AACCGCACCA TCCGTTCGCA CACTTTCAAC CCCGACGAGT

551 TCATCGCCCA GTCAAAGCG TCTGAAGCCG ATTTGCAGAA ATTTTATAAT

601 GCGAACAAAA AAGACTATCT GCTGCCGCAG GCGGTCAAAT TGGAATATGT

651 CGCCTTGAAT CTGAAGGATT TTGCAGACAA GCAGACCGTC AGTGAAACGG

701 AAGTGAAAAA TGCGTTTGAA GAGCGCGTGG CGCGTTTGCC GGCACATGAA

751 GCCAAACCTT CTTTCGAGCA GGAAAAAGCC GCCGTCGAAA ACGAATTGAA

801 AATGAAAAAG GCGGTTGCCG ACTTCAACAA GGCAAAGAA AAGCTGGGCG

851 ACGATGCGTT CAATCATCCC TCCTCGCTTG CCGAAGCCGC CAAAAACAGC

901 GGTTTGAAAG TGGAAACCCA AGAACTTGG CTGAGCAGGC AGGACGCACA

951 AATGTCCGGC ATGCCCGAAA ACCTAATCAA TGCCGTATTC AGCGACGACG

1001 TATTGAAGAA AAAACACAAT TCCGAAGTGC TGACCATCAA CAGCGAAACC

1051 GCGTGGGTCG TCCGCGCCAA AGAAGTCCGC GAAGAAAAAA ACCTACTGTT

1101 TGAAGAAGCC AAAGATGCGG TGCGTCAGGC CTATATCCGT ACCGAAGCCG

1151 CCAAACTTGC CGAAAACAAG GCAAAAGAAG TGCTTACCCA ACTGAACGGC
```

```
-continued
1201 GGCAAGGCAG TTGACGTGAA ATGGTCGGAA GTGTCCGTTT TGGGCGCGCA

1251 GCAGGCAAGG CAGTCCATGC CGCCCGAGGC TTATGCGGAA CTGCTGAAAG

1301 CAAAACCGGC AAACGGCAAA CCCGCCTATG TCAGACTGAC CGGTCTGCCG

1351 GCACCCGTGA TTGTCGAGGC GCAGGCAGTC ACGCCTCCGG AGGATATTGC

1401 CGCACAGCTT CCTCCTGCGA AACAGGCTTT GGCGCAACAG CAGTCTGCCA

1451 ATACTTTCGA CCTGCTGATC CGCTATTTCA ACGGAAAAAT CAAACAGACT

1501 AAAGGAGCAC AATCGGTTGA CAACGGCGAT GGTCAGTAA
```

This corresponds to the amino acid sequence <SEQ ID 834; ORF 230-1.ng>:

```
g230-1.pep.
   1 MFHSIEKYRT PAQVLLGLIA LTFVGFGVST VSHPGADYIV QVGDEKISEH

51 SINNAMQNEQ ADGGSPWRDA VFQSLLQRAY LKQGAKLMGI SVSSEQIKQM

101 IVDDPNFHDA NGKFSHALLS QYLSQRHMSE DQFVEEIRDQ FALQNLVSLV

151 QNGVLVGDAQ AEQLIRLTQV NRTIRSHTFN PDEFIAQVKA SEADLQKFYN

201 ANKKDYLLPQ AVKLEYVALN LKDFADKQTV SETEVKNAFE ERVARLPAHE

251 AKPSFEQEKA AVENELKMKK AVADFNKAKE KLGDDAFNHP SSLAEAAKNS

301 GLKVETQETW LSRQDAQMSG MPENLINAVF SDDVLKKKHN SEVLTINSET

351 AWVVRAKEVR EEKNLLFEEA KDAVRQAYIR TEAAKLAENK AKEVLTQLNG

401 GKAVDVKWSE VSVLGAQQAR QSMPPEAYAE LLKAKPANGK PAYVRLTGLP

451 APVIVEAQAV TPPEDIAAQL PPAKQALAQQ QSANTFDLLI RYFNGKIKQT

501 KGAQSVDNGD GQ*
```

The following partial DNA sequence was identified in *N. meningitidis* <SEQ ID 835>:

```
m230-1.seq
    1 ATGTTCCATT CCATCGAAAA ATACAGAACG CCCGCCCAAG TCCTTTTGGG

51 CCTGATTGCA TTAACCTTCG TCGGCTTCGG GGTCAGCACG GTATCCCATC

101 CGGGTGCCGA CTACATCGTC CAAGTGGGCG ACGAAAAAAT CAGCGACCAC

151 TCCATCAACA ACGCCATACA GAACGAACAG GCGGACGGCG GCGGCCCTTC

201 GCGCGACGCG GTGTTCCAAT CCCTGCTGCA ACGCGCCTAC CTGAAACAGG

251 GCGCGAAGCT GATGGGCATT TCGGTTTCTT CCGAACAAAT CAAGCAAATT

301 ATCGTGGACG ATCCCAATTT CCACGACGCA AACGGCAAAT TCGACCACGC

351 GCTTTTAAAC CGCTACCTTT CCCAACGCCA TATGTCTGAA GACCAGTTTG

401 TCGAAGAAAT CCGCGATCAG TTTGCCTTGC AGAATTTGGT AAACCTCGTC

451 CAAAACGGCG TATTGGTCGG CGACGCGCAG GCGGAACAGC TGATCAGGCT

501 GACACAGGTC AACCGCACCA TCCGTTCGCA CACTTTCAAC CCCGACGAGT

551 TCATCGCCCA AGTCAAAGTG TCTGAAGCCG ATTTGCAGAA ATTTTATAAT

601 GCGAACAAAA AAGACTATCT GCTGCCGCAG GCGGTCAAAT TGGAATATGT

651 CGCCTTGAAT CTGAAGGATT TTGCAGACAA GCAGACCGTC AGTGAAACGG

701 AAGTGAAAAA TGCATTTGAA GAGCGCGTGG CGCGTTTGCC GGCAAATGAA

751 GCCAAACCTT CTTTCGAGCA GGAAAAAGCC GCCGTCGAAA ACGAATTGAA
```

-continued

```
 801 AATGAAAAAG GCGGTTGCCG ACTTCAACAA GGCAAAGAA AAATTGGGCG

851 ACGATGCGTT CAACCATCCT TCCTCGCTTG CCGAAGCCGC CAAAAACAGC

901 GGTTTGAAAG TCGAAACCCA AGAAACTTGG CTGAGTAGGC AGGACGCGCA

951 AATGTCCGGT ATGCCCGAAA ACCTGATCAA TGCCGTATTC AGCGACGACG

1001 TATTGAAGAA AAAACACAAT TCCGAAGTGC TGACCATCAA CAGCGAAACC

1051 GCGTGGGTCG TCCGCGCCAA AGAAGTCCGC GAAGAGAAAA CCCTGCCGTT

1101 TGCCGAAGCC AAAGACGCGG TACGTCAGGC TTATATCCGT ACCGAAGCCG

1151 CCAAACTTGC CGAAAACAAG GCAAAAGACG TGCTTACCCA ACTGAACGGC

1201 GGCAAGGCTG TTGACGTGAA ATGGTCGGAA GTGTCCGTTT TGGGCGCACA

1251 GCAGGCAAGG CAGTCCATGC CGCCCGAGGC TTATGCGGAA CTGCTGAAAG

1301 CAAAACCGGC AAACGGCAAA CCCGCCTACG TCAGGCTGAT CGGTCTGCCG

1351 GCACCCGTGA TTGTCGAAGT ACAGGCTGTA ACCCCGCCGG ATGATATCGC

1401 CGCACAGCTT CCGCTTGCAA AACAGGCTTT GGCGCAACAG CAGTCTGCCA

1451 ATACTTTCGA CTTGTTGATA CGTTATTTCA ACGGCAAAAT CAAACAGACC

1501 AAAGGAGCGC AATCGGTCGA CAACGGCGAC GGTCAGTAA
```

This corresponds to the amino acid sequence <SEQ ID 836; ORF 230-1>:

```
a230-1.pep

1 MFHSIEKYRT PAQVLLGLIA LTFVGFGVST VSHPGADYIV QVGDEKISDH

51 SINNAIQNEQ ADGGGPSRDA VFQSLLQRAY LKQGAKLMGI SVSSEQIKQI

101 IVDDPNGHDA NGKFDHALLN RYLSQRHMSE DQGVEEIRDQ FALQNLVNLV

151 QNGVLVGDAQ AEQLIRLTQV NRTIRSHTFN PDEFIAQVKV SEADLQKFYN

201 ANKKDYLLPQ AVKLEYVALN LKDFADKQTV SETEVKNAFE ERVARLPANE

251 AKPSFEQEKA AVENELKMKK AVADFNKAKE KLGDDAFNHP SSLAEAAKNS

301 GLKVETQETW LSRQDAQMSG MPENLINAVF SDDVLKKKHN SEVLTINSET

351 AWVVRAKEVR EEKTLPFAEA KDAVRQAYIR TEAAKLAENK AKDVLTQLNG

401 GKAVDVKWSE VSVLGAQQAR QSMPPEAYAE LLKAKPANGK PAYVRLIGLP

451 APVIVEVQAV TPPDDIAAQL PLAKQALAQQ QSANTFDLLI RYFNGKIKQT

501 KGAQSVDNGD GQ* m230-1/g230-1  96.3% identity in 512 aa overlap 10         20         30         40         50         60
m230-1.pep MFHSIEKYRTPAQVLLGLIALTFVGFGVSTVSHPGADYIVQVGDEKISDHSINNAIQNEQ
           ||||||||||||||||||||||||||||||||||||||||||||||||:||||||:|||
g230-1     MFHSIEKYRTPAQVLLGLIALTFVGFGVSTVSHPGADYIVQVGDEKISEHSINNAMQNEQ
                10         20         30         40         50         60

70         80         90        100        110        120
m230-1.pep ADGGGPSRDAVFQSLLQRAYLKQGAKLMGISVSSEQIKQIIVDDPNFHDANGKFDHALLN
           ||||:|||||||||||||||||||||||||||||||||:||||||||||||||:||||:
g230-1     ADGGSPWRDAVFQSLLQRAYLKQGAKLMGISVSSEQIKQMIVDDPNFHDANGKFSHALLS
                70         80         90        100        110        120

130        140        150        160        170        180
m230-1.pep RYLSQRHMSEDQFVEEIRDQFALQNLVNLVQNGVLVGDAQAEQLIRLTQVNRTIRSHTFN
           :|||||||||||||||||||||||||||:|||||||||||||||||||||||||||||||
g230-1     QYLSQRHMSEDQFVEEIRDQFALQNLVSLVQNGVLVGDAQAEQLIRLTQVNRTIRSHTFN
               130        140        150        160        170        180

190        200        210        220        230        240
m230-1.pep PDEFIAQVKVSEADLQKFYNANKKDYLLPQAVKLEYVALNLKDFADKQTVSETEVKNAFE
           ||||||||||:|||||||||||||||||||||||||||||||||||||||||||||||||
g230-1     PDEFIAQVKASEADLQKFYNANKKDYLLPQAVKLEYVALNLKDFADKQTVSETEVKNAFE
               190        200        210        220        230        240
```

-continued

```
                 250       260       270       280       290       300
m230-1.pep ERVARLPANEAKPSFEQEKAAVENELKMKKAVADFNKAKEKLGDDAFNHPSSLAEAAKNS
           ||||||||:|||||||||||||||||||||||||||||||||||||||||||||||||||
g230-1     ERVARLPAHEAKPSFEQEKAAVENELKMKKAVADFNKAKEKLGDDAFNHPSSLAEAAKNS
                 250       260       270       280       290       300

310       320       330       340       350       360
m230-1.pep GAKVETQETWLSRQDAQMSGMPENLINAVFSDDVLKKKHNSEVLTINSETAWVVRAKEVR
           ||||||||||||||||||||||||||||||||||||||||||||||||||||||||||||
g230-1     GAKVETQETWLSRQDAQMSGMPENLINAVFSDDVLKKKHNSEVLTINSETAWVVRAKEVR
                 310       320       330       340       350       360

370       380       390       400       410       420
m230-1.pep EEKTLPFAEAKDAVRQAYIRTEAAKLAENKAKDVLTQLNGGKAVDVKWSEVSVLGAQQAR
           |||:| | ||||||||||||||||||||||||:|||||||||||||||||||||||||||
g230-1     EEKNLLFEEAKDAVRQAYIRTEAAKLAENKAKEVLTQLNGGKAVDVKWSEVSVLGAQQAR
                 370       380       390       400       410       420

430       440       450       460       470       480
m230-1.pep QSMPPEAYAELLKAKPANGKPAYVRLIGLPAPVIVEVQAVTPPDDIAAQLPLAKQALAQQ
           |||||||||||||||||||||||||| |||||||||:||||||:||||||| ||||||||
g230-1     QSMPPEAYAELLKAKPANGKPAYVRLTGLPAPVIVEAQAVTPPEDIAAQLPPAKQALAQQ
                 430       440       450       460       470       480

490       500       510
m230-1.pep QSANTFDLLIRYFNGKIKQTKGAQSVDNGDGQX
           |||||||||||||||||||||||||||||||||
g230-1     QSANTFDLLIRYFNGKIKQTKGAQSVDNGDGQX
                 490       500       510
```

The following partial DNA sequence was identified in *N. meningitidis* <SEQ ID 837>:

```
a230-1.seq
   1 ATGTTCCATT CCATCGAAAA ATACAGAACG CCCGCCCAAG TCCTTTTGGG

51 CCTGATTGCA TTAACCTTCG TCGGCTTCGG GGTCAGCACG GTATCCCATC

101 CGGGTGCCGA CTACATCGTC CAAGTGGGCG ACGAAAAAAT CAGCGACCAC

151 TCCATCAACA ACGCCATACA GAACGAACAG GCGGACGGCG GCGGCCCTTC

201 GCGCGACGCG GTGTTCCAAT CCCTGCTACA ACGCGCCTAC CTGAAACAGG

251 GCGCGAAGCT GATGGGCATT TCGGTTTCTT CCGAACAAAT CAAGCAGATT

301 ATCGTGGACG ATCCCAATTT CCACGACGCA AACGGCAAAT TCGACCACGC

351 GCTTTTAAAC CGCTACCTTT CCCAACGTCA TATGTCTGAA GACCAGTTTG

401 TCGAAGAAAT CCGCGATCAG TTTGCCTTGC AGAATTTGGT AAACCTCGTC

451 CAAAACGGCG TATTGGTCGG CGACGCGCAG GCGGAACAGC TGATCAGGCT

501 GACGCAGGTC AACCGCACCA TCCGTTCGCA CACTTTCAAC CCCGACGAAT

551 TCATCGCCCA AGTCAAAGTG TCTGAAGCCG ATTTGCAGAA GTTTTATAAC

601 GCAAACAAAA AAGACTACCT GCTTCCCAAA GCGGTCAAAT TGGAATATGT

651 CGCCTTGAAT CTGAAAGACT TTGCAGACAA ACAGACCGTC AGCGAAACAG

701 AAGTGAAAAA TGCGTTTGAA GAGCGCGTGG CGCGTTTGCC GGCAAATGAA

751 GCCAAACCTT CTTTCGAGCA GGAAAAAGCC GCCGTCGAAA ACGAATTGAA

801 AATGAAAAAG GCGGTTGCCG ACTTCAATAA GGCAAAAGAA AAGCTGGGCG

851 ATGACGCGTT CAACCATCCT TCCTCGCTTG CCGAAGCCGC CAAAAACAGC

901 GGTTTGAAAG TCGAAACCCA AGAAACTTGG CTGAGCAGGC AGGATGCGCA

951 AATGTCCGGT ATGCCCGAAA ACCTGATCAA TGCCGTATTC AGCGACGACG

1001 TATTGAAGAA AAAACACAAT TCCGAAGTGC TGACCATCAA CAGCGAAACC

1051 GCGTGGGTCG TCCGCGCCAA AGAAGTCCGC GAAGAGAAAA CCCTGCCGTT

1101 TGCCGAAGCC AAAGACGCGG TACGTCAGGC TTATATCCGT ACCGAAGCCG

1151 CCAAACTTGC CGAAAACAAG GCAAAAGACG TGCTTACCCA ACTGAACGGC
```

-continued

```
1201 GGCAAGGCTG TTGACGTGAA ATGGTCGGAA GTGTCCGTTT TGGGCGCACA

1251 GCAGGCAAGG CAGTCCATGC CGCCCGAGGC TTATGCGGAA CTGCTGAAAG

1301 CAAAACCGGC AAACGGCAAA CCCGCCTACG TCAGGCTGAT CGGTCTGCCG

1351 GCACCCGTGA TTGTCGAAGT ACAGGCTGTA ACCCCGCCGG ATGATATCGC

1401 CGCACAGCTT CCGCTTGCAA AACAGGCTTT GGCGCAACAG CAGTCTGCCA

1451 ATACTTTCGA CTTGTTGATA CGTTATTTCA ACGGCAAAAT CAAACAGACC

1501 AAAGGAGCGC AATCGGTCGA CAACGGCGAC GGTCAGTAA
```

This corresponds to the amino acid sequence <SEQ ID 838; ORF 230-1.a>:

```
a230-1.pep
       1   MFHSIEKYRT PAQVLLGLIA LTFVGFGVST VSHPGADYIV QVGDEKISDH

51   SINNAIQNEQ ADGGGPSRDA VFQSLLQRAY LKQGAKLMGI SVSSEQIKQI

101   IVDDPNGHDA NGKFDHALLN RYLSQRHMSE DQGVEEIRDQ FALQNLVNLV

151   QNGVLVGDAQ AEQLIRLTQV NRTIRSHTFN PDEFIAQVKV SEADLQKFYN

201   ANKKDYLLPQ AVKLEYVALN LKDFADKQTV SETEVKNAFE ERVARLPANE

251   AKPSFEQEKA AVENELKMKK AVADFNKAKE KLGDDAFNHP SSLAEAAKNS

301   GLKVETQETW LSRQDAQMSG MPENLINAVF SDDVLKKKHN SEVLTINSET

351   AWVVRAKEVR EEKTLPFAEA KDAVRQAYIR TEAAKLAENK AKDVLTQLNG

401   GKAVDVKWSE VSVLGAQQAR QSMPPEAYAE LLKAKPANGK PAYVRLIGLP

451   APVIVEVQAV TPPDDIAAQL PLAKQALAQQ QSANTFDLLI RYFNGKIKQT

501          KGAQSVDNGD GQ* a230-1/m230-1  99.8% identity in 512 aa overlap 10         20         30         40         50         60
a230-1.pep  MFHSIEKYRTPAQVLLGLIALTFVGFGVSTVSHPGADYIVQVGDEKISDHSINNAIQNEQ
            ||||||||||||||||||||||||||||||||||||||||||||||||||||| |||||
m230-1      MFHSIEKYRTPAQVLLGLIALTFVGFGVSTVSHPGADYIVQVGDEKISDHSINNIMQNEQ
                      10         20         30         40         50         60

70         80         90        100        110        120
a230-1.pep  ADGGGPSRDAVFQSLLQRAYLKQGAKLMGISVSSEQIKQIIVDDPNFHDANGKFDHALLN
            ||||||||||||||||||||||||||||||||||||||||||||||||||||||||||||
m230-1      ADGGGPSRDAVFQSLLQRAYLKQGAKLMGISVSSEQIKQIIVDDPNFHDANGKFDHALLN
                      70         80         90        100        110        120

130        140        150        160        170        180
a230-1.pep  RYLSQRHMSEDQFVEEIRDQFALQNLVNLVQNGVLVGDAQAEQLIRLTQVNRTIRSHTFN
            ||||||||||||||||||||||||||||||||||||||||||||||||||||||||||||
m230-1      RYLSQRHMSEDQFVEEIRDQFALQNLVNLVQNGVLVGDAQAEQLIRLTQVNRTIRSHTFN
                     130        140        150        160        170        180

190        200        210        220        230        240
a230-1.pep  PDEFIAQVKVSEADLQKFYNANKKDYLLPKAVKLEYVALNLKDFADKQTVSETEVKNAFE
            ||||||||||||||||||||||||||||||||:|||||||||||||||||||||||||||
m230-1      PDEFIAQVKVSEADLQKFYNANKKDYLLPQAVKLEYVALNLKDFADKQTVSETEVKNAFE
                     190        200        210        220        230        240

250        260        270        280        290        300
a230-1.pep  ERVARLPANEAKPSFEQEKAAVENELKMKKAVADFNKAKEKLGDDAFNHPSSLAEAAKNS
            ||||||||||||||||||||||||||||||||||||||||||||||||||||||||||||
m230-1      ERVARLPANEAKPSFEQEKAAVENELKMKKAVADFNKAKEKLGDDAFNHPSSLAEAAKNS
                     250        260        270        280        290        300

310        320        330        340        350        360
a230-1.pep  GAKVETQETWLSRQDAQMSGMPENLINAVFSDDVLKKKHNSEVLTINSETAWVVRAKEVR
            ||||||||||||||||||||||||||||||||||||||||||||||||||||||||||||
m230-1      GAKVETQETWLSRQDAQMSGMPENLINAVFSDDVLKKKHNSEVLTINSETAWVVRAKEVR
                     310        320        330        340        350        360

370        380        390        400        410        420
a230-1.pep  EEKTLPFAEAKDAVRQAYIRTEAAKLAENKAKDVLTQLNGGKAVDVKWSEVSVLGAQQAR
            ||||||||||||||||||||||||||||||||||||||||||||||||||||||||||||
m230-1      EEKTLPFAEAKDAVRQAYIRTEAAKLAENKAKDVLTQLNGGKAVDVKWSEVSVLGAQQAR
                     370        380        390        400        410        420
```

```
                    430        440        450        460        470        480
a230-1.pep  QSMPPEAYAELLKAKPANGKPAYVRLIGLPAPVIVEVQAVTPPDDIAAQLPLAKQALAQQ
            ||||||||||||||||||||||||||||||||||||||||||||||||||||||||||||
m230-1      QSMPPEAYAELLKAKPANGKPAYVRLIGLPAPVIVEVQAVTPPDDIAAQLPLAKQALAQQ
                    430        440        450        460        470        480

490        500        510
a230-1.pep  QSANTFDLLIRYFNGKIKQTKGAQSVDNGDGQX
            |||||||||||||||||||||||||||||||||
m230-1      QSANTFDLLIRYFNGKIKQTKGAQSVDNGDGQX
                    490        500        510
```

The following partial DNA sequence was identified in *N. gonorrhoeae* <SEQ ID 839>:

```
g231.seq
    1 atgtcaaaac gaaaatccat aaaccgtccg tatcaaaaac cggcggaact
   51 gccgccgttg caaataatc cgccatttta ccgtaaaaac cgccgcctga
  101 actttttat cgcggcagac ggcggttgcg cgtctccgca aaaatgcagg
  151 gcgcgcggtt ttcagacggc atttgccgtt caaggccgtg cggtgtcttt
  201 accaaatgcc caaccattcg cccacggaat ccatccaatc cttattgccc
  251 ccgccgctcc tgcctgcccg gcggtacgcc cacggcgctt gcggattttt
  301 agctttccac aatcctttgc gttcccttc cgcctgaatt tgagcgtcgg
  351 catagtcggc aaaatccgcc ttatcctgct gttctttagc ataacttta
  401 taatgccacg ccgccccgtc ctgcacctgc atcaggttca aatcggtttt
  451 gccggcggat acctgcgcca cttcgcgctg atagcggtcg gtttcaaaca
  501 cacgtacact gactttccta ccctccgccg ccgcgcgcag ttgtcgcgc
  551 gaacgtgtac cgtaagcctg tttcatctcc ggtgcgtcga tatacgccat
  601 ccgaatttta tgtttcgcgc cgtcgccgtc gatgacgtga agggtatcgc
  651 cgtcatagac tttggacacc gtgcctgtgt agctgtggcc ggatttcgcc
  701 gatgcccgtc ggcgaacggg cgcgtcgaaa cccacgtccc tgcagtgcc
  751 gagtacgtcg agtacggcaa ccgccgtccg caccgcctca ctgtcatatc
  801 ccgtataacc caacgcgccc aaaagcgaca gggcgacggg aagccatttc
  851 atgatttttt taatctgcat atttttcaaa tgccgatgcc gtctgaacat
  901 ctctga
```

This corresponds to the amino acid sequence <SEQ ID 840; ORF 231.ng>:

```
g231.pep
    1 MSKRKSINRP YQKPAELPPL QNNPPFYRKN RRLNFFIAAD GGCASPQKCR

51 ARGFQTAFAV QGRAVSLPNA QPFAHGIHPI LIAPAAPACP AVRPRRLRIF

101 SFPQSFAFPF RLNLSVGIVG KIRLILLFFS ITFIMPRRPV LHLHQVQIGF

151 AGGYLRHFAL IAVGFKHTYT DFPTLRRRAQ VVARTCTVSL FHLRCVDIRH

201 PNFMFRAVAV DDVKGIAVID FGHRACVAVA GFRRCPSANG RVETHVPCSA

251 EYVEYGNRRP HRLTVISRIT QRAQKRQGDG KPFHDFFNLH IFQMPMPSEH

301 L*
```

The following partial DNA sequence was identified in *N. meningitidis* <SEQ ID 841>:

```
m231.seq (partial)
    1 ATGTCAAAAC GAAAATCCAT AAACCGTCCG TATCAAAAAC CGGCGGAACT

51 GCCGCCGTTG CAAAATAATC CGCCATTTTA CCGTAAAAAC CGCCGCCTGA

101 ACTTTTTTAT CGCGGCAGAC GGCGGTTGCG CGTCTCCGCA AAAATGCAGG

151 GCGCGCGGTT TTCAGACGGC ATTTGCCGTT CAAAGCCGTG CGGTGTCTTT

201 ACCAAATGCC CAACCATTCG GC.....
```

This corresponds to the amino acid sequence <SEQ ID 842; ORF 231>:

```
m231.pep (partial)
    1 MSKRKSINRP YQKPAELPPL QNNPPFYRKN RRLNFFIAAD GGCASPQKCR

51 ARGFQTAFAV QSRAVSLPNA QPFG.....
```

Computer analysis of this amino acid sequence gave the following results:
Homology with a Predicted ORF from *N. gonorrhoeae*
ORF 231 shows 98.6% identity over a 73 aa overlap with a predicted ORF (ORF 231.ng) from *N. gonorrhoeae*:

```
m231/g231

10         20         30         40         50         60
    m231.pep  MSKRKSINRPYQKPAELPPLQNNPPFYRKNRRLNFFIAADGGCASPQKCRARGFQTAFAV
              ||||||||||||||||||||||||||||||||||||||||||||||||||||||||||||
        g231  MSKRKSINRPYQKPAELPPLQNNPPFYRKNRRLNFFIAADGGCASPQKCRARGFQTAFAV
                     10         20         30         40         50         60
                      70
    m231.pep  QSRAVSLPNAQPFG
              |:||||||||||||:
        g231  QGRAVSLPNAQPFAHGIHPILIAPAAPACPAVRPRRLRIFSFPQSFAFPFRLNLSVGIVG
                     70         80         90        100        110        120
```

The following partial DNA sequence was identified in *N. meningitidis* <SEQ ID 843>:

```
a231.seq(partial)
    1 ATGTCAAAAC GAAAATCCAT AAACCGTCCG TATCAAAAAC CGGCGGAACT

51 GCCGCCGTTG CAAAATAATC CGCCATTTTA CCGTAAAAAC CGCCGCCTGA

101 ACTTTTTTAT CGNGGCAGAC GGCGGTTGCG CGTCTCCGCA AAAATGCAGG

151 GCGCGCGGTT TTCAGACGGC ATTTGCCGTT CAAAGCCGTG CGGTGTCTTT

201 ACCAAATGCC CAACCATTCG CCCACGGCAT CCATCCAATC CTTATTGCCC

251 CCGCCGCTCC TGCCTGCCCG GCGGTACGCC CACGGCGCTT GCGGATTTTT

301 AGCTTTCCAC AATCCTTTGC GTTCCCTTTC CGCCTGAATT TGAGCGTCGG

351 CATAATCGGC AAAATCCGCC TTATCCTGCT GTTCTTTAGC ATAACTTTTA

401 TAATGCCACG CCGCCCCGTC CTGCACCTGC ATCAGGTTCA AATCGGTTTT

451 GCCGACAGAA ACCTGCGCCA CTTCGCGCTG GTAGCGGTCG GTGTCGAACA

501 CGCGGACGCT GACTTTCCTG CCTTCCGCCG CCGCGCGCAG GTTGTCGCGC

551 GAACGCGTGC CGTAAGCCTG TTTCATCTCC GGCGCGTCGA TATACGCCAT

601 CCGGATTTTG TGTTTCGCGC CGTCGCCGTC GATAACGTGA AGGGTGTCGC

651 CGTCATAGAC TTTGGACACC GTGCCTGTGT AGCGGTGGCC GGATTTCGCC
```

-continued

```
701 GATGCTCGGC GGCGGGCGGG CGCGTCGGAA CCCGCGTCCC CTGCCGCGCC

751 GAGTACGTCG AGTACGGCAA CCGCCGTCCG CACCGCCTCG CTGCCGTACC

801 CCGTATAACC CAACGCACCC AAAAGCGACA AGGCGACGGG AAGCCATTTC

851 ATGATTTTTT TAATCTGCAT ATTTTTCAAA TGCCGATGCC GTCTGAACAT

901 ATC
```

This corresponds to the amino acid sequence <SEQ ID 844; ORF 217.a>:

```
a231.pep(partial)
  1 MSKRKSINRP YQKPAELPPL QNNPPFYRKN RRLNFFIXAD GGCASPQKCR

51 ARGFQTAFAV QSRAVSLPNA QPFAHGIHPI LIAPAAPACP AVRPRRLRIF

101 SFPQSFAFPF RLNLSVGIIG KIRLILLFFS ITFIMPRRPV LHLHQVQIGF

151 ADRNLRHFAL VAVGVEHADA DFPAFRRRAQ VVARTRAVSL FHLRRVDIRH

201 PDFVFRAVAV DNVKGVAVID FGHRACVAVA GFRRCSAAGG RVGTRVPCRA

251 EYVEYGNRRP HRLAAVPRIT QRTQKRQGDG KPFHDFFNLH IFQMPMPSEH

301 I
``` m231/a231 98.6% identity in 73 aa overlap

```
                   10         20         30         40         50         60
   m231.pep MSKRKSINRPYQKPAELPPLQNNPPFYRKNRRLNFFIAADGGCASPQKCRARGFQTAFAV
            |||||||||||||||||||||||||||||||||||||| |||||||||||||||||||||
   a231     MSKRKSINRPYQKPAELPPLQNNPPFYRKNRRLNFFIXADGGCASPQKCRARGFQTAFAV
                   10         20         30         40         50         60

70
   m231.pep QSRAVSLPNAQPFG
            ||||||||||||||:
   a231     QSRAVSLPNAQPFAHGIHPILIAPAAPACPAVRPRRLRIFSFPQSFAFPFRLNLSVGIIG
                   70         80         90        100        110        120
```

The following partial DNA sequence was identified in *N. gonorrhoeae* <SEQ ID 845>:

```
g231-1.seq
  1 ATGTCAAAAC GAAAATCCAT AAACCGTCCG TATCAAAAAC CGGCGGAACT

51 GCCGCCGTTG CAAAATAATC CGCCATTTTA CCGTAAAAAC CGCCGcCTGA

101 ACTTTTTTAT CGCGGCAGAC GGCGGTTGCG CGTCTCCGCA AAAATGCAGG

151 GCGCGCGGTT TTCAGACGGC ATTTGCCGTT CAAGGCCGTG CGGTGTCTTT

201 ACCAAATGCC CAACCATTCG CCCACGGAAT CCATCCAATC CTTATTGCCC

251 CCGCCGCTCC TGCCTGCCCG GCGGTACGCC CACGGCGCTT GCGGATTTTT

301 AGCTTTCCAC AATCCTTTGC GTTCCCTTTC CGCCTGAATT TGAGCGTCGG

351 CATAGTCGGC AAAATCCGCC TTATCCTGCT GTTCTTTAGC ATAACTTTTA

401 TAATGCCACG CCGCCCCGTC CTGCACCTGC ATCAGGTTCA AATCGGTTTT

451 GCCGGCGGAT ACCTGCGCCA CTTCGCGCTG ATAGCGGTCG GTTTCAAACa

501 CaCgTaCaat gagtttcgtA ccctccGCCG ccgcgcgCAG GTTGtcgcGC

551 GAACgTGTAC CGTAagcgtg TTtcatctcc GGTGCgtcGA TATACGCCaT 601 cCgAATTTta tGTttcgcgc cgtcgcCgtc gATGACGTGA AGGGtatcGC 651 CgtcATAGAC TTTGGACACC Gtgcctgcgt AGctGTGGCC GGATttcgc
```

This corresponds to the amino acid sequence <SEQ ID 846; ORF 231-1.ng>:

```
g231-1.pep
    1 MSKRKSINRP YQKPAELPPL QNNPPFYRKN RRLNFFIAAD GGCASPQKCR

51 ARGFQTAFAV QGRAVSLPNA QPFAHGIHPI LIAPAAPACP AVRPRRLRIF

101 SFPQSFAFPF RLNLSVGIVG KIRLILLFFS ITFIMPRRPV LHLHQVQIGF

151 AGGYLRHFAL IAVGFKHTYN EFRTLRRRAQ VVARTCTVSV FHLRCVDIRH

201 PNFMFRAVAV DDVKGIAVID FGHRACVAVA GFR
```

The following partial DNA sequence was identified in *N. meningitidis* <SEQ ID 847>:

```
m231-1.seq
    1 ATGTCAAAAC GAAAATCCAT AAACCGTCCG TATCAAAAAC CGGCGGAACT

51 GCCGCCGTTG CAAAATAATC CGCCATTTTA CCGTAAAAAC CGCCGCCTGA

101 ACTTTTTTAT CGCGGCAGAC GGCGGTTGCG CGTCTCCGCA AAAATGCAGG

151 GCGCGCGGTT TTCAGACGGC ATTTGCCGTT CAAAGCCGTG CGGTGTCTTT

201 ACCAAATGCC CAACCATTCG CCCACGGCAT CCATCCAATC CTTATTGCCC

251 CCGCCGCTCC TGCCTGCTCG GCGGTACGCC CACGGCGCTT GCGGATTTTT

301 AGCTTTCCAC AATCCTTTGC GTTCCCTTTC CGCCTGAATT TGAGCGTCGG

351 CATAATCGGC AAAATCCGCC TTATCCTGCT GTTCTTTAGC ATAACTTTTA

401 TAATGCCACG CCGCCCCGTC CTGCACCTGC ATCAGGTTCA AATCGGTTTT

451 GCCGACAGAA ACCTGCGCCA CTTCGCGCTG GTAGCGGTCG GTATCGAACA

501 CGCGCACGCT GACTTTCCTG CCTTCCGCCG CCGCGCGCAG GTTGTCGCGC

551 GAACGCGTGC CGTAAGCCTG TTTCATCTCC GGCGCGTCGA TATACGCCAT

601 CCGGATTTTG TGTTTCGCGC CGTCGCCGTC GATAACGTGA AGGGTGTCGC

651 CGTCATAGAC TTTGGACACC GTGCCTGTGT AGCGGTGGCC GGATTTCGCC

701 GATGCTCGGC GGCGGGCGGG CGCGTCGGAA CCCGCGTCCC CTGCCGCGCC

751 GAGTACGTCG AGTACGGCAA CCGCCGTCCG CACCGCCTCG CTGCCGTACC

801 CCGTATAACC CAACGCACCC AAAAGCGACA GGGCGACGGG AAGCCATTTC

851 ATGATTTTTT TAATCTGCAT ATTTTTCAAA TGCCGATGCC GTCTGAACAT

901 ATCGGAATCG GATTTCAGAC GGCATCTTAA
```

This corresponds to the amino acid sequence <SEQ ID 848; ORF 231-1>:

```
m231-1.pep
    1 MSKRKSINRP YQKPAELPPL QNNPPFYRKN RRLNFFIAAD GGCASPQKCR

51 ARGFQTAFAV QSRAVSLPNA QPFAHGIHPI LIAPAAPACS AVRPRRLRIF

101 SFPQSFAFPF RLNLSVGIIG KIRLILLFFS ITFIMPRRPV LHLHQVQIGF

151 ADRNLRHFAL VAVGIEHAHA DFPAFRRRAQ VVARTRAVSL FHLRRVDIRH

201 PDFVFRAVAV DNVKGVAVID FGHRACVAVA GFRRCSAAGG RVGTRVPCRA

251 EYVEYGNRRP HRLAAVPRIT QRTQKRQGDG KPFHDFFNLH IFQMPMPSEH

301 IGIGFQTAS* g231-1/m231-1 87.0% identity in 262 aa overlap
```

-continued

```
                    10        20        30        40        50        60
g231-1.pep  MSKRKSINRPYQKPAELPPLQNNPPFYRKNRRLNFFIAADGGCASPQKCRARGFQTAFAV
            ||||||||||||||||||||||||||||||||||||||||||||||||||||||||||||
m231-1      MSKRKSINRPYQKPAELPPLQNNPPFYRKNRRLNFFIAADGGCASPQKCRARGFQTAFAV
                    10        20        30        40        50        60

70        80        90       100       110       120
g231-1.pep  QGRAVSLPNAQPFAHGIHPILIAPAAPACPAVRPRRLRIFSFPQSFAFPFRLNLSVGIVG
            |:||||||||||||||||||||||||||| ||||||||||||||||||||||||||||:|
m231-1      QSRAVSLPNAQPFAHGIHPILIAPAAPACSAVRPRRLRIFSFPQSFAFPFRLNLSVGIIG
                    70        80        90       100       110       120

130       140       150       160       170       180
g231-1.pep  KIRLILLFFSITFIMPRRPVLHLHQVQIGFAGGYLRHFALIAVGFKHTYNEFRTLRRRAQ
            |||||||||||||||||||||||||||||||   ||||||:|||::|:: :| ::|||||
m231-1      KIRLILLFFSITFIMPRRPVLHLHQVQIGFADRNLRHFALVAVGIEHAHADFPAFRRRAQ
                   130       140       150       160       170       180

190       200       210       220       230       240
g231-1.pep  VVARTCTVSVFHLRCVDIRHPNFMFRAVAVDDVKGIAVIDFGHRACVAVAGFRXCPSANG
            ||||| :||:|||| ||||||:|:|||||||:|||:||||||||||||||||| | :|:|
m231-1      VVARTRAVSLFHLRRVDIRHPDFVFRAVAVDNVKGVAVIDFGHRACVAVAGFRRCSAANG
                   190       200       210       220       230       240

250       260
g231-1.pep  CVETHVPCSAEYVVXGNRRPHR
             | |:||| ||||  |||||||
m231-1      RVGTRVPCRAEYVEYGNRRPHRLAAVPRITQRTQKRQGDGKPFHDFFNLHIFQMPMPSEH
                   250       260       270       280       290       300
```

The following partial DNA sequence was identified in *N. meningitidis* <SEQ ID 849>:

```
a231-1.seq
     1 ATGTCAAAAC GAAAATCCAT AAACCGTCCG TATCAAAAAC CGGCGGAACT

51 GCCGCCGTTG CAAAATAATC CGCCATTTTA CCGTAAAAAC CGCCGCCTGA

101 ACTTTTTTAT GCGGCAGACG GCGGTTGCGC GTCTCCGCA AAAATGCAGG

151 GCGCGCGGTT TTCAGACGGC ATTTGCCGTT CAAAGCCGTG CGGTGTCTTT

201 ACCAAATGCC CAACCATTCG CCCACGGCAT CCATCCAATC CTTATTGCCC

251 CCGCCGCTCC TGCCTGCCCG GCGGTACGCC CACGGCGCTT GCGGATTTTT

301 AGCTTTCCAC AATCCTTTGC GTTCCCTTTC CGCCTGAATT TGAGCGTCGG

351 CATAATCGGC AAAATCCGCC TTATCCTGCT GTTCTTTAGC ATAACTTTTA

401 TAATGCCACG CCGCCCCGTC CTGCACCTGC ATCAGGTTCA AATCGGTTTT

451 GCCGACAGAA ACCTGCGCCA CTTCGCGCTG GTAGCGGTCG GTGTCGAACA

501 CGCGGACGCT GACTTTCCTG CCTTCCGCCG CCGCGCGCAG GTTGTCGCGC

551 GAACGCGTGC CGTAAGCCTG TTTCATCTCC GGCGCGTCGA TATACGCCAT

601 CCGGATTTTG TGTTTCGCGC CGTCGCCGTC GATAACGTGA AGGGTGTCGC

651 CGTCATAGAC TTTGGACACC GTGCCTGTGT AGCGGTGGCC GGATTTCGCC

701 GATGCTCGGC GGCGGGCGGG CGCGTCGGAA CCCGCGTCCC CTGCCGCGCC

751 GAGTACGTCG AGTACGGCAA CCGCCGTCCG CACCGCCTCG CTGCCGTACC

801 CCGTATAACC CAACGCACCC AAAAGCGACA AGGCGACGGG AAGCCATTTC

851 ATGATTTTTT TAATCTGCAT ATTTTTCAAA TGCCGATGCC GTCTGAACAT

901 ATCGGAATCG GATTTCAGAC GGCATCTTAA
```

This corresponds to the amino acid sequence <SEQ ID 850; ORF 231-1.a>:

```
a231-1.pep

1  MSKRKSINRP YQKPAELPPL QNNPPFYRKN RRLNFFIAAD GGCASPQKCR
```

```
 51 ARGFQTAFAV QSRAVSLPNA QPFAHGIHPI LIAPAAPACS AVRPRRLRIF

101 SFPQSFAPPF RLNLSVGIIF KIRLILLFFS ITFIMPRRPV LHLHQVQIFG

151 ADRNLRHFAL VAVGIEHAHA DFPAFRRRAQ VVARTRAVSL FHLRRVDIRH

201 PDFVFRAVAV DNVKGVAVID FGHRACVAVA GFRRCSAAGG RVGTRVPCRA

251 EYVEYGNRRP HRLAAVPRIT QRTQKRQGDG KPFHDFFNLH IFQMPMPSEH

301 IGIGFQTAS* a231-1/m231-1  99.0% identity in 309 aa overlap 10         20         30         40         50         60
a231-1.pep  MSKRKSINRPYQKPAELPPLQNNPPFYRKNRRLNFFIAADGGCASPQKCRARGFQTAFAV
            ||||||||||||||||||||||||||||||||||||||||||||||||||||||||||||
m231-1      MSKRKSINRPYQKPAELPPLQNNPPFYRKNRRLNFFIAADGGCASPQKCRARGFQTAFAV
                    10         20         30         40         50         60

70         80         90        100        110        120
a231-1.pep  QSRAVSLPNAQPFAHGIHPILIAPAAPACPAVRPRRRLRIFSFPQSFAPPFRLNLSVIIG
            |||||||||||||||||||||||||||||||| |||||||||||||||||||||||||||
m231-1      QSRAVSLPNAQPFAHGIHPILIAPAAPACSAVRPRRRLRIFSFPQSFAPPFRLNLSVIIG
                    70         80         90        100        110        120

130        140        150        160        170        180
a231-1.pep  KIRLILLFFSITFIMPRRPVLHLHQVQIGFADRNLRHFALVAVGVEHADADFPAFRRRAQ
            |||||||||||||||||||||||||||||||||||||||||||||||:|||||||||||||
m231-1      KIRLILLFFSITFIMPRRPVLHLHQVQIGFADRNLRHFALVAVGIEHAHADFPAFRRRAQ
                   130        140        150        160        170        180

190        200        210        220        230        240
a231-1.pep  VVARTRAVSLFHLRRVDIRHPDFVFRAVAVDNVKGVAVIDFGHRACVAVAGFRRCSAAGG
            ||||||||||||||||||||||||||||||||||||||||||||||||||||||||||||
m231-1      VVARTRAVSLFHLRRVDIRHPDFVFRAVAVDNVKGVAVIDFGHRACVAVAGFRRCSAAGG
                   190        200        210        220        230        240

250        260        270        280        290        300
a231-1.pep  RVGTRVPCRAEYVEYGNRRPHRLAAVPRITQRTQKRQGDGKPFHDFFNLHIFQMPMPSEH
            ||||||||||||||||||||||||||||||||||||||||||||||||||||||||||||
m231-1      RVGTRVPCRAEYVEYGNRRPHRLAAVPRITQRTQKRQGDGKPFHDFFNLHIFQMPMPSEH
                   250        260        270        280        290        300

310
a231-1.pep  IGIGFQTASX
            ||||||||||
m231-1      IGIGFQTASX
                   310
```

The following partial DNA sequence was identified in *N. gonorrhoeae* <SEQ ID 851>:

```
g232.seq
   1 atgatgggca acagcctgat tgaatccggt acgtttgtcg ccatcctgtt 51 tggtcagatt ttgggaacgg cggttgccgg cgcgccgcct tatattgtcg 101 ggatactggt tttgctggtc gccgtcggag gaacggccgg cagcctgttt 151 atgccgtccg tacccgccaa ggctgccgat acccaaatcg agtggaatat 201 tgtccgtggt acaaaatccc tgctgcgtga acggtgcgg cacaatcccg 251 ttttttaccgc cattatcggc atctcgtggt tttggtttgt cggcgcggtt 301 tataccacgc aactgccgac ctttacccaa atccatttgg gcggcaacga 351 taatgttttt aacctgatgc ttgctttgtt ttccatcggt attgccgccg 401 gttcggtact gtgtgccaag ttcggcaggg aacggctgat gttggcttgg 451 gtaacggttg gtgcgttggg ttcgacggtt tgcggcctgg ttttggtgtg 501 gctgacgcac ggacaccgtt tgaagggct gaacggcatt ttttggtttt 551 tatcgcaagg atgggcatac cccgtgatgg cggtgatgac gctgatcggc 601 ttttcggcg gattttctc cgttccgctc tatacctggc tgcaaaccgc 651 cagcagcgag actttccgcg cccgcgccgt tgccgccaac aatatcgtta 701 acggcatctt tatggtttcc gccgccgttt tgagcgcggt attgctgttt
```

-continued

```
751 ttgtttgaca gcatttccct gctgtatctg attgtcgcct tgggcaatat 801 tccgttggcg gtatttttga ttaagcgcga aaggcggttt ttaggcgcgg 851 cggcaatcag gaaaaaacct tga
```

This corresponds to the amino acid sequence <SEQ ID 852; ORF 232.ng>:

```
g232.pep
  1 MMGNSLIESG TFVAILFGQI LGTAVAGAPP YIVGILVLLV AVGGTAGSLF

51 MPSVPAKAAD TQIEWNIVRG TKSLLRETVR HNPVFTAIIG ISWFWFVGAV

101 YTTQLPTFTQ IHLGGNDNVF NLMLALFSIG IAAGSVLCAK FGRERLMLAW

151 VTVGALGSTV CGLVLVWLTH GHRFEGLNGI FWFLSQGWAY PVMAVMTLIG

201 FFGGFFSVPL YTWLQTASSE TFRARAVAAN NIVNGIFMVS AAVLSAVLLF

251 LFDSISLLYL IVALGNIPLA VFLIKRERRF LGAAAIRKKP *
```

The following partial DNA sequence was identified in *N. meningitidis* <SEQ ID 853>:

```
  1 ATGATGGGCA ACAGCCTGAT TGAATCGGGT ACGTTTGTCG CCATCCTGTT

51 CGGTCAGATT TTGGGAACGG CGGTGGCAGG TGTACCGCCT TATATTGTCG

101 GGATACTGGT TTTGCTGGTC GCCGTCGGAG GCACGGTCGG CAGCCTGTTT

151 ATGCCGTCCG TACCCGCCAA GGCTGCCGAT ACACAAATTG AGTGGAATAT

201 TGTCCGTGGC ACAAAATCCC TGCTGCGTGA AACGGTGCGG CACAAGCCCG

251 TTTTTACCGC CATTATCGGT ATTTCGTGGT TTTGGTTTGT CGGCGCGGTT

301 TATACCACGC AACTGCCGAC CTTTACCCAA ATCCATCTGG GCGGCAACGA

351 CAATGTTTTC AACCTGATGC TTGCTCTGTT TTCCATCGGT ATTGCCGCCG

401 GTTCGGTACT GTGTGCCAAG TTCAGCAkGG AACGCCTGAT GTTGGCTTGG

451 GTAACGGTTG GTGCGTTGGG TTTGACGGTT TGCGGCTTGG TTTTGGTGTG

501 GCTGACGCAC GGACACCGTT TGAAGGGCT GAACGGCATT TTTTrGTTTT

551 TATCGCAAGG ATGGGCATAT CCCGTGATGG CGGTGATGAC GCTGATCGGC

601 TTTTTCGGCG GATTTTTCTC CGTTCCGCTC TATACCt(g)TG CAAACCGCCa

651 TAGCGAGaTT TCCGCGCCCg GCCGTTGCCG CCAACAATAT CGTTAACGGT

701 ATTTTTATGG TTTCCGCTGC CGTTTTGAGC GCGGTGTTGC TGTTTTTGTT

751 TGACAGCATT TCCTTGTTGT ATCTGATTGT CGCTTTGGGC AATATTCCGT

801 TGTCGGTATT TTTGATTAAG CGCGAAAGGC GGTTTTTAGG CGCGGCGGCA

851 ATCAGGAAAA AACCTTGA
```

This corresponds to the amino acid sequence <SEQ ID 854; ORF 232>:

```
m232.pep
  1 MMGNSLIESG TFVAILFGQI LGTAVAGVPP YIVGILVLLV AVGGTVGSLF

51 MPSVPAKAAD TQIEWNIVRG TKSLLRETVR HKPVFTAIIG ISWFWFVGAV

101 YTTQLPTFTQ IHLGGNDNVF NLMLALFSIG IAAGSVLCAK FSXERLMLAW

151 VTVGALGLTV CGLVLVWLTH GHRFEGLNGI FXFLSQGWAY PVMAVMTLIG
```

-continued
```
201 FFGGFFSVPL YTVQTAIARF PRPAVAANNI VNGIFMVSAA VLSAVLLFLF

251 DSISLLYLIV ALGNIPLSVF LIKRERRFLG AAAIRKKP*
```

Computer analysis of this amino acid sequence gave the following results:
Homology with a Predicted ORF from *N. gonorrhoeae*
ORF 232 shows 94.1% identity over a 290 aa overlap with a predicted ORF (ORF 232.ng) from *N. gonorrhoeae*:

```
m232/g232

10        20        30        40        50        60
    m232.pep  MMGNSLIESGTFVAILFGQILGTAVAGVPPYIVGILVLLVAVGGTVGSLFMPSVPAKAAD
              ||||||||||||||||||||||||||:||||||||||||||||:||||||||||||||||
    g232      MMGNSLIESGTFVAILFGQILGTAVAGAPPYIVGILVLLVAVGGTAGSLFMPSVPAKAAD
                  10        20        30        40        50        60

70        80        90       100       110       120
    m232.pep  TQIEWNIVRGTKSLLRETVRHKPVFTAIIGISWFWFVGAVYTTQLPTFTQIHLGGNDNVF
              ||||||||||||||||||||||||:|||||||||||||||||||||||||||||||||||
    g232      TQIEWNIVRGTKSLLRETVRHNPVFTAIIGISWFWFVGAVYTTQLPTFTQIHLGGNDNVF
                  70        80        90       100       110       120

130       140       150       160       170       180
    m232.pep  NLMLALFSIGIAAGSVLCAKFSXERLMLAWVTVGALGLTVCGLVLVWLTHGHRFEGLNGI
              ||||||||||||||||||||||:|||||||||||| ||||||||||||||||||||||||
    g232      NLMLALFSIGIAAGSVLCAKFGRERLMLAWVTVGALGSTVCGLVLVWLTHGHRFEGLNGI
                 130       140       150       160       170       180

190       200       210       220       230
    m232.pep  FXFLSQGWAYPVMAVMTLIGFFGGFFSVPLYT-VQTAIARFPRP-AVAANNIVNGIFMVS
              | ||||||||||||||||||||||||||||||:|||  ::  |  ||||||||||||||
    g232      FWFLSQGWAYPVMAVMTLIGFFGGFFSVPLYTWLQTASSETFRARAVAANNIVNGIFMVS
                 190       200       210       220       230       240

240       200       210       220       230
    m232.pep  AAVLSAVLLFLFDSISLLYLIVALGNIPLSVFLIKRERRFLGAAAIRKKPX
              ||||||||||||||||||||||||:||||||||||||||||||||||||||
    g232      AAVLSAVLLFLFDSISLLYLIVALGNIPLAVFLIKRERRFLGAAAIRKKP
                 250       260       280       280       290
```

The following partial DNA sequence was identified in *N. meningitidis* <SEQ ID 855>:

```
a232.seq
  1 ATGTACGCTA AAAAAGGCGG TTTGGGACTG GTTAAAAGCC GCCGTTTCGC

51 ACCTCTTTTC GCTACGCAGT TTCTCGGCGC GTTCAACGAC AATGTGTTCA

101 AAACCGCGCT GTTTGTGATG ATTGGGTTTT ACGGTTTGGG GCAAAACGGC

151 TTCCTGCCTG CCGGACAGAT GTTGAACTTG GCGCGTTGC TGTTTATTTT

201 GCCGTATTTC CTGTTTTCCT CGCTGTCGGG GCAGTTGGGT AACAAATTCG

251 ACAAGGCCGT TTTGGCGCGT TGGGCCAAGG TGCTGGAAAT GATCATTATG

301 GCGGTGGCGG CATACGGGTT TTATATCCGG TCTGCCCCGC TGCTTTTGGC

351 GTGTCTGTTT TGCATGGGCG CGCAATCGAC GCTGTTCGGG CCGCTGAAAT

401 ACGCCATCCT GCCCGATTAT CTCGACGACA AAGAGTTGAT GATGGGCAAC

451 AGCCTGATTG AATCGGGTAC GTTTGTCGCC ATCCTGTTCG GTCAGATACT

501 GGGGACTGCG GTGGCAGGTG TACCGCCTTA TATTGTCGGG ATACTGGTTT

551 TGCTGGTCGC CGTAGGAGGC ACGGTCGGCA GCCTGTTTAT GCCGTCCGTA

601 CCCGCCAAGG CTGCCGATAC ACAAATTGAG TGGAATATTG TCCGGGGTAC

651 AAAATCCCTG CTGCGTGAAA CGGTGCGGCA CAAGCCCGTT TTTACCGCCA

701 TTATCGGTAT TTCGTGGTTT TGGTTTGTCG GCGCGGTTTA TACCACGCAA

751 CTGCCGACCT TTACCCAAAT CCATCTAGGC GGCAACGACA ATGTTTTCAA
```

```
-continued
 801 CCTGATGCTT GCCCTGTTTT CCATCGGTAT TGCCGCCGGT TCGGTACTGT

851 GTGCCAAGTT CAGCAGGGAA CGGCTGAGGT TGGCTTGGGT AACGGTTGGT

901 GCGTTGGGTT TGACGGTTTG CGGCTTGGTT TTGGTGTGGC TGACGCACGG

951 ACACCGTTTT GAAGGGCTGA ACGGCATTTT TTGGTTTTTA TCGCAAGGAT

1001 GGGCATATCC CGTGATGGCG GTGATGACGC TGATCGGCTT TTTCGGCGGA

1051 TTTTTCTCCG TTCCGCTCTA TACCTGGCTG CAAACCGCCA GTAGCGAGAC

1101 TTTCCGCGCC CGCGCCGTTG CCGCCAACAA TATCGTTAAC GGTATTTTA

1151 TGGTTTCCGC TGCCGTTTTG AGCGCGGTGT TGCTGTTTTT GTTTGACAGC

1201 ATTTCCTTGT TGTATCTGAT TGTCGCTTTG GGCAATATTC CGTTGTCGGT

1251 ATTTTTGATT AAGCGCGAAA GGCGGTTTTT AGGCGCGGCG GCAATCAGGA

1301 AAAAACCTTG A
```

This corresponds to the amino acid sequence <SEQ ID 856; ORF 232.a>:

```
a232.pep
   1 MYAKKGGLGL VKSRRFAPLF ATQFLGAFND NVFKTALFVM IGFYGLGQNG

51 FLPAGQMLNL GALLFILPYF LFSSLSGQLG NKFDKAVLAR WAKVLEMIIM

101 AVAAYGFYIR SAPLLLACLF CMGAQSTLFG PLKYAILPDY LDDKELMMGN

151 SLIESGTFVA ILFGQILGTA VAGVPPYIVG ILVLLVAVGG TVGSLFMPSV

201 PAKAADTQIE WNIVRGTKSL LRETVRHKPV FTAIIGISWF WFVGAVYTTQ

251 LPTFTQIHLG GNDNVFNLML ALFSIGIAAG SVLCAKFSRE RLRLAWVTVG

301 ALGLTVCGLV LVWLTHGHRF EGLNGIFWFL SQGWAYPVMA VMTLIGFFGG

351 FFSVPLYTWL QTASSETFRA RAVAANNIVN GIFMVSAAVL SAVLLFLFDS

401 ISLLYLIVAL GNIPLSVFLI KRERRFLGAA AIRKKP*
                                            40
``` m232/a232 95.9% identity in 290 aa overlap

```
                                  10        20        30
 m232.pep                           MMGNSLIESGTFVAILFGQILGTAVAGVPP
                                    ||||||||||||||||||||||||||||||
 a232      ACLFCMGAQSTLFGPLKYAILPDYLDDKELMMGNSLIESGTFVAILFGQILGTAVAGVPP
               120       130       140       150       160       170

40        50        60        70        80        90
 m232.pep  YIVGILVLLVAVGGTVGSLFMPSVPAKAADTQIEWNIVRGTKSLLRETVRHKPVFTAIIG
           ||||||||||||||||||||||||||||||||||||||||||||||||||||||||||||
 a232      YIVGILVLLVAVGGTVGSLFMPSVPAKAADTQIEWNIVRGTKSLLRETVRHKPVFTAIIG
               180       190       200       210       220       230

100       110       120       130       140       150
 m232.pep  ISWFWFVGAVYTTQLPTFTQIHLGGNDNVFNLMLALFSIGIAAGSVLCAKFSXERLMLAW
           |||||||||||||||||||||||||||||||||||||||||||||||||||||   |||
 a232      ISWFWFVGAVYTTQLPTFTQIHLGGNDNVFNLMLALFSIGIAAGSVLCAKFSRERLRLAW
               240       250       260       270       280       290

160       170       180       190       200       210
 m232.pep  VTVGALGLTVCGLVLVWLTHGHRFEGLNGIFXGLSQGWAYPVMAVMTLIGFFGGFFSVPL
           ||||||||||||||||||||||||||||||| |||||||||||||||||||||||||||
 a232      VTVGALGLTVCGLVLVWLTHGHRFEGLNGIFWGLSQGWAYPVMAVMTLIGFFGGFFSVPL
               300       310       320       330       340       350

220       230       240       250       260
 m232.pep  YY-VQTAIARFPRP-AVAANNIVNGIFMVSAAVLSAVLLFLFDSISLLYLIVALGNIPLS
           || :|||  ::   | ||||||||||||||||||||||||||||||||||||||||||||
 a232      YTWLQTASSETFRARAVAANNIVNGIFMVSAAVLSAVLLFLFDSISLLYLIVALGNIPLS
               360       370       380       390       400       410
```

```
            270        280       289
m232.pep VFLIKRERRFLGAAAIRKKPX
         |||||||||||||||||||||
    a232 VFLIKRERRFLGAAAIRKKPX
            420        430
```

The following partial DNA sequence was identified in *N. gonorrhoeae* <SEQ ID 857>:

```
g233.seq
    1 atgaaacgca aaaatatcgc gctgattccc gccgccggca tcggggtgcg 51 tttcggtgcg gacaaaccca agcaatatgt cgaaatcgga agcaaaaccg 101 ttttagaaca tgtacttggg attttgaac ggcatgaggc cgtcgatttg 151 accgtcgttg tcgtctcgcc cgaagacacg tttgccgata aggttcagac 201 ggcatttcca caggttcggg tgtggaaaaa cggtggacag acccgcgccg 251 aaactgtccg caacggtgtg gcaaaactgt tggaaaccgg tttggcggcg 301 gaaaccgaca atattctggt acacgatgcc gcccgctgct gcctgccgtc 351 tgaagctctg gcgcggttga tagaacaggc gggcaacgcc gccgaaggcg 401 ggattttggc agttcccgtt gccgatacgc tcaagcgcgc agaaagcgga 451 caaatcagtg caactgtcga ccgttcgggg ctttggcagg cgcaaacgcc 501 gcagcttttt caagcgggtt tgctgcaccg cgcattggct gcggaaaact 551 tgggcggcat taccgatgaa gcgtccgccg tggaaaaact gggtgtgcgt 601 ccgctactga tacagggcga cgcgcgcaat ttgaaactga cgcagccgca 651 ggacgcatac atcgtcaggc tgctgctcaa tgccgtctga
```

This corresponds to the amino acid sequence <SEQ ID 858; ORF 233.ng>:

```
g233.pep
    1 MKRKNIALIP AAGIGVRFGA DKPKQYVEIG SKTVLEHVLG IFERHEAVDL

51 TVVVVSPEDT FADKVQTAFP QVRVWKNGGQ TRAETVRNGV AKLLETGLAA

101 ETDNILVHDA ARCCLPSEAL ARLIEQAGNA AEGGILAVPV ADTLKRAESG

151 QISATVDRSG LWQAQTPQLF QAGLLHRALA AENLGGITDE ASAVEKLGVR

201 PLLIQGDARN LKLTQPQDAY IVRLLLNAV*
```

The following partial DNA sequence was identified in *N. meningitidis* <SEQ ID 859>:

```
m233.seq (partial)
    1 ATGAAGCGCA AAAATATCGC GCTGATTCCC GCCGCCGGCA TCGGGGCGCG

51 TTTCGGTGCG GACAAACCCA AGCAATATGT CGAAATCGGA AGCAAAACCG

101 TTTTAGAACA TACGATTGGG ATTTTTGAAC GGCATGAGGC CGTCGATTTG

151 ACCGTCGTTG TCGTCTCGCC CGAAGACACG TTTGCCGATA AGGTTCAGAC

201 GGCATTTCCA CAGGTTCGGG TGTGGAAAAA CGGCGGACAG ACCCGCGCCG

251 AAACCGTCCG CAACGGTGTG GCAAAACTGT TGGAAACCGG TTTGGCGGCG

301 GAAACCGACA ATATTCTGGT ACACGATGCC GCGCGTTGCT GCCTGCCGTC

351 TGAAGCTTTG ACGCGGTTGA TAGAACAGGC GGGCAACGCC GCCGAAGGCG
```

```
401 GGATTTTGGC AATTCCCATT GCCGATACGC TCAAGTGCGC GGACGGTGGG

451 AACATT....
```

This corresponds to the amino acid sequence <SEQ ID 860; ORF 233>:

```
m233.pep (partial)
  1 MKRKNIALIP AAGIGARFGA DKPKQYVEIG SKTVLEHTIG IFERHEAVDL

51 TVVVVSPEDT FADKVQTAFP QVRVWKNGGQ TRAETVRNGV AKLLETGLAA

101 ETDNILVHDA ARCCLPSEAL TRLIEQAGNA AEGGILAIPI ADTLKCADGG

151 NI....
```

Computer analysis of this amino acid sequence gave the following results:

Homology with a Predicted ORF from *N. gonorrhoeae*

ORF 233 shows 93.4% identity over a 152 aa overlap with a predicted ORF (ORF 233.ng) from *N. gonorrhoeae*:

```
   m233/g233
                     10         20         30         40         50         60
      m233.pep  MKRKNIALIPAAGIGARFGADKPKQYVEIGSKTVLEHTIGIFERHEAVDLTVVVVSPEDT
                ||||||||||||:||||||||||||||||||||||||::|||||||||||||||||||||
          g233  MKRKNIALIPAAGIGVRFGADKPKQYVEIGSKTVLEHVLGIFERHEAVDLTVVVVSPEDT
                     10         20         30         40         50         60

70         80         90        100        110        120
      m233.pep  FADKVQTAFPQVRVWKNGGQTRAETVRNGVAKLLETGLAAETDNILVHDAARCCLPSEAL
                ||||||||||||||||||||||||||||||||||||||||||||||||||||||||||||
          g233  FADKVQTAFPQVRVWKNGGQTRAETVRNGVAKLLETGLAAETDNILVHDAARCCLPSEAL
                     70         80         90        100        110        120

130        140        150
      m233.pep  TRLIEQAGNAAEGGILAIPIADTLKCADGGNI
                :|||||||||||||||:|:|||||  |::|:|
          g233  ARLIEQAGNAAEGGILAVPVADTLKRAESGQISATVDRSGLWQAQTPQLFQAGLLHRALA
                    130        140        150        160        170        180
```

The following partial DNA sequence was identified in *N. meningitidis* <SEQ ID 861>:

```
a233.seq
  1 ATGAAGCGCA AAAATATCGC GCTGATTCCC GCCGCCGGCA TCGGGGCGCG

51 TTTCGGTGCG GACAAACCCA AGCAATATGT CGAAATCGGA AGCAAAACCG

101 TTTTAGAACA TACGATTGGG ATTTTTGAAC GGCATGAGGC CGTCGATTTG

151 ACCGTCGTTG TCGTCTCGCC CGAAGACACG TTTGCCGATA AGGTTCAGAC

201 GGCATTTCCA CAGGTTCGGG TGTGGAAAAA CGGCGGACAG ACCCGCGCCG

251 AAACTGTCCG CAACGGTGTG GCAAAATTGT TGGAAACCGG TTTGGCGGCG

301 GAAACCGACA ATATTCTGGT ACACGATGCC GCGCGTTGCT GCCTGCCGTC

351 TGAAGCTTTG ACGCGGTTGA TAGAACAGGC GGGCAACGCT GCCGAAGGTG

401 GGATTTTGGC AATTCCCGTT GCCGATACGC TCAAGTGCGC GGACGGTGGG

451 AACATTAGTG CAACCGTCGA GCGGACGAGC CTTTGGCAGG CGCAAACGCC

501 GCAGCTTTTC CGCGCCGGGC TGCTGCACCG CGCATTGGCT GCGGAAAACT

551 TGGACGGCAT TACCGATGAA GCGTCCGCCG TGGAAAAATT GGGCATCCGC

601 CCTTTGCTGG TGCAGGGCGA CGCGCGCAAT TTGAAACTGA CGCAGCCGCA

651 GGACGCATAC ATCGTCAGGC TGCTGCTCGA TGCCGTCTGA
```

This corresponds to the amino acid sequence <SEQ ID 862; ORF 233.a>:

```
a233.pep
    1 MKRKNIALIP AAGIGARFGA DKPKQYVEIG SKTVLEHTIG IFERHEAVDL

51 TVVVVSPEDT FADKVQTAFP QVRVWKNGGQ TRAETVRNGV AKLLETGLAA

101 ETDNILVHDA ARCCLPSEAL TRLIEQAGNA AEGGILAIPV ADTLKCADGG

151 NISATVERTS LWQAQTPQLF RAGLLHRALA AENLDGITDE ASAVEKLGIR

201 PLLVQGDARN LKLTQPQDAY IVRLLLDAV*
``` m233/a233 99.3% identity in 152 aa overlap

```
                  10         20         30         40         50         60
    m233.pep MKRKNIALIPAAGIGARFGADKPKQYVEIGSKTVLEHTIGIFERHEAVDLTVVVVSPEDT
            ||||||||||||||||||||||||||||||||||||||||||||||||||||||||||||
        a233 MKRKNIALIPAAGIGARFGADKPKQYVEIGSKTVLEHTIGIFERHEAVDLTVVVVSPEDT
                  10         20         30         40         50         60
                  70         80         90        100        110        120
    m233.pep FADKVQTAFPQVRVWKNGGQTRAETVRNGVAKLLETGLAAETDNILVHDAARCCLPSEAL
            ||||||||||||||||||||||||||||||||||||||||||||||||||||||||||||
        a233 FADKVQTAFPQVRVWKNGGQTRAETVRNGVAKLLETGLAAETDNILVHDAARCCLPSEAL
                  70         80         90        100        110        120
                 130        140        150
    m233.pep TRLIEQAGNAAEGGILAIPIADTLKCADGGNI
            ||||||||||||||||||:|||||||||||||
        a233 TRLIEQAGNAAEGGILAIPVADTLKCADGGNISATVERTSLWQAQTPQLGRAGLLHRALA
                 130        140        150        160        170        180
        a233 AENLDGITDEASAVEKLGIRPLLVQGDARNLKLTQPQDAYIVRLLLDAVX
                 190        200        210        220        230
```

The following partial DNA sequence was identified in *N. gonorrhoeae* <SEQ ID 863>:

```
g234.seq
    1 atgaaaaccg tttccgccgc catcgctttt gccgccgctg ccgtttcact 51 gaccggctgt gcgaccgagt cctcacgcag cctcgaggtt gcaaaagtcg 101 cctcctgcaa tacgcaatat cacggtgttc gcaccccgat ttccgtcgga 151 acattcgaca accgctccag cttccaaaaa ggcattttct ccgacagtga 201 agaccgtctg ggcagccagg caaaaaccat cctggtaaca cacctgcaac 251 aaaccaaccg cttcaacgta ctgaaccgca ccaaccttag cgcattgaaa 301 caggaatccg gcatttccgg caaagcgcag aacctgaaag gcgcagatta 351 tgtcgttacc ggcgatgtaa ccgaattcgg acgcagagat gtcggcgatc 401 atcagctctt cggcattttg ggtcgcggca atcgcaaat cgcctatgca 451 aaagtggctc tgaatatcgt caacgtcaat acttccgaaa tcgtctattc 501 cacacagggc gcgggcgaat acgcactttc caaccgcgaa atcatcggtt 551 tcggcggcac ttccggctac gatgcgactt tgaacggcaa agttttagac 601 ttggcaatcc gcgaagccgt cgacaacttg gttcaggctg tcgacaacgg 651 cgcatggcaa tccaaccgtt aa
```

This corresponds to the amino acid sequence <SEQ ID 864; ORF 234.ng>:

```
g234.pep
    1 MKTVSAAIAF AAAAVSLTGC ATESSRSLEV AKVASCNTQY HGVRTPISVG
```

-continued
```
 51  TFDNRSSFQK GIFSDSEDRL GSQAKTILVT HLQQTNRFNV LNRTNLSALK

101  QESGISGKAQ NLKGADYVVT GDVTEFGRRD VGDHQLFGIL GRGKSQIAYA

151  KVALNIVNVN TSEIVYSTQG AGEYALSNRE IIGFGGTSGY DATLNGKVLD

201  LAIREAVDNL VQAVDNGAWQ SNR*
```

The following partial DNA sequence was identified in *N. meningitidis* <SEQ ID 865>:

```
m234.seq (partial)
  1...GGCGCGGGCG AATACGCACT TTCCAACCGt GAAATCATCG GTTTCGGCGG

51    CACTTCCGGC TACGATGCGA CTTTGAACGG CAAAGTTTTA GACTTGGCAA

101    TCCGCGAAGC .gTCAACAGC CTGGTTCAGG CTGTTGACAA CGGCGCATGG

151    CAACCCAACC GTTAA
```

This corresponds to the amino acid sequence <SEQ ID 866; ORF 234>:

```
m234.pep (partial)
  1..GAGEYALSNR EIIGFGGTSG YDATLNGKVL DLAIREAVNS LVQAVDNGAW

51   QPNR*
```

Computer analysis of this amino acid sequence gave the following results:

Homology with a Predicted ORF from *N. gonorrhoeae*

ORF 234 shows 94.4% identity over a 54 aa overlap with a predicted ORF (ORF 234.ng) from *N. gonorrhoeae*:

```
    m234/g234
                                                 10         20         30
       m234.pep                              GAGEYALSNREIIGFGGTSGYDATLNGKVL
                                             ||||||||||||||||||||||||||||||
       g234         LGRGKSQIAYAKVALNIVNVNTSEIVYSTQGAGEYALSNREIIGFGGTSGYDATLNGKVL
                    140       150       160       170       180       190
                            40        50
       m234.pep    DLAIREAVNSLVQAVDNGAWQPNRX
                   ||||||||::|||||||||||| |||
       g234        DLAIREAVDNLVQAVDNGAWQSNRX
                   200       210       220
```

The following partial DNA sequence was identified in *N. meningitidis* <SEQ ID 867>:

```
a234.seq (partial)
   1  AACCGCACCT ATTTGAACGC ATTAAAACAG GAATCCGGCA TTTCCGGCAA

51  AGCGCATAAC CTGAAAGGCG CAAATTATGT CGNNACCGGC GATGTAACCG

101  AATTCGGACG CANAGATGTC GGCGATCATC AGCTCTTCGG CATTTTGGGT

151  CGCGGCAAAT CGCAAATCGC CTATGCAAAA GTGGCTCTGA ATATCGTCAA

201  CGTCAATACT TCCGAAATCG TCTATTCCGC ACAGGGCGCG GGCGAATACG

251  CACTTTCCAA CCGTGAAATC ATCGGTTTCG GCGGCACTTC CGGCTACGAT

301  GCGACTTTGA ACGGCAAAGT TTTAGACTTG GCAATCCGCG AAGCCGTCAA

351  CAGCCTGGTT CAGGCTGTTG ACAACGGCGC ATGGCAACCC AACCGTTAA
```

This corresponds to the amino acid sequence <SEQ ID 868; ORF 234.a>:

```
a234.pep (partial)
    1  NRTYLNALKQ ESGISGKAHN LKGANYVXTG DVTEFGRXDV GDHQLFGILG

51  RGKSQIAYAK VALNIVNVNT SEIVYSAQGA GEYALSNREI IGFGGTSGYD

101  ATLNGKVLDL AIREAVNSLV QAVDNGAWQP NR*
``` m234/a234 100.0% identity in 54 aa overlap

```
                                           10         20        30
    m234.pep                       GAGEYALSNREIIGFGGTSGYDATLNGKVL
                                   ||||||||||||||||||||||||||||||
    a234        LGRGKSQIAYAKVALNIVNVNTSEIVYSAQGAGEYALSNREIIGFGGTSGYDATLNGKVL
                  50        60        70        80        90       100
                   40         50
    m234.pep    DLAIREAVNSLVQAVDNGAWQPNRX
                |||||||||||||||||||||||||
    a234        DLAIREAVNSLVQAVDNGAWQPNRX
                  110       120       130
```

The following partial DNA sequence was identified in *N. gonorrhoeae* <SEQ ID 869>:

```
g235.seq
    1  atgaaacctt tgattttagg gcttgccgcc gtgttggctc tgtctgcctg 51  ccaagttcga aaagctcccg acctcgacta cacgtcattc aaagaaagca 101  aaccggcttc aattttggtg gttccgccgc tgaacgagtc gcctgatgtc 151  aacggcactt gggggatgct ggcttcgacc gccgcgccga tttccgaagc 201  cggctattac gtctttcccg ccgcagtcgt ggaggaaacc ttcaaagaaa 251  acggcttgac caatgccgcc gatattcacg ccgtccggcc ggaaaaactg 301  catcaaattt tcggcaatga tgcggttttg tacattacgg ttaccgaata 351  cggcacttca tatcaaattt tagacagcgt gacgaccgta tccgccaaag 401  cacggctggt cgattccgc aacgggaaag agttgtggtc gggttcggcc 451  agcatccgcg aaggcagcaa caacagcaac agcggcctgt tggggctttt 501  ggtcggcgca gtggtcaatc agattgccaa cagcctgacc gaccgcggtt 551  atcaggtttc caaaaccgcc gcatacaacc tactgtcgcc ctattcccgc 601  aacggtatct tgaaaggtcc gagattcgtc gaagagcagc ccaaataa
```

This corresponds to the amino acid sequence <SEQ ID 870; ORF 235.ng>:

```
g235.pep
    1  MKPLILGLAA VLALSACQVR KAPDLDYTSF KESKPASILV VPPLNESPDV

51  NGTWGMLAST AAPISEAGYY VFPAAVVEET FKENGLTNAA DIHAVRPEKL

101  HQIFGNDAVL YITVTEYGTS YQILDSVTTV SAKARLVDSR NGKELWSGSA

151  SIREGSNNSN SGLLGALVGA VVNQIANSLT DRGYQVSKTA AYNLLSPYSR

201  NGILKGPRFV EEQPK*
```

The following partial DNA sequence was identified in *N. meningitidis* <SEQ ID 871>:

```
m235.seq
   1 ATGAAACCTT TGATTTTAGG GCTTGCCGCC GTGTTGGCGC TGTCTGCCTG

51 CCAAGTTCAA AAAGCGCCCG ATTTCGACTA CACGTCATTC AAGGAAAGCA

101 AACCGGCTTC AATTTTGGTG GTTCCGCCGC TGAACGAATC GCCCGATGTC

151 AACGGAACAT GGGGTGTACT GGCTTCGACC GCCGCGCCGC TTTCCGAAGC

201 CGGCTATTAC GTCTTCCCCG CCGCAGTCGT GGAGGAAACC TTCAAACAAA

251 ACGGCTTGAC CAATGCCGCC GATATTCACG CCGTCCGGCC GGAAAAACTG

301 CATCAGATTT TCGGCAATGA TGCGGTTTTG TACATTACGG TTACCGAATA

351 CGGCACTTCA TATCAAATTT TAGACAGCGT GACGACCGTA TCCGCCAAAG

401 CACGGCTGGT CGATTCCCGC AACGGAAAAG AGTTGTGGTC GGGTTCGGCC

451 AGCATCCGCG AAGGCAGCAA CAACAGCAAC AGCGGCCTGT TGGGGGCTTT

501 GGTCAGCGCA GTGGTCAATC AGATTGCCAA CAGCCTGACC GACCGCGGTT

551 ATCAGGTTTC CAAAACCGCC GCATACAACC TGCTGTCGCC CTATTCTCAC

601 AACGGCATCT TGAAAGGTCC GAGATTCGTT GAAGAGCAGC CCAAATAA
```

This corresponds to the amino acid sequence <SEQ ID 872; ORF 235>:

```
m235.pep
   1 MKPLILGLAA VLALSACQVQ KAPDFDYTSF KESKPASILV VPPLNESPDV

51 NGTWGVLAST AAPLSEAGYY VFPAAVVEET FKQNGLTNAA DIHAVRPEKL

101 HQIFGNDAVL YITVTEYGTS YQILDSVTTV SAKARLVDSR NGKELWSGSA

151 SIREGSNNSN SGLLGALVSA VVNQIANSLT DRGYQVSKTA AYNLLSPYSH

201 NGILKGPRFV EEQPK*
```

Computer analysis of this amino acid sequence gave the following results:

Homology with a Predicted ORF from *N. gonorrhoeae*

ORF 235 shows 96.7% identity over a 215 aa overlap with a predicted ORF (ORF 235.ng) from *N. gonorrhoeae*:

```
m235/g235

10        20        30        40        50        60
m235.pep    MKPLILGLAAVLALSACQVQKAPDFDYTSFKESKPASILVVPPLNESPDVNGTWGVLAST
            ||||||||||||||||||:|||||:||||||||||||||||||||||||||||||:||||
g235        MKPLILGLAAVLALSACQVRKAPDLDYTSFKESKPASILVVPPLNESPDVNGTWGMLAST 70        80        90       100       110       120
m235.pep    AAPLSEAGYYVFPAAVVEETFKQNGLTNAADIHAVRPEKLHQIFGNDAVLYITVTEYGTS
            |||:||||||||||||||||||:|||||||||||||||||||||||||||||||||||||
g235        AAPISEAGYYVFPAAVVEETFKENGLTNAADIHAVRPEKLHQIFGNDAVLYITVTEYGTS
                    70        80        90       100       110       120

130       140       150       160       170       180
m235.pep    YQILDSVTTVSAKARLVDSRNGKELWSGSASIREGSNNSNSGLLGALVSAVVNQIANSLT
            ||||||||||||||||||||:|||||||||||||||||||||||||||:|||||||||||
g235        YQILDSVTTVSAKARLVDSRNGKELWSGSASIREGSNNSNSGLLGALVGAVVNQIANSLT
                   130       140       150       160       170       180

190       200       210
m235.pep    DRGYQVSKTAAYNLLSPYSHNGILKGPRFVEEQPKX
            ||||||||||||||||||:||||||||||||||||
g235        DRGYQVSKTAAYNLLSPYSRNGILKGPRFVEEQPKX
                   190       200       210
```

The following partial DNA sequence was identified in *N. meningitidis* <SEQ ID 873>:

```
a235.seq
   1 ATGAAACCTT TGATTTTAGG GCTTGCCGCC GTGTTGGCGC TGTCTGCCTG

51 CCAAGTTCAA AAAGCGCCCG ATTTCGACTA CACGTCATTC AAGGAAAGCA

101 AACCGGCTTC AATTTTGGTG GTTCCGCCGC TGAACGAATC GCCCGATGTC

151 AACGGAACAT GGGGTGTACT GGCTTCGACC GCCGCGCCGC TTTCCGAAGC

201 CGGCTATTAC GTCTTCCCCG CCGCAGTCGT GGAGGAAACC TTCAAACAAA

251 ACGGCTTGAC CAATGCCGCC GATATTCACG CCGTCCGGCC GGAAAAACTG

301 CATCAGATTT TCGGCAATGA TGCGGTTTTG TACATTACGG TTACCGAATA

351 CGGCACTTCA TATCAAATTT TAGACAGCGT GACGACCGTA TCCGCCAAAG

401 CACGGCTGGT CGATTCCCGC AACGGAAAAG AGTTGTGGTC GGGTTCGGCC

451 AGCATCCGCG AAGGCAGCAA CAACAGCAAC AGCGGCCTGT TGGGGGCTTT

501 GGTCAGCGCA GTGGTCAATC AGATTGCCAA CAGCCTGACC GACCGCGGTT

551 ATCAGGTTTC TAAAACCGCC GCATACAACC TGCTGTCGCC CTATTCTCAC

601 AACGGCATCT TGAAAGGTCC GAGATTCGTC GAAGAGCAGC CCAAATAA
```

This corresponds to the amino acid sequence <SEQ ID 874; ORF 235.a>:

```
a235.pep.
   1 MKPLILGLAA VLALSACQVQ KAPDFDYTSF KESKPASILV VPPLNESPDV

51 NGTWGVLAST AAPLSEAGYY VFPAAVVEET FKQNGLTNAA DIHAVRPEKL

101 HQIFGNDAVL YITVTEYGTS YQILDSVTTV SAKARLVDSR NGKELWSGSA

151 SIREGSNNSN SGLLGALVSA VVNQIANSLT DRGYQVSKTA AYNLLSPYSH

201 NGILKGPRFV EEQPK*
``` m235/a235 100.0% identity in 215 aa overlap

```
                    10        20        30        40        50        60
m235.pep    MKPLILGLAAVLALSACQVQKAPDFDYTSFKESKPASILVVPPLNESPDVNGTWGVLAST
            ||||||||||||||||||||||||||||||||||||||||||||||||||||||||||||
a235        MKPLILGLAAVLALSACQVQKAPDFDYTSFKESKPASILVVPPLNESPDVNGTWGVLAST
                    10        20        30        40        50        60

70        80        90       100       110       120
m235.pep    AAPLSEAGYYVFPAAVVEETFKQNGLTNAADIHAVRPEKLHQIFGNDAVLYITVTEYGTS
            ||||||||||||||||||||||||||||||||||||||||||||||||||||||||||||
a235        AAPLSEAGYYVFPAAVVEETFKQNGLTNAADIHAVRPEKLHQIFGNDAVLYITVTEYGTS
                    70        80        90       100       110       120

130       140       150       160       170       180
m235.pep    YQILDSVTTVSAKARLVDSRNGKELWSGSASIREGSNNSNSGLLGALVSAVVNQIANSLT
            ||||||||||||||||||||||||||||||||||||||||||||||||||||||||||||
a235        YQILDSVTTVSAKARLVDSRNGKELWSGSASIREGSNNSNSGLLGALVSAVVNQIANSLT
                   130       140       150       160       170       180

190       200       210
m235.pep    DRGYQVSKTAAYNLLSPYSHNGILKGPRFVEEQPKX
            ||||||||||||||||||||||||||||||||||||
a235        DRGYQVSKTAAYNLLSPYSHNGILKGPRFVEEQPKX
                   190       200       210
```

The following partial DNA sequence was identified in *N. gonorrhoeae* <SEQ ID 875>:

```
g236.seq
  1  ATGGCGCGTT TCGCCTTCTC CGCCGACATT CTCCGCACAG CGTTTGCAGA
```

-continued

```
  51 CGGTTTCATA ACCTGCAACC GCGCCCACAT CGCGGGTGTA ATGCCAGCAG

101 CGTTCGCATT TTTCGCCGTC GCTGGCTTTG GCGGCAACGG CAAGTTCATC

151 ACCGACTTTC ACTTCTGCTT TAGACACCAG CAGGGCAAAG CGCAATTCTT

201 CGCCCAAAGC ATTCAGATAG CCGGCCATTT CTTCCGGCGC GGTAATTTCG

251 GCTTCCGCCT GCAAggacga accgacagTT TTGTcggcGC GCAAAGGCTC

301 GAtagcggcg gTTACTGCTT CGCGCGCTTC GCGGATTGCC GTCCATTTTT

351 TCACCAGTTC GGCTTCGGCT TTTTCGTTGA TGGCCGGGAA CTCGTGCCAA

401 GTATGGAAGA GGACGCTGTC TTCTTCGCCG CCGCCGATGA TGTCCCACGC

451 TTCTTCGCCG GTGAAGCACA AAATCGGTGC AATCAAGAGA ACCAGGCTGC

501 GCGTGATGTG GTACAGGGCG GTTTGCGCGC TGCGGCGGGC GCGGCTGTCG

551 GCTTTGGTGG TGTAGAGGCG GTCTTTCAGG ATGTCGAGGT AGAACGCGCC

601 CAAGTCTTCC GAGCAGAAAG AAACAATGTC TTTCACGGCG AAGTGGAAGG

651 CATAGCGCGG ATAGTAACCG CCTGCCAAAC GCTCTTGCAG CCGCCGCGCC

701 AATACCAAGG CGTAGCGGTC GATTTCCACC ATATCCGCCT GTTGCACGGC

751 ATCTTCAATC GGATTAAAGT CGCTCAAATT GGCAAAcagG AAGCTCAAGG

801 TATTGCGGAT GCGGCGGTAG CTTTCGGTAA CGCGTTTGAG GATTTCTTTG

851 GAAatcgCCA ATtcgccgct gTAATCGGTG GATGCCGCCC ACAGGCGCAG

901 GATGTCCGCG CCGAATTCGT TATAGACTTC CTGCGGCGCG ACGACGTTGC

951 CGATGGATTT CGACATTTTG CGGCCGTTTT GGTCAACCAC GAAACCGTGG

1001 GTCAGCAGCT GTTTATACGG TGCGCGTCCC ATGGATGA
```

This corresponds to the amino acid sequence <SEQ ID 876; ORF 236.ng>:

```
g236.pep
   1 MARFAFSADI LRTAFADGFI TCNRAHIAGV MPAAFAFFAV AGFGGNGKFI

51 TDFHFCFRHQ QGKAQFFAQS IQIAGHFFRR GNFGFRLQGR TDSFVGAQRL

101 DSGGYCFARF ADCRPFFHQF GFGFFVDGRE LVPSMEEDAV FFAAADDVPR

151 FFAGEAQNRC NQENQAARDV VQGGLRAAAG AAVGFGGVEA VFQDVEVERA

201 QVFRAERNNV FHGEVEGIAR IVTACQTLLQ PPRQYQGVAV DFHHIRLLHG

251 IFNRIKVAQI GKQEAQGIAD AAVAFGNAFE DFFGNRQFAA VIGGCRPQAQ

301 DVRAEFVIDF LRRDDVADGF RHFAAVLVNH ETVGQQLFIR CASHG*
```

The following partial DNA sequence was identified in N. meningitidis <SEQ ID 877>:

```
m236.seq (partial)
   1 ..TTGCACGGAC GAACCGACGG TTTTGTCGGC GCGCAAAGGC TCGATGGCGG

51    CGGTTACCGC TTCGCGGGCT TCGCGGATTG CCGTCCATTT TTTCACCAGT

101    TCGGCTTCGG TTTTTTCGTT GATGGTCGGG AACTCGTGCC AAGTATGGAA

151    GAGGACGCTG TCKTCTTCGC CGCCGCCGwT GAyGTCCCAC GCTTCTTCGC

201    CGGTGAAGCA CAAAATCGGT GCAATCAAGA GAACCAAACT GCGTGTGATG

251    TGATACAGGG CAGTTTGTGC GCTGCGGCGT GCATGGCTGT CTGCTTTGGT

301    GGTGTAGAGG CGGTCTTTCA GGATGTCGAG GTAGAACGCA CCCAAGTCTT
```

```
                        -continued
351     CCGAGCAGAA AGAAACArTG TCTTTTACGG CAAAGTGGaA kGCATAACGC

401     GGATAGTAAT CGCCTGCCAG ACACTCTTGC AGCTGACGTG CCAATACCAC

451     GGCGTAGCGG TCGATTTCCA CCATATCCGC CTGTTGCACG GCATCTTCAA

501     TCGGATTAAA GTCGCTCAAG TTGGCAAACA AAAAGCTCAA GGTATTGCGG

551     ATACGGCGGT AgCTTTCGGT TACGCGTTTG AGGATTTCTT TGGAAATCGC

601     CAATTCGCCG CTGTAATCGG TAGATGCCGC CCACAGGCGC AGGATGTCTG

651     CGCCGAATTC GTTATAAACC TCTTGCGGTG CAACGACGTT GCCGATGGAT

701     TTCGACATTT TTTTGCCTTC GCCGTCGACA ACGAAACCAT GGGTCAGCAG

751     CTGTTTATAC GGCGCGCGAC CCATTGA
```

This corresponds to the amino acid sequence <SEQ ID 878; ORF 236>:

```
m236.pep (partial)
   1   ..LHGRTDGFVG AQRLDGGGYR FAGFADCRPF FHQFGFGFFV DGRELVPSME

51   EDAVXFAAAX DVPRFFAGEA QNRCNQENQT ACDVIQGSLC AAACMAVCFG

101   GVEAVFQDVE VERTQVFRAE RNXVFYGKVE XITRIVIACQ TLLQLTCQYH

151   GVAVDFHHIR LLHGIFNRIK VAQVGKQKAQ GIADTAVAFG YAFEDFFGNR

201   QFAAVIGRCR PQAQDVCAEF VINLLRCNDV ADGFRHFFAF AVDNETMGQQ

251   LFIRRATH*
```

Computer analysis of this amino acid sequence gave the following results:

Homology with a Predicted ORF from *N. gonorrhoeae*

ORF 236 shows 82.9% identity over a 258 aa overlap with a predicted ORF (ORF 236.ng) from *N. gonorrhoeae*:

```
m236/g236

10         20         30
   m236.pep                                     LHGRTDGFVGAQRLDGGGYRFAGFADCRPF
                                                |:||||:|||||||||:||| || |||||||
   g236      FRHQQGKAQFFAQSIQIAGHFFRRGNFGFRLQGRTDSFVGAQRLDSGGYCFARFADCRPF
                    60        70        80        90       100       110

40        50        60        70        80        90
   m236.pep  FHQFGFGFFVDGRELVPSMEEDAVXFAAAXDVPRFFAGEAQNRCNQENQTACDVIQGSLC
             ||||||||||||||||||||||| |||| |||||||||||||||||||||||:| ||:|:|
   g236      FHQFGFGFFVDGRELVPSMEEDAVFFAAADDVPRFFAGEAQNRCNQENQAARDVVQGGLR
                   120       130       140       150       160       170

100       110       120       130       140       150
   m236.pep  AAACMAVCFGGVEAVFQDVEVERTQVFRAERNXVFYGKVEXITRIVIACQTLLQLTCQYH
             ||| || ||||||||||||||||:|||||||:||||: ||  |:|||:||||||||  ||:
   g236      AAAGAAVGFGGVEAVFQDVEVERAQVFRAERNNVFHGEVEGIARIVTACQTLLQPPRQYQ
                   180       190       200       210       220       230

160       170       180       190       200       210
   m236.pep  GVAVDFHHIRLLHGIFNRIKVAQVGKQKAQGIADTAVAFGYAFEDFFGNRQFAAVIGRCR
             ||||||||||||||||||||||||:|||||:||||||:||||||||||||||||||||||
   g236      GVAVDFHHIRLLHGIFNRIKVAQIGKQEAQGIADAAVAFGNAFEDFFGNRQFAAVIGGCR
                   240       250       260       270       280       290

220       230       240       250       259
   m236.pep  PQAQDVCAEFVINLLRCNDVADGFRHFFAFAVDNETMGQQLFIRRATHX
             |||||| ||||| ::||  :||||||||| |  |::||:||||||||| |:|
   g236      PQAQDVRAEFVIDFLRRDDVADGFRHFAAVLVNHETVGQQLFIRCASHG
                   300       310       320       330       340
```

The following partial DNA sequence was identified in *N. meningitidis* <SEQ ID 879>:

```
a236.seq
   1 ATGGCGCGTT TCGCCTTCTC CGCCGACATT CTCTGCACAG CGTTTGCAGA
  51 CGGTTTCATG GCCTGCAACC GCGCCCACAT CGCGGGTGTA GTGCCAGCAG
 101 CGTTCGCATT TTTCACCATC ACTGGCTTTA GCGGCAACGG CAAGTTCGCT
 151 GCCTACTTTC ACTTCTGCTT TAGACACCAG CAAAGCAAAG CGCAATTCTT
 201 CGCCCAAAGC ATTCAGATAG CCGGCCATTT CTTCCGGCGC GGTAATTTCG
 251 GCTTCGGCTT GCAAGGACGA ACCGACGGTT TTGTCGGCGC GCAAAGGCTC
 301 GATGGCGGCG GTTACCGCTT CGCGGGCTTC GCGGATTGCC GTCCATTTTT
 351 TCACCAGTTC GGCTTCGGCT TTTTCGTTGA TGGTCGGGAA CTCGTGCCAA
 401 GTATGGAAAA GCACGCTGTC TTCTGCGCCG CCGCCGATGA TGTCCCACGC
 451 TTCTTCGCCG GTGAAGCACA AAATCGGTGC AATCAAGAGA ACCAGGCTGC
 501 GCGTGATGTG GTACAGGGCG GTTTGCGCGC TGCGGCGGGC GCGGCTGTCG
 551 GCTTTGGTGG TATAGAGGCG GTCTTTCAGG ATATCGAGGT AGAACGCGCC
 601 CAAGTCTTCC GAGCAGAAAG AAACCATTTC TTTCACGGCA AAGTGGAAGG
 651 CATAACGCGG ATAAAAATCA CCGGCAACGC GTTCTTGCAG CCGCCTTGCC
 701 AACACCAAGG CATAGCGGTC GATTTCCACC ATATCCGCCT GTTGCACGGC
 751 ATCTTCAATA GGATTGAAGT CGCTCAAGTT GGCAAACAAA AAGCTCAAGG
 801 TATTGCGGAT ACGGCGGTAG CTTTCGGTTA CGCGCTTGAG GATTTCTTTG
 851 GAAATCGCCA ATTCGCCGCT GTAATCGGTG GATGCCGCCC ACAGGCGCAG
 901 GATGTCCGCG CCGAACTCGT TATACACTTC TTGCGGCGCG ACGACGTTGC
 951 CGATGGATTT CGACATTTTG CGCCCGTTTT GATCCACCAC GAAACCATGG
1001 GTCAGCAGCT GTTTGTACGG CGCGCGACCC ATTGA
```

This corresponds to the amino acid sequence <SEQ ID 880; ORF 236.a>:

```
a236.pep
   1 MARFAFSADI LCTAFADGFM ACNRAHIAGV VPAAFAFFTI TGFSGNGKFA
  51 AYFHFCFRHQ QSKAQFFAQS IQIAGHFFRR GNFGFGLQGR TDGFVGAQRL
 101 DGGGYRFAGF ADCRPFFHQF GFGFFVDGRE LVPSMEKHAV FCAAADDVPR
 151 FFAGEAQNRC NQENQAARDV VQGGLRAAAG AAVGFGGIEA VFQDIEVERA
 201 QVFRAERNHF FHGKVEGITR IKITGNAFLQ PPCQHQGIAV DFHHIRLLHG
 251 IFNRIEVAQV GKQKAQGIAD TAVAFGYALE DFFGNRQFAA VIGGCRPQAQ
 301 DVRAELVIHF LRRDDVADGF RHFAPVLIHH ETMGQQLFVR RATH*
``` m236/a236 81.0% identity in 258 aa overlap

```
                                                  10        20        30
m236.pep                                LHGRTDGFVGAQRLDGGGYRFAGFADCRPF
                                        |:||||||||||||||||||||||||||||
a236         FRHQQSKAQFFAQSIQIAGHFFRRGNFGFGLQGRTDGFVGAQRLDGGGYRFAGFADCRPF
              60        70        80        90       100       110

40        50        60        70        80        90
m236.pep     FHQFGFGFFVDGRELVPSMEEDAVXFAAAXDVPRFFAGEAQNRCNQENQTACDVIQGSLC
             ||||||||||||||||||||: ||  ||| |||||||||||||||||||:| ||:||:| 
a236         FHQFGFGFFVDGRELVPSMEKHAVFCAAADDVPRFFAGEAQNRCNQENQAARDVVQGGLR
             120       130       140       150       160       170
```

```
                   100        110        120        130        140        150
m236.pep  AAACMAVCFGGVEAVFQDVEVERTQVFRAERNXVFYGKVEXITRIVIACQTLLQLTCQYH
          |||  ||  |||:|||||:||||:||||||||| :||||  ||| | : :::||   ||::
a236      AAAGAAVGFGGIEAVFQDIEVERAQVFRAERNHFFHGKVEGITRIKITGNAFLQPPCQHQ
                   180        190        200        210        220        230

160        170        180        190        200        210
m236.pep  GVAVDFHHIRLLHGIFNRIKVAQVGKQKAQGIADTAVAFGYAFEDFFGNRQFAAVIGRCR
          |:||||||||||||||||||:||||||||||||||||||||||:|||||||||||| ||
a236      GIAVDFHHIRLLHGIFNRIEVAQVGKQKAQGIADTAVAFGYALEDFFGNRQFAAVIGGCR
                   240        250        260        270        280        290

220        230        240        250        259
m236.pep  PQAQDVCAEFVINLLRCNDVADGFRHFFAFAVDNETMGQQLFIRRATHX
          ||||||  ||:||::||  :||||||||     : :|||||||:||||||
a236      PQAQDVRAELVIHFLRRDDVADGFRHFAPVLIHHETMGQQLFVRRATHX
                   300        310        320        330        340
```

The following partial DNA sequence was identified in *N. gonorrhoeae* <SEQ ID 881>:

```
g237.seq
   1 atgcgggaca aggttggcgg taatatcgca ctccccgccc cacgaatatt
  51 cgattctaac atcggcaagc tgcggaaaaa ctttaagcat atcttggcgg
 101 acaagctcgg tcatacgcgc aggattgtcg ataaattcgt tatccttacc
 151 gccgaaaagc agcctgccgt ccgcgctgag gcggtaataa tccaaaatat
 201 ggcggttgtc gcatactgcc atattgttgc ggataagccc ttttgtgcgc
 251 gcgcccaagg gttcggtggc aataataaag gtgctgacgg caatcgcctt
 301 gcgttccaaa ggccggaata tcgggttcaa accgacataa gtattgacgg
 351 catagaccac atttttacac tcgacgctgc cttcgggcgt gtaaaccagc
 401 caaccgtttt gatacggttc gatgcgcgtc atcggggatt gctcgaaaat
 451 ctgcgcgccg gcttcggcag cggcgctggc aacacccaac gtgtaattga
 501 gcggatgaag atgcccggac aagggatcga actgtgcgcc ttggtacata
 551 tcgctgtcaa gctgctgttt caactcggct ttatcccaaa gttgataatg
 601 actcgcaccg taatgccgtt gggcgtgttc atgccactgc tgcaactctt
 651 cccaatgctg cggacggacg gcaaccgtgg cataaccgcg ctgccaatcg
 701 caatcgatgg catgtttgcg gacgcgttcg tccaccagtt cgaccgcctg
 751 caaagactgt tgccaaaacc attgcgcctg ctccaagccg acctgttttt
 801 caatttcccc cataccgcag gcgtagtcgc tgataacctg cccgccactc
 851 ctgccggacg cgccgaagcc gatacgtgcg gcttccaaaa cgacggcttc
 901 atgtccgtgt tccgccagcg gcaatgcggt acacaaaccg ctcaaaccgc
 951 cgccgataat gcaggtttcg gctttcagac ggcattggag tttcggataa
1001 acagtatgcg gattaaccga actaaaataa taagaaggca gatattcttg
1051 aaaatcaggg cgaatcattg tgtttgcttt atcgggtata ttttcggacg
1101 gaatgataca gactgtcggg ccatatcgtc caaacagaaa atcggttga
```

This corresponds to the amino acid sequence <SEQ ID 882; ORF 237.ng>:

```
g237.pep
   1 MRDKVGGNIA LPAPRIFDSN IGKLRKNFKH ILADKLGHTR RIVDKFVILT

51 AEKQPAVRAE AVIIQNMAVV AYCHIVADKP FCARAQGFGG NNKGADGNRL

101 AFQRPEYRVQ TDISIDGIDH IFTLDAAFGR VNQPTVLIRF DARHRGLLEN
```

-continued

```
151 LRAGFGSGAG NTQRVIERMK MPGQGIELCA LVHIAVKLLF QLGFIPKLIM

201 TRTVMPLGVF MPLLQLFPML RTDGNRGITA LPIAIDGMFA DAFVHQFDRL

251 QRLLPKPLRL LQADLFFNFP HTAGVVADNL PATPAGRAEA DTCGFQNDGF

301 MSVFRQRQCG TQTAQTAADN AGFGFQTALE FRINSMRINR TKIIRRQIFL

351 KIRANHCVCF IGYIFGRNDT DCRAISSKQK IG*
```

The following partial DNA sequence was identified in *N. meningitidis* <SEQ ID 883>:

```
m237.seq
   1 ATGCGGGACA AGGTTGGCGG TAATGTCGCA CTCCCCGCCC CACGAATATT
  51 CGATTTTGAC ATCGGCAAGC TGCGGAAAAA CTTTAAGCAT ATCTTGGCGG
 101 ACAAGCTCGG TCATaCGCTC AGGATTGTCG ATAAACTCGT TATCCTTACC
 151 GCCGAAAAGC AGTCTGCCGT CCGCGCTGAG GCGGTAATAA TCCAAAATAT
 201 GGCGGTTGTC GCATACTGCC ATATTGTTAC GGATAAGCCC TTTTGCGCGC
 251 GCCCCCAAGG GTTCGGTCGC AATAATAAAG GTGCTGACAG CAATCGCCTT
 301 GCGTTCCAAA GGCCGGAATA TCGGGTTCAA ACCTGCATAA GTATTGACAG
 351 CATAGACCAC ATTTTTGCAC TCGACGCTGC CTTCGGGCGT GTAAACCAGC
 401 CAACCGTTTT GATGCGGTTC GATGCACGTC ATCGGGGATT GCTCGAAAAT
 451 CTGCGCACCG GCTTCGGCAG CGGCACGAGC GATGCCCAAA GTGTAAGTGA
 501 GCGGATGCAG GTGTCCGGAT AAGGGGTCGA ATTGTGCCCC TTGGTACATA
 551 TCGCTGTCAA GCTGCTGTTT CAACTCGGCT TTATCCCAAA GTTGATAATG
 601 ACTCGCACCG TAATGCCGTT GGGCGTGTTC ATGCCACTGC TGCAACTCTT
 651 CCCAATGCTG CGGACGGACG GCAACCGTGG CATAACCGCG CTGCCAATCA
 701 CAATCGACGG CATGTTTGCG GACGCGTTCG TCCACCAGTT CGACCGCCTG
 751 CAAAGACTGT TGCCAAAACC ATTGCGCCTG CTCCAAGCCG ACCTGTTTTT
 801 CAATTTCCCC CATACCGCAG nCGTAATCGC TGATAACCTG CCCGCCACTC
 851 CGTCCCGACG CGCCGAAACC GATACGCGCG GCTTCCAACA CAACCGTTTC
 901 ATGTCCCTGC TCCGCCAAGG GCAATGCAGT GCACAAACCA CCCAATCCGC
 951 CGCCGATGAT ACAGGTATCG GTTTTCAGAC GGCATTGAAG TTtCGGATAA
1001 ACAGTATGAG GATTAACCGA ACTGAAATAA TAAGAAGGCA GATATTCTTG
1051 AAAATCAGGG CGAATCATTG TGTTTGCTTT ATCAGGTGTA TTTTCGGACG
1101 GAATGATACA GGCTGTCGGG CCATATCGTC CAwACAGAAA ATCGGTTGA
```

This corresponds to the amino acid sequence <SEQ ID 884; ORF 237>:

```
m237.pep
  1 MRDKVGGNVA LPAPRIFDFD IGKLRKNFKH ILADKLGHTL RIVDKLVILT
 51 AEKQSAVRAE AVIIQNMAVV AYCHIVTDKP FCARPQGFGR NNKGADSNRL
101 AFQRPEYRVQ TCISIDSIDH IFALDAAFGR VNQPTVLMRF DARHRGLLEN
151 LRTGFGSGTS DAQSVSERMQ VSGXGVELCP LVHIAVKLLF QLGFIPKLIM
201 TRTVMPLGVF MPLLOLFPML RTDGNRGITA LPITIDGMFA DAFVHQFDRL
251 QRLLPKPLRL LQADLFFNFP HTAXVIADNL PATPSRRAET DTRGFQHNRF
```

```
301 MSLLRQGQCS AQTTQSAADD TGIGFQTALK FRINSMRINR TEIIRRQIFL

351 KIRANHCVCF IRCIFGRNDT GCRAISSXQK IG*
```

Computer analysis of this amino acid sequence gave the following results:

Homology with a Predicted ORF from *N. gonorrhoeae*
ORF 237 shows 86.1% identity over a 382 aa overlap with a predicted ORF (ORF 237.ng) from *N. gonorrhoeae*:

```
m237/g237
                  10         20         30         40         50         60
m237.pep  MRDKVGGNVALPAPRIFDFDIGKLRKNFKHILADKLGHTLRIVDKLVILTAEKQSAVRAE
          |||||||:|||||||| :||||||||||||||||| |||||:|||||||  |||||
g237      MRDKVGGNIALPAPRIFDSNIGKLRKNFKHILADKLGHTRRIVDKFVILTAEKQPAVRAE
                  10         20         30         40         50         60

70         80         90        100        110        120
m237.pep  AVIIQNMAVVAYCHIVTDKPFCARPQGFGRNNKGADSNRLAFQRPEYRVQTCISIDSIDH
          |||||||||||||||||:||||||| |||| ||||||:|||||||||||||||||  :|||
g237      AVIIQNMAVVAYCHIVADKPFCARAQGFGGNNKGADGNRLAFQRPEYRVQTDISIDGIDH
                  70         80         90        100        110        120

130        140        150        160        170        180
m237.pep  IFALDAAFGRVNQPTVLMRFDARHRGLLENLRTGFGSGTSDAQSVSERMQVSGXGVELCP
          ||:|||||||||||||||:|||||||||||||:||||::::|  |  |||::  |  |:|||
g237      IFTLDAAFGRVNQPTVLIRFDARHRGLLENLRAGFGSGAGNTQRVIERMKMPGQGIELCA
                 130        140        150        160        170        180

190        200        210        220        230        240
m237.pep  LVHIAVKLLFQLGFIPKLIMTRTVMPLGVFMPLLQLFPMLRTDGNRGITALPITIDGMFA
          ||||||||||||||||||||||||||||||||||||||||||||||||||||:||||||
g237      LVHIAVKLLFQLGFIPKLIMTRTVMPLGVFMPLLQLFPMLRTDGNRGITALPIAIDGMFA
                 190        200        210        220        230        240

250        260        270        280        290        300
m237.pep  DAFVHQFDRLQRLLPKPLRLLQADLFFNFPHTAXVIADNLPATPSRRAETDTRGFQHNRF
          ||||||||||||||||||||||||||||||||| |:|||||: |||:|| |||::   |
g237      DAFVHQFDRLQRLLPKPLRLLQADLFFNFPHTAGVVADNLPATPAGRAEADTCGFQNDGF
                 250        260        270        280        290        300

310        320        330        340        350        360
m237.pep  MSLLRQGQCSAQTTQSAADDTGIGFQTALKFRINSMRINRTEIIRRQIFLKIRANHCVCF
          ||::||  ||::||:|:||| ||:|||||||||||:|||||||||||||||||||||||
g237      MSVFRQRQCGTQTAQTAADNAGFGFQTALEFRINSMRINRTKIIRRQIFLKIRANHCVCF
                 310        320        330        340        350        360

370        380
m237.pep  IRCIFGRNDTGCRAISSXQKIGX
          |  ||||||| ||||| |||||
g237      IGYIFGRNDTDCRAISSKQKIGX
                 370        380
```

The following partial DNA sequence was identified in *N. meningitidis* <SEQ ID 885>:

```
a237.seq
    1 ATGCGGGACA AGGTTGGCGG TAATGTCGCA CTCCCCGCCC CACGAATATT

51 CGATTTTGAC ATCGGCAAGC TGCGGAAAAA CTTTAAGCAT ATCTTGGCGG

101 ACAAGCTCGG TCATACGCGC GGGATTGTCG ATAAACTCGT TATCCTTACC

151 GCCGAAAAGC AGTCTGCCGT CCGCGCTGAG GCGGTAATAA TCCAAAATAT

201 GACGGTTGTC GCATACTGCC ATATTGTTGC GGATAAGCCC TTTTGCACGC

251 GCGCCCAAGG GTTCTGTGGC AATAATAAAG GTGCTGACAG CAATCGCCTT

301 GCGCTCCAAA GGCTTGAATA TCGGATTCAA ACCGGCATAA GTATTGACGG

351 CGTACACCAG ATTTTTGCAT TCGACGCTGC CTTCGGGGGT GTAAACCAGC

401 CAACCGTTTT GATAAGGTTC AATGCGTATC ATGGGAGAAT GCTCAAAAAT

451 CTTCGTACCA GCTTCGGCAG CGGCGCGGGC GATGCCCAAC GTGTAATTGA

501 GCGGATGGAG ATGCCCGGAC AAGGGATCGA ACTGTGCGCC TTGGTACATA
```

```
 551 TCGCTGTCAA GCTGCTGCTT CAGTTCAGTG TTATCCCAGA GTTGATAATG

601 AGTTGCACCG TAATATTTTT GGGCGTGCTC ATGCCATTGT TGCAATTCTT

651 CCCAATGCTG CGAACGGATG CAACCGTGG CATAACCGCG CTGCCAATCG

701 CAATCAATGG CATGTTTGCG GACGCGTTCG TCCACCAGTT CGACCGCCTG

751 CAAAGACTGT TGCCAAAACC ATTGCGCTTG CTCCAAACCG ACCTGTTTTT

801 CAATTTCCTC CATACCGCAG GCGTAATCGC TGATAACCTG CCCGCCACTC

851 CGTCCCGACG CGCCGAAACC GATACGCGCG GCTTCCAACA CAACCGTTTC

901 ATGTCCCTGC TCCGCCAAGG GCAATGCAGT GCACAAACCA CTCAATCCGC

951 CGCCGATGAT ACAGGTATCG GTTTTCAGAC GGCATTGAAG TTTCGGATAA

1001 ACAGTATGAG GATTAACCGA ACTGAAATAA TAAGAAGGCA GATATTCTTG

1051 AAAATCAGGG CGAATCATTG TGTTTGCTTT ATCGGGTATA TTTTCGGACG

1101 GAATGATACA GGCTGTCGAG CCATATCGTC CAAACAGAAA ATCGGTTGA
```

This corresponds to the amino acid sequence <SEQ ID 886; ORF 237.a>:

```
a237.pep
  1 MRDKVGGNVA LPAPRIFDFD IGKLRKNFKH ILADKLGHTR GIVDKLVILT

51 AEKQSAVRAE AVIIQNMTVV AYCHIVADKP FCTRAQGFCG NNKGADSNRL

101 ALQRLEYRIQ TGISIDGVHQ IFAFDAAFGG VNQPTVLIRF NAYHGRMLKN

151 LRTSFGSGAG DAQRVIERME MPGQGIELCA LVHIAVKLLL QFSVIPELIM

201 SCTVIFLGVL MPLLQFFPML RTDGNRGITA LPIAINGMFA DAFVHQFDRL

251 QRLLPKPLRL LQTDLFFNFL HTAGVIADNL PATPSRRAET DTRGFQHNRF

301 MSLLRQGQCS AQTTQSAADD TGIGFQTALK FRINSMRINR TEIIRRQIFL

351 KIRANHCVCF IGYIFGRNDT GCRAISSKQK IG*
``` m237/a237 85.6% identity in 382 aa overlap

```
                10         20         30         40         50         60
m237.pep MRDKVGGNVALPAPRIFDFDIGKLRKNFKHILADKLGHTLRIVDKLVILTAEKQSAVRAE
         ||||||||||||||||||||||||||||||||||||||||  |||||||||||||||||
a237     MRDKVGGNVALPAPRIFDFDIGKLRKNFKHILADKLGHTRGIVDKLVILTAEKQSAVRAE
                10         20         30         40         50         60

70         80         90        100        110        120
m237.pep AVIIQNMAVVAYCHIVTDKPFCARPQGFGRNNKGADSNRLAFQRPEYRVQTCISIDSIDH
         |||||||:|||||||||:|||||| :|||  ||||||||||  ||:||  ||||::  :
a237     AVIIQNMTVVAYCHIVADKPFCTRAQGFCGNNKGADSNRLALQRLEYRIQTGISIDGVHQ
                70         80         90        100        110        120

130        140        150        160        170        180
m237.pep IFALDAAFGRVNQPTVLMRFDARHRGLLENLRTGFGSGTSDAQSVSERMQVSGXGVELCP
         |||:|||||||||||||:|||:|:|  :|:||||||||  | |||::  |  |:|||
a237     IFAFDAAFGGVNQPTVLIRFNAYHGRMLKNLRTSFGSGAGDAQRVIERMEMPGQGIELCA
               130        140        150        160        170        180

190        200        210        220        230        240
m237.pep LVHIAVKLLFQLGFIPKLIMTRTVMPLGVFMPLLQLFPMLRTDGNRGITALPITIDGMFA
         ||||||||||:::  ||:||::  |||:  |||||||:||||||||||||||:|:||||
a237     LVHIAVKLLLQFSVIPELIMSCTVIFLGVLMPLLQFFPMLRTDGNRGITALPIAINGMFA
               190        200        210        220        230        240

250        260        270        280        290        300
m237.pep DAFVHQFDRLQRLLPKPLRLLQADLFFNFPHTAXVIADNLPATPSRRAETDTRGFQHNRF
         ||||||||||||||||||||| ::|||||  |||::||||||||||||||||| |||||
a237     DAFVHQFDRLQRLLPKPLRLLQTDLFFNFLHTACVIADNLPATPSRRAETDTRCFQHNRF
               250        260        270        280        290        300
```

```
                    310       320       330       340       350       360
m237.pep   MSLLRQGQCSAQTTQSAADDTGIGFQTALKFRINSMRINRTEIIRRQIFLKIRANHCVCF
           ||||||||||||||||||||||||||||||||||||||||||||||||||||||||||||
a237       MSLLRQGQCSAQTTQSAADDTGIGFQTALKFRINSMRINRTEIIRRQIFLKIRANHCVCF
                    310       320       330       340       350       360

370       380
m237.pep   IRCIFGRNDTGCRAISSXQKIGX
           |  |||||||||||||| |||||
a237       IGYIFGRNDTGCRAISSKQKIGX
                    370       380
```

The following partial DNA sequence was identified in *N. gonorrhoeae* <SEQ ID 887>:

```
g238.seq
    1 atgaatttgc ctattcaaaa attcatgatg ctgttggcag cggcaatatc 51 gatgctgcat atccccatta gtcatgcgaa cggtttggat gcccgtttgc 101 gcgatgatat gcaggcaaaa cactacgaac cgggtggcaa ataccatctg 151 tttggtaatg ctcgcggcag tgttaaaaat cgggtttgcg ccgtccaaac 201 atttgatgca actgcggtcg gccccatact gcctattaca cacgaacgga 251 caggatttga aggtgttatc ggctatgaaa cccattttc aggacacgga 301 cacgaagtac acagtccgtt cgataatcat gattcaaaaa gcacttctga 351 tttcagcggc ggcgtagacg gcggttttac cgtttaccaa cttcatcgga 401 cagggtcgga aatacatccc gcagacggat atgacgggcc tcaaggcggc 451 ggttatccgg aaccacaagg ggcaagggat atatacagct accatatcaa 501 aggaacttca accaaaacaa agataaacac tgttccgcaa gcccctttt 551 cagaccgctg gctaaaagaa aatgccggtg ccgcttccgg ttttctcagc 601 cgtgcgatg aagcaggaaa actgatatgg gaaaacgacc ccgataaaaa 651 ttggcgggct aaccgtatgg atgatattcg cggcatcgtc caaggtgcgg 701 ttaatccttt tttaacgggt tttcaagggg tagggattgg ggcaattaca 751 gacagtgcgg taagcccggt cacagataca gccgctcagc agactctaca 801 aggtattaat gatttaggaa atttaagtcc ggaagcacaa cttgccgccg 851 cgagcctatt acaggacagt gcctttgcgg taaaagacgg catcaattcc 901 gccagacaat gggctgatgc ccatccgaat ataacagcaa cagcccaaac 951 tgcccttgcc gtagcagagg ccgcaggtac ggtttggcgc ggtaaaaaag 1001 tagaacttaa cccgaccaaa tgggattggg ttaaaaatac cggctataaa 1051 aaacctgctg cccgccatat gcagactgta gatggggaga tggcagggggg 1101 gaatagaccg cctaaatcta taacgtcgga aggaaaagct aatgctgcaa 1151 cctatcctaa gttggttaat cagctaaatg agcaaaactt aaataacatt 1201 gcggctcaag atccaagatt gagtctagct attcatgagg gtaaaaaaaa 1251 ttttccaata ggaactgcaa cttatgaaga ggcagataga ctaggtaaaa 1301 tttgggttgg tgagggtgca agacaaacta gtggaggcgg atggttaagt 1351 agagatggca ctcgacaata tcggccacca acagaaaaaa aatcacaatt 1401 tgcaactaca ggtattcaag caaattttga aacttatact attgattcaa 1451 atgaaaaaag aaataaaatt aaaaatggac atttaaatat taggtaa
```

This corresponds to the amino acid sequence <SEQ ID 888; ORF 238.ng>:

```
g238.pep
  1  MNLPIQKFMM LLAAAISMLH IPISHANGLD ARLRDDMQAK HYEPGGKYHL

51  FGNARGSVKN RVCAVQTFDA TAVGPILPIT HERTGFEGVI GYETHFSGHG

101  HEVHSPFDNH DSKSTSDFSG GVDGGFTVYQ LHRTGSEIHP ADGYDGPQGG

151  GYPEPQGARD IYSYHIKGTS TKTKINTVPQ APFSDRWLKE NAGAASGFLS

201  RADEAGKLIW ENDPDKNWRA NRMDDIRGIV QGAVNPFLTG FQGVGIGAIT

251  DSAVSPVTDT AAQQTLQGIN DLGNLSPEAQ LAAASLLQDS AFAVKDGINS

301  ARQWADAHPN ITATAQTALA VAEAAGTVWR GKKVELNPTK WDWVKNTGYK

351  KPAARHMQTV DGEMAGGNRP PKSITSEGKA NAATYPKLVN QLNEQNLNNI

401  AAQDPRLSLA IHEGKKNFPI GTATYEEADR LGKIWVGEGA RQTSGGGWLS

451  RDGTRQYRPP TEKKSQFATT GIQANFETYT IDSNEKRNKI KNGHLNIR*
```

The following partial DNA sequence was identified in *N. meningitidis* <SEQ ID 889>:

```
m238.seq
   1 ATGAATTTGC CTATTCAAAA ATTCATGATG CTGTTTGCAG CAGCAATATC

51 GTTGCTGCAA ATCCCCATTA GTCATGCGAA CGGTTTGGAT GCCCGTTTGC

101 GCGATGATAT GCAGGCAAAA CAcTACGAAC CGGGTGGTAA ATACCATCTG

151 TTTGGTAATG CTCGCGGCAG TGTTAAAAAG CGGGTTTACG CCGTCCAGAC

201 ATTTGATGCA ACTGCGGTCA GTCCTGTACT GCCTATTACA CACGAACGGA

251 CAGGGTTTGA AGGTGTTATC GGTTATGAAA CCCATTTTTC AGGGCACGGA

301 CATGAAGTAC ACAGTCCGTT CGATCATCAT GATTCAAAAA GCACTTCTGA

351 TTTCAGCGGC GGTGTAGACG GCGGTTTTAC TGTTTACCAA CTTCATCGAA

401 CAGGGTCGGA AATCCATCCG GAGGATGGAT ATGACGGGCC GCAAGGCAGC

451 GATTATCCGC CCCCCGGAGG AGCAAGGGAT ATATACAGCT ATTATGTCAA

501 AGGAACTTCA ACAAAAACAA AGACTAATAT TGTCCCTCAA GCCCCATTTT

551 CAGACCGTTG GCTAAAAGAA AATGCCGGTG CCGCCTCTGG TTTTTTCAGC

601 CGTGCGGATG AAGCAGGAAA ACTGATATGG GAAAGCGACC CCAATAAAAA

651 TTGGTGGGCT AACCGTATGG ATGATGTTCG CGGCATCGTC CAAGGTGCGG

701 TTAATCCTTT TTTAATGGGT TTTCAAGGAG TAGGGATTGG GGCAATTACA

751 GACAGTGCAG TAAGCCCGGT CACAGATACA GCCGCGCAGC AGACTCTACA

801 AGGTATTAAT GATTTAGGAA AATTAAGTCC GGAAGCACAA CTTGCTGCCG

851 CGAGCCTATT ACAGGACAGT GCTTTTGCGG TAAAAGACGG TATCAACTCT

901 GCCAAACAAT GGGCTGATGC CCATCCAAAT ATAACAGCTA CTGCCCAAAC

951 TGCCCTTTCC GCAGCAGAGG CCGCAGGTAC GGTTTGGAGA GGTAAAAAAG

1001 TAGAACTTAA CCCGACTAAA TGGGATTGGG TTAAAAATAC CGGTTATAAA

1051 AAACCTGCTG CCCGCCATAT GCAGACTTTA GATGGGGAGA TGGCAGGTGG

1101 GAATAAACCT ATTAAATCTT TACCAAACAG TGCCGCTGAA AAAAGAAAAC

1151 AAAATTTTGA GAAGTTTAAT AGTAACTGGA GTTCAGCAAG TTTTGATTCA

1201 GTGCACAAAA CACTAACTCC CAATGCACCT GGTATTTTAA GTCCTGATAA
```

-continued

```
1251 AGTTAAAACT CGATACACTA GTTTAGATGG AAAAATTACA ATTATAAAAG

1301 ATAACGAAAA CAACTATTTT AGAATCCATG ATAATTCACG AAAACAGTAT

1351 CTTGATTCAA ATGGTAATGC TGTGAAAACC GGTAATTTAC AAGGTAAGCA

1401 AGCAAAAGAT TATTTACAAC AACAAACTCA TATCAGGAAC TTAGACAAAT

1451 GA
```

This corresponds to the amino acid sequence <SEQ ID 890; ORF 238>:

```
m238.pep
  1 MNLPIQKFMM LFAAAISLLQ IPISHANGLD ARLRDDMQAK HYEPGGKYHL

51 FGNARGSVKK RVYAVQTFDA TAVSPVLPIT HERTGFEGVI GYETHFSGHG

101 HEVHSPFDHH DSKSTSDFSG GVDGGFTVYQ LHRTGSEIHP EDGYDGPQGS

151 DYPPPGGARD IYSYYVKGTS TKTKTNIVPQ APFSDRWLKE NAGAASGFFS

201 RADEAGKLIW ESDPNKNWWA NRMDDVRGIV QGAVNPFLMG FQGVGIGAIT

251 DSAVSPVTDT AAQQTLQGIN DLGKLSPEAQ LAAASLLQDS AFAVKDGINS

301 AKQWADAHPN ITATAQTALS AAEAAGTVWR GKKVELNPTK WDWVKNTGYK

351 KPAARHMQTL DGEMAGGNKP IKSLPNSAAE KRKQNFEKFN SNWSSASFDS

401 VHKTLTPNAP GILSPDKVKT RYTSLDGKIT IIKDNENNYF RIHDNSRKQY

451 LDSNGNAVKT GNLQGKQAKD YLQQQTHIRN LDK*
```

Computer analysis of this amino acid sequence gave the following results:
Homology with a Predicted ORF from *N. gonorrhoeae*
ORF 238 shows 86.0% identity over a 401 aa overlap with a predicted ORF (ORF 238.ng) from *N. gonorrhoeae*:

```
    m238/g238

10         20         30         40         50         60
    m238.pep  MNLPIQKFMMLFAAAISLLQIPISHANGLDARLRDDMQAKHYEPGGKYHLFGNARGSVKK
              ||||||||||:|||||:|:||||||||||||||||||||||||||||||||||||||||:
    g238      MNLPIQKFMMLLAAAISMLHIPISHANGLDARLRDDMQAKHYEPGGKYHLFGNARGSVKN
                   10         20         30         40         50         60

70         80         90        100        110        120
    m238.pep  RVYAVQTFDATAVSPVLPITHERTGFEGVIGYETHFSGHGHEVHSPFDHHDSKSTSDFSG
              ||:|||||||||||:|:|||||||||||||||||||||||||||||||:|||||||||||
    g238      RVCAVQTFDATAVGPILPITHERTGFEGVIGYETHFSGHGHEVHSPFDNHDSKSTSDFSG
                   70         80         90        100        110        120

130        140        150        160        170        180
    m238.pep  GVDGGFTVYQLHRTGSEIHPEDGYDGPQGSDYPPPGGARDIYSYYVKGTSTKTKTNIVPQ
              |||||||||||||||||||:|||||||||:||||||||||:|||||||||||||||||||
    g238      GVDGGFTVYQLHRTGSEIHPADGYDGPQGGGYPEPQGARDIYSYHIKGTSTKTKINTVPQ
                  130        140        150        160        170        180

190        200        210        220        230        240
    m238.pep  APFSDRWLKENAGAASGFFSRADEAGKLIWESDPNKNWWANRMDDVRGIVQGAVNPFLMG
              |||||||||||||||:||||||||||||||||:|||||||:|||||||||||||||||||
    g238      APFSDRWLKENAGAASGFLSRADEAGKLIWENDPDKNWRANRMDDIRGIVQGAVNPFLTG
                  190        200        210        2200       230        240

250        260        270        280        290        300
    m238.pep  FQGVGIGAITDSAVSPVTDTAAQQTLQGINDLGKLSPEAQLAAASLLQDSAFAVKDGINS
              |||||||||||||||||||||||||||||||::||||||||||||||||||||||||||
    g238      FQGVGIGAITDSAVSPVTDTAAQQTLQGINDLGNLSPEAQLAAASLLQDSAFAVKDGINS
                  250        260        270        280        290        300

310        320        330        340        350        360
    m238.pep  AKQWADAHPNITATAQTALSAAEAAGTVWRGKKVELNPTKWDWVKNTGYKKPAARHMQTL
              |:|||||||||||||||||::||||||||||||||||||||||||||||||||||||||:
    g238      ARQWADAHPNITATAQTALAVAEAAGTVWRGKKVELNPTKWDWVKNTGYKKPAARHMQTV
                  310        320        330        340        350        360
```

-continued

```
                    370       380       390       400       410       420
m238.pep    DGEMAGGNKPIKSLPNSAAEKRKQNFEKFNSNWSSASFDSVHKTLTPNAPGILSPDKVKT
            ||||||||:| ||: :| ||     :: |: :: :  :::::
g238        DGEMAGGNRPPKSI-TSEGKANAATYPKLVNQLNEQNLNNIAAQDPRLSLAIHEGKKNFP
                    370       380       390       400       410

430       440       450       460       470       480
m238.pep      RYTSLDGKITIIKDNENNYFRIHDNSRKQYLDSNGNAVKTGNLQGKQAKDYLQQQTHIRN g238          IGTATYEEADRLGKIWVGEGARQTSGGGWLSRDGTRQYRPPTEKKSQFATTGIQANFETY
            420       430       440       450       460       470
```

The following partial DNA sequence was identified in *N. meningitidis* <SEQ ID 891>:

```
a238.seq (partial)
   1 ATGAATTTGC CTATTCAAAA ATTCATGATG CTGTTTGCAG CAGCAATATC

51 GTTGCTGCAA ATCCCCATTA GTCATGCGAA CGGTTTGGAT GCCCGTTTGC

101 GCGATGATAT GCAGGCAAAA CACTACGAAC CGGGTGGTAA ATACCATCTG

151 TTTGGTAATG CTCGCGGCAG TGTTAAAAAT CGGGTTTACG CCGTCCAAAC

201 ATTTGATGCA ACTGCGGTCG GCCCCATACT GCCTATTACA CACGAACGGA

251 CAGGATTTGA AGGCATTATC GGTTATGAAA CCCATTTTTC AGGACATGGA

301 CATGAAGTAC ACAGTCCGTT CGATAATCAT GATTCAAAAA GCACTTCTGA

351 TTTCAGCGGC GGCGTAGACG GTGGTTTTAC CGTTTACCAA CTTCATCGGA

401 CAGGGTCGGA AATCCATCCG GAGGATGGAT ATGACGGGCC GCAAGGCAGC

451 GATTATCCGC CCCCCGGAGG AGCAAGGGAT ATATACAGCT ACTATGTCAA

501 AGGAACTTCA ACAAAAACAA AGAGTAATAT TGTTCCCCGA GCCCCATTTT

551 CAGACCGCTG GCTAAAAGAA AATGCCGGTG CCGCCTCTGG TTTTTTCAGC

601 CGTGCTGATG AAGCAGGAAA ACTGATATGG GAAAGCGACC CCAATAAAAA

651 TTGGTGGGCT AACCGTATGG ATGATATTCG CGGCATCGTC CAAGGTGCGG

701 TTAATCCTTT TTTAATGGGT TTTCAAGGAG TAGGGATTGG GGCAATTACA

751 GACAGTGCAG TAAGCCCGGT CACAGATACA GCCGCGCAGC AGACTCTACA

801 AGGTATTAAT CATTTAGGAA ATTTAAGTCC CGAAGCACAA CTTGCGGCTG

851 CAACCGCATT ACAAGACAGT GCTTTTGCGG TAAAAGACGG TATCAATTCC

901 GCCAGACAAT GGGCTGATGC CCATCCGAAT ATAACTGCAA CAGCCCAAAC

951 TGCCCTTGCC GTAGCAGAGG CCGCAACTAC GGTTTGGGGC GGTAAAAAAG

1001 TAGAACTTAA CCCGACCAAA TGGGATTGGG TTAAAAATAC CGGCTATAAA

1051 ACACCTGCTG TTCGCACCAT GCATACTTTG GATGGGGAAA TGGCCGGTGG

1101 GAATAGACCG CCTAAATCTA TAACGTCCAA CAGCAAAGCA GATGCTTCCA

1151 CACAA
```

This corresponds to the amino acid sequence <SEQ ID 892; ORF 238.a>:

```
a238.pep (partial)
  1  MNLPIQKFMM LFAAAISLLQ IPISHANGLD ARLRDDMQAK HYEPGGKYHL

51  FGNARGSVKN RVYAVQTFDA TAVGPILPIT HERTGFEGII GYETHFSGHG

101  HEVHSPFDNH DSKSTSDFSG GVDGGFTVYQ LHRTGSEIHP EDGYDGPQGS

151  DYPPPGGARD IYSYYVKGTS TKTKSNIVPR APFSDRWLKE NAGAASGFFS
```

-continued

```
201  RADEAGKLIW ESDPNKNWWA NRMDDIRGIV QGAVNPFLMG FQGVGIGAIT

251  DSAVSPVTDT AAQQTLQGIN HLGNLSPEAQ LAAATALQDS AFAVKDGINS

301  ARQWADAHPN ITATAQTALA VAEAATTVWG GKKVELNPTK WDWVKNTGYK

351  TPAVRTMHTL DGEMAGGNRP PKSITSNSKA DASTQ
``` m238/a238 91.9% identity in 385 aa overlap

```
                  10         20         30         40         50         60
m238.pep  MNLPIQKFMMLFAAAISLLQIPISHANGLDARLRDDMQAKHYEPGGKYHLFGNARGSVKK
          |||||||||||||||||||||||||||||||||||||||||||||||||||||||||||:
a238      MNLPIQKFMMLFAAAISLLQIPISHANGLDARLRDDMQAKHYEPGGKYHLFGNARGSVKN
                  10         20         30         40         50         60

70         80         90        100        110        120
m238.pep  RVYAVQTFDATAVSPVLPITHERTGFEGVIGYETHFSGHGHEVHSPFDHHDSKSTSDFSG
          |||||||||||||:|:||||||||||||:||||||||||||||||||:||||||||||||
a238      RVYAVQTFDATAVGPILPITHERTGFEGIIGYETHFSGHGHEVHSPFDNHDSKSTSDFSG
                  70         80         90        100        110        120

130        140        150        160        170        180
m238.pep  GVDGGFTVYQLHRTGSEIHPEDGYDGPQGSDYPPPGGARDIYSYYVKGTSTKTKTNIVPQ
          |||||||||||||||||||||||||||||||||||||||||||||||||||||:||||:
a238      GVDGGFTVYQLHRTGSEIHPEDGYDGPQGSDYPPPGGARDIYSYYVKGTSTKTKSNIVPR
                 130        140        150        160        170        180

190        200        210        220        230        240
m238.pep  APFSDRWLKENAGAASGFFSRADEAGKLIWESDPNYNWWANRMDDVRGIVQGAVNPFLMG
          |||||||||||||||||||||||||||||||||||||||||||||:||||||||||||||
a238      APFSDRWLKENAGAASGFFSRADEAGKLIWESDPNYNWWANRMDDIRGIVQGAVNPFLMG
                 190        200        210        220        230        240

250        260        270        280        290        300
m238.pep  GQGVGIGAITDSAVSPVTDTAAQQTLQGINDLGKLSPEAQLAAASLLQDSAFAVKDGINS
          ||||||||||||||||||||||||||||||| :|||||||||||:||||||||||||||
a238      GQGVGIGAITDSAVSPVTDTAAQQTLQGINHLGNLSPEAQLAAATALQDSAFAVKDGINS
                 250        260        270        280        290        300

310        320        330        340        350        360
m238.pep  AKQWADAHPNITATAQTALSAAEEAAGTVWRGKKVELNPTKWDWVKNTGYKKPAARHMQTL
          |:|||||||||||||||||::||||  ||| ||||||||||||||||||||| ||:|:||
a238      ARQWADAHPNITATAQTALAVAEAATTVWGGKKVELNPTKWDWVKNTGYKTPAVRTMHTL
                 310        320        330        340        350        360

370        380        390        400        410       419
m238.pep  DGEMAGGNKPIKSLP-NSAAEKRKQNFEKFNSNWSSASFDSVHKTLTPNAPGILSPDKVK
          ||||||||:|||: ||: ||| |:   |
a238      DGEMAGGNRPPKSITSNSKADASTQ
```

The following partial DNA sequence was identified in *N. gonorrhoeae* <SEQ ID 893>:

```
g239.seq
  1  atgttccacc ataaaggtat tgcccgaaac cggcggatgg aggttttgtt 51  tttctgccgc cgccctgatc gcttcgtgat tcgccaaacg cgcctgttgc 101  agcctcattt gcgcataatc ctgctccaag gcgatttcct gttttttcgc 151  cttgtccaaa gctgtgaagt tgagcctgta ctggttttgc tgcatcacaa 201  cggaaaaagc ggaaacgcac accgcaagca gcagaaagaa attcgatttg 251  ttcattgccg ttcagacgtt tttctctgtt attattccgg tatcggaccg 301  gcagtccgct ccgccacacg caaaactgcg ctcctcgccc tcgggttggc 351  ggcaatttcc gcttcacccg gctttaatgc cctgcccacg attttcaggg 401  gcggatcggg caaatccgct tctctgaccg ccgcccagct cggcaggggc 451  tcgtgttgcg aatattttt gacaaactgc ttcacaatgc ggtcttccaa 501  cgaatggaaa gcaatgaccg ccaaacgccc gccctctttc agacggcaca 551  tgacctgcgg caataccgcc cctacttctt caagctcgcg gttaataaag 601  atgcggattg cctggaaggt gcgcgtcgca ggatcctgcc cccgctcgcg
```

-continued
```
651 agtacggacg ttttgtgcca cgatctgcgc cagcttgcgg gttgtatcga 701 ttggactttc cgcccgttgc gcgacaatgg cgcgcacaat ctggcggcta 751 aaccgctctt caccataa
```

This corresponds to the amino acid sequence <SEQ ID 894; ORF 239.ng>:

```
g239.pep
  1 MFHHKGIARN RRMEVLFFCR RPDRFVIRQT RLLQPHLRII LLQGDFLFFR

51 LVQSCEVEPV LVLLHHNGKS GNAHRKQQKE IRFVHCRSDV FLCYYSGIGP

101 AVRSATRKTA LLALGLAAIS ASPGFNALPT IFRGGSGKSA SLTAAQLGRG

151 SCCEYFLTNC FTMRSSNEWK AMTAKRPPSF RRHMTCGNTA PTSSSSRLIK

201 MRIAWKVRVA GSCPRSRVRT FCATICASLR VVSIGLSARC ATMARTIWRL

251 NRSSP*
```

The following partial DNA sequence was identified in *N. meningitidis* <SEQ ID 895>:

```
m239.seq
  1 ATGCTCCACC ATAAAGGTmy kGCCCGAAAC CGGCkGATGG AGGTTTTGTT

51 TTTCTGCCGC CGCCCTGATC GCTTCGTGGT TCGCCAAACG CGCCTGTTGC

101 AGCCTCATTT GCGCATAATC CTGCTCCAAG GCGATTTCCT GTTTTTTCGC

151 CTTATCCAAA GCTGTGAAAT TGAGCCTGTA CTGGTTTTGC TGCATCACAA

201 CGGAAAAAGC GGAAACGCAC ACCGCAAGCA GCAGAAGGAA ATTCAATTTG

251 TTCATTGCCA TTCAGACGTT TTTCTCTGTG ATTGTTCCGG TATCGGACCG

301 GCAGTCCGCT CCGCCACACG CAAAACCGCA CTTCTCGCCC TCGGATTGGC

351 GGCAATTTCC GCCTCACCCG GCTTTAATGC CCTGCCCACG ATTTTCAGGG

401 GCAGCTCGGG CAAATCCGCT TCCCTGaCCG CCGCCCAGCG CGGCAGGGGC

451 GCGTGTTGCG AATATTTTTT GACAAACTGC TTCACAATGC GATCTTCCAA

501 CGAATGGAAA GCAATGACCG CCAAACGTCC GCCCTCTTTC AGACGACACA

551 TGACCTGCGG CAATACTGCC CCTACTTCTT CAAGCTCGCG GTTAATAAAG

601 ATGCGGACCG CCTGGAAGGT GCGCGTCGCA GGATCCTGCC CAAGCTCGCG

651 AGTACGGACG TTTTGTGCCA CGATCTGCGC CAGCTTGCGG GTTGTATCGA

701 TTGGACTTTC CGCCTGTTGC GCAACAATGG CGCGCGCAAT cCGGCGGCTa

751 AACCGCTCTT cACCATAA
```

This corresponds to the amino acid sequence <SEQ ID 896; ORF 239>:

```
m239.pep
  1 MLHHKGXARN RXMEVLFFCR RPDRFVVRQT RLLQPHLRII LLQGDFLFFR

51 LIQSCEIEPV LVLLHHNGKS GNAHRKQQKE IQFVHCHSDV FLCDCSGIGP

101 AVRSATRKTA LLALGLAAIS ASPGFNALPT IFRGSSGKSA SLTAAQRGRG

151 ACCEYFLTNC FTMRSSNEWK AMTAKRPPSF RRHMTCGNTA PTSSSSRLIK

201 MRTAWKVRVA GSCPRSRVRT FCATICASLR VVSIGLSARC ATMARAIRRL

251 NRSSP*
```

Computer analysis of this amino acid sequence gave the following results:
Homology with a Predicted ORF from *N. gonorrhoeae*
ORF 239 shows 93.7% identity over a 255 aa overlap with a predicted ORF (ORF 239.ng) from *N. gonorrhoeae*:

```
m239/g239

10        20        30        40        50        60
    m239.pep MLHHKGXARNRXMEVLFFCRRPDRFVVRQTRLLQPHLRIILLQGDFLFFRLIQSCEIEPV
             |:|||| |||| |||||||||||||||:||||||||||||||||||||:||||:|||
       g239  MFHHKGIARNRRMEVLFFCRRPDRFVIRQTRLLQPHLRIILLQGDFLFFRLVQSCEVEPV
                  10        20        30        40        50        60

70        80        90       100       110       120
    m239.pep LVLLHHNGKSGNAHRKQQKEIQFVHCHSDVFLCDCSGIGPAVRSATRKTALLALGLAAIS
             ||||||||||||||||||||||:||||:|||||| ||||||||||||||||||||||||
       g239  LVLLHHNGKSGNAHRKQQKEIRFVHCRSDVFLCYYSGIGPAVRSATRKTALLALGLAAIS
                  70        80        90       100       110       120

130       140       150       160       170       180
    m239.pep ASPGFNALPTIFRGSSGKSASLTAAQRGRGACCEYFLTNCFTMRSSNEWKAMTAKRPPSF
             |||||||||||||||:||||||||||:|||| |:|||||||||||||||||||||||||
       g239  ASPGFNALPTIFRGSGGKSASLTAAQLGRGSCCEYFLTNCFTMRSSNEWKAMTAKRPPSF
                 130       140       150       160       170       180

190       200       210       220       230       240
    m239.pep RRHMTCGNTAPTSSSSRLIKMRTAWKVRVAGSCPRSRVRTFCATICASLRVVSIGLSARC
             |||||||||||||||||||||||:||||||||||||||||||||||||||||||||||||
       g239  RRHMTCGNTAPTSSSSRLIKMRIAWKVRVAGSCPRSRVRTFCATICASLRVVSIGLSARC
                 190       200       210       220       230       240

250
    m239.pep ATMARAIRRLNRSSPX
             |||||:| |||||||||
       g239  ATMARTIWRLNRSSPX
                 250
```

The following partial DNA sequence was identified in *N. meningitidis* <SEQ ID 897>:

```
a239.seq
   1 ATGCTCCACC ATAAAGGTAT TGCCCGAAAC CGGCGGATGG AGGTTTTGTT

51 TTTCTGCCGC CGCCCTGATC GCTTCGTGGT TCGCCAAACG CGCCTGTTGC

101 AGCCTCATTT GCGCATAATC CTGCTCCAAG GCGATTTCCT GTTTTTTCGC

151 CTTATCCAAA GCTGTGAAGT TGAGCCTGTA CTGGTTTTGC TGCATCACAA

201 CGGAAAAAGC GGAAACGCAC ACCGCAAGCA GCAGAAGGAA ATTCAATTTG

251 TTCATTGCCA TTCAGACGTT TTTCTCTGTG ATTGTTCCGG TATCGGACCG

301 GCAGTCCGCT CCGCCACACG CAAAACCGCA CTTCTCGCCC TCGGATTGGC

351 GGCAATTTCC GCCTCACCCG GCTTTAATGC CCTGCCCGCG ATTTTCAGGG

401 GCGGCTCGGG CAAATCCGCT TCCCTGACCG CCGCCCAGCG CGGCAGGGGC

451 GCGTGTTGCG AATATTTTTT GACAAACTGC TTCACAATGC GGTCTTCCAA

501 CGAATGGAAA GCAATGACCG CCAAACGTCC GCCCTCTTTC AGACGACACA

551 TGACCTGCGG CAATACTGCC CCTACTTCTT CAAGCTCGCG GTTAATAAAG

601 ATGCGGATTG CCTGGAAGGT GCGCGTCGCA GGATCCTGCC CAAGCTCGCG

651 AGTACGGACG TTTTGTGCCA CGATCTGCGC CAGCTTGCGG GTTGTATCGA

701 TTGGACTTTC CGCCTGTTGC GCAACAATGG CGCGCGCAAT CTGGCGGCTA

751 AACCGCTCTT CACCATAA
```

This corresponds to the amino acid sequence <SEQ ID 898; ORF 239.a>:

```
a239.pep
  1 MLHHKGIARN RRMEVLFFCR RPDRFVVRQT RLLQPHLRII LLQGDFLFFR

51 LIQSCEVEPV LVLLHHNGKS GNAHRKQQKE IQFVHCHSDV FLCDCSGIGP

101 AVRSATRKTA LLALGLAAIS ASPGFNALPA IFRGGSGKSA SLTAAQRGRG

151 ACCEYFLTNC FTMRSSNEWK AMTAKRPPSF RRHMTCGNTA PTSSSSRLIK

201 MRIAWKVRVA GSCPRSRVRT FCATICASLR VVSIGLSARC ATMARAIWRL

251 NRSSP*
``` m239/a239 97.3% identity in 255 aa overlap

```
                  10         20         30         40         50         60
m239.pep  MLHHKGXARNRXMEVLFFCRRPDRFVVRQTRLLQPHLRIILLQGDFLFFRLIQSCEIEPV
          ||||||  |||| ||||||||||||||||||||||||||||||||||||||||||:|||
a239      MLHHKGIARNRRMEVLFFCRRPDRFVVRQTRLLQPHLRIILLQGDFLFFRLIQSCEVEPV
                  10         20         30         40         50         60
                  70         80         90        100        110        120
m239.pep  LVLLHHNGKSGNAHRKQQKEIQFVHCHSDVFLCDCSGIGPAVRSATRKTALLALGLAAIS
          ||||||||||||||||||||||||||||||||||||||||||||||||||||||||||||
a239      LVLLHHNGKSGNAHRKQQKEIQFVHCHSDVFLCDCSGIGPAVRSATRKTALLALGLAAIS
                  70         80         90        100        110        120
                 130        140        150        160        170        180
m239.pep  ASPGFNALPTIFRGSSGKSASLTAAQRGRGACCEYFLTNCFTMRSSNEWKAMTAKRPPSF
          ||||||||||:||||:||||||||||||||||||||||||||||||||||||||||||||
a239      ASPGFNALPAIFRGSGGKSASLTAAQRGRGACCEYFLTNCFTMRSSNEWKAMTAKRPPSF
                 130        140        150        160        170        180
                 190        200        210        220        230        240
m239.pep  RRHMTCGNTAPTSSSSRLIKMRTAWKVRVAGSCPRSRVRTFCATICASLRVVSIGLSARC
          ||||||||||||||||||||||| ||||||||||||||||||||||||||||||||||||
a239      RRHMTCGNTAPTSSSSRLIKMRIAWKVRVAGSCPRSRVRTFCATICASLRVVSIGLSARC
                 190        200        210        220        230        240
                 250
m239.pep  ATMARAIRRLNRSSPX
          |||||||  |||||||
a239      ATMARAIWRLNRSSPX
                 250
```

The following partial DNA sequence was identified in *N. gonorrhoeae* <SEQ ID 899>:

```
g240.seq
  1 atgatagaag tcatacattt cttcggcgcc gaaacgcgca gacagtttgc 51 ttgtgccgac gttggacgat ttctgcataa tgccgcgcac atccaaagag 101 gggtaaacat gggtatcatc gcgcacggga cggtccga tttataagg 151 ctgcgtattc agccgttcgt tcaaatcggt tttgcccgca tccaatgcct 201 tcgcaatcac gaacggtttg attgccgaac caggttcgat catatcggtt 251 acggcacggt tgcgccgctg ttcgctgtct gcccggccgg gtctgttggg 301 atcgtaggcg ggcgtattgg ccaaggcgag gatttccccc gtgcgggcat 351 ccaaaaccac caccgttccg gcttttgcct gatggtattc gaccgccttg 401 ttcaactctt cataggccaa ggtctgaatc ctctgatcga gggaaaggat 451 gatgtctttg ccgttttgcg gtgctttatt gcgcggggag tccaagctgt 501 ccacaatatt gccctgccgg tcccgcaaaa caacttccgc gccgtcttcg 551 ccatacaggc tgtcttcaag cgaaagttcc aaaccttcct gacctttgcc 601 gtcaatatcg gtaaatccga tgacgtgtgc aaacaggttg cccatcgggt 651 aatggcgttt taa
```

This corresponds to the amino acid sequence <SEQ ID 900; ORF 240.ng>:

```
g240.pep
   1 MIEVIHFFGA ETRRQFACAD VGRFLHNAAH IQRGVNMGII AHGRRSDFIR

51 LRIQPFVQIG FARIQCLRNH ERFDCRTRFD HIGYGTVAPL FAVCPAGSVG

101 IVGGRIGQGE DFPRAGIQNH HRSGFCLMVF DRLVQLFIGQ GLNPLIEGKD

151 DVFAVLRCFI ARGVQAVHNI ALPVPQNNFR AVFAIQAVFK RKFQTFLTFA

201 VNIGKSDDVC KQVAHRVMAF*
```

The following partial DNA sequence was identified in *N. meningitidis* <SEQ ID 901>:

```
m240.seq
   1 ATGATAGAAG TCATACATTT CTTCGGCACC GAAACGCGCA GACAGTTTGC

51 TTGTGCCGAC GTTGGACGAT TTCTGCATGA TGCCGCGCAC ATCCAAAGAG

101 GGGTAAACAT GGGTATCGCG CACGGGAGAC GGTCCGATTT TATAAGGCTG

151 CGTATTCAGC CGTTCGTTCA AATCGGTTTT GCCCGCATCC AATGCCTTCG

201 CAATCACAAA CGGTTTGATT GCCGAACCGG GTTCGATCAT ATCGGTTACG

251 GCACGGTTGC GCCGCTGTTC GCTGTCTGCC CGGCCGGGCC TGTTGGGATC

301 GTAGGCGGGC GTATTGGCCA AGGCGAGGAT TTCCCCCGTG CGGGCATCCA

351 ArACCACCAC CGTTCCGGCT TTTGCCTGAT GGTATTCGAC CGCCTTGTTC

401 AACTCTTCAT AGGCCAAGGT CTGAATCCTC TGATCGAGGG AAAGGATGAT

451 GTCTTTGCCG TTTTTCGGGG CTTTAkTGCG CGGGGAGTCC AAGCTGTCCA

501 CAATATTGCC CTGCCGGTCC CGCAAAACGA CTTCCGCGCC GTCTTCGCCA

551 TGCAAGCTGT CTTCAAGCGA AAGTTCCAAA CCTTCCTGAC CTTTGCCGTC

601 AATATCGGTA ATCCGATGA CGTGTGCAAA CAGGTTGCCC ATCGGGTAAT

651 GGCGTTTTAA
```

This corresponds to the amino acid sequence <SEQ ID 902; ORF 240>:

```
m240.pep
   1 MIEVIHFFGT ETRRQFACAD VGRFLHDAAH IQRGVNMGIA HGRRSDFIRL

51 RIQPFVQIGF ARIQCLRNHK RFDCRTGFDH IGYGTVAPLF AVCPAGPVGI

101 VGGRIGQGED FPRAGIQXHH RSGFCLMVFD RLVQLFIGQG LNPLIEGKDD

151 VFAVFRGFXA RGVQAVHNIA LPVPQNDFRA VFAMQAVFKR KFQTFLTFAV

201 NIGKSDDVCK QVAHRVMAF*
```

Computer analysis of this amino acid sequence gave the following results:

Homology with a Predicted ORF from *N. gonorrhoeae*

ORF 240 shows 94.5% identity over a 220 aa overlap with a predicted ORF (ORF 240.ng) from *N. gonorrhoeae*:

```
m240/g240

10        20        30        40        50        59
m240.pep   MIEVIHFFGTETRRQFACADVGRFLHDAAHIQRGVNMGI-AHGRRSDFIRLRIQPFVQIG
           ||||||||:||||||||||||||||||:||||||||||| ||||||||||||||||||||
g240       MIEVIHFFGAETRRQFACADVGRFLHNAAHIQRGVNMGIIAHGRRSDFIRLRIQPFVQIG
                  10        20        30        40        50        60

60        70        80        90       100       110       119
m240.pep   FARIQCLRNHKRFDCRTGFDHIGYGTVAPLFAVCPAGPVGIVGGRIGQGEDFPRAGIQXH
           ||||||||||:||||| ||||||||||||||||||||||:||||||||||||||||| |
g240       FARIQCLRNHERGDCRTRFDHIGYGTVAPLFAVCPAGSVGIVGGRIGQGEDFPRAGIQNH
                  70        80        90       100       110       120

120       130       140       150       160       170       179
m240.pep   HRSGFCLMVFDRLVQLFIGQGLNPLIEGKDDVFAVFRGFXARGVQAVHNIALPVPQNDFR
           ||||||||||||||||||||||||||||||||||| :| |  ||||||||||||||:||
g240       HRSGFCLMVFDRLVQLFIGQGLNPLIEGKDDVFAVLRCFIARGVQAVHNIALPVPQNNFR
                 130       140       150       160       170       180

180       190       200       210       220
m240.pep   AVFAMQAVFKRKFQTFLTFAVNIGKSDDVCKQVAHRVMAFX
           ||||:|||||||||||||||||||||||||||||||||||
g240       AVFAIQAVFKRKFQTFLTFAVNIGKSDDVCKQVAHRVMAF
                 190       200       210       220
```

The following partial DNA sequence was identified in *N. meningitidis* <SEQ ID 903>:

```
a240.seq
   1 ATGATAGAAG TCATACATTT CTTCGGCACC GAAACGCGCA GACAGTTTGC

51 TTGTGCCGAC GTTGGACGAT TTCTGCATGA TGCCGCGCAC ATCCAAAGAG

101 GGGTAAACAT GGGTATCGCG CACGGGAGAC GGTCCGATTT TATAAGGCTG

151 CGTATTCAGC CGTTCGTTCA AATCGGTTTT GCCCGCATCC AATGCCTTCG

201 CAATCACAAA CGGTTTGATT GCCGAACCGG GTTCGATCAT ATCGGTTACG

251 GCACGGTTGC GCCGCTGTTC GCTGTCTGCC CGGCCGGGCC TGTTGGGATC

301 GTAGGCGGGC GTATTGGCCA AGGCGAGGAT TTCCCCCGTG CGGGCATCCA

351 AAACCACCAC CGTTCCGGCT TTTGCCTGAT GGTATTCGAC CGCCTTGTTC

401 AACTCTTCAT AGGCCAAGGT CTGAATCCTC TGATCGAGGG AAAGGATGAT

451 GTCTTTGCCG TTTTTCGGGG CTTTATTGCG CGGGGAGTCC AAGCTGTCCA

501 CAATATTGCC CTGCCGGTCC CGCAAAACGA CTTCCGCGCC GTCTTCGCCA

551 TGCAGGCTGT CTTCAAGCGA AAGTTCCAAA CCTTCCTGAC CTTTGCCGTC

601 AATATCGGTA AATCCGATGA CGTGTGCAAA CAGGTTGCCC ATCGGGTAAT

651 GGCGTTTTAA
```

This corresponds to the amino acid sequence <SEQ ID 904; ORF 240.a>:

```
a240.pep
   1 MIEVIHFFGT ETRRQFACAD VGRFLHDAAH IQRGVNMGIA HGRRSDFIRL

51 RIQPFVQIGF ARIQCLRNHK RFDCRTGFDH IGYGTVAPLF AVCPAGPVGI

101 VGGRIGQGED FPRAGIQNHH RSGFCLMVFD RLVQLFIGQG LNPLIEGKDD
```

```
151 VFAVFRGFIA RGVQAVHNIA LPVPQNDFRA VFAMQAVFKR KFQTFLTFAV

201 NIGKSDDVCK QVAHRVMAF*
``` m240/a240 99.1% identity in 219 aa overlap

```
                 10         20         30         40         50         60
m240.pep  MIEVIHFFGTETRRQFACADVGRFLHDAAHIQRGVNMGIAHGRRSDFIRLRIQPFVQIGF
          ||||||||||||||||||||||||||||||||||||||||||||||||||||||||||||
a240      MIEVIHFFGTETRRQFACADVGRFLHDAAHIQRGVNMGIAHGRRSDFIRLRIQPFVQIGF
                 10         20         30         40         50         60
                 70         80         90        100        110        120
m240.pep  ARIQCLRNHKRFDCRTGFDHIGYGTVAPLFAVCPAGPVGIVGGRIGQGEDFPRAGIQXHH
          |||||||||||||||||||||||||||||||||||||||||||||||||||||||||| |
a240      ARIQCLRNHKRFDCRTGFDHIGYGTVAPLFAVCPAGPVGIVGGRIGQGEDFPRAGIQNHH
                 70         80         90        100        110        120
                130        140        150        160        170        180
m240.pep  RSGFCLMVFDRLVQLFIGQGLNPLIEGKDDVFAVFRGFXARGVQAVHNIALPVPQNDFRA
          |||||||||||||||||||||||||||||||||||||| |||||||||||||||||||||
a240      RSGFCLMVFDRLVQLFIGQGLNPLIEGKDDVFAVFRGFIARGVQAVHNIALPVPQNDFRA
                130        140        150        160        170        180
                190        200        210        220
m240.pep  VFAMQAVFKRKFQTFLTFAVNIGKSDDVCKQVAHRVMAFX
          |||||||||||||||||||||||||||||||||||||||
a240      VFAMQAVFKRKFQTFLTFAVNIGKSDDVCKQVAHRVMAFX
                190        200        210        220
```

The following partial DNA sequence was identified in *N. gonorrhoeae* <SEQ ID 905>:

```
g241.seq
   1 ATGATAGAAG TCATACATTT CTTCGGCACC GAAACGCGCA GACAGTTTGC

51 TTGTGCCGAC GTTGGACGAT TTCTGCATGA TGCCGCGCAC ATCCAAAGAG

101 GGGTAAACAT GGGTATCGCG CACGGGAGAC GGTCCGATTT TATAAGGCTG

151 CGTATTCAGC CGTTCGTTCA AATCGGTTTT GCCCGCATCC AATGCCTTCG

201 CAATCACAAA CGGTTTGATT GCCGAACCGG GTTCGATCAT ATCGGTTACG

251 GCACGGTTGC GCCGCTGTTC GCTGTCTGCC CGGCCGGGCC TGTTGGGATC

301 GTAGGCGGGC GTATTGGCCA AGGCGAGGAT TTCCCCCGTG CGGGCATCCA

351 ArACCACCAC CGTTCCGGCT TTTGCCTGAT GGTATTCGAC CGCCTTGTTC

401 AACTCTTCAT AGGCCAAGGT CTGAATCCTC TGATCGAGGG AAAGGATGAT

451 GTCTTTGCCG TTTTTCGGGG CTTTAkTGCG CGGGGAGTCC AAGCTGTCCA

501 CAATATTGCC CTGCCGGTCC CGCAAAACGA CTTCCGCGCC GTCTTCGCCA

551 TGCAAGCTGT CTTCAAGCGA AAGTTCCAAA CCTTCCTGAC CTTTGCCGTC

601 AATATCGGTA AATCCGATGA CGTGTGCAAA CAGGTTGCCC ATCGGGTAAT

651 GGCGTTTTAA
```

This corresponds to the amino acid sequence <SEQ ID 906; ORF 241.ng>:

```
g241.pep
   1 MPTRPTRAAN PPTPTTWLQT AYCPRPPYRP PSVQTHTPHE PASSTCAAKS

51 ANRRENSHNA QPTYLLHPSN KMPSETEQTL FRRHQIPPSC RQSVVVMTVR
```

-continued

```
101 TVDMTVCDFL IGCIAHAFNR SFKADFHACQ RMVAVHHRLA VGNIGYTIDD

151 NIAGFRIVRF KHHTDLDFNR ERARIFNTDQ LRIMLTERIV GRKRHFDRIA

201 GILTVQRLFH QRENAVVTAV QIRNRFFGFI QKLIVGIIHL IMQRNHGIFC

251 NSHICPFRNS RLITGAF*
```

The following partial DNA sequence was identified in *N. meningitidis* <SEQ ID 907>:

```
m241.seq (partial)
   1 ..CGGCAATCAG TGGTGGTGAT GACCGTGCGG GCCGTGGACA TGACCGTGTG

51   CGATTTCCTC ATCGGATGCA TCGCGCACGC TTTCAACTGT AGCCTTAAAG

101   CGGATTTTCA TGCCTGCCAA AGGATGGTTG CCGTCCACCA CCGCCTTGCC

151   GTCGGCAACA TCGGTTACAC GATAGACGAC AACATCGCCG GTTTCAGGAT

201   CGTCGGCTTC AAACATCATG CCGACTTCGA CTTCAACAGG GAACACGCCC

251   GCATCTTCGA TACGGACCAA CTCCGGATCC TGCTCGCCGA ACGCATCGTC

301   GGGCGACAGC GCCACATCGA CCGTATCGCC GGCATCCTTA CCGTGCAACG

351   CCTCTTCCAC CAAAGGGAAA ATGCCGTCGT AACCGCCGTG CAGATACGCA

401   ATCGGTTCTT CGGTTTTGTC CAAAAGCTGA TTGTTGGCAT CATACATCTC

451   ATAATGCAGC GAAACCACGG AATTTTTCAC GATAGCCATA TTTGTCCTTT

501   CAGGAACAGC AGATTAATTA CAGGCGCATT CTAA
```

This corresponds to the amino acid sequence <SEQ ID 908; ORF 241>:

```
m241.pep (partial)
   1 ..RQSVVVMTVR AVDMTVCDFL IGCIAHAFNC SLKADFHACQ RMVAVHHRLA

51   VGNIGYTIDD NIAGFRIVGF KHHADFDFNR EHARIFDTDQ LRILLAERIV

101   GRQRHIDRIA GILTVQRLFH QRENAVVTAV QIRNRFFGFV QKLIVGIIHL

151   IMQRNHGIFH DSHICPFRNS RLITGAF*
```

Computer analysis of this amino acid sequence gave the following results:

Homology with a Predicted ORF from *N. gonorrhoeae*

ORF 241 shows 91.5% identity over a 177 aa overlap with a predicted ORF (ORF 241.ng) from *N. gonorrhoeae*:

```
m241/g241

10        20        30
m241.pep                                  RQSVVVMTVRAVDMTVCDFLIGCIAHAFNC
                                          ||||||||||:|||||||||||||||||
g241        QPTYLLHPSNKMPSETEQTLFRRHQIPPSCRQSVVVMTVRTVDMTVCDFLIGCIAGAFNR
                    70        80        90       100       110       120

40        50        60        70        80        90
m241.pep    SLKADFHACQRMVAVHHRLAVGNIGYTIDDNIAGFRIVGFKHHADFDFNREHARIFDTDQ
            |:|||||||||||||||||||||||||||||||||||| ||||:|:|||||:||||:|||
g241        SFKADFHACQRMVAVHHRLAVGNIGYTIDDNIAGFRIVRFKHHTDLDFNRERARIFNTDQ
                   130       140       150       160       170       180
```

```
              100        110        120        130        140        150
m241.pep    LRILLAERIVGRQRHIDRIAGILTVQRLFHQRENAVVTAVQIRNRFFGFVQKLIVGIIHL
            |||:|:||||||:||:||||||||||||||||||||||||||||||||:|||||||||
g241        LRIMLTERIVGRKRHFDRIAGILTVQRLFHQRENAVVTAVQIRNRFFGFIQKLIVGIIHL
              190        200        210        220        230        240

160        170
m241.pep    IMQRNHGIFHDSHICPFRNSRLITGAFX
            ||||||||||:|||||||||||||||||
g241        IMQRNHGIFCNSHICPFRNSRLITGAFX
              250        260
```

The following partial DNA sequence was identified in *N. meningitidis* <SEQ ID 909>:

```
a241.seq
   1 ATGCCAACAC GTCCAACTCG CGCCGCAAAG CATCCAACCC CGCCAACCTG

51 GCTTCAGACG GCATACTGCC CTCGTCCGCC ATATCGTCCG CCGTCCGTGC

101 AAACGCATAC ACCGCATGAA CCGGCTTCCT CAACCTGCGC GGCAAAATCA

151 GCGAACCGAC GGGAAAATTT TCATAATGCC CAACCGACAT ACCTTCTCCA

201 TCCATCAAAC AAAATGCCGT CTGAAATGGA ACAAACCCTT TTCAGACGGC

251 ATCAGATACC TCCAAGCTGC CGGCAATCAG TGGTGGTGAT GACCGTGCGG

301 ACCGTGGACA TGACCGTGTG CGATTTCCTC ATCGGATGCA TCGCGCACAC

351 TTTCAACCGT AGCCTTAAAG CGGATTTTCA TGCCTGCCAA AGGATGGTTG

401 CCGTCCACCA CCGCCTTACC GTCGGCAACA TCGGTTACAC GATAGACGAC

451 AACATCGCCG GTTTCAGGAT CGTCGGCTTC AAACATCATG CCGACTTCGA

501 CTTCAACAGG AACACGCCC GCATCTTCAA TACGGACCAA CTCCGGATCC

551 TGCTCGCCGA ACGCATCGTC GGGCGAAAGC GCCACATCGA CCGTATCGCC

601 GGCATCCTTA CCGTGCAACG CCTCTTCCAC CAAAGGGAAA ATGCCGTCGT

651 AACCGCCGTG CAGATACGCA ATCGGTTCTT CGGTTTTGTC CAAAAGCTGA

701 TTGTTGGCAT CATACATCTC ATAATGCAGC GAAACCACGG AATTCTTCAC

751 GATAGCCATA TTTGTCCTTT CAGGAACAGC AGATTAATTA CAGGCGCATT

801 CTAA
```

This corresponds to the amino acid sequence <SEQ ID 910; ORF 241.a>:

```
a241.pep
   1 MPTRPTRAAK HPTPPTWLQT AYCPRPPYRP PSVQTHTPHE PASSTCAAKS

51 ANRRENFHNA QPTYLLHPSN KMPSEMEQTL FRRHQIPPSC RQSVVVMTVR

101 TVDMTVCDFL IGCIAHTFNR SLKADFHACQ RMVAVHHRLT VGNIGYTIDD

151 NIAGFRIVGF KHHADFDFNR EHARIFNTDQ LRILLAERIV GRKHIDRIA

201 GILTVQRLFH QRENAVVTAV QIRNRFFGFV QKLIVGIIHL IMQRNHGILH

251 DSHICPFRNS RLITGAF*
``` m241/a241 96.0% identity in 177 aa overlap

```
                              10        20        30
m241.pep                      RQSVVVMTVRAVDMTVCDFLIGCIAHAFNC
                              ||||||||||:||||||||||||||||:||
a241     QPTYLLHPSNKMPSEMEQTLFRRHQIPPSCRQSVVVMTVRTVDMTVCDFLIGCIAHTFNR
              70        80        90       100       110       120
              40        50        60        70        80        90
m241.pep SLKADFHACQRMVAVHHRLAVGNIGYTIDDNIAGFRIVGFKHHADFDFNREHARIFDTDQ
         |||||||||||||||||||:||||||||||||||||||||||||||||||||||||:|||
a241     SLKADFHACQRMVAVHHRLTVGNIGYTIDDNIAGFRIVGFKHHADFDFNREHARIFNTDQ
             130       140       150       160       170       180
             100       110       120       130       140       150
m241.pep LRILLAERIVGRQRHIDRIAGILTVQRLFHQRENAVVTAVQIRNRFFGFVQKLIVGIIHL
         ||||||||||:|||||||||||||||||||||||||||||||||||||||||||||||||
a241     LRILLAERIVGRKRHIDRIAGILTVQRLFHQRENAVVTAVQIRNRFFGFVQKLIVGIIHL
             190       200       210       220       230       240
             160       170
m241.pep IMQRNHGIFHDSHICPFRNSRLITGAFX
         ||||||||:|||||||||||||||||||
a241     IMQRNHGILHDSHICPFRNSRLITGAFX
             250       260
```

The following partial DNA sequence was identified in *N. gonorrhoeae* <SEQ ID 911>:

```
g241-1.seq
   1 ATGATAGAAG TCATACATTT CTTCGGCACC GAAACGCGCA GACAGTTTGC

51 TTGTGCCGAC GTTGGACGAT TTCTGCATGA TGCCGCGCAC ATCCAAAGAG

101 GGGTAAACAT GGGTATCGCG CACGGGAGAC GGTCCGATTT TATAAGGCTG

151 CGTATTCAGC CGTTCGTTCA AATCGGTTTT GCCCGCATCC AATGCCTTCG

201 CAATCACAAA CGGTTTGATT GCCGAACCGG GTTCGATCAT ATCGGTTACG

251 GCACGGTTGC GCCGCTGTTC GCTGTCTGCC CGGCCGGGCC TGTTGGGATC

301 GTAGGCGGGC GTATTGGCCA AGGCGAGGAT TTCCCCCGTG CGGGCATCCA

351 ArACCACCAC CGTTCCGGCT TTTGCCTGAT GGTATTCGAC CGCCTTGTTC

401 AACTCTTCAT AGGCCAAGGT CTGAATCCTC TGATCGAGGG AAAGGATGAT

451 GTCTTTGCCG TTTTTCGGGG CTTTAkTGCG CGGGGAGTCC AAGCTGTCCA

501 CAATATTGCC CTGCCGGTCC CGCAAAACGA CTTCCGCGCC GTCTTCGCCA

551 TGCAAGCTGT CTTCAAGCGA AAGTTCCAAA CCTTCCTGAC CTTTGCCGTC

601 AATATCGGTA AATCCGATGA CGTGTGCAAA CAGGTTGCCC ATCGGGTAAT

651 GGCGTTTTAA
```

This corresponds to the amino acid sequence <SEQ ID 912; ORF 241-1.ng>:

```
g241-1.pep
   1 MPTRPTRAAN PPTPTTWLQT AYCPRPPYRP PSVQTHTPHE PASSTCAAKS

51 ANRRENSHNA QPTYLLHPSN KMPSETEQTL FRRHQIPPSC RQSVVVMTVR

101 TVDMTVCDFL IGCIAHAFNR SFKADFHACQ RMVAVHHRLA VGNIGYTIDD

151 NIAGFRIVRF KHHTDLDFNR ERARIFNTDQ LRIMLTERIV GRKRHFDRIA
```

```
201 GILTVQRLFH QRENAVVTAV QIRNRFFGFI QKLIVGIIHL IMQRNHGIFC

251 NSHICPFRNS RLITGAF*
```

The following partial DNA sequence was identified in *N. meningitidis* <SEQ ID 913>:

```
m241-1.seq
  1 ATGCCAACAC GTCCAACTCG CGCTGCAAAC CCTCCAACCC CGCCAACCTG

51 GCTTCAGACG GCATACTGCC CTCGTCCGCC ATATCGTCCG CCGTCCGTGC

101 AAACGCGTAC ACCGCGTGAA CCGGCTTCCT CAACCTGCGC GGCAAAATCA

151 GCGAACCGAC GGGAAAATTC TCATAATGCC CAACCGACAT ACCTTCTCCA

201 TCCATCAAAC AAAATGCCGT CTGAAACGGA ACAAACCCTT TTCAGACGGC

251 ATCAGATACC TCCAAGCTGC CGGCAATCAG TGGTGGTGAT GACCGTGCGG

301 GCCGTGGACA TGACCGTGTG CGATTTCCTC ATCGGATGCA TCGCGCACGC

351 TTTCAACTGT AGCCTTAAAG CGGATTTTCA TGCCTGCCAA AGGATGGTTG

401 CCGTCCACCA CCGCCTTGCC GTCGGCAACA TCGGTTACAC GATAGACGAC

451 AACATCGCCG GTTTCAGGAT CGTCGGCTTC AAACATCATG CCGACTTCGA

501 CTTCAACAGG GAACACGCCC GCATCTTCGA TACGGACCAA CTCCGGATCC

551 TGCTCGCCGA ACGCATCGTC GGGCGACAGC GCCACATCGA CCGTATCGCC

601 GGCATCCTTA CCGTGCAACG CCTCTTCCAC CAAAGGGAAA ATGCCGTCGT

651 AACCGCCGTG CAGATACGCA ATCGGTTCTT CGGTTTTGTC CAAAAGCTGA

701 TTGTTGGCAT CATACATCTC ATAATGCAGC GAAACCACGG AATTTTTCAC

751 GATAGCCATA TTTGTCCTTT CAGGAACAGC AGATTAATTA CAGGCGCATT

801 CTAA
```

This corresponds to the amino acid sequence <SEQ ID 914; ORF 241-1>:

```
m241-1.pep

1  MPTRPTRAAN PPTPPTWLQT AYCPRPPYRP PSVQTRTPRE PASSTCAAKS

51  ANRRENSHNA QPTYLLHPSN KMPSETEQTL FRRHQIPPSC RQSVVVMTVR

101  AVDMTVCDFL IGCIAHAFNC SLKADFHACQ RMVAVHHRLA VGNIGYTIDD

151  NIAGFRIVGF KHHADFDFNR EHARIFDTDQ LRILLAERIV GRQRHIDRIA

201  GILTVQRLFH QRENAVVTAV QIRNRFFGFV QKLIVGIIHL IMQRNHGIFH

251  DSHICPFRNS RLITGAF* m241-/g241-1     93.3% identity in 267 aa overlap 10         20         30         40         50         60
   m241-1.pep   MPTRPTRAANPPTPPTWLQTAYCPRPPYRPPSVQTRTPREPASSTCAAKSANRRENSHNA
                ||||||||||||| |||||||||||||||||||||||:||:|||||||||||||||||||
   g241         MPTRPTRAANPPTPTTWLQTAYCPRPPYRPPSVQTHTPHEPASSTCAAKSANRRENSHNA
                    10         20         30         40         50         60

70         80         90        100        110        120
   m241-1.pep   QPTYLLHPSNKMPSETEQTLFRRHQIPPSCRQSVVVMTVRAVDMTVCDFLIGCIAHAFNC
                ||||||||||||||||||||||||||||||||||||||||:|||||||||||||||||:
   g241         QPTYLLHPSNKMPSETEQTLFRRHQIPPSCRQSVVVMTVRTVDMTVCDFLIGCIAHAFNR
                    70         80         90        100        110        120

130        140        150        160        170        180
   m241-1.pep   SLKADFHACQRMVAVHHRLAVGNIGYTIDDNIAGFRIVGFKHHADFDFNREHARIFDTDQ
                |:||||||||||||||||||||||||||||||||||||:||||:||||||:||||:|||
   g241         SFKADFHACQRMVAVHHRLAVGNIGYTIDDNIAGFRIVRFKHHTDLDFNRERARIFNTDQ
                   130        140        150        160        170        180
```

-continued

```
                190       200       210       220       230       240
m241-1.pep   LRILLAERIVGRQRHIDRIAGILTVQRLFHQRENAVVTAVQIRNRFFGFVQKLIVGIIHL
             |||:|:||||||:||:||||||||||||||||||||||||||||||||:||||||||||
g241         LRIMLTERIVGRKRHFDRIAGILTVQRLFHQRENAVVTAVQIRNRFFGFIQKLIVGIIHL
                190       200       210       220       230       240

250       260
m241-1.pep   IMQRNHGIFHDSHICPFRNSRLITGAFX
             ||||||||||:|||||||||||||||||
g241         IMQRNHGIFCNSHICPFRNSRLITGAFX
                250       260
```

The following partial DNA sequence was identified in *N. meningitidis* <SEQ ID 915>:

```
a241-1.seq
  1 ATGCCAACAC GTCCAACTCG CGCCGCAAAG CATCCAACCC CGCCAACCTG

51 GCTTCAGACG GCATACTGCC CTCGTCCGCC ATATCGTCCG CCGTCCGTGC

101 AAACGCATAC ACCGCATGAA CCGGCTTCCT CAACCTGCGC GGCAAAATCA

151 GCGAACCGAC GGGAAAATTT TCATAATGCC CAACCGACAT ACCTTCTCCA

201 TCCATCAAAC AAAATGCCGT CTGAAATGGA ACAAACCCTT TTCAGACGGC

251 ATCAGATACC TCCAAGCTGC CGGCAATCAG TGGTGGTGAT GACCGTGCGG

301 ACCGTGGACA TGACCGTGTG CGATTTCCTC ATCGGATGCA TCGCGCACAC

351 TTTCAACCGT AGCCTTAAAG CGGATTTTCA TGCCTGCCAA AGGATGGTTG

401 CCGTCCACCA CCGCCTTACC GTCGGCAACA TCGGTTACAC GATAGACGAC

451 AACATCGCCG GTTTCAGGAT CGTCGGCTTC AACATCATG CCGACTTCGA

501 CTTCAACAGG GAACACGCCC GCATCTTCAA TACGGACCAA CTCCGGATCC

551 TGCTCGCCGA ACGCATCGTC GGGCGAAAGC GCCACATCGA CCGTATCGCC

601 GGCATCCTTA CCGTGCAACG CCTCTTCCAC CAAAGGGAAA ATGCCGTCGT

651 AACCGCCGTG CAGATACGCA ATCGGTTCTT CGGTTTTGTC CAAAAGCTGA

701 TTGTTGGCAT CATACATCTC ATAATGCAGC GAAACCACGG AATTCTTCAC

751 GATAGCCATA TTTGTCCTTT CAGGAACAGC AGATTAATTA CAGGCGCATT

801 CTAA
```

This corresponds to the amino acid sequence <SEQ ID 916; ORF 241-1.a>:

```
a244-1.pep

1 MPTRPTRAAK HPTPPTWLQT AYCPRPPYRP PSVQTHTPHE PASSTCAAKS

51 ANRRENFHNA QPTYLLHPSN KMPSEMEQTL FRRHQIPPSC RQSVVVMTVR

101 TVDMTVCDFL IGCIAHTFNR SLKADFHACQ RMVAVHHRLT VGNIGYTIDD

151 NIAGFRIVGF KHHADFDFNR EHARIFNTDQ LRILLAERIV GRKRHIDRIA

201 GILTVQRLFH QRENAVVTAV QIRNRFFGFV QKLIVGIIHL IMQRNHGILH

251 DSHICPFRNS RLITGAF*
``` m241-1/a241-1 95.1% identity in 267 aa overlap

```
                10        20        30        40        50        60
m241-1.pep   MPTRPTRAANPPTPPTWLQTAYCPRPPYRPPSVQTRTPREPASSTCAAKSANRRENSHNA
             |||||||||:|||||||||||||||||||||||||:||:||||||||||||||||| |||
a241         MPTRPTRAAKHPTPPTWLQTAYCPRPPYRPPSVQTHTPHEPASSTCAAKSANRRENFHNA
                10        20        30        40        50        60
```

```
                     70         80         90        100        110        120
m241-1.pep  QPTYLLHPSNKMPSETEQTLFRRHQIPPSCRQSVVVMTVRAVDMTVCDFLIGCIAHAFNC
            ||||||||||||||| ||||||||||||||||||||||:||||||||||||||:||
a241        QPTYLLHPSNKMPSEMEQTLFRRHQIPPSCRQSVVVMTVRTVDMTVCDFLIGCIAHTFNR
                     70         80         90        100        110        120

130        140        150        160        170        180
m241-1.pep  SLKADFHACQRMVAVHHRLAVGNIGYTIDDNIAGFRIVGFKHHADFDFNREHARIFDTDQ
            ||||||||||||||||||||:|||||||||||||||||||||||||||||||||||:|||
a241        SLKADFHACQRMVAVHHRLTVGNIGYTIDDNIAGFRIVGFKHHADFDFNREHARIFNTDQ
                    130        140        150        160        170        180

190        200        210        220        230        239
m241-1.pep  LRILLAERIVGRQRHIDRIAGILTVQRLFHQRENAVVTAVQIRNRFFGFVQKLIVGIIHL
            ||||||||||||:|||||||||||||||||||||||||||||||||||||||||||||||
a241        LRILLAERIVGRKRHIDRIAGILTVQRLFHQRENAVVTAVQIRNRFFGFVQKLIVGIIHL
                    190        200        210        220        230        240

250        260
m241-1.pep  IMQRNHGIFHDSHICPFRNSRLITGAFX
            ||||||||:|||||||||||||||||||
a241        IMQRNHGILHDSHICPFRNSRLITGAFX
                    250        260
```

The following partial DNA sequence was identified in *N. gonorrhoeae* <SEQ ID 917>:

```
g242.seq
  1 atgatcggcg aacttgttgt tttgttcgtg atcgagcact tcaagcaacg
 51 cgctggcggg atcgccccga aagtcgctgc ccaatttgtc gatttcgtcg
101 agcaggaaca acgggtttct tacgcctgct tttgccatat tctgcaaaat
151 cttgccgggc atagagccga tataggtacg gcggtgcccg cggatttcgc
201 tttcgtcgcg cacgccgccc aaggccatac ggacatattt ccgccccgtt
251 gctttggcga tggattcgcc caaagaggtt ttgcccacgc ccggagggcc
301 gaccaaacac agaatcggac ctttgagctt gtccatacgt ttttggacgg
351 cgaggtattc caaaatccgt tctttgactt tttccaggcc gtagtggtcg
401 gcatccagca ccagtccggc tttggcgatg tctttgctga cgcgggattt
451 tttcttccac ggcagtccga gcagggtgtc gatgtagttg cgtacgacgg
501 tggattcggc agacatcggc ggcatcattt tgagtttttt cagttcggac
551 aggcatttt cttccgcttc tttggtcata cccgcctttt tgatgcctgc
601 ctccaaggca tccagttcgc cgttttcgtc ttcttcgccc aattctttgt
651 gtatcgcttt aatctgttcg ttcagataat attcgcgttg ggattttcc
701 atttggcgtt tgacgcgtcc gcgtatgcgt ttttcggcct gcataatgtc
751 gagttcggat tccagctttg ccagcaggaa ttccatccgt ttgccgattt
801 cgggaatctc caaaatctgt tggcgttgcg ccagtttcaa ctgcaaatgc
851 gctgcgaccg tatcggttag
```

This corresponds to the amino acid sequence <SEQ ID 918; ORF 242.ng>:

```
g242.pep
  1 MIGELVVLFV IEHFKQRAGG IAPKVAAQFV DFVEQEQRVS YACFCHILQN

51 LAGHRADIGT AVPADFAFVA HAAQGHTDIF PPRCFGDGFA QRGFAHARRA
```

-continued

```
101 DQTQNRTFEL VHTFLDGEVF QNPFFDFFQA VVVGIQHQSG FGDVFADAGF

151 FLPRQSEQGV DVVAYDGGFG RHRRHHFEFF QFGQAFFFRF FGHTRLFDAC

201 LQGIQFAVFV FFAQFFVYRF NLFVQIIFAL GFFHLAFDAS AYAFFGLHNV

251 EFGFQLCQQE FHPFADFGNL QNLLALRQFQ LQMRCDRIG*
```

The following partial DNA sequence was identified in *N. meningitidis* <SEQ ID 919>:

```
m242.seq
  1 ATGATCGGCA AACTTGTTGT TTTGTTCGGG ATCGAGCACT TCGAGCAACG

51 CGCTGGCGGG ATCGCCTCGG AAGTCGTTAC CCAATTTGTC GATTTCGTCG

101 AGCAGGAACA AGGGGTTTTT CACGCCGGCT TTTGCCATAT TCTGCAAAAT

151 CTTACCGGGC ATAGAGCCGA TATAGGTGCG GCGGTGTCCC CTGATTTCGC

201 TTTCGTCGCG CACGCCGCCC AAAGCCATGC GGACATATTT CCGCCCCGTT

251 GCTTTGGCGA TGGATTCGCC CAAAGAGGTT TTGCCCACGC CCGGAGGGCC

301 GACCAGGCAC AGAATCGGGC CTTTGAGTTT GTCCATACGT TTTTGGACGG

351 CGAGGTATTC CAAAATCCGT TCTTTGACTT TTTCCAGGCC GTAGTGGTCG

401 GCATCCAGCA CCAGTCCGGC TTTGGCGATG TCTTTGCTGA CGCGGGATTT

451 TTTCTTCCAC GGCAGCTCGA GCAAAGTGTC GATGTAGTTG CGTACGACGG

501 TGGATTCCGC AGACATCGGT GGCATCATTT TGAGCTTTTT CAGTTCGGAC

551 AGGCATTTTT CTTCCGCTTC TTTGGTCATA CCCGCCTTTT TGATATCTGC

601 TTCCAAGGCA TCCAGTTCGC CGTTTTCGTC TTCTTCGCCC AGTTCTTTGT

651 GTATCGCTTT AATCTGTTCG TTCAGATAAT ATTCGCGCTG GGATTTTTCC

701 ATTTGGCGTT TGACGCGTCC GCGTATGCGT TTTTCGGCCT GCATAATGTC

751 GAGTTCGGAT TCCAGCTGTG CCAGCAGGAA TTCCATCCGT TTGCCGATTT

801 CGGGAATTTC CAAAATCTGT TGGCGTTGCG CCAGTTTCAA CTGCAAATGC

851 GCTGCGACCG TATCGGTTAG
```

This corresponds to the amino acid sequence <SEQ ID 920; ORF 242>:

```
m242.pep
  1 MIGKLVVLFG IEHFEQRAGG IASEVVTQFV DFVEQEQGVF HAGFCHILQN

51 LTGHRADIGA AVSPDFAFVA HAAQSHADIF PPRCFGDGFA QRGFAHARRA

101 DQAQNRAFEF VHTFLDGEVF QNPFFDFFQA VVVGIQHQSG FGDVFADAGF

151 FLPRQLEQSV DVVAYDGGFR RHRWHHFELF QFGQAFFFRF FGHTRLFDIC

201 FQGIQFAVFV FFAQFFVYRF NLFVQIIFAL GFFHLAFDAS AYAFFGLHNV

251 EFGFQLCQQE FHPFADFGNF QNLLALRQFQ LQMRCDRIG*
```

Computer analysis of this amino acid sequence gave the following results:

Homology with a Predicted ORF from *N. gonorrhoeae*

ORF 242 shows 90.3% identity over a 289 aa overlap with a predicted ORF (ORF 242.ng) from *N. gonorrhoeae*:

```
m242/g24290.3% identity in 289 aa overlap
                    10        20        30        40        50        60
     m242.pep  MIGKLVVLFGIEHFEQRAGGIASEVVTQFVDFVEQEQGVFHAGFCHILQNLTGHRADIGA
               |||:||||| ||||:|| |||| :|::||||||||||| |:| ||||||||:||||||:
     g242      MIGELVVLFVIEHFKQRAGGIAPKVAAQFVDFVEQEQRVSYACFCHILQNLAGHRADIGT
                    10        20        30        40        50        60

70        80        90       100       110       120
     m242.pep  AVSPDFAFVAHAAQSHADIFPPRCFGDGFAQRGFAHARRADQAQNRAFEFVHTFLDGEVF
               || |||||||||||:|:|||||||||||||||||||||||||:|||:||:|||||||| 
     g242      AVPADFAFVAHAAQGHTDIFPPRCFGDGFAQRGFAHARRADQTQNRTFELVHTFLDGEVE
                    70        80        90       100       110       120

130       140       150       160       170       180
     m242.pep  QNPFFDFFQAVVVGIQHQSGFGDVFADAGFFLPRQLEQSVDVVAYDGGFRRHRWHHFELF
               |||||||||||||||||||||||||||||||||||: ||:|||||||||:||:||||:|
     g242      QNPFFDFFQAVVVGIQHQSGFGDVFADAGFFLPRQSEQGVDVVAYDGGFGRHRRHHFEFF
                   130       140       150       160       170       180

190       200       210       220       230       240
     m242.pep  QFGQAFFFRFFGHTRLFDICFQGIQFAVFVFFAQFFVYRFNLFVQIIFALGFFHLAFDAS
               |||||||||||||||||||:|:||||||||||||||||||||||||||||||||||||||
     g242      QFGQAFFFRFFGHTRLFDACLQGIQFAVFVFFAQFFVYRFNLFVQIIFALGFFHLAFDAS
                   190       200       210       220       230       240

250       260       270       280       290
     m242.pep  AYAFFGLHNVEFGFQLCQQEFHPFADFGNFQNLLALRQFQLQMRCDRIGX
               ||||||||||||||||||||||||||||||:|||||||||||||||||||
     g242      AYAFFGLHNVEFGFQLCQQEFHPFADFGNLQNLLALRQFQLQMRCDRIGX
                   250       260       270       280
```

The following partial DNA sequence was identified in *N. meningitidis* <SEQ ID 921>:

```
a242.seq
   1 ATGATCGGCG AACTTGTTGT TTTGCTCGGG ATCAAGCACT TCGAGCAACG

51 CGCTGGCGGG ATCGCCCCGG AAGTCGCTAN CCAATTTGTC GATTTCGTCG

101 AGCAGGAACA ATGGGTTTTT TACGCCGGCT TTTGCCATAT TCTGCAAAAT

151 CTTACCGGGC ATGGAGCCGA TATAGGTGCG GCGGTGTCCC CGGATTTCGC

201 TTTCGTCGCG CACGCCGCCC AAAGCCATGC GGACATATTT CCGCCCCGTT

251 GCTTTGGCGA TGGATTCGCC CAAAGAGGTT TTGCCCACGC CTGGAGGGCC

301 GACCAGGCAC AGAATCGGGC CTTTGAGTTT GTCCATACGT TTTTGGACGG

351 CGAGGTATTC CAAAATCCGT TCTTTGACTT TTTCCAGGCC GTAGTGGTCG

401 GTATCCAGCA CCAATCCGGC TTTGGCGATG TCTTTGCTGA CGCGGGATTT

451 TTTCTTCCAC GGCAGTTCGA GCAGGGTGTC GATGTAGTTG CGTACGACGG

501 TGGATTCGGC AGACATCGGC GGCATCATTT TGAGCTTTTT CAGTTCGGAC

551 AGGCATTTTT CTTCCGCTTC TTTGGTCATA CCCGCCTTTT TGATATCTGC

601 TTCCAAGGCA TCCAGTTCGC CGTTTTCGTC TTCTTCGCCC AGTTCTTTGT

651 GTATCGCTTT AATCTGTTCG TTCAGATAAT ATTCGCGCTG GGATTTTTCC

701 ATTTGGCGTT TGACGCGTCC GCGTATGCGT TTTTCGGCCT GCATAATGTC

751 GAGTTCGGAT TCCAGCTGTG CCAGCAGGAA TTCCATCCGT TGCCGATTT

801 CGGGAATTTC CAAAATCTGT TGGCGTTGCG CCAGTTTCAA CTGCAAATGC

851 GCTGCGACCG TATCGGTTAG
```

This corresponds to the amino acid sequence <SEQ ID 922; ORF 242.a>:

```
a242.pep
   1 MIGELVVLLG IKHFEQRAGG IAPEVAXQFV DFVEQEQWVF YAGFCHILQN

51 LTGHGADIGA AVSPDFAFVA HAAQSHADIF PPRCFGDGFA QRGFAHAWRA

101 DQAQNRAFEF VHTFLDGEVF QNPFFDFFQA VVVGIQHQSG FGDVFADAGF

151 FLPRQFEQGV DVVAYDGGFG RHRRHHFELF QFGQAFFFRF FGHTRLFDIC

201 FQGIQFAVFV FFAQFFVYRF NLFVQIIFAL GFFHLAFDAS AYAFFGLHNV

251 EFGFQLCQQE FHPFADFGNF QNLLALRQFQ LQMRCDRIG*
``` m242/a242 95.2% identity in 289 aa overlap

```
                  10         20         30         40         50         60
   m242.pep  MIGKLVVLFGIEHFEQRAGGIASEVVTQFVDFVEQEQGVFHAGFCHILQNLTGHRADIGA
             ||| :||||:||:||||||||||   ||::|||||||||||   ||:|||||||||| |||||
   a242      MIGELVVLLGIKHFEQRAGGIAPEVAXQFVDFVEQEQWVFYAGFCHILQNLTGHGADIGA
                  10         20         30         40         50         60

70         80         90        100        110        120
   m242.pep  AVSPDFAFVAHAAQSHADIFPPRCFGDGFAQRGFAHARRADAQNRAFEFVHTFLDGEVF
             ||||||||||||||||||||||||||||||||||||||| ||||||||||||||||||
   a242      AVSPDFAFVAHAAQSHADIFPPRCFGDGFAQRGFAHAWRADAQNRAFEFVHTFLDGEVE
                  70         80         90        100        110        120

130        140        150        160        170        180
   m242.pep  QNPFFDFFQAVVVGIQHQSGFGDVFADAGFFLPRQLEQSVDVVAYDGGFRRHRWHHFELF
             ||||||||||||||||||||||||||||||||||||:||:|||||||||| ||| ||||||
   a242      QNPFFDFFQAVVVGIQHQSGFGDVFADAGFFLPRQFEQGVDVVAYDGGFGRHRRHHFELF
                 130        140        150        160        170        180

190        200        210        220        230        240
   m242.pep  QFGQAFFFRFFGHTRLFDICFQGIQFAVFVFFAQFFVYRFNLFVQIIFALGFFHLAFDAS
             ||||||||||||||||||||||||||||||||||||||||||||||||||||||||||||
   a242      QFGQAFFFRFFGHTRLFDICFQGIQFAVFVFFAQFFVYRFNLFVQIIFALGFFHLAFDAS
                 190        200        210        220        230        240

250        260        270        280        290
   m242.pep  AYAFFGLHNVEFGFQLCQQEFHPFADFGNFQNLLALRQFQLQMRCDRIGX
             |||||||||||||||||||||||||||||||||||||||||||||||||
   a242      AYAFFGLHNVEFGFQLCQQEFHPFADFGNFQNLLALRQFQLQMRCDRIGX
                 250        260        270        280
```

The following partial DNA sequence was identified in *N. gonorrhoeae* <SEQ ID 923>:

```
g243.seq
   1 ATGGTaatcg tctGGTTGCc cgAGTTaccg CCGATGCCGG CGACGATGGG

51 CATCAGCGCG GCGAGTGCGA CGATTTTTTC gatactgcCT TCAAACGCGC

101 CGATGACGCG GCTGGCGAGG AAGGCGGTGC AGAGGTTGAC GGCGAGCCAC

151 ATCCAGCGGT TTTTGACGGA ATCCAAGACG GGGGCGAACA GGTCTTCCTC

201 TTCCTGCAAA CCTGCCATGT TCAACATATC CGCTTCGGAT TCTTCGCGGA

251 TCACGTCCAC CATCTCGTCG ATGGTAATCc tgCCGATGAG CTTTTTGTTT

301 TCATCAACGA CGGGCGCGGT AACCAAGTCG TAG
```

This corresponds to the amino acid sequence <SEQ ID 924; ORF 243.ng>:

```
g243.pep
  1 MVIVWLPELP PMPATMGISA ASATIFSILP SNAPMTRLAR KAVQRLTASH

51 IQRFLTESKT GANRSSSSCK PAMFNISASD SSRITSTISS MVILPMSFLF

101 SSTTGAVTKS *
```

The following partial DNA sequence was identified in *N. meningitidis* <SEQ ID 925>:

```
m243.seq
  1 ATGGTAATCG TCTGGTTGCC CGAGTTACCG CCTATGCCGG CGACGATGGG

51 CATCAGCGCG GyGAGTGCGA CGATTTTTTC GATGCTGCCT TCAAACGCGC

101 CGATAACACG GyTGGCGAGG AAGGCGGTGC AGAGGTTGAC GGCGAGCCAC

151 ATCCAGyGGT TTTTCACCGA ATCCCACACG GGGGCGAAyA GGTCTTCCTC

201 TTCCTGCAAA CCCGCCATAT TCAGCATATC CGCTTCCGAT TCTTCGCGGA

251 TCACGTCCAC CATCTCGTCG ATGGTAATCC TGCCGATGAG CTTTTTGTTT

301 TCATCGACGA CGGGCGCGGT AACCAAGTCG TAG
```

This corresponds to the amino acid sequence <SEQ ID 926; ORF 243>:

```
m243.pep
  1 MVIVWLPELP PMPATMGISA XSATIFSMLP SNAPITRLAR KAVQRLTASH

51 IQXFFTESHT GANRSSSSCK PAIFSISASD SSRITSTISS MVILPMSFLF

101 SSTTGAVTKS *
```

Computer analysis of this amino acid sequence gave the following results:
Homology with a Predicted ORF from *N. gonorrhoeae*
ORF 243 shows 92.7% identity over a 110 aa overlap with a predicted ORF (ORF 243.ng) from *N. gonorrhoeae*:

```
m243/g243
                    10        20        30        40        50        60
   m243.pep   MVIVWLPELPPMPATMGISAXSATIFSMLPSNAPITRLARKAVQRLTASHIQXFFTESHT
              ||||||||||||||||||| ||||||:||||||:||||||||||||||||| :|||:|
   g243       MVIVWLPELPPMPATMGISAASATIFSILPSNAPMTRLARKAVQRLTASHIQRFLTESKT
                    10        20        30        40        50        60

70        80        90       100       110
   m243.pep   GANRSSSSCKPAIFSISASDSSRITSTISSMVILPMSFLFSSTTGAVTKSX
              ||||||||||| :|:|||||||||||||||||||||||||||||||||||
   g243       GANRSSSSCKPAMFNISASDSSRITSTISSMVILPMSFLFSSTTGAVTKSX
                    70        80        90       100       110
```

The following partial DNA sequence was identified in *N. meningitidis* <SEQ ID 927>:

```
a243.seq
  1 ATGGTAATCG TCTGGTTGCC CGAGTTACCG CCTATGCCGG CGACGATGGG

51 CATCAGCGCG GCGAGTGCGA CGATTTTTTC GATGCTGCCT TCAAACGCGC

101 CGATAACACG GCTGGCGAGG AAGGCGGTGC AGAGGTTGAC GGCGAGCCAC

151 ATCCAGCGGT TTTTGACGGA ATCCAAGACG GGGGCGAATA AGTCTTCCTC

201 TTCTTGCAAA CCCGCCATAT TCAACATATC CGCTTCGGAT TCTTCGCGGA
```

```
251 TCACGTCCAC CATTTCGTCA ACGGTCACCC TGCCGATGAG CTTTTTGTTT

301 TCATCGACGA CGGGCGCGGT AACCAAGTCA TAG
```

This corresponds to the amino acid sequence <SEQ ID 928; ORF 243.a>:

```
a243.pep
  1 MVIVWLPELP PMPATMGISA ASATIFSMLP SNAPITRLAR KAVQRLTASH

51 IQRFLTESKT GANKSSSSCK PAIFNISASD SSRITSTISS TVTLPMSFLF

101 SSTTGAVTKS *
``` m243/a243 92.7% identity in 110 aa overlap

```
                    10         20         30         40         50         60
    m243.pep  MVIVWLPELPPMPATMGISAXSATIFSMLPSNAPITRLARKAVQRLTASHIQXFFTESHT
              |||||||||||||||||||| |||||||||||||||||||||||||||||| :|||:|
    a243      MVIVWLPELPPMPATMGISAASATIFSMLPSNAPITRLARKAVQRLTASHIQRFLTESKT
                    10         20         30         40         50         60

70         80         90        100        110
    m243.pep  GANRSSSSCKPAIFSISASDSSRITSTISSMVILPMSFLFSSTTGAVTKSX
              |||:||||||||||:||||||||||||||| ||||||||||||||||||||
    a243      GANKSSSSCKPAIFNISASDSSRITSTISSTVTLPMSFLFSSTTGAVTKSX
                    70         80         90        100        110
```

30

The following partial DNA sequence was identified in *N. gonorrhoeae* <SEQ ID 929>:

```
g244.seq
   1 atgccgcctg aagcccggcc ggcgggttca gacggcattg ccgctttact 51 tcgatcggtt tatacgcaaa acgcgcttca ggaaataaat cagattattc 101 cccagacgcc ttcaggcttc cttccgtgcc accgtaacca tagccgggcg 151 caacacacgg tcggacaggg tataacccct cttcatcaca ccaaccacgg 201 tattgggttc ctgctcactg gccaccgcct gcatcgcctg atggatattc 251 ggatcgagct tatcgcccgc tttaggattg atttccttga tttgcgtggc 301 atcaaacgcc ttctgcaact cattcaaagt catctgcaca cccattttca 351 gcgcatcgaa attaccgctc tgatccaaaa gcgccatttc cagataatcc 401 ttgaccggca catttccac ggcaaacttc tgtccggcga acttgtgcgt 451 atcggcaatt tcctgctggt ggcggcggcg caggttttgc tcgtttgcca 501 aagcgcgcag ttgttcgtct ttcaactgcg cttccagctc ggcaatccgc 551 gcctgcaaat cctcataagc cggctcggcg gcagcctgtt cctgtacacc 601 gtccgcattt cctactgtct cgacggtttc caccgcctcc acattttcaa 651 ccgcttcttc actgtttttgc tgctgtgtct gttcgctcat atcgtatccc 701 tcaaaacaaa ttggaaatca aaatccggtt attacccgag caagataagg 751 acattttcaa gaaacttcaa gcaaaggcag gaaatttcac atccgccgcc 801 gaatacccta ccgcaaaaac catataaacg gtaa
```

This corresponds to the amino acid sequence <SEQ ID 930; ORF 244.ng>:

```
g244.pep
   1 MPPEARPAGS DGIAALLRSV YTQNALQEIN QIIPQTPSGF LPCHRNHSRA

51 QHTVGQGITL LHHTNHGIGF LLTGHRLHRL MDIRIELIAR FRIDFLDLRG

101 IKRLLQLIQS HLHTHFQRIE ITALIQKRHF QIILDRQHFH GKLLSGELVR

151 IGNFLLVAAA QVLLVCQSAQ LFVFQLRFQL GNPRLQILIS RLGGSLFLYT

201 VRISYCLDGF HRLHIFNRFF TVLLLCLFAH IVSLKTNWKS KSGYYPSKIR

251 TFSRNFKQRQ EISHPPPNTL PQKPYKR*
```

The following partial DNA sequence was identified in *N. meningitidis* <SEQ ID 931>:

```
m244.seq
   1 ATGCCGTCTG AAGCCCGACA GGCGGGTTCA GACGGCATTG CCGCTTTACT

51 TCGATCGGTT TATACGCAAA ACGCGCTTCA GGAAATAAAT CAGATTATTC

101 CCCAGACGCC TTCAGGCTTC CTTCTGCGCC ACCGTAACCA TAGCCGGGCG

151 CAACACGCGG TCGGACAGCG TATAACCCTT CTTCATCACA CCCACCACGG

201 TATTCGGCTC CTGTTCGCTT GCCACCGCCT GCATCGCCTG ATGGATATTC

251 GGATCGAGCT TATCGCCCGC TTTAGGGTTG ATTTCCTTGA TTTGCGTAGC

301 ATCAAATGCT TCTGCAACT CGTTCAAAGT CATCTGCACG CCCATTTTCA

351 GCGCATCGAA ATTGCCGCTC TGATCCAAAA GCGCCATTTC CAGATAATCC

401 TTGACCGGCA GCATTTCCAC GGCAAACTTC TGTCCGGCGA ACTTGTGCGT

451 ATCCGCAATT TyCTGCTGGT GGCGGCGGCG CAGGTTTTGC TCGTTTGCCA

501 AAGCGCGCTG CTCGTCTTTC AACTGCGTTT CCAGCTCGGC AATCCGCGCC

551 TGCAAATCCT CATAAGCCGG CTCTGCGGCA GCCTGTTCCT GCACACCGTC

601 CGCATTTCCT ACTGTTTCGA CGGTTTCCAC CGCCTCCACA TTTTCAACCG

651 CTTCTTCACT GTTTTGCTGC TGTGTCTGTT CGCTCATATC GTATCCCTTA

701 AAACAAATTG GAAATCAAAA TCCAGTTATT ACCCGCGCAA GATAAGGACA

751 TTTTCAAGAA ACTTCAAkCA AAAkCAGAGA ATTTCAAATT CATTTTCAAA

801 TCCCCTACCG AAAAAATAAT ATAGACGGTA A
```

This corresponds to the amino acid sequence <SEQ ID 932; ORF 244>:

```
m244.pep
   1 MPSEARQAGS DGIAALLRSV YTQNALQEIN QIIPQTPSGF LLRHRNHSRA

51 QHAVGQRITL LHHTHHGIRL LFACHRLHRL MDIRIELIAR FRVDFLDLRS

101 IKCFLQLVQS HLHAHFQRIE IAALIQKRHF QIILDRQHFH GKLLSGELVR

151 IRNFLLVAAA QVLLVCQSAL LVFQLRFQLG NPRLQILISR LCGSLFLHTV

201 RISYCFDGFH RLHIFNRFFT VLLLCLFAHI VSLKTNWKSK SSYYPRKIRT

251 FSRNFXQXQR ISNSFSNPLP KKXYRR*
```

Computer analysis of this amino acid sequence gave the following results:
Homology with a Predicted ORF from *N. gonorrhoeae*
ORF 244 shows 86.3% identity over a 277 aa overlap with a predicted ORF (ORF 244.ng) from *N. gonorrhoeae*:

```
M244/G244

10         20         30         40         50         60
    m244.pep  MPSEARQAGSDGIAALLRSVYTQNALQEINQIIPQTPSGFLLRHRNHSRAQHAVGQRITL
              ||  ||| ||||||||||||||||||||||||||||||||| ||||||||:||| |||
    g244      MPPEARPAGSDGIAALLRSVYTQNALQEINQIIPQTPSGFLPCHRNHSRAQHTVGQITL
                    10         20         30         40         50         60

70         80         90        100        110        120
    m244.pep  LHHTHHGIRLLFACHRLHRLMDIRIELIARFRVDFLDLRSIKCFLQLVQSHLHAHFQRIE
              ||||:|||  :|::|||||||||||||||||:||||||:|| :|||:||||:||||||
    g244      LHHTNHGIGFLLTGHRLHRLMDIRIELIARFRIDFLDLRGIKRLLQLIQSHLHTHFQRIE
                    70         80         90        100        110        120

130        140        150        160        170        180
    m244.pep  IAALIQKRHFQIILDRQHFHGKLLSGELVRIRNFLLVAAAQVLLVCQSAALLVFQLRFQL
              |:||||||||||||||||||||||||||||| |||||||||||||||||| |:||||||||
    g244      ITALIQKRHFQIILDRQHFHGKLLSGELVRIGNFLLVAAAQVLLVCQSAQLFVFQLRFQL
                   130        140        150        160        170        180

190        200        210        220        230        240
    m244.pep  GNPRLQILISRLCGSLFLHTVRISYCFDGFHRLHIFNRFFTVLLLCLFAHIVSLKTNWKS
              |||||||||||| |||| |:||||||:|||||||||||||||||||||||||||||||||
    g244      GNPRLQILISRLGGSLFLYTVRISYCLDGFHRLHIFNRFFTVLLLCLFAHIVSLKTNWKS
                   190        200        210        220        230        240

250        260        270
    m244.pep  KSSYYPRKIRTFSRNFXQXQRISNSFSNPLPKKXYRRX
              ||:||| ||||||||||| |:||:   | ||:| |:||
    g244      KSGYYPSKIRTFSRNFKQRQEISHPPPNTLPQKPYKRX
                   250        260        270
```

The following partial DNA sequence was identified in *N. meningitidis* <SEQ ID 933>:

```
a244.seq
  1 ATGCCGTCTG AAGCCCGACA GGCGGGTTCA GACGGCATTG CCGCTTTACT

51 TCGATCGGTT TATACGCAAA ACGCGCTTCA GGAAATAAAT CAGATTATTC

101 CCCAGACGCC TTCAGGCTTC CTTCTGTGCC ACCGTAACCA TAGCCGGGCG

151 CAACACGCGG TCGGACAGCG TATAACCCTT CTTCATCACG CCCACCACGG

201 TATTGGGTTC CTGTTCGCTT GCCACCGCCT GCATCGCCTG ATGGATATTC

251 GGATCGAGCT TATCGCCCGC TTTAGGATTG ATTTCCTTGA TTTGCGTAGC

301 ATCAAATGCT TTCTGCAACT CGTTCAAAGT CATCTGCACG CCCATTTTCA

351 GCGCATCGAA ATTGCCGCTC TGATCCAAAA GCGCCATTTC CAGATAATCC

401 TTGACCGGCA GCATTTCCAC GGCAAACTTC TGTCCGGCGA ACTTGTGCGT

451 ATCCGCAATT TCCTGCTGGT GGCGGCGGCG CAGGTTTTGC TCGTTTGCCA

501 AAGCGCGCAG CTGCTCGTCT TTCAACTGCG CTTCCAGCTC GGCAATCCGC

551 GCCTGCAAAT CCTCATAAGC CGGCTCTGCG GCAGCCTGTT CCTGCACACC

601 GTCCGCATTT CCTACTGTCT CGACGGTTTC CACCGCCTCC ACATTTTCAA

651 CCGCTTCTTC ACTGTTTTGC TGCTGTGTCT GTTCGCTCAT ATCGTATCCC

701 TTAAAACAAA TTGGAAATCA AAATCCAGTT ATTACCCGCG CAAGATAAGG
```

-continued
```
751 ACATTTTCAA GAAACTTCAA GCAAAGGCAG AGAATTTCAA ATTCATTTTC

801 AAATCCCCTA CCGAAAAAAT AATATAGACG GTAA
```

This corresponds to the amino acid sequence <SEQ ID 934; ORF 244.a>:

```
a244.pep
  1 MPSEARQAGS DGIAALLRSV YTQNALQEIN QIIPQTPSGF LLCHRNHSRA

51 QHAVGQRITL LHHAHHGIGF LFACHRLHRL MDIRIELIAR FRIDFLDLRS

101 IKCFLQLVQS HLHAHFQRIE IAALIQKRHF QIILDRQHFH GKLLSGELVR

151 IRNFLLVAAA QVLLVCQSAQ LLVFQLRFQL GNPRLQILIS RLCGSLFLHT

201 VRISYCLDGF HRLHIFNRFF TVLLLCLFAH IVSLKTNWKS KSSYYPRKIR

251 TFSRNFKQRQ RISNSFSNPL PKK*YRR*
``` m244/a244 96.8% identity in 277 aa overlap

```
                  10         20         30         40         50         60
    m244.pep  MPSEARQAGSDGIAALLRSVYTQNALQEINQIIPQTPSGFLLRHRNHSRAQHAVGQRITL
              ||||||||||||||||||||||||||||||||||||||||||  ||||||||||||||||
    a244      MPSEARQAGSDGIAALLRSVYTQNALQEINQIIPQTPSGFLLCHRNHSRAQHAVGQRITL
                  10         20         30         40         50         60

70         80         90        100        110        120
    m244.pep  LHHTHHGIRLLFACHRLHRLMDIRIELIARFRVDFLDLRSIKCFLQLVQSHLHAHFQRIE
              |||:||||  :|||||||||||||||||||||:|||||||||||||||||||||||||||
    a244      LHHAHHGIGFLFACHRLHRLMDIRIELIARFRIDFLDLRSIKCFLQLVQSHLHAHFQRIE
                  70         80         90        100        110        120

130        140        150        160        170        179
    m244.pep  IAALIQKRHFQIILDRQHFHGKLLSGELVRIRNFLLVAAAQVLLVCQSA-LLVFQLRFQL
              |||||||||||||||||||||||||||||||||||||||||||||||| ||||||||||
    a244      IAALIQKRHFQIILDRQHFHGKLLSGELVRIRNFLLVAAAQVLLVCQSAQLLVFQLRFQL
                 130        140        150        160        170        180

190        200        210        220        230        239
    m244.pep  GNPRLQILISRLCGSLFLHTVRISYCFDGFHRLHIFNRFFTVLLLCLFAHIVSLKTNWKS
              ||||||||||||||||||||||||||:|||||||||||||||||||||||||||||||||
    a244      GNPRLQILISRLCGSLFLHTVRISYCLDGFHRLHIFNRFFTVLLLCLFAHIVSLKTNWKS
                 190        200        210        220        230        240

250        260        270
    m244.pep  KSSYYPRKIRTFSRNFXQXQRISNSFSNPLPKKXYRRX
              |||||||||||||||||| |||||||||||||||||||
    a244      KSSYYPRKIRTFSRNFKQRQRISNSFSNPLPKKXYRRX
                 250        260        270
```

The following partial DNA sequence was identified in *N. gonorrhoeae* <SEQ ID 935>:

```
g244-1.seq
  1 atgccgcctg aagcccggcc ggcgggttca gacggcattg ccgctttact 51 tcgatcggtt tatacgcaaa acgcgcttca ggaaataaat cagattattc 101 cccagacgcc ttcaggcttc cttccgtgcc accgtaacca tagccgggcg 151 caacacacgg tcggacaggg tataaccctt cttcatcaca ccaaccacgg 201 tattgggttc ctgctcactg gccaccgcct gcatcgcctg atggatattc 251 ggatcgagct tatcgcccgc tttaggattg atttccttga tttgcgtggc 301 atcaaacgcc ttctgcaact cattcaaagt catctgcaca cccatttca
```

-continued

```
351 gcgcatcgaa attaccgctc tgatccaaaa gcgccatttc cagataatcc 401 ttgaccggca acatttccac ggcaaacttc tgtccggcga acttgtgcgt 451 atcggcaatt tcctgctggt ggcggcggcg caggttttgc tcgtttgcca 501 aagcgcgcag ttgttcgtct ttcaactgcg cttccagctc ggcaatccgc 551 gcctgcaaat cctcataagc cggctcggcg gcagcctgtt cctgtacacc 601 gtccgcattt cctactgtct cgacggtttc caccgcctcc acattttcaa 651 ccgcttcttc actgttttgc tgctgtgtct gttcgctcat atcgtatccc 701 tcaaaacaaa ttggaaatca aaatccggtt attacccgag caagataagg 751 acattttcaa gaaacttcaa gcaaaggcag gaaatttcac atccgccgcc 801 gaataccata ccgcaaaaac catataaacg gtaa
```

This corresponds to the amino acid sequence <SEQ ID 936; ORF 244-1.ng>:

```
g244-1.pep
  1 MPPEARPAGS DGIAALLRSV YTQNALQEIN QIIPQTPSGF LPCHRNHSRA

51 QHTVGQGITL LHHTNHGIGF LLTGHRLHRL MDIRIELIAR FRIDFLDLRG

101 IKRLLQLIQS HLHTHFQRIE ITALIQKRHF QIILDRQHFH GKLLSGELVR

151 IGNFLLVAAA QVLLVCQSAQ LFVFQLRFQL GNPRLQILIS RLGGSLFLYT

201 VRISYCLDGF HRLHIFNRFF TVLLLCLFAH IVSLKTNWKS KSGYYPSKIR

251 TFSRNFKQRQ EISHPPPNTL PQKPYKR*
```

The following partial DNA sequence was identified in N. meningitidis <SEQ ID 937>:

```
m244-1.seq
  1 ATGCCGTCTG AAGCCCGACA GGCGGGTTCA GACGGCATTG CCGCTTTACT

51 TCGATCGGTT TATACGCAAA ACGCGCTTCA GGAAATAAAT CAGATTATTC

101 CCCAGACGCC TTCAGGCTTC CTTCTGCGCC ACCGTAACCA TAGCCGGGCG

151 CAACACGCGG TCGGACAGCG TATAACCCTT CTTCATCACA CCCACCACGG

201 TATTCGGCTC CTGTTCGCTT GCCACCGCCT GCATCGCCTG ATGGATATTC

251 GGATCGAGCT TATCGCCCGC TTTAGGGTTG ATTTCCTTGA TTTGCGTAGC

301 ATCAAATGCT TTCTGCAACT CGTTCAAAGT CATCTGCACG CCCATTTTCA

351 GCGCATCGAA ATTGCCGCTC TGATCCAAAA GCGCCATTTC CAGATAATCC

401 TTGACCGGCA GCATTTCCAC GGCAAACTTC TGTCCGGCGA ACTTGTGCGT

451 ATCCGCAATT TyCTGCTGGT GGCGGCGGCG CAGGTTTTGC TCGTTTGCCA

501 AAGCGCGCTG CTCGTCTTTC AACTGCGTTT CCAGCTCGGC AATCCGCGCC

551 TGCAAATCCT CATAAGCCGG CTCTGCGGCA GCCTGTTCCT GCACACCGTC

601 CGCATTTCCT ACTGTTTCGA CGGTTTCCAC CGCCTCCACA TTTTCAACCG

651 CTTCTTCACT GTTTTGCTGC TGTGTCTGTT CGCTCATATC GTATCCCTTA

701 AAACAAATTG GAAATCAAAA TCCAGTTATT ACCCGCGCAA GATAAGGACA

751 TTTTCAAGAA ACTTCAAkCA AAAkCAGAGA ATTTCAAATT CATTTTCAAA

801 TCCCCTACCG AAAAAATAA
```

This corresponds to the amino acid sequence <SEQ ID 938; ORF 244-1>:

```
m244-1.pep

1  MPSEARQAGS DGIAALLRSV YTQNALQEIN QIIPQTPSGF LLRHRNHSRA

51  QHAVGQRITL LHHTHHGIRL LFACHRLHRL MDIRIELIAR FRVDFLDLRS

101  IKCFLQLVQS HLHAHFQRIE IAALIQKRHF QIILDRQHFH GKLLSGELVR

151  IRNFLLVAAA QVLLVCQSAL LVFQLRFQLG NPRLQILISR LCGSLFLHTV

201  RISYCFDGFH RLHIFNRFFT VLLLCLFAHI VSLKTNWKSK SSYYPRKIRT

251  FSRNFXQXQR ISNSFSNPLP KK*
```

```
m244-1/G244-1  86.3% identity in 277 aa overlap 10        20        30        40        50        60
m244-1.pep        MPSEARQAGSDGIAALLRSVYTQNALQEINQIIPQTPSGFLLRHRNHSRAQHAVGQRITL
                  || ||| ||||||||||||||||||||||||||||||||||  |||||||||:||| |||
g244-1            MPPEARPAGSDGIAALLRSVYTQNALQEINQIIPQTPSGFLPCHRNHSRAQHTVGQGITL
                          10        20        30        40        50        60

70        80        90       100       110       120
m244-1.pep        LHHTHHGIRLLFACHRLHRLMDIRIELIARFRVDFLDLRSIKCFLQLVQSHLHAHFQRIE
                  ||||:||| :|:: ||||||||||||||||||:||||||:|| :|||:|||||:||||||
g244-1            LHHTNHGIGFLLTGHRLHRLMDIRIELIARFRIDFLDLRGIKRLLQLIQSHLHTHFQRIE
                          70        80        90       100       110       120

130       140       150       160       170       180
m244-1.pep        IAALIQKRHFQIILDRQHFHGKLLSGELVRIRNFLLVAAAQVLLVCQSAALLVFQLRFQL
                  |:||||||||||||||||||||||||||||| ||||||||||||||||| |:||||||||
g244-1            ITALIQKRHFQIILDRQHFHGKLLSGELVRIGNFLLVAAAQVLLVCQSAQLFVFQLRFQL
                         130       140       150       160       170       180

190       200       210       220       230       240
m244-1.pep        GNPRLQILISRLCGSLFLHTVRISYCFDGFHRLHIFNRFFTVLLLCLFAHIVSLKTNWKS
                  |||||||||||| |||||:|||||||:|||||||||||||||||||||||||||||||||
g244-1            GNPRLQILISRLGGSLFLYTVRISYCLDGFHRLHIFNRFFTVLLLCLFAHIVSLKTNWKS
                         190       200       210       220       230       240

250       260       270
m244-1.pep        KSSYYPRKIRTFSRNFXQXQRISNSFSNPLPKKX
                  ||:||| ||||||||| | |:||:   | ||:|
g244-1            KSGYYPSKIRTFSRNFKQRQEISHPPPNTLPQKPYKRX
                         250       260       270
```

The following partial DNA sequence was identified in *N. meningitidis* <SEQ ID 939>:

```
a244-1.seq
   1 ATGCCGTCTG AAGCCCGACA GGCGGGTTCA GACGGCATTG CCGCTTTACT

51 TCGATCGGTT TATACGCAAA ACGCGCTTCA GGAAATAAAT CAGATTATTC

101 CCCAGACGCC TTCAGGCTTC CTTCTGTGCC ACCGTAACCA TAGCCGGGCG

151 CAACACGCGG TCGGACAGCG TATAACCCTT CTTCATCACG CCCACCACGG

201 TATTGGGTTC CTGTTCGCTT GCCACCGCCT GCATCGCCTG ATGGATATTC

251 GGATCGAGCT TATCGCCCGC TTTAGGATTG ATTTCCTTGA TTTGCGTAGC

301 ATCAAATGCT TTCTGCAACT CGTTCAAAGT CATCTGCACG CCCATTTTCA

351 GCGCATCGAA ATTGCCGCTC TGATCCAAAA GCGCCATTTC CAGATAATCC

401 TTGACCGGCA GCATTTCCAC GGCAAACTTC TGTCCGGCGA ACTTGTGCGT

451 ATCCGCAATT TCCTGCTGGT GGCGGCGGCG CAGGTTTTGC TCGTTTGCCA

501 AAGCGCGCAG CTGCTCGTCT TTCAACTGCG CTTCCAGCTC GGCAATCCGC

551 GCCTGCAAAT CCTCATAAGC CGGCTCTGCG GCAGCCTGTT CCTGCACACC

601 GTCCGCATTT CCTACTGTCT CGACGGTTTC CACCGCCTCC ACATTTTCAA

651 CCGCTTCTTC ACTGTTTTGC TGCTGTGTCT GTTCGCTCAT ATCGTATCCC

701 TTAAAACAAA TTGGAAATCA AAATCCAGTT ATTACCCGCG CAAGATAAGG
```

```
751 ACATTTTCAA GAAACTTCAA GCAAAGGCAG AGAATTTCAA ATTCATTTTC

801 AAATCCCCTA CCGAAAAAAT AA
```

This corresponds to the amino acid sequence <SEQ ID 940; ORF 244-1.a>:

```
a244-1.pep
      1 MPSEARQAGS DGIAALLRSV YTQNALQEIN QIIPQTPSGF LLCHRNHSRA

51 QHAVGQRITL LHHAHHGIGF LFACHRLHRL MDIRIELIAR FRIDFLDLRS

101 IKCFLQLVQS HLHAHFQRIE IAALIQKRHF QIILDRQHFH GKLLSGELVR

151 IRNFLLVAAA QVLLVCQSAQ LLVFQLRFQL GNPRLQILIS RLCGSLFLHT

201 VRISYCLDGF HRLHIFNRFF TVLLLCLFAH IVSLKTNWKS KSSYYPRKIR

251 TFSRNFKQRQ RISNSFSNPL PKK* m244-1/a244-1  96.8% identity in 274 aa overlap
                     10         20         30         40         50         60
     m244-1.pep  MPSEARQAGSDGIAALLRSVYTQNALQEINQIIPQTPSGFLLRHRNHSRAQHAVGQRITL
                 ||||||||||||||||||||||||||||||||||||||||||  ||||||||||||||||
         a244-1  MPSEARQAGSDGIAALLRSVYTQNALQEINQIIPQTPSGFLLCHRNHSRAQHAVGQRITL
                     10         20         30         40         50         60

70         80         90        100        110        120
     m244-1.pep  LHHTHHGIRLLFACHRLHRLMDIRIELIARFRVDFLDLRSIKCFLQLVQSHLHAHFQRIE
                 |||:||||  :|||||||||||||||||||||:|||||||||||||||||||||||||||
         a244-1  LHHAHHGIGFLFACHRLHRLMDIRIELIARFRIDFLDLRSIKCFLQLVQSHLHAHFQRIE
                     70         80         90        100        110        120

130        140        150        160        170       179
     m244-1.pep  IAALIQKRHFQIILDRQHFHGKLLSGELVRIRNFLLVAAAQVLLVCQSA-LLVFQLRFQL
                 |||||||||||||||||||||||||||||||||||||||||||||||||| |||||||||
         a244-1  IAALIQKRHFQIILDRQHFHGKLLSGELVRIRNFLLVAAAQVLLVCQSAQLLVFQLRFQL
                    130        140        150        160        170        180

180        190        200        210        220        230       239
     m244-1.pep  GNPRLQILISRLCGSLFLHTVRISYCFDGFHRLHIFNRFFTVLLLCLFAHIVSLKTNWKS
                 ||||||||||||||||||||||||||||:|||||||||||||||||||||||||||||||
         a244-1  GNPRLQILISRLCGSLFLHTVRISYCLDGFHRLHIFNRFFTVLLLCLFAHIVSLKTNWKS
                    190        200        210        220        230        240

240        250        260        270
     m244-1.pep  KSSYYPRKIRTFSRNFXQXQRISNSFSNPLPKKX
                 |||||||||||||||| | ||||||||||||||||
         a244-1  KSSYYPRKIRTFSRNFKQRQRISNSFSNPLPKKX
                    250        260        270
```

The following partial DNA sequence was identified in *N. gonorrhoeae* <SEQ ID 941>:

```
g246.seq
  1 atgtacgggc ggaacggtag tactcaagcg gccgttgcct tcgttttcga 51 ccagacacag cgtgcccgtt tcggcaacgg cgaagtttac gccgctcaag 101 ccgacatcgg cagtgctgta aatatcgcgc agggctttgc gggcgaatcc 151 ggtcagttgg tccacgtcgt ctgtaagcgg tgtgccgagg ttttggtgga 201 acagttcgct gacctgttct ttggttttat ggattgcggg catcacgata 251 tgggtcggtt tttcgcctgc catttggacg ataaactcgc ccaagtcgct 301 ttccaccgcc ttaatgcctt tgcttcaag ataatggttc agctcgattt 351 cttcgctgac catggatttg cctttgacca tcagcttgcc gttttttggct
```

-continued

```
401 gtgatgatgt cgtggataat ttggcaggct tcggcagggg tttccgccca 451 gtgtactttc acgcccaact tagtcaggtt ttcttccaac tgctccagca 501 gcgcgggtaa
```

This corresponds to the amino acid sequence <SEQ ID 942; ORF 246.ng>:

```
g246.pep
  1 MYGRNGSTQA AVAFVFDQTQ RARFGNGEVY AAQADIGSAV NIAQGFAGES

51 GQLVHVVCKR CAEVLVEQFA DLFFGFMDCG HHDMGRFFAC HLDDKLAQVA

101 FHRLNAFCFK IMVQLDFFAD HGFAFDHQLA VFGCDDVVDN LAGFGRGFRP

151 VYFHAQLSQV FFQLLQQRG*
```

The following partial DNA sequence was identified in *N. meningitidis* <SEQ ID 943>:

```
m246.seq (partial)
  1 ATGCACGGGC GGTACGGTGG TACTCAAGCG ACCGTTgCTT CGTTTTCCAC

51 CAGACACAGC GTACCTGTTT CAGCAACGGC AAAGTTTACG CCACTCAAAC

101 CGACATCGGC AGTGCTGTAA ATATCGCGCA GTGCTTTACG GGCGAAGCCG

151 GTCAGTTGGT CTACATCGTC TGTCAGCGGC GTACCGAGGT TTTGGTGGAA

201 CAGTTCGCTA ACCTGTTCTT TGGTTTTGTG GATAGCAGGC ATCACGATAT

251 GGGTCGGTTT TTCGCCTGCC ATTTGGACGA TGAACTCGCC CAAGTCGCTT

301 TCTACCGCTT TAATGCyTTT TGCTTCAAGA TAATGrTTCA GCTCGATTTC

351 CTCGCTGACC ATCGATTTGC CTTTGACCAT CAGCTTGCCG TTTTTGGCTG

401 TGATGATGTC GTGGATAATT TGGCAGGCTT CGGTCGGGGT TTCTGCCCG...
```

This corresponds to the amino acid sequence <SEQ ID 944; ORF 246>:

```
m246.pep (partial)
  1 MHGRYGGTQA TVAFVFHQTQ RTCFSNGKVY ATQTDIGSAV NIAQCFTGEA

51 GQLVYIVCQR RTEVLVEQFA NLFFGFVDSR HHDMGRFFAC HLDDELAQVA

101 FYRFNAFCFK IMXQLDFLAD HRFAFDHQLA VFGCDDVVDN LAGFGRGFCP...
```

Computer analysis of this amino acid sequence gave the following results:

Homology with a Predicted ORF from *N. gonorrhoeae*
ORF 246 shows 80.0% identity over a 150 aa overlap with a predicted ORF (ORF 246.ng) from *N. gonorrhoeae*:

```
m246/g246

10         20         30         40         50         60
    m246.pep  MHGRYGGTQATVAFVFHQTQRTCFSNGKVYATQTDIGSAVNIAQCFTGEAGQLVYIVCQR
              |:||  |:|||:|||||  ||||:  |:||:|||:|:||||||||||  |:||:|||::||:|
    g246      MYCRNGSTQAAVAFVFDQTQRARFGNGEVYAAQADIGSAVNIAQGFAGESGQLVHVVCKR
                   10         20         30         40         50         60

70         80         90        100        110        120
    m246.pep  RTEVLVEQFANLFFGFVDSRHHDMGRFFACHLDDELAQVAFYRFNAFCFKIMXQLDFLAD
              :||||||||:||||||:|    ||||||||||||||||:||||:|:|||||||||  ||||:||
    g246      CAEVLVEQFADLFFGFMDCGHHDMGRFFACHLDDKLAQVAFHRLNAFCFKIMVQLDFFAD
                   70         80         90        100        110        120
```

```
                         130         140         150
   m246.pep  HRFAFDHQLAVFGCDDVVDNLAGFGRGFCP
             ||||||||||||||||||||||||||| |
   g246      HGFAFDHQLAVFGCDDVVDNLAGFGRGFRPVYFHAQLSQVFFQLLQQRGX
                         130         140         150         160
```

The following partial DNA sequence was identified in *N. meningitidis* <SEQ ID 945>:

```
a246.seq (partial)
  1 ATGCACGGGC GGAACGGTGG TACTCAAGCG ACCGTTGCCT TCGTTTTCCA

51 CCAGACACAG CGTACCTGTT TCAGCAACGG CGAAGTTCAC GCCACTCAAA

101 CCGACATCGG CAGTGCTGTA AATATCGCGC AGTGCTTTAC GGGCGAAGCC

151 GGTCAGTTGG TCTACGTCGT CCGTTAACGG TGTGCCGAGG TTTTGGTGGA

201 ACAGTTCGCT AACCTGTTCT TTGGTTTTAT GGATTGCGGG CATCACGATA

251 TGGGTCGGTT TTTCACCTGC CATTTGGACG ATGAACTCGC CCAAGTCGCT

301 TTCCACCGCT TTAATGCCTT TGCTTCAAG ATAATGGTTC AGCTCGATTT

351 CCTCGCTGAC CATCGATTTG CCTTTGACCA TCAGCTTGCC GTTTTTGGCT

401 GTGATGATGT CGTGGATGAT TTCGCAGGCT TCGGCCGGTG TTTCCGCCCA

451 GTGTACTTTT ACGCCCAACT TGGTCAGGTT TTCTTCCAGC TGCTCCAGCA

501 G
```

This corresponds to the amino acid sequence <SEQ ID 946; ORF 246.a>:

```
a246.pep (partial)
  1 MHGRNGGTQA TVAFVFHQTQ RTCFSNGEVH ATQTDIGSAV NIAQCFTGEA

51 GQLVYVVR*R CAEVLVEQFA NLFFGFMDCG HHDMGRFFTC HLDDELAQVA

101 FHRFNAFCFK IMVQLDFLAD HRFAFDHQLA VFGCDDVVDD FAGFGRCFRP

151 VYFYAQLGQV FFQLLQQ
``` m246/a246 88.0% identity in 150 aa overlap

```
                      10         20         30         40         50         60
   m246.pep  MHGRYGGTQATVAFVFHQTQRTCFSNGKVYATQTDIGSAVNIAQCFTGEAGQLVYIVCQR
             ||||  |||||||||||||||||||||||:|:|||||||||||||||||||||||||:| |
   a246      MHGRNGGTQATVAFVFHQTQRTCFSNGEVHATQTDIGSAVNIAQCFTGEAGQLVYVVRXR
                      10         20         30         40         50         60

70         80         90        100        110        120
   m246.pep  RTEVLVEQFANLFFGFVDSRHHDMGRFFACHLDDELAQVAFYRFNAFCFKIMXQLDFLAD
             :|||||||||||||||:| |||||||:||||||||||||:||||||||||| |||||||
   a246      CAEVLVEQFANLFFGFMDCGHHDMGRFFTCHLDDELAQVAFHRFNAFCFKIMVQLDFLAD
                      70         80         90        100        110        120

130        140        150
   m246.pep  HRFAFDHQLAVFGCDDVVDNLAGFGRGFCP
             ||||||||||||||||||||::||||| | |
   a246      HRFAFDHQLAVFGCDDVVDDFAGFGRCFRPVYFYAQLGQVFFQLLQQ
                     130        140        150        160
```

The following partial DNA sequence was identified in *N. gonorrhoeae* <SEQ ID 947>:

```
g247.seq
   1 atgaaacgta aaatgctaaa cgtaccaaag ggcggttatg atggtatgaa 51 gggttttacc attgttgaat ttctggttgc gggcctgctc agtataattg 101 tcctgatagc ggtcgtatcg agttacttta catcccggaa attaaatgat 151 gtggcaaacg agcgtcttgc cattcaacag gatttgcgga atgcggcaac 201 attaattgtc cgcgatgcaa gaatggcggg gagcttcggt tgtttcaata 251 tgtccgagca tactaaagac gatattgttg attcaagtaa tcaaactcaa 301 tctaaccttg caaacccgg tgccaaacaa gaaaatcccc ttttttcctt 351 aaaaaggagc ggcatggata aacaactgat tcccgttgct gaatccatag 401 atattaaata tccgggtttt atccagcgcc ttaacgcatt ggttttccaa 451 tacggtatcg atgatcttga tgcgagtgct gagactgttg tagtcagcag 501 ctgttccaaa atagcaaaac cgggtaagaa aatatctacc ttgcaagaag 551 caaagagtgc attacagatt actaatgatg ataaacaaaa tggaaatatc 601 acccgtcaga acatgtggt caatgcctat gcggtcggca ggtttggcaa 651 taatgaggaa agtttgttcc gcttccaatt ggatgataag ggcaagtggg 701 gtaatcctca gttgctcgtg aaaaaggtta aacgtatgga tgtgcggtat 751 atttatgttt ccggttgtcc tgaagatgaa gatgccggca agaggaaaa 801 attcagatat acgaataaat tcgacaaatc caaaaatgct gttacgcctg 851 ccggggtgga ggttttattg gatagcggcc ttaatgccaa gattgccgct 901 tcttcagaca atagtattta tgcttaccgt atcaatgcga caatacgcgg 951 gggaaatgta tgcgcaaaca gaacactttg a
```

This corresponds to the amino acid sequence <SEQ ID 948; ORF 247.ng>:

```
g247.pep
   1 MKRKMLNVPK GGYDGMKGFT IVEFLVAGLL SIIVLIAVVS SYFTSRKLND

51 VANERLAIQQ DLRNAATLIV RDARMAGSFG CFNMSEHTKD DIVDSSNQTQ

101 SNLAKPGAKQ ENPLFSLKRS GMDKQLIPVA ESIDIKYPGF IQRLNALVFQ

151 YGIDDLDASA ETVVVSSCSK IAKPGKKIST LQEAKSALQI TNDDKQNGNI

201 TRQKHVVNAY AVGRFGNNEE SLFRFQLDDK GKWGNPQLLV KKVKRMDVRY

251 IYVSGCPEDE DAGKEEKFRY TNKFDKSKNA VTPAGVEVLL DSGLNAKIAA

301 SSDNSIYAYR INATIRGGNV CANRTL*
```

The following partial DNA sequence was identified in *N. meningitidis* <SEQ ID 949>:

```
m247.seq (partial)
   1 ATsAGACGTA AAATGCTAAA CGTwsyArAA GGCAGTTATG ATGGTATGAA

51 AGGTTTTACC ATTATTGAAT TTTTGGTTGC GGGCCTGCTC AGTATGATTG

101 TCCTGATGGC GGTCGGATCG AGTTACTTCA CATCCCGGAA ATTAAATGAT

151 GCGGCAAACG AGCGTCTTGC CGCGCAACAG GATTTGCGGA ATGCGGCAAC

201 ATTGATTGTC CGCGATGCGA GAATGGCAGG CGGCTTCGGT TGTTTCAATA
```

-continued

```
251 TGTCCGAGCA TCCTGCAACT GATGTTATTC CCGATACGAC GCAACAAAAT

301 TCTCCTTTTT CCTTAAAAAG GAACGGTATA GATAAACTTA TTCCCATAGC

351 GGAATCTTCA AATATCAATT ATCAGAATTT TTTCCAGGTT GGTAGCGCAT

401 TGATTTTTCA ATACGGAATC GATGATGTTA ATGCAAGCAC CGCGACTACC

451 GTCGTCAGCA GCTGTGCCGC AATATCGAAA CCGGGCAAGC AAATCCCTAC

501 TTTAGAAGAT GCAAAAAAAG AATTGAAGAT TCCGGATCAG GATAAGGAGC

551 AAAATGGCAA TATAGCGCGT CAAAGGCATG TGGTCAATGC CTATGCGGTC

601 GGCAGGATTG CCGATGAGGA AAGTTTGTTC CGCTTCCAAT GGATGATAA

651 GGGCAAGTGG GGTAATCCTC AGTTGC...
```

This corresponds to the amino acid sequence <SEQ ID 950; ORF 247>:

```
m247.pep (partial)
  1 XRRKMLNVXX GSYDGMKGFT IIEFLVAGLL SMIVLMAVGS SYFTSRKLND

51 AANERLAAQQ DLRNAATLIV RDARMAGGFG CFNMSEHPAT DVIPDTTQQN

101 SPFSLKRNGI DKLIPIAESS NINYQNFFQV GSALIFQYGI DDVNASTATT

151 VVSSCAAISK PGKQIPTLED AKKELKIPDQ DKEQNGNIAR QRHVVNAYAV

201 GRIADEESLF RFQLDDKGKW GNPQL....
```

Computer analysis of this amino acid sequence gave the following results:
Homology with a Predicted ORF from *N. gonorrhoeae*
ORF 247 shows 69.3% identity over a 238 aa overlap with a predicted ORF (ORF 247.ng) from *N. gonorrhoeae*:

```
m247/g247

10         20         30         40         50         60
     m247.pep    XRRKMLNVXXGSYDGMKGFTIIEFLVAGLLSMIVLMAVGSSYFTSRKLNDAANERLAAQQ
                 :||||||  |:|||||||||:|||||||||:|||:||  ||||||||||||:||||||  ||
     g247        MKRKMLNVPKGGYDGMKGFTIVEFLVAGLLSIIVLIAVVSSYFTSRKLNDVANERLAIQQ
                         10         20         30         40         50         60

70         80         90        100
     m247.pep    DLRNAATLIVRDARMAGGFGCFNMSEHPATDVI------------PDTTQQNSPFSLKRN
                 ||||||||||||||||:||||||||||  |::            |  : |:|  ||||:
     g247        DLRNAATLIVRDARMAGSFGCFNMSEHTKDDIVDSSNQTQSNLAKPGAKQENPLFSLKRS
                         70         80         90        100        110        120

110        120        130        140        150        160
     m247.pep    GIDK-LIPIAESSNINYQNFFQVGSALIFQYGIDDVNASTATTVVSSCAAISKPGKQIPT
                 |:||  |||:|||  :|:|  :|:|   :||:|||||||::||:  |:||||||:  |:|||||:| |
     g247        GMDKQLIPVAESIDIKYPGFIQRLNALVFQYGIDDLDASAETVVSSCSKIAKPGKKIST
                        130        140        150        160        170        180

170        180        190        200        210        220
     m247.pep    LEDAKKELKIPDQDKEQNGNIARQRHVVNAYAVGRIAD-EESLFRFQLDDKGKWGNPQL
                 |::||: |:|  ::||  ||||||:||  :|||||||||:::  |||||||||||||||||||
     g247        LQEAKSALQITNDDK-QNGNITRQKHVVNAYAVGRFGNNEESLFRFQLDDKGKWGNPQLL
                        190        200        210        220        230 g247        VKKVKRMDVRYIYVSGCPEDEDAGKEEKFRYTNKFDKSKNAVTPAGVEVLLDSGLNAKIA
                        240        250        260        270        280        290
```

The following partial DNA sequence was identified in *N. meningitidis* <SEQ ID 951>:

```
a247.seq
  1 ATGAGACGTA AAATGCTAAA CGTACCAAAA GGCAATTATG ATGGTATGAA

51 GGGTTTTACC ATTATTGAAT TTTTGGTTGC GGGCATGCTC AGTATGATTG

101 TCCTGATGGC GGTCGGATCG AGTTACTTCA CATCCCGGAA ATTAAATGAT
```

-continued

```
151 GCGGCAAACG AGCGTCTTTC CGCGCAACAG GATTTGCGGA ATGCGGCAAC
201 ATTGATTGTC CGCGATGCAA GAATGGCAGG GGGCTTCGGT TGTTTCAATA
251 TGTCCGAGCA TACTAAAAAT GATATTATTG TTGATCCAAG TAAGCAAACT
301 CAACATGTCC CTGTAAAACC CGGTGCCAAA CAAGAAAATC CCCTTTTTTC
351 TTTAGAGTGG GCTAATACTA ATAATACTAA TAATAATACA GCTAAATTGA
401 TTCCTATTGC TGAATCCACA GATATTAAAT ATCCGGGTTT TGCCCAGGCT
451 CGTCCGGCAT TGATTTTCCA ATACGGCATC GATGATCTTG ATGCGAGTGC
501 TGAGACTGTT GTAGTCAGCA GCTGTTCCAA AATAGCAAAA CCGGGTAAGA
551 AAATATCTAC CTTGCAAGAA GCAAAGAGTG CATTACAGAT TACTAATGAT
601 GATAAACAAA ATGAAATAT CACCCGTCAA AGGCATGTGG TCAATGCCTA
651 TGCGGTCGGC AGGATTGCCG GTGAGGAAGG TTTGTTCCGC TTCCAATTGG
701 ATGATAAGGG CAAGTGGGGT AATCCTCAGT TGCTCGTGAA AAAGATTAGA
751 CATATGAAAG TGCGGTATAT CTATGTTTCC GACTGTCCTG AAGATGACGA
801 TGCCGGCAAA GAGGAAAAAT TCAAATATAC GGGTACATTC GACAGCTCCA
851 CAAATGCTGT TACGCCCGCC GGGGTGGAGG TTTTATTGAG TANCGGTACT
901 GATACCAAGA TTGCCGCTTC TTCAGACAAT CATATTTATG CTTACCGTAT
951 CGATGCGACA ATACGCGGGG GAAATGTATG CGCAAACAGA ACACTTTGA
```

This corresponds to the amino acid sequence <SEQ ID³⁰ 952; ORF 247.a>:

```
a247.pep
  1 MRRKMLNVPK GNYDGMKGFT IIEFLVAGML SMIVLMAVGS SYFTSRKLND

51 AANERLSAQQ DLRNAATLIV RDARMAGGFG CFNMSEHTKN DIIVDPSKQT

101 QHVPVKPGAK QENPLFSLEW ANTNNTNNNT AKLIPIAEST DIKYPGFAQA

151 RPALIFQYGI DDLDASAETV VVSSCSKIAK PGKKISTLQE AKSALQITND

201 DKQNGNITRQ RHVVNAYAVG RIAGEEGLFR FQLDDKGKWG NPQLLVKKIR

251 HMKVRYIYVS DCPEDDDAGK EEKFKYTGTF DSSTNAVTPA GVEVLLSXGT

301 DTKIAASSDN HIYAYRIDAT IRGGNVCANR TL*
``` m247/a247 70.9% identity in 244 aa overlap

```
                  10         20         30         40         50         60
    m247.pep  XRRKMLNVXXGSYDGMKGFTIIEFLVAGLLSMIVLMAVGSSYFTSRKLNDAANERLAAQQ
              |||||||  :|||||||||||||||||||||||||||||||||||||||||||||||:|||
        a247  MRRKMLNVPKGNYDGMKGFTIIEFLVAGMLSMIVLMAVGSSYFTSRKLNDAANERLSAQQ
                      10         20         30         40         50         60

70         80         90                    100
    m247.pep  DLRNAATLIVRDARMAGGFGCFNMSEHPATDVI-------------PDTTQQNSPFSLK-
              ||||||||||||||||||||||||||| :|:|             |  : |:|  |||:
        a247  DLRNAATLIVRDARMAGGFGCFNMSEHTKNDIIVDPSKQTQHVPVKPGAKQENPLFSLEW
                      70         80         90        100        110        120

110        120        130        140        150        160
    m247.pep  ------RNGIDKLIPIAESSNINYQNFFQVGSALIFQYGIDDVNASTATTVVSSCAAISK
                  |:  |||||||||||::|:| :| |: ||||||||||::|| |:|||||: |:|
        a247  ANTNNTNNNTAKLIPIAESTDIKYPGFAQARPALIFQYGIDDLDASAETVVVSSCSKIAK
                     130        140        150        160        170        180

170        180        190        200        210        220
    m247.pep  PGKQIPTLEDAKKELKIPDQDKEQNGNIARQRHVVNAYAVGRIADEESLFRFQLDDKGKW
              |||:|  ||::||: |:|  ::||  ||||:|||||||||||||  ||:||||||||||||
        a247  PGKKISTLQEAKSALQITNDDK-QNGNITRQRHVVNAYAVGRIAGEEGLFRFQLDDKGKW
                     190        200        210        220        230
```

```
m247.pep    GNPQL
            |||||
a247        GNPQQLLVKKIRHMKVRYIYVSDCPEDDDAGKEEKFKYTGTFDSSTNAVTPAGVEVLLSXG
            240       250       260       270       280       290
```

The following partial DNA sequence was identified in *N. gonorrhoeae* <SEQ ID 953>:

```
g247-1.seq (partial) ..
    1 CCCGGTGCCA AACAAGAAAA TCCCCTTTTT TCCTTAAAAA GGAGCGGCAT

51 GGATAAACAA CTGATTCCCG TTGCTGAATC CATAGATATT AAATATCCGG

101 GTTTTATCCA GCGCCTTAAC GCATTGGTTT TCCAATACGG TATCGATGAT

151 CTTGATGCGA GTGCTGAGAC TGTTGTAGTC AGCAGCTGTT CCAAAATAGC

201 AAAACCGGGT AAGAAAATAT CTACCTTGCA AGAAGCAAAG AGTGCATTAC

251 AGATTACTAA TGATGATAAA CAAAATGGAA ATATCACCCG TCAGAAACAT

301 GTGGTCAATG CCTATGCGGT CGGCAGGTTT GGCAATAATG AGGAAAGTTT

351 GTTCCGCTTC CAATTGGATG ATAAGGGCAA GTGGGGTAAT CCTCAGTTGC

401 TCGTGAAAAA GGTTAAACGT ATGGATGTGC GGTATATTTA TGTTTCCGGT

451 TGTCCTGAAG ATGAAGATGC CGGCAAAGAG GAAAAATTCA GATATACGAA

501 TAAATTCGAC AAATCCAAAA ATGCTGTTAC GCCTGCCGGG GTGGAGGTTT

551 TATTGGATAG CGGCCTTAAT GCCAAGATTG CCGCTTCTTC AGACAATAGT

601 ATTTATGCTT ACCGTATCAA TGCGACAATA CGCGGGGGAA ATGTATGCGC

651 AAACAGAACA CTTTGA
```

This corresponds to the amino acid sequence <SEQ ID 954; ORF 247-1.ng>:

```
g247-1.pep (partial) ..
    1 PGAKQENPLF SLKRSGMDKQ LIPVAESIDI KYPGFIQRLN ALVFQYGIDD

51 LDASAETVVV SSCSKIAKPG KKISTLQEAK SALQITNDDK QNGNITRQKH

101 VVNAYAVGRF GNNEESLFRF QLDDKGKWGN PQLLVKKVKR MDVRYIYVSG

151 CPEDEDAGKE EKFRYTNKFD KSKNAVTPAG VEVLLDSGLN AKIAASSDNS

201 IYAYRINATI RGGNVCANRT L*
```

The following partial DNA sequence was identified in *N. meningitidis* <SEQ ID 955>:

```
m247-1.seq
    1 ATGAGACGTA AAATGCTAAA CGTACCAAAA GGCAGTTATG ATGGTATGAA

51 AGGTTTTACC ATTATTGAAT TTTTGGTTGC GGGCCTGCTC AGTATGATTG

101 TCCTGATGGC GGTCGGATCG AGTTACTTCA CATCCCGGAA ATTAAATGAT

151 GCGGCAAACG AGCGTCTTGC CGCGCAACAG GATTTGCGGA ATGCGGCAAC

201 ATTGATTGTC CGCGATGCGA GAATGGCAGG CGGCTTCGGT TGTTTCAATA

251 TGTCCGAGCA TCCTGCAACT GATGTTATTC CCGATACGAC GCAACAAAAT

301 TCTCCTTTTT CCTTAAAAAG GAACGGTATA GATAAACTTA TTCCCATAGC

351 GGAATCTTCA AATATCAATT ATCAGAATTT TTTCCAGGTT GGTAGCGCAT

401 TGATTTTTCA ATACGGAATC GATGATGTTA ATGCAAGCAC CGCGACTACC
```

```
-continued
451 GTCGTCAGCA GCTGTGCCGC AATATCGAAA CCGGGCAAGC AAATCCCTAC

501 TTTAGAAGAT GCAAAAAAAG AATTGAAGAT TCCGGATCAG GATAAGGAGC

551 AAAATGGCAA TATAGCGCGT CAAAGGCATG TGGTCAATGC CTATGCGGTC

601 GGCAGGATTG CCGATGAGGA AGGTTTGTTC CGCTTCCAAT TGGATGATAA

651 GGGCAAGTGG GGTAATCCTC AGTTGCTCGT GAAAAAGGTT AGACATATGA

701 AAGTGCGGTA TATCTATGTT TCCGGCTGTC CTGAAGATGA CGATGCCGGC

751 AAAGAGGAAA CATTCAAATA TACGGATAAA TTCGACAGCG CCCAAAATGC

801 TGTTACGCCC GCCGGGGTGG AGGTTTTATT GAGTAGCGGT ACTGATACCA

851 AGATTGCCGC TTCTTCAGAC AATCATATTT ATGCTTACCG TATCGATGCG

901 ACAATACGCG GGGGAAATGT ATGCGCAAAC AGAACACTTT GA
```

This corresponds to the amino acid sequence <SEQ ID 956; ORF 247-1>:

```
m247-1.pep
         1  MRRKMLNVPK GSYDGMKGFT IIEFLVAGLL SMIVLMAVGS SYFTSRKLND
        51  AANERLAAQQ DLRNAATLIV RDARMAGGFG CFNMSEHPAT DVIPDTTQQN
       101  SPFSLKRNGI DKLIPIAESS NINYQNFFQV GSALIFQYGI DDVNASTATT
       151  VVSSCAAISK PGKQIPTLED AKKELKIPDQ DKEQNGNIAR QRHVVNAYAV
       201  GRIADEEGLF RFQLDDKGKW GNPQLLVKKV RHMKVRYIYV SGCPEDDDAG
       251  KEETFKYTDK FDSAQNAVTP AGVEVLLSSG TDTKIAASSD NHIYAYRIDA
       301  TIRGGNVCAN RTL* m247-1/g247-1  72.1% identity in 222 aa overlap 70         80         90        100        110        120
m247-1.pep     NAATLIVRDARMAGGFGCFNMSEHPATDVIPDTTQQNSPFSLKRNGIDK-LIPIAESSNI
                                           | : |:|  ||||:|:||  |||:||| :|
g247-1                                     PGAKQENPLFSLKRSGMDKQLIPVAESIDI
                                                   10         20         30

130        140        150        160        170        180
m247-1.pep     NYQNFFQVGSALIFQYGIDDVNASTATTVVSSCAAISKPGKQIPTLEDAKKELKIPDQDK
               :| :|:|  :||:|||||||::||: |:||||:  |:||||:  ||::||: |:| ::||
g247-1         KYPGFIQRLNALVFQYGIDDLDASAETVVVSSCSKIAKPGKKISTLQEAKSALQITNDDK
                40         50         60         70         80         90

190        200        210        220        230        240
m247-1.pep     EQNGNIARQRHVVNAYAVGRIAD-EEGLFRFQLDDKGKWGNPQLLVKKVRHMKVRYIYVS
                |||||:||:|||||||||||||:::  ||:|||||||||||||||||||||||::| ||||||||
g247-1         -QNGNITRQKHVVNAYAVGRFGNNEESLFRFQLDDKGKWGNPQLLVKKVRMDVRYIYVS
                         100        110        120        130        140

250        260        270        280        290        300
m247-1.pep     GCPEDDDAGKEETFKYTDKFDSAQNAVTPAGVEVLLSSGTDTKIAASSDNHIYAYRIDAT
               |||||:||||||  |:|:|||:::|||||||||||||||:||::|||||||||::|||
g247-1         GCPEDEDAGKEEKFRYTNKFDKSKNAVTPAGVEVLLDSGLNAKIAASSDNSIYAYRINAT
                150        160        170        180        190        200

310
m247-1.pep     IRGGNVCANRTLX
               |||||||||||||
g247-1         IRGGNVCANRTLX
                210        220
```

The following partial DNA sequence was identified in *N. meningitidis* <SEQ ID 957>:

```
a247-1.seq (partial)
   1 AATAATACAG CTAAATTGAT TCCTATTGCT GAATCCACAG ATATTAAATA

51 TCCGGGTTTT GCCCAGGCTC GTCCGGCATT GATTTTCCAA TACGGCATCG

101 ATGATCTTGA TGCGAGTGCT GAGACTGTTG TAGTCAGCAG CTGTTCCAAA
```

-continued

```
151 ATAGCAAAAC CGGGTAAGAA AATATCTACC TTGCAAGAAG CAAAGAGTGC

201 ATTACAGATT ACTAATGATG ATAAACAAAA TGGAAATATC ACCCGTCAAA

251 GGCATGTGGT CAATGCCTAT GCGGTCGGCA GGATTGCCGG TGAGGAAGGT

301 TTGTTCCGCT TCCAATTGGA TGATAAGGGC AAGTGGGGTA ATCCTCAGTT

351 GCTCGTGAAA AAGATTAGAC ATATGAAAGT GCGGTATATC TATGTTTCCG

401 ACTGTCCTGA AGATGACGAT GCCGGCAAAG AGGAAAAATT CAAATATACG

451 GGTACATTCG ACAGCTCCAC AAATGCTGTT ACGCCCGCCG GGGTGGAGGT

501 TTTATTGAGT AGCGGTACTG ATACCAAGAT TGCCGCTTCT TCAGACAATC

551 ATATTTATGC TTACCGTATC GATGCGACAA TACGCGGGGG AAATGTATGC

601 GCAAACAGAA CACTTTGA
```

This corresponds to the amino acid sequence <SEQ ID 958; ORF 247-1.a>:

```
a247-1.pep (partial)..
    1 NNTAKLIPIA ESTDIKYPGF AQARPALIFQ YGIDDLDASA ETVVVSSCSK
   51 IAKPGKKIST LQEAKSALQI TNDDKQNGNI TRQRHVVNAY AVGRIAGEEG
  101 LFRFQLDDKG KWGNPQLLVK KIRHMKVRYI YVSDCPEDDD AGKEEKFKYT
  151 GTFDSSTNAV TPAGVEVLLS SGTDTKIAAS SDNHIYAYRI DATIRGGNVC
  201 ANRTL* m247-1/a247-1  80.6% identity in 206 aa overlap 10        20        30
a247-1.pep                        NNTAKLIPIAESTDIKYPGFAQARPALIFQ
                                  |:  ||||||||::|:|  :| |:   |||||
m247-1       GFGCFNMSEHPATDVIPDTTQQNSPFSLKRNGIDKLIPIAESSNINYQNFFQVGSALIFQ
                 80        90       100       110       120       130

40        50        60        70        80        89
a247-1.pep   YGIDDLDASAETVVVSSCSKIAKPGKKISTLQEAKSALQITNDDK-QNGNITRQRHVVNA
             |||||::||: |:||||||:|:||||:| ||::|:  :| ::|| |||||:||||||||
m247-1       YGIDDVNASTATTVVSSCAAISKPGKQIPTLEDAKKELKIPDQDKEQNGNIARQRHVVNA
                 140       150       160       170       180       190

90       100       110       120       130       140       149
a247-1.pep   YAVGRIAGEEGLFRFQLDDKGKWGNPQLLVKKIRHMKVRYIYVSDCPEDDDAGKEEKFKY
             ||||||| ||||||||||||||||||||||||:||||||||||| |||||||||| |||
m247-1       YAVGRIADEEGLFRFQLDDKGKWGNPQLLVKKVRHMKVRYIYVSGCPEDDDAGKEETFKY
                 200       210       220       230       240       250

150       160       170       180       190       200
a247-1.pep   TGTFDSSTNAVTPAGVEVLLSSGTDTKIAASSDNHIYAYRIDATIRGGNVCANRTLX
             |   |||:|||||||||||||||||||||||||||||||||||||||||||||||||
m247-1       TDKFDSAQNAVTPAGVEVLLSSGTDTKIAASSDNHIYAYRIDATIRGGNVCANRTLX
                 260       270       280       290       300       310
```

The following partial DNA sequence was identified in *N. gonorrhoeae* <SEQ ID 959>:

```
g248.seq
    1 atgcgcaaac agaacacttt gacaggaatc ccgacttctg acggacagag 51 ggggtccgca ctgtttatcg tgctgatggt gatgatagtc gtggccttt 101 tggttgtaac tgccgcccag tcctacaata ccgaacagag gatcagtgcc 151 aacgaatcag acaggaaatt ggctttgtct ttagccgagg cggctttgcg 201 ggagggcgaa tttcaggttt tggatttgga atatgctgcg gacagtaagg 251 ttacgtttag cgaaaactgt gaaaaaggtc tgtgtaccgc agtgaatgtg 301 cggacaaata ataatggtag tgaagaggct tttggcaata tcgtggtgca
```

-continued

```
351 aggcaagccc gccgttgagg cggtgaaacg ttcttgccct gcaaagtctg 401 gcaaaaattc taccgacctg tgcattgaca ataaagggat ggaatataat 451 aaaggcgcgg caggcgtcag caaaatgccg cgctatatta tcgaatattt 501 aggcgtgaag aacggacaaa atgtttatcg ggttactgcc aaggcttggg 551 gtaagaatgc caataccgtg gtcgtccttc aatcttatgt aggcaataat 601 gatgagcaat aa
```

This corresponds to the amino acid sequence <SEQ ID 960; ORF 248.ng>:

```
g248.pep
  1 MRKQNTLTGI PTSDGQRGSA LFIVLMVMIV VAFLVVTAAQ SYNTEQRISA

51 NESDRKLALS LAEAALREGE FQVLDLEYAA DSKVTFSENC EKGLCTAVNV

101 RTNNNGSEEA FGNIVVQGKP AVEAVKRSCP AKSGKNSTDL CIDNKGMEYN

151 KGAAGVSKMP RYIIEYLGVK NGQNVYRVTA KAWGKNANTV VVLQSYVGNN

201 DEQ*
```

The following partial DNA sequence was identified in *N. meningitidis* <SEQ ID 961>:

```
m248.seq (partial)
  1 ..GGGTTTGCAC TGTTAATCGT GCTGATGGTG ATrATCGTCG TGGCT.TywT 51    gGwTGTAACT GCCGCGCAGT CTTACAATAC cGAGCAGCGk ATCAGTkCCA 101    ACGAATCAGA CAGGAAATTG GCTwTGTCTT TGGCCGAGkC GkCTwTGCGG

151    GAAGGCGAAC TTCAGGTTTT GGATTTGGAA TATGATACGG ACAGTAAGGT

201    TACATTTAGC GAAAACTGTG GAAAAGGTCT GTsTGCCGCA GTGAATGTGC

251    GGACAAATAA TGATAATGAA GAGGCTTTTG ACAATATCGT GGTGCAAGGC

301    AAGCCCACCG TTGAGGCGGT GAAGCGTTCT TGCCCTGCAA ATTCTACCGA

351    CCTGTGCATT GACAAGAAAG GGwTGGAATA TAAGAAAGGC ACGAGAAGCG

401    TCAc.AAAAT GCCACGTTAT ATTATCGAAT ATTTGGGCGT GwAGAACGGA

451    GAAAATGTTT ATCGGGTTAC TGCCAAGGCT TGGGGtAAGA ATGCCAATAC

501    CGTGGTCGTC CTTCAATCTT ATGTAAGCAA TAATGATGAG TAA
```

This corresponds to the amino acid sequence <SEQ ID 962; ORF 248>:

```
m248.pep (partial)
  1 ..GFALLIVLMV XIVVAFXXVT AAQSYNTEQR ISXNESDRKL AXSLAEXXXR

51    EGELQVLDLE YDTDSKVTFS ENCGKGLXAA VNVRTNNDNE EAFDNIVVQG

101    KPTVEAVKRS CPANSTDLCI DKKGXEYKKG TRSVTKMPRY IIEYLGVXNG

151    ENVYRVTAKA WGKNANTVVV LQSYVSNNDE *
```

Computer analysis of this amino acid sequence gave the following results:
Homology with a Predicted ORF from N. gonorrhoeae
ORF 248 shows 81.1% identity over a 185 aa overlap with a predicted ORF (ORF 248.ng) from N. gonorrhoeae:

```
m248/g248

10        20        30        40
    m248.pep             GFALLIVLMVXIVVAFXXVTAAQSYNTEQRISXNESDRKLAXS
                          ||:||||| |||||  |||||||||||||| ||||||||| |
    g248        MRKQNTLTGIPTSDGQRGSALFIVLMVIVVAFLVVTAAQSYNTEQRISANESDRKLALS
                         10        20        30        40        50        60

50        60        70        80        90       100
    m248.pep   LAEXXXREGELQVLDLEYDTDSKVTFSENCGKGLXAAVNVRTNND-NEEAFDNIVVQGKP
               |||    ||||:|||||||||:|||||||||| |||||||||  : :||| ||||||||
    g248       LAEAALREGEFQVLDLEYAADSKVTFSENCEKGLCTAVNVRTNNNGSEEAFGNIVVQGKP
                         70        80        90       100       110       120

110       120       130       140       150
    m248.pep   TVEAVKRSCPA----NSTDLCIDKKGXEYKKGTRSVTKMPRYIIEYLGVXNGENVYRVTA
               :|||||||||    ||||||||:|| ||:||: :|:||||||||||| ||:|||||||
    g248       AVEAVKRSCPAKSGKNSTDLCIDNKGMEYNKGAAGVSKMPRYIIEYLGVKNGQNVYRVTA
                         130       140       150       160       170       180

160       170       180
    m248.pep   KAWGKNANTVVVLQSYVSNNDEX
               ||||||||||||||||||:||||
    g248       KAWGKNANTVVVLQSYVGNNDEQX
                         190       200
```

The following partial DNA sequence was identified in N. meningitidis <SEQ ID 963>:

```
a248.seq
   1 ATGCGCAAAC AGAACACTTT GACGGGAATC CCGACTTCTG ACGGACAGAG

51 GGGGTTTGCA CTGTTTATCG TGCTGATGGT GATGATCGTC GTGGCTTTTT

101 TGGTTGTAAC TGCCGCGCAG TCTTACAATA CCGAGCAGCG GATCAGTGCC

151 AACGAATCAG ACAGGAAATT GGCTTTGTCT TTGGCCGAGG CGGCTTTGCG

201 GGAAGGCGAA CTTCAGGTTT TGGATTTGGA ATATGATACG GACAGTAAGG

251 TTACATTTAG CGAAAACTGT GGAAAAGGTC TGTGTACCGC AGTGAATGTG

301 CGGACAAATA ATGATAATGA AGAGGCTTTT GACAATATCG TGGTGCAAGG

351 CAAGCCCACC GTTGAGGCGG TGAAGCGTTC TTGCACTGCA AAATCTACAG

401 GCCTGTGCAT TGACAATAAA GGGATGGAAT ATAAGAAAGG CACGCAAAGC

451 GTCAGCAAAA TGCCACGTTA TATTATCGAA TATTTGGGCG TGAAGAACGG

501 AGAAAATGTT TATCGGGTTA CTGCCAAGGC TTGGGGTAAG AATGCCAATA

551 CCGTGGTCGT CCTTCAATCT TATGTAAGCA ATAATGATGA GTAA
```

This corresponds to the amino acid sequence <SEQ ID 964; ORF 248.a>:

```
a248.pep
   1 MRKQNTLTGI PTSDGQRGFA LFIVLMVMIV VAFLVVTAAQ SYNTEQRISA

51 NESDRKLALS LAEAALREGE LQVLDLEYDT DSKVTFSENC GKGLCTAVNV

101 RTNNDNEEAF DNIVVQGKPT VEAVKRSCTA KSTGLCIDNK GMEYKKGTQS

151 VSKMPRYIIE YLGVKNGENV YRVTAKAWGK NANTVVVLQS YVSNNDE*
``` m248/a248 89.4% identity in 180 aa overlap

```
                                       10        20        30        40
m248.pep                  GFALLIVLMVXIVVAFXXVTAAQSYNTEQRISXNESDRKLAXS
                          ||||:||||| |||||  |||||||||||||| |||||||| |
a248        MRKQNTLTGIPTSDGQRGFALFIVLMVMIVVAFLVVTAAQSYNTEQRISANESDRKLALS
                    10        20        30        40        50        60

50        60        70        80        90       100
m248.pep    LAEXXXREGELQVLDLEYDTDSKVTFSENCGKGLXAAVNVRTNNDNEEAFDNIVVQGKPT
            |||   |||||||| ||||||||||||||||||| :|||||||||||||| |||||||||
a248        LAEAALREGELQVLKLEYDTDSKVTFSENCGKGLCTAVNVRTNNDNEEAFGNIVVQGKPT
                    70        80        90       100       110       120

110       120       130       140       150       160
m248.pep    VEAVKRSCPANSTDLCIDKKGXEYKKGTRSVTKMPRYIIEYLGVXNGENVYRVTAKAWGK
            |||||||| |:|| ||||:|| ||||||:||:|||||||||||| |||||||||||||||
a248        VEAVKRSCTAKSTGLCIDNKGMEYKKGTQSVSKMPRYIIEYLGVKNGENVYRVTAKAWGK
                   130       140       150       160       170       180

170       180
m248.pep    NANTVVVLQSYVSNNDEX
            ||||||||||||||||||
a248        NANTVVVLQSYVGNNDEX
                   190
```

The following partial DNA sequence was identified in *N. meningitidis* <SEQ ID 965>:

```
m248-1.seq
   1 ATGCGCAAAC AGAACACTTT GACGGGAATC CCGACTTCTG ACGGACAGAG

51 GGGGTTTGCA CTGTTTATCG TGCTGATGGT GATGATCGTC GTGGCTTTTT

101 TGGTTGTAAC TGCCGCGCAG TCTTACAATA CCGAGCAGCG GATCAGTGCC

151 AACGAATCAG ACAGGAAATT GGCTTTGTCT TTGGCCGAGG CGGCTTTGCG

201 GGAAGGCGAA CTTCAGGTTT TGGATTTGGA ATATGATACG GACAGTAAGG

251 TTACATTTAG CGAAAACTGT GGAAAAGGTC TGTGTGCCGC AGTGAATGTG

301 CGGACAAATA ATGATAATGA AGAGGCTTTT GACAATATCG TGGTGCAAGG

351 CAAGCCCACC GTTGAGGCGG TGAAGCGTTC TTGCCCTGCA AATTCTACCG

401 ACCTGTGCAT TGACAAGAAA GGGATGGAAT ATAAGAAAGG CACGAGAAGC

451 GTCAGCAAAA TGCCACGTTA TATTATCGAA TATTTGGGCG TGAAGAACGG

501 AGAAAATGTT TATCGGGTTA CTGCCAAGGC TTGGGGTAAG AATGCCAATA

551 CCGTGGTCGT CCTTCAATCT TATGTAAGCA ATAATGATGA GTAA
```

This corresponds to the amino acid sequence <SEQ ID 966; ORF 248-1>:

```
m248-1.pep

1 MRKQNTLTGI PTSDGQRGFA LFIVLMVMIV VAFLVVTAAQ SYNTEQRISA

51 NESDRKLALS LAEAALREGE LQVLDLEYDT DSKVTFSENC GKGLCAAVNV

101 RTNNDNEEAF DNIVVQGKPT VEAVKRSCPA NSTDLCIDKK GMEYKKGTRS

151 VSKMPRYIIE YLGVKNGENV YRVTAKAWGK NANTVVVLQS YVSNNDE*
``` m248-1/g248 89.1% identity in 202 aa overlap

```
                    10        20        30        40        50        60
m248-1.pep  MRKQNTLTGIPTSDGQRGFALFIVLMVMIVVAFLVVTAAQSYNTEQRISANESDRKLALS
            |||||||||||||||||| |||||||||||||||||||||||||||||||||||||||||
g248        MRKQNTLTGIPTSDGQRGSALFIVLMVMIVVAFLVVTAAQSYNTEQRISANESDRKLALS
                    10        20        30        40        50        60
```

```
              70        80        90       100       110      119
m248-1.pep  LAEAALREGELQVLDLEYDTDSKVTFSENCGKGLCAAVNVRTNND-NEEAFDNIVVQGKP
            ||||||||||:|||||||:||||||||||||||||:|||||||||: :|||||||||||
g248        LAEAALREGEFQVLDLEYAADSKVTFSENCEKGLCTAVNVRTNNNGSEEAFGNIVVQGKP
              70        80        90       100       110      120

120       130       140       150       160       170
m248-1.pep  TVEAVKRSCPA----NSTDLCIDKKGMEYKKGTRSVSKMPRYIIEYLGVKNGENVYRVTA
            :||||||||||    ||||||||:|||||:||: :||||||||||||||||||:||||||
g248        AVEAVKRSCPAKSGKNSTDLCIDNKGMEYNKGAAGVSKMPRYIIEYLGVKNGQNVYRVTA
             130       140       150       160       170       180

180       190
m248.1.pep  KAWGKNANTVVVLQSYVSNNDEX
            ||||||||||||||||||:||||
g248        KAWGKNANTVVVLQSYVGNNDEQX
                190       200 m248-1/a248 97.0% identity in 197 aa overlap 10        20        30        40        50        60
m248-1.pep  MRKQNTLTGIPTSDGQRGFALFIVLMVMIVVAFLVVTAAQSYNTEQRISANESDRKLALS
            ||||||||||||||||||||||||||||||||||||||||||||||||||||||||||||
a248        MRKQNTLTGIPTSDGQRGFALFIVLMVMIVVAFLVVTAAQSYNTEQRISANESDRKLALS
              10        20        30        40        50        60

70        80        90       100       110      119
m248-1.pep  LAEAALREGELQVLDLEYDTDSKVTFSENCGKGLCAAVNVRTNNDNEEAFDNIVVQGKPT
            ||||||||||||||||||||||||||||||||||||:|||||||||||||||||||||||
a248        LAEAALREGELQVLDLEYDTDSKVTFSENCGKGLCTAVNVRTNNDNEEAFDNIVVQGKPT
              70        80        90       100       110      120

130       140       150       160       170       180
m248-1.pep  VEAVKRSCPANSTDLCIDKKGMEYKKGTRSVSKMPRYIIEYLGVKNGENVYRVTAKAWGK
            |||||||| |:|| ||||:|||||||:||||||||||||||||||||||||||||||||
a248        VEAVKRSCTAKSTGLCIDNKGMEYKKGTQSVSKMPRYIIEYLGVKNGENVYRVTAKAWGK
             130       140       150       160       170       180

190
m248.1.pep  NANTVVVLQSYVSNNDEX
            ||||||||||||||||||
a248        NANTVVVLQSYVSNNDEX
                190
```

The following partial DNA sequence was identified in *N. gonorrhoeae* <SEQ ID 967>:

```
g249.seq
  1 atgaagaata atgattgctt gcgcctgaaa aatccccagt ccggtatggc 51 gttgatagaa gtcttggtcg ctatgctcgt tctgaccatc ggtattttgg 101 cattgctgtc cgtacagttg cggacagtcg cttccgtcag ggaggcggaa 151 acgcaaacca tcgtcagcca aatcacgcaa aacctgatgg aaggaatgtt 201 gatgaatccg accattgatt tggacagcaa caagaaaaac tatagtcttt 251 acatgggaaa acagacacta tcagctgtgg atggtgagtt tatgcttgat 301 gccgagaaaa gtaaggcgca gttggcagag aacaattga agagatttag 351 tcatgagctg aaaaatgcct tgccggatgc ggtagctatt cattacgccg 401 tctgcaagga ttcgtcgggt gacgcgccga cattgtccga cagcggtgct 451 tttcttcaa attgcgacaa taaggcaaac ggggatactt tgattaaagt 501 attgtgggta aatgattcgg caggggattc ggatatttcc cgtacgaatc 551 ttgaagtgag cggcgacaat atcgtatata cctatcaggc aagggtcgga 601 ggtcgtgaat ga
```

This corresponds to the amino acid sequence <SEQ ID 968; ORF 249.ng>:

```
g249.pep
    1 MKNNDCLRLK NPQSGMALIE VLVAMLVLTI GILALLSVQL RTVASVREAE

51 TQTIVSQITQ NLMEGMLMNP TIDLDSNKKN YSLYMGKQTL SAVDGEFMLD

101 AEKSKAQLAE EQLKRFSHEL KNALPDAVAI HYAVCKDSSG DAPTLSDSGA

151 FSSNCDNKAN GDTLIKVLWV NDSAGDSDIS RTNLEVSGDN IVYTYQARVG

201 GRE*
```

The following partial DNA sequence was identified in *N. meningitidis* <SEQ ID 969>:

```
m249.seq
    1 ATGAAGAATA ATGATTGCTT CCGCCTGAAA GATTCCCAGT CCGGTATGGC

51 GCTGATAGAA GTCTTGGTTG CTATGCTCGT TCTGACCATC GGTATTTTGG

101 CACTATTGTC TGTACAGTTG CGGACAGTCN NNNNNNNNNN NNNNNNNNNN

151 NNNNNNNNNN NNNNNNNNNN NNNNNNNNNN NNNTTGATGG AGGGAATGTT

201 GATGAATCCG ACCATTGATT CGGACAGCAA CAAGAAAAAC TATAATCTTT

251 ACATGGGAAA CCATACACTA TCAGCTGTGG ATGGCGATTT TGCGATTGAT

301 GCCATGAAAA CTAAGGGGCA ATTGGCAGAG GCACAATTGA AGAGATTTAG

351 TTATGAGCTG AAAAATGCCT TGCCGGATGC GGCAGCCATC CATTACGCCG

401 TCTGCAAGGA TTCGTCGGGT AACGCGCCGA CATTGTCCGG CAATGCTTTT

451 TCTTCAAATT GCGACAATAA GGCAAACGGG GATACTTTAA TTAAAGTATT

501 GTGGGTAAAT GATTCGGCAG GGGATTCGGA TATTTCCCGT ACGAATCTTG

551 AGGTGAGCGG CGACAATATC GTATATACTT ATCAGGCAAG GGTCGGAGGT

601 CGGGAATGA
```

This corresponds to the amino acid sequence <SEQ ID 970; ORF 249>:

```
m249.pep
    1 MKNNDCFRLK DSQSGMALIE VLVAMLVLTI GILALLSVQL RTVXXXXXXX

51 XXXXXXXXXX XLMEGMLMNP TIDSDSNKKN YNLYMGNHTL SAVDGDFAID

101 AMKTKGQLAE AQLKRFSYEL KNALPDAAAI HYAVCKDSSG NAPTLSGNAF

151 SSNCDNKANG DTLIKVLWVN DSAGDSDISR TNLEVSGDNI VYTYQARVGG

201 RE*
```

Computer analysis of this amino acid sequence gave the following results:
Homology with a Predicted ORF from *N. gonorrhoeae*
ORF 249 shows 81.3% identity over a 203 aa overlap with a predicted ORF (ORF 249.ng) from *N. gonorrhoeae*:

```
m249/g249

10         20         30         40         50         60
         m249.pep  MKNNDCFRLKDSQSGMALIEVLVAMLVLTIGILALLSVQLRTVXXXXXXXXXXXXXXXXX
                   ||||||:|||: ||||||||||||||||||||||||||||||         :  :    :
         g249      MKNNDCLRLKNPQSGMALIEVLVAMLVLTIGILALLSVQLRTVASVREAETQTIVSQITQ
                      10         20         30         40         50         60
```

```
                 70         80         90        100        110        120
m249.pep    XLMEGMLMNPTIDSDSNKKNYNLYMGNHTLSAVDGDFAIDAMKTKGQLAEAQLKRFSYEL
            ||||||||||||| ||||||::|||::||||||:|:||| |:|:|||| |||||||:||
g249        NLMEGMLMNPTIDLDSNKKNYSLYMGKQTLSAVDGEFMLDAEKSKAQLAEEQLKRFSHEL
                 70         80         90        100        110        120

130        140        150        160        170        179
m249.pep    KNALPDAAAIHYAVCKDSSGNAPTLSGN-AFSSNCDNKANGDTLIKVLWVNDSAGDSDIS
            ||||||||:|||||||||||:|||||  : |||||||||||||||||||||||||||||
g249        KNALPDAVAIHYAVCKDSSGDAPTLSDSGAFSSNCDNKANGDTLIKVLWVNDSAGDSDIS
                130        140        150        160        170        180

180        190        200
m249.pep    RTNLEVSGDNIVYTYQARVGGREX
            ||||||||||||||||||||||||
g249        RTNLEVSGDNIVYTYQARVGGREX
                190        200
```

The following partial DNA sequence was identified in *N. meningitidis* <SEQ ID 971>:

```
a249.seq
  1 ATGAAGAATA ATGATTGCTT CCGCCTGAAA AACCCCCAGT CCGGTATGGC

51 GCTGATAGAA GTCTTGGTCG CTATGCTCGT TCTGACCATC GGTATTTTGG

101 CACTATTGTC TGTTCAGTTG CGGACAGTCG CTTCCGTCAG GGAGGCAGAG

151 ACGCAAACCA TCGTCAGTCA AATCACGCAA AACCTGATGG AAGGAATGTT

201 GATGAATCCG ACCATTGATT CGGACAGCAA CAAGAAAAAC TATAATCTTT

251 ACATGGGAAA CCATCATGCA CTATCAGTTG TGGATGGCGA TTTTCAGGTT

301 GATGCCATAA AAACTAAGAC GCAGTTGGCA GAGGCACAAT TGAAGAGATT

351 TAGTTATGAG CTGAAAAATG CCTTGCCGGA TGCGGCAGCC ATCCATTACG

401 CCGTCTGCAA GGATTCGTCG GGTGTTGCGC CGACATTGTC CGCCGGCAGT

451 ACTTTTTCTT CAAATTGCGA TGGTAGTGCA AATGGGGATA CTTTGATTAA

501 AGTATTGTGG GTAAATGATT CGGCAGGGGA TTCGGATATC GCCCGTACGA

551 ATCTTGAGAC GAACGGCAAC AATATCGTAT ATACCTATCA GGCAAGGGTC

601 GGAGGTCGGG AATGA
```

This corresponds to the amino acid sequence <SEQ ID 972; ORF 249.a>:

```
a249.pep
  1 MKNNDCFRLK NPQSGMALIE VLVAMLVLTI GILALLSVQL RTVASVREAE

51 TQTIVSQITQ NLMEGMLMNP TIDSDSNKKN YNLYMGNHHA LSVVDGDFQV

101 DAIKTKTQLA EAQLKRFSYE LKNALPDAAA IHYAVCKDSS GVAPTLSAGS

151 TFSSNCDGSA NGDTLIKVLW VNDSAGDSDI ARTNLETNGN NIVYTYQARV

201 GGRE*
``` m249/a249 81.9% identity in 204 aa overlap

```
                 10         20         30         40         50         60
m249.pep    MKNNDCFRLKDSQSGMALIEVLVAMLVLTIGILALLSVQLRTVXXXXXXXXXXXXXXXXX
            ||||||||||:|||||||||||||||||||||||||||||||    :   :        :
a249        MKNNDCFRLKNPQSGMALIEVLVAMLVLTIGILALLSVQLRTVASVREAETQTIVSQITQ
                 10         20         30         40         50         60
```

```
                        -continued
              70        80        90       100       110      119
m249.pep   XLMEGMLMNPTIDSDSNKKNYNLYMGNH-TLSAVDGDFAIDAMKTKGQLAEAQLKRFSYE
           ||||||||||||||||||||||||||||| ||:||||| :||:||| |||||||||||||
a249       NLMEGMLMNPTIDSDSNKKNYNLYMGNHHALSVVDGDFQVDAIKTKTQLAEAQLKRFSYE
              70        80        90       100       110      120
         120       130       140       150       160       170
m249.pep LKNALPDAAAIHYAVCKDSSGNAPTLS-GNAFSSNCDNKANGDTLIKVLWVNDSAGDSDI
         |||||||||||||||||||||| ||||| |::|||||::||||||||||||||||||||
a249     LKNALPDAAAIHYAVCKDSSGVAPTLSAGSTFSSNCDGSANGDTLIKVLWVNDSAGDSDI
            130       140       150       160       170       180
         180       190       200
m249.pep SRTNLEVSGDNIVYTYQARVGGREX
         :|||||::|:|||||||||||||||
a249     ARTNLETNGNNIVYTYQARVGGREX
            190       200
```

The following partial DNA sequence was identified in *N. meningitidis* <SEQ ID 973>:

```
m249-1.seq
   1 ATGAAGAATA ATGATTGCTT CCGCCTGAAA GATTCCCAGT CCGGTATGGC

51 GCTGATAGAA GTCTTGGTTG CTATGCTCGT TCTGACCATC GGTATTTTGG

101 CACTATTGTC TGTACAGTTG CGGACAGTCG CTTCCGTCAG GGAGGCGGAG

151 ACACAAACCA TCGTCAGCCA AATCACGCAA AACCTGATGG AGGGAATGTT

201 GATGAATCCG ACCATTGATT CGGACAGCAA CAAGAAAAAC TATAATCTTT

251 ACATGGGAAA CCATACACTA TCAGCTGTGG ATGGCGATTT TGCGATTGAT

301 GCCATGAAAA CTAAGGGGCA ATTGGCAGAG GCACAATTGA AGAGATTTAG

351 TTATGAGCTG AAAAATGCCT TGCCGGATGC GGCAGCCATC CATTACGCCG

401 TCTGCAAGGA TTCGTCGGGT AACGCGCCGA CATTGTCCGG CAATGCTTTT

451 TCTTCAAATT GCGACAATAA GGCAAACGGG GATACTTTAA TTAAAGTATT

501 GTGGGTAAAT GATTCGGCAG GGGATTCGGA TATTTCCCGT ACGAATCTTG

551 AGGTGAGCGG CGACAATATC GTATATACTT ATCAGGCAAG GGTCGGAGGT

601 CGGGAATGA
```

This corresponds to the amino acid sequence <SEQ ID 974; ORF 249-1>:

```
m249-1.pep

1 MKNNDCKRLK DSQSGMALIE VLVAMLVLTI GILALLSVQL RTVASVREAE

51 TQTIVSQITQ NLMEGMLMNP TIDSDSNKKN YNLYMGNHTL SAVDGDFAID

101 AMKTKGQLAW AQLKRFSYEL KNALPDAAAI HYAVCKDSSG NAPTLSGNAF

151 SSNCDNKANG DTLIKVLWVN DSAGDSDISR TNLEVSGDNI VYTYQARVGG

201 RE* m249-1/g249    90.1% identity in 203 aa overlap 10        20        30        40        50        60
m249-1.pep  MKNNDCFRLKDSQSGMALIWVLVAMLVLTIGILALLSVQLRTVASVREAETQTIVSQITQ
            ||||||:|||: ||||||||||||||||||||||||||||||||||||||||||||||||
g249        MKNNDCLRLKNPQSGMALIWVLVAMLVLTIGILALLSVQLRTVASVREAETQTIVSQITQ
                    10        20        30        40        50        60
```

```
                  70        80        90       100       110       120
m249-1.pep   NLMEGMLMNPTIDSDSNKKNYNLYMGNHTLSAVDGDFAIDAMKTKGQLAEAQLKRFSYEL
             ||||||||||||| ||||||||||::|||::|||||||:  :||  |:|:||||  |||||:||
g249         NLMEGMLMNPTIDLDSNKKNYSLYMGKQTLSAVDGEFMLDAEKSKAQLAEEQLKRFSHEL
                  70        80        90       100       110       120

130       140       150       160       170       179
m249-1.pep   KNALPDAAAIHYAVCKDSSGNAPTLSGN-AFSSNCDNKANGDTLIKVLWVNDSAGDSDIS
             ||||||:|||||||||||||:||||||  : |||||||||||||||||||||||||||||
g249         KNALPDAVAIHYAVCKDSSDNAPTLSDSGAFSSNCDNKANGDTLIKVLWVNDSAGDSDIS
                 130       140       150       160       170       180

180       190       200
m249-1.pep   RTNLEVSGDNIVYTYQARVGGREX
             ||||||||||||||||||||||||
g249         RTNLEVSGDNIVYTYQARVGGREX
                 190       200 a249/ L366117
        gi|643582 (L36117) prepilin leader sequence requires cleavage to be active [Pseudomonas aeruginosa]
        >gi|1161222 (L48934) involved in type 4 fimbrial biogenesis; contains pre-pilin like leader
         sequence [Pseudomonas aeruginosa]
        >gi|1246299 (L76605) reference L36117, L48934 [Pseudomonas aeruginosa] Length = 185
         Score = 50.4 bits (118), Expect = 9e-06
         Indentites - 45/183 (24%), Positives = 84/183 (45%), Gaps = 26/183 (14%)

Query:  13  QSGMALIEVLVAMLVLTIGILALLSVQLRTVASVREAETQTIVSQITQNLMEGMLMNPTI  72
                    QSG ++IEVLVA+L+++IG+L ++++Q +T+     ++  +   + +   NL+E M  +P
        Sbjct:  12  QSGFSMIEVLVALLLISIGVLVMIAMQGKTIQYTADSVERNKAAMLGSNLLESMRASPKA  71

Query:  73  DSDSNKKNYNLYMGNHHALSVVDGDFQVDAIKTKTQLAEA---QLKRFSYELKNALPDAA  129
                    D  +         M    G A   + T L +A      +L   ++ ++KN LP A
        Sbjct:  72  LYDVKDQ-----MATQSDFFKAKGSAFPTAPSSCTPLPDAIKDRLGCWAEQNKNELPGAG  126

Query: 130  AI---HYAVCKDSSGVAPTLSAGSTFSSNCDGSANGDTL-IKVLWVNDSAGDSDIARTNL 185
                     +      Y +C+ S         +CDG  G  L I++ W        + A ++
        Sbjct: 127  DLLKSDYYICRSSK-----------PGDCDG--KGSMLEIRLAWRGKQGACVNAADSSA  172

Query: 186  ETN 188
                    +T+
        Sbjct: 173  DTS 175 m249-1/a249    90.7% identity in 204 aa overlap 10        20        30        40        50        60
m249-1.pep   MKNNDCFRLKDSQSGMALIEVLVAMLVLTIGILALLSVQLRTVASVREAETQTIVSQITQ
             |||||||||| : ||||||||||||||||||||||||||||||||||||||||||||||
a249         MKNNDCFRLKNPQSGMALIEVLVAMLVLTIGILALLSVQLRTVASVREAETQTIVSQITQ
                   10        20        30        40        50        60

70        80        90       100       110       119
m249-1.pep   NLMEGMLMNPTIDSDSNKKNYNLYMGNH-TLSAVDGDFAIDAMKTKGQLAEAQLKRFSYE
             |||||||||||||||||||||||||||| :||:|||| :||: |||||||||||||||||
a249         NLMEGMLMNPTIDSDSNKKNYNLYMGNHHALSVVDGDFQVDAIKTKTQLAEAQLKRFSYE
                   70        80        90       100       110       120

120       130       140       150       160       170       179
m249-1.pep   LKNALPDAAAIHYAVCKDSSGNAPTLS-GNAFSSNCDNKANGDTLIKVLWVNDSAGDSDI
             ||||||||: |||||||||||:|||||  : |||||||::||||||||||||||||||||
a249         LKNALPDAVAIHYAVCKDSSDVAPTLSAGSTFSSNCDGSANGDTLIKVLWVNDSAGDSDI
                  130       140       150       160       170       180

180       190       200
m249-1.pep   SRTNLEVSGDNIVYTYQARVGGREX
             :|||||::|:||||||||||||||
a249         SRTNLETNGNNIVYTYQARVGGREX
                 190       200
```

The following partial DNA sequence was identified in *N. gonorrhoeae* <SEQ ID 975>:

```
g250.seq
  1 atgacgcaca cagcctctcc acgtgatgaa ttcatacgcg gcataaaaga 51 aagttcgccc atgctgattg gcttttgcc ttgggcattg atactcggta 101 tgcagggcgg gcaaaaaggt atgggccggc tggaaatgct gctgatgacg 151 gggatgaact tgccggcgg ctccgaattt gccacggtca acctgtgggc 201 ggaacctctg ccgatactgc ttatcgccac cataacctt atgattaatt 251 cgcggcatat cctgatgggg ggcggcgctt gccacgcaca tgaaagaaat 301 accgctgaaa aaagccgcgc ccgcgctgtt ttttatgtgt ga
```

This corresponds to the amino acid sequence <SEQ ID 976; ORF 250.ng>:

```
g250.pep
   1 MTHTASPRDE FIRGIKESSP MLIGLLPWAL ILGMQGGQKG MGRLEMLLMT

51 GMNFAGGSEF ATVNLWAEPL PILLIATITF MINSRHILMG GGACHAHERN

101 TAEKSRARAV FYV*
```

The following partial DNA sequence was identified in *N. meningitidis* <SEQ ID 977>:

```
m250.seq
   1 ATGCACACCT TCCCCGCATA ACGAATTTAT ACGCGGCATC AAAGAAAGTT

51 CGCCTATGCT GATTGGGCTG CTGCCTTGGG CATTAATACT CGGTATGCAG

101 GGCGGACAAA AAGGCATGAG CTGGCTGGAA ATGTTGTTGA TGACCAGTAT

151 GAACTTCGCC GGCGGCTCCG AGTTTGCCAC GGTCAACCTG TGGGCsGAAC

201 CTCTGCCGAT ACTGCTTATC GCCACCGTAA CCTTTATGAT TAATTCTCGG

251 CATATCCTGA T.GGGGGCGG CGCTTGCCCC GCACCTGAAA GGAaTACCGC

301 TGAAAAAAGC CGTGCCCGCA CTGTTTTTTA TGTGTGA
```

This corresponds to the amino acid sequence <SEQ ID 978; ORF 250>:

```
m250.pep
   1 MHTPSPHNEF IRGIKESSPM LIGLLPWALI LGMQGGQKGM SWLEMLLMTS

51 MNFAGGSEFA TVNLWAEPLP ILLIATVTFM INSRHILMGG GACPAPERNT

101 AEKSRARTVF YV*
```

Computer analysis of this amino acid sequence gave the following results:
Homology with a Predicted ORF from *N. gonorrhoeae*
ORF 250 shows 91.0% identity over a 111 aa overlap with a predicted ORF (ORF 250.ng) from *N. gonorrhoeae*:

```
m250/g250

10         20         30         40         50         59
      m250.pep   MHTPSPHNEFIRGIKESSPMLIGLLPWALILGMQGGQKGMSWLEMLLMTSMNFAGGSEF
                 || ||::||||||||||||||||||||||||||||||||: |||||||:|||||||||
      g250       MTHTASPRDEFIRGIKESSPMLIGLLPWALILGMQGGQKGMGRLEMLLMTGMNFAGGSEF
                         10         20         30         40         50         60

60         70         80         90        100        110
      m250.pep   ATVNLWAEPLPILLIATVTFMINSRHILMGGGACPAPERNTAEKSRARTVFYVX
                 ||||||||||||||||||:||||||||||||||| ||||||||||||:||||
      g250       ATVNLWAEPLPILLIATITFMINSRHILMGGGACHAHERNTAEKSRARAVFYV
                         70         80         90        100        110
```

The following partial DNA sequence was identified in *N. meningitidis* <SEQ ID 979>:

```
a250.seq
   1 ATGACACACA TAAGCTCGCC CCGTAACGAA TTTATACGCG GCATCAAAGA

51 AAGTTCGCCC ATGCTGATCG GGCTTTTGCC TTGGGCATTA ATACTCGGTA

101 TGCAGGGTGG ACAAAAAGGC ATGAGCTGGC TGGAAATGTT GTTGATGACC

151 GGTATGAACT TCGCCGGCGG CTCCGAGTTT GCCACGGTCA ACCTGTGGGC

201 GGAACCTCTG CCGATACTGC TTATCGCCAC CGTAACCTTT ATGATTAATT
```

```
251 CTCGGCATAT CCTGATGGGG G.CGGCACTT GCCCCGCACC TGAAAGAAAT

301 ACCGCTGAAA AAAGCCGTGC CCGCACTGTT TTTTATGTGT GA
```

This corresponds to the amino acid sequence <SEQ ID 980; ORF 250.a>:

```
a250.pep
   1 MTHISSPRNE FIRGIKESSP MLIGLLPWAL ILGMQGGQKG MSWLEMLLMT

51 GMNFAGGSEF ATVNLWAEPL PILLIATVTF MINSRHILMG XGTCPAPERN

101 TAEKSRARTV FYV*
``` m250/a250 94.6% identity in 111 aa overlap

```
                     10         20         30         40         50         59
    m250.pep  MHTPSPHNEFIRGIKESSPMLIGLLPWALILGMQGGQKGMSWLEMLLLMTSMNFAGGSEF
              |  ||:|||||||||||||||||||||||||||||||||||||||||:||||||||
    a250      MTHISSPRNEFIRGIKESSPMLIGLLPWALILGMQGGQKGMSWLEMLLMTGMNFAGGSEF
                     10         20         30         40         50         60
                     60         70         80         90        100        110
    m250.pep  ATVNLWAEPLPILLIATVTFMINSRHILMGGGACPAPERNTAEKSRARTVFYVX
              |||||||||||||||||||||||||||||||||| |:||||||||||||||||
    a250      ATVNLWAEPLPILLIATVTFMINSRHILMGTGTCPAPERNTAEKSRARTVFYVX
                     70         80         90        100        110
```

The following partial DNA sequence was identified in *N. gonorrhoeae* <SEQ ID 981>:

```
g251.seq
   1 atgcctgacc caatagggat tcttttcgct gccgtcgggg ttgattttt 51 tgccgttgtt ttgagggggc gttttcaacg aataggcgcg gttggcatgt 101 tgataataat aatcctgatg gcggaggtcg gaaccaaaac ggtcgtaacc 151 gaggttgacg ctcaggttgt ggcggatttt ggcggtatcg aaggattttt 201 tgaatgccgc ctgcaagagc ctgtggcttt ccccgtaaat cacgcggtcg 251 gatttgtagt aggaagacgg cttgtcggca ctcgggcggc aatatttgtc 301 cgaaccgtcg gcggaacagt gcgtctgctg aaaatgattg tccaaaccga 351 tgccctgccg gtcgtaagag aggcgggcat aatccgccca agtgtcttta 401 tcggcattgg tatagacata ttccaaaccg tagcggcttt tggtgtgcgt 451 ctcgtcgtaa aacacgcccg taccgtattc cgcgcccacc tccgcaccgt 501 tttcaccgtt ggtaatcagc ccgctgtatt tgcggccgcc cgcgtatttg 551 ccgtagcctc ttatcgatcc gtattttta ttttcatcaa aaaccgcctt 601 ggtcaggaat gccggaaccg tcatatcgcg cgtgtcgaaa gtttgctgcg 651 tgcgttcgag tatgccgccg atgtagtgcc gtttgttttc aaaacgaaaa 701 cccgggcgga acagccacga ccggctttcg tatga
```

This corresponds to the amino acid sequence <SEQ ID 982; ORF 251.ng>:

```
g251.pep
   1 MPDPIGILFA AVGVDFFAVV LRGRFQRIGA VGMLIIIILM AEVGTKTVVT

51 EVDAQVVADF GGIEGFFECR LQEPVAFPVN HAVGFVVGRR LVGTRAAIFV
```

-continued

101 RTVGGTVRLL KMIVQTDALP VVREAGIIRP SVFIGIGIDI FQTVAAFGVR

151 LVVKHARTVF RAHLRTVFTV GNQPAVFAAA RVFAVASYRS VFFIFIKNRL

201 GQECRNRHIA RVESLLRAFE YAADVVPFVF KTKTRAEQPR PAFV*

The following partial DNA sequence was identified in *N. meningitidis* <SEQ ID 983>:

m251.seq

1 ATGCGTGCTG CGGTAGTCGT AGCGCAAGCC CGCGCCGACA TCCGCCCACC

51 TGCCCAAACG GACATTGTCC CGAACTGCCG CGTAATAGCT TTTACCGTTG

101 ATGCTGCGCG GCGTGCAGTC CGTATAAGTA TTGTTGCCCA AGCGGCAGAT

151 TTGCCCCGTA ACGACATTTC CCCTGCCTAT GGTGACCCAA TAGGGGCTGG

201 TTTCACTGCC GTTGGGGCTG ATTTTTTTGC CGTTGTTTTG AGGGGGCGTG

251 TTCGACGAAT AGGCGCGGTT GGCATGTTGA TAATAATAAT CCTGATGGCG

301 GAGATTAGAG CCAAAGCGGT CAAACCCGAG ATTCACGCTC AGGTTGTGGC

351 GGATTTTGGC GGTATCGAAG GATTTTTTGA ATGCCGCCTG CAAGAGCCTG

401 TGGCTTTCCC CGTAAATCAC GCGATCGGAT TTGTAATAGG AAAACGGCTT

451 GTCGGCACTC GGGCGGCAAT ATTTGTCCGA ACCGTCGGCA GAACAGTGCG

501 TCTGCTGAAA ATGATTATCC AAACCGATGC CCTGCCGGTC GTAAGAGAGG

551 CGGGCATAAT CCGCCCAAGT GTCTTTATCG GCATTGGTAT AGACATATTC

601 CAAACCGTAG CGGCTTTTGG TGTGCGTCTC GTCGTAAAAC ACGCCCGTAC

651 CGTATTCCGC GCCCACCAGC GCACCGTTTT CGCCGTTGGT AAACAGTCCG

701 CCGTATTTGT GGTTGCCCGC GTATTTGCCG TTACCGGGCA AAGAACCCGC

751 CTGTTTTTTA TTTGCATCAA AAACCGCCTT GGTCAGGAAT GCCGGAACCG

801 TCATATCGCG CGTGTCGAAA GTTTGTTGCG TGTGTTCGAG TATGCCGCCG

851 ATGTAGTGCC GCTTATTCTC AAAACGAAAA CCCGGGCGGA ACAGCCACGA

901 CCGGCTTTCG TATGA

This corresponds to the amino acid sequence <SEQ ID 984; ORF 251>:

m251.pep

1 MRAAVVVAQA RADIRPPAQT DIVPNCRVIA FTVDAARRAV RISIVAQAAD

51 LPRNDISPAY GDPIGAGFTA VGADFFAVVL RGRVRRIGAV GMLIIIILMA

101 EIRAKAVKPE IHAQVVADFG GIEGFFECRL QEPVAFPVNH AIGFVIGKRL

151 VGTRAAIFVR TVGRTVRLLK MIIQTDALPV VREAGIIRPS VFIGIGIDIF

201 QTVAAFGVRL VVKHARTVFR AHQRTVFAVG KQSAVFVVAR VFAVTGQRTR

251 LFFICIKNRL GQECRNRHIA RVESLLRVFE YAADVVPLIL KTKTRAEQPR

301 PAFV*

Computer analysis of this amino acid sequence gave the following results:

Homology with a Predicted ORF from *N. gonorrhoeae*

ORF 251 shows 85.2% identity over a 243 aa overlap with a predicted ORF (ORF 251.ng) from *N. gonorrhoeae*:

```
m251/g251

40        50        60        70        80        90
        m251.pep    TVDAARRAVRISIVAQAADLPRNDISPAYGDPIGAGFTAVGADFFAVVLRGRVRRIGAVG
                       ||||  |:|||:|||||||||| :|||||
        g251                                MPDPIGILFAAVGVDFFAVVLRGRFQRIGAVG
                                            10        20        30

100       110       120       130       140       150
        m251.pep    MLIIIILMAEIRAKAVKPEIHAQVVADFGGIEGFFECRLQEPVAFPVNHAIGFVIGKRLV
                    |||||||||||:  :|:|  ||: |||||||||||||||||||||||||||:|||:|:||
        g251       MLIIIILMAEVGTKTVVTEVDAQVVADFGGIEGFFECRLQEPVAFPVNHAVGFVVGRRLV
                       40        50        60        70        80        90

160       170       180       190       200       210
        m251.pep    GTRAAIFVRTVGRTVRLLKMIIQTDALPVVREAGIIRPSVFIGIGIDIFQTVAAFGVRLV
                    |||||||||||| ||||||||:|||||||||||||||||||||||||||||||||||||
        g251       GTRAAIFVRTVGGTVRLLKMIVQTDALPVVREAGIIRPSVFIGIGIDIFQTVAAFGVRLV
                      100       110       120       130       140       150

220       230       240       250       260       270
        m251.pep    VKHARTVFRAHQRTVFAVGKQSAVFVVARVFAVTGQRTRLFFICIKNRLGQECRNRHIAR
                    ||||||||||| |||:|||:| |||::|||||::  |: :||| ||||||||||||||||
        g251       VKHARTVFRAHLRTVFTVGNQSAVFAAARVFAVASQRS-VFFIFIKNRLGQECRNRHIAR
                      160       170       180       190       200       210

280       290       300
        m251.pep    VESLLRVFEYAADVVPLILKTKTRAEQPRPAFVX
                    ||||||:||||||||: :|||||||||||||||
        g251       VESLLRAFEYAADVVPFVFKTKTRAEQPRPAFVX
                      220       230       240
```

The following partial DNA sequence was identified in *N. meningitidis* <SEQ ID 985>:

```
a251.seq
  1 ATGCGTGCTG CGGTAGTCGT AGCGCAACCC CGCGCCGACA TCCGCCCACC

51 TGCCCAAACG GACATTGTCC CGAACTGCCG CGTAATAGCT TTTGCCGTTG

101 ATGCTGCGCG GCGTGCAGTC CGTATAAGTA TTGTTGCCCA AGCGGCAGAT

151 TTGCCCCGTA ACCACATTTC CCCTGCCTAT GCTGACCCAA TAGGGTTGGT

201 CCTTGCCGCC GTTGGGGTTG GCGGTTTTAG GGGGCGTTTT CGACGAATAG

251 GCGCGGTTGG CATGTTGATA ATAATAATCC TGATGGCGGA GATTAGAGTC

301 AAAGCGGTCA AAACCGAGAT TCACGCTCAG GTTGTGGCGG ATTTTGGCGG

351 TATCGAAGGA TTTTTTGAAT GCCGCCTGCA AGAGCCTGTG GCTTTCCCCG

401 TAAATCACGC GGTCGGATTT GTAGTAGGAA AACGGCTTGT CGGCACTCGG

451 GCGGCAATAT TTGTCCGAAC CGTCGGCAGA ACAGTGCGTC TGCTGAAAAT

501 GATTGTCCAA ACCGATGCCC TGCCGGTCGT AAGAGAGGCG GGCATAATCC

551 ACCCAAGTGT CTTTATCGGC ATTGGTATAG ACATATTCCA AACCGTAGCG

601 GCTTTTGGTG TGCGTCTCGT CGTAAAACAC GCCCGTACCG TATTCCGCGC

651 CCACCAGCGC ACCGTTTTCG CCGTTGGTAA ACAGACCGCC GTATTTGTGG

701 TCGCCCGCGT ATTTGCCGTT GCCTCTTATC GGTCCGTATT TTCTATTTTC

751 ATCAAAAACC GCCTTGGTCA GGAATGCCGG AACCGTCATA TCGCGCGTGT

801 CGAAAGTTTG TTGCGTGTGT TCGAGTATGC CGCCGATGTA GTGCCGTTTG

851 TTTTCAAAAC GAAAACCCGG GCGGAACAGC CACGATCGGC TTTCGTATGA
```

This corresponds to the amino acid sequence <SEQ ID 986; ORF 251.a>:

```
a251.pep
   1 MRAAVVVAQP RADIRPPAQT DIVPNCRVIA FAVDAARRAV RISIVAQAAD

51 LPRNHISPAY ADPIGLVLAA VGVGGFRGRF RRIGAVGMLI IIILMAEIRV

101 KAVKTEIHAQ VVADFGGIEG FFECRLQEPV AFPVNHAVGF VVGKRLVGTR

151 AAIFVRTVGR TVRLLKMIVQ TDALPVVREA GIIHPSVFIG IGIDIFQTVA

201 AFGVRLVVKH ARTVFRAHQR TVFAVGKQTA VFVVARVFAV ASYRSVFSIF

251 IKNRLGQECR NRHIARVESL LRVFEYAADV VPFVFKTKTR AEQPRSAFV*
``` m251/a251 88.5% identity in 304 aa overlap

```
                   10         20         30         40         50         60
    m251.pep  MRAAVVVAQARADIRPPAQTDIVPNCRVIAFTVDAARRAVRISIVAQAADLPRNDISPAY
              ||||||||||  ||||||||||||||||||||| ||||||||||||||||||||  ||||
        a251  MRAAVVVAQPRADIRPPAQTDIVPNCRVIAFAVDAARRAVRISIVAQAADLPRNHISPAY
                      10         20         30         40         50         60

70         80         90        100        110        120
    m251.pep  GDPIGAGFTAVGADFFAVVLRGRVRRIGAVGMLIIIILMAEIRAKAVKPEIHAQVVADFG
              :||||  ::|||:  |   ||| ||||||||||||||||||:|||  ||||||||||||
        a251  ADPIGLVLAAVGVGGF----RGRFRRIGAVGMLIIIILMAEIRVKAVKTEIHAQVVADFG
                      70         80         90        100        110

130        140        150        160        170        180
    m251.pep  GIEGFFECRLQEPVAFPVNHAIGFVIGKRLVGTRAAIFVRTVGRTVRLLKMIIQTDALPV
              |||||||||||||||||||||:|||:||||||||||||||||||||||||||:||||||
        a251  GIEGFFECRLQEPVAFPVNHAVGFVVGKRLVGTRAAIFVRTVGRTVRLLKMIVQTDALPV
                     120        130        140        150        160        170

190        200        210        220        230        240
    m251.pep  VREAGIIRPSVFIGIGIDIFQTVAAFGVRLVVKHARTVFRAHQRTVFAVGKQSAVFVVAR
              ||||||:|||||||||||||||||||||||||||||||||||||||||||||:||||||
        a251  VREAGIIHPSVFIGIGIDIFQTVAAFGVRLVVKHARTVFRAHQRTVFAVGKQTAVFVVAR
                     180        190        200        210        220        230

250        260        270        280        290        300
    m251.pep  VFAVTGQRTRLFFICIKNRLGQECRNRHIARVESLLRVFEYAADVVPLILKTKTRAEQPR
              ||||::  |: :|  | ||||||||||||||||||||||||||||:::|||||||||||
        a251  VFAVASYRS-VFSIFIKNRLGQECRNRHIARVESLLRVFEYAADVVPFVFKTKTRAEQPR
                     240        250        260        270        280        290 m251.pep  PAFVX
              ||||
        a251  SAFVX
                     300
```

The following partial DNA sequence was identified in *N. gonorrhoeae* <SEQ ID 987>:

```
g253.seq
   1 atgatcgaca gggaccgtat gttgcgggac acgttggaac gtgtgcgtgc 51 ggggtcgttc tggttatggg tggtggtggc atcgatgatg tttaccgccg 101 gattttcagg cacttatctt ctgatggaca atcaggggct gaatttcttt 151 ttagttttgg cgggagtgtt gggcatgaat acgctgatgc tggcagtatg 201 gttggcaacg ttgttcctgc gcgtgaaagt gggacggttt tcagcagtc 251 cggcgacgtg gtttcggggc aaaggccctg taaatcaggc ggtgttgcgg 301 ctgtatgcgg accagtggcg gcaaccttcg gtacgatgga aaataggcgc 351 aacggcgcac agcttgtggc tctgcacgct gctcggaatg ctggtgtcgg 401 tattgctgct gcttttggtg cggcaatata cgttcaactg gaaagcacg 451 ctgttgagca atgccgcttc ggtacgcgcg gtggaaatgt tggcatggct 501 gccgtcgaaa ctcggttttcc ctgtccccga tgcgcgggcg gtcatcgaag
```

```
 551 gtcgtctgaa cggcaatatt gccgatgcgc gggcttggtc ggggctgctg 601 gtcggcagta tcgtctgcta cggcatcctg ccgcgcctct tggcttgggt 651 agtgtgtaaa atccttttga aaacaagcga aaacggattg gatttggaaa 701 aaacctatta tcaggcggtc atccgccgct ggcagaacaa aatcaccgat 751 gcggatacgc gtcgggaaac cgtgtccgcc gtttcgccga aaatcgtctt 801 gaacgatgcg ccgaaatggg cgctcatgct ggagaccgag tggcaggacg 851 gccaatggtt cgagggcagg ctggcgcagg aatggctgga taagggcgtt 901 gccgccaatc gggaacaggt tgccgcgctg gagacagagc tgaagcagaa 951 accggcgcaa ctgcttatcg gcgtacgcgc ccaaactgtg ccggaccggg 1001 gcgtgctgcg gcagattgtg cggctttcgg aagcggcgca gggcggcgcg 1051 gtggtgcagc ttttggcgga acaggggctt tcagacgacc tttcggaaaa 1101 gctggaacat tggcgtaacg cgctgaccga atgcggcgcg cgtggcttg 1151 agcctgacag ggtggcgcag gaaggccgtt tgaaagacca ataa
```

This corresponds to the amino acid sequence <SEQ ID 988; ORF 253.ng>:

```
g253.pep
  1 MIDRDRMLRD TLERVRAGSF WLWVVVASMM FTAGFSGTYL LMDNQGLNFF

51 LVLAGVLGMN TLMLAVWLAT LFLRVKVGRF FSSPATWFRG KGPVNQAVLR

101 LYADWRQPS VRWKIGATAH SLWLCTLLGM LVSVLLLLLV RQYTFNWEST

151 LLSNAASVRA VEMLAWLPSK LGFPVPDARA VIEGRLNGNI ADARAWSGLL

201 VGSIVCYGIL PRLLAWVVCK ILLKTSENGL DLEKTYYQAV IRRWQNKITD

251 ADTRRETVSA VSPKIVLNDA PKWALMLETE WQDGQWFEGR LAQEWLDKGV

301 AANREQVAAL ETELKQKPAQ LLIGVRAQTV PDRGVLRQIV RLSEAAQGGA

351 VVQLLAEQGL SDDLSEKLEH WRNALTECGA AWLEPDRVAQ EGRLKDQ*
                                                      40
```

The following partial DNA sequence was identified in *N. meningitidis* <SEQ ID 989>:

```
m253.seq
  1 ATGATTGACA GGAACCGTAT GCTGCGGGAG ACGTTGGAAC GTGTGCGTGC

51 GGGGTCGTTC TGGTTGTGGG TGGTGGCGGC GACGTTTGCA TTTTTTACCG

101 GTTTTTCAGT CACTTATCTT CTAATGGACA ATCAGGGTCT GAATTTCTTT

151 TTGGTTTTGG CGGGCGTGTT GGGCATGAAT ACGCTGATGC TGGCAGTATG

201 GTTGGCAATG TTGTTCCTGC GTGTGAAAGT GGGGCGTTTT TTCAGCAGTC

251 CGGCGACGTG GTTTCGGGGC AAAGACCCTG TAAATCAGGC GGTGTTGCGG

301 CTGTATGCGG ACGAGTGGCG GCAACCTTCG GTACGTTGGA AAATAGGCGC

351 AACGTCGCAC AGCCTGTGGC TCTGCACGCT GCTCGGAATG CTGGTGTCGG

401 TATTGTTGCT GCTTTTGGTG CGGCAATATA CGTTCAACTG GGAAAGCACG

451 CTGTTGAGCA ATGCCGCTTC GGTACGCGCG GTGGAAATGT TGGCATGGCT

501 GCCGTCGAAA CTCGGTTTCC CTGTCCCCGA TGCGCGGGCG GTCATCGAAG

551 GCCGTCTGAA CGGCAATATT GCCGATGCGC GGGCTTGGTC GGGGCTGCTG

601 GTCGGCAGTA TCGCCTGCTA CGGCATCCTG CCGCGCCTGC TGGCTTGGGT
```

-continued
```
 651 AGTGTGTAAA ATCCTTTTGA AAACAAGCGA AAACGGATTG GATTTGGAAA

701 AGCCCTATTA TCAGGCGGTC ATCCGCCGCT GGCAGAACAA AATCACCGAT

751 GCGGATACGC GTCGGGAAAC CGTGTCCGCC GTTTCACCGA AAATCATCTT

801 GAACGATGCG CCGAAATGGG CGGTCATGCT GGAGACCGAG TGGCAGGACG

851 GCGAATGGTT CGAGGGCAGG CTGGCGCAGG AATGGCTGGA TAAGGGCGTT

901 GCCACCAATC GGGAACAGGT TGCCGCGCTG GAGACAGAGC TGAAGCAGAA

951 ACCGGCGCAA CTGCTTATCG GCGTGCGCGC CCAAACTGTG CCGGACCGCG

1001 GCGTGTTGCG GCAGATTGTC CGACTCTCGG AAGCGGCGCA GGGCGGCGCG

1051 GTGGTGCAGC TTTTGGCGGA ACAGGGGCTT TCAGACGACC TTTCGGAAAA

1101 GCTGGAACAT TGGCGTAACG CGCTGGCCGA ATGCGGCGCG GCGTGGCTTG

1151 AGCCTGACAG GGCGGCGCAG GAAGGGCGTT TGAAAGACCA ATAA
```

This corresponds to the amino acid sequence <SEQ ID 990; ORF 253>:

```
m253.pep
   1 MIDRNRMLRE TLERVRAGSF WLWVVAATFA FFTGFSVTYL LMDNQGLNFF

51 LVLAGVLGMN TLMLAVWLAM LFLRVKVGRF FSSPATWFRG KDPVNQAVLR

101 LYADEWRQPS VRWKIGATSH SLWLCTLLGM LVSVLLLLLV RQYTFNWEST

151 LLSNAASVRA VEMLAWLPSK LGFPVPDARA VIEGRLNGNI ADARAWSGLL

201 VGSIACYGIL PRLLAWVVCK ILLKTSENGL DLEKPYYQAV IRRWQNKITD

251 ADTRRETVSA VSPKIILNDA PKWAVMLETE WQDGEWFEGR LAQEWLDKGV

301 ATNREQVAAL ETELKQKPAQ LLIGVRAQTV PDRGVLRQIV RLSEAAQGGA

351 VVQLLAEQGL SDDLSEKLEH WRNALAECGA AWLEPDRAAQ EGRLKDQ*
```

Computer analysis of this amino acid sequence gave the following results:
Homology with a Predicted ORF from *N. gonorrhoeae*
ORF 253 shows 94.7% identity over a 397 aa overlap with a predicted ORF (ORF 253.ng) from *N. gonorrhoeae*:

```
m253/g253
                    10         20         30         40         50         60
     m253.pep  MIDRNRMLRETLERVRAGSFWLWVVAATFAFFTGFSVTYLLMDNQGLNFFLVLAGVLGMN
               ||||:||||:|||||||||||||||||:|::  |  :|||  ||||||||||||||||||
     g253      MIDRDRMLRDTLERVRAGSFWLWVVASMMFTAGFSGTYLLMDNQGLNFFLVLAGVLGMN
                    10         20         30         40         50         60

70         80         90        100        110        120
     m253.pep  TLMLAVWLAMLFLRVKVGRFFSSPATWFRGKDPVNQAVLRLYADEWRQPSVRWKIGATSH
               |||||||||| |||||||||||||||||||| ||||||||||||:|||||||||||||:|
     g253      TLMLAVWLATLFLRVKVGRFFSSPATWFRGKGPVNQAVLRLYADQWRQPSVRWKIGATAH
                    70         80         90        100        110        120

130        140        150        160        170        180
     m253.pep  SLWLCTLLGMLVSVLLLLLVRQYTFNWESTLLSNAASVRAVEMLAWLPSKLGFPVPDARA
               ||||||||||||||||||||||||||||||||||||||||||||||||||||||||||||
     g253      SLWLCTLLGMLVSVLLLLLVRQYTFNWESTLLSNAASVRAVEMLAWLPSKLGFPVPDARA
                   130        140        150        160        170        180

190        200        210        220        230        240
     m253.pep  VIEGRLNGNIADARAWSGLLVGSIACYGILPRLLAWVVCKILLKTSENGLDLEKPYYQAV
               |||||||||||||||||||||||:|||||||||||||||||||||||||||||| ||||
     g253      VIEGRLNGNIADARAWSGLLVGSIVCYGILPRLLAWVVCKILLKTSENGLDLEKTYYQAV
                   190        200        210        220        230        240

250        260        270        280        290        300
     m253.pep  IRRWQNKITDADTRRETVSAVSPKIILNDAPKWAVMLETEWQDGEWFEGRLAQEWLDKGV
               |||||||||||||||||||||||||:|||||||||:||||||||||:|||||||||||||
     g253      IRRWQNKITDADTRRETVSAVSPKIVLNDAPKWALMLETEWQDGQWFEGRLAQEWLDKGV
                   250        260        270        280        290        300
```

-continued

```
                 310        320        330        340        350        360
m253.pep    ATNREQVAALETELKQKPAQLLIGVRAQTVPDRGVLRQIVRLSEAAQGGAVVQLLAEQGL
            |:||||||||||||||||||||||||||||||||||||||||||||||||||||||||||
g253        AANREQVAALETELKQKPAQLLIGVRAQTVPDRGVLRQIVRLSEAAQGGAVVQLLAEQGL
                 310        320        330        340        350        360

370        380        390
m253.pep    SDDLSEKLEHWRNALAECGAAWLEPDRAAQEGRLKDQX
            |||||||||||||||:|||||||||||:||||||||||
g253        SDDLSEKLEHWRNALTECGAAWLEPDRVAQEGRLKDQX
                 370        380        390
```

The following partial DNA sequence was identified in *N. meningitidis* <SEQ ID 991>:

```
a253.seq
   1 ATGATCGACA GGAACCGTAT GCTGCGGGAG ACGTTGGAAC GTGTGCGTGC

51 GGGGTCGTTC TGGTTGTGGG TGGCGGCGGC GACGTTTGCG TTTTTTACCG

101 GTTTTTCAGT TACTTATCTT CTAATGGACA ATCAGGGTCT GAATTTCTTT

151 TTGGTTTTGG CGGGCGTGTT GGGCATGAAT ACGCTGATGC TGGCAGTATG

201 GTTGGCAATG TTGTTCCTGC GCGTGAAAGT GGGGCGTTTT TTCAGCAGTC

251 CGGCGACGTG GTTTCGGGGC AAAGACCCTG TCAATCAGGC GGTGTTGCGG

301 CTGTATGCGG ACGAGTGGCG GCAACCTTCG GTACGTTGGA AAATAGGCGC

351 AACGTCGCAC AGCCTGTGGC TCTGCACGCT GCTCGGAATG CTGGTGTCGG

401 TATTGTTGCT GCTTTTGGTG CGGCAATATA CGTTCAACTG GGAAAGCACG

451 CTGTTGGGCG ATTCGTCTTC GGTACGGCTG GTGGAAATGT TGGCATGGCT

501 GCCTGCGAAA CTGGGTTTTC CCGTGCCTGA TGCGCGGGCG GTCATCGAAG

551 GTCGTCTGAA CGGCAATATT GCCGATGCGC GGGCTTGGTC GGGGCTGCTG

601 GTCGGCAGTA TCGCCTGCTA CGGCATCCTG CCGCGCCTCT TGGCTTGGGC

651 GGTATGCAAA ATCCTTTTGA AAACAAGCGA AAACGGCTTG GATTTGGAAA

701 AGCCCTATTA TCAGGCGGTC ATCCGCCGCT GGCAGAACAA AATCACCGAT

751 GCGGATACGC GTCGGGAAAC CGTGTCCGCC GTTTCGCCGA AAATCGTCTT

801 GAACGATGCG CCGAAATGGG CGGTCATGCT GGAGACCGAA TGGCAGGACG

851 GCGAATGGTT CGAGGGCAGG CTGGCGCAGG AATGGCTGGA TAAGGGCGTT

901 GCCGCCAATC GGGAACAGGT TGCCGCGCTG GAGACAGAGC TGAAGCAGAA

951 ACCGGCGCAA CTGCTTATCG GCGTGCGCGC CCAAACTGTG CCCGACCGCG

1001 GCGTGTTGCG GCAGATCGTC CGACTTTCGG AAGCGGCGCA GGGCGGCGCG

1051 GTGGTGCAGC TTTTGGCGGA ACAGGGGCTT TCAGACGACC TTTCGGAAAA

1101 GCTGGAACAT TGGCGTAACG CGCTGACCGA ATGCGGCGCG GCGTGGCTGG

1151 AACCCGACAG AGCGGCGCAG GAAGGCCGTC TGAAAACCAA CGACCGCACT

1201 TGA
```

This corresponds to the amino acid sequence <SEQ ID 992; ORF 253.a>:

a253.pep

1 MIDRNRMLRE TLERVRAGSF WLWVAAATFA FFTGFSVTYL LMDNQGLNFF

51 <u>LVLAGVLGMN TLMLAV</u>WLAM LFLRVKVGRF FSSPATWFRG KDPVNQAVLR

101 LYADEWRQPS VRWKIGATSH SLW<u>LCTLLGM LVSVLLLLLV</u> RQYTFNWEST

```
151 LLGDSSSVRL VEMLAWLPAK LGFPVPDARA VIEGRLNGNI ADARAWSGLL

201 VGSIACYGIL PRLLAWAVCK ILLKTSENGL DLEKPYYQAV IRRWQNKITD

251 ADTRRETVSA VSPKIVLNDA PKWAVMLETE WQDGEWFEGR LAQEWLDKGV

301 AANREQVAAL ETELKQKPAQ LLIGVRAQTV PDRGVLRQIV RLSEAAQGGA

351 VVQLLAEQGL SDDLSEKLEH WRNALTECGA AWLEPDRAAQ EGRLKTNDRT

401 *
``` m253/a253 97.2% identity in 395 aa overlap

```
                    10         20         30         40         50         60
m253.pep    MIDRNRMLRETLERVRAGSFWLWVVAATFAFFTGFSVTYLLMDNQGLNFFLVLAGVLGMN
            ||||||||||||||||||||||||:|||||||||||||||||||||||||||||||||||
a253        MIDRNRMLRETLERVRAGSFWLWVAAATFAFFTGFSVTYLLMDNQGLNFFLVLAGVLGMN
                    10         20         30         40         50         60
                    70         80         90        100        110        120
m253.pep    TLMLAVWLAMLFLRVKVGRFFSSPATWFRGKDPVNQAVLRLYADEWRQPSVRWKIGATSH
            ||||||||||||||||||||||||||||||||||||||||||||||||||||||||||||
a253        TLMLAVWLAMLFLRVKVGRFFSSPATWFRGKDPVNQAVLRLYADEWRQPSVRWKIGATSH
                    70         80         90        100        110        120
                   130        140        150        160        170        180
m253.pep    SLWLCTLLGMLVSVLLLLLVRQYTFNWESTLLSNAASVRAVEMLAWLPSKLGFPVPDARA
            ||||||||||||||||||||||||||||||||:::::|||:||||||||:||||||||||
a253        SLWLCTLLGMLVSVLLLLLVRQYTFNWESTLLGDSSSVRLVEMLAWLPAKLGFPVPDARA
                   130        140        150        160        170        180
                   190        200        210        220        230        240
m253.pep    VIEGRLNGNIADARAWSGLLVGSIACYGILPRLLAWVVCKILLKTSENGLDLEKPYYQAV
            ||||||||||||||||||||||||||||||||||||:|||||||||||||||||||||||
a253        VIEGRLNGNIADARAWSGLLVGSIACYGILPRLLAWAVCKILLKTSENGLDLEKPYYQAV
                   190        200        210        220        230        240
                   250        260        270        280        290        300
m253.pep    IRRWQNKITDADTRRETVSAVSPKIILNDAPKWAVMLETEWQDGEWFEGRLAQEWLDKGV
            ||||||||||||||||||||||||||:|||||||||||||||||||||||||||||||||
a253        IRRWQNKITDADTRRETVSAVSPKIVLNDAPKWAVMLETEWQDGEWFEGRLAQEWLDKGV
                   250        260        270        280        290        300
                   310        320        330        340        350        360
m253.pep    ATNREQVAALETELKQKPAQLLIGVRAQTVPDRGVLRQIVRLSEAAQGGAVVQLLAEQGL
            |:||||||||||||||||||||||||||||||||||||||||||||||||||||||||||
a253        AANREQVAALETELKQKPAQLLIGVRAQTVPDRGVLRQIVRLSEAAQGGAVVQLLAEQGL
                   310        320        330        340        350        360
                   370        380        390
m253.pep    SDDLSEKLEHWRNALAECGAAWLEPDRAAQEGRLKDQX
            |||||||||||||||:|||||||||||||||||||||
a253        SDDLSEKLEHWRNALTECGAAWLEPDRAAQEGRLKTNDRTX
                   370        380        390        400
```

The following partial DNA sequence was identified in *N. gonorrhoeae* <SEQ ID 993>:

```
g254.seq
  1 atgtatgcag gcgaacgctt caatacttac agccatttga gcggtttgat 51 tctggcggcg gcaggtttga tgctgatgct gctgaaaacc ataggacacg 101 gggacggata ccgtatcttc agcgtatcgg tttacggcat cagccttctt 151 ctgctctatt tgagttcctc gctgtaccac ggaattgcag ccggaaaact 201 gaaaagcatt ttgaaaaaaa ccgaccactg catgattyat gtgctgattg 251 ccggaagcta cacccgtttt gcactggttt ctttgagaaa cgggccgggc 301 tggacggtat tttcactgtc ctggctgctg gcggctgcag gaatcgcaca 351 agaactcacc atcggacgga aaagcgaaaa acgtctgctg tctattgcga 401 tttatatcgt aatgggctgg atggtcttgg cggtaatgaa atccctgaca 451 gcctcactcc cgccggcagg actggcttgg ctggcggcag gcggtatgct
```

-continued
```
501 gtacagcgtc ggcatttact ggtttgtaaa cgatgaaaaa atccgacacg 551 ggcacggaat ctggcatctg ttcgtattgg gcggcagcat aacccaattt 601 gtcagcgtgt acggttatgt aatctga
```

This corresponds to the amino acid sequence <SEQ ID 994; ORF 254.ng>:

```
g254.pep
  1 MYAGERFNTY SHLSGLILAA AGLMLMLLKT IGHGDGYRIF SVSVYGISLL

51 LLYLSSSLYH GIAAGKLKSI LKKTDHCMIY VLIAGSYTPF ALVSLRNGPG

101 WTVFSLSWLL AAAGIAQELT IGRKSEKRLL SIAIYIVMGW MVLAVMKSLT

151 ASLPPAGLAW LAAGGMLYSV GIYWFVNDEK IRHGHGIWHL FVLGGSITQF

201 VSVYGYVI*
```

The following partial DNA sequence was identified in *N. meningitidis* <SEQ ID 995>:

```
m254.seq (partial)
  1 ..GTATCGGTTT ACGGCATCAG CCTTCTTCTG CTCTATTTGA GTTCCTGGCT

51   GTACCACGGA ATTGCAGCCG GAAAACTGAA AAGCATTTTG AAAAAAACCG

101   ACCACTGCAT GATTTATGTG CTGATTGCCG GAAGCTACAC ACCGTTTGCA

151   CTGGTTTCTT TGAGAAACGG GCCGGGCTGG ACGGTATTTT CACTGTCCTG

201   GCTGCTGGCG GCTGCAGGAA TCGCACAAGA ACTCACCATC GGACGGAAAA

251   GCGAAAAACG TCTGCTGTCT ATTGTGATTT ATGTCGTCAT GGGTTGGATG

301   GTCTTGGCGG TAATGAAATC CCTGACAGCC TCACTCCCGT CGGCAGGACT

351   GGCTTGGCTG GCGGCAGGCG GTATGCTGTA CAGTGTCGGC ATTTACTGGT

401   TTGTAAACGA TGAAAAAATC CGACACGGGC ACGGAATCTG GCATCTGTTC

451   GTATTGGGCG GCAGCATCAC CCAATTTGTC AGCGTGTACG GTTACGTAAT

501   CTGA
```

This corresponds to the amino acid sequence <SEQ ID 996; ORF 254>:

```
m254.pep (partial)
  1 ..VSVYGISLLL LYLSSWLYHG IAAGKLKSIL KKTDHCMIYV LIAGSYTPFA

51   LVSLRNGPGW TVFSLSWLLA AAGIAQELTI GRKSEKRLLS IVIYVVMGWM

101   VLAVMKSLTA SLPSAGLAWL AAGGMLYSVG IYWFVNDEKI RHGHGIWHLF

151   VLGGSITQFV SVYGYVI*
```

Computer analysis of this amino acid sequence gave the following results:
Homology with a Predicted ORF from *N. gonorrhoeae*
ORF 254 shows 97.6% identity over a 167 aa overlap with a predicted ORF (ORF 254.ng) from *N. gonorrhoeae*:

```
m254/g254

10         20         30
    m254.pep                     VSVYGISLLLLYLSSWLYHGIAAGKLKSIL
                                 |||||||||||||| |||||||||||||||
       g254    HLSGLILAAAGLMLMLLKTIGHGDGYRIFSVSVYGISLLLLYLSSSLYHGIAAGKLKSIL
                        20        30        40        50        60        70
```

```
              40         50         60         70         80         90
m254.pep  KKTDHCMIYVLIAGSYTPFALVSLRNGPGWTVFSLSWLLAAAGIAQELTIGRKSEKRLLS
          ||||||||||||||||||||||||||||||||||||||||||||||||||||||||||||
g254      KKTDHCMIYVLIAGSYTPFALVSLRNGPGWTVFSLSWLLAAAGIAQELTIGRKSEKRLLS
              80         90        100        110        120        130

100        110        120        130        140        150
m254.pep  IVIYVVMGWMVLAVMKSLTASLPSAGLAWLAAGGMLYSVGIYWFVNDEKIRHGHGIWHLF
          |:||:||||||||||||||||||||| |||||||||||||||||||||||||||||||||
g254      IAIYIVMGWMVLAVMKSLTASLPPAGLAWLAAGGMLYSVGIYWFVNDEKIRHGHGIWHLF
             140        150        160        170        180        190

160
m254.pep  VLGGSITQFVSVYGYVIX
          ||||||||||||||||||
g254      VLGGSITQFVSVYGYVIX
              200
```

The following partial DNA sequence was identified in *N. meningitidis* <SEQ ID 997>:

```
a254.seq
   1 ATGTATACAG GCGAACGCTT CAATACTTAC AGCCATTTGA GCGGTTTGAT

51 TCTGGCGGCG GCAGGTTTGG CGCTGATGCT GCTGAAAACC ATAGGACACG

101 GGGACGGCTA CCGTATCTTC AGCGTATCGG TTTACGGCAT CAGCCTTCTT

151 CTGCTCTATT TGAGTTCCTC GCTGTACCAC GGAATTGCAG CCGGAAAACT

201 GAAAAGCATT TTGAAAAAAA CCGACCACTG CATGATTTAT GTGCTGATTG

251 CCGGAAGCTA CACACCGTTT GCACTGGTTT CTTTGAGAAA CGGGCCGGGC

301 TGGACGGTAT TTTCACTGTC CTGGCTGCTG GCGGCTGCAG GAATCGCACA

351 AGAACTCACC ATTGGACGGA AAAGCGAAAA ACGACTGCTG TCTATTGCGA

401 TTTATATCGT AATGGGCTGG ATGGTCTTGG CGGTAATGAA ATCCCTGACA

451 GCCTCACTCC CGCCGGCAGG ACTGGCTTGG CTGGCGGCAG GCGGTATGCT

501 GTACAGCGTC GGCATTTACT GGTTTGTAAA CGATGAAAAA ATCCGACACG

551 GGCACGGAAT CTGGCATCTG TTCGTATTGG GCGGCAGCAT CACCCAATTT

601 GTCAGCGTGT ACGGTTACGT AATCTGA
```

This corresponds to the amino acid sequence <SEQ ID 998; ORF 254.a>:

```
a254.pep
   1 MYTGERFNTY SHLSGLILAA AGLALMLLKT IGHGDGYRIF SVSVYGISLL

51 LLYLSSSLYH GIAAGKLKSI LKKTDHCMIY VLIAGSYTPF ALVSLRNGPG

101 WTVFSLSWLL AAAGIAQELT IGRKSEKRLL SIAIYIVMGW MVLAVMKSLT

151 ASLPPAGLAW LAAGGMLYSV GIYWFVNDEK IRHGHGIWHL FVLGGSITQF

201 VSVYGYVI*
``` m254/a254 97.6% identity in 167 aa overlap

```
                                        10         20         30
m254.pep                           VSVYGISLLLLYLSSWLYHGIAAGKLKSIL
                                   |||||||||||||| |||||||||||||||
a254      HLSGLILAAAGLALMLLKTIGHGDGYRIFSVSVYGISLLLLYLSSSLYHGIAAGKLKSIL
                  20         30         40         50         60         70

40         50         60         70         80         90
m254.pep  KKTDHCMIYVLIAGSYTPFALVSLRNGPGWTVFSLSWLLAAAGIAQELTIGRKSEKRLLS
          ||||||||||||||||||||||||||||||||||||||||||||||||||||||||||||
a254      KKTDHCMIYVLIAGSYTPFALVSLRNGPGWTVFSLSWLLAAAGIAQELTIGRKSEKRLLS
              80         90        100        110        120        130
```

```
                  100        110        120        130        140        150
m254.pep   IVIYVVMGWMVLAVMKSLTASLPSAGLAWLAAGGMLYSVGIYWFVNDEKIRHGHGIWHLF
           |:||:||||||||||||||||| ||||||||||||||||||||||||||||||||||||
a254       IAIYIVMGWMVLAVMKSLTASLPPAGLAWLAAGGMLYSVGIYWFVNDEKIRHGHGIWHLF
                  140        150        160        170        180        190

160
m254.pep   VLGGSITQFVSVYGYVIX
           ||||||||||||||||||
a254       VLGGSITQFVSVYGYVIX
                  200
```

The following partial DNA sequence was identified in *N. gonorrhoeae* <SEQ ID 999>:

```
g255.seq
   1 atggttggac aggaagcctt gcggggtcag ttcgtcgccg tgttcgctgc 51 cgcgttgcgt tacgctgtca aaacctgcgc cgatttccac gcctttgacg 101 gcgttgatgc ccatcatcgc gtaggcgatt tcggcatcga ggcggtcgaa 151 aacgggttcg cccaaaccga cggggacgtt ggcggcttcg atatgcagtt 201 tcgcgccgac ggaatccaag gatttgcgca caccgtccat atagtgttcc 251 agttcggcga tttggctttg gttggcggca aaaaaaggat tttgggaaat 301 gtgttcgctg ccttcaaacc ggattttttt ttcgccgact tgggtaacgt 351 aggcggtgat ttccgtgccg aattttctt tcagccattt tttggcaacg 401 gctccggcgg caacgcgggc tgcggtttcg cgggcggaac tcctgccgcc 451 gccccggtag tcgcgcgtac cgtatttgtg ccaataggta tagtcggcgt 501 gtccggggcg gaaggcggtg gcgatgtcgc cgtagtcttc gctgcgctgg 551 tcggtgttgc ggattag
```

This corresponds to the amino acid sequence <SEQ ID 1000; ORF 255.ng>:

```
g255.pep
   1 MVGQEALRGQ FVAVFAAALR YAVKTCADFH AFDGVDAHHR VGDFGIEAVE

51 NGFAQTDGDV GGFDMQFRAD GIQGFAHTVH IVFQFGDLAL VGGKKRILGN

101 VFAAFKPDFF FADLGNVGGD FRAEFFFQPF FGNGSGGNAG CGFAGGTPAA

151 APVVARTVFV PIGIVGVSGA EGGGDVAVVF AALVGVAD*
```

The following partial DNA sequence was identified in *N. meningitidis* <SEQ ID 1001>:

```
m255.seq
   1 GTGGTTGGAC AGGAAGCCTT GCGGGGTCAG TTCGTCGCCG TGTTCGCTGC

51 CGCGTTGCGT TACGCTGTCA AAACCTGCGC CGATTTCCAC GCCTTTGACG

101 GCGTTGATGC CCATCATCGC GTAGGCGATT TCGGCATCGA GGCGGTCAAA

151 AACAGGTTCG CCCAAGCCGA CAGGGACATT GGCTGCTTCG ATATGCAGCT

201 TCGCGCCGAC GGAATCCAAG GATTTGCGCA CGCTGTCCAT ATAGTTTTCC

251 AGCTCGGCAA TTTGGCTATG GTTGGCGGCA AAAAAGGAT TTGGGAAAT

301 GTGTTCGCAG CCTTCAAACC GGATTTCTTT TTCGCCGACT TGGGTAACGT

351 AGGCGGTGAT TTCCGTGCCG AATTTTTCTT TCAACCATTT TTTGGCAACG

401 GCTCCGGCAG CAACGCGGGC GGCGGTTTCA CGGGCGGAGC TCCTGCCGCC
```

-continued
```
451 GCCGCGGTAG TCGCGCGTGC CGTATTTGTG CCAATAGGTA TAGTCGGCGT

501 GGCCGGGGCG GAAGCTGGTG GCGATGTTGC CGTAGTCTTT GCTGCGCTGG

551 TCGGTATTGC GGATTAA
```

This corresponds to the amino acid sequence <SEQ ID 1002; ORF 255>:

```
m255.pep
  1 VVGQEALRGQ FVAVFAAALR YAVKTCADFH AFDGVDAHHR VGDFGIEAVK

51 NRFAQADRDI GCFDMQLRAD GIQGFAHAVH IVFQLGNLAM VGGKKRILGN

101 VFAAFKPDFF FADLGNVGGD FRAEFFFQPF FGNGSGSNAG GGFTGGAPAA

151 AAVVARAVFV PIGIVGVAGA EAGGDVAVVF AALVGIAD*
```

Computer analysis of this amino acid sequence gave the following results:

Homology with a Predicted ORF from *N. gonorrhoeae*
ORF 255 shows 88.8% identity over a 188 aa overlap with a predicted ORF (ORF 255.ng) from *N. gonorrhoeae*:

```
m255/g255

10         20         30         40         50         60
    m255.pep  VVGQEALRGQFVAVFAAALRYAVKTCADFHAFDGVDAHHRVGDFGIEAVKNRFAQADRDI
              :||||||||||||||||||||||||||||||||||||||||||||||||:| |||:| |:
    g255      MVGQEALRGQFVAVFAAALRYAVKTCADFHAFDGVDAHHRVGDFGIEAVENGFAQTDGDV
                   10         20         30         40         50         60

70         80         90        100        110        120
    m255.pep  GCFDMQLRADGIQGFAHAVHIVFQLGNLAMVGGKKRILGNVFAAFKPDFFFADLGNVGGD
              | ||||:|||||||||||:||||||:|:||||||||||||||||||||||||||||||||
    g255      GGFDMQFRADGIQGFAHTVHIVFQFGDLALVGGKKRILGNVFAAFKPDFFFADLGNVGGD
                   70         80         90        100        110        120

130        140        150        160        170        180
    m255.pep  FRAEFFFQPFFGNGSGSNAGGGFTGGAPAAAAVVARAVFVPIGIVGVAGAEAGGDVAVVF
              ||||||||||||||||:||| ||:|| |||| ||||:||||||||||:|||:|||||||
    g255      FRAEFFFQPFFGNGSGGNAGCGFAGGTPAAAPVVARTVFVPIGIVGVSGAEGGGDVAVVF
                  130        140        150        160        170        180

189
    m255.pep  AALVGIADX
              |||||:|||
    g255      AALVGVADX
```

The following partial DNA sequence was identified in *N. meningitidis* <SEQ ID 1003>:

```
a255.seq
  1 GTGGTTGGAC AGGAAGCCTT GCGGGGTGAG TTCGTCGCCG TGTTCGCTGC

51 CGCGTTGCGT TACGCTGTCA AAACCTGCGC CGATTTCCAC GCCTTTGACG

101 GCGTTGATGC CCATCATGGC GTAGGCGATT TCGGCATCGA GGCGGTCGAA

151 TACGGGTTCG CCCAAGCCGA CGGGGACGTT GGCGGCTTCA ATATGCAGCT

201 TCGCGCCGAC GGAATCCAAG GATTTGCGCA CGCTGTCCAT ATAGTTTTCC

251 AGCTCGGCAA TTTGGCTATG GTTGGCGGCA AAAAAGGAT TTTGGGAAAT

301 GTGTTCGCAG CCTTCAAACC GGATTTCTTT TTCGCCGACT TGGGTAACGT

351 AGGCGGTGAT TTCCGTGCCG AATTTTTCTT TCAACCATTT TTTGGCAACG

401 GCTCCGGCGG CAACGCGGGC GGCGGTTTCG CGGGCGGAAC TCCTGCCGCC

451 GCCCCGGTAG TCGCGCGTGC CGTATTTGTG CCAATAGGTA TAGTCGGCGT
```

```
-continued
501 GGCCGGGGCG GAAGCTGGTG GCGATGTTGC CGTAGTCTTT GCTGCGCTGG

551 TCGGTATTGC GGATTAA
```

This corresponds to the amino acid sequence <SEQ ID 1004; ORF 255.a>:

```
a255.pep
  1 VVGQEALRGE FVAVFAAALR YAVKTCADFH AFDGVDAHHG VGDFGIEAVE

51 YGFAQADGDV GGFNMQLRAD GIQGFAHAVH IVFQLGNLAM VGGKKRILGN

101 VFAAFKPDFF FADLGNVGGD FRAEFFFQPF FGNGSGGNAG GGFAGGTPAA

151 APVVARAVFV PIGIVGVAGA EAGGDVAVVF AALVGIAD*
``` m255/a255 93.1% identity in 188 aa overlap

```
                   10        20        30        40        50        60
   m255.pep  VVGQEALRGQFVAVFAAALRYAVKTCADFHAFDGVDAHHRVGDFGIEAVKNRFAQADRDI
             ||||||||||:|||||||||||||||||||||||||||| |||||||||: ||||  |:
   a255      VVGQEALRGEFVAVFAAALRYAVKTCADFHAFDGVDAHHGVGDFGIEAVEYGFAQADGDV
                   10        20        30        40        50        60

70        80        90       100       110       120
   m255.pep  GCFDMQLRADGIQGFAHAVHIVFQLGNLAMVGGKKRILGNVFAAFKPDFFFFADLGNVGGD
             | |:|||||||||||||||||||||||||||||||||||||||||||||||||||||||
   a255      GGFNMQLRADGIQGFAHAVHIVFQLGNLAMVGGKKRILGNVFAAFKPDFFFADLGNVGGD
                   70        80        90       100       110       120

130       140       150       160       170       180
   m255.pep  FRAEFFFQPFFGNGSGSNAGGGFTGGAPAAAAVVARAVFVPIGIVGVAGAEAGGDVAVVF
             ||||||||||||||||:|||||:||:||| ||||||||||||||||||||||||||||
   a255      FRAEFFFQPFFGNGSGGNAGGGFAGGTPAAAPVVARAVFVPIGIVGVAGAEAGGDVAVVF
                  130       140       150       160       170       180

189
   m255.pep  AALVGIADX
             |||||||||
   a255      AALVGIADX
```

The following partial DNA sequence was identified in *N. gonorrhoeae* <SEQ ID 1005>:

```
g256.seq
  1 atgctcgcgg tacgcaatcg gggttggcac ggcgcagtcg tccatttccg 51 cagctgcggc ggcgtagcga acaccgcccc ggtgttctac cacttgggtg 101 ataccgccga aatcgccttt gctttggaca cgctcaccgc gcgttaccgt 151 gaaatatacg ccgtcggcgt atcgctgggc ggcaacgcgc cggcaaaata 201 tttgggcgaa cagggcaaaa aggcattgcc gcacgcctcg gccgccgtat 251 ccgcccccgt tgatgcagag gcggcaggca gccgcttcga cagcggcatc 301 acgcggctgc tctacacgcg ctacttcctc cgcacactga tacccaaagc 351 acgttcgctc caaggttttc agacggcatt gcccgcaggg tgcaaaacac 401 tgggcgagtt tgacgaccgt ttcaccgcac cgctgcacgg ctttgccgac 451 cggcacgact actaccgcca aacttcctgc aaaccgctgc tcaaacacgt 501 tgccaaaccg ctgctcctgc tcaatgccgc caacgacccc ttcctgccgc 551 ccgaagccct gccccgtgca gacgaagcgt ccgaagccgt taccctgttc 601 caacctgcac acggcgggca cgccggcttt gtcagcagca ccggcggcag 651 gctgcacctg caatgctgc cgcagaccgt cctgtcctat tttgacagct 701 tccgcacaaa caggcgttaa
```

This corresponds to the amino acid sequence <SEQ ID 1006; ORF 256.ng>:

```
g256.pep
   1 MLAVRNRGWH GAVVHFRSCG GVANTAPVFY HLGDTAEIAF ALDTLTARYR

51 EIYAVGVSLG GNAPAKYLGE QGKKALPHAS AAVSAPVDAE AAGSRFDSGI

101 TRLLYTRYFL RTLIPKARSL QGFQTAFAAG CKTLGEFDDR FTAPLHGFAD

151 RHDYYRQTSC KPLLKHVAKP LLLLNAANDP FLPPEALPRA DEASEAVTLF

201 QPAHGGHAGF VSSTGGRLHL QWLPQTVLSY FDSFRTNRR*
```

The following partial DNA sequence was identified in *N. meningitidis* <SEQ ID 1007>:

```
m256.seq
   1 ATGCTTGCGG TACGCGATCG GGGTTGGCAC GGCGTAGTCG TCCATTTCCG

51 CAGCTGCGGC GGCATTGCCA ACACCGCTCC GGTGTTCTAC CA.CTtGGCG

101 ATACCGCCGA AATCGCCTTT ACTTTGGACA CGTTCGCCGC GCGTTACCGT

151 GAAAtATACG CCGTCGGCGT ATCGCTGGGC GGCAACGCGC TGGCAAAATA

201 TTTGGGCGAA CAGGGCAAAA AGGCATTGCC GCAAGCCGCT GCCGTCATCT

251 CCGCCCCCGT CGATGCAGAG GCGGCAGGCA GACGCTTCGA CAGCGGCATC

301 ACGCGGCTGC TCTACACGCG CTACTTCCTC CGCACCCTGA TACCCAAAGC

351 AAAATCGCTC CAAGGTTTTC AGACGGCATT TGCCGCAGGG TGCAAAACAC

401 TGGGCGAGTT TGACGACCGC TTCACCGCAC CGCTGCACGG CTTTGCCGAC

451 CGGCACGACT ACTACCGCCA AACTTCCTGC AAACCGCTGC TCAAACACGT

501 TGCCAAACCG CTGCTCCTGC TCAATGCCGT CAACGACCCC TTCCTGCCGC

551 CCGAAGCCGT GCCCCGCGCA GACGAAGTAT CCGAAGCCGT TACCCTGTTC

601 CAGCCGGCAT ATGGTGGTCA TGTCGGCTTT GTCAGCAGCA CCGGCGGCAG

651 GCTGCACCTG CAATGGCTGC CGCAGACCGT CCTGTCCTAT TTCGACAGCT

701 TCCGCACAAA CAGGCGTTAA
                                              50
```

This corresponds to the amino acid sequence <SEQ ID 1008; ORF 256>:

```
m256.pep
   1 MLAVRDRGWH GVVVHFRSCG GIANTAPVFY XLGDTAEIAF TLDTFAARYR

51 EIYAVGVSLG GNALAKYLGE QGKKALPQAA AVISAPVDAE AAGRRFDSGI

101 TRLLYTRYFL RTLIPKAKSL QGFQTAFAAG CKTLGEFDDR FTAPLHGFAD

151 RHDYYRQTSC KPLLKHVAKP LLLLNAVNDP FLPPEALPRA DEVSEAVTLF

201 QPAYGGHVGF VSSTGGRLHL QWLPQTVLSY FDSFRTNRR*
```

Computer analysis of this amino acid sequence gave the following results:
Homology with a Predicted ORF from *N. gonorrhoeae*
ORF 256 shows 92.9% identity over a 239 aa overlap with a predicted ORF (ORF 256.ng) from *N. gonorrhoeae*:

```
m256/g256

10         20         30         40         50         60
    m256.pep  MLAVRDRGWHGVVVHFRSCGGIANTAPVFYHLGDTAEIAFTLDTFAARYREIYAVGVSLG
              |||||:|||||:||||||||||:|||||||||||||||:|||:||:||||||||||||||
    g256      MLAVRNRGWHGAVVHFRSCGGVANTAPVFYHLGDTAEIAFALDTLTARYREIYAVGVSLG
                  10         20         30         40         50         60

70         80         90        100        110        120
    m256.pep  GNALAKYLGEQGKKALPQAAAVISAPVDAEAAGRRFDSGITRLLYTRYFLRTLIPKAKSL
              |||  |||||||||||||:|:::|||||||||||:|||||||||||||||||||||:||
    g256      GNAPAKYLGEQGKKALPHASAAVSAPVDAEAAGSRFDSGITRLLYTRYFLRTLIPKARSL
                  70         80         90        100        110        120

130        140        150        160        170        180
    m256.pep  QGFQTAFAAGCKTLGEFDDRFTAPLHGFADRHDYYRQTSCKPLLKHVAKPLLLLNAVNDP
              ||||||||||||||||||||||||||||||||||||||||||||||||||||||||:|||
    g256      QGFQTAFAAGCKTLGEFDDRFTAPLHGFADRHDYYRQTSCKPLLKHVAKPLLLLNAANDP
                 130        140        150        160        170        180

190        200        210        220        230        240
    m256.pep  FLPPEALPRADEVSEAVTLFQPAYGGHVGFVSSTGGRLHLQWLPQTVLSYFDSFRTNRRX
              ||||||||||||:||||||||||:|||:||||||||||||||||||||||||||||||||
    g256      FLPPEALPRADEASEAVTLFQPAHGGHAGFVSSTGGRLHLQWLPQTVLSYFDSFRTNRRX
                 190        200        210        220        230
```

The following partial DNA sequence was identified in *N. meningitidis* <SEQ ID 1009>:

```
a256.seq
    1 ATGCTCGCGG TACGCGATCG GGGTTGGAAC GGCGTAGTCG TCCATTTCCG

51 CAGCTGCGGC GGCGTAGCGA ACACCGCCCC GGTGTTCTAC CACTTGGGCG

101 ATACCGCCGA AATTGCCTTT ACTTTGGACA CGCTCGCCGC GCGTTACCGT

151 GAAATATACG CCGTCGGCGT ATCGCTGGGC GGCAACGCGC TGGCAAAATA

201 TTTGGGCGAA CAGGGCGAAA ACGCGCTGCC GCAAGCCGCC GCCGTCATCT

251 CCGAAGCCGT CGATGCAGAG GCGGCAGGCA ACCGCTTCGA CAGCGGCATC

301 ACACGGCTGC TCTACACGCG CTACTTCCTC CGCACACTGA TACCCAAAGC

351 ACGGTCGCTC CAAGGTTTTC AGACGGCATT TGCCGCAGGG TGCAAAACAC

401 TGGGCGAGTT TGACGACCGT TTCACCGCAC CGCTGCACGG CTTTGCCGAT

451 CGGCACGACT ACTACCGCCA AACTTCCTGC AAACCGCTGC TCAAACACGT

501 TGCCAAACCG CTGCTCCTGC TCAATGCCGT CAACGACCCC TTCCTGCCGC

551 CCGAAGCGCT GCCCCGCGCA GACGAAGTGT CCGAAGCCGT TACCCTGTTC

601 CAGCCGACAC ACGGTGGTCA TGTCGGCTTT GTCGGCAGCA CCGGCGGCAG

651 GCTGCACCTG CAATGGTTGC CGCAGACCGT CCTGTCCTAT TTCGACAGCT

701 TCCGCACAAA CAGGCGTTAA
```

This corresponds to the amino acid sequence <SEQ ID 1010; ORF 256.a>:

```
a256.pep
    1 MLAVRDRGWN GVVVHFRSCG GVANTAPVFY HLGDTAEIAF TLDTLAARYR

51 EIYAVGVSLG GNALAKYLGE QGENALPQAA AVISAPVDAE AAGNRFDSGI

101 TRLLYTRYFL RTLIPKARSL QGFQTAFAAG CKTLGEFDDR FTAPLHGFAD
```

```
151 RHDYYRQTSC KPLLKHVAKP LLLLNAVNDP FLPPEALPRA DEVSEAVTLF

201 QPTHGGHVGF VGSTGGRLHL QWLPQTVLSY FDSFRTNRR*
``` m256/a256 95.4% identity in 239 aa overlap

```
                   10         20         30         40         50         60
    m256.pep  MLAVRDRGWHGVVVHFRSCGGIANTAPVFYXLGDTAEIAFTLDTFAARYREIYAVGVSLG
              ||||||||||:||||||||||||||:|||||||| |||||||||||:|||||||||||||
    a256      MLAVRDRGWNGVVVHFRSCGGVANTAPVFYHLGDTAEIAFTLDTLAARYREIYAVGVSLG
                   10         20         30         40         50         60

70         80         90        100        110        120
    m256.pep  GNALAKYLGEQGKKALPQAAAVISAPVDAEAAGRRFDSGITRLLYTRYFLRTLIPKAKSL
              ||||||||||||::||||||||||||||||||||| ||||||||||||||||||||||:||
    a256      GNALAKYLGEQGENALPQAAAVISAPVDAEAAGNRFDSGITRLLYTRYFLRTLIPKARSL
                   70         80         90        100        110        120

130        140        150        160        170        180
    m256.pep  QGFQTAFAAGCKTLGEFDDRFTAPLHGFADRHDYYRQTSCKPLLKHVAKPLLLLNAVNDP
              ||||||||||||||||||||||||||||||||||||||||||||||||||||||||||||
    a256      QGFQTAFAAGCKTLGEFDDRFTAPLHGFADRHDYYRQTSCKPLLKHVAKPLLLLNAVNDP
                  130        140        150        160        170        180

190        200        210        220        230        240
    m256.pep  FLPPEALPRADEVSEAVTLFQPAYGGHVGFVSSTGGRLHLQWLPQTVLSYFDSFRTNRRX
              ||||||||||||||||||||||::|||||||||:||||||||||||||||||||||||||
    a256      FLPPEALPRADEVSEAVTLFQPTHGGHVGFVGSTGGRLHLQWLPQTVLSYFDSFRTNRRX
                  190        200        210        220        230        240
```

The following partial DNA sequence was identified in *N. gonorrhoeae* <SEQ ID 1011>:

```
g256-1.seq
   1 ATGATTTTGA CACCGCCGGA CACGCCCTTT TCCTCCGCA ACGGCAATGC

51 CGACACGATT GCCGCCAAAT TCCTGCAACA CCCCGCACCC GCATACCGCC

101 GCGAGATGCT TCCCGACAGC ACGGGTAAAA CCAAAACCGC CTACGACTTT

151 TCAGCAGGCG GCATTTCGCC CGATGCGCCG CTGGTCGTGC TGTTTCACGG

201 TTTGGAAGGA AGCAGCCGCA GCCATTACGC GGTCGAACTG ATGCTCGCGG

251 TACGCAATCG GGGTTGGCAC GGCGCAGTCG TCCATTTCCG CAGCTGCGGC

301 GGCGTAGCGA ACACCGCCCC GGTGTTCTAC CACTTGGGTG ATACCGCCGA

351 AATCGCCTTT GCTTTGGACA CGCTCACCGC GCGTTACCGT GAAATATACG

401 CCGTCGGCGT ATCGCTGGGC GGCAACGCGC CGGCAAAATA TTTGGGCGAA

451 CAGGGCAAAA AGGCATTGCC GCACGCCTCG GCCGCCGTAT CCGCCCCCGT

501 TGATGCAGAG GCGGCAGGCA GCCGCTTCGA CAGCGGCATC ACGCGGCTGC

551 TCTACACGCG CTACTTCCTC CGCACACTGA TACCCAAAGC ACGTTCGCTC

601 CAAGGTTTTC AGACGGCATT TGCCGCAGGG TGCAAAACAC TGGGCGAGTT

651 TGACGACCGT TTCACCGCAC CGCTGCACGG CTTTGCCGAC CGGCACGACT

701 ACTACCGCCA AACTTCCTGC AAACCGCTGC TCAAACACGT TGCCAAACCG

751 CTGCTCCTGC TCAATGCCGC CAACGACCCC TTCCTGCCGC CGAAGCCCT

801 GCCCCGTGCA GACGAAGCGT CCGAAGCCGT TACCCTGTTC CAACCTGCAC

851 ACGGCGGGCA CGCCGGCTTT GTCAGCAGCA CCGGCGGCAG GCTGCACCTG

901 CAATGGCTGC CGCAGACCGT CCTGTCCTAT TTTGACAGCT TCCGCACAAA

951 CAGGCGTTAA
```

This corresponds to the amino acid sequence <SEQ ID 1012; ORF 256-1.ng>:

```
g256-1.pep
   1 MILTPPDTPF FLRNGNADTI AAKFLQHPAP AYRREMLPDS TGKTKTAYDF

51 SAGGISPDAP LVVLFHGLEG SSRSHYAVEL MLAVRNRGWH GAVVHFRSCG

101 GVANTAPVFY HLGDTAEIAF ALDTLTARYR EIYAVGVSLG GNAPAKYLGE

151 QGKKALPHAS AAVSAPVDAE AAGSRFDSGI TRLLYTRYFL RTLIPKARSL

201 QGFQTAFAAG CKTLGEFDDR FTAPLHGFAD RHDYYRQTSC KPLLKHVAKP

251 LLLLNAANDP FLPPEALPRA DEASEAVTLF QPAHGGHAGF VSSTGGRLHL

301 QWLPQTVLSY FDSFRTNRR*
```

The following partial DNA sequence was identified in *N. meningitidis* <SEQ ID 1013>:

```
m256-1.seq
   1 ATGATTTTAA CACCGCCGGA CACGCCCTTT TTCCTCCGCA ACGGCAATGC

51 CGACACGATT GCCGCCAAAT TCCTGCAACG CCCCGCGCCC GCATACCGCC

101 GAGAGCTGCT TCCCGACAGC ACGGGTAAAA CCAAAGTCGC CTACGACTTT

151 TCAGACGGCA TTTCGCCCGA TGCGCCGCTG GTCGTGCTGT TTCACGGTTT

201 GGAAGGAAGC AGCCGCAGCC ATTACGCGGT CGAACTGATG CTTGCGGTAC

251 GCGATCGGGG TTGGCACGGC GTAGTCGTCC ATTTCCGCAG CTGCGGCGGC

301 ATTGCCAACA CCGCTCCGGT GTTCTACCAC TTGGGCGATA CCGCCGAAAT

351 CGCCTTTACT TTGGACACGT TCGCCGCGCG TTACCGTGAA ATATACGCCG

401 TCGGCGTATC GCTGGGCGGC AACGCGCTGG CAAAATATTT GGGCGAACAG

451 GGCAAAAAGG CATTGCCGCA AGCCGCTGCC GTCATCTCCG CCCCCGTCGA

501 TGCAGAGGCG GCAGGCAGAC GCTTCGACAG CGGCATCACG CGGCTGCTCT

551 ACACGCGCTA CTTCCTCCGC ACCCTGATAC CCAAAGCAAA ATCGCTCCAA

601 GGTTTTCAGA CGGCATTTGC CGCAGGGTGC AAAACACTGG GCGAGTTTGA

651 CGACCGCTTC ACCGCACCGC TGCACGGCTT TGCCGACCGG CACGACTACT

701 ACCGCCAAAC TTCCTGCAAA CCGCTGCTCA AACACGTTGC CAAACCGCTG

751 CTCCTGCTCA ATGCCGTCAA CGACCCCTTC CTGCCGCCCG AAGCCCTGCC

801 CCGCGCAGAC GAAGTATCCG AAGCCGTTAC CCTGTTCCAG CCGGCATATG

851 GTGGTCATGT CGGCTTTGTC AGCAGCACCG GCGGCAGGCT GCACCTGCAA

901 TGGCTGCCGC AGACCGTCCT GTCCTATTTC GACAGCTTCC GCACAAACAG

951 GCGTTAA
```

This corresponds to the amino acid sequence <SEQ ID 1014; ORF 256-1>:

```
m256-1.pep

1  MILTPPDTPF FLRNGNADTI AAKFLQRPAP AYRRELLPDS TGKTKVAYDF

51  SDGISPDAPL VVLFHGLEGS SRSHYAVELM LAVRDRGWHG VVVHFRSCGG

101  IANTAPVFYH LGDTAEIAFT LDTFAARYRE IYAVGVSLGG NALAKYLGEQ

151  GKKALPQAAA VISAPVDAEA AGRRFDSGIT RLLYTRYFLR TLIPKAKSLQ

201  GFQTAFAAGC KTLGEFDDRF TAPLHGFADR HDYYRQTSCK PLLKHVAKPL
```

```
251 LLLNAVNDPF LPPEALPRAD EVSEAVTLFQ PAYGGHVGFV SSTGGRLHLQ

301 WLPQTVLSYF DSFRTNRR*
``` m256-1/g256-1  93.1% identity in 319 aa overlap

```
                      10         20         30         40         50        59
m256-1.pep    MILTPPDTPFFLRNGNADTIAAKFLQRPAPAYRRELLPDSTGKTKVAYDFS-DGISPDAP
              ||||||||||||||||||||||||||:||||||||||:|||||||||:|||| |||||||
g256-1        MILTPPDTPFFLRNGNADTIAAKFLQHPAPAYRREMLPDSTGKTKTAYDFSAGGISPDAP
                      10         20         30         40         50         60

60         70         80         90        100        110       119
m256-1.pep    LVVLFHGLEGSSRSHYAVELMLAVRDRGWHGVVVHFRSCGGIANTAPVFYHLGDTAEIAF
              |||||||||||||||||||||||||||:|||||:||||||||:|||||||||||||||||
g256-1        LVVLFHGLEGSSRSHYAVELMLAVRNRGWHGAVVHFRSCGGVANTAPVFYHLGDTAEIAF
                      70         80         90        100        110        120

120        130        140        150        160        170       179
m256-1.pep    TLDTFAARYREIYAVGVSLGGNALAKYLGEQGKKALPQAAAVISAPVDAEAAGRRFDSGI
              :|||::||||||||||||||||||| |||||||||||||:|:::||||||||| ||||||
g256-1        ALDTLTARYREIYAVGVSLGGNAPAKYLGEQGKKALPHASAAVSAPVDAEAAGSRFDSGI
                      130        140        150        160        170        180

180        190        200        210        220        230       239
m256-1.pep    TRLLYTRYFLRTLIPKAKSLQGFQTAFAAGCKTLGEFDDRFTAPLHGFADRHDYYRQTSC
              ||||||||||||||||:|||||||||||||||||||||||||||||||||||||||||||
g256-1        TRLLYTRYFLRTLIPKARSLQGFQTAFAAGCKTLGEFDDRFTAPLHGFADRHDYYRQTSC
                      190        200        210        220        230        240

240        250        260        270        280        290       299
m256-1.pep    KPLLKHVAKPLLLLNAVNDPFLPPEALPRADEVSEAVTLFQPAYGGHVGFVSSTGGRLHL
              ||||||||||||||:||||||||||||||||:||||||||||:|||:||||||||||||
g256-1        KPLLKHVAKPLLLLNAANDPFLPPEALPRADEASEAVTLFQPAHGGHAGFVSSTGGRLHL
                      250        260        270        280        290        300

300        310    319
m256-1.pep    QWLPQTVLSYFDSFRTNRRX
              ||||||||||||||||||||
g256-1        QWLPQTVLSYFDSFRTNRRX
                      310        320
```

The following partial DNA sequence was identified in *N. meningitidis* <SEQ ID 1015>:

```
a256-1.seq
  1 ATGATTTTGA CACCGCCGGA CACACCCTTT TCCTCCGCA ACGGCAATGC

51 CGACACGATT GCCGCCAAAT TCCTGCAACG CTCCGCACCT GCATACCGCC

101 GCGAGCTGCT TCCCGACAGC ACGGGTAAAA CCAAAACCGC CTACGACTTT

151 TCAGACGGCA TTTCGCCCGA TGCGCCGCTG GTCGTGCTGT TTCACGGTTT

201 GGAGGGCGGC AGTGGCAGCC ATTACGCGGT CGAACTGATG CTCGCGGTAC

251 GCGATCGGGG TTGGAACGGC GTAGTCGTCC ATTTCCGCAG CTGCGGCGGC

301 GTAGCGAACA CCGCCCCGGT GTTCTACCAC TTGGGCGATA CCGCCGAAAT

351 TGCCTTTACT TTGGACACGC TCGCCGCGCG TTACCGTGAA ATATACGCCG

401 TCGGCGTATC GCTGGGCGGC AACGCGCTGG CAAAATATTT GGGCGAACAG

451 GGCGAAAACG CGCTGCCGCA AGCCGCCGCC GTCATCTCCG CACCCGTCGA

501 TGCAGAGGCG GCAGGCAACC GCTTCGACAG CGGCATCACA CGGCTGCTCT

551 ACACGCGCTA CTTCCTCCGC ACACTGATAC CAAAGCACG GTCGCTCCAA

601 GGTTTTCAGA CGGCATTTGC CGCAGGGTGC AAAACACTGG GCGAGTTTGA

651 CGACCGTTTC ACCGCACCGC TGCACGGCTT TGCCGATCGG CACGACTACT

701 ACCGCCAAAC TTCCTGCAAA CCGCTGCTCA AACACGTTGC CAAACCGCTG

751 CTCCTGCTCA ATGCCGTCAA CGACCCCTTC CTGCCGCCCG AAGCGCTGCC

801 CCGCGCAGAC GAAGTGTCCG AAGCCGTTAC CCTGTTCCAG CCGACACACG

851 GTGGTCATGT CGGCTTTGTC GGCAGCACCG GCGGCAGGCT GCACCTGCAA
```

```
901 TGGTTGCCGC AGACCGTCCT GTCCTATTTC GACAGCTTCC GCACAAACAG

951 GCGTTAA
```

This corresponds to the amino acid sequence <SEQ ID 1016; ORF 256-1.a>:

```
a256-1.pep

1 MILTPPDTPF FLRNGNADTI AAKFLQRSAP AYRRELLPDS TGKTKTAYDF

51 SDGISPDAPL VVLFHGLEGG SGSHYAVELM LAVRDRGWNG VVVHFRSCGG

101 VANTAPVFYH LGDTAEIAFT LDTLAARYRE IYAVGVSLGG NALAKYLGEQ

151 GENALPQAAA VISAPVDAEA AGNRFDSGIT RLLYTRYFLR TLIPKARSLQ

201 GFQTAFAAGC KTLGEFDDRF TAPLHGFADR HDYYRQTSCK PLLKHVAKPL

251 LLLNAVNDPF LPPEALPRAD EVSEAVTLFQ PTHGGHVGFV GSTGGRLHLQ

301 WLPQTVLSYF DSFRTNRR* a256-1/m256-1 95.6% identity in 318 aa overlap 10        20        30        40        50        60
a256-1.pep  MILTPPDTPFFLRNGNADTIAAKFLQRSAPAYRRELLPDSTGKTKTAYDFSDGISPDAPL
            |||||||||||||||||||||||||| |||||||||||||||:||||||||||||||||
m256-1      MILTPPDTPFFLRNGNADTIAAKFLQRPAPAYRRELLPDSTGKAKTAYDFSDGISPDAPL
                   10        20        30        40        50        60
                   70        80        90       100       110       120
a256-1.pep  VVLFHGLEGGSGSHYAVELMLAVRDRGWNGVVVHFRSCGGVANTAPVFYHLGDTAEIAFT
            |||||||||:| ||||||||||||||||:|||||||||||:|||||||||||||||||
m256-1      VVLFHGLEGSSRSHYAVELMLAVRDRGWHGVVVHFRSCGGIANTAPVFYHLGDTAEIAFT
                   70        80        90       100       110       120
                  130       140       150       160       170       180
a256-1.pep  LDTLAARYREIYAVGVSLGGNALAKYLGEQGENALPQAAAVISAPVDAEAAGNRFDSGIT
            |||:||||||||||||||||||||||||||::|||||||||||||||||||| ||||||
m256-1      LDTFAARYREIYAVGVSLGGNALAKYLGEQGKKALPQAAAVISAPVDAEAAGRRFDSGIT
                  130       140       150       160       170       180
                  190       200       210       220       230       240
a256-1.pep  RLLYTRYFLRTLIPKARSLQGFQTAFAAGCKTLGEFDDRFTAPLHGFADRHDYYRQTSCK
            |||||||||||||||||:||||||||||||||||||||||||||||||||||||||||
m256-1      RLLYTRYFLRTLIPKAKSLQGFQTAFAAGCKTLGEFDDRFTAPLHGFADRHDYYRQTSCK
                  190       200       210       220       230       240
                  250       260       270       280       290       300
a256-1.pep  PLLKHVAKPLLLLNAVNDPFLPPEALPRADEVSEAVTLFQPTHGGHVGFVGSTGGRLHLQ
            |||||||||||||||||||||||||||||||||||||||||::||||||:|||||||||
m256-1      PLLKHVAKPLLLLNAVNDPFLPPEALPRADEVSEAVTLFQPAYGGHVGFVSSTGGRLHLQ
                  250       260       270       280       290       300
                  310       319
a256-1.pep  WLPQTVLSYFDSFRTNRRX
            |||||||||||||||||||
m256-1      WLPQTVLSYFDSFRTNRRX
                  310
```

The following partial DNA sequence was identified in *N. gonorrhoeae* <SEQ ID 1017>:

```
g257.seq
   1 atgggcaggc atttcgggcg cagacgtttt ctgacggctg ccgccgttgc 51 tgtggccggt gcggcggttt ctttttttgcc gaatcctttt gccgccggcg 101 gcgaaaaacg caacatggat aaaaaacgcg atgaaaatgt gttttctgg 151 aaaggtgtcg cgctgggttc cggcgcggag ctgcgcctgt cggcgtgga 201 cgacagacag gcggcggatt tggtcaataa ggttttggcg gaagtggcgc 251 gtttggaaaa aatgttcagc ctttaccgtg aagacagcct gatcagccgt 301 ctgaaccgcg acggttatct gacttcgcct ccggcggatt ttttggaact 351 gttgagcctg gccgcgatat tcacgcgctg a
```

This corresponds to the amino acid sequence <SEQ ID 1018; ORF 257.ng>:

```
g257.pep
   1 MGRHFGRRRF LTAAAVAVAG AAVSFLPNPF AAGGEKRNMD KKRDENVFFW

51 KGVALGSGAE LRLFGVDDRQ AADLVNKVLA EVARLEKMFS LYREDSLISR

101 LNRDGYLTSP PADFLELLSL AAIFTR*
```

The following partial DNA sequence was identified in *N. meningitidis* <SEQ ID 1019>:

```
m257.seq
   1 ATGGGCAGGC ATTTCGGGCG .CAGCGTTTT CTGACGGTTG CCGCCGTTGC

51 GGCGGGGaC. GCGGcGGTTT CTTTCCTGCC GAATCCTTTT GCCGCCGATG

101 ATGAAAAACG CAAcGGGGAT GAAAAACGCA ATGAAAATGT GTTTTTCTGG

151 AAAGGTGTCG CACTGGGTTC CGGTGCGGa. CTCCGTCTGT TCGGTGTGGA

201 CGACAGGCGT GCGGCGGATT TGGTCAACAA GGTTTTGGCG GAAGTGGCGC

251 GTTTGGAAAA ATTGTTCAGC CTTTACCGTG AAGACAGCCT GATCAGCCGC

301 CTGAACAGGG ACGGTTATCT GACTTCGCCG TCGGCGGATT TTTTGGAACT

351 GkTGAGCCTG GCCGCGATAT TCACGCkCTG A
```

This corresponds to the amino acid sequence <SEQ ID 1020; ORF 257>:

```
m257.pep
   1 MGRHFGXQRF LTVAAVAAGX AAVSFLPNPF AADDEKRNGD EKRNENVFFW

51 KGVALGSGAX LRLFGVDDRR AADLVNKVLA EVARLEKLFS LYREDSLISR

101 LNRDGYLTSP SADFLELXSL AAIFTX*
```

Computer analysis of this amino acid sequence gave the following results:

Homology with a Predicted ORF from *N. gonorrhoeae*

ORF 257 shows 88.0% identity over a 125 aa overlap with a predicted ORF (ORF 257.ng) from *N. gonorrhoeae*:

```
m257/g257
                    10         20         30         40         50         60
   m257.pep MGRHFGRQRFLTVAAVAAGTAAVSFLPNPFAADDEKRNGDEKRNENVFFWKGVALGSGAD
            ||||||:||||:|||::|||||||||||||| |||| |:||:|||||||||||||||||:
   g257     MGRHFGRRRFLTAAAVAVAGAAVSFLPNPFAAGGEKRNMDKKRDENVFFWKGVALGSGAE
                    10         20         30         40         50         60

70         80         90        100        110        120
   m257.pep LRLFGVDDRRAADLVNKVLAEVARLEKLFSLYREDSLISRLNRDGYLTSPSADFLELXSL
            |||||||||:||||||||||||||||||:||||||||||||||||||||| |||||| ||
   g257     LRLFGVDDRQAADLVNKVLAEVARLEKMFSLYREDSLISRLNRDGYLTSPPADFLELLSL
                    70         80         90        100        110        120 m257.pep AAIFTXX
            ||||| |
   g257     AAIFTRX
```

The following partial DNA sequence was identified in *N. meningitidis* <SEQ ID 1021>:

```
a257.seq
   1 ATGGGCAGGC ATTTCGGGCG CAGGCGTTTT TTGACAGTTG CCGCCGTTGC

51 GGCGGCGGGC GCGGCGGTTT CTTTCCTGCC GAATCCTTTT GCCGCCGATG
```

-continued

```
101 ATGAAAAACG CAATAAAGAT GAAAAACGCA ATGAAAATGT GTTTTTCTGG

151 AAAGGTGTCG CACTGGGTTC CGGTGCGGAG CTCCGTCTGT TCGGTGTGGA

201 CGACAGGCGT GCGGCGGATT TGGTCAACAA GGTTTTGGCG GAAGTGGCGC

251 GTTTGGAAAA AATGTTCAGC CTTTACCGTG AAGACAGCCT GATCAGCCGT

301 CTGAACCGTG ACGGTTATTT GACTTCGCCG CCGGCGGATT TTTTGGAACT

351 GTTGAGCCTG GCCGTGATAT TCACGCGCTG A
```

This corresponds to the amino acid sequence <SEQ ID 1022; ORF 257.a>:

```
a257.pep
  1 MGRHFGRRRF LTVAAVAAAG AAVSFLPNPF AADDEKRNKD EKRNENVFFW

51 KGVALGSGAE LRLFGVDDRR AADLVNKVLA EVARLEKMFS LYREDSLISR

101 LNRDGYLTSP PADFLELLSL AVIFTR*
``` m257/a257 92.0% identity in 125 aa overlap

```
                  10         20         30         40         50         60
    m257.pep  MGRHGGXQRFLTVAAVAAGXAAVSFLPNPFAADDEKRNGDEKRNENVFFWKGVALGSGAX
              ||||||  :||||||||||: ||||||||||||||||| :|||||||||||||||||||||
    a257      MGRHFGRRRFLTVAAVAAAGAAVSFLPNPFAADDEKRNKDEKRNENVFFWKGVALGSGAE
                  10         20         30         40         50         60

70         80         90        100        110        120
    m257.pep  LRLFGVDDRRAADLVNKVLAEVARLEKLFSLYREDSLISRLNRDGYLTSPSADFLELXSL
              ||||||||||||||||||||||||||||:||||||||||||||||||||||| |||||| ||
    a257      LRLFGVDDRRAADLVNKVLAEVARLEKMFSLYREDSLISRLNRDGYLTSPPADFLELLSL
                  70         80         90        100        110        120 m257.pep  AAIFTXX
              |:||| |
    a257      AVIFTRX
```

The following partial DNA sequence was identified in *N. gonorrhoeae* <SEQ ID 1023>:

```
g258.seq
  1 atgcgccgct tcctaccgat cgcagccata tgcgccgtcg tcctgctgta 51 cggattgacg gcggcgaccg gcagcaccag ttcgctggcg gattatttct 101 ggtggatagt ctcgttcagc gcaatgctgc tgctggtgtt gtccgccgtt 151 ttggcacgtt atgtcatatt gctgttgaaa gacaggcgca acggcgtgtt 201 cggttcgcag attgccaaac gcctttccgg gatgttcacg ctggtcgccg 251 tactgcccgg cttgttcctg ttcggcattt ccgcgcagtt tatcaacggc 301 acgattaatt cgtggttcgg caacgacacc cacgaagccc tcgaacgcag 351 ccttaatttg agcaagtccg cactggattt ggcggcagac aatgccgtca 401 gcaacgccgt tcccgtacag atagacctca tcggcaccgc ctccctgtcg 451 ggcaatatgg gcagtgtgct ggaacactac gccggcagcg gttttgccca 501 gcttgccctg tacaatgccg caagcgggaa atcgaaaaa agcatcaatc 551 cgcaccaatt cgaccagccg cttcccgaca aagaacattg ggaacagatt 601 cagcagaccg gttcggttcg gagtttggaa agcataggcg gcgtattgta 651 cgcgcaggga tggttgtcgg caggtacgca caacgggcgc gattacgcgc 701 tgttcttccg ccagccgatt cccgaaaatg tggcacagga tgccgttctg
```

-continued

```
 751 attgaaaagg cgcgggcgaa atatgccgaa ttgagttaca gcaaaaaagg 801 tttgcagacc ttttttctgg taaccctgct gattgcctcg ctgctgtcga 851 tttttcttgc gctggtaatg gcactgtatt ttgcccgccg tttcgtcgaa 901 cccattctgt cgcttgccga gggcgcaaag gcggtggcgc agggtgattt 951 cagccagacg cgccccgtat tgcgcaacga cgagttcgga cgtttgacca 1001 agctgttcaa ccatatgacc gagcagcttt ccatcgccaa agaagcagac 1051 gaacgcaacc gccggcgcga ggaagccgcc cgtcactacc tcgagtgcgt 1101 gttggatggg ttgactaccg gtgtggtggt ctcntacccc ctctcttgtt 1151 gccgtaccgc ggtgttttcc acttgtcatt cctcccctct ttcttatttc 1201 taa
```

This corresponds to the amino acid sequence <SEQ ID 1024; ORF 258.ng>:

```
g258.pep
  1 MRRFLPIAAI CAVVLLYGLT AATGSTSSLA DYFWWIVSFS AMLLLVLSAV

51 LARYVILLLK DRRNGVFGSQ IAKRLSGMFT LVAVLPGLFL FGISAQFING

101 TINSWFGNDT HEALERSLNL SKSALDLAAD NAVSNAVPVQ IDLIGTASLS

151 GNMGSVLEHY AGSGFAQLAL YNAASGKIEK SINPHQFDQP LPDKEHWEQI

201 QQTGSVRSLE SIGGVLYAQG WLSAGTHNGR DYALFFRQPI PENVAQDAVL

251 IEKARAKYAE LSYSKKGLQT FFLVTLLIAS LLSIFLALVM ALYFARRFVE

301 PILSLAEGAK AVAQGDFSQT RPVLRNDEFG RLTKLFNHMT EQLSIAKEAD

351 ERNRRREEAA RHYLECVLDG LTTGVVVSYP LSCCRTAVFS TCHSSPLSYF*
```

The following partial DNA sequence was identified in *N. meningitidis* <SEQ ID 1025>:

```
m258.seq
  1 ATGCGCCGTT TCTACCGAT CGCAGCCATA TGCGCCGTCG TCCTGTTGTA

51 CGGACTGACG GCGGCAACCG GCAGCACCAG TTCGCTGGCG GATTATTTCT

101 GGTGGATTGT TGCGTTCAGC GCAATGCTGC TGCTGGTGTT GTCCGCCGTT

151 TTGGCACGTT ATGTCATATT GCTGTTGAAA GACAGGCGCG ACGGCGTATT

201 CGGTTCGCAG ATTGCCAAAC GCCTTTCTGG GATGTTTACG CTGGTTGCCG

251 TACTGCCCGG CGTGTTTCTG TTCGGCGTTT CCGCACAGTT CATCAACGGC

301 ACGATTAATT CGTGGTTCGG CAACGATACC CACGAGGCGC TTGAACGCAG

351 CCTCAATTTG AGCAAGTCCG CATTGAATTT GGCGGCAGAC AACGCCCTCG

401 GCAACGCCGT CCCCGTGCAG ATAGACCTCA TCGGCGCGGC TTCCCTGCCC

451 GGGGATATGG GCAGGGTGCT GGAACATTAC GCCGGCAGCG GTTTTGCCCA

501 GCTTGCCCTG TACAATGCCG CAAGCGGCAA AATCGAAAAA AGCATCAACC

551 CGCACAAGCT CGATCAGCCG TTTCCAGGTA AGGCGCGTTG GGAAAAAATC

601 CAACGGGCGG GTTCGGTCAG GGATTTGGAA AGCATAGGCG GCGTATTGTA

651 CGCGCAGGGC TGGCTGTCGG CGGGTACGCA CAACGGGCGC GATTACGCCT

701 TGTTTTTCCG TCAGCCGGTT CCCAAAGGCG TGGCAGAGGA TGCCGTCTTA

751 ATCGAAAAGG CAAGGGCGAA ATATGCTGAG TTGAGTTACA GCAAAAAAGG
```

-continued

```
 801 TTTGCAGACC TTTTTCCTGG CAACCCTGCT GATTGCCTCG CTGCTGTCGA

851 TTTTTCTTGC ACTGGTCATG GCACTGTATT TCGCCCGCCG TTTCGTCGAA

901 CCCGTCCTAT CGCTTGCCGA GGGGGCGAAG GCGGTGGCGC AAGGCGATTT

951 CAGCCAGACG CGCCCCGTGT TGCGCAACGA CGAGTTCGGA CGCTTGACCA

1001 AGTTGTTCAA CCACATGACC GAGCAGCTTT CCATCGCCAA AGAAGCAGAC

1051 GAGCGCAACC GCCGGCGCGA GGAAGCCGCC AGGCATTATC TTGAATGCGT

1101 GTTGGAGGGG CTGACCACGG GCGTGGTGGT GTTTGACGAA CAAGGCTGTC

1151 TGAAAACsTT CAACAAAGCG GCGGAACAGA TTyTGGGGAT GCCGCTTACC

1201 CCCcTGTGGG GCAGCAGCCG GCACGGTTGG CACGGCGTTT CGGCGCAGCA

1251 GTCCCTGCTT GCCGAAGTGT TTGCCGCCAT CGGCGCGGCG GCAGGTACGG

1301 ACAAACCGGT CCATGTGAAA TATGCCGCGC CGGACGATGC CAAAATCCTG

1351 CTGGGCAAGG CAACCGTCCT GCCCGAAGAC AACGGCAACg GCGTGGTAAT

1401 GGTGATTGAC GACATCACCG TTTTGATACA CGCGCAAAAA GAAGCCGCGT

1451 GGGGCGAAgT GGCGaAgCGG CTGGCACACG AAATCCGCAA TCCGCTCACG

1501 CCCATCCAGC TTTCCGCCGA ACgGsTGGCG TkGAAATTGG GCGGGAAGCT

1551 GGATGAGCAG GATGCGCAAA TCCTGACGCG TTCGACCGAC ACCATCGTCA

1601 AACAGGTGGC GGCATTGAAG GAAATGGTCG AAGCATTCCG CAATTATGCG

1651 CGTTCCCCTT CGCTCAAATT GGAAAATCAG GATTTGAACG CCTTAATCGG

1701 CGATGTGTTG GCATTGTATG AAGCCGGTCC GTGCCGGTTT GCGGCGGACT

1751 TGCCGGCGAA CCGCTGA
```

This corresponds to the amino acid sequence <SEQ ID 1026; ORF 258>:

```
m258.pep
  1 MRRFLPIAAI CAVVLLYGLT AATGSTSSLA DYFWWIVAFS AMLLLVLSAV

51 LARYVILLLK DRRDGVFGSQ IAKRLSGMFT LVAVLPGVFL FGVSAQFING

101 TINSWFGNDT HEALERSLNL SKSALNLAAD NALGNAVPVQ IDLIGAASLP

151 GDMGRVLEHY AGSGFAQLAL YNAASGKIEK SINPHKLDQP FPGKARWEKI

201 QRAGSVRDLE SIGGVLYAQG WLSAGTHNGR DYALFFRQPV PKGVAEDAVL

251 IEKARAKYAE LSYSKKGLQT FFLATLLIAS LLSIFLALVM ALYFARRFVE

301 PVLSLAEGAK AVAQGDFSQT RPVLRNDEFG RLTKLFNHMT EQLSIAKEAD

351 ERNRRREEAA RHYLECVLEG LTTGVVVFDE QGCLKTFNKA AEQILGMPLT

401 PLWGSSRHGW HGVSAQQSLL AEVFAAIGAA AGTDKPVHVK YAAPDDAKIL

451 LGKATVLPED NGNGVVMVID DITVLIHAQK EAAWGEVAKR LAHEIRNPLT

501 PIQLSAERXA XKLGGKLDEQ DAQILTRSTD TIVKQVAALK EMVEAFRNYA

551 RSPSLKLENQ DLNALIGDVL ALYEAGPCRF AADLPANR*
```

Computer analysis of this amino acid sequence gave the following results:
Homology with a Predicted ORF from *N. gonorrhoeae*
ORF 258 shows 90.9% identity over a 386 aa overlap with a predicted ORF (ORF 258.ng) from *N. gonorrhoeae*:

```
    m258/g258

10        20        30        40        50        60
        m258.pep  MRRFLPIAAICAVVLLYGLTAATGSTSSLADYFWWIVAFSAMLLLVLSAVLARYVILLLK
                  |||||||||||||||||||||||||||||||||||:||||||||||||||||||||||||
        g258      MRRFLPIAAICAVVLLYGLTAATGSTSSLADYFWWIVSFSAMLLLVLSAVLARYVILLLK
                      10        20        30        40        50        60

70        80        90       100       110       120
        m258.pep  DRRDGVFGSQIAKRLSGMFTLVAVLPGVFLFGVSAQFINGTINSWFGNDTHEALERSLNL
                  |||:||||||||||||||||||||||||||:||||:||||||||||||||||||||||||
        g258      DRRRGVFGSQIAKRLSGMFTLVAVLPGLFLFGISAQFINGTINSWFGNDTHEALERSLNL
                      70        80        90       100       110       120

130       140       150       160       170       180
        m258.pep  SKSALNLAADNALGNAVPVQIDLIGAASLPGDMGRVLEHYAGSGFAQLALYNAASGKIEK
                  ||||:||||||::|||||||||||:|||:|| ||||||||||||||||||||||||||||
        g258      SKSALDLAADNAVSNAVPVQIDLIGTASLSGNMGSVLEHYAGSGFAQLALYNAASGKIEK
                     130       140       150       160       170       180

190       200       210       220       230       240
        m258.pep  SINPHKLDQPFPGKARWEKIQRAGSVRDLESIGGVLYAQGWLSAGTHNGRDYALFFRQPV
                  ||||::|||:|  :||:||::||||:|||||||||||||||||||||||||||||||||:
        g258      SINPHQFDQPLPDKEHWEQIQQTGSVRSLESIGGVLYAQGWLSAGTHNGRDYALFFRQPI
                     190       200       210       220       230       240

250       260       270       280       290       300
        m258.pep  PKGVAEDAVLIEKARAKYAELSYSKKGLQTFFLATLLIASLLSIGLALVMALYFARRFVE
                  |::||:||||||||||||||||||||||||||:|||||||||||||||||||||||||||
        g258      PENVAQDAVLIEKARAKYAELSYSKKGLQTFFLVTLLIASLLSIGLALVMALYFARRFVE
                     250       260       270       280       290       300

310       320       330       340       350       360
        m258.pep  PVLSLAEGAKAVAQGDFSQTRPVLRNDEFGRLTKLFNHMTWQLSIAKEADERNRRREEAA
                  |:||||||||||||||||||||||||||||||||||||||||||||||||||||||||||
        g258      PILSLAEGAKAVAQGDFSQTRPVLRNDEFGRLTKLFNHMTWQLSIAKEADERNRRREEAA
                     310       320       330       340       350       360

370       380       390       400       410       420
        m258.pep  RHYLECVLEGLTTGVVVFDEQGCLKTFNKAAEQILGMPLTPLWGSSRHGWHGVSAQQSLL
                  ||||||||:|||||||:|    :| :|
        g258      RHYLECVLDGLTTGVVVSYQKSCCRTAVFSTCHSSPLSYFX
                     370       380       390       400
```

The following partial DNA sequence was identified in *N. meningitidis* <SEQ ID 1027>:

```
a258.seq
    1  ATGCGCCGTT TTCTACCGAT CGCAGCCATA TGCGCCGTCG TCCTGTTGTA

51  CGGACTGACG GCGGCAACCG GCAGCACCAG TTCGCTGGCG GATTATTTCT

101  GGTGGATTGT TGCGTTCAGC GCAATGCTGC TGCTGGTGTT GTCCGCCGTT

151  TTGGCACGTT ATGTCATATT GCTGTTGAAA GACAGGCGCG ACGGCGTATT

201  CGGTTCGCAG ATTGCCAAAC GCCTTTCCGG GATGTTTACG CTGGTTGCCG

251  TACTGCCCGG CGTGTTTCTG TTCGGCGTTT CCGCACAGTT TATCAACGGC

301  ACGATTAATT CGTGGTTCGG CAACGATACC CACGAGGCGC TTGAACGCAG

351  CCTCAATTTG AGCAAGTCCG CATTGAATCT GGCGGCAGAC AACGCCCTTG

401  GCAACGCCAT CCCCGTGCAG ATAGACCTCA TCGGCGCGGC TTCCCTGCCC

451  GGGGATATGG GCAGGGTGCT GGAACATTAC GCCGGCAGCG GTTTTGCCCA

501  GCTTGCCCTG TACAATGCCG CAAGCGGCAA AATCGAAAAA AGCATCAACC

551  CGCACAAGCT CGATCAGCCG TTTCCAGGTA AGGCGCGTTG GGAAAAAATC

601  CAACAGGCGG GTTCGGTCAG GGATTTGGAA AGCATAGGCG GCGTATTGTA

651  CGCGCAGGGC TGGCTGTCGG CAGGTACGCA CAACGGGCGC GATTACGCCT

701  TGTTTTTCCG TCAGCCGGTT CCCAAAGGCG TGGCAGAGGA TGCCGTCTTA
```

-continued

```
 751 ATCGAAAAGG CAAGGGCGAA ATATGCTGAG TTGAGTTACA GCAAAAAAGG
 801 TTTGCAGACC TTTTTCCTGG CAACCCTGCT GATTGCCTCG CTGCTGTCGA
 851 TTTTTCTTGC ACTGGTCATG GCACTGTATT TCGCCCGCCG TTTCGTCGAA
 901 CCCGTCCTAT CGCTTGCCGA GGGGGCGAAG GCGGTGGCGC AAGGCGATTT
 951 CAGCCAGACG CGCCCCGTGT TGCGCAACGA CGAGTTCGGA CGCTTGACCA
1001 AGTTGTTCAA CCACATGACC GAGCAGCTTT CCATCGCCAA AGAAGCAGAC
1051 GAGCGCAACC GCCGGCGCGA GGAAGCCGCC AGACATTATC TCGAATGCGT
1101 GTTGGAGGGG CTGACCACGG GCGTGGTGGT GTTTGACGAA CAAGGCTGTC
1151 TGAAAACCTT CAACAAAGCG GCGGAACAGA TTTTGGGGAT GCCGCTTACC
1201 CCCCTGTGGG GCAGCAGCCG GCACGGTTGG CACGGCGTTT CGGCGCAGCA
1251 GTCCCTGCTT GCCGAAGTGT TTGCCGCCAT CGGCGCGGCG GCAGGTACGG
1301 ACAAACCGGT CCATGTGAAA TATGCCGCGC CGGACGATGC CAAAATCCTG
1351 CTGGGCAAGG CAACCGTCCT GCCCGAAGAC AACGGCAACG GCGTGGTAAT
1401 GGTGATTGAC GACATCACCG TTTTGATACA CGCGCAAAAA GAAGCCGCGT
1451 GGGGCGAAGT GGCAAAACGG CTGGCACACG AAATCCGCAA TCCGCTCACG
1501 CCCATCCAGC TTTCTGCCGA ACGGCTGGCG TGGAAATTGG GCGGGAAGCT
1551 GGACGAGCAG GACGCGCAAA TCCTGACACG TTCGACCGAC ACCATCATCA
1601 AACAAGTGGC GGCATTAAAA GAAATGGTCG AGGCATTCCG CAATTACGCG
1651 CGTTCCCCTT CGCTCAAATT GGAAAATCAG GATTTGAACG CCTTAATCGG
1701 CGATGTGTTG GCATTGTACG AAGCTGGTCC GTGCCGGTTT GCGGCGGAAC
1751 TTGCCGGCGA ACCGCTGATG ATGGCGGCGG ATACGACCGC CATGCGGCAG
1801 GTGCTGCACA ATATTTTCAA AAATGCCGCC GAAGCGGCGG AAGAAGCCGA
1851 TGTGCCCGAA GTCAGGGTAA ATCGGAAGC GGGGCAGGAC GGACGGATTG
1901 TCCTGACAGT TTGCGACAAC GGCAAGGGGT TCGGCAGGGA AATGCTGCAC
1951 AATGCCTTCG AGCCGTATGT AACGGACAAA CCGGCTGGAA CGGGATTGGG
2001 ACTGCCCGTG GTGAAAAAAA TCATTGAAGA CACGGCGGC CGCATCAGCC
2051 TGAGCAATCA GGATGCGGGC GGCGCGTGTG TCAGAATCAT CTTGCCAAAA
2101 ACGGTAGAAA CTTATGCGTA G
```

This corresponds to the amino acid sequence <SEQ ID 1028; ORF 258.a>:

```
a258.pep
   1 MRRFLPIAAI CAVVLLYGLT AATGSTSSLA DYFWWIVAFS AMLLLVLSAV
  51 LARYVILLLK DRRDGVFGSQ IAKRLSGMFT LVAVLPGVFL FGVSAQFING
 101 TINSWFGNDT HEALERSLNL SKSALNLAAD NALGNAIPVQ IDLIGAASLP
 151 GDMGRVLEHY AGSGFAQLAL YNAASGKIEK SINPHKLDQP FPGKARWEKI
 201 QQAGSVRDLE SIGGVLYAQG WLSAGTHNGR DYALFFRQPV PKGVAEDAVL
 251 IEKARAKYAE LSYSKKGLQT FFLATLLIAS LLSIFLALVM ALYFARRFVE
 301 PVLSLAEGAK AVAQGDFSQT RPVLRNDEFG RLTKLFNHMT EQLSIAKEAD
 351 ERNRRREEAA RHYLECVLEG LTTGVVVFDE QGCLKTFNKA AEQILGMPLT
 401 PLWGSSRHGW HGVSAQQSLL AEVFAAIGAA AGTDKPVHVK YAAPDDAKIL
```

```
451  LGKATVLPED NGNGVVMVID DITVLIHAQK EAAWGEVAKR LAHEIRNPLT

501  PIQLSAERLA WKLGGKLDEQ DAQILTRSTD TIIKQVAALK EMVEAFRNYA

551  RSPSLKLENQ DLNALIGDVL ALYEAGPCRF AAELAGEPLM MAADTTAMRQ

601  VLHNIFKNAA EAAEEADVPE VRVKSEAGQD GRIVLTVCDN GKGFGREMLH

651  NAFEPYVTDK PAGTGLGLPV VKKIIEEHGG RISLSNQDAG GACVRIILPK

701  TVETYA*
``` m258/a258 99.0% identity in 584 aa overlap

```
                    10         20         30         40         50         60
m258.pep   MRRFLPIAAICAVVLLYGLTAATGSTSSLADYFWWIVAFSAMLLLVLSAVLARYVILLLK
           ||||||||||||||||||||||||||||||||||||||||||||||||||||||||||||
a258       MRRFLPIAAICAVVLLYGLTAATGSTSSLADYFWWIVAFSAMLLLVLSAVLARYVILLLK
                    10         20         30         40         50         60
                    70         80         90        100        110        120
m258.pep   DRRDGVFGSQIAKRLSGMFTLVAVLPGVFLFGVSAQFINGTINSWFGNDTHEALERSLNL
           ||||||||||||||||||||||||||||||||||||||||||||||||||||||||||||
a258       DRRDGVFGSQIAKRLSGMFTLVAVLPGVFLFGVSAQFINGTINSWFGNDTHEALERSLNL
                    70         80         90        100        110        120
                   130        140        150        160        170        180
m258.pep   SKSALNLAADNALGNAVPVQIDLIGAASLPGDMGRVLEHYAGSGFAQLALYNAASGKIEK
           ||||||||||||:|||||||||||||||||||||||||||||||||||||||||||||||
a258       SKSALNLAADNALGNAIPVQIDLIGAASLPGDMGRVLEHYAGSGFAQLALYNAASGKIEK
                   130        140        150        160        170        180
                   190        200        210        220        230        240
m258.pep   SINPHKLDQPFPGKARWEKIQRAGSVRDLESIGGVLYAQGWLSAGTHNGRDYALFFRQPV
           ||||||||||||||||||||||||:|||||||||||||||||||||||||||||||||||
a258       SINPHKLDQPFPGKARWEKIQQAGSVRDLESIGGVLYAQGWLSAGTHNGRDYALFFRQPV
                   190        200        210        220        230        240
                   250        260        270        280        290        300
m258.pep   PKGVAEDAVLIEKARAKYAELSYSKKGLQTFFLATLLIASLLSIFLALVMALYFARRFVE
           ||||||||||||||||||||||||||||||||||||||||||||||||||||||||||||
a258       PKGVAEDAVLIEKARAKYAELSYSKKGLQTFFLATLLIASLLSIFLALVMALYFARRFVE
                   250        260        270        280        290        300
                   310        320        330        340        350        360
m258.pep   PVLSLAEGAKAVAQGDFSQTRPVLRNDEFGRLTKLFNHMTEQLSIAKEADERNRRREEAA
           ||||||||||||||||||||||||||||||||||||||||||||||||||||||||||||
a258       PVLSLAEGAKAVAQGDFSQTRPVLRNDEFGRLTKLFNHMTEQLSIAKEADERNRRREEAA
                   310        320        330        340        350        360
                   370        380        390        400        410        420
m258.pep   RHYLECVLEGLTTGVVVFDEQGCLKTFNKAAEQILGMPLTPLWGSSRHGWHGVSAQQSLL
           ||||||||||||||||||||||||||||||||||||||||||||||||||||||||||||
a258       RHYLECVLEGLTTGVVVFDEQGCLKTFNKAAEQILGMPLTPLWGSSRHGWHGVSAQQSLL
                   370        380        390        400        410        420
                   430        440        450        460        470        480
m258.pep   AEVFAAIGAAAGTDKPVHVKYAAPDDAKILLGKATVLPEDNGNGVVMVIDDITVLIHAQK
           ||||||||||||||||||||||||||||||||||||||||||||||||||||||||||||
a258       AEVFAAIGAAAGTDKPVHVKYAAPDDAKILLGKATVLPEDNGNGVVMVIDDITVLIHAQK
                   430        440        450        460        470        480
                   490        500        510        520        530        540
m258.pep   EAAWGEVAKRLAHEIRNPLTPIQLSAERXAXKLGGKLDEQDAQILTRSTDTIVKQVAALK
           ||||||||||||||||||||||||||| |  ||||||||||||||||||||:||||||
a258       EAAWGEVAKRLAHEIRNPLTPIQLSAERLAWKLGGKLDEQDAQILTRSTDTIIKQVAALK
                   490        500        510        520        530        540
                   550        560        570        580        589
m258.pep   EMVEAFRNYARSPSLKLENQDLNALIGDVLALYEAGPCRFAADLPANRX
           |||||||||||||||||||||||||||||||||||||||||:|
a258       EMVEAFRNYARSPSLKLENQDLNALIGDVLALYEAGPCRFAAELAGEPLMMAADTTAMRQ
                   550        560        570        580        590        600
a258       VLHNIFKNAAEAAEEADVPEVRVKSEAGQDGRIVLTVCDNGKGFGREMLHNAFEPYVTDK
                   610        620        630        640        650        660
```

The following partial DNA sequence was identified in *N. gonorrhoeae* <SEQ ID 1029>:

```
g259.seq
  1  atgatgatgc acgcttctgt ccaaagtcgt ttcgcaccga tactttatgt 51  tttgattttc tttgccggtt ttttgaccgc gcaaatctgg ttcaatcaga
```

-continued

```
101 aagcctatac tgaagagctg cctccgcttc tgtccgcatt gtccgccgtc 151 gcgctggtgt ggctggcgtg ggcgttcgtg tcggtgcgtt caaaggctaa 201 ggcagaaaag ttctaccgcg aaaaaatgat acagaacgaa agcatacacc 251 ccgtcctgca cgcttctttg caacacttgg aacacaagcc gcaaatgctc 301 gccctgctgg tcaaaaacca cggcaaaggc atggcggaac aggtcaggtt 351 caaggcggaa gtgctgcccg acgacgaaga cgcgcgcacg attgccgccg 401 agttggcaaa aatggatatg ttcgcattgg ggacggacgc ggtcgcctcg 451 ggcgaaacct atgggcgcgt gttcgccgat attttcgagt tgtcggcggc 501 tttggaaagg cgcgcgttca aagggatact gaaactgacg gcggaatata 551 aaaaacatct tcggcgatgc ctgccgttcg gaaacggcgt tggatttggg 601 cgcgctcaat caggcgttga gggaaatctc gaaaacgccg gaaaagccta 651 a
```

This corresponds to the amino acid sequence <SEQ ID 1030; ORF 259.ng>:

```
g259.pep
  1 MMMHASVQSR FAPILYVLIF FAGFLTAQIW FNQKAYTEEL PPLLSALSAV

51 ALVWLAWAFV SVRSKAKAEK FYREKMIQNE SIHPVLHASL QHLEHKPQML

101 ALLVKNHGKG MAEQVRFKAE VLPDDEDART IAAELAKMDM FALGTDAVAS

151 GETYGRVFAD IFELSAALER RAFKGILKLT AEYKKHLRRC LPFGNGVGFG

201 RAQSGVEGNL ENAGKA*
```

The following partial DNA sequence was identified in *N. meningitidis* <SEQ ID 1031>:

```
m259.seq (partial)
  1 ATGATGATGC ACGCTTCTGT CCAAAGCCGT TTCGCACCGA TACTTTATGT

51 TTTGATTTTC TTTGCCGGTT TTTTGACCGC GCAAATCTGG TTCAATCAGA

101 AAGCCTATAC TGAAGAGCTG CCTCCGCTTC TGTCCGCATT GTCCGCCGTC

151 GCGCTGGTGT GGCTGGCGTG GGCGTTCGTG TCGGCGCGTT CAAAGGCCAA

201 GGCGGAAAAG TTCTACCGCG AAAAAATGAT ACAGAACGAA AGCATACACC

251 CCGTCsTGCA CGCCTCTTTG CAACACTTGG AACACAAGCC GCAAATACTC

301 GCCCTGCTGG TCAAAAACCA CGGCAAAGGG ATGGCGGAAC AGGTCAGGTT

351 CAAGGCGGAA GTGCTGCCCG ACGACGAAGA CGCGCGCACG ATTGCCGCCG

401 AGTTGGCAAA AATGGATATG TTCGCATTGG GGACkGACGC GGTCGCCTCG

451 GGCGAAACCT ATGGACGCGT GTTCGCCGAT ATTTTCGAGT TGTCGGmGGC

501 TTTGGAAGGG CGCGCGTTCA AAGGAATGTT GAAACTGACG GCGGAATATA

551 AA.AACATCT TCGGmGATGC CTGCCGTTCG GAAACGGCGT TGGAGTTGGG

601 CGCACTCAAT CAGGCGTTGC AGGAGATTTC AAAAACATCC GG..
```

This corresponds to the amino acid sequence <SEQ ID 1032; ORF 259>:

```
m259.pep (partial)
  1 MMMHASVQSR FAPILYVLIF FAGFLTAQIW FNQKAYTEEL PPLLSALSAV
```

```
 51 ALVWLAWAFV SARSKAKAEK FYREKMIQNE SIHPVXHASL QHLEHKPQIL

101 ALLVKNHGKG MAEQVRFKAE VLPDDEDART IAAELAKMDM FALGTDAVAS

151 GETYGRVFAD IFELSXALEG RAFKGMLKLT AEYKXHLRRC LPFGNGVGVG

201 RTQSGVAGDF KNIR..
```

Computer analysis of this amino acid sequence gave the following results:
Homology with a Predicted ORF from *N. gonorrhoeae*
ORF 259 shows 94.3% identity over a 212 aa overlap with a predicted ORF (ORF 259.ng) from *N. gonorrhoeae*:

```
   m259/g259

10         20         30         40         50         60
    m259.pep   MMMHASVQSRFAPILYVLIFFAGFLTAQIWFNQKAYTEELPPLLSALSAVALVWLAWAFV
               ||||||||||||||||||||||||||||||||||||||||||||||||||||||||||||
       g259    MMMHASVQSRFAPILYVLIFFAGFLTAQIWFNQKAYTEELPPLLSALSAVALVWLAWAFV
                       10         20         30         40         50         60

70         80         90        100        110        120
    m259.pep   SARSKAKAEKFYREKMIQNESIHPVXHASLQHLEHKPQILALLVKNHGKGMAEQVRFKAE
               |:||||||||||||||||||||||| ||||||||||||:|||||||||||||||||||||
       g259    SVRSKAKAEKFYREKMIQNESIHPVLHASLQHLEHKPQMLALLVKNHGKGMAEQVRFKAE
                       70         80         90        100        110        120

130        140        150        160        170        180
    m259.pep   VLPDDEDARTIAAELAKMDMFALGTDAVASGETYGRVFADIFELSXALEGRAFKGMLKLT
               |||||||||||||||||||||||||||||||||||||||||||| ||| |||||:||||
       g259    VLPDDEDARTIAAELAKMDMFALGTDAVASGETYGRVFADIFELSAALERRAFKGILKLT
                      130        140        150        160        170        180

190        200        210
    m259.pep   AEYKKHLRRCLPFGNGVGVGRTQSGVAGDFKNIR
               |||||||||||||||||| ||:|||| |:::|
       g259    AEYKKHLRRCLPFGNGVGFGRAQSGVEGNLENAGKAX
                      190        200        210
```

The following partial DNA sequence was identified in *N. meningitidis* <SEQ ID 1033>:

```
a259.seq (partial)
   1 ATGATGATGC ACGCTTCTGT CCAAAGCCGT TTCGCACCGA TACTTTATGT

51 TTTGATTTTC TTTGCCGGTT TTTTGACCGC GCAAATCTGG TTCAATCAGA

101 AAGCCTATAC TGAAGAGCTG CCTCCGCTTC TGTCCGCATT GTCCGCCGTC

151 GCGCTGGTGT GGCTGGCGTG GGCGTTCGTG TCGGCGCGTT CAAAGGCTAA

201 GGCGGAAAAG TTCTACCGCG AAAAAATGAT ACAGAACGAA AGCATACACC

251 CCGTCCTGCA CGCTTCTTTG CAACACTTGG AACACAAGCC GCAAATGCTC

301 GCCCTGCTGG TCAAAAACCA CGGCAAAGGG ATGGCGGAAC AGGTCAGGTT

351 CAAGGCGGAA GTGCTGCCCG ACGACGAAGA CGCGCGCACG ATTGCCGCCG

401 AGTTGGCAAA AATGGATATG TTTGCATTGG GGACGGACGC GGTCGCCTCG

451 GGCGAAACCT ATGGACGCGT GTTCGCCGAT ATTTTCGAGT TGTCGGCGGC

501 TTTGGAAGGG CGCGCGTTCA AAGGAATGTT GAAACTGACG GCGGAATATA

551 AAAA.CATCT TCGGCGATGC CTGCCGTTCG GAAACGGCGT TGGAGTTGGG

601 CGCGCTCAAT CAGGCGTTGC AGGAGATTTC AAAAACATCG GAAAAGTCCA

651 A
```

This corresponds to the amino acid sequence <SEQ ID 1034; ORF 259.a>:

```
a259.pep (partial)
  1 MMMHASVQSR FAPILYVLIF FAGFLTAQIW FNQKAYTEEL PPLLSALSAV

51 ALVWLAWAFV SARSKAKAEK FYREKMIQNE SIHPVLHASL QHLEHKPQML

101 ALLVKNHGKG MAEQVRFKAE VLPDDEDART IAAELAKMDM FALGTDAVAS

151 GETYGRVFAD IFELSAALEG RAFKGMLKLT AEYKXHLRRC LPFGNGVGVG

201 RAQSGVAGDF KNIGKVQ
``` m259/a259 98.1% identity in 213 aa overlap

```
                 10         20         30         40         50         60
   m259.pep    MMMHASVQSRFAPILYVLIFFAGFLTAQIWFNQKAYTEELPPLLSALSAVALVWLAWAFV
               ||||||||||||||||||||||||||||||||||||||||||||||||||||||||||||
   a259        MMMHASVQSRFAPILYVLIFFAGFLTAQIWFNQKAYTEELPPLLSALSAVALVWLAWAFV
                 10         20         30         40         50         60
                 70         80         90        100        110        120
   m259.pep    SARSKAKAEKFYREKMIQNESIHPVXHASLQHLEHKPQILALLVKNHGKGMAEQVRFKAE
               ||||||||||||||||||||||||||||| |||||||||||:||||||||||||||||||
   a259        SARSKAKAEKFYREKMIQNESIHPVLHASLQHLEHKPQMLALLVKNHGKGMAEQVRFKAE
                 70         80         90        100        110        120
                130        140        150        160        170        180
   m259.pep    VLPDDRDARTIAAELAKMDMFALGTDAVASGETYGRVFADIFELSXALEGRAFKGMLKLT
               |||||||||||||||||||||||||||||||||||||||||||||| |||||||||||||
   a259        VLPDDRDARTIAAELAKMDMFALGTDAVASGETYGRVFADIFELSAALEGRAFKGMLKLT
                130        140        150        160        170        180
                190        200        210
   m259.pep    AEYKXHLRRCLPFGNGVGVGRTQSGVAGDFKNIR
               |||||||||||||||||||||||:|||||||||
   a259        AEYKXHLRRCLPFGNGVGVGRAQSGVAGDFKNIGKVQ
                190        200        210
```

The following partial DNA sequence was identified in *N. gonorrhoeae* <SEQ ID 1035>:

```
g259-1.seq
  1 ATGATGATGC ACGCTTCTGT CCAAAGTCGT TTCGCACCGA TACTTTATGT

51 TTTGATTTTC TTTGCCGGTT TTTTGACCGC GCAAATCTGG TTCAATCAGA

101 AAGCCTATAC TGAAGAGCTG CCTCCGCTTC TGTCCGCATT GTCCGCCGTC

151 GCGCTGGTGT GGCTGGCGTG GGCGTTCGTG TCGGTGCGTT CAAAGGCTAA

201 GGCAGAAAAG TTCTACCGCG AAAAAATGAT ACAGAACGAA AGCATACACC

251 CCGTCCTGCA CGCTTCTTTG CAACACTTGG AACACAAGCC GCAAATGCTC

301 GCCCTGCTGG TCAAAAACCA CGGCAAAGGC ATGGCGGAAC AGGTCAGGTT

351 CAAGGCGGAA GTGCTGCCCG ACGACGAAGA CGCGCGCACG ATTGCCGCCG

401 AGTTGGCAAA AATGGATATG TTCGCATTGG GGACGGACGC GGTCGCCTCG

451 GGCGAAACCT ATGGGCGCGT GTTCGCCGAT ATTTTCGAGT TGTCGGCGGC

501 TTTGGAA
```

This corresponds to the amino acid sequence <SEQ ID 1036; ORF 259-1.ng>:

```
g259-1.pep
  1 MMMHASVQSR FAPILYVLIF FAGFLTAQIW FNQKAYTEEL PPLLSALSAV

51 ALVWLAWAFV SVRSKAKAEK FYREKMIQNE SIHPVLHASL QHLEHKPQML
```

```
101 ALLVKNHGKG MAEQVRFKAE VLPDDEDART IAAELAKMDM FALGTDAVAS

151 GETYGRVFAD IFELSAALE
```

The following partial DNA sequence was identified in *N. meningitidis* <SEQ ID 1037>:

```
m259-1.seq
   1 ATGATGATGC ACGCTTCTGT CCAAAGCCGT TCGCACCGA TACTTTATGT

51 TTTGATTTTC TTTGCCGGTT TTTTGACCGC GCAAATCTGG TTCAATCAGA

101 AAGCCTATAC TGAAGAGCTG CCTCCGCTTC TGTCCGCATT GTCCGCCGTC

151 GCGCTGGTGT GGCTGGCGTG GCGTTCGTG TCGGCGCGTT CAAAGGCCAA

201 GGCGGAAAAG TTCTACCGCG AAAAAATGAT ACAGAACGAA AGCATACACC

251 CCGTCCTGCA CGCCTCTTTG CAACACTTGG AACACAAGCC GCAAATACTC

301 GCCCTGCTGG TCAAAAACCA CGGCAAAGGG ATGGCGGAAC AGGTCAGGTT

351 CAAGGCGGAA GTGCTGCCCG ACGACGAAGA CGCGCGCACG ATTGCCGCCG

401 AGTTGGCAAA AATGGATATG TTCGCATTGG GGACGGACGC GGTCGCCTCG

451 GGCGAAACCT ATGGACGCGT GTTCGCCGAT ATTTTCGAGT TGTCGGCGGC

501 TTTGGAAGGG CGCGCGTTCA AAGGAATGTT GAAACTGACG GCGGAATATA

551 AAAACATCTT CGGCGATGCC TGCCGTTCGG AAACGGCGTT GGAGTTGGGC

601 GCACTCAATC AGGCGTTGCA GGAGATTTCA AAAACATCGG AAAAGTCCAA

651 ACGGATATTT TATTGA
```

This corresponds to the amino acid sequence <SEQ ID 1038; ORF 259-1>:

```
m259-1.pep
      1 MMMHASVQSR FAPILYVLIF FAGFLTAQIW FNQKAYTEEL PPLLSALSAV

51 ALVWLAWAFV SARSKAKAEK FYREKMIQNE SIHPVLHASL QHLEHKPQIL

101 ALLVKNHGKG MAEQVRFKAE VLPDDEDART IAAELAKMDM FALGTDAVAS

151 GETYGRVFAD IFELSAALEG RAFKGMLKLT AEYKNIFGDA CRSETALELG

201 ALNQALQEIS KTSEKSKRIF Y* g259-1/m259-1   98.8% indentity in 169 aa overlap 10         20         30         40         50         60
      g259-1.pep  MMMHASVQSRFAPILYVLIFFAGFLTAQIWFNQKAYTEELPPLLSALSAVALVWLAWAFV
                  ||||||||||||||||||||||||||||||||||||||||||||||||||||||||||||
      m259-1      MMMHASVQSRFAPILYVLIFFAGFLTAQIWFNQKAYTEELPPLLSALSAVALVWLAWAFV
                        10         20         30         40         50         60
                        70         80         90        100        110        120
      g259-1.pep  SVRSKAKAEKFYREKMIQNESIHPVLHASLQHLEHKPQMLALLVKNHGKGMAEQVRFKAE
                  |:||||||||||||||||||||||||||||||||||||:|||||||||||||||||||||
      m259-1      SARSKAKAEKFYREKMIQNESIHPVLHASLQHLEHKPQILALLVKNHGKGMAEQVRFKAE
                        70         80         90        100        110        120
                       130        140        150        160       169
      g259-1.pep  VLPDDEDARTIAAELAKMDMFALGTDAVASGETYGRVFADIFELSAALE
                  |||||||||||||||||||||||||||||||||||||||||||||||||
      m259-1      VLPDDEDARTIAAELAKMDMFALGTDAVASGETYGRVFADIFELSAALEGRAFKGMLKLT
                       130        140        150        160        170       180
```

The following partial DNA sequence was identified in *N. meningitidis* <SEQ ID 1039>:

```
a259-1.seq
   1 ATGATGATGC ACGCTTCTGT CCAAAGCCGT TCGCACCGA TACTTTATGT
```

-continued

```
 51 TTTGATTTTC TTTGCCGGTT TTTTGACCGC GCAAATCTGG TTCAATCAGA

101 AAGCCTATAC TGAAGAGCTG CCTCCGCTTC TGTCCGCATT GTCCGCCGTC

151 GCGCTGGTGT GGCTGGCGTG GGCGTTCGTG TCGGCGCGTT CAAAGGCTAA

201 GGCGGAAAAG TTCTACCGCG AAAAAATGAT ACAGAACGAA AGCATACACC

251 CCGTCCTGCA CGCTTCTTTG CAACACTTGG AACACAAGCC GCAAATGCTC

301 GCCCTGCTGG TCAAAAACCA CGGCAAAGGG ATGGCGGAAC AGGTCAGGTT

351 CAAGGCGGAA GTGCTGCCCG ACGACGAAGA CGCGCGCACG ATTGCCGCCG

401 AGTTGGCAAA AATGGATATG TTTGCATTGG GGACGGACGC GGTCGCCTCG

451 GGCGAAACCT ATGGACGCGT GTTCGCCGAT ATTTTCGAGT TGTCGGCGGC

501 TTTGGAAGGG CGCGCGTTCA AAGGAATGTT GAAACTGACG GCGGAATATA

551 AAAACATCTT CGGCGATGCC TGCCGTTCGG AAACGGCGTT GGAGTTGGGC

601 GCGCTCAATC AGGCGTTGCA GGAGATTTCA AAAACATCGG AAAAGTCCAA

651 ACGGATATTT TATTGA
```

This corresponds to the amino acid sequence <SEQ ID 1040; ORF 259-1.a>:

```
a259-1.pep

1 MMMHASVQSR FAPILYVLIF FAGFLTAQIW FNQKAYTEEL PPLLSALSAV

51 ALVWLAWAFV SARSKAKAEK FYREKMIQNE SIHPVLHASL QHLEHKPQML

101 ALLVKNHGKG MAEQVRFKAE VLPDDEDART IAAELAKMDM FALGTDAVAS

151 GETYGRVFAD IFELSAALEG RAFKGMLKLT AEYKNIFGDA CRSETALELG

201 ALNQALQEIS KTSEKSKRIF Y* g259-1/m259-1    99.5% indentity in 221 aa overlap 10        20        30        40        50        60
   a259-1.pep  MMMHASVQSRFAPILYVLIFFAGFLTAQIWFNQKAYTEELPPLLSALSAVALVWLAWAFV
               ||||||||||||||||||||||||||||||||||||||||||||||||||||||||||||
   m259-1      MMMHASVQSRFAPILYVLIFFAGFLTAQIWFNQKAYTEELPPLLSALSAVALVWLAWAFV
                   10        20        30        40        50        60

70        80        90       100       110       120
   a259-1.pep  SARSKAKAEKFYREKMIQNESIHPVLHASLQHLEHKPQMLALLVKNHGKGMAEQVRFKAE
               |||||||||||||||||||||||||||||||||||||||:||||||||||||||||||||
   m259-1      SARSKAKAEKFYREKMIQNESIHPVLHASLQHLEHKPQILALLVKNHGKGMAEQVRFKAE
                   70        80        90       100       110       120

130       140       150       160       169
   a259-1.pep  VLPDDEDARTIAAELAKMDMFALGTDAVASGETYGRVFADIFELSAALEGRAFKGMLKLT
               ||||||||||||||||||||||||||||||||||||||||||||||||||||||||||||
   m259-1      VLPDDEDARTIAAELAKMDMFALGTDAVASGETYGRVFADIFELSAALEGRAFKGMLKLT
                  130       140       150       160       170       180

190       200       210       220
   a259-1.pep  AEYKNIFGDACRSETALELGALNQALQEISKTSEKSKRIFYX
               |||||||||||||||||||||||||||||||||||||||||
   m259-1      AEYKNIFGDACRSETALELGALNQALQEISKTSEKSKRIFYX
                  190       200       210       220
```

The following partial DNA sequence was identified in *N. gonorrhoeae* <SEQ ID 1041>:

```
g260.seq
   1 atgggtgcgg gtgtagtatt cgttgtcttt cagccgttct tcagcctgtt 51 tcgagcgttg ttcgagggcg gagtcggtat agtcgaggga gcgcacgatg 101 ccgctgaatg cgacttcttg tccgaggaat ttacccgtat ccggatcggt 151 gatgttttta ttgattcggt aggtcagata acggcccggt tctttcaggc
```

-continued

```
201 ctttggtgta aaccctggcg cctttggtgt acagcagcct gccttccggg 251 cccgagagca ggcgcggcgc ggcagcggtt tctttgcggg aaacgatttg 301 cgggtgctgc ataaagacgc ggtagaagtt gacatcgatg gcgggaatac 351 cgtatccgga cacttcctta tccggactga ttttgacgac ggggatgccg 401 tctgtctgtt ccaagccgag gcgcggttcg ccgccaacgt agcgcaacac 451 caatacctgg cccggataaa tcaggtcggg attgtggatt tgatcccggt 501 tcgcgcccca caggggggga ccattgccac gggctgtaca ggtatttgcc 551 cgaaataccc cacagggtgt cgccctgttt ga
```

This corresponds to the amino acid sequence <SEQ ID 1042; ORF 260.ng>:

```
g260.pep
  1 MGAGVVFVVF QPFFSLFRAL FEGGVGIVEG AHDAAECDFL SEEFTRIRIG

51 DVFIDSVGQI TARFFQAFGV NPGAFGVQQP AFRAREQARR GSGFFAGNDL

101 RVLHKDAVEV DIDGGNTVSG HFLIRTDFDD GDAVCLFQAE ARFAANVAQH

151 QYLARINQVG IVDLIPVRAP QGGTIATGCT GICPKYPTGC RPV*
```

The following partial DNA sequence was identified in *N. meningitidis* <SEQ ID 1043>:

```
m260.seq
  1 ATGGGTGCGG GTATGGTATT CGTTGTCTTT CGGCCGTTCT CCAGCCTGTT

51 TCGAGCGTTG TTCGAGGACA GAGTCGGTAT AGTCGAGGGA GCGCACGATG

101 CCGCTGAATG CGACTTCCTG CCCGAGGAAT TTACCCGTAT CCGGATCGGT

151 GATGTTTTTA TTGATTCGGT AGGTCAGGTA GCGGCCCGGC TCTTTCAGGC

201 CTTTGGTGTA AACCCTGGTG CCTTTGGTGT ACAGCAGCCT GCCTTCCGGG

251 CCCGAGwrCA sGCGCGGyGC GGCAGCGGTT TCTTTGCGGG AAACGATTTG

301 CGGATGCCGC ATAAAGATGC GGTAGAAGTT GACATCGATG GCGGGAATAC

351 CGTATCCGGA CACTTCCTTA TCCGGACTCA TTTTGACGAC GGGGATGCCG

401 TCTGTCTGTT CCAAGCCGAG GCGCGGTTCG CCGTCAACGT GGCGCAACAC

451 CAATACCTGG TCCGGATAAA TCAGGTCGGG ATTGTGGATT TGATCCCGGT

501 TCGCGTyCCA CAG
```

This corresponds to the amino acid sequence <SEQ ID 1044; ORF 260>:

```
m260.pep
  1 MGAGMVFVVF RPFSSLFRAL FEDRVGIVEG AHDAAECDFL PEEFTRIRIG

51 DVFIDSVGQV AARLFQAFGV NPGAFGVQQP AFRARXXARX GSGFFAGNDL

101 RMPHKDAVEV DIDGGNTVSG HFLIRTHFDD GDAVCLFQAE ARFAVNVAQH

151 QYLVRINQVG IVDLIPVRVP Q
```

Computer analysis of this amino acid sequence gave the following results:
Homology with a Predicted ORF from *N. gonorrhoeae*
ORF 260 shows 89.5% identity over a 171 aa overlap with a predicted ORF (ORF 260.ng) from *N. gonorrhoeae*:

```
m260/g260
                    10         20         30         40         50         60
    m260.pep  MGAGMVFVVFRPFSSLFRALFEDRVGIVEGAHDAAECDFLPEEFTRIRIGDVFIDSVGQV
              ||||:|||||:|| ||||||| |||||||||||||||||||| |||||||||||||||:
    g260      MGAGVVFVVFQPFFSLFRALFEGGVGIVEGAHDAAECDFLSEEFTRIRIGDVFIDSVGQI
                    10         20         30         40         50         60

70         80         90        100        110        120
    m260.pep  AARLFQAFGVNPGAFGVQQPAFRARXXARXGSGFFAGNDLRMPHKDAVEVDIDGGNTVSG
              :||:|||||||||||||||||||||| || ||||||||||||:||||||||||||||||
    g260      TARFFQAFGVNPGAFGVQQPAFRAREQARXGSGFFAGNDLRVLHKDAVEVDIDGGNTVSG
                    70         80         90        100        110        120

130        140        150        160        170        180
    m260.pep  HFLIRTHFDDGDAVCLFQAEARFAVNVAQHQYLVRINQVGIVDLIPVRVPQ
              ||||||  ||||||||||||||||:|||||||:||||||||||||||||:||
    g260      HFLIRTDFDDGDAVCLFQAEARFAANVAQHQYLARINQVGIVDLIPVRAPQGGTIATGCT
                   130        140        150        160        170        180 g260      GICPKYPTGCRPV
                   190
```

The following partial DNA sequence was identified in *N. meningitidis* <SEQ ID 1045>:

```
a260.seq
   1 ATGGGTGCGG GTATGGTATT CGTTGTCTTT CGGCCGTTCT CCAGCCTGTT

51 TCGAGCGTTG TTCGAGGACA GAGTCGGTAT AGTCGAGGGA GCGCACGATG

101 CCGCTGAATG CGACTTCCTG CCCGAGGAAT TTACCCGTAT CCGGATCGGT

151 GATGTTTTTA TTGATTCGGT AGGTCAGGTA GCGGCCCGGC TCTTTCAGGC

201 CTTTGGTGTA AACCCTGGTG CCTTTGGTGT ACAGCAGCCT GCCTTCCGGG

251 CCCGAGAGCA GGCGCGGCGC GGCAGCGGTT TCTTTGCGGG AAACGATTTG

301 CGGGTGCCGC ATAAAGATGC GGTAGAAGTT GACATCGATG GCGGGAATAC

351 CGTATCCGGA CACTTCCTTA TCCGGACTCA TTTTGACGAC GGGGATGCCG

401 TCTGTCTGTT CCAAGCCGAG GCGCGGTTCG CCGTCAACGT GGCGCAACAC

451 CAATACCTGG TCCAGATAAA TCAGGTCGGG ATTGTGGATT TGATCCCGGT

501 TCGCGTCCCA CAGGCGGCC. CCATTGCCAC GGGCTGTACA GGTATTTGCC

551 CGAAATGCCC CACAGGGTGT CGCCCTGTTT GA
```

This corresponds to the amino acid sequence <SEQ ID 1046; ORF 260.a>:

```
a260.pep
   1 MGAGMVFVVF RPFSSLFRAL FEDRVGIVEG AHDAAECDFL PEEFTRIRIG

51 DVFIDSVGQV AARLFQAFGV NPGAFGVQQP AFRAREQARR GSGFFAGNDL

101 RVPHKDAVEV DIDGGNTVSG HFLIRTHFDD GDAVCLFQAE ARFAVNVAQH

151 QYLVQINQVG IVDLIPVRVP QAAXIATGCT GICPKCPTGC RPV*
``` m260/a260 97.1% identity in 171 aa overlap

```
              10         20         30         40         50         60
m260.pep  MGAGMVFVVFRPFSSLFRALFEDRVGIVEGAHDAAECDFLPEEFTRIRIGDVFIDSVGQV
          ||||||||||||||||||||||||||||||||||||||||||||||||||||||||||||
a260      MGAGMVFVVFRPFSSLFRALFEDRVGIVEGAHDAAECDFLPEEFTRIRIGDVFIDSVGQV
              10         20         30         40         50         60

70         80         90        100        110        120
m260.pep  AARLFQAFGVNPGAFGVQQPAFRARXXARXGSGFFAGNDLRMPHKDAVEVDIDGGNTVSG
          |||||||||||||||||||||||||||  || |||||||||||:||||||||||||||||
a260      AARLFQAFGVNPGAFGVQQPAFRAREQARRGSGFFAGNDLRVPHKDAVEVDIDGGNTVSG
              70         80         90        100        110        120

130        140        150        160        170
m260.pep  HFLIRTHFDDGDAVCLFQAEARFAVNVAQHQYLVRINQVGIVDLIPVRVPQ
          |||||||||||||||||||||||||||||||||||:|||||||||||||||
a260      HFLIRTHFDDGDAVCLFQAEARFAVNVAQHQYLVQINQVGIVDLIPVRVPQAAXIATGCT
             130        140        150        160        170        180 a260      GICPKCPTGCRPVX
              190
```

The following partial DNA sequence was identified in *N. gonorrhoeae* <SEQ ID 1047>:

```
g261.seq
   1 atggagcttg gcatatcgt attccttgtg ctttgcgcgc gttcagacgg
  51 ccttttttact ttccagacat tccgccagcc cgcgttcgcg caagatacag
 101 ctcgggcatt cgcggcagcc gccgacgata cccttgtagc aggtgtgggt
 151 ctgttcgcgg atgtagtcca acacgcccat ttcgtccgcc aacgcccacg
 201 tttgcgcctt ggtcaggtac atcagcggcg tgtggatttg aaaatcgtag
 251 tccatcgcca gattaagggt aacgttcatg gatttgacga acacgccgcg
 301 gcagtcggga tagcccgaaa aatcggtttc gcacacgccc gcgatgatgt
 351 gccggatacc ctgcccttg gcaaaaatgg cggcgtaaag caggaaaagc
 401 gcgttacgcc cgtccacaaa ggtattggga acgccgttgt cggcggtttc
 451 gatggcggcg gtttcgatgg cggcggtttc gtccatcagg gcgttgtgcg
 501 taatctgccg catcaggctc aaatcgagta cggtttgact gacacccaaa
 551 tcctgcgcga tccactctgc gcgttccagc tcgacggcat ggcgttgccc
 601 gtatcggaag gtgatggctt ggacgttttc gcgcccgtag gtttggattg
 651 cctgaatcag gcaggtggtc gaatcctgac cgcccgagaa gatgaccaag
 701 gcttttggt ttga
```

This corresponds to the amino acid sequence <SEQ ID 1048; ORF 261.ng>:

```
g261.pep
   1 MELGHIVFLV LCARSDGLFT FQTFRQPAFA QDTARAFAAA ADDTLVAGVG

51 LFADVVQHAH FVRQRPRLRL GQVHQRRVDL KIVVHRQIKG NVHGFDEHAA

101 AVGIARKIGF AHARDDVPDT LPFGKNGGVK QEKRVTPVHK GIGNAVVGGF

151 DGGGFDGGGF VHQGVVRNLP HQAQIEYGLT DTQILRDPLC AFQLDGMALP

201 VSEGDGLDVF APVGLDCLNQ AGGRILTARE DDQGFLV*
```

The following partial DNA sequence was identified in *N. meningitidis* <SEQ ID 1049>:

```
m261.seq
   1 ATGGAGCTTG GGCATATCGT ATTCCTTATG GTTTGCGCGT GTTCAGACGG

51 CCTTTTTACT TTCCAGATAT TCCGCCAGCC cGcGTTCGCG CAAGATACAG

101 CTCGGGCATT CGCGgCAGCC GCCGACGATG CCGTTATAGC AGGTGTGGGT

151 TTGCTCGCGG ATATAGTCCA GCACGCCCAT TTCGTCCGCC AACGCCCACG

201 TTTGCGCCTT GGTCAGATAC ATCAGCGGCG TGTGGATTTG AAAATCATAG

251 TCCATCGCCA AATTAAGGGT AACGTTCATC GATTTGACAA ACACGTCGCG

301 GCAGTCGGGA TAGCCGGAGA AGTCGGTTTC GCACACGCCC GCGATGATGT

351 GCCGTATCCC CTGCCCTTTG GCGTAAATCG CGGCATAGAG CAGGAAAAGC 401 gCGTTGCGGC CGTCTACAAA GGTATTCGGA ACGCCGTTTT CGGCAGTTTC

451 GATGGCGGCG GTGTCGTCCA TCAGGGCATT GTGCGTAATC TGCCGCATCA

501 GgCTcAAGTC GAGTACGGTT TGTTTGACGC CCAAATCCTG CGCAATCCAG

551 CGGGCACGTT CCAGCTCGAC GGCATGGCGT TGCCCGTATT GGAAAGTAAT

601 GGCTTGGACG TTTTCGCGCC CGTAGGTTTG GATTGCCTGA ATCAGGCAGG

651 TGGTCGAATC CTGACCGCCC GAAAAGATGA CCAAGGCTTG TTGGTTTGA
```

This corresponds to the amino acid sequence <SEQ ID 1050; ORF 261>:

```
m261.pep
   1 MELGHIVFLM VCACSDGLFT FQIFRQPAFA QDTARAFAAA ADDAVIAGVG

51 LLADIVQHAH FVRQRPRLRL GQIHQRRVDL KIIVHRQIKG NVHRFDKHVA

101 AVGIAGEVGF AHARDDVPYP LPFGVNRGIE QEKRVAAVYK GIRNAVFGSF

151 DGGGVVHQGI VRNLPHQAQV EYGLFDAQIL RNPAGTFQLD GMALPVLESN

201 GLDVFAPVGL DCLNQAGGRI LTARKDDQGL LV*
```

Computer analysis of this amino acid sequence gave the following results:

Homology with a Predicted ORF from *N. gonorrhoeae*

ORF 261 shows 79.7% identity over a 237 aa overlap with a predicted ORF (ORF 261.ng) from *N. gonorrhoeae*:

```
m261/g261

10        20        30        40        50        60
m261.pep    MELGHIVFLMVCACSDGLFTFQIFRQPAFAQDTARAFAAAADDAVIAGVGLLADIVQHAH
            |||||||||::|| |||||||| ||||||||||||||||||||:::|||||:||:|||||
g261        MELGHIVFLVLCARSDGLFTFQTFRQPAFAQDTARAFAAAADDTLVAGVGLFADVVQHAH
                    10        20        30        40        50        60

70        80        90       100       110       120
m261.pep    FVRQRPRLRLGQIHQRRVDLKIIVHRQIKGNVHRFDKHVAAVGIAGEVGFAHARDDVPYP
            ||||||||||||:|||||||||:|||||||||| ||:|:|||||| ::||||||||||  
g261        FVRQRPRLRLGQVHQRRVDLKIVVHRQIKGNVHGFDEHAAAVGIARKIGFAHARDDVPDT
                    70        80        90       100       110       120

130       140       150            160       170
m261.pep    LPFGVNRGIEQEKRVAAVYKGIRVAVFGSFDGGGV-----VHQGIVRNLPHQAQVEYGLF
            |||| | |::|||||: |:||| ||| |:|||||      ||||:|||||||||:|||| 
g261        LPFGKNGGVKQEKRVTPVHKGIGNAVVGGFDGGGFDGGGFVHQGVVRNLPHQAQIEYGLT
                   130       140       150       160       170       180

180       190       200       210       220       230
m261.pep    DAQILRNPAGTFQLDGMALPVLESNGLDVFAPVGLDCLNQAGGRILTARKDDQGLLVX
            |:||||:|  :||||||||||:|::||||||||||||||||||||||||:||||:|||
g261        DTQILRDPLCAFQLDGMALPVSEGDGLDVFAPVGLDCLNQAGGRILTAREDDQGFLVX
                   190       200       210       220       230
```

The following partial DNA sequence was identified in *N. meningitidis* <SEQ ID 1051>:

```
a261.seq
   1 ATGGAGCTTG GGCATATCGT ATTCCTTATG GTTTGCGCGT GTTCAGACGG

51 CCTTTTTACT TTCCAGATAT TCCGCCAGCC CGCGTTCGCG CAAGATACAG

101 CTCGGGCATT CGCGGCAGCC GCCGACGATG CCGTTATAGC AGGTGTGGGT

151 TTGCTCGCGG ATATAGTCCA GCGCGCCCAT TTCGTCCGCC AACGCCCAAG

201 TTTGCGCCTT GGTCAGATAC ATCAGCGGCG TGTGGATTTG AAAATCATAG

251 TCCATCGCCA GATTAAGGGT AACGTTCATG GATTTGACAA ACACGTCACG

301 GCAGTCGGGA TAGCCGGAGA AGTCGGTTTC GCACACGCCC GCGATGATGT

351 GCCGTATCCC CTGCCCTTTG GCGTAAATCG CGGCATAGAG CAGGAAAAGC

401 GCGTTGCGGC CGTCTACAAA GGTATTCGGA ACGCCGTTTT CGGCAGTTTC

451 GATGGCGGCG GTGTCGTCCA TCAGGGCATT GTGCGTAATC TGCCGCATCA

501 GGCTCAAGTC GAGTACGGTT TGTTTGACGC CCAAATCCTG CGCAATCCAG

551 CGGGCACGTT CCAGCTCGAC GGCATGGCGT TGCCCGTATT GGAAAGTAAT

601 GGCTTGGACG TTTTCGCGCC CGTAGGTTTG GATTGCCTGA ATCAGGCAGG

651 TGGTCGAATC CTGACCGCCC GAAAAGATGA CCAAGGCTTT TTGGTTTGA
```

This corresponds to the amino acid sequence <SEQ ID 1052; ORF 261.a>:

```
a261.pep
   1 MELGHIVFLM VCACSDGLFT FQIFRQPAFA QDTARAFAAA ADDAVIAGVG

51 LLADIVQRAH FVRQRPSLRL GQIHQRRVDL KIIVHRQIKG NVHGFDKHVT

101 AVGIAGEVGF AHARDDVPYP LPFGVNRGIE QEKRVAAVYK GIRNAVFGSF

151 DGGGVVHQGI VRNLPHQAQV EYGLFDAQIL RNPAGTFQLD GMALPVLESN

201 GLDVFAPVGL DCLNQAGGRI LTARKDDQGF LV*
``` m261/a261 97.8% identity in 232 aa overlap

```
                    10        20        30        40        50        60
m261.pep    MELGHIVFLMVCACSDGLFTFQIFRQPAFAQDTARAFAAAADDAVIAGVGLLADIVQHAH
            ||||||||||||||||||||||||||||||||||||||||||||||||||||||||||:||
a261        MELGHIVFLMVCACSDGLFTFQIFRQPAFAQDTARAFAAAADDAVIAGVGLLADIVQRAH
                    10        20        30        40        50        60

70        80        90       100       110       120
m261.pep    FVRQRPRLRLGQIHQRRVDLKIIVHRQIKGNVHRFDKHVAAVGIAGEVGFAHARDDVPYP
            |||||| ||||||||||||||||||||||||||| |||||:|||||||||||||||||||
a261        FVRQRPSLRLGQIHQRRVDLKIIVHRQIKGNVHGFDKHVTAVGIAGEVGFAHARDDVPYP
                    70        80        90       100       110       120

130       140       150       160       170       180
m261.pep    LPFGVNRGIEQEKRVAAVYKGIRNAVFGSFDGGGVVHQGIVRNLPHQAQVEYGLFDAQIL
            ||||||||||||||||||||||||||||||||||||||||||||||||||||||||||||
a261        LPFGVNRGIEQEKRVAAVYKGIRNAVFGSFDGGGVVHQGIVRNLPHQAQVEYGLFDAQIL
                   130       140       150       160       170       180

190       200       210       220       230
m261.pep    RNPAGTFQLDGMALPVLESNGLDVFAPVGLDCLNQAGGRILTARKDDQGLLVX
            |||||||||||||||||||||||||||||||||||||||||||||||||:|||
a261        RNPAGTFQLDGMALPVLESNGLDVFAPVGLDCLNQAGGRILTARKDDQGFLVX
                   190       200       210       220       230
```

The following partial DNA sequence was identified in *N. gonorrhoeae* <SEQ ID 1053>:

```
g263.seq
   1 atggcacgtt taaccgtaca caccctcgaa accgccccg aagccgccaa 51 accgcgcgta gaggccgtac ccaaaaacaa cggctttatc cccaacctca 101 tcggcgtatt ggcaaacgcc cccgaagctt tggcgtttta ccaagaagtc 151 ggcaagctca acgccgccaa cagcctgacc gccggcgaag tcgaagtgat 201 ccggatcatc gccgtccgca ccaaccaatg cagcttctgc gtggcagggc 251 acaccaaact cgcaaccctg aaaaaactcc tgtccgagca atccctcaat 301 gccgcccgcg ctttggcggc aggtaaatct gacgatgcca aactcggcgc 351 gcttgccgcc ttcacccaag ccgtaatggc gaaaaaggc gcagtatccg 401 acgacgaact caacgccttc ctcgaagcgg gctacaaccg gcagcaggca 451 gtcgaagtcg taatgggcgt agccttggca actttgtgca actacgccaa 501 caacctcgcc caaaccgaaa tcaaccccaa attgcaggca tacgcctaa
                                                        25
```

This corresponds to the amino acid sequence <SEQ ID 1054; ORF 263.ng>:

```
g263.pep
   1 MARLTVHTLE TAPEAAKPRV EAVPKNNGFI PNLIGVLANA PEALAFYQEV

51 GKLNAANSLT AGEVEVIRII AVRTNQCSFC VAGHTKLATL KKLLSEQSLN

101 AARALAAGKS DDAKLGALAA FTQAVMAKKG AVSDDELNAF LEAGYNRQQA

151 VEVVMGVALA TLCNYANNLA QTEINPKLQA YA*
```

The following partial DNA sequence was identified in *N. meningitidis* <SEQ ID 1055>:

```
m263.seq (partial)
   1 ..GCAGCAGGCG AATTTGACGA TGCCAAACTC GGCGCGCTCG CCGCCTTCAC

51    CCAAGCCGTA ATGGCGAAAA AAGGCGCGGT ATCCGACGAG GAACTCAAAG

101    CATTTTTCGA TGCGGGCTAC AACCAGCAGC AGGCAGTCGA AGTCGTGATG

151    GGCGT.AsyC TgGCAACCCT GTGCAACTAC GTCAACAACC TCGGACAAAC

201    CGAAATCAAC CCCGAATTGC AGGCTTACGC CTGA
                                            50
```

This corresponds to the amino acid sequence <SEQ ID 1056; ORF 263>:

```
m263.pep (partial)
   1 ..GCAGCAGGCG AATTTGACGA TGCCAAACTC GGCGCGCTCG CCGCCTTCAC

51    CCAAGCCGTA ATGGCGAAAA AAGGCGCGGT ATCCGACGAG GAACTCAAAG

101    CATTTTTCGA TGCGGGCTAC AACCAGCAGC AGGCAGTCGA AGTCGTGATG

151    GGCGT.AsyC TgGCAACCCT GTGCAACTAC GTCAACAACC TCGGACAAAC

201    CGAAATCAAC CCCGAATTGC AGGCTTACGC CTGA
```

Computer analysis of this amino acid sequence gave the following results:
Homology with a Predicted ORF from *N. gonorrhoeae*
ORF 263 shows 85.7% identity over a 77 aa overlap with a predicted ORF (ORF 263.ng) from *N. gonorrhoeae*:

```
m263/g263

10        20        30
m263.pep                AAGEFDDAKLGALAAFTQAVMAKKGAVSDE
                        |||: |||||||||||||||||||||||||:
g263     QCSFCVAGNTKLATLKKLLSEQSLNAARALAAGKSDDAKLGALAAFTQAVMAKKGAVSDD
              80        90       100       110       120       130

40        50        60        70
m263.pep  ELKAFFDAGYNQQQAVEVVMGVXLATLCNYVNNLGQTEINPELQAYAX
          ||:||::||||  |||||||||  ||||||:|||:||||||  ||||||
g263      ELNAFLEAGYNRQQAVEVVMGVALATLCNYANNLAQTEINPKLQAYAX
             140       150       160       170       180
```

The following partial DNA sequence was identified in *N. meningitidis* <SEQ ID 1057>:

```
a263.seq
   1 ATGGCACGTT TAACCGTACA CACCCTCGAA ACCGCCCCCG AAGCCGCCAA

51 AGCGCGCGTC GAGGCGGTAC TTCAAAACAA CGGCTTTATC CCCAACCTTA

101 TCGGCGTATT ATCAAACGCC CCCGAAGCCT TGGCGTTTTA CCAAGAAGTC

151 GGCAAGCTCA ACGCCGCCAA CAGCCTGACC GCCGGCGAAG TCGAAGTAAT

201 CCAGATTATT GCCGCCCGCA CCAACCAATG CGGCTTCTGC GTGGCAGGGC

251 ACACCAAACT CGCAACCCTG AAAAAACTCC TTTCCGAACA ATCCGTCAAA

301 GCCGCGCGCG CTTTGGCGGC AGGCGAATTT GACGATGCTA AACTCGGCGC

351 GCTCGCCGCC TTTACCCAAG CCGTAATGGC AAAAAAAGGC GCGGTATCCG

401 ACGAGGAACT CAAAGCATTT TTTGATGCGG GCTACAACCA GCAGCAGGCA

451 GTCGAAGTCG TGATGGGCGT AGCCTTGGCA ACTTTGTGCA ACTACGTCAA

501 CAACCTCGGA CAAACCGAAA TCAACCCCGA ATTGCAGGCT TACGCCTGA
```

This corresponds to the amino acid sequence <SEQ ID 1058; ORF 263.a>:

```
a263.pep
   1 MARLTVHTLE TAPEAAKARV EAVLQNNGFI PNLIGVLSNA PEALAFYQEV

51 GKLNAANSLT AGEVEVIQII AARTNQCGFC VAGHTKLATL KKLLSEQSVK

101 AARALAAGEF DDAKLGALAA FTQAVMAKKG AVSDEELKAF FDAGYNQQQA

151 VEVVMGVALA TLCNYVNNLG QTEINPELQA YA*
``` m263/a263 97.4% identity in 77 aa overlap

```
                              10        20        30
m263.pep                AAGEFDDAKLGALAAFTQAVMAKKGAVSDE
                        ||||||||||||||||||||||||||||||
a263     QCGFCVAGHTKLATLKKLLSEQSVKAARALAAGEFDDAKLGALAAFTQAVMAKKGAVSDE
              80        90       100       110       120       130

40        50        60        70
m263.pep  ELKAFFDAGYNQQQAVEVVMGXXLATLCNYVNNLGQTEINPELQAYAX
          ||||||||||||||||||||||| ||||||||||||||||||||||||
a263      ELKAFFDAGYNQQQAVEVVMGVALATLCNYVNNLGQTEINPELQAYAX
             140       150       160       170       180
```

The following partial DNA sequence was identified in *N. gonorrhoeae* <SEQ ID 1059>:

```
g264.seq
   1 ttgactttaa cccgaaaaac cctttcctc ctcaccgccg cgttcggcac 51 acactccctt cagacggcat ccgccgacgc agtggtcaag ccggaaaaac 101 tgcacgcctc cgccaaccgc agctacaaag tcgccgaatt cacgcaaacc 151 ggcaacgcct cgtggtacgg cggcaggttt cacgggcgca aaacttccgg 201 cggagaccgc tacgatatga acgcctttac cgccgcccac aaaaccctgc 251 ccatccccag ccatgtgcgc gtaaccaaca ccaaaaacgg caaaagcgtc 301 atcgtccgcg tcaacgaccg cggcccctcc cacggcaacc gcatcatcga 351 cgtatccaaa gccgccgcgc aaaaattggg ctttgtcagc caagggacgg 401 cacacgtcaa aatcgaacaa atcgtcccgg gccaatccgc accggttgcc 451 gaaaacaaag acatctttat cgacttgaaa tctttcggta cggaacacga 501 agcacaagcc tatctgaacc aagccgccca aaatttcgcc gcttcgtcat 551 caagcccgaa cctctcggtt gaaaaacgcc gttacgaata cgttgtcaaa 601 atgggcccgt ttgcctcgca ggaacgcgcc gccgaagccg aagcgcaggc 651 acgcggtatg gttcgggcgg tactgacctc cggttga
```

This corresponds to the amino acid sequence <SEQ ID 1060; ORF 264.ng>:

```
g264.pep
   1 LTLTRKTLFL LTAAFGTHSL QTASADAVVK PEKLHASANR SYKVAEFTQT

51 GNASWYGGRF HGRKTSGGDR YDMNAFTAAH KTLPIPSHVR VTNTKNGKSV

101 IVRVNDRGPF HGNRIIDVSK AAAQKLGFVS QGTAHVKIEQ IVPGQSAPVA

151 ENKDIFIDLK SFGTEHEAQA YLNQAAQNFA ASSSSPNLSV EKRRYEYVVK

201 MGPFASQERA AEAEAQARGM VRAVLTSG*
```
                                                40

The following partial DNA sequence was identified in *N. meningitidis* <SEQ ID 1061>:

```
m264.seq
   1 TTGACTTTAA CCCGAAAAAC CCTTTTCCTT CTCACCGCCG CATTCGGCAC

51 ACACTCCCTT CAGACGGCAT CCGCCGACGC AGTGGTCAAG GCAGAAAAAC

101 TGCACGCCTC CGCCAACCGC AGCTACAAAG TCGCCGGAAA ACGCTACACG

151 CCGAAAAACC AAGTCGCCGA ATTCACGCAA ACCGGCAACG CCTCGTGGTA

201 CGGCGGCAGG TTTCACGGGC GCAAAACTTC CGGCGGAGAA CGATACGATA

251 TGAACGCCTT TACCGCCGCC CACAAAACCC TGCCCATCCC CAGCTATGTG

301 CGCGTAACCA ATACCAAAAA CGGCAAAAGC GTCATCGTCC GCGTCAACGA

351 CCGCGGCCCC TTCCACGGCA ACCGCATCAT CGACGTATCC AAAGCCGCCG

401 CGCAAAAATT GGGCTTTGTC AACCAAGGGA CGGCACACGT CAAAATCGAA

451 CAAATCGTCC CGGGCCAATC CGCACCGGTT GCCGAAAACA AAGACATCTT

501 TATCGACTTG AAATCTTTCG GTACGGAACA CGAAGCACAA GCCTATCTGA

551 ACCAAGCCGC CCAAAACTTC GCCGTTTCGT CATCGGGTAC GAACCTCTCG

601 GTTGAAAAAC GCCGTTACGA ATACGTCGTC AAAATGGGAC CGTTTACCTC
```

```
-continued
651 GCAGGAACGC GCCGCCGAAG CCGAAGCTCA GGCGCGCGGT ATGGTTCGGG

701 CGGTATTGAC CGCCGGCTGA
```

This corresponds to the amino acid sequence <SEQ ID 1062; ORF 264>:

```
m264.pep
  1 LTLTRKTLFL LTAAFGTHSL QTASADAVVK AEKLHASANR SYKVAGKRYT

51 PKNQVAEFTQ TGNASWYGGR FHGRKTSGGE RYDMNAFTAA HKTLPIPSYV

101 RVTNTKNGKS VIVRVNDRGP FHGNRIIDVS KAAAQKLGFV NQGTAHVKIE

151 QIVPGQSAPV AENKDIFIDL KSFGTEHEAQ AYLNQAAQNF AVSSSGTNLS

201 VEKRRYEYVV KMGPFTSQER AAEAEAQARG MVRAVLTAG*
```

Computer analysis of this amino acid sequence gave the following results:
Homology with a Predicted ORF from *N. gonorrhoeae*
ORF 264 shows 91.6% identity over a 239 aa overlap with a predicted ORF (ORF 264.ng) from *N. gonorrhoeae*:

```
m264/g264

10         20         30         40         50         60
    m264.pep    LTLTRKTLFLLTAAFGTHSLQTASADAVVKAEKLHASANRSYKVAGKRYTPKNQVAEFTQ
                ||||||||||||||||||||||||||||||||||||||||||||           ||||
    g264        LTLTRKTLFLLTAAFGTHSLQTASADAVVKPEKLHASANRSYKVA-----------EFTQ
                    10         20         30         40
                    70         80         90        100        110        120
    m264.pep    TGNASWYGGRFHGRKTSGGERYDMNAFTAAHKTLPIPSYVRVTNTKNGKSVIVRVNDRGP
                ||||||||||||||||||||:||||||||||||||||:||||||||||||||||||||||
    g264        TGNASWYGGRFHGRKTSGGDRYDMNAFTAAHKTLPIPSHVRVTNTKNGKSVIVRVNDRGP
                        50         60         70         80         90        100
                   130        140        150        160        170        180
    m264.pep    FHGNRIIDVSKAAAQKLGFVNQGTAHVKIEQIVPGQSAPVAENKDIFIDLKSFGTEHEAQ
                ||||||||||||||||||||:|||||||||||||||||||||||||||||||||||:|||
    g264        FHGNRIIDVSKAAAQKLGFVSQGTAHVKIEQIVPGQSAPVAENKDIFIDLKSFGTEGEAQ
                       110        120        130        140        150        160
                   190        200        210        220        230        240
    m264.pep    AYLNQAAQNFAVSSSGTNLSVEKRRYEYVVKMGPFTSQERAAEAEAQARGMVRAVLTAGX
                |||||||||||:|||:||||:||||||||||||||||:||||||||||||||||||||:||
    g264        AYLNQAAQNFAASSSSPNLSVEKRRYEYVVKMGPFASQERAAEAEAQARGMVRAVLTSGX
                       170        180        190        200        210        220
```

The following partial DNA sequence was identified in *N. meningitidis* <SEQ ID 1063>:

```
a264.seq
  1 TTGACTTTAA CCCGAAAAAC CCTTTTCCTC CTCACCGCCG CATTCGGCAT

51 ACATTCCTTT CAGACGGCAT CCGCCGACGC AGTGGTCAGG GCAGAAAAAC

101 TGCACGCCTC CGCCAACCGC AGCTACAAAG TCGCCGGAAA ACGCTACACG

151 CCGAAAAACC AAGTCGCCGA ATTCACGCAA ACCGGCAACG CCTCGTGGTA

201 CGGCGGCAGG TTTCACGGGC GCAAAACTTC CGGCGGAGAA CGATACGATA

251 TGAACGCCTT TACCGCCGCC CACAAAACCC TGCCCATCCC CAGCTATGTG

301 CGCGTAACCA ATACCAAAAA CGGCAAAAGC GTCATCGTCC GCGTCAACGA

351 CCGCGGCCCC TTCCACGGCA ACCGCATCAT CGACGTATCC AAAGCCGCCG

401 CGCAAAAATT GGGCTTTGTC AACCAAGGGA CGGCGCACGT CAAAATCGAA

451 CAAATCGTCC CGGGCCAATC CGCACCGGTT GCCGAAAACA AAGACATCTT
```

-continued
```
501 CATCGACTTG AAATCTTTCG GTACGGAACA CGAAGCACAA GCCTATCTGA

551 ACCAAGCCGC CCAAAACCTG GCTTCATCGG CATCAAACCC GAACCTCTCG

601 GTTGAAAAAC GCCGTTACGA ATACGTCGTC AAAATGGGAC CGTTTGCCTC

651 GCAGGAACGC GCCGCCGAGG CCGAAGCTCA GGCGCGCGGT ATGGTTCGGG

701 CGGTATTAAC CGCCGGTTGA
```

This corresponds to the amino acid sequence <SEQ ID 1064; ORF 264.a>:

```
a264.pep
  1 LTLTRKTLFL LTAAFGIHSF QTASADAVVR AEKLHASANR SYKVAGKRYT

51 PKNQVAEFTQ TGNASWYGGR FHGRKTSGGE RYDMNAFTAA HKTLPIPSYV

101 RVTNTKNGKS VIVRVNDRGP FHGNRIIDVS KAAAQKLGFV NQGTAHVKIE

151 QIVPGQSAPV AENKDIFIDL KSFGTEHEAQ AYLNQAAQNL ASSASNPNLS

201 VEKRRYEYVV KMGPFASQER AAEAEAQARG MVRAVLTAG*
``` m264/a264 96.2% identity in 239 aa overlap

```
                 10        20        30        40        50        60
     m264.pep    LTLTRKTLFLLTAAFGTHSLQTASADAVVKAEKLHASANRSYKVAGKRYTPKNQVAEFTQ
                 ||||||||||||||| ||:||||||||:||||||||||||||||||||||||||||||
         a264    LTLTRKTLFLLTAAFGTHSFQTASADAVVRAEKLHASANRSYKVAGKRYTPKNQVAEFTQ
                 10        20        30        40        50        60

70        80        90       100       110       120
     m264.pep    TGNASWYGGRFHGRKTSGGERYDMNAFTAAHKTLPIPSYVRVTNTKNGKSVIVRVNDRGP
                 ||||||||||||||||||||||||||||||||||||||||||||||||||||||||||||
         a264    TGNASWYGGRFHGRKTSGGERYDMNAFTAAHKTLPIPSYVRVTNTKNGKSVIVRVNDRGP
                 70        80        90       100       110       120

130       140       150       160       170       180
     m264.pep    FHGNRIIDVSKAAAQKLGFVNQGTAHVKIEQIVPGQSAPVAENKDIFIDLKSFGTEHEAQ
                 |||||||||||||||||||||||||||||||||||||||||||||||||||||||:|||
         a264    FHGNRIIDVSKAAAQKLGFVNQGTAHVKIEQIVPGQSAPVAENKDIFIDLKSFGTEGEAQ
                130       140       150       160       170       180

190       200       210       220       230       240
     m264.pep    AYLNQAAQNFAVSSSGTNLSVEKRRYEYVVKMGPFTSQERAAEAEAQARGMVRAVLTAGX
                 |||||||||:|  |:|: ||||||||||||||||:|||||||||||||||||||||||
         a264    AYLNQAAQNLASSASNPNLSVEKRRYEYVVKMGPFASQERAAEAEAQARGMVRAVLTAGX
                190       200       210       220       230       240
```

The following partial DNA sequence was identified in *N. meningitidis* <SEQ ID 1065>:

```
m265.seq
  1 ATGTCGGTGA TTTTGCCGCC GACACGCGCC AACGCTGCTT TTTCGGCTTG

51 GGCGCGGCTG ATGATTTTGT CTTGTTTGTT GTGTTGGTGT GCGGCGTGTC

101 CGTGGTCGTC ATCGCCGTGT CCGTCGTGGT GGGCGAGCGC GGGGGCGGAA

151 ATGCTCAGCA GTGCGGTTGC GGCGGAGGTC AAGAGAAGGT GTTTGATGTT

201 CATAT.TTTT GCCTTTGTAA ATCGTGGGTT GGAAAATGTG GATATTAATA

251 AGGTATCAAA TAACCGTCAG CCGGCGGTCA ATACCGCCCG AACCATACCG

301 CGCGCCTGAG CTTCGGCTTC GGCGGCGCGT TCCTGCGAGG TAAACGGTCC

351 CATTTTGACG ACGTATTCGT AA
```

This corresponds to the amino acid sequence <SEQ ID 1066; ORF 265>:

```
m265.pep
  1 MSVILPPTRA NAAFSAWARL MILSCLLCWC AACPWSSSPC PSWWASAGAE

51 MLSSAVAAEV KRRCLMFIXF AFVNRGLENV DINKVSNNRQ PAVNTARTIP

101 RAXASASAAR SCEVNGPILT TYS*
```

Computer analysis of this amino acid sequence gave the following results:
Homology with a Predicted ORF from *N. gonorrhoeae*
ORF 265 shows 88.6% identity over a 123 aa overlap with a predicted ORF (ORF 265.ng) from *N. gonorrhoeae*:

```
m265/g265
                      10         20         30         40         50         60
     m265.pep    MSVILPPTRANAAFSAWARLMILSCLLCWCAACPWSSSPCPSWWASAGAEMLSSAVAAEV
                 ||||||||||:|||||||||||||||| ||||||||||||||||||||||:||||| |
     g265        MSVILPPTRAQAAFSAWARLMILSCLPCWCAACPWSSSPCPSWWASAGAEMPNSAVAAAV
                      10         20         30         40         50         60

70         80         90        100        110        120
     m265.pep    KRRCLMFIXFAFVNRGLENVDINKVSNNRQPAVNTARTIPRAXASASAARSCEVNGPILT
                 ||||||||| ||:||:||:| ||||||||||||| |:|||||||| ||||||||:|||||
     g265        KRRCLMFI-FALVNQGLKNGDINKVSNNRQPEVSTARTIPRACASASAARSCEANGPILT
                      70         80         90        100        110 m265.pep    TYSX
                 ||||
     g265        TYSX
                 120
```

The following partial DNA sequence was identified in *N. meningitidis* <SEQ ID 1067>:

```
a265.seq
  1 ATGTCGGTGA TTTTGCCGCC GACACGCGCC AACGCTGCTT TTTCGGCTTG

51 GGCGCGGCTG ATGATTTTGT CTTGTTTGCT GTGTTGGTGT GCGGCGTGTC

101 CGTGGTCGTC ATCGCCGTGT CCGTCGTGGT GGGCGAGTGC GGGGCGGAA

151 ATGCCCATCA GTGCGGTTGC GGCGGCGGTC AAGAGAAGGC GTTTGAAGTT

201 CATTTTTGCT CCTGCGAAGT ATCTGGT... ......GGTGT TTGAAGGACG

251 TAAAGGCGGG ACATCAACCG GCGGTTAATA CCGCCCGAAC CATACCGCGC

301 GCCTGAGCTT CGGCCTCGGC GGCGCGTTCC TGCGAGGCAA ACGGTCCCAT

351 TTTGACGACG TATTCGTAA
```

This corresponds to the amino acid sequence <SEQ ID 1068; ORF 265.a>:

```
a265.pep
  1 MSVILPPTRA NAAFSAWARL MILSCLLCWC AACPWSSSPC PSWWASAGAE

51 MPISAVAAAV KRRRLKFIFA PAKYLX..XC LKDVKAGHQP AVNTARTIPR

101 A*ASASAARS CEANGPILTT YS*
``` m265/a265 79.7% identity in 123 aa overlap

```
              10         20         30         40         50         60
m265.pep  MSVILPPTRANAAFSAWARLMILSCLLCWCAACPWSSSPCPSWWASAGAEMLSSAVAAEV
          ||||||||||||||||||||||||||||||||||||||||||||||||||  ||||| |
a265      MSVILPPTRANAAFSAWARLMILSCLLCWCAACPWSSSPCPSWWASAGAEMPISAVAAAV
              10         20         30         40         50         60

70         80         90        100        110        120
m265.pep  KRRCLMFIXFAFVNRGLENVDINKVSNNRQPAVNTARTIPRAXASASAARSCEVNGPILT
          |||  |  ||    |:         ::  |: ::||||||||||||||||||||:|||||
a265      KRRRLKFI---FAPAKYLXXCLKDVKAGHQPAVNTARTIPRAXASASAARSCEANGPILT
              70         80         90        100        110 m265.pep  TYSX
          ||||
a265      TYSX
          120
```

The following partial DNA sequence was identified in *N. gonorrhoeae* <SEQ ID 1069>:

```
g266.seq
   1 agttcagacg gcatcgccgc cgacaatgcc caaacagaaa gcccatcatg 51 accgcatcca tgtacatcct tttggtcttg gcactcatct ttgccaacgc 101 ccccttcctc acgaccagac tgttcggcgt ggccgcgctc aagcgcaaac 151 atttcggaca ccacctgatc gagctggcgg caggtttcgc gctgaccgcc 201 tctcttgcct acatcctcga atcccgtgcg ggagcggtac acaatcaggg 251 ttgggagttt tacgccaccg tcgtctgcct gtacctcatt ttcgccttcc 301 cgtgtttcgt gcggcggtat ttttggcaca cgcgcaacag ggaataa
```

This corresponds to the amino acid sequence <SEQ ID 1070; ORF 266.ng>:

```
g266.pep
   1 MQFRRHRRRQ CPNRKPIMTA SMYILLVLAL IFANAPFLTT RLFGVAALKR

51 KHFGHHLIEL AAGFALTASL AYILESRAGA VHNQGWEFYA TVVCLYLIFA

101 FPCFVRRYFW HTRNRE*
```

The following partial DNA sequence was identified in *N. meningitidis* <SEQ ID 1071>:

```
m266.seq
   1 ATGCCGTTCC GCAACGCGtT cAGACGGCAT CGCCGCCGAC AACGCCTAAA

51 CAGAAAGCCC ACCATGACCG CATCCATGTA CATCCTTTTG GTCTTGGCAC

101 TCATCTTTGC CAACGCCCCC TTCCTCACGA CCAGACTGTT CGGCGTGGCC 151 rCACTCAAGC GCAAACATTT CGGACACCAC ATGATCGAGC TGGCGGCAGG

201 TTTCGCGCTG ACCGCCGTTC TTGCCTACAT CCTsGAATCC CGTGCAGGAT

251 CGGTACACGA TCAGGGTTGG GAGTTTTATG CCACAGTCGT CTGCCTGTAC

301 CTGATTTTTG CGTTTCCATG TTTTGTGTGG CGGTATTTTT GGCACACGCG

351 CAACAGGGAA TAG
```

This corresponds to the amino acid sequence <SEQ ID 1072; ORF 266>:

```
m266.pep
   1 MPFRNAFRRH RRRQRLNRKP TMTASMYILL VLALIFANAP FLTTRLFGVA

51 XLKRKHFGHH MIELAAGFAL TAVLAYILES RAGSVHDQGW EFYATVVCLY

101 LIFAFPCFVW RYFWHTRNRE *
```

Computer analysis of this amino acid sequence gave the following results:
Homology with a Predicted ORF from *N. gonorrhoeae*
ORF 266 shows 92.1% identity over a 114 aa overlap with a predicted ORF (ORF 266.ng) from *N. gonorrhoeae*:

```
    m266/g266

10         20         30         40         50         60
     m266.pep    MPFRNAFRRHRRRQRLNRKPTMTASMYILLVLALIFANAPFLTTRLFGVAXLKRKHFGHH
                 ||||||||| ||||  |||||||||||||||||||||||||||||||| |||||||||
     g266              MQFRRHRRRQCPNRKPIMTASMYILLVLALIFANAPFLTTRLFGVAALKRKHFGHH
                              10         20         30         40         50

70         80         90        100        110        120
     m266.pep    MIELAAGFALTAVLAYILESRAGSVHDQGWEFYATVVCLYLIFAFPCFVWRYFWHTRNREX
                 :|||||||||| ||||||||||||:||:|||||||||||||||||||||| |||||||||||
     g266        LIELAAGFALTASLAYILESRAGAVHNQGWEFYATVVCLYLIFAFPCFVRRYFWHTRNREX
                        60         70         80         90        100        110
```

The following partial DNA sequence was identified in *N. meningitidis* <SEQ ID 1073>:

```
a266.seq
   1 ATGCCGTTCC GCAATGCGTT CAGACGGCAT CGCCGCCGAC AATGCCCAAA

51 CAGAAAGCCC GCCATGACCG CATCCATGTA CATCCTTTTG CTGCTTGCCT

101 TGATTTTTGC CAACGCCCCC TTCCTCACGA CCAAGCTGTT CGGCATCGTA

151 CCGCTCAAGC GCAAACATTT CGGACACCAC CTGATCGAGC TGGCGGCAGG

201 TTTCGCGCTG ACCGCCGTTC TTGCCTACAT CCTCGAATCC CGTGCGGGAG

251 CGGTACACGA TCAGGGTTGG GAGTTTTACG CCACCGTCGT CTGCCTGTAC

301 CTGATTTTTG CGTTTCCCTG TTTCGTGTGG CGGTATTTTT GGCACACGCG

351 CAACAGGGAA TAG
```

This corresponds to the amino acid sequence <SEQ ID 1074; ORF 266.a>:

```
a266.pep
   1 MPFRNAFRRH RRRQCPNRKP AMTASMYILL LLALIFANAP FLTTKLFGIV

51 PLKRKHFGHH LIELAAGFAL TAVLAYILES RAGAVHDQGW EFYATVVCLY

101 LIFAFPCFVW RYFWHTRNRE *
``` m266/a266 91.7% identity in 120 aa overlap

```
                    10         20         30         40         50         60
  m266.pep    MPFRNAFRRHRRRQRLNRKPTMTASMYILLVLALIFANAPFLTTRLFGVAXLKRKHFGHH
              ||||||||||||| ||||:|||||||||:||||||||||:|||::  |||||||||
  a266        MPFRNAFRRHRRRQCPNRKPAMTASMYILLLLALIFANAPFLTTKLFGIVPLKRKHFGHH
                    10         20         30         40         50         60
```

-continued

```
                      70         80         90        100        110        120
m266.pep    MIELAAGFALTAVLAYILESRAGSVHDQGWEFYATVVCLYLIFAFPCFVWRYFWHTRNRE
            :|||||||||||||||||||||||:||||||||||||||||||||||||||||||||||
a266        LIELAAGFALTAVLAYILESRAGAVHDQGWEFYATVVCLYLIFAFPCFVWRYFWHTRNRE
                      70         80         90        100        110        120 m266.pep    X
            |
a266        X
```

The following partial DNA sequence was identified in *N. gonorrhoeae* <SEQ ID 1075>:

```
g267.seq
    1 atgcaagtcg cctttttct cgccgtggta ttcaaaaata tgggtttcca 51 caatcgcatc ggtcgggcag gcctcttcgc agaaaccgca gaagatgcac 101 ttggtcaggt cgatgtcgta acgcttggtg cggcgggtgc cgtcttcgcg 151 ttcttccgat tcgatgttga tcgccattgc cggacacacc gcctcgcaca 201 atttacacgc gatgcagcgt tcctctccgt tcggaaaacg gcgttgcgcg 251 tgcagaccgc ggaaacgcac ggattgcggc gttttctctt cgggaaaata 301 aattgtgtct ttgcgggcaa aaaagttttt gagcgttacg cccatgcctt 351 tgaccagttc gccaagcaga aaggtttta ctaa
```

This corresponds to the amino acid sequence <SEQ ID 1076; ORF 267.ng>:

```
g267.pep
    1 MQVAFFLAVV FKNMGFHNRI GRAGLFAETA EDALGQVDVV TLGAAGAVFA

51 FFRFDVDRHC RTHRLAQFTR DAAFLSVRKT ALRVQTAETH GLRRFLFGKI

101 NCVFAGKKVF ERYAHAFDQF AKQKGFY*
```

The following partial DNA sequence was identified in *N. meningitidis* <SEQ ID 1077>:

```
m267.seq
    1 GTGCAAGTCG CCTTTTTTCT CGCCGTGGTA TTCAAAAATA TGGGTTTCCA

51 CAATCGCATC AGTCGGGCAT GCCTCTTCGC AGAAACCGCA GAAGATGCAC

101 TTGGTCAGGT CGATGTCGTA ACGCTTGGTG CGGCGCGTAC CGTCTTCACG

151 TTCTTCCGAT TCGATGTTAA TCGCCATTGC CGGACACACT GCCTCACACA

201 ACTTACACGC GATACACCGC TCTTCGCCGT TCGGATACCG CcGCTGCGCG

251 TGCAGACCGC GGAAACGCAC GGATTGCGGC GTTTTCTCTT CGGGGAAATA

301 AATTGTGTCT TTGCGGGCGA AAAGTTTTT GAGCGTTACG CCCATACCTT

351 TTACCAATTC GCCAAGCAGA AAGGTTTTTA CTAA
```

This corresponds to the amino acid sequence <SEQ ID 1078; ORF 267>:

```
m267.pep
    1 VQVAFFLAVV FKNMGFHNRI SRACLFAETA EDALGQVDVV TLGAARTVFT

51 FFRFDVNRHC RTHCLTQLTR DTPLFAVRIP PLRVQTAETH GLRRFLFGEI

101 NCVFAGEKVF ERYAHTFYQF AKQKGFY*
```

Computer analysis of this amino acid sequence gave the following results:
Homology with a Predicted ORF from *N. gonorrhoeae*
ORF 267 shows 82.7% identity over a 127 aa overlap with a predicted ORF (ORF 267.ng) from *N. gonorrhoeae*:

```
m267/g267
                    10         20         30         40         50         60
   m267.pep  VQVAFFLAVVFKNMGFHNRISRACLFAETAEDALGQVDVVTLGAARTVFTFFRFDVNRHC
             :||||||||||||||||||:|| :||||||||||||||||| :||:||||||:|||
   g267      MQVAFFLAVVFKNMGFHNRIGRAGLFAETAEDALGQVDVVTLGAAGAVFAFFRFDVDRHC
                    10         20         30         40         50         60

70         80         90        100        110        120
   m267.pep  RTHCLTQLTRDTPLFAVRIPPLRVQTAETHGLRRFLFGEINCVFAGEKVFERYAHTFYQF
             ||| |:|:||| :::|| ||||||||||||||:|||||||:||||||||:| ||
   g267      RTHRLAQFTRDAAFLSVRKTALRVQTAETHGLRRFLFGKINCVFAGKKVFERYAHAFDQF
                    70         80         90        100        110        120 m267.pep  AKQKGFYX
             ||||||||
   g267      AKQKGFYX
```

The following partial DNA sequence was identified in *N. meningitidis* <SEQ ID 1079>:

```
a267.seq
   1 GTGCAAGTCG CCTTTTTTCT CGCCGTGGTA TTCAAAAATA TGGGTTTCCA

51 CAATCGCATC GGTCGGGCAG GCTTCTTCGC AGAAACCGCA GAAGATGCAC

101 TTGGTCAGGT CGATGTCGTA ACGCTTGGTG CGGCGCGTGC CGTCTTCGCG

151 TTCTTCCGAT TCGATGTTGA TCGCCATTGC GGGGCAAACG GCTTCACACA

201 ATTTACACGC GATGCAGCGT TCCTCGCCGT TTGGATAACG GCGTTGCGCG

251 TGCAGACCGC GGAAACGCAC GGATTGCGGC GTTTTCTCTT CGGGAAAATA

301 AATCGTGTCT TTGCGGGCAA AAAGTTTTT GAGCGTTACG CCCATACCTT

351 TTACCAATTC GCCAAGCAGA AAGGTTTTTA CTAA
```

This corresponds to the amino acid sequence <SEQ ID 1080; ORF 267.a>:

```
a267.pep
   1 VQVAFFLAVV FKNMGFHNRI GRAGFFAETA EDALGQVDVV TLGAARAVFA

51 FFRFDVDRHC GANGFTQFTR DAAFLAVWIT ALRVQTAETH GLRRFLFGKI

101 NRVFAGKKVF ERYAHTFYQF AKQKGFY*
``` m267/a267 82.7% identity in 177 an overlap

```
                    10         20         30         40         50         60
   m267.pep  VQVAFFLAVVFKNMGFHNRISRACLFAETAEDALGQVDVVTLGAARTVFTFFRFDVNRHC
             ||||||||||||||||||||:| :||||||||||||||||||:||:||||||:|||
   a267      VQVAFFLAVVFKNMGFHNRIGRAGFFAETAEDALGQVDVVTLGAARAVFAFFRFDVDRHC
                    10         20         30         40         50         60

70         80         90        100        110        120
   m267.pep  RTHCLTQLTRDTPLFAVRIPPLRVQTAETHGLRRFLFGEINCVFAGEKVFERYAHTFYQF
             :: :||:|||: :::|| |  ||||||||||||||||||:|||| |||||||||||||
   a267      GANGFTQFTRDAAFLAVWITALRVQTAETHGLRRFLFGKINRVFAGKKVFERYAHTFYQF
                    70         80         90        100        110        120 m267.pep  AKQKGFYX
             ||||||||
   a267      AKQKGFYX
```

The following partial DNA sequence was identified in *N. gonorrhoeae* <SEQ ID 1081>:

```
G268.seq
    1 atgaaaaaaa atttacccgc actggcattg gcaagtatgc tgattttgtc 51 gggctgcgac cgtttgggaa taggcaaccc gttttccgga aaggaaattt 101 cctgcggaag cgaagagact aaagagattt tggtcaaact ggtccgcgac 151 aatgtcgaag gtgaaaccgt caaaactttt gacgacgacg cattcaaaga 201 ccaagcattt gccgatatcg gcatatcgca tatccgcaga atggtcgaac 251 gtttgggcat aaccgtcgat gaagtccgaa ctaccgagaa aaccgacacg 301 tccagcaaac tcaaatgtga agccgcgtta aaactggacg tgcccgacga 351 tgttgtcgat tatgccgtcg ccgccaacca atctataggc aacagccata 401 agaaaacgcc cgactttttt gaaccctact accgcaaaga aggcgcgtat 451 tatgtcaaaa ctatttctta cagcgtccag ccgacagacg acaaaagcaa 501 aatctttgcc gaactcagtc aggcacacga tatcatccat ccgctcagcg 551 agctggtgtc tatggcactg attaaagagc cgttggacaa agcgaaacaa 601 aggaacgaaa aacttgaagc ggcagaagcc accgcgcagg aagcgaggga 651 ggcagaagaa gcggcggcgc aggaggcatt gggtcgggag caggaagccg 701 cccgcgtatc cgaatgggaa gaacgctaca gctgtcgcg cagcgagttc 751 gagcagtttt ggaaaggatt gcctcaaact gtacagaata agctgcaagc 801 ctcgcagaaa acatggaaaa gcggtatgga caagatctgt gccaacaatg 851 cgaaagccga aggtgaaacg ccaaacggca taaaagtcag tgagttggcg 901 tgtaaaacgg cagaaaccga agcacgcttg gaagagctgc acaaccgtaa 951 aaaagccctt atcgacgaaa tggtcaggga agaggacaag aaagaactgc 1001 caaagcggct ctga
```

This corresponds to the amino acid sequence <SEQ ID 1082; ORF 268.ng>:

```
m268.pep
    1 MKKNLPALAL ASMLILSGCD RLGIGNPFSG KEISCGSEET KEILVKLVRD

51 NVEGETVKTF DDDAFKDQAF ADIGISHIRR MVERLGITVD EVRTTEKTDT

101 SSKLKCEAAL KLDVPDDVVD YAVAANQSIG NSHKKTPDFF EPYYRKEGAY

151 YVKTISYSVQ PTDDKSKIFA ELSQAHDIIH PLSELVSMAL IKEPLDKAKQ

201 RNEKLEAAEA TAQEAREAEE AAAQEALGRE QEAARVSEWE ERYKLSRSEF

251 EQFWKGLPQT VQNKLQASQK TWKSGMDKIC ANNAKAEGET PNGIKVSELA

301 CKTAETEARL EELHNRKKAL IDEMVREEDK KELPKRL*
```

The following partial DNA sequence was identified in *N. meningitidis* <SEQ ID 1083>:

```
m268.seq (partial)
    1 ..ATGGCACTGA TTAAAGAGCC GTTGGACAAA GTGAAACAAA GGAACGAAGA

51   ACTTGAAGCG GCAGAAGAAG CGGCGGCGCA GGAGGCATTG GGTCGGGAGC

101   AGGAAGCCGC CCGCGTATCC GAATGGGAAG AACGCTACAA GCTGTCGCGC

151   AG.CAGTTCG AGCAGTTCTG GAAAGGATTG CCTCAAACCG TACAGAATAA
```

```
-continued
201   GCTGCAACCn TCACAGAAAA CATGGAAAAG CGGGATGGAT AAAATCTGTG

251   CCAACAATGC GAAAGCTGAA GGTAAAACGC CAAACGGCAT AAAATTCAGC

301   GAACTGGCAT GCAAAACGGC GAAAACCGAA GCACGCTTGG AAGAGCTGCA

351   CAACCGTAAA AAGCCCTTA TCGACGAAAT GGyCAGGGAA GCGGACAmGA

401   AAGAACTGTC AAAGCGGCTs TGA
```

This corresponds to the amino acid sequence <SEQ ID 1084; ORF 268>.

```
m268.pep (partial)
  1  ..MALIKEPLDK VKQRNEELEA AEEAAAQEAL GREQEAARVS EWEERYKLSR

51  XQFEQFWKGL PQTVQNKLQP SQKTWKSGMD KICANNAKAE GKTPNGIKFS

101  ELACKTAKTE ARLEELHNRK KALIDEMXRE ADXKELSKRL *
```

Computer analysis of this amino acid sequence gave the following results:
Homology with a Predicted ORF from *N. gonorrhoeae*
ORF 268 shows 86.0% identity over a 150 aa overlap with a predicted ORF (ORF 268.ng) from *N. gonorrhoeae*:

```
   m268/g268

10         20
      m268.pep                      MALIKEPLDKVKQRNEELEAAE--------
                                    ||||||||||:|||:||||||||||||
      g268       SVQPTDDKSKIFAELSQAHDIIHPLSELVSMALIKEPLDKAKQRNEKLEAAEATAQEARE
                 160       170       180       190       200       210

30        40        50        60        70        80
      m268.pep   --EAAAQEALGREQEAARVSEWEERYKLSRSQFEQFWKGLPQTVQNKLQPSQKTWKSGMD
                   ||||||||||||||||||||||||||||||:||||||||||||||||||:|||||||||
      g268       AEEAAAQEALGREQEAARVSEWEERYKLSRSEFEQFWKGLPQTVQNKLQASQKTWKSGMD
                 220       230       240       250       260       270

90        100       110       120       130       140
      m268.pep   KICANNAKAEGKTPNGIKFSELACKTAKTEARLEELHNRKKALIDEMXREADXKELSKRLX
                 ||||||||||:|||||||  ||||||||:|||||||||||||||||||||  ||  ||||
      g268       KICANNAKAEGETPNGIKVSELACKTAETEARLEELHNRKKALIDEMVREEDKKELPKRLX
                 280       290       300       310       320       330
```

The following partial DNA sequence was identified in *N. meningitidis* <SEQ ID 1085>:

```
a268.seq
  1 ATGGCACTGA TTAAAGAGCC GTTGGACAAA GCGAAACAAA GGAACGAAGA

51 ACTTGAAGCG GCAGAAGAAG CGGCGGCGCA GGAGGCATTG GGTCGGGAGC

101 AGGAAGTCGA CCGCGTATCC GAATGGGAAG AACGCTACAA GCTGTCGCGC

151 AGCGAGTTCG AGCAGTTCTG GAAAGGATTG CCTCAAACCG TACAGAATAA

201 GCTGCAAGCC TCACAGAAAA CATGGAAAAG CGGGATGGAT AAAATCTGTG

251 CCAACAATGC GAAAGCTGAA GGTGAAACGC CAAACGGCAT AAAATTCAGC

301 GAACTGGCAT GCAAAACGGC GGAAACCGAA GCACGCTTGG AAGAGCTGCA

351 CAACCGTAAA AAGCCCTTC TCGACGAAAT GGCCAGGGAA GCGGACAAGA

401 AAGAACTGCC AAAGCGGCTC TGA
```

This corresponds to the amino acid sequence <SEQ ID 1086; ORF 268.a>:

```
a268.pep
  1 MALIKEPLDK AKQRNEELEA AEEAAAQEAL GREQEVDRVS EWEERYKLSR

51 SEFEQFWKGL PQTVQNKLQA SQKTWKSGMD KICANNAKAE GETPNGIKFS

101 ELACKTAETE ARLEELHNRK KALLDEMARE ADKKELPKRL *
``` m268/a268 91.4% identity in 140 aa overlap

```
                   10        20        30        40        50        60
    m268.pep  MALIKEPLDKVKQRNEELEAAEEAAAQEALGREQEAARVSEWEERYKLSRXQFEQFWKGL
              |||||||||| :|||||||||||||||||||||||||: |||||||||||| :|||||||
        a268  MALIKEPLDKAKQRNEELEAAEEAAAQEALGREQEVDRVSEWEERYKLSRSEFEQFWKGL
                   10        20        30        40        50        60

70        80        90       100       110       120
    m268.pep  PQTVQNKLQPSQKTWKSGMDKICANNAKAEGKTPNGIKFSELACKTAKTEARLEELHNRK
              ||||||||| ||||||||||||||||||||||:|||||||||||:|||||||||||||||
        a268  PQTVQNKLQASQKTWKSGMDKICANNAKAEGETPNGIKFSELACKTAETEARLEELHNRK
                   70        80        90       100       110       120

130       140
    m268.pep  KALIDEMXREADXKELSKRLX
              |||:||| |||| ||| ||||
        a268  KALLDEMAREADKKELPKRLX
                  130       140
```

The following partial DNA sequence was identified in *N. meningitidis* <SEQ ID 1087>:

```
m268-1.seq
  1 GTGCAATCCC GATATGATGG TTTGCATAAA TTTAAACATA TATGTTCCGC

51 AGCTATGGCA CTGATTAAAG AGCCGTTGGA CAAAGTGAAA CAAAGGAACG

101 AAGAACTTGA AGCGGCAGAA GAAGCGGCGG CGCAGGAGGC ATTGGGTCGG

151 GAGCAGGAAG CCGCCCGCGT ATCCGAATGG GAAGAACGCT ACAAGCTGTC

201 GCGCAGCGAG TTCGAGCAGT TCTGGAAAGG ATTGCCTCAA ACCGTACAGA

251 ATAAGCTGCA AGCCTCACAG AAAACATGGA AAAGCGGGAT GGATAAAATC

301 TGTGCCAACA ATGCGAAAGC TGAAGGTAAA ACGCCAAACG GCATAAAATT

351 CAGCGAACTG GCATGCAAAA CGGCGAAAAC CGAAGCACGC TTGGAAGAGC

401 TGCACAACCG TAAAAAAGCC CTTATCGACG AAATGGCCAG GGAAGCGGAC

451 AAGAAAGAAC TGTCAAAGCG GCTCTGA
```

This corresponds to the amino acid sequence <SEQ ID 1088; ORF 268-1>:

```
m268-1.pep

1   VQSRYDGLHK FKHICSAAMA LIKEPLDKVK QRNEELEAAE EAAAQEALGR

51   EQEAARVSEW EERYKLSRSE FEQFWKGLPQ TVQNKLQASQ KTWKSGMDKI

101   CANNAKAEGK TPNGIKFSEL ACKTAKTEAR LEELHNRKKA LIDEMAREAD

151   KKELSKRL*
``` m268-1/g268 82.3% identity in 164 aa overlap

```
                                       10        20        30
    m268-1.pep                    VQSRYDGLHKFKHICSAAMALIKEPLDKVKQRNE
                                  :| :| :::: | ||||||||||:|||||
         g268  KEGAYYVKTISYSVQPTDDKSKIFAELSQAHDIIHPLSELVS--MALIKEPLDKAKQRNE
                         150       160       170       180       190       200
```

-continued

```
              40                    50         60         70         80
m268-1.pep    ELEAAE----------EAAAQEALGREQEAARVSEWEERYKLSRSEFEQFWKGLPQTVQN
              :|||||          ||||||||||||||||||||||||||||||||||||||||||||
g268          KLEAAEATAQEAREAEEAAAQEALGREQEAARVSEWEERYKLSRSEFEQFWKGLPQTVQN
                210       220       230       240       250       260

90        100       110       120       130       140
m268-1.pep    KLQASQKTWKSGMDKICANNAKAEGKTPNGIKFSELACKTAKTEARLEELHNRKKALIDE
              ||||||||||||||||||||||||:|||||| ||||||||:|||||||||||||||||||
g268          KLQASQKTWKSGMDKICANNAKAEGETPNGIKVSELACKTAETEARLEELHNRKKALIDE
                270       280       290       300       310       320

150       159
m268-1.pep    MAREADKKELSKRLX
              |:|| ||||| ||||
g268          MVREEDKKELPKRLX
                330
```

The following partial DNA sequence was identified in *N. meningitidis* <SEQ ID 1089>:

```
a268-1.seq
   1 GTGCAATCCC GATATGATGG TTTGCATAAA TTTAAACATA TATGTTCCGC

51 AGCTATGGCA CTGATTAAAG AGCCGTTGGA CAAAGCGAAA CAAAGGAACG

101 AAGAACTTGA AGCGGCAGAA GAAGCGGCGG CGCAGGAGGC ATTGGGTCGG

151 GAGCAGGAAG TCGACCGCGT ATCCGAATGG GAAGAACGCT ACAAGCTGTC

201 GCGCAGCGAG TTCGAGCAGT TCTGGAAAGG ATTGCCTCAA ACCGTACAGA

251 ATAAGCTGCA AGCCTCACAG AAAACATGGA AAAGCGGGAT GGATAAAATC

301 TGTGCCAACA ATGCGAAAGC TGAAGGTGAA ACGCCAAACG GCATAAAATT

351 CAGCGAACTG GCATGCAAAA CGGCGGAAAC CGAAGCACGC TTGGAAGAGC

401 TGCACAACCG TAAAAAAGCC CTTCTCGACG AAATGGCCAG GGAAGCGGAC

451 AAGAAAGAAC TGCCAAAGCG GCTCTGA
```

This corresponds to the amino acid sequence <SEQ ID 1090; ORF 268-1.a>:

```
a268-1.pep

1  VQSRYDGLHK FKHICSAAMA LIKEPLDKAK QRNEELEAAE EAAAQEALGR

51  EQEVDRVSEW EERYKLSRSE FEQFWKGLPQ TVQNKLQASQ KTWKSGMDKI

101  CANNAKAEGE TPNGIKFSEL ACKTAETEAR LEELHNRKKA LLDEMAREAD

151  KKELPKRL* a268-1/m268-1   95.6% identity in 158 aa overlap 10        20        30        40        50        60
a268-1.pep    VQSRYDGLHKFKHICSAAMALIKEPLDKAKQRNEELEAAEEAAAQEALGREQEVDRVSEW
              ||||||||||||||||||||||||||||:|||||||||||||||||||||||: |||||
m268-1        VQSRYDGLHKFKHICSAAMALIKEPLDKVKQRNEELEAAEEAAAQEALGREQEAARVSEW
                      10        20        30        40        50        60

70        80        90       100       110       120
a268-1.pep    EERYKLSRSEFEQFWKGLPQTVQNKLQASQKTWKSGMDKICANNAKAEGETPNGIKFSEL
              ||||||||||||||||||||||||||||||||||||||||||||||||:||||||||||
m268-1        EERYKLSRSEFEQFWKGLPQTVQNKLQASQKTWKSGMDKICANNAKAEGKTPNGIKFSEL
                      70        80        90       100       110       120

130       140       150      159
a268-1.pep    ACKTAETEARLEELHNRKKALLDEMAREADKKELPKRLX
              |||||:|||||||||||||||:||||||||||||| ||||
m268-1        ACKTAKTEARLEELHNRKKALIDEMAREADKKELSKRLX
                     130       140       150
```

The following partial DNA sequence was identified in *N. gonorrhoeae* <SEQ ID 1091>:

```
g269.seq
   1 atggtttggc gtgtgaattg cgcggcaacg gcggcgctga ttttttcgtc 51 cagcccttgg atttgggcgg tggtgtgggt gtggtcgcgg tcggctttt 101 cctgcaaacc ttgcgccagc cttgacgcgt ccagtgcgcc ggcgttggcg 151 gtttcgccgt gggactttat ccggaacacg gcttcgccca aggtgtcggc 201 ggctttgatg cacagtttta aaaccagggc tttggggcgg ttttctgcgc 251 cgcccgttgc cattttgctg tccaatcgcg gggttaaaaa accgttgtcg 301 tttaagtcgc cgtccgtcca agtcgatacg agcgcgcttc tttgcctttc 351 attgcggtct tcgtaa
```

This corresponds to the amino acid sequence <SEQ ID 1092; ORF 269.ng>:

```
g269.pep
   1 MVWRVNCAAT AALIFSSSPW IWAVVWVWSR SAFSCKPCAS LDASSAPALA

51 VSPWDFIRNT ASPKVSAALM HSFKTRALGR FSAPPVAILL SNRGVKKPLS

101 FKSPSVQVDT SALLCLSLRS S*
```

The following partial DNA sequence was identified in *N. meningitidis* <SEQ ID 1093>:

```
m269.seq
   1 ATGGTTTGGC GTGTGAATTG CGCGGCAACG GCGGTGCTGA TTTTTTCGTC

51 CAGCCCTTGG ATTTGGGCGG CGGTGTGGGT GTGGTCTCGG TCGGCTTTGT

101 CTTGCAAACC TTGCGCCaCG TGCCCGCGTC CAGCGCCTGC GTTGATGGTT

151 TCGCCGTGGG ACTTTATCCA AAACACGGCT TCGCCCAAGG TGTCGGCGGC

201 TTTGATGCAC AGTTTTAAAA CCAGGGCTTT GGGGCGGTTT TCGTCGCCGC

251 CTGTCGCCAT TTTGCTGTCC GAGCGCGGGG TTAAAAAGCC GTTGTCGTTT

301 AAATTTTCGT CCGTCCAAGT CGATACGAGC GCGCTTCTCT GCCTTTCGTT

351 GCGGTCTTCG TAA
```

This corresponds to the amino acid sequence <SEQ ID 1094; ORF 269>:

```
m269.pep
   1 MVWRVNCAAT AVLIFSSSPW IWAAVWVWSR SALSCKPCAT CPRPAPALMV

51 SPWDFIQNTA SPKVSAALMH SFKTRALGRF SSPPVAILLS ERGVKKPLSF

101 KFSSVQVDTS ALLCLSLRSS *
```

Computer analysis of this amino acid sequence gave the following results:
Homology with a Predicted ORF from *N. gonorrhoeae*
ORF 269 shows 87.6% identity over a 121 aa overlap with a predicted ORF (ORF 269.ng) from *N. gonorrhoeae*:

```
m269.pep MVWRVNCAATAVLIFSSSPWIWAAVWVWSRSALSCKPCATCP-RPAPALMVSPWDFIQNT  59
         ||||||||||:||||||||||:||||||||:||||||:     ||||||||||||:||
g269     MVWRVNCAATAALIFSSSPWIWAVVWVWSRSAFSCKPCASLDASSAPALAVSPWDFIRNT  60
```

```
m269.pep  ASPKVSAALMHSFKTRALGRFSSPPVAILLSERGVKKPLSFKFSSVQVDTSALLCLSLRS  119
          ||||||||||||||||||||||||:||||||||:||||||||||  ||||||||||||||
g269      ASPKVSAALMHSFKTRALGRFSAPPVAILLSNRGVKKPLSFKSPSVQVDTSALLCLSLRS  120 m269.pep  SX  121
          ||
g269      SX  122
```

The following partial DNA sequence was identified in *N. meningitidis* <SEQ ID 1095>:

```
a269.seq
  1 ATGGTTTGGC GTGTGAATTG CGCGGCAACG GCGGTGCTGA TTTTTTCGTC

51 CAGCCCTTGG ATTTGGGCGG CGGTGTGGGT GTGGGCGCGG TCTGCTTTGT

101 CTTGGAGGTT TTGCGCCAGC GTGCCCGCGT CCAGCGCGCC GGCGTTGACG

151 GTTTCGCCGT GGGACTTTAT CCAGAACACG GCTTCGCCCA AGGTGTCGGC

201 GGCTTTGATG CACAGTTTTA AAACCAGGGC TTTGGGGCGG TTTTCGTCGC

251 CGCCTGTCGC CATTTTGCTG TCCGGGCGCG GGGTTAAAAA GCCGTTGTCG

301 TTTAAATTTT CGTCCGTCCA AGTCGATACG AGCGCGCTTC TCTGCCTTTC

351 GTTGTGGTCT TCGTAA
```

This corresponds to the amino acid sequence <SEQ ID 1096; ORF 269.a>:

```
a269.pep
  1 MVWRVNCAAT AVLIFSSSPW IWAAVWVWAR SALSWRFCAS VPASSAPALT

51 VSPWDFIQNT ASPKVSAALM HSFKTRALGR FSSPPVAILL SGRGVKKPLS

101 FKFSSVQVDT SALLCLSLWS S*
``` m269/a269 90.1% identity in 121 aa overlap

```
                 10         20         30         40         50        59
m269.pep  MVWRVNCAATAVLIFSSSPWIWAAVWVWSRSALSCKPCATCP-RPAPALMVSPWDFIQNT
          |||||||||||||||||||||||||||:||||  :   ||:  |    ||||||||||||
a269      MVWRVNCAATAVLIFSSSPWIWAAVWVWARSALSWRFCASVPASSAPALTVSPWDFIQNT
                 10         20         30         40         50        60

60         70         80         90        100       110       119
m269.pep  ASPKVSAALMHSFKTRALGRFSSPPVAILLSERGVKKPLSFKFSSVQVDTSALLCLSLRS
          ||||||||||||||||||||||:|||||||| ||||||||||  ||||||||||||||| |
a269      ASPKVSAALMHSFKTRALGRFSAPPVAILLSGRGVKKPLSFKSPSVQVDTSALLCLSLWS
                 70         80         90        100       110       120

120
m269.pep  SX
          ||
a269      SX
```

The following partial DNA sequence was identified in *N. gonorrhoeae* <SEQ ID 1097>:

```
g270.seq
  1 atgaataaaa accgcaaatt actgcttgcc gcactgctgc tgactgcctt 51 tgccgccttc aagctcgttt tgttgcaatg gtggcaggcg cagcagccgc 101 aagccgtggc ggcgcaatgc gatttgaccg agggttgcac gctgccggac 151 ggaagccgtg tccgcgccgc cgccgtttca accaaaaaac cgtttgatat 201 ttatatcgaa cacgcgcccg ccggcacgga acaggtcagc atcagcttca
```

-continued

```
251 gtatgaaaaa tatggatatg ggtttcaacc gctatatgtt cgagcggcaa 301 ccgtcgggga cttggcaggc agcacgcatc cgcctgcccg tctgtgtcga 351 aggcaggcgc gattttacgg cggacattac aatcggcagc cggacatttc 401 agacggcatt taccgccgaa taa
```

This corresponds to the amino acid sequence <SEQ ID 1098; ORF 270.ng>:

```
g270.pep
  1 MNKNRKLLLA ALLLTAFAAF KLVLLQWWQA QQPQAVAAQC DLTEGCTLPD

51 GSRVRAAAVS TKKPFDIYIE HAPAGTEQVS ISFSMKNMDM GFNRYMFERQ

101 PSGTWQAARI RLPVCVEGRR DFTADITIGS RTFQTAFTAE*
```

The following partial DNA sequence was identified in *N. meningitidis* <SEQ ID 1099>:

```
m270.seq
  1 ATGAATAAAA ACCGTAAATT ACTGCTTGCC GCACTGCTGC TGATTGCCTT

51 TGCCGCCGTC AAGCTCGTTT TGTTGCAATG GTGGCAGGCG Ca.CAGCCGC

101 AAGCTGTGGC GGCGCAATGC GATTTGACCG AGGGTTGCAC GCTGCCGGAC

151 GGAAGCCGCG TCCGCGCCGC CGCcGTTTCA ACCAAAAAAC CGTTTGATAT

201 TTATATCGAA CACGCGCCCG CCGGCACGGA ACAGGTCAGC ATCAGCTTCA

251 GTATGAAAAA TATGGATATG GGTTTCaACC GCTATATGTT CGAGCGGCAA 301 cCGTCGGGGA CTTGGCAGGC AGTACGCATC CGCCTGCCCA TCTGTGTCGA

351 AGGCAGGCGC GATTTTACGG CGGACATTAC AATCGGCAGT CGGACATTTC

401 AGACGGCATT TACCGCCGAA TAA
```

This corresponds to the amino acid sequence <SEQ ID 1100; ORF 270>:

```
m270.pep
  1 MNKNRKLLLA ALLLIAFAAV KLVLLQWWQA XQPQAVAAQC DLTEGCTLPD

51 GSRVRAAAVS TKKPFDIYIE HAPAGTEQVS ISFSMKNMDM GFNRYMFERQ

101 PSGTWQAVRI RLPICVEGRR DFTADITIGS RTFQTAFTAE *
```

Computer analysis of this amino acid sequence gave the following results:
Homology with a Predicted ORF from *N. gonorrhoeae*
ORF 270 shows 96.4% identity over a 140 aa overlap with a predicted ORF (ORF 270.ng) from *N. gonorrhoeae*:

```
m270/g270

10         20         30         40         50         60
    m270.pep   MNKNRKLLLAALLLIAFAAVKLVLLQWWQAXQPQAVAAQCDLTEGCTLPDGSRVRAAAVS
               ||||||||||||  |||| |||||||||| |||||||||||||||||||||||||||||
        g270   MNKNRKLLLAALLLTAFAAFKLVLLQWWQAQQPQAVAAQCDLTEGCTLPDGSRVRAAAVS
                    10         20         30         40         50         60

70         80         90        100        110        120
    m270.pep   TKKPFDIYIEHAPAGTEQVSISFSMKNMDMGFNRYMFERQPSGTWQAVRIRLPICVEGRR
               |||||||||||||||||||||||||||||||||||||||||||||||:||||:||||||
        g270   TKKPFDIYIEHAPAGTEQVSISFSMKNMDMGFNRYMFERQPSGTWQAARIRLPVCVEGRR
                    70         80         90        100        110        120
```

```
                        130       140
       m270.pep  DFTADITIGSRTFQTAFTAEX
                 |||||||||||||||||||||
       g270      DFTADITIGSRTFQTAFTAEX
                        130       140
```

The following partial DNA sequence was identified in *N. meningitidis* <SEQ ID 1101>:

```
a270.seq
   1 ATGAATAAAA ACCGTAAATT ACTGCTTGCC GCACTGCTGC TGATTGCCTT

51 TGCCGCCGTC AAGCTCGTTT TGTTGCAATG GTGGCAGGCG CAGCAGCCGC

101 AAGCTGTGGC GGCGCAATGC GATTTGACCG AGGGTTGCAC GCTGCCGGAC

151 GGAAGCCGCG TCCGCGCCGC CGCCGTTTCA ACCAAAAAAC CGTTTGATAT

201 TTATATCGAA CACGCGCCCG CCGGCACGGA ACAGGTCAGC ATCAGCTTCA

251 GTATGAAAAA TATGGATATG GGTTTCAACC GCTATATGTT CGAGCGGCAA

301 CCGTCGGGGA CTTGGCAGGC AGTACGCATC CGCCTGCCCA TCTGTGTCGA

351 AGGCAGGCGC GATTTTACGG CGGACATTAC AATCGGCAGC CGGACATTTC

401 AGACGGCATT TACCGCCGAA TAA
```

This corresponds to the amino acid sequence <SEQ ID 1102; ORF 270.a>:

```
a270.pep
   1 MNKNRKLLLA ALLLIAFAAV KLVLLQWWQA QQPQAVAAQC DLTEGCTLPD

51 GSRVRAAAVS TKKPFDIYIE HAPAGTEQVS ISFSMKNMDM GFNRYMFERQ

101 PSGTWQAVRI RLPICVEGRR DFTADITIGS RTFQTAFTAE *
``` m270/a270 99.3% identity in 140 aa overlap

```
                    10         20         30         40         50         60
    m270.pep  MNKNRKLLLAALLLIAFAAVKLVLLQWWQAXQPQAVAAQCDLTEGCTLPDGSRVRAAAVS
              ||||||||||||||||||||||||||||| ||||||||||||||||||||||||||||||
    a270      MKKNRKLLAALLLLIAFAAVKLVLLQWWQAQQPQAVAAQCDLTEGCTLPDGSRVRAAAVS
                    10         20         30         40         50         60
                    70         80         90        100        110        120
    m270.pep  TKKPFDIYIEHAPAGTEQVSISFSMKNMDMGFNRYMFERQPSGTWQAVRIRLPICVEGRR
              ||||||||||||||||||||||||||||||||||||||||||||||||||||||||||||
    a270      TKKPFDIYIEHAPAGTEQVSISFSMKNMDMGFNRYMFERQPSGTWQAVRIRLPICVEGRR
                    70         80         90        100        110        120
                   130        140
    m270.pep  DFTADITIGSRTFQTAFTAEX
              |||||||||||||||||||||
    a270      DFTADITIGSRTFQTAFTAEX
                   130        140
```

The following partial DNA sequence was identified in *N. gonorrhoeae* <SEQ ID 1103>:

```
g271.seq
   1 atgttcagtt cgcggatggc gaggatttgg gcgacggggg taacgttgtg 51 tatggtcagt ccgtgtccgg cgttgacgac caagcccaaa tcgccggcga 101 aatgcgcgcc gttttggatg cgctcgaact gcctgatttg ttcggcgtgg 151 ctttgtgcgt cggcatatgc gccggtgtgc agctcgacaa cgggcgcgcc
```

-continued

```
201 gacatcacgg gcggcttgga tttgcctgtc gtcggcatcg ataaacaagg 251 acacgcgtat gcccgcgtcg gtcaggattt tggcgaattc ggcgattttt 301 tcctgttgcg ccaatacgtc caaaccgcct tcggtcgtga tttcctgccg 351 tttttcaggc acgatgcaca cgtcttccgg catcacttta agcgcgtttt 401 cgagcatttc ttccgtcaac gccatttcaa ggttcaggcg cgtgcggatg 451 gcgttttga cggcaaatac atccgcgtct ttgatgtggc ggcggtcttc 501 gcgcaggtgc atggtaatca ggtctgcacc gtgcgtttcg gcaaccagtg 551 ccgcctccac ggggctggga taa
```

This corresponds to the amino acid sequence <SEQ ID 1104; ORF 271.ng>:

```
g271.pep
  1 MFSSRMARIW ATGVTLCMVS PCPALTTKPK SPAKCAPFWM RSNCLICSAW

51 LCASAYAPVC SSTTGAPTSR AAWICLSSAS INKDTRMPAS VRILANSAIF

101 SCCANTSKPP SVVISCRFSG TMHTSSGITL SAFSSISSVN AISRFRRVRM

151 AFLTANTSAS LMWRRSSRRC MVIRSAPCVS ATSAASTGLG*
```

The following partial DNA sequence was identified in *N. meningitidis* <SEQ ID 1105>:

```
m271.seq
  1 AwGTTCAGTT CGCGGATGGC GAGGATTTGG GCGATGGGGG TAACGTTGTG

51 TATGGTCAGT CCGTGTCCGG CGTTGACGAC CAAGCCCAAA TCGCCGGCGA

101 AATGCGCGCC GTTTTGGATG CGCTCGAACT GCCTGATTTG TTCGGCGTGG

151 CTGCGCGCGT CGGCATACGC GCCTGTGTGC AGCTCGACAA CGGGCGCGCC

201 GACATCACGG GCGGCTTGGA TTTGCCTGTC GTCGGCATCG ATAAACAAG

251 ACACGCGTAT GCCTGCGTCG GTCAGGATTT TGGTGAACCC GGCGATTTTT

301 TCCTGTTGCG CCAATACGTC CAAACCGCCT TCGGTCGTGA TTTCCTGACG

351 TTTTTCAGGC ACGATGCACA CGTCTTCCGG CATCACTTTC AAAGCGTTTT

401 CCAACATTTC TTCCGTCAAC GCCATTTCAA GGTTCAGGCG CGTGCGGATG

451 GCGTTTTTGA CGGCAAACAC GTCCGCGTCT TTGATGTGGC GGCGGTCTTC

501 GCGCAGGTGC ATGGTAATCA AATCCGCACC GTGCGTTTCG GCAACCAGTG

551 CCGCCTCCAC GGGGCTGGGA TAA
```

This corresponds to the amino acid sequence <SEQ ID 1106; ORF 271>:

```
m271.pep
  1 XFSSRMARIW AMGVTLCMVS PCPALTTKPK SPAKCAPFWM RSNCLICSAW

51 LRASAYAPVC SSTTGAPTSR AAWICLSSAS INKDTRMPAS VRILVNPAIF

101 SCCANTSKPP SVVISXRFSG TMHTSSGITF KAFSNISSVN AISRFRRVRM

151 AFLTANTSAS LMWRRSSRRC MVIKSAPCVS ATSAASTGLG *
```

Computer analysis of this amino acid sequence gave the following results:
Homology with a Predicted ORF from *N. gonorrhoeae*
ORF 271 shows 95.2% identity over a 189 aa overlap with a predicted ORF (ORF 271.ng) from *N. gonorrhoeae*:

```
    m271/g271
                    10        20        30        40        50        60
    m271.pep  XFSSRMARIWAMGVTLCMVSPCPALTTKPKSPAKCAPFWMRSNCLICSAWLRASAYAPVC
              ||||||||||| |||||||||||||||||||||||||||||||||||| |||||||||
    g271      MFSSRMARIWATGVTLCMVSPCPALTTKPKSPAKCAPFWMRSNCLICSAWLCASAYAPVC
                    10        20        30        40        50        60

70        80        90       100       110       120
    m271.pep  SSTTGAPTSRAAWICLSSASINKDTRMPASVRILVNPAIFSCCANTSKPPSVVISXRFSG
              |||||||||||||||||||||||||||||||||||| :| |||||||||||||||| |||
    g271      SSTTGAPTSRAAWICLSSASINKDTRMPASVRILANSAIFSCCANTSKPPSVVISCRFSG
                    70        80        90       100       110       120

130       140       150       160       170       180
    m271.pep  TMHTSSGITFKAFSNISSVNAISRFRRVRMAFLTANTSASLMWRRSSRRCMVIKSAPCVS
              ||||||||::|||:||||||||||||||||||||||||||||||||||||||:|||||
    g271      TMHTSSGITLSAFSSISSVNAISRFRRVRMAFLTANTSASLMWRRSSRRCMVIRSAPCVS
                   130       140       150       160       170       180

190
    m271.pep  ATSAASTGLGX
              |||||||||||
    g271      ATSAASTGLGX
                   190
```

The following partial DNA sequence was identified in *N. meningitidis* <SEQ ID 1107>:

```
a271.seq
  1 ATGTTCAGTT CGCGGATGGC GAGGATTTGG GCGATGGGGG TAACGTTGTG

51 TATGGTCAGT CCGTGTCCGG CGTTGACGAC CAAGCCCAAA TCGCTGGCAA

101 AATGCGCGCC GTTTTGGATG CGCTCGAACT GCCTGATTTG TTCGGCGTGG

151 CTGCGCGCGT CGGCATACGC GCCTGTGTGC AGCTCGACAA CGGGCGCGCC

201 GACATCACGG GCGGCTTGGA TTTGCCTGTC GTCGGCATCG ATAAACAAGG

251 ACACGCGTAT GCCCGCGTCG GTCAGGATTT TGGTGAATTC GGCAATTTTG

301 TCTTGTTGCG CCAATACGTC CAAGCCGCCT TCGGTCGTGA TTTCCTGACG

351 TTTTTCCGGC ACGATGCACA CGTCTTCCGG CATCACTTTA AGCGCGTTTT

401 CGAGCATTTC TTCCGTCAAC GCCATTTCAA GGTTCAGGCG CGTGCGGATG

451 GCGTTTTTGA CAGCAAACAC GTCCGCGTCT TTGATGTGGC GGCGGTCTTC

501 GCGCAGGTGC ATGGTAATCA GGTCGGCACC GTGCGTTTCG GCAACCAGTG

551 CCGCCTCCAC GGGGCTGGGA TAA
```

This corresponds to the amino acid sequence <SEQ ID 1108; ORF 271.a>:

```
a271.pep
  1 MFSSRMARIW AMGVTLCMVS PCPALTTKPK SLAKCAPFWM RSNCLICSAW

51 LRASAYAPVC SSTTGAPTSR AAWICLSSAS INKDTRMPAS VRILVNSAIL

101 SCCANTSKPP SVVIS*RFSG TMHTSSGITL SAFSSISSVN AISRFRRVRM

151 AFLTANTSAS LMWRRSSRRC MVIRSAPCVS ATSAASTGLG *
``` m271/a271 96.3% identity in 189 aa overlap

```
              10        20        30        40        50        60
m271.pep  XFSSRMARIWAMGVTLCMVSPCPALTTKPKSPAKCAPFWMRSNCLICSAWLRASAYAPVC
          |||||||||||||||||||||||||||||| ||||||||||||||||| |||||||||||
a271      MFSSRMARIWAMGVTLCMVSPCPALTTKPKSLAKCAPFWMRSNCLICSAWLCASAYAPVC
              10        20        30        40        50        60

70        80        90       100       110       120
m271.pep  SSTTGAPTSRAAWICLSSASINKDTRMPASVRILVNPAIFSCCANTSKPPSVVISXRFSG
          ||||||||||||||||||||||||||||||||||||  :|||||||||||||||||||||
a271      SSTTGAPTSRAAWICLSSASINKDTRMPASVRILANSAILSCCANTSKPPSVVISXRFSG
              70        80        90       100       110       120

130       140       150       160       170       180
m271.pep  TMHTSSGITFKAFSNISSVNAISRFRRVRMAFLTANTSASLMWRRSSRRCMVIKSAPCVS
          ||||||||||::|||:||||||||||||||||||||||||||||||||||||||:||||||
a271      TMHTSSGITLSAFSSISSVNAISRFRRVRMAFLTANTSASLMWRRSSRRCMVIRSAPCVS
             130       140       150       160       170       180

190
m271.pep  ATSAASTGLGX
          |||||||||||
a271      ATSAASTGLGX
             190
```

The following partial DNA sequence was identified in *N. gonorrhoeae* <SEQ ID 1109>:

```
g272.seq
    1 atgactgcaa aggaagaact gttcgcatgg ctgcgccata tgaacaaaaa
   51 caaaggttcc gacctgtttg tgacgaccca tttcccgccc gctatgaagc
  101 tggacggcaa aatcacccgc atcacggacg aaccgctgac ggcggaaaaa
  151 tgtatggaaa tcgccttttc gattatgagt gcgaagcagg cggaagaatt
  201 ttcatcgacc aacgagtgca atttcgccat cagcctgccg gacaccagcc
  251 gcttccgcgt caatgcgatg atacagcgcg gtgcgacggc gttggtattc
  301 cgcgcgatta ccagcaagat tcccaagttt gaaagcctga acctgccgcc
  351 ggccttgaag gatgttgcgc tgaaaaaacg cgggctggtt atttttgtcg
  401 gcggcaccgg ctcgggcaaa tcgacttcgc tcgcctcgct tatcgactac
  451 cgcaatgaaa attcgttcgg acacatcatc accatcgaag atccgatcga
  501 gtttgtccac gaacacaaaa actgcatcat tacccagcgc gaggtcggcg
  551 tggacacgga aaactggatg gcggcgttga aaaatacgct gcgtcaggcg
  601 ccggatgtga tccttatcgg cgaaatccgc gaccgtgaaa caatggacta
  651 cgccatcgcc tttgccgaaa cggggcattt gtgtatggcg acgctgcacg
  701 ccaacagcac caatcaggcg ctcgaccgca tcatcaactt cttccccgag
  751 gagcggcgcg aacaattgct gacggatttg tcgctcaacc ttcaggcgtt
  801 tatttcgcaa cgcctcgttc cgcgagacgg cggcaagggc agggtggcgg
  851 cagtcgaggt gctgctcaat cgccccctga tttcggagtt gattcacaac
  901 ggcaacatcc atgaaatcaa agaagtgatg aaaaaatcca ctaccctggg
  951 tatgcagacc ttcgaccaac acctttacca attgtatgaa aaaggcgaga
 1001 tttccttgca ggatgccttg aaaaatgccg attccgcaca tgatttgcgt
 1051 ttggcggtac agttgcgcag ccgcagggca caaagttccg accccgatt
 1101 ggaactgctc tga
```

This corresponds to the amino acid sequence <SEQ ID 1110; ORF 272.ng>:

```
g272.pep
   1 MTAKEELFAW LRHMNKNKGS DLFVTTHFPP AMKLDGKITR ITDEPLTAEK

51 CMEIAFSIMS AKQAEEFSST NECNFAISLP DTSRFRVNAM IQRGATALVF

101 RAITSKIPKF ESLNLPPALK DVALKKRGLV IFVGGTGSGK STSLASLIDY

151 RNENSFGHII TIEDPIEFVH EHKNCIITQR EVGVDTENWM AALKNTLRQA

201 PDVILIGEIR DRETMDYAIA FAETGHLCMA TLHANSTNQA LDRIINFFPE

251 ERREQLLTDL SLNLQAFISQ RLVPRDGGKG RVAAVEVLLN SPLISELIHN

301 GNIHEIKEVM KKSTTLGMQT FDQHLYQLYE KGEISLQDAL KNADSAHDLR

351 LAVQLRSRRA QSSDPDLELL*
```

The following partial DNA sequence was identified in *N. meningitidis* <SEQ ID 1111>:

```
m272.seq
   1 ATGACCGCAA AGGAAGAACT GTTCGCATGG CTGCGCCATA TGAwCCAAAA

51 CAAAGGTTCC GACCTGTTCG TGACAACCCA TTTCCCGCCC GCAATGAAGC

101 TGGACGGCAA AATCACCCGC ATCACGGACG AACCGCTGAC GGCGGAAAAA

151 TGTATGGAAA TCGCCTTTTC GATTATGAGT GCGAAGCAGG CGGAAGAATT

201 TTCATCGACC AACGAGTGCA ACTTCGCCAT CAGCCTGCCG GACACCAGCC

251 GCTTCCGCGT CAATGCGATG ATACAGCgCG GCGCGACGGC GTTGGTATTC

301 CGTACGATTA CCAGCAAGAT TCCCAAGTTT GAAAGCCTGA ACCTGCCGCC

351 AGTCTTGAAG GATGTCGCGC TGAAAAAACG CGGGCTGGTT ATTTTTGTCG

401 GCGGCACCGG CTCGGGTAAA TCGACTTCGC TTGCCTCGCT TATCGACTAC

451 CGCAATGAAA ATTCGTTCGG ACACATCATC ACCATCGAAG ACCCGATCGA

501 GTTTGTCCAC GAACACAAAA ACTGCATCAT CACCCAGCGC GAGGTCGGCG

551 TGGATACGGA AAACTGGATG GcGGCGTTGA AAAACACGCT GCGTCAGGCG

601 CCTGATGTCA TCCTTATCGG CGAAATCCGT GACCGCGAAA CAATGGACTA

651 CGCCATTGCC TTTGCCGAAA CGGGGCATTT GTGTATGGCG ACGCTGCACG

701 CCAACAGCAC CAATCAGGCA CTCGACCGCA TCATCAACTT TTTCCCCGAG

751 GAGCGGCGCG AACAATTGCT GACGGATTTG TCGCTCAACC TTCAGGCGTT

801 TATTTCGCAA CGCCTCGTTC CGCGAGACGG CGGCAAGGGC AGGGTGGCGG

851 CAGTCGAGGT GCTGCTCAAT TCGCCCCtGA TTTCGGAGTT GATTCACAAC

901 GGCAACATCC ATGAAATCAA AGAAGTGATG AAAAAATCCA CTACCCTGGG

951 TATGCAGACC TTCGATCAAC ACCTTTACCA ATTGTATGAA AAAGGCGATA

1001 TTTCCCTGCA AGAAGCATTG AAAAATGCCG ATTCCGCACA CGATTTGCGT

1051 TTGGCGGTAC AGTTGCGCAG CCGCCGCGCG CAaAGTTyCA GCCCCGATTT

1101 GGnACTGCTC TGA
```

This corresponds to the amino acid sequence <SEQ ID 1112; ORF 272>:

```
m272.pep
   1 MTAKEELFAW LRHMXQNKGS DLFVTTHFPP AMKLDGKITR ITDEPLTAEK
```

```
-continued
 51 CMEIAFSIMS AKQAEEFSST NECNFAISLP DTSRFRVNAM IQRGATALVF

101 RTITSKIPKF ESLNLPPVLK DVALKKRGLV IFVGGTGSGK STSLASLIDY

151 RNENSFGHII TIEDPIEFVH EHKNCIITQR EVGVDTENWM AALKNTLRQA

201 PDVILIGEIR DRETMDYAIA FAETGHLCMA TLHANSTNQA LDRIINFFPE

251 ERREQLLTDL SLNLQAFISQ RLVPRDGGKG RVAAVEVLLN SPLISELIHN

301 GNIHEIKEVM KKSTTLGMQT FDQHLYQLYE KGDISLQEAL KNADSAHDLR

351 LAVQLRSRRA QSXSPDLXLL *
```

Computer analysis of this amino acid sequence gave the following results:

Homology with a Predicted ORF from *N. gonorrhoeae*

ORF 272 shows 97.6% identity over a 370 aa overlap with a predicted ORF (ORF 272.ng) from *N. gonorrhoeae*:

```
m272/g272

10         20         30         40         50         60
    m272.pep  MTAKEELFAWLRHMXQNKGSDLFVTTHFPPAMKLDGKITRITDEPLTAEKCMEIAFSIMS
              ||||||||||||| :|||||||||||||||||||||||||||||||||||||||||||||
    g272      MTAKEELFAWLRHMNKNKGSDLFVTTHFPPAMKLDGKITRITDEPLTAEKCMEIAFSIMS
                    10         20         30         40         50         60
                    70         80         90        100        110        120
    m272.pep  AKQAEEFSSTNECNFAISLPDTSRFRVNAMIQRGATALVFRTITSKIPKFESLNLPPVLK
              |||||||||||||||||||||||||||||||||||||||||:||||||||||||||||:||
    g272      AKQAEEFSSTNECNFAISLPDTSRFRVNAMIQRGATALVFRAITSKIPKFESLNLPPALK
                    70         80         90        100        110        120
                   130        140        150        160        170        180
    m272.pep  DVALKKRGLVIFVGGTGSGKSTSLASLIDYRNENSFGHIITIEDPIEFVHEHKNCIITQR
              ||||||||||||||||||||||||||||||||||||||||||||||||||||||||||||
    g272      DVALKKRGLVIFVGGTGSGKSTSLASLIDYRNENSFGHIITIEDPIEFVHEHKNCIITQR
                   130        140        150        160        170        180
                   190        200        210        220        230        240
    m272.pep  EVGVDTENWMAALKNTLRQAPDVILIGEIRDRETMDYAIAFAETGHLCMATLHANSTNQA
              ||||||||||||||||||||||||||||||||||||||||||||||||||||||||||||
    g272      EVGVDTENWMAALKNTLRQAPDVILIGEIRDRETMDYAIAFAETGHLCMATLHANSTNQA
                   190        200        210        220        230        240
                   250        260        270        280        290        300
    m272.pep  LDRIINFFPEERREQLLTDLSLNLQAFISQRLVPRDGGKGRVAAVEVLLNSPLISELIHN
              ||||||||||||||||||||||||||||||||||||||||||||||||||||||||||||
    g272      LDRIINFFPEERREQLLTDLSLNLQAFISQRLVPRDGGKGRVAAVEVLLNSPLISELIHN
                   250        260        270        280        290        300
                   310        320        330        340        350        360
    m272.pep  GNIHEIKEVMKKSTTLGMQTFDQHLYQLYEKGDISLQEALKNADSAHDLRLAVQLRSRRA
              ||||||||||||||||||||||||||||||:||||:|||||||||||||||||||||||
    g272      GNIHEIKEVMKKSTTLGMQTFDQHLYQLYEKGEISLQDALKNADSAHDLRLAVQLRSRRA
                   310        320        330        340        350        360
                   370
    m272.pep  QSXSPDLXLLX
              ||:||| |||
    g272      QSSDPDLELLX
                   370
```

The following partial DNA sequence was identified in *N. meningitidis* <SEQ ID 1113>:

```
a272.seq
   1 ATGACCGCAA AGGAAGAACT GTTCGCATGG CTGCGCCATA TGAACAAAAA

51 CAAAGGTTCC GACCTGTTCG TGACGACCCA TTTCCCGCCC GCAATGAAGC

101 TGGACGGCAA AATCACCCGC ATCACGGACG AACCGCTGAC GGCGGAAAAA

151 TGTATGGAAA TCGCCTTTTC GATTATGAGT GCGAAGCAGG CGGAAGAATT

201 TTCATCGACC AACGAGTGCA ACTTCGCCAT CAGTCTGCCG GACACCAGCC

251 GCTTCCGCGT CAATGCGATG ATACAGCGCG GTGCGACGGC GTTGGTATTC
```

-continued

```
 301 CGTGCGATTA CCAGCAAGAT TCCCAAGTTT GAAAGCCTGA ACCTGCCGCC

351 GGTCTTGAAG GATGTCGCGC TGAAAAAACG CGGGCTGGTT ATTTTTGTCG

401 GCGGCACCGG CTCGGGCAAA TCGACTTCGC TTGCCTCGCT TATCGACTAC

451 CGCAATGAAA ATTCGTTCGG ACACATCATC ACCATCGAAG ACCCGATCGA

501 GTTTGTCCAC GAACACAAAA ACTGCATCAT CACCCAGCGC GAGGTCGGCG

551 TGGATACGGA AAACTGGATG GCGGCGTTGA AAAACACGCT GCGTCAGGCA

601 CCGGATGTGA TTCTGATCGG CGAAATCCGC GACCGCGAAA CAATGGACTA

651 CGCCATTGCT TTTGCCGAAA CGGGGCATTT GTGTATGGCG ACGCTGCACG

701 CCAACAGCAC CAATCAGGCA CTCGACCGCA TCATCAACTT TTTCCCCGAG

751 GAGCGGCGCG AACAATTGCT GACGGATTTG TCGCTCAACC TTCAGGCATT

801 TATTTCGCAA CGCCTCGTTC CGCGAGACGG CGGCAAGGGC AGGGTGGCGG

851 CAGTCGAGGT GCTGCTCAAT TCGCCCCTGA TTTCGGAGTT GATTCACAAC

901 GGCAATATCC ATGAAATCAA AGAAGTGATG AAAAAATCCA CTACCCTGGG

951 TATGCAGACT TTCGACCAAC ACCTTTACCA ATTGTATGAA AAAGGCGAGA

1001 TTTCCTTGCA GGATGCCTTG AAAAATGCCG ATTCCGCACA CGATTTGCGT

1051 TTGGCGGTAC AGTTGCGCAG CCGCCAGGCG CAAAGTTCCG GTCCCGATTT

1101 GGAACTGCTC TGA
```

This corresponds to the amino acid sequence <SEQ ID 1114; ORF 272.a>:

```
a272.pep
   1 MTAKEELFAW LRHMNKNKGS DLFVTTHFPP AMKLDGKITR ITDEPLTAEK

51 CMEIAFSIMS AKQAEEFSST NECNFAISLP DTSRFRVNAM IQRGATALVF

101 RAITSKIPKF ESLNLPPVLK DVALKKRGLV IFVGGTGSGK STSLASLIDY

151 RNENSFGHII TIEDPIEFVH EHKNCIITQR EVGVDTENWM AALKNTLRQA

201 PDVILIGEIR DRETMDYAIA FAETGHLCMA TLHANSTNQA LDRIINFFPE

251 ERREQLLTDL SLNLQAFISQ RLVPRDGGKG RVAAVEVLLN SPLISELIHN

301 GNIHEIKEVM KKSTTLGMQT FDQHLYQLYE KGEISLQDAL KNADSAHDLR

351 LAVQLRSRQA QSSGPDLELL *
``` m272/a272 97.6% identity in 370 aa overlap

```
                 10         20         30         40         50         60
m272.pep MTAKEELFAWLRHMXQNKGSDLFVTTHFPPAMKLDGKITRITDEPLTAEKCMEIAFSIMS
         ||||||||||||||:|||||||||||||||||||||||||||||||||||||||||||
a272     MTAKEELFAWLRHMNKNKGSDLFVTTHFPPAMKLDGKITRITDEPLTAEKCMEIAFSMIS
                 10         20         30         40         50         60

70         80         90        100        110        120
m272.pep AKQAEEFSSTNECNFAISLPDTSRFRVNAMIQRGATALVFRTITSKIPKFESLNLPPVLK
         ||||||||||||||||||||||||||||||||||||||||:|||||||||||||||||||
a272     AKQAEEFSSTNECNFAISLPDTSRFRVNAMIQRGATALVFRAITSKIPKFESLNLPPVLK
                 70         80         90        100        110        120

130        140        150        160        170        180
m272.pep DVALKKRGLVIFVGGTGSGKSTSLASLIDYRNENSFGHIITIEDPIEFVHEHKNCIITQR
         ||||||||||||||||||||||||||||||||||||||||||||||||||||||||||||
a272     DVALKKRGLVIFVGGTGSGKSTSLASLIDYRNENSFGHIITIEDPIEFVHEHKNCIITQR
                130        140        150        160        170        180
```

```
             190        200        210        220        230        240
m272.pep  EVGVDTENWMAALKNTLRQAPDVILIGEIRDRETMDYAIAFAETGHLCMATLHANSTNQA
          ||||| ||||||| |||||||||||||||||||||||||||||||||||||||||||||
a272      EVGVTENWMAALKKNTLRQAPDVILIGEIRDRETMDYAIAFAETGHLCMATLHANSTNQA
             190        200        210        220        230        240

250        260        270        280        290        300
m272.pep  LDRIINFFPEERREQLLTDLSLNLQAFISQRLVPRDGGKGRVAAVEVLLNSPLISELIHN
          ||||||||||||||||||||||||||||||||||||||||||||||||||||||||||||
a272      LDRIINFFPEERREQLLTDLSLNLQAFISQRLVPRDGGKGRVAAVEVLLNSPLISELIHN
             250        260        270        280        290        300

310        320        330        340        350        360
m272.pep  GNIHEIKEVMKKSTTLGMQTFDQHLYQLYERGDISLQEALKNADSAHDLRLAVQLRSRRA
          |||||||||||||||||||||||||||||||| |||:||||||||||||||||||||:|
a272      GNIHEIKEVMKKSTTLGMQTFDQHLYQLYEKGEISLQDALKNADSAHDLRLAVQLRSRQA
             310        320        330        340        350        360

370
m272.pep  QSXSPDLXLLX
          ||:|||  |||
a272      QSSGPDLELLX
             370
```

The following partial DNA sequence was identified in *N. gonorrhoeae* <SEQ ID 1115>:

```
g273.seq
   1 atgagtcttc aggcggtatt tatataccccc ccaagccgta ccgcacaata
  51 caacgaaaat caggaaaacg gcggtaaagc tcataaacag gacaaagcg
 101 gcaaacacac cgaccgccgt caggatatag gcgtattcga ggccggaact
 151 ccattcaccg ttttcctgcc gtttcttgtc gcttttgaaa taaggatga
 201 tgccggcaag cagcgcggca gccgcgcccg acattggcat tgtgttcatt
 251 gttgttcctt aacggttaaa acccgcccg gccgtgcaac cgttttaagg
 301 cgggaaattg caaatttgt ttgcgggcgc gtgccgctga aatcaaggcg
 351 gtttgagaag tgtttccnac gcgcccgccc tatgtgccga aatattattt
 401 gtcgctcacc tgcaaaatcg ccaagaacgc gctttgcgga atttccacgt
 451 tgcccacttg tttcatacgg cgtttgcctg cttttgttt tcaagcagt
 501 tttttcttac gcgtaa
```

This corresponds to the amino acid sequence <SEQ ID 1116; ORF 273.ng>:

```
g273.pep
   1 MSLQAVFIYP PSRTAQYNEN QENGGKAHKQ GQSGKHTDRR QDIGVFEAGT
  51 PFTVFLPFLV AFEIKDDAGK QRGSRARHWH CVHCCSLTVK NPPGRATVLR
 101 REIAKFVCGR VPLKSRRFEK CFXRARPMCR NIICRSPAKS PRTRFAEFPR
 151 CPLVSYGVCL LFVFQAVFSY A*
```

The following partial DNA sequence was identified in *N. meningitidis* <SEQ ID 1117>:

```
m273.seq
   1 ATGAGTCTTC AGGCGGTATT TATATACCCm CCAAGCCGTA CCGCACAATA
  51 CAACGAAAAT CAGGAAAACG GCGGTAAAGC TCAyAAACAG GACAAAGCG
 101 GCAAACACGC CGACCGCTGT CAGGATATAG GCGTATTCAA GGCCGGAACT
 151 CCATTCCCCG TTTTCCTGCC GCTTCTTGTC GCTTTTGAAA TAAGGATGA
```

```
-continued
201 TGCCGGCAAG CAGCGCGGCA GCCGCGCCCG ACATTAGCAT TGTGTTCATT

251 GTTGTTCCTT AATGCTTAAA AACCCGCCTG TCCGTGCAAC CGTTTTAAGG

301 CGGCAAATTG CAAAATTTGT TTGCGGGCGC GTGCCCCTGA AATCAGGGCG

351 GTTTGAGGGG TGTTCCCGAC GCGCCGCCCT GTGTGCCGGA GTTATTTGTC

401 GCTCACCTGC AAAATCGCCA AGAACGCGCT TTGCGGAATT TCCACATTGC

451 CCACTTGTTT CATACGGCGT TTACCTGCCT TTTGTkTwTC AAGCAGTTTT

501 TTCTTACGCG TAA
```

This corresponds to the amino acid sequence <SEQ ID 1118; ORF 273>:

```
m273.pep
  1 MSLQAVFIYP PSRTAQYNEN QENGGKAHKQ GQSGKHADRC QDIGVFKAGT

51 PFPVFLPLLV AFEIKDDAGK QRGSRARH*H CVHCCSLMLK NPPVRATVLR

101 RQIAKFVCGR VPLKSGRFEG CSRRAALCAG VICRSPAKSP RTRFAEFPHC

151 PLVSYGVYLP FVXQAVFSYA *
                                             25
```

Computer analysis of this amino acid sequence gave the following results:
Homology with a Predicted ORF from *N. gonorrhoeae*
ORF 273 shows 86.0% identity over a 171 aa overlap with a predicted ORF (ORF 273.ng) from *N. gonorrhoeae*:

```
    m273/g273
                 10         20         30         40         50         60
    m273.pep MSLQAVFIYPPSRTAQYNENQENGGKAHKQGQSGKHADRCQDIGVFKAGTPFPVFLPLLV
             ||||||||||||||||||||||||||||||||||||:||  ||||||:|||| ||||:||
    g273     MSLQAVFIYPPSRTAQYNENQENGGKAHKQGQSGKHTDRRQDIGVFEAGTPFTVFLPFLV
                 10         20         30         40         50         60
                 70         80         90        100        110        120
    m273.pep AFEIKDDAGKQRGSRARHXHCVHCCSLMLKNPPVRATVLRRQIAKFVCGRVPLKSGRFEG
             |||||||||||||||||| |||||| :|||  ||||||:|||||||||||||||| |||
    g273     AFEIKDDAGKQRGSRARHWHCVHCCSLTVKNPPGRATVLRREIAKFVCGRVPLKSRRFEK
                 70         80         90        100        110        120
                130        140        150        160        170
    m273.pep CSRRA-ALCAGVICRSPAKSPRTRFAEFPHCPLVSYGVYLPFVXQAVFSYAX
             |   || :|  ::||||||||||||||||:||||||| | || ||||||||
    g273     CFXRARPMCRNIICRSPAKSPRTRFAEFPRCPLVSYGVCLLFVQAVFSYAX
                130        140        150        160        170
```

The following partial DNA sequence was identified in *N. meningitidis* <SEQ ID 1119>:

```
a273.seq
  1 ATGAGTCTTC AGGCGGTATT TGTATACCCC CCAAGCCGTA CCGCACAATA

51 CAACGAAAAT CAGGAAAACG GCGGTAAAGC TCATAAACAG GGACAAAGCG

101 GCAAACACGC CGACCGCCGT CAGGATATAG GCGTATTCCA GACCGGAACT

151 CCATTCACCG TTTTCCTGCC GCTTTTTGTC GCTTTTGAAA TAAAGGATGA

201 TGCCGGCAAG CAGCGCGGCA GCCGCGCCCG ACATTAGCAT AATGTTCATT

251 GTTGTTCCTT AACGGTTAAA AACCCGCCCG TCCGTGCAAC CGTTTTAAG

301 AGGCGGTAAA TCACAAAGTT TGTTGGCGGA CGTGCTCTCT TACAATCAGG

351 GCGGTTTAAG GGGCATGATG CACTGCCCCG TGTGCCGGAT ATTATTTGTC
```

```
-continued
401 GCTCACCTGC AAAATTGCCA AGAACGCGCT TTGCGGGATT TCCACATTGC

451 CCACTTGTTT CATACGGCGT TGCCTGCTT TTTGTTTTTC AAGCAGTTTT

501 TTCTTACGCG TAA
```

This corresponds to the amino acid sequence <SEQ ID 1120; ORF 273.a>:

```
a273.pep
  1 MSLQAVFVYP PSRTAQYNEN QENGGKAHKQ GQSGKHADRR QDIGVFQTGT

51 PFTVFLPLFV AFEIKDDAGK QRGSRARH*H NVHCCSLTVK NPPVRATVFK

101 RR*ITKFVGG RALLQSGRFK GHDALPRVPD IICRSPAKLP RTRFAGFPHC

151 PLVSYGVCLL FVFQAVFSYA *
``` m273/a273 80.1% identity in 171 aa overlap

```
                  10         20         30         40         50         60
     m273.pep  MSLQAVFIYPPSRTAQYNENQENGGKAHKQGQSGKHADRCQDIGVFKAGTPFPVFLPLLV
               ||||||:||||||||||||||||||||||||||||||| ||||||::||||  ||||||:|
     a273      MSLQAVFVYPPSRTAQYNENQENGGKAHKQGQSGKHADRRQDIGVFQTGTPFTVFLPLFV
                  10         20         30         40         50         60

70         80         90        100        110        119
     m273.pep  AFEIKDDAGKQRGSRARHXHCVHCCSLMLKNPPVRATVL-RRQIAKFVCGRVPLKSGRFE
               ||||||||||||||||||| |||||||:|||||||||: || |:||| ||: |:||||:
     a273      AFEIKDDAGKQRGSRARHXHNVHCCSLTVKNPPVRATVFKRRXITKFVGGRALLQSGRFK
                  70         80         90        100        110        120

120        130        140        150        160        170
     m273.pep  GCSRRAALCAGVICRSPAKSPRTRFAEFPHCPLVSYGVYLPFVXQAVFSYAX
               | :    :  :|||||| ||||| ||||||||||||||| | || |||||||
     a273      GHDALPRV-PDIICRSPAKLPRTRFAGFPHCPLVSYGVCLLFVFQAVFSYAX
                 130        140        150        160        170
```

The following partial DNA sequence was identified in *N. gonorrhoeae* <SEQ ID 1121>:

```
g274.seq
  1 ATGGCGGGGC CGATTTTTGT CGTCatCGCC AgcgTCGCTA TGTTTTTTGT

51 CGCGCAGCAG CACGCGACAG ATTTGGTTAC GGACGATTAT TATAAGGATG

101 GCAAGCATAT CGACATCCAG CTTCATCGGG ATGAAGAAGC CGTCAGACGG

151 CATATCGGGG TGCAGGTCCT CATTTCTCCC GATATGAATG CGGCAAAAGT

201 GTTTGTCGGc ggCgagtTTG ACGGCAAACA GCCTTTGAAC CTGCTGCTGA

251 TGCACCCGAC CCGCAAGGCG GACGATCAAA CCGTCGCCCT CAAGCCCGTC

301 GGCAGCGCGC AGAACGGCAG GCGGAATAT GAGGCGGTgt tcaaAACCCT

351 TCCGCCGGCC AACCACTGGT ATGTGCGCGT GGAggacgCG GCAGGCGTGT

401 GGCGCGTCGA GAACAAATGG ATTACCAGCC AGGGCAATGC GGTCGATTTG

451 ACCCCGATGG ACAAACTTTT CAATAATGCA GGAAGCAAAT AA
```

This corresponds to the amino acid sequence <SEQ ID 1122; ORF 274.ng>:

```
g274.pep
  1 MAGPIFVVIA SVAMFFVAQQ HATDLVTDDY YKDGKHIDIQ LHRDEEAVRR

51 HIGVQVLISP DMNAAKVFVG GEFDGKQPLN LLLMHPTRKA DDQTVALKPV
```

```
101 GSAQNGRAEY EAVFKTLPPA NHWYVRVEDA AGVWRVENKW ITSQGNAVDL

151 TPMDKLFNNA GSK*
```

The following partial DNA sequence was identified in *N. meningitidis* <SEQ ID 1123>:

```
m274.seq
  1 ATGGCGGGGC CGATTTTTGT CGTCATCGCC AGCGTCGCTA TGTTTTTTGT

51 CGCGCAGCAG CACGCGACAG ATTTGGTTAC GGACGATTAT TATAAAGACG

101 GCAAACATAT CGACATCCAG CTTCATCGGG ATGAAGAAGC CGTCAGACGG

151 CATATCGGGG TGCAGGTTCT CATTTCCCCC GATATGAATG CGGCAAAAGT

201 GTTTGTCGGC GGCGAGTTTG ACGGCAAACA GCCTTTGAAC CTGCTGCTGA

251 TGCACCCGAC CCGCAAGGCG GACGATCAAA CCGTCGCCCT CAAGCCCGTC

301 GGCAGCGCGC AGAACGGCAG GGCGGAATAT GAGGCGGTGT TCAAAACCCT

351 TTCGCCGACC AACCACTGGT ATGTGCGCGT GGAGGACGCG GCAGGCGTGT

401 GGCGCGTCGA GAACAAATGG ATTACCAGCC AAGGCAATGC GGTCGATTTG

451 ACCCCGATGG ACAAGCTTTT CAATAATACT GAAAGCAAAT AA
```

This corresponds to the amino acid sequence <SEQ ID 1124; ORF 274>:

```
m274.pep
  1 MAGPIFVVIA SVAMFFVAQQ HATDLVTDDY YKDGKHIDIQ LHRDEEAVRR

51 HIGVQVLISP DMNAAKVFVG GEFDGKQPLN LLLMHPTRKA DDQTVALKPV

101 GSAQNGRAEY EAVFKTLSPT NHWYVRVEDA AGVWRVENKW ITSQGNAVDL

151 TPMDKLFNNT ESK*
```

Computer analysis of this amino acid sequence gave the following results:
Homology with a Predicted ORF from *N. gonorrhoeae*
ORF 274 shows 97.5% identity over a 163 aa overlap with a predicted ORF (ORF 274.ng) from *N. gonorrhoeae*:

```
g274/m274
                     10         20         30         40         50         60
        g274.pep  MAGPIFVVIASVAMFFVAQQHATDLVTDDYYKDGKHIDIQLHRDEEAVRRHIGVQVLISP
                  ||||||||||||||||||||||||||||||||||||||||||||||||||||||||||||
        m274      MAGPIFVVIASVAMFFVAQQHATDLVTDDYYKDGKHIDIQLHRDEEAVRRHIGVQVLISP
                     10         20         30         40         50         60

70         80         90        100        110        120
        g274.pep  DMNAAKVFVGGEFDGKQPLNLLLMHPTRKADDQTVALKPVGSAQNGRAEYEAVFKTLPPA
                  |||||||||||||||||||||||||||||||||||||||||||||||||||||||||| :
        m274      DMNAAKVFVGGEFDGKQPLNLLLMHPTRKADDQTVALKPVGSAQNGRAEYEAVFKTLSPT
                     70         80         90        100        110        120

130        140        150        160
        g274.pep  NHWYVRVEDAAGVWRVENKWITSQGNAVDLTPMDKLFNNAGSKX
                  |||||||||||||||||||||||||||||||||||||||: |||
        m274      NHWYVRVEDAAGVWRVENKWITSQGNAVDLTPMDKLFNNTESKX
                    130        140        150        160
```

The following partial DNA sequence was identified in *N. meningitidis* <SEQ ID 1125>:

```
a274.seq
    1 ATGGCGGGGC CGATTTTTGT CGTCATCGCC AGCGTCGCTA TGTTTTTTGT

51 CGCGCAGCAG CACGCGACAG ATTTGGTTAC GGACGATTAT TATAAAGACG

101 GCAAGCATAT CGACATCCAG CTTCATCGGG ATGAAGAAGC CGTCAGACGG

151 CATATCGGGG TGCAGGTTCT CATTTCCCCC GATATGAATG CGGCAAAAGT

201 GTTTGTCGGC GGCGAGTTTG ACGGCAAACA GCCTTTGAAC CTGCTGCTGA

251 TGCACCCGAC CCGCAAGGCG GACGATCAAA CCGTCGCCCT CAAGCCCGTC

301 GGCAGCGCGC AGAACGGCAG GGCGGAATAT GAGGCGGTGT TCAAAACCCT

351 TTCGCCGACC AACCACTGGT ATGTGCGCGT GGAGGACGCG GCAGGCGTGT

401 GGCGCGTCGA GAACAAATGG ATTACCAGCC AAGGCAATGC GGTCGATTTG

451 ACCCCGATGG ACAAACTTTT CAATAATACT GAAAGCAAAT AA
```

This corresponds to the amino acid sequence <SEQ ID 1126; ORF 274.a>:

```
a274.pep
    1 MAGPIFVVIA SVAMFFVAQQ HATDLVTDDY YKDGKHIDIQ LHRDEEAVRR

51 HIGVQVLISP DMNAAKVFVG GEFDGKQPLN LLLMHPTRKA DDQTVALKPV

101 GSAQNGRAEY EAVFKTLSPT NHWYVRVEDA AGVWRVENKW ITSQGNAVDL

151 TPMDKLFNNT ESK*
``` m274/a274 100.0% identity in 163 aa overlap

```
                    10         20         30         40         50         60
   m274.pep  MAGPIFVVIASVAMFFVAQQHATDLVTDDYYKDGKHIDIQLHRDEEAVRRHIGVQVLISP
             ||||||||||||||||||||||||||||||||||||||||||||||||||||||||||||
   a274      MAGPIFVVIASVAMFFVAQQHATDLVTDDYYKDGKHIDIQLHRDEEAVRRHIGVQVLISP
                    10         20         30         40         50         60

70         80         90        100        110        120
   m274.pep  DMNAAKVFVGGEFDGKQPLNLLLMHPTRKADDQTVALKPVGSAQNGRAEYEAVFKTLSPT
             ||||||||||||||||||||||||||||||||||||||||||||||||||||||||||||
   a274      DMNAAKVFVGGEFDGKQPLNLLLMHPTRKADDQTVALKPVGSAQNGRAEYEAVFKTLSPT
                    70         80         90        100        110        120

130        140        150        160
   m274.pep  NHWYVRVEDAAGVWRVENKWITSQGNAVDLTPMDKLFNNTESKX
             |||||||||||||||||||||||||||||||||||||||||||
   a274      NHWYVRVEDAAGVWRVENKWITSQGNAVDLTPMDKLFNNTESKX
                   130        140        150        160
```

The following partial DNA sequence was identified in *N. gonorrhoeae* <SEQ ID 1127>:

```
g276.seq
    1  atgattttgc cgccatccat gacgatgatg cggtcggcgg attcgacggt 51  ggtcaggcgg tgggcgacga tgatgccggt gcggttttcc atcaggcgtt 101  cgagcgcttg ttggacgagg cgttcggatt cgttgtccaa tgcgctggtg 151  gcttcgtcca ataataatat cggcgcgtct ttcaaaatgg cgcgggcgat 201  ggcgacgcgt tgccgctgtc cgccggataa gttgctgccg ttcgatccga 251  tgggctggtg cagtccgagc ggggatgcgt cgatcaggct ttgcaggttg 301  gcggcttgga gggcggacag gacttcggct tcgcccgcgt cgggacggct
```

-continued

```
351   gtatcggacg ttttcaaaca gggtgtcgtc aaacaggaat acgtcttggg
401   agacgagggc gaattgggcg cgcaggcagt cgagtttgat gtcggcgatg
451   tcgataccgt ctatgcagat gttgccggca gacggttcga caaagcgggg
501   cagaaggttg acgacggtgg atttgccgct gccggaacgt ccgaccaggg
551   cgacgcgttc gccttgtctg atgtcgaggt tgaagttgtc gagggctttg
601   atgccgtctg aacggtattc gacatcgacg ttgcggaagc tgatgcgccc
651   ttcgacacgc tgcggcgcga gcgtgccttt gtcctgttcg ggcggggtgt
701   cgagaaatgc acatacgccg tcggcggcga ggaacatcgt ctgcataggg
751   atgctgatgt tggcaaggct tttgatgggg gcgtacattt gcagcatcgc
801   gacgatgaat gccataaatt cgccgatggt ggtgtag
```

This corresponds to the amino acid sequence <SEQ ID 1128; ORF 276.ng>:

```
g276.pep
  1 MILPPSMTMM RSADSTVVRR WATMMPVRFS IRRSSACWTR RSDSLSNALV
 51 ASSNNNIGAS FKMARAMATR CRCPPDKLLP FDPMGWCSPS GDASIRLCRL
101 AAWRADRTSA SPASGRLYRT FSNRVSSNRN TSWETRANWA RRQSSLMSAM

151 SIPSMQMLPA DGSTKRGRRL TTVDLPLPER PTRATRSPCL MSRLKLSRAL

201 MPSERYSTST LRKLMRPSTR CGASVPLSCS GGVSRNAHTP SAARNIVCIG

251 MLMLARLLMG AYICSIATMN AINSPMVV*
```

The following partial DNA sequence was identified in *N. meningitidis* <SEQ ID 1129>:

```
m276.seq
  1 ATGATTTTGC CGTCGTCCAT CACGATGATG CGGTCGGCCC CTTCGATGGT
 51 GGTCAGGCGG TGGGCGACGA TGATGCCGGT GCGGTTTTCC ATCAGGCGTT
101 CGAGCGCCTG TTGGACGAGG CGTTCGGATT CGTTGTCTAA TGCGCTGGTG
151 GCTTCGTCCA ATAATAATAT CGGCGCGTCT TTCAAAATGG CGCGGGCAAT
201 GGCGACGCGT TGCCGCTGTC CGCCGGATAA GTTGCTGCCG TTCGATCCGA
251 TGGGCTGGTG CAGTCCGAGC GGGGAGCTGT CAATCAGGCT TTGCAGGTTG
301 GCGGTTTGGA GGGCGAACAG GACTTCGGCT TCGCCCGCGT CGGGACGGCT
351 GTATCGGACG TTTTCAAACA GGGTGTCGTC AAACAGGAAT ACGTCTTGGG
401 AGACGAGGGC GAATTGGGCG CGCAGGCAGT CGAGTTTGAT GTCGGCGATG
451 TCGATACCGT CTATGCAGAT GTTGCCGGCA GACGGTTCGA CAAAGCGGGG
501 CAGCAGGTTG ACGACGGTGG ATTTGCCGCT GCCGGAACGT CCGACCAGGG
551 CGACGCGTTC GCCTTGTCTG ATGTCGAGGT TGAAGTTGTC GAGGGCTTTG
601 ATGCCGTCTG AACGGTATTC GACATCGACG TTGCGGAAGC TGATGCGCCC
651 TTCGACACGC TGCGGTGCGA GCGTGCCCTT GTCCTGTTCG GGCGGGGTGT
701 CGAGAAATGC ACATACACCG TCGGCGGCGA GGAACATCGT CTGCATAGGG
751 ATGCTGATGT TGGCAAGGCT TTTGATGGGG GCGTACATTT GCAGCATCGC
801 GACGATGAAT GCCATAAATT CGCCGATGGT GGTGTAG
```

This corresponds to the amino acid sequence <SEQ ID 1130; ORF 276>:

```
m276.pep
    1 MILPSSITMM RSAPSMVVRR WATMMPVRFS IRRSSACWTR RSDSLSNALV

51 ASSNNNIGAS FKMARAMATR CRCPPDKLLP FDPMGWCSPS GELSIRLCRL

101 AVWRANRTSA SPASGRLYRT FSNRVSSNRN TSWETRANWA RRQSSLMSAM

151 SIPSMQMLPA DGSTKRGSRL TTVDLPLPER PTRATRSPCL MSRLKLSRAL

201 MPSERYSTST LRKLMRPSTR CGASVPLSCS GGVSRNAHTP SAARNIVCIG

251 MLMLARLLMG AYICSIATMN AINSPMVV*
```

Computer analysis of this amino acid sequence gave the following results:
Homology with a Predicted ORF from *N. gonorrhoeae*
ORF 276 shows 96.8% identity over a 278 aa overlap with a predicted ORF (ORF 276.ng) from *N. gonorrhoeae*:

```
m276/g276

10         20         30         40         50         60
       m276.pep   MILPSSITMMRSAPSMVVRRWATMMPVRFSIRRSSACWTRRSDSLSNALVASSNNNIGAS
                  ||||  |:|||||| | |||||||||||||||||||||||||||||||||||||||||||
       g276       MILPPSMTMMRSADSTVVRRWATMMPVRFSIRRSSACWTRRSDSLSNALVASSNNNIGAS
                           10         20         30         40         50         60

70         80         90        100        110        120
       m276.pep   FKMARAMATRCRCPPDKLLPFDPMGWCSPSGELSIRLCRLAVWRANRTSASPASGRLYRT
                  ||||||||||||||||||||||||||||||: |||||||||::|||:|||||||||||||
       g276       FKMARAMATRCRCPPDKLLPFDPMGWCSPSGDASIRLCRLAAWRADRTSASPASGRLYRT
                           70         80         90        100        110        120

130        140        150        160        170        180
       m276.pep   FSNRVSSNRNTSWETRANWARRQSSLMSAMSIPSMQMLPADGSTKRGSRLTTVDLPLPER
                  |||||||||||||||||||||||||||||||||||||||||||||||| ||||||||||
       g276       FSNRVSSNRNTSWETRANWARRQSSLMSAMSIPSMQMLPADGSTKRGRRLTTVDLPLPER
                          130        140        150        160        170        180

190        200        210        220        230        240
       m276.pep   PTRATRSPCLMSRLKLSRALMPSERYSTSTLRKLMRPSTRCGASVPLSCSGGVSRNAHTP
                  ||||||||||||||| |||||||||||||||||||||||||||||||||||||||||||
       g276       PTRATRSPCLMSRLKPSRALMPSERYSTSTLRKLMRPSTRCGASVPLSCSGGVSRNAHTP
                          190        200        210        220        230        240

250        260        270    279
       m276.pep   SAARNIVCIGMLMLARLLMGAYICSIATMNAINSPMVVX
                  |||||||||||||||||||||||||||||||||||||||
       g276       SAARNIVCIGMLMLARLLMGAYICSIATMNAINSPMVVX
                          250        260        270
```

The following partial DNA sequence was identified in *N. meningitidis* <SEQ ID 1131>:

```
a276.seq
    1 ATGATTTTGC CGTCGTCCAT TACGATGATG CGGTCGGCCC CTTCGATGGT

51 GGTCAGGCGG TGGGCGACGA TGATGCCGGT GCGGTTTTCC ATCAGGCGTT

101 CGAGCGCCTG TTGGACGAGG CGTTCGGATT CGTTGTCCAA TGCGCTGGTG

151 GCTTCGTCCA ATAATAATAT CGGCGCGTCT TTCAAAATGG CGCGGGCAAT

201 GGCAACGCGT TGCCGCTGTC CGCCGGATAA GTTGCTGCCG TTCGATCCGA

251 TGGGCTGGTG CAGTCCGAGC GGTGATGCGT CGATCAGGCT TTGCAGGTTA

301 GCGGCTTGGA GGGCGGATAG GACTTCGGCT TCGCCCGCGT CGGGACGGCT

351 ATATCGGACG TTTTCAAACA GGGTGTCGTC AAACAGGAAT ACGTCTTGGG

401 AGACGAGGGC AAATTGGGCG CGCAGGCAGT CGAGTTTGAT GTCGGCGATG

451 TCGATACCGT CTATGCAGAT GTTGCCGGCA GACGGTTCGA CAAAGCGGGG
```

-continued

```
501  CAGCAGGTTG ACGACGGTGG ATTTGCCGCT GCCGGAACGT CCGACCAGGG

551  CGACGCGTTC GCCTTGTCTG ATGTCGAGGT TGAAGCCGTC GAGGGCTTTG

601  ATGCCGTCCG AACGGTATTC GACATCGACG TTGCGGAAGC TGATGCGCCC

651  TTCGACACGC TGCGGTGCGA GCGTGCCTTT GTCCTGTTCG GGCGGGGTGT

701  CGAGAAATGC ACATACGCCG TCGGCGGCGA GGAACATCGT CTGCATAGGG

751  ATGCTAATGT TGGCAAGGCT TTTGATGGGG GCGTACATTT GCAGCATCGC

801  GACGATGAAT GCCATAAATT CGCCGATGGT GGTGTAG
```

This corresponds to the amino acid sequence <SEQ ID 1132; ORF 276.a>:

```
a276.pep
  1    MILPSSITMM RSAPSMVVRR WATMMPVRFS IRRSSACWTR RSDSLSNALV

51    ASSNNNIGAS FKMARAMATR CRCPPDKLLP FDPMGWCSPS GDASIRLCRL

101    AAWRADRTSA SPASGRLYRT FSNRVSSNRN TSWETRANWA RRQSSLMSAM

151    SIPSMQMLPA DGSTKRGSRL TTVDLPLPER PTRATRSPCL MSRLKPSRAL

201    MPSERYSTST LRKLMRPSTR CGASVPLSCS GGVSRNAHTP SAARNIVCIG

251    MLMLARLLMG AYICSIATMN AINSPMVV*
``` m276/a276 98.2% identity in 278 aa overlap

```
                  10         20         30         40         50         60
      m276.pep    MILPSSITMMRSAPSMVVRRWATMMPVRFSIRRSSACWTRRSDSLSNALVASSNNNIGAS
                  ||||||||||||||||||||||||||||||||||||||||||||||||||||||||||||
      a276       MILPSSITMMRSAPSMVVRRWATMMPVRFSIRRSSACWTRRSDSLSNALVASSNNNIGAS
                  10         20         30         40         50         60

70         80         90        100        110        120
      m276.pep    FKMARAMATRCRCPPDKLLPFDPMGWCSPSGELSIRLCRLAVWRANRTSASPASGRLYRT
                  ||||||||||||||||||||||||||||||: |||||||:|||:||||||||||||||||
      a276       FKMARAMATRCRCPPDKLLPFDPMGWCSPSGDASIRLCRLAAWRADRTSASPASGRLYRT
                  70         80         90        100        110        120

130        140        150        160        170        180
      m276.pep    FSNRVSSNRNTSWETRANWARRQSSLMSAMSIPSMQMLPADGSTKRGSRLTTVDLPLPER
                  ||||||||||||||||||||||||||||||||||||||||||||||||||||||||||||
      a276       FSNRVSSNRNTSWETRANWARRQSSLMSAMSIPSMQMLPADGSTKRGSRLTTVDLPLPER
                 130        140        150        160        170        180

190        200        210        220        230        240
      m276.pep    PTRATRSPCLMSRLKLSRALMPSERYSTSTLRKLMRPSTRCGASVPLSCSGGVSRNAHTP
                  ||||||||||||||||| ||||||||||||||||||||||||||||||||||||||||||
      a276       PTRATRSPCLMSRLKPSRALMPSERYSTSTLRKLMRPSTRCGASVPLSCSGGVSRNAHTP
                 190        200        210        220        230        240

250        260        270    279
      m276.pep    SAARNIVCIGMLMLARLLMGAYICSIATMNAINSPMVVX
                  |||||||||||||||||||||||||||||||||||||||
      a276       SAARNIVCIGMLMLARLLMGAYICSIATMNAINSPMVVX
                 250        260        270
```

The following partial DNA sequence was identified in *N. gonorrhoeae* <SEQ ID 1133>:

```
g277.seq (partial)
  1. . .   atggtacacg tcgccgtagc ttacggtatt gccgtccggc gttttttgccc 51        aaacgaggtc atagacgttt tccacgcctt gcaggtacat cgccaagcgt 101        tcgatgccgt aggtaatttc gccgagtacg ggcgtgcaat cgataccgcc 151        gacttgttgg aaataggtaa actgggttac ttccatgccg ttgagccaga 201        cttcccagcc caaacccac gcaccgaggg tggggttttc ccagtcgtct
```

-continued

```
251    tcgacaaagc ggatgtcgtg gactttggga tcgatgccca attcgcgcag 301    ggagtcgaga tagaggtctt ggatattggc gggggcgggt ttgagggcga 351    cttggaattg gtaatagtgt tgcaggcggt tggggttgtc gccgtagcgg 401    ccgtctttgg ggcggcggct gggttggacg taggcggcaa accaaggctc 451    ggggccgagc gcgcgcaggc aggtggcggg atgggatgtg ccggcaccga 501    cttccatgtc gaagggttgg atgacggtgc agcctttgtc tgcccagaag 551    gtttgcagtt tgaagatgat ttgttggaag gtaagcatgg cttattgttc 601    gataaaataa aggttttatt ttactgtttc catagccgct tgaatagatt 651    tatctcgaag acagcctga
```

This corresponds to the amino acid sequence <SEQ ID 1134; ORF 277.ng>:

```
g277.pep (partial)
  1  . . . MVHVAVAYGI AVRRFCPNEV IDVFHALQVH RQAFDAVGNF AEYGRAIDTA

51         DLLEIGKLGY FHAVEPDFPA QTPRTEGGVF PVVFDKADVV DFGIDAQFAQ

101         GVEIEVLDIG GGGFEGDLEL VIVLQAVGVV AVAAVFGAAA GLDVGGKPRL

151         GAERAQAGGG MGCAGTDFHV EGLDDGAAFV CPEGLQFEDD LLEGKHGLLF

201         DKIKVLFYCF HSRLNRFISK TA*
```

The following partial DNA sequence was identified in *N. meningitidis* <SEQ ID 1135>:

```
m277.seq
  1  ATGCCCCGCT TGAGGACAA GCTCGTAGGC AGGCAGGGCG AGGGCGGCGT

51  TTTCTTCGGC AAGCAGGCGT TTGGCTTGCG CTTCGTAGTC GTTGAACTGG

101  CGCAGCAGCC AGTCGGCATC GCTGTATTCG AAGTTGTAGG TGGATTGCTC

151  GACTTCGTTT TGGTGGTACA CGTCGCCGTA GGTGACGGTG TTGCCGTCGA

201  GCGTTTTTGC CCAAACGAGG TCGTAGACGT TTTCTACACC TTGCAAGTAC

251  ATCGCCAAGC GTTCGATGCC GTAGGTGATT TCGCCGAGTA CGGGCGTGCA

301  GTCGATGCCG CCGACTTGTT GGAAATAGGT AAACTGGGTT ACTTCCATGC

351  CGTTGAGCCA GACTTCCCAG CCCAAACCCC ACGCGCCGAG GGTGGGGTTT

401  TCCCAGTCGT CTTCGACAAA GCGGATGTCG TGGACTTTGG GATCGATGCC

451  CAATTCGCGC AGAGAGTCGA GATAGAGGTC TTGGATATTG GCGGGAGCGG

501  GCTTGAGGGC GACTTGGAAT TGGTAATAGT GTTGCAGGCG GTTGGGGTTG

551  TCGCCGTAGC GGCCGTCTTT GGGGCGGCGG CTGGGTTGGA CGTAGGCGGC

601  AAACCAAGGC TCGGGGCCGA GTGCGCGCAG GCAGGTGGCG GGATGGGATG

651  TGCCGGCACC GACTTCCATG TCGAAGGGTT GGATGACGGT GCAGCCTTTG

701  TCTGCCCAGA ATGTTTGCAG TTTGAAGATG ATTTGTTGGA AGGTAAGCAT

751  GGCTTATGA
```

This corresponds to the amino acid sequence <SEQ ID 1136; ORF 277>:

```
m277.pep
  1  MPRFEDKLVG RQGEGGVFFG KQAFGLRFVV VELAQQPVGI AVFEVVGGLL
```

-continued
```
 51 DFVLVVHVAV GDGVAVERFC PNEVVDVFYT LQVHRQAFDA VGDFAEYGRA

101 VDAADLLEIG KLGYFHAVEP DFPAQTPRAE GGVFPVVFDK ADVVDFGIDA

151 QFAQRVEIEV LDIGGSGLEG DLELVIVLQA VGVVAVAAVF GAAAGLDVGG

201 KPRLGAECAQ AGGGMGCAGT DFHVEGLDDG AAFVCPECLQ FEDDLLEGKH

251 GL*
```

Computer analysis of this amino acid sequence gave the following results:
Homology with a Predicted ORF from *N. gonorrhoeae*
ORF 277 shows 90.0% identity over a 221 aa overlap with a predicted ORF (ORF 277.ng) from *N. gonorrhoeae*:

```
   g277/m277

10        20        30
            g277.pep                  MVHVAVAYGIAVRRFCPNEVIDVFHALQVH
                                      :|||||: |:||:|||||||:|||::||||
            m277     GLRFVVVELAQQPVGIAVFEVVGGLLDFVLVVHVAVGDGVAVERFCPNEVVDVFYTLQVH
                     30        40        50        60        70        80
                     40        50        60        70        80        90
            g277.pep RQAFDAVGNFAEYGRAIDTADLLEIGKLGYFHAVEPDFPAQTPRTEGGVFPVVFDKADVV
                     ||||||||:|||||||:|:|||||||||||||||||||||||||:|||||||||||||||
            m277     RQAFDAVGDFAEYGRAVDAADLLEIGKLGYFHAVEPDFPAQTPRAEGGVFPVVFDKADVV
                     90        100       110       120       130       140
                     100       110       120       130       140       150
            g277.pep DFGIDAQFAQGVEIEVLDIGGGGFEGDLELVIVLQAVGVVAVAAVFGAAAGLDVGGKPRL
                     |||||||||| ||||||||||::|:|||||||||||||||||||||||||||||||||||
            m277     DFGIDAQFAQRVEIEVLDIGGSGLEGDLELVIVLQAVGVVAVAAVFGAAAGLDVGGKPRL
                     150       160       170       180       190       200
                     160       170       180       190       200
            g277.pep GAERAQAGGGMGCAGTDFHVEGLDDGAAFVCPEGLQFEDDLLEGKHGLL
                     ||| |||||||||||||||||||||||||||||| ||||||||||||||
            m277     GAECAQAGGGMGCAGTDFHVEGLDDGAAFVCPECLQFEDDLLEGKHGLX
                     210       220       230       240       250
```

The following partial DNA sequence was identified in *N. meningitidis* <SEQ ID 1137>:

```
a277.seq
   1 ATGCCCCGCT TGAGGACAA GCTCGTAGGC AGGCAGGGCG AGGGCGGCGT

51 TTTCTTCGGC AAGCAGGCGT TTGGCTTGCG CTTCGTAGTC GTTGAACTGG

101 CGCAGCAGCC AATCGGCATC GCTGTATTCG AAGTTGTAGG TGGATTGTTC

151 GACTTCGTTT TGGTGGTACA CGTCGCCGTA AGTTACTGTA TTACCGTCCA

201 GCGTTTTTGC CCAAACGAGG TCATAGACGT TTTCCACGCC TTGCAGGTAC

251 ATCGCCAAGC GTTCGATGCC GTAGGTGATT TCGCCGAGTA CGGGGGTGCA

301 GTCGATGCCG CCGACTTGTT GGAAATAGGT GAACTGGGTT ACTTCCATAC

351 CGTTGAGCCA GACTTCCCAG CCCAAACCCC ACGCGCCGAG GGTGGGGTTT

401 TCCCAGTCGT CTTCGACAAA GCGGATGTCG TGCACTTTGG GGTCGATGCC

451 CAATTCGCGC AGGGAGTCGA GATAGAGGTC TTGGATATTG GCGGGAGCGG

501 GCTTGAGGGC GACTTGGAAT TGGTAATAGT GTTGCAGGCG GTTGGGGTTG

551 TCGCCGTAGC GACCGTCTTT GGGGCGGCGG CTGGGTTGGA CGTAGGCGGC

601 AAACCAAGGC TCGGGGCCGA GTGCGCGCAG ACAGGTGGCG GGATGGGATG

651 TGCCGGCACC GACTTCCATG TCGAAGGGTT GGATGACGGT GCAGCCTTTG
```

```
701 TCTGCCCAGA ATGTTTGCAG TTTGAAGATG ATTTGTTGGA AGGTAAGCAT

751 GGCTTATGA
```

This corresponds to the amino acid sequence <SEQ ID 1138; ORF 277.a>:

```
a277.pep
    1 MPRFEDKLVG RQGEGGVFFG KQAFGLRFVV VELAQQPIGI AVFEVVGGLF

51 DFVLVVHVAV SYCITVQRFC PNEVIDVFHA LQVHRQAFDA VGDFAEYGGA

101 VDAADLLEIG ELGYFHTVEP DFPAQTPRAE GGVFPVVFDK ADVVHFGVDA

151 QFAQGVEIEV LDIGGSGLEG DLELVIVLQA VGVVAVATVF GAAAGLDVGG

201 KPRLGAECAQ TGGGMGCAGT DFHVEGLDDG AAFVCPECLQ FEDDLLEGKH

251 GL*
``` m277/a277 92.5% identity in 252 aa overlap

```
                  10         20         30         40         50         60
    m277.pep MPRFEDKLVGRQGEGGVFFGKQAFGLRFVVVELAQQPVGIAVFEVVGGLLDFVLVVHVAV
            ||||||||||||||||||||||||||||||||||||:||||||||||||:|||||||||
    a277    MPRFEDKLVGRQGEGGVFFGKQAFGLRFVVVELAQQPIGIAVFEVVGGLFDFVLVVHVAV
                  10         20         30         40         50         60

70         80         90        100        110        120
    m277.pep GDGVAVERFCPNEVVDVFYTLQVHRQAFDAVGDFAEYGRAVDAADDLLEIGHKLGYFHAVEP
            : ::|:||||||:|||:|||||||||||||||||||| ||||||||||||:|||||:|||
    a277    SYCITVQRFCPNEVIDVFHALQVHRQAFDAVGDFAEYGGAVDAADDLLEIGHELGYFHTVEP
                  70         80         90        100        110        120

130        140        150        160        170        180
    m277.pep DFPAQTPRAEGGVFPVVFDKADVVDFGIDAQFAQRVEIEVLDIGGSGLEGDLELVIVLQA
            |||||||||||||||||||||||||::||||||:||||||||||||||||||||||||||
    a277    DFPAQTPRAEGGVFPVVFDKADVVHFGVDAQFAQGVEIEVLDIGGSGLEGDLELVIVLQA
                 130        140        150        160        170        180

190        200        210        220        230        240
    m277.pep VGVVAVAAVFGAAAGLDVGGKPRLGAECAQAGGGMGCAGTDFHVEGLDDGAAFVCPECLQ
            ||||||||:|||||||||||||||||||||:|||||||||||||||||||||||||||||
    a277    VGVVAVATVFGAAAGLDVGGKPRLGAECAQTGGGMGCAGTDFHVEGLDDGAAFVCPECLQ
                 190        200        210        220        230        240

250
    m277.pep FEDDLLEGKHGLX
            |||||||||||||
    a277    FEDDLLEGKHGLX
                 250
```

The following partial DNA sequence was identified in *N. gonorrhoeae* <SEQ ID 1139>:

```
g278.seq (partial)
    1 ttgcgtgcaa tcacgcccgg tgcgattttt tcgacagggg cggtcaaagt 51 tgtattaatc ggacctttgc cgtcgatagg ccgacccaat gcatcgacga 101 cgcgtccgac caattcgcgt ccgaccggca cttctaaaat acggccggta 151 caggtaaccg tgtcgccttc tttaatatgt tcgtactcgc ccaacactac 201 ggcaccgacg gagtcgcgct ccaggttcat cgccaagcct aaagtgttac 251 ccgggaattc gagcatctca ccttgcattg catctgacaa accatggatg 301 cgaacgatac cgtcagttac cgaaatcacc gtaccacggg tactcacttc 351 ggcatttaca gacagatttt cgatcttggc tttaatcaga tcgctaattt 401 cagcaggatt aagctgcatg aaaactctcc taattcgtca tagtcgtgta
```

-continued

```
451 caaagcactc agtttgcctt gtacagacaa atccaaaacc tgatcaccca 501 cttcaacttt ta . . .
```

This corresponds to the amino acid sequence <SEQ ID 1140; ORF 278.ng>:

```
g278.pep (partial)
  1 LRAITPGAIF STGAVKVVLI GPLPSIGRPN ASTTRPTNSR PTGTSKIRPV

51 QVTVSPSLIC SYSPNTTAPT ESRSRFIAKP KVLPGNSSIS PCIASDKPWM

101 RTIPSVTEIT VPRVLTSAFT DRFSILALIR SLISAGLSCM KTLLIRHSRV

151 QSTQFALYRQ IQNLITHFNF . . .
```

The following partial DNA sequence was identified in *N. meningitidis* <SEQ ID 1141>:

```
m278.seq . . .
  1 TTGCGCGCAA TCACGCCCGG TGCGATTTTT TCGATAGGGG CGGTCAAAGT

51 TGTATTAATC GGGCCTTTGC CGTCGATAGG CCGACCCAAT GCATCAACGA

101 CGCGTCCGAC CAGTTCGCGT CCGACCGGCA CTTCCAAGAT ACGACCGGTA

151 CAGGTAACCG TGTCGCCTTC TTTAATGTGT TCGTACTCGC CCAACACTAC

201 GGCGCCGACG GAGTCGCGCT CCAGGTTCAT CGCCAAGCCG AAAGTGTTAC

251 CCGGGAATTC GAGCATCTCA CCTTGCATTG CATCTGACAA ACCATGGATG

301 CGAACGATAC CGTCAGTTAC CGAAATTACC GTACCACAGG TACGCACTTC

351 GGCATTTACA GACAGATTTT CGATCTTGGC TTTAATCAAA TCGCTAATTT

401 CAGCAGGATT AAGCTGCATG AAAACTCTCC TAATTCGTCA TAGTCGTGTA

451 CAAGGCACTC AATTTGCCTT GTACAGACAA ATCCAAAACC TGATCACCCA

501 CTTCAACTTT TATGCCGCCA ATCAGCTCCG GTTCGATTTC GACAGAGATT

551 TTCAGCTCGC TGTCGAAACG CTTATTCAGC ATTTGCACCA ACTCGCCGAC

601 CTGTTTGTCG GTCAACGGAT AGGCACTGTA AATGACGGCA GATTTGATAT

651 GGTTGAATGA
```

This corresponds to the amino acid sequence <SEQ ID 1142; ORF 278>:

```
m278.pep
  1 LRAITPGAIF SIGAVKVVLI GPLPSIGRPN ASTTRPTSSR PTGTSKIRPV

51 QVTVSPSLMC SYSPNTTAPT ESRSRFIAKP KVLPGNSSIS PCIASDKPWM

101 RTIPSVTEIT VPQVRTSAFT DRFSILALIK SLISAGLSCM KTLLIRHSRV

151 QGTQFALYRQ IQNLITHFNF YAANQLRFDF DRDFQLAVET LIQHLHQLAD

201 LFVGQRIGTV NDGRFDMVE*
```

Computer analysis of this amino acid sequence gave the following results:
Homology with a Predicted ORF from N. gonorrhoeae
ORF 278 shows 95.9% identity over a 170 aa overlap with a predicted ORF (ORF 278.ng) from N. gonorrhoeae:

```
    g278/m278
                    10         20         30         40         50         60
        g278.pep LRAITPGAIFSTGAVKVVLIGPLPSIGRPNASTTRPTNSRPTGTSKIRPVQTVSPSLIC
                ||||||||||| |||||||||||||||||||||||| ||||||||||||||||||||||:|
        m278    LRAITPGAIFSIGAVKVVLIGPLPSIGRPNASTTRPTSSRPTGTSKIRPVQTVSPSLMS
                    10         20         30         40         50         60

70         80         90        100        110        120
        g278.pep SYSPNTTAPTESRSRFIAKPKVLPGNSSISPCIASDKPWMRTIPSVTEITVPRVLTSAFT
                |||||| |||||||||||||||||||||||||||||||||||||||||||||:| |||||
        m278    SYSPNITAPTESRSRFIAKPKVLPGNSSISPCIASDKPWMRTIPSVTEITVPQVRTSAFT
                    70         80         90        100        110        120

130        140        150        160        170
        g278.pep DRFSILALIRSLISAGLSCMKTLLIRHSRVQSTQFALYRQIQNLITHFNF
                |||||||||:||||||||||||||||||||:|||||||||||||||||||
        m278    DRFSILALIKSLISAGLSCMKTLLIRHSRVQGTQFALYRQIQNLITHFNFYAANQLRFDF
                   130        140        150        160        170        180 m278    DRDFQLAVETLIQHLHQLADLFVGQRIGTVNDGRFDMVE*
                   190        200        210
```

The following partial DNA sequence was identified in N. meningitidis <SEQ ID 1143>:

```
a278.seq
    1 TTGCGCGCAA TCACGCCCGG TGCGATTTTT TCGATAGGGG CGGTCAAAGT

51 TGTATTAATC GGGCCTTTGC CGTCGATAGG CCGACCCAAT GCATCAACGA

101 CGCGTCCGAC CAGTTCGCGT CCGACCGGCA CTTCCAAGAT ACGACCGGTA

151 CAGGTAACCG TGTCGCCTTC TTTAATATGT TCGTGCTCGC CCAACACTAC

201 GGCGCCGACG GAGTCGCGCT CCAGGTTCAT CGCCAAGCCG AAAGTGTTAC

251 CCGGGAATTC GAGCATCTCA CCTTGCATTG CATCTGACAA ACCATGGATG

301 CGAACGATAC CGTCAGTTAC CGAAATCACC GTACCACGGG TACGCACTTC

351 GGCATTTACA GACAGATTTT CGATCTTGGC TTTAATCAAA TCGCTAATTT

401 CAGCAGGATT AAGCTGCATG AAAACTCTCC TAATTCGTCA TAGTCGTGTA

451 CAAGGCACTC AATTTGCCTT GTACAGACAA ATCCAAAACC TGATCACCCA

501 CTTCAACTTT TATGCCGCCA ATCAGCTCCG GTTCGATTTC GACAGAGATT

551 TTCAGCTCGC TGTCGAAACG CTTATTCAGC ATTTGCGCCA ACTCGCCGAC

601 CTGTTTGTCG GTCAACGGAT AGGCACTGTA AATGACGGCA GATTTGATAT

651 GGTTGAATGA
```

This corresponds to the amino acid sequence <SEQ ID 1144; ORF 278.a>:

```
a278.pep
    1 LRAITPGAIF SIGAVKVVLI GPLPSIGRPN ASTTRPTSSR PTGTSKIRPV

51 QVTVSPSLIC SCSPNTTAPT ESRSRFIAKP KVLPGNSSIS PCIASDKPWM

101 RTIPSVTEIT VPRVRTSAFT DRFSILALIK SLISAGLSCM KTLLIRHSRV

151 QGTQFALYRQ IQNLITHFNF YAANQLRFDF DRDFQLAVET LIQHLRQLAD

201 LFVGQRIGTV NDGRFDMVE*
``` m278/a278 98.2% identity in 219 aa overlap

```
                10         20         30         40         50         60
m278.pep  LRAITPGAIFSIGAVKVVLIGPLPSIGRPNASTTRPTSSRPTGTSKIRPVQVTVSPSLMC
          ||||||||||||||||||||||||||||||||||||||||||||||||||||||||:|
a278      LRAITPGAIFSIGAVKVVLIGPLPSIGRPNASTTRPTSSRPTGTSKIRPVQVTVSPSLIS
                10         20         30         40         50         60

70         80         90        100        110        120
m278.pep  SYSPNTTAPTESRSRFIAKPKVLPGNSSISPCIASDKPWMRTIPSVTEITVPQVRTSAFT
          | |||||||||||||||||||||||||||||||||||||||||||||||:||||||
a278      SCSPNTTAPTESRSRFIAKPKVLPGNSSISPCIASDKPWMRTIPSVTEITVPRVRTSAFT
                70         80         90        100        110        120

130        140        150        160        170        180
m278.pep  DRFSILALIKSLISAGLSCMKTLLIRHSRVQGTQFALYRQIQNLITHFNFYAANQLRFDF
          ||||||||||||||||||||||||||||||||||||||||||||||||||||||||||||
a278      DRFSILALIKSLISAGLSCMKTLLIRHSRVQGTQFALYRQIQNLITHFNFYAANQLRFDF
               130        140        150        160        170        180

190        200        210        220
m278.pep  DRDFQLAVETLIQHLHQLADLFVGQRIGTVNDGRFDMVEX
          |||||||||||||:||||||||||||||||||||||||||
a278      DRDFQLAVETLIQHLRQLADLFVGQRIGTVDNGRFDMVEX
               190        200        210        220
```

The following partial DNA sequence was identified in *N. gonorrhoeae* <SEQ ID 1145>:

```
g279.seq
    1 atgacgcgga tttgcggctg cttgatttca acggttttga gtgtttcggc 51 aagtttgtcg gcggcgggtt tcatcaggct gcaatgggaa ggaacggata 101 ccggcagcgg cagggcgcgt ttggctccgg cttctttggc ggcagccatg 151 gtgcgtccga cggcggcggc gttgcctgca atcacgactt gtccgggcga 201 gttgaagttg acggcttcga ccacttcgcc ctgtgcggat tcggcacaaa 251 tctgcctgac ctgttcatct tccaaaccca aaatggccgc cattgcgcct 301 acgccttgcg gtacggcgga ctgcatcagt tcggcgcgca ggcggacgag 351 tttgacggca tcggcaaaat ccaatgcttc ggcggcgaca agcgcggtgt 401 attcgccgag gctgtgtccg gcaacggcgg caggcgtttt gccgcccact 451 tccaaatag
```

This corresponds to the amino acid sequence <SEQ ID 1146; ORF 279.ng>:

```
g279.pep
    1 MTRICGCLIS TVLSVSASLS AAGFIRLQWE GTDTGSGRAR LAPASLAAAM

51 VRPTAAALPA ITTCPGELKL TASTTSPCAD SAQICLTCSS SKPKMAAIAP

101 TPCGTADCIS SARRRTSLTA SAKSNASAAT SAVYSPRLCP ATAAGVLPPT

151 SK*
```

The following partial DNA sequence was identified in *N. meningitidis* <SEQ ID 1147>:

```
m279.seq
    1 ATAACGCGGA TTTGCGGCTG CTTGATTTCA ACGGTTTTCA GGGCTTCGGC

51 AAGTTTGTCG GCGGCGGGTT TCATCAGGCT GCAATGGGAA GGTACGGACA

101 CGGGCAGCGG CAGGGCGCGT TTGGCACCGG CTTCTTTGGC GGCAGCCATG

151 GCGCGTCCGA CGGCGGCGGC GTTGCCTGCA ATCACGATTT GTCCGGGTGA
```

```
-continued
201 GTTGAAGTTG ACGGCTTCGA CCACTTCGCT TTGGGCGGCT TCGGCACAAA

251 TGGCTTTAAC CTGCTCATCT TCCAAGCCGA GAATCGCCGC CATTGCGCCC

301 ACGCCTTGCG GTACGGCGGA CTGCATCAGT TCGGCGCGCA GGCGCACGAG

351 TTTGACCGCG TCGGCAAAAT TCAATGCGCC GGCGGCAACG AGTGCGGTGT

401 ATTCGCCGAG GCTGTGTCCG GCAACGGCGG CAGGCGTTTT GCCGCCCGCT

451 TCTAAATAG
```

This corresponds to the amino acid sequence <SEQ ID 1148; ORF 279>:

```
m279.pep
  1 ITRICGCLIS TVFRASASLS AAGFIRLQWE GTDTGSGRAR LAPASLAAAM

51 ARPTAAALPA ITICPGELKL TASTTSLWAA SAQMALTCSS SKPRIAAIAP

101 TPCGTADCIS SARRRTSLTA SAKFNAPAAT SAVYSPRLCP ATAAGVLPPA

151 SK*
```

Computer analysis of this amino acid sequence gave the following results:

Homology with a Predicted ORF from *N. gonorrhoeae*

ORF 279 shows 89.5% identity over a 152 aa overlap with a predicted ORF (ORF 279.ng) from *N. gonorrhoeae*:

```
                    10         20         30         40         50         60
m279.pep    ITRICGCLISTVFRASASLSAAGFIRLQWEGTDTGSGRARLAPASLAAAMARPTAAALPA
            :||||||||||:  :|||||||||||||||||||||||||||||||||||:||||||||
g279        MTRICGCLISTVLSVSASLSAAGFIRLQWEGTDTGSGRARLAPASLAAAMVRPTAAALPA
                    10         20         30         40         50         60

70         80         90        100        110        120
m279.pep    ITICPGELKLTASTTSLWAASAQMALTCSSSKPRIAAIAPTPCGTADCISSARRRTSLTA
            ||  |||||||||||||| |  |||::||||||::|||||||||||||||||||||||||
g279        ITTCPGELKLTASTTSPCADSAQICLTCSSSKPKMAAIAPTPCGTADCISSARRRTSLTA
                    70         80         90        100        110        120

130        140        150
m279.pep    SAKFNAPAATSAVYSPRLCPATAAGVLPPASKX
            |||  ||  ||||||||||||||||||||:|||
g279        SAKSNASAATSAVYSPRLCPATAAGVLPPTSKX
                   130        140        150
```

The following partial DNA sequence was identified in *N. meningitidis* <SEQ ID 1149>:

```
a279.seq
  1 ATGACNCNGA TTTGCGGCTG CTTGATTTCA ACGGTTTNNA GGGCTTCGGC

51 GAGTTTGTCG GCGGCGGGTT TCATGAGGCT GCAATGGGAA GGTACNGACA

101 CNGGCAGCGG CAGGGCGCGT TTGGCGCCGG CTTCTTTGGC GGCAAGCATA

151 GCGCGCTCGA CGGCGGCGGC ATTGCCTGCA ATCACGACTT GTCCGGGCGA

201 GTTGAAGTTG ACGGCTTCAA CCACTTCATC CTGTGCGGAT TCGGCGCAAA

251 TTTGTTTTAC CTGTTCATCT TCCAAGCCGA GAATCGCCGC CATTGCGCCC

301 ACGCCTTGCG GTACGGCGGA CTGCATCAGT TCGGCGCGCA NGCGCACGAG

351 TTTGACCGCG TCGGCAAAAT CCAATGCGCC GGCGGCAACN AGTGCGGTGT

401 ATTCGCCGAN GCTGTGTCCG GCAACGGCGG CAGGCGTTTT GCCGCCCGCT

451 TCCGAATAG
```

This corresponds to the amino acid sequence <SEQ ID 1150; ORF 279.a>:

```
a279.pep
   1 MTXICGCLIS TVXRASASLS AAGFMRLQWE GTDTGSGRAR LAPASLAASI

51 ARSTAAALPA ITTCPGELKL TASTTSSCAD SAQICFTCSS SKPRIAAIAP

101 TPCGTADCIS SARXRTSLTA SAKSNAPAAT SAVYSPXLCP ATAAGVLPPA

151 SE*
``` m279/a279 88.2% identity in 152 aa overlap

```
                    10         20         30         40         50         60
   m279.pep  ITRICGCLISTVFRASASLSAAGFIRLQWEGTDTGSGRARLAPASLAAAMARPTAAALPA
             :| |||||||||  ||||||||||||:||||||||||||||||||||||||::|| ||||||
   a279      MTXICGCLISTVXRASASLSAAGFMRLQWEGTDTGSGRARLAPASLAASIARSTAAALPA
                    10         20         30         40         50         60

70         80         90        100        110        120
   m279.pep  ITICPGELKLTASTTSLWAASAQMALTCSSSKPRIAAIAPTPCGTADCISSARRRTSLTA
             || |||||||||||||  | |||: :||||||||||||||||||||||||||||| ||||||
   a279      ITTCPGELKLTASTTSSCADSAQICFTCSSSKPRIAAIAPTPCGTADCISSARXRTSLTA
                    70         80         90        100        110        120

130        140        150
   m279.pep  SAKFNAPAATSAVYSPRLCPATAAGVLPPASKX
             ||| |||||||||||||| |||||||||||||:|
   a279      SAKSNAPAATSAVYSPXLCPATAAGVLPPASEX
                   130        140        150
```

Expression of ORF 279

The primer described in Table 1 for ORF 279 was used to locate and clone ORF 279. ORF 279 was cloned in pET and pGex vectors and expressed in E. coli as above-described. The products of protein expression and purification were analyzed by SDS-PAGE. FIG. 2A shows the results of affinity purification and FIG. 2B shows the expression in E. coli. Purified GST-fusion protein was used to immunize mice whose sera were used for ELISA (positive result), FACS analysis (FIG. 2C), western blot (FIG. 2D). These experiments confirm that 279 is a surface-exposed protein and that it is a useful immunogen. The hydrophilicity plots, antigenic index, and amphipatic regions of ORF 279 are provided in FIG. 6. The AMPHI program is used to predict putative T-cell epitopes (Gao et al 1989, *J. Immunol* 143:3007; Roberts et al. 1996, *AIDS Res Human Retroviruses* 12:593; Quakyi et al. 1992, *Scand J Immunol Suppl* 11:9). The nucleic acid sequence of ORF 279 and the amino acid sequence encoded thereby is provided herein.

The following partial DNA sequence was identified in *N. gonorrhoeae* <SEQ ID 1151>:

```
g280.seq
   1 atgaaacacc tcaaacttac ccttattgcc gcattgctgg ccaccgccgc 51 aactgccgca cccttccgg ttgtaaccag tttcagcatt ttaggcgacg 101 tagccaaaca aatcggcggt gagcgcgtag ccgtacaaag cctcgtcgga 151 gccaaccaag atactcatgc ctatcacatg accagtggcg acattaaaaa 201 aatccgcagt gcaaaactcg tcctgctcaa cggcttggga cttgaagccg 251 ccgacatcca acgcgccgtc aaacagagca aagtatccta tgccgaagcg 301 accaaaggca tccaacccct caaagccgaa gaagaaggcg gacaccatca 351 cgaccaccat cacgaccacg atcatgacca cgaaggacac caccacgacc 401 acggcgaata tgaccccac gtctggaacg accctgttct tatgtccgac
```

-continued
```
451 tatgcccaaa acgtcgctga aaccctgata aaggccgatc ccgaaggcaa 501 agtttattat caacaacgct tgggcaacta ccaaatgcag cttaaaaaac 551 tgcacagcga cgcacaagcc gcatttaatg ccgtccctgc cgccaaacgc 601 aaagtcctga ccgggcacga cgcattttcc tacatgggca accgctacaa 651 catcagcttc atcgccccgc aaggcgtgag cagcgaagcc gagccgtccg 701 ccaaacaagt cgccgccatc atccggcaaa tcaaacgcga aggcatcaaa 751 gccgtattta ccgaaaatat caaagacacc cgcatggttg accgcatcgc 801 caaagaaacc ggcgtcaacg tcagcggcaa actgtattcc gacgcactcg 851 gcaacgcgcc cgcagacacc tacatcggca tgtaccgcca caacgtcgaa 901 gccttgacca acgcgatgaa gcaataa
```

This corresponds to the amino acid sequence <SEQ ID 1152; ORF 280.ng>:

```
g280.pep
  1 MKHLKLTLIA ALLATAATAA PLPVVTSFSI LGDVAKQIGG ERVAVQSLVG

51 ANQDTHAYHM TSGDIKKIRS AKLVLLNGLG LEAADIQRAV KQSKVSYAEA

101 TKGIQPLKAE EEGGHHHDHH HDHDHDHEGH HHDHGEYDPH VWNDPVLMSD

151 YAQNVAETLI KADPEGKVYY QQRLGNYQMQ LKKLHSDAQA AFNAVPAAKR

201 KVLTGHDAFS YMGNRYNISF IAPQGVSSEA EPSAKQVAAI IRQIKREGIK

251 AVFTENIKDT RMVDRIAKET GVNVSGKLYS DALGNAPADT YIGMYRHNVE

301 ALTNAMKQ*
```

The following partial DNA sequence was identified in *N. meningitidis* <SEQ ID 1153>:

```
m280.seq
  1 ATGAAACACC TCAAACTCAC CCTTATTGCC GCATTGCTGA CCGCCTCCGC

51 AACTGCCGCC CCCCTGCCGG TTGTAACCAG CTTCAGCATT TTAGGCGACG

101 TAGCCAAACA AATCGGCGGA GAGCGCGTAT CCATACAAAG TTTGGTCGGA

151 GCCAACCAAG ATACGCACGC CTATCATATG ACCAGTGGCG ACATTAAAAA

201 AATCCGCAGT GCAAAACTCG TCCTGCTCAA CGGCTTAGGA CTTGAAGCTG

251 CCGATGTGCA ACGCGCCGTC AAACAAAGCA AAGTATCCTA TACCGAAGCG

301 ACCAAAGGCA TCCAACCCCT CAAAGCCGAA GAAGAAGGCG GACACCATCA

351 CGACCACGAT CATGACCACG AAGGACACCA CCATGACCAC GGCGAATATG

401 ACCCGCACGT CTGGAACGAC CCCGTCCTTA TGTCCGCCTA TGCCCAAAAC

451 GTTGCCAAAG CCCTGATAAA GGCCGATCCC GAAGGCAAAG TTTATTATCA

501 ACAACGCTTG GCAACTACC AAATGCAGCT CAAAAAACTG CACAGCGACG

551 CACAAGCCGC ATTTAATGCC GTCCCTGCTG CCAAACGCAA AGTCCTGACC

601 GGGCACGATG CCTTTTCCTA TATGGGCAAA CGTTACCATA TCGAATTCAT

651 CGCCCCGCAA GGCGTGAGCA GCGAAGCCGA GCCTTCGGCC AAACAAGTCG

701 CCGCCATCAT CCGACAAATC AAACGCGAAG GCATCAAAGC CGTCTTTACC

751 GAAAACATCA AGGACACCCG TATGGTTGAC CGTATCGCCA AAGAAACCGG

801 TGTCAACGTC AGCGGCAAAC TGTATTCCGA CGCACTCGGC AACGCGCCCG
```

```
851 CAGACACCTA CATCGGAATG TACCGCCACA ACATCAAAGC CTTGACCAAC

901 GCGATGAAGC AATAA
```

This corresponds to the amino acid sequence <SEQ ID 1154; ORF 280>:

```
m280.pep
  1 MKHLKLTLIA ALLTASATAA PLPVVTSFSI LGDVAKQIGG ERVSIQSLVG

51 ANQDTHAYHM TSGDIKKIRS AKLVLLNGLG LEAADVQRAV KQSKVSYTEA

101 TKGIQPLKAE EEGGHHHDHD HDHEGHHHDH GEYDPHVWND PVLMSAYAQN

151 VAKALIKADP EGKVYYQQRL GNYQMQLKKL HSDAQAAFNA VPAAKRKVLT

201 GHDAFSYMGK RYHIEFIAPQ GVSSEAEPSA KQVAAIIRQI KREGIKAVFT

251 ENIKDTRMVD RIAKETGVNV SGKLYSDALG NAPADTYIGM YRHNIKALTN

301 AMKQ*
```

Computer analysis of this amino acid sequence gave the following results:
Homology with a Predicted ORF from *N. gonorrhoeae*
ORF 280 shows 93.8% identity over a 308 aa overlap with a predicted ORF (ORF 280.ng) from *N. gonorrhoeae*:

```
    m280/g280
                        10         20         30         40         50         60
       m280.pep MKHLKLTLIAALLTASATAAPLPVVTSFSILGDVAKQIGGERVSIQSLVGANQDTHAYHM
                ||||||||||:::|||||||||||||||||||||||||||||:||||||||||||||||
           g280 MKHLKLTLIAALLATAATAAPLPVVTSFSILGDVAKQIGGERVAVQSLVGANQDTHAYHM
                        10         20         30         40         50         60

70         80         90        100        110       119
       m280.pep TSGDIKKIRSAKLVLLNGLGLEAADVQRAVKQSKVSYTEATKGIQPLKAEEEGGHHHDH-
                ||||||||||||||||||||||||||:|||||||||||||:||||||||||||||||||
           g280 TSGDIKKIRSAKLVLLNGLGLEAADIQRAVKQSKVSYAEATKGIQPLKAEEEGGHHHDHH
                        70         80         90        100        110       120

120        130        140        150        160        170
       m280.pep ---DHDHEGHHHDHGEYDPHVWNDPVLMSAYAQNVAKALIKADPEGKVYYQQRLGNYQMQ
                   |||||||||||||||||||||||||||| |||||::|||||||||||||||||||||
           g280 HDHDHDHEGHHHDHGEYDPHVWNDPVLMSDYAQNVAETLIKADPEGKVYYQQRLGNYQMQ
                       130        140        150        160        170        180

180        190        200        210        220        230
       m280.pep LKKLHSDAQAAFNAVPAAKRKVLTGHDAFSYMGKRYHIEFIAPQGVSSEAEPSAKQVAAI
                |||||||||||||||||||||||||||||||||:||:|||||||||||||||||||||
           g280 LKKLHSDAQAAFNAVPAAKRKVLTGHDAFSYMGNRYNISFIAPQGVSSEAEPSAKQVAAI
                       190        200        210        220        230        240

240        250        260        270        280        290
       m280.pep IRQIKREGIKAVFTENIKDTRMVDRIAKETGVNVSGKLYSDALGNAPADTYIGMYRHNIK
                ||||||||||||||||||||||||||||||||||||||||||||||||||||||||||::
           g280 IRQIKREGIKAVFTENIKDTRMVDRIAKETGVNVSGKLYSDALGNAPADTYIGMYRHNVE
                       250        260        270        280        290        300

300
       m280.pep ALTNAMKQX
                |||||||||
           g280 ALTNAMKQX
```

The following partial DNA sequence was identified in *N. meningitidis* <SEQ ID 1155>:

```
a280.seq
  1 ATGAAACACC CAAACTCAC CCTTATCGCC GCATTGCTGA CCACTGCCGC

51 AACTGCCGCC CCCCTGCCGG TTGTAACCAG CTTCAGCATT TTAGGCGACG
```

-continued

```
101 TAGCCAAACA AATCGGCGGA GAGCGCGTAT CCATACAAAG TTTGGTCGGA

151 GCCAACCAAG ATACGCACGC CTATCATATG ACCAGCGGCG ACATTAAAAA

201 AATCCGCAGT GCAAAACTCG TCCTGATTAA CGGCTTAGGA CTTGAAGCTG

251 CCGACATCCA ACGTGCCGTC AAACAGAGCA AAGTATCCTA TGCCGAAGCG

301 ACCAAAGGCA TCCAACCCCT CAAAGCCGAA GAAGAAGGCG GACACCATCA

351 CGACCACGAT CATGACCACG ACCATGACCA CGAAGGACAC CACCACGACC

401 ACGGCGAATA TGACCCCCAC GTCTGGAACG ACCCCGTCCT TATGTCCGCC

451 TATGCCCAAA ACGTCGCCGA AGCCCTGATA AAGGCCGACC CGAAGGCAA

501 AGTTTATTAT CAACAACGCT TGGGCAACTA CCAAATGCAG CTCAAAAAAC

551 TGCACAGTGA CGCACAAGCC GCATTTAATG CCGTCCCTGC CGCCAAACGC

601 AAAGTCCTGA CCGGGCACGA TGCCTTTTCC TATATGGGCA AACGTTACCA

651 TATCGAATTC ATCGCCCCAC AAGGTGTGAG CAGCGAAGCC GAGCCTTCAG

701 CCAAACAAGT CGCCGCCATC ATCCGACAAA TCAAACGCGA AGGCATCAAA

751 GCCGTATTTA CCGAAAATAT CAAAGACACC CGCATGGTTG ACCGCATCGC

801 CAAAGAAACC GGTGTCAACG TCAGCGGCAA ACTGTATTCC GACGCACTCG

851 GCAACGCACC CGCAGACACC TACATCGGCA TGTACCGCCA CAACATCAAA

901 GCCTTAACCA ACGCGATGAA GCAATAA
```

This corresponds to the amino acid sequence <SEQ ID 1156; ORF 280.a>:

```
a280.pep
  1 MKHPKLTLIA ALLTTAATAA PLPVVTSFSI LGDVAKQIGG ERVSIQSLVG

51 ANQDTHAYHM TSGDIKKIRS AKLVLINGLG LEAADIQRAV KQSKVSYAEA

101 TKGIQPLKAE EEGGHHHDHD HDHDHDHEGH HHDHGEYDPH VWNDPVLMSA

151 YAQNVAEALI KADPEGKVYY QQRLGNYQMQ LKKLHSDAQA AFNAVPAAKR

201 KVLTGHDAFS YMGKRYHIEF IAPQGVSSEA EPSAKQVAAI IRQIKREGIK

251 AVFTENIKDT RMVDRIAKET GVNVSGKLYS DALGNAPADT YIGMYRHNIK

301 ALTNAMKQ*
``` m280/a280 96.4% identity in 308 aa overlap

```
                    10         20         30         40         50         60
    m280.pep  MKHLKLTLIAALLTASATAAPLPVVTSFSILGDVAKQIGGERVSIQSLVGANQDTHAYHM
              ||| ||||||||||::|||||||||||||||||||||||||||| ||||||||||||||
        g280  MKHLKLTLIAALLATAATAAPLPVVTSFSILGDVAKQIGGERVAVQSLVGANQDTHAYHM
                    10         20         30         40         50         60

70         80         90        100        110        120
    m280.pep  TSGDIKKIRSAKLVLLNGLGLEAADVQRAVKQSKVSYTEATKGIQPLKAEEEGGHHHDHD
              |||||||||||||||||||||||||:||||||||||||:|||||||||||||||||||||
        g280  TSGDIKKIRSAKLVLLNGLGLEAADIQRAVKQSKVSYAEATKGIQPLKAEEEGGHHHDHD
                    70         80         90        100        110        120

130        140        150        160        170
    m280.pep  HDH----EGHHHDHGEYDPHVWNDPVLMSAYAQNVAKALIKADPEGKVYYQQRLGNYQMQ
              |||    ||||||||||||||||||||||||:|||||:||||||||||||||||||||||
        g280  HDHDHDHEGHHHDHGEYDPHVWNDPVLMSDYAQNVAETLIKADPEGKVYYQQRLGNYQMQ
                    130        140        150        160        170        180
```

```
             180        190        200        210        220        230
m280.pep  LKKLHSDAQAAFNAVPAAKRKVLTGHDAFSYMGKRYHIEFIAPQGVSSEAEPSAKQVAAI
          ||||||||||||||||||||||||||||||||||||||||||||||||||||||||||||
g280      LKKLHSDAQAAFNAVPAAKRKVLTGHDAFSYMGKRYHIEFIAPQGVSSEAEPSAKQVAAI
             190        200        210        220        230        240

240        250        260        270        280        290
m280.pep  IRQIKREGIKAVFTENIKDTRMVDRIAKETGVNVSGKLYSDALGNAPADTYIGMYRHNIK
          ||||||||||||||||||||||||||||||||||||||||||||||||||||||||||||
g280      IRQIKREGIKAVFTENIKDTRMVDRIAKETGVNVSGKLYSDALGNAPADTYIGMYRHNIK
             250        260        270        280        290        300

300
m280.pep  ALTNAMKQX
          |||||||||
g280      ALTNAMKQX
```

The following partial DNA sequence was identified in *N. gonorrhoeae* <SEQ ID 1157>:

```
g281.seq
    1 atgcactacg ccctcgcatc cgtcttctgc ctgtccctca gcgccgcacc
   51 cgtcggcgta ttcctcgtca tgcgccgtat gagcctgata ggcgacgcat
  101 tgagccacgc cgtcctgccc ggtgccgccg tcggctacat gtttgccggc
  151 ttgagcctgc ccgctatggg tgtgggcggg tttgccgccg gtatgctgat
  201 ggcgctgctt gccggactcg tcagccgctt taccaccctg aaagaagatg
  251 ccaactttgc cgccttttac ctgagcagcc tcgccatcgg cgtaatcctc
  301 atcagcaaaa acggcagcag cgtcgattta ctccacctcc ttttcggatc
  351 tgtgcttgcc gtcgatattc ccgcactgca actcatcgcc gccgtctccg
  401 gcctcacgct cattaccctt gccgtcatct accgccccct ggtgctagaa
  451 agcatagacc ccttttcct caagtccgtc aacggcaaag cgggctttg
  501 gcacgtcatt ttcctcatcc tcgtcgttat gaacctcgta tccggcttcc
  551 aagctctcgg catcctgatg tcggtcggaa ttatgatgct gcccgccatt
  601 accgcccgtt tatgggcaag aaatatgggg acgctcattc tgttgtccgt
  651 cctcatcgcc cttttttgcg gtttgatcgg gctgctcatt tcctaccaca
  701 tcgaaatccc ttccggcccc gccatcatcc tctgttgcag cgtcctttat
  751 cttttttccg tcatactcgg caaagaaggc ggcatcttgc ccaaatggtt
  801 caaaaaccac cgccaccaca ccacctga
```

This corresponds to the amino acid sequence <SEQ ID 1158; ORF 281.ng>:

```
g281.pep
    1 MHYALASVFC LSLSAAPVGV FLVMRRMSLI GDALSHAVLP GAAVGYMFAG

51 LSLPAMGVGG FAAGMLMALL AGLVSRFTTL KEDANFAAFY LSSLAIGVIL

101 ISKNGSSVDL LHLLFGSVLA VDIPALQLIA AVSGLTLITL AVIYRPLVLE

151 SIDPLFLKSV NGKGGLWHVI FLILVVMNLV SGFQALGILM SVGIMMLPAI

201 TARLWARNMG TLILLSVLIA LFCGLIGLLI SYHIEIPSGP AIILCCSVLY

251 LFSVILGKEG GILPKWFKNH RHHTT*
```

The following partial DNA sequence was identified in *N. meningitidis* <SEQ ID 1159>:

```
m281.seq (partial)
    1 ATGCGCTACG CCCTCGCATC CGTCTTCTGC CTGTCCCTCA GTGCCGCACC

51 CGTCGGCGTA TTCCTCGTCA TGCGCCGTAT GAGCCTGATA GGCGACGCAT

101 TGAGCCACGC CGTCCTGCCC GGTGCCGCCG TCGGCTACAT GTTTGCCGGC

151 TTGAGCCTGC CCGCCATGGG TTTGGGCGGC GTAGCCGCAG GCATGCTGAT

201 GGCACTGCTT GCCGGACTCG TCAGCCGCTT CACCACCCTG AAAGAAGATG

251 CCAACTTTGC CGCCTTTTAT CTCAGCAGCC TCGCCATCGG CGTAGTCCTC

301 GTCAGCAAAA ACGGGAGCAG CGTCGATTTG CTCCACCTCC TTTTCGGCTC

351 TGTACTTGCC GTCGATATTC CTGCCCTGCA GCTCATCGCC GCCGTCTCCA

401 GCCTCACGCT CATTACCCTT GCCGTCATCT ACCGCCCGCT CGTACTCGAA

451 AGCATCGACC CCCTGTTTCT CAAATCCGTC GGCGGCAAAG GCGGGCTTTG

501 GCACGTCCTC TTTCTCGTCC TGGTCGTCAT GAACCTCGTA TCCGGCTTTC

551 AAGCCCTCGG CACACTCATG TCCGTCGGAC TCATGATGCT GCCAGCCATT

601 ACCGCCCGCC TGTGGGCGAA GCATATGGGC GCACTCATCC TCCTATCCGT

651 TCTGACAGCC CTGCTGTGCG GCTTGAGCGG ACTGCTCATT CCTACCACA

701 TCGAAATTCC TTCCGGTCCC GCCATCATCC TCTGTTGCAG CGTCCTTTAT

751 CTCTTTTCCG TCATACTCGG CAAAGAAGGC GGCATTCTGA CC..
```

This corresponds to the amino acid sequence <SEQ ID 1160; ORF 281>:

```
m281.pep (partial)
    1 MRYALASVFC LSLSAAPVGV FLVMRRMSLI GDALSHAVLP GAAVGYMFAG

51 LSLPAMGLGG VAAGMLMALL AGLVSRFTTL KEDANFAAFY LSSLAIGVVL

101 VSKNGSSVDL LHLLFGSVLA VDIPALQLIA AVSSLTLITL AVIYRPLVLE

151 SIDPLFLKSV GGKGGLWHVL FLVLVVMNLV SGFCALGILM SVGLMMLPAI

201 TARLWAKHMG ALILLSVLTA LLCGLSGLLI SYHIEIPSGP AIILCCSVLY

251 LFSVILGKEG GILT . . .
                                                       45
```

Computer analysis of this amino acid sequence gave the following results:
Homology with a Predicted ORF from *N. gonorrhoeae*
ORF 281 shows 93.5% identity over a 263 aa overlap with a predicted ORF (ORF 281.ng) from *N. gonorrhoeae*:

```
    m281/g281

10         20         30         40         50         60
    m281.pep MRYALASVFCLSLSAAPVGVFLVMRRMSLIGDALSHAVLPGAAVGYMFAGLSLPAMGLGG
             |:||||||||||||||||||||||||||||||||||||||||||||||||||||||:||
    g281     MHYALASVFCLSLSAAPVGVFLVMRRMSLIGDALSHAVLPGAAVGYMFAGLSLPAMGVGG
                     10         20         30         40         50         60

70         80         90        100        110        120
    m281.pep VAAGMLMALLAGLVSRFTTLKEDANFAAFYLSSLAIGVVLVSKNGSSVDLLHLLFGSVLA
             |||||||||||||||||||||||||||||||||||||||:|:||||||||||||||||||
    g281     FAAGMLMALLAGLVSRFTTLKEDANFAAFYLSSLAIGVILISKNGSSVDLLHLLFGSVLA
                     70         80         90        100        110        120

130        140        150        160        170        180
    m281.pep VDIPALQLIAAVSSLTLITLAVIYRPLVLESIDPLFLKSVGGKGGLWHVLFLVLVVMNLV
             ||||||||||||:|||||||||||||||||||||||||||:||||||:||:||||||||
    g281     VDIPALQLIAAVSGLTLITLAVIYRPLVLESIDPLFLKSVNGKGGLWHVIFLILVVMNLV
                    130        140        150        160        170        180
```

-continued

```
                190       200       210       220       230       240
m281.pep  SGFQALGTLMSVGLMMLPAITARLWAKHMGALILLSVLTALLCGLSGLLISYHIEIPSGP
          ||||||| |||||:||||||||||||::||:||||||| ||:||| ||||||||||||||
g281      SGFQALGILMSVGIMMLPAITARLWARNMGTLILLSVLIALFCGLIGLLISYHIEIPSGP
                190       200       210       220       230       240

250       260
m281.pep  AIILCCSVLYLFSVILGKEGGILT
          |||||||||||||||||||||||
g281      AIILCCSVLYLFSVILGKEGGILPKWFKNHRHHTTX
                250       260       270
```

The following partial DNA sequence was identified in *N. meningitidis* <SEQ ID 1161>:

```
a281.seq
    1 ATGCGCTACG CCCTCGCATC CGTCTTCTGC CTGTCCCTCA GTGCCGCACC

51 CGTCGGCGTA TTCCTCGTCA TGCGCCGTAT GAGCCTGATA GGCGACGCAT

101 TGAGCCACGC CGTCCTGCCC GGTGCCGCCG TCGGCTACAT GTTTGCCGGC

151 TTAAGCCTGC CCGCCATGGG TTTGGGCGGC GTAGCCGCAG GTATGCTGAT

201 GGCACTGCTT GCCGGACTCG TCAGCCGCTT CACCACCCTG AAAGAAGATG

251 CCAACTTTGC CGCCTTTTAT CTCAGCAGCC TCGCCATCGG TGTAGTCCTC

301 GTCAGCAAAA ACGGCAGCAG CGTCGATTTG CTCCACCTCC TTTTCGGCTC

351 CGTACTTGCC GTCGATATTC CTGCCCTGCA ACTCATCGCC GCCGTATCCA

401 CCCTCACACT GCTTACCCTT GCCGTCATCT ACCGCCCGCT CGTACTCGAA

451 AGCATCGACC CCCTGTTTCT CAAATCTGTC GGCGGCAAAG GCGGGCTTTG

501 GCACGTCCTC TTTCTCGTCC TGGTCGTCAT GAACCTCGTA TCCGGCTTTC

551 AAGCCCTCGG CACACTCATG TCCGTCGGAC TTATGATGCT GCCAGCCATT

601 ACCGCCCGCC TATGGGCGAA GCACATGGGC GCACTCATCC TCCTATCCGT

651 TCTGACAGCC CTGCTGTGCG GCTTGAGCGG ACTGCTCATT TCCTACCACA

701 TCGAAATTCC TTCCGGTCCC GCCATCATCC TCTGTTGCAG CGTCCTTTAT

751 CTCTTTTCCG TCATACTCGG CAAAGAAGGC GGCATTCTGA CCAAATGGCT

801 CAAAAACCAC CGCCACCACA CCACCTGA
```

This corresponds to the amino acid sequence <SEQ ID 1162; ORF 281.a>:

```
a281.pep
    1 MRYALASVFC LSLSAAPVGV FLVMRRMSLI GDALSHAVLP GAAVGYMFAG

51 LSLPAMGLGG VAAGMLMALL AGLVSRFTTL KEDANFAAFY LSSLAIGVVL

101 VSKNGSSVDL LHLLFGSVLA VDIPALQLIA AVSTLTLLTL AVIYRPLVLE

151 SIDPLFLKSV GGKGGLWHVL FLVLVVMNLV SGFQALGTLM SVGLMMLPAI

201 TARLWAKHMG ALILLSVLTA LLCGLSGLLI SYHIEIPSGP AIILCCSVLY

251 LFSVILGKEG GILTKWLKNH RHHTT*
``` m281/a281 99.2% identity in 264 aa overlap

```
                 10        20        30        40        50        60
m281.pep  MRYALASVFCLSLSAAPVGVFLVMRRMSLIGDALSHAVLPGAAVGYMFAGLSLPAMGLGG
          ||||||||||||||||||||||||||||||||||||||||||||||||||||||||| ||
a281      MRYALASVFCLSLSAAPVGVFLVMRRMSLIGDALSHAVLPGAAVGYMFAGLSLPAMGVGG
                 10        20        30        40        50        60
```

```
                 70        80        90       100       110       120
m281.pep  VAAGMLMALLAGLVSRFTTLKEDANFAAFYLSSLAIGVVLVSKNGSSVDLLHLLFGSVLA
          ||||||||||||||||||||||||||||||||||||||||||||||||||||||||||||
a281      VAAGMLMALLAGLVSRFTTLKEDANFAAFYLSSLAIGVVLVSKNGSSVDLLHLLFGSVLA
                 70        80        90       100       110       120

130       140       150       160       170       180
m281.pep  VDIPALQLIAAVSSLTLITLAVIYRPLVLESIDPLFLKSVGGKGGLWHVLFLVLVVMNLV
          ||||||||||||:|||:|||||||||||||||||||||||||||||||||||||||||||
a281      VDIPALQLIAAVSTLTLLTLAVIYRPLVLESIDPLFLKSVGGKGGLWHVLFLVLVVMNLV
                130       140       150       160       170       180

190       200       210       220       230       240
m281.pep  SGFQALGTLMSVGLMMLPAITARLWAKHMGALILLSVLTALLCGLSGLLISYHIEIPSGP
          ||||||||||||||||||||||||||||||||||||||||||||||||||||||||||||
a281      SGFQALGTLMSVGLMMLPAITARLWAKHMGALILLSVLTALLCGLSGLLISYHIEIPSGP
                190       200       210       220       230       240

250       260
m281.pep  AIILCCSVLYLFSVILGKEGGILT
          ||||||||||||||||||||||||
a281      AIILCCSVLYLFSVILGKEGGILTKWLKNHRHHTTX
                250       260       270
```

The following partial DNA sequence was identified in *N. gonorrhoeae* <SEQ ID 1163>:

```
g282.seq
    1 atgggattgg gtatggaaat cggcaagctg attgtggctc ttttggtgct 51 gatcaatccg tttagcgcgt tgtcgcttta ccttgacctg accaacggac 101 acagcacgaa ggagcgcagg aaggtcgcgc ggacggccgc cgtcgccgtg 151 tttgccgtga ttgcggtatt tgcgctgatc ggcggtgcgc tattgaaggt 201 tttgggcatc agcgtcggtt cgtttcaggt cggcggcggg attttggtgc 251 tgctgatcgc catttcgatg atgaacggca acgacaatcc cgccaagcag 301 aatctcggcg cgcagccgga aacggggcaa gcgcgccccg cccgcaatgc 351 aggggcgatt gccgtcgtgc ccatcgccat accgatcacc atcggtccgg 401 gcggtatttc gactgtgatt atttatgctt cggcagccaa aacgtacagc 451 gatatcgcgc tgattatcgc ggccggtttg gtggtcagtg cgatttgtta 501 tgccattta atcgttgccg ggaaggtcag ccgcctgctg ggcgcgacgg 551 ggctgacgat tttaaaccgc attatgggta tgatgctggc ggcggtatcg 601 gtggagatta ttgtgtcggg actgaaaacg atattcccgc aactggcagg 651 ttga
```

This corresponds to the amino acid sequence <SEQ ID 1164; ORF 282.ng>:

```
g282.pep
    1 MGLGMEIGKL IVALLVLINP FSALSLYLDL TNGHSTKERR KVARTAAVAV

51 FAVIAVFALI GGALLKVLGI SVGSFQVGGG ILVLLIAISM MNGNDNPAKQ

101 NLGAQPETGQ ARPARNAGAI AVVPIAIPIT IGPGGISTVI IYASAAKTYS

151 DIALIIAAGL VVSAICYAIL IVAGKVSRLL GATGLTILNR IMGMMLAAVS

201 VEIIVSGLKT IFPQLAG*
```

The following partial DNA sequence was identified in *N. meningitidis* <SEQ ID 1165>:

```
m282.seq
    1 ATGGGATTGG GCATGGAAAT CGGCAAGCTG ATTGTGGCTT TTTTGGTGCT
```

-continued

```
 51 GATTAATCCG TTTAGCGCGT TGTCGCTTTA CCTTGACCTG ACCAACGGGC

101 ACAGCACGAA GGAGCGCAGG AAGGTCGCGC GGACGGCCGC CGTTGCCGTG

151 TTTGCCGTGA TTGCGGTATT TGCGCTGATC GGCGGTACGC TGCTGAAGGT

201 TTTGGGCATC AGCGTCGGTT CGTTTCAGGT CGGCGGCGGG ATTTTGGTGC

251 TGCTGATCGC CATTTCGATG ATGAACGGCA ACGACAATCC CGCCAAGCAG

301 AATCTCGGCG CGCAGCCGGA AACGGGGCAG GCGCGCCCCG CCCGCAATGC

351 CGGAGCGATT GCCGTCGTGC CCATCGCCAT ACCGATCACC ATCGGCCCGG

401 GCGGTATTTC GACCGTGATT ATTTACGCTT CGGCGGCTAA ACATACGGC

451 GACATCGCGT TGATTATCGC GGCCGGTTTG GTGGTCAGTG CGATTTGTTA

501 TGCCATTTTA ATCGTTGCCG GGAAGGTCAG CCGCCTGCTG GGCGCGACGG

551 GGCTGACGAT TTTAAACCGC ATTATGGGTA TGATGCTGGC GGCGGTATCG

601 GTGGAGATTA TTGTGTCGGG ACTGAAAACG ATATTCCCGC AACTGGCAGG

651 TTGA
```

This corresponds to the amino acid sequence <SEQ ID 1166; ORF 282.ng>:

```
m282.pep
  1 MGLGMEIGKL IVAFLVLINP FSALSLYLDL TNGHSTKERR KVARTAAVAV

51 FAVIAVFALI GGTLLKVLGI SVGSFQVGGG ILVLLIAISM MNGNDNPAKQ

101 NLGAQPETGQ ARPARNAGAI AVVPIAIPIT IGPGGISTVI IYASAAKTYG

151 DIALIIAAGL VVSAICYAIL IVAGKVSRLL GATGLTILNR IMGMMLAAVS

201 VEIIVSGLKT IFPQLAG*
```

Computer analysis of this amino acid sequence gave the following results:
Homology with a Predicted ORF from *N. gonorrhoeae*
ORF 282 shows 98.6% identity over a 217 aa overlap with a predicted ORF (ORF 282.ng) from *N. gonorrhoeae*:

```
m282/g282
                   10         20         30         40         50         60
      m282.pep MGLGMEIGKLIVAFLVLINPFSALSLYLDLTNGHSTKERRKVARTAAVAVFAVIAVFALI
               |||||||||||:||||||||||||||||||||||||||||||||||||||||||||||||
      g282     MGLGMEIGKLIVALLVLINPFSALSLYLDLTNGHSTKERRKVARTAAVAVFAVIAVFALI
                   10         20         30         40         50         60

70         80         90        100        110        120
      m282.pep GGTLLKVLGISVGSFQVGGGILVLLIAISMMNGNDNPAKQNLGAQPETGQARPARNAGAI
               ||:|||||||||||||||||||||||||||||||||||||||||||||||||||||||||
      g282     GGALLKVLGISVGSFQVGGGILVLLIAISMMNGNDNPAKQNLGAQPETGQARPARNAGAI
                   70         80         90        100        110        120

130        140        150        160        170        180
      m282.pep AVVPIAIPITIGPGGISTVIIYASAAKTYGDIALIIAAGLVVSAICYAILIVAGKVSRLL
               |||||||||||||||||||||||||||||:||||||||||||||||||||||||||||||
      g282     AVVPIAIPITIGPGGISTVIIYASAAKTYSDIALIIAAGLVVSAICYAILIVAGKVSRLL
                  130        140        150        160        170        180

190        200        210
      m282.pep GATGLTILNRIMGMMLAAVSVEIIVSGLKTIFPQLAGX
               ||||||||||||||||||||||||||||||||||||||
      g282     GATGLTILNRIMGMMLAAVSVEIIVSGLKTIFPQLAGX
                  190        200        210
```

The following partial DNA sequence was identified in *N. meningitidis* <SEQ ID 1167>:

```
a282.seq
    1 ATGGGATTGG GCATGGAAAT CGGCAAGCTG ATTGTGGCTT TTTTGGTGCT

51 GATTAATCCG TTTAGCGCGT TGTCGCTTTA CCTTGACCTG ACCAACGGGC

101 ACAGCACGAA GGAGCGCAGG AAGGTCGCGC GGACGGCCGC CGTTGCCGTG

151 TTTGCCGTGA TTGCGGTATT TGCGCTGATC GGCGGTACGC TGCTGAAGGT

201 TTTGGGCATC AGCGTCGGTT CGTTTCAGGT CGGCGGCGGA ATTTTGGTGT

251 TGCTGATTGC CATTTCGATG ATGAACGGCA ACGACAATCC CGCCAAGCAG

301 AATCTCGGCG CGCAGCCGGA AACGGGGCAG GTGCGCCCCG CCCGCAATGC

351 CGGAGCGATT GCCGTCGTGC CCATCGCCAT ACCGATCACC ATCGGCCCGG

401 GCGGTATTTC GACCGTGATT ATTTACGCTT CGGCGGCTAA AACATACGGC

451 GACATCGCGT TGATTATCGC GGCCGGTTTG GTGGTCAGTG CGATTTGTTA

501 TGCCATTTTA ATCGTTGCCG GGAAGGTCAG CCGCCTGCTG GGTGCGACGG

551 GGCTGACGAT TTTAAACCGT ATCATGGGTA TGATGCTGGC GGCGGTATCG

601 GTGGAGATTA TTGTGTCGGG ACTGAAAATG ATATTCCCGC AACTGGCAGG

651 TTGA
```

This corresponds to the amino acid sequence <SEQ ID 1168; ORF 282.a>:

```
a282.pep
    1 MGLGMEIGKL IVAFLVLINP FSALSLYLDL TNGHSTKERR KVARTAAVAV

51 FAVIAVFALI GGTLLKVLGI SVGSFQVGGG ILVLLIAISM MNGNDNPAKQ

101 NLGAQPETGQ VRPARNAGAI AVVPIAIPIT IGPGGISTVI IYASAAKTYG

151 DIALIIAAGL VVSAICYAIL IVAGKVSRLL GATGLTILNR IMGMMLAAVS

201 VEIIVSGLKM IFPQLAG*
``` m282/a282 99.1% identity in 217 aa overlap

```
                    10        20        30        40        50        60
m282.pep    MGLGMEIGKLIVAFLVLINPFSALSLYLDLTNGHSTKERRKVARTAAVAVFAVIAVFALI
            ||||||||||||||||||||||||||||||||||||||||||||||||||||||||||||
a282        MGLGMEIGKLIVAFLVLINPFSALSLYLDLTNGHSTKERRKVARTAAVAVFAVIAVFALI
                    10        20        30        40        50        60

70        80        90       100       110       120
m282.pep    GGTLLKVLGISVGSFQVGGGILVLLIAISMMNGNDNPAKQNLGAQPETGQARPARNAGAI
            ||||||||||||||||||||||||||||||||||||||||||||||||||:|||||||||
a282        GGTLLKVLGISVGSFQVGGGILVLLIAISMMNGNDNPAKQNLGAQPETGQVRPARNAGAI
                    70        80        90       100       110       120

130       140       150       160       170       180
m282.pep    AVVPIAIPITIGPGGISTVIIYASAAKTYGDIALIIAAGLVVSAICYAILIVAGKVSRLL
            ||||||||||||||||||||||||||||||||||||||||||||||||||||||||||||
a282        AVVPIAIPITIGPGGISTVIIYASAAKTYGDIALIIAAGLVVSAICYAILIVAGKVSRLL
                   130       140       150       160       170       180

190       200       210
m282.pep    GATGLTILNRIMGMMLAAVSVEIIVSGLKTIFPQLAGX
            |||||||||||||||||||||||||||||| ||||||||
a282        GATGLTILNRIMGMMLAAVSVEIIVSGLKMIFPQLAGX
                   190       200       210
```

The following partial DNA sequence was identified in *N. gonorrhoeae* <SEQ ID 1169>:

```
g283.seq
    1 atgaactttg ctttatccgt catcacattt accctcgcct ctttcctgcc 51 cgtcccgcct gccggaaccg ccgtctttac ttggaaagac ggcggcggca 101 acagctattc ggatgtgccg aaacagcttc atcccgacca gagccaaatc 151 ctcaacctgc ggacgctcca aaccaaaccg gcggtcaagc ccaaacctgc 201 cgtcgatacg aatgcggaca gtgcgaagga aaacgaaaag gatatcgccg 251 agaaaaacgg gcagcttgag gaagaaaaga aaaaaattgc cgaaaccgaa 301 cggcagaaca agaagaaaa ctgccggatt tcaaaaatga acctgaaggc 351 ggtgggaaac tcaaatgcga aaaacaagga tgatttgatc cgtaaataca 401 ataacgccgt aaacaaatac tgccgttaa
```

This corresponds to the amino acid sequence <SEQ ID 1170; ORF 283.ng>:

```
g283.pep
    1 MNFALSVITF TLASFLPVPP AGTAVFTWKD GGGNSYSDVP KQLHPDQSQI

51 LNLRTLQTKP AVKPKPAVDT NADSAKENEK DIAEKNGQLE EEKKKIAETE

101 RQNKEENCRI SKMNLKAVGN SNAKNKDDLI RKYNNAVNKY CR*
```

The following partial DNA sequence was identified in *N. meningitidis* <SEQ ID 1171>:

```
m283.seq
    1 ATGAACTTTG CTTTATCCGT CATTATGTTG ACCCTCGCCT CTTTCCTGCC

51 CGTCCCGCCT GCCGGAGCCG CCGTCTTTAC TTGGAAGGAC GGCGGCGGCA

101 ACAGCTATTC GGATGTACCG AAACAGCTTC ATCCCGACCA AAGCCAAATC

151 TTAAACCTGC GGACGCGCCA AACCAAACCG GCGGTCAAAC CCGCCCAAGC

201 CGACGCAGGG AAGCGCACAG ACGGCGCGGC ACAGGAAAAC AATCCCGACA

251 CTGCCGAGAA AAACCGGCAG CTTGAGGAAG AAAGAAAAG AATTGCCGAA

301 ACCGAACGGC AGAACAAAGA AGAAAACTGC CGGATTTCAA AAATGAACCT

351 GAAGGCGGTG GGAAATTCAA ATGCAAAAAA CAAGGATGAT TGATTCGGA

401 AATACAATAA CGCCGTAAAC AAATACTGCC GTTAA
```

This corresponds to the amino acid sequence <SEQ ID 1172; ORF 283>:

```
m283.pep
    1 MNFALSVIML TLASFLPVPP AGAAVFTWKD GGGNSYSDVP KQLHPDQSQI

51 LNLRTRQTKP AVKPAQADAG KRTDGAAQEN NPDTAEKNRQ LEEEKKRIAE

101 TERQNKEENC RISKMNLKAV GNSNAKNKDD LIRKYNNAVN KYCR*
```

Computer analysis of this amino acid sequence gave the following results:
Homology with a Predicted ORF from *N. gonorrhoeae*

```
m283/g283  86.1% identity in 144 aa overlap 10        20        30        40        50        60
m283.pep  MNFALSVIMLTLASFLPVPPAGAAVFTWKDGGGNSYSDVPKQLHPDQSQILNLRTRQTKP
          ||||||||: |||||||||||:||||||||||||||||||||||||||||||||| |||
g283      MNFALSVITFTLASFLPVPPAGTAVFTWKDGGGNSYSDVPKQLHPDQSQILNLRTLQTKP
                  10        20        30        40        50        60

70        80        90       100       110       120
m283.pep  AVKPAQADAGKRTDGAAQENNPDTAEKNRQLEEEKKRIAETERQNKEENCRISKMNLKAV
          ||||  |:   :| :|:||: | |||| |||||||:||||||||||||||||||||||
g283      AVKPKPA-VDTNAD-SAKENEKDIAEKNGQLEEEKKKIAETERQNKEENCRISKMNLKAV
                  70        80        90       100       110

130       140
m283.pep  GNSNAKNKDDLIRKYNNAVNKYCRX
          |||||||||||||||||||||||||
g283      GNSNAKNKDDLIRKYNNAVNKYCRX
                 120       130       140
```

The following partial DNA sequence was identified in *N. meningitidis* <SEQ ID 1173>:

```
a283.seq
    1 ATGAACTTTG CTTTATCCGT CATTATGTTG ACCCTCGCCT CTTTCCTGCC

51 CGTCCCGCCT GCCGGAGCCG CCGTCTTTAC TTGGAAGGAC GGCGGCGGCA

101 ACAGCTATTC GGATGTACCG AAACAGCTTC ATCCCGACCA AAGCCAAATC

151 TTAAACCTGC GGACGCGCCA AACCAAACCG GCGGTCAAAC CCGCCCAAGC

201 CGACGCAGGG AAGCGCACAG ACGGCGCGGC ACAGGAAAAC AATCCCGACA

251 CTGCCGAGAA AAACCGGCAG CTTGAGGAAG AAAAGAAAAG AATTGCCGAA

301 ACCGAACGGC AGAACAAAGA AGAAAACTGC CGGATTTCAA AAATGAACCT

351 GAAAGCGGTG GGAAATTCAA ATGCAAAAAA CAAGGATGAT TTGATTCGGA

401 AATACAATAA CGCCGTAAAC AAATACTGCC GTTAA
```

This corresponds to the amino acid sequence <SEQ ID 1174; ORF 283.a>:

```
a283.pep

1 MNFALSVIML TLASFLPVPP AGAAVFTWKD GGGNSYSDVP KQLHPDQSQI

51 LNLRTRQTKP AVKPAQADAG KRTDGAAQEN NPDTAEKNRQ LEEEKKRIAE

101 TERQNKEENC RISKMNLKAV GNSNAKNKDD LIRKYNNAVN KYCR* m283/a283  100.0% identity in 144 aa overlap 10        20        30        40        50        60
m283.pep  MNFALSVIMLTLASFLPVPPAGAAVFTWKDGGGNSYSDVPKQLHPDQSQILNLRTRQTKP
          ||||||||||||||||||||||||||||||||||||||||||||||||||||||||||||
a283      MNFALSVIMLTLASFLPVPPAGAAVFTWKDGGGNSYSDVPKQLHPDQSQILNLRTRQTKP
                  10        20        30        40        50        60

70        80        90       100       110       120
m283.pep  AVKPAQADAGKRTDGAAQENNPDTAEKNRQLEEEKKRIAETERQNKEENCRISKMNLKAV
          ||||||||||||||||||||||||||||||||||||||||||||||||||||||||||||
a283      AVKPAQADAGKRTDGAAQENNPDTAEKNRQLEEEKKRIAETERQNKEENCRISKMNLKAV
                  70        80        90       100       110       120

130       140
m283.pep  GNSNAKNKDDLIRKYNNAVNKYCRX
          |||||||||||||||||||||||||
a283      GNSNAKNKDDLIRKYNNAVNKYCRX
                 130       140
```

The following partial DNA sequence was identified in *N. gonorrhoeae* <SEQ ID 1175>:

```
g284.seq.
    1 atgccgtctg aaactcgaaa tcggtttcag acggcattgg tttacgcggc
   51 aggttggggc ttagcggtct ttgtaacggc attcgctttt gcctgcaaaa
  101 gagtcgccgg ctttgcgttt gcctttgaag ccttcgccgg ttttttgaa
  151 actgtctttc ttaaagcctt ctttcttgaa accttcgccg cgcgttttgc
  201 cgccgaagcc ttctttgccc ggtttatgat cgccgcgccg gccgccggat
  251 ttcctatcgc cccagccgcc tttgcctttc ggcttgccgc ctgcggattt
  301 gcgtttgcgg gccggctcca tgccttcgat ggtcagttcg ggcagtttgc
  351 ggttaatgta tttttcgatt ttgtggactt tgacgtattc gttcacttcg
  401 gcaaacgtaa tcgcaatacc cgtgcggcct gcgcggccgg tgcgcccgat
  451 gcggtggacg tagtcttccg cctgtttcgg caggtcgtag tttatgacgt
  501 gggtaatggt cggtacgtca ataccgcgtg cggcaacgtc ggtggcaacc
  551 aaaattttgc agcggccttt acgcaaatcc gtcagcgtgc ggttgcgcca
  601 gccctgcggc atatcgccgt gcaggcagtt ggcggcgaaa cctttttcgt
  651 acaattcatc cgcgatgact cggtcatcg ctttggtgga cgtgaaaatc
  701 acacattggt cgatgttggc atcgcgcagg atgtggtcga gcaggcggtt
  751 tttgtggcgc atatcgtcgc agtacaacaa ctgctcttcg attttgcctt
  801 ggccgtccac gcgttcgact tcgataattt cagagtcttt ggtcagtttg
  851 cgcgccagtt tgccgactgc gccgtcccaa gtggcggaga acaataa
```

This corresponds to the amino acid sequence <SEQ ID 1176; ORF 284.ng>:

```
g284.pep
    1 MPSETRNRFQ TALVYAAGWG LAVFVTAFAF ACKRVAGFAF AFEAFAGFFE
   51 TVFLKAFFLE TFAARFAAEA FFARFMIAAP AAGFPIAPAA FAFRLAACGF
  101 AFAGRLHAFD GQFGQFAVNV FFDFVDFDVF VHFGKRNRNT RAACAAGAPD
  151 AVDVVFRLFR QVVVYDVGNG RYVNTACGNV GGNQNFAAAF TQIRQRAVAP
  201 ALRHIAVQAV GGETFFVQFI RDDFGHRFGG RENHTLVDVG IAQDVVEQAV
  251 FVAHIVAVQQ LLFDFALAVH AFDFDNFRVF GQFARQFADC AVPSGGEQ*
```

The following partial DNA sequence was identified in *N. meningitidis* <SEQ ID 1177>:

```
m284.seq..
    1 ATGCCGTCTG AAACTCGAAA TCGGTTTCAG ACGGCATTGG TTTATGCGGC
   51 AGGTTGGGGC TTAGCGGTCT TTGTAACGGC GTTCGCCTTT GCCTGCAAAA
  101 GAATCGCCGG CTTTGCGTTT GCCTTTGAAG CCTTCGCCGG TTTTTTTGAA
  151 ACCGTCTCTC TTAAAGCCTT CTTTCTTGAA ACCTTCGCCG CGCGTTTTGC
  201 CGCCGAAGCC TTCTTTGCTC GGTTTATGAT CGCCGCGCCA ACCGCCGGAT
  251 TTACGATCGC CCCAGCCGCC TTTGCCTTTC GGCTTGCCGC CTGCGGATTT
  301 GCGTTTGCGG GTCGGTTCCA TGCCTTCGAT GGTCAGTTCG GGCAGTTTTC
  351 GGTTAATGTA TTTTTCGATT TTGTGGACTT TGACGTATTC GTTCACTTCG
```

-continued

```
 401 GCAAACGTAA TCGCAATACC CGTGCGGCCT GCGCGGCCGG TGCGCCCGAT

451 GCGGTGGACG TAGTCTTCCG CCTGTTTCGG CAGGTCGTAG TTGATAACGT

501 GGGTAATGGT CGGTACGTCG ATACCGCGTG CGGCAACATC GGTGGCAACC

551 AAAATTTTGC AGCGGCCTTT ACGCAAATCC ATCAGCGTGC GGTTGCGCCA

601 GCCTTGCGGC ATATCGCCGT GCAGGCAGTT TGCGGCGAAA CCTTTTTCGT

651 ACAGTTCATC CGCAATGACT TCGGTCATGG CTTTGGTGGA CGTGAAAATC

701 ACGCATTGAT CGATATTGGC ATCGCGCAAG ATATGATCGA GCAGGCGGTT

751 TTTGTGGCGC ATATCGTCGC AGTACAGCAG TTGTTCTTCG ATTTTGCCTT

801 GATCGTCCAC GCGTTCGACT TCGATGATTT CAGGGTCTTT GGTCAGTTTG

851 CGCGCCAGTT TGCCGACCGC GCCGTCCCAA GTGGCGGAGA ACAACAAAGT

901 CTGACGGTCG CTCGGCGTTG CTTCCACGAT GGTTTCGATG TCGTCGATAA

951 AGCCCATATC CAACATACGG TCGGCTTCGT CCAAAATCAG CACTTCCAAA

1001 CGTTCAAAAT CAACTTTGCC GCTTTGCATC AGGTCCATCA GACGGCCCGG

1051 CGTGGCGACA ATCAGATCGA CCGGTTTGCT CAGGGCACGG GTTTGGTAGC

1101 CGAAAGACGC GCCGCCGACG ATGCTGACGG TGCGGAACCA ACGCATATTT

1151 TTGGCATACG CCAGCGCGTT TTTCTCGACT TGAGCCGCCA GTTCGCGGGT

1201 CGGGGTCAAC ACCAAAGCAC GCGGGCCTTT GCCCGGTTTT TCGCTGCGTT

1251 TGGTCAGTTT TTGCAAAGTC GGTAA
```

This corresponds to the amino acid sequence <SEQ ID 1178; ORF 284>:

```
m284.pep
  1 MPSETRNRFQ TALVYAAGWG LAVFVTAFAF ACKRIAGFAF AFEAFAGFFE

51 TVSLKAFFLE TFAARFAAEA FFARFMIAAP TAGFTIAPAA FAFRLAACGF

101 AFAGRFHAFD GQFGQFSVNV FFDFVDFDVF VHFGKRNRNT RAACAAGAPD

151 AVDVVFRLFR QVVVDNVGNG RYVDTACGNI GGNQNFAAAF TQIHQRAVAP

201 ALRHIAVQAV CGETFFVQFI RNDFGHGFGG RENHALIDIG IAQDMIEQAV

251 FVAHIVAVQQ LFFDFALIVH AFDFDDFRVF GQFARQFADR AVPSGGEQQS

301 LTVARRCFHD GFDVVDKAHI QHTVGFVQNQ HFQTFKINFA ALHQVHQTAR

351 RGDNQIDRFA QGTGLVAERR AADDADGAEP THIFGIRQRV FLDLSRQFAG

401 RGQHQSTRAF ARFFAAFGQF LQSR*
```

Computer analysis of this amino acid sequence gave the following results:

Homology with a Predicted ORF from *N. gonorrhoeae*

```
m284/g284 92.3% identity in 298 aa overlap 10        20        30        40        50        60
     m284.pep MPSETRNRFQTALVYAAGWGLAVFVTAFAFACKRIAGFAFAFEAFAGFFETVSLKAFFLE
              ||||||||||||||||||||||||||||||||||:||||||||||||||||| ||||||
         g284 MPSETRNRFQTALVYAAGWGLAVFVTAFAFACKRVAGFAFAFEAFAGFFETVFLKAFFLE
                  10        20        30        40        50        60

70        80        90       100       110       120
     m284.pep TFAARFAAEAFFARFMIAAPTAGFTIAPAAFAFRLAACGFAFAGRFHAFDGQFGQFSVNV
              ||||||||||||||||||||:|||  |||||||||||||||||||||:|||||||| |||
         g284 TFAARFAAEAFFARFMIAAPAAGFPIAPAAFAFRLAACGFAFAGRLHAFDGQFGQFAVNV
                  70        80        90       100       110       120
```

-continued

```
                 130        140        150        160        170        180
m284.pep  FFDFVDFDVFVHFGKRNRNTRAACAAGAPDAVDVVFRLFRQVVVDNVGNGRYVDTACGNI
          |||||||||||||||||||||||||||||||||||||||||||| :|||||||:|||||:
g284      FFDFVDFDVFVHFGKRNRNTRAACAAGAPDAVDVVFRLFRQVVVYDVGNGRYVNTACGNV
                 130        140        150        160        170        180

190        200        210        220        230        240
m284.pep  GGNQNFAAAFTQIHQRAVAPALRHIAVQAVCGETFFVQFIRNDFGHGFGGRENHALIDIG
          |||||||||||||||||||||||||||||| ||||||||||:|||| |||||||:|:|:|
g284      GGNQNFAAAFTQIRQRAVAPALRHIAVQAVGGETFFVQFIRDDFGHRFGGRENHTLVDVG
                 190        200        210        220        230        240

250        260        270        280        290        300
m284.pep  IAQDMIEQAVFVAHIVAVQQLFFDFALIVHAFDFDDFRVFGQFARQFADRAVPSGGEQQS
          |||||::|||||||||||||||:|||||||||||||:||||||||||||| ||||||||
g284      IAQDVVEQAVFVAHIVAVQQLLFDFALAVHAFDFDNFRVFGQFARQFADCAVPSGGEQX
                 250        260        270        280        290

310        320        330        340        350        360
m284.pep  LTVARRCFHDGFDVVDKAHIQHTVGFVQNQHFQTFKINFAALHQVHQTARRGDNQIDRFA
```

The following partial DNA sequence was identified in *N. meningitidis* <SEQ ID 1179>:

```
a284.seq
   1 ATGCCGTCTG AAACTCGAAA TCGGTTTCAG ACGGCATTGG TTTATGCGGC

51 AGGTTGGGGC TTAGCGGTCT TTGTAACGGC GTTCGCCTTT GCCTGCAAAA

101 GAATCGCCGG CTTTGCGTTT GCCTTTGAAG CCTTCGCCGG TTTTTTTGAA

151 ACCGTCTCTC TTAAAGCCTT CTTTCTTGAA ACCTTCGCCG CGCGTTTTGC

201 CGCCGAAGCC TTCTTTGCTC GGTTTATGAT CGCCGCGCCA ACCGCCGGAT

251 TTACGATCGC CCCAGCCGCC TTTGCCTTTC GGCTTGCCGC CTGCGGATTT

301 GCGTTTGCGG GTCGGTTCCA TGCCTTCGAT GGTCAGTTCG GGCAGTTTTC

351 GGTTAATGTA TTTTTCGATT TTGTGGACTT TGACGTATTC GTTCACTTCG

401 GCAAACGTAA TCGCAATACC CGTGCGGCCT GCGCGGCCGG TGCGCCCGAT

451 GCGGTGGACG TAGTCTTCCG CCTGTTTCGG CAGGTCGTAG TTGATAACGT

501 GGGTAATGGT CGGTACGTCG ATACCGCGTG CGGCAACGTC GGTGGCAACC

551 AAAATTTTGC AGCGGCCTTT GCGCAAATCC ATCAGCGTGC GGTTGCGCCA

601 GCCTTGCGGC ATATCGCCGT GCAGGCAGTT GGCGGCGAAA CCTTTTTCGT

651 ACAATTCATC CGCGATGACT TCGGTCATGG CTTTGGTGGA CGTGAAAATC

701 ACGCATTGAT CGATGTCGGC ATCGCGCAAG ATATGATCGA GCAGGCGGTT

751 TTTGTGGCGC ATATCGTCGC AGTACAGCAG TTGTTCTTCG ATTTTGCCTT

801 GGTCGTCCAC GCGTTCGACT TCGATGATTT CAGGGTCTTT GGTCAGTTTG

851 CGCGCCAGTT TGCCGACCGC GCCGTCCCAA GTGGCGGAGA ACAACAAAGT

901 CTGACGGTCT TCCGGCGTGG CTTCGACGAT GGTTTCGATG TCGTCGATAA

951 AGCCCATATC CAACATACGG TCGGCTTCGT CCAAAATCAG CACTTCCAAG

1001 CGGGCGAAAT CGACTTTGCC GCTTTGCATC AAGTCCATCA GACGGCCCGG

1051 CGTGGCGACA ATCAGATCGA CCGGTTTGCT CAGGGCGCGG GTTTGGTAGC

1101 CGAACGATGC ACCACCGACG ATGCTGACGG TACGGAACCA ACGCATATTT

1151 TTGGCATACG CCAGCGCGTT TTTCTCGACT TGAGCCGCCA ATTCGCGGGT

1201 CGGCGTCAAC ACCAACGCGC GCGGGCCTTT GCCCGGTTTT TCGCTGCGTT

1251 TGGTCAGTCG CTGCAAAGTC GGTAA
```

This corresponds to the amino acid sequence <SEQ ID 1180; ORF 284.a>:

```
a284.pep

1 MPSETRNRFQ TALVYAAGWG LAVFVTAFAF ACKRIAGFAF AFEAFAGFFE

51 TVSLKAFFLE TFAARFAAEA FFARFMIAAP TAGFTIAPAA FAFRLAACGF

101 AFAGRFHAFD GQFGQFSVNV FFDFVDFDVF VHFGKRNRNT RAACAAGAPD

151 AVDVVFRLFR QVVVDNVGNG RYVDTACGNV GGNQNFAAAF AQIHQRAVAP

201 ALRHIAVQAV GGETFFVQFI RDDFGHGFGG RENHALIDVG IAQDMIEQAV

251 FVAHIVAVQQ LFFDFALVVH AFDFDDFRVF GQFARQFADR AVPSGGEQQS

301 LTVFRRGFDD GFDVVDKAHI QHTVGFVQNQ HFQAGEIDFA ALHQVHQTAR

351 RGDNQIDRFA QGAGLVAERC TTDDADGTEP THIFGIRQRV FLDLSRQFAG

401 RRQHQRARAF ARFFAAFGQS LQSR* m284/a284   94.8% identity in 424 aa overlap 10         20         30         40         50         60
m284.pep   MPSETRNRFQTALVYAAGWGLAVFVTAFAFACKRIAGFAFAFEAFAGFFETVSLKAFFLE
           ||||||||||||||||||||||||||||||||||||||||||||||||||||||||||||
a284       MPSETRNRFQTALVYAAGWGLAVFVTAFAFACKRIAGFAFAFEAFAGFFETVSLKAFFLE
                  10         20         30         40         50         60

70         80         90        100        110        120
m284.pep   TFAARFAAEAFFARFMIAAPTAGFTIAPAAFAFRLAACGFAFAGRFHAFDGQFGQFSVNV
           ||||||||||||||||||||||||||||||||||||||||||||||||||||||||||||
a284       TFAARFAAEAFFARFMIAAPTAGFTIAPAAFAFRLAACGFAFAGRFHAFDGQFGQFSVNV
                  70         80         90        100        110        120

130        140        150        160        170        180
m284.pep   FFDFVDFDVFVHFGKRNRNTRAACAAGAPDAVDVVFRLFRQVVVDNVGNGRYVDTACGNI
           |||||||||||||||||||||||||||||||||||||||||||||||||||||||||||:
a284       FFDFVDFDVFVHFGKRNRNTRAACAAGAPDAVDVVFRLFRQVVVDNVGNGRYVDTACGNV
                 130        140        150        160        170        180

190        200        210        220        230        240
m284.pep   GGNQNFAAAFTQIHQRAVAPALRHIAVQAVCGETFFVQFIRNDFGHGFGGRENHALIDIG
           ||||||||||:|||||||||||||||||||  ||||||||| ||||||||||||||||:|
a284       GGNQNFAAAFAQIHQRAVAPALRHIAVQAVGGETFFVQFIRDDFGHGFGGRENHALIDVG
                 190        200        210        220        230        240

250        260        270        280        290        300
m284.pep   IAQDMIEQAVFVAHIVAVQQLFFDFALIVHAFDFDDFRVFGQFARQFADRAVPSGGEQQS
           ||||||||||||||||||||||||||||:|||||||||||||||||||||||||||||||
a284       IAQDMIEQAVFVAHIVAVQQLFFDFALVVHAFDFDDFRVFGQFARQFADRAVPSGGEQQS
                 250        260        270        280        290        300

310        320        330        340        350        360
m284.pep   LTVARRCFHDGFDVVDKAHIQHTVGFVQNQHFQTFKINFAALHQVHQTARRGDNQIDRFA
           ||| || |||||||||||||||||||||||||| : :|||||||||||||||||||||||
a284       LTVFRRGFDDGFDVVDKAHIQHTVGFVQNQHFQAGEIDFAALHQVHQTARRGDNQIDRFA
                 310        320        330        340        350        360

370        380        390        400        410        420
m284.pep   QGTGLVAERRAADDADGAEPTHIFGIRQRVFLDLSRQFAGRGQHQSTRAFARFFAAFGQF
           ||:||||||  ::||||:|||||||||||||||||||||||  :|||||||||||||||
a284       QGAGLVAERCTTDDADGTEPTHIFGIRQRVFLDLSRQFAGRRQHQRARAFARFFAAFGQS
                 370        380        390        400        410        420 m284.pep   LQSRX
           |||||
a284       LQSRX
```

The following partial DNA sequence was identified in *N. gonorrhoeae* <SEQ ID 1181>:

```
g285.seq
    1 atgaccgata ccacaccgac agataccgat ccgaccgaaa acggcacgcg 51 caaaatgccg tctgaacacc gccccgcccc gccggcaaaa aaacgccgcc
```

-continued

```
 101 cgctgctgaa gctgtcggcg gcactgctgt ctgtcctgat tttggcagta 151 tgtttcctcg gctggatcgc cggtacgaaa gcaggtttgc gcttcgggct 201 gtaccaaatc ccgtcctggt tcggcgtaaa catttcctcc caaaacctca 251 aaggcacact gctcgacggc ttcgacggcg caactggtc gatagaaacc 301 gagggggcag accttaaaat cagccgcttc cgcttcgcgt ggaaaccgtc 351 cgaactgatg cgccgcagcc tgcacatcac cgacatctcc gccggcgaca 401 tcgccatcgt aaccaaaccg actccgccta agaagaacg cccgcctcaa 451 ggcctgcccg acagcataga cctgcccgcc gctgtctatc tcgaccgctt 501 cgagacgggc aaaatcagca tgggcaaaac ctttgacaaa caaaccgtct 551 atctcgaacg cctcaacgcg gcataccgtt acgaccgtaa agggcaccgc 601 ctcgacctga aggccgccga cacgccgtgg agcagttcgt cggggtcagc 651 ctcggtcggc ttgaaaaaac cgtttgccct cgataccgcc atttacacca 701 aaggcggatt cgaaggcgaa accatacaca gtacggcgcg gctgagcggc 751 agcctgaagg atgtgcgcgc cgaactgacg atcgacggcg caatatccg 801 cctctcggga aaatccgtca tccacccgtt tgccgaatca ttggataaaa 851 cattggaaga agtactggtc aaaggattca acatcaatcc gtccgccttc 901 gtgccttccc tgcccgatgc cgggctgaat ttcgacctga ccgccatccc 951 gtcgttttca gacggcatcg cgctggaagg ctcgctcgat ttggaaaaca 1001 ccaaagccgg ctttgccgac cgcaacggca tccccgtccg tcaggttttg 1051 ggcggctttg tcatccggca ggacggcacg gtgcatatcg gcaatacgtc 1101 cgccgccctg ctcggacggg gcggcatcag gctgtcgggc aaaatcgaca 1151 ccgaaaaaga catccttgat ttaaatatag gcatcaactc cgtcggcgcg 1201 gaagacgtgc tgcaaaccgc gttcaaaggc aggttggacg cagcatcgg 1251 catcggcggc acgaccgcct cgcccaaaat ctcttggcaa ctcggcaccg 1301 gcacggcacg cacggacggc agcctccccca tcgcaagcga ccccgcaaac 1351 gaacagcgga aactggtgtt cgacaccgtc aacatctccg ccggggaagg 1401 cagcctgacc gcgcaaggct atctcgagct gtttaaagac cgcctgctca 1451 agctggacat ccgttcccgc gcattcgacc cttcgcgcat cgatccgcaa 1501 tttccggcag gcaatatcaa cggttcgatt catcttgccg gtgaactggc 1551 aaaagagaaa tttacgggca aaatgcgttt tttgcccggt acgttcaacg 1601 gcgtgccgat tgccggcagc gccgacattg tttacgagtc ccgccacctt 1651 ccgcgcgccg ccgtcgattt gcggttgggg cggaacatcg tcaaaacaga 1701 cggcggcttc ggcaaaaaag gcgaccggct taacctcaat atcaccgcac 1751 ccgatttatc ccgtttcggt ttcggactcg cggggtcttt aaatgtacgc 1801 ggacacctttt ccggcgattt ggacggcggc atccgaacct tgaaaccga 1851 cctttccggc acggcgcgca acttacacat cggcaaagcg gcagacatcc 1901 gttcgctcga ttttacccctc aaaggctcac ccggcacaag ccgcccgatg 1951 cgcgccgata tcaagggcgg ccgccttttcc ctgtcgggcg gcgcggcgt 2001 tgtcgatacc gccggcctga cgctggaagg tacgggcgcg cagcaccgca 2051 tccgcacaca cgccgccatg acgctggacg gcaaaccgtt caaactcgat 2101 ttggacgctt caggcggcat caacagggaa cttacccgat ggaaaggcag
```

-continued

```
2151 catcggcatc ctcgacatcg gcggcgcatt caacctcaag ctgcaaaacc
2201 gtatgacgct cgaagccggt gcggaacacg tggcggcaag tgcggcaaat
2251 tggcaggcaa tgggcggcag cctcaacctg caacactttt cttgggacag
2301 gaaaaccggc atatcggcaa aaggcggcgc acgcggcctg cacatcgccg
2351 agttgcacaa tttcttcaaa ccgcccttcg aacacaatct ggttttaaac
2401 ggcgactggg atgtcgccta cgggcacaac gcgcgcggct acctcaatat
2451 cagccggcaa agcggcgatg ccgtattgcc cggcgggcag gctttgggtt
2501 tgaacgcatt ttccctgaaa acgcgctttc aaaacgaccg catcggaatc
2551 ctgcttgacg gcggcgcgcg tttcggacgg attaacgccg atttgggcat
2601 cggcaacgcc ttcggcggca atatggcaaa tacaccgctc ggcggcagga
2651 ttacagcctc ccttcccgac ttgggcgcat gaagcccttt tctgcccgcc
2701 gccgcgcaaa acattaccgg cagcctgaat gcctccgcgc aaatcggcgg
2751 acgggtaggc tctccgtccg tcaatgccgc cgtcaacggt agcagcaact
2801 acgggaaaat caacggcaat atcaccgtcg ggcaaagccg ctccttcgat
2851 accgcacctt tgggcggcag gctcaacctg accgttgccg atgccgaagc
2901 attccgcaac ttcctaccgg tcggacaaac cgtcaaaggc agcctgaatg
2951 ccgccgtaac cctcggcggc agcatcgccg acccgcactt gggcggcagt
3001 atcaacggcg acaagctcta ttaccgcaac caaacccaag gcatcatctt
3051 ggacaacggc tcgctgcgtt cgcatattgc aggcaggaaa tgggtaatcg
3101 acagcctgaa attccggcac gaagggacgg cggaactctc cggcacggtc
3151 agcatggaaa acagcgtgcc cgatgtcgat atcggcgcgg tgttcgacaa
3201 ataccgcatc ctgtcccgcc ccaaccgccg cctgacggtt tccggcaaca
3251 cccgcctgcg ctattcgccg caaaaaggca tatccgttac cggtatgatt
3301 aaaactgatc aggggctgtt cggttcgcaa aaatcctcga tgccgtccgt
3351 cggcgacgat gtcgtcgtat tgggcgaagt caagaaagag cggcggcat
3401 cgctccccgt caatatgaac ctgactttag acctcaatga cggcatccgc
3451 ttctccggct acggcgcgga cgttaccata ggcggcaaac tgaccctgac
3501 cgcgcaaccg gcgcgaaatg tgcgtggggt gggcacggtc cgcgtcatca
3551 aagggcgtta caaagcatac gggcaggatt tagacattac caaaggcaca
3601 gtctcctttg tcggcccgct caacgacccc aacctgaaca tccgcgccga
3651 acgccgcctt tcccccgtcg gtgcgggcgt ggaaatattg gcagcctca
3701 acagcccgcg cattacgctg acggcaaacg aaccgatgag tgaaaagac
3751 aagctctcct ggctcatcct caaccgtgcc ggcagcggca gcgggcga
3801 caatgccgcc ctgtccgcag ccgcaggcgc gctgcttgcc gggcaaatca
3851 acgaccgcat cgggctggtg gatgatttgg gctttaccag caagcgcagc
3901 cgcaacgcgc aaaccggcga actcaacccc gccgaacagg tgctgaccgt
3951 cggcaaacaa ctgaccggca aactctacat cggctacgaa tacggcatct
4001 ccagcgcgga acagtccgtc aaactgattt accggctgac ccgcgcccta
4051 caggcggttg cccgtatcgg cagccgttcg tcgggcggcg agctgacata
```

```
                       -continued
4101  caccatacgt ttcgaccgcc tcttcggttc ggacaaaaaa gactccgcag 4151  gaaacggcaa agggaaataa
```

This corresponds to the amino acid sequence <SEQ ID 1182; ORF 285.ng>:

```
g285.pep
   1  MTDTTPTDTD PTENGTRKMP SEHRPAPPAK KRRPLLKLSA ALLSVLILAV

51  CFLGWIAGTE AGLRFGLYQI PSWFGVNISS QNLKGTLLDG FDGDNWSIET

101  EGADLKISRF RFAWKPSELM RRSLHITDIS AGDIAIVTKP TPPKEERPPQ

151  GLPDSIDLPA AVYLDRFETG KISMGKTFDK QTVYLERLNA AYRYDRKGHR

201  LDLKAADTPW SSSSGSASVG LKKPFALDTA IYTKGGFEGE TIHSTARLSG

251  SLKDVRAELT IDGGNIRLSG KSVIHPFAES LDKTLEEVLV KGFNINPSAF

301  VPSLPDAGLN FDLTAIPSFS DGIALEGSLD LENTKAGFAD RNGIPVRQVL

351  GGFVIRQDGT VHIGNTSAAL LGRGGIRLSG KIDTEKDILD LNIGINSVGA

401  EDVLQTAFKG RLDGSIGIGG TTASPKISWQ LGTGTARTDG SLPIASDPAN

451  EQRKLVFDTV NISAGEGSLT AQGYLELFKD RLLKLDIRSR AFDPSRIDPQ

501  FPAGNINGSI HLAGELAKEK FTGKMRFLPG TFNGVPIAGS ADIVYESRHL

551  PRAAVDLRLG RNIVKTDGGF GKKGDRLNLN ITAPDLSRFG FGLAGSLNVR

601  GHLSGDLDGG IRTFETDLSG TARNLHIGKA ADIRSLDFTL KGSPGTSRPM

651  RADIKGGRLS LSGGAAVVDT AGLTLEGTGA QHRIRTHAAM TLDGKPFKLD

701  LDASGGINRE LTRWKGSIGI LDIGGAFNLK LQNRMTLEAG AEHVAASAAN

751  WQAMGGSLNL QHFSWDRKTG ISAKGGARGL HIAELHNFFK PPFEHNLVLN

801  GDWDVAYGHN ARGYLNISRQ SGDAVLPGGQ ALGLNAFSLK TRFQNDRIGI

851  LLDGGARFGR INADLGIGNA FGGNMANTPL GGRITASLPD LGALKPFLPA

901  AAQNITGSLN ASAQIGGRVG SPSVNAAVNG SSNYGKINGN ITVGQSRSFD

951  TAPLGGRLNL TVADAEAFRN FLPVGQTVKG SLNAAVTLGG SIADPHLGGS

1001  INGDKLYYRN QTQGIILDNG SLRSHIAGRK WVIDSLKFRH EGTAELSGTV

1051  SMENSVPDVD IGAVFDKYRI LSRPNRRLTV SGNTRLRYSP QKGISVTGMI

1101  KTDQGLFGSQ KSSMPSVGDD VVVLGEVKKE AAASLPVNMN LTLDLNDGIR

1151  FSGYGADVTI GGKLTLTAQP GGNVRGVGTV RVIKGRYKAY GQDLDITKGT

1201  VSFVGPLNDP NLNIRAERRL SPVGAGVEIL GSLNSPRITL TANEPMSEKD

1251  KLSWLILNRA GSGSSGDNAA LSAAAGALLA GQINDRIGLV DDLGFTSKRS

1301  RNAQTGELNP AEQVLTVGKQ LTGKLYIGYE YGISSAEQSV KLIYRLTRAI

1351  QAVARIGSRS SGGELTYTIR FDRLFGSDKK DSAGNGKGK*
```

The following partial DNA sequence was identified in *N. meningitidis* <SEQ ID 1183>:

```
m285.seq
   1  ATGACCGATA CCGCACCGAC AGATACCGAT CCGACCGAAA ACGGCACGCG

51  CAAAATGCCG TCTGAACACC GCCCTACCCC GCCGGCAAAA AAACGCCGCC

101  CGTTGCTGAA GCTGTCGGCG GCACTGCTGT CTGTCCTGAT TTTGGCAGTA

151  TGTTTCCTCG GCTGGCTCGC CGGTACGGAA GCAGGTTTGC GCTTCGGGCT
```

```
 201 GTACCAAATC CCGTCTTGGT TCGGCGTAAA CATTTCCTCC CAAAACCTCA
 251 AAGGCACGCT GCTCGACGGC TTCGACGGCG ACAACTGGTC GATAGAAACC
 301 GAGGGGGCAG ACCTTAAAAT CAGCCGCTTC CGCTTCGCGT GGAAACCGTC
 351 CGAACTGATG CGCCGCAGCC TGCACATTAC CGAAATTTCC GCCGGCGACA
 401 TCGCCATCGT TACCAAACCG ACTCCGCCTA AGAAGAACG CCCGCCGCTC
 451 AGCCTTCCCG ACAGCATAGA CCTGCCTGCC GCCGTCTATC TCGACCGCTT
 501 CGAGACGGGC AAAATCAGCA TGGGCAAAGC CTTTGACAAA CAAACCGTCT
 551 ATCTCGAACG GCTGGATGCT TCATACCGTT ACGACCGCAA AGGACACCGC
 601 CTTGACCTGA AGGCCGCCGA CACGCCGTGG AGCAGTTCGT CGGGGGCGGC
 651 CTCGGTCGGC TTGAAAAAAC CGTTTGCCCT CGATACCGCC ATTTACACCA
 701 AAGGCGGACT CGAAGGCAAA ACCATACACA GTACGGCTCG GCTGAGCGGC
 751 AGCCTGAAGG ATGTGCGCGC CGAACTGGCG ATCGACGGCG GCAATATCCG
 801 CCTCTCGGGA AAATCCGTCA TCCACCCGTT TGCCGAATCA TTGGATAAAA
 851 CATTGGAAGA AGTACTGGTC AAAGGGTTCA ACATCAATCC GGCCGCCTTC
 901 GTGCCTTCCC TGCCCGATGC CGGACTGAAT TTCGACCTGA CCGCCATCCC
 951 GTCGTTTTCA GACGGCATCG CGCTGGAAGG TTCGCTCGAT TTGGAAAACA
1001 CCAAAGCCGG CTTTGCCGAC CGCAACGGCA TCCCCGTCCG TCAGGTTTTA
1051 GGCGGCTTTG TCATCCGGCA GGACGGCACG GTGCATATCG GCAATACGTC
1101 CGCCGCCCTG CTCGGACGGG GCGGCATCAG GCTGTCGGGC AAAATCGACA
1151 CCGAAAAAGA CATCCTCGAT TTAAATATAG GCATCAACTC CGTCGGCGCG
1201 GAAGACGTAC TGCAAACCGC GTTCAAAGGC AGGTTGGACG GCAGCATCGG
1251 CATCGGTGGC ACGACCGCCT CGCCCAAAAT CTCTTGGCAA CTCGGCATCG
1301 GCACGGCGCG CACGGACGGC AGCCTCGCCA TTGCAAGCGA CCCAGCAAAC
1351 GGACAGCGGA AACTGGTGCT CGACACCGTC AACATCGCCG CCGGGCAAGG
1401 CAGCCTGACC GCGCAAGGCT ATCTCGAGCT GTTTAAAGAC CGCCTGCTCA
1451 AGCTGGACAT CCGTTCCCGC GCATTCGACC CTTCGCGCAT CGATCCGCAA
1501 CTTCCGGCAG GCAATATCAA CGGCTCAATA AACCTTGCCG GCGAACTGGC
1551 AAAAGAGAAA TTCACAGGCA AAATGCGGTT TTTACCCGGC ACGTTCAACG
1601 GCGTACCGAT TGCCGGCAGT GCCGACATTG TTTACGAGTC CCGCCACCTT
1651 CCGCGTGCCG CCGTCGATTT GCGGCTGGGG CGGAACATTA TTAAAACAGA
1701 CGGCGGCTTC GGCAAAAAAG GCGACCGGCT TAACCTCAAT ATCACCGCAC
1751 CCGATTTATC CCGTTTCGGT TTCGGACTCG CGGGGTCTTT AAATGTACGC
1801 GGACACCTTT CCGGTGATTT GGACGGCGGC ATCCGAACCT TTGAAACCGA
1851 CCTTTCCGGC GCGGCGCGCA ACCTGCACAT CGGCAAGGCG GCAGACATCC
1901 GTTCGCTCGA TTTCACGCTC AAAGGTTCGC CCGACACAAG CCGCCCGATA
1951 CGCGCCGACA TCAAAGGCAG CCGCCTTTCG CTGTCGGGCG GAGCGGCGGT
2001 TGTCGATACC GCCGACCTGA TGCTGGACGG CACGGGCGTG CAGCACCGCA
2051 TCCGCACACA CGCCGCCATG ACGCTGGATG GCAAACCGTT CAAATTCGAT
2101 TTGGACGCTT CAGGCGGCAT CAACAGGGAA CTTACCCGAT GGAAAGGCAG
2151 CATCGGCATC CTCGACATCG GCGGCGCATT CAACCTCAAG CTGCAAAACC
2201 GTATGACGCT CGAAGCCGGT GCGGAACGCG TGGCGGCAAG TGCGGCAAAT
```

```
-continued
2251 TGGCAGGCAA TGGGCGGCAG CCTCAACCTG CAACACTTTT CTTGGGATAA

2301 AAAAACCGGC ATATCGGCAA AAGGCGGCGC ACACGGTCTG CATATCGCCG

2351 AGTTGCACAA TTTCTTCAAA CCGCCCTTCG AACACAATCT GGTTTTAAAC

2401 GGCGACTGGG ATGTCGCCTA CGGGCGCAAC GCGCGCGGCT ACCTCAATAT

2451 CAGCCGGCAA AGCGGCGATG CCGTATTGCC CGGCGGGCAG GCTTTGGGTT

2501 TGAACGCATT TTCCCTGAAA ACGCGCTTTC AAAACGACCG CATCGGAATC

2551 CTGCTTGACG GCGGCGCGCG TTTCGGGCGG ATTAACGCCG ATTTGGGCAT

2601 CGCCAACGCC TTCGGCGGCA ATATGGCAAA TGCACCGCTC GGCGGCAGGA

2651 TTACCGCCTC CCTTCCCGAC TTGGGCGCAT GAAGCCCTT TCTGCCCGCC

2701 GCCGCGCAAA ACATTACCGG CAGCCTGAAT GCCGCCGCGC AAATCGGCGG

2751 ACGGGTAGGC TCTCCGTCCG TCAATGCCGC CGTCAACGGC AGCAGCAACT

2801 ACGGGAAAAT CAACGGCAAC ATCACCGTCG GCAAAGCCG CTCTTTCGAT

2851 ACCGCGCCTT TGGGCGGCAG GCTCAACCTG ACCGTTGCCG ATGCCGAAGT

2901 ATTCCGCAAC TTCCTACCGG TCGACAAAC CGTCAAAGGC AGCCTGAATG

2951 CCGCCGTAAC CCTCGGCGGC AGCATCGCCG ATCCGCACTT GGGCGGCAGC

3001 ATCAACGGCG ACAAACTCTA TTACCGCAAC CAAACCCAAG GCATCATCTT

3051 GGACAACGGC TCGCTGCGTT CGCATATCGC GGGCAGGAAA TGGGTAATCG

3101 ACAGCCTGAA ATTCCGGCAC GAAGGGACGG CGGAACTCTC CGGTACGGTC

3151 GGTATGGAAA CAGCGGACC CGATGTCGAT ATCGGCGCGG TGTTCGACAA

3201 ATACCGCATC CTGTCCCGCC CCAACCGCCG CCTGACGGTT TCCGGCAACA

3251 CCCGCCTGCG CTATTCGCCG CAAAAAGGCA TATCCGTTAC CGGGATGATT

3301 AAAACGGATC AGGGGCTGTT CGGTTCGCAA AAATCCTCGA TGCCGTCCGT

3351 CGGCGACGAT GTCGTCGTAT TAGGCGAAGT CAAAAAAGAG GCGGCGGCAC

3401 CGCTCCCCGT CAATATGAAC CTGACTTTAG ACCTCAATGA CGGCATCCGC

3451 TTCGCCGGCT ACGGCGCGGA CGTTACCATA GGCGGCAAAC TGACCCTGAC

3501 CGCCCAATCG GGCGGAAGCG TACGGGCGT GGGCACGGTC CGCGTCATCA

3551 AAGGGCGTTA TAAGGCATAC GGGCAGGATT TGGACATTAC CAAAGGCACG

3601 GTCTCCTTTG TCGGCCCGCT CAACGATCCC AACCTCAACA TCCGCGCCGA

3651 ACGCCGCCTT TCCCCCGTCG GTGCGGGCGT GGAAATATTG GCAGCCTCA

3701 ACAGCCCGCG CATTACGCTG ACGGCAAACG AACCGATGAG TGAAAAAGAC

3751 AAGCTCTCTT GGCTCATCCT CAACCGCGCC GGCAGCGGCA GCAGCGGCGA

3801 CAATGCCGCC CTGTCTGCAG CCGCAGGTGC GCTGCTTGCC GGGCAAATCA

3851 ACGACCGCAT CGGGCTGGTG GATGATTTGG GCTTTACCAG CAAGCGCAGC

3901 CGCAACGCGC AAACCGGCGA ACTCAACCCC GCCGAACAGG TGCTGACCGT

3951 CGGCAAACAA CTGACCGGCA AACTCTACAT CGGCTACGAA TACAGCATCT

4001 CCAGCGCGGA ACAGTCCGTC AAACTGATTT ACCGGCTGAC CCGCGCCATA

4051 CAGGCGGTTG CCCGTATCGG CAGCCGTTCG TCGGGCGGCC AGCTGACATA

4101 CACCATACGT TTCGACCGCT TCTCCGGTTC GGACAAAAAA GACTCCGCCG

4151 GAAACGGCAA AGGAAAATAA
```

This corresponds to the amino acid sequence <SEQ ID 1184; ORF 285>:

```
m285.pep
    1 MTDTAPTDTD PTENGTRKMP SEHRPTPPAK KRRPLLKLSA ALLSVLILAV

51 CFLGWLAGTE AGLRFGLYQI PSWFGVNISS QNLKGTLLDG FDGDNWSIET

101 EGADLKISRF RFAWKPSELM RRSLHITEIS AGDIAIVTKP TPPKEERPPL

151 SLPDSIDLPA AVYLDRFETG KISMGKAFDK QTVYLERLDA SYRYDRKGHR

201 LDLKAADTPW SSSSGAASVG LKKPFALDTA IYTKGGLEGK TIHSTARLSG

251 SLKDVRAELA IDGGNIRLSG KSVIHPFAES LDKTLEEVLV KGFNINPAAF

301 VPSLPDAGLN FDLTAIPSFS DGIALEGSLD LENTKAGFAD RNGIPVRQVL

351 GGFVIRQDGT VHIGNTSAAL LGRGGIRLSG KIDTEKDILD LNIGINSVGA

401 EDVLQTAFKG RLDGSIGIGG TTASPKISWQ LGIGTARTDG SLAIASDPAN

451 GQRKLVLDTV NIAAGQGSLT AQGYLELFKD RLLKLDIRSR AFDPSRIDPQ

501 LPAGNINGSI NLAGELAKEK FTGKMRFLPG TFNGVPIAGS ADIVYESRHL

551 PRAAVDLRLG RNIIKTDGGF GKKGDRLNLN ITAPDLSRFG FGLAGSLNVR

601 GHLSGDLDGG IRTFETDLSG AARNLHIGKA ADIRSLDFTL KGSPDTSRPI

651 RADIKGSRLS LSGGAAVVDT ADLMLDGTGV QHRIRTHAAM TLDGKPFKFD

701 LDASGGINRE LTRWKGSIGI LDIGGAFNLK LQNRMTLEAG AERVAASAAN

751 WQAMGGSLNL QHFSWDKKTG ISAKGGAHGL HIAELHNFFK PPFEHNLVLN

801 GDWDVAYGRN ARGYLNISRQ SGDAVLPGGQ ALGLNAFSLK TRFQNDRIGI

851 LLDGGARFGR INADLGIANA FGGNMANAPL GGRITASLPD LGALKPFLPA

901 AAQNITGSLN AAAQIGGRVG SPSVNAAVNG SSNYGKINGN ITVGQSRSFD

951 TAPLGGRLNL TVADAEVFRN FLPVGQTVKG SLNAAVTLGG SIADPHLGGS

1001 INGDKLYYRN QTQGIILDNG SLRSHIAGRK WVIDSLKFRH EGTAELSGTV

1051 GMENSGPDVD IGAVFDKYRI LSRPNRRLTV SGNTRLRYSP QKGISVTGMI

1101 KTDQGLFGSQ KSSMPSVGDD VVVLGEVKKE AAAPLPVNMN LTLDLNDGIR

1151 FAGYGADVTI GGKLTLTAQS GGSVRGVGTV RVIKGRYKAY GQDLDITKGT

1201 VSFVGPLNDP NLNIRAERRL SPVGAGVEIL GSLNSPRITL TANEPMSEKD

1251 KLSWLILNRA GSGSSGDNAA LSAAAGALLA GQINDRIGLV DDLGFTSKRS

1301 RNAQTGELNP AEQVLTVGKQ LTGKLYIGYE YSISSAEQSV KLIYRLTRAI

1351 QAVARIGSRS SGGELTYTIR FDRFSGSDKK DSAGNGKGK*
```

Computer analysis of this amino acid sequence gave the following results:

Homology with a Predicted ORF from *N. gonorrhoeae*

```
    m285/g285   96.5% identity in 1389 aa overlap 10         20         30         40         50         60
    m285.pep MTDTAPTDTDPTENGTRKMPSEHRPTPPAKKRRPLLKLSAALLSVLLLAVCFLGWLAGTE
             ||||:||||||||||||||||||||:|||||||||||||||||||||||||||||:||||
    g285     MTDTTPTDTDPTENGTRKMPSEHRPAPPAKKRRPLLKLSAALLSVLILAVCFLGWIAGTE
                    10         20         30         40         50         60

70         80         90        100        110        120
    m285.pep AGLRFGLYQIPSWFGVNISSQNLKGTLLDGFDGDNWSIETEGADLKISRFRFAWKPSELM
             ||||||||||||||||||||||||||||||||||||||||||||||||||||||||||||
    g285     AGLRFGLYQIPSWFGVNISSQNLKGTLLDGFDGDNWSIETEGADLKISRFRFAWKPSELM
                    70         80         90        100        110        120
```

-continued

```
              130       140       150       160       170       180
m285.pep  RRSLHITEISAGDIAIVTKPTPPKEERPPLSLPDSIDLPAAVYLDRFETGKISMGKAFDK
          ||||||:||||||||||||||||||||||:||||||||||||||||||||||||||:|||
g285      RRSLHITDISAGDIAIVTKPTPPKEERPPLSLPDSIDLPAAVYLDRFETGKISMGKAFDK
              130       140       150       160       170       180

190       200       210       220       230       240
m285.pep  QTVYLERLDASYRYDRKGHRLDLKAADTPWSWSSGAASVGLKKPFALDTAIYTKGGLEGK
          ||||||||:|:||||||||||||||||||||:||||:|||||||||||||||||||:||:
g285      QTVYLERLNAAYRYDRKGHRLDLKAADTPWSSSSGSASVGLKKPFALDTAIYTKGGFEGE
              190       200       210       220       230       240

250       260       270       280       290       300
m285.pep  TIHSTARLSGSLKDVRAELAIDGGNIRLSGKSVIHPFAESLDKTLEEVLVKGFNINPAAF
          |||||||||||||||||||:||||||||||||||||||||||||||||||||||||:||
g285      TIHSTARLSGSLKDVRAELTIDGGNIRLSGKSVIHPFAESLDKTLEEVLVKGFNINPSAF
              250       260       270       280       290       300

310       320       330       340       350       360
m285.pep  VPSLPDAGLNFDLTAIPSFSDGIALEGSLDLENTKAGFADRNGIPVRQVLGGFVIRQDGT
          ||||||||||||||||||||||||||||||||||||||||||||||||||||||||||||
g285      VPSLPDAGLNFDLTAIPSFSDGIALEGSLDLENTKAGFADRNGIPVRQVLGGFVIRQDGT
              310       320       330       340       350       360

370       380       390       400       410       420
m285.pep  VHIGNTSAALLGRGGIRLSGKIDTEKDILDLNIGINSVGAEDVLQTAFKGRLDGSIGIGG
          ||||||||||||||||||||||||||||||||||||||||||||||||||||||||||||
g285      VHIGNTSAALLGRGGIRLSGKIDTEKDILDLNIGINSVGAEDVLQTAFKGRLDGSIGIGG
              370       380       390       400       410       420

430       440       450       460       470       480
m285.pep  TTASPKISWQLGIGTARTDGSLAIASDPANGQRKLVLDTVNIAAGQGSLTAQGYLELFKD
          |||||||||||||:|||||||||||||||||:||||:|||||||||:||||||||||||
g285      TTASPKISWQLGTGTARTDGSLAIASDPANEQRKLVFDTVNIAAGEGSLTAQGYLELFKD
              430       440       450       460       470       480

490       500       510       520       530       540
m285.pep  RLLKLDIRSRAFDPSRIDPQLPAGNINGSINLAGELAKEKFTKMRPLPGTFNGVPIAGS
          ||||||||||||||||||||:|||||||||:||||||||||||||||:|||||||||||
g285      RLLKLDIRSRAFDPSRIDPQFPAGNINGSIHLAGELAKEKFTKMRFLPGTFNGVPIAGS
              490       500       510       520       530       540

550       560       570       580       590       600
m285.pep  ADIVYESRHLPRAAVDLRLGRNIIKTDGGFGKKGDRLNLNITAPDLSRFGFGLAGSLNVR
          |||||||||||||||||||||||:||||||||||||||||||||||||||||||||||||
g285      ADIVYESRHLPRAAVDLRLGRNIVKTDGGFGKKGDRLNLNITAPDLSRFGFGLAGSLNVR
              550       560       570       580       590       600

610       620       630       640       650       660
m285.pep  GHLSGDLDGGIRTFFTDLSGAARNLHIGKAADIRSLDFTLKGSPDTSRPIRADIKGSRLS
          |||||||||||||||||||:||||||||||||||||||||||||  ||:|||||:|||
g285      GHLSGDLDGGIRTFFTDLSGTARNLHIGKAADIRSLDFTLKGSPGTSRPMRADIKGGRLS
              610       620       630       640       650       660

670       680       690       700       710       720
m285.pep  LSGGAAVVDTADLMLDGTGVQHRIRTHAAMTLDGKPFKFDLDASGGINRELTRWKGSIGI
          ||||||||||| | |:|||:||||||||||||||||||:|||||||||||||||||||
g285      LSGGAAVVDTAGLTLEGTGAQHRIRTHAAMTLDGKPFKLDLDASGGINRELTRWKGSIGI
              670       680       690       700       710       720

730       740       750       760       770       780
m285.pep  LDIGGAFNLKLQNRMTLEAGAERVAASAANWQAMGGSLNLQHFSWDKKTGISAKGGAHGL
          ||||||||||||||||||||||:|||||||||||||||||||||||:|||||||||:|
g285      LDIGGAFNLKLQNRMTLEAGAEHVAASAANWQAMGGSLNLQHFSWDRKTGISAKGGARGL
              730       740       750       760       770       780

790       800       810       820       830       840
m285.pep  HIAELHNFFKPPFEHNLVLNGDWDVAYGRNARGYLNISRQSGDAVLPGGQALGINAFSLK
          ||||||||||||||||||||||||||||:|||||||||||||||||||||||:||||||
a285      HIAELHNFFKPPFEHNLVLNGDWDVAYGHNARGYLNISRQSGDAVLPGGQALGLNAFSLK
              790       800       810       820       830       840

850       860       870       880       890       900
m285.pep  TRFQNDRIGILLDGGARFGRINADLGIANAFGGNMANAPLGGRITASLPDLGALKPFLPA
          |||||||||||||||||||||||||:||||||||||||||||||||||||||||||||
a285      TRFQNDRIGILLDGGARFGRINADLDIGNAFGGNMANAPLGGRITASLPDLGALKPFLPA
              850       860       870       880       890       900

910       920       930       940       950       960
m285.pep  AAQNITGSLNAAAQIGGRVGSPSVNAAVNGSSNYGKINGNITVGQSRSFDTAPLGGRLNL
          ||||||||||:||||||||||||||||||||||||||||||||||||||||||||||||
g285      AAQNITGSLNASAQIGGRVGSPSVNAAVNGSSNYGKINGNITVGQSRSFDTAPLGGRLNL
              910       920       930       940       950       960

970       980       990       1000      1010      1020
m285.pep  TVADAEVFRNFLPVGQTVKGSLNAAVTLGGSIADPHLGGSINGDKLYYRNQTQGIILDNG
          ||||||:|||||||||||||||||||||||||||||||||||||||||||||||||||
g285      TVADAEAFRNFLPVGQTVKGSLNAAVTLGGSIADPHLGGSINGDKLYYRNQTQGIILDNG
              970       980       990       1000      1010      1020

1030      1040      1050      1060      1070      1080
m285.pep  SLRSHIAGRKWVIDSLKFRHEGTAELSGTVGMENSGPDVDIGAVFDKYRILSRPNRRLTV
          |||||||||||||||||||||||||||||||:||||||||||||||||||||||||||
g285      SLRSHIAGRKWVIDSLKFRHEGTAELSGTVSMENSGPDVDIGAVFDKYRILSRPNRRLTV
              1030      1040      1050      1060      1070      1080
```

-continued

```
                1090      1100      1110      1120      1130      1140
m285.pep  SGNTRLRYSPQKGISVTGMIKTDQGLFGSQKSSMPSVGDDVVVLGEVKKEAAAPLPVNMN
          ||||||||||||||||||||||||||||||||||||||||||||||||||||| ||||||
g285      SGNTRLRYSPQKGISVTGMIKTDQGLFGSQKSSMPSVGDDVVVLGEVKKEAAASLPVNMN
                1090      1100      1110      1120      1130      1140

1150      1160      1170      1180      1190      1200
m285.pep  LTLDLNDGIRFAGYGADVTIGGKLTLTAQSGGSVRGVGTVRVIKGRYKAYGQDLDITKGT
          |||||||||||:||||||||||||||||| ||:|||||||||||||||||||||||||||
g285      LTLDLNDGIRFAGYGADVTIGGKLTLTAQPGGNVRGVGTVRVIKGRYKAYGQDLDITKGT
                1150      1160      1170      1180      1190      1200

1210      1220      1230      1240      1250      1260
m285.pep  VSFVGPLNDPNLNIRAERRLSPVGAGVEILGSLNSPRITLTANEPMSEKDKLSWLILNRA
          ||||||||||||||||||||||||||||||||||||||||||||||||||||||||||||
g285      VSFVGPLNDPNLNIRAERRLSPVGAGVEILGSLNSPRITLTANEPMSEKDKLSWLILNRA
                1210      1220      1230      1240      1250      1260

1270      1280      1290      1300      1310      1320
m285.pep  GSGSSGDNAALSAAAGALLAGQINDRIGLVDDLGFTSKRSRNAQTGELNPAEQVLTVGKQ
          ||||||||||||||||||||||||||||||||||||||||||||||||||||||||||||
g285      GSGSSGDNAALSAAAGALLAGQINDRIGLVDDLGFTSKRSRNAQTGELNPAEQVLTVGKQ
                1270      1280      1290      1300      1310      1320

1330      1340      1350      1360      1370      1380
m285.pep  LTGKLYIGYEYSISSAEQSVKLIYRLTRAIQAVARIGSRSSGGELTYTIRFDRFSGSDKK
          |||||||||||:|||||||||||||||||||||||||||||||||||||||||: |||||
g285      LTGKLYIGYEYGISSAEQSVKLIYRLTRAIQAVARIGSRSSGGELTYTIRFDRLFGSDKK
                1330      1340      1350      1360      1370      1380

1390
m285.pep  DSAGNGKGKX
          ||||||||||
g285      DSAGNGKGKX
```

The following partial DNA sequence was identified in *N. meningitidis* <SEQ ID 1185>:

```
a285.seq
   1 ATGACCGATA CCGCACCGAC AGATACCGAT CCGACCGAAA ACGGCACGCG

51 CAAAATGCCG TCTGAACACC GCCCTACCCC GCCGGCAAAA AAACGCCGCC

101 CGCTGCTGAA GCTGTCGGCG GCACTGCTGT CTGTTCTGAT TTTGGCAGTA

151 TGTTTCCTCG GCTGGCTCGC CGGCACGGAA GCGGGTTTGC GCTTCGGGCT

201 GTACCAAATC CCGTCTTGGT TCGGCGTAAA CATTTCCTCC CAAAACCTCA

251 AAGGCACGCT GCTCGACGGC TTCGACGGCG ACAACTGGTC GATAGAAACC

301 GAGGGGGCAG ACCTTAAAAT CAGCCGCTTC CGCTTCGCGT GGAAACCGTC

351 CGAACTGATG CGCCGCAGCC TGCACATTAC CGAAATTTCC GCCGGCGACA

401 TCGCCATCGT TACCAAACCG ACTCCGCCTA AAGAAGAACG CCCGCCGCTC

451 AGCCTTCCCG ACAGCATAGA CCTGCCTGCC GCCGTCTATC TCGACCGCTT

501 CGAGACGGGC AAAATCAGCA TGGGCAAAGC CTTTGACAAA CAAACCGTCT

551 ATCTCGAACG GCTGGATGCT TCATACCGTT ACGACCGCAA AGGACACCGC

601 CTCGACCTGA AGGCTGCCGA CACGCCGTGG AGCAGTTCGT CGGGGTCAGC

651 CTCGGTCGGC TTGAAAAAAC CGTTTGCCCT CGATACCGCC ATTTACACCA

701 AAGGCGGACT CGAAGGCAAA ACCATACACA GTACGGCTCG GCTGAGCGGC

751 AGCCTGAAGG ATGTGCGCGC CGAACTGGCG ATCGACGGCG GCAATATCCG

801 CCTCTCGGGA AAATCCGTCA TCCACCCGTT TGCCGAATCA TTGGATAAAA

851 CATTGGAAGA AGTACTGGTC AAAGGGTTCA ACATCAATCC GTCCGCCTTC

901 GTGCCTTCCC TGCCCGATGC CGGGCTGAAT TTCGACCTGA CCGCCATCCC

951 GTCGTTTTCA GACGGCATCG CGCTGGAAGG CTCGCTCGAT TTGGAAAACA

1001 CCAAAGCCGG CTTTGCCGAC CGCAACGGCA TCCCCGTCCG TCAGGTTTTA

1051 GGCAGCTTTG TCATCCGGCA GGACGGCACG GTGCATATCG GCAATACGTC
```

-continued

```
1101  CGTCGCCCTG CTCGGACGGG GCGGCATCAG GCTGTCGGGC AAAATCGACA
1151  CCGAAAAAGA CATCCTCGAT TTAAATATAG GCATCAACTC CGTCGGCGCG
1201  GAAGACGTAC TGCAAACCGC GTTCAAAGGC AGGTTGGACG GCAGCATCGG
1251  CATCGGTGGC ACGACCGCCT CGCCCAAAAT CTCTTGGCAA CTCGGCATCG
1301  GCACGGCGCG CACGGACGGC AGCCTCGCCA TTGCAAGCGA CCCCGCAAAC
1351  GGACAGCGGA AACTGGTGCT CGACACCGTC AACATCGCCG CCGGGCAAGG
1401  CAGCCTGACC GCGCAAGGCT ATCTCGAGCT GTTTAAAGAC CGCCTGCTCA
1451  AGCTGGACAT CCGTTCCCGC GCATTCGACC CTTCGCGCAT CGATCCGCAA
1501  CTTCCGGCAG GCAATATCAA CGGCTCAATA AACCTTGCCG GCGAACTGGC
1551  AAAAGAGAAA TTCACAGGCA AAATGCGGTT TTTACCCGGC ACGTTCAACG
1601  GCGTACCGAT TGCCGGCAGT GCCGACATTG TTTACGAGTC CCGCCACCTT
1651  CCGCGTGCCG CCGTCGATTT GCGGCTGGGG CGGAACATTA TTAAAACAGA
1701  CGGCGGCTTC GGCAAAAAAG GCGACCGGCT TAACCTCAAT ATCACCGCAC
1751  CCGATTTATC CCGTTTCGGT TTCGGACTCG CGGGGTCTTT AAATGTACGC
1801  GGACACCTTT CCGGCGATTT GGACGGTGGC ATCCGAACCT TTGAAACCGA
1851  CCTTTCCGGC GCGGCGCGCA ACCTGCACAT CGGCAAGGCG GCAGACATCC
1901  GTTCGCTCGA TTTCACGCTC AAAGGTTCGC CCGACACAAG CCGCCCGATA
1951  CGCGCCGACA TCAAAGGCAG CCGCCTTTCG CTGTCGGGCG GAGCGGAGGT
2001  TGTCGATACC GCCGACCTGA TGCTGGACGG CACGGGCGTG CAGCACCGCA
2051  TCCGCACACA CGCCGCCATG ACGCTGGATG GCAAACCGTT CAAATTCGAT
2101  TTGGACGCTT CAGGCGGCAT CAACAGGGAA CTTACCCGAT GGAAAGGCAG
2151  CATCGGCATC CTCGACATCG GCGGCGCATT CAACCTCAAG CTGCAAAACC
2201  GTATGACGCT CGAAGCCGGT GCGGAACGCG TGGCGGCAAG TGCGGCAAAT
2251  TGGCAGGCAA TGGGCGGCAG CCTCAACCTG CAACACTTTT CTTGGGATAA
2301  AAAAACCGGC ATATCGGCAA AAGGCGGCGC ACACGGTCTG CATATCGCCG
2351  AGTTGCACAA TTTCTTCAAA CCGCCCTTCG AACACAATCT GGTTTTAAAC
2401  GGCGACTGGG ATGTCGCCTA CGGGCGAAAC GCGCGCGGCT ACCTCAATAT
2451  CAGCCGGCAA AGCGGCGATG CCGTATTGCC CGGCGGGCAG GCTTTGGGTT
2501  TGAACGCATT TTCCCTGAAA ACGCGCTTTC AAAACGACCG TATCGGAATC
2551  CTGCTTGACG GCGGCGCGCG TTTCGGGCGG ATTAACGCCG ATTTGGACAT
2601  CGGCAACGCC TTCGGCGGCA ATATGGCAAA TGCACCGCTC GGCGGCAGGA
2651  TTACCGCCTC CCTTCCCGAC TTGGGCACAT TGAAGCCCTT TCTGCCCGCC
2701  GCCGCGCAAA ACATTACCGG CAGCCTGAAT GCCGCCGCGC AAATCGGCGG
2751  ACGGGTCGGC TCTCCGTCCG TCAATGCCGC CGTCAACGGC AGCAGCAACT
2801  ACGGGAAAAT CAACGGCAAC ATCACCGTCG GCAAAGCCG CTCTTTCGAT
2851  ACCGCGCCTT TGGGCGGCAG GCTCAACCTG ACCGTTGCCG ATGCCGAAGT
2901  ATTCCGCAAC TTCCTACCGG TCGACAAAC CGTCAAAGGC AGCCTGAATG
2951  CCGCCGTAAC CCTCGGCGGC AGCATCGCCG ATCCGCACTT GGGCGGCAGC
3001  ATCAACGGCG ACAAACTCTA TTACCGCAAC CAAACCCAAG GCATCATCTT
3051  GGACAACGGC TCGCTGCGTT CGCATATCGC GGGCAGGAAA TGGGTAATCG
```

```
3101 ACAGCCTGAA ATTCCGGCAC GAAGGGACGG CGGAACTCTC CGGTACGGTC

3151 GGTATGGAAA ACAGCGGACC CGATGTCGAT ATCGGCGCGG TGTTCGACAA

3201 ATACCGCATC CTGTCCCGCC CCAACCGCCG CCTGACGGTT TCCGGCAACA

3251 CCCGCCTGCG CTATTCGCCG CAAAAAGGCA TATCCGTTAC CGGGATGATT

3301 AAAACGGATC AGGGGCTGTT CGGTTCGCAA AAATCCTCGA TGCCGTCCGT

3351 CGGCGACGAT GTCGTCGTAT TAGGCGAAGT CAAAAAAGAG GCGGCGGCAC

3401 CGCTCCCCGT CAATATGAAC CTGACTTTAG ACCTCAATGA CGGCATCCGC

3451 TTCGCCGGCT ACGGCGCGGA CGTTACCATA GGCGGCAAAC TGACCCTGAC

3501 CGCCCAATCG GGCGGAAGCG TGCGGGCGT GGGCACGGTC CGCGTCATCA

3551 AAGGGCGTTA TAAGGCATAC GGGCAGGATT TGGACATTAC CAAAGGCACG

3601 GTCTCCTTTG TCGGCCCGCT CAACGACCCC AACCTCAACA TCCGCGCCGA

3651 ACGCCGCCTT TCCCCCGTCG GTGCGGGCGT GGAAATATTG GGCAGCCTCA

3701 ACAGTCCGCG CATTACGCTG ACGGCAAACG AACCGATGAG TGAAAAAGAC

3751 AAGCTCTCCT GGCTCATCCT CAACCGCGCC GGCAGTGGCA GCAGCGGCGA

3801 CAATGCCGCC CTGTCCGCAG CCGCCGGCGC GCTGCTTGCC GGGCAAATCA

3851 ACGACCGCAT CGGGCTGGTG GATGATTTGG GCTTTACCAG CAAGCGCAGC

3901 CGCAACGCGC AAACCGGCGA ACTCAACCCC GCCGAACAGG TGCTGACCGT

3951 CGGCAAACAA CTGACCGGCA AACTCTACAT CGGCTACGAA TACAGCATCT

4001 CCAGCGCGGA ACAGTCCGTC AAACTGATTT ACCGGCTGAC CCGCGCCATA

4051 CAGGCGGTTG CCCGTATCGG CAGCCGTTCG TCGGGCGGCG AGCTGACATA

4101 CACCATACGT TTCGACCGCT TCTCCGGTTC GGACAAAAAA GACTCCGCCG

4151 GAAACAGCAA AGGAAAATAA
```

This corresponds to the amino acid sequence <SEQ ID 1186; ORF 285.a>:

```
a285.pep

1 MTDTAPTDTD PTENGTRKMP SEHRPTPPAK KRRPLLKLSA ALLSVLILAV
     51 CFLGWLAGTE AGLRFGLYQI PSWFGVNISS QNLKGTLLDG FDGDNWSIET
    101 EGADLKISRF RFAWKPSELM RRSLHITEIS AGDIAIVTKP TPPKEERPPL
    151 SLPDSIDLPA AVYLDRFETG KISMGKAFDK QTVYLERLDA SYRYDRYGHR
    201 LDLKAADTPW SSSSGSASVG LKKPFALDTA IYTKGGLEGK TIHSTARLSG
    251 SLKDVRAELA IDGGNIRLSG KSVIHPFAES LDKTLEEVLV KGFNINPSAF
    301 VPSLPDAGLN FDLTAIPSFS DGIALEGSLD LENTKAGFAD RNGIPVRQVL
    351 GSFVIRQDGT VHIGNTSVAL LGRGGIRLSG KIDTEKDILD LNIGINSVGA
    401 EDVLQTAFKG RLDGSIGIGG TTASPKISWQ LGIGTARTDG SLAIASDPAN
    451 GQRKLVLDTV NIAAGQGSLT AQGYLELFKD RLLKLDIRSR AFDPSRIDPQ
    501 LPAGNINGSI NLAGELAKEK FTGKMRFLPG TFNGVPIAGS ADIVYESRHL
    551 PRAAVDLRLG RNIIKTDGGF GKKGDRLNLN ITAPDLSRFG FGLAGSLNVR
    601 GHLSGDLDGG IRTFETDLSG AARNLHIGKA ADIRSLDFTL KGSPDTSRPI
    651 RADIKGSRLS LSGGAEVVDT ADLMLDGTGV QHRIRTHAAM TLDGKPFKFD
    701 LDASGGINRE LTRWKGSIGI LDIGGAFNLK LQNRMTLEAG AERVAASAAN
    751 WQAMGGSLNL QHFSWDKKTG ISAKGGAHGL HIAELHNFFK PPFEHNLVLN
```

```
 801   GDWDVAYGRN ARGYLNISRQ SGDAVLPGGQ ALGLNAFSLK TRFQNDRIGI

851   LLDGGARFGR INADLDIGNA FGGNMANAPL GGRITASLPD LGTLKPFLPA

901   AAQNITGSLN AAAQIGGRVG SPSVNAAVNG SSNYGKINGN ITVGQSRSFD

951   TAPLGGRLNL TVADAEVFRN FLPVGQTVKG SLNAAVTLGG SIADPHLGGS

1001   INGDKLYYRN QTQGIILDNG SLRSHIAGRK WVIDSLKFRH EGTAELSGTV

1051   GMENSGPDVD IGAVFDKYRI LSRPNRRLTV SGNTRLRYSP QKGISVTGMI

1101   KTDQGLFGSQ KSSMPSVGDD VVVLGEVKKE AAAPLPVNMN LTLDLNDGIR

1151   FAGYGADVTI GGKLTLTAQS GGSVRGVGTV RVIKGRYKAY GQDLDITKGT

1201   VSFVGPLNDP NLNIRAERRL SPVGAGVEIL GSLNSPRITL TANEPMSEKD

1251   KLSWLILNRA GSGSSGDNAA LSAAAGALLA GQINDRIGLV DDLGFTSKRS

1301   RNAQTGELNP AEQVLTVGKQ LTGKLYIGYE YSISSAEQSV KLIYRLTRAI

1351   QAVARIGSRS SGGELTYTIR FDRFSGSDKK DSAGNSKGK*
``` m285/a285 99.4% identity in 1389 aa overlap

```
                10         20         30         40         50         60
m285.pep   MTDTAPTDTDPTENGTRKMPSEHRPTPPAKKRRPLLKLSAALLSVLLLAVCFLGWLAGTE
           ||||||||||||||||||||||||||||||||||||||||||||||| ||||||||||||
a285       MTDTAPTDTDPTENGTRKMPSEHRPTPPAKKRRPLLKLSAALLSVLILAVCFLGWLAGTE
                10         20         30         40         50         60

70         80         90        100        110        120
m285.pep   AGLRFGLYQIPSWFGVNISSQNLKGTLLDGFDGDNWSIETEGADLKISRFRFAWKPSELM
           ||||||||||||||||||||||||||||||||||||||||||||||||||||||||||||
a285       AGLRFGLYQIPSWFGVNISSQNLKGTLLDGFDGDNWSIETEGADLKISRFRFAWKPSELM
                70         80         90        100        110        120

130        140        150        160        170        180
m285.pep   RRSLHITEISAGDIAIVTKPTPPKEERPPLSLPDSIDLPAAVYLDRFETGKISMGKAFDK
           ||||||||||||||||||||||||||||||||||||||||||||||||||||||||||||
a285       RRSLHITEISAGDIAIVTKPTPPKEERPPLSLPDSIDLPAAVYLDRFETGKISMGKAFDK
               130        140        150        160        170        180

190        200        210        220        230        240
m285.pep   QTVYLERLDASYRYDRKGHRLDLKAADTPWSWSSGAASVGLKKPFALDTAIYTKGGLEGK
           |||||||||||||||||||||||||||||||| :|||||||||||||||||||||||||
a285       QTVYLERLDASYRYDRKGHRLDLKAADTPWSSSSGSASVGLKKPFALDTAIYTKGGLEGK
               190        200        210        220        230        240

250        260        270        280        290        300
m285.pep   TIHSTARLSGSLKDVRAELAIDGGNIRLSGKSVIHPFAESLDKTLEEVLVKGFNINPAAF
           |||||||||||||||||||||||||||||||||||||||||||||||||||||||||:||
a285       TIHSTARLSGSLKDVRAELAIDGGNIRLSGKSVIHPFAESLDKTLEEVLVKGFNINPSAF
               250        260        270        280        290        300

310        320        330        340        350        360
m285.pep   VPSLPDAGLNFDLTAIPSFSDGIALEGSLDLENTKAGFADRNGIPVRQVLGGFVIRQDGT
           |||||||||||||||||||||||||||||||||||||||||||||||||:||||||||
a285       VPSLPDAGLNFDLTAIPSFSDGIALEGSLDLENTKAGFADRNGIPVRQVLGSFVIRQDGT
               310        320        330        340        350        360

370        380        390        400        410        420
m285.pep   VHIGNTSAALLGRGGIRLSGKIDTEKDILDLNIGINSVGAEDVLQTAFKGRLDGSIGIGG
           ||||||:|||||||||||||||||||||||||||||||||||||||||||||||||||||
a285       VHIGNTSVALLGRGGIRLSGKIDTEKDILDLNIGINSVGAEDVLQTAFKGRLDGSIGIGG
               370        380        390        400        410        420

430        440        450        460        470        480
m285.pep   TTASPKISWQLGIGTARTDGSLAIASDPANGQRKLVLDTVNIAAGQGSLTAQGYLELFKD
           ||||||||||||||||||||||||||||||||||||||||||||||||||||||||||||
a285       TTASPKISWQLGIGTARTDGSLAIASDPANGQRKLVLDTVNIAAGQGSLTAQGYLELFKD
               430        440        450        460        470        480

490        500        510        520        530        540
m285.pep   RLLKLDIRSRAFDPSRIDPQLPAGNINGSINLAGELAKEKFTGKMRPLPGTFNGVPIAGS
           |||||||||||||||||||||||||||||||||||||||||||||||| |||||||||||
a285       RLLKLDIRSRAFDPSRIDPQLPAGNINGSINLAGELAKEKFTGKMRFLPGTFNGVPIAGS
               490        500        510        520        530        540

550        560        570        580        590        600
m285.pep   ADIVYESRHLPRAAVDLRLGRNIIKTDGGFGKKGDRLNLNITAPDLSRFGFGLAGSLNVR
           ||||||||||||||||||||||||||||||||||||||||||||||||||||||||||||
a285       ADIVYESRHLPRAAVDLRLGRNIIKTDGGFGKKGDRLNLNITAPDLSRFGFGLAGSLNVR
               550        560        570        580        590        600

610        620        630        640        650        660
m285.pep   GHLSGDLDGGIRTFFTDLSGAARNLHIGKAADIRSLDFTLKGSPDTSRPIRADIKGSRLS
           ||||||||||||||||||||||||||||||||||||||||||||||||||||||||||||
a285       GHLSGDLDGGIRTFFTDLSGAARNLHIGKAADIRSLDFTLKGSPDTSRPIRADIKGSRLS
               610        620        630        640        650        660
```

-continued

```
              670        680        690        700        710        720
m285.pep   LSGGAAVVDTADLMLDGTGVQHRIRTHAAMTLDGKPFKFDLDASGGINRELTRWKGSIGI
           ||||| |||||||||||||||||||||||||||||||||||||||||||||||||||||
a285       LSGGAEVVDTADLMLDGTGVQHRIRTHAAMTLDGKPFKFDLDASGGINRELTRWKGSIGI
              670        680        690        700        710        720

730        740        750        760        770        780
m285.pep   LDIGGAFNLKLQNRMTLEAGAERVAASAANWQAMGGSLNLQHFSWDKKTGISAKGGAHGL
           ||||||||||||||||||||||||||||||||||||||||||||||||||||||||||||
a285       LDIGGAFNLKLQNRMTLEAGAERVAASAANWQAMGGSLNLQHFSWDKKTGISAKGGAHGL
              730        740        750        760        770        780

790        800        810        820        830        840
m285.pep   HIAELHNFFKPPFEHNLVLNGDWDVAYGRNARGYLNISRQSGDAVLPGGQALGINAFSLK
           ||||||||||||||||||||||||||||||||||||||||||||||||||||| ||||||
a285       HIAELHNFFKPPFEHNLVLNGDWDVAYGRNARGYLNISRQSGDAVLPGGQALGLNAFSLK
              790        800        810        820        830        840

850        860        870        880        890        900
m285.pep   TRFQNDRIGILLDGGARFGRINADLGIANAFGGNMANAPLGGRITASLPDLGALKPFLPA
           |||||||||||||||||||||||||| :||||||||||||||||||||||||| ||||||
a285       TRFQNDRIGILLDGGARFGRINADLDIGNAFGGNMANAPLGGRITASLPDLGTLKPFLPA
              850        860        870        880        890        900

910        920        930        940        950        960
m285.pep   AAQNITGSLNAAAQIGGRVGSPSVNAAVNGSSNYGKINGNITVGQSRSFDTAPLGGRLNL
           ||||||||||||||||||||||||||||||||||||||||||||||||||||||||||||
a285       AAQNITGSLNAAAQIGGRVGSPSVNAAVNGSSNYGKINGNITVGQSRSFDTAPLGGRLNL
              910        920        930        940        950        960

970        980        990       1000       1010       1020
m285.pep   TVADAEVFRNFLPVGQTVKGSLNAAVTLGGSIADPHLGGSINGDKLYYRNQTQGIILDNG
           ||||||||||||||||||||||||||||||||||||||||||||||||||||||||||||
a285       TVADAEVFRNFLPVGQTVKGSLNAAVTLGGSIADPHLGGSINGDKLYYRNQTQGIILDNG
              970        980        990       1000       1010       1020

1030       1040       1050       1060       1070       1080
m285.pep   SLRSHIAGRKWVIDSLKFRHEGTAELSGTVGMENSGPDVDIGAVFDKYRILSRPNRRLTV
           ||||||||||||||||||||||||||||||||||||||||||||||||||||||||||||
a285       SLRSHIAGRKWVIDSLKFRHEGTAELSGTVGMENSGPDVDIGAVFDKYRILSRPNRRLTV
             1030       1040       1050       1060       1070       1080

1090       1100       1110       1120       1130       1140
m285.pep   SGNTRLRYSPQKGISVTGMIKTDQGLFGSQKSSMPSVGDDVVVLGEVKKEAAAPLPVNMN
           ||||||||||||||||||||||||||||||||||||||||||||||||||||||||||||
a285       SGNTRLRYSPQKGISVTGMIKTDQGLFGSQKSSMPSVGDDVVVLGEVKKEAAAPLPVNMN
             1090       1100       1110       1120       1130       1140

1150       1160       1170       1180       1190       1200
m285.pep   LTLDLNDGIRFAGYGADVTIGGKLTLTAQSGGSVRGVGTVRVIKGRYKAYGQDLDITKGT
           ||||||||||||||||||||||||||||||||||||||||||||||||||||||||||||
a285       LTLDLNDGIRFAGYGADVTIGGKLTLTAQSGGSVRGVGTVRVIKGRYKAYGQDLDITKGT
             1150       1160       1170       1180       1190       1200

1210       1220       1230       1240       1250       1260
m285.pep   VSFVGPLNDPNLNIRAERRLSPVGAGVEILGSLNSPRITLTANEPMSEKDKLSWLILNRA
           ||||||||||||||||||||||||||||||||||||||||||||||||||||||||||||
a285       VSFVGPLNDPNLNIRAERRLSPVGAGVEILGSLNSPRITLTANEPMSEKDKLSWLILNRA
             1210       1220       1230       1240       1250       1260

1270       1280       1290       1300       1310       1320
m285.pep   GSGSSGDNAALSAAAGALLAGQINDRIGLVDDLGFTSKRSRNAQTGELNPAEQVLTVGKQ
           ||||||||||||||||||||||||||||||||||||||||||||||||||||||||||||
a285       GSGSSGDNAALSAAAGALLAGQINDRIGLVDDLGFTSKRSRNAQTGELNPAEQVLTVGKQ
             1270       1280       1290       1300       1310       1320

1330       1340       1350       1360       1370       1380
m285.pep   LTGKLYIGYEYSISSAEQSVKLIYRLTRAIQAVARIGSRSSGGELTYTIRFDRFSGSDKK
           ||||||||||||||||||||||||||||||||||||||||||||||||||||||||||||
a285       LTGKLYIGYEYSISSAEQSVKLIYRLTRAIQAVARIGSRSSGGELTYTIRFDRFSGSDKK
             1330       1340       1350       1360       1370       1380

1390
m285.pep   DSAGNGKGKX
           |||||:||||
a285       DSAGNSKGKX
             1390
```

The following partial DNA sequence was identified in *N. gonorrhoeae* <SEQ ID 1187>:

```
g285-1.seq
    1  CTGAAGCTGT CGGCGGCACT GCTGTCTGTC CTGATTTTGG CAGTATGTTT

51  CCTCGGCTGG ATCGCCGGTA CGGAAGCAGG TTTGCGCTTC GGGCTGTACC

101  AAATCCCGTC CTGGTTCGGC GTAAACATTT CCTCCCAAAA CCTCAAGGGC

151  ACACTGCTCG ACGGCTTCGA CGGCGACAAC TGGTCGATAG AAACCGAGGG
```

-continued

```
 201 GGCAGACCTT AAAATCAGCC GCTTCCGCTT CGCGTGGAAA CCGTCCGAAC
 251 TGATGCGCCG CAGCCTGCAC ATCACCGACA TCTCCGCCGG CGACATCGCC
 301 ATCGTAACCA AACCGACTCC GCCTAAAGAA GAACGCCCGC CTCAAGGCCT
 351 GCCCGACAGC ATAGACCTGC CCGCCGCCGT CTATCTCGAC CGCTTCGAGA
 401 CGGGCAAAAT CAGCATGGGC AAAACCTTTG ACAAACAAAC CGTCTATCTC
 451 GAACGCCTCA ACGCGGCATA CCGTTACGAC CGTAAAGGGC ACCGCCTCGA
 501 CCTGAAGGCC GCCGACACGC CGTGGAGCAG TTCGTCGGGG TCAGCCTCGG
 551 TCGGCTTGAA AAAACCGTTT GCCCTCGATA CCGCCATTTA CACCAAAGGC
 601 GGATTCGAAG GCGAAACCAT ACACAGTACG GCGCGGCTGA GCGGCAGCCT
 651 GAAGGATGTG CGCGCCGAAC TGACGATCGA CGGCGGCAAT ATCCGCCTCT
 701 CGGGAAAATC CGTCATCCAC CCGTTTGCCG AATCATTGGA TAAAACATTG
 751 GAAGAAGTAC TGGTCAAAGG ATTCAACATC AATCCGTCCG CCTTCGTGCC
 801 TTCCCTGCCC GATGCCGGGC TGAATTTCGA CCTGACCGCC ATCCCGTCGT
 851 TTTCAGACGG CATCGCGCTG GAAGGCTCGC TCGATTTGGA AACACCAAA
 901 GCCGGCTTTG CCGACCGCAA CGGCATCCCC GTCCGTCAGG TTTTGGGCGG
 951 CTTTGTCATC CGGCAGGACG GCACGGTGCA TATCGGCAAT ACGTCCGCCG
1001 CCCTGCTCGG ACGGGGCGGC ATCAGGCTGT CGGGCAAAAT CGACACCGAA
1051 AAAGACATCC TTGATTTAAA TATAGGCATC AACTCCGTCG GCGCGGAAGA
1101 CGTGCTGCAA ACCGCGTTCA AAGGCAGGTT GGACGGCAGC ATCGGCATCG
1151 GCGGCACGAC CGCCTCGCCC AAAATCTCTT GGCAACTCGG CACCGGCACG
1201 GCACGCACGG ACGGCAGCCt cgcCATCGCA AGCGAcCCCG CAAACGAACA
1251 GCGGAAACTG GTGTTCGACA CCGTCAACAT CTCCGCCGGG GAAGGCAGCC
1301 TGACCGCGCA AGGCTATCTC GAGCTGTTTA AGACCGCCT GCTCAAGCTG
1351 GACATCCGTT CCCGCGCATT CGACCCTTCG CGCATCGATC CGCAATTTCC
1401 GGCAGGCgat atCAACGGTT CGATTCATCT TGCCGGTGAA CTGGCAAAAG
1451 AGAAATTTAC GGGCAAAATG CGTTTTTTGC CCGGTACGTT CAACGGCGTG
1501 CCGATTGCCG GCAGCGCCGA CATTGTTTAC GAGTCCCGCC ACCTTCCGCG
1551 CGCCGCCGTC GATTTGCGGT TGGGGCGGAA CATCGTCAAA ACAGACGGCG
1601 GCTTCGGCAA AAAAGGCGAC CGGCTTAACC TCAATATCAC CGCACCCGAT
1651 TTATCCCGTT TCGGTTTCGG ACTCGCGGGG TCTTTAAATG TACGCGGACA
1701 CCTTTCCGGC GATTTGGACG GCGGCATCCG AACCTTTGAA ACCGACCTTT
1751 CCGGCACGGC GCGCAACTTA CACATCGGCA AGCGGCAGA CATCCGTTCG
1801 CTCGATTTTA CCCTCAAAGG CTCACCCGGC ACAAGCCGCC CGATGCGCGC
1851 CGATATCAAG GGCGGCCGCC TTTCCCTGTC GGGCGGCGCG GCGGTTGTCG
1901 ATACCGCCGG CCTGACGCTG GAAGGTACGG GCGCGCAGCA CCGCATCCGC
1951 ACACACGCCG CCATGACGCT GGACGGCAAA CCGTTCAAAC TCGATTTGGA
2001 CGCTTCAGGC GGCATCAACA GGGAACTTAC CCGATGGAAA GGCAGCATCG
2051 GCATCCTCGA CATCGGCGGC GCATTCAACC TCAAGCTGCA AAACCGTATG
2101 ACGCTCGAAG CCGGTGCGGA ACACGTGGCG GCAAGTGCGG CAAATTGGCA
2151 GGCAATGGGC GGCAGCCTCA ACCTGCAACA CTTTTCTTGG GACAGGAAAA
```

-continued

```
2201 CCGGCATATC GGCAAAAGGC GGCGCACGCG GCCTGCACAT CGCCGAGTTG

2251 CACAATTTCT TCAAACCGCC CTTCGAACAC AATCTGGTTT TAAACGGCGA

2301 CTGGGATGTC GCCTACGGGC ACAACGCGCG CGGCTACCTC AATATCAGCC

2351 GGCAAAGCGG CGATGCCGTA TTGCCCGGCG GCAGGCTTT GGGTTTGAAC

2401 GCATTTTCCC TGAAAACGCG CTTTCAAAAC GACCGCATCG GAATCCTGCT

2451 TGACGGCGGC GCGCGTTTCG GACGGATTAA CGCCGATTTG GGCATCGGCA

2501 ACGCCTTCGG CGGCAATATG GCAAATACAC CGCTCGGCGG CAGGATTACA

2551 GCCTCCCTTC CCGACTTGGG CGCATTGAAG CCCTTTCTGC CCGCCGCCGC

2601 GCAAAACATT ACCGGCAGCC TGAATGCCTC CGCGCAAATC GGCGGACGGG

2651 TAGGCTCTCC GTCCGTCAAT GCCGCCGTCA ACGGTAGCAG CAACTACGGG

2701 AAAATCAACG GCAATATCAC CGTCGGGCAA AGCCGCTCCT TCGATACCGC

2751 ACCTTTGGGC GGCAGGCTCA ACCTGACCGT TGCCGATGCC GAAGCATTCC

2801 GCAACTTCCT ACCGGTCGGA CAAACCGTCA AAGGCAGCCT GAATGCCGCC

2851 GTAACCCTCG GCGGCAGCAT CGCCGACCCG CACTTGGGCG GCAGTATCAA

2901 CGGCGACAAG CTCTATTACC GCAACCAAAC CCAAGGCATC ATCTTGGACA

2951 ACGGCTCGCT GCGTTCGCAT ATTGCAGGCA GGAAATGGGT AATCGACAGC

3001 CTGAAATTCC GGCACGAAGG GACGGCGGAA CTCTCCGGCA CGGTCAGCAT

3051 GGAAAACAGC GTGCCCGATG TCGATATCGG CGCGGTGTTC GACAAATACC

3101 GCATCCTGTC CCGCCCCAAC CGCCGCCTGA CGGTTTCCGG CAACACCCGC

3151 CTGCGCTATT CGCCGCAAAA AGGCATATCC GTTACCGGTA TGATTAAAAC

3201 TGATCAGGGG CTGTTCGGTT CGCAAAAATC CTCGATGCCG TCCGTCGGCG

3251 ACGATGTCGT CGTATTGGGC GAAGTCAAGA AGAGGCGGC GGCATCGCTC

3301 CCCGTCAATA TGAACCTGAC TTTAGACCTC AATGACGGCA TCCGCTTCTC

3351 CGGCTACGGC GCGGACGTTA CCATAGGCGG CAAACTGACC CTGACCGCGC

3401 AACCGGGCGG AAATGTGCGT GGGGTGGGCA CGGTCCGCGT CATCAAAGGG

3451 CGTTACAAAG CATACGGGCA GGATTTAGAC ATTACCAAAG CACAGTCTC

3501 CTTTGTCGGC CCGCTCAACG ACCCCAACCT GAACATCCGC GCCGAACGCC

3551 GCCTTTCCCC CGTCGGTGCG GGCGTGGAAA TATTGGGCAG CCTCAACAGC

3601 CCGCGCATTA CGCTGACGGC AAACGAACCG ATGAGTGAAA AAGACAAGCT

3651 CTCCTGGCTC ATCCTCAACC GTGCCGGCAG CGGCAGCAGC GGCGACAATG

3701 CCGCCCTGTC CGCAGCCGCA GGCGCGCTGC TTGCCGGGCA AATCAACGAC

3751 CGCATCGGGC TGGTGGATGA TTTGGGCTTT ACCAGCAAGC GCAGCCGCAA

3801 CGCGCAAACC GGCGAACTCA ACCCCGCCGA ACAGGTGCTG ACCGTCGGCA

3851 AACAACTGAC CGGCAAACTC TACATCGGCT ACGAATACGG CATCTCCAGC

3901 GCGGAACAGT CCGTCAAACT GATTTACCGG CTGACCCGCG CCATACAGGC

3951 GGTTGCCCGT ATCGGCAGCC GTTCGTCGGG CGGCGAGCTG ACATACACCA

4001 TACGTTTCGA CCGCCTCTTC GGTTCGGACA AAAAGACTC CGCAGGAAAC

4051 GGCAAAGGGA AATAA
```

This corresponds to the amino acid sequence <SEQ ID 1188; ORF 285-1.ng>:

```
g285-1.pep
     1 LKLSAALLSV LILAVCFLGW IAGTEAGLRF GLYQIPSWFG VNISSQNLKG
    51 TLLDGFDGDN WSIETEGADL KISRFRFAWK PSELMRRSLH ITDISAGDIA
   101 IVTKPTPPKE ERPPQGLPDS IDLPAAVYLD RFETGKISMG KTFDKQTVYL
   151 ERLNAAYRYD RKGHRLDLKA ADTPWSSSSG SASVGLKKPF ALDTAIYTKG
   201 GFEGETIHST ARLSGSLKDV RAELTIDGGN IRLSGKSVIH PFAESLDKTL
   251 EEVLVKGFNI NPSAFVPSLP DAGLNFDLTA IPSFSDGIAL EGSLDLENTK
   301 AGFADRNGIP VRQVLGGFVI RQDGTVHIGN TSAALLGRGG IRLSGKIDTE
   351 KDILDLNIGI NSVGAEDVLQ TAFKGRLDGS IGIGGTTASP KISWQLGTGT
   401 ARTDGSLAIA SDPANEQRKL VFDTVNISAG EGSLTAQGYL ELFKDRLLKL
   451 DIRSRAFDPS RIDPQFPAGD INGSIHLAGE LAKEKFTGKM RFLPGTFNGV
   501 PIAGSADIVY ESRHLPRAAV DLRLGRNIVK TDGGFGKKGD RLNLNITAPD
   551 LSRFGFGLAG SLNVRGHLSG DLDGGIRTFE TDLSGTARNL HIGKAADIRS
   601 LDFTLKGSPG TSRPMRADIK GGRLSLSGGA AVVDTAGLTL EGTGAQHRIR
   651 THAAMTLDGK PFKLDLDASG GINRELTRWK GSIGILDIGG AFNLKLQNRM
   701 TLEAGAEHVA ASAANWQAMG GSLNLQHFSW DRKTGISAKG GARGLHIAEL
   751 HNFFKPPFEH NLVLNGDWDV AYGHNARGYL NISRQSGDAV LPGGQALGLN
   801 AFSLKTRFQN DRIGILLDGG ARFGRINADL GIGNAFGGNM ANTPLGGRIT
   851 ASLPDLGALK PFLPAAAQNI TGSLNASAQI GGRVGSPSVN AAVNGSSNYG
   901 KINGNITVGQ SRSFDTAPLG GRLNLTVADA EAFRNFLPVG QTVKGSLNAA
   951 VTLGGSIADP HLGGSINGDK LYYRNQTQGI ILDNGSLRSH IAGRKWVIDS
  1001 LKFRHEGTAE LSGTVSMENS VPDVDIGAVF DKYRILSRPN RRLTVSGNTR
  1051 LRYSPQKGIS VTGMIKTDQG LFGSQKSSMP SVGDDVVVLG EVKKEAAASL
  1101 PVNMNLTLDL NDGIRFSGYG ADVTIGGKLT LTAQPGGNVR GVGTVRVIKG
  1151 RYKAYGQDLD ITKGTVSFVG PLNDPNLNIR AERRLSPVGA GVEILGSLNS
  1201 PRITLTANEP MSEKDKLSWL ILNRAGSGSS GDNAALSAAA GALLAGQIND
  1251 RIGLVDDLGF TSKRSRNAQT GELNPAEQVL TVGKQLTGKL YIGYEYGISS
  1301 AEQSVKLIYR LTRAIQAVAR IGSRSSGGEL TYTIRFDRLF GSDKKDSAGN
  1351 GKGK*
```

The following partial DNA sequence was identified in *N. meningitidis* <SEQ ID 1189>:

```
m285-1.seq
     1 CTGAAGCTGT CGGCGGCACT GCTGTCTGTC CTGATTTTGG CAGTATGTTT
    51 CCTCGGCTGG CTCGCCGGTA CGGAAGCAGG TTTGCGCTTC GGGCTGTACC
   101 AAATCCCGTC TTGGTTCGGC GTAAACATTT CCTCCCAAAA CCTCAAAGGC
   151 ACGCTGCTCG ACGGCTTCGA CGGCGACAAC TGGTCGATAG AAACCGAGGG
   201 GGCAGACCTT AAAATCAGCC GCTTCCGCTT CGCGTGGAAA CCGTCCGAAC
   251 TGATGCGCCG CAGCCTGCAC ATTACCGAAA TTTCCGCCGG CGACATCGCC
   301 ATCGTTACCA AACCGACTCC GCCTAAAGAA GAACGCCCGC CGCTCAGCCT
```

-continued

```
 351 TCCCGACAGC ATAGACCTGC CTGCCGCCGT CTATCTCGAC CGCTTCGAGA
 401 CGGGCAAAAT CAGCATGGGC AAAGCCTTTG ACAAACAAAC CGTCTATCTC
 451 GAACGGCTGG ATGCTTCATA CCGTTACGAC CGCAAAGGAC ACCGCCTTGA
 501 CCTGAAGGCC GCCGACACGC CGTGGAGCAG TTCGTCGGGG GCGGCCTCGG
 551 TCGGCTTGAA AAACCGTTT GCCCTCGATA CCGCCATTTA CACCAAAGGC
 601 GGACTCGAAG GCAAAACCAT ACACAGTACG GCTCGGCTGA GCGGCAGCCT
 651 GAAGGATGTG CGCGCCGAAC TGGCGATCGA CGGCGGCAAT ATCCGCCTCT
 701 CGGGAAAATC CGTCATCCAC CCGTTTGCCG AATCATTGGA TAAAACATTG
 751 GAAGAAGTAC TGGTCAAAGG GTTCAACATC AATCCGGCCG CCTTCGTGCC
 801 TTCCCTGCCC GATGCCGGAC TGAATTTCGA CCTGACCGCC ATCCCGTCGT
 851 TTTCAGACGG CATCGCGCTG GAAGGTTCGC TCGATTTGGA AAACACCAAA
 901 GCCGGCTTTG CCGACCGCAA CGGCATCCCC GTCCGTCAGG TTTTAGGCGG
 951 CTTTGTCATC CGGCAGGACG GCACGGTGCA TATCGGCAAT ACGTCCGCCG
1001 CCCTGCTCGG ACGGGCGGC ATCAGGCTGT CGGGCAAAAT CGACACCGAA
1051 AAAGACATCC TCGATTTAAA TATAGGCATC AACTCCGTCG GCGCGGAAGA
1101 CGTACTGCAA ACCGCGTTCA AAGGCAGGTT GGACGGCAGC ATCGGCATCG
1151 GTGGCACGAC CGCCTCGCCC AAAATCTCTT GGCAACTCGG CATCGGCACG
1201 GCGCGCACGG ACGGCAGCCT CGCCATTGCA AGCGACCCAG CAAACGGACA
1251 GCGGAAACTG GTGCTCGACA CCGTCAACAT CGCCGCCGGG CAAGGCAGCC
1301 TGACCGCGCA AGGCTATCTC GAGCTGTTTA AGACCGCCT GCTCAAGCTG
1351 GACATCCGTT CCCGCGCATT CGACCCTTCG CGCATCGATC CGCAACTTCC
1401 GGCAGGCAAT ATCAACGGCT CAATAAACCT TGCCGGCGAA CTGGCAAAAG
1451 AGAAATTCAC AGGCAAAATG CGGTTTTTAC CCGGCACGTT CAACGGCGTA
1501 CCGATTGCCG GCAGTGCCGA CATTGTTTAC GAGTCCCGCC ACCTTCCGCG
1551 TGCCGCCGTC GATTTGCGGC TGGGGCGGAA CATTATTAAA ACAGACGGCG
1601 GCTTCGGCAA AAAGGCGAC CGGCTTAACC TCAATATCAC CGCACCCGAT
1651 TTATCCCGTT CGGTTTCGG ACTCGCGGGG TCTTTAAATG TACGCGGACA
1701 CCTTTCCGGT GATTTGGACG GCGGCATCCG AACCTTTGAA ACCGACCTTT
1751 CCGGCGCGGC GCGCAACCTG CACATCGGCA AGGCGGCAGA CATCCGTTCG
1801 CTCGATTTCA CGCTCAAAGG TTCGCCCGAC ACAAGCCGCC CGATACGCGC
1851 CGACATCAAA GGCAGCCGCC TTTCGCTGTC GGGCGGAGCG GCGGTTGTCG
1901 ATACCGCCGA CCTGATGCTG GACGGCACGG GCGTGCAGCA CCGCATCCGC
1951 ACACACGCCG CCATGACGCT GGATGGCAAA CCGTTCAAAT TCGATTTGGA
2001 CGCTTCAGGC GGCATCAACA GGGAACTTAC CCGATGGAAA GGCAGCATCG
2051 GCATCCTCGA CATCGGCGGC GCATTCAACC TCAAGCTGCA AAACCGTATG
2101 ACGCTCGAAG CCGGTGCGGA ACGCGTGGCG GCAAGTGCGG CAAATTGGCA
2151 GGCAATGGGC GGCAGCCTCA ACCTGCAACA CTTTTCTTGG GATAAAAAAA
2201 CCGGCATATC GGCAAAAGGC GGCGCACACG GTCTGCATAT CGCCGAGTTG
2251 CACAATTTCT TCAAACCGCC CTTCGAACAC AATCTGGTTT TAAACGGCGA
2301 CTGGGATGTC GCCTACGGGC GCAACGCGCG CGGCTACCTC AATATCAGCC
2351 GGCAAAGCGG CGATGCCGTA TTGCCCGGCG GGCAGGCTTT GGGTTTGAAC
```

-continued

```
2401 GCATTTTCCC TGAAAACGCG CTTTCAAAAC GACCGCATCG GAATCCTGCT
2451 TGACGGCGGC GCGCGTTTCG GGCGGATTAA CGCCGATTTG GGCATCGCCA
2501 ACGCCTTCGG CGGCAATATG GCAAATGCAC CGCTCGGCGG CAGGATTACC
2551 GCCTCCCTTC CCGACTTGGG CGCATTGAAG CCCTTTCTGC CCGCCGCCGC
2601 GCAAACATT ACCGGCAGCC TGAATGCCGC CGCGCAAATC GGCGGACGGG
2651 TAGGCTCTCC GTCCGTCAAT GCCGCCGTCA ACGGCAGCAG CAACTACGGG
2701 AAAATCAACG GCAACATCAC CGTCGGGCAA AGCCGCTCTT TCGATACCGC
2751 GCCTTTGGGC GGCAGGCTCA ACCTGACCGT TGCCGATGCC GAAGTATTCC
2801 GCAACTTCCT ACCGGTCGGA CAAACCGTCA AAGGCAGCCT GAATGCCGCC
2851 GTAACCCTCG GCGGCAGCAT CGCCGATCCG CACTTGGGCG CAGCATCAA
2901 CGGCGACAAA CTCTATTACC GCAACCAAAC CCAAGGCATC ATCTTGGACA
2951 ACGGCTCGCT GCGTTCGCAT ATCGCGGGCA GGAAATGGGT AATCGACAGC
3001 CTGAAATTCC GGCACGAAGG GACGGCGGAA CTCTCCGGTA CGGTCGGTAT
3051 GGAAAACAGC GGACCCGATG TCGATATCGG CGCGGTGTTC GACAAATACC
3101 GCATCCTGTC CCGCCCCAAC CGCCGCCTGA CGGTTTCCGG CAACACCCGC
3151 CTGCGCTATT CGCCGCAAAA AGGCATATCC GTTACCGGGA TGATTAAAAC
3201 GGATCAGGGG CTGTTCGGTT CGCAAAAATC CTCGATGCCG TCCGTCGGCG
3251 ACGATGTCGT CGTATTAGGC GAAGTCAAAA AGAGGCGGC GGCACCGCTC
3301 CCCGTCAATA TGAACCTGAC TTTAGACCTC AATGACGGCA TCCGCTTCGC
3351 CGGCTACGGC GCGGACGTTA CCATAGGCGG CAAACTGACC CTGACCGCCC
3401 AATCGGGCGG AAGCGTACGG GGCGTGGGCA CGGTCCGCGT CATCAAAGGG
3451 CGTTATAAGG CATACGGGCA GGATTTGGAC ATTACCAAAG GCACGGTCTC
3501 CTTTGTCGGC CCGCTCAACG ATCCCAACCT CAACATCCGC GCCGAACGCC
3551 GCCTTTCCCC CGTCGGTGCG GGCGTGGAAA TATTGGGCAG CCTCAACAGC
3601 CCGCGCATTA CGCTGACGGC AAACGAACCG ATGAGTGAAA AGACAAGCT
3651 CTCTTGGCTC ATCCTCAACC GCGCCGGCAG CGGCAGCAGC GGCGACAATG
3701 CCGCCCTGTC TGCAGCCGCA GGTGCGCTGC TTGCCGGGCA AATCAACGAC
3751 CGCATCGGGC TGGTGGATGA TTTGGGCTTT ACCAGCAAGC GCAGCCGCAA
3801 CGCGCAAACC GGCGAACTCA ACCCCGCCGA ACAGGTGCTG ACCGTCGGCA
3851 AACAACTGAC CGGCAAACTC TACATCGGCT ACGAATACAG CATCTCCAGC
3901 GCGGAACAGT CCGTCAAACT GATTTACCGG CTGACCCGCG CCATACAGGC
3951 GGTTGCCCGT ATCGGCAGCC GTTCGTCGGG CGGCGAGCTG ACATACACCA
4001 TACGTTTCGA CCGCTTCTCC GGTTCGGACA AAAAGACTC CGCCGGAAAC
4051 GGCAAAGGAA AATAA
```

This corresponds to the amino acid sequence <SEQ ID 1190; ORF 285-1>:

m285-1.pep

```
  1  LKLSAALLSV LILAVCFLGW LAGTEAGLRF GLYQIPSWFG VNISSQNLKG
 51  TLLDGFDGDN WSIETEGADL KISRFRFAWK PSELMRRSLH ITEISAGDIA
```

-continued

```
 101  IVTKPTPPKE ERPPLSLPDS IDLPAAVYLD RFETGKISMG KAFDKQTVYL

151  ERLDASYRYD RYGHRLDLKA ADTPWSSSSG AASVGLKKPF ALDTAIYTKG

201  GLEGKTIHST ARLSGSLKDV RAELAIDGGN IRLSGKSVIH PFAESLDKTL

251  EEVLVKGFNI NPAAFVPSLP DAGLNFDLTA IPSFSDGIAL EGSLDLENTK

301  AGFADRNGIP VRQVLGSFVI RQDGTVHIGN TSAALLGRGG IRLSGKIDTE

351  KDILDLNIGI NSVGAEDVLQ TAFKGRLDGS IGIGGTTASP KISWQLGIGT

401  ARTDGSLAIA SDPANGQRKL VLDTVNIAAG QGSLTAQGYL ELFKDRLLKL

451  DIRSRAFDPS RIDPQLPAGN INGSINLAGE LAKEKFTGKM RFLPGTFNGV

501  PIAGSADIVY ESRHLPRAAV DLRLGRNIIK TDGGFGKKGD RLNLNITAPD

551  LSRFGFGLAG SLNVRGHLSG DLDGGIRTFE TDLSGAARNL HIGKAADIRS

601  LDFTLKGSPD TSRPIRADIK GSRLSLSGGA AVVDTADLML DGTGVQHRIR

651  THAAMTLDGK PFKFDLDASG GINRELTRWK GSIGILDIGG AFNLKLQNRM

701  TLEAGAERVA ASAANWQAMG GSLNLQHFSW DKKTGISAKG GAHGLHIAEL

751  HNFFKPPFEH NLVLNGDWDV AYGRNARGYL NISRQSGDAV LPGGQALGLN

801  AFSLKTRFQN DRIGILLDGG ARFGRINADL DIGNAFGGNM ANAPLGGRIT

851  ASLPDLGALK PFLPAAAQNI TGSLNAAAQI GGRVGSPSVN AAVNGSSNYG

901  KINGNITVGQ SRSFDTAPLG GRLNLTVADA EVFRNFLPVG QTVKGSLNAA

951  VTLGGSIADP HLGGSINGDK LYYRNQTQGI ILDNGSLRSH IAGRKWVIDS

1001  LKFRHEGTAE LSGTVGMENS GPDVDIGAVF DKYRILSRPN RRLTVSGNTR

1051  LRYSPQKGIS VTGMIKTDQG LFGSQKSSMP SVGDDVVVLG EVKKEAAAPL

1101  PVNMNLTLDL NDGIRFAGYG ADVTIGGKLT LTAQSGGSVR GVGTVRVIKG

1151  RYKAYGQDLD ITKGTVSFVG PLNDPNLNIR AERRLSPVGA GVEILGSLNS

1201  PRITLTANEP MSEKDKLSWL ILNRAGSGSS GDNAALSAAA GALLAGQIND

1251  RIGLVDDLGF TSKRSRNAQT GELNPAEQVL TVGKQLTGKL YIGYEYSISS

1301  AEQSVKLIYR LTRAIQAVAR IGSRSSGGEL TYTIRFDRFS GSDKKDSAGN

1351  GKGK*
``` g285-1/m285-1  96.5% identity in 1354 aa overlap

```
                    10         20         30         40         50         60
g285-1.pep  LKLSAALLSVLLLAVCFLGWIAGTEAGLRFGLYQIPSWFGVNISSQNLKGTLLDGFDGDN
            ||||||||||||:|||||||||:|||||||||||||||||||||||||||||||||||||
m285-1      LKLSAALLSVLILAVCFLGWLAGTEAGLRFGLYQIPSWFGVNISSQNLKGTLLDGFDGDN
                    10         20         30         40         50         60

70         80         90        100        110        120
g285-1.pep  WSIETEGADLKISRFRFAWKPSELMRRSLHITDISAGDIAIVTKPTPPKEERPPQGLPDS
            |||||||||||||||||||||||||||||||||:||||||:|||||||||||||:||||
m285-1      WSIETEGADLKISRFRFAWKPSELMRRSLHITEISAGDIAIVTKPTPPKEERPPLSLPDS
                    70         80         90        100        110        120

130        140        150        160        170        180
g285-1.pep  IDLPAAVYLDRFETGKISMGKTFDKQTVYLERLNAAYRYDRKGHRLDLKAADTPWSSSSG
            |||||||||||||||||||||:|||||||||||:|:||||||||||||||||||||||||
m285-1      IDLPAAVYLDRFETGKISMGKAFDKQTVYLERLDASYRYDRKGHRLDLKAADTPWSSSSG
                   130        140        150        160        170        180

190        200        210        220        230        240
g285-1.pep  SASVGLKKPFALDTAIYTKGGFEGETIHSTARLSGSLKDVRAELTIDGGNIRLSGKSVIH
            :|||||||||||||||||||||::|||||||||||||||||||:|||||||||||||||
m285-1      AASVGLKKPFALDTAIYTKGGLEGKTIHSTARLSGSLKDVRAELAIDGGNIRLSGKSVIH
                   190        200        210        220        230        240

250        260        270        280        290        300
g285-1.pep  PFAESLDKTLEEVLVKGFNINPSAFVPSLPDAGLNFDLTAIPSFSDGIALEGSLDLENTK
            ||||||||||||||||||||||:|||||||||||||||||||||||||||||||||||||
m285-1      PFAESLDKTLEEVLVKGFNINPAAFVPSLPDAGLNFDLTAIPSFSDGIALEGSLDLENTK
                   250        260        270        280        290        300

310        320        330        340        350        360
g285-1.pep  AGFADRNGIPVRQVLGGFVIRQDGTVHIGNTSAALLGRGGIRLSGKIDTEKDILDLNIGI
            ||||||||||||||||:|||||||||||||||||||||||||||||||||||||||||||
m285-1      AGFADRNGIPVRQVLGSFVIRQDGTVHIGNTSAALLGRGGIRLSGKIDTEKDILDLNIGI
                   310        320        330        340        350        360
```

-continued

```
            370        380        390        400        410        420
g285-1.pep  NSVGAEDVLQTAFKGRLDGSIGIGGTTASPKISWQLGIGTARTDGSLAIASDPANGQRKL
            ||||||||||||||||||||||||||||||||||||||||||||||||||||||||||||
m285-1      NSVGAEDVLQTAFKGRLDGSIGIGGTTASPKISWQLGIGTARTDGSLAIASDPANGQRKL
            370        380        390        400        410        420

430        440        450        460        470        480
g285-1.pep  VLDTVNIAAGQGSLTAQGYLELFKDRLLKLDIRSRAFDPSRIDPQFPAGDINGSIHLAGE
            |||||||||||||||||||||||||||||||||||||||||||| |||:||| ||:||||
m285-1      VLDTVNIAAGQGSLTAQGYLELFKDRLLKLDIRSRAFDPSRIDPQLPAGNINGSINLAGE
            430        440        450        460        470        480

490        500        510        520        530        540
g285-1.pep  LAKEKFTGKMRPLPGTFNGVPIAGSADIVYESRHLPRAAVDLRLGRNIVKTDGGFGKKGD
            ||||||||||||:|||||||||||||||||||||||||||||||||:|||||||||||||
m285-1      LAKEKFTGKMRFLPGTFNGVPIAGSADIVYESRHLPRAAVDLRLGRNIIKTDGGFGKKGD
            490        500        510        520        530        540

550        560        570        580        590        600
g285-1.pep  RLNLNITAPDLSRFGFGLAGSLNVRGHLSGDLDGGIRTFFTDLSGTARNLHIGKAADIRS
            |||||||||||||||||||||||||||||||||||||||||||||:||||||||||||||
m285-1      RLNLNITAPDLSRFGFGLAGSLNVRGHLSGDLDGGIRTFFTDLSGAARNLHIGKAADIRS
            550        560        570        580        590        600

610        620        630        640        650        660
g285-1.pep  LDFTLKGSPGTSRPMRADIKGGRLSLSGGAAVVDTAGLTLEGTGAQHRIRTHAAMTLDGK
            |||||||||:||||||:|||||:|||||||||||||||| | |:|||:||||||||||||
m285-1      LDFTLKGSPDTSRPIRADIKGSRLSLSGGAAVVDTADLMLDGTGVQHRIRTHAAMTLDGK
            610        620        630        640        650        660

670        680        690        700        710        720
g285-1.pep  PFKLDLDASGGINRELTRWKGSIGILDIGGAFNLKLQNRMTLEAGAEHVAASAANWQAMG
            |||:||||||||||||||||||||||||||||||||||||||||||||:|||||||||||
m285-1      PFKFDLDASGGINRELTRWKGSIGILDIGGAFNLKLQNRMTLEAGAERVAASAANWQAMG
            670        680        690        700        710        720

730        740        750        760        770        780
g285-1.pep  GSLNLQHFSWDRKTGISAKGGARGLHIAELHNFFKPPFEHNLVLNGDWDVAYGHNARGYL
            |||||||||||:||||||||||:||||||||||||||||||||||||||||||:||||||
m285-1      GSLNLQHFSWDKKTGISAKGGAHGLHIAELHNFFKPPFEHNLVLNGDWDVAYGRNARGYL
            730        740        750        760        770        780

790        800        810        820        830        840
g285-1.pep  NISRQSGDAVLPGGQALGINAFSLKTRFQNDRIGILLDGGARFGRINADLGIGNAFGGNM
            ||||||||||||||||||:|||||||||||||||||||||||||||||||||:|||||||
m285-1      NISRQSGDAVLPGGQALGLNAFSLKTRFQNDRIGILLDGGARFGRINADLGIANAFGGNM
            790        800        810        820        830        840

850        860        870        880        890        900
g285-1.pep  ANTPLGGRITASLPDLGALKPFLPAAAQNITGSLNASAQIGGRVGSPSVNAAVNGSSNYG
            ||:|||||||||||||||||||||||||||||||||:|||||||||||||||||||||||
m285-1      ANAPLGGRITASLPDLGALKPFLPAAAQNITGSLNAAAQIGGRVGSPSVNAAVNGSSNYG
            850        860        870        880        890        900

910        920        930        940        950        960
g285-1.pep  KINGNITVGQSRSFDTAPLGGRLNLTVADAEAFRNFLPVGQTVKGSLNAAVTLGGSIADP
            |||||||||||||||||||||||||||||||:||||||||||||||||||||||||||||
m285-1      KINGNITVGQSRSFDTAPLGGRLNLTVADAEVFRNFLPVGQTVKGSLNAAVTLGGSIADP
            910        920        930        940        950        960

970        980        990        1000       1010       1020
g285-1.pep  HLGGSINGDKLYYRNQTQGIILDNGSLRSHIAGRKWVIDSLKFRHEGTAELSGTVSMENS
            ||||||||||||||||||||||||||||||||||||||||||||||||||||||:||||
m285-1      HLGGSINGDKLYYRNQTQGIILDNGSLRSHIAGRKWVIDSLKFRHEGTAELSGTVGMENS
            970        980        990        1000       1010       1020

1030       1040       1050       1060       1070       1080
g285-1.pep  VPDVDIGAVFDKYRILSRPNRRLTVSGNTRLRYSPQKGISVTGMIKTDQGLFGSQKSSMP
             ||||||||||||||||||||||||||||||||||||||||||||||||||||||||||
m285-1      GPDVDIGAVFDKYRILSRPNRRLTVSGNTRLRYSPQKGISVTGMIKTDQGLFGSQKSSMP
            1030       1040       1050       1060       1070       1080

1090       1100       1110       1120       1130       1140
g285-1.pep  SVGDDVVVLGEVKKEAAASLPVNMNLTLDLNDGIRFSGYGADVTIGGKLTLTAQPGGNVR
            ||||||||||||||||||:|||||||||||||||||:||||||||||||||||||:|:||
m285-1      SVGDDVVVLGEVKKEAAAPLPVNMNLTLDLNDGIRFAGYGADVTIGGKLTLTAQSGGSVR
            1090       1100       1110       1120       1130       1140

1150       1160       1170       1180       1190       1200
g285-1.pep  GVGTVRVIKGRYKAYGQDLDITKGTVSFVGPLNDPNLNIRAERRLSPVGAGVEILGSLNS
            ||||||||||||||||||||||||||||||||||||||||||||||||||||||||||||
m285-1      GVGTVRVIKGRYKAYGQDLDITKGTVSFVGPLNDPNLNIRAERRLSPVGAGVEILGSLNS
            1150       1160       1170       1180       1190       1200

1210       1220       1230       1240       1250       1260
g285-1.pep  PRITLTANEPMSEKDKLSWLILNRAGSGSSGDNAALSAAAGALLAGQINDRIGLVDDLGF
            ||||||||||||||||||||||||||||||||||||||||||||||||||||||||||||
m285-1      PRITLTANEPMSEKDKLSWLILNRAGSGSSGDNAALSAAAGALLAGQINDRIGLVDDLGF
            1210       1220       1230       1240       1250       1260
```

```
                    1270        1280        1290        1300        1310        1320
g285-1.pep  TSKRSRNAQTGELNPAEQVLTVGKQLTGKLYIGYEYGISSAEQSVKLIYRLTRAIQAVAR
            ||||||||||||||||||||||||||||||||||||:|||||||||||||||||||||||
m285-1      TSKRSRNAQTGELNPAEQVLTVGKQLTGKLYIGYEYSISSAEQSVKLIYRLTRAIQAVAR
                    1270        1280        1290        1300        1310        1320

1330        1340        1350
g285-1.pep  IGSRSSGGELTYTIRFDRLFGSDKKDSAGNGKGK
            |||||||||||||||||||:||||||||||||||
m285-1      IGSRSSGGELTYTIRFDRFSGSDKKDSAGNGKGKX
                    1330        1340        1350
```

The following partial DNA sequence was identified in *N. meningitidis* <SEQ ID 1191>:

```
a285-1.seq
   1 CTGAAGCTGT CGGCGGCACT GCTGTCTGTT CTGATTTTGG CAGTATGTTT

51 CCTCGGCTGG CTCGCCGGCA CGGAAGCGGG TTTGCGCTTC GGGCTGTACC

101 AAATCCCGTC TTGGTTCGGC GTAAACATTT CCTCCCAAAA CCTCAAAGGC

151 ACGCTGCTCG ACGGCTTCGA CGGCGACAAC TGGTCGATAG AAACCGAGGG

201 GGCAGACCTT AAAATCAGCC GCTTCCGCTT CGCGTGGAAA CCGTCCGAAC

251 TGATGCGCCG CAGCCTGCAC ATTACCGAAA TTTCCGCCGG CGACATCGCC

301 ATCGTTACCA AACCGACTCC GCCTAAAGAA GAACGCCCGC CGCTCAGCCT

351 TCCCGACAGC ATAGACCTGC CTGCCGCCGT CTATCTCGAC CGCTTCGAGA

401 CGGGCAAAAT CAGCATGGGC AAAGCCTTTG ACAAACAAAC CGTCTATCTC

451 GAACGGCTGG ATGCTTCATA CCGTTACGAC CGCAAAGGAC ACCGCCTCGA

501 CCTGAAGGCT GCCGACACGC CGTGGAGCAG TTCGTCGGGG TCAGCCTCGG

551 TCGGCTTGAA AAAACCGTTT GCCCTCGATA CCGCCATTTA CACCAAAGGC

601 GGACTCGAAG GCAAAACCAT ACACAGTACG GCTCGGCTGA GCGGCAGCCT

651 GAAGGATGTG CGCGCCGAAC TGGCGATCGA CGGCGGCAAT ATCCGCCTCT

701 CGGGAAAATC CGTCATCCAC CCGTTTGCCG AATCATTGGA TAAAACATTG

751 GAAGAAGTAC TGGTCAAAGG GTTCAACATC AATCCGTCCG CCTTCGTGCC

801 TTCCCTGCCC GATGCCGGGC TGAATTTCGA CCTGACCGCC ATCCCGTCGT

851 TTTCAGACGG CATCGCGCTG GAAGGCTCGC TCGATTTGGA AAACACCAAA

901 GCCGGCTTTG CCGACCGCAA CGGCATCCCC GTCCGTCAGG TTTTAGGCAG

951 CTTTGTCATC CGGCAGGACG GCACGGTGCA TATCGGCAAT ACGTCCGTCG

1001 CCCTGCTCGG ACGGGGCGGC ATCAGGCTGT CGGGCAAAAT CGACACCGAA

1051 AAAGACATCC TCGATTTAAA TATAGGCATC AACTCCGTCG GCGCGGAAGA

1101 CGTACTGCAA ACCGCGTTCA AAGGCAGGTT GGACGGCAGC ATCGGCATCG

1151 GTGGCACGAC CGCCTCGCCC AAAATCTCTT GGCAACTCGG CATCGGCACG

1201 GCGCGCACGG ACGGCAGCCT CGCCATTGCA AGCGACCCCG CAAACGGACA

1251 GCGGAAACTG GTGCTCGACA CCGTCAACAT CGCCGCCGGG CAAGGCAGCC

1301 TGACCGCGCA AGGCTATCTC GAGCTGTTTA AAGACCGCCT GCTCAAGCTG

1351 GACATCCGTT CCCGCGCATT CGACCCTTCG CGCATCGATC CGCAACTTCC

1401 GGCAGGCAAT ATCAACGGCT CAATAAACCT TGCCGGCGAA CTGGCAAAAG

1451 AGAAATTCAC AGGCAAAATG CGGTTTTTAC CCGGCACGTT CAACGGCGTA

1501 CCGATTGCCG GCAGTGCCGA CATTGTTTAC GAGTCCCGCC ACCTTCCGCG
```

-continued

```
1551 TGCCGCCGTC GATTTGCGGC TGGGGCGGAA CATTATTAAA ACAGACGGCG

1601 GCTTCGGCAA AAAAGGCGAC CGGCTTAACC TCAATATCAC CGCACCCGAT

1651 TTATCCCGTT TCGGTTTCGG ACTCGCGGGG TCTTTAAATG TACGCGGACA

1701 CCTTTCCGGC GATTTGGACG GTGGCATCCG AACCTTTGAA ACCGACCTTT

1751 CCGGCGCGGC GCGCAACCTG CACATCGGCA AGGCGGCAGA CATCCGTTCG

1801 CTCGATTTCA CGCTCAAAGG TTCGCCCGAC ACAAGCCGCC CGATACGCGC

1851 CGACATCAAA GGCAGCCGCC TTTCGCTGTC GGGCGGAGCG GAGGTTGTCG

1901 ATACCGCCGA CCTGATGCTG GACGGCACGG GCGTGCAGCA CCGCATCCGC

1951 ACACACGCCG CCATGACGCT GGATGGCAAA CCGTTCAAAT TCGATTTGGA

2001 CGCTTCAGGC GGCATCAACA GGGAACTTAC CCGATGGAAA GGCAGCATCG

2051 GCATCCTCGA CATCGGCGGC GCATTCAACC TCAAGCTGCA AAACCGTATG

2101 ACGCTCGAAG CCGGTGCGGA ACGCGTGGCG GCAAGTGCGG CAAATTGGCA

2151 GGCAATGGGC GGCAGCCTCA ACCTGCAACA CTTTTCTTGG GATAAAAAAA

2201 CCGGCATATC GGCAAAAGGC GGCGCACACG GTCTGCATAT CGCCGAGTTG

2251 CACAATTTCT TCAAACCGCC CTTCGAACAC AATCTGGTTT TAAACGGCGA

2301 CTGGGATGTC GCCTACGGGC GAAACGCGCG CGGCTACCTC AATATCAGCC

2351 GGCAAAGCGG CGATGCCGTA TTGCCCGGCG GCAGGCTTT GGGTTTGAAC

2401 GCATTTTCCC TGAAAACGCG CTTTCAAAAC GACCGTATCG GAATCCTGCT

2451 TGACGGCGGC GCGCGTTTCG GCGGATTAA CGCCGATTTG GACATCGGCA

2501 ACGCCTTCGG CGGCAATATG GCAAATGCAC CGCTCGGCGG CAGGATTACC

2551 GCCTCCCTTC CCGACTTGGG CACATTGAAG CCCTTTCTGC CCGCCGCCGC

2601 GCAAAACATT ACCGGCAGCC TGAATGCCGC CGCGCAAATC GGCGGACGGG

2651 TCGGCTCTCC GTCCGTCAAT GCCGCCGTCA ACGGCAGCAG CAACTACGGG

2701 AAAATCAACG GCAACATCAC CGTCGGGCAA AGCCGCTCTT TCGATACCGC

2751 GCCTTTGGGC GGCAGGCTCA ACCTGACCGT TGCCGATGCC GAAGTATTCC

2801 GCAACTTCCT ACCGGTCGGA CAAACCGTCA AAGGCAGCCT GAATGCCGCC

2851 GTAACCCTCG GCGGCAGCAT CGCCGATCCG CACTTGGGCG GCAGCATCAA

2901 CGGCGACAAA CTCTATTACC GCAACCAAAC CCAAGGCATC ATCTTGGACA

2951 ACGGCTCGCT GCGTTCGCAT ATCGCGGGCA GGAAATGGGT AATCGACAGC

3001 CTGAAATTCC GGCACGAAGG GACGGCGGAA CTCTCCGGTA CGGTCGGTAT

3051 GGAAAACAGC GGACCCGATG TCGATATCGG CGCGGTGTTC GACAAATACC

3101 GCATCCTGTC CCGCCCCAAC CGCCGCCTGA CGGTTTCCGG CAACACCCGC

3151 CTGCGCTATT CGCCGCAAAA AGGCATATCC GTTACCGGGA TGATTAAAAC

3201 GGATCAGGGG CTGTTCGGTT CGCAAAAATC CTCGATGCCG TCCGTCGGCG

3251 ACGATGTCGT CGTATTAGGC GAAGTCAAAA AGAGGCGGC GGCACCGCTC

3301 CCCGTCAATA TGAACCTGAC TTTAGACCTC AATGACGGCA TCCGCTTCGC

3351 CGGCTACGGC GCGGACGTTA CCATAGGCGG CAAACTGACC CTGACCGCCC

3401 AATCGGGCGG AAGCGTGCGG GGCGTGGGCA CGGTCCGCGT CATCAAAGGG

3451 CGTTATAAGG CATACGGGCA GGATTGGAC ATTACCAAAG GCACGGTCTC

3501 CTTTGTCGGC CCGCTCAACG ACCCCAACCT CAACATCGCG CCGAACGCC

3551 GCCTTTCCCC CGTCGGTGCG GGCGTGGAAA TATTGGGCAG CCTCAACAGT
```

-continued

```
3601  CCGCGCATTA CGCTGACGGC AAACGAACCG ATGAGTGAAA AAGACAAGCT

3651  CTCCTGGCTC ATCCTCAACC GCGCCGGCAG TGGCAGCAGC GGCGACAATG

3701  CCGCCCTGTC CGCAGCCGCC GGCGCGCTGC TTGCCGGGCA AATCAACGAC

3751  CGCATCGGGC TGGTGGATGA TTTGGGCTTT ACCAGCAAGC GCAGCCGCAA

3801  CGCGCAAACC GGCGAACTCA ACCCCGCCGA ACAGGTGCTG ACCGTCGGCA

3851  AACAACTGAC CGGCAAACTC TACATCGGCT ACGAATACAG CATCTCCAGC

3901  GCGGAACAGT CCGTCAAACT GATTTACCGG CTGACCCGCG CCATACAGGC

3951  GGTTGCCCGT ATCGGCAGCC GTTCGTCGGG CGGCGAGCTG ACATACACCA

4001  TACGTTTCGA CCGCTTCTCC GGTTCGGACA AAAAGACTC CGCCGGAAAC

4051  AGCAAAGGAA AATAA
```

This corresponds to the amino acid sequence <SEQ ID 1192; ORF 285-1.a>:

```
a285-1.pep

1  LKLSAALLSV LILAVCFLGW LAGTEAGLRF GLYQIPSWFG VNISSQNLKG
     51  TLLDGFDGDN WSIETEGADL KISRFRFAWK PSELMRRSLH ITEISAGDIA
    101  IVTKPTPPKE ERPPLSLPDS IDLPAAVYLD RFETGKISMG KAFDKQTVYL
    151  ERLDASYRYD RYGHRLDLKA ADTPWSSSSG SASVGLKKPF ALDTAIYTKG
    201  GLEGKTIHST ARLSGSLKDV RAELAIDGGN IRLSGKSVIH PFAESLDKTL
    251  EEVLVKGFNI NPSAFVPSLP DAGLNFDLTA IPSFSDGIAL EGSLDLENTK
    301  AGFADRNGIP VRQVLGSFVI RQDGTVHIGN TSVALLGRGG IRLSGKIDTE
    351  KDILDLNIGI NSVGAEDVLQ TAFKGRLDGS IGIGGTTASP KISWQLGIGT
    401  ARTDGSLAIA SDPANGQRKL VLDTVNIAAG QGSLTAQGYL ELFKDRLLKL
    451  DIRSRAFDPS RIDPQLPAGN INGSINLAGE LAKEKFTGKM RFLPGTFNGV
    501  PIAGSADIVY ESRHLPRAAV DLRLGRNIIK TDGGFGKKGD RLNLNITAPD
    551  LSRFGFGLAG SLNVRGHLSG DLDGGIRTFE TDLSGAARNL HIGKAADIRS
    601  LDFTLKGSPD TSRPIRADIK GSRLSLSGGA EVVDTADLML DGTGVQHRIR
    651  THAAMTLDGK PFKFDLDASG GINRELTRWK GSIGILDIGG AFNLKLQNRM
    701  TLEAGAERVA ASAANWQAMG GSLNLQHFSW DKKTGISAKG GAHGLHIAEL
    751  HNFFKPPFEH NLVLNGDWDV AYGRNARGYL NISRQSGDAV LPGGQALGLN
    801  AFSLKTRFQN DRIGILLDGG ARFGRINADL DIGNAFGGNM ANAPLGGRIT
    851  ASLPDLGTLK PFLPAAAQNI TGSLNAAAQI GGRVGSPSVN AAVNGSSNYG
    901  KINGNITVGQ SRSFDTAPLG GRLNLTVADA EVFRNFLPVG QTVKGSLNAA
    951  VTLGGSIADP HLGGSINGDK LYYRNQTQGI ILDNGSLRSH IAGRKWVIDS
   1001  LKFRHEGTAE LSGTVGMENS GPDVDIGAVF DKYRILSRPN RRLTVSGNTR
   1051  LRYSPQKGIS VTGMIKTDQG LFGSQKSSMP SVGDDVVVLG EVKKEAAAPL
   1101  PVNMNLTLDL NDGIRFAGYG ADVTIGGKLT LTAQSGGSVR GVGTVRVIKG
   1151  RYKAYGQDLD ITKGTVSFVG PLNDPNLNIR AERRLSPVGA GVEILGSLNS
   1201  PRITLTANEP MSEKDKLSWL ILNRAGSGSS GDNAALSAAA GALLAGQIND
   1251  RIGLVDDLGF TSKRSRNAQT GELNPAEQVL TVGKQLTGKL YIGYEYSISS
   1301  AEQSVKLIYR LTRAIQAVAR IGSRSSGGEL TYTIRFDRFS GSDKKDSAGN
   1351  SKGK*
``` a285-1/m285-1  99.3% identity in 1354 aa overlap

```
                    10        20        30        40        50        60
a285-1.pep   LKLSAALLSVLLLAVCFLGWLAGTEAGLRFGLYQIPSWFGVNISSQNLKGTLLDGFDGDN
             ||||||||||| |||||||||||||||||||||||||||||||||||||||||||||||
m285-1       LKLSAALLSVLILAVCFLGWLAGTEAGLRFGLYQIPSWFGVNISSQNLKGTLLDGFDGDN
                    10        20        30        40        50        60

70        80        90       100       110       120
a285-1.pep   WSIETEGADLKISRFRFAWKPSELMRRSLHITEISAGDIAIVTKPTPPKEERPPLSLPDS
             ||||||||||||||||||||||||||||||||||||||||||||||||||||||||||||
m285-1       WSIETEGADLKISRFRFAWKPSELMRRSLHITEISAGDIAIVTKPTPPKEERPPLSLPDS
                    70        80        90       100       110       120

130       140       150       160       170       180
a285-1.pep   IDLPAAVYLDRFETGKISMGKAFDKQTVYLERLDASYRYDRKGHRLDLKAADTPWSWSSG
             ||||||||||||||||||||||||||||||||||||||||||||||||||||||||||||
m285-1       IDLPAAVYLDRFETGKISMGKAFDKQTVYLERLDASYRYDRKGHRLDLKAADTPWSWSSG
                   130       140       150       160       170       180

190       200       210       220       230       240
a285-1.pep   SASVGLKKPFALDTAIYTKGGLEGKTIHSTARLSGSLKDVRAELAIDGGNIRLSGKSVIH
             :|||||||||||||||||||||||||||||||||||||||||||||||||||||||||||
m285-1       AASVGLKKPFALDTAIYTKGGLEGKTIHSTARLSGSLKDVRAELAIDGGNIRLSGKSVIH
                   190       200       210       220       230       240

250       260       270       280       290       300
a285-1.pep   PFAESLDKTLEEVLVKGFNINPSAFVPSLPDAGLNFDLTAIPSFSDGIALEGSLDLENTK
             |||||||||||||||||||||||:||||||||||||||||||||||||||||||||||||
m285-1       PFAESLDKTLEEVLVKGFNINPAAFVPSLPDAGLNFDLTAIPSFSDGIALEGSLDLENTK
                   250       260       270       280       290       300

310       320       330       340       350       360
a285-1.pep   AGFADRNGIPVRQVLGSFVIRQDGTVHIGNTSVALLGRGGIRLSGKIDTEKDILDLNIGI
             ||||||||||||||||:||||||||||||||||:||||||||||||||||||||||||||
m285-1       AGFADRNGIPVRQVLGGFVIRQDGTVHIGNTSAALLGRGGIRLSGKIDTEKDILDLNIGI
                   310       320       330       340       350       360

370       380       390       400       410       420
a285-1.pep   NSVGAEDVLQTAFKGRLDGSIGIGGTTASPKISWQLGIGTARTDGSLAIASDPANGQRKL
             ||||||||||||||||||||||||||||||||||||||||||||||||||||||||||||
m285-1       NSVGAEDVLQTAFKGRLDGSIGIGGTTASPKISWQLGIGTARTDGSLAIASDPANGQRKL
                   370       380       390       400       410       420

430       440       450       460       470       480
a285-1.pep   VLDTVNIAAGQGSLTAQGYLELFKDRLLKLDIRSRAFDPSRIDPQLPAGNINGSINLAGE
             ||||||||||||||||||||||||||||||||||||||||||||||||||||||||||||
m285-1       VLDTVNIAAGQGSLTAQGYLELFKDRLLKLDIRSRAFDPSRIDPQLPAGNINGSINLAGE
                   430       440       450       460       470       480

490       500       510       520       530       540
a285-1.pep   LAKEKFTGKMRPLPGTFNGVPIAGSADIVYESRHLPRAAVDLRLGRNIIKTDGGFGKKGD
             |||||||||||:||||||||||||||||||||||||||||||||||||||||||||||||
m285-1       LAKEKFTGKMRFLPGTFNGVPIAGSADIVYESRHLPRAAVDLRLGRNIIKTDGGFGKKGD
                   490       500       510       520       530       540

550       560       570       580       590       600
a285-1.pep   RLNLNITAPDLSRFGFGLAGSLNVRGHLSGDLDGGIRTFFTDLSGAARNLHIGKAADIRS
             ||||||||||||||||||||||||||||||||||||||||||||||||||||||||||||
m285-1       RLNLNITAPDLSRFGFGLAGSLNVRGHLSGDLDGGIRTFFTDLSGAARNLHIGKAADIRS
                   550       560       570       580       590       600

610       620       630       640       650       660
a285-1.pep   LDFTLKGSPDTSRPIRADIKGSRLSLSGGAEVVDTADLMLDGTGVQHRIRTHAAMTLDGK
             |||||||||||||||||||||||||||||| |||||||||||||||||||||||||||||
m285-1       LDFTLKGSPDTSRPIRADIKGSRLSLSGGAAVVDTADLMLDGTGVQHRIRTHAAMTLDGK
                   610       620       630       640       650       660

670       680       690       700       710       720
a285-1.pep   PFKFDLDASGGINRELTRWKGSIGILDIGGAFNLKLQNRMTLEAGAERVAASAANWQAMG
             ||||||||||||||||||||||||||||||||||||||||||||||||||||||||||||
m285-1       PFKFDLDASGGINRELTRWKGSIGILDIGGAFNLKLQNRMTLEAGAERVAASAANWQAMG
                   670       680       690       700       710       720

730       740       750       760       770       780
a285-1.pep   GSLNLQHFSWDKKTGISAKGGAHGLHIAELHNFFKPPFEHNLVLNGDWDVAYGRNARGYL
             ||||||||||||||||||||||||||||||||||||||||||||||||||||||||||||
m285-1       GSLNLQHFSWDKKTGISAKGGAHGLHIAELHNFFKPPFEHNLVLNGDWDVAYGRNARGYL
                   730       740       750       760       770       780

790       800       810       820       830       840
a285-1.pep   NISRQSGDAVLPGGQALGINAFSLKTRFQNDRIGILLDGGARFGRINADLDIGNAFGGNM
             |||||||||||||||||||||||||||||||||||||||||||||||||:||||||||||
m285-1       NISRQSGDAVLPGGQALGLNAFSLKTRFQNDRIGILLDGGARFGRINADLGIANAFGGNM
                   790       800       810       820       830       840

850       860       870       880       890       900
a285-1.pep   ANAPLGGRITASLPDLGALKPFLPAAAQNITGSLNAAAQIGGRVGSPSVNAAVNGSSNYG
             ||||||||||||||||| ||||||||||||||||||||||||||||||||||||||||||
m285-1       ANAPLGGRITASLPDLGTLKPFLPAAAQNITGSLNAAAQIGGRVGSPSVNAAVNGSSNYG
                   850       860       870       880       890       900
```

```
              910        920        930        940        950        960
a285-1.pep  KINGNITVGQSRSFDTAPLGGRLNLTVADAEVFRNFLPVGQTVKGSLNAAVTLGGSIADP
            ||||||||||||||||||||||||||||||||||||||||||||||||||||||||||||
m285-1      KINGNITVGQSRSFDTAPLGGRLNLTVADAEVFRNFLPVGQTVKGSLNAAVTLGGSIADP
              910        920        930        940        950        960

970        980        990       1000       1010       1020
a285-1.pep  HLGGSINGDKLYYRNQTQGIILDNGSLRSHIAGRKWVIDSLKFRHEGTAELSGTVGMENS
            ||||||||||||||||||||||||||||||||||||||||||||||||||||||||||||
m285-1      HLGGSINGDKLYYRNQTQGIILDNGSLRSHIAGRKWVIDSLKFRHEGTAELSGTVGMENS
              970        980        990       1000       1010       1020

1030       1040       1050       1060       1070       1080
a285-1.pep  GPDVDIGAVFDKYRILSRPNRRLTVSGNTRLRYSPQKGISVTGMIKTDQGLFGSQKSSMP
            ||||||||||||||||||||||||||||||||||||||||||||||||||||||||||||
m285-1      GPDVDIGAVFDKYRILSRPNRRLTVSGNTRLRYSPQKGISVTGMIKTDQGLFGSQKSSMP
             1030       1040       1050       1060       1070       1080

1090       1100       1110       1120       1130       1140
a285-1.pep  SVGDDVVVLGEVKKEAAAPLPVNMNLTLDLNDGIRFAGYGADVTIGGKLTLTAQSGGSVR
            ||||||||||||||||||||||||||||||||||||||||||||||||||||||||||||
m285-1      SVGDDVVVLGEVKKEAAAPLPVNMNLTLDLNDGIRFAGYGADVTIGGKLTLTAQSGGSVR
             1090       1100       1110       1120       1130       1140

1150       1160       1170       1180       1190       1200
a285-1.pep  GVGTVRVIKGRYKAYGQDLDITKGTVSFVGPLNDPNLNIRAERRLSPVGAGVEILGSLNS
            ||||||||||||||||||||||||||||||||||||||||||||||||||||||||||||
m285-1      GVGTVRVIKGRYKAYGQDLDITKGTVSFVGPLNDPNLNIRAERRLSPVGAGVEILGSLNS
             1150       1160       1170       1180       1190       1200

1210       1220       1230       1240       1250       1260
a285-1.pep  PRITLTANEPMSEKDKLSWLILNRAGSGSSGDNAALSAAAGALLAGQINDRIGLVDDLGF
            ||||||||||||||||||||||||||||||||||||||||||||||||||||||||||||
m285-1      PRITLTANEPMSEKDKLSWLILNRAGSGSSGDNAALSAAAGALLAGQINDRIGLVDDLGF
             1210       1220       1230       1240       1250       1260

1270       1280       1290       1300       1310       1320
a285-1.pep  TSKRSRNAQTGELNPAEQVLTVGKQLTGKLYIGYEYSISSAEQSVKLIYRLTRAIQAVAR
            ||||||||||||||||||||||||||||||||||||||||||||||||||||||||||||
m285-1      TSKRSRNAQTGELNPAEQVLTVGKQLTGKLYIGYEYSISSAEQSVKLIYRLTRAIQAVAR
             1270       1280       1290       1300       1310       1320

1330       1340       1350
a285-1.pep  IGSRSSGGELTYTIRFDRFSGSDKKDSAGNSKGKX
            |||||||||||||||||||||||||||||:||||
m285-1      IGSRSSGGELTYTIRFDRFSGSDKKDSAGNGKGKX
             1330       1340       1350
```

The following partial DNA sequence was identified in *N. gonorrhoeae* <SEQ ID 1193>:

```
g286.seq
   1  atgcagaaca ccggtaccat gatgatcaaa ccgaccgccc tgctcctgcc 51  ggctttattt ttctttccgc acgcatacgc gcctgccgcc gaccttcccg 101  aaaacaaggc ggcgggtttc gcattgttca aaagcaaaag ccccgacacc 151  gaatcagtca aattaaaacc caaattcccc gtccgcatcg acacgcagga 201  cagtgaaatc aaagatatgg tcgaagaaca cctgccgctc atcacgcagc 251  agcaggaaga ggtttttggat aaggaacaga cgggattcct tgccgaagaa 301  gcaccggaca acgttaaaac aatgctccgc agcaaaggct atttcagcag 351  caaggtcagc ctgacggaaa aagacggagc ttatacggtg cacatcacac 401  cgggcccgcg caccaaaatc gccaacgtcg gcgtcgccat cctcggcgac 451  atcctttcag acggcaacct cgccgaatac taccgcaacg cgctggaaaa 501  ctggcagcag ccggtaggca gcgatttcga tcaggacagt tgggaaaaca 551  gcaaaacttc cgtcctcggc gcggtaacgc gcaaaggcta cccgcttgcc 601  aagctcggca cacccgggc ggccgtcaac ccgataccg ccaccgccga 651  tttgaacgtc gtcgtggaca gcggccgccc cattgccttc ggcgactttg 701  aaatcaccgg cacacagcgt taccccgaac aaaccgtctc cggcctggcg 751  cgcttccaac cgggcacgcc ctacgacctc gacctgctgc tcgacttcca
```

-continued

```
 801 acaggcgctc gaacaaaacg ggcattattc cggcgcgtcc gtacaagccg
 851 acttcgaccg cctcccaagg ggaccgcgtc cccgtcaaag tcagcgtaac
 901 cgaggtcaaa cgccacaaac tcgaaaccgg catccgcctc gattcggaat
 951 acggtttggg cggcaaaatc gcctacgact attacaacct cttcaacaaa
1001 ggctatatcg gctcggtcgt ctgggatatg gacaaatacg aaaccacgct
1051 tgccgccggc atcagccagc cgcgcaacta tcggggcaac tactggacaa
1101 gcaacgtttc ctacaaccgt tcgaccaccc aaaacctcga aaaacgcgcc
1151 ttctccggcg gcatctggta tgtgcgcgac cgcgcgggca tcgatgccag
1201 gctgggggcg gaatttctcg cagaaggccg gaaaatcccc ggctcggatg
1251 tcgatttggg caacagccac gccacgatgc tgaccgcctc ttggaaacgc
1301 cagctgctca acaacgtgct gcaccccgaa aacggccatt acctcgacgg
1351 caaaatcggg acgactttgg gcacattcct gtcctccacc gcgctaatcc
1401 gcacctctgc ccgcgcaggt tatttcttca cgcccgaaaa caaaaaactc
1451 ggcacgttca tcatacgcgg acaagcgggt tacaccgttg cacgcgacaa
1501 tgccgatgtc ccctcggggc tgatgttccg cagcggcggc gcgtcttccg
1551 tgcgcggtta cgaacttga
```

This corresponds to the amino acid sequence <SEQ ID 1194; ORF 286.ng>:

```
g286.pep
  1 MQNTGTMMIK PTALLLPALF FFPHAYAPAA DLSENKAAGF ALFKSKSPDT
 51 ESVKLKPKFP VRIDTQDSEI KDMVEEHLPL ITQQQEEVLD KEQTGFLAEE
101 APDNVKTMLR SKGYFSSKVS LTEKDGAYTV HITPGPRTKI ANVGVAILGD
151 ILSDGNLAEY YRNALENWQQ PVGSDFDQDS WENSKTSVLG AVTRKGYPLA
201 KLGNTRAAVN PDTATADLNV VVDSGRPIAF GDFEITGTQR YPEQTVSGLA
251 RFQPGTPYDL DLLLDFQQAL EQNGHYSGAS VQADFDRLPR GPRPRQSQRN
301 RGQTPQTRNR HPPRFGIRFG RQNRLRLLQP LQQRLYRLGR LGYGQIRNHA
351 CRRHQPAAQL SGQLLDKQRF LQPFDHPKPR KTRLLRRHLV CARPRGHRCQ
401 AGGGISRRRP ENPRLGCRFG QQPRHDADRL LETPAAQQRA APRKRPLPRR
451 QNRDDFGHIP VLHRANPHLC PRRLFLHARK QKTRHVHHTR TSGLHRCTRQ
501 CRCPLGADVP QRRRVFRARL RT*
```

The following partial DNA sequence was identified in *N. meningitidis* <SEQ ID 1195>:

```
m286.seq
  1  ATGCACGACA CCCGTACCAT GATGATCAAA CCGACCGCCC TGCTCCTGCC
 51  GGCTTTATTT TTCTTTCCGC ACGCATACGC GCCTGCCGCC GACCTTTCCG
101  AAAACAAGGC GGCGGGTTTC GCATTGTTCA AAAACAAAAG CCCCGACACC
151  GAATCAGTCA AATTAAAACC CAAATTCCCC GTCCTCATCG ACACGCAGGA
201  CAGTGAAATC AAAGATATGG TCGAAGAACA CCTGCCGCTC ATCACGCAGC
251  AGCAGGAAGA AGTATTGGAC AAGGAACAGA CGGGCTTCCT CGCCGAAGAA
301  GCGCCGGACA ACGTTAAAAC GATGCTCCGC AGCAAAGGCT ATTTCAGCAG
```

```
-continued
 351 CAAAGTCAGC CTGACGGAAA AAGACGGAGC TTATACGGTA CACATCACAC

401 CGGGCCCGCG CACCAAAATC GCCAACGTCG GCGTCGCCAT CCTCGGCGAC

451 ATCCTTTCAG ACGGCAACCT CGCCGAATAC TACCGCAACG CGCTGGAAAA

501 CTGGCAGCAG CCGGTAGGCA GCGATTTCGA TCAGGACAGT TGGGAAAACA

551 GCAAAACTTC CGTCCTCGGC GCGGTAACGC GCAAAGCCTA CCCGCTTGCC

601 AAGCTCGGCA ATACGCAGGC GGCCGTCAAC CCCGATACCG CCACCGCCGA

651 TTTGAACGTC GTCGTGGACA GCGGCCGCCC CATCGCCTTC GGCGACTTTG

701 AAATCACCGG CACACAGCGT TACCCCGAAC AAATCGTCTC CGGCCTTGCG

751 CGTTTCCAGC CCGGTATGCC GTACGACCTC GACCTGCTGC TCGACTTCCA

801 ACAGGCGCTC GAACAAAACG GGCATTATTC CGGCGCGTCC GTACAAGCCG

851 ACTTCGACCG CCTCCAAGGC GACCGCGTCC CCGTCAAAGT CAGCGTAACC

901 GAGGTCAAAC GCCACAAACT CGAAACCGGC ATCCGCCTCG ATTCGGAATA

951 CGGTTTGGGC GGCAAAATCG CCTACGACTA TTACAACCTC TTCAACAAAG

1001 GCTATATCGG TTCGGTCGTC TGGGATATGG ACAAATACGA AACCACGCTT

1051 GCCGCCGGCA TCAGCCAGCC GCGCAACTAT CGGGGCAACT ACTGGACAAG

1101 CAACGTTTCC TACAACCGTT CGACCACCCA AAACCTCGAA AACGCGCCT

1151 TCTCCGGCGG CGTCTGGTAT GTGCGCGACC GCGCGGGCAT CGATGCCAGG

1201 CTGGGGGCGG AATTTCTCGC AGAAGGCCGG AAAATCCCCG GCTCGGCTGT

1251 CGATTTGGGC AACAGCCACG CCACGATGCT GACCGCCTCT TGGAAACGCC

1301 AGCTGCTCAA CAACGTGCTG CATCCCGAAA ACGGCCATTA CCTCGACGGC

1351 AAAATCGGTA CGACTTTGGG CACATTCCTG TCCTCCACCG GCTGATCCG

1401 CACCTCTGCC CGTGCAGGTT ATTTCTTCAC GCCCGAAAAC AAAAAACTCG

1451 GCACGTTCAT CATACGCGGA CAAGCGGGTT ACACCGTTGC CCGCGACAAT

1501 GCCGACGTTC CTTCAGGGCT GATGTTCCGC AGCGGCGGCG CGTCTTCCGT

1551 GCGCGGTTAC GAACTCGACA GCATCGGACT TGCCGGCCCG AACGGATCGG

1601 TCCTGCCCGA ACGCGCCCTC CTGGTGGGCA GCCTGGAATA CCAACTGCCG

1651 TTTACGCGCA CCCTTTCCGG CGCGGTGTTC CACGATATGG CGATGCCGC

1701 CGCCAATTTC AAACGTATGA AGCTGAAACA CGGTTCGGGA CTGGGCGTGC

1751 GCTGGTTCAG CCCGCTTGCG CCGTTTTCCT TCGACATCGC CTACGGGCAC

1801 AGCGATAAGA AAATCCGCTG GCACATCAGC TTGGGAACGC GCTTCTAA
```

This corresponds to the amino acid sequence <SEQ ID 1196; ORF 286>:

```
m286.pep
   1 MHDTRTMMIK PTALLLPALF FFPHAYAPAA DLSENKAAGF ALFKNKSPDT

51 ESVKLKPKFP VLIDTQDSEI KDMVEEHLPL ITQQQEEVLD KEQTGFLAEE

101 APDNVKTMLR SKGYFSSKVS LTEKDGAYTV HITPGPRTKI ANVGVAILGD

151 ILSDGNLAEY YRNALENWQQ PVGSDFDQDS WENSKTSVLG AVTRKAYPLA

201 KLGNTQAAVN PDTATADLNV VVDSGRPIAF GDFEITGTQR YPEQIVSGLA

251 RFQPGMPYDL DLLLDFQQAL EQNGHYSGAS VQADFDRLQG DRVPVKVSVT

301 EVKRHKLETG IRLDSEYGLG GKIAYDYYNL FNKGYIGSVV WDMDKYETTL
```

-continued
```
351 AAGISQPRNY RGNYWTSNVS YNRSTTQNLE KRAFSGGVWY VRDRAGIDAR

401 LGAEFLAEGR KIPGSAVDLG NSHATMLTAS WKRQLLNNVL HPENGHYLDG

451 KIGTTLGTFL SSTALIRTSA RAGYFFTPEN KKLGTFIIRG QAGYTVARDN

501 ADVPSGLMFR SGGASSVRGY ELDSIGLAGP NGSVLPERAL LVGSLEYQLP

551 FTRTLSGAVF HDMGDAAANF KRMKLKHGSG LGVRWFSPLA PFSFDIAYGH

601 SDKKIRWHIS LGTRF*
```

Computer analysis of this amino acid sequence gave the following results:
Homology with a Predicted ORF from *N. gonorrhoeae*

```
    m286/g286   95.9% identity in 293 aa overlap 10         20         30         40         50         60
      m286.pep  MHDTRTMMIKPTALLLPALFFFPHAYAPAADLSENKAAGFALFKNKSPDTESVKLKPKFP
                |::| ||||||||||||||||||||||||||||||||||||:|||||||||||||||||
          g286  MQNTGTMMIKPTALLLPALFFFPHAYAPAADLSENKAAGFALFKSKSPDTESVKLKPKFP
                    10         20         30         40         50         60

70         80         90        100        110        120
      m286.pep  VLIDTQDSEIKDMVEEHLPLITQQQEEVLDKEQTGFLAEEAPDNVKTMLRSKGYFSSKVS
                | |||||||||||||||||||||||||||||||||||||||||||||||||||||||||
          g286  VRIDTQDSEIKDMVEEHLPLITQQQEEVLDKEQTGFLAEEAPDNVKTMLRSKGYFSSKVS
                    70         80         90        100        110        120

130        140        150        160        170        180
      m286.pep  LTEKDGAYTVHITPGPRTKIANVGVAILGDILSDGNLAEYYRNALENWQQPVGSDFDQDS
                ||||||||||||||||||||||||||||||||||||||||||||||||||||||||||||
          g286  LTEKDGAYTVHITPGPRTKIANVGVAILGDILSDGNLAEYYRNALENWQQPVGSDFDQDS
                   130        140        150        160        170        180

190        200        210        220        230        240
      m286.pep  WENSKTSVLGAVTRKAYPLAKLGNTQAAVNPDTATADLNVVVDSGRPIAFGDFEITGTQR
                ||||||||||||||:|||||||||:|||||||||||||||||||||||||||||||||||
          g286  WENSKTSVLGAVTRKGYPLAKLGNTRAAVNPDTATADLNVVVDSGRPIAFGDFEITGTQR
                   190        200        210        220        230        240

250        260        270        280        290        300
      m286.pep  YPEQIVSGLARFQPGMPYDLDLLLDFQQALEQNGHYSGASVQADFDRL-QGDRVPVKVSV
                |||| ||||||||||  |||||||||||||||||||||||||||||||  :| |
          g286  YPEQTVSGLARFQPGTPYDLDLLLDFQQALEQNGHYSGASVQADFDRLPRGPRPRQSQRN
                   250        260        270        280        290        300

300        310        320        330        340        350        359
      m286.pep      TEVKRHKLETGIRLDSEYGLGGKIAYDYYNLFNKGYIGSVVWDMDKYETTLAAGISQPRN g286      RGQTPQTRNRHPPRFGIRFGRQNRLRLLQPLQQRLYRLGRLGYGQIRNHACRRHQPAAQL
                         310        320        330        340        350        360
```

The following partial DNA sequence was identified in *N. meningitidis* <SEQ ID 1197>:

```
a286.seq
    1 ATGCACGACA CCCGTACCAT GATGATTAAA CCGACCGCCC TGCTCCTGCC

51 GGCTTTATTT TTCTTTCCGC ACGCATACGC GCCTGCCGCC GACCTTTCCG

101 AAAACAAGGC GGCGGGTTTC GCATTGTTCA AAACAAAAG CCCCGACACC

151 GAATCAGTTA AATTAAAACC CAAATTCCCC GTCCGCATCG ACACGCAGGA

201 TAGTGAAATC AAAGATATGG TCGAAGAACA CCTGCCGCTC ATCACGCAGC

251 AGCAGGAAGA AGTATTGGAC AAGGAACAGA CGGGCTTCCT CGCCGAAGAA

301 GCACCGGACA ACGTTAAAAC AATGCTCCGC AGCAAAGGCT ATTTCAGCAG

351 CAAAGTCAGC CTGACGGAAA AAGACGGAGC TTATACGGTA CACATCACAC

401 CGGGCCCGCG CACCAAAATC GCCAACGTCG GCGTCGCCAT CCTCGGCGAC
```

```
 451 ATCCTTTCAG ACGGCAACCT CGCCGAATAC TACCGCAACG CGCTGGAAAA

501 CTGGCAGCAG CCGGTAGGCA GTGATTTCGA TCAGGACAGT TGGGAAAACA

551 GCAAAACTTC CGTCCTCGGC GCGGTAACGC GCAAAGCCTA CCCGCTTGCC

601 AAGCTCGGCA ACACCCGGGC GGCCGTCAAC CCCGATACCG CCACCGCCGA

651 TTTGAACGTC GTCGTGGACA GCGGCCGCCC CATCGCCTTC GGCGACTTTG

701 AAATTACCGG CACGCAGCGT TACCCCGAAC AAATCGTCTC CGGCTTGGCG

751 CGCTTCCAAC CGGGCACGCC CTACGACCTC GACCTGCTGC TCGACTTCCA

801 ACAGGCGCTC GAACAAAACG GGCATTATTC CGGCGCGTCC GTACAAGCCG

851 ACTTCGACCG CCTCCAAGGC GACCGCGTCC CCGTCAAAGT CAGCGTAACC

901 GAGGTCAAAC GCCACAAGCT CGAAACCGGC ATCCGCCTCG ATTCGGAATA

951 CGGTTTGGGC GGCAAAATCG CCTACGACTA TTACAACCTC TTCAACAAAG

1001 GCTATATCGG TTCGGTCGTC TGGGATATGG ACAAATACGA AACCACGCTT

1051 GCCGCCGGCA TCAGCCAGCC GCGCAACTAT CGGGGCAACT ACTGGACAAG

1101 CAACGTTTCC TACAACCGTT CGACCACCCA AAACCTCGAA AACGCGCCT

1151 TCTCCGGCGG CATCTGGTAT GTGCGCGACC GCGCGGGCAT CGATGCCAGG

1201 CTGGGGGCGG AGTTTCTCGC AGAAGGCCGG AAAATCCCCG GCTCGGATAT

1251 CGATTTGGGC AACAGCCACG CCACGATGCT GACCGCCTCT TGGAAACGCC

1301 AGCTGCTCAA CAACGTGCTG CATCCCGAAA ACGGCCATTA CCTCGACGGC

1351 AAAATCGGTA CGACTTTGGG CGCATTCCTG TCCTCCACCG CGCTGATCCG

1401 CACCTCTGCC CGCGCAGGTT ATTTCTTCAC GCCCGAAAAC AAAAAACTCG

1451 GCACGTTCAT CATACGCGGA CAAGCGGGTT ACACCGTTGC CCGCGACAAT

1501 GCCAACGTTC CTTCAGGGCT GATGTTCCGC AGCGGCGGCG CGTCTTCCGT

1551 GCGCGGTTAC GAACTCGACA GCATCGGGCT TGCCGGCCCG AACGGATCGG

1601 TCCTGCCCGA ACGCGCCCTC TTGGTGGGCA GCCTGGAATA CCAACTGCCG

1651 TTTACGCGCA CCCTTTCCGG CGCGGTGTTC CACGATATGG GCGACGCCGC

1701 CGCCAATTTC AAACGTATGA AGCTGAAACA CGGTTCGGGA CTGGGCGTGC

1751 GCTGGTTCAG CCCGCTCGCG CCGTTTTCCT TCGACATCGC CTACGGGCAC

1801 AGCGACAAGA AAATCCGCTG GCACATCAGC TTGGGAACGC GCTTCTAA
```

This corresponds to the amino acid sequence <SEQ ID 1198; ORF 286.a>:

```
a286.pep

1 MHDTRTMMIK PTALLLPALF FFPHAYAPAA DLSENKAAGF ALFKNKSPDT

51 ESVKLKPKFP VRIDTQDSEI KDMVEEHLPL ITQQQEEVLD KEQTGFLAEE

101 APDNVKTMLR SKGYFSSKVS LTEKDGAYTV HITPGPRTKI ANVGVAILGD

151 ILSDGNLAEY YRNALENWQQ PVGSDFDQDS WENSKTSVLG AVTRKAYPLA

201 KLGNTRAAVN PDTATADLNV VVDSGRPIAF GDFEITGTQR YPEQIVSGLA

251 RFQPGTPYDL DLLLDFQQAL EQNGHYSGAS VQADFDRLQG DRVPVKVSVT

301 EVKRHKLETG IRLDSEYGLG GKIAYDYYNL FNKGYIGSVV WDMDKYETTL

351 AAGISQPRNY RGNYWTSNVS YNRSTTQNLE KRAFSGGIWY VRDRAGIDAR

401 LGAEFLAEGR KIPGSDIDLG NSHATMLTAS WKRQLLNNVL HPENGHYLDG
```

```
    451  KIGTTLGAFL SSTALIRTSA RAGYFFTPEN KKLGTFIIRG QAGYTVARDN

501  ANVPSGLMFR SGGASSVRGY ELDSIGLAGP NGSVLPERAL LVGSLEYQLP

551  FTRTLSGAVF HDMGDAAANF KRMKLKHGSG LGVRWFSPLA PFSFDIAYGH

601  SDKKIRWHIS LGTRF* m286/a286  98.7% identity in 615 aa overlap 10         20         30         40         50         60
m286.pep  MHDTRTMMIKPTALLLPALFFFPHAYAPAADLSENKAAGFALFKNKSPDTESVKLKPKFP
          ||||||||||||||||||||||||||||||||||||||||||||||||||||||||||||
a286      MHDTRTMMIKPTALLLPALFFFPHAYAPAADLSENKAAGFALFKNKSPDTESVKLKPKFP
                 10         20         30         40         50         60

70         80         90        100        110        120
m286.pep  VLIDTQDSEIKDMVEEHLPLITQQQEEVLDKEQTGFLAEEAPDNVKTMLRSKGYFSSKVS
          | |||||||||||||||||||||||||||||||||||||||||||||||||||||||||
a286      VRIDTQDSEIKDMVEEHLPLITQQQEEVLDKEQTGFLAEEAPDNVKTMLRSKGYFSSKVS
                 70         80         90        100        110        120

130        140        150        160        170        180
m286.pep  LTEKDGAYTVHITPGPRTKIANVGVAILGDILSDGNLAEYYRNALENWQQPVGSDFDQDS
          ||||||||||||||||||||||||||||||||||||||||||||||||||||||||||||
a286      LTEKDGAYTVHITPGPRTKIANVGVAILGDILSDGNLAEYYRNALENWQQPVGSDFDQDS
                130        140        150        160        170        180

190        200        210        220        230        240
m286.pep  WENSKTSVLGAVTRKAYPLAKLGNTRAAVNPDTATADLNVVVDSGRPIAFGDFEITGTQR
          ||||||||||||||||||||||||||||||||||||||||||||||||||||||||||||
a286      WENSKTSVLGAVTRKAYPLAKLGNTRAAVNPDTATADLNVVVDSGRPIAFGDFEITGTQR
                190        200        210        220        230        240

250        260        270        280        290        300
m286.pep  YPEQIVSGLARFQPGMPYDLDLLLDFQQALEQNGHYSGASVQADFDRLQGDRVPVKVSVT
          ||||||||||||||| | |||||||||||||||||||||||||||||||||||||||||
a286      YPEQIVSGLARFQPGTPYDLDLLLDFQQALEQNGHYSGASVQADFDRLQGDRVPVKVSVT
                250        260        270        280        290        300

310        320        330        340        350        360
m286.pep  EVKRHKLETGIRLDSEYGLGGKIAYDYYNLFNKGYIGSVVWDMDKYETTLAAGISQPRNY
          ||||||||||||||||||||||||||||||||||||||||||||||||||||||||||||
a286      EVKRHKLETGIRLDSEYGLGGKIAYDYYNLFNKGYIGSVVWDMDKYETTLAAGISQPRNY
                310        320        330        340        350        360

370        380        390        400        410        420
m286.pep  RGNYWTSNVSYNRSTTQNLEKRAFSGGVWYVRDRAGIDARLGAEFLAEGRKIPGSAVDLG
          |||||||||||||||||||||||||||||:||||||||||||||||||||||||||:|||
a286      RGNYWTSNVSYNRSTTQNLEKRAFSGGIWYVRDRAGIDARLGAEFLAEGRKIPGSDIDLG
                370        380        390        400        410        420

430        440        450        460        470        480
m286.pep  NSHATMLTASWKRQLLNNVLHPENGHYLDGKIGTTLGTFLSSTALIRTSARAGYFFTPEN
          |||||||||||||||||||||||||||||||||||||:||||||||||||||||||||||
a286      NSHATMLTASWKRQLLNNVLHPENGHYLDGKIGTTLGAFLSSTALIRTSARAGYFFTPEN
                430        440        450        460        470        480

490        500        510        520        530        540
m286.pep  KKLGTFIIRGQAGYTVARDNADVPSGLMFRSGGASSVRGYELDSIGLAGPNGSVLPERAL
          ||||||||||||||||||||||:|||||||||||||||||||||||||||||||||||||
a286      KKLGTFIIRGQAGYTVARDNANVPSGLMFRSGGASSVRGYELDSIGLAGPNGSVLPERAL
                490        500        510        520        530        540

550        560        570        580        590        600
m286.pep  LVGSLEYQLPFTRTLSGAVFHDMGDAAANFKRMKLKHGSGLGVRWFSPLAPFSFDIAYGH
          ||||||||||||||||||||||||||||||||||||||||||||||||||||||||||||
a286      LVGSLEYQLPFTRTLSGAVFHDMGDAAANFKRMKLKHGSGLGVRWFSPLAPFSFDIAYGH
                550        560        570        580        590        600

610
m286.pep  SDKKIRWHISLGTRFX
          ||||||||||||||||
a286      SDKKIRWHISLGTRFX
                610
```

The following partial DNA sequence was identified in *N. gonorrhoeae* <SEQ ID 1199>:

```
g287.seq
   1  atgtttaaac gcagtgtgat tgcaatggct tgtatttttc ccctttcagc 51  ctgtggggc ggcggtggcg gatcgcccga tgtcaagtcg gcggacacgc 101  cgtcaaaacc ggccgccccc gttgttgctg aaaatgccgg ggaaggggtg 151  ctgccgaaag aaaagaaaga tgaggaggca gcgggcggtg cgccgcaagc
```

-continued
```
 201 cgatacgcag gacgcaaccg ccggagaagg cagccaagat atggcggcag 251 tttcggcaga aaatacaggc aatggcggtg cggcaacaac ggacaacccc 301 aaaaatgaag acgcggggc gcaaaatgat atgccgcaaa atgccgccga 351 atccgcaaat caaacaggga acaaccaacc cgccggttct tcagattccg 401 cccccgcgtc aaaccctgcc cctgcgaatg gcggtagcga ttttggaagg 451 acgaacgtgg gcaattctgt tgtgattgac ggaccgtcgc aaaatataac 501 gttgacccac tgtaaaggcg attcttgtaa tggtgataat ttattggatg 551 aagaagcacc gtcaaaatca gaatttgaaa aattaagtga tgaagaaaaa 601 attaagcgat ataaaaaaga cgagcaacgg gagaattttg tcggtttggt 651 tgctgacagg gtaaaaaagg atggaactaa caaatatatc atcttctata 701 cggacaaacc acctactcgt tctgcacggt cgaggaggtc gcttccggcc 751 gagattccgc tgattcccgt caatcaggcc gatacgctga ttgtggatgg 801 ggaagcggtc agcctgacgg ggcattccgg caatatcttc gcgcccgaag 851 ggaattaccg gtatctgact tacggggcgg aaaaattgcc cggcggatcg 901 tatgccctcc gtgtgcaagg cgaaccggca aaaggcgaaa tgcttgttgg 951 cacggccgtg tacaacggcg aagtgctgca tttccatatg gaaaacggcc 1001 gtccgtaccc gtccggaggc aggtttgccg caaaagtcga tttcggcagc 1051 aaatctgtgg acggcattat cgacagcggc gatgatttgc atatgggtac 1101 gcaaaaattc aaagccgcca tcgatggaaa cggctttaag gggacttgga 1151 cggaaatgg cggcggggat gtttccggaa ggttttacgg cccggccggc 1201 gaggaagtgg cgggaaaata cagctatcgc ccgacagatg ctgaaaaggg 1251 cggattcggc gtgtttgccg gcaaaaaaga tcgggattga
```

This corresponds to the amino acid sequence <SEQ ID 1200; ORF 287.ng>:

```
g287.pep
  1 MFKRSVIAMA CIFPLSACGG GGGGSPDVKS ADTPSKPAAP VVAENAGEGV

51 LPKEKKDEEA AGGAPQADTQ DATAGEGSQD MAAVSAENTG NGGAATTDNP

101 KNEDAGAQND MPQNAAESAN QTGNNQPAGS SDSAPASNPA PANGGSDFGR

151 TNVGNSVVID GPSQNITLTH CKGDSCNGDN LLDEEAPSKS EFEKLSDEEK

201 IKRYKKDEQR ENFVGLVADR VKKDGTNKYI IFYTDKPPTR SARSRRSLPA

251 EIPLIPVNQA DTLIVDGEAV SLTGHSGNIF APEGNYRYLT YGAEKLPGGS

301 YALRVQGEPA KGEMLVGTAV YNGEVLHFHM ENGRPYPSGG RFAAKVDFGS

351 KSVDGIIDSG DDLHMGTQKF KAAIDGNGFK GTWTENGGGD VSGRFYGPAG

401 EEVAGKYSYR PTDAEKGGFG VFAGKKDRD*
```

The following partial DNA sequence was identified in *N. meningitidis* <SEQ ID 1201>:

```
m287.seq.
  1 ATGTTTAAAC GCAGCGTAAT CGCAATGGCT TGTATTTTTG CCCTTTCAGC

51 CTGCGGGGGC GGCGGTGGCG GATCGCCCGA TGTCAAGTCG GCGGACACGC

101 TGTCAAAACC TGCCGCCCCT GTTGTTTCTG AAAAAGAGAC AGAGGCAAAG
```

```
 151 GAAGATGCGC CACAGGCAGG TTCTCAAGGA CAGGGCGCGC CATCCGCACA

201 AGGCAGTCAA GATATGGCGG CGGTTTCGGA AGAAAATACA GGCAATGGCG

251 GTGCGGTAAC AGCGGATAAT CCCAAAAATG AAGACGAGGT GGCACAAAAT

301 GATATGCCGC AAAATGCCGC CGGTACAGAT AGTTCGACAC CGAATCACAC

351 CCCGGATCCG AATATGCTTG CCGGAAATAT GGAAAATCAA GCAACGGATG

401 CCGGGGAATC GTCTCAGCCG GCAAACCAAC CGGATATGGC AAATGCGGCG

451 GACGGAATGC AGGGGGACGA TCCGTCGGCA GGCGGGCAAA ATGCCGGCAA

501 TACGGCTGCC CAAGGTGCAA ATCAAGCCGG AAACAATCAA GCCGCCGGTT

551 CTTCAGATCC CATCCCCGCG TCAAACCCTG CACCTGCGAA TGGCGGTAGC

601 AATTTTGGAA GGGTTGATTT GGCTAATGGC GTTTTGATTG ACGGGCCGTC

651 GCAAAATATA ACGTTGACCC ACTGTAAAGG CGATTCTTGT AGTGGCAATA

701 ATTTCTTGGA TGAAGAAGTA CAGCTAAAAT CAGAATTTGA AAAATTAAGT

751 GATGCAGACA AAATAAGTAA TTACAAGAAA GATGGGAAGA ATGATAAATT

801 TGTCGGTTTG GTTGCCGATA GTGTGCAGAT GAAGGGAATC AATCAATATA

851 TTATCTTTTA TAAACCTAAA CCCACTTCAT TTGCGCGATT TAGGCGTTCT

901 GCACGGTCGA GGCGGTCGCT TCCGGCCGAG ATGCCGCTGA TTCCCGTCAA

951 TCAGGCGGAT ACGCTGATTG TCGATGGGGA AGCGGTCAGC CTGACGGGGC

1001 ATTCCGGCAA TATCTTCGCG CCCGAAGGGA ATTACCGGTA TCTGACTTAC

1051 GGGGCGGAAA AATTGCCCGG CGGATCGTAT GCCCTTCGTG TTCAAGGCGA

1101 ACCGGCAAAA GGCGAAATGC TTGCGGGCGC GGCCGTGTAC AACGGCGAAG

1151 TACTGCATTT CCATACGGAA AACGGCCGTC CGTACCCGAC CAGGGGCAGG

1201 TTTGCCGCAA AAGTCGATTT CGGCAGCAAA TCTGTGGACG GCATTATCGA

1251 CAGCGGCGAT GATTTGCATA TGGGTACGCA AAAATTCAAA GCCGCCATCG

1301 ATGGAAACGG CTTTAAGGGG ACTTGGACGG AAAATGGCAG CGGGGATGTT

1351 TCCGGAAAGT TTTACGGCCC GGCCGGCGAG GAAGTGGCGG GAAAATACAG

1401 CTATCGCCCG ACAGATGCGG AAAAGGGCGG ATTCGGCGTG TTTGCCGGCA

1451 AAAAGAGCA GGATTGA
```

This corresponds to the amino acid sequence <SEQ ID 1202; ORF 287>:

```
m287.pep
  1 MFKRSVIAMA CIFALSACGG GGGGSPDVKS ADTLSKPAAP VVSEKETEAK

51 EDAPQAGSQG QGAPSAQGSQ DMAAVSEENT GNGGAVTADN PKNEDEVAQN

101 DMPQNAAGTD SSTPNHTPDP NMLAGNMENQ ATDAGESSQP ANQPDMANAA

151 DGMQGDDPSA GGQNAGNTAA QGANQAGNNQ AAGSSDPIPA SNPAPANGGS

201 NFGRVDLANG VLIDGPSQNI TLTHCKGDSC SGNNFLDEEV QLKSEFEKLS

251 DADKISNYKK DGKNDKFVGL VADSVQMKGI NQYIIFYKPK PTSFARFRRS

301 ARSRRSLPAE MPLIPVNQAD TLIVDGEAVS LTGHSGNIFA PEGNYRYLTY

351 GAEKLPGGSY ALRVQGEPAK GEMLAGAAVY NGEVLHFHTE NGRPYPTRGR

401 FAAKVDFGSK SVDGIIDSGD DLHMGTQKFK AAIDGNGFKG TWTENGSGDV

451 SGKFYGPAGE EVAGKYSYRP TDAEKGGFGV FAGKKEQD*
```

Computer analysis of this amino acid sequence gave the following results:
Homology with a Predicted ORF from *N. gonorrhoeae*

```
    m287/g287   70.1% identity in 499 aa overlap 10        20        30        40           49
    m287.pep   MFKRSVIAMACIFALSACGGGGGSPDVKSADTLSKPAAPVVSE----------KETEA
               ||||||||||||| ||||||||||||||||||||| ||||||||:|         |: ||
    g287       MFKRSVIAMACIFPLSACGGGGGSPDVKSADTPSKPAAPVVAENAGEGVLPKEKKDEEA
                      10        20        30        40        50        60
                      50        60        70        80        90       100       109
    m287.pep   KEDAPQAGSQGQGAPSAQGSQDMAAVSEENTGNGGAVTADNPKNEDEVAQNDMPQNAAGT
               ||||  :|      |   :::||||||||| ||||||||:|:||||||   ||||||||
    g287       AGGAPQADTQD--ATAGEGSQDMAAVSAENTGNGGAATTDNPKNEDAGAQNDMPQNAA--
                      70        80        90       100       110
                     110       120       130       140       150       160       169
    m287.pep   DSSTPNHTPDPNMLAGNMENQATDAGESSQPANQPDMANAADGMQGDDPSAGGQNAGNTA g287       ------------------------------------------------------------
                     170       180       190       200       210       220       229
    m287.pep   AQGANQAGNNQAAGSSDPIPASNPAPANGGSNFGRVDLANGVLIDGPSQNITLTHCKGDS
               ::|||:||||  |||||   |||||||||||||:|||:::::|:|:|||||||||||||
    g287       -ESANQTGNNQPAGSSDSAPASNPAPANGGSDFGRTNVGNSVVIDGPSQNITLTHCKGDS
                     120       130       140       150       160       170
                     230       240       250       260       270       280       289
    m287.pep   CSGNNFLDEEVQLKSEFEKLSDADKISNYKKDGKNDKFVGLVADSVQMKGINQYIIFYKP
               |:|:|:||||:  |||||||||:||:  ||||   ::||||||| |:    | |:|||||
    g287       CNGDNLLDEEAPSKSEFEKLSDEEKIKRYKKDEQRENFVGLVADRVKKDGTNKYIIFYTD
                     180       190       200       210       220       230
                     290       300       310       320       330       340       349
    m287.pep   KPTSFARFRRSARSRRSLPAEMPLIPVNQADTLIVDGEAVSLTGHSGNIFAPEGNYRYLT
               || :     |||||||||||:|||||||||||||||||||||||||||||||||||||||
    g287       KPPT-----RSARSRRSLPAEIPLIPVNQADTLIVDGEAVSLTGHSGNIFAPEGNYRYLT
                              240       250       260       270       280       290
                     350       360       370       380       390       400       409
    m287.pep   YGAEKLPGGSYALRVQGEPAKGEMLAGAAVYNGEVLHFHTENGRPYPTRGRFAAKVDFGS
               |||||||||||||||||||||||||:|:|||||||||||||| ||||||: |||||||||
    g287       YGAEKLPGGSYALRVQGEPAKGEMLVGTAVYNGEVLHFHMENGRPYPSGGRFAAKVDFGS
                             300       310       320       330       340       350
                     410       420       430       440       450       460       469
    m287.pep   KSVDGIIDSGDDLHMGTQKFKAAIDGNGFKGTWTENGSGDVSGKFYGPAGEEVAGKYSYR
               |||||||||||||||||||||||||||||||||||||:||||||:||||||||||||||
    g287       KSVDGIIDSGDDLHMGTQKFKAAIDGNGFKGTWTENGGGDVSGRFYGPAGEEVAGKYSYR
                             360       370       380       390       400       410
                     470       480       489
    m287.pep   PTDAEKGGFGVFAGKKEQDX
               |||||||||||||||::||
    g287       PTDAEKGGFGVFAGKKDRDX
                             420       430
```

The following partial DNA sequence was identified in *N. meningitidis* <SEQ ID 1203>:

```
a287.seq
    1 ATGTTTAAAC GCAGTGTGAT TGCAATGGCT TGTATTGTTG CCCTTTCAGC

51 CTGTGGGGGC GGCGGTGGCG GATCGCCCGA TGTTAAGTCG GCGGACACGC

101 TGTCAAAACC TGCCGCCCCT GTTGTTACTG AAGATGTCGG GGAAGAGGTG

151 CTGCCGAAAG AAAAGAAAGA TGAGGAGGCG GTGAGTGGTG CGCCGCAAGC

201 CGATACGCAG GACGCAACCG CCGGAAAAGG CGGTCAAGAT ATGGCGGCAG

251 TTTCGGCAGA AAATACAGGC AATGGCGGTG CGGCAACAAC GGATAATCCC

301 GAAAATAAAG ACGAGGGACC GCAAAATGAT ATGCCGCAAA ATGCCGCCGA
```

-continued

```
 351 TACAGATAGT TCGACACCGA ATCACACCCC TGCACCGAAT ATGCCAACCA

401 GAGATATGGG AAACCAAGCA CCGGATGCCG GGGAATCGGC ACAACCGGCA

451 AACCAACCGG ATATGGCAAA TGCGGCGGAC GGAATGCAGG GGGACGATCC

501 GTCGGCAGGG GAAAATGCCG GCAATACGGC AGATCAAGCT GCAAATCAAG

551 CTGAAAACAA TCAAGTCGGC GGCTCTCAAA ATCCTGCCTC TTCAACCAAT

601 CCTAACGCCA CGAATGGCGG CAGCGATTTT GGAAGGATAA ATGTAGCTAA

651 TGGCATCAAG CTTGACAGCG GTTCGGAAAA TGTAACGTTG ACACATTGTA

701 AAGACAAAGT ATGCGATAGA GATTTCTTAG ATGAAGAAGC ACCACCAAAA

751 TCAGAATTTG AAAAATTAAG TGATGAAGAA AAAATTAATA AATATAAAAA

801 AGACGAGCAA CGAGAGAATT TTGTCGGTTT GGTTGCTGAC AGGGTAGAAA

851 AGAATGGAAC TAACAAATAT GTCATCATTT ATAAAGACAA GTCCGCTTCA

901 TCTTCATCTG CGCGATTCAG GCGTTCTGCA CGGTCGAGGC GGTCGCTTCC

951 GGCCGAGATG CCGCTGATTC CCGTCAATCA GGCGGATACG CTGATTGTCG

1001 ATGGGGAAGC GGTCAGCCTG ACGGGGCATT CCGGCAATAT CTTCGCGCCC

1051 GAAGGGAATT ACCGGTATCT GACTTACGGG GCGGAAAAAT TGTCCGGCGG

1101 ATCGTATGCC CTCAGTGTGC AAGGCGAACC GGCAAAAGGC GAAATGCTTG

1151 CGGGCACGGC CGTGTACAAC GGCGAAGTGC TGCATTTCCA TATGGAAAAC

1201 GGCCGTCCGT CCCCGTCCGG AGGCAGGTTT GCCGCAAAAG TCGATTTCGG

1251 CAGCAAATCT GTGGACGGCA TTATCGACAG CGGCGATGAT TTGCATATGG

1301 GTACGCAAAA ATTCAAAGCC GTTATCGATG GAAACGGCTT TAAGGGGACT

1351 TGGACGGAAA ATGGCGGCGG GGATGTTTCC GGAAGGTTTT ACGGCCCGGC

1401 CGGCGAAGAA GTGGCGGGAA AATACAGCTA TCGCCCGACA GATGCGGAAA

1451 AGGGCGGATT CGGCGTGTTT GCCGGCAAAA AAGAGCAGGA TTGA
```

This corresponds to the amino acid sequence <SEQ ID 1204; ORF 287.a>:

```
a287.pep

1 MFKRSVIAMA CIVALSACGG GGGGSPDVKS ADTLSKPAAP VVTEDVGEEV

51 LPKEKKDEEA VSGAPQADTQ DATAGKGGQD MAAVSAENTG NGGAATTDNP

101 ENKDEGPQND MPQNAADTDS STPNHTPAPN MPTRDMGNQA PDAGESAQPA

151 NQPDMANAAD GMQGDDPSAG ENAGNTADQA ANQAENNQVG GSQNPASSTN

201 PNATNGGSDF GRINVANGIK LDSGSENVTL THCKDKVCDR DFLDEEAPPK

251 SEFEKLSDEE KINKYKKDEQ RENFVGLVAD RVEKNGTNKY VIIYKDKSAS

301 SSSARFRRSA RSRRSLPAEM PLIPVNQADT LIVDGEAVSL TGHSGNIFAP

351 EGNYRYLTYG AEKLSGGSYA LSVQGEPAKG EMLAGTAVYN GEVLHFHMEN

401 GRPSPSGGRF AAKVDFGSKS VDGIIDSGDD LHMGTQKFKA VIDGNGFKGT

451 WTENGGGDVS GRFYGPAGEE VAGKYSYRPT DAEKGGFGVF AGKKEQD* m287/a287  77.2% identity in 501 aa overlap 10        20        30        40            49
m287.pep    MFKRSVIAMACIPALSACGGGGGGSPDVKSADTLSKPAAPVVSE----------KETEA
            ||||||||||| |||||||||| |||||||||||||||||||||:|         |: ||
a287        MFKRSVIAMACIVALSACGGGGGGSPDVKSADTLSKPAAPVVTEDVGEEVLPKEKKDEEA
                    10        20        30        40        50        60
```

```
                    50         60         70         80         90        100       109
m287.pep    KEDAPQAGSQGQGAPSAQGSQDMAAVSEENTGNGGAVTADNPKNEDEVAQNDMPQNAAGT
            ||||  :|    |   :::|:||||||  ||||||||:||:|:||  ||||||||| |
a287        VSGAPQADTQ--DATAGKGGQDMAAVSAENTGNGGAATTDNPENKDEGPQNDMPQNAADT
                       70         80         90        100        110

110        120        130        140        150        160       169
m287.pep    DSSTPNHTPDPNMLAGNMENQATDAGESSQPANQPDMANAADGMQGDDPSAGGQNAGNTA
            |||||||||  |||  : :|  |||  |||||:|||||||||||||||||||  ||||||
a287        DSSTPNHTPAPNMPTRDMGNQAPDAGESAQPANQPDMANAADGMQGDDPSAG-ENAGNTA
                       120        130        140        150        160        170

170        180        190        200        210        220       229
m287.pep    AQGANQAGNNQAAGSSDPIPASNPAPANGGSNFGRVDLANGVLIDGPSQNITLTHCKGDS
            |:||||  |||::||::|   ::||   :||||:|||:::|||:  :|:   |:|:|||||
a287        DQAANQAENNQVGGSQNPASSTNPATNGGSDFGRINVANGIKLDSGSENVTLTHCKDKV
                       180        190        200        210        220        230

230        240        250        260        270        280       289
m287.pep    CSGNNFLDEEVQLKSEFEKLSDADKISNYKKDGKNDKFVGLVADSVQMKGINQYIIFYKP
            |: :||||| : |||||||||::||| ||:||| : ::|:|||||||| |:  |:|:|:||
a287        CD-RDFLDEEAPPKSEFEKLSDEEKINKYKKDEQRENFVGLVADRVEKNGTNKYVIIYKD
                       240        250        260        270        280        290

290        300        310        320        330        340
m287.pep    KP--TSFARFRRSARSRRSLPAEMPLIPVNQADTLIVDGEAVSLTGHSGNIFAPEGNYRY
            |:  :|||||  ||||||||||||||||||:||::|||  : ::|:|:||:|:|||||||
a287        KSASSSSARFRRSARSRRSLPAEMPLIPVNQADTLIVDGEAVSLTGHSGNIFAPEGNYRY
                       300        310        320        330        340        350

350        360        370        380        390        400
m287.pep    LTYGAEKLPGGSYALRVQGEPAKGEMLAGAAVYNGEVLHFHTENGRPYPTRGRFAAKVDF
            ||||||||| ||||||:|||||||||||||||:|||||||||||| ||||| |: ||||||||
a287        LTYGAEKLSGGSYALSVQGEPAKGEMLAGTAVYNGEVLHFHMENGRPSPSGGRFAAKVDF
                       360        370        380        390        400        410

410        420        430        440        450        460
m287.pep    GSKSVDGIIDSGDDLHMGTQKFKAAIDGNGFKGTWTENGSGDVSGKFYGPAGEEVAGKYS
            ||||||||||||||||||||||||:|||||||||||||:||||:|||||||||||||||||
a287        GSKSVDGIIDSGDDLHMGTQKFKAVIDGNGFKGTWTENGGGDVSGRFYGPAGEEVAGKYS
                       420        430        440        450        460        470

470        480       489
m287.pep    YRPTDAEKGGFGVFAGKKEQDX
            ||||||||||||||||||||||
a287        YRPTDAEKGGFGVFAGKKEQDX
                       480        490
```

The following partial DNA sequence was identified in *N. gonorrhoeae* <SEQ ID 1205>:

```
g288.seq
  1 atgcacaccg acaggcggt aagccgggtt ctgtctcgga cagtcattcc 51 tctaggcata ccgttgccgg tatgctcaag caacctaccc gaacgctcgg 101 cgggcagcgt cattgcgttc tgtttggtct tgctccgaat ggggtttggc 151 ctgccgcata ttgttaccaa atgcgcggtg cgcccttacc gcaccttttc 201 acccttgcct gtgctgccaa agcagccatc ggcggttttg ctttctgttc 251 cactttccgt cgcgttaccg cgcccggccg ttaaccggca ttctaccctg 301 cggagcccgg actttcctcc ccgtatgcct tacgcgatac gcggcgactg 351 tctgcccgtc ccgtgtgcgg cgcggattat aacacgaaac gcaaaaatgc 401 cgtctgaaac ggtacaggtt tcagacggca tacagcctaa actacacacc 451 ctgtttcagg ctggcttcga tgaagccgtc caagtcgccg tccaatacgg 501 ctttgtggtt gccgacttcg tagcctgtac gcaagtcttt gatgcgtga
```

This corresponds to the amino acid sequence <SEQ ID 1206; ORF 288.ng>:

```
g288.pep
  1 MHTGQAVSRV LSRTVIPLGI PLPVCSSNLP ERSAGSVIAF CLVLLRMGFG

51 LPHIVTKCAV RPYRTFSPLP VLPKQPSAVL LSVPLSVALP RPAVNRHSTL
```

-continued

```
101 RSPDFPPRMP YAIRGDCLPV PCAARIITRN AKMPSETVQV SDGIQPKLHT

151 LFQAGFDEAV QVAVQYGFVV ADFVACTQVF DA*
```

The following partial DNA sequence was identified in *N. meningitidis* <SEQ ID 1207>:

```
m288.seq
   1 ATGCACACCG GACAGGCGGT AAGCCGGGTT CTGTCTCGGA CAGTCATTCC

51 TCTAGGCATA CCGTTACCGG TATGCTCAAG CAACCTACCC GAACGCTCGG

101 CGGGCAGCGT CATTGCGTTC TGTTTGGTCT TGCTCCGAAT GGGGTTTGGC

151 CTGCCGCATA TTGTTACCAA ATGCGCGGTG CGCCCTTACC GCACCTTTTC

201 ACCCTTACCT GTGCTGCCAA AGCAGCCATC GGCGGTTTTG CTTTCTGTTC

251 CACTTTCCGT CGCGTTACCG CGCCCGGCCG TTAACCGGCA TTCTACCCTG

301 CGGAGCCCGG ACTTTCCTCC CCGTATGCCT TACGCGATAC GCGGCGACTG

351 TCTGCCCGTC CCGTGTGCGG CGCGGATTAT AACACGAAAC ACAAAAATGC

401 CGTCTGAAAC GGTACAGGTT TCAGACGGCA TACAGCCTAA ACTACACGCC

451 CTGTTTCAGG CTGGCTTCGA TGAAGCCGTC CAAGTCGCCA TCCAATACGG

501 CTTTGGTGTT GCCGACTTCG TAGCCTGTAC GCAAGTCTTT GATACGTGA
```

This corresponds to the amino acid sequence <SEQ ID 1208; ORF 288>:

```
m288.pep
   1 MHTGQAVSRV LSRTVIPLGI PLPVCSSNLP ERSAGSVIAF CLVLLRMGFG

51 LPHIVTKCAV RPYRTFSPLP VLPKQPSAVL LSVPLSVALP RPAVNRHSTL

101 RSPDFPPRMP YAIRGDCLPV PCAARIITRN TKMPSETVQV SDGIQPKLHA

151 LFQAGFDEAV QVAIQYGFGV ADFVACTQVF DT*
```

Computer analysis of this amino acid sequence gave the following results:

Homology with a Predicted ORF from *N. gonorrhoeae*

```
    m288/g288   97.8% identity in 181 aa overlap 10         20         30         40         50         60
        m288.pep   MHTGQAVSRVLSRTVIPLGIPLPVCSSNLPERSAGSVIAFCLVLLRMGFGLPHIVTKCAV
                   ||||||||||||||||||||||||||||||||||||||||||||||||||||||||||||
        g288       MHTGQAVSRVLSRTVIPLGIPLPVCSSNLPERSAGSVIAFCLVLLRMGFGLPHIVTKCAV
                     10         20         30         40         50         60

70         80         90        100        110        120
        m288.pep   RPYRTFSPLPVLPKQPSAVLLSVPLSVALPRPAVNRHSTLRSPDFPPRMPYAIRGDCLPV
                   ||||||||||||||||||||||||||||||||||||||||||||||||||||||||||||
        g288       RPYRTFSPLPVLPKQPSAVLLSVPLSVALPRPAVNRHSTLRSPDFPPRMPYAIRGDCLPV
                     70         80         90        100        110        120

130        140        150        160        170        180
        m288.pep   PCAARIITRNTKMPSETVQVSDGIQPKLHALFQAGFDEAVQVAIQYGFGVADFVACTQVF
                   |||||||||||:||||||||||||||||||:|||||||||||||:||| ||||||||||
        g288       PCAARIITRNAKMPSETVQVSDGIQPKLHTLFQAGFDEAVQVAVQYGFVVADFVACTQVF
                    130        140        150        160        170        180 m288.pep   DTX
                   |:|
        g288       DAX
```

The following partial DNA sequence was identified in *N. meningitidis* <SEQ ID 1209>:

```
a288.seq
   1 ATGCACACCG GACAGGCGGT AAGCCGGGTT CTGTCTCGGA CAGTCATTCC

51 TCTAGGCATA CCGTTGCCGG TATGCTCAAG CAACCTACCC GAACGCTCGG

101 CGGGCAGCGT CATTGCGTTC TGTTTGGTCT TGCTCCGAAT GGGGTTTGGC

151 CTGCCGCATA TTGTTACCAA ATGCGCGGTG CGCCCTTACC GCACCTTTTC

201 ACCCTTGCCT GTGCTGCCAA AGCAGCCATC GGCGGTTTTG CTTTCTGTTC

251 CACTTTCCGT CGCGTTACCG CGCCCGGCCG TTAACCGGCA TTCTACCCTG

301 CGGAGCCCGG ACTTTCCTCC CCGTATGCCT TACGCGATAC GCGGCGACTG

351 TCTGCCCGTC CCGTGTGCGG CGCGGATTAT AACACGAAAC GCAAAAATGC

401 CGTCTGAAAC GGTACAGGTT TCAGACGGCA TACAGCCTAA ACTACACGCC

451 CTGTTTCAGG CTGGCTTCGA TAAAGCCGTC CAAGTCGCCG TCCAATACGG

501 CTTTGGTGTT GCCGACTTCG TAGCCTGTGC GCAAGTCTTT AATGCGTGA
```

This corresponds to the amino acid sequence <SEQ ID 1210; ORF 288.a>:

```
a288.pep
       1 MHTGQAVSRV LSRTVIPLGI PLPVCSSNLP ERSAGSVIAF CLVLLRMGFG

51 LPHIVTKCAV RPYRTFSPLP VLPKQPSAVL LSVPLSVALP RPAVNRHSTL

101 RSPDFPPRMP YAIRGDCLPV PCAARIITRN AKMPSETVQV SDGIQPKLHA

151 LFQAGFDKAV QVAVQYGFGV ADFVACAQVF NA* m288/a288   97.2% identity in 181 aa overlap 10        20        30        40        50        60
m288.pep    MHTGQAVSRVLSRTVIPLGIPLPVCSSNLPERSAGSVIAFCLVLLRMGFGLPHIVTKCAV
            ||||||||||||||||||||||||||||||||||||||||||||||||||||||||||||
a288        MHTGQAVSRVLSRTVIPLGIPLPVCSSNLPERSAGSVIAFCLVLLRMGFGLPHIVTKCAV
                    10        20        30        40        50        60

70        80        90       100       110       120
m288.pep    RPYRTFSPLPVLPKQPSAVLLSVPLSVALPRPAVNRHSTLRSPDFPPRMPYAIRGDCLPV
            ||||||||||||||||||||||||||||||||||||||||||||||||||||||||||||
a288        RRYRTFSPLPVLPKQPSAVLLSVPLSVALPRPAVNRHSTLRSPDFPPRMPYAIRGDCLPV
                    70        80        90       100       110       120

130       140       150       160       170       180
m288.pep    PCAARIITRNTKMPSETVQVSDGIQPKLHALFQAGFDEAVQVAIQYGFGVADFVACTQVF
            ||||||||||:|||||||||||||||||||||||||||:|||||:|||||||||||||:|||
a288        PCAARIITRNAKMPSETVQVSDGIQPKLHALFQAGFDKAVQVAVQYGFGVADFVACAQVF
                   130       140       150       160       170       180 m288.pep    DTX
            ::
a288        NAX
```

The following partial DNA sequence was identified in *N. gonorrhoeae* <SEQ ID 1211>:

```
g290.seq
   1  atggcaaaaa tgatgaaatg ggcggctgtt gcggcggtcg cggcggcagc 51  ggtttggggc ggatggtctt atctgaagcc cgaaccgcag gctgcttata 101  ttacggaagc ggtcaggcgc ggcgatatca gccggacggt ttccgcgacg 151  ggcgagattt cgccgtccaa cctggtatcg gtcggcgcgc aggcttcggg 201  gcagattaaa aagctttatg tcaaactcgg gcaacaggtc aaaaagggcg
```

-continued

```
 251 atttgattgc ggaaatcaat tcgaccacgc agaccaacac gatcgatatg 301 gaaaaatcca aattggaaac gtatcaggcg aagctggtgt ccgcacagat 351 tgcattgggc agcgcggaaa aaaaatataa gcgtcaggcg gcgttgtgga 401 aggatgatgc gacctctaaa gaagatttgg aaagcgcgca ggatgcgctt 451 gccgccgcca aagccaatgt tgccgagttg aaggctttaa tcagacagag 501 caaaatttcc atcaataccg ccgagtcgga tttgggctac acgcgcatta 551 ccgcgacgat ggacggcacg gtggtggcga ttcccgtgga agaggggcag 601 actgtgaacg cggcgcagtc tacgccgacg attgtccaat tggcgaatct 651 ggatatgatg ttgaacaaaa tgcagattgc cgagggcgat attaccaagg 701 tgaaggcggg gcaggatatt tcgtttacga ttttgtccga accggatacg 751 ccgattaagg cgaagctcga cagcgtcgac cccgggctga ccacgatgtc 801 gtcgggcggc tacaacagca gtacggatac ggcttccaat gcggtctatt 851 attatgcccg ttcgtttgtg ccgaatccgg acggcaaact cgccacgggg 901 atgacgacgc agaatacggt tgaaatcgac ggtgtgaaaa atgtgttgct 951 tattccgtcg ctgaccgtga aaaatcgcgg cggcaaggcg ttcgtacgcg 1001 tgttgggtgc ggacggcaag gcagtggaac gcgaaatccg gaccggtatg 1051 aaagacagta tgaataccga agtgaaaagc gggttgaaag aggggacaa 1101 agtggtcatc tccgaaataa ccgccgccga gcagcaggaa agcggcgaac 1151 gcgccctagg cggcccgccg cgccgataa
```

This corresponds to the amino acid sequence <SEQ ID 1212; ORF 290.ng>:

```
g290.pep
   1 MAKMMKWAAV AAVAAAAVWG GWSYLKPEPQ AAYITEAVRR GDISRTVSAT

51 GEISPSNLVS VGAQASGQIK KLYVKLGQQV KKGDLIAEIN STTQTNTIDM

101 EKSKLETYQA KLVSAQIALG SAEKKYKRQA ALWKDDATSK EDLESAQDAL

151 AAAKANVAEL KALIRQSKIS INTAESDLGY TRITATMDGT VVAIPVEEGQ

201 TVNAAQSTPT IVQLANLDMM LNKMQIAEGD ITKVKAGQDI SFTILSEPDT

251 PIKAKLDSVD PGLTTMSSGG YNSSTDTASN AVYYYARSFV PNPDGKLATG

301 MTTQNTVEID GVKNVLLIPS LTVKNRGGKA FVRVLGADGK AVEREIRTGM

351 KDSMNTEVKS GLKEGDKVVI SEITAAEQQE SGERALGGPP RR*
```

The following partial DNA sequence was identified in *N. meningitidis* <SEQ ID 1213>:

```
m290.seq (partial)
   1 ..GTATCGGTCG GCGCGCAGGC ATCGGGGCAG ATTAAGATAC TTTATGTCAA

51    ACTCGGGCAA CAGGTTAAAA AGGGCGATTT GATTGCGGAA ATCAATTCGA

101    CCTCGCAGAC CAATACGCTC AATACGGAAA ATCCAAGTT GGAAACGTAT

151    CAGGCGAAGC TGGTGTCGGC ACAGATTGCA TTGGGCAGCG CGGAGAAGAA

201    ATATAAGCGT CAGGCGGCGT TATGGAAGGA AAACGCGACT TCCAAAGAGG

251    ATTTGGAAAG CGCGCAGGAT GCGTTTGCCG CCGCCAAAGC CAATGTTGCC

301    GAGCTGAAGG CTTTAATCAG ACAGAGCAAA ATTTCCATCA ATACCGCCGA
```

-continued

```
 351   GTCGGAATTG GGCTACACGC GCATTACCGC AACGATGGAC GGCACGGTGG

401   TGGCGATTCT CGTGGAAGAG GGGCAGACTG TGAACGCGGC GCAGTCTACG

451   CCGACGATTG TCCAATTGGC GAATCTGGAT ATGATGTTGA ACAAAATGCA

501   GATTGCCGAG GGCGATATTA CCAAGGTGAA GGCGGGGCAG ATATTTCGT

551   TTACGATTTT GTCCGAACCG GATACGCCGA TTAAGGCGAA GCTCGACAGC

601   GTCGACCCCG GGCTGACCAC GATGTCGTCG GGCGGTTACA ACAGCAGTAC

651   GGATACGGCT TCCAATGCGG TCTACTATTA TGCCCGTTCG TTTGTGCCGA

701   ATCCGGACGG CAAACTCGCC ACGGGGATGA CGACGCAGAA TACGGTTGAA

751   ATCGACGGCG TGAAAAATGT GCTGATTATT CCGTCGCTGA CCGTGAAAAA

801   TCGCGGCGGC AAGGCGTTTG TGCGCGTGTT GGGTGCGGAC GGCAAGGCGG

851   CGGAACGCGA AATCCGGACC GGTATGAGAG ACAGTATGAA TACCGAAGTA

901   AAAAGCGGGT TGAAAGAGGG GGACAAAGTG GTCATCTCCG AAATAACCGC

951   CGCCGAGCAA CAGGAAAGCG GCGAACGCGC CCTAGGCGGC CCGCCGCGCC

1001   GATAA
```

This corresponds to the amino acid sequence <SEQ ID 1214; ORF 290>:

```
m290.pep (partial)
   1   ..VSVGAQASGQ IKILYVKLGQ QVKKGDLIAE INSTSQTNTL NTEKSKLETY

51   QAKLVSAQIA LGSAEKKYKR QAALWKENAT SKEDLESAQD AFAAAKANVA

101   ELKALIRQSK ISINTAESEL GYTRITATMD GTVVAILVEE GQTVNAAQST

151   PTIVQLANLD MMLNKMQIAE GDITKVKAGQ DISFTILSEP DTPIKAKLDS

201   VDPGLTTMSS GGYNSSTDTA SNAVYYYARS FVPNPDGKLA TGMTTQNTVE

251   IDGVKNVLII PSLTVKNRGG KAFVRVLGAD GKAAEREIRT GMRDSMNTEV

301   KSGLKEGDKV VISEITAAEQ QESGERALGG PPRR*
```

Computer analysis of this amino acid sequence gave the following results:
Homology with a Predicted ORF from *N. gonorrhoeae*

```
    m290/g290  96.1% identity in 334 aa overlap 10         20         30
    m290.pep                       VSVGAQASGQIKILYVKLGQQVKKGDLIAE
                                   ||||||||||| |||||||||||||||||
    g290       PQAAYITEAVRRGDISRTVSATGEISPSNLVSVGAQASGQIKKLYVKLGQQVKKGDLIAE
                30         40         50         60         70         80

40         50         60         70         80         90
    m290.pep   INSTSQTNTLNTEKSKLETYQAKLVSAQIALGSAEKKYKRQAALWKENATSKEDLESAQD
               ||||:||||::|||||||||||||||||||||||||||||||||||||:|||||||||||
    g290       INSTTQTNTIDMEKSKLETYQAKLVSAQIALGSAEKKYKRQAALWKDDATSKEDLESAQD
                90        100        110        120        130        140

100        110        120        130        140        150
    m290.pep   AFAAAKANVAELKALIRQSKISINTAESELGYTRITATMDGTVVAILVEEGQTVNAAQST
               |:||||||||||||||||||||||||||||:|||||||||||||||| |||||||||||
    g290       ALAAAKANVAELKALIRQSKISINTAESDLGYTRITATMDGTVVAIPVEEGQTVNAAQST
                150        160        170        180        190        200

160        170        180        190        200        210
    m290.pep   PTIVQLANLDMMLNKMQIAEGDITKVKAGQDISFTILSEPDTPIKAKLDSVDPGLTTMSS
               ||||||||||||||||||||||||||||||||||||||||||||||||||||||||||||
    g290       PTIVQLANLDMMLNKMQIAEGDITKVKAGQDISFTILSEPDTPIKAKLDSVDPGLTTMSS
                210        220        230        240        250        260
```

-continued

```
                     220        230        240        250        260        270
m290.pep     GGYNSSTDTASNAVYYYARSFVPNPDGKLATGMTTQNTVEIDGVKNVLIIPSLTVKNRGG
             ||||||||||||||||||||||||||||||||||||||||||||||:|||||||||||
g290         GGYNSSTDTASNAVYYYARSFVPNPDGKLATGMTTQNTVEIDGVKNVLLIPSLTVKNRGG
                     270        280        290        300        310        320

280        290        300        310        320        330
m290.pep     KAFVRVLGADGKAAEREIRTGMRDSMNTEVKSGLKEGDKVVISEITAAEQQESGERALGG
             |||||||||||||:||||:|||||||||||||||||||||||||||||||||||||||
g290         KAFVRVLGADGKAVEREIRTGMKDSMNTEVKSGLKEGDKVVISEITAAEQQESGERALGG
                     330        340        350        360        370        380 m290.pep     PPRRX
             |||||
g290         PPRRX
             390
```

The following partial DNA sequence was identified in *N. meningitidis* <SEQ ID 1215>:

```
a290.seq
    1 ATGGCAAAAA TGATGAAATG GCGGCTGTT GCGGCGGTCG CGGCGGCAGC

51 GGTTTGGGGC GGATGGTCTT ATCTGAAGCC CGAGCCGCAG GCTGCTTATA

101 TTACGGAAAC GGTCAGGCGC GGCGACATCA GCCGGACGGT TTCTGCAACA

151 GGGGAGATTT CGCCGTCCAA CCTGGTATCG GTCGGCGCGC AGGCATCGGG

201 GCAGATTAAG AAACTTTATG TCAAACTCGG CAACAGGTT AAAAAGGGCG

251 ATTTGATTGC GGAAATCAAT TCGACCTCGC AGACCAATAC GCTCAATACG

301 GAAAAATCCA AATTGGAAAC GTATCAGGCG AAGCTGGTGT CGGCACAGAT

351 TGCATTGGGC AGCGCGGAGA AGAAATATAA GCGTCAGGCG GCGTTGTGGA

401 AGGATGATGC GACCGCTAAA GAAGATTTGG AAAGCGCACA GGATGCGCTT

451 GCCGCCGCCA AAGCCAATGT TGCCGAGCTG AAGGCTCTAA TCAGACAGAG

501 CAAAATTTCC ATCAATACCG CCGAGTCGGA ATTGGGCTAC ACGCGCATTA

551 CCGCAACGAT GGACGGCACG GTGGTGGCGA TTCTCGTGGA AGAGGGGCAG

601 ACTGTGAACG CGGCGCAGTC TACGCCGACG ATTGTCCAAT TGGCGAATCT

651 GGATATGATG TTGAACAAAA TGCAGATTGC CGAGGGCGAT ATTACCAAGG

701 TGAAGGCGGG GCAGGATATT TCGTTTACGA TTTTGTCCGA ACCGGATACG

751 CCGATTAAGG CGAAGCTCGA CAGCGTCGAC CCCGGGCTGA CCACGATGTC

801 GTCGGGCGGC TACAACAGCA GTACGGATAC GGCTTCCAAT GCGGTCTACT

851 ATTATGCCCG TTCGTTTGTG CCGAATCCGG ACGGCAAACT CGCCACGGGG

901 ATGACGACGC AGAATACGGT TGAAATCGAC GGTGTGAAAA ATGTGCTGAT

951 TATTCCGTCG CTGACCGTGA AAAATCGCGG CGGCAGGGCG TTTGTGCGCG

1001 TGTTGGGTGC AGACGGCAAG GCGGCGGAAC GCGAAATCC GACCGGTATG

1051 AGAGACAGTA TGAATACCGA AGTAAAAAGC GGGTTGAAAG AGGGGACAA

1101 AGTGGTCATC TCCGAAATAA CCGCCGCCGA GCAGCAGGAA AGCGGCGAAC

1151 GCGCCCTAGG CGGCCCGCCG CGCCGATAA
```

This corresponds to the amino acid sequence <SEQ ID 1216; ORF 290.a>:

```
a290.pep
    1 MAKMMKWAAV AAVAAAAVWG GWSYLKPEPQ AAYITETVRR GDISRTVSAT
```

```
 51 GEISPSNLVS VGAQASGQIK KLYVKLGQQV KKGDLIAEIN STSQTNTLNT

101 EKSKLETYQA KLVSAQIALG SAEKKYKRQA ALWKDDATAK EDLESAQDAL

151 AAAKANVAEL KALIRQSKIS INTAESELGY TRITATMDGT VVAILVEEGQ

201 TVNAAQSTPT IVQLANLDMM LNKMQIAEGD ITKVKAGQDI SFTILSEPDT

251 PIKAKLDSVD PGLTTMSSGG YNSSTDTASN AVYYYARSFV PNPDGKLATG

301 MTTQNTVEID GVKNVLIIPS LTVKNRGGRA FVRVLGADGK AAEREIRTGM

351 RDSMNTEVKS GLKEGDKVVI SEITAAEQQE SGERALGGPP RR*
``` m290/a290  98.2% identity in 334 aa overlap

```
                                        10        20        30
m290.pep                       VSVGAQASGQIKILYVKLGQQVKKGDLIAE
                                         |||||||||||| ||||||||||||||||||
a290     PQAAYITETVRRGDISRTVSATGEISPSNLVSVGAQASGQIKKLYVKLGQQVKKGDLIAE
              30        40        50        60        70        80

40        50        60        70        80        90
m290.pep  INSTSQTNTLNTEKSKLETYQAKLVSAQIALGSAEKKYKRQAALWKENATSKEDLESAQD
          |||||||||||||||||||||||||||||||||||||||||||||::||:|||||||||
a290      INSTSQTNTLNTEKSKLETYQAKLVSAQIALGSAEKKYKRQAALWKDDATAKEDLESAQD
              90       100       110       120       130       140

100       110       120       130       140       150
m290.pep  AFAAAKANVAELKALIRQSKISINTAESELGYTRITATMDGTVVAILVEEGQTVNAAQST
          |:||||||||||||||||||||||||||||||||||||||||||||||||||||||||
a290      ALAAAKANVAELKALIRQSKISINTAESELGYTRITATMDGTVVAILVEEGQTVNAAQST
              150       160       170       180       190       200

160       170       180       190       200       210
m290.pep  PTIVQLANLDMMLNKMQIAEGDITKVKAGQDISFTILSEPDTPIKAKLDSVDPGLTTMSS
          ||||||||||||||||||||||||||||||||||||||||||||||||||||||||||
a290      PTIVQLANLDMMLNKMQIAEGDITKVKAGQDISFTILSEPDTPIKAKLDSVDPGLTTMSS
              210       220       230       240       250       260

220       230       240       250       260       270
m290.pep  GGYNSSTDTASNAVYYYARSFVPNPDGKLATGMTTQNTVEIDGVKNVLIIPSLTVKNRGG
          ||||||||||||||||||||||||||||||||||||||||||||||||||||||||||
a290      GGYNSSTDTASNAVYYYARSFVPNPDGKLATGMTTQNTVEIDGVKNVLIIPSLTVKNRGG
              270       280       290       300       310       320

280       290       300       310       320       330
m290.pep  KAFVRVLGADGKAAEREIRTGMRDSMNTEVKSGLKEGDKVVISEITAAEQQESGERALGG
          :|||||||||||||||||||||||||||||||||||||||||||||||||||||||||
a290      RAFVRVLGADGKAAEREIRTGMKDSMNTEVKSGLKEGDKVVISEITAAEQQESGERALGG
              330       340       350       360       370       380 m290.pep  PPRRX
          |||||
a290      PPRRX
          390
```

The following partial DNA sequence was identified in *N. gonorrhoeae* <SEQ ID 1217>:

```
g292.seq
  1 atgaaaacca agttaatcaa aatcttgacc cccttttaccg tcctgccgct 51 gctggcttgc gggcaaacgc ccgtttccaa tgccaacgcc gaatccgccg 101 tcaaagccga atccgccggc aaatccgttg ccgcttcttt gaaagcgcgt 151 ttggaaaaaa cctattccgc ccaagatttg aaagtgttga cgtcagcga 201 aacaccggtc aaaggcattt acgaagtcgt cgtcagcggc aggcagatta 251 tctacaccga tgccgaaggc ggctatatgt tcgtcggcga actcatcaac 301 atcgacacgc gcaaaaacct gaccgaagaa cgcgccgccg atttgaacaa 351 aatcgacttc gcctccctgc ctttggacaa agccatcaaa gaagtacgcg 401 gcaacggcaa gctgaaagtc gccgtcttct ccgaccccga ttgtccgttc 451 tgcaaacgct tggaacatga gtttgaaaaa atgaccgacg tgacggttta 501 cagctttatg atgcccattg ccggcctgca cccagatgcc gcgcgcaagg
```

-continued

```
551 cgcaaatctt atggtgtcag cccgaccgtg ccaaagcgtg gacggattgg 601 atgcgtaaag gcaaattccc ggtcggcggc agcatctgcg acaatcccgt 651 cgcggaaacc acttccttgg gcgaacagtt cggcttcaac ggcacgccga 701 cccttcgtct tccccaacgg gcgcacccaa agcggttaca gcccgatgcc 751 ccaactggag gaaatcatcc gcaaaaacca gcagtaaacc cgcaatga
```

This corresponds to the amino acid sequence <SEQ ID 1218; ORF 292.ng>:

```
g292.pep
  1 MKTKLIKILT PFTVLPLLAC GQTPVSNANA ESAVKAESAG KSVAASLKAR

51 LEKTYSAQDL KVLSVSETPV KGIYEVVVSG RQIIYTDAEG GYMFVGELIN

101 IDTRKNLTEE RAADLNKIDF ASLPLDKAIK EVRGNGKLKV AVFSDPDCPF

151 CKRLEHEFEK MTDVTVYSFM MPIAGLHPDA ARKAQILWCQ PDRAKAWTDW

201 MRKGKFPVGG SICDNPVAET TSLGEQFGFN GTPTLRLPQR AHPKRLQPDA

251 PTGGNHPQKP AVNPQ*
```

The following partial DNA sequence was identified in *N. meningitidis* <SEQ ID 1219>:

```
m292.seq
  1 ATGAAAACCA AGTTAATCAA AATCTTGACC CCCTTTACCG TCCTCCCGCT

51 GCTGGCTTGC GGGCAAACGC CCGTTTCCAA TGCCAACGCC GAACCCGCCG

101 TCAAAGCCGA GTCCGCCGGC AAATCCGTTG CCGCCTCTTT GAAAGCGCGT

151 TTGGAAAAAA CCTATTCCGC CCAAGATTTG AAAGTGTTGA GCGTCAGCGA

201 AACACCGGTC AAAGGCATTT ACGAAGTCGT CGTCAGCGGC AGGCAGATTA

251 TCTACACCGA TGCCGAAGGC GGCTATATGT TCGTCGGCGA ACTCATCAAC

301 ATCGACACGC GCAAAAACCT GACCGAAGAA CGCGCCGCCG ATTTGAACAA

351 AATCGACTTC GCCTCCCTGC CTTTGGACAA AGCCATCAAA GAAGTGCGCG

401 GCAACGGCAA GCTGAAAGTC GCCGTCTTCT CCGACCCCGA TTGTCCGTTC

451 TGCAAACGCT TGGAACACGA GTTTGAAAAA ATGACCGACG TGACGGTTTA

501 CAGCTTTATG ATGCCCATTG CCGGCCTGCA CCCCGATGCC GCGCGCAAGG

551 CGCAAATCTT ATGGTGTCAG CCCGACCGCG CCAAAGCGTG GACGGATTGG

601 ATGCGTAAAG GCAAATTCCC GGTCGGCGGC AGCATCTGCG ACAATCCCGT

651 CGCGGAAACC ACTTCCTTGG GCGAACAATT CGGCTTCAAC GGCACGCCGA

701 CCCTCGTCTT CCCCAACGGG CGCAGCCAAA GCGGCTACAG CCCGATGCCC

751 CAACTGGAGG AAATCATCCG CAAAAATCAA TAA
```

This corresponds to the amino acid sequence <SEQ ID 1220; ORF 292>:

```
m292.pep
  1 MKTKLIKILT PFTVLPLLAC GQTPVSNANA EPAVKAESAG KSVAASLKAR

51 LEKTYSAQDL KVLSVSETPV KGIYEVVVSG RQIIYTDAEG GYMFVGELIN

101 IDTRKNLTEE RAADLNKIDF ASLPLDKAIK EVRGNGKLKV AVFSDPDCPF

151 CKRLEHEFEK MTDVTVYSFM MPIAGLHPDA ARKAQILWCQ PDRAKAWTDW
```

```
201 MRKGKFPVGG SICDNPVAET TSLGEQFGFN GTPTLVFPNG RSQSGYSPMP

251 QLEEIIRKNQ *
```

Computer analysis of this amino acid sequence gave the following results:
Homology with a Predicted ORF from *N. gonorrhoeae*

```
   m292/g292  98.7% identity in 238 aa overlap 10         20         30         40         50         60
     m290.pep   MKTKLIKILTPFTVLPLLACGQTPVSNANAEPAVKAESAGKSVAASLKARLEKTYSAQDL
                ||||||||||||||||||||||||||||||||| ||||||||||||||||||||||||||
     g290       MKTKLIKILTPFTVLPLLACGQTPVSNANAESAVKAESAGKSVAASLKARLEKTYSAQDL
                        10         20         30         40         50         60

70         80         90        100        110        120
     m290.pep   KVLSVSETPVKGIYEVVVSGRQIIYTDAEGGYMFVGELINIDTRKNLTEERAADLNKIDF
                ||||||||||||||||||||||||||||||||||||||||||||||||||||||||||||
     g290       KVLSVSETPVKGIYEVVVSGRQIIYTDAEGGYMFVGELINIDTRKNLTEERAADLNKIDF
                        70         80         90        100        110        120

130        140        150        160        170        180
     m290.pep   ASLPLDKAIKEVRGNGKLKVAVFSDPDCPFCKRLEHEFEKMTDVTVYSFMMPIAGLHPDA
                ||||||||||||||||||||||||||||||||||||||||||||||||||||||||||||
     g290       ASLPLDKAIKEVRGNGKLKVAVFSDPDCPFCKRLEHEFEKMTDVTVYSFMMPIAGLHPDA
                       130        140        150        160        170        180

190        200        210        220        230        240
     m290.pep   ARKAQILWCQPDRAKAWTDWMRKGKFPVGGSICDNPVAETTSLGEQFGFNGTPTLVFPNG
                |||||||||||||||||||||||||||||||||||||||||||||||||||||||| :|:
     g290       ARKAQILWCQPDRAKAWTDWMRKGKFPVGGSICDNPVAETTSLGEQFGFNGTPTLRLPQR
                       190        200        210        220        230        240

250        260
     m290.pep   RSQSGYSPMPQLEEIIRKNQX g290       AHPKRLQPDAPTGGNHPQKPAVNPQX
                       250        260
```

The following partial DNA sequence was identified in *N. meningitidis* <SEQ ID 1221>:

```
a292.seq
  1 ATGAAAACCA AGTTAATCAA AATCTTGACC CCCTTTACCG TCCTCCCGCT

51 GCTGGCTTGC GGGCAAACGC CCGTTTCCAA TGCCAACGCC GAACCCGCCG

101 TCAAAGCCGA GTCCGCCGGC AAATCCGTTG CCGCCTCTTT GAAAGCGCGT

151 TTGGAAAAAA CCTATTCCGC CCAAGATTTG AAAGTGTTGA GCGTCAGCGA

201 AACACCGGTC AAAGGCATTT ACGAAGTCGT CGTCAGCGGC AGGCAGATTA

251 TCTACACCGA TGCCGAAGGC GGCTATATGT TCGTCGGCGA ACTCATCAAC

301 ATCGACACGC GCAAAAACCT GACCGAAGAA CGCGCCGCCG ATTTGAACAA

351 AATCGACTTC GCCTCCCTGC CTTTGGACAA AGCCATCAAA GAAGTGCGCG

401 GCAACGGCAA GCTGAAAGTC GCCGTCTTCT CCGACCCCGA TTGTCCGTTC

451 TGCAAACGCT TGGAACACGA GTTTGAAAAA ATGACCGACG TGACGGTTTA

501 CAGCTTTATG ATGCCCATTG CCGGCCTGCA CCCCGATGCC GCGCGCAAGG

551 CGCAAATCTT ATGGTGTCAG CCCGACCGCG CCAAAGCGTG GACGGATTGG

601 ATGCGTAAAG GCAAATTCCC GGTCGGCGGC AGCATCTGCG ACAATCCCGT

651 CGCGGAAACC ACTTCCTTGG GCGAACAATT CGGCTTCAAC GGCACGCCGA

701 CCCTCGTCTT CCCCAACGGG CGCAGCCAAA GCGGCTACAG CCCGATGCCC

751 CAACTGGAGG AAATCATCCG CAAAAATCAA TAA
```

This corresponds to the amino acid sequence <SEQ ID 1222; ORF 292.a>:

```
a292.pep

1  MKTKLIKILT PFTVLPLLAC GQTPVSNANA EPAVKAESAG KSVAASLKAR

51  LEKTYSAQDL KVLSVSETPV KGIYEVVVSG RQIIYTDAEG GYMFVGELIN

101  IDTRKNLTEE RAADLNKIDF ASLPLDKAIK EVRGNGKLKV AVFSDPDCPF

151  CKRLEHEFEK MTDVTVYSFM MPIAGLHPDA ARKAQILWCQ PDRAKAWTDW

201  MRKGKFPVGG SICDNPVAET TSLGEQFGFN GTPTLVFPNG RSQSGYSPMP

251  QLEEIIRKNQ * m292/a292  100.0% identity in 260 aa overlap 10         20         30         40         50         60
m292.pep  MKTKLIKILTPFTVLPLLACGQTPVSNANAEPAVKAESAGKSVAASLKARLEKTYSAQDL
          ||||||||||||||||||||||||||||||| ||||||||||||||||||||||||||||
a292      MKTKLIKILTPFTVLPLLACGQTPVSNANAESAVKAESAGKSVAASLKARLEKTYSAQDL
                  10         20         30         40         50         60

70         80         90        100        110        120
m292.pep  KVLSVSETPVKGIYEVVVSGRQIIYTDAEGGYMFVGELINIDTRKNLTEERAADLNKIDF
          ||||||||||||||||||||||||||||||||||||||||||||||||||||||||||||
a292      KVLSVSETPVKGIYEVVVSGRQIIYTDAEGGYMFVGELINIDTRKNLTEERAADLNKIDF
                  70         80         90        100        110        120

130        140        150        160        170        180
m292.pep  ASLPLDKAIKEVRGNGKLKVAVFSDPDCPFCKRLEHEFEKMTDVTVYSFMMPIAGLHPDA
          ||||||||||||||||||||||||||||||||||||||||||||||||||||||||||||
a292      ASLPLDKAIKEVRGNGKLKVAVFSDPDCPFCKRLEHEFEKMTDVTVYSFMMPIAGLHPDA
                 130        140        150        160        170        180

190        200        210        220        230        240
m292.pep  ARKAQILWCQPDRAKAWTDWMRKGKFPVGGSICDNPVAETTSLGEQFGFNGTPTLVFPNG
          ||||||||||||||||||||||||||||||||||||||||||||||||||||||||||||
a292      ARKAQILWCQPDRAKAWTDWMRKGKFPVGGSICDNPVAETTSLGEQFGFNGTPTLVFPNG
                 190        200        210        220        230        240

250        260
m292.pep  RSQSGYSPMPQLEEIIRKNQX a292      RSQSGYSPMPQLEEIIRKNQX
                 250        260
```

The following partial DNA sequence was identified in *N. gonorrhoeae* <SEQ ID 1223>:

```
g294.seq (partial)
   1  atgcgtatta cctgtgcgcc gatgtcgctt ttgtcggcgg cagtctggtc 51  ggttcgggct gtcagaacat catcgaaccg ctttcctgcg gcgttacgac 101  gatattcggc ttttcgacct acaattttc cgaagcctgc cggcacgcct 151  tggcatcggg tgcggcggtt caagtcgaat cggcggacgc gtggcgtgaa 201  gccgttgaaa aaaccttatc tggcgagggg gcggaatgc agatgcaggc 251  gcgcgtggac ggcttatcg cacaacatcg cggagcgggc gcgagaatcg 301  ccgaggcggt gcgggaagcg gtatgcggac atcggggcg atagtgatac 351  aatccgtatc cgagttttcc ggttggagca tcgtatgagt atttatgccg 401  tcgcgcacat catccacctg tattgcgcca ccgcctttgt cggcggcgtg 451  tttttttgaag tgctggtttt gtccgtcctg catacgggac gggtgtcgcg 501  cgaggcgcgg cgcgaagtgg aaaaggcaat gtcttaccgc gccgtcaggg 551  tgatgccgtt tgcggtcgga ctgctgttcg ccaggggaac tctagagtcg 601  actgcagcag catgccctc...
```

This corresponds to the amino acid sequence <SEQ ID 1224; ORF 294.ng>:

```
g294.pep (partial)
   1 MRITCAPMSL LSAAVWSVRA VRTSSNRFPA ALRRYSAFRP TIFPKPAGTP

51 WHRVRRFKSN RRTRGVKPLK KPYLARGAEC RCRRAWTALS HNIAERARES

101 PRRCGKRYAD IGGDSDTIRI RVFRLEHRMS IYAVAHIIHL YCATAFVGGV

151 FFEVLVLSVL HTGRVSREAR REVEKAMSYR AVRVMPFAVG LLFARGTLES

201 TAAACP....
```

The following partial DNA sequence was identified in *N. meningitidis* <SEQ ID 1225>:

```
m294.seq
   1 ATGCGTATTA CCTGTGCGCC GATGTCGCTT TTGTCGGCGG CAGTCTGGTC

51 GATTCGGGTT GTCAGAACAT CATCGAACCG CTTTCCTGCG GCGTTCCGAC

101 GATATTCGGC TTTTCAACCT ACAATTTTTC CGAAGCCTGC CGACACGCCT

151 TGGCATCGGG TGCGGCGGTT CAAGTCGAAT CGGCGGATGC GTGGCGGGAA

201 GCCGTTGAAA AAACCTTATC GTCCGAGGGG GGGGGGATGC AGATGCAGGC

251 GCGCGTGGAC GGCTTTATCG CACAACATCG CGGAGCGGGC GCGAGAATCG

301 CCGAGGCGGT GCGGGAAGCG GTATGCGGAT ATCGGGGGCG ATAGTGATAC

351 AATCCGTATC CGAGTTTTCC GTTTGGAGCA TCGTATGAGT ATTTATGCCG

401 TCGCGCACAT CGTTCATCTG TATTGCGCTA TTGCCTTTGT CGGCGGCGTG

451 TTTTTTGAAG TGCTGGTTTT GTCCGTCCTG CATACGGGAC GGGTGTCGCG

501 CGAGGCGCGG CGCGAAGTGG AAAAGGCAAT GTCTTACCGC GCCGTCAGGG

551 TGATGCCGTT TGTGGTCGGA CTGCTGTTCG CCAGCGGCAT CGTGATGGCG

601 GCAAACCGCT ATCTTTCTAT ATTGGGCGAA CCGTTTGCCA CTTCCTTCGG

651 TACGATGCTG ACGCTGAAAA TCCTGTTGGC GTTCAGCGTA TTGGCGCACT

701 TCGCCATCGC CGTCGTCAAA ATGGCGCGTT CCACACTGAC GGTCGGTTGG

751 TCGAAATACA TACACGCCGT CGTCTTTACC CATATGcTGC TGATTGTCTT

801 TTTGGCAAAA GCGATGTTTT ATATCAGCTG GTAA
```

This corresponds to the amino acid sequence <SEQ ID 1226; ORF 294>:

```
m294.pep

1  MRITCAPMSL LSAAVWSIRV VRTSSNRFPA AFRRYSAFQP TIFPKPADTP

51  WHRVRRFKSN RRMRGGKPLK KPYRPRGGGC RCRRAWTALS HNIAERARES

101  PRRCGKRYAD IGGDSDTIRI RVFRLEHRMS IYAVAHIVHL YCAIAFVGGV

151  FFEVLVLSVL HTGRVSREAR REVEKAMSYR AVRVMPFVVG LLFASGIVMA

201  ANRYLSILGE PFATSFGTML TIKILLAFSV LAHFAIAVVK MARSTLTVGW

251  SKYIHAVVFT HMLLIVFLAK AMFYISW* g294/m294  92.3% identity in 196 aa overlap 10        20        30        40        50        60
g294.pep  MRITCAPMSLLSAAVWSVRAVRTSSNRFPAALRRYSAFRPTIFPKPAGTPWHRVRRFKSN
          ||||||||||||||||:|:|||||||||||:||||||:|||||||| |||||||||||||
m294      MRITCAPMSLLSAAVWSIRVVRTSSNRFPAAFRRYSAFQPTIFPKPADTPWHRVRRFKSN
                 10        20        30        40        50        60
```

-continued

```
                  70        80        90       100       110       120
g294.pep  RRTRGVKPLKKPYLARGAECRCRRAWTALSHNIAERARESPRRCGKRYADIGGDSDTIRI
          || || |||||||  ||: |||||||||||||||||||||||||||||||||||||||||
m294      RRMRGGKPLKKPYRPRGGGCRCRRAWTALSHNIAERARESPRRCGKRYADIGGDSDTIRI
                  70        80        90       100       110       120

130       140       150       160       170       180
g294.pep  RVFRLEHRMSIYAVAHIIHLYCATAFVGGVFFEVLVLSVLHTGRVSPEARREVEKAMSYR
          |||||||||||||||||:||||| |||||||||||||||||||||| |||||||||||||
m294      RVFRLEHRMSIYAVAHIVHLYCAIAFVGGVFFEVLVLSVLHTGRVSREARREVEKAMSYR
                 130       140       150       160       170       180

190       200
g294.pep  AVRVMPFAVGLLFARGTLESTAAACP
          |||||||:|||||| |
m294      AVRVMPFVVGLLFASGIVMAANRYLSILGEPFATSFGTMLTLKILLAFSVLAHFAIAVVK
                 190       200       210       220       230       240
```

The following partial DNA sequence was identified in *N. meningitidis* <SEQ ID 1227>:

```
a294.seq
   1 ATGCGTATTA CCTGTGCGCC GATGTCGCTT TTGTCGGCGG CAGTCTGGTC
  51 GATTCGGGCT GTCAGAACAT CATCGAACCG CTTTCCTGCG GCGTTCCGAC
 101 GATATTCGGC TTTTCGACCT ACAATTTTTC CGAAGCCTGC CGGCACGCCT
 151 TGGCATCGGG TGCGGCGGTT CAAGTCGAAT CGGCGGACGC GTGGCGGGAA
 201 GCCGTTGAAA AAAACTTATC GTCCGAGGAG GGCGGAATGC AGATGCAGGC
 251 GCGCGCGGAC GGCTTTATCG CACAACATCG CGGAGCGGGC GCGAGAATCG
 301 CCGAGGCGGT ACGGGAAGCG GTATGCGGAC ATCGGGGACG ATAGTGATAC
 351 AATCCGTATC CGAGTTTTCC GGTTGGAGTA CCGTATGAGT ATTTATGCCG
 401 TCGCGCACAT CGTCCACCTG TATTGCGCCA TCGCCTTTGT CGGCGGCGTG
 451 TTTTTTGAAG TGCTGGTTTT GTCCGTCCTG CATACGGGAC GGGTGTCGTG
 501 CGAGGCGCGG CGCGAAGTGG AAAAGGCAAT GTCTTACCGC GCCGTCAGGG
 551 TGATGCCGTT TGTGGTCGGA CTGCTGTTCG CCAGCGGCAT CGTGATGGCG
 601 GCAAACCGCT ATCTTTCTAT ATTGGGCGAA CCGTTTGCCA CTTCCTTCGG
 651 TACGATGCTG ACGCTGAAAA TCCTGTTGGC GTTCAGCGTG TTGGCGCACT
 701 TCGCCATCGC CGTCGTCAAA ATGGCGCGTT CCACACTGAC CGTCGGCTGG
 751 TCGAAATACA TACACACCGT CGTCTTTACC CATATGCTGC TGATTGTCTT
 801 TTTGGCAAAA GCGATGTTTT ATATCAGCTG GTAA
```

This corresponds to the amino acid sequence <SEQ ID 1228; ORF 294.a>:

```
a294.pep
   1 MRITCAPMSL LSAAVWSIRA VRTSSNRFPA AFRRYSAFRP TIFPKPAGTP
  51 WHRVRRFKSN RRTRGGKPLK KTYRPRRAEC RCRRARTALS HNIAERARES
 101 PRRYGKRYAD IGDDSDTIRI RVFRLEYRMS IYAVAHIVHL YCAIAFVGGV
 151 FFEVLVLSVL HTGRVSCEAR REVEKAMSYR AVRVMPFVVG LLFASGIVMA
 201 ANRYLSILGE PFATSFGTML TLKILLAFSV LAHFAIAVVK MARSTLTVGW
 251 SKYIHTVVFT HMLLIVFLAK AMFYISW*
``` m294/a294 94.9% identity in 277 aa overlap

```
                  10         20         30         40         50         60
   m294.pep  MRITCAPMSLLSAAVWSIRVVRTSSNRFPAAFRRYSAFQPTIFPKPADTPWHRVRRFKSN
             ||||||||||||||||||:|||||||||||||||||:|||||||| ||||||||||||||
   a294      MRITCAPMSLLSAAVWSIRAVRTSSNRFPAAFRRYSAFRPTIFPKPAGTPWHRVRRFKSN
                  10         20         30         40         50         60

70         80         90        100        110        120
   m294.pep  RRMRGGKPLKKPYRPRGGGCRCRRAWTALSHNIAERARESPRRCGKRYADIGGDSDTIRI
             || |||||||| |||:|||||||||||||||||||||||||  |||||||||||||||
   a294      RRTRGGKPLKKTYRPRRAECRCRRARTALSHNIAERARESPRRYGKRYADIGDDSDTIRI
                  70         80         90        100        110        120

130        140        150        160        170        180
   m294.pep  RVFRLEHRMSIYAVAHIVHLYCAIAFVGGVFFEVLVLSVLHTGRVSREARREVEKAMSYR
             ||||||:|||||||||||||||||||||||||||||||||||||||:|||||||||||||
   a294      RVFRLEYRMSIYAVAHIVHLYCAIAFVGGVFFEVLVLSVLHTGRVSCEARREVEKAMSYR
                 130        140        150        160        170        180

190        200        210        220        230        240
   m294.pep  AVRVMPFVVGLLFASGIVMAANRYLSILGEPFATSFGTMLTLKILLAFSVLAHFAIAVVK
             ||||||||||||||||||||||||||||||||||||||||||||||||||||||||||||
   a294      AVRVMPFVVGLLFASGIVMAANRYLSILGEPFATSFGTMLTLKILLAFSVLAHFAIAVVK
                 190        200        210        220        230        240

250        260        270
   m294.pep  MARSTLTVGWSKYIHAVVFTHMLLIVFLAKAMFYISWX
             |||||||||||||||:|||||||||||||||||||||
   a294      MARSTLTVGWSKYIHTVVFTHMLLIVFLAKAMFYISWX
                 250        260        270
```

The following partial DNA sequence was identified in *N. gonorrhoeae* <SEQ ID 1229>:

```
g295.seq
  1 atgctcggga tggcgcggca cgacggccag cagggcatcg ccgcgatatt 51 gttgccacgc cgccagcagt ttttccgcct cgtcttcgcc ccgataaacg 101 cgcgtgctgc cgcacacggc aaccggccgg cctccgatgc gttttttcaaa 151 ctgccccgcc agcgttttca tgtcttcaga cggcatcagg tcgtatttgg 201 tattgccgca cacctgcacg gatgccgcgc ccaatttcgc caaccgcgcc 251 gcatccgcct ccgtctgcgc cagacagccc gtcagcgaag cggctgcggg 301 acggatcagg cggcggactt tcagataacc gttcagcgat ttttccgaca 351 gccgcgcatt cgccaaaaac agcggcacac ccgctcgccg gcattccttc 401 atcagattgg gccagatttc ggtttccatc aaaatgccga acatcgggcg 451 gtgttcgcgc aaaaactgcc gtacccacgt tttttttgtca tacggaagat 501 agcggcattg cgcatcggga aacagaactt gcgcggtttc ccgtcccgtc 551 ggggtcatct gcgtcatcag cagcggcgca tcgggaaaac gccgccgcaa 601 ctcgcgtatc aagggctggg cggcacgcgt ttctccgacc gaaacggcgt 651 gtatccaaac cgcgccggta acgggattcg gatgcggctt gccgaaacgc 701 tcgtccctat gcgcccggta tgccggggca cttccggagc gtttgtccaa 751 ataacgccgt atccatatcg gcgcaagcag ccacaataca tcataaagcc 801 attggaacat ctttctatt cctgcaaaac aaatgccgtc cgaacggttc 851 ggacggcatt tcggcaacgg aatcaaatat cgtag
```

This corresponds to the amino acid sequence <SEQ ID 1230; ORF 295.ng>:

```
g295.pep
  1 MLGMARHDGQ QGIAAILLPR RQQFFRLVFA PINARAAAHG NRPASDAFFK

51 LPRQRFHVFR RHQVVFGIAA HLHGCRAQFR QPRRIRLRLR QTARQRSGCG
```

-continued

```
101 TDQAADFQIT VQRFFRQPRI RQKQRHTRSP AFLHQIGPDF GFHQNAEHRA

151 VFAQKLPYPR FFVIRKIAAL RIGKQNLRGF PSRRGHLRHQ QRRIGKTPPQ

201 LAYQGLGGTR FSDRNGVYPN RAGNGIRMRL AETLVPMRPV CRGTSGAFVQ

251 ITPYPYRRKQ PQYIIKPLEH LSISCKTNAV RTVRTAFRQR NQIS*
```

The following partial DNA sequence was identified in *N. meningitidis* <SEQ ID 1231>:

```
m295.seq.
  1 ATGCTCGGGA TGGCGCGGCA CGACGACCAG CAGCGCATCG CCGCGATATT

51 GTTGCCACGC CGCCAGCAGT TTTTCCGCCT CGTCTTCACC CCGATAAACG

101 CGCGTGCTGC CGCACACGGC AACCGGCCGG CCTCCGATGC GTTTTTCAAA

151 CTGCCCCGCC AGCGTTTTCA TCTGTTCCGA CGGTATGATG TCGTATTTGG

201 TATTGCCGCA CACCTGCACG GATGCCGCGC CCAATTTCGC CAACCGCGCC

251 GCATCCGCCT CTGTCTGCGC CAGACACCCC GTCAGCGAAG CGGCGGCAGG

301 ACGGATCAGG CGGCGGACTT TCAGATAACC GTTCAACGAT TTTTCCGACA

351 GCCGCGCATT CGCCAAAAAC AGCGGCACAC CCGCGCGCCG GCATTCCCTC

401 ATCAGGTTGG GCCAGATTTC GGTTTCCATC AAAATGCCGA ACATCGGGCG

451 GTGTTCGCGC AAAAACTGCC GTACCCACGT TTTTTTGTCA TACGGAAGAT

501 AGCGGCATTG CGCATCGGGA ACAGAACTT GCGCGGTTTC CCGCCCCGTC

551 GGGGTCATCT GCGTCATCAG CAGCGGCGCA TCGGGAAAAC GCCGCCGCAA

601 CTCGCGTATC AAGGACTGGG CGGCACGCGT TTCTCCGACC GAAACGGCGT

651 GTATCCAAAC CGCGCCGGTA ACGGGATTCG GATACGGCTT GCCGAAACGC

701 TCGTCCCGAT GCGCCCGATA TGCCGGGGCA CTTCCGGAGC GTTTGTCCAA

751 ATAACGCCGT ATCCATATCG GCGCAAGCAG CCACAATACA TCATAAAGCC

801 ATTGGAACAT CTTTCTATTT CCTGCAAAAC AAATGCCGTC TGAACGGTTC

851 AGACGGCATT TCGGCAACGG AATCAAATAT CGTAG
```

This corresponds to the amino acid sequence <SEQ ID 1232; ORF 295>:

```
m295.pep
  1 MLGMARHDDQ QRIAAILLPR RQQFFRLVFT PINARAAAHG NRPASDAFFK

51 LPRQRFHLFR RYDVVFGIAA HLHGCRAQFR QPRRIRLCLR QTPRQRSGGR

101 TDQAADFQIT VQRFFRQPRI RQKQRHTRAP AFPHQVGPDF GFHQNAEHRA

151 VFAQKLPYPR FFVIRKIAAL RIGKQNLRGF PPRRGHLRHQ QRRIGKTPPQ

201 LAYQGLGGTR FSDRNGVYPN RAGNGIRIRL AETLVPMRPI CRGTSGAFVQ

251 ITPYPYRRKQ PQYIIKPLEH LSISCKTNAV XTVQTAFRQR NQIS*
```

```
m295/g295    93.9% identity in 294 aa overlap 10         20         30         40         50         60
    m295.pep  MLGMARHDDQQRIAAILLPRRQQFFRLVFTPINARAAAHGNRPASDAFFKLPRQRFHLFR
              ||||||||| || |||||||||||||||||||:||||||||||||||||||||||||:||
        g295  MLGMARHDGQQGIAAILLPRRQQFFRLVFAPINARAAAHGNRPASDAFFKLPRQRFHVFR
                      10         20         30         40         50         60
```

-continued

```
                        70        80        90       100       110       120
m295.pep        RYDVVFGIAAHLHGCRAQFRQPRRIRLCLRQTPRQRSGGRTDQAADFQITVQRFFRQPRI
                |::|||||||||||||||||||||||| |||| |||||  ||||||||||||||||||||
g295            RHQVVFGIAAHLHGCRAQFRQPRRIRLRLRQTARQRSGCGTDQAADFQITVQRFFRQPRI
                        70        80        90       100       110       120

130       140       150       160       170       180
m295.pep        RQKQRHTRAPAFPHQVGPDFGFHQNAEHRAVFAQKLPYPRFFVIRKIAALRIGKQNLRGF
                ||||||||:||| ||:||||||||||||||||||||||||||||||||||||||||||||
g295            RQKQRHTRSPAFLHQIGPDFGFHQNAEHRAVFAQKLPYPRFFVIRKIAALRIGKQNLRGF
                       130       140       150       160       170       180

190       200       210       220       230       240
m295.pep        PPRRGHLRHQQRRIGKTPPQLAYQGLGGTRFSDRNGVYPNRAGNGIRIRLAETLVPMRPI
                | |||||||||||||||||||||||||||||||||||||||||||||:|||||||||||:
g295            PSRRGHLRHQQRRIGKTPPQLAYQGLGGTRFSDRNGVYPNRAGNGIRMRLAETLVPMRPV
                       190       200       210       220       230       240

250       260       270       280       290
m295.pep        CRGTSGAFVQITPYPYRRKQPQYIIKPLEHLSISCKTNAVXTVQTAFRQRNQISX
                |||||||||||||||||||||||||||||||||||||||| ||:||||||||||
g295            CRGTSGAFVQITPYPYRRKQPQYIIKPLEHLSISCKTNAVRTVRTAFRQRNQIS
                       250       260       270       280       290
```

The following partial DNA sequence was identified in *N. meningitidis* <SEQ ID 1233>:

```
a295.seq.
   1 ATGCTCGGGA TGGCGCGGCA CGACGACCAG CAGGGCATCG CCGCGATATT

51 GTTGCCACGC CGCCAGCAGT TTTTCCGCCT CGTCTTCACC CCGATAAACG

101 CGCGTGCTGC CGCACACGGC AACCTGCCGG TCTCCGATGC GTTTTTCAAA

151 CTGCCCCGCC AGCGTTTTCA TCTGTTCCGA CGGCATCAGG TCGTATTTGG

201 TATTGCCGCA CACCTGCACG GATGCCGCGC CCAATTTCGC CAACCGCGCC

251 GCATCCGCCT CCGTCTGTGC CAGACAGCCC GTCAGCGAAG CGGCGGCAGG

301 ACGGATCAGG CTGCGGACTT TCAGATAACC GTTTAGCGAT TTTTCCGACA

351 GCCGCGCATT CGCCAAAAAC AGCGGCACAC CCGTGCGCCG GCATTCCTTC

401 ATCAGATTGG GCCAGATTTC GGTTTCCATC AAAATGCCGA ACATCGGGCG

451 GTGTTCGCGC AAAAACTGCC GTACCCACGT TTTTTTGTCA TACGGAAGAT

501 AGCGGCATTG TGCATCAGGA AACAGAACTT GCGCGGTTTC CCGTCCCGTC

551 GGGGTCATCT GCGTCATCAG CAGCGGCGCA TCGGGAAAAC GCTGCCGCAA

601 CTCGCGTATC AAAGGTTGGG CGGCACGCGT TTCCCCGACC GAAACGGCGT

651 GTATCCAAAC CGCGCCGGTA ACGGGATTCG GATACGGCTT GCCGAAACGC

701 TCGCCCCGAT GCGCCCGATA TGCAGGGGCA CTTCCGGAGC GTTTGTCCAA

751 ATAACGCCGT ATCCATATCG GCGCAAGCAG CCACAATACA TCATAAAGCC

801 ATTGGAACAT CTTTCTATTT CCTGCAAAAC AAATGCCGTC CGAACGGTTC

851 GGACGGCATT TCGGCAACGG AATCAAATAT CGTAG
```

This corresponds to the amino acid sequence <SEQ ID 1234; ORF 295.a>:

```
a295.pep
   1 MLGMARHDDQ QGIAAILLPR RQQFFRLVFT PINARAAAHG NLPVSDAFFK

51 LPRQRFHLFR RHQVVFGIAA HLHGCRAQFR QPRRIRLRLC QTARQRSGGR

101 TDQAADFQIT V*RFFRQPRI RQKQRHTRAP AFLHQIGPDF GFHQNAEHRA

151 VFAQKLPYPR FFVIRKIAAL CIRKQNLRGF PSRRGHLRHQ QRRIGKTLPQ
```

-continued

```
201 LAYQRLGGTR FPDRNGVYPN RAGNGIRIRL AETLAPMRPI CRGTSGAFVQ

251 ITPYPYRRKQ PQYIIKPLEH LSISCKTNAV RTVRTAFRQR NQIS*
``` m295/a295 93.2% identity in 294 aa overlap

```
                  10         20         30         40         50         60
m295.pep  MLGMARHDDQQRIAAILLPRRQQFFRLVFTPINARAAAHGNRPASDAFFKLPRQRFHLFR
          ||||||||||| |||||||||||||||||||||||||||| |:|||||||||||||||||
a295      MLGMARHDDQQGIAAILLPRRQQFFRLVFTPINARAAAHGNLPVSDAFFKLPRQRFHLFR
                  10         20         30         40         50         60

70         80         90        100        110        120
m295.pep  RYDVVFGIAAHLHGCRAQFRQPRRIRLCLRQTPRQRSGGRTDQAADFQITVQRFFRQPRI
          |::||||||||||||||||||||||| | ||||||| ||| |||||||||||||||||||
a295      RHQVVFGIAAHLHGCRAQFRQPRRIRLRLRQTARQRSGCGTDQAADFQITVQRFFRQPRI
                  70         80         90        100        110        120

130        140        150        160        170        180
m295.pep  RQKQRHTRAPAFPHQVGPDFGFHQNAEHRAVFAQKLPYPRFFVIRKIAALRIGKQNLRGF
          |||||||| ||:||||:|||||||||||||||||||||||||||||||||||| ||||||
a295      RQKQRHTRSPAFLHQIGPDFGFHQNAEHRAVFAQKLPYPRFFVIRKIAALRIGKQNLRGF
                 130        140        150        160        170        180

190        200        210        220        230        240
m295.pep  PPRRGHLRHQQRRIGKTPPQLAYQGLGGTRFSDRNGVYPNRAGNGIRIRLAETLVPMRPI
          | |||||||||||||||||||||||||||||||||||||||||||||| :|||||:||||
a295      PSRRGHLRHQQRRIGKTPPQLAYQGLGGTRFSDRNGVYPNRAGNGIRMRLAETLVPMRPI
                 190        200        210        220        230        240

250        260        270        280        290
m295.pep  CRGTSGAFVQITPYPYRRKQPQYIIKPLEHLSISCKTNAVXTVQTAFRQRNQISX
          |||||||||||||||||||||||||||||||||||||||| |:|||||||||||
a295      CRGTSGAFVQITPYPYRRKQPQYIIKPLEHLSISCKTNAVXTVQTAFRQRNQISX
                 250        260        270        280        290
```

The following partial DNA sequence was identified in *N. gonorrhoeae* <SEQ ID 1235>:

```
g297.seq.
    1 ATGGCTGTCT TCCCACTTTC GGCAAAACAT CGGAAATACG CGCTGCGCGC

51 GCTTGCCGTT TCGATTATTC TGGTGtcgGC GGCATACATT GCttcgacag 101 aggggaccga gcgcgtcaga ccgcAGCGCG TggaacaaAA ACTGCCGCCG 151 CTGTCtTGGg gcggcaacgg CGTtcagacg gcaTATTGGG TGCAGGAGGC 201 GGTGCagccg ggggactcgC TGGCGGACGT GCTGGCGCGT TCGGGTATGG 251 CGCGGGacga gattgCCcga ATcacGGAAA aataTggcgG CGAAGCCGAT 301 TTGCGgcatt tGCGTGCCGA CCAGTCGGTT CATGTTTTGG TCGGCGGCGA 351 CGGCAGTGCG CGCGAAGTGC AGTTTTttaC CGACGAAGAC GGCGAGCGCA 401 aTctGGTCGC TTTGGAAAAA AAAGGCGGCA TATGGCGGCG GTCGGCTTCT

451 GATGCGGATA TGAAGGTTTT GCCGACACTG CGTTCGGTCG TGGTCAAAAC

501 GTCGGCGCGC GGTTCGCTGG CGCGGGCGGA AGTGCCCGTC GAAATCCGCG

551 AATCCTTAAG CGGGATTTTT GCCGGCCGCT TCAGCCTTGA CGGTTTGAAG

601 GAAGGCGATG CCGTGCGCCT GCTTTACGAC AGCCTGTATT CCACGGGCA

651 GCAGGTGGCG GCGGGCGATA TTTTGGCGGC GGAAGTTGTC AAGGGCGGCA

701 CAACCCATCA GGCGTTCTAT TACCGTTCGG ACAAGGAAGG CGGAGGGGGC

751 GGCAATTATT ACGATGAAGA CGGCAGGGTG TTGCAGGAAA AAGGCGGCTT

801 CAACATCgaG CCGCTGGTCT ATACGCGCAT TTCTTCGCCG TTCGGCTACC
```

-continued
```
 851 GTATGCACCC CATCCTGCAC ACATGGCGGC TGCACACGGG CATCGATTAT

901 GCCGCACCGC AGGGAACGCC GGTCAGGGCT TCCGCCGACG GCGTGATTAC

951 CTTTAAAGGC CGGAAGGGCG GATACGGCAA CGCGGTGATG ATACGCCACG

1001 CCAACGGTGT GGAAACGCTG TACGCGCACT TGAGCGCGTT TTCGCAGGCA

1051 CAAGGCAATG TGCGCGGCGG CGAGGTCATC GGTTTTGTCG GTTCGACAGG

1101 GCGTTCGACC GGGCCGCACC TGCATTACGA GGCGCGCATC AACGGGCAGC

1151 CCGTCAATCC TGTTTCGGTC GCATTGCCGA CACCCGAATT GACGCAGGCG

1201 GACAAGGCGG CGTTTGCCGC GCAGAAACAG AAGGCGGACG CGCTGCTTGC

1251 GCGCTTGCGC GGCATACCGG TTACCGTGTC GCAATCGGAT TGA
```

This corresponds to the amino acid sequence <SEQ ID 1236; ORF 297.ng>:

g297.pep
```
  1 MAVFPLSAKH RKYALRALAV SIILVSAAYI ASTEGTERVR PQRVEQKLPP

51 LSWGGNGVQT AYWVQEAVQP GDSLADVLAR SGMARDEIAR ITEKYGGEAD

101 LRHLRADQSV HVLVGGDGSA REVQFFTDED GERNLVALEK KGGIWRRSAS

151 DADMKVLPTL RSVVVKTSAR GSLARAEVPV EIRESLSGIF AGRFSLDGLK

201 EGDAVRLLYD SLYFHGQQVA AGDILAAEVV KGGTTHQAFY YRSDKEGGGG

251 GNYYDEDGRV LQEKGGFNIE PLVYTRISSP FGYRMHPILH TWRLHTGIDY

301 AAPQGTPVRA SADGVITFKG RKGGYGNAVM IRHANGVETL YAHLSAFSQA

351 QGNVRGGEVI GFVGSTGRST GPHLHYEARI NGQPVNPVSV ALPTPELTQA

401 DKAAFAAQKQ KADALLARLR GIPVTVSQSD *
```

The following partial DNA sequence was identified in *N. meningitidis* <SEQ ID 1237>:

m297.seq.
```
  1 ATGGCTGTCT TCCCACTTTC GGCAAAACAT CGGAAATACG CGCTGCGTGC

51 GCTTGCCGTT TCGATTATTT TGGTGTCGGC GGCATACATT GCTTCGACAG

101 AGAGGACGGA GCGCGTCAGA CCGCAGCGCG TGGAACAAAA TCTGCCGCCG

151 CTGTCTTGGG GCGGCAGCGG CGTTCAGACG GCATATTGGG TGCAGGAGGC

201 GGTGCAGCCG GGCGACTCGC TGGCGGACGT GCTGGCGCGT TCGGGTATGG

251 CGCGGGACGA GATTGCCCGA ATCACGGAAA AATATGGCGG CGAAGCCGAT

301 TTGCGGCATT TGCGTGCCGA CCAGTCGGTT CATGTTTTGG TCGGCGGCGA

351 CGGCGGCGCG CGCGAAGTGC AGTTTTTTAC CGACGAAGAC GGCGAGCGCA

401 ATCTGGTCGC TTTGGAAAAG AAAGGCGGCA TATGGCGGCG GTCGGCTTCT

451 GAGGCGGATA TGAAGGTTTT GCCGACGCTG CGTTCGGTCG TGGTCAAAAC

501 GTCGGCGCGC GGTTCGCTGG CGCGGGCGGA AGTGCCCGTC GAAATCCGCG

551 AATCCTTAAG CGGGATTTTC GCCGGCCGCT TCAGCCTTGA CGGTTTGAAG

601 GAAGGCGATG CCGTGCGCCT GATGTACGAC AGCCTGTATT TCCACGGGCA

651 GCAGGTGGCG GCGGGCGATA TTTTGGCGGC TGAAGTCGTT AAGGGCGGCA

701 CAAGGCATCA GGCGTTCTAT TACCGTTCGG ACAAGGAAGG CGGAGGGGGC

751 GGCAATTATT ATGATGAAGA CGGCAAGGTG TTGCAGGAAA AAGGCGGCTT
```

```
 801 CAACATCGAG CCGCTGGTCT ATACGCGCAT TTCTTCGCCG TTCGGCTACC

851 GTATGCACCC CATCCTGCAC ACATGGCGGC TGCACACGGG CATCGATTAT

901 GCCGCACCGC AGGGAACGCC GGTCAGGGCT TCCGCCGACG GCGTGATTAC

951 CTTTAAAGGC CGGAAGGGCG GATACGGCAA CGCGGTGATG ATACGCCACG

1001 CCAACGGTGT GGAAACGCTG TACGCGCACT TGAGCGCGTT TTCGCAGGCG

1051 GAAGGCAATG TGCGCGGCGG CGAGGTCATC GGTTTTGTCG GTTCGACCGG

1101 GCGTTCGACC GGGCCGCACC TGCATTACGA GGCGCGCATC AACGGGCAGC

1151 CCGTCAATCC TGTTTCGGTC GCATTGCCGA CACCGGAATT GACGCAGGCG

1201 GACAAGGCGG CGTTTGCCGC GCAGAAACAG AAGGCGGACG CGCTGCTTGC

1251 GCGCTTGCGC GGCATACCGG TTACCGTGTC GCAATCGGAT TGA
```

This corresponds to the amino acid sequence <SEQ ID 1238; ORF 297>:

```
m297.pep

1 MAVFPLSAKH RKYALRALAV SIILVSAAYI ASTERTERVR PQRVEQNLPP

51 LSWGGSGVQT AYWVQEAVQP GDSLADVLAR SGMARDEIAR ITEKYGGEAD

101 LRHLRADQSV HVLVGGDGGA REVQFFTDED GERNLVALEK KGGIWRRSAS

151 EADMKVLPTL RSVVVKTSAR GSLARAEVPV EIRESLSGIF AGRFSLDGLK

201 EGDAVRLMYD SLYFHGQQVA AGDILAAEVV KGGTRHQAFY YRSDKEGGGG

251 GNYYDEDGKV LQEKGGFNIE PLVYTRISSP FGYRMHPILH TWRLHTGIDY

301 AARQGTPVRA SADGVITFKG RKGGYGNAVM IRHANGVETL YAHLSAFSQA

351 EGNVRGGEVI GFVGSTGRST GPHLHYEARI NGQPVNPVSV ALPTPELTQA

401 DKAAFAAQKQ KADALLARLR GIPVTVSQSD * m297/g297  97.9% identity in 430 aa overlap 10         20         30         40         50         60
m297.pep  MAVFPLSAKHRKYALRALAVSIILVSAAYIASTERTERVRPQRVEQNLPPLSWGGSGVQT
          ||||||||||||||||||||||||||||||||| |||||||||:||||||||:||||
g297      MAVFPLSAKHRKYALRALAVSIILVSAAYIASTEGTERVRPQRVEQKLPPLSWGGNGVQT
                  10         20         30         40         50         60

70         80         90        100        110        120
m297.pep  AYWVQEAVQPGDSLADVLARSGMARDEIARITEKYGGEADLRHLRADQSVHVLVGGDGGA
          ||||||||||||||||||||||||||||||||||||||||||||||||||||||||||:|
g297      AYWVQEAVQPGDSLADVLARSGMARDEIARITEKYGGEADLRHLRADQSVHVLVGGDSA
                  70         80         90        100        110        120

130        140        150        160        170        180
m297.pep  REVQFFTDEDGERNLVALEKKGGIWRRSASEADMKVLPTLRSVVVKTSARGSLARAEVPV
          |||||||||||||||||||||||||||||:||||||||||||||||||||||||||||||
g297      REVQFFTDEDGERNLVALEKKGGIWRRSASDADMKVLPTLRSVVVKTSARGSLARAEVPV
                 130        140        150        160        170        180

190        200        210        220        230        240
m297.pep  EIRESLSGIFAGRFSLDGLKEGDAVRLMYDSLYFHGQQVAAGDILAAEVVKGGTRHQAFY
          ||||||||||||||||||||||||||||:|||||||||||||||||||||||:||||||
g297      EIRESLSGIFAGRFSLDGLKEGDAVRLLYDSLYFHGQQVAAGDILAAEVVKGGTTHQAFY
                 190        200        210        220        230        240

250        260        270        280        290        300
m297.pep  YRSDKEGGGGNYYDEDGKVLQEKGGFNIEPLVYTRISSPFGYRMHPILHTWRLHTGIDY
          |||||||||||||||:||||||||||||||||||||||||||||||||||||||||||||
g297      YRSDKEGGGGNYYDEDGRVLQEKGGFNIEPLVYTRISSPFGYRMHPILHTWRLHTGIDY
                 250        260        270        280        290        300

310        320        330        340        350        360
m297.pep  AAPQGTPVRASADGVITFKGRKGGYGNAVMIRHANGVETLYAHLSAFSQAEGNVRGGEVI
          ||||||||||||||||||||||||||||||||||||||||||||||||||:|||||||
g297      AAPQGTPVRASADGVITFKGRKGGYGNAVMIRHANGVETLYAHLSAFSQAQGNVRGGEVI
                 310        320        330        340        350        360

370        380        390        400        410        420
m297.pep  GFVGSTGRSTGPHLHYEARINGQPVNPVSVALPTPELTQADKAAFAAQKQKADALLARLR
          ||||||||||||||||||||||||||||||||||||||||||||||||||||||||||||
g297      GFVGSTGRSTGPHLHYEARINGQPVNPVSVALPTPELTQADKAAFAAQKQKADALLARLR
                 370        380        390        400        410        420
```

```
                  430
m297.pep  GIPVTVSQSDX
          ||||||||||
g297      GIPVTVSQSDX
                  430
```

The following partial DNA sequence was identified in *N. meningitidis* <SEQ ID 1239>:

```
a297.seq.
    1 ATGGCTGTCT TCCCACTTTC GGCAAAACAT CGGAAATACG CGCTGCGCGC

51 GCTTGCCGTT TCGATTATTT TGGTGTCGGC GGCATACATT GCTTCGACAG

101 AGAGGACGGA GCGCGTCAGA CCGCAGCGCG TGGAACAAAA ACTGCCGCCG

151 CTGTCTTGGG GCGGCAGCGG TGTTCAGACG GCATATTGGG TGCAGGAGGC

201 GGTGCAGCCA GGCGACTCGC TGGCGGACGT GCTGGCGCGT TCGGGTATGG

251 CGCGGGACGA AATTGCCCGA ATAACGGAAA AATATGGCGG CGAAGCCGAT

301 TTGCGGCATT TGCGTGCCGA CCAGTCGGTT CATGTTTTGG TCGGCGGCGA

351 CGGCGGCGCG CGCGAAGTGC AGTTTTTTAC CGACGAAGAC GGCGAGCGCA

401 ATCTGGTCGC TTTGGAAAAA AAAGGCGGCA TATGGCGGCG GTCGGCTTCT

451 GAGGCGGATA TGAAGGTTTT GCCGACGCTG CGTTCGGTCG TGGTCAAAAC

501 GTCGGCGCGC GGTTCGCTGG CGCGGGCGGA AGTGCCCGTC GAAATTCGCG

551 AATCCTTAAG CGGGATTTTC GCCGGCCGCT TCAGCCTTGA TGGTTTGAAG

601 GAAGGCGATG CCGTGCGCCT GATTTACGAC AGCCTGTATT TCCACGGGCA

651 GCAGGTGGCG GCGGGCGATA TTCTGGCGGC GGAAGTCGTT AAGGGCGGCA

701 CAAGGCATCA GGCGTTCTAT TACCGTTCGG ACAAGGAAGG AGGAGGGGGC

751 GGCAATTATT ACGATGAAGA CGGCAGGGTG TTGCAGGAAA AAGGCGGCTT

801 CAACATCGAG CCACTGGTCT ATCGCGCAT TTCTTCGCCG TTCGGCTACC

851 GTATGCACCC CATCCTGCAC ACTTGGCGGC TGCACACGGG CATCGATTAT

901 GCCGCACCGC AGGGAACGCC GGTCAGGGCT TCCGCCGACG GCGTGATTAC

951 CTTTAAAGGC CGGAAGGGTG GCTACGGCAA CGCGGTGATG ATACGCCACG

1001 CCAACGGTGT GGAAACGCTG TATGCGCACT TGAGCGCGTT TTCTCAGGCA

1051 GAAGGCAATG TGCGCGGCGG CGAGGTCATC GGTTTTGTCG GTTCGACCGG

1101 GCGTTCGACG GGGCCGCACC TGCATTACGA GGCGCGCATC AATGGGCAGC

1151 CCGTCAATCC TGTTTCGGTC GCATTGCCGA CACCCGAATT GACGCAGGCG

1201 GACAAGGCGG CGTTTGCCGC GCAGAAACAG AAGGCGGACG CGCTGCTTGC

1251 GCGCTTGCGC GGCATACCGG TTACCGTGTC GCAATCGGAT TGA
```

This corresponds to the amino acid sequence <SEQ ID 1240; ORF 297.a>:

```
a297.pep
    1 MAVFPLSAKH RKYALRALAV SIILVSAAYI ASTERTERVR PQRVEQKLPP

51 LSWGGSGVQT AYWVQEAVQP GDSLADVLAR SGMARDEIAR ITEKYGGEAD

101 LRHLRADQSV HVLVGGDGGA REVQFFTDED GERNLVALEK KGGIWRRSAS

151 EADMKVLPTL RSVVVKTSAR GSLARAEVPV EIRESLSGIF AGRFSLDGLK

201 EGDAVRLIYD SLYFHGQQVA AGDILAAEVV KGGTRHQAFY YRSDKEGGGG
```

-continued

```
251 GNYYDEDGRV LQEKGGFNIE PLVYTRISSP FGYRMHPILH TWRLHTGIDY

301 AAPQGTPVRA SADGVITFKG RKGGYGNAVM IRHANGVETL YAHLSAFSQA

351 EGNVRGGEVI GFVGSTGRST GPHLHYEARI NGQPVNPVSV ALPTPELTQA

401 DKAAFAAQKQ KADALLARLR GIPVTVSQSD *
``` m297/a297 99.3% identity in 430 aa overlap

```
                  10         20         30         40         50         60
m297.pep  MAVFPLSAKHRKYALRALAVSIILVSAAYIASTERTERVRPQRVEQNLPPLSWGGSGVQT
          ||||||||||||||||||||||||||||||||||||||||||:||||||||||||||||
a297      MAVFPLSAKHRKYALRALAVSIILVSAAYIASTERTERVRPQRVEQKLPPLSWGGSGVQT
                  10         20         30         40         50         60
                  70         80         90        100        110        120
m297.pep  AYWVQEAVQPGDSLADVLARSGMARDEIARITEKYGGEADLRHLRADQSVHVLVGGDGGA
          ||||||||||||||||||||||||||||||||||||||||||||||||||||||||||||
a297      AYWVQEAVQPGDSLADVLARSGMARDEIARITEKYGGEADLRHLRADQSVHVLVGGDGGA
                  70         80         90        100        110        120
                 130        140        150        160        170        180
m297.pep  REVQFFTDEDGERNLVALEKKGGIWRRSASEADMKVLPTLRSVVVKTSARGSLARAEVPV
          ||||||||||||||||||||||||||||||||||||||||||||||||||||||||||||
a297      REVQFFTDEDGERNLVALEKKGGIWRRSASEADMKVLPTLRSVVVKTSARGSLARAEVPV
                 130        140        150        160        170        180
                 190        200        210        220        230        240
m297.pep  EIRESLSGIFAGRFSLDGLKEGDAVRLMYDSLYFHGQQVAAGDILAAEVVKGGTRHQAFY
          |||||||||||||||||||||||||||||:||||||||||||||||||||||||||||||
a297      EIRESLSGIFAGRFSLDGLKEGDAVRLLYDSLYFHGQQVAAGDILAAEVVKGGTRHQAFY
                 190        200        210        220        230        240
                 250        260        270        280        290        300
m297.pep  YRSDKEGGGGGNYYDEDGKVLQEKGGFNIEPLVYTRISSPFGYRMHPILHTWRLHTGIDY
          |||||||||||||||||:||||||||||||||||||||||||||||||||||||||||||
a297      YRSDKEGGGGGNYYDEDGRVLQEKGGFNIEPLVYTRISSPFGYRMHPILHTWRLHTGIDY
                 250        260        270        280        290        300
                 310        320        330        340        350        360
m297.pep  AAPQGTPVRASADGVITFKGRKGGYGNAVMIRHANGVETLYAHLSAFSQAEGNVRGGEVI
          ||||||||||||||||||||||||||||||||||||||||||||||||||||||||||||
a297      AAPQGTPVRASADGVITFKGRKGGYGNAVMIRHANGVETLYAHLSAFSQAEGNVRGGEVI
                 310        320        330        340        350        360
                 370        380        390        400        410        420
m297.pep  GFVGSTGRSTGPHLHYEARINGQPVNPVSVALPTPELTQADKAAFAAQKQKADALLARLR
          ||||||||||||||||||||||||||||||||||||||||||||||||||||||||||||
a297      GFVGSTGRSTGPHLHYEARINGQPVNPVSVALPTPELTQADKAAFAAQKQKADALLARLR
                 370        380        390        400        410        420
                 430
m297.pep  GIPVTVSQSDX
          |||||||||||
a297      GIPVTVSQSDX
                 430
```

The following partial DNA sequence was identified in *N. gonorrhoeae* <SEQ ID 1241>:

```
g298.seq.
  1 ATGAAAAACT TCTTTCCCT TTTCGCCTCC ATACTGATGT CTGCCCTGAT

51 TGCCGTGTGG TTCAGCCAAA ACCCCATCAA CGCCTACTGG CAGCAGACCT

101 ACCACCGCAA CAGCCCGCTC GAACCGCTTG CCGCCTACGG ATGGTGGCGG

151 AGCGGAGCGG CGTTGCAAGA AAACGCCTAC GCCCTTTCAG ACGGCATCAA

201 AACCTTCCTG TCCGGCGAAA cgcccccac ggCTCAAGAC GGCGGTTCGG

251 CAGATATGCC GCCTGAAGCC GCCGCATCCG AAGCCGCCCC GCCGGCCGGC

301 GGAACAGAAT GGAAACAAGG CACCGAAGCC GCCGCCGTCC GCAGCGGCGA

351 CAAAGTCTTT TTCGCCGGAG ATTCGCTGAT GCAGGGCGTT GCGCCTTTCG

401 TGCAAAAAAG CCTGAAACAG CAATACGGCA TCGAATCCGC CAACCTCAGC

451 AAACAAAGCA CGGGGCTTTC CTATCCCTCA TTCTTCGACT GGCCGAAAAC
```

-continued

```
501 GATTGAAGAA ACCTTGAAAA AACATCCCGA AATCAGCGTA CTCGCCGTCT

551 TCCTCGGCCC GAACGACCCG TGGGATTTCC CCGTCGGCAA ACGCTACCTC

601 AAATTCGCTT CCGACGAATG GGCGCAAGAA TACCTGAAAC GCGTCGACCG

651 CATCCTTGAA GCCGCACACA CGCACCGCGT CCAAGTCGTC TGGCTCGGCA

701 TCCCCTACAT GAAAAAAGTC AAGCTCGACG GTCAGATGCG CTACCTCGAC

751 AAACTGCTTT CGGAACACTT GAAAGGCAAA ATCATCCTGA TTCCCACCGC

801 GCAAACACTG AGCGGCGGGA AAGgccGCTA CACCGATTCC GTCAACGTCA

851 ACGGCAAACC CGTCCGCTAC CGCAGTAAGG ACGGCATACA CTTTACCGCC

901 GAAGGACAAA AACTGCTGGC GGAAAAAATA ATGGAAAAAA TCGTTTTTGA

951 ACCGAGTACG CAACCATCAA GTACACAGCC ATGA
```

This corresponds to the amino acid sequence <SEQ ID 1242; ORF 298.ng>:

```
g298.pep
  1 MKNFLSLFAS ILMSALIAVW FSQNPINAYW QQTYHRNSPL EPLAAYGWWR

51 SGAALQENAY ALSDGIKTFL SGETPPTAQD GGSADMPPEA AASEAAPPAG

101 GTEWKQGTEA AAVRSGDKVF FAGDSLMQGV APFVQKSLKQ QYGIESANLS

151 KQSTGLSYPS FFDWPKTIEE TLKKHPEISV LAVFLGPNDP WDFPVGKRYL

201 KFASDEWAQE YLKRVDRILE AAHTHRVQVV WLGIPYMKKV KLDGQMRYLD

251 KLLSEHLKGK IILIPTAQTL SGGKGRYTDS VNVNGKPVRY RSKDGIHFTA

301 EGQKLLAEKI MEKIVFEPST QPSSTQP*
```

The following partial DNA sequence was identified in *N. meningitidis* <SEQ ID 1243>:

```
m298.seq.
  1 ATGAAAAACT TCTTTCCCT TTTCTCCTCC ATACTGATGT CTGCCCTGAT

51 TGCCGTGTGG TTCAGCCAAA ACCCCATCAA CGCCTACTGG CAGCAGACCT

101 ACCACCGCAA CAGCCCGCTC GAACCGCTTG CCGCCTACGG ATGGTGGCGG

151 AGCGGTGCGG CGTTGCAAGA AAACGCCTAC GCCCTTTCAG ACGGCATCAA

201 AGCCTTCCTG TCCGGCGAAA CGCCGCCGAC GGCTCAAGAC GGCGGTTCGG

251 CAGATATGCC GTCTGAAGCC GCCGCATCCG AAGCCGTCCC TCAAACCGGT

301 GAAACAGAAT GGAAACAAGA CACCGAAGCC GCCGCCGTCC GCAGCGGCGA

351 CAAAGTCTTT TTTGTCGGCG ACTCGCTGAT GCAGGGCGTT GCCCCCTTCG

401 TGCAAAAAAG CCTGAAACAG CAATACGGCA TCGAATCCGT CAACCTCAGC

451 AAACAAAGCA CGGGGCTGTC CTACCCCTCA TTCTTCGACT GGCCGAAAAC

501 GATTGAAGAA ACCCTGCAAA AACATCCCGA AATCAGCGTA CTCGCCGTCT

551 TCCTCGGACC GAACGACCCG TGGGATTTCC CCGTCGGCAA ACTCTATCTC

601 AAATTCGCTT CCGACGAATG GGCGCAAGAA TACCTGAAAC GTGTCGACCG

651 CATCCTTGAA GCCGCACACA CGCACCGCGT CCAAGTCGTC TGGCTCGGCA

701 TCCCCTACAT GAAAAAAGCC AAGCTCGACG GACAGATGCG CTACCTAGAC

751 AAACTGCTTT CGGAACATTT GAAAGGCAAA ATCATCCTGA TTCCCACCAC

801 GCACACCCTG AGCGGCGGGA AAGACCGCTA CACCGACTCC GTCAACGTCA
```

```
851 ACGGCAAACC CGTCCGCTAC CGCAGCAAGG ACGGCATACA CTTTACCGCC

901 GAAGGACAAA AACTGCTGGC GGCAAAAATA ATGGAAAAAA TCGTTTTTGA

951 ACCAAGTACG CAACCATCAA GTACACAGCC ATGA
```

This corresponds to the amino acid sequence <SEQ ID 1244; ORF 298>:

```
m298.pep

1   MKNFLSLFSS ILMSALIAVW FSQNPINAYW QQTYHRNSPL EPLAAYGWWR

51   SGAALQENAY ALSDGIKAFL SGETPPTAQD GGSADMPSEA AASEAVPQTG

101   ETEWKQDTEA AAVRSGDKVF FVGDSLMQGV APFVQKSLKQ QYGIESVNLS

151   KQSTGLSYPS FFDWPKTIEE TLQKHPEISV LAVFLGPNDP WDFPVGKLYL

201   KFASDEWAQE YLKRVDRILE AAHTHRVQVV WLGIPYMKKA KLDGQMRYLD

251   KLLSEHLKGK IILIPTTHTL SGGKDRYTDS VNVNGKPVRY RSKDGIHFTA

301   EGQKLLAAKI MEKIVFEPST QPSSTQP*
```

```
                  10         20         30         40         50         60
m298.pep  MKNFLSLFSSILMSALIAVWFSQNPINAYWQQTYHRNSPLEPLAAYGWWRSGAALQENAY
          ||||||||:|||||||||||||||||||||||||||||||||||||||||||||||||||
g298      MKNFLSLFASILMSALIAVWFSQNPINAYWQQTYHRNSPLEPLAAYGWWRSGAALQENAY
                  10         20         30         40         50         60

70         80         90        100        110        120
m298.pep  ALSDGIKAFLSGETPPTAQDGGSADMPSEAAASEAVPQTGETEWKQDTEAAAVRSGDKVF
          ||||||:|||||||||||||||||||||| ||||||:| :|||||| |||||||||||||
g298      ALSDGIKTFLSGETPPTAQDGGSADMPPEAAASEAAPPAGGTEWKQGTEAAAVRSGDKVF
                  70         80         90        100        110        120

130        140        150        160        170        180
m298.pep  FVGDSLMQGVAPFVQKSLKQQYGIESVNLSKQSTGLSYPSFFDWPKTIEETLQKHPEISV
          |:||||||||||||||||||||||||||:|||||||||||||||||||||||:||||||
g298      FAGDSLMQGVAPFVQKSLKQQYGIESANLSKQSTGLSYPSFFDWPKTIEETLKKHPEISV
                 130        140        150        160        170        180

190        200        210        220        230        240
m298.pep  LAVFLGPNDPWDFPVGKLYLKFASDEWAQEYLKRVDRILEAAHTHRVQVVWLGIPYMKKA
          |||||||||||||||||| ||||||||||||||||||||||||||||||||||||||||:
g298      LAVFLGPNDPWDFPVGKRYLKFASDEWAQEYLKRVDRILEAAHTHRVQVVWLGIPYMKKV
                 190        200        210        220        230        240

250        260        270        280        290        300
m298.pep  KLDGQMRYLDKLLSEHLKGKIILIPTTHTLSGGKDRYTDSVNVNGKPVRYRSKDGIHFTA
          |||||||||||||||||||||||||||::||||| |||||||||||||||||||||||||
g298      KLDGQMRYLDKLLSEHLKGKIILIPTAQTLSGGKGRYTDSVNVNGKPVRYRSKDGIHFTA
                 250        260        270        280        290        300

310        320
m298.pep  EGQKLLAAKIMEKIVFEPSTQPSSTQPX
          ||||||| |||||||||||||||||||
g298      EGQKLLAEKIMEKIVFEPSTQPSSTQPX
                 310        320
```

The following partial DNA sequence was identified in *N. meningitidis* <SEQ ID 1245>:

```
a298.seq.
   1  ATGAAAAACT TCTTTCCCT TTTCGCCTCC ATACTGATGT CTGCCCTGAT

51  TGCCGTGTGG TTCAGCCAAA ACCCCATCAA CGCCTACTGG CAGCAGACCT

101  ACCACCGCAA CAGCCCGCTC GAACCGCTTG CCGCCTACGG ATGGTGGCGG

151  AGCGGTGCGG CATTGCAAGA AAACGCCTAC GCCCTTTCAG ACGGCATCAA

201  AGCCTTCCTG TCCGGCGAAA CGCCGCCGAC GGCTCAAGAC GGCGGTTCGG

251  CAGATATGCC GTCTGAAGCC GCCGCACCCG AAACCGCCCC TCAAACTGGC

301  GAAACAGAAT GGAAACAAAA CACCGAAGCC GCCGCCGTCC GAACAGGGGA

351  CAAAGTCTTT TTCGCCGGCG ACTCGCTGAT GCAGGGCGTT GCACCCTTCG
```

```
401 TGCAAAAAAG CCTGAAACAG CAATACGGCA TCGAATCCGT CAACCTCAGC

451 AAACAAAGCA CGGGGCTGTC CTACCCCTCA TTCTTCGACT GGCCGAAAAC

501 GATTGAAGAA ACCCTGAAAA ACATCCCGA AATCAGCGTG CTCGCCGTCT

551 TCCTCGGTCC GAACGACCCG TGGGATTTCC CCGTTGGCAA ACGCTACCTC

601 AAATTCGCTT CCGACGAATG GGCGCAAGAA TACCTGAAAC GCGTCGACCG

651 CATCCTTGAA GCCGCACACA CGCACTACGT CCAAGTCGTC TGGCTCGGCA

701 TCCCCTACAT GAAAAAAGCC AAGCTCGACG GACAGATGCG CTACCTAGAC

751 AAACTGCTTT CGGAATATTT GAAAGGCAAA ATCATCCTGA TTCCCACCGC

801 GCACACCCTG AGCGGCGGGA AGACCGCTA CACCGACTCC GTCAACGTCA

851 ACGGCAAACC CGTCCGCTAC CGCAGCAAGG ACGGCATACA CTTTACCGCC

901 GAAGGACAAA AACTGCTGGC GGCAAAAATA ATGGAAAAAA TCGTTTTTGA

951 ACCAAGTACG CAACCATCAA GTACACAGCC ATGA
```

This corresponds to the amino acid sequence <SEQ ID 1246; ORF 298.a>:

```
a298.pep
  1 MKNFLSLFAS ILMSALIAVW FSQNPINAYW QQTYHRNSPL EPLAAYGWWR

51 SGAALQENAY ALSDGIKAFL SGETPPTAQD GGSADMPSEA AAPETAPQTG

101 ETEWKQNTEA AAVRTGDKVF FAGDSLMQGV APFVQKSLKQ QYGIESVNLS

151 KQSTGLSYPS FFDWPKTIEE TLKKHPEISV LAVFLGPNDP WDFPVGKRYL

201 KFASDEWAQE YLKRVDRILE AAHTHYVQVV WLGIPYMKKA KLDGQMRYLD

251 KLLSEYLKGK IILIPTAHTL SGGKDRYTDS VNVNGKPVRY RSKDGIHFTA

301 EGQKLLAAKI MEKIVFEPST QPSSTQP*
``` m298/a298 96.3% identity in 327 aa overlap

```
                  10         20         30         40         50         60
m298.pep  MKNFLSLFSSILMSALIAVWFSQNPINAYWQQTYHRNSPLEPLAAYGWWRSGAALQENAY
          ||||||||:||||||||||||||||||||||||||||||||||||||||||||||||||
a298      MKNFLSLFASILMSALIAVWFSQNPINAWQQTYHRNSPKLEPLAAYGWWRSGAALQENAY
                  10         20         30         40         50         60

70         80         90        100        110        120
m298.pep  ALSDGIKAFLSGETPPTAQDGGSADMPSEAAASEAVPQTGETEWKQDTEAAAVRSGDKVF
          |||||||||||||||||||||||||||||||| ::||||||||:||||||||:|||||
a298      ALSDGIKAFLSGETPPTAQDGGSADMPSEAAAPETAPQTGETEWKQNTEAAAVRTGDKVF
                  70         80         90        100        110        120

130        140        150        160        170        180
m298.pep  FVGDSLMQGVAPFVQKSLKQQYGIESVNLSKQSTGLSYPSFFDWPKTIEETLQKHPEISV
          |:||||||||||||||||||||||||||||||||||||||||||||||||:|||||||
a298      FAGDSLMQGVAPFVQKSLKQQYGIESVNLSKQSTGLSYPSFFDWPKTIEETLKKHPEISV
                 130        140        150        160        170        180

190        200        210        220        230        240
m298.pep  LAVFLGPNDPWDFPVGKLYLKFASDEWAQEYLKRVDRILEAAHTHRVQVVWLGIPYMKKA
          |||||||||||||||||:|||||||||||||||||||||||||||| ||||||||||||
a298      LAVFLGPNDPWDFPVGKRYLKFASDEWAQEYLKRVDRILEAAHTHYVQVVWLGIPYMKKA
                 190        200        210        220        230        240

250        260        270        280        290        300
m298.pep  KLDGQMRYLDKLLSEHLKGKIILIPTTHTLSGGKDRYTDSVNVNGKPVRYRSKDGIHFTA
          |||||||||||||||:||||||||||:|||||||||||||||||||||||||||||||
a298      KLDGQMRYLDKLLSEYLKGKIILIPTAHTLSGGKDRYTDSVNVNGKPVRYRSKDGIHFTA
                 250        260        270        280        290        300
```

```
                       -continued
                  310         320
m298.pep    EGQKLLAAKIMEKIVFEPSTQPSSTQPX
            ||||||||||||||||||||||||||||
a298        EGQKLLAAKIMEKIVFEPSTQPSSTQPX
                  310         320
```

The following partial DNA sequence was identified in *N. gonorrhoeae* <SEQ ID 1247>:

```
g299.seq.
     1 ATGAACCCCA AACACTTCAT CGCATTTTCC GCCCTGTTCG CCGCCACGCA

51 GGCAGAAGCC CTGCCCGTCG CCTCCGTCAG CCCCGACACC GTTACCGTTT

101 CCCCGTCCGC CCCCTACACC GATACAAACG GCTGCTGAC CGACTACGGC

151 AACGCCGCCG CCTCGCCTTG GATGAAAAAA CTCCGATCCG TCGCACAAGG

201 CAGCGGCGAG GCCTTCCGCA TCCTGCAAAT CGGCGACTCG CATACCGCCG

251 GCGACTTCTT TACCGACGCC CTGCGCAAAC GCCTGCAAAA AACATGGGGC

301 GACGGCGGCA TAGGCTGGGT TTACCCCGCC AACGTCAAAG GCAGCGCAT

351 GGCGGCCGTC CGTCACAGCG GCAACTGGCA AAGCTTCACC AGCAGGAACA

401 ATACCGGAGA TTTCCCGCTC GGCGGCATCC TCGCCCAAAC CGGCAGCGGC

451 GGCGGCATGA CCCTGACCGC GTCTGACGGC AAAACCGGCA AACAGCGCGT

501 TTCCCTGTTT GCCAAACCGC TGCTCGCCGA ACAAACCCTG ACCGTCAACG

551 GCAACACCGT CTCCGCCAAC GGCGGCGGCT GGCAGGTACT GGATACGGGC

601 GCGGCACTGC CCCTGGCCAT ACAGACCGAA ATGCCGTGGG ACATCGGCTT

651 CATCAACATC GAAAATCCCG CCGGCGGCAT TACCGTTTCC GCGATGGGCA

701 TCAACGGCGC ACAATTGACC CAGTGGTCGA AATGGCGTGC CGACCGTATG

751 AACGACCTTG CCCAAACCGG CGCCGATTTG GTTATCCTTT CCTACGGCAC

801 CAACGAAGCC TTCAACAACA ACATCGACAT TGCCGATACC GAACAAAAAT

851 GGCTGGATAC CGTCCGCCAA ATCCGCGACA GCCTGCCCGC CGCCGGCATC

901 CTCATCATCG GCGCGCCCGA ATCCCTGAAA ACACGCTCG GCGTATGCGG

951 CACGCGCCCC GTCCTCCTGA CCGAAGTCCA ACAGATGCAG CGGCGCGTCG

1001 CCCGTCAGGG GCAGACGATG TTTTGGTCTT GGCAAAACGC AATGGGCGGC

1051 ATATGCAGCA TGAAAAACTG GCTCAACCAA GGATGGGCCG CCAAAGACGG

1101 CGTACACTTC TCCGCCCAAG GCTACCGGCG CGCGGCGGAA ATGCTTGCCG

1151 ACAGCCTCGA AGAACTCGTC CGCGCCGCCG CAATCAGGCA ATAA
```

This corresponds to the amino acid sequence <SEQ ID 1248; ORF 299.ng>:

```
g299.pep
     1 MNPKHFIAFS ALFAATQAEA LPVASVSPDT VTVSPSAPYT DTNGLLTDYG

51 NAAASPWMKK LRSVAQGSGE AFRILQIGDS HTAGDFFTDA LRKRLQKTWG

101 DGGIGWVYPA NVKGQRMAAV RHSGNWQSFT SRNNTGDFPL GGILAQTGSG

151 GGMTLTASDG KTGKQRVSLF AKPLLAEQTL TVNGNTVSAN GGGWQVLDTG

201 AALPLAIQTE MPWDIGFINI ENPAGGITVS AMGINGAQLT QWSKWRADRM

251 NDLAQTGADL VILSYGTNEA FNNNIDIADT EQKWLDTVRQ IRDSLPAAGI
```

```
301 LIIGAPESLK NTLGVCGTRP VLLTEVQQMQ RRVARQGQTM FWSWQNAMGG

351 ICSMKNWLNQ GWAAKDGVHF SAQGYRRAAE MLADSLEELV RAAAIRQ*
```

The following partial DNA sequence was identified in *N. meningitidis* <SEQ ID 1249>:

```
m299.seq
   1 ATGAACCCCA AACACCTCAT CGCATTTTCC GCCCTATTCG CCGCCACGCA

51 GGCAGAAGCC CTACCTGTCG CCTCCGTCAG CCTCGACACC GTTACCGTTT

101 CCCCGTCCGC CCCCTACACC GATACAAACG GGCTGCTGAC CGACTACGGC

151 AACGCCTCCG CCTCGCCTTG GATGAAAAAA CTCCAATCCG TCGCACAAGG

201 CAGCGGCGAG ACCTTCCGTA TCCTGCAAAT CGGCGACTCG CATACCGCCG

251 GCGACTTCTT TACCGACAGC CTGCGCAAAC GCCTGCAAAA AACTTGGGGC

301 GACGGCGGCA TAGGCTGGGT TTACCCCGCC AACGTCAAAG GGCAGCGCAT

351 GGCGGCCGTC CGGCACAACG GTAACTGGCA AAGCCTCACC AGCAGGAACA

401 ACACCGGAGA CTTCCCGCTC GGCGGCATCC TCGCCCACAC CGGCAGCGGC

451 GGCAGCATGA CCCTGACCGC ATCGGACGGC ATAGCAAGCA AGCAGCGCGT

501 TTCCCTGTTT GCCAAACCCC TGCTTGCCGA ACAAACCCTG ACCGTCAACG

551 GCAACACCGT CTCCGCCAAC GGCGGCGGCT GGCAGGTACT GGATACGGGC

601 GCGGCACTGC CCCTGACCAT ACACACCGAA ATGCCGTGGG ACATCGGCTT

651 CATCAACATC GAAATCCCG CCGGCGGCAT TACCGTTTCC GCGATGGGCA

701 TCAACGGCGC ACAATTAACC CAGTGGTCGA AATGGCGTGC CGACCGTATG

751 AACGACCTCG CCCAAACCGG CGCCGATTTG GTTATCCTTT CCTACGGCAC

801 CAACGAAGCT TTCAACAACA ACATCGACAT TGCCGACACC GAACAAAAAT

851 GGCTGGATAC CGTCCGCCAA ATCCGCGACA GCCTGCCTGC CGCCGGCATC

901 CTCATCATCG GCGCACCCGA ATCCCTGAAA AACACGCTCG GCGTATGCGG

951 CACACGCCCC GTCCGCCTGA CCGAAGTCCA ACAGATGCAG CGGCGCGTCG

1001 CCCGTCAGGG GCAGACGATG TTCTGGTCTT GGCAAAACGC CATGGGCGGC

1051 ATATGCAGCA TGAAAAACTG GCTCAACCAA GGATGGGCCG CCAAAGACGG

1101 CGTACACTTC TCCGCCAAAG GCTACCGGCG CGCGGCGGAA ATGCTCGCCG

1151 ACAGCCTCGA AGAACTCGTC CGCTCCGCTG CAATCAGGCA ATAA
```

This corresponds to the amino acid sequence <SEQ ID 1250; ORF 299>:

```
m299.pep

1 MNPKHLIAFS ALFAATQAEA LPVASVSLDT VTVSPSAPYT DTNGLLTDYG

51 NASASPWMKK LQSVAQGSGE TFRILQIGDS HTAGDFFTDS LRKRLQKTWG

101 DGGIGWVYPA NVKGQRMAAV RHNGNWQSLT SRNNTGDFPL GGILAHTGSG

151 GSMTLTASDG IASKQRVSLF AKPLLAEQTL TVNGNTVSAN GGGWQVLDTG

201 AALPLTIHTE MPWDIGFINI ENPAGGITVS AMGINGAQLT QWSKWRADRM

251 NDLAQTGADL VILSYGTNEA FNNNIDIADT EQKWLDTVRQ IRDSLPAAGI

301 LIIGAPESLK NTLGVCGTRP VRLTEVQQMQ RRVARQGQTM FWSWQNAMGG

351 ICSMKNWLNQ GWAAKDGVHF SAKGYRRAAE MLADSLEELV RSAAIRQ*
```

-continued

```
m299/g299  95.5% identity in 397 aa overlap 10         20         30         40         50         60
m299.pep  MNPKHLIAFSALFAATQAEALPVASVSLDTVTVSPSAPYTDTNGLLTDYGNASASPWMKK
          ||||:||||||||||||||||||||:||||||||||||||||||||||||:|||||||
g299      MNPKHFIAFSALFAATQAEALPVASVSPDTVTVSPSAPYTDTNGLLTDYGNAAASPWMKK
                 10         20         30         40         50         60

70         80         90        100        110        120
m299.pep  LQSVAQGSGETFRILQIGDSHTAGDFFTDSLRKRLQKTWGDGGIGWVYPANVKGQRMAAV
          |:|||||||:||||||||||||||||||:|||||||||||||||||||||||||||||
g299      LRSVAQGSGEAFRILQIGDSHTAGDFFTDALRKRLQKTWGDGGIGWVYPANVKGQRMAAV
                 70         80         90        100        110        120

130        140        150        160        170        180
m299.pep  RHNGNWQSLTSRNNTGDFPLGGILAHTGSGGSMTLTASDGIASKQRVSLFAKPLLAEQTL
          ||:||||:||||||||||||||||||:|||:|||||||||::||||||||||||||||
g299      RHSGNWQSFTSRNNTGDFPLGGILAQTGSGGGMTLTASDGKTGKQRVSLFAKPLLAEQTL
                130        140        150        160        170        180

190        200        210        220        230        240
m299.pep  TVNGNTVSANGGGWQVLDTGAALPLTIHTEMPWDIGFINIENPAGGITVSAMGINGAQLT
          |||||||||||||||||||||||||:|:||||||||||||||||||||||||||||||
g299      TVNGNTVSANGGGWQVLDTGAALPLAIQTEMPWDIGFINIENPAGGITVSAMGINGAQLT
                190        200        210        220        230        240

250        260        270        280        290        300
m299.pep  QWSKWRADRMNDLAQTGADLVILSYGTNEAFNNNIDIADTEQKWLDTVRQIRDSLPAAGI
          ||||||||||||||||||||||||||||||||||||||||||||||||||||||||||
g299      QWSKWRADRMNDLAQTGADLVILSYGTNEAFNNNIDIADTEQKWLDTVRQIRDSLPAAGI
                250        260        270        280        290        300

310        320        330        340        350        360
m299.pep  LIIGAPESLKNTLGVCGTRPVRLTEVQQMQRRVARQGQTMFWSWQNAMGGICSMKNWLNQ
          ||||||||||||||||||||||:|||||||||||||||||||||||||||||||||||
g299      LIIGAPESLKNTLGVCGTRPVLLTEVQQMQRRVARQGQTMFWSWQNAMGGICSMKNWLNQ
                310        320        330        340        350        360

370        380        390
m299.pep  GWAAKDGVHFSAKGYRRAAEMLADSLEELVRSAAIRQX
          ||||||||||||:|||||||||||||||||:||||||
g299      GWAAKDGVHFSAQGYRRAAEMLADSLEELVRAAAIRQX
                370        380        390
```

The following partial DNA sequence was identified in *N. meningitidis* <SEQ ID 1251>:

```
a299.seq
    1 ATGAACCCCA AACACCTCAT CGCATTTTCC GCCCTATTCG CCGCCACGCA

51 GGCAGAAGCC CTACCTGTCG CCTCAGTCAG CCTCGACACC GTTACCGTTT

101 CCCCGTCCGC CCCCTACACC GATACAAACG GGCTGCTGAC CGACTACGGC

151 AACGCCTCCG CCTCGCCTTG GATGAAAAAA CTCCAATCCG TCGCACAAGG

201 CAGCGGCGAG ACCTTCCGTA TCCTGCAAAT CGGCGACTCG CATACCGCCG

251 GCGACTTCTT TACCGACAGC CTGCGCAAAC GCCTACAAAA AACTTGGGGC

301 GACGGCGGCA TAGGCTGGGT TTACCCCGCC AACGTCAAAG GGCAGCGCAT

351 GGCGGCCGTC CGGCACAACG GTAACTGGCA AAGCCTCACC AGCAGGAACA

401 ACACCGGAGA CTTCCCGCTC GGCGGCATCC TCGCCCACAC CGGCAGCGGC

451 GGCAGCATGA CCCTGACCGC ATCGGACGGC ATAGCAAGCA AGCAGCGCGT

501 TTCCCTGTTT GCCAAACCCC TGCTTGCCGA ACAAACCCTG ACCGTCAACG

551 GCAACACCGT CTCCGCCAAC GGCGGCGGCT GGCAGGTACT GGATACGGGC

601 GCGGCACTGC CCCTGACCAT ACACACCGAA ATGCCGTGGG ACATCGGCTT

651 CATCAACATC GAAAATCCCG CCGGCGGCAT TACCGTTTCC GCGATGGGCA

701 TCAACGGCGC ACAATTAACC CAGTGGTCGA AATGGCGTGC CGACCGTATG

751 AACGACCTTG CCCAAACCGG CGCCGATCTA GTCATCCTTG CCTACGGTAC

801 CAACGAAGCC TTCGGCGACA ACATCGACAT TGCCGATACC GAACAGAAAT

851 GGCTGGATAC CGTCCGCCAA ATCCGCGACA GCCTACCTGC CGCCGGCATC
```

```
 901 CTCATCATCG GCGCGCCCGA ATCCCTGAAA ACACGCTCG GCGTATGCGG

951 CACACGCCCC GTCCGCCTGA CCGAAGTCCA ACAGATGCAG CGGCGCATCG

1001 CCCGTCAGGG GCAGACGATG TTCTGGTCTT GGCAAAACGC GATGGGCGGC

1051 GTTTGCAGCA TGAAAAACTG GCTCAACCAC GGATGGGCCG CCAAAGACGG

1101 CGTACACTTT TCCGCCAAAG CTACCAACG GTCGGCGGAA ATGCTCGCCG

1151 ACAGCCTCGA GAACTCGTC CGCTCCGCTG CAATCAGGCA ATAA
```

This corresponds to the amino acid sequence <SEQ ID 1252; ORF 299.a>:

```
a299.pep
  1 MNPKHLIAFS ALFAATQAEA LPVASVSLDT VTVSPSAPYT DTNGLLTDYG

51 NASASPWMKK LQSVAQGSGE TFRILQIGDS HTAGDFFTDS LRKRLQKTWG

101 DGGIGWVYPA NVKGQRMAAV RHNGNWQSLT SRNNTGDFPL GGILAHTGSG

151 GSMTLTASDG IASKQRVSLF AKPLLAEQTL TVNGNTVSAN GGGWQVLDTG

201 AALPLTIHTE MPWDIGFINI ENPAGGITVS AMGINGAQLT QWSKWRADRM

251 NDLAQTGADL VILAYGTNEA FGDNIDIADT EQKWLDTVRQ IRDSLPAAGI

301 LIIGAPESLK NTLGVCGTRP VRLTEVQQMQ RRIARQGQTM FWSWQNAMGG

351 VCSMKNWLNH GWAAKDGVHF SAKGYQRSAE MLADSLEELV RSAAIRQ*
``` m299/a299 98.0% identity in 397 aa overlap

```
                  10         20         30         40         50         60
m299.pep  MNPKHLIAFSALFAATQAEALPVASVSLDTVTVSPSAPYTDTNGLLTDYGNASASPWMKK
          ||||||||||||||||||||||||||||||||||||||||||||||||||||||||||||
a299      MNPKHLIAFSALFAATQAEALPVASVSLDTVTVSPSAPYTDTNGLLTDYGNASASPWMKK
                  10         20         30         40         50         60

70         80         90        100        110        120
m299.pep  LQSVAQGSGETFRILQIGDSHTAGDFFTDSLRKRLQKTWGDGGIGWVYPANVKGQRMAAV
          ||||||||||||||||||||||||||||||||||||||||||||||||||||||||||||
a299      LQSVAQGSGETFRILQIGDSHTAGDFFTDSLRKRLQKTWGDGGIGWVYPANVKGQRMAAV
                  70         80         90        100        110        120

130        140        150        160        170        180
m299.pep  RHNGNWQSLTSRNNTGDFPLGGILAHTGSGGSMTLTASDGIASKQRVSLFAKPLLAEQTL
          ||||||||||||||||||||||||||||||||||||||||||||||||||||||||||||
a299      RHNGNWQSLTSRNNTGDFPLGGILAHTGSGGSMTLTASDGIASKQRVSLFAKPLLAEQTL
                 130        140        150        160        170        180

190        200        210        220        230        240
m299.pep  TVNGNTVSANGGGWQVLDTGAALPLTIHTEMPWDIGFINIENPAGGITVSAMGINGAQLT
          ||||||||||||||||||||||||||||||||||||||||||||||||||||||||||||
a299      TVNGNTVSANGGGWQVLDTGAALPLTIHTEMPWDIGFINIENPAGGITVSAMGINGAQLT
                 190        200        210        220        230        240

250        260        270        280        290        300
m299.pep  QWSKWRADRMNDLAQTGADLVILSYGTNEAFNNNIDIADTEQKWLDTVRQIRDSLPAAGI
          |||||||||||||||||||||||:||||||||::||||||||||||||||||||||||||
a299      QWSKWRADRMNDLAQTGADLVILAYGTNEAFGDNIDIADTEQKWLDTVRQIRDSLPAAGI
                 250        260        270        280        290        300

310        320        330        340        350        360
m299.pep  LIIGAPESLKNTLGVCGTRPVRLTEVQQMQRRVARQGQTMFWSWQNAMGGICSMKNWLNQ
          ||||||||||||||||||||||||||||||||:|||||||||||||||||:||||||||:
a299      LIIGAPESLKNTLGVCGTRPVRLTEVQQMQRRIARQGQTMFWSWQNAMGGVCSMKNWLNH
                 310        320        330        340        350        360
```

-continued

```
                       370         380         390
m299.pep   GWAAKDGVHFSAKGYRRAAEMLADSLEELVRSAAIRQX
           ||||||||||||||:|:||||||||||||||||||||
a299       GWAAKDGVHFSAKGYQRSAEMLADSLEELVRSAAIRQX
                       370         380         390
```

The following partial DNA sequence was identified in *N. gonorrhoeae* <SEQ ID 1253>:

```
g302.seq
    1 ATGCACTCAA TATATTTTTT TAAGGAGAAG CAGATGAGTC AAACCGACGC

51 GCGTCGTAGC GGACGATTTT TACGCACAGT CGAATGGCTG GGCAATATGT

101 TGCCGCACCC GGTTACGCTT TTTATTATTT TCATTGTGTT ATTGCTGATT

151 GCCTCTGCCG TCGGTGCGTA TTTCGGACTA TCCGTCCCCG ATCCGCGTCC

201 TGTTGGGGCG AAAGGACGTG CCGATGACGG TTTGATTCAC GTTGTCAGCC

251 TGCTCGATGC CGACGGTTTG ATCAAAATCC TGACGCATAC CGTTAAAAAT

301 TTCACCGGTT TCGCGCCGTT GGGAACGGTG TTGGTTTCTT TATTGGGCGT

351 GGGGATTGCG GAAAAATCGG GCTTGATTTC CGCATTAATG CGCTTATTGC

401 TCACAAAATC CCCACGCAAA CTCACTACTT TTATGGTTGT TTTTACAGGG

451 ATTTTATCCA ATACGGCTTC TGAATTGGGC TATGTCGTCC TAATCCCTTT

501 GTCCGCCGTC ATCTTTCATT CGCTCGGCCG CCATCCGCTT GCCGGTTTGG

551 CTGCGGCTTT CGCCGGCGTT TCGGGCGGTT ATTCGGCCAA TCTGTTCTTA

601 GGCACAATCG ATCCGCTCTT GGCAGGCATC ACCCAACAGG CGGCGCAAAT

651 CATCCATCCC GACTACGTCG TAGGCCCTGA AGCCAACTGG TTTTTTATGG

701 CAGCCAGTAC GTTTGTGATT GCTTTGATTG GTTATTTTGT TACTGAAAAA

751 ATCGTCGAAC CGCAATTGGG CCCTTATCAA TCAGATTTGT CACAAGAAGA

801 AAAAGACATT CGGCATTCCA ATGAAATCAC GCCTTTGGAA TATAAAGGAT

851 TAATTTGGGC AGGCGTGGTG TTTGTTGCCT TATCCGCCCT ATTGGCTTGG

901 AGCATCGTCC CTGCCGACGG TATTTTGCGT CATCCTGAAA CAGGATTGGT

951 TGCCGGTTCG CCGTTTTTAA AATCGATTGT TGTTTTTATT TTCTTGTTGT

1001 TTGCGCTGCC GGGCATTGTT TATGGCCGGA TAACCCGAAG TTTGCGCGGC

1051 GAACGGGAAG TCGTTAATGC GATGGCCGAA TCGATGAGTA CTTTGGGACT

1101 TTATTTGGTC ATCATCTTTT TTGCCGCACA GTTTGTCGCA TTTTTTAATT

1151 GGACGAATAT TGGGCAATAT ATTGCCGTTA AAGGGGCGGT GTTCTTAAAA

1201 GAAGTCGGCT TGGGCGGCAG TGTGTTGTTT ATCGGTTTTA TTTTAATTTG

1251 TGCTTTTATC AATCTGATGA TAGGCTCCGC CTCCGCGCAA TGGGCGGTAA

1301 CTGCGCCGAT TTTCGTCCCT ATGCTGATGT TGGCCGGCTA CGCGCCCCAA

1351 GTCATTCAAG CCGCTTACCG CATCGGTGAT TCCGTTACCA ATATTATTAC

1401 GCCGATGATG AGTTATTTCG GCTGATTAT GGCGACGGTA ATCAAATACA

1451 AAAAAGATGC GGGCGTAGGC ACGCTGATTT CTATGATGTT GCCGTATTCC

1501 GCTTTCTTCT TAATTGCATG GATCGCCTTA TTCTGCATTT GGGTATTTGT

1551 TTTGGGTCTG CCCGTCGGTC CCGGCACACC CACATTCTAT CCGGTGCCTT

1601 AA
```

This corresponds to the amino acid sequence <SEQ ID 1254; ORF 302.ng>:

```
g302.pep
   1 MHSIYFFKEK QMSQTDARRS GRFLRTVEWL GNMLPHPVTL FIIFIVLLLI

51 ASAVGAYFGL SVPDPRPVGA KGRADDGLIH VVSLLDADGL IKILTHTVKN

101 FTGFAPLGTV LVSLLGVGIA EKSGLISALM RLLLTKSPRK LTTFMVVFTG

151 ILSNTASELG YVVLIPLSAV IFHSLGRHPL AGLAAAFAGV SGGYSANLFL

201 GTIDPLLAGI TQQAAQIIHP DYVVGPEANW FFMAASTFVI ALIGYFVTEK

251 IVEPQLGPYQ SDLSQEEKDI RHSNEITPLE YKGLIWAGVV FVALSALLAW

301 SIVPADGILR HPETGLVAGS PFLKSIVVFI FLLFALPGIV YGRITRSLRG

351 EREVVNAMAE SMSTLGLYLV IIFFAAQFVA FFNWTNIGQY IAVKGAVFLK

401 EVGLGGSVLF IGFILICAFI NLMIGSASAQ WAVTAPIFVP MLMLAGYAPQ

451 VIQAAYRIGD SVTNIITPMM SYFGLIMATV IKYKKDAGVG TLISMMLPYS

501 AFFLIAWIAL FCIWVFVLGL PVGPGTPTFY PVP*
```

The following partial DNA sequence was identified in *N. meningitidis* <SEQ ID 1255>:

```
m302.seq
    1 ATGCACTCAA TATATTTTTT TAAGGAGAAG CAGATGAGTC AAACCGATAC

51 GCAACGGGAC GGACGATTTT TACGCACAGT CGAATGGCTG GGCAATATGT

101 TGCCGCATCC GGTTACGCTT TTTATTATTT TCATTGTGTT ATTGCTGATT

151 GCCTCTGCCG TCGGTGCGTA TTTCGGACTA TCCGTCCCCG ATCCGCGCCC

201 TGTTGGTGCG AAAGGACGTG CCGATGACGG TTTGATTTAC ATTGTCAGCC

251 TGCTCAATGC CGACGGTTTT ATCAAAATCC TGACGCATAC CGTTAAAAAT

301 TTCACCGGTT TCGCGCCGTT GGGAACGGTG TTGGTTTCTT TATTGGGCGT

351 GGGGATTGCG GAAAAATCGG GCTTGATTTC CGCATTAATG CGCTTATTGC

401 TCACAAAATC GCCACGCAAA CTCACTACTT TTATGGTTGT TTTTACAGGG

451 ATTTTATCTA ATACCGCTTC TGAATTGGGC TATGTCGTCC TAATCCCTTT

501 GTCCGCCATC ATCTTTCATT CCCTCGGCCG CCATCCGCTT GCCGGTCTGG

551 CTGCGGCTTT CGCCGGCGTT TCGGGCGGTT ATTCGGCCAA TCTGTTCTTA

601 AGCACAATCG ATCCGCTCTT GGCATGCATC ACCCATCAGG CGGCGGTCGT

651 AGGCCCTGAA GCCAACTGGT TTTTTATGGT AGCCAGTACG TTTGTGATTG

701 CTTTGATTGG TTATTTTGTT ACTGAAAAAA TCGTCGAACC GCAATTGGGC

751 CCTTATCAAT CAGATTTGTC ACAAGAAGAA AAAGACATTC GGCATTCCAA

801 TGAAATCACG CCTTTGGAAT ATAAAGGATT AATTTGGGCT GGCGTGGTGT

851 TTGTTGCCTT ATCCGCCCTA TTGGCTTGGA GCATCGTCCC TGCCGACGGT

901 ATTTTGCGTC ATCCTGAAAC AGGATTGGTT TCCGGTTCGC CGTTTTTAAA

951 ATCGATTGTT GTTTTTATTT TCTTGTTGTT TGCACTGyCG GGCmTTGTTT

1001 ATGGmCGGGT AACAGGAAGT TTGCGCGGCG AACAGGAAGT CGTTAATGCG

1051 ATGGCCGAAT CGATGAGTAC TCTGGsGCTT TmTTTGswCA kcATCTTTTT

1101 TGCCGCACAG TTTGTCGCAT TTTTTAATTG GACGAATATT GGGCAATATA

1151 TTGCCGTTAA AGGGGCGACG TTCTTAAAAG AAGTCGGCTT GGGCGGCAGC
```

```
                              -continued
1201 GTGTTGTTTA TCGGTTTTAT TTTAATTTGT GCTTTTATCA ATCTGATGAT

1251 AGGCTCCGCC TCCGCGCAAT GGGCGGTAAC TGCGCCGATT TTCGTCCCTA

1301 TGCTGATGTT GGCCGGCTAC GCGCCCGAAG TCATTCAAGC CGCTTACCGC

1351 ATCGGTGATT CCGTTACCAA TATTATTACG CCGATGATGA GTTATTTCGG

1401 GCTGATTATG GCGACGGTGA TCAAATACAA AAAAGATGCG GGCGTGGGTA

1451 CGCTGATTTC TATGATGTTG CCGTATTCCG CTTTCTTCTT GATTGCGTGG

1501 ATTGCCTTAT TCTGCATTTG GGTATTTGTT TTGGGCCTGC CCGTCGGTCC

1551 CGGCGCGCCC ACATTCTATC CCGCACCTTA A
```

This corresponds to the amino acid sequence <SEQ ID 1256; ORF 302>:

```
m302.pep
  1 MHSIYFFKEK QMSQTDTQRD GRFLRTVEWL GNMLPHPVTL FIIFIVLLLI

51 ASAVGAYFGL SVPDPRPVGA KGRADDGLIY IVSLLNADGF IKILTHTVKN

101 FTGFAPLGTV LVSLLGVGIA EKSGLISALM RLLLTKSPRK LTTFMVVFTG

151 ILSNTASELG YVVLIPLSAI IFHSLGRHPL AGLAAAFAGV SGGYSANLFL

201 STIDPLLACI THQAAVVGPE ANWFFMVAST FVIALIGYFV TEKIVEPQLG

251 PYQSDLSQEE KDIRHSNEIT PLEYKGLIWA GVVFVALSAL LAWSIVPADG

301 ILRHPETGLV SGSPFLKSIV VFIFLLFALX GXVYGRVTRS LRGEQEVVNA

351 MAESMSTLXL XLXXIFFAAQ FVAFFNWTNI GQYIAVKGAT FLKEVGLGGS

401 VLFIGFILIC AFINLMIGSA SAQWAVTAPI FVPMLMLAGY APEVIQAAYR

451 IGDSVTNIIT PMMSYFGLIM ATVIKYKKDA GVGTLISMML PYSAFFLIAW

501 IALFCIWVFV LGLPVGPGAP TFYPAP*
```

Computer analysis of this amino acid sequence gave the following results:
Homology with a Predicted ORF from *N. gonorrhoeae*
ORF 302 shows 94.0% identity over a 533 aa overlap with a predicted ORF (ORF 302.ng) from *N. gonorrhoeae*:

```
   m302/g302
                   10         20         30         40         50         60
   m302.pep  MHSIYFEKEKQMSQTDTQRDGRFLRTVEWLGNMLPHPVTLFIIFIVLLLIASAVGAYFGL
             |||||| ||||||||||| ::|:||||||||||||||||||||||||||||||||||||
   g302      MHSIYFFKEKQMSQTDARRSGRFLRTVEWLGNMLPHPVTLFIIFIVLLLIASAVGAYFGL
                   10         20         30         40         50         60

70         80         90        100        110        120
   m302.pep  SVPDPRPVGAKGRADDGLIYIVSLLNADGFIKILTHTVKNFTGFAPLGTVLVSLLGVGIA
             ||||||||||||||||||| ::||||:|||:|||||||||||||||||||||||||||||
   g302      SVPDPRPVGAKGRADDGLIHVVSLLDADGLIKILTHTVKNFTGFAPLGTVLVSLLGVGIA
                   70         80         90        100        110        120

130        140        150        160        170        180
   m302.pep  EKSGLISALMRLLLTKSPRKLTTFMVVFTGILSNTASELGYVVLIPLSAIIFHSLGRHPL
             |||||||||||||||||||||||||||||||||||||||||||||||||:||||||||
   g302      EKSGLISALMRLLLTKSPRKLTTFMVVFTGILSNTASELGYVVLIPLSAVIFHSLGRHPL
                  130        140        150        160        170        180

190        200        210        220        230
   m302.pep  AGLAAAFAGVSGGYSANLFLSTIDPLLACITHQAA-------VVGPEANWFFMVASTFVI
             ||||||||||||||||||||| |||||| ||:|||       ||||||||||:||||||
   g302      AGLAAAFAGVSGGYSANLFLGTIDPLLAGITQQAAQIIHPDYVVGPEANWFFMAASTFVI
                  190        200        210        220        230        240

240        250        260        270        280        290
   m302.pep  ALIGYFVTEKIVEPQLGPYQSDLSQEEKDIRHSNEITPLEYKGLIWAGVVFVALSALLAW
             |||||||||:||||||||||||||||||||||||||||||||||||||||||||||||||
   g302      ALIGYFVTECIVEPQLGPYQSDLSQEEKDIRHSNEITPLEYKGLIWAGVVFVALSALLAW
                  250        260        270        280        290        300
```

-continued

```
            300        310        320        330        340        350
m302.pep  SIVPADGILRHPETGLVSGSPFLKSIVVFIFLLFALXGXVYGRVTRSLRGEQEVVNAMAE
          ||||||||||||||||:|||||||||||||||||| | ||||:|||||||:||||||||
g302      SIVPADGILRHPETGLVAGSPFLKSIVVFIFLLFALPGIVYGRITRSLRGEREVVNAMAE
                  310        320        330        340        350        360

360        370        380        390        400        410
m302.pep  SMSTLXLXLXXIFFAAQFVAFFNWTNIGQYIAVKGATFLKEVGLGGSVLFIGFILICAFI
          ||||| | |  |||||||||||||||||||||||:|||||||||||||||||||||||||
g302      SMSTLGLYLVIIFFAAQFVAFFNWTNIGQYIAVKGAVFLKEVGLGGSVLFIGFILICAFI
                  370        380        390        400        410        420

420        430        440        450        460        470
m302.pep  NLMIGSASAQWAVTAPIFVPMLMLAGYAPEVIQAAYRIGDSVTNIITPMMSYFGLIMATV
          |||||||||||||||||||||||||||||:||||||||||||||||||||||||||||||
g302      NLMIGSASAQWAVTAPIFVPMLMLAGYAPQVIQAAYRIGDSVTNIITPMMSYFGLIMATV
                  430        440        450        460        470        480

480        490        500        510        520
m302.pep  IKYKKDAGVGTLISMMLPYSAFFLIAWIALFCIWVFVLGLPVGPGAPTFYPAPX
          ||||||||||||||||||||||||||||||||||||||||||||:|||||:||
g302      IKYKKDAGVGTLISMMLPYSAFFLIAWIALFCIWVFVLGLPVGPGTPTFYPVPX
                  490        500        510        520        530
```

The following partial DNA sequence was identified in *N. meningitidis* <SEQ ID 1257>:

```
a302.seq
   1 ATGCACTCAA TATATTTTTT TAAGGAGAAG CAGATGAGTC AAACCGATAC
  51 GCAACGGGAC GGACGATTTT TACGCACAGT CGAATGGCTG GGCAATATGT
 101 TGCCGCACCC GGTTACGCTT TTTATTATTT TCATTGTGTT ATTGCTGATT
 151 GCCTCTGCCG CCGGTGCGTA TTTCGGACTA TCCGTCCCCG ATCCGCGCCC
 201 TGTTGGTGCG AAAGGACGTG CCGATGACGG TTTGATTCAC GTTGTCAGCC
 251 TGCTCGATGC TGACGGTTTG ATCAAAATCC TGACGCATAC CGTTAAAAAT
 301 TTCACCGGTT TCGCGCCGTT GGGAACGGTG TTGGTTTCTT TATTGGGCGT
 351 GGGGATTGCG GAAAAATCGG GCTTGATTTC CGCATTAATG CGCTTATTGC
 401 TCACAAAATC TCCACGCAAA CTCACTACTT TTATGGTTGT TTTTACAGGG
 451 ATTTTATCTA ATACCGCTTC TGAATTGGGC TATGTCGTCC TAATCCCTTT
 501 GTCCGCCATC ATCTTTCATT CCCTCGGCCG CCATCCGCTT GCCGGTCTGG
 551 CTGCGGCTTT CGCCGGCGTT TCGGGCGGTT ATTCGGCCAA TCTGTTCTTA
 601 GGCACAATCG ATCCGCTCTT GGCAGGCATC ACCCAACAGG CGGCGCAAAT
 651 CATCCATCCC GACTACGTCG TAGGCCCTGA AGCCAACTGG TTTTTTATGG
 701 TAGCCAGTAC GTTTGTGATT GCTTTGATTG GTTATTTTGT TACTGAAAAA
 751 ATCGTCGAAC CGCAATTGGG CCCTTATCAA TCAGATTTGT CACAAGAAGA
 801 AAAAGACATT CGACATTCCA ATGAAATCAC GCCTTTGGAA TATAAAGGAT
 851 TAATTTGGGC TGGCGTGGTG TTTGTTGCCT TATCCGCCCT ATTGGCTTGG
 901 AGCATCGTCC CTGCCGACGG TATTTTGCGT CATCCTGAAA CAGGATTGGT
 951 TTCCGGTTCG CCGTTTTTAA AATCAATTGT TGTTTTTATT TTCTTGTTGT
1001 TTGCACTGCC GGGCATTGTT TATGGCCGGG TAACCCGAAG TTTGCGCGGC
1051 GAACAGGAAG TCGTTAATGC GATGGCCGAA TCGATGAGTA CTCTGGGGCT
1101 TTATTTGGTC ATCATCTTTT TTGCCGCACA GTTTGTCGCA TTTTTTAATT
1151 GGACGAATAT TGGGCAATAT ATTGCCGTTA AAGGGGCGAC GTTCTTAAAA
1201 GAAGTCGGCT TGGGCGGCAG CGTGTTGTTT ATCGGTTTTA TTTTAATTTG
1251 TGCTTTTATC AATCTGATGA TAGGCTCCGC CTCCGCGCAA TGGGCGGTAA
```

```
-continued
1301 CTGCGCCGAT TTTCGTCCCT ATGCTGATGT TGGCCGGCTA CGCGCCCGAA

1351 GTCATTCAAG CCGCTTACCG CATCGGTGAT TCCGTTACCA ATATTATTAC

1401 GCCGATGATG AGTTATTTCG GCTGATTAT GGCGACGGTG ATCAAATACA

1451 AAAAAGATGC GGGCGTGGGT ACGCTGATTT CTATGATGTT GCCGTATTCC

1501 GCTTTCTTCT TGATTGCGTG GATTGCCTTA TTCTGCATTT GGGTATTTGT

1551 TTTGGGCCTG CCCGTCGGTC CCGGCGCGCC CACATTCTAT CCCGCACCTT

1601 AA
```

This corresponds to the amino acid sequence <SEQ ID 1258; ORF 302.a>:

```
a302.pep
  1 MHSIYFFKEK QMSQTDTQRD GRFLRTVEWL GNMLPHPVTL FIIFIVLLLI

51 ASAAGAYFGL SVPDPRPVGA KGRADDGLIH VVSLLDADGL IKILTHTVKN

101 FTGFAPLGTV LVSLLGVGIA EKSGLISALM RLLLTKSPRK LTTFMVVFTG

151 ILSNTASELG YVVLIPLSAI IFHSLGRHPL AGLAAAFAGV SGGYSANLFL

201 GTIDPLLAGI TQQAAQIIHP DYVVGPEANW FFMVASTFVI ALIGYFVTEK

251 IVEPQLGPYQ SDLSQEEKDI RHSNEITPLE YKGLIWAGVV FVALSALLAW

301 SIVPADGILR HPETGLVSGS PFLKSIVVFI FLLFALPGIV YGRVTRSLRG

351 EQEVVNAMAE SMSTLGLYLV IIFFAAQFVA FFNWTNIGQY IAVKGATFLK

401 EVGLGGSVLF IGFILICAFI NLMIGSASAQ WAVTAPIFVP MLMLAGYAPE

451 VIQAAYRIGD SVTNIITPMM SYFGLIMATV IKYKKDAGVG TLISMMLPYS

501 AFFLIAWIAL FCIWVFVLGL PVGPGAPTFY PAP*
``` m302/a302 96.1% identity in 533 aa overlap

```
                   10         20         30         40         50         60
m302.pep   MHSIYFEKEKQMSQTDTQRDGRFLRTVEWLGNMLPHPVTLFIIFIVLLLIASAVGAYFGL
           ||||||:|||||||||||||||||||||||||||||||||||||||||||||:||||||
a302       MHSIYFFKEKQMSQTDQRRDGRFLRTVEWLGNMLPHPVTLFIIFIVLLLIASAAGAYFGL
                   10         20         30         40         50         60

70         80         90        100        110        120
m302.pep   SVPDPRPVGAKGRADDGLIYIVSLLNADGFIKILTHTVKNFTGFAPLGTVLVSLLGVGIA
           ||||||||||||||||||||::||||:|||:|||||||||||||||||||||||||||||
a302       SVPDPRPVGAKGRADDGLIHVVSLLDADGLIKILTHTVKNFTGFAPLGTVLVSLLGVGIA
                   70         80         90        100        110        120

130        140        150        160        170        180
m302.pep   EKSGLISALMRLLLTKSPRKLTTFMVVFTGILSNTASELGYVVLIPLSAIIFHSLGRHPL
           ||||||||||||||||||||||||||||||||||||||||||||||||||||||||||||
a302       EKSGLISALMRLLLTKSPRKLTTFMVVFTGILSNTASELGYVVLIPLSAIIFHSLGRHPL
                  130        140        150        160        170        180

190        200        210        220        230
m302.pep   AGLAAAFAGVSGGYSANLFLSTIDPLLACITHQAA-------VVGPEANWFFMVASTFVI
           |||||||||||||||||||||:|||||||  ||:|||       ||||||||||||||||
a302       AGLAAAFAGVSGGYSANLFLGTIDPLLAGITQQAAQIIHPDYVVGPEANWFFMVASTFVI
                  190        200        210        220        230        240

240        250        260        270        280        290
m302.pep   ALIGYFVTEKIVEPQLGPYQSDLSQEEKDIRHSNEITPLEYKGLIWAGVVFVALSALLAW
           ||||||||| ||||||||||||||||||||||||||||||||||||||||||||||||||
a302       ALIGYFVTECIVEPQLGPYQSDLSQEEKDIRHSNEITPLEYKGLIWAGVVFVALSALLAW
                  250        260        270        280        290        300

300        310        320        330        340        350
m302.pep   SIVPADGILRHPETGLVSGSPFLKSIVVFIFLLFALXGXVYGRVTRSLRGEQEVVNAMAE
           ||||||||||||||||||||||||||||||||||||| |||||||||||||||||||||
a302       SIVPADGILRHPETGLVSGSPFLKSIVVFIFLLFALPGIVYGRVTRSLRGEQEVVNAMAE
                  310        320        330        340        350        360
```

-continued

```
              360        370        380        390        400        410
m302.pep  SMSTLXLXLXXIFFAAQFVAFFNWTNIGQYIAVKGATFLKEVGLGGSVLFIGFILICAFI
          |||||  |  | ||||||||||||||||||||||||||||||||||||||||||||||||
a302      SMSTLGLYLVIIFFAAQFVAFFNWTNIGQYIAVKGATFLKEVGLGGSVLFIGFILICAFI
              370        380        390        400        410        420

420        430        440        450        460        470
m302.pep  NLMIGSASAQWAVTAPIFVPMLMLAGYAPEVIQAAYRIGDSVTNIITPMMSYFGLIMATV
          ||||||||||||||||||||||||||||||||||||||||||||||||||||||||||||
a302      NLMIGSASAQWAVTAPIFVPMLMLAGYAPEVIQAAYRIGDSVTNIITPMMSYFGLIMATV
              430        440        450        460        470        480

480        490        500        510        520
m302.pep  IKYKKDAGVGTLISMMLPYSAFFLIAWIALFCIWVFVLGLPVGPGAPTFYPAPX
          |||||||||||||||||||||||||||||||||||||||||||||||| ||| |
a302      IKYKKDAGVGTLISMMLPYSAFFLIAWIALFCIWVFVLGLPVGPGTPTFYPVPX
              490        500        510        520        530
```

The following partial DNA sequence was identified in *N. gonorrhoeae* <SEQ ID 1259>:

```
g305.seq
   1 ATGGATTTTT TGATTGTCCT GAAAGCCCTG ATGATGGGCT TGGTAGAAGG

51 TTTTACCGAA TTTTTACCGA TTTCCAGCAC CGGACATTTG ATTGTGTTCG

101 GCAATCTGAT TGGTTTTCAC AGCAATCACA AGGTTTTTGA AATTGCCATC

151 CAGCTCGGTG CGGTTTTGGC GGTAGTGTTT GAATACCGGC AGCGTTTCAG

201 CAATGTGTTG CATGGCGTGG GAAAAGACCG GAAAGCCAAC CGTTTCGTCC

251 TCAATCTTGC CATTGCTTTT ATACCTGCCG CCGTGATGGG GCTGTTGTTC

301 GACAAACAAA TCAAAGAGTA TCTGTTTAAC CCCTTGAGTG TTGCAGTCAT

351 GCTGGTTTTG GGCGGTTTTT TTATTTTGTG GGTGGAGAAA CGCCAAAGCC

401 GAGCAGAGCC TAAAATTGCC GATGTTGATG CATTGCGTCC GATTGATGCG

451 TTGATGATCG GTGTTGCCCA AGTGTTTGCA CTGGTTCCGG GTACGTCCCG

501 TTCGGGCAGT ACGGTTATGG GCGGGATGCT TTGGGGAATC GAGCGGAAAA

551 CGGCAACGGA GTTTTCATTT TTCTTGGCCG TTCCGATGAT GGTTGCAGCA

601 ACGGCTTATG ATGTCCTGAA ACATTACCGA TTTTTCACCC TGCATGATGT

651 CGGTTTGATT TTGATAGGCT TTATTGCCGC TTTTGTTTCC GGTTTGGTAG

701 CGGTTAAAGC ACTGCTGAAG TTTGTTTCCA AGAAAAACTA TATCCCGTTT

751 GCCTATTACC GCATTGTTTT CGGCATTGTC ATCATAATAT TGTGGTTGTC

801 GGGCTGGATA AGTTGGGAAT GA
```

This corresponds to the amino acid sequence <SEQ ID 1260; ORF 305.ng>:

```
g305.pep
   1 MDFLIVLKAL MMGLVEGFTE FLPISSTGHL IVFGNLIGFH SNHKVFEIAI

51 QLGAVLAVVF EYRQRFSNVL HGVGKDRKAN RFVLNLAIAF IPAAVMGLLF

101 DKQIKEYLFN PLSVAMLVL GGFFILWVEK RQSRAEPKIA DVDALRPIDA

151 LMIGVAQVFA LVPGTSRSGS TVMGGMLWGI ERKTATEFSF FLAVPMMVAA

201 TAYDVLKHYR FFTLHDVGLI LIGFIAAFVS GLVAVKALLK FVSKKNYIPF

251 AYYRIVFGIV IIILWLSGWI SWE*
```

The following partial DNA sequence was identified in *N. meningitidis* <SEQ ID 1261>:

```
m305.seq (partial)
   1 AtGGATTTTC TGATTGTCCT GAAAGCCCTG ATGATGGGCT TGGTAGAAGG

51 TTTTACCGAA TTTTTACCGA TTTCCAGCAC CGGACATTTG ATTGTGTTCG

101 GCAATCTGAT TGGTTTTCAC AGCAATCACA AGGTTTTTGA AATTGCCATC

151 CAGCTCGGTG CAGTTTTGGC GGTAGTGTTT GAATACCGGC AACGTTTCAG

201 CAATGTGTTG CACGGCTTGG GAAAAGACCG GAAAGCCAAC CGCTTCGTCC

251 TTAATCTTGC CATTGCTTTT ATACCTGCCG CCGTGATGGG GCTGTTGTTC

301 GGCAwACAAA TCAAAGAGyA TCTGTTTAAC CCCTTGAGTG TTGCAGTCAT

351 GCTGGTTyTG GrCGGTTTTT yTATTTTGTG GGTGGAGAAA CGCCAAAGCC

401 GAGCAGAGCC TAAAATTGCC GATGTTGATG CATTGCGTCC GATTGATGCC

451 TTGATGATCG GCGTTGCCCA AGTGTTTGCA CTGGTTCCGG GTACGTCCCG

501 TTCGGGCAGT ACGATTATGG GCGGGATGCT TTGGGGCATC GAACGGAAAA

551 CTGCGACAGA ATTCTCGTTT TTCTTGGCTG TGCCGATGAT GGTTGCCGCA

601 ACGGCTTATG ATGTCCTGAA ACATTACCGA TTTTTCACCC TGCATGATGT

651 CGGTTTGATT CTGATAGGCT TTATTGCTGC CTTTGTTTCA GGCTTGGTAG

701 CGGTAAAAGC GTTGCTGAGG TTTGTTTCGG GTAC...
```

This corresponds to the amino acid sequence <SEQ ID 1262; ORF 305>:

```
m305.pep (partial)
   1 MDFLIVLKAL MMGLVEGFTE FLPISSTGHL IVFGNLIGFH SNHKVFEIAI

51 QLGAVLAVVF EYRQRFSNVL HGLGKDRKAN RFVLNLAIAF IPAAVMGLLF

101 GXQIKEXLFN PLSVAVMLVL XGFXILWVEK RQSRAEPKIA DVDALRPIDA

151 LMIGVAQVFA LVPGTSRSGS TIMGGMLWGI ERKTATEFSF FLAVPMMVAA

201 TAYDVLKHYR FFTLHDVGLI LIGFIAAFVS GLVAVKALLR FVSG...
```

Computer analysis of this amino acid sequence gave the following results:

Homology with a Predicted ORF from *N. gonorrhoeae*

ORF 305 shows 96.7% identity over a 243 aa overlap with a predicted ORF (ORF 305.ng) from *N. gonorrhoeae*:

```
g305/m305

10        20        30        40        50        60
g305.pep     MDFLIVLKALMMGLVEGFTEFLPISSTGHLIVFGNLIGFHSNHKVFEIAIQLGAVLAVVF
             ||||||||||||||||||||||||||||||||||||||||||||||||||||||||||||
m305         MDFLIVLKALMMGLVEGFTEFLPISSTGHLIVFGNLIGFHSNHKVFEIAIQLGAVLAVVF
                      10        20        30        40        50        60

70        80        90       100       110       120
g305.pep     EYRQRFSNVLHGVGKDRKANRFVLNLAIAFIPAAVMGLLFDKQIKEYLFNPLSVAVMLVL
             ||||||||||||:|||||||||||||||||||||||||||  |||| |||||||||||||
m305         EYRQRFSNVLHGLGKDRKANRFVLNLAIAFIPAAVMGLLFGXQIKEXLFNPLSVAVMLVL
                      70        80        90       100       110       120

130       140       150       160       170       180
g305.pep     GGFFILWVEKRQSRAEPKIADVDALRPIDALMIGVAQVFALVPGTSRSGSTVMGGMLWGI
              || |||||||||||||||||||||||||||||||||||||||||||||:||||||||
m305         XGFXILWVEKRQSRAEPKIADVDALRPIDALMIGVAQVFALVPGTSRSGSTIMGGMLWGI
                    130       140       150       160       170       180
```

-continued

```
              190        200        210        220        230        240
g305.pep  ERKTATEFSFFLAVPMMVAATAYDVLKHYRFFTLHDVGLILIGFIAAFVSGLVAVKALLK
          |||||||||||||||||||||||||||||||||||||||||||||||||||||||||||:
m305      ERKTATEFSFFLAVPMMVAATAYDVLKHYRFFTLHDVGLILIGFIAAFVSGLVAVKALLR
              190        200        210        220        230        240

250        260        270
g305.pep  FVSKKNYIPFAYYRIVFGIVIIILWLSGWISWEX
          |||
m305      FVSG
```

The following partial DNA sequence was identified in *N. meningitidis* <SEQ ID 1263>:

```
a305.seq
   1 ATGGATTTTC TGATTGTCCT GAAAGCCCTG ATGATGGGCT TGGTAGAAGG
  51 TTTTACCGAA TTTTTACCGA TTTCCAGCAC CGGACATTTG ATTGTGTTCG
 101 GCAATCTGAT TGATTTTCAC AGCAATCACA AGGTTTTTGA AATTACCATC
 151 CAGCTCGGTG CGGTTTTGGC GGTAGTGTTT GAATACCGGC AGCGTTTCAG
 201 CAATGTGTTG CATGGCGTGG GAAAAGACCG GAAAGCCAAC CGTTTCGTCC
 251 TTAATCTTGC CATTGCTTTT ATACCTGCCG CCGTGATGGG GCTGTTGTTC
 301 GGCAAACAAA TCAAAGAGTA TCTGTTTAAC CCCTTGAGTG TTGCAGTCAT
 351 GCTGGTTTTG GGCGGTTTTT TTATTTTGTG GGTGGAGAAA CGCCAAAGCC
 401 GAGCAGAGCC TAAAATTGTC GATGTTGATG CATTGCGTCC GATTGATGCG
 451 TTGATGATCG GCGTTGCCCA AGTGTTTGCA CTGGTTCCAG GTACGTCCCG
 501 TTCGGGCAGT ACGATTATGG GCGGGATGCT TGGGGAATC GAGCGGAAAA
 551 CGGCAACGGA GTTTTCATTT TTCTTGGCCG TTCCGATGAT GGTTGCAGCA
 601 ACGGCTTATG ATGTCCTGAA GCATTACCGG TTTTTCACCC TGCATGATGT
 651 CGGTTTGATT TTGATTGGCT TTGTTGCTGC CTTTGTTTCA GGCTTGGTGG
 701 CGGTCAAAGC GTTGCTGAGG TTTGTTTCCA AGAAAAATTA TATTCCTTTT
 751 GCCTATTACC GCATTGTTTT TGGTATTGCC ATCATTATAT TGTGGCTGTC
 801 AGGCTGGATA AGTTGGGAAT GA
```

This corresponds to the amino acid sequence <SEQ ID 1264; ORF 305.a>:

```
a305.pep
   1 MDFLIVLKAL MMGLVEGFTE FLPISSTGHL IVFGNLIDFH SNHKVFEITI
  51 QLGAVLAVVF EYRQRFSNVL HGVGKDRKAN RFVLNLAIAF IPAAVMGLLF
 101 GKQIKEYLFN PLSVAVMLVL GGFFILWVEK RQSRAEPKIV DVDALRPIDA
 151 LMIGVAQVFA LVPGTSRSGS TIMGGMLWGI ERKTATEFSF FLAVPMMVAA
 201 TAYDVLKHYR FFTLHDVGLI LIGFVAAFVS GLVAVKALLR FVSKKNYIPF
 251 AYYRIVFGIA IIILWLSGWI SWE*
``` m305/a305 96.3% identity in 243 aa overlap

```
              10         20         30         40         50         60
m305.pep  MDFLIVLKALMMGLVEGFTEFLPISSTGHLIVFGNLIGFHSNHKVFEIAIQLGAVLAVVF
          ||||||||||||||||||||||||||||||||||||| |||||||||||:||||||||||
a305      MDFLIVLKALMMGLVEGFTEFLPISSTGHLIVFGNLIDFHSNHKVFEITIQLGAVLAVVF
              10         20         30         40         50         60

70         80         90        100        110        120
m305.pep  EYRQRFSNVLHGLGKDRKANRFVLNLAIAFIPAAVMGLLFGXQIKEXLFNPLSVAVMLVL
          ||||||||||| :|||||||||||||||||||||||||||| |||| |||||||||||||
a305      EYRQRFSNVLHGVGKDRKANRFVLNLAIAFIPAAVMGLLFGKQIKEYLFNPLSVAVMLVL
              70         80         90        100        110        120

130        140        150        160        170        180
m305.pep  XGFXILWVEKRQSRAEPKIADVDALRPIDALMIGVAQVFALVPGTSRSGSTIMGGMLWGI
          || |||||||||||||||||||||||||||||||||||||||||||||||||:|||||||
a305      GGFFILWVEKRQSRAEPKIADVDALRPIDALMIGVAQVFALVPGTSRSGSTVMGGMLWGI
             130        140        150        160        170        180

190        200        210        220        230        240
m305.pep  ERKTATEFSFFLAVPMMVAATAYDVLKHYRFFTLHDVGLILIGFIAAFVSGLVAVKALLR
          ||||||||||||||||||||||||||||||||||||||||||||:|||||||||||||||
a305      ERKTATEFSFFLAVPMMVAATAYDVLKHYRFFTLHDVGLILIGFVAAFVSGLVAVKALLR
             190        200        210        220        230        240 m305.pep  FVSG
          |||
a305      FVSKKNYIPFAYYRIVFGIAIIILWLSGWISWEX
             250        260        270
```

The following partial DNA sequence was identified in *N. gonorrhoeae* <SEQ ID 1265>:

```
g306.seq
   1 ATGTTTATGA ACAAATTTTC CCAATCCGGA AAAGGTCTGT CCGGTTTCTT

51 CTTCGGTTTG ATACTGGCAA CGGTCATTAT TGCCGGTATT TTGCTTTATC

101 TGAACCAGGG CGGTCAAAAT GCGTTCAAAA TCCCGGCTCC GTCGAAGCAG

151 CCTGCAGAAA CGGAAATCCT GAAACTGAAA AACCAGCCTA AGGAAGACAT

201 CCAACCTGAA CCGGCCGATC AAAACGCCTT GTCCGAACCG GATGTTGCGA

251 AAGAGGCAGA GCAGTCGGAT GCGGAAAAAG CTGCCGACAA GCAGCCCGTT

301 GCCGACAAAA CCGACGAGGT TGAAGAAAAG GCGGGCGAGC CGGAACGGGA

351 AGAGCCGGAC GGACAGGCAG TGCGCAAGAA AGCACTGACT GAAGAGCGTG

401 AACAAACCGT CAGGGAAAAA GCGCAGAAGA AGATGCCGA AACGGTTAAA

451 AAAAAAGCGG TAAAACCGTC TAAAGAAACA GAGAAAAAAG CTTCAAAAGA

501 AGAGAAAAAG GCGGCGAAAG AAAAAGTTGC ACCCAAACCG ACCCCGGAAC

551 AAATCCTCAA CAGCCGCAGT ATCGAAAAAG CGCGTAGTGC CGCTGCCAAA

601 GAAGTGCAGA AAATGAAAAA CTTTGGGCAA GGCGGAAGCC AACGCATTAT

651 CTGCAAATGG GCGCGTATGC CGAACCCCGG AGCGCGGAAG GGCAGCGTGC

701 CAAACTGGCA ATCTTGGGCA TATCTTCCGA AGTGGTCGGC TATCAGGCGG

751 GACATAAAAC GCTTTACCGC GTGCAAAGCG GCAATATGTC CGCCGATGCG

801 GTGA
```

This corresponds to the amino acid sequence <SEQ ID 1266; ORF 306.ng>:

```
g306.pep
   1 MFMNKFSQSG KGLSGFFFGL ILATVIIAGI LLYLNQGGQN AFKIPAPSKQ
```

-continued

```
 51 PAETEILKLK NQPKEDIQPE PADQNALSEP DVAKEAEQSD AEKAADKQPV

101 ADKADEVEEK AGEPEREEPD GQAVRKKALT EEREQTVREK AQKKDAETVK

151 KKAVKPSKET EKKASKEEKK AAKEKVAPKP TPEQILNSRS IEKARSAAAK

201 EVQKMKNFGQ GGSQRIICKW ARMPNPGARK GSVPNWQSWA YLPKWSAIRR

251 DIKRFTACKA AICPPMR*
```

The following partial DNA sequence was identified in *N. meningitidis* <SEQ ID 1267>:

```
m306.seq (partial)
  1 ..GGTTTGTTCT TCGGTTTGAT ACTGGCGACG GTCATTATTG CCGGTATTTT

51   GTTTTATCTG AACCAGAGCG GTCAAAATGC GTTCAAAATC CCGGCTTCGT

101   CGAAGCAGCC TGCAGAAACG GAAATCCTGA AACCGmAwAA CCAGCyTAAG

151   GAAGACATCC AACCTGAwCC GGCCGATCAA AACGCCTTGT CCGAACCGGA

201   TGCTGCGACA GAGGCAGAGC AGTCGGATGC GGAAAAwGCT GCCGACAAGC

251   AGCCCGTTGC CGATAAAGCC GACGAGGTTG AAGAAAAGGC GGGCGAGCCG

301   GAACGGGAAG AGCCGGACGG ACAGGCAGTG CGTAAGAAAG CGCTGACGGA

351   AGAGCGTGAA CAAACCGTCA GGGAAAAAGC GCAGAAGAAA GATGCCGAAA

401   CGGTTAAAAw ACAAGCGGTA AAACCGTCTA AAGAAACAGA GAAAAAAGCT

451   TCAAAAGAAG AGAAAAAGGC GGCGAAGGAA AAAGTTGCAC CCAAACCAAC

501   CCCGGAACAA ATCCTCAACA GCGGCAGCAT CGAAAAAGCG CGCAGTGCCG

551   CCGCCAAAGA AGTGCAGAAA ATGAAAACGC CGACAAGGCG GAAGCAACGC

601   ATTATCTGCA AATGGGCGCG TATGCCGACC GTCAGAGCGC GGAAGGGCAG

651   CGTGCCAAAC TGGCAATCTT GGGCATATCT TCCAAGGTGG TCGGTTATCA

701   GGCGGGACAT AAAACGCTTT ACCGGGTGCA AAGCGGCAAT ATGTCTGCCG

751   ATGCGGTGA
```

This corresponds to the amino acid sequence <SEQ ID 1268; ORF 306>:

```
m306.pep (partial)
  1 ..GLFFGLILAT VIIAGILFYL NQSGQNAFKI PASSKQPAET EILKPXNQXK

51   EDIQPXPADQ NALSEPDAAT EAEQSDAEXA ADKQPVADKA DEVEEKAGEP

101   EREEPDGQAV RKKALTEERE QTVREKAQKK DAETVKXQAV KPSKETEKKA

151   SKEEKKAAKE KVAPKPTPEQ ILNSGSIEKA RSAAAKEVQK MKTPTRRKQR

201   IICKWARMPT VRARKGSVPN WQSWAYLPRW SVIRRDIKRF TGCKAAICLP

251   MR*
```

Computer analysis of this amino acid sequence gave the following results:
Homology with a Predicted ORF from *N. gonorrhoeae*
ORF 306 shows 88.9% identity over a 253 aa overlap with a predicted ORF (ORF 306.ng) from *N. gonorrhoeae*:

```
m306/g306

10         20         30         40
  m306.pep             GLFFGLILATVIIAGILFYLNQSGQNAFKIPASSKQPAETEILKPX
                       |:||||||||||||||||:||||:|||||||| |||||||||||
  g306     MFMNKFSQSGKGLSGFFFGLILATVIIAGILLYLNQGGQNAFKIPAPSKQPAETEILKLK
                   10         20         30         40         50         60

50         60         70         80         90        100
  m306.pep NQXKEDIQPXPADQNALSEPDAATEAEQSDAEXAADKQPVADKADEVEEKAGEPEREEPD
           || |||||| ||||||||||||:| |||||||| |||||||||||||||||||||||||
  g306     NQPKEDIQPEPADQNALSEPDVAKEAEQSDAEKAADKQPVADKADEVEEKAGEPEREEPD
                   70         80         90        100        110        120

110        120        130        140        150        160
  m306.pep GQAVRKKALTEEREQTVREKAQKKDAETVKXQAVKPSKETEKKASKEEKKAAKEKVAPKP
            ||||||||||||||||||||||||||||||:|||||||||||||||||||||||||||
  g306     CQAVRKKALTEEREQTVREKAQKKDAETVKKKAVKPSKETEKKASKEEKKAAKEKVAPKP
                  130        140        150        160        170        180

170        180        190        200        210        220
  m306.pep TPEQILNSGSIEKARSAAAKEVQKMKTPTRR-KQRIICKWARMPTVRARKGSVPNWQSWA
           ||||||||| ||||||||||||||||| :   :||||||||||: |||||||||||||
  g306     TPEQILNSRSIEKARSAAAKEVQKMKNFGQGGSQRIICKWARMPNPGARKGSVPNWQSWA
                  190        200        210        220        230        240

230        240        250
  m306.pep YLPRWSVIRRDIKRFTGCKAAICLPMRX
           |||:||:|||||||||:||||| ||||
  g306     YLPKWSAIRRDIKRFTACKAAICPPMRX
                  250        260
```

The following partial DNA sequence was identified in *N. meningitidis* <SEQ ID 1269>:

```
a306.seq
  1 ATGTTTATGA ACAAATTTTC CCAATCCGGA AAAGGTCTGT CCGGTTTTTT

51 CTTCGGTTTG ATACTGGCGA CGGTCATTAT TGCCGGTATT TTGTTTTATC

101 TGAACCAGAG CGGTCAAAAT GCGTTCAAAA TCCCGGTTCC GTCGAAGCAG

151 CCTGCAGAAA CGGAAATCCT GAAACCGAAA AACCAGCCTA AGGAAGACAT

201 CCAACCTGAA CCGGCCGATC AAAACGCCTT GTCCGAACCG GATGCTGCGA

251 AAGAGGCAGA GCAGTCGGAT GCGGAAAAAG CTGCCGACAA GCAGCCCGTT

301 GCCGACAAAG CCGACGAGGT TGAGGAAAAG GCGGACGAGC CGGAGCGGGA

351 AAAGTCGGAC GGACAGGCAG TGCGCAAGAA AGCACTGACG GAAGAGCGTG

401 AACAAACCGT CGGGGAAAAA GCGCAGAAGA AAGATGCCGA AACGGTTAAA

451 AAACAAGCGG TAAAACCATC TAAAGAAACA GAGAAAAAAG CTTCAAAAGA

501 AGAGAAAAAG GCGGAGAAGG AAAAAGTTGC ACCCAAACCG ACCCCGGAAC

551 AAATCCTCAA CAGCGGCAGC ATCGAAAAAG CGCGCAGTGC CGCTGCCAAA

601 GAAGTGCAGA AAATGAAAAC GCCGACAAGG CGGAAGCAAC GCATTATCTG

651 CAAATGGGCG CGTATGCCGA CCGCCGGAGC GCGGAAGGGC AGCGTGCCAA

701 ACTGGCAATC TTGGGCATAT CTTCCAAGGT GGTCGGTTAT CAGGCGGGAC

751 ATAAAACGCT TACCGGGTG CAAAGCGGCA ATATGTCTGC CGATGCGGTG

801 A
```

This corresponds to the amino acid sequence <SEQ ID 1270; ORF 306.a>:

```
a306.pep
  1 MFMNKFSQSG KGLSGFFFGL ILATVIIAGI LFYLNQSGQN AFKIPVPSKQ

51 PAETEILKPK NQPKEDIQPE PADQNALSEP DAAKEAEQSD AEKAADKQPV

101 ADKADEVEEK ADEPEREKSD GQAVRKKALT EEREQTVGEK AQKKDAETVK

151 KQAVKPSKET EKKASKEEKK AEKEKVAPKP TPEQILNSGS IEKARSAAAK

201 EVQKMKTPTR RKQRIICKWA RMPTAGARKG SVPNWQSWAY LPRWSVIRRD

251 IKRFTGCKAA ICLPMR*
``` m306/a306 93.7% identity in 252 aa overlap

```
                         10         20         30         40
    m306.pep            GLFFGLILATVIIAGILFYLNQSGQNAFKIPASSKQPAETEILKPX
                        |:||||||||||||||||||||||||||||: ||||||||||||
    a306     MFMNKFSQSGKGLSGFFFGLILATVIIAGILLYLNQSGQNAFKIPVPSKQPAETEILKPK
                     10         20         30         40         50         60
                 50         60         70         80         90        100
    m306.pep  NQXKEDIQPXPADQNALSEPDAATEAEQSDAEXAADKQPVADKADEVEEKAGEPEREEPD
              || |||||| ||||||||||||||  |||||| |||||||||||||||||| |||||: |
    a306     NQPKEDIAPEPADQNALSEPDAAKEAEQSDAEKAADKQPVADKADEVEEKADEPEREKSD
                     70         80         90        100        110        120
                110        120        130        140        150        160
    m306.pep  GQAVRKKALTEEREQTVREKAQKKDAETVKXQAVKPSKETEKKASKEEKKAAKEKVAPKP
              |||||||||||||||||| ||||||||||| |||||||||||||||||||| ||||||||
    a306     CQAVRKKALTEEREQTVGEKAQKKDAETVKKQAVKPSKETEKKASKEEKKAEKEKVAPKP
                    130        140        150        160        170        180
                170        180        190        200        210        220
    m306.pep  TPEQILNSGSIEKARSAAAKEVQKMKTPTRRKQRIICKWARMPTVRATKGSVPNWQSWAY
              |||||||||||||||||||||||||||||||||||||||||||:|| ||||||||||||
    a306     TPEQILNSGSIEKARSAAAKEVQKMKTPTRRKQRIICKWARMPTAGARKGSVPNWQSWAY
                    190        200        210        220        230        240
                230        240        250
    m306.pep  LPRWSVIRRDIKRFTGCKAAICLPMRX
              |||||||||||||||||||||||||||
    a306     LPRWSVIRRDIKRFTGCKAAICLPMRX
                    250        260
```

40

The following partial DNA sequence was identified in *N. gonorrhoeae* <SEQ ID 1271>:

```
g307.seq
  1 atgaaaacct tcttcaaaac cctttcgacc gcgtcactcg cgctcatcct 51 cgcagcctgc ggcggtcaaa aagacagcgc gcccgcagcc tctgccgccg 101 ccccttctgc cgataacggc gcggcgaaaa aagaaatcgt cttcggcacg 151 accgtgggcg acttcggcga tatggtcaaa gaacaaatcc aagccgagct 201 ggagaaaaaa ggctacaccg tcaaattggt cgaatttacc gactatgtgc 251 gcccgaatct ggcattggcg gagggcgagt tggacatcaa cgtcttccaa 301 cacaaaccct atcttgacga tttcaaaaaa gaacacaacc tggacatcac 351 cgaagccttc caagtgccga ccgcgccttt gggactgtat ccgggcaaac 401 tgaaatcgct ggaagaagtc aaagacggca gcaccgtatc cgcgcccaac 451 gacccgtcca acttcgcacg cgccttggtg atgctgaacg aactgggttg 501 gatcaaactc aaagacggca tcaatccgct gaccgcatcc aaagccgaca 551 tcgcggaaaa cctgaaaaac atcaaaatcg tcgagcttga agccgcacaa 601 ctgccgcgca gccgcgccga cgtggatttt gccgtcgtca acggcaacta
```

```
-continued
651 cgccataagc agcggcatga agctgaccga agccctgttc caagagccga 701 gctttgccta tgtcaactgg tctgccgtca aaaccgccga caaagacagc 751 caatggctta agacgtaac cgaggcctat aactccgacg cgttcaaagc 801 ctacgcgcac aaacgcttcg agggctacaa atacccctgcc gcatggaatg 851 aaggcgcagc caaataa
```

This corresponds to the amino acid sequence <SEQ ID 1272; ORF 307.ng>:

```
g307.pep
  1 MKTFFKTLST ASLALILAAC GGQKDSAPAA SAAAPSADNG AAKKEIVFGT

51 TVGDFGDMVK EQIQAELEKK GYTVKLVEFT DYVRPNLALA EGELDINVFQ

101 HKPYLDDFKK EHNLDITEAF QVPTAPLGLY PGKLKSLEEV KDGSTVSAPN

151 DPSNFARALV MLNELGWIKL KDGINPLTAS KADIAENLKN IKIVELEAAQ

201 LPRSRADVDF AVVNGNYAIS SGMKLTEALF QEPSFAYVNW SAVKTADKDS

251 QWLKDVTEAY NSDAFKAYAH KRFEGYKYPA AWNEGAAK*
```

The following partial DNA sequence was identified in *N. meningitidis* <SEQ ID 1273>:

```
m307.seq(partial)
  1 ..CAATGGCTTA AAGACGTAAC CGAGGCCTAT AACTCCGACG CGTTCAAAGC

51    CTACGCGCAC AAACGCTTCG AGGGCTACAA ATCCCCTGCC GCATGGAATG

101    AAGGCGCAGC CAAATAA
```

This corresponds to the amino acid sequence <SEQ ID 1274; ORF 307>:

```
m307.pep (partial)
  1 ..QWLKDVTEAY NSDAFKAYAH KRFEGYKSPA AWNEGAAK*
```

Computer analysis of this amino acid sequence gave the following results:

Homology with a Predicted ORF from *N. gonorrhoeae*

ORF 307 shows 97.4% identity over a 38 aa overlap with a predicted ORF (ORF 307.ng) from *N. gonorrhoeae*:

```
m307/g307
                                          10        20        30
m307.pep                           QWLKDVTEAYNSDAFKAYAHKRFEGYKSPA
                                   |||||||||||||||||||||||||||| ||
g307     SGMKLTEALFQEPSFAYVNWSAVKTADKDSQWLKDVTEAYNSDAFKAYAHKRFEGYKYPA
                 230       240       250       260       270       280
                          39
m307.pep AWNEGAAKX
         |||||||||
g307     AWNEGAAKX
```

The following partial DNA sequence was identified in *N. meningitidis* <SEQ ID 1275>:

```
a307.seq
  1 ATGAAAACCT TCTTCAAAAC CCTTTCCGCC GCCGCACTCG CGCTCATCCT

51 CGCCGCCTGC GGCGGTCAAA AAGATAGCGC GCCCGCCGCA TCCGCTTCTG

101 CCGCCGCCGA CAACGGCGCG GCGAAAAAAG NAATCGTCTT CGGCACGACC

151 GTCGGCGACT TCGGCGATAT GGTCAAAGAA CAAATCCAAC CCGAGCTGGA

201 GAAAAAGGC TACACCGTCA AACTGGTCGA GTTTACCGAC TATGTGCGCC
```

-continued

```
251 CGAATCTGGC ATTGGCTGAG GGCGAGTNGG ACATCAACGT CTTCCAACAC

301 AAACCCTATC TTGACGACTT CAAAAAAGAA CACAATCTGG ACATCACCGA

351 AGTCTTCCAA GTGCCGACCG CGCCTTTGGG ACTGTACCCG GGCAAGCTGA

401 AATCGCTGGA AGAAGTCAAA GACGGCAGCA CCGTATCCGC GCCCAACGAC

451 CCGTCCAACT TCGCCCGCGT CTTGGTGATG CTCGACGAAC TGGGTTGGAT

501 CAAACTCAAA GANGGCATCA ATCCGCTGAC CGCATCCAAA GCGGACATTG

551 CCGAAAACCT GAAAAACATC AAAATCGTCG AGCTTGAAGC CGCGCAACTG

601 CCGCGTAGCC GCGCCGACGT GGATTTTGNC GTCGTCAACG GCAANTACGC

651 CATAAGCAGC GGCATGAAGC TGACCGAAGC CCTGTTCCAA GAACCGAGCT

701 TTGCCTATGT CAACTGGTCT GCCGTCAAAA CCGCCGACAA AGACAGCCAA

751 TGGCTTAAAG ACGTAACCGA GGCCTATAAC TCCGACGCGT TCAAAGCCTA

801 CGCGCACAAA CGCTTCGAGG GCTACAAATC CCCTGCCGCA TGGAATGAAG

851 GCGCAGCCAA ATAA
```

This corresponds to the amino acid sequence <SEQ ID 1276; ORF 307.a>:

```
a307.pep
  1 MKTFFKTLSA AALALILAAC GGQKDSAPAA SASAAADNGA AKKXIVFGTT

51 VGDFGDMVKE QIQPELEKKG YTVKLVEFTD YVRPNLALAE GEXDINVFQH

101 KPYLDDFKKE HNLDITEVFQ VPTAPLGLYP GKLKSLEEVK DGSTVSAPND

151 PSNFARVLVM LDELGWIKLK XGINPLTASK ADIAENLKNI KIVELEAAQL

201 PRSRADVDFX VVNGXYAISS GMKLTEALFQ EPSFAYVNWS AVKTADKDSQ

251 WLKDVTEAYN SDAFKAYAHK RFEGYKSPAA WNEGAAK*
``` m307/a307 100.0% identity in 38 aa overlap

```
                                              10        20        30
    m307.pep                            QWLKDVTEAYNSDAFKAYAHKRFEGYKSPA
                                        ||||||||||||||||||||||||||||||
    a307        SGMKLTEALFQEPSFAYVNWSAVKTADKDSQWLKDVTEAYNSDAFKAYAHKRFEGYKSPA
                 220       230       240       250       260       270
                      39
    m307.pep  AWNEGAAKX
              |||||||||
    a307      AWNEGAAKX
              280
```

The following partial DNA sequence was identified in *N. gonorrhoeae* <SEQ ID 1277>:

```
g308.seq
  1 ATGTTAAATC GGGTATTTTA TCGGATATTG GGTGTTGCCG ACAATTTGTA

51 TCCGTGTTTA TCGGATTTCT GTTTTTTCAC TATAATAGCC GGTTTGCCGT

101 TGCAGGCGGT TTTATGGGAA AGGCGGATGA TGGTACGGCG TTTGATAATC

151 GGCATCAGCG GGGCGAGCGG TTTCCAATAC GGCGTGAAGG CTTTGGAACT

201 TTTGCGCGCG CAAGATGTCG AAACGCACCT TGTGGTATCG AAAGGCGCGG

251 AGATGGCGCG CGCTTCGGAA ACGGATTATA CGAAAGACGA AGTATATGCC

301 TTGGCTGATT TCGTCCATCC GATCGGCAAT ATCGGGGCGT GCATTGCCAG
```

-continued

```
351 CGGTACGTTT AAAACGGACG GGATGCTGGT CGCACCCTGT TCGATGCGGA

401 CGCTTGCCTC TGTCGCGCAC GGCTTCGGCG ACAACCTCTT GACGCGTGCG

451 GCGGATGTGG TTTTGAAGGA AAGGCGGCGG CTGGTGCTGA TGGTGCGCGA

501 AACGCCGCTG AACCTTGCCC ATTTGGACAA TATGAAGCGG GTAACGGAAA

551 TGGGCGGCGT GGTGTTTCCC CCTGTTCCTG CGATGTACCG CAAGCCGCAG

601 ACGGCGGACG ACATAGTGGC GCACAGTATC GCACACACGC TGTCGCTGTT

651 CGGAATCGAT ACGCCGGATT TGGCGGAATG GCAGGGAATG GCGGATTAA
```

This corresponds to the amino acid sequence <SEQ ID 1278; ORF 308.ng>:

```
g308.pep
  1 MLNRVFYRIL GVADNLYPCL SDFCFFTIIA GLPLQAVLWE RRMMVRRLII

51 GISGASGFQY GVKALELLRA QDVETHLVVS KGAEMARASE TDYTKDEVYA

101 LADFVHPIGN IGACIASGTF KTDGMLVAPC SMRTLASVAH GFGDNLLTRA

151 ADVVLKERRR LVLMVRETPL NLAHLDNMKR VTEMGGVVFP PVPAMYRKPQ

201 TADDIVAHSI AHTLSLFGID TPDLAEWQGM AD*
```

The following partial DNA sequence was identified in N. meningitidis <SEQ ID 1279>:

```
m308.seq (partial)
  1 ATGTTAAATC GGGTATTTTA TCGGATATTG GGTGTTGCCG ACAATTTGTA

51 TCCGCGTTTA TCGGATTTCT GTTTTTTCAC TATAATAGCC GGTTTGCCGT

101 TGCAGGCGGT TTTATGGGAA AGGCGGATGA TGGTACGGCG TTTGATAATC

151 GGCATCAGCG GGGCGAGCGG TTTCCAATAC GGCGTGAAGG CTTTGGAACT

201 TTTGCGCGCG CAAGATGTCG AAACGCACCT TGTGGTATCG AAAGGTGCGG

251 AGATGGCGCG CGCTTCGGAA ACGGCTTATG CGAGAGACGA GGTATATGCC

301 TTGGCGGACT TCGTGCATCC GATCGGCAAT ATCGGGGCGT GCATTGCCAG

351 CGGTACGTTT AAAACGGATG GGATGCTGGT CGCCCCCTGT TCGATGCGGA

401 CGCTTGCCTC TGTCGCGCAC GGCTTCGGCG ACAATCTGcT GACGCgTGCG

451 GCGGATGTGG TTTTGAAGGA AAGGCGGCGG CTGGTGCTGA TGGTGCGCGA

501 AACGCCGCTG AACCTTGCCC ATTTGGACAA TATGAAGCGG GwAACGGAAA

551 TGGGCGGCGT GGTGTTTCCC CCTGTTCCTG CGATGTACCG CAAACCGCAG

601 ACGGCGGACG ACATAGTGGC GCACAGTGTT GCACACGCtT TGTCGCTGTT

651 CGGAATCGAT ACGCCGGATT CGGCGGAATG GCArGGAATG gcG . . .
```

This corresponds to the amino acid sequence <SEQ ID 1280; ORF 308>:

```
m308.pep (partial)
  1 MLNRVFYRIL GVADNLYPRL SDFCFFTIIA GLPLQAVLWE RRMMVRRLII

51 GISGASGFQY GVKALELLRA QDVETHLVVS KGAEMARASE TAYARDEVYA

101 LADFVHPIGN IGACIASGTF KTDGMLVAPC SMRTLASVAH GFGDNLLTRA

151 ADVVLKERRR LVLMVRETPL NLAHLDNMKR XTEMGGVVFP PVPAMYRKPQ

201 TADDIVAHSV AHALSLFGID TPDSAEWQGM A..
```

Computer analysis of this amino acid sequence gave the following results:

Homology with a Predicted ORF from *N. gonorrhoeae*

ORF 308 shows 96.5% identity over a 231 aa overlap with a predicted ORF (ORF 308.ng) from *N. gonorrhoeae*:

```
m308/g308

10        20        30        40        50        60
     m308.pep MLNRVFYRILGVADNLYPRLSDFCFFTIIAGLPLQAVLWERRMMVRRLIIGISGASGFQY
              ||||||||||||||||||||||||||||||||||||||||||||||||||||||||||||
     g308     MLNRVFYRILGVADNLYPRLSDFCFFTIIAGLPLQAVLWERRMMVRRLIIGISGASGFQY
                  10        20        30        40        50        60

70        80        90       100       110       120
     m308.pep GVKALELLRAQDVETHLVVSKGAEMARASETAYARDEVYALADFVHPIGNIGACIASGTF
              |||||||||||||||||||||||||||||||||||::|||||||||||||||||||||||
     g308     GVKALELLRAQDVETHLVVSKGAEMARASETAYTKDEVYALADFVHPIGNIGACIASGTF
                  70        80        90       100       110       120

130       140       150       160       170       180
     m308.pep KTDGMLVAPCSMRTLASVAHGFGDNLLTRAADVVLKERRRLVLMVRETPLNLAHLDNMKR
              ||||||||||||||||||||||||||||||||||||||||||||||||||||||||||||
     g308     KTDGMLVAPCSMRTLASVAHGFGDNLLTRAADVVLKERRRLVLMVRETPLNLAHLDNMKR
                 130       140       150       160       170       180

190       200       210       220       230
     m308.pep XTEMGGVVFPPVPAMYRKPQTADDIVAHSVAHALSLFGIDTPDSAEWQGMA
              ||||||||||||||||||||||||||||||:||:||||||||||||||||||
     g308     XTEMGGVVFPPVPAMYRKPQTADDIVAHSIAHTLSLFGIDTPDSAEWQGMADX
                 190       200       210       220       230
```

The following partial DNA sequence was identified in *N. meningitidis* <SEQ ID 1281>:

```
a308.seq
  1 ATGTTAAATC GGATATTTTA TCGGATATTG GGTGTTGCCG ACAATTTGTA

51 TCCGTATTTA TCGGATTTCT GTTTTTTCAC TATAATAGCC GGTTTGCCGT

101 TGCAGGCGGT TTTATGGGAA AGGCGGATGA TGGTACGGCG TTTGATAATC

151 GGCATCAGTG GGGCGAGCGG TTTCCAATAC GGCGTGAAGG CTTTGGANCT

201 TTTACGCGCG CAAGATATCG AAACGCACCT TGTGGTATCG AAAGGTGCGG

251 AGATGGCGCG CGCTTCGGAA ACGGNTTATG CGAGAGACGA NGTATATGCC

301 TTGGCGGACT TNGTGCATCC GATCGGCAAT ATCGGGGCGT GCATTGCCAG

351 CGGTACGTTT AAAACGGACG GGATGCTGGT CGCCCCCTGT TCGATGCGGA

401 CGCTTGCCTC GGTCGTGCAC GGCTTCGGCG ACAACCTCTT GACGCGTGCG

451 GCGGATGTGG TTTTGAAGGA AAGGCGGCGG CTGGTGCTGA TGGTGCGCGA

501 AACGCCGCTG AACCTTGCCC ATTTGGACAA TATGAANCGG GTAACGGAAA

551 TGGGCGGCGT GGTGTTTCCC CCTGTTCCTG CGATGTACCG CAAACCGCAG

601 ACGGCGGACG ACATAGTGGC GCACAGTGTT GCACACGCTT TGTCGCTGTT

651 CGGAATCGAT ACGCCGGATT CGGCGGAATG GCAGGGAATG GCGGATTAA
```

This corresponds to the amino acid sequence <SEQ ID 1282; ORF 308.a>:

```
a308.pep
  1 MLNRIFYRIL GVADNLYPYL SDFCFFTIIA GLPLQAVLWE RRMMVRRLII

51 GISGASGFQY GVKALXLLRA QDIETHLVVS KGAEMARASE TXYARDXVYA

101 LADXVHPIGN IGACIASGTF KTDGMLVAPC SMRTLASVVH GFGDNLLTRA

151 ADVVLKERRR LVLMVRETPL NLAHLDNMXR VTEMGGVVFP PVPAMYRKPQ

201 TADDIVAHSV AHALSLFGID TPDSAEWQGM AD*
``` m308/a308 95.7% identity in 231 aa overlap

```
                10         20         30         40         50         60
m308.pep MLNRVFYRILGVADNLYPRLSDFCFFTIIAGLPLQAVLWERRMMVRRLIIGISGASGFQY
         ||||:|||||||||||||  ||||||||||||||||||||||||||||||||||||||||
a308     MLNRIFYRILGVADNLYPYLSDFCFFTIIAGLPLQAVLWERRMMVRRLIIGISGASGFQY
                10         20         30         40         50         60

70         80         90        100        110        120
m308.pep GVKALELLRAQDVETHLVVSKGAEMARASETAYARDEVYALADFVHPIGNIGACIASGTF
         ||||| ||||||:|||||||||||||||||||| ||||:|||||:|||||||||||||||
a308     GVKALXLLRAQDIETHLVVSKGAEMARASETXYARDXVYALADXVHPIGNIGACIASGTF
                70         80         90        100        110        120

130        140        150        160        170        180
m308.pep KTDGMLVAPCSMRTLASVAHGFGDNLLTRAADVVLKERRRLVLMVRETPLNLAHLDNMKR
         |||||||||||||||||:||||||||||||||||||||||||||||||||||||||||| |
a308     KTDGMLVAPCSMRTLASVVHGFGDNLLTRAADVVLKERRRLVLMVRETPLNLAHLDNMXR
               130        140        150        160        170        180

190        200        210        220        230
m308.pep XTEMGGVVFPPVPAMYRKPQTADDIVAHSVAHALSLFGIDTPDSAEWQGMA
          |||||||||||||||||||||||||||||||||||||||||||||||||||
a308     VTEMGGVVFPPVPAMYRKPQTADDIVAHSVAHALSLFGIDTPDSAEWQGMADX
               190        200        210        220        230
```

The following partial DNA sequence was identified in *N. gonorrhoeae* <SEQ ID 1283>:

```
g308-1.seq
  1 ATGTTAAATC GGGTATTTTA TCGGATATTG GGTGTTGCCG ACAATTTGTA

51 TCCGTGTTTA TCGGATTTCT GTTTTTTCAC TATAATAGCC GGTTTGCCGT

101 TGCAGGCGGT TTTATGGGAA AGGCGGATGA TGGTACGGCG TTTGATAATC

151 GGCATCAGCG GGGCGAGCGG TTTCCAATAC GGCGTGAAGG CTTTGGAACT

201 TTTGCGCGCG CAAGATGTCG AAACGCACCT TGTGGTATCG AAAGGCGCGG

251 AGATGGCGCG CGCTTCGGAA ACGGATTATA CGAAAGACGA AGTATATGCC

301 TTGGCTGATT TCGTCCATCC GATCGGCAAT ATCGGGGCGT GCATTGCCAG

351 CGGTACGTTT AAAACGGACG GGATGCTGGT CGCACCCTGT TCGATGCGGA

401 CGCTTGCCTC TGTCGCGCAC GGCTTCGGCG ACAACCTCTT GACGCGTGCG

451 GCGGATGTGG TTTTGAAGGA AAGGCGGCGG CTGGTGCTGA TGGTGCGCGA

501 AACGCCGCTG AACCTTGCCC ATTTGGACAA TATGAAGCGG GTAACGGAAA

551 TGGGCGGCGT GGTGTTTCCC CCTGTTCCTG CGATGTACCG CAAGCCGCAG

601 ACGGCGGACG ACATAGTGGC GCACAGTATC GCACACACGC TGTCGCTGTT

651 CGGAATCGAT ACGCCGGATT TGGCGGAATG GCAGGGAATG GCGGATTAA
```

This corresponds to the amino acid sequence <SEQ ID 1284; ORF 308-1.ng>:

```
g308-1.pep
  1 MLNRVFYRIL GVADNLYPCL SDFCFFTIIA GLPLQAVLWE RRMMVRRLII

51 GISGASGFQY GVKALELLRA QDVETHLVVS KGAEMARASE TDYTKDEVYA

101 LADFVHPIGN IGACIASGTF KTDGMLVAPC SMRTLASVAH GFGDNLLTRA

151 ADVVLKERRR LVLMVRETPL NLAHLDNMKR VTEMGGVVFP PVPAMYRKPQ

201 TADDIVAHSI AHTLSLFGID TPDLAEWQGM AD*
```

The following partial DNA sequence was identified in *N. meningitidis* <SEQ ID 1285>:

```
m308-1.seq
  1 ATGTTAAATC GGGTATTTTA TCGGATATTG GGTGTTGCCG ACAATTTGTA

51 TCCGCGTTTA TCGGATTTCT GTTTTTTCAC TATAATAGCC GGTTTGCCGT

101 TGCAGGCGGT TTTATGGGAA AGGCGGATGA TGGTACGGCG TTTGATAATC

151 GGCATCAGCG GGGCGAGCGG TTTCCAATAC GGCGTGAAGG CTTTGGAACT

201 TTTGCGCGCG CAAGATGTCG AAACGCACCT TGTGGTATCG AAAGGTGCGG

251 AGATGGCGCG CGCTTCGGAA ACGGCTTATG CGAGAGACGA GGTATATGCC

301 TTGGCGGACT TCGTGCATCC GATCGGCAAT ATCGGGGCGT GCATTGCCAG

351 CGGTACGTTT AAAACGGATG GGATGCTGGT CGCCCCCTGT TCGATGCGGA

401 CGCTTGCCTC TGTCGCGCAC GGCTTCGGCG ACAATCTGCT GACGCGTGCG

451 GCGGATGTGG TTTTGAAGGA AAGGCGGCGG CTGGTGCTGA TGGTGCGCGA

501 AACGCCGCTG AACCTTGCCC ATTTGGACAA TATGAAGCGG GTAACGGAAA

551 TGGGCGGCGT GGTGTTTCCC CCTGTTCCTG CGATGTACCG CAAACCGCAG

601 ACGGCGGACG ACATAGTGGC GCACAGTGTT GCACACGCTT TGTCGCTGTT

651 CGGAATCGAT ACGCCGGATT CGGCGGAATG GCAGGGAATG GCGGATTAA
                                                       30
```

This corresponds to the amino acid sequence <SEQ ID 1286; ORF 308-1>:

```
m308-1.pep

1 MLNRVFYRIL GVADNLYPRL SDFCFFTIIA GLPLQAVLWE RRMMVRRLII

51 GISGASGFQY GVKALELLRA QDVETHLVVS KGAEMARASE TAYARDEVYA

101 LADFVHPIGN IGACIASGTF KTDGMLVAPC SMRTLASVAH GFGDNLLTRA

151 ADVVLKERRR LVLMVRETPL NLAHLDNMKR VTEMGGVVFP PVPAMYRKPQ

201 TADDIVAHSV AHALSLFGID TPDSAEWQGM AD* m308-1/g308-1 97.0% identity in 232 aa overlap 10         20         30         40         50         60
m308-1.pep MLNRVFYRILGVADNLYPRLSDFCFFTIIAGLPLQAVLWERRMMVRRLIIGISGASGFQY
           |||||||||||||||||||| |||||||||||||||||||||||||||||||||||||||
g308-1     MLNRVFYRILGVADNLYPCLSDFCFFTIIAGLPLQAVLWERRMMVRRLIIGISGASGFQY
                10         20         30         40         50         60

70         80         90        100        110        120
m308-1.pep GVKALELLRAQDVETHLVVSKGAEMARASETAYARDEVYALADFVHPIGNIGACIASGTF
           |||||  |||||||||||||||||||||||| ::|||||||||||||||||||||||||
g308-1     GVKALXLLRAQDVETHLVVSKGAEMARASETDYKRDEVYALADFVHPIGNIGACIASGTF
                70         80         90        100        110        120

130        140        150        160        170        180
m308-1.pep KTDGMLVAPCSMRTLASVAHGFGDNLLTRAADVVLKERRRLVLMVRETPLNLAHLDNMKR
           ||||||||||||||||||||||||||||||||||||||||||||||||||||||||||||
g308-1     KTDGMLVAPCSMRTLASVAHGFGDNLLTRAADVVLKERRRLVLMVRETPLNLAHLDNMKR
               130        140        150        160        170        180

190        200        210        220        230
m308.pep   VTEMGGVVFPPVPAMYRKPQTADDIVAHSVAHALSLFGIDTPDSAEWQGMADX
           |||||||||||||||||||||||||||||:||:||||||||| |||||||||
g308       VTEMGGVVFPPVPAMYRKPQTADDIVAHSIAHTLSLFGIDTPDLAEWQGMADX
               190        200        210        220        230
```

The following partial DNA sequence was identified in *N. meningitidis* <SEQ ID 1287>:

```
a308-1.seq
  1 ATGTTAAATC GGATATTTTA TCGGATATTG GGTGTTGCCG ACAATTTGTA

51 TCCGTATTTA TCGGATTTCT GTTTTTTCAC TATAATAGCC GGTTTGCCGT

101 TGCAGGCGGT TTTATGGGAA AGGCGGATGA TGGTACGGCG TTTGATAATC

151 GGCATCAGTG GGGCGAGCGG TTTCCAATAC GGCGTGAAGG CTTTGGANCT

201 TTTACGCGCG CAAGATATCG A

```
  51 gctgtcgcct gttgcggcac ttgcgtgccg gcgcgctttg gggtgtttgg
 101 gtttggaaac gcaaatcaag tggccaaacg atttggtcgt cggacgcgac
 151 aaattgggcg gcattctgat tgaaacagtc agggcgggcg gtaaaacggt
 201 tgccgtggtc ggtatcggca tcaatttcgt gctgcccaag gaagtggaaa
 251 acgccgcttc cgtgcagtcg ctgtttcaga cggcatcgcg gcggggcaat
 301 gccgatgccg ccgtattgct ggaaacattg cttgcggaac tgggcgcggt
 351 gttggaacaa tatgcggaag aagggttcgc gccattttta aatgagtatg
 401 aaacggccaa ccgcgaccac ggcaaggcgg tattgctgtt gcgcgacggc
 451 gaaaccgtgt gcgaaggcac ggttaaaggc gtggacggac gaggcgttct
 501 gcacttggaa acggcagaag gcgaacagac ggtcgtcagc ggcgaaatca
 551 gcctgcggcc cgacaacagg tcggtttccg tgccgaagcg gccggattcg
 601 gaacgttttt tgctgttgga aggcgggaac agccggctca gtgggcgtg
 651 ggtggaaaac ggcacgttcg caaccgtggg cagcgcgccg taccgcgatt
 701 tgtcgccttt gggcgcggag tgggcggaaa aggcggatgg aaatgtccgc
 751 atcgtcggtt gcgccgtgtg cggagaatcc aaaaaggcac aagtgaagga
 801 acagctcgcc cgaaaaatcg agtggctgcc gtcttccgca caggctttgg
 851 gcatacgcaa ccactaccgc caccccgaag aacacggttc cgaccgttgg
 901 ttcaacgcct tgggcagccg ccgcttcagc cgcaacgcct gcgtcgtcgt
 951 cagttgcggc acggcggtaa cggttgacgc gctcaccgat gacggacatt
1001 atctcggcgg aaccatcatg cccggcttcc acctgatgaa agaatcgctc
1051 gccgtccgaa ccgccaacct caaccgcccc gccggcaaac gttacccttt
1101 cccgaccaca acgggcaacg ccgtcgcaag cggcatgatg gacgcggttt
1151 gcggctcgat aatgatgatg cacggccgtt gaaagaaaa aaacggcgcg
1201 ggcaagcctg tcgatgtcat cattaccggc ggcggcgcgg cgaaagtcgc
1251 cgaagccctg ccgcctgcat ttttggcgga aaataccgtg cgcgtggcgg
1301 acaacctcgt catccacggg ctgctgaacc tgattgccgc cgaaggcggg
1351 gaatcggaac acgcttaa
```

This corresponds to the amino acid sequence <SEQ ID 1290; ORF 311.ng>:

```
g311.pep
   1 MFSFGWAFDR PQYELGSLSP VAALACRRAL GCLGLETQIK WPNDLVVGRD
  51 KLGGILIETV RAGGKTVAVV GIGINFVLPK EVENAASVQS LFQTASRRGN
 101 ADAAVLLETL LAELGAVLEQ YAEEGFAPFL NEYETANRDH GKAVLLLRDG
 151 ETVCEGTVKG VDGRGVLHLE TAEGEQTVVS GEISLRPDNR SVSVPKRPDS
 201 ERFLLLEGGN SRLKWAWVEN GTFATVGSAP YRDLSPLGAE WAEKADGNVR
 251 IVGCAVCGES KKAQVKEQLA RKIEWLPSSA QALGIRNHYR HPEEHGSDRW
 301 FNALGSRRFS RNACVVVSCG TAVTVDALTD DGHYLGGTIM PGFHLMKESL
 351 AVRTANLNRP AGKRYPFPTT TGNAVASGMM DAVCGSIMMM HGRLKEKNGA
 401 GKPVDVIITG GGAAKVAEAL PPAFLAENTV RVADNLVIHG LLNLIAAEGG
 451 ESEHA*
```

The following partial DNA sequence was identified in *N. meningitidis* <SEQ ID 1291>:

```
m311.seq (partial)
     1 ATGTTCAGTT TTGGCTGGGT GTTTGACCGG CCGCAGTATG AGTTGGGTTC
    51 GCTGTCGCCT GTTGCGGCAG TGGCGTGTCG GCGCGCCTTG TCGCGTTTAG
   101 GTTTGGATGT GCArATTAAG TGGCCCAATG ATTTGGTTGT CGGACGCGAC
   151 AAATTGGGCG GCATTCTGAT TGAAACGGTC AGGACGGGCG GCAAAACGGT
   201 TGCCGTGGTC GGTATCGGCA TCAATTTTGT CCTGCCCAAn GAAGTAGAAA
   251 ATGCCGCTTC CGTGCAATCG CTGTTTCAGA CGGCATCGCG GCGGGGCAAT
   301 GCCGATGCCG CCGTGCTGCT nnnnnnnnnn nnnnnnnnnn nnnnGGAAAT
   351 CAGCCTGCGG TCCGACnACA GGCCGGTTTC CGTGnCGAAG CGGCGGGATT
   401 CGGAACGTTT TCTGCTGTTG GACGGCGGCA ACAGCCGGCT CAAGTGGgCG
   451 TGGGTGGAAA ACGGCACGTT CGCAACCGTC GGTAGCGCGC CGTACCgCGA
   501 TTTGTCGCCT TTGGGCGCGG AGTGGGCGGA AAAGGCGGAT GGAAATGTCC
   551 GCATCGTCGG TTGCGCTGTG TGCGGAGAAT TCAAAAAGGC ACAAGTGCAG
   601 GAACAGCTCG CCCGAAAAAT CGAGTGGCTG CCGTCTTCCG CACAGGCTTT
   651 GTTTGGCATA CGCAACCACT ACCGCCACCC CGAAGAACAC GGTTCCGACC
   701 GCTGGTTCAA CGCCTTGGGC AGCCGCCGCT TCAGCCGCAA CGCyTGCGTC
   751 GTCGTCAGTT GCGGCACGGC GGTAACGGTT GACGCGCTCA CCGATGACGG
   801 ACATTATCTC GGrgGAACCA TCATGCCCGG TTTCCACCTG ATGAAAGAAT
   851 CGCTCGCCGT CCGAACCGCC AACCTCAACC GGCACGCCGG TAAGCGTTAT
   901 CCTTTCCCGA CCACAACGGG CAATGCCGTC GCCAGCGGCA TGATGGATGC
   951 GGTTTGCGGC TCGGTTATGA TGATGCACGG GCGTTTGAAA GAAAAAACCG
  1001 GGGCGGGCAA GCCTGTCGAT GTCATCATTA CCGGCGGCGG CGCGGCAAAA
  1051 GTTGCCGAAG CCCTGCCGCC TGCATTTTTG GCGGAAAATA CCGTGCGCGT
  1101 GGCGGACAAC CTCGTCATTT ACGGGTTGTT GAACATGATT GCCGCCGAAG
  1151 GCAGGGAATA TGAACAT....
```

This corresponds to the amino acid sequence <SEQ ID 1292; ORF 311>:

```
m311.pep (partial)
     1 MFSFGWVFDR PQYELGSLSP VAAVACRRAL SRLGLDVQIK WPNDLVVGRD
    51 KLGGILIETV RTGGKTVAVV GIGINFVLPX EVENAASVQS LFQTASRRGN
   101 ADAAVLLXXX XXXXXEISLR SDXRPVSVXK RRDSERFLLL DGGNSRLKWA
   151 WVENGTFATV GSAPYRDLSP LGAEWAEKAD GNVRIVGCAV CGEFKKAQVQ
   201 EQLARKIEWL PSSAQALFGI RNHYRHPEEH GSDRWFNALG SRRFSRNACV
   251 VVSCGTAVTV DALTDDGHYL GGTIMPGFHL MKESLAVRTA NLNRHAGKRY
   301 PFPTTTGNAV ASGMMDAVCG SVMMMHGRLK EKTGAGKPVD VIITGGGAAK
   351 VAEALPPAFL AENTVRVADN LVIYGLLNMI AAEGREYEH....
```

Computer analysis of this amino acid sequence gave the following results:
Homology with a Predicted ORF from N. gonorrhoeae
ORF 311 shows 78.5% identity over a 455 aa overlap with a predicted ORF (ORF 311.ng) from N. gonorrhoeae:

```
m311/g311
                    10        20        30        40        50        60
    m311.pep  MFSFGWVFDRPQYELGSLSPVAAVACRRALSRLGLDVQIKWPNDLVVGRDKLGGILIETV
              ||||||:||||||||||||||:||||||:|||::||||||||||||||||||||||||
    g311      MFSFGWAFDRPQYELGSLSPVAALACRRALGCLGLETQIKWPNDLVVGRDKLGGILIETV
                    10        20        30        40        50        60

70        80        90        100       110
    m311.pep  RTGGKTVAVVGIGINFVLPXEVENAASVQSLFQTASRRGNADAAVLLXXX----------
              |:||||||||||||||||| ||||||||||||||||||||||||||| :
    g311      RAGGKTVAVVGIGINFVLPKEVENAASVQSLFQTASRRGNADAAVLLETLLAELGAVLEQ
                    70        80        90        100       110       120 m311.pep  --------------------------------------------------------XXXX
                                                                      :
    g311      YAEEGFAPFLNEYETANRDHGKAVLLLRDGETVCEGTVKGVDGRGVLHLETAEGEQTVVS
                    130       140       150       160       170       180

120       130       140       150       160       170
    m311.pep  XEISLRSDXRPVSVXKRRDSERFLLLDGGNSRLKWAWVENGTFATVGSAPYRDLSPLGAE
              |||||  |   |||  ||  ||||||||:||||||||||||:|||||||||||||||||
    g311      GEISLRPDNRSVSVPKRPDSERFLLLEGGNSRLKWAWVEMGTFATVGSAPYRDLSPLGAE
                    190       200       210       220       230       240

180       190       200       210       220       230
    m311.pep  WAEKADGNVRIVGCAVCGEFKKAQVQEQLARKIEWLPSSAQALFGIRNHYRHPEEHGSDR
              ||||||||||||||||||| |||||:|||||||||||||||| |||||||||||||||
    g311      WAEKADGNVRIVGCAVCGESKKAQVKEQLARKIEWLPSSAQAL-GIRNHYRHPEEHGSDR
                    250       260       270       280       290

240       250       260       270       280       290
    m311.pep  WFNALGSRRFSRNACVVVSCGTAVTVDALTDDGHYLGGTIMPGFHLMKESLAVRTANLNR
              ||||||||||||||||||||||||||||||||||||||||||||||||||||||||||||
    g311      WFNALGSRRFSRNACVVVSCGTAVTVDALTDDGHYLGGTIMPGFHLMKESLAVRTANLNR
                   300        310       320       330       340       350

300       310       320       330       340       350
    m311.pep  HAGKRYPFPTTTGNAVASGMMDAVCGSVMMMHGRLKEKTGAGKPVDVIITGGGAAKVAEA
              |||||||||||||||||||||||||||:||||||||||:|||||||||||||||||||
    g311      PAGKRYPFPTTTGNAVASGMMDAVCGSIMMMHGRLKEKNGAGKPVDVIITGGGAAKVAEA
                    360       370       380       390       400       410

360       370       380       389
    m311.pep  LPPAFLAENTVRVADNLVIYGLLNMIAAEGREYEH
              |||||||||||||||||||:||||:|||| | ||
    g311      LPPAFLAENTVRVADNLVIHGLLNLIAAEGGESEHAX
                    420       430       440       450
```

The following partial DNA sequence was identified in N. meningitidis <SEQ ID 1293>:

```
a311.seq
    1  ATGTTCAGTT TTGGCTGGGT GTTTGACCGG CCGCAGTATG AGTTGGGTTC

51  GCTGTCGCCT GTTGCGGCAG TGGCGTGCCG GCGCGCCTTG TCGCGTTTGG

101  GTTTGAAAAC GCAAATCAAG TGGCCAAACG ATTTGGTCGT CGGACGCGAC

151  AAAATTGGGCG GCATTCTGAT TGAAACGGTC AGGACGGGCG GCAAAACGGT

201  TGCCGTGGTC GGTATCGGCA TCAATTTCGT GCTGCCCAAG GAAGTGGAAA

251  ACGCCGCTTC CGTGCAATCG CTGTTTCAGA CGGCATCGCG GCGGGGAAAT

301  GCCGATGCCG CCGTGTTGCT GGAAACGCTG TTGGCGGAAC TTGATGCGGT

351  GTTGTTGCAA TATGCGCGGG ACGGATTTGC GCCTTTTGTG GCGGAATATC

401  AGGCTGCCAA CCGCGACCAC GGCAAGGCGG TATTGCTGTT GCGCGACGGC

451  GAAACCGTGT CGAAGGCAC GGTTAAAGGC GTGGACGGAC AAGGCGTTCT

501  GCACTTGGAA ACGGCAGAGG GCAAACAGAC GGTCGTCAGC GGCGAAATCA

551  GCCTGCGGTC CGACGACAGG CCGGTTTCCG TGCCGAAGCG GCGGGATTCG
```

```
 601  GAACGTTTTC TGCTGTTGGA CGGCGGCAAC AGCCGGCTCA AGTGGGCGTG

651  GGTGGAAAAC GGCACGTTCG CAACCGTCGG TAGCGCGCCG TACCGCGATT

701  TGTCGCCTTT GGGCGCGGAG TGGGCGGAAA AGGTGGATGG AAATGTCCGC

751  ATCGTCGGTT GCGCCGTGTG CGGAGAATTC AAAAAGGCAC AAGTGCAGGA

801  ACAGCTCGCC CGAAAAATCG AGTGGCTGCC GTCTTCCGCA CAGGCTTTGG

851  GCATACGCAA CCACTACCGC CACCCCGAAG AACACGGTTC CGACCGCTGG

901  TTCAACGCCT TGGGCAGCCG CCGCTTCAGC CGCAACGCCT GCGTCGTCGT

951  CAGTTGCGGC ACGGCGGTAA CGGTTGACGC GCTCACCGAT GACGGACATT

1001  ATCTCGGGGG AACCATCATG CCCGGTTTCC ACCTGATGAA AGAATCGCTC

1051  GCCGTCCGAA CCGCCAACCT CAACCGGCAC GCCGGTAAGC GTTATCCTTT

1101  CCCGACCACA ACGGGCAATG CCGTCGCCAG CGGCATGATG GATGCGGTTT

1151  GCGGCTCGGT TATGATGATG CACGGGCGTT TGAAAGAAAA AACCGGGGCG

1201  GGCAAGCCTG TCGATGTCAT CATTACCGGC GGCGGCGCGG CAAAAGTTGC

1251  CGAAGCCCTG CCGCCTGCAT TTTTGGCGGA AAATACCGTG CGCGTGGCGG

1301  ACAACCTCGT CATTCACGGG CTGCTGAACC TGATTGCCGC CGAAGGCGGG

1351  GAATCGGAAC ATACTTAA
```

This corresponds to the amino acid sequence <SEQ ID 1294; ORF 311.a>:

```
a311.pep
  1  MFSFGWVFDR PQYELGSLSP VAAVACRRAL SRLGLKTQIK WPNDLVVGRD

51  KLGGILIETV RTGGKTVAVV GIGINFVLPK EVENAASVQS LFQTASRRGN

101  ADAAVLLETL LAELDAVLLQ YARDGFAPFV AEYQAANRDH GKAVLLLRDG

151  ETVFEGTVKG VDGQGVLHLE TAEGKQTVVS GEISLRSDDR PVSVPKRRDS

201  ERFLLLDGGN SRLKWAWVEN GTFATVGSAP YRDLSPLGAE WAEKVDGNVR

251  IVGCAVCGEF KKAQVQEQLA RKIEWLPSSA QALGIRNHYR HPEEHGSDRW

301  FNALGSRRFS RNACVVVSCG TAVTVDALTD DGHYLGGTIM PGFHLMKESL

351  AVRTANLNRH AGKRYPFPTT TGNAVASGMM DAVCGSVMMM HGRLKEKTGA

401  GKPVDVIITG GGAAKVAEAL PPAFLAENTV RVADNLVIHG LLNLIAAEGG

451  ESEHT*
``` m311/a311 81.3% identity in 455 aa overlap

```
                  10         20         30         40         50         60
    m311.pep  MFSFGWVFDRPQYELGSLSPVAAVACRRALSRLGLDVQIKWPNDLVVGRDKLGGILIETV
              |||||||||||||||||||||||||||||||||||| :||||||||||||||||||||||
    a311      MFSFGWVFDRPQYELGSLSPVAAVACRRALSRLGLKTQIKWPNDLVVGRDKLGGILIETV
                  10         20         30         40         50         60

70         80         90        100        110
    m311.pep  RTGGKTVAVVGIGINFVLPXEVENAASVQSLFQTASRRGNADAAVLLXXXXXXXX-----
              |||||||||||||||||||| |||||||||||||||||||||||||| :
    a311      RTGGKTVAVVGIGINFVLPKEVENAASVQSLFQTASRRGNADAAVLLETLLAELDAVLLQ
                  70         80         90        100        110        120 m311.pep  ------------------------------------------------------------ a311      YARDGFAPFVAEYQAANRDHGKAVLLLRDGETVFEGTVKGVDGQGVLHLETAEGKQTVVS
                 130        140        150        160        170        180
```

```
                120       130       140       150       160       170
m311.pep   -EISLRSDXRPVSVXKRRDSERFLLLDGGNSRLKWAWVENGTFATVGSAPYRDLSPLGAE
            |||||| |||||  |||||||||||||||||||||||||||||||||||||||||||
a311       GEISLRSDDRPVSVPKRRDSERFLLLDGGNSRLKWAWVENGTFATVGSAPYRDLSPLGAE
                 190       200       210       220       230       240

180       190       200       210       220       230
m311.pep   WAEKADGNVRIVGCAVCGEFKKAQVQEQLARKIEWLPSSAQALFGIRNHYRHPEEHGSDR
           ||||:||||||||||||||||||||||||||||||||||||| ||||||||||||||||
a311       WAEKVDGNVRIVGCAVCGEFKKAQVQEQLARKIEWLPSSAQAL-GIRNHYRHPEEHGSDR
                 250       260       270       280       290

240       250       260       270       280       290
m311.pep   WFNALGSRRFSRNACVVVSCGTAVTVDALTDDGHYLGGTIMPGFHLMKESLAVRTANLNR
           ||||||||||||||||||||||||||||||||||||||||||||||||||||||||||||
a311       WFNALGSRRFSRNACVVVSCGTAVTVDALTDDGHYLGGTIMPGFHLMKESLAVRTANLNR
              300       310       320       330       340       350

300       310       320       330       340       350
m311.pep   HAGKRYPFPTTTGNAVASGMMDAVCGSVMMMHGRLKEKTGAGKPVDVIITGGGAAKVAEA
           ||||||||||||||||||||||||||||||||||||||||||||||||||||||||||||
a311       HAGKRYPFPTTTGNAVASGMMDAVCGSVMMMHGRLKEKTGAGKPVDVIITGGGAAKVAEA
              360       370       380       390       400       410

360       370       380   389
m311.pep   LPPAFLAENTVRVADNLVIYGLLNMIAAEGREYEH
           ||||||||||||||||||||:|||:||||| | ||
a311       LPPAFLAENTVRVADNLVIHGLLNLIAAEGGESEHTX
              420       430       440       450
```

The following partial DNA sequence was identified in *N. gonorrhoeae* <SEQ ID 1295>:

```
g311-1.seq
   1 ATGACGGTTT TGAAGCCTTC GCATTGGCGG GTGTTGGCGG AGCTTGCCGA

51 CGGTTTGCCG CAACACGTAT CGCAATTGGC GCGTGAGGCG GACATGAAGC

101 CGCAGCAGCT CAACGGTTTT TGGCAGCAGA TGCCGGCGCA TATACGCGGG

151 CTGTTGCGCC AACACGACGG CTATTGGCGG CTGGTGCGCC CCTTGGCGGT

201 TTTCGATGCC GAAGGTTTGC GCGATCTGGG GGAAAGGTCG GGTTTTCAGA

251 CGGCATTGAA GCACGAGTGC GCGTCCAGCA ACGACGAGAT ACTGGAATTG

301 GCGCGGATTG CGCCGGACAA GGCGCACAAA ACCATATGCG TGACCCACCT

351 GCAAAGTAAG GGCAGGGGGC GGCAGGGGCG GAAGTGGTCG CACCGTTTGG

401 GCGAGTGCCT GATGTTCAGT TTCGGCTGGG CGTTTGACCG GCCGCAGTAT

451 GAGTTGGGTT CGCTGTCGCC TGTTGCGGCA CTTGCGTGCC GGCGCGCTTT

501 GGGGTGTTTG GGTTTGGAAA CGCAAATCAA GTGGCCAAAC GATTTGGTCG

551 TCGGACGCGA CAAATTGGGC GGCATTCTGA TTGAAACAGT CAGGGCGGGC

601 GGTAAAACGG TTGCCGTGGT CGGTATCGGC ATCAATTTCG TGCTGCCCAA

651 GGAAGTGGAA AACGCCGCTT CCGTGCAGTC GCTGTTTCAG ACGGCATCGC

701 GGCGGGGCAA TGCCGATGCC GCCGTATTGC TGGAAACATT GCTTGCGGAA

751 CTGGGCGCGG TGTTGGAACA ATATGCGGAA GAAGGGTTCG CGCCATTTTT

801 AAATGAGTAT GAAACGGCCA ACCGCGACCA CGGCAAGGCG GTATTGCTGT

851 TGCGCGACGG CGAAACCGTG TGCGAAGGCA CGGTTAAAGG CGTGGACGGA

901 CGAGGCGTTC TGCACTTGGA AACGGCAGaa ggCGAACAGa cggtcGtcag 951 cggcGaaaTC AGccTGCGGc CCGacaacag gtcggttttcc GTgccgaagc 1001 gGccggatTC GgaacgttTT tTGCTgttgg aaggcgggaa cagccggctc 1051 aAGTGGgcgt gGGTggAAAA Cggcacgttc gcaaccgtgg gcAGCGCgCC
```

```
-continued
1101  gtaCCGCGAT TTGTCGCCTT TGGGCGCGGA GTGGGCGGAA AAGGCGGATG

1151  GAAATGTCCG CATCGTCGGT TGCGCCGTGT GCGGAGAATC CAAAAAGGCA

1201  CAAGTGAAGG AACAGCTCGC CCGAAAAATC GAGTGGCTGC CGTCTTCCGC

1251  ACAGGCTTTG GGCATACGCA ACCACTACCG CCACCCCGAA GAACACGGTT

1301  CCGACCGTTG GTTCAACGCC TTGGGCAGCC GCCGCTTCAG CCGCAACGCC

1351  TGCGTCGTCG TCAGTTGCGG CACGGCGGTA ACGGTTGACG CGCTCACCGA

1401  TGACGGACAT TATCTCGGCG GAACCATCAT GCCCGGCTTC CACCTGATGA

1451  AAGAATCGCT CGCCGTCCGA ACCGCCAACC TCAACCGCCC CGCCGGCAAA

1501  CGTTACCCTT TCCCGACCAC AACGGGCAAC GCCGTCGCAA GCGGCATGAT

1551  GGACGCGGTT TGCGGCTCGA TAATGATGAT GCACGGCCGT TTGAAAGAAA

1601  AAAACGGCGC GGGCAAGCCT GTCGATGTCA TCATTACCGG CGGCGGCGCG

1651  GCGAAAGTCG CCGAAGCCCT GCCGCCTGCA TTTTTGGCGG AAAATACCGT

1701  GCGCGTGGCG GACAACCTCG TCATCCACGG GCTGCTGAAC CTGATTGCCG

1751  CCGAAGGCGG GGAATCGGAA CACGCTTAA
```

This corresponds to the amino acid sequence <SEQ ID 1296; ORF 311-1.ng>:

```
g311-1.pep
  1  MTVLKPSHWR VLAELADGLP QHVSQLAREA DMKPQQLNGF WQQMPAHIRG

51  LLRQHDGYWR LVRPLAVFDA EGLRDLGERS GFQTALKHEC ASSNDEILEL

101  ARIAPDKAHK TICVTHLQSK GRGRQGRKWS HRLGECLMFS FGWAFDRPQY

151  ELGSLSPVAA LACRRALGCL GLETQIKWPN DLVVGRDKLG GILIETVRAG

201  GKTVAVVGIG INFVLPKEVE NAASVQSLFQ TASRRGNADA AVLLETLLAE

251  LGAVLEQYAE EGFAPFLNEY ETANRDHGKA VLLLRDGETV CEGTVKGVDG

301  RGVLHLETAE GEQTVVSGEI SLRPDNRSVS VPKRPDSERF LLLEGGNSRL

351  KWAWVENGTF ATVGSAPYRD LSPLGAEWAE KADGNVRIVG CAVCGESKKA

401  QVKEQLARKI EWLPSSAQAL GIRNHYRHPE EHGSDRWFNA LGSRRFSRNA

451  CVVVSCGTAV TVDALTDDGH YLGGTIMPGF HLMKESLAVR TANLNRPAGK

501  RYPFPTTTGN AVASGMMDAV CGSIMMMHGR LKEKNGAGKP VDVIITGGGA

551  AKVAEALPPA FLAENTVRVA DNLVIHGLLN LIAAEGGESE HA*
```

The following partial DNA sequence was identified in *N. meningitidis* <SEQ ID 1297>:

```
m311-1.seq
  1  ATGACGGTTT TGAAGCTTTC GCACTGGCGG GTGTTGGCGG AGCTTGCCGA

51  CGGTTTGCCG CAACACGTCT CGCAACTGGC GCGTATGGCG GATATGAAGC

101  CGCAGCAGCT CAACGGTTTT TGGCAGCAGA TGCCGGCGCA CATACGCGGG

151  CTGTTGCGCC AACACGACGG CTATTGGCGG CTGGTGCGCC CATTGGCGGT

201  TTTCGATGCC GAAGGTTTGC GCGAGCTGGG GGAAAGGTCG GGTTTTCAGA

251  CGGCATTGAA GCACGAGTGC GCGTCCAGCA ACGACGAGAT ACTGGAATTG

301  GCGCGGATTG CGCCGGACAA GGCGCACAAA ACCATATGCG TGACCCACCT

351  GCAAAGTAAG GGCAGGGGGC GGCAGGGGCG GAAGTGGTCG CACCGTTTGG
```

-continued

```
 401 GCGAGTGTCT GATGTTCAGT TTTGGCTGGG TGTTTGACCG GCCGCAGTAT
 451 GAGTTGGGTT CGCTGTCGCC TGTTGCGGCA GTGGCGTGTC GGCGCGCCTT
 501 GTCGCGTTTA GGTTTGGATG TGCAGATTAA GTGGCCCAAT GATTTGGTTG
 551 TCGGACGCGA CAAATTGGGC GGCATTCTGA TTGAAACGGT CAGGACGGGC
 601 GGCAAAACGG TTGCCGTGGT CGGTATCGGC ATCAATTTTG TCCTGCCCAA
 651 GGAAGTAGAA AATGCCGCTT CCGTGCAATC GCTGTTTCAG ACGGCATCGC
 701 GGCGGGGCAA TGCCGATGCC GCCGTGCTGC TGGAAACGCT GTTGGTGGAA
 751 CTGGACGCGG TGTTGTTGCA ATATGCGCGG GACGGATTTG CGCCTTTTGT
 801 GGCGGAATAT CAGGCTGCCA ACCGCGACCA CGGCAAGGCG GTATTGCTGT
 851 TGCGCGACGG CGAAACCGTG TTCGAAGGCA CGGTTAAAGG CGTGGACGGA
 901 CAAGGCGTTT TGCACTTGGA AACGGCAGAG GGCAAACAGA CGGTCGTCAG
 951 CGGCGAAATC AGCCTGCGGT CCGACGACAG GCCGGTTTCC GTGCCGAAGC
1001 GGCGGGATTC GGAACGTTTT CTGCTGTTGG ACGGCGGCAA CAGCCGGCTC
1051 AAGTGGGCGT GGGTGGAAAA CGGCACGTTC GCAACCGTCG GTAGCGCGCC
1101 GTACCGCGAT TTGTCGCCTT TGGGCGCGGA GTGGGCGGAA AAGGCGGATG
1151 GAAATGTCCG CATCGTCGGT TGCGCTGTGT GCGGAGAATT CAAAAAGGCA
1201 CAAGTGCAGG AACAGCTCGC CCGAAAAATC GAGTGGCTGC CGTCTTCCGC
1251 ACAGGCTTTG GGCATACGCA ACCACTACCG CCACCCCGAA GAACACGGTT
1301 CCGACCGCTG GTTCAACGCC TTGGGCAGCC GCCGCTTCAG CCGCAACGCC
1351 TGCGTCGTCG TCAGTTGCGG CACGGCGGTA ACGGTTGACG CGCTCACCGA
1401 TGACGGACAT TATCTCGGGG AACCATCAT GCCCGGTTTC CACCTGATGA
1451 AAGAATCGCT CGCCGTCCGA ACCGCCAACC TCAACCGGCA CGCCGGTAAG
1501 CGTTATCCTT TCCCGACCAC AACGGGCAAT GCCGTCGCCA GCGGCATGAT
1551 GGATGCGGTT TGCGGCTCGG TTATGATGAT GCACGGGCGT TTGAAAGAAA
1601 AAACCGGGGC GGGCAAGCCT GTCGATGTCA TCATTACCGG CGGCGGCGCG
1651 GCAAAAGTTG CCGAAGCCCT GCCGCCTGCA TTTTTGGCGG AAAATACCGT
1701 GCGCGTGGCG GACAACCTCG TCATTTACGG GTTGTTGAAC ATGATTGCCG
1751 CCGAAGGCAG GGAATATGAA CATATTTAA
```

This corresponds to the amino acid sequence <SEQ ID 1298; ORF 311-1>:

```
m311-1.pep

1 MTVLKLSHWR VLAELADGLP QHVSQLARMA DMKPQQLNGF WQQMPAHIRG
     51 LLRQHDGYWR LVRPLAVFDA EGLRELGERS GRQTALKHEC ASSNDEILEL
    101 ARIAPDKAHK TICVTHLQSK GRGRQGRKWS HRLGECLMFS FGWVFDRPQY
    151 ELGSLSPVAA VACRRALSRL GLDVQIKWPN DLVVGRDKLG GILIETVRTG
    201 GKTVAVVGIG INFVLPKEVE NAASVQSLFQ TASRRGNADA AVLLETLLVE
    251 LDAVLLQYAR DGFAPFVAEY QAANRDHGKA VLLLRDGETV FEGTVKGVDG
    301 QGVLHLETAE GKQTVVSGEI SLRSDDRPVS VPKRRDSERF LLLDGGNSRL
    351 KWAWVENGTF ATVGSAPYRD LSPLGAEWAE KADGNVRIVG CAVCGEFKKA
    401 QVQEQLARKI EWLPSSAQAL GIRNHYRHPE EHGSDRWFNA LGSRRFSRNA
```

-continued

```
451  CVVVSCGTAV  TVDALTDDGH  YLGGTIMPGF  HLMKESLAVR  TANLNRHAGK

501  RYPFPTTTGN  AVASGMMDAV  CGSVMMMHGR  LKEKTGAGKP  VDVIITGGGA

551  AKVAEALPPA  FLAENTVRVA  DNLVIYGLLN  MIAAEGREYE  HI*
```

```
m311-1/g311-1  93.9% identity in 591 aa overlap 10        20        30        40        50        60
m311-1.pep      MTVLKLSHWRVLAELADGLPQHVSQLARMADMKPQQLNGFWQQMPAHIRGLLRQHDGYWR
                |||||||||||||||||||||||||||| |||||||||||||||||||||||||||||||
g311-1          MTVLKLSHWRVLAELADGLPQHVSQLAREADMKPQQLNGFWQQMPAHIRGLLRQHDGYWR
                        10        20        30        40        50        60

70        80        90       100       110       120
m311-1.pep      LVRPLAVFDAEGLRELGERSGFQTALKHECASSNDEILELARIAPDKAHKTICVTHLQSK
                ||||||||||||||:|||||||||||||||||||||||||||||||||||||||||||||
g311-1          LVRPLAVFDAEGLRDLGERSGFQTALKHECASSNDEILELARIAPDKAHKTICVTHLQSK
                        70        80        90       100       110       120

130       140       150       160       170       180
m311-1.pep      GRGRQGRKWSHRLGECLMFSFGWVFDRPQYELGSLSPVAAVACRRALSRLGLDVQIKWPN
                |||||||||||||||||||||||:||||||||||||||||:||||||: |||::||||||
g311-1          GRGRQGRKWSHRLGECLMFSFGWAFDRPQYELGSLSPVAALACRRALGCLGLETQIKWPN
                       130       140       150       160       170       180

190       200       210       220       230       240
m311-1.pep      DLVVGRDKLGGILIETVRTGGKTVAVVGIGINFVLPKEVENAASVQSLFQTASRRGNADA
                ||||||||||||||||||:|||||||||||||||||||||||||||||||||||||||||
g311-1          DLVVGRDKLGGILIETVRAGGKTVAVVGIGINFVLPKEVENAASVQSLFQTASRRGNADA
                       190       200       210       220       230       240

250       260       270       280       290       300
m311-1.pep      AVLLETLLVELDAVLLQYARDGFAPFVAEYQAANRDHGKAVLLLRDGETVFEGTVKGVDG
                ||||||||:|| ||| |||::|||||: ||::|||||||||||||||||| |||||||||
g311-1          AVLLETLLAELGAVLEQYAEEGFAPFLNEYETANRDHGKAVLLLRDGETVCEGTVKGVDG
                       250       260       270       280       290       300

310       320       330       340       350       360
m311-1.pep      QGVLHLETAEGKQTVVSGEISLRSDDRPVSVPKRRDSERFLLLDGGNSRLKWAWVENGTF
                :||||||||||:||||||||||| |:| |||||| ||||||||:||||||||||||||||
g311-1          RGVLHLETAEGEQTVVSGEISLRPDNRSVSVPKRPDSERFLLLEGGNSRLKWAWVENGTF
                       310       320       330       340       350       360

370       380       390       400       410       420
m311-1.pep      ATVGSAPYRDLSPLGAEWAEKADGNVRIVGCAVCGEFKKAQVQEQLARKIEWLPSSAQAL
                ||||||||||||||||||||||||||||||||||||| |||||:||||||||||||||||
g311-1          ATVGSAPYRDLSPLGAEWAEKADGNVRIVGCAVCGESKKAQVKEQLARKIEWLPSSAQAL
                       370       380       390       400       410       420

430       440       450       460       470       480
m311-1.pep      GIRNHYRHPEEHGSDRWFNALGSRRFSRNACVVVSCGTAVTVDALTDDGHYLGGTIMPGF
                |||||||||||||||||||||||:||||||||||||||||:||||||: |||::||||||
g311-1          GIRNHYRHPEEHGSDRWFNALGSRRFSRNACVVVSCGTAVTVDALTDDGHYLGGTIMPGF
                       430       440       450       460       470       480

490       500       510       520       530       540
m311-1.pep      HLMKESLAVRTANLNRHAGKRYPFPTTTGNAVASGMMDAVCGSVMMMHGRLKEKTGAGKP
                |||||||||||||||| ||||||||||||||||||||||||||:||||||||||:|||||
g311-1          HLMKESLAVRTANLNRPAGKRYPFPTTTGNAVASGMMDAVCGSIMMMHGRLKEKNGAGKP
                       490       500       510       520       530       540

550       560       570       580       590
m311-1.pep      VDVIITGGGAAKVAEALPPAFLAENTVRVADNLVIYGLLNMIAAEGREYEHIX
                |||||||||||||||||||||||||||||||||||:||||:||||| | ||
g311-1          VDVIITGGGAAKVAEALPPAFLAENTVRVADNLVIHGLLNLIAAEGGESEHAX
                       550       560       570       580       590
```

The following partial DNA sequence was identified in *N. meningitidis* <SEQ ID 1299>:

```
a311-1.seq
     1  ATGACGGTTT TGAAGCCTTC GCACTGGCGG GTGTTGGCGG AGCTTGCCGA

51  CGGTTTGCCG CAACACGTCT CGCAACTGGC GCGTATGGCG GATATGAAGC

101  CGCAGCAGCT CAACGGTTTT TGGCAGCAGA TGCCGGCGCA CATACGCGGG
```

```
 151 CTGTTGCGCC AACACGACGG CTATTGGCGG CTGGTGCGCC CATTGGCGGT
 201 TTTCGATGCC GAAGGTTTGC GCGAGCTGGG GGAAAGGTCG GGTTTTCAGA
 251 CGGCATTGAA GCACGAGTGC GCGTCCAGCA ACGACGAGAT ACTGGAATTG
 301 GCGCGGATTG CGCCGGACAA GGCGCACAAA ACCATATGTG TGACCCACCT
 351 GCAAAGTAAG GGCAGGGGGC GGCAGGGGCG GAAGTGGTCG CACCGTTTGG
 401 GCGAGTGTCT GATGTTCAGT TTTGGCTGGG TGTTTGACCG GCCGCAGTAT
 451 GAGTTGGGTT CGCTGTCGCC TGTTGCGGCA GTGGCGTGCC GGCGCGCCTT
 501 GTCGCGTTTG GGTTTGAAAA CGCAAATCAA GTGGCCAAAC GATTTGGTCG
 551 TCGGACGCGA CAAATTGGGC GGCATTCTGA TTGAAACGGT CAGGACGGGC
 601 GGCAAAACGG TTGCCGTGGT CGGTATCGGC ATCAATTTCG TGCTGCCCAA
 651 GGAAGTGGAA AACGCCGCTT CCGTGCAATC GCTGTTTCAG ACGGCATCGC
 701 GGCGGGGAAA TGCCGATGCC GCCGTGTTGC TGGAAACGCT GTTGGCGGAA
 751 CTTGATGCGG TGTTGTTGCA ATATGCGCGG GACGGATTTG CGCCTTTTGT
 801 GGCGGAATAT CAGGCTGCCA ACCGCGACCA CGGCAAGGCG GTATTGCTGT
 851 TGCGCGACGG CGAAACCGTG TTCGAAGGCA CGGTTAAAGG CGTGGACGGA
 901 CAAGGCGTTC TGCACTTGGA AACGGCAGAG GGCAAACAGA CGGTCGTCAG
 951 CGGCGAAATC AGCCTGCGGT CCGACGACAG GCCGGTTTCC GTGCCGAAGC
1001 GGCGGGATTC GGAACGTTTT CTGCTGTTGG ACGGCGGCAA CAGCCGGCTC
1051 AAGTGGGCGT GGGTGGAAAA CGGCACGTTC GCAACCGTCG GTAGCGCGCC
1101 GTACCGCGAT TTGTCGCCTT GGGCGCGGA GTGGGCGGAA AAGGTGGATG
1151 GAAATGTCCG CATCGTCGGT TGCGCCGTGT GCGGAGAATT CAAAAAGGCA
1201 CAAGTGCAGG AACAGCTCGC CCGAAAAATC GAGTGGCTGC CGTCTTCCGC
1251 ACAGGCTTTG GGCATACGCA ACCACTACCG CCACCCCGAA GAACACGGTT
1301 CCGACCGCTG GTTCAACGCC TTGGGCAGCC GCCGCTTCAG CCGCAACGCC
1351 TGCGTCGTCG TCAGTTGCGG CACGGCGGTA ACGGTTGACG CGCTCACCGA
1401 TGACGGACAT TATCTCGGGG GAACCATCAT GCCCGGTTTC CACCTGATGA
1451 AAGAATCGCT CGCCGTCCGA ACCGCCAACC TCAACCGGCA CGCCGGTAAG
1501 CGTTATCCTT TCCCGACCAC AACGGGCAAT GCCGTCGCCA GCGGCATGAT
1551 GGATGCGGTT TGCGGCTCGG TTATGATGAT GCACGGGCGT TTGAAAGAAA
1601 AAACCGGGGC GGGCAAGCCT GTCGATGTCA TCATTACCGG CGGCGGCGCG
1651 GCAAAAGTTG CCGAAGCCCT GCCGCCTGCA TTTTTGGCGG AAAATACCGT
1701 GCGCGTGGCG GACAACCTCG TCATTCACGG GCTGCTGAAC CTGATTGCCG
1751 CCGAAGGCGG GGAATCGGAA CATACTTAA
```

55

This corresponds to the amino acid sequence <SEQ ID 1300; ORF 311-1.a>:

```
a311-1.pep

1 MTVLKPSHWR VLAELADGLP QHVSQLARMA DMKPQQLNGF WQQMPAHIRG

51 LLRQHDGYWR LVRPLAVFDA EGLRELGERS GFQTALKHEC ASSNDEILEL

101 ARIAPDKAHK TICVTHLQSK GRGRQGRKWS HRLGECLMFS FGWVFDRPQY
```

```
151  ELGSLSPVAA  VACRRALSRL  GLKTQIKWPN  DLVVGRDKLG  GILIETVRTG

201  GKTVAVVGIG  INFVLPKEVE  NAASVQSLFQ  TASRRGNADA  AVLLETLLAE

251  LDAVLLQYAR  DGFAPFVAEY  QAANRDHGKA  VLLLRDGETV  FEGTVKGVDG

301  QCFLHLETAE  GKQTVVSGEI  SLRSDDRPVS  VPKRRDSERF  LLLDGGNSRL

351  KWAWVENGTF  ATVGSAPYRD  LSPLGAEWAE  KVDGNVRIVG  CAVCGEFKKA

401  QVQEQLARKI  EWLPSSAQAL  GIRNHYRHPE  EHGSDRWFNA  LGSRRFSRNA

451  CVVVSCGTAV  TVDALTDDGH  YLGGTIMPGF  HLMKESLAVR  TANLNRHAGK

501  RYPFPTTTGN  AVASGMMDAV  CGSVMMMHGR  LKEKTGAGKP  VDVIITGGGA

551  AKVAEALPPA  FLAENTVRVA  DNLVIHGLLN  LIAAEGGESE  HT*
``` a311-1/m311-1  98.5% identity in 591 aa overlap

```
                  10         20         30         40         50         60
a311-1.pep  MTVLKPSHWRVLAELADGLPQHVSQLARMADMKPQQLNGFWQQMPAHIRGLLRQHDGYWR
            |||||:||||||||||||||||||||||||||||||||||||||||||||||||||||||
m311-1      MTVLKLSHWRVLAELADGLPQHVSQLARMADMKPQQLNGFWQQMPAHIRGLLRQHDGYWR
                  10         20         30         40         50         60

70         80         90        100        110        120
a311-1.pep  LVRPLAVFDAEGLRELGERSGFQTALKHECASSNDEILELARIAPDKAHKTICVTHLQSK
            ||||||||||||||||||||||||||||||||||||||||||||||||||||||||||||
m311-1      LVRPLAVFDAEGLRELGERSGFQTALKHECASSNDEILELARIAPDKAHKTICVTHLQSK
                  70         80         90        100        110        120

130        140        150        160        170        180
a311-1.pep  GRGRQGRKWSHRLGECLMFSFGWVFDRPQYELGSLSPVAAVACRRALSRLGLKTQIKWPN
            |||||||||||||||||||||||||||||||||||||||||||||||||||:||||||
m311-1      GRGRQGRKWSHRLGECLMFSFGWVFDRPQYELGSLSPVAAVACRRALSRLGLDVQIKWPN
                 130        140        150        160        170        180

190        200        210        220        230        240
a311-1.pep  DLVVGRDKLGGILIETVRTGGKTVAVVGIGINFVLPKEVENAASVQSLFQTASRRGNADA
            ||||||||||||||||||||||||||||||||||||||||||||||||||||||||||||
m311-1      DLVVGRDKLGGILIETVRTGGKTVAVVGIGINFVLPKEVENAASVQSLFQTASRRGNADA
                 190        200        210        220        230        240

250        260        270        280        290        300
a311-1.pep  AVLLETLLAELDAVLLQYARDGFAPFVAEYQAANRDHGKAVLLLRDGETVFEGTVKGVDG
            |||||||||:||||||||||||||||||||||||||||||||||||||||||||||||||
m311-1      AVLLETLLVELDAVLLQYARDGFAPFVAEYQAANRDHGKAVLLLRDGETVFEGTVKGVDG
                 250        260        270        280        290        300

310        320        330        340        350        360
a311-1.pep  QGVLHLETAEGKQTVVSGEISLRSDDRPVSVPKRRDSERFLLLDGGNSRLKWAWVENGTF
            |||||||||||||||||||||||||||||||||||| |||||||||||||||||||||||
m311-1      QGVLHLETAEGKQTVVSGEISLRSDDRPVSVPKRPDSERFLLLDGGNSRLKWAWVENGTF
                 310        320        330        340        350        360

370        380        390        400        410        420
a311-1.pep  ATVGSAPYRDLSPLGAEWAEKVDGNVRIVGCAVCGEFKKAQVQEQLARKIEWLPSSAQAL
            ||||||||||||||||||||||:|||||||||||||||||||||||||||||||||||||
m311-1      ATVGSAPYRDLSPLGAEWAEKADGNVRIVGCAVCGEFKKAQVQEQLARKIEWLPSSAQAL
                 370        380        390        400        410        420

430        440        450        460        470        480
a311-1.pep  GIRNHYRHPEEHGSDRWFNALGSRRFSRNACVVVSCGTAVTVDALTDDGHYLGGTIMPGF
            ||||||||||||||||||||||||||||||||||||||||||||||||||||||||||||
m311-1      GIRNHYRHPEEHGSDRWFNALGSRRFSRNACVVVSCGTAVTVDALTDDGHYLGGTIMPGF
                 430        440        450        460        470        480

490        500        510        520        530        540
a311-1.pep  HLMKESLAVRTANLNRHAGKRYPFPTTTGNAVASGMMDAVCGSVMMMHGRLKEKTGAGKP
            |||||||||||||||||||||||||||||||||||||||||||||||||||||||||||||
m311-1      HLMKESLAVRTANLNRHAGKRYPFPTTTGNAVASGMMDAVCGSVMMMHGRLKEKTGAGKP
                 490        500        510        520        530        540

550        560        570        580        590
a311-1.pep  VDVIITGGGAAKVAEALPPAFLAENTVRVADNLVIHGLLNLIAAEGGESEHTX
            ||||||||||||||||||||||||||||||||||||:||||:|||||  | ||
m311-1      VDVIITGGGAAKVAEALPPAFLAENTVRVADNLVIYGLLNMIAAEGREYEHIX
                 550        560        570        580        590
```

The following partial DNA sequence was identified in *N. gonorrhoeae* <SEQ ID 1301>:

```
g312.seq
    1 atgaGtatCc aatCcGgcga AATTTtagaa accgtCAAAA TGGTTGCCGA 51 ccggaATttt gAtgtccgCA CCATTAccat cggcaTTgaT ttgcacgact 101 gcatcagcac cgacatcgac gtgttaAACC AAAACATtta caaCAaaaTc 151 accacggtcg gcaaagactT GGTGGCAacg Gcgaaacacc tTTccgcCAA 201 ATACGGCGTG CCGATTGTGA ATCAGCGCAT TTCCGTTACG CCGAttgccc 251 AaatcGCGGC GGcgaccaAa gccgaCAGTT AtgtcAGCgt ggcgcAGact 301 tTGGACAAGG CAGCCAAAGC CATCGGCGTG TCCTTTATCG GcggCTTTTC

351 CGCGCTGGTG CAAAAAGGTA TGTCGCCTTC GGATGAGGTG TTGATCCGTT

401 CCGTTCCCGA AGCGATGAAA ACTACCGATA TCGTGTGCAG CTCCATCAAT

451 ATCGGCAGCA CGCGTGCCGG TATCAATATG GATGCGGTCA AGCTGGCAGG

501 CGAAACCATC AAACGCACGG CTGAAATCAC ACCCGAAGGT TTCGGCTGCG

551 CCAAAATCGT CGTGTTCTGC AACGCGGTGG AAGACAATCC GTTTATGGCG

601 GGTGCGTTCC ACGGCTCGGG CGAAGCGGAT GCTGTGATTA ATGTCGGCGT

651 ATCCGGTCCA GGCGTGGTCA AAGCCGCGCT GGAAAATTCG GACGCGGTCA

701 GCCTGACCGA GGTCGCCGAA GTCGTGAAGA AAACCGCTTT CAAAATCACC

751 CGCGTGGGCG AACTCATCGG TCGCGAAGCC TCAAAAATGC TGAATATCCC

801 GTTCGGCATT CTCGATTTGT CGCTGGCACC GACCGCCGTC GTCGGCGACT

851 CGGTGGCGCG CATTCTTGAA GAAATGGGCT TGAGCGTCTG CGGTACGCAC

901 GGCACAACAG CAGCTTTGGC ATTGCTGAAC GATGCCGTGA AAAAGGGCGG

951 CATGATGGCT TCCAGCGCGG TCGGCGGTTT GAGCGGCGCG TTTATCCCCG

1001 TTTCCGAAGA CGAAGGTATG ATTGCCGCCG CCGAGGCAGG CGTGTTGACG

1051 CTGGACAAAC TCGAAGCCAT GACCGCCGTC TGCTCCGTTG GTTTGGACAT

1101 GATTGCCGTT CCCGGCGACA CGCCCGCGCA CACCATTTCC GGCATCATCG

1151 CCGACGAAGC CGCCATCGGC ATGATCAACA GCAAAACCAC CGCCGTGCGC

1201 ATTATTCCGG TAACGGGCAA AACCGTCGGC GACAGCGTCG AGTTCGGCGG

1251 TCTGTTGGGC TACGCGCCTG TAATGCCGGC AAAAGAAGGT TCGTGCGAAG

1301 TGTTCGTCAA CCGGGGCGGC AGGATTCCCG CACCGGTTCA ATCGATGAAA

1351 AACTGA
```

This corresponds to the amino acid sequence <SEQ ID 1302; ORF 312.ng>:

```
g312.pep
    1 MSIQSGEILE TVKMVADRNF DVRTITIGID LHDCISTDID VLNQNIYNKI

51 TTVGKDLVAT AKHLSAKYGV PIVNQRISVT PIAQIAAATK ADSYVSVAQT

101 LDKAAKAIGV SFIGGFSALV QKGMSPSDEV LIRSVPEAMK TTDIVCSSIN

151 IGSTRAGINM DAVKLAGETI KRTAEITPEG FGCAKIVVFC NAVEDNPFMA

201 GAFHGSGEAD AVINVGVSGP GVVKAALENS DAVSLTEVAE VVKKTAFKIT

251 RVGELIGREA SKMLNIPFGI LDLSLAPTPA VGDSVARILE EMGLSVCGTH

301 GTTAALALLN DAVKKGGMMA SSAVGGLSGA FIPVSEDEGM IAAAEAGVLT
```

-continued
```
351 LDKLEAMTAV CSVGLDMIAV PGDTPAHTIS GIIADEAAIG MINSKTTAVR

401 IIPVTGKTVG DSVEFGGLLG YAPVMPAKEG SCEVFVNRGG RIPAPVQSMK

451 N*
```

The following partial DNA sequence was identified in *N. meningitidis* <SEQ ID 1303>:

```
m312.seq
    1 ATGAGTATCC AATCCGGCGA AATTTTAGAA ACCGTCAAAA TGGTTGCCGA

51 CCAGAATTTT GATGTCCGCA CCATTACCAT CGGCATTGAT TTGCACGACT

101 GCATCAGCAG CGATATCAAT GTGTTGAACC AAAATATTTA CAATAAAATT

151 ACCACAGTCG GCAAAGACTT GGTCACTACG GCAAAATATC TGTCTGCCAA

201 ATACGGCGTA CCGATTGTGA ATCAGCGCAT TTCCGTTACG CCGATTGCCC

251 AAATCGCGGC GGCCACCCAT GCTGATTCTT ACGTCAGCGT GGCGCAAACT

301 TTGGATAAAG CTGCCAAAGC CATCGGTGTG TCTTTTATCG GCGGTTTTTC

351 CGCGTTGGTG CAAAAAGGGA TGTCGCcTTC GGATGAGGTG TTAATCCGCT

401 CCATTCCCGA AGCGATGAAG ACTACCGATA TTGTGTGCwG CTCCATCAAT

451 ATCGGCAGTA CGCGTGCCGG TATCAATATG GATGCGGTCA AGCTGGCGGG

501 CGAAACcGTc AAACGCACGG CGGAAATCAC GCCCGAAGGT TTCGGCTGCG

551 CTAAAATTGT CGTGTTCTGC AACGCGGTGG AAGACAACCC GTTTwTGGCG

601 GGCGCGTTTC ATGGTTCGGG CGATGCCGTT ATCAATGTCG GCGTATCCGG

651 CCCAGGTGTC GTAAAAGCCG CGTTGGAAAA TTCAGATGCA ACGACATTGA

701 CCGAAGTTGC GGAAGTAGTG AAGAAAACTG CTTTCAAAAT TACCCGCGTG

751 GGCGAACTCA TCGGCCGCGA AGCcTCAAAA ATGCTGAATA TCCCGTTTGG

801 TATTCTCGAC TTGTCGCCGA CCCCGCCCGT CGGCGACTCA GTGGCACGCA

851 TTCTTGAAGA AATGGGCTTG AGCGTCTGCG GTACGCACGG CACAACAGCA

901 GCTTTGGCAT TGCTGAACGA TGCCGTGAAA AAAGGCGGCA TGATGGCTTC

951 CAGCGCGGTC GGGGGTTTGA GTGGCGCGTT TATCCCCGTT TCCGAAGACG

1001 AAGGTATGAT yGmCgCcGCC GAAGCAGGCG TGCTGACGCT GGACAAACTC

1051 GAAGCCATGA CCGCCGTTTG TTCGGTCGGC TTGGATATGA TTGCCGTTCC

1101 CGGCGACACG CCCGCGCACA CCATTTCCGG CATCATTGCC GACGAAGCCG

1151 CCATCGGCAt GATCAACAGC AAAACCACTG CCGTGCGCAT TATTCCGGTA

1201 ACCGGTAAAA CCGTCGGCGA CAcGGTCGAG TTCGGCGGCT TGTTGGgCTA

1251 CGCGCCTGTG ATGCCGGTCA AGAAGGTTC GTGCGAAGTA TTCGTCAACC

1301 GAGGCGGCAG AATTCCGGCT CCGGTTCAAT CGATGAAAAA CTGA
```

This corresponds to the amino acid sequence <SEQ ID 1304; ORF 312>:

```
m312.pep
    1 MSIQSGEILE TVKMVADQNF DVRTITIGID LHDCISSDIN VLNQNIYNKI

51 TTVGKDLVTT AKYLSAKYGV PIVNQRISVT PIAQIAAATH ADSYVSVAQT

101 LDKAAKAIGV SFIGGFSALV QKGMSPSDEV LIRSIPEAMK TTDIVCXSIN

151 IGSTRAGINM DAVKLAGETV KRTAEITPEG FGCAKIVVFC NAVEDNPFXA
```

```
201 GAFHGSGDAV INVGVSGPGV VKAALENSDA TTLTEVAEVV KKTAFKITRV

251 GELIGREASK MLNIPFGILD LSPTPPVGDS VARILEEMGL SVCGTHGTTA

301 ALALLNDAVK KGGMMASSAV GGLSGAFIPV SEDEGMIXAA EAGVLTLDKL

351 EAMTAVCSVG LDMIAVPGDT PAHTISGIIA DEAAIGMINS KTTAVRIIPV

401 TGKTVGDTVE FGGLLGYAPV MPVKEGSCEV FVNRGGRIPA PVQSMKN*
```

Computer analysis of this amino acid sequence gave the following results:

Homology with a Predicted ORF from *N. gonorrhoeae*

ORF 312 shows 95.6% identity over a 451 aa overlap with a predicted ORF (ORF 312.ng) from *N. gonorrhoeae*:

```
m312/g312

10         20         30         40         50         60
    m312.pep  MSIQSGEILETVKMVADQNFDVRTITIGIDLHDCISSDINVLNQNIYNKITTVGKDLVTT
              ||||||||||||||||:|||||||||||||||||:||:||||||||||||||||||||:|
    g312      MSIQSGEILETVKMVADRNFDVRTITIGIDLHDCISTDIDVLNQNIYNKITTVGKDLVAT
                    10         20         30         40         50         60
                    70         80         90        100        110        120
    m312.pep  AKYLSAKYGVPIVNQRISVTPIAQIAAATHADSYVSVAQTLDKAAKAIGVSFIGGFSALV
              ||:|||||||||||||||||||||||||||:||||||||||||||||||||||||||||
    g312      AKHLSAKYGVPIVNQRISVTPIAQIAAATKADSYVSVAQTLDKAAKAIGVSFIGGFSALV
                    70         80         90        100        110        120
                   130        140        150        160        170        180
    m312.pep  QKGMSPSDEVLIRSIPEAMKTTDIVCXSINIGSTRAGINMDAVKLAGETVKRTAEITPEG
              |||||||||||||:||||||||||||:||||||||||||||||||||||:||||||||||
    g312      QKGMSPSDEVLIRSVPEAMKTTDIVCSSINIGSTRAGINMDAVKLAGETIKRTAEITPEG
                   130        140        150        160        170        180
                   190        200        210        220        230
    m312.pep  FGCAKIVVFCNAVEDNPFXAGAFHGSG--DAVINVGVSGPGVVKAALENSDATTLTEVAE
              |||||||||||||||||| ||||||||   |||||||||||||||||||||::|||||
    g312      FGCAKIVVFCNAVEDNPFMAGAFHGSGEADAVINVGVSGPGVVKAALENSDAVSLTEVAE
                   190        200        210        220        230        240
              240        250        260        270        280        290
    m312.pep  VVKKTAFKITRVGELIGREASKMLNIPFGILDLS--PTPPVGDSVARILEEMGLSVCGTH
              ||||||||||||||||||||||||||||||||||   |||||||||||||||||||||
    g312      VVKKTAFKITRVGELIGREASKMLNIPFGILDLSLAPTPAVGDSVARILEEMGLSVCGTH
                   250        260        270        280        290        300
                   300        310        320        330        340        350
    m312.pep  GTTAALALLNDAVKKGGMMASSAVGGLSGAFIPVSEDEGMIXAAEAGVLTLDKLEAMTAV
              ||||||||||||||||||||||||||||||||||||||||| |||||||||||||||||
    g312      GTTAALALLNDAVKKGGMMASSAVGGLSGAFIPVSEDEGMIAAAEAGVLTLDKLEAMTAV
                   310        320        330        340        350        360
                   360        370        380        390        400        410
    m312.pep  CSVGLDMIAVPGDTPAHTISGIIADEAAIGMINSKTTAVRIIPVTGKTVGDTVEFGGLLG
              ||||||||||||||||||||||||||||||||||||||||||||||||||||:||||||
    g312      CSVGLDMIAVPGDTPAHTISGIIADEAAIGMINSKTTAVRIIPVTGKTVGDSVEFGGLLG
                   370        380        390        400        410        420
                   420        430        440
    m312.pep  YAPVMPVKEGSCEVFVNRGGRIPAPVQSMKNX
              ||||||:||||||||||||||||||||||||
    g312      YAPVMPAKEGSCEVFVNRGGRIPAPVQSMKNX
                   430        440        450
```

The following partial DNA sequence was identified in *N. meningitidis* <SEQ ID 1305>:

```
a312.seq
   1 ATGAGTATCC AATCCGGCGA AATTTTAGAA ACCGTCAAAA TGGTTGCCGA

51 CCAGAATTTC GATGTCCGCA CCATTACCAT CGGCATTGAT TTGCACGACT

101 GCATCAGCAC CGACATCGAC GTGTTGAACC AAAATATTTA CAACAAAATT

151 ACCACGGTCG GCAAAGACTT GGTGGCGACA GCAAAATATC TGTCTGCCAA
```

-continued

```
 201 ATACGGCGTG CCGATTGTGA ATCAGCGCAT TTCTGTCACG CCGATTGCCC

251 AAATCGCGGC GGCCACCCAT GCTGATTCTT ACGTCAGCGT GGCGCAAACT

301 TTGGATAAGG CTGCCAAAGC CATCGGCGTG TCTTTTATTG GCGGCTTTTC

351 CGCGCTGGTG CAAAAAGGTA TGTCGCCTTC TGACGAGGTG TTAATCCGTT

401 CCATTCCCGA AGCGATGAAG ACTACTGATA TCGTGTGCAG CTCCATCAAT

451 ATCGGCAGTA CGCGCGCCGG TATCAATATG GACGCGGTCA GACTGGCGGG

501 CGAAACCATC AAACGCACGG CTGAAATCAC ACTAGAAGGT TTCGGCTGCG

551 CCAAAATCGT CGTGTTCTGC AACGCGGTGG AAGACAACCC GTTTATGGCG

601 GGCGCGTTTC ACGGCTCAGG CGAAGCGGAT GCTGTGATTA ATGTCGGCGT

651 ATCCGGCCCG GGTGTCGTAA AAGCCGCGTT GGAAAATTCG GATGCAACGA

701 CATTGACCGA AGTTGCCGAA GTTGTGAAGA AAACCGCCTT CAAAATTACC

751 CGCGTGGGCG AACTCATCGG CCGCGAAGCC TCAAAAATGC TGAATATCCC

801 GTTTGGTATT CTCGACTTGT CGCTGGCACC GACCCCTGCC GTCGGCGACT

851 CGGTGGCGCG CATTCTTGAA GAAATGGGTT TGAGCGTCTG CGGTACGCAC

901 GGCACAACAG CAGCTTTGGC ATTGCTGAAC GATGCCGTGA AAAAGGGCGG

951 CATGATGGCT TCGAGCGCGG TTGGCGGTTT GAGTGGCGCG TTTATCCCCG

1001 TTTCCGAAGA CGAAGGTATG ATTGCCGCCG CCGAAGCAGG CGTGCTGACG

1051 TTGGATAAAC TCGAAGCGAT GACCGCCGTT TGTTCGGTCG GCTTGGATAT

1101 GATTGCCGTT CCCGGCGACA CACCCGCGCA CACCATTTCC GGCATCATTG

1151 CCGACGAAGC CGCCATCGGC ATGATCAACA GCAAAACCAC TGCCGTGCGC

1201 ATTATTCCGG TAACCGGTAA AACCGTCGGC GACAGCGTCG AGTTCGGCGG

1251 CCTGTTGGGC TACGCGCCTG TAATGCCGGT AAAAGAAGGC TCATGCGAAG

1301 TGTTCGTCAA CCGGGGCGGC AGGATTCCCG CACCGGTTCA ATCGATGAAA

1351 AACTGA
```

This corresponds to the amino acid sequence <SEQ ID 1306; ORF 312.a>:

```
a312.pep
  1 MSIQSGEILE TVKMVADQNF DVRTITIGID LHDCISTDID VLNQNIYNKI

51 TTVGKDLVAT AKYLSAKYGV PIVNQRISVT PIAQIAAATH ADSYVSVAQT

101 LDKAAKAIGV SFIGGFSALV QKGMSPSDEV LIRSIPEAMK TTDIVCSSIN

151 IGSTRAGINM DAVRLAGETI KRTAEITLEG FGCAKIVVFC NAVEDNPFMA

201 GAFHGSGEAD AVINVGVSGP GVVKAALENS DATTLTEVAE VVKKTAFKIT

251 RVGELIGREA SKMLNIPFGI LDLSLAPTPA VGDSVARILE EMGLSVCGTH

301 GTTAALALLN DAVKKGGMMA SSAVGGLSGA FIPVSEDEGM IAAAEAGVLT

351 LDKLEAMTAV CSVGLDMIAV PGDTPAHTIS GIIADEAAIG MINSKTTAVR

401 IIPVTGKTVG DSVEFGGLLG YAPVMPVKEG SCEVFVNRGG RIPAPVQSMK

451 N*
``` m312/a312 96.7% identity in 451 aa overlap

```
               10        20        30        40        50        60
m312.pep  MSIQSGEILETVKMVADQNFDVRTITIGIDLHDCISSDINVLNQNIYNKITTVGKDLVTT
          |||||||||||||||||||||||||||||||||||:||:||||||||||||||||||||:|
a312      MSIQSGEILETVKMVADRNFDVRTITIGIDLHDCISTDIDVLNQNIYNKITTVGKDLVAT
               10        20        30        40        50        60

70        80        90       100       110       120
m312.pep  AKYLSAKYGVPIVNQRISVTPIAQIAAATHADSYVSVAQTLDKAAKAIGVSFIGGFSALV
          ||||||||||||||||||||||||||||||||||||||||||||||||||||||||||||
a312      AKYLSAKYGVPIVNQRISVTPIAQIAAATHADSYVSVAQTLDKAAKAIGVSFIGGFSALV
               70        80        90       100       110       120

130       140       150       160       170       180
m312.pep  QKGMSPSDEVLIRSIPEAMKTTDIVCXSINIGSTRAGINMDAVKLAGETVKRTAEITPEG
          |||||||||||||||||||||||||| |||||||||||||||||:||||:||||||||  ||
a312      QKGMSPSDEVLIRSIPEAMKTTDIVCSSINIGSTRAGINMDAVRLAGETIKRTAEITLEG
              130       140       150       160       170       180

190       200       210       220       230
m312.pep  FGCAKIVVFCNAVEDNPFXAGAFHGSG--DAVINVGVSGPGVVKAALENSDATTLTEVAE
          |||||||||||||||||||| ||||||||    ||||||||||||||||||| ||||||||
a312      FGCAKIVVFCNAVEDNPFMAGAFHGSGEADAVINVGVSGPGVVKAALENSDATTLTEVAE
              190       200       210       220       230       240

240       250       260       270       280       290
m312.pep  VVKKTAFKITRVGELIGREASKMLNIPFGILDLS--PTPPVGDSVARILEEMGLSVCGTH
          ||||||||||||||||||||||||||||||||||||   |||  ||||||||||||||||||||
a312      VVKKTAFKITRVGELIGREASKMLNIPFGILDLSLAPTPAVGDSVARILEEMGLSVCGTH
              250       260       270       280       290       300

300       310       320       330       340       350
m312.pep  GTTAALALLNDAVKKGGMMASSAVGGLSGAFIPVSEDEGMIXAAEAGVLTLDKLEAMTAV
          ||||||||||||||||||||||||||||||||||||||||| ||||||||||||||||||
a312      GTTAALALLNDAVKKGGMMASSAVGGLSGAFIPVSEDEGMIAAAEAGVLTLDKLEAMTAV
              310       320       330       340       350       360

360       370       380       390       400       410
m312.pep  CSVGLDMIAVPGDTPAHTISGIIADEAAIGMINSKTTAVRIIPVTGKTVGDTVEFGGLLG
          ||||||||||||||||||||||||||||||||||||||||||||||||||||:||||||
a312      CSVGLDMIAVPGDTPAHTISGIIADEAAIGMINSKTTAVRIIPVTGKTVGDSVEFGGLLG
              370       380       390       400       410       420

420       430       440
m312.pep  YAPVMPVKEGSCEVFVNRGGRIPAPVQSMKNX
          |||||||||||||||||||||||||||||||
a312      YAPVMPVKEGSCEVFVNRGGRIPAPVQSMKNX
              430       440       450
```

The following partial DNA sequence was identified in *N. gonorrhoeae* <SEQ ID 1307>:

```
g313.seq
   1 atgacgacc cgcgcaccta cggatcgggc aatcccggcg cgaccaatgt 51 tttacgcagc ggcaaaaaaa aggcggccgc gctgacgctc ttgggcgatg 101 ccgccaaagg tttggttgcc gttttgcttg cacgcgtgct tcaagaaccg 151 ctcggtttat ccgacagcgc aatcgccgcc gtcgcactcg ccgcgctggt 201 cgggcatatg tggccggtgt ttttcggatt taagggcggc aaaggcgtgg 251 caacggcatt gggcgtgctt ctggcactct ctcctgcaac tgccttggtc 301 tgcgcgttga tttggcttgt gatggcattc ggcttcaaag tatcctccct 351 tgccgcgctg gtcgccacaa ccgccgcccc ccttgccgca ctgtttttta 401 tgccgcatac ttcttggatt ttcgcaaccc tcgcaatcgc catattggtg 451 ttgctccgcc ataagagcaa catcctcaac ctgattaaag gcaaagaaag 501 caaaatcggc gaaaaacgct ga
```

This corresponds to the amino acid sequence <SEQ ID 1308; ORF 313.ng>:

```
g313.pep
  1 MDDPRTYGSG NPGATNVLRS GKKKAAALTL LGDAAKGLVA VLLARVLQEP

51 LGLSDSAIAA VALAALVGHM WPVFFGFKGG KGVATALGVL LALSPATALV

101 CALIWLVMAF GFKVSSLAAL VATTAAPLAA LFFMPHTSWI FATLAIAILV

151 LLRHKSNILN LIKGKESKIG EKR*
```

The following partial DNA sequence was identified in *N. meningitidis* <SEQ ID 1309>:

```
m313.seq
  1 ATGGACGACC CGCGCACCTA CGGATCGGGC AATCCGGGGG CAACCAATGT

51 TTTACGCAGC GGCAAAAAAA AGGCGGCCGC GCTGACGCTC TTGGGCGATG

101 CCGCCAAAGG TTTAGTTGCC GTTTTGCTTG CACGCGTGCT TCAAGAACCG

151 CTCGGTTTAT CCGACAGCGC AATCGCGGCC GTCGCACTCG CCGCGCTGGT

201 CGGGCATATG TGGCCGGTGT TTTTCGGATT TAAAGGCGGC AAAGGCGTGG

251 CAACGGCATT GGGCGTGCTT CTGGCACTCT CTCCCGCAAC TGCCTTGGTC

301 TGCGCGTTGA TTTGGCTTGT TATGGCATTC GGCTTCAAGG TGTCCTCCCT

351 TGCCGCATTA ACCGCCACAA TCGCCGCACC GGTCGCCGCA TCCTTCTTTA

401 TGCCGCACGT CTCGTGGGTT TGGGCGACCG TCGCCATTGC TTTGCTGGTG

451 TTGTTCCGCC ACAAAAGTAA TATCGTCAAG CTGCTCGAAG GCAGAGAAAG

501 CAAAATCGGC GGCAGCCGCT GA
```

This corresponds to the amino acid sequence <SEQ ID 1310; ORF 313>:

```
m313.pep
  1 MDDPRTYGSG NPGATNVLRS GKKKAAALTL LGDAAKGLVA VLLARVLQEP

51 LGLSDSAIAA VALAALVGHM WPVFFGFKGG KGVATALGVL LALSPATALV

101 CALIWLVMAF GFKVSSLAAL TATIAAPVAA SFFMPHVSWV WATVAIALLV

151 LFRHKSNIVK LLEGRESKIG GSR*
```

Computer analysis of this amino acid sequence gave the following results:
Homology with a Predicted ORF from *N. gonorrhoeae*
ORF 313 shows 90.2% identity over a 173 aa overlap with a predicted ORF (ORF 313.ng) from *N. gonorrhoeae*:

```
    m313/g313
                 10         20         30         40         50         60
    m313.pep MDDPRTYGSGNPGATNVLRSGKKKAAALTLLGDAAKGLVAVLLARVLQEPLGLSDSAIAA
             ||||||||||||||||||||||||||||||||||||||||||||||||||||||||||||
    g313     MDDPRTYGSGNPGATNVLRSGKKKAAALTLLGDAAKGLVAVLLARVLQEPLGLSDSAIAA
                 10         20         30         40         50         60

70         80         90        100        110        120
    m313.pep VALAALVGHMWPVFFGFKGGKGVATALGVLLALSPATALVCALIWLVMAFGFKVSSLAAL
             ||||||||||||||||||||||||||||||||||||||||||||||||||||||||||||
    g313     VALAALVGHMWPVFFGFKGGKGVATALGVLLALSPATALVCALIWLVMAFGFKVSSLAAL
                 70         80         90        100        110        120

130        140        150        160        170
    m313.pep TATIAAPVAASFFMPHVSWVWATVAIALLVLFRHKSNIVKLLEGRESKIGGSRX
             :||  |||:|| |||||:|:|||:|||:||||||||||:|::|:|||||  :||
    g313     VATTAAPLAALFFMPHTSWIFATLAIAILVLLRHKSNILNLIKGKESKIGEKRX
                130        140        150        160        170
```

The following partial DNA sequence was identified in *N. meningitidis* <SEQ ID 1311>:

```
a313.seq
   1 ATGGACGACC CGCGCACCTA CGGATCGGGC AATCCGGGGG CAACCAATGT

51 TTTACGCAGC GGCAAAAAAA AGGCGGCCGC GCTGACGCTC TTGGGCGATG

101 CCGCCAAAGG TTTGGTTGCC GTTTTGCTTG CACGCGTGCT TCAAGAACCG

151 CTCGGTTTAT CCGACAGCGC AATCGCGGCC GTCGCACTCG CCGCGCTGGT

201 CGGGCATATG TGGCCGGTGT TTTTCGGATT TAAAGGCGGC AAAGGCGTGG

251 CAACGGCATT GGGCGTGCTT CTGGCACTCT CTCCCACAAC TGCCTTGGTC

301 TGCGCGTTGA TTTGGCTTGT GATGGCATTC GGCTTCAAGG TGTCCTCCCT

351 TGCCGCATTA ACCGCCACAA TCGCCGCCCC CCTTGCCGCA CTGTTTTTTA

401 TGCCGCATAC TTCTTGGATT TTCGCAACCC TCGCAATCGC CATATTGGTG

451 TTGCTCCGCC ATAAGAGCAA CATCCTCAAC CTGATTAAAG GCAAAGAAAG

501 CAAAATCGGC GAAAAACGCT GA
```

This corresponds to the amino acid sequence <SEQ ID 1312; ORF 313.a>:

```
a313.pep
   1 MDDPRTYGSG NPGATNVLRS GKKKAAALTL LGDAAKGLVA VLLARVLQEP

51 LGLSDSAIAA VALAALVGHM WPVFFGFKGG KGVATALGVL LALSPTTALV

101 CALIWLVMAF GFKVSSLAAL TATIAAPLAA LFFMPHTSWI FATLAIAILV

151 LLRHKSNILN LIKGKESKIG EKR*
``` m313/a313 90.8% identity in 173 aa overlap

```
                     10        20        30        40        50        60
m313.pep    MDDPRTYGSGNPGATNVLRSGKKKAAALTLLGDAAKGLVAVLLARVLQEPLGLGLSDSAIAA
            |||||||||||||||||||||||||||||||||| :||||||||||||||||||||||||
a313        MDDPRTYGSGNPGATNVLRSGKKKAAALTLLGDAAKGLVAVLLARVLQEPLGLGLSDSAIAA
                     10        20        30        40        50        60

70        80        90       100       110       120
m313.pep    VALAALVGHMWPVFFGFKGGKGVATALGVLLALSPATALVCALIWLVMAFGFKVSSLAAL
            |||||||||||||||||||||||||||||||||||:||||||||||||||||||||||||
a313        VALAALVGHMWPVFFGFKGGKGVATALGVLLALSPTTALVCALIWLVMAFGFKVSSLAAL
                     70        80        90       100       110       120

130       140       150       160       170
m313.pep    TATIAAPVAASFFMPHVSWVWATVAIALLVLFRHKSNIVKLLEGRESKIGGSRX
            |||||||:|| |||||:||::||:|||:|||:||||||::|::|:||||| :||
a313        TATIAAPLAALFFMPHTSWIFATLAIAILVLLRHKSNILNLIKGKESKIGEKRX
                    130       140       150       160       170
```

The following partial DNA sequence was identified in *N. gonorrhoeae* <SEQ ID 1313>:

```
g401.seq
   1 atgaaattac aacaattggc tgaagaaaaa atcggcgttc tgattgtgtt 51 cacgctgctt gtagtcagtg tcggtctgtt gattgaagtt gtgcccttgg 101 cctttaccaa ggcggcaaca cagccggcgc cgggcgtgaa gccttacaat 151 gccctgcagg ttgccggacg cgatatttac atccgtgagg gctgttacaa 201 ctgccactct caaatgattc gtccgttccg tgcggaaacc gagcgttacg 251 gtcattactc tgttgccgga gagtcggttt acgaccatcc gttccaatgg
```

-continued

```
301 ggttccaaac gtaccggtcc tgatttggca cgtgtgggcg gccgctattc 351 cgacgaatgg caccgcatcc acctgctgaa tccccgtgat gtcgtgcctg 401 agtccaatat gccggcattc ccgtggcttg cacgcaataa agtcgatgtc 451 gatgcaaccg ttgccaacat gaaggctttg cgtaaagtag gtactcctta 501 cagtgatgag gaaattgcga aagcgcctga ggctttggca aacaaatccg 551 agctggatgc tgtagtcgcc tatctgcaag gattgggtct ggctttgaaa 601 aacgtaaggt aa
```

This corresponds to the amino acid sequence <SEQ ID 1314; ORF 401.ng>:

```
g401.pep
  1 MKLQQLAEEK IGVLIVFTLL VVSVGLLIEV VPLAFTKAAT QPAPGVKPYN

51 ALQVAGRDIY IREGCYNCHS QMIRPFRAET ERYGHYSVAG ESVYDHPFQW

101 GSKRTGPDLA RVGGRYSDEW HRIHLLNPRD VVPESNMPAF PWLARNKVDV

151 DATVANMKAL RKVGTPYSDE EIAKAPEALA NKSELDAVVA YLQGLGLALK

201 NVR*
```

The following partial DNA sequence was identified in *N. meningitidis* <SEQ ID 1315>:

```
m401.seq
  1 ATGAAATTAC AaCAATTGGC TGAAGAAAAA ATCGGCGTTC TGATTGTGTT

51 CACGCTGCTT GTAGTCAGTG TCGGTCTGTT GATTGAAGTT GTGCCCTTGG

101 CCTTTACCAA GGCGGCAACA CAGCCGGCGC CGGGCGTGAA GCCTTACAAT

151 GCCCTGCAGG TTGCCGGACG CGATATTTAC ATCCGTGAGG GCTGTTACAA

201 CTGCCACTCG CAAATGATTC GTCCGTTCCG TGCGGAAACC GAGCGTTACG

251 GTCATTACTC TGTTGCCGGA GAGTCGGTTT ACGACCATCC GTTCCAATGG

301 GGTTCCAAAC GTACCGGTCC TGATTTGGCA CGTGTGGGCG GTCGCTATTC

351 CGACGAATGG CACCGTATCC ACCTGCTGAA TCCCCGTGAT GTCGTGCCTG

401 AGTCCAATAT GCCGGCATTC CCGTGGCTTG CACGCAATAA AGTCGATGTC

451 GATGCAACCG TTGCCAACAT GAAGGCTTTG CGTAAAGTAG GTACTCCTTA

501 CAGTGATGAG GAAATTGCGA AAGCACCTGA GGCTTTGGCA AACAAATCCG

551 AGCTGGATGC TGTAGTCGCC TATCTGCAAG GATTGGGTCT GGCTTTGAAA

601 AACGTAAGGT AA
```

This corresponds to the amino acid sequence <SEQ ID 1316; ORF 401>:

```
m401.pep
  1 MKLQQLAEEK IGVLIVFTLL VVSVGLLIEV VPLAFTKAAT QPAPGVKPYN

51 ALQVAGRDIY IREGCYNCHS QMIRPFRAET ERYGHYSVAG ESVYDHPFQW

101 GSKRTGPDLA RVGGRYSDEW HRIHLLNPRD VVPESNMPAF PWLARNKVDV

151 DATVANMKAL RKVGTPYSDE EIAKAPEALA NKSELDAVVA YLQGLGLALK

201 NVR*
```

Computer analysis of this amino acid sequence gave the following results:

Homology with a Predicted ORF from *N. gonorrhoeae*

ORF 401 shows 100.0% identity over a 203 aa overlap with a predicted ORF (ORF 401.ng) from *N. gonorrhoeae*:

```
m401/g401

10         20         30         40         50         60
    m401.pep  MKLQQLAEEKIGVLIVFTLLVVSVGLLIEVVPLAFTKAATQPAPGVKPYNALQVAGRDIY
              ||||||||||||||||||||||||||||||||||||||||||||||||||||||||||||
        g401  MKLQQLAEEKIGVLIVFTLLVVSVGLLIEVVPLAFTKAATQPAPGVKPYNALQVAGRDIY
                   10         20         30         40         50         60

70         80         90        100        110        120
    m401.pep  IREGCYNCHSQMIRPFRAETERYGHYSVAGESVYDHPFQWGSKRTGPDLARVGGRYSDEW
              ||||||||||||||||||||||||||||||||||||||||||||||||||||||||||||
        g401  IREGCYNCHSQMIRPFRAETERYGHYSVAGESVYDHPFQWGSKRTGPDLARVGGRYSDEW
                   70         80         90        100        110        120

130        140        150        160        170        180
    m401.pep  HRIHLLNPRDVVPESNMPAFPWLARNKVDVDATVANMKALRKVGTPYSDEEIAKAPEALA
              ||||||||||||||||||||||||||||||||||||||||||||||||||||||||||||
        g401  HRIHLLNPRDVVPESNMPAFPWLARNKVDVDATVANMKALRKVGTPYSDEEIAKAPEALA
                  130        140        150        160        170        180

190        200
    m401.pep  NKSELDAVVAYLQGLGLALKNVRX
              ||||||||||||||||||||||||
        g401  NKSELDAVVAYLQGLGLALKNVRX
                  190        200
```

The following partial DNA sequence was identified in *N. meningitidis* <SEQ ID 1317>:

```
a401.seq
   1 ATGAAATTAC AACAATTGGC TGAAGAAAAA ATCGGCGTTC TGATTGTGTT

51 CACGCTGCTT GTAGTCAGTG TCGGTCTGTT GATTGAAGTT GTGCCCTTGG

101 CCTTTACCAA GGCGGCAACA CAGCCGGCGT CGGGCGTGAA GCCTTACAAT

151 GCCCTGCAGG TTGCCGGACG CGATATTTAC ATCCGTGAGG GCTGTTACAA

201 CTGCCACTCG CAAATGATTC GTCCGTTCCG TGCGGAAACC GAGCGTTACG

251 GTCATTACTC TGTTGCCGGA GAGTCGGTTT ACGACCATCC GTTCCAATGG

301 GGTTCCAAAC GTACCGGTCC TGATTTGGCA CGTGTGGGCG GTCGCTATTC

351 CGACGAATGG CACCGTATCC ACCTGCTGAA TCCCCGTGAT GTCGTGCCTG

401 AGTCCAATAT GCCGGCATTC CCGTGGCTTG CACGCAATAA AGTCGATGTC

451 GATGCAACCG TTGCCAACAT GAAGGCTTTG CGTAAAGTAG GTACTCCTTA

501 CAGTGATGAG GAAATTGCGA AAGCGCCTGA GGCTTTGGCA AACAAATCCG

551 AGCTGGATGC TGTAGTCGCC TATCTGCAAG GATTGGGTCT GGCTTTGAAA

601 AACGTAAGGT AA
```

This corresponds to the amino acid sequence <SEQ ID 1318; ORF 401.a>:

```
a401.pep
   1 MKLQQLAEEK IGVLIVFTLL VVSVGLLIEV VPLAFTKAAT QPASGVKPYN

51 ALQVAGRDIY IREGCYNCHS QMIRPFRAET ERYGHYSVAG ESVYDHPFQW

101 GSKRTGPDLA RVGGRYSDEW HRIHLLNPRD VVPESNMPAF PWLARNKVDV

151 DATVANMKAL RKVGTPYSDE EIAKAPEALA NKSELDAVVA YLQGLGLALK

201 NVR*
``` m401/a401 99.5% identity in 203 aa overlap

```
                 10         20         30         40         50         60
m401.pep  MKLQQLAEEKIGVLIVFTLLVVSVGLLIEVVPLAFTKAATQPAPGVKPYNALQVAGRDIY
          ||||||||||||||||||||||||||||||||||||||||||| ||||||||||||||||
a401      MKLQQLAEEKIGVLIVFTLLVVSVGLLIEVVPLAFTKAATQPASGVKPYNALQVAGRDIY
                 10         20         30         40         50         60

70         80         90        100        110        120
m401.pep  IREGCYNCHSQMIRPFRAETERYGHYSVAGESVYDHPFQWGSKRTGPDLARVGGRYSDEW
          ||||||||||||||||||||||||||||||||||||||||||||||||||||||||||||
a401      IREGCYNCHSQMIRPFRAETERYGHYSVAGESVYDHPFQWGSKRTGPDLARVGGRYSDEW
                 70         80         90        100        110        120

130        140        150        160        170        180
m401.pep  HRIHLLNPRDVVPESNMPAFPWLARNKVDVDATVANMKALRKVGTPYSDEEIAKAPEALA
          ||||||||||||||||||||||||||||||||||||||||||||||||||||||||||||
a401      HRIHLLNPRDVVPESNMPAFPWLARNKVDVDATVANMKALRKVGTPYSDEEIAKAPEALA
                130        140        150        160        170        180

190        200
m401.pep  NKSELDAVVAYLQGLGLALKNVRX
          ||||||||||||||||||||||||
a401      NKSELDAVVAYLQGLGLALKNVRX
                190        200
```

The following partial DNA sequence was identified in *N. gonorrhoeae* <SEQ ID 1319>:

```
g402.seq
    1 ATGGATATGG TGAACACTAA Accgaatact agtgtgatta atatgctttc 51 tttccttacc ggatTATTGA GCTTGGGTat agaagtCtTg tGGGTAAGGA 101 TGtttcgTT CGCagcAcag tccgtgcctc aggCATTTTC atttattctt 151 gcctGttttc tgACCGgtat cgccgtcggc gCgTATTTTG GCAAACGGAT 201 TTGCCGCAGC CGCTTTGTTG ATATTCCctT TATCGGGCAG TgcttcttgT 251 GGGCGGGTAT TgccgaTttt ttgatTTTGG GTGCTGCGTG GTTGTTGACG 301 GGTTTTTccg gtttcGTCCA CCACGCCGGT AtttTCATTA CCCTgtctgc 351 CGtcGTCAGG GGGTTGATTT TCCCACTTGT ACACCATgtg GGTACGGATG

401 GCAACAAATC CGGACGACAG GTTTCCAATG TTTATTTCGC CAACGTTGCC

451 GGCAGTGCAT TGGGTCCGGT CCTTATCGGC TTTGTGATAC TTGATttgtt 501 gTCCACCCAA CAGATTtacc tgctcatCTG TTTGATTTCT GCTGCtgtcc 551 cTTTGTTTTg tacaCTGtTC CAAAAAAGTC TCCGACTGAA TGCAGTGTCG

601 GTAGCAGTTT CCCTAATGTT CGGCATCCTC ATGTTCCTAC TGCCGGATTC

651 TGTCTTTCAA AATATTGCTG GCCGTCCGGA TAGGTTGATT GAAAACAAAC

701 ACGGCATTGT TGCGGTTTAC CATAGAGATG GTGATAAGGT TGTTTATGGG

751 GCGAATGTAT ACGACGGCGC ATACAATACC GATATATTCA ATAGTGTCAA

801 CGGCATCGAA CGTGCCTATC TGCTACCCTC CCTGAAGTCC GGCATACGCC

851 GCATTTTCGT CGTTGGATTG AGTACAGGTT CGTGGGCGCG CGTCTTGTCT

901 GCCATTCCGG AAATGCAGTC GATGATCGTT GCGGAAATCA ATCCGGCATA

951 CCGTAGCCTT ATCGCGGAcg agccgcAAAT CGCACCGCTT TTGCAGGACA

1001 AACGTGTTGA AATTGTATTG GATGACGGTA GGAAATGGCT GCGTCGCCAT

1051 CCTGATGAAA AATTCGACCT GATTTGATG AATTCGACTT GGTACTGGCG

1101 TGCCTATTCC ACTAACCTGT TGAGTGCGGA ATTTTTAAAA CAGGTGCAAA

1151 GCCACCTTAC CCCGGATGGT ATTGTAATGT TTAATACCAC GCACAGCCCG
```

```
1201 CATgctTTTG CTACCGCCGT ACACAGTATT CCCTATGCAT ACCGCTACGG

1251 GCATATGGTA GTCGGCTCGG CAACCCCGGT AGTTTTCcct AATAAAGAAC

1301 TGCTCaagca aCGCCTTTcc cgGTTGATTT GGCCGGAAAG CGGCAGgcac 1351 gtATTTGACA GCAGCACCGT GGATGCTGCA GCACAAAAGG TTGtctctCG 1401 TATGCTGATT CGGATGACGG AAcctTCGGC TGGGGCGGAA GTCATTACTG

1451 ACGATAATAT GATTGTAGAA TACAAATACG GCAGAGGGAT TTAA
```

This corresponds to the amino acid sequence <SEQ ID 1320; ORF 402.ng>:

```
g402.pep
  1 MDMVNTKPNT SVINMLSFLT GLLSLGIEVL WVRMFSFAAQ SVPQAFSFIL

51 ACFLTGIAVG AYFGKRICRS RFVDIPFIGQ CFLWAGIADF LILGAAWLLT

101 GFSGFVHHAG IFITLSAVVR GLIFPLVHHV GTDGNKSGRQ VSNVYFANVA

151 GSALGPVLIG FVILDLLSTQ QIYLLICLIS AAVPLFCTLF QKSLRLNAVS

201 VAVSLMFGIL MFLLPDSVFQ NIAGRPDRLI ENKHGIVAVY HRDGDKVVYG

251 ANVYDGAYNT DIFNSVNGIE RAYLLPSLKS GIRRIFVVGL STGSWARVLS

301 AIPEMQSMIV AEINPAYRSL IADEPQIAPL LQDKRVEIVL DDGRKWLRRH

351 PDEKFDLILM NSTWYWRAYS TNLLSAEFLK QVQSHLTPDG IVMFNTTHSP

401 HAFATAVHSI PYAYRYGHMV VGSATPVVFP NKELLKQRLS RLIWPESGRH

451 VFDSSTVDAA AQKVVSRMLI RMTEPSAGAE VITDDNMIVE YKYGRGI*
```

The following partial DNA sequence was identified in *N. meningitidis* <SEQ ID 1321>:

```
m402.seq
   1 ATGGATATAG TGAACACTAA ACCGAATACT AGTTTGATTT ATATGCnTTC

51 TTTCCTTAGC GGCTTATTGA GCTTGGGTAT AGAAGTCTTG TGGGTGAGGA

101 TGTTTTCGTT CGCAGCACAG TCCGTGCCTC AGGCATTTTC ATTTACCCTT

151 GCCTGTTTTC TGACCGGTAT CGCCGTCGGC GCGTATTTTG GCAAACGGAT

201 TTGCCGCAGC CGCTTTGTTG ATATTCCCTT TATCGGGCAG TGCTTCTTGT

251 GGGCGGGTAT TGCCGACTTT TTGATTTTGG GTGCTGCGTG GTTGTTGACG

301 GGTTTTTCCG GCTTCGTCCA CCACGCCGGT ATCTTCATTA CCCTGTCTGC

351 CGTCGTCAsA sGGTTGATTT TCCCGCTCGT ACACCATGTG GGTACGGATG

401 GCAACAAATC CGGACGACAG GTTTCCAATG TTTATTTCGC CAmCGTTGCC

451 GGCAGTGCAT TGGGTCCGGT CCTTATCGGC TTTGTGATAC TTGATTTCTT

501 GTCCACCCAA CAGATTTACC TGCTCATCTG TwTGATTTCT GCTGCTGTCC

551 CTTTGTTTTG TACACTGTTC CAAAAAAGTC TCCGACTGAA TGCAGTGTCG

601 GTAGCAGTTT CCCTAATGTT CGGCATCCTC ATGTTCyTAC TGCCGGATTC

651 TGTCTTTCAA AATATTGCTG ACCGTCCGGA TAgGCTGATT GAAAACAAAC

701 ACGGCATTGT TGCGGTTTAC CATAGAGATG GTGATAAGGT TGTTTATGGG

751 GCGAATGTAT ACGACGGCGC ATACAATACC GATGTATTCA ATAGTGTCAA

801 CGGCATCGAA CGTGCCTATC TGCTACCCTC CCTGAAGTCT GGCATACGCC

851 GCATTTTCGT CGTTGGACTG AGTACAGGTT CGTGGGCGCG CGTCTTGTCT
```

```
-continued
 901 GCCATTCCGG AAATGCAGTC GATGATCGTT GCGGAAATCA ATCCGGCATA

951 CCGTAGCCTT ATCGCGGACG AGCCGCAAAT CGCCCCGCTT TTGCAGGACA

1001 AACGTGTTGA AATTGTATTG GATGACGGTA GGAAATGGCT GCGTCGCCAT

1051 CCTGATGAAA AATTCGACCT GATTTTGATG AATACGACTT GGTACTGGCG

1101 TGCCTATTCC ACCAACCTGT TGAGTGCGGA ATTTTTAAAA CAGGTGCAAA

1151 GCCACCTTAC CCCGGATGGT ATTGTAATGT TTAATACCAC GCACAGCCCG

1201 CATGCTTTTG CTACCGCCGT ACACAGTATT CCCTATGCAT ACCGCTATGG

1251 GCATATGGTA GTCGGCTCGG CAACCCCGGT AGTTTTCCCT AATAAAGAAC

1301 TGCTCAAGCA ACGTCTCTCC CGGTTGATTT GGCCGGAAAG CGGCAGGCAC

1351 GTATTTGACA GCAGCACCGT GGATGCTGCA GCACAAAAGG TTGTCTCTCG

1401 TATGCTGATT CAGATGACGG aAcCTTCGGC TGGGGCGGAA GTTATTACCG

1451 ACGATAATAT GATTGTAGAA TACAAATACG GCAGAGGGAT TTAA
```

This corresponds to the amino acid sequence <SEQ ID 1322; ORF 402>:

```
m402.pep
  1 MDIVNTKPNT SLIYMXSFLS GLLSLGIEVL WVRMFSFAAQ SVPQAFSFTL

51 ACFLTGIAVG AYFGKRICRS RFVDIPFIGQ CFLWAGIADF LILGAAWLLT

101 GFSGFVHHAG IFITLSAVVX XLIFPLVHHV GTDGNKSGRQ VSNVYFAXVA

151 GSALGPVLIG FVILDFLSTQ QIYLLICXIS AAVPLFCTLF QKSLRLNAVS

201 VAVSLMFGIL MFLLPDSVFQ NIADRPDRLI ENKHGIVAVY HRDGDKVVYG

251 ANVYDGAYNT DVFNSVNGIE RAYLLPSLKS GIRRIFVVGL STGSWARVLS

301 AIPEMQSMIV AEINPAYRSL IADEPQIAPL LQDKRVEIVL DDGRKWLRRH

351 PDEKFDLILM NTTWYWRAYS TNLLSAEFLK QVQSHLTPDG IVMFNTTHSP

401 HAFATAVHSI PYAYRYGHMV VGSATPVVFP NKELLKQRLS RLIWPESGRH

451 VFDSSTVDAA AQKVVSRMLI QMTEPSAGAE VITDDNMIVE YKYGRGI*
```

Computer analysis of this amino acid sequence gave the following results:
Homology with a Predicted ORF from *N. gonorrhoeae*
ORF 402 shows 97.0% identity over a 497 aa overlap with a predicted ORF (ORF 402.ng) from *N. gonorrhoeae*:

```
    m402/g402

10         20         30         40         50         60
      m402.pep   MDIVNTKPNTSLIYMXSFLSGLLSLGIEVLWVRMFSFAAQSVPQAFSFTLACFLTGIAVG
                 ||:||||||:| | |||:||||||||||||||||||||||||||||||| ||||||||||
         g402   MDMVNTKPNTSVINMLSFLTGLLSLGIEVLWVRMFSFAAQSVPQAFSILACFLTGIAVG
                 10         20         30         40         50         60

70         80         90        100        110        120
      m402.pep   AYFGKRICRSRFVDIPFIGQCFLWAGIADFLILGAAWLLTGFSGFVHHAGIFITLSAVVX
                 ||||||||||||||||||||||||||||||||||||||||||||||||||||||||||||
         g402   AYFGKRICRSRFVDIPFIGQCFLWAGIADFLILGAAWLLTGFSGFVHHAGIFITLSAVVR
                 70         80         90        100        110        120

130        140        150        160        170        180
      m402.pep   XLIFPLVHHVGTDGNKSGRQVSNVYFAXVAGSALGPVLIGFVILDFLSTQQIYLLICXIS
                 ||||||||||||||||||||||||||| |||||||||||||||||:|||||||||| ||
         g402   GLIFPLVHHVGTDGNKSGRQVSNVYFANVAGSALGPVLIGFVILDLLSTQQIYLLICLIS
                130        140        150        160        170        180
```

-continued

```
                        190        200        210        220        230        240
m402.pep        AAVPLFCTLFQKSLRLNAVSVAVSLMFGILMFLLPDSVFQNIADRPDRLIENKHGIVAVY
                |||||||||||||||||||||||||||||||||||||||||||| |||||||||||||||
g402            AAVPLFCTLFQKSLRLNAVSVAVSLMFGILMFLLPDSVFQNIAGRPDRLIENKHGIVAVY
                        190        200        210        220        230        240

250        260        270        280        290        300
m402.pep        HRDGDKVVYGANVYDGAYNTDVFNSVNGIERAYLLPSLKSGIRRIFVVGLSTGSWARVLS
                |||||||||||||||||||||:||||||||||||||||||||||||||||||||||||||
g402            HRDGDKVVYGANVYDGAYNTDIFNSVNGIERAYLLPSLKSGIRRIFVVGLSTGSWARVLS
                        250        260        270        280        290        300

310        320        330        340        350        360
m402.pep        AIPEMQSMIVAEINPAYRSLIADEPQIAPLLQDKRVEIVLDDGRKWLRRHPDEKFDLILM
                |||||||||||||||||||||||||| |||||||||||||||||||||||||||||||||
g402            AIPEMQSMIVAEINPAYRSLIADEPQIAPLLQDKRVEIVLDDGRKWLRRHPDEKFDLILM
                        310        320        330        340        350        360

370        380        390        400        410        420
m402.pep        NTTWYWRAYSTNLLSAEFLKQVQSHLTPDGIVMFNTTHSPHAFATAVHSIPYAYRYGHMV
                |:||||||||||||||||||||||||||||||||||||||||||||||||||||||||||
g402            NSTWYWRAYSTNLLSAEFLKQVQSHLTPDGIVMFNTTHSPHAFATAVHSIPYAYRYGHMV
                        370        380        390        400        410        420

430        440        450        460        470        480
m402.pep        VGSATPVVFPNKELLKQRLSRLIWPESGRHVFDSSTVDAAAQKVVSRMLIQMTEPSAGAE
                |||||||||||||||||||||||||||||||||||||||||||||||||:||||||||||
g402            VGSATPVVFPNKELLKQRLSRLIWPESGRHVFDSSTVDAAAQKVVSRMLIRMTEPSAGAE
                        430        440        450        460        470        480

490
m402.pep        VITDDNMIVEYKYGRGIX
                ||||||||||||||||
g402            VITDDNMIVEYKYGRGI
                        490
```

The following partial DNA sequence was identified in *N. meningitidis* <SEQ ID 1323>:

```
a402.seq
   1 ATGGATATAG TGAACACTAA ACCGAATACT AGTTTGATTT ATATGCTTTC
  51 TTTCCTTAGC GGCTTATTGA GCTTGGGTAT AGAAGTCTTG TGGGTAAGGA
 101 TGTTTTCGTT CGCAGCACAG TCCGTGCCTC AGGCATTTTC ATTTACTCTT
 151 GCCTGTTTTC TGACCGGTAT CGCCGTCGGC GCGTATTTTG GCAAACGGAT
 201 TTGCCGCAGC CGCTTTGTTG ATATTCCCTT TATCGGGCAG TGCTTCTTGT
 251 GGGCGGGTAT TGCCGACTTT TTGATTTTGG GTGCTGCGTG GTTGTTGACG
 301 GGTTTTTCCG GCTTCGTCCA CCACGCCGGT ATCTTCATTA CCCTGTCTGC
 351 CGTCGTCAGA GGGTTGATTT TCCCGCTCGT ACACCATGTG GGTACGGATG
 401 GCAACAAATC CGGACGACAG GTTTCCAATG TTTATTTCGC CAACGTTGCC
 451 GGCAGTGCAT TGGGTCCGGT CCTTATCGGC TTTGTGATAC TTGATTTCTT
 501 GTCCACCCAA CAGATTTACC TGCTCATCTG TTTGATTTCT GCTGCTGTCC
 551 CTTTGTTTTG TACACTGTTC CAAAAAAGTC TCCGACTGAA TGCAGTGTCG
 601 GTAGCAGTTT CCCTAATGTT CGGCATCCTC ATGTTCCTAC TGCCGGATTC
 651 TGTCTTTCAA AATATTGCTG ACCGTCCGGA TAGGCTGATT GAAAACAAAC
 701 ACGGCATTGT TGCGGTTTAC CATAGAGATG GTGATAAGGT TGTTTATGGG
 751 GCGAATGTAT ACGACGGCGC ATACAATACC GATGTATTCA ATAGTGTCAA
 801 CGGCATCGAA CGTGCCTATC TGCTACCCTC CCTGAAGTCT GGCATACGCC
 851 GCATTTTCGT CGTTGGATTG AGTACAGGTT CGTGGGCGCG CGTCTTGTCT
```

-continued
```
 901 GCCATTCCGG AAATGCAGTC GATGATCGTT GCGGAAATCA ATCCGGCATA
 951 CCGTAGCCTT ATCGCGGACG AGCCGCAAAT CGCCCCGCTT TTGCAGGACA
1001 AACGTGTTGA AATTGTATTG GATGACGGTA GGAAATGGCT GCGTCGCCAT
1051 CCTGATGAAA AATTCGACCT GATTTTGATG AATACGACTT GGTACTGGCG
1101 TGCCTATTCC ACCAACCTGT TGAGTGCGGA ATTTTTAAAA CAGGTGCAAA
1151 GCCACCTTAC CCCGGATGGT ATTGTAATGT TTAATACCAC GCACAGCCCG
1201 CATGCTTTTG CTACCGCCGT ACACAGTATT CCCTATGCAT ACCGCTATGG
1251 GCATATGGTA GTCGGCTCGG CAACCCCGGT AGTTTTCCCT AATAAAGAAC
1301 TGCTCAAGCA ACGTCTCTCC CGGTTGATTT GGCCGGAAAG CGGCAGGCAC
1351 GTATTTGACA GCAGCACCGT GGATGCTGCA GCACAAAAGG TTGTCTCTCG
1401 TATGCTGATT CAGATGACGG AACCTTCGGC TGGTGCGGAA GTCATTACCG
1451 ACGATAATAT GATTGTAGAA TACAAATACG GCAGAGGGAT TTAA
```

This corresponds to the amino acid sequence <SEQ ID 1324; ORF 402.a>:

```
a402.pep
  1 MDIVNTKPNT SLIYMLSFLS GLLSLGIEVL WVRMFSFAAQ SVPQAFSFTL
 51 ACFLTGIAVG AYFGKRICRS RFVDIPFIGQ CFLWAGIADF LILGAAWLLT
101 GFSGFVHHAG IFITLSAVVR GLIFPLVHHV GTDGNKSGRQ VSNVYFANVA
151 GSALGPVLIG FVILDFLSTQ QIYLLICLIS AAVPLFCTLF QKSLRLNAVS
201 VAVSLMFGIL MFLLPDSVFQ NIADRPDRLI ENKHGIVAVY HRDGDKVVYG
251 ANVYDGAYNT DVFNSVNGIE RAYLLPSLKS GIRRIFVVGL STGSWARVLS
301 AIPEMQSMIV AEINPAYRSL IADEPQIAPL LQDKRVEIVL DDGRKWLRRH
351 PDEKFDLILM NTTWYWRAYS TNLLSAEFLK QVQSHLTPDG IVMFNTTHSP
401 HAFATAVHSI PYAYRYGHMV VGSATPVVFP NKELLKQRLS RLIWPESGRH
451 VFDSSTVDAA AQKVVSRMLI QMTEPSAGAE VITDDNMIVE YKYGRGI*
``` m402/a402 99.0% identity in 497 aa overlap

```
                 10         20         30         40         50         60
m402.pep MDIVNTKPNTSLIYMXSFLSGLLSLGIEVLWVRMFSFAAQSVPQAFSFTLACFLTGIAVG
         ||||||||||||||| ||||||||||||| |||||||||||||||||||||||||||||
a402     MDDPRTYGSGNPGATLVLRSGKKKAAALTLLGDAAKGLVAVLLARVLQEPLGLSDSAIAA
                 10         20         30         40         50         60

70         80         90        100        110        120
m402.pep AYFGKRICRSRFVDIPFIGQCFLWAGIADFLILGAAWLLTGFSGFVHHAGIFITLSAVVX
         ||||||||||||||||||||||||||||||||||||||||||||||||||||||||||
a402     AYFGKRICRSRFVDIPFIGQCFLWAGIADFLILGAAWLLTGFSGFVHHAGIFITLSAVVR
                 70         80         90        100        110        120

130        140        150        160        170        180
m402.pep XLIFPLVHHVGTDGNKSGRQVSNVYFAXVAGSALGPVLIGFVILDFLSTQQIYLLICXIS
          |||||||||||||||||||||||| |||||||||||||||||||||||||||||| ||
a402     GLIFPLVHHVGTDGNKSGRQVSNVYFANVAGSALGPVLIGFVILDFLSTQQIYLLICLIS
                130        140        150        160        170        180

190        200        210        220        230        240
m402.pep AAVPLFCTLFQKSLRLNAVSVAVSLMFGILMFLLPDSVFQNIADRPDRLIENKHGIVAVY
         ||||||||||||||||||||||||||||||||||||||||||||||||||||||||||
a402     AAVPLFCTLFQKSLRLNAVSVAVSLMFGILMFLLPDSVFQNIADRPDRLIENKHGIVAVY
                190        200        210        220        230        240

250        260        270        280        290        300
m402.pep HRDGDKVVYGANVYDGAYNTDVFNSVNGIERAYLLPSLKSGIRRIFVVGLSTGSWARVLS
         ||||||||||||||||||||||||||||||||||||||||||||||||||||||||||
a402     HRDGDKVVYGANVYDGAYNTDVFNSVNGIERAYLLPSLKSGIRRIFVVGLSTGSWARVLS
                250        260        270        280        290        300
```

-continued

```
              310        320        330        340        350        360
m402.pep  AIPEMQSMIVAEINPAYRSLIADEPQIAPLLQDKRVEIVLDDGRKWLRRHPDEKGDLILM
          ||||||||||||||||||||||||||||||||||||||||||||||||||||||||||||
a402      AIPEMQSMIVAEINPAYRSLIADEPQIAPLLQDKRVEIVLDDGRKWLRRHPDEKGDLILM
              310        320        330        340        350        360

370        380        390        400        410        420
m402.pep  NTTWYWRAYSTNLLSAEFLKQVQSHLTPDGIVMFNTTHSPHAFATAVHSIPYAYRYGHMV
          ||||||||||||||||||||||||||||||||||||||||||||||||||||||||||||
a402      NTTWYWRAYSTNLLSAEFLKQVQSHLTPDGIVMFNTTHSPHAFATAVHSIPYAYRYGHMV
              370        380        390        400        410        420

430        440        450        460        470        480
m402.pep  VGSATPVVFPNKELLKQRLSRLIWPESGRHVFDSSTVDAAAQKVVSRMLIQMTEPSAGAE
          ||||||||||||||||||||||||||||||||||||||||||||||||||||||||||||
a402      VGSATPVVFPNKELLKQRLSRLIWPESGRHVFDSSTVDAAAQKVVSRMLIQMTEPSAGAE
              430        440        450        460        470        480

490
m402.pep  VITDDNMIVEYKYGRGIX
          ||||||||||||||||||
a402      VITDDNMIVEYKYGRGIX
              490
```

The following partial DNA sequence was identified in *N. gonorrhoeae* <SEQ ID 1325>:

```
g406.seq
  1 ATGCGGGCAC GGCTGCTGAT ACCTATTCTT TTTTCAGTTT TTATTTTATC

51 CGCCTGCGGG ACACTGACAG GTATTCCATC GCATGGCGGA GGCAAACGCT

101 TCGCGGTCGA ACAAGAACTT GTGGCCGCTT CTGCCAGAGC TGCCGTTAAA

151 GACATGGATT TACAGGCATT ACACGGACGA AAAGTTGCAT TGTACATTGC

201 AACTATGGGC GACCAAGGTT CAGGCAGTTT GACAGGGGGT CGCTACTCCA

251 TTGATGCACT GATTCGCGGC GAATACATAA ACAGCCCTGC CGTCCGCACC

301 GATTACACCT ATCCGCGTTA CGAAACCACC GCTGAAACAA CATCAGGCGG

351 TTTGACGGGT TTAACCACTT CTTTATCTAC ACTTAATGCC CCTGCACTCT

401 CGCGCACCCA ATCAGACGGT AGCGGAAGTA GGAGCAGTCT GGGCTTAAAT

451 ATTGGCGGGA TGGGGGATTA TCGAAATGAA ACCTTGACGA CCAACCCGCG

501 CGACACTGCC TTTCTTTCCC ACTTGGTGCA GACCGTATTT TTCCTGCGCG

551 GCATAGACGT TGTTTCTCCT GCCAATGCCG ATACAGATGT GTTTATTAAC

601 ATCGACGTAT TCGGAACGAT ACGCAACAGA ACCGAAATGC ACCTATACAA

651 TGCCGAAACA CTGAAAGCCC AAACAAAACT GGAATATTTC GCAGTAGACA

701 GAACCAATAA AAAATTGCTC ATCAAACCCA AAACCAATGC GTTTGAAGCT

751 GCCTATAAAG AAAATTACGC ATTGTGGATG GGGCCGTATA AAGTAAGCAA

801 AGGAATCAAA CCGACGGAAG GATTGATGGT CGATTTCTCC GATATCCAAC

851 CATACGGCAA TCATACGGGT AACTCCGCCC CATCCGTAGA GGCTGATAAC

901 AGTCATGAGG GGTATGGATA CAGCGATGAA GCAGTGCGAC AACATAGACA

951 AGGGCAACCT TGA
```

This corresponds to the amino acid sequence <SEQ ID 1326; ORF 406>:

```
g406.pep
  1 MRARLLIPIL FSVFILSACG TLTGIPSHGG GKRFAVEQEL VAASARAAVK

51 DMDLQALHGR KVALYIATMG DQGSGSLTGG RYSIDALIRG EYINSPAVRT

101 DYTYPRYETT AETTSGGLTG LTTSLSTLNA PALSRTQSDG SGSRSSLGLN
```

-continued

```
151 IGGMGDYRNE TLTTNPRDTA FLSHLVQTVF FLRGIDVVSP ANADTDVFIN

201 IDVFGTIRNR TEMHLYNAET LKAQTKLEYF AVDRTNKKLL IKPKTNAFEA

251 AYKENYALWM GPYKVSKGIK PTEGLMVDFS DIQPYGNHTG NSAPSVEADN

301 SHEGYGYSDE AVRQHRQGQP *
```

The following partial DNA sequence was identified in *N. meningitidis* <SEQ ID 1327>:

```
m406.seq
   1 ATGCAAGCAC GGCTGCTGAT ACCTATTCTT TTTTCAGTTT TTATTTTATC

51 CGCCTGCGGG ACACTGACAG GTATTCCATC GCATGGCGGA GGTAAACGCT

101 TTGCGGTCGA ACAAGAACTT GTGGCCGCTT CTGCCAGAGC TGCCGTTAAA

151 GACATGGATT TACAGGCATT ACACGGACGA AAAGTTGCAT TGTACATTGC

201 CACTATGGGC GACCAAGGTT CAGGCAGTTT GACAGGGGGT CGCTACTCCA

251 TTGATGCACT GATTCGTGGC GAATACATAA ACAGCCCTGC CGTCCGTACC

301 GATTACACCT ATCCACGTTA CGAAACCACC GCTGAAACAA CATCAGGCGG

351 TTTGACAGGT TTAACCACTT CTTTATCTAC ACTTAATGCC CCTGCACTCT

401 CTCGCACCCA ATCAGACGGT AGCGGAAGTA AAAGCAGTCT GGGCTTAAAT

451 ATTGGCGGGA TGGGGGATTA TCGAAATGAA ACCTTGACGA CTAACCCGCG

501 CGACACTGCC TTTCTTTCCC ACTTGGTACA GACCGTATTT TTCCTGCGCG

551 GCATAGACGT TGTTTCTCCT GCCAATGCCG ATACAGATGT GTTTATTAAC

601 ATCGACGTAT TCGGAACGAT ACGCAACAGA ACCGAAATGC ACCTATACAA

651 TGCCGAAACA CTGAAAGCCC AAACAAAACT GGAATATTTC GCAGTAGACA

701 GAACCAATAA AAAATTGCTC ATCAAACCAA AAACCAATGC GTTTGAAGCT

751 GCCTATAAAG AAAATTACGC ATTGTGGATG GGGCCGTATA AAGTAAGCAA

801 AGGAATTAAA CCGACGGAAG GATTAATGGT CGATTTCTCC GATATCCGAC

851 CATACGGCAA TCATACGGGT AACTCCGCCC CATCCGTAGA GGCTGATAAC

901 AGTCATGAGG GGTATGGATA CAGCGATGAA GTAGTGCGAC AACATAGACA

951 AGGACAACCT TGA
```

This corresponds to the amino acid sequence <SEQ ID 1328; ORF 406>:

```
m406.pep
   1 MQARLLIPIL FSVFILSACG TLTGIPSHGG GKRFAVEQEL VAASARAAVK

51 DMDLQALHGR KVALYIATMG DQGSGSLTGG RYSIDALIRG EYINSPAVRT

101 DYTYPRYETT AETTSGGLTG LTTSLSTLNA PALSRTQSDG SGSKSSLGLN

151 IGGMGDYRNE TLTTNPRDTA FLSHLVQTVF FLRGIDVVSP ANADTDVFIN

201 IDVFGTIRNR TEMHLYNAET LKAQTKLEYF AVDRTNKKLL IKPKTNAFEA

251 AYKENYALWM GPYKVSKGIK PTEGLMVDFS DIRPYGNHTG NSAPSVEADN

301 SHEGYGYSDE VVRQHRQGQP *
```

Computer analysis of the amino acid sequences gave the following results:

Homology with a Predicted ORF from *N. meningitidis* menA with menB ORF 406 shows 98.8% identity over a 320 aa overlap with a predicted ORF (ORF406.a) from *N. gonorrhoeae*:

```
g406/m406

10         20         30         40         50         60
g406.pep   MRARLLIPILFSVFILSACGTLTGIPSHGGGKRFAVEQELVAASARAAVKDMDLQALHGR
           |:||||||||||||||||||||||||||||||||||||||||||||||||||||||||||
m406       MQARLLIPILFSVFILSACGTLTGIPSHGGGKRFAVEQELVAASARAAVKDMDLQALHGR
                   10         20         30         40         50         60

70         80         90        100        110        120
g406.pep   KVALYIATMGDQGSGSLTGGRYSIDALIRGEYINSPAVRTDYTYPRYETTAETTSGGLTG
           ||||||||||||||||||||||||||||||||||||||||||||||||||||||||||||
m406       KVALYIATMGDQGSGSLTGGRYSIDALIRGEYINSPAVRTDYTYPRYETTAETTSGGLTG
                   70         80         90        100        110        120

130        140        150        160        170        180
g406.pep   LTTSLSTLNAPALSRTQSDGSGSRSSLGLNIGGMGDYRNETLTTNPRDTAFLSHLVQTVF
           |||||||||||||||||||||||||||:||||||||||||||||||||||||||||||||
m406       LTTSLSTLNAPALSRTQSDGSGSKSSLGLNIGGMGDYRNETLTTNPRDTAFLSHLVQTVF
                  130        140        150        160        170        180

190        200        210        220        230        240
g406.pep   FLRGIDVVSPANADTDVFINIDVFGTIRNRTEMHLYNAETLKAQTKLEYFAVDRTNKKLL
           ||||||||||||||||||||||||||||||||||||||||||||||||||||||||||||
m406       FLRGIDVVSPANADTDVFINIDVFGTIRNRTEMHLYNAETLKAQTKLEYFAVDRTNKKLL
                  190        200        210        220        230        240

250        260        270        280        290        300
g406.pep   IKPKTNAFEAAYKENYALWMGPYKVSKGIKPTEGLMVDFSDIQPYGNHTGNSAPSVEADN
           |||||||||||||||||||||||||||||||||||||||||:||||||||||||||||||
m406       IKPKTNAFEAAYKENYALWMGPYKVSKGIKPTEGLMVDFSDIRPYGNHTGNSAPSVEADN
                  250        260        270        280        290        300

310        320
g406.pep   SHEGYGYSDEAVRQHRQGQPX
           |||||||||:|||||||||||
m406       SHEGYGYSDEVVRQHRQGQPX
                  310        320
```

The following partial DNA sequence was identified in *N. meningitidis* <SEQ ID 1329>:

```
a406.seq
  1 ATGCAAGCAC GGCTGCTGAT ACCTATTCTT TTTTCAGTTT TTATTTTATC

51 CGCCTGCGGG ACACTGACAG GTATTCCATC GCATGGCGGA GGTAAACGCT

101 TCGCGGTCGA ACAAGAACTT GTGGCCGCTT CTGCCAGAGC TGCCGTTAAA

151 GACATGGATT TACAGGCATT ACACGGACGA AAAGTTGCAT TGTACATTGC

201 AACTATGGGC GACCAAGGTT CAGGCAGTTT GACAGGGGGT CGCTACTCCA

251 TTGATGCACT GATTCGTGGC GAATACATAA ACAGCCCTGC CGTCCGTACC

301 GATTACACCT ATCCACGTTA CGAAACCACC GCTGAAACAA CATCAGGCGG

351 TTTGACAGGT TTAACCACTT CTTTATCTAC ACTTAATGCC CCTGCACTCT

401 CGCGCACCCA ATCAGACGGT AGCGGAAGTA AAAGCAGTCT GGGCTTAAAT

451 ATTGGCGGGA TGGGGGATTA TCGAAATGAA ACCTTGACGA CTAACCCGCG

501 CGACACTGCC TTTCTTTCCC ACTTGGTACA GACCGTATTT TTCCTGCGCG

551 GCATAGACGT TGTTTCTCCT GCCAATGCCG ATACGGATGT GTTTATTAAC

601 ATCGACGTAT TCGGAACGAT ACGCAACAGA ACCGAAATGC ACCTATACAA

651 TGCCGAAACA CTGAAAGCCC AAACAAAACT GGAATATTTC GCAGTAGACA
```

-continued

```
701 GAACCAATAA AAAATTGCTC ATCAAACCAA AAACCAATGC GTTTGAAGCT

751 GCCTATAAAG AAAATTACGC ATTGTGGATG GGACCGTATA AAGTAAGCAA

801 AGGAATTAAA CCGACAGAAG GATTAATGGT CGATTTCTCC GATATCCAAC

851 CATACGGCAA TCATATGGGT AACTCTGCCC CATCCGTAGA GGCTGATAAC

901 AGTCATGAGG GGTATGGATA CAGCGATGAA GCAGTGCGAC GACATAGACA

951 AGGGCAACCT TGA
```

This corresponds to the amino acid sequence <SEQ ID 1330; ORF 406.a>:

```
a406.pep

1  MQARLLIPIL  FSVFILSACG  TLTGIPSHGG  GKRFAVEQEL  VAASARAAVK

51  DMDLQALHGR  KVALYIATMG  DQGSGSLTGG  RYSIDALIRG  EYINSPAVRT

101  DYTYPRYETT  AETTSGGLTG  LTTSLSTLNA  PALSRTQSDG  SGSKSSLGLN

151  IGGMGDYRNE  TLTTNPRDTA  FLSHLVQTVF  FLRGIDVVSP  ANADTDVFIN

201  IDVFGTIRNR  TEMHLYNAET  LKAQTKLEYF  AVDRTNKKLL  IKPKTNAFEA

251  AYKENYALWM  GPYKVSKGIK  PTEGLMVDFS  DIQPYGNHMG  NSAPSVEADN

301  SHEGYGYSDE  AVRRHRQGQP  * m406/a406  98.8% identity in 320 aa overlap 10         20         30         40         50         60
    m406.pep  MQARLLIPILFSVFILSACGTLTGIPSHGGGKRFAVEQELVAASARAAVKDMDLQALHGR
              ||||||||||||||||||||||||||||||||||||||||||||||||||||||||||||
    a406      MQARLLIPILFSVFILSACGTLTGIPSHGGGKRFAVEQELVAASARAAVKDMDLQALHGR
                   10         20         30         40         50         60

70         80         90        100        110        120
    m406.pep  KVALYIATMGDQGSGSLTGGRYSIDALIRGEYINSPAVRTDYTYPRYETTAETTSGGLTG
              ||||||||||||||||||||||||||||||||||||||||||||||||||||||||||||
    a406      KVALYIATMGDQGSGSLTGGRYSIDALIRGEYINSPAVRTDYTYPRYETTAETTSGGLTG
                   70         80         90        100        110        120

130        140        150        160        170        180
    m406.pep  LTTSLSTLNAPALSRTQSDGSGSKSSLGLNIGGMGDYRNETLTTNPRDTAFLSHLVQTVF
              ||||||||||||||||||||||||||||||||||||||||||||||||||||||||||||
    a406      LTTSLSTLNAPALSRTQSDGSGSKSSLGLNIGGMGDYRNETLTTNPRDTAFLSHLVQTVF
                  130        140        150        160        170        180

190        200        210        220        230        240
    m406.pep  FLRGIDVVSPANADTDVFINIDVFGTIRNRTEMHLYNAETLKAQTKLEYFAVDRTNKKLL
              ||||||||||||||||||||||||||||||||||||||||||||||||||||||||||||
    a406      FLRGIDVVSPANADTDVFINIDVFGTIRNRTEMHLYNAETLKAQTKLEYFAVDRTNKKLL
                  190        200        210        220        230        240

250        260        270        280        290        300
    m406.pep  IKPKTNAFEAAYKENYALWMGPYKVSKGIKPTEGLMVDFSDIRPTGNHTGNSAPSVEADN
              |||||||||||||||||||||||||||||||||||||||:|||| |||||||||||||||
    a406      IKPKTNAFEAAYKENYALWMGPYKVSKGIKPTEGLMVDFSDIQPYGNHMGNSAPSVEADN
                  250        260        270        280        290        300

310        320
    m406.pep  SHEGYGYSDEVVRQHRQGQPX
              ||||||||||:||:|||||||
    a406      SHEGYGYSDEAVRRHRQGQPX
                  310        320
```

The following partial DNA sequence was identified in *N. gonorrhoeae* <SEQ ID 1331>:

```
g501.seq
   1  atggtcggac ggaccttgac cgcagatacc gacatatttg ttctgcttgc,
```

-continued

```
  51 ggcaggcgga gatggcaaga tgcagcatca ctttgacggc agggttgcgt
 101 tcgtcaaacg attcggacac caagccgctg tctcggtcga ggccgagggt
 151 cagctgggtc atgtcgttcg agccgatgga gaagccgtcg aagtattgca
 201 ggaattgttc cgccaatacc gcgttgctcg gcagctcgca catcataatc
 251 aggcgcaggc cgttttttgcc gcgttccaag ccgttttctt tcaatgcctt
 301 aaccactgct tcggcttcgc ccaaagtgcg gacgaacgga atcatgattt
 351 cgacgttggt cagacccatt tcgtcacgaa cgcgtttcaa ggctttgcat
 401 tccaaggcga aacagtcttt gaagctctcg gcaacataac gcgccgcacc
 451 acggaagccc aacatcgggt tttcttcatg cggttcgtat acgctgccgc
 501 cgaccaggtt ggcgtattcg ttggatttga agtcggacat acggacgatg
 551 gttttacgcg gataaaccga tgcggcaagc gttgccacgc cttcggcgat
 601 tttatcgacg tagaagtcga caggggatgc gtaaccggcg atgcggcgga
 651 taatttccgc tttcagttcg tcgtcttgtt tgtcaaattc caacaaggct
 701 ttcgggtgga tgccgatttg gcggttgatg ataaattcca tacgcgccaa
 751 gccgatgcct tcgctgggca gattggcgaa gctgaatgcg agttcgggat
 801 tgccgacgtt catcatgact ttgacgggtg cttttggcat attgtccaag
 851 gcgacatcgg taatttgtac gtccagcagg ccggcataga taaagccggt
 901 atcgccttcg gcacaggata cggtaacttc ctgaccgttt ccaagagtt
 951 cggtcgcatt gccgcagccg acgacggcag gaatacccag ttcgcgcgcg
1001 atgatggcgg cgtggcaggt gcgtccgccg cggttggtca cgatggcgga
1051 agcacgtttc atcacgggtt cccaatccgg atcggtcatg tcggtaacca
1101 gtacgtcgcc ggcttcgacg gaatccatct cggaagcatc tttaatcagg
1151 cgcaccttgc cctgaccgac ttttttgaccg atggcacgac cttcgcacaa
1201 gacggttttt tcgccgttga tggcgtagcg gcgcaggttg cggctgcctt
1251 cttcttggga tttgacggtt tcggggcggg cttgcaggat gtagagtttg
1301 ccgtccaggc cgtcgcgtcc ccattcgata tccatcgggc ggccgtagtg
1351 ttttttcgatg gtcagcgcgt agtgtgccaa ctcggtgatt tcttcgtcgg
1401 taatggagaa gcggttgcgg tcttcttcgg ggacttcgac gttggttacc
1451 gatttgccgg cttcggcttt gtcggtgaaa atcattttga tgtgtttcga
1501 acccatggtc ttgcgcagga tggcgggttt gcctgctttg agcgtgggtt
1551 tgaacacata aaattcgtcc gggttgaccg cgccttgtac gacgttttcg
1601 cccagaccgt aagaggaggt aacaaagacg acttggttgt agccggattc
1651 ggtgtcgagg gtgaacatca cacctga
```

This corresponds to the amino acid sequence <SEQ ID 1332; ORF 501.ng>:

g501.pep

```
  1 MVGRTLTADT DIFVLLAAGG DGKMQHHFDG RVAFVKRFGH QAAVSVEAEG

51 QLGHVVRADG EAVEVLQELF RQYRVARQLA HHNQAQAVFA AFQAVFFQCL

101 NHCFGFAQSA DERNHDFDVG QTHFVTNAFQ GFAFQGETVF EALGNITRRT

151 TEAQHRVFFM RFVYAAADQV GVFVGFEVGH TDDGFTRINR CGKRCHAFGD
```

-continued

```
201 FIDVEVDRGC VTGDAADNFR FQFVVLFVKF QQGFRVDADL AVDDKFHTRQ

251 ADAFAGQIGE AECEFGIADV HHDFDGCFWH IVQGDIGNLY VQQAGIDKAG

301 IAFGTGYGNF LTVFQEFGRI AAADDGRNTQ FARDDGGVAG ASAAVGHDGG

351 STFHHGFPIR IGHVGNQYVA GFDGIHLGSI FNQAHLALTD FLTDGTTFAQ

401 DGFFAVDGVA AQVAAAFFLG FDGFGAGLQD VEFAVQAVAS PFDIHRAAVV

451 FFDGQRVVCQ LGDFFVGNGE AVAVFFGDFD VGYRFAGFGF VGENHFDVFR

501 THGLAQDGGF ACFERGFEHI KFVRVDRALY DVFAQTVRGG NKDDLVVAGF

551 GVEGEHHT*
```

The following partial DNA sequence was identified in *N. meningitidis* <SEQ ID 1333>:

```
m501.seq
   1 atggtcggac sggccttgac cgcagatgcc gacatatttg ttctgcttgc 51 ggcaggcgga gatggcaagg tgcagcatca ctttgacggc agggttgcgt 101 tcgtcaaacg attcggatac caagccgctg tcgcggtcga gaccgagggt 151 cagttgggtc atgtcgttcg agccgatgga gaagccgtcg aagtattgca 201 ggaattgttc cgccaatacc gcgttgctcg gcagctcgca catcataatc 251 aggcgcaggc cgtttttgcc gcgttccaag ccgttttctt tcagggcttt 301 gacaacggmt tcggcttcgc ccaaagtgcg gacgaacgga atcatgattt 351 caacgttggy caaccccatt tcatcgcgga cgcgtttcaa ggctttgcat 401 tccaaggcga aacagtcttt gaagttgtcg gcgacataac gcgccgcacc 451 acggaagccc aacatcgggt tttcttcatg cggttcgtat acgttgccgc 501 cgaccaggtt ggcgtattcg ttggatttga agtcggacat acggacgatg 551 gttttacgcg gataaaccga tgcggccaat gtcgccacgc cttcggcgat 601 tttatcgacg tagaagtcga caggggacgc gtaaccggcg atacggcggg 651 taatttccgc ttttaattcg tcgtcttgtt tgtcaaattc caacaargct 701 ttggggtgga taccgatttg gcggttgatg ataaattcca tacgcgccaa 751 gccgatgcct tcgctgggca ggttggcgaa gctgaatgcg agttcgggat 801 tgccgacgtt catcatgact tttacaggtg ctttaggcat attgtctaag 851 gcgacatcgg taatctgtac gtccaacaga ccggcataga taaagccggt 901 atcgccttcg gcacaggata cggtaacttc ttgaccgttt ttcagcaatt 951 cggttgcatt gccgcagccg acaacggcag gaatgcccaa ttcacgcgcg 1001 atgatggcgg cgtggcaggt acggccgccg cggttggtaa cgatggcaga 1051 agcacgtttc atcacgggtt cccaatccgg atcggtcatg tcggtaacga 1101 gtacgtcgcc ggcttcgacg gaatccatct cggaagcatc tttaatcagg 1151 cgcaccttgc cctgaccgac tttctgaccg atggcgcggc cttcgcataa 1201 tacggttttg tcgccgttga tggcgaagcg gcgcaggttg cggttgccct 1251 cttcttggga ttttacggtt tcgggacggg cttgcaggat gtagagtttg 1301 ccgtccaagc cgtcgcgtcc ccattcgata tccatcgggc ggccgtagtg 1351 tttttcgatg gtcagtgcgt aatgcgccaa ctcagtaatt tcttcgtcgg 1401 taatggagaa gcggttgcgg tcttcctcgg ggacatcgac gttggttacg
```

-continued
```
1451 gatttaccgg cttctgcttt gtcggtaaaa atcattttga tgtgttttga 1501 acccatggtt ttacgcagga tggcgggctt gcccgytttg agcgtgggtt 1551 tgaacacatr aaattcgtcc gggttgaccg caccttgtac gacgttttcg 1601 cccagaccgt aagaggaggt aacaaagacg acytgatcgt akccggattc 1651 ggtgtcgagg gtgaacatca cacctga
```

This corresponds to the amino acid sequence <SEQ ID 1334; ORF 501>:

```
m501.pep
  1 MVGXALTADA DIFVLLAAGG DGKVQHHFDG RVAFVKRFGY QAAVAVETEG

51 QLGHVVRADG EAVEVLQELF RQYRVARQLA HHNQAQAVFA AFQAVFFQGF

101 DNGFGFAQSA DERNHDFNVG QPHFIADAFQ GFAFQGETVF EVVGDITRRT

151 TEAQHRVFFM RFVYVAADQV GVFVGFEVGH TDDGFTRINR CGQCRHAFGD

201 FIDVEVDRGR VTGDTAGNFR FXFVVLFVKF QQXFGVDTDL AVDDKFHTRQ

251 ADAFAGQVGE AECEFGIADV HHDFYRCFRH IVXGDIGNLY VQQTGIDKAG

301 IAFGTGYGNF LTVFQQFGCI AAADNGRNAQ FTRDDGGVAG TAAAVGNDGR

351 STFHHGFPIR IGHVGNEYVA GFDGIHLGSI FNQAHLALTD FLTDGAAFAX

401 YGFVAVDGEA AQVAVALFLG FYGFGTGLQD VEFAVQAVAS PFDIHRAAVV

451 FFDGQCVMRQ LSNFFVGNGE AVAVFLGDID VGYGFTGFCF VGKNHFDVFX

501 THGFTQDGGL ARFERGFEHX KFVRVDRTLY DVFAQTVRGG NKDDLIVXGF

551 GVEGEHHT*
```

Computer analysis of this amino acid sequence gave the following results:

Homology with a Predicted ORF from *N. gonorrhoeae*

ORF 501 shows 86.2% identity over a 558 aa overlap with a predicted ORF (ORF 501.ng) from *N. gonorrhoeae*:

```
m501/g501

10         20         30         40         50         60
      m501.pep MVGXALTADADIFVLLAAGGDGKVQHHFDGRVAFVKRFGYQAAVAVETEGQLGHVVRADG
               ||| :||||:||||||||||:||||||||||||||||:||||:||:||||||||||
          g501 MVGRTLTADTDIFVLLAAGGDGKMQHHFDGRVAFVKRGFHQAAVSVEAEGQLGHVVRADG
                   10         20         30         40         50         60

70         80         90        100        110        120
      m501.pep EAVEVLQELFRQYRVARQLAHHNQAQAVFAAFQAVFFQGFDNGFGFAQSADERNHDFNVG
               ||||||||||||||||||||||||||||||||||||||| :::|||||||||||||:||
          g501 EAVEVLQELFRQYRVARQLAHHNQAQAVFAAFQAVFFQCLNHCFGFAQSADERNHDFDVG
                   70         80         90        100        110        120

130        140        150        160        170        180
      m501.pep QPHFIADAFQGFAFQGETVFEVVGDITRRTTEAQHRVFFMRFVYVAADQVGVFVGFEVGH
               | ||:::|||||||||||||::|||||||||||||||||||||:|||||||||||||||
          g501 QTHFVTNAFQGFAFQGETVFEALGNITRRTTEAQHRVFFMRFVYAAADQVGVFVGFEVGH
                  130        140        150        160        170        180

190        200        210        220        230        240
      m501.pep TDDGFRTINRCGQCRHAFGDFIDVEVDRGRVTGDTAGNFRFXFVVLFVKFQQXFGVDTDL
               ||||||||||:  ||||||||||||||||| |||:|||||||:||||||||| ||:||
          g501 TDDGFRTINRCGKRCHAFGDFIDVEVDRGCVTGDAADNFRFQFVVLFVKFQQGFRVDADL
                  190        200        210        220        230        240

250        260        270        280        290        300
      m501.pep AVDDKFHTRQADAFAGQVGEAECEFGIADVHHDFYRCFRHIVXGDIGNLYVQQTGIDKAG
               ||||||||||||||||||:|||||||||||||||||:|| |||||||||||:||||||
          g501 AVDDKFHTRQADAFAGQIGEAECEFGIADVHHDFDGCFWHIVQGDIGNLYVQQAGIDKAG
                  250        260        270        280        290        300
```

-continued

```
                310       320       330       340       350       360
m501.pep IAFGTGYGNFLTVFQQFGCIAAADNGRNAQFTRDDGGVAGTAAAVGNDGRSTFHHGFPIR
         |||||||||||||||:|| |||||:|||:||:||||||||::||||:|| ||||||||||
g501     IAFGTGYGNFLTVFQEFGRIAAADDGRNTQFARDDGGVAGASAAVGHDGGSTFHHGFPIR
                310       320       330       340       350       360

370       380       390       400       410       420
m501.pep IGHVGNEYVAGFDGIHLGSIFNQAHLALTDFLTDGAAFAXYGFVAVDGEAAQVAVALFLG
         ||||||:||||||||||||||||||||||||||||::||  || |||| |||||:|:|||
g501     IGHVGNQYVAGFDGIHLGSIFNQAHLALTDFLTDGTTFAQDGFFAVDGVAAQVAAAFFLG
                370       380       390       400       410       420

430       440       450       460       470       480
m501.pep FYGFGTGLQDVEFAVQAVASPFDIHRAAVVFFDGQCVMRQLSNFFVGNGEAVAVFLGDID
         | |||:||||||||||||||||||||||||||||| |: ||::||||||||||||:||:|
g501     FDGFGAGLQDVEFAVQAVASPFDIHRAAVVFFDGQRVVCQLGDFFVGNGEAVAVFFGDFD
                430       440       450       460       470       480

490       500       510       520       530       540
m501.pep VGYGFTGFCFVGKNHFDVFXTHGFTQDGGLARFERGREHXKFVRVDRTLYDVFAQTRVGG
         |||||:|| |||:|||||| |||::||||:| ||||||| |||||||:||||||||||||
g501     VGYGFAGFGFVGENHFDVFRTHGLAQDGGFACFERGREHIKFVRVDRALYDVFAQTRVGG
                490       500       510       520       530       540

550
m501.pep NKDDLIVXGFGVEGEHHT
         |||||:| ||||||||||
g501     NKDDLVVAGFGVEGEHHT
                550
```

The following partial DNA sequence was identified in *N. meningitidis* <SEQ ID 1335>:

```
a501.seq (partial)
   1 ATGGTCGGAC GGGCCTTGAC CGCAGATGCC GACATATTTG TTCTGCTTGC

51 GGCAGGCGGA GATGGCAAGG TGCAGCATCA CTTTGACGGC AGGGTTGCGT

101 TCGTCAAACG ATTCGGATAC CAAGCCGCTG TCGCGGTCGA GACCGAGGGT

151 CAGTTGGGTC ATGTCGTTCG AGCCGATGGA GAAGCCGTCG AAGTATTGCA

201 GGAATTGTTC CGCCAATACC GCGTTGCTCG GCAGCTCGCA CATCATAATC

251 AGGCGCAGGC CGTTTTTGCC GCGTTCCAAG CCGTTTTCTT TCAGGGCTTT

301 GACAACGGCT TCGGCTTCGC CCAAAGTGCG GACGAACGGA ATCATGATTT

351 CAACGTTGGT CAACCCCATT TCATCGCGGA CGCGTTTCAA GGCTTTGCAT

401 TCCAAGGCGA AACAGTCTTT GAAGTTGTCG GCGACATAAC GCGCCGCACC

451 ACGGAAGCCC AACATCGGGT TTTCTTCATG CGGTTCGTAT ACGTTGCCGC

501 CGACCAGGTT GGCGTATTCG TTGGATTTGA AGTCGGACAT ACGGACGATG

551 GTTTTACGCG GATAAACCGA TGCGGCCAAT GTCGCCACGC CTTCGGCGAT

601 TTTATCGACG TAGAAGTCGA CAGGGGACGC GTAACCGGCG ATACGGCGGG

651 TAATTTCCGC TTTTAATTCG TCGTCTTGTT TGTCAAATTC CAACAAGGCT

701 TTGGGGTGGA TACCGATTTG GCGGTTGATG ATAAATTCCA TACGCGCCAA

751 GCCGATGCCT TCGCTGGGCA GGTTGGCGAA GCTGAATGCG AGTTCGGGAT

801 TGCCGACGTT CATCATGACT TTTACAGGTG CTTTAGGCAT GTTGTCCAAA

851 GCAACATCGG TAATTTGTAC GTCCAGCAGG CCGGAGTAGA TGAAGCCGGT

901 ATCGCCTTCG GCACAGGATA CGGTAACTTC TTGACCGTTT TTCAGCAATT

951 CGGTTGCATT GCCGCAGCCG ACAACGGCAG GAATACCCAG TTCGCGCGCG

1001 ATGATGGCGG CGTGGCAGGT ACGTCCGCCC CTGTTGGTCA CGATGGCGGA

1051 AGCGCGTTTC ATCACCGGTT CCCAATCTGG GTCGGTCATG TCGGTAACCA

1101 GTACGTCGCC GGCTTCGACG GAATCCATCT CGGAAGCATC TTTAATCAGG

1151 CGTACCTTGC CCTGACCGAC TTTCTGACCG ATGGCGCGGC CTTCGCACAA
```

-continued

```
1201 GACGGTTTTT TCGCCGTTGA TAGAAAAGCG GCGCAGGTTG CGGCTGCCTT

1251 CTTCCTGGGA TTTGACGGTT TCGGGACGGG CTTGCAGGAT GTAGAGTTTG

1301 CCGTCCAAGC CGTCGCGTCC CCATTCGATG TCCATCGGGC GGCCGTAGTG

1351 TTTTTCGATG GTCAGTGCGT AATGCGCCAA CTCGGTGATT TCTTCGTCGG

1401 TAATGGAGAA GCGGTTGCGG TCTTCTTCGG GGACATCGAC GTTGGTTACC

1451 GATTTGCCGG CTTCTGCTTT GTCGGTAAAA ATCATTTTGA TGTGTTTTGA

1501 GCCCATGGTT TTGCGCAGGA TGGCAGGTTT GCCTGCTTTC AGCGTGGGTT

1551 TGAACACATA GAATTCGTCG GGATTGACTG CGCCTTGTAC GACGTTTTCG

1601 CCCAGACCGT AGGATGAAGT GACAAAGACG ACTTGGTCGT AACCGGATTC

1651 GGTATCGAGG GTGAACATCA C
```

This corresponds to the amino acid sequence <SEQ ID 1336; ORF 501.a>:

```
a501.pep
  1 MVGRALTADA DIFVLLAAGG DGKVQHHFDG RVAFVKRFGY QAAVAVETEG

51 QLGHVVRADG EAVEVLQELF RQYRVARQLA HHNQAQAVFA AFQAVFFQGF

101 DNGFGFAQSA DERNHDFNVG QPHFIADAFQ GFAFQGETVF EVVGDITRRT

151 TEAQHRVFFM RFVYVAADQV GVFVGFEVGH TDDGFTRINR CGQCRHAFGD

201 FIDVEVDRGR VTGDTAGNFR F*FVVLFVKF QQGFGVDTDL AVDDKFHTRQ

251 ADAFAGQVGE AECEFGIADV HHDFYRCFRH VVQSNIGNLY VQQAGVDEAG

301 IAFGTGYGNF LTVFQQFGCI AAADNGRNTQ FARDDGGVAG TSAPVGHDGG

351 SAFHHRFPIW VGHVGNQYVA GFDGIHLGSI FNQAYLALTD FLTDGAAFAQ

401 DGFFAVDRKA AQVAAAFFLG FDGFGTGLQD VEFAVQAVAS PFDVHRAAVV

451 FFDGQCVMRQ LGDFFVGNGE AVAVFFGDID VGYRFAGFCF VGKNHFDVF*

501 AHGFAQDGRF ACFQRGFEHI EFVGIDCALY DVFAQTVG*S DKDDLVVTGF

551 GIEGEHH
``` m501/a501 90.3% identity in 557 aa overlap

```
                       10         20         30         40         50         60
      m501.pep  MVGXALTADADIFVLLAAGGDGKVQHHFDGRVAFVKRFGYQAAVAVETEGQLGHVVRADG
                ||| ||||||||||||||||||||||||||||||||||||||||||||||||||||||||
      a501      MVGRALTADADIFVLLAAGGDGKVQHHFDGRVAFVKRFGYQAAVAVETEGQLGHVVRADG
                       10         20         30         40         50         60

70         80         90        100        110        120
      m501.pep  EAVEVLQELFRQYRVARQLAHHNQAQAVFAAFQAVFFQGFDNGFGFAQSADERNHDFNVG
                ||||||||||||||||||||||||||||||||||||||||||||||||||||||||||||
      a501      EAVEVLQELFRQYRVARQLAHHNQAQAVFAAFQAVFFQGFDNGFGFAQSADERNHDFNVG
                       70         80         90        100        110        120

130        140        150        160        170        180
      m501.pep  QPHFIADAFQGFAFQGETVFEVVGDITRRTTEAQHRVFFMRFVYVAADQVGVFVGFEVGH
                ||||||||||||||||||||||||||||||||||||||||||||||||||||||||||||
      a501      QPHFIADAFQGFAFQGETVFEVVGDITRRTTEAQHRVFFMRFVYVAADQVGVFVGFEVGH
                      130        140        150        160        170        180

190        200        210        220        230        240
      m501.pep  TDDGFTRINRCGQCRHAFGDFIDVEVDRGRVTGDTAGNFREXFVVLFVKFQQXFGVDTDL
                ||||||||||||||||||||||||||||||||||||||||||||||||||||| ||||||
      a501      TDDGFTRINRCGQCRHAFGDFIDVEVDRGRVTGDTAGNFREXFVVLFVKFQQGFGVDTDL
                      190        200        210        220        230        240
```

```
                   250        260        270        280        290        300
m501.pep  AVDDKFHTRQADAFAGQVGEAECEFGIADVHHDFYRCFRHIVXGDIGNLYVQQTGIDKAG
          ||||||||||||||||||||||||||||||||||||||:| ::||||||||:|:|:||
a501      AVDDKFHTRQADAFAGQVGEAECEFGIADVHHDFYRCFRHVVQSNIGNLYVQQAGVDEAG
                   250        260        270        280        290        300

310        320        330        340        350        360
m501.pep  IAFGTGYGNFLTVFQQFGCIAAADNGRNAQFTRDDGGVAGTAAAVGNDGRSTFHHGFPIR
          ||||||||||||||||||||||||||||||:||:||||||||:||||:|| |:||| |||
a501      IAFGTGYGNFLTVFQQFGCIAAADNGRNTQFARDDGGVAGTSAPVGHDGGSAFHHRFPIW
                   310        320        330        340        350        360

370        380        390        400        410        420
m501.pep  IGHVGNEYVAGFDGIHLGSIFNQAHLALTDFLTDGAAFAXYGFVAVDGEAAQVAVALFLG
          :|||||:|||||||||||||||||:|||||||||||||||   || ||| :|||||:|||
a501      VGHVGNQYVAGFDGIHLGSIFNQAYLALTDFLTDGAAFAQDGFFAVDRKAAQVAAAFFLG
                   370        380        390        400        410        420

430        440        450        460        470        480
m501.pep  FYGFGTGLQDVEFAVQAVASPFDIHRAAVVFFDGQCVMRQLSNFFVGNGEAVAVFLGDID
          |  |||||||||||||||||||:|||||||||||||||||:::||||||||||||:||||
a501      FDGFGTGLQDVEFAVQAVASPFDVHRAAVVFFDGQCVMRQLGDFFVGNGEAVAVFFGDID
                   430        440        450        460        470        480

490        500        510        520        530        540
m501.pep  VGYGFTGFCFVGKNHFDVFXTHGFTQDGGLARFERGFEHXKFVRVDRTLYDVFAQTVRGG
          |||  |:|||||||||||||:|||:||| :|  |:||||| :||  :|  :|||||||| :
a501      VGYRFAGFCFVGKNHFDVFXAHGFAQDGRFACFQRGFEHIEFVGIDCALYDVFAQTVGXS
                   490        500        510        520        530        540

550        559
m501.pep  NKDDLIVXGFGVEGEHHTX
          :||||:|:|||:|||||
a501      DKDDLVVTGFGIEGEHH
                   550
```

The following partial DNA sequence was identified in *N. gonorrhoeae* <SEQ ID 1337>:

```
g502.seq
   1 atgatgaaac cgcacaacct gttccaattc ctcgccgttt gctccctgac 51 cgtcgccgtc gcttccgcac aggcgggcgc ggtggacgcg ctcaagcaat 101 tcaacaacga tgccgacggt atcagcggca gcttcaccca aaccgtccaa 151 agcaaaaaga aacccaaac cgcgcacggc acgttcaaaa tcctgcgccc 201 gggcctcttc aaatgggaat acactttgcc ctacagacag actattgtcg 251 gcgacggtca aaccgttggg ctctacgatg ttgatttggc acaagtgacc 301 aagtcgtccc aagaccaggc catcggcggc agcccgccg ccatcctgtc 351 gaacaaaacc gccctcgaaa gcagttacac gctgaaagag gacggttcgt 401 ccaacggcat cgattatgtg cggggcaacg cccaaacgca acaacgccgg 451 ctaccaatac atccgcatcg gcttcaaagg cggcaacctc gccgccatgc 501 agcttaa
```

This corresponds to the amino acid sequence <SEQ ID 1338; ORF 502.ng>:

```
g502.pep
   1 MMKPHNLFQF LAVCSLTVAV ASAQAGAVDA LKQFNNDADG ISGSFTQTVQ

51 SKKKTQTAHG TFKILRPGLF KWEYTLPYRQ TIVGDGQTVW LYDVDLAQVT

101 KSSQDQAIGG SPAAILSNKT ALESSYTLKE DGSSNGIDYV RGNAQTQQRR

151 LPIHPHRLQR RQPRRHAA*
```

The following partial DNA sequence was identified in *N. meningitidis* <SEQ ID 1339>:

```
m502.seq
   1 atgatgaaac cgcacaacct gttccaattc ctcgccgttt gctccctgac 51 cgtcgccgtc gcttccgcac aggcgggcgc ggtagacgcg cttaagcaat 101 tcaacaacga tgccgacggt atcagcggca gcttcaccca amccgtccaa 151 wgcaaaaaga aaacccaaac cgcgcacggc acgttcaaaa tcctgcgacc 201 gggccttttc aaatgggaat acaccaaact t.acaggcaa accatcgtcg 251 gcgacggtca aacygtttgg ctmtacgatg tygatctggc acaagtgacc 301 aagtcgtccc aagaccaggc cataggcgsc agccccgccg ccatcctgtc 351 gaacaaarcc gccctcgaaa gcagctacac gctgaaagag gacggttcgt 401 ccaacggcat cgattatgtg ggcaacgccc aaacgcaaca acgccggcta 451 ccaatacatc cgcatcggct tcaaaggcgg caacctcgcc gccatgcagc 501 tyaa
```

This corresponds to the amino acid sequence <SEQ ID 1340; ORF 502.ng>:

```
m502.pep
   1 MMKPHNLFQF LAVCSLTVAV ASAQAGAVDA LKQFNNDADG ISGSFTQXVQ

51 XKKKTQTAHG TFKILRPGLF KWEYTKLYRQ TIVGDGQTVW LYDVDLAQVT

101 KSSQDQAIGX SPAAILSNKX ALESSYTLKE DGSSNGIDYV GNAQTQQRRL

151 PIHPHRLQRR QPRRHAAX
```

Computer analysis of this amino acid sequence gave the following results:

Homology with a Predicted ORF from *N. gonorrhoeae*

ORF 502 shows 95.8% identity over a 168 aa overlap with a predicted ORF (ORF 502.ng) from *N. gonorrhoeae*:

```
m502/g502

10        20        30        40        50        60
m502.pep  MMKPHNLFQFLAVCSLTVAVASAQAGAVDALKQFNNDADGISGSFTQXVQXKKKTQTAHG
          |||||||||||||| ||||||||||||||||||||||||||||||||:|| |||||||||
g502      MMKPHNLFQFLAVCSLTVAVASAQAGAVDALKQFNNDADGISGSFTQTVQSKKKTQTAHG
                  10        20        30        40        50        60

70        80        90       100       110       120
m502.pep  TFKILRPGLFKWEYTKLYRQTIVGDGQTVWLYDVDLAQVTKSSQDQAIGXSPAAILSNKX
          |||||||||||||| |||||||||||||||||||||||||||||||||| |||||||||:
g502      TFKILRPGLFKWEYTLPYRQTIVGDGQTVWLYDVDLAQVTKSSQDQAIGGSPAAILSNKT
                  70        80        90       100       110       120

130       140       150       160
m502.pep  ALESSYTLKEDGSSNGIDYV-GNAQTQQRRLPIHPHRLQRRQPRRHAA
          |||||||||||||||||||| ||||||||||||||||||||||||||
g502      ALESSYTLKEDGSSNGIDYVRGNAQTQQRRLPIHPHRLQRRQPRRHAA
                 130       140       150       160
```

The following partial DNA sequence was identified in *N. meningitidis* <SEQ ID 1341>:

```
a502.seq
   1 ATGATGAAAC CGCACAACCT GTTCCAATTC CTCGCCGTTT GCTCCCTGAC

51 CGTCTCCGTC GCTTCCGCAC AGGCGGGCGC GGTGGACGCG CTCAAGCAAT

101 TCAACAACGA TGCCGACGGT ATCAGCGGCA GCTTCACCCA AACCGTCCAA
```

```
-continued
151 AGCAAAAAGA AAACCCAAAC CGCGCACGGC ACGTTCAAAA TCCTGCGCCC

201 GGGCCTCTTT AAATGGGAAT ACACTTCGCC TTACAAACAG ACTATTGTCG

251 GCGACGGTCA AACCGTTTGG CTCTACGATG TCGATTTGGC ACAAGTGACC

301 AAGTCGTCCC AAGACCAGGC CATAGGCGGC AGCCCCGCCG CCATCCTGTC

351 GAACAAAACC GCCCTCGAAA GCAGCTACAC GCTGAAAGAG GACGGTTCGT

401 CCAACGGCAT CGATTATGTG GGCAACGCCC AAACGCAACA ACGCCGGCTA

451 CCAATACATC CGCATCGGCT TCAAAGGCGG CAACCTCGCC GCCATGCAGC

501 TTAA
```

This corresponds to the amino acid sequence <SEQ ID 1342; 502 217.a>:

```
a502.pep
  1 MMKPHNLFQF LAVCSLTVSV ASAQAGAVDA LKQFNNDADG ISGSFTQTVQ

51 SKKKTQTAHG TFKILRPGLF KWEYTSPYKQ TIVGDGQTVW LYDVDLAQVT

101 KSSQDQAIGG SPAAILSNKT ALESSYTLKE DGSSNGIDYV GNAQTQQRRL

151 PIHPHRLQRR QPRRHAA*
``` m502/a502 95.2% identity in 167 aa overlap

```
                  10         20         30         40         50         60
    m502.pep  MMKPHNLFQFLAVCSLTVAVASAQAGAVDALKQFNNDADGISGSFTQXVQXKKKTQTAHG
              |||||||||||||||||:||||||||||||||||||||||||||||:||  ||||||||
    a502      MMKPHNLFQFLAVCSLTVSVASAQAGAVDALKQFNNDADGISGSFTQTVQSKKKTQTAHG
                  10         20         30         40         50         60

70         80         90        100        110        120
    m502.pep  TFKILRPGLFKWEYTKLYRQTIVGDGQTVWLYDVDLAQVTKSSQDQAIGXSPAAILSNKX
              ||||||||||||||||:  |:|||||||||||||||||||||||||||  ||||||||:
    a502      TFKILRPGLFKWEYTSPYKQTIVGDGQTVWLYDVDLAQVTKSSQDQAIGGSPAAILSNKT
                  70         80         90        100        110        120

130        140        150        160
    m502.pep  ALESSYTLKEDGSSNGIDYVGNAQTQQRRLPIHPHRLQRRQPRRHAAX
              ||||||||||||||||||||||||||||||||||||||||||||||||
    a502      ALESSYTLKEDGSSNGIDYVGNAQTQQRRLPIHPHRLQRRQPRRHAAX
                 130        140        150        160
```

The following partial DNA sequence was identified in *N. gonorrhoeae* <SEQ ID 1343>:

```
g502-1.seq
  1 ATGatGAAAc cgcaCaacct gttccaaTTc CTCGCCGTTT GCTCCCTGAC

51 CGTCGCCGTC GCTTCCGCAC AGGCGGGCGC GGTGGACGCG CTCAAGCAAT

101 TCAACAACGA TGCCGACGGT ATCAGCGGCA GCTTCACCCA AACCGTCCAA

151 AGCAAAAAGA AAACCCAAAC CGCGCACGGC ACGTTCAAAA TCCTGCGCCC

201 GGGCCTCTTC AAATGGGAAT ACACTTTGCC CTACAGACAG ACTATTGTCG

251 GCGACGGTCA AACCGTTTGG CTCTACGATG TTGATTTGGC ACAAGTGACC

301 AAGTCGTCCC AAGACCAGGC CATCGGCGGC AGCCCCGCCG CCATCCTGTC

351 GAACAAAACC GCCCTCGAAA GCAGTTACAC GCTGAAAGAG GACGGTTCGT

401 CCAACGGCAT CGATTATGTG CGGGCAACGC CCAAACGCAA CAACGCCGGC

451 TACCAATACA TCCGCATCGG CTTCAAAGGC GGCAACCTCG CCGCCATGCA

501 GCTTAAAGAC AGCTTCGGCA ACCAAACCTC CATCAGTTTC GGCGGTTTGA
```

```
551 ATACCAATCC CCAACTCTCG CGCGGCGCGT TCAAGTTTAC CCCGCCCAAA

601 GGCGTGGACG TGTTGAGCAA CTGA
```

This corresponds to the amino acid sequence <SEQ ID 1344; ORF 502-1.ng>:

```
g502-1.pep
   1 MMKPHNLFQF LAVCSLTVAV ASAQAGAVDA LKQFNNDADG ISGSFTQTVQ

51 SKKKTQTAHG TFKILRPGLF KWEYTLPYRQ TIVGDGQTVW LYDVDLAQVT

101 KSSQDQAIGG SPAAILSNKT ALESSYTLKE DGSSNGIDYV RATPKRNNAG

151 YQYIRIGFKG GNLAAMQLKD SFGNQTSISF GGLNTNPQLS RGAFKFTPPK

201 GVDVLSN*
```

The following partial DNA sequence was identified in *N. meningitidis* <SEQ ID 1345>:

```
m502-1.seq
   1 ATGATGAAAC CGCACAACCT GTTCCAATTC CTCGCCGTTT GCTCCCTGAC

51 CGTCGCCGTC GCTTCCGCAC AGGCGGGCGC GGTAGACGCG CTTAAGCAAT

101 TCAACAACGA TGCCGACGGT ATCAGCGGCA GCTTCACCCA AACCGTCCAA

151 AGCAAAAAGA AACCCAAAC CGCGCACGGC ACGTTCAAAA TCCTGCGACC

201 GGGCCTTTTC AAATGGGAAT ACACCAAACC TTACAGGCAA ACCATCGTCG

251 GCGACGGTCA AACCGTTTGG CTCTACGATG TTGATCTGGC ACAAGTGACC

301 AAGTCGTCCC AAGACCAGGC CATAGGCGGC AGCCCCGCCG CCATCCTGTC

351 GAACAAAACC GCCCTCGAAA GCAGCTACAC GCTGAAAGAG GACGGTTCGT

401 CCAACGGCAT CGATTATGTG CTGGCAACGC CCAAACGCAA CAACGCCGGC

451 TACCAATACA TCCGCATCGG CTTCAAAGGC GGCAACCTCG CCGCCATGCA

501 GCTTAAAGAC AGCTTCGGCA ACCAAACCTC CATCAGTTTC GGCGGTTTGA

551 ATACCAATCC CCAACTCTCG CGCGGCGCGT TCAAGTTTAC CCCGCCCAAA

601 GGCGTGGACG TGTTGAGCAA CTGA
```

This corresponds to the amino acid sequence <SEQ ID 1346; ORF 502-1>:

```
    m502-1.pep
       1 MMKPHNLFQF LAVCSLTVAV ASAQAGAVDA LKQFNNDADG ISGSFTQTVQ

51 SKKKTQTAHG TFKILRPGLF KWEYTKPYRQ TIVGDGQTVW LYDVDLAQVT

101 KSSQDQAIGG SPAAILSNKT ALESSYTLKE DGSSNGIDYV LATPKRNNAG

151 YQYIRIGFKG GNLAAMQLKD SFGNQTSISF GGLNTNPQLS RGAFKFTPPK

201 GVDVLSN* m502-1/g502-1 99.0% identity in 207 aa overlap 10        20        30        40        50        60
    m502-1.pep MMKPHNLFQFLAVCSLTVAVASAQAGAVDALKQFNNDADGISGSFTQTVQSKKKTQTAHG
               ||||||||||||||||||||||||||||||||||||||||||||||||||||||||||||
    g502-1     MMKPHNLFQFLAVCSLTVAVASAQAGAVDALKQFNNDADGISGSFTQTVQSKKKTQTAHG
                     10        20        30        40        50        60

70        80        90       100       110       120
    m502-1.pep TFKILRPGLFKWEYTKPYRQTIVGDGQTVWLYDVDLAQVTKSSQDQAIGGSPAAILSNKT
               |||||||||||||||| |||||||||||||||||||||||||||||||||||||||||||
    g502-1     TFKILRPGLFKWEYTLPYRQTIVGDGQTVWLYDVDLAQVTKSSQDQAIGGSPAAILSNKT
                     70        80        90       100       110       120
```

-continued

```
                    130       140       150       160       170       180
m502-1.pep ALESSYTLKEDGSSNGIDYVLATPKRNNAGYQYIRIGFKGGNLAAMQLKDSFGNQTSISF
           |||||||||||||| |||||||||||||||||||||||||||||||||||||||||||||
g502-1     ALESSYTLKEDGSSNGIDYVLATPKRNNAGYQYIRIGFKGGNLAAMQLKDSFGNQTSISF
                    130       140       150       160       170       180

190       200
m502-1.pep GGLNTNPQLSRGAFKFTPPKGVDVLSNX
           ||||||||||||||||||||||||||||
g502-1     GGLNTNPQLSRGAFKFTPPKGVDVLSNX
                    190       200
```

The following partial DNA sequence was identified in *N. meningitidis* <SEQ ID 1347>:

```
a502-1.seq
  1 ATGATGAAAC CGCACAACCT GTTCCAATTC CTCGCCGTTT GCTCCCTGAC

51 CGTCTCCGTC GCTTCCGCAC AGGCGGGCGC GGTGGACGCG CTCAAGCAAT

101 TCAACAACGA TGCCGACGGT ATCAGCGGCA GCTTCACCCA AACCGTCCAA

151 AGCAAAAAGA AAACCCAAAC CGCGCACGGC ACGTTCAAAA TCCTGCGCCC

201 GGGCCTCTTT AAATGGGAAT ACACTTCGCC TTACAAACAG ACTATTGTCG

251 GCGACGGTCA AACCGTTTGG CTCTACGATG TCGATTTGGC ACAAGTGACC

301 AAGTCGTCCC AAGACCAGGC CATAGGCGGC AGCCCCGCCG CCATCCTGTC

351 GAACAAAACC GCCCTCGAAA GCAGCTACAC GCTGAAAGAG GACGGTTCGT

401 CCAACGGCAT CGATTATGTG CTGGCAACGC CCAAACGCAA CAACGCCGGC

451 TACCAATACA TCCGCATCGG CTTCAAAGGC GGCAACCTCG CCGCCATGCA

501 GCTTAAAGAC AGCTTCGGCA ATCAAACCTC CATCAGTTTC GGCGGTTTGA

551 ATACCAATCC CCAACTCTCG CGCGGCGCGT TCAAGTTTAC CCCGCCCAAA

601 GGCGTGGACG TGTTGAGCAA CTGA
```

This corresponds to the amino acid sequence <SEQ ID 1348; ORF 502-1.a>:

```
a502-1.pep

1  MMKPHNLFQF  LAVCSLTVSV  ASAQAGAVDA  LKQFNNDADG  ISGSFTQTVQ

51  SKKKTQTAHG  TFKILRPGLF  KWEYTSPYKQ  TIVGDGQTVW  LYDVDLAQVT

101  KSSQDQAIGG  SPAAILSNKT  ALESSYTLKE  DGSSNGIDYV  LATPKRNNAG

151  YQYIRIGFKG  GNLAAMQLKD  SFGNQTSISF  GGLNTNPQLS  RGAFKFTPPK

201  GVDVLSN*
```

(In the printed sequence, the stretch "MMKPHNLFQF LAVCSLTVSV ASAQAG" is underlined.)

```
a502-1/m502-1  98.6% identity in 207 aa overlap 10        20        30        40        50        60
a502-1.pep      MMKPHNLFQFLAVCSLTVSVASAQAGAVDALKQFNNDADGISGSFTQTVQSKKKTQTAHG
                ||||||||||||||||||:|||||||||||||||||||||||||||||||||||||||||
m502-1          MMKPHNLFQFLAVCSLTVAVASAQAGAVDALKQFNNDADGISGSFTQTVQSKKKTQTAHG
                        10        20        30        40        50        60

70        80        90       100       110       120
a502-1.pep      TFKILRPGLFKWEYTSPYKQTIVGDGQTVWLYDVDLAQVTKSSQDQAIGGSPAAILSNKT
                |||||||||||||||:||:|||||||||||||||||||||||||||||||||||||||||
m502-1          TFKILRPGLFKWEYTKPYRQTIVGDGQTVWLYDVDLAQVTKSSQDQAIGGSPAAILSNKT
                        70        80        90       100       110       120

130       140       150       160       170       180
a502-1.pep      ALESSYTLKEDGSSNGIDYVLATPKRNNAGYQYIRIGFKGGNLAAMQLKDSFGNQTSISF
                ||||||||||||||||||||||||||||||||||||||||||||||||||||||||||||
m502-1          ALESSYTLKEDGSSNGIDYVLATPKRNNAGYQYIRIGFKGGNLAAMQLKDSFGNQTSISF
                       130       140       150       160       170       180
```

```
                         -continued
                190          200
a502-1.pep   GGLNTNPQLSRGAFKFTPPKGVDVLSNX
             ||||||||||||||||||||||||||||
m502-1       GGLNTNPQLSRGAFKFTPPKGVDVLSNX
                190          200
```

The following partial DNA sequence was identified in *N. gonorrhoeae* <SEQ ID 1349>:

```
g503.seq
   1 atgtccgcgc cgtcggcatc ggtaatcatt ttgttccatg ccgcttcgat 51 ttcggcatcg agctgttcgg ggaagggcgt gtccaaaatc cattggcgga 101 tttctttgcc gacgcgtgcc agttcggaaa cgtcttcgac atccaatttt 151 gccagagcgg cggaaatgcg ttcgttcaga ccgttgtgtg cgagaaatgc 201 gcggtag
                                                           20
```

This corresponds to the amino acid sequence <SEQ ID 1350; ORF 503.ng>:

```
g503.pep
  1 MSAPSASVII LFHAASISAS SCSGKGVSKI HWRISLPTRA SSETSSTSNF

51 ARAAEMRSFR PLCARNAR*
```

The following partial DNA sequence was identified in *N. meningitidis* <SEQ ID 1351>:

```
m503.seq
   1 atgtccgcac cgccggcatc ggcaaccatt ttgttccatg ccgcttcgat 51 ttcggcatcg agctgttcgg ggaaaggcgt atccaaaatc cattggcgga 101 tttctttgcc gacgcgtgcc agttcggcaa cgtcttcgac atccaatttt 151 gccagtgcgg cggaaatgcg ttcgctcaga ccgttgtgtg cgaggaatgc 201 gcggtag
```

This corresponds to the amino acid sequence <SEQ ID 1352; ORF 503>:

```
m503.pep
  1 MSAPPASATI LFHAASISAS SCSGKGVSKI HWRISLPTRA SSATSSTSNF

51 ASAAEMRSLR PLCARNAR*
                                                           50
```

Computer analysis of this amino acid sequence gave the following results:

Homology with a Predicted ORF from *N. gonorrhoeae*

ORF 503 shows 91.2% identity over a 68 aa overlap with a predicted ORF (ORF 503.ng) from *N. gonorrhoeae*:

```
m503/g503
                    10        20        30        40        50        60
    m503.pep MSAPPASATILFHAASISASSCSGKGVSKIHWRISLPTRASSATSSTSNFASAAEMRSLR
             ||||  ||: ||||||||||||||||||||||||||||| |||||||| ||||||:|
    g503     MSAPSASVIILFHAASISASSCSGKGVSKIHWRISLPTRASSETSSTSNFARAAEMRSFR
                    10        20        30        40        50        60
                    69
    m503.pep PLCARNAR
             ||||||||
    g503     PLCARNAR
```

The following partial DNA sequence was identified in N. meningitidis <SEQ ID 1353>:

```
a503.seq
   1 ATGTCCGCGC CGCCGGCATC GGCAACCATT TGTTCCATG CCGCTTCGAT

51 TTCGGCATCG AGCTGTTCGG GGAAGGGCGT GTCCAAAATC CATTGGCGGA

101 TTTCTTTGCC GACGCGTGCC AGTTCGGCAA CGTCTTCGAC ATCTAATTTT

151 GCCAGTGCGG CGGAAATGCG TTCGCTCAGA CCGTTGTGTG CGAGGAATGC

201 GCGGTAG
```

This corresponds to the amino acid sequence <SEQ ID 1354; ORF 503.a>:

```
a503.pep
   1 MSAPPASATI LFHAASISAS SCSGKGVSKI HWRISLPTRA SSATSSTSNF

51 ASAAEMRSLR PLCARNAR*
``` m503/a503 100.0% identity in 68 aa overlap

```
                    10        20        30        40        50        60
    m503.pep  MSAPPASATILFHAASISASSCSGKGVSKIHWRISLPTRASSATSSTSNFASAAEMRSLR
              ||||||||||||||||||||||||||||||||||||||||||||||||||||||||||||
    a503      MSAPPASATILFHAASISASSCSGKGVSKIHWRISLPTRASSATSSTSNFASAAEMRSLR
                    10        20        30        40        50        60
                    69
    m503.pep  PLCARNARX
              |||||||||
    a503      PLCARNARX
```

The following partial DNA sequence was identified in N. gonorrhoeae <SEQ ID 1355>:

```
g503-1.seq
   1 ATGGCGCGGT CGTTGTACAG GGAGGCGAAA ACGTGGCGCA TCGCTTTTTT

51 AACGTTATCC AAGCCATTGA TATTCAGGAA GGTTTCCTGT TGGCCGGCAA

101 ATGATGCGTC GGGCAGGTCT TCGGCGGTTG CGGAAGAGCG TACGGCAACG

151 GAAATGTCCG CGCCGTCGGC ATCGGTAATC ATTTTGTTCC ATGCCGCTTC

201 GATTTCGGCA TCGAGCTGTT CGGGGAAGGG CGTGTCCAAA ATCCATTGGC

251 GGATTTCTTT GCCGACGCGT GCCAGTTCGG AAACGTCTTC GACATCCAAT

301 TTTGCCAGAG CGGCGGAAAT GCGTTCGTTC AGACCGTTGT GTGCGAGAAA

351 TGCGCGGTAG
```

This corresponds to the amino acid sequence <SEQ ID 1356; ORF 214.ng>:

```
g503-1.pep
   1 MARSLYREAK TWRIAFLTLS KPLIFRKVSC WPANDASGRS SAVAEERTAT

51 EMSAPSASVI ILFHAASISA SSCSGKGVSK IHWRISLPTR ASSETSSTSN

101 FARAAEMRSF RPLCARNAR*
```

The following partial DNA sequence was identified in *N. meningitidis* <SEQ ID 1357>:

```
m503-1.seq
   1 ATGGCACGGT CGTTATACAG GGAAGCGAAT ACATGGTGCA TCGCTTCTTT

51 AACGTTATCC AAGCCGTTGA TGTTCAAGAA GGTTTCCTGT TGTCCAGCGA

101 ATGATGCGTC CGGCAGGTCT TCGGCAGTTG CGGAAGAACG TACGGCAACG

151 GAAATGTCCG CACCGCCGGC ATCGGCAACC ATTTTGTTCC ATGCCGCTTC

201 GATTTCGGCA TCGAGCTGTT CGGGGAAAGG CGTATCCAAA ATCCATTGGC

251 GGATTTCTTT GCCGACGCGT GCCAGTTCGG CAACGTCTTC GACATCCAAT

301 TTTGCCAGTG CGGCGGAAAT GCGTTCGCTC AGACCGTTGT GTGCGAGGAA

351 TGCGCGGTAG
```

This corresponds to the amino acid sequence <SEQ ID 1358; ORF 503-1>:

```
m503-1.pep

1  MARSLYREAN TWCIASLTLS KPLMFKKVSC CPANDASGRS SAVAEERTAT

51  EMSAPPASAT ILFHAASISA SSCSGKGVSK IHWRISLPTR ASSATSSTSN

101  FASAAEMRSL RPLCARNAR* g503-1 / m503-1 89.9% identity in 119 aa overlap 10        20        30        40        50        60
g503-1.pep     MARSLYREAKTWRIAFLTLSKPLIFRKVSCWPANDASGRSSAVAEERTATEMSAPSASVI
               |||||||||:|| || |||||||:|:|||| |||||||||||||||||||||||| ||: 
m503-1         MARSLYREANTWCIASLTLSKPLMFKKVSCCPANDASGRSSAVAEERTATEMSAPPASAT
                         10        20        30        40        50        60

70        80        90       100       110       120
g503-1.pep     ILFHAASISASSCSGKGVSKIHWRISLPTRASSETSSTSNFARAAEMRSFRPLCARNARX
               ||||||||||||||||||||||||||||||||| |||||||| ||||||:||||||||||
m503-1         ILFHAASISASSCSGKGVSKIHWRISLPTRASSATSSTSNFASAAEMRSFRPLCARNARX
                         70        80        90       100       110       120
```

The following partial DNA sequence was identified in *N. meningitidis* <SEQ ID 1359>:

```
a503-1.seq
   1 ATGGCGCGGT CGTTGTACAG GGAGGCGAAT ACATGGCGCA TCGCTTCTTT

51 AACGTTTTCC AAGCCGTTGA TATTCAGGAA GGTTTCCTGT TGGCCGGCAA

101 ATGATGCGTC GGGCAGGTCT TCGGCGGTTG CGGAAGAGCG TACGGCAACG

151 GAAATGTCCG CGCCGCCGGC ATCGGCAACC ATTTTGTTCC ATGCCGCTTC

201 GATTTCGGCA TCGAGCTGTT CGGGGAAGGG CGTGTCCAAA ATCCATTGGC

251 GGATTTCTTT GCCGACGCGT GCCAGTTCGG CAACGTCTTC GACATCTAAT

301 TTTGCCAGTG CGGCGGAAAT GCGTTCGCTC AGACCGTTGT GTGCGAGGAA

351 TGCGCGGTAG
```

This corresponds to the amino acid sequence <SEQ ID 1360; ORF 503-1.a>:

```
a503-1.pep

1  MARSLYREAN TWRIASLTFS KPLIFRKVSC WPANDASGRS SAVAEERTAT
```

-continued
```
     51  EMSAPPASAT ILFHAASISA SSCSGKGVSK IHWRISLPTR ASSATSSTSN

101  FASAAEMRSL RPLCARNAR* a501-1/m503-1 95.8% identity in 119 aa overlap
                       10         20         30         40         50         60
a503-1.pep  MARSLYREANTWRIASLTFSKPLIFRKVSCWPANDASGRSSAVAEERTATEMSAPPASAT
            ||||||||||||| |||||:||||:|:||||  ||||||||||||||||||||||||||||
m503-1      MARSLYREANTWCIASLTLSKPLMFKKVSCCPANDASGRSSAVAEERTATEMSAPPASAT
                       10         20         30         40         50         60

70         80         90        100        110        120
a503-1.pep  ILFHAASISASSCSGKGVSKIHWRISLPTRASSATSSTSNFASAAEMRSLRPLCARNARX
            ||||||||||||||||||||||||||||||||||||||||||||||||||||||||||||
m503-1      ILFHAASISASSCSGKGVSKIHWRISLPTRASSATSSTSNFASAAEMRSLRPLCARNARX
                       70         80         90        100        110        120
```

The following partial DNA sequence was identified in *N. gonorrhoeae* <SEQ ID 1361>:

```
g504.seq
    1  atgttggttc aggacttgcc ttttgaagtc aaactgaaaa aattccatat 51  cgatttttac aatacgggta tgccgcgcga ttttgccagc gatattgaag 101  taacggacaa ggcaaccggt gagaaactcg agcgcaccat ccgcgtgaac 151  catcctttga ccttgcacgg catcacgatt tatcaggcga gttttgccga 201  cggcggttcg gatttgacat tcaaggcgtg gaatttgagg gatgcttcgc 251  gcgaacctgt cgtgttgaag gcaacctcca tacaccagtt tccgttggaa 301  atcggcaaac acaaatatcg tcttgagttc gatcagttca cttctatgaa 351  tgtggaggac atgagcgagg gtgcggaacg ggaaaaaagc ctgaaatcca 401  ctctgaacga tgtccgcgcc gttactcagg aaggtaaaaa atacaccaat 451  atcggcccct ccatcgtgta ccgcatccgt gatgcggcag ggcaggcggt 501  cgaatataaa aactatatgc tgccgatttt gcaggacaaa gattattttt 551  ggctgaccgg cacgcgcagc ggcttgcagc agcaataccg ctggctgcgt 601  atccccttgg acaagcagtt gaaagcggac accttatgg cattgcgtga 651  gtttttgaaa gatggggaag ggcgcaaacg tctggttgcc gacgcaacca 701  aagacgcacc tgccgaaatc cgcgaacaat tcatgctggc tgcggaaaac 751  acgctgaata tctttgcgca aaaaggctat ttgggattgg acgaatttat 801  tacgtccaat atcccgaaag ggcagcagga taagatgcag ggctatttct 851  acgaaatgct ttacggcgtg atgaacgctg ctttggatga accatacgc 901  cggtacggct tgcccgaatg gcagcaggat gaagcgcgga accgtttcct 951  gctgcacagt atggatgcct atacggggct gacggaatat cccgcgccta 1001  tgctgctcca gcttgacggg ttttccgagg tgcgttcctc aggtttgcag 1051  atgacccgtt cgccgggtgc gcttttggtc tatctcggct cggtattgtt 1101  ggttttgggt acagtattta tgttttatgt gcccaaaaaa cgggcgtggg 1151  tattgttttc aaacdgcaaa atccgttttg ctatgtcttc ggcccgcagc 1201  gaacgggatt tgcagaagga atttccaaaa cacgtcgaga gcctgcaacg 1251  gctcggcaag gacttgaatc atgactga
```

This corresponds to the amino acid sequence <SEQ ID 1362; ORF 504.ng>:

```
g504.pep
   1 MLVQDLPFEV KLKKFHIDFY NTGMPRDFAS DIEVTDKATG EKLERTIRVN

51 HPLTLHGITI YQASFADGGS DLTFKAWNLR DASREPVVLK ATSIHQFPLE

101 IGKHKYRLEF DQFTSMNVED MSEGAEREKS LKSTLNDVRA VTQEGKKYTN

151 IGPSIVYRIR DAAGQAVEYK NYMLPILQDK DYFWLTGTRS GLQQQYRWLR

201 IPLDKQLKAD TFMALREFLK DGEGRKRLVA DATKDAPAEI REQFMLAAEN

251 TLNIFAQKGY LGLDEFITSN IPKGQQDKMQ GYFYEMLYGV MNAALDETIR

301 RYGLPEWQQD EARNRFLLHS MDAYTGLTEY PAPMLLQLDG FSEVRSSGLQ

351 MTRSPGALLV YLGSVLLVLG TVFMFYVPKK RAWVLFSNKI RFAMSSARSE

401 RDLQKEFPKH VESLQRLGKD LNHD*
```

The following partial DNA sequence was identified in N. meningitidis <SEQ ID 1363>:

```
m504.seq..
    1 atattggttc aggacttgcc ttttgaagtc aaactgaaaa aattccatat 51 cgatttttac aatacgggta tgccgcgtga tttcgccagc gatattgaag 101 tgacggacaa ggcaaccggt gagaaactcg agcgcaccat ccgcgtgaac 151 catcctttga ccttgcacgg catcacgatt tatcaggcga gttttgccga 201 cggcggttcg gatttgacat tcaaggcgtg gaatttgggt gatgcttcgc 251 gcgagcctgt cgtgttgaag gcaacatcca tacaccagtt tccgttggaa 301 attggcaaac acaaatatcg tcttgagttc gatcagttca cttctatgaa 351 tgtggaggac atgagcgagg gcgcggaacg ggaaaaaagc ctgaaatcca 401 cgctgmmcga tgtccgcgcc gttactcagg aaggtaaaaa atacaccaat 451 atcggcccct ccattgttta ccgtatccgt gatgcggcag ggcaggcggt 501 cgaatataaa aactatatgc tgccggtttt gcaggaacag gattattttt 551 ggattaccgg cacgcgcagc ggcttgcagc agcaataccg ctggctgcgt 601 atccccttgg acaagcagtt gaaagcggac acctttatgg cattgcgtga 651 gttttgaaaa gatggggaag ggcgcaaacg tctggttgcc gacgcaacca 701 aaggcgcacc tgccgaaatc cgcgaacaat tcatgctggc tgcggaaaac 751 acgctgaaca tctttgcaca aaaaggctat ttgggattgg acgaatttat 801 tacgtccaat atcccgaaag agcagcagga taagatgcag ggctatttct 851 acgaaatgct ttacggcgtg atgaacgctg ctttggatga accatacgc 901 cggtacggct tgcccgaatg gcagcaggat gaagcgcgga atcgtttcct 951 gctgcacagt atggatgcgt acacgggttt gaccgaatat cccgcgccta 1001 tgctgctgca acttgatggg ttttccgagg tgcgttcgtc gggtttgcag 1051 atgacccgtt ccccgggtgc gcttttggtc tatctcggct cggtgctgtt 1101 ggtattgggt acggtattga tgttttatgt gcgcgaaaaa cgggcgtggg 1151 tattgttttc agacggcaaa atccgttttg ccatgtcttc ggcccgcagc 1201 gaacgggatt tgcagaagga atttccaaaa cacgtcgaga gtctgcaacg 1251 gctcggcaag gacttgaatc atga
```

This corresponds to the amino acid sequence <SEQ ID 1364; ORF 504>:

```
m504.pep..
  1 ILVQDLPFEV KLKKFHIDFY NTGMPRDFAS DIEVTDKATG EKLERTIRVN

51 HPLTLHGITI YQASFADGGS DLTFKAWNLG DASREPVVLK ATSIHQFPLE

101 IGKHKYRLEF DQFTSMNVED MSEGAEREKS LKSTLXDVRA VTQEGKKYTN

151 IGPSIVYRIR DAAGQAVEYK NYMLPVLQEQ DYFWITGTRS GLQQQYRWLR

201 IPLDKQLKAD TFMALREFLK DGEGRKRLVA DATKGAPAEI REQFMLAAEN

251 TLNIFAQKGY LGLDEFITSN IPKEQQDKMQ GYFYEMLYGV MNAALDETIR

301 RYGLPEWQQD EARNRFLLHS MDAYTGLTEY PAPMLLQLDG FSEVRSSGLQ

351 MTRSPGALLV YLGSVLLVLG TVLMFYVREK RAWVLFSDGK IRFAMSSARS

401 ERDLQKEFPK HVESLQRLGK DLNHD*
```

Computer analysis of this amino acid sequence gave the following results:

Homology with a Predicted ORF from *N. gonorrhoeae*

ORF 504 shows 96.7% identity over a 425 aa overlap with a predicted ORF (ORF 504.ng) from *N. gonorrhoeae*:

```
m504/g504
                      10         20         30         40         50         60
      m504.pep   ILVQDLPFEVKLKKFHIDFYNTGMPRDFASDIEVTDKATGEKLERTIRVNHPLTLHGITI
                 :||||||||||||||||||||||||||||||||||||||||||||||||||||||||||
      g504       MLVQDLPFEVKLKKFHIDFYNTGMPRDFASDIEVTDKATGEKLERTIRVNHPLTLHGITI
                      10         20         30         40         50         60

70         80         90        100        110        120
      m504.pep   YQASFADGGSDLTFKAWNLGDASREPVVLKATSIHQFPLEIGKHKYRLEFDQFTSMNVED
                 ||||||||||||||||||||| ||||||||||||||||||||||||||||||||||||||
      g504       YQASFADGGSDLTFKAWNLRDASREPVVLKATSIHQFPLEIGKHKYRLEFDQFTSMNVED
                      70         80         90        100        110        120

130        140        150        160        170        180
      m504.pep   MSEGAEREKSLKSTLXDVRAVTQEGKKYTNIGPSIVYRIRDAAGQAVEYKNYMLPVLQEQ
                 ||||||||||||||| ||||||||||||||||||||||||||||||||||||||:||::
      g504       MSEGAEREKSLKSTLNDVRAVTQEGKKYTNIGPSIVYRIRDAAGQAVEYKNYMLPILQDK
                     130        140        150        160        170        180

190        200        210        220        230        240
      m504.pep   DYFWITGTRSGLQQQYRWLRIPLDKQLKADTFMALREFLKDGEGRKRLVADATKGAPAEI
                 ||||:||||||||||||||||||||||||||||||||||||||||||||||||| |||||
      g504       DYFWLTGTRSGLQQQYRWLRIPLDKQLKADTFMALREFLKDGEGRKRLVADATKDAPAEI
                     190        200        210        220        230        240

250        260        270        280        290        300
      m504.pep   REQFMLAAENTLNIFAQKGYLGLDEFITSNIPKEQQDKMQGYFYEMLYGVMNAALDETIR
                 |||||||||||||||||||||||||||||||||| |||||||||||||||||||||||||
      g504       REQFMLAAENTLNIFAQKGYLGLDEFITSNIPKGQQDKMQGYFYEMLYGVMNAALDETIR
                     250        260        270        280        290        300

310        320        330        340        350        360
      m504.pep   RYGLPEWQQDEARNRFLLHSMDAYTGLTEYPAPMLLQLDGFSEVRSSGLQMTRSPGALLV
                 ||||||||||||||||||||||||||||||||||||||||||||||||||||||||||||
      g504       RYGLPEWQQDEARNRFLLHSMDAYTGLTEYPAPMLLQLDGFSEVRSSGLQMTRSPGALLV
                     310        320        330        340        350        360

370        380        390        400        410        420
      m504.pep   YLGSVLLVLGTVLMFYVREKRAWVLFSDGKIRFAMSSARSERDLQKEFPKHVESLQRLGK
                 ||||||||||||:||| :||||||||:  |||||||||||||||||||||||||||||||
      g504       YLGSVLLVLGTVFMFYVPKKRAWVLFSN-KIRFAMSSARSERDLQKEFPKHVESLQRLGK
                     370        380        390        400        410 m504.pep   DLNHD
                 |||||
      g504       DLNHD
                     420
```

The following partial DNA sequence was identified in *N. meningitidis* <SEQ ID 1365>:

```
a504.seq
     1  ATATTGGTTC AGGACTTGCC TTTTGAAGTC AAACTGAAAA AATTCCATAT
    51  CGATTTTTAC AATACGGGTA TGCCGCGCGA TTTTGCCAGT GATATTGAAG
   101  TAACGGATAA GGCAACCGGT GAGAAACTCG AGCGCACCAT CCGCGTGAAC
   151  CATCCTTTGA CCTTGCACGG CATCACGATT TATCAGGCGA GTTTTGCCGA
   201  CGGCGGTTCG GATTTGACAT TCAAGGCGTG GAATTTGGGT GATGCTTCGC
   251  GCGAGCCTGT CGTGTTGAAG GCAACATCCA TACACCAGTT TCCGTTGGAA
   301  ATTGGCAAAC ACAAATATCG TCTTGAGTTC GATCAGTTTA CTTCTATGAA
   351  TGTGGAGGAC ATGAGCGAGG GCGCGGAACG GGAAAAAAGC CTGAAATCCA
   401  CGCTGAACGA TGTCCGCGCC GTTACTCAGG AAGGTAAAAA ATACACCAAT
   451  ATCGGCCCTT CCATTGTTTA CCGTATCCGT GATGCGGCAG GGCAGGCGGT
   501  CGAATATAAA AACTATATGC TGCCGGTTTT GCAGGAACAG GATTATTTTT
   551  GGATTACCGG CACGCGCAGC GGCTTGCAGC AGCAATACCG CTGGCTGCGT
   601  ATCCCCTTGG ACAAGCAGTT GAAAGCGGAC ACCTTTATGG CATTGCGTGA
   651  GTTTTTGAAA GATGGGGAAG GGCGCAAACG TCTGGTTGCC GACGCAACCA
   701  AAGGCGCACC TGCCGAAATC CGCGAACAAT TCATGCTGGC TGCGGAAAAC
   751  ACGCTGAACA TCTTTGCACA AAAAGGCTAT TTGGGATTGG ACGAATTTAT
   801  TACGTCCAAT ATCCCGAAAG AGCAGCAGGA TAAGATGCAG GGCTATTTCT
   851  ACGAAATGCT TTACGGCGTG ATGAACGCTG CTTTGGATGA AACCATACGC
   901  CGGTACGGCT TGCCCGAATG GCAGCAGGAT GAAGCGCGGA ATCGTTTCCT
   951  GCTGCACAGT ATGGATGCGT ACACGGGTTT GACCGAATAT CCCGCGCCTA
  1001  TGCTGCTGCA ACTTGATGGG TTTTCCGAGG TGCGTTCGTC GGGTTTGCAG
  1051  ATGACCCGTT CCCCGGGTGC GCTTTTGGTC TATCTCGGCT CGGTGCTGTT
  1101  GGTATTGGGT ACGGTATTGA TGTTTTATGT GCGCGAAAAA CGGGCGTGGG
  1151  TATTGTTTTC AGACGGCAAA ATCCGTTTTG CCATGTCTTC GGCTTGCAGC
  1201  GAACGGGATT TGCAGAAGGA ATTTCCAAAA CACGTCGAGA GTCTGCAACG
  1251  GCTCGGCAAG GACTTGAATC ATGACTGA
```

This corresponds to the amino acid sequence <SEQ ID 1366; ORF 504.a>:

```
a504.pep
    1 ILVQDLPFEV KLKKFHIDFY NTGMPRDFAS DIEVTDKATG EKLERTIRVN
   51 HPLTLHGITI YQASFADGGS DLTFKAWNLG DASREPVVLK ATSIHQFPLE
  101 IGKHKYRLEF DQFTSMNVED MSEGAEREKS LKSTLNDVRA VTQEGKKYTN
  151 IGPSIVYRIR DAAGQAVEYK NYMLPVLQEQ DYFWITGTRS GLQQQYRWLR
  201 IPLDKQLKAD TFMALREFLK DGEGRKRLVA DATKGAPAEI REQFMLAAEN
  251 TLNIFAQKGY LGLDEFITSN IPKEQQDKMQ GYFYEMLYGV MNAALDETIR
  301 RYGLPEWQQD EARNRFLLHS MDAYTGLTEY PAPMLLQLDG FSEVRSSGLQ
  351 MTRSPGALLV YLGSVLLVLG TVLMFYVREK RAWVLFSDGK IRFAMSSARS
  401 ERDLQKEFPK HVESLQRLGK DLNHD*
``` m504/a504 99.8% identity in 425 aa overlap

```
               10        20        30        40        50        60
m504.pep  ILVQDLPFEVKLKKFHIDFYNTGMPRDFASDIEVTDKATGEKLERTIRVNHPLTLHGITI
          ||||||||||||||| ||||||||||||||||||||||||||||||||||||||||||||
a504      ILVQDLPFEVKLKKFHIDFYNTGMPRDFASDIEVTDKATGEKLERTIRVNHPLTLHGITI
               10        20        30        40        50        60

70        80        90       100       110       120
m504.pep  YQASFADGGSDLTFKAWNLGDASREPVVLKATSIHQFPLEIGKHKYRLEFDQFTSMNVED
          ||||||||||||||||||||||||||||||||||||||||||||||||||||||||||||
a504      YQASFADGGSDLTFKAWNLGDASREPVVLKATSIHQFPLEIGKHKYRLEFDQFTSMNVED
               70        80        90       100       110       120

130       140       150       160       170       180
m504.pep  MSEGAEREKSLKSTLXDVRAVTQEGKKYTNIGPSIVYRIRDAAGQAVEYKNYMLPVLQEQ
          |||||||||||||||| |||||||||||||||||||||||||||||||||||||||||||
a504      MSEGAEREKSLKSTLXDVRAVTQEGKKYTNIGPSIVYRIRDAAGQAVEYKNYMLPVLQEQ
              130       140       150       160       170       180

190       200       210       220       230       240
m504.pep  DYFWITGTRSGLQQQYRWLRIPLDKQLKADTFMALREFLKDGEGRKRLVADATKGAPAEI
          ||||||||||||||||||||||||||||||||||||||||||||||||||||||||||||
a504      DYFWITGTRSGLQQQYRWLRIPLDKQLKADTFMALREFLKDGEGRKRLVADATKGAPAEI
              190       200       210       220       230       240

250       260       270       280       290       300
m504.pep  REQFMLAAENTLNIFAQKGYLGLDEFITSNIPKEQQDKMQGYFYEMLYGVMNAALDETIR
          ||||||||||||||||||||||||||||||||||||||||||||||||||||||||||||
a504      REQFMLAAENTLNIFAQKGYLGLDEFITSNIPKEQQDKMQGYFYEMLYGVMNAALDETIR
              250       260       270       280       290       300

310       320       330       340       350       360
m504.pep  RYGLPEWQQDEARNRFLLHSMDAYTGLTEYPAPMLLQLDGFSEVRSSGLQMTRSPGALLV
          ||||||||||||||||||||||||||||||||||||||||||||||||||||||||||||
a504      RYGLPEWQQDEARNRFLLHSMDAYTGLTEYPAPMLLQLDGFSEVRSSGLQMTRSPGALLV
              310       320       330       340       350       360

370       380       390       400       410       420
m504.pep  YLGSVLLVLGTVLMFYVREKRAWVLFSDGKIRFAMSSARSERDLQKEFPKHVESLQRLGK
          ||||||||||||||||||||||||||||||||||||||||||||||||||||||||||||
a504      YLGSVLLVLGTVLMFYVREKRAWVLFSDGKIRFAMSSARSERDLQKEFPKHVESLQRLGK
              370       380       390       400       410       420 m504.pep  DLNHDX
          ||||||
a504      DLNHDX
```

The following partial DNA sequence was identified in *N. gonorrhoeae* <SEQ ID 1367>:

```
g505.seq
   1 atgtttcgtt tacaattcag gctgtttccc cctttgcgaa ccgccatgca
  51 catcctgttg accgccctgc tcaaatgcct ctccctgctg tcgctttcct
 101 gtctgcacac gctgggaaac cggctcggac atctggcgtt ttaccttta
 151 aaggaagacc gcgcgcgcat cgtcgccaat atgcggcagg cgggtttgaa
 201 ccccgacacg cagacggtca aagccgtttt tgcggaaacg gcaaaatgcg
 251 gtttggaact tgccccgcg tttttcaaaa accggaaga catcgaaaca
 301 atgttcaaag cggtacacgg ctgggaacac gtgcagcagg ctttggacaa
 351 gggcgaaggg ctgctgttca tcacgccgca catcggcagc tacgatttgg
 401 gcggacgcta catcagccag cagcttccgt tccacctgac cgccatgtac
 451 aagccgccga aaatcaaagc gatagacaaa atcatgcagg cgggcagggt
 501 gcgcggcaaa ggcaaaaccg cgcccaccgg catacaaggg gtcaaacaaa
 551 tcatcaaggc cctgcgcgcg ggcgaggcaa ccatcatcct gcccgaccac
 601 gtcccttctc cgcaggaagg cggcggcgtg tgggcggatt ttttcggcaa
 651 acctgcatac accatgacac tggcggcaaa attggcacac gtcaaaggcg
 701 tgaaaaccct gttttctgc tgcgaacgcc tgcccgacgg acaaggcttc
 751 gtgttgcaca tccgccccgt ccaaggggaa ttgaacggca acaaagccca
```

```
-continued
801 cgatgccgcc gtgttcaacc gcaataccga atattggata cgccgttttc 851 cgacgcagta tctgtttatg tacaaccgct ataaaacgcc gtaa
```

This corresponds to the amino acid sequence <SEQ ID 1368; ORF 505.ng>:

```
g505.pep
    1 MFRLQFRLFP PLRTAMHILL TALLKCLSLL SLSCLHTLGN RLGHLAFYLL

51 KEDRARIVAN MRQAGLNPDT QTVKAVFAET AKCGLELAPA FFKKPEDIET

101 MFKAVHGWEH VQQALDKGEG LLFITPHIGS YDLGGRYISQ QLPFHLTAMY

151 KPPKIKAIDK IMQAGRVRGK GKTAPTGIQG VKQIIKALRA GEATIILPDH

201 VPSPQEGGGV WADFFGKPAY TMTLAAKLAH VKGVKTLFFC CERLPDGQGF

251 VLHIRPVQGE LNGNKAHDAA VFNRNTEYWI RRFPTQYLFM YNRYKTP*
```

The following partial DNA sequence was identified in *N. meningitidis* <SEQ ID 1369>:

```
m505.seq (partial)
    1 GGCATGTTTC GTTTACAATT CAGGCTGTTT CCCCCTTTGC GAACCGCCAT

51 GCACATCCTG TTGACCGCCC TGCTCAAATG CCTCTCCCTG CTGCCGCTTT

101 CCTGTCTGCA CACGCTGGGA AACCGGCTCG ACATCTGGC GTTTTACCTT

151 TTAAAGGAAG ACCGCGCGCG CATCGTCGCC AATATGCGGC AGGCGGGTTT

201 GAACCCCGAC CCCAAAACGG TCAAAGCCGT TTTTGCGGAA ACGGCAAAAG

251 GCGGTTTGGA ACTTGCCCCC GCGTTTTTCA GAAAACCGGA AGACATAGAA

301 ACAATGTTCA AAGCGGTACA CGGCTGGGAA CATGTGCAGC AGGCTTTGGA

351 CAAACACGAA GGGCTGCTAT TCATCACGCC GCACATCGGC AGCTACGATT

401 TGGGCGGACG CTACATCAGC CAGCAGCTTC CGTTCCCGCT GACCGCCATG

451 TACAAACCGC CGAAAATCAA AGCGATAGAC AAAATCATGC AGGCGGGCAG

501 GGTTCGCGGC AAAGGAAAAA CCGCGCCTAC CAGCATACAA GGGGTCAAAC

551 AAATCATCAA AGCCCTGCGT TCGGGCGAgC AACCATCGTC CTGCCCGACC

601 ACGTCCCCTC CCCTCAAGAA GGCGGGGAAG GCGTATGGGT GGATTTCTTC

651 GGCAAACCTG CCTATACCAT GACGCTGGCG GCAArATTGG CACACGTCAA

701 AGGCGTGAAA ACCCTGTTTT TCTGCTGCGA ACGCCTGCCT GGCGGACAAG

751 GTTTCGATTT GCACATCCGC CCCGTCCAAG GGGAATTGAA CGGCGACAAA

801 GCCCATGATG CCGCCGTGTT CAACCGCAAT GCCGAATATT GGATACGCCG

851 TTTTCCGACG CAtATC....
```

This corresponds to the amino acid sequence <SEQ ID 1370; ORF 505>:

```
m505.pep (partial)
    1 MFRLQFRLFP PLRTAMHILL TALLKCLSLL PLSCLHTLGN RLGHLAFYLL

51 KEDRARIVAN MRQAGLNPDP KTVKAVFAET AKGGLELAPA FFRKPEDIET

101 MFKAVHGWEH VQQALDKHEG LLFITPHIGS YDLGGRYISQ QLPFPLTAMY

151 KPPKIKAIDK IMQAGRVRGK GKTAPTSIQG VKQIIKALRS GEATIVLPDH
```

-continued

```
201 VPSPQEGGEG VWVDFFGKPA YTMTLAAXLA HVKGVKTLFF CCERLPGGQG

251 FDLHIRPVQG ELNGDKAHDA AVFNRNAEYW IRRFPTHI...
```

Computer analysis of this amino acid sequence gave the following results:

Homology with a Predicted ORF from *N. gonorrhoeae*

ORF 505 shows 93.7% identity over a 287 aa overlap with a predicted ORF (ORF 505.ng) from *N. gonorrhoeae*:

```
    m505/g505

10         20         30         40         50         60
        m505.pep    MFRLQFRLFPPLRTAMHILLTALLKCLSLLPLSCLHTLGNRLGHLAFYLLKEDRARIVAN
                   ||||||||||||||||||||||||||||||| |||||||||||||||||||||||||||||
           g505    MFRLQFRLFPPLRTAMHILLTALLKCLSLLSLSCLHTLGNRLGHLAFYLLKEDRARIVAN
                      10         20         30         40         50         60

70         80         90        100        110        120
        m505.pep    MRQAGLNPDPKTVKAVFAETAKGGLELAPAFFRKPEDIETMFKAVHGWEHVQQALDKHEG
                   ||||||||| :|||||||||||| |||||||||:|||||||||||||||||||||||| ||
           g505    MRQAGLNPDTQTVKAVFAETAKCGLELAPAFFKKPEDIETMFKAVHGWEHVQQALDKGEG
                      70         80         90        100        110        120

130        140        150        160        170        180
        m505.pep    LLFITPHIGSYDLGGRYISQQLPFPLTAMYKPPKIKAIDKIMQAGRVRGKGKTAPTSIQG
                   |||||||||||||||||||||||||| |||||||||||||||||||||||||||||:|||
           g505    LLFITPHIGSYDLGGRYISQQLPFHLTAMYKPPKIKAIDKIMQAGRVRGKGKTAPTGIQG
                     130        140        150        160        170        180

190        200        210        220        230        240
        m505.pep    VKQIIKALRSGEATIVLPDHVPSPQEGGEGVWVDFFGKPAYTMTLAAXLAHVKGVKTLFF
                   |||||||||:|||||||| ||||||||||   |||:|||||||||||| ||||||||||||
           g505    VKQIIKALRAGEATIILPDHVPSPQEGG-GVWADFFGKPAYTMTLAAKLAHVKGVKTLFF
                     190        200        210        220        230

250        260        270        280       289
        m505.pep    CCERLPGGQGFDLHIRPVQGELNGDKAHDAAVFNRNAEYWIRRFPTHI
                   |||||| |||| |||||||||||||:|||||||||:||||||||:
           g505    CCERLPDGQGFVLHIRPVQGELNGNKAHDAAVFNRNTEYWIRRFPTQYLFMYNRYKTP
                     240        250        260        270        280        290
```

The following partial DNA sequence was identified in *N. meningitidis* <SEQ ID 1371>:

```
a505.seq
   1 ATGTTTCGTT TACAATTCAG GCTGTTTCCC CCTTTGCGAA CCGCCATGCA

51 CATCCTGTTG ACCGCCCTGC TCAAATGCCT CTCCCTGCTG CCGCTTTCCT

101 GTCTGCACAC GCTGGGAAAC CGGCTCGGAC ATCTGGCGTT TTACCTTTTA

151 AAGGAAGACC GCGCGCGCAT CGTCGCCAAT ATGCGTCAGG CAGGCATGAA

201 TCCCGACCCC AAAACGGTCA AAGCCGTTTT TGCGGAAACG GCAAAAGGCG

251 GTTTGGAACT TGCCCCCGCG TTTTTCAGAA AACCGGAAGA CATAGAAACA

301 ATGTTCAAAG CGGTACACGG CTGGGAACAT GTGCAGCAGG CTTTGGACAA

351 ACACGAAGGG CTGCTATTCA TCACGCCGCA CATCGGCAGC TACGATTTGG

401 GCGGACGCTA CATCAGCCAG CAGCTTCCGT TCCCGCTGAC CGCCATGTAC

451 AAACCGCCGA AAATCAAAGC GATAGACAAA ATCATGCAGG CGGGCAGGGT

501 TCGCGGCAAA GGAAAAACCG CGCCTACCAG CATACAAGGG GTCAAACAAA

551 TCATCAAAGC CCTGCGTTCG GGCGAAGCAA CCATCGTCCT GCCCGACCAC

601 GTCCCCTCCC CTCAAGAAGG CGGGGAAGGC GTATGGGTGG ATTTCTTCGG

651 CAAACCTGCC TATACCATGA CGCTGGCGGC AAAATTGGCA CACGTCAAAG

701 GCGTGAAAAC CCTGTTTTTC TGCTGCGAAC GCCTGCCTGG CGGACAAGGT
```

-continued
```
751 TTCGATTTGC ACATCCGCCC CGTCCAAGGG GAATTGAACG GCGACAAAGC

801 CCATGATGCC GCCGTGTTCA ACCGCAATGC CGAATATTGG ATACGCCGTT

851 TTCCGACGCA GTATCTGTTT ATGTACAACC GCTACAAAAT GCCGTAA
```

This corresponds to the amino acid sequence <SEQ ID 1372; ORF 505.a>:

```
a505.pep
  1 MFRLQFRLFP PLRTAMHILL TALLKCLSLL PLSCLHTLGN RLGHLAFYLL

51 KEDRARIVAN MRQAGMNPDP KTVKAVFAET AKGGLELAPA FFRKPEDIET

101 MFKAVHGWEH VQQALDKHEG LLFITPHIGS YDLGGRYISQ QLPFPLTAMY

151 KPPKIKAIDK IMQAGRVRGK GKTAPTSIQG VKQIIKALRS GEATIVLPDH

201 VPSPQEGGEG VWVDFFGKPA YTMTLAAKLA HVKGVKTLFF CCERLPGGQG

251 FDLHIRPVQG ELNGDKAHDA AVFNRNAEYW IRRFPTQYLF MYNRYKMP*
``` m505/a505 99.0% identity in 287 aa overlap

```
                  10         20         30         40         50         60
   m505.pep  MFRLQFRLFPPLRTAMHILLTALLKCLSLLPLSCLHTLGNRLGHLAFYLLKEDRARIVAN
             ||||||||||||||||||||||||||||||||||||||||||||||||||||||||||||
   a505      MFRLQFRLFPPLRTAMHILLTALLKCLSLLPLSCLHTLGNRLGHLAFYLLKEDRARIVAN
                  10         20         30         40         50         60

70         80         90        100        110        120
   m505.pep  MRQAGLNPDPKTVKAVFAETAKGGLELAPAFFRKPEDIETMFKAVHGWEHVQQALDKHEG
             |||||:||||||||||||||||||||||||||||||||||||||||||||||||||||||
   a505      MRQAGMNPDPKTVKAVFAETAKGGLELAPAFFRKPEDIETMFKAVHGWEHVQQALDKHEG
                  70         80         90        100        110        120

130        140        150        160        170        180
   m505.pep  LLFITPHIGSYDLGGRYISQQLPFPLTAMYKPPKIKAIDKIMQAGRVRGKGKTAPTSIQG
             ||||||||||||||||||||||||||||||||||||||||||||||||||||||||||||
   a505      LLFITPHIGSYDLGGRYISQQLPFPLTAMYKPPKIKAIDKIMQAGRVRGKGKTAPTSIQG
                 130        140        150        160        170        180

190        200        210        220        230        240
   m505.pep  VKQIIKALRSGEATIVLPDHVPSPQEGGEGVWVDFFGKPAYTMTLAAXLAHVKGVKTLFF
             |||||||||||||||||||||||||||||||||||||||||||||| |||||||||||||
   a505      VKQIIKALRSGEATIVLPDHVPSPQEGGEGVWVDFFGKPAYTMTLAAKLAHVKGVKTLFF
                 190        200        210        220        230        240

250        260        270        280
   m505.pep  CCERLPGGQGFDLHIRPVQGELNGDKAHDAAVFNRNAEYWIRRFPTHI
             |||||||||||||||||||||||||||||||||||||||||||||:
   a505      CCERLPGGQGFDLHIRPVQGELNGDKAHDAAVFNRNAEYWIRRFPTQYLFMYNRYKMPX
                 250        260        270        280        290
```

The following partial DNA sequence was identified in *N. meningitidis* <SEQ ID 1373>:

```
m505-1.seq
  1 ATGTTTCGTT TACAATTCAG GCTGTTTCCC CCTTTGCGAA CCGCCATGCA

51 CATCCTGTTG ACCGCCCTGC TCAAATGCCT CTCCCTGCTG CCGCTTTCCT

101 GTCTGCACAC GCTGGGAAAC CGGCTCGGAC ATCTGGCGTT TTACCTTTTA

151 AAGGAAGACC GCGCGCGCAT CGTCGCCAAT ATGCGGCAGG CGGGTTTGAA

201 CCCCGACCCC AAAACGGTCA AGCCGTTTT TGCGGAAACG GCAAAAGGCG

251 GTTTGGAACT GCCCCCGCG TTTTTCAGAA ACCGGAAGA CATAGAAACA

301 ATGTTCAAAG CGGTACACGG CTGGGAACAT GTGCAGCAGG CTTTGGACAA
```

-continued
```
351 ACACGAAGGG CTGCTATTCA TCACGCCGCA CATCGGCAGC TACGATTTGG

401 GCGGACGCTA CATCAGCCAG CAGCTTCCGT TCCCGCTGAC CGCCATGTAC

451 AAACCGCCGA AAATCAAAGC GATAGACAAA ATCATGCAGG CGGGCAGGGT

501 TCGCGGCAAA GGAAAAACCG CGCCTACCAG CATACAAGGG GTCAAACAAA

551 TCATCAAAGC CCTGCGTTCG GGCGAAGCAA CCATCGTCCT GCCCGACCAC

601 GTCCCCTCCC CTCAAGAAGG CGGGGAAGGC GTATGGGTGG ATTTCTTCGG

651 CAAACCTGCC TATACCATGA CGCTGGCGGC AAAATTGGCA CACGTCAAAG

701 GCGTGAAAAC CCTGTTTTTC TGCTGCGAAC GCCTGCCTGG CGGACAAGGT

751 TTCGATTTGC ACATCCGCCC CGTCCAAGGG GAATTGAACG GCGACAAAGC

801 CCATGATGCC GCCGTGTTCA ACCGCAATGC CGAATATTGG ATACGCCGTT

851 TTCCGACGCA GTATCTGTTT ATGTACAACC GCTACAAAAT GCCGTAA
```

This corresponds to the amino acid sequence <SEQ ID 20 1374; ORF 505-1>:

```
m505-1.pep

1 MFRLQFRLFP PLRTAMHILL TALLKCLSLL PLSCLHTLGN RLGHLAFYLL

51 KEDRARIVAN MRQAGLNPDP KTVKAVFAET AKGGLELAPA FFRKPEDIET

101 MFKAVHGWEH VQQALDKHEG LLFITPHIGS YDLGGRYISQ QLPFPLTAMY

151 KPPKIKAIDK IMQAGRVRGK GKTAPTSIQG VKQIIKALRS GEATIVLPDH

201 VPSPQEGGEG VWVDFFGKPA YTMTLAAKLA HVKGVKTLFF CCERLPGGQG

251 FDLHIRPVQG ELNGDKAHDA AVFNRNAEYW IRRFPTQYLF MYNRYKMP* m505-1/g505    94.3% identity in 298 aa overlap 10         20         30         40         50         60
    m505-1.pep  MFRLQFRLFPPLRTAMHILLTALLKCLSLLPLSCLHTLGNRLGHLAFYLLKEDRARIVAN
                ||||||||||||||||||||||||||||||| ||||||||||||||||||||||||||||
         g505  MFRLQFRLFPPLRTAMHILLTALLKCLSLLSLSCLHTLGNRLGHLAFYLLKEDRARIVAN
                     10         20         30         40         50         60

70         80         90        100        110        120
    m505-1.pep  MRQAGLNPDPKTVKAVFAETAKGGLELAPAFFRKPEDIETMFKAVHGWEHVQQALDKHEG
                ||||||||||:|||||||||||| ||||||||:|||||||||||||||||||||||| ||
         g505  MRQAGLNPDTQTVKAVFAETAKCGLELAPAFFKKPEDIETMFKAVHGWEHVQQALDKGEG
                     70         80         90        100        110        120

130        140        150        160        170        180
    m505-1.pep  LLFITPHIGSYDLGGRYISQQLPFPLTAMYKPPKIKAIDKIMQAGRVRGKGKTAPTSIQG
                |||||||||||||||||||||||||:||||||||||||||||||||||||||||||:|||
         g505  LLFITPHIGSYDLGGRYISQQLPFHLTAMYKPPKIKAIDKIMQAGRVRGKGKTAPTGIQG
                    130        140        150        160        170        180

190        200        210        220        230        240
    m505-1.pep  VKQIIKALRSGEATIVLPDHVPSPQEGGEGVWVDFFGKPAYTMTLAAKLAHVKGVKTLFF
                |||||||||:|||||:|||||||||||| |||:|||||||||||||||||||||||||||
         g505  VKQIIKALRAGEATIILPDHVPSPQEGG-GVWADFFGKPAYTMTLAAKLAHVKGVKTLFF
                    190        200        210        220        230

250        260        270        280        290      299
    m505-1.pep  CCERLPGGQGFDLHIRPVQGELNGDKAHDAAVFNRNAEYWIRRFPTQYLFMYNRYKMPX
                |||||| |||| |||||||||||:|||||||||||:|||||||||||||||||||||||
         g505  CCERLPDGQGFVLHIRPVQGELNGNKAHDAAVFNRNTEYWIRRFPTQYLFMYNRYKTPX
                240        250        260        270        280        290 m505-1/a505    99.7% identity in 298 aa overlap 10         20         30         40         50         60
    m505-1.pep  MFRLQFRLFPPLRTAMHILLTALLKCLSLLPLSCLHTLGNRLGHLAFYLLKEDRARIVAN
                ||||||||||||||||||||||||||||||||||||||||||||||||||||||||||||
         a505  MFRLQFRLFPPLRTAMHILLTALLKCLSLLPLSCLHTLGNRLGHLAFYLLKEDRARIVAN
                     10         20         30         40         50         60
```

```
                   70         80         90        100        110        120
m505-1.pep   MRQAGLNPDPKTVKAVFAETAKGGLELAPAFFRKPEDIETMFKAVHGWEHVQQALDKHEG
             |||||:||||||||||||||||||||||||||||||||||||||||||||||||||||| 
a505         MRQAGMNPDPKTVKAVFAETAKGGLELAPAFFRKPEDIETMFKAVHGWEHVQQALDKHEG
                   70         80         90        100        110        120

130        140        150        160        170        180
m505-1.pep   LLFITPHIGSYDLGGRYISQQLPFPLTAMYKPPKIKAIDKIMQAGRVRGKGKTAPTSIQG
             ||||||||||||||||||||||||||||||||||||||||||||||||||||||||||||
a505         LLFITPHIGSYDLGGRYISQQLPFPLTAMYKPPKIKAIDKIMQAGRVRGKGKTAPTSIQG
                  130        140        150        160        170        180

190        200        210        220        230        240
m505-1.pep   VKQIIKALRSGEATIVLPDHVPSPQEGGEGVWVDFFGKPAYTMTLAAXLAHVKGVKTLFF
             |||||||||||||||||||||||||||||||||||||||||||||| |||||||||||| 
a505         VKQIIKALRSGEATIVLPDHVPSPQEGGEGVWVDFFGKPAYTMTLAAKLAHVKGVKTLFF
                  190        200        210        220        230        240

250        260        270        280        290    299
m505-1.pep   CCERLPGGQGFDLHIRPVQGELNGDKAHDAAVFNRNAEYWIRRFPTQYLFMYNRYKMPX
             |||||||||||||||||||||||||||||||||||||||||||||||||||||||||| 
a505         CCERLPGGQGFDLHIRPVQGELNGDKAHDAAVFNRNAEYWIRRFPTQYLFMYNRYKMPX
                  250        260        270        280        290
```

The following partial DNA sequence was identified in *N. gonorrhoeae* <SEQ ID 1375>:

```
g506.seq
    1 ATGGCGGTAT TTGATGAAGT CGGGCGCATC GCCCATGGCT GCGGCGGTGT

51 TGTCAAACAA AGCCTGTTTC TGCGCGTCGT TCATCAGGTT GAACAAGGCG

101 CGCGGTTGGC TGAAGTAGTC GTCATCGTCT GGCGGTAGT  CCCAGTGTGC

151 CGCGTCGCCG TTGATTTTCA AAGGCGGTTC GGCGAAGTCG GGTTGTTGCT

201 GCCATTGGCC GAAGCTGTTG GGTTCGTAGT GCGGCAGGCT GCCGTAGTTG

251 CCGTCGGCGC GGCCTTGTCC GTCGCGCTGG TTGCTGTGAA CAGGGCAACG

301 CGGACGATTG ACGGGATTT  GGCGGAAGTT CACACCCAAG CGGTAACGTT

351 GCGCGTCGGC GTAATTGAAC AAACGGGCTT GCAACATTTT ATCCGGGCTC

401 GCGCCGATAC CGGGAACGAG GTTGCTCGGT GCGAAGGCGG ATTGTTCCAC

451 ATCGGCGAAG AAGTTTTCGG GATTGCGGTT CAACTCGAAT TTGCCGACTT

501 CAATCAGCGG ATAGTCTTTT TTCGGCCAAA CTTTGGTCAA GTCAAACGGA

551 TGATAAGGCA CTTTTTCGGC ATCGGCTTCA GGCATGACTT GGATGTACAT

601 CGTCCATTTC GGGAACTCGC CGCGCTCGAT GGCTTCGTAC AGGTCGCGCT

651 GATGGCTTTC GCGGTCGTCG GCGATGATTT TTGCAGCTTC TTCGTTGGTC

701 AGGTTTTTAA TCCCTTGCTG GCTGCGGAAA TGGAATTTCA CCCAAAAACG

751 TTCGCCCGCT TCGTTCCAGA AGCTGTAGGT ATGCGAACCG AAGCCGTGCA

801 TATGGCGGTA GCTGGCGGGA ATACCGCGGT CGCTCATCAC GATGGTAACT

851 TGGTGCAGGG CTTCGGGCAG CAGCGTCCAG AAGTCCCAGT TGTTTGTGGC

901 GGAACGCATA TTGGTGCGCG GATCGCGTTT GACGGCTTTG TTCAGGTCGG

951 GGAATTTGCG CGGGTCGCGC AGGAAGAACA CGGGCGTGTT GTTGCCGACC

1001 ACATCCCAGT TGCCTTCTTC GGTATAGAAT TCAACGCAA  AACCGCGGAT

1051 GTCGCGTTCC GCATCGGCTG CGCCGCGCTC GCCTGCCACG GTGGTGAAAC

1101 GGGCGAACAT CTCGGTTTTT TGCCGACTT  CGCTGAAAAT TTTGGCGCGG

1151 GTGTATTTGG TGATGTCGTG TGTTACGGTA AACGTACCGA ACGCGCCCGA

1201 ACCTTTGGCG TGCATACGGC GTTCGGGGAT GACTTCGCGC ACGAAGTCGG
```

-continued

```
1251  CGAGTTTTTC ATTCAGCCAC AAATCTTGCG TCAGCAGGGG GCCGCGCGGG

1301  CCGGCGGTCA GGCTGTTTTG ATTGTCGGCA ACGGGCGCGC CGTTGTTCAT

1351  GGTCAGATGG GTTACGGGGC ATTTGGAGGT AGTCATCGCT CTTGTTCCTT

1401  TTCTCAGGTT GGTCAAATGG GGGGCAAACG GCTTACAGTA CGATTTGGCG

1451  GAAAGCGTAT TCGTAACCGG TTTCTTGATT GTAATAAATT TCTTGAATCG

1501  ACATTTTATT TTCCTTTTGC AAAAACTATG GATGCGATTA TACGCCAAGA

1551  TTTTCGTTAT TAA
```

This corresponds to the amino acid sequence <SEQ ID 1376; ORF 506.ng>:

```
g506.pep
  1  MAVFDEVGRI AHGCGGVVKQ SLFLRVVHQV EQGARLAEVV VIVLAVVPVC

51  RVAVDFQRRF GEVGLLLPLA EAVGFVVRQA AVVAVGAALS VALVAVNRAT

101  RTIDGDLAEV HTQAVTLRVG VIEQTGLQHF IRARADTGNE VARCEGGLFH

151  IGEEVFGIAV QLEFAHFNQR IVFFRPNFGQ VKRMIRHFFG IGFRHDLDVH

201  RPFRELAALD GFVQVALMAF AVVGDDFCSF FVGQVFNPLL AAEMEFHPKT

251  FARFVPEAVG MRTEAVHMAV AGGNTAVAHH DGNLVQGFGQ QRPEVPVVCG

301  GTHIGARIAF DGFVQVGEFA RVAQEEHGRV VADHIPVAFF GIEFQRKTAD

351  VAFRIGCAAL ACHGGETGEH LGFFADFAEN FGAGVFGDVV CYGKRTERAR

401  TFGVHTAFGD DFAHEVGEFF IQPQILRQQG AARAGGQAVL IVGNGRAVVH

451  GQMGYGAFGG SHRSCSFSQV GQMGGKRLTV RFGGKRIRNR FLDCNKFLES

501  TFYFPFAKTM DAIIRQDFRY *
```

The following partial DNA sequence was identified in *N. meningitidis* <SEQ ID 1377>:

```
m506.seq
  1  ATGGCGGTAT TTGATGAAGT CGGGCGCGTC GCCCATTGCG GCGGCGGTGT

51  TGCCGAACAA TGCCTGTTTC TGCGCGTCGT TCATCAGGTT GAACAGGGCG

101  CGCGGTTGGC TGAAATAGTC GTCATCGTCT TGGCGGTAGT CCCAGTGTGC

151  CGCGTCGCCG TTGATTTTCA AAGGCGGTTC GGCGAAtCGg GGTTGTTGCT

201  GCCATTGGCC GAAGCTGTyG GGTTCGTAGT GCGGCAGGCT GCCGyAGTTG

251  CCGTCGGCGC GGCCTTGCCC GTyGCGsTgr TTgCTGTgAA CAsGGCAACG

301  CGGACGATTG ACGGGAATTT GGCGGAAGTT TACGCCCAAA CGGTAGCGTT

351  GTGCGTCGGC GTAATTGAAC AAACGCGCTT GCAGCATTTT ATCTsGGCTG

401  GCGCCGACAC CGGGAACGAG GTTGCTCGGT GCGAAGGCGG ATTGTTCCAC

451  ATCGGCGAAG AAGTTTTCGG GATTGCGGTT CTCAAACGGA TGATAAGGTA

501  CTTTTTCCGC GTCTGCTTCA GGCATGACTT GGATGTACAT CGTCCATTTC

551  GGAAACTCGC CGCGTTCGAT GGCTTCsTAT AAGTCGCGCT GATGGCTTTC

601  GCGGTCGTCG GCGATGATTT TGGCGGCTTC TTCGTTGGTC AGGTTTTTAA

651  TGCCTTGTTG GGTGCGGAAA TGGAATTTCA CCCAAAAACG CTCGCCTGCT

701  TCGTTCCAGA AGCTGTAGGT ATGCGAACCG AAGCCGTGCA TATGGCGGTA

751  GCCGGCGGGG ATGCCGCGGT CGCTCATCAC GATGGTAACT TGGTGCAGTG
```

-continued

```
 801 CTTCGGGCAG CAGCGTCCAG AAGTCCCAGT TGTTTGTGGC AGAGCGCATA

851 TTGGTGCGCG GGTCGCGTTT GACGGCTTTG TTCAGGTCGG GGAACTTACG

901 CGGGTCGCGC AGGAAGAACA CGGGCGTGTT GTTGCCGACC ACATCCCAGT

951 TGCCTTCTTC GGTATAAAAT TTCAAGGCAA AACCGCGGAT GTCGCGTTCT

1001 GCATCGGCTG CGCCGCGTTC GCCTGCCACG GTGGTGAAAC GGGCGAACAT

1051 CTCGGTTTTT TTGCCGACTT CGCTGAAGAT TCCTTTGGCG TGCATACGGC

1101 GTTCGGGGAT GACTTCGCGC ACGAAGTCGG CGAGTTTTTC AGTCATCGCT

1151 CTTGTTCCTT TTCTCAGGTT GGTCAAATGG GGGTAAACGG CTTACAGTAC

1201 GATTTGGCGG AAAGCGTATT CGTAACCGGT TTCTTGATTG CAATAAATTT

1251 CTTGAATCGA CATTTTATTT CCCTTTTGTA AAAACTATGG ATGCGACTAT

1301 ACGCCAAGAT TTTCGCTATT AA
```

This corresponds to the amino acid sequence <SEQ ID 1378; ORF 506>:

```
m506.pep
  1 MAVFDEVGRV AHCGGGVAEQ CLFLRVVHQV EQGARLAEIV VIVLAVVPVC

51 RVAVDFQRRF GESGLLLPLA EAVGFVVRQA AXVAVGAALP VAXXAVNXAT

101 RTIDGNLAEV YAQTVALCVG VIEQTRLQHF IXAGADTGNE VARCEGGLFH

151 IGEEVFGIAV QLEFAHFNQR IVFFRPNFGQ VKRMIRYFFR VCFRHDLDVH

201 RPFRKLAAFD GFXXVALMAF AVVGDDFGGF FVGQVFNALL GAEMEFHPKT

251 LACFVPEAVG MRTEAVHMAV AGGDAAVAHH DGNLVQCFGQ QRPEVPVVCG

301 RAHIGARVAF DGFVQVGELT RVAQEEHGRV VADHIPVAFF GIKFQGKTAD

351 VAFCIGCAAF ACHGGETGEH LGFFADFAED FGAGVFGDVV RYGKRTERAR

401 TFGVHTAFGD DFAHEVGEFF IQPQILRQQR AARTGGQAVL IVGNRRAVVH

451 GQMGYRAFGG SHRSCSFSQV GQMGGKRLTV RFGGKRIRNR FLDCNKFLES

501 TFYFPFVKTM DATIRQDFRY *
```

Computer analysis of this amino acid sequence gave the following results:

Homology with a Predicted ORF from *N. gonorrhoeae*
ORF 506 shows 89.2% identity over a 520 aa overlap with a predicted ORF (ORF 506.ng) from *N. gonorrhoeae*:

```
m506/g506
                  10         20         30         40         50         60
     m506.pep  MAVFDEVGRVAHCGGGVAEQCLFLRVVHQVEQGARLAEIVVIVLAVVPVCRVAVDFQRRF
               |||||||||:|| |||::| ||||||||||||||||:||||||||||||||||||||||
     g506      MAVFDEVGRIAHCGCGVAVKCSLFLRVVHQVEQGARLAEVVVIVLAVVPVCRVAVDFQRRF
                  10         20         30         40         50         60

70         80         90        100        110        120
     m506.pep  GESGLLLPLAEAVGFVVRQAAXVAVGAALPVAXXAVNXATRTIDGNLAEVYAQTVALCVG
               || |||||||||||||||||| ||||||| |||   ||| |||||:||||||::|:|:|
     g506      GEVGLLLPLAEAVGFVVRQAAVVAVGAALSVALVAVNRATRTIDGDLAEVHTQAVTLRVG
                  70         80         90        100        110        120

130        140        150        160        170        180
     m506.pep  VIEQTRLQHFIXAGADTGNEVARCEGGLFHIGEEVFGIAVQLEFAHFNQRIVFFRPNFGQ
               ||||| ||||| | ||||||||||||||||||||||||||||||||||||||||||||
     g506      VIEQTGLQHFIRARADTGNEVARCEGGLFHIGEEVFGIAVQLEFAHFNQRIVFFRPNFGQ
                 130        140        150        160        170        180
```

-continued

```
                    190       200       210       220       230       240
m506.pep    VKRMIRYFFRVCFRHDLDVHRPFRKLAAFDGFXXVALMAFAVVGDDFGGFFVGQVFNALL
            ||||||:|| : ||||||||||||:|||:|||  ||||||||||||| :|||||||||||
g506        VKRMIRHFFGIGFRHDLDVHRPFRELAALDGFVQVALMAFAVVGDDFCSFFVGQVFNALL
                    190       200       210       220       230       240

250       260       270       280       290       300
m506.pep    GAEMEFHPKTLACFVPEAVGMRTEAVHMAVAGGDAAVAHHDGNLVQCFGQQRPEVPVVCG
            :|||||||||:| |||||||||||||||||||||::||||||||||| |||||||||||||
g506        AAEMEFHPKTFARFVPEAVGMRTEAVHMAVAGGNTAVAHHDGNLVQGFGQQRPEVPVVCG
                    250       260       270       280       290       300

310       320       330       340       350       360
m506.pep    RAHIGARVAFDGFVQVGELTRVAQEEHGRVVADHIPVAFFGIKFQGKTADVAFCIGCAAF
             :|||||:||||||||||::|||||||||||||||||||||||:|| ||||||| |||||:
g506        GTHIGARIAFDGFVQVGEFARVAQEEHGRVVADHIPVAFFGIEFQRKTADVAFRIGCAA:
                    310       320       330       340       350       360

370       380       390       400       410       420
m506.pep    ACHGGETGEHLGFFADFAEDFGAGVFGDVVRYGKRTERARTFGVHTAFGDDFAHEVGEFF
            ||||||||||||||||||:|||||||||| ||||||||||||||||||||||||||||||
g506        ACHGGETGEHLGFFADFAENFGAGVFGDVVCYGKRTERARTFGVHTAFGDDFAHEVGEFF
                    370       380       390       400       410       420

430       440       450       460       470       480
m506.pep    IQPQILRQQRAARTGGQAVLIVGNRRAVVHGQMGYRAFGGSHRSCSFSQVGQMGGKRLTV
            ||||||||| |||:|||||||||| ||||||||||| |||||||||||||||||||||||
g506        IQPQILRQQGAARAGGQAVLIVGNGRAVVHGQMGYGAFGGSHRSCSFSQVGQMGGKRLTV
                    430       440       450       460       470       480

490       500       510       520
m506.pep    RFGGKRIRNRFLDCNKFLESTFYFPFVKTMDATIRQDFRY
            ||||||||||||||||||||||||||:||||| |||||||
g506        RFGGKRIRNRFLDCNKFLESTFYFPPAKTMDAIIRQDFRY
                    490       500       510       520
```

The following partial DNA sequence was identified in *N. meningitidis* <SEQ ID 1379>:

```
a506.seq
   1  ATGGCGGTAT TTGATGAAGT CGGGCGCGTC GCCCATTGCG GCGGCGGTGT

51  TGCCGAACAA TGCCTGTTTC TGCGCGTCGT TCATCAGGTT GAACAGGGCG

101  CGCGGTTGGC TGAAATAGTC GTCATCGTCT TGGCGGTAGT CCCAGTGCGC

151  CGCGTCGCCG TTGATTTTCA AAGGCGGTTC GGCGAAGTCG GGCTGCTGCT

201  GCCATTGGCC GAAGCTGTTG GGTTCGTAGT GCGGCAGGCT GCCGTAGTTG

251  CCGTCGGCGC GTCCTTGTCC GTCGCGCTGG TTGCTGTGAA CAGGGCAACG

301  CGGACGGTTG ACAGGGATTT GGCGGAAGTT CACGCCCAAG CGGTAGCGTT

351  GCGCGTCGGC GTAATTGAAC AAACGCGCCT GCAACATTTT ATCTGGGCTG

401  GCGCCGACAC CGGGAACGAG GTTGCTCGGT GCGAAGGCGG ATTGTTCCAC

451  ATCGGCGAAG AAGTTTTCGG GATTGCGGTT CAACTCGAAT TCGCCCACTT

501  CAATCAGCGG ATAGTCTTTT TTCGGCCAAA CTTTGGTCAA GTCAAACGGA

551  TGATACGGCA CTTTTTCCGC ATCGGCTTCA GGCATGACTT GGATGTACAT

601  CGTCCATTTC GGAAACTCGC CGCGCTCGAT GGCTTCGTAC AGGTCGCGCT

651  GATGGCTTTC ACGGTCGTCG GCGATGATTT TGGCGGCTTC TTCGTTGGTC

701  AGGTTTTTAA TGCCTTGTTG GGTGCGGAAA TGGAATTTCA CCCAAAAACG

751  CTCGCCTGCT TCGTTCCAGA AGCTGTAGGT ATGCGAACCG AAGCCGTGCA

801  TATGGCGGTA GCCGGCGGGG ATGCCGCGGT CGCTCATCAC GATGGTAACT

851  TGGTGCAGTG CTTCGGGCAG CAGCGTCCAG AAGTCCCAGT TGTTTGTGGC

901  AGAGCGCATA TTGGTGCGCG GGTCGCGTTT GACGGCTTTG TTCAGGTCGG
```

```
-continued
 951 GGAACTTACG CGGGTCGCGC AGGAAGAACA CGGGCGTGTT GTTGCCGACC

1001 ACATCCCAGT TGCCTTCTTC GGTATAGAAC TTCAACGCAA AACCGCGGAT

1051 GTCGCGTTCT GCATCGGCTG CGCCGCGTTC GCCTGCCACG GTGGTGAAAC

1101 GGGCGAACAT CTCGGTTTTT TGCCGACTTT CGCTGAAGAT TTTGGCGCGG

1151 GTGTATTTGG TGATGTCGTG CGTTACGGTA AACGTACCGA ACGCGCCCGA

1201 ACCTTTGGCG TGCATACGGC GTTCGGGGAT GACTTCGCGC ACGAAGTCGG

1251 CGAGTTTTTC ATTCAGCCAC AAATCCTGCG CCAGCAGAGG GCCGCGAGGA

1301 CCGGCGGTCA GGCTGTTTTG ATTGTCGGCA ACAGGCGCGC CGTTGTTCAT

1351 GGTCAGATGG GTTACAGGGC ATTTGGAGGT ANTCATCGCT CTTGTTCCTT

1401 TTCTCAGGTT GGTCAAAT.G GGGGTAAACG GCTTACAGTA CGATTTGGCG

1451 GAAAGCGTAT TCGTAACCGG TTTCTTGATT GCAATAAATT TCTTGAATCG

1501 ACATTTTATT TCCCTTTTGT AAAAACTATG GATGCGACTA TACGCCAAGA

1551 TTTTCGCTAT TAA
                                             25
```

This corresponds to the amino acid sequence <SEQ ID 1380; ORF 506.a>:

```
a506.pep
  1 MAVFDEVGRV AHCGGGVAEQ CLFLRVVHQV EQGARLAEIV VIVLAVVPVR

51 RVAVDFQRRF GEVGLLLPLA EAVGFVVRQA AVVAVGASLS VALVAVNRAT

101 RTVDRDLAEV HAQAVALRVG VIEQTRLQHF IWAGADTGNE VARCEGGLFH

151 IGEEVFGIAV QLEFAHFNQR IVFFRPNFGQ VKRMIRHFFR IGFRHDLDVH

201 RPFRKLAALD GFVQVALMAF TVVGDDFGGF FVGQVFNALL GAEMEFHPKT

251 LACFVPEAVG MRTEAVHMAV AGGDAAVAHH DGNLVQCFGQ QRPEVPVVCG

301 RAHIGARVAF DGFVQVGELT RVAQEEHGRV VADHIPVAFF GIELQRKTAD

351 VAFCIGCAAF ACHGGETGEH LGFFADFAED FGAGVFGDVV RYGKRTERAR

401 TFGVHTAFGD DFAHEVGEFF IQPQILRQQR AARTGGQAVL IVGNRRAVVH

451 GQMGYRAFGG XHRSCSFSQV GQXGGKRLTV RFGGKRIRNR FLDCNKFLES

501 TFYFPFVKTM DATIRQDFRY *
``` m506/a506 94.8% identity in 520 aa overlap

```
                   10         20         30         40         50         60
  m506.pep MAVFDEVGRVAHCGGGVAEQCLFLRVVHQVEQGARLAEIVVIVLAVVPVCRVAVDFQRRF
           ||||||||||||| ||| || ||||||||||||||||||| ||||||||| ||||||||
  a506     MAVFDEVGRIAHGCGVAVKCSLFLRVVHQVEQGARLAEVVIVLAVVPVRRVAVDFQRRF
                   10         20         30         40         50         60

70         80         90        100        110        120
  m506.pep GESGLLLPLAEAVGFVVRQAAXVAVGAALPVAXXAVNXATRTIDGNLAEVYAQTVALCVG
           ||  ||||||||||||||||| ||||:|  ||   |||:|  :||||:||:||   ||
  a506     GEVGLLLPLAEAVGFVVRQAAVVAVGASLSVALVAVNRATRTVDRDLAEVHAQAVALRVG
                   70         80         90        100        110        120

130        140        150        160        170        180
  m506.pep VIEQTRLQHFIXAGADTGNEVARCEGGLFHIGEEVFGIAVQLEFAHFNQRIVFFRPNFGQ
           |||||||||||| |||||||||||||||||||||||||||||||||||||||||||||
  a506     VIEQTRLQHFIWAGADTGNEVARCEGGLFHIGEEVFGIAVQLEFAHFNQRIVFFRPNFGQ
                  130        140        150        160        170        180
```

```
              190       200       210       220       230       240
m506.pep   VKRMIRYFFRVCFRHDLDVHRPFRKLAAFDGFXXVALMAFAVVGDDFGGFFVGQVFNALL
           |||||:|||: ||||||||||||||||||:||| ||||||:||||||||||||||||||
a506       VKRMIRHFFRIGFRHDLDVHRPFRKLAALDGFVQVALMAFTVVGDDFGGFFVGQVFNALL
              190       200       210       220       230       240

250       260       270       280       290       300
m506.pep   GAEMEFHPKTLACFVPEAVGMRTEAVHMAVAGGDAAVAHHDGNLVQCFGQQRPEVPVVCG
           ||||||||||||||||||||||||||||||||||||||||||||||||||||||||||||
a506       GAEMEFHPKTLACFVPEAVGMRTEAVHMAVAGGDAAVAHHDGNLVQCFGQQRPEVPVVCG
              250       260       270       280       290       300

310       320       330       340       350       360
m506.pep   RAHIGARVAFDGFVQVGELTRVAQEEHGRVVADHIPVAFFGIKFQGKTADVAFCIGCAAF
           ||||||||||||||||||||||||||||||||||||||||||||::|||||||||||||
a506       RAHIGARVAFDGFVQVGELTRVAQEEHGRVVADHIPVAFFGIELQRKTADVAFCIGCAAF
              310       320       330       340       350       360

370       380       390       400       410       420
m506.pep   ACHGGETGEHLGFFADFAEDFGAGVFGDVVRYGKRTERARTFGVHTAFGDDFAHEVGEFF
           ||||||||||||||||||||||||||||||||||||||||||||||||||||||||||||
a506       ACHGGETGEHLGFFADFAEDFGAGVFGDVVRYGKRTERARTFGVHTAFGDDFAHEVGEFF
              370       380       390       400       410       420

430       440       450       460       470       480
m506.pep   IQPQILRQQRAARTGGQAVLIVGNRRAVVHGQMGYRAFGGSHRSCSFSQVGQMGGKRLTV
           |||||||||||||||||||||||||||||||||||||||| |||||||||| |||||||
a506       IQPQILRQQRAARTGGQAVLIVGNRRAVVHGQMGYRAFGGXHRSCSFSQVGQXGGKRLTV
              430       440       450       460       470       480

490       500       510       520
m506.pep   RFGGKRIRNRFLDCNKFLESTFYFPFVKTMDATIRQDFRYX
           ||||||||||||||||||||||||||||||||||||||||
a506       RFGGKRIRNRFLDCNKFLESTFYFPFVKTMDATIRQDFRYX
              490       500       510       520
```

The following partial DNA sequence was identified in *N. gonorrhoeae* <SEQ ID 1381>:

```
g507.seq
   1 ATGCTCTTGC CGGCTTTGCA ACAAGGCGGC GGCTTCCTGA GCGGCGGCGG

51 TTTCGGCCTC GTCGGGCAGG TTCAGGGCTT GGTTTTCCTG CTTCAGACGG

101 CCTTTGCGCT CTTCGTGCTT GGCAACGGTT TGTTCGGCAT GGGCAAGCTG

151 CTGCTGCTTC AACGCCAGTT CGCGGCGGAT GCGGTTTGCC TCGTCCTGCT

201 GGGTTTGGAA GGCAGCGTTG AGCGTGGCTT GGACTTCTTC CAATTCGGGC

251 AGACGCTCTT CGTGTTCGGC AACCTGCATC GCCCATTCCG CCAATTCGGT

301 TTGCTTTTCT TCGACCTGCA ACTCGTTTTC CTCAAGCTGC ACGCGGATTT

351 GCTGCTGCTC CTGCCGGATG CGTTGCAACT GCGCCTGCGC TGCCTGCTTG

401 TCGCGTTCGA TGCGTTGGTG CAGGTTTTGC CGGTGGCGGA TTTGTTCTTC

451 CAAACGGGCA ATCTGCTCGC GCAACACGCC GCGTTTGTTG CTCAATTCGT

501 GTACTGCCTG CTGCTGCGAC TGTTCGGCAG TCTGCAAGGC GTGTACTTCG

551 TTATTTAA
```

This corresponds to the amino acid sequence <SEQ ID 1382; ORF 507.ng>:

```
g507.pep
   1 MLLPALQQGG GFLSGGGFGL VGQVQGLVFL LQTAFALFVL GNGLFGMGKL

51 LLLQRQFAAD AVCLVLLGLE GSVERGLDFF QFGQTLFVFG NLHRPFRQFG

101 LLFFDLQLVF LKLHADLLLL LPDALQLRLR CLLVAFDALV QVLPVADLFF

151 QTGNLLAQHA AFVACFVYCL LLRLFGSLQG VYFVI*
```

The following partial DNA sequence was identified in *N. meningitidis* <SEQ ID 1383>:

```
m507.seq
    1 ATGCTCTTGC TGACTTTGCA ACAAGGCGGC TGCTTCCTGC GCGGCGGCGG

51 TTTCGGCTTC GTCGGGCAGG TTTAAGGCTT GGTTTTCCTG TTTCAGACGA

101 CCTTTGCGCT CTTCGTGCTT GGCAATCGTT TGTTCGGCAT GGGCAAGCTG

151 CTGCTGCTTC AACGCCAGTT CGCGGCGGAT GCGGTTTGCC TCGTCCTGCT

201 GGGTTTGGAA GGCGGCGTTG AGCGTGGCTT GGGCTTCTTC CAATTCGGGC

251 AGACGCTCCT CGTGTTCGGC AACCTGCATC GCCCATTCCG CCAGCTCGGT

301 TTGTTTTTCT TCGACCTGCA ACTCGTTTTC TTCAAGCTGC ACGCGGATTT

351 GCTGCTGCTC TTGATGAATG CGTTGTAACT GCGCCTGCGC TGCCTGCTTG

401 TCGCGTTCGA TGCGTTGGTG CAGGTTTTGC TGATGGCGGA TTTGTTCTTC

451 CAAACGGGCA ATCTGCTCGC GCAACACGCC GCGCTTGTTG CTCAATTCAT

501 GCACTGCCTG CTGCTGCGAC TGTTCGGCAG TCTGCAAGGC GTGTACTTCG

551 TCGTTTAA
```

This corresponds to the amino acid sequence <SEQ ID 1384; ORF 507>:

```
m507.pep
    1 MLLLTLQQGG CFLRGGGFGF VGQVXGLVFL FQTTFALFVL GNRLFGMGKL

51 LLLQRQFAAD AVCLVLLGLE GGVERGLGFF QFGQTLLVFG NLHRPFRQLG

101 LFFFDLQLVF FKLHADLLLL LMNALXLRLR CLLVAFDALV QVLLMADLFF

151 QTGNLLAQHA ALVAQFMHCL LLRLFGSLQG VYFVV*
```

Computer analysis of this amino acid sequence gave the following results:
Homology with a Predicted ORF from *N. gonorrhoeae*
ORF 507 shows 87.0% identity over a 185 aa overlap with a predicted ORF (ORF 507.ng) from *N. gonorrhoeae*:

```
m507/g507
                    10         20         30         40         50         60
    m507.pep  MLLLTLQQGGCFLRGGGFGFVGQVXGLVFLFQTTFALFVLGNRLFGMGKLLLLQRQFAAD
              ||| :||||| || |||||:|||| |||||:||:|||||||| ||||||||||||||||
    g507      MLLPALQQGGGFLSGGGFGLVGQVQGLVFLLQTAFALFVLGNGLFGMGKLLLLQRQFAAD
                    10         20         30         40         50         60

70         80         90        100        110        120
    m507.pep  AVCLVLLGLEGGVERGLGFFQGFQTLLVFGNLHRPFRQLGLFFFDLQLVFFKLHADLLLL
              ||||||||||:||||| |||||| :||||||||||||||:|||||||||||:||||||||
    g507      AVCLVLLGLEGSVERGLDFFQGFQTLFVFGNLHRPFRQFGLLFFDLQLVFLKLHADLLLL
                    70         80         90        100        110        120

130        140        150        160        170        180
    m507.pep  LMNALXLRLRCLLVAFDALVQVLLMADLFFQTGNLLAQHAALVAQFMHCLLLRLFGSLQG
              | :|| |||||||||||||||||| :||||||||||||||||| :||||::||||||||||
    g507      LPDALQLRLRCLLVAFDALVQVLPVADLFFQTGNLLAQHAAFVAQFVYCLLLRLFGSLQG
                   130        140        150        160        170        180 m507.pep  VYFVV
              ||||:
    g507      VYFVI
```

The following partial DNA sequence was identified in *N. meningitidis* <SEQ ID 1385>:

```
a507.seq
    1 ATGCTCTTGC TGGCTTTGCA ACAAGGCGGC AGCTTCCTGC GCGGCGGCGG
```

-continued

```
 51 TTTCGGCTTC GTCAGGCAGA TTCAGGGCTT GGTTTTCCTG TTTCAGACGA

101 CCTTTGCGCT CTTCGTGCTT GGCAACGGTT TGTTCGGCAT GGGCAAGCTG

151 CTGCTGCTTC AACGCCAGTT CGCGGCGGAT GCGGTTTGCC TCGTCCTGCT

201 GGGTTTGGAA GGCGGCATTG AGTGTGGCTT GGGTTTCTTC CAATTCGGGC

251 AGACGCTCTT CGTGTTCGGC AACCTGCATC GCCCATTCCG CCAATTCGGT

301 TTGCTTTTCT TCCGCCTGCA ACTCGTTTTC TTCAAGCTGC ACGCGGATTT

351 GCTGCTGCTC CTGATGGATG CGCTGCATCT GCGCCTGCGC CGCCTGCTTG

401 TCGCGTTCGA TGCGTTGGTG CAGGTTTTGC TGATGGCGGA TTTGTTCTTC

451 CAAACGGGCA ATCTGTTCGC GCAACACGCC GCGTTTGTTG CCCAATTCGT

501 GCACCGCCTG CTGCTGCGAC TGTTCGGCAG TCTGCAAGGC GTGTACTTCG

551 TCGTTTAA
```

This corresponds to the amino acid sequence <SEQ ID 1386; ORF 507.a>:

```
a507.pep
  1 MLLLALQQGG SFLRGGGFGF VRQIQGLVFL FQTTFALFVL GNGLFGMGKL

51 LLLQRQFAAD AVCLVLLGLE GGIECGLGFF QFGQTLFVFG NLHRPFRQFG

101 LLFFRLQLVF FKLHADLLLL LMDALHLRLR RLLVAFDALV QVLLMADLFF

151 QTGNLFAQHA AFVAQFVHRL LLRLFGSLQG VYFVV*
``` m507/a507 89.7% identity in 185 aa overlap

```
                    10         20         30         40         50         60
       m507.pep     MLLLTLQQGGCFLRGGGFGFVGQVXGLVFLFQTTFALFVLGNRLFGMGKLLLLLQRQFAAD
                    ||||:|||||  ||||||||||||  |:  |||||||||||||||| ||||||  ||||||||||
       a507         MLLLALQQGGSFLRGGGFGFVRQIQGLVFLFQTTFALFVLGNGLFGMGKLLLLQRQFAAD
                    10         20         30         40         50         60

70         80         90        100        110        120
       m507.pep     AVCLVLLGLEGGVERGLGFFQFGQTLLVFGNLHRPFRQLGLFFFDLQLVFFKLHADLLLL
                    |||||||||||||:|  ||||||||||||:|||||||||||||:||:||  |||||||||||||
       a507         AVCLVLLGLEGGIECGLGFFQFGQTLFVFGNLHRPFRQFGLLFFRLQLVFFKLHADLLLL
                    70         80         90        100        110        120

130        140        150        160        170        180
       m507.pep     LMNALXLRLRCLLVAFDALVQVLLMADLFFQTGNLLAQHAALVAQFMHCLLLRLFGSLQG
                    ||:||  ||||  |||||||||||||||||||||||||||:|||||:||||:|  ||||||||||||
       a507         LMDALHLRLRRLLVAFDALVQVLLMADLFFQTGNLFAQHAAFVAQFVHRLLLRLFGSLQG
                    130        140        150        160        170        180 m507.pep     VYFVVX
                    ||||||
       a507         VYFVVX
```

The following partial DNA sequence was identified in *N. gonorrhoeae* <SEQ ID 1387>:

```
g508.seq
  1 ATGGTAGCGT TTGGCGTTGA TCAGGGCCTC CTGCTGCTGC AACAGGGCGG

51 TTTGGGTGGC GGCCTGAAGC TGCGGCAGCT TGGTTTGCAG GGTTTGTACG

101 CGGGCGTATT GCTCCCTGCC CTGTTCCTGA ATCTGCGCGA GTTTTTCCTG

151 CACGGCGATG TATTCTTCGT CCAGCGTGTG TACGGTTTCG GTCAACTCGT

201 CGAGCTTGAT GTGCTGCTCG TCGTTTTGGA ACTCGGTTTC ATAGGCGAGG

251 GCAAGCTCTT GCCGGCGTTC CTGCCAGTCC AGGGTTTGCT GTTCGAGCCG
```

-continued

```
301 GGCGATTTGC TGCCGGTAGT TTTGTTTTTG CGGGTTGAGT TTGTGGACGG

351 CGACTTCGGC AAGCCCGTAT TGGCGGTTGG CTTCCAACAG GGCAAGCTGC

401 GCCTGTTTCA GACGGCCTTG CTGCTCTTGG CGGCTGTGCG CGGTGGTTTG

451 CTGCTGGTGT TCGAGTTCGG CGGCGGCTTC CTGCAAAGTA GCGATGTCGT

501 CTGA
```

This corresponds to the amino acid sequence <SEQ ID 1388; ORF 508.ng>:

```
g508.pep
  1 MVAFGVDQGL LLLQQGGLGG GLKLRQLGLQ GLYAGVLLPA LFLNLREFFL

51 HGDVFFVQRV YGFGQLVELD VLLVVLELGF IGEGKLLPAF LPVQGLLFEP

101 GDLLPVVLFL RVEFVDGDFG KPVLAVGFQQ GKLRLFQTAL LLLAAVRGGL

151 LLVFEFGGGF LQSSDVV
```

The following partial DNA sequence was identified in *N. meningitidis* <SEQ ID 1389>:

```
m508.seq
  1 ATGGTAGCGT TTGGCGTTGA TCAGGGCTTC CTGCTGCTGC AACAAGGCGG

51 TTTGGGTGGC GGCCTGAAGC TGCGGCAGCT TGGTTTGCAG GGTTTGCACT

101 TTAGCGTATT GCTCCCTGCC CTGTTCCTGA ATCTGCGCGA GTTTCTCTTG

151 CACAACAATA TATTCTTCGT CCAAGGTCTG TACGGCTTCG CTTAATTCTT

201 CAAGCTTGAT GTGCTGCTCG TCGTTTTGGA ACTCGGTTTC ATAGGCGAGG

251 GCAAGCTCTT GCTGGCGTTC CTGCCAGTCG AGGGTTTGCT GTTCAAGCTG

301 GGCGATTTGC TGCCGGTAGT TTTGTTTTTG CTGGTTGAGT TTGTGGACGG

351 CGACTTCGGC AAGCCCGTAT TGGCGGTTGG CTTCCAACAG GGCAAGCTGC

401 GCCTGTTTCA GACGGCCTTG CTGCTCTTGG CGGCTGTGCG CGGTGGTTTG

451 CTGCTGGTGT TCGAGTTCGG CGGCGGCTTC CTGCAAGGTA ACGATGTCGT

501 CTGA
```

This corresponds to the amino acid sequence <SEQ ID 1390; ORF 508.ng>:

```
m508.pep
  1 MVAFGVDQGF LLLQQGGLGG GLKLRQLGLQ GLHFSVLLPA LFLNLREFLL

51 HNNIFFVQGL YGFAXFFKLD VLLVVLELGF IGEGKLLLAF LPVEGLLFKL

101 GDLLPVVLFL LVEFVDGDFG KPVLAVGFQQ GKLRLFQTAL LLLAAVRGGL

151 LLVFEFGGGF LQGNDVV*
```

Computer analysis of this amino acid sequence gave the following results:

Homology with a Predicted ORF from *N. gonorrhoeae*
ORF 508 shows 86.8% identity over a 167 aa overlap with a predicted ORF (ORF 508.ng) from *N. gonorrhoeae*:

```
    m508/g508
                      10        20        30        40        50        60
      m508.pep   MVAFGVDQGFLLLQQGGLGGGLKLRQLGLQGLHFSVLLPALFLNLREFLLHNNIFFVQGL
                 ||||||||||:||||||||||||||||||:  :|||||||||||:||:::||||  :
      g508       MVAFGVDQGLLLLQQGGLGGGLKLRQLGLQGLYAGVLLPALFLNLREFFLHGDVFFVQRV
                      10        20        30        40        50        60

70        80        90       100       110       120
      m508.pep   YGFAXFFKLDVLLVVLELGFIGEGKLLLAFLPVEGLLFKLGDLLPVVLFLLVEFVDGDFG
                 |||: : :|||||||||||||||||| |||||:||||: |||||||||| ||||||||||
      g508       YGFGQLVELDVLLVVLELGFIGEGKLLPAFLPVQGLLFEPGDLLPVVLFLRVEFVDGDFG
                      70        80        90       100       110       120

130       140       150       160
      m508.pep   KPVLAVGFQQGKLRLFQTALLLLAAVRGGLLLLVFEFGGGFLQGNDVV
                 ||||||||||||||||||||||||||||||||||||||||||||::|||
      g508       KPVLAVGFQQGKLRLFQTALLLLAAVRGGLLLLVFEFGGGFLQSSDVV
                     130       140       150       160
```

The following partial DNA sequence was identified in *N. meningitidis* <SEQ ID 1391>:

```
a508.seq
  1 ATGGTAGCGT TTGGCGTTGA TCAGGGCTTC CTGCTGCTGC AACAGGGCGG

51 TTTGGGTGGC GGCCTGAAGC TGCGGCAGCT TGGTTTGCAG GGTTTGTACG

101 CGGGCGTATT GTTCCCTACC CTGCTCCTGA ATCTGCGCGA GTTTCTCCTG

151 TACGACAATA TATTCTTCGT CCAAACTCTG TACGGCTTCG CTCAACTCTT

201 CGAGCTTGAT GTGCTGCTCG TCGTTTTGGA ACTCGGTTTC ATAGGCGAGG

251 GCAAGCTCTT GCTGGCGTTC CTGCCAATCG AAGGTTTGTT GTTCAAGCTG

301 GGCAATTTGC TGTTGGTAGT TTTGTTTTTG CTGGTTGAGC TTGTGGACGG

351 CGACTTCGGC AAGCCCGTAT TGGCGGTTGG CTTCCAACAG GGCAAGCTGC

401 GCCTGTTTCA GACGACCTTG CTGCTCTTGG CGGCTGTGCG CGGCGGTTTG

451 CTGCTGGTGT TCGAGTTCGG CGGCGGCTTC CTGCAAAATG GCGATGTCGT

501 CTGA
```

This corresponds to the amino acid sequence <SEQ ID 1392; ORF 508.a>:

```
a508.pep
  1 MVAFGVDQGF LLLQQGGLGG GLKLRQLGLQ GLYAGVLFPT LLLNLREFLL

51 YDNIFFVQTL YGFAQLFELD VLLVVLELGF IGEGKLLLAF LPIEGLLFKL

101 GNLLLVVLFL LVELVDGDFG KPVLAVGFQQ GKLRLFQTTL LLLAAVRGGL

151 LLVFEFGGGF LQNGDVV*
``` m508/a508 88.6% identity in 167 aa overlap

```
                      10        20        30        40        50        60
      m508.pep   MVAFGVDQGFLLLQQGGLGGGLKLRQLGLQGLHFSVLLPALFLNLREFLLHNNIFFVQGL
                 |||||||||||||||||||||||||||||||||:  :||:|:|:||||||||::||||| |
      a508       MVAFGVDQGFLLLQQGGLGGGLKLRQLGLQGLYAGVLFPTLLLNLREFLLYDNIFFVQTL
                      10        20        30        40        50        60
```

```
                        70         80         90        100        110        120
m508.pep    YGFAXFFKLDVLLVVLELGFIGEGKLLLAFLPVEGLLFKLGDLLPVVLFLLVEFVDGDFG
            ||||  : | : ||||||||||||||||||||||||||| : |||||||| : || ||||||||| : ||||||
a508        YGFAQLFELDVLLVVLELGFIGEGKLLLAFLPIEGLLFKLGNLLLVVLFLLVELVDGDFG
                        70         80         90        100        110        120

130        140        150        160
m508.pep    KPVLAVGFQQGKLRLFQTALLLLAAVRGGLLLVFEFGGGFLQGNDVVX
            ||||||||||||||||||||||| : ||||||||||||||||||||||||| : : ||||
a508        KPVLAVGFQQGKLRLFQTTLLLLAAVRGGLLLVFEFGGGFLQNGDVVX
                       130        140        150        160
```

The following partial DNA sequence was identified in *N. gonorrhoeae* <SEQ ID 1393>:

```
g509.seq
   1 atggtcgctg tatgtgatga acgggctgta cagcggacgt tggtggccca
  51 attcgcgcaa caaggcggct tgttttttgct cttcgttcag gctgttgtag
 101 tcttccaagc ctgcgtgttg gaaaagctcg gcaaccacat cggcgtgttt
 151 gcctgcgtgt tggcgcaggt cgagcggcat catgtggaag ccgaacacgg
 201 acacggaacg gatgaggtct gccaaacggc cttcggcaag caggcggctg
 251 ccgttgtcga taagggaacg ttgcaatttt ttcaaatcat cgagaaattt
 301 ttgggccgaa gcataaggct cgagaaagcc gaatttgcag cccatgccca
 351 aaccgagcga gcgcgctttg cccatagcgc gcgccataat gtaggcaatg
 401 gcgcggcggt aaggttcttc ggtgcgggcg atttcttcgt caggcgagag
 451 ggctgccagt gccattacgt cgtcgttgac tttgacgcgg cggatggaaa
 501 gcggcagttc gcggtaaagt ttgtcgagtt cgctgcggta aaaacggaac
 551 acggcatcgg cgtggcggcg gaaggcaaag cgcagggttt cgccagaaac
 601 aaacggattg ccgtcgcggt cgccgccgat ccagccgccg attttaagga
 651 tattcggaac gcggacatcg ggataggccg tctgaaagtc gtgttccatc
 701 ttgcggtaga gtttgggcag ggcttcaaaa aagctcatcg ggaagatgga
 751 cacgccgttg ttgatttcgt cgttgacgct gagtttgtgg cggcgcgttt
 801 cgctggtctg ccacaagccc agaagcacgg tgtcgatttc gcggcgcagc
 851 cgtgccagcg cgtcggcatt ggtgcagcgt tcgcgttgcg gcagcagcgc
 901 gcggatgcgg cggttgaaat tcaaaacggt ttggcgttgc acttcggtcg
 951 ggtgcgcggt caaaacggcg gtaacggacg tattgtccaa ctgccgctgc
1001 accgatttgc cgtcggcttt ccccgctttg agcctgcgga cggtttccgt
1051 caggctgcct tctgctgcgt tgtggccggc atcttcgtgg atttggcggc
1101 ggcgttcgtg gtgcacgtct tcggcgatat tcagaatctg ggcgaacagc
1151 ccgcaggcaa gcgtcagatc gtaggtctgc cgttcgtcca attgcggcaa
1201 tacttttca atcaatgccg cgctgtcgtc ggaagtggac aagagtttga
1251 ccgtttcgac aaccaacggc gaggcttctt cgtgcaggag gttgaacagg
1301 gactgtttca aaaattccgc gtccgccgcc aaagccgcgt ccttcggatt
1351 gttcaggata tgcagttgca tgattttcct ctcattgccg taaatactgt
1401 aaatgtacct caaatgccgc atccgtgcca aaccgttcac actttaacca
1451 ctcatgtccc gaaatgccgt ctgaagttga acgccgcccg acggcggcgt
1501 tacaatcgcc cgcaactgtt tttttccgaa catcatcatg accgcgaccg
```

```
-continued
1551 aacacgacaa cgacgacgca ctcctgctgc ggtacagccg ccacatcctc 1601 ttggacgaaa tcggcatcga agggcagcag aagctttccg ccgcgcatat 1651 tttggtcgtc ggctgcggcg gattgggcgc cgccgcccct gccctatctc 1701 gccgcctcgg gggtcggcac gctga
```

This corresponds to the amino acid sequence <SEQ ID 1394; ORF 509.ng>:

```
g509.pep
  1 MVAVCDERAV QRTLVAQFAQ QGGLFLLFVQ AVVVFQACVL EKLGNHIGVF

51 ACVLAQVERH HVEAEHGHGT DEVCQTAFGK QAAAVVDKGT LQFFQIIEKF

101 LGRSIRLEKA EFAAHAQTER ARFAHSARHN VGNGAAVRFF GAGDFFVRRE

151 GCQCHYVVVD FDAADGKRQF AVKFVEFAAV KTEHGIGVAA EGKAQGFARN

201 KRIAVAVAAD PAADFKDIRN ADIGIGRLKV VFHLAVEFGQ GFKKAHREDG

251 HAVVDFVVDA EFVAARFAGL PQAQKHGVDF AAQPCQRVGI GAAFALRQQR

301 ADAAVEIQNG LALHFGRVRG QNGGNGRIVQ LPLHRFAVGF PRFEPADGFR

351 QAAFCCVVAG IFVDLAAAFV VHVFGDIQNL GEQPAGKRQI VGLPFVQLRQ

401 YFFNQCRAVV GSGQEFDRFD NQRRGFFVQE VEQGLFQKFR VRRQSRVLRI

451 VQDMQLHDFP LIAVNTVNVP QMPHPCQTVH TLTTHVPKCR LKLNAARRRR

501 YNRPQLFFSE HHHDRDRTRQ RRRTPAAVQP PHPLGRNRHR RAAEAFRRAY

551 FGRRLRRIGR RRPCPISPPR GSAR*
```

The following partial DNA sequence was identified in *N. meningitidis* <SEQ ID 1395>:

```
m509.seq
  1 ATGGTCGCTG TATGTGATAA ACGGGCTGTA CAGAGGACGT TGATGGCTCA

51 ATTCGCGCAA CAGGGCGGTT TGTTTTTGCT CTTCGTTCAG GCGGTTGTAG

101 TCTTCCAAGC CTGCGTGTTG GAAAAGCTCG GCAACCACAT CGGCGTGTTT

151 GCCTGCGTGT TGGCGCAAGT CGAGCGGCAT CATGTGAAAG CCGAACACGG

201 ATACGGAACG GATGAGGTCT GCCAAACGGC CTTCGGCAAG CAGACGGCTG

251 CCGTTGTCGA TAAGGGAACG TTGCAATTTT TTCAAATCAT CCAGAAACTC

301 TTGTGCCGAA GCATAAGGCT CGAGAAAGCC GAATTTGCAG CCCATACCCA

351 AACCGAGCGC GCGCGCTTTG CCCATAGCGC GCGCCATAAT GTAGGCGATG

401 GCGCGGCGGT AGGGTTCTTC GGCGCGGGCG ATTTCTTCGT CGGGCGATTT

451 GTCGGACAAC GCCGTTACAT CGCCGTTGAC TTTGACGCGG CGGATGGAGA

501 GCGGCAGTTC GCGGTAGAGT TTGTCGAGTT CGCCGCGATA GAAGCGGAAC

551 ACGGCATCGG CGTGGCGGCG GAAGGCAAAG CGCAGGGTTT CGGCAGAAAC

601 AAACGGATTG CCGTCGCGGT CGCCGCCGAT CCAGCCGCCG ATTTTGAGGA

651 TGTCCGGAAC GCGGACGCCG GGATAGGCCG TCTGAAAGTC GTGTTCCATC

701 TTGCGGTAGA GCTTGGGCAG GGCTTCGAAA AAGCTCATCG GAAGATGGA

751 CACGCCGTTG TTGATTTCGT CGTTGACGCT GAGTTTGTGG CGGCGCGTTT

801 CGCTGGTCTG CCACAAGCCC AGCAGGATAG TGTCGATTtC GCgGCGCAGC

851 CGTGCCAGCG CGTCGGCATT GGTGCAGCGT TCgCGTTGCG GCAACAGTGC
```

```
-continued
 901 GCGGATGCGG CGGTTGAAGC TTAAGACGGT TTGGCGTTGC ACTTCGGTCG

951 GGTGCGCGGT CAAAACGGCG GTAACGGACG TATTGTCCAA CTGCCGCTGC

1001 ACCGATTTGC CGTCGGCTTT CCCCGCTTTG AGCCTGCGGA CGGTTTCCGT

1051 CAGGCTGCCT TCCGCGCCGC CGCGTCCGGC TTCTTCGTGG ATTTGGCGGC

1101 GGCGTTCGTG GTGCACGTCT TCGGCGATGT TCAAAATCTG GGCGAACAGG

1151 CCGCAGGCCA AGGTTAAATC GTGGGTTTGT TGTTCGTCCA ATTGCGGCAA

1201 TACTTTTTCA ATCAATGCCG CGCTGTCGTC GGAAGTGGAC AAGAGTTTGA

1251 CTGTTTCGAC AACCAACGGC GAGGCTTCTT CGTGCAGGAG GTTGAACAGG

1301 GATTGTTTCA GAAATTCCGC GTCCGCCGCC AAAGCCGCGT CCTTTGGATT

1351 GTTCAGAATA TGCAGTTGCA TGATTTTTCT CTCTCGTCTG CCGTAAATAT

1401 TGTAAATGTA CCCCAAATGC CGCATCCGTG CCAAACCGTT CACACTTTAA

1451 CCGCCCGTGT CCCGAAATGC CGTCTGAAGT TGAACGCCGC CCGACGGCAG

1501 CGTTACAATC GCCCGCAACT GTTTTtTTCC GAACATCATC ATGACCACGA

1551 CCGAACACGA CAACGACGAT GCATTCCTGC TGCGGTACAG CCGCCACATC

1601 CTCTTGGACG AAATCGGCAT CGAAGGGCAG CAGAAACTTT CCGCCGCGCA

1651 TATTTTGGTC GTCGGCTGCG GCGGTTTGGG TGCCGCCGCA CT.GCCCTAC

1701 CTTGCCGCTT CGGGTGTCGG CACGCTGA
```

This corresponds to the amino acid sequence <SEQ ID 1396; ORF 509>:

```
m509.pep
  1 MVAVCDKRAV QRTLMAQFAQ QGGLFLLFVQ AVVVFQACVL EKLGNHIGVF

51 ACVLAQVERH HVKAEHGYGT DEVCQTAFGK QTAAVVDKGT LQFFQIIQKL

101 LCRSIRLEKA EFAAHTQTER ARFAHSARHN VGDGAAVGFF GAGDFFVGRF

151 VGQRRYIAVD FDAADGERQF AVEFVEFAAI EAEHGIGVAA EGKAQGFGRN

201 KRIAVAVAAD PAADFEDVRN ADAGIGRLKV VFHLAVELGQ GFEKAHREDG

251 HAVVDFVVDA EFVAARFAGL PQAQQDSVDF AAQPCQRVGI GAAFALRQQC

301 ADAAVEAXDG LALHFGRVRG QNGGNGRIVQ LPLHRFAVGF PRFEPADGFR

351 QAAFRAAASG FFVDLAAAFV VHVFGDVQNL GEQAAGQGXI VGLLFVQLRQ

401 YFFNQCRAVV GSGQEFDCFD NQRRGFFVQE VEQGLFQKFR VRRQSRVLWI

451 VQNMQLHDFS LSSAVNIVNV PQMPHPCQTV HTLTARVPKC RLKLNAARRQ

501 RYNRPQLFFS EHHHDHDRTR QRRCIPAAVQ PPHPLGRNRH RRAAETFRRA

551 YFGRRLRRFG CRRTXPTLPL RVSAR*
```

Computer analysis of this amino acid sequence gave the following results:
Homology with a Predicted ORF from *N. gonorrhoeae*
ORF 509 shows 87.8% identity over a 575 aa overlap with a predicted ORF (ORF 509.ng) from *N. gonorrhoeae*:

```
m509/g509
                        10         20         30         40         50         60
        m509.pep   MVAVCDKRAVQRTLMAQFAQQGGLFLLFVQAVVVFQACVLEKLGNHIGVFACVLAQVERH
                   ||||||:||||||||:||||||||||||||||||||||||||||||||||||||||||||
        g509       MVAVCDERAVQRTLVAQFAQQGGLFLLFVQAVVVFQACVLEKLGNHIGVFACVLAQVERH
                        10         20         30         40         50         60
```

-continued

```
                        70        80        90       100       110       120
m509.pep        HVKAEHGYGTDEVCQTAFGKQTAAVVDKGTLQFFQIIQKLLCRSIRLEKAEFAAHTQTER
                ||:||||:|||||||||||||:|||||||||||||||:|:| |||||||||||||:|||
g509            HVEAEHGHGTDEVCQTAFGKQAAAVVDKGTLQFFQIIEKFLGRSIRLEKAEFAAHAQTER
                        70        80        90       100       110       120

130       140       150       160       170       180
m509.pep        ARFAHSARHNVGDGAAVGFFGAGDFFVGRFVGQRRYIAVDFDAADGERQFAVEFVEFAAI
                ||||||||||||:|||| ||||||||| |   | :|::||||||||:|||||:||||||:
g509            ARFAHSARHNVGNGAAVRFFGAGDFFVRREGCQCHYVVVDFDAADGKRQFAVKFVEFAAV
                       130       140       150       160       170       180

190       200       210       220       230       240
m509.pep        EAEHGIGVAAEGKAQGFGRNKRIAVAVAADPAADFEDVRNADAGIGRLKVVFHLAVELGQ
                ::|||||||||||||||:|||||||||||||||||:|:|||| ||||||||||||||:||
g509            KTEHGIGVAAEGKAQGFARNKRIAVAVAADPAADFKDIRNADIGIGRLKVVFHLAVEFGQ
                       190       200       210       220       230       240

250       260       270       280       290       300
m509.pep        GFEKAHREDGHAVVDFVVDAEFVAARFAGLPQAQQDSVDFAAQPCQRVGIGAAFALRQQC
                ||:|||||||||||||||||||||||||||||||: :||||||||||||||||||||||
g509            GFKKAHREDGHAVVDFVVDAEFVAARFAGLPQAQKHGVDFAAQPCQRVGIGAAFALRQQR
                       250       260       270       280       290       300

310       320       330       340       350       360
m509.pep        ADAAVEAXDGLALHFGRVRGQNGGNGRIVQLPLHRFAVGFPRFEPADGFRQAAFRAAASG
                ||||||  :|||||||||||||||||||||||||||||||||||||||||||||  :::|
g509            ADAAVEIQNGLALHFGRVRGQNGGNGRIVQLPLHRFAVGFPRFEPADGFRQAAFCCVVAG
                       310       320       330       340       350       360

370       380       390       400       410       420
m509.pep        FFVDLAAAFVVHVFGDVQNLGEQAAGQGXIVGLLFVQLRQYFFNQCRAVVGSGQEFDCFD
                :|||||||||||||||:|||||| ||:  |||| ||||||||||||||||||||||| ||
g509            IFVDLAAAFVVHVFGDIQNLGEQPAGKRQIVGLPFVQLRQYFFNQCRAVVGSGQEFDRFD
                       370       380       390       400       410       420

430       440       450       460       470       480
m509.pep        NQRRGFFVQEVEQGLFQKFRVRRQSRVLWIVQNMQLHDFSLSSAVNIVNVPQMPHPCQTV
                |||||||||||||||||||||||||||| |||:|||||| |  ||| |||||||||||||
g509            NQRRGFFVQEVEQGLFQKFRVRRQSRVLRIVQDMQLHDFPLI-AVNTVNVPQMPHPCQTV
                       430       440       450       460       470

490       500       510       520       530       540
m509.pep        HTLTARVPKCRLKLNAARRQRYNRPQLFFSEHHHDHDRTRQRRCIPAAVQPPHPLGRNRH
                ||||::|||||||||||||:|||||||||||||||:|||||||  |||||||||||||||
g509            HTLTTHVPKCRLKLNAARRRRYNRPQLFFSEHHHDRDRTRQRRRTPAAVQPPHPLGRNRH
              480       490       500       510       520       530

550       560       570
m509.pep        RRAAETFRRAYFGRRLRRFGCRRTCPTLPLRVSAR
                |||||:||||||||||||:| || ||  | | |||
g509            RRAAEAFRRAYFGRRLRRIGRRRPCPISPPRGSAR
              540       550       560       570
```

The following partial DNA sequence was identified in *N. meningitidis* <SEQ ID 1397>:

```
a509.seq
   1  ATGGTCGCTG TATGTGATGA ACGGACTGTA CAGTGGACGT TGATGGCTCA

51  ATTCGCGCAA CAGGGCGGCT TGTTTTTGCT CTTCGTTGAG GCTGTTGTAG

101  TCTTCCAAGC CTGCGTGTTG GAAAAGCTCG GCAACCACAT CGGCGTGTTT

151  GCCTGCGTGT TGGCGCAGGT CGAGCGGCAT CATGTGGAAG CCGAACACGG

201  ATACGGAACG GATGAGGTCT GCCAAACGGC CTTCGGCAAG CAGGCGGCTG

251  CCGTTGTCGA TAAGGGAATG TTGCAATTTT TTCAAATCAT CGAGAAATTC

301  TTGTGCCGAA GCATAAGGCT CGAGAAAGCC GAATTTGCAG CCCATACCCA

351  AACCGAGCGC GCGCGCTTTG CCCATAGCGC GCGCCATAAT GTAGGCAATG

401  GCGCGACGGT AGGGTTCTTC GGCGCGGGCG GTTTCTTCGT CGGGCGATTT

451  GTCGGACAAC GCCATCACAT CGCCGTTGAC TTTGACGCGG CGGATGGAGA
```

```
 501 GCGGCAGTTC GCGGTAGAGT TTGTCGAGTT CGCCACGGTA AAAACGGAAC

551 ACGGCATCGG CGTGGCGGCG GAAGGCAAAA CGCAAGGTTT CGGCAGAAAC

601 GAACGGATTG CCGTCGCGGT CGCCGCCGAT CCAGCCGCCG ATTTTGAGGA

651 TGTCCGGAAC GCGGACATCG GGATAGGCCG TCTGAAAGTC GTGTTCCATC

701 TTGCGGTAGA GCTTGGGCAG GGCTTCAAAA AAGCTCATCG GAAAGATGGA

751 CACGCCGTTG TTGATTTCGT CGTTGACGCT GAGTTTGTGG CGGCGCGTTT

801 CGCTGGTCTG CCACAAGCCC AGCAGGATAG TGTCGATTTC GCGGCGCAGC

851 CGTGCCAGCG CGTCGGCATT GGTACAGCGT TCGCGTTGCG GCAGCAGCGC

901 GCGGATGCGG CGGTTGAAAT TCAAGACGGT CTGGCGTTGC ACTTCGGTCG

951 GGTGCGCGGT CAAAACGGCG GTAACGGACG TATTGTCCAA CTGCCGCTGC

1001 ACCGATTTGC CGTCGGCTTT CCCCGCTTTG AGCCTGCGGA CGGTTTCCGT

1051 CAGGCTGCCT TCCGCGCCGC CGCGTCCGGC TTCTTCGTGG ATTTGGCGGC

1101 GGCGTTCGTG GTGCACGTCT TCGGCGATGT TCAAAATCTG GGCGAACAGG

1151 CCGCAGGCCA AGGTTAAATC GTGGGTTTGT TGTTCGTCCA ATTGCGGCAA

1201 TACTTTTTCA ATCAATGCCG CGCTGTCGTC GGAAGTGGAC AAGAGTTTGA

1251 CCGTTTCGAC AACCAACGGC GAGGCTTCTT CGTGCAGGAG GTTGAACAGG

1301 GATTGTTTCA GAAATTCCGC GTCCGCCGCC AAAGCCGCGT CCTTTGGATT

1351 GTTCAGAATA TGCAGTTGCA TGATTTTTCT CTCATTGCCG TAAATACTGT

1401 AAATGTACCT CAAATGCCGC ATCCGTGCCA AACCGTTCAC ACTTTAACCG

1451 CCCGTGTCCC GAAATGCCGT CTGAAGTTGA ACGCCGCCCG ACGGCAGCGT

1501 TACAATCGCC CACAACTGTT TTT.TCCGAA CATCATCATG ACCACGACCG

1551 AACACGACAA CGACGATGCA TTCCTGCTGC GGTACAGCCG CCACATCCTC

1601 TTGGACGAAA TTGGCATCGA AGGGCAGCAG AAACTTTCCG CCGCGCATAT

1651 TTTGGTCGTC GGCTGCGGCG GTTTGGGTGC CGCCGCCGAT GCCCTATCTC

1701 GCCGCTTCCG GCATCGGCAC GCTGA
```

This corresponds to the amino acid sequence <SEQ ID 1398; ORF 509.a>:

```
a509.pep
  1 MVAVCDERTV QWTLMAQFAQ QGGLFLLFVE AVVVFQACVL EKLGNHIGVF

51 ACVLAQVERH HVEAEHGYGT DEVCQTAFGK QAAAVVDKGM LQFFQIIEKF

101 LCRSIRLEKA EFAAHTQTER ARFAHSARHN VGNGATVGFF GAGGFFVGRF

151 VGQRHHIAVD FDAADGERQF AVEFVEFATV KTEHGIGVAA EGKTQGFGRN

201 ERIAVAVAAD PAADFEDVRN ADIGIGRLKV VFHLAVELGQ GFKKAHRKDG

251 HAVVDFVVDA EFVAARFAGL PQAQQDSVDF AAQPCQRVGI GTAFALRQQR

301 ADAAVEIQDG LALHFGRVRG QNGGNGRIVQ LPLHRFAVGF PRFEPADGFR

351 QAAFRAAASG FFVDLAAAFV VHVFGDVQNL GEQAAGQG*I VGLLFVQLRQ

401 YFFNQCRAVV GSGQEFDRFD NQRRGFFVQE VEQGLFQKFR VRRQSRVLWI

451 VQNMQLHDFS LIAVNTVNVP QMPHPCQTVH TLTARVPKCR LKLNAARRQR

501 YNRPQLFXSE HHHDHDRTRQ RRCIPAAVQP PHPLGRNWHR RAAETFRRAY

551 FGRRLRRFGC RXPCPISPLP ASAR*
``` m509/a509 93.0% identity in 575 aa overlap

```
              10        20        30        40        50        60
m509.pep  MVAVCDKRAVQRTLMAQFAQQGGLFLLFVQAVVVFQACVLEKLGNHIGVFACVLAQVERH
          ||||||:|| |||||||||||||||||:|||||||||||||||||||||||||||||||
a509      MVAVCDERTVQWTLMAQFAQQGGLFLLFVEAVVVFQACVLEKLGNHIGVFACVLAQVERH
              10        20        30        40        50        60

70        80        90       100       110       120
m509.pep  HVKAEHGYGTDEVCQTAFGKQTAAVVDKGTLQFFQIIQKLLCRSIRLEKAEFAAHTQTER
          ||:|||||||||||||||||||:|||||||:|||||||:||:|||||||||||||||||
a509      HVEAEHGYGTDEVCQTAFGKQAAAVVDKGMLQFFQIIEKFLCRSIRLEKAEFAAHTQTER
              70        80        90       100       110       120

130       140       150       160       170       180
m509.pep  ARFAHSARHNVGDGAAVGFFGAGDPFFVGRFVGQRRYIAVDFDAADGERQFAVEFVEFAAI
          |||||||||||:|:||||||||:|||||||||||::|||||||||||||||||||||::
a509      ARFAHSARHNVGNGATVGFFGAGGFFVGRFVGQRHHIAVDFDAADGERQFAVEFVEFATV
             130       140       150       160       170       180

190       200       210       220       230       240
m509.pep  EAEHGIGVAAEGKAQGFGRNKRIAVAVAADPAADFEDVRNADAGIGRLKVVFHLAVELGQ
          ::|||||||||||:|||||||:||||||||||||||||||||:|||||||||||||||
a509      KTEHGIGVAAEGKTQGFGRNERIAVAVAADPAADFEDVRNADIGIGRLKVVFHLAVELGQ
             190       200       210       220       230       240

250       260       270       280       290       300
m509.pep  GFEKAHREDGHAVVDFVVDAEFVAARFAGLPQAQQDSVDFAAQPCQRVGIGAAFALRQQC
          ||:||||:||||||||||||||||||||||||||||||||||||||||||:||||||| 
a509      GFKKAHRKDGHAVVDFVVDAEFVAARFAGLPQAQQDSVDFAAQPCQRVGITAFALRQQR
             250       260       270       280       290       300

310       320       330       340       350       360
m509.pep  ADAAVEAXDGLALHFGRVRGQNGGNGRIVQLPLHRFAVGFPRFEPADGFRQAAFRAAASG
          ||||||  |||||||||||||||||||||||||||||||||||||||||||||||||||
a509      ADAAVEIQDGLALHFGRVRGQNGGNGRIVQLPLHRFAVGFPRFEPADGFRQAAFRAAASG
             310       320       330       340       350       360

370       380       390       400       410       420
m509.pep  FFVDLAAAFVVHVFGDVQNLGEQAAGQGXIVGLLFVQLRQYFFNQCRAVVGSGQEFDCFD
          |||||||||||||||||||||||||||||||||||||||||||||||||||||||| ||
a509      FFVDLAAAFVVHVFGDVQNLGEQAAGQGXIVGLLFVQLRQYFFNQCRAVVGSGQEFDRFD
             370       380       390       400       410       420

430       440       450       460       470       480
m509.pep  NQRRGFFVQEVEQGLFQKFRVRRQSRVLWIVQNMQLHDFSLSSAVNIVNVPQMPHPCQTV
          |||||||||||||||||||||||||||||||||||||||||| |||||||||||||||
a509      NQRRGFFVQEVEQGLFQKFRVRRQSRVLWIVQNMQLHDFSLI-AVNTVNVPQMPHPCQTV
             430       440       450       460       470

490       500       510       520       530       540
m509.pep  HTLTARVPKCRLKLNAARRQRYNRPQLFFSEHHHDHDRTQRRCIPAAVQPPHPLGRNRH
          ||||||||||||||||||||||||||||:|||||||||||||||||||||||||||| 
a509      HTLTARVPKCRLKLNAARRQRYNRPQLFXSEHHHDHDRTQRRCIPAAVQPPHPLGRNWH
                480       490       500       510       520       530

550       560       570
m509.pep  RRAAETFRRAYFGRRLRRFGCRRTXPTLPLRVSARX
          |||||||||||||||||||||||  |  ||:||||
a509      RRAAETFRRAYFGRRLRRFGCRXPCPISPLPASARX
             540       550       560       570
```

45

The following partial DNA sequence was identified in *N. gonorrhoeae* <SEQ ID 1399>:

```
g510.seq
  1 atgccttcgc ggacaccgca gggaaaaagg ggttattcct gccccaagcg 51 ggatagtgcc ttttggcagg cgttgtccat atcggttatt ttacgcgcaa 101 aatcgccgat tgccaaatcg ccgccgttca gggaggtttt caataggtcg 151 tggacgacgt tgagcgcggc cataatgacg atttttttcgc tgtccgcgac 201 gcggccgcct tcgcggatgg cttcggcttt gccgttgagc attccgactg 251 cctgcaacag tgtgtctttt tcttctgccg gcgtgttgac agtcagccgg 301 ggcgtgcatg acttcgatgt agacttgttc gatgttcatc ctttaatcct 351 tattgctgcg tttcctgccg ttgggggagg cgcgctgcca gtgcgctga
```

This corresponds to the amino acid sequence <SEQ ID 1400; ORF 510.ng>:

```
g510.pep
  1 MPSRTPQGKR GYSCPKRDSA FWQALSISVI LRAKSPIAKS PPFREVFNRS

51 WTTLSAAIMT IFSLSATRPP SRMASALPLS IPTACNSVSF SSAGVLTVSR

101 GVHDFDVDLF DVHPLILIAA FPAVGGGALP VR*
```

The following partial DNA sequence was identified in *N. meningitidis* <SEQ ID 1401>:

```
m510.seq
  1 ATGCCTTCGC GGACACCGCA GGGnAAAAGG GGTTATTCCT GCGCCAAGCG

51 GGATAGTGCT TTTTGGCAGG CGTTGTCCAT ATCGGCTATT TTACGCGCAA

101 AATCGCCGAT TGCCAAATCG CCGCCGTTCA GGGAGGTTTT CAACAGGTCG

151 TGGACGACGT TGAGCGCGGC CATAATGACG ATTTTTTCGC TGTCCGCGAC

201 GCGTCCGCCT TCGCGGATGG CTTCGGCTTT GCCGTTGAGC ATTCCGACTG

251 CCTGCAACAG TGTGTCTTTT TCTTCTGCCG GCGTGTTGAC GGTCAGCCGG

301 GGCGTGCAwG ACTTCsAtGT GGACTTGTTC GATGTTCATC CTTTAATCCT

351 TATTGCTGCG TTTCCTGCCA TTGGGGGAGG CGCGCTGCCA GTGCGCTGA
```

This corresponds to the amino acid sequence <SEQ ID 1402; ORF 510>:

```
m510.pep
  1 MPSRTPQGKR GYSCAKRDSA FWQALSISAI LRAKSPIAKS PPFREVFNRS

51 WTTLSAAIMT IFSLSATRPP SRMASALPLS IPTACNSVSF SSAGVLTVSR

101 GVXDFXVDLF DVHPLILIAA FPAIGGGALP VR*
```

Computer analysis of this amino acid sequence gave the following results:
Homology with a Predicted ORF from *N. gonorrhoeae*
ORF 510 shows 96.2% identity over a 132 aa overlap with a predicted ORF (ORF 510.ng) from *N. gonorrhoeae*:

```
m510/g510
                   10         20         30         40         50         60
    m510.pep  MPSRTPQGKRGYSCAKRDSAFWQALSISAILRAKSPIAKSPPFREVFNRSWTTLSAAIMT
              ||||||||||||||| |||||||||||||:||||||||||||||||||||||||||||||
    g510      MPSRTPQGKRGYSCPKRDSAFWQALSISVILRAKSPIAKSPPFREVFNRSWTTLSAAIMT
                   10         20         30         40         50         60

70         80         90        100        110        120
    m510.pep  IFSLSATRPPSRMASALPLSIPTACNSVSFSSAGVLTVSRGVXDFXVDLFDVHPLILIAA
              |||||||||||||||||||||||||||||||||||||||||| || ||||||||||||||
    g510      IFSLSATRPPSRMASALPLSIPTACNSVSFSSAGVLTVSRGVHDFDVDLFDVHPLILIAA
                   70         80         90        100        110        120

130
    m510.pep  FPAIGGGALPVRX
              |||:|||||||||
    g510      FPAVGGGALPVRX
                  130
```

The following partial DNA sequence was identified in *N. meningitidis* <SEQ ID 1403>:

```
a510.seq
  1 ATGCCTTCGC GGACACCGCA GGGAAAAAGG GGTTATTCCT GCGCCAAGCG

51 GGATAGTGCT TTTTGGCAGG CGTTGTCCAT ATCGGCTATT TTACGCGCAA
```

-continued

```
101 AATCGCCGAT TGCCAAATCG CCGCCGTTCA GGGAGGTTTT CAACAGGTCG

151 TGGACGACGT TGAGCGCGGC CATAATGACG ATTTTTTCGC TGTCCGCGAC

201 GCGTCCGCCT TCGCGGATGG CTTCGGCTTT GCCGTTGAGC ATTCCGACTG

251 CCTGCAACAG TGTGTCTTTT TCTTCTGCCG GCGTGTTGAC GGTCAGCCGG

301 G.CGTGCATG ACTTCGATGT GGACTTGTTC GATGTTCATC CTTTAATCCT

351 TATTGCTGCG TTTCCTGCCG TTGGGGGAGG CGCGCTGCCA GTGCGCTGA
```

This corresponds to the amino acid sequence <SEQ ID 1404; ORF 510.a>:

```
a510.pep
  1 MPSRTPQGKR GYSCAKRDSA FWQALSISAI LRAKSPIAKS PPFREVFNRS

51 WTTLSAAIMT IFSLSATRPP SRMASALPLS IPTACNSVSF SSAGVLTVSR

101 XVHDFDVDLF DVHPLILIAA FPAVGGGALP VR*
``` m510/a510 97.0% identity in 132 aa overlap

```
                  10         20         30         40         50         60
   m510.pep  MPSRTPQGKRGYSCAKRDSAFWQALSISAILRAKSPIAKSPPFREVFNRSWTTLSAAIMT
             ||||||||||||||||||||||||||||||||||||||||||||||||||||||||||||
   a510      MPSRTPQGKRGYSCAKRDSAFWQALSISAILRAKSPIAKSPPFREVFNRSWTTLSAAIMT
                  10         20         30         40         50         60
                  70         80         90        100        110        120
   m510.pep  IFSLSATRPPSRMASALPLSIPTACNSVSFSSAGVLTVSRGVXDFXVDLFDVHPLILIAA
             |||||||||||||||||||||||||||||||||||||||  | ||  |||||||||||||
   a510      IFSLSATRPPSRMASALPLSIPTACNSVSFSSAGVLTVSRXVHDFDVDLFDVHPLILIAA
                  70         80         90        100        110        120
                 130
   m510.pep  FPAIGGGALPVRX
             |||:|||||||||
   a510      FPAVGGGALPVRX
                 130
```

The following partial DNA sequence was identified in *N. gonorrhoeae* <SEQ ID 1405>:

```
g512.seq
  1 atgaaagtgc ttgttttagg tgcgggtgtt gccggcgtat cctccgtgtg 51 gtatctggca gaggccggac atgaagtaac ggtcatcgac cgcaccgagg 101 gtgtggcgat ggaaaccagt tttgccaatg caggccagct ttcttacggc 151 tataccacgc cttgggctgc acccggtatt ccgaccaaag cactgaaacg 201 gctgtttaaa agccatccgc ctttactgtt ccgccctgac ggcggcctgt 251 atcaaatcga atggctgtgg cggatgctgc aaaactgcac ggcaacgcgc 301 tatcaaatca ataaagagcg catggtcagg atttccgaat acagccgtga 351 aatgttccgc cgttttgaag cgcaaaccga catgaatttt gagggacgca 401 aaaagggac gttgcagatt ttccgccaaa ccgaagaagt cgaagcggca 451 aaacaagaca ttgccgtttt ggaacgctac ggcgtgccgt accgccgtct 501 gaagcccgaa gaatgcgcag aattcgagcc tgcgctggca cgcgttaccg 551 ccaaaattgt cggcggtctg cacctgcctg cggatgcgac cggcgactgc 601 cgcctcttca ccgaaaacct gtacaaattg tgtcaagaga aggggggtacg 651 gttctacttc aaccaaacca tcagccgcat cgaccacaac gggctgcgca
```

-continued
```
701 tcaaagccgt tgaaacgaaa cagggcggtt tgaaacagat gccgttgtct 751 gcgcgctcgg ctgcttcagc aggactgtgt tggcgcagtt ggatctcaat 801 ctgcccattt atcccgtcaa aggctattcc ttga
```

This corresponds to the amino acid sequence <SEQ ID 1406; ORF 512.ng>:

```
g512.pep
  1 MKVLVLGAGV AGVSSVWYLA EAGHEVTVID RTEGVAMETS FANAGQLSYG

51 YTTPWAAPGI PTKALKRLFK SHPPLLFRPD GGLYQIEWLW RMLQNCTATR

101 YQINKERMVR ISEYSREMFR RFEAQTDMNF EGRKKGTLQI FRQTEEVEAA

151 KQDIAVLERY GVPYRRLKPE ECAEFEPALA RVTAKIVGGL HLPADATGDC

201 RLFTENLYKL CQEKGVRFYF NQTISRIDHN GLRIKAVETK QGGLKQMPLS

251 ARSAASAGLC WRSWISICPF IPSKAIP*
```

The following partial DNA sequence was identified in *N. meningitidis* <SEQ ID 1407>:

```
m512.seq (partial)
  1 ..GTTTTGGAAC GCTACGGCGT GCCGTACCGC CGTCTGAAAC CCGAAGAATG

51   TGCAGAATTT GAGCCTGCGC TGGCACGCGT TACCGCCAAA ATTGCCGGCG

101   GCCTGCACCT GCCTGCAGAT GCGACCGGCG ACTggCGCCT CTTCACTGAA

151   AACCTATACA AATTGTGTCA GGAAAAGGGC GTACGGTTTC ATTTCAACCA

201   AAACATCAGC CGCATCGACC ACAACGGGCT GCGCATCAAA ACCGTTGAAA

251   CCAAACAGGG CGGTTTGAAG CAGATGCCGT TGTCTGCGCG CTCGGTTGCT

301   TCAGCAGGAC GGTTTTGGCG CAGTTGGATC TCAATCTGCC CATTTATCCC

351   GTCAAAGGCT ATTCCTTGA
```

This corresponds to the amino acid sequence <SEQ ID 1408; ORF 512>:

```
m512.pep (partial)
  1 ..VLERYGVPYR RLKPEECAEF EPALARVTAK IAGGLHLPAD ATGDWRLFTE

51   NLYKLCQEKG VRFHFNQNIS RIDHNGLRIK TVETKQGGLK QMPLSARSVA

101   SAGRFWRSWI SICPFIPSKA IP*
```

Computer analysis of this amino acid sequence gave the following results:
Homology with a Predicted ORF from *N. gonorrhoeae*
ORF 512 shows 93.4% identity over a 122 aa overlap with a predicted ORF (ORF 512.ng) from *N. gonorrhoeae*:

```
    m512/g512
                                            10        20        30
       m512.pep                     VLERYGVPYRRLKPEECAEFEPALARVTAK
                                    ||||||||||||||||||||||||||||||
          g512   TDMNFEGRKKGTLQIFRQTEEVEAAKQDIAVLERYGVPYRRLKPEECAEFEPALARVTAK
                      130       140       150       160       170       180

40        50        60        70        80        90
       m512.pep   IAGGLHLPADATGDWRLFTENLYKLCQEKGVRFHFNQNISRIDHNGLRIKTVETKQGGLK
                  |:||||||||| ||||||||||||||||||||:|||:||||||||||||:||||||||
          g512   IVGGLHLPADATGDCRLFTENLYKLCQEKGVRFYFNQTISRIDHNGLRIKAVETKQGGLK
                      190       200       210       220       230       240
```

```
                        100        110        120
m512.pep   QMPLSARSVASAGRFWRSWISICPFIPSKAIP
           ||||||||:||||  ||||||||||||||||
g512       QMPLSARSAASAGLCWRSWISICPFIPSKAIP
               250        260        270
```

The following partial DNA sequence was identified in *N. meningitidis* <SEQ ID 1409>:

```
a512.seq
   1  ATGAAAGTGC TTGTTTTAGG TGCTGGTGTT GCCGGCGTAT CTTCCGCGTG

51  GTATCTGGCA GAGGCAGGAC ATGAAGTAAC GGTCATCGAC CGCGCCGAGG

101  GCGTGGCGAT GGAAACCAGT TTTGCCAACG CAGGCCAGCT TTCTTACGGC

151  TATACCACGC CTTGGGCTGC ACCCGGTATT CCGACCAAAG CACTGAAATG

201  GCTGTTTAAA AGCCATCCGC CTTTGCTGTT TCGCCCCGAC GGCAGCCTGT

251  ATCAAATCGA ATGGCTGTGG CAGATGCTGC AACACTGCAC GGCAGCGCGC

301  TATCAAATCA ATAAAGAGCG CATGGTCAGG ATGTCCGAAT ACAGCCGTGA

351  AATGTTCCGC CGTTTTGAAG CGCAAACCGG CATGAATTTT GAGGGACGCA

401  AAAAAGGGAC GTTGCAGATT TTCCGCCAAA CCAAAGAAGT CGAAGCGGCA

451  AAACAAGACA TTGCCGTTTT GGAACGCTAC GGCGTGCCGT ACCGCCGTCT

501  GAAGCCCGAA GAATGCGCAG AATTCGAGCC TGCGCTGGCA CGCGTTACCG

551  CCAAAATTGC CGGCGGCCTG CACCTGCCCG CAGACGCGAC CGGCGACTGC

601  CGCCTCTTCA CTGAAAACCT GTACAAATTG TGTCAGGAAA AGGGCGTACG

651  GTTTCATTTC AACCAAACCA TCAGCCGCAT CGACCACAAC GGGCTGCGCA

701  TCAAAACCGT TGAAACGAAA CAGGGCGGTT TGAAGCAGAT GCCGTTGTCT

751  GCGCGCTCGG CTGCTTCAGC AGGACGGTTT TGGCGCAAGT GGATCTCAAT

801  CTGCCGATTT ATCCCGTCAA AGGCTATTCC TTGA
```

This corresponds to the amino acid sequence <SEQ ID 1410; ORF 512.a>:

```
a512.pep
   1  MKVLVLGAGV AGVSSAWYLA EAGHEVTVID RAEGVAMETS FANAGQLSYG

51  YTTPWAAPGI PTKALKWLFK SHPPLLFRPD GSLYQIEWLW QMLQHCTAAR

101  YQINKERMVR MSEYSREMFR RFEAQTGMNF EGRKKGTLQI FRQTKEVEAA

151  KQDIAVLERY GVPYRRLKPE ECAEFEPALA RVTAKIAGGL HLPADATGDC

201  RLFTENLYKL CQEKGVRFHF NQTISRIDHN GLRIKTVETK QGGLKQMPLS

251  ARSAASAGRF WRKWISICRF IPSKAIP*
``` m512/a512 95.9% identity in 122 aa overlap

```
                                    10         20         30
m512.pep                      VLERYGVPYRRLKPEECAEFEPALARVTAK
                              |||||||||||||||||||||||||||||
a512       TGMNFEGRKKGTLQIFRQTEEVEAAKQDIAVLERYGVPYRRLKPEECAEFEPALARVTAK
              130        140        150        160        170        180

40         50         60         70         80         90
m512.pep   IAGGLHLPADATGDWRLFTENLYKLCQEKGVRFHFNQNISRIDHNGLRIKTVETKQGGLK
           ||||||||||||||  |||||||||||||||||||:||||||||||||||||||||||||
a512       IAGGLHLPADATGDCRLFTENLYKLCQEKGVRHHFNQTISRIDHNGLRIKTVETKQGGLK
              190        200        210        220        230        240
```

-continued

```
                      100        110         120
m512.pep   QMPLSARSVASAGRFWRSWISICPFIPSKAIP
           |||||||:||||||||:|||||  ||||||||
    a512   QMPLSARSAASAGRFWRKWISICRFIPSKAIP
                      250        260         270
```

The following partial DNA sequence was identified in *N. gonorrhoeae* <SEQ ID 1411>:

```
g513.seq
    1 ATGGGTTCCG CGCCGAACGC CGCCGCCGCC GCCGAAGTGA AACACCCTGT

51 TTCGCAAGGT ATGATTCAAA TGCTGGGCGT GTTTGTCGAT ACCATCATCG

101 TTTGTTCTTG CACCGCCTTC ATCATCTTGA TTTACCAACA GCCTTATGGC

151 GATTTGAGCG GTGCGGCGCT GAcgcAGGCG GCGATTGTCA GCCAAGTGGG

201 GCAATGGGGC GCGGGTTTCC TCGCCGTCAT CCTGTTTATG TTTGCCTTTT

251 CCACCGTTAT CGGCAACTAT GCCTATGCCG AGTCCAACGT CCAATTCATC

301 AAAAGCCATT GGCTGATTAC CGCCGTTTTC CGTATGCTGG TTTTGGCGTG

351 GGTCTATTTC GGCGCGGTTG CCAATGTGCC TTTGGTCTGG GATATGGCGG

401 ATATGGCGAT GGGCATCATG GCGTGGATCA ACCTCGTCGC CATCCTGCTG

451 CTCTCGCCat TGGCGTTTAT GCTGCTGCGC GATTACACCG CCAAGCTGAA

501 AATGGGCAAA GACCCCGAGT TCAAACTTTc cgAACATCCG GGCCTGAAAC

551 GCCGCATCAA ATCCGATGTT TGGTAA
```

This corresponds to the amino acid sequence <SEQ ID 1412; ORF 513.ng>:

```
g513.pep
    1 MGSAPNAAAA AEVKHPVSQG MIQMLGVFVD TIIVCSCTAF IILIYQQPYG

51 DLSGAALTQA AIVSQVGQWG AGFLAVILFM FAFSTVIGNY AYAESNVQFI

101 KSHWLITAVF RMLVLAWVYF GAVANVPLVW DMADMAMGIM AWINLVAILL

151 LSPLAFMLLR DYTAKLKMGK DPEFKLSEHP GLKRRIKSDV W*
```

The following partial DNA sequence was identified in *N. meningitidis* <SEQ ID 1413>:

```
m513.seq
    1 ATGGGTTCCG CGCCGAACGC CGCCGCCGCC GCCGAAGTGA AACACCCTGT

51 TTCGCAAGGT ATGATTCAAA TGCTGGGCGT GTTTGTCGAT ACCATCATCG

101 TTTGTTCTTG CACCGCCTTC ATCATCTTGA TTTACCAACA GCCTTATGGC

151 GATTTGAGCG GTGCGGCGCT GAcgcAGGCG GCGATTGTCA GCCAAGTGGG

201 GCAATGGGGC GCGGGTTTCC TCGCCGTCAT CCTGTTTATG TTTGCCTTTT

251 CCACCGTTAT CGGCAACTAT GCCTATGCCG AGTCCAACGT CCAATTCATC

301 AAAAGCCATT GGCTGATTAC CGCCGTTTTC CGTATGCTGG TTTTGGCGTG

351 GGTCTATTTC GGCGCGGTTG CCAATGTGCC TTTGGTCTGG GATATGGCGG

401 ATATGGCGAT GGGCATCATG GCGTGGATCA ACCTCGTCGC CATCCTGCTG

451 CTCTCGCCat TGGCGTTTAT GCTGCTGCGC GATTACACCG CCAAGCTGAA

501 AATGGGCAAA GACCCCGAGT TCAAACTTTc cgAACATCCG GGCCTGAAAC

551 GCCGCATCAA ATCCGATGTT TGGTAA
```

This corresponds to the amino acid sequence <SEQ ID 1414; ORF 513>:

```
m513.pep
   1 MGSAPNAAAA AEVKHPVSQG MIQMLGVFVD TIIVCSCTAF IILIYQQPYG

51 DLSGAALTQA AIVSQVGQWG AGFLAVILFM FAFSTVIGNY AYAESNVQFI

101 KSHWLITAVF RMLVLAWVYF GAVANVPLVW DMADMAMGIM AWINLVAILL

151 LSPLAFMLLR DYTAKLKMGK DPEFKLSEHP GLKRRIKSDV W*
```

Computer analysis of this amino acid sequence gave the following results:
Homology with a Predicted ORF from *N. gonorrhoeae*
ORF 513 shows 99.5% identity over a 191 aa overlap with a predicted ORF (ORF 513.ng) from *N. gonorrhoeae*:

```
    m513/g513
                      10         20         30         40         50         60
       m513.pep  MGSAPNAAAAAEVKHPVSQGMIQMLGVFVDTIIVCSCTAFIILIYQQPYGDLSGAALTQA
                 ||||||||||||||||||||||||||||||||||||||||||||||||||||||||||||
          g513   MGSAPNAAAAAEVKHPVSQGMIQMLGVFVDTIIVCSCTAFIILIYQQPYGDLSGAALTQA
                      10         20         30         40         50         60

70         80         90        100        110        120
       m513.pep  AIVSQVGQWGAGFLAVILFMFAFSTVIGNYAYAESNVQFIKSHWLITAVFRMLVLAWVYF
                 ||||||||||||||||||||||||||||||||||||||||||||||||||||||||||||
          g513   AIVSQVGQWGAGFLAVILFMFAFSTVIGNYAYAESNVQFIKSHWLITAVFRMLVLAWVYF
                      70         80         90        100        110        120

130        140        150        160        170        180
       m513.pep  GAVANVPLVWDMADMAMGIMAWINLVAILLLSPLAFMXLRDYTAKLKMGKDPEFKLSEHP
                 |||||||||||||||||||||||||||||||||||| |||||||||||||||||||||||
          g513   GAVANVPLVWDMADMAMGIMAWINLVAILLLSPLAFMLLRDYTAKLKMGKDPEFKLSEHP
                     130        140        150        160        170        180

190
       m513.pep  GLKRRIKSDVW
                 |||||||||||
          g513   GLKRRIKSDVW
                     190
```

The following partial DNA sequence was identified in *N. meningitidis* <SEQ ID 1415>:

```
a513.seq
   1 ATGAACGAGA ACTTTACCGA ATGGCTGCAC GGCTGGGTCG GCGCCATCAA

51 CGATCCGATG TGGTCATACT TGGTTTATNT GCTTTTGGGT ACGGGGCTTT

101 TCTTCACCGT AACCACGGGC TTTGTCCAAT TCCGCCTGTT CGGGCGCAGC

151 ATCAAAGAAA TGCTCGGCGG CCGCAAACAG GGGGACGACC CTCACGGCAT

201 CACGCCGTTT CAGGCATTTG TAACCGGCCT TGCCAGCCGC GTGGGCGTGG

251 GCAATATCGC GGGCGTGGCC ATCGCCATCA AAGTCGGCGG ACCGGGCGCG

301 GTGTTTTGGA TGTGGGTAAC CGCCTTAATC GGTATGAGTT CGGCGTTTGT

351 CGAATCTTCG CTGGCGCAGC TCTTTAAAGT CCGCGACTAC GACAACCACC

401 ATTTCCGGGG CGGCCCTGCC TACTACATCA CTCAAGGGCT GGGGCAGAAA

451 TGGCTGGGCG TGTTGTTCGC CCTGAGCCTG ATTTTCTGTT TCGGCTTTGT

501 GTTTGAAGCG GTTCAGACCA ATACCATTGC CGATACCGTC AAAGCGGCGT

551 GGGGTTGGGA GCCTCATTAT GTCGGCGTCG CCCTGGTGAT TTTAACCGCG

601 CCGATTATCT TCGGCGGCAT CAGGCGCATA TCTAAAGCGG CGGAAATCGT

651 CGTCCCCCTG ATGCGGTTT TGTACCTCTT TATCGCGCTT TTCATCATTT

701 TGACCAATAT TCCGATGATT CCGGACGTGT TCGGTCAGAT TTTTTCGGGC
```

```
 751 GCGTTCAAAT TCGACGCGGC AGCAGGCGGC TTACTCGGCG GTCTGATTTC

801 GCAAACGATG ATGATGGGCA TCAAACGCGG CCTGTATTCC AACGAGGCGG

851 GTATGGGTTC CGCGCCGAAC GCCGCCGCCG CCGCCGAAGT GAAACACCCT

901 GTTTCGCAAG GTATGATTCA AATGCTGGGC GTGTTTGTCG ATACCATCAT

951 CGTTTGTTCT TGCACCGCCT TCATCATCTT GATTTACCAA CAGCCTTACG

1001 GCGATTTGAG CGGTGCGGCG CTGACGCAGG CGGCGATTGT CAGCCAAGTG

1051 GGGCAATGGG GCGCGGGCTT CCTCGCCGTC ATCCTGTTTA TGTTTGCCTT

1101 TTCCACCGTT ATCGGCAACT ATGCCTATGC CGAGTCCAAC GTCCAATTCA

1151 TCAAAAGCCA TTGGCTGATT ACCGCCGTTT TCCGTATGCT GGTTTTGGCG

1201 TGGGTCTATT TCGGCGCGGT TGCCAATGTG CCTTTGGTCT GGGATATGGC

1251 GGATATGGCG ATGGGCATTA TGGCGTGGAT CAACCTTGTC GCCATCCTGC

1301 TGCTCTCGCC CTTGGCGTTT ATGCTGCTGC GCGATTACAC CGCCAAGCTG

1351 AAAATGGGCA AGACCCCGA GTTCAAACTT TCCGAACATC CGGGCCTGAA

1401 ACGCCGTATC AAATCCGACG TTTGGTAA
```

This corresponds to the amino acid sequence <SEQ ID 1416; ORF 513.a>:

```
a513.pep
  1 MNENFTEWLH GWVGAINDPM WSYLVYXLLG TGLFFTVTTG FVQFRLFGRS

51 IKEMLGGRKQ GDDPHGITPF QAFVTGLASR VGVGNIAGVA IAIKVGGPGA

101 VFWMWVTALI GMSSAFVESS LAQLFKVRDY DNHHFRGGPA YYITQGLGQK

151 WLGVLFALSL IFCFGFVFEA VQTNTIADTV KAAWGWEPHY VGVALVILTA

201 PIIFGGIRRI SKAAEIVVPL MAVLYLFIAL FIILTNIPMI PDVFGQIFSG

251 AFKFDAAAGG LLGGLISQTM MMGIKRGLYS NEAGMGSAPN AAAAAEVKHP

301 VSQGMIQMLG VFVDTIIVCS CTAFIILIYQ QPYGDLSGAA LTQAAIVSQV

351 GQWGAGFLAV ILFMFAFSTV IGNYAYAESN VQFIKSHWLI TAVFRMLVLA

401 WVYFGAVANV PLVWDMADMA MGIMAWINLV AILLLSPLAF MLLRDYTAKL

451 KMGKDPEFKL SEHPGLKRRI KSDVW*
``` m513/a513 100.0% identity in 191 aa overlap

```
                        10        20        30
        m513.pep        MGSAPNAAAAAEVKHPVSQGMIQMLGVFVD
                        |||||||||||||||||||||||||||||
        a513    DAAAGGLLGGLISQTMMMGIKRGLYSNEAGMGSAPNAAAAAEVKHPVSQGMIQMLGVFVD
                260       270       280       290       300       310

40        50        60        70        80        90
        m513.pep TIIVCSCTAFIILIYQQPYGDLSGAALTQAAIVSQCGQWGAGFLAVILFMFAFSTVIGNY
                ||||||||||||||||||||||||||||||||||||||||||||||||||||||||||||
        a513    TIIVCSCTAFIILIYQQPYGDLSGAALTQAAIVSQCGQWGAGFLAVILFMFAFSTVIGNY
                320       330       340       350       360       370

100       110       120       130       140       150
        m513.pep AYAESNVQFIKSHWLITAVFRMLVLAWVYFGAVANVPLVWDMADMAMGIMAWINLVAILL
                ||||||||||||||||||||||||||||||||||||||||||||||||||||||||||||
        a513    AYAESNVQFIKSHWLITAVFRMLVLAWVYFGAVANVPLVWDMADMAMGIMAWINLVAILL
                380       390       400       410       420       430

160       170       180       190
        m513.pep LSPLAFMLLRDYTAKLKMGKDPEFKLSEHPGLKRRIKSDVWX
                |||||||||||||||||||||||||||||||||||||||||
        a513    LSPLAFMLLRDYTAKLKMGKDPEFKLSEHPGLKRRIKSDVWX
                440       450       460       470
```

The following partial DNA sequence was identified in *N. gonorrhoeae* <SEQ ID 1417>:

```
g515.seq
    1 atggttcaaa tacaggttgt gcgcgccgcc ggcgttgccc gtggtctgca 51 ttccgagttt gcgcgcgctg taactgccga ggaaatagcc ttcgacaatg 101 ccgttttgaa tcacgaagcg cggcgcggtg gcaacacctt ccgcatcaaa 151 atagctgctg cggaaagagc gggggatgtg cggttcttcg cgcaggttga 201 ggaaatcggg caggactttt ttgccgatgc tgtcgatcag gaaactgctt 251 tggcggtaga gcgcgccgcc ggagagtgtg ccgacgaggt gtccgatcag 301 cccgcccgaa acggtggtat cgaagaggac ggggtagctg cctgtcggga 351 tgctgcggct gccgagtcgg cgcaaagtgc ggcgggcggc ggtttgaccg 401 atggtttcgg ggctgtccat atccggatgg cggcaggcgg aatcgtacca 451 gtagtcgcgc tgcattccgt tttcgtcggc ggcgacgacg ctgcaggaaa 501 tgctgtggtg cgtgctttgc cggtgtgcgg caaaaccgtg ggtgttgccg 551 taaacgtatt ggtactgtcc ggtttgcacc gccgcgcctt cggagttttc 601 gatgcggctg tccgtgtcca acgctgcctg ttcgcattgt tttgccaagc 651 cgacggcggc ttccgtatcc aaatcccatt cgtggtaaag gtcggggtcg 701 ccgatgtgtt gcgccatcaa ctcggggtcg gcaagtccgg cgcaaccgtc 751 ttcggcggtg tggcgggcga tgtcggcggc ggcgcggacg gtgtcgcgca 801 gggcttgttc ggagaagtcg gcggtgccgg cgcggccttt gcgtttgccg 851 acgtaaacgg taatgtccag cgatttgtcc tgctggaact cgatttgttc 901 gatttcgccc aagcgcacgc tgacgctttg tccgagcgat tcgctgaagt 951 cggcttcggc ggcggtcgcg cccgctgctt tgccaagtc gagcgtgcgg 1001 cggcagaggt cgaggagttc ggaagcggtg tggttgaaca gcataacaat 1051 ctttcttggt ggagcgttgt ggcattttaa
                                         40
```

This corresponds to the amino acid sequence <SEQ ID 1418; ORF 515.ng>:

```
g515.pep
    1 MVQIQVVRAA GVARGLHSEF ARAVTAEEIA FDNAVLNHEA RRGGNTFRIK

51 IAAAERAGDV RFFAQVEEIG QDFFADAVDQ ETALAVERAA GECADEVSDQ

101 PARNGGIEED GVAACRDAAA AESAQSAAGG GLTDGFGAVH IRMAAGGIVP

151 VVALHSVFVG GDDAAGNAVV RALPVCGKTV GVAVNVLVLS GLHRRAFGVF

201 DAAVRVQRCL FALFCQADGG FRIQIPFVVK VGVADVLRHQ LGVGKSGATV

251 FGGVAGDVGG GADGVAQGLF GEVGGAGAAF AFADVNGNVQ RFVLLELDLF

301 DFAQAHADAL SERFAEVGFG GGRARCFCQV ERAAAEVEEF GSGVVEQHNN

351 LSWWSVVAF*
```

The following partial DNA sequence was identified in *N. meningitidis* <SEQ ID 1419>:

```
m515.seq (partial)
    1 ..GGAAAGAGCG GGGGATGTGC GTTCTTCGCG CAGGTTGAGG AAATCGGGCA

51    GGACTTTTCT GCCGATGCTG TCGATCAGGA AACTGCTTTG GCGGTAGAGC
```

-continued
```
101    GCGCCGCCGG AGAGTGCGCC GACGAGGTGT CCGATAAGAC CGCCCGAAAC

151    GGTGGTATCG AAGAGGACGG GGTAGCTGCC TGTCGGGATG CTGCGGCTGC

201    CGAGTCGGCG CAAAGTGCGG CGGGCGGCGG TTTGACCGAT GGTTTCGGGG

251    CTGTCCATAT CCGGATGGCG GCAGGCGGAA TCGTACCAGT AGTCGCGCTG

301    CATGCCGTTT TCGTCGGCGG CAACGACGCT GCAGGAAATG CTGTGGTGCG

351    TGCCTTGCCG GTGTGCGGCA AAACCGTGGG TGTTGCCGTA AACGTATTGG

401    TAATGGCCGG TTTGCACCGC CGCGCCTTCG GAGTTTTCGA TGCGCTCATC

451    CTCGTTCAGG GCGGCTTGTT CGCATTGTTT TGCCAAGCCG ACGGCGGCTk

501    CCGTATCCAA ATCCCATTCG TGGTAAAGGT CGGGGTCGCC GATGTGTTTT

551    GCCATCAGAC AGGCATCGGC AAGTCCGGCG CAACCGTCTT CGGCGGTGTG

601    GCGGGCGATG TCGATGGCGG CTTTGACGGT GTCTTGCAGG GCTTTTTCGG

651    AGAAGTCGGC AGTACTGGCG CGGCCTTTGC GTTTGCCGAC GTAAACGGTA

701    ATGTCCAGCG ACTTGTCCTG CTGGAACTCG ATTTGTTsGA TTTsGCCCAG

751    CCGCACGCTG ACGCTTTGTC CCAATGATTC GCTGAAATCG GCTTCGGCGG

801    CGGTTGCGCC CGTCGCTTTT GCCAAGTCGA GCGTGCGGCG GCAGAGGTCG

851    AGGAGTTCGG AAGCGGTGTG GTTgAACAGC ATAGAAATCT TTCTTGATGA

901    TGCTTTGCGG CATTTTAA
```

This corresponds to the amino acid sequence <SEQ ID 1420; ORF 515>:

```
m515.pep (partial)
  1    ..GKSGGCAFFA QVEEIGQDFS ADAVDQETAL AVERAAGECA DEVSDKTARN

51    GGIEEDGVAA CRDAAAAESA QSAAGGGLTD GFGAVHIRMA AGGIVPVVAL

101    HAVFVGGNDA AGNAVVRALP VCGKTVGVAV NVLVMAGLHR RAFGVFDALI

151    LVQGGLFALF CQADGGXRIQ IPFVVKVGVA DVFCHQTGIG KSGATVFGGV

201    AGDVDGGFDG VLQGFFGEVG STGAAFAFAD VNGNVQRLVL LELDLXDXAQ

251    PHADALSQXF AEIGFGGGCA RRFCQVERAA AEVEEFGSGV VEQHRNLSXX

301    CFAAF*
```

Computer analysis of this amino acid sequence gave the following results:

Homology with a Predicted ORF from *N. gonorrhoeae*
ORF 515 shows 85.9% identity over a 304 aa overlap with a predicted ORF (ORF 515.ng) from *N. gonorrhoeae*:

```
m515/g515

10         20         30
      m515.pep                                 GKSGGCAFFAQVEEIGQDFSADAVDQETALA
                                                 ::| ||||||||||||| |||||||||||
      g515    AEEIAFDNAVLNHEARRGGNTFRIKIAAAERAGDVRFFAQVEEIGQDFFADAVDQETALA
                  30         40         50         60         70         80

40         50         60         70         80         90
      m515.pep    VERAAGECADEVSDKTARNGGIEEDGVAACRDAAAAESAQSAAGGGLTDGFGAVHIRMAA
                  |||||||||||||||:|| ||||||||||||||||||||||||||||||||||||||||
      g515       VERAAGECADEVSDQPARNGGIEEDGVAACRDAAAAESAQSAAGGGLTDGFGAVHIRMAA
                  90        100        110        120        130        140
```

-continued

```
                   100       110       120       130       140       150
m515.pep    GGIVPVVALHAVFVGGNDAAGNAVVRALPVCGKTVGVAVNVLVMAGLHRRAFGVFDALIL
            ||||||||||:|||||:|||||||||||||||||||||||||||::||||||||||||| :
g515        GGIVPVVALHSVFVGGDDAAGNAVVRALPVCGKTVGVAVNVLVLSGLHRRAFGVFDAAVR
              150       160       170       180       190       200

160       170       180       190       200       210
m515.pep    VQGGLFALFCQADGGXRIQIPFVVKVGVADVFCHQTGIGKSGATVFGGVAGDVDGGFDGV
            ||  |||||||||| ||||||||||||||: || |:|||||||||||||| || |||
g515        VQRCLFALFCQADGGFRIQIPFVVKVGVADVLRHQLGVGKSGATVFGGVAGDVGGGADGV
              210       220       230       240       250       260

220       230       240       250       260       270
m515.pep    LQGFFGEVGSTGAAFAFADVNGNVQRLVLLELDLXDXAQPHADALSQXFAEIGFGGGCAR
             ||:|||||::|||||||||||||||:||||||| | || ||||||: |||:||||| ||
g515        AQGLFGEVGGAGAAFAFADVNGNVQRFVLLELDLXDFAQAHADALSERFAEVGFGGGRAR
              270       280       290       300       310       320

280       290       300
m515.pep    RFCQVERAAAEVEEFGSGVVEQHRNLSXXCFAAF
             |||||||||||||||||||||| |||     :||
g515        CFCQVERAAAEVEEFGSGVVEQHNNLSWWSVVAF
              330       340       350
```

The following partial DNA sequence was identified in *N. meningitidis* <SEQ ID 1421>:

```
a515.seq
   1 ATGGTTCAAA TAAAGGTTGT GCGCGCCGCC GGCGTTGCCC GTGGTCTGCA

51 TTCCGAGTTT GCGCGCGCTG TAACTGCTGA GGAAATAGCC TTCGACAATG

101 CCGTTTTGAA TCACGAAGCG CGGTGCGGTG GCAACGCCTT CCGCATCAAA

151 ATAGCTGCTG CGGAAAGAGC GGGGGATGTG CGGTTCTTCG CGCAGGTTGA

201 GGAAATCGGG CAGGACTTTT TTGCCGATGC TGTCGATCAG GAAACTGCTT

251 TGGCGGTAGA GCGCTCCGCC GGAGAGTGCG CCGACGAGGT GTCCGATAAG

301 ACCGCCCGAA ACGGTGGTAT CGAAGAGGAC GGGGTAGTTG CCTGTCGGGA

351 TGCTGCGGCT GCCGAGTCGG CGCAAAGTGC GGCGGGCGGC GGTTTGACCG

401 ATGGTTTCGG GGCTGTCCAT ATCCGGATGG CGGCAGGCGG AATCGTACCA

451 GTAGTCGCGC TGCATGCCGT TTTCGTCGGC GGCAACGACG CTGCAGGAAA

501 TGCTGTGGTG CGTGCTTTGC CGGTGTGCGG CAAAACCGTA GGTGTTGCCG

551 TAAACGTATT GGTAATGGCC GGTTTGCACC GCCGCGCCTT CGGAGTTTTC

601 GATGCGCTCA TCCTCGTTCA GGGCGGCTTG TTCGCATTGT TTTGCCAAGC

651 CGACGGCGGC TTCCGTATCC AAATCCCATT CGTGGTAAAG GTCGGGGTCG

701 CCGATGTGTT GCGCCATCAA CTCGGGGTCG GCAAGTCCGG CGCAACCGTC

751 TTCGGCGGTG TGGCGGGCGA TGTCNNNNGC GGCGCGGACG GTGTCGCGCA

801 GGGCTTGTTC GGAGAAATCG GCGGTGCCGG CGCGGCCTTT GCGTTTGCCG

851 ACGTAAACGG TAATGTCCAG CGACTTGTCC TGCTGAAACT CGATTTGTTC

901 GATTTCGCCC AGCCGCACGC TGACGCTTTG TCCCAATGAT TCGCTGAAAT

951 CGGCTTCGGC GGCGGTTGCG CCCGTCGCTT TTGCCAAGTC GAGCGTGCGG

1001 CGGCAGAGGT CGAGGAGTTC GGAAGCGGTG TGGTTGAACA GCATAGAAAT

1051 CTTTCTTGAT GATGCTTTGC GGCATTTTAA
```

This corresponds to the amino acid sequence <SEQ ID 1422; ORF 515.a>:

```
a515.pep
   1 MVQIKVVRAA GVARGLHSEF ARAVTAEEIA FDNAVLNHEA RCGGNAFRIK

51 IAAAERAGDV RFFAQVEEIG QDFFADAVDQ ETALAVERSA GECADEVSDK

101 TARNGGIEED GVVACRDAAA AESAQSAAGG GLTDGFGAVH IRMAAGGIVP

151 VVALHAVFVG GNDAAGNAVV RALPVCGKTV GVAVNVLVMA GLHRRAFGVF

201 DALILVQGGL FALFCQADGG FRIQIPFVVK VGVADVLRHQ LGVGKSGATV

251 FGGVAGDVXX GADGVAQGLF GEIGGAGAAF AFADVNGNVQ RLVLLKLDLF

301 DFAQPHADAL SQ*FAEIGFG GGCARRFCQV ERAAAEVEEF GSGVVEQHRN

351 LS**CFAAF*
``` m515/a515 92.1% identity in 304 aa overlap

```
                                         10         20         30
        m515.pep                 GKSGGCAFFAQVEEIGQDFSADAVDQETALA
                                  : :|  ||||||||||||| ||||||||||||
        a515     AEEIAFDNAVLNHEARCGGNTFRIKIAAAERAGDVRFFAQVEEIGQDFFADAVDQETALA
                         30         40         50         60         70         80
                 40         50         60         70         80         90
        m515.pep VERAAGECADEVSDKTARNGGIEEDGVAACRDAAAAESAQSAAGGGLTDGFGAVHIRMAA
                 |||:|||||||||||||||||||||||||||:||||||||||||||||||||||||||||
        a515     VERSAGECADEVSDKTARNGGIEEDGVVACRDAAAAESAQSAAGGGLTDGFGAVHIRMAA
                         90        100        110        120        130        140
                        100        110        120        130        140        150
        m515.pep GGIVPVVALHAVFVGGNDAAGNAVVRALPVCGKTVGVAVNVLVMAGLHRRAFGVFDALIL
                 ||||||||||||||||||||||||||||||||||||||||||||||||||||||||||||
        a515     GGIVPVVALHAVFVGGNDAAGNAVVRALPVCGKTVGVAVNVLVMAGLHRRAFGVFDALIL
                        150        160        170        180        190        200
                        160        170        180        190        200        210
        m515.pep VQGGLFALFCQADGGXRIQIPFVVKVGVADVFCHQTGIGKSGATVFGGVAGDVDGGFDGV
                 ||||||||||||||| ||||||||||||||||: ||  |:||||||||||||||   |||
        a515     VQGGLFALFCQADGGFRIQIPFVVKVGVADVLRHQLGVGKSGATVFGGVAGDVXXGADGV
                        210        220        230        240        250        260
                        220        230        240        250        260        270
        m515.pep LQGFFGEVGSTGAAFAFADVNGNVQRLVLLELDLXDXAQPHADALSQXFAEIGFGGGCAR
                 ||:|||:|::||||||||||||||||||||||||:|||  |||||||||||||||||||||
        a515     AQGLFGEVGGAGAAFAFADVNGNVQRLVLLELDLFDFAQPHADALSQXFAEIGFGGGCAR
                        270        280        290        300        310        320
                        280        290        300
        m515.pep RFCQVERAAAEVEEFGSGVVEQHRNLSXXCFAAFX
                 |||||||||||||||||||||||||||||||||||
        a515     RFCQVERAAAEVEEFGSGVVEQHRNLSXXCFAAFX
                        330        340        350        350
```

50

The following partial DNA sequence was identified in *N. gonorrhoeae* <SEQ ID 1423>:

```
g515-1.seq
   1 ATGGTTCAAA TACAGGTTGT GCGCGCCGCC GGCGTTGCCC GTGGTCTGCA

51 TTCCGAGTTT GCGCGCGCTG TAACTGCCGA GGAAATAGCC TTCGACAATG

101 CCGTTTTGAA TCACGAAGCG CGGCGCGGTG GCAACACCTT CCGCATCAAA

151 ATAGCTGCTG CGGAAAGAGC GGGGGATGTG CGGTTCTTCG CGCAGGTTGA

201 GGAAATCGGG CAGGACTTTT TTGCCGATGC TGTCGATCAG GAAACTGCTT

251 TGGCGGTAGA GCGCGCCGCC GGAGAGTGTG CCGACGAGGT GTCCGATCAG

301 CCCGCCCGAA ACGGTGGTAT CGAAGAGGAC GGGGTAGCTG CCTGTCGGGA
```

-continued

```
 351 TGCTGCGGCT GCCGAGTCGG CGCAAAGTGC GGCGGGCGGC GGTTTGACCG
 401 ATGGTTTCGG GGCTGTCCAT ATCCGGATGG CGGCAGGCGG AATCGTACCA
 451 GTAGTCGCGC TGCATTCCGT TTTCGTCGGC GGCAACGACG CTGCAGGAAA
 501 TGCTGTGGTG CGTGCTTTGC CGGTGTGCGG CAAAACCGTG GGTGTTGCCG
 551 TAAACGTATT GGTAGTGTCC GGTTTGCACC GCCGCGCCTT CGGAGTTTTC
 601 GATGCGGCTG TCCGTGTCCA ACGCTGCCTG TTCGCATTGT TTTGCCAAGC
 651 CGACGGCGGC TTCCGTATCC AAATCCCATT CGTGGTAAAG GTCGGGGTCG
 701 CCGATGTGTT GCGCCATCAA CTCGGGGTCG GCAAGTCCGG CGCAACCGTC
 751 TTCGGCGGTG TGGCGGGCGA TGTCGGCGGC GGCGCGGACG GTGTCGCGCA
 801 GGGCTTGTTC GGAGAAGTCG GCGGTGCCGG CGCGGCCTTT GCGTTTGCCG
 851 ACGTAAACGG TAATGTCCAG CGATTTGTCC TGCTGGAACT CGATTTGTTC
 901 GATTTCGCCC AAGCGCACGC TGACGCTTTG TCCGAGCGAT TCGCTGAAGT
 951 CGGCTTCGGC GGCGGTCGCG CCCGCTGCTT TTGCCAAGTC GAGCGTGCGG
1001 CGGCAGAGGT CGAGGAGTTC GGAAGCGGTG TGGTTGAACA GCATAACAAT

1051 CTTTCTTGGT GGAGCGTTGT GGCATTTTAA
```

This corresponds to the amino acid sequence <SEQ ID 1424; ORF 515-1.ng>:

```
g515-1.pep
  1 MVQIQVVRAA GVARGLHSEF ARAVTAEEIA FDNAVLNHEA RRGGNTFRIK
 51 IAAAERAGDV RFFAQVEEIG QDFFADAVDQ ETALAVERAA GECADEVSDQ
101 PARNGGIEED GVAACRDAAA AESAQSAAGG GLTDGFGAVH IRMAAGGIVP

151 VVALHSVFVG GNDAAGNAVV RALPVCGKTV GVAVNVLVVS GLHRRAFGVF

201 DAAVRVQRCL FALFCQADGG FRIQIPFVVK VGVADVLRHQ LGVGKSGATV

251 FGGVAGDVGG GADGVAQGLF GEVGGAGAAF AFADVNGNVQ RFVLLELDLF

301 DFAQAHADAL SERFAEVGFG GGRARCFCQV ERAAAEVEEF GSGVVEQHNN

351 LSWWSVVAF*
```

The following partial DNA sequence was identified in *N. meningitidis* <SEQ ID 1425>:

```
m515-1.seq
  1 ATGGTTCAAA TACAGGTTGT GCGCGCCGCC GGCGTTGCCC GTGGTCTGCA
 51 TACCGAGTTT GCGCGCGCTG TAACTGCTGA GGAAATAGCC TTCGACAATG
101 CCGTTTTGAA TCACGAAGCG CGGTGCGGTG GCAACGCCTT CCGCATCAAA
151 ATAGCTGCTG CGGAAAGAGC GGGGGATGTG CGGTTCTTCG CGCAGGTTGA
201 GGAAATCGGG CAGGACTTTT TTGCCGATGC TGTCGATCAG GAAACTGCTT
251 TGGCGGTAGA GCGCGCCGCC GGAGAGTGCG CCGACGAGGT GTCCGATAAG
301 ACCGCCCGAA ACGGTGGTAT CGAAGAGGAC GGGGTAGCTG CCTGTCGGGA
351 TGCTGCGGCT GCCGAGTCGG CGCAAAGTGC GGCGGGCGGC GGTTTGACCG
401 ATGGTTTCGG GGCTGTCCAT ATCCGGATGG CGGCAGGCGG AATCGTACCA
451 GTAGTCGCGC TGCATGCCGT TTTCGTCGGC GGCAACGACG CTGCAGGAAA
501 TGCTGTGGTG CGTGCCTTGC CGGTGTGCGG CAAAACCGTG GGTGTTGCCG
```

-continued

```
551 TAAACGTATT GGTAATGGCC GGTTTGCACC GCCGCGCCTT CGGAGTTTTC

601 GATGCGCTCA TCCTCGTTCA GGGCGGCTTG TTCGCATTGT TTTGCCAAGC

651 CGACGGCGGC TTCCGTATCC AAATCCCATT CGTGGTAAAG GTCGGGGTCG

701 CCGATGTGTT TTGCCATCAG ACAGGCATCG GCAAGTCCGG CGCAACCGTC

751 TTCGGCGGTG TGGCGGGCGA TGTCGATGGC GGCTTTGACG GTGTCTTGCA

801 GGGCTTTTTC GGAGAAGTCG GCAGTACTGG CGCGGCCTTT GCGTTTGCCG

851 ACGTAAACGG TAATGTCCAG CGACTTGTCC TGCTGGAACT CGATTTGTTC

901 GATTTCGCCC AGCCGCACGC TGACGCTTTG TCCCAATGA
```

This corresponds to the amino acid sequence <SEQ ID 1426; ORF 515-1>:

```
m515-1.pep

1 MVQIQVVRAA GCARGLHTEF ARAVTAEEIA FDNAVLNHEA RCGGNAFRIK

51 IAAAERAGDV RFFAQVEEIG QDFFADAVDQ ETALAVERAA GECADEVSDK

101 TARNGGIEED GVAACRDAAA AESAQSAAGG GLTDGFGAVH IRMAAGGIVP

151 VVALHAVFVG GNDAAGNAVV RALPVCGKTV GVAVNVLVMA GLHRRAFGVF

201 DALILVQGGL FALFCQADGG FRIQIPFVVK VGVADVFCHQ TGIGKSGATV

251 FGGVAGDVDG GFDGVLQGFF GEVGSTGAAF AFADVNGNVQ RLVLLELDLF

301 DFAQPHADAL SQ* m515-1/g515-1  91.7% identity in 312 aa overlap 10         20         30         40         50         60
g515-1.pep MVQIQVVRAAGVARGLHSEFARACTAEEIAFDNAVLNHEARRGGNTFRIKIAAAERAGDV
           ||||||||||||||||| :||||| |||||||||||||||||| |||:|||||||||||
m515-1     MVQIQVVRAAGVARGLHTEFARACTAEEIAFDNAVLNHEARCGGNAFRIKIAAAERAGDV
                  10         20         30         40         50         60

70         80         90        100        110        120
g515-1.pep RFFAQVEEIGQDFFADAVDQETALAVERAAGECADEVSDQPARNGGIEEDGVAACRDAAA
           |||||||||||||||||||||||||||||||||||||||:  ||||||||||||||||||
m515-1     RFFAQVEEIGQDFFADAVDQETALAVERAAGECADEVSDKTARNGGIEEDGVAACRDAAA
                  70         80         90        100        110        120

130        140        150        160        170        180
g515-1.pep AESAQSAAGGGLTDGFGAVHIRMAAGGIVPVVALHSVFVGGNDAAGNAVVRALPVCGKTV
           |||||||||||||||||||||||||||||||||||:||||||||||||||||||||||||
m515-1     AESAQSAAGGGLTDGFGAVHIRMAAGGIVPVVALHAVFVGGNDAAGNAVVRALPVCGKTV
                 130        140        150        160        170        180

190        200        210        220        230        240
g515-1.pep GVAVNVLVVSGLHRRAFGVFDAAVRVQRCLFALFCQADGGFRIQIPFVVKVGVADVLRHQ
           ||||||||::|||||||||||   :  ||  |||||||||||||||||||||||||: ||
m515-1     GVAVNVLVMAGLHRRAFGVFDALILVQGGLFALFCQADGGFRIQIPFVVKVGVADVFCHQ
                 190        200        210        220        230        240

250        260        270        280        290        300
g515-1.pep LGVGKSGATVFGGVAGDVGGGADGVAQGLFGECGGAGAAFAFADVNGNVQRFVLLELDLF
           |:||||||||||||||||| ||  |||:|||||::|||||||||||||||||:|||||||
m515-1     TGIGKSGATVFGGVAGDVDGGFDGVLQGFFGECGSTGAAFAFADVNGNVQRLVLLELDLF
                 250        260        270        280        290        300

310        320        330        340        350        360
g515-1.pep DFAQAHADALSERFAECGFGGGRARCFCQVERAAAEVEEFGSGVVEQHNNLSWWSVVAFX
           ||||  ||||||:
m515-1     DFAQPHADALSQX
                 310
```

The following partial DNA sequence was identified in *N. meningitidis* <SEQ ID 1427>:

```
a515-1.seq
   1 ATGGTTCAAA TAAGGTTGT GCGCGCCGCC GGCGTTGCCC GTGGTCTGCA

51 TTCCGAGTTT GCGCGCGCTG TAACTGCTGA GGAAATAGCC TTCGACAATG
```

```
-continued
101 CCGTTTTGAA TCACGAAGCG CGGTGCGGTG GCAACGCCTT CCGCATCAAA

151 ATAGCTGCTG CGGAAAGAGC GGGGGATGTG CGGTTCTTCG CGCAGGTTGA

201 GGAAATCGGG CAGGACTTTT TTGCCGATGC TGTCGATCAG GAAACTGCTT

251 TGGCGGTAGA GCGCTCCGCC GGAGAGTGCG CCGACGAGGT GTCCGATAAG

301 ACCGCCCGAA ACGGTGGTAT CGAAGAGGAC GGGGTAGTTG CCTGTCGGGA

351 TGCTGCGGCT GCCGAGTCGG CGCAAAGTGC GGCGGGCGGC GGTTTGACCG

401 ATGGTTTCGG GGCTGTCCAT ATCCGGATGG CGGCAGGCGG AATCGTACCA

451 GTAGTCGCGC TGCATGCCGT TTTCGTCGGC GGCAACGACG CTGCAGGAAA

501 TGCTGTGGTG CGTGCTTTGC CGGTGTGCGG CAAAACCGTA GGTGTTGCCG

551 TAAACGTATT GGTAATGGCC GGTTTGCACC GCCGCGCCTT CGGAGTTTTC

601 GATGCGCTCA TCCTCGTTCA GGGCGGCTTG TTCGCATTGT TTTGCCAAGC

651 CGACGGCGGC TTCCGTATCC AAATCCCATT CGTGGTAAAG GTCGGGGTCG

701 CCGATGTGTT GCGCCATCAA CTCGGGGTCG GCAAGTCCGG CGCAACCGTC

751 TTCGGCGGTG TGGCGGGCGA TGTCGGCGGC GGCGCGGACG GTGTCGCGCA

801 GGGCTTGTTC GGAGAAATCG GCGGTGCCGG CGCGGCCTTT GCGTTTGCCG

851 ACGTAAACGG TAATGTCCAG CGACTTGTCC TGCTGAAACT CGATTTGTTC

901 GATTTCGCCC AGCCGCACGC TGACGCTTTG TCCCAATGA
```

This corresponds to the amino acid sequence <SEQ ID 1428; ORF 515-1.a>:

```
a515-1.pep

1  MVQIQVVRAA GCARGLHTEF ARAVTAEEIA FDNAVLNHEA RCGGNAFRIK

51  IAAAERAGDV RFFAQVEEIG QDFFADAVDQ ETALAVERAA GECADEVSDK

101  TARNGGIEED GVAACRDAAA AESAQSAAGG GLTDGFGAVH IRMAAGGIVP

151  VVALHAVFVG GNDAAGNAVV RALPVCGKTV GVAVNVLVMA GLHRRAFGVF

201  DALILVQGGL FALFCQADGG FRIQIPFVVK VGVADVFCHQ TGIGKSGATV

251  FGGVAGDVDG GFDGVLQGFF GEVGSTGAAF AFADVNGNVQ RLVLLELDLF

301  DFAQPHADAL SQ* m515-1/a515-1  94.9% identity in 312 aa overlap 10         20         30         40         50         60
a515-1.pep  MVQIKVVRAAGVARGLHSEFARACTAEEIAFDNAVLNHEARRGGNTFRIKIAAAERAGDV
            ||||:|||||||||||||:||||| |||||||||||||||||||||||||||||||||||
m515-1      MVQIQVVRAAGVARGLHTEFARACTAEEIAFDNAVLNHEARRGGNTFRIKIAAAERAGDV
                 10         20         30         40         50         60

70         80         90        100        110        120
a515-1.pep  RFFAQVEEIGQDFFADAVDQETALAVERSAGECADEVSDQPARNGGIEEDGVVACRDAAA
            ||||||||||||||||||||||||||||:|||||||||||||||||||||||:|||||||
m515-1      RFFAQVEEIGQDFFADAVDQETALAVERAAGECADEVSDQPARNGGIEEDGVAACRDAAA
                 70         80         90        100        110        120

130        140        150        160        170        180
a515-1.pep  AESAQSAAGGGLTDGFGAVHIRMAAGGIVPVVALHAVFVGGNDAAGNAVVRALPVCGKTV
            ||||||||||||||||||||||||||||||||||||||||||||||||||||||||||||
m515-1      AESAQSAAGGGLTDGFGAVHIRMAAGGIVPVVALHAVFVGGNDAAGNAVVRALPVCGKTV
                130        140        150        160        170        180

190        200        210        220        230        240
a515-1.pep  GVAVNVLVMAGLHRRAFGVFDALILVQGGLFALFCQADGGFRIQIPFVVKVGVADVLRHQ
            |||||||||||||||||||||||||||||||||||||||||||||||||||||||||:||
m515-1      GVAVNVLVMAGLHRRAFGVFDALILVQGGLFALFCQADGGFRIQIPFVVKVGVADVFCHQ
                190        200        210        220        230        240
```

```
                   250        260        270        280        290        300
a515-1.pep  LGVGKSGATVFGGVAGDVGGGADGVAQGLFGEIGGAGAAFAFADVNGNVQRLVLLKLDLF
            |:|||||||||||||  |||  ||:|||:::||||||||||||||||||||||||:||||
m515-1      TGIGKSGATVFGGVAGDVDGGFDGVLQGFFGEVGSTGAAFAFADVNGNVQRLVLLELDLF
                   250        260        270        280        290        300

310
a515-1.pep  DFAQPHADALSQX
            |||||||||||||
m515-1      DFAQPHADALSQX
                   310
```

The following partial DNA sequence was identified in *N. gonorrhoeae* <SEQ ID 1429>:

```
g516.seq
   1 atgttgttcc gtaaaacgac cgccgccgtt ttggcggcaa ccttgatact 51 gaacggctgt acgatgatgt tgcgggggat gaacaacccg gtcagccaaa 101 caatcacccg caaacacgtt gacaaagacc aaatccgcgc cttcggtgtg 151 gttgccgaag acaatgccca attggaaaag ggcagcctgg tgatgatggg 201 cgggaaatac tggttcgccg tcaatcccga agattcggcg aagctgacgg 251 gccttttgaa ggccggggttg gacaagccct tccaaatagt tgaggatacc 301 ccgagctatg cccgccacca agccctgccg gtcaaattcg aagcgcccgg 351 cagccagaat ttcagtaccg gaggtctttg cctgcgctat gataccggca 401 gacctgacga catcgccaag ctgaaacagc ttgagtttaa agcggtcaaa 451 ctcgacaatc ggaccattta cacgcgctgc gtatccgcca aaggcaaata 501 ctacgccacg ccgcaaaaac tgaacgccga ttatcatttt gagcaaagtg 551 tgcccgccga tatttattat acggttactg aaaaacatac cgacaaatcc 601 aagctgtttg gaaatatctt atatacgccc cccttgttga tattggatgc 651 ggcggccgcg gtgctggtct tgcctatggc tctgattgca gccgcgaatt 701 cctcagacaa atga
                                                   40
```

This corresponds to the amino acid sequence <SEQ ID 1430; ORF 516.ng>:

```
g516.pep
   1 MLFRKTTAAV LAATLILNGC TMMLRGMNNP VSQTITRKHV DKDQIRAFGV

51 VAEDNAQLEK GSLVMMGGKY WFAVNPEDSA KLTGLLKAGL DKPFQIVEDT

101 PSYARHQALP VKFEAPGSQN FSTGGLCLRY DTGRPDDIAK LKQLEFKAVK

151 LDNRTIYTRC VSAKGKYYAT PQKLNADYHF EQSVPADIYY TVTEKHTDKS

201 KLFGNILYTP PLLILDAAAA VLVLPMALIA AANSSDK*
```

The following partial DNA sequence was identified in *N. meningitidis* <SEQ ID 1431>:

```
m516.seq
   1 ATGTTGTTCC GTAAAACGAC CGCCGCCGTT TTGGCGGCAA CCTTGATGCT

51 GAACGGCTGT ACGTTGATGT TGTGGGGAAT GAACAACCCG GTCAGCGAAA

101 CAATCACCCG CAAACACGTT GACAAAGACC AAATCCGCGC CTTCGGTGTG

151 GTTGCCGAAG ACAATGCCCA ATTGGAAAAG GGCAGCCTGG TGATGATGGG

201 CGGAAAATAC TGGTTCGTCG TCAATCCCGA AGATTCGGCG AAGCTGACGG
```

```
-continued
251 GCATTTTGAA GGCAGGGCTG GACAAACCCT TCCAAATAGT TGAGGATACC

301 CCGAGCTATG CTCGCCACCA AGCCCTGCCG GTCAAACTCG AATCGCCTGG

351 CAGCCAGAAT TTCAGTACCG AAGGCCTTTG CCTGCGCTAC GATACCGACA

401 AGCCTGCCGA CATCGCCAAG CTGAAACAGC TCGGGTTTGA AGCGGTCAAA

451 CTCGACAATC GGACCATTTA CACGCGCTGC GTATCCGCCA AAGGCAAATA

501 CTACGCCACA CCGCAAAAAC TGAACGCCGA TTACCATTTT GAGCAAAGTG

551 TGCCTGCCGA TATTTATTAC ACGGTTACTG AAGAACATAC CGACAAATCC

601 AAGCTGTTTG CAAATATCTT ATATACGCCC CCCTTTTTGA TACTGGATGC

651 GGCGGGCGCG GTACTGGCCT TGCCTGCGGC GGCTCTGGGT GCGGTCGTGG

701 ATGCCGCCCG CAAATGA
```

This corresponds to the amino acid sequence <SEQ ID 1432; ORF 516>:

```
m516.pep
  1 MLFRKTTAAV LAATLMLNGC TLMLWGMNNP VSETITRKHV DKDQIRAFGV

51 VAEDNAQLEK GSLVMMGGKY WFVVNPEDSA KLTGILKAGL DKPFQIVEDT

101 PSYARHQALP VKLESPGSQN FSTEGLCLRY DTDKPADIAK LKQLGFEAVK

151 LDNRTIYTRC VSAKGKYYAT PQKLNADYHF EQSVPADIYY TVTEEHTDKS

201 KLFANILYTP PFLILDAAGA VLALPAAALG AVVDAARK*
```

Computer analysis of this amino acid sequence gave the following results:
Homology with a Predicted ORF from *N. gonorrhoeae*
ORF 516 shows 90.0% identity over a 231 aa overlap with a predicted ORF (ORF 516.ng) from *N. gonorrhoeae*:

```
   m516/g516
                   10         20         30         40         50         60
      m516.pep  MLFRKTTAAVLAATLMLNGCTLMLWGMNNPVSETITRKHVDKDQIRAFGVVAEDNAQLEK
                ||||||||||||||||:|||||:|| |||||||:||||||||||||||||||||||||||
         g516  MLFRKTTAAVLAATLILNGCTMMLRGMNNPVSQTITRKHVDKDQIRAFGVVAEDNAQLEK
                   10         20         30         40         50         60

70         80         90        100        110        120
      m516.pep  GSLVMMGGKYWFVVNPEDSADLTGILKAGLDKPFQIVEDTPSYARHQALPVKLESPGSQN
                |||||||||||||:|||||||||||:|||||||||||||||||||||||||||::|||||
         g516  GSLVMMGGKYWFAVNPEDSADLTGLLKAGLDKPFQIVEDTPSYARHQALPVKKEAPGSQN
                   70         80         90        100        110        120

130        140        150        160        170        180
      m516.pep  FSTEGLCLRYDTDKPADIAKLKQLGFEAVKLDNRTIYTRCVSAKGKYYATPQKLNADYHF
                ||| ||||||||||:|||||||||:|||||||||||||||||||||||||||||||||||
         g516  FSTGGLCLRYDTGRPDDIAKLKQLEFKAVKLDNRTIYTRCVSAKGKYYATPQKLNADYHF
                  130        140        150        160        170        180

190        200        210        220        230       239
      m516.pep  EQSVPADIYYTVTEEHTDKSKLFANILYTPPFLILDAAGAVLALPAAALGAVVDAARK
                ||||||||||||||:|||||||||:|||||||:||||||:|||| :||  | ::|:
         g516  EQSVPADIYYTVTEKHTDKSKLFGNILYTPPLILDAAAAVLVLPMALIAAANSSDK
                  190        200        210        220        230
```

The following partial DNA sequence was identified in *N. meningitidis* <SEQ ID 1433>:

```
a516.seq
  1 ATGTTGTTCC GTAAAACGAC CGCCGCCGTT TTGGCGGCAA CCTTGATGTT

51 GAACGGCTGT ACGGTAATGA TGTGGGGTAT GAACAGCCCG TTCAGCGAAA

101 CGACCGCCCG CAAACACGTT GACAAGGACC AAATCCGCGC CTTCGGTGTG
```

-continued
```
151 GTTGCCGAAG ACAATGCCCA ATTGGAAAAG GGCAGCCTGG TGATGATGGG

201 CGGGAAATAC TGGTTCGTCG TCAATCCTGA AGATTCGGCG AAGCTGACGG

251 GCATTTTGAA GGCCGGGTTG GACAAGCAGT TTCAAATGGT TGAGCCCAAC

301 CCGCGCTTTG CCTACCAAGC CCTGCCGGTC AAACTCGAAT CGCCCGCCAG

351 CCAGAATTTC AGTACCGAAG GCCTTTGCCT GCGCTACGAT ACCGACAGAC

401 CTGCCGACAT CGCCAAGCTG AAACAGCTTG AGTTTGAAGC GGTCGAACTC

451 GACAATCGGA CCATTTACAC GCGCTGCGTC TCCGCCAAAG GCAAATACTA

501 CGCCACACCG CAAAAACTGA ACGCCGATTA TCATTTTGAG CAAAGTGTGC

551 CTGCCGATAT TTATTACACG GTTACGAAAA AACATACCGA CAAATCCAAG

601 TTGTTTGAAA ATATTGCATA TACGCCCACC ACGTTGATAC TGGATGCGGT

651 GGGCGCGGTG CTGGCCTTGC CTGTCGCGGC GTTGATTGCA GCCACGAATT

701 CCTCAGACAA ATGA
```

This corresponds to the amino acid sequence <SEQ ID 1434; ORF 516.a>:

```
a516.pep
  1 MLFRKTTAAV LAATLMLNGC TVMMWGMNSP FSETTARKHV DKDQIRAFGV

51 VAEDNAQLEK GSLVMMGGKY WFVVNPEDSA KLTGILKAGL DKQFQMVEPN

101 PRFAYQALPV KLESPASQNF STEGLCLRYD TDRPADIAKL KQLEFEAVEL

151 DNRTIYTRCV SAKGKYYATP QKLNADYHFE QSVPADIYYT VTKKHTDKSK

201 LFENIAYTPT TLILDAVGAV LALPVAALIA ATNSSDK*
``` m516/a516 86.1% identity in 238 aa overlap

```
                  10         20         30         40         50         60
  m516.pep  MLFRKTTAAVLAATLMLNGCTLMLWGMNNPVSETITRKHVDKDQIRAFGVVAEDNAQLEK
            |||||||||||||||||||:::||||:|||| :|||||||||||||||||||||||||||
  a516      MLFRKTTAAVLAATLMLNGCTVMMWGMNSPFSETTARKHVDKDQIRAFGVVAEDNAQLEK
                  10         20         30         40         50         60

70         80         90        100        110        120
  m516.pep  GSLVMMGGKYWFVVNPEDSAKLTGILKAGLDKPFQIVEDTPSYARHQALPVKLESPGSQN
            ||||||||||||||||||||||||||||||||| ||:|| :| :|||||||||||:|||
  a516      GSLVMMGGKYWFVVNPEDSAKLTGILKAGLDKQFQMVEPNPRFA-YQALPVKLESPASQN
                  70         80         90        100        110        120

130        140        150        160        170        180
  m516.pep  FSTEGLCLRYDTDKPADIAKLKQLGFEAVKLDNRTIYTRCVSAKGKYYATPQKLNADYHF
            |||||||||||||:|||||||||| |||:||||||||||||||||||||||||||||||
  a516      FSTEGLCLRYDTDRPADIAKLKQLEFEAVELDNRTIYTRCVSAKGKYYATPQKLNADYHF
                     120        130        140        150        160        170

190        200        210        220        230      239
  m516.pep  EQSVPADIYYTVTEEHTDKSKLFANILYTPPFLILDAAGAVLALPAAALGAVVDAARKX
            ||||||||||||::||||||||  || |||  ||||:||||||||:|||  |:::: ||
  a516      EQSVPADIYYTVTKKHTDKSKLFENIAYTPTTLILDAVGAVLALPVAALIAATNSSDKX
                180        190        200        210        220        230
```

The following partial DNA sequence was identified in *N. gonorrhoeae* <SEQ ID 1435>:

```
g517.seq
  1 atgcatcggg tttcagacgg cattggagtg tcagtcgtgt tctgccgatt 51 cgtaggcttc gacgatttt tgcaccagag gatgccggac aacgtcttcg 101 ccggtgaagg tatggaaata cagtcctgcc acgccgtgca gtttctcacg 151 tgcgtctttc aatcccgatt tgatgttttt gggcaggtcg atttggctgg
```

-continued
```
 201 tgtcgccggt aatgacggct ttcgcgccga agccgatgcg ggtcaggaac 251 attttcattt gttcgggcgt ggtgttttgc gcttcgtcga ggatgatgta 301 tgcgccgttg agcgtcctgc cgcgcatata ggcgagcggg gcgatttcaa 351 tcaggccttt ttcaatcagc ttggttacac ggtcaaagcc catcaggtca 401 tagagggcat cataaagcgg acggaggtag gggtcgactt tttgggtcag 451 gtctccgggc aggaagccca gtttctcacc ggcttcgacg gcaggccgaa 501 ctaa
```

This corresponds to the amino acid sequence <SEQ ID 1436; ORF 517.ng>:

```
g517.pep
   1 MHRVSDGIGV SVVFCRFVGF DDFLHQRMPD NVFAGEGMEI QSCHAVQFLT

51 CVFQSRFDVF GQVDLAGVAG NDGFRAEADA GQEHFHLFGR GVLRFVEDDV

101 CAVERPAAHI GERGDFNQAF FNQLGYTVKA HQVIEGIIKR TEVGVDFLGQ

151 VSGQEAQFLT GFDGRPN*
```

The following partial DNA sequence was identified in *N. meningitidis* <SEQ ID 1437>:

```
m517.seq
   1 ATGCATCGGG TTTCAGACGG CATTGGAATG TCAGTCGTGT TCTGCCGATT

51 CGTAGGCTTC GACGATTTTT TGCACCAAAG GATGCCGGAC AACGTCTTCG

101 CCGGTAAAGG TGTGGAAATA CAGCCCTTCC ACGTTGTGCA GTTTCTCACG

151 CGCATCTTTT AATCCCGATT TGATGTTTTT GGGCAGGTCG ATTTGGCTGG

201 TGTCGCCGGT AATGACGGCT TTCGCGCCGA AGCCGATGCG GGTCAGGAAC

251 ATTTTCATTT GTTCGGGCGT GGTGTTTTGC GCTTCGTCGA GGATGATGTA

301 TGCGCCGTTG AGCGTCCTGC CGCGCATATA GGCGAGCGGG GCGATTTCAA

351 TCAGGCCTTT TTCAATCAGC TTGGTTACAC GGTCAAAGCC CATCAGGTCA

401 TAGAGGGCAT CATAAAGCGG ACGAAGGTAG GGATCGACTT TCTGGGTCAG

451 GTCTCCGGGC AGGAAGCCCA GTTTCTCGCC GGCTTCGACG GCTGgGCGCA

501 CTAA
```

This corresponds to the amino acid sequence <SEQ ID 1438; ORF 517>:

```
m517.pep
   1 MHRVSDGIGM SVVFCRFVGF DDFLHQRMPD NVFAGKGVEI QPFHVVQFLT

51 RIFXSRFDVF GQVDLAGVAG NDGFRAEADA GQEHFHLFGR GVLRFVEDDV

101 CAVERPAAHI GERGDFNQAF FNQLGYTVKA HQVIEGIIKR TKVGIDFLGQ

151 VSGQEAQFLA GFDGWAH*
```

Computer analysis of this amino acid sequence gave the following results:
Homology with a Predicted ORF from *N. gonorrhoeae*
ORF 517 shows 92.7% identity over a 164 aa overlap with a predicted ORF (ORF 517.ng) from *N. gonorrhoeae*:

```
m517/g517

10        20        30        40        50        60
    m517.pep   MHRVSDGIGMSVVFCRFVGFDDFLHQRMPDNVFAGKGVEIQPFHVVQFLTRIFXSRFDVF
               ||||||||:||||||||||||||||||||||||||:|:|||  |:|||||  :|  ||||||
    g517       MHRVSDGIVSVVFCRFVGFDDFLHQRMPDNVFAGEGMEIQSCHAVQFLTCVFQSRFDVF
                      10        20        30        40        50        60

70        80        90       100       110       120
    m517.pep   GQVDLAGVAGNDGFRAEADAGQEHFHLFGRGVLRFVEDDVCAVERPAAHIGERGDFNQAF
               ||||||||||||||||||||||||||||||||||||||||||||||||||||||||||||
    g517       GQVDLAGVAGNDGFRAEADAGQEHFHLFGRGVLRFVEDDVCAVERPAAHIGERGDFNQAF
                      70        80        90       100       110       120

130       140       150       160
    m517.pep   FNQLGYTVKAHQVIEGIIKRTKVGIDFLGQVSGQEAQFLAGFDGWAH
               |||||||||||||||||||||:||:||||||||||||||:||||
    g517       FNQLGYTVKAHQVIEGIIKRTEVGVDFLGQVSGQEAQFLTGFDGRPN
                     130       140       150       160
```

The following partial DNA sequence was identified in *N. meningitidis* <SEQ ID 1439>:

```
a517.seq
   1 ATGCATCGGG TTTCAGACGG CATTGGAATG TCAGTCGTGT TCTGCCGATT

51 CGTAGGCTTC GACGATTTTT TGCACCAAAG GATGCCGGAC AACGTCTTCG

101 CCGGTAAAGG TGTGGAAATA CAGCCCTTCC ACGCCGTGCA GTTTCTCACG

151 CGCATCTTTT AATCCCGATT TGATGTTTTT GGGCAGGTCG ATTTGGCTGG

201 TGTCGCCGGT AATGACGGCT TTCGCGCCGA AGCCGATGCG GGTCAGGAAC

251 ATTTTCATTT GTTCGGGCGT GGTGTTTTGC GCTTCGTCGA GGATGATGTA

301 TGCGCCGTTG AGCGTCCTGC CGCGCATATA GGCGAGCGGG GCAATCTCAA

351 TCAGACCTTT TTCAATCAGC TTGGTGACAC GGTCGAAGCC CATCAGGTCA

401 TAGAGGGCAT CATAAAGCGG ACGAAGGTAG GGATCGACTT TCTGGGTCAG

451 GTCACCGGGC AGAAAACCCA GTTTCTCGCC GGCTTCGACG GCAGGCCGCA

501 CTAA
```

This corresponds to the amino acid sequence <SEQ ID 1440; ORF 517.a>:

```
a517.pep

1 MHRVSDGIGM SVVFCRFVGF DDFLHQRMPD NVFAGKGVEI QPFHAVQFLT

51 RAF*SRFDVF GQVDLAGVAG NDGFRAEADA GQEHFHLFGR GVLRFVEDDV

101 CAVERPAAHI GERGNLNQTF FNQLGDTVEA HQVIEGIIKR TKVGIDFLGQ

151 VTGQKTQFLA GFDGRPH* m517/a517   93.4% identity in 167 aa overlap 10        20        30        40        50        60
    m517.pep   MHRVSDGIGMSVVFCRFVGFDDFLHQRMPDNVFAGKGVEIQPFHVVQFLTRIFXSRFDVF
               ||||||||||||||||||||||||||||||||||||||||||||:|||||||||||||||
    a517       MHRVSDGIGMSVVFCRFVGFDDFLHQRMPDNVFAGKGVEIQPFHAVQFLTRIFXSRFDVF
                      10        20        30        40        50        60

70        80        90       100       110       120
    m517.pep   GQVDLAGVAGNDGFRAEADAGQEHFHLFGRGVLRFVEDDVCAVERPAAHIGERGDFNQAF
               |||||||||||||||||||||||||||||||||||||||||||||||||||||::||:|
    a517       GQVDLAGVAGNDGFRAEADAGQEHFHLFGRGVLRFVEDDVCAVERPAAHIGERGNLNQTF
                      70        80        90       100       110       120
```

```
                   130         140         150         160
m517.pep   FNQLGYTVKAHQVIEGIIKRTKVGIDFLGQVSGQEAQFLAGFDGWAHX
           ||||| ||:||||||||||||||||||||||||:||::|||||||| ||
a517       FNQLGDTVEAHQVIEGIIKRTKVGIDFLGQVTGQKTQFLAGFDGRPHX
                   130         140         150         160
```

The following partial DNA sequence was identified in *N. gonorrhoeae* <SEQ ID 1441>:

```
g518.seq
    1 atgacgtttt cggcggcaaa gctcaacatt tcggcactga tgttgtgtct 51 ttcggcagga atgaccgttt tactttccgc ttttttactg ctccgaccgg 101 aaggcagcat cttattcaac cattttttca gcataaatat tctgacccga 151 agagcggcat ctccacgggc aaccgtgttc agactgcatc aggcggtacg 201 attccacaag atgccgaaaa ccataagcaa atgcgtaga aactacgccg 251 tccgaatcac gccgcctcct cgggcggcaa cgcttcatta taacagattg 301 ccccttaaaa aatcagaccc tgcttttgtg gcggagtctg aaatttga
```

This corresponds to the amino acid sequence <SEQ ID 1442; ORF 518.ng>:

```
g518.pep
    1 MTFSAAKLNI SALMLCLSAG MTVLLSAFLL LRPEGSILFN HFFSINILTR

51 RAASPRATVF RLHQAVRFHK MPKTISKMRR NYAVRITPPP RAATLHYNRL

101 PLKKSDPAFV AESEI*
```

The following partial DNA sequence was identified in *N. meningitidis* <SEQ ID 1443>:

```
m518.seq
    1 ATGACGTTTT CGGCGGCAAA GCTCAACATT TCGGCACGGA TGTTGTGTCT

51 TTCGGCAGGA ATGACCGTTT TACTTTCCGC TTTTTTACTG CTCCGACCGG

101 AAGGCAGCAT CTTATTCAAC CATTTTTTCA GCATAAATAT TCTGACCCGA

151 AGAGCGGCAT CTCCACAGGC AACCGTGTTC AGACGGCATC AGGCGCGGTT

201 TGCAAGATGC CGTACCATAA ACAAAAGGCG TAGAAACTAC GCCGTCCGAA

251 TCACGCCGCC CTCGCG.GCG GCAACGCGTC ATTATAACAG ATTGCCCTCC

301 GCGGCAGGCT TAGTGCGGCG GGAGCGCCGC CGTTGCGCAG TAATATTGTC

351 TAACGGGAGG AAAAAATCAG ACCCTGCTTT TGTGGCAGAG TCTGAAATTT

401 GA
```

This corresponds to the amino acid sequence <SEQ ID 1444; ORF 518>:

```
m518.pep
    1 MTFSAAKLNI SARMLCLSAG MTVLLSAFLL LRPEGSILFN HFFSINILTR

51 RAASPQATVF RRHQARFARC RTINKRRRNY AVRITPPSXA ATRHYNRLPS

101 AAGLVRRERR RCAVILSNGR KKSDPAFVAE SEI*
```

Computer analysis of this amino acid sequence gave the following results:
Homology with a Predicted ORF from *N. gonorrhoeae*
ORF 518 shows 74.1% identity over a 135 aa overlap with a predicted ORF (ORF 518.ng) from *N. gonorrhoeae*:

```
   m518/g518 m518.pep    MTFSAAKLNISARMLCLSAGMTVLLSAFLLLRPEGSILFNHFFSINILTRRAASPQATVF
               ||||||||||||| ||||||||||||||||||||||||||||||||||||||||:|||||
   g518        MTFSAAKLNISALMLCLSAGMTVLLSAFLLLRPEGSILFNHFFSINILTRRAASPRATVF
                       10        20        30        40        50        60

70        80        90       100       110
   m518.pep    RRHQA-RFARC-RTINKRRRNYAVRITPPSXAATRHYNRLPSAAGLVRRERRRCAVILSN
               | ||| || :  :||:| || |||||||||| ||| ||||||
   g518        RLHQAVRFHKMPKTISKMRRNYAVRITPPPRAATLHYNRLPL------------------
                       70        80        90       100

120       130
   m518.pep       GRKKSDPAFVAESEI
                  |||||||||||||||
   g518           --KKSDPAFVAESEI
                         110
```

The following partial DNA sequence was identified in *N. meningitidis* <SEQ ID 1445>:

```
a518.seq
   1 ATGACGTTTT CGGCGGCAAA GCTCAACATT TCGGCACGGA TGTTGTGTCT

51 TTCGGCAGGA ATGACCGTTT TACTTTCCGC TTTTTTACTG CTCCGACCGG

101 AAGGCAGCAT CTTATTCAAC CATTTTTTCA GCATAAATAT TCTAACCCGA

151 AGAGCGGCAT CTCCACGGGC AACCGTGTTC AGACGGCATC AGGCGGTACG

201 ATTCCGCAAG ATGCCGACCA TAAACAAAAG GCGTAGAAAC TACGCCGTCC

251 GAATCACGCC GTCCTCG.CG GCGGCAACGC GTCATTATAA CAGATTGCCC

301 TCC....... .......... .......... .......... ..........

351 .......... ...AAAAAAT CAGACCCTGC TTTTGTGGCA GAGTCTGAAA

401 TTTGA
```

This corresponds to the amino acid sequence <SEQ ID 1446; ORF 518.a>:

```
   a518.pep

1 MTFSAAKLNI SARMLCLSAG MTVLLSAFLL LRPEGSILFN HFFSINILTR

51 RAASPRATVF RRHQAVRFRK MPTINKRRRN YAVRITPSSX AATRHYNRLP

101 S......... .......... .KKSDPAFVA ESEI* m518/a518    79.9% identity in 134 aa overlap 10        20        30        40        50        60
   m518.pep    MTFSAAKLNISARMLCLSAGMTVLLSAFLLLRPEGSILFNHFFSINILTRRAASPQATVF
               ||||||||||||||||||||||||||||||||||||||||||||||||||||||:|||||
   a518        MTFSAAKLNISARMLCLSAGMTVLLSAFLLLRPEGSILFNHFFSINILTRRAASPRATVF
                       10        20        30        40        50        60

70        80        90       100       119
   m518.pep    RRHQA-RFARCRTINKRRRNYAVRITPPSXAATRHYNRLPSAAGLVRRERRRCAVILSNG
               ||||| || :  |||||||||||||| ||||||||||||||
   a518        RRHQAVRFRKMPTINKRRRNYAVRITPSSXAATRHYNRLPS-------------------
                       70        80        90       100

120       130
   m518.pep      RKKSDPAFVAESEIX
                 |||||||||||||||
   a518          -KKSDPAFVAESEIX
                        110
```

The following partial DNA sequence was identified in *N. gonorrhoeae* <SEQ ID 1447>:

```
g519.seq
   1 atggaatttt tcattatctt gttggcagcc gtcgccgttt tcggcttcaa 51 atcctttgtc gtcatccccc agcaggaagt ccacgttgtc gaaaggctcg 101 ggcgtttcca tcgcgccctg acggccggtt tgaatatttt gattcccttt 151 atcgaccgcg tcgcctaccg ccattcgctg aaagaaatcc ctttagacgt 201 acccagccag gtctgcatca cgcgcgataa tacgcaattg actgttgacg 251 gcatcatcta tttccaagta accgatccca aactcgcctc atacggttcg 301 agcaactaca ttatggcaat tacccagctt gcccaaacga cgctgcgttc 351 cgttatcggg cgtatggagt tggacaaaac gtttgaagaa cgcgacgaaa 401 tcaacagtac cgtcgtctcc gccctcgatg aagccgccgg ggcttggggt 451 gtgaaagtcc tccgttacga aatcaaggat ttggttccgc cgcaagaaat 501 ccttcgcgca atgcaggcac aaattaccgc cgaacgcgaa aaacgcgccc 551 gtattgccga atccgaaggc cgtaaaatcg aacaaatcaa ccttgccagt 601 ggtcagcgtg aagccgaaat ccaacaatcc gaaggcgagg ctcaggctgc 651 ggtcaatgcg tccaatgccg agaaaatcgc ccgcatcaac cgcgccaaag 701 gcgaagcgga atccctgcgc cttgttgccg aagccaatgc cgaagccaac 751 cgtcaaattg ccgccgccct tcaaacccaa agcggggcgg atgcggtcaa 801 tctgaagatt gcgggacaat acgttaccgc gttcaaaaat cttgccaaag 851 aagacaatac gcggattaag cccgccaagg ttgccgaaat cgggaaccct 901 aattttcggc ggcatgaaaa attttcgcca gaagcaaaaa cggccaaata 951 a
```

This corresponds to the amino acid sequence <SEQ ID 1448; ORF 519.ng>:

```
g519.pep
   1 MEFFIILLAA VAVFGFKSFV VIPQQEVHVV ERLGRFHRAL TAGLNILIPF

51 IDRVAYRHSL KEIPLDVPSQ VCITRDNTQL TVDGIIYFQV TDPKLASYGS

101 SNYIMAITQL AQTTLRSVIG RMELDKTFEE RDEINSTVVS ALDEAAGAWG

151 VKVLRYEIKD LVPPQEILRA MQAQITAERE KRARIAESEG RKIEQINLAS

201 GQREAEIQQS EGEAQAAVNA SNAEKIARIN RAKGEAESLR LVAEANAEAN

251 RQIAAALQTQ SGADAVNLKI AGQYVTAFKN LAKEDNTRIK PAKVAEIGNP

301 NFRRHEKFSP EAKTAK*
```

The following partial DNA sequence was identified in *N. meningitidis* <SEQ ID 1449>:

```
m519.seq (partial)
   1 ..TCCGTTATCG GCGTATGGA GTTGGACAAA ACGTTTGAAG AACGCGACGA 51    AATCAACAGT ACTGTTGTTG CGGCTTTGGA CGAGGCGGCC GGGgCTTgGG

101    GTGTGAAGGT TTTGCGTTAT GAGATTAAAG ACTTGGTTCC GCCGCAAGAA

151    ATCCTTCGCT CAATGCAGGC GCAAATTACT GCCGAACGCG AAAAACGCGC

201    CCGTATCGCC GAATCCGAAG GTCGTAAAAT CGAACAAATC AACCTTGCCA
```

-continued
```
 251    GTGGTCAGCG CGAAGCCGAA ATCCAACAAT CCGAAGGCGA GGCTCAGGCT

301    GCGGTCAATG CGTCAAATGC CGAGAAAATC GCCCGCATCA ACCGCGCCAA

351    AGGTGAAGCG GAATCCTTGC GCCTTGTTGC CGAAGCCAAT GCCGAAGCCA

401    TCCGTCAAAT TGCCGCCGCC CTTCAAACCC AAGGCGGTGC GGATGCGGTC

451    AATCTGAAGA TTGCGGAACA ATACGTCGCT GCGTTCAACA ATCTTGCCAA

501    AGAAAGCAAT ACGCTGATTA TGCCCGCCAA TGTTGCCGAC ATCGGCAGCC

551    TGATTTCTGC CGGTATGAAA ATTATCGACA GCAGCAAAAC CGCCAAaTAA
```

This corresponds to the amino acid sequence <SEQ ID 1450; ORF 519>:

```
m519.pep (partial)
   1   ..SVIGRMELDK TFEERDEINS TVVAALDEAA GAWGVKVLRY EIKDLVPPQE

51   ILRSMQAQIT AEREKRARIA ESEGRKIEQI NLASGQREAE IQQSEGEAQA

101   AVNASNAEKI ARINRAKGEA ESLRLVAEAN AEAIRQIAAA LQTQGGADAV

151   NLKIAEQYVA AFNNLAKESN TLIMPANVAD IGSLISAGMK IIDSSKTAK*
```

Computer analysis of this amino acid sequence gave the following results:

Homology with a Predicted ORF from *N. gonorrhoeae*
ORF 519 shows 87.5% identity over a 200 aa overlap with a predicted ORF (ORF 519.ng) from *N. gonorrhoeae*:

```
   m519/g519

10         20         30
       m519.pep                   SVIGRMELDKTFEERDEINSTVVAALDEAA
                                  ||||||||||||||||||||||||||||||
       g519       YFQVTDPKLASYGSSNYIMAITQLAQTTLRSVIGRMELDKTFEERDEINSTVVSALDEAA
                          90        100       110       120       130       140
                        40         50         60         70         80         90
       m519.pep   GAWGVKVLRYEIKDLVPPQEILRSMQAQITAEREKRARIAESEGRKIEQINLASGQREAE
                  ||||||||||||||||||||||||:|||||||||||||||||||||||||||||||||||
       g519       GAWGVKVLRYEIKDLVPPQEILRAMQAQITAEREKRARIAESEGRKIEQINLASGQREAE
                         150       160       170       180       190       200
                              100        110        120        130        140        150
       m519.pep   IQQSEGEAQAAVNASNAEKIARINRAKGEAESLRLVAEANAEAIRQIAAALQTQGGADAV
                  ||||||||||||||||||||||||||||||||||||||||||||| ||||||||:|||||
       g519       IQQSEGEAQAAVNASNAEKIARINRAKGEAESLRLVAEANAEANRQIAAALQTQSGADAV
                         210       220       230       240       250       260
                              160        170        180        190        200
       m519.pep   NLKIAEQYVAAFNNLAKESNTLIMPANVADIGSL-ISAGMKIIDSSKTAK
                  |||||  |||:||:||||||:||  ||:||:||:   |:    :||||
       g519       NLKIAGQYVTAFKNLAKEDNTRIKPAKVAEIGNPNFRRHEKFSPEAKTAK
                         270       280       290       300       310
```

The following partial DNA sequence was identified in *N. meningitidis* <SEQ ID 1451>:

```
a519.seq
   1   ATGGAATTTT TCATTATCTT GCTGGCAGCC GTCGTTGTTT TCGGCTTCAA

51   ATCCTTTGTT GTCATCCCAC AGCAGGAAGT CCACGTTGTC GAAAGGCTCG

101   GGCGTTTCCA TCGCGCCCTG ACGGCCGGTT TGAATATTTT GATTCCCTTT

151   ATCGACCGCG TCGCCTACCG CCATTCGCTG AAAGAAATCC CTTTAGACGT

201   ACCCAGCCAG GTCTGCATCA CGCGCGACAA TACGCAGCTG ACTGTTGACG
```

```
251 GTATCATCTA TTTCCAAGTA ACCGACCCCA AACTCGCCTC ATACGGTTCG

301 AGCAACTACA TTATGGCGAT TACCCAGCTT GCCCAAACGA CGCTGCGTTC

351 CGTTATCGGG CGTATGGAAT TGGACAAAAC GTTTGAAGAA CGCGACGAAA

401 TCAACAGCAC CGTCGTCTCC GCCCTCGATG AAGCCGCCGG AGCTTGGGGT

451 GTGAAGGTTT TGCGTTATGA GATTAAAGAC TTGGTTCCGC CGCAAGAAAT

501 CCTTCGCTCA ATGCAGGCGC AAATTACTGC TGAACGCGAA AAACGCGCCC

551 GTATCGCCGA ATCCGAAGGT CGTAAAATCG AACAAATCAA CCTTGCCAGT

601 GGTCAGCGCG AAGCCGAAAT CCAACAATCC GAAGGCGAGG CTCAGGCTGC

651 GGTCAATGCG TCAAATGCCG AGAAAATCGC CCGCATCAAC CGCGCCAAAG

701 GTGAAGCGGA ATCCTTGCGC CTTGTTGCCG AAGCCAATGC CGAAGCCATC

751 CGTCAAATTG CCGCCGCCCT TCAAACCCAA GGCGGTGCGG ATGCGGTCAA

801 TCTGAAGATT GCGGAACAAT ACGTCGCCGC GTTCAACAAT CTTGCCAAAG

851 AAAGCAATAC GCTGATTATG CCCGCCAATG TTGCCGACAT CGGCAGCCTG

901 ATTTCTGCCG GTATGAAAAT TATCGACAGC AGCAAAACCG CCAAATAA
```

This corresponds to the amino acid sequence <SEQ ID 1452; ORF 519.a>:

```
a519.pep

1 MEFFIILLAA VVVFGFKSFV VIPQQEVHVV ERLGRFHRAL TAGLNILIPF

51 IDRVAYRHSL KEIPLDVPSQ VCITRDNTQL TVDGIIYFQV TDPKLASYGS

101 SNYIMAITQL AQYYLRSVIG RMELDKTFEE RDEINSTVVS ALDEAAGAWG

151 VKVLRYEIKD LVPPQEILRS MQAQITAERE KRARIAESEG RKIEQINLAS

201 GQREAEIQQS EGEAQAAVNA SNAEKIARIN RAKGEAESLR LVAEANAEAI

251 RQIAAALQTQ GGADAVNLKI AEQYVAAFNN LAKESNTLIM PANVADIGSL

301 ISAGMKIIDS SKTAK* m519/a519   99.5% identity in 199 aa overlap 10         20         30
m519.pep                            SVIGRMELDKTFEERDEINSTVVAALDEAA
                                    ||||||||||||||||||||||||:||||||
a519        YFQVTDPKLASYGSSNYIMAITQLAQTTLRSVIGRMELDKTFEERDEINSTVVSAALDEA
                 90        100       110       120       130       140

40         50         60         70         80         90
m519.pep    GAWGVKVLRYEIKDLVPPQEILRSMQAQITAEREKRARIAESEGRKIEQINLASGQREAE
            ||||||||||||||||||||||||||||||||||||||||||||||||||||||||||||
a519        GAWGVKVLRYEIKDLVPPQEILRSMQAQITAEREKRARIAESEGRKIEQINLASGQREAE
                 150       160       170       180       190       200

100        110        120        130        140        150
m519.pep    IQQSEGEAQAAVNASNAEKIARINRAKGEAESLRLVAEANAEAIRQIAAALQTQGGADAV
            ||||||||||||||||||||||||||||||||||||||||||||||||||||||||||||
a519        IQQSEGEAQAAVNASNAEKIARINRAKGEAESLRLVAEANAEAIRQIAAALQTQGGADAV
                 210       220       230       240       250       260

160        170        180        190        200
m519.pep    NLKIAEQYVAAFNNLAKESNTLIMPANVADIGSLISAGMKIIDSSKTAKX
            ||||||||||||||||||||||||||||||||||||||||||||||||||
a519        NLKIAEQYVAAFNNLAKESNTLIMPANVADIGSLISAGMKIIDSSKTAKX
                 270       280       290       300       310
```

The following partial DNA sequence was identified in *N. gonorrhoeae* <SEQ ID 1453>:

```
g519-1.seq
    1 ATGGAATTTT TCATTATCTT GTTGGCAGCC GTCGCCGTTT TCGGCTTCAA
```

```
 51 ATCCTTTGTC GTCATCCCCC AGCAGGAAGT CCACGTTGTC GAAAGGCTCG

101 GGCGTTTCCA TCGCGCCCTG ACGGCCGGTT TGAATATTTT GATTCCCTTT

151 ATCGACCGCG TCGCCTACCG CCATTCGCTG AAAGAAATCC CTTTAGACGT

201 ACCCAGCCAG GTCTGCATCA CGCGCGATAA TACGCAATTG ACTGTTGACG

251 GCATCATCTA TTTCCAAGTA ACCGATCCCA AACTCGCCTC ATACGGTTCG

301 AGCAACTACA TTATGGCAAT TACCCAGCTT GCCCAAACGA CGCTGCGTTC

351 CGTTATCGGG CGTATGGAGT TGGACAAAAC GTTTGAAGAA CGCGACGAAA

401 TCAACAGTAC CGTCGTCTCC GCCCTCGATG AAGCCGCCGG GGCTTGGGGT

451 GTGAAAGTCC TCCGTTACGA AATCAAGGAT TTGGTTCCGC CGCAAGAAAT

501 CCTTCGCGCA ATGCAGGCAC AAATTACCGC CGAACGCGAA AAACGCGCCC

551 GTATTGCCGA ATCCGAAGGC CGTAAAATCG AACAAATCAA CCTTGCCAGT

601 GGTCAGCGTG AAGCCGAAAT CCAACAATCC GAAGGCGAGG CTCAGGCTGC

651 GGTCAATGCG TCCAATGCCG AGAAAATCGC CCGCATCAAC CGCGCCAAAG

701 GCGAAGCGGA ATCCCTGCGC CTTGTTGCCG AAGCCAATGC CGAAGCCATC

751 CGTCAAATTG CCGCCGCCCT TCAAACCCAA GGCGGGGCGG ATGCGGTCAA

801 TCTGAAGATT GCGGAACAAT ACGTAGCCGC GTTCAACAAT CTTGCCAAAG

851 AAAGCAATAC GCTGATTATG CCCGCCAATG TTGCCGACAT CGGCAGCCTG

901 ATTTCTGCCG GCATGAAAAT TATCGACAGC AGCAAAACCG CCAAATAA
```

This corresponds to the amino acid sequence <SEQ ID 1454; ORF 519-1.ng>:

```
g519-1.pep
   1 MEFFIILLAA VAVFGFKSFV VIPQQEVHVV ERLGRFHRAL TAGLNILIPF

51 IDRVAYRHSL KEIPLDVPSQ VCITRDNTQL TVDGIIYFQV TDPKLASYGS

101 SNYIMAITQL AQTTLRSVIG RMELDKTFEE RDEINSTVVS ALDEAAGAWG

151 VKVLRYEIKD LVPPQEILRA MQAQITAERE KRARIAESEG RKIEQINLAS

201 GQREAEIQQS EGEAQAAVNA SNAEKIARIN RAKGEAESLR LVAEANAEAI

251 RQIAAALQTQ GGADAVNLKI AEQYVAAFNN LAKESNTLIM PANVADIGSL

301 ISAGMKIIDS SKTAK*
```

The following partial DNA sequence was identified in *N. meningitidis* <SEQ ID 1455>:

```
m519-1.seq
   1 ATGGAATTTT TCATTATCTT GTTGGTAGCC GTCGCCGTTT TCGGTTTCAA

51 ATCCTTTGTT GTCATCCCAC AACAGGAAGT CCACGTTGTC GAAAGGCTGG

101 GGCGTTTCCA TCGCGCCCTG ACGGcCGGTT TGAATATTTT GATTCCCTTT

151 ATCGACCGCG TCGCCTACCG CCATTCGCTG AAAGAAATCC CTTTAGACGT

201 ACCCAGCCAG GTCTGCATCA CGCGCGACAA TACGCAGCTG ACTGTTGACG

251 GCATCATCTA TTTCCAAGTA ACCGACCCCA AACTCGCCTC ATACGGTTCG

301 AGCAACTACA TTATGGCGAT TACCCAGCTT GCCCAAACGA CGCTGCGTTC

351 CGTTATCGGG CGTATGGAGT TGGACAAAAC GTTTGAAGAA CGCGACGAAA

401 TCAACAGTAC TGTTGTTGCG GCTTTGGACG AGGCGGCCGG GGCTTGGGGT
```

-continued

```
451 GTGAAGGTTT TGCGTTATGA GATTAAAGAC TTGGTTCCGC CGCAAGAAAT

501 CCTTCGCTCA ATGCAGGCGC AAATTACTGC CGAACGCGAA AAACGCGCCC

551 GTATCGCCGA ATCCGAAGGT CGTAAAATCG AACAAATCAA CCTTGCCAGT

601 GGTCAGCGCG AAGCCGAAAT CCAACAATCC GAAGGCGAGG CTCAGGCTGC

651 GGTCAATGCG TCAAATGCCG AGAAAATCGC CCGCATCAAC CGCGCCAAAG

701 GTGAAGCGGA ATCCTTGCGC CTTGTTGCCG AAGCCAATGC CGAAGCCATC

751 CGTCAAATTG CCGCCGCCCT TCAAACCCAA GGCGGTGCGG ATGCGGTCAA

801 TCTGAAGATT GCGGAACAAT ACGTCGCTGC GTTCAACAAT CTTGCCAAAG

851 AAAGCAATAC GCTGATTATG CCCGCCAATG TTGCCGACAT CGGCAGCCTG

901 ATTTCTGCCG GTATGAAAAT TATCGACAGC AGCAAAACCG CCAAATAA
```

This corresponds to the amino acid sequence <SEQ ID 1456; ORF 519-1>:

```
m519-1.

1 MEFFIILLVA VAVFGFKSFV VIPQQEVHVV ERLGRFHRAL TAGLNILIPF

51 IDRVAYRHSL KEIPLDVPSQ VCITRDNTQL TVDGIIYFQV TDPKLASYGS

101 SNYIMAITQL AQTTLRSVIG RMELDKTFEE RDEINETVVA ALDEAAGAWG

151 VKVLRYEIKD LVPPQEILRS MQAQITAERE KRARIAESEG RKIEQINLAS

201 GQREAEIQQS EGEAQAAVNA SNAEKIARIN RAKGEAESLR LVAEANAEAI

251 RQIAAALQTQ GGADAVNLKI AEQYVAAFNN LAKESNTLIM PANVADIGSL

301 ISAGMKIIDS SKTAK* m519-1/g519-1 99.0% identity in 315 aa overlap 10         20         30         40         50         60
g519-1.pep  MEFFIILLAAVAVFGFKSFVVIPQQEVHVVERLGRFHRALTAGLNILIPFIDRVAYRHSL
            ||||||||:|||||||||||||||||||||||||||||||||||||||||||||||||||
m519-1      MEFFIILLVAVAVFGFKSFVVIPQQEVHVVERLGRFHRALTAGLNILIPFIDRVAYRHSL
               10         20         30         40         50         60

70         80         90        100        110        120
g519-1.pep  KEIPLDVPSQVCITRDNTQLTVDGIIYFQVTDPKLASYGSSNYIMAITQLAQTTLRSVIG
            ||||||||||||||||||||||||||||||||||||||||||||||||||||||||||||
m519-1      KEIPLDVPSQVCITRDNTQLTVDGIIYFQVTDPKLASYGSSNYIMAITQLAQTTLRSVIG
               70         80         90        100        110        120

130        140        150        160        170        180
g519-1.pep  RMELDKTFEERDEINSTVVSALDEAAGAWGVKVLRYEIKDLVPPQEILRAMQAQITAERE
            ||||||||||||||||:|||||||||||||||||||||||||||||||||:|||||||||
m519-1      RMELDKTFEERDEINSTVVAALDEAAGAWGVKVLRYEIKDLVPPQEILRSMQAQITAERE
              130        140        150        160        170        180

190        200        210        220        230        240
g519-1.pep  KRARIAESEGRKIEQINLASGQREAEIQQSEGEAQAAVNASNAEKIARINRAKGEAESLR
            ||||||||||||||||||||||||||||||||||||||||||||||||||||||||||||
m519-1      KRARIAESEGRKIEQINLASGQREAEIQQSEGEAQAAVNASNAEKIARINRAKGEAESLR
              190        200        210        220        230        240

250        260        270        280        290        300
g519-1.pep  LVAEANAEAIRQIAAALQTQGGADAVNLKIAEQYVAAFNNLAKESNTLIMPANVADIGSL
            ||||||||||||||||||||||||||||||||||||||||||||||||||||||||||||
m519-1      LVAEANAEAIRQIAAALQTQGGADAVNLKIAEQYVAAFNNLAKESNTLIMPANVADIGSL
              250        260        270        280        290        300

310
g519-1.pep  ISAGMKIIDSSKTAKX
            |||||||||||||||
m519-1      ISAGMKIIDSSKTAKX
              310
```

The following partial DNA sequence was identified in *N. meningitidis* <SEQ ID 1457>:

```
a519-1.seq
   1 ATGGAATTTT TCATTATCTT GCTGGCAGCC GTCGTTGTTT TCGGCTTCAA

51 ATCCTTTGTT GTCATCCCAC AGCAGGAAGT CCACGTTGTC GAAAGGCTCG

101 GGCGTTTCCA TCGCGCCCTG ACGGCCGGTT TGAATATTTT GATTCCCTTT

151 ATCGACCGCG TCGCCTACCG CCATTCGCTG AAAGAAATCC CTTTAGACGT

201 ACCCAGCCAG GTCTGCATCA CGCGCGACAA TACGCAGCTG ACTGTTGACG

251 GTATCATCTA TTTCCAAGTA ACCGACCCCA AACTCGCCTC ATACGGTTCG

301 AGCAACTACA TTATGGCGAT TACCCAGCTT GCCCAAACGA CGCTGCGTTC

351 CGTTATCGGG CGTATGGAAT TGGACAAAAC GTTTGAAGAA CGCGACGAAA

401 TCAACAGCAC CGTCGTCTCC GCCCTCGATG AAGCCGCCGG AGCTTGGGGT

451 GTGAAGGTTT TGCGTTATGA GATTAAAGAC TTGGTTCCGC CGCAAGAAAT

501 CCTTCGCTCA ATGCAGGCGC AAATTACTGC TGAACGCGAA AAACGCGCCC

551 GTATCGCCGA ATCCGAAGGT CGTAAAATCG AACAAATCAA CCTTGCCAGT

601 GGTCAGCGCG AAGCCGAAAT CCAACAATCC GAAGGCGAGG CTCAGGCTGC

651 GGTCAATGCG TCAAATGCCG AGAAAATCGC CCGCATCAAC CGCGCCAAAG

701 GTGAAGCGGA ATCCTTGCGC CTTGTTGCCG AAGCCAATGC CGAAGCCATC

751 CGTCAAATTG CCGCCGCCCT TCAAACCCAA GGCGGTGCGG ATGCGGTCAA

801 TCTGAAGATT GCGGAACAAT ACGTCGCCGC GTTCAACAAT CTTGCCAAAG

851 AAAGCAATAC GCTGATTATG CCCGCCAATG TTGCCGACAT CGGCAGCCTG

901 ATTTCTGCCG GTATGAAAAT TATCGACAGC AGCAAAACCG CCAAATAA
```

This corresponds to the amino acid sequence <SEQ ID 1458; ORF 519-1.a>:

```
m519-1.pep.

1 MEFFIILLVA VVVFGFKSFV VIPQQEVHVV ERLGRFHRAL TAGLNILIPF

51 IDRVAYRHSL KEIPLDVPSQ VCITRDNTQL TVDGIIYFQV TDPKLASYGS

101 SNYIMAITQL AQTTLRSVIG RMELDKTFEE RDEINETVVS ALDEAAGAWG

151 VKVLRYEIKD LVPPQEILRS MQAQITAERE KRARIAESEG RKIEQINLAS

201 GQREAEIQQS EGEAQAAVNA SNAEKIARIN RAKGEAESLR LVAEANAEAI

251 RQIAAALQTQ GGADAVNLKI AEQTVAAFNN LAKESNTLIM PANVADIGSL

301 ISAGMKIIDS SKTAK* m519-1/a519-1 99.0% identity in 315 aa overlap 10        20        30        40        50        60
a519-1.pep   MEFFIILLAAVVVFGFKSFVVIPQQEVHVVERLGRFHRALTAGLNILIPFIDRVAYRHSL
             ||||||||:||:||||||||||||||||||||||||||||||||||||||||||||||||
m519-1       MEFFIILLVAVAVFGFKSFVVIPQQEVHVVERLGRFHRALTAGLNILIPFIDRVAYRHSL
                   10        20        30        40        50        60

70        80        90       100       110       120
a519-1.pep   KEIPLDVPSQVCITRDNTQLTVDGIIYFQVTDPKLASYGSSNYIMAITQLAQTTLRSVIG
             ||||||||||||||||||||||||||||||||||||||||||||||||||||||||||||
m519-1       KEIPLDVPSQVCITRDNTQLTVDGIIYFQVTDPKLASYGSSNYIMAITQLAQTTLRSVIG
                   70        80        90       100       110       120

130       140       150       160       170       180
a519-1.pep   RMELDKTFEERDEINSTVVSALDEAAGAWGVKVLRYEIKDLVPPQEILRSMQAQITAERE
             |||||||||||||||||||:||||||||||||||||||||||||||||||||||||||||
m519-1       RMELDKTFEERDEINSTVVAALDEAAGAWGVKVLRYEIKDLVPPQEILRSMQAQITAERE
                  130       140       150       160       170       180
```

```
190       200        210        220        230        240
a519-1.pep  KRARIAESEGRKIEQINLASGQREAEIQQSEGEAQAAVNASNAEKIARINRAKGEAESLR
            ||||||||||||||||||||||||||||||||||||||||||||||||||||||||||||
m519-1      KRARIAESEGRKIEQINLASGQREAEIQQSEGEAQAAVNASNAEKIARINRAKGEAESLR
            190       200        210        220        230        240
250       260        270        280        290        300
a519-1.pep  LVAEANAEAIRQIAAALQTQGGADAVNLKIAEQYVAAFNNLAKESNTLIMPANVADIGSL
            ||||||||||||||||||||||||||||||||||||||||||||||||||||||||||||
m519-1      LVAEANAEAIRQIAAALQTQGGADAVNLKIAEQYVAAFNNLAKESNTLIMPANVADIGSL
            250       260        270        280        290        300
310
a519-1.pep  ISAGMKIIDSSKTAKX
            ||||||||||||||||
m519-1      ISAGMKIIDSSKTAKX
            310
```

Expression of ORF 519

The primer described in Table 1 for ORF 519 was used to locate and clone ORF 519. ORF 519 was cloned in pET and pGex vectors and expressed in *E. coli* as above described. The products of protein expression and purification were analyzed by SDS-PAGE. FIG. 4A shows the results of affinity purification, and FIG. 4B shows the expression in *E. coli*. Purified Nis-fusion protein was used to immunize mice whose sera were used for ELISA (positive result), FACS analysis (FIG. 4C), western blot (FIG. 1E), and a bactericidal assay (FIG. 4D). These experiments confirm that 519 is a surface-exposed protein and that it is a useful immunogen. The hydrophilicity plots, antigenic index, and amphipatic regions of ORF 519 are provided in FIG. 8. The AMPHI program is used to predict putative T-cell epitopes (Gao et al 1989, *J. Immunol* 143: 3007; Roberts et al. 1996, *AIDS Res Human Retroviruses* 12:593; Quakyi et al. 1992, *Scand J Immunol Suppl* 11:9). The nucleic acid sequence of ORF 519 and the amino acid sequence encoded thereby as provided herein.

The following partial DNA sequence was identified in *N. gonorrhoeae* <SEQ ID 1459>:

```
g520.seq
   1 atgcctgcgc ttctttcaat acgtcgggca aacgcgctgc ctttttcgcg 51 catttcggaa aggatgaagt tgctggtgcc gttaataatg ccggcgatgg 101 atttaatcct gtttgccgcc aaaccttcgc gcacggcttt gatgattggg 151 ataccgcccg ctactgccgc ttcaaattgg acgatgacgt tttgttttc 201 cgccagcggg aagatttcgt tgccgtattc ggcgagcagt ttttgttgg 251 cggtaacgat gtgtttgccg ttttcaatgg ctttcaacac cgcttctttg 301 gcaatgcccg tgccgccgaa caattcgacc aagacatcga cgtctttacg 351 cgcgaacagt tcgaacggat cttttgacaa gggcgggcga cgggccgatt 401 ttggcgggct ttttcttcgc ttaagtcgca catggcagaa atacggattt 451 cgcgccccaa gcggcgggaa atttcctctg cgttgtcccg caacacggca 501 gccgcaccgc cgccgaccgt acctaagcct aaaagaccga tgtttactgg 551 cttcattgtg tctccttgta agccgactga aatgtaaata ttga
```

This corresponds to the amino acid sequence <SEQ ID 1460; ORF 520.ng>:

```
g520.pep
   1 MPALLSIRRA NALPFSRISE RMKLLVPLIM PAMDLILFAA KPSRTALMIG

51 IPPATAASNW TMTFCFSASG KISLPYSASS FLLAVTMCLP FSMAFNTASL

101 AMPVPPNNST KTSTSLRANS SNGSFDKGGR RADFGGLFLR LSRTWQKYGF

151 RAPSGGKFPL RCPATRQPHR RRPYLSLKDR CLLASLCLLV SRLKCKY*
      60
```

The following partial DNA sequence was identified in *N. meningitidis* <SEQ ID 1461>:

```
m520.seq
   1 ATGCCTGCGC TTCTTTCAGT ACATCG.GCA AACGCGCTGC CTTTTTCGCG
```

```
 51 CATTTCGGrk AGGATGAAGT TGCTGGTGCC GTTAATAATG CCGGCGATGG

101 ATTTAATCCT GTTTGCCGCC AAACCTTCGC GCAGGGCTTT GATGATTGGG

151 ATACCGCCCG CTACTGCCGC TTCAAATTGG ACGATGACGT TTTGTTTTTC

201 CGCCAGCGGG AAGATTTCGT TGCCGTATTC GGCGAGCAGT TTTTTGTTGG

251 CGGTAACGAT GTGTTTGCCG TTTTCAATGG CTTTCAACAC CGCATCTTTG

301 GCAATGCCGG TACCGCCGaA CAATTCGACG ACGACATCGA CGTCTTCACG

351 TGCGACCAGT TCGAACGGAT CTTTGACAAA GGCTGc.CGG ACGGGCAGGT

401 TTGTCGGGCT TTTTCTTCAC TCAAATCGCA CACGGCAGAA ATACGGATTT

451 CGCGCCCCAA GCGACGGGAA ATTTCCTCCG CGTTGTCsCG CAACACGGCA

501 GCCGTACCGC CGCCGACCGT ACCCAAACCT AAAAGACCGA TGTTTACTGG

551 CTTCATTGTG TCTCCTTGTA AGCCGACTGA AATGTAAATA TTGA
```

This corresponds to the amino acid sequence <SEQ ID 1462; ORF 520>:

```
m520.pep
   1 MPALLSVHXA NALPFSRISX RMKLLVPLIM PAMDLILFAA KPSRRALMIG

51 IPPATAASNW TMTFCFSASG KISLPYSASS FLLAVTMCLP FSMAFNTASL

101 AMPVPPNNST TTSTSSRATS SNGSLTKAXR TGRFVGLFLH SNRTRQKYGF

151 RAPSDGKFPP RCXATRQPYR RRPYPNLKDR CLLASLCLLV SRLKCKY*
```

Computer analysis of this amino acid sequence gave the following results:

Homology with a Predicted ORF from *N. gonorrhoeae*
ORF 520 shows 87.3% identity over a 197 aa overlap with a predicted ORF (ORF 520.ng) from *N. gonorrhoeae*:

```
    m520/g520
                     10         20         30         40         50         60
        m520.pep  MPALLSVHRANALPFSRISXRMKLLVPLIMPAMDLILFAAKPSRRALMIGIPPATAASNW
                  ||||||::||||||||||| ||||||||||||||||||||||| |||||||||||||||
        g520      MPALLSIRRANALPFSRISERMKLLVPLIMPAMDLILFAAKPSRTALMIGIPPATAASNW
                     10         20         30         40         50         60

70         80         90        100        110        120
        m520.pep  TMTFCFSASGKISLPYSASSFLLAVTMCLPFSMAFNTASLAMPVPPNNSTTTSTSSRATS
                  |||||||||||||||||||||||||||||||||||||||||||| |||| |||| ||:|
        g520      TMTFCFSASGKISLPYSASSFLLAVTMCLPFSMAFNTASLAMPVPPNNSTKTSTSLRANS
                     70         80         90        100        110        120

130        140        150        160        170        180
        m520.pep  SNGSLTKAARTGRFVGLFLHSNRTRQKYGFRAPSDGKFPPRCXATRQPYRRRPYPNLKDR
                  ||||: |::|  : |  ||||: :|| ||||||||| ||| || ||||||:|||| :|||
        g520      SNGSFDKGGRRADFGGLFLRLSRTWQKYGFRAPSGGKFPLRCPATRQPHRRRPYLSLKDR
                    130        140        150        160        170        180

190
        m520.pep  CLLASLCLLVSRLKCKY
                  |||||||||||||||||
        g520      CLLASLCLLVSRLKCKY
                    190
```

The following partial DNA sequence was identified in *N. meningitidis* <SEQ ID 1463>:

```
a520.seq
   1 ATGCCTGCGC TTCTTTCAGT ACATCGG.CA AACGCGCTGC CTTTTTCGCG

51 CATTTCGGAG AGGATGAAGT TGCTGGTGCC GTTAATAATG CCGGCGATGG
```

-continued

```
101 ATTTAATCCT GTTTGCCGCC AAACCTTCGC GCAGGGCTTT GATGATTGGG

151 ATACCGCCCG CTACTGCCGC TTCAAATTGG ACGATGACGT TTTGTTTTTC

201 CGCCAGCGGG AAGATTTCGT TGCCGTATTC GGCGAGCAGT TTTTTGTTGG

251 CGGTAACGAT GTGTTTGCCG TTTTCAATGG CTTTCAACAC CGCATCTTTG

301 GCAATGCCGG TACCGCCGAA CAATTCGACG ACGACATCGA CGTCTTCACG

351 TGCGACCAGT TCGAACGGAT CTTTGACAAA GGCTG..CGG ACGGGCAGGT

401 TTGTCGGGCT TTTTCTTCAC TCAAATCGCA CACGGCAGAA ATACGGATTT

451 CGCGCCCCAA GCGACGGGAA ATTTCCTCCG CGTTGTCCCG CAACACGGCA

501 GCCGTACCGC CGCCGACCGT ACCCAAACCT AAAAGACCGA TGTTTACTGG

551 CTTCATTGTG TCTCCTTGTA AGCCGACTGA AATGTAAATA TTGA
```

This corresponds to the amino acid sequence <SEQ ID 1464; ORF 520.a>:

```
a520.pep
  1 MPALLSVHRX NALPFSRISE RMKLLVPLIM PAMDLILFAA KPSRRALMIG

51 IPPATAASNW TMTFCFSASG KISLPYSASS FLLAVTMCLP FSMAFNTASL

101 AMPVPPNNST TTSTSSRATS SNGSLTKAXR TGRFVGLFLH SNRTRQKYGF

151 RAPSDGKFPP RCPATRQPYR RRPYPNLKDR CLLASLCLLV SRLKCKY*
``` m520/a520 98.0% identity in 197 aa overlap

```
              10        20        30        40        50        60
   m520.pep   MPALLSVHXANALPFSRISXRMKLLVPLIMPAMDLILFAAKPSRRALMIGIPPATAASNW
              |||||||| |||||||||| |||||||||||||||||||||||||||||||||||||||
   a520       MPALLSVHRXNALPFSRISERMKLLVPLIMPAMDLILFAAKPSRRALMIGIPPATAASNW
              10        20        30        40        50        60
              70        80        90       100       110       120
   m520.pep   TMTFCFSASGKISLPYSASSFLLAVTMCLPFSMAFNTASLAMPVPPNNSTTTSTSSRATS
              ||||||||||||||||||||||||||||||||||||||||||||||||||||||||||||
   a520       TMTFCFSASGKISLPYSASSFLLAVTMCLPFSMAFNTASLAMPVPPNNSTTTSTSSRATS
              70        80        90       100       110       120
             130       140       150       160       170       180
   m520.pep   SNGSLTKAXRTGRFVGLFLHSNRTRQKYGFRAPSDGKFPPRCXATRQPYRRRPYPNLKDR
              ||||||||||||||||||||||||||||||||||||||||||| ||||||||||||||||
   a520       SNGSLTKAXRTGRFVGLFLHSNRTRQKYGFRAPSDGKFPPRCPATRQPYRRRPYPNLKDR
              130       140       150       160       170       180
             190
   m520.pep   CLLASLCLLVSRLKCKYX
              ||||||||||||||||||
   a520       CLLASLCLLVSRLKCKYX
              190
```

50

The following partial DNA sequence was identified in *N. gonorrhoeae* <SEQ ID 1465>:

```
g520-1.seq
  1 ATGAAGTTGC TGGTGCCGTT AATAATGCCG GCGATGGATT TAATCCTGTT

51 TGCCGCCAAA CCTTCGCGCA GGGCTTTGAT GATTGGGATA CCGCCCGCTA

101 CTGCCGCTTC AAATTGGACG ATGACGTTTT GTTTTCCGC CAGCGGGAAG

151 ATTTCGTTGC CGTATTCGGC GAGCAGTTTT TTGTTGGCGG TAACGATGTG

201 TTTGCCGTTT TCAATGGCTT TCAACACCGC TTCTTTGGCA ATGCCCGTGC

251 CGccgAACAA TTCGACGACG ACATCGACGT CTTTACGCGC GACCAGTtCG

301 AACGGATCTT TGACAAAGGC GGCGGACGGG CAGATTTGGC GGGCTTTTTC
```

```
-continued
351 TTCGCTTAAG TCGCACATGG CAGAAATACG GATTTCGCGC CCCAAGCGGC

401 GGGAAATTTC CTCTGCGTTG TCCCGCAACA CGGCAGCCGC ACCGCCGCCG

451 ACCgTACCTA AGCCTAAAAG ACCGATGTTT ACTGGCTTCA TTGTGTCTCC

501 TTGTAAGCCG ACTGAAATGT AA
```

This corresponds to the amino acid sequence <SEQ ID 1466; ORF 520-1.ng>:

```
g520-1.pep
  1 MKLLVPLIMP AMDLILFAAK PSRRALMIGI PPATAASNWT MTFCFSASGK

51 ISLPYSASSF LLAVTMCLPF SMAFNTASLA MPVPPNNSTT TSTSLRATSS

101 NGSLTKAADG QIWRAFSSLK SHMAEIRISR PKRREISSAL SRNTAAAPPP

151 TVPKPKRPMF TGFIVSPCKP TEM*
```

The following partial DNA sequence was identified in *N. meningitidis* <SEQ ID 1467>:

```
m520-1.seq
  1 ATGAAGTTGC TGGTGCCGTT AATAATGCCG GCGATGGATT TAATCCTGTT

51 TGCCGCCAAA CCTTCGCGCA GGGCTTTGAT GATTGGGATA CCGCCCGCTA

101 CTGCCGCTTC AAATTGGACG ATGACGTTTT GTTTTCCGC CAGCGGGAAG

151 ATTTCGTTGC CGTATTCGGC GAGCAGTTTT TTGTTGGCGG TAACGATGTG

201 TTTGCCGTTT TCAATGGCTT TCAACACCGC ATCTTTGGCA ATGCCGGTAC

251 CGCCGAACAA TTCGACGACG ACATCGACGT CTTCACGTGC GACCAGTTCG

301 AACGGATCTT TGACAAAGGC TGCGGACGGG CAGGTTTGTC GGGCTTTTTC

351 TTCACTCAAA TCGCACACGG CAGAAATACG GATTTCGCGC CCCAAGCGAC

401 GGGAAATTTC CTCCGCGTTG TCCCGCAACA CGGCAGCCGT ACCGCCGCCG

451 ACCGTACCCA AACCTAAAAG ACCGATGTTT ACTGGCTTCA TTGTGTCTCC

501 TTGTAAGCCG ACTGAAATGT AA
```

This corresponds to the amino acid sequence <SEQ ID 1468; ORF 520-1>:

```
    m520-1.pep

1 MKLLVPLIMP AMDLILFAAK PSRRALMIGI PPATAASNWT MTFCFSASGK

51 ISLPYSASSF LLAVTMCLPF SMAFNTASLA MPVPPNNSTT TSTSSRATSS

101 NGSLTKAADG QVCRAFSSLK SHTAEIRISR PKRREISSAL SRNTAAVPPP

151 TVPKPKRPMF TGFIVSPCKP TEM* g520-1/m520-1 97.1% identity in 173 aa overlap 10        20        30        40        50        60
g520-1.pep  MKLLVPLIMPAMDLILFAAKPSRRALMIGIPPATAASNWTMTFCFSASGKISLPYSASSF
            ||||||||||||||||||||||||||||||||||||||||||||||||||||||||||||
m520-1      MKLLVPLIMPAMDLILFAAKPSRRALMIGIPPATAASNWTMTFCFSASGKISLPYSASSF
                     10        20        30        40        50        60

70        80        90       100       110       120
g520-1.pep  LLAVTMCLPFSMAFNTASLAMPVPPNNSTTTSTSLRATSSNGSLTKAADGQIWRAFSSLK
            ||||||||||||||||||||||||||||||||| ||||||||||||||||:|||||||
m520-1      LLAVTMCLPFSMAFNTASLAMPVPPNNSTTTSTSSRATSSNGSLTKAADGQVCRAFSSLK
                     70        80        90       100       110       120
```

```
                    130       140       150       160       170
g520-1.pep  SHMAEIRISRPKRREISSALSRNTAAAPPPTVPKPKRPMFTGFIVSPCKPTEMX
            || |||||||||||||||||||||||||:|||||||||||||||||||||||||
m520-1         SHTAEIRISRPKRREISSALSRNTAAVPPPTVPKPKRPMFTGFIVSPCKPTEMX
                    130       140       150       160       170
```

The following partial DNA sequence was identified in *N. meningitidis* <SEQ ID 1469>:

```
a520-1.seq
  1 ATGAAGTTGC TGGTGCCGTT AATAATGCCG GCGATGGATT TAATCCTGTT

51 TGCCGCCAAA CCTTCGCGCA GGGCTTTGAT GATTGGGATA CCGCCCGCTA

101 CTGCCGCTTC AAATTGGACG ATGACGTTTT GTTTTTCCGC CAGCGGGAAG

151 ATTTCGTTGC CGTATTCGGC GAGCAGTTTT TTGTTGGCGG TAACGATGTG

201 TTTGCCGTTT TCAATGGCTT TCAACACCGC ATCTTTGGCA ATGCCGGTAC

251 CGCCGAACAA TTCGACGACG ACATCGACGT CTTCACGTGC GACCAGTTCG

301 AACGGATCTT TGACAAAGGC TGCGGACGGG CAGGTTTGTC GGGCTTTTTC

351 TTCACTCAAA TCGCACACGG CAGAAATACG GATTTCGCGC CCCAAGCGAC

401 GGGAAATTTC CTCCGCGTTG TCCCGCAACA CGGCAGCCGT ACCGCCGCCG

451 ACCGTACCCA AACCTAAAAG ACCGATGTTT ACTGGCTTCA TTGTGTCTCC

501 TTGTAAGCCG ACTGAAATGT AA
```

This corresponds to the amino acid sequence <SEQ ID 1470; ORF 520-1.a>:

```
a520-1.pep

1 MKLLVPLIMP AMDLILFAAK PSRRALMIGI PPATAASNWT MTFCFSASGK

51 ISLPYSASSF LLAVTMCLPF SMAFNTASLA MPVPPNNSTT TSTSSRATSS

101 NGSLTKAADG QVCRAFSSLK SHTAEIRISR PKRREISSAL SRNTAAVPPP

151 TVPKPKRPMF TGFIVSPCKP TEM* m520-1/a520-1 100.0% identity in 173 aa overlap 10        20        30        40        50        60
a520-1.pep  MKLLVPLIMPAMDLILFAAKPSRRALMIGIPPATAASNWTMTFCFSASGKISLPYSASSF
            ||||||||||||||||||||||||||||||||||||||||||||||||||||||||||||
m520-1      MKLLVPLIMPAMDLILFAAKPSRRALMIGIPPATAASNWTMTFCFSASGKISLPYSASSF
                   10        20        30        40        50        60

70        80        90       100       110       120
a520-1.pep  LLAVTMCLPFSMAFNTASLAMPVPPNNSTTTSTSSRATSSNGSLTKAADGQVCRAFSSLK
            ||||||||||||||||||||||||||||||||||||||||||||||||||||||||||||
m520-1      LLAVTMCLPFSMAFNTASLAMPVPPNNSTTTSTSSRATSSNGSLTKAADGQVCRAFSSLK
                   70        80        90       100       110       120

130       140       150       160       170
a520-1.pep  SHTAEIRISRPKRREISSALSRNTAAVPPPTVPKPKRPMFTGFIVSPCKPTEMX
            |||||||||||||||||||||||||||||||||||||||||||||||||||||
m520-1      SHTAEIRISRPKRREISSALSRNTAAVPPPTVPKPKRPMFTGFIVSPCKPTEMX
                   130       140       150       160       170
```

The following partial DNA sequence was identified in *N. gonorrhoeae* <SEQ ID 1471>:

```
g521.seq
  1 ATGAAATCAA AACTCCCCTT AATCCTAATC AACCTTTCCC TGATTTCAAG

51 CCCATTGGGT GCGAATGCGG CCAAAATCTA TACCTGCACA ATCAACGGAG

101 AAACCGTTTA CACCACCAAG CCGTCTAAAA GCTGCCACTC AACCGATTTG
```

```
151 CCCCCAATCG GCAACTACAG CAGCGAACGC TATATCCTGC CCCAAACTCC

201 CGAACCGGCA CCATCACCGT CAAACGGCGG ACAGGCTGTC AAATATAAAG

251 CCCCGGTCAA AACAGTATCC AAGCCGGCAA AATCCAATAC GCCGCCTCAA

301 CAAGCACCTG TAAATAACAG CAGACGCTCC ATTCTcgaag caGaattaag 351 cAatgaacgc aaagccctGa ctGaAGCCCA AAAAATGTTA TCACAagcac 401 gtCtGGCAAA AGGCGgcaAC AtcaaCCatc aaaAaatcaa cgcattgtaa 451 AGCAATGTTt tggacAGACA GCAAAATaTC Caagcactgc aaaGAgAATt

501 GGGACGTATG TAA
```

This corresponds to the amino acid sequence <SEQ ID 1472; ORF 521.ng>:

```
g521n.pep
  1 MKSKLPLILI NLSLISSPLG ANAAKIYTCT INGETVYTTK PSKSCHSTDL

51 PPIGNYSSER YILPQTPEPA PSPSNGGQAV KYKAPVKTVS KPAKSNTPPQ

101 QAPVNNSRRS ILEAELSNER KALTEAQKML SQARLAKGGN INHQKINAL*

151 SNVLDRQQNI QALQRELGRM *
```

The following partial DNA sequence was identified in *N. meningitidis* <SEQ ID 1473>:

```
m521.seq
  1 ATGAAATCAA AACTCCTCTT AATCCTAATC AACTTTTCCC TGATTTCAAG

51 CCCATTGGGT GCGAATGCGG CCAAAATCTA sACCTGCACA ATCAACGGAG

101 AAACCGTTTA CACCAsCAAG CCGTCCAAAA GCTGCCACTC AACCGATTTG

151 CCCCCAATCG GCAACTACAG CAGCGAACGC TATATCCCGC CCCAAACGCC

201 CGAACCGGTA TCATCACCGT CAAACGGCGG ACwGGTTGTC AAATATAAAG

251 CCCCGGTCAA AACAGTATCC AAGCCGGCAA AATCCArTAC GCCGCCGCCG

301 CAACAAGCAC CCTCAAACAA CAGCAGACGC TCCATTCTCG AAACAGAATT

351 GAGCAACGAA CGCAAAGCAT TGGTTGAAGC CCAAAAAATG TTATCACAAG

401 CACGTCTGGC AAAGGGCGGC AACATCAACC ATCAAGAAAT AAATGCATTA

451 CAAAGCAATG TATTGGACAG GCAGCAAAAT ATTCAAGCCC TGCAAAGGGA

501 ACTGGGGCGT ATGTAA
```

This corresponds to the amino acid sequence <SEQ ID 1474; ORF 521>:

```
m521.pep
  1 MKSKLLLILI NFSLISSPLG ANAAKIXTCT INGETVYTXK PSKSCHSTDL

51 PPIGNYSSER YIPPQTPEPV SSPSNGGXVV KYKAPVKTVS KPAKSXTPPP

101 QQAPSNNSRR SILETELSNE RKALVEAQKM LSQARLAKGG NINHQEINAL

151 QSNVLDRQQN IQALQRELGR M*
```

Computer analysis of this amino acid sequence gave the following results:
Homology with a Predicted ORF from *N. gonorrhoeae*
ORF 521 shows 90.6% identity over a 171 aa overlap with a predicted ORF (ORF 521.ng) from *N. gonorrhoeae*:

```
    m521/g521
                       10         20         30         40         50         60
        m521.pep   MKSKLLLILINFSLISSPLGANAAKIXTCTINGETVYTXKPSKSCHSTDLPPIGNYSSER
                   |||||  ||||| :||||||||||||||  ||||||||||| :|||||||||||||||||||
        g521       MKSKLPLILINLSLISSPLGANAAKIYTCTINGETVYTTKPSKSCHSTDLPPIGNYSSER
                       10         20         30         40         50         60

70         80         90        100        110        120
        m521.pep   YIPPQTPEPVSSPSNGGXVVKYKAPVKTVSKPAKSXTPPPQQAPSNNSRRSILETELSNE
                   ||  ||||||: ||||||  :|||||||||||||||  ||| ||||||||||||:|||||
        g521       YILPQTPEPAPSPSNGGQAVKYKAPVKTVSKPAKSNTPP-QQAPVNNSRRSILEAELSNE
                       70         80         90        100        110        120

130        140        150        160        170
        m521.pep   RKALVEAQKMLSQARLAKGGNINHQEINALQSNVLDRQQNIQALQRELGRMX
                   ||||:|||||||||||||||||||||||||:||||  |||||||||||||||||
        g521       RKALTEAQKMLSQARLAKGGNINHQKINALXSNVLDRQQNIQALQRELGRMX
                      120        130        140        150        160        170
```

The following partial DNA sequence was identified in *N. meningitidis* <SEQ ID 1475>:

```
a521.seq
    1 ATGAAATCAA AACTCCCCTT AATCCTAATC AACTTTTCCC TGATTTCAAG

51 CCCATTGGGT GCGAATGCGG CCAAAATCTA CACCTGCACA ATCAACGGAG

101 AAACCGTTTA CACCACCAAG CCGTCCAAAA GCTGCCTCTC AACCGATTTG

151 CCCCCAATCG GCAACTACAG CAGCGAACGC TATATCCCGC CCCAAACATC

201 CGAACCGACA CCATCACCGT CAAACGGCGG ACAGGCTGTC AAATATAAAG

251 CCCCGGTCAA AACAGTATCC AAGCCGGCAA ATCCAATAC GCCGCCGCCG

301 CAACAAGCAC CCTCAAACAA CAGCAGACGC TCCATTCTCG AAACAGAATT

351 GAGCAACGAA CGCAAAGCAT TGGTTGAAGC CCAAAAAATG TTATCACAAG

401 CACGTCTGGC AAAAGGCGGC AACATCAACC ATCAAGAAAT CAACGCATTG

451 CAAAGCAATG TATTGGACAG GCAGCAAAAT ATCCAAGCAC TGCAAAGAGA

501 ATTGGGACGT ATGTAA
```

This corresponds to the amino acid sequence <SEQ ID 1476; ORF 521.a>:

```
a521.pep
    1 MKSKLPLILI NFSLISSPLG ANAAKIYTCT INGETVYTTK PSKSCLSTDL

51 PPIGNYSSER YIPPQTSEPT PSPSNGGQAV KYKAPVKTVS KPAKSNTPPP

101 QQAPSNNSRR SILETELSNE RKALVEAQKM LSQARLAKGG NINHQEINAL

151 QSVLDRQQN IQALQRELGR M*
``` m521/a521 94.2% identity in 171 aa overlap

```
                       10         20         30         40         50         60
        m521.pep   MKSKLLLILINFSLISSPLGANAAKIXTCTINGETVYTXKPSKSCHSTDLPPIGNYSSER
                   |||||  |||||||||||||||||||||  ||||||||| :|||||||| ||||||||||||
        a521       MKSKLPLILINFSLISSPLGANAAKIYTCTINGETVYTTKPSKSCLSTDLPPIGNYSSER
                       10         20         30         40         50         60
```

```
                    70         80         90        100        110        120
m521.pep    YIPPQTPEPVSSPSNGGXVVKYKAPVKTVSKPAKSXTPPPQQAPSNNSRRSILETELSNE
            ||||||  ||: ||||||  |||||||||||||||||||  ||||||||||||||||||||
a521        YIPPQTSEPTPSPSNGGQAVKYKAPVKTVSKPAKSNTPP-QQAPVNNSRRSILEAELSNE
                    70         80         90        100        110        120

130        140        150        160        170
m521.pep    RKALVEAQKMLSQARLAKGGNINHQEINALQSNVLDRQQNIQALQRELGRMX
            ||||||||||||||||||||||||||||||||||||||||||||||||||||
a521        RKALVEAQKMLSQARLAKGGNINHQEINALQSNVLDRQQNIQALQRELGRMX
                   130        140        150        160        170
```

The following partial DNA sequence was identified in *N. gonorrhoeae* <SEQ ID 1477>:

```
g522.seq
  1 atgactgagc cgaaacacga aacgccgacg gaagagcagg ttgccgcgcg 51 caaaaaagca aaagccaaaa tccgcaccat ccgcatttgg gcgtgggtca 101 ttttggcgtt gctcgcttca accgccctgc tctcccaatg cgcgatgtcc 151 aaaccgcagg caaaacagaa aattgtcgag tcttgcatga aaatattcc 201 gtttgctgaa aaatggcaga acgatttgaa agcgcgcggc ttggatgcgg 251 acaatacccg tctcgccgtc gactactgca aatgtatgtg ggagcagcct 301 ttggacggat tgagcgagaa acagatcagc tccttcggca aactcggtgc 351 acaagaacag cttgacctgc tcggcggcgc aaacgcgttt gaaactcgag 401 acaaacaatg tgtcgcggat ttgaaagccg attga
```

This corresponds to the amino acid sequence <SEQ ID 1478; ORF 522.ng>:

```
g522.pep
  1 MTEPKHETPT EEQVAARKKA KAKIRTIRIW AWVILALLAS TALLSQCAMS

51 KPQAKQKIVE SCMKNIPFAE KWQNDLKARG LDADNTRLAV DYCKCMWEQP

101 LDGLSEKQIS SFGKLGAQEQ LDLLGGANAF ETRDKQCVAD LKAD*
```

The following partial DNA sequence was identified in *N. meningitidis* <SEQ ID 1479>:

```
m522.seq
  1 ATGACTGAGC CGAAACACGA AATGCTGACG AAAGAGCAGG TTGCCGCGCG

51 CAAAAAAGCA AAAGCCAAAA TCCGCACCAT CCGCATTTGG GCGTGGGTCA

101 TTTTGGCGTT GCTCGCTTTA ACCGCCCTGC TCTCCCAATG CGCGATGTCC

151 AAACCGCAGG CAAAACAGAA AATTGTCGAG TCTTGCGTGA AGAATATTCC

201 GTTTGCCGAA AAATGGCAAA ACGATTTGCG GGCCCGCGGT TTAGATTCAA

251 ACAATACCCG CCTCGCCGTC GACTACTGCA AATGTATGTG GGAGCAGCCT

301 TTGGACAGAT TGAGCGAGAA ACAGATTAGA TCCTTCGGCA AACTCGGCGC

351 ACAAGAACAG CTTGACCTGC TCGGCGGCGC AAATGCCTTT GAAGCACGTG

401 ACAAGCAGTG TGTTGCCGAT TTGAAATCAG AATAA
```

This corresponds to the amino acid sequence <SEQ ID 1480; ORF 522>:

```
m522.pep
  1 MTEPKHEMLT KEQVAARKKA KAKIRTIRIW AWVILALLAL TALLSQCAMS
```

```
 51 KPQAKQKIVE SCVKNIPFAE KWQNDLRARG LDSNNTRLAV DYCKCMWEQP

101 LDRLSEKQIR SFGKLGAQEQ LDLLGGANAF EARDKQCVAD LKSE*
```

Computer analysis of this amino acid sequence gave the following results:
Homology with a Predicted ORF from *N. gonorrhoeae*
ORF 522 shows 91.0% identity over a 144 aa overlap with a predicted ORF (ORF 522.ng) from *N. gonorrhoeae*:

```
    m522/g522

10         20         30         40         50         60
    m522.pep    MTEPKHEMLTKEQVAARKKAKAKIRTIRIWAWVILALLALTALLSQCAMSKPQAKQKIVE
                |||||||  |:|||||||||||||||||||||||||||| |||||||||||||||||||
    g522        MTEPKHETPTEEQVAARKKAKAKIRTIRIWAWVILALLASTALLSQCAMSKPQAKQKIVE
                       10         20         30         40         50         60

70         80         90        100        110        120
    m522.pep    SCVKNIPFAEKWQNDLRARGLDSNNTRLAVDYCKCMWEQPLDRLSEKQIRSFGKLGAQEQ
                ||:|||||||||||||||:|||||::||||||||||||||||| ||||||| ||||||||
    g522        SCMKNIPFAEKWQNDLKARGLDADNTRLAVDYCKCMWEQPLDGLSEKQISSFGKLGAQEQ
                       70         80         90        100        110        120

130        140
    m522.pep    LDLLGGANAFEARDKQCVADLKSEX
                |||||||||||:|||||||||||::
    g522        LDLLGGANAFETRDKQCVADLKAD
                      130        140
```

The following partial DNA sequence was identified in *N. meningitidis* <SEQ ID 1481>:

```
a522.seq
  1 ATGACTGAGC CGAAACACGA AATGCCGACG GAAGAGCAGG TTGCCGCGCG

51 CAAAAAGCA AAAGCCAAAA TCCGCACCAT CCGCATTTGG GCATGGGTCA

101 TTTTGGCGTT GCTCGCTTCA ACCGCCCTGC TCTCCCAATG CGCGATGTCC

151 AAACCGCAGG CAAAACAGAA AATTGTCGAG TCTTGCGTGA AGAATATTCC

201 GTTTGCCGAA AAATGGCAAA ACGATTTGCG GGCCCGCGGT TTAGATTCAA

251 ACAATACCCG CCTTACCGTC GACTACTGCA AATGTATGTG GGAGCAGCCT

301 TTGGACAGAT TGAGCGAGAA ACAGATTAGT TCCTTCGGCA AACTCGGCGC

351 ACAAGAACAG CTTGACCTGC TCGGCGGCGC AAATGCCTTT GAAACGCGAG

401 ACAAGCAGTG TGTTGCCGAT TTGAAATCAG AATAA
```

This corresponds to the amino acid sequence <SEQ ID 1482; ORF 522.a>:

```
a522.pep
  1 MTEPKHEMPT EEQVAARKKA KAKIRTIRIW AWVILALLAS TALLSQCAMS

51 KPQAKQKIVE SCVKNIPFAE KWQNDLRARG LDSNNTRLTV DYCKCMWEQP

101 LDRLSEKQIS SFGKLGAQEQ LDLLGGANAF ETRDKQCVAD LKSE*
``` m522/a522 95.8% identity in 144 aa overlap

```
                       10         20         30         40         50         60
    m522.pep    MTEPKHEMLTKEQVAARKKAKAKIRTIRIWAWVILALLALTALLSQCAMSKPQAKQKIVE
                |||||||  |:|||||||||||||||||||||||||||| |||||||||||||||||||
    a522        MTEPKHEMPTEEQVAARKKAKAKIRTIRIWAWVILASLASTALLSQCAMSKPQAKQKIVE
                       10         20         30         40         50         60
```

```
                    70         80         90        100        110        120
m522.pep   SCVKNIPFAEKWQNDLRARGLDSNNTRLAVDYCKCMWEQPLDRLSEKQIRSFGKLGAQEQ
           ||||||||||||||||||||||||||||||||:|||||||||||||||| ||||||||
a522       SCVKNIPFAEKWQNDLRARGLDSNNTRLTVDYCKCMWEQPLDGLSEKQISSFGKLGAQEQ
                    70         80         90        100        110        120
                   130        140
m522.pep   LDLLGGANAFEARDKQCVADLKSEX
           ||||||||||||:||||||||||||
a522       LDLLGGANAFETRDKQCVADLKSEX
                   130        140
```

The following partial DNA sequence was identified in *N. gonorrhoeae* <SEQ ID 1483>:

```
g523.seq
   1 atgactgtat ggtttgttgc cgctgttgcc gtcttaatca tcgaattatt 51 gacgggaacg gtttatcttt tggttgtcag cgcggctttg gcgggttcgg 101 gcattgccta cgggctgact ggcagcacgc ctgccgccgt cttgaccgcc 151 gcactgcttt ccgcgctggg catttggttc gtacatgcca aaaccgccgt 201 gggaaaagtt gaaacggatt catatcagga tttggatacc ggaaaatatg 251 ccgaaatcct ccgatacaca ggcggcaacc gttacgaagt tttttatcgc 301 ggtacgcact ggcaggcgca aaatacgggg caggaagtgt ttgaaccggg 351 aacgcgcgcc ctcatcgtcc gcaaagaagg taaccttctt atcatcgcaa 401 acccttaa
```

This corresponds to the amino acid sequence <SEQ ID 1484; ORF 523.ng>:

```
g523.pep
   1 MTVWFVAAVA VLIIELLTGT VYLLVVSAAL AGSGIAYGLT GSTPAAVLTA

51 ALLSALGIWF VHAKTAVGKV ETDSYQDLDT GKYAEILRYT GGNRYEVFYR

101 GTHWQAQNTG QEVFEPGTRA LIVRKEGNLL IIANP*
```

The following partial DNA sequence was identified in *N. meningitidis* <SEQ ID 1485>:

```
m523.seq (partial)
   1 ..GCCGTCTTAA TCATCGAATT ATTGACGGGA ACGGTTTATC TTTTGGTTGT 51    nAGCGCGGCT TTGGCGGGTT CGGGCATTGC TTACGGGCTG ACCGGCAGTA 101    CGCCTGCCGC CGTCTTGACC GnCGCTCTGC TTTCCGCGCT GGGTATTTnG

151    TTCGTACACG CCAAAACCGC CGTTAGAAAA GTTGAAACGG ATTCATATCA

201    GGATTTGGAT GCCGGACAAT ATGTCGAAAT CCTCCGACAC ACAGGCGGCA

251    ACCGTTACGA AGTTTTtTAT CGCGGTACGc ACTGGCAGGC TCAAAATACG

301    GGGCAAGAAG AGCTTGAACC AGGAACTCGC GCCCTCATTG TCCGCAAGGA

351    AGGCAACCTT CTTATTATCA CACACCCTTAA
```

This corresponds to the amino acid sequence <SEQ ID 1486; ORF 523>:

```
m523.pep (partial)
   1   ..AVLIIELLTG TVYLLVVSAA LAGSGIAYGL TGSTPAAVLT XALLSALGIX
```

```
 51  FVHAKTAVRK VETDSYQDLD AGQYVEILRH TGGNRYEVFY RGTHWQAQNT

101  GQEELEPGTR ALIVRKEGNL LIITHP*
```

Computer analysis of this amino acid sequence gave the following results:

Homology with a Predicted ORF from *N. gonorrhoeae*

ORF523 shows 91.3% identity over a 126 aa overlap with a predicted ORF (ORF 523.ng) from *N. gonorrhoeae*:

```
m523/g523

10         20         30         40         50
   m523.pep            AVLIIELLTGTVYLLVVSAALAGSGIAYGLTGSTPAAVLTXALLSALGIXF
                       ||||||||||||||||||||||||||||||||||||||| ||||||||| |
   g523      MTVWFVAAVAVLIIELLTGTVYLLVVSAALAGSGIAYGLTGSTPAAVLTAALLSALGIWF
                10         20         30         40         50         60

60         70         80         90        100        110
   m523.pep   VHAKTAVRKVETDSYQDLDAGQYVEILRHTGGNRYEVFYRGTHWQAQNTGQEELEPGTRA
              ||||||| |||||||||||| : : : |||| :|||||||||||||||||||| : |||||
   g523       VHAKTAVGKVETDSYQDLDTGKYAEILRYTGGNRYEVFYRGTHWQAQNTGQEVFEPGTRA
                70         80         90        100        110        120

120
   m523.pep   LIVRKEGNLLIITHP
              ||||||||||||: :|
   g523       LIVRKEGNLLIIANPX
                130
```

The following partial DNA sequence was identified in *N. meningitidis* <SEQ ID 1487>:

```
a523.seq
  1 ATGACTGTAT GGTTTGTTGC CGCTGTTGCC GTCTTAATCA TCGAATTATT

51 GACGGGAACG GTTTATCTTT TGGTTGTCAG CGCGGCTTTG GCGGGTTCGG

101 GCATTGCTTA CGGGCTGACC GGCAGCACGC CTGCCGCCGT CTTGACCGCC

151 GCTCTGCTTT CCGCGCTGGG TATTTGGTTC GTACACGCCA AAACCGCCGT

201 GGGAAAAGTT GAAACGGATT CATATCAGGA TTTGGATGCC GGGCAATATG

251 CCGAAATCCT CCGGCACGCA GGCGGCAACC GTTACGAAGT TTTTTATCGC

301 GGTACGCACT GGCAGGCTCA AAATACGGGG CAAGAAGAGC TTGAACCAGG

351 AACGCGCGCC CTAATCGTCC GCAAGGAAGG CAACCTTCTT ATCATCGCAA

401 AACCTTAA
```

This corresponds to the amino acid sequence <SEQ ID 1488; ORF 523.a>:

```
a523.pep
  1 MTVWFVAAVA VLIIELLTGT VYLLVVSAAL AGSGIAYGLT GSTPAAVLTA

51 ALLSALGIWF VHAKTAVGKV ETDSYQDLDA GQYAEILRHA GGNRYEVFYR

101 GTHWQAQNTG QEELEPGTRA LIVRKEGNLL IIAKP*
``` m523/a523 94.4% identity in 126 aa overlap

```
                       10         20         30         40         50
   m523.pep            AVLIIELLTGTVYLLVVSAALAGSGIAYGLTGSTPAAVLTXALLSALGIXF
                       ||||||||||||||||||||||||||||||||||||||| ||||||||| |
   a523      MTVWFVAAVAVLIIELLTGTVYLLVVSAALAGSGIAYGLTGSTPAAVLTAALLSALGIWF
                10         20         30         40         50         60
```

```
                  60         70         80         90        100        110
m523.pep    VHAKTAVRKVETDSYQDLDAGQYVEILRHTGGNRYEVFYRGTHWQAQNTGQEELEPGTRA
            ||||||| |||||||||||||||:||||:|||||||||||||||||||||||| |||||
a523        VHAKTAVGKVETDSYQDLDAGQYAEILRHAGGNRYEVFYRGTHWQAQNTGQEVFEPGTRA
                  70         80         90        100        110        120

120
m523.pep    LIVRKEGNLLIITHPX
            ||||||||||||::||
a523        LIVRKEGNLLIIAKPX
                 130
```

The following partial DNA sequence was identified in *N. gonorrhoeae* <SEQ ID 1489>:

```
g525.seq
   1 atgaagtacg tccggttatt tttcctcggc acggcactcg ccggcactca 51 agcggcggct gccgaaatgg ttcaaatcga aggcggcagc taccgcccgc 101 tttatctgaa aaaagatacc ggcctgatta aagtcaaacc gttcaaactg 151 gataaatatc ccgttaccaa tgccgagttt gccgaatttg tcaacagcca 201 cccccaatgg caaaaaggca ggatcggttc caaacaggca gaacccgctt 251 acctgaagca ttggatgaaa aacggcagcc gcagctatgc gccgaaggcg 301 ggcgaattga acagccggt taccaatatt tcctggtttg ccgccaacgc 351 ctattgcgcc gcacaaggca aacgcctgcc gaccatcgac gaatgggaat 401 ttgccggact tgcttccgcc acgcagaaaa aacggctcaa acgaacccgg 451 ctacaaccgc actattctcg attggtatgc cgacggcgga cggaaaggcc 501 tgcacgatgt cggcaaagca ccgcccgaac tactggggtg tttatgatat 551 gcacgggctg a
```

This corresponds to the amino acid sequence <SEQ ID 1490; ORF 525.ng>:

```
g525.pep
   1 MKYVRLFFLG TALAGTQAAA AEMVQIEGGS YRPLYLKKDT GLIKVKPFKL

51 DKYPVTNAEF AEFVNSHPQW QKGRIGSKQA EPAYLKHWMK NGSRSYAPKA

101 GELKQPVTNI SWFAANAYCA AQGKRLPTID EWEFAGLASA TQKKRLKRTR

151 LQPHYSRLVC RRRTERPARC RQSTARTTGV FMICTG *
```

The following partial DNA sequence was identified in *N. meningitidis* <SEQ ID 1491>:

```
m525.seq
   1 ATGAAGTATG TCCGGTTATT TTwCCTCGGC GCGGCACTCG cCrrCACTCA

51 ArCGGCGGCT GcCGAAATGG TTCAAATCGA AGGCGGCAgC TACCGCCCrC

101 TTTATCTGAA AAAAGATACC GGCCTGATTA AAGTCAAACC GTTCAAACTG

151 GATAAATATC CCGTTACCAA TGCCGAGTTT GCCGAATTTG TCAACAGCCA

201 CCCCCAATGG CAAAAAGGCA GGATCGGTTC CAAACAGGCA GAACCCGCTT

251 ACCTGAAGCA TTGGATGAAA AACGGCAGCC GCAGCTATGc GCCGAAGgCG

301 GgCGAATTAA ACAACCGGT AACCAATGTT TCCTGGwTTG CCGCCAAcGC

351 CTAtTGCGCC GCACAAGGCA AACGCCTGCC GACCATTGAC GAATGGGAAT

401 TTGCCGGACT TGCTTCCGCC ACGCAGAAAA A.CGGCTCAA ACGAACCCGG
```

```
451 CTACAACCGC ACTATTCTCG ATTGGTATGC CGACGGCGGA CGGAAAGGCC

501 TGCACGATGT CGGCA.AAGG CCGCCCGAAC TACTGGGGCG TTTATGATAT

551 GCACGGGCTG A
```

This corresponds to the amino acid sequence <SEQ ID 1492; ORF 525>:

```
m525.pep
  1 MKYVRLFXLG AALAXTQXAA AEMVQIEGGS YRPLYLKKDT GLIKVKPFKL

51 DKYPVTNAEF AEFVNSHPQW QKGRIGSKQA EPAYLKHWMK NGSRSYAPKA

101 GELKQPVTNV SWXAANAYCA AQGKRLPTID EWEFAGLASA TQKXRLKRTR

151 LQPHYSRLVC RRRTERPARC RXKAARTTGA FMICTG*
```

Computer analysis of this amino acid sequence gave the following results:

Homology with a Predicted ORF from *N. gonorrhoeae*
ORF 525 shows 94.1% identity over a 186 aa overlap with a predicted ORF (ORF 525.ng) from *N. gonorrhoeae*:

```
m525/g525

10         20         30         40         50         60
    m525.pep    MKYVRLFXLGAALAXTQXAAAEMVQIEGGSYRPLYLKKDTGLIKVKPFKLDKYPVTNAEF
                |||||||  ||:||| || ||||||||||||||||||||||||||||||||||||||||
    g525        MKYVRLFFLGTALAGTQAAAAEMVQIEGGSYRPLYLKKDTGLIKVKPFKLDKYPVTNAEF
                         10         20         30         40         50         60

70         80         90        100        110        120
    m525.pep    AEFVNSHPQWQKGRIGSKQAEPAYLKHWMKNGSRSYAPKAGELKQPVTNVSWXAANAYCA
                ||||||||||||||||||||||||||||||||||||||||||||||||||:|||||||||
    g525        AEFVNSHPQWQKGRIGSKQAEPAYLKHWMKNGSRSYAPKAGELKQPVTNISWFAANAYCA
                         70         80         90        100        110        120

130        140        150        160        170        180
    m525.pep    AQGKRLPTIDEWEFAGLASATQKXRLKRTRLQPHYSRLVCRRRTERPARCRXKAARTTGA
                |||||||||||||||||||||||||||||||||||||||||||||||||||::||||:
    g525        AQGKRLPTIDEWEFAGLASATQKKRLKRTRLQPHYSRLVCRRRTERPARCRQSTARTTGV
                        130        140        150        160        170        180 m525.pep    FMICTGX
                |||||||
    g525        FMICTGX
```

The following partial DNA sequence was identified in *N. meningitidis* <SEQ ID 1493>:

```
a525.seq
  1 ATGAAGTTTA CCCGGTTACT CTTTCTCTGT GCGGCACTCG CCGGCACTCA

51 AGCGGCAGCT GCCGAAATGG TTCAAATCGA AGGCGGCAGC TACCGCCCGC

101 TTTATCTGAA AAAAGATACC GGCCTGATTA AAGTCAAACC GTTCAAACTG

151 GATAAATATC CCGTTACCAA TGCCGAGTTT GCCGAATTTG TCAACAGCCA

201 CCCCCAATGG CAAAAAGGCA GGATCGGTTC CAAACAGGCA GAACCCGCTT

251 ACCTGAAGCA TTGGATGAAA AACGGCAGCC GCAGCTATGC GCCGAAGGCG

301 GGCGATTTAA AACAACCGGT AACCAATGTT TCCTGGTTCG CCGCCAACGC

351 CTATTGCGCC GCACAAGGCA AACGCCTGCC GACCATTGAC GAATGGGAAT

401 TTGCCGGACT TGCCTCCGCC ACGCAG.AAA AACGGCTCAA ACGAACCCGG

451 CTACAACCGC ACTATTCTCG ACTGGTATGC GGATGGCGAC CGGAAAGACC

501 TGCACGATGT CGGCAAAG.G TCGCCCGAAC TACTGGGGCG TTTATGATAT

551 GCACGGTCTG A
```

This corresponds to the amino acid sequence <SEQ ID 1494; ORF 525.a>:

```
a525.pep
  1 MKFTRLLFLC AALAGTQAAA AEMVQIEGGS YRPLYLKKDT GLIKVKPFKL

51 DKYPVTNAEF AEFVNSHPQW QKGRIGSKQA EPAYLKHWMK NGSRSYAPKA

101 GDLKQPVTNV SWFAANAYCA AQGKRLPTID EWEFAGLASA TQXKRLKRTR

151 LQPHYSRLVC GWRPERPARC RQXVARTTGA FMICTV*
``` m525/a525 90.8% identity in 185 aa overlap

```
                   10         20         30         40         50         60
    m525.pep   MKYVRLFXLGAALAXTQXAAAEMVQIEGGSYRPLYLKKDTGLIKVKPFKLDKYPVTNAEF
               ||::||: |  |||| || |||||||||||||||||||||||||||||||||||||||
    a525       MKFTRLLFLCAALAGTQAAAAEMVQIEGGSYRPLYLKKDTGLIKVKPFKLDKYPVTNAEF
                   10         20         30         40         50         60
           70         80         90        100        110        120
    m525.pep   AEFVNSHPQWQKGRIGSKQAEPAYLKHWMKNGSRSYAPKAGELKQPVTNVSWXAANAYCA
               |||||||||||||||||||||||||||||||||||||||:|||||||||||| |||||||
    a525       AEFVNSHPQWQKGRIGSKQAEPAYLKHWMKNGSRSYAPKAGDLKQPVTNVSWFAANAYCA
                   70         80         90        100        110        120
          130        140        150        160        170        180
    m525.pep   AQGKRLPTIDEWEFAGLASATQKXRLKRTRLQPHYSRLVCRRRTERPARCRXKAARTTGA
               ||||||||||||||||||||||| |||||||||||||||| ||||||   :|||||
    a525       AQGKRLPTIDEWEFAGLASATQXKRLKRTRLQPHYSRLVCGWRPERPARCRQXVARTTGA
                   130        140        150        160        170        180
    m525.pep   FMICTGX
               |||||
    a525       FMICTVX
```

The following partial DNA sequence was identified in *N. gonorrhoeae* <SEQ ID 1495>:

```
g525-1.seq
  1 ATGAAGTACG TCCGGTTATT TTTCCTCGGC ACGGCACTCG CCGGCACTCA

51 AGCGGCGGCT GCCGAAATGG TTCAAATCGA AGGCGGCAGC TACCGCCCGC

101 TTTATCTGAA AAAGATACC GGCCTGATTA AAGTCAAACC GTTCAAACTG

151 GATAAATATC CCGTTACCAA TGCCGAGTTT GCCGAATTTG TCAACAGCCA

201 CCCCCAATGG CAAAAAGGCA GGATCGGTTC CAAACAGGCA GAACCCGCTT

251 ACCTGAAGCA TTGGATGAAA AACGGCAGCC GCAGCTATGC GCCGAAGGCG

301 GGCGAATTGA ACAGCCGGT TACCAATATT TCCTGGTTTG CCGCCAACGC

351 CTATTGCGCC GCACAAGGCA AACGCCTGCC GACCATCGAC GAATGGGAAT

401 TTGCCGGACT TGCTTCCGCC ACGCAGAAAA ACGGCTCAAA CGAACCCGGC

451 TACAACCGCA CTATTCTCGA TTGGTATGCC GACGGCGGAC GGAAAGGCCT

501 GCACGATGTC GGCAAAGACC GCCCGAACTA CTGGGGTGTT TATGATATGC

551 ACGGGCTGAT TTGGGAATGG ACGGAAGATT TCAACAGCAG CCTGCTTTCT

601 TCCGGCAATG CCAACGCGCA AATGTTTTGC AGCGGCGCAT CTGTCGGGGC

651 GAGCGACTCG TCCAACTATG CCGCCTTCCT CCGCTACGGC ATCCGCACCA

701 GCCTGCAATC CAAATACGTC CTGCACAACT TGGGCTTCCG CTGCGCAAGC

751 CGATAA
```

This corresponds to the amino acid sequence <SEQ ID 1496; ORF 525-1.ng>:

```
g525-1.pep
    1 MKYVRLFFLG TALAGTQAAA AEMVQIEGGS YRPLYLKKDT GLIKVKPFKL

51 DKYPVTNAEF AEFVNSHPQW QKGRIGSKQA EPAYLKHWMK NGSRSYAPKA

101 GELKQPVTNI SWFAANAYCA AQGKRLPTID EWEFAGLASA TQKNGSNEPG

151 YNRTILDWYA DGGRKGLHDV GKDRPNYWGV YDMHGLIWEW TEDFNSSLLS

201 SGNANAQMFC SGASVGASDS SNYAAFLRYG IRTSLQSKYV LHNLGFRCAS

251 R*
```

The following partial DNA sequence was identified in *N. meningitidis* <SEQ ID 1497>:

```
m525-1.seq
    1 ATGAAGTATG TCCGGTTATT TTTCCTCGGC GCGGCACTCG CCGGCACTCA

51 AGCGGCGGCT GCCGAAATGG TTCAAATCGA AGGCGGCAGC TACCGCCCGC

101 TTTATCTGAA AAAAGATACC GGCCTGATTA AGTCAAACC GTTCAAACTG

151 GATAAATATC CCGTTACCAA TGCCGAGTTT GCCGAATTTG TCAACAGCCA

201 CCCCCAATGG CAAAAAGGCA GGATCGGTTC CAAACAGGCA GAACCCGCTT

251 ACCTGAAGCA TTGGATGAAA AACGGCAGCC GCAGCTATGC GCCGAAGGCG

301 GGCGAATTAA ACAACCGGT AACCAATGTT TCCTGGTTTG CCGCCAACGC

351 CTATTGCGCC GCACAAGGCA AACGCCTGCC GACCATTGAC GAATGGGAAT

401 TTGCCGGACT TGCTTCCGCC ACGCAGAAAA ACGGCTCAAA CGAACCCGGC

451 TACAACCGCA CTATTCTCGA TTGGTATGCC GACGGCGGAC GGAAAGGCCT

501 GCACGATGTC GGCAAAGGCC GCCCGAACTA CTGGGGCGTT TATGATATGC

551 ACGGGCTGAT TTGGGAATGG ACGGAAGATT TCAACAGCAG CCTGCTTTCT

601 TCCGGCAATG CCAACGCGCA AATGTTTTGC AGCGGCGCGT CTATCGGGTC

651 GAGCGACTCG TCCAACTATG CCGCCTTCCT CCGCTACGGC ATCCGTACCA

701 GCCTGCAATC CAAATATGTC TTGCACAACT TGGGCTTCCG TTGCACAAGC

751 CGATAA
```

This corresponds to the amino acid sequence <SEQ ID 1498; ORF 525-1>:

```
m525-1.pep
    1 MKYVRLFFLG AALAGTQAAA AEMVQIEGGS YRPLYLKKDT GLIKVKPFKL

51 DKYPVTNAEF AEFVNSHPQW QKGRIGSKQA EPAYLKHWMK NGSRSYAPKA

101 GELKQPVTNV SWFAANAYCA AQGKRLPTID EWEFAGLASA TQKNGSNEPG

151 YNRTILDWYA DGGRKGLHDV GKGRPNYWGV TDMHGLIWEW TEDFNSSLLS

201 SGNANAQMFC SGASIGSSDS SNYAAFLRYG IRTSLQSKYV LHNLGFRCTS

251 R* m525-1/g525-1 97.6% identity in 251 aa overlap 10         20         30         40         50         60
m525-1.pep  MKYVRLFFLGAALAGTQAAAAEMVQIEGGSYRPLYLKKDTGLIKVKPFKLDKYPVTNAEF
            ||||||||||:||||||||||||||||||||||||||||||||||||||||||||||||
g525-1      MKYVRLFFLGTALAGTQAAAAEMVQIEGGSYRPLYLKKDTGLIKVKPFKLDKYPVTNAEF
              10         20         30         40         50         60
```

-continued

```
70        80        90        100       110       120
m525-1.pep  AEFVNSHPQWQKGRIGSKQAEPAYLKHWMKNGSRSYAPKAGELKQPVTNVSWFAANAYCA
            ||||||||||||||||||||||||||||||||||||||||||||||||:|||||||||||
g525-1      AEFVNSHPQWQKGRIGSKQAEPAYLKHWMKNGSRSYAPKAGELKQPVTNISWFAANAYCA
                    70        80        90        100       110       120

130       140       150       160       170       180
m525-1.pep  AQGKRLPTIDEWEFAGLASATWKNGSNEPGYNRTILDWYADGGRKGLHDVGKGRPNYWGV
            |||||||||||||||||||||||||||||||||||||||||||||||||||| |||||||
g525-1      AQGKRLPTIDEWEFAGLASATWKNGSNEPGYNRTILDWYADGGRKGLHDVGKDRPNYWGV
                    130       140       150       160       170       180

190       200       210       220       230       240
m525-1.pep  YDMHGLIWEWTEDFNSSLLSSGNANAQMFCSGASIGSSDSSNYAAFLRYGIRTSLQSKYV
            ||||||||||||||||||||||||||||||||:|:|||||||||||||||||||||||||
g525-1      YDMHGLIWEWTEDFNSSLLSSGNANAQMFCSGASVGASDSSNYAAFLRYGIRTSLQSKYV
                    190       200       210       220       230       240

250
m525-1.pep  LHNLGFRCTSRX
            ||||||||:|||
g525-1      LHNLGFRCASRX
                    250
```

The following partial DNA sequence was identified in *N. meningitidis* <SEQ ID 1499>:

```
a525-1.seq
  1 ATGAAGTTTA CCCGGTTACT CTTTCTCTGT GCGGCACTCG CCGGCACTCA

51 AGCGGCAGCT GCCGAAATGG TTCAAATCGA AGGCGGCAGC TACCGCCCGC

101 TTTATCTGAA AAAAGATACC GGCCTGATTA AAGTCAAACC GTTCAAACTG

151 GATAAATATC CCGTTACCAA TGCCGAGTTT GCCGAATTTG TCAACAGCCA

201 CCCCCAATGG CAAAAAGGCA GGATCGGTTC CAAACAGGCA GAACCCGCTT

251 ACCTGAAGCA TTGGATGAAA AACGGCAGCC GCAGCTATGC GCCGAAGGCG

301 GGCGATTTAA AACAACCGGT AACCAATGTT TCCTGGTTCG CCGCCAACGC

351 CTATTGCGCC GCACAAGGCA AACGCCTGCC GACCATTGAC GAATGGGAAT

401 TTGCCGGACT TGCCTCCGCC ACGCAGAAAA ACGGCTCAAA CGAACCCGGC

451 TACAACCGCA CTATTCTCGA CTGGTATGCG GATGGCGACC GGAAAGACCT

501 GCACGATGTC GGCAAAGGTC GCCCGAACTA CTGGGGCGTT TATGATATGC

551 ACGGTCTGAT TTGGGAATGG ACGGAAGATT TCAACAGCAG CCTGCTTTCT

601 TCCGGCAATG CCAACGCGCA AATGTTTTGC AGCGGCGCGT CTATCGGGTC

651 GAGCGACTCG TCCAACTATG CCGCCTTCCT CCGCTACGGC ATCCGCACCA

701 GCCTGCAATC CAAATATGTC TTGCACAACT TGGGCTTCCG TTGCACAAGC

751 CGATAA
```

This corresponds to the amino acid sequence <SEQ ID 1500; ORF 525-1.a>:

```
a525-1.pep

1 MKFTRLLFLC AALAGTQAAA AEMVQIEGGS YRPLYLKKDT GLIKVKPFKL

51 DKYPVTNAEF AEFVNSHPQW QKGRIGSKQA EPAYLKHWMK NGSRSYAPKA

101 GDLKQPVTNV SWFAANAYCA AQGKRLPTID EWEFAGLASA TQKNGSNEPG

151 YNRTILDWYA DGDRKDLHDV GKGRPNYWGV YDMHGLIWEW TEDFNSSLLS

201 SGNANAQMFC SGASIGSSDS SNYAAFLRYG IRTSLQSKYV LHNLGFRCTS

251 R*
``` m525-1/a525-1 97.2% identity in 251 aa overlap

```
               10         20         30         40         50         60
m525-1.pep  MKYVRLFFLGAALAGTQAAAAEMVQIEGGSYRPLYLKKDTGLIKVKPFKLDKYPVTNAEF
            ||::||:|| ||||||||||||||||||||||||||||||||||||||||||||||||
a525-1      MKFTRLLFLCTALAGTQAAAAEMVQIEGGSYRPLYLKKDTGLIKVKPFKLDKYPVTNAEF
                       10         20         30         40         50         60

70         80         90        100        110        120
m525-1.pep  AEFVNSHPQWQKGRIGSKQAEPAYLKHWMKNGSRSYAPKAGELKQPVTNVSWFAANAYCA
            |||||||||||||||||||||||||||||||||||||||:||||||||||||||||||||
a525-1      AEFVNSHPQWQKGRIGSKQAEPAYLKHWMKNGSRSYAPKAGDLKQPVTNVSWFAANAYCA
                       70         80         90        100        110        120

130        140        150        160        170        180
m525-1.pep  AQGKRLPTIDEWEFAGLASATQKNGSNEPGYNRTILDWYADGGRKGLHDVGKGRPNYWGV
            |||||||||||||||||||||||||||||||||||||||||||| || |||||| |||||
a525-1      AQGKRLPTIDEWEFAGLASATQKNGSNEPGYNRTILDWYADGDRKDLHDVGKDRPNYWGV
                      130        140        150        160        170        180

190        200        210        220        230        240
m525-1.pep  YDMHGLIWEWTEDFNSSLLSSGNANAQMFCSGASIGSSDSSNYAAFLRYGIRTSLQSKYV
            ||||||||||||||||||||||||||||||||||||||||||||||||||||||||||||
a525-1      YDMHGLIWEWTEDFNSSLLSSGNANAQMFCSGASIGSSDSSNYAAFLRYGIRTSLQSKYV
                      190        200        210        220        230        240

250
m525-1.pep  LHNLGFRCTSRX
            ||||||||||||
a525-1      LHNLGFRCTSRX
                      250
```

The following partial DNA sequence was identified in *N. gonorrhoeae* <SEQ ID 1501>:

```
g527.seq
   1 atggttttac cagtctcctt ttttcagcct gtccagttgg cggcggtcgc
  51 gcttggtcgg tctgccgtcg ggatgggcgg aagtgatgcg gctgaattgg
 101 tcgagctgtt tgcactcttc cctcaatgct gccgttttcg cgtcttcttc
 151 atacagaagc cgcgcctcgg gtgccgggcg gcgttggtgg ttcaaacctt
 201 taaccttgat tttatgggga agggaattga gcgtcaggtc gataatatcg
 251 ccgatgtcta tggttttact gttttgact ttcgagccgt ttacttgaac
 301 cctacccagt tcgatatgct tttgcgcaag ggaacgggtc ttgaaaaaac
 351 gtgccgccca aagccatttg tccagccgca tggcggaaga atcgtgcttg
 401 tctttcatac gattttgttt gaaataattg aatttgtttc gagtttagca
 451 taa
```

This corresponds to the amino acid sequence <SEQ ID 1502; ORF 527.ng>:

```
g527.pep
   1 MVLPVSFFQP VQLAAVALGR SAVGMGGSDA AELVELFALF PQCCRFRVFF
  51 IQKPRLGCRA ALVVQTFNLD FMGKGIERQV DNIADVYGFT VFDFRAVYLN
 101 PTQFDMLLRK GTGLEKTCRP KPFVQPHGGR IVLVFHTILF EIIEFVSSLA
 151 *
```

The following partial DNA sequence was identified in *N. meningitidis* <SEQ ID 1503>:

```
m527.seq
   1 ATGGTTTTAC CAGTCTCCTT TTTTCAGCCT GTCCAGTTGG CGGCGGTCGC
  51 GCTTGGTCGG TCTGCCGTCG GGATAGGCGG AAGTGATGCG GCTGAATTGG
 101 TCGAGCTGTT TGCGCTCTTC CCTCAATGTT GCCGTTwTCG CGTCCTCTTC
```

-continued
```
151 ATACAGAAGC CGCGCyTCGG ATGCCGGGCG GCGTTGGTGG TTCAAACCTT

201 TAACCkTGAT TTTATAGGGA AGGG.AATTk AgCkTCaGTy GrTwATaTCG

251 CsGATGTmTA TGGTTTTACT GTTTTTGACC TTCGAGCCGT TTACTTGAAC

301 CCTACCCAGT TCGATGTGCT TTTGCGCAAG GGAACGGGTC TTGAAAAAAC

351 GTGCCGCCCA AAGCCATTTG TCCAGCCGCA TGGCGGAAGA ATCGTGCTTG

401 TCTTTCATAC GATTTTGTTT GAAATAATTG AATTTGTTTC GAGTTTAGCA

451 TAA
```

This corresponds to the amino acid sequence <SEQ ID 1504; ORF 527>:

```
m527pep
  1 MVLPVSFFQP VQLAAVALGR SAVGIGGSDA AELVELFALF PQCCRXRVLF

51 IQKPRXGCRA ALVVQTFNXD FIGKXNXASV XXIADVYGFT VFDLRAVYLN

101 PTQFDVLLRK GTGLEKTCRP KPFVQPHGGR IVLVFHTILF EIIEFVSSLA

151 *
```

Computer analysis of this amino acid sequence gave the following results:
Homology with a Predicted ORF from *N. gonorrhoeae*
ORF 527 shows 90.0% identity over a 150 aa overlap with a predicted ORF (ORF 527.ng) from *N. gonorrhoeae*:

```
    m527/g527
                       10         20         30         40         50         60
         m527.pep    MVLPVSFFQPVQLAAVALGRSAVGIGGSDAAELVELFALFPQCCRXRVLFIQKPRXGCRA
                    ||||||||||||||||||||||||||||:|||||||||||||||||||||  ||:||||||  ||||
         g527       MVLPVSFFQPVQLAAVALGRSAVGMGGSDAAELVELFALFPQCCRFRVFFIQKPRLGCRA
                       10         20         30         40         50         60

70         80         90        100        110        120
         m527.pep    ALVVQTFNXDFIGKXNXASVXXIADVYGFTVFDLRAVYLNPTQFDVLLRKGTGLEKTCRP
                    ||||||||  ||:||      :|   ||||||||||:|||||||||||||:||||||||||||
         g527       ALVVQTFNLDPMGKGIERQVDNIADVYGFTVFDFRAVYLNPTQFDMLLRKGTGLEKTCRP
                       70         80         90        100        110        120

130        140        150
         m527.pep    KPFVQPHGGRIVLVFHTILFEIIEFVSSLA
                    |||||||||||||||||||||||||||||
         g527       KPFVQPHGGRIVLVFHTILFEIIEFVSSLA
                      130        140        150
```

The following partial DNA sequence was identified in *N. meningitidis* <SEQ ID 1505>:

```
a527.seq
  1 ATGGTTTTAC CAGTCTCCTT TTTTCAGCCT GTCCAGTTGG CGGCGGTCGC

51 GCTTGGTCGG TCTGCCGTCG GGATAGGCGG AAGTGATGCG GCTGAATTGG

101 TCGAGCTGTT TGCGCTCTTC CCTCAATGTT GCCGTTTTCG CGTCCTCTTC

151 ATACAGAAGC CGCGCCTCGG ATGCCGGGCG GCGTTGGTGG TTCAAACCTT

201 TAACCTTGAT TTTATAGGGA AGGGAATTGA GCGTCAGGTC GATAATATCG

251 CCGATGTCTA TGGTTTTACT GTTTTTGACC TTCGAGCCGT TTACTTGAAC

301 CCTACCCAGT TCGATGTGCT TTTGCGCAAG GGAACGGGTC TTGAAAAAAC

351 GTGCCGCCCA AAGCCATTTG TCCAGCCGCA TGGCGGAAGA ATCGTGCTTG
```

```
-continued
401 TCTTTCATAC GATTTTGTTT GAAATAATTG AATTTGTTTC GAGTTTAGCA

451 TAA
```

This corresponds to the amino acid sequence <SEQ ID 1506; ORF 527.a>:

```
a527.pep
  1 MVLPVSFFQP VQLAAVALGR SAVGIGGSDA AELVELFALF PQCCRFRVLF

51 IQKPRLGCRA ALVVQTFNLD FIGKGIERQV DNIADVYGFT VFDLRAVYLN

101 PTQFDVLLRK GTGLEKTCRP KPFVQPHGGR IVLVFHTILF EIIEFVSSLA

151 *
``` m527/a527 93.3% identity in 150 aa overlap

```
                    10         20         30         40         50         60
     m527.pep   MVLPVSFFQPVQLAAVALGRSAVGIGGSDAAELVELFALFPQCCRXRVLFIQKPRXGCRA
                ||||||||||||||||||||||||||||||||||||||||||||| |||||||||| ||||
     a527       MVLPVSFFQPVQLAAVALGRSAVGIGGSDAAELVELFALFPQCCRFRVLFIQKPRLGCRA
                    10         20         30         40         50         60

70         80         90        100        110        120
     m527.pep   ALVVQTFNXDFIGKXNXASVXXIADVYGFTVFDLRAVYLNPTQFDVLLRKGTGLEKTCRP
                |||||||| |||||      :| ||||||||||||||||||||||||||||||||||||||
     a527       ALVVQTFNLDFIGKGIERQVDNIADVYGFTVFDLRAVYLNPTQFDVLLRKGTGLEKTCRP
                    70         80         90        100        110        120

130        140        150
     m527.pep   KPFVQPHGGRIVLVFHTILFEIIEFVSSLAX
                ||||||||||||||||||||||||||||||
     a527       KPFVQPHGGRIVLVFHTILFEIIEFVSSLAX
                   130        140        150
```

The following partial DNA sequence was identified in *N. gonorrhoeae* <SEQ ID 1507>:

```
g528.seq
  1 atggaaattc gggtaataaa atatacggca acggctgcgt tgtttgcatt 51 tacggttgca ggctgccggc tggcggggtg gtatgagtgt ttgtccttgt 101 ccggctggtg taagccgaga aaacctgccg ccatcgattt tgggatatt 151 ggcggcgaga gtccgctgtc tttagaggac tacgagatac cgctttcaga 201 cggcaatcgt tccgtcaggg caaacgaata tgaatccgcg caaaaatctt 251 acttttatag gaaaataggg aagtttgaag cctgcgggtt ggattggcgt 301 acgcgtgacg gcaaaccttt ggttgagagg ttcaaacagg aaggtttcga 351 ctgtttggaa aagcaggggt tgcggcgcaa cggcctgtcc gagcgcgtcc 401 gatggtaa
```

This corresponds to the amino acid sequence <SEQ ID 1508; ORF 528.ng>:

```
g528.pep
  1 MEIRVIKYTA TAALFAFTVA GCRLAGWYEC LSLSGWCKPR KPAAIDFWDI

51 GGESPLSLED YEIPLSDGNR SVRANEYESA QKSYFYRKIG KFEACGLDWR

101 TRDGKPLVER FKQEGFDCLE KQGLRRNGLS ERVRW*
```

The following partial DNA sequence was identified in *N. meningitidis* <SEQ ID 1509>:

```
m528.seq (partial)
   1 ATGGAAATTC GGGCAATAAA ATATACGGCA ATGGCTGCGT TGCTTGCATT

51 TACGGTTGCA GGCTGCCGGC TGGCGGGGTG GTATGAGTGT TCGTCCCTCA

101 CCGGCTGGTG TAAGCCGAGA AAACCGGCTG CCATCGATTT TTGGGATATT

151 GGCGGCGAGA GTCCGCCGTC TTTAGGGGAC TACGAGATAC CGCTTTCAGA

201 CGGCAATAGT TCCGTCAGGG CAAACGAATA TGAATCCGCA CAACAATCTT

251 ACTTTTACAG GAAAATAGGG AAGTTTGAAG C.TGCGGGCT GGATTGGCGT

301 ACGCGTGACG GCAAACCTTT GATTGAGACG TTCAAACAGG GAGGATTTGA

351 CTGCTTGGAA AAG....
```

This corresponds to the amino acid sequence <SEQ ID 1510; ORF 528>:

```
m528.pep (partial)
   1 MEIRAIKYTA MAALLAFTVA GCRLAGWYEC SSLTGWCKPR KPAAIDFWDI

51 GGESPPSLGD YEIPLSDGNS SVRANEYESA QQSYFYRKIG KFEXCGLDWR

101 TRDGKPLIET FKQGGFDCLE K....
```

Computer analysis of this amino acid sequence gave the following results:

Homology with a Predicted ORF from *N. gonorrhoeae*

ORF 528 shows 89.3% identity over a 121 aa overlap with a predicted ORF (ORF 528.ng) from *N. gonorrhoeae*:

```
m528/g528

10        20        30        40        50        60
m528.pep    MEIRAIKYTAMAALLAFTVAGCRLAGWYECSSLTGWCKPRKPAAIDFWDIGGESPPSLGD
            ||||:||||| |||:||||||||||||||| ||:|||||||||||||||||||| || |
g528        MEIRVIKYTATAALFAFTVAGCRLAGWYECLSLSGWCKPRKPAAIDFWDIGGESPLSLED
                    10        20        30        40        50        60

70        80        90       100       110       120
m528.pep    YEIPLSDGNSSVRANEYESAQQSYFYRKIGKFEXCGLDWRTRDGKPLIETFKQGGFDCLE
            ||||||||| |||||||||||:||||||||||| |||||||||||||:| ||| ||||||
g528        YEIPLSDGNRSVRANEYESAQKSYFYRKIGKFEACGLDWRTRDGKPLVERFKQEGFDCLE
                    70        80        90       100       110       120 m528.pep    K
            |
g528        KQGLRRNGLSERVRW
```

The following partial DNA sequence was identified in *N. meningitidis* <SEQ ID 1511>:

```
a528.seq
   1 ATGGAAATTC GGGCAATAAA ATATACGGCA ATGGCTGCGT TGCTTGCATT

51 TACGGTTGCA GGCTGCCGGT TGGCAGGTTG GTATGAGTGT TCGTCCCTGT

101 CCGGCTGGTG TAAGCCGAGA AAACCTGCCG CCATCGATTT TTGGGATATT

151 GGCGGCGAGA GTCCTCCGTC TTTAGAGGAC TACGAGATAC CGCTTTCAGA

201 CGGCAATCGT TCCGTCAGGG CAAACGAATA TGAATCCGCA CAACAATCTT

251 ACTTTTACAG GAAAATAGGG AAGTTTGAAG CCTGCGGGTT GGATTGGCGT

301 ACGCGTGACG GCAAACCTTT GATTGAGACG TTCAAACAGG AAGGTTTTGA
```

-continued

```
351 TTGTTTGAAA AAGCAGGGGT TGCGGCGCAA CGGTCTGTCC GAGCGCGTCC

401 GATGGTAA
```

This corresponds to the amino acid sequence <SEQ ID 1512; ORF 528.a>:

```
a528.pep
  1 MEIRAIKYTA MAALLAFTVA GCRLAGWYEC SSLSGWCKPR KPAAIDFWDI

51 GGESPPSLED YEIPLSDGNR SVRANEYESA QQSYFYRKIG KFEACGLDWR

101 TRDGKPLIET FKQEGFDCLK KQGLRRNGLS ERVRW*
``` m528/a528 95.0% identity in 121 aa overlap

```
                    10         20         30         40         50         60
     m528.pep   MEIRAIKYTAMAALLAFTVAGCRLAGWYECSSLTGWCKPRKPAAIDFWDIGGESPPSLGD
                ||||||||||||||||||||||||||||||||:|||||||||||||||||||||||||| |
     a528       MEIRAIKYTAMAALLAFTVAGCRLAGWYECSSLSGWCKPRKPAAIDFWDIGGESPPSLED
                    10         20         30         40         50         60

70         80         90        100        110        120
     m528.pep   YEIPLSDGNSSVRANEYESAQQSYFYRKIGKFEXCGLDWRTRDGKPLIETFKQGGFDCLE
                ||||||||| |||||||||||||||||||||||| ||||||||||||||||||||:|||:
     a528       YEIPLSDGNRSVRANEYESAQQSYFYRKIGKFEACGLDWRTRDGKPLIETFKQEGFDCLK
                    70         80         90        100        110        120 m528.pep   K
                |
     a528       KQGLRRNGLSERVRWX
                       130
```

The following partial DNA sequence was identified in *N. gonorrhoeae* <SEQ ID 1513>:

```
g528-1.seq
  1 ATGGAAATTC GGGTAATAAA ATATACGGCA ACGGCTGCGT TGTTTGCATT

51 TACGGTTGCA GGCTGCCGGC TGGCGGGGTG GTATGAGTGT TCGTCCTTGT

101 CCGGCTGGTG TAAGCCGAGA AAACCTGCCG CCATCGATTT TTGGGATATT

151 GGCGGCGAGA GTCCGCTGTC TTTAGAGGAC TACGAGATAC CGCTTTCAGA

201 CGGCAATCGT TCCGTCAGGG CAAACGAATA TGAATCCGCG CAAAAATCTT

251 ACTTTTATAG GAAAATAGGG AAGTTTGAAG CCTGCGGGTT GGATTGGCGT

301 ACGCGTGACG GCAAACCTTT GGTTGAGAGG TTCAAACAGG AAGGTTTCGA

351 CTGTTTGGAA AAGCAGGGGT TGCGGCGCAA CGGCCTGTCC GAGCGCGTCC

401 GATGGTAA
```

This corresponds to the amino acid sequence <SEQ ID 1514; ORF 528-1.ng>:

```
g528-1.pep
  1 MEIRVIKYTA TAALFAFTVA GCRLAGWYEC SSLSGWCKPR KPAAIDFWDI

51 GGESPLSLED YEIPLSDGNR SVRANEYESA QKSYFYRKIG KFEACGLDWR

101 TRDGKPLVER FKQEGFDCLE KQGLRRNGLS ERVRW*
```

The following partial DNA sequence was identified in *N. meningitidis* <SEQ ID 1515>:

```
m528-1.seq
    1 ATGGAAATTC GGGCAATAAA ATATACGGCA ATGGCTGCGT TGCTTGCATT

51 TACGGTTGCA GGCTGCCGGC TGGCGGGGTG GTATGAGTGT TCGTCCCTCA

101 CCGGCTGGTG TAAGCCGAGA AAACCGGCTG CCATCGATTT TTGGGATATT

151 GGCGGCGAGA GTCCGCCGTC TTTAGGGGAC TACGAGATAC CGCTTTCAGA

201 CGGCAATCGT TCCGTCAGGG CAAACGAATA TGAATCCGCA CAACAATCTT

251 ACTTTTACAG GAAAATAGGG AAGTTTGAAG CCTGCGGGCT GGATTGGCGT

301 ACGCGTGACG GCAAACCTTT GATTGAGACG TTCAAACAGG GAGGATTTGA

351 CTGCTTGGAA AAGCAGGGGT TGCGGCGCAA CGGTCTGTCC GAGCGCGTCC

401 GATGGTAA
```

This corresponds to the amino acid sequence <SEQ ID 1516; ORF 528-1>:

```
m528-1.pep..

1 MEIRAIKYTA MAALLAFTVA GCRLAGWYEC SSLTGWCKPR KPAAIDFWDI

51 GGESPPSLGD YEIPLSDGNR SVRANEYESA QQSYFYRKIG KFEACGLDWR

101 TRDGKPLIET FKQGGFDCLE KQGLRRNGLS ERVRW* g528-1/m528-1  92.6% identity in 135 aa overlap 10        20        30        40        50        60
g528-1.pep   MEIRVIKYTATAALFAFTVAGCRLAGWYECSSLSGWCKPRKPAAIDFWDIGGESPLSLED
             ||||:|||||  |||:|||||||||||||||||:||||||||||||||||||||| || |
m528-1       MEIRAIKYTAMAALLAFTVAGCRLAGWYECSSLTGWCKPRKPAAIDFWDIGGESPPSLGD
                     10        20        30        40        50        60

70        80        90       100       110       120
g528-1.pep   YEIPLSDGNRSVRANEYESAQKSYFYRKIGKFEACGLDWRTRDGKPLVERFKQEGFDCLE
             |||||||||||||||||||||:||||||||||||||||||||||||:|  ||||:|||||
m528-1       YEIPLSDGNRSVRANEYESAQQSYFYRKIGKFEACGLDWRTRDGKPLIETFKQGGFDCLE
                     70        80        90       100       110       120

130
g528-1.pep   KQGLRRNGLSERVRWX
             ||||||||||||||||
m528-1       KQGLRRNGLSERVRWX
                    130
```

The following partial DNA sequence was identified in *N. meningitidis* <SEQ ID 1517>:

```
a528-1.seq
    1 ATGGAAATTC GGGCAATAAA ATATACGGCA ATGGCTGCGT TGCTTGCATT

51 TACGGTTGCA GGCTGCCGGT TGGCAGGTTG GTATGAGTGT TCGTCCCTGT

101 CCGGCTGGTG TAAGCCGAGA AAACCTGCCG CCATCGATTT TTGGGATATT

151 GGCGGCGAGA GTCCTCCGTC TTTAGAGGAC TACGAGATAC CGCTTTCAGA

201 CGGCAATCGT TCCGTCAGGG CAAACGAATA TGAATCCGCA CAACAATCTT

251 ACTTTTACAG GAAAATAGGG AAGTTTGAAG CCTGCGGGTT GGATTGGCGT

301 ACGCGTGACG GCAAACCTTT GATTGAGACG TTCAAACAGG AAGGTTTTGA

351 TTGTTTGAAA AAGCAGGGGT TGCGGCGCAA CGGTCTGTCC GAGCGCGTCC

401 GATGGTAA
```

This corresponds to the amino acid sequence <SEQ ID 1518; ORF 528-1.a>:

```
a528-1.pep

1  MEIRAIKYTA MAALLAFTVA GCRLAGWYEC SSLSGWCKPR KPAAIDFWDI
     51  GGESPPSLED YEIPLSDGNR SVRANEYESA QQSYFYRKIG KFEACGLDWR
    101  TRDGKPLIET FKQEGFDCLK KQGLRRNGLS ERVRW* a528-1/m528-1  97.0% identity in 135 aa overlap
                        10         20         30         40         50         60
    a528-1.pep  MEIRAIKYTAMAALLAFTVAGCRLAGWYECSSLSGWCKPRKPAAIDFWDIGGESPPSLED
                |||||||||||||||||||||||||||||||:|||||||||||||||||||||||||||| |
    m528-1      MEIRAIKYTAMAALLAFTVAGCRLAGWYECSSLTGWCKPRKPAAIDFWDIGGESPPSLGD
                        10         20         30         40         50         60

70         80         90        100        110        120
    a528-1.pep  YEIPLSDGNRSVRANEYESAQQSYFYRKIGKFEACGLDWRTRDGKPLIETFKQEGFDCLK
                ||||||||||||||||||||||||||||||||||||||||||||||||||||||| ||||:
    m528-1      YEIPLSDGNRSVRANEYESAQQSYFYRKIGKFEACGLDWRTRDGKPLIETFKQGGFDCLE
                        70         80         90        100        110        120

130
    a528-1.pep  KQGLRRNGLSERVRWX
                ||||||||||||||||
    m528-1      KQGLRRNGLSERVRWX
                       130
```

The following partial DNA sequence was identified in *N. gonorrhoeae* <SEQ ID 1519>:

```
g529.seq (partial)
   1 atgacccata tcaaacccgt cattgccgcg ctcgcactca tcgggcttgc
  51 cgcctgctcc ggcagcaaaa ccgaacagcc caagctcgac taccaaagcc
 101 ggtcgcaccg cctgatcaaa ctcgaagtcc cgcctgattt gaacaacccc
 151 gaccaaggca acctctaccg cctgcctgcc ggttcgggag ccgtccgcgc
 201 cggggatttg gaaaaacgcc gcacacccgc cgtccaacag ccagcggatg
 251 ccggaagtat tgaaaagcgt caaaggcgtc cgcttcgagc ggcgacggca
 301 gccaacgcct ggcttgtcgt tgacggcaaa tcccccgccg aaatctccgc
 351 cgctttctg.
```

This corresponds to the amino acid sequence <SEQ ID 1520; ORF 529.ng>:

```
g529.pep (partial)
   1 MTHIKPVIAA LALIGLAACS GSKTEQPKLD YQSRSHRLIK LEVPPDLNNP
  51 DQGNLYRLPA GSGAVRAGDL EKRRTPAVQQ PADAGSIEKR QRRPLRAATA
 101 ANAWLVVDGK SPAEISAAF..
```

The following partial DNA sequence was identified in *N. meningitidis* <SEQ ID 1521>:

```
m529.seq
   1 ATGACCCATA TCAAACCCGT CATTGCCGCG CTCGCACTCA TCGGGCTTGC
  51 CGCCTGCTCC GGCAGCAAAA CCGAACAGCC CAAGCTCGAC TACCAAAGCC
 101 GGTCGCACCG CCTGATCAAA CTTGAAGTCC CACCTGATTT GAAAAACGCC
 151 GACCAAGGCA ACCTCTACCG CCTGCCTGCC GGTTCGGGCG CCGTCCGCGC
```

-continued

```
 201 CAGCGATTTG GAAAAACGCC GCACACCCGC CGTCCAACAG CCTGCCGATG

251 CCGAAGTATT GAAAAGCGTC AAAGGTGTCC GCCTCGAGCG CGACGGCAGC

301 CAACGCTGGC TCGTTGTCGA CGGCAAGTCT CCTGCCGAAA TCTGGCCGCT

351 CCTGAAAGCC TTTTGGCAGG AAAACGGCTT CGACATCAAA TCCGAAGAAC

401 CCGCCATCGG ACAAATGGAA ACCGAGTGGG CGGAAAACCG CGCCAAAATC

451 CCCCAAGACA GCTTGCGCCG CCTCTTCGAC AAAGTCGGCT TGGGCGGCAT

501 CTACTCCACC GGCGAGCGCG ACAAATTCAT CGTCCGTATC GAACAGGGCA

551 AAAACGGCGT TTCCGACATC TTCTTCGCCC ACAAAGCCAT GAAAGAAGTG

601 TACGGCGGCA AAGACAAAGA CACGACCGTA TGGCAGCCCT CCCCGTCCGA

651 TCCCAACCTC GAAGCCGCTT TCCTGACGCG CTTTATGCAA TATTTGGGCG

701 TTGACGGACA GCAGGCGGAA AACGCATCGG CAAAAAAACC TACCCTTCCC

751 GCCGCCAACG AAATGGCGCG TATCGAAGGC AAAAGCCTGA TTGTCTTTGG

801 CGACTACGGC AGAAACTGGC GGCGCACCGT GCTCGCCCTC GACCGCATCG

851 GGCTGACCGT CGTCGGTCAA AACACCGAAC GCCACGCCTT CCTGGTTCAA

901 AAAGCCCCGA ACGAAAGCAA TGCAGTTACC GAACAAAAAC CCGGCCTGTT

951 CAAACGCCTG CTGGGCAAAG GCAAAGCGGA GAAACCTGCC GAACAGCCGG

1001 AACTGATTGT CTATGCAGAA CCTGTCGCCA ACGGCTCGCG CATCGTCCTG

1051 CTCAACAAAG ACGGCAGCGC ATATGCCGGC AAAGACGCAT CCGCATTATT

1101 GGGCAAACTC CATTCCGAAC TGCGTTAA
```

This corresponds to the amino acid sequence <SEQ ID 1522; ORF 529>:

```
m529.pep
  1 MTHIKPVIAA LALIGLAACS GSKTEQPKLD YQSRSHRLIK LEVPPDLNNP

51 DQGNLYRLPA GSGAVRASDL EKRRTPAVQQ PADAEVLKSV KGVRLERDGS

101 QRWLVVDGKS PAEIWPLLKA FWQENGFDIK SEEPAIGQME TEWAENRAKI

151 PQDSLRRLFD KVGLGGIYST GERDKFIVRI EQGKNGVSDI FFAHKAMKEV

201 YGGKDKDTTV WQPSPSDPNL EAAFLTRFMQ YLGVDGQQAE NASAKKPTLP

251 AANEMARIEG KSLIVFGDYG RNWRRTVLAL DRIGLTVVGQ NTERHAFLVQ

301 KAPNESNAVT EQKPGLFKRL LGKGKAEKPA EQPELIVYAE PVANGSRIVL

351 LNKDGSAYAG KDASALLGKL HSELR*
```

Computer analysis of this amino acid sequence gave the following results:
Homology with a Predicted ORF from *N. gonorrhoeae*
ORF 529 shows 83.5% identity over a 115 aa overlap with a predicted ORF (ORF 529.ng) from *N. gonorrhoeae*:

```
g529/m529
                   10         20         30         40         50         60
      g529.pep    MTHIKPVIAALALIGLAACSGSKTEQPKLDYQSRSHRLIKLEVPPDLNNPDQGNLYRLPA
                  ||||||||||||||||||||||||||||||||||||||||||||||||||||||||||||
      m529        MTHIKPVIAALALIGLAACSGSKTEQPKLDYQSRSHRLIKLEVPPDLNNPDQGNLYRLPA
                   10         20         30         40         50         60
```

-continued

```
                      70         80         90        100        110        120
g529.pep      GSGAVRAGDLEKRRTPAVQQPADAGSIEKRQRRPLRAATAANAWLVVDGKSPAEISAAFX
              |||||||:||||||||||||||||  ::: :    |:    ::: |||||||||||
m529          GSGAVRASDLEKRRTPAVQQPADAEVLKSVKGVRLER-DGSQRWLVVDGKSPAEIWPLLK
                      70         80         90         100        110 m529          AFWQENGFDIKSEEPAIGQMETEWAENRAKIPQDSLRRLFDKVGLGGIYSTGERDKFIVR
            120        130        140        150        160        170
```

The following partial DNA sequence was identified in *N. meningitidis* <SEQ ID 1523>:

```
a529.seq
   1  ATGACCCATA TCAAACCCGT CATTGCCGCG CTCGCACTCA TCGGGCTTGC

51  CGCCTGCTCC GGCAGCAAAA CCGAACAGCC CAAGCTCGAC TACCAAAGCC

101  GGTCGCACCG CCTGATCAAA CTCGAAGTCC CACCTGATTT GAAAAACGCC

151  GACCAAGGCA ACCTCTACCG CCTGCCTGCC GGTTCGGGCG CCGTCCGCGC

201  CAGCGATTTG GAAAAACGCC GCACACCCGC CGTCCAACAG CCTGCCGATG

251  CCGAAGTATT GAAAAGCGTC AAAGGTGTCC GCCTCGAGCG CGACGGCAGC

301  CAACGCTGGC TCGTTGTCGA CGGCAAGTCT CATGCCGAAA TCTGGCCGCT

351  CCTGAAAGCC TTTTGGCAGG AAAACGGCTT CGACATCAAA TCCGAAGAAC

401  CCGCCATCGG ACAAATGGAA ACCGAGTGGG CGGAAAACCG TGCCAAAATC

451  CCCCAAGACA GCTTGCGCCG CCTATTCGAC ACAGTCGGTT TGGGCGGCAT

501  CTACTCCACC GGCGAGCGCG ACAAATTCAT CGTCCGTATC GAACAGGGCA

551  AAAACGGCGT TTCCGACATC TTCTTCGCCC ACAAAGCCAT GAAAGAAGTG

601  TACGGCGGCA AAGACAAAGA CACGACCGTA TGGCAGCCCT CCCCGTCCGA

651  TCCCAACCTC GAAGCCGCTT TCCTGACGCG CTTTATGCAA TATTTGGGCG

701  TTGACGGACA GCAGGCGGAA AACGCATCGG CAAAAAAACC TACCCTTCCC

751  GCCGCCAACG AAATGGCGCG TATCGAAGGC AAAAGCCTGA TTGTCTTTGG

801  CGACTACGGC AGAAACTGGC GGCGCACCGC GCTCGCCCTC GACCGCATCG

851  GGCTGACCGT CGTCGGTCAA AACACCGAAC GCCACGCTTT CCTGGTTCAA

901  AAAGCCCCGA ACGAAAGCAA TGCAGTTACC GAACAAAAAC CCGGCCTGTT

951  CAAACGCCTG CTGGGCAAAG GCAAAGCGGA GAAACCTGCC GAACAGCCGG

1001  AACTGATTGT CTATGCCGAG CCTGTCGCCA ACGGCTCGCG CATCGTCCTG

1051  CTCAACAAAG ACGGCAGCGC ATATGCCGGC AAAGACGCAT CCGCATTATT

1101  GGGCAAACTC CATTCCGAAC TGCGTTAA
```

This corresponds to the amino acid sequence <SEQ ID 1524; ORF 529.a>:

```
a529.pep
  1  MTHIKPVIAA LALIGLAACS GSKTEQPKLD YQSRSHRLIK LEVPPDLNNP

51  DQGNLYRLPA GSGAVRASDL EKRRTPAVQQ PADAEVLKSV KGVRLERDGS

101  QRWLVVDGKS HAEIWPLLKA FWQENGFDIK SEEPAIGQME TEWAENRAKI

151  PQDSLRRLFD TVGLGGIYST GERDKFIVRI EQGKNGVSDI FFAHKAMKEV

201  YGGKDKDTTV WQPSPSDPNL EAAFLTRFMQ YLGVDGQQAE NASAKKPTLP
```

```
-continued
251 AANEMARIEG KSLIVFGDYG RNWRRTALAL DRIGLTVVGQ NTERHAFLVQ

301 KAPNESNAVT EQKPGLFKRL LGKGKAEKPA EQPELIVYAE PVANGSRIVL

351 LNKDGSAYAG KDASALLGKL HSELR*
``` m529/a529 99.2% identity in 375 aa overlap

```
                   10         20         30         40         50         60
    m529.pep  MTHIKPVIAALALIGLAACSGSKTEQPKLDYQSRSHRLIKLEVPPDLNNPDQGNLYRLPA
              ||||||||||||||||||||||||||||||||||||||||||||||||||||||||||||
    a529      MTHIKPVIAALALIGLAACSGSKTEQPKLDYQSRSHRLIKLEVPPDLNNPDQGNLYRLPA
                   10         20         30         40         50         60
         70         80         90        100        110        120
    m529.pep  GSGAVRASDLEKRRTPAVQQPADAEVLKSVKGVRLERDGSQRWLVVDGKSPAEIWPLLKA
              |||||||||||||||||||||||||||||||||||||||||||||||| |||||||||||
    a529      GSGAVRASDLEKRRTPAVQQPADAEVLKSVKGVRLERDGSQRWLVVDGKSHAEIWPLLKA
                   70         80         90        100        110        120
        130        140        150        160        170        180
    m529.pep  FWQENGFDIKSEEPAIGQMETEWAENRAKIPQDSLRRLFDKVGLGGIYSTGERDKFIVRI
              ||||||||||||||||||||||||||||||||||||||||| ||||||||||||||||||
    a529      FWQENGFDIKSEEPAIGQMETEWAENRAKIPQDSLRRLFDTVGLGGIYSTGERDKFIVRI
                  130        140        150        160        170        180
        190        200        210        220        230        240
    m529.pep  EQGKNGVSDIFFAHKAMKEVYGGKDKDTTVWQPSPSDPNLEAAFLTRFMQYLGVDGQQAE
              ||||||||||||||||||||||||||||||||||||||||||||||||||||||||||||
    a529      EQGKNGVSDIFFAHKAMKEVYGGKDKDTTVWQPSPSDPNLEAAFLTRFMQYLGVDGQQAE
                  190        200        210        220        230        240
        250        260        270        280        290        300
    m529.pep  NASAKKPTLPAANEMARIEGKSLIVFGDYGRNWRRYVLALDRIGLTVVGQNTERHAFLVQ
              |||||||||||||||||||||||||||||||||||| :||||||||||||||||||||||
    a529      NASAKKPTLPAANEMARIEGKSLIVFGDYGRNWRRYALALDRIGLTVVGQNTERHAFLVQ
                  250        260        270        280        290        300
        310        320        330        340        350        360
    m529.pep  KAPNESNAVTEQKPGLFKRLLGKGKAEKPAEQPELIVYAEPVANGSRIVLLNKDGSAYAG
              ||||||||||||||||||||||||||||||||||||||||||||||||||||||||||||
    a529      KAPNESNAVTEQKPGLFKRLLGKGKAEKPAEQPELIVYAEPVANGSRIVLLNKDGSAYAG
                  310        320        330        340        350        360
        370
    m529.pep  KDASALLGKLHSELRX
              ||||||||||||||||
    a529      KDASALLGKLHSELRX
                  370
```

The following partial DNA sequence was identified in *N. gonorrhoeae* <SEQ ID 1525>:

```
g530.seq
   1 atgagtgcga gcgcggcaat gacgggtttg atatgggtca tcgtgtcatc 51 ctgtgtgatg gatattaaag tgtttgtcat gttatgccgt ccgaacggtt 101 cagacggcat ggctatattt aaagttgtcc tgaggctttc agggcggcgc 151 ggacttttgc ctgtccgcct tccgtcagcg gaacgagcgg caggcgcacg 201 tgcggtccgc atccgcccaa ggcggatacc gcccatttcg gtgcggcggg 251 actgggttcg cagaacatgg tgtcgtaaat cggaatcagc cggtcgttga
```

This corresponds to the amino acid sequence <SEQ ID 1526; ORF 530.ng>:

```
g530.pep
   1 MSASAAMTGL IWVIVSSCVM DIKVFVMLCR PNGSDGMAIF KVVLRLSGRR

51 GLLPVRLPSA ERAAGARAVR IRPRRIPPIS VRRDWVRRTW CRKSESAGR*
```

The following partial DNA sequence was identified in *N. meningitidis* <SEQ ID 1527>:

```
m530.seq
   1 wTGAGTGCGA GCGCGGCAAT GACGGGTyTG ATATGGGTCA TCGTGTCATC 51 sTGTGTGATG GATATTAAAG TGTyTGTTGC GwTATGCCGT CCGAACGGTT 101 CGGACGGCAT GGmTATATTT AAAGTTGTCC TGAGGCTTTC AGGGCGGCGC 151 GGACTkTTGC wTGTCCGTTT yCCGTCAGCG GAACGAGCGG CAGGCGGACG 201 TGCGGTTCGC ATCTGCCCAg GGCGGATACC GCCCATTTCG GTGCGGCGGG

251 GCTGGGTTCG CAGAACATGG TGTCGTAAAT CGGAATCAGT CGGTCGTTGA
```

This corresponds to the amino acid sequence <SEQ ID 1528; ORF 530>:

```
m530.pep
   1 XSASAAMTGL IWVIVSSCVM DIKVXVAXCR PNGSDGMXIF KVVLRLSGRR

51 GLLXVRFPSA ERAAGGRAVR ICPGRIPPIS VRRGWVRRTW CRKSESVGR*
```

Computer analysis of this amino acid sequence gave the following results:

Homology with a Predicted ORF from *N. gonorrhoeae*

ORF 530 shows 88.8% identity over a 98 aa overlap with a predicted ORF (ORF 530.ng) from *N. gonorrhoeae*:

```
m530/g530 m530.pep    XSASAAMTGLIWVIVSSCVMDIKVXVAXCRPNGSDGMXIFKVVLRLSGRRGLLXVRFPSA   60
             ||||||||||||||||||||||| |  ||||||||| ||||||||||||||| ||:|||
g530        MSASAAMTGLIWVIVSSCVMDIKVFVMLCRPNGSDGMAIFKVVLRLSGRRGLLPVRLPSA   60
                    10        20        30        40        50        60 m530.pep    ERAAGGRAVRICPGRIPPISVRRGWVRRTWCRKSESVGR   99
            |||||:||||| | ||||||||| ||||||||||||:||
g530        ERAAGARAVRIRPRRIPPISVRRDWVRRTWCRKSESAGR   99
```

The following partial DNA sequence was identified in *N. meningitidis* <SEQ ID 1529>:

```
a530.seq
   1 ATGAGTGCGA GCGCGGCAAT GACGGGTTTG ATATGGGTCA TCGTGTCATC

51 CTGTGTGATG GATATTAAAG TGTTTGTTGC GTTATGCCGT CCGAACGGTT

101 CGGACGGCAT GGCTATATTT AAAGTTGTCC TGAGGCTTTC AGGGCGGCGC

151 GGACTTTTGC CTGTCCGCCT TCCGTCAGCG GAACGAGCGG CAGGCGGACG

201 TGCGGTTCGC ATCTGCCCAG GGCGGATACC GCCCATTTCG GTGCGGCGGG

251 GCTGGGTTCG CAGAACATGG TGTCGTAAAT CGGAATCAGC CGGTCGTTGA
```

This corresponds to the amino acid sequence <SEQ ID 1530; ORF 530.a>:

```
a530.pep
   1 MSASAAMTGL IWVIVSSCVM DIKVFVALCR PNGSDGMAIF KVVLRLSGRR

51 GLLPVRLPSA ERAAGGRAVR ICPGRIPPIS VRRGWVRRTW CRKSESAGR*
``` m530/a530 93.9% identity in 98 aa overlap

```
                        10        20        30        40        50        60
        m530.pep   XSASAAMTGLIWVIVSSCVMDIKVXVAXCRPNGSDGMXIFKVVLRLSGRRGLLXVRFPSA
                   |||||||||||||||||||||||||| |||||||||| |||||||||||||||| :|||
        a530       MSASAAMTGLIWVIVSSCVMDIKVFVALCRPNGSDGMAIFKVVLRLSGRRGLLPVRLPSA
                        10        20        30        40        50        60

70        80        90       100
        m530.pep   ERAAGGRAVRICPGRIPPISVRRGWVRRTWCRKSESVGRX
                   |||||||||||||||||||||||||||||||||||:|||
        a530       ERAAGGRAVRICPGRIPPISVRRGWVRRTWCRKSESAGRX
                        70        80        90       100
```

The following partial DNA sequence was identified in *N. gonorrhoeae* <SEQ ID 1531>:

```
g531.seq
   1 ATGACCGCCC TACTCGTCAT CCTCGCCCTC GCCCTGATAG CCGTCGGCAC

51 GGCAGGCATC GTCTATCCCG CCCTGCCCGG CTTGGCATTG ATGTTTGCCG

101 GAACATGGCT GCTTGCCTAT GCCGGCGGCT ATCAAATCTA CGGCGCAGGC

151 ATCTTGTGGA CGGTCGGACT CATCAGCCTT GGCGGCATAC TGGCGGACTA

201 TATGGCAGGC ATGTTGGGGG TAAAATACAC TGGGGCAGGC AAACTCGCCG

251 TCCGAGGTGC ATTGGCCGGC AGCATCATCG GCATATTTTT CTCCCTTCCC

301 GGACTAATAC TCGGCCCCTT TATCGGCGCG GCGGCAGGCG AACTGATCGA

351 TCGGCGCAAT ATGCTTCAGG CAGGTAAAGC GGGCTTGGGT ACGCTGTTGG

401 GGCTTGTCGT CGGCACGGCG TTCAAAATCG GCTGCGCCGT ATCCATCTTG

451 TTTATCCTGT TGGTGAAATA CATCGCATAC CTGTTTTAA
```

This corresponds to the amino acid sequence <SEQ ID 1532; ORF 531.ng>:

```
g531.pep
   1 MTALLVILAL ALIAVGTAGI VYPALPGLAL MFAGTWLLAY AGGYQIYGAG

51 ILWTVGLISL GGILADYMAG MLGVKYTGAG KLAVRGALAG SIIGIFFSLP

101 GLILGPFIGA AAGELIDRRN MLQAGKAGLG TLLGLVVGTA FKIGCAVSIL

151 FILLVKYIAY LF
```

The following partial DNA sequence was identified in *N. meningitidis* <SEQ ID 1533>:

```
m531.seq
   1 ATGACCGTAC TGACCGTCAT CCTCGCCCTC GCCCTGATAG CCGTCGGCAC

51 GGCGGGCATC GTTTaCCCCG CCCTGCCCGG ATTGGCATTG ATGTTTGCCG

101 GAACATGGCT GCTTGCCTAT GCCGGCGGCT ACCAAATCTA CGGCGCGGGC

151 GTTTTGTGGA CGGTCGGACT CATCAGCCTT GCCGGCATAC TGGCGGACTA

201 TGTGGCAGGC ATATGGGGGA CAAAATATAC CGGAGCGGGC AAGCTCGCCG

251 TTCGCGGCGC ATTGGCCGGC AGCATCATCG GCATATTTTT CTCCCTTCCC

301 GGACTAATAC TCGGTCCCTT TATCGGCGCG GCGGCAGGCG AACTGATCGA

351 ACGGCGCAAT ATGCTTCAGG CAGGTAAAGC GGGCTTGGGT ACGCTGTTGG
```

-continued
```
401 GGCTTGTCGT CGGCACGGCG TTCAAAATCG GCTGCGCnGT ATCCATCTTG

451 TTTATCCTGT TGGTGAaATA CATCGCCTAC CTGTTTTAA
```

This corresponds to the amino acid sequence <SEQ ID 1534; ORF 531>:

```
m531.pep
  1 MTVLTVILAL ALIAVGTAGI VYPALPGLAL MFAGTWLLAY AGGYQIYGAG

51 VLWTVGLISL AGILADYVAG IWGTKYTGAG KLAVRGALAG SIIGIFFSLP

101 GLILGPFIGA AAGELIERRN MLQAGKAGLG TLLGLVVGTA FKIGCAVSIL

151 FILLVKYIAY LF*
```

Computer analysis of this amino acid sequence gave the following results:
Homology with a Predicted ORF from *N. gonorrhoeae*
ORF 531 shows 94.4% identity over a 162 aa overlap with a predicted ORF (ORF 531.ng) from *N. gonorrhoeae*:

```
    m531/g531
                      10         20         30         40         50         60
    m531.pep    MTVLTVILALALIAVGTAGIVYPALPGLALMFAGTWLLAYAGGYQIYGAGVLWTVGLISL
                ||:|||||||||||||||||||||||||||||||||||||||||||||||:||||||||
    g531        MTALLVILALALIAVGTAGIVYPALPGLALMFAGTWLLAYAGGYQIYGAGILWTVGLISL
                      10         20         30         40         50         60
                      70         80         90        100        110        120
    m531.pep    AGILADYVAGIWGTKYTGAGKLAVRGALAGSIIGIFFSLPGLILGPFIGAAAGELIERRN
                :||||||:||: |:||||||||||||||||||||||||||||||||||||||||||:|||
    g531        GGILADYMAGMLGVKYTGAGKLAVRGALAGSIIGIFFSLPGLILGPFIGAAAGELIDRRN
                      70         80         90        100        110        120
                     130        140        150        160
    m531.pep    MLQAGKAGLGTLLGLVVGTAFKIGCAVSILFILLVKYIAYLF
                |||||||||||||||||||||||||||||||||||||||||
    g531        MLQAGKAGLGTLLGLVVGTAFKIGCAVSILFILLVKYIAYLF
                     130        140        150        160
```

The following partial DNA sequence was identified in *N. meningitidis* <SEQ ID 1535>:

```
a531.seq
  1 ATGACCGCCT TGCTCGTCAT CCTCGCCCTC GCCCTGATAG CCGCCGGTAC

51 GGCGGGCATC GTTTACCCCG CCCTGCCCGG ATTGGCATTG ATGTTTGCCG

101 GAACCTGGCT GCTCGCCTAC TCCGGCGGCT ACCAAATCTA CGGCGCGGGC

151 GTTTTGTGGA CGGTCGGACT CATCAGCCTT GCCGGCATAC TGGCGGACTA

201 TGTGGCAGGC ATATGGGGGA CAAAATATAC CGGAGCGGGC AAGCTCGCCG

251 TTCGCGGCGC ATTGGCCGGC AGCATCATCG GCATATTTTT CTCCCTTCCC

301 GGACTAATAC TCGGTCCCTT TATCGGCGCG GCGGCAGGCG AACTGATCGA

351 ACGGCGCAAT ATGCTTCAGG CAGGTAAAGC GGGCTTGGGT ACGCTGTTGG

401 GGCTTATCGT CGGTACGGCG TTCAAAATCG GCTGCGCCGT ATCCATCTTG

451 TTTATCCTGT TGGTGAAATA CATCGCCTAC CTGTTTTAA
```

This corresponds to the amino acid sequence <SEQ ID 1536; ORF 531.a>:

```
a531.pep
  1 MTALLVILAL ALIAAGTAGI VYPALPGLAL MFAGTWLLAY SGGYQIYGAG

51 VLWTVGLISL AGILADYVAG IWGTKYTGAG KLAVRGALAG SIIGIFFSLP

101 GLILGPFIGA AAGELIERRN MLQAGKAGLG TLLGLIVGTA FKIGCAVSIL

151 FILLVKYIAY LF*
``` m531/a531 96.9% identity in 162 aa overlap

```
                    10         20         30         40         50         60
    m531.pep    MTVLTVILALALIAVGTAGIVYPALPGLALMFAGTWLLAYAGGYQIYGAGVLWTVGLISL
                || :| ||||||||||| :||||||||||||||||||||| :|||||| |||||||||||
    a531        MTALLVILALALIAAGTAGIVYPALPGLALMFAGTWLLAYSGGYQIYGAGVLWTVGLISL
                    10         20         30         40         50         60

70         80         90        100        110        120
    m531.pep    AGILADYVAGIWGTKYTGAGKLAVRGALAGSIIGIFFSLPGLILGPFIGAAAGELIERRN
                ||||||||||||||||||||||||||||||||||||||||||||||||||||||||||||
    a531        AGILADYVAGIWGTKYTGAGKLAVRGALAGSIIGIFFSLPGLILGPFIGAAAGELIERRN
                    70         80         90        100        110        120

130        140        150        160
    m531.pep    MLQAGKAGLGTLLGLVVGTAFKIGCAVSILFILLVKYIAYLFX
                |||||||||||||||:||||||||||||||||||||||||||
    a531        MLQAGKAGLGTLLGLIVGTAFKIGCAVSILFILLVKYIAYLFX
                   130        140        150        160
```

The following partial DNA sequence was identified in *N. gonorrhoeae* <SEQ ID 1537>:

```
g532.seq (partial)
  1 atggctgaaa caatgaaaaa acaggcggat tcgcctgatt tggtgtacgg 51 tttggaagac aggccgccgt tcggtaatgc gctcttgagc gcggttaccc 101 atcttttggc gattttcgtg ccgatgatta cgcccgcgct gattgtgggc 151 ggcgcgctgg aattgccggt ggagatgacg gcgtatctgg tgtcgatggc 201 gatggttgcg tcgggtgtcg gcacttattt gcaggtcaac cgcttcgggt 251 cggtcggctc ggggatgctg tccatccagc gttaccgtca tgattgcgct 301 cggcgcgggg atgaaagagg gcggtttgag ...
```

This corresponds to the amino acid sequence <SEQ ID 1538; ORF 532.ng>:

```
g532.pep (partial)
  1 MAETMKKQAD SPDLVYGLED RPPFGNALLS AVTHLLAIFV PMITPALIVG

51 GALELPVEMT AYLVSMAMVA SGVGTYLQVN RFGSVGSGML SIQRYRHDCA

101 RRGDERGRFE ...
```

The following partial DNA sequence was identified in *N. meningitidis* <SEQ ID 1539>:

```
m532.seq
   1 ATGAGCGGTC AGTTGGGCAA AGGTGCGGAT GCGCCTGATT TGGTGTACGG

51 TTTGGAAGAC AGGCCGCCGT TCGGTAATGC GCTCTTGAGC GCGGTTACCC

101 ATCTTTTGGC GATTTTGTG CCGATGATTA CGCCCGCGCT GATTGTGGGC

151 GGCGCGCTGG AATTGCCGGT GGAGATGACG GCGTATCTCG TGTCGATGGC
```

```
 201 GATGGTTGCG TCGGGTGTCG GCACTTATTT GCAGGTCAAC CGCTTCGGGC

251 CGGTCGGTTC GGGGATGCTG TCCATCCAGT CGGTGAATTT TTCGTTCGTT

301 ACCGTGATGA TTGCGCTGGG CGCGGGGATG AAAGAGGGCG GTTTGACTAA

351 GGATGCGATG ATTTCGACGC TCTTGGGCGT ATCGTTTGTC GGCGCGTTTT

401 TGGTGTGTTT CTCGGCGTGG CTTCTGCCGT ATTTGAAAAA AGTGATTACG

451 CCGACGGTCA GCGGCGTGGT CGTGATGCTC ATTGGTTTGA GTTTGGTACA

501 CGTCGGCATT ACCGATTTCG GCGGCGGCTT CGGCGCGAAG GCGGACGGCA

551 CGTTCGGCTC GATGGAAAAC TTGGGGCTGG CATCGCTGGT GTTGCTGATT

601 GTGTTGGTGT TCAACTGCAT GAAAAACCCG CTGTTGCGCA TGAGCGGCAT

651 TGCGGTCGGG CTGATTGCCG GCTATATCGT CGCGCTGTTT TTGGGCAAGG

701 TGGATTTTTC CGCGCTGCAA AACCTGCCGC TGGTTACGCT GCCCGTACCG

751 TTTAAATACG GTTTTGCTTT CGACTGGCAC GCGTTTATTG TGGCGGGCGC

801 GATTTTCTTG TTGAGCGTGT TTGAGGCGGT CGGCGATTTA ACCGCGACGG

851 CAATGGTGTC CGACCAGCCG ATTGAAGGCG AGGAATACAC CAAACGCCTG

901 CGCGGCGGCG TGTTGGCTGA CGGCTTGGTG TCGGTGATTG CGACGGCTTT

951 GGGTTCGCTG CCGCTGACGA CGTTTGCGCA AAACAACGGC GTGATTCAGA

1001 TGACCGGCGT GGCTTCGCGC CATGTGGGCA AATATATTGC CGTGATTTTG

1051 GTGCTGTTGG GTCTGTTCCC CGTTGTCGGT CGCGCGTTTA CGACGATTCC

1101 GAGTCCGGTG TTGGGCGGCG CGATGGTTTT GATGTTCGGC TTAATTGCGA

1151 TTGCGGGCGT GCGGATTTTG GTCAGTCACG GCATCCGCAG GCGCGAAGCG

1201 GTGATTGCGG CAACGTCGGT CGGTTTGGGC TTGGGTGTCG CGTTTGAGCC

1251 GGAAGTGTTT AAAAACCTGC CCGTCTTGTT CCAAAACTCT ATTTCCGCCG

1301 GCGGCATTAC GGCAGTCTTG CTGAATTTGG TCTTGCCCGA AGATAAAACC

1351 GAGGCGGCGG TCAAGTTTGA TACCGACCAC TTGGAACACT GA
                                                       40
```

This corresponds to the amino acid sequence <SEQ ID 1540; ORF 532>.

```
m532.pep
  1 MSGQLGKGAD APDLVYGLED RPPFGNALLS AVTHLLAIFV PMITPALIVG

51 GALELPVEMT AYLVSMAMVA SGVGTYLQVN RFGPVGSGML SIQSVNFSFV

101 TVMIALGAGM KEGGLTKDAM ISTLLGVSFV GAFLVCFSAW LLPYLKKVIT

151 PTVSGVVVML IGLSLVHVGI TDFGGGFGAK ADGTFGSMEN LGLASLVLLI

201 VLVFNCMKNP LLRMSGIAVG LIAGYIVALF LGKVDFSALQ NLPLVTLPVP

251 FKYGFAFDWH AFIVAGAIFL LSVFEAVGDL TATAMVSDQP IEGEEYTKRL

301 RGGVLADGLV SVIATALGSL PLTTFAQNNG VIQMTGVASR HVGKYIAVIL

351 VLLGLFPVVG RAFTTIPSPV LGGAMVLMFG LIAIAGVRIL VSHGIRRREA

401 VIAATSVGLG LGVAFEPEVF KNLPVLFQNS ISAGGITAVL LNLVLPEDKT

451 EAAVKFDTDH LEH*
```

Computer analysis of this amino acid sequence gave the following results:
Homology with a Predicted ORF from *N. gonorrhoeae*
ORF532 shows 91.4% identity over a 93 aa overlap with a predicted ORF (ORF 532.ng) from *N. gonorrhoeae*:

```
g532/m532
                  10        20        30        40        50        60
   g532.pep  MAETMKKQADSPDLVYGLEDRPPFGNALLSAVTHLLAIFVPMITPALIVGGALELPVEMT
             |:  : | ||:||||||||||||||||||||||||||||||||||||||||||||||||||
   m532      MSGQLGKGADAPDLVYGLEDRPPFGNALLSAVTHLLAIFVPMITPALIVGGALELPVEMT
                  10        20        30        40        50        60
         70        80        90       100       110
   g532.pep  AYKVSMAMVASGVGTYLQVNRFGSVGSGMLSIQRYRHDCARRGDERGRFEX
             |||||||||||||||||||||||| ||||||||||
   m532      AYKVSMAMVASGVGTYLQVNRFGPVGSGMLSIQSVNFSFVTVMIALGAGMKEGGLTKDAM
                  70        80        90       100       110       120
```

The following partial DNA sequence was identified in *N. meningitidis* <SEQ ID 1541>:

```
a532.seq
    1 ATGAGCGGTC AGTTGGGCAA AGGTGCGGAT GCGCCTGATT TGGTGTACGG

51 TTTGGAGGAT AGGCCGCCGT TCGGTAATGC GCTCTTGAGC GCGGTTACCC

101 ATCTTTTGGC GATTTTTGTG CCGATGATTA CGCCCGCGCT GATTGTGGGC

151 GGCGCGCTGG AATTGCCGGT GGAGATGACG GCGTATCTCG TGTCGATGGC

201 GATGGTTGCG TCGGGTGTCG GCACTTATTT GCAGGTCAAC CGCTTCGGGC

251 CGGTCGGTTC GGGGATGCTG TCCATCCAGT CGGTGAATTT CTCGTTCGTT

301 ACCGTCATGA TTGCGCTCGG CGCGGGGATG AAAGAGGGCG GTTTGACTAA

351 GGATGCGATG ATTTCGACGC TCTTGGGCGT ATCGTTTGTC GGCGCGTTTT

401 TGGTGTGTTT TTCGGCGTGG CTTCTGCCGT ATTTGAAAAA AGTGATTACG

451 CCGACGGTCA GCGGTGTGGT GGTGATGCTG ATCGGCTTGA GTTTGGTACA

501 CGTCGGTATT ACCGATTTCG GCGGCGGCTT CGGCGCAAAG GCGGACGGCA

551 CGTTCGGCTC GATGGAAAAC TTGGGGCTGG CATCGCTGGT GCTGCTGATT

601 GTGCTGGTGT TCAATTGCAT GAAAAACCCG CTGCTGCGGA TGAGCGGCAT

651 TGCGGTCGGT CTGATTGCCG GCTATATCGT CGCGCTGTTT TTGGGCAAGG

701 TGGATTTTTC GGCACTGCAA AACCTGCCGC TGGTTACGCT GCCCGTACCG

751 TTTAAATATG GTTTTGCTTT TGACTGGCAC GCATTTATTG TGGCGGGTGC

801 GATTTTCTTG TTGAGCGTGT TTGAGGCGGT CGGCGATTTG ACGGCGACGG

851 CAATGGTGTC CGACCAGCCG ATTGAAGGCG AGGAATACAC CAAACGCTTG

901 CGCGGCGGCG TGTTGGCGGA CGGCTTGGTG TCGGTGATTG CGACGGCTTT

951 GGGTTCGCTG CCGCTGACGA CGTTTGCACA AACAACGGC GTGATTCAGA

1001 TGACCGGCGT GGCTTCGCGC CATGTGGGCA ATATATTGC CGTGATTTTG

1051 GTGCTGTTGG GTCTGTTCCC CGTTGTCGGA CGCGCGTTTA CGACGATTCC

1101 GAGTCCGGTG TTGGGCGGCG CGATGGTTTT GATGTTCGGC TTGATTGCGA

1151 TTGCGGGCGT GCGGATTTTG GTCAGCCACG GCATCCGCAG GCGCGAAGCG

1201 GTAATTGCGG CAACGTCGGT CGGTTTGGGC TTGGGTGTCG CGTTTGAGCC

1251 GGAAGTGTTT AAAAACCTGC CCGTCTTGTT CCAAAACTCT ATTTCCGCCG

1301 GCGGCATTAC GGCAGTCTTG CTGAATTTGG TCTTGCCCGA AGATAAAACC

1351 GAGGCGGCGG TCAAGTTTGA TACCGACCAC TTGGAACACT GA
```

This corresponds to the amino acid sequence <SEQ ID 1542; ORF 532.a>:

```
a532.pep
   1 MSGQLGKGAD APDLVYGLED RPPFGNALLS AVTHLLAIFV PMITPALIVG

51 GALELPVEMT AYLVSMAMVA SGVGTYLQVN RFGPVGSGML SIQSVNFSFV

101 TVMIALGAGM KEGGLTKDAM ISTLLGVSFV GAFLVCFSAW LLPYLKKVIT

151 PTVSGVVVML IGLSLVHVGI TDFGGGFGAK ADGTFGSMEN LGLASLVLLI

201 VLVFNCMKNP LLRMSGIAVG LIAGYIVALF LGKVDFSALQ NLPLVTLPVP

251 FKYGFAFDWH AFIVAGAIFL LSVFEAVGDL TATAMVSDQP IEGEEYTKRL

301 RGGVLADGLV SVIATALGSL PLTTFAQNNG VIQMTGVASR HVGKYIAVIL

351 VLLGLFPVVG RAFTTIPSPV LGGAMVLMFG LIAIAGVRIL VSHGIRRREA

401 VIAATSVGLG LGVAFEPEVF KNLPVLFQNS ISAGGITAVL LNLVLPEDKT

451 EAAVKFDTDH LEH*
``` m532/a532 100.0% identity in 463 aa overlap

```
                    10         20         30         40         50         60
  m532.pep  MSGQLGKGADAPDLVYGLEDRPPFGNALLSAVTHLLAIFVPMITPALIVGGALELPVEMT
            ||||||||||||||||||||||||||||||||||||||||||||||||||||||||||||
  a532      MSGQLGKGADAPDLVYGLEDRPPFGNALLSAVTHLLAIFVPMITPALIVGGALELPVEMT
                    10         20         30         40         50         60
  70         80         90        100        110        120
  m532.pep  AYLVSMAMVASGVGTYLQVNRFGPVGSGMLSIQSVNFSFVTVMIALGAGMKEGGLTKDAM
            ||||||||||||||||||||||||||||||||||||||||||||||||||||||||||||
  a532      AYLVSMAMVASGVGTYLQVNRFGPVGSGMLSIQSVNFSFVTVMIALGAGMKEGGLTKDAM
                    70         80         90        100        110        120
 130        140        150        160        170        180
  m532.pep  ISTLLGVSFVGAFLVCFSAWLLPYLKKVITPTVSGVVVMLIGLSLVHVGITDFGGGFGAK
            ||||||||||||||||||||||||||||||||||||||||||||||||||||||||||||
  a532      ISTLLGVSFVGAFLVCFSAWLLPYLKKVITPTVSGVVVMLIGLSLVHVGITDFGGGFGAK
                   130        140        150        160        170        180
 190        200        210        220        230        240
  m532.pep  ADGTFGSMENLGLASLVLLIVLVFNCMKNPLLRMSGIAVGLIAGYIVALFLGKVDFSALQ
            ||||||||||||||||||||||||||||||||||||||||||||||||||||||||||||
  a532      ADGTFGSMENLGLASLVLLIVLVFNCMKNPLLRMSGIAVGLIAGYIVALFLGKVDFSALQ
                   190        200        210        220        230        240
 250        260        270        280        290        300
  m532.pep  NLPLVTLPCPFKTGFAFDEHAFIVAGAIFLLSVFEAVGDLTATAMVSDQPIEGEEYRKRL
            ||||||||||||||||||||||||||||||||||||||||||||||||||||||||||||
  a532      NLPLVTLPCPFKTGFAFDEHAFIVAGAIFLLSVFEAVGDLTATAMVSDQPIEGEEYRKRL
                   250        260        270        280        290        300
 310        320        330        340        350        360
  m532.pep  RGGVLADGLVSVIATALGSLPLTTFAQNNGVIQMTGVASRHVGKYIAVILVLLGLFPVVG
            ||||||||||||||||||||||||||||||||||||||||||||||||||||||||||||
  a532      RGGVLADGLVSVIATALGSLPLTTFAQNNGVIQMTGVASRHVGKYIAVILVLLGLFPVVG
                   310        320        330        340        350        360
 370        380        390        400        410        420
  m532.pep  RAFTTIPSPVLGGAMVLMFGLIAIAGVRILVSHGIRRREAVIAATSVGLGLGVAFEPEVE
            ||||||||||||||||||||||||||||||||||||||||||||||||||||||||||||
  a532      RAFTTIPSPVLGGAMVLMFGLIAIAGVRILVSHGIRRREAVIAATSVGLGLGVAFEPEVE
                   370        380        390        400        410        420
 430        440        450        460
  m532.pep  KNLPVLFQNSISAGGITAVLLNLVLPEDKTEAAVKFDTDHLEHX
            |||||||||||||||||||||||||||||||||||||||||||
  a532      KNLPVLFQNSISAGGITAVLLNLVLPEDKTEAAVKFDTDHLEHX
                   430        440        450        460
```

The following partial DNA sequence was identified in *N. gonorrhoeae* <SEQ ID 1543>:

```
g535.seq
   1 atgccctttc ccgttttcag acaantattt gcttngtcct tgctacggtt 51 ttttgccgta ggtcggattc tcgaatccga catttccaac agcggttttt
```

-continued
```
101 cggaaacgat aaacgcgtca aatgtttttt ttgtcggata cgaatatccg 151 gcctgcattt caaatttaca tcgcttccaa tttcgcaaac ttggtatcca 201 gttctttcac gccctgtttg ccgaagttga tggtcagtcg ggcggattcg 251 cctttgtctg cggcatcgat aatcacgccg gtgccgaatt tggcgtgacg 301 gacgttttgt ccgatgcgga agcctgcgta ggtttgcggc tgtttgaagt 351 catcgatgat tttgtcccgt tgtacggtgg tttggcgcgt gttgccgtag 401 ctgtcgaagg cgggtttttt gacggacagg tagtgcaata cttctggcgg 451 gatttcttcg acgaagcggg atgcgatgcc gaattgggtt tgtccgtgca 501 gcatgcgttg ctgtgccatg gtgatgtaga ggcgtttgcg ggcgcgggtg 551 atggcgacgt acatgaggcg gcgttcttct tcgaggccgc cgcgctcggc 601 aaggctcatt tcgctgggga aacgccctc ttccataccg gtgaggaaga 651 cggcgttgaa ttccaagcct ttggcggcgt ggacggtcat cagttggacg 701 gcttttcgc ctgccctgc ttggttttcg ccggattcga gggcggcgtt 751 gctcaagaag gcgaggatgg ggaaggcggg atcgtctga
```

This corresponds to the amino acid sequence <SEQ ID 1544; ORF 535.ng>:

```
g535.pep
  1 MPFPVFRQXF AXSLLRFFAV GRILESDISN SGFSETINAS NVFFVGYEYP

51 ACISNLHRFQ FRKLGIQFFH ALFAEVDGQS GGFAFVCGID NHAGAEFGVT

101 DVLSDAEACV GLRLFEVIDD FVPLYGGLAR VAVAVEGGFF DGQVVQYFWR

151 DFFDEAGCDA ELGLSVQHAL LCHGDVEAFA GAGDGDVHEA AFFFEAAALG

201 KAHFAGETPL FHTGEEDGVE FQAFGGVDGH QLDGFFACPC LVFAGFEGGV

251 AQEGEDGEGG IV*
```

The following partial DNA sequence was identified in *N. meningitidis* <SEQ ID 1545>:

```
m535.seq
  1 aTGCCCTTtC CCGTTTTCAG ACGGCCTTTT GCTTTGTCCT TACTtACGTT

51 TTTTGCCGTA AGTCAGATTC TTGTATCCGA CATTTCCAAC AGCGGTGTTT

101 CGGAAACAAT AGACGCGTCA AATGTTTTTG TCGGATACGA ATATCCGACC

151 TACATTTCAA ATTTACATCT CTTCCAATTT CGCAAACTTG GTGTCCAACT

201 CTTTCACGCC CTGTTTGCCG AAATTGATGG TCAGTCGGGC GGATTCGCCT

251 TTATCTGCGG CATCGATAAT CACGCCGGTG CCGAATTTGG CGTGGCGGAC

301 GTTTTGTCCG ATACGGAAAC CTGCGTAGGT TTGGGGCTGT TGTAGTCGT

351 CGATGATTTT ATCTTTGGAT GCGGCGGTTT GGCGCGTGTT GCCGTAACTG

401 TCGTAGGCAG GCTTTTTGAC GGACAGGTAG TGCAATACTT CGGGTGGGAT

451 CTCTTCGACG AAGCGGGAGA CGATGCCGAA TTGGGTTTGT CCGTGCAGCA

501 TGCGTTGTTG CGCCATGGTG ATGTAGAGGC GTTTGCGGGC GCGGGTGATG

551 GCGACGTACA TGAGGCGGCG TTCTTCTTCG AGGCCGCCGC GTTCGGCAAG

601 GCTCATTTCG CTGGGGAAGC GGCCTTCTTC CATGCCGGTG AGGAAGACGG

651 CGTTAAATTC CAAGCCTTTG GCGGCGTGGA CGGTCATGAG TTGGACGGCC
```

```
701 TTTTCGCCTG CGCCTGCCTG GTTTTCACCG GATTCGAGGG CGGCATTGCT

751 TAGGAAGGCG AGAATGGGGA AGGCGGGGTC GTCTGA
```

This corresponds to the amino acid sequence <SEQ ID 1546; ORF 535>:

```
m535.pep
  1 MPFPVFRRPF ALSLLTFFAV SQILVSDISN SGVSETIDAS NVFVGYEYPT

51 YISNLHLFQF RKLGVQLFHA LFAEIDGQSG GFAFICGIDN HAGAEFGVAD

101 VLSDTETCVG LGLFVVVDDF IFGCGGLARV AVTVVGRLFD GQVVQYFGWD

151 LFDEAGDDAE LGLSVQHALL RHGDVEAFAG AGDGDVHEAA FFFEAAAFGK

201 AHFAGEAAFF HAGEEDGVKF QAFGGVDGHE LDGLFACACL VFTGFEGGIA

251 XEGENGEGGV V*
```

Computer analysis of this amino acid sequence gave the following results:
Homology with a Predicted ORF from *N. gonorrhoeae*
ORF 535 shows 80.9% identity over a 262 aa overlap with a predicted ORF (ORF 535.ng) from *N. gonorrhoeae*:

```
   m535/g535

10         20         30         40         50         59
      m535.pep    MPFPVFRRPFALSLLTFFAVSQILVSDISNSGVSETIDASNVF-VGYEYPTYISNLHLFQ
                  |||||||:  ||  |||  ||::||  |||||||  |||:|||||  ||||||: |||| ||
         g535    MPFPVFRQXFAXSLLRFFAVGRILESDISNSGFSETINASNVFFVGYEYPACISNLHRFQ
                     10         20         30         40         50         60
                     60         70         80         90        100        110        119
      m535.pep    FRKLGVQLFHALFAEIDGQSGGFAFICGIDNHAGAEFGVADVLSDTETCVGLGLFVVVDD
                  ||||:|:|||||||:||||||||||||:|||||||||||||||:|:||||  ||  |:||
         g535    FRKLGIQFFHALFAEVDGQSGGFAFVCGIDNHAGAEFGVTDVLSDAEACVGLRLFEVIDD
                     70         80         90        100        110        120
                    120        130        140        150        160        170        179
      m535.pep    FIFGCGGLARVAVTVVGRLFDGQVVQYFGWDLFDEAGDDAELGLSVQHALLRHGDVEAFA
                  |:  ||||||||:| | :||||||||  |:|||| ||||||||||||||||||||||||||
         g535    FVPLYGGLARVAVAVEGGFFDGQVVQYFWRDFFDEAGCDAELGLSVQHALLCHGDVEAFA
                    130        140        150        160        170        180
                    180        190        200        210        220        230        239
      m535.pep    GAGDGDVHEAAFFFEAAAFGKAHFAGEAAFFHAGEEDGVKFQAFGGVDGHELDGLFACAC
                  ||||||||||||||||||||:||||||||: :||:||||||: |||||||||:|||:|||  |
         g535    GAGDGDVHEAAFFFEAAALGKAHFAGETPLFHTGEEDGVEFQAFGGVDGHQLDGFFACPC
                    190        200        210        220        230        240
                    240        250        260
      m535.pep    LVFTGFEGGIAXEGENGEGGVV
                  |||:||||||:| |||:||||:|
         g535    LVFAGFEGGVAQEGEDGEGGIV
                    250        260
```

The following partial DNA sequence was identified in *N. meningitidis* <SEQ ID 1547>:

```
a535.seq (partial)
  1 TTCAGACGGC CTTTTGCCTT GTCCTTGCTA CAGTTTTTTG CCATAGGTCG

51 GATTCTCGAA TCCGACATTT CCAACAGCGG TTTTTCGGAA ACGATAGACG

101 CGTCAAATAT TTTTGTCGGA TACGAGTATC CAGCCTGCAT TTCAAATTTA

151 CATCGCTTCC AATTTCGCAA ACTTGGTGTC CAACTCTTTC ACGCCCTGTT

201 TGCCGAAATT GATGGTCAGT CGGGCGGATT CGCCTTTATC TGCGGCATCG

251 ATAATCACGC CGGTGCCGAA TTTGGCGTGG CGGACGTTTT GTCCGATACG

301 GAAACCTGCG TAGGTTTGGG GCTGTTTGTA GTCGTCGATG ATTTTGTCTT
```

-continued
```
351 TGGGCGCGGC GGTTTGGCGC GTGTTGCCAT AGCGGTCGTA GGCGGGTTTT

401 TTGACGGACA GGTAGTGCAA TACTTCGGGC GGGATTTCTT CGACGAAGCG

451 GGAGACGATG CCGAATTGGG TTTGTCCGTG CAGCATGCGT TGTTGCGCCA

501 TGGTGATGTA GAGGCGTTTG CGGGCGCGGG TGATGGCGAC GTACATCAGG

551 CGGCGTTCTT CTTCGAGGCC GCCGCGTTCG GCAAGGCTCA TTTCGCTGGG

601 GAAGCGGCCT TCTTCCATGC CGGTGAGGAA TACGGCGTTA AATTCCAAGC

651 CTTTGGCGGC GTGCACGGTC ATGAGTTGTA CGGCTTTTTC GCCCGCGCCT

701 GCTTGGTTTT CGCCGGATTC GAGAGCAGCA TTGCTTAGGA AAGCGAGGAT

751 GGGGAAGGCG GGGTCGTCTG A
```

This corresponds to the amino acid sequence <SEQ ID 1548; ORF 535.a>:

```
a535.pep (partial)
  1 FRRPFALSLL QFFAIGRILE SDISNSGFSE TIDASNIFVG YEYPACISNL

51 HRFQFRKLGV QLFHALFAEI DGQSGGFAFI CGIDNHAGAE FGVADVLSDT

101 ETCVGLGLFV VVDDFVFGRG GLARVAIAVV GGFFDGQVVQ YFGRDFFDEA

151 GDDAELGLSV QHALLRHGDV EAFAGAGDGD VHQAAFFFEA AAFGKAHFAG

201 EAAFFHAGEE YGVKFQAFGG VHGHELYGFF ARACLVFAGF ESSIA*ESED

251 GEGGVV*
``` m535/a535 88.7% identity in 256 aa overlap

```
                   10         20         30         40         50         60
    m535.pep    MPFPVFRRPFALSLLTFFAVSQILVSDISNSGVSETIDASNVFVGYEYPTYISNLHLFQF
                        ||||||||| |||::::|| |||||||| ||||||||:|||||||: ||||| |||
    a535           FRRPFALSLLQFFAIGRILESDISNSGFSETIDASNIFVGYEYPACISNLHRFQF
                              10         20         30         40         50

70         80         90        100        110        120
    m535.pep    RKLGVQLFHALFAEIDGQSGGFAFICGIDNHAGAEFGVADVLSDTETCVGLGLFVVVDDF
                ||||||||||||||||||||||||||||||||||||||||||||||||||||||||||||
    a535        RKLGVQLFHALFAEIDGQSGGFAFICGIDNHAGAEFGVADVLSDTETCVGLGLFVVVDDF
                     60         70         80         90        100        110

130        140        150        160        170        180
    m535.pep    IFGCGGLARVAVTVVGRLFDGQVVQYFGWDLFDEAGDDAELGLSVQHALLRHGDVEAFAG
                :||  ||||||::||| :|||||||||| |:||||||||||||||||||||||||||||
    a535        VFGRGGLARVAIAVVGGFFDGQVVQYFGRDFFDEAGDDAELGLSVQHALLRHGDVEAFAG
                    120        130        140        150        160        170

190        200        210        220        230        240
    m535.pep    AGDGDVHEAAFFFEAAAFGKAHFAGEAAFFHAGEEDGVKFQAFGGVDGHELDGLFACACL
                |||||||:||||||||||||||||||||||||||| |||||||||||:||||| :||||
    a535        AGDGDVHQAAFFFEAAAFGKAHFAGEAAFFHAGEEYGVKFQAFGGVHGHELYGFFARACL
                    180        190        200        210        220        230

250        260
    m535.pep    VFTGFEGGIAXEGENGEGGVVX
                ||:|||::||||:|:|||||||
    a535        VFAGFESSIAXESEDGEGGVVX
                    240        250
```

The following partial DNA sequence was identified in *N. gonorrhoeae* <SEQ ID 1549>:

```
g537.seq
  1 atgaaatccc tttttatttg gctgcttcta ttgggctcgg cggcaggcgt 51 tttctaccat acccaaaacc aatccctgcc cgcgggcgaa cttgtctatc 101 cgtccgcacc gcaaatcagg gacggcggcg atgcgctgca ctacctcaac 151 cgcatccgca cacaaatcgg tttgcacgcg ctggcacacg cgccggtttt
```

```
 201 ggaaaattcc gcccgcaggc acgcacgcta tctcacgctc aatcccgaag 251 acggacacgg cgaacaccat cccgacaatc cgcactacac cgcacaaaag 301 ctgaccgaac gcacacgcct tgccgggtat ctctacaacg gcgtgcatga 351 aaacatcagc acggaagagg aagccgccga atcgtccgac agcgacatcc 401 gcacgcagca acgccaagtg gacgctttga tgagcgcaat ctaccaccgc 451 ctttcgctgc ttgaccgcca taccgacgaa gcaggtgcgg catttgtgcg 501 cgaaaacggc aaaaccgtcc tcgtattcaa tcagggcaac ggcagcttcg 551 agcgcgcctg tgcaaaagga aggcggcagc cggaagcagg acggaaatat 601 taccgcaacg cttgccacaa cggtgcggcc gtttatgctg acgaagccat 651 gcccgtaacg gaattgcttt ataccgccta tccggttggc ggcggcgcgc 701 tgccttattt ttacggggaa cgtcccgacc ccgtgccgga atatgaaatc 751 acaggcaatc ctgccagcat tgattttcc gaggcggcag gcaaaattgc 801 gatgaaaagt ttcaagctgt atcagggtaa aaacgaaatc cgccccgtca 851 gggttttaac cgccggcaac gaccctaacg gcaggctgac cgcgcaccaa 901 ttcgcccttt tcccgctcaa acctttggaa tacggcacgc tttatacggc 951 ggtattcgac tatgtccgca acggacggca cgcgcaggcg aaatggcagt 1001 ttagaacccg aaaacccgat taccctta ttgaggtaaa cggcggcgag 1051 acacttgcgg ttagaaaagg cgaaaaatat ttcatccact ggcgcggacg 1101 ctggtgtctg gaagcgtgta cccgttatac ctaccggcgg cagttcggca 1151 acagcctgtc catactccgg cacgaagcgg gcggcattgt cttcagcgtc 1201 agcggaatgg cgggaagccg catcaggctt actccggaag acagcccgga 1251 acgcggtgta acccttttatt tgcaggattg a
```

This corresponds to the amino acid sequence <SEQ ID 1550; ORF 537.ng>:

```
g537.pep
  1 MKSLFIWLLL LGSAAGVFYH TQNQSLPAGE LVYPSAPQIR DGGDALHYLN

51 RIRTQIGLHA LAHAPVLENS ARRHARYLTL NPEDGHGEHH PDNPHYTAQK

101 LTERTRLAGY LYNGVHENIS TEEEAAESSD SDIRTQQRQV DALMSAIYHR

151 LSLLDRHTDE AGAAFVRENG KTVLVFNQGN GSFERACAKG RRQPEAGRKY

201 YRNACHNGAA VYADEAMPVT ELLYTAYPVG GGALPYFYGE RPDPVPEYEI

251 TGNPASIDFS EAAGKIAMKS FKLYQGKNEI RPVRVLTAGN DPNGRLTAHQ

301 FALFPLKPLE YGTLYTAVFD YVRNGRHAQA KWQFRTRKPD YPYFEVNGGE

351 TLAVRKGEKY FIHWRGRWCL EACTRYTYRR QFGNSLSILR HEAGGIVFSV

401 SGMAGSRIRL TPEDSPERGV TLYLQD *
```

The following partial DNA sequence was identified in *N. meningitidis* <SEQ ID 1551>:

```
m537.seq (partial)
  1 ATGAAATCCC TTTTTATTCG GCTGCTCCTG TTGGGTTCGG CGGCAGGCGT 51 TTTCTACCAT ACCCAAAmCC AATCCCTGCC CGCGGGCGAA CTTGTCTATC

101 CGTCCGCACC GCAAATCAGG GACGGCGGCG ATGCGCTGCA CTACCTCAAC
```

-continued

```
151 CGCATCCGAG CCCAAATCGG TTTGCACAAG CTGGCACACG CGCCGGTTTT

201 GGAAAACTCC GCCCGCAgGC ACGCAAGCTA CCTCACGCTC AATCCCGAAG

251 ACGGACACGG CGAACACCAT CCCGACAATC CGCACTACAC CGCACAAAAG

301 CTGACCGAAC GCACACGCCT TGCCGGGTAT CTCTACAACG GCGTGCATGA

351 AAACATCAGC ACGGAAGAAG AAGCCGCCGA ATCGTCCGAC AGCGACATCC

401 GCACGCAGCA ACGCCAAGTG GACGGATTAA TGAGCGCAAT CTACCACCGC

451 CTTTCCCTAC TTGACCGCCA TACGGATGAG TCAGGAGCGG CATT...
```

This corresponds to the amino acid sequence <SEQ ID 1552; ORF 537>:

```
m537.pep (partial)
  1 MKSLFIRLLL LGSAAGVFYH TQXQSLPAGE LVYPSAPQIR DGGDALHYLN

51 RIRAQIGLHK LAHAPVLENS ARRHASYLTL NPEDGHGEHH PDNPHYTAQK

101 LTERTRLAGY LYNGVHENIS TEEEAAESSD SDIRTQQRQV DGLMSAIYHR

151 LSLLDRHTDE SGAA...
```

Computer analysis of this amino acid sequence gave the following results:
Homology with a Predicted ORF from *N. gonorrhoeae*
ORF 537 shows 95.7% identity over a 164 aa overlap with a predicted ORF (ORF 537.ng) from *N. gonorrhoeae*:

```
   m537/g537
                    10         20         30         40         50         60
     m537.pep  MKSLFIRLLLLGSAAGVFYHTQXQSLPAGELVYPSAPQIRDGGDALHYLNRIRAQIGLHK
               ||||||  |||||||||||||||||||||||||||||||||||||||||||||:|||||
     g537      MKSLFIWLLLLGSAAGVFYHTQNQSLPAGELVYPSAPQIRDGGDALHYLNRIRTQIGLHA
                    10         20         30         40         50         60
          70         80         90        100        110        120
     m537.pep  LAHAPVLENSARRHASYLTLNPEDGHGEHHPDNPHYTAQKLTERTRLAGYLYNGVHENIS
               |||||||||||||| |||||||||||||||||||||||||||||||||||||||||||||
     g537      LAHAPVLENSARRHARYLTLNPEDGHGEHHPDNPHYTAQKLTERTRLAGYLYNGVHENIS
                    70         80         90        100        110        120
         130        140        150        160        170        180
     m537.pep  TEEEAAESSDSDIRTQQRQVDGLMSAIYHRLSLLDRHTDESGAA
               ||||||||||||||||||||:|||||||||||||||||||||:|||
     g537      TEEEAAESSDSDIRTQQRQVDALMSAIYHRLSLLDRHTDEAGAAFVRENGKTVLVFNQGN
                    130        140        150        160        170        180
     g537      GSFERACAKGRRQPEAGRKYYRNACHNGAAVYADEAMPVTELLYTAYPVGGGALPYFYGE
                    190        200        210        220        230        240
```

The following partial DNA sequence was identified in *N. meningitidis* <SEQ ID 1553>:

```
a537.seq
  1 ATGAAATCCC TTTTTATTCG GCTGCTCCTG TTGGGTTCGG CGGCCGGCGT

51 TTTCTATCAT ACCCAAAACC AATCCCTGCC CGCGGGCGAA CTTGTCTATC

101 CGTCCGCACC GCAAATCAGG GACGGCGGCG ATGCGCTGCA CTACCTCAAC

151 CGCATCCGCG CCCAAATCGG TTTGCACAAG CTGGCACACG CGCCGGTTTT

201 GGAAAATTCC GCCCGCAGGC ACGCACGCTA TCTCACGCTC AATCCCGAAG

251 ACGGACACGG CGAACACCAT CCCGACAATC CGCACTACAC CGCACAAAAG

301 CTGACCGAAC GCACACGCCT TGCCGGGTAT CTCTACAACG GCGTGCATGA

351 AAACATCAGC ACGGAAGAGG AAGCCGCCGA ATCGTCCGAC AGCGACATCC
```

```
 401 GCACGCAGCA ACGCCAAGTG GACGGATTAA TGAGCGCAAT CTACCACCGC

451 CTTTCCCTAC TTGACCGCCA TACGGATGAG GCAGGAGCGG CATTTGTGCG

501 CGAAAACGGT AAAACCGTTC TCGTATTCAA TCAGGGCAAC GGCAGGTTTG

551 AGCGGCATTG CGCCCAAGGC AGAAATCAGC CGGAAGCAGG ACGGAAATAT

601 TACCGCAACG CCTGCCATAA CGGTGCGGTC GTGTACACCG ACGAAGCCAT

651 GCCCGCACAG GAGCTGCTCT ATACAGCCTA TCCCGTCGGC AACGGCGCAC

701 TGCCTTATTT CCACGGCGAG CGTCCAGACC CCGTGCCGGA ATATGAAATC

751 ACGGGCAATC CTGCCAGCAT TGATTTTTCC GAGGCGGCAG GCAAAATTAC

801 GATGAAAAGT TTCAAGCTGT ATCAGGGTAA AAACGAAATC CGCCCCGTCA

851 GGGTTTTAAC CGCCGGCAAC GACCCCAACG GCAGGCTGAC CGCGTACCAA

901 TTCGCGCTTT TCCCGCTCAA GCCTTTGGAA TACGGTACGC TTTATACGGC

951 GGTATTCGAC TATGTCCGCA ACGGACGGCG CGCGCAGGCG AAATGGCAGT

1001 TTAGAACCCG AAAACCCGAT TACCCTTATT TTGAGGTAAA CGGCGGCGAG

1051 ACACTTGCGG TTAGAAAAGG CGAAAAATAT TTCATCCACT GGCGCGGACG

1101 CTGGTGTTTG GAAGCGTGTA CCCGTTATAC CTACCGGCAG CGACCCGGCA

1151 GCCGCCTGTC CATAGGAAGG CACAAGGCGG GCGGCATCGT CTTCAGCGTT

1201 GACGGAATGG CGGGCAGCCG CATCACGCTT GCACCGGAAG GAGAAACGGA

1251 ACGAGGCGTA ACCCTTTATT TACAGGATTG A
```

This corresponds to the amino acid sequence <SEQ ID 1554; ORF 537.a>:

```
a537.pep
  1 MKSLFIRLLL LGSAAGVFYH TQNQSLPAGE LVYPSAPQIR DGGDALHYLN

51 RIRAQIGLHK LAHAPVLENS ARRHARYLTL NPEDGHGEHH PDNPHYTAQK

101 LTERTRLAGY LYNGVHENIS TEEEAAESSD SDIRTQQRQV DGLMSAIYHR

151 LSLLDRHTDE AGAAFVRENG KTVLVFNQGN GRFERHCAQG RNQPEAGRKY

201 YRNACHNGAV VYTDEAMPAQ ELLYTAYPVG NGALPYFHGE RPDPVPEYEI

251 TGNPASIDFS EAAGKITMKS FKLYQGKNEI RPVRVLTAGN DPNGRLTAYQ

301 FALFPLKPLE YGTLYTAVFD YVRNGRRAQA KWQFRTRKPD YPYFEVNGGE

351 TLAVRKGEKY FIHWRGRWCL EACTRYTYRQ RPGSRLSIGR HKAGGIVFSV

401 DGMAGSRITL APEGETERGV TLYLQD*
``` m537/a537 98.2% identity in 164 aa overlap

```
                10         20         30         40         50         60
m537.pep  MKSLFIRLLLLGSAAGVFYHTQXQSLPAGELVYPSAPQIRDGGDALHYLNRIRAQIGLHK
          ||||||||||||||||||||||| ||||||||||||||||||||||||||||||||||||
a537      MKSLFIRLLLLGSAAGVFYHTQNQSLPAGELVYPSAPQIRDGGDALHYLNRIRAQIGLHA
                10         20         30         40         50         60

70         80         90        100        110        120
m537.pep  LAHAPVLENSARRHASYLTLNPEDGHGEHHPDNPHYTAQKLTERTRLAGYLYNGVHENIS
          ||||||||||||||| ||||||||||||||||||||||||||||||||||||||||||||
a537      LAHAPVLENSARRHARYLTLNPEDGHGEHHPDNPHYTAQKLTERTRLAGYLYNGVHENIS
                70         80         90        100        110        120
```

```
                  130       140       150       160       170       180
    m537.pep      TEEEAAESSDSDIRTQQRQVDGLMSAIYHRLSLLDRHTDESGAA
                  |||||||||||||||||||||||||||||||||||||||:|||
    a537          TEEEAAESSDSDIRTQQRQVDGLMSAIYHRLSLLDRHTDEAGAAFVRENGKTVLVFNQGN
                  130       140       150       160       170       180 a537          GRFERACAQGRNQPEAGRKYYRNACHNGAVVYADEAMPAQELLTYAYPVGNGALPYFHGE
                       190       200       210       220       230       240
```

The following partial DNA sequence was identified in *N. gonorrhoeae* <SEQ ID 1555>:

```
g538.seq
    1 atgtcaggta gaacaggacg gaacagtgcc actcaggcgc aaccggaacg
   51 cgtcatgctg gtgggcgtaa tgttggataa agatgatacg ggcagcaatg
  101 ccgcccgtct gaacggtttt cagacggcat tggcggaagc cgtcgagctg
  151 gtcaaagcgg cgggcggcga ttccgtacgc gtggagactg ccaaacgcga
  201 ccgcccgcac actgcgctgt ttgtcggcac gggcaaggcg gcggagctgt
  251 cggaagcagt tgccgcagac ggcattgatt tggtcgtatt caaccacgaa
  301 cttactccca cgcaggaacg caatttggaa aaaatcctcc aatgccgcgt
  351 attggacaga gtggggctga ttctggcgat tttcgcccgc cgcgcccgca
  401 cgcaggaagg caggctgcaa gtcgagttgg cgcaattgag ccatttggcg
  451 ggacgcttga tacgcggtta cggacatttg caaagccagc gcggcggtat
  501 cggcatgaaa gggccgggcg aaaccaaact ggaaaccgac cgccgattaa
  551 ccgcccatcg gatcaacgcc ttgaaaaaac agcttgccaa cctcaaaaaa
  601 cagcgcgccc tgcgccgcaa gtcccgcgag tcgggcagaa tcaaaacgtt
  651 tgcgctggtc ggctatacca atgtcggcaa atccagcctg ttcaaccggc
  701 tgaccaagtc gggcatatat gcgaaagacc agcttttcgc cactctcgac
  751 acgacggcgc ggcggctgta catcagtccc gcatgcagca ttatcctgac
  801 cgataccgtc ggattcgtca gcgatctgcc gcacaaactg atttccgcct
  851 tttccgccac cttggaagaa accgtgcaag ccgatgtgct gctgcacgtc
  901 gtcgatgctg ccgcccggaa cagcgggcag cagattgaaa acgtggaaaa
  951 cgtactgcaa gaaatccatg cccacgatat tccgtgcatc aaggtgtaca
 1001 acaaaaccga cctgctgccg tctgaagaac aaaaacacgg gcatatggcg
 1051 gacgctgcgg gaaaaattgc cgccgtccgc atttccgttg ctgaaaatac
```

This corresponds to the amino acid sequence <SEQ ID 1556; ORF 538.ng>:

```
g538.pep
    1 MSGRTGRNSA TQAQPERVML VGVMLDKDDT GSNAARLNGF QTALAEAVEL
   51 VKAAGGDSVR VETAKRDRPH TALFVGTGKA AELSEAVAAD GIDLVVFNHE
  101 LTPTQERNLE KILQCRVLDR VGLILAIFAR RARTQEGRLQ VELAQLSHLA
  151 GRLIRGYGHL QSQRGGIGMK GPGETKLETD RRLTAHRINA LKKQLANLKK
  201 QRALRRKSRE SGRIKTFALV GYTNVGKSSL FNRLTKSGIY AKDQLFATLD
  251 TTARRLYISP ACSIILTDTV GFVSDLPHKL ISAFSATLEE TVQADVLLHV
  301 VDAAARNSGQ QIEDVENVLQ EIHAHDIPCI KVYNKTDLLP SEEQNTGIWR
  351 DAAGKIAAVR ISVAENTGID ALREAIAEYC AAPNTDETE MP*
```

The following partial DNA sequence was identified in *N. meningitidis* <SEQ ID 1557>:

```
m538.seq
   1 ATGACAGGCA GAACAGGCGG CAACGGCAGT ACCCAAGCGC AACCCGAACG
  51 CGTCATGCTG GTGGGCGTAA TGTTGGACAA AGATGGTACG GGCAGTAGTG
 101 CCGCCCGTCT GAACGGTTTT CAGACGGCAT TGGCGGAAGC TGTCGAGCTG
 151 GTCAAAGCGG CGGGCGGCGA TTCCGTGCGC GTGGAGACTG CCAAACGCGA
 201 CCGTCCGCAC ACCGCGCTGT TTGTCGGCAC GGGCAAGGCG GCGGAGCTGT
 251 CAGAAGCAGT TGCCGCAGAC GGCATCGATT TGGTCGTATT CAACCACGAA
 301 CTCACGCCCA CGCAGGAACG CAACCTTGAA AAAGAACTsA AATGCCGCGT
 351 ATTGGACAGG GTAGGGCTGA TTCTGGCGAT TTTCGCTCGC CGCGCCCGCA
 401 CGCAGGAAGG CAGGCTGCAA GTCGAGTTGG CGCAATTGAG CCATTTGGCG
 451 GGACGCTTGA TACGCGGTTA CGGCCATCTG CAGAGCCAGC GCGGCGGTAT
 501 CGGCATGAAA GGCCCCGGCG AAACCAAACT GGAAACCGAC CGCCGATTGA
 551 TCGCCCATCG GATCAATGCC TTGATAAAAC AGCTTGCCAA CCTCAAAAAA
 601 CAGCGCGCCC TGCGCCGCAA GTCnCGCGAA TCGGGCACAA TCAAAACGTT
 651 TGCGCTGGTC GGCTATACAA ATGTCGGAAA ATCCAGCCTG TTCAACCGGC
 701 TGACAAAGTC GGGCATATAT GCAAAGGACA AGCTTAGTCC CGAATGCAGC
 751 ATTATCCTGA CCGATACCGT CGGATTCGTn AGCGATCTGC CGCAcAAACT
 801 GATTTCCGCC TTTTCgCC.A CGCTGGAAGA AACCGCGCAA GCCGATGTGC
 851 TGCTGCACGT CGTCGATGCC GCCGCTCCGA ACAGCGGACA GCAGATTGAA
 901 GACGTGGAAA ACGTACTGCA AGAAATCCAT GCCGGCGATA TTCCGTGCAT
 951 cAAGGTGTAC AACAAAACCG ACCTGCTGCC GTCTGAAGAA CAAAACACGG
1001 GCATATGGCG CGACGCTGCG GGAAAAATTG CCGCCGTCCG CATTTCCGTT
1051 GCTGAAAATA CCGGTATAGA CGCACTGCGC GAAGCcATTG CCGAGTCTTG
1101 TGCCGCCGCA CCAAACACAG ACGAAACCGA AATGCCATGA
```

This corresponds to the amino acid sequence <SEQ ID 1558; ORF 538>:

```
m538.pep
  1 MTGRTGGNGS TQAQPERVML VGVMLDKDGT GSSAARLNGF QTALAEAVEL
 51 VKAAGGDSVR VETAKRDRPH TALFVGTGKA AELSEAVAAD GIDLVVFNHE
101 LTPTQERNLE KELKCRVLDR VGLILAIFAR RARTQEGRLQ VELAQLSHLA
151 GRLIRGYGHL QSQRGGIGMK GPGETKLETD RRLIAHRINA LIKQLANLKK
201 QRALRRKSRE SGTIKTFALV GYTNVGKSSL FNRLTKSGIY AKDKLSPECS
251 IILTDTVGFV SDLPHKLISA FSXTLEETAQ ADVLLHVVDA AAPNSGQQIE
301 DVENVLQEIH AGDIPCIKVY NKTDLLPSEE QNTGIWRDAA GKIAAVRISV
351 AENTGIDALR EAIAESCAAA PNTDETEMP*
```

Computer analysis of this amino acid sequence gave the following results:
Homology with a Predicted ORF from *N. gonorrhoeae*
ORF 538 shows 92.1% identity over a 392 aa overlap with a predicted ORF (ORF 538.ng) from *N. gonorrhoeae*:

```
m538/g538

10        20        30        40        50        60
m538.pep        MTGRTGGNGSTQAQPERVMLVGVMLDKDGTGSSAARLNGFQTALAEAVELVKAAGGDSVR
                |:|||| |::|||||||||||||||||| |||:|||||||||||||||||||||||||||
g538            MSGRTGRNSATQAQPERVMLVGVMLDKDDTGSNAARLNGFQTALAEAVELVKAAGGDSVR
                        10        20        30        40        50        60

70        80        90       100       110       120
m538.pep        VETAKRDRPHTALFVGTGKAAELSEAVAADGIDLVVFNHELTPTQERNLEKELKCRVLDR
                ||||||||||||||||||||||||||||||||||||||||||||||||||| |:||||||
g538            VETAKRDRPHTALFVGTGKAAELSEAVAADGIDLVVFNHELTPTQERNLEKILQCRVLDR
                        70        80        90       100       110       120

130       140       150       160       170       180
m538.pep        VGLILAIFARRARTQEGRLQVELAQLSHLAGRLIRGYGHLQSQRGGIGMKGPGETKLETD
                ||||||||||||||||||||||||||||||||||||||||||||||||||||||||||||
g538            VGLILAIFARRARTQEGRLQVELAQLSHLAGRLIRGYGHLQSQRGGIGMKGPGETKLETD
                       130       140       150       160       170       180

190       200       210       220       230       240
m538.pep        RRLIAHRINALIKQLANLKKQRALRRKSRESGTIKTFALVGYTNVGKSSLFNRLTKSGIY
                ||| ||||||| |||||||||||||||||||| |||||||||||||||||||||||||||
g538            RRLTAHRINALKKQLANLKKQRALRRKSRESGRIKTFALVGYTNVGKSSLFNRLTKSGIY
                       190       200       210       220       230       240

250       260       270       280
m538.pep        AKDKL-------------SPECSIILTDTVGFVSDLPHKLISAFSXTLEETAQADVLLHV
                |||:|             || |||||||||||||||||||||||| |||||:||||||||
g538            AKDQLFATLDTTARRLYISPACSIILTDTVGFVSDLPHKLISAFSATLEETVQADVLLHV
                       250       260       270       280       290       300

290       300       310       320       330       340
m538.pep        VDAAAPNSGQQIEDVENVLQEIHAGDIPCIKVYNKTDLLPSEEQNTGIWRDAAGKIAAVR
                ||||| |||||||||||||||||| |||||||||||||||||||||||||||||||||||
g538            VDAAARNSGQQIEDVENVLQEIHAHDIPCIKVYNKTDLLPSEEQNTGIWRDAAGKIAAVR
                       310       320       330       340       350       360

350       360       370       380
m538.pep        ISVAENTGIDALREAIAESCAAAPNTDETEMPX
                |||||||||||||||||| ||||||||||||||
g538            ISVAENTGIDALREAIAEYCAAAPNTDETEMPX
```

The following partial DNA sequence was identified in *N. meningitidis* <SEQ ID 1559>:

```
a538.seq
   1 ATGACAGGCA GAACAGGCCG CAACGGCAGT ACCCAAGCGC AACCCGAACG

51 CGTCATGCTG GTGGGCGTAA TGTTGGACAA AGATGGTACG GGCAGCAGTG

101 CCACCCGTCT GAACGGTTTT CAGACGGCAT TGGCGGAAGC TGTCGAGCTG

151 GTCAAAGCGG CGGGCGGCGA TTCCGTGCGC GTGGAGACTG CCAAACGCGA

201 CCGTCCGCAC ACCGCGCTGT TTGTCGGCAC GGGCAAGGCG GCGGAGCTGT

251 CGGAAGCAGT TGCCGCAGAC GGCATCGATT TGGTCGTATT CAACCACGAA

301 CTTACGCCCA CGCAGGAACG CAATTTGGAA AAAATCCTCC AATGCCGCGT

351 ATTGGACAGA GTGGGGCTGA TTCTGGCGAT TTTCGCCCGC CGCGCCCGCA

401 CGCAGGAAGG CAGGCTGCAA GTCGAGTTGG CACAATTGAG CCATTTGGCG

451 GGACGCTTGA TACGCGGTTA CGGCCATCTG CAGAGCCAGC GCGGCGGTAT

501 CGGCATGAAA GGCCCCGGCG AAACCAAACT GGAAACCGAC CGCCGATTGA

551 TCGCCCATCG GATCAATGCC TTGAAAAAAC AGCTTGCCAA CCTCAAAAAA

601 CAGCGCGCCC TGCGCCGCAA GTCCCGCGAA TCGGGCACAA TCAAAACGTT

651 TGCGCTGGTC GGCTATACCA ATGTCGGCAA ATCCAGTCTG TTCAACCGGC

701 TGACCAAGTC GGGCATATAT GCGAAAGACC AGCTTTTCGC CACACTCGAC
```

-continued

```
 751 ACGACGGCGC GGCGGCTGTA CATCAGTCCC GAATGCAGCA TTATCCTGAC

801 CGATACCGTC GGATTCGTCA GCGATCTGCC GCACAAACTG ATTTCCGCCT

851 TTTCCGCCAC GCTGGAAGAA ACCGCGCAAG CCGATGTGCT GCTGCACGTC

901 GTCGATGCCG CCGCTCCGAA CAGCGGACAG CAGATTGAAG ACGTGGAAAA

951 CGTACTGCAA GAAATCCATG CCGGCGATAT TCCGTGCATC AAGGTGTACA

1001 ACAAAACCGA CCTGCTGCCG TCTGAAGAAC AAAACACGGG CATATGGCGC

1051 GACGCTGCGG GAAAAATTGC CGCCGTCCGC ATTTCCGTTG CTGAAAATAC

1101 CGGTATAGAC GCACTGCGCG AAGCCATTGC CGAGTATTGT GCCGCCGCAC

1151 CAAACACAGA CGAAACCGAA ATGCCATGA
```

This corresponds to the amino acid sequence <SEQ ID 1560; ORF 538.a>:

```
a538.pep
  1 MTGRTGRNGS TQAQPERVML VGVMLDKDGT GSSATRLNGF QTALAEAVEL

51 VKAAGGDSVR VETAKRDRPH TALFVGTGKA AELSEAVAAD GIDLVVFNHE

101 LTPTQERNLE KILQCRVLDR VGLILAIFAR RARTQEGRLQ VELAQLSHLA

151 GRLIRGYGHL QSQRGGIGMK GPGETKLETD RRLIAHRINA LKKQLANLKK

201 QRALRRKSRE SGTIKTFALV GYTNVGKSSL FNRLTKSGIY AKDQLFATLD

251 TTARRLYISP ECSIILTDTV GFVSDLPHKL ISAFSATLEE TAQADVLLHV

301 VDAAAPNSGQ QIEDVENVLQ EIHAGDIPCI KVYNKTDLLP SEEQNTGIWR

351 DAAGKIAAVR ISVAENTGID ALREAIAEYC AAAPNTDETE MP*
``` m538/a538 94.6% identity in 392 aa overlap

```
                10         20         30         40         50         60
  m538.pep  MTGRTGGNGSTQAQPERVMLVGVMLDKDGTGSSAARLNGFQTALAEAVELVKAAGGDSVR
            |||||  ||||||||||||||||||||||||||| :|||||||||||||||||||||||||
  a538      MTGRTGRNGSTQAQPERVMLVGVMLDKDGTGSSATRLNGFQTALAEAVELVKAAGGDSVR
                10         20         30         40         50         60

70         80         90        100        110        120
  m538.pep  VETAKRDRPHTALFVGTGKAAELSEAVAADGIDLVVFNHELTPTQERNLEKELKCRVKDR
            |||||||||||||||||||||||||||||||||||||||||||||||||||| :||||||
  a538      VETAKRDRPHTALFVGTGKAAELSEAVAADGIDLVVFNHELTPTQERNLEKILQCRVKDR
                70         80         90        100        110        120

130        140        150        160        170        180
  m538.pep  VGLILAIFARRARTWEGRLQVELAQLSHLAGRLIRGYGHLQSQRGGIGMKGPGETKLETD
            ||||||||||||||||||||||||||||||||||||||||||||||||||||||||||||
  a538      VGLILAIFARRARTWEGRLQVELAQLSHLAGRLIRGYGHLQSQRGGIGMKGPGETKLETD
                130        140        150        160        170        180

190        200        210        220        230        240
  m538.pep  RRLIAHRINALIKQLANLKKQRALRRKSRESGTIKTFALVGYTNVGKEELFNRLTKSGIY
            |||||||||||:||||||||||||||||||||||||||||||||||||||||||||||||
  a538      RRLIAHRINALKKQLANLKKQRALRRKSRESGTIKTFALVGYTNVGKEELFNRLTKSGIY
                190        200        210        220        230        240

250        260        270        280
  m538.pep  AKDKL-------------SPECSIILTDTVGFVSDLPHKLISAFSXTLEETAQADVLLHV
            |||:|             |||||||||||||||||||||||||| |||||||||||||
  a538      AKDQLFATLDTTARRLYISPECSIILTDTVGFVSDLPHKLISAFSATLEETAQADVLLHV
                250        260        270        280        290        300

290        300        310        320        330        340
  m538.pep  VDAAAPNSGQQIEDVENVLQEIHAGDIPCIKVYNKTDLLPSEEQNTGIWRDAAGKIAAVR
            ||||||||||||||||||||||||||||||||||||||||||||||||||||||||||||
  a538      VDAAAPNSGQQIEDVENVLQEIHAGDIPCIKVYNKTDLLPSEEQNTGIWRDAAGKIAAVR
                310        320        330        340        350        360
```

```
                              -continued
           350       360       370       380
    m538.pep    ISVAENTGIDALREAIAESCAAAPNTDETEMPX
               |||||||||||||||||| |||||||||||||||
    a538       ISVAENTGIDALREAIAEYCAAAPNTDETEMPX
                         370       380       390
```

The following partial DNA sequence was identified in *N. gonorrhoeae* <SEQ ID 1561>:

```
g539.seq
    1 atggaggatc tgcaggaaat cgggttcgat gtcgccgccg taaaggtagg
   51 tcggcagcgc gaacatcatc gtctgcatca tacccagtcc ggcaacggca
  101 aggcggacga tgtattgttt gcgttctttt tggttggcgg cttcgatttt
  151 ttgcgcgtca tagggtgcgg cggtgtagcc tgtctgccgg attttcaaca
  201 gaatgtcgga gaggcggatt ttgccgtcgt cccagacgac gcggcagcgg
  251 tgcgtgctgt aattgaggtc gatgcggacg atgccgtctg tgcgcaaaag
  301 ctgctgttcg atcagccaga cgcaggcggc gcaggtaatg ccgctgagca
  351 tcagcactgc ttcgtgcgtg ccattatggg tttccacaaa gtcggattgg
  401 acttcgggca ggtcgtacag gcggatttgg tcgaggattt cttggggcgg
  451 cagttcggtt tttttcgcgt cggcggtgcg tcgtttgtaa taactgccca
  501 agccggaatc gatgatgctt tgtgcgactg cctgacagcc gacgcagcag
  551 gtttcgcggt cttcgccttc gtagcggacg gtcagatgca ggttttcggg
  601 aacgtccagc ccgcagtgga acaggttttt ttcatggcca tttcggtttc
  651 gtctgtgttt ggtgcggcgg cacaatactc ggcaatggct tcgcgcagtg
  701 cgtctatacc ggtattttca gcaacggaaa tgcggacggc ggcaattttt
  751 cccgcagcgt cgcgccatat gcccgtgttt tgttcttcag acggcagcag
  801 gtcggttttg ttgtacacct tgatgcacgg aatatcgtgg gcatggattt
  851 cttgcagtac gttttccacg tcttcaatct gctgcccgct gttccgggcg
  901 gcagcatcga cgacgtgcag cagcacatcg gcttgcacgg tttcttccaa
  951 ggtggcggaa aaggcggaaa tcagtttgtg cggcagatcg ctgacgaatc
 1001 cgacggtatc ggtcaggata atgctgcatg cgggactgat gtacagccgc
 1051 cgcgccgtcg tgtcgagagt ggcgaaaagc tggtctttcg catatatgcc
 1101 cgacttggtc agccggttga acaggctgga tttgccgaca ttggtatag
```

This corresponds to the amino acid sequence <SEQ ID 1562; ORF 539.ng>:

```
g539.pep
    1 MEDLQEIGFD VAAVKVGRQR EHHRLHHTQS GNGKADDVLF AFFLVGGFDF
   51 LRVIGCGGVA CLPDFQQNVG EADFAVVPDD AAAVRAVIEV DADDAVCAQK
  101 LLFDQPDAGG AGNAAEHQHC FVRAIMGFHK VGLDFGQVVQ ADLVEDFLGR
  151 QFGFFRVGGA SFVITAQAGI DDALCDCLTA DAAGFAVFAF VADGQMQVFG
  201 NVQPAVETGF FHGISVSSVF GAAAQYSAMA SRSASIPVFS ATEMRTAAIF
  251 PAASRHMPVF CSSDGSRSVL LYTLMHGISW AWISCSTFST SSICCPLFRA
  301 AASTTCSSTS ACTVSSKVAE KAEISLCGRS LTNPTVSVRI MLHAGLMYSR
  351 RAVVSRVAKS WSFAYMPDLV SRLNRLDLPT LV*
```

The following partial DNA sequence was identified in *N. meningitidis* <SEQ ID 1563>:

```
m539.seq (partial)
   1 ATGGAGGATT TGCAGGAAAT CGGGTTCGAT GTCGCCGCCG TAAAGGTAGG
  51 TCGGCAGCGC GAACATCATC GTCTGCATCA TCCCCAGCCC GGCAACGGCG
 101 AGGCGGACGA TGTATTGTTT GCGTTCTTTT TGGTTGGCGG CTTCGATTTT
 151 TTGCGCGTCA TAGGGTGCGG CGGTGTAGCC TATCTGCCTG ATTTTCAACA
 201 GAATGTCGGA AAGGCGGATT TTGCCGTCGT CCCAGACGAc GCGGCaGCgG
 251 TGCGTGCTGT AATTGAGGTC GATGCGGACG ATGCCGTCTG TACGCAAAAG
 301 CTGCTGTTCG ATCAGCCAGA CGCAGGCGGC GCAGGTGATG CCGCCGAGCA
 351 TTAAAACCGC CTCGCGCGTG CCGCCGTGGG TTTCCACAAA GTCGGACTGG
 401 ACTTCGGGCA GGTCGTACAG GCGGATTTGG TCGAGGATTT CTTGGGGCGG
 451 CAgCTCGGTT TTTTGCGCGT CGGCGGTGCG TTGTTTGTAA TAACTGCCCA
 501 AGCCCGCGTC AATAATGCTT TGTGCGACCG CCTGACAGCC GGCGCaCAgG
 551 GTTTCGCGGT CTTCGTTTTC GTAACGGACA GTCAGGTGGA GGTGTTCGGG
 601 AACATCCAGA CCGCAGTGGA AACAGGTTTT TTTCATGGCA TTTCGGTTTC
 651 GTCTGTGTTT GGTGCGGCGG CACAAGACTC GGCAATgGCT TCGCGCAGTG
 701 CGTCTATACC GGTATTTTCA GCAACGGAAA TGCGGACGGC GGCAATTTTT
 751 CCCGCAGCGT CGCGCCATAT GTCTGTGTTT TGTTCTTCAG ACGGCAGCAG
 801 GTCGGTTTTG TTGTACACCT TgATGCACGG AATATCGCCG GCATGGATTT
 851 CTTGCAGTAC GTTTTCCACG TCTTCAATCT GCTGTCCGCT GTTCGGAGCG
 901 GCGGCATCGA CGACGTGCAG CAGCACATCG GCTTGCGCGG TTTCTTCCAG
 951 CGTGGcG.AA AAGGCGGAAA TCAGTTTgTG CGGCAGATCG CTnACGAATC
1001 CGACGGTATC GGTCAGGATA ATGCTGCATT CGGGAC...
```

This corresponds to the amino acid sequence <SEQ ID 1564; ORF 539>:

```
m539.pep (partial)
   1 MEDLQEIGFD VAAVKVGRQR EHHRLHHPQP GNGEADDVLF AFFLVGGFDF
  51 LRVIGCGGVA YLPDFQQNVG KADFAVVPDD AAAVRAVIEV DADDAVCTQK
 101 LLFDQPDAGG AGDAAEH*NR LARAAVGFHK VGLDFGQVVQ ADLVEDFLGR
 151 QLGFLRVGGA LFVITAQARV NNALCDRLTA GAQGFAVFVF VTDSQVEVFG
 201 NIQTAVETGF FHGISVSSVF GAAAQDSAMA SRSASIPVFS ATEMRTAAIF
 251 PAASRHMPVF CSSDGSRSVL LYTLMHGISP AWISCSTFST SSICCPLFGA
 301 AASTTCSSTS ACAVSSSVAX KAEISLCGRS LTNPTVSVRI MLHSG....
```

Computer analysis of this amino acid sequence gave the following results:

Homology with a Predicted ORF from *N. gonorrhoeae*
ORF 539 shows 89% identity over a 345 aa overlap with a predicted ORF (ORF 539.ng) from *N. gonorrhoeae*:

```
m539/g539

10        20        30        40        50        60
    m539.pep   MEDLQEIGFDVAAVKVGRQREHHRLHHPQPGNGEADDVLFAFFLVGGFDFLRVIGCGGVA
               |||||||||||||||||||||||| | |||:||||||||||||||||||||||||||||
    g539       MEDLQEIGFDVAAVKVGRQREHHRLHHTQSGNGKADDVLFAFFLVGGFDFLRVIGCGGVA
                       10        20        30        40        50        60

70        80        90       100       110       120
    m539.pep   YLPDFQQNVGKADFAVVPDDAAAVRAVIEVDADDAVCTQKLLFDQPDAGGAGDAAEHXNR
               ||||||||||:||||||||||||||||||||||||||:||||||||||||||:||||  :
    g539       CLPDFQQNVGEADFAVVPDDAAAVRAVIEVDADDAVCAQKLLFDQPDAGGAGNAAEHQHC
                       70        80        90       100       110       120

130       140       150       160       170       180
    m539.pep   LARAAVGFHKVGLDFGQVVQADLVEDFLGRQLGFLRVGGALFVITAQARVNNALCDRLTA
               ::|| :||||||||||||||||||||||||||:||:|||||:|||||| :::|||| |||
    g539       FVRAIMGFHKVGLDFGQVVQADLVEDFLGRQFGFFRVGGASFVITAQAGIDDALCDCLTA
                      130       140       150       160       170       180

190       200       210       220       230       240
    m539.pep   GAQGFAVFVFVTDSQVEVFGNIQTAVETGFFHGISVSSVFGAAAQDSAMASRSASIPVFS
               | |||||:||:|:|::|||||:| |||||||||||||||||||||| ||||||||||||
    g539       DAAGFAVFAFVADGQMQVFGNVQPAVETGFFHGISVSSVFGAAAQYSAMASRSASIPVFS
                      190       200       210       220       230       240

250       260       270       280       290       300
    m539.pep   ATEMRTAAIFPAASRHMPVFCSSDGSRSVLLYTLMHGISPAWISCSTFSTSSICCPLFGA
               |||||||||||||||||||||||||||||||||||||||| ||||||||||||||||| |
    g539       ATEMRTAAIFPAASRHMPVFCSSDGSRSVLLYTLMHGISWAWISCSTFSTSSICCPLFRA
                      250       260       270       280       290       300

310       320       330       340
    m539.pep   AASTTCSSTSACAVSSSVAXKAEISLCGRSLTNPTVSVRIMLHSG
               ||||||||||||:|||:|| ||||||||||||||||||||||||:|
    g539       AASTTCSSTSACTVSSKVAEKAEISLCGRSLTNPTVSVRIMLHAGLMYSRRAVVSRVAKS
                      310       320       330       340       350       360 g539       WSFAYMPDLVSRLNRLDLPTLV
                      370       380
```

The following partial DNA sequence was identified in *N. meningitidis* <SEQ ID 1565>:

```
a539.seq
   1 ATGGAGGATT TGCAGGAAAT CGGGTTCGAT GTCGCCGCCG TAAAGGTAGG

51 TCGGCAGCGC GAACATCATC GTCTGCATCA TCCCCAGCCC GGCAACGGCG

101 AGGCGGACGA TGTATTGTTT GCGTTCTTTT TGGTTGGCGG CTTCGATTTT

151 TTGCGCGTCA TAGGGTGCGG CGGTGTAGCC TATCTGCCTG ATTTTCAACA

201 GAATGTCGGA AAGGCGGATT TTGCCGTCGT CCCAGACGAC GCGGCAGCGG

251 TGCGTGCTGT AATTGAGGTC GATGCGGACG ATGCCGTCTG TACGCAAAAG

301 CTGCTGTTCG ATCAGCCAGA CGCAGGCGGC GCAGGTGATG CCGCCGAGCA

351 TTAAAACCGC CTCGCGCGTG CCGCCGTGGG TTTCCACAAA GTCGGACTGG

401 ACTTCGGGCA GGTCGTACAG GCGGATTTGG TCGAGGATTT CTTGGGGCGG

451 CAGCTCGGTT TTTTGCGCGT CGGCGGTGCG TTGTTTGTAA TAACTGCCCA

501 AGCCCGCGTC AATAATGCTT TGTGCGACTG CCTGACAACC GGCGCAGCAG

551 GTTTCGCGGT CTTCGTTTTC GTAACGGACG GTCAGATGCA GGTTTTCGGG

601 AACGTCCAGC CCGCAGTGGA AACAGGTTTT TTTCATGGCA TTTCGGTTTC

651 GTCTGTGTTT GGTGCGGCGG CACAATACTC GGCAATGGCT TCGCGCAGTG

701 CGTCTATACC GGTATTTTCA GCAACGGAAA TGCGGACGGC GGCAATTTTT
```

```
-continued
 751 CCCGCAGCGT CGCGCCATAT GCCCGTGTTT TGTTCTTCAG ACGGCAGCAG

801 GTCGGTTTTG TTGTACACCT TGATGCACGG AATATCGCCG GCATGGATTT

851 CTTGCAGTAC GTTTTCCACG TCTTCAATCT GCTGTCCGCT GTTCGGAGCG

901 GCGGCATCGA CGACGTGCAG CAGCACATCG GCTTGCGCGG TTTCTTCCAG

951 CGTGGCGGAA AAGGCGGAAA TCAGTTTGTG CGGCAGATCG CTGACGAATC

1001 CGACGGTATC GGTCAGGATA ATGCTGCATT CGGGACTGAT GTACAGCCGC

1051 CGCGCCGTCG TGTCGAGTGT GGCGAAAAGC TGGTCTTTCG CATATATGCC

1101 CGACTTGGTC AGCCGGTTGA ACAGACTGGA TTTGCCGACA TTGGTATAG
                                                       15
```

This corresponds to the amino acid sequence <SEQ ID
1566; ORF 539.a>:

```
a539.pep
  1 MEDLQEIGFD VAAVKVGRQR EHHRLHHPQP GNGEADDVLF AFFLVGGFDF

51 LRVIGCGGVA YLPDFQQNVG KADFAVVPDD AAAVRAVIEV DADDAVCTQK

101 LLFDQPDAGG AGDAAEH*NR LARAAVGFHK VGLDFGQVVQ ADLVEDFLGR

151 QLGFLRVGGA LFVITAQARV NNALCDCLTT GAAGFAVFVF VTDGQMQVFG

201 NVQPAVETGF FHGISVSSVF GAAAQYSAMA SRSASIPVFS ATEMRTAAIF

251 PAASRHMPVF CSSDGSRSVL LYTLMHGISP AWISCSTFST SSICCPLFGA

301 AASTTCSSTS ACAVSSSVAE KAEISLCGRS LTNPTVSVRI MLHSGLMYSR

351 RAVVSSVAKS WSFAYMPDLV SRLNRLDLPT LV*
``` m539/a539 97.1% identity in 345 aa overlap

```
                  10         20         30         40         50         60
    m539.pep  MEDLQEIGFDVAAVKVGRQREHHRLHHPQPGNGEADDVLFAFFLVGGFDFLRVIGCGGVA
              ||||||||||||||||||||||||||||||||||||||||||||||||||||||||||||
        a539  MEDLQEIGFDVAAVKVGRQREHHRLHHPQPGNGEADDVLFAFFLVGGFDFLRVIGCGGVA
                  10         20         30         40         50         60

70         80         90        100        110        120
    m539.pep  YLPDFQQNVGKADFAVVPDDAAAVRAVIEVDADDAVCTQKLLFDQPDAGGAGDAAEHXNR
              ||||||||||||||||||||||||||||||||||||||||||||||||||||||||||||
        a539  YLPDFQQNVGKADFAVVPDDAAAVRAVIEVDADDAVCTQKLLFDQPDAGGAGDAAEHXNR
                  70         80         90        100        110        120

130        140        150        160        170        180
    m539.pep  LARAAVGFHKVGLDFGQVVQADLVEDFLGRQLGFLRVGGALFVITAQARVNNALCDRLTA
              ||||||||||||||||||||||||||||||||||||||||||||||||||||||||||||
        a539  LARAAVGFHKVGLDFGQVVQADLVEDFLGRQLGFLRVGGALFVITAQARVNNALCDRLTA
                 130        140        150        160        170        180

190        200        210        220        230        240
    m539.pep  GAQGFAVFVFVTDSQVEVFGNIQTAVETGFFHGISVSSVFGAAAQDSAMASRSASIPVFS
              || ||||||||||:|::||||:| |||||||||||||||||||||  ||||||||||||
        a539  GAAGFAVFVFVTDGQMQVFGNVQPAVETGFFHGISVSSVFGAAAQYSAMASRSASIPVFS
                 190        200        210        220        230        240

250        260        270        280        290        300
    m539.pep  ATEMRTAAIFPAASRHMPVFCSSDGSRSVLLYTLMHGISPAWISCSTFSTSSICCPLFGA
              ||||||||||||||||||||||||||||||||||||||||||||||||||||||||||||
        a539  ATEMRTAAIFPAASRHMPVFCSSDGSRSVLLYTLMHGISPAWISCSTFSTSSICCPLFGA
                 250        260        270        280        290        300

310        320        330        340
    m539.pep  AASTTCSSTSACAVSSSVAXKAEISLCGRSLTNPTVSVRIMLHSG
              |||||||||||||||||||| ||||||||||||||||||||||||
        a539  AASTTCSSTSACAVSSSVAEKAEISLCGRSLTNPTVSVRIMLHSGLMYSRRAVVSSVAKS
                 310        320        330        340        350        360 a539  WSFAYMPDLVSRLNRLDLPTLVX
                 370        380
```

The following partial DNA sequence was identified in *N. gonorrhoeae* <SEQ ID 1567>:

```
g540.seq
   1 atgccgccct cccgacgcgg caacggggtg ttttatcaaa acggcaaact 51 tgccaatgcg gtttccgctt gccgattgcc aaaccggcaa acctttcccg 101 tgccggtgcc gaacccgatg ccgtctgaac cttcagacgg catcgggtgt 151 ttatttgtcc actcggacgg gtgcaggttc gtattgtgtc gattcgtcgc 201 cgtaatacag cacgccgagt ttgacgggga tgcgtccctg cgatttgcgg 251 tgggcgttgg aatcgcgcaa ggaatacgcg cagccgcagt attcctgctg 301 gtagaagttt tcgcgtttgc tgatttcaat catacgcgcg ccgccgccgc 351 ctttgcgcca gttgaagtcc aataggcca catcatcgta aggcgcggcg 401 gcacggtgtc cgcagtcgtt gatttgcgcc atatttttcc agcgtga
```

This corresponds to the amino acid sequence <SEQ ID 1568; ORF 540.ng>:

```
g540.pep
   1 MPPSRRGNGV FYQNGKLANA VSACRLPNRQ TFPVPVPNPM PSEPSDGIGC

51 LFVHSDGCRF VLCRFVAVIQ HAEFDGDASL RFAVGVGIAQ GIRAAAVFLL

101 VEVFAFADFN HTRAAAAFAP VEVPIGHIIV RGGTVSAVV DLRHIFPA *
```

The following partial DNA sequence was identified in *N. meningitidis* <SEQ ID 1569>:

```
m540.seq (partial)
   1 ..CCGAACCCGA TGCCGTCTGA ACCTTCAGAC GGCATCGGGT GTTTATTTGT

51   CCACCCGGAT GGGGGCAGGT TCGTATTGTG TCGATTCGTC GCCGTAATAC

101   AGCACGCCGA GTTTGATGGG GATTCTGCCC TGTGATTTGC GGTGGGCATT

151   GGAATCCCTC AGGGAATAGG CACAACCGCA ATATTCCTGC TGGTAGAAGT

201   TTTCACGTTT GCTGATTTCA ATCATGCGCG CGCTGCCGCC GCCTTTGCGC

251   CAGTTGAAAT CCCAATACAC CACATCATCG TAAGGCGCGC CGGCGCGGTG

301   TCCGCAGTCG TTGATTTGCG CCATATTTTT CCAGCGTGA
```

This corresponds to the amino acid sequence <SEQ ID 1570; ORF 540>:

```
m540.pep (partial)
   1 ..PNPMPSEPSD GIGCLFVHPD GGRFVLCRFV AVIQHAEFDG DSAL*FAVGI

51   GIPQGIGTTA IFLLVEVFTF ADFNHARAAA AFAPVEIPIH HIIVRRGGAV

101   SAVVDLRHIF PA*
```

Computer analysis of this amino acid sequence gave the following results:
Homology with a Predicted ORF from *N. gonorrhoeae*
ORF 540 shows 85.7% identity over a 112 aa overlap with a predicted ORF (ORF 540.ng) from *N. gonorrhoeae*:

```
m540/g540
                                          10        20        30
  m540.pep                        PNPMPSEPSDGIGCLFVHPDGGRFVLCRFV
                                  ||||||||||||||| || ||||||||
  g540      GNGVFYQNGKLANAVSACRLPNRQTFPVPVPNPMPSEPSDGIGCLFVHSDGCRFVLCRFV
            10        20        30        40        50        60

40        50        60        70        80        90
  m540.pep AVIQHAEFDGDSALXFAVGIGIPQGIGTTAIFLLVEVFTFADFNHARAAAAFAPVEIPIH
           ||||||||||::| ||||:|| ||| ::|:|||||:||||||:|||||||||||:||
  g540     AVIQHAEFDGDASLRFAVGVGIAQGIRAAAVFLLVEVFAFADFNHTRAAAAFAPVEVPIG
           70        80        90       100       110       120

100       110
  m540.pep HIIVRRGGAVSAVVDLRHIFPAX
           ||||||||:||||||||||||||
  g540     HIIVRRGGTVSAVVDLRHIFPAX
           130       140
```

L' estremita' N-terminale di meningococco e' assente perche' interviene la fine del contig The following partial DNA sequence was identified in *N. meningitidis* <SEQ ID 1571>:

```
a540.seq
   1 ATGCCGTCCT CCCGACGCGG CAACGGGGTG TTTTATCAAA ACGGCAAACT

51 TGCCAATGCG GTTTCCGATT GCAGATTGCC AAACCGGCAA ACCTTTCCCG

101 TGCCGATGCC GAACCCGATG CCGTCTGAAC CTTCAGACGG CATCGGGTGT

151 TTATTTGTCC ACCCGGATGG GTGCAGGTTC GTATTGTGTC GATTCGTCGC

201 CGTAATACAG CACGCCGAGT TTGATGGGGA TTCTGCCCTG TGATTTGCGG

251 TGGGCGTTGG AATCCCTCAG GGAATAGGCA CAACCGCAAT ATTCCTGCTG

301 GTAGAAGTTT TCACGTTTGC TGATTTCAAT CATACGCGCG CTGCCGCCGC

351 CTTTGCGCCA GTTGAAATCC CAATACACCA CATCATCGTA AGGCGCGGCG

401 GCGCGGCGGC CGCAGTCGTT AATCTGGTTC ATGTTTTTCC A
```

This corresponds to the amino acid sequence <SEQ ID 1572; ORF 540.a>:

```
a540.pep (partial)
   1 MPSSRRGNGV FYQNGKLANA VSDCRLPNRQ TFPVPMPNPM PSEPSDGIGC

51 LFVHPDGCRF VLCRFVAVIQ HAEFDGDSAL *FAVGVGIPQ GIGTTAIFLL

101 VEFTFADFN HTRAAAAFAP VEIPIHHIIV RRGGAAAAVV NLVHVFP
``` m540/a540 92.8% identity in 111 aa overlap

```
                                          10        20        30
  m540.pep                        PNPMPSEPSDGIGCLFVHPDGGRFVLCRFV
                                  ||||||||||||||||||||| ||||||||
  a540      GNGVFYQNGKLANAVSDCRLPNRQTFPVPMPNPMPSEPSDGIGCLFVHPDGCRFVLCRFV
            10        20        30        40        50        60

40        50        60        70        80        90
  m540.pep AVIQHAEFDGDSALXFAVGIGIPQGIGTTAIFLLVEVFTFADFNHARAAAAFAPVEIPIH
           ||||||||||||||||||:|||||||||||||||||||||||||||:|||||||||||||
  a540     AVIQHAEFDGDSALXFAVGVGIPQGIGTTAIFLLVEVFTFADFNHTRAAAAFAPVEIPIH
           70        80        90       100       110       120
```

```
                  100        110
m540.pep  HIIVRRGGAVSAVVDLRHIFPAX
          |||||||||::|||:| |:||
   a540   HIIVRRGGAAAAVVNLVHVFP
                  130        140
```

The following partial DNA sequence was identified in *N. gonorrhoeae* <SEQ ID 1573>:

```
g542.seq
  1 atgccgaaat ggtcgcgcat acggcgttgc agcgtccttt cgctgatgtt 51 cagcgcggct gtcagccggt tgacttggtg tgcgccgccg tcgaacgcgg 101 cattcagggt gcggctgaag tcttcagacg gcatagcgtc tgcttccgcc 151 gtttgccccg ccgccggctc gatgccgtct gaaaccgtgt cccacaaatc 201 cgacagcagc cgcaacacgt ccgcctcgcg gcgcaatgtt tcgcccaaat 251 gccccttttgg gacggtttgc aggcaggatg ccgccaagcc gcgcaggttt 301 gggggcaaat cccatatcct gaccggttcg cggtaa
```

This corresponds to the amino acid sequence <SEQ ID 1574; ORF 542.ng>:

```
g542.pep
  1 MPKWSRIRRC SVLSLMFSAA VSRLTWCAPP SNAAFRVRLK SSDGIASASA

51 VCPAAGSMPS ETVSHKSDSS RNTSASRRNV SPKCPFGTVC RQDAAKPRRF

101 GGKSHILTGS R*
```

The following partial DNA sequence was identified in *N. meningitidis* <SEQ ID 1575>:

```
m542.seq
  1 ATGCCGAAAT GGTCGCGCAT ACGGCGTTGC AGCGTCCTTT CACTGATGTT

51 CAGCGCGTCT GTCAGCCGGT TGACTTGGTG TGCGCCGTCG GCAAACGCGG

101 CATTTAGGGT GCGGCTGAAG TCTTCAGACG GCATAGCGTC TGCTTCCGCC

151 GTTTGCCCCG CCGCCGGCCC GATGCCGTCT GAAACCGTGT CCCACAAGTC

201 CGACAGCAGC CGCAACACGT CCGCCTCGCG .CGCAATGTT TCGCCCAAAT

251 GCCCCTTTGG GACGGCTTTC AGGCAGGATG CCGCCAAGCC GCGCAGGTTC

301 GGGGGCAAAT CCCATATCCT GACCGGTTCG CGGTAA
```

This corresponds to the amino acid sequence <SEQ ID 1576; ORF 542>:

```
m542.pep
  1 MPKWSRIRRC SVLSLMFSAS VSRLTWCAPS ANAAFRVRLK SSDGIASASA

51 VCPAAGPMPS ETVSHKSDSS RNTSASRAMF RPNAPLGRNV SPKCPFGTAF

101 RQDAAKPRRF GGKSHILTGS R*
```

Computer analysis of this amino acid sequence gave the following results:
Homology with a Predicted ORF from *N. gonorrhoeae*
ORF 542 shows 93.7% identity over a 111 aa overlap with a predicted ORF (ORF 542.ng) from *N. gonorrhoeae*:

```
m542/g542
                10        20        30        40        50        60
     m542.pep MPKWSRIRRCSVLSLMFSASVSRLTWCAPSANAAFRVRLKSSDGIASASAVCPAAGPMPS
              ||||||||||||||||||:||||||||| :||||||||||||||||||||||||| |||
     g542     MPKWSRIRRCSVLSLMFSAAVSRLTWCAPPSNAAFRVRLKSSDGIASASAVCPAAGSMPS
                10        20        30        40        50        60

70        80        90       100       110
     m542.pep ETVSHKSDSSRNTSASXRNVSPKCPFGTAFRQDAAKPRRFGGKSHILTGSRX
              |||||||||||||||||| ||||||||||:||||||||||||||||||||||
     g542     ETVSHKSDSSRNTSASRRNVSPKCPFGTVCRQDAAKPRRFGGKSHILTGSRX
                70        80        90       100       110
```

The following partial DNA sequence was identified in *N. meningitidis* <SEQ ID 1577>:

```
a542.seq
   1 ATGCCGAAAT GGTCGCGCAT ACGGCGTTGC AGCGTCCTTT CGCTGATGTT

51 CAGCGTGTCT GCCAGCCGGT TGACTTGATG TGCGCCGCCG GCAAACGCGG

101 CATTCAGGAT GCGGCTGAAG TCTTCAGACG GCATAGCGTC TGCTTCCGCC

151 GTTTGCCCCG CCGCCGGCCC GATGCCGTCT GAAACCGTGT CCCACAAGTC

201 CGACAGCAGC CGCAACACGT CCGCCTCGCG GCGCAATGTT TCGCCCAAAT

251 GCCCCTTTGG GACGGCTTTC AGGCAGGATG CCGCCAAGCC GCGCAGGTTC

301 GGGGGCAAAT CCCATATCCT GACCGGTTCG CGGTAA
```

This corresponds to the amino acid sequence <SEQ ID 1578; ORF 542.a>:

```
a542.pep
   1 MPKWSRIRRC SVLSLMFSVS ASRLT*CAPP ANAAFRMRLK SSDGIASASA

51 VCPAAGPMPS ETVSHKSDSS RNTSASRRNV SPKCPFGTAF RQDAAKPRRF

101 GGKSHILTGS R*
``` m542/a542 94.6% identity in 111 aa overlap

```
                10        20        30        40        50        60
     m542.pep MPKWSRIRRCSVLSLMFSASVSRLTWCAPSANAAFRVRLKSSDGIASASAVCPAAGPMPS
              ||||||||||||||||||:|:||||  ||| ||||||:||||||||||||||||||||||
     a542     MPKWSRIRRCSVLSLMFSVSASRLTXCAPPANAAFRMRLKSSDGIASASAVCPAAGPMPS
                10        20        30        40        50        60

70        80        90       100       110
     m542.pep ETVSHKSDSSRNTSASXRNVSPKCPFGTAFRQDAAKPRRFGGKSHILTGSRX
              |||||||||||||||| ||||||||||||||||||||||||||||||||||||
     a542     ETVSHKSDSSRNTSASRRNVSPKCPFGTAFRQDAAKPRRFGGKSHILTGSRX
                70        80        90       100       110
```

The following partial DNA sequence was identified in *N. gonorrhoeae* <SEQ ID 1579>:

```
g543.seq
    1 atggtttgtc ggttatttgc cgccgttttt ggctttcaac tcggcaatca 51 gcccgtcgat gcctttggct ttgatgattt cgccgaattg gttgcggtac 101 acggtaacca ggctcgtgcc ttcgatggcg acgttgtagg tacggtattt
```

-continued

```
 151 gccgccgctt tggtaggtgg taaagtccat attgacgggc ttctgaccgg
 201 ggatgccgac ttcggcacgg acgacgattt ccttgccgcc cttattgacg
 251 atgggattgt ctttgacgtt gacggtcgcg tttttgaatt tcagcatcgt
 301 gccggaatag gtgcggatca gcagggtttg aaattctttg gccaacgctt
 351 gtttttgcgc gtcggacgcg gtacgccaag ggttgccgac cgccaatgcg
 401 gtcatacgtt ggaaatcgaa atagggaacc gcataggctt cggcttttgg
 451 gcgtgcagaa gccgcgtcgc cgcttttgag gatggtcaaa acctgtgtgg
 501 cgtttggcg gatttgtccc actgcgtcgg ccggggaggc aaatgccatg
 551 ccgatgctca aaataccgat gcccaatgcg ctgatgaagg aggatttttt
 601 cacgatgtct ttcctgaaaa tggatgtgta tgtttattct gcggcttttt
 651 ccgcattgcc gccctcagcg tttttctcgg cgaagctggt catgaattta
 701 ccgatcaggt tttccagaac cattgcagaa ctggttacgg agatggtgtc
 751 gccggcagca aggttttccg tatcgccgcc ctgctgcagc ccgatgtact
 801 gttcgcccaa aagtcccgaa gtcaggattt gcgcggaaac gtcactgctg
 851 aactgatact tgccgtccaa atcaaggcgc accctcgcct gataggattt
 901 cgggtcaagc ccgatagcgc cgacgcgccc gaccaatacg cctgcggatt
 951 tgacgggggc attgaccttc aaaccgccga tgtcgccgaa atcggcataa
1001 acggcgtaag ttttgtccga accgccgaac gccgcgccgc ccgccacgcg
1051 gaaagcgaga aaggcaaccg ccgccgcgcc gatcaagacg aacagtccga
1101 cccaaaattc caatatgttc tttttcatta a
```

This corresponds to the amino acid sequence <SEQ ID 1580; ORF 543.ng>:

```
g543.pep
  1 MVCRLFAAVF GFQLGNQPVD AFGFDDFAEL VAVHGNQARA FDGDVVGTVF
 51 AAALVGGKVH IDGLLTGDAD FGTDDDFLAA LIDDGIVFDV DGRVFEFQHR
101 AGIGADQQGL KFFGQRLFLR VGRGTPRVAD RQCGHTLEIE IGNRIGFGFW

151 ACRSRVAAFE DGQNLCGVLA DLSHCVGRGG KCHADAQNTD AQCADEGGFF

201 HDVFPENGCV CLFCGFFRIA ALSVFLGEAG HEFTDQVFQN HCRTGYGDGV

251 AGSKVFRIAA LLQPDVLFAQ KSRSQDLRGN VTAELILAVQ IKAHPRLIGF

301 RVKPDSADAP DQYACGFDGG IDLQTADVAE IGINGVSFVR TAERRAARHA

351 ESEKGNRRRA DQDEQSDPKF QYVLFH*
```

The following partial DNA sequence was identified in *N. meningitidis* <SEQ ID 1581>:

```
m543.seq
  1 ATGGTTTGTC GGTTATTTGC CGCCGTTTTT GGCTTTCAAC TCGGCAATCA
 51 GTCCGTCCAC GCCTTTCGCT TTGATAATTT CGCCGAATTG GTTGCGGTAC
101 ACGGTAACCA GGCTCGCGCC TTCGATGGCG ACGTTGTAGG TACGGTATTT
151 ACCGCCGCTT TGGTAGGTGG TGAAGTCCAT GTTGACGGGT TTTTGCCCGG
201 GTACGCCGAC TTCGGCGCGG ACGATGATTT CTTTGCCGCC TTTATTGACG
251 ATGGGATTGT CTTTGACGTT GACGTTGGCG TTTTTTAATT TCAGCATCGT
```

-continued

```
 301 GCCGGAATAG GTGCGGATCA GCAGGGTTTG AAATTCTTTG GCCAACGCTT

351 GTTTTTGCGC GTCGGACGCG GTGCGCCAAG GGTTGCCGAC CGCCAATGCG

401 GTCATACGTT GGAAATCGAA ATAGGGAATC GCATAGGCTT CGGCTTTTTG

451 GCGAGCGGTG TTGGCATCGC CGTTTTTTAA GATGCTCAAT ACTTGAGTGG

501 CGTTTTGACG GATTTGGCTT ACCGCGTCGG CAGGGCGGC AAATGCCATG

551 CCGATGCTCA AAATACCGAT GCCCAATGCG CTGATGAGGG AGGATTTTTT

601 CATGATTAAG TGTCCTAGTT TGAATATGAT GGCATACGTT TATTCGGCGG

651 CTTTTTCCGC ATTGCCGCCG TCGGCATTTT TCTCGGCAAA ACTCGTCATG

701 AATTTGCCGA TAAGGTTTTC CAGAACCATT GCAGAACTGG TTACGGAGAT

751 GGTGTCGCCG GCAGCAAGGT TTTCCGTGTC GCCGCCCTGC TGCAGCCCGA

801 TGTACTGCTC GCCCAAAAGT CCCGAAGTCA GGATTTGCGC GGAAACGTCG

851 CTGCTGAACT GATACTTGCC GTCCAAATCG AGGCGCACCC TCGCCTGATA

901 GGATTTCGGG TCAAGTCCGA TAGCGCCGAC GCGCCCGACC AATACGCCTG

951 CGGATTTGAC GGGGGCATTG ACCTTCAAAC CGCCGATGTC GCCGAAATCG

1001 GCATAAACGG CGTAAGTTTT GTCCGAACCG CCGAACGCCG CACCGCCGGC

1051 CACGCGGAAA GCGAGAAAGG CAACCGCCGC CGCGCCAATC AGGACGAACA

1101 GTCCGACCCA AAATTCCAAT ATGTTCTTCT TCATTAA
```

This corresponds to the amino acid sequence <SEQ ID 1582; ORF 543>:

```
m543.pep
  1 MVCRLFAAVF GFQLGNQSVH AFRFDNFAEL VAVHGNQARA FDGDVVGTVF

51 TAALVGGEVH VDGFLPGYAD FGADDDFFAA FIDDGIVFDV DVGVFXFQHR

101 AGIGADQQGL KFFGQRLFLR VGRGAPRVAD RQCGHTLEIE IGNRIGFGFL

151 ASGVGIAVFX DAQYLSGVLT DLAYRVGRGG KCHADAQNTD AQCADEGGFF

201 HDXVSXFEYD GIRLFGGFFR IAAVGIFLGK TRHEFADKVF QNHCRTGYGD

251 GVAGSKVFRV AALLQPDVLL AQKSRSQDLR GNVAAELILA VQIEAHPRLI

301 GFRVKSDSAD APDQYACGFD GGIDLQTADV AEIGINGVSF VRTAERRTAG

351 HAESEKGNRR RANQDEQSDP KFQYVLLH*
```

Computer analysis of this amino acid sequence gave the following results:
Homology with a Predicted ORF from *N. gonorrhoeae*
ORF 543 shows 84.2% identity over a 379 aa overlap with a predicted ORF (ORF 543.ng) from *N. gonorrhoeae*:

```
    m543/g543
                   10         20         30         40         50         60
      m543.pep  MVCRLFAAVFGFQLGNQSVHAFRFDNFAELVAVHGNQARAFDGDVVGTVFTAALVGGEVH
                ||||||||||||||||||| || ||:|||||||||||||||||||||||||:||||||:||
         a543  MVCRLFAAVFGFQLGNQPVDAFGFDDFAELVAVHGNQARAFDGDVVGTVFAAALVGGKVH
                   10         20         30         40         50         60

70         80         90        100        110        120
      m543.pep  VDGFLPGYADFGADDDFFAAFIDDGIVFDVDVGVFXFQHRAGIGADQQGLKFFGQRLFLR
                :||:| | ||||:||||:|:|||||||||| || |||||||||||||||||||||||||
         a543  IDGLLTGDADFGTDDDFLAALIDDGIVFDVDGRVFEFQHRAGIGADQQGLKFFGQRLFLR
                   70         80         90        100        110        120
```

-continued

```
                130       140       150       160        170       180
m543.pep    VGRGAPRVADRQCGHTLEIEIGNRIGFGFLASGVGIAVFXDAQYLSGVLTDLAYRVGRGG
            ||||:|||||||||||||||||||||||| |    :|:| |:| | |||:||:: |||||
a543        VGRGTPRVADRQCGHTLEIEIGNRIGFGFWACRSRVAAFEDGQNLCGVLADLSHCVGRGG
                130       140       150       160        170       180

190      200        210        220       230       239
m543.pep    KCHADAQNTDAQCADEGGFFHDXVSXFEYDG-IRLFGGFFRIAAVGIFLGKTRHEFADKV
            ||||||||||||||||||||||    |  :| : || ||||||:::|||:: |||:|:|
a543        KCHADAQNTDAQCADEGGFFHDV---FPENGCVCLFCGFFRIAALSVFLGEAGHEFTDQV
                190      200        210        220      230

240       250       260       270       280       290       299
m543.pep      FQNHCRTGYGDGVAGSKVFRVAALLQPDVLLAQKSRSQDLRGNVAAELILAVQIEAHPRL
              ||||||||||||||||||||:|||||||||:|||||||||||||:|||||||||:|||||
a543          FQNHCRTGYGDGVAGSKVFRIAALLQPDVLFAQKSRSQDLRGNVTAELILAVQIKAHPRL
              240       250       260       270       280       290

300       310       320       330       340       350       359
m543.pep      IGFRVKSDSADAPDQYACGFDGGIDLQTADVAEIGINGVSFVRTAERRTAGHAESEKGNR
              |||||| ||||||||||||||||||||||||||||||||||||||||| : |||||||||
a543          IGFRVKPDSADAPDQYACGFDGGIDLQTADVAEIGINGVSFVRTAERRAARHAESEKGNR
              300       310       320       330       340       350

360 370 379
m543.pep      RRANQDEQSDPKFQYVLLHX
              |||:|||||||||||||:||
a543          RRADQDEQSDPKFQYVLFHX
              360       370
```

The following partial DNA sequence was identified in *N. meningitidis* <SEQ ID 1583>:

```
a543.seq
   1 ATGGCTTATG GATTACTTGC TGCCGTTTNT AGCCTTCAAC TCGNCAATCA

51 GTCCGTCCAC GCCTTTCGCT TTGATAATTT CGCCGAATTG GTTGCGGTAC

101 ACGGTAACCA GGCTCGCGCC TTCGATGGCG ACGTTGTAGG TACGGTATTT

151 ACCGCCGCTT TGGTAGGTGG TGAAGTCCAT GTTGACGGGT TTTTGCCCGG

201 NNACGCCGAC TTCGGCGCGG ACGATGATTT CTTTGCCGCC TTTATTGACG

251 ATNGGATTGT CTTTGACGTT GACGTTGGCG TTTTTTAATT TCAGCATCGT

301 GCCGGAATAG GTGCGGATCA GCAGGGTTTG AAATTCTTTG GCCAACGCTT

351 GTTTTTGCGC GTCGGACGCG GTGCGCCAAG GGTTGCCGAC CGCCAATGCG

401 GTCATACGTT GGAAATCGAA ATAGGGAATC GCATAGGCTT CGGCTTTTTG

451 GCGGGCGGTG TTGGCATCAC CGCTTTTTAA GATGCTCAAT ACTTGAGTGG

501 CGTTTTGACG GATTTGGTTT ACCGCGTCGG CAGGGGCGGC AAATGCCATG

551 CCGATGCTCA AAATACCGAT GCCCAATGCG CTGATGAAGG AGGATTTTTT

601 CATGATTAAG TGTCCTAGTT TGAATATGAT GGCATACGTT TATTCGGCGG

651 CTTTTTCCGC ATTGCCGCCG TCGGCATTTT TCTCGGCAAA ACTCGTCATG

701 AATTTGCCGA TAAGGTTTTC CAGAACCATT GCAGAACTGG TTACGGAGAT

751 GGTGTCGCCG GCAGCAAGGT TTTCCGTGTC GCCGCCCTGC TGCAGCCCGA

801 TGTACTGCTC GCCCAAAAGT CCCGAAGTCA GGATTTGCGC GGAAACGTCG

851 CTGCTGAACT GATACTTGCC GTCCAAATCG AGGCGCACCC TCGCCTGATA

901 GGATTTCGGG TCAAGTCCGA TAGCGCCGAC GCGCCCGACC AATACGCCTG

951 CGGATTTGAC GGGGGCATTG ACCTTCAAAC CGCCGATGTC GCCGAAATCG

1001 GCATAAACGG CGTAAGTTTT GTCCGAACCG CCGAACGCCG CACCGCCGGC

1051 CACGCGGAAA GCGAGAAAGG CAACCGCCGC CGCGCCAATC AGGACGAACA

1101 GTCCGACCCA AAATTCCAAT ATGTTCTTTT TCATTAA
```

This corresponds to the amino acid sequence <SEQ ID 1584; ORF 543.a>:

```
a543.pep
   1 MAYGLLAAVX SLQLXNQSVH AFRFDNFAEL VAVHGNQARA FDGDVVGTVF

51 TAALVGGEVH VDGFLPGXAD FGADDDFFAA FIDDXIVFDV DVGVF*FQHR

101 AGIGADQQGL KFFGQRLFLR VGRGAPRVAD RQCGHTLEIE IGNRIGFGFL

151 AGGVGITAF* DAQYLSGVLT DLVYRVGRGG KCHADAQNTD AQCADEGGFF

201 HD*VS*FEYD GIRLFGGFFR IAAVGIFLGK TRHEFADKVF QNHCRTGYGD

251 GVAGSKVFRV AALLQPDVLL AQKSRSQDLR GNVAAELILA VQIEAHPRLI

301 GFRVKSDSAD APDQYACGFD GGIDLQTADV AEIGINGVSF VRTAERRTAG

351 HAESEKGNRR RANQDEQSDP KFQYVLFH*
``` m543/a543 96.0% identity in 378 aa overlap

```
                  10         20         30         40         50         60
m543.pep  MVCRLFAAVFGFQLGNQSVHAFRFDNFAELVAVHGNQARAFDGDVVGTVFTAALVGGEVH
          |:  |:|||  ::||  ||||||||||||||||||||||||||||||||||||||||||
a543      MAYGLLAAVXSLQLXNQSVHAFRFDNFAELVAVHGNQARAFDGDVVGTVFTAALVGGEVH
                  10         20         30         40         50         60

70         80         90        100        110        120
m543.pep  VDGFLPGYADFGADDDFFAAFIDDGIVFDVDVGVFXFQHRAGIGADQQGLKFFGQRLFLR
          |||||||  ||||||||||||||||  ||||||||||||||||||||||||||||||||
a543      VDGFLPGXADFGADDDFFAAFIDDXIVFDVDVGVFXFQHRAGIGADQQGLKFFGQRLFLR
                  70         80         90        100        110        120

130        140        150        160        170        180
m543.pep  VGRGAPRVADRQCGHTLEIEIGNRIGFGFLASGVGIAVFXDAQYLSGVLTDLAYRVGRGG
          ||||||||||||||||||||||||||||||||:||| ::|||||||||||||: ||||||
a543      VGRGAPRVADRQCGHTLEIEIGNRIGFGFLAGGVGITAFXDAQYLSGVLTDLVYRVGRGG
                 130        140        150        160        170        180

190        200        210        220        230        240
m543.pep  KCHADAQNTDAQCADEGGFFHDXVSXFEYDGIRLFGGFFRIAAVGIFLGKTRHEFADKVF
          ||||||||||||||||||||||||||||||||||||||||||||||||||||||||||||
a543      KCHADAQNTDAQCADEGGFFHDXVSXFEYDGIRLFGGFFRIAAVGIFLGKTRHEFADKVF
                 190        200        210        220        230        240

250        260        270        280        290        300
m543.pep  QNHCRTGYGDGVAGSKVFRVAALLQPDVLLAQKSRSQDLRGNVAAELILAVQIEAHPRLI
          ||||||||||||||||||||||||||||||||||||||||||||||||||||||||||||
a543      QNHCRTGYGDGVAGSKVFRVAALLQPDVLLAQKSRSQDLRGNVAAELILAVQIEAHPRLI
                 250        260        270        280        290        300

310        320        330        340        350        360
m543.pep  GFRVKSDSADAPDQYACGFDGGIDLQTADVAEIGINGVSFVRTAERRTAGHAESEKGNRR
          ||||||||||||||||||||||||||||||||||||||||||||||||||||||||||||
a543      GFRVKSDSADAPDQYACGFDGGIDLQTADVAEIGINGVSFVRTAERRTAGHAESEKGNRR
                 310        320        330        340        350        360

370      379
m543.pep  RANQDEQSDPKFQYVLLHX
          ||||||||||||||||:||
a543      RANQDEQSDPKFQYVLFHX
                 370
```

The following partial DNA sequence was identified in *N. gonorrhoeae* <SEQ ID 1585>:

```
g544.seq
   1 atgaaaaaaa tactcaccgc cgccgccgtc gcactgatcg gcatcctcct 51 cgccaccgtc ctcatccccg acagtaaaac cgcgcccgcc ttctccctgc 101 ccgacctgca cggaaaaacc gtttccaacg ccgacctgca aggcaaagtc 151 accctgatta attttggtt tccctcctgt ccgggttgtg tgagcgaaat 201 gcccaaagtc accaaaacgg caaacgacta caaaaataaa gatttccaag 251 tcctcgccgt tgcccagccc atcgatccga tagaaagcgt ccgccaatac 301 gtcaaagact acggactgcc gtttaccgtc atttatgatg cggacaaagc
```

```
351 cgtcggacag gcattcggca cacaggttta tccgacttcc gtccttatcg 401 gcaaaaaagg cgaaatcctc aaaacttatg tcggcgaacc cgatttcggc 451 aaactctacc aagaaatcga taccgcgctg gcgcaatag
```

This corresponds to the amino acid sequence <SEQ ID 1586; ORF 544.ng>:

```
g544.pep
   1 MKKILTAAAV ALIGILLATV LIPDSKTAPA FSLPDLHGKT VSNADLQGKV

51 TLINFWFPSC PGCVSEMPKV TKTANDYKNK DFQVLAVAQP IDPIESVRQY

101 VKDYGLPFTV IYDADKAVGQ AFGTQVYPTS VLIGKKGEIL KTYVGEPDFG

151 KLYQEIDTAL AQ*
```

The following partial DNA sequence was identified in *N. meningitidis* <SEQ ID 1587>:

```
m544.seq
   1 ATGAwAAAAA TACTCACCGC CGCCGTCGTC GCACTGATCG GCATCCTCCT

51 TGCCATCGTC CTCmTCCCCG ACAGCAAAAC CGCGCCCGCC TTCTCCmTGC

101 CCGACCTGCA CGGAAAAACC GTTTCCAACG CCGACCTGCA AGGCAAAGTA

151 ACCCTGATTA ATTTTTGGTT TCCCTCCTGT CCGGGTTGTG TGAGCGAwAT

201 GCCCAAAATC ATTAAAACGG CAAATGACTA TAAAAwCAAA AACTTCCAAG

251 TACTTGCCGT CGCCCAGCCC ATCGATCCGA TAGAAAGCGT CCGCCAATAT

301 GTCAAAGACT ACGGTTTGCC GTTTACCGTC ATGTATGATG CGGACAAAGC

351 TGTCGGACAG GCGTTCGGCA CACAGGTTTA TCCGACTTCC GTCCTTATCG

401 GCAAATAAGG CGAAATCTTC AAAACCTACG TCGGCGAACC CGATTTCGGC

451 AAACTCTACC AAGAAATCGA TACGCGCGTG GCGCAATAG
```

This corresponds to the amino acid sequence <SEQ ID 1588; ORF 544>:

```
m544.pep
   1 MXKILTAAVV ALIGILLAIV LXPDSKTAPA FSXPDLHGKT VSNADLQGKV

51 TLINFWFPSC PGCVSXMPKI IKTANDYKXK NFQVLAVAQP IDPIESVRQY

101 VKDYGLPFTV MYDADKAVGQ AFGTQVYPTS VLIGK*GEIF KTYVGEPDFG

151 KLYQEIDTRV AQ*
```

Computer analysis of this amino acid sequence gave the following results:
Homology with a Predicted ORF from *N. gonorrhoeae*
ORF 544 shows 90.7% identity over a 162 aa overlap with a predicted ORF (ORF 544.ng) from *N. gonorrhoeae*:

```
   m544/g544
                      10         20         30         40         50         60
       m544.pep  MXKILTAAVVALIGILLAIVLXPDSKTAPAFSXPDLHGKTVSNADLQGKVTLINFWFPSC
                 |||||||:||||||||| || |||||||||| |||||||||||||||||||||||||||
          g544   MKKILTAAAVALIGILLATVLIPDSKTAPAFSLPDLHGKTVSNADLQGKVTLINFWFPSC
                      10         20         30         40         50         60
```

-continued

```
                  70        80        90       100       110       120
m544.pep PGCVSXMPKIIKTANDYKXKNFQVLAVAQPIDPIESVRQYVKDYGLPFTVMYDADKAVGQ
         ||||| |||: ||||||| |:||||||||||||||||||||||||||||:|||||||||
g544     PGCVSEMPKVTKTANDYKNKDFQVLAVAQPIDPIESVRQYVKDYGLPFTVIYDADKAVGQ
                  70        80        90       100       110       120

130       140       150       160
m544.pep AFGTQVYPTSVLIGKXGEIFKTYVGEPDFGKLYQEIDTRVAQX
         |||||||||||||| |||:||||||||||||||||| :|||
g544     AFGTQVYPTSVLIGKKGEILKTYVGEPDFGKLYQEIDTALAQX
                 130       140       150       160
```

The following partial DNA sequence was identified in *N. meningitidis* <SEQ ID 1589>:

```
a544.seq
   1 ATGAAAAAAA TACTCACCGC CGCCGTCGTC GCACTGATCG GCATCCTCCT

51 TGCCATCGTC CTCATCCCCG ACAGCAAAAC CGCGCCCGCT TTCTCCCTGT

101 CCGANCTGCA CGGAAAAANC GTTTNCAACG CCGACCTGCA AGGCNAAGTT

151 ANCCTGATTA ANTTTTGGTT TCCCTCCTGT CCGGGTTGTG TGAGCGAAAT

201 GNCCANAATC ATTAAAACGG CAAATGACTA TAAAAACAAA AACTTCCAAG

251 TCCTTGCCGT CGCCCAGCCC ATCGATCCGA TAGAAAGCGT CCGCCAATAT

301 GTCAAAGACT ACGGTTTGCC GTTTACCGTC ATGTATGATG CGGACAAAGC

351 TGTCGGACAG GCGTTCGGCA CACAGGTTTA TCCGACTTCC GTCCTTATCG

401 GCAAAAAAGG CGAAATCCTC AAAACTTATG TCGGCGAACC CGATTTCGGC

451 AAACTCTACC AAGAAATCGA TACCGCGCTG GCACAATAG
```

This corresponds to the amino acid sequence <SEQ ID 1590; ORF 544.a>:

```
a544.pep
   1 MKKILTAAVV ALIGILLAIV LIPDSKTAPA FSLSXLHGKX VXNADLQGXV

51 XLIXFWFPSC PGCVSEMXXI IKTANDYKNK NFQVLAVAQP IDPIESVRQY

101 VKDYGLPFTV MYDADKAVGQ AFGTQVYPTS VLIGKKGEIL KTYVGEPDFG

151 KLYQEIDTAL AQ*
``` m544/a544 88.9% identity in 162 aa overlap

```
                  10        20        30        40        50        60
m544.pep MXKILTAAVVALIGILLAIVLXPDSKTAPAFSXPDLHGKTVSNADLQGKVTLINFWFPSC
         | |||||||||||||||||| |||||||||||    ||||:| |||||| |:|| ||||||
a544     MKKILTAAVVALIGILLAIVLIPDSKTAPAFSLSXLHGKXVXNADLQGXVXLIXFWFPSC
                  10        20        30        40        50        60

70        80        90       100       110       120
m544.pep PGCVSXMPKIIKTANDYKXKNFQVLAVAQPIDPIESVRQYVKDYGLPFTVMYDADKAVGQ
         ||||| |  ||||||||| ||||||||||||||||||||||||||||||||||||||||
a544     PGCVSEMXXIIKTANDYKNKNFQVLAVAQPIDPIESVRQYVKDYGLPFTVMYDADKAVGQ
                  70        80        90       100       110       120

130       140       150       160
m544.pep AFGTQVYPTSVLIGKXGEIFKTYVGEPDFGKLYQEIDTRVAQX
         |||||||||||||| |||:||||||||||||||||| :|||
a544     AFGTQVYPTSVLIGKKGEILKTYVGEPDFGKLYQEIDTALAQX
                 130       140       150       160
```

The following partial DNA sequence was identified in *N. gonorrhoeae* <SEQ ID 1591>:

```
g547.seq
   1 atgttcgtag ataacggatt taataaaacg gtagcgagtt ttgcccaaat 51 cgtcgaaact ttcgacgtat tcttctttag gaacgattgc gccttttta 101 cgcagatgaa acagcggtgc ggttgggtct gctcgttggt atatctcgtt 151 gatatattta caagatgcgg cttcgagatt ccgaaccgct cctttaaaga 201 gcttgggctt ttgatacaga taagtctgtc ggaacgtttt aggactaatg 251 ccgaagtcga gatggatgcc cattacttcc ccttactcag aaaatattta 301 aaatttataa tgttacatat agttacaaat attagagttt tttgtgtgtg 351 cgtcaaggaa ttgttgacaa ttttagttaa aaatttgtct ccaaacggaa 401 aaaagcggtt tgtttttgt tgttaa
```

This corresponds to the amino acid sequence <SEQ ID 1592; ORF 547.ng>:

```
g547.pep
   1 MFVDNGFNKT VASFAQIVET FDVFFFRNDC AFFTQMKQRC GWVCSLVYLV

51 DIFTRCGFEI PNRSFKELGL LIQISLSERF RTNAEVEMDA HYFPLLRKYL

101 KFIMLHIVTN IRVFCVCVKE LLTILVKNLS PNGKKRFVFC C*
```

The following partial DNA sequence was identified in *N. meningitidis* <SEQ ID 1593>:

```
m547.seq.
   1 ATGTTCGTAG ATAACGGATT TAATAAAACG GTAGCGAGTT TTGCCCAAAT

51 CGTCGAAACT TTCGACGTAT TCTTCTTTAG GAACGATTGC GCCTTTTTA

101 CGCAGATGAA ACAGCGGTGC GGTTGGGTCT GCTCGTTGGT ATATCTCGTT

151 GATATCTTTC CAAGATGCGG ATTCGAGATT CCGAACCGCT CCTTTAAAGA

201 GCTTGGGCTT TTGATACAGA TAAGTCTGTC GGAACGTTTT AGGACTAATG

251 CCGAAGTCGA GATGGATGCT CATTACTTCC CCTTACTCAG AAAATATTTA

301 AAATTTATAA TGTTACATAT ATTTACAAAT ATTAAAGTTT TTTwTTGTGT

351 GTGCGTCAAG GAATTGTTGA CAATTTTAGT TAAAAATTTG TCTCCAAACG

401 GAAAAAGCG GTTTGTTTTT TGTTGTTAA
```

This corresponds to the amino acid sequence <SEQ ID 1594; ORF 547>:

```
m547.pep
   1 MFVDNGFNKT VASFAQIVET FDVFFFRNDC AFFTQMKQRC GWVCSLVYLV

51 DIFPRCGFEI PNRSFKELGL LIQISLSERF RTNAEVEMDA HYFPLLRKYL

101 KFIMLHIFTN IKVFXCVCVK ELLTILVKNL SPNGKKRFVF CC*
```

Computer analysis of this amino acid sequence gave the following results:
Homology with a Predicted ORF from *N. gonorrhoeae*
ORF 547 shows 97.2% identity over a 142 aa overlap with a predicted ORF (ORF 547.ng) from *N. gonorrhoeae*:

```
m547/g547
                  10        20        30        40        50        60
   m547.pep  MFVDNGFNKTVASFAQIVETFDVFFFRNDCAFFTQMKQRCGWVCSLVYLVDIFPRCGFEI
             ||||||||||||||||||||||||||||||||||||||||||||||||||||| ||||||
   g547      MFVDNGFNKTVASFAQIVETFDVFFFRNDCAFFTQMKQRCGWVCSLVYLVDIFTRCGFEI
                  10        20        30        40        50        60
                  70        80        90       100       110       120
   m547.pep  PNRSFKELGLLIQISLSERFRTNAEVEMDAHYFPLLRKYLKFIMLHIFTNIKVFXCVCVK
             ||||||||||||||||||||||||||||||||||||||||||||||||:||  |||||
   g547      PNRSFKELGLLIQISLSERFRTNAEVEMDAHYFPLLRKYLKFIMLHIVTNIRVF-CVCVK
                  70        80        90       100       110
                 130       140
   m547.pep  ELLTILVKNLSPNGKKRFVFCCX
             |||||||||||||||||||||||
   g547      ELLTILVKNLSPNGKKRFVFCCX
                 120       130       140
```

The following partial DNA sequence was identified in *N. meningitidis* <SEQ ID 1595>:

```
a547.seq
   1  ATGTTCGTAG ATAACGGATT TAATAAAACG GTAGCGAGTT TTGCCCAAAT

51  CGTCGAAACT TTCGACGTAT TCTTCTTTAG GAACAATTGC ACCTTTTTA

101  CGCAGATGAA ACAGCGGTGC GGTTGGGTCT GCTCGTTGGT ATATCTCGTT

151  GATATCTTTC CAAGATGCGG CTTCGAGATT CCGAACCGCT CCTTTAAAGA

201  GCTTGGGCTT TTGATACAGA TAAGTCTGTC GGAACGTTTT AGGACTAATG

251  CCGAAGTCGA GATAGATGCT CATTACTTCC CCTTACTCAG AAAATATTTA

301  AAATTTATAA TGTTACATAT ATTTACAAAT ATTAAAGTTT TTTT.TGTGT

351  GTGCGTCAAG GAATTGTTGA CAATTTTAGT T
```

This corresponds to the amino acid sequence <SEQ ID 1596; ORF 547.a>:

```
a547.pep
   1  MFVDNGFNKT VASFAQIVET FDVFFFRNNC TFFTQMKQRC GWVCSLVYLV

51  DIFPRCGFEI PNRSFKELGL LIQISLSERF RTNAEVEIDA HYFPLLRKYL

101  KFIMLHIFTN IKVFXCVCVK ELLTILV
``` m547/a547 97.6% identity in 127 aa overlap

```
                  10        20        30        40        50        60
   m547.pep  MFVDNGFNKTVASFAQIVETFDVFFFRNDCAFFTQMKQRCGWVCSLVYLVDIFPRCGFEI
             |||||||||||||||||||||||||||||:|:||||||||||||||||||||||||||||
   a547      MFVDNGFNKTVASFAQIVETFDVFFFRNNCTFFTQMKQRCGWVCSLVYLVDIFPRCGFEI
                  10        20        30        40        50        60
                  70        80        90       100       110       120
   m547.pep  PNRSFKELGLLIQISLSERFRTNAEVEMDAHYFPLLRKYLKFIMLHIFTNIKVFXCVCVK
             ||||||||||||||||||||||||||||||:|||||||||||||||||||||||||||||
   a547      PNRSFKELGLLIQISLSERFRTNAEVEIDAHYFPLLRKYLKFIMLHIFTNIKVFXCVCVK
                  70        80        90       100       110       120
                 130       140
   m547.pep  ELLTILVKNLSPNGKKRFVFCCX
             |||||||
   a547      ELLTILV
```

The following partial DNA sequence was identified in *N. gonorrhoeae* <SEQ ID 1597>:

```
g548.seq
    1 atgttttccg taccgcgttc cttttttgccg ggcgttttcg tacttgccgc 51 gcttgccgcc tgcaaacctc aagacaacag tgcggcgcaa gccgcttctt 101 caagtgcatc cgcgccggct gcggaaaatg cggcaaagcc gcaaacgcgc 151 ggtacggata tgcgtaagga agacatcggc ggcgatttca cactgaccga 201 cggcgaaggc aagcctttca gcctgagcga tttgaaaggc aaggtcgtga 251 ttctgtcttt cggctttacg cactgtcccg atgtctgccc gacagggctt 301 ttgacgtaca gcgacacttt gaagcagttg ggcgggcagg ctaaggacgt 351 gaaagtggtg ttcgtcagca tcgatccgga acgcgacacg cctgaaatca 401 tcggcaagta tgccaaacag ttcaatccgg actttatcgg tctgacggca 451 acgggcggcc aaaacctgcc ggtcatcaag cagcaatacc gcgtggtttc 501 tgccaaaatc aatcaaaaag acgacagcga aaactatttg gtcgaccact 551 cttccggtgc gtatcttatc gataaaaacg gtgaggttgc cattttctcg 601 ccttacggaa gcgagccgga aacgattgct gccgatgtaa ggaccctgct 651 ctga
```

This corresponds to the amino acid sequence <SEQ ID 1598; ORF 548.ng>:

```
g548.pep
    1 MFSVPRSFLP GVFVLAALAA CKPQDNSAAQ AASSSASAPA AENAAKPQTR

51 GTDMRKEDIG GDFTLTDGEG KPFSLSDLKG KVVILSFGFT HCPDVCPTGL

101 LTYSDTLKQL GGQAKDVKVV FVSIDPERDT PEIIGKYAKQ FNPDFIGLTA

151 TGGQNLPVIK QQYRVVSAKI NQKDDSENYL VDHSSGAYLI DKNGEVAIFS

201 PYGSEPETIA ADVRTLL*
                                                         40
```

The following partial DNA sequence was identified in *N. meningitidis* <SEQ ID 1599>:

```
m548.seq
    1 ATGTTTTCCG TACCGCGTTC CTTTTTGCCG GGCGTTTTCG TACTTGCCGC

51 GCTTGCCGCC TGCAAACCTC AAGACAACAG TGCGGCGCAA GTCGCTTCTT

101 CAAGTGCATC CGCGTCGGCT GCGGAAAATG CGGCAAAGCA AnACACGCGC

151 GGTACGGATA TGCGTAAGGA AGACATCGGC GGCGATTTCA CGCTGACCGA

201 CGGCGAAGGC AAGCCTTTCA ACCTGAGCGA TTTGAAAGGC AAGGTCGTGA

251 TTCTGTCTTT CGGCTTTACG CACTGTCCCG ATGTCTGCCC GACAGAGCTT

301 TTGACGTACA GCGACACGTT GAAGCAGTTG GGCGGGCAGG CTAAGGACGT

351 GAAAGTGGTG TTCGTCAGCA TCGATCCGGA ACGCGACACG CCTGAAATCA

401 TCGGCAAGTA TGCCAAACAG TTCAATCCGG ACTTTATCGs TCTGACGGCA

451 ACGGGCGGCC AAAACCTGCC GGTCATCAAG CAGCAATACc GCGTGGTTTC

501 TGCCAAAGTC AATCAAAmG ACGACAGCGA AAACTATTTG GTCGACCACT

551 CTTCCGGTGC GTATCTCATC GACAAAAACG GTGAGGTTGC CATTTTCTCG
```

```
-continued
601 CCTTACGGAA GCGAGCCGGA AACGATTGCT GCCGATGTAA GGACCCTGCT

651 CTGA
```

This corresponds to the amino acid sequence <SEQ ID 1600; ORF 548>.

```
m548.pep
    1 MFSVPRSFLP GVFVLAALAA CKPQDNSAAQ VASSSASASA AENAAKQXTR

51 GTDMRKEDIG GDFTLTDGEG KPFNLSDLKG KVVILSFGFT HCPDVCPTEL

101 LTYSDTLKQL GGQAKDVKVV FVSIDPERDT PEIIGKYAKQ FNPDFIXLTA

151 TGGQNLPVIK QQYRVVSAKV NQXDDSENYL VDHSSGAYLI DKNGEVAIFS

201 PYGSEPETIA ADVRTLL*
```

Computer analysis of this amino acid sequence gave the following results:

Homology with a Predicted ORF from *N. gonorrhoeae*
ORF 548 shows 95.9% identity over a 217 aa overlap with a predicted ORF (ORF 548.ng) from *N. gonorrhoeae*:

```
m548/g548

10         20         30         40         50         60
    m548.pep   MFSVPRSFLPGVFVLAALAACKPQDNSAAQVASSSASASAAENAAKQXTRGTDMRKEDIG
               ||||||||||||||||||||||||||||||:|||||||   ||||||:||||||||||||
    g548       MFSVPRSFLPGVFVLAALAACKPQDNSAAQAASSSASAPAAENAAKPQTRGTDMRKEDIG
                    10         20         30         40         50         60

70         80         90        100        110        120
    m548.pep   GDFTLTDGEGKPFNLSDLKGKVVILSFGFTHCPDVCPTELLTYSDTLKQLGGQAKDVKVV
               |||||||||||||:|||||||||||||||||||||||||| |||||||||||||||||||
    g548       GDFTLTDGEGKPFSLSDLKGKVVILSFGFTHCPDVCPTGLLTYSDTLKQLGGQAKDVKVV
                    70         80         90        100        110        120

130        140        150        160        170        180
    m548.pep   FVSIDPERDTPEIIGKYAKQFNPDFIXLTATGGQNLPVIKQQYRVVSAKVNQXDDSENYL
               |||||||||||||||||||||||||||||:||||||||||||||||||||:||:|||||||
    g548       FVSIDPERDTPEIIGKYAKQFNPDFIGLTATGGQNLPVIKQQYRVVSAKINQKDDSENYL
                   130        140        150        160        170        180

190        200        210
    m548.pep   VDHSSGAYLIDKNGEVAIFSPYGSEPETIAADVRTLLX
               |||||||||||||||||||||||||||||||||||||
    g548       VDHSSGAYLIDKNGEVAIFSPYGSEPETIAADVRTLLX
                   190        200        210
```

The following partial DNA sequence was identified in *N. meningitidis* <SEQ ID 1601>:

```
a548.seq
    1 ATGTTTTCCG TACCGCGTTC CTTTTTGCCG GGCGTTTTCG TACTTGCCGC

51 GCTTGCCGCC TGCAAACCTC AAGACAACAG TGCGGCGCAA GTCGCTTCTT

101 CAAGTGCATC CGCGTCGGCT GCGGAAAATG CGGCAAAGCC GCAAACGCGC

151 GGTACGGATA TGCGTAAGGA AGACATCGGC GGCGATTTCA CGCTGACCGA

201 CGGCGAAGGC AAGCCTTTCA ACCTGAGCGA TTTGAAAGGC AAGGTCGTGA

251 TTCTGTCTTT CGGCTTTACG CACTGTCCCG ATGTCTGCCC GACAGAGCTT

301 TTGACGTACA GCGACACGTT GAAGCAGTTG GGCGGGCAGG CTAAGGACGT

351 GAAAGTGGTG TTCGTCAGCA TCGATCCGGA ACGCGACACG CCTGAAATCA

401 TCGGCAAGTA TGCCAAACAG TTCAATCCGG ACTTTATCGG TCTGACGGCA

451 ACGGGCGACC AAAACCTGCC GGTCATCAAG CAGCAATACC GCGTGGTTTC
```

```
-continued
501 TGCCAAAGTC AATCAAAAAG ACGACAGCGA AAACTATTTG GTCGACCACT

551 CTTCCGGTGC GTATCTCATC GACAAAAACG GTGAGGTTGC CATTTTCTCG

601 CCTTACGGAA GCGAGCCGGA AACGATTGCT GCCGATGTAA GGACCCTGCT

651 CTGA
```

This corresponds to the amino acid sequence <SEQ ID 1602; ORF 548.a>:

```
a548.pep
  1 MFSVPRSFLP GVFVLAALAA CKPQDNSAAQ VASSSASASA AENAAKPQTR

51 GTDMRKEDIG GDFTLTDGEG KPFNLSDLKG KVVILSFGFT HCPDVCPTEL

101 LTYSDTLKQL GGQAKDVKVV FVSIDPERDT PEIIGKYAKQ FNPDFIGLTA

151 TGDQNLPVIK QQYRVVSAKV NQKDDSENYL VDHSSGAYLI DKNGEVAIFS

201 PYGSEPETIA ADVRTLL*
``` m548/a548 97.7% identity in 217 aa overlap

```
                 10        20        30        40        50        60
    m548.pep MFSVPRSFLPGVFVLAALAACKPQDNSAAQVASSSASASAAENAAKQXTRGTDMRKEDIG
            ||||||||||||||||||||||||||||||||||||||||||||| |||||||||||||
    a548    MFSVPRSFLPGVFVLAALAACKPQDNSAAQVASSSASASAAENAAKPQTRGTDMRKEDIG
                 10        20        30        40        50        60

70        80        90       100       110       120
    m548.pep GDFTLTDGEGKPFNLSDLKGKVVILSFGFTHCPDVCPTELLTYSDTLKQLGGQAKDVKVV
            ||||||||||||||||||||||||||||||||||||||||||||||||||||||||||||
    a548    GDFTLTDGEGKPFNLSDLKGKVVILSFGFTHCPDVCPTELLTYSDTLKQLGGQAKDVKVV
                 70        80        90       100       110       120

130       140       150       160       170       180
    m548.pep FVSIDPERDTPEIIGKYAKQFNPDFIXLTATGGQNLPVIKQQYRVVSAKVNQXDDSENYL
            |||||||||||||||||||||||||||||  ||| |||||||||||||||||| ||||||
    a548    FVSIDPERDTPEIIGKYAKQFNPDFIGLTATGDQNLPVIKQQYRVVSAKVNQKDDSENYL
                130       140       150       160       170       180

190       200       210
    m548.pep VDHSSGAYLIDKNGEVAIFSPYGSEPETIAADVRTLLX
            ||||||||||||||||||||||||||||||||||||||
    a548    VDHSSGAYLIDKNGEVAIFSPYGSEPETIAADVRTLLX
                190       200       210
```

The following partial DNA sequence was identified in *N. gonorrhoeae* <SEQ ID 1603>:

```
g550.seq
  1 atgataacgg acaggtttca tctctttcat tttccagtat ctttcattta 51 tcaatctgac aacaaaatgc cgcctgaaaa cagttcagac ggcattttaa 101 ccacaaacgg cttacagctt ccattcgccc aacttggcag cgtaagcttc 151 caaatctgca atcggacggg ttgccacgcc gctttccatc gctgctttgg 201 cggcagccgt agcgacgcga ggcagcaggc gggaatcgaa cggagtagga 251 atcaggtatt ccgcgccgaa ttcgaatttc ttaccgtaag cggcaaccac 301 ttcttcggtt acttcttcca tcgccaaatc tgccaaagca tacacgcagg 351 cgcgtttcat ttcttcgttg atggtggttg cgccgacatc caacgcgccc 401 cggaagatga acgggaagca caatacgttg ttcacttggt tcgggaagtc 451 ggagcggccg gtaccgataa ccacgtccgg acgggtttct ttcgccagcg 501 gcggcaggat ttccggattc gggttggcca tggcgaacac gatgggtttt 551 tcgttcatcg tgttcaacat ttcaggcgtc agcaggtttg cgccggagag
```

-continued

```
601 gcccaagaag atgtctttgc ctttaaccgc atcggcaagt acgcgccggc 651 cgttgtcttc aacggcgtag aattttttgg attcgtccat gcggtctttg 701 tcttcgcggg tttggtaaat cacgcctttg gagttgcaaa cggttacgtt 751 ttcacgtttc aagcccaaat ccagcagttg gttcaggcag gcaatcgcgg 801 cggcacctgc gccggagcac accaaagtcg cttcttcgat tttacggccg 851 gtataacgca gggcgttcaa tacggcggcg gcggtaatga tggccgtgcc 901 gtgctggtca tcatgaaata cgggganttt gcagcgtttg cgtaa
```

This corresponds to the amino acid sequence <SEQ ID 1604; ORF 550.ng>:

```
g550.pep
  1 MITDRFHLFH FPVSFIYQSD NKMPPENSSD GILTTNGLQL PFAQLGSVSF

51 QICNRTGCHA AFHRCFGGSR SDARQQAGIE RSRNQVFRAE FEFLTVSGNH

101 FFGYFFHRQI CQSIHAGAFH FFVDGGCADI QRAPEDEREA QYVVHLVREV

151 GAAGTDNHVR TGFFRQRRQD FRIRVGHGEH DGFFVHRVQH FRRQQVCAGE

201 AQEDVFAFNR IGKYAPAVVF NGVEFFGFVH AVFVFAGLVN HAFGVANGYV

251 FTFQAQIQQL VQAGNRGGTC AGAHQSRFFD FTAGITQGVQ YGGGGNDGRA

301 VLVIMKYGDF AAFA*
```

The following partial DNA sequence was identified in *N. meningitidis* <SEQ ID 1605>:

```
m550.seq (partial)
  1 ..GACGGCATCG GCAAGCACGC GCTGGCCGTT GTCTTCAATG GCGTAGAACT

51   GTTTGGACTC GTCCATACGG TCTTTGTCTT CGCGGGTTTG GTAAATCACG

101   CCTTTGGAGT CGCAAACGGT CACGTTTTCG CGTTTCAAGC CCAAATCCAG

151   CAATTGGwTC AAGCAGGCAA TCGCGGCCGC ACCTGCGCCG GAACACACCA

201   AAGTCGCTTC TTCGATTTTA CGGCCGGTAA AACGCAkGGC GTTCAATACG

251   GCGGCGGCGG TAATGATGGC CGTGCCGTGC TGGTCGTCGT GGAATACGGG

301   GATTTTGCAG CGTTTGCGTA A
```

This corresponds to the amino acid sequence <SEQ ID 1606; ORF 550>:

```
m550.pep (partial)
  1 ..DGIGKHALAV VFNGVELFGL VHTVFVFAGL VNHAFGVANG HVFAFQAQIQ

51   QLXQAGNRGR TCAGTHQSRF FDFTAGKTXG VQYGGGGNDG RAVLVVVEYG

101   DFAAFA*
```

Computer analysis of this amino acid sequence gave the following results:
Homology with a Predicted ORF from *N. gonorrhoeae*
ORF 550 shows % identity over a aa overlap with a predicted ORF (ORF 550.ng) from *N. gonorrhoeae*:

```
    m550/g550
                                      10         20         30
        m550.pep                DGIGKHALAVVFNGVELFGLVHTVFVFAGLVN
                                |||:| |||||||||:||:|:||||||||||
        g550    DGFFVHRVQHFRRQQVCCAGEAQEDVFAFNRIGKYAPAVVFNGVEFFGFVHAVFVFAGLVN
                    190        200        210        220        230        240

40         50         60         70         80         90
        m550.pep HAFGVANGHVFAFQAQIQQLXQAGNRGRTCAGTHQSRFFDFTAGKTXGVQYGGGGNDGRA
                |||||||||:||:||||||| ||||| ||||:||||||||||| ||||||||||||||||
        g550    HAFGVANGYVFTFQAQIQQLVQAGNRGGTCAGAHQSRFFDFTAGITQGVQYGGGGNDGRA
                    250        260        270        280        290        300

100
        m550.pep VLVVVEYGDFAAFAX
                |||:::|||||||||
        g550    VLVIMKYGDFAAFAX
                    310
```

The following partial DNA sequence was identified in *N. meningitidis* <SEQ ID 1607>:

```
a550.seq
    1   CTATATCAAT CTGACAGCAA AATGCCGCCT GAAAACAGTT CAGACGGCAT

51   TTTAACCGCA AACGGCTTAC AGCTTCCATT CGCTCAGCTT GGCAGCGTAA

101   GCTTCCAAAT CTGCAATCGG ACGGGTTGCC ACGCCGCTTT CCATCGCTGC

151   TTTGGCGGCA GCCGTAGCAA CGCGCGGCAG CAGGCGGGAA TCGAACGGAG

201   TCGGAATCAG GTATTCCGCG CCGAATTCAA ATTTCTTACC GTAAGCGGCA

251   ACCACTTCTT CGGTTACCTC TTCCATCGCC AAATCCGCCA AAGCATACAC

301   GCAGGCGCGT TTCATTTCTT CGTTGATGGT CGTCGCGCCG ACATCCAACG

351   CACCGCGGAA GATGAACGGG AAGCACAATA CATTGTTCAC TTGGTTCGGG

401   AAGTCGGAGC GGCCGGTACC GATAACCACG TCCGGACGGG TTTCTTTCGC

451   CAGCGGCGGC AGGATTTCCG GATTCGGGTT GGCCATAGCG AACACGATGG

501   GTTTTTCGTT CATGGTGTTC AGTATTTCAG GCGTCAGCAG GTTCGCGCCG

551   GAGAGGCCCA AGAAGATGTC TTTGCCTTTG ACGGCATCGG CAAGCACGCG

601   CTGGCCGTTG TCTTCAATGG CGTAGAACTG TTTGGACTCG TCCATACGGT

651   CTTTGTCTTC GCGGGTTTGG TAAATCACGC CTTTGGAGTC GCAAACGGTC

701   ACGTTTTCGC GTTTCAAGCC CAAATCCAGC AATTGGTTCA AGCAGGCAAT

751   CGCGGCCGCA CCTGCGCCGG AACACACCAA AGTCGCTTCT TCGATTTTAC

801   GGCCGGTAAA ACGCAGGGCG TTCAATACGG CAGCGGCGGT AATGATGGCC

851   GTGCCGTGCT GGTCGTCGTG GAATACGGGG ATTTTGCAGC GTTTGCGTAA
```

This corresponds to the amino acid sequence <SEQ ID 1608; ORF 550.a>:

```
a550.pep
    1 LYQSDSKMPP ENSSDGILTA NGLQLPFAQL GSVSFQICNR TGCHAAFHRC

51 FGGSRSNARQ QAGIERSRNQ VFRAEFKFLT VSGNHFFGYL FHRQIRQSIH

101 AGAFHFFVDG RRADIQRTAE DEREAQYIVH LVREVGAAGT DNHVRTGFFR

151 QRRQDFRIRV GHSEHDGFFV HGVQYFRRQQ VRAGEAQEDV FAFDGIGKHA
```

-continued

```
201 LAVVFNGVEL FGLVHTVFVF AGLVNHAFGV ANGHVFAFQA QIQQLVQAGN

251 RGRTCAGTHQ SRFFDFTAGK TQGVQYGSGG NDGRAVLVVV EYGDFAAFA*
``` m550/a550 97.2% identity in 106 aa overlap

```
                                     10         20         30
    m550.pep                 DGIGKHALAVVFNGVELFGLVHTVFVFAGL
                             ||||||||||||||||||||||||||||||
       a550    EHDGFFVHGVQYFRRQQVRAGEAQEDVFAFDGIGKHALAVVFNGVELFGLVHTVFVFAGL
              170       180       190       200       210       220
                  40         50         60         70         80         90
    m550.pep  VNHAFGVANGHVFAFQAQIQQLXQAGNRGRTCAGTHQSRFFDFTAGKTXGVQYGGGGNDG
              ||||||||||||||||||||||||| ||||||||||||||||||||||||| |||||:|||||
       a550   VNHAFGVANGHVFAFQAQIQQLVQAGNRGRTCAGTHQSRFFDFTAGKTQGVQYGSGGNDG
              230       240       250       260       270       280
                  100
    m550.pep  RAVLVVVEYGDFAAFAX
              |||||||||||||||||
       a550   RAVLVVVEYGDFAAFAX
              290       300
```

The following partial DNA sequence was identified in *N. gonorrhoeae* <SEQ ID 1609>:

```
g552.seq
  1 atgaagctga aaaccttgtt attgcccttc gccgcactgg cattgtgtgc 51 caacgcattt gccgccccgc ccggcgacgc gtcgttggca cgttggctgg 101 atacgcagaa tttcgaccgg gatatagaaa aaaatatgat tgaaggcttt 151 aatgccggat ttaaaccgta tgcggacaaa gcccttgccg aaatgccgga 201 agcgaaaaaa gatcaggcgg cagaagcctt taatcgttat cgtgagaatg 251 ttttgaaaga tttgattacg cccgaagtga acaggctgt ccgcaatacc 301 ttattgaaga atgcccgtga aatatacacg caagaagaaa ttgacggcat 351 gattgccttt tacggttcgc ctgtcggtca gtccgtcgtt gccaaaaatc 401 cgcgcttaat caagaaatcg atgagtgaaa tagcggtatc ttggactgca 451 ttgtcaggga aaatcgcgcg acatcatctg cccgagttta cggaagagtt 501 acggcgcatc atctgcggcg gtatagtgga ttaa
                                          45
```

This corresponds to the amino acid sequence <SEQ ID 1610; ORF552.ng>:

```
g552.pep
  1 MKLKTLLLPF AALALCANAF AAPPGDASLA RWLDTQNFDR DIEKNMIEGF

51 NAGFKPYADK ALAEMPEAKK DQAAEAFNRY RENVLKDLIT PEVKQAVRNT

101 LLKNAREIYT QEEIDGMIAF YGSPVGQSVV AKNPRLIKKS MSEIAVSWTA

151 LSGKIARHHL PEFTEELRRI ICGGIVD*
```

The following partial DNA sequence was identified in *N. meningitidis* <SEQ ID 1611>:

```
m552.seq (partial)
  1 ..ATTAAACTGA AAACCTTGTT ATTGCCCTTC GCCACGCTGG CATTGTGCAC

51    CAATGCTTTT GCCGCCCCGC CCAGCGACGC GTCGTTGGCG CGTTGGCTGG

101    ATACGCAGAA TTTTGACCGG GATATAGAAA AAAATATGAT TGAGGGCTTT
```

```
151    AATGCCGGAT TTAAACCGTA TGCGGACAAA GCCCTTGCCG AAATGCCGGA

201    AGCGAAAAAA GATCAGGCGG CAGAAGCCTT TAACCGTTAT CGTGAGAATG

251    TTTTGAAAGA TTTGATTACG CCCGAAGTGA ACAGGCTGT  CCGCAATACT

301    TTATTGAAGA ATGCCCGTGA GATATACACG CAAGAAGAAA TTGACGGCAT

351    GATTGCCTTT TACGGTTCGC CTGTCGGTCA GTCCGTCGTT GCCAAAAATC

401    CGCGCTTAAT CAAGAAATCG ATGAGTGAAA TAGCGGTATC TTGGACTGCA

451    TTGTCAGGGA AAATCGCGCA ACATCATCTG CCCGAGTTTA CGGAAGAGTT

501    GCGGCGCATC ATCTGCGGCG GTAAAAATCC CGATGCGGGC TGTAAACAAG

551    CCGGACAGGT TGGGAAAAGG CATCAGAAAT AA
```

This corresponds to the amino acid sequence <SEQ ID 1612; ORF 552>:

```
m552.pep (partial)
  1 ..IKLKTLLLPF ATLALCTNAF AAPPSDASLA RWLDTQNFDR DIEKNMIEGF

51   NAGFKPYADK ALAEMPEAKK DQAAEAFNRY RENVLKDLIT PEVKQAVRNT

101   LLKNAREIYT QEEIDGMIAF YGSPVGQSVV AKNPRLIKKS MSEIAVSWTA

151   LSGKIAQHHL PEFTEELRRI ICGGKNPDAG CKQAGQVGKR HQK*
```

Computer analysis of this amino acid sequence gave the following results:

Homology with a Predicted ORF from N. gonorrhoeae
ORF 552 shows 97.1% identity over a 174 aa overlap with a predicted ORF (ORF 552.ng) from N. gonorrhoeae:

```
m552/g552
                  10         20         30         40         50         60
    m552.pep  IKLKTLLLPFATLALCTNAFAAPPSDASLARWLDTQNFDRDIEKNMIEGFNAGFKPYADK
              :||||||||:||||:|||||||||||:|||||||||||||||||||||||||||||||||
    g552      MKLKTLLLPFAALALCANAFAAPPGDASLARWLDTQNFDRDIEKNMIEGFNAGFKPYADK
                  10         20         30         40         50         60

70         80         90        100        110        120
    m552.pep  ALAEMPEAKKDQAAEAFNRYRENVLKDLITPEVKQAVRNTLLKNAREIYTQEEIDGMIAF
              ||||||||||||||||||||||||||||||||||||||||||||||||||||||||||||
    g552      ALAEMPEAKKDQAAEAFNRYRENVLKDLITPEVKQAVRNTLLKNAREIYTQEEIDGMIAF
                  70         80         90        100        110        120

130        140        150        160        170        180
    m552.pep  YGSPVGQSVVAKNPRLIKKSMSEIAVSWTALSGKIAQHHLPEFTEELRRIICGGKNPDAG
              ||||||||||||||||||||||||||||||||||||:|||||||||||||||:|||
    g552      YGSPVGQSVVAKNPRLIKKSMSEIAVSWTALSGKIARHHLPEFTEELRRIICGGIVDX
                 130        140        150        160        170

190
    m552.pep  CKQAGQVGKRHQKX
```

The following partial DNA sequence was identified in N. meningitidis <SEQ ID 1613>:

```
a552.seq
   1 ATTAAACTGA AACCTTGTT  ATTGCCCTTC GCCACGCTGG CATTGTGCAC

51 CAATGCTTTT GCCGCCCCGC CAGCGACGC  GTCGTTGGCG CGTTGGCTGG

101 ATACGCAGAA TTTTGACCGG GATATAGAAA AAAATATGAT TGAGGGCTTT

151 AATGCCGGAT TTAAACCGTA TGCGGACAAA GCCCTTGCCG AAATGCCGGA

201 AGCGAAAAAA GATCAGGCGG CAGAAGCCTT TAACCGTTAT CGTGAGAATG

251 TTTTGAAAGA TTTGATTACG CCCGAAGTGA ACAGGCTGT  CCGCAATACT
```

```
-continued
301 TTATTGAAGA ATGCCCGTGA GATATACACG CAAGAAGAAA TTGACGGCAT

351 GATTGCCTTT TACGGTTCGC CTGTCGGTCA GTCCGTCGTT GCCAAAAATC

401 CGCGCTTAAT CAAGAAATCG ATGAGTGAAA TAGCGGTATC TTGGACTGCA

451 TTGTCAGGGA AAATCGCGCA ACATCATCTG CCCGAGTTTA CGGAAGAGTT

501 GCGGCGCATC ATCTGCGGCG GTAAAAATCC CGATGCGGGC TGTAAACAAG

551 CCGGACAGGT TGGGAAAAGG CATCAGAAAT AA
```

This corresponds to the amino acid sequence <SEQ ID 1614; ORF 552.a>:

```
a552.pep
  1 IKLKTLLLPF ATLALCTNAF AAPPSDASLA RWLDTQNFDR DIEKNMIEGF

51 NAGFKPYADK ALAEMPEAKK DQAAEAFNRY RENVLKDLIT PEVKQAVRNT

101 LLKNAREIYT QEEIDGMIAF YGSPVGQSVV AKNPRLIKKS MSEIAVSWTA

151 LSGKIAQHHL PEFTEELRRI ICGGKNPDAG CKQAGQVGKR HQK*
``` m552/a552 100.0% identity in 193 aa overlap

```
                  10         20         30         40         50         60
     m552.pep IKLKTLLLPFATLALCTNAFAAPPSDASLARWLDTQNFDRDIEKNMIEGFNAGFKPYADK
             ||||||||||||||||||||||||||||||||||||||||||||||||||||||||||||
         a552 IKLKTLLLPFATLALCTNAFAAPPSDASLARWLDTQNFDRDIEKNMIEGFNAGFKPYADK
                  10         20         30         40         50         60

70         80         90        100        110        120
     m552.pep ALAEMPEAKKDQAAEAFNRYRENVLKDLITPEVKQAVRNTLLKNAREIYTQEEIDGMIAF
             ||||||||||||||||||||||||||||||||||||||||||||||||||||||||||||
         a552 ALAEMPEAKKDQAAEAFNRYRENVLKDLITPEVKQAVRNTLLKNAREIYTQEEIDGMIAF
                  70         80         90        100        110        120

130        140        150        160        170        180
     m552.pep YGSPVGQSVVAKNPRLIKKSMSEIAVSWTALSGKIAQHHLPEFTEELRRIICGGKNPDAG
             ||||||||||||||||||||||||||||||||||||||||||||||||||||||||||||
         a552 YGSPVGQSVVAKNPRLIKKSMSEIAVSWTALSGKIAQHHLPEFTEELRRIICGGKNPDAG
                 130        140        150        160        170        180

190
     m552.pep CKQAGQVGKRHQKX
             ||||||||||||||
         a552 CKQAGQVGKRHQKX
                 190
```

The following partial DNA sequence was identified in *N. meningitidis* <SEQ ID 1615>:

```
m552-1.seq
  1 TTGAATATTA AACTGAAAAC CTTGTTATTG CCCTTCGCCA CGCTGGCATT

51 GTGCACCAAT GCTTTTGCCG CCCCGCCCAG CGACGCGTCG TTGGCGCGTT

101 GGCTGGATAC GCAGAATTTT GACCGGGATA TAGAAAAAAA TATGATTGAG

151 GGCTTTAATG CCGGATTTAA ACCGTATGCG GACAAAGCCC TTGCCGAAAT

201 GCCGGAAGCG AAAAAGATC AGGCGGCAGA AGCCTTTAAC CGTTATCGTG

251 AGAATGTTTT GAAAGATTTG ATTACGCCCG AAGTGAAACA GGCTGTCCGC

301 AATACTTTAT TGAAGAATGC CCGTGAGATA TACACGCAAG AAGAAATTGA

351 CGGCATGATT GCCTTTTACG GTTCGCCTGT CGGTCAGTCC GTCGTTGCCA

401 AAAATCCGCG CTTAATCAAG AAATCGATGA GTGAAATAGC GGTATCTTGG

451 ACTGCATTGT CAGGGAAAAT CGCGCAACAT CATCTGCCCG AGTTTACGGA
```

-continued
```
501 AGAGTTGCGG CGCATCATCT GCGGCGGTAA AAATCCCGAT GCGGGCTGTA

551 AACAAGCCGG ACAGGTTGGG AAAAGGCATC AGAAATAA
```

This corresponds to the amino acid sequence <SEQ ID 1616; ORF 552-1>:

```
m552-1.pep
  1 LNIKLKTLLL PFATLALCTN AFAAPPSDAS LARWLDTQNF DRDIEKNMIE

51 GFNAGFKPYA DKALAEMPEA KKDQAAEAFN RYRENVLKDL ITPEVKQAVR

101 NTLLKNAREI YTQEEIDGMI AFYGSPVGQS VVAKNPRLIK KSMSEIAVSW

151 TALSGKIAQH HLPEFTEELR RIICGGKNPD AGCKQAGQVG KRHQK*
```

The following partial DNA sequence was identified in *N. meningitidis* <SEQ ID 1617>:

```
a552-1.seq
  1 TTGAATATTA AACTGAAAAC CTTGTTATTG CCCTTCGCCA CGCTGGCATT

51 GTGCACCAAT GCTTTTGCCG CCCCGCCCAG CGACGCGTCG TTGGCGCGTT

101 GGCTGGATAC GCAGAATTTT GACCGGGATA TAGAAAAAAA TATGATTGAG

151 GGCTTTAATG CCGGATTTAA ACCGTATGCG GACAAAGCCC TTGCCGAAAT

201 GCCGGAAGCG AAAAAAGATC AGGCGGCAGA AGCCTTTAAC CGTTATCGTG

251 AGAATGTTTT GAAAGATTTG ATTACGCCCG AAGTGAAACA GGCTGTCCGC

301 AATACTTTAT TGAAGAATGC CCGTGAGATA TACACGCAAG AAGAAATTGA

351 CGGCATGATT GCCTTTTACG GTTCGCCTGT CGGTCAGTCC GTCGTTGCCA

401 AAAATCCGCG CTTAATCAAG AAATCGATGA GTGAAATAGC GGTATCTTGG

451 ACTGCATTGT CAGGGAAAAT CGCGCAACAT CATCTGCCCG AGTTTACGGA

501 AGAGTTGCGG CGCATCATCT GCGGCGGTAA AAATCCCGAT GCGGGCTGTA

551 AACAAGCCGG ACAGGTTGGG AAAAGGCATC AGAAATAA
```

This corresponds to the amino acid sequence <SEQ ID 1618; ORF 552-1.a>:

```
a552-1.pep

1 LNIKLKTLLL PFATLALCTN AFAAPPSDAS LARWLDTQNF DRDIEKNMIE

51 GFNAGFKPYA DKALAEMPEA KKDQAAEAFN RYRENVLKDL ITPEVKQAVR

101 NTLLKNAREI YTQEEIDGMI AFYGSPVGQS VVAKNPRLIK KSMSEIAVSW

151 TALSGKIAQH HLPEFTEELR RIICGGKNPD AGCKQAGQVG KRHQK* a552-1/m552-1 100.0% identity in 195 aa overlap 10        20        30        40        50        60
    a552-1.pep LNIKLKTLLLPFATLALCTNAFAAPPSDASLARWLDTQNFDRDIEKNMIEGFNAGFKPYA
               ||||||||||||||||||||||||||||||||||||||||||||||||||||||||||||
       m552-1 LNIKLKTLLLPFATLALCTNAFAAPPSDASLARWLDTQNFDRDIEKNMIEGFNAGFKPYA
                    10        20        30        40        50        60

70        80        90       100       110       120
    a552-1.pep DKALAEMPEAKKDQAAEAFNRYRENVLKDLITPEVKQAVRNTLLKNAREIYTQEEIDGMI
               ||||||||||||||||||||||||||||||||||||||||||||||||||||||||||||
       m552-1 DKALAEMPEAKKDQAAEAFNRYRENVLKDLITPEVKQAVRNTLLKNAREIYTQEEIDGMI
                    70        80        90       100       110       120

130       140       150       160       170       180
    a552-1.pep AFYGSPVGQSVVAKNPRLIKKSMSEIAVSWTALSGKIAQHHLPEFTEELRRIICGGKNPD
               ||||||||||||||||||||||||||||||||||||||||||||||||||||||||||||
       m552-1 AFYGSPVGQSVVAKNPRLIKKSMSEIAVSWTALSGKIAQHHLPEFTEELRRIICGGKNPD
                   130       140       150       160       170       180
```

```
                        190
a552-1.pep  AGCKQAGQVGKRHQKX
            |||||||||||||||
    m552-1  AGCKQAGQVGKRHQKX
                        190
```

The following partial DNA sequence was identified in *N. gonorrhoeae* <SEQ ID 1619>:

```
g553.seq
    1 atggattatc tgcaaaacct gtctttgggc ttgacaaaaa agctgcccgt 51 tatactgcaa acagaagtag cggagtgtgg cttggcatgt ctagcggctg 101 tggccggatt ttatggtttc tatacggatt tgcgcgcact gcgttcaaaa 151 tactgtctgt cacttaaggg tgagaatttg gcagatattg ttcgttttgc 201 tgatgatatg gggctgacgg gacgggcgtt gaggctggat ttagacgaat 251 tgggcagttt gcgcctgccc tgtattctac attgggattt gaatcatttt 301 gtggtgctgg aatcggtatc ttcggacggg gctgccgtca tggatccggc 351 ttcgggacga cgcaaagtca agacggagga aatatcgcgc aagtttacgg 401 gaattgcttt ggaactgtgg ccaaacacgc gtttcgaggc aggggaagaa 451 aagcaggaaa tccgcatcct acccatgttg cgcgggattt ctgggctggg 501 gcggacattg tttcagcttt tggctttggc agcagcaatg gaagtgtttg 551 cttttttaca aaacgtcagc ttcaagatcg gacgtggtga atcgcttgcg 601 ttaatcggac gatcgggctg cggtaaatcg acacttttgg atattttaag 651 cggcaatcta cctcccgaat caggcaaagt catgataaat gggcacgaca 701 tttacagctt accgccacct tttattccgc aatttgagtg cgatggtcaa 751 ggcaggacga tgttttatag tggattaaat ttaaaccggt ag
```

This corresponds to the amino acid sequence <SEQ ID 1620; ORF 553.ng>:

```
g553.pep
    1 MDYLQNLSLG LTKKLPVILQ TEVAECGLAC LAAVAGFYGF YTDLRALRSK

51 YCLSLKGENL ADIVRFADDM GLTGRALRLD LDELGSLRLP CILHWDLNHF

101 VVLESVSSDG AAVMDPASGR RKVKTEEISR KFTGIALELW PNTRFEAGEE

151 KQEIRILPML RGISGLGRTL FQLLALAAAM EVFAFLQNVS FKIGRGESLA

201 LIGRSGCGKS TLLDILSGNL PPESGKVMIN GHDIYSLPPP FIPQFECDGQ

251 GRTMFYSGLN LNR*
```

The following partial DNA sequence was identified in *N. meningitidis* <SEQ ID 1621>:

```
m553.seq (partial)
    1 ATGGATTATT TATCAAGACT GTCCTTTGGA TTTAACAAAA AGCTACCTGT

51 CATTCTGCAA ACAGAAGTTG CTGAATGTGG TTTAGCATGC CTGACATCCA

101 TCTTGTCCTA TTATGGCTTT CACACTGATT TAAGAACGTT ACGCCAAAAA

151 TACACCCTGT CATTAAAGGG CGCAAATCTT GCAGACATCA TGAGATTTGG

201 CAATGAAATG AATTTAACGC CACGAGCTTT GCGTTTAGAG TTAGATGAGC

251 TGTCAAATTT ACAACTACCC TGCATTCTCC ATTGGAACTT AAACCATTTT
```

-continued

```
301 GTTGTACTTT GTTCCATTTC CAAAGACAGT ATCGTCATTA TGGACCCTGC

351 TGTCGGTATG CGAAAAATCA AAATGGACGA AGTTTCACAA AAATTCACAG

401 GGATTGCCCT AGAATTATTC CCCAATACCC ATTTTGAAGA GAAAAAAGAA

451 ACAAAGAAAA TCAAAATATT ATCTCTATTA AGGGGGGG.T CAGGCTTAAA

501 ACGCTCTTTA ATTCAAATGC TTATATTAGC TATTTCTTTG GAAGTCTTTG

551 CATTG...
```

This corresponds to the amino acid sequence <SEQ ID 1622; ORF 553>:

```
m553.pep (partial)
  1 MDYLSRLSFG FNKKLPVILQ TEVAECGLAC LTSILSYYGF HTDLRTLRQK

51 YTLSLKGANL ADIMRFGNEM NLTPRALRLE LDELSNLQLP CILHWNLNHF

101 VVLCSISKDS IVIMDPAVGM RKIKMDEVSQ KFTGIALELF PNTHFEEKKE

151 TKKIKILSLL RGXSGLKRSL IQMLILAISL EVFAL...
```

Computer analysis of this amino acid sequence gave the following results:
Homology with a Predicted ORF from *N. gonorrhoeae*
ORF 553 shows 65.5% identity over a 185 aa overlap with a predicted ORF (ORF 553.ng) from *N. gonorrhoeae*:

```
m553/g553

10         20         30         40         50         60
g553.pep MDYLQNLSLGLTKKLPVILQTEVAECGLACLAAVAGFYGFYTDLRALRSKYCLSLKGENL
         ||||: ||:|:::|||||||||||||||||::: ::|||:||||:||:|| |||||  ||
    m553 MDYLSRLSFGFNKKLPVILQTEVAECGLACLTSILSYYGFHTDLRTLRQKYTLSLKGANL
                  10         20         30         40         50         60

70         80         90        100        110        120
g553.pep ADIVRFADDMGLTGRALRLDLDELGSLRLPCILHWDLNHFVVLESVSSDGAAVMDPASGR
         |||:||::::|:||  |||||:||||::|:|||||||:|||||| |:|:|: ::|||| |
    m553 ADIMRFGNEMNLTPRALRLELDELSNLQLPCILHWNLNHFVVLCSISKDSIVIMDPAVGM
                  70         80         90        100        110        120

130        140        150        160        170        180
g553.pep RKVKTEEISRKFTGIALELWPNTRFEAGEEKQEIRILPMLRGISGLGRTLFQLLALAAAM
         ||:| :|:|:|||||||||| |:||   :| ::|:|| :||| ||| |:|:|:| || ::
    m553 RKIKMDEVSQKFTGIALELFPNRHFEEKKETKKIKILSLLRGXSGLKRSLIQMLILAISL
                 130        140        150        160        170        180

180        190        200        210        220        240
g553.pep EVFAFLQNVSFKIGRGESLALIGRSGCGKSTLLDILSGNLPPESGKVMINGHDIYSLPPP
         ||||:
    m553 EVFAL
```

The following partial DNA sequence was identified in *N. meningitidis* <SEQ ID 1623>:

```
a553.seq
  1 ATGCCCCATC TGCAAAACCT GTCTTTGGGC TTAAAGAAAA AGCTGCCTGT

51 TATCCTGCAA ACAGAAATAT CAGAATGCGG CTTGGCATGT CTGGCGGCTG

101 TGGCGGGATT TCATGGTTTC CATACGAATT TACGCGCACT GCGTTCAAAA

151 TAC
```

This corresponds to the amino acid sequence <SEQ ID 1624; ORF 553.a>:

```
a553.pep
   1 MPHLQNLSLG LKKKLPVILQ TEISECGLAC LAAVAGFHGF HTNLRALRSK

51 Y
``` m553/a553 62.7% identity in 51 aa overlap

```
                 10         20         30         40         50         60
   m553.pep MDYLSRLSFGFNKKLPVILQTEVAECGLACLTSILSYYGFHTDLRTLRQKYTLSLKGANL
             :|: ||:|::||||||||||||::||||||:::   :::|||||||:||:||:||
       a553 MPHLQNLSLGLKKKLPVILQTEISECGLACLAAVAGFHGPHTNLRALRSKY
                 10         20         30         40         50
                 70         80         90        100        110        120
   m553.pep ADIMRFGNEMNLTPRALRLELDELSNLQLPCILHWNLNHFVVLCSISKDSIVIMDPAVGM
```

The following partial DNA sequence was identified in *N. gonorrhoeae* <SEQ ID 1625>:

```
g554.seq..
   1 atgacagcac ataaaatcct gcccgtcctt cttcccatca tcttaggcgt 51 ttctcacgca acggctgcat cgcccgcgcc aacagaccg acggtacacg 101 ccgccccac gctccaaaca cccgaaaccc tcacggcggc acacatcgtt 151 atcgaccttc aaagcaggca gactttatcc gccaaaaaca ccaatacccc 201 tgtcgaaccg gcggcactaa cccaactgat gaccgcatat ttggttttca 251 aaaacatgaa atcgggaaat atccaatctg aagaaaactt aaaaataccc 301 gaatccgcat gggcttcaga aggaagcaga atgtttgtac gtcccggcga 351 tacggtcagc accgacaaac tcttaaaagg catgattgcc ctatgcgcaa 401 acgatgccgc cctaacccett gccgaccggc tgggcaacgg ctcgattgaa 451 aattttgtgc aacaaatgaa caaagaagcc cgacgcttgg gcatgaagaa 501 caccgtattc aaaaacccga caggcttggg tagagaagga caggtttcca 551 ccgccaaaga cctctccctg ctgtctgaag cattgatgcg cgactttccg 601 gaatattacc cgctgttttc catcaaatcg ttcaagtttg aaaacataga 651 acaaaacaac cgcaatatcc ttttatatag ggacaacaat gtaaacggcc 701 tgaaagccgg gcacacagaa agcggcggct acaaccttgc cgtgtcatac 751 tccggcaacg gcaggcacat ccttgtcatc acactaggtt cggaatcggc 801 ggaaacccgc gcatcggaca acagcaagct gctgaaccgg cattgcagg 851 ccttcgatac gcccaaaata tatccgaaag gcaaaaccgt tgcccaaatc 901 caaatttccg gaggcagcaa aaaaaccgtc cgcgcaggct tcctcaaaga 951 agcctacatc actctgccac ataaagaagc gaaaatggca gaacagattt 1001 tggaaaccat acagccgatt cccgccccgg taaaaaaagg gcagatttta 1051 ggaaaaatca aaatcaggca aaacggacat accattgccg aaaaagaaat 1101 cgtcgcactg gaaaacgtag aaaaaagaag ccggtggcaa aggctttgga 1151 cgcgtctgac agggcagtaa
```

This corresponds to the amino acid sequence <SEQ ID 1626; ORF 554.ng>:

```
g554.pep..
   1 MTAHKILPVL LPIILGVSHA TAASPAPNRP TVHAAPTLQT PETLTAAHIV

51 IDLQSRQTLS AKNTNTPVEP AALTQLMTAY LVFKNMKSGN IQSEENLKIP

101 ESAWASEGSR MFVRPGDTVS TDKLLKGMIA LCANDAALTL ADRLGNGSIE

151 NFVQQMNKEA RRLGMKNTVF KNPTGLGREG QVSTAKDLSL LSEALMRDFP

201 EYYPLFSIKS FKFENIEQNN RNILLYRDNN VNGLKAGHTE SGGYNLAVSY

251 SGNGRHILVI TLGSESAETR ASDNSKLLNR ALQAFDTPKI YPKGKTVAQI

301 QISGGSKKTV RAGFLKEAYI TLPHKEAKMA EQILETIQPI PAPVKKGQIL

351 GKIKIRQNGH TIAEKEIVAL ENVEKRSRWQ RLWTRLTGQ*
```

The following partial DNA sequence was identified in *N. meningitidis* <SEQ ID 1627>:

```
m554.seq..
    1 ATGACAGCAC ATAAAATCCT GCCCGTCCTG CTTTCCATCA TCTTAGGCGT

51 TTCTCACGCA ACGGCTGCAT CGCCCGCGCC AACAGACCG ACGGTACACG

101 CCGCCCCCAC GTTCCAAACA CCCGAAACCC TCACAGCGGC ACACATCGTT

151 ATCGACCTTC AAAGCAAACA GATTTTATCC GCCAAAAACA TCAATACCCC

201 TGTTGAACCG GCGGCACTAA CCCAACTGAT GACCGCATAT CTGGTTTTCA

251 AAAACATGAA ATCGGGCAAT ATCCAATCTG AAGAAAACTT AAAAATACCC

301 GAATCCGCAT GGGCTTCAGA AGGAAGCAGA ATGTTTGTAC GTCCCGGCGA

351 TACGGTCAGC ACCGACAAAC TCTTAAAAGG CATGATTGCA CTATCCGCAA

401 ACGATGCCGC CCTAACCCTT GCCGGCCGGC TGGGCAACGG CTCGATTGAA

451 AATTTTGTGC AACAAATGAA CAAAGAAGCC CGACGCTTGG GCATGAAGAA

501 CACTGTATTC AAAAACCCGA CAGGCTTGAG TAGAGAAGGA CAGGTTTCCA

551 CCGCCAAAGA CGTCGCACTG CTGTCTGAAG CATTGATGCG CGACTTTCCG

601 GAATATTACC CGCTGTTTTC CATCAAATCT TTCAAATTCA AAAATATAGA

651 ACAAAACAAC CGCAATATCC TTTTATATAG GGACAACAAT GTAAACGGTC

701 TGAAAGCCGG ACACACAGAA AGCGGCGGCT ACAACCTTGC CGTGTCATAC

751 TCCGGCAACG GCAGGCACAT CCTTGTCATC ACATTGGGTT CGGAATCGGC

801 GGAAACACGC GCATCAGACA ACAGCAAGCT GCTGAACTGG CATTGCAGG

851 CCTTCGATAC GCCCAAAATA TATCCGAAAG GCAAACCGT TGCCCAAATC

901 CAAATTTCCG GAGGCAGCAA AAAACCGTC CGCGCAGGCT TCCTCAAAGA

951 AGCCTACATC ACTCTGCCAC ATAAGGAAGC GAAAATGGCA GAACAAATTC

1001 TAGAAACCAT ACAGCCGATT CCCGCCCCAG TAAAAAAAGG GCAAATTTTA

1051 GGAAAAATCA AAATCAGACA AAACGGATAC ACCATTGCCG AAAAAGAAAT

1101 CGTCGCACTG GAAAATGTAA AAAAAAGAAG CCGGTGGCAA AGGCTTTGGG

1151 CGTGTCTGAC AGGGCAGTAA
```

This corresponds to the amino acid sequence <SEQ ID 1628; ORF 554>:

```
m554.pep..
  1 MTAHKILPVL LSIILGVSHA TAASPAPNRP TVHAAPTFQT PETLTAAHIV

51 IDLQSKQILS AKNINTPVEP AALTQLMTAY LVFKNMKSGN IQSEENLKIP

101 ESAWASEGSR MFVRPGDTVS TDKLLKGMIA LSANDAALTL AGRLGNGSIE

151 NFVQQMNKEA RRLGMKNTVF KNPTGLSREG QVSTAKDLAL LSEALMRDFP

201 EYYPLFSIKS FKFKNIEQNN RNILLYRDNN VNGLKAGHTE SGGYNLAVSY

251 SGNGRHILVI TLGSESAETR ASDNSKLLNW ALQAFDTPKI YPKGKTVAQI

301 QISGGSKKTV RAGFLKEAYI TLPHKEAKMA EQILETIQPI PAPVKKGQIL

351 GKIKIRQNGY TIAEKEIVAL ENVKKRSRWQ RLWACLTGQ*
```

Computer analysis of this amino acid sequence gave the following results:

Homology with a Predicted ORF from *N. gonorrhoeae*
ORF 554 shows 96.1% identity over a 389 aa overlap with a predicted ORF (ORF 554.ng) from *N. gonorrhoeae*:

```
m554/g554
                   10         20         30         40         50         60
      m554.pep MTAHKILPVLLSIILGVSHATAASPAPNRPTVHAAPTFQTPETLTAAHIVIDLQSKQILS
              ||||||||||| |||||||||||||||||||||||||| |||||||||||||||:| ||
         g554 MTAHKILPVLLPIILGVSHATAASPAPNRPTVHAAPTLQTPETLTAAHIVIDLQSRQTLS
                   10         20         30         40         50         60

70         80         90        100        110        120
      m554.pep AKNINTPVEPAALTQLMTAYLVFKNMKSGNIQSEENLKIPESAWASEGSRMFVRPGDTVS
              ||| ||||||||||||||||||||||||||||||||||||||||||||||||||||||||
         g554 AKNTNTPVEPAALTQLMTAYLVFKNMKSGNIQSEENLKIPESAWASEGSRMFVRPGDTVS
                   70         80         90        100        110        120

130        140        150        160        170        180
      m554.pep TDKLLKGMIALSANDAALTLAGRLGNGSIENFVQQMNKEARRLGMKNTVFKNPTGLSREG
              |||||||||| |||||||||| ||||||||||||||||||||||||||||||||||:|||
         g554 TDKLLKGMIALCANDAALTLADRLGNGSIENFVQQMNKEARRLGMKNTVFKNPTGLREG
                  130        140        150        160        170        180

190        200        210        220        230        240
      m554.pep QVSTAKDLALLSEALMRDFPEYYPLFSIKSFKFKNIEQNNRNILLYRDNNVNGLKAGHTE
              ||||||||:|||||||||||||||||||||:|||||||||||||||||||||||||||||
         g554 QVSTAKDLSLLSEALMRDFPEYYPLFSIKSFKEKNIEQNNRNILLYRDNNVNGLKAGHTE
                  190        200        210        220        230        240

250        260        270        280        290        300
      m554.pep SGGYNLAVSYSGNGRHILVITLGSESAETRASDNSKLLNWALQAFDTPKIYPKGKTVAQI
              |||||||||||||||||||||||||||||||||||||| |||||||||||||||||||||
         g554 SGGYNLAVSYSGNGRHILVITLGSESAETRASDNSKLLNRALQAFDTPKIYPKGKTVAQI
                  250        260        270        280        290        300

310        320        330        340        350        360
      m554.pep QISGGSKKTVRAGFLKEAYITLPHKEAKMAEQILETIQPIPAPVKKGQILGKIKIRQNGY
              |||||||||||||||||||||||||||||||||||||||||||||||||||||||||||:
         g554 QISGGSKKTVRAGFLKEAYITLPHKEAKMAEQILETIQPIPAPVKKGQILGKIKIRQNGH
                  310        320        330        340        350        360

370        380        390
      m554.pep TIAEKEIVALENVKKRSRWQRLWACLTGQX
              |||||||||||:|||||||||:| ||||
         g554 TIAEKEIVALENEKKRSRWQRLWTRLTGQX
                  370        380        390
```

The following partial DNA sequence was identified in *N. meningitidis* <SEQ ID 1629>:

```
a554.seq
   1 ATGACAGCAC ATAAAATCCT GCCCGTCCTG CTTTCCATCA TCTTAGGCGT

51 TTCTCACGCA ACGGCTGCAT CGCCCGCGCC CAACAGACCG ACGGCACACG

101 CCGCCCCCAC GTTCCAAACA CCCGAAACCC TCACAGCGGC ACACATCGTT
```

-continued

```
 151 ATCGACCTTC AAAGCAAACA GATTTTATCC GCCAAAAACA TCAATACCCC

201 TGTCGAACCG GCGGCACTAA CCCAACTGAT GACCGCATAT CTGGTTTTCA

251 AAAACATGAA ATCGGGAAAT ATCCGATCTG AAGAAACTTT AAAAATACCC

301 GAATCCGCAT GGGCTTCAGA AGGAAGCAGA ATGTTTGTAC GTCCCGGCGA

351 TACGGTCAGC ACCGACAAAC TCTTAAAAGG CATGATTGCA CTATCCGCAA

401 ACGATGCCGC CCTAACCCTT GCCGGCCGGC TGGGCAACGG CTCGATTGAA

451 AATTTTGTGC AACAAATGAA CAAGAAGCC CGACGCTTGG GCATGAAGAA

501 CACTGTATTC AAAAATCCGA CAGGCTTGAG TAGAGAAGGA CAGGTTTCCA

551 CCGCCAAAGA CCTCGCCCAG CTGTCTGAAG CATTGATGCG CGACTTTCCG

601 GAATATTACC CGCTGTTTTC CATCAAATCT TTCAAATTCA AAAATATAGA

651 GCAAACAAC CGCAATATCC TTTTATATAG GGACAACAAT GTAAACGGTC

701 TGAAAGCCGG ACACACAGAA AGCGGCGGCT ACAACCTTGC CGTGTCATAC

751 TCCGGCAACG GCAGGCACAT CCTTGTCATC ACATTGGGTT CGGAATCGGC

801 GGAAACACGC GCATCAGACA ACAGCAAGCT GCTGAACTGG CATTGCAAG

851 CCTTCGATAC GCCCAAAATA TATCCGAAAG GCAAAACCGT TGCCCAAATC

901 CAAATTTCCG GAGGCAGCAA AAAACCGTC CGCGCAGGCT TCCTCAAAGA

951 AGCCTACATC ACTCTGCCAC ATAAGGAAGC GAAATGGCA GAACAAATTC

1001 TAGAAACCAT ACAGCCGATT CCCGCCCCAG TAAAAAAGG GCAAATTTTA

1051 GGAAAAATCA AAATCAGACA AACGGATAC ACCATTGCCG AAAAAGAAAT

1101 CGTCGCACTG GAAAATGTAA AAAAAAGAAG CCGGTGGCAA AGGCTTTGGG

1151 CGTGTCTGAC AGGGCAGTAA
                                                                35
```

This corresponds to the amino acid sequence <SEQ ID 1630; ORF 554.a>:

```
a554.pep
  1 MTAHKILPVL LSIILGVSHA TAASPAPNRP TAHAAPTFQT PETLTAAHIV

51 IDLQSKQILS AKNINTPVEP AALTQLMTAY LVFKNMKSGN IRSEENLKIP

101 ESAWASEGSR MFVRPGDTVS TDKLLKGMIA LSANDAALTL AGRLGNGSIE

151 NFVQQMNKEA RRLGMKNTVF KNPTGLSREG QVSTAKDLAQ LSEALMRDFP

201 EYYPLFSIKS FKFKNIEQNN RNILLYRDNN VNGLKAGHTE SGGYNLAVSY

251 SGNGRHILVI TLGSESAETR ASDNSKLLNW ALQAFDTPKI YPKGKTVAQI

301 QISGGSKKTV RAGFLKEAYI TLPHKEAKMA EQILETIQPI PAPVKKGQIL

351 GKIKIRQNGY TIAEKEIVAL ENVKKRSRWQ RLWACLTGQ*
``` m554/a554 99.2% identity in 389 aa overlap

```
                 10         20         30         40         50         60
   m554.pep  MTAHKILPVLLSIILGVSHATAASPAPNRPTVHAAPTFQTPETLTAAHIVIDLQSKQILS
             ||||||||||||||||||||||||||||||:|||||||||||||||||||||||||||||
       a554  MTAHKILPVLLSIILGVSHATAASPAPNRPTAHAAPTFQTPETLTAAHIVIDLQSKQILS
                 10         20         30         40         50         60

70         80         90        100        110        120
   m554.pep  AKNINTPVEPAALTQLMTAYLVFKNMKSGNIQSEENLKIPESAWASEGSRMFVRPGDTVS
             ||||||||||||||||||||||||||||||:|||||||||||||||||||||||||||||
       a554  AKNINTPVEPAALTQLMTAYLVFKNMKSGNIRSEENLKIPESAWASEGSRMFVRPGDTVS
                 70         80         90        100        110        120
```

-continued

```
                     130        140        150        160        170        180
   m554.pep   TDKLLKGMIALSANDAALTLAGRLGNGSIENFVQQMNKEARRLGMKNTVFKNPTGLSREG
              ||||||||||||||||||||||||||||||||||||||||||||||||||||||||||||
   a554       TDKLLKGMIALSANDAALTLAGRLGNGSIENFVQQMNKEARRLGMKNTVFKNPTGLSREG
                     130        140        150        160        170        180

190        200        210        220        230        240
   m554.pep   QVSTAKDLALLSEALMRDFPEYYPLFSIKSFKFKNIEQNNRNILLYRDNNVNGLKAGHTE
              ||||||||| ||||||||||||||||||||||||||||||||||||||||||||||||||
   a554       QVSTAKDLAQLSEALMRDFPEYYPLFSIKSFKFKNIEQNNRNILLYRDNNVNGLKAGHTE
                     190        200        210        220        230        240

250        260        270        280        290        300
   m554.pep   SGGYNLAVSYSGNGRHILVITLGSESAETRASDNSKLLNWALQAFDTPKIYPKGKTVAQI
              ||||||||||||||||||||||||||||||||||||||||||||||||||||||||||||
   a554       SGGYNLAVSYSGNGRHILVITLGSESAETRASDNSKLLNWALQAFDTPKIYPKGKTVAQI
                     250        260        270        280        290        300

310        320        330        340        350        360
   m554.pep   QISGGSKKTVRAGFLKEAYITLPHKEAKMAEQILETIQPIPAPVKKGQILGKIKIRQNGY
              ||||||||||||||||||||||||||||||||||||||||||||||||||||||||||||
   a554       QISGGSKKTVRAGFLKEAYITLPHKEAKMAEQILETIQPIPAPVKKGQILGKIKIRQNGY
                     310        320        330        340        350        360

370        380        390
   m554.pep   TIAEKEIVALENVKKRSRWQRLWACLTGQX
              |||||||||||||||||||||||||||||
   a554       TIAEKEIVALENVKKRSRWQRLWACLTGQX
                     370        380        390
```

The following partial DNA sequence was identified in *N. gonorrhoeae* <SEQ ID 1631>:

```
g556.seq..
   1 atggacaata agaccaaact gcgcttgggc ggcctgattt tactgaccac 51 cgccgtttta agcctcatta tcgtattgat tgtcgattcc tggccgcttg 101 ccatcctgct tgccgccgtc atcgtcgccg ccgctgcggg cggctttgtt 151 tggacatccc gccgacagca acgccagttt atcgaacgtc tgaaaaaatt 201 cgacatcgat cccgaaaaag gcagaatcaa cgaggcaaac ctgcgccgta 251 tgtaccacag cggcggacaa caccagaaag atgcgattac cctgatctgc 301 ctgtcgcaaa aatgttcggt ggacgaggcg cacgctatgt tcaaaaaacg 351 cccgacacgt caggaaatca atcaaatggc ggcaaaacag tcgcgcggtc 401 agaaacgtcc gcaccgttaa
```

This corresponds to the amino acid sequence <SEQ ID 1632; ORF 556.ng>:

```
g556.pep..
   1 MDNKTKLRLG GLILLTTAVL SLIIVLIVDS WPLAILLAAV IVAAAAGGFV

51 WTSRRQQRQF IERLKKFDID PEKGRINEAN LRRMYHSGGQ HQKDAITLIC

101 LSQKCSVDEA HAMFKKRPTR QEINQMAAKQ SRGQKRPHR*
```

The following partial DNA sequence was identified in *N. meningitidis* <SEQ ID 1633>:

```
m556.seq..
   1 ATGGACAATA AGACCAAACT GCGCTTGGGC GGCCTGATTT TACTGACCAC

51 CGCCGTTTTA AGCCTCATTA TCGTATTGAT TGTCGATTCC TGGCCGCTTG

101 CCATCCTGCT TGCAGCCGTC ATTGTCGCTG CCGCTGCGGG CGGTTTTGTT
```

-continued
```
151 TGGACATCCC GCCGACAGCA ACGCCAGTTT ATCGAACGCC TGAAAAAATT

201 CGACATCGAT CCCGAAAAAG GCAGAATCAA CGAGGCAAAC CTGCGCCGTA

251 TGTACCACAG CGGCGGACAA CACCAGAAAG ATGCGATTAC CCTGATCTGC

301 CTGTCGCAAA AATGTTCGGT GGACGAGGCG CACGCTATGT TCAAAAAACG

351 CCCGACACGT CAGGAAATCA ATCAAATGGC GGCAAAACAG TCGCGCGGTC

401 AGAAACGTCC GCACCGTTAA
```

This corresponds to the amino acid sequence <SEQ ID 1634; ORF 556>:

```
m556.pep..
  1 MDNKTKLRLG GLILLTTAVL SLIIVLIVDS WPLAILLAAV IVAAAAGGFV

51 WTSRRQQRQF IERLKKFDID PEKGRINEAN LRRMYHSGGQ HQKDAITLIC

101 LSQKCSVDEA HAMFKKRPTR QEINQMAAKQ SRGQKRPHR*
```

Computer analysis of this amino acid sequence gave the following results:
Homology with a Predicted ORF from *N. gonorrhoeae*
ORF 556 shows 100.0% identity over a 139 aa overlap with a predicted ORF (ORF 556.ng) from *N. gonorrhoeae*:

```
   m556/g556

10         20         30         40         50         60
      m556.pep MDNKTKLRLGGLILLTTAVLSLIIVLIVDSWPLAILLAAVIVAAAAGGFVWTSRRQQRQF
               ||||||||||||||||||||||||||||||||||||||||||||||||||||||||||||
          g556 MDNKTKLRLGGLILLTTAVLSLIIVLIVDSWPLAILLAAVIVAAAAGGFVWTSRRQQRQF
                   10         20         30         40         50         60

70         80         90        100        110        120
      m556.pep IERLKKFDIDPEKGRINEANLRRMYHSGGQHQKDAITLICLSQKCSVDEAHAMFKKRPTR
               ||||||||||||||||||||||||||||||||||||||||||||||||||||||||||||
          g556 IERLKKFDIDPEKGRINEANLRRMYHSGGQHQKDAITLICLSQKCSVDEAHAMFKKRPTR
                   70         80         90        100        110        120

130        140
      m556.pep QEINQMAAKQSRGQKRPHRX
               ||||||||||||||||||||
          g556 QEINQMAAKQSRGQKRPHRX
                  130        140
```

The following partial DNA sequence was identified in *N. meningitidis* <SEQ ID 1635>:

```
a556.seq
  1 ATGGACAATA AGACCAAACT GCGCTTGGGC GGCCTGATTT TACTGACCAC

51 CGCCGTTTTA AGCCTCATTA TCGTATTGAT TGTCGATTCC TGGCCGCTTG

101 CCATCCTGCT TGCCGCCGTC ATCGTCGCCG CCGCTGCGGG CGGCTTTGTT

151 TGGACATCCC GCCGACAGCA ACGCCAGTTT ATCGAACGTC TGAAAAAATT

201 CGACATCGAT CCCGAAAAAG GCAGAATCAA CGAGGCAAAC CTGCGCCGTA

251 TGTACCACAG CGGCGGACAA CACCAAAAAG ATGCGATTAC CCTGATCTGC

301 CTGTCGCAAA AATGTTCGGT GGACGAGGCG CACGCTATGT TCAAAAAACG

351 CCCGACACGT CAGGAAATCA ATCAAATGGC GGCAAAACAG TCGCGCGGTC

401 AGAAACGTCC GCACCGTTAA
```

This corresponds to the amino acid sequence <SEQ ID 1636; ORF 556.a>:

```
a556.pep
  1 MDNKTKLRLG GLILLTTAVL SLIIVLIVDS WPLAILLAAV IVAAAAGGFV

51 WTSRRQQRQF IERLKKFDID PEKGRINEAN LRRMYHSGGQ HQKDAITLIC

101 LSQKCSVDEA HAMFKKRPTR QEINQMAAKQ SRGQKRPHR*
``` m556/a556 100.0% identity in 139 aa overlap

```
                10         20         30         40         50         60
 m556.pep MDNKTKLRLGGLILLTTAVLSLIIVLIVDSWPLAILLAAVIVAAAAGGFVWTSRRQQRQF
          ||||||||||||||||||||||||||||||||||||||||||||||||||||||||||||
     a556 MDNKTKLRLGGLILLTTAVLSLIIVLIVDSWPLAILLAAVIVAAAAGGFVWTSRRQQRQF
                10         20         30         40         50         60

70         80         90        100        110        120
 m556.pep IERLKKFDIDPEKGRINEANLRRMYHSGGQHQKDAITLICLSQKCSVDEAHAMFKKRPTR
          ||||||||||||||||||||||||||||||||||||||||||||||||||||||||||||
     a556 IERLKKFDIDPEKGRINEANLRRMYHSGGQHQKDAITLICLSQKCSVDEAHAMFKKRPTR
                70         80         90        100        110        120

130        140
 m556.pep QEINQMAAKQSRGQKRPHRX
          ||||||||||||||||||||
     a556 QEINQMAAKQSRGQKRPHRX
               130        140
```

The following partial DNA sequence was identified in *N. gonorrhoeae* <SEQ ID 1637>:

```
g557.seq
  1 atgaacaaaa tattccttac tgccgcagcc ttggtgctgg gcgcgtgcgg 51 tttccacctg aaaggtgcag acggcatttc tccgccgctg acctaccgga 101 gctggcacat cgaaggcgga caggcattgc aatttccttt ggaaaccgcg 151 ctgtatcagg cttcgggcag ggtggacgat gctgccggcg cgcagatgac 201 cctgcgtata gacagcgttt cccaaaacaa ggaaacctat accgttaccc 251 gtgcggcagt catcaacgaa tatcttttga tattgacggt tgaagcgcag 301 gtattgaaac gcggcgagcc ggtcggcaaa ccgatgaccg tgtccgtccg 351 ccgcattttg gattatgccg acaacgaaat tttgggcaaa caggaagaag 401 aagaaaccct gtgggcggaa atgcggcagg atgttgccga acagattgtc 451 cgccgcctga cctttctgaa ggcggaatga
```

This corresponds to the amino acid sequence <SEQ ID 1638; ORF 557.ng>:

```
g557.pep..
  1 MNKIFLTAAA LVLGACGFHL KGADGISPPL TYRSWHIEGG QALQFPLETA

51 LYQASGRVDD AAGAQMTLRI DSVSQNKETY TVTRAAVINE YLLILTVEAQ

101 VLKRGEPVGK PMTVSVRRIL DYADNEILGK QEEETLWAE MRQDVAEQIV

151 RRLTFLKAE*
```

The following partial DNA sequence was identified in *N. meningitidis* <SEQ ID 1639>:

```
m557.seq..
  1 ATGAACAAAC TGTTTCTTAC TGCCGCAGTG CTGATGCTGG GCGCGTGCGG
```

-continued
```
 51 TTTCCACCTG AAAGGTGCAG ACGGCATTTC TCCGCCGCTG ACCTACCGGA

101 GCTGGCACAT CGAAGGCGGA CAGGCATTGC GGTTTCCTTT GGAAACCGCG

151 CTGTATCAGG CTTCGGGCAG GGTGGACGAT GCTGCCGGCG CGCAGATGAC

201 CCTGCGTATA GACAGCGTTT CCCAAAACAA GGAAACCTAC ACCGTTACCC

251 GTGCGGCAGT CATCAACGAA TATCTTTTGA TATTGACGGT TGAAGCGCAG

301 GTATTGAAAC GCGGCGAGCC GGTCGGTAAA CCGATGACCG TGTCCGTCCG

351 CCGCGTCCTT GCTTATGCCG ACAACGAGAT CTTGGGCAAA CAGGAAGAGG

401 AAGCGGCATT GTGGGCGGAA ATGCGGCAGG ATGCCGCCGA ACAGATTGTC

451 CGCCGCCTGA CCTTTCTGAA GGCGGAATGA
```

This corresponds to the amino acid sequence <SEQ ID 1640; ORF 557>:

```
m557.pep..
  1 MNKLFLTAAV LMLGACGFHL KGADGISPPL TYRSWHIEGG QALRFPLETA

51 LYQASGRVDD AAGAQMTLRI DSVSQNKETY TVTRAAVINE YLLILTVEAQ

101 VLKRGEPVGK PMTVSVRRVL AYADNEILGK QEEEAALWAE MRQDAAEQIV

151 RRLTFLKAE*
```

Computer analysis of this amino acid sequence gave the following results:
Homology with a Predicted ORF from *N. gonorrhoeae*
ORF 557 shows 94.3% identity over a 159 aa overlap with a predicted ORF (ORF 557.ng) from *N. gonorrhoeae*:

```
   m557/g557
                   10         20         30         40         50         60
      m557.pep MNKLFLTAAVLMLGACGFHLKGADGISPPLTYRSWHIEGGQALRFPLETALYQASGRVDD
                ||| :||||| :|:|||||||||||||||||||||||||||| :|||||||||||||||
          g557 MNKIFLTAAALVLGACGFHLKGADGISPPLTYRSWHIEGGQALQFPLETALYQASGRVDD
                   10         20         30         40         50         60

70         80         90        100        110        120
      m557.pep AAGAQMTLRIDSVSQNKETYTVTRAAVINEYLLILTVEAQVLKRGEPVGKPMTVSVRRVL
                ||||||||||||||||||||||||||||||||||||||||||||||||||||||||||:|
          g557 AAGAQMTLRIDSVSQNKETYTVTRAAVINEYLLILTVEAQVLKRGEPVGKPMTVSVRRIL
                   70         80         90        100        110        120

130        140        150        160
      m557.pep AYADNEILGKQEEEAALWAEMRQDAAEQIVRRLTFLKAEX
                |||||||||||||| :|||||||||:||||||||||||||
          g557 DYADNEILGKQEEETLWAEMRQDVAEQIVRRLTFLKAEX
                  130        140        150        160
```

The following partial DNA sequence was identified in *N. meningitidis* <SEQ ID 1641>:

```
a557.seq
  1 ATGAACAAAC TGTTTCTTAC TGCCGCAGTG CTGATGCTGG GCGCGTGCGG

51 TTTCCACCTG AAAGGTGCAG ACGGCATTTC TCCGCCGCTG ACCTACCGGA

101 GCTGGCACAT CGAAGGCGGA CAGGCATTGC AGTTTCCTTT GGAAACCGCG

151 CTGTATCAGG CTTCGGGTAG GGTGGACGAT GCTGCCGGCG CGCAGATGAC

201 CCTGCGTATA GACAGCGTTT CCCAAAACAA GGAAACCTAC ACCGTTACCC

251 GTGCGGCAGT CATCAACGAA TATCTTTTGA TATTGACGGT TGAAGCGCAG

301 GTATTGAAAC GCGGCGAGCC GGTCGGCAAA CCGATGACCG TGTCCGTCCG
```

```
                                -continued
351 CCGCGTCCTT GCTTATGCCG ACAACGAGAT CTTGGGCAAA CAGGAAGAGG

401 AAGCGGCATT GTGGGCGGAA ATGCGGCAGG ATGCCGCCGA ACAGATTGTC

451 CGCCGCCTGA CCTTTCTGAA GGCGGAATGA
```

This corresponds to the amino acid sequence <SEQ ID 1642; ORF 557.a>:

```
a557.pep
  1 MNKLFLTAAV LMLGACGFHL KGADGISPPL TYRSWHIEGG QALQFPLETA

51 LYQASGRVDD AAGAQMTLRI DSVSQNKETY TVTRAAVINE YLLILTVEAQ

101 VLKRGEPVGK PMTVSVRRVL AYADNEILGK QEEEAALWAE MRQDAAEQIV

151 RRLTFLKAE*
``` m557/a557 99.4% identity in 159 aa overlap

```
                    10        20        30        40        50        60
     m557.pep  MNKLFLTAAVLMLGACGFHLKGADGISPPLTYRSWHIEGGQALRFPLETALYQASGRVDD
               ||||||||||||||||||||||||||||||||||||||||:|||||||||||||||||||
         a557  MNKLFLTAAVLMLGACGFHLKGADGISPPLTYRSWHIEGGQALQFPLETALYQASGRVDD
                    10        20        30        40        50        60

70        80        90       100       110       120
     m557.pep  AAGAQMTLRIDSVSQNKETYTVTRAAVINEYLLILTVEAQVLKRGEPVGKPMTVSVRRVL
               ||||||||||||||||||||||||||||||||||||||||||||||||||||||||||||
         a557  AAGAQMTLRIDSVSQNKETYTVTRAAVINEYLLILTVEAQVLKRGEPVGKPMTVSVRRVL
                    70        80        90       100       110       120

130       140       150       160
     m557.pep  AYADNEILGKQEEEAALWAEMRQDAAEQIVRRLTFLKAEX
               ||||||||||||||||||||||||||||||||||||||||
         a557  AYADNEILGKQEEEAALWAEMRQDAAEQIVRRLTFLKAEX
                   130       140       150       160
```

The following partial DNA sequence was identified in *N. gonorrhoeae* <SEQ ID 1643>:

```
g558.seq..
  1 ATGGATGCTT GTTTTTTCGT CATTCCCGCA CAGGCGGGAA TTCGGAGATT

51 CGGGATTGTT TTCAAACGTT CGGGTCGGAT TCTTGCCGGT GCGGGAATGA

101 TGCCCTTATA TACTTTCTCC GAGCTTTATA TGCTTCAACA GGGGACGGCA

151 CATCAAGCAC CGCACTGCGT GTTGCCCGAA CGAGGCTGCC CTCCGATTAG

201 ATTCTATCGC TATAAACAGA CGGGTTTCAA CCGAAAAGGA ATGGGGATAA

251 AGTCCATTTC CGACACCTCT CGGGCGATGC CGTCTGAAAA CCAATCTCCA

301 CTTTCAGACG GCATTGTTTA G
```

This corresponds to the amino acid sequence <SEQ ID 1644; ORF 558.ng>:

```
g558.pep..
  1 MDACFFVIPA QAGIRRFGIV FKRSGRILAG AGMMPLYTFS ELYMLQQGTA

51 HQAPHCVLPE RGCPPIRFYR YKQTGFNRKG MGIKSISDTS RAMPSENQSP

101 LSDGIV*
```

The following partial DNA sequence was identified in *N. meningitidis* <SEQ ID 1645>:

```
m558.seq..
    1 ATGAATGCTT GTTTTTTCGT CATTCCCACA CAGGCGGGAA TTCGGAGATT

51 CGGGATTGTT TTCAAACGTT CGGGTCGGAT TCTTGCCGGT GCAGGAATGA

101 TGCCCTTATA TACTTTCTCC GAGCTTTATA TGTTTCAACA GGGGACGGCA

151 CATCAAGCAC CGCACTGCGT GTTGCCCGAA CGAGACTACC CTCCGATTAG

201 ATTCTATCGC CATAAACAGA CGGGTTTCAA CCGAAAAGGA ATGGGGATAA

251 AGTCCATTTC CGACATCTsT CGGGCGATGC CGTCTGAAAA CCAATCTCCA

301 CTTTCAGACG GCATTGTTTA G
```

This corresponds to the amino acid sequence <SEQ ID 1646; ORF 558>:

```
m558.pep..
    1 MNACFFVIPT QAGIRRFGIV FKRSGRILAG AGMMPLYTFS ELYMFQQGTA

51 HQAPHCVLPE RDYPPIRFYR HKQTGFNRKG MGIKSISDIX RAMPSENQSP

101 LSDGIV*
```

Computer analysis of this amino acid sequence gave the following results:
Homology with a Predicted ORF from *N. gonorrhoeae*
ORF 558 shows 92.5% identity over a 106 aa overlap with a predicted ORF (ORF 558.ng) from *N. gonorrhoeae*:

```
    m558/g558

10         20         30         40         50         60
    m558.pep MNACFFVIPTQAGIRRFGIVFKRSGRILAGAGMMPLYTFSELYMFQQGTAHQAPHCVLPE
             |:||||||||:|||||||||||||||||||||||||||||||||:||||||||||||||
        g558 MDACFFVIPAQAGIRRFGIVFKRSGRILAGAGMMPLYTFSELYMLQQGRAHQAPHCVLPE
                     10         20         30         40         50         60

70         80         90        100
    m558.pep RDYPPIRFYRHKQTGFNRKGMGIKSISDIXRAMPSENQSPLSDGIVX
             |  |||||||:|||||||||||||||||||   ||||||||||||||
        g558 RGCPPIRFYRYKQTGFNRKGMGIKSISDTSRAMPSENQSPLSDGIVX
                     70         80         90        100
```

The following partial DNA sequence was identified in *N. meningitidis* <SEQ ID 1647>:

```
a558.seq
    1 ATGAATGCTT GTTTTTTCGT CATTCCCACA CAGGCGGGAA TTCGGAGATT

51 CGGGATTGTT TTCAAACGTT CGGGTCGGAT TCTTGCCGGT GCGGGAATGA

101 TGCCCTTATA TATAGTGGAT TAAATTTAAA TCAGGACAAG GCGACGAAGC

151 CGCAGACAGT ACAAATAGTA CGGCAAGGCG AGGCAACGCC GTACTGGTTT

201 AAATTTAATC CACTATACTT TCTCCGAGCT TTATATGTTT CAACAGAGGA

251 CGGCACATCA AGCACCGCAC TGCGTGTTGC CCGAACGAGA CTGCCCTCCG

301 ATTAGATTCT ATCGCTATAA ACAGACGGGT TTCAACCGAA AAGGAATGGG

351 AATGAAGTCC GTTTCCGACA CCTCTCGGGC GATGCCGTCT GAAAACCAAT

401 CTCCACTTTC AGACGGCATT GTTTAG
```

This corresponds to the amino acid sequence <SEQ ID 1648; ORF 558.a>:

```
a558.pep
    1 MNACFFVIPT QAGIRRFGIV FKRSGRILAG AGMMPLYIVD *I*IRTRRRS

51 RRQYK*YGKA RQRRTGLNLI HYTFSELYMF QQRTAHQAPH CVLPERDCPP

101 IRFYRYKQTG FNRKGMGMKS VSDTSRAMPS ENQSPLSDGI V*
``` m558/a558 70.2% identity in 141 aa overlap

```
                    10        20        30        40        50        60
      m558.pep MNACFFVIPTQAGIRRFGIVFKRSGRILAGAGMMPLY----------------------
              |:||||||:||||||||||||||||||||||||||||
         a558 MNACFFVIPTQAGIRRFGIVFKRSGRILAGAGMMPLYIVDXIXIRTRRRSRRQYKXYGKA
                    10        20        30        40        50        60
                          40        50        60        70        80
      m558.pep -----------TFSELYMFQQGTAHQAPHCVLPERDYPPIRFYRHKQTGFNRKGMGIKS
                         ||||||||| |||||||||||||||| |||||||:||||||||||:||
         a558 RQRRTGLNLIHYTFSELYMFQQRTAHQAPHCVLPERDCPPIRFYRYKQTGFNRKGMGMKS
                    70        80        90       100       110       120
                    90       100
      m558.pep ISDIXRAMPSENQSPLSDGIVX
              :||  |||||||||||||||||
         a558 VSDTSRAMPSENQSPLSDGIVX
                   130       140
```

The following partial DNA sequence was identified in *N. gonorrhoeae* <SEQ ID 1649>:

```
g560.seq
    1 atgctcatca tccgcaacct gatttactgg ctgatactct gttccagcct 51 gattttcctc tttcccttta tgctgctcgc ctcgcctttc cgggacgggg 101 cgcacaagat ggcgcgggtc tgggtcggca tcctcaactg gtcgctcaaa 151 cacatcgtcg ggctcaaata ccgcatcatc ggcgcggaac acattccgga 201 ccgcccctcc gtcatctgcg ccaaacacca aagcggctgg gaaacgctcg 251 cgctccaaga gattttccg ccgcaggttt acgttgccaa gcgcgagttg 301 ttcaaaatcc cctttttcgg ctggggcttg aaactggtca aaaccatagg 351 catagaccgc aacaaccgcc gcgaagccaa cgaacagctc ataaaacagg 401 gtttggcgcg caaaaacgaa ggttattgga ttaccatttt ccccgaaggc 451 acgcgccttg cgcccggaaa acgcggcaaa tacaaactcg gcggcgcgcg 501 catggcgaaa atgtttgaga tggacatcgt ccccgtcgcc ctcaacagcg 551 gcgaattttg gccgaaaaat tcctttctga aatatccggg ggaaatcacc 601 gtcatcatct gtccgaccat cccgcacgca agcggcagcg aagccgaatt 651 gatggaaaaa tgcgaacacc tcattgaaac gcaacaaccg cttatttccg 701 gcgcaggccc gtttgccgcc gaaatgccgt ctgaaaccgc atga
```

This corresponds to the amino acid sequence <SEQ ID 1650; ORF 560.ng>:

```
g560.pep..
    1 MLIIRNLIYW LILCSSLIFL FPFMLLASPF RDGAHKMARV WVGILNWSLK

51 HIVGLKYRII GAEHIPDRPS VICAKHQSGW ETLALQEIFP PQVYVAKREL

101 FKIPFFGWGL KLVKTIGIDR NNRREANEQL IKQGLARKNE GYWITIFPEG
```

```
151 TRLAPGKRGK YKLGGARMAK MFEMDIVPVA LNSGEFWPKN SFLKYPGEIT

201 VIICPTIPHA SGSEAELMEK CEHLIETQQP LISGAGPFAA EMPSET*
```

The following partial DNA sequence was identified in *N. meningitidis* <SEQ ID 1651>:

```
m560.seq
  1 ATGCTCATCA TCCGCAACCT GATTTACTGG CTGATACTCT GTTCCACCCT

51 GATTTTCCTC TTTCCCTTTA TGCTGCTCGC CTCGCCTTTC CGGGACGGGG

101 CGCACAAGAT GGCGCGGGTC TGGGTCGGCA TTCTCAACTG GTCGCTCAAA

151 CACATCGTCG GGCTCAAATA CCGCATCATC GGCGCGGAAA ACATCCCCGA

201 CCGCCCCGCC GTCATCTGCG CCAAACACCA AAGCGGCTGG GAAACGCTCG

251 CCCTTCAGGA CATTTTTCCG CCGCAGGTTT ACGTTGCCAA ACGCGAGTTG

301 TTCAAAATCC CCTTTTTCGG CTGGGGCTTG AAACTGGTCA AAACCATAGG

351 CATAGACCGC AACAACCGCC GCGAAGCCAA CGAGCAGCTC ATAAAACAGG

401 GGTTGGTGCG CAAAAACGAA GGCTATTGGA TTACCATTTT CCCCGAAGGC

451 ACGCGCCTTG CGCCCGGAAA ACGCGGCAAA TACAAACTCG GCGGCGCGCG

501 CATGGCGAAA ATGTTTGAGA TGGACATCGT CCCCGTCGCC CTCAACAGCG

551 GCGAATTTTG GCCGAAAAAC TCCTTTCTGA ATATCCGGG GGAAATCACC

601 GTCGTCATCT GTCCGACCAT CCCGCACGCA AGCGGCAGCG AAGCCGAATT

651 GATGGAAAAA TGCGAACATC TCATCGAAAC GCAACAACCG CTTATTTCCG

701 GCGCAGGCCC GTTTGCCGCC AAAATGCCGT CTGAAACCGC ATGA
```

This corresponds to the amino acid sequence <SEQ ID 1652; ORF 560>:

```
m560.pep
  1 MLIIRNLIYW LILCSTLIFL FPFMLLASPF RDGAHKMARV WVGILNWSLK

51 HIVGLKYRII GAENIPDRPA VICAKHQSGW ETLALQDIFP PQVYVAKREL

101 FKIPFFGWGL KLVKTIGIDR NNRREANEQL IKQGLVRKNE GYWITIFPEG

151 TRLAPGKRGK YKLGGARMAK MFEMDIVPVA LNSGEFWPKN SFLKYPGEIT

201 VVICPTIPHA SGSEAELMEK CEHLIETQQP LISGAGPFAA KMPSETA*
```

Computer analysis of this amino acid sequence gave the following results:

Homology with a Predicted ORF from *N. gonorrhoeae*

ORF 560 shows 97.2% identity over a 246 aa overlap with a predicted ORF (ORF 560.ng) from *N. gonorrhoeae*:

```
m560/g560

10         20         30         40         50         60
    m560.pep MLIIRNLIYWLILCSTLIFLFPFMLLASPFRDGAHKMARVWVGILNWSLKHIVGLKYRII
             ||||||||||||||:|||||||||||||||||||||||||||||||||||||||||||||
        g560 MLIIRNLIYWLILCSSLIFLFPFMLLASPFRDGAHKMARVWVGILNWSLKHIVGLKYRII
                   10         20         30         40         50         60

70         80         90        100        110        120
    m560.pep GAENIPDRPAVICAKHQSGWETLALQDIFPPQVYVAKRELFKIPFFGWGLKLVKTIGIDR
             |||:||||||:|||||||||||||||||:|||||||||||||||||||||||||||||||
        g560 GAEHIPDRPSVICAKHQSGWETLALQEIFPPQVYVAKRELFKIPFFGWGLKLVKTIGIDR
                   70         80         90        100        110        120
```

-continued

```
                   130       140       150       160       170       180
m560.pep NNRREANEQLIKQGLVRKNEGYWITIFPEGTRLAPGKRGKYKLGGARMAKMFEMDIVPVA
         ||||||||||||||:|||||||||||||||||||||||||||||||||||||||||||||
    g560 NNRREANEQLIKQGLARKNEGYWITIFPEGTRLAPGKRGKYKLGGARMAKMFEMDIVPVA
                   130       140       150       160       170       180

190       200       210       220       230       240
m560.pep LNSGEFWPKNSFLKYPGEITVVICPTIPHASGSEAELMEKCEHLIETQQPLISGAGPFAA
         ||||||||||||||||||||:|||||||||||||||||||||||||||||||||||||||
    g560 LNSGEFWPKNSFLKYPGEITVIICPTIPHASGSEAELMEKCEHLIETQQPLISGAGPFAA
                   190       200       210       220       230       240 m560.pep KMPSETAX
         :|||||
    g560 EMPSETX
```

The following partial DNA sequence was identified in *N. meningitidis* <SEQ ID 1653>:

```
a560.seq
  1 ATGCTCATCA TCCGCAACCT GATTTACTGG CTGATACTCT GTTCCACCCT

51 GATTTTCCTC TTTCCCTTTA TGCTGCTCGC CTCGCCTTTC CGAGACGGGG

101 CGCACAAGAT GGCGCGGGTC TGGGTCAAAA TCCTCAACCT CTCGCTCAAA

151 CACATCGTCG GGCTCAAATA CCGCATCATC GGCGCGGAAA ACATCCCCGA

201 CCGCCCCGCC GTCATCTGCG CCAAACACCA AAGCGGCTGG GAAACGCTCG

251 CCCTTCAGGA CATTTTTCCG CCGCAGGTTT ACGTTGCCAA ACGCGAGTTG

301 TTCAAAATCC CCTTTTTCGG CTGGGGCTTG AAACTGGTCA AAACCATAGG

351 CATAGACCGC AACAACCGCC GCGAAGCCAA CGAGCAGCTC ATAAAACAGG

401 GGTTGGCGCG CAAAAACGAA GGCTATTGGA TTACCATTTT CCCCGAAGGC

451 ACACGCCTTG CGCCCGGAAA ACGCGGCAAA TACAAACTCG GCGGCGCGCG

501 CATGGCGAAA ATGTTTGAGA TGGACATCGT CCCCGTCGCC CTCAACAGCG

551 GCGAATTTTG GCCGAAAAAC TCCTTTCTGA AATATCCGGG GGAAATCACC

601 GTCGTCATCT GTCCGACCAT CCCGCACGCA AGCGGCAGCG AAGCCGAATT

651 GATGGGAAAA TGCGAACACC TCATCGAAAC GCAGCAGCCG CTCATTTCCG

701 GCGCAGGCCC GTTTGCCGCC AAAATGCCGT CTGAAACCGC ATGA
```

This corresponds to the amino acid sequence <SEQ ID 1654; ORF 560.a>:

```
a560.pep
  1 MLIIRNLIYW LILCSTLIFL FPFMLLASPF RDGAHKMARV WVKILNLSLK

51 HIVGLKYRII GAENIPDRPA VICAKHQSGW ETLALQDIFP PQVYVAKREL

101 FKIPFFGWGL KLVKTIGIDR NNRREANEQL IKQGLARKNE GYWITIFPEG

151 TRLAPGKRGK YKLGGARMAK MFEMDIVPVA LNSGEFWPKN SFLKYPGEIT

201 VVICPTIPHA SGSEAELMGK CEHLIETQQP LISGAGPFAA KMPSETA*
```

(residues 1–37, MLIIRNLIYW LILCSTLIFL FPFMLLA, are underlined)

m560/a560 98.4% identity in 247 aa overlap

```
                   10        20        30        40        50        60
m560.pep MLIIRNLIYWLILCSTLIFLFPFMLLASPFRDGAHKMARVWVGILNWSLKHIVGLKYRII
         ||||||||||||||||||||||||||||||||||||||||||||||||||||||||||||
    a560 MLIIRNLIYWLILCSTLIFLFPFMLLASPFRDGAHKMARVWVGILNWSLKHIVGLKYRII
                   10        20        30        40        50        60
```

-continued

```
                  70        80        90        100       110       120
m560.pep GAENIPDRPAVICAKHQSGWETLALQDIFPPQVYVAKRELFKIPFFGWGLKLVKTIGIDR
         ||||||||||||||||||||||||||||||||||||||||||||||||||||||||||||
    a560 GAENIPDRPAVICAKHQSGWETLALQDIFPPQVYVAKRELFKIPFFGWGLKLVKTIGIDR
                  70        80        90        100       110       120

130       140       150       160       170       180
m560.pep NNRREANEQLIKQGLVRKNEGYWITIFPEGTRLAPGKRGKYKLGGARMAKMFEMDIVPVA
         |||||||||||||||:||||||||||||||||||||||||||||||||||||||||||||
    a560 NNRREANEQLIKQGLARKNEGYWITIFPEGTRLAPGKRGKYKLGGARMAKMFEMDIVPVA
                  130       140       150       160       170       180

190       200       210       220       230       240
m560.pep LNSGEFWPKNSFLKYPGEITVVICPTIPHASGSEAELMEKCEHLIETQQPLISGAGPFAA
         ||||||||||||||||||||||||||||||||||||||||||||||||||||||||||||
    a560 LNSGEFWPKNSFLKYPGEITVVICPTIPHASGSEAELMEKCEHLIETQQPLISGAGPFAA
                  190       200       210       220       230       240 m560.pep KMPSETAX
         ||||||||
    a560 KMPSETAX
```

The following partial DNA sequence was identified in *N. meningitidis* <SEQ ID 1655>:

```
Nm561.seq.
   1 ATGATACTGC CAGCCCGTTT TTCAGACGGC ATCAGCCTTT CCCTGCGCCT

51 GAAACTCCTG ACCGGACTGT GGGTCGGGTT GGCGGCATTG TCTGTCGTTT

101 TGACACTGCT GCTCTCTTTG CGTCTGGAAA ACGCGGCCTC CGTCATCGAA

151 GAGGCGGGCA ACTTGAGAAT GCAGGCATAC CGTCTGGCAT ACATGGCGGG

201 TGAAGGCTCG CCCCGTGCGC AAATTGACAA TCAGGTTGCC GAATTTGAAA

251 AAAGTTTAAA ACGCATTGCC CAAAGCGATG CCATCCATCC GCTGATTCCT

301 TCGGACACCC CTCTTGCTTA TGATTTGATA CAATCCATGC TGATTATAGA

351 TTGGCAGGCA CACATCCTCC CCCCGCTCCA GTCCTACCGG CGACCGACTC

401 AGGTCGATCT CTACCGCTTT GCCGGAAACA TCGAACTGTT TTTGCAGGCA

451 TTGGAAAATG CCAACGAAAA AAACACATGG TGGCTCAGGC GTTTTCAATG

501 GGCAATTATG TTGATGACGC TGGTGTCGTC TGTACTGATG CTGTTTTGGC

551 ACCAGATTTG GGTTATCCGG CCGCTGCAGG CGTTAAGGGA AGGTGCGGAA

601 CGCATCGGAC GGAGGTGTTT CGATATTCCG GTTCCCGAAG GCGGTACGCC

651 GGAATTCAAA CAGGTCGGGC GTTGTTTCAA TCAAATGGGC GGCAGGTTGA

701 AAATTTTATA TGATGATTTG GAAGGACAAG TCGCCGAGCA GACACGCAGT

751 CTCGAAAAAC AAAATCAAAA CCTGACCCTG CTGTACCAAA CTACACGGGA

801 CCTGCACCAA TCCTACATAC CGCAACAGGC TGCAGAACAT TTTCTAAACC

851 GTATCCTGCC CGCCGTAGGA GCAGATTCCG GCAGAGTTTG TTTGGACGGC

901 GGATCCGATG TTTATGTTTC CATTCATCAT GCGGATTGCG GCACAGCAGC

951 TTCGGATTTG GGGAAGTACC ATGAGGAAAT CTTCCCCATT GAGTACCAGA

1001 ACGAAACATT GGGCAGGCTG TTGCTCAGCT TTCCAAACGG CATTTCTCTT

1051 GATGAAGACG ACCGCATCCT GCTTCAAACA CTAGGCAGGC AATTGGGCGT

1101 ATCGCTTGCC GGCGCAAAAC AGGAGGAAGA AAAACGCCTG CTTGCAGTAT

1151 TGCAGGAACG CAACCTGATT GCGCAAGGAT TACATGACAG CATCGCACAA

1201 GCATTAACGT TCCTAAACCT ACAGGTACAG ATGCTGGAAA CCGCCTTTGC

1251 CGAAAACAAA CGGGAGGAAG CCGCAGAAAA CATCAGCTTT ATCAAAAACAG

1301 GCGTGCAGGA ATGTTATGAA GATGTCCGCG AACTGCTGCT CAACTTCCGT
```

-continued

```
1351 ACCAAAATCA GCAATAAAGA ATTTCCCGAA GCCGTTGCCG ACCTATTCGC

1401 CCGCTTTACG CAACAAACCG GGATAACGGT CGAAACCGCC TGGGAAAACG

1451 GTTCGTTCCT GCCGCCTCAG GAAGCGCAGC TCCAAATGAT TTTTATCCTG

1501 CAGGAAAGCC TGTCCAACAT CCGCAAACAC GCCCGCGCCA CCCATGTAAA

1551 ATTCACCCTT TCCGAACACG GCGGACGCTT TACCATGACC ATCCAAGACA

1601 ACGGACAAGG TTTCGACACG GAGAAAATAG GAGAACCCAC GGGCAGCCAT

1651 GTCGGACTGC ACATCATGCA GGAGCGTGCC AAACGCATCC ATGCCGTTTT

1701 AGAAATCCGT TCCCAAGCTC AACAGGGAAC CACCGTCTCA TTGACGGTTG

1751 CATCTGAAGA AAGCTTGAAA TGA
```

This corresponds to the amino acid sequence <SEQ ID 1656; ORF 561>:

```
m561.pep
   1 MILPARFSDG ISLSLRLKLL TGLWVGLAAL SVVLTLLLSL RLENAASVIE

51 EAGNLRMQAY RLAYMAGEGS PRAQIDNQVA EFEKSLKRIA QSDAIHPLIP

101 SDTPLAYDLI QSMLIIDWQA HILPPLQSYR RPTQVDLYRF AGNIELFLQA

151 LENANEKNTW WLRRFQWAIM LMTLVSSVLM LFWHQIWVIR PLQALREGAE

201 RIGRRCFDIP VPEGGTPEFK QVGRCFNQMG GRLKILYDDL EGQVAEQTRS

251 LEKQNQNLTL LYQTTRDLHQ SYIPQQAAEH FLNRILPAVG ADSGRVCLDG

301 GSDVYVSIHH ADCGTAASDL GKYHEEIFPI EYQNETLGRL LLSFPNGISL

351 DEDDRILLQT LGRQLGVSLA GAKQEEEKRL LAVLQERNLI AQGLHDSIAQ

401 ALTFLNLQVQ MLETAFAENK REEAAENISF IKTGVQECYE DVRELLLNFR

451 TKISNKEFPE AVADLFARFT QQTGITVETA WENGSFLPPQ EAQLQMIFIL

501 QESLSNIRKH ARATHVKFTL SEHGGRFTMT IQDNGQGFDT EKIGEPTGSH

551 VGLHIMQERA KRIHAVLEIR SQAQQGTTVS LTVASEESLK *
```

Computer analysis of this amino acid sequence gave the following results:
Homology with a Predicted ORF from *N. gonorrhoeae*

```
    m561/g561  89.7% identity in 223 aa overlap 10         20         30         40         50         60
       m561.pep  MILPARFSDGISLSLRLKLLTGLWVGLAALSVVLTLLLSLRLENAASVIEEAGNLRMQAY
                 ||||:||||||  |||||||||||||||||||||||||||:||||||||||||||:||||
       g561      MILPTRFSDGIPLSLRLKLLTGLWVGLAALSVVLTLLLSFRLENAASVIEEAGNLKMQAY
                    10         20         30         40         50         60

70         80         90        100        110        120
       m561.pep  RLAYMAGEGSPRAQIDNQVAEFEKSLKRIAQSDAIHPLIPSDTPLAYDLIQSMLIIDWQA
                 ||||||||||||||||||||:|||||||||:|||||||||||||:|||||||||||||||
       g561      RLAYMAGEGSPRAQIDNQIAEFEKSLKRISQSDAIHPLIPSDNPLAYDLIQSMLIIDWQA
                    70         80         90        100        110        120

130        140        150        160        170        180
       m561.pep  HILPPLQSYRRPTQVDLYRFAGNIELFLQALENANEKNTWWLRRFQWAIMLMTLVSSVLM
                 :||||||:|||||::||||||||||||||||||||:||||||||||||:|||||||||||
       g561      NILPPLQAYRRPTQIELYRFAGNIELFLQALENAGEKNTWWLRRFQWVIMLMTLVSSVLM
                   130        140        150        160        170        180

190        200        210        220        230        240
       m561.pep  LFWHQIWVIRPLQALREGAERIGRRCFDIPVPEGGTPEFKQVGRCFNQMGGRLKILYDDL
                 |||||||||||||||||||||:| ||||||     |:  :: |
       g561      LFWHQIWVIRPLQALREGAERIGQRHFDIPVPEDVRPNSNRGGVSTKWRSGX
                   190        200        210        220        230
```

```
                250       260        270        280        290        300
m561.pep   EGQVAEQTRSLEKQNQNLTLLYQTTRDLHQSYIPQQAAEHFLNRILPAVGADSGRVCLDG
```

The following partial DNA sequence was identified in *N. meningitidis* <SEQ ID 1657>:

```
a561.seq
   1 ATGATACTGC CAGCCCGTTT TTCAGACGGC ATCAGCCTTT CCCTGCGCCT
  51 GAAACTCCTG ACCGGACTGT GGGTCGGGTT GGCGGCATTG TCTGTCGTTT
 101 TGACACTGCT GCTCTCTTTG CGTCTGGAAA ACGCGGCCTC CGTCATCGAA
 151 GAGGCGGGCA ACTTGAGAAT GCAGGCATAC CGTCTGGCAT ACATGGCGGG
 201 TGAAGGCTCG CCCCGTGCGC AAATTGACAA TCAGGTTGCC GAATTTGAAA
 251 AAAGTTTAAA ACGCATTGCC CAAAGCGATG CCATCCATCC GCTGATTCCT
 301 TCGGACACCC CTCTTGCTTA TGATTTGATA CAATCCATGC TGATTATAGA
 351 TTGGCAGGCA CACATCCTCC CCCCGCTCCA GTCCTACCGG CGACCGACTC
 401 AGGTCGATCT CTACCGCTTT GCCGGAAACA TCGAACTGTT TTTGCAGGCA
 451 TTGGAAAATG CCAACGAAAA AAACACATGG TGGCTCAGGC GTTTTCAATG
 501 GGCAATTATG TTGATGACGC TGGTGTCGTC TGTACTGATG CTGTTTTGGC
 551 ACCAGATTTG GGTTATCCGG CCGCTGCAGG CGTTAAGGGA AGGTGCGGAA
 601 CGCATCGGAC GGAGGTGTTT CGATATTCCG GTTCCCGAAG GCGGTACGCC
 651 GGAATTCAAA CAGGTCGGGC GTTGTTTCAA TCAAATGGGC GGCAGGTTGA
 701 AAATTTTATA TGATGATTTG GAAGGACAAG TCGCCGAGCA GACACGCAGT
 751 CTCGAAAAAC AAAATCAAAA CCTGACCCTG CTGTACCAAA CTACACGGGA
 801 TCTGCACCAA TCCTACATAC CGCAACAGGC TGCAGAACAT TTTCTAAACC
 851 GTATCCTGCC CGCCGTAGGA GCAGATTCCG GCAGAGTTTG TTTGGACGGC
 901 GGATCCGATG TTTATGTTTC CATTCATCAT GCGGATTGCG GCACAGCAGC
 951 TTCGGATTTG GGGAAGTACC ATGAGGAAAT CTTCCCCATT GAGTACCAGA
1001 ACGAAACATT GGGCAGGCTG TTGCTCAGCT TTCCAAACGG CATTTCTCTT
1051 GATGAAGACG ACCGCATCCT GCTTCAAACA CTAGGCAGGC AATTGGGCGT
1101 ATCGCTTGCC GGCGCAAAAC AGGAGGAAGA AAAACGCCTG CTTGCAGTAT
1151 TGCAGGAACG CAACCTGATT GCGCAAGGAT TACATGACAG CATCGCACAA
1201 GCATTAACGT TCCTAAACCT ACAGGTACAG ATGCTGGAAA CCGCCTTTGC
1251 CGAAAACAAA CGGGAGGAAG CCGCAGAAAA CATCGGCTTC ATCAAAACAG
1301 GCGTGCAGGA ATGTTATGAA GATGTCCGCG AACTGCTGCT CAACTTCCGT
1351 ACCAAAATCA GTAATAAAGA ATTTCCCGAA GCCGTTGCCG ACCTATTCTC
1401 GCGCTTTACG CAACAGACCG GCACGACTGT CGAAACCGCT TGGGAAAACG
1451 GCACGCACCT GCCTACACAG GACGAGCAGC TCCAAATGAT TTTCATCCTG
1501 CAAGAAAGCT TGTCCAACAT CCGAAAACAT GCCCACGCCA CCCATATCAA
1551 ATTCAGACTG CTCAAACAGG ATGGAAGTTT TACAATGACC ATTCAAGACA
1601 ACGGACAGGG TTTTGACACG GAAACATTG GAGAACCATC GGGCAGCCAT
1651 GTCGGACTGC ATATCATGCA GGAGCGTGCC AAACGCATCC ATGCCGTTTT
```

-continued
```
1701 AGAAATCCGT TCCCAAGCTC AACAGGGAAC CACCGTCTCA TTGACGGTTG

1751 CATCTGAAGA AAGCTTGAAA TGA
```

This corresponds to the amino acid sequence <SEQ ID 1658; ORF 561.a>:

```
a561.pep

1   MILPARFSDG ISLSLRLKLL TGLWVGLAAL SVVLTLLLSL RLENAASVIE

51   EAGNLRMQAY RLAYMAGEGS PRAQIDNQVA EFEKSLKRIA QSDAIHPLIP

101   SDTPLAYDLI QSMLIIDWQA HILPPLQSYR RPTQVDLYRF AGNIELFLQA

151   LENANEKNTW WLRRFQWAIM LMTLVSSVLM LFWHQIWVIR PLQALREGAE

201   RIGRRCFDIP VPEGGTPEFK QVGRCFNQMG GRLKILYDDL EGQVAEQTRS

251   LEKQNQNLTL LYQTTRDLHQ SYIPQQAAEH FLNRILPAVG ADSGRVCLDG

301   GSDVYVSIHH ADCGTAASDL GKYHEEIFPI EYQNETLGRL LLSFPNGISL

351   DEDDRILLQT LGRQLGVSLA GAKQEEEKRL LAVLQERNLI AQGLHDSIAQ

401   ALTFLNLQVQ MLETAFAENK REEAAENIGF IKTGVQECYE DVRELLLNFR

451   TKISNKEFPE AVADLFSRFT QQTGTTVETA WENGTHLPTQ DEQLQMIFIL

501   QESLSNIRKH AHATHIKFRL LKQDGSFTMT IQDNGQGFDT ENIGEPSGSH

551   VGLHIMQERA KRIHAVLEIR SQAQQGTTVS LTVASEESLK * m561/a561  96.9% identity in 590 aa overlap 10         20         30         40         50         60
m561.pep   MILPARFSDGISLSLRLKLLTGLWVGLAALSVVLTLLLSRLENAASVIEEAGNLRMQAY
           ||||||||||||||||||||||||||||||||||||||||||||||||||||||||||
a561       MILPARFSDGISLSLRLKLLTGLWVGLAALSVVLTLLLSLRLENAASVIEEAGNLRMQAY
                   10         20         30         40         50         60

70         80         90        100        110        120
m561.pep   RLAYMAGEGSPRAQIDNQVAEFEKSLKRIAQSDAIHPLIPSDTPLAYDLIQSMLIIDWQA
           ||||||||||||||||||||||||||||||||||||||||||||||||||||||||||
a561       RLAYMAGEGSPRAQIDNQVAEFEKSLKRIAQSDAIHPLIPSDTPLAYDLIQSMLIIDWQA
                   70         80         90        100        110        120

130        140        150        160        170        180
m561.pep   HILPPLQSYRRPTQVDLYRFAGNIELFLQALENANEKNTWWLRRFQWAIMLMTLVSSVLM
           ||||||||||||||||||||||||||||||||||||||||||||||||||||||||||
a561       HILPPLQSYRRPTQVDLYRFAGNIELFLQALENANEKNTWWLRRFQWAIMLMTLVSSVLM
                  130        140        150        160        170        180

190        200        210        220        230        240
m561.pep   LFWHQIWVIRPLQALREGAERIGRRCFDIPVPEGGTPEFKQVGRCFNQMGGRLKILYDDL
           ||||||||||||||||||||||||||||||||||||||||||||||||||||||||||
a561       LFWHQIWVIRPLQALREGAERIGRRCFDIPVPEGGTPEFKQVGRCFNQMGGRLKILYDDL
                  190        200        210        220        230        240

250        260        270        280        290        300
m561.pep   EGQVAEQTRSLEKQNQNLTLLYQTTRDLHQSYIPQQAAEHFLNRILPAVGADSGRVCLDG
           ||||||||||||||||||||||||||||||||||||||||||||||||||||||||||
a561       EGQVAEQTRSLEKQNQNLTLLYQTTRDLHQSYIPQQAAEHFLNRILPAVGADSGRVCLDG
                  250        260        270        280        290        300

310        320        330        340        350        360
m561.pep   GSDVYVSIHHADCGTAASDLGKYHEEIFPIEYQNETLGRLLLSFPNGISLDEDDRILLQT
           ||||||||||||||||||||||||||||||||||||||||||||||||||||||||||
a561       GSDVYVSIHHADCGTAASDLGKYHEEIFPIEYQNETLGRLLLSFPNGISLDEDDRILLQT
                  310        320        330        340        350        360

370        380        390        400        410        420
m561.pep   LGRQLGVSLAGAKQEEEKRLLAVLQERNLIAQGLHDSIAQALTFLNLQVQMLETAFAENK
           ||||||||||||||||||||||||||||||||||||||||||||||||||||||||||
a561       LGRQLGVSLAGAKQEEEKRLLAVLQERNLIAQGLHDSIAQALTFLNLQVQMLETAFAENK
                  370        380        390        400        410        420
```

```
              430        440        450        460        470        480
m561.pep  REEAAENISFIKTGVQECYEDVRELLLNFRTKISNKEFPEAVADLFARFTQQTGITVETA
          |||||||:|||||||||||||||||||||||||||||||||||:|||||||  |||||
a561      REEAAENIGFIKTGVQECYEDVRELLLNFRTKISNKEFPEAVADLFSRFTQQTGTTVETA
              430        440        450        460        470        480

490        500        510        520        530        540
m561.pep  WENGSFLPPQEAQLQMIFILQESLSNIRKHARATHVKFTLSEHGGRFTMTIQDNGQGFDT
          ||||: || |: ||||||||||||||||||||:|||:||  :: | ||||||||||||
a561      WENGTHLPTQDEQLQMIFILQESLSNIRKHAHATHIKFRLLKQDGSFTMTIQDNGQGFDT
              490        500        510        520        530        540

550        560        570        580        590
m561.pep  EKIGEPTGSHVGLHIMQERAKRIHAVLEIRSQAQQGTTVSLTVASEESLKX
          |:|||:|||||||||||||||||||||||||||||||||||||||||||||
a561      ENIGEPSGSHVGLHIMQERAKRIHAVLEIRSQAQQGTTVSLTVASEESLKX
              550        560        570        580        590
```

The following partial DNA sequence was identified in *N. gonorrhoeae* <SEQ ID 1659>:

```
g562.seq..
    1 atggcaagcc cgtcgagtct gcctttcaat tcgggcaaga ccaaaccgac 51 ggcttttgcc gcgccggttt tggtcggaat catgttttcc acgccgctgc 101 gggcgcggcg caggtctttg tggcgcacgt cggtaacggt ttggtcgttg 151 gtcagtgcgt ggatggtggt cattgcgcct ttgacgatgc cgacgctttc 201 gctcaacact ttggcaaccg gcgagaggca gttggtggtg caggaagcgt 251 tggaaacgac ggtcatgtcg gcggtcagga cgctgtcgtt cacgccgtac 301 acgacggttg catcgacatc gtcgccgccc ggtgcggaaa tgaggacttt 351 tttcgcgccg ctttcgaggt ggattttggc tttttctttg ctggtgaacg 401 cgccggtgca ttccatgacc aaatcgacac cgagttcttt ccacggcagt 451 tcggcagggt gcgggtcga aagaagggg attttgtcgc cgttgacgat 501 gaggttgccg ccgtcgtggg atacgtcggc ttcaaagcgt ccgtgtacgg 551 tgtcgaattt ggtcagatgg gcgttggttt caaggctgcc gctggcgttg 601 acggcgacga tttggagttg gtcttga
```

This corresponds to the amino acid sequence <SEQ ID 1660; ORF 562.ng>:

```
g562.pep
    1 MASPSSLPFN SGKTKPTAFA APVLVGIMFS TPLRARRRSL WRTSVTVWSL

51 VSAWMVVIAP LTMPTLSLNT LATGERQLVV QEALETTVMS AVRTLSFTPY

101 TTVASTSSPP GAEMRTFFAP LSRWILAFSL LVNAPVHSMT KSTPSSFHGS

151 SAGLRVEKKG ILSPLTMRLP PSWDTSASKR PCTVSNLVRW ALVSRLPLAL

201 TATIWSWS*
```

The following partial DNA sequence was identified in *N. meningitidis* <SEQ ID 1661>:

```
m562.seq
    1 ATGGCAAGCC CGTCGAGCCT GCCTTTCAAT TCGGGCAGTA CCAAACCGAC

51 GGCTTTTGCC GCGCCGGTTT TGGTCGGAAT CATGTTTTCC ACGCCGCTGC

101 GGGCGCGGCG CAGGTCTTTG TGGCGCACGT CGGTAACGGT TTGGTCGTTG
```

```
151 GTCAGCGCGT GGATGGTGGT CATCGCGCCT TTGACGATGC CGACGCTTTC

201 GCTCAACACT TTGGCAACCG GCGAGAGGCA GTTGGTGGTG CAGGAAGCGT

251 TGGAAACGAC GGTCATGTCG GCGGTCAGGA CGCTGTCGTT CACGCCGTAC

301 ACGACGGTTG CATCGACATC GTCGCCGCCC GGTGCGGAAA TGAGGACTTT

351 TTTCGCGCCG CTTTCGAGGT GGATTTTGGC TTTTTCTTTG CTGGTGAACG

401 CGCCGGTGCA TTCCATGACC AAATCGACAC CGAGTTCTTT CCACGGCAGT

451 TCGGCAGGGT TGCGGGTCGA GAAGAAGGGG ATTTTGTCGC CGTTGACGAT

501 GAGGTTGCCG CCGTCGTGGG ATACGTCGGC TTCAAAGCGT CCGTGCACGG

551 TGTCGAATTT GGTCAGATGG GCGTTGGTTT CAAGGCTGCC GCTGGCGTTG

601 ACGGCGACGA GTTGGAGTTG GTCTTGA
```

This corresponds to the amino acid sequence <SEQ ID 1662; ORF 562>:

```
m562.pep
  1 MASPSSLPFN SGSTKPTAFA APVLVGIMFS TPLRARRRSL WRTSVTVWSL

51 VSAWMVVIAP LTMPTLSLNT LATGERQLVV QEALETTVMS AVRTLSFTPY

101 TTVASTSSPP GAEMRTFFAP LSRWILAFSL LVNAPVHSMT KSTPSSFHGS

151 SAGLRVEKKG ILSPLTMRLP PSWDTSASKR PCTVSNLVRW ALVSRLPLAL

201 TATSWSWS*
```

Computer analysis of this amino acid sequence gave the following results:
Homology with a Predicted ORF from *N. gonorrhoeae*

```
    m562/g562  99.0% identity in 208 aa overlap 10         20         30         40         50         60
   m562.pep  MASPSSLPFNSGSTKPTAFAAPVLVGIMFSTPLRARRRSLWRTSVTVWSLVSAWMVVIAP
             ||||||||||||:||||||||||||||||||||||||||||||||||||||||||||||
      g562   MASPSSLPFNSGKTKPTAFAAPVLVGIMFSTPLRARRRSLWRTSVTVWSLVSAWMVVIAP
                 10         20         30         40         50         60

70         80         90        100        110        120
   m562.pep  LTMPTLSLNTLATGERQLVVQEALETTVMSAVRTLSFTPYTTVASTSSPPGAEMRTFFAP
             ||||||||||||||||||||||||||||||||||||||||||||||||||||||||||||
      g562   LTMPTLSLNTLATGERQLVVQEALETTVMSAVRTLSFTPYTTVASTSSPPGAEMRTFFAP
                 70         80         90        100        110        120

130        140        150        160        170        180
   m562.pep  LSRWILAFSLLVNAPVHSMTKSTPSSFHGSSAGLRVEKKGILSPLTMRLPPSWDTSASKR
             ||||||||||||||||||||||||||||||||||||||||||||||||||||||||||||
      g562   LSRWILAFSLLVNAPVHSMTKSTPSSFHGSSAGLRVEKKGILSPLTMRLPPSWDTSASKR
                130        140        150        160        170        180

190        200        210        220        230        240
   m562.pep  PCTVSNLVRWALVSRLPLALTATSWSWSX
             ||||||||||||||||||||||||| ||||
      g562   PCTVSNLVRWALVSRLPLALTATIWSWSX
```

The following partial DNA sequence was identified in *N. meningitidis* <SEQ ID 1663>:

```
a562.seq
  1 ATGGCAAGCC CGTCGAGTTT GTCTTTCAAT TCGGGCAGTA CCAAACCGAC

51 GGCTTTTGCC GCGCCAGTTT TGGTCGGAAT CATGTTTTCC ACGCCGCTGC

101 GGGCGCGGCG CAGGTCTTTG TGGCGCACGT CGGTAACGGT TTGGTCGTTG
```

-continued

```
151 GTCAGCGCGT GGATGGTGGT CATCGCGCCT TTGACGATGC CGACGCTTTC

201 GCTCAACACT TTGGCAACCG GCGAGAGGCA GTTGGTGGTG CAGGAAGCGT

251 TGGAAACGAC GGTCATGTCG GCGGTCAGGA TGCTGTCGTT CACGCCGTAC

301 ACGACGGTTG CATCGACATC GTCGCCGCCC GGTGCGGAAA TGAGGACTTT

351 TTTCGCGCCG CTTTCCAGAT GAACTTTGGC TTTTTCTTTG CTGGTGAACG

401 CGCCGGTGCA TTCCATGACC AAATCGACAC CGAGTTCTTT CCACGGCAGT

451 TCGGCAGGGT TGCGGGTCNA GAAGAANGGG ATTTTGTCGC CGTTGACGAT

501 GAGGTTGCCG CCGTCGTGGG ATACGTCGGC TTCAAAGCGT CCGTGCACGG

551 TGTCGAATTT GGTGAGGTGG GCGTTGGTTT CAAGGCTGCC GCTGGCGTTG

601 ACGGCGACGA TTTGGAGTTG GTCTTGA
```

This corresponds to the amino acid sequence <SEQ ID 1664; ORF 562.a>:

```
a562.pep

1  MASPSSLSFN SGSTKPTAFA APVLVGIMFS TPLRARRRSL WRTSVTVWSL

51  VSAWMVVIAP LTMPTLSLNT LATGERQLVV QEALETTVMS AVRMLSFTPY

101  TTVASTSSPP GAEMRTFFAP LSR*TLAFSL LVNAPVHSMT KSTPSSFHGS

151  SAGLRVXKXG ILSPLTMRLP PSWDTSASKR PCTVSNLVRW ALVSRLPLAL

201  TATIWSWS* m562/a562  96.6% identity in 208 aa overlap
                    10         20         30         40         50         60
m562.pep    MASPSSLPFNSGSTKPTAFAAPVLVGIMFSTPLRARRRSLWRTSVTVWSLVSAWMVVIAP
            ||||||| ||||||||||||||||||||||||||||||||||||||||||||||||||||
a562        MASPSSLSFNSGSTKPTAFAAPVLVGIMFSTPLRARRRSLWRTSVTVWSLVSAWMVVIAP
                    10         20         30         40         50         60

70         80         90        100        110        120
m562.pep    LTMPTLSLNTLATGERQLVVQEALETTVMSAVRTLSFTPYTTVASTSSPPGAEMRTFFAP
            |||||||||||||||||||||||||||||||||| |||||||||||||||||||||||||
a562        LTMPTLSLNTLATGERQLVVQEALETTVMSAVRMLSFTPYTTVASTSSPPGAEMRTFFAP
                    70         80         90        100        110        120

130        140        150        160        170        180
m562.pep    LSRWILAFSLLVNAPVHSMTKSTPSSFHGSSAGLRVEKKGILSPLTMRLPPSWDTSASKR
            |||  |||||||||||||||||||||||||||||||| | ||||||||||||||||||||
a562        LSRXTLAFSLLVNAPVHSMTKSTPSSFHGSSAGLRVXKXGILSPLTMRLPPSWDTSASKR
                   130        140        150        160        170        180

190        200      209
m562.pep    PCTVSNLVRWALVSRLPLALTATSWSWSX
            |||||||||||||||||||||||| |||||
a562        PCTVSNLVRWALVSRLPLALTATIWSWSX
                   190        200
```

The following partial DNA sequence was identified in *N. gonorrhoeae* <SEQ ID 1665>:

```
g563.seq
     1  ATGAACAAAA CCCTCTATCG TGTGATTTTC AACCGCAAAC GCGGTGCTGT

51  GGTAGCTGTT GCCGAAACCA CCAAGCGCGA AGGTAAAAGC TGTGCCGATA

101  GTGGTTCGGG CAGCGTTTAT GTGAAATCCG TTTCTTTCAT TCCTACTCAT

151  TCCAAAGCCT TTGTTTTTC TGCATTAGGC TTTTCTTTAT GTTTGGCTTT

201  GGGTACGGTC AATATTGCTT TGCTGACGG CATTATTACT GATAAAGCTG
```

```
-continued
 251 CTCCTAAAAC CCAACAAGCC ACGATTCTGC AAACAGGTAA CGGCATACCG

301 CAAGTCAATA TTCAAACCcc tACTTCGGCa ggGGTTTCTG TTAATCAATA

351 TGCCCAGTTT GATGTGGGTA ATcgcGGGGC GATTTTAAAC AACAGTCGCA

401 GCAACACCCA AACACAGCTA GGCGGTTGGA TTCAAGGCAA TCCTTGGTTG

451 ACAAGGGGCG AAGCACGTGT GGTTGTAAAC CAAATCAACA GCAGCCATCC

501 TTCACAACTG AATGGCTATA TTGAAGTGGG TGGACGACGT GCAGAAGTCG

551 TTATTGCCAA TCCGGCAGGG ATTGCAGTCA ATGGTGGTGG TTTTATCAAT

601 GCTTCCCGTG CCACTTTGAC GACAGGCCAA CCGCAATATC AAGCAGGAGA

651 CTTTAGCGGC TTTAAGATAA GGCAAGGCAA TGCTGTAATC GCCGGACACG

701 GTTTGGATGC CCGTGATACC GATTTCACAC GTATTCTTTT GTATGCCAAC

751 AAAATCACCT TGATCAGTAC GGCCGAACAA GCAGGCATTC GTAATCAAGG

801 GCAGTTGTTT GCTTCTTCCG GTAATGTGGC GATTGATGCA AATGGCCGTT

851 TGGTCAATAG TGGCACGATG GCTGCCGCCA ATGTGCAAGA TATGAATAAT

901 ACAGCGGAAC ACAAAGTCAA TATCCGCAGT CAAGCCTTTG AAAACAGCGG

951 TACGGCGGTA TCGCAACAAG GCACTCAAAT TCACAGTCAA TCGATTCAAA

1001 ACACTGGCAA ATTATTGTCG GCAGGAACAG AGGATTTAGC CGTTTCAGGC

1051 AGCCTGAACA ATCAAAATGG CGAAATAGCG ACCAATCAAC AACTGATTAT

1101 TCACGATGGT CAGCAATCTA CCGTTGTCAT TGATAATACG AATGGCACGA

1151 TACAATCAGG CCGTGATGTT GCCATTCAGG CAAATCGTT ATCCAACAAC

1201 GGCACACTTG CCGCTGATAA TAAACTGGAT ATTGCGTTAC AAGATGATTT

1251 TTATGTAGAA CGCAAGATCG TGGCGGGCAA TGAATTGTCG CTCAGTACAC

1301 GAGGCAGCCT GAAAAATTCA CATACCTTGC AAGCAGGAAA ACGCATTCGG

1351 ATTAAAGCAA ATAACCTTGA TAATGCAGTA CAAGGCAACA TTCAATCCGG

1401 CGGTACGACA GACATTGGCA CGCAGCACAA TTTAACCAAT AGAGGCTTGA

1451 TTGACGGACA ACAAACCAAA ATCCAAGCCG GGCAAATGAA TAATATCGGT

1501 ACAGGTCGGA TTTATGGCGA CAATATCGCT ATTGCGGCTA CCCGCTTAGA

1551 CAATCAAGAT GAAAACGGTA CAGGTGCCGC CATTGCGGCA CGCGAAAACC

1601 TGAATTTAGG CATTGAACAA TTAAATAACC GTGAAAACAG TCTGATTTAC

1651 AGCGGTAACG ATATGGCGGT TGGCGGCGCA TTAGATACCA ATGACCAAGC

1701 CACAGGCAAA GCCCAAAGGA TACACAATGC CGGCGCAATC ATTGAAGCTG

1751 CAGGCAAAAT GCGTTTAGGT GTAGAAAAGC TGCACAATAC CAATGAGCAT

1801 TTGAAAACGC AGTTGGTAGA AACAGGGCGC GAGCGTATTG TTGATTACGA

1851 AGCATTTGGA CGACACGAAT TATTGCGAGA AGGCACGCAA CATGAATTAG

1901 GCTGGTTTGT CTACAACAAT GAATCAGACC ACTTACGCAC CCCTGATGGA

1951 GTGGCGCATG AAAATTGGCA TAAATACGAT TATGAAAAAG TAACGCAAGA

2001 AACTCAAGTA ACCGGAACTG CGCCTGCTAA ATCATTGCA GGTAGCGATT

2051 TGATTATTGA TAGCAAAGCA GTCTTCAACA GCGACAGCCG AATCATTGCC

2101 GGCGGCCAAT TGCTTGTGCA AACAGAAAAA GACGGTTTGC ATAACGAGCA

2151 AACCTTTGGC GAGAAGAAAG TCTTCAGCGA AAATGGTAAG TTGCACAACT

2201 ACTGGCGTGC GCGTCGTAAA GGACATGATG AAACAGGGCA TCGTGAACAA

2251 AATTATACTT TGCCGGAGGA AATCACACGC GACATTTCAC TGGGTTCATT
```

-continued

```
2301 TGCCTATGAA TCGCATAGCA AAGCATTAAG CCGTCATGCG CCCAGCCAAG
2351 GCACTGAGTT GCCACAAAGT AACCGGGATA ATATCCGTAC TGCGAAAAGC
2401 AACGGTATTT CGCTACCCTA TACGCCCAAT TCTTTTACCC CATTACCCGG
2451 CAGCAGCTTA TACATTATCA ATCCTGCCAA TAAAGGCTAT CTTGTTGAAA
2501 CCGATCCACG CTTTGCCAAC TACCGTCAAT GGTTGGGTAG TGACTATATG
2551 CTGGGCAGCC TCAAACTAGA CCCAAACAAT TTACATAAAC GTTTGGGTGA
2601 TGGTTATTAC GAGCAACGTT TAATCAATGA ACAAATCGCA GAGCTGACAG
2651 GGCATCGTCG TTTAGACGGT TATCAAAACG ACGAAGAACA ATTTAAAGCC
2701 TTAATGGATA ATGGCGCGAC TGCGGCACGT TCGATGAATC TCAGCGTTGG
2751 CATTGCATTA AGTGCCGAGC AAGCAGCGCA ACTGACCAGC GATATTGTTT
2801 GGTTGGTACA AAAGAAGTT AAACTTCCTG ATGGCGGCAC ACAAACCGTA
2851 TTGATGCCAC AGGTTTATGT ACGCGTTAAA AATGGCGGCA TAGACGGTAA
2901 AGGTGCATTG TTGTCAGGCA GCAATACACA AATCAATGTT TCAGGCAGCC
2951 TGAAAAACTC AGGCACGATT GCAGGGCGCA ATGCGCTTAT TATCAATACC
3001 GATACGCTAG ACAATATCGG TGGGCGTATT CATGCGCAAA AATCAGCGGT
3051 TACGGCCACA CAAGACATCA ATAATATTGG CGGCATTCTT TCTGCCGAAC
3101 AGACATTATT GCTCAATGCG GGTAACAACA TCAACAACCA AAGCACGGCC
3151 AAGAGCAGTC AAAATGCACA AGGTAGCAGC ACCTACCTAG ACCGAATGGC
3201 AGGTATTTAT ATCACAGGCA AAGAAAAAGG TGTTTTAGCA GCGCAGGCAG
3251 GCAAAGACAT CAACATCATT GCCGGTCAAA TCAGCAATCA ATCAGATCAA
3301 GGGCAAACCC GGCTGCAGGC AGGACGCGAC ATTAACCTGG ATACGGTACA
3351 AACCGGCAAA TATCAAGAAA TCCATTTTGA TGCCGATAAC CATACCATCC
3401 GAGGTTCAAC GAACGAAGTC GGCAGCAGCA TTCAAACAAA AGGCGATGTT
3451 ACCCtatTGT CAGGGAATAA TCTCAATGCC AAAGCTGCCG AAGTCGGCAG
3501 CGCAAAAGGC ACACTTGCCG TGTATGCTAA AAATGACATT ACTATCAGCT
3551 CAGGCATCCA TGCCGGCCAA GTTGATGATG CGTCCAAACA TACAGGCAGA
3601 AGCGGCGGCG GTAATAAATT AGTCATTACC GATAAAGCCC AAAGTCATCA
3651 CGAAACTGCT CAAAGCAGCA CCTTTGAAGG CAAGCAAGTT GTATTGCAGG
3701 CAGGAAACGA TGCCAACATC CTTGGCAGTA ATGTTATTTC CGATAATGGC
3751 ACCCGGATTC AAGCAGGCAA TCATGTTCGC ATTGGTACAA CCCAAACTCA
3801 AAGCCAAAGC GAAACCTATC ATCAAACCCA AAAATCAGGA TTGATGAGTG
3851 CAGGTATCGG CTTCACTATT GGCAGCAAGA CAAACACACA AGAAAACCAA
3901 TCCCAAAGCA ACGAACATAC AGGCAGTACC GTAGGCAGCC TGAAAGGCGA
3951 TACCACCATT GTTGCAAGCA AACACTACGA ACAAACCGGC AGCAACGTTT
4001 CCAGCCCTGA GGGCAACAAC CTTATCAGCA CGCAAAGTAT GGATATTGGC
4051 GCAGCACAAA ACCAATTAAA CAGCAAAACC ACCCAAACCT ACGAACAAAA
4101 AGGCTTAACG GTGGGCATTC AGTTCGCCCG TTACCGATTT GGCACAACAA
4151 GCGATTGCCG TAGCACACAA AGCAGCAAAC AAGTCGGACA AAGCAAAAAC
4201 GACCGCGTTA ATGCCATGGC GGCTGCCAAT GCAGGTTGGC AGGCCTATCA
4251 AACAGGCAAA GGCGCACAAA ACTTAGCCAA TGGTACAACC AATGCCAAAC
```

```
4301 AAGTCAGCAT CTCCATAACC TACGGCGAAC AGCAAAACCG ACAAACCACC

4351 CAAGTTCAAG CCAATCAAGC CCAAGCGAGT CAAATTCAAG CAGGCGGCAA

4401 AACTACCCTT TATTGCCGAA GGTGCGGCGA ACAATCCAAT ATCAACATCA

4451 CAGGCTCAGG TGTTTCAGGC AGAGCAGGAA CCGGCCTGAT TGCCGATAAG

4501 CAAATCCATC TGCAATCAGC CGAGCAAAGC AATACCGAAC GCAGCCAAAA

4551 CAAATCAGCA GGCTGGAACG CAGGTGCTGC CGTATCATTC GGACAAGGAG

4601 GCTGGTCATT AGGCGTTGCC GCAGGCGGCA ATGTCGGCAA AGGCTACGGC

4651 TATGGCGATA GCGTAACCCA CCGCCATAGC CATATTGGCG ACAAAGGCAG

4701 CCAAACCCTT ATCCAAAGTG GTGGCGATAC CATCATCAAA GGCGCGCAAG

4751 TACGCGGCAA AGGCGTACAA GTCAATGCCA AAAACCTAAG CATTCAAAGT

4801 GTACAAGATA GAGAAACTTA TCAAAGCAAA CAACAAAACG CCGGTGCACA

4851 AGTTACCGTA GGTTATGGCT TCAGTGCCAG TGGCGATTAC AGCCAAAGCA

4901 AAATCCGAGC CGACCATGCT TCGGTAACCG AGCAAAGCGG TATTTATGCC

4951 GGAGAAGACG GCTATCAAAT CAAGGTCGGA AACCATACAG GCCTCAAAGG

5001 CGGCATCATC ACCAGCAGCC AAAGCGCAAA AGACAAGGGT AAAAACCGAT

5051 TCAGCACAGG CACACTCGCC GGCAGTGATA TTCAAAATTA CAGCCAATAC

5101 GAAGGAAAAA GTTTTGGATT GGGTGCCAGC GTTGCCGTAA GCGGCAAAAC

5151 ACTGGGACAG GGCGCAAAAA ATAAACCTCA AGACAAACAC CTGACAAGCA

5201 TAGCCGATAA AAACGGCGCA AGTTCATCAG TAGGGTACGG CAGCGACAGC

5251 GACAGTCAAA GCAGCATCAC AAAAAGCGGC ATCAATACCC CAAAAACAT

5301 TCAAATCACA GACGAAGCCG CACAAATCAG GCTGACAGGC AAAATAGCGG

5351 CACAAACCAA AGCCGATATT GATACAAACG TAACCACAGA CACCGCCGAA

5401 CGACATTCGG GCAGCCTGAA AAACATATTT GACAAAGATA GAGTGCAAAG

5451 TGAACTGGAT TTACAAAgaA CCGTCAGCCA AGATTTTAGT AAAAATGTTC

5501 AACAAACCAA TACCGAGATT AACCAACATT TAGACAAACT CAAAGCAGAC

5551 AAAGAAGCAG CCGAAACAGC AGCAGCCGAG GCATTAGCCA ATGGCGATAT

5601 GGAAACTGCC AAACGCAAAG CCCATGAAGC TCAAGATGCG GCAGCAAAAG

5651 CAGATAATTG CAACAAGGC AAAGTCATTC TCAACATGTT AGCCTCAGGT

5701 TTAGCTGAGC CGACCCAAAG CGGAGCgggc ATCGCTGCGG CTACCGCATC

5751 GCCagaCGTA TCGTATGCGA TTGGACAGCA CTTTAAagaT TTAGCCGGTC

5801 AAAACGCGAA TGGCAAACTA ACCGCCAGTC AagaAACCGC TCACGTTCTT

5851 GCCCACGCGG TATTAGGAGC AGCGGTTGCC GCAGCATGAG GCAACAATGC

5901 CCCGGCAGGA GCATTGGGTG CGGGCGGGTc ggAagcggCC GCCCCAATCA

5951 TCGGCAAATG GCTGTACGGC AAAGGAGAcg gcggcagccT GAATgcggag 6001 gaaaAAGaga CCGTTTCGGC GATTACAAGG ATGCTGggta cGgctGCCGG 6051 AGCAGCTGAG GGAAACTCGT CCGCCGATGC TGTGTGGGGT TGTTTTcaaa 6101 cggctTCaga TTTCGCTTCC TCTTTTTCAT ATCCTATAAA CATGTGA
```

This corresponds to the amino acid sequence <SEQ ID 1666; ORF 563.ng>:

```
g563.pep..
   1 MNKTLYRVIF NRKRGAVVAV AETTKREGKS CADSGSGSVY VKSVSFIPTH

51 SKAFCFSALG FSLCLALGTV NIAFADGIIT DKAAPKTQQA TILQTGNGIP

101 QVNIQTPTSA GVSVNQYAQF DVGNRGAILN NSRSNTQTQL GGWIQGNPWL

151 TRGEARVVVN QINSSHPSQL NGYIEVGGRR AEVVIANPAG IAVNGGGFIN

201 ASRATLTTGQ PQYQAGDFSG FKIRQGNAVI AGHGLDARDT DFTRILLYAN

251 KITLISTAEQ AGIRNQGQLF ASSGNVAIDA NGRLVNSGTM AAANVQDMNN

301 TAEHKVNIRS QAFENSGTAV SQQGTQIHSQ SIQNTGKLLS AGTEDLAVSG

351 SLNNQNGEIA TNQQLIIHDG QQSTVVIDNT NGTIQSGRDV AIQAKSLSNN

401 GTLAADNKLD IALQDDFYVE RKIVAGNELS LSTRGSLKNS HTLQAGKRIR

451 IKANNLDNAV QGNIQSGGTT DIGTQHNLTN RGLIDGQQTK IQAGQMNNIG

501 TGRIYGDNIA IAATRLDNQD ENGTGAAIAA RENLNLGIEQ LNNRENSLIY

551 SGNDMAVGGA LDTNDQATGK AQRIHNAGAI IEAAGKMRLG VEKLHNTNEH

601 LKTQLVETGR ERIVDYEAFG RHELLREGTQ HELGWFVYNN ESDHLRTPDG

651 VAHENWHKYD YEKVTQETQV TGTAPAKIIA GSDLIIDSKA VFNSDSRIIA

701 GGQLLVQTEK DGLHNEQTFG EKKVFSENGK LHNYWRARRK GHDETGHREQ

751 NYTLPEEITR DISLGSFAYE SHSKALSRHA PSQGTELPQS NRDNIRTAKS

801 NGISLPYTPN SFTPLPGSSL YIINPANKGY LVETDPRFAN YRQWLGSDYM

851 LGSLKLDPNN LHKRLGDGYY EQRLINEQIA ELTGHRRLDG YQNDEEQFKA

901 LMDNGATAAR SMNLSVGIAL SAEQAAQLTS DIVWLVQKEV KLPDGGTQTV

951 LMPQVYVRVK NGGIDGKGAL LSGSNTQINV SGSLKNSGTI AGRNALIINT

1001 DTLDNIGGRI HAQKSAVTAT QDINNIGGIL SAEQTLLLNA GNNINNQSTA

1051 KSSQNAQGSS TYLDRMAGIY ITGKEKGVLA AQAGKDINII AGQISNQSDQ

1101 GQTRLQAGRD INLDTVQTGK YQEIHFDADN HTIRGSTNEV GSSIQTKGDV

1151 TLLSGNNLNA KAAEVGSAKG TLAVYAKNDI TISSGIHAGQ VDDASKHTGR

1201 SGGGNKLVIT DKAQSHHETA QSSTFEGKQV VLQAGNDANI LGSNVISDNG

1251 TRIQAGNHVR IGTTQTQSQS ETYHQTQKSG LMSAGIGFTI GSKTNTQENQ

1301 SQSNEHTGST VGSLKGDTTI VASKHYEQTG SNVSSPEGNN LISTQSMDIG

1351 AAQNQLNSKT TQTYEQKGLT VGIQFARYRF GTTSDCRSTQ SSKQVGQSKN

1401 DRVNAMAAAN AGWQAYQTGK GAQNLANGTT NAKQVSISIT YGEQQNRQTT

1451 QVQANQAQAS QIQAGGKTTL YCRRCGEQSN INITGSGVSG RAGTGLIADK

1501 QIHLQSAEQS NTERSQNKSA GWNAGAAVSF GQGGWSLGVA AGGNVGKGYG

1551 YGDSVTHRHS HIGDKGSQTL IQSGGDTIIK GAQVRGKGVQ VNAKNLSIQS

1601 VQDRETYQSK QQNAGAQVTV GYGFSASGDY SQSKIRADHA SVTEQSGIYA

1651 GEDGYQIKVG NHTGLKGGII TSSQSAKDKG KNRFSTGTLA GSDIQNYSQY

1701 EGKSFGLGAS VAVSGKTLGQ GAKNKPQDKH LTSIADKNGA SSSVGYGSDS

1751 DSQSSITKSG INTPKNIQIT DEAAQIRLTG KIAAQTKADI DTNVTTDTAE

1801 RHSGSLKNIF DKDRVQSELD LQRTVSQDFS KNVQQTNTEI NQHLDKLKAD

1851 KEAAETAAAE ALANGDMETA KRKAHEAQDA AAKADNWQQG KVILNMLASG

1901 LAEPTQSGAG IAAATASPDV SYAIGQHFKD LAGQNANGKL TASQETAHVL
```

-continued

```
1951 AHAVLGAAVA AAXGNNAPAG ALGAGGSEAA APIIGKWLYG KGDGGSLNAE

2001 EKETVSAITR MLGTAAGAAE GNSSADAVWG CFQTASDFAS SFSYPINM*
```

The following partial DNA sequence was identified in *N. meningitidis* <SEQ ID 1667>:

```
m563.seq..
   1 ATGAATAAAA CTCTCTATCG TGTAATTTTC AACCGCAAAC GTGGGGCTGT

51 GGTAGCCGTT GCTGAAACTA CCAAGCGCGA AGGTAAAAGC TGTGCCGATA

101 GTGATTCAGG CAGCGCTCAT GTGAAATCTG TTCCTTTTGG TACTACTCAT

151 GCACCTGTTT GTCGTTCAAA TATCTTTTCT TTTTCTTTAT TGGGCTTTTC

201 TTTATGTTTG GCTGTAGGTA CGGCCAATAT TGCTTTTGCT GATGGCATTA

251 TTGCTGATAA AGCTGCTCCT AAAACTCAAC AAGCCACGAT TCTGCAAACA

301 GGTAACGGCA TACCGCAAGT CAATATTCAA ACCCCTACTT CGGCAGGGGT

351 TTCTGTTAAT CAATACGCCC AGTTTGATGT GGGTAATCGC GGGGCGATTT

401 TAAACAACAG CCGCAGCAAC ACCCAAACAC AGCTAGGCGG TTGGATTCAA

451 GGTAATCCTT GGTTGGCAAG GGGCGAAGCA CGTGTGGTTG TAAACCAAAT

501 CAACAGCAGC CATTCTTCAC AAATGAATGG CTATATTGAA GTGGGCGGAC

551 GACGTGCAGA AGTCGTTATT GCCAATCCGG CAGGGATTGC AGTCAATGGT

601 GGTGGTTTTA TCAATGCTTC CCGTGCCACT TTGACGACAG GCCAACCGCA

651 ATATCAAGCA GGAGACCTTA GCGGCTTTAA GATAAGGCAA GGCAATGTTG

701 TAATCGCCGG ACACGGTTTG GATGCCCGTG ATACCGATTT CACACGTATT

751 CTCAGTTATC ATTCCAAAAT TGATGCACCC GTATGGGGAC AAGATGTTCG

801 TGTCGTCGCG GGACAAAACG ATGTGGTCGC AACAGGTAAT GCACATTCGC

851 CTATTCTCAA TAATGCTGCT GCCAATACGT CAAACAATAC AGCCAACAAC

901 GGCACACATA TCCCTTTATT TGCGATTGAT ACAGGCAAAT TAGGAGGTAT

951 GTATGCCAAC AAAATCACCT TGATCAGTAC GGCCGAGCAA GCAGGCATTC

1001 GTAATCAAGG GCAGTTGTTT GCTTCTTCCG GTAATGTGGC GATTGATGCA

1051 AATGGCCGTT TAGTCAATAG TGGCACGATG GCTGCCGCCA ATGCGAAAGA

1101 TACGGATAAT ACAGCGGAAC ACAAAGTCAA TATCCGCAGT CAGGGCGTTG

1151 AAAACAGCGG TACGGCGGTA TCGCAACAAG GCACTCAAAT TCACAGTCAG

1201 TCGATTCAAA ACACTGGCAC ATTATTGTCC TCAGGCGAAA TATTGATTCA

1251 CAATTCGGGC AGCCTGAAAA ATGAAACATC AGGCACCATT GAAGCCGCTC

1301 GTTTGGCTAT TGATACCGAC ACACTTAATA ATCAAGGCAA ACTCTCTCAA

1351 ACAGGTTCAC AAAAACTCCA TATTGATGCA CAAGGCAAAA TGGATAACCG

1401 TGGCCGCATG GGTTTACAAG ATACCGCACC AACCGCGTCA AATGGTTCAA

1451 GCAATCAAAC CGGCAATAGT TACAATGCAT CTTTCCATTC ATCCACTACC

1501 ACACCAACAA CGGCAACAGG TACGGGTACT GCAACCGTTT CTATATCAAA

1551 CATAACTGCG CCTACCTTTG CTGATGGGAC AATTCGCACT CATGGTGCAC

1601 TGGATAATTC AGGCAGTATT ATTGCCAATG GTCAAACAGA TGTTAGTGCG

1651 CAACAAGGTT TAAATAATGC AGGACAAATA GACATTCATC AGTTAAATGC

1701 AAAAGGTTCG GCGTTTGACA ATCACAATGG AACAATTATC AGTGATGCGG
```

-continued

```
1751 TCCACATTCA AGCCGGCAGC CTGAATAATC AAAATGGCAA CATCACAACA

1801 CGCCAACAGT TAGAGATTGA AACCGATCAA CTGGATAACG CTCATGGCAA

1851 GTTATTATCA GCAGAAATAG CGGATTTAGC CGTTTCAGGC AGCCTGAACA

1901 ATCAAAATGG CGAAATAGCG ACCAATCAAC AACTGATTAT TCACGATGGT

1951 CAGCAATCTA CCGCTGTCAT TGATAATACG AATGGCACGA TACAATCAGG

2001 CCGTGATGTT GCTATTCAGG CAAAATCGTT ATCCAACAAC GGCACACTTG

2051 CCGCTGATAA TAAACTGGAT ATTGCGTTAC AAGATGATTT TTATGTAGAA

2101 CGCAATATCG TGGCGGGCAA TGAATTGTCG CTCAGTACAC GAGGCAGCCT

2151 GAAAAATTCA CATACTTTGC AAGCAGGAAA ACGCATTCGG ATTAAAGCAA

2201 ATAACCTTGA TAATGCAGCA CAAGGCAACA TTCAATCCGG CGGTACGACA

2251 GACATTGGCA CGCAGCACAA TTTAACCAAT AGAGGCTTGA TTGACGGACA

2301 ACAAACCAAA ATCCAAGCCG GGCAAATGAA TAATATCGGT ACAGGTCGGA

2351 TTTATGGCGA CAATATCGCT ATTGCGGCTA CCCGCTTAGA CAATCAAGAT

2401 GAAAACGGTA CAGGTGCCGC CATTGCGGCA CGTGAAAACC TGAATTTAGG

2451 CATCGGACAA TTAAACAACC GTGAAAACAG TCTGATTTAC AGCGGTAACG

2501 ATATGGCGGT TGGCGGCGCA TTAGATACCA ATGGCCAAGC CACAGGCAAA

2551 GCCCAAAGGA TACACAATGC CGGCGCAACC ATTGAAGCTG CAGGCAAAAT

2601 GCGTTTAGGT GTAGAAAAGC TGCACAATAC CAATGAGCAT TTGAAAACGC

2651 AGTTGGTAGA ACAGGGCGCG GAGCATATTG TTGATTACGA AGCATTTGGA

2701 CGACACGAAT TATTGCGAGA AGGCACGCAA CATGAATTAG CTGGTCTGT

2751 CTATAACGAT GAATCAGACC ACTTACGCAC CCCTGATGGA GCGGCGCATG

2801 AAAATTGGCA TAAATACGAT TATGAAAAAG TCACCCAAAA AACCCAAGTT

2851 ACCCAAACTG CGCCAGCCAA AATCATTTCA GGTAATGATT TAACCATTGA

2901 TGGTAAAGAA GTATTTAATA CCGATAGCCA AATCATTGCT GGTGGCAATC

2951 TCATTGTACA AACAGAAAAA GACGGTTTGC ATAACAGCA AACCTTTGGC

3001 GAAAAGAAAG TATTCAGTGA AAATGGCAAA TTACACAGCT ATTGGCGTGA

3051 GAAACATAAA GGACGAGACT CAACGGGACA TAGCGAACAA AATTACACTT

3101 TGCCGGAGGA AATCACACGC AACATTTCAC TGGGTTCATT TGCCTATGAA

3151 TCGCATCGCA AAGCATTAAG CCATCATGCG CCCAGCCAAG GCACTGAGTT

3201 GCCGCAAAGC AACGGTATTT CGCTACCCTA TACGTCCAAT TCTTTTACCC

3251 CATTACCCAG CAGCAGCTTA TACATTATCA ATCCTGTCAA TAAAGGCTAT

3301 CTTGTTGAAA CCGATCCACG CTTTGCCAAC TACCGTCAAT GGTTGGGTAG

3351 TGACTATATG CTGGACAGCC TCAAACTAGA CCCAAACAAT TTACATAAAC

3401 GTTTGGGTGA TGGTTATTAC GAGCAACGTT TAATCAATGA ACAAATCGCA

3451 GAGCTGACAG GGCATCGTCG TTTAGACGGT TATCAAAACG ACGAAGAACA

3501 ATTTAAAGCC TTAATGGATA ATGGCGCGAC TGCGGCACGT TCGATGAATC

3551 TCAGCGTTGG CATTGCATTA AGTGCCGAGC AAGTAGCGCA ACTGACCAGC

3601 GATATTGTTT GGTTGGTACA AAAAGAAGTT AAGCTTCCTG ATGGCGGCAC

3651 ACAAACCGTA TTGGTGCCAC AGGTTTATGT ACGCGTTAAA AATGGCGACA

3701 TAGACGGTAA AGGTGCATTG TTGTCAGGCA GCAATACACA AATCAATGTT
```

```
-continued
3751 TCAGGCAGCC TGAAAAACTC AGGCACGATT GCAGGGCGCA ATGCGCTTAT

3801 TATCAATACC GATACGCTAG ACAATATCGG TGGGCGTATT CATGCGCAAA

3851 AATCAGCGGT TACGGCCACA CAAGACATCA ATAATATTGG CGGCATGCTT

3901 TCTGCCGAAC AGACATTATT GCTCAACGCA GGCAACAACA TCAACAGCCA

3951 AAGCACCACC GCCAGCAGTC AAAATACACA AGGCAGCAGC ACCTACCTAG

4001 ACCGAATGGC AGGTATTTAT ATCACAGGCA AGAAAAAGG TGTTTTAGCA

4051 GCGCAGGCAG GAAAAGACAT CAACATCATT GCCGGTCAAA TCAGCAATCA

4101 ATCAGAGCAA GGGCAAACCC GGCTGCAAGC AGGGCGCGAC ATTAACCTAG

4151 ATACGGTACA AACCAGCAAA CATCAAGCAA CCCATTTTGA TGCCGATAAC

4201 CATGTTATTC GCGGTTCAAC GAACGAAGTC GGCAGCAGCA TTCAAACAAA

4251 AGGCGATGTT ACCCTATTGT CAGGGAATAA CCTCAATGCC AAAGCTGCCG

4301 AAGTCAGCAG CGCAAACGGT ACACTCGCTG TGTCTGCCAA AAATGACATC

4351 AACATCAGCG CAGGCATCAA CACGACCCAT GTTGATGATG CGTCCAAACA

4401 CACAGGCAGA AGCGGTGGTG GCAATAAATT AGTCATTACC GATAAAGCCC

4451 AAAGTCATCA CGAAACCGCC CAAAGCAGCA CCTTTGAAGG CAAGCAAGTT

4501 GTATTGCAGG CAGGAAACGA TGCCAACATC CTTGGCAGCA ATGTTATTTC

4551 CGATAATGGC ACCCAGATTC AAGCAGGCAA TCATGTTCGC ATTGGTACAA

4601 CCCAAACTCA AAGCCAAAGC GAAACCTATC ATCAAACCCA GAAATCAGGA

4651 TTGATGAGTG CAGGTATCGG CTTCACTATT GGCAGCAAGA CAAACACACA

4701 AGAAAACCAA TCCCAAAGCA ACGAACATAC AGGCAGTACC GTAGGCAGCT

4751 TGAAAGGCGA TACCACCATT GTTGCAGGCA AACACTACGA ACAAATCGGC

4801 AGTACCGTTT CCAGCCCGGA AGGCAACAAT ACCATCTATG CCCAAAGCAT

4851 AGACATTCAA GCGGCACACA ACAAATTAAA CAGTAATACC ACCCAAACCT

4901 ATGAACAAAA AGGCCTAACG GTGGCATTCA GTTCGCCCGT TACCGATTTG

4951 GCACAACAAG CGATTGCCGT AGCACAAAGC AGCAAACAAG TCGGACAAAG

5001 CAAAAACGAC CGCGTTAATG CCATGGCGGC TGCCAATGCA GGCTGGCAAG

5051 CCTATCAAAC AGGTAAGAGT GCACAAAACT AGCCAATGG TACAACCAAT

5101 GCCAAACAAG TCAGCATCTC CATAACCTAC GGCGAACAGC AAAACCGACA

5151 AACCACCCAA GTTCAAGCCA ATCAAGCCCA AGCGAGTCAA ATTCAAGCAG

5201 GTGGTAAAAC CACATTAATC GCCACAGGCG CAGCAGAACA ATCCAATATC

5251 AACATCGCAG GCTCAGATGT TGCCGGCAAA GCAGGCACAA TCCTGATTGC

5301 CGATAACGAC ATCACACTCC AATCAGCCGA GCAAAGCAAT ACCGAACGCG

5351 GCCAAAACAA ATCGGCAGGC TGGAACGCAG GTGCTGCCGT ATCATTCGGA

5401 CAAGGAGGCT GGTCATTAGG CGTTACCGCA GGCGGCAATG TCGGCAAAGG

5451 CTACGGCAAT GGCGACAGCA TCACCCACCG CCATAGCCAT ATCGGCGACA

5501 AAGGCAGCCA AACCCTTATC CAAAGCGGTG GCGACACTAC CATCAAAGGC

5551 GCGCAAGTAC GCGGCAAAGG CGTACAAGTC AATGCCAAAA ACCTAAGTAT

5601 TCAAAGCGTA CAAGATAGAG AAACCTATCA AAGCAAACAA CAAAACGCCA

5651 GTGCACAAGT TACCGTAGGT TATGGCTTCA GTGCCGGTGG CGATTACAGC

5701 CAAAGCAAAA TCCGAGCCGA CCATGTTTCA GTAACCGAGC AAAGCGGTAT

5751 TTATGCCGGA GAAGACGGCT ATCAAATCAA GGTCGGAAAC CATACAGACC
```

-continued

```
5801 TCAAAGGCGG CATCATCACC AGTACCCAAA GCGCAGAAGA CAAGGGTAAA

5851 AACCGCTTTC AGACGGCCAC CCTCACCCAT AGCGACATCA AAAACCACAG

5901 CCAATACAAA GGCGAAAGTT TTGGATTGGG CGCAAGTGCG TCCATAAGCG

5951 GCAAAACACT GGGACAGGGC GCACAAAATA AACCTCAAAA CAAACACCTG

6001 ACAAGCGTAG CCGATAAAAA CAGCGCAAGT TCATCAGTGG GTTATGGCAG

6051 CGACAGCGAC AGTCAAAGCA GCATCACAAA AAGCGGCATC AACACCCGCA

6101 ACATTCAAAT CACCGACGAA GCCGCACAAA TCCGGCTGAC AGGCAAAACA

6151 GCGGCACAAA CCAAAGCCGA TATTGATACA AACGTAACCA CAGACACCGC

6201 CGAACGACAT TCGGGCAGCT TGAAGAACAC CTTCAACAAA GAAGCGGTGC

6251 AAAGTGAACT GGATTTACAA AGAACCGTCA GCCAAGATTT TAGTAAAAAT

6301 GTTCAACAAG CCAATACCGA GATTAACCAA CATTTAGACA AACTCAAAGC

6351 AGACAAAGAA GCAGCCGAAA CAGCAGCAGC CGAGGCATTA GCCAATGGCG

6401 ATATGGAAAC TGCCAAACGC AAAGCCCATG AAGCTCAAGA TGCGGCAGCA

6451 AAAGCAGATA ATTGGCAACA AGGCAAAGTC ATTCTCAACA TGTTAGCCTC

6501 AGGTTTAGCT GCGCCGACCC AAAGCGGAGC GGGCATCGCT GCGGCTACCG

6551 CATCGCCAGC CGTATCGTAT GCGATTGGAC AGCACTTTAA AGATTTAGCC

6601 GGTCAAAACG CGAATGGTAA ACTAACCGCC AGTCAAGAAA CCGCACACGT

6651 TCTTGCCCAC GCGGTATTAG GAGCAGCGGT TGCCGCAGTA GGAGACAACA

6701 ATGCTCTAGC AGGAGCATTG AGTGCGGGCG GGTCGGAAGC GGCTGCGCCT

6751 TACATCAGCA AATGGTTATA CGGCAAAGAA AAAGGAAGCG ACTTAACGGC

6801 GGAAGAGAAA GAGACTGTAA CAGCGATTAC AAATGTATTG GGTACGGCTA

6851 CGGGTGCGGC AGTCGGCAAC AGCGCAACAG ATGCAGCGCA AGGCAGCCTG

6901 AATGCGCAAA GTGCGGTGGA GAATAATGAT ACTGTAGAGC AAGTGAAATT

6951 TGCTCTTAGG CACCCTAGAA TTGCTATTGC AATTGGATCT GTACATAAAG

7001 ATCCTGGCTC TACATTAGAG CCTAATATTT CAACAATTGC TTCAACTTTT

7051 CAATTAAATT TATTTCCTAA TAGTGAATTT GGTGGTGAAG GTGGAGTTGG

7101 CAATGCATTC AGGCACGTTT TATGGCAAGC AACCATCACA CGAGAATTTG

7151 GCAAAGATAT TGCTGTTAAA GTAGGAAATA GTCATGAAAG TGGGGAAAAA

7201 ATTAATTATT CTATAAGACG TAATCTTTCA TTAGATAAAG CAGATGAAAT

7251 GATTGATCAA CTAAATAACG AAATAGGAAG AGAAATAGCA TTAAATACCA

7301 ATAGGTTAAA CACAAAAGAG TTAGTTGGAT TAATTCTGGA AACTTATAAA

7351 AATAATGGTT TTTATCAAGC AGAAAGAAAC AGTAATGGAA ATTATGATGT

7401 TGTAAGAAAA AGATTATCTG AAAAAGATTA CCAGAATACA AGCAATATAT

7451 TGATTCACTT AGATAATACT GGTGCCGGAT TTAAAATTCA GCAGAGGAGA

7501 AAACAAATCA GAGCACAAAT TTCAGCCAGA CAATGGAGAA GATAA
```

This corresponds to the amino acid sequence <SEQ ID 1668; ORF 563>:

```
m563.pep..
   1 MNKTLYRVIF NRKRGAVVAV AETTKREGKS CADSDSGSAH VKSVPFGTTH

51 APVCRSNIFS FSLLGFSLCL AVGTANIAFA DGIIADKAAP KTQQATILQT
```

-continued

```
 101  GNGIPQVNIQ TPTSAGVSVN QYAQFDVGNR GAILNNSRSN TQTQLGGWIQ

151  GNPWLARGEA RVVVNQINSS HSSQMNGYIE VGGRRAEVVI ANPAGIAVNG

201  GGFINASRAT LTTGQPQYQA GDLSGFKIRQ GNVVIAGHGL DARDTDFTRI

251  LSYHSKIDAP VWGQDVRVVA GQNDVVATGN AHSPILNNAA ANTSNNTANN

301  GTHIPLFAID TGKLGGMYAN KITLISTAEQ AGIRNQGQLF ASSGNVAIDA

351  NGRLVNSGTM AAANAKDTDN TAEHKVNIRS QGVENSGTAV SQQGTQIHSQ

401  SIQNTGTLLS SGEILIHNSG SLKNETSGTI EAARLAIDTD TLNNQGKLSQ

451  TGSQKLHIDA QGKMDNRGRM GLQDTAPTAS NGSSNQTGNS YNASFHSSTT

501  TPTTATGTGT ATVSISNITA PTFADGTIRT HGALDNSGSI IANGQTDVSA

551  QQGLNNAGQI DIHQLNAKGS AFDNHNGTII SDAVHIQAGS LNNQNGNITT

601  RQQLEIETDQ LDNAHGKLLS AEIADLAVSG SLNNQNGEIA TNQQLIIHDG

651  QQSTAVIDNT NGTIQSGRDV AIQAKSLSNN GTLAADNKLD IALQDDFYVE

701  RNIVAGNELS LSTRGSLKNS HTLQAGKRIR IKANNLDNAA QGNIQSGGTT

751  DIGTQHNLTN RGLIDGQQTK IQAGQMNNIG TGRIYGDNIA IAATRLDNQD

801  ENGTGAAIAA RENLNLGIGQ LNNRENSLIY SGNDMAVGGA LDTNGQATGK

851  AQRIHNAGAT IEAAGKMRLG VEKLHNTNEH LKTQLVETGR EHIVDYEAFG

901  RHELLREGTQ HELGWSVYND ESDHLRTPDG AAHENWHKYD YEKVTQKTQV

951  TQTAPAKIIS GNDLTIDGKE VFNTDSQIIA GGNLIVQTEK DGLHNEQTFG

1001  EKKVFSENGK LHSYWREKHK GRDSTGHSEQ NYTLPEEITR NISLGSFAYE

1051  SHRKALSHHA PSQGTELPQS NGISLPYTSN SFTPLPSSSL YIINPVNKGY

1101  LVETDPRFAN YRQWLGSDYM LDSLKLDPNN LHKRLGDGYY EQRLINEQIA

1151  ELTGHRRLDG YQNDEEQFKA LMDNGATAAR SMNLSVGIAL SAEQVAQLTS

1201  DIVWLVQKEV KLPDGGTQTV LVPQVYVRVK NGDIDGKGAL LSGSNTQINV

1251  SGSLKNSGTI AGRNALIINT DTLDNIGGRI HAQKSAVTAT QDINNIGGML

1301  SAEQTLLLNA GNNINSQSTT ASSQNTQGSS TYLDRMAGIY ITGKEKGVLA

1351  AQAGKDINII AGQISNQSEQ GQTRLQAGRD INLDTVQTSK HQATHFDADN

1401  HVIRGSTNEV GSSIQTKGDV TLLSGNNLNA KAAEVSSANG TLAVSAKNDI

1451  NISAGINTTH VDDASKHTGR SGGGNKLVIT DKAQSHHETA QSSTFEGKQV

1501  VLQAGNDANI LGSNVISDNG TQIQAGNHVR IGTTQTQSQS ETYHQTQKSG

1551  LMSAGIGFTI GSKTNTQENQ SQSNEHTGST VGSLKGDTTI VAGKHYEQIG

1601  STVSSPEGNN TIYAQSIDIQ AAHNKLNSNT TQTYEQKGLT VAFSSPVTDL

1651  AQQAIAVAQS SKQVGQSKND RVNAMAAANA GWQAYQTGKS AQNLANGTTN

1701  AKQVSISITY GEQQNRQTTQ VQANQAQASQ IQAGGKTTLI ATGAAEQSNI

1751  NIAGSDVAGK AGTILIADND ITLQSAEQSN TERGQNKSAG WNAGAAVSFG

1801  QGGWSLGVTA GGNVGKYGN GDSITHRHSH IGDKGSQTLI QSGGDTTIKG

1851  AQVRGKGVQV NAKNLSIQSV QDRETYQSKQ QNASAQVTVG YGFSAGGDYS

1901  QSKIRADHVS VTEQSGIYAG EDGYQIKVGN HTDLKGGIIT STQSAEDKGK

1951  NRFQTATLTH SDIKNHSQYK GESFGLGASA SISGKTLGQG AQNKPQNKHL

2001  TSVADKNSAS SSVGYGSDSD SQSSITKSGI NTRNIQITDE AAQIRLTGKT

2051  AAQTKADIDT NVTTDTAERH SGSLKNTFNK EAVQSELDLQ RTVSQDFSKN
```

```
-continued
2101  VQQANTEINQ HLDKLKADKE AAETAAAEAL ANGDMETAKR KAHEAQDAAA

2151  KADNWQQGKV ILNMLASGLA APTQSGAGIA AATASPAVSY AIGQHFKDLA

2201  GQNANGKLTA SQETAHVLAH AVLGAAVAAV GDNNALAGAL SAGGSEAAAP

2251  YISKWLYGKE KGSDLTAEEK ETVTAITNVL GTATGAAVGN SATDAAQGSL

2301  NAQSAVENND TVEQVKFALR HPRIAIAIGS VHKDPGSTLE PNISTIASTF

2351  QLNLFPNSEF GGEGGVGNAF RHVLWQATIT REFGKDIAVK VGNSHESGEK

2401  INYSIRRNLS LDKADEMIDQ LNNEIGREIA LNTNRLNTKE LVGLILETYK

2451  NNGFYQAERN SNGNYDVVRK RLSEKDYQNT SNILIHLDNT GAGFKIQQRR

2501  KQIRAQISAR QWRR*
```

Computer analysis of this amino acid sequence gave the following results:

Homology with a Predicted ORF from *N. gonorrhoeae*

ORF 563 shows 79.1% identity over a 2316 aa overlap with a predicted ORF (ORF 563.ng) from *N. gonorrhoeae*:

```
m563/g563
                      10         20         30         40         50
    g563.pep  MNKTLYRVIFNRKRGAVVAVAETTKREGKSCADSGSGSVYVKSVSFIPTH-----SKAFC
              |||||||||||||||||||||||||||||||||||| |||::|||| | ||       |:|
    m563.pep  MNKTLYRVIFNRKRGAVVAVAETTKREGKSCADSDSGSAHVKSVPFGTTHAPVCRSNIFS
                      10         20         30         40         50         60

60         70         80         90        100        110
    g563.pep  FSALGFSLCLALGTVNIAFADGIITDKAAPKTQQATILQTGNGIPQVNIQTPTSAGVSVN
              ||  |||||||:||:|||||||||:|||||||||||||||||||||||||||||||||||
    m563.pep  FSLLGFSLCLAVGTANIAFADGIIADKAAPKTQQATILQTGNGIPQVNIQTPTSAGVSVN
                      70         80         90        100        110        120

120        130        140        150        160        170
    g563.pep  QYAQFDVGNRGAILNNSRSNTQTQLGGWIQGNPWLTRGEARVVVNQINSSHPSQLNGYIE
              |||||||||||||||||||||||||||||||||||:||||||||||||||:|::|||||
    m563.pep  QYAQFDVGNRGAILNNSRSNTQTQLGGWIQGNPWLARGEARVVVNQINSSHSSQMNGYIE
                     130        140        150        160        170        180

180        190        200        210        220        230
    g563.pep  VGGRRAEVVIANPAGIAVNGGGFINASRATLTTGQPQYQAGDFSGFKIRQGNAVIAGHGL
              |||||||||||||||||||||||||||||||||||||||:||||||||||:||||||||
    m563.pep  VGGRRAEVVIANPAGIAVNGGGFINASRATLTTGQPQYQAGDLSGFKIRQGNVVIAGHGL
                     190        200        210        220        230        240

240
    g563.pep  DARDTDFTRIL-------------------------------------------------
              |||||||||||
    m563.pep  DARDTDFTRILSYHSKIDAPVWGQDVRVVAGQNDVVATGNAHSPILNNAAANTSNNTANN
                     250        260        270        280        290        300

250        260        270        280        290
    g563.pep  ----------------LYANKITLISTAEQAGIRNQGQLFASSGNVAIDANGRLVNSGTM
                              :|||||||||||||||||||||||||||||||||||||||||||
    m563.pep  GTHIPLFAIDTGKLGGMYANKITLISTAEQAGIRNQGQLFASSGNVAIDANGRLVNSGTM
                     310        320        330        340        350        360

300        310        320        330        340
    g563.pep  AAANVQDMNNTAEHKVNIRSQAFENSGTAVSQQGTQIHSQSIQNTGKLLSAGT-------
              ||||::|:|||||||||||||:|||||||||||||||||||||||| |||:||
    m563.pep  AAANAKDTDNTAEHKVNIRSQGVENSGTAVSQQGTQIHSQSIQNTGTLLSSGEILIHNSG
                     370        380        390        400        410        420 g563.pep  ------------------------------------------------------------
    m563.pep  SLKNETSGTIEAARLAIDTDTLNNQGKLSQTGSQKLHIDAQGKMDNRGRMGLQDTAPTAS
                     430        440        450        460        470        480 g563.pep  ------------------------------------------------------------
    m563.pep  NGSSNQTGNSYNASFHSSTTTPTTATGTGTATVSISNITAPTFADGTIRTHGALDNSGSI
                     490        500        510        520        530        540
```

-continued

```
g563.pep   ------------------------------------------------------------
m563.pep   IANGQTDVSAQQGLNNAGQIDIHQLNAKGSAFDNHNGTIISDAVHIQAGSLNNQNGNITT
                550       560       570       580       590       600

350       360       370       380
g563.pep   ----------------------EDLAVSGSLNNQNGEIATNQQLIIHDGQQSTVVIDNT
                                 ||||||||||||||||||||||||||||||||:|||||
m563.pep   RQQLEIETDQLDNAHGKLLSAEIADLAVSGSLNNQNGEIATNQQLIIHDGQQSTAVIDNT
                610       620       630       640       650       660

390       400       410       420       430       440
g563.pep   NGTIQSGRDVAIQAKSLSNNGTLAADNKLDIALQDDFYVERKIVAGNELSLSTRGSLKNS
           ||||||||||||||||||||||||||||||||||||||||||:|||||||||||||||||
m563.pep   NGTIQSGRDVAIQAKSLSNNGTLAADNKLDIALQDDFYVERNIVAGNELSLSTRGSLKNS
                670       680       690       700       710       720

450       460       470       480       490       500
g563.pep   HTLQAGKRIRIKANNLDNAVQGNIQSGGTTDIGTQHNLTNRGLIDGQQTKIQAGQMNNIG
           ||||||||||||||||||||:|||||||||||||||||||||||||||||||||||||||
m563.pep   HTLQAGKRIRIKANNLDNAAQGNIQSGGTTDIGTQHNLTNRGLIDGQQTKIQAGQMNNIG
                730       740       750       760       770       780

510       520       530       540       550       560
g563.pep   TGRIYGDNIAIAATRLDNQDENGTGAAIAAREENLNLGIEQLNNRENSLIYSGNDMAVGGA
           |||||||||||||||||||||||||||||||||||||:|||||||||||||||||||||
m563.pep   TGRIYGDNIAIAATRLDNQDENGTGAAIAARENLNLGIGQLNNRENSLIYSGNDMAVGGA
                790       800       810       820       830       840

570       580       590       600       610       620
g563.pep   LDTNDQATGKAQRIHNAGAIIEAAGKMRLGVEKLHNTNEHLKTQLVETGRERIVDYEAFG
           ||||:||||||||||||||||:|||||||||||||||||||||||||||||:|||||||
m563.pep   LDTNGQATGKAQRIHNAGATIEAAGKMRLGVEKLHNTNEHLKTQLVETGREHIVDYEAFG
                850       860       870       880       890       900

630       640       650       660       670       680
g563.pep   RHELLREGTQHELGWFVYNNESDHLRTPDGVAHENWHKYDYEKVTQETQVTGTAPAKIIA
           ||||||||||||||||  |||:||||||||||:|||||||||||||||:|||||||||:
m563.pep   RHELLREGTQHELGWSVYNDESDHLRTPDGAAHENWHKYDYEKVTQKTQVTQTAPAKIIS
                910       920       930       940       950       960

690       700       710       720       730       740
g563.pep   GSDLIIDSKAVFNSDSRIIAGGQLLVQTEKDGLHNEQTFGEKKVFSENGKLHNYWRARRK
           |:||  ||:||||:||||||||:|||||||||||||||||||||||||||:||  ::|
m563.pep   GNDLTIDGKEVFNTDSQIIAGGNLIVQTEKDGLHNEQTFGEKKVFSENGKLHSYWREKHK
                970       980       990      1000      1010      1020

750       760       770       780       790       800
g563.pep   GHDETGHREQNYTLPEEITRDISLGSFAYESHSKALSRHAPSQGTELPQSNRDNIRTAKS
           |:||||||||||||||||||:||||||||||||||:|||||||||||| 
m563.pep   GRDSTGHSEQNYTLPEEITRNISLGSFAYESHRKALSHHAPSQGTELPQSN---------
               1030      1040      1050      1060      1070

810       820       830       840       850       860
g563.pep   NGISLPYTPNSFTPLPGSSLYIINPANKGYLVETDPRFANYRQWLGSDYMLGSLKLDPNN
            |||||||:|||||||:|||||||:|||||||||||||||||||||||||:||||||||
m563.pep   -GISLPYTSNSFTPLPSSSLYIINPVNKGYLVETDPRFANYRQWLGSDYMLDSLKLDPNN
               1080      1090      1100      1110      1120      1130

870       880       890       900       910       920
g563.pep   LHKRLGDYYEQRLINEQIAELTGHRRLDGYQNDEEQFKALMDNGATAARSMNLSVGIAL
           ||||||||||||||||||||||||||||||||||||||||||||||||||||||||||
m563.pep   LHKRLGDYYEQRLINEQIAELTGHRRLDGYQNDEEQFKALMDNGATAARSMNLSVGIAL
               1140      1150      1160      1170      1180      1190

930       940       950       960       970       980
g563.pep   SAEQAAQLTSDIVWLVQKEVKLPDGGTQTVLMPQVYVRVKNGGIDGKGALLSGSNTQINV
           ||||:|||||||||||||||||||||||||||:|||||||||||| ||||||||||||
m563.pep   SAEQVAQLTSDIVWLVQKEVKLPDGGTQTVLVPQVYVRVKNGDIDGKGALLSGSNTQINV
               1200      1210      1220      1230      1240      1250

990      1000      1010      1020      1030      1040
g563.pep   SGSLKNSGTIAGRNALIINTDTLDNIGGRIHAQKSAVTATQDINNIGGILSAEQTLLLNA
           ||||||||||||||||||||||||||||||||||||||||||||||||:|||||||||
m563.pep   SGSLKNSGTIAGRNALIINTDTLDNIGGRIHAQKSAVTATQDINNIGGMLSAEQTLLLNA
               1260      1270      1280      1290      1300      1310
```

```
              1050       1060       1070       1080       1090       1100
g563.pep  GNNINNQSTAKSSQNAQGSSTYLDRMAGIYITGKEKGVLAAQAGKDINIIAGQISNQSDQ
          ||||:|||:|||::|||||||||||||||||||||||||||||||||||||||||||:|
m563.pep  GNNINSQSTTASSQNTQGSSTYLDRMAGIYITGKEKGVLAAQAGKDINIIAGQISNQSEQ
              1320       1330       1340       1350       1360       1370

1110       1120       1130       1140       1150       1160
g563.pep  GQTRLQAGRDINLDTVQTGKYQEIHFDADNHTIRGSTNEVGSSIQTKGDVTLLSGNNLNA
          |||||||||||||||||||:|:||||||||:|||||||||||:|||||||||||||||||
m563.pep  GQTRLQAGRDINLDTVQTSKHQATHFDADNHVIRGSTNEVGSSIQTKGDVTLLSGNNLNA
              1380       1390       1400       1410       1420       1430

1170       1180       1190       1200       1210       1220
g563.pep  KAAEVGSAKGTLAVYAKNDITISSGIHAGQVDDASKHTGRSGGGNKLVITDKAQSHHETA
          ||||:||:|||||||:||||:|:||:::  :|||||||||||||||||||||||||||||
m563.pep  KAAEVSSANGTLAVSAKNDINISAGINTTHVDDASKHTGRSGGGNKLVITDKAQSHHETA
              1440       1450       1460       1470       1480       1490

1230       1240       1250       1260       1270       1280
g563.pep  QSSTFEGKQVVLQAGNDANILGSNVISDNGTRIQAGNHVRIGTTQTQSQSETYHQTQKSG
          |||||||||||||||||||||||||||||||:|||||||:||||||||||||||||||||
m563.pep  QSSTFEGKQVVLQAGNDANILGSNVISDNGTQIQAGNHVRIGTTQTQSQSETYHQTQKSG
              1500       1510       1520       1530       1540       1550

1290       1300       1310       1320       1330       1340
g563.pep  LMSAGIGFTIGSKTNTQENQSQSNEHTGSTVGSLKGDTTIVASKHYEQTGSNVSSPEGNN
          ||||||||||||||||||||||||||||||||||||||||:|||||:||:||||||||||
m563.pep  LMSAGIGFTIGSKTNTQENQSQSNEHTGSTVGSLKGDTTIVAGKHYEQIGSTVSSPEGNN
              1560       1570       1580       1590       1600       1610

1350       1360       1370       1380       1390       1400
g563.pep  LISTQSMDIGAAQNQLNSKTTQTYEQKGLTVGIQFARYRFGTTSDCRSTQSSKQVGQSKN
          |:||:||  ||:|:|||:||||||||||||||:|:       :       ::|||||||||
m563.pep  TIYAQSIDIQAAHNKLNSNTTQTYEQKGLTVAFSSPVTDLAQQA-IAVAQSSKQVGQSKN
              1620       1630       1640       1650       1660

1410       1420       1430       1440       1450       1460
g563.pep  DRVNAMAAANAGWQAYQTGKGAQNLANGTTNAKQVSISITYGEQQNRQTTQVQANQAQAS
          |||||||||||||||||||||:||||||||||||||||||||||||||||||||||||||
m563.pep  DRVNAMAAANAGWQAYQTGKSAQNLANGTTNAKQVSISITYGEQQNRQTTQVQANQAQAS
             1670       1680       1690       1700       1710       1720

1470       1480       1490       1500       1510       1520
g563.pep  QIQAGGKTTLYCRRCGEQSNINITGSGVSGRAGTGLIADKQIHLQSAEQSNTERSQNKSA
          ||||||||||:||||  :|||||||:||  |:|:|||  ||||:::| ||||||||:||||
m563.pep  QIQAGGKTTLIATGAAEQSNINIAGSDVAGKAGTILIADNDITLQSAEQSNTERGQNKSA
              1730       1740       1750       1760       1770       1780

1530       1540       1550       1560       1570       1580
g563.pep  GWNAGAAVSFGQGGWSLGVAAGGNVGKGYGYGDSVTHRHSHIGDKGSQTLIQSGGDTIIK
          ||||||||||||||||||||:|||||||||:|||:||||||||||||||||||||||:||
m563.pep  GWNAGAAVSFGQGGWSLGVTAGGNVGKGYGNGDSITHRHSHIGDKGSQTLIQSGGDTTIK
              1790       1800       1810       1820       1830       1840

1590       1600       1610       1620       1630       1640
g563.pep  GAQVRGKGVQVNAKNLSIQSVQDRETYQSKQQNAGAQVTVGYGFSASGDYSQSKIRADHA
          ||||||||||||||||||||||||||||||||:||||||||||||:|||||||||||||:
m563.pep  GAQVRGKGVQVNAKNLSIQSVQDRETYQSKQQNASAQVTVGYGFSAGGDYSQSKIRADHV
              1850       1860       1870       1880       1890       1900

1650       1660       1670       1680       1690       1700
g563.pep  SVTEQSGIYAGEDGYQIKVGNHTGLKGGIITSSQSAKDKGKNRFSTGTLAGSDIQNYSQY
          |||||||||||||||||||||||:|||||||||||:|||||||||:|:||: |||:|:|||
m563.pep  SVTEQSGIYAGEDGYQIKVGNHTDLKGGIITSQSAEDKGKNRFQTATLTHSDIKNHSQY
              1910       1920       1930       1940       1950       1960

1710       1720       1730       1740       1750       1760
g563.pep  EGKSFGLGASVAVSGKTLGQGAKNKPQDKHLTSIADKNGASSSVGYGSDSDSQSSITKSG
          :|:||||||||:::|||||||||:||||:|||||:||||:|||||||||||||||||||||
m563.pep  KGESFGLGASASISGKTLGQGAQNKPQNKHLTSVADKNSASSSVGYGSDSDSQSSITKSG
              1970       1980       1990       2000       2010       2020

1770       1780       1790       1800       1810       1820
g563.pep  INTPKNIQITDEAAQIRLTGKIAAQTKADIDTNVTTDTAERHSGSLKNIFDKDRVQSELD
          |||  :||||||||||||||||:||||||||||||||||||||||||||:|: ||||||
m563.pep  INT-RNIQITDEAAQIRLTGKTAAQTKADIDTNVTTDTAERHSGSLKNTFNKEAVQSELD
             2030       2040       2050       2060       2070       2080
```

-continued

```
                      1830      1840      1850      1860      1870      1880
g563.pep        LQRTVSQDFSKNVQQTNTEINQHLDKLKADKEAAETAAAEALANGDMETAKRKAHEAQDA
                |||||||||||||||:||||||||||||||||||||||||||||||||||||||||||||
m563.pep        LQRTVSQDFSKNVQQANTEINQHLDKLKADKEAAETAAAEALANGDMETAKRKAHEAQDA
              2090      2100      2110      2120      2130      2140

1890      1900      1910      1920      1930      1940
g563.pep        AAKADNWQQGKVILNMLASGLAEPTQSGAGIAAATASPDVSYAIGQHFKDLAGQNANGKL
                |||||||||||||||||||||| ||||||||||||||| |||||||||||||||||||||
m563.pep        AAKADNWQQGKVILNMLASGLAAPTQSGAGIAAATASPAVSYAIGQHFKDLAGQNANGKL
              2150      2160      2170      2180      2190      2200

1950      1960      1970      1980      1990      2000
g563.pep        TASQETAHVLAHAVLGAAVAAAXGNNAPAGALGAGGSEAAAPIIGKWLYGKGDGGSLNAE
                |||||||||||||||||||||:  ||| ||||:||||||||| |:||||||  |::|:||
m563.pep        TASQETAHVLAHAVLGAAVAAVGDNNALAGALSAGGSEAAAPYISKWLYGKEKGSDLTAE
              2210      2220      2230      2240      2250      2260

2010      2020      2030      2040     2049
g563.pep        EKETVSAITRMLGTAAGAAEGNSSADAVWGCFQTASDFASSFSYPINMX
                |||||:||| :||||:||| |||::||: | ::: |
m563.pep        EKETVTAITNVLGTATGAAVGNSATDAAQGSLNAQSAVENNDTVEQVKFALRHPRIAIAI
              2270      2280      2290      2300      2310      2320 m563.pep        GSVHKDPGSTLEPNISTIASTFQLNLFPNSEFGGEGGVGNAFRHVLWQATITREFGKDIA
                      2330      2340      2350      2360      2370      2380
```

The following partial DNA sequence was identified in *N. meningitidis* <SEQ ID 1669>:

```
m564.seq
   1 ATGAACCGCA CCCTGTACAA AGTTGTATTT AACAAACATC GAAACTGCAT

51 GATAGCCGTT GCTGAAAATG CCAAACGCGA GGGCAAAAAC ACAGCCGACA

101 CCCAAGCTGT AGGTATTTTG CCAAATGATA TTGCGGGCTT TGCGGGTTTT

151 ATCCATTCTA TCTCTGTTAT CTCATTCTCC CTTTCATTAC TGCTCGGTTC

201 TGCCCTTATC CTGACTTCTT CTTCTGCTAC TGCCCAAGGT ATCGTTGCCG

251 ACAAATCCGC ACCTGCACAG CAACAGCCTA CCATCCTGCA AACAGGTAAC

301 GGCATACCGC AAGTCAATAT TCAAACCCCT ACTTCGGCAG GGGTTTCTGT

351 TAATCAATAC GCCCAGTTTG ATGTGGGTAA TCGCGGGGCG ATTTTAAACA

401 ACAGTCGCAG CAACACCCAA ACACAGCTAG GCGGTTGGAT TCAAGGCAAT

451 CCTTGGTTGG CAAGGGGCGA AGCACGTGTG GTTGTAAACC AAATCAACAG

501 CAGCCATTCT TCACAACTGA ATGGCTATAT TGAAGTGGGC GGACGACGTG

551 CAGAAGTCGT TATTGCCAAT CCGGCAGGGA TTGCAGTCAA TGGTGGTGGT

601 TTTATCAATG CTTCCCGTGC CACTTTGACG ACAGCCCAAC CGCAATATCA

651 AGCAGGAGAC CTTAGCGGCT TTAAGATAAG GCAAGGCAAT GTTGTAATCG

701 CCGGACACGG TTTGGATGCA CGTGATACCG ATTACACACG TATTCTCAGT

751 TATCATTCCA AAATTGATGC ACCCGTATGG GGACAAGATG TTCGTGTCGT

801 CGCGGGACAA AACGATGTGG CCGCAACAGG TGATGCACAT TCGCCTATTC

851 TCAATAATGC TGCTGCCAAT ACGTCAAACA ATACAGCCAA CAACGGCACA

901 CATATCCCTT TATTTGCGAT TGATACAGGC AAATTAGGAG GTATGTATGC

951 CAACAAAATC ACCTTGATCA GTACGGTCGA GCAAGCAGGC ATTCGTAATC

1001 AAGGGCAATG GTTTGCCTCA GCCGGCAATG TGGCAGTGAA TGCTGAGGGT

1051 AAACTGGTCA ACACGGGCAT GATTGCAGCG ACGGGAGAAA ATCATGCGGT

1101 TTCACTTCAT GCCGGCAATG TTCATAATAG CGGTACGGTT GCCTCACAGG
```

-continued
```
1151 ATGATGCCAA TATTCACAGC CAGACGCTGG ACAATTCAGG TACGGTCTTA
1201 TCCTCAGGTC GATTGACTGT TCGTAATTTA GGCCGTCTGA AAAACCAAAA
1251 CAACGGTACG ATCCAGGCTG CCCGCTTAGA TATGTCAACA GGTGGTTTGG
1301 ATAACACAGG TAATATTACT CAAACAGGTT CACAAGCATT GGATTTGGTA
1351 TCTGCCGGCA AATTCGATAA CAGTGGCAAG ATTGGTGTAA GTGACGTTCC
1401 ACAGACCGGT TTGAATCCCA ATCCATCAGT CATACCACAG ATTCCGAGTA
1451 CTGCAACAGG TTCAGGCAGC AGCACTGTCT CGGTATCTAA GCCTGGTTCA
1501 AACAATCCCG TTTCACCTAC AGCACCTGCA AAAACTACG CCGTAGGACG
1551 CATTCAAACA ACAGGAGCAT TTGACAATGC AGGATCAATT AATGCGGGTG
1601 GGCAAATTGA CATTGCCGCC CAAAACGGTT TGGGAAATTC GGGTAGTCTG
1651 AATGCGGCTA AACTACGAGT ATCAGGCGAT TCATTTAACA ATACGGTAAA
1701 AGGCAAACTC CAGGCACACG ATCTGGCTGT TAACACTCAA ACTGCTAAAA
1751 ACAGCGGTCA CTTATTAACT CAAACCGGCA AGATTGATAA CCGTGAACTG
1801 CATAATGCCG GAGAAATTGC CGCCAACAAT CTGACACTCA TTCATTCGGG
1851 CCGCTTGAGC AATGATAAAA AAGGCAATAT TCGAGCTGCA CATTTACAGC
1901 TTGATACCGC CGGTTTACAT AATGCAGGTA ACATTCTTGC CGATAGTGGA
1951 ACCGTTACCA CCAAGAATAA TCTTCGCAAT ACAGGAAAAG TTTCTGTTGC
2001 ACGACTGAAT ACCGAAGGTC AGACTCTAGA TAATACGCGC GGACGTATAG
2051 AGGCTGAAAC GGTTAACATC CAAAGTCAGC AACTGACTAA CCAAAGCGGC
2101 CATATTACTG CTACCGAACA ACTGACTATC AATAGTCGAA ATGTAGACAA
2151 CCAAAACGGC AAACTCCTAT CTGCAAACCA AGCACAATTA GCTGTTTCAG
2201 ACGGCCTATA CAACCAACAT GGTGAAATTG CCACCAACCG GCAGTTGTCT
2251 ATTCACGATA AAAATCAAAA CACTTTGGCG TTAAACAATG CGGATGGCAC
2301 GATTCAATCT GCCGGTAATG TATCGCTACA AGCCAAATCA CTCGCCAACA
2351 ATGGCACATT AACAGCCGGT AACAAACTGG ATATTGCTTT GACGGACGAT
2401 TTCGTCGTAG AGCGCGACCT CACTGCAGGC AAACAATTAA ATCTAAGCAT
2451 AAAAGGCCGT CTGAAAAATA CCCATACCCT ACAAGCAGGC CATACGCTCA
2501 AACTCAATGC CGGCAATATA GATAACCAAG TTACAGGCAA AATTATTGGT
2551 GGAGAACAAA CGGACATCAC ATCCGAACAG CATGTTGACA ACAGGGGCTT
2601 GATCAACAGC GACGGTTTGA CCCACATCGG TGCAGGTCAA ACCCTGACCA
2651 ACACCGGGAC AGGCAAAATC TATGGCAACC ATATTGCCCT GGACGCGCAA
2701 ATACTGCTTA ACCGGGAAGA AACGACGGAA GGCAGTACCA AAGCGGGGGC
2751 AATAGCTGCA AGGAAACGTT TGGATATTGG AGCGAAAGAG ATTCATAACC
2801 AAGAAGGTGC CCTACTATCC AGCGAAGGTA TTTTTGCCGT AgGTAATCGA
2851 CTGGATGAAC AACATCATGC GGCAGGCATG GCCGATACCT TTGTTAATGG
2901 CAGTGCCGGT TTGGAAGTAC AAGGTGATGC ATTGATGTCC GTTCGGAATA
2951 TGCAGAATAT CAATAATCAC TTTAAAACAG AGACATACTT AGCCAAAGCG
3001 GAAAAGCAAG TCCGCGACTA CACCGTACTG GGGCAAAATA CCTACTATCA
3051 GGCGGGAAAA GACGGTTTAT TCGACAACTC GCAAGGACAA AAAGACCAAA
3101 CTACTGCTAC GTTCCATTTA AAAAATGGTT CTCGTATTGA GGCCAACCAA
3151 TGGCATGTCC GAGACTACCA CATCGAGACT TATAAAGAAC GCATCATCGA
```

-continued

```
3201 AAACCGGCCG GCACACATTA CTGTGGGCGG TGATTTGACT GCCTCAGGTC

3251 AAAATTGGCT GAACAAAGAC AGCCGGATTG TAGTAGGCGG GCGTATTATC

3301 ACTGATGATT TAAACCAGAA AGAAATTACC AATCAAAGTA CAACAGGCAA

3351 AGGTCGCACA GATGCTGTCG GCACACAGTG GGATTCAGTT ACAAAAAAAG

3401 GATGGTACAG CGGTAGAAAA AGACAACGCC GTACTGAAAG AAACCATACT

3451 CCTTACCATG ATACCCAACT ATTTACCCAC GACTTCGACA CGCCTGTATC

3501 CGTCATCCAA CAGAATGCCG CCTCCCCTTC CTTTCAACCC GCCGCATCTG

3551 CAATCAAACT GATTGACGGA GTATCCACGG CAGCCGTCAA TGGTCAGCGC

3601 ATCCATACCG GTAATGTGGT CTCGTTAAAT AACGCTACTG TTACTCTGCC

3651 TAACAGCAGC CTCTATACCA CCCATCCTGA CAATAAAGGC TGGTTGGTTG

3701 AAACCGATCC TCAATTTGCA GACTACCGCC GCTGGTTGGG CAGCGACTAC

3751 ATGTTGCAAC AACTGCAATT GGACACCAAT CATCTACACA AACGGCTTGG

3801 CGACGGCTAC TACGAACAAA AACTTGTTAA TGAACAAATC CATCAGTTAA

3851 CAGGCTACCG CCGACTCGAC GGCTACAGGA GTGATGAAGA ACAATTCAAA

3901 GCTCTGATGG ACAACGGCCT TACTGCTGCC AAAACATTCG GTCTCACCCC

3951 AGGTATCGCC TTGAGTGCAG AGCAAGTTGC CCGCTTAACT TCAGATATCG

4001 TTTGGATGGA AAATCAAACC GTCACCCTGT CTGACGGTTC GACTCAAACC

4051 GTACTGGTTC CTAAAGTCTA TGCCCTGGCG CGCAAAGGTG ATCTCAATAC

4101 CTCCGGTGGC CTGATTAGTG CCGAACAAGT CTTACTTAAA CTGCAAAACG

4151 GCAACCTGAC TAACAGCGGT ACCATTGCGG GGCGACAGGC CGTACTCATC

4201 CAGGCACGGA ATATTAACAG CAACGGTAAC ATTCAAGCCG ACCAAATCGG

4251 CTTAAAAGCT GAAAAAGTA TCAATATCGA CGGCGGGCAG GTACAAGCAG

4301 GCAGACTGCT GACTGCCCAA GCGCAAAATA TCAACCTTAA CGGTACAACC

4351 CAAACTTCCG GTAATGAACG TAACGGCAAT ACCGCCATCG ATCGTATGGC

4401 CGGCATTAAC GTGGTCGGAA GCCATACTGA ACAAGTAGAT AACAGAACTT

4451 CAGACGGCAT CCTATCCCTG CATGCCAGCA ACGATATCAA CCTCAATGCG

4501 GCCACCGTCT CTAACCAAGT TAAAGACGGC ACTACCCAAA TTACCGCCGG

4551 CAATAATCTC AACCTCGGCA CCATCCGTAC CGAACATCGC GAAGCCTATG

4601 GTACATTAGA TGACGAGAAC CATCGCCATG TCCGCCAAAG TACCGAAGTC

4651 GGCAGCAGTA TCCGCACGCA AAACGGCGCA CTGCTTAGAG CCGGTAACGA

4701 CTTAAAAATC CGCCAAGGCG AACTGGAGGC CGAAGAAGGC AAAACCGTCC

4751 TTGCCGCAGG ACGTGATGTC ACTATCAGCG AAGGACGCCA ATAACCGAA

4801 CTGGATACCT CGGTAAGCGG AAAAAGCAAA GGCATCCTTT CCAGTACCAA

4851 AACACACGAC CGCTACCGCT TCAGTCATGA TGAAGCAGTC GGCAGCAACA

4901 TCGGCGGCGG CAAAATGATT GTTGCAGCCG GGCAGGATAT CAATGTACGC

4951 GGCAGCAACC TTATTTCTGA TAAGGGCATT GTTTTAAAAG CAGGACACGA

5001 CATCGATATT TCTACTGCCC ATAATCGCTA TACCGGCAAT GAATACCACG

5051 AGAGCAAAAA ATCAGGCGTC ATGGGTACTG GCGGATTGGG CTTTACTATC

5101 GGTAACCGGA AAACTACCGA TGCACTGATG CGTACCAATA TTGTCCATAC

5151 AGGCAGCATT ATAGGCAGCC TGAATGGAGA CACCGTTACA GTTGCAGGAA
```

```
-continued
5201 ACCGCTACCG ACAAACCGGC AGTACCGTCT CCAGCCCCGA GGGGCGCAAT

5251 ACCGTCACAG CCAAAAGCAT AGATGTAGAG TTCGCAAACA ACCGGTATGC

5301 CACTGACTAC GCCCATACCC AGGAACAAAA AGGCCTTACC GTCGCCCTCA

5351 ATGTCCCGGT TGTCCAAGCT GCACAAAACT TCATACAAGC AGCCCAAAAT

5401 GTGGGCAAAA GTAAAAATAA ACGCGTTAAT GCCATGGCTG CAGCCAATGC

5451 TGCATGGCAG AGTTATCAAG CAAACAACA AATGCAACAA TTTGCTCCAA

5501 GCAGCAGTGC GGGACAAGGT CAAACAACA ATCAAAGCCC CAGTATCAGT

5551 GTGTCCATTA CCTACGGCGA ACAGAAAAGT CGTAACGAGC AAAAAGACA

5601 TTACACCGAA GCGGCAGCAA GTCAAATTAT CGGCAAAGGG CAAACCACAC

5651 TTGCGGCAAC AGGAAGTGGG GAGCAGTCCA ATATCAATAT TACAGGTTCC

5701 GATGTCATCG GCCATGCAGG TACTGCCCTC ATTGCCGACA ACCATATCAG

5751 ACTCCAATCT GCCAAACAGG ACGGCAGCGA GCAAAGCAAA ACAAAAGCA

5801 GTGGTTGGAA TGCAGGCGTA GCCGTCAAAA TAGGCAACGG CATCAGGTTT

5851 GGAATTACCG CCGGAGGAAA TATCGGTAAA GGTAAAGAGC AAGGGGGAAG

5901 TACTACCCAC CGCCACACCC ATGTCGGCAG CACAACCGGC AAAACTACCA

5951 TCCGAAGCGG CGGGGATACC ACCCTCAAAG GTGTGCAGCT CATCGGCAAA

6001 GGCATACAGG CAGATACGCG CAACCTGCAT ATAGAAAGTG TTCAAGATAC

6051 TGAAACCTAT CAGAGCAAAC AGCAAAACGG CAATGTCCAA GTTACTGTCG

6101 GTTACGGATT CAGTGCAAGC GGCAGTTACC GCCAAAGCAA AGTCAAAGCA

6151 GACCATGCCT CCGTAACCGG GCAAAGCGGT ATTTATGCCG GAGAAGACGG

6201 CTATCAAATC AAAGTCAGAG ACAACACAGA CCTCAAGGGC GGTATCATCA

6251 CGTCTAGCCA AAGCGCAGAA GATAAGGGCA AAAACCTTTT TCAGACGGCC

6301 ACCCTTACTG CCAGCGACAT TCAAAACCAC AGCCGCTACG AAGGCAGAAG

6351 CTTCGGCATA GGCGGCAGTT TCGACCTGAA CGGCGGCTGG GACGGCACGG

6401 TTACCGACAA ACAAGGCAGG CCTACCGACA GGATAAGCCC GGCAGCCGGC

6451 TACGGCAGCG ACGGAGACAG CAAAAACAGC ACCACCCGCA GCGGCGTCAA

6501 CACCCACAAC ATACACATCA CCGACGAAGC GGGACAACTT GCCCGAACAG

6551 GCAGGACTGC AAAAGAAACC GAAGCGCGTA TCTACACCGG CATCGACACC

6601 GAAACTGCGG ATCAACACTC AGGCCATCTG AAAAACAGCT TCGACAAAGA

6651 CGCGGTCGCC AAAGAGATCA ACCTGCAAAG GGAAGTAACG AAGGAGTTCG

6701 GCAGAAACGC CGCCCAAGCC GTAGCGGCCG TTGCCGACAA ACTCGGCAAT

6751 ACCCAAAGTT ACGAACGGTA TCAGGAAGCC CGAACCCTGC TGGAGGCCGA

6801 ACTGCAAAAC ACGGACAGCG AAGCCGAAAA AGCCGCCTTC CGCGCATCCC

6851 TCGGCCAAGT AAACGCCTAT CTTGCCGAAA ACCAAAGCCG CTACGACACC

6901 TGGAAAGAAG GCGGCATAGG CAGGAGCATA CTGCACGGGG CGGCAGGCGG

6951 ACTGACGACC GGCAGCCTCG GCGGCATACT GGCCGGCGGC GGCACTTCCC

7001 TTGCCGCACC GTATTTGGAC AAAGCGGCGG AAAACCTCGG TCCGGCGGGC

7051 AAAGCGGCGG TCAACGCACT GGGCGGTGCG GCCATCGGCT ATGCAACTGG

7101 TGGTAGTGGT GGTGCTGTGG TGGGTGCGAA TGTAGATTGG AACAATAGGC

7151 AGCTGCATCC GAAAGAAATG GCGTTGGCCG ACAAATATGC CGAAGCCCTC

7201 AAGCGCGAAG TTGAAAAACG CGAAGGCAGA AAAATCAGCA GCCAAGAAGC
```

```
7251 GGCAATGAGA ATCCGCAGGC AGATACTGCG TTGGGTGGAC AAAGGTTCCC

7301 AAGACGGCTA TACCGACCAA AGCGTCATAT CCCTTATCGG AATGAAAGGC

7351 GAAGACAAAG CCTTGGGTTA TACTTGGGAC TACCGCGACT ACGGCGCAAG

7401 AAATCCGCAA ACCTACAACG ATCCGAAGCT GTTTGAGGAA TACCGCCGAC

7451 AGGACAAACC CGAATACCGC AACCTGACCT GGCTGCACAG CGGGACGAAA

7501 GACACCAAAA TCAGGCAGGG AGAGCGGAAA AACGAAGAGT TTGCACTGAA

7551 CGTTGCCGAA GGACTGACGA GCCTTGTCAA CCCCAATCCG AGGATAAAAG

7601 TCCCGATTCT TGCAGGCATC CGCAACCTGA AAACATCAA GCCGACAGTT

7651 ACCGGCAGCG ATCCCTTATT GGCGGGTGCG GGAATATCC GTATCCCTGC

7701 AAACGGCAAT GTTGCGAAGG GGGACAGGAT TCCGGATACG GCATTGGCTA

7751 GCAAGGGAAT CAAACATAAA GATCGTAAAG ATCAACTGGA GAAAAAATAA
```

This corresponds to the amino acid sequence <SEQ ID 1670; ORF 564>:

```
m564.pep
   1 MNRTLYKVVF NKHRNCMIAV AENAKREGKN TADTQAVGIL PNDIAGFAGF

51 IHSISVISFS LSLLLGSALI LTSSSATAQG IVADKSAPAQ QQPTILQTGN

101 GIPQVNIQTP TSAGVSVNQY AQFDVGNRGA ILNNSRSNTQ TQLGGWIQGN

151 PWLARGEARV VVNQINSSHS SQLNGYIEVG GRRAEVVIAN PAGIAVNGGG

201 FINASRATLT TAQPQYQAGD LSGFKIRQGN VVIAGHGLDA RDTDYTRILS

251 YHSKIDAPVW GQDVRVVAGQ NDVAATGDAH SPILNNAAAN TSNNTANNGT

301 HIPLFAIDTG KLGGMYANKI TLISTVEQAG IRNQGQWFAS AGNVAVNAEG

351 KLVNTGMIAA TGENHAVSLH ARNVHNSGTV ASQDDANIHS QTLDNSGTVL

401 SSGRLTVRNL GRLKNQNNGT IQAARLDMST GGLDNTGNIT QTGSQALDLV

451 SAGKFDNSGK IGVSDVPQTG LNPNPSVIPQ IPSTATGSGS STVSVSKPGS

501 NNPVSPTAPA KNYAVGRIQT TGAFDNAGSI NAGGQIDIAA QNGLGNSGSL

551 NAAKLRVSGD SFNNTVKGKL QAHDLAVNTQ TAKNSGHLLT QTGKIDNREL

601 HNAGEIAANN LTLIHSGRLS NDKKGNIRAA HLQLDTAGLH NAGNILADSG

651 TVTTKNNLRN TGKVSVARLN TEGQTLDNTR GRIEAETVNI QSQQLTNQSG

701 HITATEQLTI NSRNVDNQNG KLLSANQAQL AVSDGLYNQH GEIATNRQLS

751 IHDKNQNTLA LNNADGTIQS AGNVSLQAKS LANNGTLTAG NKLDIALTDD

801 FVVERDLTAG KQLNLSIKGR LKNTHTLQAG HTLKLNAGNI DNQVTGKIIG

851 GEQTDITSEQ HVDNRGLINS DGLTHIGAGQ TLTNTGTGKI YGNHIALDAQ

901 ILLNREETTE GSTKAGAIAA RKRLDIGAKE IHNQEGALLS SEGIFAVGNR

951 LDEQHHAAGM ADTFVNGSAG LEVQGDALMS VRNMQNINNH FKTETYLAKA

1001 EKQVRDYTVL GQNTYYQAGK DGLFDNSQGQ KDQTTATFHL KNGSRIEANQ

1051 WHVRDYHIET YKERIIENRP AHITVGGDLT ASGQNWLNKD SRIVVGGRII

1101 TDDLNQKEIT NQSTTGKGRT DAVGTQWDSV TKKGWYSGRK RQRRTERNHT

1151 PYHDTQLFTH DFDTPVSVIQ QNAASPSFQP AASAIKLIDG VSTAAVNGQR

1201 IHTGNVVSLN NATVTLPNSS LYTTHPDNKG WLVETDPQFA DYRRWLGSDY

1251 MLQQLQLDTN HLHKRLGDGY YEQKLVNEQI HQLTGYRRLD GYRSDEEQFK
```

-continued

```
1301 ALMDNGLTAA KTFGLTPGIA LSAEQVARLT SDIVWMENQT VTLSDGSTQT

1351 VLVPKVYALA RKGDLNTSGG LISAEQVLLK LQNGNLTNSG TIAGRQAVLI

1401 QARNINSNGN IQADQIGLKA EKSINIDGGQ VQAGRLLTAQ AQNINLNGTT

1451 QTSGNERNGN TAIDRMAGIN VVGSHTEQVD NRTSDGILSL HASNDINLNA

1501 ATVSNQVKDG TTQITAGNNL NLGTIRTEHR EAYGTLDDEN HRHVRQSTEV

1551 GSSIRTQNGA LLRAGNDLKI RQGELEAEEG KTVLAAGRDV TISEGRQITE

1601 LDTSVSGKSK GILSSTKTHD RYRFSHDEAV GSNIGGGKMI VAAGQDINVR

1651 GSNLISDKGI VLKAGHDIDI STAHNRYTGN EYHESKKSGV MGTGGLGFTI

1701 GNRKTTDDTD RTNIVHTGSI IGSLNGDTVT VAGNRYRQTG STVSSPEGRN

1751 TVTAKSIDVE FANNRYATDY AHTEQKGLT VALNVPVVQA AQNFIQAAQN

1801 VGKSKNKRVN AMAAANAAWQ SYQATQQMQQ FAPSSSAGQG QNNNQSPSIS

1851 VSITYGEQKS RNEQKRHYTE AAASQIIGKG QTTLAATGSG EQSNINITGS

1901 DVIGHAGTAL IADNHIRLQS AKQDGSEQSK NKSSGWNAGV AVKIGNGIRF

1951 GITAGGNIGK GKEQGGSTTH RHTHVGSTTG KTTIRSGGDT TLKGVQLIGK

2001 GIQADTRNLH IESVQDTETY QSKQQNGNVQ VTVGYGFSAS GSYRQSKVKA

2051 DHASVTGQSG IYAGEDGYQI KVRDNTDLKG GIITSSQSAE DKGKNLFQTA

2101 TLTASDIQNH SRYEGRSFGI GGSFDLNGGW DGTVTDKQGR PTDRISPAAG

2151 YGSDGDSKNS TTRSGVNTHN IHITDEAGQL ARTGRTAKET EARIYTGIDT

2201 ETADQHSGHL KNSFDKDAVA KEINLQREVT KEFGRNAAQA VAAVADKLGN

2251 TQSYERYQEA RTLLEAELQN TDSEAEKAAF RASLGQVNAY LAENQSRYDT

2301 WKEGGIGRSI LHGAAGGLTT GSLGGILAGG GTSLAAPYLD KAAENLGPAG

2351 KAAVNALGGA AIGYATGGSG GAVVGANVDW NNRQLHPKEM ALADKYAEAL

2401 KREVEKREGR KISSQEAAMR IRRQILRWVD KGSQDGYTDQ SVISLIGMKG

2451 EDKALGYTWD YRDYGARNPQ TYNDPKLFEE YRRQDKPEYR NLTWLHSGTK

2501 DTKIRQGERK NEEFALNVAE GLTSLVNPNP RIKVPILAGI RNLKNIKPTV

2551 TGSDPLLAGA GNIRIPANGN VAKGDRIPDT ALASKGIKHK DRKDQLEKK*
```

Computer analysis of this amino acid sequence gave the following results:
Homology with a Predicted ORF from *N. gonorrhoeae*

```
m564/fha

ID        FHAB_BORPE STANDARD; PRT; 3591 AA.

AC        P12255;

DT        01-OCT-1989 (REL. 12, CREATED)

DT        01-FEB-1996 (REL. 33, LAST SEQUENCE UPDATE)

DT        01-FEB-1996 (REL. 33, LAST ANNOTATION UPDATE)

DE        FILAMENTOUS HEMAGGLUTININ...

SCORES    Initl: 190 Initn: 524 Opt: 594
Smith-
Waterman
score:    866; 21.7% identity in 2427 aa overlap
```

-continued

```
                10        20        30        40        50        60
m564.pep    MNRTLYKVVFNKHRNCMIAVAENAKREGKNTADTQAVGILPNDIAGFAGFIHSISVISFS
            ||  :||::  |::   |:|:   | ||    ::   ||     ::   |:|::||:|
fhab_borpe  MNTNLYRLVFSHVRGMLVPVSEHCTV-G-NTFCGRTRG---QARSGARATSLSVAPNALA
                10        20        30         40         50

70        80        90       100       110      119
m564.pep    LSLLLG-SALILTSSSATAQGIVADKSAPAQQQPTILQTGNGIPQVNIQTPTSAGVSVNQ
            :|:|: ::|  |::     |||:|     |||    ::|| ||  |||    |:|||  |:
fhab_borpe  WALMLACTGLPLVTH---AQGLV-----P-QGQTQVLQGGNKVPVVNIADPNSGGVSHNK
              60        70            80         90       100

120       130       140       150       160       170      179
m564.pep    YAQFDVGNRGAILNNSRSNTQTQLGGWIQGNPWLARGEARVVVNQINSSHSSQLNGYIEV
            : ||:|:| |:::||:  :: ||  :   ||  |: |:   ::: :::::   |:|  | :||
fhab_borpe  FQQFNVANPGVVFNNGLTDGVSRIGGALTKNPNLTR-QASAILAEVTDTSPSRLAGTLEV
               110       120       130       140        150       160

180       190       200       210       220       230      239
m564.pep    GGRRAEVVIANPAGIAVNGGGFINASRATLTTAQPQYQAGDLSGFKIRQGNVVIAGHGLD
            |:  |:::||||  ||:|||   : :|||    ||||::|:   ::: |:   |: ::||:|   |::
fhab_borpe  YGKGADLIIANPNGISVNGLSTLNASNLTLTTGRPSVNGGRI-GLDVQQGTVTIERGGVN
               170       180       190       200       210       220

240       250       260       270       280       290
m564.pep    ARDTDYTRILSYHSKIDAPV---WGQ---DVRVVAGQNDVAATGDAHSPILNNAAANTSN
            |         |:::      |:::  |     |:   |:  ||||              ::||   ||:: :
fhab_borpe  ATGLGYFDVVARLVKLQGAVSSKQGKPLADIAVVAGANRYDHATRRATPI----AAGARG
               230       240       250       260       270       280

300       310       320       330       340       350
m564.pep    NTANNGTHIPLFAIDTGKLGGMYANKITLISTVEQAGIRNQGQWFASAGNVAVNAEGKLV
            : |:     :|||        |:|:|::||||:|:     |:|:    :|||::|||::|
fhab_borpe  AAAGA------YAIDGTAAGAMYGKHITLVSSDSGLGVRQLGS-LSSPSAITVSSQGEIA
                         290       300       310       320       330

360       370       380       390       400       410
m564.pep    NTGMIAATGENHAVSLHARNVHNSGTVASQDDANIHSQTLDNSGTVLSSGRLTVRNLGRL
             :  ||  :  :||::  :|   :||    ::  :::|:|         :      ::   ::|    |
fhab_borpe  ---LGDATVQRGPLSLKGAGVVSAGKLASGGGAV----NVAGGGAVKIA---SASSVGNL
                  340       350       360           370       380

420       430       440       450       460       470
m564.pep    KNQNNGTIQAARLDMSTGGLDNTGNITQTGSQALDLVSAGKFDNSGKIGVSDVPQTGLNP
             |::   :||   |: :   |      |::   :|  |||:: :|::: :   :   :::   |:
fhab_borpe  AVQGGGKVQATLLNAG-------GTLLVSGRQAVQLGAASSRQALSVNAGGALKADKLSA
               390       400              410       420       430

480       490       500       510       520       530
m564.pep    NPSV-IPQIPSTATGSGSSTVSVSKPGSNNPVSPTAPAKNYAVGRIQTTGAFD-NAGSIN
             :    |:      ::| ||:||::     :  |:       :|  |:||:::    | :   :||:
fhab_borpe  TRRVDVDGKQAVALGSASSNALSVRAGGA-----LKAGKLSATGRLDVDGKQAVTLGSVA
               440       450       460            470       480       490

540       550        55     560          570       579
m564.pep    AGGQIDIAAQNGLGNSGSLNAAKLRVSG------DSFNNT------VKGKLQAHDLAVNT
             :  |  :::::| ::|      :::|:|:|  |         |::|: |    |:::|:|:|:|
fhab_borpe  SDGALSVSAGGNLRANELVSSAQLEVRGQREVALDDASSARGMTVVAAGALAARNLQSKG
               500       510       520       530       540       550

580       590       600       610       620       630
m564.pep    QTAKNSGHLLTQTGKIDNRELH--NAGEIAANNLTLIHSGRLSNDKKGNIRAAHLQLDTA
             :  :::|:     ::  ::  ::   ||    : |  ::::  ::|| |||    || ::|   |
fhab_borpe  AIGVQGGEAVSVANANSDAELRVRGRGQVDLHDLSAARGADISGEGRVNIGRARSDSDVK
               560       570       580       590       600       610

640       650       660       670       680       690
m564.pep    GLHNAGNILADSGTVTTKNNLRNTGKVSVARLNTEGQTLDNTRGRIEAETVNIQSQQLTN
              :    | : || |:   ::: :|||  : ::|: : :     |    :|||:: :  |
fhab_borpe  -VSAHGALSIDSMTALGAIGVQAGGSVSAKDMRSRGAVTVSGGG-----AVNLGDVQ---
                620       630       640       650       660
```

-continued

```
              700        710        720        730        740        750
m564.pep    QSGHITATEQLTINSRNVDNQNGKLLSANQAQLAVSDGLYNQHGEIATNRQLSIHDKNQN
            ::|::  ||   :::   |:|       |   |:||::  |    |  |   :  :   :::: ::
fhab_borpe  SDGQVRATSAGAMTVRDV---------AAAADLALQAGDALQAGFLKSAGAMTVNGRDAV
                    670        680              690        700        710

760        770        780        790        800        810
m564.pep    TLALNNADGTIQSAGNVSLQAKSLANNGTLTAGNKLDIALTDDFVVERDLTAGKQL-NLS
            |      ||: :::|:: :::  :   |    |:|:|   ::|: ::    :|    :|   |:|
fhab_borpe  RL-----DGA-HAGGQLRVSSDGQAALGSLAAKGELTVSAARAATVA-EL---KSLDNIS
                         720        730        740        750        760

820        830        840        850        860        870
m564.pep    IKGRLK-NTHTLQAGHTLKLNA-GNIDNQVTGKIIGGEQTDITSEQHVDNRGLINSDGLT
            :  |  :  :::::::::  :  ::|   | |:|  :|||:   : :::  |     :  |  :::|:|
fhab_borpe  VTGGERVSVQSVNSASRVAISAHGALD---VGKV--SAKSGIGLE----GWGAVGADSL-
                 770        780        790        800        810

880        890        900        910        920        930
m564.pep    HIGAGQTLTNTGTGKIYGNHIALDAQILLNREETTEGSTKAGAIAARKRLDI-GAKEIHN
            |:   :::  :::  :|    :   ::     |:||:    ||:|     :|:  |::  :
fhab_borpe  --GSDGAISVSGRDAVRVDQARSLADISLG----AEGGATLGAVEAAGSIDVRGGSTV--
                  820        830        840        850        860

940        950        960        970        980        990
m564.pep    QEGALLSSEGIFAVGNRLDEQHHAAGMADTFVNGSAGLEVQGDALMSVRNMQNINNHFKT
            ::|  :::   :  :|:  :   ::  ::   |:|        ::|  :|::|     ::
fhab_borpe  AANSLHANRDVRVSGK--DAVRVTAATSGGGLHVSSGRQLDLGAVQA-RGALALDGGAGV
                  870        880        890        900        910        920

1000       1010       1020       1030       1040       1050
m564.pep    ETYLAKAEK--QVRDYTVLGQNTYYQAGKDGLFDNSQGQKDQTTATFHLKNGSRIEANQ-
            |||     :|:        |     :|      :|         :|       :|  ::|      : ::|::
fhab_borpe  ALQSAKASGTLHVQGGEHLDLGTLAAVGAVDV----NGTGDVRVAKLVSDAGADLQAGRS
                     930        940        950        960        970

1060       1070       1080       1090       1100
m564.pep    --WHVRDYHIETYKERIIENRPAHITVGGDLTASGQNWLNKDSRIVVGGRIITDDLNQKE
              :       :          :     :  :::      |  |  |::  |:      :  |:|:    :|
fhab_borpe  MTLGIVDTTGDLQARAQQKLELGSVKSDGGLQAAAGGALSLAAAEVAGALELS---GQGV
                 980        990       1000       1010       1020       1030

1110       1120       1130       1140       1150       1160
m564.pep    ITNQSTTGKGRTDAVGTQWDSVTKKGWY--SGRKRQRRTERNHTPYHDTQLFTHDFDTPV
            ::::::::::|  |::|:    ::    ||        ::    :|  |||:  |                :||  ||
fhab_borpe  TVDRASASRARIDSTGSVGIGALKAGAVEAASPRRARRALR------------QDFFTPG
                 1040       1050       1060       1070              1080

1170       1180       1190       1200       1210       1220
m564.pep    SVI---QQNAASPSFQPAASAIKLIDGVSTAAVNGQRIHTGNVVSLNNATVTLPNSSLYT
            ||:     |   |::  :|     :|      :|::  |       |  :|:|||:  |      :
fhab_borpe  SVVVRAQGNVTVGRGDPHQGVLAQGDIIMDA--KGGTLLLRNDALTENGTVTISADSAVL
                 1090       1100       1110       1120       1130       1140

1230       1240       1250       1260       1270       1280
m564.pep    THPDNKGWLVETD-PQFADYRRWLGSDYMLQQLQLDTNHLHKRLGDGYYEQKLVNEQIHQ
            |      ::  : ::      :|   |    :       |    :  ::||          :  :::|            :: :  :||
fhab_borpe  EHSTIESKISQSVLAAKGDKGKPAVSVKVAKKLFL--NGTLRAVNDN--NETMSGRQIDV
                 1150       1160       1170       1180       1190

1290       1300       1310       1320       1330       1340
m564.pep    LTGYRRLDGYRSDEEQFKALMDNGLTAAKTFGLTPG-IALSAEQVARLTSDIVWMENQTV
              :   |    ::     :|    :|  |::::: ::     | |::  |  :::  ::      :|:
fhab_borpe  VDGRPQI----TDAVTGEARKDESVVSDAALVADGGPIVVEAGELVSHAGGIGNGRNK--
                 1200       1210       1220       1230       1240       1250

1350       1360       1370       1380       1390       1400
m564.pep    TLSDGSTQTVLVPKVYALARKGDLNTSGGLISAEQVLLKLQNGNLTNSGTIAGRQAVLIQ
              :|:: || :        |:|  ::   :  :::| :|::  :|   |||      :::     :  |:
fhab_borpe  --ENGASVTVRTT--------GNLVNKGYISAGKQGVLEV-GGALTNEFLVGSDGTQRIE
                       1260       1270       1280       1290       1300

1410       1420       1430       1440       1450
m564.pep    ARNINSNGNIQ-------ADQIGLKAEKSINIDGGQVQAGRLLTAQ----AQNINLNGTT
            |:  | ::  |::          |       :  :||  ::| ||                |
fhab_borpe  AQRIENRGTFQSQAPAGTAGALVVKAAEAIVHDGVMATKGEMQIAGKGGGSPTVTAGAKA
                 1310       1320       1330       1340       1350       1360
```

-continued

```
              1460       1470       1480       1490       1500
m564.pep    QTSGNERNGNTAI-DRMAGINVV-GSHTEQVDNRTSD-GILSLHASNDINLNAATVSNQV
             ||:|: : ::|   |    | :::::  |:  :|::  :: |:::    ||
fhab_borpe  TTSANKLSVDVASWDNAGSLDIKKGGAQVTVAGRYAEHGEVSIQGDYTVSADAIALAAQV
              1370       1380       1390       1400       1410       1420

1510       1520       1530       1540            1550
m564.pep    --KDGTTQITAGNNLNLGT-IRTE---HREAYGTLDDENHRHVRQST---------EVGS
              : |::::|: :: ::: ||   ::| | ::: ::  :||:::        |:|:
fhab_borpe  TQRGGAANLTSRHDTRFSNKIRLMGPLQVNAGGPVSNTGNLKVREGVTVTAASFDNETGA
              1430       1440       1450       1460       1470       1480

1560       1570       1580       1590       1600
m564.pep    SIRTQNGALLRAGNDLKIRQGELEAEEGKTVLAAGRDV--TISEGRQITELDTS---VSG
             :  :::::|  :|   :   |::::::|: ::||: :   |:: |:::||  :: :  |
fhab_borpe  EVMAKSATLTTSGAARN--AGKMQVKEAATIVAASVSNPGTFTAGKDITVTSRGGFDNEG
              1490       1500       1510       1520       1530

1610       1620       1630       1640       1650       1660
m564.pep    K---SKGILSSTKTHDRYRF---SHDEAV-GSNIGGGKMIVAAGQDINVRGSNLISDKGI
             |   :|  |: ::  :    :||  :| :|: :    :  ||:|::|::: :    |::
fhab_borpe  KMESNKDIVIKTEQFSNGRVLDAKHDLTVTASGQADNRGSLKAGHDFTVQAQRI--DNSG
            1540        1550       1560       1570       1580       1590

1670       16    1680       1690       1700       1710
m564.pep    VLKAGHDIDISTAHNRYTG-----NEYHESKKSGVMGTGGLGFTIGNRKTTDDTDRTNIV
             ::  ||||    :::  ||     | ::   |  :||   : |  :     ::
fhab_borpe  TMAAGHDATLKAPHLRNTGQVVAGHDIHIINSAKLENTGRV--DARNDIALDVADFTN--
             1600       1610       1620       1630       1640       1650

1720       1730       1    1740       1750       1760       1770
m564.pep    HTGSIIGSLNGDTVTVAGNRYRQT----GSTVSSPEGRNTVTAKSIDVEFANNRYATDYA
             |||: :  ::|:|:|| | :       ::   ||   :||| |||| :|: :: :: |
fhab_borpe  -TGSLYAEHDA-TLTLAQGTQRDLVVDQDHILPVAEGTLRVKAKSLTTEIETGNPGSLIA
             1660       1670       1680       1690       1700       1710

1780       1790       1800       1810       1820       1830
m564.pep    HTQEQKGLTVALNVPVVQAAQNFIQAAQNVGKSKNKRVNAMAAANAA-WQSYQATQQMQQ
             ::||        |:  ||    | :::::  | : :|   |||   |||    |: :|:
fhab_borpe  EVQE--------NIDNKQA----IVVGKDLTLS-SAHGNVANEANALLWAAGELTVKAQN
                       1720       1730       1740       1750

1840       1850       1860       1870       1880       1890
m564.pep    FAPSSSAGQGQNNNQSPSISVSITYGEQKSRNEQKRHYTEAAASQIIGKGQTTLAATGSG
             :: : :|      :|    : :|::   :  | |   |   |:|   ::|    :|
fhab_borpe  ITNKRAALIEAGGNARLTAAVALLNKLGRIRAGEDMHLD---APRI----ENTAKLSGEV
              1760       1770       1780       1790       1800       1810

1900       1910       1920       1930       1940       1950
m564.pep    EQSNINITGSDVIGHAGTALIADNHIRLQSAKQDGSEQSKNKSSGWNAGVAVKIGNGIRF
             ::::::  :|:           ::  |  ::| |:   | |:
fhab_borpe  QRKGVQDVGGGEHGRWSGIGYVNYWLRAGNGKKAGT-----IAAPWYGGDLTAEQSLIEV
              1820       1830       1840       1850       1860

1960       1970       1980       1990       2000       2010
m564.pep    GITAGGNIGKGKEQGGSTTHRHTHVGSTTGKTTIRSGGDTTLKGVQLIGKGIQADTRNLH
             |      |||  |::    |||      ::  :|::||    :  |       ::|:|::
fhab_borpe  GKDLYLNAGARKDE-----HRHL-----LNEGVIQAGGHGHIGG--------DVDNRSV-
              1870       1880       1890       1900

2020       2030       2040       2050       2060
m564.pep    IESVQDTETYQSKQQNGNVQVTVGYGFSASGSYRQSKVKA-----DHASVTGQSGIYAGE
             :::|: |  :::    : :   |:|   ||     |:    ||    |:   |:|
fhab_borpe  VRTVSAMEYFKTPLPVSLTALDNRAGLSPATWNFQSTYELLDYLLDQNRYEYIWGLYPTY
              1910       1920       1930       1940       1950       1960

2070       2080       2090       2100       2110       2120
m564.pep    DGYQIKVRDNTDLKGGIITSSQSAEDKGKNLFQTATLTASDIQNHS--RYEGRSFGIGGS
             :::::  |||   :|  : :|     |:|::|:     |||::  :|
fhab_borpe  TEWSVNTLKNLDL-GYQAKPAPTAPPMPKA-------PELDLRGHTLESAEGRKI-FGEY
             1970       1980       1990       2000       2010

2130       2140       2150       2160       2170
m564.pep    FDLNGGWDGT-----VTDKQGRPTDRISPAAGYGSDGDSKNSTTRSGVNTHNIHITDEAG
             |:|:: :        ::   :::    ::  :   |   |: |   :|
fhab_borpe  KKLQGEYEKAKMAVQAVEAYGEATRRVHDQLG------QRYGKALGGMDAETKEVDGIIQ
             2020       2030       2040       2050       2060       2070
```

-continued

```
              2180       2190       2200       2210       2220       2230
  m564.pep    QLARTGRTAKETEARIYTGIDTETADQHSGHLKNSFDKDAVAKEINLQREVTKEFGRNAA
              ::|    ||:      :|    |  ||:|| |: : : |:::|   ||  :   :||  ::: :
  fhab_borpe  EFAADLRTVYAKQADQAT-IDAET-DKVAQRYKSQID--AVRLQAIQPGRVT--LAKALS
                   2080       2090       2100       2110       2120

2240       2250       2260       2270       2280       2290
  m564.pep    QAVAAVADKLGNTQSYERYQEARTLLE-AELQNTDSEAEKAAFRASLGQVNAYL------
              |::|     ||::|  ::|::: ::   :  ||:    :|     |   |:|   |: :
  fhab_borpe  AALGADWRALGHSQLMQRWKDFKAGKRGAEIAFYPKEQTVLAAGAGLTLSNGAIHNGENA
                   2130       2140       2150       2160       2170       2180

2300       2310       2320       2330       2340       2350
  m564.pep    AENQSRYDTWKEGGIGRSILHGAAGGLTTGSLGGILAGGGTSLAAPYLDKAAENLGPAGK
              |:|:::|  :   ||: :   |  :|  |:|
  fhab_borpe  AQNRGRPEGLKIGAHSATSVSGSFDALRDVGLEKRLDIDDALAAVLVNPHIFTRIGAAQT
                   2190       2200       2210       2220       2230       2240
```

The following partial DNA sequence was identified in *N. gonorrhoeae* <SEQ ID 1671>:

```
g565.seq
   1 atggacagca cattgtctaa aacgtgttgc gtttcgtgca tattgttgag 51 cgtaaccacc accattttcg cccgtcccag accggcggct tccaatactt 101 ccctgcgttt cgcatcgccg aacgacaccg gctcgcctgc acttctggct 151 acctgcacgc gtgcgatgtc caagtcgagc gcgaaatacg gaatatcctc 201 tttgggcgaa gacgcgtccg accgtctgcc cgcccctgcc gaagccgaca 251 atcagcacat gatcagactt gctcatcgct tccaccaaca tgctgtgcag 301 atcgagcgac ttcatgtccc agcttga
```

This corresponds to the amino acid sequence <SEQ ID 1672; ORF 565.ng>:

```
g565.pep
   1 MDSTLSKTCC VSCILLSVTT TIFARPRPAA SNTSLRFASP NDTGSPALLA

51 TCTRAMSKSS AKYGISSLGE DASDRLPAPA EADNQHMIRL AHRFHQHAVQ

101 IERLHVPA*
```

The following partial DNA sequence was identified in *N. meningitidis* <SEQ ID 1673>:

```
m565.seq
   1 ATGGACAGCA CATTGTCTAA AACGTGTTGC GTTTCGTGCA TATTGTTGAG

51 CGTAACCACC ACCATTTTCG CCCGTCCCAG ACCGGCGGCT TCCAATACTT

101 CCCTGCGTTT CGCATCGCCG AACGACACCG GTTCGCCCGC ACTTCTGGCA

151 ACCTGCACCC GCGCAATGTC CAAGTCGAGC GCGAAATACG GAATATCCTC

201 TTGGGCAAGG ACGCGTCCGA CCGTCTGCCC GCCCCTGCCG AAGCCGACAA

251 TCAGCACATG GTCGGACTTG CTCATGGTTT CTACCAGCAT ACTGTGCAGA

301 TCGAGCGACT TCATGTCCCA GCTTGACTTG ACCAAACGCC CGACCAGCGC

351 ATCGCTGCCG CCCAAGAGGA AGGGCGCGAT AATCATCGAC AGCAGAACCG

401 CCGCCGTCGC CGCCTGTTCC CATTCTGGCG AAACCATATC AAGCTGCCCG

451 GCAATGGCCA GCATCACGAA GCCGAACTCG CCGCCCTGCG CGAGATACAA

501 AGCCGTTTTG AGGCTGTCGC CGACCGAATG TTTCATTTTG AAGGCAATGG
```

```
551 CAAACACAAC CAGTGCCTTC AACACCAGCA GCATTGCCAA CAGCATCAAT

601 ACCTGCCGCC AGCCGCCGAT CAATGCCTGA
```

This corresponds to the amino acid sequence <SEQ ID 1674; ORF 565>:

```
m565.pep
  1 MDSTLSKTCC VSCILLSVTT TIFARPRPAA SNTSLRFASP NDTGSPALLA

51 TCTRAMSKSS AKYGISSWAR TRPTVCPPLP KPTISTWSDL LMVSTSILCR

101 SSDFMSQLDL TKRPTSASLP PKRKGAIIID SRTAAVAACS HSGETISSCP

151 AMASITKPNS PPCARYKAVL RLSPTECFIL KAMANTTSAF NTSSIANSIN

201 TCRQPPINA*
```

Computer analysis of this amino acid sequence gave the following results:
Homology with a Predicted ORF from *N. gonorrhoeae*

```
    m565/g565 100.0% identity in 67 aa overlap 10        20        30        40        50        60
    m565.pep MDSTLSKTCCVSCILLSVTTTIFARPRPAASNTSLRFASPNDTGSPALLATCTRAMSKSS
             ||||||||||||||||||||||||||||||||||||||||||||||||||||||||||||
        g565 MDSTLSKTCCVSCILLSVTTTIFARPRPAASNTSLRFASPNDTGSPALLATCTRAMSKSS
                   10        20        30        40        50        60

70        80        90       100       110       120
    m565.pep AKYGISSWARTRPTVCPPLPKPTISTWSDLLMVSTSILCRSSDFMSQLDLTKRPRSASLP
             |||||||
        g565 AKYGISSLGEDASDRLPAPAEADNQHMIRLAHRFHQHAVQIERLHVPAX
```

The following partial DNA sequence was identified in *N. meningitidis* <SEQ ID 1675>:

```
a565.seq
  1 ATGGACAGCA CATTGTCTAA AACGTGTTGC GTTTCGTGCA TATTGTTGAG

51 CGTAACCACC ACCATTTTCG CCCGTCCCAG ACCGGCGGCT TCCAATACTT

101 CCCTGCGTTT CGCATCGCCG AACGACACCG GTTCGCCCGC ACTTCTGGCA

151 ACCTGCACCC GCGCAATGTC CAAGTCGAGC GCGAAATACG GAATATCCTC

201 TTGGGCAAGG ACGCGTCCGA CCGTCTGCCC GCCCCTGCCG AAGCCGACAA

251 TCAGCACATG GTCGGACTTG CTCATGGTTT CTACCAGCAT ACTGTGCAGA

301 TCGAGCGACT TCATGTCCCA GCTTGACTTG ACCAAACGCC CGACCAGTGC

351 ATCGCTGCCG CCCAAGAGGA AGGGCGCGAT AATCATCGAC AGCAGAACCG

401 CCGCCGTCGC CGCCTGTTCC CATTCTAGCG AAACCATATC AAGCTGCCCG

451 GCAATGGCCA GCATCACGAA GCCGAACTCG CCGCCCTGCG CGAGATACAA

501 AGCCGTTTTG AGGCTGTCGC CGACCGAATG TTTCATTTTG AAGGCAATGG

551 CAAACACAAC CAGTGCCTTC AACACCAGCA GCATTGCCAA CAGCATCAAT

601 ACCTGCCGCC AGCCGCCGAT TAATGCCTGA
```

This corresponds to the amino acid sequence <SEQ ID 1676; ORF 565.a>:

```
a565.pep

1  MDSTLSKTCC VSCILLSVTT TIFARPRPAA SNTSLRFASP NDTGSPALLA

51  TCTRAMSKSS AKYGISSWAR TRPTVCPPLP KPTISTWSDL LMVSTSILCR

101  SSDFMSQLDL TKRPTSASLP PKRKGAIIID SRTAAVAACS HSSETISSCP

151  AMASITKPNS PPCARYKAVL RLSPTECFIL KAMANTTSAF NTSSIANSIN

201  TCRQPPINA* m565/a565  99.5% identity in 209 aa overlap 10         20         30         40         50         60
m565.pep  MDSTLSKTCCVSCILLSVTTTIFARPRPAASNTSLRFASPNDTGSPALLATCTRAMSKSS
          ||||||||||||||||||||||||||||||||||||||||||||||||||||||||||||
a565      MDSTLSKTCCVSCILLSVTTTIFARPRPAASNTSLRFASPNDTGSPALLATCTRAMSKSS
                  10         20         30         40         50         60

70         80         90        100        110        120
m565.pep  AKYGISSWARTRPTVCPPLPKPTISTWSDLLMVSTSILCRSSDFMSQLDLTKRPTSASLP
          ||||||||||||||||||||||||||||||||||||||||||||||||||||||||||||
a565      AKYGISSWARTRPTVCPPLPKPTISTWSDLLMVSTSILCRSSDFMSQLDLTKRPTSASLP
                  70         80         90        100        110        120

130        140        150        160        170        180
m565.pep  PKRKGAIIIDSRTAAVAACSHSGETISSCPAMASITKPNSPPCARYKAVLRLSPTECFIL
          |||||||||||||||||||||||||:||||||||||||||||||||||||||||||||||
a565      PKRKGAIIIDSRTAAVAACSHSSETISSCPAMASITKPNSPPCARYKAVLRLSPTECFIL
                 130        140        150        160        170        180

190        200        210
m565.pep  KAMANTTSAFNTSSIANSINTCRQPPINAX
          |||||||||||||||||||||||||||||
a565      KAMANTTSAFNTSSIANSINTCRQPPINAX
                 190        200        210
```

The following partial DNA sequence was identified in *N. gonorrhoeae* <SEQ ID 1677>:

```
g566.seq..
    1 atgccgtctg aacaatatct tttcagacgg cattttgtat gggggttaac 51 ggttgttcag cccgagtacg tcctgcatat cgtacaaacc cgttttgccg 101 tttacccaaa ctgcggcgcg gacggcaccg gcggcaaagg tcatgcggct 151 gccggctttg tgggtgattt ccacgcgttc gccgtcggtg gcgaagaggg 201 cggtgtggtc gccgactatg tcgcctgcgc ggacggtggc aaagccgatg 251 gtggaaggat cgcgcggacc agtgtggcct tcgcggccgt aaacggcgca 301 ttgtttgagg tcgcggccga gcgcgccggc gatgacttcg cccattcgta 351 a
```

This corresponds to the amino acid sequence <SEQ ID 1678; ORF 566.ng>:

```
g566.pep..

1  MPSEQYLFRR HFVWGLTVVQ PEYVLHIVQT RFAVYPNCGA DGTGGKGHAA

51  AGFVGDFHAF AVGGEEGGVV ADYVACADGG KADGGRIART SVAFAAVNGA

101  LFEVAAERAG DDFAHS*
```

The following partial DNA sequence was identified in *N. meningitidis* <SEQ ID 1679>:

```
m566.seq..
    1 ATGCCGTCTG AACAATATCT TTTCAGACGG CATTTTGTAT GGGGGTTAAC

51 GGTTGTTCAG CCCGAGTACG TCCTGCATAT CGTACAAACC CGTTTTGCCG

101 TTGACCCAAA CTGCGGCGCG GACGGCACCG GCGGCAAAGG TCATGCGGCT

151 GCTGGCCTTG TGGGTGATTT CCACGCGCTC GCCGTCGGTG GCGAAGAGGG

201 CGGTGTGGTC GCCGACGATG TCGCCTGCGC GGACGGTGGC AAAGCCGATG

251 GTCGACGGAT CGCGCGGACC GGTGTGGCCT TCGCGGCCGT AAACGGCGCA

301 TTGTTTGAGG TCTCTGCCGA GCGCGCCGGC GATGACTTCG CCCATGCGTA

351 A
```

This corresponds to the amino acid sequence <SEQ ID 1680; ORF 566>:

```
m566.pep..
    1 MPSEQYLFRR HFVWGLTVVQ PEYVLHIVQT RFAVDPNCGA DGTGGKGHAA

51 AGLVGDFHAL AVGGEEGGVV ADDVACADGG KADGRRIART GVAFAAVNGA

101 LFEVSAERAG DDFAHA*
```

Computer analysis of this amino acid sequence gave the following results:
Homology with a Predicted ORF from *N. gonorrhoeae*

```
    m566/g566 93.1% identity in 116 aa overlap 10         20         30         40         50         60
    m566.pep MPSEQYLFRRHFVWGLTVVQPEYVLHIVQTRFAVDPNCGADGTGGKGHAAAGLVFDFHAL
             ||||||||||||||||||||||||||||||||| |||||||||||||||| ||||||:
       g566 MPSEQYLFRRHFVWGLTVVQPEYVLHIVQTRFAVYPNCGADGTGGKGHAAAGFVFDFHAF
                 10         20         30         40         50         60

70         80         90        100        110
    m566.pep AVGGEEGGVVADDVACADGGKADGRRIARTGVAFAAVNGALFEVSAERAGDDFAHAX
             ||||||||||||  ||||||||||||||||||:||||||||||||| |||||||||:|
       g566 AVGGEEGGVVADYVACADGGKADGGRIARTSVAFAAVNGALFEVAAERAGDDFAHSX
                 70         80         90        100        110
```

The following partial DNA sequence was identified in *N. meningitidis* <SEQ ID 1681>:

```
a566.seq
    1 ATGCCGTCTG AACAATATCT TTTCAGACGG CATTTTGTAT GGGGGTTAAC

51 GGTTGTTCAG CCCGAGTACG TCCTGCATAT CGTACAAACC CGTTTTACCG

101 TTTACCCAAA CTGCGGCGCG GACGGCGCCG GCGGCAAAGG TCATGCGGCT

151 GCTTGCCTTG TGGGTGATTT CCACGCGCTC GCCGTCGGTG GCGAAGAGGG

201 CGGTGTGGTC GCCGACGATG TCGCCCGCGC GGACGGTGGC AAAGCCGATG

251 GTGGACGGAT CGCGCGGGCC GGTGTGGCCT TCGCGGCCGT AAACGGCGCA

301 TTGTTTGAGG TCTCTGCCGA GCGCGCCGGC GATGACTTCG CCCATGCGTA

351 A
```

This corresponds to the amino acid sequence <SEQ ID 1682; ORF 566.a>:

```
a556.pep
    1 MPSEQYLFRR HFVWGLTVVQ PEYVLHIVQT RFTVYPNCGA DGAGGKGHAA

51 ACLVGDFHAL AVGGEEGGVV ADDVARADGG KADGGRIARI GVAFAAVNGA

101 LFEVSAERAG DDFAHA* m566/a566 94.0% identity in 116 aa overlap
                   10        20        30        40        50        60
     m566.pep MPSEQYLFRRHFVWGLTVVQPEYVLHIVQTRFAVDPNCGADGTGGKGHAAAGLVGDFHAL
              ||||||:||||||||||||||||||||||||:|||||||||:||||||||:||||||||
         a566 MPSEQYLFRRHFVWGLTVVQPEYVLHIVQTRFTVDPNCGADGAGGKGHAAACLVGDFHAL
                   10        20        30        40        50        60

70        80        90       100       110
     m566.pep AVGGEEGGVVADDVACADGGKADGRRIARTGVAFAAVNGALFEVSAERAGDDRAGAX
              ||||||||||||||| ||||||||| ||||:||||||||||||||||||||||||||
         a566 AVGGEEGGVVADDVARADGGKADGGRIARAGVAFAAVNGALFEVSAERAGDDRAGAX
                   70        80        90       100       110
```

The following partial DNA sequence was identified in *N. gonorrhoeae* <SEQ ID 1683>:

```
g567.seq..
    1 atgcgacgac gggcagcggc atcgacaagg cgggtttgca gtccggcgtt 51 tatcaggtct tattgggcga tgcggacgtg cagtcggcgg cggtacgcag 101 caaagagggc ggatacggcg tgttgggtgc gaacgcgcgc gcttgccggc 151 gcggaaatcg agctggtgca ggaaatcgcc cgggaagtgc gtttgaaaaa 201 cgcgctcaag gcagtggcgg aagattacga ctttatcctg atcgactgtc 251 cgccttcgct gacgctgttg acgcttaacg gcttggtggc ggcgggcggc 301 gtgattgtgc cgatgttgtg cgaatattac gcgctggaag ggatttccga 351 tttgattgcg accgtgcgca aaatccgtca ggcggtcaat cccgatttgg 401 acatcacggg catcgtgcgt acgatgtacg acagccgcag caggctggtt 451 gccgaagtca gcgaacagtt gcgcagccat ttcgggatt tgcttttga 501 aaccgccatc ccgcgcaata tccgccttgc ggaagcgccg agccacggta 551 tgccggtgat ggcttacgac gcgcaggcaa agggtgccaa ggcgtatctt 601 gccttggcgg acgaactggc ggcgagggtg tcggggaaat ag
```

This corresponds to the amino acid sequence <SEQ ID 1684; ORF 567.ng>:

```
g567.pep
    1 MRRRAAASTR RVCSPAFIRS YWAMRTCSRR RYAAKRADTA CWVRTRALAG

51 AEIELVQEIA REVRLKNALK AVAEDYDFIL IDCPPSLTLL TLNGLVAAGG

101 VIVPMLCEYY ALEGISDLIA TVRKIRQAVN PDLDITGIVR TMYDSRSRLV

151 AEVSEQLRSH FGDLLFETAI PRNIRLAEAP SHGMPVMAYD AQAKGAKAYL

201 ALADELAARV SGK*
```

60

The following partial DNA sequence was identified in *N. meningitidis* <SEQ ID 1685>:

```
m567.seq..
    1 ATGAGTGCGA ACATCCTTGC CATCGCCAAT CAGAAGGGCG GTGTGGGCAA
```

-continued

```
 51 AACGACGACG ACGGTAAATT TGGCGGCTTC GCTGGCATCG CGCGGCAAAC

101 GCGTGCTGGT GGTCGATTTG GATCCGCAGG GCAATGCGAC GACGGGCAGC

151 GGCATCGACA AGGCGGGTTT GCAGTCCGGC GTTTATCAGG TCTTATTGGG

201 CGATGCGGAC GTGCAGTCGG CGGCGGTACG CAGCAAAGAG GGCGGATACG

251 CTGTGTTGGG TGCGAACCGC GCGCTGGCCG GCGCGGAAAT CGAACTGGTG

301 CAGGAAATCG CCCGGGAAGT GCGTTTGAAA AACGCGCTCA AGGCAGTGGA

351 AGAAGATTAC GACTTTATCC TGATCGACTG CCCGCCTTCG CTGACGCTGT

401 TGACGCTTAA CGGGCTGGTG GCGGCGGGCG GCGTGATTGT GCCGATGTTG

451 TGCGAATATT ACGCGCTGGA AGGGATTTCC GATTTGATTG CGACCGTGCG

501 CAAAATCCGT CAGGCGGTCA ATCCCGATTT GGACATCACG GGCATCGTGC

551 GCACGATGTA CGACAGCCGC AGCAGGCTGG TTGCCGAAGT CAGCGAACAG

601 TTGCGCAGCC ATTTCGGGGA TTTGCTTTTT GAAACCGTCA TCCCGCGCAA

651 TATCCGCCTT GCGGAAGCGC CGAGCCACGG TATGCCGGTG ATGGCTTACG

701 ACGCGCAGGC AAAGGGTACC AAGGCGTATC TTGCCTTGGC GGACGAGCTG

751 GCGGCGAGGG TGTCGGGGAA ATAG
```

This corresponds to the amino acid sequence <SEQ ID 1686; ORF 567>:

```
m567.pep..
  1 MSANILAIAN QKGGVGKTTT TVNLAASLAS RGKRVLVVDL DPQGNATTGS

51 GIDKAGLQSG VYQVLLGDAD VQSAAVRSKE GGYAVLGANR ALAGAEIELV

101 QEIAREVRLK NALKAVEEDY DFILIDCPPS LTLLTLNGLV AAGGVIVPML

151 CEYYALEGIS DLIATVRKIR QAVNPDLDIT GIVRTMYDSR SRLVAEVSEQ

201 LRSHFGDLLF ETVIPRNIRL AEAPSHGMPV MAYDAQAKGT KAYLALADEL

251 AARVSGK*
```

Computer analysis of this amino acid sequence gave the following results:
Homology with a Predicted ORF from *N. gonorrhoeae*

```
   m567/g567  98.2% identity in 168 aa overlap 60         70         80         90        100        110       119
   m567.pep   GVYQVLLGDADVQSAAVRSKEGGYAVLGANRALAGAEIELVQEIAREVRLKNALKAVEED
                                             ||||||||||||||||||||||||||||||  ||
   g567       AFIRSYWAMRTCSRRRYAAKRADTACWVRTRALAGAEIELVQEIAREVRLKNALKAVAED
              20         30         40         50         60         70

120        130        140        150        160        170       179
   m567.pep   YDFILIDCPPSLTLLTLNGLVAAGGVIVPMLCEYYALEGISDLIATVRKIRQAVNPDLDI
              ||||||||||||||||||||||||||||||||||||||||||||||||||||||||||||
   g567       YDFILIDCPPSLTLLTLNGLVAAGGVIVPMLCEYYALEGISDLIATVRKIRQAVNPDLDI
              80         90        100        110        120        130

180        190        200        210        220        230       239
   m567.pep   TGIVRTMYDSRSRLVAEVSEQLRSHFGDLLFETVIPRNIRLAEAPSHGMPVMAYDAQAKG
              |||||||||||||||||||||||||||||||:||||||||||||||||||||||||||||
   g567       TGIVRTMYDSRSRLVAEVSEQLRSHFGDLLFETAIPRNIRLAEAPSHGMPVMAYDAQAKG
              140        150        160        170        180        190

240        250
   m567.pep   TKAYLALADELAARVSGKX
              :||||||||||||||||||
   g567       AKAYLALADELAARVSGKX
              200        210
```

The following partial DNA sequence was identified in *N. meningitidis* <SEQ ID 1687>:

```
a567.seq
   1 ATGAGTGCGA ACATCCTTGC CATCGCCAAT CAGAAGGGCG GTGTGGGCAA

51 AACGACGACG ACGGTAAATT TGGCGGCTTC GCTGGCATCG CGCGGCAAAC

101 GCGTGCTGGT GGTCGATTTG GATCCGCAGG GCAATGCGAC GACGGGCAGC

151 GGCATCGACA AGGCGAGTTT GCAGTCCGGC GTTTATCAGG TCTTATTGGG

201 CGATGCGGAC GTGAAATCGG CGGCGGTACG CAGCAAAGAG GGCGGATACG

251 GCGTGTTGGG TGCGAACCGC GCGCTGGCCG GCGCGGAAAT CGAGCTGGTG

301 CAGGAAATCG CCCGGGAAGT GCGTTTGAAA AACGCGCTCA AGGCAGTGGC

351 GGAAGATTAC GACTTTATCC TGATCGACTG CCCGCCTTCG CTGACGCTGT

401 TGACGCTTAA CGGCTTGGTG GCGGCAGGCG GCGTGATTGT GCCGATGTTG

451 TGCGAATATT ACGCGCTGGA AGGGATTTCC GATTTGATTG CGACCGTGCG

501 CAAAATCCGT CAGGCGGTCA ATCCCGATTT GGATATCACG GGCATCGTGC

551 GTACGATGTA CGACAGCCGC AGCAGGCTAG TTGCCGAAGT CAGCGAACAG

601 TTGCGCAGCC ATTTCGGGGA TTTGCTGTTT GAAACCGTCA TCCCGCGCAA

651 TATCCGCCTT GCGGAAGCGC CGAGCCACGG TATGCCGGTG ATGGCTTATG

701 ATGCGCAGGC AAAGGGTGCC AAGGCGTATC TTGCCTTGGC GGACGAGCTG

751 ATGGCGAGGG TGTCGGGGAA ATAG
```

This corresponds to the amino acid sequence <SEQ ID 1688; ORF 567.a>:

```
a567.pep

1  MSANILAIAN QKGGVGKTTT TVNLAASLAS RGKRVLVVDL DPQGNATTGS

51  GIDKASLQSG VYQVLLGDAD VKSAAVRSKE GGYGVLGANR ALAGAEIELV

101  QEIAREVRLK NALKAVAEDY DFILIDCPPS LTLLTLNGLV AAGGVIVPML

151  CEYYALEGIS DLIATVRKIR QAVNPDLDIT GIVRTMYDSR SRLVAEVSEQ

201  LRSHFGDLLF ETVIPRNIRL AEAPSHGMPV MAYDAQAKGA KAYLALADEL

251  MARVSGK*
```

(In the a567.pep listing, "LTLLTLNGLV AAGGVIV" of residues 141–157 is underlined.)

```
m567/a567  97.7% identity in 257 aa overlap 10        20        30        40        50        60
m567.pep    MSANILAIANQKGGVGKTTTTVNLAASLASRGKRVLVVDLDPQGNATTGSGIDKAGLQSG
            ||||||||||||||||||||||||||||||||||||||||||||||||||||||||:||||
a567        MSANILAIANQKGGVGKTTTTVNLAASLASRGKRVLVVDLDPQGNATTGSGIDKASLQSG
                    10        20        30        40        50        60

70        80        90       100       110       120
m567.pep    VYQVLLGDADVQSAAVRSKEGGYAVLGANRALAGAEIELVQEIAREVRLKNALKAVEEDY
            ||||||||||:||||||||||||:|||||||||||||||||||||||||||||||||| |||
a567        VYQVLLGDADVKSAAVRSKEGGYGVLGANRALAGAEIELVQEIAREVRLKNALKAVAEDY
                    70        80        90       100       110       120

130       140       150       160       170       180
m567.pep    DFILIDCPPSLTLLTLNGLVAAGGVIVPMLCEYYALEGISDLIATVRKIRQAVNPDLDIT
            ||||||||||||||||||||||||||||||||||||||||||||||||||||||||||||
a567        DFILIDCPPSLTLLTLNGLVAAGGVIVPMLCEYYALEGISDLIATVRKIRQAVNPDLDIT
                   130       140       150       160       170       180

190       200       210       220       230       240
m567.pep    GIVRTMYDSRSRLVAEVSEQLRSHFGDLLFETVIPRNIRLAEAPSHGMPVMAYDAQAKGT
            |||||||||||||||||||||||||||||||||||||||||||||||||||||||||||:
a567        GIVRTMYDSRSRLVAEVSEQLRSHFGDLLFETVIPRNIRLAEAPSHGMPVMAYDAQAKGA
                   190       200       210       220       230       240
```

```
               250
m567.pep   KAYLALADELAARVSGKX
           ||||||||||  |||||||
a567       KAYLALADELMARVSGKX
               250
```

The following partial DNA sequence was identified in *N. gonorrhoeae* <SEQ ID 1689>:

```
g568.seq
   1 atgctcaggg tcagaccggt attatttgcc gtcaaggctt ccgcctcttc 51 gataccttgc agaatctgcc gattaaagcg ttcgcggctg cccaatattt 101 tcaggcgcat attgttttcg tgcaggcggc gtacctgttt ttgcaaagcc 151 tgtaaaaaca gccccatcag gaacgaaact tcgtcttcgg ggcgacgcca 201 gttttcggtt gaaaaggcaa acacggtcag atattgcacg cccagtttgg 251 cgcaatgctt caccatattt tccaacgcgt ccaagccgcg tttgtgtccc 301 attatacgcg ggagaaaacg ttttttcgcc caacggccgt tgccgtccat 351 aattacggcg atgtgcctcg ggatggcggt gtgttccaaa atggtctgcg 401 tgctgctctt catatctgcc tttgcggtt cggcgttcaa atgccgtctg 451 aacgccgcgc cgtga
```

This corresponds to the amino acid sequence <SEQ ID 1690; ORF 568.ng>:

```
g568.pep
   1 MLRVRPVLFA VKASASSIPC RICRLKRSRL PNIFRRILFS CRRRTCFCKA

51 CKNSPIRNET SSSGRRQFSV EKANTVRYCT PSLAQCFTIF SNASKPRLCP

101 IIRGRKRFFA QRPLPSIITA MCLGMAVCSK MVCVLLFISA FRGSAFKCRL

151 NAAP*
```

The following partial DNA sequence was identified in *N. meningitidis* <SEQ ID 1691>:

```
m568.seq
   1 ATGCTCAGGG TCAGGCCGGT ATTGTTTGCC GTCAACGCTT CCGCCTCTTC

51 GATGCCTTGC AGAATCTGCC GGTTGAAGCG TTCGCGGCTG CCCAATATCT

101 TCAGGCGCAT ATTGTTTTCG TGCAGGCGGC GTACCTGTTT TTGCAAAGCC

151 TGTAAAAACA GCCCCATCAG GAACGAAACT TCGTCTTCGG GGCGGCGCCA

201 GTTTTCGGTT GAAAAGGCAA ACACGGTCAG ATATTGCACA CCCAGTTTGG

251 CGCAATGCTT CACCATATTT TCCAATGCGT CCAAACCGCG TTTGTGTCCC

301 ATTATGCGCG GGAGGAAACG TTTTTTCGCC CAACGGCCGT TGCCGTCCAT

351 AATCACGGCG ATATGCTTGG GAATGGCGGT GTGTTCCAAA ACGGCCTGCG

401 TGCTGCTTTT CATGTCTGCC TTTCGCGGTT CGGCATTCAA ATGCCGTCTG

451 AACGCCGAAC CGTGCAGGTT AAATTGCCAT CAAATCTTCT TCTTTGGCAG

501 TCAGGAGTTT GTCGGCTTCG GTAATGTATT TGTCGGTCAG TTTTTGAACC

551 GCTTCTTCGC CGCGACGTGC CTCGTCTTCG GAAATTTCTT TGTCTTTGAG

601 GAGTTTTTTG ATGTGGTCGT TGGCATCGCG GCGCACGTTG CGGATAGAGA

651 CGCGGCCTTC TTCCGCTTCG CCGCGTACGA CTTTAATCAG GTCTTTGCGG
```

-continued

```
701 CGTTCCTCGG TCAGCATGGG CATCGGCACG CGGATCAGGT CGCCGACAGC

751 TGCCGGGTTC AGTCCCAAGT TTGA
```

This corresponds to the amino acid sequence <SEQ ID 1692; ORF 568>:

```
m568.pep..
   1 MLRVRPVLFA VNASASSMPC RICRLKRSRL PNIFRRILFS CRRRTCFCKA

51 CKNSPIRNET SSSGRRQFSV EKANTVRYCT PSLAQCFTIF SNASKPRLCP

101 IMRGRKRFFA QRPLPSIITA ICLGMAVCSK TACVLLFMSA FRGSAFKCRL

151 NAEPCRLNCH QIFFFGSQEF VGFGNVFVGQ FLNRFFAATC LVFGNFFVFE

201 EFFDVVVGIA AHVADRDAAF FRFAAYDFNQ VFAAFLGQHG HRHADQVADS

251 CRVQSQV*
```
                                                                    20

Computer analysis of this amino acid sequence gave the following results:
Homology with a Predicted ORF from *N. gonorrhoeae*

```
    m568/g568 94.8% identity in 154 aa overlap 10        20        30        40        50        60
    m568.pep  MLRVRPVLFAVNASASSMPCRICRLKRSRLPNIFRRILFSCRRRTCFCKACKNSPIRNET
              ||||||||||:|||||:|||||||||||||||||||||||||||||||||||||||||||
    g568      MLRVRPVLFAVKASASSIPCRICRLKRSRLPNIFRRILFSCRRRTCFCKACKNSPIRNET
                  10        20        30        40        50        60

70        80        90       100       110       120
    m568.pep  SSSGRRQFSVEKANTVRYCTPSLAQCFTIFSNASKPRLCPIMRGRKRFFAQRPLPSIITA
              ||||||||||||||||||||||||||||||||||||||||||:|||||||||||||||||
    g568      SSSGRRQFSVEKANTVRYCTPSLAQCFTIFSNASKPRLCPIIRGRKRFFAQRPLPSIITA
                  70        80        90       100       110       120

130       140       150       160       170       180
    m568.pep  ICLGMAVCSKTACVLLFMSAFRGSAFKCRLNAEPCRLNCHQIFFFGSQEFVGFGNVFVGQ
              :||||||||| :||||:|||||||||||||| |
    g568      MCLGMAVCSKMVCVLLFISAFRGSAFKCRLNAAPX
                 130       140       150

190       200       210       220       230       240
    m568.pep  FLNRFFAATCLVFGNFFVFEEFFDVVVGIAAHVADRDAAFFRFAAYDFNQVFAAFLGQHG
```

The following partial DNA sequence was identified in *N. meningitidis* <SEQ ID 1693>:

```
a568.seq
   1 ATGCTCAGGG TCAGGCCGGT ATTGTTTGCC GTCAAGGCTT CCGCCTCTTC

51 GATGCCCTTC AGGATTTGAC GGTTGAAGCG TTCGCGGCTG CCCAGTATTT

101 TCAGGCGCAT ATTGTTTTCG TGCAGGCGGC GTACCTGTTT TTGCAAAGCC

151 TGTAAAAACA GCCCCATCAG GAACGAAACT TCGTCTTCGG GGCGGCGCCA

201 GTTTTCGGTT GAAAAGGCAA ACACGGTCAG ATATTGCACA CCCAGTTTGG

251 CGCAATGCTT CACCATATTT TCCAATGCGT CCAAACCGCG TTTGTGTCCC

301 ATTATGCGCG GGAGGAAACG TTTTTTCGCC CAACGGCCGT TGCCGTCCAT

351 AATCACGGCG ATATGCTTGG GAATGGCGGT GTGTTCCAAA ACGGCCTGCG

401 TGCTGCTTTT CATGTCTGCC TTTCGCGGTT CGGCATTCAA ATGCCGTCTG

451 AACGCCGAAC CGTGCAGGTT AAATTGCCAT CAAATCTTCT TCTTTGGCAG

501 TCAGGAGTTT GTCGGCTTCG GTAATGTATT TGTCGGTCAG TTTTTGAACC

551 GCTTCTTCGC CGCGACGTGC CTCGTCTTCG GAAATTTCTT TGTCTTTGAG
```

-continued
```
601 GAGTTTTTTG ATGTGGTCGT TGGCATCGCG GCGCACGTTG CGGATGGAGA

651 CGCGGCCTTC TTCCGCTTCG CCGCGTACGA CTTTAATCAG GTCTTTGCGG

701 CGTTCCTCGG TCAGCATGGG CATCGGCACG CGGATCAGGT CGCCGACAGC

751 TGCCGGGTTC AGTCCCAAGT TTGA
```

This corresponds to the amino acid sequence <SEQ ID 1694; ORF 568.a>:

```
a568.pep

1 MLRVRPVLFA VKASASSMPF RI*RLKRSRL PSIFRRILFS CRRRTCFCKA

51 CKNSPIRNET SSSGRRQFSV EKANTVRYCT PSLAQCFTIF SNASKPRLCP

101 IMRGRKRFFA QRPLPSIITA ICLGMAVCSK TACVLLFMSA FRGSAFKCRL

151 NAEPCRLNCH QIFFFGSQEF VGFGNVFVGQ FLNRFFAATC LVFGNFFVFE

201 EFFDVVVGIA AHVADGDAAF FRFAAYDFNQ VFAAFLGQHG HRHADQVADS

251 CRVQSQV* m568/a568   98.1% identity in 257 aa overlap 10        20        30        40        50        60
  m568.pep   MLRVRPVLFAVNASASSMPCRICRLKRSRLPNIFRRILFSCRRRTCFCKACKNSPIRNET
             ||||||||||:||||||  ||||||||:||||||||||||||||||||||||||||||||
  a568       MLRVRPVLFAVKASASSMPFRIXRLKRSRLPSIFRRILFSCRRRTCFCKACKNSPIRNET
                        10        20        30        40        50        60

70        80        90       100       110       120
  m568.pep   SSSGRRQFSVEKANTVRYCTPSLAQCFTIFSNASKPRLCPIMRGRKRFFAQRPLPSIITA
             ||||||||||||||||||||||||||||||||||||||||||||||||||||||||||||
  a568       SSSGRRQFSVEKANTVRYCTPSLAQCFTIFSNASKPRLCPIMRGRKRFFAQRPLPSIITA
                        70        80        90       100       110       120

130       140       150       160       170       180
  m568.pep   ICLGMAVCSKTACVLLFMSAFRGSAFKCRLNAEPCRLNCHQIFFFGSQEFVGFGNVFVGQ
             ||||||||||||||||||||||||||||||||||||||||||||||||||||||||||||
  a568       ICLGMAVCSKTACVLLFMSAFRGSAFKCRLNAEPCRLNCHQIFFFGSQEFVGFGNVFVGQ
                       130       140       150       160       170       180

190       200       210       220       230       240
  m568.pep   FLNRFFAATCLVFGNFFVFEEFFDVVVGIAAHVADRDAAFFRFAAYDFNQVFAAFLGQHG
             |||||||||||||||||||||||||||||||||||| |||||||||||||||||||||||
  a568       FLNRFFAATCLVFGNFFVFEEFFDVVVGIAAHVADGDAAFFRFAAYDFNQVFAAFLGQHG
                       190       200       210       220       230       240

250
  m568.pep   HRHADQVADSCRVQSQVX
             ||||||||||||||||||
  a568       HRHADQVADSCRVQSQVX
                       250
```

The following partial DNA sequence was identified in *N. gonorrhoeae* <SEQ ID 1695>:

```
g569.seq..
   1 atgctgaaac aacgggtaat aaccgctatg tggctgctgc cgctgatgct 51 gggcatgctg ttttacgcgc cgcaatggct gtgggctgca ttttgcgggc 101 tgattgccct gaccgccttg tgggagtatg cccgtatggc cggtttgtgc 151 aaaaccgaaa ccaaccatta cctcgccgca accttggttt tcggcgtagt 201 tgcctatgcg ggcggctgga tgctgcctaa tttggtttgg tatgttgttt 251 tggcattttg gctcgccgtt atgcctttgt ggttgagatt caaatggagg 301 ctcaacggcg gttggcaggt ttatgccgtc ggctggcttt tgctcatgcc 351 gttttggttc gcgctcgtat ccctggcgcc cgcatcccga tga
```

This corresponds to the amino acid sequence <SEQ ID 1696; ORF 569.ng>:

```
g569.pep
   1 MLKQRVITAM WLLPLMLGML FYAPQWLWAA FCGLIALTAL WEYARMAGLC

51 KTETNHYLAA TLVFGVVAYA GGWMLPNLVW YVVLAFWLAV MPLWLRFKWR

101 LNGGWQVYAV GWLLLMPFWF ALVSLAPASR *
```

The following partial DNA sequence was identified in *N. meningitidis* <SEQ ID 1697>:

```
m569.seq..
   1 ATGCTGAAAC AACGGGTAAT AACCGCCATG TGGCTGCTGC CGCTGATGCT

51 GGGCATGCTG TTTTACGCGC CGCAATGGTT GTGGGCTGCA TTTTGCGGAC

101 TGATTGCCCT GATTGCCTTG TGGGAATATG CCCGTATGGG CGGTTTGTGC

151 AAAATTAAAA CCAACCATTA CCTCGCCGCA ACCTTGGTTT TCGGCGTGGT

201 TGCCTATGCG GGCGGCTGGA TGCTGCCTAA TTTGGTTTGG TATGTTGTTT

251 TGGCATTTTG GCTCGCCGTT ATGCCTTTAT GGTTGAGATT CAAATGGAGG

301 CTCAACGGCG GTTGGCAGGT TTATGCCGTC GGCTGGCTTC TGGTCATGCC

351 GTTTTGGTTC GCGCTCGTAT CCCTGCGCCC GCATCCCGAT GATGCCCTGC

401 CGCTGCTCGC CGTGATGGGT TTGGTGTGGG TTGCCGATAT TTGCGCGTAT

451 TTCAGCGGCA AGGCGTTCGG CAAACACAAA ATCGCGCCGG CAATCAGCCC

501 CGGCAAAAGC TGGGAAGGTG CAATCGGCGG CGCGGTTTGC GTGGCAGTGT

551 ACATGACCGC CGTACGAAGT GCCGGCTGGC TGGCATTCGA TACAGGCTGG

601 TTCGATACCG TGTTAATCGG TTTGGTGCTG ACCGTTGTCA GCGTATGCGG

651 CGACCTTTTG GAAAGCTGGC TCAAGCGCGC GGCAGGCATC AAAGACAGCA

701 GCAAGCTGCT GCCCGGACAC GGCGGCGTGT TCGACCGTAC CGACAGCCTG

751 ATTGCCGTTA TCAGCGTCTA TGCAGCGATG ATGTCGGTTT TAAATTGA
```

This corresponds to the amino acid sequence <SEQ ID 1698; ORF 569>:

```
m569.pep..

1  MLKQRVITAM WLLPLMLGML FYAPQWLWAA FCGLIALIAL WEYARMGGLC

51  KIKTNHYLAA TLVFGVVAYA GGWMLPNLVW YVVLAFWLAV MPLWLRFKWR

101  LNGGWQVYAV GWLLVMPFWF ALVSLRPHPD DALPLLAVMG LVWVADICAY

151  FSGKAFGKHK IAPAISPGKS WEGAIGGAVC VAVYMTAVRS AGWLAFDTGW

201  FDTVLIGLVL TVVSVCGDLL ESWLKRAAGI KDSSKLLPGH GGVFDRTDSL

251  IAVISVYAAM MSVLN* m569/g569  95.3% identity in 127 aa overlap 10        20        30        40        50        60
m569.pep    MLKQRVITAMWLLPLMLGMLFYAPQWLWAAFCGLIALIALWEYARMGGLCKIKTNHYLAA
            |||||||||||||||||||||||||||||||||||| |||||||||:|||| :|||||||
g569        MLKQRVITAMWLLPLMLGMLFYAPQWLWAAFCGLIALTALWEYARMAGLCKTETNHYLAA
                    10        20        30        40        50        60

70        80        90       100       110       120
m569.pep    TLVFGVVAYAGGWMLPNLVWYVVLAFWLAVMPLWLRFKWRLNGGWQVYAVGWLLVMPFWF
            ||||||||||||||||||||||||||||||||||||||||||||||||||||||:|||||
g569        TLVFGVVAYAGGWMLPNLVWYVVLAFWLAVMPLWLRFKWRLNGGWQVYAVGWLLLMPFWF
                    70        80        90       100       110       120
```

```
                   130        140        150        160        170        180
m569.pep   ALVSLRPHPDDALPLLAVMGLVWVADICAYFSGKAFGKHKIAPAISPGKSWEGAIGGAVC
           |||||  |
g569       ALVSLAPASRX
                   130
```

The following partial DNA sequence was identified in *N. meningitidis* <SEQ ID 1699>:

```
a569.seq
   1 ATGCTGAAAC AACGGGTGAT AACCGCCATG TGGCTGCTGC CGCTGATGCT

51 GGGCATGCTG TTTTACGCGC CGCAATGGTT GTGGGCTGCA TTTTGCGGAC

101 TGATTGCCCT GATTGCCTTG TGGGAATATG CCCGTATGGG CGGTTTGTGC

151 AAAATTAAAA CCAACCATTA CCTCGCCGCA ACCTTGGTTT TCGGCGTGGT

201 TGCCTATGCG GGCGGCTGGA TGCTGCCTAA TTTGGTTTGG TATGTTGTTT

251 TGGCATTTTG GCTCGCCGTT ATGCCTTTAT GGTTGAGATT CAAATGGAGG

301 CTCAACGGCG GTTGGCAGGT TTATGCCGTC GGCTGGCTTC TGGTCATGCC

351 GTTTTGGTTC GCGCTCGTAT CCCTGCGCCC GCATCCCGAT GATGCCCTGC

401 CGCTGCTCGC CGTGATGGGT TTGGTGTGGG TTGCCGATAT TTGCGCGTAT

451 TTCAGCGGCA AGGCGTTCGG CAAACACAAA ATCGCACCGG CAATCAGCCC

501 CGGCAAAAGC TGGGAAGGTG CAATCGGCGG CGCGGTTTGC GTGGCCGTGT

551 ACATGACCGC CGTACGAAGT GCCGGCTGGC TGGCATTCGA TACAGGCTGG

601 TTCGATACCG TGTTAATCGG TTTGGTGTTG ACCGTTGTCA GCGTATGCGG

651 CGACCTTTTG GAAAGCTGGC TCAAGCGCGC GGCAGGCATC AAAGACAGCA

701 GCAACCTGCT GCCCGGACAC GGCGGCGTGT TCGACCGCAC CGACAGCCTG

751 ATTGCCGTTA TCAGCGTCTA TGCAGCGATG ATGTCGGTTT TAAATTGA
```

This corresponds to the amino acid sequence <SEQ ID 1700; ORF 569.a>:

```
a569.pep

1   MLKQRVITAM WLLPLMLGML FYAPQWLWAA FCGLIALIAL WEYARMGGLC

51   KIKTNHYLAA TLVFGVVAYA GGWMLPNLVW YVVLAFWLAV MPLWLRFKWR

101   LNGGWQVYAV GWLLVMPFWF ALVSLRPHPD DALPLLAVMG LVWVADICAY

151   FSGKAFGKHK IAPAISPGKS WEGAIGGAVC VAVYMTAVRS AGWLAFDTGW

201   FDTVLIGLVL TVVSVCGDLL ESWLKRAAGI KDSSNLLPGH GGVFDRTDSL

251   IAVISVYAAM MSVLN* m569/a569  99.6% identity in 265 aa overlap 10         20         30         40         50         60
m569.pep   MLKQRVITAMWLLPLMLGMLFYAPQWLWAAFCGLIALIALWEYARMGGLCKIKTNHYLAA
           ||||||||||||||||||||||||||||||||||||||||||||||||||||||||||||
a569       MLKQRVITAMWLLPLMLGMLFYAPQWLWAAFCGLIALIALWEYARMGGLCKIKTNHYLAA
                   10         20         30         40         50         60

70         80         90        100        110        120
m569.pep   TLVFGVVAYAGGWMLPNLVWYVVLAFWLAVMPLWLRFKWRLNGGWQVYAVGWLLVMPFWF
           ||||||||||||||||||||||||||||||||||||||||||||||||||||||||||||
a569       TLVFGVVAYAGGWMLPNLVWYVVLAFWLAVMPLWLRFKWRLNGGWQVYAVGWLLVMPFWF
                   70         80         90        100        110        120

130        140        150        160        170        180
m569.pep   ALVSLRPHPDDALPLLAVMGLVWVADICAYFSGKAFGKHKIAPAISPGKSWEGAIGGAVC
           ||||||||||||||||||||||||||||||||||||||||||||||||||||||||||||
a569       ALVSLRPHPDDALPLLAVMGLVWVADICAYFSGKAFGKHKIAPAISPGKSWEGAIGGAVC
                  130        140        150        160        170        180
```

-continued

```
               190       200       210       220       230       240
m569.pep   VAVYMTAVRSAGWLAFDTGWFDTVLIGLVLTVVSVCGDLLESWLKRAAGIKDSSKLLPGH
           ||||||||||||||||||||||||||||||||||||||||||||||||||||:||||
a569       VAVYMTAVRSAGWLAFDTGWFDTVLIGLVLTVVSVCGDLLESWLKRAAGIKDSSNLLPGH
               190       200       210       220       230       240

250       260
m569.pep   GGVFDRTDSLIAVISVYAAMMSVLNX
           ||||||||||||||||||||||||||
a569       GGVFDRTDSLIAVISVYAAMMSVLNX
               250       260
```

The following partial DNA sequence was identified in *N. gonorrhoeae* <SEQ ID 1701>:

```
g570.seq..
    1 atgatccgtt tgacccgcgc gtttgccgcc gccctgatcg gtttatgctg 51 caccacaggc gcgcacgccg acaccttcca aaaaatcggc tttatcaaca 101 ccgagcgcat ctacctcgaa tccaagcagg cgcgcaacat ccaaaaaacg 151 ctggacggcg aatttccgc ccgtcaggac gaattgcaaa aactgcaacg 201 cgaaggcttg gatttggaaa ggcagctcgc cggcggcaaa cttaaggacg 251 caaaaaaggc gcaagccgaa gaaaaatggc gcgggctggt cgaagcgttc 301 cgcaaaaaac aggcgcagtt tgaagaagac tacaacctcc gccgcaacga 351 agagtttgcc tccctccagc aaaacgccaa ccgcgtcatc gtcaaaatcg 401 ccaaacagga aggttacgat gtcattttgc aggacgtgat ttacgtcaac 451 acccaatacg acgttaccga cagcgtcatt aaagaaatga acgcccgctg 501 a
```

This corresponds to the amino acid sequence <SEQ ID 1702; ORF 570.ng>:

```
g570.pep..
    1 MIRLTRAFAA ALIGLCCTTG AHADTFQKIG FINTERIYLE SKQARNIQKT

51 LDGEFSARQD ELQKLQREGL DLERQLAGGK LKDAKKAQAE EKWRGLVEAF

101 RKKQAQFEED YNLRRNEEFA SLQQNANRVI VKIAKQEGYD VILQDVIYVN

151 TQYDVTDSVI KEMNAR*
```

The following partial DNA sequence was identified in *N. meningitidis* <SEQ ID 1703>:

```
m570.seq..
    1 ATGACCCGTT TGACCCGCGC GTTTGCCGCG GCTCTGATCG GTTTGTGCTG

51 CACCGCAGGC GCGCACGCCG ACACCTTCCA AAAAATCGGC TTTATCAACA

101 CCGAGCGCAT CTACCTCGAA TCCAAGCAGG CGCGCAAGAT TCAAAAAACG

151 CTGGACAGCG AATTTTCCGC TCGTCAGGAC GAATTGCAAA AACTGCAACG

201 CGAAGGTCTG GATTTGGAAA GGCAGCTTGC CGAAGGCAAA CTCAGAAACG

251 CAAAAAAGGC GCAAGCCGAA GAAAAATGGC GCGGGCTGGT CGCAGCGTTC

301 CGCAAAAAAC AGGCGCAGTT TGAAGAAGAC TACAACCTCC GCCGCAACGA

351 AGAGTTTGCC TCCCTCCAGC AAAACGCCAA CCGCGTCATC GTCAAAATCG
```

```
                              -continued
401 CCAAACAGGA AGGTTACGAT GTCATTTTGC AGAACGTGAT TTACGTCAAC

451 ACCCAATACG ACGTTACCGA CAGCGTCATT AAAGAAATGA ACGCCCGCTG

501 A
```

This corresponds to the amino acid sequence <SEQ ID 1704; ORF 570>:

```
   m570.pep
        1     MTRLTRAFAA ALIGLCCTAG AHADTFQKIG FINTERIYLE SKQARKIQKT
       51     LDSEFSARQD ELQKLQREGL DLERQLAEGK LRNAKKAQAE EKWRGLVAAF
      101     RKKQAQFEED YNLRRNEEFA SLQQNANRVI VKIAKQEGYD VILQNVIYVN
      151     TQYDVTDSVI KEMNAR* m570/g570    94.6% identity in 166 aa overlap 10         20         30         40         50         60
   m570.pep   MTRLTRAFAAALIGLCCTAGAHADTFQKIGFINTERIYLESKQARKIQKTLDSEFSARQD
              | ||||||||||||||||:|||||||||||||||||||||||||:|||||:|||||||
   g570       MIRLTRAFAAALIGLCCTTGAHADTFQKIGFINTERIYLESKQARNIQKTLDGEFSARQD
                        10         20         30         40         50         60

70         80         90        100        110        120
   m570.pep   ELQKLQREGLDLERQLAEGKLRNAKKAQAEEKWRGLVAAFRKKQAQFEEDYNLRRNEEFA
              |||||||||||||||||||| |||::||||||||||||| ||||||||||||||||||||
   g570       ELQKLQREGLDLERQLAGGKLKDAKKAQAEEKWRGLVEAFRKKQAQFEEDYNLRRNEEFA
                        70         80         90        100        110        120

130        140        150        160
   m570.pep   SLQQNANRVIVKIAKQEGYDVILQNVIYVNTQYDVTDSVIKEMNARX
              |||||||||||||||||||||||:|||||||||||||||||||||||
   g570       SLQQNANRVIVKIAKQEGYDVILQDVIYVNTQYDVTDSVIKEMNARX
                       130        140        150        160
```

The following partial DNA sequence was identified in *N. meningitidis* <SEQ ID 1705>:

```
a570.seq
   1 ATGACCCGTT TGACCCGCGC GTTTGCCGCG GCTCTGATCG GTTTGTGCTG

51 CACCGCAGGC GCGCACGCCG ACACCTTCCA AAAAATCGGC TTTATCAACA

101 CCGAGCGCAT CTACCTCGAA TCCAAGCAGG CGCGCAAGAT TCAAAAAACG

151 CTGGACAGCG AATTTTCCGC CGCCAGGAC GAATTGCAAA AACTGCAACG

201 CGAAGGTCTG GATTTGGAAA GGCAGCTTGC CGAAGGCAAA CTCAAAGACG

251 CAAAAAAGGC GCAAGCCGAA GAAAAATGGT GCGGGCTGGT CGCAGCGTTC

301 CGCAAAAAAC AGGCGCAGTT TGAAGAAGAC TACAACCTCC GCCGCAACGA

351 AGAGTTTGCC TCCCTCCAGC AAAACGCCAA CCGCGTCATC GTCAAAATCG

401 CCAAACAGGA AGGTTACGAT GTCATTTTGC AGGACGTGAT TTACGTCAAC

451 ACCCAATACG ACGTTACCGA CAGCGTCATT AAAGAAATGA ACGCCCGCTG

501 A
```

This corresponds to the amino acid sequence <SEQ ID 1706; ORF 570.a>:

```
   a570.pep
        1     MTRLTRAFAA ALIGLCCTAG AHADTFQKIG FINTERIYLE SKQARKIQKT
       51     LDSEFSARQD ELQKLQREGL DLERQLAEGK LKDAKKAQAE EKWCGLVAAF
```

-continued

```
    101  RKKQAQFEED YNLRRNEEFA SLQQNANRVI VKIAKQEGYD VILQDVIYVN

151  TQYDVTDSVI KEMNAR* m570/a570  97.6% identity in 166 aa overlap
                10         20         30         40         50         60
  m570.pep  MTRLTRAFAAALIGLCCTAGAHADTFQKIGFINTERIYLESKQARKIQKTLDSEFSARQD
            ||||||||||||||||||||||||||||||||||||||||||||||||||||||||||||
  a570      MTRLTRAFAAALIGLCCTAGAHADTFQKIGFINTERIYLESKQARKIQKTLDSEFSARQD
                10         20         30         40         50         60

70         80         90        100        110        120
  m570.pep  ELQKLQREGLDLERQLAEGKLRNAKKAQAEEKWRGLVAAFRKKQAQFEEDYNLRRNEEFA
            |||||||||||||||||||||::|||||||||| ||||||||||||||||||||||||||
  a570      ELQKLQREGLDLERQLAEGKLKDAKKAQAEEKWCGLVAAFRKKQAQFEEDYNLRRNEEFA
                70         80         90        100        110        120

130        140        150        160
  m570.pep  SLQQNANRVIVKIAKQEGYDVILQNVIYVNTQYDVTDSVIKEMNARX
            |||||||||||||||||||||||:|||||||||||||||||||||||
  a570      SLQQNANRVIVKIAKQEGYDVILQDVIYVNTQYDVTDSVIKEMNARX
               130        140        150        160
```

The following partial DNA sequence was identified in *N. gonorrhoeae* <SEQ ID 1707>:

```
g571.seq (partial)
   1 atgcgcgttt tccgagtaaa ccgatttgtt gttaccgttt cggcggcgg 51 tataggttct gccgtcccac acgctgcctg cgtcggcaaa caggctcagg 101 cggacggtgc gtgcgtcttt cgcaccgggc atcgggaaga gcagctcggc 151 ggagacgttg gcttttttgt tgccgccgta gctgattttt tcgccgtatt 201 cgtcatacac tttcgggccg agcgtgccgc tttcgtagcc gcgcaccgaa 251 cccaggccgc cgccgtagaa gttttcaaag aagggatt ctttggttct 301 gccgtagccg cccgcaatgc cgacttcgcc gccgagcatc agcgtgaagg 351 ttttgct...
```

This corresponds to the amino acid sequence <SEQ ID 1708; ORF 571.ng>:

```
g571.pep (partial)
   1 MRVFRVNRFV VTVFGGGIGS AVPHAACVGK QAQADGACVF RTGHREEQLG

51 GDVGFFVAAV ADFFAVFVIH FRAERAAFVA AHRTQAAAVE VFKEGDFFGS

101 AVAARNADFA AEHQREGFA...
```

The following partial DNA sequence was identified in *N. meningitidis* <SEQ ID 1709>:

```
m571.seq
   1 ATGGGTATTG CCGGCGCCGT AAATGTTTTG AACCCTGCCG CCGGTCGCGG

51 AACTGCTGTT GTCGTCGTAG GTTTTGCCGT CCCACACGCT GCCTGCGTCG

101 GCAAACAGGC TCAGGCGGAC GGTGCGCGCG TCTTTCGCGC CGGGCATCGG

151 GAAGAGCAGC TCGGCGGAGA CGTTGGCTTT TTTGTTGCCG CCGTAGCTGA

201 TTTTTTCGCC GTATTCGTCA TAGACTTTCG GACCGAGCGT GCCGCTTTCG

251 TATCCGCGCA CCGAACCCAG GCCGCCGCCG TAGAAGTTTT CAAAGAAGGG

301 GATTTCTTTG GTTCTGCCGT AGCCGCCCGC AATGCCGACT TCGCCGCCGA

351 GCATCAGCGT GAAGGTTTTG CTCAGGGGGA AGAACCAGGT TTGGTTGTGG
```

-continued
```
401 GTGGCGGAGT AGTATTGCAG TTTGCTGCCA GGCAGGGCGA TTTCGGCGTT

451 CACGCCCGTC AGGTAGCCGC GCGTCGGCCA TAA
```

This corresponds to the amino acid sequence <SEQ ID 1710; ORF 571>:

```
a571.pep

1   MGIAGAVNVL NPAAGRGTAV VVVGFAVPHA ACVGKQAQAD GARVFRAGHR

51   EEQLGGDVGF FVAAVADFFA VFVIDFRTER AAFVSAHRTQ AAAVEVFKEG

101   DFFGSAVAAR NADFAAEHQR EGFAQGEEPG LVVGGGVVLQ FAARQGDFGV

151   HARQVAARRP * m571/g571 93.1% identity in 102 aa overlap 10         20         30         40         50         60
  m571.pep  MGIAGAVNVLNPAAGRGTAVVVVGFAVPHAACVGKQAQADGARVFRAGHREEQLGGDVGF
                          :|  ||||||||||||||| |||:|||||||||||
  g571              MRVFRVNRFVVTFGGGIGSAVPHAACVGKQAQADGACVFRTGHREEQLGGDVGF
                           10         20         30         40         50

70         80         90        100        110        120
  m571.pep  FVAAVADFFAVFVIDFRTERAAFVSAHRTQAAAVEVFKEGDFFGSAVAARNADFAAEHQR
            ||||||||||||  ::||||| :|||||||||||||||||||||||||||||||||||||
  g571      FVAAVADFFAVFVIHFRAERAAFVAAHRTQAAAVEVFKEGDFFGSAVAARNADFAAEHQR
                    60         70         80         90        100        110

130        140        150        160
  m571.pep  EGFAQGEEPGLVVGGGVVLQFAARQGDFGVHARQVAARRPX
            ||||
  g571      EGFA
                   119
```

The following partial DNA sequence was identified in *N. meningitidis* <SEQ ID 1711>:

```
a571.seq
   1 ATGGGTATTG CCGGCGCCGT AAATGTTTTG AACCCTGCCG CCGGTCGCGG

51 AACTGCTGTT GTCGTCGTAG GTTTTGCCGT CCCACACGCT GCCTGCGTCG

101 GCAAACAGGC TCAGGCGGAC GGTGCGCGCG TCTTTCGCGC CGGGCATCGG

151 GAAGAGCAGC TCGGCGGAGA CGTTGGCTTT TTTGTTGCCG CCGTAGCTGA

201 TTTTTTCGCC GTATTCGTCA TACACTTTCG GACCGAGCGT GCCGCTTTCG

251 TATCCGCGCA CCGAACCCAG GCCGCCGCCG TAGAAGTTTT CAAAGAAGGG

301 GATTTCTTTG GTTCTGCCGT AGCCGCCCGC AATGCCGACT TCGCCGCCGA

351 GCATCAGCGT GAAGGTTTTG CTTAAGGGGA AGAACCAGGT TTGGTTGTGG

401 GTGGCGGAGT AGTATTGCAG TTTGCTGCCG GCAGGGCGA TTTCGGCGTT

451 CACGCCCGTC AGGTAGCCGC GCGTCGGCCA TAA
```

This corresponds to the amino acid sequence <SEQ ID 1712; ORF 571.a>:

```
a571.pep

1   MGIAGAVNVL NPAAGRGTAV VVVGFAVPHA ACVGKQAQAD GARVFRAGHR

51   EEQLGGDVGF FVAAVADFFA VFVIHFRTER AAFVSAHRTQ AAAVEVFKEG

101   DFFGSAVAAR NADFAAEHQR EGFA*GEEPG LVVGGGVVLQ FAAGQGDFGV

151   HARQVAARRP *
```

-continued m571/a571    98.1% identity in 160 aa overlap

```
                    10         20         30         40         50         60
m571.pep    MGIAGAVNVLNPAAGRGTAVVVVGFAVPHAACVGKQAQADGARVFRAGHREEQLGGDVGF
            ||||||||||||||||||||||||||||||||||||||||||||||||||||||||||||
a571        MGIAGAVNVLNPAAGRGTAVVVVGFAVPHAACVGKQAQADGARVFRAGHREEQLGGDVGF
                    10         20         30         40         50         60

70         80         90        100        110        120
m571.pep    FVAAVADFFAVFVIDFRTERAAFVSAHRTQAAAVEVFKEGDFFGSAVAARNADFAAEHQR
            ||||||||||||| |||||||||| |||||||||||||||||||||||||||||||||||
a571        FVAAVADFFAVFVIHFRTERAAFVSAHRTQAAAVEVFKEGDFFGSAVAARNADFAAEHQR
                    70         80         90        100        110        120

130        140        150        160
m571.pep    EGFAQGEEPGLVVGGGVVLQFAARQGDFGVHARQVAARRPX
            |||| ||||||||||||||||||| |||||||||||||||
a571        EGFAXGEEPGLVVGGGVVLQFAAGQGDFGVHARQVAARRPX
                   130        140        150        160
```

The following partial DNA sequence was identified in *N. gonorrhoeae* <SEQ ID 1713>:

```
g572.seq..
   1 atgtgcgcca tcgtcggggc ggcggggctg ccttccgcgc tcgcagcggc
  51 gcaaaaaggc aaaaccattt atctggcaaa caaagaaacg ctggtggttt
 101 ccggcgcgtt gtttatggaa accgcccgcg caaacggcgc ggcagtgttg
 151 cccgtcgaca gcgaacacaa cgccattttc caagttttgc cgcgcgatta
 201 cacagaccgt ctgaacgaac acggcatcga ttcgattatc ctgaccgctt
 251 ccggcggccc gttttaaca accgatttaa gcacgttcga cagcattacg
 301 cccgagcagg cggtcaaaca ccccaattgg cgtatggggc gcaaaatctc
 351 cgtcgattca gccactatgg caaacaaggg cttggaactg attgaagcgc
 401 attggctgtt caactgtccg cccgacaaac tcgaagtcgt catccatccc
 451 caatccgtga tacacagtat ggtgcgctac cgcgacggct ccgtgctggc
 501 gcaactgggc aatcccgata tgcgaacgcc catcgcctat tgtttgggct
 551 tgcccgagcg catcgattcg ggtgtcggca aactcgattt cggcgcattg
 601 tccgcgctga ccttccaaaa gcccgacttc ggccgcttcc cctgcctgaa
 651 gttcgcctat gaaaccataa acgcaggcgg agccgcgccc tgcgtattga
 701 acgccgccaa cgaaaccgcc gtcgccgcct ttttggacgg acagattaag
 751 tttaccgaca ttgccaaaac cgtcgcccac tgtcttgcac aagactttc
 801 aaacggcatg ggcgatatag aaggactgtt ggcgcaagat gcccggacac
 851 gcgcacaagc gcgggcattt atcggcacac tgcgctga
```

This corresponds to the amino acid sequence <SEQ ID 1714; ORF 572.ng>:

```
g572.pep..
   1 MCAIVGAAGL PSALAAAQKG KTIYLANKET LVVSGALFME TARANGAAVL
  51 PVDSEHNAIF QVLPRDYTDR LNEHGIDSII LTASGGPFLT TDLSTFDSIT
 101 PEQAVKHPNW RMGRKISVDS ATMANKGLEL IEAHWLFNCP PDKLEVVIHP
 151 QSVIHSMVRY RDGSVLAQLG NPDMRTPIAY CLGLPERIDS GVGKLDFGAL
 201 SALTFQKPDF GRFPCLKFAY ETINAGGAAP CVLNAANETA VAAFLDGQIK
```

The following partial DNA sequence was identified in *N. meningitidis* <SEQ ID 1715>:

```
m572.seq..
   1 ATGTGCGCCA TCGTCGGGGC GGTGGGGCTG CCTTCCGCGC TCGCAGCGGC

51 GCAAAAAGGC AAAACCATTT ATCTGGCAAA CAAAGAAACG CTGGTGGTTT

101 CCGGCGCGTT GTTTATGGAA ACCGCCCGTG CAAACGGCGC GGCAGTGCTG

151 CCCGTCGACA GCGAACACAA CGCCGTTTTC CAAGTTTTGC CGCGCGATTA

201 CGCCGGCCGT CTGAACGAAC ACGGCATCGC TTCGATTATC CTGACCGCTT

251 CCGGCGGCCC GTTTCTGACC GCCGATTTAA ACACGTTCGA CCGCATTACG

301 CCCGCCCAAG CGGTCAAACA CCCCAATTGG CGTATGGGAC GCAAAATCTC

351 CGTCGATTCC GCCACCATGA TGAACAAAGG TTTGGAGCTG ATTGAAGCGC

401 ATTGGCTGTT CAACTGTCCG CCCGACAAAC TCGAAGTCGT CATCCATCCG

451 CAATCCGTGA TACACAGCAT GGTGCGCTAC CGCGACGGCT CCGTGCTGGC

501 GCAACTGGGC AATCCCGATA TGCGAACGCC CATCGCTTAT TGTTTGGGTT

551 TGCCCGAGCG CATCGATTCG GGTGTCGGCG ACCTGGATTT CGACGCATTG

601 TCCGCGCTGA CCTTCCAAAA GCCCGACTTT GACCGCTTCC CCTGCCTGAG

651 GCTCGCCTAT GAAGCCATGA ACGCAGGCGG AGCCGCGCCC TGCGTATTGA

701 ACGCCGCCAA CGAAGCCGCC GTCGCCGCCT TTTTGGACGG ACAGATTAAG

751 TTTACCGACA TTGCCAAAAC CGTCGCCCAC TGTCTTGCAC AAGACTTTTC

801 AGACGGCATA GGCGATATAG GGGGGCTCTT GGCGCAAGAT GCCCGGACAC

851 GCGCACAAGC GCGAGCATTT ATCGGCACAC TGCGCTGA
```

This corresponds to the amino acid sequence <SEQ ID 1716; ORF 572>:

```
m572.pep..

1    MCAIVGAVGL PSALAAAQKG KTIYLANKET LVVSGALFME TARANGAAVL

51    PVDSEHNAVF QVLPRDYAGR LNEHGIASII LTASGGPFLT ADLNTFDRIT

101    PAQAVKHPNW RMGRKISVDS ATMMNKGLEL IEAHWLFNCP PDKLEVVIHP

151    QSVIHSMVRY RDGSVLAQLG NPDMRTPIAY CLGLPERIDS GVGDLDFDAL

201    SALTFQKPDF DRFPCLRLAY EAMNAGGAAP CVLNAANEAA VAAFLDGQIK

251    FTDIAKTVAH CLAQDFSDGI GDIGGLLAQD ARTRAQARAF IGTLR* m572/g572   92.9% identity in 295 aa overlap 10        20        30        40        50        60
m572.pep    MCAIVGAVGLPSALAAAQKGKTIYLANKETLVVSGALFMETARANGAAVLPVDSEHNAVF
            |||||||:||||||||||||||||||||||||||||||||||||||||||||||||||:|
g572        MCAIVGAAGLPSALAAAQKGKTIYLANKETLVVSGALFMETARANGAAVLPVDSEHNAIF
                    10        20        30        40        50        60

70        80        90       100       110       120
m572.pep    QVLPRDYAGRLNEHGIASIILTASGGPFLTADLNTFDRITPAQAVKHPNWRMGRKISVDS
            |||||||: ||||||| ||||||||||||||:||:||| ||| |||||||||||||||||
g572        QVLPRDYTDRLNEHGIDSIILTASGGPFLTTDLSTFDSITPEQAVKHPNWRMGRKISVDS
                    70        80        90       100       110       120

130       140       150       160       170       180
m572.pep    ATMMNKGLELIEAHWLFNCPPDKLEVVIHPQSVIHSMVRYRDGSVLAQLGNPDMRTPIAY
            ||| ||||||||||||||||||||||||||||||||||||||||||||||||||||||||
g572        ATMANKGLELIEAHWLFNCPPDKLEVVIHPQSVIHSMVRYRDGSVLAQLGNPDMRTPIAY
                   130       140       150       160       170       180
```

-continued

```
                190       200       210       220       230       240
m572.pep    CLGLPERIDSGVGDLDFDALSALTFQKPDFDRFPCLRLAYEAMNAGGAAPCVLNAANEAA
            |||||||||||| ||| ||||||||||| |||||::|||::||||||||||||||||:|
g572        CLGLPERIDSGVGKLDFGALSALTFQKPDFGRFPCLKFAYETINAGGAAPCVLNAANETA
                190       200       210       220       230       240

250       260       270       280       290
m572.pep    VAAFLDGQIKFTDIAKTVAHCLAQDFSDGIGDIGGLLAQDARTRAQARAFIGTLRX
            |||||||||||||||||||||||||:|:||| |||||||||||||||||||||
g572        VAAFLDGQIKFTDIAKTVAHCLAQDFSNGMGDIEGLLAQDARTRAQARAFIGTLRX
                250       260       270       280       290
```

The following partial DNA sequence was identified in *N. meningitidis* <SEQ ID 1717>:

```
a572.seq
   1 ATGTGCGCCA TCGTCGGGGC GGTGGGGCTG CCTTCCGCGC TCGCAGCGGC
  51 GCAAAAAGGC AAAACCATTT ATCTGGCGAA CAAAGAGACG CTGGTGGTTT
 101 CCGGCGCGTT GTTTATGGAA ACCGCCCGTG CAAACGGCGC GGCAGTGCTG
 151 CCCGTCGACA GCGAACACAA CGCCGTTTTC CAAGTTTTGC CGCGCGATTA
 201 CACAGGTCGC CTGAACGAAC ACGGCATCGC TTCGATTATC CTGACCGCTT
 251 CCGGCGGCCC GTTTCTGACC GCCGATTTAA ACACGTTCGA CAGCATTACG
 301 CCCGACCAAG CGGTCAAACA CCCCAATTGG CGTATGGGAC GCAAAATCTC
 351 CGTCGATTCC GCCACCATGA TGAACAAAGG TTTGGAGCTG ATTGAAGCGC
 401 ATTGGCTGTT CAACTGTCCG CCCGACAAAC TCGAAGTCGT CATCCATCCG
 451 CAATCTGTGA TACACAGCAT GGTGCGCTAC CGCGACGGCT CCGTGTTGGC
 501 GCAACTGGGC AATCCCGATA TGCGAACGCC TATCGCTTAT TGTTTGGGTT
 551 TGCCCGAGCG CATCGATTCG GGTGTCGGCG ACCTGGATTT CGACGCATTG
 601 TCCGCGCTGA CCTTCCAAAA GCCCGACTTT GACCGCTTCC CCTGCCTGAA
 651 GCTCGCCTAT GAAGCCATGA ACGCAGGCGG AGCCGCGCCC TGCGTATTGA
 701 ACGCCGCCAA CGAAGCCGCC GTCGCCGCCT TTTTGGACGG ACAGATTAAG
 751 TTTACCGACA TTGCCAAAAC CGTCGCCCAT TGTCTTTCAC AAGACTTTTC
 801 AGACGGCATA GGCGACATAG GGGGCTCTT GGCGCAAGAT GCCCGGACAC
 851 GCGCACAAGC GCGGGCATTT ATCGGCACAC TGCGCTGA
```

This corresponds to the amino acid sequence <SEQ ID 1718; ORF 572.a>:

```
a572.pep
      1    MCAIVGAVGL PSALAAAQKG KTIYLANKET LVVSGALFME TARANGAAVL
     51    PVDSEHNAVF QVLPRDYTGR LNEHGIASII LTASGGPFLT ADLNTFDSIT
    101    PDQAVKHPNW RMGRKISVDS ATMMNKGLEL IEAHWLFNCP PDKLEVVIHP
    151    QSVIHSMVRY RDGSVLAQLG NPDMRTPIAY CLGLPERIDS GVGDLDFDAL
    201    SALTFQKPDF DRFPCLKLAY EAMNAGGAAP CVLNAANEAA VAAFLDGQIK
    251    FTDIAKTVAH CLSQDFSDGI GDIGGLLAQD ARTRAQARAF IGTLR*
m572/a572   98.3% identity in 295 aa overlap 10        20        30        40        50        60
m572.pep    MCAIVGAVGLPSALAAAQKGKTIYLANKETLVVSGALFMETARANGAAVLPVDSEHNAVF
            ||||||||||||||||||||||||||||||||||||||||||||||||||||||||||||
a572        MCAIVGAVGLPSALAAAQKGKTIYLANKETLVVSGALFMETARANGAAVLPVDSEHNAVF
                10        20        30        40        50        60
```

-continued

```
                70        80        90       100       110       120
m572.pep  QVLPRDYAGRLNEHGIASIILTASGGPFLTADLNTFDRITPAQAVKHPNWRMGRKISVDS
          ||||||| :||||||||||||||||||||||||||||||| ||| ||||||||||||||||
a572      QVLPRDYTGRLNEHGIASIILTASGGPFLTADLNTFDSITPDQAVKHPNWRMGRKISVDS
                70        80        90       100       110       120

130       140       150       160       170       180
m572.pep  ATMMNKGLELIEAHWLFNCPPDKLEVVIHPQSVIHSMVRYRDGSVLAQLGNPDMRTPIAY
          ||||||||||||||||||||||||||||||||||||||||||||||||||||||||||||
a572      ATMMNKGLELIEAHWLFNCPPDKLEVVIHPQSVIHSMVRYRDGSVLAQLGNPDMRTPIAY
               130       140       150       160       170       180

190       200       210       220       230       240
m572.pep  CLGLPERIDSGVGDLDFDALSALTFQKPDFDRFPCLRLAYEAMNAGGAAPCVLNAANEAA
          |||||||||||||||||||||||||||||||||||||| :||||||||||||||||||||
a572      CLGLPERIDSGVGDLDFDALSALTFQKPDFDRFPCLKLAYEAMNAGGAAPCVLNAANEAA
               190       200       210       220       230       240

250       260       270       280       290
m572.pep  VAAFLDGQIKFTDIAKTVAHCLAQDFSDGIGDIGGLLAQDARTRAQARAFIGTLRX
          |||||||||||||||||||||||| :|||||||||||||||||||||||||||||
a572      VAAFLDGQIKFTDIAKTVAHCLSQDGSDGIGDIGGLLAQDARTRAQARAFIGTLRX
               250       260       270       280       290
```

The following partial DNA sequence was identified in *N. gonorrhoeae* <SEQ ID 1719>:

```
g573.seq..
    1 atgccctgtt tgtgccgcct taatcgcaat atcggcagtt tccaaatcac 51 gaatctcacc gaccataatg atgtccgggt cctgacgcag gaaagacttc 101 aaagcagcgg caaaagtcag accctgctta tcattgacgt taacctgatt 151 gatgcccggc aggttaatct cggcagggtc ttccgccgtt gcaatattta 201 ccgactccgt attcaaaata ttcaaacagg tatagagcga caccgtctta 251 cccgaacccg tcggaccggt taccagcacc atcccgtaag gacggtgaat 301 cgcttccaac aacaattttt tctggaacgg ctcaaaaccg agctggtcga 351 tgttcaaaga cgcggcatcg gaattcaaaa tccgcatcac gaccttttcg 401 ccaaacagcg tcggcaatgt gctgacacgg aaatcgacag gcttgccgcc 451 cttttgaaag gtcagctgca tcctaccgtc ctgcggtatc cgttttttcgg 501 aaatgtccaa acgcgacatt accttaatcc gggaagcaag ctgccccctt 551 accgcaatgg gcggctgaac cacctcgcgg agctgcccgt ccacacggaa 601 acggatacgc gcattgtgtt cgtaaaactc gaaatggatg tcggatgccc 651 cgctacgcaa ggcatccgac aaagttttat ggataaacct cggaacaggg 701 ccgtcttctg cctcctcgtc gtcgatatac agggtgtggc tttcctcttc 751 ctcttgcccc tccccaagct cctgaagcag cgatgtcgaa cgcgaaccca 801 cccaatcgag caaacccgcc aactggtcat cctcgacaat gaccaactca 851 accgcaatcc ctgcggcaga aaccgttttc tgaatttgcg gcatctgggt 901 cggatcggaa accgcaaaaa atactttgtc gcccccacgg aaaaccggca 951 cacagtggaa ctccaccatc tgctcctccg tcaacacccc catcagcacc 1001 ctgtggcgcg gataatgacg caaatcaaga atcgaataac tgaacaccct 1051 cgcaatcaat gccgcaagcg acttgggcga aatgacaccg tctga
```

This corresponds to the amino acid sequence <SEQ ID 1720; ORF 573.ng>:

```
g573.pep..
   1 MPCLCRLNRN IGSFQITNLT DHNDVRVLTQ ERLQSSGKSQ TLLIIDVNLI

51 DARQVNLGRV FRRCNIYRLR IQNIQTGIER HRLTRTRRTG YQHHPVRTVN

101 RFQQQFFLER LKTELVDVQR RGIGIQNPHH DLFAKQRRQC ADTEIDRLAA

151 LLKGQLHPTV LRYPFFGNVQ TRHYLNPGSK LPPYRNGRLN HLAELPVHTE

201 TDTRIVFVKL EMDVGCPATQ GIRQSFMDKP RNRAVFCLLV VDIQGVAFLF

251 LLPLPKLLKQ RCRTRTHPIE QTRQLVILDN DQLNRNPCGR NRFLNLRHLG

301 RIGNRKKYFV APTENRHTVE LHHLLLRQHP HQHPVARIMT QIKNRITEHP

351 RNQCRKRLGR NDTV*
```

The following partial DNA sequence was identified in *N. meningitidis* <SEQ ID 1721>:

```
m573.seq..
    1 ATGCCCTGTT TGTGCCGCCT TAATCGCAAT ATCGGCAGTT TCCAAATCAC

51 GAATCTCACC GACCATAATG ATGTCCGGGT CCTGACGCAG GAAAGACTTC

101 AAAGCAGCGG CAAAAGTCAG GCCCTGCTTA TCATTGACGT TAACCTGATT

151 GATGCCCGGC AGGTTAATCT CGGCAGGGTC TTCCGCCGTT GCAATATTTA

201 CCGACTCCGT ATTCAAAATA TTCAAACAGG TATAGAGCGA CACCGTCTTA

251 CCCGAACCCG TCGGACCGGT TACCAGCACC ATCCCGTAGG GACGGTGAAT

301 CGCTACCAAC aCaw.TTTTT TCTGAAACGG CTCAAAACCG AGCTGGTCGA

351 TGTTCAAAGA CGCGGCATCG GAATTCAAAA TCCGCATCAC GACCTTTTCG

401 CCAAACAGCG TCGGCAATGT GCTGACACGG AAATCGACAG GCTTGCCGCC

451 CTTTTGAAAG GTCAGCTGCA TCCTGCCGTC CTGCGGTATC CGTTTTTCGG

501 AAATGTCCAA ACGCGACATT ACCTTAATCC GTGAAGCAAG CTGCCCCCTT

551 ACCGCAATGG GCGGCTGAAC CACCTCGCGG AGCTGCCCGT CCACACGGAA

601 ACGGATACGG GCATTGTGTT CGTAAAACTC GAAATGGATG TCCGATGCCC

651 CGCTGCGCAA GGCATCCGAC AAAGTCTTAT GGATAAACCT CGGAACAGGG

701 CCGTCTTCTG CCTCCTCGTT GTCGATATAC AGGGTGTGGC TTTCCTCTTC

751 CTCCTGCCCC TCCCCAAGCT CCTGAAGCAG CGATGTCGAA CGCGAACCCA

801 CCCAATCGAG CAAACCCGCC AACTGGTCAT CCTCGACAAT GACCAACTCA

851 ACCTCAATCC CTGCGGCAGA AACGGTTTTC TGAATTTGCG GCATCTGTGT

901 CGGATCGGAA ACCGCAAAAA ATACTTTGTC GCCCCGACGG AAAACCGGCA

951 CACAGTGGAA CTCCACCATC TGCTCCTCCG TCAACACCCC CATCAGCACC

1001 CTGTGGCGCG GATAATGACG CAAATCAAGA ATCGAATAAC TGAACACCCT

1051 CGCAATCAAT GCCGCAAGCG ACTTGGGCGA AATGACACCG TCTGA
```

This corresponds to the amino acid sequence <SEQ ID 1722; ORF 573>:

```
m573.pep..
    1    MPCLCRLNRN IGSFQITNLT DHNDVRVLTQ ERLQSSGKSQ ALLIIDVNLI
```

-continued

```
 51    DARQVNLGRV FRRCNIYRLR IQNIQTGIER HRLTRTRRTG YQHHPVGTVN

101    RYQHXFFLKR LKTELVDVQR RGIGIQNPHH DLFAKQRRQC ADTEIDRLAA

151    LLKGQLHPAV LRYPFFGNVQ TRHYLNP*SK LPPYRNGRLN HLAELPVHTE

201    TDTGIVFVKL EMDVRCPAAQ GIRQSLMDKP RNRAVFCLLV VDIQGVAFLF

251    LLPLPKLLKQ RCRTRTHPIE QTRQLVILDN DQLNLNPCGR NGFLNLRHLC

301    RIGNRKKYFV APTENRHTVE LHHLLLRQHP HQHPVARIMT QIKNRITEHP

351    RNQCRKRLGR NDTV*
``` m573/g573 95.9% identity in 364 aa overlap

```
                 10         20         30         40         50         60
m573.pep  MPCLCRLNRNIGSFQITNLTDHNDVRVLTQERLQSSGKSQALLIIDVNLIDARQVNLGRV
          ||||||||||||||||||||||||||||||||||||||:|||||||||||||||||||||
g573      MPCLCRLNRNIGSFQITNLTDHNDVRVLTQERLQSSGKSQTLLIIDVNLIDARQVNLGRV
                 10         20         30         40         50         60
                 70         80         90        100        110        120
m573.pep  FRRCNIYRLRIQNIQTGIERHRLTRTRRTGYQHHPVGTVNRYQHXFFLKRLKTELVDVQR
          ||||||||||||||||||||||||||||||||||||||| ||||:|: |||:||||||||
g573      FRRCNIYRLRIQNIQTGIERHRLTRTRRTGYQHHPVRTVNRFQQQFFLERLKTELVDVQR
                 70         80         90        100        110        120
                130        140        150        160        170        180
m573.pep  RGIGIQNPHHDLFAKQRRQCADTEIDRLAALLKGQLHPAVLRYPFFGNVQTRHYLNPXSK
          |||||||||||||||||||||||||||||||||||||||:||||||||||||||||| ||
g573      RGIGIQNPHHDLFAKQRRQCADTEIDRLAALLKGQLHPTVLRYPFFGNVQTRHYLNPGSK
                130        140        150        160        170        180
                190        200        210        220        230        240
m573.pep  LPPYRNGRLNHLAELPVHTETDTGIVFVKLEMDVRCPAAQGIRQSLMDKPPNRAVFCLLV
          |||||||||||||||||||||||||| ||||||||:|||||||||:||||||||||||||
g573      LPPYRNGRLNHLAELPVHTETDTRIVFVKLEMDVGCPATQGIRQSFMDKPPNRAVFCLLV
                190        200        210        220        230        240
                250        260        270        280        290        300
m573.pep  VDIQGVAFLFLLPLPKLLKQRCRTRTHPIEQTRQLVILDNDQLNLNPCGRNGFLNLRHLC
          |||||||||||||||||||||||||||||||||||||||||||||:|||||| |||||||
g573      VDIQGVAFLFLLPLPKLLKQRCRTRTHPIEQTRQLVILDNDQLNRNPCGRNRFLNLRHLC
                250        260        270        280        290        300
                310        320        330        340        350        360
m573.pep  RIGNRKKYFVAPTENRHTVELHHLLLRQHPHQHPVARIMTQIKNRITEHPRNQCRKRLGR
          ||||||||||||||||||||||||||||||||||||||||||||||||||||||||||||
g573      RIGNRKKYFVAPTENRHTVELHHLLLRQHPHQHPVARIMTQIKNRITEHPRNQCRKRLGR
                310        320        330        340        350        360
m573.pep  NDTVX
          |||||
g573      NDTVX
```

The following partial DNA sequence was identified in *N. meningitidis* <SEQ ID 1723>:

```
a573.seq
   1   ATGCCCTGTT TGTGCCGCCT TAATCGCAAT ATCGGCAGTT TCCAAATCAC

51   GAATCTCACC GACCATAATG ATGTCCGGGT CCTGACGCAG GAAAGACTTC

101   AAAGCAGCGG CAAAAGTCAG ACCCTGCTTA TCATTGACGT TAACCTGATT

151   GATGCCCGGC AGGTTAATCT CGGCAGGGTC TTCCGCCGTT GCAATATTTA

201   CCGACTCCGT ATTCAAAATA TTCAAACAGG TATAGAGCGA CACCGTCTTA

251   CCCGAACCCG TCGGACCGGT TACCAGCACC ATCCCGTAGG GACGGTGAAT

301   CGCTTCCAAC AACAATTTTT TCTGAAACGG CTCAAAACCG AGCTGGTCGA

351   TGTTCAAAGA CGCGGCATCG GAATTCAAAA TCCGCATCAC GACCTTTTCG

401   CCAAACAGCG TCGGCAATGT GCTGACACGG AAATCGACAG GCTTGCCGCC

451   CTTTTGAAAG GTCAGCTGCA TCCTGCCGTC CTGCGGTATC CGTTTTTCGG

501   AAATGTCCAA ACGCGACATT ACCTTAATCC GGGAAGCAAG CTGCCCCCTT

551   ACCGCAATGG GCGGCTGAAC CACCTCGCGG AGCTGCCCGT CCACACGGAA
```

```
 601 ACGGATACGG GCATTGTGTT CGTAAAACTC GAAATGGATG TCCGATGCCC

651 CGCTGCGCAA GGCATCCGAC AAAGTCTTAT GGATAAACCT CGGAACAGGG

701 CCGTCTTCTG CCTCCTCGTT GTCGATATAC AGGGTGTGGC TTTCCTCTTC

751 CTCCTGCCCC TCCCCAAGCT CCTGAAGCAG CGATGTCGAA CGCGAACCCA

801 CCCAATCGAG CAAACCCGCC AACTGGTCAT CCTCGACAAT GACCAACTCA

851 ACCTCAATCC CTGCGGCAGA AACGGTTTTC TGAATTTGCG GCATCTGTGT

901 CGGATCGGAA ACCGCAAAAA ATACTTTGTC GCCCCGACGG AAAACCGGCA

951 CACAGTGGAA CTCCACCATC TGCTCCTCCG TCAACACCCC CATCAGCACC

1001 CTGTGGCGCG GATAATGACG CAAATCAAGA ATCGAATAAC TGAACACCCT

1051 CGCAATCAAT GCCGCAAGCG ACTTGGGCGA AATGACACCG TCTGA
```

This corresponds to the amino acid sequence <SEQ ID 1724; ORF 573.a>:

```
a573.pep

1   MPCLCRLNRN IGSFQITNLT DHNDVRVLTQ ERLQSSGKSQ TLLIIDVNLI

51   DARQVNLGRV FRRCNIYRLR IQNIQTGIER HRLTRTRRTG YQHHPVGTVN

101   RFQQQFFLKR LKTELVDVQR RGIGIQNPHH DLFAKQRRQC ADTEIDRLAA

151   LLKGQLHPAV LRYPFFGNVQ TRHYLNPGSK LPPYRNGRLN HLAELPVHTE

201   TDTGIVFVKL EMDVRCPAAQ GIRQSLMDKP RNRAVFCLLV VDIQGVAFLF

251   LLPLPKLLKQ RCRTRTHPIE QTRQLVILDN DQLNLNPCGR NGFLNLRHLC

301   RIGNRKKYFV APTENRHTVE LHHLLLRQHP HQHPVARIMT QIKNRITEHP

351   RNQCRKRLGR NDTV*
``` m573/a573   98.6% identity in 364 aa overlap

```
                 10         20         30         40         50         60
m573.pep  MPCLCRLNRNIGSFQITNLTDHNDVRVLTQERLQSSGKSQALLIIDVNLIDARQVNLGRV
          ||||||||||||||||||||||||||||||||||||||||:|||||||||||||||||||
a573      MPCLCRLNRNIGSFQITNLTDHNDVRVLTQERLQSSGKSQTLLIIDVNLIDARQVNLGRV
                 10         20         30         40         50         60

70         80         90        100        110        120
m573.pep  FRRCNIYRLRIQNIQTGIERHRLTRTRRTGYQHHPVGTVNRYQHXFFLKRLKTELVDVQR
          |||||||||||||||||||||||||||||||||||||||||:|:||||||||||||||||
a573      FRRCNIYRLRIQNIQTGIERHRLTRTRRTGYQHHPVGTVNRFQQQFFLKRLKTELVDVQR
                 70         80         90        100        110        120

130        140        150        160        170        180
m573.pep  RGIGIQNPHHDLFAKQRRQCADTEIDRLAALLKGQLHPAVLRYPFFGNVQTRHYLNPXSK
          |||||||||||||||||||||||||||||||||||||||||||||||||||||||||| ||
a573      RGIGIQNPHHDLFAKQRRQCADTEIDRLAALLKGQLHPAVLRYPFFGNVQTRHYLNPGSK
                130        140        150        160        170        180

190        200        210        220        230        240
m573.pep  LPPYRNGRLNHLAELPVHTETDTGIVFVKLEMDVRCPAAQGIRQSLMDKPRNRAVFCLLV
          ||||||||||||||||||||||||||||||||||||||||||||||||||||||||||||
a573      LPPYRNGRLNHLAELPVHTETDTGIVFVKLEMDVRCPAAQGIRQSLMDKPRNRAVFCLLV
                190        200        210        220        230        240

250        260        270        280        290        300
m573.pep  VDIQGVAFLFLLPLPKLLKQRCRTRTHPIEQTRQLVILDNDQLNLNPCGRNGFLNLRHLC
          ||||||||||||||||||||||||||||||||||||||||||||||||||||||||||||
a573      VDIQGVAFLFLLPLPKLLKQRCRTRTHPIEQTRQLVILDNDQLNLNPCGRNGFLNLRHLC
                250        260        270        280        290        300

310        320        330        340        350        360
m573.pep  RIGNRKKYFVAPTENRHTVELHHLLLRQHPHQHPVARIMTQIKNRITEHPRNQCRKRLGR
          ||||||||||||||||||||||||||||||||||||||||||||||||||||||||||||
a573      RIGNRKKYFVAPTENRHTVELHHLLLRQHPHQHPVARIMTQIKNRITEHPRNQCRKRLGR
                310        320        330        340        350        360 m573.pep  NDTVX
          |||||
a573      NDTVX
```

The following partial DNA sequence was identified in *N. gonorrhoeae* <SEQ ID 1725>:

```
g574.seq
    1 atgctgccga atctgccaaa cagccttaag aaagccgata tggacaacga
   51 attgtggatt atcctgctgc cgattatcct tttgcccgtc ttcttcacga
  101 tgggctggtt tgccgcccgc gtggatatga aaaccgtatt gaagcaggca
  151 aaaagcatcc cttcgggatt ttataaaagc ctggacgctt ggtcgaccg
  201 caacagcggg cgcgcggcaa gggagttggc ggaagtcgtc gacggccggc
  251 cgcaatcgta tgatttgaac cttaccctcg gcaaacttta ccgtcagcgc
  301 ggcgaaaacg acaaagccat caacatacac cggacaatgc tcgattctcc
  351 cgatacggtc ggcgaaaagc gcgcgcgcgt cctgtttgaa ttggcgcaaa
  401 actaccaaag cgcgggtttg gtcgatcgtg ccgaacagat ttttttgggg
  451 ctgcaagacg gtgaaatggc gcgtgaagcc agacagcacc tgctcaatat
  501 ctaccagcag gacagggatt gggaaaaagc ggttgaaacc gcccaacttc
  551 ttagtcacga cgaacagaca tatcagtttg agattgcaca gttttattgc
  601 gaacttgccc aagccgcgct gttcaagtcc aatttcgatg ccgcgcgttt
  651 caatgtcggc aaggcactcg aagccaacaa aaaatgcacc cgcgccaaca
  701 tgattttggg cgacattgaa caccgacaag gcaatttccc tgccgccgtc
  751 gaagcctatg ccgccatcga gcagcaaaac catgcatact gagcatggt
  801 cggcgagaag ctttacgaag cctatgccgc gcagggaaaa cctgaagaag
  851 gcttgaaccg tctgacagga tatatgcaga cgtttcccga acttgacctg
  901 atcaatgtcg tgtacgagaa atccctgctg cttaagggcg agaaagaagc
  951 cgcgcaaacc gccgtcgagc ttgtccgccg caagcccgac cttaacggcg
 1001 tgtaccgcct gctcggtttg aaactcagcg atttggatcc ggcttggaaa
 1051 gccgatgccg acatgatgcg ttcggttatc ggacggcagc tccagcgcag
 1101 cgtgatgtac cgttgccgca actgccactt caaatcccaa gtctttttct
 1151 ggcactgtcc cgcctgcaac aaatggcaga cgtttacgcc gaataaaatc
 1201 gaagtttaa
```

This corresponds to the amino acid sequence <SEQ ID 1726; ORF 574.ng>:

```
g574.pep..
    1 MLPNLPNSLK KADMDNELWI ILLPIILLPV FFTMGWFAAR VDMKTVLKQA
   51 KSIPSGFYKS LDALVDRNSG RAARELAEVV DGRPQSYDLN LTLGKLYRQR
  101 GENDKAINIH RTMLDSPDTV GEKRARVLFE LAQNYQSAGL VDRAEQIFLG
  151 LQDGEMAREA RQHLLNIYQQ DRDWEKAVET AQLLSHDEQT YQFEIAQFYC
  201 ELAQAALFKS NFDAARFNVG KALEANKKCT RANMILGDIE HRQGNFPAAV
  251 EAYAAIEQQN HAYLSMVGEK LYEAYAAQGK PEEGLNRLTG YMQTFPELDL
  301 INVVYEKSLL LKGEKEAAQT AVELVRRKPD LNGVYRLLGL KLSDLDPAWK
  351 ADADMMRSVI GRQLQRSVMY RCRNCHFKSQ VFFWHCPACN KWQTFTPNKI
  401 EV*
```

The following partial DNA sequence was identified in *N. meningitidis* <SEQ ID 1727>:

```
m574.seq..
     1  ATGCGCCCGA ATCTACCAAA CAGCCTTAAG AAAGCCGATA TGGACAACGA
    51  ATTGTGGATT ATCCTGCTGC CGATTATCCT TTTGCCCGTC TTCTTCGCGA
   101  TGGGCTGGTT TGCCGCCCGC GTGGATATGA AAACCGTATT GAAGCAGGCA
   151  AAAAGCATCC CTTCGGGATT TTATAAAAGC TTGGACGCTT TGGTCGACCG
   201  CAACAGCGGG CGCGCGGCAA GGGAGTTGGC GGAAGTCGTC GACGGCCGGC
   251  CGCAATCGTA TGATTTGAAC CTCACCCTCG GCAAACTTTA CCGCCAGCGT
   301  GGCGAAAACG ACAAAGCCAT CAACATACAC CGGACAATGC TCGATTCTCC
   351  CGATACGGTC GGCGAAAAGC GCGCGCGCGT CCTGTTTGAA TTGGCGCAAA
   401  ACTACCAAAG TGCGGGGTTG GTCGATCGTG CCGAACAGAT TTTTTTGGGG
   451  CTGCAAGACG GTAAAATGGC GCGTGAAGCC AGACAGCACC TGCTCAATAT
   501  CTACCAACAG GACAGGGATT GGGAAAAAGC GGTTGAAACC GCCCGGCTGC
   551  TCAGCCATGA CGATCAGACC TATCAGTTTG AAATCGCCCA GTTTTATTGC
   601  GAACTTGCCC AAGCCGCGCT GTTCAAGTCC AATTTCGATG TCGCGCGTTT
   651  CAATGTCGGC AAGGCACTCG AAGCCAACAA AAAATGCACC CGCGCCAACA
   701  TGATTTTGGG CGACATCGAA CACCGACAAG GCAATTTCCC TGCCGCCGTC
   751  GAAGCCTATG CCGCCATCGA GCAGCAAAAC CATGCATACT TGAGCATGGT
   801  CGGCGAGAAG CTTTACGAAG CCTATGCCGC GCAGGGAAAA CCTGAAGAAG
   851  GCTTGAACCG TCTGACAGGA TATATGCAGA CGTTTCCCGA ACTTGACCTG
   901  ATCAATGTCG TGTACGAGAA ATCCCTGCTG CTTAAGTGCG AGAAAGAAGC
   951  CGCGCAAACC GCCGTCGAGC TTGTCCGCCG CAAGCCCGAC CTTAACGGCG
  1001  TGTACCGCCT GCTCGGTTTG AAACTCAGCG ATATGAATCC GGCTTGGAAA
  1051  GCCGATGCCG ACATGATGCG TTCGGTTATC GGACGGCAGC TACAGCGCAG
  1101  CGTGATGTAC CGTTGCCGCA ACTGCCACTT CAAATCCCAA GTCTTTTTCT
  1151  GGCACTGCCC CGCCTGCAAC AAATGGCAGA CGTTTACCCC GAATAAAATC
  1201  GAAGTTTAA
```

This corresponds to the amino acid sequence <SEQ ID 1728; ORF 574>:

```
m574.pep..
     1  MRPNLPNSLK KADMDNELWI ILLPIILLPV FFAMGWFAAR VDMKTVLKQA
    51  KSIPSGFYKS LDALVDRNSG RAARELAEVV DGRPQSYDLN LTLGKLYRQR
   101  GENDKAINIH RTMLDSPDTV GEKRARVLFE LAQNYQSAGL VDRAEQIFLG
   151  LQDGKMAREA RQHLLNIYQQ DRDWEKAVET ARLLSHDDQT YQFEIAQFYC
   201  ELAQAALFKS NFDVARFNVG KALEANKKCT RANMILGDIE HRQGNFPAAV
   251  EAYAAIEQQN HAYLSMVGEK LYEAYAAQGK PEEGLNRLTG YMQTFPELDL
   301  INVVYEKSLL LKCEKEAAQT AVELVRRKPD LNGVYRLLGL KLSDMNPAWK
   351  ADADMMRSVI GRQLQRSVMY RCRNCHFKSQ VFFWHCPACN KWQTFTPNKI
   401  EV*
```

-continued

```
m573/g573 97.8% identity in 402 aa overlap 10        20        30        40        50        60
m574.pep   MRPNLPNSLKKADMDNELWIILLPIILLPVFFAMGWFAARVDMKTVLKQAKSIPSGFYKS
           | |||||||||||||||||||||||||||||:||||||||||||||||||||||||||||
g574       MLPNLPNSLKKADMDNELWIILLPIILLPVFFTMGWFAARVDMKTVLKQAKSIPSGFYKS
                   10        20        30        40        50        60

70        80        90       100       110       120
m574.pep   LDALVDRNSGRAARELAEVVDGRPQSYDLNLTLGKLYRQRGENDKAINIHRTMLDSPDTV
           ||||||||||||||||||||||||||||||||||||||||||||||||||||||||||||
g574       LDALVDRNSGRAARELAEVVDGRPQSYDLNLTLGKLYRQRGENDKAINIHRTMLDSPDTV
                   70        80        90       100       110       120

130       140       150       160       170       180
m574.pep   GEKRARVLFELAQNYQSAGLVDRAEQIFLGLQDGKMAREARQHLLNIYQQDRDWEKAVET
           ||||||||||||||||||||||||||||||||||:|||||||||||||||||||||||||
g574       GEKRARVLFELAQNYQSAGLVDRAEQIFLGLQDGEMAREARQHLLNIYQQDRDWEKAVET
                  130       140       150       160       170       180

190       200       210       220       230       240
m574.pep   ARLLSHDDQTYQFEIAQFYCELAQAALFKSNFDVARFNVGKALEANKKCTRANMILGDIE
           |:|||||:|||||||||||||||||||||||||:||||||||||||||||||||||||||
g574       AQLLSHDEQTYQFEIAQFYCELAQAALFKSNFDAARFNVGKALEANKKCTRANMILGDIE
                  190       200       210       220       230       240

250       260       270       280       290       300
m574.pep   HRQGNFPAAVEAYAAIEQQNHAYLSMVGEKLYEAYAAQGKPEEGLNRLTGYMQTFPELDL
           ||||||||||||||||||||||||||||||||||||||||||||||||||||||||||||
g574       HRQGNFPAAVEAYAAIEQQNHAYLSMVGEKLYEAYAAQGKPEEGLNRLTGYMQTFPELDL
                  250       260       270       280       290       300

310       320       330       340       350       360
m574.pep   INVVYEKSLLLKCEKEAAQTAVELVRRKPDLNGVYRLLGLKLSDMNPAWKADADMMRSVI
           |||||||||||| ||||||||||||||||||||||||||||||||::||||||||||||||
g574       INVVYEKSLLLKGEKEAAQTAVELVRRKPDLNGVYRLLGLKLSDLDPAWKADADMMRSVI
                  310       320       330       340       350       360

370       380       390       400
m574.pep   GRQLQRSVMYRCRNCHFKSQVFFWHCPACNKWQTFTPNKIEVX
           |||||||||||||||||||||||||||||||||||||||||||
g574       GRQLQRSVMYRCRNCHFKSQVFFWHCPACNKWQTFTPNKIEVX
                  370       380       390       400
```

The following partial DNA sequence was identified in *N. meningitidis* <SEQ ID 1729>:

```
a574.seq
     1  ATGCGCCCGA ATCTGCCAAA CAGCCTTGAG AAAGCCGATA TGGACAATGA

51  ATTGTGGATT ATCCTGCTGC CGATTATCCT TTTGCCCGTT TTCTTCGCGA

101  TGGGCTGGTT TGCCGCCCGC GTGGATATGA AGACTGTATT AAAGCAGGCA

151  AAAAGCATAC CGTCGGGATT TTATAAAAGT CTGGATGCCT TGGTTGACCG

201  CAACAGCGGG CGCGCGGCAA GGGAGTTGGC GGAAGTCGTC GACGGCCGGC

251  CGCAATCGTA TGATTTGAAC CTCACCCTCG GCAAACTTTA CCGCCAGCGT

301  GGCGAAAACG ACAAAGCCAT CAATATGCAC CAAACATTGC TTGACTCTCC

351  CGATACAACC GGAGCCAAGC GCGCGCGCGT CCTGTTTGAA TTGGCGCAAA

401  ACTACCAAAG TGCGGGGTTG GTCGATCGTG CCGAACAGAT TTTTTTGGGG

451  CTGCAAGACG GTGAAATGGC GCGTGAAGCC AGACAGCACC TGCTCAATAT

501  CTACCAACAG GACAGGGATT GGGAAAAAGC GGTTGAAACC GCCCGGCTGC

551  TCAGCCATGA CGATCAGACC TATCAGTTTG AAATCGCCCA GTTTTATTGC

601  GAACTTGCCC AAGCCGCGCT GTTCAAGTCC AATTTCGATG CCGCGCGTTT

651  CAATGTCGGC AAGGCACTCG AAGCCAACAA AAAATGCACC CGCGCCAACA

701  TGATTTTGGG CGACATCGAA CACCGACAAG GCAATTTCCC TGCCGCCGTC

751  GAAGCCTATG CCGCCATCGA GCAGCAAAAC CATGCATACT TGAGTATGGT

801  CGGCGAGAAG CTTTACGAAG CCTATGCCGC GCAGGGAAAA CCTGAAGAAG

851  GCTTGAACCG TCTGACAGGA TATATGCAGA CGTTTCCCGA ACTTGACCTG
```

```
-continued
 901 ATCAATGTCG TGTACGAGAA ATCCCTGCTG CTTAAGTGCG AGAAAGAAGC

951 CGCGCAAACC GCCGTCGAGC TTGTCCGCCG CAAGCCCGAC CTCAACGGCG

1001 TGTACCGCCT GCTTGGTTTG AAACTCAGCG ATTTGGATCC GGCTTGGAAA

1051 GCCGATGCCG ATATGATGCG TTCGGTTATC GGACGGCAGC TACAGCGCAG

1101 CGTGATGTAC CGGTGCCGAA ACTGCCACTT CAAATCACAA GTCTTTTTCT

1151 GGCATTGTCC TGCCTGCAAC AAATGGCAGA CGTTTACGCC AAACAAATC

1201 GAAGTTTAA
```

This corresponds to the amino acid sequence <SEQ ID 1730; ORF 574.a>:

```
a574.pep

1     MRPNLPNSLE KADMDNELWI ILLPIILLPV FFAMGWFAAR VDMKTVLKQA

51     KSIPSGFYKS LDALVDRNSG RAARELAEVV DGRPQSYDLN LTLGKLYRQR

101     GENDKAINMH QTLLDSPDTT GAKRARVLFE LAQNYQSAGL VDRAEQIFLG

151     LQDGEMAREA RQHLLNIYQQ DRDWEKAVET ARLLSHDDQT YQFEIAQFYC

201     ELAQAALFKS NFDAARFNVG KALEANKKCT RANMILGDIE HRQGNFPAAV

251     EAYAAIEQQN HAYLSMVGEK LYEAYAAQGK PEEGLNRLTG YMQTFPELDL

301     INVVYEKSLL LKCEKEAAQT AVELVRRKPD LNGVYRLLGL KLSDLDPAWK

351     ADADMMRSVI GRQLQRSVMY RCRNCHFKSQ VFFWHCPACN KWQTFTPNKI

401     EV* m574/a574   97.5% identity in 402 aa overlap 10         20         30         40         50         60
m574.pep    MRPNLPNSLKKADMDNELWIILLPIILLPVFFAMGWFAARVDMKTVLKQAKSIPSGFYKS
            ||||||||| :|||||||||||||||||||||||||||||||||||||||||||||||||
a574        MRPNLPNSLEKADMDNELWIILLPIILLPVFFAMGWFAARVDMKTVLKQAKSIPSGFYKS
                     10         20         30         40         50         60

70         80         90        100        110        120
m574.pep    LDALVDRNSGRAARELAEVVDGRPQSYDLNLTLGKLYRQRGENDKAINIHRTMLDSPDTV
            ||||||||||||||||||||||||||||||||||||||||||||||||||:|:|||||:
a574        LDALVDRNSGRAARELAEVVDGRPQSYDLNLTLGKLYRQRGENDKAINMHQTLLDSPDTT
                     70         80         90        100        110        120

130        140        150        160        170        180
m574.pep    GEKRARVLFELAQNYQSAGLVDRAEQIFLGLQDGKMAREARQHLLNIYQQDRDWEKAVET
            | ||||||||||||||||||||||||||||||||:|||||||||||||||||||||||||
a574        GAKRARVLFELAQNYQSAGLVDRAEQIFLGLQDGEMAREARQHLLNIYQQDRDWEKAVET
                    130        140        150        160        170        180

190        200        210        220        230        240
m574.pep    ARLLSHDDQTYQFEIAQFYCELAQAALFKSNFDVARFNVGKALEANKKCTRANMILGDIE
            |||||||||||||||||||||||||||||||||:||||||||||||||||||||||||||
a574        ARLLSHDDQTYQFEIAQFYCELAQAALFKSNFDAARFNVGKALEANKKCTRANMILGDIE
                    190        200        210        220        230        240

250        260        270        280        290        300
m574.pep    HRQGNFPAAVEAYAAIEQQNHAYLSMVGEKLYEAYAAQGKPEEGLNRLTGYMQTFPELDL
            ||||||||||||||||||||||||||||||||||||||||||||||||||||||||||||
a574        HRQGNFPAAVEAYAAIEQQNHAYLSMVGEKLYEAYAAQGKPEEGLNRLTGYMQTFPELDL
                    250        260        270        280        290        300

310        320        330        340        350        360
m574.pep    INVVYEKSLLLKCEKEAAQTAVELVRRKPDLNGVYRLLGLKLSDMNPAWKADADMMRSVI
            ||||||||||||||||||||||||||||||||||||||||||||:||||||||||||||
a574        INVVYEKSLLLKCEKEAAQTAVELVRRKPDLNGVYRLLGLKLSDLDPAWKADADMMRSVI
                    310        320        330        340        350        360

370        380        390        400
m574.pep    GRQLQRSVMYRCRNCHFKSQVFFWHCPACNKWQTFTPNKIEVX
            ||||||||||||||||||||||||||||||||||||||||||
a574        GRQLQRSVMYRCRNCHFKSQVFFWHCPACNKWQTFTPNKIEVX
                    370        380        390        400
```

The following partial DNA sequence was identified in *N. gonorrhoeae* <SEQ ID 1731>:

```
g575.seq (partial)
   1  ..atgccgtgcc tccgccggca agcagcaagg tgtacgaacc gccgaacaga 51    ccgtcaaaca gtccgctttc ggtttcttct cggcagaaa  cctgttcgac 101    aggttcggca acgggttcgg cggcaacttc actggctgtt tccgcaacag 151    gttcggaaac ggtgttaccg gtttcgtcgg tcggcgtgtc gatggcagaa 201    gcggcggctt cttgggggg  cggattcggc agcggtttcc gatgcggcag 251    tatttgcagc gggtacaggt ccgggttggc gttctgtcgc cgaagccgga 301    gtttcggaca ctgcgggttt gggttcgggt cgaacggccg gtttttccgc 351    ttttgcttcg ggcgcggcaa cttttgcttc aggtttttca accggttttt 401    cgacaggttt ctctatcggt ttctccacag ttgcctgttt ggacggttca 451    gacggcatgg atgcagtttc ggctttgggt ttcgccgttt gcggtttggg 501    ttgttccgct ttgatttttt tgggtgctgc cgctttgatc ctgttcagat 551    tcggaatgtg a*
```

This corresponds to the amino acid sequence <SEQ ID 1732; ORF 575.ng>:

```
g575.pep (partial)
   1  ..MPCLRRQAAR CTNRRTDRQT VRFRFLLRQK PVRQVRQRVR RQLHWLFPQQ

51    VRKRCYRFRR SACRWQKRRL LGGADSAAVS DAAVFAAGTG PGWRSVAEAG

101    VSDTAGLGSG RTAGFSAFAS GAATFASGFS TGFSTGFSIG FSTVACLDGS

151    DGMDAVSALG FAVCGLGCSA LIFLGAAALI LFRFGM*
```

The following partial DNA sequence was identified in *N. meningitidis* <SEQ ID 1733>:

```
m575.seq..
   1  ATGGTTTCGG GCGAGGAAGC CTTCAGGAAG CCTGCCAGTC CGGAGGGTGA

51  GGCAGGTTTT GCGGAAGCTG TTTCTTCTGT GCCGATATGG TTGTTTGAGG

101  GCAGGTTGTC GGAGAAATCG GTATCGACGG TTTCCGGTTT GTTTTCGGCA

151  GTTTGGGCGA CAGATTCCGG TTCGGGCGTG TCGATGACGA TTTCGACAGG

201  GTTGTACGGG TTGAAGGTCT CGGGCTCGTA CACGCTGTCT GTGGATTCGA

251  TGGCGTTCCA ATCGGCATCC GCGCGTTTTT GGGTTTCTTC ATCCTGCGTA

301  AGTGCGCCGG ATAAAATGCC GTTTTGCGCG GCTGCCAGGC TGTCGAAATC

351  CAAGTCGATG CGGTTGGAAG GCGTATCGGT TTCGACATCG AACGTTTGTT

401  TTGCCGATAA CTCTTCTTCA GATTCCCCAT CTAAGGCAAG TGTGTCGTTT

451  ACATCGTTTT TCGGAGCGGG TTCGGGCGTT GCCGGAGTTT CGACTTCGGC

501  AAAGGTGATT TCTATGCCGT CGTCTGCCGC GTCGTCAAGG TCAGGCTCTT

551  CCTCAGGGAC GGATTCTTCG GTACGGCGCG CGCGTTTGGA TTGGGCAAGG

601  CGCAAAAGCA GCAGCAGGGC GATTAATGCC GCGCCTCCGC CGGCAAGCAG

651  CAAGGTGTAC GAACCGCCGA ACAGACCGTC AAACAGTCCG CTTTCGGTTT

701  CTTCTTCGGC AGAAACCTGT TCGACAGGTT CGGAAACGGC GTTACCGGTT

751  TCGTCGGTCG GCGTGTCGAT GGCAGAAGCG GCGGCTTCTT GGGGGGCGGA
```

-continued

```
 801 TTCGGCAGCG GTTTCCGATG CGGCAGTATT TGCAGCGGGT ACAGGTTCGG

851 GTCGAACGGC CGGTTTTTCC GCTTTTGCTT CGGGCGCGGC AACTTTTGCT

901 TCAGGTTTTT CAACCGGTTT CTCTACCGTT GCCTGTTTGG ACGGTTCGGA

951 CGGCATGGAT GCGGTTTCGG CTTTGGGTTT CGCCGTTTGC GGTTTGGGTT

1001 GTTCCGCTTT GATCCTGTTC AGATTCGGAA TGTGA
```

This corresponds to the amino acid sequence <SEQ ID 1734; ORF 575>:

```
   m575.pep

1    MVSGEEAFRK PASPEGEAGF AEAVSSVPIW LFEGRLSEKS VSTVSGLFSA

51    VWATDSGSGV SMTISTGLYG LKVSGSYTLS VDSMAFQSAS ARFWVSSSCV

101    SAPDKMPFCA AARLSKSKSM RLEGVSVSTS NVCFADNSSS DSPSKASVSF

151    TSFFGAGSGV AGVSTSAKVI SMPSSAASSR SGSSSGTDSS VRRARLDWAR

201    RKSSSRAINA APPPASSKVY EPPNRPSNSP LSVSSSAETC STGSETALPV

251    SSVGVSMAEA AASWGADSAA VSDAAVFAAG TGSGRTAGFS AFASGAATFA

301    SGFSTGFSTV ACLDGSDGMD AVSALGFAVC GLGCSALILF RFGM* m575/g575   70.2% identity in 114 aa overlap 240        250        260        270        280
    m575.pep   SSAETCSTGSETALPVSSVGVSMAEAAASWGADSAAVSDAAVFAAGTG------------
                                  ||||||||||||||||||||||||||||
        g575   LHWLFPQQVRKRCYRFRRSACRWQKRRLLGGADSAAVSDAAVFAAGTGPGWRSVAEAGVS
                   50         60         70         80         90        100

290        300  309       310        320
    m575.pep   ------SGRTAGFSAFASGAATFASGFSTGFST--------VACLDGSDGMDAVSALGFA
                     ||||||||||||||||||||||||||||         ||||||||||||||||||
        g575   DTAGLGSGRTAGFSAFASGAATFASGFSTGFSIGFSTVACLDGSDGMDAVSALGFA
                      110        120        130        140        150        160

330            340
    m575.pep   VCGLGCSALI--------LFRFGMX
               |||||||||        |||||||
        g575   VCGLGCSALIFLGAAALILFRFGMX
                      170        180
```

The following partial DNA sequence was identified in N. meningitidis <SEQ ID 1735>:

```
a575.seq
   1 ATGGTTTCGG GCGAGGAAGC CTTCAGGAAG CCTGCCAGTC CGGAGGGTGA

51 GGCAGGTTTT GCGGAAGCTG TTTCTTCTGT GCCGATATGG TTGTTTGAGG

101 GCAGGTTGTC GGAGAAATCG GTATCGACGG TTTCCGGTTT GTTTTCGGCA

151 GTTTGGGCGA CAGATTCCGG TTCGGGCGTG TCGATGACGA TTTCGACAGG

201 GTTGTACGGG TTGAAGGTCT CGGGCTCGTA CACGCTGTCT GTGGATTCGA

251 TGGCGTTCCA ATCGGCATCC GCGCGTTTTT GGGTTTCTTC ATCCTGCGTA

301 AGTGCGCCGG ATAAAATGCC GTTTTGCGCG GCTGCCAGGC TGTCGAAATC

351 CAAGTCGATG CGGTTGGAAG GCGTATCGGT TTCGACATCG AACGTTTGTT

401 TTGCCGACAA CTCTTCTTCA GATTCCCCAT CTAAGGCAAG TGTGTCGTTT

451 ACATCGTTTT TCGGAGCGGG TTCGGGCGTT GCCGGAGTTT CGACTTCGGC

501 AAAGGTGATT TCTATGCCGT CGTCTGCCGC GTCGTCAAGG TCAGGCTCTT

551 CCTCAGGGAC GGATTCTTCG GTACGGCGCG CGCGTTTGGA TTGGGCAAGG

601 CGCAAAAGCA GCAGCAGGGC GATCAATGCC GCGCCTCCGC CGGCAAGCAG
```

-continued

```
 651  CAAGGTGTAC GAACCGCCGA ACAGTCCGCT TTCGGTTTCT TCTTCGGCAG
 701  AAACCTGTTC GACAGGTTCG GAAACGGCGT TACCGGTTTC GTCGGTCGGC
 751  GTGTCGATGG CAGAAGCGGC GGCTTCTTGG GGGGCGGATT CGGCAGCGGT
 801  TTCCGATGCG GCAGTATTTG CAGCGGGTAC AGGTTCGGGT CGAACGGCCG
 851  GTTTTTCCGC TTTTGCTTCG GGCGCGGCAA CTTTTGCTTC AGGTTTTTCA
 901  ACCGGTTTCT CTACCGTTGC CTGTTTGGAC GGTTCGGACG GCATGGATGC
 951  GGTTTCGGCT TTGGGTTTCG CCGTTTGCGG TTTGGGTTGT TCCGCTTTGA
1001  TCCTGTTCAG ATTCGGAATG TGA
```

This corresponds to the amino acid sequence <SEQ ID 1736; ORF 575.a>:

```
a575.pep

1   MVSGEEAFRK PASPEGEAGF AEAVSSVPIW LFEGRLSEKS VSTVSGLFSA
   51   VWATDSGSGV SMTISTGLYG LKVSGSYTLS VDSMAFQSAS ARFWVSSSCV
  101   SAPDKMPFCA AARLSKSKSM RLEGVSVSTS NVCFADNSSS DSPSKASVSF
  151   TSFFGAGSGV AGVSTSAKVI SMPSSAASSR SGSSSGTDSS VRRARLDWAR
  201   RKSSSRAINA APPPASSKVY EPPNSPLSVS SSAETCSTGS ETALPVSSVG
  251   VSMAEAAASW GADSAAVSDA AVFAAGTGSG RTAGFSAFAS GAATFASGFS
  301   TFGSTVACLD GSDGMDAVSA LGFAVCGLGC SALILFRFGM * m575/a575   98.8% identity in 344 aa overlap 10         20         30         40         50         60
m575.pep  MVSGEEAFRKPASPEGEAGFAEAVSSVPIWLFEGRLSEKSVSTVSGLFSAVWATDSGSGV
          ||||||||||||||||||||||||||||||||||||||||||||||||||||||||||||
a575      MVSGEEAFRKPASPEGEAGFAEAVSSVPIWLFEGRLSEKSVSTVSGLFSAVWATDSGSGV
                  10         20         30         40         50         60

70         80         90        100        110        120
m575.pep  SMTISTGLYGLKVSGSYTLSVDSMAFQSASARFWVSSSCVSAPDKMPFCAAARLSKSKSM
          ||||||||||||||||||||||||||||||||||||||||||||||||||||||||||||
a575      SMTISTGLYGLKVSGSYTLSVDSMAFQSASARFWVSSSCVSAPDKMPFCAAARLSKSKSM
                  70         80         90        100        110        120

130        140        150        160        170        180
m575.pep  RLEGVSVSTSNVCFADNSSSDSPSKASVSFTSFFGAGSGVAGVSTSAKVISMPSSAASSR
          ||||||||||||||||||||||||||||||||||||||||||||||||||||||||||||
a575      RLEGVSVSTSNVCFADNSSSDSPSKASVSFTSFFGAGSGVAGVSTSAKVISMPSSAASSR
                 130        140        150        160        170        180

190        200        210        220        230        240
m575.pep  SGSSSGTDSSVRRARLDWARRKSSSRAINAAPPPASSKVYEPPNRPSNSPLSVSSSAETC
          |||||||||||||||||||||||||||||||||||||||||||||    ||||||||||||
a575      SGSSSGTDSSVRRARLDWARRKSSSRAINAAPPPASSKVYEPPN----SPLSVSSSAETC
                 190        200        210        220            230

250        260        270        280        290        300
m575.pep  STGSETALPVSSVGVSMAEAAASWGADSAAVSDAAVFAAGTGSGRTAGFSAFASGAATFA
          ||||||||||||||||||||||||||||||||||||||||||||||||||||||||||||
a575      STGSETALPVSSVGVSMAEAAASWGADSAAVSDAAVFAAGTGSGRTAGFSAFASGAATFA
              240        250        260        270        280        290

310        320        330        340
m575.pep  SGFSTGFSTVACLDGSDGMDAVSALGFAVCGLGCSALILFRFGMX
          |||||||||||||||||||||||||||||||||||||||||||||
a575      SGFSTGFSTVACLDGSDGMDAVSALGFAVCGLGCSALILFRFGMX
              300        310        320        330        340
```

The following partial DNA sequence was identified in *N. gonorrhoeae* <SEQ ID 1737>:

```
g576.seq..(partial)
    1   ..atgggcgtgg acatcggacg ctccctgaaa caaatgaagg aacagggcgc
```

-continued

```
 51    ggaaatcgat ttgaaagtct ttaccgatgc catgcaggca gtgtatgacg
101    gcaaagaaat caaaatgacc gaagagcagg cccaggaagt gatgatgaaa
151    ttcctgcagg agcagcaggc taaagccgta gaaaaacaca aggcggatgc
201    gaaggccaac aagaaaaag gcgaagcctt cctgaaggaa aatgccgccg
251    aagacggcgt gaagaccact gcttccggtc tgcagtacaa aatcaccaaa
301    cagggtgaag gcaaacagcc gacaaaagac gacatcgtta ccgtggaata
351    cgaaggccgc ctgattgacg gtaccgtatt cgacagcagc aaagccaacg
401    gcggcccggc caccttccct ttgagccaag tgattccggg ttggaccgaa
451    ggcgtacggc ttctgaaaga aggcggcgaa gccacgttct acatcccgtc
501    caaccttgcc taccgcgaac agggtgcggg cgaaaaaatc ggtccgaacg
551    ccactttggt atttgacgtg aaactggtca aaatcggcgc acccgaaaac
601    gcgcccgcca agcagccgga tcaagtcgac atcaaaaaag taaattaa
```

This corresponds to the amino acid sequence <SEQ ID 1738; ORF 576.ng>:

```
g576.pep..(partial)
  1  ..MGVDIGRSLK QMKEQGAEID LKVFTDAMQA VYDGKEIKMT EEQAQEVMMK
 51    FLQEQQAKAV EKHKADAKAN KEKGEAFLKE NAAEDGVKTT ASGLQYKITK
101    QGEGKQPTKD DIVTVEYEGR LIDGTVFDSS KANGGPATFP LSQVIPGWTE
151    GVRLLKEGGE ATFYIPSNLA YREQGAGEKI GPNATLVFDV KLVKIGAPEN
201    APAKQPDQVD IKKVN*
```

The following partial DNA sequence was identified in *N. meningitidis* <SEQ ID 1739>:

```
m576.seq.. (partial)
  1  ..ATGCAGCAGG CAAGCTATGC GATGGGCGTG GACATCGGAC GCTCCCTGAA
 51    GCAAATGAAG GAACAGGGCG CGGAAATCGA TTTGAAAGTC TTTACCGAAG
101    CCATGCAGGC AGTGTATGAC GGCAAAGAAA TCAAAATGAC CGAAGAGCAG
151    GCTCAGGAAG TCATGATGAA ATTCCTTCAG GAACAACAGG CTAAAGCCGT
201    AGAAAAACAC AAGGCGGACG CGAAGGCCAA TAAAGAAAAA GGCGAAGCCT
251    TTCTGAAAGA AAATGCCGCC AAAGACGGCG TGAAGACCAC TGCTTCCGGC
301    CTGCAATACA AAATCACCAA ACAGGGCGAA GGCAAACAGC CGACCAAAGA
351    CGACATCGTT ACCGTGGAAT ACGAAGGCCG CCTGATTGAC GGTACGGTAT
401    TCGACAGCAG CAAAGCCAAC GGCGGCCCGG TCACCTTCCC TTTGAGCCAA
451    GTGATTCCGG GTTGGACCGA AGgCGTACAG CTTCTGAAAG AAGGCGGCGA
501    AGCCACGTTC TACATCCCGT CCAACCTTGC CTACCGCGAA CAGGGTGCGG
551    GCGACAAAAT CGGTCCGAAC GCCACTTTGG TATTTGATGT GAAACTGGTC
601    AAAATCGGCG CACCCGAAAA CGCGCCCGCC AAGCAGCCGG CTCAAGTCGA
651    CATCAAAAAA GTAAATTAA
```

This corresponds to the amino acid sequence <SEQ ID 1740; ORF 576>:

```
m576.pep.. (partial)
  1 ..MQQASYAMGV DIGRSLKQMK EQGAEIDLKV FTEAMQAVYD GKEIKMTEEQ

51    AQEVMMKFLQ EQQAKAVEKH KADAKANKEK GEAFLKENAA KDGVKTTASG

101    LQYKITKQGE GKQPTKDDIV TVEYEGRLID GTVFDSSKAN GGPVTFPLSQ

151    VIPGWTEGVQ LLKEGGEATF YIPSNLAYRE QGAGDKIGPN ATLVFDVKLV

201    KIGAPENAPA KQPAQVDIKK VN*
```

Computer analysis of this amino acid sequence gave the following results:
Homology with a Predicted ORF from *N. gonorrhoeae*

```
    m576/g576 97.2% identity in 215 aa overlap 10         20         30         40         50         60
    m576.pep MQQASYAMGVDIGRSLKQMKEQGAEIDLKVFTEAMQAVYDGKEIKMTEEQAQEVMMKFLQ
                     ||||||||||||||||||||||||:|||||||||||||||||||||||||
    g576             MGVDIGRSLKQMKEQGAEIDLKVFTDAMQAVYDGKEIKMTEEQAQEVMMKFLQ
                             10         20         30         40         50
                   70         80         90        100        110        120
    m576.pep EQQAKAVEKHKADAKANKEKGEAFLKENAAKDGVKTTASGLQYKITKQGEGKQPTKDDIV
            ||||||||||||||||||||||||||||||:|||||||||||||||||||||||||||||
    g576     EQQAKAVEKHKADAKANKEKGEAFLKENAAEDGVKTTASGLQYKITKQGEGKQPTKDDIV
                     60         70         80         90        100        110
                  130        140        150        160        170        180
    m576.pep TVEYEGRLIDGTVFDSSKANGGPVTFPLSQVIPGWTEGVQLLKEGGEATFYIPSNLAYRE
            |||||||||||||||||||||||:||||||||||||||:|||||||||||||||||||||
    g576     TVEYEGRLIDGTVFDSSKANGGPATFPLSQVIPGWTEGVRLLKEGGEATFYIPSNLAYRE
                     120        130        140        150        160        170
                  190        200        210        220
    m576.pep QGAGDKIGPNATLVFDVKLVKIGAPENAPAKQPAQVDIKKVNX
            ||||:||||||||||||||||||||||||||| ||||||||||
    g576     QGAGEKIGPNATLVFDVKLVKIGAPENAPAKQPDQVDIKKVNX
                     180        190        200        210
```

The following partial DNA sequence was identified in *N. meningitidis* <SEQ ID 1741>:

```
a576.seq
  1 ATGAACACCA TTTTCAAAAT CAGCGCACTG ACCCTTTCCG CCGCTTTGGC

51 ACTTTCCGCC TGCGGCAAAA AAGAAGCCGC CCCCGCATCT GCATCCGAAC

101 CTGCCGCCGC TTCTTCCGCG CAGGGCGACA CCTCTTCGAT CGGCAGCACG

151 ATGCAGCAGG CAAGCTATGC GATGGGCGTG GACATCGGAC GCTCCCTGAA

201 GCAAATGAAG GAACAGGGCG CGGAAATCGA TTTGAAAGTC TTTACCGAAG

251 CCATGCAGGC AGTGTATGAC GGCAAAGAAA TCAAAATGAC CGAAGAGCAG

301 GCTCAGGAAG TCATGATGAA ATTCCTTCAG GAACAACAGG CTAAAGCCGT

351 AGAAAAACAC AAGGCGGACG CGAAGGCCAA TAAAGAAAAA GGCGAAGCCT

401 TTCTGAAAGA AAATGCCGCC AAAGACGGCG TGAAGACCAC TGCTTCCGGC

451 CTGCAATACA AAATCACCAA ACAGGGCGAA GGCAAACAGC CGACCAAAGA

501 CGACATCGTT ACCGTGGAAT ACGAAGGCCG CCTGATTGAC GGTACGGTAT

551 TCGACAGCAG CAAAGCCAAC GGCGGCCCGG TCACCTTCCC TTTGAGCCAA

601 GTGATTCTGG GTTGGACCGA AGGCGTACAG CTTCTGAAAG AAGGCGGCGA

651 AGCCACGTTC TACATCCCGT CCAACCTTGC CTACCGCGAA CAGGGTGCGG

701 GCGACAAAAT CGGCCCGAAC GCCACTTTGG TATTTGATGT GAAACTGGTC
```

```
-continued
751 AAAATCGGCG CACCCGAAAA CGCGCCCGCC AAGCAGCCGG CTCAAGTCGA

801 CATCAAAAAA GTAAATTAA
```

This corresponds to the amino acid sequence <SEQ ID 1742; ORF 576.a>:

```
a576.pep

1   MNTIFKISAL TLSAALALSA CGKKEAAPAS ASEPAAASSA QGDTSSIGST

51   MQQASYAMGV DIGRSLKQMK EQGAEIDLKV FTEAMQAVYD GKEIKMTEEQ

101   AQEVMMKFLQ EQQAKAVEKH KADAKANKEK GEAFLKENAA KDGVKTTASG

151   LQYKITKQGE GKQPTKDDIV TVEYEGRLID GTVFDSSKAN GGPVTFPLSQ

201   VILGWTEGVQ LLKEGGEATF YIPSNLAYRE QGAGDKIGPN ATLVFDVKLN

251   KIGAPENAPA KQPAQVDIKK VN* m576/a576   99.5% identity in 222 aa overlap 10         20         30
m576.pep                      MQQASYAMGVDIGRSLKQMKEQGAEIDLKV
                              |||||||||||||||||||||||||||||
a576        CGKKEAAPASASEPAAASSAQGDTSSIGSTMQQASYAMGVDIGRSLKQMKEQGAEIDLKV
                30        40        50        60        70        80

40         50         60         70         80         90
m576.pep    FTEAMQAVYDGKEIKMTEEQAQEVMMKFLQEQQAKAVEKHKADAKANKEKGEAFLKENAA
            ||||||||||||||||||||||||||||||||||||||||||||||||||||||||||||
a576        FTEAMQAVYDGKEIKMTEEQAQEVMMKFLQEQQAKAVEKHKADAKANKEKGEAFLKENAA
                    90        100       110       120       130       140

100        110        120        130        140        150
m576.pep    KDGVKTTASGLQYKITKQGEGKQPTKDDIVTVEYEGRLIDGTVFDSSKANGGPVTFPLSQ
            ||||||||||||||||||||||||||||||||||||||||||||||||||||||||||||
a576        KDGVKTTASGLQYKITKQGEGKQPTKDDIVTVEYEGRLIDGTVFDSSKANGGPVTFPLSQ
                   150       160       170       180       190       200

160        170        180        190        200        210
m576.pep    VIPGWTEGVQLLKEGGEATFYIPSNLAYREQGAGDKIGPNATLVFDVKLVKIGAPENAPA
            || |||||||||||||||||||||||||||||||||||||||| |||||||||||||||
a576        VILGWTEGVQLLKEGGEATFYIPSNLAYREQGAGDKIGPNATLVGDVKLVKIGAPENAPA
                   210       220       230       240       250       260

220
m576.pep    KQPAQVDIKKVNX
            |||||||||||||
a576        KQPAQVDIKKVNX
                   270
```

The following partial DNA sequence was identified in *N. gonorrhoeae* <SEQ ID 1743>:

```
g576-1.seq
    1 ATGAACACCA TTTTCAAAAT CAGCGCACTG ACCCTTTCCG CCGCTTTGGC

51 ACTTTCCGCC TGCGGCAAAA AAGAAGCCGC CCCCGCATCT GCATCCGAAC

101 CTGCCGCCGC TTCTGCCGCG CAGGGCGACA CCTCTTCAAT CGGCAGCACG

151 ATGCAGCAGG CAAGCTATGC AATGGGCGTG GACATCGGAC GCTCCCTGAA

201 ACAAATGAAG GAACAGGGCG CGGAAATCGA TTTGAAAGTC TTTACCGATG

251 CCATGCAGGC AGTGTATGAC GGCAAAGAAA TCAAAATGAC CGAAGAGCAG

301 GCCCAGGAAG TGATGATGAA ATTCCTGCAG GAGCAGCAGG CTAAAGCCGT

351 AGAAAAACAC AAGGCGGATG CGAAGGCCAA CAAAGAAAAA GGCGAAGCCT

401 TCCTGAAGGA AAATGCCGCC AAAGACGGCG TGAAGACCAC TGCTTCCGGT

451 CTGCAGTACA AAATCACCAA ACAGGGTGAA GGCAAACAGC CGACAAAAGA

501 CGACATCGTT ACCGTGGAAT ACGAAGGCCG CCTGATTGAC GGTACCGTAT
```

-continued

```
551 TCGACAGCAG CAAAGCCAAC GGCGGCCCGG CCACCTTCCC TTTGAGCCAA

601 GTGATTCCGG GTTGGACCGA AGGCGTACGG CTTCTGAAAG AAGGCGGCGA

651 AGCCACGTTC TACATCCCGT CCAACCTTGC CTACCGCGAA CAGGGTGCGG

701 GCGAAAAAAT CGGTCCGAAC GCCACTTTGG TATTTGACGT GAAACTGGTC

751 AAAATCGGCG CACCCGAAAA CGCGCCCGCC AAGCAGCCGG ATCAAGTCGA

801 CATCAAAAAA GTAAATTAA
```

This corresponds to the amino acid sequence <SEQ ID 1744; ORF 576-1.ng>:

```
g576-1.pep
   1 MNTIFKISAL TLSAALALSA CGKKEAAPAS ASEPAAASAA QGDTSSIGST

51 MQQASYAMGV DIGRSLKQMK EQGAEIDLKV FTDAMQAVYD GKEIKMTEEQ

101 AQEVMMKFLQ EQQAKAVEKH KADAKANKEK GEAFLKENAA KDGVKTTASG

151 LQYKITKQGE GKQPTKDDIV TVEYEGRLID GTVFDSSKAN GGPATFPLSQ

201 VIPGWTEGVR LLKEGGEATF YIPSNLAYRE QGAGEKIGPN ATLVFDVKLV

251 KIGAPENAPA KQPDQVDIKK VN*
```

The following partial DNA sequence was identified in *N. meningitidis* <SEQ ID 1745>:

```
m576-1.seq
   1 ATGAACACCA TTTTCAAAAT CAGCGCACTG ACCCTTTCCG CCGCTTTGGC

51 ACTTTCCGCC TGCGGCAAAA AAGAAGCCGC CCCCGCATCT GCATCCGAAC

101 CTGCCGCCGC TTCTTCCGCG CAGGGCGACA CCTCTTCGAT CGGCAGCACG

151 ATGCAGCAGG CAAGCTATGC GATGGGCGTG GACATCGGAC GCTCCCTGAA

201 GCAAATGAAG GAACAGGGCG CGGAAATCGA TTTGAAAGTC TTTACCGAAG

251 CCATGCAGGC AGTGTATGAC GGCAAAGAAA TCAAAATGAC CGAAGAGCAG

301 GCTCAGGAAG TCATGATGAA ATTCCTTCAG GAACAACAGG CTAAAGCCGT

351 AGAAAAACAC AAGGCGGACG CGAAGGCCAA TAAAGAAAAA GGCGAAGCCT

401 TTCTGAAAGA AAATGCCGCC AAAGACGGCG TGAAGACCAC TGCTTCCGGC

451 CTGCAATACA AAATCACCAA ACAGGGCGAA GGCAAACAGC CGACCAAAGA

501 CGACATCGTT ACCGTGGAAT ACGAAGGCCG CCTGATTGAC GGTACGGTAT

551 TCGACAGCAG CAAAGCCAAC GGCGGCCCGG TCACCTTCCC TTTGAGCCAA

601 GTGATTCCGG GTTGGACCGA AGGCGTACAG CTTCTGAAAG AAGGCGGCGA

651 AGCCACGTTC TACATCCCGT CCAACCTTGC CTACCGCGAA CAGGGTGCGG

701 GCGACAAAAT CGGTCCGAAC GCCACTTTGG TATTTGATGT GAAACTGGTC

751 AAAATCGGCG CACCCGAAAA CGCGCCCGCC AAGCAGCCGG CTCAAGTCGA

801 CATCAAAAAA GTAAATTAA
```

This corresponds to the amino acid sequence <SEQ ID 1746; ORF 576-1>:

```
m576-1.pep
   1    MNTIFKISAL TLSAALALSA CGKKEAAPAS ASEPAAASSA QGDTSSIGST
```

-continued

```
 51      MQQASYAMGV DIGRSLKQMK EQGAEIDLKV FTEAMQAVYD GKEIKMTEEQ

101      AQEVMMKFLQ EQQAKAVEKH KADAKANKEK GEAFLKENAA KDGVKTTASG

151      LQYKITKQGE GKQPTKDDIV TVEYEGRLID GTVFDSSKAN GGPVTFPLSQ

201      VIPGWTEGVQ LLKEGGEATF YIPSNLAYRE QGAGDKIGPN ATLVFDVKLV

251      KIGAPENAPA KQPAQVDIKK VN*
``` g576-1/m576-1 97.8% identity in 272 aa overlap

```
                    10         20         30         40         50         60
g576-1.pep  MNTIFKISALTLSAALALSACGKKEAAPASASEPAAASAAQGDTSSIGSTMQQASYAMGV
            |||||||||||||||||||||||||||||||||||||:||||||||||||||||||||||
m576-1      MNTIFKISALTLSAALALSACGKKEAAPASASEPAAASSAQGDTSSIGSTMQQASYAMGV
                    10         20         30         40         50         60

70         80         90        100        110        120
g576-1.pep  DIGRSLKQMKEQGAEIDLKVFTDAMQAVYDGKEIKMTEEQAQEVMMKFLQEQQAKAVEKH
            ||||||||||||||||||||||:|||||||||||||||||||||||||||||||||||||
m576-1      DIGRSLKQMKEQGAEIDLKVFTEAMQAVYDGKEIKMTEEQAQEVMMKFLQEQQAKAVEKH
                    70         80         90        100        110        120

130        140        150        160        170        180
g576-1.pep  KADAKANKEKGEAFLKENAAKDGVKTTASGLQYKITKQGEGKQPTKDDIVTVEYEGRLID
            ||||||||||||||||||||||||||||||||||||||||||||||||||||||||||||
m576-1      KADAKANKEKGEAFLKENAAKDGVKTTASGLQYKITKQGEGKQPTKDDIVTVEYEGRLID
                   130        140        150        160        170        180

190        200        210        220        230        240
g576-1.pep  GTVFDSSKANGGPATFPLSQVIPGWTEGVRLLKEGGEATFYIPSNLAYREQGAGEKIGPN
            |||||||||||||:||||||||||||||||:|||||||||||||||||||||||||:|||
m576-1      GTVFDSSKANGGPVTFPLSQVIPGWTEGVQLLKEGGEATFYIPSNLAYREQGAGDKIGPN
                   190        200        210        220        230        240

250        260        270
g576-1.pep  ATLVFDVKLVKIGAPENAPAKQPDQVDIKKVNX
            ||||||||||||||||||||||||:||||||||
m576-1      ATLVFDVKLVKIGAPENAPAKQPAQVDIKKVNX
                   250        260        270
```

The following partial DNA sequence was identified in *N. meningitidis* <SEQ ID 1747>:

```
a576-1.seq
  1 ATGAACACCA TTTTCAAAAT CAGCGCACTG ACCCTTTCCG CCGCTTTGGC

51 ACTTTCCGCC TGCGGCAAAA AAGAAGCCGC CCCCGCATCT GCATCCGAAC

101 CTGCCGCCGC TTCTTCCGCG CAGGGCGACA CCTCTTCGAT CGGCAGCACG

151 ATGCAGCAGG CAAGCTATGC CGATGGGCGTG GACATCGGAC GCTCCCTGAA

201 GCAAATGAAG GAACAGGGCG CGGAAATCGA TTTGAAAGTC TTTACCGAAG

251 CCATGCAGGC AGTGTATGAC GGCAAAGAAA TCAAAATGAC CGAAGAGCAG

301 GCTCAGGAAG TCATGATGAA ATTCCTTCAG GAACAACAGG CTAAAGCCGT

351 AGAAAAACAC AAGGCGGACG CGAAGGCCAA TAAAGAAAAA GGCGAAGCCT

401 TTCTGAAAGA AAATGCCGCC AAAGACGGCG TGAAGACCAC TGCTTCCGGC

451 CTGCAATACA AAATCACCAA ACAGGGCGAA GGCAAACAGC CGACCAAAGA

501 CGACATCGTT ACCGTGGAAT ACGAAGGCCG CCTGATTGAC GGTACGGTAT

551 TCGACAGCAG CAAAGCCAAC GGCGGCCCGG TCACCTTCCC TTTGAGCCAA

601 GTGATTCTGG GTTGGACCGA AGGCGTACAG CTTCTGAAAG AAGGCGGCGA

651 AGCCACGTTC TACATCCCGT CCAACCTTGC CTACCGCGAA CAGGGTGCGG

701 GCGACAAAAT CGGCCCGAAC GCCACTTTGG TATTTGATGT GAAACTGGTC

751 AAAATCGGCG CACCCGAAAA CGCGCCCGCC AAGCAGCCGG CTCAAGTCGA

801 CATCAAAAAA GTAAATTAA
```

This corresponds to the amino acid sequence <SEQ ID 1748; ORF 576-1.a>:

```
m576-1.pep

1    MNTIFKISAL TLSAALALSA CGKKEAAPAS ASEPAAASSA QGDTSSIGST

51    MQQASYAMGV DIGRSLKQMK EQGAEIDLKV FTEAMQAVYD GKEIKMTEEQ

101    AQEVMMKFLQ EQQAKAVEKH KADAKANKEK GEAFLKENAA KDGVKTTASG

151    LQYKITKQGE GKQPTKDDIV TVEYEGRLID GTVFDSSKAN GGPVTFPLSQ

201    VILGWTEGVQ LLKEGGEATF YIPSNLAYRE QGAGDKIGPN ATLVFDVKLV

251    KIGAPENAPA KQPAQVDIKK VN* a576-1/m576-1 99.6% identity in 272 aa overlap
                    10         20         30         40         50         60
a576-1.pep  MNTIFKISALTLSAALALSACGKKEAAPASASEPAAASSAQGDTSSIGSTMQQASYAMGV
            ||||||||||||||||||||||||||||||||||||||||||||||||||||||||||||
m576-1      MNTIFKISALTLSAALALSACGKKEAAPASASEPAAASSAQGDTSSIGSTMQQASYAMGV
                    10         20         30         40         50         60
                    70         80         90        100        110        120
a576-1.pep  DIGRSLKQMKEQGAEIDLKVFTEAMQAVYDGKEIKMTEEQAQEVMMKFLQEQQAKAVEKH
            ||||||||||||||||||||||||||||||||||||||||||||||||||||||||||||
m576-1      DIGRSLKQMKEQGAEIDLKVFTEAMQAVYDGKEIKMTEEQAQEVMMKFLQEQQAKAVEKH
                    70         80         90        100        110        120
                   130        140        150        160        170        180
a576-1.pep  KADAKANKEKGEAFLKENAAKDGVKTTASGLQYKITKQGEGKQPTKDDIVTVEYEGRLID
            ||||||||||||||||||||||||||||||||||||||||||||||||||||||||||||
m576-1      KADAKANKEKGEAFLKENAAKDGVKTTASGLQYKITKQGEGKQPTKDDIVTVEYEGRLID
                   130        140        150        160        170        180
                   190        200        210        220        230        240
a576-1.pep  GTVFDSSKANGGPVTFPLSQVILGWTEGVQLLKEGGEATFYIPSNLAYREQGAGDKIGPN
            |||||||||||||||||||||| |||||||||||||||||||||||||||||||||||||
m576-1      GTVFDSSKANGGPVTFPLSQVIPGWTEGVQLLKEGGEATFYIPSNLAYREQGAGDKIGPN
                   190        200        210        220        230        240
                   250        260        270
a576-1.pep  ATLVFDVKLVKIGAPENAPAKQPAQVDIKKVNX
            |||||||||||||||||||||||||||||||||
m576-1      ATLVFDVKLVKIGAPENAPAKQPAQVDIKKVNX
                   250        260        270
```

Expression of ORF 576

The primer described in Table 1 for ORF 576 was used to locate and clone ORF 576. ORF 576 was cloned in pET and pGex vectors and expressed in E. coli as above described. The products of protein expression and purification were analyzed by SDS-PAGE. FIG. 3A shows the results of affinity purification and FIG. 3B shows the expression in E. coli. Purified His-fusion protein was used to immunize mice, whose sera were used for ELISA (positive result), FACS analysis (FIG. 3C), western blot (FIG. 3D). These experiments confirm that ORF 576 is a surface-exposed protein and that it is a useful immunogen. The hydrophilicity plots, antigenic index, and amphipatic regions of ORF 576 are provided in FIG. 7. The AMPHI program is used to predict putative T-cell epitopes (Gao et al 1989, J. Immunol 143:3007; Roberts et al. 1996, AIDS Res Human Retroviruses 12:593; Quakyi et al. 1992, Scand J Immunol Suppl 11:9). The nucleic acid sequence of ORF 576 and the amino acid sequence encoded thereby is provided in Example 1.

The following partial DNA sequence was identified in N. gonorrhoeae <SEQ ID 1749>:

```
g577.seq..

1 atggaaagga gcggtgtatt tggtaaaatt gtcggcaatc gcatactccg 51 tatgccgtcc gaacacgctg ccgcattcta tccgaaaccg tgcaaatcgt 101 ttaaactaac gcaatcttgg ttcagagtgc gaagctgtcc gtgcggcgtt 151 tttatttacg gagcaaacat gaaacttatc tataccgtca tcaaaatcat 201 tatcctgctg ctcttcctgc tgcttgccgt cattaatatg gatgccgtta 251 ccttttccta tcttccgggg cagagtgtca atctgccgct gattgtcgta 301 ttgttcggcg cgtttgtcgt cggcatcgtg ttcggaatgt ttgccctgtt
```

```
351 cgggcggctg ctgtccttgc gcggcgaaaa cagccgcctg cgtgcggaag 401 tgaagaaaag tgcgcgcttg agcggacaga aattgactgc accgccgata 451 caaaatgctg ccgaatctgc aaacagcct taa
```

This corresponds to the amino acid sequence <SEQ ID 1750; ORF 577.ng>:

```
g577.pep
  1 MERSGVFGKI VGNRILRMPS EHAAAFYPKP CKSFKLTQSW FRVRSCPCGV

51 FIYGANMKLI YTVIKIIILL LFLLLAVINM DAVTFSYLPG QSVNLPLIVV

101 LFGAFVVGIV FGMFALFGRL LSLRGENSRL RAEVKKSARL SGQKLTAPPI

151 QNAAESAKQP *
```

The following partial DNA sequence was identified in *N. meningitidis* <SEQ ID 1751>:

```
m577.seq..
  1 ATGGAAAGGA ACGGTGTATT TGGTAAAATT GTCGGCAATC GCATACTCCG

51 TATGTCGTCC GAACACGCTG CCGCATCCTA TCCGAAACCG TGCAAATCGT

101 TTAAACTAGC GCAATCTTGG TTCAGAGTGC GAAGCTGTCT GGGCGGCGTT

151 TTTATTTACG GAGCAAACAT GAAACTTATC TATACCGTCA TCAAAATCAT

201 TATCCTGCTG CTCTTCCTGC TGCTTGCCGT CATTAATACG GATGCCGTTA

251 CCTTTTCCTA CCTGCCGGGG CAAAAATTCG ATTTGCCGCT GATTGTCGTA

301 TTGTTCGGCG CATTTGTAGT CGGTATTATT TTTGGAATGT TTGCCTTGTT

351 CGGACGGTTG TTGTCGTTAC GTGGCGAGAA CGGCAGGTTG CGTGCCGAAG

401 TAAAGAAAAA TGCGCGTTTG ACGGGGAAGG AGCTGACCGC ACCACCGGCG

451 CAAAATGCGC CGAATCTAC CAAACAGCCT TAA
```

This corresponds to the amino acid sequence <SEQ ID 1752; ORF 577>:

```
m577.pep..
  1 MERNGVFGKI VGNRILRMSS EHAAASYPKP CKSFKLAQSW FRVRSCLGGV

51 FIYGANMKLI YTVIKIIILL LFLLLAVINT DAVTFSYLPG QKFDLPLIVV

101 LFGAFVVGII FGMFALFGRL LSLRGENGRL RAEVKKNARL TGKELTAPPA

151 QNAPESTKQP *
```

Computer analysis of this amino acid sequence gave the following results:

Homology with a Predicted ORF from *N. gonorrhoeae*

```
    m577/g577    88.1% identity in 160 aa overlap 10         20         30         40         50         60
    m577.pep  MERNGVFGKIVGNRILRMSSEHAAASYPKPCKSFKLAQSWFRVRSCLGGVFIYGANMKLI
              |||:|||||||||||||| |||||  ||||||||||:||||||||||  ||||||||||
    g577      MERSGVFGKIVGNRILRMPSEHAAAFYPKPCKSFKLTQSWFRVRSCPCGVFIYGANMKLI
                10         20         30         40         50         60

70         80         90        100        110        120
    m577.pep  YTVIKIIILLLFLLLAVINTDAVTFSYLPGQKFDLPLIVVLFGAFVVGIIGMFALFGRL
              |||||||||||||||||||: :|||||||||| :||||||||||||||||:||||||||
    g577      YTVIKIIILLLFLLLAVINMDAVTFSYLPGQSVNLPLIVVLFGAFVVGIVFGMFALFGRL
                70         80         90        100        110        120
```

-continued

```
              130        140        150        160
m577.pep   LSLRGENGRLRAEVKKNARLTGKELTAPPAQNAPESTKQPX
           |||||||:|||||||||:|||:|::|||| ||| ||:||||
g577       LSLRGENSRLRAEVKKSARLSGQKLTAPPIQNAAESAKQPX
              130        140        150        160
```

The following partial DNA sequence was identified in *N. meningitidis* <SEQ ID 1753>:

```
a577.seq
   1 ATGGAAAGGA ACGGTGTATT TGGTAAAATT GTCGGCAATC GCATACTCCG

51 TATGTCGTCC GAACACGCTG CCGCATCCTA TCCGAAACCG TGCAAATCGT

101 TTAAACTAGC GCAATCTTGG TTCAGAGTGC GAAGCTGTCC GGGCGGCGTT

151 TTTATTTACG GAGCAAACAT GAAACTTATC TATACCGTCA TCAAAATCAT

201 TATCCTGCTG CTCTTCCTGC TGCTTGCTGT CATTAATACG GATGCCGTTA

251 CCTTTTCCTA CCTGCCGGGG CAAAAATTCG ATTTGCCGCT GATTGTCGTA

301 TTGTTCGGCG CGTTTGTCGT CGGCATCGTG TTCGGAATGT TTGCCTTGTT

351 CGGACGGTTG TTGTCGTTAC GTGGCGAGAA CGGCAGGTTG CGTGCCGAAG

401 TAAAGAAAAA TGCGCGTTTG ACGGGGAAGG AGCTGACCGC ACCACCGGCG

451 CAAAATGCGC CCGAATCTGC CAAACAGCCT TGA
```

This corresponds to the amino acid sequence <SEQ ID 1754; ORF 577.a>:

```
a577.pep

1   MERNGVFGKI VGNRILRMSS EHAAASYPKP CKSFKLAQSW FRVRSCPGGV

51   FIYGANMKLI YTVIKIIILL LFLLLAVINT DAVTFSYLPG QKFDLPLIVV

101   LFGAFVVGIV FGMFALFGRL LSLRGENGRL RAEVKKNARL TGKELTAPPA

151   QNAPESAKQP * m577/a577 98.1% identity in 160 aa overlap 10         20         30         40         50         60
m577.pep   MERNGVFGKIVGNRILRMSSEHAAASYPKPCKSFKLAQSWFRVRSCLGGVFIYGANMKLI
           ||||||||||||||||||||||||||||||||||||||||||||||| ||||||||||||
a577       MERNGVFGKIVGNRILRMSSEHAAASYPKPCKSFKLAQSWFRVRSCPGGVFIYGANMKLI
              10         20         30         40         50         60

70         80         90        100        110        120
m577.pep   YTVIKIIILLLFLLLAVINTDAVTFSYLPGQKFDLPLIVVLFGAFVVGIIFGMFALFGRL
           |||||||||||||||||||||||||||||||||||||||||||||||||:||||||||||
a577       YTVIKIIILLLFLLLAVINTDAVTFSYLPGQKFDLPLIVVLFGAFVVGIVFGMFALFGRL
              70         80         90        100        110        120

130        140        150        160
m577.pep   LSLRGENGRLRAEVKKNARLTGKELTAPPAQNAPESTKQPX
           ||||||||||||||||||||||||||||||||||||:||||
a577       LSLRGENGRLRAEVKKNARLTGKELTAPPAQNAPESAKQPX
              130        140        150        160
```

The following partial DNA sequence was identified in *N. gonorrhoeae* <SEQ ID 1755>:

```
g578.seq..
   1 atgggaaagc tcgacatcgg gatattgttt gccgatttct tcaaagattt 51 cgcgccacag ttcggtggtt tccaaaacgt tggctttgcc tacggagcag 101 acttttttgc tgcgtttttg ggcggattgg aaggccacgt gggcgatgcg 151 gcggatttcg ctttcgctgt atttcatggt gttgtagcct tcgtgttcgc
```

-continued

```
201 cgttttccaa aacacggatg ccgcgcggtt cgccgaaata aatatcgccg 251 gtaagttcgc gcacaatcaa aatatccaaa ccggcaacga tttcaggctt 301 gagcgtggag gcgttggcta a
```

This corresponds to the amino acid sequence <SEQ ID 1756; ORF 578.ng>:

```
g578.pep
   1 MGKLDIGILF ADFFKDFAPQ FGGFQNVGFA YGADFFAAFL GGLEGHVGDA

51 ADFAFAVFHG VVAFVFAVFQ NTDAARFAEI NIAGKFAHNQ NIQTGNDFRL

101 ERGGVG*
```

The following partial DNA sequence was identified in *N. meningitidis* <SEQ ID 1757>:

```
m578.seq..
   1 ATGGGAAAGC TCGACATCAG GGTACTCTTT GCCGATTTCT TCAAAGATTT

51 CGCGCCACAA TTCGGTGGTT TCCAAAACGT TGGCTTTGCC TACGGAACAG

101 ACTTTTTTGC TGCGTTTTTG GGCGGATTGG AAGGCAACAT GGGCAATACG

151 GCGGATTTCG CTTTCGCTGT ATTTCATGGT GTTGTAGCCT TCGCGTTCGC

201 CGTTTTCCAG AACGCGGATG CCGCGCGGTT CGCCGAAATA GATGTCGCCG

251 GTGAGTTCGC GCACAATCAA AATATCCAAA CCGGCAACGA TTTCAGGCTT
```

This corresponds to the amino acid sequence <SEQ ID 1758; ORF 578>:

```
  m578.pep..
          1 MGKLDIRVLF ADFFKDFAPQ FGGFQNVGFA YGTDFFAAFL GGLEGNMGNT

51 ADFAFAVFHG VVAFAFAVFQ NADAARFAEI DVAGEFAHNQ NIQTGNDFRL

101 QRGGVG* m578/g578    87.7% identity in 106 aa overlap 10         20         30         40         50         60
        m578.pep  MGKLDIRVLFADFFKDFAPQFGGFQNVGFAYGTDFFAAFLGGLEGNMGNTADFAFAVFHG
                  ||||||:|||||||||||||||||||||||:||||||||||::|::|||||||||
        g578      MGKLDIGILFADFFKDFAPQFGGFQNVGFAYGADFFAAFLGGLEGHVGDAADFAFAVFHG
                        10         20         30         40         50         60

70         80         90        100
        m578.pep  VVAFAFAVFQNADAARFAEIDVAGEFAHNQNIQTGNDFRLQRGGVGX
                  ||||:||||||:|||||||::||:|||||||||||||||:||||||
        g578      VVAFVFAVFQNTDAARFAEINIAGKFAHNQNIQTGNDFRLERGGVGX
                        70         80         90        100
```

The following partial DNA sequence was identified in *N. meningitidis* <SEQ ID 1759>:

```
a578.seq
   1 ATGGGAAAGC TCGACATCAG GGTATTCTTT GCCGATTTCT TCAAAGATTT

51 CGCGCCACAA TTCGGTGGTT TCCAAAACGT TGGCTTTGCC TACGGAGCAG

101 ACTTTTTTGC TGCGTTTTTG GGCGGATTGG AAGGCGACGT GGGCAATACG

151 GCGGATTTCG CTTTCGCTGT ATTTCATGGT GTTGTAGCCT TCGCGTTCGC

201 CGTTTTCCAG AACACGGATG CCGCGCGGTT CGCCGAAATA AATATCGCCG
```

```
251 GTGAGTTCGC GCACAATCAA AATATCCAAA CCCGCAACGA TTTCAGACTT

301 GAGCGTGGAG GCGTTGGCTA G
```

This corresponds to the amino acid sequence <SEQ ID 1760; ORF 578.a>:

```
a578.pep

1 MGKLDIRVFF ADFFKDFAPQ FGGFQNVGFA YGADFFAAFL GGLEGDVGNT

51 ADFAFAVFHG VVAFAFAVFQ NTDAARFAEI NIAGEFAHNQ NIQTRNDFRL

101 ERGGVG* m578/a578    91.5% identity in 106 aa overlap 10         20         30         40         50         60
  m578.pep    MGKLDIRVLFADFFKDFAPQFGGFQNVGFAYGTDFFAAFLGGLEGNMGNTADFAFAVFHG
              ||||||||:|||||||||||||||||||||| :|||||||||||:::||||||||||||
  a578        MGKLDIRVFFADFFKDFAPQFGGFQNVGFAYGADGGAAFLGGLEGDVGNTADFAFAVFHG
                   10         20         30         40         50         60

70         80         90        100
  m578.pep    VVAFAFAVFQNADAARFAEIDVAGEFAHNQNIQTGNDFRLQRGGVGX
              |||||||||||:|||||||::||||||||||||| |||||:||||||
  a578        VVAFAFAVFQNTDAARFAEINIAGEFAHNQNIQTRNDFRLERGGVGX
                   70         80         90        100
```

The following partial DNA sequence was identified in *N. gonorrhoeae* <SEQ ID 1761>:

```
g579.seq..
    1 ATGAGGGCGG CGATGACGCG CGCGCAGGTC GATGCCACGC TGATTAGTTT

51 TTTGTGTAAT GTTGCCAATA TCGGCTTATT GATTTTGGTG ATTATTGCCG

101 CATTGGGACG GTTGGGCGTT TCCACAACAT CCGTAACCGC CTTAATCGGC

151 GGCGCGGGTT TGGCGGTGGC GTTGTCCTTA AAAGACCAGC TGTCCAATTT

201 TGCCGCCGGC GCGCTGATTA TCCTGTTCCG CCCGTTCAAA GTCGGCGACT

251 TTATCCGTGT CGGCGGTTTT GAAGGATATG TCCGGGAAAT CAAAATGGTG

301 CAGACTTCTT TGCGGACGAC CGACAACGAA GAAGTCGTGC TGCCCAACAG

351 CGTGGTGATG GGCAACAGCA TCGTCAACCG TTCCAGCCTG CCGCTTTGCC

401 GCGCCCAAGT GATAGTCGGC GTCGATTACA ACTGCGATTT GAAAGTGGCG

451 AAAGAGGCGG TGTTGAAAGC CGCCGCCGAA CACCCCTTGA GCGTTCAAAA

501 CGAAGAGCGG CAGCCCGCCG CCTACATCAC CGCCTTGGGC GACAATGCCA

551 TCGAAATCAC ATTATGGGCT TGGGCAAACG AAGCAGACCG CTGGACGCTG

601 CAATGCGACT TGAACGAACA AGTGGTCGAA AACCTCCGCA AAGTCAATAT

651 CAACATCCCG TTCCCGCAAC GCGACATACA CATCATCAAT TCTTAA
```

This corresponds to the amino acid sequence <SEQ ID 1762; ORF 579.ng>:

```
g579.pep..
    1 MRAAMTRAQV DATLISFLCN VANIGLLILV IIAALGRLGV STTSVTALIG

51 GAGLAVALSL KDQLSNFAAG ALIILFRPFK VGDFIRVGGF EGYVREIKMV

101 QTSLRTTDNE EVVLPNSVVM GNSIVNRSSL PLCRAQVIVG VDYNCDLKVA

151 KEAVLKAAAE HPLSVQNEER QPAAYITALG DNAIEITLWA WANEADRWTL

201 QCDLNEQVVE NLRKVNINIP FPQRDIHIIN S*
```

The following partial DNA sequence was identified in N. meningitidis <SEQ ID 1763>:

```
m579.seq..
    1 ATGAGGGCGG CGATGACGCG CGCGCAGGTC GATGCCACGC TGATTAGTTT

51 TTTGTGTAAT GTTGCCAATA TCGGCTTATT GATTTTGGTG ATTATTGCCG

101 CATTGGGCAG ATTGGGCGTT TCCACAACAT CCGTAACCGC CTTAATCGGC

151 GGCGCGGGTT TGGCGGTGGC GTTGTCCCTG AAAGACCAGC TGTCCAATTT

201 TGCCGCCGGC GCACTGATTA TCCTGTTCCG CCCGTTCAAA GTCGGCGATT

251 TTATCCGCGT CGGCGGTTTT GAAGGATATG TCCGAGAGAT TAAAATGGTG

301 CAGACTTCTT TGCGGACGAC CGACAACGAA GAAGTCGTGC TGCCCAACAG

351 CGTGGTGATG GGCAACAGCA TCGTCAACCG TTCCACACTG CCGCTGTGCC

401 GCGCCCAAGT GATAGTCGGC GTCGATTACA ACTGCGATTT GAAAGTGGCG

451 AAAGAGGCGG TGTTGAAAGC CGCCGTCGAA CACCCCTTGA GCGTTCAAAA

501 CGAAGAGCGG CAGGCTGCCG CCTACATCAC CGCCTTGGGC GACAATGCCA

551 TCGAAATCAC ATTATGGGCT TGGGCAAACG AAGCAGACCG CTGGACGCTG

601 CAATGCGACT TGAACGAACA AGTGGTCGAA AACCTCCGCA AAGTCAATAT

651 CAACATCCCG TTCCCGCAAC GCGACATACA CATCATCAAT TCTTAA
```

This corresponds to the amino acid sequence <SEQ ID 1764; ORF 579>:

```
m579.pep..
    1 MRAAMTRAQV DATLISFLCN VANIGLLILV IIAALGRLGV STTSVTALIG

51 GAGLAVALSL KDQLSNFAAG ALIILFRPFK VGDFIRVGGF EGYVREIKMV

101 QTSLRTTDNE EVVLPNSVVM GNSIVNRSTL PLCRAQVIVG VDYNCDLKVA

151 KEAVLKAAVE HPLSVQNEER QAAAYITALG DNAIEITLWA WANEADRWTL

201 QCDLNEQVVE NLRKVNINIP FPQRDIHIIN S*
                                            40
```

Computer analysis of this amino acid sequence gave the following results:

Homology with a Predicted ORF from N. gonorrhoeae

```
    m579/g576   98.7% identity in 231 aa overlap 10         20         30         40         50         60
      m579.pep    MRAAMTRAQVDATLISFLCNVANIGLLILVIIAALGRLGVSTTSVTALIGGAGLAVALSL
                  ||||||||||||||||||||||||||||||||||||||||||||||||||||||||||||
      g579        MRAAMTRAQVDATLISFLCNVANIGLLILVIIAALGRLGVSTTSVTALIGGAGLAVALSL
                      10         20         30         40         50         60

70         80         90        100        110        120
      m579.pep    KDQLSNFAAGALIILFRPFKVGDFIRVGGFEGYVREIKMVQTSLRTTDNEEVVLPNSVVM
                  |||||||||||||||||||||||||||||||||||||:||||||||||||||||||||||
      g579        KDQLSNFAAGALIILFRPFKVGDFIRVGGFEGYVREIMKVQTSLRTTDNEEVVLPNSVVM
                      70         80         90        100        110        120

130        140        150        160        170        180
      m579.pep    GNSIVNRSTLPLCRAQVIVGVDYNCDLKVAKEAVLKAAVEHPLSVQNEERQAAAYITALG
                  ||||||||:|||||||||||||||||||||||||||:|||||||||||||:|||||||||
      g579        GNSIVNRSSLPLCRAQVIVGVDYNCDLKVAKEAVLKAAAEHPLSVQNEERQPAAYITALG
                     130        140        150        160        170        180

190        200        210        220        230
      m579.pep    DNAIEITLWAWANEADRWTLQCDLNEQVVENLRKVNINIPFPQRDIHIINSX
                  ||||||||||||||||||||||||||||||||||||||||||||||||||||
      g579        DNAIEITLWAWANEADRWTLQCDLNEQVVENLRKVNINIPFPQRDIHIINSX
                     190        200        210        220        230
```

The following partial DNA sequence was identified in *N. meningitidis* <SEQ ID 1765>:

```
a579.seq
   1 ATGAGGGCGG CGATGACGCG CGCGCAGGTC GATGCCACGC TGATTAGTTT

51 TTTGTGTAAT GTTGCCAATA TCGGCTTATT GATTTTGGTG ATTATTGCCG

101 CATTGGGCAG ATTGGGCGTT TCCACAACAT CCGTAACCGC CTTAATCGGC

151 GGCGCGGGTT TGGCGGTGGC GTTGTCCTTG AAAGACCAGC TGTCCAATTT

201 TGCCGCCGGC GCGCTGATTA TCCTGTTCCG CCCGTTCAAA GTCGGCGATT

251 TTATCCGCGT CGGCGGTTTT GAAGGATATG TCCGAGAGAT TAAAATGGTG

301 CAGACTTCTT TGCGGACGAC CGACAACGAA GAAGTCGTGC TGCCCAACAG

351 CGTGGTGATG GGCAACAGCA TCGTCAACCG TTCCACACTG CCGCTGTGCC

401 GCGCCCAAGT GATAGTCGGC GTCGATTACA ACTGCGATTT GAAAGTGGCG

451 AAAGAGGCGG TGTTGAAAGC CGCCGTCGAA CACCCCTTGA GCGTTCAAAA

501 CGAAGAGCGG CAGGCCGCCG CCTACATCAC CGCCTTGGGC GACAATGCCA

551 TCGAAATCAC ATTATGGGCT TGGGCAAACG AAGCAGACCG CTGGACGCTG

601 CAATGCGACT TGAACGAACA AGTGGTCGAA AACCTCCGCA AAGTCAATAT

651 CAACATCCCG TTCCCGCAAC GCGACATACA CATCATCAAT TCTTAA
```

This corresponds to the amino acid sequence <SEQ ID 1766; ORF 579.a>:

```
a579.pep
    1    MRAAMTRAQV DATLISFLCN VANIGLLILV IIAALGRLGV STTSVTALIG

51    GAGLAVALSL KDQLSNFAAQ ALIILFRPKF VGDFIRVGGF EGYVREIKMV

101    QTSLRTTDNE EVVLPNSVVM GNSIVNRSTL PLCRAQVIVG VDYNCDLKVA

151    KEAVLKAAVE HPLSVQNEER QAAAYITALG DNAIEITLWA WANEADRWTL

201    QCDLNEQVVE NLRKVNINIP FPQRDIHIIN S* m579/a579    100.0% identity in 231 aa overlap
                     10         20         30         40         50         60
m579.pep     MRAAMTRAQVDATLISFLCNVANIGLLILVIIAALGRLGVSTTSVTALIGGAGLAVALSL
             ||||||||||||||||||||||||||||||||||||||||||||||||||||||||||||
a579         MRAAMTRAQVDATLISFLCNVANIGLLILVIIAALGRLGVSTTSVTALIGGAGLAVALSL
                     10         20         30         40         50         60

70         80         90        100        110        120
m579.pep     KDQLSNFAAGALIILFRPFKVGDFIRVGGFEGYVREIKMVQTSLRTTDNEEVVLPNSVVM
             ||||||||||||||||||||||||||||||||||||||||||||||||||||||||||||
a579         KDQLSNFAAGALIILFRPFKVGDFIRVGGFEGYVREIKMVQTSLRTTDNEEVVLPNSVVM
                     70         80         90        100        110        120

130        140        150        160        170        180
m579.pep     GNSIVNRSTLPLCRAQVIVGVDYNCDLKVAKEAVLKAAVEHPLSVQNEERQAAAYITALG
             ||||||||||||||||||||||||||||||||||||||||||||||||||||||||||||
a579         GNSIVNRSTLPLCRAQVIVGVDYNCDLKVAKEAVLKAAVEHPLSVQNEERQAAAYITALG
                    130        140        150        160        170        180

190        200        210        220        230
m579.pep     DNAIEITLWAWANEADRWTLQCDLNEQVVENLRKVNINIPFPQRDIHIINSX
             |||||||||||||||||||||||||||||||||||||||||||||||||||||
a579         DNAIEITLWAWANEADRWTLQCDLNEQVVENLRKVNINIPFPQRDIHIINSX
                    190        200        210        220        230
```

The following partial DNA sequence was identified in *N. gonorrhoeae* <SEQ ID 1767>:

```
g579-1.seq
   1 ATGGACTTCA AACAATTTGA TTTTTTACAC CTGATCAGTG TTTCCGGTTG
```

-continued

```
 51 GGGGCATCTG GCTGAAAAGG CGTGGGCGTT CGGGCTGAAC CTTGCCGCCG

101 CGCTGCTTAT TTTCTTGGTC GGGAAATGGG CGGCGAAACG CATTGTCGCC

151 GTAATGAGGG CGGCGATGAC GCGCGCGCAG GTCGATGCCA CGCTGATTAG

201 TTTTTTGTGT AATGTTGCCA ATATCGGCTT ATTGATTTTG GTGATTATTG

251 CCGCATTGGG ACGGTTGGGC GTTTCCACAA CATCCGTAAC CGCCTTAATC

301 GGCGGCGCGG GTTTGGCGGT GGCGTTGTCC TTAAAAGACC AGCTGTCCAA

351 TTTTGCCGCC GGCGCGCTGA TTATCCTGTT CCGCCCGTTC AAAGTCGGCG

401 ACTTTATCCG TGTCGGCGGT TTTGAAGGAT ATGTCCGGGA AATCAAAATG

451 GTGCAGACTT CTTTGCGGAC GACCGACAAC GAAGAAGTCG TGCTGCCCAA

501 CAGCGTGGTG ATGGGCAACA GCATCGTCAA CCGTTCCAGC CTGCCGCTTT

551 GCCGCGCCCA AGTGATAGTC GGCGTCGATT ACAACTGCGA TTTGAAAGTG

601 GCGAAAGAGG CGGTGTTGAA AGCCGCCGCC GAACACCCCT TGAGCGTTCA

651 AAACGAAGAG CGGCAGCCCG CCGCCTACAT CACCGCCTTG GGCGACAATG

701 CCATCGAAAT CACATTATGG GCTTGGGCAA ACGAAGCAGA CCGCTGGACG

751 CTGCAATGCG ACTTGAACGA ACAAGTGGTC GAAAACCTCC GCAAAGTCAA

801 TATCAACATC CCGTTCCCGC AACGCGACAT ACACATCATC AATTCTTAA
```

This corresponds to the amino acid sequence <SEQ ID 1768; ORF 008.ng>:

```
g579-1.pep
    1 MDFKQFDFLH LISVSGWGHL AEKAWAFGLN LAAALLIFLV GKWAAKRIVA

51 VMRAAMTRAQ VDATLISFLC NVANIGLLIL VIIAALGRLG VSTTSVTALI

101 GGAGLAVALS LKDQLSNFAA GALIILFRPF KVGDFIRVGG FEGYVREIKM

151 VQTSLRTTDN EEVVLPNSVV MGNSIVNRSS LPLCRAQVIV GVDYNCDLKV

201 AKEAVLKAAA EHPLSVQNEE RQPAAYITAL GDNAIEITLW AWANEADRWT

251 LQCDLNEQVV ENLRKVNINI PFPQRDIHII NS*
```

The following partial DNA sequence was identified in *N. meningitidis* <SEQ ID 1769>:

```
m579-1.seq
    1 ATGGACTTCA AACAATTTGA TTTTTTACAC CTGATCAGTG TTTCCGGTTG

51 GGAGCATCTG GCTGAAAAGG CGTGGGCGTT CGGGCTGAAC CTTGCCGCCG

101 CGCTGCTTAT TTTTTTGGTC GGAAAATGGG CGGCGAAACG CATTGTCGCT

151 GTGATGAGGG CGGCGATGAC GCGCGCGCAG GTCGATGCCA CGCTGATTAG

201 TTTTTTGTGT AATGTTGCCA ATATCGGCTT ATTGATTTTG GTGATTATTG

251 CCGCATTGGG CAGATTGGGC GTTTCCACAA CATCCGTAAC CGCCTTAATC

301 GGCGGCGCGG GTTTGGCGGT GGCGTTGTCC CTGAAAGACC AGCTGTCCAA

351 TTTTGCCGCC GGCGCACTGA TTATCCTGTT CCGCCCGTTC AAAGTCGGCG

401 ATTTTATCCG CGTCGGCGGT TTTGAAGGAT ATGTCCGAGA GATTAAAATG

451 GTGCAGACTT CTTTGCGGAC GACCGACAAC GAAGAAGTCG TGCTGCCCAA

501 CAGCGTGGTG ATGGGCAACA GCATCGTCAA CCGTTCCACA CTGCCGCTGT

551 GCCGCGCCCA AGTGATAGTC GGCGTCGATT ACAACTGCGA TTTGAAAGTG
```

-continued

```
601 GCGAAAGAGG CGGTGTTGAA AGCCGCCGTC GAACACCCCT TGAGCGTTCA

651 AAACGAAGAG CGGCAGGCTG CCGCCTACAT CACCGCCTTG GGCGACAATG

701 CCATCGAAAT CACATTATGG GCTTGGGCAA ACGAAGCAGA CCGCTGGACG

751 CTGCAATGCG ACTTGAACGA ACAAGTGGTC GAAAACCTCC GCAAAGTCAA

801 TATCAACATC CCGTTCCCGC AACGCGACAT ACACATCATC AATTCTTAA
```

This corresponds to the amino acid sequence <SEQ ID 1770; ORF 579-1>:

```
a579-1.pep

1    MDFKQFDFLH LISVSGWEHL AEKAWAFGLN LAAALLIFLV GKWAAKRIVA

51    VMRAAMTRAQ VDATLISFLC NVANIGLLIL VIIAALGRLG VSTTSVTALI

101    GGAGLAVALS LKDQLSNFAA GALIILFRPF KVGDFIRVGG FEGYVREIKM

151    VQTSLRTTDN EEVVLPNSVV MGNSIVNRST LPLCRAQVIV GVDYNCDLKV

201    AKEAVLKAAV EHPLSVQNEE RQAAAYITAL GDNAIEITLW AWANEADRWT

251    LQCDLNEQVV ENLRKVNINI PFPQRDIHII NS* m579-1/g579-1  98.6% identity in 282 aa overlap 10         20         30         40         50         60
m579-1.pep    MDFKQFDFLHLISVSGWEHLAEKAWAFGLNLAAALLIFLVGKWAAKRIVAVMRAAMTRAQ
              ||||||||||||||||||| |||||||||||||||||||||||||||||||||||||||
g579-1        MDFKQFDFLHLISVSGWGHLAEKAWAFGLNLAAALLIFLVGKWAAKRIVAVMRAAMTRAQ
                      10         20         30         40         50         60

70         80         90        100        110        120
m579-1.pep    VDATLISFLCNVANIGLLILVIIAALGRLGVSTTSVTALIGGAGLAVALSLKDQLSNFAA
              ||||||||||||||||||||||||||||||||||||||||||||||||||||||||||||
g579-1        VDATLISFLCNVANIGLLILVIIAALGRLGVSTTSVTALIGGAGLAVALSLKDQLSNFAA
                      70         80         90        100        110        120

130        140        150        160        170        180
m579-1.pep    GALIILFRPFKVGDFIRVGGFEGYVREIKMVQTSLRTTDNEEVVLPNSVVMGNSIVNRST
              |||||||||||||||||||||||||||||||||||||||||||||||||||||||||||:
g579-1        GALIILFRPFKVGDFIRVGGFEGYVREIKMVQTSLRTTDNEEVVLPNSVVMGNSIVNRSS
                     130        140        150        160        170        180

190        200        210        220        230        240
m579-1.pep    LPLCRAQVIVGVDYNCDLKVAKEAVLKAAVEHPLSVQNEERQAAAYITALGDNAIEITLW
              |||||||||||||||||||||||||||||||:||||||||||||||||||||||||||||
g579-1        LPLCRAQVIVGVDYNCDLKVAKEAVLKAAAEHPLSVQNEERQPAAYITALGDNAIEITLW
                     190        200        210        220        230        240

250        260        270        280
m579-1.pep    AWANEADRWTLQCDLNEQVVENLRKVNINIPFPQRDIHIINSX
              ||||||||||||||||||||||||||||||||||||||||||
g579-1        AWANEADRWTLQCDLNEQVVENLRKVNINIPFPQRDIHIINSX
                     250        260        270        280
```

The following partial DNA sequence was identified in *N. meningitidis* <SEQ ID 1771>:

```
a579-1.seq
   1 ATGGACTTCA AACAATTTGA TTTTTTACAC CTGATAAGTG CTTCCGGCTG

51 GGAGCATCTG GCTGAAAAGG CGTGGGCGTT CGGGCTGAAC CTTGCCGCCG

101 CGCTGCTTAT TTTTTTGGTC GGAAAATGGG CGGCGAAACG CATTGTCGCC

151 GTGATGAGGG CGGCGATGAC GCGCGCGCAG GTCGATGCCA CGCTGATTAG

201 TTTTTTGTGT AATGTTGCCA ATATCGGCTT ATTGATTTTG GTGATTATTG

251 CCGCATTGGG CAGATTGGGC GTTTCCACAA CATCCGTAAC CGCCTTAATC

301 GGCGGCGCGG GTTTGGCGGT GGCGTTGTCC TTGAAAGACC AGCTGTCCAA

351 TTTTGCCGCC GGCGCGCTGA TTATCCTGTT CCGCCCGTTC AAAGTCGGCG
```

-continued

```
401 ATTTTATCCG CGTCGGCGGT TTTGAAGGAT ATGTCCGAGA GATTAAAATG

451 GTGCAGACTT CTTTGCGGAC GACCGACAAC GAAGAAGTCG TGCTGCCCAA

501 CAGCGTGGTG ATGGGCAACA GCATCGTCAA CCGTTCCACA CTGCCGCTGT

551 GCCGCGCCCA AGTGATAGTC GGCGTCGATT ACAACTGCGA TTTGAAAGTG

601 GCGAAAGAGG CGGTGTTGAA AGCCGCCGTC GAACACCCCT TGAGCGTTCA

651 AAACGAAGAG CGGCAGGCCG CCGCCTACAT CACCGCCTTG GGCGACAATG

701 CCATCGAAAT CACATTATGG GCTTGGGCAA ACGAAGCAGA CCGCTGGACG

751 CTGCAATGCG ACTTGAACGA ACAAGTGGTC GAAAACCTCC GCAAAGTCAA

801 TATCAACATC CCGTTCCCGC AACGCGACAT ACACATCATC AATTCTTAA
```

This corresponds to the amino acid sequence <SEQ ID 1772; ORF 579-1.a>:

```
a579-1.pep

1 MDFKQFDFLH LISASGWEHL AEKAWAFGLN LAAALLIFLV GKWAAKRIVA

51 VMRAAMTRAQ VDATLISFLC NVANIGLLIL VIIAALGRLG VSTTSVTALI

101 GGAGLAVALS LKDQLSNFAA GALIILFRPF KVGDFIRVGG FEGYVREIKM

151 VQTSLRTTDN EEVVLPNSVV MGNSIVNRST LPLCRAQVIV GVDYNCDLKV

201 AKEAVLKAAV EHPLSVQNEE RQAAAYITAL GDNAIEITLW AWANEADRWT

251 LQCDLNEQVV ENLRKVNINI PFPQRDIHII NS* a579-1/m579-1 99.6% identity in 282 aa overlap 10         20         30         40         50         60
a579-1.pep MDFKQFDFLHLISASGWEHLAEKAWAFGLNLAAALLIFLVGKWAAKRIVAVMRAAMTRAQ
           ||||||||||||:|||||||||||||||||||||||||||||||||||||||||||||||
m579-1     MDFKQFDFLHLISVSGWEHLAEKAWAFGLNLAAALLIFLVGKWAAKRIVAVMRAAMTRAQ
                  10         20         30         40         50         60

70         80         90        100        110        120
a579-1.pep VDATLISFLCNVANIGLLILVIIAALGRLGVSTTSVTALIGGAGLAVALSLKDQLSNFAA
           ||||||||||||||||||||||||||||||||||||||||||||||||||||||||||||
m579-1     VDATLISFLCNVANIGLLILVIIAALGRLGVSTTSVTALIGGAGLAVALSLKDQLSNFAA
                  70         80         90        100        110        120

130        140        150        160        170        180
a579-1.pep GALIILFRPFKVGDFIRVGGFEGYVREIKMVQTSLRTTDNEEVVLPNSVVMGNSIVNRST
           ||||||||||||||||||||||||||||||||||||||||||||||||||||||||||||
m579-1     GALIILFRPFKVGDFIRVGGFEGYVREIKMVQTSLRTTDNEEVVLPNSVVMGNSIVNRST
                 130        140        150        160        170        180

190        200        210        220        230        240
a579-1.pep LPLCRAQVIVGVDYNCDLKVAKEAVLKAAVEHPLSVQNEERQAAAYITALGDNAIEITLW
           ||||||||||||||||||||||||||||||||||||||||||||||||||||||||||||
m579-1     LPLCRAQVIVGVDYNCDLKVAKEAVLKAAVEHPLSVQNEERQAAAYITALGDNAIEITLW
                 190        200        210        220        230        240

250        260        270        280
a579-1.pep AWANEADRWTLQCDLNEQVVENLRKVNINIPFPQRDIHIINSX
           ||||||||||||||||||||||||||||||||||||||||||
m579-1     AWANEADRWTLQCDLNEQVVENLRKVNINIPFPQRDIHIINSX
                 250        260        270        280
```

The following partial DNA sequence was identified in *N. gonorrhoeae* <SEQ ID 1773>:

```
g580.seq
    1 atggattcgc ccaaggtcgg gtgcgggtgg atggttttgc cgatgtctgc 51 cgcgtcgcag cccatttcga tggcaaggca gacttcgccg atcatgtcgc 101 caccgttcgg accgacaatg ccgccgccga tgatgcggcc ggtttcggca 151 tcgaaaatca gcttggtaaa gccgttgtcg caaccgttgg caatcgcacg
```

-continued
```
201 accggaagcc gcccatggga agttggcttt ggtaattttg cggcctgatg 251 ctttggcaga caattcggtt tcaccgaccc atgccacttc gggggaagtg 301 tag
```

This corresponds to the amino acid sequence <SEQ ID 1774; ORF 580.ng>:

```
g580.pep..
  1 MDSPKVGCGW MVLPMSAASQ PISMARQTSP IMSPPFGPTM PPPMMRPVSA

51 SKISLVKPLS QPLAIARPEA AHGKLALVIL RPDALADNSV SPTHATSGEV

101 *
```

The following partial DNA sequence was identified in *N. meningitidis* <SEQ ID 1775>:

```
m580.seq..
  1 ATGGATTCGC CCAAGGTCGG GTGCGGGTGG ATGGTTTTGC CGATGTCTGC

51 CGCGTCGCAG CCCATTTCGA TGGCAAGGCA GACTTCGCCG ATCATATCGC

101 CACCGTTCGG ACCGACAATG CCGCCGCCGA TGATGCGGCC GGTTTCGGCA

151 TCAAAAATCA GCTTGGTAAA GCCGTTGTCG CAACCGTTGG CAATCGCACG

201 GCCGGAAGCC GCCCACGGGA AGTTGGCTTT GGTGATTTTG CGGCCGGAGG

251 CTTTGGCGGA CAGTTCGGTT TCGCCCACCC ACGCCACTTC GGGGGAAGTG

301 TAG
```

This corresponds to the amino acid sequence <SEQ ID 1776; ORF 580>:

```
m580.pep..
          1 MDSPKVGCGW MVLPMSAASQ PISMARQTSP IISPPFGPTM PPPMMRPVSA

51 SKISLVKPLS QPLAIARPEA AHGKLALVIL RPEALADSSV SPTHATSGEV

101 * m580/g580   97.0% identity in 100 aa overlap
                    10         20         30         40         50         60
m580.pep    MDSPKVGCGWMVLPMSAASQPISMARQTSPIISPPFGPTMPPPMMRPVSASKISLVKPLS
            |||||||||||||||||||||||||||||||:|||||||||||||||||||||||||||
g580        MDSPKVGCGWMVLPMSAASQPISMARQTSPIMSPPFGPTMPPPMMRPVSASKISLVKPLS
                    10         20         30         40         50         60

70         80         90        100
m580.pep    QPLAIARPEAAHGKLALVILRPEALADSSVSPTHATSGEVX
            |||||||||||||||||||||:||||:||||||||||||||
g580        QPLAIARPEAAHGKLALVILRPDALADNSVSPTHATSGEVX
                    70         80         90        100
```

The following partial DNA sequence was identified in *N. meningitidis* <SEQ ID 1777>:

```
a580.seq
  1 ATGGATTCGC CCAAGGTCGG GTGCGGGTGG ATGGTTTTGC CGATGTCTGC

51 CGCGTCGCAG CCCATTTCGA TGGCAAGGCA GACTTCGCCG ATCATGTCGC

101 CACCGTTCGG ACCGACAATG CCGCCGCCGA TGATGCGGCC GGTTTCAGCA

151 TCAAAAATCA GCTTGGTGAA ACCATTGTCG CAACCGTTGG CAATCGCACG

201 GCCGGAAGCA GCCCATGGGA AGTTGGCTTT GGTGATTTTG CGGCCGGAGG
```

-continued

```
251 CTTTGGCAGA CAATTCGGTT TCGCCCACCC ATGCCACTTC AGGAGAAGTG

301 TAA
```

This corresponds to the amino acid sequence <SEQ ID 1778; ORF 580.a>:

```
a580.pep

1  MDSPKVGCGW MVLPMSAASQ PISMARQTSP IMSPPFGPTM PPPMMRPVSA

51  SKISLVKPLS QPLAIARPEA AHGKLALVIL RPEALADNSV SPTHATSGEV

101  * m580/a580   98.0% identity in 100 aa overlap 10        20        30        40        50        60
 m580.pep   MDSPKVGCGWMVLPMSAASQPISMARQTSPIISPPFGPTMPPPMMRPVSASKISLVKPLS
            |||||||||||||||||||||||||||||||:||||||||||||||||||||||||||||
 a580       MDSPKVGCGWMVLPMSAASQPISMARQTSPIMSPPFGPTMPPPMMRPVSASKISLVKPLS
                  10        20        30        40        50        60

70        80        90       100
 m580.pep   QPLAIARPEAAHGKLALVILRPEALADSSVSPTHATSGEVX
            |||||||||||||||||||||||||||:||||||||||||
 a580       QPLAIARPEAAHGKLALVILRPEALADNSVSPTHATSGEVX
                  70        80        90       100
```

The following partial DNA sequence was identified in *N. gonorrhoeae* <SEQ ID 1779>:

```
g581.seq..
   1 atgcacttcg cccagcttgt gggtcaaacc ggtatagaac aaaatacgtt 51 ctgtcgtcgt ggttttaccc gcatcgatat gggcggaaat accgatgttg 101 cggtacaggc tgatcggggt cttacgagcc attttattag cctttcaaaa 151 ttagaaacgg aagtgagaga atgctttgtt ggcttcagcc atacggtgta 201 cttcttcacg tttttcaac gcaccgccac ggccttcgga cgcatcaatc 251 aactcgcctg ccaaacgcag atccatggat ttctcaccac gtttgcgggc 301 cgcgtcgcga acccaacgca ttgccaaagc cagacggcgt ga
```

This corresponds to the amino acid sequence <SEQ ID 1780; ORF 581.ng>:

```
g581.pep..
   1 MHFAQLVGQT GIEQNTFCRR GFTRIDMGGN TDVAVQADRG LTSHFISLSK

51 LETEVRECFV GFSHTVYFFT FFQRTATAFG RINQLACQTQ IHGFLTTFAG

101 RVANPTHCQS QTA*
```

The following partial DNA sequence was identified in *N. meningitidis* <SEQ ID 1781>:

```
m581.seq..
   1 ATGCACTTCG CCCAGCTTGT GGGTCAAACC GGTATAGAAC AAAATACGTT

51 CTGTCGTCGT GGTTTTACCC GCGTCAATAT GGGCGGAAAT ACCGATGTTA

101 CGGTACAGGC TGATCGGGGT CTTACGAGCC ATTTTATTAG CCTTTCAAAA

151 TTAGAAACGG AAGTGAGAGA ATGCTTTGTT GGCTTCAGCC ATACGGTGTA

201 CTTCTTCACG TTTTTTCAAC GCACCGCCAC GGCCTTCGGA CGCATCAATC
```

```
-continued
251 AATTCGCCTG CCAAACGCAG GTCCATGGAT TTCTCACCAC GTTTGCGGGC

301 CGCATCGCGA ACCCAGCGCA TTGCCAAAGC CAAACGGCGT GA
```

This corresponds to the amino acid sequence <SEQ ID 1782; ORF 581>:

```
    m581.pep..

1  MHFAQLVGQT GIEQNTFCRR GFTRVNMGGN TDVTVQADRG LTSHFISLSK

51  LETEVRECFV GFSHTVYFFT FFQRTATAFG RINQFACQTQ VHGFLTTFAG

101  RIANPAHCQS QTA* m581/g581   93.8% identity in 113 aa overlap 10         20         30         40         50         60
    m581.pep   MHFAQLVGQTGIEQNTFCRRGFTRVNMGGNTDVTVQADRGLTSHFISLSKLETEVRECFV
               ||||||||||||||||||||||||:::|||||||:|||||||||||||||||||||||||
    g581       MHFAQLVGQTGIEQNTFCRRGFTRIDMGGNTDVAVQADRGLTSHFISLSKLETEVRECFV
                       10         20         30         40         50         60

70         80         90        100        110
    m581.pep   GFSHTVYFFTFFQRTATAFGRINQFACQTQVHGFLTTFAGRIANPAHCQSQTAX
               |||||||||||||||||||||||||:||||:||||||||||:|||:|||||||
    g581       GFSHTVYFFTFFQRTATAFGRINQLACQTQIHGFLTTFAGRVANPTHCQSQTAX
                       70         80         90        100        110
```

The following partial DNA sequence was identified in *N. meningitidis* <SEQ ID 1783>:

```
a581.seq
   1 ATGCACTTCG CCCAGCTTGT GGGTCAAACC GGTATAGAAC AAAATACGTT

51 CTGTCGTCGT GGTTTTACCC GCATCGATAT GGGCGGAAAT ACCGATGTTA

101 CGGTACAGGC TGATCGGGGT CTTACGAGCC ATTTTATTAG CCTTTCAAAA

151 TTAGAAACGG AAGTGAGAGA ATGCTTTGTT GGCTTCAGCC ATACGGTGTA

201 CTTCTTCACG TTTTTTCAAC GCACCGCCAC GGCCTTCGGA CGCATCAATC

251 AATTCGCCTG CCAAACGCAG GTCCATGGAT TTCTCACCAC GTTTGCGGGC

301 CGCATCGCGA ACCCAGCGCA TTGCCAAAGC CAAACGGCGT GA
```

This corresponds to the amino acid sequence <SEQ ID 1784; ORF 581.a>:

```
    a581.pep

1  MHFAQLVGQT GIEQNTFCRR GFTRIDMGGN TDVTVQADRG LTSHFISLSK

51  LETEVRECFV GFSHTVYFFT FFQRTATAFG RINQFACQTQ VHGFLTTFAG

101  RINPAHCQS QTA* m581/a581   98.2% identity in 113 aa overlap 10         20         30         40         50         60
    m581.pep   MHFAQLVGQTGIEQNTFCRRGFTRVNMGGNTDVTVQADRGLTSHFISLSKLETEVRECFV
               ||||||||||||||||||||||||:::|||||||||||||||||||||||||||||||||
    a581       MHFAQLVGQTGIEQNTFCRRGFTRIDMGGNTDVTVQADRGLTSHFISLSKLETEVRECFV
                       10         20         30         40         50         60

70         80         90        100        110
    m581.pep   GFSHTVYFFTFFQRTATAFGRINQFACQTQVHGFLTTFAGRIANPAHCQSQTAX
               |||||||||||||||||||||||||||||||||||||||||||||||||||||
    a581       GFSHTVYFFTFFQRTATAFGRINQFACQTQVHGFLTTFAGRIANPAHCQSQTAX
                       70         80         90        100        110
```

The following partial DNA sequence was identified in *N. gonorrhoeae* <SEQ ID 1785>:

```
g582.seq..
    1 atgcgctata ttcttttgac aggactgttg ccgacggcat ccgcttttgg 51 agagaccgcg ctgcaatgcg ccgctttgac ggacaatgtt acgcgtttgg 101 cgtgttacga caggattttt gcggcacagc ttccgtcttc ggcagggcag 151 gaagggcagg agtcgaaagc cgtactcaat ctgacggaaa ccgtccgcag 201 cagcttggat aagggcgagg cggtcattgt tgttgaaaaa ggcggggatg 251 cgcttcctgc cgacagtgcg ggcgaaaccg ccgatatcta tacgcctttg 301 agcctgatgt acgacttgga caaaaacgat ttgcgcgggc tgttgggcgt 351 acgcgaacac aatccgatgt accttatgcc gttttggtat aacaattcgc 401 ccaactatgc cccgagttcg ccgacgcgcg gtacgactgt acaggaaaaa 451 ttcggacagc agaaacgtgc ggaaaccaaa ttgcaggttt cgttcaaaag 501 caaaattgcc gaaatttgt ttaaaacccg cgcggatctg tggttcggct 551 acacccaaag atccgattgg cagatttaca accaaggcag gaaatccgcg 601 ccgttccgca atacggatta caaacctgaa attttcctga cccagcctgt 651 gaaggcggat ttgccgttcg gcggcaggct gcgtatgctc ggtgcgggtt 701 ttgtccacca gtccaacgga cagagccgtc ccgaatcgcg ttcgtggaac 751 aggatttatg ccatggcagg catggaatgg ggcaaattga cggtgattcc 801 gcgcgtgtgg gtgcgtgcgt tcgatcagag cggcgataaa aacgacaatc 851 ccgatattgc cgactatatg gggtatggcg acgtgaagct gcagtaccgc 901 ctgaacgaca ggcagaatgt gtattccgta ttgcgctaca accccaaaac 951 gggctacggc gcgattgaag ccgcctacac gtttccgatt aagggcaaac 1001 tcaaaggcgt ggtacgcgga ttccacggtt acggcgagag cctgatcgac 1051 tacaaccaca agcagaacgg tatcggtatc gggttgatgt tcaacgactg 1101 ggacggcatc tga
```

This corresponds to the amino acid sequence <SEQ ID 1786; ORF 582.ng>:

```
g582.pep ..
    1 MRYILLTGLL PTASAFGETA LQCAALTDNV TRLACYDRIF AAQLPSSAGQ

51 EGQESKAVLN LTETVRSSLD KGEAVIVVEK GGDALPADSA GETADIYTPL

101 SLMYDLDKND LRGLLGVREH NPMYLMPFWY NNSPNYAPSS PTRGTTVQEK

151 FGQQKRAETK LQVSFKSKIA ENLFKTRADL WFGYTQRSDW QIYNQGRKSA

201 PFRNTDYKPE IFLTQPVKAD LPFGGRLRML GAGFVHQSNG QSRPESRSWN

251 RIYAMAGMEW GKLTVIPRVW VRAFDQSGDK NDNPDIADYM GYGDVKLQYR

301 LNDRQNVYSV LRYNPKTGYG AIEAAYTFPI KGKLKGVVRG FHGYGESLID

351 YNHKQNGIGI GLMFNDWDGI *
```

The following partial DNA sequence was identified in *N. meningitidis* <SEQ ID 1787>:

```
m582.seq ..
    1   ATGCGCTATA TTCTTTTGAC AGGACTGTTG CCGATGGCAT CCGCTTTTGG
```

-continued

```
  51 AGAGACCGCG CTGCAATGCG CCGCTTTGAC GGACAATGTT ACGCGTTTGG
 101 CGTGTTACGA CAGGATTTTT GCGGCACAGC TTCCGTCTTC GGCAGGGCAG
 151 GAAGGGCAGG AGTCGAAAGC CGTACTCAAT CTGACGGAAA CCGTCCGCAG
 201 CAGCCTGGAT AAGGGCGAGG CGGTCATTGT TGTTGAAAAA GGCGGGGATG
 251 CGCTTCCTGC CGACAGTGCG GGCGAAACCG CCGACATCTA TACGCCTTTG
 301 AGCCTGATGT ACGACTTGGA CAAAAACGAT TTGCGCGGGC TGTTGGGCGT
 351 ACGCGAACAC AATCCGATGT ACCTTATGCC GCTCTGGTAC AACAATTCGC
 401 CCAACTATGC CCCGGGTTCG CCGACGCGCG GTACGACTGT ACAGGAAAAA
 451 TTCGGACAGC AGAAACGTGC GGAAACCAAA TTGCAGGTTT CGTTCAAAAG
 501 CAAAATTGCC GAAGATTTGT TTAAAACCCG CGCGGATCTG TGGTTCGGCT
 551 ACACCCAAAG ATCCGATTGG CAGATTTACA ACCAAGGCAG GAAATCCGCG
 601 CCGTTCCGCA ATACGGATTA CAAACCTGAA ATTTTCCTGA CCCAGCCTGT
 651 GAAGGCGGAT TTGCCGTTCG GCGGCAGGCT GCGTATGCTC GGTGCGGGTT
 701 TTGTCCACCA GTCCAACGGA CAGAGCCGTC CCGAATCGCG TTCGTGGAAC
 751 AGGATTTACG CCATGGCAGG CATGGAATGG GGCAAATTGA CGGTGATTCC
 801 GCGCGTGTGG GTGCGTGCGT TCGATCAGAG CGGCGATAAA AACGACAATC
 851 CCGATATTGC CGACTATATG GGGTATGGCG ACGTGAAGCT GCAGTACCGC
 901 CTGAACGACA GGCAGAATGT GTATTCCGTA TTGCGCTACA ACCCCAAAAC
 951 GGGCTACGGC GCGATTGAAG CCGCCTACAC GTTTCCGATT AAGGGCAAAC
1001 TCAAAGGCGT GGTACGCGGA TTCCACGGTT ACGGCGAGAG CCTGATCGAC
1051 TACAACCACA AGCAGAACGG TATCGGTATC GGGTTGATGT TCAACGACTT
1101 GGACGGCATC TGA
```

This corresponds to the amino acid sequence <SEQ ID 1788; ORF 582>:

```
m582.pep

1   MRYILLTGLL PMASAFGETA LQCAALTDNV TRLACYDRIF AAQLPSSAGO

51   EGQESKAVLN LTETVRSSLD KGEAVIVVEK GGDALPADSA GETADIYTPL

101   SLMYDLDKND LRGLLGVREH NPMYLMPLWY NNSPNYAPGS PTRGTTVQEK

151   FGQQKRAETK LQVSFKSKIA EDLFKTRADL WFGYTQRSDW QIYNQGRKSA

201   PFRBTDTJOE UFKTQOVJAD KOFGGRKRNK GAGFVGQSBG QSROESRSWN

251   RIYANAGMEW GKLTVIPRVW VRAFDQSGDK NDNPDIADYM GYGDVKLQYR

301   LNDRQNVYSV LRYNPKTGYG AIEAAYTFPI KGKLKGVVRG FHGYGESLID

351   YNHKQNGIGI GLMFNDLDGI * m582/g582    98.6% identity in 370 aa overlap 10         20         30         40         50         60
     m582.pep    MRYILLTGLLPMASAFGETALQCAALTDNVTRLACYDRIFAAQLPSSAGQEGQESKAVLN
                 ||||||||||| ||||||||||||||||||||||||||||||||| ||||||||||||||
     g582        MRYILLTGLLPTASAFGETALQCAALTDNVTRLACYDRIFAAQLPSAAGQEGQESKAVLN
                    10         20         30         40         50         60

70         80         90        100        110        120
     m582.pep    LTETVRSSLDKGEAVIVVEKGGDALPADSAGETADIYTPLSLMYDLDKNDLRGLLGVREH
                 ||||||||||||||||||||||||||||||||||||||||||||||||||||||||||||
     g582        LTETVRSSLDKGEAVIVVEKGGDALPADSAGETADIYTPLSLMYDLDKNDLRGLLGVREH
                    70         80         90        100        110        120
```

-continued

```
                     130        140        150        160        170        180
m582.pep   NPMYLMPLWYNNSPNYAPGSPTRGTTVQEKFGQQKRAETKLQVSFKSKIAEDLFKTRADL
           |||||||:||||||||||:||||||||||||||||||||||||||||||||||:||||||||
g582       NPMYLMPFWYNNSPNYAPSSPTRGTTVQEKFGQQKRAETKLQVSFKSKIAENLFKTRADL
                     130        140        150        160        170        180

190        200        210        220        230        240
m582.pep   WFGYTQRSDWQIYNQGRKSAPFRNTDYKPEIFLTQPVKADLPFGGRLRMLGAGFVHQSNG
           ||||||||||||||||||||||||||||||||||||||||||||||||||||||||||||
g582       WFGYTQRSDWQIYNQGRKSAPFRNTDYKPEIFLTQPVKADLPFGGRLRMLGAGFVHQSNG
                     190        200        210        220        230        240

250        260        270        280        290        300
m582.pep   QSRPESRSWNRIYAMAGMEWGKLTVIPRVWVRAFDQSGDKNDNPDIADYMGYGDVKLQYR
           ||||||||||||||||||||||||||||||||||||||||||||||||||||||||||||
g582       QSRPESRSWNRIYAMAGMEWGKLTVIPRVWVRAFDQSGDKNDNPDIADYMGYGDVKLQYR
                     250        260        270        280        290        300

310        320        330        340        350        360
m582.pep   LNDRQNVYSVLRYNPKTGYGAIEAAYTFPIKGKLKGVVRGFHGYGESLIDYNHKQNGIGI
           ||||||||||||||||||||||||||||||||||||||||||||||||||||||||||||
g582       LNDRQNVYSVLRYNPKTGYGAIEAAYTFPIKGKLKGVVRGFHGYGESLIDYNHKQNGIGI
                     310        320        330        340        350        360

370
m582.pep   GLMFNDLDGIX
           |||||| ||||
g582       GLMFNDWDGIX
                     370
```

The following partial DNA sequence was identified in *N. meningitidis* <SEQ ID 1789>:

```
a582.seq
     1  ATGCGCTATA TTCTTTTGAC AGGACTGTTG CCGATGGCAT CCGCTTTTGG
    51  AGAGACCGCG CTGCAATGCG CCGCTTTGAC GGACAATGTT ACGCGTTTGG
   101  CGTGTTACGA CAGGATTTTT GCGGCACAGC TTCCGTCTTC GGCAGGGCAG
   151  GAAGGGCAGG AGTCGAAAGC CGTACTCAAT CTGACGGAAA CCGTCCGCAG
   201  CAGCCTGGAT AAGGGCGAGG CGGTCATTGT TGTTGAAAAA GGCGGGGATG
   251  CGCTTCCTGC CGACAGTGCG GGCGAAACCG CCGACATCTA TACGCCTTTG
   301  AGCCTGATGT ACGACTTGGA CAAAAACGAT TTGCGCGGGC TGTTGGGCGT
   351  ACGCGAACAC AATCCGATGT ACCTTATGCC GCTCTGGTAC AACAATTCGC
   401  CCAACTATGC CCCGGGTTCG CCGACGCGCG GTACGACTGT ACAGGAAAAA
   451  TTCGGACAGC AGAAACGTGC GGAAACCAAA TTGCAGGTTT CGTTCAAAAG
   501  CAAAATTGCC GAAGATTTGT TTAAAACCCG CGCGGATCTG TGGTTCGGCT
   551  ACACCCAAAG ATCCGATTGG CAGATTTACA ACCAAGGCAG GAAATCCGCG
   601  CCGTTCCGCA ATACGGATTA CAAACCTGAA ATTTTCCTGA CCCAGCCTGT
   651  GAAGGCGGAT TTGCCGTTCG GCGGCAGGCT GCGTATGCTC GGTGCGGGTT
   701  TTGTCCACCA GTCCAACGGA CAGAGCCGTC CCGAATCGCG TTCGTGGAAC
   751  AGGATTTACG CCATGGCAGG CATGGAATGG GGCAAATTGA CGGTGATTCC
   801  GCGCGTGTGG GTGCGTGCGT TCGATCAGAG CGGCGATAAA AACGACAATC
   851  CCGATATTGC CGACTATATG GGGTATGGCG ACGTGAAGCT GCAGTACCGC
   901  CTGAACGACA GGCAGAATGT GTATTCCGTA TTGCGCTACA ATCCCAAAAC
   951  GGGCTACGGC GCGATTGAAG CCGCCTACAC GTTTCCGATT AAGGGCAAAC
  1001  TCAAAGGCGT GGTACGCGGA TTCCACGGTT ACGGCGAGAG CCTGATCGAC
  1051  TACAACCACA AGCAGAACGG TATCGGTATC GGGTTGATGT TCAACGACTT
  1101  GGACGGCATC TGA
```

This corresponds to the amino acid sequence <SEQ ID 1790; ORF 582.a>:

```
a582.pep

1 MRYILLTGLL PMASAFGETA LQCAALTDNV TRLACYDRIF AAQLPSSAGQ

51 EGQESKAVLN LTETVRSSLD KGEAVIVVEK GGDALPADSA GETADIYTPL

101 SLMYDLDKND LRGLLGVREH NPMYLMPLWY NNSPNYAPGS PTRGTTVQEK

151 FGQQKRAETK LQVSFKSKIA EDLFKTRADL WFGYTQRSDW QIYNQGRKSA

201 PFRNTDYKPE IFLTQPVKAD LPFGGRLRML GAGFVHQSNG QSRPESRSWN

251 RIYAMAGMEW GKLTVIPRVW VRAFDQSGDK NDNPDIADYM GYGDVKLQYR

301 LNDRQNVYSV LRYNPKTGYG AIEAAYTFPI KGKLKGVVRG FHGYGESLID

351 YNHKQNGIGI GLMFNDLDGI * m582/a582 100.0% identity in 370 aa overlap
                  10         20         30         40         50         60
m582.pep  MRYILLTGLLPMASAFGETALQCAALTDNVTRLACYDRIFAAQLPSSAGQEGQESKAVLN
          ||||||||||||||||||||||||||||||||||||||||||||||||||||||||||||
a582      MRYILLTGLLPMASAFGETALQCAALTDNVTRLACYDRIFAAQLPSSAGQEGQESKAVLN
                  10         20         30         40         50         60

70         80         90        100        110        120
m582.pep  LTETVRSSLDKGEAVIVVEKGGDALPADSAGETADIYTPLSLMYDLDKNDLRGLLGVREH
          ||||||||||||||||||||||||||||||||||||||||||||||||||||||||||||
a582      LTETVRSSLDKGEAVIVVEKGGDALPADSAGETADIYTPLSLMYDLDKNDLRGLLGVREH
                  70         80         90        100        110        120

130        140        150        160        170        180
m582.pep  NPMYLMPLWYNNSPNYAPGSPTRGTTVQEKFGQQKRAETKLQVSFKSKIAEDLFKTRADL
          ||||||||||||||||||||||||||||||||||||||||||||||||||||||||||||
a582      NPMYLMPLWYNNSPNYAPGSPTRGTTVQEKFGQQKRAETKLQVSFKSKIAEDLFKTRADL
                 130        140        150        160        170        180

190        200        210        220        230        240
m582.pep  WFGYTQRSDWQIYNQGRKSAPFRNTDYKPEIFLTQPVKADLPFGGRLRMLGAGFVHQSNG
          ||||||||||||||||||||||||||||||||||||||||||||||||||||||||||||
a582      WFGYTQRSDWQIYNQGRKSAPFRNTDYKPEIFLTQPVKADLPFGGRLRMLGAGFVHQSNG
                 190        200        210        220        230        240

250        260        270        280        290        300
m582.pep  QSRPESRSWNRIYAMAGMEWGKLTVIPRVWVRAFDQSGDKNDNPDIADYMGYGDVKLQYR
          ||||||||||||||||||||||||||||||||||||||||||||||||||||||||||||
a582      QSRPESRSWNRIYAMAGMEWGKLTVIPRVWVRAFDQSGDKNDNPDIADYMGYGDVKLQYR
                 250        260        270        280        290        300

310        320        330        340        350        360
m582.pep  LNDRQNVYSVLRYNPKTGYGAIEAAYTFPIKGKLKGVVRGFHGYGESLIDYNHKQNGIGI
          ||||||||||||||||||||||||||||||||||||||||||||||||||||||||||||
a582      LNDRQNVYSVLRYNPKTGYGAIEAAYTFPIKGKLKGVVRGFHGYGESLIDYNHKQNGIGI
                 310        320        330        340        350        360

370
m582.pep  GLMFNDLDGIX
          |||||||||||
a582      GLMFNDLDGIX
                 370
```

The following partial DNA sequence was identified in *N. gonorrhoeae* <SEQ ID 1791>:

```
g583.seq..
   1 atgataattg accaaagcca aatatttacc catcttgcct tctgtgcctt 51 ttgcgggatt ggagccgtaa ctgccggcaa tcgactgcat aatcggatgt 101 ataatgccgc cgccgcgcgc ggtattggaa ggggtaacgg gagccagcag 151 cagttcggaa agagcgagac tgtaaccgat gcccagcgtt tttcttccaa 201 aaacggcgat aaacaaatat ccgatacgca tccccagccc tgttttgagc 251 aaaccgcgcg aaatcataac tgcgatggca atcagccaaa tcaacggatt 301 ggcgaacgca ctcaacgcat cgctcatcgc cgcgcccggt ttgtcggcgg 351 ttacgccggt tactgcgacc aacccgacgg caataatcga cagcgcgccc
```

-continued
```
401 aacggcataa ccttgccgat aatggcggca atcacaccga caaacatagc 451 cagcagcgtc caagcctgag gcttgacccc gtcgggtacg ggcagtgcca 501 aaaccagggc gcacaatact gcggcaatgg cgaggggtat cggtttgaaa 551 cccaatttca tcatattgac ctccgtaaaa aagaccgtcc cgaaaaatcg 601 gaaaaataa
```

This corresponds to the amino acid sequence <SEQ ID 1792; ORF 583.ng>:

```
g583.pep..
  1 MIIDQSQIFT HLAFCAFCGI GAVTAGNRLH NRMYNAAAAR GIGRGNGSQQ

51 QFGKSETVTD AQRFSSKNGD KQISDTHPQP CFEQTARNHN CDGNQPNQRI

101 GERTQRIAHR RARFVGGYAG YCDQPDGNNR QRAQRHNLAD NGGNHTDKHS

151 QQRPSLRLDP VGYGQCQNQG AQYCGNGEGY RFETQFHHID LRKKDRPEKS

201 EK*
```

The following partial DNA sequence was identified in *N. meningitidis* <SEQ ID 1793>:

```
m583.seq..
  1 ATGATAGTTG ACCAAAGCCA AATATTTACC CATCTTGCCT TCTGTGCCTT

51 TTGCGGGATT GGAGCCGTAA CTGCCGGCAA TCGACTGCAT AATCGGATGT

101 ATAATGCCGC CGCCGCGCGC GGTATTGGAA GGGGTAACGG GAGCCAGCAG

151 CAGTTCGGAA AGAGCGAGAC TGTAACCGAT GCCCAGCGTT TTTCTTCCAA

201 AAACGGCGAT AAACAAATAT CCGATACGCA TCCCCAGCCC TGTTTTGAGC

251 AAACCGCGCG AAATCATAAC TGCGATGGCA ATCAGCCAAA TCAACGGATT

301 GGCGAACGCA CTCAACGCAT CGCTCATCGC CGCGCCCGGT TTGTCGGCGG

351 TTACGCCGGT TACTGCGACC AACCCGACGG CAATAATCGA CAGCGCGCCC

401 AACGGCATGG CCTTGCCGAT AATGGCGGCA ATCACACCGA CAAACATGGC

451 CAGCAGCGTC CAAGCCTGAG GCTTGACCCC GTCGGGTACG GGCAGTGCCA

501 AAACCAGGGC GCACAATACT GCGGCAATGG CGAGGGGTAT CGGTTTGAAA

551 CCCAATTTCA TCATATTGAC CTCCGTAAAA AAGACCGTCC CGAAAAATCG

601 GAAAAATAA
```

This corresponds to the amino acid sequence <SEQ ID 1794; ORF 583>:

```
a583.pep..
      1 MIVDQSQIFT HLAFCAFCGI GAVTAGNRLH NRMYNAAAAR GIGRGNGSQQ

51 QFGKSETVTD AQRFSSKNGD KQISDTHPQP CFEQTARNHN CDGNQPNQRI

101 GERTQRIAHR RARFVGGYAG YCDQPDGNNR QRAQRHGLAD NGGNHTDKHG

151 QQRPSLRLDP VGYGQCQNQG AQYCGNGEGY RFETQFHHID LRKKDRPEKS

201 EK* m583/g583 98.5% identity in 202 aa overlap
```

-continued

```
            10        20        30        40        50        60
m583.pep MIVDQSQIFTHLAFCAFCGIGAVTAGNRLHNRMYNAAAARGIGRGNGSQQQFGKSETVTD
         ||:|||||||||||||||||||||||||||||||||||||||||||||||||||||||||
g583     MIIDQSQIFTHLAFCAFCGIGAVTAGNRLHNRMYNAAAARGIGRGNGSQQQFGKSETVTD
            10        20        30        40        50        60

70        80        90       100       110       120
m583.pep AQRFSSKNGDKQISDTHPQPCFEQTARNHNCDGNQPNQRIGERTQRIAHRRARFVGGYAG
         ||||||||||||||||||||||||||||||||||||||||||||||||||||||||||||
g583     AQRFSSKNGDKQISDTHPQPCFEQTARNHNCDGNQPNQRIGERTQRIAHRRARFVGGYAG
            70        80        90       100       110       120

130       140       150       160       170       180
m583.pep YCDQPDGNNRQRAQRHGLADNGGNHTDKHGQQRPSLRLDPVGYGQCQNQGAQYCGNGEGY
         |||||||||||||||:|||||||||||||:||||||||||||||||||||||||||||||
g583     YCDQPDGNNRQRAQRHNLADNGGNHTDKHSQQRPSLRLDPVGYGQCQNQGAQYCGNGEGY
           130       140       150       160       170       180

190       200
m583.pep RFETQFHHIDLRKKDRPEKSEKX
         |||||||||||||||||||||||
a583     RFETQFHHIDLRKKDRPEKSEKX
           190       200
```

The following partial DNA sequence was identified in *N. meningitidis* <SEQ ID 1795>:

```
a583.seq
   1 ATGATAGTTG ACCAAAGCCA AATATTTACC CATCTTGCCT TCTGTGCCTT
  51 TTGCGGGATT GGAGCCGTAA CTGCCGGCAA TCGACTGCAT AATCGGATGT
 101 ATAATGCCGC CGCCGCGCGC GGTATTGGAA GGGGTAACGG GAGCCAGCAG
 151 CAGTTCGGAA AGAGCGAGAC TGTAACCGAT GCCCAGCGTT TTTCTTCCAA
 201 AAACGGCGAT AAACAAATAT CCGATACGCA TCCCCAGCCC TGTTTTGAGC
 251 AAACCGCGCG AAATCATAAC TGCGATGGCA ATCAGCCAAA TCAACGGATT
 301 GGCGAACGCA CTCAACGCAT CGCTCATCGC CGCACCCGGT TTGTCGGCGG
 351 TTACGCCGGT TACTGCGACC AACCCGACGG CAATAATCGA CAGCGCACCC
 401 AACGGCATGG CCTTGCCGAT AATGGCGGCA ATCACACCGA TAAACATGGC
 451 CAGCAGCGTC CAAGCCTGAG GCTTGACCCC GTCGGGTACG GGCAGTGCCA
 501 AAACCAAGGC GCACAATACT GCGGCAATGG CGAGGGGTAT CGGTTTGAAA
 551 CCCAATTTCA TCATATTGAC CTCCGTAAAA AAGACCGTCC CGAAAAATCG
 601 GAAAAATAA
```

This corresponds to the amino acid sequence <SEQ ID 1796; ORF 583.a>:

```
a583.pep
      1 MIVDQSQIFT HLAFCAFCGI GAVTAGNRLH NRMYNAAAAR GIGRGNGSQQ
     51 QFGKSETVTD AQRFSSKNGD KQISDTHPQP CFEQTARNHN CDGNQPNQRI
    101 GERTQRIAHR RTRFVGGYAG YCDQPDGNNR QRTQRHGLAD NGGNHTDKHG
    151 QQRPSLRLDP VGYGQCQNQG AQYCGNGEGY RFETQFHHID LRKKDRPEKS
    201 EK* m583/a583 99.0% identity in 202 aa overlap 10        20        30        40        50        60
m583.pep MIVDQSQIFTHLAFCAFCGIGAVTAGNRLHNRMYNAAAARGIGRGNGSQQQFGKSETVTD
         ||||||||||||||||||||||||||||||||||||||||||||||||||||||||||||
a583     MIVDQSQIFTHLAFCAFCGIGAVTAGNRLHNRMYNAAAARGIGRGNGSQQQFGKSETVTD
            10        20        30        40        50        60
```

-continued

```
              70         80         90        100        110        120
m583.pep  AQRFSSKNGDKQISDTHPQPCFEQTARNHNCDGNQPNQRIGERTQRIAHRRARFVGGYAG
          ||||||||||||||||||||||||||||||||||||||||||||||||||:||||||||
a583      AQRFSSKNGDKQISDTHPQPCFEQTARNHNCDGNQPNQRIGERTQRIAHRRTRFVGGYAG
              70         80         90        100        110        120

130        140        150        160        170        180
m583.pep  YCDQPDGNNRQRAQRHGLADNGGNHTDKHGQQRPSLRLDPVGYGQCQNQGAQYCGNGEGY
          ||||||||||||:|||||||||||||||||||||||||||||||||||||||||||||||
a583      YCDQPDGNNRQRTQRHGLADNGGNHTDKHGQQRPSLRLDPVGYGQCQNQGAQYCGNGEGY
             130        140        150        160        170        180

190        200
m583.pep  RFETQFHHIDLRKKDRPEKSEKX
          |||||||||||||||||||||||
a583      RFETQFHHIDLRKKDRPEKSEKX
             190        200
```

The following partial DNA sequence was identified in *N. gonorrhoeae* <SEQ ID 1797>:

```
g584.seq..
   1 atgctgcgtt ctattttggc ggcttccctg ctggcggtat cttttccggc
  51 ggcggctgag gcattgaatt acaatattgt cgaattttcc gaatcggcgg
 101 gtatcgaggt ggctcaggat acaatgtccg cgcgtttcca ggtggcggcg
 151 gaaggacggg acaaaaatgc cgtcaatgcc gagtttgtta aaaaattcaa
 201 caatttcacc agaaaatcga aaaatggtag ctttaaaacc gaattggtat
 251 cgcgcagtgc gatgccgcgc tatcaatata ccaacggcag acgcattcaa
 301 acaggctggg aggagcgtgc ggaatttaag gcggagggca gggattttga
 351 tgctttaaac cgttttattg ctgatgttca gacggatgct tcgcttgaag
 401 ataccgattt cagcgtgtcg cgcgaacgcc gaaacgaggt catcgatcag
 451 gtcagcaagg atgccgtttt gcgtttcaag gcgcgtgccg aaaaactggc
 501 gggcgttctg ggtgcgtccg gttataaaat cgtcaaattg aattttgggc
 551 aaatcggcag ccatattgcg ggcgatgggg ctgttcgggc aaaaatgctg
 601 cgcgcgatgc cgatggcggc aagcgtcaat atgaagggta cggattcagc
 651 cgcaccgggt gtggaggaaa tcagcatcag catcaatggg acggttcagt
 701 tctaa
```

This corresponds to the amino acid sequence <SEQ ID 1798; ORF 584.ng>:

```
g584.pep Length: ..
   1 MLRSILAASL LAVSFPAAAE ALNYNIVEFS ESAGIEVAQD TMSARFQVAA
  51 EGRDKNAVNA EFVKKFNNFT RKSKNGSFKT ELVSRSAMPR YQYTNGRRIQ
 101 TGWEERAEFK AEGRDFDALN RFIADVQTDA SLEDTDFSVS RERRNEVIDQ
 151 VSKDAVLRFK ARAEKLAGVL GASGYKIVKL NFGQIGSHIA GDGAVRAKML
 201 RAMPMAASVN MKGTDSAAPG VEEISISING TVQF*
```

The following partial DNA sequence was identified in *N. meningitidis* <SEQ ID 1799>:

```
m584.seq..
   1 ATGTTGCGTC TTGTTTTGGC GGCTTCGCTG TCGGCGGTAT CTTTTCCGGC
  51 AGCGGCTGAA GCATTGAATT ACAATATTGT CGAATTTTCC GAATCGGCGG
 101 GTGTCGAGGT GGCTCAGGAT ACAATGTCCG CACGTTTCCA AGTGACGGCG
```

-continued

```
151 GAAGGACGGG ACAAAAATGC CGTCAATGCT GAGTTTGTTA AAAAATTCAA

201 CAAGTTCATC AGAAAATCGA AAAATGGTAG CTTTAAAACC GAATTGGTAT

251 CGCGCAGTGC GATGCCGCGC TATCAATATA CCAACGGCAG ACGCATTCAA

301 ACAGGCTGGG AGGAGCGTGC GGAATTTAAG GTCGAAGGTA GAGATTTTGA

351 TGAGTTAAAC CGTTTTATTG CCGATATTCA AGCAGATGCC GCGTTGGmAT

401 ATACGGATTT CCATGTGTCG CGCGAACGCC GCAACGAGGT CATCkATCAG

451 GTCAGCAAGG ATGCCGTTTT GCGTTTCAAG GCGCGTGCCG AAAAGTTGGC

501 GGGCGTTTTG GGTGCGTCCG GTTATAAAAT CGTCAAATTG AATTTGGGAC

551 ACATCGGCAG CCATATCGCG GGAGGGGGAG CTGCTCAGGC AAAAATGCTT

601 CGTGCCATGC CGATGGCGGC AAGCGTCAAT ATGGAGGGTG CGGATTCCGC

651 CGCGCCTGGT GTGGAGGAAA TCAGCATCAG CGTCAATGGG ACGGTTCAGT

701 TCTGA
```

This corresponds to the amino acid sequence <SEQ ID 1800; ORF 584>:

```
a584.pep..

1 MLRLVLAASL SAVSFPAAAE ALNYNIVEFS ESAGVEVAQD TMSARFQVTA

51 EGRDKNAVNA EFVKKFNKFI RKSKNGSFKT ELVSRSAMPR YQYTNGRRIQ

101 TGWEERAEFK VEGRDFDELN RFIADIQADA ALXYTDFHVS RERRNEVIXQ

151 VSKDAVLRFK ARAEKLAGVL GASGYKIVKL NLGHIGSHIA GGGAAQAKML

201 RAMPMAASVN MEGADSAAPG VEEISISVNG TVQF* m584/g584 89.7% identity in 234 aa overlap 10         20         30         40         50         60
m584.pep  MLRLVLAASLSAVSFPAAAEALNYNIVEFSESAGVEVAQDTMSARFQVTAEGRDKNAVNA
          |||:||||| ||||||||||||||||||||||||:|||||||||||:||||||||||||
g584      MLRSILAASLLAVSFPAAAEALNYNIVEFSESAGIEVAQDTMSARFQVAAEGRDKNAVNA
                  10         20         30         40         50         60
                  70         80         90        100        110        120
m584.pep  EFVKKFNKFIRKSKNGSFKTELVSRSAMPRYQYTNGRRIQTGWEERAEFKVEGRDFDELN
          ||||||||:| ||||||||||||||||||||||||||||||||||||||||:|||||| ||
g584      EFVKKFNNFTRKSKNGSFKTELVSRSAMPRYQYTNGRRIQTGWEERAEFKAEGRDFDALN
                  70         80         90        100        110        120
                 130        140        150        160        170        180
m584.pep  RFIADIQADAALXYTDFHVSRERRNEVIXQVSKDAVLRFKARAEKLAGVLGASGYKIVKL
          |||||:|:||:|   |||:|||||||||||:|||||||||||||||||||||||||||||
g584      RFIADVQTDASLEDTDFSVSRERRNEVIDQVSKDAVLRFKARAEKLAGVLGASGYKIVKL
                 130        140        150        160        170        180
                 190        200        210        220        230
m584.pep  NLGHIGSHIAGGGAAQAKMLRAMPMAASVNMEGADSAAPGVEEISISVNGTVQFX
          |:|:||||||   ||::|||||||||||||||:|:|||||||||||||:||||||
g584      NFGQIGSHIAGDGAVRAKMLRAMPMAASVNMKGTDSAAPGVEEISISINGTVQFX
                 190        200        210        220        230
```

The following partial DNA sequence was identified in *N. meningitidis* <SEQ ID 1801>:

```
a584.seq
    1 ATGTTGCGTT CTATTTTGGC GGCTTCCCTG CTG....... ..........

51 .......... .......... .....ATTGT CGAATTTTCT GAATCGGCGG

101 GTGTCGAGGC GGTTCAGGAT ACAATGTCCG CACGTTTCCA AGTGACGGCG

151 GAAGGACGGG ACAAAAATGC CGTCAATGCC GAGTTTGTTA AAAAATTCAA

201 CAATTTCACC AGAAAATCAA AAAATGGTAG CTTTAAAACC GAATTGGTAT
```

-continued

```
251 CGCGCAGTGC GATGCCGCGC TATCAATATA CCAACGGCAG ACGCATTCAA

301 ACAGGTTGGG AGGAGCGTGC GGAATTTAAG GTCGAGGGTA GGAATTTTGA

351 TGCGTTGAAC CGTTTTATTG CCGATGTTCA GGCAGATGCC GCGTTGGAAT

401 ATACGGATTT CCATGTGTCG CGCGAACGCC GCAACGAGGT CATCGATCAG

451 GTCAGCAAGG ATGCCGTTTT GCGTTTCAAG GCGCGTGCCG AAAAGTTGGC

501 GGGCGTTTTG GGTGCGTCCG GTTATAAAAT CGTCAAATTG AATTTGGGAC

551 ACATCGGCAG CCATATCGCG GGAGGGGGAG CTGCTCAGGC AAAAATGCTT

601 CGTGCCATGC CGATGGCGGC AAGCGTCAAT ATGGAGGGTG CGGATTCCGC

651 CGCGCCTGGT GTGGAGGAAA TCAGCATCAG CGTCAATGGG ACGGTTCAGT

701 TCTGA
```

This corresponds to the amino acid sequence <SEQ ID 1802; ORF 584.a>:

```
a584.pep

1   MLRSILAASL L.......... .....IVEFS ESAGVEAVQD TMSARFQVTA

51   EGRDKNAVNA EFVKKFNNFT RKSKNGSFKT ELVSRSAMPR YQYTNGRRIQ

101   TGWEERAEFK VEGRNFDALN RFIADVQADA ALEYTDFHVS RERRNEVIDQ

151   VSKDAVLRFK ARAEKLAGVL GASGYKIVKL NLGHIGSHIA GGGAAQAKML

201   RAMPMAASVN MEGADSAAPG VEEISISVNG TVQF* m584/a584 88.9% identity in 234 aa overlap 10         20         30         40         50         60
m584.pep  MLRLVLAASLSAVSFPAAAEALNYNIVEFSESAGVEVAQDTMSARFQVTAEGRDKNAVNA
          ||| :|||||              ||||||||||::||||||||||||||||||||||||
a584      MLRSILAASLL--------------IVEFSESAGVEAVQDTMSARFQVTAEGRDKNAVNA
                10                    20         30         40

70         80         90        100        110        120
m584.pep  EFVKKFNKFIRKSKNGSFKTELVSRSAMPRYQYTNGRRIQTGWEERAEFKVEGRDFDELN
          ||||||| : | ||||||||||||||||||||||||||||||||||||||||||| :|| ||
a584      EFVKKFNNFTRKSKNGSFKTELVSRSAMPRYQYTNGRRIQTGWEERAEFKVEGRNFDALN
                50         60         70         80         90        100

130        140        150        160        170        180
m584.pep  RFIADIQADAALXYTDFHVSRERRNEVIXQVSKDAVLRFKARAEKLAGVLGASGYKIVKL
          |||| :||||||  ||||||||||||||| ||||||||||||||||||||||||||||||
a584      RFIADVQADAALEYTDFHVSRERRNEVIDQVSKDAVLRFKARAEKLAGVLGASGYKIVKL
               110        120        130        140        150        160

190        200        210        220        230
m584.pep  NLGHIGSHIAGGGAAQAKMLRAMPMAASVNMEGADSAAPGVEEISISVNGTVQFX
          ||||||||||||||||||||||||||||||||||||||||||||||||||||||
a584      NLGHIGSHIAGGGAAQAKMLRAMPMAASVNMEGADSAAPGVEEISISVNGTVQFX
               170        180        190        200        210        220
```

The following partial DNA sequence was identified in *N. gonorrhoeae* <SEQ ID 1803>:

```
g585.seq..
   1 atgaaactgt tccaacgcat tttcgccaca ttttgcgcgg ttatcgtctg 51 cgcaatcttt gtggcgagtt tttcttttg gctggtgcag aacacccttg 101 ccgaaaacca attcaaccaa cgccgcacca tcgaaaccac attgatgggc 151 agcattattt ccgcattcaa gacacggggc gacaacggcg cgcgcgaaat 201 cctgaccgaa tggaaaaaca gccccgtctc atccgccgtt tacgtcatac 251 agggcgacga gaaaaaagac atcttaaacc gctatatcga caattacacc 301 atagaacgcg cccggctgtt tgccgccaac aaccccccatt ccaaccttgt
```

-continued

```
351 ccgcatcgaa tacgaccgtt tcggcgaaga atacctgttc ttcattaaag 401 gctgggacaa ccaccaggca caacgcctgc ccagcccgct gtttatcccg 451 ggcctgccgc ttgccccgat ttggcacgaa ttcatcatcc tctccttcat 501 catcattgtc ggactgctga tggcatatat ccttgccggc aacattgcca 551 aacccatcag aatcttaggc aacggcatgg acagggtggc agaacgagaa 601 cttgaagacc gcgtttgcca acaggttcgc gaccgcgacg acgaattggc 651 cgatgttgcc atgcaattcg acacaatggt ggaaaaactg gaataa
```

This corresponds to the amino acid sequence <SEQ ID 1804; ORF 585.ng>:

```
g585.pep..
  1 MKLFQRIFAT FCAVIVCAIF VASFSFWLVQ NTLAENQFNQ RRTIETTLMG

51 SIISAFKTRG DNGAREILTE WKNSPVSSAV YVIQGDEKKD ILNRYIDNYT

101 IERARLFAAN NPHSNLVRIE YDRFGEEYLF FIKGWDNHQA QRLPSPLFIP

151 GLPLAPIWHE FIILSFIIIV GLLMAYILAG NIAKPIRILG NGMDRVAERE

201 LEDRVCQQVR DRDDELADVA MQFDTMVEKL E*
```

The following partial DNA sequence was identified in *N. meningitidis* <SEQ ID 1805>:

```
m585.seq..
   1 ATGAAACTGT TCCAACGCAT TTTCGCCACA TTTTGCGCGG TTATCGTCTG

51 TGCAATCTTT GTGGCGAGTT TTTCTTTCTG GCTGGTGCAG AACACCCTTG

101 CCGAAAACCA GTTCAACCAA CGCCGCACCA TCGAAACCAC TTTGATGGGC

151 AGCATCATTT CCGCATTCCG GGCACGCGGG GACGCGGGTG CGCGCGAAAT

201 CCTGACGGAA TGGAAAGACA GCCCCGTCTC ATCGGGCGTG TACGTTATAC

251 AGGGCGACGA GAAAAAGAT ATCCTGAACC GGTATATCGA CAGCTATACC

301 ATCGAACGCG CCCGGCTTTT CGCCGCCGGA CACCCGCATT CCAACCTCGT

351 CCATATCGAA TACGACCGCT TCGGCGAAGA ATACCTGTTC TTCACCAAAG

401 ACTGGGACAA ACTCCAAGCC CGCCGCCTGC CCAGCCCCCT GTTGATCCCC

451 GGCCTGCCGC TCGCCCCGAT TTGGCACGAA CTCATCATAT TGTCCTTCAT

501 CATCATCGTC GGACTGCTGA TGGCATATAT CCTCGCCGGC AACATTGCCA

551 AACCCATCAG AATCTTAGGC AACGGCATGG ACAGGGTGGC AAACGGAGAA

601 CTTGAAACCC GTATCTCCCA ACAGGTCGAC GACCGCGACG ACGAATTGTC

651 CCATCTTGCC ATCCAATTCG ACAAAATGGT GGAAAAACTC GAAAAACTCG

701 TTGCCAAAGA ACGCCACCTG CTCCATCACG TCTCCCATGA AATGCGTTCT

751 CCCCTTGCGC GCATGCAGGC AATTGTCGGA CTGATTCAGG CGCAGCCCCA

801 AAAACAGGAG CAATATCTCA AACGGCTGGA AGGCGAACTG ACCCGCATGG

851 ATACGCTGGC CGGGGAACTG TTAACCCTGT CCCGTCTCGA AACTTCCAAT

901 ATGGCTTTGG AAAAAGAAAG CCTGAAACTC CTGCCCTTCC TGGGCAACCT

951 GGTAGAAGAC AATCAAAGCA TTGCCCAGAA AAACGGACAA ACGGTTACCC

1001 TGTCTGCCGA CGGAAAAATC CCCGAAAACA CAACCATCCT TGCCAACGAA

1051 AGCTACCTGT ACCGCGCCTT CGACAACGTC ATCCGCAACG CCGTCAACTA
```

```
-continued
1101 CAGTCCCGAA GGCAGCACCA TCCTGATCAA CATCGGACAA GACCACAAAC

1151 ACTGGATAAT CGACGTTACC GACAACGGCC CCGGCGTGGA CGAAATGCAG

1201 CTCCCGCACA TCTTCACCGC TTTCTACCGT GCAGACTCCA GTGCCAACAA

1251 ACCCGGAACA GGACTGGGGC TTGCATTGAC CCAACATATT ATTGAACAGC

1301 ACTGCGGCAA AATCATCGCC GAAACATCA AACCGAACGG TCTGCGGATG

1351 CGCTTTATCC TGCCCAAGAA AAAACCGGT TCCAAACAG AAAAAGTGC

1401 GAACTGA
```

This corresponds to the amino acid sequence <SEQ ID 1806; ORF 585>:

```
m585.pep..

1  MKLFQRIFAT FCAVIVCAIF VASFSFWLVQ NTLAENQFNQ RRTIETTLMG
         51  SIISAFRARG DAGAREILTE WKDSPVSSGV YVIQGDEKKD ILNRYIDSYT
        101  IERARLFAAG HPHSNLVHIE YDRFGEEYLF FTKDWDKLQA RRLPSPLLIP
        151  GLPLAPIWHE LIILSFIIIV GLLMAYILAG NIAKPIRILG NGMDRVANGE
        201  LETRISQQVD DRDDELSHLA IQFDKMVEKL EKLVAKERHL LHHVSHEMRS
        251  PLARMQAIVG LIQAQPQKQE QYLKRLEGEL TRMDTLAGEL LTLSRLETSN
        301  MALEKESLKL LPFLGNLVED NQSIAQKNGQ TVTLSADGKI PENTTILANE
        351  SYLYRAFDNV IRNAVNYSPE GSTILINIGQ DHKHWIIDVT DNGPGVDEMQ
        401  LPHIFTAFYR ADSSANKPGT GLGLALTQHI IEQHCGKIIA ENIKPNGLRM
        451  RFILPKKKTG SKTEKSAN*
```

```
m585/g585 88.3% identity in 231 aa overlap
                 10         20         30         40         50         60
m585.pep MKLFQRIFATFCAVIVCAIFVASFSFWLVQNTLAENQFNQRRTIETTLMGSIISAFRARG
         ||||||||||||||||||||||||||||||||||||||||||||||||||||||::||
g585     MKLFQRIFATFCAVIVCAIFVASFSFWLVQNTLAENQFNQRRTIETTLMGSIISAFKTRG
                 10         20         30         40         50         60

70         80         90        100        110        120
m585.pep DAGAREILTEWKDSPVSSGVYVIQGDEKKDILNRYIDSYTIERARLFAAGHPHSNLVHIE
         | |||||||||:||||:|||||||||||||||||||:||||||||||::|||||:||
g585     DNGAREILTEWKNSPVSSAVYVIQGDEKKDILNRYIDNYTIERARLFAANNPHSNLVRIE
                 70         80         90        100        110        120

130        140        150        160        170        180
m585.pep YDRFGEEYLFFTKDWDKLQARRLPSPLLIPGLPLAPIWHELIILSFIIIVGLLMAYILAG
         |||||||||| | ||: ||:||||||:||||||||||||:||||||||||||||||||
g585     YDRFGEEYLFFIKGWDNHQARLPSPLFIPGLPLAPIWHEFIILSFIIIVGLLMAYILAG
                130        140        150        160        170        180

190        200        210        220        230        240
m585.pep NIAKPIRILGNGMDRVANGELETRISQQVDDRDDELSHLAIQFDKMVEKLEKLVAKERHL
         ||||||||||||||||||:  ||| |:  |||  ||||||: :|:||| ||||||
g585     NIAKPIRILGNGMDRVAERELEDRVCQQVRDRDDELADVAMQFDTMVEKLEX
                190        200        210        220        230

250        260        270        280        290        300
m585.pep LHHVSHEMRSPLARMQAIVGLIQAQPQKQEQYLKRLEGELTRMDTLAGELLTLSRLETSN
```

55

The following partial DNA sequence was identified in *N. meningitidis* <SEQ ID 1807>:

```
a585.seq
    1 ATGAAACTGT TCCAACGCAT CTTCGCCACA TTTTGCGCGG TTATCGTCTG

51 TGCAATCTTT GTGGCGAGTT TTTCTTTCTG GCTGGTGCAG AACACCCTTG

101 CCGAAAACCA GTTCAACCAA CGCCGCACCA TCGAAACCAC TTTGATGGGC

151 AGCATCATTT CCGCATTCCG GGCACGCGGG GACGCGGGTG CGCGCGAAAT
```

-continued

```
 201 CCTGACGGAA TGGAAAGACA GCCCCGTCTC ATCGGGCGTG TACGTTATAC

251 AGGGCGACGA GAAAAAAGAT ATCCTGCACC GGTATATCGA CAGCTACACC

301 ATCGAACGCG CCCGGCTTTT CGCCGCCGGA CACCCGCATT CCAACCTCGT

351 CCATATCGAA TACGACCGCT TCGGCGAAGA ATACCTGTTC TTCACCAAAG

401 ACTGGGACAA ACTCCAAGCC CGCCGCCTGC CCAGCCCCCT GTTGATCCCC

451 GGCCTGCCGC TCGCCCCGAT TTGGCACGAA CTCATCATAT TGTCCTTCAT

501 CATCATCGTC GGACTGCTGA TGGCGTACAT CCTCGCCGGC AACATTGCCA

551 AACCCATCAG AATCTTAGGC AACGGCATGG ACAGGGTGGC AAACGGAGAA

601 CTTGAAACCC GTATCTCCCA ACAGGTCGAC GACCGCGACG ACGAATTGTC

651 CCATCTTGCC ATCCAATTCG ACAAAATGGT GGAAAAACTC GAAAAACTCG

701 TTGCCAAAGA ACGCCACCTG CTCCATCACG TCTCCCATGA ATGCGTTCT

751 CCCCTTGCGC GCATGCAGGC AATTGTCGGA CTGATTCAGG CGCAGCCCCA

801 AAAACAGGAG CAATATCTCA AACGGCTGGA AGGCGAACTG AACGGCATGG

851 ATACGCTGGC CGGGGAACTG TTAACCCTGT CCCGTCTCGA AACTTCCAAT

901 ATGGCTTTGG AAAAGAAAG CCTGAAACTC CTGCCCTTCC TGGGCAACCT

951 GGTAGAAGAC AATCAAAGCA TTGCCCAGAA AAACGGACAA ACGGTTACCC

1001 TGTCTGCCGA CGGAAAAATC CCCGAAAACA CAACCATCCT TGCCAACGAA

1051 AGCTACCTGT ACCGCGCCTT CGACAACGTC ATCCGCAACG CCGTCAACTA

1101 CAGTCCCGAA GGCAGCACCA TCCTGATCAA CATCGGACAA GACCACAAAC

1151 ACTGGATAAT CGACGTTACC GACAACGGCC CCGGCGTGGA CGAAATGCAG

1201 CTCCCGCACA TCTTCACCGC TTTCTACCGT GCAGACTCCA GTGCCAACAA

1251 ACCCGGAACA GGACTGGGGC TTGCATTGAC CCAACATATT ATTGAACAGC

1301 ACTGCGGCAA AATCATCGCC GAAAACATCA AACCGAACGG TCTGCGGATG

1351 CGCTTTATCC TGCCCAAGAA AAAACCGGT TCCAAAACAG AAAAAGTGC

1401 GAACTGA
```

This corresponds to the amino acid sequence <SEQ ID 1808; ORF 585.a>:

```
a585.pep

1 MKLFQRIFAT FCAVIVCAIF VASFSFWLVQ NTLAENQFNQ RRTIETTLMG

51 SIISAFRARG DAGAREILTE WKDSPVSSGV YVIQGDEKKD ILHRYIDSYT

101 IERARLFAAG HPHSNLVHIE YDRFGEEYLF FTKDWDKLQA RRLPSPLLIP

151 GLPLAPIWHE LIILSFIIIV GLLMAYILAG NIAKPIRILG NGMDRVANGE

201 LETRISQQVD DRDDELSHLA IQFDKMVEKL EKLVAKERHL LHHVSHEMRS

251 PLARMQAIVG LIQAQPQKQE QYLKRLEGEL TRMDTLAGEL LTLSRLETSN

301 MALEKESLKL LPFLGNLVED NQSIAQKNGQ TVTLSADGKI PENTTILANE

351 SYLYRAFDNV IRNAVNYSPE GSTILINIGQ DHKHWIIDVT DNGPGVDEMQ

401 LPHIFTAFYR ADSSANKPGT GLGLALTQHI IEQHCGKIIA ENIKPNGLRM

451 RFILPKKKTG SKTEKSAN* m585/a585 99.8% identity in 468 aa overlap
```

```
               10         20         30         40         50         60
m585.pep  MKLFQRIFATFCAVIVCAIFVASFSFWLVQNTLAENQFNQRRTIETTLMGSIISAFRARG
          ||||||||||||||||||||||||||||||||||||||||||||||||||||||||||||
a585      MKLFQRIFATFCAVIVCAIFVASFSFWLVQNTLAENQFNQRRTIETTLMGSIISAFRARG
               10         20         30         40         50         60

70         80         90        100        110        120
m585.pep  DAGAREILTEWKDSPVSSGVYVIQGDEKKDILNRYIDSYTIERARLFAAGHPHSNLVHIE
          |||||||||||||||||||||||||||||||||:||||||||||||||||||||||||||
a585      DAGAREILTEWKDSPVSSGVYVIQGDEKKDILHRYIDSYTIERARLFAAGHPHSNLVHIE
               70         80         90        100        110        120

130        140        150        160        170        180
m585.pep  YDRFGEEYLFFTKDWDKLQARRLPSPLLIPGLPLAPIWHELIILSFIIIVGLLMAYILAG
          ||||||||||||||||||||||||||||||||||||||||||||||||||||||||||||
a585      YDRFGEEYLFFTKDWDKLQARRLPSPLLIPGLPLAPIWHELIILSFIIIVGLLMAYILAG
              130        140        150        160        170        180

190        200        210        220        230        240
m585.pep  NIAKPIRILGNGMDRVANGELETRISQQVDDRDDELSHLAIQFDKMVEKLEKLVAKERHL
          ||||||||||||||||||||||||||||||||||||||||||||||||||||||||||||
a585      NIAKPIRILGNGMDRVANGELETRISQQVDDRDDELSHLAIQFDKMVEKLEKLVAKERHL
              190        200        210        220        230        240

250        260        270        280        290        300
m585.pep  LHHVSHEMRSPLARMQAIVGLIQAQPQKQEQYLKRLEGELTRMDTLAGELLTLSRLETSN
          ||||||||||||||||||||||||||||||||||||||||||||||||||||||||||||
a585      LHHVSHEMRSPLARMQAIVGLIQAQPQKQEQYLKRLEGELTRMDTLAGELLTLSRLETSN
              250        260        270        280        290        300

310        320        330        340        350        360
m585.pep  MALEKESLKKLLPFLGNLVEDNQSIAQKNGQTVTLSADGKIPENTTILANESYLYRAFDNV
          ||||||||||||||||||||||||||||||||||||||||||||||||||||||||||||
a585      MALEKESLKKLLPFLGNLVEDNQSIAQKNGQTVTLSADGKIPENTTILANESYLYRAFDNV
              310        320        330        340        350        360

370        380        390        400        410        420
m585.pep  IRNAVNYSPEGSTILINIGQDHKHWIIDVTDNGPGVDEMQLPHIFTAFYRADSSANKPGT
          ||||||||||||||||||||||||||||||||||||||||||||||||||||||||||||
a585      IRNAVNYSPEGSTILINIGQDHKHWIIDVTDNGPGVDEMQLPHIFTAFYRADSSANKPGT
              370        380        390        400        410        420

430        440        450        460    469
m585.pep  GLGLALTQHIIEQHCGKIIAENIKPNGLRMRFILPKKKTGSKTEKSANX
          |||||||||||||||||||||||||||||||||||||||||||||||||
a585      GLGLALTQHIIEQHCGKIIAENIKPNGLRMRFILPKKKTGSKTEKSANX
              430        440        450        460
```

The following partial DNA sequence was identified in *N. gonorrhoeae* <SEQ ID 1809>:

```
g586.seq..
  1 atggcagccc atctcgaaga acaacaagag ttagacaact ttaaatattt 51 ttggaaaacc acgggcaaat ggctgtttgc cctgctgatt ttggcggcac 101 tcggctactt gggatacacg gtttaccaaa accgtgcggc ttcccaaaat 151 caggaagcgg cggcggtgct ggcaaacatc gtggaaaagg cgcaaaacaa 201 agccccgcaa agcgaaatca atgccgaact gtccaaactc caacaaagct 251 accccattc catttccgcc gcccaagcca cgctgatggc ggcggcaacc 301 gaatttgacg cgcagcgtta cgatgttgcc gaaggtcatt tgaaatgggt 351 gttgtccaac caaaaagaca gcctgattca ggcgttggcg gcgcagcgtc 401 tgggcgttgt gttgttgcaa caaaaaaaat acgatgccgc gcttgccgca 451 ctcgacacgc cggttgaggc ggacttcgcc ccctgctga tggaaactaa 501 aggcgatgtt tatgccgcac aggaaaaaag ccaggaagcc ttaaaaaact 551 acggacaggc tttggaaaaa atgcctcaag attctgtcgg tcgcgaattg 601 cttcaaatga aactcgattc gctgaaataa
```

This corresponds to the amino acid sequence <SEQ ID 1810; ORF 586.ng>:

```
g586.pep..
   1 MAAHLEEQQE LDNFKYFWKT TGKWLFALLI LAALGYLGYT VYQNRAASQN

51 QEAAAVLANI VEKAQNKAPQ SEINAELSKL QQSYPHSISA AQATLMAAAT

101 EFDAQRYDVA EGHLKWVLSN QKDSLIQALA AQRLGVVLLQ QKKYDAALAA

151 LDTPVEADFA PLLMETKGDV YAAQEKSQEA LKNYGQALEK MPQDSVGREL

201 LQMKLDSLK*
```

The following partial DNA sequence was identified in *N. meningitidis* <SEQ ID 1811>:

```
m586.seq
   1 ATGGCAGCCC ATCTCGAAGA ACAACAAGAG TTAGACAACT TTAAATATTT

51 TTGGAAAACC ACGGGCAAAT GGCTGTTTGC CTTGCTGATT TTGGCGGCAC

101 TCGGCTACTT GGGATACACG GTTTACCAAA ACCGTAAAGT TTCCCAAAAT

151 CAGGAAGCGG CGGCGGTGCT GGCAAACATC GTAGAAAAGG CGCAAAGCAA

201 AGCCCCGCAA AGCGAAATCA ATGCCGAATT GACCAAACTC CAACAAAGCT

251 ACCCGCATTC CATTTCCGCC GCCCAAGCCA CACTGATGGC GGCGGCAACC

301 GAATTTGACG CGCAGCGTTA CGATGTTGCC GAAGGCCATT TGAAATGGGT

351 GTTGTCCAAC CAAAAAGACA GCCTGATTCA AGCGTTGGCG GCGCAGCGTC

401 TGGGCGTTGT GTTGTTGCAA CAAAAAAAAT ACGATGCCGC GCTTGCCGCG

451 CTCGATACGC CGGTTGAAGC GGACTTCGCC CCCCTGCTGA TGGAAACCAA

501 AGGCGATGTC TATGCCGCAC AGGGAAAAAG CCAGGAAGCC TTAAAAAACT

551 ACGGACAGGC TTTAGAAAAA ATGCCTCAAG ATTCTGTCGG TCGCGAATTG

601 GTTCAAATGA AACTTGATTC GCTGAAATAA
```

This corresponds to the amino acid sequence <SEQ ID 1812; ORF 586>:

```
    m586.pep
         1   MAAHLEEQQE LDNFKYFWKT TGKWLFALLI LAALGYLGYT VYQNRKVSQN

51   QEAAAVLANI VEKAQSKAPQ SEINAELTKL QQSYPHSISA AQATLMAAAT

101   EFDAQRYDVA EGHLKWVLSN QKDSLIQALA AQRLGVVLLQ QKKYDAALAA

151   LDTPVEADFA PLLMETKGDV YAAQGKSQEA LKNYGQALEK MPQDSVGREL

201   VQMKLDSLK* m586/g586    97.1% identity in 209 aa overlap 10         20         30         40         50         60
    m586.pep   MAAHLEEQQELDNFKYFWKTTGKWLFALLILAALGYLGYTVYQNRKVSQNQEAAAVLANI
               ||||||||||||||||||||||||||||||||||||||||||||: |||||||||||||
    g586       MAAHLEEQQELDNFKYFWKTTGKWLFALLILAALGYLGYTVYQNRAASQNQEAAAVLANI
                       10         20         30         40         50         60

70         80         90        100        110        120
    m586.pep   VEKAQSKAPQSEINAELTKLQQSYPHSISAAQATLMAAATEFDAQRYDVAEGHLKWVLSN
               |||||:||||||||||||:|||||||||||||||||||||||||||||||||||||||||
    g586       VEKAQNKAPQSEINAELSKLQQSYPHSISAAQATLMAAATEFDAQRYDVAEGHLKWVLSN
                       70         80         90        100        110        120

130        140        150        160        170        180
    m586.pep   QKDSLIQALAAQRLGVVLLQQKKYDAALAALDTPVEADFAPLLMETKGDVYAAQGKSQEA
               ||||||||||||||||||||||||||||||||||||||||||||||||||||||:||||
    g586       QKDSLIQALAAQRLGVVLLQQKKYDAALAALDTPVEADFAPLLMETKGDVYAAQEKSQEA
                      130        140        150        160        170        180
```

-continued

```
              190         200         210
m586.pep   LKNYGQALEKMPQDSVGRELVQMKLDSLKX
           ||||||||||||||||||||:|||||||||
g586       LKNYGQALEKMPQDSVGRELLQMKLDSLKX
              190         200         210
```

The following partial DNA sequence was identified in *N. meningitidis* <SEQ ID 1813>:

```
a586.seq
  1 ATGGCAGCCC ATTTGGAAGA ACAACAAGAG TTGGACAACT TTAAATATTT

51 TTGGAAAACC ACGGGCAAAT GGCTGTTTGC CGTGCTGATT TTGGCGGCAC

101 TCGGCTACTT GGGATACACG GTTTACCAAA ACCGTGCGGC TTCCCAAAAT

151 CAGGAAGCGG CGGCGGTGCT GGCAAACATC GTGGAAAAGG CGCAAAACAA

201 AGCCCCGCAA AGCGAAATCA ATGCCGAATT GGCCAAGCTC CAACAAAGCT

251 ACCCCCATTC CATTTCCGCC GCCCAAGCCA CGCTGATGGC GGCAGCAACC

301 GAATTTGACG CGCAGCGTTA CGATGTTGCC GAAGGCCATT TGAAATGGGT

351 ATTGTCCAAC CAAAAAGACA GCCTGATCCA GGCGTTGGCG GCGCAGCGTC

401 TGGGCGTTGT GTTGTTGCAA CAAAAAAAAT ACGATGCCGC GCTTGCCGCA

451 CTCGACACGC CGGTTGAAGC GGACTTCGCC CCCCTGCTGA TGGAAACCAA

501 AGGCGATGTC TATGCCGCAC AGGGAAAAAG CCAGGAAGCC TTAAAAAACT

551 ACGGACAGGC TTTAGAAAAA ATGCCTCAAG ATTCTGTCGG TCGCGAATTG

601 GTTCAAATGA AACTTGATTC GCTGAAATAA
```

This corresponds to the amino acid sequence <SEQ ID 1814; ORF 586.a>:

```
a586.pep

1  MAAHLEEQQE LDNFKYFWKT TGKWLFAVLI LAALGYLGYT VYQNRAASQN

51  QEAAAVLANI VEKAQNKAPQ SEINAELAKL QQSYPHSISA AQATLMAAAT

101  EFDAQRYDVA EGHLKWVLSN QKDSLIQALA AQRLGVVLLQ QKKYDAALAA

151  LDTPVEADFA PLLMETKGDV YAAQGKSQEA LKNYGQALEK MPQDSVGREL

201  VQMKLDSLK* m586/a586   97.6% identity in 209 aa overlap 10         20         30         40         50         60
m586.pep   MAAHLEEQQELDNFKYFWKTTGKWLFALLILAALGYLGYTVYQNRKVSQNQEAAAVLANI
           ||||||||||||||||||||||||||||:|||||||||||||||| :||||||||||||
a586       MAAHLEEQQELDNFKYFWKTTGKWLFAVLILAALGYLGYTVYQNRAASQNQEAAAVLANI
                  10         20         30         40         50         60

70         80         90        100        110        120
m586.pep   VEKAQSKAPQSEINAELTKLQQSYPHSISAAQATLMAAATEFDAQRYDVAEGHLKWVLSN
           ||||:|||||||||||||:|||||||||||||||||||||||||||||||||||||||||
a586       VEKAQNKAPQSEINAELAKLQQSYPHSISAAQATLMAAATEFDAQRYDVAEGHLKWVLSN
                  70         80         90        100        110        120

130        140        150        160        170        180
m586.pep   QKDSLIQALAAQRLGVVLLQQKKYDAALAALDTPVEADFAPLLMETKGDVYAAQGKSQEA
           |||||||||||||||||||||||||||||||||||||||||||||||||||||| ||||
a586       QKDSLIQALAAQRLGVVLLQQKKYDAALAALDTPVEADFAPLLMETKGDVYAAQEKSQEA
                 130        140        150        160        170        180

190        200        210
m586.pep   LKNYGQALEKMPQDSVGRELVQMKLDSLKX
           |||||||||||||||||||||||||||||
a586       LKNYGQALEKMPQDSVGRELVQMKLDSLKX
                 190        200        210
```

The following partial DNA sequence was identified in *N. gonorrhoeae* <SEQ ID 1815>:

```
g587.seq..
   1 atgaaacgta tcttttttgcc cgccttgccc gccatcctgc ctttatccgc
  51 ttatgccgac ctgcccttga cgattgaaga cataatgacc gacaagggaa
 101 aatggaaact ggaaacttcc cttacctatc tgaatagcga aaacagccgc
 151 gccgcacttg ccgcaccggt ttacattcaa accggcgcaa cctcgtttat
 201 ccccattccg accgaaattc aagaaaacgg cagcaatacc gatatgctcg
 251 ccggcacgct cggtttgcgc tacggactga ccggcaatac cgacatttac
 301 ggcagcggca gctatctgtg gcacgaagaa cgcaaactcg acggcaacgg
 351 caaaacccgc aacaaacgga tgtccgacat atccgccggc atcagccaca
 401 ccttccttaa agacggcaaa aaccccgccc taatcagctt tcttgaaagc
 451 acggtttacg aaaatcgcg caacaaagcc tcgttaatca aaaaaagggg
 501 gctttgcccc ttttataact taaggataaa ttatgaatat taa
```

This corresponds to the amino acid sequence <SEQ ID 1816; ORF 587.ng>:

```
g587.pep..
   1 MKRIFLPALP AILPLSAYAD LPLTIEDIMT DKGKWKLETS LTYLNSENSR
  51 AALAAPVYIQ TGATSFIPIP TEIQENGSNT DMLAGTLGLR YGLTGNTDIY
 101 GSGSYLWHEE RKLDGNGKTR NKRMSDISAG ISHTFLKDGK NPALISFLES
 151 TVYEKSRNKA SLIKKRGLCP FYNLRINYEY *
```

The following partial DNA sequence was identified in *N. meningitidis* <SEQ ID 1817>:

```
m587.seq..
   1 ATGAAGCGCA TCTTTTTGCC CGCCTTGCCC GCCATCCTGC CTTTATCCAC
  51 TTATGCCGAC CTGCCCTTGA CGATTGAAGA CATAATGACC GACAAGGGAA
 101 AATGGAAACT GGAAACTTCC CTTACCTACC TGAACAGCGA AAACAACCGC
 151 GCCGAACTTG CCGCACCGGT TTACATTCAA ACCGGCGCAA CCTCGTTTAT
 201 CCCCATTCCG ACCGAAATCC AAGAAAACGG CAGCAATACC GATATGCTCG
 251 TCGGCACGCT CGGTTTGCGC TACGGACTGA CCGGGAATAC CGACATTTAC
 301 GGCAGCGGCA GCTATCTGTG GCACGAAGAA CGCAAACTCG ACGGCAACAG
 351 CAAAACCCGC AACAAACGGA TGTCCGACGT ATCCCTCGGC ATCAGCCACA
 401 CTTTCCTTAA AGACGACAAA AACCCCGCCC TAATCAGCTT TCTTGAAAGC
 451 ACGGTTTACG AAAATCGCG CAACAAAGCC TCGTCGGGAA ATCCTGGCT
 501 CATCGGCGCC ACCACCTACA AAGCCATAGA TCCGATTGTC CTTTCCTTCA
 551 CCGCCGCCTA CCGCATCAAC GGCAGCAAAA CCCTTTCAGA CGGCATCCGC
 601 TACAAATCGG GCAACTACCT GCTGCTCAAC CCCAACATCT CATTTGCTGC
 651 CAACGACAGA ATCAGCCTGA CCGGAGGCAT CCAATGGCTG GCAGGCAGC
 701 CCGACCGGAC GGACGGCAAA CGGGAATCCT CCAGAAACAC ATCCACCTAC
 751 GCCCATTTCG GCGCAGGTTT CGGTTTCACC AAAACCACGG CTTTAAACGC
```

-continued

```
801 ATCCGCACGT TCAACGTTT CAGGGCAAAG CAGTTCCGAA CTGAAATTTG

851 GCGTACAGCA TACATTTTAA
```

This corresponds to the amino acid sequence <SEQ ID 1818; ORF 587>:

```
m587.pep..
  1 MKRIFLPALP AILPLSTYAD LPLTIEDIMT DKGKWKLETS LTYLNSENNR

51 AELAAPVYIQ TGATSFIPIP TEIQENGSNT DMLVGTLGLR YGLTGNTDIY

101 GSGSYLWHEE RKLDGNSKTR NKRMSDVSLG ISHTFLKDDK NPALISFLES

151 TVYEKSRNKA SSGKSWLIGA TTYKAIDPIV LSLTAAYRIN GSKTLSDGIR

201 YKSGNYLLLN PNISFAANDR ISLTGGIQWL GRQPDRTDGK RESSRNTSTY

251 AHFGAGFGFT KTTALNASAR FNVSGQSSSE LKFGVQHTF*
```

Computer analysis of this amino acid sequence gave the following results:
Homology with a Predicted ORF from *N. gonorrhoeae*

```
    m587/g587    95.0% identity in 161 aa overlap 10        20        30        40        50        60
       m587.pep  MKRIFLPALPAILPLSTYADLPLTIEDIMTDKGKWKLETSLTYLNSENNRAELAAPVYIQ
                 ||||||||||||||||:|||||||||||||||||||||||||||||:||  ||||||||
       g587      MKRIFLPALPAILPLSAYADLPLTIEDIMTDKGKWKLETSLTYLNSENSRAALAAPVYIQ
                         10        20        30        40        50        60

70        80        90       100       110       120
       m587.pep  TGATSFIPIPTEIQENGSNTDMLVGTLGLRYGLTGNTDIYGSGSYLWHEERKLDGNSKTR
                 |||||||||||||||||||||||:||||||||||||||||||||||||||||||||:|||
       g587      TGATSFIPIPTEIQENGSNTDMLAGTLGLRYGLTGNTDIYGSGSYLWHEERKLDGNGKTR
                         70        80        90       100       110       120

130       140       150       160       170       180
       m587.pep  NKRMSDVSLGISHTFLKDDKNPALISFLESTVYEKSRNKASSGKSWLIGATTYKAIDPIV
                 ||||||:| |||||||||| ||||||||||||||||||||  ||||||||||||||:|||
       g587      NKRMSDISAGISHTFLKDGKNPALISFLESTVYEKSRNKASLIKKRGLCPFYNLRINYEY
                        130       140       150       160       170       180

190       200       210       220       230       240
       m587.pep  LSLTAAYRINGSKTLSDGIRYKSGNYLLLNPNISFAANDRISLTGGIQWLGRQPDRTDGK g587      X
```

The following partial DNA sequence was identified in *N. meningitidis* <SEQ ID 1819>:

```
a587.seq
  1 ATGAAGCGCA TCTTTTTGCC CGCCTTGCCC GCCATCCTGC CTTTATCCGC

51 TTATGCCGAC CTGCCCTTGA CGATTGAAGA CATAATGACC GACAAGGGCA

101 AATGGAAACT GGAAACTTCC CTTACCTACC TGAACAGCGA AAACAACCGC

151 GCCGAACTTG CCGCACCGGT TTACATCCAA ACCGGCGCAA CCTCGTTTAT

201 CCCCATTCCG ACCGAAATCC AAGAAAACGG CAGCAATACC GATATGCTCG

251 TTGGCACGCT CGGTTTGCGC TACGGACTGA CCGGGAATAC CGACATTTAC

301 GGCAGCGGCA GCTATCTGTG GCACGAAGAA CGCAAACTCG ACGGCAACGG

351 CAAAACCCGA AACAAACGGA TGTCCGACGT ATCCCTCGGC ATCAGCCACA

401 CCTTCCTTAA AGACGACAAA AACCCCGCCC TAATCAGCTT TCTTGAAAGC

451 ACGGTTTACG AAAAATCGCG CAACAAAGCC TCGTCGGGAA AATCCTGGCT

501 CATCGGCGCC ACCACCTACA AAGCCATCGA CCCCGTCGTC CTCTCATTGA
```

-continued
```
551 CCGCTGCCTA CCGTATCAAC GGCAGCAAAA CCCTTTCAAG CAACACCAAA

601 TACAAAGCAG GCAATTACTG GATGCTGAAT CCCAATATAT CCTTCGCCGC

651 CAACGACAGA ATCAGCCTCA CGGGCGGCAT CCAATGGCTG GGCAAGCAGC

701 CCGACCGTCT GGACGGCAAA AAAGAATCCG CAAGAAACAC ATCCACCTAT

751 GCCCATTTCG GCGCAGGTTT CGGTTTCACC AAAACCACGG CTTTAAACGC

801 ATCCGCACGT TTCAACGTTT CAGGGCAAAG CAGTTCCGAA CTGAAATTTG

851 GCGTACAGCA TACGTTTTAA
```

This corresponds to the amino acid sequence <SEQ ID 1820; ORF 587.a>:

```
a587.pep

1 MKRIFLPALP AILPLSAYAD LPLTIEDIMT DKGKWKLETS LTYLNSENNR

51 AELAAPVYIQ TGATSFIPIP TEIQENGSNT DMLVGTLGLR YGLTGNTDIY

101 GSGSYLWHEE RKLDGNGKTR NKRMSDVSLG ISHTLFKDDK NPALISFLES

151 TVYEKSRNKA SSGKSWLIGA TTYKAIDPVV LSLTAAYRIN GSKTLSSNTK

201 YKAGNYWMLN PNISFAANDR ISLTGGIQWL GKQPDRLDGK KESARNTSTY

251 AHFGAGFGFT KTTALNASAR FNVSGQSSSE LKFGVQHTF*
```

```
m587/a587    95.2% identity in 289 aa overlap 10        20        30        40        50        60
m587.pep    MKRIFLPALPAILPLSTYADLPLTIEDIMTDKGKWKLETSLTYLNSENNRAELAAPVYIQ
            |||||||||||||||||:||||||||||||||||||||||||||||||||||||||||||
a587        MKRIFLPALPAILPLSAYADLPLTIEDIMTDKGKWKLETSLTYLNSENNRAELAAPVYIQ
                10        20        30        40        50        60

70        80        90       100       110       120
m587.pep    TGATSFIPIPTEIQENGSNTDMLVGTLGLRYGLTGNTDIYGSGSYLWHEERKLDGNSKTR
            ||||||||||||||||||||||||||||||||||||||||||||||||||||||||:|||
a587        TGATSFIPIPTEIQENGSNTDMLVGTLGLRYGLTGNTDIYGSGSYLWHEERKLDGNGKTR
                70        80        90       100       110       120

130       140       150       160       170       180
m587.pep    NKRMSDVSLGISHTFLKDDKNPALISFLESTVYEKSRNKASSGKSWLIGATTYKAIDPIV
            |||||||||||||||||||||||||||||||||||||||||||||||||||||||||||:|
a587        NKRMSDVSLGISHTFLKDDKNPALISFLESTVYEKSRNKASSGKSWLIGATTYKAIDPVV
               130       140       150       160       170       180

190       200       210       220       230       240
m587.pep    LSLTAAYRINGSKTLSDGIRYKSGNYLLLNPNISFAANDRISLTGGIQWLGRQPDRTDGK
            |||||||||||||||::  :||:|||  :||||||||||||||||||||||  :|||  ||
a587        LSLTAAYRINGSKTLSSNTKYKAGNYWMLNPNISFAANDRISLTGGIQWLGKQPDRLDGK
               190       200       210       220       230       240

250       260       270       280       290
m587.pep    RESSRNTSTYAHFGAGFGFTKTTALNASARFNVSGQSSSELKFGVQHTFX
            :||:||||||||||||||||||||||||||||||||||||||||||||||
a587        KESARNTSTYAHFGAGFGFTKTTALNASARFNVSGQSSSELKFGVQHTFX
               190       200       210       220       230
```

The following partial DNA sequence was identified in *N. gonorrhoeae* <SEQ ID 1821>:

```
g588.seq
  1 atgcttaaac atctcgcatt cctactgccc gccatgatgt tcgccctccc 51 cgcccagacc gccgtcctaa gcccctatca ggaaaccggc tgcacctacg 101 aaggcgggat cggaaaagac gggcttcctt caggcaaagg catatggcgt 151 tgccgggatg ggcgcggtta taccggttca ttcaaaaacg gcaaattcga 201 cgggcaaggc gtttataccg ttgccgccgg ccgcgaagta tttctcgagc 251 cgttcaattc cgacagtacc aaattccgca atatggcatt gtcgggcacg
```

```
-continued
301 ttcaaacaag gcttggcaca cggcaggttc gccgcctcgc aaaacggcga 351 aaccctcttt tattatgaaa tgcgaacacg gcatgattaa
```

This corresponds to the amino acid sequence <SEQ ID 1822; ORF 588.ng>:

```
g588.pep..
  1 MLKHLAFLLP AMMFALPAQT AVLSPYQETG CTYEGGIGKD GLPSGKGIWR

51 CRDGRGYTGS FKNGKFDGQG VYTVAAGREV FLEPFNSDST KFRNMALSGT

101 FKQGLAHGRF AASQNGETLF YYEMRTRHD*
```

The following partial DNA sequence was identified in *N. meningitidis* <SEQ ID 1823>:

```
m588.seq..
  1 ATGCTTAAAC ATCTCGCATT CCTACTGCCC GCCATGATGT TCGCCCTCCC

51 CACTTCGGCC GCCGTCCTGA CTTCCTATCA AGAACCAGGC TGCACCTACG

101 ACGGCAATGT CGGCAAAGAC GGTAAACCCG CCGGCAAAGG CACATGGCGC

151 TGCCAAGACG GCGCAACTA TACCGGTTCG TTTAAAAACG GCAAATTCGA

201 CGGGCAAGGC GTTTATACCG TTGCCGCCAA CCGCGAAATA TTTATCGAAC

251 CGTTCAATTC CGACAGTACC AAATTCCGCA ACATGGTACT CTCGGGCACG

301 TTCAAAAAAG GCTTGGCACA CGGCAGATTT ACCGTCTCGC AAAACGGCGA

351 AACCCTCTTC ATTATGAAAT GCGAAAACGG CATGATTAAA GAAGTGAAAC

401 TGCCCAAAAA CAAATAA
```

This corresponds to the amino acid sequence <SEQ ID 1824; ORF 588>:

```
m588.pep..
  1 MLKHLAFLLP AMMFALPTSA AVLTSYQEPG CTYDGNVGKD GKPAGKGTWR

51 CQDGRNYTGS FKNGKFDGQG VYTVAANREI FIEPFNSDST KFRNMVLSGT

101 FKKGLAHGRF TVSQNGETLF IMKCENGMIK EVKLPKNK*
```

Computer analysis of this amino acid sequence gave the following results:
Homology with a Predicted ORF from *N. gonorrhoeae*

```
   m588/g588    82.5% identity in 120 aa overlap 10         20         30         40         50         60
       m588.pep   MLKHLAFLLPAMMFALPTSAAVLTSYQEPGCTYDGNVGKDGKPAGKGTWRCQDGRNYTGS
                  |||||||||||||||||:::|||: ||| ||||:::|||| |:||| |||:|||:||||
       g588       MLKHLAFLLPAMMFALPAQTAVLSPYQETGCTYEGGIGKDGLPSGKGIWRCRDGRGYTGS
                      10         20         30         40         50         60

70         80         90        100        110        120
       m588.pep   FKNGKFDGQGVYTVAANREIFIEPFNSDSTKFRNMVLSGTFKKGLAHGRFTVSQNGETLF
                  ||||||||||||||||:||:|||||||||||||||:||||||:|||||||::||||||||
       g588       FKNGKFDGQGVYTVAAGREVFLEPFNSDSTKFRNMALSGTFKQGLAHGRFAASQNGETLF
                      70         80         90        100        110        120

130        139
       m588.pep   IMKCENGMIKEVKLPKNKX g588       YYEMRTRHDX
                     130
```

The following partial DNA sequence was identified in *N. meningitidis* <SEQ ID 1825>:

```
a588.seq
   1 ATGCTTAAAC ATCTCGCATT CCTACTGCCC GCCATGATGT TCGCCCTCCC

51 CGCCGCGTCC GCCGTTCTGA CTTCCTATCA AGAACCCGGC TGCACCTACG

101 AAGGCGATGT CGGCAAAGAC GGTAAACCCG CCGGCAAAGG CACATGGCGC

151 TGCCAAGACG GCGCAACTA TACCGGTTCG TTTAAAAATG GCAAATTCGA

201 CGGACAAGGC GTTTATACCG TTGCCGCCAA CCGCGAAATA TTTATCGAAC

251 CGTTCAATTC CGACAGTACC AAATTCCGCA ACATGGTACT CTCGGGCACA

301 TTCAAAAAAG GCTTGGCACA CGGCAGATTT ACCGTCTCGC AAAACGGCGA

351 AACCCTCTTC ATTATGAAAT GCGAAAACGG CATGATTAAA GAAGTGAAGC

401 TGCCCAAAAA CAAATAA
```

This corresponds to the amino acid sequence <SEQ ID 1826; ORF 588.a>:

```
a588.pep
    1   MLKHLAFLLP AMMFALPAAS AVLTSYQEPG CTYEGDVGKD GKPAGKGTWR

51   CQDGRNYTGS FKNGKFDGQG VYTVAANREI FIEPFNSDST KFRNMVLSGT

101   FKKGLAHGRF TVSQNGETLF IMKCENGMIK EVKLPKNK* m588/a588    96.4% identity in 138 aa overlap 10         20         30         40         50         60
         m588.pep    MLKHLAFLLPAMMFALPTSAAVLTSYQEPGCTYDGNVGKDGKPAGKGTWRCQDGRNYTGS
                     ||||||||||||||||||:::||||||||||||:|:||||||||||||||||||||||||
         a588        MLKHLAFLLPAMMFALPAASAVLTSYQEPGCTYEGDVGKDGKPAGKGTWRCQDGRNYTGS
                       10         20         30         40         50         60

70         80         90        100        110        120
         m588.pep    FKNGKFDGQGVYTVAANREIFIEPFNSDSTKFRNMVLSGTFKKGLAHGRFTVSQNGETLF
                     ||||||||||||||||||||||:|||||||||||||||||||||||||||||||||||||
         a588        FKNGKFDGQGVYTVAANREIFLEPFNSDSTKFRNMVLSGTFKKGLAHGRFTVSQNGETLF
                       70         80         90        100        110        120

130        139
         m588.pep    IMKCENGMIKEVKLPKNKX
                     |||||||||||||||||||
         a588        IMKCENGMIKEVKLPKNKX
                      130
```

The following partial DNA sequence was identified in *N. gonorrhoeae* <SEQ ID 1827>:

```
g589.seq..
   1  atgcaacaaa aaatccgttt ccaaatcgag gcgatgacct gtcaggcatg 51  tgcttcgcgc attgaaaaag tgttgaacaa aaaagatttt gtcgaatcgg 101  cgggagtgaa ctttgccagt gaggaagcgc aggttacgtt tgacggcagc 151  aaaacctcgg ttgccgacat tgccaaaatc attgagaaaa ccggttacgg 201  cgcgaaggaa aaaacggaag atacattgcc gcaacctgaa gcagaacacc 251  atatcggctg gcggttgtgg cttttgctga ccatcaatat cccgttcctt 301  atcggtatgg tagggatgat gctaaaaggg ctgaattgga cacggcacga 351  ttggatgatt ccgcctgtat ggcagtttgt actggcaagc atagtgcaac 401  tttggctggc aatcccgttt tacaaaagcg cgtgggcaag cattaaaggc 451  gggctggcga atatggacgt actcgttacc atcggcacgg tgtcgattta
```

-continued

```
 501 cctgtattcc gtttatatgc tgttttcag ttcgcatgcg gcgcacggta
 551 tggcgcatgt gtattttgaa gcgggcgtga tggtgatcgg ttttgtgtcg
 601 ctgggtaagt ttttggaaca ccgcaccaaa aaatccagcc tgaacagctt
 651 gggcttactg ctaaaactca cgccgaccca agtcaacgtg caacgcaacg
 701 gcgaatggaa acaactgccc atcgaccaag tgcaaatcgg cgaccttatc
 751 cgcaccaacc acggcgaacg catcgctgcc gacggcatta tcgaaagcgg
 801 cagcggttgg gcggacgaaa gccaccttac cggcgaatcc aatcccgaag
 851 agaaaaaggc gggcggcaaa gtgttggcgg gcgcgctgat gaccgaaggc
 901 agcgtggtgt accgcgccgc gcagctcggc agccaaaccc tgctcggcga
 951 catgatgaac gcgctctctg aagcacaagg cagtaaagca ccgattgcgc
1001 gcgtggccga taaagcggcg gcggtatttg tgccaactgt cgtgggcatc
1051 gcgcttctga cttttatcgt tgcttggctg attaagggcg attggacggt
1101 cgcactgatg cacgccgttg ccgttttggt gattgcctgc ccgtgcgcgc
1151 tcggtctggc gaccccctgcc gcgattatgg tcggcatggg caaagcggtg
1201 aaacacggca tttggtttaa agacgcggcg gcaatggagg aagcagccca
1251 cgtcgatgcc gtcgtattgg acaaaaccgg tacgctgacc gaaggcaggc
1301 cgcaggttgc cgccgtttat tacgttcccg cagcggctt tgacgaagac
1351 gctttgtacc gcatcgccgc cgccgtcgag caaaacgccg cccacccgct
1401 cgcccgcgcc atcgtctccg ccgcacaagc gcgcggtttg gagattcccg
1451 ctgcacaaaa tgcgcaaacc gttgtcggag caggcattac cgccgaagtg
1501 gaaggcgtgg gtttggtgaa atcaggcaaa gccgaatttg ccgaactgac
1551 cttgccgaag ttttcagacg gcgtttggga atcgccagt gcggttaccg
1601 tatctgtaaa cggcaaaccg atcggcgcat cgcactctc cgacgcgttg
1651 aaagccgata ccgccgaagc cataggccgt ctgaaaaaac acaatatcga
1701 tgtctatatt atgagcggcg ataaccaaag tacggtcgaa tacgtcgcca
1751 aacaactggg catcgcacac gccttcggta atatgagtcc gtgcgacaaa
1801 gccgccgaag tgcagaaact caaagccgcc ggcaaaaccg tggcgatggt
1851 cggcgacggc atcaacgacg cgcccgcgct tgccgccgcc aacgtcagct
1901 tcgccatgaa aggcggtgcg gacgttgccg aacacaccgc ctccgccacg
1951 ctgatgcagc attcggtcaa tcagctcgcc gatgccctgc tgatatcgca
2001 ggcaacgttg gaaaacatca agcaaaacct atttttcgcc ttcttctaca
2051 atatattggg cattccgctc gccgcgctcg gcttttaaa tcccgtcata
2101 gcaggcgcgg caatggcggc aagctcggtt tcggtattgg caatgccct
2151 gcgcctgaaa tgggtaaaaa tcgattga
```

This corresponds to the amino acid sequence <SEQ ID 1828; ORF 589.ng>:

```
g589.pep..
  1 MQQKIRFQIE AMTCQACASR IEKVLNKKDF VESAGVNFAS EEAQVTFDGS
 51 KTSVADIAKI IEKTGYGAKE KTEDTLPQPE AEHHIGWRLW LLLTINIPFL
101 IGMVGMMLKG LNWTRHDWMI PPVWQFVLAS IVQLWLAIPF YKSAWASIKG
```

-continued

```
151 GLANMDVLVT IGTVSIYLYS VYMLFFSSHA AHGMAHVYFE AGVMVIGFVS

201 LGKFLEHRTK KSSLNSLGLL LKLTPTQVNV QRNGEWKQLP IDQVQIGDLI

251 RTNHGERIAA DGIIESGSGW ADESHLTGES NPEEKKAGGK VLAGALMTEG

301 SVVYRAAQLG SQTLLGDMMN ALSEAQGSKA PIARVADKAA AVFVPTVVGI

351 ALLTFIVAWL IKGDWTVALM HAVAVLVIAC PCALGLATPA AIMVGMGKAV

401 KHGIWFKDAA AMEEAAHVDA VVLDKTGTLT EGRPQVAAVY YVPDSGFDED

451 ALYRIAAAVE QNAAHPLARA IVSAAQARGL EIPAAQNAQT VVGAGITAEV

501 EGVGLVKSGK AEFAELTLPK FSDGVWEIAS AVTVSVNGKP IGAFALSDAL

551 KADTAEAIGR LKKHNIDVYI MSGDNQSTVE YVAKQLGIAH AFGNMSPCDK

601 AAEVQKLKAA GKTVAMVGDG INDAPALAAA NVSFAMKGGA DVAEHTASAT

651 LMQHSVNQLA DALLISQATL ENIKQNLFFA FFYNILGIPL AALGFLNPVI

701 AGAAMAASSV SVLGNALRLK WVKID*
```

The following partial DNA sequence was identified in *N. meningitidis* <SEQ ID 1829>:

```
m589.seq..
   1 ATGCAACAAA AAATCCGTTT CCAAATCGAA GGCATGACCT GCCAGGCCTG

51 CGCTTCGCGC ATTGAAAAAG TGTTGAACAA AAAAGATTTT GTCGAATCGG

101 CGGGGGTAAA CTTCGCCAGC GAAGAGGCGC AGGTAGTGTT TGACGACAGC

151 AAAACCTCAG TAGCCGACAT TGCCAAAATC ATTGAGAAAA CCGGTTACGG

201 CGCGAAGGAA AAAACGGAAG ATACATTGCC GCAACCCGAA GCAGAACACC

251 ATATCGGCTG GCGGCTGTGG CTGCTGTTCA CCATCAACGT CCCGTTCCTT

301 ATCGGCATGG CGGGGATGAT GATCGGCAGA CACGATTGGA TGATTCCGCC

351 GTTGTGGCAG TTCGCATTGG CAAGCGTGGT GCAGCTTTGG CTGGCAATCC

401 CGTTTTACAA AAGCGCGTGG GCGAGCATTA AGGGCGGACT GGCGAATATG

451 GACGTGCTGG TTACCATCGG CACGGTCTCG ATTTACCTGT ATTCCGTCTA

501 TATGCTGTTT TTCAGCCCGC ACGCGGCGTA CGGTATGGCG CATGTGTATT

551 TTGAAGTGGG CGTGATGGTG ATCGGTTTTG TGTCACTGGG TAAATTTTTG

601 GAACACCGTA CCAAAAAATC CAGCCTCAAC AGCTTGGGCT TGCTGCTCAA

651 ACTTACACCA ACCCAAGTCA ACGTGCAACG CAACGGCGAA TGGAAACAGC

701 TTCCCATCGA CCAAGTGCAA ATCGGCGACC TTATCCGCGC CAACCACGGC

751 GAACGCATTG CCGCAGACGG CATCATTGAA AGCGGCAGCG GTTGGGCGGA

801 CGAGAGCCAT CTTACCGGCG AATCCAATCC TGAAGAAAAA AAGGCGGGCG

851 GCAAAGTGTT GGCGGGCGCG TTAATGACCG AAGGCAGTGT GGTGTACCGC

901 GCCACGCAGC TCGGCAGCCA AACCCAGCTC GGCGACATGA TGAACGCGCT

951 CTCTGAAGCA CAAGGCAGTA AAGCACCGAT TGCGCGCGTA GCCGATAAAG

1001 CGGCTGCGGT ATTCGTGCCT GCCGTCGTGG GCATTGCGTT GTTGACTTTT

1051 ATTGTTACTT GGCTGATTAA GGGCGATTGG ACGGTTGCGC TGATGCACGC

1101 CGTCGCCGTT TTGGTGATTG CCTGCCCGTG CGCGCTGGGT CTGGCAACCC

1151 CTGCCGCGAT TATGGTCGGT ATGGGCAAAG CGGTTAAACA CGGTATTTGG

1201 TTTAAAGACG CGGCAGCAAT GGAGGAAGCC GCCCACGTCG ATGCCGTCGT
```

```
                              -continued
1251 GTTGGACAAA ACCGGTACGC TGACCGAAGG CAGCCCGCAG GTTGCCGCCG

1301 TTTATTGCGT TCCCGACAGC GGCTTTGACG AAGACGCTTT GTACCGCATC

1351 GCCGCCGCCG TCGAACAAAA CGCCGCCCAT CCGCTCGCCC GTGCCATCGT

1401 CTCCGCCGCC CAAGCGCGCG GTTTGGACAT TCCCGCCGCA CAAAACGCAC

1451 AAACCGTTGT CGGCGCAGGC ATTACCGCCG AAGTGGAAGG CGTGGGTTTG

1501 GTGAAAGCAG GCAAAGCCGA ATTTGCCGAA CTGGCCTTGC CGAAGTTTTT

1551 AGACGGCGTT TGGGATATTG CAAGCATTGT TGCGGTCTCA GTCGATAACA

1601 AACCCATCGG CGCATTCGCA CTTGCCGACG CGTTGAAAGC CGATACCGCC

1651 GAAGCCATAG GCCGTCTGAA AAAACACAAT ATCGATGTCT ATATTATGAG

1701 CGGCGACAAC CAAGGCACGG TCGAATACGT CGCCAAACAA CTGGGCATCG

1751 CACACGCCTT CGGCAACATG AGTCCGCGCG ATAAAGCTGC CGAAGTGCAA

1801 AAACTCAAAG CCGCCGGCAA AACCGTGGCG ATGGTCGGCG ACGGCATCAA

1851 CGACGCGCCC GCGCTTGCCG CCGCTAACGT CAGCTTCGCC ATGAAAGGCG

1901 GAGCGGACGT TGCCGAACAT ACCGCATCCG CCACGCTGAT GCAGCATTCG

1951 GTCAACCAAC TCGCCGATGC TCTGCTGGTG TCGCAAGCCA CTTTGAAAAA

2001 CATCAAGCAA AACCTGTTTT TCGCCTTCTT CTACAATATT TTGGGCATTC

2051 CTCTCGCCGC GCTTGGCTTT TTAAATCCCG TCATCGCTGG CGCGGCAATG

2101 GCGGCAAGCT CGGTTTCCGT GTTGAGCAAT GCCTTGCGCC TGAAACGGGT

2151 AAAAATCGAT TAG
```

This corresponds to the amino acid sequence <SEQ ID 1830; ORF 589>:

```
m589.pep..
   1 MQQKIRFQIE GMTCQACASR IEKVLNKKDF VESAGVNFAS EEAQVVFDDS

51 KTSVADIAKI IEKTGYGAKE KTEDTLPQPE AEHHIGWRLW LLFTINVPFL

101 IGMAGMMIGR HDWMIPPLWQ FALASVVQLW LAIPFYKSAW ASIKGGLANM

151 DVLVTIGTVS IYLYSVYMLF FSPHAAYGMA HVYFEVGVMV IGFVSLGKFL

201 EHRTKKSSLN SLGLLLKLTP TQVNVQRNGE WKQLPIDQVQ IGDLIRANHG

251 ERIAADGIIE SGSGWADESH LTGESNPEEK KAGGKVLAGA LMTEGSVVYR

301 ATQLGSQTQL GDMMNALSEA QGSKAPIARV ADKAAAVFVP AVVGIALLTF

351 IVTWLIKGDW TVALMHAVAV LVIACPCALG LATPAAIMVG MGKAVKHGIW

401 FKDAAAMEEA AHVDAVVLDK TGTLTEGSPQ VAAVYCVPDS GFDEDALYRI

451 AAAVEQNAAH PLARAIVSAA QARGLDIPAA QNAQTVVGAG ITAEVEGVGL

501 VKAGKAEFAE LALPKFLDGV WDIASIVAVS VDNKPIGAFA LADALKADTA

551 EAIGRLKKHN IDVYIMSGDN QGTVEYVAKQ LGIAHAFGNM SPRDKAAEVQ

601 KLKAAGKTVA MVGDGINDAP ALAAANVSFA MKGGADVAEH TASATLMQHS

651 VNQLADALLV SQATLKNIKQ NLFFAFFYNI LGIPLAALGF LNPVIAGAAM

701 AASSVSVLSN ALRLKRVKID *
```

Computer analysis of this amino acid sequence gave the following results:
Homology with a Predicted ORF from N. gonorrhoeae

```
m589/g589 94.2% identity in 725 aa overlap 10        20        30        40        50        60
m589.pep  MQQKIRFQIEGMTCQACASRIEKVLNKKDFVESAGVNFASEEAQVVFDDSKTSVADIAKI
          ||||||||||:||||||||||||||||||||||||||||||||||:||  |||||||||
g589      MQQKIRFQIEAMTCQACASRIEKVLNKKDFVESAGVNFASEEAQVTFDGSKTSVADIAKI
                 10        20        30        40        50        60

70        80        90       100         1       110
m589.pep  IEKTGYGAKEKTEDTLPQPEAEHHIGWRLWLLFTINVPFLIGMAGMMIG-----RHDWMI
          |||||||||||||||||||||||||||||||:|||:|||||||:|||:     |||||
g589      IEKTGYGAKEKTEDTLPQPEAEHHIGWRLWLLLTINIPFLIGMVGMMLKGLNWTRHDWMI
                 70        80        90       100       110       120

120       130       140       150       160       170
m589.pep  PPLWQFALASVVQLWLAIPFYKSAWASIKGGLANMDVLVTIGTVSIYLYSVYMLFFSPHA
          ||:|||:||||:||||||||||||||||||||||||||||||||||||||||||||| ||
g589      PPVWQFVLASIVQLWLAIPFYKSAWASIKGGLANMDVLVTIGTVSIYLYSVYMLFFSSHA
                130       140       150       160       170       180

180       190       200       210       220       230
m589.pep  AYGMAHVYFEVGVMVIGFVSLGKFLEHRTKKSSLNSLGLLLKLTPTQVNVQRNGEWKQLP
          |:||||||||:|||||||||||||||||||||||||||||||||||||||||||||||
g589      AHGMAHVYFEAGVMVIGFVSLGKFLEHRTKKSSLNSLGLLLKLTPTQVNVQRNGEWKQLP
                190       200       210       220       230       240

240       250       260       270       280       290
m589.pep  IDQVQIGDLIRANHGERIAADGIIESGSGWADESHLTGESNPEEKKAGGKVLAGALMTEG
          ||||||||||||:|||||||||||||||||||||||||||||||||||||||||||||
g589      IDQVQIGDLIRTNHGERIAADGIIESGSGWADESHLTGESNPEEKKAGGKVLAGALMTEG
                250       260       270       280       290       300

300       310       320       330       340       350
m589.pep  SVVYRATQLGSQTQLGDMMNALSEAQGSKAPIARVADKAAAVFVPAVVGIALLTFIVTWL
          ||||||:|||||| ||||||||||||||||||||||||||||||:|||||||||||:||
g589      SVVYRAAQLGSQTLLGDMMNALSEAQGSKAPIARVADKAAAVFVPTVVGIALLTFIVAWL
                310       320       330       340       350       360

360       370       380       390       400       410
m589.pep  IKGDWTVALMHAVAVLVIACPCALGLATPAAIMVGMGKAVKHGIWFKDAAAMEEAAHVDA
          ||||||||||||||||||||||||||||||||||||||||||||||||||||||||||
g589      IKGDWTVALMHAVAVLVIACPCALGLATPAAIMVGMGKAVKHGIWFKDAAAMEEAAHVDA
                370       380       390       400       410       420

420       430       440       450       460       470
m589.pep  VVLDKTGTLTEGSPQVAAVYCVPDSGFDEDALYRIAAAVEQNAAHPLARAIVSAAQARGL
          ||||||||||||| ||||||| ||||||||||||||||||||||||||||||||||||
g589      VVLDKTGTLTEGRPQVAAVYYVPDSGFDEDALYRIAAAVEQNAAHPLARAIVSAAQARGL
                430       440       450       460       470       480

480       490       500       510       520       530
m589.pep  DIPAAQNAQTVVGAGITAEVEGVGLVKAGKAEFAELALPKFLDGVWDIASIVAVSVDNKP
          :|||||||||:|||||||||||||||:||||||||| |||| |||| ||| |:|||::||
g589      EIPAAQNAQTVVGAGITAEVEGVGLVKSGKAEFAELTLPKFSDGVWEIASAVTVSVNGKP
                490       500       510       520       530       540

540       550       560       570       580       590
m589.pep  IGAFALADALKADTAEAIGRLKKHNIDVYIMSGDNQGTVEYVAKQLGIAHAFGNMSPRDK
          ||||||:|||||||||||||||||||||||||||||:|||||||||||||||||||| ||
g589      IGAFALSDALKADTAEAIGRLKKHNIDVYIMSGDNQSTVEYVAKQLGIAHAFGNMSPCDK
                550       560       570       580       590       600

600       610       620       630       640       650
m589.pep  AAEVQKLKAAGKTVAMVGDGINDAPALAAANVSFAMKGGADVAEHTASATLMQHSVNQLA
          ||||||||||||||||||||||||||||||||||||||||||||||||||||||||||
g589      AAEVQKLKAAGKTVAMVGDGINDAPALAAANVSFAMKGGADVAEHTASATLMQHSVNQLA
                610       620       630       640       650       660

660       670       680       690       700       710
m589.pep  DALLVSQATLKNIKQNLFFAFFYNILGIPLAALGFLNPVIAGAAMAASSVSVLSNALRLK
          ||||:|||||:||||||||||||||||||||||||||||||||||||||||:||||||
g589      DALLISQATLENIKQNLFFAFFYNILGIPLAALGFLNPVIAGAAMAASSVSVLGNALRLK
                670       680       690       700       710       720

720
m589.pep  RVKIDX
          |||||
g589      WVKIDX
```

60

The following partial DNA sequence was identified in N. meningitidis <SEQ ID 1831>:

```
a589.seq
  1    ATGCAACAAA AAGTCCGTTT CCAAATCGAA GGCATGACCT GCCAGGCATG
```

-continued

```
  51 TGCTTCGCGC ATTGAAAAAG TGTTGAACAA AAAAGATTTT GTCGAATCGG
 101 CGGGGGTAAA CTTCGCCAGC GAAGAGGCTC AGGTAGTGTT TGACGACAGC
 151 AAAACCTCAG TAGCCGACAT TGCCAAAATC ATTGAGAAAA CCGGTTACGG
 201 CGCGAAGGAA AAAACGGAAG ATACATTGCC GCAACCCGAA GCAGAACACC
 251 ATATCGGCTG GAGGTTGTGG CTTTTGCTGG CCATCAATAT CCCGTTCCTT
 301 ATCGGTATGG TAGGGATGAT GCTAAAAGGG CTGAATTGGA CACGGCATGA
 351 TTGGATGTTG TCGCCCTTGT TGCAGTTTGC ATTGGCGAGT GTGGTGCAGC
 401 TTTGGCTGGC GGTGCCATTT TACAAAAGCG CGTGGGCGAG CATTAAAGGC
 451 GGGCTGGCGA ATATGGACGT ACTCGTTACC ATCGGCACGG TCTCGATTTA
 501 CCTGTATTCC GTCTATATGC TGTTTTTCAG CCCGCACGCG GCGTACGGTA
 551 TGGCGCATGT GTATTTTGAA GTAGGCATAA TGGTGATTGG TTTTGTGTCA
 601 CTGGGTAAAT TTTTGGAACA CCGCACCAAA AAATCCAGCC TGAACAGCTT
 651 GGGCTTGCTG CTCAAACTCA CGCCAACCCA AGTCAACGTG CAACGCGATG
 701 GCGAATGGCG GCAGCTACCC ATCGACCAAG TGCAAATCGG CGACCTAATC
 751 CGCGCCAATC ACGGCGAACG CATTGCCGCC GACGGCATCA TAGAAAGCGG
 801 CAGCGGCTGG GCGGACGAAA GCCATCTTAC CGGCGAATCC AATCCCGAAG
 851 AGAAAAAGGC AGGCGGCAAA GTATTGGCGG GCGCGCTGAT GACTGAAGGC
 901 AGCGTGGTGT ACCGCGCCGC GCAGCTCGGC AGCCAAACCC TGCTCGGCGA
 951 CATGATGAAC GCGCTCTCCG AAGCGCAAGG CAGTAAAGCA CCGATTGCGC
1001 GTGTGGCGGA CAAGGCGGCG GCGGTATTCG TGCCTGCCGT TGTGGGCATC
1051 GCACTTTTGA CTTTTATCGC TACTTGGCTG ATTAAGGGCG ATTGGACGCT
1101 CGCATTGATG CACGCCGTCG CCGTTTTGGT GATTGCCTGC CCGTGTGCAC
1151 TCGGTTTGGC AACCCCTGCT GCGATTATGG TCGGTATGGG CAAAGCGGTT
1201 AAACACGGTA TTTGGTTTAA AGACGCGGCA GCAATGGAAG AAGCCGCCCA
1251 CGTTGATGCC GTCGTGCTGG ACAAAACCGG CACGCTGACC GAAGGCAAGC
1301 CGCAGGTTGC CGCCGTTTAT TGTGTTCCCG ACAGCGGCTT TGACGAAGAC
1351 GCTTTGTACC GCATCGCCGC CGCCGTCGAA CAAAACGCCG CCCATCCGCT
1401 CGCCCGTGCC ATCGTCTCCG CCGCCCAGGC GCGCGGTTTG GAGATTCCCA
1451 CCGCACAAAA TGCCCAAACC ATTGTCGGCG CGGGCATTAC CGCCGAAGTA
1501 AAAGGCGCGG GTTTGGTAAA AGCAGGCAAA GCCGAATTTG CCGAACTGAC
1551 CTTGCCGAAG TTTTCAGACG GCGTTTGGGA AATCGCCAGT GTGGTTGCCG
1601 TATCTGTAAA CGGCAAACCT ATCGGCGCAT TCGCACTCGC CGACGCGTTG
1651 AAAGCCGATA CCGCCGAAGC CATAGGCCGT CTGAAAAAAC ACAATATCGA
1701 TGTCTATATT ATGAGCGGCG ATAACCAAGG CACGGTCGAG TACGTCGCCA
1751 AACAACTGGG CATCGCACAC GCCTTCGGTA ATATGAGTCC GCGCGACAAA
1801 GCCGCCGAAG TGCAGAAACT CAAAGCCGCC GGCAAAACCG TGGCGATGGT
1851 CGGCGACGGC ATCAACGACG CGCCCGCGCT CGCCGCCGCC AACGTCAGCT
1901 TCGCCATGAA AGGCGGTGCA GACGTTGCCG AACACACCGC ATCCGCCACA
1951 CTGATGCAGC ATTCGGTCAA CCAGCTCGCC GATGCGCTAT CGGTATCGCG
2001 AGCGACGTTG AAAAACATCA AGCAAAACCT GTTTTTCGCC TTCTTCTACA
```

-continued

```
2051 ATATTTTGGG CATTCCGCTC GCCGCGCTCG GCTTTTTAAA CCCCGTCATC

2101 GCAGGCGCGG CAATGGCGGC AAGCTCGGTT TCCGTGTTGA GCAACGCCTT

2151 GCGCCTGAAA CGGGTAAAAA TCGATTGA
```

This corresponds to the amino acid sequence <SEQ ID 1832; ORF 589.a>:

```
a589.pep

1 MQQKVRFQIE GMTCQACASR IEKVLNKKDF VESAGVNFAS EEAQVVFDDS

51 KTSVADIAKI IEKTGYGAKE KTEDTLPQPE AEHHIGWRLW LLLAINIPFL

101 IGMVGMMLKG LNWTRHDWML SPLLQFALAS VVQLWLAVPF YKSAWASIKG

151 GLANMDVLVT IGTVSIYLYS VYMLFFSPHA AYGMAHVYFE VGIMVIGFVS

201 LGKFLEHRTK KSSLNSLGLL LKLTPTQVNV QRDGEWRQLP IDQVQIGDLI

251 RANHGERIAA DGIIESGSGW ADESHLTGES NPEEKKAGGK VLAGALMTEG

301 SVVYRAAQLG SQTLLGDMMN ALSEAQGSKA PIARVADKAA AVFVPAVVGI

351 ALLTFIATWL IKGDWTLALM HAVAVLVIAC PCALGLATPA AIMVGMGKAV

401 KHGIWFKDAA AMEEAAHVDA VVLDKTGTLT EGKPQVAAVY CVPDSGFDED

451 ALYRIAAAVE QNAAHPLARA IVSAAQARGL EIPTAQNAQT IVGAGITAEV

501 KGAGLVKAGK AEFAELTLPK FSDGVWEIAS VVAVSVNGKP IGAFALADAL

551 KADTAEAIGR LKKHNIDVYI MSGDNQGTVE YVAKQLGIAH AFGNMSPRDK

601 AAEVQKLKAA GKTVAMVGDG INDAPALAAA NVSFAMKGGA DVAEHTASAT

651 LMQHSVNQLA DALSVSRATL KNIKQNLFFA FFYNILGIPL AALGFLNPVI

701 AGAAMAASSV SVLSNALRLK RVKID*
```

```
m589/a589 94.9% identity in 725 aa overlap 10        20        30        40        50        60
m589.pep MQQKIRFQIEGMTCQACASRIEKVLNKKDFVESAGVNFASEEAQVVFDDSKTSVADIAKI
         ||||:|||||||||||||||||||||||||||||||||||||||||||||||||||||||
a589     MQQKVRFQIEGMTCQACASRIEKVLNKKDFVESAGVNFASEEAQVVFDDSKTSVADIAKI
              10        20        30        40        50        60

70        80        90       100          1       110
m589.pep IEKTGYGAKEKTEDTLPQPEAEHHIGWRLWLLFTINVPFLIGMAGMMIG-----RHDWMI
         ||||||||||||||||||||||||||||||||::||:||||||:|||      ||||:
a589     IEKTGYGAKEKTEDTLPQPEAEHHIGWRLWLLLAINIPFLIGMVGMMLKGLNWTRHDWML
              70        80        90       100       110       120

120       130       140       150       160       170
m589.pep PPLWQFALASVVQLWLAIPFYKSAWASIKGGLANMDVLVTIGTVSIYLYSVYMLFFSPHA
         ||  |||||||||||||:||||||||||||||||||||||||||||||||||||||||||
a589     SPLLQFALASVVQLWLAVPFYKSAWASIKGGLANMDVLVTIGTVSIYLYSVYMLFFSPHA
             130       140       150       160       170       180

180       190       200       210       220       230
m589.pep AYGMAHVYFEVGVMVIGFVSLGKFLEHRTKKSSLNSLGLLLKLTPTQVNVQRNGEWKQLP
         ||||||||||:|||||||||||||||||||||||||||||||||||||||:|||:|||
a589     AYGMAHVYFEVGIMVIGFVSLGKFLEHRTKKSSLNSLGLLLKLTPTQVNVQRDGEWRQLP
             190       200       210       220       230       240

240       250       260       270       280       290
m589.pep IDQVQIGDLIRANHGERIAADGIIESGSGWADESHLTGESNPEEKKAGGKVLAGALMTEG
         ||||||||||||||||||||||||||||||||||||||||||||||||||||||||||||
a589     IDQVQIGDLIRANHGERIAADGIIESGSGWADESHLTGESNPEEKKAGGKVLAGALMTEG
             250       260       270       280       290       300

300       310       320       330       340       350
m589.pep SVVYRATQLGSQTQLGDMMNALSEAQGSKAPIARVADKAAAVFVPAVVGIALLTFIVTWL
         ||||||:||||||:||||||||||||||||||||||||||||||||||||||||||:|||
a589     SVVYRAAQLGSQTLLGDMMNALSEAQGSKAPIARVADKAAAVFVPAVVGIALLTFIATWL
             310       320       330       340       350       360

360       370       380       390       400       410
m589.pep IKGDWTVALMHAVAVLVIACPCALGLATPAAIMVGMGKAVKHGIWFKDAAAMEEAAHVDA
         ||||||:|||||||||||||||||||||||||||||||||||||||||||||||||||||
a589     IKGDWTLALMHAVAVLVIACPCALGLATPAAIMVGMGKAVKHGIWFKDAAAMEEAAHVDA
             370       380       390       400       410       420
```

```
               420       430       440       450       460       470
m589.pep  VVLDKTGTLTEGSPQVAAVYCVPDSGFDEDALYRIAAAVEQNAAHPLARAIVSAAQARGL
          ||||||||||:||||||||||||||||||||||||||||||||||||||||||||||||
a589      VVLDKTGTLTEGKPQVAAVYCVPDSGFDEDALYRIAAAVEQNAAHPLARAIVSAAQARGL
               430       440       450       460       470       480

480       490       500       510       520       530
m589.pep  DIPAAQNAQTVVGAGITAEVEGVGLVKAGKAEFAELALPKFLDGVWDIASIVAVSVDNKP
          :||:|||||||||||||:|:||||||||||||||||:||| ||||:|||||||||::||
a589      EIPTAQNAQTIVGAGITAEVKGAGLVKAGKAEFAELTLPKFSDGVWEIASVVAVSVNGKP
               490       500       510       520       530       540

540       550       560       570       580       590
m589.pep  IGAFALADALKADTAEAIGRLKKHNIDVYIMSGDNQGTVEYVAKQLGIAHAFGNMSPRDK
          ||||||||||||||||||||||||||||||||||||||||||||||||||||||||||||
a589      IGAFALADALKADTAEAIGRLKKHNIDVYIMSGDNQGTVEYVAKQLGIAHAFGNMSPRDK
               550       560       570       580       590       600

600       610       620       630       640       650
m589.pep  AAEVQKLKAAGKTVAMVGDGINDAPALAAANVSFAMKGGADVAEHTASATLMQHSVNQLA
          ||||||||||||||||||||||||||||||||||||||||||||||||||||||||||||
a589      AAEVQKLKAAGKTVAMVGDGINDAPALAAANVSFAMKGGADVAEHTASATLMQHSVNQLA
               610       620       630       640       650       660

660       670       680       690       700       710
m589.pep  DALLVSQATLKNIKQNLFFAFFYNILGIPLAALGFLNPVIAGAAMAASSVSVLSNALRLK
          |||  ||:||||||||||||||||||||||||||||||||||||||||||||||||||||
a589      DALSVSRATLKNIKQNLFFAFFYNILGIPLAALGFLNPVIAGAAMAASSVSVLSNALRLK
               670       680       690       700       710       720

720
m589.pep  RVKIDX
          ||||||
a589      RVKIDX
```

The following partial DNA sequence was identified in *N. gonorrhoeae* <SEQ ID 1833>:

```
g590.seq..
    1 atgaaaaaac ctttgatttc agttgcggca gtattgctcg gcgttgcttt
   51 gggtacacct tattatttgg gtgtcaaagc agaagaaagt ctgacgcagc
  101 agcaaaaaat attgcagaaa acgggctttt tgaccgtcga atcgcaccag
  151 tatgatcgag gctggtttac ctctacggaa acgacggtca tccgtctgaa
  201 acccgagttg ctgcataatg cgcagaaata cctgccggat aacttgaaaa
  251 tagtgttgga acagccggtt acgctggtaa accatatcac gcacggccct
  301 ttcgccggcg gattcggcac gcaggcgcac attgaaaccg agttcaaata
  351 cgcgcctgaa acggaaaaag tttttggaacg cttttttggg aaacaagttc
  401 cggtttccct tgccaatacc gtttatttca acggcagcgg taaaatggaa
  451 gtcagtgttc ccgctttcga ttatgaagaa ctgtcgggca tcaggctgca
  501 ctgggaaggc ctgacggggg aaacggttta tcaaaaaggt ttcaaaagct
  551 accgcaacag ctatgatgcg cccttgttca aaatcaagct ggcagacaaa
  601 ggcgatgccg cgtttgaaaa agcgcatttc gattcggaaa cttcagacgg
  651 catcaatccg cttgctttgg gcagcagcaa tctgactttg gaaaaatttt
  701 cgctcgaatg gaaagagggt gtcgattaca acgtcaaatt gaacgaactg
  751 gtcaacctcg ttaccgattt gcagatcggc gcgtttatca atcccaacgg
  801 cagcatcgca ccttccaaaa tcgaagtcgg caagctggct tttcaacca
  851 agaccgggga atcgggcgcg tttatcgaca gcgaagggcg gttccgtttc
  901 gatacgttgg tgtacggcga tgaaaaatac ggcccgctgg acatccatat
  951 cgctgccgaa cacctcgatg cttctgcctt aaccgtattg aaacgcaagt
 1001 ttgcacaaat ttctgccaaa aaaatgactg aggaacaaat ccgcaatgat
 1051 ttgattgcgg cagtcaaagg cgatgcttcc ggattattta cccatgaccc
```

```
1101  ggtactaaat atcaaaattt tccgtttcac cctgcctcag ggaaaaattg 1151  atgtgggcgg aaaaatcatg tttaaaggca tgaagaagga agatttgaac 1201  caattgggac tgatgttaaa gaaaaccgag gcaaacatca gaatgagtat 1251  tcctcaaaaa atgttggaag atttggcggt aagtcaggct ggaaatattt 1301  tcagtgtaaa tgccgaagat gaggcggaag ccagagcaag cattgccgat 1351  attaatgaaa cattgcgcct gatggtggac agtacggtcc aaagtatggc 1401  aagggaaaaa tatcttactt tagacggtaa tcagattgat acggtcattt 1451  cccttaaaaa caacgccctg aagttaaacg ggaaaacgct gcaaaatgaa 1501  cccgatcctg attttgacga gggagatatg gtttccggcc agccgcatta 1551  a
```

This corresponds to the amino acid sequence <SEQ ID 1834; ORF 590.ng>:

```
g590.pep..
  1 MKKPLISVAA VLLGVALGTP YYLGVKAEES LTQQQKILQK TGFLTVESHQ

51 YDRGWFTSTE TTVIRLKPEL LHNAQKYLPD NLKIVLEQPV TLVNHITHGP

101 FAGGFGTQAH IETEFKYAPE TEKVLERFFG KQVPVSLANT VYFNGSGKME

151 VSVPAFDYEE LSGIRLHWEG LTGETVYQKG FKSYRNSYDA PLFKIKLADK

201 GDAAFEKAHF DSETSDGINP LALGSSNLTL EKFSLEWKEG VDYNVKLNEL

251 VNLVTDLQIG AFINPNGSIA PSKIEVGKLA FSTKTGESGA FIDSEGRFRF

301 DTLVYGDEKY GPLDIHIAAE HLDASALTVL KRKFAQISAK KMTEEQIRND

351 LIAAVKGDAS GLFTHDPVLN IKIFRFTLPQ GKIDVGGKIM FKGMKKEDLN

401 QLGLMLKKTE ANIRMSIPQK MLEDLAVSQA GNIFSVNAED EAEARASIAD

451 INETLRLMVD STVQSMAREK YLTLDGNQID TVISLKNNAL KLNGKTLQNE

501 PDPDFDEGDM VSGQPH*
```

The following partial DNA sequence was identified in *N. meningitidis* <SEQ ID 1835>:

```
m590.seq (partial) ..
  1 ..TGGTTTACCT CTATGGAAAC GACGGTCATC CGTCTGAAAC CCGAGTTGCT

51    GAATAATGCC CGAAAATACC TGCCGGATAA CCTGAAAACA GTGTTGGAAC

101    AGCCGGTTAC GCTGGTTAAC CATATCACGC ACGGCCCTTT CGCCGGCGGA

151    TTCGGCACGC AGGCGTACAT TGAAACCGAG TTCAAATACG CGCCTGAAAC

201    GGAAAAAGTT CTGGAACGCT TTTTTGGAAA ACAAGTCCCG GCTTCCCTTG

251    CCAATACCGT TTATTTTAAC GGCAGCGGTA AAATGGAAGT CAGTGTTCCC

301    GCCTTCGATT ATGAAGAGCT GTCGGGCATc AG.CTGCACT GGGAAkGCCT

351    GACGGGAGAA ACGGTTTATC AAAAAGGTTT CAAAAGCTAC CGGAACGGCT

401    ATGATGCCCC CTTGTTTAAA ATCAAGCTGG CAGACAAAGG CGATGCCGCG

451    TTTGAAAAAG TGCATTTCGA TTCGGAAACT TCAGACGGCA TCAATCCGCT

501    TGCTTTGGGC AGCAGCAATC TGACCTTGGA AAAATTCTCC CTAGAATGGA

551    AAGAGGGTGT CGATTACAAC GTCAAGTTAA ACGAACTGGT CAATCTTGTT

601    ACCGATTTGC AGATTGGCGC GTTTATCAAT CCCAACGGCA GCATCGCACC
```

```
 651  TTCCAAAATC GAAGTCGGCA AACTGGCTTT TCAACCAAG ACCGGGGAAT

701  CAGGCGCGTT TATCAACAGT GAAGGGCAGT TCCGTTTCGA TACACTGGTG

751  TACGGCGATG AAAAATACGG CCCGCTGGAC ATCCATATCG CTGCCGAACA

801  CCTCGATGCT TCTGCCTTAA CCGTATTGAA ACGCAAGTTT GCACAAATTT

851  CCGCCAAAAA AATGACCGAG GAACAAATCC GCAATGATTT GATTGCCGCC

901  GTCAAAGGAG AGGCTTCCGG ACTGTTCACC AACAATCCCG TATTGGACAT

951  TAAAACTTTC CGATTCACGC TGCCATCGGG AAAAATCGAT GTGGGCGGAA

1001  AAATCATGTT TAAAGACATG AAGAAGGAAG ATTTGAATCA ATTGGGTTTG

1051  ATGCTGAAGA AAACCGAAGC CGACATCAGA ATGAGTATTC CCCAAAAAAT

1101  GCTGGAAGAC TTGGCGGTCA GTCAAGCAGG CAATATTTTC AGCGTCAATG

1151  CCGAAGATGA GGCGGAAGGC AGGGCAAGTC TTGACGACAT CAACGAGACC

1201  TTGCGCCTGA TGGTGGACAG TACGGTTCAG AGTATGGCAA GGGAAAAATA

1251  TCTGACTTTG AACGGCGACC AGATTGATAC TGCCATTTCT CTGAAAAACA

1301  ATCAGTTGAA ATTGAACGGT AAAACGTTGC AAAACGAACC GGAGCCGGAT

1351  TTTGATGAAG GCGGTATGGT TTCAGAGCCG CAGCAGTAA
```

This corresponds to the amino acid sequence <SEQ ID 1836; ORF 590>:

```
m590.pep..(partial)

1  ..WFTSMETTVI RLKPELLNNA RKYLPDNLKT VLEQPVTLVN HITHGPFAGG

51    FGTQAYIETE FKYAPETEKV LERFFGKQVP ASLANTVYFN GSGKMEVSVP

101    AFDYEELSGI XLHWEXLTGE TVYQKGFKSY RNGYDAPLFK IKLADKGDAA

151    FEKVHFDSET SDGINPLALG SSNLTLEKFS LEWKEGVDYN VKLNELVNLV

201    TDLQIGAFIN PNGSIAPSKI EVGKLAFSTK TGESGAFINS EGQFRFDTLV

251    YGDEKYGPLD IHIAAEHLDA SALTVLKRKF AQISAKKMTE EQIRNDLIAA

301    VKGEASGLFT NNPVLDIKTF RFTLPSGKID VGGKIMFKDM KKEDLNQLGL

351    MLKKTEADIR MISPQKMLED LAVSQAGNIF SVNAEDEAEG RASLDDINET

401    LRLMVDSTVQ SMAREKYLTL NGDQIDTAIS LKNNQLKLNG KTLQNEPEPD

451    FDEGGMVSEP QQ* m590/g590 93.1% identity in 462 aa overlap
                                    10         20         30
 m590.pep                            WFTSMETTVIRLKPELLNNARKYLPDNLKT
                                     ||||  |||||||||||||:||:|||||||
 g590      VKAEESLTQQQKILQKTGFLTVESHQYDRGWFTSTETTVIRLKPELLHNAQKYLPDNLKI
              30         40         50         60         70         80

40         50         60         70         80         90
 m590.pep  VLEQPVTLVNHITHGPFAGGFGTQAYIETEFKYAPETEKVLERFFGKQVPASLANTVYFN
           ||||||||||||||||||||||||||:|||||||||||||||||||||:|||||||||
 g590      VLEQPVTLVNHITHGPFAGGFGTQAHIETEFKYAPETEKVLERFFGKQVPVSLANTVYFN
              90        100        110        120        130        140

100        110        120        130        140        150
 m590.pep  GSGKMEVSVPAFDYEELSGIXLHWEXLTGETVYQKGFKSYRNGYDAPLFKIKLADKGDAA
           ||||||||||||||||||||  ||||   ||||||||||||||:||||||||||||||||
 g590      GSGKMEVSVPAFDYEELSGIRLHWEGLTGETVYQKGFKSYRNSYDAPLFKIKLADKGDAA
              150        160        170        180        190        200

160        170        180        190        200        210
 m590.pep  FEKVHFDSETSDGINPLALGSSNLTLEKFSLEWKEGVDYNVKLNELVNLVTDLQIGAFIN
           |||:||||||||||||||||||||||||||||||||||||||||||||||||||||||||
 g590      FEKAHFDSETSDGINPLALGSSNLTLEKFSLEWKEGVDYNVKLNELVNLVTDLQIGAFIN
              210        220        230        240        250        260
```

-continued

```
                220       230       240       250       260       270
m590.pep PNGSIAPSKIEVGKLAFSTKTGESGAFINSEGQFRFDTLVYGDEKYGPLDIHIAAEHLDA
         ||||||||||||||||||||||||||||:|||:|||||||||||||||||||||||||||
g590     PNGSIAPSKIEVGKLAFSTKTGESGAFIDSEGRFRFDTLVYGDEKYGPLDIHIAAEHLDA
            270       280       290       300       310       320

280       290       300       310       320       330
m590.pep SALTVLKRKFAQISAKKMTEEQIRNDLIAAVKGEASGLFTNNPVLDIKTFRFTLPSGKID
         |||||||||||||||||||||||||||||||||:||||||::|||:|| ||||||:||||
g590     SALTVLKRKFAQISAKKMTEEQIRNDLIAAVKGDASGLFTHDPVLNIKIFRFTLPQGKID
            330       340       350       360       370       380

340       350       360       370       380       390
m590.pep VGGKIMFKDMKKEDLNQLGLMLKKTEADIRMSIPQKMLEDLAVSQAGNIFSVNAEDEAEG
         |||||||| ||||||||||||||||||:|||||||||||||||||||||||||||||||:
g590     VGGKIMFKGMKKEDLNQLGLMLKKTEANIRMSIPQKMLEDLAVSQAGNIFSVNAEDEAEA
            390       400       410       420       430       440

400       410       420       430       440       450
m590.pep RASLDDINETLRLMVDSTVQSMAREKYLTLNGDQIDTAISLKNNQLKLNGKTLQNEPEPD
         |||: |||||||||||||||||||||||||:|:||||:|||||| ||||||||||||:||
g590     RASIADINETLRLMVDSTVQSMAREKYLTLDGNQIDTVISLKNNALKLNGKTLQNEPDPD
            450       460       470       480       490       500

460
m590.pep FDEGGMVS-EPQQX
         |||| ||| :|:
g590     FDEGDMVSGQPHX
            510
```

The following partial DNA sequence was identified in *N. meningitidis* <SEQ ID 1837>:

```
a590.seq
   1 ATGAAAAAAC CTTTGATTTC GGTTGCGGCA GCATTGCTCG GCGTTGCTTT

51 GGGCACGCCT TATTATTTGG GTGTCAAAGC CGAAGAAAGC TTGACGCAGC

101 AGCAAAAAAT ATTGCAGGAA GCGGGCTTCT TGACCGTCGA ATCGCACCAA

151 TATGAGCGCG GCTGGTTTAC CTCTACGGAA ACGACGGTCA TCCGCTTGAA

201 ACCCGAGTTG CTGCATAATG CGCAGAAATA CCTGCCGGAT AACCTGAAAA

251 CAGTGTTGGA ACAGCCGGTT ACGCTGGTAA ACCATATCAC GCACGGTCCT

301 TTTGCCGGCG GATTCGGCAC GCAGGCGTAC ATTGAAACCG AGTTCAAATA

351 CGCGCCTGAA ACGGAAAAAG TTCTGGAACG CTTTTTTGGA AAACAAGTCC

401 CGGTTTCCCT TGCCAATACC GTTTATTTTA ACGGCAGCGG TAAAATGGAA

451 GTCAGTGTTC CCGCCTTCGA TTATGAAGAG CTGTCGGGCA TCAGGCTGCA

501 CTGGGAAGGC CTGACGGGAG AAACGGTTTA TCAAAAAGGT TTCAAAAGCT

551 ACCGGAACGG CTATGATGCC CCCTTGTTTA AAATCAAGCT GGCAGACAAA

601 GGCGATGCCG CGTTTGAAAA AGTGCATTTC GATTCGGAAA CTTCAGACGG

651 CATCAACCCG CTTGCTTTGG GCAGCAGCAA TCTGACCTTG GAAAAATTTT

701 CCTTAGAATG GAAAGAGGGT GTCGATTACA ACGTCAAGTT AAACGAACTG

751 GTCAATCTTG TTACCGATTT GCAGATTGGC GCGTTTATCA ATCCCAACGG

801 CAGCATCGCA CCTTCCAAAA TCGAAGTCGG CAAGCTGGCT TTTTCAACCA

851 AGACCGGGGA ATCGGGCGCG TTTATCGATA GCGAAGGGCA GTTCCGTTTT

901 GGCACGCTGG TTTACGGCGA TGAAAAATAC GGCCCTCTGG ACATCCATAT

951 CGCTGCCGAA CACCTCGATG CTTCTGCCTT AACCGTATTG AAACGCAAGT

1001 TTGCACGAAT TTCTGCCAAA AAAATGACTG AAGAACAAAT CCGCAATGAT

1051 TTGATTGCGG CAGTCAAAGG CGAGGCTTCC GGATTATTTA CCCATAACCC

1101 AGTATTGGAC ATTAAAACTT TCCGATTCAC GCTGCCATCG GGAAAAATCG

1151 ATGTGGGCGG AAAAATCATG TTTAAAGACA TGAAGAAGGA AGATTTGAAC
```

```
-continued
1201 CAATTGGGTT TGATGCTGAA GAAAACCGAA GCCGACATCA GAATGAGTAT

1251 TCCCCAAAAA ATGCTGGAAG ACTTGGCGGT CAGTCAAGCA GGCAATATTT

1301 TCAGCGTCAA TGCCGAAGAT GAGGCGGAAG GCAGGGCAAG TCTTGACGAC

1351 ATCAACGAGA CCTTGCGCCT GATGGTGGAC AGTACGGTTC AGAGTATGGC

1401 AAGGGAAAAA TATCTGACTT TGAACGGCGA CCAGATTGAT ACTGCCATTT

1451 CTCTGAAAAA CAATCAGTTG AAATTGAACG GTAAAACGTT GCAAAACGAA

1501 CCGGAGCCGG ATTTTGATGA AGGCGGTATG GTTTCAGAGC CGCAGCAGTA

1551 A
```

This corresponds to the amino acid sequence <SEQ ID 1838; ORF 590.a>:

```
a590.pep

1 MKKPLISVAA ALLGVALGTP YYLGVKAEES LTQQQKILQE AGFLTVESHQ

51 YERGWFTSTE TTVIRLKPEL LHNAQKYLPD NLKTVLEQPV TLVNHITHGP

101 FAGGFGTQAY IETEFKYAPE TEKVLERFFG KQVPVSLANT VYFNGSGKME

151 VSVPAFDYEE LSGIRLHWEG LTGETVYQKG FKSYRNGYDA PLFKIKLADK

201 GDAAFEKVHF DSETSDGINP LALGSSNLTL EKFSLEWKEG VDYNVKLNEL

251 VNLVTDLQIG AFINPNGSIA PSKIEVGKLA FSTKTGESGA FIDSEGQFRF

301 GTLVYGDEKY GPLDIHIAAE HLDASALTVL KRKFARISAK KMTEEQIRND

351 LIAAVKGEAS GLFTHNPVLD IKTFRFTLPS GKIDVGGKIM FKDMKKEDLN

401 QLGLMLKKTE ADIRMSIPQK MLEDLAVSQA GNIFSVNAED EAEGRASLDD

451 INETLRLMVD STVQSMAREK YLTLNGDQID TAISLKNNQL KLNGKTLQNE

501 PEPDFDEGGM VSEPQQ* m590/a590 97.8% identity in 462 aa overlap 10         20         30
m590.pep                     WFTSMETTVIRLKPELLNNARKYLPDNLKT
                             ||||  |||||||||||| :||:||||||||
a590      VKAEESLTQQQKILQEAGFLTVESHQYERGWFTSTETTVIRLKPELLHNAQKYLPDNLKT
               30        40        50        60        70        80

40        50        60        70        80        90
m590.pep  VLEQPVTLVNHITHGPFAGGFGTQAYIETEFKYAPETEKVLERFFGKQVPASLANTVYFN
          ||||||||||||||||||||||||||||||||||||||||||||||||||:|||||||||
a590      VLEQPVTLVNHITHGPFAGGFGTQAYIETEFKYAPETEKVLERFFGKQVPVSLANTVYFN
               90       100       110       120       130       140

100       110       120       130       140       150
m590.pep  GSGKMEVSVPAFDYEELSGIXLHWEXLTGETVYQKGFKSYRNGYDAPLFKIKLADKGDAA
          |||||||||||||||||||| |||| ||||||||||||||||||||||||||||||||||
a590      GSGKMEVSVPAFDYEELSGIRLHWEGLTGETVYQKGFKSYRNGYDAPLFKIKLADKGDAA
              150       160       170       180       190       200

160       170       180       190       200       210
m590.pep  FEKVHFDSETSDGINPLALGSSNLTLEKFSLEWKEGVDYNVKLNELVNLVTDLQIGAFIN
          ||||||||||||||||||||||||||||||||||||||:|||||||||||||||||||||
a590      FEKVHFDSETSDGINPLALGSSNLTLEKFSLEWKEGVDYNVKLNELVNLVTDLQIGAFIN
              210       220       230       240       250       260

220       230       240       250       260       270
m590.pep  PNGSIAPSKIEVGKLAFSTKTGESGAFINSEGQFRFDTLVYGDEKYGPLDIHIAAEHLDA
          ||||||||||||||||||||||||||||:||||||| |||||||||||||||||||||||
a590      PNGSIAPSKIEVGKLAFSTKTGESGAFIDSEGQFRFGTLVYGDEKYGPLDIHIAAEHLDA
              270       280       290       300       310       320

280       290       300       310       320       330
m590.pep  SALTVLKRKFAQISAKKMTEEQIRNDLIAAVKGEASGLFTNNPVLDIKTFRFTLPSGKID
          ||||||||||:|||||||||||||||||||||||||||||:|||||||||||||||||||
a590      SALTVLKRKFARISAKKMTEEQIRNDLIAAVKGEASGLFTHNPVLDIKTFRFTLPSGKID
              330       340       350       360       370       380
```

```
                  340        350        360        370        380        390
m590.pep VGGKIMFKDMKKEDLNQLGLMLKKTEADIRMSIPQKMLEDLAVSQAGNIFSVNAEDEAEG
         ||||||||||||||||||||||||||||||||||||||||||||||||||||||||||||
a590     VGGKIMFKDMKKEDLNQLGLMLKKTEADIRMSIPQKMLEDLAVSQAGNIFSVNAEDEAEG
                  390        400        410        420        430        440

400        410        420        430        440        450
m590.pep RASLDDINETLRLMVDSTVQSMAREKYLTLNGDQIDTAISLKNNQLKLNGKTLQNEPEPD
         ||||||||||||||||||||||||||||||||||||||||||||||||||||||||||||
a590     RASLDDINETLRLMVDSTVQSMAREKYLTLNGDQIDTAISLKNNQLKLNGKTLQNEPEPD
                  450        460        470        480        490        500

460
m590.pep FDEGGMVSEPQQX
         |||||||||||||
g590     FDEGGMVSEPQQX
                  510
```

The following partial DNA sequence was identified in *N. meningitidis* <SEQ ID 1839>:

```
m590-1.seq
    1 ATGAAAAAAC CTTTGATTTC GGTTGCGGCA GCATTGCTCG GCGTTGCTTT

51 GGGCACGCCT TATTATTTGG GTGTCAAAGC CGAAGAAAGC TTGACGCAGC

101 AGCAAAAAAT ATTGCAGGAA ACGGGCTTCT TGACCGTCGA ATCGCACCAA

151 TATGAGCGCG GCTGGTTTAC CTCTATGGAA ACGACGGTCA TCCGTCTGAA

201 ACCCGAGTTG CTGAATAATG CCCGAAAATA CCTGCCGGAT AACCTGAAAA

251 CAGTGTTGGA ACAGCCGGTT ACGCTGGTTA ACCATATCAC GCACGGCCCT

301 TTCGCCGGCG GATTCGGCAC GCAGGCGTAC ATTGAAACCG AGTTCAAATA

351 CGCGCCTGAA ACGGAAAAAG TTCTGGAACG CTTTTTTGGA AAACAAGTCC

401 CGGCTTCCCT TGCCAATACC GTTTATTTTA ACGGCAGCGG TAAAATGGAA

451 GTCAGTGTTC CCGCCTTCGA TTATGAAGAG CTGTCGGGCA TCAGGCTGCA

501 CTGGGAAGGC CTGACGGGAG AAACGGTTTA TCAAAAGGT TTCAAAAGCT

551 ACCGGAACGG CTATGATGCC CCCTTGTTTA AAATCAAGCT GGCAGACAAA

601 GGCGATGCCG CGTTTGAAAA AGTGCATTTC GATTCGGAAA CTTCAGACGG

651 CATCAATCCG CTTGCTTTGG GCAGCAGCAA TCTGACCTTG GAAAAATTCT

701 CCCTAGAATG GAAAGAGGGT GTCGATTACA ACGTCAAGTT AAACGAACTG

751 GTCAATCTTG TTACCGATTT GCAGATTGGC GCGTTTATCA ATCCCAACGG

801 CAGCATCGCA CCTTCCAAAA TCGAAGTCGG CAAACTGGCT TTTTCAACCA

851 AGACCGGGGA ATCAGGCGCG TTTATCAACA GTGAAGGGCA GTTCCGTTTC

901 GATACACTGG TGTACGGCGA TGAAAAATAC GGCCCGCTGG ACATCCATAT

951 CGCTGCCGAA CACCTCGATG CTTCTGCCTT AACCGTATTG AAACGCAAGT

1001 TTGCACAAAT TTCCGCCAAA AAAATGACCG AGGAACAAAT CCGCAATGAT

1051 TTGATTGCCG CCGTCAAAGG AGAGGCTTCC GGACTGTTCA CCAACAATCC

1101 CGTATTGGAC ATTAAAACTT CCGATTCAC GCTGCCATCG GAAAAATCG

1151 ATGTGGGCGG AAAAATCATG TTTAAAGACA TGAAGAAGGA AGATTTGAAT

1201 CAATTGGGTT TGATGCTGAA GAAAACCGAA GCCGACATCA GAATGAGTAT

1251 TCCCCAAAAA ATGCTGGAAG ACTTGGCGGT CAGTCAAGCA GGCAATATTT

1301 TCAGCGTCAA TGCCGAAGAT GAGGCGGAAG GCAGGGCAAG TCTTGACGAC

1351 ATCAACGAGA CCTTGCGCCT GATGGTGGAC AGTACGGTTC AGAGTATGGC

1401 AAGGGAAAAA TATCTGACTT TGAACGGCGA CCAGATTGAT ACTGCCATTT
```

```
1451 CTCTGAAAAA CAATCAGTTG AAATTGAACG GTAAAACGTT GCAAAACGAA

1501 CCGGAGCCGG ATTTTGATGA AGGCGGTATG GTTTCAGAGC CGCAGCAGTA

1551 A
```

This corresponds to the amino acid sequence <SEQ ID 1840; ORF 590-1>:

```
m590-1.pep

1  MKKPLISVAA ALLGVALGTP YYLGVKAEES LTQQQKILQE TGFLTVESHQ

51  YERGWFTSME TTVIRLKPEL LNNARKYLPD NLKTVLEQPV TLVNHITHGP

101  FAGGFGTQAY IETEFKYAPE TEKVLERFFG KQVPASLANT VYFNGSGKME

151  VSVPAFDYEE LSGIRLHWEG LTGETVYQKG FKSYRNGYDA PLFKIKLADK

201  GDAAFEKVHF DSETSDGINP LALGSSNLTL EKFSLEWKEG VDYNVKLNEL

251  VNLVTDLQIG AFINPNGSIA PSKIEVGKLA FSTKTGESGA FINSEGQFRF

301  DTLVYGDEKY GPLDIHIAAE HLDASALTVL KRKFAQISAK KMTEEQIRND

351  LIAAVKGEAS GLFTNNPVLD IKTFRFTLPS GKIDVGGKIM FKDMKKEDLN

401  QLGLMLKKTE ADIRMSIPQK MLEDLAVSQA GNIFSVNAED EAEGRASLDD

451  INETLRLMVD STVQSMAREK YLTLNGDQID TAISLKNNQL KLNGKTLQNE

501  PEPDFDEGGM VSEPQQ* m590-1/g590     93.6% identity in 516 aa overlap 10         20         30         40         50         60
m590-1.pep  MKKPLISVAAALLGVALGTPYYLGVKAEESLTQQQKILQETGFLTVESHQYERGWFTSME
            ||||||||||:|||||||||||||||||||||||||||:|||||||||||:||||||| |
g590        MKKPLISVAAVLLGVALGTPYYLGVKAEESLTQQQKILQKTGFLTVESHQYDRGWFTSTE
                    10         20         30         40         50         60

70         80         90        100        110        120
m590-1.pep  TTVIRLKPELLNNARKYLPDNLKTVLEQPVTLVNHITHGPFAGGFGTQAYIETEFKYAPE
            |||||||||||:||:||||||||:||||||||||||||||||||||||||::||||||||
g590        TTVIRLKPELLHNAQKYLPDNLKIVLEQPVTLVNHITHGPFAGGFGTQAHIETEFKYAPE
                    70         80         90        100        110        120

130        140        150        160        170        180
m590-1.pep  TEKVLERFFGKQVPASLANTVYFNGSGKMEVSVPAFDYEELSGIRLHWEGLTGETVYQKG
            ||||||||||||||:|||||||||||||||||||||||||||||||||||||||||||||
g590        TEKVLERFFGKQVPVSLANTVYFNGSGKMEVSVPAFDYEELSGIRLHWEGLTGETVYQKG
                   130        140        150        160        170        180

190        200        210        220        230        240
m590-1.pep  FKSYRNGYDAPLFKIKLADKGDAAFEKVHFDSETSDGINPLALGSSNLTLEKFSLEWKEG
            ||||||:||||||||||||||||||||:||||||||||||||||||||||||||||||||
g590        FKSYRNSYDAPLFKIKLADKGDAAFEKAHFDSETSDGINPLALGSSNLTLEKFSLEWKEG
                   190        200        210        220        230        240

250        260        270        280        290        300
m590-1.pep  VDYNVKLNELVNLVTDLQIGAFINPNGSIAPSKIEVGKLAFSTKTGESGAFINSEGQFRF
            ||||||||||||||||||||||||||||||||||||||||||||||||||:|||:|||
g590        VDYNVKLNELVNLVTDLQIGAFINPNGSIAPSKIEVGKLAFSTKTGESGAFIDSEGRFRF
                   250        260        270        280        290        300

310        320        330        340        350        360
m590-1.pep  DTLVYGDEKYGPLDIHIAAEHLDASALTVLKRKFAQISAKKMTEEQIRNDLIAAVKGEAS
            |||||||||||||||||||||||||||||||||||||||||||||||||||||||||:||
g590        DTLVYGDEKYGPLDIHIAAEHLDASALTVLKRKFAQISAKKMTEEQIRNDLIAAVKGDAS
                   310        320        330        340        350        360

370        380        390        400        410        420
m590-1.pep  GLFTNNPVLDIKTFRFTLPSGKIDVGGKIMFKDMKKEDLNQLGLMLKKTEADIRMSIPQK
            |||::|||:||  |||||||:|||||||||||:|||||||||||||||||||:|||||||
g590        GLFTHDPVLNIKIFRFTLPQGKIDVGGKIMFKGMKKEDLNQLGLMLKKTEANIRMSIPQK
                   370        380        390        400        410        420

430        440        450        460        470        480
m590-1.pep  MLEDLAVSQAGNIFSVNAEDEAEGRASLDDINETLRLMVDSTVQSMAREKYLTLNGDQID
            ||||||||||||||||||||||:|||: |||||||||||||||||||||||||:|:|||
g590        MLEDLAVSQAGNIFSVNAEDEAEARASIADINETLRLMVDSTVQSMAREKYLTLDGNQID
                   430        440        450        460        470        480
```

```
                     490        500         510
m590-1.pep  TAISLKNNQLKLNGKTLQNEPEPDFDEGGMVS-EPQQX
            |:||||||  ||||||||||||:||||||  |||  :|:
g590        TVISLKNNALKLNGKTLQNEPDPDFDEGDMVSGQPHX
                     490        500         510 a590/m590-1  98.3% identity in 516 aa overlap 10         20         30         40         50         60
a590.pep    MKKPLISVAAALLGVALGTPYYLGVKAEESLTQQQKILQEAGFLTVESHQYERGWFTSTE
            ||||||||||||||||||||||||||||||||||||||:|||||||||||||||||||:
m590-1      MKKPLISVAAALLGVALGTPYYLGVKAEESLTQQQKILQETGFLTVESHQYERGWFTSME
                    10         20         30         40         50         60

70         80         90        100        110        120
a590.pep    TTVIRLKPELLHNAQKYLPDNLKTVLEQPVTLVNHITHGPFAGGFGTQAYIETEFKYAPE
            ||||||||||||:||:||||||||||||||||||||||||||||||||||||||||||||
m590-1      TTVIRLKPELLNNARKYLPDNLKTVLEQPVTLVNHITHGPFAGGFGTQAYIETEFKYAPE
                    70         80         90        100        110        120

130        140        150        160        170        180
a590.pep    TEKVLERFFGKQVPVSLANTVYFNGSGKMEVSVPAFDYEELSGIRLHWEGLTGETVYQKG
            |||||||||||||||:||||||||||||||||||||||||||||||||||||||||||||
m590-1      TEKVLERFFGKQVPASLANTVYFNGSGKMEVSVPAFDYEELSGIRLHWEGLTGETVYQKG
                   130        140        150        160        170        180

190        200        210        220        230        240
a590.pep    FKSYRNGYDAPLFKIKLADKGDAAFEKVHFDSETSDGINPLALGSSNLTLEKFSLEWKEG
            ||||||||||||||||||||||||||||||||||||||||||||||||||||||||||||
m590-1      FKSYRNGYDAPLFKIKLADKGDAAFEKVHFDSETSDGINPLALGSSNLTLEKFSLEWKEG
                   190        200        210        220        230        240

250        260        270        280        290        300
a590.pep    VDYNVKLNELVNLVTDLQIGAFINPNGSIAPSKIEVGKLAFSTKTGESGAFIDSEGQPRF
            |||||||||||||||||||||||||||||||||||||||||||||||||||:|||||||
m590-1      VDYNVKLNELVNLVTDLQIGAFINPNGSIAPSKIEVGKLAFSTKTGESGAFINSEGQPRF
                   250        260        270        280        290        300

310        320        330        340        350        360
a590.pep    GTLVYGDEKYGPLDIHIAAEHLDASALTVLKRKFARISAKKMTEEQIRNDLIAAVKGEAS
             |||||||||||||||||||||||||||||||:|||||||||||||||||||||||||||
m590-1      DTLVYGDEKYGPLDIHIAAEHLDASALTVLKRKFAQISAKKMTEEQIRNDLIAAVKGEAS
                   310        320        330        340        350        360

370        380        390        400        410        420
a590.pep    GLFTHNPVLDIKTFRFTLPSGKIDVGGKIMFKDMKKEDLNQLGLMLKKTEADIRMSIPQK
            ||||:|||||||||||||||||||||||||||||||||||||||||||||||||||||||
m590-1      GLFTNNPVLDIKTFRFTLPSGKIDVGGKIMFKDMKKEDLNQLGLMLKKTEADIRMSIPQK
                   370        380        390        400        410        420

430        440        450        460        470        480
a590.pep    MLEDLAVSQAGNIFSVNAEDEAEGRASLDDINETLRLMVDSTVQSMAREKYLTLNGDQID
            ||||||||||||||||||||||||||||||||||||||||||||||||||||||||||||
m590-1      MLEDLAVSQAGNIFSVNAEDEAEGRASLDDINETLRLMVDSTVQSMAREKYLTLNGDQID
                   430        440        450        460        470        480

490        500        510
a590.pep    TAISLKNNQLKLNGKTLQNEPEPDFDEGGMVSEPQQX
            |||||||||||||||||||||||||||||||||||||
m590-1      TAISLKNNQLKLNGKTLQNEPEPDFDEGGMVSEPQQX
                   490        500        510
```

The following partial DNA sequence was identified in *N. gonorrhoeae* <SEQ ID 1841>:

```
g591.seq
  1 TTGCAAACCC TTCTAGCTTT TATCTTCGCC ATCCTGATTT TGGTCAGCCT

51 GCACGAATTC GGACACTACA TCGTCGCCAG GTTGTGCGGC GTCAAGGTTG

101 TGCGTTTTTC CGTCGGCTTC GGCAAACCGT TTTTCACCCG AAAGCGCGGC

151 GACACCGAAT GGTGCCTCGC CCCGATTCCG TTGGGCGGCT ACGTCAAAAT

201 GGTCGATACG CGCGAAGGCG AAGTATCAGA AGCCGATTTA CCCTACGCTT

251 TTGACAAACA ACACCCCGCC AAGCGCATCG CCATCGTCGC CGCCGGTCCG

301 CTGACCAACC TCGCActggc ggTTTTGCTG TACGGACTGa gctTttcctt 351 cggcgtaaCC GAACTGCGGC CCtatgtcgg cacagtcgaA cccgacaccg 401 ttgccgCCCG CACCGGCTTC caaagcggcg acaaAATACa atccgtcaac 451 ggcgtTtccg tCCAAGACTG GAGCAGCGCG CAAACCGAAA TCGTcctcAA
```

-continued

```
 501 CCTCGAAGCC Ggcaaagtcg ccgtcggcgT TCAGACGGCA TCGGGCGCGC

551 AAACCGTCCG CACCAtcgAT GCCGCAGGCA CGCCGGAAGC CGGTAAAATC

601 GCAAAAAACC AAGGCTACAT CGGACTGATG CCCTTTAAAA TCACAACCGT

651 TGCCGGCGGC GTGGAAAAAG GCAGCCCCGC CGAAAAAGCA GGCCTGAAAC

701 CGGGCGACAG GCTGACTGCC GCCGACGGCA AACCCATCGc ctcaTGGCAG

751 GAATGggcaa acctgACccg cCAAAGCCCg ggcAAAAAAA Tcaccctgac 801 ctacgAaCGC GCcggacaaa cccaTAccgc CGACATCCGC CccgATactg 851 TCGAAcagcc cgACCACACC CTGATCgggc gcgTCGGCCT CCGtccgcaG

901 CCGGACAGGG CGTGGGACGC GCAAATCCGC CGCAGCTACC GTCCGTCTGT

951 TGTCCGCGCA TTCGGCATGG GCTGGGAAAA AACCGTTTCC CACTCGTGGA

1001 CAACCCTCAA ATTTTTCGGC AAACTAATCA GCGGCAACGC CTCTGTCAGC

1051 CATATTTCCG GGCCGCTGAC CATTGCCGAC ATTGCCGGAC AGTCCGCCGA

1101 ACTCGGCTTG CAAAGTTATT TGGAATTTTT AGCGTTGGTC AGCATCAGCC

1151 TCGGCGTGCT GAACCTGCTG CCCGTCCCCG TTTTGGACGG CGGGCACCTC

1201 GTGTTTTATA CTGTCGAATG GATACGCGGC AAACCTTTGG GCGAACGTGT

1251 CCAAAACATC GGTTTGCGCT TCGGGCTCGC CCTGATGATG CTGATGATGG

1301 CGGCCGCCTT CTTCAACGAC GTTACCCGGC TGATCGGTTA G
```

This corresponds to the amino acid sequence <SEQ ID 1842; ORF 591.ng>:

```
g591.pep..
   1 LQTLLAFIFA ILILVSLHEF GHYIVARLCG VKVVRFSVGF GKPFFTRKRG

51 DTEWCLAPIP LGGYVKMVDT REGEVSEADL PYAFDKQHPA KRIAIVAAGP

101 LTNLALAVLL YGLSFSFGVT ELRPYVGTVE PDTVAARTGF QSGDKIQSVN

151 GVSVQDWSSA QTEIVLNLEA GKVAVGVQTA SGAQTVRTID AAGTPEAGKI

201 AKNQGYIGLM PFKITTVAGG VEKGSPAEKA GLKPGDRLTA ADGKPIASWQ

251 EWANLTRQSP GKKITLTYER AGQTHTADIR PDTVEQPDHT LIGRVGLRPQ

301 PDRAWDAQIR RSYRPSVVRA FGMGWEKTVS HSWTTLKFFG KLISGNASVS

351 HISGPLTIAD IAGQSAELGL QSYLEFLALV SISLGVLNLL PVPVLDGGHL

401 VFYTVEWIRG KPLGERVQNI GLRFGLALMM LMMAAAFFND VTRLIG*
```

The following partial DNA sequence was identified in N. meningitidis <SEQ ID 1843>:

```
m591.seq
   1 TTGCACACCC TTCTAGCTTT TATCTTCGCC ATCCTGATTT TGGTCAGCCT

51 GCACGAGTTC GGACACTACA TCGTTGCCAG ATTGTGCGGC GTCAAAGTCG

101 TACGCTTTTC CGTCGGCTTC GGCAAACCGT TTTTCACCCG AAAGCGCGGC

151 GACACCGAAT GGTGCCTCGC CCCGATTCCG TTGGGCGGTT ACGTCAAAAT

201 GGTCGATACG CGCGAAGGCG AAGTATCAGA AGCCGATTTA CCCTACGCTT

251 TTGACAAACA ACACCCCGCC AAGCGCATCG CCATCGTCGC CGCCGGCCCA

301 CTGACCAACC TCGCACTGGC GGTTTTGCTG TACGGACTGA GCTTTTCCTT

351 CGGCGTAACC GAACTGCGCC CCTACGTCGG CACAGTCGAA CCCGACACCA
```

-continued

```
 401 TTGCCGCCCG CGCCGGCTTC CAAAGCGGCG ACAAAATACA ATCCGTCAAC

451 GGCACACCCG TTGCAGATTG GGGCAGCGCG CAAACCGAAA TCGTCCTCAA

501 CCTCGAAGCC GGCAAAGTCG CCGTCGGCGT TCAGACGGCA TCGGGCGCGC

551 AAACCGTCCG CACCATCGAT GCCGCAGGCA CGCCGGAAGC CGGTAAAATC

601 GCAAAAAACC AAGGCTACAT CGGACTGATG CCCTTTAAAA TCACAACCGT

651 TGCCGGCGGC GTGGAAAAAG GCAGCCCCGC CGAAAAAGCA GGCCTGAAAC

701 CGGGCGACAG GCTGACTGCC GCCGACGGCA AACCCATCGC CTCATGGCAA

751 GAATGGGCAA ACCTGACCCG CCAAAGCCCC GGCAAAAAAA TCACCCTGAA

801 CTACGAACGC GCCGGACAAA CCCATACCGC CGACATCCGC CCCGATACTG

851 TCGAACAGTC CGACCACACC CTGATCGGGC GCGTCGGCCT CCGTCCGCAG

901 CCGGACAGGG CGTGGGACGC GCAAATCCGC CGCAGCTACC GTCCGTCTGT

951 TGTCCGCGCA TTCGGCATGG GCTGGGAAAA AACCGTTTCC CACTCGTGGA

1001 CAACCCTCAA ATTTTTCGGC AAACTAATCA GCGGCAACGC CTCCGTCAGC

1051 CATATTTCCG GGCCGCTGAC CATTGCCGAC ATTGCCGGAC AGTCCGCCGA

1101 ACTCGGCTTG CAAAGTTATT TGGAATTTTT AGCACTGGTC AGCATCAGCC

1151 TCGGCGTGCT GAACCTACTG CCCGTCCCTG TTTTGGACGG CGGGCACCTC

1201 GTGTTTTATA CTGCCGAATG GATACGCGGC AAACCTTTGG GCGAACGCGT

1251 CCAAAACATC GGTTTGCGCT TCGGGCTCGC CCTCATGATG CTGATGATGG

1301 CGGTCGCCTT CTTCAACGAC GTTACCCGGC TGCTCGGTTA G
```

This corresponds to the amino acid sequence <SEQ ID 1844; ORF 591>:

```
m591.pep..
  1 LHTLLAFIFA ILILVSLHEF GHYIVARLCG VKVVRFSVGF GKPFFTRKRG

51 DTEWCLAPIP LGGYVKMVDT REGEVSEADL PYAFDKQHPA KRIAIVAAGP

101 LTNLALAVLL YGLSFSFGVT ELRPYVGTVE PDTIAARAGF QSGDKIQSVN

151 GTPVADWGSA QTEIVLNLEA GKVAVGVQTA SGAQTVRTID AAGTPEAGKI

201 AKNQGYIGLM PFKITTVAGG VEKGSPAEKA GLKPGDRLTA ADGKPIASWQ

251 EWANLTRQSP GKKITLNYER AGQTHTADIR PDTVEQSDHT LIGRVGLRPQ

301 PDRAWDAQIR RSYRPSVVRA FGMGWEKTVS HSWTTLKFFG KLISGNASVS

351 HISGPLTIAD IAGQSAELGL QSYLEFLALV SISLGVLNLL PVPVLDGGHL

401 VFYTAEWIRG KPLGERVQNI GLRFGLALMM LMMAVAFFND VTRLLG*
```

Computer analysis of this amino acid sequence gave the following results:
Homology with a Predicted ORF from *N. gonorrhoeae*

```
m591/g591  97.3% identity in 446 aa overlap 10        20        30        40        50        60
    m591.pep  LHTLLAFIFAILILVSLHEFGHYIVARLCGVKVVRFSVGFGKPFFTRKRGDTEWCLAPIP
              |:||||||||||||||||||||||||||||||||||||||||||||||||||||||||||
        g591  LQTLLAFIFAILILVSLHEFGHYIVARLCGVKVVRFSVGFGKPFFTRKRGDTEWCLAPIP
                 10        20        30        40        50        60
```

-continued

```
                   70        80        90       100       110       120
m591.pep    LGGYVKMVDTREGEVSEADLPYAFDKQHPAKRIAIVAAGPLTNLALAVLLYGLSFSFGVT
            ||||||||||||||||||||||||||||||||||||||||||||||||||||||||||||
g591        LGGYVKMVDTREGEVSEADLPYAFDKQHPAKRIAIVAAGPLTNLALAVLLYGLSFSFGVT
                   70        80        90       100       110       120

130       140       150       160       170       180
m591.pep    ELRPYVGTVEPDTIAARAGFQSGDKIQSVNGTPVADWGSAQTEIVLNLEAGKVAVGVQTA
            |||||||||||||:|||:||||||||||||||: | ||:|||||||||||||||||||||
g591        ELRPYVGTVEPDTVAARTGFQSGDKIQSVNGVSVQDWSSAQTEIVLNLEAGKVAVGVQTA
                  130       140       150       160       170       180

190       200       210       220       230       240
m591.pep    SGAQTVRTIDAAGTPEAGKIAKNQGYIGLMPFKITTVAGGVEKGSPAEKAGLKPGDRLTA
            ||||||||||||||||||||||||||||||||||||||||||||||||||||||||||||
g591        SGAQTVRTIDAAGTPEAGKIAKNQGYIGLMPFKITTVAGGVEKGSPAEKAGLKPGDRLTA
                  190       200       210       220       230       240

250       260       270       280       290       300
m591.pep    ADGKPIASWQEWANLTRQSPGKKITLNYERAGQTHTADIRPDTVEQSDHTLIGRVGLRPQ
            ||||||||||||||||||||||||||:||||||||||||||||||| |||||||||||||
g591        ADGKPIASWQEWANLTRQSPGKKITLTYERAGQTHTADIRPDTVEQPDHTLIGRVGLRPQ
                  250       260       270       280       290       300

310       320       330       340       350       360
m591.pep    PDRAWDAQIRRSYRPSVVRAFGMGWEKTVSHSWTTLKFFGKLISGNASVSHISGPLTIAD
            ||||||||||||||||||||||||||||||||||||||||||||||||||||||||||||
g591        PDRAWDAQIRRSYRPSVVRAFGMGWEKTVSHSWTTLKFFGKLISGNASVSHISGPLTIAD
                  310       320       330       340       350       360

370       380       390       400       410       420
m591.pep    IAGQSAELGLQSYLEFLALVSISLGVLNLLPVPVLDGGHLVFYTAEWIRGKPLGERVQNI
            ||||||||||||||||||||||||||||||||||||||||||||:|||||||||||||||
g591        IAGQSAELGLQSYLEFLALVSISLGVLNLLPVPVLDGGHLVFYTVEWIRGKPLGERVQNI
                  370       380       390       400       410       420

430       440
m591.pep    GLRFGLALMMLMMAVAFFNDVTRLLGX
            ||||||||||||||:|||||||||:||
g591        GLRFGLALMMLMMAAAFFNDVTRLIGX
                  430       440
```

The following partial DNA sequence was identified in *N. meningitidis* <SEQ ID 1845>:

```
a591.seq
     1 TTGCACACCC TTCTAGCTTT TATCTTCGCC ATCCTGATTT TGGTCAGCCT

51 GCACGAATTC GGACACTACA TCGTCGCCAG ATTGTGCGGC GTCAAGGTTG

101 TGCGTTTTTC CGTCGGCTTC GGCAAACCGT TTTTCACCCG AAAGCGCGGC

151 GACACCGAAT GGTGCCTCGC CCCGATTCCG TTGGGCGGTT ACGTCAAAAT

201 GGTCGACACG CGCGAAGGCG AAGTATCAGA AGCCGATTTA CCCTACGCTT

251 TTGACAAACA ACACCCCGCC AAGCGCATCG CCATCGTCGC CGCCGGCCCG

301 CTGACCAACC TCGCACTGGC GGTTTTGCTG TACGGACTGA GCTTTTCCTT

351 CGGCGTTACC GAACTGCGCC CCTATGTCGG CACAGTCGAA CCCGACACCA

401 TTGCCGCCCG CGCCGGCTTC CAAAGCGGCG ACAAAATACA ATCCGTCAAC

451 GGCACACCCG TTGCAGATTG GGGCAGCGCG CAAACCGAAA TCGTCCTCAA

501 CCTCGAAGCC GGCAAAGTCG CCGTCGGCGT TCAGACGGCA TCGGGCGCGC

551 AAACCGTCCG CACCATCGAT GCCGCAGGCA CGCCGGAAGC CGGTAAAATC

601 GCAAAAAACC AAGGCTACAT CGGACTGATG CCCTTTAAAA TCACAACCGT

651 TGCCGGCGGC GTGGAAAAAG GCAGCCCCGC CGAAAAAGCA GGCCTGAAAC

701 CGGGCGACAG GCTGACTGCC GCCGACGGCA AACCCATCGC CTCATGGCAA

751 GAATGGGCAA ACCTGACCCG CCAAAGCCCC GGCAAAAAAA TCACCCTGAC

801 CTACGAACGC GCCGGACAAA CCCATACCGC CGACATCCGC CCCGATACTG

851 TCGAACAGCC CGACCACACC CTGATCGGGC GCGTCGGCCT CCGTCCGCAG

901 CCGGACAGGG CGTGGGACGC GCAAATCCGC CGCAGCTACC GTCCGTCTGT
```

-continued

```
 951 TGTCCGCGCA TTCGGCATGG GCTGGGAAAA AACCGTTTCC CACTCGTGGA
1001 CAACCCTCAA ATTTTTCGGC AAACTAATCA GCGGCAACGC CTCCGTCAGC
1051 CATATTTCCG GTCCGCTGAC CATTGCCGAT ATTGCCGGAC AGTCCGCCGA
1101 ACTCGGCTTG CAAAGTTATT TGGAATTTTT GGCACTGGTC AGCATCAGCC
1151 TCGGCGTGCT GAACCTGCTG CCCGTCCCCG TTTTGGACGG CGGCCACCTC
1201 GTGTTTTATA CTGCCGAATG GATACGCGGC AAACCTTTGG GCGAACGCGT
1251 CCAAAACATC GGTTTGCGCT TCGGGCTTGC CCTCATGATG CTGATGATGG
1301 CGGTCGCCTT CTTCAACGAC GTTACCCGGC TGCTCGGTTA G
```

This corresponds to the amino acid sequence <SEQ ID 1846; ORF 591.a>:

```
a591.pep

1 LHTLLAFIFA ILILVSLHEF GHYIVARLCG VKVVRFSVGF GKPFFTRKRG

51 DTEWCLAPIP LGGYVKMVDT REGEVSEADL PYAFDKQHPA KRIAIVAAGP

101 LTNLALAVLL YGLSFSFGVT ELRPYVGTVE PDTIAARAGF QSGDKIQSVN

151 GTPVADWGSA QTEIVLNLEA GKVAVGVQTA SGAQTVRTID AAGTPEAGKI

201 AKNQGYIGLM PFKITTVAGG VEKGSPAEKA GLKPGDRLTA ADGKPIASWQ

251 EWANLTRQSP GKKITLTYER AGQTHTADIR PDTVEQPDHT LIGRVGLRPQ

301 PDRAWDAQIR RSYRPSVVRA FGMGWEKTVS HSWTTLKFFG KLISGNASVS

351 HISGPLTIAD IAGQSAELGL QSYLEFLALV SISLGVLNLL PVPVLDGGHL

401 VFYTAEWIRG KPLGERVQNI GLRFGLALMM LMMAVAFFND VTRLLG* m591/a591 99.6% identity in 446 aa overlap 10         20         30         40         50         60
m591.pep  LHTLLAFIFAILILVSLHEFGHYIVARLCGVKVVRFSVGFGKPFFTRKRGDTEWCLAPIP
          ||||||||||||||||||||||||||||||||||||||||||||||||||||||||||||
a591      LHTLLAFIFAILILVSLHEFGHYIVARLCGVKVVRFSVGFGKPFFTRKRGDTEWCLAPIP
                 10         20         30         40         50         60

70         80         90        100        110        120
m591.pep  LGGYVKMVDTREGEVSEADLPYAFDKQHPAKRIAIVAAGPLTNLALAVLLYGLSFSFGVT
          ||||||||||||||||||||||||||||||||||||||||||||||||||||||||||||
a591      LGGYVKMVDTREGEVSEADLPYAFDKQHPAKRIAIVAAGPLTNLALAVLLYGLSFSFGVT
                 70         80         90        100        110        120

130        140        150        160        170        180
m591.pep  ELRPYVGTVEPDTIAARAGFQSGDKIQSVNGTPVADWGSAQTEIVLNLEAGKVAVGVQTA
          ||||||||||||||||||||||||||||||||||||||||||||||||||||||||||||
a591      ELRPYVGTVEPDTIAARAGFQSGDKIQSVNGTPVADWGSAQTEIVLNLEAGKVAVGVQTA
                130        140        150        160        170        180

190        200        210        220        230        240
m591.pep  SGAQTVRTIDAAGTPEAGKIAKNQGYIGLMPFKITTVAGGVEKGSPAEKAGLKPGDRLTA
          ||||||||||||||||||||||||||||||||||||||||||||||||||||||||||||
a591      SGAQTVRTIDAAGTPEAGKIAKNQGYIGLMPFKITTVAGGVEKGSPAEKAGLKPGDRLTA
                190        200        210        220        230        240

250        260        270        280        290        300
m591.pep  ADGKPIASWQEWANLTRQSPGKKITLNYERAGQTHTADIRPDTVEQSDHTLIGRVGLRPQ
          |||||||||||||||||||||||||||||:||||||||||||||||| |||||||||||
a591      ADGKPIASWQEWANLTRQSPGKKITLTYERAGQTHTADIRPDTVEQPDHTLIGRVGLRPQ
                250        260        270        280        290        300

310        320        330        340        350        360
m591.pep  PDRAWDAQIRRSYRPSVVRAFGMGWEKTVSHSWTTLKFFGKLISGNASVSHISGPLTIAD
          ||||||||||||||||||||||||||||||||||||||||||||||||||||||||||||
a591      PDRAWDAQIRRSYRPSVVRAFGMGWEKTVSHSWTTLKFFGKLISGNASVSHISGPLTIAD
                310        320        330        340        350        360

370        380        390        400        410        420
m591.pep  IAGQSAELGLQSYLEFLALVSISLGVLNLLPVPVLDGGHLVFYTAEWIRGKPLGERVQNI
          ||||||||||||||||||||||||||||||||||||||||||||||||||||||||||||
a591      IAGQSAELGLQSYLEFLALVSISLGVLNLLPVPVLDGGHLVFYTAEWIRGKPLGERVQNI
                370        380        390        400        410        420
```

```
                         -continued
                430          440
    m591.pep    GLRFGLALMMLMMAVAFFNDVTRLLGX
                ||||||||||||||||||||||||||
    a591        GLRFGLALMMLMMAVAFFNDVTRLLGX
                430          440
```

The following partial DNA sequence was identified in *N. gonorrhoeae* <SEQ ID 1847>:

```
g592.seq..
   1 atgattccgg acgtgttcgg tcagattttt tcgggcgcgt tcaaattcga
  51 cgcggcagca ggcggcttac tcggcggtct gatttcgcaa acgatgatga
 101 tgggcatcaa acgcggcctg tattccaacg aggcgggtat gggttccgcg
 151 ccgaacgccg ccgccgccgc cgaagtgaaa caccctgttt cgcaaggtat
 201 gattcaaatg ctgggcgtgt tgtcgatac catcatcgtt tgttcttgca
 251 ccgccttcat catcttgatt taccaacagc cttatggcga tttgagcggt
 301 gcggcgctga cgcaggcggc gattgtcagc caagtggggc aatggggcgc
 351 gggtttcctc gccgtcatcc tgtttatgtt tgccttttcc accgttatcg
 401 gcaactatgc ctatgccgag tccaacgtcc aattcatcaa aagccattgg
 451 ctgattaccg ccgttttccg tatgctggtt ttggcgtggg tctatttcgg
 501 cgcggttgcc aatgtgcctt tggtctggga tatggcggat atggcgatgg
 551 gcatcatggc gtggatcaac ctcgtcgcca tcctgctgct ctcgccattg
 601 gcgtttatgc tgctgcgcga ttacaccgcc aagctgaaaa tgggcaaaga
 651 ccccgagttc aaactttccg aacatccggg cctgaaacgc cgcatcaaat
 701 ccgatgtttg gtaa
```

This corresponds to the amino acid sequence <SEQ ID 1848; ORF 592.ng>:

```
g592.pep ..
   1 MIPDVFGQIF SGAFKFDAAA GGLLGGLISQ TMMMGIKRGL YSNEAGMGSA
  51 PNAAAAAEVK HPVSQGMIQM LGVFVDTIIV CSCTAFIILI YQQPYGDLSG
 101 AALTQAAIVS QVGQWGAGFL AVILFMFAFS TVIGNYAYAE SNVQFIKSHW
 151 LITAVFRMLV LAWVYFGAVA NVPLVWDMAD MAMGIMAWIN LVAILLLSPL
 201 AFMLLRDYTA KLKMGKDPEF KLSEHPGLKR RIKSDVW*
```

The following partial DNA sequence was identified in *N. meningitidis* <SEQ ID 1849>:

```
m592.seq ..
   1 ATGATTCCGG ACGTGTTCGG TCAGATTTTT TCGGGCGCGT TCAAATTCGA
  51 CGCGGCAGCA GGCGGCTTAC TCGGCGGTCT GATTTCGCAA ACGATGATGA
 101 TGGGCATCAA ACGCGGCCTG TATTCCAACG AGGCGGGTAT GGGTTCCGCG
 151 CCGAACGCCG CCGCCGCCGC CGAAGTGAAA CACCCTGTTT CGCAAGGTAT
 201 GATTCAAATG CTGGGCGTGT TGTCGATAC CATCATCGTT TGTTCTTGCA
 251 CCGCCTTCAT CATCTTGATT TACCAACAGC CTTACGGCGA TTTGAGCGGT
 301 GCGGCGCTGA CGCAGGCGGC GATTGTCAGC CAAGTGGGGC AATGGGGCGC
 351 GGGCTTCCTC GCCGTCATCC TGTTTATGTT TGCCTTTTCC ACCGTTATCG
```

-continued

```
401 GCAACTATGC CTATGCCGAG TCCAACGTCC AATTCATCAA AAGCCATTGG

451 CTGATTACCG CCGTTTTCCG TATGCTGGTT TTGGCGTGGG TCTATTTCGG

501 CGCGGTTGCC AATGTGCCTT TGGTCTGGGA TATGGCGGAT ATGGCGATGG

551 GCATTATGGC GTGGATCAAC CTTGTCGCCA TCCTGCTGCT CTCGCCCTTG

601 GCGTTTATGC TGCTGCGCGA TTACACCGCC AAGCTGAAAA TGGGCAAAGA

651 CCCCGAGTTC AAACTTTCCG AACATCCGGG CCTGAAACGC CGTATCAAAT

701 CCGACGTTTG GTAA
```

This corresponds to the amino acid sequence <SEQ ID 1850; ORF 592>:

```
m592.pep..
       1   MIPDVFGQIF SGAFKFDAAA GGLLGGLISQ TMMMGIKRGL YSNEAGMGSA

51   PNAAAAAEVK HPVSQGMIQM LGVFVDTIIV CSCTAFIILI YQQPYGDLSG

101   AALTQAAIVS QVGWQGAGFL AVILFMFAFS TVIGNYAYAE SNVQFIKSHW

151   LITAVFRMLV LAWVYFGAVA NVPLVWDMAD MAMGIMAWIN LVAILLLSPL

201   AFMLLRDYTA KLKMGKDPEF KLSEHPGLKR RIKSDVW* m592/g592   100.0% identity in 237 aa overlap
                  10         20         30         40         50         60
m592.pep   MIPDVFGQIFSGAFKFDAAAGGLLGGLISQTMMMGIKRGLYSNEAGMGSAPNAAAAAEVK
           ||||||||||||||||||||||||||||||||||||||||||||||||||||||||||||
g592       MIPDVFGQIFSGAFKFDAAAGGLLGGLISQTMMMGIKRGLYSNEAGMGSAPNAAAAAEVK
                  10         20         30         40         50         60

70         80         90        100        110        120
m592.pep   HPVSQGMIQMLGVFVDTIIVCSCTAFIILIYQQPYGDLSGAALTQAAIVSQVGQWGAGFL
           ||||||||||||||||||||||||||||||||||||||||||||||||||||||||||||
g592       HPVSQGMIQMLGVFVDTIIVCSCTAFIILIYQQPYGDLSGAALTQAAIVSQVGQWGAGFL
                  70         80         90        100        110        120

130        140        150        160        170        180
m592.pep   AVILFMFAFSTVIGNYAYAESNVQFIKSHWLITAVFRMLVLAWVYFGAVANVPLVWDMAD
           ||||||||||||||||||||||||||||||||||||||||||||||||||||||||||||
g592       AVILFMFAFSTVIGNYAYAESNVQFIKSHWLITAVFRMLVLAWVYFGAVANVPLVWDMAD
                 130        140        150        160        170        180

190        200        210        220        230
m592.pep   MAMGIMAWINLVAILLLSPLAFMLLRDYTAKLKMGKDPEFKLSEHPGLKRRIKSDVWX
           ||||||||||||||||||||||||||||||||||||||||||||||||||||||||||
g592       MAMGIMAWINLVAILLLSPLAFMLLRDYTAKLKMGKDPEFKLSEHPGLKRRIKSDVWX
                 190        200        210        220        230
```

The following partial DNA sequence was identified in *N. meningitides* <SEQ ID 1851>:

```
a592.seq
   1 ATGATTCCGG ACGTGTTCGG TCAGATTTTT TCGGGCGCGT TCAAATTCGA

51 CGCGGCAGCA GGCGGCTTAC TCGGCGGTCT GATTTCGCAA ACGATGATGA

101 TGGGCATCAA ACGCGGCCTG TATTCCAACG AGGCGGGTAT GGGTTCCGCG

151 CCGAACGCCG CCGCCGCCGC CGAAGTGAAA CACCCTGTTT CGCAAGGTAT

201 GATTCAAATG CTGGGCGTGT TGTCGATAC CATCATCGTT TGTTCTTGCA

251 CCGCCTTCAT CATCTTGATT TACCAACAGC CTTACGGCGA TTTGAGCGGT

301 GCGGCGCTGA CGCAGGCGGC GATTGTCAGC CAAGTGGGGC AATGGGGCGC

351 GGGCTTCCTC GCCGTCATCC TGTTTATGTT TGCCTTTTCC ACCGTTATCG

401 GCAACTATGC CTATGCCGAG TCCAACGTCC AATTCATCAA AAGCCATTGG

451 CTGATTACCG CCGTTTTCCG TATGCTGGTT TTGGCGTGGG TCTATTTCGG
```

-continued

```
501 CGCGGTTGCC AATGTGCCTT TGGTCTGGGA TATGGCGGAT ATGGCGATGG

551 GCATTATGGC GTGGATCAAC CTTGTCGCCA TCCTGCTGCT CTCGCCCTTG

601 GCGTTTATGC TGCTGCGCGA TTACACCGCC AAGCTGAAAA TGGGCAAAGA

651 CCCCGAGTTC AAACTTTCCG AACATCCGGG CCTGAAACGC CGTATCAAAT

701 CCGACGTTTG GTAA
```

This corresponds to the amino acid sequence <SEQ ID 1852; ORF 592.a>:

```
a592.pep

1 MIPDVFGQIF SGAFKFDAAA GGLLGGLISQ TMMMGIKRGL YSNEAGMGSA

51 PNAAAAAEVK HPVSQGMIQM LGVFVDTIIV CSCTAFIILI YQQPYGDLSG

101 AALTQAAIVS QVGQWGAGFL AVILFMFAFS TVIGNYAYAE SNVQFIKSHW

151 LITAVFRMLV LAWVYFGAVA NVPLVWDMAD MAMGIMAWIN LVAILLLSPL

201 AFMLLRDYTA KLKMGKDPEF KLSEHPGLKR RIKSDVW* m592/a592   100.0% identity in 237 aa overlap 10         20         30         40         50         60
m592.pep  MIPDVFGQIFSGAFKFDAAAGGLLGGLISQTMMMGIKRGLYSNEAGMGSAPNAAAAAEVK
          ||||||||||||||||||||||||||||||||||||||||||||||||||||||||||||
a592      MIPDVFGQIFSGAFKFDAAAGGLLGGLISQTMMMGIKRGLYSNEAGMGSAPNAAAAAEVK
                  10         20         30         40         50         60

70         80         90        100        110        120
m592.pep  HPVSQGMIQMLGVFVDTIIVCSCTAFIILIYQQPYGDLSGAALTQAAIVSQVGQWGAGFL
          ||||||||||||||||||||||||||||||||||||||||||||||||||||||||||||
a592      HPVSQGMIQMLGVFVDTIIVCSCTAFIILIYQQPYGDLSGAALTQAAIVSQVGQWGAGFL
                  70         80         90        100        110        120

130        140        150        160        170        180
m592.pep  AVILFMFAFSTVIGNYAYAESNVQFIKSHWLITAVFRMLVLAWVYFGAVANVPLVWDMAD
          ||||||||||||||||||||||||||||||||||||||||||||||||||||||||||||
a592      AVILFMFAFSTVIGNYAYAESNVQFIKSHWLITAVFRMLVLAWVYFGAVANVPLVWDMAD
                 130        140        150        160        170        180

190        200        210        220        230
m592.pep  MAMGIMAWINLVAILLLSPLAFMLLRDYTAKLKMGKDPEFKLSEHPGLKRRIKSDVWX
          |||||||||||||||||||||||||||||||||||||||||||||||||||||||||
a592      MAMGIMAWINLVAILLLSPLAFMLLRDYTAKLKMGKDPEFKLSEHPGLKRRIKSDVWX
                 190        200        210        220        230
```

The following partial DNA sequence was identified in N. gonorrhoeae <SEQ ID 1853>:

```
g593.seq..
   1 atgcttgaac tgaacggact ctgcaaatgc ttcggcggca aaacggtcgc 51 cgacaacatc tgcctgactg tcgggcgcgg caaaatactc gccgtactgg 101 ggcggtcggg ctgcggcaaa tccaccctgc tgaatatgat tgcgggcatc 151 gtccggccgg acggcggcga aattcggctg aacggggaaa acattacctg 201 tatgccgccc gaaaaacgcc gtatctcgct gatgtttcaa gattacgcgc 251 tgtttcccca tatgagtgcg ctggaaaata cggcattcgg tttgaaaatg 301 caaaaaatgc cgaaagccga agccgaacgc ctcgccttgt cggcacttgc 351 cgaagtcggg ctggaaaacg aggcgcaccg caagcctgaa aaactttccg 401 gaggcgagaa gcaacggttg gcactggcgc gcgctttggt tgtccgccct 451 tccctgctgt tgctggatga atcgttttcc agtttggaca cgcatttgcg 501 cgaccggctg cgccgtatga ccgccgaacg catccgcaag gcggcatcc 551 ctgccgttttt ggtaacgcat tcgcccgaag aggcctgcac ggcggcggac
```

-continued

```
601 gaaatcgccg tcatgcacga ggggaaaatc cttcaatgcg gtacgcccga 651 aaccttgatt caaacgcctg ccggcgtgca ggtcgcccgt ctgatggggc 701 tgcccaatac cgacgatgac cgccatattc cgcaaaatgc cgtgtgcttg 751 gacaatcatg gaacggaatg ccgtctgctg tccctcgtcc gcctgcccga 801 ctcgctccgg ctttccgccg tccatcccga acacggcgag ctgaccttaa 851 acctgactgt cggacaacat acggacggta tttccggaaa cggtacggtc 901 cgcatccgcg tcgatgaagg gcgtatcgtc cgtttccgat ga
```

This corresponds to the amino acid sequence <SEQ ID 1854; ORF 593.ng>:

```
g593.pep..
  1 MLELNGLCKC FGGKTVADNI CLTVGRGKIL AVLGRSGCGK STLLNMIAGI

51 VRPDGGEIRL NGENITCMPP EKRRISLMFQ DYALFPHMSA LENTAFGLKM

101 QKMPKAEAER LALSALAEVG LENEAHRKPE KLSGGEKQRL ALARALVVRP

151 SLLLLDESFS SLDTHLRDRL RRMTAERIRK GGIPAVLVTH SPEEACTAAD

201 EIAVMHEGKI LQCGTPETLI QTPAGVQVAR LMGLPNTDDD RHIPQNAVCL

251 DNHGTECRLL SLVRLPDSLR LSAVHPEHGE LTLNLTVGQH TDGISGNGTV

301 RIRVDEGRIV RFR*
```

The following partial DNA sequence was identified in *N. meningitidis* <SEQ ID 1855>:

```
m593.seq
  1 ATGCTTGAAC TGAACGGACT CTGCAAACGC TTCGGCAATA AAACCGTCGC

51 CGACAACATC TGCCTGACTG TCGGGCGCGG CAAAATACTC GCCGTTTTGG

101 GGCGGTCGGG CTGCGGAAAA TCCACCCTGC TGAATATAAT TGCGGGGATT

151 GTCCGGCCGG ACGGCGGGGA AATATGGCTG AACGGAGAAA ACATTACCCG

201 TATGCCGCCC GAAAAACGCC GTATCTCGCT GATGTTTCAA GATTACGCGC

251 TGTTTCCCCA TATGAGTGCG CTGGAAAATG CGGCATTCGG TTTGAAAATG

301 CAAAAAATGC CGAAAGCCGA AGCCGAACGC CTCGCCATGG CGGCACTTGC

351 CGAAGTCGGA CTGGAAAACG AGGCGCACCG CAAGCCTGAA AAACTTTCCG

401 GAGGCGAGAA GCAACGGCTG GCGTTGGCGC GCGCTTTGGT TGTCCGCCCT

451 TCCCTGCTGC TGTTGGACGA ATCGTTTTCC AGTTTGGACA CGCATTTGCG

501 CGGCACGCTG CGCCGTATGA CTGCCGAACG TATCCGAAAC GGCGGCATCC

551 CTGCCGTTTT GGTAACGCAT TCGCCCGAAG AAGCCTGTAC GACGGCAGAC

601 GAAATCGCCG TGATGCATAA AGGGAGGATT CTACAATACG GTACGCCCGA

651 AACATTGGTC AAAACACCAT CCTGCGTGCA GGTCGCCCGA CTGATGGGTT

701 TGCCCAATAC CGACGATAAC CGCCATATTC CGCAACATGC GGTGCGTTTC

751 GACCAAGACG GCATGGAGTG CCGCGTATTA TCCCGTACCT GTTTGCCCGA

801 ATCGTTCAGC CTGTCCGTCC TCCATCCGGA ACACGGCATC CTGTGGCTGA

851 ACCTCGATAT GCGGCACGCC GGGGCGGTAT CGGGCAAGGA TACGGTACGC

901 ATCCATATCG AAGAACGGGA AATCGTCCGC TTCCGCTGA
```

This corresponds to the amino acid sequence <SEQ ID 1856; ORF 593>:

```
m593.pep ..
   1 MLELNGLCKR FGNKTVADNI CLTVGRGKIL AVLGRSGCGK STLLNIIAGI

51 VRPDGGEIWL NGENITRMPP EKRRISLMFQ DYALFPHMSA LENAAFGLKM

101 QKMPKAEAER LAMAALAEVG LENEAHRKPE KLSGGEKQRL ALARALVVRP

151 SLLLLDESFS SLDTHLRGTL RRMTAERIRN GGIPAVLVTH SPEEACTTAD

201 EIAVMHKGRI LQYGTPETLV KTPSCVQVAR LMGLPNTDDN RHIPQHAVRF

251 DQDGMECRVL SRTCLPESFS LSVLHPEHGI LWLNLDMRHA GAVSGKDTVR

301 IHIEEREIVR FR*
```

Computer analysis of this amino acid sequence gave the following results:
Homology with a Predicted ORF from *N. gonorrhoeae*

```
    m593/g593   83.4% identity in 313 aa overlap 10         20         30         40         50         60
      m593.pep  MLELNGLCKRFGNKTVADNICLTVGRGKILAVLGRSGCGKSTLLNIIAGIVRPDGGEIWL
                ||||||||| ||:||||||||||||||||||||||||||||||:||||||||||||| |
      g593      MLELNGLCKCFGGKTVADNICLTVGRGKILAVLGRSGCGKSTLLNMIAGIVRPDGGEIRL
                    10         20         30         40         50         60

70         80         90        100        110        120
      m593.pep  NGENITRMPPEKRRISLMFQDYALFPHMSALENAAFGLKMQKMPKAEAERLAMAALAEVG
                |||||| ||||||||||||||||||||||||||||:|||||||||||||||::||||||
      g593      NGENITCMPPEKRRISLMFQDYALFPHMSALENTAFGLKMQKMPKAEAERLALSALAEVG
                    70         80         90        100        110        120

130        140        150        160        170        180
      m593.pep  LENEAHRKPEKLSGGEKQRLALARALVVRPSLLLLDESFSSLDTHLRGTLRRMTAERIRN
                ||||||||||||||||||||||||||||||||||||||||||||||| ||||||||||:
      g593      LENEAHRKPEKLSGGEKQRLALARALVVRPSLLLLDESFSSLDTHLRDLRRMTAERIRK
                   130        140        150        160        170        180

190        200        210        220        230        240
      m593.pep  GGIPAVLVTHSPEEACTTADEIAVMHKGRILQYGTPETLVKTPSCVQVARLMGLPNTDDN
                |||||||||||||||||||:||||||:|:|||||||::||: |||||||||||||||||:
      g593      GGIPAVLVTHSPEEACTAADEIAVMHEGKILQCGTPETLIQTPAGVQVARLMGLPNTDDD
                   190        200        210        220        230        240

250        260        270        280        290        299
      m593.pep  RHIPQHAVRFDQDGMECRVLSRTCLPESFSLSVLHPEHGILWLNLDM-RHAGAVSGKDTV
                |||||:|| :|: | |||:|| : ||:|: ||::|||| |  : :|: ||
      g593      RHIPQNAVCLDNHGTECRLLSLVRLPDSLRLSAVHPEHGELTLNLTVGQHTDGISGNGTV
                   250        260        270        280        290        300

300        310
      m593.pep  RIHIEEREIVRFRX
                ||:::| :||||||
      g593      RIRVDEGRIVRFRX
                           310
```

The following partial DNA sequence was identified in *N. meningitidis* <SEQ ID 1857>:

```
a593.seq
   1 ATGCTTGAAC TGAACGGACT CTGCAAACGC TTCGGCGGCA AAACGGTTGC

51 CGACGATATC TGCCTGACTG TCGGGCGCGG CAAAATACTC GCCGTTTTGG

101 GGCGGTCGGG CTGCGGCAAA TCCACCCTGC TGAATATGAT TGCGGGCATC

151 GTCCGGCCGG ACGGCGGGGA AATATGGCTG AATGGGAAA ACATTACCCG

201 TATGCCGCCC GAAAAACGCC GTATTTCGCT GATGTTTCAA GATTACGCGC

251 TGTTTCCCCA TATGAGTGCA CTGGAAAATG CGGCATTCGG TTTGAAAATG

301 CAAAAAATGC CGAAAGCCGA AGCCGAAAGC CTCGCCATGG CGGCACTTGC

351 CGAAGTCGGA CTGGAAAACG AGGCGCACCG CAAGCCTGAN AAACTTTCCG
```

```
401 GAGGCGAAAA GCAACGGTTG GCACTGGCGC GCGCTTTGGT TGTCCGCCCT

451 TCCCTGCTGC TGTTGGACGA ATCGTTTTCC AGTTTGGACA CGCATTTGCG

501 CGACCGGCTG CGCCGCATGA CTGCCGAACG TATCCGCAAG GGCGGCATCC

551 CTGCCGTTTT GGTAACGCAT TCGCCCGAAG AGGCCTGCAC GGCGGCAGAC

601 GAAATCGCCG TCATGCACGA GGGGAAAATC CTTCAATGCG GTACGCCCGA

651 AACCTTGGTT CAAACGCCTG CCGGCGTGCA GGTCGCCCAT CTGATGGGGC

701 TGCCCAATAC CGACGATGAC CGCCATATTC CGCAACATGC GGTGCGTTTC

751 GACCAAGACG GCATGGAGTG CCGCGTATTA TCCCGTACCT GTTTGCCCGA

801 ATCGTTCAGC CTGTCCGTCC TCCATCCGGA ACACGGCATC CTGTGGCTGA

851 ACCTCGATAT GCCGCACGCC GGTGAAATAT CGGGAAACGA TACGGTACGC

901 ATCCATATCG AAGACAGGGA AATCGTCCGC TTCCGCTGA
```

This corresponds to the amino acid sequence <SEQ ID 1858; ORF 593.a>:

```
a593.pep

1 MLELNGLCKR FGGKTVADDI CLTVGRGKIL AVLGRSGCGK STLLNMIAGI

51 VRPDGGEIWL NGENITRMPP EKRRISLMFQ DYALFPHMSA LENAAFGLKM

101 QKMPKAEAES LAMAALAEVG LENEAHRKPX KLSGGEKQRL ALARALVVRP

151 SLLLLDESFS SLDTHLRDRL RRMTAERIRK GGIPAVLVTH SPEEACTAAD

201 EIAVMHEGKI LQCGTPETLV QTPAGVQVAH LMGLPNTDDD RHIPQHAVRF

251 DQDGMECRVL SRTCLPESFS LSVLHPEHGI LWLNLDMPHA GEISGNDTVR

301 IHIEDREIVR FR*
``` m593/a593  92.9% identity in 312 aa overlap

```
                10         20         30         40         50         60
m593.pep  MLELNGLCKRFGNKTVADNICLTVGRGKILAVLGRSGCGKSTLLNIIAGIVRPDGGEIWL
          ||||||||||:||||||||:||||||||||||||||||||||||:|||||||||||||||
a593      MLELNGLCKRFGGKTVADDICLTVGRGKILAVLGRSGCGKSTLLNMIAGIVRPDGGEIWL
                10         20         30         40         50         60

70         80         90        100        110        120
m593.pep  NGENITRMPPEKRRISLMFQDYALFPHMSALENAAFGLKMQKMPKAEAERLAMAALAEVG
          ||||||||||||||||||||||||||||||||||||||||||||||||||:|||||||||
a593      NGENITRMPPEKRRISLMFQDYALFPHMSALENAAFGLKMQKMPKAEAESLAMAALAEVG
                70         80         90        100        110        120

130        140        150        160        170        180
m593.pep  LENEAHRKPEKLSGGEKQRLALARALVVRPSLLLLDESFSSLDTHLRGTLRRMTAERIRN
          |||||||||:|||||||||||||||||||||||||||||||||||||| ||||||||||:
a593      LENEAHRKPXKLSGGEKQRLALARALVVRPSLLLLDESFSSLDTHLRDRLRRMTAERIRK
               130        140        150        160        170        180

190        200        210        220        230        240
m593.pep  GGIPAVLVTHSPEEACTTADEIAVMHKGRILQYGTPETLVKTPSCVQVARLMGLPNTDDN
          |||||||||||||||||:|||||||:|:|||  ||||||||:||  ||||:|||||||||:
a593      GGIPAVLVTHSPEEACTAADEIAVMHEGKILQCGTPETLVQTPAGVQVAHLMGLPNTDDD
               190        200        210        220        230        240

250        260        270        280        290        300
m593.pep  RHIPQHAVRFDQDGMECRVLSRTCLPESFSLSVLHPEHGILWLNLDMRHAGAVSGKDTVR
          ||||||||||||||||||||||||||||||||||||||||||||||||||| :|:||||
a593      RHIPQHAVRFDQDGMECRVLSRTCLPESFSLSVLHPEHGILWLNLDMPHAGEISGNDTVR
               250        260        270        280        290        300

310
m593.pep  IHIEEREIVRFRX
          ||||:||||||||
a593      IHIEDREIVRFRX
               310
```

The following partial DNA sequence was identified in *N. gonorrhoeae* <SEQ ID 1859>:

```
g594.seq..
   1 atgggtgcag ataccgatgg cgacaaggat gttcggctta atcgaacggg 51 tctcgttttt agcatactcc ggctgctgtt ccgcatcgga attgggatcg 101 gtaagttcgc cgttcaggcc tttcaggtct ttaagctgct gatctgtacg 151 gttgagcacc caaatcggtt tgccttgcca ctcggcggtc agcagctgac 201 ccgcttcgat tttactgaca tccacctcga cggcagcacc ggaggccttg 251 gcttttccg aagggaaaaa actggccaca acggcgttg ccacacccaa 301 tgctgccact ccgcccgcgc cgcaggtcgc aagtgtcagg aaacggcggc 351 ggccgttgtt gatttcttga ttatccatta ttcagtcgtc ctaatatttt 401 gggaatgccg agccattaaa cattgcaatt ttacccagtt tgcagtgata 451 ctcaaagcat tatttaaaat aaggtaa
```

This corresponds to the amino acid sequence <SEQ ID 1860; ORF 594.ng>:

```
g594.pep
   1 MGADTDGDKD VRLNRTGLVF SILRLLFRIG IGIGKFAVQA FQVFKLLICT

51 VEHPNRFALP LGGQQLTRFD FTDIHLDGST GGLGFFRREK TGHKRRCHTQ

101 CCHSARAAGR KCQETAAAVV DFLIIHYSVV LIFWECRAIK HCNFTQFAVI

151 LKALFKIR*
```

The following partial DNA sequence was identified in *N. meningitidis* <SEQ ID 1861>:

```
m594.seq
   1 ATGGGTGCAG ATACCGATGG CGACAAGGAT GTTCGGCTTA ATCGAACGGG

51 TCTCGTTTTT AGCATACTCC GGCTGCTGTT CCGCATCGGA ATTGGGATCG

101 GTAAGTTCGC CGTTCAGGCC TTTCAGGTCT TTAAGCTGCT GATCTGTACG

151 GTTGAGCACC CAAATCGGTT TGCCTTGCCA CTCGGCGGTC AGCAGCTGAC

201 CCGCTTCGAT TTTACTGACA TCCACCTCGA CGGCAGCACC GGCGGCCTTG

251 GCTTTTCCG AAGGGAAAAA ACTGGCCACA ACGGCGTTG CCACACCCAA

301 TGCTGCCACT CCGCCCGCGC CGCAGGTCGC GAGTGTCAGG AAACGGCGGC

351 GGCCGTTGTT GATTTCTTGA TTATCCATTA TTCAGTCGTC CTAATATTTT

401 GGGAATACCG AGCCATTAAA CGTTGCAATT TTACCCAGTT TGCAGTGATA

451 CTCAAAGCAT TATTTAAAAT AAGGTAA
```

This corresponds to the amino acid sequence <SEQ ID 1862; ORF 594>:

```
m594.pep
   1 MGADTDGDKD VRLNRTGLVF SILRLLFRIG IGIGKFAVQA FQVFKLLICT

51 VEHPNRFALP LGGQQLTRFD FTDIHLDGST GGLGFFRREK TGHKRRCHTQ

101 CCHSARAAGR ECQETAAAVV DFLIIHYSVV LIFWEYRAIK RCNFTQFAVI

151 LKALFKIR*
```

Computer analysis of this amino acid sequence gave the following results:
Homology with a Predicted ORF from *N. gonorrhoeae*

```
    m594/g594   98.1% identity in 158 aa overlap 10         20         30         40         50         60
    m594.pep    MGADTDGDKDVRLNRTGLVFSILRLLFRIGIGIGKFAVQAFQVFKLLICTVEHPNRFALP
                ||||||||||||||||||||||||||||||||||||||||||||||||||||||||||||
    g594        MGADTDGDKDVRLNRTGLVFSILRLLFRIGIGIGKFAVQAFQVFKLLICTVEHPNRFALP
                    10         20         30         40         50         60

70         80         90        100        110        120
    m594.pep    LGGQQLTRFDFTDIHLDGSTGGLGFFRREKTGHKRRCHTQCCHSARAAGRECQETAAAVV
                |||||||||||||||||||||||||||||||||||||||||||||||||:||||||||||
    g594        LGGQQLTRFDFTDIHLDGSTGGLGFFRREKTGHKRRCHTQCCHSARAAGRKCQETAAAVV
                    70         80         90        100        110        120

130        140        150        159
    m594.pep    DFLIIHYSVVLIFWEYRAIKRCNFTQFAVILKALFKIRX
                ||||||||||||||||||||:||||||||||||||||||
    g594        DFLIIHYSVVLIFWECRAIKHCNFTQFAVILKALFKIRX
                   130        140        150
```

The following partial DNA sequence was identified in *N. meningitidis* <SEQ ID 1863>:

```
a594.seq
   1 ATGGGTGCAG ATACCGATGG CGACAAGGAT GTTCGGCTTA ATCGAACGGG

51 TCTCGTTTTT AGCATACTCC GGCTGCTGTT CCGCATCGGA ATTGGGATCG

101 GTAAGTTCGC CGTTCAGGCC TTTCAGGTCT TTAAGCTGCT GATCTGTACG

151 GTTGAGCACC CAAATCGGTT TGCCTTGCCA CTCGGCGGTC AGCAACTGAC

201 CCGCTTCGAT TTTACTGACA TCCACCTCGA CGGCAGCACC GGCGGCCTTG

251 GCTTTTTCCG AAGGGAAAAA ACTGGCCACA AACGGCGTTG CCACACCCAA

301 TGCTGCCACT CCGCCCGCGC CGCAGGTCGC GAGTGTCAGG AAACGGCGGC

351 GGCCGTTGTT GATTTCTTGA TTATCCATTA TTCAGTCGTC CTAATATTTT

401 GGGAATACCG AGCCATTAAA CGTTGCAATT TTACCCAGTT TGCAGTGATA

451 CTCAAAGCAT TATTTAAAAT AAGGTAA
```

This corresponds to the amino acid sequence <SEQ ID 1864; ORF 594.a>:

```
    a594.pep

1 MGADTDGDKD VRLNRTGLVF SILRLLFRIG IGIGKFAVQA FQVFKLLICT

51 VEHPNRFALP LGGQQLTRFD FTDIHLDGST GGLGFFRREK TGHKRRCHTQ

101 CCHSARAAGR ECQETAAAVV DFLIIHYSVV LIFWEYRAIK RCNFTQFAVI

151 LKALFKIR* m594/a594   100.0% identity in 158 aa overlap 10         20         30         40         50         60
    m594.pep    MGADTDGDKDVRLNRTGLVFSILRLLFRIGIGIGKFAVQAFQVFKLLICTVEHPNRFALP
                ||||||||||||||||||||||||||||||||||||||||||||||||||||||||||||
    a594        MGADTDGDKDVRLNRTGLVFSILRLLFRIGIGIGKFAVQAFQVFKLLICTVEHPNRFALP
                    10         20         30         40         50         60

70         80         90        100        110        120
    m594.pep    LGGQQLTRFDFTDIHLDGSTGGLGFFRREKTGHKRRCHTQCCHSARAAGRECQETAAAVV
                ||||||||||||||||||||||||||||||||||||||||||||||||||||||||||||
    a594        LGGQQLTRFDFTDIHLDGSTGGLGFFRREKTGHKRRCHTQCCHSARAAGRECQETAAAVV
                    70         80         90        100        110        120
```

```
                        130        140        150    159
m594.pep    DFLIIHYSVVLIFWEYRAIKRCNFTQFAVILKALFKIRX
            ||||||||||||||||||||||||||||||||||||||
a594        DFLIIHYSVVLIFWEYRAIKRCNFTQFAVILKALFKIRX
                        130        140        150
```

The following partial DNA sequence was identified in *N. gonorrhoeae* <SEQ ID 1865>:

```
g595.seq..
    1 atgagaaaat tcaatttgac cgcattgtcc gtgatgcttg ccttgggttt
   51 gaccgcgtgc cagccgccgg aggcggagaa agccgcgccg gccgcgtccg
  101 gtgagaccca atccgccaac gaaggcggtt cggtcggtat cgccgtcaac
  151 gacaatgcct gcgaaccgat gaatctgacc gtgccgagcg gacaggttgt
  201 gttcaatatt aaaaacaaca gcggccgcaa gctcgaatgg gaaatcctga
  251 agggcgtgat ggtggtggac gaacgcgaaa atatcgcccc ggggctttcc
  301 gacaaaatga accgtaacct gctgccgggc gaatacgaaa tgacctgcgg
  351 ccttttgacc aatccgcgcg gcaagctggt ggtagccgac agcggcttta
  401 aagacaccgc caacgaagcg gatttggaaa aactgccccca accgctcgcc
  451 gactataaag cctacgttca aggcgaggtt aaagagctgg cggcgaaaac
  501 caaaaccttt accgaagccg tcaaagcagg cgacattgaa aaggcgaaat
  551 ccctgttttgc cgccacccgc gtccattacg aacgcatcga accgattgcc
  601 gagcttttca gcgaactcga ccccgtcatc gatgcgtgtg aagacgactt
  651 caaagacggt gcgaaagatg ccgggtttac cggcttccac cgtatcgaac
  701 acgccctttg ggtggaaaaa gacgtatccg gcgtgaagga aaccgcggcc
  751 aaactgatga ccgatgtcga agccctgcaa aaagaaatcg acgcattggc
  801 gttccctccg ggcaaagtgg tcggcggcgc gtccgaactg attgaagaag
  851 cggcgggcag taaaatcagc ggcgaagaag accgttacag ccacaccgat
  901 ttgagcgact ccaagctaa tgcggacgga tctaaaaaaa tcgtcgattt
  951 gttccgtccg ttgattgagg ccaaaaacaa agccttgttg gaaaaaaccg
 1001 ataccaactt caaacaggtc aacgaaattc tggcgaaata ccgcaccaaa
 1051 gacggttttg aaacctacga caagctgagc gaagccgacc gcaaagcatt
 1101 acaggctcct attaacgcgc ttgccgaaga ccttgcccaa cttcgcggca
 1151 tactcggctt gaaataa
```

This corresponds to the amino acid sequence <SEQ ID 1866; ORF 595.ng>:

```
g595.pep ..
    1 MRKFNLTALS VMLALGLTAC QPPEAEKAAP AASGETQSAN EGGSVGIAVN
   51 DNACEPMNLT VPSGQVVFNI KNNSGRKLEW EILKGVMVVD ERENIAPGLS
  101 DKMNRNLLPG EYEMTCGLLT NPRGKLVVAD SGFKDTANEA DLEKLPQPLA
  151 DYKAYVQGEV KELAAKTKTF TEAVKAGDIE KAKSLFAATR VHYERIEPIA
  201 ELFSELDPVI DACEDDFKDG AKDAGFTGFH RIEHALWVEK DVSGVKETAA
  251 KLMTDVEALQ KEIDALAFPP GKVVGGASEL IEEAAGSKIS GEEDRYSHTD
```

```
301 LSDFQANADG SKKIVDLFRP LIEAKNKALL EKTDTNFKQV NEILAKYRTK

351 DGFETYDKLS EADRKALQAP INALAEDLAQ LRGILGLK*
```

The following partial DNA sequence was identified in *N. meningitidis* <SEQ ID 1867>:

```
m595.seq
    1 ATGAGAAAAT TCAATTTGAC CGCATTGTCC GTGATGCTTG CCTTAGGTTT

51 GACCGCGTGC CAGCCGCCGG AGGCGGAGAA AGCTGCGCCG GCAGCGTCCG

101 GTGAGGCGCA AACCGCCAAC GAGGGCGGTT CGGTCAGTAT CGCCGTCAAC

151 GACAATGCCT GCGAACCGAT GGAACTGACC GTGCCGAGCG GACAGGTTGT

201 GTTCAATATT AAAAACAACA GCGGCCGCAA GCTCGAATGG GAAATCCTGA

251 AAGGCGTGAT GGTGGTGGAC GAGCGCGAAA ACATCGCCCC CGGACTTTCC

301 GATAAAATGA CCGTCACCCT GTTGCCGGGC GAATACGAAA TGACTTGCGG

351 TCTTTTGACC AATCCGCGCG GCAAGCTGGT GGTAACCGAC AGCGGCTTTA

401 AAGACACCGC CAACGAAGCG GATTTGGAAA AACTGTCCCA ACCGCTCGCC

451 GACTATAAAG CCTACGTTCA AGGCGAGGTT AAAGAGCTGG TGGCGAAAAC

501 CAAAACTTTT ACCGAAGCCG TCAAAGCAGG CGACATTGAA AAGGCGAAAT

551 CCCTGTTTGC CGACACCCGC GTCCATTACG AACGCATCGA ACCGATTGCC

601 GAGCTTTTCA GCGAACTCGA CCCCGTCATC GATGCGCGTG AAGACGACTT

651 CAAAGACGGC GCGAAAGATG CCGGATTTAC CGGCTTTCAC CGTATCGAAT

701 ACGCCCTTTG GGTGGAAAAA GACGTGTCCG GCGTGAAGGA AATTGCAGCG

751 AAACTGATGA CCGATGTCGA AGCCCTGCAA AAAGAAATCG ACGCATTGGC

801 GTTTCCTCCG GGCAAGGTGG TCGGCGGCGC GTCCGAACTG ATTGAAGAAG

851 TGGCGGGCAG TAAAATCAGC GGCGAAGAAG ACCGGTACAG CCACACCGAT

901 TTGAGCGACT TCCAAGCCAA TGTGGACGGA TCTAAAAAAA TCGTCGATTT

951 GTTCCGTCCG CTGATCGAGG CCAAAAACAA AGCCTTGTTG GAAAAAACCG

1001 ATACCAACTT CAAACAGGTC AACGAAATTC TGGCGAAATA CCGGACTAAA

1051 GACGGTTTTG AAACCTACGA CAAGCTGGGC GAAGCCGACC GCAAAGCGTT

1101 ACAGGCCTCT ATTAACGCGC TTGCCGAAGA CCTTGCCCAA CTTCGCGGCA

1151 TACTCGGCTT GAAATAA
```

This corresponds to the amino acid sequence <SEQ ID 1868; ORF 595>:

```
m595.pep
    1 MRKFNLTALS VMLALGLTAC QPPEAEKAAP AASGEAQTAN EGGSVSIAVN

51 DNACEPMELT VPSGQVVFNI KNNSGRKLEW EILKGVMVVD ERENIAPGLS

101 DKMTVTLLPG EYEMTCGLLT NPRGKLVVTD SGFKDTANEA DLEKLSQPLA

151 DYKAYVQGEV KELVAKTKTF TEAVKAGDIE KAKSLFADTR VHYERIEPIA

201 ELFSELDPVI DAREDDFKDG AKDAGFTGFH RIEYALWVEK DVSGVKEIAA

251 KLMTDVEALQ KEIDALAFPP GKVVGGASEL IEEVAGSKIS GEEDRYSHTD

301 LSDFQANVDG SKKIVDLFRP LIEAKNKALL EKTDTNFKQV NEILAKYRTK

351 DGFETYDKLG EADRKALQAS INALAEDLAQ LRGILGLK*
```

Computer analysis of this amino acid sequence gave the following results:

Homology with a Predicted ORF from N. gonorrhoeae

```
m595/g595  95.4% identity in 388 aa overlap 10        20        30        40        50        60
m595.pep  MRKFNLTALSVMLALGLTACQPPEAEKAAPAASGEAQTANEGGSVSIAVNDNACEPMELT
          |||||||||||||||||||||||||||||||:|:||||||:||||||||||||||||:||
g595      MRKFNLTALSVMLALGLTACQPPEAEKAAPAASGETQSANEGGSVGIAVNDNACEPMNLT
                  10        20        30        40        50        60

70        80        90       100       110       120
m595.pep  VPSGQVVFNIKNNSGRKLEWEILKGVMVVDERENIAPGLSDKMTVTLLPGEYEMTCGLLT
          ||||||||||||||||||||||||||||||||||||||||||:||:||||||||||||||
g595      VPSGQVVFNIKNNSGRKLEWEILKGVMVVDERENIAPGLSDKMNRNLLPGEYEMTCGLLT
                  70        80        90       100       110       120

130       140       150       160       170       180
m595.pep  NPRGKLVVTDSGFKDTANEADLEKLSQPLADYKAYVQGEVKELVAKTKTFTEAVKAGDIE
          ||||||||:|||||||||||||||||:|||||||||||||||||:|||||||||||||||
g595      NPRGKLVVADSGFKDTANEADLEKLPQPLADYKAYVQGEVKELAAKTKTFTEAVKAGDIE
                 130       140       150       160       170       180

190       200       210       220       230       240
m595.pep  KAKSLFADTRVHYERIEPIAELFSELDPVIDAREDDFKDGAKDAGFTGFHRIEYALWVEK
          ||||||| ||||||||||||||||||||||||:||||||||||||||||||||:||||||
g595      KAKSLFAATRVHYERIEPIAELFSELDPVIDACEDDFKDGAKDAGFTGFHRIEHALWVEK
                 190       200       210       220       230       240

250       260       270       280       290       300
m595.pep  DVSGVKEIAAKLMTDVEALQKEIDALAFPPGKVVGGASELIEEVAGSKISGEEDRYSHTD
          ||||||| ||||||||||||||||||||||||||||||||||||:|||||||||||||||
g595      DVSGVKETAAKLMTDVEALQKEIDALAFPPGKVVGGASELIEEAAGSKISGEEDRYSHTD
                 250       260       270       280       290       300

310       320       330       340       350       360
m595.pep  LSDFQANVDGSKKIVDLFRPLIEAKNKALLEKTDTNFKQVNEILAKYRTKDGFETYDKLG
          |||||||:|||||||||||||||||||||||||||||||||||||||||||||||||||:
g595      LSDFQANADGSKKIVDLFRPLIEAKNKALLEKTDTNFKQVNEILAKYRTKDGFETYDKLS
                 310       320       330       340       350       360

370       380       389
m595.pep  EADRKALQASINALAEDLAQLRGILGLKX
          |||||||||  ||||||||||||||||||
g595      EADRKALQAPINALAEDLAQLRGILGLKX
                 370       380
```

The following partial DNA sequence was identified in N. meningitidis <SEQ ID 1869>:

```
a595.seq
    1  ATGAGAAAAT TCAATTTGAC CGCATTGTCC GTGATGCTTG CCTTAGGTTT

51  GACCGCGTGC CAGCCGCCGG AGGCGGAGAA AGCTGCGCCG GCAGCGTCCG

101  GTGAGGCGCA AACCGCCAAC GAGGGCGGTT CGGTCAGTAT CGCCGTCAAC

151  GACAATGCCT GCGAACCGAT GGAACTGACC GTGCCGAGCG GACAGGTTGT

201  GTTCAATATT AAAAACAACA GCGGCCGCAA GCTCGAATGG GAAATCCTGA

251  AAGGCGTGAT GGTGGTGGAC GAGCGCGAAA ACATCGCCCC CGGACTTTCC

301  GATAAAATGA CCGTCACCCT GTTGCCGGGC GAATACGAAA TGACTTGCGG

351  TCTTTTGACC AATCCGCGCG GCAAGCTGGT GGTAACCGAC AGCGGCTTTA

401  AAGACACCGC CAACGAAGCG GATTTGGAAA AACTGTCCCA ACCGCTCGCC

451  GACTATAAAG CCTATGTTCA AGGCGAAGTC AAAGAGCTGG TGGCGAAAAC

501  CAAAACCTTT ACCGAAGCCG TCAAAGCAGG CGACATTGAA AAGGCGAAAT

551  CCCTGTTTGC CGACACCCGC GTCCATTACG AACGCATCGA ACCGATTGCC

601  GAGCTTTTCA GCGAACTCGA CCCCGTCATC GATGCGCGTG AAGACGACTT

651  CAAAGACGGC GCGAAAGATG CCGGATTTAC CGGCTTCCAC CGTATCGAAT

701  ACGCCCTTTG GGTGGAAAAA GACGTGTCCG GCGTGAAGGA AATTGCAGCG
```

```
-continued
 751 AAACTGATGA CCGATGTCGA AGCCCTGCAA AAAGAAATCG ACGCATTGGC

801 GTTTCCTCCG GGCAAGGTGG TCGGCGGCGC GTCCGAACTG ATTGAAGAAG

851 TGGCGGGCAG TAAAATCAGC GGCGAAGAAG ACCGGTACAG CCACACCGAT

901 TTGAGCGACT TCCAAGCCAA TGTGGACGGA TCGAAAAAAA TCGTCGATTT

951 GTTCCGTCCG TTGATCGAGA CCAAAAACAA AGCCTTGTTG GAAAAAACCG

1001 ATACCAACTT CAAACAGGTC AACGAAATTC TGGCGAAATA CCGGACTAAA

1051 GACGGTTTTG AAACCTACGA CAAGCTGGGC GAAGCCGACC GCAAAGCGTT

1101 ACAGGCCTCT ATTAACGCGC TTGCCGAAGA CCTTGCCCAA CTTCGCGGCA

1151 TACTCGGCTT GAAATAA
```

This corresponds to the amino acid sequence <SEQ ID 1870; ORF 595.a>:

```
a595.pep

1   MRKFNLTALS VMLALGLTAC QPPEAEKAAP AASGEAQTAN EGGSVSIAVN

51   DNACEPMELT VPSGQVVFNI KNNSGRKLEW EILKGVMVVD ERENIAPGLS

101   DKMTVTLLPG EYEMTCGLLT NPRGKLVVTD SGFKDTANEA DLEKLSQPLA

151   DYKAYVQGEV KELVAKTKTF TEAVKAGDIE KAKSLFADTR VHYERIEPIA

201   ELFSELDPVI DAREDDFKDG AKDAGFTGFH RIEYALWVEK DVSGVKEIAA

251   KLMTDVEALQ KEIDALAFPP GKVVGGASEL IEEVAGSKIS GEEDRYSHTD

301   LSDFQANVDG SKKIVDLFRP LIETKNKALL EKTDTNFKQV NEILAKYRTK

351   DGFETYDKLG EADRKALQAS INALAEDLAQ LRGILGLK* m595/a595  99.7% identity in 388 aa overlap 10         20         30         40         50         60
m595.pep  MRKFNLTALSVMLALGLTACQPPEAEKAAPAASGEAQTANEGGSVSIAVNDNACEPMELT
          ||||||||||||||||||||||||||||||||||||||||||||||||||||||||||||
a595      MRKFNLTALSVMLALGLTACQPPEAEKAAPAASGEAQTANEGGSVSIAVNDNACEPMELT
                 10         20         30         40         50         60

70         80         90        100        110        120
m595.pep  VPSGQVVFNIKNNSGRKLEWEILKGVMVVDERENIAPGLSDKMTVTLLPGEYEMTCGLLT
          ||||||||||||||||||||||||||||||||||||||||||||||||||||||||||||
a595      VPSGQVVFNIKNNSGRKLEWEILKGVMVVDERENIAPGLSDKMTVTLLPGEYEMTCGLLT
                 70         80         90        100        110        120

130        140        150        160        170        180
m595.pep  NPRGKLVVTDSGFKDTANEADLEKLSQPLADYKAYVQGEVKELVAKTKTFTEAVKAGDIE
          ||||||||||||||||||||||||||||||||||||||||||||||||||||||||||||
a595      NPRGKLVVTDSGFKDTANEADLEKLSQPLADYKAYVQGEVKELVAKTKTFTEAVKAGDIE
                130        140        150        160        170        180

190        200        210        220        230        240
m595.pep  KAKSLFADTRVHYERIEPIAELFSELDPVIDAREDDFKDGAKDAGFTGFHRIEYALWVEK
          ||||||||||||||||||||||||||||||||||||||||||||||||||||||||||||
a595      KAKSLFADTRVHYERIEPIAELFSELDPVIDAREDDFKDGAKDAGFTGFHRIEYALWVEK
                190        200        210        220        230        240

250        260        270        280        290        300
m595.pep  DVSGVKEIAAKLMTDVEALQKEIDALAFPPGKVVGGASELIEEVAGSKISGEEDRYSHTD
          ||||||||||||||||||||||||||||||||||||||||||||||||||||||||||||
a595      DVSGVKEIAAKLMTDVEALQKEIDALAFPPGKVVGGASELIEEVAGSKISGEEDRYSHTD
                250        260        270        280        290        300

310        320        330        340        350        360
m595.pep  LSDFQANVDGSKKIVDLFRPLIEAKNKALLEKTDTNFKQVNEILAKYRTKDGFETYDKLG
          |||||||||||||||||||||||| :||||||||||||||||||||||||||||||||||
a595      LSDFQANVDGSKKIVDLFRPLIETKNKALLEKTDTNFKQVNEILAKYRTKDGFETYDKLG
                310        320        330        340        350        360

370        380        389
m595.pep  EADRKALQASINALAEDLAQLRGILGLKX
          |||||||||||||||||||||||||||||
a595      EADRKALQASINALAEDLAQLRGILGLKX
                370        380
```

The following partial DNA sequence was identified in *N. gonorrhoeae* <SEQ ID 1871>:

```
g596.seq.(partial).
   1 ..atgctgtct tggacgagcc gaccaaccac ttggatgcgg aatcggtgga
  51   atggctggag caattcctcg tgcgcttccc cggcacagtg gtcgcggtaa
 101   cgcacgaccg ctacttcctc gacaacgccg ccgaatggat tttggaactc
 151   gaccgcggac acggcattcc gtggaaaggc aattactcgt cttggctgga
 201   gcagaaagaa aaacgcttgg aaaacgaggc gaaatccgaa gccgcgcgcg
 251   tgaaggcgat gaagcaggaa ttggaatggg tgcgccaaaa tgccaaaggc
 301   cgccaagcca agcccaaagc gcgtttggcg cgttttgaag aaatgagcaa
 351   ctacgaatac caaaaacgca acgaaactca ggaaatcttt atccctgttg
 401   ccgagcgttt gggtaacgaa gtgattgaat ttgtgaatgt ttccaaatcg
 451   ttcggcgata aagtgctgat tgacggtttg agcttcaaag tgccggcggg
 501   cgcgattgtc ggcatcatcg gcccgaacgg cgcgggtaaa tcgacgctgt
 551   tcaaaatgat tgcgggcaaa gagcagcccg attcgggcga agtgaaaatc
 601   gggcaaaccg tgaaaatgag cttgattgac caaagccgcg aaggtttgca
 651   aaacgacaaa accgtgttcg acaacattgc cgaaggtcgc gatattttgc
 701   aggtcggaca gtttgaaatc cccgcccgcc aatatttggg acgcttcaac
 751   tttaaaggca gcgaccaaag caaaatcgca aggcagcttt ccggcggcga
 801   acgcggccgt ctgcacttgg caaaaacctt gttgggcggc ggcaatgtgt
 851   tgctgctgga cgaaccgtcc aacgatctcg acgtggaaac cctgcgcgcg
 901   ttggaagacg cattgttgga atttgccggc agcgtgatgg tgatttcgca
 951   cgaccgctgg tttctcgacc gcatagccac gcatatcttg gcgtgtgaag
1001   gcgactccaa atgggtgttc ttcgacggca actatcaaga atacgaagcc
1051   gacaagaaac gccgactcgg caaagaaggc gcgaaaccga aacgcatcaa
1101   atacaaaccg gtaacgcgtt aa
```

This corresponds to the amino acid sequence <SEQ ID 1872; ORF 596.ng>:

```
g596.pep (partial).
   1 ..MLLLDEPTNH LDAESVEWLE QFLVRFPGTV VAVTHDRYFL DNAAEWILEL
  51   DRGHGIPWKG NYSSWLEQKE KRLENEAKSE AARVKAMKQE LEWVRQNAKG
 101   RQAKPKARLA RFEEMSNYEY QKRNETQEIF IPVAERLGNE VIEFVNVSKS
 151   FGDKVLIDGL SFKVPAGAIV GIIGPNGAGK STLFKMIAGK EQPDSGEVKI
 201   GQTVKMSLID QSREGLQNDK TVFDNIAEGR DILQVGQFEI PARQYLGRFN
 251   FKGSDQSKIA RQLSGGERGR LHLAKTLLGG GNVLLLDEPS NDLDVETLRA
 301   LEDALLEFAG SVMVISHDRW FLDRIATHIL ACEGDSKWVF FDGNYQEYEA
 351   DKKRRLGKEG AKPKRIKYKP VTR*
```

The following partial DNA sequence was identified in *N. meningitidis* <SEQ ID 1873>:

```
m596.seq..
   1    ATGTCCCAAC AATACGTCTA TTCTATGCTG CGCGTGAGCA AGGTTGTGCC
```

```
  51 GCCGCAGAAA ACCATCATTA AAGATATTTC CCTTTCTTTC TTCCCCGGCG

101 CGAAAATCGG CCTGCTCGGT TTGAACGGCG CGGGCAAGTC CACCGTGCTG

151 CGGATTATGG CGGGCGTGGA TAAGGAATTT GAGGGCGAAG CCGTGCCGAT

201 GGGCGGCATC AAAATCGGCT ACCTGCCGCA AGAGCCTGAG CTTGATCCGG

251 AAAAAACCGT GCGCGAGGAA GTGGAAAGCG GTTTGGGCGA AGTGGCTGCC

301 GCGCAGAAAC GTTTGGAAGA AGTGTATGCC GAGTACGCCA ATCCTGATGC

351 GGATTTTGAC GCGTTGGCAG AAGAGCAGGG CCGCTTGGAA GCGATTATTG

401 CGGCAGGTTC GTCCACGGGC GGCGGTGCGG AACACGAATT GGAAATCGCC

451 GCCGACGCGC TGCGCCTGCC GGAATGGGAT GCCAAAATCG ATAATTTGTC

501 CGGCGGTGAA AACGCCGCG TTGCCTTGTG CAAACTCTTG TTGAGCAAGC

551 CCGATATGCT TTTGCTGGAC GAGCCGACCA ACCACTTGGA TGCGGAATCG

601 GTCGAGTGGC TGGAGCAATT TCTCGTGCGC TTCCCCGGCA CAGTCGTTGC

651 GGTAACGCAC GACCGCTACT TCCTCGACAA CGCCGCCGAA TGGATTTTGG

701 AACTCGACCG CGGCCATGGT ATTCCGTGGA AAGGCAATTA CTCGTCTTGG

751 CTGGAGCAGA AAGAAAAACG CTTGGAAAAC GAGGCAAAAT CCGAAGCCGC

801 GCGCGTGAAG GCGATGAAGC AGGAATTGGA ATGGGTGCGC CAAAATGCCA

851 AAGGCCGCCA AGCCAAGTCC AAAGCGCGTT TGGCTCGTTT TGAAGAAATG

901 AGCAACTACG AATACCAAAA ACGCAATGAA ACGCAGGAAA TCTTTATTCC

951 CGTTGCCGAG CGTTTGGGTA ACGAAGTGAT TGAATTTGTA AATGTTTCCA

1001 AATCGTTCGG CGATAAAGTG CTGATTGACG ATTTGAGCTT CAAAGTGCCT

1051 GCGGGCGCGA TTGTCGGCAT CATCGGCCCG AACGGCGCGG GTAAATCTAC

1101 GCTGTTCAAA ATGATTTCGG GCAAAGAGCA GCCTGATTCC GGCGAGGTGA

1151 AAATCGGACA AACCGTGAAA ATGAGCTTGA TTGACCAAAG CCGCGAAGGT

1201 TTGCAAAACG ACAAAACCGT GTTCGACAAC ATTGCCGAAG CCGCGACAT

1251 TTTGCAGGTT GGTCAGTTTG AAATTCCCGC CGCCAATAT TTGGGGCGTT

1301 TCAACTTCAA AGGCAGCGAC AAAGCAAAA TTGCAGGTCA ATTGTCTGGC

1351 GGCGAACGCG GTCGTCTGCA CTTGGCAAAA ACCTTGTTGA GCGGCGGCAA

1401 TGTATTGCTG CTGGATGAAC CGTCTAACGA CCTTGACGTG GAAACCCTGC

1451 GCGCGTTGGA AGACGCATTG TTGGAATTTG CCGGCAGCGT GATGGTGATT

1501 TCGCACGACC GTTGGTTCCT CGACCGCATC GCCACGCATA TCTTGGCGTG

1551 TGAAGGCGAC TCTAAATGGG TGTTCTTCGA CGGCAACTAT CAGGAATACG

1601 AAGCCGACAA GAAACGCCGT TTGGGCGAAG AAGGCGCGAA ACCGAAACGC

1651 ATCAAATACA AACCGGTAAC GCGTTAA
```

This corresponds to the amino acid sequence <SEQ ID 1874; ORF 596>:

```
m596.pep..
  1 MSQQYVYSML RVSKVVPPQK TIIKDISLSF FPGAKIGLLG LNGAGKSTVL

51 RIMAGVDKEF EGEAVPMGGI KIGYLPQEPE LDPEKTVREE VESGLGEVAA

101 AQKRLEEVYA EYANPDADFD ALAEEQGRLE AIIAAGSSTG GGAEHELEIA

151 ADALRLPEWD AKIDNLSGGE KRRVALCKLL LSKPDMLLLD EPTNHLDAES
```

```
201 VEWLEQFLVR FPGTVVAVTH DRYFLDNAAE WILELDRGHG IPWKGNYSSW

251 LEQKEKRLEN EAKSEAARVK AMKQELEWVR QNAKGRQAKS KARLARFEEM

301 SNYEYQKRNE TQEIFIPVAE RLGNEVIEFV NVSKSFGDKV LIDDLSFKVP

351 AGAIVGIIGP NGAGKSTLFK MISGKEQPDS GEVKIGQTVK MSLIDQSREG

401 LQNDKTVFDN IAEGRDILQV GQFEIPARQY LGRFNFKGSD QSKIAGQLSG

451 GERGRLHLAK TLLSGGNVLL LDEPSNDLDV ETLRALEDAL LEFAGSVMVI

501 SHDRWFLDRI ATHILACEGD SKWVFFDGNY QEYEADKKRR LGEEGAKPKR

551 IKYKPVTR*
```

Computer analysis of this amino acid sequence gave the following results:
Homology with a Predicted ORF from *N. gonorrhoeae*

```
  m596 g596   98.4% identity in 373 aa overlap
                160       170       180       190       200       210
    m596.pep LPEWDAKIDNLSGGEKRRVALCKLLLSKPDMLLLDEPTNHLDAESVEWLEQFLVRFPGTV
                                          ||||||||||||||||||||||||||||||
        g596                              MLLLDEPTNHLDAESVEWLEQFLVRFPGTV
                                                  10        20        30
                220       230       240       250       260       270
    m596.pep VAVTHDRYFLDNAAEWILELDRGHGIPWKGNYSSWLEQKEKRLENEAKSEAARVKAMKQE
             ||||||||||||||||||||||||||||||||||||||||||||||||||||||||||||
        g596 VAVTHDRYFLDNAAEWILELDRGHGIPWKGNYSSWLEQKEKRLENEAKSEAARVKAMKQE
                40        50        60        70        80        90
                280       290       300       310       320       330
    m596.pep LEWVRQNAKGRQAKSKARLARFEEMSNYEYQKRNETQEIFIPVAERLGNEVIEFVNVSKS
             |||||||||||||||:||||||||||||||||||||||||||||||||||||||||||||
        g596 LEWVRQNAKGRQAKPKARLARFEEMSNYEYQKRNETQEIFIPVAERLGNEVIEFVNVSKS
                 100       110       120       130       140       150
                340       350       360       370       380       390
    m596.pep FGDKVLIDDLSFKVPAGAIVGIIGPNGAGKSTLFKMISGKEQPDSGEVKIGQTVKMSLID
             ||||||||:|||||||||||||||||||||||||||:|||||||||||||||||||||||
        g596 FGDKVLIDGLSFKVPAGAIVGIIGPNGAGKSTLFKMIAGKEQPDSGEVKIGQTVKMSLID
                 160       170       180       190       200       210
                400       410       420       430       440       450
    m596.pep QSREGLQNDKTVFDNIAEGRDILQVGQFEIPARQYLGRFNFKGSDQSKIAGQLSGGERGR
             ||||||||||||||||||||||||||||||||||||||||||||||||||||:|||||||
        g596 QSREGLQNDKTVFDNIAEGRDILQVGQFEIPARQYLGRFNFKGSDQSKIARQLSGGERGR
                 220       230       240       250       260       270
                460       470       480       490       500       510
    m596.pep LHLAKTLLSGGNVLLLDEPSNDLDVETLRALEDALLEFAGSVMVISHDRWFLDRIATHIL
             ||||||||:||||||||||||||||||||||||||||||||||||||||||||||||||
        g596 LHLAKTLLGGGNVLLLDEPSNDLDVETLRALEDALLEFAGSVMVISHDRWFLDRIATHIL
                 280       290       300       310       320       330
                520       530       540       550     559
    m596.pep ACEGDSKWVFFDGNYQEYEADKKRRLGEEGAKPKRIKYKPVTRX
             |||||||||||||||||||||||||||:||||||||||||||||
        g596 ACEGDSKWVFFDGNYQEYEADKKRRLGKEGAKPKRIKYKPVTRX
                 340       350       360       370
```

The following partial DNA sequence was identified in *N. meningitidis* <SEQ ID 1875>:

```
a596.seq
    1 ATGTCCCAAC AATACGTCTA TTCTATGCTG CGCGTGAGCA AGGTTGTGCC

51 GCCGCAGAAA ACCATCATTA AAGATATTTC CCTTTCTTTC TTCCCCGGCG

101 CGAAAATCGG TTTGCTCGGT TGAACGGCG CGGGCAAGTC CACCGTGCTG

151 CGGATTATGG CGGGCGTGGA TAAAGAATTT GAGGGCGAAG CCGTGCCGAT

201 GGGCGGTATT AAAATCGGCT ACCTGCCGCA AGAGCCTGAG CTTGATCCGG

251 AAAAAACCGT GCGTGAGGAA GTGGAAAGCG GTTTGGGCGA AGTGGCTGCC
```

-continued

```
 301 GCGCAGAAAC GTTTGGAGGA AGTGTATGCC GAGTACGCCA ATCCCGATGC

351 GGATTTTGAC GCGTTGGCGG AAGAGCAGGG GCGTTTGGAA GCGATTATTG

401 CGGCGGGTTC GTCCACGGGC GGCGGTGCGG AACACGAATT GGAAATCGCT

451 GCCGACGCGC TGCGCCTGCC GGAATGGGAT GCCAAAATCG ATAATTTGTC

501 CGGCGGTGAA AAACGCCGCG TCGCTTTGTG CAAACTCTTG TTGAGCAAGC

551 CCGATATGCT TTTGCTGGAC GAGCCGACCA ACCACTTGGA TGCGGAATCG

601 GTCGAGTGGC TGGAGCAATT TCTCGTGCGC TTCCCCGGTA CAGTCGTTGC

651 CGTAACACAC GACCGCTACT TCCTCGACAA CGCCGCCGAA TGGATTTTGG

701 AACTCGACCG CGGGCACGGT ATTCCGTGGA AGGAAATTA CTCGTCTTGG

751 TTGGAGCAGA AGAAAAACG TTTGGAAAAC GAGGCGAAAT CCGAAGCCGC

801 GCGCGTGAAA GCGATGAAGC AGGAATTGGA ATGGGTGCGC CAAAATGCCA

851 AAGGCCGTCA AGCCAAGTCC AAAGCGCGTT TGGCGCGTTT TGAAGAAATG

901 AGCAACTATG AATACCAAAA ACGCAATGAA ACGCAGGAAA TCTTCATTCC

951 CGTCGCCGAG CGTTTGGGTA ACGAAGTGAT TGAATTTGTG AATGTTTCCA

1001 AATCGTTCGG CGACAAAGTG CTGATTGACG ATTTGAGCTT CAAAGTGCCT

1051 GCGGGCGCGA TTGTCGGCAT CATCGGTCCG AACGGCGCGG GTAAATCGAC

1101 ACTGTTTAAA ATGATTGCGG GCAAAGAGCA GCCCGATTCC GGTGAAGTGA

1151 AAATCGGGCA AACCGTGAAA ATGAGCTTGA TTGACCAAAG CCGCGAAGGT

1201 TTGCAAAACG ACAAAACCGT GTTCGACAAC ATTGCCGAAG GTCGCGATAT

1251 TTTACAGGTC GGGCAGTTTG AAATCCCCGC CGCCAATAT TTGGGACGCT

1301 TCAATTTCAA AGGCAGCGAC CAAAGCAAAA TCACGGGGCA GCTTTCCGGC

1351 GGCGAACGCG GACGTTTGCA CTTGGCAAAA ACCTTGTTGG GCGGTGGCAA

1401 TGTGTTGCTG CTGGACGAAC CGTCCAACGA CCTCGACGTG GAAACCCTGC

1451 GCGCGTTGGA AGACGCATTG CTGGAATTTG CCGGCAGCGT GATGGTGATT

1501 TCGCACGACC GCTGGTTCCT CGACCGTATT GCTACGCATA TCTTGGCTTG

1551 CGAAGGCGAC TCCAAATGGG TGTTCTTTGA CGGCAACTAT CAGGAATACG

1601 AAGCCGACAA GAAACGCCGA CTCGGCGAAG AAGGCACGAA ACCGAAACGC

1651 ATCAAATACA AACCGGTAAC GCGTTAA
```

This corresponds to the amino acid sequence <SEQ ID 1876; ORF 596.a>:

```
a596.pep

1 MSQQYVYSML RVSKVVPPQK TIIKDISLSF FPGAKIGLLG LNGAGKSTVL

51 RIMAGVDKEF EGEAVPMGGI KIGYLPQEPE LDPEKTVREE VESGLGEVAA

101 AQKRLEEVYA EYANPDADFD ALAEEQGRLE AIIAAGSSTG GGAEHELEIA

151 ADALRLPEWD AKIDNLSGGE KRRVALCKLL LSKPDMLLLD EPTNHLDAES

201 VEWLEQFLVR FPGTVVAVTH DRYFLDNAAE WILELDRGHG IPWKGNYSSW

251 LEQKEKRLEN EAKSEAARVK AMKQELEWVR QNAKGRQAKS KARLARFEEM

301 SNYEYQKRNE TQEIFIPVAE RLGNEVIEFV NVSKSFGDKV LIDDLSFKVP

351 AGAIVGIIGP NGAGKSTLFK MIAGKEQPDS GEVKIGQTVK MSLIDQSREG

401 LQNDKTVFDN IAEGRDILQV GQFEIPARQY LGRFNFKGSD QSKITGQLSG
```

```
451 GERGRLHLAK TLLGGGNVLL LDEPSNDLDV ETLRALEDAL LEFAGSVMVI

501 SHDRWFLDRI ATHILACEGD SKWVFFDGNY QEYEADKKRR LGEEGTKPKR

551 IKYKPVTR*
``` m596/a596  99.3% identity in 558 aa overlap

```
                  10         20         30         40         50         60
m596.pep  MSQQYVYSMLRVSKVVPPQKTIIKDISLSFFPGAKIGLLGLNGAGKSTVLRIMAGVDKEF
          ||||||||||||||||||||||||||||||||||||||||||||||||||||||||||||
a596      MSQQYVYSMLRVSKVVPPQKTIIKDISLSFFPGAKIGLLGLNGAGKSTVLRIMAGVDKEF
                  10         20         30         40         50         60

70         80         90        100        110        120
m596.pep  EGEAVPMGGIKIGYLPQEPELDPEKTVREEVESGLGEVAAAQKRLEEVYAEYANPDADFD
          ||||||||||||||||||||||||||||||||||||||||||||||||||||||||||||
a596      EGEAVPMGGIKIGYLPQEPELDPEKTVREEVESGLGEVAAAQKRLEEVYAEYANPDADFD
                  70         80         90        100        110        120

130        140        150        160        170        180
m596.pep  ALAEEQGRLEAIIAAGSSTGGGAEHELEIAADALRLPEWDAKIDNLSGGEKRRVALCKLL
          ||||||||||||||||||||||||||||||||||||||||||||||||||||||||||||
a596      ALAEEQGRLEAIIAAGSSTGGGAEHELEIAADALRLPEWDAKIDNLSGGEKRRVALCKLL
                 130        140        150        160        170        180

190        200        210        220        230        240
m596.pep  LSKPDMLLLDEPTNHLDAESVEWLEQFLVRFPGTVVAVTHDRYFLDNAAEWILELDRGHG
          ||||||||||||||||||||||||||||||||||||||||||||||||||||||||||||
a596      LSKPDMLLLDEPTNHLDAESVEWLEQFLVRFPGTVVAVTHDRYFLDNAAEWILELDRGHG
                 190        200        210        220        230        240

250        260        270        280        290        300
m596.pep  IPWKGNYSSWLEQKEKRLENEAKSEAARVKAMKQELEWVRQNAKGRQAKSKARLARFEEM
          ||||||||||||||||||||||||||||||||||||||||||||||||||||||||||||
a596      IPWKGNYSSWLEQKEKRLENEAKSEAARVKAMKQELEWVRQNAKGRQAKSKARLARFEEM
                 250        260        270        280        290        300

310        320        330        340        350        360
m596.pep  SNYEYQKRNETQEIFIPVAERLGNEVIEFVNVSKSFGDKVLIDDLSFKVPAGAIVGIIGP
          ||||||||||||||||||||||||||||||||||||||||||||||||||||||||||||
a596      SNYEYQKRNETQEIFIPVAERLGNEVIEFVNVSKSFGDKVLIDDLSFKVPAGAIVGIIGP
                 310        320        330        340        350        360

370        380        390        400        410        420
m596.pep  NGAGKSTLFKMISGKEQPDSGEVKIGQTVKMSLIDQSREGLQNDKTVFDNIAEGRDILQV
          |||||||||||||:||||||||||||||||||||||||||||||||||||||||||||||
a596      NGAGKSTLFKMIAGKEQPDSGEVKIGQTVKMSLIDQSREGLQNDKTVFDNIAEGRDILQV
                 370        380        390        400        410        420

430        440        450        460        470        480
m596.pep  GQFEIPARQYLGRFNFKGSDQSKIAGQLSGGERGRLHLAKTLLSGGNVLLLDEPSNDLDV
          |||||||||||||||||||||||||:||||||||||||||||:|||||||||||||||||
a596      GQFEIPARQYLGRFNFKGSDQSKITGQLSGGERGRLHLAKTLLGGGNVLLLDEPSNDLDV
                 430        440        450        460        470        480

490        500        510        520        530        540
m596.pep  ETLRALEDALLEFAGSVMVISHDRWFLDRIATHILACEGDSKWVFFDGNYQEYEADKKRR
          ||||||||||||||||||||||||||||||||||||||||||||||||||||||||||||
a596      ETLRALEDALLEFAGSVMVISHDRWFLDRIATHILACEGDSKWVFFDGNYQEYEADKKRR
                 490        500        510        520        530        540

550       559
m596.pep  LGEEGAKPKRIKYKPVTRX
          |||||:|||||||||||||
a596      LGEEGTKPKRIKYKPVTRX
                 550
```

The following partial DNA sequence was identified in *N. gonorrhoeae* <SEQ ID 1877>

```
g597.seq
   1  ATGCTGCTTC ATGTCAGCAA TTCCCTCAAA CAGCTTCAGG AAGAGCGTAT

51  CCGCCAAGAA CGTATCCGCC AAGAGCGTAT CCGTCAGGCG CGCGGCAACC

101  TTGCTTCCGT CAACCGCAAA CAGCGCGAGG CTTGGGACAA ATTCCAAAAA

151  CTCAATACCG AGCTGAACCG TTTGAAAACG GAAGTCGCCG CTACGAAAGC

201  GCAGATTTCC CGTTTCGTAT CGGGGAACTA TAAAAACAGC CGGCCGAATG

251  CGGTTGCCCT GTTCCTGAAA AACGCCGAAC CGGGTCAGAA AAACCGCTTT

301  TTGCGTTATA CGCGTTATGT AAACGCCTCC AATCGGGAAG TTGTCAAGGA
```

-continued

```
 351 TTTGGAAAAA CAGCAGAAGG CTTTGGCGGT ACAAGAGCAG AAAATCAACA

401 ATGAGCTTGC CCGTTTGAAG AAAATTCAGG CAAACGTGCA ATCCCTGCTG

451 AAAAAACAGG GTGTAACCGA TGCGGCGGAA CAGACGGAAA GCCGCAGACA

501 GAATGCCAAA ATCTCCAAAG ATGCCCGAAA ACTGCTGGAA CAGAAAGGGA

551 ACGAGCAGCA GCTGAACAAG CTCTTGAGCA ATTTGgagaa aaAAAaagcc 601 gaacaccgCA TTcaggAtgc ggAagcaaAA agaAAATTGG CTGAagcCaa 651 actGgcggca gccgAAAAAG CCAGAAAAGA AGCGGCGCAG CAGAAGGCTG

701 AAGCGCGACG TGCGGAAATG TCCAACCTGA CCGCCGAAGA CAGGAACATC

751 CAAGCGCCTT CGGTTATGGG TATCGGCAGT GCCGACGgTT TCAGCCGCAT

801 GCAGGGACGT TTGAAAAAAC CGGTTGACGG TGTGCCGACC GGGCTTTTCG

851 GGCAGAACCG GAGCGGcggC GATGTTTGGA AAGGCGTGTT CTATTCCACT

901 GCGCCTGCAA CGGTTGAAAG CATTGCGCcg gGAACggtaa GCTATGCGGA 951 cgaGTTGGAC GGCTACGGCA AAGTGGTCGT GATCGATCAC GGCGAGAACT

1001 ACATCAGCAT CTATGCCGGT TTGAGCGAAA TTTCCGCCGG CAAGGGTTAT

1051 ACGGTCGCGG CAGGAAGCAA AATCGGCACG AGCGGGTCGC TGCCGGACGG

1101 GGAAGAGGGG CTTTACCTGC AAATACGTTA TCGAGGTCAG GTGTTGAACC

1151 CTTCGGGCTG GATACGTTGA
```

This corresponds to the amino acid sequence <SEQ ID 1878; ORF 597>:

```
g597.pep
  1 MLLHVSNSLK QLQEERIRQE RIRQERIRQA RGNLASVNRK QREAWDKFQK

51 LNTELNRLKT EVAATKAQIS RFVSGNYKNS RPNAVALFLK NAEPGQKNRF

101 LRYTRYVNAS NREVVKDLEK QQKALAVQEQ KINNELARLK KIQANVQSLL

151 KKQGVTDAAE QTESRRQNAK ISKDARKLLE QKGNEQQLNK LLSNLEKKKA

201 EHRIQDAEAK RKLAEAKLAA AEKARKEAAQ QKAEARRAEM SNLTAEDRNI

251 QAPSVMGIGS ADGFSRMQGR LKKPVDGVPT GLFGQNRSGG DVWKGVFYST

301 APATVESIAP GTVSYADELD GYGKVVVIDH GENYISIYAG LSEISAGKGY

351 TVAAGSKIGT SGSLPDGEEG LYLQIRYRGQ VLNPSGWIR*
```

The following partial DNA sequence was identified in N. meningitidis <SEQ ID 1879>:

```
m597.seq
  1 ATGCTGCTTC ATGTCAGCAA TTCCCTCAAA CAGCTTCAGG AAGAGCGTAT

51 CCGCCAAGAG CGTATCCGTC AGGCGCGCGG CAACCTTGCT TCCGTCAACC

101 GCAAACAGCG CGAGGCTTGG GACAAGTTCC AAAAACTCAA TACCGAGCTG

151 AACCGTTTGA AAACGGAAGT CGCCGCTACG AAAGCGCAGA TTTCCCGTTT

201 CGTATCGGGG AACTATAAAA ACAGCCAGCC GAATGCGGTT GCCCTGTTCC

251 TGAAAAACGC CGAACCGGGT CAGAAAAACC GCTTTTTGCG TTATACGCGT

301 TATGTAAACG CCTCCAATCG GGAAGTTGTC AAGGATTTGG AAAAACAGCA

351 GAAGGCTTTG GCGGTACAAG AGCAGAAAAT CAACAATGAG CTTGCCCGTT

401 TGAAGAAAAT TCAGGCAAAC GTGCAATCTC TGCTGAAAAA ACAGGGTGTA
```

```
-continued
 451 ACCGATGCGG CGGAACAGAC GGAAAGCCGC AGACAGAATG CCAAAATCGC

501 CAAAGATGCC CGAAAACTGC TGGAACAGAA AGGGAACGAG CAGCAGCTGA

551 ACAAGCTCTT GAGCAATTTG GAGAAGAAAA AGGCCGAACA CCGCATTCAG

601 GATGCGGAAG CAAAAAGAAA ATTGGCTGAA GCCAGACTGG CGGCAGCCGA

651 AAAAGCCAGA AAAGAAGCGG CGCAGCAGAA GGCTGAAGCA CGACGTGCGG

701 AAATGTCCAA CCTGACCGCC GAAGACAGGA ACATCCAAGC GCCTTCGGTT

751 ATGGGTATCG GCAGTGCCGA CGGTTTCAGC CGCATGCAAG GACGTTTGAA

801 AAAACCGGTT GACGGTGTGC CGACCGGACT TTTCGGGCAG AACCGGAGCG

851 GCGGCGATAT TTGGAAAGGC GTGTTCTATT CCACTGCACC GGCAACGGTT

901 GAAAGCATTG CGCCGGGAAC GGTAAGCTAT GCGGACGAGT TGGACGGCTA

951 CGGCAAAGTG GTCGTGGTCG ATCACGGCGA GAACTACATC AGCATCTATG

1001 CCGGTTTGAG CGAAATTTCC GTCGGCAAGG GTTATATGGT CGCGGCAGGA

1051 AGCAAAATCG GCTCGAGCGG GTCGCTGCCG GACGGGGAAG AGGGGCTTTA

1101 CCTGCAAATA CGTTATCAAG GTCAGGTATT GAACCCTTCG AGCTGGATAC

1151 GTTGA
```

This corresponds to the amino acid sequence <SEQ ID 1880; ORF 597>:

```
m597.pep
   1 MLLHVSNSLK QLQEERIRQE RIRQARGNLA SVNRKQREAW DKFQKLNTEL

51 NRLKTEVAAT KAQISRFVSG NYKNSQPNAV ALFLKNAEPG QKNRFLRYTR

101 YVNASNREVV KDLEKQQKAL AVQEQKINNE LARLKKIQAN VQSLLKKQGV

151 TDAAEQTESR RQNAKIAKDA RKLLEQKGNE QQLNKLLSNL EKKKAEHRIQ

201 DAEAKRKLAE ARLAAAEKAR KEAAQQKAEA RRAEMSNLTA EDRNIQAPSV

251 MGIGSADGFS RMQGRLKKPV DGVPTGLFGQ NRSGGDIWKG VFYSTAPATV

301 ESIAPGTVSY ADELDGYGKV VVVDHGENYI SIYAGLSEIS VGKGYMVAAG

351 SKIGSSGSLP DGEEGLYLQI RYQGQVLNPS SWIR*
```

Computer analysis of this amino acid sequence gave the following results:
Homology with a Predicted ORF from *N. gonorrhoeae*
ORF 597 shows 96.1% identity over a 389 aa overlap with a predicted ORF (ORF 597) from *N. gonorrhoeae*:

```
m597/g597  96.1% identity in 389 aa overlap 10        20        30        40        50        60
    g597.pep  MLLHVSNSLKQLQEERIRQERIRQERIRQARGNLASVNRKQREAWDKFQKLNTELNRLKT
              ||||||||||||||||||||||||||        ||||||||||||||||||||||||||
    m597      MLLHVSNSLKQLQEERIRQERIRQ-----ARGNLASVNRKQREAWDKFQKLNTELNRLKT
                10        20             30        40        50

70        80        90       100       110       120
    g597.pep  EVAATKAQISRFVSGNYKNSRPNAVALFLKNAEPGQKNRFLRYTRYVNASNREVVKDLEK
              ||||||||||||||||||||:|||||||||||||||||||||||||||||||||||||||
    m597      EVAATKAQISRFVSGNYKNSQPNAVALFLKNAEPGQKNRFLRYTRYVNASNREVVKDLEK
                60        70        80        80       100       110

130       140       150       160       170       180
    g597.pep  QQKALAVQEQKINNELARLKKIQANVQSLLKKQGVTDAAEQTESRRQNAKISKDARKLLE
              |||||||||||||||||||||||||||||||||||||||||||||||||||:||||||||
    m597      QQKALAVQEQKINNELARLKKIQANVQSLLKKQGVTDAAEQTESRRQNAKIAKDARKLLE
               120       130       140       150       160       170
```

-continued

```
                190       200       210       220       230       240
g597.pep  QKGNEQQLNKLLSNLEKKKAEHRIQDAEAKRKLAEAKLAAAEKARKEAAQQKAEARRAEM
          ||||||||||||||||||||||||||||||||:|||||||||||||||||||||||||||
m597      QKGNEQQLNKLLSNLEKKKAEHRIQDAEAKRKLAEARLAAAEKARKEAAQQKAEARRAEM
              180       190       200       210       220       230

250       260       270       280       290       300
g597.pep  SNLTAEDRNIQAPSVMGIGSADGFSRMQGRLKKPVDGVPTGLFGQNRSGGDVWKGVFYST
          |||||||||||||||||||||||||||||||||||||||||||||||||:||||||||||
m597      SNLTAEDRNIQAPSVMGIGSADGFSRMQGRLKKPVDGVPTGLFGQNRSGGDIWKGVFYST
              240       250       260       270       280       290

310       320       330       340       350       360
g597.pep  APATVESIAPGTVSYADELDGYGKVVVIDHGENYISIYAGLSEISAGKYTVAAGSKIGT
          |||||||||||||||||||||||||||||:||||||||||||||||||||||||||||
m597      APATVESIAPGTVSYADELDGYGKVVVVDHGENYISIYAGLSEISAGKYTVAAGSKIGT
              300       310       320       330       340       350

370       380       390
g597.pep  SGSLPDGEEGLYLQIRYRGQVLNPSGWIRX
          ||||||||||||||||:|||||||:||||
m597      SGSLPDGEEGLYLQIRYQGQVLNPSSWIRX
              360       370       380
```

The following partial DNA sequence was identified in *N. meningitidis* <SEQ ID 1881>

```
a597.seq
    1 ATGCTGCTTC ATGTCAGCAA TTCCCTCAAG CAGCTTCAGG AAGAGCGTAT

51 CCGCCAAGAA CGTATCCGCC AAGAGCGTAT CCGTCAGGCG CGCGGCAACC

101 TTGCTTCCGT CAACCGCAAA CAGCGCGAGG CTTGGGACAA GTTCCAAAAA

151 CTCAATACCG AGCTGAACCG TTTGAAAACG GAAGTCGCCG CTACGAAAGC

201 GCAGATTTCC CGTTTCGTAT CGGGGAACTA TAAAAACAGC CAGCCGAATG

251 CGGTTGCCCT GTTCCTGAAA AACGCCGAAC CGGGTCAGAA AAACCGCTTT

301 TTGCGTTATA CGCGTTATGT AAACGCCTCC AATCGGGAAG TTGTCAAGGA

351 TTTGGAAAAA CAGCAGAAGG CTTTGGCGGT ACAAGAGCAG AAAATCAACA

401 ATGAGCTTGC CCGTTTGAAG AAAATTCAGG CAAACGTGCA ATCCCTGCTG

451 AAAAAACAGG GTGTAACCGA TGCGGCGGAA CAGACGGAAA GCCGCAGACA

501 GAATGCCAAA ATCGCCAAAG ATGCCCGAAA ACTGCTGAAA CAGAAAGGGA

551 ACGAGCAGCA GCTGAACAAG CTCTTGAGCA ATTTGGAGAA GAAAAAGGCC

601 GAACACCGCA TTCAGGATGC GGAAGCAAAA AGAAAATTGG CTGAAGCCAG

651 ACTGGCGGCA GCCGAAAAAG CCAGAAAAGA AGCGGCGCAG CAGAAGGCTG

701 AAGCACGACG TGCGGAAATG TCCAACCTGA CCGCCGAAGA CAGGAACATC

751 CAAGCGCCTT CGGTTATGGG TATCGGCAGT GCCGACGGTT TCAGCCGCAT

801 GCAAGGACGT TTGAAAAAAC CGGTTGACGG TGTGCCGACC GGACTTTTCG

851 GGCAGAACCG GAGCGGCGGC GATGTTTGGA AAGGCGTGTT CTATTCCACT

901 GCACCGGCAA CGGTTGAAAG CATTGCGCCG GAACGGTAA GCTATGCGGA

951 CGAGTTGGAC GGCTACGGCA AAGTGGTCGT GGTCGATCAC GGCGAGAACT

1001 ACATCAGCAT CTATGCCGGT TTGAGCGAAA TTTCCGTCGG CAAGGGTTAT

1051 ATGGTCGCGG CAGGAAGCAA AATCGGCTCG AGCGGGTCGC TGCCGGACGG

1101 GGAAGAGGGG CTTTACCTGC AAATACGTTA TCAAGGTCAG GTATTGAACC

1151 CTTCGAGCTG GATACGTTGA
```

This corresponds to the amino acid sequence <SEQ ID 1882; ORF 597.a>:

```
a597.pep
    1 MLLHVSNSLK QLQEERIRQE RIRQERIRQA RGNLASVNRK QREAWDKFQK

51 LNTELNRLKT EVAATKAQIS RFVSGNYKNS QPNAVALFLK NAEPGQKNRF

101 LRYTRYVNAS NREVVKDLEK QQKALAVQEQ KINNELARLK KIQANVQSLL

151 KKQGVTDAAE QTESRRQNAK IAKDARKLLE QKGNEQQLNK LLSNLEKKKA

201 EHRIQDAEAK RKLAEARLAA AEKARKEAAQ QKAEARRAEM SNLTAEDRNI

251 QAPSVMGIGS ADGFSRMQGR LKKPVDGVPT GLFGQNRSGG DVWKGVFYST

301 APATVESIAP GTVSYADELD GYGKVVVVDH GENYISIYAG LSEISVGKGY

351 MVAAGSKIGS SGSLPDGEEG LYLQIRYQGQ VLNPSSWIR*
```

Computer analysis of this amino acid sequence gave the following results:

Homology with a Predicted ORF from *N. meningitidis*
ORF 597 shows 98.5% identity over a 389 aa overlap with a predicted ORF (ORF 597) from *N. meningitidis*

```
   m597/a597   98.5% identity in 389 aa overlap 10         20         30         40         50         60
      a597.pep  MLLHVSNSLKQLQEERIRQERIRQERIRQARGNLASVNRKQREAWDKFQKLNTELNRLKT
                ||||||||||||||||||||||||||       ||||||||||||||||||||||||||||
      m597      MLLHVSNSLKQLQEERIRQERIRQ-----ARGNLASVNRKQREAWDKFQKLNTELNRLKT
                       10         20              30         40         50

70         80         90        100        110        120
      a597.pep  EVAATKAQISRFVSGNYKNSQPNAVALFLKNAEPGQKNRFLRYTRYVNASNREVVKDLEK
                ||||||||||||||||||||||||||||||||||||||||||||||||||||||||||||
      m597      EVAATKAQISRFVSGNYKNSQPNAVALFLKNAEPGQKNRFLRYTRYVNASNREVVKDLEK
                       60         70         80         90        100        110

130        140        150        160        170        180
      a597.pep  QQKALAVQEQKINNELARLKKIQANVQSLLKKQGVTDAAEQTESRRQNAKIAKDARKLLE
                ||||||||||||||||||||||||||||||||||||||||||||||||||||||||||||
      m597      QQKALAVQEQKINNELARLKKIQANVQSLLKKQGVTDAAEQTESRRQNAKIAKDARKLLE
                      120        130        140        150        160        170

190        200        210        220        230        240
      a597.pep  QKGNEQQLNKLLSNLEKKKAEHRIQDAEAKRKLAEARLAAAEKARKEAAQQKAEARRAEM
                ||||||||||||||||||||||||||||||||||||||||||||||||||||||||||||
      m597      QKGNEQQLNKLLSNLEKKKAEHRIQDAEAKRKLAEARLAAAEKARKEAAQQKAEARRAEM
                      180        190        200        210        220        230

250        260        270        280        290        300
      a597.pep  SNLTAEDRNIQAPSVMGIGSADGFSRMQGRLKKPVDGVPTGLFGQNRSGGDVWKGVFYST
                |||||||||||||||||||||||||||||||||||||||||||||||||||:||||||||
      m597      SNLTAEDRNIQAPSVMGIGSADGFSRMQGRLKKPVDGVPTGLFGQNRSGGDIWKGVFYST
                      240        250        260        270        280        290

310        320        330        340        350        360
      a597.pep  APATVESIAPGTVSYADELDGYGKVVVVDHGENYISIYAGLSEISVGKGYMVAAGSKIGS
                ||||||||||||||||||||||||||||||||||||||||||||||||||||||||||||
      m597      APATVESIAPGTVSYADELDGYGKVVVVDHGENYISIYAGLSEISVGKGYMVAAGSKIGS
                      300        310        320        330        340        350

370        380        390
      a597.pep  SGSLPDGEEGLYLQIRYQGQVLNPSSWIRX
                |||||||||||||||||||||||||||||
      m597      SGSLPDGEEGLYLQIRYQGQVLNPSSWIRX
                      360        370        380
```

The following partial DNA sequence was identified in *N. gonorrhoeae* <SEQ ID 1883>:

```
g601.seq
    1 ATGTTCCCAA CCGGCAATTT GGTCGACGAA ATTGATGTGC CGAATATAGG

51 TCGTCTGAAA GCCACGCTCA TCAACGCGGG CATTCCGACC GTTTTCCTGA

101 ACGCCGCCGA CTTGGGCTAC ACGGGCAAAG AGTTGCAGGA CGACATCAAC
```

-continued

```
151 AACGATGCCG CCGCGCTGGA AAAATTTGAA ACCATCCGCG CATATGGCGC

201 GCTGAAAATG GGTTTGATCA GCGACGTATC CGAAGCCGCC GCCCGCGCGC

251 GCACGCCGAA ACCCGCCTTC GTCGCGCCCG CCGCCGATTA CACCGCCTCC

301 AGCGGCAAAA CCGTAAACGC CGCCGACATC GATTTGCCGG TACGCGCCCT

351 GAGCATGGGC AAACTGCACC ACGCTATGAT GGGCATCGCC TCGGTCGCCA

401 TCGCCGCCGC CGTGCTCGGT ACGCTGGTCA ACCTTGCCGC AGGCGGCGGA

451 ACGCGTAAAG AAGTGCGCTT CGGGCATCCG TCAGGTACGC TGCGTGTCGG

501 TGCTGCCGCC GAATGTCAGG ACGGACAATG GACGGCCGCc aaagcggtca 551 tgaGCCGCAG CGCACgcgtg attatggaaa gttgGGTGCg cgttcccgat 601 gattGTTTTT GA
```

This corresponds to the amino acid sequence <SEQ ID 1884; ORF 601.ng>:

```
g601.pep
    1 MFPTGNLVDE IDVPNIGRLK ATLINAGIPT VFLNAADLGY TGKELQDDIN

51 NDAAALEKFE TIRAYGALKM GLISDVSEAA ARARTPKPAF VAPAADYTAS

101 SGKTVNAADI DLPVRALSMG KLHHAMMGIA SVAIAAAVLG TLVNLAAGGG

151 TRKEVRFGHP SGTLRVGAAA ECQDGQWTAA KAVMSRSARV IMESWVRVPD

201 DCF*
```

The following partial DNA sequence was identified in *N. meningitidis* <SEQ ID 1885>:

```
m601.seq
    1 ATGTTCCCAA CCGGCAATTT GGTCGATGAA ATTGATGTGC CGAATATAGG

51 CCGTTTGAAA GCCACGCTCA TCAACGCGGG CATTCCGACC GTTTTCTTGA

101 ATGCCGCCGA CTTGGGCTAC ACAGGCAAAG AGTTGCAAGA CGACATCAAC

151 AACGATGCCG CGGCTTTGGA AAAATTCGAG AAAATCCGCG CTTACGGTGC

201 GCTGAAAATG GGTCTGATCA GCGACGTATC CGAAGCTGCC GCTCGCGCGC

251 ACACGCCGAA AGTCGCCTTC GTCGCGCCCG CCGCCGATTA CACCGCCTCC

301 AGTGGCAAAA CCGTGAACGC CGCCGACATC GATTTGCTGG TACGCGCCCT

351 GAGCATGGGC AAACTGCACC ACGCGATGAT GGGTACCGCC TCTGTTGCCA

401 TTGCGACCGC CGCCGCCGTA CCCGGTACGC TGGTCAACCT TGCCGCAGGC

451 GGCGGAACGC GTAAAGAAGT GCGCTTCGGG CATCCTTCCG GCACATTGCG

501 CGTCGGTGCA GCCGCCGAAT GTCAGGACGG ACAATGGACG GCCACCAAAG

551 CGGTCATGAG CCGTAGCGCA CGCGTGATGA TGGAAGGTTG GGTCAGGGTG

601 CCTGAGGATT GTTTTTAA
```

This corresponds to the amino acid sequence <SEQ ID 1886; ORF 601>:

```
m601.pep
    1 MFPTGNLVDE IDVPNIGRLK ATLINAGIPT VFLNAADLGY TGKELQDDIN

51 NDAAALEKFE KIRAYGALKM GLISDVSEAA ARAHTPKVAF VAPAADYTAS

101 SGKTVNAADI DLLVRALSMG KLHHAMMGTA SVAIATAAAV PGTLVNLAAG
```

-continued
```
151 GGTRKEVRFG HPSGTLRVGA AAECQDGQWT ATKAVMSRSA RVMMEGWVRV

201 PEDCF*
```

Computer analysis of this amino acid sequence gave the following results:

Homology with a Predicted ORF from *N. gonorrhoeae*

ORF 601 shows 94.1% identity over a 205 aa overlap with a predicted ORF (ORF 601.ng) from *N. gonorrhoeae*:

```
   m601/g601

10         20         30         40         50         60
        m601.pep   MFPTGNLVDEIDVPNIGRLKATLINAGIPTVFLNAADLGYTGKELQDDINNDAAALEKFE
                   ||||||||||||||||||||||||||||||||||||||||||||||||||||||||||||
        g601       MFPTGNLVDEIDVPNIGRLKATLINAGIPTVFLNAADLGYTGKELQDDINNDAAALEKFE
                      10         20         30         40         50         60

70         80         90        100        110        120
        m601.pep   KIRAYGALKMGLISDVSEAAARAHTPKVAFVAPAADYTASSGKTVNAADIDLLVRALSMG
                   |||||||||||||||||||||||||:|||.||||||||||||||||||||||.||||||
        g601       TIRAYGALKMGLISDVSEAAARARTPKPAFVAPAADYTASSGKTVNAADIDLPVRALSMG
                      70         80         90        100        110        120

130        140        150        160        170        180
        m601.pep   KLHHAMMGTASVAIATAAAVPGTLVNLAAGGGTRKEVRFGHPSGTLRVGAAAECQDGQWT
                   ||||||||.||||..||||.|||||||||||||||||||||||||||||||||||||||
        g601       KLHHAMMGIASVAI--AAAVLGTLVNLAAGGGTRKEVRFGHPSGTLRVGAAAECQDGQWT
                     130        140        150        160        170

190        200
        m601.pep   ATKAVMSRSARVMMEGWVRVPEDCFX
                   |:||||||||||:||:|||||:||||
        g601       AAKAVMSRSARVIMESWVRVPDDCFX
                     180        190        200
```

The following partial DNA sequence was identified in *N. meningitidis* <SEQ ID 1887>:

```
a601.seq
    1 ATGTTCCCAA CCGGCAATTT GGTCGATGAA ATTGATGTGC CGAATATAGG

51 CCGTTTGAAA GCCACGCTCA TCAACGCGGG CATTCCGACC GTTTTCCTGA

101 ATGCCGCCGA CTTGGGCTAC ACGGGCAAAG AGTTGCAAGA CGACATCAAC

151 AACGATGCCG CAGCTTTGGA AAAATTCGAG AAAATCCGCG CTTACGGTGC

201 GCTGAAAATG GGTCTGATCA GCGACGTATC CGAAGCTGCC GCCCGCGCGC

251 ACACGCCGAA AGTCGCCTTC GTCGCGCCCG CCGCCGATTA CACCGCCTCC

301 AGTGGCAAAA CCGTGAATGC CGCCGACATC GATTTGCTGG TACGCGCCCT

351 GAGCATGGGC AAATTGCACC ACGCGATGAT GGGTACCGCC TCTGTTGCCA

401 TTGCGACCGC CGCCGCCGTG CCCGGTACGC TGGTCAACCT TGCCGCAGGC

451 GGCGGAACGC GTAAAGAAGT GCGCTTCGGG CATCCTTCCG GCACATTGCG

501 CGTCGGTGCA GCCGCCGAAT GTCAGGACGG ACAATGGACG GCCACCAAAG

551 CGGTTATGAG CCGCAGCGCA CGCGTGATGA TGGAAGGTTG GGTCAGGGTG

601 CCGGAAGATT GTTTTTAA
```

This corresponds to the amino acid sequence <SEQ ID 1888; ORF 601.a>:

```
a601.pep
    1 MFPTGNLVDE IDVPNIGRLK ATLINAGIPT VFLNAADLGY TGKELQDDIN

51 NDAAALEKFE KIRAYGALKM GLISDVSEAA ARAHTPKVAF VAPAADYTAS

101 SGKTVNAADI DLLVRALSMG KLHHAMMGTA SVAIATAAAV PGTLVNLAAG
```

-continued

```
151 GGTRKEVRFG HPSGTLRVGA AAECQDGQWT ATKAVMSRSA RVMMEGWVRV

201 PEDCF*
``` m601/a601 100.0% identity in 205 aa overlap

```
                  10        20        30        40        50        60
       m601.pep   MFPTGNLVDEIDVPNIGRLKATLINAGIPTVFLNAADLGYTGKELQDDINNDAAALEKFE
                  ||||||||||||||||||||||||||||||||||||||||||||||||||||||||||||
          a601    MFPTGNLVDEIDVPNIGRLKATLINAGIPTVFLNAADLGYTGKELQDDINNDAAALEKFE
                  10        20        30        40        50        60

70        80        90        100       110       120
       m601.pep   KIRAYGALKMGLISDVSEAAARAHTPKVAFVAPAADYTASSGKTVNAADIDLLVRALSMG
                  ||||||||||||||||||||||||||||||||||||||||||||||||||||||||||||
          a601    KIRAYGALKMGLISDVSEAAARAHTPKVAFVAPAADYTASSGKTVNAADIDLLVRALSMG
                  70        80        90        100       110       120

130       140       150       160       170       180
       m601.pep   KLHHAMMGTASVAIATAAAVPGTLVNLAAGGGTRKEVRFGHPSGTLRVGAAAECQDGQWT
                  ||||||||||||||||||||||||||||||||||||||||||||||||||||||||||||
          a601    KLHHAMMGTASVAIATAAAVPGTLVNLAAGGGTRKEVRFGHPSGTLRVGAAAECQDGQWT
                  130       140       150       160       170       180

190       200
       m601.pep   ATKAVMSRSARVMMEGWVRVPEDCFX
                  ||||||||||||||||||||||||||
          a601    ATKAVMSRSARVMMEGWVRVPEDCFX
                  190       200
```

The following partial DNA sequence was identified in *N. gonorrhoeae* <SEQ ID 1889>:

```
g602.seq
   1 ATGTTGCTCC ATCAATGCGA CAAAGCGCGA CATATGCGTC CCTTTCTGCT

51 CGGCGGGCAG ATAAACCGTC ATCGTCAGGC GAGCAACCGT GGATTGTGTT

101 CCTTCGGCGG TTTTCAGGGT AATCGGGAAG CGCAGGTCTT TAATGCCGAC

151 CTGATTGATC GGCAGGTTGC GCAAATCTCT GCTGGATTGC ACGTCTGCAA

201 TGGCGTTCAT GCGTTGTTTG TCCTTAATAT TCAGATAATT ATTGAGATGT

251 GTGTATTGTA TGGCAGGcag atgccgtctg aAAAAacgct gtcggCCGCC

301 TGCCTGCAAA TgcgagattA TATCACTTGC TTTtggcgGC TGCATTGA
```

This corresponds to the amino acid sequence <SEQ ID 1890; ORF 602.ng>:

```
g602.pep
   1 MLLHQCDKAR HMRPFLLGGQ INRHRQASNR GLCSFGGFQG NREAQVFNAD

51 LIDRQVAQIS AGLHVCNGVH ALFVLNIQII IEMCVLYGRQ MPSEKTLSAA

101 CLQMRDYITC FWRLH*
```

The following partial DNA sequence was identified in *N. meningitidis* <SEQ ID 1891>:

```
m602.seq
   1 ATGTTGCTCC ATCAATGCGA CAAAACGCGA CATATGCGTC CCCTTCTGCT

51 CAGCAGGCAG GTAAACCGTC ATGGTCAGAC GGGCAATGGT GGACTGGATG

101 CCTTCTGCAG TTTGCAGGGT AATCGGAAAG CGCAGGTCTT TGATACCGAC

151 CTGATTGATC GGCAGATTGC GCAAATCTCG GCTGGATTGC ACGTCTGCAA

201 TAGTGTTCAT GAGTTGTTTT TCCTTAATAT TCATGTAATT GTTGAGATGT
```

```
251 GTGCATGGTA TGGCGTTTCC GCCGGGGAAT ATACCGTCAA TCTGCAAATG

301 CGAGATTATA TCACTCGCTT TTAGCAGCTG CATTGA
```

This corresponds to the amino acid sequence <SEQ ID 1892; ORF 602>:

```
    m602.pep

1   MLLHQCDKTR HMRPLLLSRQ VNRHGQTGNG GLDAFCSLQG NRKAQVFDTD

51   LIDRQIAQIS AGLHVCNSVH ELFFLNIHVI VEMCAWYGVS AGEYTVNLQM

101   RDYITRF*QL H*
    m595/a595 65.2% identity in 115 aa overlap 10         20         30         40         50         60
    m602.pep  MLLHQCDKTRHMRPLLLSRQVNRHGQTGNGGLDAFCSLQGNRKAQVFDTDLIDRQIAQIS
              ||||||||:||||:||: :||| |::|  ||  :::||||:||||::|||||:||||
              MLLHQCDKARHMRPFLLGGQINRHRQASNRGLCSFGGFQGNREAQVFNADLIDRQVAQIS
                      10         20         30         40         50         60

70         80         90        100        110
    m602.pep  AGLHVCNSVHELFFLNIHVIVEMCAWYGVSA-GEYTVN---LQMRDYITRFXQLHX
              ||||||||:|| ||  |||::|||: ||   :|  |::     |||||||| |:|||
              AGLHVCNGVHALFVLNIQIIIEMCVLYGRQMPSEKTLSAACLQMRDYITCFWRLHX
                      70         80         90        100        110
```

The following partial DNA sequence was identified in *N. meningitidis* <SEQ ID 1893>:

```
a602.seq
  1 ATGTTGCTCC ATCAATGCGA CAAAGCGCGA CATATGCGTA CCCTTCTGCT

51 CGGCAGGCAG GTAAACCGTC ATGGTCAGAC GGGCAACTGT GGACTGGATG

101 CCTTCTGCAG TTTGCAGGGT AATCGGAAAG CGCAGGTCTT TGATACCGAC

151 CTGATTGATC GGCAGATTGC GCAAATCTCG GCTGGATTGC ACGTCTGCAA

201 TAGTGTTCAT GAGTTGTTTT TCCTTAATAT TCATGTAATT GTTGAGATGT

251 GTGCATGGTA TGGCGTTTCC ACCGGGGAAT ATACCGTCAA TCTGCAAATG

301 CGAGATTATA TCACTCGCTT TTAGCAGCTG CATTGA
```

This corresponds to the amino acid sequence <SEQ ID 1894; ORF 602.a>:

```
    m602.pep

1   MLLHQCDKAR HMRTLLLGRQ VNRHGQTGNC GLDAFCSLQG NRKAQVFDTD

51   LIDRQIAQIS AGLHVCNSVH ELFFLNIHVI VEMCAWYGVS TGEYTVNLQM

101   RDYITRF*QL H* m602/a602 95.5% identity in 111 aa overlap 10         20         30         40         50         60
    m602.pep  MLLHQCDKTRHMRPLLLSRQVNRHGQTGNGGLDAFCSLQGNRKAQVFDTDLIDRQIAQIS
              ||||||||:||||:|||:||||||||||| ||||||||||||||||||||||||||||||
    a602      MLLHQCDKARHMRTLLLGRQVNRHGQTGNCGLDAFCSLQGNRKAQVFDTDLIDRQIAQIS
                      10         20         30         40         50         60

70         80         90        100        110
    m602.pep  AGLHVCNSVHELFFLNIHVIVEMCAWYGVSAGEYTVNLQMRDYITRFXQLHX
              |||||||||||||||||||||||||||||:|||||||||||||||||||||
    a602      AGLHVCNSVHELFFLNIHVIVEMCAWYGVSTGEYTVNLQMRDYITRFXQLHX
                      70         80         90        100        110
```

The following partial DNA sequence was identified in *N. gonorrhoeae* <SEQ ID 1895>:

```
g603.seq
    1 ATGGATTCCC GCCTGCGTGG GAATGACGCT AGGAAATACG GCATACGCTT
   51 TGCCCAAAGA GGCCGTCTGA ACACACTCC GCCCAACGCC CATCCTTTTT
  101 CAGACGGCCC CGCACCAAAA AAACAACCAC AAACTACAAG GAGAAACATC
  151 ATGTCCGACC AACTCATTCT TGTCCTGAAC TGCGTCAGTT CATCGCTCAA
  201 AGGCGCCGTT ATCGACCGCA AAAGCGGCAG CGTCGTCCTA AGCTGCCTCG
  251 GGGAACGCCT GACTACGCCC GAAGCCGTCA TTACCTTCAA CAAAGACGGC
  301 AACAAACGCC AAGTTCCCCT GAGCGGCCGC AACTGCCACG CCGGCGCGGT
  351 GGGTATGCTG TTGAACGAAC TGGAAAAACA CGGACTGCAC GACCGCATCA
  401 AAGCCATCGG CCGCCGCATC GCCCACGGCG GCGAAAAATA TCACGAGTCC
  451 GTCCTCATCG ACCAAGACGT CCTTGACGAA CTGAAAGCCT GCATCCCGTT
  501 CGCCCCGCTG CACAACCCCG CCAACATCAG CGGCATCCTC GCCGCGCAGG
  551 AACACTTTCC CGGCCTGCCC AACGTCGGCG TGATGGACAC CTCGTTCCAC
  601 CAAACCATGC CGGAGCGGGC CTACACTTAT GCCGTGCCGC GCGAATTGCG
  651 CAAAAAATAC GCCTTCCGCC GCTACGGTTT CCACGGTACC GGTATGCGTT
  701 ACGTCGCCCC TGAAGCCGCA CGCATCTTGG GCAAACCTct ggaaGACATC
  751 CGCATGATTA TTGCCCACTT AGGCAACGGC GCATCTATTA CCGCCGTCAA
  801 AAACGGCAAA TCCGTCGATA CCGGTATGGG TTTCACGCCG ATCGAAGGTT
  851 TGGTAATGGG TACACGTTGC GGCGACACCG ATCCGGGCGT ATACAGCTAT
  901 CCGACTTTCC ACGCAGGGAT GGATGTTGCC CAAGTTGATG AAATGCTGAA
  951 CGAAAAATCA GGTTTCCCCG GTATTTCcgA actTCCCAAC GACTGCCGCA
 1001 CCCTCGAAAT CGCCGCCGAC GAAGGCCGCG AAGGCGCGCG CCTCGCCCTc
 1051 gaAGTCATGA CCTGCCGCCT CGCCAAATAC ATCGCTTCGA TGGCTGTGGC
 1101 CTGCGGCAGT GTTGACGCAC TCGTGTTCAC CGGCGGTATC GGCGAAAACT
 1151 CGCGTAATAT CCGTGCCAAA ACCGTTTCCT ATCTTGATTT CTTGGGTCTG
 1201 CACATCGACA CCAAAGCCAA TATGGAAAAA CGCTACGGCA ATTCGGGCAT
 1251 TATCAGCCCG ACCGATTCTT CTCCGGCTGT TTTGGTCGTC CCGACCAATG
 1301 AAGAACTGAT GATTGCCTGC GACACTGCCG AACTTGCCGG CATCTTGTAG
```

This corresponds to the amino acid sequence <SEQ ID 1896; ORF 603.ng>:

```
g603.pep
    1 MDSRLRGNDA RKYGIRFAQR GRLKHTPPNA HPFSDGPAPK KQPQTTRRNI
   51 MSDQLILVLN CVSSSLKGAV IDRKSGSVVL SCLGERLTTP EAVITFNKDG
  101 NKRQVPLSGR NCHAGAVGML LNELEKHGLH DRIKAIGRRI AHGGEKYHES
  151 VLIDQDVLDE LKACIPFAPL HNPANISGIL AAQEHFPGLP NVGVMDTSFH
  201 QTMPERAYTY AVPRELRKKY AFRRYGFHGT GMRYVAPEAA RILGKPLEDI
  251 RMIIAHLGNG ASITAVKNGK SVDTGMGFTP IEGLVMGTRC GDTDPGVYSY
  301 PTFHAGMDVA QVDEMLNEKS GFPGISELPN DCRTLEIAAD EGREGARLAL
```

```
351 EVMTCRLAKY IASMAVACGS VDALVFTGGI GENSRNIRAK TVSYLDFLGL

401 HIDTKANMEK RYGNSGIISP TDSSPAVLVV PTNEELMIAC DTAELAGIL*
```

The following partial DNA sequence was identified in *N. meningitidis* <SEQ ID 1897>:

```
m603.seq
     1 CTGTCCTCGC GTAGGCGGGG ACGGAATAAC GATAGAAAAT GCGGCATACG

51 CTTTGCCCAA AGAGGCCGTC TGAAACACCT TGCGCCTGAT GTCTGC.CTT

101 TTTCAGACGA CCCCACACTA AAAAACAAC CACAAACTAC AAGGAGAAAC

151 ATCATGTCCG ACCAACTCAT CCTCGTTCTG AACTGCGGCA GTTCATCGCT

201 CAAAGGCGCC GTTATCGACC GAmAAAGCGG CAGCGTCGTC CTAAGCTGCC

251 TCGGCGAACG cCtGACCACG CCCGAAGCCG TCATTACGTT CAACAAAGAC

301 GGCAACAAAC GCCAAGTTCC CCTGAGCGGC CGAAATTGCC ACGCCGGCGC

351 GGTGGGTATG CTTTTGAACG AACTGGAAAA ACACGGTCTG CACGACCGCA

401 TCAAAGCCAT CGGCCACCGC ATCGCCCACG GCGGCGAAAA ATACAGCGAG

451 TCTGTTTTGA TCGACCAGGC CGTAATGGAC GAACTCAATG CCTGCATTCC

501 GCTTGCGCCG CTGCACAACC CCGCCAACAT CAGCGGCATC CTTGCCGCAC

551 AGGAACATTT CCCCGGTCTG CCCAATGTCG GCGTGATGGA TACTTCGTTC

601 CACCAAACCA TGCCGGAGCG TGCCTACACT TATGCCGTGC CGCGCGAGTT

651 GCGTAAAAAA TACGCTTTCC GCCGCTACGG TTTCCACGGC ACCAGTATGC

701 GTTACGTTGC CCCTGAAGCC GCACGCATCT TGGGCAAACC TCTGGAAGAC

751 ATCCGCATGA TTATTGCCCA CTTAGGCAAC GGCGCATCCA TTACCGCCAT

801 CAAAAACGGC AAATCCGTCG ATACCAGTAT GGGTTTCACG CCGATCGAAG

851 GTTTGGTAAT GGGTACACGT TGCGGCGACA TCGATCCGGG CGTATACAGC

901 TATCTGACTT CCCACGCCGG GATGGATGTT GCCCAAGTGG ATGAAATGCT

951 GAACAAAAAA TCAGGTTTGC TCGGTATTTC CGAACTTTCC AACGACTGCC

1001 GCACCCTCGA AATCGCCGCC GACGAAGGCC ACGAAGGCGC GCGCCTCGCC

1051 CTCGAAGTCA TGACCTACCG CCTCGCCAAA TACATCGCTT CGATGGCTGT

1101 GGGCTGCGGC GGCGTTGACG CACTCGTGTT CACCGGCGGT ATCGGCGAAA

1151 ACTCGCGTAA TATCCGTGCC AAAACCGTTT CCTATCTTGA TTTCTTGGGT

1201 CTGCACATCG ACACCAAAGC CAATATGGAA AAACGCTACG GCAATTCGGG

1251 CATTATCAGC CCGACCGATT CTTCTCCGGC TGTTTTGGTT GTCCCGACCA

1301 ATGAAGAACT GATGATTGCC TGCGACACTG CCGAACTTGC CGGCATCTTG

1351 TAG
```

This corresponds to the amino acid sequence <SEQ ID 1898; ORF 603>:

```
m603.pep
     1 LSSRRRGRNN DRKCGIRFAQ RGRLKHLAPD VCXFSDDPTL KKQPQTTRRN

51 IMSDQLILVL NCGSSSLKGA VIDRXSGSVV LSCLGERLTT PEAVITFNKD

101 GNKRQVPLSG RNCHAGAVGM LLNELEKHGL HDRIKAIGHR IAHGGEKYSE

151 SVLIDQAVMD ELNACIPLAP LHNPANISGI LAAQEHFPGL PNVGVMDTSF
```

-continued

```
201 HQTMPERAYT YAVPRELRKK YAFRRYGFHG TSMRYVAPEA ARILGKPLED

251 IRMIIAHLGN GASITAIKNG KSVDTSMGFT PIEGLVMGTR CGDIDPGVYS

301 YLTSHAGMDV AQVDEMLNKK SGLLGISELS NDCRTLEIAA DEGHEGARLA

351 LEVMTYRLAK YIASMAVGCG GVDALVFTGG IGENSRNIRA KTVSYLDFLG

401 LHIDTKANME KRYGNSGIIS PTDSSPAVLV VPTNEELMIA CDTAELAGIL

451 *
```

Computer analysis of this amino acid sequence gave the following results:
Homology with a Predicted ORF from *N. gonorrhoeae*
ORF 603 shows 91.6% identity over a 450 aa overlap with a predicted ORF (ORF 603.ng) from *N. gonorrhoeae*:

```
    m603/g603
                        10         20         30         40         50         60
    m603.pep    LSSRRRGRNNDRKCGIRFAQRGRLKHLAPDVCXFSDDPTLKKQPQTTRRNIMSDQLILVL
                  ::||  || |: || |||||||||||| |:: ||| |: |||||||||||||||||||
    g603        MDSRLRG-NDARKYGIRFAQRGRLKHTPPNAHPFSDGPAPKKQPQTTRRNIMSDQLILVL
                          10         20         30         40         50

70         80         90        100        110        120
    m603.pep    NCGSSSLKGAVIDRXSGSVVLSCLGERLTTPEAVITFNKDGNKRQVPLSGRNCHAGAVGM
                || |||||||||| |||||||||||||||||||||||||||||||||||||||||||||
    g603        NCVSSSLKGAVIDRKSGSVVLSCLGERLTTPEAVITFNKDGNKRQVPLSGRNCHAGAVGM
                        60         70         80         90        100        110

130        140        150        160        170        180
    m603.pep    LLNELEKHGLHDRIKAIGHRIAHGGEKYSESVLIDQAVMDELNACIPLAPLHNPANISGI
                ||||||||||||||||||||:|||||||||| |||||| |:|||:||||:|||||||||
    g603        LLNELEKHGLHDRIKAIGRRIAHGGEKYHESVLIDQDVLDELKACIPFAPLHNPANISGI
                    120        130        140        150        160        170

190        200        210        220        230        240
    m603.pep    LAAQEHFPGLPNVGVMDTSFHQTMPERAYTYAVPRELRKKYAFRRYGFHGTSMRYVAPEA
                ||||||||||||||||||||||||||||||||||||||||||||||||||:||||||||
    g603        LAAQEHFPGLPNVGVMDTSFHQTMPERAYTYAVPRELRKKYAFRRYGFHGTGMRYVAPEA
                180        190        200        210        220        230

250        260        270        280        290        300
    m603.pep    ARILGKPLEDIRMIIAHLGNGASITAIKNGKSVDTSMGFTPIEGLVMGTRCGDIDPGVYS
                |||||||||||||||||||||||||||:|||||||:||||||||||||||||||:||||
    g603        ARILGKPLEDIRMIIAHLGNGASITAVKNGKSVDTGMGFTPIEGLVMGTRCGDTDPGVYS
                       240        250        260        270        280        290

310        320        330        340        350        360
    m603.pep    YLTSHAGMDVAQVDEMLNKKSGLLGISELSNDCRTLEIAADEGHEGARLALEVMTYRLAK
                | | |||||||||||||||:|||: ||||| |||||||||||:|||||||||||| |||
    g603        YPTFHAGMDVAQVDEMLNEKSGFPGISELPNDCRTLEIAADEGREGARLALEVMTCRLAK
                       300        310        320        330        340        350

370        380        390        400        410        420
    m603.pep    YIASMAVGCGGVDALVFTGGIGENSRNIRAKTVSYLDFLGLHIDTKANMEKRYGNSGIIS
                ||||||:||:||||||||||||||||||||||||||||||||||||||||||||||:||
    g603        YIASMAVACGSVDALVFTGGIGENSRNIRAKTVSYLDFLGLHIDTKANMEKRYGNSCIIS
                       360        370        380        390        400        410

430        440        450
    m603.pep    PTDSSPAVLVVPTNEELMIACDTAELAGILX
                |||||||||||||||||||||||||||||||
    g603        PTDSSPAVLVVPTNEELMIACDTAELAGILX
                       420        430        440        450
```

The following partial DNA sequence was identified in *N. meningitidis* <SEQ ID 1899>:

```
a603.seq
    1  CTGTCCTCGC GTAGGCGGGG ACGGAATAAC GATAGAAAAT GCGGCATACG

51  CTTTGCCCAA AGAGGCCGTC TGAAACACAC TCCGCCCAAC GCCCATCCTT

101  TTTCAGACGA CCCCACACC. AAAAACAAC CACAAACTAC AAGGAGAAAC

151  ATCATGTCCG ACCAACTCAT TCTTGTTCTG AACTGCGGCA GTTCATCGCT

201  CAAAGGTGCC GTTATCGACC GCAAAAGCGG CAGCGTCGTC CTAAGCTGCC
```

```
 251 TCGGCGAACG CCTGACCACG CCCGAAGCCG TCATTACGTT CAGCAAAGAC

301 GGCAACAAAC GCCAAGTTCC CCTGAGCGGC CGGAACTGCC ACGCCGGCGC

351 GGTGGGTATG CTGTTGAACG AACTGGAAAA ACACGAACTG CACGACCGCA

401 TTCAAGCCGT CGGCCACCGC ATCGCCCACG GCGGCGAAAA ATACAGCGAG

451 TCTGTTTTGA TCGACCAGGC CGTAATGGAC GAACTCAATG CCTGCATTCC

501 GCTTGCGCCG CTGCACAACC CCGCCAACAT CAGCGGCATC CTCGCCGCAC

551 AGGAACATTT CCCCGGTCTG CCCAATGTCG GCGTGATGGA TACTTCGTTC

601 CACCAAACCA TGCCGGAGCG TGCCTACACT TATGCCGTGC CGCGCGAGTT

651 GCGTAAAAAA TACGCTTTCC GCCGCTACGG TTTCCACGGC ACCAGTATGC

701 GTTACGTTGC CCCTGAAGCC GCATGCATCT TGGGCAAACC TCTGGAAGAC

751 ATCCGCATGA TTATTGCCCA CTTAGGCAAC GGCGCATCCA TTACCGCCAT

801 CAAAAACGGC AAATCCGTCG ATACCAGTAT GGGTTTCACG CCGATCGAAG

851 GTTTGGTAAT GGGTACGCGC TGCGGCGATA TCGACCCGGG CGTATACAGC

901 TATCTGACTT CACACGCCGG TTTGGATGTT GCACAAGTTG ATGAAATGCT

951 GAATAAAAAA TCAGGCTTGC TCGGTATTTC CGAACTCTCC AACGACTGCC

1001 GCACCCTCGA AATCGCCGCC GACGAAGGCC ACGAAGGCGC GCGCCTCGCC

1051 CTCGAAGTTA TGACCTACCG CCTCGCCAAA TACATCGCTT CGATGGCTGT

1101 GGGCTGCGGC GGCGTTGACG CACTCGTGTT CACCGGCGGT ATCGGCGAAA

1151 ACTCGCGTAA TATCCGTGCC AAAACCGTTT CCTATCTTGA TTTCTTGGGT

1201 CTGCACATCG ACACCAAAGC CAATATGGAA AAACGCTACG GCAATTCGGG

1251 TATTATCAGC CCGACCGATT CTTCTCCGGC TGTTTTGGTT GTCCCGACCA

1301 ATGAAGAACT GATGATTGCC TGCGACACTG CCGAACTTGT CGGCATCTTG

1351 TAG
```

This corresponds to the amino acid sequence <SEQ ID 
1900; ORF 603.a>:

```
a603.pep
  1 LSSRRRGRNN DRKCGIRFAQ RGRLKHTPPN AHPFSDDPTX KKQPQTTRRN

51 IMSDQLILVL NCGSSSLKGA VIDRKSGSVV LSCLGERLTT PEAVITFSKD

101 GNKRQVPLSG RNCHAGAVGM LLNELEKHEL HDRIQAVGHR IAHGGEKYSE

151 SVLIDQAVMD ELNACIPLAP LHNPANISGI LAAQEHFPGL PNVGVMDTSF

201 HQTMPERAYT YAVPRELRKK YAFRRYGFHG TSMRYVAPEA ACILGKPLED

251 IRMIIAHLGN GASITAIKNG KSVDTSMGFT PIEGLVMGTR CGDIDPGVYS

301 YLTSHAGLDV AQVDEMLNKK SGLLGISELS NDCRTLEIAA DEGHEGARLA

351 LEVMTYRLAK YIASMAVGCG GVDALVFTGG IGENSRNIRA KTVSYLDFLG

401 LHIDTKANME KRYGNSGIIS PTDSSPAVLV VPTNEELMIA CDTAELVGIL

451 *
``` m603/a603 96.7% identity in 450 aa overlap

```
              10         20         30         40         50         60
m603.pep  LSSRRRGRNNDRKCGIRFAQRGRLKHLAPDVCXFSDDPTLKKQPQTTRRNIMSDQLILVL
          ||||||||||||||||||||||||||| |::  ||||||| ||||||||||||||||||||
a603      LSSRRRGRNNDRKCGIRFAQRGRLKHTPPNAHPCXFSDDXTLKKQPQTTRRNIMSDQLILVL
              10         20         30         40         50         60

70         80         90        100        110        120
m603.pep  NCGSSSLKGAVIDRXSGSVVLSCLGERLTTPEAVITFNKDGNKRQVPLSGRNCHAGAVGM
          |||||||||||||| ||||||||||||||||||||||:|||||||||||||||||||||
a603      NCGSSSLKGAVIDRKSGSVVLSCLGERLTTPEAVITFSKDGNKRQVPLSGRNCHAGAVGM
              70         80         90        100        110        120

130        140        150        160        170        180
m603.pep  LLNELEKHGLHDRIKAIGHRIAHGGEKYSESVLIDQAVMDELNACIPLAPLHNPANISGI
          |||||||||||||:||||||||||||||||||||||||||||||||||||||||||||||
a603      LLNELEKHGLHDRIVAIGHRIAHGGEKYSESVLIDQAVMDELNACIPLAPLHNPANISGI
             130        140        150        160        170        180

190        200        210        220        230        240
m603.pep  LAAQEHFPGLPNVGVMDTSFHQTMPERAYTYAVPRELRKKYAFRRYGFHGTSMRYVAPEA
          ||||||||||||||||||||||||||||||||||||||||||||||||||||||||||||
a603      LAAQEHFPGLPNVGVMDTSFHQTMPERAYTYAVPRELRKKYAFRRYGFHGTSMRYVAPEA
             190        200        210        220        230        240

250        260        270        280        290        300
m603.pep  ARILGKPLEDIRMIIAHLGNGASITAIKNGKSVDTSMGFTPIEGLVMGTRCGDIDPGVYS
          | |||||||||||||||||||||||||||||||||||||||||||||||||||||||||
a603      ACILGKPLEDIRMIIAHLGNGASITAIKNGKSVDTSMGFTPIEGLVMGTRCGDIDPGVYS
             250        260        270        280        290        300

310        320        330        340        350        360
m603.pep  YLTSHAGMDVAQVDEMLNKKSGLLGISELSNDCRTLEIAADEGHEGARLALEVMTYRLAK
          |||||||:||||||||||||||||||||||||||||||||||||||||||||||||||||
a603      YLTSHAGLDVAQVDEMLNKKSGLLGISELSNDCRTLEIAADEGHEGARLALEVMTYRLAK
             310        320        330        340        350        360

370        380        390        400        410        420
m603.pep  YIASMAVGCGGVDALVFTGGIGENSRNIRAKTVSYLDFLGLHIDTKANMEKRYGNSGIIS
          ||||||||||||||||||||||||||||||||||||||||||||||||||||||||||||
a603      YIASMAVGCGGVDALVFTGGIGENSRNIRAKTVSYLDFLGLHIDTKANMEKRYGNSGIIS
             370        380        390        400        410        420

430        440        450
m603.pep  PTDSSPAVLVVPTNEELMIACDTAELAGILX
          |||||||||||||||||||||||||:||||
a603      PTDSSPAVLVVPTNEELMIACDTAELVGILX
             430        440        450
```

The following partial DNA sequence was identified in *N. gonorrhoeae* <SEQ ID 1901>:

```
g604.seq
  1 ATGCCCGAAG CGCACTTCTT TACGCGTTCC GCCGCCTGCG GCAAGGTTGA

51 CCAGCGTACC GAGCACGGCG GCGGCGATGG CGACCGAGGC GATGCCCATC

101 ATAGCGTGGT GCAGTTTGCC CATGCTCAGG GCGCGTACCG GCAAATCGAT

151 GTCGGCGGCG TTTACGGTTT TGCCGCTGGA GGCGGTGTAA TCGGCGGCGG

201 GCGCGACGAA GGCGGGTTTC GGCGTGCGCG CGCGGGCGGC GGCTTCGGAT

251 ACGTCGCTGA TCAAACCCAT TTTCAGCGCG CCATATGCGC GGATGGTTTC

301 AAATTTTTCC AGCGCGGCGG CATCGTTGTT GATGTCGTCC TGCAACTCTT

351 TGCCCGTGTA GCCCAAGTCG GCGGCGTTCA GGAAAACGGT CGGAATGCCC

401 GCGTTGATGA GCGTGGCTTT CAGACGACCT ATATTCGGCA CATCAATTTC

451 GTCGACCAAA TTGCCGGTTG GAACATACT GCCTTcgcCG TCGGCTGGAT

501 CTAA
```

This corresponds to the amino acid sequence <SEQ ID 1902; ORF 604.ng>:

```
g604.pep
  1 MPEAHFFTRS AACGKVDQRT EHGGGDGDRG DAHHSVVQFA HAQGAYRQID

51 VGGVYGFAAG GGVIGGGRDE GGFRRARAGG GFGYVADQTH FQRAICADGF
```

```
-continued
101 KFFQRGGIVV DVVLQLFARV AQVGGVQENG RNARVDERGF QTTYIRHINF

151 VDQIAGWEHT AFAVGWI*
```

The following partial DNA sequence was identified in *N. meningitidis* <SEQ ID 1903>:

```
m604.seq
  1 ATGCCCGAAG CGCACTTCTT TACGCGTTCC GCCGCCTGCG GCAAGGTTGA

51 CCAGCGTACC GGGTACGGCG GCGGCGGTCG CAATGGCAAC AGAGGCGGTA

101 CCCATCATCG CGTGGTGCAG TTTGCCCATG CTCAGGGCGC GTACCAGCAA

151 ATCGATGTCG GCGGCGTTCA CGGTTTTGCC ACTGGAGGCG GTGTAATCGG

201 CGGCGGGCGC GACGAAGGCG ACTTTCGGCG TGTGCGCGCG AGCGGCAGCT

251 TCGGATACGT CGCTGATCAG ACCCATTTTC AGCGCACCGT AAGCGCGGAT

301 TTTCTCGAAT TTTTCCAAAG CCGCGGCATC GTTGTTGATG TCGTCTTGCA

351 ACTCTTTGCC TGTGTAGCCC AAGTCGGCGG CATTCAAGAA AACGGTCGGA

401 ATGCCCGCGT TGATGAGCGT GGCTTTCAAA CGGCCTATAT TCGGCACATC

451 AATTTCATCG ACCAAATTGC CGGTTGGGAA CATACTGCCT TCGCCGTCGG

501 CTGGATC
```

This corresponds to the amino acid sequence <SEQ ID 1904; ORF 604>:

```
m604.pep
  1 MPEAHFFTRS AACGKVDQRT GYGGGGRNGN RGGTHHRVVQ FAHAQGAYQQ

51 IDVGGVHGFA TGGGVIGGGR DEGDFRRVRA SGSFGYVADQ THFQRTVSAD

101 FLEFFQSRGI VVDVVLQLFA CVAQVGGIQE NGRNARVDER GFQTAYIRHI

151 NFIDQIAGWE HTAFAVGWI
```

Computer analysis of this amino acid sequence gave the following results:
Homology with a Predicted ORF from *N. gonorrhoeae*
ORF 604 shows 83.4% identity over a 169 aa overlap with a predicted ORF (ORF 604.ng) from *N. gonorrhoeae*:

```
m604/g604
                  10         20         30         40         50         60
    m604.pep  MPEAHFFTRSAACGKVDQRTGYGGGRNGNRGGTHHRVVQFAHAQGAYQQIDVGGVHGFA
              |||||||||||||||||||||:|||   :|:||  :||  |||||||||:||||||:|||
    g604      MPEAHFFTRSAACGKVDQRTGHGGG--DGDRGDAHHSVVQFAHAQGAYRQIDVGGVYGFA
                  10         20            30         40         50

70         80         90        100        110        120
    m604.pep  TGGGVIGGGRDEGDFRRVRASGSFGYVADQTHFQRTVSADFLEFFQSRGIVVDVVLQLFA
              :|||||||||||  |||:|::|:|||||||||||||::   ||   :|||  |||||||||
    g604      AGGGVIGGGRDEGGFRRARAGGGFGYVADQTHFQRAICADGFKFFQRGGIVVDVVLQLFA
                  60         70         80         90        100        110

130        140        150        160        169
    m604.pep  CVAQVGGIQENGRNARVDERGFQTAYIRHINFIDQIAGWEHTAFAVGWI
              ||||||:|||||||||||||||||:|||||||:||||||||||||||||
    g604      RVAQVGGVQENGRNARVDERGFQTTYIRHINFVDQIAGWEHTAFAVGWIX
                 120        130        140        150        160
```

The following partial DNA sequence was identified in *N. meningitidis* <SEQ ID 1905>:

```
a604.seq
   1 ATGCCCGAAG CGCACTTCTT TACGCGTTCC GCCGCCTGCG GCAAGGTTGA

51 CCAGCGTACC GGGCACGGCG GCGGCGGTCG CAATGGCAAC AGAGGCGGTA

101 CCCATCATCG CGTGGTGCAA TTTGCCCATG CTCAGGGCGC GTACCAGCAA

151 ATCGATGTCG GCGGCATTCA CGGTTTTGCC ACTGGAGGCG GTGTAATCGG

201 CGGCGGGCGC GACGAAGGCG ACTTTCGGCG TGTGCGCGCG GGCGGCAGCT

251 TCGGATACGT CGCTGATCAG ACCCATTTTC AGCGCACCGT AAGCGCGGAT

301 TTTCTCGAAT TTTTCCAAAG CTGCGGCATC GTTGTTGATG TCGTCTTGCA

351 ACTCTTTGCC CGTGTAGCCC AAGTCGGCGG CATTCAGGAA AACGGTCGGA

401 ATGCCCGCGT TGATGAGCGT GGCTTTCAAA CGGCCTATAT TCGGCACATC

451 AATTTCATCG ACCAAATTGC CGGTTGGGAA CATACTGCCT TCGCCGTCGG

501 CTGGATCAAG AAATTCGATT TGTACTTCGG CTGCCGGGAA CGTTACGCCG

551 TCGAGCTCAA AATCGCCTGT TTCCAAAACT GCGCCGTTTT GCATCGGTAC

601 ATGGGCAATA ATGGTTTTGC CGATGTTTTT CTGCCAGATT TTGACTGTGC

651 AGATGCCGTC TGA
```

This corresponds to the amino acid sequence <SEQ ID 1906; *ORF* 604.a>:

```
a604.pep
   1 MPEAHFFTRS AACGKVDQRT GHGGGGRNGN RGGTHHRVVQ FAHAQGAYQQ

51 IDVGGIHGFA TGGGVIGGGR DEGDFRRVRA GGSFGYVADQ THFQRTVSAD

101 FLEFFQSCGI VVDVVLQLFA RVAQVGGIQE NGRNARVDER GFQTAYIRHI

151 NFIDQIAGWE HTAFAVGWIK KFDLYFGCRE RYAVELKIAC FQNCAVLHRY

201 MGNNGFADVF LPDFDCADAV *
``` m604/a604 97.0% identity in 169 aa overlap

```
                     10        20        30        40        50        60
m604.pep    MPEAHFFTRSAACGKVDQRTGYGGGGRNGNRGGTHHRVVQFAHAQGAYQQIDVGGVHGFA
            |||||||||||||||||||||:|||||||||||||||||||||||||||||||||:||||
            MPEAHFFTRSAACGKVDQRTGHGGGGRNGNRGGTHHRVVQFAHAQGAYQQIDVGGIHGFA
                     10        20        30        40        50        60

70        80        90       100       110       120
m604.pep    TGGGVIGGGRDEGDFRRVRASGSFGYVADQTHFQRTVSADFLEFFQSRGIVVDVVLQLFA
            ||||||||||||||||||||:|||||||||||||||||||||||||| ||||||||||||
            TGGGVIGGGRDEGDFRRVRAGGSFGYVADQTHFQRTVSADFLEFFQSCGIVVDVVLQLFA
                     70        80        80       100       110       120

130       140       150       160      169
m604.pep    CVAQVGGIQENGRNARVDERGFQTAYIRHINFIDQIAGWEHTAFAVGWI
             ||||||||||||||||||||||||||||||||||||||||||||||||
            RVAQVGGIQENGRNARVDERGFQTAYIRHINFIDQIAGWEHTAFAVGWIKKFDLYFGCRE
                    130       140       150       160       170       180 a604        RYAVELKIACFQNCAVLHRYMGNNGFADVFLPDFDCADAVX
                    190       200       210       220
```

The following partial DNA sequence was identified in *N. gonorrhoeae* <SEQ ID 1907>:

```
g605.seq
   1   ATGATGACCG AAATGCAACA ACGCGCCCAA CTGCACCGCC AAATTTGGAA

51   AATCGCCGAC GAAGTACGCG GCGCGGTGGA TGGCTGGGAC TTTAAACAAT
```

-continued

```
 101 ACGTTCTCGG CACACTTTTC TACCGCTTTA TCAGCGAAAA CTTCACCGAC
 151 TATATGCAGG CCGGCGACAG CAGCATTGAT TACGCCGCta tGCCGGACAG
 201 CATCATCACG CCCGAAATCA AAGACGATgc cgtcaaagtc aaAGGCTATT
 251 TCATCtacCc cgGCCAGCTT TTTTgcaata ttgccgccga agcCCATCAA
 301 AACGAAGAGC TCAACACCAA GCTGAAAGAa atCTTTACCG CGATTGAAAG
 351 CTCCGCCTCC GGCTAcccgT CCGAACAAGG CATCAAAGGC TTGTTTGACG
 401 ACTTCgACAC CACCAGCAGC CGGCTCGGCA GCACCGTTGC CGACAAAAAC
 451 AAACGCCTTG CCGCCGTCCT TAAAGGCGTG GCGGAACTCG ATTTCGGCAA
 501 TTTTGAAGAC CACCGCATCG ACCTTTTCGG TGATGCCTAC GAATACCTGA
 551 TTTCCAACTA CGCcgcCAAC GCAGGCAAAT CCGGCGGCGA ATTTTTCACC
 601 CCGCAAAGCG TCTCCAAGCT GATTGCGCGG CTGGCGGTGC ACGGGCAGGA
 651 GAAAGTCAAC AAAATCTACG ACCCCGCCTG CGGCTCGGGC AGCCTGCTCT
 701 TGCAGGCGAA AAAACAGTTT GACGAACACA TCATCGAAGA AGGCTTCTTC
 751 GGGCAGGAAA TCAACCACAC CACCTACAAC CTCGCCCGCA TGAATATGTT
 801 TCTGCACAAC GTCAATTACA ACAAATTCCA CATCGAATTG GGCGACACGC
 851 TGACCAACCC CAAACTCAAA GACAGCAAAC CCTTTGATGC CGTCGTCTCC
 901 AATCCGCCCT ATTCCATCGA CTGGATAGGC AGCGACGACC CCACCTtgaT
 951 CAACGACGAC CGCTTTGCCC CCGCAGGCGT ACTCGCACCG AAATCCAAAG
1001 CCGATTTTGC CTTCATCCTG CACGCACTGA ACTACCTTTC CGGCAGAGGC
1051 CGCGCCGCTA TCGTCTCATT CCCCGGCATT TTCTATCGCG GCGGCGCAGA
1101 GCAGAAAATc CGCCAATATC TGGTGGAGGG CAACTATGTG GAAACCGTGA
1151 TTGCCCTTGC GCCCAATCTC TTTTACGGCA CCTGCATCGC CGTCAATATC
1201 CTGGTTTTGT CCAAACACAA AGACAATACC GACATCCAAT TCATCGACGC
1251 AAGCGGCTTC TTTAAAAAAG AAACCAACAA CAACGTCTTA ACCGAAGAAC
1301 ACATTGCCGA AATCGTCAAA CTCTTCGCCG ACAAAGCCGA TGTGCCGCAT
1351 ATCGCCCAAA ACGCCGCCCA GCAAACCGTC AAAGACAACG GCTACAACCT
1401 CGCCGTCAGC AGCTATGTCG AAGCCGAAGA CACCCGCGAG GTCATCGACA
1451 TCAGACAGCT CAACGCCGAA ATCAGCGAAA CCgtcgCcaa AATCGAACGG
1501 CTGCGGCGTG AAATTGACGA AGTGATTGCA GAGATTGAAA CCTAG
```

This corresponds to the amino acid sequence <SEQ ID 1908; *ORF* 605.ng>:

```
g605.pep
  1 MMTEMQQRAQ LHRQIWKIAD EVRGAVDGWD FKQYVLGTLF YRFISENFTD
 51 YMQAGDSSID YAAMPDSIIT PEIKDDAVKV KGYFIYPGQL FCNIAAEAHQ
101 NEELNTKLKE IFTAIESSAS GYPSEQGIKG LFDDFDTTSS RLGSTVADKN
151 KRLAAVLKGV AELDFGNFED HRIDLFGDAY EYLISNYAAN AGKSGGEFFT
201 PQSVSKLIAR LAVHGQEKVN KIYDPACGSG SLLLQAKKQF DEHIIEEGFF
251 GQEINHTTYN LARMNMFLHN VNYNKFHIEL GDTLTNPKLK DSKPFDAVVS
301 NPPYSIDWIG SDDPTLINDD RFAPAGVLAP KSKADFAFIL HALNYLSGRG
351 RAAIVSFPGI FYRGGAEQKI RQYLVEGNYV ETVIALAPNL FYGTCIAVNI
```

```
401 LVLSKHKDNT DIQFIDASGF FKKETNNNVL TEEHIAEIVK LFADKADVPH

451 IAQNAAQQTV KDNGYNLAVS SYVEAEDTRE VIDIRQLNAE ISETVAKIER

501 LRREIDEVIA EIET*
```

The following partial DNA sequence was identified in *N. meningitidis* <SEQ ID 1909>:

```
m605.seq
    1 ATGATGACCG AAATGCAACA ACGCGCCCAA CTGCACCGCC AAATTTGGAA

51 AATTGCCGAC GAAGTACGCG GCGCGGTGGA TGGCTGGGAC TTTAAACAAT

101 ACGTTCTCGG CACACTTTTC TACCGCTTTA TCAGCGAAAA CTTCACCGAC

151 TATATGCAGG CAGGCGACAG CAGTATTGAT TACGCCGCTA TGCCGGACAG

201 CATCATCACG CCCGAAATCA AAGACGATGC CGTCAAAGTT AAAGGCTATT

251 TCATCTACCC CGGCCAGCTT TTTTGCAATA TTGCCGCCGA AGCCCATCAA

301 AACGAAGAGC TCAACACCAA GCTGAAAGAA ATTTTTACCG CGATTGAAAG

351 CTCCGCCTCC GGCTATCCGT CCGAACAGGA CATCAAAGGC CTGTTTGACG

401 ACTTCGACAC CACCAGCAGC CGGCTCGGCA GCACTGTTGC CGACAAGAAC

451 AAACGCCTTG CCGCCGTCCT CAAAGGCGTG GCGGAACTCG ATTTCGGCAA

501 TTTTGAAAAC CACCACATCG ACCTTTTCGG CGATGCCTAC GAATACCTGA

551 TTTCCAACTA CGCTGCCAAC GCAGGCAAAT CCGGCGGCGA ATTTTTCACC

601 CCGCAAAGCG TATCCAAGCT GATTGCGCGG CTGGCGGTGC ACGGACAGGA

651 GAAAGTCAAC AAAATCTACG ACCCAGCTTG CGGCTCGGGC AGTCTGCTCT

701 TGCAGGCGAA AAAACAGTTT GACGAGCACA TCATCGAAGA AGGCTTCTTC

751 GGGCAGGAAA TCAACCACAC CACCTACAAC CTCGCCCGCA TGAACATGTT

801 CCTGCACAAC GTCAATTACA ACCAATTCCA CATCGAATTG GGCGACACAC

851 TGACCAACCC AAAGCTCAAA GACAGCAAAC CCTTTGATGC CATCGTTTCC

901 AATCCGCCTT ATTCCATCAA CTGGATAGGC AGCGACGACC CCACCTTAAT

951 CAACGACGAC CGCTTTGCCC CCGCAGGCGT ACTTGCCCCG AAATCCAAAG

1001 CCGATTTTGC CTTCATCCTG CACGCACTGA ACTACCTTTC CGGCAGAGGC

1051 CGCGCCGCCA TCGTCTCATT CCCCGGCATT TTCTATCGCG GCGGCGCAGA

1101 ACAGAAAATC CGCCAATATC TGGTGGAGGG CAACTACGTG GAAACCGTGA

1151 TTGCCCTTGC GCCCAATCTC TTTTACGGCA CCGGCATCGC CGTCAATATC

1201 CTGGTTTTGT CCAAACACAA AGACAATACC GACATCCAAT TCATCGACGC

1251 AAGCGGCTTC TTTAAAAAAG AAACCAACAA CAACGTCTTA ATCGAAGAAC

1301 ACATTGCTGA AATCGTCAAA CTCTTCGCCG ATAAAGCCGA TGTGCCGCAT

1351 ATCGCCCAAA ACGCTGCCCA GCAAACCGTC AAAGACAACG GCTACAACCT

1401 CGCCGTCAGC AGCTATGTCG AAGCCGAAGA CACACGCGAA ATTATCGACA

1451 TCAAACAGCT CAACGCCGAA ATCGGCGAAA CCGTCGCCAA AATCGAACGG

1501 CTGCGGCGTG AAATTGACGA AGTGATTGCA GAGATTGAAG CATGA
```

This corresponds to the amino acid sequence <SEQ ID 1910; ORF 605>:

```
m605.pep
   1 MMTEMQQRAQ LHRQIWKIAD EVRGAVDGWD FKQYVLGTLF YRFISENFTD

51 YMQAGDSSID YAAMPDSIIT PEIKDDAVKV KGYFIYPGQL FCNIAAEAHQ

101 NEELNTKLKE IFTAIESSAS GYPSEQDIKG LFDDFDTTSS RLGSTVADKN

151 KRLAAVLKGV AELDFGNFEN HHIDLFGDAY EYLISNYAAN AGKSGGEFFT

201 PQSVSKLIAR LAVHGQEKVN KIYDPACGSG SLLLQAKKQF DEHIIEEGFF

251 GQEINHTTYN LARMNMFLHN VNYNQFHIEL GDTLTNPKLK DSKPFDAIVS

301 NPPYSINWIG SDDPTLINDD RFAPAGVLAP KSKADFAFIL HALNYLSGRG

351 RAAIVSFPGI FYRGGAEQKI RQYLVEGNYV ETVIALAPNL FYGTGIAVNI

401 LVLSKHKDNT DIQFIDASGF FKKETNNNVL IEEHIAEIVK LFADKADVPH

451 IAQNAAQQTV KDNGYNLAVS SYVEAEDTRE IIDIKQLNAE IGETVAKIER

501 LRREIDEVIA EIEA*
```

Computer analysis of this amino acid sequence gave the following results:

Homology with a Predicted ORF from *N. gonorrhoeae*

ORF 605 shows 97.9% identity over a 513 aa overlap with a predicted ORF (ORF 605.ng) from *N. gonorrhoeae*:

```
m605/g605
                       10         20         30         40         50         60
     m605.pep  MMTEMQQRAQLHRQIWKIADEVRGAVDGWDFKQYVLGTLFYRFISENFTDYMQAGDSSID
               ||||||||||||||||||||||||||||||||||||||||||||||||||||||||||||
         g605  MMTEMQQRAQLHRQIWKIADEVRGAVDGWDFKQYVLGTLFYRFISENFTDYMQAGDSSID
                       10         20         30         40         50         60

70         80         90        100        110        120
     m605.pep  YAAMPDSIITPEIKDDAVKVKGYFIYPGQLFCNIAAEAHQNEELNTKLKEIFTAIESSAS
               ||||||||||||||||||||||||||||||||||||||||||||||||||||||||||||
         g605  YAAMPDSIITPEIKDDAVKVKGYFIYPGQLFCNIAAEAHQNEELNTKLKEIFTAIESSAS
                       70         80         90        100        110        120

130        140        150        160        170        180
     m605.pep  GYPSEQDIKGLFDDFDTTSSRLGSTVADKNKRLAAVLKGVAELDFGNFENHHIDLFGDAY
               ||||||| ||||||||||||||||||||||||||||||||||||||||||||:|||||||
         g605  GYPSEQGIKGLFDDFDTTSSRLGSTVADKNKRLAAVLKGVAELDFGNFEDHRIDLFGDAY
                      130        140        150        160        170        180

190        200        210        220        230        240
     m605.pep  EYLISNYAANAGKSGGEFFTPQSVSKLIARLAVHGQEKVNKIYDPACGSGSLLLQAKKQF
               ||||||||||||||||||||||||||||||||||||||||||||||||||||||||||||
         g605  EYLISNYAANAGKSGGEFFTPQSVSKLIARLAVHGQEKVNKIYDPACGSGSLLLQAKKQF
                      190        200        210        220        230        240

250        260        270        280        290        300
     m605.pep  DEHIIEEGFFGQEINHTTYNLARMNMFLHNVNYNQFHIELGDTLTNPKLKDSKPFDAIVS
               ||||||||||||||||||||||||||||||||||||:|||||||||||||||||||:||
         g605  DEHIIEEGFFGQEINHTTYNLARMNMFLHNVNYNKFHIELGDTLTNPKLKDSKPFDAVVS
                      250        260        270        280        290        300

310        320        330        340        350        360
     m605.pep  NPPYSINWIGSDDPTLINDDRFAPAGVLAPKSKADFAFILHALNYLSGRGRAAIVSFPGI
               ||||||:|||||||||||||||||||||||||||||||||||||||||||||||||||||
         g605  NPPYSIDWIGSDDPTLINDDRFAPAGVLAPKSKADFAFILHALNYLSGRGRAAIVSFPGI
                      310        320        330        340        350        360

370        380        390        400        410        420
     m605.pep  FYRGGAEQKIRQYLVEGNYVETVIALAPNLFYGTGIAVNILVLSKHKDNTDIQFIDASGF
               ||||||||||||||||||||||||||||||||||:|||||||||||||||||||||||||
         g605  FYRGGAEQKIRQYLVEGNYVETVIALAPNLFYGTCIAVNILVLSKHKDNTDIQFIDASGF
                      370        380        390        400        410        420

430        440        450        460        470        480
     m605.pep  FKKETNNNVLIEEHIAEIVKLFADKADVPHIAQNAAQQTVKDNGYNLAVSSYVEAEDTRE
               ||||||||||:|||||||||||||||||||||||||||||||||||||||||||||||||
         g605  FKKETNNNVLTEEHIAEIVKLFADKADVPHIAQNAAQQTVKDNGYNLAVSSYVEAEDTRE
                      430        440        450        460        470        480
```

-continued

```
                490       500       510
m605.pep   IIDIKQLNAEIGETVAKIERLRREIDEVIAEIEAX
           :|||:||||||:||||||||||||||||||||:
g605       VIDIRQLNAEISETVAKIERLRREIDEVIAEIETX
                490       500       510
```

The following partial DNA sequence was identified in *N. meningitidis* <SEQ ID 1911>:

```
a605.seq
   1 ATGATGACCG AAATACAACA ACGCGCCCAA CTGCACCGCC AAATTTGGAA
  51 AATTGCCGAC GAAGTACGCG GCGCGGTGGA TGGCTGGGAC TTCAAACAAT
 101 ACGTTCTCGG CACACTTTTC TACCGCTTTA TCAGCGAAAA CTTTACCGAC
 151 TATATGCAGG CAGGCGACAG CAGTATTGAT TACGCCGCTA TGCCGGACAG
 201 CATCATCACG CCCGAAATCA AAGACGATGC CGTCAAAGTC AAAGGCTATT
 251 TCATCTACCC CGGCCAGCTT TTTTGCAATA TTGCCGCCGA AGCCCATCAA
 301 AACGAAGAGC TCAACACCAA GCTGAAAGAA ATTTTTACCG CGATTGAAAG
 351 CTCCGCCTCC GGCTATCCGT CCGAACAAGA CATTAAAGGC CTGTTTGACG
 401 ACTTCGACAC CACCAGCAGC CGGCTCGGCA GCACCGTTGC CGACAAGAAC
 451 AAACGCCTTG CCGCCGTCCT AAAAGGCGTG GCGGAACTCG ATTTCGGCAG
 501 TTTTGAAGAC CACCACATCG ACCTTTTCGG CGATGCCTAC GAATACCTGA
 551 TTTCCAACTA CGCTGCCAAC GCAGGCAAAT CCGGCGGCGA ATTTTTCACC
 601 CCGCAAAGCG TATCCAAGCT GATTGCGCGG CTGGCGGTGC ACGGGCAGGA
 651 GAAAGTAAAC AAAATCTACG ACCCAGCTTG CGGCTCGGGC AGCCTGCTCT
 701 TGCAGGCGAA AAAACAGTTT GACGAGCACA TCATCGAAGA AGGCTTCTTC
 751 GGGCAGGAAA TCAACCACAC CACCTACAAC CTCGCCCGCA TGAATATGTT
 801 TCTGCACAAC GTCAATTACA ACAAATTCCA CATCGAATTG GGCGACACAC
 851 TGACCAATCC CAAACTCAAA GACAGCAAAC CCTTTGATGC CGTCGTTTCC
 901 AATCCGCCCT ATTCCATCAA CTGGATAGGC AGCGGCGACC CCACCTTAAT
 951 CAACGACGAC CGCTTTGCCC CTGCAGGCGT ACTCGCCCCG AAATCCAAAG
1001 CCGATTTTGC CTTCATTCTG CACGCACTGA ACTACCTTTC CGGCAGAGGC
1051 CGCGCCGCCA TCGTCTCATT CCCCGGCATT TTCTATCGCG GCGGCGCAGA
1101 GCAGAAAATC CGCCAATATC TGGTGGAGGG CAACTACGTG GAAACCGTCA
1151 TCGCCCTTGC GCCCAATCTC TTTTACGGCA CCGGCATCGC CGTCAATATA
1201 CTGGTTTTGT CCAAACACAA AGACAATACC GACATCCAAT TCATCGACGC
1251 AGGCGGCTTC TTTAAAAAAG AAACCAACAA CAACGTCTTA ACCGAAGAAC
1301 ACATTGCCGA AATCGTCAAA CTCTTCGCCG ATAAAGCCGA TGTGCCGCAT
1351 ATCGCCCAAA ACGCCGCCCA GCAAACCGTC AAAGACAACG GCTACAACCT
1401 CGCCGTCAGC AGCTATGTTG AACCCGAAGA CACCCGCGAA ATTATCGACA
1451 TCAAACAGCT TAACGCCGAA ATCAGCGAAA CCGTTGCCAA AATCGAACGG
1501 CTGCGGCGTG AAATTGACGA AGTGATTGCA GAGATTGAAG CATGA
```

This corresponds to the amino acid sequence <SEQ ID 1912; ORF 605.a>:

```
a605.pep
   1 MMTEIQQRAQ LHRQIWKIAD EVRGAVDGWD FKQYVLGTLF YRFISENFTD

51 YMQAGDSSID YAAMPDSIIT PEIKDDAVKV KGYFIYPGQL FCNIAAEAHQ

101 NEELNTKLKE IFTAIESSAS GYPSEQDIKG LFDDFDTTSS RLGSTVADKN

151 KRLAAVLKGV AELDFGSFED HHIDLFGDAY EYLISNYAAN AGKSGGEFFT

201 PQSVSKLIAR LAVHGQEKVN KIYDPACGSG SLLLQAKKQF DEHIIEEGFF

251 GQEINHTTYN LARMNMFLHN VNYNKFHIEL GDTLTNPKLK DSKPFDAVVS

301 NPPYSINWIG SGDPTLINDD RFAPAGVLAP KSKADFAFIL HALNYLSGRG

351 RAAIVSFPGI FYRGGAEQKI RQYLVEGNYV ETVIALAPNL FYGTGIAVNI

401 LVLSKHKDNT DIQFIDAGGF FKKETNNNVL TEEHIAEIVK LFADKADVPH

451 IAQNAAQQTV KDNGYNLAVS SYVEPEDTRE IIDIKQLNAE ISETVAKIER

501 LRREIDEVIA EIEA*
``` m605/a605 98.1% identity in 514 aa overlap

```
                  10         20         30         40         50         60
m605.pep  MMTEMQQRAQLHRQIWKIADEVRGAVDGWDFKQYVLGTLFYRFISENFTDYMQAGDSSID
          ||||:|||||||||||||||||||||||||||||||||||||||||||||||||||||||
a605      MMTEIQQRAQLHRQIWKIADEVRGAVDGWDFKQYVLGTLFYRFISENFTDYMQAGDSSID
                  10         20         30         40         50         60

70         80         90        100        110        120
m605.pep  YAAMPDSIITPEIKDDAVKVKGYFIYPGQLFCNIAAEAHQNEELNTKLKEIFTAIESSAS
          ||||||||||||||||||||||||||||||||||||||||||||||||||||||||||||
a605      YAAMPDSIITPEIKDDAVKVKGYFIYPGQLFCNIAAEAHQNEELNTKLKEIFTAIESSAS
                  70         80         90        100        110        120

130        140        150        160        170        180
m605.pep  GYPSEQDIKGLFDDFDTTSSRLGSTVADKNKRLAAVLKGVAELDFGNFENHHIDLFGDAY
          |||||||||||||||||||||||||||||||||||||||||||||||:||:|||||||||
a605      GYPSEQDIKGLFDDFDTTSSRLGSTVADKNKRLAAVLKGVAELDFGSFEDHHIDLFGDAY
                 130        140        150        160        170        180

190        200        210        220        230        240
m605.pep  EYLISNYAANAGKSGGEFFTPQSVSKLIARLAVHGQEKVNKIYDPACGSGSLLLQAKKQF
          ||||||||||||||||||||||||||||||||||||||||||||||||||||||||||||
a605      EYLISNYAANAGKSGGEFFTPQSVSKLIARLAVHGQEKVNKIYDPACGSGSLLLQAKKQF
                 190        200        210        220        230        240

250        260        270        280        290        300
m605.pep  DEHIIEEGFFGQEINHTTYNLARMNMFLHNVNYNQFHIELGDTLTNPKLKDSKPFDAIVS
          |||||||||||||||||||||||||||||||||||:||||||||||||||||||||||:||
a605      DEHIIEEGFFGQEINHTTYNLARMNMFLHNVNYNKFHIELGDTLTNPKLKDSKPFDAVVS
                 250        260        270        280        290        300

310        320        330        340        350        360
m605.pep  NPPYSINWIGSDDPTLINDDRFAPAGVLAPKSKADFAFILHALNYLSGRGRAAIVSFPGI
          |||||||||||:|||||||||||||||||||||||||||||||||||||||||||||||||
a605      NPPYSINWIGSGDPTLINDDRFAPAGVLAPKSKADFAFILHALNYLSGRGRAAIVSFPGI
                 310        320        330        340        350        360

370        380        390        400        410        420
m605.pep  FYRGGAEQKIRQYLVEGNYVETVIALAPNLFYGTGIAVNILVLSKHKDNTDIQFIDASGF
          |||||||||||||||||||||||||||||||||||||||||||||||||||||||||:||
a605      FYRGGAEQKIRQYLVEGNYVETVIALAPNLFYGTGIAVNILVLSKHKDNTDIQFIDAGGF
                 370        380        390        400        410        420

430        440        450        460        470        480
m605.pep  FKKETNNNVLIEEHIAEIVKLFADKADVPHIAQNAAQQTVKDNGYNLAVSSYVEAEDTRE
          |||||||||| |||||||||||||||||||||||||||||||||||||||||||| |||||
a605      FKKETNNNVLTEEHIAEIVKLFADKADVPHIAQNAAQQTVKDNGYNLAVSSYVEPEDTRE
                 430        440        450        460        470        480

490        500        510
m605.pep  IIDIKQLNAEIGETVAKIERLRREIDEVIAEIEAX
          ||||||||||:|||||||||||||||||||||||||
a605      IIDIKQLNAEISETVAKIERLRREIDEVIAEIEAX
                 490        500        510
```

The following partial DNA sequence was identified in *N. gonorrhoeae* <SEQ ID 1913>:

```
g606.seq
    1 ATGTCCAAAT TTATCGCCAA ACAATCGGTC GGTGCGGAAG TCATCGACAC

51 GCCGcgCACC GAAGAAGAAG CCTGGCTTCT GAACACTGTC GAAGCCCAAg 101 cgcGGCAATG GAATCTGAAA ACGCCAGAAG TCGCCATCTA CCACTCCCCC

151 GAACCCAATG CCTTTGCCAC GGGCGCATCG AGAAACAGCT CCCTGATCGC

201 CGTCAGCacc ggtttgctcg accaTAtgaC GCGCGACgaa gtggaagccg 251 tgTTGGCGCA CGAAATGGCG CACGTCGGCA ACGGCGACAT GGTTACGCTG 301 ACGCTGAtTC AAGGCGTGGT CAATACCTTT GTCGTGTTCC TGTCGCGCAT

351 TATTGCCAAC CTGATTGCCC GAAACAACGA CGGCAGCCAG TCCCAGGGAA

401 CTTATTTCCT AGTCAGCATG GTATTCCAAA TCCTGTTCGG CTTCCTTGCC

451 AGCCTGATTG TCATGTGGTT CAGCCGCCAA CGCGAATACC GCGCCGAcgc 501 gggCGcggCA AAACTGGTCG GCGCACCGAA AATGATTTCC GCCCTGCAAA

551 GGCTTAAAGG CAACCCGGTC GATTTGCCCG AAGAAATGAA CGCAATGGGC

601 ATCGCCGGAG ATACGCGCGA CTCCCTGCTC AGCACCCACC CTTCGCTGGA

651 CAACCGAATC GCCCGCCTCA AATCGCTTTA A
```

This corresponds to the amino acid sequence <SEQ ID 1914; *ORF*606.ng>:

```
g606.pep
    1 MSKFIAKQSV GAEVIDTPRT EEEAWLLNTV EAQARQWNLK TPEVAIYHSP

51 EPNAFATGAS RNSSLIAVST GLLDHMTRDE VEAVLAHEMA HVGNGDMVTL

101 TLIQGVVNTF VVFLSRIIAN LIARNNDGSQ SQGTYFLVSM VFQILFGFLA

151 SLIVMWFSRQ REYRADAGAA KLVGAPKMIS ALQRLKGNPV DLPEEMNAMG

201 IAGDTRDSLL STHPSLDNRI ARLKSL*
```

40

The following partial DNA sequence was identified in *N. meningitidis* <SEQ ID 1915>:

```
m606.seq
    1 ATGTCCAAAT TTATCGCCAA ACAATCGGTC GGCGCGGAAG TTATCGACAC

51 GCCGCGCACC GAAGAAGAAG CCTGGCTTTT GAACACTGTC GAAGCCCAAG

101 CGCGGCAATG GAACCTGAAA ACGCCCGAAG TCGCCATCTA CCACTCCCCC

151 GAACCCAATG CCTTTGCCAC GGGCGCATCG AGAAACAGCT CCCTGATCGC

201 CGTCAGCACC GGTTTGCTCG ACCATATGAC GCGTGACGAA GTGGAAGCCG

251 TATTGGCGCA CGAAATGGCA CACGTCGGCA ACGGCGATAT GGTTACGCTG

301 ACGCTGATTC AAGGCGTGGT CAATACCTTT GTCGTGTTCC TGTCGCGCAT

351 TATTGCCAAC CTGATTGCCC GAAACAACGA CGGCAGCCAG TCCCAGGGAA

401 CTTATTTCCT GGTCAGCATG GTATTCCAAA TCCTGTTCGG CTTCCTTGCC

451 AGCTTAATTG TCATGTGGTT CAGCCGACAA CGCGAATACC GCGCCGATGC

501 GGGCGCGGCA AAACTGGTCG GCGCGCCGAA AATGATTTCC GCCCTGCAAA

551 GGCTCAAAGG CAACCCGGTC GATTTGCCCG AAGAAATGAA CGCAATGGGC
```

```
601 ATCGCCGGAG ATACGCGCGA CTCCCTGCTC AGCACCCACC CTTCGCTGGA

651 CAACCGTATC GCCCGCCTCA AATCGCTTTA A
```

This corresponds to the amino acid sequence <SEQ ID 1916; ORF 606>:

```
m606.pep
  1 MSKFIAKQSV GAEVIDTPRT EEEAWLLNTV EAQARQWNLK TPEVAIYHSP

51 EPNAFATGAS RNSSLIAVST GLLDHMTRDE VEAVLAHEMA HVGNGDMVTL

101 TLIQGVVNTF VVFLSRIIAN LIARNNDGSQ SQGTYFLVSM VFQILFGFLA

151 SLIVMWFSRQ REYRADAGAA KLVGAPKMIS ALQRLKGNPV DLPEEMNAMG

201 IAGDTRDSLL STHPSLDNRI ARLKSL*
```

Computer analysis of this amino acid sequence gave the following results:

Homology with a Predicted ORF from *N. gonorrhoeae*

ORF 606 shows 100.0% identity over a 225 aa overlap with a predicted ORF (ORF 606.ng) from *N. gonorrhoeae*:

```
   m606.g606
                      10         20         30         40         50         60
       m606.pep  MSKFIAKQSVGAEVIDTPRTEEEAWLLNTVEAQARQWNLKTPEVAIYHSPEPNAFATGAS
                 ||||||||||||||||||||||||||||||||||||||||||||||||||||||||||||
           g606  MSKFIAKQSVGAEVIDTPRTEEEAWLLNTVEAQARQWNLKTPEVAIYHSPEPNAFATGAS
                      10         20         30         40         50         60
                      70         80         90        100        110        120
       m606.pep  RNSSLIAVSTGLLDHMTRDEVEAVLAHEMAHVGNGDMVTLTLIQGVVNTFVVFLSRIIAN
                 ||||||||||||||||||||||||||||||||||||||||||||||||||||||||||||
           g606  RNSSLIAVSTGLLDHMTRDEVEAVLAHEMAHVGNGDMVTLTLIQGVVNTFVVFLSRIIAN
                      70         80         80        100        110        120
                     130        140        150        160        170        170
       m606.pep  LIARNNDGSQSQGTYFLVSMVFQILFGFLASLIVMWFSRQREYRADAGAAKLVGAPKMIS
                 ||||||||||||||||||||||||||||||||||||||||||||||||||||||||||||
           g606  LIARNNDGSQSQGTYFLVSMVFQILFGFLASLIVMWFSRQREYRADAGAAKLVGAPKMIS
                     130        140        150        160        170        180
                     190        200        210        220
       m606.pep  ALQRLKGNPVDLPEEMNAMGIAGDTRDSLLSTHPSLDNRIARLKSLX
                 |||||||||||||||||||||||||||||||||||||||||||||||
           g606  ALQRLKGNPVDLPEEMNAMGIAGDTRDSLLSTHPSLDNRIARLKSLX
                     190        200        210        220
```

The following partial DNA sequence was identified in *N. meningitidis* <SEQ ID 1917>:

```
a606.seq
  1 ATGTCCAAAT TCATCGCCAA ACAATCGGTC GGCGCGGAAG TTATCGACAC

51 GCCGCGCACC GAAGAAGAAG CCTGGCTTTT GAACACTGTC GAAGCCCAAG

101 CGCGGCAATG GAACCTGAAA ACGCCCGAAG TCGCCATCTA CCACTCCCCC

151 GAACCCAATG CCTTTGCCAC GGGCGCATCG AGAAACAGCT CCCTGATCGC

201 CGTCAGCACC GGTTTGCTCG ACCATATGAC GCGTGACGAA GTGGAAGCCG

251 TATTGGCGCA CGAAATGGCA CACGTCGGCA ACGGCGATAT GGTTACGCTG

301 ACGCTGATTC AAGGCGTGGT CAATACCTTT GTCGTGTTCC TGTCGCGCAT

351 TATTGCCAAC CTGATTGCCC GAAACAACGA CGGCAGCCAG TCCCAGGGAA

401 CTTATTTCCT GGTCAGCATG GTATTCCAAA TCCTGTTCGG CTTCCTTGCC

451 AGCTTAATTG TCATGTGGTT CAGCCGACAA CGCGAATACC GCGCCGACGC

501 GGGCGCGGCA AAACTGGTCG GCGCGCCGAA AATGATTTCC GCCCTGCAAA
```

-continued

```
551 GGCTTAAAGG CAACCCGGTC GATTTGCCCG AAGAAATGAA CGCAATGGGC

601 ATCGCCGGAG ATACGCGCGA CTCCCTGCTC AGCACCCACC CTTCGCTGGA

651 CAACCGAATC GCCCGCCTCA AATCGCTTTA A
```

This corresponds to the amino acid sequence <SEQ ID 1918; ORF 606.a>:

```
a606.pep
  1 MSKFIAKQSV GAEVIDTPRT EEEAWLLNTV EAQARQWNLK TPEVAIYHSP

51 EPNAFATGAS RNSSLIAVST GLLDHMTRDE VEAVLAHEMA HVGNGDMVTL

101 TLIQGVVNTF VVFLSRIIAN LIARNNDGSQ SQGTYFLVSM VFQILFGFLA

151 SLIVMWFSRQ REYRADAGAA KLVGAPKMIS ALQRLKGNPV DLPEEMNAMG

201 IAGDTRDSLL STHPSLDNRI ARLKSL*
``` m606/a606 100.0% identity in 226 aa overlap

```
                 10         20         30         40         50         60
m606.pep  MSKFIAKQSVGAEVIDTPRTEEEAWLLNTVEAQARQWNLKTPEVAIYHSPEPNAFATGAS
          ||||||||||||||||||||||||||||||||||||||||||||||||||||||||||||
a606      MSKFIAKQSVGAEVIDTPRTEEEAWLLNTVEAQARQWNLKTPEVAIYHSPEPNAFATGAS
                 10         20         30         40         50         60

70         80         90        100        110        120
m606.pep  RNSSLIAVSTGLLDHMTRDEVEAVLAHEMAHVGNGDMVTLTLIQGVVNTFVVFLSRIIAN
          ||||||||||||||||||||||||||||||||||||||||||||||||||||||||||||
a606      RNSSLIAVSTGLLDHMTRDEVEAVLAHEMAHVGNGDMVTLTLIQGVVNTFVVFLSRIIAN
                 70         80         90        100        110        120

130        140        150        160        170        180
m606.pep  LIARNNDGSQSQGTYFLVSMVFQILFGFLASLIVMWFSRQREYRADAGAAKLVGAPKMIS
          ||||||||||||||||||||||||||||||||||||||||||||||||||||||||||||
a606      LIARNNDGSQSQGTYFLVSMVFQILFGFLASLIVMWFSRQREYRADAGAAKLVGAPKMIS
                130        140        150        160        170        180

190        200        210        220
m606.pep  ALQRLKGNPVDLPEEMNAMGIAGDTRDSLLSTHPSLDNRIARLKSLX
          |||||||||||||||||||||||||||||||||||||||||||||||
a606      ALQRLKGNPVDLPEEMNAMGIAGDTRDSLLSTHPSLDNRIARLKSLX
                190        200        210        220
```

The following partial DNA sequence was identified in *N. gonorrhoeae* <SEQ ID 1919>:

```
g607.seq
  1 ATGCTGCTCG accTcgaCCG CTTTTCCTtt tccGTCTTCC TGAAAGAAAT

51 CCGCCTGCTG ACCGCCCTTG CCCTGCCCAT GCTGTTGGCG CAGGTCGCGC

101 AGGTGGGCAT CGGTTTCGTC GATACCGTGA TGGCGGGCGG TGCGGGCAAG

151 GAAGATTTGG CGGCGGTGGC TTTGGGCAGC AGCGCGTTTG CCACGGTTTA

201 TATTACCTTT ATGGGCATTA TGGCGGCGCT GAACCCGATG ATTGCCCAGC

251 TTTACGGCGC GGGTAAAACC GgtgAAGCAG GCGAAACGGG GCGGCAGGGG

301 ATTTGGTTCG GCTGATTTT GGGGATTTTC GGCATGATTT TGATGTGGGC

351 GGCGATTACG CCGTTCCGCA ACTGGCTGAC TTTGAGCGAT TATGTGGAAG 401 gcacAAtggc gcAGTATATG CTGTTCACCA GCTTGGCGAT GCCGGCGGCA

451 ATGGTACACC GCGCACTGCA CGCCTACGCT TCCAGCCTGA ACCGCCGCG

501 CCTGATTATG TTGGTCAGCT TGCGGCGTT TGTGTTGAAC GTGCCGCTGA

551 ACTATATTTT CGTTTACGGC AAATTCGGTA TGCCCGCTTT GGGTGGCGCA

601 GGTTGCGGCG TGGCGACAAT GGCGGTGTTT TGGTTCAGCG CGCTGGCATT
```

-continued

```
 651 GTGGATTTAT ATCGCCAAGG AAAAATTCTT CCGCCCGTTC GGACTGACAG

701 CGAAATTCGg caaACCGGat tGGgcGGTGT TCAAACAGAT TtGGAAAATC 751 gGcgcgCCCA TCGGGCTGTC TTATTTTTTG GAAgccaGcg cGTTTTCGTT 801 TATCGTGTTT TTGATTGCGC CTttcggCGA GGATTATGTG GCGGCGCAGC

851 AGGTCGGCAT CAGTTTGTCG GGGATTCTCT ATATGATTCC GCAAAGCGTC

901 GGCTCGGCAG GGACGGTGCG CATCGGCTTT TCGCTTGGGC GGCGCGAATT

951 TTCGCGGGCG CGTTATATTT CAGGAGTGTC GCTGGTGTCG GGCTGGGTGC

1001 TCGCCGTGAT TACCGTGCTT TCCTTGGTAT TATTCCGTTC GCCGCTGGCA

1051 AGCATGTACA ACGATGaTCC GGCAGTTTTA AGCATCGCCT CCACCGTCCT

1101 GCTGTTCGCC GGCCTGTtcc aACCGGCAGA CTTCACCCAA TGTATCGCGT

1151 CCTATGCCCT GCGCGGCTAC AAAGTCACCA AGGTGCCGAT GTTCATCCAC

1201 GCCGCCGCCT TCTGGGGCTG CGGCCTGCTG CCGGGCTATC TGCTCGCCTA

1251 CCGTTTCGAT ATGGGCATTT ACGGCTTCTG GACGGCATTG ATTGCCTCGC

1301 TCACCATCGC AGCCGTCGCC TTGGTGTGGT GCTTGGAAAA ATACAGTATG

1351 GAGTTGGTCA AATCACACAA GGCCGTCTGA
```

This corresponds to the amino acid sequence <SEQ ID 1920; ORF 607.ng>:

```
g607.pep
   1 MLLDLDRFSF SVFLKEIRLL TALALPMLLA QVAQVGIGFV DTVMAGGAGK

51 EDLAAVALGS SAFATVYITF MGIMAALNPM IAQLYGAGKT GEAGETGRQG

101 IWFGLILGIF GMILMWAAIT PFRNWLTLSD YVEGTMAQYM LFTSLAMPAA

151 MVHRALHAYA SSLNRPRLIM LVSFAAFVLN VPLNYIFVYG KFGMPALGGA

201 GCGVATMAVF WFSALALWIY IAKEKFFRPF GLTAKFGKPD WAVFKQIWKI

251 GAPIGLSYFL EASAFSFIVF LIAPFGEDYV AAQQVGISLS GILYMIPQSV

301 GSAGTVRIGF SLGRREFSRA RYISGVSLVS GWVLAVITVL SLVLFRSPLA

351 SMYNDDPAVL SIASTVLLFA GLFQPADFTQ CIASYALRGY KVTKVPMFIH

401 AAAFWGCGLL PGYLLAYRFD MGIYGFWTAL IASLTIAAVA LVWCLEKYSM

451 ELVKSHKAV*
```

The following partial DNA sequence was identified in *N. meningitidis* <SEQ ID 1921>:

```
m607.seq
   1 ATGCTGCTCG ACCTCAACCG CTTTTCCTTT CCCGTCTTCC TGAAAGAAGT

51 CCGCCTGCTG ACCACTCTTG CCCTGCCCAT GCTGTTGGCG CAGGTCGCGC

101 AGGTGGGCAT CGGTTTTGTC GATACTGTGA TGGCGGGCGG TGCGGGCAAG

151 GAAGACTTGG CGGCGGTGGC TTTGGGCAGC AGCGCGTTTG CCACGGTTTA

201 TATTACCTTT ATGGGCATTA TGGCGGCGCT GAACCCGATG ATTGCCCAGC

251 TTTACGGCGC GGGTAAAACC GACGAAGTGG CGAAACGGG GCGGCAGGGG

301 ATTTGGTTCG GGCTGTTTTT GGGCGTGTTC GGCATGGTCT TGATGTGGGC

351 GGCGATTACG CCGTTCCGCA ACTGGCTGAC CTTGAGCGAT TATGTGGAAG

401 GCACGATGGC GCAGTATATG TTGTTCACCA GCTTGGCGAT GCCGGCGGCA
```

-continued

```
 451 ATGGTACACC GCGCGCTGCA CGCCTACACT TCCAGCCTGA ACCGCCCGCG

501 CCTGATTATG TTGGTCAGCT TTGCGGCGTT TGTGTTGAAC GTGCCGCTGA

551 ACTATATTTT CGTTTACGGC AAATTCGGTA TGCCCGCTTT GGGCGGCGCA

601 GGCTGCGGAC TGGCGACGAT GGCGGTGTTT TGGTTCAGCG CGCTGGCATT

651 GTGGATTTAT ATCGCCAAGG AAAATTTCTT CCGCCCATTC GGACTGACGG

701 CGAAATTCGG CAAACCGGAT TGGGCGGTGT TCAAACAGAT TTGGAAAATC

751 GGCGCACCCA TCGGGCTGTC TTATTTTTTG GAAGCCAGCG CGTTTTCGTT

801 TATCGTGTTT TTGATTGCGC CTTTCGGCGA GGATTATGTG GCGGCGCAGC

851 AGGTCGGCAT CAGTTTGTCG GGGATTCTCT ATATGATTCC GCAAAGCGTC

901 GGCTCGGCGG GGACGGTGCG CATCGGCTTT TCGCTTGGGC GGCGCGAATT

951 TTCGCGGGCG CGTTATATTT CGGGCGTGTC ACTGGTGTTA GGATGGATGC

1001 TCGCCGTGAT TACCGTGCTT TCCTTGGTAT TATTCCGTTC GCCGCTGGTA

1051 AGTATGTACA ACAATGATCC GGCGGTTTTA AGCATCGCCG CCACCGTCTT

1101 ACTGTTCGCC GGCTTGTTCC AACCGGCAGA CTTCACCCAA TGTATCGCCT

1151 CCTACGCCTT GCGCGGCTAC AAAGTTACAA AGGTGCCGAT GTTCATCCAC

1201 GCCGCCGCCT TTTGGGGCTG CGGCCTGCTG CCGGGCTATC TGCTCGCCTA

1251 CCGTTTCAAT ATGGGCATTT ACGGCTTCTG GACGGCATTG ATTGCCTCGC

1301 TCACCATCGC CGCCATCGCC TTGGTGTGGT GCTTGGAATT GTGCAGTAGG

1351 GAGATGGTCA GATCGCATAA GGCCGTCTGA
```

This corresponds to the amino acid sequence <SEQ ID 1922; *ORF 607*>:

```
m607.pep
   1 MLLDLNRFSF PVFLKEVRLL TTLALPMLLA QVAQVGIGFV DTVMAGGAGK

51 EDLAAVALGS SAFATVYITF MGIMAALNPM IAQLYGAGKT DEVGETGRQG

101 IWFGLFLGVF GMVLMWAAIT PFRNWLTLSD YVEGTMAQYM LFTSLAMPAA

151 MVHRALHAYT SSLNRPRLIM LVSFAAFVLN VPLNYIFVYG KFGMPALGGA

201 GCGLATMAVF WFSALALWIY IAKENFFRPF GLTAKFGKPD WAVFKQIWKI

251 GAPIGLSYFL EASAFSFIVF LIAPFGEDYV AAQQVGISLS GILYMIPQSV

301 GSAGTVRIGF SLGRREFSRA RYISGVSLVL GWMLAVITVL SLVLFRSPLV

351 SMYNNDPAVL SIAATVLLFA GLFQPADFTQ CIASYALRGY KVTKVPMFIH

401 AAAFWGCGLL PGYLLAYRFN MGIYGFWTAL IASLTIAAIA LVWCLELCSR

451 EMVRSHKAV*
```

Computer analysis of this amino acid sequence gave the following results:
Homology with a Predicted ORF from *N. gonorrhoeae*
ORF 607 shows 94.8% identity over a 459 aa overlap with a predicted ORF (ORF 607.ng) from *N. gonorrhoeae*:

```
    m607/g607
                    10         20         30         40         50         60
    m607.pep  MLLDLNRFSFPVFLKEVRLLTTLALPMLLAQVAQVGIGFVDTVMAGGAGKEDLAAVALGS
              |||||:|||| |||||:||||:||||||||||||||||||||||||||||||||||||||
    g607      MLLDLDRFSFSVFLKEIRLLTALALPMLLAQVAQVGIGFVDTVMAGGAGKEDLAAVALGS
                    10         20         30         40         50         60
```

-continued

```
                    70        80        90       100       110       120
m607.pep   SAFATVYITFMGIMAALNPMIAQLYGAGKTDEVGETGRQGIWFGLFLGVFGMVLMWAAIT
           |||||||||||||||||||||||||||||| |:||||||||||||:||:|||:|||||||
g607       SAFATVYITFMGIMAALNPMIAQLYGAGKTGEAGETGRQGIWFGLILGIFGMILMWAAIT
                    70        80        90       100       110       120

130       140       150       160       170       180
m607.pep   PFRNWLTLSDYVEGTMAQYMLFTSLAMPAAMVHRALHAYTSSLNRPRLIMLVSFAAFVLN
           |||||||||||||||||||||||||||||||||||||||:||||||||||||||||||||
g607       PFRNWLTLSDYVEGTMAQYMLFTSLAMPAAMVHRALHAYASSLNRPRLIMLVSFAAFVLN
                   130       140       150       160       170       180

190       200       210       220       230       240
m607.pep   VPLNYIFVYGKFGMPALGGAGCGLATMAVFWFSALALWIYIAKENFFRPFGLTAKFGKPD
           |||||||||||||||||||||||:||||||||||||||||||||:|||||||||||||||
g607       VPLNYIFVYGKFGMPALGGAGCGVATMAVFWFSALALWIYIAKEKFFRPFGLTAKFGKPD
                   190       200       210       220       230       240

250       260       270       280       290       300
m607.pep   WAVFKQIWKIGAPIGLSYFLEASAFSFIVFLIAPFGEDYVAAQQVGISLSGILYMIPQSV
           ||||||||||||||||||||||||||||||||||||||||||||||||||||||||||||
g607       WAVFKQIWKIGAPIGLSYFLEASAFSFIVFLIAPFGEDYVAAQQVGISLSGILYMIPQSV
                   250       260       270       280       290       300

310       320       330       340       350       360
m607.pep   GSAGTVRIGFSLGRREFSRARYISGVSLVLGWMLAVITVLSLVLFRSPLVSMYNNDPAVL
           ||||||||||||||||||||||||||||| ||:||||||||||||||||:||||:|||||
g607       GSAGTVRIGFSLGRREFSRARYISGVSLVSGWVLAVITVLSLVLFRSPLASMYNDDPAVL
                   310       320       330       340       350       360

370       380       390       400       410       420
m607.pep   SIAATVLLFAGLFQPADFTQCIASYALRGYKVTKVPMFIHAAAFWGCGLLPGYLLAYRFN
           |||:|||||||||||||||||||||||||||||||||||||||||||||||||||||||:
g607       SIASTVLLFAGLFQPADFTQCIASYALRGYKVTKVPMFIHAAAFWGCGLLPGYLLAYRFD
                   370       380       390       400       410       420

430       440       450       460
m607.pep   MGIYGFWTALIASLTIAAIALVWCLELCSREMVRSHKAVX
           ||||||||||||||||||:|||||||  | |:|:||||||
g607       MGIYGFWTALIASLTIAAVALVWCLEKYSMELVKSHKAVX
                   430       440       450       460
```

The following partial DNA sequence was identified in *N. meningitidis* <SEQ ID 1923>:

```
a607.seq
   1  ATGCTGCTCG ACCTCAACCG CTTTTCCTTT TCCGTCTTCC TGAAAGAAGT

51  CCGCCTGCTG ACCGCTCTTG CCCTGCCCAT GCTGTTGGCG CAGGTCGCGC

101  AGGTGGGCAT CGGTTTTGTC GATACCGTGA TGGCGGGCGG TGCGGGCAAG

151  GAAGACTTGG CGGCGGTGGC TTTGGGCAGC AGCGCGTTTG CCACGGTTTA

201  TATTACCTTT ATGGGCATTA TGGCGGCGCT GAACCCGATG ATTGCCCAGC

251  TTTACGGCGC GGGTAAAACC GACGAAGTGG GCGAAACGGG ACGGCAGGGG

301  ATTTGGTTCG GGCTGTTTTT GGGCGTGTTC GGCATGGTCT TGATGTGGGC

351  GGCGATTACG CCGTTCCGCA ACTGGCTGAC CTTGAGCGAT TATGTGGAAG

401  GCACAATGGC GCAGTATATG CTGTTCACCA GCTTGGCGAT GCCGGCGGCA

451  ATGGTACACC GCGCACTGCA CGCCTACGCC TCCAGCCTGA ACCGCCCGCG

501  CCTGATTATG TTGGTCAGCT TTGCGGCGTT TGTGTTGAAC GTGCCGCTGA

551  ACTATATTTT CGTTTACGGC AAATTCGGTA TGCCCGCTTT GGGCGGCGCA

601  GGCTGCGGAC TGGCGACGAT GGCGGTGTTT TGGTTCAGCG CGCTGGCATT

651  GTGGATTTAT ATCGCCAAGG AAAATTTCTT CCGCCCATTC GGACTGACGG

701  CGAAATTCGG CAAACCGGAT TGGGCGGTGT TCAAACAGAT TTGGAAAATC

751  GGCGCACCCA TCGGGCTGTC TTATTTTTTG GAAGCCAGCG CGTTTTCGTT

801  TATCGTGTTT TTGATTGCGC CTTTCGGCGA GGATTATGTG GCGGCGCAGC

851  AGGTCGGCAT CAGTTTGTCG GGGATTCTCT ATATGATTCC GCAAAGCGTC

901  GGCTCGGCGG GGACGGTGCG CATCGGCTTT TCGCTTGGGC GGCGCGAATT
```

-continued

```
 951 TTCGCGGGCG CGTTATATTT CGGGCGTGTC ACTGGTGTCA GGATGGATGC

1001 TCGCCGTGAT TACCGTGCTT CCTTGGTAT TATTCCGTTC GCCGCTGGTA

1051 AGTATGTACA ACAATGATCC GGCGGTTTTA AGCATCGCCG CCACCGTCTT

1101 ACTGTTCGCC GGCTTGTTCC AACCGGCAGA CTTCACCCAA TGTATCGCCT

1151 CCTACGCCTT GCGCGGCTAC AAAGTTACAA AGGTGCCGAT GTTCATCCAC

1201 GCCGCCGCCT TTTGGGGCTG CGGTCTGCTG CCGGGCTACC TGCTCGCCTA

1251 CCGTTTCGAT ATGGGCATTT ACGGCTTCTG GACGGCATTG ATTGCCTCGC

1301 TCACCATCGC CGCCATCGCC TTGGTGTGGT GCTTGGAATT GTGCAGTAGG

1351 GAGATGGTCA GATCGCATAA GGCTGTCTGA
```

This corresponds to the amino acid sequence <SEQ ID 1924; ORF 607.a>:

```
a607.pep
  1 MLLDLNRFSF SVFLKEVRLL TALALPMLLA QVAQVGIGFV DTVMAGGAGK

51 EDLAAVALGS SAFATVYITF MGIMAALNPM IAQLYGAGKT DEVGETGRQG

101 IWFGLFLGVF GMVLMWAAIT PFRNWLTLSD YVEGTMAQYM LFTSLAMPAA

151 MVHRALHAYA SSLNRPRLIM LVSFAAFVLN VPLNYIFVYG KFGMPALGGA

201 GCGLATMAVF WFSALALWIY IAKENFFRPF GLTAKFGKPD WAVFKQIWKI

251 GAPIGLSYFL EASAFSFIVF LIAPFGEDYV AAQQVGISLS GILYMIPQSV

301 GSAGTVRIGF SLGRREFSRA RYISGVSLVS GWMLAVITVL SLVLFRSPLV

351 SMYNNDPAVL SIAATVLLFA GLFQPADFTQ CIASYALRGY KVTKVPMFIH

401 AAAFWGCGLL PGYLLAYRFD MGIYGFWTAL IASLTIAAIA LVWCLELCSR

451 EMVRSHKAV*
``` m607/a607 98.9% identity in 459 aa overlap

```
                10         20         30         40         50         60
m607.pep  MLLDLNRFSFPVFLKEVRLLTTLALPMLLAQVAQVGIGFVDTVMAGGAGKEDLAAVALGS
          ||||||||||| ||||||||| :|||||||||||||||||||||||||||||||||||||
a607      MLLDLNRFSFSVFLKEVRLLTALALPMLLAQVAQVGIGFVDTVMAGGAGKEDLAAVALGS
                10         20         30         40         50         60

70         80         90        100        110        120
m607.pep  SAFATVYITFMGIMAALNPMIAQLYGAGKTDEVGETGRQGIWFGLFLGVFGMVLMWAAIT
          ||||||||||||||||||||||||||||||||||||||||||||||||||||||||||||
a607      SAFATVYITFMGIMAALNPMIAQLYGAGKTDEVGETGRQGIWFGLFLGVFGMVLMWAAIT
                70         80         90        100        110        120

130        140        150        160        170        180
m607.pep  PFRNWLTLSDYVEGTMAQYMLFTSLAMPAAMVHRALHAYTSSLNRPRLIMLVSFAAFVLN
          |||||||||||||||||||||||||||||||||||||||:||||||||||||||||||||
a607      PFRNWLTLSDYVEGTMAQYMLFTSLAMPAAMVHRALHAYASSLNRPRLIMLVSFAAFVLN
               130        140        150        160        170        180

190        200        210        220        230        240
m607.pep  VPLNYIFVYGKFGMPALGGAGCGLATMAVFWFSALALWIYIAKENFFRPFGLTAKFGKPD
          ||||||||||||||||||||||||||||||||||||||||||||||||||||||||||||
a607      VPLNYIFVYGKFGMPALGGAGCGLATMAVFWFSALALWIYIAKENFFRPFGLTAKFGKPD
               190        200        210        220        230        240

250        260        270        280        290        300
m607.pep  WAVFKQIWKIGAPIGLSYFLEASAFSFIVFLIAPFGEDYVAAQQVGISLSGILYMIPQSV
          ||||||||||||||||||||||||||||||||||||||||||||||||||||||||||||
a607      WAVFKQIWKIGAPIGLSYFLEASAFSFIVFLIAPFGEDYVAAQQVGISLSGILYMIPQSV
               250        260        270        280        290        300

310        320        330        340        350        360
m607.pep  GSAGTVRIGFSLGRREFSRARYISGVSLVLGWMLAVITVLSLVLFRSPLVSMYNNDPAVL
          |||||||||||||||||||||||||||||||| |||||||||||||||||||||||||||
a607      GSAGTVRIGFSLGRREFSRARYISGVSLVSGWMLAVITVLSLVLFRSPLVSMYNNDPAVL
               310        320        330        340        350        360
```

```
                 370        380        390        400        410        420
m607.pep  SIAATVLLFAGLFQPADFTQCIASYALRGYKVTKVPMFIHAAAFWGCGLLPGYLLAYRFN
          ||||||||||||||||||||||||||||||||||||||||||||||||||||||||||| :
a607      SIAATVLLFAGLFQPADFTQCIASYALRGYKVTKVPMFIHAAAFWGCGLLPGYLLAYRFD
                 370        380        390        400        410        420

430        440        450        460
m607.pep  MGIYGFWTALIASLTIAAIALVWCLELCSREMVRSHKAVX
          ||||||||||||||||||||||||||||||||||||||||
a607      MGIYGFWTALIASLTIAAIALVWCLELCSREMVRSHKAVX
                 430        440        450        460
```

The following partial DNA sequence was identified in *N. gonorrhoeae* <SEQ ID 1925>:

```
g608.seq
    1 ATGTCCGCCC TCCTCCCCAT CATCAACCGC CTGATTCTGC AAAGCCCGGA

51 CAGCCGCTCG GAACTTACCT CCTTTGCAGG CAAAACACTG ACCCTGAACA

101 TTGCCGGGCT GAAACTGGCG GGACGCATCA CAGAAGACGG TTTGCTCTCG

151 GCGGGAAACG GCTTTGCAGA CACCGAAATT ACCTTCCGCA ACAGCGCGAT

201 ACGGAAAATC CTCCAAGGCG GCGAACCCGG GGCTGGCGAC ATCAGGCTCG

251 AAGGCGACCT CATCCTCGGC ATcGCGGTAC TGTCCCTGCT CGGCAGCCTG

301 CGTTCCCGCG CATCGGacgA ATTGGCACGG ATTTTCGGCA CGCAGGCAGg 351 catcggcagc CGTGCCACCG ACATCGGACA CGGCaTCaaa cAAATCGGCA 401 GGAACATCGC CGAACAAATC GGCGGATTTT CCCGCGAACC CGAGTCcgCa 451 aacaccggca acgaagccct tgccgactgc ctCGACGAAA TAAGCAGACT

501 GCGCGACGGC GTGGAACGCC TCAACGAACG CCTCGACAGG CTCGAACGCG

551 ACATTTGGAT AGACTAA
```

This corresponds to the amino acid sequence <SEQ ID 1926; ORF 608.ng>:

```
g608.pep
    1 MSALLPIINR LILQSPDSRS ELTSFAGKTL TLNIAGLKLA GRITEDGLLS

51 AGNGFADTEI TFRNSAIRKI LQGGEPGAGD IRLEGDLILG IAVLSLLGSL

101 RSRASDELAR IFGTQAGIGS RATDIGHGIK QIGRNIAEQI GGFSREPESA

151 NTGNEALADC LDEISRLRDG VERLNERLDR LERDIWID*
```

The following partial DNA sequence was identified in *N. meningitidis* <SEQ ID 1927>:

```
m608.seq
    1 ATGTCCGCCC TCCTCCCCAT CATCAACCGC CTGATTCTGC AAAGCCCGGA

51 CAGCCGCTCG GAACTTGCCG CCTTTGCAGG CAAAACACTG ACCCTGAACA

101 TTGCCGGGCT GAAACTGGCG GGACGCATCA CGGAAGACGG TTTGCTCTCG

151 GCGGGAAACG GCTTTGCAGA CACCGAAATT ACCTTCCGCA ACAGCGCGGT

201 ACAGAAAATC CTCCAAGGAG GCGAACCCGG GGCGGGCGAC ATCGGGCTCG

251 AAGGCGACCT CATCCTCGGC ATCGCGGTAC TGTCCCTGCT CGGCAGCCTG

301 CGTTCCCGCG CATCGGACGA ATTGGCACGG ATTTTCGGCA CGCAGGCAGA

351 CATCGGCAGC CGTGCCGCCG ACATCGGACA CGGCATCAAA CAAATCGGCA

401 GGAACATCGC CGAACAAATC GGCGGATTTT CCCGCGAATC CGAGTCCGCA
```

```
451 AACATCGGCA ACGAAGCCCT TGCCGACTGC CTCGACGAAA TAAGCAGACT

501 GCGCGACGGC GTGGAACGCC TCAACGAACG CCTCGACCGG CTCGAACGCG

551 ACATTTGGAT AGACTAA
```

This corresponds to the amino acid sequence <SEQ ID 1928; ORF 608>:

```
m608.pep
   1 MSALLPIINR LILQSPDSRS ELAAFAGKTL TLNIAGLKLA GRITEDGLLS

51 AGNGFADTEI TFRNSAVQKI LQGGEPGAGD IGLEGDLILG IAVLSLLGSL

101 RSRASDELAR IFGTQADIGS RAADIGHGIK QIGRNIAEQI GGFSRESESA

151 NIGNEALADC LDEISRLRDG VERLNERLDR LERDIWID*
```

Computer analysis of this amino acid sequence gave the following results:

Homology with a Predicted ORF from *N. gonorrhoeae*
ORF 608 shows 95.2% identity over a 188 aa overlap with a predicted ORF (ORF 608.ng) from *N. gonorrhoeae*:

```
m608/g608

10         20         30         40         50         60
   m608.pep  MSALLPIINRLILQSPDSRSELAAFAGKTLTLNIAGLKLAGRITEDGLLSAGNGFADTEI
             ||||||||||||||||||||::|||||||||||||||||||||||||||||||||||||
   g608      MSALLPIINRLILQSPDSRSELTSFAGKTLTLNIAGLKLAGRITEDGLLSAGNGFADTEI
                    10         20         30         40         50         60

70         80         90        100        110        120
   m608.pep  TFRNSAVQKILQGGEPGAGDIGLEGDLILGIAVLSLLGSLRSRASDELARIFGTQADIGS
             ||||||::|||||||||||||| |||||||||||||||||||||||||||||||| |||
   g608      TFRNSAIRKILQGGEPGAGDIRLEGDLILGIAVLSLLGSLRSRASDELARIFGTQAGIGS
                    70         80         80        100        110        120

130        140        150        160        170        180
   m608.pep  RAADIGHGIKQIGRNIAEQIGGFSRESESANIGNEALADCLDEISRLRDGVERLNERLDR
             ||:|||||||||||||||||||||||| |||| |||||||||||||||||||||||||||
   g608      RATDIGHGIKQIGRNIAEQIGGFSREPESANTGNEALADCLDEISRLRDGVERLNERLDR
                   130        140        150        160        170        180

189
   m608.pep  LERDIWIDX
             |||||||||
   g608      LERDIWIDX
```

The following partial DNA sequence was identified in *N. meningitidis* <SEQ ID 1929>:

```
a608.seq
   1 ATGTCCGCCC TCCTCCCCAT CATCAACCGC CTGATTCTGC AAAGCCCGGA

51 CAGCCGCTCG GAACTTGCCG CCTTCGCAGG CAAAACACTG ACCCTGAACA

101 TTGCCGGGTT GAAACTGGCG GGACGCATCA CGGAAGACGG TTTGCTCTCG

151 GCGGGAAACG GCTTTGCAGA CACCGAAATC ACCTTCCGCA ACAGCGCGGT

201 ACAGAAAATC CTCCAAGGCG GCGAACCCGG GGCGGGCGAC ATCGGGCTCG

251 AAGGCGACCT CATCCTCGGC ATCGCGGTAC TGTCCCTGCT CGGCAGCCTG

301 CGTTCCCGCG CATCGGACGA ATTGGCACGG ATTTTCGGCA CGCAGGCAGA

351 CATCGGCAGC CGTGCCGCCG ACATCGGACA CGGCATCAAA CAAATCGGCA

401 GGAACATCGC CGAACAAATC GGCAGATTTT CCCGCGAACC CGAGTCCGCA

451 AACATCGGCA ACGAAGCCCT TGCCGACTGC CTCGACGAAA TAAGCAGACT
```

```
501 GCGCGACGGC GTGGAACGCC TCAACGAACG CCTCGACCGG CTCGAACGCG

551 ACATTTGGAT AGACTAA
```

This corresponds to the amino acid sequence <SEQ ID 1930; ORF 608.a>:

```
a608.pep
  1 MSALLPIINR LILQSPDSRS ELAAFAGKTL TLNIAGLKLA GRITEDGLLS

51 AGNGFADTEI TFRNSAVQKI LQGGEPGAGD IGLEGDLILG IAVLSLLGSL

101 RSRASDELAR IFGTQADIGS RAADIGHGIK QIGRNIAEQI GRFSREPESA

151 NIGNEALADC LDEISRLRDG VERLNERLDR LERDIWID*
``` m608/a608 98.9% identity in 188 aa overlap

```
                      10         20         30         40         50         60
        m608.pep  MSALLPIINRLILQSPDSRSELAAFAGKTLTLNIAGLKLAGRITEDGLLSAGNGFADTEI
                  ||||||||||||||||||||||||||||||||||||||||||||||||||||||||||||
        a608      MSALLPIINRLILQSPDSRSELAAFAGKTLTLNIAGLKLAGRITEDGLLSAGNGFADTEI
                      10         20         30         40         50         60

70         80         90        100        110        120
        m608.pep  TFRNSAVQKILQGGEPGAGDIGLEGDLILGIAVLSLLGSLRSRASDELARIFGTQADIGS
                  ||||||||||||||||||||||||||||||||||||||||||||||||||||||||||||
        a608      TFRNSAVQKILQGGEPGAGDIGLEGDLILGIAVLSLLGSLRSRASDELARIFGTQADIGS
                      70         80         80        100        110        120

130        140        150        160        170        180
        m608.pep  RAADIGHGIKQIGRNIAEQIGGFSRESESANIGNEALADCLDEISRLRDGVERLNERLDR
                  |||||||||||||||||||| ||||   ||||||||||||||||||||||||||||||||
        a608      RAADIGHGIKQIGRNIAEQIGRFSREPESANIGNEALADCLDEISRLRDGVERLNERLDR
                     130        140        150        160        170        180

189
        m608.pep  LERDIWIDX
                  |||||||||
        a608      LERDIWIDX
```

The following partial DNA sequence was identified in *N. gonorrhoeae* <SEQ ID 1931>:

```
g609.seq
  1 ATGGTTGTGG ATAGACTCGA AATTCTCGCT CTCGACGACG AAACTCTTGA

51 TGCGTTTGTC GGCAATCAGC GAAGTAGCGA CATCGCGCAC CATATCTTCC

101 ACGAATTTCG GGTTTTCGTA GGCCTTTTCG GTAACGTATT TTTCATCGGG

151 GCGTTTGAGC AGGCCGTAGA GTTGGCAGCT CGCCTGCGTT CCACATAAT

201 CGATAACTTC CTCGATACCG ACTTCGGCAT CGGAAGTCAG GCTGACGGTA

251 ACGTGCGAAC GCTGATTATG CGCGCCATAT TGGGAAATTT CTTTGGAACA

301 CGGGCAAAGC GAGGTTACGG GAATCATGAC CTTCATACTG TGGCCGTATG

351 CCCCGTCTTT CATTTCACCC GTGAGGCTGA CATCATAATC CAGtaa
```

This corresponds to the amino acid sequence <SEQ ID 1932; ORF 609.ng>:

```
g609.pep
  1 MVVDRLEILA LDDETLDAFV GNQRSSDIAH HIFHEFRVFV GLFGNVFFIG

51 AFEQAVELAA RLRFHIIDNF LDTDFGIGSQ ADGNVRTLIM RAILGNFFGT

101 RAKRGYGNHD LHTVAVCPVF HFTREADIII Q*
```

The following partial DNA sequence was identified in *N. meningitidis* <SEQ ID 1933>:

```
m609.seq
    1 ATGGTTGTGG ATAGACTCGA AATTCTCGCT CTCGACGACG AAACTCTTGA

51 TGCGTTTGTC GGCAATCAGC GAAGTAGCGA CATCGCGCAC CATATCTTCC

101 ACGAATTTCG GGTTTTCGTA GGCTTTTTCG GTAACGTATT TTTCATCGGG

151 GCGTTTGAGC AGGCCGTAGA GTTGGCAGCT CGCCTGCGCC TCCACATAAT

201 CGATGACTTC CTCGATACCG ACTTCGGCAT CGGCAGTCAG GCTGACGGTA

251 ACGTGCGAAC GCTGGTTGTG CGCGCCGTAT TGGGAAATTT CTTTGGAACA

301 CGGGCAAAGC GAGGTTACGG GAATCATGAC CTTCATACTG TGGCCGTATG

351 CCCCGTCTTT GATTTCGCCC GTGAGACAGA CATCATAATC CAGTAA
```

This corresponds to the amino acid sequence <SEQ ID 1934; *ORF 609*>:

```
m609.pep
    1   MVVDRLEILA LDDETLDAFV GNQRSSDIAH HIFHEFRVFV GFFGNVFFIG

51   AFEQAVELAA RLRLHIIDDF LDTDFGIGSQ ADGNVRTLVV RAVLGNFFGT

101   RAKRGYGNHD LHTVAVCPVF DFARETDIII Q* m609/g609  93.1% identity in 131 aa overlap
                  10         20         30         40         50         60
m609.pep   MVVDRLEILALDDETLDAFVGNQRSSDIAHHIFHEFRVFVGFFGNVFFIGAFEQAVELAA
           ||||||||||||||||||||||||||||||||||||||||:|||||||||||||||||||
g609       MVVDRLEILALDDETLDAFVGNQRSSDIAHHIFHEFRVFVGLFGNVFFIGAFEQAVELAA
                  10         20         30         40         50         60

70         80         90        100        110        120
m609.pep   RLRLHIIDDFLDTDFGIGSQADGNVRTLVVRAVLGNFFGTRAKRGYGNHDLHTVAVCPVF
           |||:||||:||||||||||||||||||||::||:||||||||||||||||||||||||||
g609       RLRFHIIDNFLDTDFGIGSQADGNVRTLIMRAILGNFFGTRAKRGYGNHDLHTVAVCPVF
                  70         80         90        100        110        120

130
m609.pep   DFARETDIIIQX
           |:||:||||||
g609       HFTREADIIIQX
                 130
```

The following partial DNA sequence was identified in *N. meningitidis* <SEQ ID 1935>:

```
a609.seq
    1 ATGGTTGTGG ATAGACTCGA AATTCTCGCT CTCGACGACG AAACTCTTGA

51 TGCGTTTGTC GGCAATCAGC GAAGTAGCGA CATCGCGCAC CATATCTTCC

101 ACGAATTTCG GGTTTTCGTA GGCTTTTTCG GTAACGTATT TTTCATCGGG

151 GCGTTTGAGC AGGCCGTAGA GTTGGCAGCT CGCCTGCGCC TCCACATAAT

201 CGATGACTTC CTCGATACCG ACTTCGGCAT CGGCAGTCAG GCTGACGGTA

251 ACGTGCGAAC GCTGGTTGTG CGCGCCATAT TGGGAAATTT CTTTGGAACA

301 CGGGCAAAGC GAGGTTACGG GAATCATGAC CTTCATACTG TGGCCGTATG

351 CACCGTCTTT CATTTCGCCC GTGAGGCTGA CATCATAATC CAGTAA
```

This corresponds to the amino acid sequence <SEQ ID 1936; ORF 609.a>:

```
m609.pep

1   MVVDRLEILA LDDETLDAFV GNQRSSDIAH HIFHEFRVFV GFFGNVFFIG

51   AFEQAVELAA RLRLHIIDDF LDTDFGIGSQ ADGNVRTLVV RAVLGNFFGT

101   RAKRGYGNHD LHTVAVCPVF DFARETDIII Q* m609/g609  93.1% identity in 131 aa overlap 10         20         30         40         50         60
m609.pep   MVVDRLEILALDDETLDAFVGNQRSSDIAHHIFHEFRVFVGFFGNVFFIGAFEQAVELAA
           ||||||||||||||||||||||||||||||||||||||||:|||||||||||||||||||
g609       MVVDRLEILALDDETLDAFVGNQRSSDIAHHIFHEFRVFVGLFGNVFFIGAFEQAVELAA
                   10         20         30         40         50         60

70         80         90        100        110        120
m609.pep   RLRLHIIDDFLDTDFGIGSQADGNVRTLVVRAVLGNFFGTRAKRGYGNHDLHTVAVCPVF
           |||:||||:|||||||||||||||||||||::||:|||||||||||||||||||||||||
g609       RLRFHIIDNFLDTDFGIGSQADGNVRTLIMRAILGNFFGTRAKRGYGNHDLHTVAVCPVF
                   70         80         90        100        110        120

130
m609.pep   DFARETDIIIQX
           |:||:|||||||
g609       HFTREADIIIQX
                  130
```

130
The following partial DNA sequence was identified in *N. gonorrhoeae* <SEQ ID 1937>:

```
g610.seq
      1   ATGATTGGAG GGCTTATGCA ATTTCCTTAC CGCAATGTTC CGGCTTCGCG

51   TATGCGCCGT ATGCGCAGGG ATGATTTTTC ACGCCGCCTG ATGCGCGAGC

101   ATATGCTGAC CGCCGATGAT TTGATTTATC CGGTGTTCGT ATTGGAGGGG

151   GCGGCGCGCG AGGAGGATGT GCCTTCTATG CCGGGCGTGA AGCGTCAGAG

201   TTTGGACAGG CTGCTGTTTA CGGCGGAAGA GGCGGTGAAG CTCGGTATTC

251   CGATGTTGGC ACTCTTTCCC GTGGTTACGG CAAACAAAAC CGGGCGTGCG

301   CAGGAGGCGT ACAATCCCGA AGGACTCGTG CCGTCAACTG tccgagccTT

351   GCGCGAGAGG TttcCcgaac tggggattat gacggatgtc gcgctcgAtc 401   cttatacggt gcacGGTCAG GACGGACTGA CGGACgaaaa cggttaCGTG 451   ATGAatgATg aaaCCGTAGA AGTCTTGGTG AAACAGGCTT TATGTCATGC

501   AGAGGCGGGC ACGCAGGTCG TTGCTCCTTC CGATATGATG GACGGGCGTA

551   TCGGCGCCAT CCGCGAGGCT TTGGAGGATG CCGGACATAT CCATACGCGG

601   ATTATGGCAT ATTCCGCCAA ATATGCTTCT GCATTCTACG GCCCTTTCCG

651   TGATGCGGTA GGCAGTTCGG GCAATTTGGG AAAGGCAGAT AAAAAGACCT

701   ATCAGATGGA TCCTGCAAAT ACCGATGAGG CGCTGCATGA AGTGGCGCTC

751   GATATTCAGG AAGGTGCGGA TATGGTGATG GTGAAGCCCG GTTTGCCGTA

801   TTTGGACGTT GTCCGCCGCG TGAAGGACGA GTTCGGCGTA CCGACTTATG

851   CCTATCAGGT TTCGGGCGAA TATGCGATGT TGCAGGCGGC GGTTGCCAAC

901   GGCTGGCTGG ACGGCGGCAA AGTGGTTTTG GAAAGCCTGC TGGCATTCAA

951   ACGTGCGGGT GCGGACGGGA TTTTGACCTA TTACGCCATT GAGGCGGCAA

1001   AGATGCTGAA GCGTTGA
```

This corresponds to the amino acid sequence <SEQ ID 1938; ORF 610.ng>:

```
g610.pep
   1 MIGGLMQFPY RNVPASRMRR MRRDDFSRRL MREHMLTADD LIYPVFVLEG

51 AAREEDVPSM PGVKRQSLDR LLFTAEEAVK LGIPMLALFP VVTANKTGRA

101 QEAYNPEGLV PSTVRALRER FPELGIMTDV ALDPYTVHGQ DGLTDENGYV

151 MNDETVEVLV KQALCHAEAG TQVVAPSDMM DGRIGAIREA LEDAGHIHTR

201 IMAYSAKYAS AFYGPFRDAV GSSGNLGKAD KKTYQMDPAN TDEALHEVAL

251 DIQEGADMVM VKPGLPYLDV VRRVKDEFGV PTYAYQVSGE YAMLQAAVAN

301 GWLDGGKVVL ESLLAFKRAG ADGILTYYAI EAAKMLKR*
```

The following partial DNA sequence was identified in *N. meningitidis* <SEQ ID 1939>:

```
m610.seq
   1 ATGATTGGAG GGCTTATGCA GTTTCCTTAC CGCAATGTTC CGGCTTCGCG

51 TATGCGCCGT ATGCGCAGGG ACGATTTTTC ACGCCGCCTG ATGCGCGAAC

101 ACACGCTGAC CGCCGATGAT TTGATTTATC CGGTGTTCGT ATTGGAGGGG

151 TCGGCGCGCG AGGAGGATGT GCCTTCTATG CCGGGTGTGA AGCGTCAAAG

201 TTTGGACAGG CTGCTGTTTA CGGCGGAAGA GGCGGTAAAG CTCGGTATTC

251 CGATGTTGGC ACTGTTCCCC GTGGTTACGG CAAACAAAAC CGAGCGTGCG

301 CAGGAGGCGT ACAATCCCGA AGGACTCGTG CCGTCAACTG TCCGCGCCTT

351 GCGCGAGAGG TTTCCCGAAC TGGGCATTAT GACGGATGTC GCGCTCGATC

401 CTTATACGGT TCACGGTCAG GACGGGCTGA CGGACGAAAA CGGTTATGTG

451 ATGAACGATG AAACCGTAGA GGTTTTGGTC AAGCAGGCTT TGTGCCACGC

501 TGAAGCGGGC GCGCAGGTGG TTGCCCCTTC CGATATGATG GACGGGCGTA

551 TCGGTGCGAT TCGCGAGGCG TTGGAGGATG CCGGGCATAT CCATACGCGG

601 ATTATGGCGT ATTCCGCCAA ATATGCTTCT GCATTTTACG GCCCTTTCCG

651 TGATGCGGTA GGCAGTTCGG GCAATTTGGG CAAGGCAGAT AAAAAGACCT

701 ACCAGATGGA TCCGGCAAAT ACCGATGAGG CGTTGCACGA AGTGGCGTTG

751 GACATTCAGG AAGGTGCGGA TATGGTAATG GTCAAGCCCG GTTTGCCGTA

801 TTTGGACGTT GTCCGCCGCG TAAAGGACGA GTTCGGTGTG CCGACTTATG

851 CCTATCAGGT TTCGGGAGAA TACGCGATGT TGCAGGCAGC GATTGCCAAC

901 GGCTGGCTGG ACGGCGGCAA AGTGGTTTTG GAAAGCCTGC TGGCATTCAA

951 ACGTGCGGGT GCGGACGGGA TTTTGACCTA TTACGCTATT GAGGCGGCAA

1001 AGATGTTGAA GCGTTGA
```

This corresponds to the amino acid sequence <SEQ ID 1940; ORF 610>:

```
m610.pep
   1 MIGGLMQFPY RNVPASRMRR MRRDDFSRRL MREHTLTADD LIYPVFVLEG

51 SAREEDVPSM PGVKRQSLDR LLFTAEEAVK LGIPMLALFP VVTANKTERA

101 QEAYNPEGLV PSTVRALRER FPELGIMTDV ALDPYTVHGQ DGLTDENGYV

151 MNDETVEVLV KQALCHAEAG AQVVAPSDMM DGRIGAIREA LEDAGHIHTR
```

```
-continued
201 IMAYSAKYAS AFYGPFRDAV GSSGNLGKAD KKTYQMDPAN TDEALHEVAL

251 DIQEGADMVM VKPGLPYLDV VRRVKDEFGV PTYAYQVSGE YAMLQAAIAN

301 GWLDGGKVVL ESLLAFKRAG ADGILTYYAI EAAKMLKR*
``` m610/g610 98.5% identity in 338 aa overlap

```
                   10         20         30         40         50         60
m610.pep   MIGGLMQFPYRNVPASRMRRMRRDDFSRRLMREHTLTADDLIYPVFVLEGSAREEDVPSM
           |||||||||||||||||||||||||||||||||| :||||||||||||||| ||||||||
g610       MIGGLMQFPYRNVPASRMRRMRRDDFSRRLMREHMLTADDLIYPVFVLEGAAREEDVPSM
                   10         20         30         40         50         60

70         80         90        100        110        120
m610.pep   PGVKRQSLDRLLFTAEEAVKLGIPMLALFPVVTANKTERAQEAYNPEGLVPSTVRALRER
           ||||||||||||||||||||||||||||||||||||| ||||||||||||||||||||||
g610       PGVKRQSLDRLLFTAEEAVKLGIPMLALFPVVTANKTGRAQEAYNPEGLVPSTVRALRER
                   70         80         90        100        110        120

130        140        150        160        170        180
m610.pep   FPELGIMTDVALDPYTVHGQDGLTDENGYVMNDETVEVLVKQALCHAEAGAQVVAPSDMM
           |||||||||||||||||||||||||||||||||||||||||||||||||||:||||||||
g610       FPELGIMTDVALDPYTVHGQDGLTDENGYVMNDETVEVLVKQALCHAEAGTQVVAPSDMM
                  130        140        150        160        170        180

190        200        210        220        230        240
m610.pep   DGRIGAIREALEDAGHIHTRIMAYSAKYASAFYGPFRDAVGSSGNLGKADKKTYQMDPAN
           ||||||||||||||||||||||||||||||||||||||||||||||||||||||||||||
g610       DGRIGAIREALEDAGHIHTRIMAYSAKYASAFYGPFRDAVGSSGNLGKADKKTYQMDPAN
                  190        200        210        220        230        240

250        260        270        280        290        300
m610.pep   TDEALHEVALDIQEGADMVMVKPGLPYLDVVRRVKDEFGVPTYAYQVSGEYAMLQAAIAN
           ||||||||||||||||||||||||||||||||||||||||||||||||||||||||:||
g610       TDEALHEVALDIQEGADMVMVKPGLPYLDVVRRVKDEFGVPTYAYQVSGEYAMLQAAVAN
                  250        260        270        280        290        300

310        320        330    339
m610.pep   GWLDGGKVVLESLLAFKRAGADGILTYYAIEAAKMLKRX
           ||||||||||||||||||||||||||||||||||||||
g610       GWLDGGKVVLESLLAFKRAGADGILTYYAIEAAKMLKRX
                  310        320        330
```

The following partial DNA sequence was identified in *N. meningitidis* <SEQ ID 1941>:

```
a610.seq
    1 ATGATTGGAG GGCTTATGCA GTTTCCTTAC CGCAATGTTT CGGCTTCGCG

51 TATGCGCCGT ATGCGCAGGG ACGATTTTTC ACGCCGCCTG ATGCGCGAGC

101 ATACGCTGAC TGCCGATGAT TTGATTTATC CGGTGTTCGT ATTGGAGGGG

151 TCGGCGCGCG AGGAGGATGT GCCTTCTATG CCGGGCGTGA AGCGTCAGAG

201 TTTGGACAGG CTGCTGTTTA CGGCGGAAGA GGCGGTAAAG CTCGGTATTC

251 CGATGTTGGC ACTGTTCCCC GTGGTTACGG CAAACAAAAC CGAGCGTGCG

301 CAGGAGGCGT ACAATCCCGA AGGACTCGTG CCGTCAACTG TCCGCGCCTT

351 GCGCGAGAGG TTTCCCGAAC TGGGCATTAT GACGGATGTC GCGCTCGATC

401 CTTATACGGT GCACGGTCAG GACGGGCTGA CGGACGAAAA CGGTTATGTG

451 ATGAACGATG AAACCGTAGA GGTTTTGGTC AAGCAGGCTT TGTGTCATGC

501 AGAGGCAGGC GCACAGGTCG TTGCTCCTTC CGATATGATG GATGGGCGTA

551 TCGGTGCGAT TCGCGAGGCG TTGGAGGATG CCGGGCATAT CCATACGCGG

601 ATTATGGCGT ATTCCGCCAA ATATGCTTCT GCATTTTACG GCCCTTTCCG

651 TGATGCGGTA GGCAGTTCGG GCAATTTGGG CAAGGCAGAT AAAAAGACCT

701 ACCAGATGGA TCCGGCAAAT ACCGATGAGG CGTTGCACGA AGTGGCGTTG

751 GACATTCAGG AAGGTGCGGA TATGGTGATG GTCAAGCCCG GTTTGCCGTA

801 TTTGGACGTT GTCCGCCGCG TGAAGGACGA GTTCGGCGTG CCGACTTATG

851 CCTATCAGGT TTCGGGAGAA TACGCGATGC TGCAGGCGGC GGTTGCCAAC
```

-continued

```
 901 GGCTGGCTGG ACGGCGGCAA AGTGGTTTTG AAAGCCTGC TGGCATTCAA

951 ACGTGCGGGT GCGGATGGGA TTTTGACCTA TTACGCCATT GAGGCGGCAA

1001 AGATGCTGAA GCGTTGA
```

This corresponds to the amino acid sequence <SEQ ID 1942; ORF 610.a>:

```
a610.pep

1   MIGGLMQFPY RNVSASRMRR MRRDDFSRRL MREHTLTADD LIYPVFVLEG

51   SAREEDVPSM PGVKRQSLDR LLFTAEEAVK LGIPMLALFP VVTANKTERA

101   QEAYNPEGLV PSTVRALRER FPELGIMTDV ALDPYTVHGQ DGLTDENGYV

151   MNDETVEVLV KQALCHAEAG AQVVAPSDMM DGRIGAIREA LEDAGHIHTR

201   IMAYSAKYAS AFYGPFRDAV GSSGNLGKAD KKTYQMDPAN TDEALHEVAL

251   DIQEGADMVM VKPGLPYLDV VRRVKDEFGV PTYAYQVSGE YAMLQAAVAN

301   GWLDGGKVVL ESLLAFKRAG ADGILTYYAI EAAKMLKR* m610/a610 99.4% identity in 388 aa overlap
                  10         20         30         40         50         60
m610.pep  MIGGLMQFPYRNVPASRMRRMRRDDFSRRLMREHTLTADDLIYPVFVLEGSAREEDVPSM
          ||||||||||||| ||||||||||||||||||||||||||||||||||||||||||||||
a610      MIGGLMQFPYRNVSASRMRRMRRDDFSRRLMREHTLTADDLIYPVFVLEGSAREEDVPSM
                  10         20         30         40         50         60
                  70         80         90        100        110        120
m610.pep  PGVKRQSLDRLLFTAEEAVKLGIPMLALFPVVTANKTERAQEAYNPEGLVPSTVRALRER
          ||||||||||||||||||||||||||||||||||||||||||||||||||||||||||||
a610      PGVKRQSLDRLLFTAEEAVKLGIPMLALFPVVTANKTERAQEAYNPEGLVPSTVRALRER
                  70         80         90        100        110        120
                 130        140        150        160        170        180
m610.pep  FPELGIMTDVALDPYTVHGQDGLTDENGYVMNDETVEVLVKQALCHAEAGAQVVAPSDMM
          ||||||||||||||||||||||||||||||||||||||||||||||||||||||||||||
a610      FPELGIMTDVALDPYTVHGQDGLTDENGYVMNDETVEVLVKQALCHAEAGAQVVAPSDMM
                 130        140        150        160        170        180
                 190        200        210        220        230        240
m610.pep  DGRIGAIREALEDAGHIHTRIMAYSAKYASAFYGPFRDAVGSSGNLGKADKKTYQMDPAN
          ||||||||||||||||||||||||||||||||||||||||||||||||||||||||||||
a610      DGRIGAIREALEDAGHIHTRIMAYSAKYASAFYGPFRDAVGSSGNLGKADKKTYQMDPAN
                 190        200        210        220        230        240
                 250        260        270        280        290        300
m610.pep  TDEALHEVALDIQEGADMVMVKPGLPYLDVVRRVKDEFGVPTYAYQVSGEYAMLQAAIAN
          |||||||||||||||||||||||||||||||||||||||||||||||||||||||:||
a610      TDEALHEVALDIQEGADMVMVKPGLPYLDVVRRVKDEFGVPTYAYQVSGEYAMLQAAVAN
                 250        260        270        280        290        300
                 310        320        330     339
m610.pep  GWLDGGKVVLESLLAFKRAGADGILTYYAIEAAKMLKRX
          ||||||||||||||||||||||||||||||||||||||
a610      GWLDGGKVVLESLLAFKRAGADGILTYYAIEAAKMLKRX
                 310        320        330
```

The following partial DNA sequence was identified in *N. gonorrhoeae* <SEQ ID 1943>:

```
g611.seq
  1 ATGCCGTCTG AAAACGGGAT GGGAAAACGG CAGCTTGCGG GCTGCCGTTT

51 GTTCGGGAAG TTAAGCCTTG TTTTCAGGCT GCTGCCCGGA CTCTGTCGAG

101 GCGGTGTCTG CCGGGGCAGG TGCTTCGGTT TTTTCCCGAG TCGGAGCGTG

151 CGGCGCGTTA TCTTCCGCCG CGTCCGCATT Ctcgcgcagg ttgtGGCtgt 201 tatcctTGGG CGGGCTGggt tgtttgcccg ccataaTTtc cagtacctgA 251 TcgcgGTCta tggtttcCCa ttCcatcagg gctttgcaca TCGTTTCCAT 301 cttgTCGCGG TTTTcatcga ggaTTTTGTA ggcaacCTGA TACTgctcgt
```

-continued
```
351 ccaaaAtccg Gcggatttcc gcgtcgAtgt cctgctgggt tTTCTCGGAA

401 ATGTTTTGCG AACGGgttac gctGCGCCCC AAGAAGACTT CGCCTTCGTT

451 TTCCGCATAA ACCATCACGC CCATTTTGtc gCTCAtgcCG TAGCGCGTTA

501 CCATTTCGCG TGCCATTTGG GTTGCGCGTT CAAAGTCGTT TGA
```

This corresponds to the amino acid sequence <SEQ ID 1944; ORF 611.ng>:

```
g611.pep
  1 MPSENGMGKR QLAGCRLFGK LSLVFRLLPG LCRGGVCRGR CFGFFPSRSV

51 RRVIFRRVRI LAQVVAVILG RAGLFARHNF QYLIAVYGFP FHQGFAHRFH

101 LVAVFIEDFV GNLILLVQNP ADFRVDVLLG FLGNVLRTGY AAPQEDFAFV

151 FRINHHAHFV AHAVARYHFA CHLGCAFKVV *
```

The following partial DNA sequence was identified in *N. meningitidis* <SEQ ID 1945>:

```
m611.seq
  1 ATGCCGTCTG AAAACGGGAT GGGAAAACGG CAGCTTGCGG GCTGCCGTTT

51 GTTCGGGAAG TTAAGCCTTG TTTTCAGGCT GCTGCTCGGA CTCTGTCGAA

101 GCGGTGTCTG CCGGGGCAGG TGCTTCGGTT TCTTCCCGAG TCGGAGCGTG

151 CGGCGCGTTA TCTTCCGCCG CGTCCGCATT CTCGCGCAGG TTGTGGCTGT

201 AATCTTTGGG CGGGCTGGGT TGTTTGCCCG CCATGATTTC CAGTACCTGA

251 TCGCGGTCGA TGGTTTCCCA TTCCATCAGG GCTTTGCACA TCGTTTCCAT

301 CTTGTCGCGG TTTTCATCGA GGATTTTGTA GGCAACCTGA TATTGCTCGT

351 CCAAAATCCG GCGGATTTCC GCGTCGATGT CCTGCTGGGT TTTCTCGGAA

401 ATGTTTTGCG AACGGGTTAC GCTGCGTCCC AAGAAGACTT CGCCTTCGTT

451 TTCCGCATAA ACCATCACGC CCATTTTGTC GCTCATGCCG TAGCGCGTTA

501 CCATTTCGCG CGCCATTTGG GTTGCGCGTT CAAAGTCGTT TGA
```

This corresponds to the amino acid sequence <SEQ ID 1946; ORF 611>:

```
m611.pep

1    MPSENGMGKR QLAGCRLFGK LSLVRFLLLG LCRSGVCRGR CFGRRPSRSV

51    RRVIFRRVRI LAQVVAVIFG RAGLFARHDF QYLIAVDGFP FHQGFAHRFH

101    LVAVFIEDFV GNLILLVQNP ADFRVDVLLG FLGNVLRTGY AASQEDFAFV

151    FRINHHAHFV AHAVARYHFA RHLGCAFKVV * m611/g611 96.1% identity in 180 aa overlap 10         20         30         40         50         60
    m611.pep  MPSENGMGKRQLAGCRLFGKLSLVRFLLLGLCRSGVCRGRCFGFFPSRSVRRVIFRRVRI
              ||||||||||||||||||||||||:||||  ||||:||||||||||||||||||||||||
    g611      MPSENGMGKRQLAGCRLFGKLSLVFRLLPGLCRGGVCRGRCFGFFPSRSVRRVIFRRVRI
                  10         20         30         40         50         60

70         80         90        100        110        120
    m611.pep  LAQVVAVUFGRAGKFARGDFQYKIAVDGFPPHQGFAHRFHLVAVFIEDFVGNLILLVQNP
              ||||||||:|||||||||:||||||||:|| |||||||||||||||||||||||||||||
    g611      LAQVVAVULGRAGKFARGNFQYKIAVYGFPFHQGFAHRFHLVAVFIEDFVGNLILLVQNP
                  70         80         90        100        110        120
```

-continued

```
                   130       140       150       160       170       180
m611.pep   ADFRVDVLLGFLGNVLRTGYAASQEDFAFVFRINHHAHFVAHAVARYHFARHLGCAFKVV
           |||||||||||||||||||| |||||||||||||||||||||||||||||| |||||||||
g611       ADFRVDVLLGFLGNVLRTGYAAPQEDFAFVFRINHHAHFVAHAVARYHFACHLGCAFKVV
                   130       140       150       160       170       180 m611.pep   X
           |
g611       X
```

The following partial DNA sequence was identified in *N. meningitidis* <SEQ ID 1947>:

```
a611.seq
   1 ATGCCGTCTG AAAACAGGAT GGGAAAACGG CAGCTTGCGG GCTGCCGTTT
  51 GTTCGGGAAG TTAAGCCTTG TTTTCAGGCT GCTGCTCGGA CTCTGTCGAA
 101 GCGGTGTCTG CCGGGGCAGG TGCTTCGGTT TCTTCCCGAG TCGGAGCGTG
 151 CGGCGCGTTA TCTTCCGCCG CGTCCGCATT CTCGCGCAGG TTGTGGCTGT
 201 AATCTTTGGG CGGGCTGGGT TGTTTGCCCG CCATGATTTC CAGTACCTGA
 251 TCGCGGTCGA TGGTTTCCCA TTCCATCAGG GCTTTGCACA TCGTTTCCAT
 301 CTTGTCGCGG TTTTCATCGA GGATTTTGTA GGCAACCTGA TACTGCTCGT
 351 CCAAAATCCG GCGGATTTCC GCATCGATGT CCTGCTGGGT TTTCTCGGAA
 401 ATGTTTTGCG AACGGGTTAC GCTGCGTCCC AAGAAGACTT CGCCTTCGTT
 451 TTCCGCATAA ACCATCACGC CCATTTTGTC GCTCATGCCG TAGCGCGTTA
 501 CCATTTCGCG CGCCATTTGG GTTGCGCGTT CAAAGTCGTT TGA
```

This corresponds to the amino acid sequence <SEQ ID 1948; *ORF* 611.a>:

```
a611.pep
       1 MPSENRMGKR GLAGCRLFGK LSLVFRLLLG LCRSGVCRGR CFGFFPSRSV
      51 RRVIFRRVRI LAQVVAVIFG RAGLFARHDF QYLIAVDGFP FHQGFAHRFH
     101 LVAVFIEDFV GNLILLVQNP ADFRIDVLLG FLGNVLRTGY AASQEDFAFV
     151 FRINHHAHFV AHAVARYHFA RHLGCAFKVV * m611/a611  98.9% identity in 180 aa overlap 10        20        30        40        50        60
m611.pep   MPSENGMGKRQLAGCRLFGKLSLVFRLLLGLCRSGVCRGRCFGFFPSRSVRRVIFRRVRI
           ||||| ||||||||||||||||||||||||||||||||||||||||||||||||||||||
a611       MPSENRMGKRQLAGCRLFGKLSLVFRLLLGLCRSGVCRGRCFGFFPSRSVRRVIFRRVRI
                   10        20        30        40        50        60

70        80        90       100       110       120
m611.pep   LAQVVAVIFGRAGLFARHDFQYLIAVDGFPFHQGFAHRFHLVAVFIEDFVGNLILLVQNP
           ||||||||||||||||||||||||||||||||||||||||||||||||||||||||||||
a611       LAQVVAVIFGRAGLFARHDFQYLIAVDGFPFHQGFAHRFHLVAVFIEDFVGNLILLVQNP
                   70        80        90       100       110       120

130       140       150       160       170       180
m611.pep   ADFRVDVLLGFLGNVLRTGYAASQEDFAFVFRINHHAHFVAHAVARYHFARHLGCAFKVV
           ||||:|||||||||||||||||||||||||||||||||||||||||||||||||||||||
a611       ADFRIDVLLGFLGNVLRTGYAASQEDFAFVFRINHHAHFVAHAVARYHFARHLGCAFKVV
                   130       140       150       160       170       180 m611.pep   X
           |
a611       X
```

The following partial DNA sequence was identified in *N. gonorrhoeae* <SEQ ID 1949>:

```
g612.seq
   1 ATGGgcttcg gcggcaatat tgcAAAAAAG CTGGCcggGg taGATGAAAT

51 AGCCTttgac tttgacggcA TCGTCTTTGA TTTCGGGCGT GATGATGCTG

101 TCCGGCataG CGGCGTAATC AATGCTGCTG TCGCCGGCCT GCATATAGTC

151 GGTGAAGTTT TCGCTGATAA AGCGGTAGAA AAGTGTGCCG AGAACGTATT

201 GTTTAAAGTC CCAGCCATCC ACCGCGCCGC GTACTTCGTC GGCGATTTTC

251 CAAATTTGGC GGTGCAGTTG GGCGCGTTGT TGCATTTCGG TCATCATCGA

301 AATCCATATA TAAAGTTAAA CAAATCAAAA TCGCCTGATA TTTTCAGACG

351 ATTTTTTTAC GGGCATTCAA ATTAA
```

This corresponds to the amino acid sequence <SEQ ID 1950; ORF 612.ng>:

```
g612.pep
   1 MGFGGNIAKK LAGVDEIAFD FDGIVFDFGR DDAVRHSGVI NAAVAGLHIV

51 GEVFADKAVE KCAENVLFKV PAIHRAAYFV GDFPNLAVQL GALLHFGHHR

101 NPYIKLNKSK SPDIFRRFFY GHSN*
```

The following partial DNA sequence was identified in *N. meningitidis* <SEQ ID 1951>:

```
m612.seq
   1 ATGGGCTTCG GCGGCAATAT TGCAAAAAAG CTGGCCGGGG TAGATGAAAT

51 AGCCTTTAAC TTTGACGGCA TCGTCTTTGA TTTCGGGCGT GATGATGCTG

101 TCCGGCATAG CGGCGTAATC AATACTGCTG TCGCCTGCCT GCATATAGTC

151 GGTGAAGTTT TCGCTGATAA AGCGGTAGAA AAGTGTGCCG AGAACGTATT

201 GTTTAAAGTC CCAGCCATCC ACCGCGCCGC GTACTTCGTC GGCAATTTTC

251 CAAATTTGGC GGTGCAGTTG GGCGCGTTGT TGCATTTCGG TCATCATCGA

301 AATCCATATA .AAAGTTAAA CAAATCAAAA TCGCCTGATA TTTTCAGACG

351 ATTTTTTTAC GGGCATTCAA ATTAA
```

This corresponds to the amino acid sequence <SEQ ID 1952; ORF 612>:

```
m612.pep

1 MGFGGNIAKK LAGVDEIAFN FDGIVFDFGR DDAVRHSGVI NTAVACLHIV

51 GEVFADKAVE KCAENVLFKV PAIHRAAYFV GNFPNLAVQL GALLHFGHHR

101 NPYXKLNKSK SPDIFRRFFY GHSN*
```

```
m612/g612 96.0% identity in 124 aa overlap 10         20         30         40         50         60
m612.pep    MGFGGNIAKKLAGVDEIAFNFDGIVFDFGRDDAVRHSGVINTAVACLHIVGEVFADKAVE
            ||||||||||||||||||||:||||||||||||||||||||:|||  ||||||||||||
g612        MGFGGNIAKKLAGVDEIAFDFDGIVFDFGRDDAVRHSGVINAAVAGLHIVGEVFADKAVE
                    10         20         30         40         50         60

70         80         90        100        110        120
m612.pep    KCAENVLFKVPAIHRAAYFVGNFPNLAVQLGALLHFGHHRNPYXKLNKSKSPDIFRRFFY
            ||||||||||||||||||||||:|||||||||||||||||||| ||||||||||||||||
g612        KCAENVLFKVPAIHRAAYFVGDFPNLAVQLGALLHFGHHRNPYIKLNKSKSPDIFRRFFY
                    70         80         90        100        110        120
```

```
m612.pep    GHSNX
            |||||
g612        GHSNX
```

The following partial DNA sequence was identified in *N. meningitidis* <SEQ ID 1953>:

```
a612.seq
   1 ATGGGCTTCG GCGGCAATAT TGCAAAAAAG CTGGCCGGGG TAGATGAAAT

51 AGCCTTTGAC TTTGACGGCA TCGTCTTTGA TTTCGGGCGT GATGATGCTG

101 TCCGGCATAG CGGCGTAATC AATACTGCTG TCGCCTGCCT GCATATAGTC

151 GGTAAAGTTT TCGCTGATAA AGCGGTAGAA AAGTGTGCCG AGAACGTATT

201 GTTTGAAGTC CCAGCCATCC ACCGCGCCGC GTACTTCGTC GGCAATTTTC

251 CAAATTTGGC GGTGCAGTTG GCGCGTTGT TGTATTTCGG TCATCATCGA

301 AATCCATAT. AAAAGTTAAA CAAATCAAAA TCGCCTGATA TTTTCAGACG

351 ATTTTTT.AC GGGCATTCAA ATTAA
```

This corresponds to the amino acid sequence <SEQ ID 1954; ORF 612.a>:

```
a612.pep

1 MGFGGNIAKK LAGVDEIAFD FDGIVFDFGR DDAVRHSGVI NTAVACLHIV

51 GKVFADKAVE KCAENVLFEV PAIHRAAYFV GNFPNLAVQL GALLYFGHHR

101 NPYXKLNKSK SPDIFRRFFX GHSN* m612/a612  96.0% identity in 124 aa overlap
                       10         20         30         40         50         60
m612.pep    MGFGGNIAKKLAGVDEIAFNFDGIVFDFGRDDAVRHSGVINTAVACLHIVGEVFADKAVE
            |||||||||||||||||||:||||||||||||||||||||||||||||||||:|||||||
a612        MGFGGNIAKKLAGVDEIAFDFDGIVFDFGRDDAVRHSGVINTAVACLHIVGKVFADKAVE
                       10         20         30         40         50         60
                       70         80         90        100        110        120
m612.pep    KCAENVLFKVPAIHRAAYFVGNFPNLAVQLGALLHFGHHRNPYXKLNKSKSPDIFRRFFY
            ||||||||:||||||||||||||||||||||||||:||||||||||||||||||||||||
a612        KCAENVLFEVPAIHRAAYFVGNFPNLAVQLGALLYFGHHRNPYXKLNKSKSPDIFRRFFY
                       70         80         90        100        110        120
m612.pep    GHSNX
            |||||
a612        GHSNX
```

The following partial DNA sequence was identified in *N. gonorrhoeae* <SEQ ID 1955>:

```
g613.seq
  1ATGTCGCGTT CGAGCCTGTC GAGGCGTTCG TTGAGGCGTT CCACGCCGTC

51GCGCAGTCTG CTTATTTCGT CGaggcagtc ggcaagggct tcgttgccgg

101tgtttGcgGA CTCGGGTTCG CGGGAAAATC CGCCGATTTG TTCGGCGATG

151TTCCTGCCGA TTTgtttGAt GCCGTGTCCG ATGTCGGTGG CACGgctgcc

201gatgcCTGCC TGCGTGCCGA AAATCCGTGC CAATTcgtCC GATGCGCGGG

251AACGCAGGCT GCCGAGCAGG GACAGTACCG CgATGCCGAG GATGAGGTCG
```

-continued
```
301 CCTTCGAGCC TGATGTCGCC AGCCCCGGGT TCGCCGCCTT GGAGGATTTT

351 CCGTATCGCG CTGTTGCGGA AGGTAATTTC GGTGTCTGCA AAGCCGTTTC

401 CCGCCGAGAG CAAACCGTCT TCTGTGATGC GTCCCGCCAG TTTCAGCCCG

451 GCAATGTTCA GGGTCAGTGT TTTGCCTGCA AAGGAGGTAA GTTCCGAGCG

501 GCTGTCCGGG CTTTGCAGAA TCAGGCGGTT GATGATGGGG AGGAGGGCGG

551 ACATATTTTC TGATTGGGGC GGAGAATGCC TGTTGTTGCT GTTGCCGCTT

601 ATTTTACAGG CTTAA
```

This corresponds to the amino acid sequence <SEQ ID 1956; ORF 613.ng>:

```
g613.pep
  1 MSRSSLSRRS LRRSTPSRSL LISSRQSARA SLPVFADSGS RENPPICSAM

51 FLPICLMPCP MSVARLPMPA CVPKIRANSS DARERRLPSR DSTAMPRMRS

101 PSSLMSPAPG SPPWRIFRIA LLRKVISVSA KPFPAESKPS SVMRPASFSP

151 AMFRVSVLPA KEVSSERLSG LCRIRRLMMG RRADIFSDWG GECLLLLLPL

201 ILQA*
```

The following partial DNA sequence was identified in *N. meningitidis* <SEQ ID 1957>:

```
m613.seq
  1 ATGTCGCGTT CGAGCCGGTC GAGGCGTTCG TTGAGGCGTT CCACGCCGTC

51 GCGCAGTCTG CTTATTTCGT CGAGGCAGTC GGCAAGGGCT TCGTTGCCGA

101 TGTTTGCGGA CTCGGATTCG CGGGAAAATC CGCCGATTTG TTCGGCGATG

151 TTCCTGCCGA TTTGTTTGAT GCCGTGTCCG ATGTCGGCGG CACGGCTGCC

201 GATGTCTGCC TGCGTGCCGA AAATCCGTGC CAATTCGTCC GATGCGCGGG

251 AACGCAGGCT GCCGAGCAGG GACAGTACCG CGATGCCGAG GATGAGGTCG

301 CCTTCGAGCC CGATGTCGCC CGCCCCGGGT TCGCCTCCTT GGAGGATTTT

351 CTGTACCGCG CTGTTGCGGA AGGTAATTTC GGTGTCTGCA AAGCCGTTTC

401 CCGCCGAGAG CAAACCGTCT TCCGTGATGC GTCCCGCCAG TTTCAGCCCG

451 GCAATGTTCA GGGTCAGTGT TTTGCCTGCA AAGGCGGCAA GTTCCGAGCG

501 GCTGTCCGGG CTTTGCAGAA TCAGGCGGTT GATGATGGGG AGGAGGGCGG

551 ACATATTTTC TGATCGGGGC GGAGAATGCC TGTTGTTGCT GTTGCCGCTT

601 ATTTTACAGG CTTAA
```

This corresponds to the amino acid sequence <SEQ ID 1958; ORF 613>:

```
m613.pep
  1 MSRSSRSRRS LRRSTPSRSL LISSRQSARA SLPMFADSDS RENPPICSAM

51 FLPICLMPCP MSAARLPMSA CVPKIRANSS DARERRLPSR DSTAMPRMRS

101 PSSPMSPAPG SPPWRIFCTA LLRKVISVSA KPFPAESKPS SVMRPASFSP

151 AMFRVSVLPA KAASSERLSG LCRIRRLMMG RRADIFSDRG GECLLLLLPL

201 ILQA*
```

Computer analysis of this amino acid sequence gave the following results:
Homology with a Predicted ORF from N. gonorrhoeae

```
    m613/g613 94.6% identity in 204 aa overlap
                10         20         30         40         50         60
    m613.pep  MSRSSRSRRSLRRSTPSRSLLISSRQSARASLPMFADSDSRENPPICSAMFLPICLMPCP
              |||||  ||||||||||||||||||||||||||||||:||| ||||||||||||||||||
    g613      MSRSSLSRRSLRRSTPSRSLLISSRQSARASLPVFADSGSRENPPICSAMFLPICLMPCP
                10         20         30         40         50         60

70         80         90        100        110        120
    m613.pep  MSAARLPMSACVPKIRANSSDARERRLPSRDSTAMPRMRSPSSPMSPAPGSPPWRIFCTA
              ||:|||| ||||||||||||||||||||||||||||||||| |||||||||||||| |
    g613      MSVARLPMPACVPKIRANSSDARERRLPSRDSTAMPRMRSPSSLMSPAPGSPPWRIFRIA
                70         80         90        100        110        120

130        140        150        160        170        180
    m613.pep  LLRKVISVSAKPFPAESKPSSVMRPASFSPAMFRVSVLPAKAASSERLSGLCRIRRLMMG
              |||||||||||||||||||||||||||||||||||||||||:||||||||||||||||||
    g613      LLRKVISVSAKPFPAESKPSSVMRPASFSPAMFRVSVLPAKEVSSERLSGLCRIRRLMMG
               130        140        150        160        170        180

190        200
    m613.pep  RRADIFSDRGGECLLLLLPLILQAX
              ||||||||  |||||||||||||||
    g613      RRADIFSDWGGECLLLLLPLILQAX
               190        200
```

The following partial DNA sequence was identified in N. meningitidis <SEQ ID 1959>:

```
a613.seq
  1 ATGTCGCGTT CGAGCCGGTC GAGGCGTTCG TTGAGGCGTT CCACGCCGTC

51 GCGCAGTCTG CTTATTTCGT CGAGGCAGTC GGCAAGGGCT TCGTTGCCGA

101 TGTTTGCGGA CTCGGGTTCG CGGGAAAATC TGCCGATTTG TTCGGCGATG

151 TTCCTGCCGA TTTGTTTGAT GCCGTGTCCG ATGTCGGCGG CACGGCTGCC

201 GATGTCTGCC TGCGTGCCGA AAATCCGTGC CAATTCGTCC GATGCGCGGG

251 AACGCAGGCT GCCGAGCAGG GACAGTACCG CGATGCCGAG GATGAGGTCG

301 CCTTCGAGCC CGATGTCGCC CGCCCCGGGT TCGCCGCCTT GGAGGATTTT

351 CTGTACCGCG CTGTTGCGGA AGGTGATTTC GGTGTCTGCA AAGCCGTTTC

401 CCGCCGAGAG CAAACCGTCT TCCGTGATGC GTCCCGCCAG TTTCAACCCG

451 GCAATGTTCA GGGTCAGTGT TTTGCCTGCG AAGGCGGCAA GTTCCGAGCG

501 GCTGTCCGGG CTTTGCAGAA TCAGGCGGTT GATGATGGGG AGGAGGGCGG

551 ACATATTTTC TGATCGGGGC GGAGAATGCC TGTTGTTGCT GTTGACGCTT

601 ATTTTACAGG CTTAA
```

This corresponds to the amino acid sequence <SEQ ID 1960; ORF 613.a>:

```
a613.pep

1 MSRSSRSRRS LRRSTPSRSL LISSRQSARA SLPMFADSGS RENLPICSAM

51 FLPICLMPCP MSAARLPMSA CVPKIRANSS DARERRLPSR DSTAMPRMRS

101 PSSPMSPAPG SPPWRIFCTA LLRKVISVSA KPFPAESKPS SVMPASFNP

151 AMFRVSVLPA KAASSERLSG LCRIRRLMMG RRADIFSDRG GECLLLLLTL

201 ILQA* m613/a613 98.0% identity in 204 aa overlap
```

```
                   10         20         30         40         50         60
m613.pep   MSRSSRSRRSLRRSTPSRSLLISSRQSARASLPMFADSDSRENPPICSAMFLPICLMPCP
           ||||||||||||||||||||||||||||||||||||||||    ||||||||||||||||
a613       MSRSSRSRRSLRRSTPSRSLLISSRQSARASLPMFADSGSRENLPICSAMFLPICLMPCP
                   10         20         30         40         50         60

70         80         90        100        110        120
m613.pep   MSAARLPMSACVPKIRANSSDARERRLPSRDSTAMPRMRSPSSPMSPAPGSPPWRIFCTA
           ||||||||||||||||||||||||||||||||||||||||||||||||||||||||||||
a613       MSAARLPMSACVPKIRANSSDARERRLPSRDSTAMPRMRSPSSPMSPAPGSPPWRIFCTA
                   70         80         90        100        110        120

130        140        150        160        170        180
m613.pep   LLRKVISVSAKPFPAESKPSSVMRPASFSPAMFRVSVLPAKAASSERLSGLCRIRRLMMG
           ||||||||||||||||||||||||||||||||||:|||||||||||||||||||||||||
a613       LLRKVISVSAKPFPAESKPSSVMRPASFNPAMFRVSVLPAKAASSERLSGLCRIRRLMMG
                  130        140        150        160        170        180

190        200
m613.pep   RRADIFSDRGGECLLLLLPLILQAX
           |||||||||||||||||| ||||||
a613       RRADIFSDRGGECLLLLLTLILQAX
                  190        200
```

The following partial DNA sequence was identified in *N. gonorrhoeae* <SEQ ID 1961>:

```
g614.seq
   1 AtggcTgcgt tcAacgcttt ggacggcaaa aaagaagaca acgggcaaat
  51 cgaaTATTCT CAGTTCATCC GACAGGTCAA CAACGGCGAA GTATCCGGCG
 101 TCAACATCGA AGGATCCGTC GTCAGCGGTT ACCTGATTAA AGGCGAGCGC
 151 ACCGACAAAA GCACCTTCTT CACCAACGCG CCCTTGGATG ACAACCTGAT
 201 TCAAACCCTT TTGAACAAAA ACGTCCGCGT AAAAGTAACG CCGGAAGAAA
 251 AACCGAGCGC GCTGACTGCC CTGTTTTACA GCCTGCTGCC CGTCCTGCTG
 301 CTGATTGGCG CATGGTTCTA CTTTATGCGT ATGCAGGCGG GCGGCGGCGG
 351 AAAAGGCGGC GCATTCTCCT TCGGCAAAAG CCGCGCCCGC CTGCTGGACA
 401 AAGATGCCAA CAAAGTTACC TTTGCCGATG TCGCCGGCTG CGACGAAGCC
 451 AAAGAAGAAG TGCAGGAAAT CGTCGATTAC CTCAAAGCAC CGAACCGCta
 501 tcaAAGcctc ggcggccgtg ttcCGCGCGG CATCCtgCtg gcgGgcagcc
 551 CGGGAaccgg taaAACACTC TTGGCGAAAG CCATTGCAGG CGAGGCCGGC
 601 GTGCCGTTCT TCAGCATTTC CGGTTCCGAT TTTGTCGAAA TGTTCGTCGG
 651 TGTCGGTGCA AGCCGCGTCC GCGATATGTT CGAGCAGGCA AAGAAAAACG
 701 CCCCATGCAT TATCTTTATC GACGAGATTG ACGCGGTAGG CCGCCAACGC
 751 GGCGCAGgTT TGGGCGGCGG CAATGATGAG CGCGAGCAAA CATTAAACCA
 801 ATTATTGGTT GAAATGGACG GTTTTGAGAG CAATCAGACT GTAATTGTGA
 851 TTGCGGCAAC CAACCGCCCC GACGTACTCG ATCCTGCGCT GCAACGCCCC
 901 GGCCGCTTCG ACCGCCAAGT CGTCGTCCCC CTGCCGGACA TCCGGGGGCG
 951 CGAACAGatn ttGAACGTCC ATTCtaaAAA AGTGCctttG dacgaATCTg
1001 tggaTTTATT GTCCCTCGCG CGCGGCACGC ccggttttTc cggcgcggat
1051 tTggcgaaac tggtcaacga agcccccctg tttgccggcc gccgcaacaa
```

-continued

```
1101 agtgaaagtc gatcaaagcg attTGAAGAC GCCAAAGACA AAATCTATAT

1151 GGGTCCGGAA CGCCGCAGTA TGGTGA
```

This corresponds to the amino acid sequence <SEQ ID 1962; ORF 614.ng>:

```
g614.pep
   1 MAAFNALDGK KEDNGQIEYS QFIRQVNNGE VSGVNIEGSV VSGYLIKGER

51 TDKSTFFTNA PLDDNLIQTL LNKNVRVKVT PEEKPSALTA LFYSLLPVLL

101 LIGAWFYFMR MQAGGGGKGG AFSFGKSRAR LLDKDANKVT FADVAGCDEA

151 KEEVQEIVDY LKAPNRYQSL GGRVPRGILL AGSPGTGKTL LAKAIAGEAG

201 VPFFSISGSD FVEMFVGVGA SRVRDMFEQA KKNAPCIIFI DEIDAVGRQR

251 GAGLGGGNDE REQTLNQLLV EMDGFESNQT VIVIAATNRP DVLDPALQRP

301 GRFDRQVVVP LPDIRGREQX LNVHSKKVPL DESVDLLSLA RGTPGFSGAD

351 LAKLVNEAPL FAGRRNKVKV DQSDLKTPKT KSIWVRNAAV W*
```

The following partial DNA sequence was identified in *N. meningitidis* <SEQ ID 1963>:

```
m614.seq
    1 ATGGCTGCGT TCAACGCTTT AGACGGTAAA AAAGAAGACA ACGGGCAAAT

51 CGAATACTCT CAGTTCATCC AACAGGTCAA CAACGGCGAA GTATCCGGCG

101 TCAACATCGA AGGATCCGTC GTCAGCGGCT ACCTGATTAA GGGCGAGCGC

151 ACCGACAAAA GCACTTTCTT CACCAACGCG CCTTTGGACG ACAACCTAAT

201 TAAAACACTG CTCGACAAAA ACGTCCGCGT AAAAGTAACG CCGGAAGAAA

251 AACCGAGCGC GCTGGCTGCC CTGTTTTACA GCCTGCTGCC CGTCCTGCTG

301 CTGATTGGCG CATGGTTCTA CTTCATGCGT ATGCAGACGG GCGGCGGCGG

351 AAAAGGCGGC GCATTCTCAT TCGGTAAAAG CCGCGCCCGC CTGCTGGACA

401 AAGATGCCAA CAAAGTGACC TTTGCCGATG TCGCCGGCTG CGACGAAGCC

451 AAAGAAGAAG TACAGGAAAT CGTCGATTAC CTCAAAGCGC CGAACCGCTA

501 TCAAAGCCTG GGCGGGCGCG TGCCGCGCGG CATCCTGCTG GCGGGCAGCC

551 CGGGTACGGG TAAGACGCTT TTGGCGAAAG CGATTGCAGG CGAAGCCGGC

601 GTGCCGTTCT TCAGCATTTC AGGTTCCGAC TTTGTCGAAA TGTTCGTCGG

651 TGTCGGTGCG AGCCGCGTCC GCGATATGTT CGAGCAGGCG AAGAAAAACG

701 CCCCCTGCAT CATCTTTATC GACGAGATTG ACGCAGTCGG CCGCCAACGC

751 GGCGCAGGTT TGGGCGGCGG CAATGATGAG CGCGAGCAAA CATTAAACCA

801 ATTGTTGGTT GAAATGGACG GTTTTGAGAG CAATCAGACT GTAATTGTGA

851 TTGCGGCAAC CAACCGCCCC GACGTACTCG ATCCTGCGCT GCAACGCCCC

901 GGCCGTTTCG ACCGCCAAGT GGTTGTCCCC CTGCCGGACA TCCGAGGGCG

951 CGAACAGATT TTGAACGTCC ATTCTAAAAA AGTGCCTTTG GACGAATCTG

1001 TGGATTTATT GTCCCTCGCG CGCGGCACGC CGGGTTTTTC CGGCGCGGAT

1051 TTGGCGAACT TGGTCAACGA AGCCGCCCTG TTTGCCGGCC GCCGCAATAA

1101 AGTCAAAGTC GATCAGAGCG ATTTGAAGAC GCCAAAGACA AAATCTATAT

1151 GGGTCCGGAA CGCCGCAGTA TGGTGA
```

This corresponds to the amino acid sequence <SEQ ID 1964; ORF 614>:

```
m614.pep
  1 MAAFNALDGK KEDNGQIEYS QFIQQVNNGE VSGVNIEGSV VSGYLIKGER

51 TDKSTFFTNA PLDDNLIKTL LDKNVRVKVT PEEKPSALAA LFYSLLPVLL

101 LIGAWFYFMR MQTGGGKGG AFSFGKSRAR LLDKDANKVT FADVAGCDEA

151 KEEVQEIVDY LKAPNRYQSL GGRVPRGILL AGSPGTGKTL LAKAIAGEAG

201 VPFFSISGSD FVEMFVGVGA SRVRDMFEQA KKNAPCIIFI DEIDAVGRQR

251 GAGLGGGNDE REQTLNQLLV EMDGFESNQT VIVIAATNRP DVLDPALQRP

301 GRFDRQVVVP LPDIRGREQI LNVHSKKVPL DESVDLLSLA RGTPGFSGAD

351 LANLVNEAAL FAGRRNKVKV DQSDLKTPKT KSIWVRNAAV W*
```

Computer analysis of this amino acid sequence gave the following results:
Homology with a Predicted ORF from *N. gonorrhoeae*

```
   m614/g614 98.0% identity in 391 aa overlap 10        20        30        40        50        60
m614.pep  MAAFNALDGKKEDNGQIEYSQFIQQVNNGEVSGVNIEGSVVSGYLIKGERTDKSTFFTNA
          ||||| ||||||||||||||||:|||||||||||||||||||||||||||||||||||||
g614      MAAFNALDGKKEDNGQIEYSQFIRQVNNGEVSGVNIEGSVVSGYLIKGERTDKSTFFTNA
                 10        20        30        40        50        60

70        80        90       100       110       120
m614.pep  PLDDNLIKTLLDKNVRVKVTPEEKPSALAALFYSLLPVLLLIGAWFYFMRMQTGGGKGG
          ||||||||:|||:||||||||||||||||:||||||||||||||||||||||:||||||
g614      PLDDNLIQTLLNKNVRVKVTPEEKPSALTALFYSLLPVLLLIGAWFYFMRMQAGGGGKGG
                 70        80        90       100       110       120

130       140       150       160       170       180
m614.pep  AFSFGKSRARLLDKDANKVTFADVAGCDEAKEEVQEIVDYLKAPNRYQSLGGRVPRGILL
          ||||||||||||||||||||||||||||||||||||||||||||||||||||||||||||
g614      AFSFGKSRARLLDKDANKVTFADVAGCDEAKEEVQEIVDYLKAPNRYQSLGGRVPRGILL
                130       140       150       160       170       180

190       200       210       220       230       240
m614.pep  AGSPGTGKTLIAKAIAGEAGVPFFSISGSDFVEMFVGVGASRVRDMFEQAKKNAPCIIFI
          ||||||||||||||||||||||||||||||||||||||||||||||||||||||||||||
g614      AGSPGTGKTLIAKAIAGEAGVPFFSISGSDFVEMFVGVGASRVRDMFEQAKKNAPCIIFI
                190       200       210       220       230       240

250       260       270       280       290       300
m614.pep  DEIDAVGRQRGAGLGGGNDEREQTLNQLLVEMDGFESNQTVIVIAATNRPDVLDPALQRP
          ||||||||||||||||||||||||||||||||||||||||||||||||||||||||||||
g614      DEIDAVGRQRGAGLGGGNDEREQTLNQLLVEMDGFESNQTVIVIAATNRPDVLDPALQRP
                250       260       270       280       290       300

310       320       330       340       350       360
m614.pep  GRFDRQVVVPLPDIRGREQILNVHSKKVPLDESVDLLSLARGTPGFSGADLANLVNEAAL
          |||||||||||||||||||| |||||||||||||||||||||||||||||:||||| |
g614      GRFDRQVVVPLPDIRGREQXLNVHSKKVPLDESVDLLSLARGTPGFSGADLAKLVNEAPL
                310       320       330       340       350       360

370       380       390
m614.pep  FAGRRNKVKVDQSDLKTPKTKSIWVRNAAVWX
          ||||||||||||||||||| ||||||||||||
g614      FAGRRNKVKVDQSDLKTPKTKSIWVRNAAVWX
                370       380       390
```

The following partial DNA sequence was identified in *N. meningitidis* <SEQ ID 1965>:

```
a614.seq
    1 ATGGCTGCGT TCAACGCTTT A

```
              70        80        90       100       110       120
m614.pep  PLDDNLIKTLLDKNVRVKVTPEEKPSALAALFYSLLPVLLLIGAWFYFMRMQTGGGKGG
          ||||||||||||||||||||||||||||||||||||||||||||||||||||||||||
a614      PLDDNLIKTLLDKNVRVKVTPEEKPSALAALFYSLLPVLLLIGAWFYFMRMQTGGGKGG
              70        80        90       100       110       120

130       140       150       160       170       180
m614.pep  AFSFGKSRARLLDKDANKVTFADVAGCDEAKEEVQEIVDYLKAPNRYQSLGGRVPRGILL
          ||||||||||||||||||||||||||||||||||||||||||||||||||||||||||||
a614      AFSFGKSRARLLDKDANKVTFADVAGCDEAKEEVQEIVDYLKAPNRYQSLGGRVPRGILL
             130       140       150       160       170       180

190       200       210       220       230       240
m614.pep  AGSPGTGKTLLAKAIAGEAGVPFFSISGSDFVEMFVGVGASRVRDMFEQAKKNAPCIIFI
          ||||||||||||||||||||||||||||||||||||||||||||||||||||||||||||
a614      AGSPGTGKTLLAKAIAGEAGVPFFSISGSDFVEMFVGVGASRVRDMFEQAKKNAPCIIFI
             190       200       210       220       230       240

250       260       270       280       290       300
m614.pep  DEIDAVGRQRGAGLGGGNDEREQTLNQLLVEMDGFESNQTVIVIAATNRPDVLDPALQRP
          ||||||||||||||||||||||||||||||||||||||||||||||||||||||||||||
a614      DEIDAVGRQRGAGLGGGNDEREQTLNQLLVEMDGFESNQTVIVIAATNRPDVLDPALQRP
             250       260       270       280       290       300

310       320       330       340       350       360
m614.pep  GRFDRQVVVPLPDIRGREQILNVHSKKVPLDESVDLLSLARGTPGFSGADLANLVNEAAL
          |||||||||||||||||||||||||||||||:||||||||||||||||||||||||||||
a614      GRFDRQVVVPLPDIRGREQILNVHSKKVPLDKSVDLLSLARGTPGFSGADLANLVNEAAL
             310       320       330       340       350       360

370       380       390
m614.pep  FAGRRNKVKVDQSDLKTPKTKSIWVRNAAVWX
          |||||||||||||||||||||||||||||||
a614      FAGRRNKVKVDQSDLKTPKTKSIWVRNAAVWX
             370       380       390
```

The following partial DNA sequence was identified in *N. gonorrhoeae* <SEQ ID 1967>:

```
g615.seq
    1 ATGTGGAAAC GGCGGCGGCG CGGTGtcggC AGCTTtgaag agcagcGaAT 51 agatgCCGCC GGCAAACCAC AATGCGGAAa gcaggCtgaa gcGGTTgcgC 101 GGCagcTTca tGCCGCCTCC TcGTCCaGCC ACGtttGgca gattttggac 151 aggcgcAGga ATTTGCcgCc gcgtgcggCA agtatgtcgc gcCAttgtgc 201 cacttcttcg gcggacggTG cttcgtcgaT gctgCATTCG TACagcagga 251 aatcgagggt ttcttcgatg acggGgatgg AttccgTTTG GataAgCTgc 301 ttgagttcgt tcatgactGt TCgGATAcgg aaatcgggaa aatgccgtct 351 gAaagggctt CAGACGGCat tggATTATTT GCTGTGCAGG AAgcgcgttg 401 cctcttccca tttgcCGGAA AtgATGTCGg gtacggcctg cAGGGATttg 451 gCGACGGcat cgtcgatttg ccgGcggtgc ttCcgcgctc ggtttGTTca 501 agacgtagcc gaCGACGagg ttgcggtcGC CGGGGtggcC GATGCCGAGG 551 CGCAGGCGGt aatagtctgC CGTGCCGAGT TTTGCctgAA TGTCTTTCAA 601 GCCGTTGTGT CcgcCGttgc cgcCGCCGAG TTTGAATTTg ATCCGTCCGC

651 AAGGGATGTC GAGTTCGTCG TGGACGACGA GGATTTCTTC GGGTTTGATT

701 TTGTAGAACT GTGCAAGCGC GGCAACCGCC TGTCCGGAAC GGTTCATGAA

751 CGTGGCCGGT TTGAGCAGCC AAACATCGCC GTCGGGCAGG GCGGCGCGGG

801 CAACTTCGCC GAAGAATTTT TTTTCTTCTT TAAACGAAGC CTTCCATTTC

851 CACGCCAGTT CGTCGAGGAA CCAAAAGCCC GCATTGTGGC GGGTCTGTTC

901 GTATTCTTTG CCCGGGTTGC CCAAGCCGAC AACCATTTTG ATTGTGttcg 951 acatgataTT TtccgtgTTT CTgTCGaatg cggtCtgaAG GCTTCAGacg 1001 gcatggTtaT TCTTCTTgaT TTtgaACgcg tgtgcggCGC GCTTCTTTGG
```

```
1051 GGTCGATCAA CAGCGGGCGG TACACTTCGA TGCGGTCGCC GTCGCGCAGC

1101 GGCGTGTCGT CTTTGA
```

This corresponds to the amino acid sequence <SEQ ID 1968; ORF 615.ng>:

```
g615.pep
   1 MWKRRRRGVG SFEEQRIDAA GKPQCGKQAE AVARQLHAAS SSSHVWQILD

51 RRRNLPPRAA SMSRHCATSS ADGASSMLHS YSRKSRVSSM TGMDSVWISC

101 LSSFMTVRIR KSGKCRLKGL QTALDYLLCR KRVASSHLPE MMSGTACRDL

151 ATASSICRRC FRARFVQDVA DDEVAVAGVA DAEAQAVIVC RAEFCLNVFQ

201 AVVSAVAAAE FEFDPSARDV EFVVDDEDFF GFDFVELCKR GNRLSGTVHE

251 RGRFEQPNIA VGQGGAGNFA EEFFFFFKRS LPFPRQFVEE PKARIVAGLF

301 VFFARVAQAD NHFDCVRHDI FRVSVECGLK ASDGMVILLD FERVCGALLW

351 GRSTAGGTLR CGRRRAAACR L*
```

The following partial DNA sequence was identified in *N. meningitidis* <SEQ ID 1969>:

```
m615.seq Length: 1116
     1 ATGCGGAAAA GGCGGTGGCG CGGTTTCGGC AGCTTTGAAA AGCAGTGAGT

51 AAATGCTGCC TGCAAACCAC AATGCCGAGA GCAGGATAAA GCGGTTGCGT

101 GGCAGATTCA TGCTTGTTCC TCTTCAAGCC ATGTCTGGCA TAGTTTGGAT

151 AGGCGCAGGA ATTTTCCGCC GCGTGCGGCC AGCATATCGC GCCAAACGGC

201 AATTTCTTCG GCGGAGGGGG CATCGTCTAT GCTGCATTCG TAGAGCAGGA

251 AATCGAGGGT TTCTTCGATG ACGGGGATGG ATTCGGTTTG GATAAGCTGC

301 TTGAGTTCGG TCATGACTGT TCGGATATGG AAATCGGGAA CATGCCGTCT

351 GAAAGGGCTT CAGACGGCAT CGGGTCATTT GCTGTGCAGG AAGCGGGTTG

401 CTTCTTCCCA TTTGCCGGCA AGGATGTCGG GTATGGCTTG CAGGGATTTG

451 GCGACGGCAT CGTCAATCTG TCGGCGGTGT .TCCGTACTG GGTTTGTTCA

501 GGACATAGCC GACGACGAGG TTGCGGTCGC CCGGGTGGCC GATGCCGAGG

551 CGCAGGCGGT AATAGTCTGC CGTGCCGAGT TTTGCCTGAA TGTCTTTCAA

601 GCCGTTGTGT CCGCCGTTGC CGCCGCCGAG TTTGAATTTG ATCCGTCCGC

651 AGGGAATGTC GAGTTCGTCG TGGACGACGA GGATTTCTTC GGGTTTGATT

701 TTGTAGAACT GTGCAAGCGC GGCAACTGCC TGTCCGGAAC GGTTCATGAA

751 CGTGGCAGGT TTGAGCAGCC AAACGTCGCC GTCGGGCAGG GCGGCACGGG

801 CGACTTCGCC GAAGAATTTT TTTTCTTCTT TAAATGAAGC CTTCCATTTC

851 CACGCCAGTT CGTCGAGGAA CCAAAAACCC GCATTGTGGC GTGTCTGTTC

901 GTATTCTTTG CCCGGGTTGC CCAAGCCGAC AACCATTTTG ATTGTGTTTG

951 ACATGATATT TTCCGTGTTT CTGTCGAATG CTGTCTGAAG GCTTCAGACG

1001 GCATGGTTAT TCTTCTTGAT TTTGAACGCG TTTGCGGCGC GCTTCTTTGG

1051 GGTCGATCAA CAGCGGGCGG TACACTTCGA TGCGGTCGCC GTCGCGCAGC

1101 GGCGTGTCGT CTTTGA
```

This corresponds to the amino acid sequence <SEQ ID 1970; ORF 615>:

```
m615.pep Length: 372
   1 MRKRRWRGFG SFEKQXVNAA CKPQCREQDK AVAWQIHACS SSSHVWHSLD

51 RRRNFPPRAA SISRQTAISS AEGASSMLHS XSRKSRVSSM TGMDSVWISC

101 LSSVMTVRIW KSGTCRLKGL QTASGHLLCR KRVASSHLPA RMSGMACRDL

151 ATASSICRRC XRTGFVQDIA DDEVAVARVA DAEAQAVIVC RAEFCLNVFQ

201 AVVSAVAAAE FEFDPSAGNV EFVVDDEDFF GFDFVELCKR GNCLSGTVHE

251 RGRFEQPNVA VGQGGTGDFA EEFFFFFKXS LPFPRQFVEE PKTRIVACLF

301 VFFARVAQAD NHFDCVXHDI FRVSVECCLK ASDGMVILLD FERVCGALLW

351 GRSTAGGTLR CGRRRAAACR L*
```

Computer analysis of this amino acid sequence gave the following results:
Homology with a Predicted ORF from *N. gonorrhoeae*

```
    m615/g615  86.8% identity in 371 aa overlap 10         20         30         40         50         60
    m615.pep  MRKRRWRGFGSFEKQXVNAACKPQCREQDKAVAWQIHACSSSHVWHSLDRRRNFPPRAA
              | ||| || ||||:| ::|| |||| :| :||| |:|| ||||||: |||||:||||
    g615      MWKRRRRGVGSFEEQRIDAAGKPQCGKQAEAVARQLHAASSSHVWQILDRRRNLPPRAA
                  10         20         30         40         50         60

70         80         90        100        110        120
    m615.pep  SISRQTAISSAEGASSMLHSXSRKSRVSSMTGMDSVWISCLSSVMTVRIWKSGTCRLXGL
              |:||: | |||:|||||||| |||||||||||||||||||||: ||||| | ||||
    g615      SMSRHCATSSADGASSMLHSYSRKSRVSSMTGMDSVWISCLSSFMTVRIRKSGKCRLKGL
                  70         80         90        100        110        120

130        140        150        160        170        180
    m615.pep  QTASGHLLCRKRVASSHLPARMSGMACRDLATASSICRRCXRTGFVQDIADDEVAVARVA
              |||  :||||||||||||||  ||| |||||||||||||||| : |||| :||||||| ||
    g615      QTALDYLLCRKRVASSHLPEMMSGTACRDLATASSICRRCFRARFVQDVADDEVAVAGVA
                 130        140        150        160        170        180

190        200        210        220        230        240
    m615.pep  DAEAQAVIVCRAEFCLNVFQAVVSAVAAAEFEFDPSAGNVEFVVDDEDFFGFDFVELCKR
              |||||||||||||||||||||||||||||||||||||| :||||||||||||||||||||
    g615      DAEAQAVIVCRAEFCLNVFQAVVSAVAAAEFEFDPSARDVEFVVDDEDFFGFDFVELCKR
                 190        200        210        220        230        240

250        260        270        280        290        300
    m615.pep  GNCLSGTVHERGRFEQPNVAVGQGGTGDFAEEFFFFFKXSLPFPRQFVEEPKTRIVACLF
              || |||||||||||||||:|||||:|:||||||||||| ||||||||||||:|||| ||
    g615      GNRLSGTVHERGRFEQPNIAVGQGGAGNFAEEFFFFFKRSLPFPRQFVEEPKARIVAGLF
                 250        260        270        280        290        300

310        320        330        340        350        360
    m615.pep  VFFARVAQADNHFDCVXHDIFRVSVECCLKASDGMVILLDFERVCGALLWGRSTAGGTLR
              ||||||||||||||||||||||||||||||||||||||||||||||||||||||||||
    g615      VFFARVAQADNHFDCVRHDIFRVSVECGLKASDGMVILLDFERVCGALLWGRSTAGGTLR
                 310        320        330        340        350        360

370
    m615.pep  CGRRRAAACRLX
              ||||||||||||
    g615      CGRRRAAACRLX
                 370
```

The following partial DNA sequence was identified in *N. meningitidis* <SEQ ID 1971>:

```
a615.seq
   1 ATGCGGAAAC GGCGGCGGCG CGGTGTCGGC AGCTTTGAAG AGCAGCGAAT

51 AGATGCCGCC GGCAAACCAC AATGCGGAAA GCAGGCTGAA GCGGTTGCGC

101 GGCAGCTTCA TGCCGCCTCC TCGTCCAGCC ACGTTTGGCA GATTTTGGAC

151 AGGCGCAGGA ATTTGCCGCC GCGTGCGGCA AGTATGTCGC GCCATTGTGC

201 CACTTCTTCG GCGGATGGTG CGTCGTCGAT GCTGCATTCG TACAGCAGGA
```

```
-continued
 251 AATCGAGGGT TCTTCGATG ACGGGGATGG ATTCGGTTTG GATAAGCTGC

301 TTGAGTTCGG TCATGACTGT TCGGATATGG AAATCGGGAA CATGCCGTCT

351 GAAAGGGCTT CAGACGGCAT CGGGTCATTT GCTGTGCAGG AAGCGGGTTG

401 CCTCTTCACA TTTGCCGGCA AGGATGTCGG GTATGGCTTG CAGGGATTTG

451 GCGACGGCAT CGTCAATCTG TCGGCGGTG. TTCCGTACTG GGTTTGTTCA

501 GGACATAGCC GACGACGAGG TTGCGGTCGC CCGGGTGGCC GATGCCGAGG

551 CGCAGGCGGT AATAGTCTGC CGTGCCGAGT TTTGCCTGAA TGTCTTTCAA

601 GCCGTTGTGT CCACCGTTGC CGCCGCCGAG TTTGAATTTG ATCCGTCCGC

651 AGGGAATGTC GAGTTCGTCG TGGACGACGA GGATTTCTTC GGGTTTGATT

701 TTATAAAACT GCGCAAGGGC GGCAACTGCC TGTCCGGAAC GGTTCATGAA

751 CGTGGTCGGC TTGAGCAGCC AGACATCGCC GTCGGGCAGG GTAGCACGGG

801 CGACTTCGCC GAAGAATTTT TTTTCTTCTT TAAATGAAGC CTTCCATTTC

851 CACGCCAGTT CGTCGAGGAA CCAAAAACCC GCATTGTGGC GTGTCTGTTC

901 GTATTCTTTG CCCGGGTTGC CCAAGCCGAC AACCATTTTG ATTGTGTTTG

951 ACATGATATT TTCCGTGTTT CTGCCGAATG CCGTCTGAAG GCTTCAGACG

1001 GCATGGTTAT TCTTCTTGAT TTTGAACGCG TTTGCGGCGC GCTTCTTTGG

1051 GGTCGATCAA CAGCGGGCGG TACACTTCGA TGCGGTCGCC GTCGCGCAGC

1101 GGCGTGTCGT CTTTGA
```

This corresponds to the amino acid sequence <SEQ ID 1972; ORF 615.a>:

```
a614.pep
      1 MRKRRRRGVG SFEEQRIDAA GKPQCGKQAE AVARQLHAAS SSSHVWQILD

51 RRRNLPPRAA SMSRHCATSS ADGASSMLHS YSRKSRVSSM TGMDSVWIGC

101 LSSVMTVRIW KSGTCRLKGL QTASGHLLCR KRVASSHLPA RMSGMACRDL

151 ATAGGICRRX FRTGFVQDIA DDEVAVARVA DAEAQAVIVC RAEFCLNVFQ

201 AVVSTVAAAE FEFDPSAGNV EFVVDDEDFF GFDFIKLRKG GNCLSGTVHE

251 RGRLEQPDIA VGQGSTGDFA EEFFFFFK*S LPFPRQFVEE PKTRIVACLF

301 VFFARVAQAD NHFDCV*HDI FRVSAECRLK ASDGMVILLD FERVCGALLW

351 GRSTAGGTLR CGRRAAACR L*
```

```
m615/a615 90.3% identity in 371 aa overlap 10         20         30         40         50         60
m615.pep  MRKRRWRGFGSFEKQXVNAACKPQCREQDKAVAWQIHACSSSSHVWHSLDRRRNFPPRAA
          ||||| || ||||:| ::|| |||| :|  :||| |:|| ||||||: ||||||:||||
a615      MRKRRRRGVGSFEEQRIDAAGKPQCGKQAEAVARQLHAASSSSHVWQILDRRRNLPPRAA
                  10         20         30         40         50         60

70         80         90        100        110        120
m615.pep  SISRQTAISSAEGASSMLHSXSRKSRVSSMTGMDSVWISCLSSVMTVRIWKSGTCRLKGL
          |:||:  |||:|||||||||| |||||||||||||||| |||||||||||||||||||||
a615      SMSRHCATSSADGASSMLHSYSRKSRVSSMTGMDSVWISCLSSVMTVRIWKSGTCRLKGL
                  70         80         90        100        110        120

130        140        150        160        170        180
m615.pep  QTASGHLLCRKRVASSHLPARMSGMACRDLATASSICRRCXRTGFVQDIADDEVAVARVA
          |||||||||||||||||||||||||||||||||||||||| |||||||||||||||||||
a615      QTASGHLLCRKRVASSHLPARMSGMACRDLATASSICRRXFRTGFVQDIADDEVAVARVA
                 130        140        150        160        170        180

190        200        210        220        230        240
m615.pep  DAEAQAVIVCRAEFCLNVFQAVVSAVAAAEFEFDPSAGNVEFVVDDEDFFGFDFVELCKR
          ||||||||||||||||||||||||:|||||||||||||||||||||||||||||:: |
a615      DAEAQAVIVCRAEFCLNVFQAVVSTVAAAEFEFDPSAGNVEFVVDDEDFFGFDFIKLRKG
                 190        200        210        220        230        240
```

-continued

```
                250        260        270        280        290        300
m615.pep  GNCLSGTVHERGRFEQPNVAVGQGGTGDFAEEFFFFFKXSLPFPRQFVEEPKTRIVACLF
          ||||||||||||:|||::|||||:||||||||||||||||||||||||||||||||||||
a615      GNCLSGTVHERGRLEQPDIAVGQGSTGDFAEEFFFFFKXSLPFPRQFVEEPKTRIVACLF
                250        260        270        280        290        300

310        320        330        340        350        360
m615.pep  VFFARVAQADNHFDCVXHDIFRVSVECCLKASDGMVILLDFERVCGALLWGRSTAGGTLR
          |||||||||||||||||||||||||:|| ||||||||||||||||||||||||||||||
a615      VFFARVAQADNHFDCVXHDIFRVSAECRLKASDGMVILLDFERVCGALLWGRSTAGGTLR
                310        320        330        340        350        360

370
m615.pep  CGRRRAAACRLX
          ||||||||||||
a615      CGRRRAAACRLX
                370
```

The following partial DNA sequence was identified in *N. gonorrhoeae* <SEQ ID 1973>:

```
g616.seq
    1 atgtcgaaCA CAATCAAAAT GGTTGTCGGC TTGGGCAACC CGGGCAAAGA

51 ATACGAACAG ACCCGCCACA ATGCGGGCTT TTGGTTCCTC GACGAACTGG

101 CGTGGAAATG GAAGGCTTCG TTTAAAGAAG AAAAAAAATT CTTCGGCGAA

151 GTTGCCCGCG CCGCCCTGCC CGACGGCGAT GTTTGGCTGC TCAAACCGGC

201 CACGTTCATG AACCGTTCCG GACAGGCGGT TGCCGCGCTT GCACAGTTCT

251 ACAAAATCAA ACCCGAAGAA ATCCTCGTCG TCCACGACGA ACTCGACATC

301 CCTTGCGGAC GGATcAAATT CAAACTCGGC GgcggcaaCG gcgGACACAA

351 CGGCTTGAAA GACATTcagG CAAAACTCGG CACGGcagac tattaCCGCC

401 TGCGCCTCGG CATCGgccaC CCCGGCgacc gcaaccCGT CGtcggctac 451 gtcttgAACa aaccgagcgc gGaagcaccg Ccggcaaatc gacgatgCCG 501 TCGccaaATC CCTgcaggcc gtaccCGACA TcaTTTCCGg caaatgggaa 551 gaggcaacgc gcTTCCTGCA CAGCAAATAA TccaatGCCG TCTGaagccc 601 ttTcagacgg cattttcccg atttccgTAT CcGAaCagtc atgaacgaac 651 tcaagcAGcT tatCCAAAcg gaaTccatcC ccgtcatcga agaaacccct 701 gatttcctgc tGTACGAATG cagcAtcgac gaagCAccgt ccgccgaaga 751 agtggcacaa TGgcgcgaca tactTGccgc acgcgGcgGC AAATtcCTgc 801 gcctgtccaa aatctgcCaa aCGTGGCtGG ACgAGGAGGC GGCatgAAgc 851 tGCCGcgcAA CCgcttcaGc ctgctTTCCG CATTGTGGTT TGCCGGCGGc 901 atctATtCgc tgctcttcaA AGCTGccgaC ACCGCGCCGC CGCCGTTTCC 951 ACATTtcgaC AAAGCAGCAC ACCTTGCCCT GTTTTTCGCA CAaatCTTgt 1001 tTctGGCCAA AGCATTCAAA ACCGGAAAAC TTCCCATCCC CTACCGCAGC

1051 CTGATTGCGT TCGCCTTCTG TTTTGCCGTC GGCAGCGAAT GCGCGCAGGC

1101 ATGGTTTACC GCAACGCGAA CCGGCAGTTT GGGCGATGTC CTTGCCgACC

1151 TGACGGGCGC AGCCCTTGCC CTCTTTGCCG CGCGTTCTGC CTGCCGcccg 1201 gactaa
```

This corresponds to the amino acid sequence <SEQ ID 1974; *ORF* 616.ng>:

```
g616.pep
    1 MSNTIKMVVG LGNPGKEYEQ TRHNAGFWFL DELAWKWKAS FKEEKKFFGE
```

-continued

51 VARAALPDGD VWLLKPATFM NRSGQAVAAL AQFYKIKPEE ILVVHDELDI

101 PCGRIKFKLG GGNGGHNGLK DIQAKLGTAD YYRLRLGIGH PGDRNLVVGY

151 VLNKPSAEAP PANRRCRRQI PAGRTRHHFR QMGRGNALPA QQIIQCRLKP

201 FQTAFSRFPY PNSHERTQAA YPNGIHPRHR RNPRFPAVRM QHRRSTVRRR

251 SGTMARHTCR TRRQIPAPVQ NLPNVAGRGG GMKLPRNRFS LLSALWFAGG

301 IYSLLFKAAD TAPPPFPHFD KAAHLALFFA QILFLAKAFK TGKLPIPYRS

351 LIAFAFCFAV GSECAQAWFT ATRTGSLGDV LADLTGAALA LFAARSACRP

401 D*

The following partial DNA sequence was identified in *N. meningitidis* <SEQ ID 1975>:

m616.seq

1 ATGTCAAACA CAATCAAAAT GGTTGTCGGC TTGGGCAACC CGGGCAAAGA

51 ATACGAACAG ACACGCCACA ATGCGGGTTT TTGGTTCCTC GACGAACTGG

101 CGTGGAAATG GAAGGCTTCA TTTAAAGAAG AAAAAAAATT CTTCGGCGAA

151 GTCGCCCGTG CCGCCCTGCC CGACGGCGAC GTTTGGCTGC TCAAACCTGC

201 CACGTTCATG AACCGTTCCG GACAGGCAGT TGCCGCGCTT GCACAGTTCT

251 ACAAAATCAA ACCCGAAGAA ATCCTCGTCG TCCACGACGA ACTCGACATT

301 CCCTGCGGAC GGATCAAATT CAAACTCGGC GGCGGCAACG GCGGACACAA

351 CGGCTTGAAA GACATTCAGG CAAAACTCGG CACGGCAGAC TATTACCGCC

401 TGCGCCTCGG CATCGGCCAC CCGGGCGACC GCAACCTCGT CGTCGGCTAT

451 GTCCTGAACA AACCCAGTAC GGAACA.CCG CCGACAGATT GACGATGCCG

501 TCGCCAAATC CCTGCAAGCC ATACCCGACA TCCTTGCCGG CAAATGGGAA

551 GAAGCAACCC GCTTCCTGCA CAGCAAATGA CCCGATGCCG TCTGAAGCCC

601 TTTCAGACGG CATGTTCCCG ATTTCCATAT CCGAACAGTC ATGACCGAAC

651 TCAAGCAGCT TATCCAAACC GAATCCATCC CCGTCATCGA AGAAACCCTC

701 GATTTCCTGC TCTACGAATG CAGCATAGAC GATGCCCCCT CCGCCGAAGA

751 AATTGCCGTT TGGCGCGATA TGCTGGCCGC ACGCGGCGGA AAATTCCTGC

801 GCCTATCCAA ACTATGCCAG ACATGGCTTG AAGAGGAACA AGCATGAATC

851 TGCCACGCAA CCGCTTTATC CTGCTCTCGG CATTGTGGTT TGCAGGCAGC

901 ATTTACTCAC TGCTTTTCAA AGCTGCCGAA ACCGCGCCAC CGCCTTTTCC

951 GCATTTTGAC AAAGTGGCGC ACCTCGCCCT GTTTTTCGCA CAAATCTGGC

1001 TTCTGACCAA AGCATTCAGA ACCGACAACC GCCCCATCCC CTATCGCAGC

1051 CTGATGGTCT TTGCCCTCTG TTTCGCCCTC TTCAGCGAAT GCGCGCAGGC

1101 ATGGTTTACC GCAACGAGAA CCGGCAGTTT GGGCGATGTC CTTGCCGACC

1151 TGACGGGCGC AGCCCTTGCC CTCTTTACCG CGCGAGCTGC CTGCCGCCCG

1201 GACTAA

This corresponds to the amino acid sequence <SEQ ID 1976; ORF 616>:

```
a616.pep

1 MSNTIKMVVG LGNPGKEYEQ TRHNAGFWFL DELAWKWKAS FKEEKKFFGE

51 VARAALPDGD VWLLKPATFM NRSGQAVAAL AQFYKIKPEE ILVVHDELDI

101 PCGRIKFKLG GGNGGHNGLK DIQAKLGTAD VYRLRLGIGH PGDRNLVVGY

151 VLNKPSTEXP PTDXRCRRQI PASHTRHPCR QMGRSNPLPA QQMTRCRLKP

201 FQTACSRFPY PNSHDRTQAA YPNRIHPRHR RNPRFPALRM QHRRCPLRRR

251 NCRLARYAGR TRRKIPAPIQ TMPDMAXRGT SMNLPRNRFI LLSALWFAGS

301 IYSLLFKAAE TAPPPFPHFD KVAHLALFFA QIWLLTKAFR TCNRPIPYRS

351 LMVFALCFAL FSECAQAWFT ATRTGGLGDV LACLTGAALA LFTARAACRP

401 D* m616/g616 86.0% identity in 401 aa overlap
                  10         20         30         40         50         60
m616.pep  MSNTIKMVVGLGNPGKEYEQTRHNAGFWFLDELAWKWKASFKEEKKFFGEVARAALPDGD
          ||||||||||||||||||||||||||||||||||||||||||||||||||||||||||||
g616      MSNTIKMVVGLGNPGKEYEQTRHNAGFWFLDELAWKWKASFKEEKKFFGEVARAALPDGD
                  10         20         30         40         50         60
                  70         80         90        100        110        120
m616.pep  VWLLKPATFMNRSGQAVAALAQFYKIKPEEILVVHDELDIPCGRIKFKLGGGNGGHNGLK
          ||||||||||||||||||||||||||||||||||||||||||||||||||||||||||||
g616      VWLLKPATFMNRSGQAVAALAQFYKIKPEEILVVHDELDIPCGRIKFKLGGGNGGHNGLK
                  70         80         90        100        110        120
                 130        140        150        160        170        180
m616.pep  DIQAKLGTADYYRLRLGIGHPGDRNLVVGYVLNKPSTEXPPTDXRCRRQIPASHTRHPCR
          ||||||||||||||||||||||||||||||||||||||:|   ||::  |||||||||||:  |||    |
g616      DIQAKLGTADYYRLRLGIGHPGDRNLVVGYVLNKPSAEAPPANRCRRQIPAGRTRHHFR
                 130        140        150        160        170        180
                 190        200        210        220        230        240
m616.pep  QMGRSNPLPAQQMTRCRLKPFQTACSRFPYPNSHDRTQAAYPNRIHPRHRRNPRFPALRM
          ||||:|  |||||:  :|||||||| |||||||||:|||||||| |||||||||||:||
g616      QMGRGNALPAQQIIQCRLKPFQTAFSRFPYPNSHERTQAAYPNGIHPRHRRNPRFPAVRM
                 190        200        210        220        230        240
                 250        260        270        280        290        300
m616.pep  QHRRCPLRRRNCRLARYAGRTRRKIPAPIQTMPDMAXRGTSMNLPRNRFILLSALWFAGS
          ||||    :|||:   :||::  ||||:||||:|::|::|    || :|:|||||   ||||||||||:
g616      QHRRSTVRRRSGTMARHTCRTRRQIPAPVQNLPNVAGRGGGMKLPRNRFSLLSALWFAGG
                 250        260        270        280        290        300
                 310        320        330        340        350        360
m616.pep  IYSLLFKAAETAPPPFPHFDKVAHLALFFAQIWLLTKAFRTDNRPIPYRSLMVFALCFAL
          |||||||||:|||||||||||:||||||||||  :|:|||:|  :||||||||::||:|||:
g616      IYSLLFKAADTAPPPFPHFDKAAHLALFFAQILFLAKAFKTGKLPIPYRSLIAFAFCFAV
                 310        320        330        340        350        360
                 370        380        390        400
m616.pep  FSECAQAWFTATRTGSLGDVLADLTGAALALFTARAACRPDX
          ||||||||||||||||||||||||:||:||||||
g616      GSECAQAWFTATRTGSLGDVLADLTGAALALFAARSACRPDX
                 370        380        390        400
```

The following partial DNA sequence was identified in *N. meningitidis* <SEQ ID 1977>:

```
a616.seq
   1 ATGTCAAACA CAATCAAAAT GGTTGTCGGC TTGGGCAACC CGGGCAAAGA

51 ATACGAACAG ACACGCCACA ATGCGGGTTT TTGGTTCCTC GACGAACTGG

101 CGTGGAAATG GAAGGCTTCA TTTAAAGAAG AAAAAAAATT CTTCGGCGAA

151 GTCGCCCGTG CTACCCTGCC CGACGGCGAT GTCTGGCTGC TCAAGCCGAC

201 CACGTTCATG AACCGTTCCG GACAGGCAGT TGCCGCCCTT GCGCAGTTTT

251 ATAAAATCAA ACCCGAAGAA ATCCTCGTCG TCCACGACGA ACTCGACATT

301 CCCTGCGGAC GGATCAAATT CAAACTCGGC GGCGGCAACG GTGGACACAA
```

-continued

```
 351 CGGCTTGAAA GACATTCAGG CAAAACTCGG CACGGCAGAC TATTACCGCC

401 TGCGCCTCGG CATCGGCCAC CCGGGCGACC GCAACCTCGT CGTCGGCTAT

451 GTCCTGAACA AACCCAGTAC GGAA.CACCG CCGACAGATT GACGATGCCG

501 TCGCCAAATC CCTGCAAGCC ATACCCGACA TCCTTGCCGG CAAATGTGAA

551 GAGGCAACCC GCTTCCTGCA CAGCAAATGA CCCGATGCCG TCTGAAGCCC

601 TTTCAGACGG CATGTTCCCG ATTTCCATAT CCGAACAGTC ATGACCGAAC

651 TCAAGCAGCT TATCCAAACC GAATCCATCC CCGTCATCGA AGAAACCCTC

701 GATTTCCTGC TGTACGAATG CAGCATCGAC GACGCACCAT CCGCCGAAGA

751 AGTGGCACAA TGGCGCGACA TACTTGCCGC ACGCGGCGGC AAATTCCTGC

801 GCCTGTCCAA AATCTGCCAA ACGTGGCTGG ACGAGGAGGC GGCATGAAGC

851 TGCCGCGCAA CCGCTTCAGC CTGCTTTCCG CATTGTGGTT TGCCGGCGGC

901 ATCTATTCGC TGCTCTTCAA AGCTGCCGAC ACCGCGCCGC CGCCGTTTCC

951 GCATTTCGAC AAAGCAGCAC ACCTTGCCCT GTTTTTCGCA CAAATCTGGC

1001 TTTTGACCAA AGCATTCAAA ACCGGAAAAC TTCCCATCCC CTACCGCAGC

1051 CTGATGGTCT TTGCCCTCTG TTTCGCCCTC TTCAGCGAAT GCGCGCAGGC

1101 ATGATTTACC GCAACGAGAA CCGGCAGTTT GGGCGATGTT CTTGCCGATA

1151 TGGCAGGTAC GGTTCTCGCA CTCTTTGCCG CCCGCGCCGC CGACCGCCCG

1201 GACTGA
```

This corresponds to the amino acid sequence <SEQ ID 1978; *ORF* 616.a>:

```
a616.pep

1 MSNTIKMVVG LGNPGKEYEQ TRHNAGFWFL DELAWKWKAS FKEEKKFFGE

51 VARATLPDGD VWLLKPTTFM NRSGQAVAAL AQFYIKPEE  ILVVHDELDI

101 PCGRIKFKLG GGNGGHNGLK DIQAKLGTAD YYRLRLGIFH PGDRNLVVGY

151 VLNKPSTEXP PTD*RCRRQI PASHTRHPCR QM*RGNPLPA QQMTRCRLKP

201 FQTACSRFPY PNSHDRTQAA YPNRIHPRHR RNPRFPAVRM QHRRRTIRRR

251 SGTMARHTCR TRRQIPAPVQ NLPNVAGRGG GMKLPNRNFS LLSALWFAGG

301 IYSLLFKAAD TAPPPFPHFD KAAHLALFFA QIWLLTKARK TGKLPIPYRS

351 LMVFALCFAL FSECAQA*FT ATRTGSLGDV LADMAGTVLA LFAARAADRP

401 D* m616/a616  90.0% identity in 401 aa overlap 10         20         30         40         50         60
m616.pep   MSNTIKMVVGLGNPGKEYEQTRHNAGFWFLDELAWKWKASFKEEKKFFGEVARAALPDGD
           ||||||||||||||||||||||||||||||||||||||||||||||||||||:|||||
a616       MSNTIKMVVGLGNPGKEYEQTRHNAGFWFLDELAWKWKASFKEEKKFFGEVARATLPDGD
                   10         20         30         40         50         60

70         80         90        100        110        120
m616.pep   VWLLKPATFMNRSGQAVVALAQFYIKPEEILVVHDELDIPCGRIKFKLGGGNGGHNGLK
           ||||||:||||||||||||:|||||||||||||||||||||||||||:|||||||||||
a616       VWLLKPTTFMNRSGQAVAALAQFYIKPEEILVVHDELDIPCGRIKFDLGGGNGGHNGLK
                   70         80         90        100        110        120

130        140        150        160        170        180
m616.pep   DIQAKLGTADYYRLRLGIGHPGDRNLVVGYVLNKPSTEXPPTDXRCRRQIPASHTRHPCR
           ||||||||||||||||||:|||||||||||||||||||||||||||||||||||||||||
a616       DIQAKLGTADYYRLRLGIGHPGDRNLVVGYVLNKPSTEXPPTDXRCRRQIPASHTRHPCR
                  130        140        150        160        170        180
```

-continued

```
              190        200        210        220        230        240
m616.pep  QMGRSNPLPAQQMTRCRLKPFQTACSRFPYPNSHDRTQAAYPNRIHPRHRRNPRFPALRM
          || :||||||||||||||||||||||||||||||||||||||||||||||||||||:||
a616      QMXRGNPLPAQQMTRCRLKPFQTACSRFPYPNSHDRTQAAYPNRIHPRHRRNPRFPAVRM
              190        200        210        220        230        240

250        260        270        280        290        300
m616.pep  QHRRCPLRRRNCRLARYAGRTRRKIPAPIQTMPDMAXRGTSMNLPRNRFILLSALWFAGS
          ||||  :|||:  :||:: ||||:||||:|::|::| || :|:|||||| |||||||||:
a616      QHRRRTIRRRSGTMARHTCRTRRQIPAPVQNLPNVAGRGGGMKLPRNRFSLLSALWFAGG
              250        260        270        280        290        300

310        320        330        340        350        360
m616.pep  IYSLLFKAAETAPPPFPHFDKVAHLALFFAQIWLLTKAFRTDNRPIPYRSLMVFALCFAL
          |||||||||:||||||||||||:|||||||||||||||||:| |:||||||||||||||
a616      IYSLLFKAADTAPPPFPHFDKAAHLALFFAQIWLLTKAFKTGKLPIPYRSLMVFALCFAL
              310        320        330        340        350        360

370        380        390        400
m616.pep  FSECAQAWFTATRTGSLGDVLADLTGAALALFTARAACRPDX
          ||||||| ||||||||||||||::|::||||:|||| ||||
a616      FSECAQAXFTATRTGSLGDVLADMAGTVLALFAARAADRPDX
              370        380        390        400
```

The following partial DNA sequence was identified in *N. gonorrhoeae* <SEQ ID 1979>:

```
g619.seq
  1 ATGCCGTCTG AAAAAAATAT CGGTTTTATG GCAGGAAGCA GCCGTCCGTT

51 GCGGGTCGCC TTTGCGCTGT TGCTGGTTTC CTGCATCCTG TTTATGACGC

101 TCAACGTCAA AGGAGATTGG GACTTTGTCT TGCACCTGCG CCTGACCAAG

151 CTTGCCGCGC TGCTGATGGT CGCCTATGCG GTCGGCGTGT CCACTCAACT

201 CTTCCAAACG CTGACCAACA ACCCGATTCT GACCCCTTCG ATTTTGGGTT

251 TCGATTCGCT GTATGTGTTT TTGCAGACCT TGCTGgtGTT TACGTtcgGC

301 GGCGTGGGCT ATAcatccct gccgttgacg gGCAAATTCG GCTTTGAACT

351 GGTTGTTATG ATGGGCGGCT CGCTGCTGCT GTTTTACACG CTCATCCGTC

401 AGGGCGGGCG CGATTTGCCG CACATGATTT TAATCGGCGT GATTTTCGGG

451 ATTTTGTTCC GCAGCCTTTC CTCGCTGCTT TCGCGCATGA TAGACCCCGA

501 AGAATTTACC GCCGCGCAGG CGAATATGTT TGCCGGATTC AATACCGTCC

551 GCAGCGAGCT TTTAGGCATA GGCGCGCTGG TCCTGCTCGT CAGCGCGGCG

601 GTCGTTTGGC ACGAACGCTA CCGCTCGGAC GTACACCTTT TGGGGCGCGA

651 CCAAGCCGTC AATTTGGGCA TCAGCTACAC GCGCAACACC TTATGGATAC

701 TGCTTTGGAT TGCCGCATTG GTGGCGACGG CGACCGCCGT TGTCGGCCCG

751 GTGAGCTTTT TCGGGCTTCT CGCCGCCTCG CTTGCCAACC ACTTTTCCCc 801 gtCCGTGCGC CATTCCGTCC GCCTGCcgat gacggtttGC gtcgGcggCA 851 TCCTCTTGgt cggCggacaA ACCGTATTCG AACACTTCTT GGGCATGAag 901 gCggTATTAA GCGTGGTGGt cgAATTTGCG ggcggactcG TTTTCCTCTA

951 TCTCGTTTTA AAACACAAAA AATGA
```

This corresponds to the amino acid sequence <SEQ ID 1980; ORF 619.a>:

```
g619.pep
  1 MPSEKNIGFM AGSSRPLRVA FALLLVSCIL FMTLNVKGDW DFVLHLRLTK

51 LAALLMVAYA VGVSTQLFQT LTNNPILTPS ILGFDSLYVF LQTLLVFTFG

101 GVGYTSLPLT GKFGFELVVM MGGSLLLFYT LIRQGGRDLP HMILIGVIFG
```

-continued

```
151 ILFRSLSSLL SRMIDPEEFT AAQANMFAGF NTVRSELLGI GALVLLVSAA

201 VVWHERYRSD VHLLGRDQAV NLGISYTRNT LWILLWIAAL VATATAVVGP

251 VSFFGLLAAS LANHFSPSVR HSVRLPMTVC VGGILLVGGQ TVFEHFLGMK

301 AVLSVVVEFA GGLVFLYLVL KHKK*
```

The following partial DNA sequence was identified in *N. meningitidis* <SEQ ID 1981>:

```
m619.seq
   1 ATGCCGTCTG AAAAAAATAT CGGTTTTATG GCAGGAAGCA GCCGCCCGTT

51 GTGGGTCGCC TTTGCGCTGT TGCTGGTTTC CTGCGTCCTG TTTATGACGC

101 TCAACGTCAA AGGCGATTGG GATTTTGTTT TGCAACTGCG GCTGACCAAA

151 CTTGCCGCGC TGCTGATGGT CGCCTATGCG GTCGGCGTGT CCACGCAACT

201 CTTCCAAACG CTGACCAATA ATCCGATTCT GACCCCTTCA ATTTTGGGTT

251 TCGATTCGCT GTATGTGTTT TTGCAGACCT TGCTGGTGTT TACGTTCGGC

301 GGCGTGGGCT ATGCTTCCCT GCCGTTGACG GGCAAATTCG GCTTTGAACT

351 GGTCGTCATG ATGGGCGGCT CGCTGCTGCT GTTCTACACG CTCATCAAAC

401 AGGGCGGACG CGATTTGTCG CGCATGATTT TAATCGGCGT GATTTTCGGG

451 ATTTTGTTCC GCAGCCTGTC GTCGCTGCTT TCGCGCATGA TCGATCCCGA

501 AGAATTTACC GCCGCGCAGG CGAATATGTT TGCCGGATTC AATACCGTCC

551 ACAGCGAGCT TTTGGGCATA GGCGCGCTGA TTCTGCTCGT CAGCGCGGCG

601 GTCGTTTGGC GCGAACGCTA CCGCTTGGAC GTTTACCTTT TGGGGCGTGA

651 CCAAGCCGTC AATTTGGGCA TCAGCTACAC GCGCAACACC TTATGGATAC

701 TGCTTTGGAT TGCCGCATTG GTGGCGACGG CGACCGCCGT GGTCGGCCCC

751 GTAAGCTTTT TCGGGCTTCT CGCCGCCTCG CTTGCCAACC ACTTTTCCCC

801 GTCGGTCAAA CATTCCGTCC GCCTGCCGAT GACGGTTTGT ATCGGCGGCA

851 TCCTCTTGGT CGGCGGACAG ACCGTGTTCG AACACCTGCT CGGTATGCAG

901 GCAGTGTTGA GCGTAGTAGT AGAATTTGCC GGCGGACTCG TTTTCCTCTA

951 TCTCGTTTTA AAACACAAAA AATGA
```

This corresponds to the amino acid sequence <SEQ ID 1982; ORF 619>:

```
m619.pep
   1 MPSEKNIGFM AGSSRPLWVA FALLLVSCVL FMTLNVKGDW DRVLQLRLTK

51 LAALLMVAYA VGVSTQLFQT LTNNPILTPS ILGRDSLYVF LQTLLVFTFG

101 GVGYASLPLT GKFGFELVVM MGGSLLLFYT LIKQGGRDLS RMILIGVIFG

151 ILFRSLSSLL SRMIDPEEFT AAQANMFAGF NTVHSELLGI GALILLVSAA

201 VVWRERYRLD VYLLGRDQAV NLGISYTRNT LWILLWIAAL VATATAVVGP

251 VSFFGLLAAS LANHFSPSVK HSVRLPMTVC IGGILLVGGQ TVFEHLLGMQ

301 AVLSVVVEFA GGLVFLYLVL KHKK*
```

-continued

```
m619/g619  95.1% identity in 324 aa overlap 10        20        30        40        50        60
m619.pep    MPSEKNIGFMAGSSRPLWVAFALLLVSCVLFMTLNVKGDWDFVLQLRLTKLAALLMVAYA
            ||||||||||||||||| |||||||:||||||||||||||||||:|||||||||||||||
g619        MPSEKNIGFMAGSSRPLRVAFALLLVSCILFMTLNVKGDWDFVLHLRLTKLAALLMVAYA
                    10        20        30        40        50        60

70        80        90       100       110       120
m619.pep    VGVSTQLFQTLTNNPILTPSILGFDSLYVFLQTLLVFTFGGVGYASLPLTGKFGRELVVM
            ||||||||||||||||||||||||||||||||||||||||||||:|||||||||||||||
g619        VGVSTQLFQTLTNNPILTPSILGRDSLYVFLQTLLVFTFGGVGYTSLPLTGKFGRELVVM
                    70        80        90       100       110       120

130       140       150       160       170       180
m619.pep   MGGSLLLFYTLIKQGGRDLSRMILIGVIFGILFRSLSSLLSRMIDPEEFTAAQANMFAGF
           ||||||||||||:|||||| :|||||||||||||||||||||||||||||||||||||||
g619       MGGSLLLFYTLIRQGGRDLPHMILIGVIFGILFRSLSSLLSRMIDPEEFTAAQANMFAGR
                  130       140       150       160       170       180

190       200       210       220       230       240
m619.pep   NTVHSELLGIGALILLVSAAVVWRERYRLDVYLLGRDQAVNLGISYTRNTLWILLWIAAL
           |||:|||||||||:|||||||||:|||| ||:||||||||||||||||||||||||||||
g619       NTVRSELLGIFALVLLVSAAVVWHERYRSDVHLLGRDQAVNLGISYTRNTLWILLWIAAL
                  190       200       210       220       230       240

250       260       270       280       290       300
m619.pep   VATATAVVGPVSFFGLLAASLANHFSPSVKHSVRLPMTVCIGGILLVGGQTVFEHLLGMQ
           |||||||||||||||||||||||||||||:||||||||||:||||||||||||||:|||:
g619       VATATAVVGPVSFFGLLAASLANHFSPSVRHSVRLPMTVCVGGILLVGGQTVFEHFLGMK
                  250       260       270       280       290       300

310       320
m619.pep   AVLSVVVEFAGGLVFLYLVLKHKKX
           ||||||||||||||||||||||||
g619       AVLSVVVEFAGGLVFLYLVLKHKKX
                  310       320
```

The following partial DNA sequence was identified in *N. meningitidis* <SEQ ID 1983>:

```
a619.seq
  1 ATGCCGTCTG AAAAAAATAT CGGTTTTATG GCAGGAAGCA GCCGTCCGTT

51 GTGGGTTGCC TTTGCGCTGT TGCTGGTTTC CTGCATCCTG TTTATGACGC

101 TCAACGTCAA AGGCGATTGG GATTTTGTTT TGCACCTGCG CCTGACCAAG

151 CTTGCCGCGC TGCTGATGGT CGCCTATGCG GTCGGCGTTT CGACCCAGCT

201 TTTTCAAACG CTGACCAACA ATCCGATTCT GACCCCTTCG ATTTTGGGTT

251 TCGATTCGCT GTATGTGTTT TTGCAGACCT TGCTGGTGTT TACGTTCGGC

301 GGCGTGGGCT ATGCTTCCCT GCCGTTGACG GGCAAATTCG GCTTTGAACT

351 GGTCGTTATG ATGGGCGGCT CGCTGCTGCT GTTTTACACG CTCATCAAAC

401 AGGGCGGGCG CGATTTGCCG CGTATGATTT TAATCGGCGT GATTTTCGGG

451 ATTTTGTTCC GCAGCCTGTC GTCGCTGCTT TCGCGCATGA TCGACCCCGA

501 AGAATTTACG GCGGCGCAGG CGAATATGTT TGCCGGATTC AATACCGTCC

551 ACAGCGAGCT TTTAGGCATA GGCGCGCTGA TTCTGCTCGT CAGCGCGGCG

601 GTCGTTTGGC GCGAACGCTA CCGCTTGGAC GTACACCTTT TGGGGCGCGA

651 CCAAGCCATA AATTTGGGCA TCAGCTACAC GCGCAACACC TTATGGATAC

701 TGCTTTGGAT TGCCGCGCTG GTGGCGACGG CGACCGCCGT TGTCGGCCCG

751 GTAAGCTTTT TCGGGCTTCT CGCCGCCTCG CTTGCCAACC ACTTTTCCCC

801 GTCGGTCAAA CATTCCGTCC GCCTGCCGAT GACGGTTTGT GTCGGCGGCA

851 TCCTCTTGGT CGGCGGACAG ACCGTATTCG AACACTTCTT GGGCATGAAG

901 GCGGTATTAA GCGTGGTGGT CGAATTTGCG GGCGGACTCG TTTTCCTCTA

951 TCTCGTTTTA AGACACAAAA AATGA
```

This corresponds to the amino acid sequence <SEQ ID 1984; ORF 619.a>:

```
a619.pep

1  MPSEKNIGFM AGSSRPLWVA FALLLVSCIL FMTLNVKGDW DFVLGLRLTK

51  LAALLMVAYA VGSVTQLFQT LTNNPILTPS ILGFDSLYVF LQTLLVFTFG

101  GVGYASLPLT GKFGFELVVM MGGSLLLFYT LIKQGGRDLP RMILIGVIFG

151  ILFRSLSSLL SRMIDPEEFT AAQANMFAGF NTVHSELLGI GALILLVSAA

201  VVWRERYRLD VHLLGRDQAI NLGISYTRNT LWILLWIAAL VATATAVVGP

251  VSFFGLLAAS LANHFSPSVK HSVRLPMTVC VGGILLVGGQ TVFEHFLGMK

301  AVLSVVVEFA GGLVFLYLVL RHKK* m619/a619  97.2% identity in 324 aa overlap 10         20         30         40         50         60
m619.pep   MPSEKNIGFMAGSSRPLWVAFALLLVSCVLFMTLNVKGDWDFVLQLRLTKLAALLMVAYA
           ||||||||||||||||||||||||||||:||||||||||||||||:||||||||||||||
a619       MPSEKNIGFMAGSSRPLWVAFALLLVSCILFMTLNVKGDWDFVLHLRLTKLAALLMVAYA
                  10         20         30         40         50         60

70         80         90        100        110        120
m619.pep   VGVSTQLFQTLTNNPILTPSILGFDSLYVFLQTLLVFTFGGVGYASLPLTGKFGFELVVM
           ||||||||||||||||||||| ||||||||||||||||||||||||||||||||||||||
a619       VGVSTQLFQTLTNNPILTPSILGRDSLYVFLQTLLVFTFGGVGYASLPLTGKFGFELVVM
                  70         80         90        100        110        120

130        140        150        160        170        180
m619.pep   MGGSLLLFYTLIKQGGRDLSRMILIGVIFGILFRSLSSLSRMIDPEEFTAAQANMFAGF
           ||||||||||||||||||||  ||||||||||||||||||||||||||||||||||||||
a619       MGGSLLLFYTLIKQGGRDLPRMILIGVIFGILFRSLSSLLSRMIDPEEFTAAQANMFAGF
                 130        140        150        160        170        180

190        200        210        220        230        240
m619.pep   NTVHSELLGIGALILLVSAAVVWRERYRLDVYLLGRDQAVNLGISYTRNTLWILLWIAAL
           ||||||||||||||||||||||||||||||:||||||:||||||||||||||||||||||
a619       NTVHSELLGIGALILLVSAAVVWRERYRLDVHLLGRDQAINLGISYTRNTLWILLWIAAL
                 190        200        210        220        230        240

250        260        270        280        290        300
m619.pep   VATATAVVGPVSFFGLLAASLANHFSPSVKHSVRLPMTVCIGGILLVGGQTVFEHLLGMQ
           |||||||||||||||||||||||||||||||||||||||:|||||||||||||||:|||:
a619       VATATAVVGPVSFFGLLAASLANHFSPSVKHSVRLPMTVCVGGILLVGGQTVFEHFLGMK
                 250        260        270        280        290        300

310        320
m619.pep   AVLSVVVEFAGGLVFLYLVLKHKKX
           |||||||||||||||||||||:|||
a619       AVLSVVVEFAGGLVFLYLVLRHKKX
                 310        320
```

The following partial DNA sequence was identified in *N. gonorrhoeae* <SEQ ID 1985>:

```
g620.seq
   1 ATGAAGAAAA CCCTGTTGGc AATTGTTGCC gtTTTCGCCT TAAGTGCCTG

51 CCGGCaggcg gaAGaggcac cgccgCCTTT ACCCCGGCAG AtTAGCGacc 101 gttcggtcgg aCACTAttgC Agtatgaacc tgaccgaaca caacggcccc 151 aaagcccaga tttttttgaa cGGCAAACCC GATCAGCCCG TTTGGTTCTC 201 CACCGTcaag cagatgttcg GCTATACCAA GCTGCCCGAA GAGCCCAAAG

251 GCATCCGCGT GATTTACGTT ACCGATATGG GCAATGTTAC CGATTGGACG

301 AATCCTAATG CCGACACGGA GTGGATAGAT GCGAAAAAAG CCTTTTACGT

351 CATCGACAGC GGCTTTATCG GCGGTATGGG CGCGGAAGAC GCGCTGCCGT

401 TCGGCAACAA GGAGCAGGCT GAAAAATTTG CAAAGGATAA AGGCGGCAAG

451 GTCGTCGGTT TTGACGATAT GCCCGATGCT TACATTTTCA AGTAA
```

This corresponds to the amino acid sequence <SEQ ID 1986; ORF 620.ng>:

```
g620.pep
  1 MKKTLLAIVA VFALSACRQA EEAPPPLPRQ ISDRSVGHYC SMNLTEHNGP

51 KAQIFLNGKP DQPVWFSTVK QMFGYTKLPE EPKGIRVIYV TDMGNVTDWT

101 NPNADTEWID AKKAFYVIDS GFIGGMGAED ALPFGNKEQA EKFAKDKGGK

151 VVGFDDMPDA YIFK*
```

The following partial DNA sequence was identified in *N. meningitidis* <SEQ ID 1987>:

```
m620.seq
  1 ATGAAAAAAA CCCTGTTGGC AATTGTTGCC GTTTCCGCCT TAAGTGCCTG

51 CCGGCAGGCG GAAGAGGGAC CGCCGCCTTT ACCCCGGCAG ATTAGCGACC

101 GTTCGGTCGG ACACTATTGC AGTATGAACC TGACCGAACA CAACGGCCCC

151 AAAGCCCAGA TTTTCTTGAA CGGCAAACCC GATCAGCCCG TTTGGTTCTC

201 CACCATCAAG CAGATGTTCG GCTATACCAA GCTGCCCGAA GAGCCTAAAG

251 GCATCCGCGT GATTTACGTT ACCGATATGG GCAATGTTAC CGATTGGACG

301 AATCCCAATG CCGACACGGA GTGGATGGAT GCGAAAAAAG CCTTTTACGT

351 CATCGACAGC GGCTTTATCG GCGGTATGGG TGCGGAAGAC GCGCTGCCGT

401 TCGGCAACAA AGAGCAGGCT GAGAAATTTG CAAAGGATAA AGGCGGTAAG

451 GTTGTCGGTT TCGACGATAT GCCTGATACC TATATTTTCA AATAA
```

This corresponds to the amino acid sequence <SEQ ID 1088; ORF 670>:

```
m620.pep
      1 MKKTLLAIVA VSALSACRQA EEGPPPLPRQ ISDRSVGHYC SMNLTEHNGP

51 KAQIFLNGKP DQPVWFSTIK QMFGYTKLPE EPKGIRVIYV TDMGNVTDWT

101 NPNADTEWMD AKKAFYVIDS GFIGGMGAED ALPFGNKEQA EKFAKDKGGK

151 VVGFDDMPDT YIFK* m620/g620  97.0% identity in 164 aa overlap 10         20         30         40         50         60
   m620.pep  MKKTLLAIVAVSALSACRQAEEGPPPLPRQISDRSVGHYCSMNLTEHNGPKAQIFLNGKP
             ||||||||||  ||||||||| :|||||||||||||||||||||||||||||||||||||
   g620      MKKTLLAIVAVFALSACRQAEEAPPPLPRQISDRSVGHYCSMNLTEHNGPKAQIFLNGKP
                  10         20         30         40         50         60

70         80         90        100        110        120
   m620.pep  DQPVWFSTIKQMFGYTKLPEEPKGIRVIYVTDMGNVTDWTNPNADTEWMDAKKAFYVIDS
             ||||||||:|||||||||||||||||||||||||||||||||||||||:|||||||||||
   g620      DQPVWFSTVKQMFGYTKLPEEPKGIRVIYVTDMGNVTDWTNPNADTEWIDAKKAFYVIDS
                  70         80         90        100        110        120

130        140        150        160
   m620.pep  GRIFFMGAEDALPFGNKEQAEKFAKDKGGKVVGFDDMPDTYIFKX
             |||||||||||||||||||||||||||||||||||||:||||
   g620      GFIGGMGAEDALPFGNKEQAEKFAKDKGGKVVGFDDMPDAYIFKX
                  130        140        150        160
```

The following partial DNA sequence was identified in *N. meningitidis* <SEQ ID 1989>:

```
a620.seq
  1 ATGAAAAAAA CCCTGTTGGC AATTGTTGCC GTTTCCGCCT TAAGTGCCTG

51 CCGGCAGGCG GAAGAGGGAC CGCCGCCTTT ACCCCGGCAG ATTAGCGACC
```

```
101 GTTCGGTCGG ACACTATTGC AGTATGAACC TGACCGAACA CAACGGCCCC

151 AAAGCCCAGA TTTTCTTGAA CGGCAAACCC GATCAGCCCG TTTGGTTCTC

201 CACCATCAAG CAGATGTTCG GCTATACCAA GCTGCCCGAA GAGCCTAAAG

251 GCATCCGCGT GATTTACGTT ACCGATATGG GCAATGTTAC CGATTGGACG

301 AATCCCAATG CCGACACGGA GTGGATGGAT GCGAAAAAAG CCTTTTACGT

351 CATCGACAGC GGCTTTATCG GCGGTATGGG TGCGGAAGAC GCGCTGCCGT

401 TCGGCAACAA AGAGCAGGCT GAGAAATTTG CAAAGGATAA AGGCGGTAAG

451 GTTGTCGGTT TCGACGATAT GCCTGATACC TATATTTTCA AATAA
```

This corresponds to the amino acid sequence <SEQ ID 1990; *ORF* 620.a>:

```
a620.pep
    1 MKKTLLAIVA VSALSACRQA EEGPPPLPRQ ISDRSVGHYC SMNLTEHNGP

51 KAQIFLNGKP DQPVWFSTIK QMFGYTKLPE EPKGIRVIYV TDMGNVTDWT

101 NPNADTEWMD AKKAFYVIDS GFIGGMGAED ALPFGNKEQA EKFAKDKGGK

151 VVGFDDMPDT YIFK* m620/a620 100.0% identity in 164 aa overlap 10         20         30         40         50         60
m620.pep    MKKTLLAIVAVSALSACRQAEEGPPPLPRQISDRSVGHYCSMNLTEHNGPKAQIFLNGKP
            ||||||||||||||||||||||||||||||||||||||||||||||||||||||||||||
a620        MKKTLLAIVAVSALSACRQAEEGPPPLPRQISDRSVGHYCSMNLTEHNGPKAQIFLNGKP
                10         20         30         40         50         60

70         80         90        100        110        120
m620.pep    DQPVWFSTIKQMFGYTKLPEEPKGIRVIYVTDMGNVTDWTNPNADTEWMDAKKAFYVIDS
            ||||||||||||||||||||||||||||||||||||||||||||||||||||||||||||
a620        DQPVWFSTIKQMFGYTKLPEEPKGIRVIYVTDMGNVTDWTNPNADTEWMDAKKAFYVIDS
                70         80         90        100        110        120

130        140        150        160
m620.pep    GFIGGMGAEDALPFGNKEQAEKFAKDKGGKVVGFDDMPDTYIFKX
            |||||||||||||||||||||||||||||||||||||||||||||
a620        GFIGGMGAEDALPFGNKEQAEKFAKDKGGKVVGFDDMPDTYIFKX
               130        140        150        160
```

The following partial DNA sequence was identified in *N. gonorrhoeae* <SEQ ID 1991>:

```
g622.seq
    1 ATGCAactta ccgctgtcgg ACTCAATCAT CAAACCGCAC CTTTAAGCAT

51 ACGGGAAAag ctggCGTTTG CCGCCGCCGC CCTGCCAGAA gccgTccgCA

101 ATCTTGCCCG AAGCAATGCG GCAACGGAGG CGGTAATCCT TTCTACCTGC

151 AACCGCACCG AGCTTTACTG CGTCGGCGAT TCGGAAgaaa TCATCCGATG

201 GCTTGCCGAT TACCACAGTT TGCCGATTGA AGAAATCCGT CCGTATCTGT

251 ACACGCTGGA TATGCAGGAA ACCGTGCGCC ACGCCTTCCG CGTTGCCTGC

301 GGCTTGGATT CGATGGTTTT GGGCGAGCCG CAGATTTTGG GGCAGATTAA

351 AGATGCGGTG CGTGCGGCTC AAGAACAGGA AGTATGGGG CAAAACTCA

401 ATGCCCTGTT CCAAAAAACC TTTTCCGTTG CTAAAGAAGT CCGTACCGAT

451 ACCGCTGTCG GCGAAAATTC GGTTTCGATG GCTTCCGCGT CCGTCAAGTT
```

-continued

```
 501 GGCGGAACAG ATTTTTCCCG ACATCGGCGA TTTGAACGTA TTGTTTATCG

551 GCGCAGGCGA AATGATTGAG CTGGTTGCCA CTTATTTTGC CGCCAAAAAT

601 CCCCGGCTGA TGACGGTTGC CAACCGGACG CTGGCGCGTG CACAGGAGTT

651 GTGCGACAAG CTCGGTGTTA ACGCCGAACC GTGCCTGCTG TCCGATCTGC

701 CTGCCATTCT GCACGATTAC GACGTGGTGG TTTCTTCAAC GGCGAGCCAG

751 CTTCCGATAG TCGGCAAAGG CATGGTCGAA CGCGCATTGA AACAGCGTCA

801 GAGTATGCCG TTGTTCATGC TTGACTTGGC CGTGCCGCGC GATATTGAAG

851 CGGAAGTCGG CGATTTGAAC GATGCGTATC TTTATACGGT GGACGATATG

901 GTCAACATCG TCCAAAGCGg caaggaggca aggcagaaag ccgccgcCgc 951 cgccgaaacg ctggTGTCCG AAAAGGTTGC CGAATTTGTC AGGCAGCAGC 1001 AGGGCAGGCA GagcgttcCG CTGATTAAGG CCTTGCGGGA CGAGGGCGAG

1051 AAAGCGCGCA AGCAGGTGTT GGAAAATGCG ATGAAACAGC TTGCCAAAGG

1101 CGcaaCGGCG GAAGaggttt TGgaacggct gtccgtcCAA CTGACCAACA

1151 AGCTGCTGCA TTCGCCAACT CAAACCTTGA ATAAGGCGGG GGAAGAAGAT

1201 AAAGatttGG TTCATGCCgt cGCGCAGATt tatcatttGG ACAAATAA
```

This corresponds to the amino acid sequence <SEQ ID 1992; ORF 622.ng>:

```
g622.pep
   1 MQLTAVGLNH QTAPLSIREK LAFAAAALPE AVRNLARSNA ATEAVILSTC

51 NRTELYCVGD SEEIIRWLAD YHSLPIEEIR PYLYTLDMQE TVRHAFRVAC

101 GLDSMVLGEP QILGQIKDAV RAAQEQESMG AKLNALFQKT FSVAKEVRTD

151 TAVGENSVSM ASASVKLAEQ IFPDIGDLNV LFIGAGEMIE LVATYFAAKN

201 PRLMTVANRT LARAQELCDK LGVNAEPCLL SDLPAILHDY DVVVSSTASQ

251 LPIVGKGMVE RALKQRQSMP LFMLDLAVPR DIEAEVGDLN DAYLYTVDDM

301 VNIVQSGKEA RQKAAAAAET LVSEKVAEFV RQQQGRQSVP LIKALRDEGE

351 KARKQVLENA MKQLAKGATA EEVLERLSVQ LTNKLLHSPT QTLNKAGEED

401 KDLVHAVAQI YHLDK*
```

The following partial DNA sequence was identified in *N. meningitidis* <SEQ ID 1993>:

```
m622.seq
   1 ATGCAACTTA CCGCTGTCGG ACTCAATCAT CAAACCGCAC CTTTAAGCAT

51 ACGGGAAAAG CTGGCGTTTG CCGCCGCCGC CCTGCCTAAA GCCGTCCGCA

101 ATCTTGCCCG AAGCAATGCG GCAACGGAGG CGGTAATCCT TTCTACCTGC

151 AACCGCACCG AGCTTTACTG CGTCGGTGAT TCGGAAGAAA TCATCCGATG

201 GCTTGCCGAT TACCACAGTT TGCCGATTGA AGAAATCCGT CCGTATCTGT

251 ACGCGCTGGA TATGCAGGAG ACTGTGCGCC ATGCTTTCCG CGTCGCCTGC

301 GGGCTGGATT CGATGGTGTT GGGCGAGCCG CAGATTTTAG GACAGATTAA

351 GGATGCCGTT AGGGTTGCTC AAGAGCAGGA AAGTATGGGT AAGAAACTCA

401 ATGCCCTGTT CCAAAAAACC TTTTCCGTTG CTAAAGAGGT CCGTACCGAT

451 ACTGCCGTCG GCGAAAACTC GGTTTCCATG GCTTCCGCTT CCGTCAAATT
```

-continued

```
 501 GGCGGAACAG ATTTTTCCCG ACATCGGCGA TTTGAATGTC TTGTTTATCG

551 GCGCAGGCGA AATGATTGAG CTGGTTGCCA CTTATTTTGC CGCCAAAAGT

601 CCCCGGCTGA TGACGGTTGC CAACCGGACG CTGGCGCGTG CACAGGAGTT

651 GTGCGACAAG CTCGGTGTCA ACGCCGAACC GTGCCTGCTG TCCGATCTGC

701 CTGCCATTCT GCACGATTAC GACGTAGTGG TTTCTTCAAC GGCAAGCCAG

751 TTGCCCATTG TCGGCAAAGG CATGGTGGAG CGTGCATTGA AACAAAGGCA

801 GAGTATGCCG TTGTTCATGC TTGATTTGGC AGTGCCGCGT GACATTGAAG

851 CGGAAGTCGG CGATTTGAAT GATGCCTATC TTTATACGGT GGACGATATG

901 GTCAATATCG TCCAAAGCGG CAAGGAGGCA AGGCAGAAGG CCGCCGCCGC

951 CGCCGAAACG CTGGTGTCCG AGAAAGTTGC CGAATTTGTC AGGCAGCAGC

1001 AGGGCAGGCA GAGTGTCCCC TTGATTAAGG CGTTGCGGGA CGAGGGCGAG

1051 AAAGCGCGCA AACAGGTGTT GGAAAATGCC ATGAAACAGC TTGCCAAAGG

1101 CGCAACGGCA GAAGAGGTTT TGGAACGGCT GTCCGTCCAA CTGACCAACA

1151 AGCTGCTGCA TTCGCCGACC CAAACCTTGA ATAAGGCGGG GGAAGAAGAT

1201 AAAGATTTGG TTCATGCCGT CGCGCAGATT TATCATTTGG ACAAATAA
```

This corresponds to the amino acid sequence <SEQ ID 1994; ORF 622>:

```
m622.pep

1 MQLTAVGLNH QTAPLSIREK LAFAAAALPK AVRNLARSNA ATEAVILSTC

51 NRTELYCVGD SEEIIRWLAD YHSLPIEEIR PYLYALDMQE TVRHAFRVAC

101 GLDSMVLGEP QILGQIKDAV RVAQEQESMG KKLNALFQKT FSVAKEVRTD

151 TAVGENSVSM ASASVKLAEQ IFPDIGDLNV LFIGAGEMIE LVATYFAAKS

201 PRLMTVANRT LARAQELCDK LGVNAEPCLL SDLPAILHDY DVVVSSTASQ

251 LPIVGKGMVE RALKQRQSMP LFMLDLAVPR DIEAEVGDLN DAYLYTVDDM

301 VNIVQSGKEA RQKAAAAAET LVSEKVAEFV RQQQGRQSVP LIKALRDEGE

351 KARKQVLENA MKQLAKGATA EEVLERLSVQ LTNKLLHSPT QTLNKAGEED

401 KDLVHAVAQI YHLDK* m622/g622 98.8% identity in 415 aa overlap
                   10         20         30         40         50         60
      m622.pep  MQLTAVGLNHQTAPLSIREKLAFAAAALPKAVRNLARSNAATEAVILSTCNRTELYCVGD
                ||||||||||||||||||||||||||||||:|||||||||||||||||||||||||||||
          g622  MQLTAVGLNHQTAPLSIREKLAFAAAALPEAVRNLARSNAATEAVILSTCNRTELYCVGD
                   10         20         30         40         50         60

70         80         90        100        110        120
      m622.pep  SEEIIRWLADYHSLPIEEIRPYLYALDMQETVRHAFRVACGLDSMVLGEPQILGQIKDAV
                ||||||||||||||||||||||||:|||||||||||||||||||||||||||||||||||
          g622  SEEIIRWLADYHSLPIEEIRPYLYTLDMQETVRHAFRVACGLDSMVLGEPQILGQIKDAV
                   70         80         90        100        110        120

130        140        150        160        170        180
      m622.pep  RVAQEQESMGKKLNALFQKTFSVAKEVRTDTAVGENSVSMASASVKLAEQIFPDIGDLNV
                |:||||||||||||||||||||||||||||||||||||||||||||||||||||||||||
          g622  RAAQEQESMGAKLNALFQKTFSVAKEVRTDTAVGENSVSMASASVKLAEQIFPDIGDLNV
                  130        140        150        160        170        180

190        200        210        220        230        240
      m622.pep  LFIGAGEMIELVATYFAAKSPRLMTVANRTLARAQELCDKLGVNAEPCLLSDLPAILHDY
                ||||||||||||||||||||:|||||||||||||||||||||||||||||||||||||||
          g622  LFIGAGEMIELVATYFAAKNPRLMTVANRTLARAQELCDKLGVNAEPCLLSDLPAILHDY
                  190        200        210        220        230        240
```

-continued

```
                250        260        270        280        290        300
m622.pep  DVVVSSTASQLPIVGKGMVERALKQRQSMPLFMLDLAVPRDIEAEVGDLNDAYLYTVDDM
          ||||||||||||||||||||||||||||||||||||||||||||||||||||||||||||
g622      DVVVSSTASQLPIVGKGMVERALKQRQSMPLFMLDLAVPRDIEAEVGDLNDAYLYTVDDM
                250        260        270        280        290        300

310        320        330        340        350        360
m622.pep  VNIVQSGKEARQKAAAAAETLVSEKVAEFVRQQQGRQSVPLIKALRDEGEKARKQVLENA
          ||||||||||||||||||||||||||||||||||||||||||||||||||||||||||||
g622      VNIVQSGKEARQKAAAAAETLVSEKVAEFVRQQQGRQSVPLIKALRDEGEKARKQVLENA
                310        320        330        340        350        360

370        380        390        400        410
m622.pep  MKQLAKGATAEEVLERLSVQLTNKLLHSPTQTLNKAGEEDKDLVHAVAQIYHLDKX
          ||||||||||||||||||||||||||||||||||||||||||||||||||||||||
g622      MKQLAKGATAEEVLERLSVQLTNKLLHSPTQTLNKAGEEDKDLVHAVAQIYHLDKX
                370        380        390        400        410
```

The following partial DNA sequence was identified in *N. meningitidis* <SEQ ID 1995>:

```
a622.seq
     1 ATGCAACTTA CCGCTGTCGG ACTCAATCAT CAAACCGCAC CTTTAAGCAT
    51 ACGGGAAAAG CTGGCGTTTG CCGCGGCCTG CCTGCCCGAA GCCGTCCGCA
   101 ATCTTGCCCG AAGCAATGCG GCAACGGAGG CGGTAATCCT TTCTACCTGC
   151 AACCGTACCG AGCTTTACTG TGTAGGTGAT TCGGAAGAAA TCATCCGTTG
   201 GCTCGCAGAC TATCACAGCC TTCCCATAGA AGAAATCAGC CCCTACCTTT
   251 ATACTTTGGG GATGCAGGAG ACTGTGCGCC ATGCTTTCCG CGTCGCCTGC
   301 GGCTTGGATT CGATGGTGTT GGGCGAGCCG CAGATTTTAG GACAGATTAA
   351 GGATGCGGTC AGGGTTGCTC AAGAGCAGGA AAGTATGGGT AAGAAACTCA
   401 ATGCCCTGTT CCAAAAAACC TTTTCTGTTG CTAAAGAGGT CCGTACCGAT
   451 ACTGCCGTCG GCGAAAACTC GGTTTCCATG GCTTCCGCTT CCGTCAAGTT
   501 GGCAGAGCAG ATTTTCCCCG ACATCGGCGA TTTGAATGTC TTGTTTATCG
   551 GTGCGGGTGA GATGATTGAG CTGGTTGCCA CTTATTTTGC CGCCAAAAGT
   601 CCCCGGCTGA TGACGGTTGC CAACCGGACG CTGGCGCGTG CACAGGAGTT
   651 GTGCGACAAG CTCGGTGTCA ACGCCGAACC GTGCCTGCTG TCCGATCTGC
   701 CTGCCATTTT GCATGAGTAC GACGTGGTGG TTTCTTCAAC GGCAAGCCAG
   751 TTGCCCATTG TCGGCAAAGG TATGGTGGAG CGCGCATTGA AACAAAGGCA
   801 GAGTATGCCG TTGTTTATGC TTGACTTGGC CGTGCCGCGA GACATTGAGG
   851 CGGAAGTCGG AGATTTGAAC GATGCCTATC TTTATACGGT GGACGATATG
   901 GTCAATATCG TCCAAAGCGG CAAGGAGGCA AGGCAGAAGG CCGCCGCCGC
   951 CGCCGAAACG CTGGTGTCCG AGAAGGTTGC CGAATTTGTC AGGCAGCAGC
  1001 AGGGCAGGCA GAGTGTCCCG TTAATCAGGG CATTGAGGGA TGAGGGAGAG
  1051 AAAGCGCGCA AACAGGTCTT GGAAAATGCG ATGAAACAGC TTGCCAAAGG
  1101 CGCAACGGCA GAAGAGGTTT TGGAAAGGCT GTCGATCCAA CTGACCAACA
  1151 AGCTGCTGCA TTCGCCGACC CAAACCTTGA ATAAGGCGGG GGAAGAAGAT
  1201 AAAGATTTGG TTCACGCCGT CGCGCAGATT TATCATTTGG ACAAATAA
```

This corresponds to the amino acid sequence <SEQ ID 1996; ORF 622.a>:

```
a622.pep

1 MQLTAVGLNH QTAPLSIREK LAFAAACLPE AVRNLARSNA ATEAVILSTC

51 NRTELYCVGD SEEIIRWLAD YHSLPIEEIS PYLYTLGMQE TVRHAFRVAC

101 GLDSMVLGEP QILGQIKDAV RVAQEQESMG KKLNALFQKT FSVAKEVRTD

151 TAVGENSVSM ASASVKLAEQ IFPDIGDLNV LFIGAGEMIE LVATYFAAKS

201 PRLMTVANRT LARAQELCDK LGVNAEPCLL SDLPAILHEY DVVVSSTASQ

251 LPIVGKGMVE RALKQRQSMP LFMLDLAVPR DIEAEVGDLN DAYLYTVDDM

301 VNIVQSGKEA RQKAAAAAET LVSEKVAEFV RQQQGRQSVP LIRALRDEGE

351 KARKQVLENA MKQLAKGATA EEVLERLSIQ LTNKLLHSPT QTLNKAGEED

401 KDLVHAVAQI YHLDK* m622/a622 98.1% identity in 415 aa overlap 10         20         30         40         50         60
m622.pep   MQLTAVGLNHQTAPLSIREKLAFAAAALPKAVRNLARSNAATEAVILSTCNRTELYCVGD
           ||||||||||||||||||||||||||| ||:|||||||||||||||||||||||||||||
a622       MQLTAVGLNHQTAPLSIREKLAFAAACLPEAVRNLARSNAATEAVILSTCNRTELYCVGD
                 10         20         30         40         50         60

70         80         90        100        110        120
m622.pep   SEEIIRWLADYHSLPIEEIRPYLYALDMQETVRHAFRVACGLDSMVLGEPQILGQIKDAV
           ||||||||||||||||||||    :|  ||||||||||||||||||||||||||||||||
a622       SEEIIRWLADYHSLPIEEISPYLYTLGMQETVRHAFRVACGLDSMVLGEPQILGQIKDAV
                 70         80         90        100        110        120

130        140        150        160        170        180
m622.pep   RVAQEQESMGKKLNALFQKTFSVAKEVRTDTAVGENSVSMASASVKLAEQIFPDIGDLNV
           ||||||||||||||||||||||||||||||||||||||||||||||||||||||||||||
a622       RVAQEQESMGKKLNALFQKTFSVAKEVRTDTAVGENSVSMASASVKLAEQIFPDIGDLNV
                130        140        150        160        170        180

190        200        210        220        230        240
m622.pep   LFIGAGEMIELVATYFAAKSPRLMTVANRTLARAQELCDKLGVNAEPCLLSDLPAILHDY
           |||||||||||||||||||||||||||||||||||||||||||||||||||||||||| :|
a622       LFIGAGEMIELVATYFAAKSPRLMTVANRTLARAQELCDKLGVNAEPCLLSDLPAILHEY
                190        200        210        220        230        240

250        260        270        280        290        300
m622.pep   DVVVSSTASQLPIVGKGMVERALKQRQSMPLFMLDLAVPRDIEAEVGDLNDAYLYTVDDM
           ||||||||||||||||||||||||||||||||||||||||||||||||||||||||||||
a622       DVVVSSTASQLPIVGKGMVERALKQRQSMPLFMLDLAVPRDIEAEVGDLNDAYLYTVDDM
                250        260        270        280        290        300

310        320        330        340        350        360
m622.pep   VNIVQSGKEARQKAAAAAETLVSEKVAEFVRQQQGRQSVPLIKALRDEGEKARKQVLENA
           ||||||||||||||||||||||||||||||||||||||||||:|||||||||||||||||
a622       VNIVQSGKEARQKAAAAAETLVSEKVAEFVRQQQGRQSVPLIRALRDEGEKARKQVLENA
                310        320        330        340        350        360

370        380        390        400        410
m622.pep   MKQLAKGATAEEVLERLSVQLTNKLLHSPTQTLNKAGEEDKDLVHAVAQIYHLDKX
           ||||||||||||||||||:|||||||||||||||||||||||||||||||||||||
a622       MKQLAKGATAEEVLERLSIQLTNKLLHSPTQTLNKAGEEDKDLVHAVAQIYHLDKX
                370        380        390        400        410
```

The following partial DNA sequence was identified in *N. gonorrhoeae* <SEQ ID 1997>:

```
g624.seq
    1 ATGATCCGTT ATCTTTTAAT TGCCTGCGGC GGCATCTCCC TGCTGTTGGG

51 GATAATCGGC ATTTTTTTGC CGCTGTTGCC GACCACGCCG TTCGTACTAC

101 TCTCCGCCGC CTGCTGGGCA AAGGCAtccc cgcgcTTTCa ccgCTGGCTG

151 CACcgGCacc gCTATTTCGG CCCGATGGTT CATAACTGGG AACAAAACGG

201 CGCAGTGCCG CGCAAAGCCA AGATTTTCGC CATCAGCATG AtaaccgcAt 251 cctgcctcat gatctTTtgg CattTTCccc aacnctggtg ggtcGGGGCG
```

```
301 GTTTCATCGG TTTTTTGTTC CCTTGTcacC ATacggatgt gGcacAGacC 351 cgaatCTTGA
```

This corresponds to the amino acid sequence <SEQ ID 1998; ORF 624.ng>:

```
g624.pep
  1 MIRYLLIACG GISLLLGIIG IFLPLLPTTP FVLLSAACWA KASPRFHRWL

51 HRHRYFGPMV HNWEQNGAVP RKAKIFAISM ITASCLMIFW HFPQXWWVGA

101 VSSVFCSLVT IRMWHRPES*
```

The following partial DNA sequence was identified in *N. meningitidis* <SEQ ID 1999>:

```
m624.seq
  1 ATGATACGTT ATCTTTTAAT TGCCTGCGGC TGCATTTCCC TACTGTTGGG

51 TATCATCGGC ATTTTTTTGC CGCTGTTGCC GACCACGCCG TTCGTACTGC

101 TCTCCGCCGC CTGCTGGGCA AAGGCATCCC CGCGCTTTTA CCGCTGGCTG

151 CACCGGCACC GCTATTTCGG CCCGATGGTT CATAACTGGG AACAAAACGG

201 CGCAGTGCCG CGCAAAGCCA AAATATTCGC CATCAGTATG ATGACCGCAT

251 CCTGCCTGAT AATGTTTTGG CAGTTTCCCC AACGCTGGTG GGTCGGGGCG

301 GTTTCATCGG TTTTTTGTTC CCTTGTCGCC ATATGGATGT GGCGCAGGCC

351 CGAATCTTGA
```

This corresponds to the amino acid sequence <SEQ ID 2000; ORF 624>:

```
m624.pep
    1 MIRYLLIACG CISLLLGIIG IFLPLLPTTP FVLLSAACWA KASPRFYRWL

51 HRHRYFGPMV HNWEQNGAVP RKAKIFAISM MTASCLIMFW QFPQRWWVGA

101 VSSVFCSLVA IWMWRRPES*
m624/g624  91.6% identity in 119 aa overlap 10        20        30        40        50        60
m624.pep  MIRYLLIACGCISLLLGIIGIFLPLLPTTPFVLLSAACWAKASPRFYRWLHRHRYFGPMV
          ||||||||||  |||||||||||||||||||||||||||||||||||:|||||||||||
g624      MIRYLLIACGGISLLLGIIGIFLPLLPTTPFVLLSAACWAKASPRFHRWLHRHRYFGPMV
                 10        20        30        40        50        60

70        80        90       100       110       120
m624.pep  HNWEQNGAVPRKAKIFAISMMTASCLIMFWQFPQRWWVGAVSSVFCSLVAIWMWRRPESX
          ||||||||||||||||||||:|||| ::||:||| ||||||||||||||||:| ||:|||||
g624      HNWEQNGAVPRKAKIFAISMITASCLMIFWHFPQXWWVGAVSSVFCSLVTIRMWHRPESX
                 70        80        90       100       110       120
```

The following partial DNA sequence was identified in *N. meningitidis* <SEQ ID 2001>:

```
a624.seq
  1 ATGATACGTT ATCTTTTAAT TGCCTGCGGC TGCATTTCCC TGCTGTTGGG

51 TATCATCGGC ATTTTTTTGC CGCTGTTGCC GACCACGCCG TTCGTACTGC

101 TCTCCGCCGC CTGCTGGGCA AAGGCATCCC CGCGCTTTCA CCGCTGGCTG

151 CACCGGCACC GCTATTTCGG TCCGATGGTT CATAACTGGG AACAAAACGG
```

-continued

```
201 CGCAGTGCCG CGCAAAGCCA AAATATTCGC CATCAGTATG ATGACCGCAT

251 CCTGCCTGAT AATGTTTTGG CAGTTTCCCC AACGCTGGTG GGTCGGGGCG

301 GTTTCATCGG TTTTTTGTTC CCTTGTCGCC ATATGGATGT GGCGCAGGCC

351 CGAATCTTGA
```

This corresponds to the amino acid sequence <SEQ ID 2002; ORF 624.a>:

```
a624.pep
      1 MIRYLLIACG CISLLLGIIG IFLPLLPTTP FVLLSAACWA KASPRFHRWL
     51 HRHRYFGPMV HNWEQNGAVP RKAKIFAISM MTASCLIMFW QFPQRWWVGA
    101 VSSVFCSLVA IWMWRRPES*
 m624/a624  99.2% identity in 119 aa overlap 10        20        30        40        50        60
    m624.pep  MIRYLLIACGCISLLLGIIGIFLPLLPTTPFVLLSAACWAKASPRFYRWLHRHRYFGPMV
              ||||||||||  ||||||||||||||||||||||||||||||||||:||||||||||||
       a624   MIRYLLIACGCISLLLGIIGIFLPLLPTTPFVLLSAACWAKASPRFHRWLHRHRYFGPMV
                   10        20        30        40        50        60

70        80        90       100       110       120
    m624.pep  HNWEQNGAVPRKAKIFAISMMTASCLIMFWQFPQRWWVGAVSSVFCSLVAIWMWRRPESX
              ||||||||||||||||||||||||||||||||||||||||||||||||||||||||||||
       a624   HNWEQNGAVPRKAKIFAISMMTASCLIMFWQFPQRWWVGAVSSVFCSLVAIWMWRRPESX
                   70        80        90       100       110       120
```

The following partial DNA sequence was identified in *N. meningitidis* <SEQ ID 2003>:

```
a625.seq
  1 ATGTTTGCAA CCAGGAAAAT GAAGAAGATG ACGATGTGCA CGCGGCGGGT

51 ACGGTTTTGG TTGGCTTTCA GCAGCGGACG AATCATCAGC ATTGCTGCGC

101 CGGTCGTTCC CATGATAGAG GCAAGTGCCG TACCGACGGA AGCAGGGCG

151 GTGTTGAGCT TGGGTGTGCC GTTCAAGTCG CCCCAAACCA AAATGCCGCC

201 TGAAATGGTG TACAGGGCAA GCAGCAGCAG GATGAAAGGG ATGTATTCTT

251 CAACGAGTGC GTGTGCGACG GTATGGATAC CGGCGGACGC GCCAAAAACC

301 AAACTGAACG GGATGAGGAA GAGCAATGTC CAAAAGGCGG TAATTTTGCC

351 GTAA
```

The following partial DNA sequence was identified in *N. gonorrhoeae* <SEQ ID 2004>:

```
g625.seq
  1 atGTTTGCAA CCAGGAAAAT GAAGAAGATG ACGATGTGCA CGCGGCGGGT

51 ACGGtcTTGG TTGGCTTTCA GCAGCGGACG AATCATCAGC AttgCCGCGC

101 CGGtcgttcC CATGATAGAG GCAAGTGCCG TACCGACGGA AGCAGGGCG

151 GTGTTGAGCT TGGGTGTGCC GTTCAAGTCG CCCCAAACCA AAATGCCGCC

201 TGAAATGGTG TACAGGGCAA GCAGCAGCAG GATGAAGGGG ATATATTCTT

251 CAACGAGTGC GTGTGCGACG GTATGGATAC CGGCGGACGC GCCAAAAACC

301 AAACTGAACG GGATGAGGAA GAGCAATGTC CAAAAGGCGG TGATTTTGCc 351 gtAA
```

This corresponds to the amino acid sequence <SEQ ID 2005; ORF 625.ng>:

```
g625.pep
    1 MFATRKMKKM TMCTRRVRSW LAFSSGRIIS IAAPVVPMIE ASAVPTASRA

51 VLSLGVPFKS PQTKMPPEMV YRASSSRMKG IYSSTSACAT VWIPADAPKT

101 KLNGMRKSNV QKAVILP*
```

The following partial DNA sequence was identified in *N. meningitidis* <SEQ ID 2006>:

```
m625.seq
    1 ATGTTTGCAA CCAGGAAAAT GAAGAAGATG ACGATGTGCA CGCGGCGGGT

51 ACGGTTTTGG TTGGCTTTCA GCAGCGGACG AATCATCAGC ATTGCTGCGC

101 CGGTCGTTCC CATGATAGAG GCAAGTGCCG TACCGACGGC AAGCAGGGCG

151 GTGTTGAGCT TGGGTGTGCC GTTCAAGTCG CCCCAAACCA AAATGCCGCC

201 TGAAATGGTG TACAGGGCAA GCAGCAGCAG GATGAAAGGG ATGTATTCTT

251 CAACGAGTGC GTGTGCGACG GTATGGATAC CGGCGGACGC GCCAAAAACC

301 AAACTGAACG GGATGAGGAA GAGCAATGTC CAAAAGGCGG TAATTTTGCC

351 GTAA
```

This corresponds to the amino acid sequence <SEQ ID 2007; ORF 625>:

```
m625.pep
        1 MFATRKMKKM TMCTRRVRFW LAFSSGRIIS IAAPVVPMIE ASAVPTASRA

51 VLSLGVPFKS PQTKMPPEMV YRASSSRMKG MYSSTSACAT VWIPADAPKT

101 KLNGMRKSNV QKAVILP*
m625/g625  98.3% identity in 117 aa overlap 10         20         30         40         50         60
m625.pep  MFATRKMKKMTMCTRRVRFWLAFSSGRIISIAAPVVPMIEASAVPTASRAVLSLGVPFKS
          |||||||||||||||||||| |||||||||||||||||||||||||||||||||||||||
g625      MFATRKMKKMTMCTRRVRSWLAFSSGRIISIAAPVVPMIEASAVPTASRAVLSLGVPFKS
                 10         20         30         40         50         60

70         80         90        100        110
m625.pep  PQTKMPPEMVYRASSSRMKGMYSSTSACATVWIPADAPKTKLNGMRKSNVQKAVILPX
          ||||||||||||||||||||:||||||||||||||||||||||||||||||||||||
g625      PQTKMPPEMVYRASSSRMKGIYSSTSACATVWIPADAPKTKLNGMRKSNVQKAVILPX
                 70         80         90        100        110
```

This corresponds to the amino acid sequence <SEQ ID 2008; ORF 625.a>:

```
a625.pep
        1 MFATRKMKKM TMCTRRVRFW LAFSSGRIIS IAAPVVPMIE ASAVPTASRA

51 VLSLGVPFKS PQTKMPPEMV YRASSSRMKG MYSSTSACAT VWIPADAPKT

101 KLNGMRKSNV QKAVILP*
m625/a625  100.0% identity in 117 aa overlap 10         20         30         40         50         60
m625.pep  MFATRKMKKMTMCTRRVRFWLAFSSGRIISIAAPVVPMIEASAVPTASRAVLSLGVPFKS
          ||||||||||||||||||||||||||||||||||||||||||||||||||||||||||||
a625      MFATRKMKKMTMCTRRVRFWLAFSSGRIISIAAPVVPMIEASAVPTASRAVLSLGVPFKS
                 10         20         30         40         50         60
```

```
                             70        80        90       100       110
    m625.pep    PQTKMPPEMVYRASSSRMKGMYSSTSACATVWIPADAPKTKLNGMRKSNVQKAVILPX
                ||||||||||||||||||||||||||||||||||||||||||||||||||||||||||
    a625        PQTKMPPEMVYRASSSRMKGMYSSTSACATVWIPADAPKTKLNGMRKSNVQKAVILPX
                             70        80        90       100       110
```

The following partial DNA sequence was identified in *N. gonorrhoeae* <SEQ ID 2009>:

```
g627.seq
   1 ATGTCCGGCC TTTGGAAACC CGAACACCCG GGATTTGAAA TCCTCGGCAG

51 CCGTTACGCC CTGCAAAACC TTGTCCGCGA TGTCATCCTG ATTACATTGA

101 CCGCCGTATC TATGGCAATC ACGCCCAAAC AAGTCCGCGC AGGCAACGAA

151 TTCAACTTTG AACCCATCGC CGAAGTGGGC AAACTCTTCC TCGGCATCTT

201 CATCACCATC TTCCCCGTCC TGAGCATTCT GAAAGCAGGC GAGGCAGGCG

251 CGCTGGGCGG GGTGGTATCG CTGGTTCACG ATACGGCAGG TCATCCGATT

301 AATACGATGT ATTTCTGGAT GAGCGGCATA TTGTCGGCAT TCTTGGATAA

351 CGCGCCCACT TATCTCGTGT TTTTCAATAT GGCGGGCGGC GATGCCCAAG

401 CCTTAATGAC GGGTCCCCTG TTTCATTcgc TGCTGGCGGT TTCTAtgggT 451 tCGGTATTCA TGGGCGCACT GaccTACATc gGCAAcgcac cgaactTCAT 501 GGTcaaggcc aTTGCCGaaC agcgcgGCgt accgaTGCcg actTTCTTcc 551 ggtaTAtgat gtggtcggtc gcCTTCCTGa caCCCGTCTT CAtcgTACAT 601 ACCCTcgtCT TTTTcgTTtt cAAACTACTg taa
```

This corresponds to the amino acid sequence <SEQ ID 2010; ORF 627.ng>:

```
g627.pep
   1 MSGLWKPEHP GFEILGSRYA LQNLVRDVIL ITLTAVSMAI TPKQVRAGNE

51 FNFEPIAEVG KLFLGIFITI FPVLSILKAG EAGALGGVVS LVHDTAGHPI

101 NTMYFWMSGI LSAFLDNAPT YLVFFNMAGG DAQALMTGPL FHSLLAVSMG

151 SVFMGALTYI GNAPNFMVKA IAEQRGVPMP TFFRYMMWSV AFLTPVFIVH

201 TLVFFVFKLL *
```

The following partial DNA sequence was identified in *N. meningitidis* <SEQ ID 2011>:

```
m627.seq
   1 ATGTCCGGCC TTTGGAAACC CGAACACCCG GGATTTGAAA TCCTCGGCAG

51 CCGTTACGCC CTGCAAAACC TCGTCCGCGA TGTCATCCTG ATTGCATTGA

101 CCGCCGTATC TATGGCAATC ACGCCCAAAC AAGTCCGCGC AGGCAACGAA

151 TTCAACTTTG AACCCATCGC CGAAGTGGGC AAACTCTTCC TCGGCATCTT

201 CATCACCATC TTTCCCGTCC TGAGCATTCT GAAAGCAGGC GAGGCAGGCG

251 CGCTGGGCGG GGTGGTATCG CTGGTTCACG ATACGGCAGG TCATCCGATT

301 AATGTGATGT ATTTTTGGAT GAGCGGCATA TTGTCGGCAT TCTTGGATAA

351 CGCGCCCACT TATCTCGTTT TTTTCAATAT GGCGGGCGGC GATGCCCAAG

401 CCTTGATGAC GGGTACCCTG TTTCATTCGC TGCTGGCGGT TTCTATGGGT
```

-continued

```
451 TCGGTATTCA TGGGCGCACT GACCTACATC GGCAACGCAC CGAACTTCAT

501 GGTCAAGGCC ATTGCCGAAC AGCGCGGCGT ACCGATGCCG ACTTTCTTCG

551 GCTATATGAT GTGGTCGGTC GCCTTCCTGA CACCCGTCTT CATCGTACAT

601 ACCCTTATCT TTTTCGTTTT CAAACTGCTG TAA
```

This corresponds to the amino acid sequence <SEQ ID 2012; ORF 627>:

```
m627.pep
  1 MSGLWKPEHP GFEILGSRYA LQNLVRDVIL IALTAVSMAI TPKQVRAGNE

51 FNFEPIAEVG KLFLGIFITI FPVLSILKAG EAGALGGVVS LVHDTAGHPI

101 NVMYFWMSGI LSAFLDNAPT YLVFFNMAGG DAQALMTGTL FHSLLAVSMG

151 SVFMGALTYI GNAPNFMVKA IAEQRGVPMP TFFGYMMWSV AFLTPVFIVH

201 TLIFFVFKLL *
```

Computer analysis of this amino acid sequence gave the following results:
Homology with a Predicted ORF from N. gonorrhoeae

```
m627/g627  97.6% identity in 210 aa overlap 10         20         30         40         50         60
m627.pep   MSGLWKPEHPGFEILGSRYALQNLVRDVILIALTAVSMAITPKQVRAGNEFNEEPIAEVG
           |||||||||||||||||||||||||||||:||||||||||||||||||||||||||||||
g627       MSGLWKPEHPGFEILGSRYALQNLVRDVILITLTAVSMAITPKQVRAGNEFNEPIAEVG
                   10         20         30         40         50         60

70         80         90        100        110        120
m627.pep   KLFLGIFITIFPVLSILKAGEAGALGGVVSLVHDTAGHPINVMYFWMSGILSAFLDNAPT
           |||||||||||||||||||||||||||||||||||||||||:||||||||||||||||||
g627       KLFLGIFITIFPVLSILKAGEAGALGGVVSLVHDTAGHPINTMYFWMSGILSAFLDNAPT
                   70         80         90        100        110        120

130        140        150        160        170        180
m627.pep   YLVFFNMAGGDAQALMTGTLFHSLLAVSMGSVFMGALTYIGNAPNFMVKAIAEQRGVPMP
           ||||||||||||||||||| ||||||||||||||||||||||||||||||||||||||||
g627       YLVFFNMAGGDAQALMTGPLFHSLLAVSMGSVFMGALTYIGNAPNFMVKAIAEQRGVPMP
                  130        140        150        160        170        180

190        200        210
m627.pep   TFFGYMMWSVAFLTPVFIVHTLIFFVFKLLX
           |||  ||||||||||||||||||:|||||||
g627       TFFRYMMWSVAFLTPVFIVHTLVFFVFKLLX
                  190        200        210
```

The following partial DNA sequence was identified in N. meningitidis <SEQ ID 2013>:

```
a627.seq
  1 ATGTCCGGCC TTTGGAAACC CGAACACCCG GGATTTGAAA TCCTCGGCAG

51 CCGTTACGCC CTGCAAAACC TCGTCCGCGA TGTCATCCTG ATTGCATTGA

101 CCGCCGTATC TATGGCAATC ACGCCCAAAC AAGTCCGCGC AGGCAACGAA

151 TTCAACTTTG AACCCATCGC CGAAGTGGGC AAACTCTTCC TCGGCATCTT

201 CATCACCATC TTTCCCGTCC TGAGCATTCT GAAAGCAGGC GAGGCAGGCG

251 CGCTGGGCGG GGTGGTATCG CTGGTTCACG ATACGGCAGG TCATCCGATT

301 AATGTGATGT ATTTTTGGAT GAGCGGCATA TTGTCGGCAT TCTTGGATAA

351 CGCGCCCACT TATCTCGTTT TTTTCAATAT GGCGGGCGGC GATGCCCAAG

401 CCTTGATGAC GGGTTCCCTG TTTCATTCGC TGCTGGCGGT TTCTATGGGT

451 TCGGTATTCA TGGGCGCACT GACCTACATC GGCAACGCAC CGAACTTCAT
```

-continued

```
501 GGTCAAGGCC ATTGCCGAAC AGCGCGGCGT ACCGATGCCG ACTTTCTTCG

551 GCTATATGAT GTGGTCGGTC GCCTTCCTGA CACCCGTCTT CATCGTACAT

601 ACCCTTATCT TTTTCGTTTT CAAACTGCTG TAA
```

This corresponds to the amino acid sequence <SEQ ID 2014; ORF 627.a>:

```
a627.pep

1 MSGLWKPEHP GFEILGSRYA LQNLVRDVIL IALTAVSMAI TPKQVRAGNE

51 FNFEPIAEVG KLFLGIFITI RPVLSILKAG EAGALGGVVS LVHDTAGHPI

101 NVMYFWMSGI LSAFLDNAPT YLVFFNMAGG DAQALMTGSL FHSLLAVSMG

151 SVFMGALTYI GNAPNFMVKA IAEQRGVPMP TFFGYMMWSV AFLTPVFIVH

201 TLIFFVFKLL * m627/a627  99.5% identity in 210 aa overlap 10         20         30         40         50         60
m627.pep MSGLWKPEHPGFEILGSRYALQNLVRDVILIALTAVSMAITPKQVRAGNEFNFEPIAEVG
         ||||||||||||||||||||||||||||||||||||||||||||||||||||||||||||
a627     MSGLWKPEHPGFEILGSRYALQNLVRDVILIALTAVSMAITPKQVRAGNEFNFEPIAEVG
                 10         20         30         40         50         60

70         80         90        100        110        120
m627.pep KLFLGIFITIFPVLSILKAGEAGALGGVVSLVHDTAGHPINVMYFWMSGILSAFLDNAPT
         ||||||||||||||||||||||||||||||||||||||||||||||||||||||||||||
a627     KLFLGIFITIFPVLSILKAGEAGALGGVVSLVHDTAGHPINVMYFWMSGILSAFLDNAPT
                 70         80         90        100        110        120

130        140        150        160        170        180
m627.pep YLVFFNMAGGDAQALMTGTLFHSLLAVSMGSVFMGALTYIGNAPNFMVKAIAEQRGVPMP
         ||||||||||||||||||:|||||||||||||||||||||||||||||||||||||||||
a627     YLVFFNMAGGDAQALMTGSLFHSLLAVSMGSVFMGALTYIGNAPNFMVKAIAEQRGVPMP
                130        140        150        160        170        180

190        200        210
m627.pep TFFGYMMWSVAFLTPVFIVHTLIFFVFKLLX
         |||||||||||||||||||||||||||||||
a627     TFFGYMMWSVAFLTPVFIVHTLIFFVFKLLX
                190        200        210
```

The following partial DNA sequence was identified in *N. gonorrhoeae* <SEQ ID 2015>:

```
g628.seq
   1 ATGTGCGTGC CACTCAAGCC GGCAGGATGC GGGCCGCCAA ATTCATGTGT

51 TTCGATATTG GCAGCATTTT CAGACGGCAC GTCTGCGCCT GCTGCTTTAC

101 ACACATGGAT TTTACGTTCG GTCAGGCGGC TCAATACCAA CAGGCCGCGT

151 TTGAAGTCTT CGGCGGCTTC TTTGATGATG ACCGTAGGGT CGGCAGCCAG

201 CGGATTGGTG TCCATCGCAT TGACGAAGAT GGCGAACGGC TCGGCATCTA

251 CGGCAGGGAT TTTGCTGAAC GGACGGGTGC GAAGCGCAGT CCATAAGCCT

301 GATTGAATCA GGTTGCGGCG CACTTTTTCG CTGCTCAATT TGCCAGCGC

351 TTCAGGTacg TAG
```

This corresponds to the amino acid sequence <SEQ ID 2016; ORF 628.ng>:

```
g628.pep
   1 MCVPLKPAGC GPPNSCVSIL AAFSDGTSAP AALHTWILRS VRRLNTNRPR
```

-continued
```
 51 LKSSAASLMM TVGSAASGLV SIALTKMANG SASTAGILLN GRVRSAVHKP

101 D*IRLRRTFS LLNFASASGT *
```

The following partial DNA sequence was identified in *N. meningitidis* <SEQ ID 2017>:

```
m628.seq
   1 ATGTGCGTGC CACTCAAACC GGCAGGATGC GGGCCGCCGA ATTCATGTGT

51 TTCGATGTTG GCAGCATTTT CAGACGGCAC GTCTGCGCCA GCTGCCTTAC

101 AAACATGGAT TTTGCGTTCG GTCAAACGGC TCAATACCAA CAGGCCGCGT

151 TTGAAATCCT CGGCGGCTTC TTTGATAATG ACCGTAGGGT CGGCAGCCAG

201 CGGATTGGTG TCCATCGCAT TGACGAAGAT GGCGAACGGC TCGGCATCGA

251 CGGCAGGAAT TTTGCTGAAC GGACGGGTGC GCAGCGCAGT CCACAAACCG

301 GATTGGATCA GGTTGCGGCG CACTTCTTCG CCGCTTAAGT TTGCCAGCGC

351 TTCAGGTGCG TAG
```

This corresponds to the amino acid sequence <SEQ ID 2018; *ORF* 628>:

```
m628.pep
   1 MCVPLKPAGC GPPNSCVSML AAFSDGTSAP AALQTWILRS VKRLNTNRPR

51 LKSSAASLIM TVGSAASGLV SIALTKMANG SASTAGILLN GRVRSAVHKP

101 DWIRLRRTSS PLKFASASGA *
```

Computer analysis of this amino acid sequence gave the following results:
Homology with a Predicted ORF from *N. gonorrhoeae*

```
    m628/a628  93.3% identity in 119 aa overlap 10         20         30         40         50         60
    m628.pep  MCVPLKPAGCGPPNSCVSMLAAFSDGTSAPAALQTWILRSVKRLNTNRPRLKSSAASLIM
              ||||||||||||||||||||:||||||||||||||||:||||||:||||||||||||||:|
    g628      MCVPLKPAGCGPPNSCVSILAAFSDGTSAPAALHTWILRSVRRLNTNRPRLKSSAASLMM
                     10         20         30         40         50         60

70         80         90        100        110        120
    m628.pep  TVGSAASGLVSIALTKMANGSASTAGILLNGRVRSAVHKPDWIRLRRTSSPLKFASASGA
              |||||||||||||||||||||||||||||||||||||||| |||||| |:|||||:
    g628      TVGSAASGLVSIALTKMANGSASTAGILLNGRVRSAVHKPDXIRLRRTFSLLNFASASGT
                     70         80         90        100        110        120 m628.pep  X g628      X
```

The following partial DNA sequence was identified in *N. meningitidis* <SEQ ID 2019>:

```
a628.seq
   1 ATGTGCGTGC CACTCAAACC GGCCGGATGC GGGCCGCCGA ATTCATGTGT

51 TTCGATGTTG GCAGCATTTT CAGACGGCAC GTCTGCGCCA GCTGCCTTAC

101 ACACATGGAT TTTACGCTCG GTCAAACGGC TCAATACCAG CAAACCTCGT

151 CTGAAATCCT CGGCGGCTTC TTTGATCACA ACCACAGGGT CTGCCGCCAG

201 CGGATTGGTG TCCATCGCAT TGACGAAGAT GGCGAACGGC TCGGCATCGA

251 CGGCAGGGAT TTTGCTGAAC GGACGGGTAC GCAGCGCAGT CCACAAACCG
```

```
301 GATTGGATCA GATTGCGGCG CACTTCTTCG CCGCTTAAGT TTGCCAACGC

351 TTCGGGCGCG TAG
```

This corresponds to the amino acid sequence <SEQ ID 2020; ORF 628.a>:

```
a628.pep
      1 MCVPLKPAGC GPPNSCVSML AAFSDGTSAP AALHTWILRS VKRLNTSKPR
     51 LKSSAASLIT TTGSAASGLV SIALTKMANG SASTAGILLN GRVRSAVHKP
    101 DWIRLRRTSS PLKFANASGA *
m628/a628 95.0% identity in 120 aa overlap 10        20        30        40        50        60
    m628.pep  MCVPLKPAGCGPPNSCVSMLAAFSDGTSAPAALQTWILRSVKRLNTNRRRLKSSAASLIM
              ||||||||||||||||||||||||||||||||||||:||||||||||::|||||||||||
    a628      MCVPLKPAGCGPPNSCVSMLAAFSDGTSAPAALHTWILRSVKRLNTSKRRLKSSAASLIM
                   10        20        30        40        50        60

70        80        90       100       110       120
    m628.pep  TVGSAASGLVSIALTKMANGSASTAGILLNGRVRSAVHKPDWIRLRRTSSPLKFASASGA
              |:||||||||||||||||||||||||||||||||||||||||||||||||||||:||||
    a628      TTGSAASGLVSIALTKMANGSASTAGILLNGRVRSAVHKPDWIRLRRTSSPLKFANASGA
                   70        80        90       100       110       120 m628.pep  X
              |
    a628      X
```

The following partial DNA sequence was identified in *N. gonorrhoeae* <SEQ ID 2021>:

```
g629.seq
  1 ATGACTGCca aacCTTTTTC CCTCAACCTG GCcaaCCTCC TGCTGCCggc 51 ggtatTGTTT GCCGTCAGcc tGtcggTCGG cattgccgaT TTCCGCTGGT

101 CGGATGTGTT TTCGCTGTCC GACAGCCAGC AAGTGATGTT CATCAGCCGC

151 CTGCCGCGCA CGTTTGcgaT TGTGTTGACG GGCgcgtcga tagcgGtggc 201 gGGGAtgatt atgcagATTC TGATGCGCAA CcgtTTTGTC GAGCCTtcta 251 tggcgGGTGC GGGCCAAAGt gcgGCTTTGG GTttgcttct gAtgtccctg 301 ctgctgcctg CcgcGccgct gccggtcaAA ATGTCGGtag Ccgccgttgc 351 CGCGCTGATC GGGATGTTGG tctTtatgct gctaatccgC Cgcctgccac 401 cgacggcgca gctgatgGTg ccgCTGGTGG Gg.ttATTTT CGGCGGCGTG 451 GttgaGGCGG TGGCGACGTT TGTCGCGTAT GAGTTTGAGA TGCTGCAAAT

501 GTTGGGCGTG TGGCAGCAGG GCGACTTTTC AAGCGTGCTG CTGGGGCGGT

551 ACGAGCTGCT TTGGATTACG GGCGGTTTGG CGGTGTTTGC CTACCTGATT

601 GCCGACCGGC TGACGATTTT GGGGCTGGGC GAGACGGTGA GCGTGAATTT

651 GGGTTTGAAC CGGACGGCGG TGTTGTGGTC GGGTTTGATT ATTGTGGCAC

701 TGATTACATC GCTGGTCATT GTAACGGTCG GCAATATTCC GTTTATCGGG

751 CTGGTCGTGC CGAATATCGT CAGCCGCCTG ATGGGCGACA GGCTGCGCCA

801 AAGCCTGCCT GCGGTCGCCC TCTTGGGCGC GTCTTTGGTT TTATTGTGCG

851 ACATTATCGG ACGCATGATT GTGTTTCCGT TTGAAATTCC GGTCTCCACG
```

```
901 GTTTTTGGTG TGTTGGGTAC GGCTTTGTTT TTGTGGCTTT TGTTGAGGAA

951 ACCCGCCTAT GCCGTCTGA
```

This corresponds to the amino acid sequence <SEQ ID 2022; ORF 629.ng>:

```
g629.pep
   1 MTAKPFSLNL ANLLLPAVLF AVSLSVGIAD FRWSDVFSLS DSQQVMFISR

51 LPRTFAIVLT GASIAVAGMI MQILMRNRFV EPSMAGAGQS AALGLLLMSL

101 LLPAAPLPVK MSVAAVAALI GMLVFMLLIR RLPPTAQLMV PLVGXIFGGV

151 VEAVATFVAY EFEMLQMLGV WQQGDFSSVL LGRYELLWIT GGLAVFAYLI

201 ADRLTILGLG ETVSVNLGLN RTAVLWSGLI IVALITSLVI VTVGNIPFIG

251 LVVPNIVSRL MGDRLRQSLP AVALLGASLV LLCDIIGRMI VFPFEIPVST

301 VFGVLGTALF LWLLLRKPAY AV*
```

The following partial DNA sequence was identified in *N. meningitidis* <SEQ ID 2023>:

```
m629.seq
   1 ATGACTGCCA AACCTTTTTC CCTCAACCTG ACCAACCTGC TGCTGCTGGC

51 GGTGTTGTTT GCCGTCAGCC TGTCGGTGGG CGTTGCCGAT TTCCGCTGGT

101 CTGATGTGTT TTCACTGTCC GACAGCCAGC AGGTCATGTT CATCAGCCGC

151 CTGCCGCGCA CGTTTGCGAT TGTGCTGACG GGCGCGTCGA TGGCGGTGGC

201 CGGCATGATT ATGCAGATTT TGATGCGCAA CCGTTTTGTC GAACCGTCGA

251 TGGTGGGCGC AAGCCAAAGC GCGGCTTTAG GTTTGCTGCT GATGACCCTG

301 CTGCTGCCGG CCGCGCCGCT GCCGGCGAAA ATGTCGGTTG CCGCCGTTGC

351 CGCGCTGATC GGGATGTTGG TCTTTATGCT GCTGATCCGC CGCCTGCCGC

401 CGACCGCGCA ACTGATGGTG CCTTTGGTCG GGATTATTTT CGGCGGTGTG

451 ATTGAGGCGG TAGCCACCTT TATCGCGTAT GAAAACGAAA TGCTGCAAAT

501 GCTCGGCGTG TGGCAGCAGG GCGATTTTTC GAGCGTGCTG CTGGGGCGGT

551 ACGAGCTGCT TTGGATTACG GGCGGTTTGG CGGTGTTTGC CTATCTGATT

601 GCCGACCGGC TGACGATTTT GGGGCTGGGC GAAACGGTAA GCGTGAATTT

651 GGGTTTGAAC CGGACGGCGG TGTTGTGGTC GGGTTTGATT ATTGTGGCTT

701 TGATTACGTC GCTGGTTATC GTTACGGTCG GCAATATTCC GTTTATCGGG

751 CTGGTCGTGC CGAACATCAT CAGCCGCCTG ATGGGCGACA GGTTGCGCCA

801 AAGCCTGCCT GCGGTGGCCT TGCTGGGCGC ATCTTTGGTG TTGCTGTGCG

851 ACATTATCGG ACGCGTGATT GTGTTTCCGT TTGAAATTCC GGTCTCTACG

901 GTTTTTGGTG TATTGGGTAC GGCTTTGTTT TTGTGGCTTT TGTTGAGGAA

951 ACCCGCCTAT GCCGTCTGA
```

This corresponds to the amino acid sequence <SEQ ID 2024; ORF 629>:

```
m629.pep
   1 MTAKPFSLNL TNLLLLAVLF AVSLSVGVAD FRWSDVFSLS DSQQVMFISR

51 LPRTFAIVLT GASMAVAGMI MQILMRNRFV EPSMVGASQS AALGLLLMTL
```

```
101 LLPAAPLPAK MSVAAVAALI GMLVFMLLIR RLPPTAQLMV PLVGIIFGGV

151 IEAVATFIAY ENEMLQMLGV WQQGDFSSVL LGRYELLWIT GGLAVFAYLI

201 ADRLTILGLG ETVSVNLGLN RTAVLWSGLI IVALITSLVI VTVGNIPFIG

251 LVVPNIISRL MGDRLRQSLP AVALLGASLV LLCDIIGRVI VFPFEIPVST

301 VFGVLGTALF LWLLLRKPAY AV*
```

Computer analysis of this amino acid sequence gave the following results:

Homology with a Predicted ORF from *N. gonorrhoeae*

```
   m629/g629  95.7% identity in 322 aa overlap
                    10         20         30         40         50         60
   m629.pep  MTAKPFSLNLTNLLLLAVLFAVSLSVGVADFRWSDVFSLSDSQQVMFISRLPRTFAIVLT
             ||||||||||:||| |||||||||||||||:|||||||||||||||||||||||||||||
   g629      MTAKPFSLNLANLLLPAVLFAVSLSVGIADFRWSDVFSLSDSQQVMFISRLPRTFAIVLT
                    10         20         30         40         50         60

70         80         90        100        110        120
   m629.pep  GASMAVAGMIMQILMRNRFVEPSMVGASQSAALGLLLMTLLLPAAPLPAKMSVAAVAALI
             |||:||||||||||||||||||||||:||:|||||||||||:|||||||:||||||||||
   g629      GASIAVAGMIMQILMRNRFVEPSMAGAGQSAALGLLLMSLLLPAAPLPVKMSVAAVAALI
                    70         80         90        100        110        120

130        140        150        160        170        180
   m629.pep  GMLVFMLLIRRLPPTAQLMVPLVGIIFGGVIEAVATFIAYENEMLQMLGVWQQGDFSSVL
             ||||||||||||||||||||||||| :|||||:||||||:||:|||||||||||||||||
   g629      GMLVFMLLIRRLPPTAQLMVPLVGXIFGGVVEAVATFVAYEFEMLQMLGVWQQGDFSSVL
                   130        140        150        160        170        180

190        200        210        220        230        240
   m629.pep  LGRYELLWITGGLAVFAYLIADRLTILGLGETVSVNLGLNRTAVLWSGLIIVALITSLVI
             ||||||||||||||||||||||||||||||||||||||||||||||||||||||||||||
   g629      LGRYELLWITGGLAVFAYLIADRLTILGLGETVSVNLGLNRTAVLWSGLIIVALITSLVI
                   190        200        210        220        230        240

250        260        270        280        290        300
   m629.pep  VTVGNIPFIGLVVPNIISRLMGDRLRWSLPAVALLGASLVLLCDIIGRVIVFPFEIPVST
             ||||||||||||||||:|||||||||||||||||||||||||||||||:|||||||||||
   g629      VTVGNIPFIGLVVPNIVSRLMGDRLRWSLPAVALLGASLVLLCDIIGRMIVFPFEIPVST
                   250        260        270        280        290        300

310        320
   m629.pep  VFGVLGTALFLWLLLRKPAYAVX
             |||||||||||||||||||||||
   g629      VFGVLGTALFLWLLLRKPAYAVX
                   310        320
```

The following partial DNA sequence was identified in *N. meningitidis* <SEQ ID 2025>:

```
a629.seq
    1 ATGACTGCCA AACCTTTTTC CCTCAACCTG ACTAACCTCC TGCTGCTGGC

51 GGTGTTGTTT GCCGTCAGCC TGTCGGTGGG CGTTGCCGAT TTCCGCTGGT

101 CGGATGTGTT TTCGCTGTCG GACAGCCAGC AGGTTATGTT CATCAGCCGC

151 CTGCCGCGCA CGTTTGCGAT TGTGTTGACG GGCGCGTCGA TGGCGGTGGC

201 GGGGATGATT ATGCAGATTC TGATGCGTAA CCGTTTTGTC GAGCCTTCTA

251 TGGCGGGCGC GGGTCAGAGT GCGGCTTTGG GTTTGCTTCT GATGTCCCTG

301 CTGCTGCCTG CCGCGCCGCT GCCGGTCAAA ATGTCGGTTG CCGCCGTTGC

351 CGCGTTAATC GGGATGTTGG TGTTTATGAT GCTTATCCGC CGCCTGCCGC

401 CGACGGCGCA ACTGATGGTG CCTTTGGTCG GGATTATTTT CGGCGGCGTG

451 GTTGAGGCGG TGGCCACCTT TATTGCGTAT GAAAACGAAA TGCTGCAAAT

501 GCTGGGCGTG TGGCAACAGG GCGATTTTTC CGGCGTGTTG CTCGGACGGT

551 ATGAACTGTT GTGGGCAACG GGGATTTTGG CTTTGTTTGC CTATTTGATT
```

```
601 GCCGACCAGC TGACGATTTT GGGTTTGGGC GAAACGGTAA GCGTGAACTT

651 GGGGCTGAAC CGGACGGCGA TTCTGTGGTC GGGGCTGATT ATTGTGGCTT

701 TGATTACGTC GCTGGTTATC GTTACGGTCG GCAATATTCC GTTTATCGGG

751 CTGGTCGTGC CGAACATCAT CAGCCGCCTG ATAGGCGACA GGCTGCGCCA

801 AAGCCTGCCT GCGGTGGCTT TGCTGGGTGC GTCTTTGGTT TTATTGTGCG

851 ACATTATCGG ACGAGTGATT GTGTTTCCGT TTGAAATTCC GGTATCGACC

901 GTCTTCGGCG TATTGGGTAC GGCGTTGTTT TTATGGCTTT TGTTAAGGAA

951 ACCTGCTCAT GCCGTCTGA
```

This corresponds to the amino acid sequence <SEQ ID 2026; ORF 629.a>:

```
a629.pep

1 MTAKPFSLNL TNLLLLAVLF AVSLSVGVAD FRWSDVFSLS DSQQVMFISR

51 LPRTFAIVLT GASMAVAGMI MQILMRNRFV EPSMAGAGQS AALGLLLMSL

101 LLPAAPLPVK MSVAAVAALI GMLVFMMLIR RLPPTAQLMV PLVGIIFGGV

151 VEAVATFIAY ENEMLQMLGV WQQGDFSGVL LGRYELLWAT GILALFAYLI

201 ADQLTILGLG ETVSVNLGLN RTAILWSGLI IVALITSLVI VTVGNIPFIG

251 LVVPNIISRL IGDRLRQSLP AVALLGASLV LLCDIIGRVI VFPFEIPVST

301 VFGVLGTALF LWLLLRKPAH AV* m629/a629  95.7% identity in 322 aa overlap 10         20         30         40         50         60
m629.pep  MTAKPFSLNLTNLLLLAVLFAVSLSVGVADFRWSDVFSLSDSQQVMFISRLPRTFAIVLT
          ||||||||||||||||||||||||||||||||||||||||||||||||||||||||||||
a629      MTAKPFSLNLTNLLLLAVLFAVSLSVGVADFRWSDVFSLSDSQQVMFISRLPRTFAIVLT
                  10         20         30         40         50         60

70         80         90        100        110        120
m629.pep  GASMAVAGMIMQILMRNRFVEPSMVGASQSAALGLLLMTLLLPAAPLPAKMSVAAVAALI
          |||||||||||||||||||||||||:||:|||||||||:|||||||||:||||||||||
a629      GASMAVAGMIMQILMRNRFVEPSMAGAGQSAALGLLLMSLLLPAAPLPVKMSVAAVAALI
                  70         80         90        100        110        120

130        140        150        160        170        180
m629.pep  GMLVFMLLIRRLPPTAQLMVPLVGIIFGGVIEAVATFIAYENEMLQMLGVWQQGDFSSVL
          |||||:||||||||||||||||||||||||:|||||||||||||||||||||||||:||
a629      GMLVFMMLIRRLPPTAQLMVPLVGIIFGGVVEAVATFIAYENEMLQMLGVWQQGDFSGVL
                 130        140        150        160        170        180

190        200        210        220        230        240
m629.pep  LGRYELLWITGGLAVFAYLIADRLTILGLGETVSVNLGLNRTAVLWSGLIIVALITSLVI
          |||||||| ||  ||:||||||:|||||||:||||||||||||:||:||||||||||||
a629      LGRYELLWATGILALFAYLIADQLTILGLFETVSVNLGLNRTAILSWGLIIVALITSLVI
                 190        200        210        220        230        240

250        260        270        280        290        300
m629.pep  VTVGNIPFIGLVVPNIISRLMGDRLRQSLPAVALLGASLVLLCDITGRVIVFPFEIPVST
          ||||||||||||||||||||:|||||||||||||||||||||||:|||||||||||||
a629      VTVGNIPFIGLVVPNIISRLIGDRLRQSLPAVALLGASLVLLCDIIGRVIVFPFEIPVST
                 250        260        270        280        290        300

310        320
m629.pep  VFGVLGTALFLWLLLRKPAYAVX
          |||||||||||||||||||:|||
a629      VFGVLGTALFLWLLLRKPAHAVX
                 310        320
```

The following partial DNA sequence was identified in *N. gonorrhoeae* <SEQ ID 2027>:

```
g630.seq (partial)
    1 aTgatGATTT TGGTGTGGCT ggctttgttt cccccccatgt tttacggcat 51 gtacaacgtc GGCGCACAGG CATTCGGTGC CTTAACGCCC GAtttgctgc
```

```
-continued
101 aacaaagcat cgcccacgac ggcaattacg ccctcgccaa cgctttgggc 151 atcaatatgt cccccgaaGc gggcgtgtTg ggcaaaatgc tgttcgGCGC 201 GATttacttc ctgccgattt acgcgaccgt aTTTATTGTG GGcggcttct 251 ggGaagtCTT GTTCGCATCc gtACGCAAAC ACGAAATCAA CGAAGGTTTC

301 TTCGTTACTT CGATTCTGTT TGCCTTAATC GTTCCGCCCA CGCTGCCGCT

351 GTGGCAGGCG GCTTTGGGTA TTTCTTTCGG CGTTGTGGTT GCGAAAGAAG

401 TATTCGGCGG TACAGGTAAA AACTTCATGA ACCCTGCGCT GGCAGGCCGC

451 GCCTTCCTGT TCTTCGCCTA CCCCGCCAAC TTGAGCGGCG ATGCGGTTTG

501 GACGGCGGTT GACGGCTATT CCGGCGCAAC CGCGCTGGCG CAATGGGCGG

551 CACACGGTGC AGACGGCCTG AAAAACGCCG TAACCGGTCA AACCATCACT

601 TGGATGGACG CGTTTATCGG CAAACTGCCC GGCTCCATCG GCGAAGTCTC

651 CACTTTGGCA CTCTTAATCG GCGGCGCGTT TATCGTGTTT GCCCGCATCG

701 CTtcttgGCG CATTATTGCc ggCGTGATGA TCGGTatGat tGcgatgTCT 751 tcgctgatta acttcatCGg ttctgacacc aaagctatgt ttgctatgca 801 cttggtacat ggcacttggt GGAaagatGa ttAtcactca ctgtacatta 851 aa.....
```

This corresponds to the amino acid sequence <SEQ ID 2028; ORF 630.ng>:

```
g630.pep
  1 MMILVWLALF PPMFYGMYNV GAQAFGALTP DLLQQSIAHD GNYALANALG

51 INMSPEAGVL GKMLFGAIYF LPIYATVFIV GGFWEVLFAS VRKHEINEGF

101 FVTSILFALI VPPTLPLWQA ALGISFGVVV AKEVFGGTGK NFMNPALAGR

151 AFLFFAYPAN LSGDAVWTAV DGYSGATALA QWAAHGADGL KNAVTGQTIT

201 WMDAFIGKLP GSIGEVSTLA LLIGGAFIVF ARIASWRIIA GVMIGMIAMS

251 SLINFIGSDT KAMFAMHLVH GTWWKDDYHS LYIK....
```

The following partial DNA sequence was identified in N. meningitidis <SEQ ID 2029>:

```
m630.seq
   1 ATGATGATTT TGGTGTGGCT GGCTTTGTTC CCTGCCATGT TCTACGGTAT

51 GTACAACGTC GGCGCGCAGG CATTCGGTGC GTTAACGCCT GATTTGCTGC

101 AACAAAACAT CGCCAACGAC TGGCATTACG CCTTTGCCAA CGCTTTGGGC

151 ATCAATATGT CGTCTGAAGC GGGCGTGTCG ACAAAATGC TGTTTGGCGC

201 GATTTACTTC CTGCCGATTT ACGCGACTGT ATTTGTTGTG GGCGGTTTCT

251 GGGAAGTTTT GTTCGCCACC GTGCGCAAAC ACGAAATCAA CGAAGGTTTC

301 TTCGTTACTT CGATTCTGTT TGCCTTAATC GTTCCGCCCA CGCTGCCGCT

351 GTGGCAGGCG GCTTTGGGTA TTTCTTTCGG CGTTGTGGTT GCGAAAGAAG

401 TATTCGGCGG TACAGGTAAA AACTTCATGA ACCCTGCGCT GGCAGGCCGT

451 GCTTTCCTGT TCTTCGCCTA CCCTGCCAAC TTGAGCGGCG ATGCGGTTTG

501 GACGGCGGTT GACGGCTATT CCGGCGCAAC CGCACTGGCG CAATGGGCGG

551 CACACGGTGC AGACGGCCTG AAAAACGCCG TAACCGGTCA AACCATCACT
```

```
-continued
 601 TGGATGGACG CGTTTATCGG CAAACTGCCC GGCTCCATTG GCGAAGTCTC

651 CACTTTGGCA CTCTTAATCG GCGGCGCGTT TATCGTGTTT GCCCGCATCG

701 CTTCTTGGCG CATTATTGCC GGCGTGATGA TCGGTATGAT TGCGATGTCT

751 TCGCTGTTCA ACTTCATCGG TTCGGACACC AACGCTATGT TTGCTATGCC

801 TTGGTACTGG CACTTGGTGG TCGGCGGCTT CGCCATCGGT ATGCTGTTTA

851 TGGCGACCGA CCCTGTTTCC GCTTCCTTTA CCAATGTCGG CAAATGGTGG

901 TACGGCGCAC TGATCGGTGT GATGTGCGTA TTAATCCGCG TGGTCAATCC

951 GGCTTACCCC GAAGGCATGA TGTTGGCGAT TCTGTTTGCC AACCTGTTTG

1001 CCCCGATTTT CGACTATTTC GTCGCACAAG CGAACATCAA ACGCAGAAAG

1051 GCGCGCAGCA ATGGCTAA
```

This corresponds to the amino acid sequence <SEQ ID 2030; ORF 630>:

```
m630.pep

1 MMILVWLALF PAMFYGMYNV GAQAFGALTP DLLQQNIAND WHYAFANALG

51 INMSSEAGVS DKMLFGAIYF LPIYATVFVV GGFWEVLFAT VRKHEINEGF

101 FVTSILFALI VPPTLPLWQA ALGISFGVVV AKEVFGGTGK NFMNPALAGR

151 AFLFFAYPAN LSGDAVWTAV DGYSGATALA QWAAHGADGL KNAVTGQTIT

201 WMDAFIGKLP GSIGEVSTLA LLIGGAFIVF ARIASWRIIA GVMIGMIAMS

251 SLFNFIGSDT NAMFAMPWYW HLVVGGFAIG MLFMATDPVS ASFTNVGKWW

301 YGALIGVMCV LIRVVNPAYP EGMMLAILFA NLFAPIFDYF VAQANIKRRK

351 ARSNG* m630/g630 93.5% identity in 275 aa overlap 10         20         30         40         50         60
 m630.pep MMILVWLALFPAMFYGMYNVGAQAFGALTPDLLQQNIANDWHYAFANALGINMSSEAGVS
          ||||||||||| ||||||||||||||||||||||||:||:| :||:||||||| |||||
    g630  MMILVWLALFPPMFYGMYNVGAQAFGALTPDLLQQSIAHDGNYALANALGINMSPEAGVS
                  10         20         30         40         50         60

70         80         90        100        110        120
 m630.pep DKMLFGAIYFLPIYATVFVVGGFWEVLFATVRKHEINEGFFVTSILFALIVPPTLPLWQA
          |||||||||||||||||||:||||||||||:|||||||||||||||||||||||||||||
    g630  GKMLFGAIYFLPIYATVFIVGGFWEVLFASVRKHEINEGFFVTSILFALIVPPTLPLWQA
                  70         80         90        100        110        120

130        140        150        160        170        180
 m630.pep ALGISFGVVVAKEVFGGTGKNFMNPALAGRAFLFFAYPANLSGDAVWTAVDGYSGATALA
          ||||||||||||||||||||||||||||||||||||||||||||||||||||||||||||
    g630  ALGISFGVVVAKEVFGGTGKNFMNPALAGRAFLFFAYPANLSGDAVWTAVDGYSGATALA
                 130        140        150        160        170        180

190        200        210        220        230        240
 m630.pep QWAAHGADGLKNAVTGQTITWMDAFIGKLPGSIGEVSTLALLIGGAFIVFARIASWRIIA
          ||||||||||||||||||||||||||||||||||||||||||||||||||||||||||||
    g630  QWAAHGADGLKNAVTGQTITWMDAFIGKLPGSIGEVSTLALLIGGAFIVFARIASWRIIA
                 190        200        210        220        230        240

250        260        270        280        290        300
 m630.pep GVMIGMIAMSSLFNFIGSDTNAMFAMPWYWHLVVGGFAIGMLFMATDPVSASFTNVGKWW
          ||||||||||:|||||||:|||||    |||:||| ||| |
    g630  GVMIGMIAMSSLINFIGSDTKAMFAM----HLVHGTWWKDDYHSLYIK•
                 250        260        270        280

310        320        330        340        350
 m630.pep YGALIGVMCVLIRVVNPAYPEGMMLAILFANLFAPIFDYFVAQANIKRRKARSNGX
```

The following partial DNA sequence was identified in *N. meningitidis* <SEQ ID 2031>:

```
a630.seq
     1 ATGATGATTT TGGTGTGGCT GGCTTTGTTC CCTGCCATGT TCTACGGTAT
    51 GTACAACGTC GGCGCACAGG CATTCGGTGC GTTAACGCCC GATTTGCTGC
   101 AACAAAGCAT CGCCAACGAC TGGCATTACG CCCTTGCCAA CGCTTTGGGC
   151 ATCAATATGT CGTCTGAAGC GGGCGTGTTG GGCAAAATGC TGTTCGGCGC
   201 GATTTACTTC CTGCCGATTT ACGCGACCGT ATTTATTGTC GGCGGTTTCT
   251 GGGAAGTTTT GTTCGCCACC GTGCGCAAAC ATGAAATCAA CGAAGGTTTC
   301 TTTGTTACCT CGATTCTGTT TGCCTTAATC GTTCCGCCCA CGCTGCCGCT
   351 GTGGCAGGCA GCTTTGGGTA TTTCTTTCGG CGTTGTGGTT GCGAAAGAAG
   401 TATTCGGCGG TACAGGTAAA AACTTCATGA ACCCTGCGCT GGCAGGCCGT
   451 GCCTTCCTGT TCTTCGCCTA CCCTGCCAAC TTGAGCGGCG ATGCGGTTTG
   501 GACGGCGGTT GACGGCTATT CCGGCGCAAC CGCGCTGGCG CAATGGGCGG
   551 CACACGGTGC AGACGGCCTG AAAAACGCCA TAACCGGTCA AACCATCACT
   601 TGGATGGATG CGTTTATCGG CAAACTGCCC GGCTCCATCG GCGAAGTCTC
   651 CACTTTGGCA CTCTTAATCG GCGGCGCGTT TATCGTGTTT GCCCGCATCG
   701 CTTCTTGGCG CATTATTGCC GGCGTGATGA TCGGTATGAT TGCCATGTCT
   751 TCGCTGTTCA ACTTCATCGG TTCGGACACC AACGCTATGT TTGCTATGCC
   801 TTGGTACTGG CATTTGGTCG TCGGCGGCTT CGCCATCGGT ATGCTGTTTA
   851 TGGCGACCGA CCCCGTTTCC GCTTCCTTTA CCAATGTCGG CAAATGGTGG
   901 TACGGCGCAC TGATCGGTGT GATGTGCGTA TTAATCCGCG TGGTCAATCC
   951 GGCTTACCCC GAAGGCATGA TGTTGGCGAT TCTGTTTGCC AACCTGTTTG
  1001 CCCCGATTTT CGACTATTTC GTCGCACAAG CGAACATCAA ACGCAGAAAG
  1051 GCGCGCAGCA ATGGCTAA
```

This corresponds to the amino acid sequence <SEQ ID 2032; ORF 630.a>:

```
a630.pep

1 MMILVWLALF PAMFYGMYNV GAQAFGALTP DLLQQSIAND WHYALANALG
    51 INMSSEAGVL GKMLFGAIYF LPIYATVFIV GGFWEVLFAT VRKHEINEGF
   101 FVTSILFALI VPPTLPLWQA ALGISFGVVV AKEVFGGTGK NFMNPALAGR
   151 AFLFFAYPAN LSGDAVWTAV DGYSGATALA QWAAHGADGL KNAITGQTIT
   201 WMDAFIGKLP GSIGEVSTLA LLIGGAFIVF ARIASWRIIA GVMIGMIAMS
   251 SLFNFIGSDT NAMFAMPWYW HLVVGGFAIG MLFMATDPVS ASFTNVGKWW
   301 YGALIGVMCV LIRVVNPAYP EGMMLAILFA NLFAPIFDYF VAQANIKRRK
   351 ARSNG*
```

```
m630/a630  98.3% identity in 355 aa overlap 10        20        30        40        50        60
m630.pep   MMILVWLALFPAMFYGMYNVGAQAFGALTPDLLQQNIANDWHYAFANALGINMSSEAGVS
           ||||||||||||||||||||||||||||||||||||:||||||||:||||||||||||||
a630       MMILVWLALFPAMFYGMYNVGAQAFGALTPDLLQQSIANDWHYALANALGINMSSEAGVL
                    10        20        30        40        50        60
```

```
              70         80         90        100        110        120
m630.pep  DKMLFGAIYFLPIYATVFVVGGFWEVLFATVRKHEINEGRRVTSILFALIVPPTLPLWQA
          ||||||||||||||||:|||||||||||||||||||||||||||||||||||||||||||
a630      GKMLFGAIYFLPIYATVFIVGGFWEVLFATVRKHEINEGRRVTSILFALIVPPTLPLWQA
              70         80         90        100        110        120

130        140        150        160        170        180
m630.pep  ALGISFGVVVAKEVFGGTGKNFMNPALAGRAFLFFAYPANLSGDAVWTAVDGYSGATALA
          ||||||||||||||||||||||||||||||||||||||||||||||||||||||||||||
a630      ALGISFGVVVAKEVFGGTGKNFMNPALAGRAFLFFAYPANLSGDAVWTAVDGYSGATALA
             130        140        150        160        170        180

190        200        210        220        230        240
m630.pep  QWAAHGADGLKNAVTGQTITWMDAFIGKLPGSIGEVSTLALLIGGAFIVFARIASWRITA
          ||||||||||||:|||||||||||||||||||||||||||||||||||||||||||||||
a630      QWAAHGADGLKNAITGQTITWMDAFIGKLPGSIGEVSTLALLIGGAFIVFARIASWRIIA
             190        200        210        220        230        240

250        260        270        280        290        300
m630.pep  GVMIGMIAMSSLFNFIGSDTNAMFAMPWYWHLVVGGFAIGMLFMATDPVSASFTNVGKWW
          ||||||||||||||||||||||||||||||||||||||||||||||||||||||||||||
a630      GVMIGMIAMSSLFNFIGSDTNAMFAMPWYWHLVVGGFAIGMLFMATDPVSASFTNVGKWW
             250        260        270        280        290        300

310        320        330        340        350
m630.pep  YGALIGVMCVLIRVVNPAYPEGMMLAILFANLFAPIFDYFVAQANIKRRKARSNGX
          |||||||||||||||||||||||||||||||||||||||||||||||||||||||
a630      YGALIGVMCVLIRVVNPAYPEGMMLAILFANLFAPIFDYFVAQANIKRRKARSNGX
             310        320        330        340        350
```

The following partial DNA sequence was identified in *N. gonorrhoeae* <SEQ ID 2033>:

```
g635.seq
   1 ATGACCCGGC GACGGGTCGG CAAGCAAAAC CGTATTGCCA TCCACTCCGC

51 GCAATACCGA AAAATGGTCG TCTTTGCGGT ATTTCAGATA CACGATGACG

101 GGGATTTTCA ACTGCGCGAG CTGTTCGAAA GACAGGGCAT AGCCTTTCGC

151 CTCAAAACCC AAATCGGGCA TAATGCGCCG CATATCCTCA AACGACGCGC

201 GCATCTGTTC CTTACCCAGT TTTTCCAACA CTTCTTCTTC CGTCAGCTTT

251 TGCCCGTAAA AATTGTTCAA AAGCGTCGCC ACCGAAGCCG CCCCGCAGGA

301 AAAATCCAAA TCCTGCTTTA CAATATTGAA ATCCCGCCGC GCTTTCCAAC

351 TCTGCAATTT GATTTTTCCG TAAACAACAG GATTATCGTT AAACATCGGT

401 GCAGCATTCA AACGATAAGA CAAGGGTCTG TACCAGATTA G
```

This corresponds to the amino acid sequence <SEQ ID 2034; ORF 635.ng>:

```
g635.pep
   1 MTRRRVGKQN RIAIHSAQYR KMVVFAVFQI HDDGDFQLRE LFERQGIAFR

51 LKTQIGHNAP HILKRRAHLF LTQFFQHFFF RQLLPVKIVQ KRRHRSRPAG

101 KIQILLYNIE IPPRFPTLQF DFSVNNRIIV KHRCSIQTIR QGSVPD*
```

The following partial DNA sequence was identified in *N. meningitidis* <SEQ ID 2035>:

```
m635.seq
   1 ATGACCCAGC GACGGGTCGG CAAGCAAAAC CGTATTGCCG TCTATACCGC

51 GCAATACCGA GAAATGATCA TCCTTGCGGT ATTTCAGATA CACGATGACG

101 GGGATTTGCA ACTGTGCAAG CTGCTCGAAA GACAGGGCAT AGCCTTTCGC

151 TTCAAAACCC AAATCAGGCA TAATGCGCCG CATATCCTCA AACGACGCGG

201 GCATCTGCTC CTTATCCAGT TTTTTAACA CGTCCTCTTC CGTCAGCTTT
```

```
251 TGCCCGTAAA AATTGTTCAA AAGCGTCACC ACCGAAGCCG CCCCGCAGGA

301 AAAATCCAAA TCCTGCTTTA CAATATTGAA ATCGCGCCTT TCTTTCCAAC

351 TCTGCACTTT GATTTTCCA TAAGCAACAG GATTATAGTG GATTAA
```

This corresponds to the amino acid sequence <SEQ ID 2036; ORF 635>:

```
m635.pep
      1 MTQRRVGKQN RIAVYTAQYR EMIILAVFQI HDDGDLQLCK LLERQGIAFR
     51 FKTQIRHNAP HILKRRGHLL LIQFF*HVLF RQLLPVKIVQ KRHHRSRPAG
    101 KIQILLYNIE IAPFFPTLHF DFSISNRIIV D*
m635/g635 80.0% identity in 130 aa overlap
                  10         20         30         40         50         60
m635.pep    MTQRRVGKQNRIAVYTAQYREMIILAVFQIHDDGDLQLCKLLERQGIAFRFKTQIRHNAP
            ||:|||||||||:::||||:|:::|||||||||||:||  :|:||||||||:||||  ||||
g635        MTRRRVGKQNRIAIHSAQYRKMVVFAVFQIHDDGDFQLRELFERQGIAFRLKTQIGHNAP
                  10         20         30         40         50         60
                  70         80         90        100        110        120
m635.pep    HILKRRGHLLLIQFFXHVLFRQLLPVKIVQKRHHRSRPAGKIQILLYNIEIAPFFPTLHF
            ||||||:||:| ||| | :||||||||||||:|||||||||||||||||||| | ||||:|
g635        HILKRRAHLFLTQFFQHFFFRQLLPVKIVQKRRHRSRPAGKIQILLYNIEIPPRFPTLQF
                  70         80         90        100        110        120
                 130
m635.pep    DFSISNRIIVDX
            |||::|||||
g635        DFSVNNRIIVKHRCSIQTIRQGSVPDX
                 130        140
```

The following partial DNA sequence was identified in *N. meningitidis* <SEQ ID 2037>:

```
a635.seq
  1 ATGACCCAGC GACGGGTCGG CAAGCAAAAC CGTATTGCCG TCTATACCGC

51 GCAATACCGA GAAATGATCA TCCTTGCGGT ATTTCAGATA CACGATGACG

101 GGGATTTGCA ACTGTGCAAG CTGCTCGAAA GACAGGGCAT AGCCTTTCGC

151 CTCAAAACCC AAATCAGGCA TGATGCGCCG CATATCCTCA AACGACGCGC

201 GCATCTGCTC CTTATCCAGC TTTTTCAACA CGTCCTCTTC CGTCAGCTTT

251 TGCCCGTGAA AATTGTTCAA AAGCGTCGCC ACCGAAGCCG CCCCGCAGGA

301 AAAATCCAAA TCCTGCTTTA CAATATTGAA ATCGCGCCTT TCTTTCCAAC

351 TCTGCACTTT GATTTTCCA TAAGCAACAG GATTATAGTG GATTAA
```

This corresponds to the amino acid sequence <SEQ ID 2038; ORF 635.a>:

```
a635.pep
      1 MTQRRVGKQN RIAVYTAQYR EMIILAVFQI HDDGDLQLCK LLERQGIAFR
     51 LKTQIRHDAP HILKRRAHLL LIQLFQHVLF RQLLPVKIVQ KRRHRSRPAG
    101 KIQILLYNIE IAPFFPTLHF DFSISNRIIV D*
m635/a635 95.4% identity in 131 aa overlap
```

```
              10         20         30         40         50         60
m635.pep   MTQRRVGKQNRIAVYTAQYREMIILAVFQIHDDGDLQLCKLLERQGIAFRFKTQIRHNAP
           |||||||||||||||||||||||||||||||||||||||||||||||:||||||:||
a635       MTQRRVGKQNRIAVYTAQYREMIILAVFQIHDDGDLQLCKLLERQGIAFRLKTQIRHDAP
              10         20         30         40         50         60

70         80         90        100        110        120
m635.pep   HILKRRGHLLLIQFFXHVLFRQLLPVKIVQKRHHRSRPAGKIQILLYNIEIAPFFPTLHF
           ||||||:||||||:| |||||||||||||||||:||||||||||||||||||||||||||
a635       HILKRRAHLLLIQLFQHVLFRQLLPVKIVQKRRHRSRPAGKIQILLYNIEIAPFFPTLHF
              70         80         90        100        110        120

130
m635.pep   DFSISNRIIVDX
           ||||||||||||
a635       DFSISNRIIVDX
             130
```

The following partial DNA sequence was identified in *N. gonorrhoeae* <SEQ ID 2039>:

```
g638.seq
   1 ATGATTGGCG ACAGTTTAT CGTAGttgGc atTGTAGGCA AAACGCACT

51 TGCCCGCTTT GTTGATAATA ttgtcGTGAA TAtcGGAATA GTTGACATAG

101 TTGAGCATGA TGCCCTAATC GCGGCTGCCG ACGGCGATAT TGTCGAACAC

151 TTTGAGCCGT TCGGAAAACA TCAGCACATA GCCCATATTG TtgcCCACGG

201 AAATATTGCC GCTGacttcg ctgtcgTTGG TGTACATATA GTGGACGGCG

251 AAACGCAGGT CGCTGAAGCG GTTGTTTTTA TAGGTGTTGT GCGTGCTGGT

301 ATTGGAAAAA ATGCCGTCCC GCCCTTTGGA AATGTCGTTG ccgACGACCT

351 GCGCgccggg CgcgtTCCAA ACGGTAACGC CATTGCCGCG CTCATTCACG

401 CGCAAGGTcg catcgCCGAC GATTTTATTC TCGCGCACCA TCGCATCGGC

451 AGAACCATGA AGGTATACGC CGAACGAATT ATCAAAAATA TTGTTGTGTT

501 CAACCAGGGC GCGCGGGGCG GCTTTTTCGA GATAAATACC GGCATCCATT

551 GCTGGCAGGC TCATACCGGA ACGGGTAACG GTCAGGTTGC GGAGCGTTAC

601 GTCCGGCGCG TGTACGGCTA TGGTACGCCC GCTCTTGTCC CCTTCGATGG

651 TTGCGGAACG GTCGGCAGGC CCTTCAATCG TAATCGGTTT GTCGATATAA

701 AGTTTGGTTT GATATACGCC GGAAGCCAGT TTGATCGTAT CGCCCGCCCG

751 GGCGCGGGCA AAAATTTCGG CAAGGTTGTC TTGCGGGGAA ACGTGGACGA

801 CGGCTGCCGA TGCCGTCTGA AAAATGCTGC CGGCGGCAAG TATCAGCACG

851 GCCTTCAGCC ATATACGGAG CGCGGATGTG TGCATAGTGT CCCTCTGTTT

901 CGTTCGGTAT GGCCGAACAA AATAAAGCAT CATTCAAATG TGCCTGTTTT

951 TATAGCGAAA CCGCCTGAAA CGGTACGGCA AGCGGTTTGG CTATAA
```

This corresponds to the amino acid sequence <SEQ ID 2040; ORF 638.ng>:

```
g638.pep
   1 MIGGQFIVVG IVGKNALARF VDNIVVNIGI VDIVEHDALI AAADGDIVEH

51 FEPFGKHQHI AHIVAHGNIA ADFAVVGVHI VDGETQVAEA VVFIGVVRAG

101 IGKNAVPPFG NVVADDLRAG RVPNGNAIAA LIHAQGRIAD DFILAHHRIG
```

-continued

```
151 RTMKVYAERI IKNIVVFNQG ARGGFFEINT GIHCWQAHTG TGNGQVAERY

201 VRRVYGYGTP ALVPFDGCGT VGRPFNRNRF VDIKFGLIYA GSQFDRIARP

251 GAGKNFGKVV LRGNVDDGCR CRLKNAAGGK YQHGLQPYTE RGCVHSVPLF

301 RSVWPNKIKH HSNVPVFIAK PPETVRQAVW L*
```

The following partial DNA sequence was identified in *N. meningitidis* <SEQ ID 2041>:

```
m638.seq
  1 ATGATTGGCG AAAAGTTTAT CGTAGTTGGC ATTATAGGCA AATACGCACT

51 TGCCTGCCTT GTTGATAATG TTGTCGTGAA TATCGGAATA GTTGACATAG

101 TTGAGCATAA TGCCCTGATC GCGGCTGCCG ACGGCGATAT TGTCGAATAC

151 TTTGAGCCGC TCGGAAAACA TCAGCACATA GCCCATATTG TTGCCCACGG

201 AAATATTGCC GCTGATTTCG CTGTCGTTGG TGTACATATA GTGGACGGCG

251 AAACGCAAAT CGCTGAAGCG GTTGTTTTTG TAGGTGTTGT GCGTGCTGGT

301 ATTGGAAAAA ATGCCGTCCC GCCCTTTGGA AATGTCGTTG CCGACGACCT

351 GCGCACCGGG TGCGTTCCAA ACGGTAACGC CGTTGCCGCG CTCGTTCACG

401 CGCAAAGTCG CGTCGCCGAC GATTTTATTC TCGCGCACCA TCGCATCGGC

451 AGAACCATGC AGATATACGC CGACCGAATT ATCCAAAATA TTGTTGTGTT

501 CAATCAGGGC GCGCGGGGCA GTTTCTTCGA GATAAATACC GGCATCCATT

551 GCGGGCAGGC TCATACCGGA ACGGGTAACG GTCAGGTTGC GGAGCGTTAC

601 GTCCGGCGCG TGTACGGCTA TGGTACGCCC GCTCCTGTCG CCTTCGATGG

651 TTGCGGAACG GTCGGCAGGC CCTTCAATCG TAATCGGTTT GTCAATGTGA

701 AGTTTGGTTT TATATACGCC GGAAGCCAGT TTGAGCGTAT CGCCCGCCCG

751 GGCGCGGGCA AATGCGGGAT ACCGATCAGC ATAATCGGTT CGTGA
```

This corresponds to the amino acid sequence <SEQ ID 2042; *ORF 638*>:

```
m638.pep
    1 MIGEKFIVVG IIGKYALACL VDNVVVNIGI VDIVEHNALI AAADGDIVEY

51 FEPLGKHQHI AHIVAHGNIA ADFAVVGVHI VDGETQIAEA VVFVGVVRAG

101 IGKNAVPPFG NVVADDLRTG CVPNGNAVAA LVHAQSRVAD DFILAHHRIG

151 RTMQIYADRI IQNIVVFNQG ARGSFFEINT GIHCGQAHTG TGNGQVAERY

201 VRRVYGYGTP APVAFDGCGT VGRPFNRNRF VNVKFGFIYA GSQFERIARP

251 GAGKCGIPIS IIGS*
```

```
m638/g638 88.2% identity in 254 aa overlap 10        20        30        40        50        60
      m638.pep   MIGEKFIVVGIIGKYALACLVDNVVVNIGIVDIVEHNALIAAADGDIVEYFEPLGKHQHI
                 ||| :||||||:|| ||| :|||:|||||||||||||:||||||||||||:|||:||||||
      g638       MIGGQFIVVGIVGKNALARFVDNIVVNIGIVDIVEHDALIAAADGDIVEHFEPFGKHQHI
                 10        20        30        40        50        60

70        80        90       100       110       120
      m638.pep   AHIVAHGNIAADFAVVGVHIVDGETQIAEAVVFVGVVRAGIGKNAVPPFGNVVADDLRTG
                 ||||||||||||||||||||||||||:||||||:||||||||||||||||||||||||:|
      g638       AHIVAHGNIAADFAVVGVHIVDGETQVAEAVVFIGVVRAGIGKNAVPPFGNVVADDLRAG
                 70        80        90       100       110       120
```

```
                130       140       150       160       170       180
m638.pep    CVPNGNAVAALVHAQSRVADDFILAHHRIGRTMQIYADRIIQNIVVFNQGARGSFFEINT
            ||||||:|||:|||:|:||||||||||||||||::||:|||||||||||||||||:|||||
g638        RVPNGNAIAALIHAQGRIADDFILAHHRIGRTMKVYAERIIKNIVVFNQGARGGFFEINT
                130       140       150       160       170       180

190       200       210       220       230       240
m638.pep    GIHCGQAHTGTGNGQVAERYVRRVYGYGTPAPVAFDGCGTVGRPFNRNRFVNVKFGFIYA
            ||||  ||||||||||||||||||||||||||  |  |||||||||||||||::|||:|||
g638        GIHCWQAHTGTGNGQVAERYVRRVYGYGTPALVPFDGCGTVGRPFNRNRFVDIKFGLIYA
                190       200       210       220       230       240

250       260
m638.pep    GSQFERIARPGAGKCGIPISIIGSX
            ||||:|||||||||
g638        GSQFDRIARPGAGKNFGKVVLRGNVDDGCRCRLKNAAGGKYQHGLQPYTERGCVHSVPLF
                250       260       270       280       290       300
```

The following partial DNA sequence was identified in *N. meningitidis* <SEQ ID 2043>:

```
a638.seq
   1 ATGATTGGCG GACAGTTTAT CGTAGTTGGC ATTGTAGGCA AAAACGCACT

51 TGCCCGCTTT GTTGATAATG TTGTCGTGAA TATCGGAATA GTTGACATAG

101 TTGAGCATGA TGCCTTGGTC GCGGCTGCCG ACGGCGATAT TGTCAAACAC

151 TTTGAGCCGC TCGGAAAACA TCAGCACATA GCCCATATTG TTGCCCACGG

201 AAATATTGCC GCTGATTTCG CTGTCGTTGG TGTACATATA GTGGACGGCG

251 AAACGCAAAT CGCTGAAGCG GTTGTTTTTA TAGGTGTTGT GCGTGCTGGT

301 ATTGGAAAAA ATGCCGTCCC GCCCTTTGGA AATATCGTTG CCGACGACCT

351 GCGCGCCGGG CGCGTTCCAA ACGGTAACGC CATTGCCGCG CTCGTTCACG

401 CGCAAAGTCG CGTCGCCGAC GATTTTATTC TCCCGCACCA TCGCATCGGC

451 AGAACCATGC AGATAGACGC CGACCGAATT ATCCAAAATA TTATTGTGTT

501 CAATCAGGGC GCGCGGGGCA GTTTCTTCGA GATAAATACC GGCATCCATT

551 GCGGGCAGGC TCATACCGGA ACGGGTAACG GTCAGGTTGC GGAGCGTTAC

601 GTCCGGCGCG TGTACGGCTA TGGTACGCCC GCTCCTGTCT CCTTCGATGG

651 TTGCAGAACG GTCGGCAGGC CCTTCAATCG TAATCGGTTT GTCGATGTGA

701 AGTTTGGTTT GATATACGCC GGAAGCCAGT TTGAGCGTAT CGCCCGCCCG

751 GGCGCGGGCA AATGCGGGAT ACCGATCAGC ATAATCGACT CATGGTGA
```

This corresponds to the amino acid sequence <SEQ ID 2044; *ORF* 638.a>:

```
m638.pep

1 MIGGQFIVVG IVGKNALARF VDNVVVNIGI VDIVEHDALV AAADGDIVKH

51 FEPLGKHQHI AHIVAHGNIA ADFAVVGVHI VDGETQIAEA VVFIGVVRAG

101 IGKNAVPPFG NIVADDLRAG RVPNGNAIAA LVHAQSRVAD DFILPHHRIG

151 RTMQIDADRI IQNIIVFNQG ARGSFFEINT GIHCGQAHTG TGNGQVAERY

201 VRRVYGYGTP APVSFDGCRT VGRPFNRNRF VDVKFGLIYA GSQFERIARP

251 GAGKCGIPIS IIDSW* m638/a638  91.3%% identity in 264 aa overlap
```

```
                    10         20         30         40         50         60
m638.pep    MIGEKFIVVGIIGKYALACLVDNVVVNIGIVDIVEHNALIAAADGDIVEYFEPLGKHQHI
            ||| :|||||| :|||  :|||||||||||||||||:||:|||||||||:::||||||||
a638        MIGGQFIVVGIVGKNALARFVDNVVVNIGIVDIVEHDALVAAADGDIVKHFEPLGKHQHI
                    10         20         30         40         50         60

70         80         90        100        110        120
m638.pep    AHIVAHGNIAADFAVVGVHIVDGETQIAEAVVFVGVVRAGIGKNAVPPFGNVVADDLRTG
            ||||||||||||||||||||||||||||||||||:||||||||||||||||||:||||||:|
a638        AHIVAHGNIAADFAVVGVHIVDGETQIAEAVVFIGVVRAGIGKNAVPPFGNIVADDLRAG
                    70         80         90        100        110        120

130        140        150        160        170        180
m638.pep    CVPNGNAVAALVHAQSRVADDFILAHHRIGRTMQIYADRIIQNIVVFNQGARGSFFEINT
            ||||||:||||||||||||||| |||||||||| ||||||||:|||||||||||||||||
a638        RVPNGNAIAALVHAQSRVADDFILPHHRIGRTMQIDADRIIQNIIVFNQGARGSFFEINT
                   130        140        150        160        170        180

190        200        210        220        230        240
m638.pep    GIHCGQAHTGTGNGQVAERYVRRVYGYGTPAPVAFDGCGTVGRPFNRNRFVNVKFGFIYA
            |||||||||||||||||||||||||||||||||||:|||| |||||||||||:||||:|||
a638        GIHCGQAHTGTGNGQVAERYVRRVYGYGTPAPVSFDGCRTVGRPFNRNRFVDVKFGLIYA
                   190        200        210        220        230        240

250        260
m638.pep    GSQFERIARPGAGKCGIPISIIGSX
            |||||||||||||||||||||| |
a638        GSQFERIARPGAGKCGIPISIIDSWX
                   250        260
```

The following partial DNA sequence was identified in *N. gonorrhoeae* <SEQ ID 2045>:

```
g639-1.seq
   1  ATGAGCCTGC CAGCAATGGA TGCCGGTATT TATCTCGAAA AAGCCGCCCC

51  GCGCGCCCTG GTTGAACACA CAATATTTT TGATAATTCG TTCGGCGTAT

101  ACCTTCATGG TTCTGCCGAT GCGATGGTGC GCGAGAATAA AATCGTCGGC

151  GATGCGACCT TGCGCGTGAA TGAGCGCGGC AATGGCGTTA CCGTTTGGAA

201  CGCGCCCGGC GCGCAGGTCG TCGGCAACGA CATTTCCAAA GGGCGGGACG

251  GCATTTTTTC CAATACCAGC ACGCACAACA CCTATAAAAA CAACCGCTTC

301  AGCGACCTGC GTTTCGCCGT CCACTATATG TACACCAACG ACAGCGAAGT

351  CAGCGGCAAT ATTTCCGTGG CAACAATAT GGGCTATGTG CTGATGTTTT

401  CCGAACGGCT CAAAGTGTTC GACAATATCG CCGTCGGCAG CCGCGATTAG

451  GGCATCATGC TCAACTATGT CAACTATTCC GATATTCACG ACAATATTAT

501  CAACAAAGCG GGCAAGTGCG TTTTTGCCTA CAATGCCAAC TACGATAAAC

551  TGTCCGCCAA TCATTTTGAA AACTGCCAAA TCGGCATGCA CTTTACCGCC

601  GCCATCGAAG GCACGTCCCT GCACGACAAT TCCTTTATCA CAACGGAAG

651  CCAGGTCAAA TATGTCAGTA CGCGCTTTCT CGACTGGAGC GAGGGCGGAC

701  ACGGCAACTA CTGGAGCGAC AACAGCCCGT TCGATTTGAA CGGCGACGGC

751  TTCGGAGACA CGCGTACCG TCCCGACGGC ATCATCGACC AAATCATCTG

801  GCGCGCGCCC GTATCGCGCC TCTTGATGAA CAGTCCCGCA ATCAGCATCG

851  TCAAATGGGC GCAGGCGCAG TTTCCCGCCG TTCTGCCCGG CGGCGTGGTG

901  GACAGCAAAC CGCTGATGAA GCCTTATGCC CCCAAAATTC AAACCCGTTA
```

```
 951 TCAGGCGATG AAGGACGAGT TGCTCAAAGA AGCCGAAACG CGGCAGTCGG

1001 AACGGGCAG  GGCGGAAAAC GGTTCTTTGA ACTAG
```

This corresponds to the amino acid sequence <SEQ ID 2046; *ORF* 639-1.ng>:

```
g639-1.pep
    1 MSLPAMDAGI YLEKAAPRAL VEHNNIFDNS FGVYLHGSAD AMVRENKIVG

51 DATLRVNERG NGVTVWNAPG AQVVGNDISK GRDGIFSNTS THNTYKNNRF

101 SDLRFAVHYM YTNDSEVSGN ISVGNNMGYV LMFSERLKVF DNIAVGSRD*

151 GIMLNYVNYS DIHDNIINKA GKCVFAYNAN YDKLSANHFE NCQIGMHFTA

201 AIEGTSLHDN SFINNGSQVK YVSTRFLDWS EGGHGNYWSD NSPFDLNGDG

251 FGDSAYRPDG IIDQIIWRAP VSRLLMNSPA ISIVKWAQAQ FPAVLPGGVV

301 DSKPLMKPYA PKIQTRYQAM KDELLKEAET RQSERGRAEN GSLN*
```

The following partial DNA sequence was identified in *N. meningitidis* <SEQ ID 2047>:

```
m639-1.seq
    1 ATGAGCCTGC CCGCAATGGA TGCCGGTATT TATCTCGAAG AAACTGCCCC

51 GCGCGCCCTG ATTGAACACA ACAATATTTT GGATAATTCG GTCGGCGTAT

101 ATCTGCATGG TTCTGCCGAT GCGATGGTGC GCGAGAATAA AATCGTCGGC

151 GACGCGACTT TGCGCGTGAA CGAGCGCGGC AACGGCGTTA CCGTTTGGAA

201 CGCACCCGGT GCGCAGGTCG TCGGCAACGA CATTTCCAAA GGGCGGGACG

251 GCATTTTTTC CAATACCAGC ACGCACAACA CCTACAAAAA CAACCGCTTC

301 AGCGATTTGC GTTTCGCCGT CCACTATATG TACACCAACG ACAGCGAAAT

351 CAGCGGCAAT ATTTCCGTGG GCAACAATAT GGGCTATGTG CTGATGTTTT

401 CCGAGCGGCT CAAAGTATTC GACAATATCG CCGTCGGCAG CCGCGATCAG

451 GGCATTATGC TCAACTATGT CAACTATTCC GATATTCACG ACAACATTAT

501 CAACAAGGCA GGCAAGTGCG TATTTGCCTA TAATGCCAAC TACGATAAAC

551 TTTTCGCCAA TCATTTTGAA AACTGTCAAA TCGGCATACA CTTTACCGCC

601 GCCATCGAAG GCACGTCCTT GCATGACAAT TCCTTTATCA ACAACGAAAG

651 CCAGGTCAAA TACGTCAGCA CGCGCTTTCT CGATTGGAGC GAGGGCGGAC

701 ACGGCAACTA TTGGAGCGAC AACAGCGCGT TCGATTTGAA CGGCGACGGC

751 TTCGGAGACA GCGCGTACCG CCCCAACGGC ATCATCGACC AAATCATCTG

801 GCGCGCGCCC GTATCGCGCC TTTTGATGAA CAGTCCCGCA ATCAGCATCG

851 TCAAATGGGC GCAGGCGCAG TTTCCCGCCG TTCTGCCTGG CGGCGTGGTG

901 GACAGCAAAC CGCTGATGAA GCCTTATGCC CCCAAAATTC AAACCCGTTA

951 TCAGGCGATG AAGGACGAGC TACTCAAAGA AGTCGAAACG CGGCAGTCGG

1001 AATGGGGCAG GGCGGAAAAC GGTTCTTTGA ACTAG
```

This corresponds to the amino acid sequence <SEQ ID 2048; ORF 639-1>:

```
m639-1.pep

1 MSLPAMDAGI YLEETAPRAL IEHNNILDNS VGVYLHGSAD AMVRENKIVG

51 DATLRVNERG NGVTVWNAPG AQVVGNDISK GRDGIFSNTS THNTYKNNRF

101 SDLRFAVHYM YTNDSEISGN ISVGNNMGYV LMFSERLKVF DNIAVGSRDQ

151 GIMLNYVNYS DIHDNIINKA GKCVFAYNAN YDKLFANHFE NCQIGIFHTA

201 AIEGTSLHDN SFINNESQVK YVSTRFLDWS EGGHGNYWSD NSAFDLNGDG

251 FGDSAYRPNG IIDQIIWRAP VSRLLMNSPA ISIVKWAQAQ FPAVLPGGVV

301 DSKPLMKPYA PKIQTRYQAM KDELLKEVET RQSEWGRAEN GSLN* g639-1/m639-1 95.9% identity in 344 aa overlap
                  10         20         30         40         50         60
g639-1.pep  MSLPAMDAGIYLEKAAPRALVEHNNIFDNSFGVYLHGSADAMVRENKIVGDATLRVNERG
            ||||||||||||::||||:||||:|||||||||||||||||||||||||||||||||||
m639-1      MSLPAMDAGIYLEETAPRALIEHNNILDNSVGVYLHGSADAMVRENKIVGDATLRVNERG
                  10         20         30         40         50         60
                  70         80         90        100        110        120
g639-1.pep  NGVTVWNAPGAQVVGNDISKGRDGIFSNTSTHNTYKNNRFSDLRFAVHYMYTNDSEVSGN
            |||||||||||||||||||||||||||||||||||||||||||||||||||||||:|||
m639-1      NGVTVWNAPGAQVVGNDISKGRDGIFSNTSTHNTYKNNRFSDLRFAVHYMYTNDSEISGN
                  70         80         90        100        110        120
                 130        140        150        160        170        180
g639-1.pep  ISVGNNMGYVLMFSERLKVFDNIAVGSRDXGIMLNYVNYSDIHDNIINKAGKCVFAYNAN
            |||||||||||||||||||||||||||||||||||||||||||||||||||||||||||
m639-1      ISVGNNMGYVLMFSERLKVFDNIAVGSRDQGIMLNYVNYSDIHDNIINKAGKCVFAYNAN
                 130        140        150        160        170        180
                 190        200        210        220        230        240
g639-1.pep  YDKLSANHFENCQIGMHFTAAIEGTSLHDNSFINNGSQVKYVSTRFLDWSEGGHGNYWSD
            ||||:|||||||||||:|||||||||||||||||||:|||||||||||||||||||||||
m639-1      YDKLFANHFENCQIGIHFTAAIEGTSLHDNSFINNESQVKYVSTRFLDWSEGGHGNYWSD
                 190        200        210        220        230        240
                 250        260        270        280        290        300
g639-1.pep  NSPFDLNGDGFGDSAYRPDGIIDQIIWRAPVSRLLMNSPAISIVKWAQAQFPAVLPGGVV
            ||  |||||||||||||||:||||||||||||||||||||||||||||||||||||||||
m639-1      NSAFDLNGDGFGDSAYRPNGIIDQIIWRAPVSRLLMNSPAISIVKWAQAQFPAVLPGGVV
                 250        260        270        280        290        300
                 310        320        330        340
g639-1.pep  DSKPLMKPYAPKIQTRYQAMKDELLKEAETRQSERGRAENGSLNX
            |||||||||||||||||||||||||||:|||||| ||||||||||
m639-1      DSKPLMKPYAPKIQTRYQAMKDELLKEVETRQSEWGRAENGSLNX
                 310        320        330        340
```

The following partial DNA sequence was identified in *N. meningitidis* <SEQ ID 2049>:

```
a639-1.seq
    1 ATGAGCCTGC CCGCAATGGA TGCCGGTATT TATCTCGAAG AAACTGCCCC

51 GCGCGCCCTG ATTGAACACA ATAATATTTT GGATAATTCG GTCGGCGTCT

101 ATCTGCATGG TTCTGCCGAT GCGATGGTGC GGGAGAATAA AATCGTCGGC

151 GACGCGACTT TGCGCGTGAA CGAGCGCGGC AATGGCGTTA CCGTTTGGAA

201 CGCGCCCGGC GCGCAGGTCG TCGGCAACGA TATTTCCAAA GGGCGGGACG

251 GCATTTTTTC CAATACCAGC ACGCACAACA CCTATAAAAA CAACCGCTTC

301 AGCGATTTGC GTTTCGCCGT CCACTATATG TACACCAACG ACAGCGAAAT

351 CAGCGGCAAT ATTTCCGTGG GCAACAATAT GGGCTATGTG CTGATGTTTT

401 CCGAGCGGCT CAAAGTGTTT GACAATATCG CCGTCGGCAG CCGCGACCAA

451 GGCATCATGC TCAACTATGT CAACTATTCC GATATTCACG ACAACATTAT

501 CAACAAAGCG GGCAAGTGCG TTTTTGCCTA CAATGCCAAC TACGATAAAC

551 TGTCCGCCAA TCATTTTGAA AACTGCCAAA TCGGCATACA CTTTACCGCC
```

```
601 GCCATCGAAG GCACGTCCCT GCACGACAAT TCCTTTATCA ACAACGAAAG

651 CCAGGTCAAA TACGTCAGCA CGCGCTTTCT CGACTGGAGC GAGGGCGGAC

701 ACGGCAACTA TTGGAGCGAC AACAGCGCGT TCGATTTGAA CGGCGACGGC

751 TTCGGAGACA GCGCGTACCG TCCCAACGGC ATCATCGACC AAATCATCTG

801 GCGCGCACCC GTATCGCGCC TCTTGATGAA CAGTCCCGCA ATCAGCATCG

851 TCAAATGGGC GCAGGCGCAA TTTCCCGCCG TTTTGCCTGG CGGCGTGGTG

901 GACAGCAAAC CGCTGATGAA GCCTTATGCC CCCAAAATTC AAACCCGTTA

951 TCAGGCGATG AAGGACGGGC TGCTCAAAAA AGTCGAAACG CGGCAGTTGG

1001 AATGGGGCAG GGCGGAAAAC GGTTCTTTGA ACTAG
```

This corresponds to the amino acid sequence <SEQ ID 2050; *ORF* 639-1.a>:

```
a639-1.pep

1 MSLPAMDAGI YLEETAPRAL IEHNNILDNS VGVYLHGSAD AMVRENKIVG

51 DATLRVNERG NGVTVWNAPG AQVVGNDISK GRDGIFSNTS THNTYKNNRF

101 SDLRFAVHYM YTNDSEISGN ISVGNNMGYV LMFSERLKVF DNIAVGSRDQ

151 GIMLNYVNYS DIHDNIINKA GKCVFAYNAN YDKLSANHFE NCQIGIHFTA

201 AIEGTSLHDN SFINNESQVK YVSTRFLDWS EGGHGNYWSD NSAFDLNGDG

251 FGDSAYRPNG IIDQIIWRAP VSRLLMNSPA ISIVKWAQAQ FPAVLPGGVV

301 DSKPLMKPYA PKIQTRYQAM KDGLLKKVET RQLEWGRAEN GSLN* a639-1/m639-1 98.8% identity in 344 aa overlap 10         20         30         40         50         60
a639-1.pep  MSLPAMDAGIYLEETAPRALIEHNNILDNSVGVYLHGSADAMVRENKIVGDATLRVNERG
            ||||||||||||||||||||||||||||||||||||||||||||||||||||||||||||
m639-1      MSLPAMDAGIYLEETAPRALIEHNNILDNSVGVYLHGSADAMVRENKIVGDATLRVNERG
                  10         20         30         40         50         60

70         80         90        100        110        120
a639-1.pep  NGVTVWNAPGAQVVGNDISKGRDGIFSNTSTHNTYKNNRFSDLRFAVHYMYTNDSEISGN
            ||||||||||||||||||||||||||||||||||||||||||||||||||||||||||||
m639-1      NGVTVWNAPGAQVVGNDISKGRDGIFSNTSTHNTYKNNRFSDLRFAVHYMYTNDSEISGN
                  70         80         90        100        110        120

130        140        150        160        170        180
a639-1.pep  ISVGNNMGYVLMFSERLKVFDNIAVGSRDQGIMLNYVNYSDIHDNIINKAGKCVFAYNAN
            ||||||||||||||||||||||||||||||||||||||||||||||||||||||||||||
m639-1      ISVGNNMGYVLMFSERLKVFDNIAVGSRDQGIMLNYVNYSDIHDNIINKAGKCVFAYNAN
                 130        140        150        160        170        180

190        200        210        220        230        240
a639-1.pep  YDKLSANHFENCQIGIHFTAAIEGTSLHDNSFINNESQVKYVSTRFLDWSEGGHGNYWSD
            ||||||||||||||||||||||||||||||||||||||||||||||||||||||||||||
m639-1      YDKLSANHFENCQIGIHFTAAIEGTSLHDNSFINNESQVKYVSTRFLDWSEGGHGNYWSD
                 190        200        210        220        230        240

250        260        270        280        290        300
a639-1.pep  NSAFDLNGDGFGDSAYRPNGIIDQIIWRAPVSRLLMNSPAISIVKWAQAQFPAVLPGGVV
            ||||||||||||||||||||||||||||||||||||||||||||||||||||||||||||
m639-1      NSAFDLNGDGFGDSAYRPNGIIDQIIWRAPVSRLLMNSPAISIVKWAQAQFPAVLPGGVV
                 250        260        270        280        290        300

310        320        330        340
a639-1.pep  DSKPLMKPYAPKIQTRYQAMKDGLLKKVETRQLEWGRAENGSLNX
            |||||||||||||||||||||||||||||||||||||||||||||
m639-1      DSKPLMKPYAPKIQTRYQAMKDGLLKKVETRQLEWGRAENGSLNX
                 310        320        330        340
```

The following partial DNA sequence was identified in *N. gonorrhoeae* <SEQ ID 2051>:

```
g640.seq
    1 ATGATTCATA TAATATCAAT ATTAAAGAGT ATCGGTATAT CGGGGATAGC

51 TATGTCCTGT TTTTCAATCC GGCGTATGTC TGCGTTTCGG GCGCGGATAA

101 CGGCGTTTTT TACCGCCTTT GTCTTTTTGA CGGcggcACT GCCCGCTTAT

151 GcggAgcgTc tgcctGATTT TCTGgcgAAA ATacAgcctT CGGAAATTTT

201 TCCGGGTGCG GATCGTTACG GCAAGCCGGA aggcAAGCCT AtggtTGCCC

251 GCgtttACAA AGgcgATGAG CAGCTCGGTT TGGTTTATAT CACGACCGAT

301 GCGGTCAATA CGCGCGGTTA TTCGAGCAAA CCGATCGATA CGCTGATGGC

351 TTTGGCAAAC GACGGCACGA TAGCCGGGGC GAAACTGGTC GATCATCACG

401 AACCGATTAT GCTGATCGGT ATCCCGCAAT CGCGTGTCGA TAAGTTCATC

451 GACAAATATA TCGGTCTGAA TTTTATTAAA AATCCGCCGA CCCCGAGCGT

501 GGCGCCGGGC GACATCATCA GcggtGCGAC TgttaCACTG ATGGTGGTTA

551 ACGACAGCAT CCAGCGTTCG TACAAGGTCA TTGCCAACCA ATACCGTCTG

601 GGTTCGGACA AGGCCCTTCA GACGGCATCC GCTTCCGATG TTCGGGAAGC

651 CGCGCCTGCG TCAGAAACCC GTCCGCGCCG TATGGCAAAT CCCGACAAGC

701 AGGATATTTT GTCTTGGGAC GAACTTTTGA ACAAAAGGC CGTCGGCCAT

751 CTGCATATCA CGCTCGATCA AATCAACAAA CTGTTTGAGA AAGGCGGCAA

801 GGCCGGCGTG GCCGATCACG CCGAACAGGG CGATCCTGAC GATACCTTTA

851 TTGATTTGTA TGTTGCCTTG GTCAGCCAGC CTTCCATCGG TAAAAGCCTG

901 CTGGGTGAGG ACGGCTGGGC GCATCTGCAA AAACGGCTGA AACCCGGGCA

951 GCAGGCGGTT TTGGTTGCCG GAGAGGGCCG TTATTCTTGG AAAGGTTCGG

1001 GCTATGTGCG CGGCGGTATT TTCGACCGTA TCGAGATGAT TCAGGGGGAG

1051 AACAGCTTCC GTTTTACCGA TGCCCAACAC GAACGCGTCG TCGAGCTGTC

1101 TGCCGCCGAT GCGCCGCGTT TTAAAGAAGT TTCTTGGTTT ACCATCCCTG

1151 AAGGCGTAGC GTTTGACGGT GCGGAGCCGT GGCGGCTGTA A
```

This corresponds to the amino acid sequence <SEQ ID 2052; *ORF* 640.ng>:

```
g640.pep
    1 MIHIISILKS IGISGIAMSC FSIRRMSAFR ARITAFFTAF VFLTAALPAY

51 AERLPDFLAK IQPSEIFPGA DRYGKPEGKP MVARVYKGDE QLGLVYITTD

101 AVNTRGYSSK PIDTLMALAN DGTIAGAKLV DHHEPIMLIG IPQSRVDKFI

151 DKYIGLNFIK NPPTPSVAPG DIISGATVTL MVVNDSIQRS YKVIANQYRL

201 GSDKALQTAS ASDVREAAPA SETRPRRMAN PDKQDILSWD ELLKQKAVGH

251 LHITLDQINK LFEKGGKAGV ADHAEQGDPD DTFIDLYVAL VSQPSIGKSL

301 LGEDGWAHLQ KRLKPGQQAV LVAGEGRYSW KGSGYVRGGI FDRIEMIQGE

351 NSFRFTDAQH ERVVELSAAD APRFKEVSWF TIPEGVAFDG AEPWRL*
```

The following partial DNA sequence was identified in *N. meningitidis* <SEQ ID 2053>:

```
m640.seq (partial)
   1 ATGATTCATA TAATATCAAT ATTAAAGAGT ATCGGTATAT CGGGGATAGT

51 CATGTCCTGT TTTTCAATCA AACGTATGTC CGCGTTTCGG GCGCGGATAA

101 CGGCGTTTTT TGCCGCCTTT GTCTTTTTGA CGGCGGCACT GCCCGCTTAT

151 GCGGAGCGTC TGCCTGATTT TCTGGCGAAA ATACAGCCTT CGGAAATTTT

201 TCCGGGTGCG GACCGTTACG GCAAGCCGGA AGGTAAGCCT ATGGTTGCCC

251 GCGTTTACAA AGGCGATGAG CAGTTGGGCT TGGTCTATAT CACGACCGAT

301 GCGGTCAATA CGCGCGGTTA TTCGAGCAAA CCGATTGATA CGCTGATGGT

351 GTTGGCAAAC GACGGCACGA TAGCCGGGGC GAAACTGGTC GACCATCACG

401 AACCGATTAT GCTGATCGGT ATCCCGCAT...
```

This corresponds to the amino acid sequence <SEQ ID 2054; ORF 640>:

```
m640.pep (partial)
   1 MIHIISILKS IGISGIVMSC FSIKRMSAFR ARITAFFAAF VFLTAALPAY

51 AERLPDFLAK IQPSEIFPGA DRYGKPEGKP MVARVYKGDE QLGLVYITTD

101 AVNTRGYSSK PIDTLMVLAN DGTIAGAKLV DHHEPIMLIG IPH...
``` m640/g640 96.5% identity in 143 aa overlap

```
                    10         20         30         40         50         60
    m640.pep   MIHIISILKSIGISGIVMSCFSIKRMSAFRARITAFFAAFVFLTAALPAYAERLPDFLAK
               |||||||||||||||||:||||||:|||||||||||||:||||||||||||||||||||
    g640       MIHIISILKSIGISGIAMSCFSIRRMSAFRARITAFFTAFVFLTAALPAYAERLPDFLAK
                    10         20         30         40         50         60

70         80         90        100        110        120
    m640.pep   IQPSEIFPGADRYGKPEGKPMVARVYKGDEQLGLVYITTDAVNTRGYSSKPIDTLMVLAN
               ||||||||||||||||||||||||||||||||||||||||||||||||||||||||:||
    g640       IQPSEIFPGADRYGKPEGKPMVARVYKGDEQLGLVYITTDAVNTRGYSSKPIDTLMALAN
                    70         80         90        100        110        120

130        140
    m640.pep   DGTIAGAKLVDHHEPIMLIGIPH
               |||||||||||||||||||||:
    g640       DGTIAGAKLVDHHEPIMLIGIPQSRVDKFIDKYIGLNFIKNPPTPSVAPGDIISGATVTL
                   130        140        150        160        170        180
```

The following partial DNA sequence was identified in *N. meningitidis* <SEQ ID 2055>:

```
a640.seq (partial)
   1 ATGATTCATA TAATATCAAT ATTAAAGAGT ATCGGTATAT CGGGGATAGT

51 CATGTCCTGT TTTTCAATCA AACGTATGTC CGCGTTTCGG GCGCGGATAA

101 CGGCGTTTTT TGCCGCCTTT GTCTTTTTGA CGGCGGCACT GCCCGCTTAT

151 GCGGAGCGTC TGCCTGATTT TCTGGCGAAA ATACAGCCTT CGGAAATTGT

201 TCCGGGTGCG GACCGTTACA GCAAGCCGGA AGGTAAGCCT ATGGTTGCCC

251 GCGTTTACAA AGGCGATGAG CAGTTGGGCT TGGTCTATAT CACGACCGAT

301 GCGGTCAATA CGCGCGGTTA TTCGAGCAAA CCGATTGATA CGCTGATGGC

351 GTTGGCTAAA GACGGTACGA TAGCCGGAGC GAAATTGGTT GATCACCATG

401 AGTCGATTAT GCTGATCGGT ATCCCGCAT...
```

This corresponds to the amino acid sequence <SEQ ID 2056; ORF 640.a>:

```
a640.pep (partial) Length: 143
   1 MIHIISILKS IGISGIVMSC FSIKRMSAFR ARITAFFAAF VFLTAALPAY

51 AERLPDFLAK IQPSEIVPGA DRYSKPEGKP MVARVYKGDE QLGLVYITTD

101 AVNTRGYSSK PIDTLMALAK DGTIAGAKLV DHHESIMLIG IPH...
``` m640/a640 96.5% identity in 143 aa overlap

```
                    10         20         30         40         50         60
     m640.pep  MIHIISILKSIGISGIVMSCFSIKRMSAFRARITAFFAAFVFLTAALPAYAERLPDFLAK
               ||||||||||||||||||||||||||||||||||||||||||||||||||||||||||||
     a640      MIHIISILKSIGISGIVMSCFSIKRMSAFRARITAFFAAFVFLTAALPAYAERLPDFLAK
                    10         20         30         40         50         60

70         80         90        100        110        120
     m640.pep  IQPSEIFPGADRYGKPEGKPMVARVYKGDEQLGLVYITTDAVNTRGYSSKPIDTLMVLAN
               ||||||  ||||||:|||||||||||||||||||||||||||||||||||||||||:||:
     a640      IQPSEIVPGADRYSKPEGKPMVARVYKGDEQLGLVYITTDAVNTRGYSSKPIDTLMALAK
                    70         80         90        100        110        120

130        140
     m640.pep  DGTIAGAKLVDHHEPIMLIGIPH
               |||||||||||||| ||||||||
     a640      DGTIAGAKLVDHHESIMLIGIPH
                   130        140
```

The following partial DNA sequence was identified in *N. gonorrhoeae* <SEQ ID 2057>:

```
g642.seq
    1 ATGCGGTATC CGCCGCAATC GGCGGTTTTG CAGAATGCCG CGCGTTGCCT

51 TTTGCGCCGC CCGAAATCTG CCTGCCGCCG TATTTGCCCG CTATCCGCAA

101 TATCGGCAGT CCAATATATC TTTGCGGATG TCGTTCAGCA GGAAGGCTGT

151 GGTGTCTTCG TGTTCCTCCT GTACGAAGAC AAAAAGTCGG GCGATGATTT

201 TGCCGATGAA GACTTTTTGC AGGGCGCAGG CGTCGGTCAG GGTGTGTTCC

251 TGCAGGAAGC TGCCGATGTC TTCGGGCAAA GCGTAgtCgc gGGCAACGGC

301 GGcaaagcgG ACatcggtTT Gcacggcgtc gagCAGGGtt tggtTTTTGT

351 CCAACTTAAT GCCTGCTTCT TTTTCTTCGG CGGTGGCGCG GACGAACTGG

401 TCGTAAATTT CGGCATAAAG CATATCGTTC GGGCCTTCAA AAATCGTGAA

451 GGGGCGGATA TCGATGGCGA TATTGCCGGC TGGGTGTCCG CGTTCAAAAC

501 CCTTCGCGCC CAAGAGTTTT TGCAACATTT GCGCGGCGgc gTAAGTGTAT

551 TCCGTGGCGa ggGTTTTGAc gatgTTCGCC TCCATCAATT GATGGGCGAc 601 ggGCGcgacg ggCGAAACGG AATGGCAGAC GTAGCGGTAA AGGATTTCGG

651 AAACCTGATG GCGGCGTTGG ATTTCGCGGC GTTCGTAATC GACGAATCTG

701 ATATCGTTGC GGACATATCG GTTCAGGTTG TCAAGGATGT ATTCCATAAT

751 GCCGTGCGTC ATGCCGATCA GTTGCAGGCG GCTGCGGATA AGATGTTTT

801 GGAACGCGCG CAAACCGGCA GCGTCGCCCC GGGAGAGTTT CATCACGGCG

851 GTTGCAGGCA TTTCGGCATC GATGCGGTTG ACGGCGTAAC GGACGGCGCG

901 CAGGCCTTCG GATGCGAGGG TTTCGCAGCG GATGTATGTT TTGGGGACGA

951 GCAGCAGGTC GATGactttg gcgagtttgC Cgttttttgcg ctctttggcg 1001 gcaacgaggA GGAAGTCGCT TTGCGAATTG CCCTGCCAGT ATTTCGCGGC
```

-continued

```
1051 GttgACGTAA ATGGTTtgtt cgtcggtata ttcgtagcag gactgcaTTT

1101 CGCGTGCAAt cgCcgcgccg gaggtTtcgg gttcggtaAc gcccaaacgg 1151 cggctttcgc ctTTGAAAAT CATGTCCAAA CCTTGTGCGA CTTGCgcttc 1201 gccgccgaac tCTTGCAGAG GCTGCAACAC CAGCGCGCCT TCGATGCCGG

1251 TACGCAGCGT AACGGGCACG CCGTAATGCC CCGCAATCCT TAG
```

This corresponds to the amino acid sequence <SEQ ID 2058; *ORF* 642.ng>:

```
g642.pep
  1 MRYPPQSAVL QNAARCLLRR PKSACRRICP LSAISAVQYI FADVVQQEGC

51 GVFVFLLYED KKSGDDFADE DFLQGAGVGQ GVFLQEAADV FGQSVVAGNG

101 GKADIGLHGV EQGLVFVQLN ACFFFFGGGA DELVVNFGIK HIVRAFKNRE

151 GADIDGDIAG WVSAFKTLRA QEFLQHLRGG VSVFRGEGFD DVRLHQLMGD

201 GRDGRNGMAD VAVKDFGNLM AALDFAAFVI DESDIVADIS VQVVKDVFHN

251 AVRHADQLQA AADKDVLERA QTGSVAPGEF HHGGCRHFGI DAVDGVTDGA

301 QAFGCEGFAA DVCFGDEQQV DDFGEFAVFA LFGGNEEEVA LRIALPVFRG

351 VDVNGLFVGI FVAGLHFACN RRAGGFGFGN AQTAAFAFEN HVQTLCDLRF

401 AAELLQRLQH QRAFDAGTQR NGHAVMPRNP *
```

The following partial DNA sequence was identified in *N. meningitidis* <SEQ ID 2059>:

```
m642.seq (partial)
  1 GCCTGCCGCC GTATTTGCCC GCTACCCGCA ATATCGGCAG TCCAATATAT

51 CTTTGCGGAT GTCGTTCAGC AGGAAGGCTG CGGTGTCTTC GTGTTTCGCC

101 TGTACGAAGA CAAAGAGTCG GGCGATGATT TTGCCGATAA AGACTTTTTG

151 CAGGGCGCAG GCATCGGTCA GGGTGTGTTC CTGCAGGAAG CTGCGGATGT

201 CTTCAGGCAA AGTGTAGTCG CGGGCGACGG CGGCAAAGCG GGCATCGGTT

251 TGCAGGCGGT CGAGCAGGGT TTGGTTTTTG TCCAACTTCA TGCCTGCTTC

301 TTTTTCTTCG GCGGTGGCGC GGACAAACTG GTCGTAAATT TCGGCATAAA

351 GCATATCGTT CGGGCCTTCA AAAATCGTGA AGGGGCGGAT GTCGATAGCG

401 ATATTGCCGG CGGTGTGTCC GCGTTCAAAA CCCTTCGCAC CCAAGAGTTT

451 TTGCAACATT TGCGCGGCGG CGTAAGTGTA TTCCGTGGCG AGGGTTTTGA

501 CGATGTTCGC CTCCATCAGC TGATGGGCGA CGGGGGCAAC AGGCGAAACG

551 GAATGGCAGA CGTAGCGGTA AAGAATCTCG GAAACCTGAT GGCGGCGCCG

601 GATTTCGCGG CGTTCGTAAT CGACGAATTT GATGTCGTTG CGGACGTATC

651 GTTCCAGATT TTCAAGGATG TATTCCATAA TGCCGTGCGT CATGCCGATC

701 AGTTGCAGGC GGCTGCGGAT AAAGATGTTT TGGAACGCGC GCAAACCGGC

751 AGCGTCGCTC TGGGAGAGTT TCATCACGGC GGTTGCAGGC ATTTCGGCAT

801 CGATGCGGTT GACGGCGTAA CGGACGGCGC GCAAGCCTTC GGATGCGAGG

851 GTTTCGCAGC GGATGTATGT TTTGGGGACG AGCAGCAGGT CGATGACTTT

901 GGCGAGTTTG CCGTTTTTGC GCTCTTTGGC GGCAACGAGG AGGAAGTCGC

951 TTTGCGAGTT GCCCTGCCAG TATTTCGCGG CGTTGACGTA AATGGTTTGT
```

-continued

```
1001 CCGTCGATAT ATTCGTAGTA GGACTGCATT TCGCGTGCAA TCGCCGCGCC

1051 GGAGGTTTCG GGTTCGGTAA CACCCAAACC GCCGCCCTCG CCTTTGAAAA

1101 TCATCTCCAA ACCTTGCGCG ACTTGCGCTT CATCGCCGAA CTCTTGCAGT

1151 GGCTGCAACA CCAGCGCGCC TTCGATGCCG GTACGCAGCG TAACGGGCAC

1201 GCCGTAATGC CCCGCAATCC G
```

This corresponds to the amino acid sequence <SEQ ID 2060; ORF 642>:

```
m642.pep (partial)
  1 ACRRICPLPA ISAVQYIFAD VVQQEGCGVF VFRLYEDKES GDDFADKDFL

51 QGAGIGQGVF LQEAADVFRQ SVVAGDGGKA GIGLQAVEQG LVFVQLHACF

101 FFFGGGADKL VVNFGIKHIV RAFKNREGAD VDSDIAGGVS AFKTLRTQEF

151 LQHLRGGVSV FRGEGFDDVR LHQLMGDGGN RRNGMADVAV KNLGNLMAAP

201 DFAAFVIDEF DVVADVSFQI FKDVFHNAVR HADQLQAAAD KDVLERAQTG

251 SVALGEFHHG GCRHFGIDAV DGVTDGAQAF GCEGFAADVC FGDEQQVDDF

301 GEFAVFALFG GNEEEVALRV ALPVFRGVDV NGLSVDIFVV GLHFACNRRA

351 GGFGFGNTQT AALAFENHLQ TLRDLRFIAE LLQWLQHQRA FDAGTQRNGH

401 AVMPRNP
``` m642/g642 90.4% identity in 407 aa overlap

```
                              10        20        30
m642.pep                              ACRRICPLPAISAVQYIFADVVQQEGCGVFVFRLYED
                                      |||||||||||||||||||||||||||||||| ||||
g642     MRYPPQSAVLQNAARCLLRRPKSACRRICPLSAISAVQYIFADVVQQEGCGVFVFLLYED
                 10        20        30        40        50        60

40        50        60        70        80        90
m642.pep KESGDDFADKDFLQGAGIGQGVFLQEAADVFRQSVVAGDGGKAGIGLQAVEQGLVFVQLH
         |:||||||:||||||||||:||||||||||||| ||||||:|||| |::||||| |||:
g642     KKSGDDFADEDFLQGAGVGQGVFLQEAADVFGQSVVAGNGGKADIGLHGVEQGLVFVQLN
                70        80        90       100       110       120

100       110       120       130       140       150
m642.pep ACFFFFGGGADKLVVNFGIKHIVRAFKNREGADVDSDIAGGVSAFKTLRTQEFLQHLRGG
         ||||||||||:|||||||||||||||||||||:|:||||||||||||||:|||||||||
g642     ACFFFFGGGADELVVNFGIKHIVRAFKNREGADIDGDIAGWVSAFKTLRAQEFLQHLRGG
                130       140       150       160       170       180

160       170       180       190       200       210
m642.pep VSVFRGEGFDDVRLHQLMGDGGNRRNGMADVAVKNLGNLMAAPDFAAFVIDEFDVVADVS
         |||||||||||||||||||||| :||||||||||:|||||| ||||||||| :|||:|
g642     VSVFRGEGFDDVRLHQLMGDGRDGRNGMADVAVKDFGNLMAALDFAAFVIDESDIVADIS
                190       200       210       220       230       240

220       230       240       250       260       270
m642.pep FQIFKDVFHNAVRHADQLQAAADKDVLERAQTGSVALGEFHHGGCRHFGIDAVDGVTDGA
         |: ||||||||||||||||||||||||||||||||| |||||||||||||||||||||||
g642     VQVVKDVFHNAVRHADQLQAAADKDVLERAQTGSVAPGEFHHGGCRHFGIDAVDGVTDGA
                250       260       270       280       290       300

280       290       300       310       320       330
m642.pep QAFGCEGFAADVCFGDEQQVDDFGEFAVFALFGGNEEEVALRVALPVFRGVDVNGLSVDI
         ||||||||||||||||||||||||||||||||||||||||||:|||||||||||| | |
g642     QAFGCEGFAADVCFGDEQQVDDFGEFAVFALFGGNEEEVALRIALPVFRGVDVNGLFVGI
                310       320       330       340       350       360

340       350       360       370       380       390
m642.pep FVVGLHFACNRRAGGFGFGNTQTAALAFENHLQTLRDLRFIAELLQWLQHQRAFDAGTQR
         ||:|||||||||||||||||:|||||||||:|| |||||:|||||| ||||||||||||
g642     FVAGLHFACNRRAGGFGFGNAQTAALAFENHVQTLCDLRFAAELLQRLQHQRAFDAGTQR
                370       380       390       400       410       420

400
m642.pep NGHAVMPRNP
         ||||||||||
g642     NGHAVMPRNPX
                430
```

The following partial DNA sequence was identified in *N. meningitidis* <SEQ ID 2061>:

```
a642.seq (partial)
    1 GCCTGCCGCC GTATTTGCCC GCTATCCGCA ATATCGGCAG TCCAATATGT

51 CTTTGCGGAT GTCGTTCAGC AGGAAGGCTG CGGTGTCTTC GTGTTCCGCC

101 TGTACGAAGA CAAAGAGTCG GGCGATGATT TTGCCGATAA AGACTTTTTG

151 CAGGGCGCAG GCATCGGTCA GGGTGTGTTC CTGCAGGAAG CTGCGGATGT

201 CTTCGGGCAA AGTGTAGTCG CGGGCGACGG CGGCAAAGCG GGCATCGGTT

251 TGCAGGCGGT CGAGCAGGGT TTGGTTTTTG TCCAACTTCA TGCCTGCTTC

301 TTTTTCTTCG GCGGTGGCGC GGACAAACTG GTCGTAAATT TCGGCATAAA

351 GCATATCGTT CGGGCCTTCA AAAATCGTGA AGGGGCGGAT GTCGATAGCG

401 ATATTGCCGG CGGTGTGTCC GCGTTCAAAA CCCTTCGCGC CAAGAGTTT

451 TTGCAACATT TGCGCGGCGG CGTAAGTGTA TTCCGTGGCG AGGGTTTTGA

501 CGATGTTCGC CTCCATCAGT TGATGGGCGA CGGGTGCAAC GGGCGAAACG

551 GAATGGCAGA CGTAGCGGTA AAGAATCTCG GAAACCTGAT GGCGGCGCCG

601 GATTTCGCGG CGTTCGTAAT CGACGAATCT GATGTCGTTG CGGACGTATC

651 GTTCCAGGTT TTCAAGGGTG TATTCCATAA TGCCGTGCGT CATGCCGATC

701 AGTTGCAGGC GGCTGCGGAT AAAGATGTTT GGAACGCGC GCAAACCGGC

751 AGCGTCGCTC TGGGAGAGTT TCATCACGGC GGTTGCAGGC ATTTCGGCAT

801 CGATGCGGTT GACGGCGTAA CGGACGGCGC GCAAGCCTTC GGATGCGAGG

851 GTTTCGCAGC GGATGTATGT TTTGGGGACG AGCAGCAGGT CGATGACTTT

901 GGCGAGTTTG CCGTTTTTGC GCTCTTTGGC GGCAACGAGG AGGAAGTCGC

951 TTTGCGAGTT GCCCTGCCAG TATTTCGCGG CGTTGACGTA AATGGTTTGT

1001 CCGTCGGTAT ATTCGTAGTA AGACTGCATT TCTCGGGCAA TCGCCGCGCC

1051 GGAGGTTTCG GGTTCGGTAA CGCCTAAACC GCCGCCCTCG CCTTTGAAAA

1101 CCATGTCCAA ACCCTGTGCG ATTTGCGCTT CATCGCCGAA CTCTTGCAGT

1151 GGCTGCAACA CCAGCGCGCC TTCGATGCCG GTACGCAGCG TAACGGGCAC

1201 GCCGTAATGC CCCGCAATCC G
```

This corresponds to the amino acid sequence <SEQ ID 2062; ORF 642.a>:

```
a642.pep Length: 407
  1 ACRRICPLSA ISAVQYVFAD VVQQEGCGVF VFRLYEDKES GDDFADKDFL

51 QGAGIGQGVF LQEAADVFGQ SVVAGDGGKA GIGLQAVEQG LVFVQLHACF

101 FFFGGADKL VVNFGIKHIV RAFKNREGAD VDSDIAGGVS AFKTLRAQEF

151 LQHLRGGVSV FRGEGFDDVR LHQLMGDGCN GRNGMADVAV KNLGNLMAAP

201 DFAAFVIDES DVVADVSFQV FKGVFHNAVR HADQLQAAAD KDVLERAQTG

251 SVALGEFHHG GCRHFGIDAV DGVTDGAQAF GCEGFAADVC FGDEQQVDDF

301 GEFAVFALFG GNEEEVALRV ALPVFRGVDV NGLSVGIFVV RLHFSGNRRA

351 GGFGFGNA*T AALAFENHVQ TLCDLRFIAE LLQWLQHQRA FDAGTQRNGH

401 AVMPRNP
``` m642/a642 95.8% identity in 407 aa overlap

```
                    10        20        30        40        50        60
     m642.pep  ACRRICPLPAISAVQYIFADVVQQEGCGVFVFRLYEDKESGDDFADKDFLQGAGIGQGVF
               ||||||||  ||||||  :|||||||||||||||||||||||||||||| ||||||||
         a642  ACRRICPLSAISAVQYVFADVVQQEGCGVFVFRLYEDKESGDDFADKDFLQCAGIGQGVF
                    10        20        30        40        50        60

70        80        90       100       110       120
     m642.pep  LQEAADVFRQSVVAGDGGKAGIGLQAVEQGLVFVQLHACFFFFGGGADKLVVNFGIKHIV
               ||||||||  ||||||||||||||||||||||||||||||||||||||||||||||||||
         a642  LQEAADVFGQSVVAGDGGKAGIGLQAVEQGLVFVQLHACFFFFGGGADKLVVNFGIKHIV
                    70        80        90       100       110       120

130       140       150       160       170       180
     m642.pep  RAFKNREGADVDSDIAGGVSAFKTLRTQEFLQHLRGGVSVFRGEGFDDVRLHQLMGDGGN
               ||||||||||||||||||||||||||||:||||||||||||||||||||||||||||| |
         a642  RAFKNREGADVDSDIAGGVSAFKTLRAQEFLQHLRGGVSVFRGEGFDDVRLHQLMGDGCN
                   130       140       150       160       170       180

190       200       210       220       230       240
     m642.pep  RRNGMADVAVKNLGNLMAAPDFAAFVIDEFDVVADVSFQIFKDVFHNAVRHADQLQAAAD
               |||||||||||||||||||||||||||||| |||||||| :|| ||||||||||||||||
         a642  GRNGMADVAVKNLGNLMAAPDFAAFVIDESDVVADVSGQVFKGVFHNAVRHADQLQAAAD
                   190       200       210       220       230       240

250       260       270       280       290       300
     m642.pep  RRNGMADVAVKNLGNLMAAPDFAAFVIDEFDVVADVSFQIFKDVFHNAVRHADQLQAAAD
               |||||||||||||||||||||||||||||| |||||||| :|| ||||||||||||||||
         a642  GRNGMADVAVKNLGNLMAAPDFAAFVIDESDVVADVSGQVFKGVFHNAVRHADQLQAAAD
                   250       260       270       280       290       300

310       320       330       340       350       360
     m642.pep  GEFAVFALFGGNEEEVALRVALPVFRGVDVNGLSVDIFVVGLHFACNRRAGGFGFGNTQT
               ||||||||||||||||||||||||||||||||||||| |||| ||| :||||||||||:|
         a642  GEFAVFALFGGNEEEVALRVALPVFRGVDVNGLSVGIFVVRLHFSGNRRAGGFGFGNAXT
                   310       320       330       340       350       360

370       380       390       400
     m642.pep  AALAFENHLQTLRDLRFIAELLQWLQHQRAFDAGTQRNGHAVMPRNP
               ||||||||:|||  ||||||||||| |||||||||||||||||||||
         a642  AALAFENHVQTLCDLRFIAELLQELQHQRAFDAGTQRNGHAVMPRNP
                   370       380       330       400
```

The following partial DNA sequence was identified in *N. gonorrhoeae* <SEQ ID 2063>:

```
g643.seq
  1 ATGGTGTTGC CTTTGATGTT GTTGGCGACA ATCAGgTcgg CTACGCTGAc 51 gttgtancGt TTGGcaATGt tGaaCAgggt gtcgccTTCT ACAACGCGGT 101 GGATGCTGGC ATGGagcGGG GAGGTTTCGG CTTCGCCGTC GGCAGCTTTG 151 GCTACGCGCG TTTCCAAACG TGCCCGGCGT TtgCCGTCGG CGGCAACGGT

201 ATGTTGCGGA GATGAGGAAA TGTTGTGTTC GGCAACTGTG TCAGGCGTGC

251 CGATGACGGC GGagaTGGTT TCTTCAGCCT GCCGGCGCag gTTGTTTCGG

301 GCAACAAGCT GCATGAGTTC GTCTGCCGCC TGCATGTCGT TTGGGGGGAt

351 GACCTGCGCg aGTGtTGCGG TTTGGGTTTC agacgGCATG GCAGTCTGTT

401 TTTcggTTTG a
```

This corresponds to the amino acid sequence <SEQ ID 2064; *ORF* 643>:

```
g643.pep
  1 MVLPLMLLAT IRSATLTLXR LAMLNRVSPS TTRWMLAWSG EVSASPSAAL

51 ATRVSKRARR LPSAATVCCG DEEMLCSATV SGVPMTAEMV SSACRRRLFR

101 ATSCMSSSAA CMSFGGMTCA SVAVWVSDGM AVCFSV*
```

The following partial DNA sequence was identified in N. meningitidis <SEQ ID 2065>:

```
m643.seq
    1 ATGGTGTTGC CTTTGATGTT GTTGGCGACA ATCAGGTCGG CTACACTGAC

51 GTTGTAGCGT TTGGCAATGT TGAACAGGGT GTCGCCTTCT ACAACGCGGT

101 GGATGCTGGC ATGGAGCGGG GAGATTTCGG CTTCGCCGTC GGCAGCTTTG

151 GCTACGCGCG TTTCCAAACG TACCCGGCGT TTGCCGTCGG CGGCAGCGGT

201 ATGTTGCGGA GATGCGGAAA TTTTGTGTTC GGCAACTGTG TCAGGCGTGC

251 CGATGACGGC GGAGATGGTT TCTTCAGCCT GTCGGCGCAG GTTGTTTCGG

301 GCAACAAGCT GCATGAGTTC GTCTGCCGCC TGCATGTCGT TTTGGGGGAT

351 GATCTGCGCG AGTGTTGCGG TTTGGGTTTC AGACGGCATG GCGGTCTGTT

401 TTTCGGTTTG A
```

This corresponds to the amino acid sequence <SEQ ID 2066; ORF 643>:

```
m643.pep
    1 MVLPLMLLAT IRSATLTL*R LAMLNRVSPS TTRWMLAWSG EISASPSAAL

51 ATRVSKRTRR LPSAAAVCCG DAEILCSATV SGVPMTAEMV SSACRRRLFR

101 ATSCMSSSAA CMSFWGMICA SVAVWVSDGM AVCFSV*
```

Computer analysis of the amino acid sequences gave the following results:

Homology with a Predicted ORF from N. meningitidis menA with menB

ORF 643 shows 94.9% identity over a 136 aa overlap with a predicted ORF (ORF643.a) from N. gonorrhoeae:

```
    m643/g643

10         20         30         40         50         60
       m643.pep    MVLPLMLLATIRSATLTLZRLAMLNRVSPSTTRWMLAWSGEISASPSAALATRVSKRTRR
                   ||||||||||||||||||||||||||||||||||||||||:|||||||||||||||:||
           g643    MVLPLMLLATIRSATLTLXRLAMLNRVSPSTTRWMLAWSGEVSASPSAALATRVSKRARR
                      10         20         30         40         50         60

70         80         90        100        110        120
       m643.pep    LPSAAAVCCGDAEILCSATVSGVPMTAEMVSSACRRRLFRATSCMSSSAACMSFWGMICA
                   |||||:||||| |:|||||||||||||||||||||||||||||||||||||||| || ||
           g643    LPSAATVCCGDEEMLCSATVSGVPMTAEMVSSACRRRLFRATSCMSSSAACMSFGGMTCA
                      70         80         90        100        110        120

130
       m643.pep    SVAVWVSDGMAVCFSVX
                   |||||||||||||||||
           g643    SVAVWVSDGMAVCFSVX
                     130
```

The following partial DNA sequence was identified in N. meningitidis <SEQ ID 2067>:

```
a643.seq
    1 ATGGTGTTGC CTTTGATGTT GTTGGCGACA ATCAGGTCGG CTACACTGAC

51 GTTGTAGCGT TTGGCAATGT TGAACAGGGT GTCGCCTTCT ACAACGCGGT

101 GGATGCTGGC ATGGAGCGGG GAGATTTCGG CTTCGCCGTC GGCAGCTTTG

151 GCTACGCGCG TTTCCAAACG TACCCGGCGT TGCCGTCGG CGGCAACGGT

201 ATGTTGCGGA GATGAGGAAA TGTTGTGTTC GGCAACTGTG TCAGGCGTGC
```

```
-continued
251 CGATGACGGC AGAGATGGTT TCTTCAGCCT GTCGGCGCAG GTTGTTTCGG

301 GCAACAAGCT GCATGAGTTC GTCTGCCGCC TGCATGTCGT TTTGGGGGAC

351 GATCTGCGCG AGTGTTGCGG TTTGGGTTTC AGACGGCATG GCGGTCTGTT

401 TTTCGGTTTG A
```

This corresponds to the amino acid sequence <SEQ ID 2068; ORF 643.a>:

```
a643.pep
      1    MVLPLMLLAT IRSATLTL*R LAMLNRVSPS TTRWMLAWSG EISASPSAAL
     51    ATRVSKRTRR LPSAATVCCG DEEMLCSATV SGVPMTAEMV SSACRRRLFR
    101    ATSCMSSSAA CMSFWGTICA SVAVWVSDGM AVCFSV* m643/a643    97.1% identity in 136 aa overlap 10         20         30         40         50         60
m643.pep    MVLPLMLLATIRSATLTLZRLAMLNRVSPSTTRWMLAWSGEISASPSAALATRVSKRTRR
            ||||||||||||||||||| |||||||||||||||||||||:||||||||||||||||||
a643        MVLPLMLLATIRSATLTLXRLAMLNRVSPSTTRWMLAWSGEVSASPSAALATRVSKRTRR
                    10         20         30         40         50         60

70         80         90        100        110        120
m643.pep    LPSAAAVCCGDAEILCSATVSGVPMTAEMVSSACRRRLFRATSCMSSSAACMSFWGMICA
            |||||:|||||:|||||||||||||||||||||||||||||||||||||||||||| |||
a643        LPSAATVCCGDEEMLCSATVSGVPMTAEMVSSACRRRLFRATSCMSSSAACMSFWGTICA
                    70         80         90        100        110        120

130
m643.pep    SVAVWVSDGMAVCFSVX
            |||||||||||||||||
a643        SVAVWVSDGMAVCFSVX
                   130
```

The following partial DNA sequence was identified in *N. gonorrhoeae* <SEQ ID 2069>:

```
g644.seq
    1 ATGCCGTCTG AAAGGccgGC GGATTGTTGC CCGGTGCACT TTGTGGTAAA

51 GTTTAGAAAA TTAACTCTAA ACTGTGGCAG GCGGTTTGAC CGGCCGCCGA

101 TTAATGGGAA CCGACAGAGG AAGCCGATGA TACACACCGA ACCGAGCGCG

151 CAGCCGTCAA CCATGGACAC GGCTGCTTTT TTAAagcaca tcgaatCCGC

201 ATTcCCCCGC ATTTTTTCAG ACGGCATCGA CCTGATGCGA TACCTGCCCG

251 AAGACAAATG GCTTGCCTTG AAGCAGGCGG GTTTGCTGTT GCCCTTCCTC

301 GACAAAAAAC ACGGCGGGCG CAAGGGCAGT CAGTTTGAAA TCCAAGAAGT

351 CCTAAGGATT GCGGGGCATT ACGGCGTGCC CGTTACGCTG CGTACCGGCA

401 TCGAAGGCGC GCTGGTGTTG CAGCCTCTGC AAGagttcgg cggcgaagcG

451 CAAGTCGCAC AAGGTTTGGA CATGATTTTC AAaggcgaaa gccgccgttt 501 gggcgTtacc gaacccgaAa cctccggcgc gGcgaTTGCA CGCGAAAtgc 551 agtcctgcta cgaatatacc gacgaacaAA CCATTTACGT caaCGCCGCG 601 AAATACTGGC AGGGCAATTC GCAAAGCGAC TTCCTcctcg ttgccgccaa 651 agagcgcaaa aacGGcaaac tcgccaaagt CATCGACCTG CTGCTCGTCC

701 CCAAAACATA CATCCGCTGC GAAACCCTCG CATCCGAAGG CCTGCGCGCC

751 GTCCGTTACG CCGTCAACCG CATCGATGCC GAAATGCCTG CAACCGCCGT

801 GATGAAACTC TCCCGGGGCG ACGCTGCCGG TTTGCGCGCG TTCCAAAACA
```

```
-continued
 851  TCTTTATCCG CAGCCGCCTG CAACTGATCG GCATGACGCA CGGCATTATG

901  GAATACATCC TTGACAACCT GAACCGATAT GTCCGCAACG ATATCAGATT

951  CGTCGATTAC GAACGCCGCG AAATCCAACG CCGCCATCAG GTTTCCGAAA

1001  TCCTTTACCG CTACGTCTGC CATTCCGTTT CGcccgtcgC GCccgTCGCC

1051  CATCAATTGA TGGAGGCGAA catcgTCAAA ACcctCGCCA CGGAATACAC

1101  TTAcgcCGCC GCGCAAATGT TGCAAAAACT CTTGGGCGCG AAGGGTTTTG

1151  AACGCGGACA CCCAGCCGGC AATATCGCCA TCGATATCCG CCCCTTCACG

1201  ATTTTTGAAG CCCGAACGA TATGCTTTAT GCCGAAATTT ACGACCAGTT

1251  CGTCCGCGCC ACCGCCGAAG AAAAAGAAGC AGGCATTAAG TTGGACAAAA 1301  accaaaCCCT Gctcgacgcc gtgCAAaccg atGTCcgctt tgCCGCCGTT 1351  GCCcgcGacT ACGCTTTGCC CGAAGACATC CGCAGCTTCC TGCAGGAACA

1401  CACCCTGACC GACGCCTGCG CCCTGCAAAA AGTCTTCATC GGCAAAATCA

1451  TCGCCCGACT TTTTGTCTTC GTACAGGAGG AACACGAAGA CACCACAGCC

1501  TTCCTGCTGA ACGACATCCG CAAAGATATA TTGGACTGCC GATATTGCGG

1551  ATAG
```

This corresponds to the amino acid sequence <SEQ ID 2070; *ORF* 644.ng>:

```
g644.pep
  1 MPSERPADCC PVHFVVKFRK LTLNCGRRFD RPPINGNRQR KPMIHTEPSA

51 QPSTMDTAAF LKHIESAFPR IFSDGIDLMR YLPEDKWLAL KQAGLLLPFL

101 DKKHGGRKGS QFEIQEVLRI AGHYGVPVTL RTGIEGALVL QPLQEFGGEA

151 QVAQGLDMIF KGESRRLGVT EPETSGAAIA REMQSCYEYT DEQTIYVNAA

201 KYWQGNSQSD FLLVAAKERK NGKLAKVIDL LLVPKTYIRC ETLASEGLRA

251 VRYAVNRIDA EMPATAVMKL SRGDAAGLRA FQNIFIRSRL QLIGMTHGIM

301 EYILDNLNRY VRNDIRFVDY ERREIQRRHQ VSEILYRYVC HSVSPVAPVA

351 HQLMEANIVK TLATEYTYAA AQMLQKLLGA KGFERGHPAG NIAIDIRPFT

401 IFEGPNDMLY AEIYDQFVRA TAEEKEAGIK LDKNQTLLDA VQTDVRFAAV

451 ARDYALPEDI RSFLQEHTLT DACALQKVFI GKIIARLFVF VQEEHEDTTA

501 FLLNDIRKDI LDCRYCG*
```

The following partial DNA sequence was identified in *N. meningitidis* <SEQ ID 2071>:

```
m644.seq
   1  ATGCCGTCTG AAAGGTCGGC GGATTGTTGC CCGGCGCACT TTGTGGTAAA

51  GTTTAGAAAA TCAACTCTAA ACTGTGGCAG GCGGTTTGAC CGGCCGCCGA

101  TTAATGGGAA CCGACAGAGG AAGCCGATGA TACACACCGA ACCGAGCGCG

151  CAGCCGTCAA CTATGGACAC GGCTGCTTTT TTAAAGCACA TCGAATCCGC

201  ATTCCGCCGC ATTTTTTCAG ACGGTATCGA CCTGATGCGA TACCTGCCCG

251  AAGACAAATG GCTTGCCTTG AAGCAGGCGG GTTTGCTGTT GCCCTTCCTC

301  GACAAAAAAT ACGGCGGGCG CAAGGGCAGC CAGTTTGAAA TCCAAGAAGT

351  CcTGCGGATT GCGGGGCATT ACGGCGTGCC CGTTACGCTG CGTACCGGCA
```

```
 401 TCGAAGGCGC GCTGGTGTTG CAGCCACTGC AAGAGTTCGG CGATGAAGCG
 451 CAAGTCGCGC AAGGTTTGGA GATGATTTTC AAAGGCGAGG GCGGCGGTTT
 501 GGGTGTTACC GAACCCGAAA CCTCCGGCGC GGCGATTGCA CGCGAAATGC
 551 AGTCCTACTA CGAATATATC GACGGACAAA CCATTTACGT CAACGCCGCG
 601 AAATACTGGC AGGGCAACTC GCAAAGCGAC TTCCTCCTCG TTGCCGCCAA
 651 AGAGCGCAAA AACGGCAAAC TCGCCAAAGT CATCGACCTG CTGCTCGTCC
 701 CCAAAACATA CATCCGCTGC GAAACCCTCG CATCCGAAGG CTTGCGCGCC
 751 GTCCGTTACG CCGTCAACCG CATCGATGCC GAAATGCCTG CAACCGCCGT
 801 GATGAAACTC TCCCAGAGCG ACGCTGCCGG TTTGCGCGCG TTCCAAAACA
 851 TCTTTATCCG CAGCCGCCTG CAACTGATCG GCATGACGCA CGGCATTATG
 901 GAATACATCC TTGAAAATCT GGAACGATAC GTCCGCAACG ACATCAAATT
 951 CGTCGATTAC GAACGCCGCG AAATCCGGCG CCGCCATCAG GTTTCCGAGA
1001 TTCTTTACCG CTACGTCTGC CATTCCGTTT CGCCTGTTGC CCCCGTCGCC
1051 CATCAGCTGA TGGAGGCGAA CATCGTCAAA ACCCTCGCCA CGGAATACAC
1101 TTACGCCGCC GCGCAAATGT TGCAAAAACT CTTGGGTGCG AAGGGTTTTG
1151 AACGCGGACA CACCGCCGGC AATATCGCTA TCGACATCCG CCCCTTCACG
1201 ATTTTTGAAG GCCCGAACGA TATGCTTTAT GCCGAAATTT ACGACCAGTT
1251 TGTCCGCGCC ACCGCCGAAG AAAAAGAAGC AGGCATGAAG TTGGACAAAA
1301 ACCAAACCCT GCTCGACCGC CTGCAAACCG ATGCCCGCTT TGCCGCCGTC
1351 GCCCGCGACT ACACTTTGCC TGAAGACATC CGCAGCTTCC TGCAGGAACA
1401 CACCCTGACC GATGCCTGCG CCCTGCAAAA AGTCTTTATC GGCAAAATCA
1451 TCGCCCGACT CTTTGTCTTC GTACAGGCGA AACACGAAGA CACCGCAGCC
1501 TTCCTGCTGA ACGACATCCG CAAAGATATA TTGGACTGCC GATATTGCGG
1551 GTAG
```

This corresponds to the amino acid sequence <SEQ ID 2072; ORF 644>:

```
m644.pep

1 MPSERSADCC PAHFVVKFRK STLNCGRRFD RPPINGNRQR KPMIHTEPSA

51 QPSTMDTAAF LKHIESAFRR IFSDGIDLMR YLPEDKWLAL KQAGLLLPFL

101 DKKYGGRKGS QFEIQEVLRI AGHYGVPVTL RTGIEGALVL QPLQEFGDEA

151 QVAQGLEMIF KGEGGGLGVT EPETSGAAIA REMQSYYEYI DGQTIYVNAA

201 KYWQGNSQSD FLLVAAKERK NGKLAKVIDL LLVPKTYIRC ETLASEGLRA

251 VRYAVNRIDA EMPATAVMKL SQSDAAGLRA FQNIFIRSRL QLIGMTHGIM

301 EYILENLERY VRNDIKFVDY ERREIRRRHQ VSEILYRYVC HSVSPVAPVA

351 HQLMEANIVK TLATEYTYAA AQMLQKLLGA KGFERGHTAG NIAIDIRPFT

401 IFEGPNDMLY AEIYDQFVRA TAEKKEAGMK LDKNQTLLDR LQTDARFAAV

451 ARDYTLPEDI RSFLQEHTLT DACALQKVFI GKIIARLFVF VQAKHEDTAA

501 FLLNDIRKDI LDCRYCG*
```

-continued m644/g644 94.6% identity in 517 aa overlap

```
              10         20         30         40         50         60
m644.pep  MPSERSADCCPAHFVVKFRKSTLNCGRRFDRPPINGNRQRKPMIHTEPSAQPSTMDTAAF
          |||||  ||||:||||||||| |||||||||||||||||||||||||||||||||||||
g644      MPSERPADCCPVHFVVKFRKLTLNCGRRFDRPPINGNRQRKPMIHTEPSAQPSTMDTAAF
              10         20         30         40         50         60

70         80         90        100        110        120
m644.pep  LKHIESAFRRIFSDGIDLMRYLPEDKWLALKQAGLLLPFLDKKYGGRKGSQFEIQEVLRI
          ||||||||| ||||||||||||||||||||||||||||||||||:|||||||||||||||
g644      LKHIESAFPRIFSDGIDLMRYLPEDKWLALKQAGLLLPFLDKKHGGRKGSQFEIQEVLRI
              70         80         90        100        110        120

130        140        150        160        170        180
m644.pep  AGHYGVPVTLRTGIEGALVLQPLQEFGDEAQVAQGLEMIFKGEGGGLGVTEPETSGAAIA
          |||||||||||||||||||||||||||| |||||||||:|||||:  |||||||||||||
g644      AGHYGVPVTLRTGIEGALVLQPLQEFGGEAQVAQGLDMIFKGESRRLGVTEPETSGAAIA
             130        140        150        160        170        180

190        200        210        220        230        240
m644.pep  REMQSYYEYIDGQTIYVNAAKYWQGNSQSDFLLVAAKERKNGKLAKVIDLLLVPKTYIRC
          ||||| ||| | |||||||||||||||||||||||||||||||||||||||||||||||
g644      REMQSCYEYTDEQTIYVNAAKYWQGNSQSDFLLVAAKERKNGKLAKVIDLLLVPKTYIRC
             190        200        210        220        230        240

250        260        270        280        290        300
m644.pep  ETLASEGLRAVRYAVNRIDAEMPATAVMKLSQSDAAGLRAFQNIFIRSRLQLIGMTHGIM
          ||||||||||||||||||||||||||||||::|||||||||||||||||||||||||||
g644      ETLASEGLRAVRYAVNRIDAEMPATAVMKLSRGDAAGLRAFQNIFIRSRLQLIGMTHGIM
             250        260        270        280        290        300

310        320        330        340        350        360
m644.pep  EYILENLERYVRNDIKFVDYERREIRRRHQVSEILYRYVCHSVSPVAPVAHQLMEANIVK
          ||||:||:|||||||:|||||||||:||||||||||||||||||||||||||||||||
g644      EYILDNLNRYVRNDIRFVDYERREIQRRHQVSEILYRYVCHSVSPVAPVAHQLMEANIVK
             310        320        330        340        350        360

370        380        390        400        410        420
m644.pep  TLATEYTYAAAQMLQKLLGAKGFERGHTAGNIAIDIRPFTIFEGPNDMLYAEIYDQFVRA
          |||||||||||||||||||||||||||| |||||||||||||||||||||||||||||
g644      TLATEYTYAAAQMLQKLLGAKGFERGHPAGNIAIDIRPFTIFEGPNDMLYAEIYDQFVRA
             370        380        390        400        410        420

430        440        450        460        470        480
m644.pep  TAEEKEAGMKLDKNQTLLDRLQTDARFAAVARDYTLPEDIRSFLQEHTLTDACALQKVFI
          |||||||| :|||||||||  |||:|||||||||:|||||||||||||||||||||||
g644      TAEEKEAGIKLDKNQTLLDAVQTDVRFAAVARDYALPEDIRSFLQEHTLTDACALQKVFI
             430        440        450        460        470        480

490        500        510
m644.pep  GKIIARLFVFVQAKHEDTAAFLLNDIRKDILDCRYCGX
          |||||||||||| :||||:||||||||||||||||||
g644      GKIIARLFVFVQEEHEDTTAFLLNDIRKDILDCRYCGX
             490        500        510
```

The following partial DNA sequence was identified in *N. meningitidis* <SEQ ID 2073>:

```
a644.seq
  1 ATGCCGTCTG AAAGGTCGGC GGATTGTTGC CCGGCGCACT TTGTGGTAAA

51 GTTTAGAAAA TCAACTCTAA ACTGTGGCAG GCGGTTTGAC CGGCCGCCGA

101 TTAATGGGAA CCGACAGAGG AAGCCGATGA TACACACCGA ACCGAGCGCG

151 CAGCCGTCAA CTATGGACAC GGCTGCTTTT TTAAAGCACA TCGAATCCGC

201 ATTCCGCCGC ATTTTTGCAG ACGGTATCGA CCTGATGCGA TACCTGCCCG

251 AAGACAAATG GCTTGCCTTG AAGCAGGCGG GTTTGCTGTT GCCCTTCCTC

301 GACAAAAAAT ACGGCGGGCG CAAGGGCAGC CAGTTTGAAA TTCAGGAAGT

351 CTTGCGGATT GCGGGGCATT ACGGCGTGCC CGTTANNNNN NNNNNNNNNN

401 NNGAAGGCGC GCTGGTGTTG CAGCCACTGC AAGAGTTCGG CGATGAAGCG

451 CAAATCGCAC AGGGTTTGGA CATGGTTTTC AAAGGCGAGG GCGGCGGTTT

501 AGGCGTTACC GAACCCGAAA CCTCCGGCGC GGCGATTGCC CGAGAAATGC

551 AGTCTTACTA CGAATATACC GACGGACAAA CCATTTACGT CAACGCCGCG
```

```
 601 AAATACTGGC AGGGCAACTC GCAAAGCGAC TTCCTCCTCG TTGCCGCCAA

651 AGAGCGCAAA AACGGCAAAC TCGCCAAAGT CATCGACCTG CTGCTCGTCC

701 CCAAAACATA CATCCGCTGC GAAACCCTCG CATCCGAAGG CTTGCGCGCC

751 GTCCGTTACG CCGTCAACCG CATCGATGCC GAAATGCCTG CAACCGCCGT

801 GATGAAACTC TCCCAGAGCG ACGCTGCCGG TTTGCGCGCG TTCCAAAACA

851 TCTTTATCCG CAGCCGCCTG CAACTGATCG GCATGACGCA CGGCATTATG

901 GAATACACCC TTGAAAACCT GGAACGATAC GTCCGCAACG ACATCAGATT

951 CGTCGATTAC GAACGCCGCG AAATCCGGCG CCGCCATCAG GTTTCCGAGA

1001 TTCTTTACCG CTACGTCTGC CATTCCGTTT CGCCCGTTGC ACCCGTCGCC

1051 CATCAACTGA TGGAGGCGAA CATCGTCAAA ACCCTCGCCA CGGAATACAC

1101 TTACGCCGCC GCGCAAATGT TGCAAAAACT CTTGGGCGCG AAGGGTTTTG

1151 AACGCGGACA CACCGCCGGC AATATCGCTA TCGACATCCG CCCCTTCACG

1201 ATTTTTGAAG GCCCGAACGA TATGCTTTAT GCCGAAATTT ACGACCAGTT

1251 TGTCCGCGCC ACCGCCGAAG AAAAAGAAGC AGGCATGAAG TTGGACAAAA

1301 ACCAAACCCT GCTCGACCGC CTGCAAACCG ATGCCCGCTT TGCCGCCGTC

1351 GCCCGCGACT ACACTTTGCC CGAAGACATC CGCAGCTTCC TGCAGGAACA

1401 CACCCTGACC GATGCCTGCG CCCTGCAAAA AGTCTTTATC GGCAAAATCA

1451 TCGCCCGACT CTTTGTCTTC GTACAGGCGG AACACGAAGA CACCGCAGCC

1501 TTCCTGCTGA ACGACATCCG CAAAGACATA TTGGACTGCC GATATTGCGG

1551 ATAG
```

This corresponds to the amino acid sequence <SEQ ID 2074; ORF 644.a>:

```
a644.pep

1 MPSERSADCC PAHFVVKFRK STLNCGRRFD RPPINGNRQR KPMIHTEPSA

51 QPSTMDTAAF LKHIESAFRR IFADGIDLMR YLPEDKWLAL KQAGLLLPFL

101 DKKYGGRKGS QFEIQEVLRI AGHYGVPVXX XXXXEGALVL QPLQEFGDEA

151 QIAQGLDMVF KGEGGGLGVT EPETSGAAIA REMQSYYEYT DGQTIYVNAA

201 KYWQGNSQSD FLLVAAKERK NGKLAKVIDL LLVPKTYIRC ETLASEGLRA

251 VRYAVNRIDA EMPATAVMKL SQSDAAGLRA FQNIFIRSRL QLIGMTHGIM

301 EYTLENLERY VRNDIRFVDY ERREIRRRHQ VSEILYRYVC HSVSPVAPVA

351 HQLMEANIVK TLATEYTYAA AQMLQKLLGA KGFERGHTAG NIAIDIRPFT

401 IFEGPNDMLY AEIYDQFVRA TAEEKEAGMK LDKNQTLLDR LQTDARFAAV

451 ARDYTLPEDI RSFLQEHTLT DACALQKVFI GKIIARLFVF VQAEHEDTAA

501 FLLNDIRKDI LDCRYCG* m644/a644 97.3% identity in 517 aa overlap 10        20        30        40        50        60
m644.pep  MPSERSADCCPAHFVVKFRKSTLNCGRRFDRPPINGNRQRKPMIHTEPSAQPSTMDTAAF
          ||||||||||||||||||||||||||||||||||||||||||||||||||||||||||||
a644      MPSERSADCCPAHFVVKFRKSTLNCGRRFDRPPINGNRQRKPMIHTEPSAQPSTMDTAAF
                 10        20        30        40        50        60

70        80        90       100       110       120
m644.pep  LKHIESAFRRIFSDGIDLMRYLPEDKWLALKQAGLLLPFLDKKYGGRKGSQFEIQEVLRI
          |||||||||:||||||||||||||||||||||||||||||||||:|||||||||||||||
a644      LKHIESAFPRIFADGIDLMRYLPEDKWLALKQAGLLLPFLDKKHGGRKGSQFEIQEVLRI
                 70        80        90       100       110       120
```

```
                130       140       150       160       170       180
m644.pep  AGHYGVPVTLRTGIEGALVLQPLQEFGDEAQVAQGLEMIFKGEGGGLGVTEPETSGAAIA
          ||||||||: :   ||||||||||||||||||||:||||:|:||||||||||||||||||
a644      AGHYGVPVXXXXXXEGALVLQPLQEFGDEAQIAQGLDMVFKGEGGGLGVTEPETSGAAIA
                130       140       150       160       170       180

190       200       210       220       230       240
m644.pep  REMQSYYEYIDGQTIYVNAAKYWQGNSQSDFLLVAAKERKNGKLAKVIDLLLVPKTYIRC
          ||||||||||  ||||||||||||||||||||||||||||||||||||||||||||||||
a644      REMQSYYEYTDGQTIYVNAAKYWQGNSQSDFLLVAAKERKNGKLAKVIDLLLVPKTYIRC
                190       200       210       220       230       240

250       260       270       280       290       300
m644.pep  ETLASEGLRAVRYAVNRIDAEMPATAVMKLSQSDAAGLRAFQNIFIRSRLQLIGMTHGIM
          ||||||||||||||||||||||||||||||||||||||||||||||||||||||||||||
a644      ETLASEGLRAVRYAVNRIDAEMPATAVMKLSQSDAAGLRAFQNIFIRSRLQLIGMTHGIM
                250       260       270       280       290       300

310       320       330       340       350       360
m644.pep  EYILENLERYVRNDIKFVDYERREIRRRHQVSEILYRYVCHSVSPVAPVAHQLMEANIVK
          || ||||||||||||:|||||||||||||||||||||||||||||||||||||||||||
a644      EYTLENLERYVRNDIRFVDYERREIRRRHQVSEILYRYVCHSVSPVAPVAHQLMEANIVK
                310       320       330       340       350       360

370       380       390       400       410       420
m644.pep  TLATEYTYAAAQMLQKLLGAKGFERGHTAGNIAIDIRPFTIFEGPNDMLYAEIYDQFVRA
          ||||||||||||||||||||||||||||||||||||||||||||||||||||||||||||
a644      TLATEYTYAAAQMLQKLLGAKGFERGHTAGNIAIDIRPFTIFEGPNDMLYAEIYDQFVRA
                370       380       390       400       410       420

430       440       450       460       470       480
m644.pep  TAEEKEAGMKLDKNQTLLDRLQTDARFAAVARDYTLPEDIRSFLQEHTLTDACALQKVFI
          ||||||||||||||||||||||||||||||||||||||||||||||||||||||||||||
a644      TAEEKEAGMKLDKNQTLLDRLQTDARFAAVARDYTLPEDIRSFLQEHTLTDACALQKVFI
                430       440       450       460       470       480

490       500       510
m644.pep  GKIIARLFVFVQAKHEDTAAFLLNDIRKDILDCRYCGX
          |||||||||||||:|||||||||||||||||||||||
a644      GKIIARLFVFVQAEHEDTAAFLLNDIRKDILDCRYCGX
                490       500       510
```

The following partial DNA sequence was identified in *N. gonorrhoeae* <SEQ ID 2075>:

```
g645.seq
   1 ATGATGATGG TGTTGGCGTT GGGGATGTCG ATGCCGGTTT CGATGATGGT

51 GGAACAGAGC AACACATTGA ATCTTTGCTG CAAAAAGTCG CGCATGACTT

101 GTTCCAGCTC GCGCTCACGC AGTTGTCCGT GCGCCACGCC GATACGGGCT

151 TCGGGCAGCA GGGTTTCCAG CCGCTCGCGC ATATTCTCAA TCGTATCTAC

201 TTCATTGTGC AGGAAAAata cCTGTCCTCC GCGTTTGAGT TCGCGCAACA

251 CGGCTTCGCG CACGCTGCCT TCGCTGAACG GTTTGACAAA GGTTTTCACG

301 GCGAGGCGGC GGCTCGGTGC AGTGGTAATC AGCGAGAAGT CGCGCAGACC

351 TTCGAGCGCC ATGCTGAGGG TGCGCGGAAT CGGCGTGGCG GTCATGGTTA

401 GGATGTCGAC ATTGGCGCGC AGGCGTTTGA GCTGCTCTTT CTGTCGCACG

451 CCGAAGCGGT GTTCTTCATC GATAATCAAT AAACCTAAGT TTTTGAATTT

501 TATGTCGTCC TGCACCAATT TGTGCGTACC GATAACGATA TCGACAGTAC

551 CGTCCGCCAT GCCTTCGAGC GTGGCTTTGG TGGCTTTGCT GTTGTTGAAA

601 CGCGAAAGGC TGGCGACTTT CACGGGGAAA TCGGCGAAAC GGTCGGCGAA

651 GTTTTGCGCG TGCTGCTCGA CCAGAAGCGT GGTCGGGGCG AGTACGGCGA

701 CCTGTTTGCC GCCCATCACC GCCACAAACG CGGCGCGAAG GGCGACTTCG

751 GTTTTGCCGA AACCGACATC GCCGCACACA AGTCGGTCCA TCGGCTTCGC

801 CTGCGTCAAA TCTTTAATCA CGGcggcgat ggcggcggcC TGGTCTTCGG

851 TTTCCTCGTA G
```

This corresponds to the amino acid sequence <SEQ ID 2076; ORF 645.ng>:

```
g645.pep
    1 MMMVLALGMS MPVSMMVEQS NTLNLCCKKS RMTCSSSRSR SCPCATPIRA

51 SGSRVSSRSR IFSIVSTSLC RKNTCPPRLS SRNTASRTLP SLNGLTKVFT

101 ARRRLGAVVI SEKSRRPSSA MLRVRGIGVA VMVRMSTLAR RRLSCSFCRT

151 PKRCSSSIIN KPKFLNFMSS CTNLCVPITI STVPSAMPSS VALVALLLLK

201 RERLATFTGK SAKRSAKFCA CCSTRSVVGA STATCLPPIT ATNAARRATS

251 VLPKPTSPHT SRSIGFACVK SLITAAMAAA WSSVSS*
```

The following partial DNA sequence was identified in *N. meningitidis* <SEQ ID 2077>:

```
m645.seq
    1 ATGATGATGG TGTTGGCGTT GGGGATATCG ATACCGGTTT CGATGATGGT

51 GGAACAGAGC AACACGTTAA ATCGTTGCTG CAAAAAGTCG CGCATGACTT

101 GTTCCAGCTC GCGCTCGCGC AGTTGTCCGT GCGCCACGCC GATGCGGGCT

151 TCGGGCAGCA GGGTTTCCAG CCGCTCGCGC ATATTTTCAA TCGTATCTAC

201 TTCATTGTGC AGGAAAAATA CCTGTCCTCC GCGTTTGAGT TCGCGCAACA

251 CGGCTTCGCG CACGCTGCCT TCGCTAAAGG GTTTGACAAA GGTTTTGACG

301 GCGAGGCGGC GGCTGGGCGC GGTGGTAATC AGCGAGAAGT CGCGCAGTCC

351 TTCCAACGCC ATACTTAAAG TACGCGGAAT CGGCGTGGCG GTCATGGTAA

401 GGATATCAAC ATTGGCGCGC AGGCGTTTGA GCTGCTCTTT CTGACGCACG

451 CCGAAGCGGT GTTCTTCGTC GATAATCACT AAACCTAAGT TTTTGAATTT

501 GATGTCGTCC TGCACCAGTT TGTGCGTACC GATAACAATA TCGACCGTGC

551 CGTCTGCCAT GCCTTCCAGC GCGGCTTTGG TGGCTTTGCT GTTGTTGAAA

601 CGCGAAAGGC TGGCGACTTT CACGGGGAAA TCGGCGAAAC GGTCGGCGAA

651 GTTTTGCGCG TGCTGCTCGA CCAAAAGCGT GGTCGGAGCA AGTACGGCGA

701 CCTGTTTGCC GCCCATCACC GCCACAAACG CGGCGCGCAG GGCGACTTCG

751 GTTTTGCCGA AGCCGACATC GCCGCACACA AGGCGATCCA TCGGCTTCGC

801 TTGCGTCAAA TCTTTAATCA CGGCGGCGAT GGCGGCGGCC TGGTCTTCGG

851 TTTCCTCGTA G
```

This corresponds to the amino acid sequence <SEQ ID 2078; ORF 645>:

```
m645.pep
    1 MMMVLALGIS IPVSMMVEQS NTLNRCCKKS RMTCSSSRSR SCPCATPMRA

51 SGSRVSSRSR IFSIVSTSLC RKNTCPPRLS SRNTASRTLP SLKGLTKVLT

101 ARRRLGAVVI SEKSRSPSNA ILKVRGIGVA VMVRISTLAR RRLSCSF*RT

151 PKRCSSSIIT KPKFLNLMSS CTSLCVPITI STVPSAMPSS AALVALLLLK

201 RERLATFTGK SAKRSAKFCA CCSTKSVVGA STATCLPPIT ATNAARRATS

251 VLPKPTSPHT RRSIGFACVK SLITAAMAAA WSSVSS* m645/g645    93.7% identity in 286 aa overlap
```

```
                  10         20         30         40         50         60
   m645.pep  MMMVLALGISIPVSMMVEQSNTLNRCCKKSRMTCSSSRSRSCPCATPMRASGSRVSSRSR
             ||||||||:|:||||||||||||| |||||||||||||||||||||:||||||||||||
   g645      MMMVLALGMSMPVSMMVEQSNTLNLCCKKSRMTCSSSRSRSCPCATPIRASGSRVSSRSR
                  10         20         30         40         50         60

70         80         90        100        110        120
   m645.pep  IFSIVSTSLCRKNTCPPRLSSRNTASRTLPSLKGLTKVLTARRRLGAVVISEKSRSPSNA
             ||||||||||||||||||||||||||||||||||:|||||:||||||||||||||||| ||:|
   g645      IFSIVSTSLCRKNTCPPRLSSRNTASRTLPSLNGLTKVFTARRRLGAVVISEKSRRPSSA
                  70         80         90        100        110        120

130        140        150        160        170        180
   m645.pep  ILKVRGIGVAVMVRISTLARRRLSCSFXRTPKRCSSSIITKPKFLNLMSSCTSLCVPITI
             :|:||||||||||:|||||||||||||:|||||||||||:|||||||:||||||:|||||
   g645      MLRVRGIGVAVMVRMSTLARRRLSCSFCRTPKRCSSSIINKPKFLNFMSSCTNLCVPITI
                 130        140        150        160        170        180

190        200        210        220        230        240
   m645.pep  STVPSAMPSSAALVALLLLKRERLATFTGKSAKRSAKFCACCSTKSVVGASTATCLPPIT
             ||||||||||:|||||||||||||||||||||||||||||||||:|||||||||||||||
   g645      STVPSAMPSSVALVALLLLKRERLATFTGKSAKRSAKFCACCSTRSVVGASTATCLPPIT
                 190        200        210        220        230        240

250        260        270        280
   m645.pep  ATNAARRATSVLPKPTSPHTRRSIGFACVKSLITAAMAAAWSSVSSX
             |||||||||||||||||||||  ||||||||||||||||||||||||
   g645      ATNAARRATSVLPKPTSPHTSRSIGFACVKSLITAAMAAAWSSVSSX
                 250        260        270        280
```

The following partial DNA sequence was identified in *N. meningitidis* <SEQ ID 2079>:

```
a645.seq
  1 ATGATGATGG TGTTGGCGTT GGGAATGTCG ATACCGGTTT CGATGATGGT

51 GGAACAGAGC AACACGTTAA ATCGTTGCTG CAAAAAGTCG CGCATGACTT

101 GTTCCAGCTC GCGCTCGCGC AGTTGTCCGT GCGCCACGCC GATGCGGGCT

151 TCGGGCAGCA GGGTTTCCAG CCGCTCACGC ATGTTTTCGA TGGTATCCAC

201 TTCATTGTGC AGGAAAAATA CTTGCCCGCC GCGTTTGAGT TCGCGCAATA

251 CGGCTTCGCG CACGCTGCCT TCGCTGAACG GTTTGACAAA GGTTTTGACG

301 GCGAGGCGGC GGCTGGGCGC AGTGGTAATC AGCGAGAAGT CGCGCAGTCC

351 TTCCAGCGCC ATACTTAAAG TACGCGGAAT CGGCGTAGCG GTCATGGTAA

401 GGATGTCGAC ATTGGCGCGC AGGCGTTTGA GCTGCTCTTT CTGACGCACG

451 CCGAAGCGGT GTTCTTCGTC GATAATCACT AAACCTACGT TTTTGAATTT

501 TATGTCGTCC TGCACCAGTT TGTGCGTACC GATAACAATA TCGACCGTGC

551 CGTCCGCCAT GCCTTCCAGC GCGGCTTTGG TGGCTTTGCT GTTGTTGAAA

601 CGCGAAAGGC TGGCGACTTT CACGGGGAAA TCGGCGAAGC GGTCGGCAAA

651 ATTTTGCGCG TGCTGCTCGA CCAGAAGCGT GGTCGGTGCG AGTACGGCAA

701 CTTGTTTGCC ACCCATTACC GCCACAAACG CGGCGCGCAG GGCGACTTCG

751 GTTTTGCCGA AACCGACATC GCCGCACACG AGGCGGTCCA TCGGCTTCGC

801 CTGCGTCAAA TCTTTAATCA CGGCGGCGAT GGCGGCTGCC TGGTCTTCGG

851 TTTCTTCGTA G
```

This corresponds to the amino acid sequence <SEQ ID 2080; *ORF* 645.a>:

```
m645.pep

1     MMMVLALGMS IPVSMMVEQS NTLNRCCKKS RMTCSSSRSR SCPCATPMRA
```

-continued

```
  51  SGSRVSSRSR MFSMVSTSLC RKNTCPPRLS SRNTASRTLP SLNGLTKVLT

101  ARRRLGAVVI SEKSRSPSSA ILKVRGIGVA VMVRMSTLAR RRLSCSF*RT

151  PKRCSSSIIT KPTFLNFMSS CTSLCVPITI STVPSAMPSS AALVALLLLK

201  RERLATFTGK SAKRSAKFCA CCSTRSVVGA STATCLPPIT ATNAARRATS

251  VLPKPTSPHT RRSIGFACVK SLITAAMAAA WSSVSS*
```

```
m645/a645   96.9% identity in 286 aa overlap 10         20         30         40         50         60
m645.pep    MMMVLALGISIPVSMMVEQSNTLNRCCKKSRMTCSSSRSRSCPCATPMRASGSRVSSRSR
            ||||||||: ||||||||||||||||||| |||||||||||||||: |||||||||||||
a645        MMMVLALGMSMPVSMMVEQSNTLNLCCKKSRMTCSSSRSRSCPCATPIRASGSRVSSRSR
                    10         20         30         40         50         60

70         80         90        100        110        120
m645.pep    IFSIVSTSLCRKNTCPPRLSSRNTASRTLPSLKGLTKVLTARRRLGAVVISEKSRSPSNA
            :||:||||||||||||||||||||||||||||||:|||||||||||||||||||||||:|
a645        MFSMVSTSLCRKNTCPPRLSSRNTASRTLPSLNGLTKVLTARRRLGAVVISEKSRSPSSA
                    70         80         90        100        110        120

130        140        150        160        170        180
m645.pep    ILKVRGIGVAVMVRISTLARRRLSCSFXRTPKCSSSIITKPKFLNLMSSCTSLCVPITI
            ||||||||||||||: ||||||||||||||||||||||  ||||:||||:|||||||||||
a645        ILKVRGIGVAVMVRMSTLARRRLSCSFXRTPKRCSSSIITKPTFLNFMSSCTSLCVPITI
                   130        140        150        160        170        180

190        200        210        220        230        240
m645.pep    STVPSAMPSSAALVALLLLKRERLATFTGKSAKRSAKFCACCSTKSVVGASTATCLPPIT
            ||||||||||||||||||||||||||||||||||||||||||||:|||||||||||||||
a645        STVPSAMPSSAALVALLLLKRERLATFTGKSAKRSAKFCACCSTRSVVGASTATCLPPIT
                   190        200        210        220        230        240

250        260        270        280
m645.pep    ATNAARRATSVLPKPTSPHTRRSIGFACVKSLITAAMAAAWSSVSSX
            |||||||||||||||||||||||||||||||||||||||||||||||
a645        ATNAARRATSVLPKPTSPHTRRSIGFACVKSLITAAMAAAWSSVSSX
                   250        260        270        280
```

The following partial DNA sequence was identified in *N. gonorrhoeae* <SEQ ID 2081>:

```
g647.seq
   1  ATGCAAAGGC TCGCCGCAGA CGGCATCCAA ATCTTTTTTG TAGGTGTCGA

51  TGGGCAGTTT GCCTTGCGAA TAAACGGTTT GGTTAAAGAG CGTGCACGCT

101  CCGTATTCTT TGGCAAGGTT TGCCGATGCT TTGAGCAGGT AATACTGTAT

151  GGCTTCAAAG GTACGGTGGG TCAGACCGAG CGCGGAACCG TCGCTGTAGC

201  GGACACCGTT TTTCGCCAGA TAGTAGGCGT AGTTGATGAC ACCGATGCCG

251  AGCGAACGGC GGTCCATAGT AGAGGTACGC GCGGCTTCTA CCGGATATCC

301  CTGATAATCT AA
```

This corresponds to the amino acid sequence <SEQ ID 2082; ORF 647.ng>:

```
g647.pep
   1  MQRLAADGIQ IFFVGVDGQF ALRINGLVKE RARSVFFGKV CRCFEQVILY

51  GFKGTVGQTE RGTVAVADTV FRQIVGVVDD TDAERTAVHS RGTRGFYRIS

101  LII*
```

The following partial DNA sequence was identified in *N. meningitidis* <SEQ ID 2083>:

```
m647.seq
   1  ATGCAAAGGC TCGCCGCAGA CGGCATCCAA ATCTTTTTTG TAAGTGTCGA

51  TGGGCAGTTT GCCTTGCGAA TAAACGGTTT GGTTAAAGAG CGTGCACGCA
```

```
101 CCGTATTCTT TGGCAAGGTT TGCCGATGCT TTGAGCAGGT AATACTGTAT

151 GGCTTCAAAG GTACGGTGGG TCAGACCGAG CGCGGAACCG TCGCTGTAGC

201 GGACACCGTT TTTCGCCAGA TAATAAGCAT AGTTAATCAC GCCGATGCCG

251 AGCGAACGGC GGCCCATAGT AGAGGTACGC GCGGCTTCTA CCGGATATCC

301 CTGATAATCT AA
```

This corresponds to the amino acid sequence <SEQ ID 2084; ORF 647>:

```
m647.pep

1    MQRLAADGIQ IFFVSVDGQF ALRINGLVKE RARTVFFGKV CRCFEQVILY

51    GFKGTVGQTE RGTVAVADTV FRQIISIVNH ADAERTAAHS RGTRGFYRIS

101    LII* m647/g647    91.3% identity in 103 aa overlap 10         20         30         40         50         60
m647.pep     MQRLAADGIQIFFVSVDGQFALRINGLVKERARTVFFGKVCRCFEQVILYGFKGTVGQTE
             ||||||||||:|||||||||||||||||||:|||||||||||||||||||||||||||||
g647         MQRLAADGIQIFFVGVDGQFALRINGLVKERARSVFFGKVCRCFEQVILYGFKGTVGQTE
                     10         20         30         40         50         60

70         80         90        100
m647.pep     RGTVAVADTVFRQIISIVNHADAERTAAHSRGTRGFYRISLIIX
             ||||||||||||||:::|:  :||||||:||||||||||||||
g647         RGTVAVADTVFRQIVGVVDDTDAERTAVHSRGTRGFYRISLIIX
                     70         80         90        100
```

The following partial DNA sequence was identified in *N. meningitidis* <SEQ ID 2085>:

```
a647.seq
  1 GTGCAAAGGC TCGTTACACA CAGCGTCCAA GTCTTTTTTG TAGGTGTCGA

51 TGGGCAGTTT GCCTTGCGAA TAAACGGTTT GGTTAAAGAG CGTGCACGCA

101 CCGTATTCTT TGGCAAGGTT TGCCGATGCT TTGAGCAGGT AATACTGTAT

151 GGCTTCAAAG GTACGGTGGG TCAGACCGAG CGCGGAGCCG TCGCTGTAGC

201 GGACACCGTT TTTCGCCAAA TAATACGCAT AGTTGATCAC GCCGATACCG

251 AGCGAACGGC GGCCCATAGT GGAGGTACGC GCGGCTTCTA CCGGATATCC

301 CTGATAATCT AA
```

This corresponds to the amino acid sequence <SEQ ID 2086; ORF 647.a>:

```
m647.pep

1    VQRLVTHSVQ VFFVGVDGQF ALRINGLVKE RARTVFFGKV CRCFEQVILY

51    GFKGTVGQTE RGAVAVADTV FRQIIRIVDH ADTERTAAHS GGTRGFYRIS

101    LII* m647/a647    87.4% identity in 103 aa overlap 10         20         30         40         50         60
m647.pep     MQRLAADGIQIFFVSVDGQFALRINGLVKERARTVFFGKVCRCFEQVILYGFKGTVGQTE
             :|||: : ::|:|||:|||||||||||||||||||||||||||||||||||||||||||
a647         VQRLVTHSVQVFFVGVDGQFALRINGLVKERARTVFFGKVCRCFEQVILYGFKGTVGQTE
                     10         20         30         40         50         60
```

```
              70         80         90        100
m647.pep  RGTVAVADTVFRQIISIVNHADAERTAAHSRGTRGFYRISLIIX
          ||:||||||||||| ||:|||:||||||| |||||||||||||
a647      RGAVAVADTVFRQIIRIVDHADTERTAAHSGGTRGFYRISLIIX
              70         80         90        100
```

The following partial DNA sequence was identified in *N. gonorrhoeae* <SEQ ID 2087>:

```
g648.seq
    1 ATGAACAGGC GCAACGCGCG GATCGAACGG GCTGTGCGTA TTGCAGTGAT

51 CGACGTTTTG AATGTAGATG CGCCCGGTCC CGGCACGCTC CTGCATCAGC

101 GTGGAAAACA GGTCGGCAGC CGGAATGATA CGCTTGCGTA TGTTCGGGTC

151 TTGCTCGTAT TTCGTATAGA GCCGCTCAAA TTCGTCTTGG TCGGCAAAAA

201 ACGCTTCGTA CAACCCCGAA ACCTCGTTGG GCGAAAACAG CGTAATGTTG

251 CCGCCCTTAA TCAGGCGGGT GTACAGCAGG CGGTTGATTT GCACGCCATA

301 ATCAAGCTGG CGGATACGGT TGTCTTCCAC GCCCCGGTTG TTTTTCAACA

351 CCAGCAGGCT TTCGGCTTCA ATATGCCACA AGGGGTAGAA CAAGGTTGCC

401 GCGCCGCCGC GCACGCCACC TTGCGAACAA GATTTGACCG CCGCCTGAAA

451 CATCTTAAAG AAGGGAATGC AGCCGGTATG CCGGGCTTCA CCGCCCCGGA

501 TTTCGCTGTC CAGCCCGCGG ATACGTCCGG CATTGATGCC GATGCCCGCG

551 CGTTGGGAAA CGTATTTCAC AATCGCGCTG GTAGTGGCAT TGATGGAATC

601 CAAACTATCG TCGCATTCAA TCAGCACACA GCTTGA
```

This corresponds to the amino acid sequence <SEQ ID 2088; *ORF* 648.ng>:

```
g648.pep
    1 MNRRNARIER AVRIAVIDVL NVDAPGPGTL LHQRGKQVGS RNDTLAYVRV

51 LLVFRIEPLK FVLVGKKRFV QPRNLVGRKQ RNVAALNQAG VQQAVDLHAI

101 IKLADTVVFH APVVFQHQQA FGFNMPQGVE QGCRAAAHAT LRTRFDRRLK

151 HLKEGNAAGM PGFTAPDFAV QPADTSGIDA DARALGNVFH NRAGSGIDGI

201 QTIVAFNQHT A*
```

The following partial DNA sequence was identified in *N. meningitidis* <SEQ ID 2089>:

```
m648.seq
    1 ATGAACAGGC GCGACGCGCG GATCGAACGG GCTGTGCGTA TTGCAGTGAT

51 CGACGTTTTG AATGTAGATG CGCCCGGTTC CGGCACGCTC CTGCATCAGC

101 GTGGAAAACA GGTCGGCAGC CGGAATGATG CGCTTGCGGA TATCAGGGTC

151 TTGCTCGTAT TTCGTATAGA GCCGCTCAAA TTCGTCTTGG TCGGCAAAAA

201 ACGCTTCGTA CAATCCCGGA ACCTCGTTGG GCGAAAACAG CGTAATGTTG

251 CCGCCCTTAA TCAGGCGGGT GTACAGCAGG CGGTTGATTT GCACGCCGTA

301 ATCAAGCTGA CGGATACGGT TGTCTTCCAC ACCGCGGTTG TTTTTCAACA

351 CCAGCAGGCT TTCGGCTTCG ATATGCCACA AGGGGTAGAA CAAGGTTGCC

401 GCGCCGCCGC GCACGCCGCC TTGCGAACAG GATTTGACCG CCGCCTGAAA
```

```
451 CATTTTAAAG AAGGGAATGC AGCCGGTATG CCGCGCTTCG CCGCCCCGGA

501 TTTCGCTGTC CAAACCGCGG ATACGTCCGG CATTGATGCC GATGCCCGCA

551 CGCTGGGAAA CGTATTTCAC AATCGCGCTG GTAGTGGCAT TGATGGAATC

601 CAAACTATCG TCGCATTCAA TCAGCACACA GCTTGA
```

This corresponds to the amino acid sequence <SEQ ID 2090; ORF 648>:

```
m648.pep
       1   MNRRDARIER AVRIAVIDVL NVDAPGSGTL LHQRGKQVGS RNDALADIRV
      51   LLVFRIEPLK FVLVGKKRFV QSRNLVGRKQ RNVAALNQAG VQQAVDLHAV
     101   IKLTDTVVFH TAVVFQHQQA FGFDMPQGVE QGCRAAAHAA LRTGFDRRLK
     151   HFKEGNAAGM PRFAAPDFAV QTADTSGIDA DARTLGNVFH NRAGSGIDGI
     201   QTIVAFNQHT A* m648/g648    91.5% identity in 211 aa overlap 10         20         30         40         50         60
m648.pep   MNRRDARIERAVRIAVIDVLNVDAPGSGTLLHQRGKQVGSRNDALADIRVLLVFRIEPLK
           ||||:||||||||||||||||||||| ||||||||||||||||:|| :||||||||||||
g648       MNRRNARIERAVRIAVIDVLNVDAPGPGTLLHQRGKQVGSRNDTLAYVRVLLVFRIEPLK
                   10         20         30         40         50         60

70         80         90        100        110        120
m648.pep   FVLVGKKRFVQSRNLVGRKQRNVAALNQAGVQQAVDLHAVIKLTDTVVFHTAVVFQHQQA
           |||||||||||| ||||||||||||||||||||||||||:|||:||||||: ||||||||
g648       FVLVGKKRFVQPRNLVGRKQRNVAALNQAGVQQAVDLHAIIKLADTVVFHAPVVGQHQQA
                   70         80         90        100        110        120

130        140        150        160        170        180
m648.pep   FGFDMPQGVEQGCRAAAHAALRTGFDRRLKHFKEGNAAGMPRFAAPDFAVQTADTSGIDA
           |||:|||||||||||||||:|||||||:||||||||||||||:|||||||||:|||||||
g648       FGFNMPQGVEQGCRAAAHATLRTRFDRRLKHLKEGNAAGMPGFTAPDFAVQPADTSGIDA
                  130        140        150        160        170        180

190        200        210
m648.pep   DARTLGNVFHNRAGSGIDGIQTIVAFNQHTAX
           |||:|||||||||||||||||||||||||||
g648       DARALGNVFHNRAGSGIDGIQTIVAFNQHTAX
                  190        200        210
```

The following partial DNA sequence was identified in *N. meningitidis* <SEQ ID 2091>:

```
a648.seq
   1 ATGAACAGGC GCAACGCGCG GATCGAACGG GCTGTGCGTA TTGCAGTGAT

51 CGACGTTTTG AATGTAGATG CGCCCGGTTC CGGCACGCTC CTGCATCAGC

101 GTGGAAAACA GGTCGGCAGC CGGAATGATG CGCTTGCGGA TATCAGGGTC

151 TTGCTCGTAT TCGTATAGA GCCGCTCAAA TTCGTCTTGG TCGGCAAAAA

201 ACGCTTCGTA CAATCCCGGA ACCTCGTTGG GCGAAAACAG CGTAATGTTG

251 CCGCCCTTAA TCAGGCGGGT GTACAGCAGG CGGTTGATTT GCACGCCGTA

301 ATCAAGCTGA CGGATACGGT TGTCTTCCAC GCCCCGGTTG TTTTTCAACA

351 CCAGCAGGCT TTCGGCTTCG ATATGCCACA AGGGGTAGAA CAAGGTTGCC

401 GCGCCGCCGC GCACGCCACC TTGCGAACAG GATTTGACTG CCGCCTGAAA

451 CATTTTAAAG AAGGGAATGC AGCCGGTATG CCGTGCTTCG CCGCCCCGGA

501 TTTCGCTGTC CAGTCCGCGG ATACGTCCGG CATTGATGCC GATGCCCGCA

551 CGCTGGGAAA CGTATTTCAC AATCGCGCTG GTAGTGGCGT TGATGGAATC

601 CAGGCTGTCG TCGCATTCGA TCAATACGCA GCTTGA
```

This corresponds to the amino acid sequence <SEQ ID 2092; ORF 648.a>:

```
a648.pep
        1   MNRRDARIER AVRIAVIDVL NVDAPGSGTL LHQRGKQVGS RNDALADIRV
       51   LLVFRIEPLK FVLVGKKRFV QSRNLVGRKQ RNVAALNQAG VQQAVDLHAV
      101   IKLTDTVVFH APVVGQHQQA FGFDMPQGVE QGCRAAAHAT LRTGFDCRLK
      151   HFKEGNAAGM PCFAAPDFAV QSADTSGIDA DARTLGNVFH NRAGSGVDGI
      201   QAVVAFDQYA A* m648/a648    93.8% identity in 211 aa overlap 10         20         30         40         50         60
m648.pep    MNRRDARIERAVRIAVIDVLNVDAPGSGTLLHQRGKQVGSRNDALADIRVLLVFRIEPLK
            ||||:|||||||||||||||||||||||:|||||||||||||||||||||||||||||||
a648        MNRRNARIERAVRIAVIDVLNVDAPGPGTLLHQRGKQVGSRNDALADIRVLLVFRIEPLK
                   10         20         30         40         50         60

70         80         90        100        110        120
m648.pep    FVLVGKKRFVQSRNLVGRKQRNVAALNQAGVQQAVDLHAVIKLTDTVVFHTAVVFQHQQA
            ||||||||||||||||||||||||||||||||||||||||||||||||||:||||||||
a648        FVLVGKKRFVQSRNLVGRKQRNVAALNQAGVQQAVDLHAVIKLTDTVVFHAPVVFQHQQA
                   70         80         90        100        110        120

130        140        150        160        170        180
m648.pep    FGFDMPQGVEQGCRAAAHAALRTGFDRRLKHFKEGNAAGMPRFAAPDFAVQTADTSGIDA
            |||:||||||||||||||||:||||| |||||||||||||| ||||||||||:|||||||
a648        FGFNMPQGVEQGCRAAAHATLRTRFDCRLKHLKEGNAAGMPCFTAPDFAVQSADTSGIDA
                   130        140        150        160        170        180

190        200        210
m648.pep    DARTLGNVFHNRAGSGIDGIQTIVAFNQHTAX
            ||||||||||||||||:|||::|||:|::||
a648        DARTLGNVFHNRAGSGVDGIQAVVAFDQYAAX
                   190        200        210
```

The following partial DNA sequence was identified in *N. gonorrhoeae* <SEQ ID 2093>:

```
g649.seq
    1 ATGCTTGCCA TACTGTTGTC TGCAATACTG GGACTGGTAT CAACAACTGC

51 CGCTGCCGGT ACGTCAGAAC CCGCCCACCG ACATACCAAA CATATCAGCA

101 AGGCAAACAA GCAGATGCTG CACCCCGAAT GCAGGAAATA TTTGGAACGC

151 CGTGCCGCGT GGTACCGATC GCAAGGCAAC GTGCAGGAAT TGCGCGAAAA

201 CAAAAAGGCG CGCAAAGCAT TCCGCACCCT GCCTTATGCG GAACAGAAAA

251 TCCAATGCCG GCGGCTTAT GAGGCTTTCG ATGATTTCGA CGGCGGCAGG

301 TTCCGCCGTT AA
```

This corresponds to the amino acid sequence <SEQ ID 2094; ORF 649.ng>:

```
g649.pep
    1 MLAILLSAIL GLVSTTAAAG TSEPAHRHTK HISKANKQML HPECRKYLER

51 RAAWYRSQGN VQELRENKKA RKAFRTLPYA EQKIQCRAAY EAFDDFDGGR

101 FRR*
```

The following partial DNA sequence was identified in *N. meningitidis* <SEQ ID 2095>:

```
m649.seq
    1 ATGCTTGCCA TACTGTTGTC TGCAATATTG GGACTGGTAT CGACAACTGC

51 CGCTGCCGGT ACGTCAGAAC CCGCCCACCG CGATACCAAA CATATCCGCA
```

-continued

```
101 AGGCAAACAA GCAGATGCTG CACCCCGAAT GCAGGAAATA TTTGGAACGC

151 CGTGCCGCGT GGTACCGATC GCAAGGCAAC GTGCAGGAAT GCGCGAAAA

201 CAAAAAGGCG CGCAAAGCAT TCCGCTCCCT GCCTTATGCG AACAGAAAA

251 TCCAATGCCG GGCGGCTTAT GAGGCTTTCG ATGATTTCGA CGGCGGCAGT

301 TTCCGCCGTT AA
```

This corresponds to the amino acid sequence <SEQ ID 2096; ORF 649>:

```
m649.pep

1    MLAILLSAIL GLVSTTAAAG TSEPAHRDTK HIRKANKQML HPECRKYLER

51    RAAWYRSQGN VQELRENKKA RKAFRSLPYA EQKIQCRAAY EAFDDFDGGS

101    FRR* m649/g649   96.1% identity in 103 aa overlap 10         20         30         40         50         60
m649.pep    MLAILLSAILGLVSTTAAAGTSEPAHRDTKHIRKANKQMLHPECRKYLERRAAWYRSQGN
            |||||||||||||||||||||||||||| ||||  ||||||||||||||||||||||||
g649        MLAILLSAILGLVSTTAAAGTSEPAHRHTKHISKANKQMLHPECRKYLERRAAWYRSQGN
                    10         20         30         40         50         60

70         80         90        100
m649.pep    VQELRENKKARKAFRSLPYAEQKIQCRAAYEAFDDFDGGSFRRX
            ||||||||||||||||:||||||||||||||||||||||:|||
g649        VQELRENKKARKAFRTLPYAEQKIQCRAAYEAFDDFDGGRFRRX
                    70         80         90        100
```

The following partial DNA sequence was identified in *N. meningitidis* <SEQ ID 2097>:

```
a649.seq
   1 ATGCTTGCCA TACTGTTGTC TGCAATATTG GGACTGGTAT CGACAACTGC

51 CGCTGCCGGT ACGTCAGAAC CCGCCCACCG CGATACCAAA CATATCCGCA

101 AGGCAAACAA GCAGATGCTG CACCCCGAAT GCAGGAAATA TTTGGAACGC

151 CGTGCCGCGT GGTACCGATC GCAAGGCAAC GTGCAGGAAT GCGCGAAAA

201 CAAAAAGGCG CGCAAAGCAT TCCGCTCCCT GCCTTATAAG AACAGAAAA

251 CCCAATGCCG GCGGCTTAT GAGGCTTTCG ATGATTTCGA CGGCAGCAGG

301 TTCCGCCGTT AA
```

This corresponds to the amino acid sequence <SEQ ID 2098; ORF 649.a>:

```
a649.pep

1    MLAILLSAIL GLVSTTAAAG TSEPAHRDTK HIRKANKQML HPECRKYLER

51    RAAWYRSQGN VQELRENKKA RKAFRSLPYK EQKTQCRAAY EAFDDFDGSR

101    FRR* m649/a649   96.1% identity in 103 aa overlap 10         20         30         40         50         60
m649.pep    MLAILLSAILGLVSTTAAAGTSEPAHRDTKHIRKANKQMLHPECRKYLERRAAWYRSQGN
            ||||||||||||||||||||||||||||||||||||||||||||||||||||||||||
a649        MLAILLSAILGLVSTTAAAGTSEPAHRDTKHIRKANKQMLHPECRKYLERRAAWYRSQGN
                    10         20         30         40         50         60
```

```
                  70         80         90        100
m649.pep   VQELRENKKARKAFRSLPYAEQKIQCRAAYEAFDDFDGGSFRRX
           |||||||||||||||||||| ||| ||||||||||||||:||||
a649       VQELRENKKARKAFRSLPYKEQKEQCRAAYEAFDDFDGSRFRRX
                  70         80         90        100
```

The following partial DNA sequence was identified in *N. gonorrhoeae* <SEQ ID 2099>:

```
g650.seq
    1 ATGTCCAAAC TCAAAACCAT CGCCCTGACC GCATCAGGTC TGTCCGTTTG
   51 TCCGGGTTTC CTATATGCCC AAAACACCTC ATCACACCAA GTCGGTTTAG
  101 CGATTATGCG GTTAAACTCT TCAATACTCG ACCTGCCACC GACAAAACAA
  151 TATTTCCAAT CCGGCAGCCT GTGGGACGAG CTGCGCCAAG GCTTCCGGAT
  201 GGGCGAAGTC AATCCCGAAC TGGTACGCCG CCACGAAAGC AAATTCATCG
  251 CAAGCCGCAG CTATTTCGAC AGGGTCGTCA ACCGGAGCCG ACCCTATATG
  301 TACCATATCG CCAACGAAGT CAAAAAACGC AATATGCCCG CCGAAGCCGC
  351 CCTGCTTCCC TTCATCGAAA GCGCGTTCGT CACCAAAGCC AAATCACACG
  401 TCGGCGCATC GGGCCTGTGG CAGTTCATGC CCGCTACCGG CAGGCATTAC
  451 GGCTTGGAAA AACaccgGT TTACGacggc aggcacGacg TTtacgcaGc
  501 taccgatgcc gcacTCAACT AtctGcAATA TCTCTAtggA CTGTTCGGCG
  551 ACTGGCCGCT CGCCTTTGCC GCCTACAACT GGGGTGAAGG CAACGTCGGA
  601 CGCGCCGTCA ACCGCGCCCG CGACCAAGGG CTCGAACCGA CCTACGAAAA
  651 CCTGCGTATG CCCAACGAAA CGCGCAACTA TGTCCCCAAG CTGCTCGCCG
  701 TGCGCAACAT TATTGCCACC CCCCAATCTT TCGGCATGAA TATCAGCGAC
  751 ATAGACAACA AACCCTATTT TCAGGCAGTC GAACCGGGCC GTCCGCTCGA
  801 caacGAagcC ATCGCCCGGC TTGCCGGCAT CACGCAAAGC GAGCTGCTCG
  851 CCCTGAATCC TGCATTCAAC GTCCCCGCgt tcatCCCCAA AAAcaaacgc
  901 aaacTGCTGC TTCCTGTCGC GTCCGTCCAA ACCTTccaaa gcaACTACCT
  951 CAACGCCGCA CCCGACAGCC TGTTTTCATG GAAGTCTAT ACGCCTGCCG
 1001 CCAAAACCAG CCTGTCCGAC ATCTCGACGG CAACCGGCAT GAGCATTGCC
 1051 GACATCAAAC GCCTCAACAA CCTGAACGGC AACCTTGTCA ACGCAGGACG
 1101 CAGCATCCTT GTCGCCAAGA ACGGCAAGAC CCTTCATACG GCATCGGAat
 1151 ccGTCGTTTC CATCGACATC GACAATACGC CcgacacCTa ccgttccaaT
 1201 ATGCcggcag gcaCGGTGAA CGTCAGCATt gccCgaatcc aacCCgccgc
 1251 cgcaCAGACA gcggacatta ccgtcgcacc tttgccgcaa gaaaccgtcc
 1301 gtacgggaac ccgatcccct tgtccgcaTt accgaacccg ccctTGCGAC
 1351 AGCCGCAGCg CaacctCAAA ccgAAAAACA GACTGCCATG CcgtctGA
```

This corresponds to the amino acid sequence <SEQ ID 2100; ORF 650.ng>:

```
g650.pep
    1 MSKLKTIALT ASGLSVCPGF LYAQNTSSHQ VGLAIMRLNS SILDLPPTKQ
   51 YFQSGSLWDE LRQGFRMGEV NPELVRRHES KFIASRSYFD RVVNRSRPYM
  101 YHIANEVKKR NMPAEAALLP FIESAFVTKA KSHVGASGLW QFMPATGRHY
```

```
151 GLEKTPVYDG RHDVYAATDA ALNYLQYLYG LFGDWPLAFA AYNWGEGNVG

201 RAVNRARDQG LEPTYENLRM PNETRNYVPK LLAVRNIIAT PQSFGMNISD

251 IDNKPYFQAV EPGRPLDNEA IARLAGITQS ELLALNPAFN VPAFIPKNKR

301 KLLLPVASVQ TFQSNYLNAA PDSLFSWEVY TPAAKTSLSD ISTATGMSIA

351 DIKRLNNLNG NLVNAGRSIL VAKNGKTLHT ASESVVSIDI DNTPDTYRSN

401 MPAGTVNVSI ARIQPAAAQT ADITVAPLPQ ETVRTGTRSP CPHYRTRPCD

451 SRSATSNRKT DCHAV*
```

The following partial DNA sequence was identified in *N. meningitidis* <SEQ ID 2101>:

```
m650.seq
    1 ATGTCCAAAC TCAAAACCAT CGCTCTGACC GCATCAGGTC TGTCCGTTTG

51 TCCGGGTTTC CTATACGCCC AAAACACCTC ATCACACCAA ATCGGTTTGG

101 CGATTATGCG CTTAAACTCT TCAATACTCG ACCTGCCCCC GACAAAACAA

151 TATTTCCAAT CCGGCAGCCT GTGGGCGAG CTGCGCCAAG GCTTCCGGAT

201 GGGCGAAGTC AATCCCGAAC TGGTACGCCG CCACGAAAGC AAATTCATCG

251 CAAGCCACAG CTATTTCAAC AGGGTCATCA ACCGGAGTAG ACCCTATATG

301 TACCATATCG CCAACGAAGT CAAAAAACGC AATATGCCCG CCGAAGCCGC

351 CCTGCTTCCC TTCATCGAAA GCGCGTTCGT CACCAAAGCC AAATCACACG

401 TCGGCGCATC AGGATTATGG CAGTTTATGC CCGCTACCGG CAGGCATTAC

451 GGCCTGGAAA AAACACCGGT TTACGACGGC AGGCACGACG TTTACGCCGC

501 CACCGATGCC GCACTCAACT ATCTGCAATA CCTCTATGGA CTGTTCGGCG

551 ACTGGCCGCT TGCCTTTGCC GCCTACAACT GGGGTGAAGG CAACGTCGGA

601 CGCGCCATCA ACCGCGCCCG CGCCCAAGGG CTCGAACCGA CCTACGAAAA

651 CCTGCGTATG CCCAACGAAA CGCGCAACTA TGTCCCCAAG CTGCTCGCCG

701 TGCGCAACAT TATTGCCACT CCCCAATCTT TCGGCATGAA TATCAGCGAC

751 ATAGACAACA AACCCTATTT TCAGGCAGTC GAACCGGATC GTCCGCTCGA

801 CAACGAAGCC ATCGCCCGGC TTGCCGGCAT CACGCAAAGC GAGCTGCTCG

851 CCCTAAACCC CGCATTCAAC GTCCCCGCGT TTATCCCCAA AAGCAAACGC

901 AAACTGCTGC TTCCTGTCGC GTCCGTACAA ACCTTCCAAA GCAACTACCT

951 CAACGCCGCA CCCGACAGCC TGTTTTCATG GGAAGTCTAT ACGCCTGCCG

1001 CCAAAACCAG CCTGTCCGAC ATCTCGACGG CAACCGGCAT GAGCATTGCC

1051 GACATCAAAC GCCTCAACAA CCTGAACGGC AACCTTGTCA ACGCAGGACG

1101 CAGCATCCTT GTCGCCAAGA ACGGCAAAAC CCTTCAGACG GCATCGGAAT

1151 CCGTCGTTTC CATCGACATC GACAATACGC CGACACCTA CCGTTCCAAT

1201 ATGCCGGCAG GCACGGTGAA CGTCGGCATT GCCCGAATCC GACCCGCCGC

1251 CGCACAGACA GCGGACATTA CCGTCGCACC TTTGCCGCAG AAAACCGTCC

1301 GTACGG.AAC CCGATCCCCT TGTCCGTATT GCCGAACCTG CCCTTGCGAC

1351 AGCCGCAGCG CAACCTCAAA CCGAAAAACA GACCGCCATG CCGTCTGA
```

This corresponds to the amino acid sequence <SEQ ID 2102; ORF 650>:

```
m650.pep

1 MSKLKTIALT ASGLSVCPGF LYAQNTSSHQ IGLAIMRLNS SILDLPPTKQ

51 YFQSGSLWGE LRQGFRMGEV NPELVRRHES KFIASHSYFN RVINRSRPYM

101 YHIANEVKKR NMPAEAALLP FIESAFVTKA KSHVGASGLW QFMPATGRHY

151 GLEKTPVYDG RHDVYAATDA ALNYLQYLYG LFGDWPLAFA AYNWGEGNVG

201 RAINRARAQG LEPTYENLRM PNETRNYVPK LLAVRNIIAT PQSFGMNISD

251 IDNKPYFQAV EPDRPLDNEA IARLAGITQS ELLALNPAFN VPAFIPKSKR

301 KLLLPVASVQ TFQSNYLNAA PDSLFSWEVY TPAAKTSLSD ISTATGMSIA

351 DIKRLNNLNG NLVNAGRSIL VAKNGKTLQT ASESVVSIDI DNTPDTYRSN

401 MPAGTVNVGI ARIRPAAAQT ADITVAPLPQ KTVRTXTRSP CPYCRTCPCD

451 SRSATSNRKT DRHAV* m650/g650 96.1% identity in 465 aa overlap 10         20         30         40         50         60
    m650.pep   MSKLKTIALTASGLSVCPGFLYAQNTSSHQIGLAIMRLNSSILDLPPTKQYFQSGSLWGE
               ||||||||||||||||||||||||||||:|||||||||||||||||||||||||||| |
    g650       MSKLKTIALTASGLSVCPGFLYAQNTSSHQVGLAIMRLNSSILDLPPTKQYFQSGSLWDE
                    10         20         30         40         50         60

70         80         90        100        110        120
    m650.pep   LRQGFRMGEVNPELVRRHESKFIASHSYFNRVINRSRPYMYHIANEVKKRNMPAEAALLP
               ||||||||||||||||||||||||||:|||::||||||||||||||||||||||||||||
    g650       LRQGFRMGEVNPELVRRHESKFIASRSYFDRVVNRSRPYMYHIANEVKKRNMPAEAALLP
                    70         80         90        100        110        120

130        140        150        160        170        180
    m650.pep   FIESAFVTKAKSHVGASGLWQFMPATGRHYGLEKTPVYDGRHDVYAATDAALNYLQYLYG
               ||||||||||||||||||||||||||||||||||||||||||||||||||||||||||||
    g650       FIESAFVTKAKSHVGASGLWQFMPATGRHYGLEKTPVYDGRHDVYAATDAALNYLQYLYG
                   130        140        150        160        170        180

190        200        210        220        230        240
    m650.pep   LFGDWPLAFAAYNWGEGNVGRAINRARAQGLEPTYENLRMPNETRNYVPKLLAVRNIIAT
               ||||||||||||||||||||||:||| ||||||||||||||||||||||||||||||||
    g650       LFGDWPLAFAAYNWGEGNVGRAVNRARDQGLEPTYENLRMPNETRNYVPKLLAVRNIIAT
                   190        200        210        220        230        240

250        260        270        280        290        300
    m650.pep   PQSFGMNISDIDNKPYFQAVEPDRPLDNEAIARLAGITQSELLALNPAFNVPAFIPKSKR
               |||||||||||||||||||||| ||||||||||||||||||||||||||||||||||:||
    g650       PQSFGMNISDIDNKPYFQAVEPGRPLDNEAIARLAGITQSELLALNPAFNVPAFIPKNKR
                   250        260        270        280        290        300

310        320        330        340        350        360
    m650.pep   KLLLPVASVQTFQSNYLNAAPDSLFSWEVYTPAAKTSLSDISTATGMSIADIKRLNNLNG
               ||||||||||||||||||||||||||||||||||||||||||||||||||||||||||||
    g650       KLLLPVASVQTFQSNYLNAAPDSLFSWEVYTPAAKTSLSDISTATGMSIADIKRLNNLNG
                   310        320        330        340        350        360

370        380        390        400        410        420
    m650.pep   NLVNAGRSILVAKNGKTLQTASESVVSIDIDNTPDTYRSNMPAGTVNVGIARIRPAAAQT
               ||||||||||||||||||||:|||||||||||||||||||||||||||||:||||:||||
    g650       NLVNAGRSILVAKNGKTLHTASESVVSIDIDNTPDTYRSNMPAGTVNVSIARIQPAAAQT
                   370        380        390        400        410        420

430        440        450        460
    m650.pep   ADITVAPLPQKTVRTXTRSPCPYCRTCPCDSRSATSNRKTDRHAVX
               ||||||||||:||||  ||||||:  ||  ||||||||||||||||
    g650       ADITVAPLPQETVRTGTRSPCPHYRTRPCDSRSATSNRKTDCHAVX
                   430        440        450        460
```

The following partial DNA sequence was identified in *N. meningitidis* <SEQ ID 2103>:

```
a650.seq
    1 ATGTCCAAAC TCAAAACCAT CGCCCTGACC GCGTCAGGTC TGTCCGTTTG

51 TCCGGGTTTC CTATACGCCC AAAACACCTC ATCACACCAA ATCGGTTTGG

101 CGATTATGCG CTTAAACTCT TCAATACTCG ACCTGCCACC GACAAAACAA
```

```
151 TATTTCCAAT CCGGCAGCCT GTGGAGCGAG CTGCGCCAAG GCTTCCGGAT

201 GGGCGAAGTC AATCCCGAAC TGGTACGCCG CCACGAAAGC AAATTCATCG

251 CAAGCCACAG CTATTTCAAC AGGGTCATCA ACCGGAGTAG ACCCTATATG

301 TACCATATCG CCAACGAAGT CAAAAAACGC AATATGCCCG CCGAAGCCGC

351 CCTGCTTCCC TTCATCGAAA GCGCGTTCGT CACCAAAGCC AAATCACACG

401 TCGGCGCATC GGGCCTGTGG CAGTTCATGC CCGCTACCGG CAGGCATTAC

451 GGCCTGGAAA AAACACCGGT TTACGACGGC AGGCACGACA TTTACGCCGC

501 CACCGATGCC GCACTCAACT ATCTGCAATA CCTCTATGGA CTGTTCGGCG

551 ACTGGCCGCT CGCCTTTGCC GCCTACAACT GGGGTGAAGG CAACGTCGGA

601 CGCGCCATCA ACCGCGCCCG CGCCCAAGGG CTCGAACCGA CCTACGAAAA

651 CCTGCGTATG CCCAACGAAA CGCGCAACTA TGTTCCCAAG CTGCTCGCCG

701 TGCGCAACAT CATTGCCGCC CCCCAATCTT TCGGCATGAA TATCAGCGAC

751 ATAGACAACA AACCGTATTT CAGGCAGTC GAACCGGACC GTCCGCTCGA

801 CAACGAAGCC ATCGCCCGGC TTGCCGGCAT CACGCAAAGC GAGCTGCTCG

851 CCCTAAACCC CGCATTCAAC GTCCCCGCGT TCATCCCCAA AAGCAAACGC

901 AAACTGCTGC TTCCTGTCGC GTCCGTACAA ACCTTCCAAA GCAACTACCT

951 CAACGCCGCA CCCGACAGCC TGTTTTCATG GGAAGTCTAT ACGCCTGCCG

1001 CCAAAACCAG CTTGTCCGAC ATCTCGACGG CAACCGGCAT GAGCATTGCC

1051 GACATCAAAC GCCTCAACAA CCTGAACGGC AACCTTGTCA ACGCAGGACG

1101 CAGCATCCTT GTCGCCAAGA ACGGCAAAAC CCTTCAGACG GCATCGGAAT

1151 CCGTCGTTTC CATCGACATC GACAATACGC CCAACACCTA CCGTTCCAAT

1201 ATGCCGGCAG GCACGGTGAA CGTCGGCATT GCCCGAATCC GACCCGCCGC

1251 CGCACAGACA GCGGACATTA CCGTCGCACC TTTGCCGCAG AAAACCGTCC

1301 GTACGG.AAC CCGATCCCCT TGTCCGTATT GCCGAACCTG CCCTTGCGAC

1351 AGCCGCAGCG CAACCTCAAA CCGAAAAACA GACCGCCATG CCGTCTGA
```

This corresponds to the amino acid sequence <SEQ ID 2104; ORF 650.a>:

```
a650.pep

1 MSKLKTIALT ASGLSVCPGF LYAQNTSSHQ IGLAIMRLNS SILDLPPTKQ

51 YFQSGSLWSE LRQGFRMGEV NPELVRRHES KFIASHSYFN RVINRSRPYM

101 YHIANEVKKR NMPAEAALLP FIESAFVTKA KSHVGASGLW QFMPATGRHY

151 GLEKTPVYDG RHDIYAATDA ALNYLQYLYG LFGDWPLAFA AYNWGEGNVG

201 RAINRARAQG LEPTYENLRM PNETRNYVPK LLAVRNIIAA PQSFGMNISD

251 IDNKPYFQAV EPDRPLDNEA IARLAGITQS ELLALNPAFN VPAFIPKSKR

301 KLLLPVASVQ TFQSNYLNAA PDSLFSWEVY TPAAKTSLSD ISTATGMSIA

351 DIKRLNNLNG NLVNAGFSIL VAKNGKTLQT ASESVVSIDI DNTPNTYRSN

401 MPAGTVNVGI ARIRPAAAQT ADITVAPLPQ KTVRTXTRSP CPYCRTCPCD

451 SRSATSNRKT DRHAV*
```

-continued m650/a650 99.1% identity in 465 aa overlap

```
              10        20        30        40        50        60
m650.pep  MSKLKTIALTASGLSVCPGFLYAQNTSSHQIGLAIMRLNSSILDLPPTKQYFQSGSLWGE
          |||||||||||||||||||||||||||||||||||||||||||||||||||||||||:|
a650      MSKLKTIALTASGLSVCPGFLYAQNTSSHQIGLAIMRLNSSILDLPPTKQYFQSGSLWSE
              10        20        30        40        50        60

70        80        90       100       110       120
m650.pep  LRQGFRMGEVNPELVRRHESKFIASHSYFNRVINRSRPYMYHIANEVKKRNMPAEAALLP
          ||||||||||||||||||||||||||||||||||||||||||||||||||||||||||||
a650      LRQGFRMGEVNPELVRRHESKFIASHSYFNRVINRSRPYMYHIANEVKKRNMPAEAALLP
              70        80        90       100       110       120

130       140       150       160       170       180
m650.pep  FIESAFVTKAKSHVGASGLWQFMPATGRHYGLEKTPVYDGRHDVYAATDAALNYLQYLYG
          |||||||||||||||||||||||||||||||||||||||||||:||||||||||||||||
a650      FIESAFVTKAKSHVGASGLWQFMPATGRHYGLEKTPVYDGRHDIYAATDAALNYLQYLYG
             130       140       150       160       170       180

190       200       210       220       230       240
m650.pep  LFGDWPLAFAAYNWGEGNVGRAINRARAQGLEPTYENLRMPNETRNYVPKLLAVRNIIAT
          |||||||||||||||||||||||||||||||||||||||||||||||||||||||||||:
a650      LFGDWPLAFAAYNWGEGNVGRAINRARAQGLEPTYENLRMPNETRNYVPKLLAVRNIIAA
             190       200       210       220       230       240

250       260       270       280       290       300
m650.pep  PQSFGMNISDIDNKPYFQAVEPDRPLDNEAIARLAGITQSELLALNPAFNVPAFIPKSKR
          ||||||||||||||||||||||||||||||||||||||||||||||||||||||||||||
a650      PQSFGMNISDIDNKPYFQAVEPDRPLDNEAIARLAGITQSELLALNPAFNVPAFIPKSKR
             250       260       270       280       290       300

310       320       330       340       350       360
m650.pep  KLLLPVASVQTFQSNYLNAAPDSLFSWEVYTPAAKTSLSDISTATGMSIADIKRLNNLNG
          ||||||||||||||||||||||||||||||||||||||||||||||||||||||||||||
a650      KLLLPVASVQTFQSNYLNAAPDSLFSWEVYTPAAKTSLSDISTATGMSIADIKRLNNLNG
             310       320       330       340       350       360

370       380       390       400       410       420
m650.pep  NLVNAGRSILVAKNGKTLQTASESVVSIDIDNTPDTYRSNMPAGTVNVGIARIRPAAAQT
          |||||||||||||||||||||||||||||||||||||:||||||||||||||||||||||
a650      NLVNAGRSILVAKNGKTLQTASESVVSIDIDNTPNTYRSNMPAGTVNVGIARIRPAAAQT
             370       380       390       400       410       420

430       440       450       460
m650.pep  ADITVAPLPQKTVRTXTRSPCPYCRTCPCDSRSATSNRKTDRHAVX
          |||||||||||||||||||||||||||||||||||||||||||||
a650      ADITVAPLPQKTVRTXTRSPCPYCRTCPCDSRSATSNRKTDRHAVX
             430       440       450       460
```

The following partial DNA sequence was identified in *N. gonorrhoeae* <SEQ ID 2105>:

```
g652.seq
    1 ATGATCGAAT TGGACGGTAC TGAAAACAAA GGCAATTTGG GTGCGAATGC

51 GACTTTGGCG GTCTCTATGG CGGTTGCACG CGCCGCTGCC GAAGACTCAG

101 GCCTGCCGCT TTACCGCTAC TTGGGGGGCG CAGGTCCGAT GTCCCTGCCC

151 GTACCGATGA TGAACGTCAT CAACGGCGGC GAACACGCCA CAACAGCCT

201 GAACATCCAA GAGTTTATGA TTATGCCCGT CGGCGCAAAA TCTTTCCGCG

251 AAGCGTTGCG CTGCGGTGCG GAAATTTTCC ACGCCTTGAA AAAACTGTGC

301 GACAGTAAAG GCTTCCCGAC CACAGTCGGC GACGAAGGCG GTTTCGCCCC

351 CAACCTGAAC AGCCACAAAG AAGCCCTGCA ACTGATGGTC GAAGCGGCCG

401 AAGCCGCCGG CTACAAGGCG GGCGAAGACG TATTATTCGC ATTGGACTGC

451 GCGTCCAGCG AGTTCTACAA AGACGGCAAA TACCACTTGG AAGCCGAAGG

501 CCGCTCCTAC ACCAACGCGG AATTTGCCGA ATACTTGGAA GGCTTGGTTA

551 ACGAATTCCC GATTATTTCC ATTGAAGACG GGATGGACGA AAACGACTGG

601 GAAGGCTGGA AACTGCTGAC CGAAAAATTG GGCAAAAAAG TTCAATTGGT

651 CGGCGACGAC TTGTTCGTAA CCAATCCGAA AATTCTTGCC GAAGGCATCG

701 AAAAGGCGT AGCAAACGCA TTGCTGGTCA AAGTCAACCA AATCGGTACT
```

```
 751 TTAAGCGAAA CCCTGAAAGc cgtcgatctg gCAAAATGCA accgctacGc 801 cagCGTGATG AGCCAccgct ccggCGAAAC CGAAGACAGT Accattgccg 851 ACTTGGCAGT CGCCACCAAC TGTATGCAGA TTAAAAccgG TTCTTTGAGc 901 cgTTCCGACC GCATGGCGAA ATACAACCAa ctGCTGCGTA TCGAGGAAGA 951 ATTGGCGGAA GCcgcctACT ACCCCGGCAA AGCCGCATTC TACCAACTGG

1001 GCAAATAA
```

This corresponds to the amino acid sequence <SEQ ID 2106; ORF 652.ng>:

```
g652.pep
  1 MIELDGTENK GNLGANATLA VSMAVARAAA EDSGLPLYRY LGGAGPMSLP

51 VPMMNVINGG EHANNSLNIQ EFMIMPVGAK SFREALRCGA EIFHALKKLC

101 DSKGFPTTVG DEGGFAPNLN SHKEALQLMV EAAEAAGYKA GEDVLFALDC

151 ASSEFYKDGK YHLEAEGRSY TNAEFAEYLE GLVNEFPIIS IEDGMDENDW

201 EGWKLLTEKL GKKVQLVGDD LFVTNPKILA EGIEKGVANA LLVKVNQIGT

251 LSETLKAVDL AKCNRYASVM SHRSGETEDS TIADLAVATN CMQIKTGSLS

301 RSDRMAKYNQ LLRIEEELAE AAYYPGKAAF YQLGK*
```

The following partial DNA sequence was identified in *N. meningitidis* <SEQ ID 2107>:

```
m652.seq
    1 ATGATCGAAT TGGACGGTAC TGAAAACAAA GGCAATTTGG GTGCGAATGC

51 GACTTTGGCG GTTTCTATGG CGGTTGCACG CGCCGCTGCC GAAGACTCAG

101 GCCTGCCGCT TTACCGCTAC TTGGGCGGCG CAGGCCCGAT GTCCCTGCCC

151 GTACCGATGA TGAACGTCAT CAACGGCGGC GAACACGCCA ACAACAGCCT

201 GAACATCCAA GAGTTTATGA TTATGCCCGT CGGCGCAAAA TCTTTCCGCG

251 AAGCGTTGCG CTGCGGTGCG GAAATTTTCC ACGCCTTGAA AAAACTGTGC

301 GACAGCAAAG GCTTCCCGAC CACAGTCGGC GACGAAGGCG GTTTCGCCCC

351 CAACCTGAAC AGCCACAAAG AAGCCCTGCA ACTGATGGTC GAGGCGACCG

401 AAGCCGCCGG CTACAAAGCG GGCGAAGACG TATTATTCGC ATTGGACTGC

451 GCCTCCAGCG AGTTCTACAA AGACGGCAAA TACCACTTGG AAGCCGAAGG

501 CCGCTCCTAC ACCAACGCGG AATTTGCCGA ATATCTGGAA GGCCTGGTCA

551 ACGAGTTCCC CATCATCTCC ATCGAAGACG GCATGGATGA AAACGACTGG

601 GAAGGCTGGA AACTGCTGAC CGAAAAACTG GGCGGTAGAG TTCAATTGGT

651 TGGCGACGAC TTGTTCGTAA CCAATCCAAA AATCTTGGCC GAAGGCATCG

701 AAAAAGGCGT AGCAAACGCA TTGCTGGTCA AAGTCAATCA AATCGGTACT

751 TTGAGCGAGA CCCTGAAAGC CGTCGACTTA GCCAAACGCA ACCGCTACGC

801 CAGCGTAATG AGCCACCGCT CCGGCGAAAC CGAAGACAGC ACCATTGCCG

851 ACTTGGCAGT CGCCACCAAC TGTATGCAGA TCAAAACCGG TTCTTTGAGC

901 CGTTCCGACC GCATGGCGAA ATACAACCAA CTGCTGCGTA TCGAGGAAGA

951 ATTGGCGGAA GCCGCCGACT ACCCCAGCAA AGCCGCATTC TACCAACTGG

1001 GCAAATAA
```

This corresponds to the amino acid sequence <SEQ ID 2108; ORF 652>:

```
m652.pep

1 MIELDGTENK GNLGANATLA VSMAVARAAA EDSGLPLYRY LGGAGPMSLP

51 VPMMNVINGG EHANNSLNIQ EFMIMPVGAK SFREALRCGA EIFHALKKLC

101 DSKGFPTTVG DEGGFAPNLN SHKEALQLMV EATEAAGYKA GEDVLFALDC

151 ASSEFYKDGK YHLEAEGRSY TNAEFAEYLE GLVNEFPIIS IEDGMDENDW

201 EGWKLLTEKL GGRVQLVGDD LFVTNPKILA EGIEKGVANA LLVKVNQIGT

251 LSETLKAVDL AKRNRYASVM SHRSGETEDS TIADLAVATN CMQIKTGSLS

301 RSDRMAKYNQ LLRIEEELAE AADYPSKAAF YQLGK* m652/g652 98.2% identity in 335 aa overlap 10         20         30         40         50         60
   m652.pep   MIELDGTENKGNLGANATLAVSMAVARAAAEDSGLPLYRYLGGAGPMSLPVPMMNVINGG
              ||||||||||||||||||||||||||||||||||||||||||||||||||||||||||||
   g652       MIELDGTENKGNLGANATLAVSMAVARAAAEDSGLPLYRYLGGAGPMSLPVPMMNVINGG
                   10         20         30         40         50         60

70         80         90        100        110        120
   m652.pep   EHANNSLNIQEFMIMPVGAKSFREALRCGAEIFHALKKLCDSKGFPTTVGDEGGFAPNLN
              ||||||||||||||||||||||||||||||||||||||||||||||||||||||||||||
   g652       EHANNSLNIQEFMIMPVGAKSFREALRCGAEIFHALKKLCDSKGFPTTVGDEGGFAPNLN
                   70         80         90        100        110        120

130        140        150        160        170        180
   m652.pep   SHKEALQLMVEATEAAGYKAGEDVLFALDCASSEFYKDGKYHLEAEGRSYTNAEFAEYLE
              |||||||||||:||||||||||||||||||||||||||||||||||:|||||||||||||
   g652       SHKEALQLMVEAAEAAGYKAGEDVLFALDCASSEFYKDGKYHLEAEGRSYTNAEFAEYLE
                  130        140        150        160        170        180

190        200        210        220        230        240
   m652.pep   GLVNEFPIISIEDGMDENDWEGWKLLTEKLGGRVQLVGDDLFVTNPKILAEGIEKGVANA
              ||||||||||||||||||||||||||||||||:|||||||||||||||||||||||||||
   g652       GLVNEFPIISIEDGMDENDWEGWKLLTEKLGKKVQLVGDDLFVTNPKILAEGIEKGVANA
                  190        200        210        220        230        240

250        260        270        280        290        300
   m652.pep   LLVKVNQIGTLSETLKAVDLAKRNRYASVMSHRSGETEDSTIADLAVATNCMQIKTGSLS
              |||||||||||||||||||||| |||||||||||||||||||||||||||||||||||||
   g652       LLVKVNQIGTLSETLKAVDLAKCNRYASVMSHRSGETEDSTIADLAVATNCMQIKTGSLS
                  250        260        270        280        290        300

310        320        330
   m652.pep   RSDRMAKYNQLLRIEEELAEAADYPSKAAFYQLGKX
              ||||||||||||||||||||||||||||||||||||
   g652       RSDRMAKYNQLLRIEEELAEAADYPSKAAFYQLGKX
                  310        320        330
```

The following partial DNA sequence was identified in *N. meningitidis* <SEQ ID 2109>:

```
a652.seq
    1 ATGATCGAAT TGGACGGTAC TGAAAACAAA GGCAATTTGG GTGCGAATGC

51 GACTTTGGCG GTTTCTATGG CGGTTGCACG CGCCGCTGCC GAAGACTCAG

101 GCCTGCCGCT TTACCGCTAC TTGGGCGGCG CAGGCCCGAT GTCCCTGCCC

151 GTACCGATGA TGAACGTCAT CAACGGCGGC GAACACGCCA ACAACAGCCT

201 GAACATCCAA GAGTTTATGA TTATGCCCGT CGGCGCAAAA TCTTTCCGCG

251 AAGCGTTGCG CTGCGGTGCG GAAATTTTCC ACGCCTTGAA AAAACTGTGC

301 GACAGCAAAG GCTTCCCGAC CACAGTCGGC GACGAAGGCG GTTTCGCCCC

351 CAACCTGAAC AGCCACAAAG AAGCCCTGCA ACTGATGGTC GAGGCGACCG

401 AAGCCGCCGG CTACAAAGCG GGCGAAGACG TATTATTCGC ATTGGACTGC

451 GCGTCCAGCG AGTTCTACAA AGACGGCAAA TACCACTTGG AAGCCGAAGG

501 CCGCTCCTAC ACCAACGCGG AATTTGCCGA ATATCTGGAA GGCCTGGTCA
```

-continued

```
 551 ACGAGTTCCC CATCATCTCC ATCGAAGACG GGATGGATGA AAACGACTGG

601 GAAGGCTGGA AACTGCTGAC CGAAAAACTG GGCGGCAAAG TCCAACTCGT

651 TGGCGACGAC CTCTTCGTTA CCAACCCGAA AATCCTTGCC GAAGGCATTG

701 AAAAAGGCGT GGCAAACGCA CTATTGGTCA AAGTCAACCA AATCGGTACT

751 TTGAGTGAAA CCCTGAAAGC CGTCGACTTA GCCAAACGCA ACCGCTACGC

801 CAGCGTAATG AGCCACCGCT CCGGCGAAAC CGAAGACAGC ACCATTGCCG

851 ACTTGGCAGT CGCCACCAAC TGTATGCAGA TCAAAACCGG TTCTTTGAGC

901 CGTTCCGACC GCATGGCGAA ATACAACCAA CTGCTGCGTA TCGAGGAAGA

951 ATTGGCGGAA GCCGCCGACT ACCCCAGCAA AGCCGCATTC TACCAACTGG

1001 GCAAATAA
```

This corresponds to the amino acid sequence <SEQ ID 2110; ORF 652.a>:

```
a652.pep

1 MIELDGTENK GNLGANATLA VSMAVARAAA EDSGLPLYRY LGGAGPMSLP

51 VPMMNVINGG EHANNSLNIQ EFMIMPVGAK SFREALRCGA EIFHALKKLC

101 DSKGFPTTVG DEGGFAPNLN SHKEALQLMV EATEAAGYKA GEDVLFALDC

151 ASSEFYKDGK YHLEAEGRSY TNAEFAEYLE GLVNEFPIIS IEDGMDENDW

201 EGWKLLTEKL GGKVQLVGDD LFVTNPKILA EGIEKGVANA LLVKVNQIGT

251 LSETLKAVDL AKRNRYASVM SHRSGETEDS TIADLAVATN CMQIKTGSLS

301 RSDRMAKYNQ LLRIEEELAE AADYPSKAAF YQLGK*
``` m652/a652 99.7% identity in 335 aa overlap

```
                 10        20        30        40        50        60
m652.pep  MIELDGTENKGNLGANATLAVSMAVARAAAEDSGLPLYRYLGGAGPMSLPVPMMNVINGG
          ||||||||||||||||||||||||||||||||||||||||||||||||||||||||||||
a652      MIELDGTENKGNLGANATLAVSMAVARAAAEDSGLPLYRYLGGAGPMSLPVPMMNVINGG
                 10        20        30        40        50        60

70        80        90       100       110       120
m652.pep  EHANNSLNIQEFMIMPVGAKSFREALRCGAEIFHALKKLCDSKGFPTTVGDEGGFAPNLN
          ||||||||||||||||||||||||||||||||||||||||||||||||||||||||||||
a652      EHANNSLNIQEFMIMPVGAKSFREALRCGAEIFHALKKLCDSKGFPTTVGDEGGFAPNLN
                 70        80        90       100       110       120

130       140       150       160       170       180
m652.pep  SHKEALQLMVEATEAAGYKAGEDVLFALDCASSEFYKDGKYHLEAEGRSYTNAEFAEYLE
          ||||||||||||||||||||||||||||||||||||||||||||||||||||||||||||
a652      SHKEALQLMVEATEAAGYKAGEDVLFALDCASSEFYKDGKYHLEAEGRSYTNAEFAEYLE
                130       140       150       160       170       180

190       200       210       220       230       240
m652.pep  GLVNEFPIISIEDGMDENDWEGWKLLTEKLGGRVQLVGDDLFVTNPKILAEGIEKGVANA
          |||||||||||||||||||||||||||||||:||||||||||||||||||||||||||||
a652      GLVNEFPIISIEDGMDENDWEGWKLLTEKLGGKVQLVGDDLFVTNPKILAEGIEKGVANA
                190       200       210       220       230       240

250       260       270       280       290       300
m652.pep  LLVKVNQIGTLSETLKAVDLAKRNRYASVMSHRSGETEDSTIADLAVATNCMQIKTGSLS
          ||||||||||||||||||||||| ||||||||||||||||||||||||||||||||||||
a652      LLVKVNQIGTLSETLKAVDLAKCNRYASVMSHRSGETEDSTIADLAVATNCMQIKTGSLS
                250       260       270       280       290       300

310       320       330
m652.pep  RSDRMAKYNQLLRIEEELAEAADYPSKAAFYQLGKX
          |||||||||||||||||||||||||||||||||||
a652      RSDRMAKYNQLLRIEEELAEAADYPSKAAFYQLGKX
                310       320       330
```

The following partial DNA sequence was identified in *N. gonorrhoeae* <SEQ ID 2111>:

```
g652-1.seq
    1 ATGAGCGCAA TCGTTGATAT TTTCGCCCGC GAAATTTTGG ACTCACGCGG

51 CAACCCCACA GTCGAGTGTG ATGTATTGCT CGAATCCGGC GTAATGGGAC

101 GTGCGGCCGT ACCGAGCGGC GCATCCACCG GTCAGAAAGA AGCTTTGGAA

151 CTTCGCGACG GCGACAAATC CCGCTATTCC GGCAAAGGCG TATTGAAGGC

201 CGTCGAACAC GTCAACAACC AAATCGCCCA AGCCCTCATC GGTATCGATG

251 CCAACGAGCA ATCTTATATC GACCAAATCA TGATCGAATT GGACGGTACT

301 GAAAACAAAG GCAATTTGGG TGCGAATGCG ACTTTGGCGG TCTCTATGGC

351 GGTTGCACGC GCCGCTGCCG AAGACTCAGG CCTGCCGCTT TACCGCTACT

401 TGGGGGGCGC AGGTCCGATG TCCCTGCCCG TACCGATGAT GAACGTCATC

451 AACGGCGGCG AACACGCCAA CAACAGCCTG AACATCCAAG AGTTTATGAT

501 TATGCCCGTC GGCGCAAAAT CTTTCCGCGA AGCGTTGCGC TGCGGTGCGG

551 AAATTTTCCA CGCCTTGAAA AAACTGTGCG ACAGTAAAGG CTTCCCGACC

601 ACAGTCGGCG ACGAAGGCGG TTTCGCCCCC AACCTGAACA GCCACAAAGA

651 AGCCCTGCAA CTGATGGTCG AAGCGGCCGA AGCCGCCGGC TACAAGGCGG

701 GCGAAGACGT ATTATTCGCA TTGGACTGCG CGTCCAGCGA GTTCTACAAA

751 GACGGCAAAT ACCACTTGGA AGCCGAAGGC CGCTCCTACA CCAACGCGGA

801 ATTTGCCGAA TACTTGGAAG GCTTGGTTAA CGAATTCCCG ATTATTTCCA

851 TTGAAGACGG GATGGACGAA AACGACTGGG AAGGCTGGAA ACTGCTGACC

901 GAAAAATTGG GCAAAAAAGT TCAATTGGTC GGCGACGACT TGTTCGTAAC

951 CAATCCGAAA ATTCTTGCCG AAGGCATCGA AAAAGGCGTA GCAAACGCAT

1001 TGCTGGTCAA AGTCAACCAA ATCGGTACTT TAAGCGAAAC CCTGAAAGCC

1051 GTCGATCTGG CAAAATGCAA CCGCTACGCC AGCGTGATGA GCCACCGCTC

1101 CGGCGAAACC GAAGACAGTA CCATTGCCGA CTTGGCAGTC GCCACCAACT

1151 GTATGCAGAT TAAAACCGGT TCTTTGAGCC GTTCCGACCG CATGGCGAAA

1201 TACAACCAAC TGCTGCGTAT CGAGGAAGAA TTGGCGGAAG CCGCCTACTA

1251 CCCCGGCAAA GCCGCATTCT ACCAACTGGG CAAATAA
```

This corresponds to the amino acid sequence <SEQ ID 2112; ORF 652-1.ng>:

```
g652-1.pep
    1 MSAIVDIFAR EILDSRGNPT VECDVLLESG VMGRAAVPSG ASTGQKEALE

51 LRDGDKSRYS GKGVLKAVEH VNNQIAQALI GIDANEQSYI DQIMIELDGT

101 ENKGNLGANA TLAVSMAVAR AAAEDSGLPL YRYLGGAGPM SLPVPMMNVI

151 NGGEHANNSL NIQEFMIMPV GAKSFREALR CGAEIFHALK KLCDSKGFPT

201 TVGDEGGFAP NLNSHKEALQ LMVEAAEAAG YKAGEDVLFA LDCASSEFYK

251 DGKYHLEAEG RSYTNAEFAE YLEGLVNEFP IISIEDGMDE NDWEGWKLLT

301 EKLGKKVQLV GDDLFVTNPK ILAEGIEKGV ANALLVKVNQ IGTLSETLKA

351 VDLAKCNRYA SVMSHRSGET EDSTIADLAV ATNCMQIKTG SLSRSDRMAK

401 YNQLLRIEEE LAEAAYYPGK AAFYQLGK*
```

The following partial DNA sequence was identified in *N. meningitidis* <SEQ ID 2113>:

```
m652-1.seq
    1 ATGAGCGCAA TCGTTGATAT TT

-continued

```
m652-1/g652-1  98.6% identity in 428 aa overlap 10        20        30        40        50        60
m652-1      MSAIVDIFAREILDSRGNPTVECDVLLESGVMGRAAVPSGASTGQKEALELRDGDKSRYS
            ||||||||||||||||||||||||||||||||||||||||||||||||||||||||||||
g652-1      MSAIVDIFAREILDSRGNPTVECDVLLESGVMGRAAVPSGASTGQKEALELRDGDKSRYS
                    10        20        30        40        50        60

70        80        90       100       110       120
m652-1      GKGVLKAVEHVNNQIAQALIGIDANEQSYIDQIMIELDGTENKGNLGANATLAVSMAVAR
            ||||||||||||||||||||||||||||||||||||||||||||||||||||||||||||
g652-1      GKGVLKAVEHVNNQIAQALIGIDANEQSYIDQIMIELDGTENKGNLGANATLAVSMAVAR
                    70        80        90       100       110       120

130       140       150       160       170       180
m652-1      AAAEDSGLPLYRYLGGAGPMSLPVPMMNVINGGEHANNSLNIQEFMIMPVGAKSFREALR
            ||||||||||||||||||||||||||||||||||||||||||||||||||||||||||||
g652-1      AAAEDSGLPLYRYLGGAGPMSLPVPMMNVINGGEHANNSLNIQEFMIMPVGAKSFREALR
                   130       140       150       160       170       180

190       200       210       220       230       240
m652-1      CGAEIFHALKKLCDSKGFPTTVGDEGGFAPNLNSHKEALQLMVEATEAAGYKAGEDVLFA
            |||||||||||||||||||||||||||||||||||||||||||||:||||||||||||||
g652-1      CGAEIFHALKKLCDSKGFPTTVGDEGGFAPNLNSHKEALQLMVEAAEAAGYKAGEDVLFA
                   190       200       210       220       230       240

250       260       270       280       290       300
m652-1      LDCASSEFYKDGKYHLEAEGRSYTNAEFAEYLEGLVNEFPIISIEDGMDENDWEGWKLLT
            ||||||||||||||||||||||||||||||||||||||||||||||||||||||||||||
g652-1      LDCASSEFYKDGKYHLEAEGRSYTNAEFAEYLEGLVNEFPIISIEDGMDENDWEGWKLLT
                   250       260       270       280       290       300

310       320       330       340       350       360
m652-1      EKLGGRVQLVGDDLFVTNPKILAEGIEKGVANALLVKVNQIGTLSETLKAVDLAKRNRYA
            |||| :||||||||||||||||||||||||||||||||||||||||||||||| ||||
g652-1      EKLGKKVQLVGDDLFVTNPKILAEGIEKGVANALLVKVNQIGTLSETLKAVDLAKCNRYA
                   310       320       330       340       350       360

370       380       390       400       410       420
m652-1      SVMSHRSGETEDSTIADLAVATNCMQIKTGSLSRSDRMAKYNQLLRIEEELAEAADYPSK
            ||||||||||||||||||||||||||||||||||||||||||||||||||||||| ||:|
g652-1      SVMSHRSGETEDSTIADLAVATNCMQIKTGSLSRSDRMAKYNQLLRIEEELAEAAYYPGK
                   370       380       390       400       410       420

429
m652-1      AAFYQLGKX
            |||||||||
g652-1      AAFYQLGKX
```

The following partial DNA sequence was identified in *N. meningitidis* <SEQ ID 2115>:

```
a652-1.seq
  1  ATGAGCGCAA TCGTTGATAT TTTCGCCCGC GAAATTTTGG ACTCACGCGG

51  CAACCCCACA GTCGAGTGTG ATGTATTGCT CGAATCCGGC GTAATGGGAC

101  GCGCAGCCGT ACCGAGCGGC GCGTCCACCG GTCAAAAAGA GGCTTTGGAA

151  CTTCGCGACG GCGACAAATC CCGTTATTCG GGCAAGGGCG TATTGAAGGC

201  GGTCGAACAC GTCAACAACC AAATCGCCCA AGCCCTCATT GGTATCGATG

251  CCAACGAGCA ATCTTATATC GACCAAATCA TGATCGAATT GGACGGTACT

301  GAAAACAAAG GCAATTTGGG TGCGAATGCG ACTTTGGCGG TTTCTATGGC

351  GGTTGCACGC GCCGCTGCCG AAGACTCAGG CCTGCCGCTT TACCGCTACT

401  TGGGCGGCGC AGGCCCGATG TCCCTGCCCG TACCGATGAT GAACGTCATC

451  AACGGCGGCG AACACGCCAA CAACAGCCTG AACATCCAAG AGTTTATGAT

501  TATGCCCGTC GGCGCAAAAT CTTTCCGCGA AGCGTTGCGC TGCGGTGCGG

551  AAATTTTCCA CGCCTTGAAA AAACTGTGCG ACAGCAAAGG CTTCCCGACC

601  ACAGTCGGCG ACGAAGGCGG TTTCGCCCCC AACCTGAACA GCCACAAAGA

651  AGCCCTGCAA CTGATGGTCG AGGCGACCGA AGCCGCCGGC TACAAAGCGG
```

```
 701 GCGAAGACGT ATTATTCGCA TTGGACTGCG CGTCCAGCGA GTTCTACAAA

751 GACGGCAAAT ACCACTTGGA AGCCGAAGGC CGCTCCTACA CCAACGCGGA

801 ATTTGCCGAA TATCTGGAAG GCCTGGTCAA CGAGTTCCCC ATCATCTCCA

851 TCGAAGACGG GATGGATGAA AACGACTGGG AAGGCTGGAA ACTGCTGACC

901 GAAAAACTGG GCGGCAAAGT CCAACTCGTT GGCGACGACC TCTTCGTTAC

951 CAACCCGAAA ATCCTTGCCG AAGGCATTGA AAAAGGCGTG GCAAACGCAC

1001 TATTGGTCAA AGTCAACCAA ATCGGTACTT TGAGTGAAAC CCTGAAAGCC

1051 GTCGACTTAG CCAAACGCAA CCGCTACGCC AGCGTAATGA GCCACCGCTC

1101 CGGCGAAACC GAAGACAGCA CCATTGCCGA CTTGGCAGTC GCCACCAACT

1151 GTATGCAGAT CAAAACCGGT TCTTTGAGCC GTTCCGACCG CATGGCGAAA

1201 TACAACCAAC TGCTGCGTAT CGAGGAAGAA TTGGCGGAAG CCGCCGACTA

1251 CCCCAGCAAA GCCGCATTCT ACCAACTGGG CAAATAA
```

This corresponds to the amino acid sequence <SEQ ID 2116; ORF 652-1.a>:

```
a652-1.pep

1 MSAIVDIFAR EILDSRGNPT VECDVLLESG VMGRAAVPSG ASTGQKEALE

51 LRDGDKSRYS GKGVLKAVEH VNNQIAQALI GIDANEQSYI DQIMIELDGT

101 ENKGNLGANA TLAVSMAVAR AAAEDSGLPL YRYLGGAGPM SLPVPMMNVI

151 NGGEHANNSL NIQEFMIMPV GAKSFREALR CGAEIFHALK KLCDSKGFPT

201 TVGDEGGFAP NLNSHKEALQ LMVEATEAAG YKAGEDVLFA LDCASSEFYK

251 DGKYHLEAEG RSYTNAEFAE YLEGLVNEFP IISIEDGMDE NDWEGWKLLT

301 EKLGGKVQLV GDDLFVTNPK ILAEGIEKGV ANALLVKVNQ IGTLSETLKA

351 VDLAKRNRYA SVMSHRSGET EDSTIADLAV ATNCMQIKTG SLSRSDRMAK

401 YNQLLRIEEE LAEAADYPSK AAFYQLGK* m652-1/a652-1 99.8% identity in 428 aa overlap 10         20         30         40         50         60
        m652-1   MSAIVDIFAREILDSRGNPTVECDVLLESGVMGRAAVPSGASTGQKEALELRDGDKSRYS
                 ||||||||||||||||||||||||||||||||||||||||||||||||||||||||||||
        a652-1   MSAIVDIFAREILDSRGNPTVECDVLLESGVMGRAAVPSGASTGQKEALELRDGDKSRYS
                 10         20         30         40         50         60

70         80         90        100        110        120
        m652-1   GKGVLKAVEHVNNQIAQALIGIDANEQSYIDQIMIELDGTENKGNLGANATLAVSMAVAR
                 ||||||||||||||||||||||||||||||||||||||||||||||||||||||||||||
        a652-1   GKGVLKAVEHVNNQIAQALIGIDANEQSYIDQIMIELDGTENKGNLGANATLAVSMAVAR
                 70         80         90        100        110        120

130        140        150        160        170        180
        m652-1   AAAEDSGLPLYRYLGGAGPMSLPVPMMNVINGGEHANNSLNIQEFMIMPVGAKSFREALR
                 ||||||||||||||||||||||||||||||||||||||||||||||||||||||||||||
        a652-1   AAAEDSGLPLYRYLGGAGPMSLPVPMMNVINGGEHANNSLNIQEFMIMPVGAKSFREALR
                130        140        150        160        170        180

190        200        210        220        230        240
        m652-1   CGAEIFHALKKLCDSKGFPTTVGDEGGFAPNLNSHKEALQLMVEATEAAGYKAGEDVLFA
                 ||||||||||||||||||||||||||||||||||||||||||||||||||||||||||||
        a652-1   CGAEIFHALKKLCDSKGFPTTVGDEGGFAPNLNSHKEALQLMVEATEAAGYKAGEDVLFA
                190        200        210        220        230        240

250        260        270        280        290        300
        m652-1   LDCASSEFYKDGKYHLEAEGRSYTNAEFAEYLEGLVNEFPIISIEDGMDENDWEGWKLLT
                 ||||||||||||||||||||||||||||||||||||||||||||||||||||||||||||
        a652-1   LDCASSEFYKDGKYHLEAEGRSYTNAEFAEYLEGLVNEFPIISIEDGMDENDWEGWKLLT
                250        260        270        280        290        300

310        320        330        340        350        360
        m652-1   EKLGGRVQLVGDDLFVTNPKILAEGIEKGVANALLVKVNQIGTLSETLKAVDLAKRNRYA
                 |||||:||||||||||||||||||||||||||||||||||||||||||||||||||||||
        a652-1   EKLGGKVQLVGDDLFVTNPKILAEGIEKGVANALLVKVNQIGTLSETLKAVDLAKRNRYA
                310        320        330        340        350        360
```

```
             370       380       390       400       410       420
m652-1  SVMSHRSGETEDSTIADLAVATNCMQIKTGSLSRSDRMAKYNQLLRIEEELAEAADYPSK
        ||||||||||||||||||||||||||||||||||||||||||||||||||||||||||||
a652-1  SVMSHRSGETEDSTIADLAVATNCMQIKTGSLSRSDRMAKYNQLLRIEEELAEAADYPSK
             370       380       390       400       410       420

429
m652-1  AAFYQLGKX
        |||||||||
a652-1  AAFYQLGKX
```

The following partial DNA sequence was identified in *N. gonorrhoeae* <SEQ ID 2117>:

```
g653.seq
   1 ATGGCGGcgg aaccgatgcg gAtgccggag gtaAcgtaCG GTTTTTCCGG

51 ATCGTTCGGG ATGGCGTTTT TGTtgacggT GATGTGCGCt ttgcccaAAG

101 CGGCTtcggc ggctttgcCg gtgaTTTTCA TCGGTTGCAG GtcgacgaGG

151 AAaacgTGGC TTTCGGTGCG GCCGGAAacg atgcgCaaac cgCGTttaac 201 caactcttcc gcCATGACGG CAGCATTGAT TTTCACTTGT TTTGCGTATT 251 GTTTGAactC GGGTTGcaac gcttctTTAA acgctACGGC TttgGCGGCG 301 ATAACGTgca tcaACGGAcc gCCTTGCAGG CTTGGGAAGA TGGAAGAGTT

351 CAGCGCTTTT TCGTGGGTAT TGTCACGGCA CAAAATCACA CCGCCGCGAG

401 GGCCGCGTAG GGTTTTGTGG GTGGTAGTGg ttACgaaGTc GCAGAatggc

451 ACGGGgttag gatattcgcc gccGGCAACC AgtccgGCAT Ag
```

This corresponds to the amino acid sequence <SEQ ID 2118; ORF 653.ng>:

```
g653.pep
   1 MAAEPMRMPE VTYGFSGSFG MAFLLTVMCA LPKAASAALP VIFIGCRSTR

51 KTWLSVRPET MRKPRLTNSS AMTAALIFTC FAYCLNSGCN ASLNATALAA

101 ITCINGPPCR LGKMEEFSAF SWVLSRHKIT PPRGPRRVLW VVVVTKSQNG

151 TGLGYSPPAT SPA*
```

The following partial DNA sequence was identified in *N. meningitidis* <SEQ ID 2119>:

```
m653.seq
   1 ATGGCAGCGG AGCCGATGCG GATGCCGGAG GTAACGAAGG GTTTTTCCGG

51 ATCGTTCGGA ATGGCGTTTT TGTTGACGGT GATGTGCGCT TTGCCCAAAG

101 CGGCTTCGGC GGCTTTGCCG GTAATTTTCA TCGGTTGCAG GTCAACGAGG

151 AAAACGTGGC TTTCGGTGCG GCCGGAAACG ATGCGCAAAC CGCGTTTAAC

201 CAACTCTTCC GCCATGGCGG CTGCATTGAT TTTCACTTGT TTTGCGTATT

251 GTTTGAACTC GGGTTGCAAT GCTTCTTTAA ACGCCACGGC TTTGGCGGCG

301 ATAACGTGCA TCAGCGGACC GCCTTGCAGG CTTGGGAAGA TGGAAGAGTT

351 CAACGCTTTT TCGTGGGTAT TGTCGCGGCA CAAAATTACG CCGCCGCGAG

401 GACCGCGCAG GGTTTTGTGG GTGGTGGTGG TCACGAAGTC GCAGAACGGC

451 ACCGGGTTGG GATATTCGCC GCCGGCAACC AGACCGGCAT AG
```

This corresponds to the amino acid sequence <SEQ ID 2120; ORF 653>:

```
m653.pep

1  MAAEPMRMPE VTKGFSGSFG MAFLLTVMCA LPKAASAALP VIFIGCRSTR

51  KTWLSVRPET MRKPRLTNSS AMAAALIFTC FAYCLNSGCN ASLNATALAA

101  ITCISGPPCR LGKMEEFNAF SWVLSRHKIT PPRGPRRVLW VVVVTKSQNG

151  TGLGYSPPAT RPA* m653/g653  96.9% identity in 163 aa overlap 10         20         30         40         50         60
m653.pep   MAAEPMRMPEVTKGFSGSFGMAFLLTVMCALPKAASAALPVIFIGCRSTRKTWLSVRPET
           ||||||||||||||||||||||||||||||||||||||||||||||||||||||||||||
g653       MAAEPMRMPEVTKGFSGSFGMAFLLTVMCALPKAASAALPVIFIGCRSTRKTWLSVRPET
                10         20         30         40         50         60

70         80         90        100        110        120
m653.pep   MRKPRLTNSSAMAAALIFTCFAYCLNSGCNASLNATALAAITCISGPPCRLGKMEEFNAF
           ||||||||||||:|||||||||||||||||||||||||||||||:|||||||||||:||
g653       MRKPRLTNSSAMTAALIFTCFAYCLNSGCNASLNATALAAITCINGPPCRLGKMEEFSAF
                70         80         90        100        110        120

130        140        150        160
m653.pep   SWVLSRHKITPPRGPRRVLWVVVVTKSQNGTGLGYSPPATRPAX
           |||||||||||||||||||||||||||||||||||||||| ||
g653       SWVLSRHKITPPRGPRRVLWVVVVTKSQNGTGLGYSPPATSPAX
               130        140        150        160
```

The following partial DNA sequence was identified in *N. meningitidis* <SEQ ID 2121>:

```
a653.seq
    1 ATGGCGGCGG AACCGATGCG GATGCCGGAG GTAACGAAGG GTTTTTCCGG

51 ATCATTCGGG ATGGCGTTTT TGTTGACAGT GATGTGCGCT TTGCCCAAAG

101 CAGCTTCGGC GGCTTTGCCG GTAATTTTCA TCGGTTGCAG GTCAACGAGG

151 AAAACGTGGC TTTCGGTGCG GCCGGAAACG ATGCGCAAAC CGCGTTTAAC

201 CAACTCTTCC GCCATGGCGG CTGCATTGAT TTTCACTTGT TTTGCGTATT

251 GTTTGAACTC GGGTTGCAAT GCTTCTTTAA ACGCCACGGC TTTGGCGGCG

301 ATAACGTGCA TCAGCGGGCC ACCTTGCAGG CTTGGGAAGA TGGAAGAGTT

351 CAACGCTTTT TCGTGGGTAT TGTCGCGGCA CAAAATTACG CCGCCGCGAG

401 GACCGCGCAG GGTTTTGTGG GTGGTGGTGG TAACGAAGTC GCAGAACGGC

451 ACGGGATTGG GATATTCGCC GCCGGCAACC AGACCGGCAT AG
```

This corresponds to the amino acid sequence <SEQ ID 2122; ORF 653.a>:

```
a653.pep

1    MAAEPMRMPE VTKGFSGSFG MAFLLTVMCA LPKAASAALP VIFIGCRSTR

51    KTWLSVRPET MRKPRLTNSS AMAAALIFTC FAYCLNSGCN ASLNATALAA

101    ITCISGPPCR LGKMEEFNAF SWVLSRHKIT PPRGPRRVLW VVVVTKSQNG

151    TGLGYSPPAT RPA* m653/a653  100.0% identity in 163 aa overlap 10         20         30         40         50         60
m653.pep   MAAEPMRMPEVTKGFSGSFGMAFLLTVMCALPKAASAALPVIFIGCRSTRKTWLSVRPET
           ||||||||||||||||||||||||||||||||||||||||||||||||||||||||||||
a653       MAAEPMRMPEVTKGFSGSFGMAFLLTVMCALPKAASAALPVIFIGCRSTRKTWLSVRPET
                10         20         30         40         50         60
```

```
              70         80         90         100        110        120
m653.pep    MRKPRLTNSSAMAAALIFTCFAYCLNSGCNASLNATALAAITCISGPPCRLGKMEEFNAF
            ||||||||||||||||||||||||||||||||||||||||||||||||||||||||||||
a653        MRKPRLTNSSAMAAALIFTCFAYCLNSGCNASLNATALAAITCISGPPCRLGKMEEFNAF
              70         80         90         100        110        120

130        140        150        160
m653.pep    SWVLSRHKITPPRGPRRVLWVVVVTKSQNGTGLGYSPPATRPAX
            ||||||||||||||||||||||||||||||||||||||||||||
a653        SWVLSRHKITPPRGPRRVLWVVVVTKSQNGTGLGYSPPATRPAX
              130        140        150        160
```

The following partial DNA sequence was identified in *N. gonorrhoeae* <SEQ ID 2123>:

```
g656.seq
  1 ATGCCGCGTT TCTCCGGTTC GATTTCTTCG ATGATTTCCA TCGCGCGGAC

51 TTTtggcGCG CCGGAGAGTG TGCcggcagg gAAGGTGGCG GCGAGGATGT

101 CCATATTGGT AACGCCCTCT TTCAAACAGc ctTCGACGTT GGAAACGATG

151 TGCATCACAT GGGAGTATTT TTCAATCACC ATTTTGTCGG TGACTTTGAC

201 TTCGCCTGTT TTGCTGATGC GTCCGACATC GTTGCGCCCC AAATCGATAA

251 GCATAACGTG TTCGGCgatt TCTTTGGCGT CGCTTAACAA ATCTTGTTCG

301 TTGGCAAGGT CTTCGGCGGG GGTTTTGCCG CGCAGGCGCG TGCCGGCGAT

351 GGGGCGGACG ATGACGTcat CGCGTTCGCG GCGGACGAGG ATTTCGGGCG

401 AGGAACCGAC GATGTGGAAA TCGCCGAAAT CGTAG
```

This corresponds to the amino acid sequence <SEQ ID 2124; ORF 656.ng>:

```
g656.pep
  1 MPRFSGSISS MISIARTFGA PESVPAGKVA ARMSILVTPS FKQPSTLETM

51 CITWEYFSIT ILSVTLTSPV LLMRPTSLRP KSISITCSAI SLASLNKSCS

101 LARSSAGVLP RRRVPAMGRT MTSSRSRRTR ISGEEPTMWK
    SPKS*
```

The following partial DNA sequence was identified in *N. meningitidis* <SEQ ID 2125>:

```
m656.seq
  1 ATGCCGCGTT TGCTCGGTTC GACTTCTTCG ATGATTTCCA TGGCGCGGAC

51 TTTGGGTGCG CCGGAGAGTG TGCCGGCAGG GAAGGTAGCG GCGAGGATGT

101 CCATGTTGGT CATGCCGTCT TTCAGACGGC CTTCGACGTT GGAAACGATG

151 TGCATTACAT GGGAGTATTT TTCAATCACC ATTTTGTCGG TAACTTTGAC

201 TTCGCCGGTT TTACTGATGC GGCCGACGTC GTTGCGTCCT AAGTCAATCA

251 ACATGACGTG TTCGGCGATT TCTTTGGCAT CGCTTAACAA ATCTTGTTCG

301 TTGGCAAGGT CTTCGGCGGG GGTTTTGCCG CGCAGGCGCG TGCCGGCGAT

351 GGGGCGGACG ATAACGTCGT TGCGTTCGCG TCGGACGAGG ATTTCGGGCG

401 AGGAGCCGAC GATGTGGAAA TCGCCGAAAT CGTAG
```

This corresponds to the amino acid sequence <SEQ ID 2126; ORF 656>:

```
m656.pep
   1 MPRLLGSTSS MISMARTLGA PESVPAGKVA ARMSMLVMPS FRRPSTLETM

51 CITWEYFSIT ILSVTLTSPV LLMRPTSLRP KSINMTCSAI SLASLNKSCS

101 LARSSAGVLP RRRVPAMGRT ITSLRSRRTR ISGEEPTMWK SPKS*
```

Computer analysis of this amino acid sequence gave the following results:
Homology with a Predicted ORF from *N. gonorrhoeae*

```
    m656/g656    91.0% identity in 144 aa overlap 10         20         30         40         50         60
       m656.pep   MPRLLGSTSSMISMARTLGAPESVPAGKVAARMSMLVMPSFRRPSTLETMCITWEYFSIT
                  |||: || |||||:|||:||||||||||||||||||||:|| |||::|||||||||||||
       g656       MPRFSGSISSMISIARTFGAPESVPAGKVAARMSILVTPSFKQPSTLETMCITWEYFSIT
                      10         20         30         40         50         60

70         80         90        100        110        120
       m656.pep   ILSVTLTSPVLLMRPTSLRPKSINMTCSAISLASLNKSCSLARSSAGVLPRRRVPAMGRT
                  ||||||||||||||||||||||||::||||||||||||||||||||||||||||||||||
       g656       ILSVTLTSPVLLMRPTSLRPKSISITCSAISLASLNKSCSLARSSAGVLPRRRVPAMGRT
                      70         80         90        100        110        120

130        140
       m656.pep   ITSLRSRRTRISGEEPTMWKSPKSX
                  :|| |||||||||||||||||||||
       g656       MTSSRSRRTRISGEEPTMWKSPKSX
                     130        140
```

The following partial DNA sequence was identified in *N. meningitidis* <SEQ ID 2127>:

```
a656.seq
   1 ATGCCGCGTT TGCTCGGTTC GACTTCTTCG ATGATTTCCA TGGCGCGGAC

51 TTTGGGTGCG CCGGAGAGTG TGCCGGCAGG GAAGGTAGCG GCGAGGATGT

101 CCATGTTGGT CATGCCGTCT TTCAGACGGC CTTCGACGTT GGAAACGATG

151 TGCATTACAT GGGAGTATTT TTCAATCACC ATTTTGTCGG TAACTTTGAC

201 TTCGCCGGTT TTACTGATGC GGCCGACGTC GTTGCGTCCT AAGTCAATCA

251 ACATGACGTG TTCGGCGATT TCTTTGGCAT CGCTTAACAA ATCTTGTTCG

301 TTGGCAAGGT CTTCGGCGGG GGTTTTGCCG CGCAGGCGCG TGCCGGCGAT

351 GGGGCGGACG ATGACATCGT CGCGTTCGCG GCGGACGAGG ATTTCGGGCG

401 AGGAGCCGAC GATGTGGAAA TCGCCGAAAT CGTAG
```

This corresponds to the amino acid sequence <SEQ ID 2128; ORF 656.a>:

```
a656.pep
      1 MPRLLGSTSS MISMARTLGA PESVPAGKVA ARMSMLVMPS FRRPSTLETM

51 CITWEYFSIT ILSVTLTSPV LLMRPTSLRP KSINMTCSAI SLASLNKSCS

101 LARSSAGVLP RRRVPAMGRT MTSSRSRRTR ISGEEPTMWK SPKS*
```

-continued m656/a656 98.6% identity in 144 aa overlap

```
                  10         20         30         40         50         60
m656.pep  MPRLLGSTSSMISMARTLGAPESVPAGKVAARMSMLVMPSFRRPSTLETMCITWEYFSIT
          ||||||||||||||||||||||||||||||||||||||||||||||||||||||||||||
a656      MPRLLGSTSSMISMARTLGAPESVPAGKVAARMSMLVMPSFRRPSTLETMCITWEYFSIT
                  10         20         30         40         50         60

70         80         90        100        110        120
m656.pep  ILSVTLTSPVLLMRPTSLRPKSINMTCSAISLASLNKSCSLARSSAGVLPRRRVPAMGRT
          ||||||||||||||||||||||||||||||||||||||||||||||||||||||||||||
a656      ILSVTLTSPVLLMRPTSLRPKSINMTCSAISLASLNKSCSLARSSAGVLPRRRVPAMGRT
                  70         80         90        100        110        120

130        140
m656.pep  ITSLRSRRTRISGEEPTMWKSPKSX
          :||  |||||||||||||||||||
a656      MTSSRSRRTRISGEEPTMWKSPKSX
                 130        140
```

The following partial DNA sequence was identified in *N. gonorrhoeae* <SEQ ID 2129>:

```
g657.seq
    1 ATGAACACAC CCCCCATCCT TCCTCCCGCC ATGCTCGGCA TCCTCGGCGG
   51 CGGACAATTa ggcagAATGT TTGCCGTTGC CGCTAAAACC ATGGGCTACA
  101 AAGTAACCGT TCTCGATCCC GACCCGAATG CGCCGGCGGC GGAATTTGCC
  151 GACCGCCATT TGTGCGCGCC GTTTGACGAC CGGGCCGCGT TGGACGAATT
  201 GGCAAAATGC GCGGCGGTta cgACCGAATT TGAAAacgtc aaTGCCGACG
  251 CGATGCGCTC TCTGGCAAAG CATACCAACG TTTCCCCCAG CGGCGACTGC
  301 GTGTCCATTG CACAAAACCG CATTCAGGAA AAAGCGTGGA TACGCAAAGC
  351 AGGCTTGCAA ACCGCGCCGT ATCAGGCGGT TTGCAAGGCC GAAGACATTA
  401 CTGAAGCAAG CGCGCAATTT TTGCCCGGCA TCCTGAAAAC GGCTACGTTG
  451 GGCTACGACG GCAAAGGTCA AATCCGCGTC AAAACGTTGG ACGAACTCAA
  501 AGCCGCGTTT GCCGAACACG GCGGCGTGGA TTGCGTTTTG GAAAAAATGG
  551 TGGACTTGCG CGGCGAGATT TCCGTGATCG TATGCCGTCT GAACGATGAA
  601 AACGTGCAAA CCTTCGACCC CGCCGAAAAC ATCCACGAAA ACGGCATCTT
  651 GGCTTattcC ATCGTCcccg CGCGGCTGAG TGCCGACGTG CAGCAACAGG
  701 CGCGGCAGAC GGCGCAACgc tTGGCGGACG AATTGGATTA TGTCGGCgta
  751 TTGGCGGTAG AAATGTTTGT TGTCGGCGAC ACACATGAAT TGCTCGTCAA
  801 TGAAACCGCC CCGCGCACGC ACAATTCCGG CCACCATACG ATAGATGCCT
  851 GCGCCGCAGA CCAGTTCCAA CAGCAGGTAC GCATTATGTG CAAcctGCCG
  901 cccGccgACA CCAAATTATT aTCCCCttgC TGTATGGCGA ATATTTTGGg
  951 CGACGTTTGG CAGGAAGATG GCGGCGAACC GGATTGGCTG CCGTTGCAAA
 1001 GCCGGCCGAA TGCACACCTG CACCTATACG GAAAAAAAAC CGCACAGAAA
 1051 GGTCGGAAAA TGGGACACTT TaccgTTTTG ACCACCGATT CGGACaccgC
 1101 ATTTCAAGAA GCAAAAAAAC TGCATCAGTC CCTATAA
```

This corresponds to the amino acid sequence <SEQ ID 2130; ORF 657.ng>:

```
g657.pep
    1 MNTPPILPPA MLGILGGGQL GRMFAVAAKT MGYKVTVLDP DPNAPAAEFA
```

-continued

```
 51 DRHLCAPFDD RAALDELAKC AAVTTEFENV NADAMRSLAK HTNVSPSGDC

101 VSIAQNRIQE KAWIRKAGLQ TAPYQAVCKA EDITEASAQF LPGILKTATL

151 GYDGKGQIRV KTLDELKAAF AEHGGVDCVL EKMVDLRGEI SVIVCRLNDE

201 NVQTFDPAEN IHENGILAYS IVPARLSADV QQQARQTAQR LADELDYVGV

251 LAVEMFVVGD THELLVNETA PRTHNSGHHT IDACAADQFQ QQVRIMCNLP

301 PADTKLLSPC CMANILGDVW QEDGGEPDWL PLQSRPNAHL HLYGKKTAQK

351 GRKMGHFTVL TTDSDTAFQE AKKLHQSL*
```

The following partial DNA sequence was identified in *N. meningitidis* <SEQ ID 2131>:

```
m657.seq
   1 ATGAAAAACA TATCTCTTTC TCCGCCCGCC ATGCTTGGCA TCCTCGGCGG

51 CGGACAATTA GGCAGAATGT TTACCGTTGC CGCCAAAACC ATGGGCTACA

101 AAGTAACCGT TCTCGACCCC GATCCGGACG CGCCGGCAGC AGAATTTGCC

151 GACCGCCATT TGTGCGCGCC GTTTAACGAC CAAGCTGCTT TGGACGAATT

201 GGCAAAATGC GCGGCGGTGA CCACTGAATT TGAAAACGTC AATGCCGATG

251 CGATGCGCTT TTTGGCAAAA CATACCAATG TTTCCCCTAG CGGCGATTGT

301 GTGGCGATTG CACAAAACCG CATTCAGGAA AAGGCATGGA TACGCAAAGC

351 GGGATTGCAA ACCGCGCCGT ATCAAGTGGT TTGTAAGGCT GAAGACATCA

401 CTGAAGCAAG CGCGCAATTT TTGCCCGGCA TCCTGAAAAC GGCTACGTTG

451 GGCTACGACG GCAAAGGTCA AATCCGCGTA AAAACATTGG ATGAACTCAA

501 AGCCGCGTTT GCCGAACACG GCGGCGTGGA TTGCGTTTTG GAAAAAATGG

551 TGGATTTGCG CAGTGAAATT TCCGTAATCG TATGCCGTTT GAACAATGAC

601 AACGTGCAAA CTTTCGACCC TGCCGAAAAC ATCCACGAAA ACGGCATCTT

651 GGCTTATTCC ATCGTCCCCG CGCGACTGAG TGCCGACGTG CAGCAACAGG

701 CGCGGCAGAT GGCGCAACGC TTGGCGGACG AATTGGATTA TGTCGGCGTA

751 TTGGCGGTAG AAATGTTTGT TGTCGGTGAC ACGCATGAAT TGGTCGTCAA

801 CGAAATCGCC CCGCGCCCGC ACAATTCCGG ACACCATACG ATAGATGCCT

851 GCGCAGCAGA CCAGTTCCAG CAGCAGGTAC GCATTATGTG CAACCTGCCG

901 CCTGCCGATA CCAAATTACT GAGTTCTTGC TGTATGGCAA ATATTTTGGG

951 CGACGTTTGG CAGGAAGACG GCGGCGAACC GGATTGGCTG CCCTTGCAAA

1001 GCCATCCGAA TGCACACCTG CACCTTTACG GCAAAAAAAC CGCGCACAAA

1051 GGGCGGAAAA TGGGACACTT TACCGTTTTA ACCACCGATT CGGACACCGC

1101 ATTTCAAGAA GCAAAAAAAC TGCATCAGTC CCTATAA
```

This corresponds to the amino acid sequence <SEQ ID 2132; ORF 657>:

```
m657.pep
  1 MKNISLSPPA MLGILGGGQL GRMFTVAAKT MGYKVTVLDP DPDAPAAEFA

51 DRHLCAPFND QAALDELAKC AAVTTEFENV NADAMRFLAK HTNVSPSGDC

101 VAIAQNRIQE KAWIRKAGLQ TAPYQVVCKA EDITEASAQF LPGILKTATL

151 GYDGKGQIRV KTLDELKAAF AEHGGVDCVL EKMVDLRSEI SVIVCRLNND
```

```
201 NVQTFDPAEN IHENGILAYS IVPARLSADV QQQARQMAQR LADELDYVGV

251 LAVEMFVVGD THELVVNEIA PRPHNSGHHT IDACAADQFQ QQVRIMCNLP

301 PADTKLLSSC CMANILGDVW QEDGGEPDWL PLQSHPNAHL HLYGKKTAHK

351 GRKMGHFTVL TTDSDTAFQE AKKLHQSL*
```

Computer analysis of this amino acid sequence gave the following results:

Homology with a Predicted ORF from *N. gonorrhoeae*

```
    m657/g657 93.9% identity in 378 aa overlap 10        20        30        40        50        60
    m657.pep  MKNISLSPPAMLGILGGGQLGRMFTVAAKTMGYKVTVLDPDPDAPAAEFADRHLCAPFND
              |::  : ||||||||||||||||||:||||||||||||||||||:|||||||||||||||:|
    g657      MNTPPILPPAMLGILGGGQLGRMFAVAAKTMGYKVTVLDPDPNAPAAEFADRHLCAPFDD
                    10        20        30        40        50        60

70        80        90       100       110       120
    m657.pep  QAALDELAKCAAVTTEFENVNADAMRFLAKHTNVSPSGDCVAIAQNRIQEKAWIRKAGLQ
              :||||||||||||||||||||||||| |||||||||||||||:||||||||||||||||
    g657      RAALDELAKCAAVTTEFENVNADAMRSLAKHTNVSPSGDCVSIAQNRIQEKAWIRKAGLQ
                    70        80        90       100       110       120

130       140       150       160       170       180
    m657.pep  TAPYQVVCKAEDITEASAQFLPGILKTATLGYDGKGQIRVKTLDELKAAFAEHGGVDCVL
              ||||:|||||||||||||||||||||||||||||||||||||||||||||||||||||
    g657      TAPYQAVCKAEDITEASAQFLPGILKTATLGYDGKGQIRVKTLDELKAAFAEHGGVDCVL
                   130       140       150       160       170       180

190       200       210       220       230       240
    m657.pep  EKMVDLRSEISVIVCRLNNDNVQTFDPAENIHENGILAYSIVPARLSADVQQQARQMAQR
              ||||||::|||||||||::||||||||||||||||||||||||||||||||||| ||
    g657      EKMVDLRGEISVIVCRLNDENVQTFDPAENIHENGILAYSIVPARLSADVQQQARQTAQR
                   190       200       210       220       230       240

250       260       270       280       290       300
    m657.pep  LADELDYVGVLAVEMFVVGDTHELVVNEIAPRPHNSGHHTIDACAADQFQQQVRIMCNLP
              |||||||||||||||||||||||||:||| ||| ||:|||||||||||||||||||||
    g657      LADELDYVGVLAVEMFVVGDTHELLVNETAPRTHNSGHHTIDACAADQFQQQVRIMCNLP
                   250       260       270       280       290       300

310       320       330       340       350       360
    m657.pep  PADTKLLSSCCMANILGDVWQEDGGEPDWLPLQSHPNAHLHLYGKKTAHKGRKMHGFTVL
              ||||||||| |||||||||||||||||||||||:|||||||||||||:|||||||||||
    g657      PADTKLLSPCCMANILGDVWQEDGGEPDWLPLQSRPNAHLHLYGKKTAQKGRKMHGFTVL
                   310       320       330       340       350       360

370       379
    m657.pep  TTDSDTAFQEAKKLHQSLX
              |||||||||||||||||||
    g657      TTDSDTAFQEAKKLHQSLX
                   370
```

The following partial DNA sequence was identified in *N. meningitidis* <SEQ ID 2133>:

```
a657.seq
   1  ATGAAAAACA TATCTCTTTC TCCGCCCGCC ATGCTCGGCA TTCTTGGCGG

51  CGGACAATTA GGCAGAATGT TTACTGTTGC TGCCAAAACC ATGGGCTACA

101  AAGTAACCGT ACTCGATCCC AACCCGAATG CGCCGGCAGC GGAATTTGCC

151  GACCGCCATT TGTGTGCGCC GTTTGACAAC CAAACCGCTT TGGAAGAATT

201  GGCAAAATGT GCGGCTGTTA CGACCGAGTT CGAAAACGTC AATGCCGATG

251  CGATGCGTTT TCTCGCCAAA CATACCAATG TTTCCCCCAG CGGCGACTGC

301  GTTGCCATCG CGCAAAACCG CATTCAGGAA AAGGCATGGA TACGCAAAGC

351  AGGCCTGCAA ACCGCGCCGT ATCAAGCAAT TGCAAAGCC GAAGACATCA

401  CTGAAGAAAG CATACAATTT CTGCCCGGCA TCCTGAAAAC CGCTACATTG

451  GGCTATGACG GCAAAGGCCA AATCCGCGTC AAAACGGTGG ATGAACTCAA
```

```
-continued
 501 AGCCGCGTTT GCCGAACACC GCGGCGTGGA TTGCGTTTTG GAAAAAATGG

551 TGGACTTGCG CGGCGAAATT TCCGTTATCG TATGCCGTCT GAACAATGAC

601 AACGTGCAAA CTTTCGATCC TGCCGAAAAC ATTCACGAAA ACGGTATCCT

651 CGCCTACTCC ATCGTCCCAG CCCGACTGAG TGCCGACATT CAGCAACAGG

701 CGCGACAAAT GGCGCAGCGT TTGGCCGATG AATTGAACTA CGTCGGCGTA

751 TTGGCGGTAG AAATGTTTGT TGTCGGCGAC ACGCATGAAT TGGTCGTCAA

801 CGAAATCGCG CCGCGTCCGC ACAATTCCGG CCACCATACC GTCGACGCCT

851 GCGCGGCAGA CCAATTCCAG CAACAGGTCC GCCTGATGTG CAACCTGCCA

901 CCTGCTGACA CCAAATTGCT GAGTTCTTGC TGTATGGCGA ATATTTTGGG

951 CGACGTTTGG CAGGAAGACG GCGGCGAACC GGATTGGTTT CCCCTGCAAA

1001 GCCGGCCGGA CGCGCACCTG CACCTTTACG GCAAAAAAAC CGCGCACAAA

1051 GGGCGGAAAA TGGGACACTT TACCATTTTA AGCACCGATT CGGACACCGC

1101 ATTTCAAGAA GCAAAAAAAC TGCATCAGTC CCTATAA
```

This corresponds to the amino acid sequence <SEQ ID 2134; ORF 657.a>:

```
a657.pep

1 MKNISLSPPA MLGILGGGQL GRMFTVAAKT MGYKVTVLDP NPNAPAAEFA

51 DRHLCAPFDN QTALEELAKC AAVTTEFENV NADAMRFLAK HTNVSPSGDC

101 VAIAQNRIQE KAWIRKAGLQ TAPYQAICKA EDITEESIQF LPGILKTATL

151 GYDGKGQIRV KTVDELKAAF AEHRGVDCVL EKMVDLRGEI SVIVCRLNND

201 NVQTFDPAEN IHENGILAYS IVPARLSADI QQQARQMAQR LADELNYVGV

251 LAVEMFVVGD THELVVNEIA PRPHNSGHHT VDACAADQFQ QQVRLMCNLP

301 PADTKLLSSC CMANILGDVW QEDGGEPDWF PLQSRPDAHL HLYGKKTAHK

351 GRKMGHFTIL STDSDTAFQE AKKLHQSL* m657/a657 94.2% identity in 378 aa overlap 10         20         30         40         50         60
m657.pep MKNISLSPPAMLGILGGGQLGRMFTVAAKTMGYKVTVLDPDPDAPAAEFADRHLCAPFND
         ||||||||||||||||||||||||||||||||||||||:|:||||||||||||||||::
a657     MKNISLSPPAMLGILGGGQLGRMFTVAAKTMGYKVTVLDPNPNAPAAEFADRHLCAPFDN
                 10         20         30         40         50         60

70         80         90        100        110        120
m657.pep QAALDELAKCAAVTTEFENVNADAMRFLAKHTNVSPSGDCVAIAQNRIQEKAWIRKAGLQ
         |:||:|||||||||||||||||||||||||||||||||||||||||||||||||||||||
a657     QTALEELAKCAAVTTEFENVNADAMRFLAKHTNVSPSGDCVAIAQNRIQEKAWIRKAGLQ
                 70         80         90        100        110        120

130        140        150        160        170        180
m657.pep TAPYQVVCKAEDITEASAQFLPGILKTATLGYDGKGQIRVKTLDELKAAFAEHGGVDCVL
         |||||::||||||||:| |||||||||||||||||||||||:|||||||||||:||||||
a657     TAPYQAICKAEDITEESIQFLPGILKTATLGYDGKGQIRVKTVDELKAAFAEHRGVDCVL
                130        140        150        160        170        180

190        200        210        220        230        240
m657.pep EKMVDLRSEISVIVCRLNNDNVQTFDPAENIHENGILAYSIVPARLSADVQQQARQMAQR
         ||||||:|||||||||||||||||||||||||||||||||||||||||||:|||||||||
a657     EKMVDLRGEISVIVCRLNNDNVQTFDPAENIHENGILAYSIVPARLSADIQQQARQMAQR
                190        200        210        220        230        240

250        260        270        280        290        300
m657.pep LADELDYVGVLAVEMFVVGDTHELVVNEIAPRPHNSGHHTIDACAADQFQQQVRIMCNLP
         |||||:||||||||||||||||||||||||||||||||||:|||||||||||||:||||
a657     LADELNYVGVLAVEMFVVGDTHELVVNEIAPRPHNSGHHTVDACAADQFQQQVRLMCNLP
                250        260        270        280        290        300

310        320        330        340        350        360
m657.pep PADTKLLSSCCMANILGDVWQEDGGEPDWLPLQSHPNAHLHLYGKKTAHKGRKMGHFTVL
         ||||||||||||||||||||||||||||| ||||:|:|||||||||||||||||||||:|
a657     PADTKLLSSCCMANILGDVWQEDGGEPDWFPLQSRPDAHLHLYGKKTAHKGRKMGHFTIL
                310        320        330        340        350        360
```

```
                     370       379
m657.pep  TTDSDTAFQEAKKLHQSLX
          :||||||||||||||||||
     a657 STDSDTAFQEAKKLHQSLX
                     370
```

The following partial DNA sequence was identified in *N. gonorrhoeae* <SEQ ID 2135>:

```
g658.seq
   1 ATGGTGGCCG GAATTGTGCG TGCGCGGGGC GGTTTCATTG ACGAGCAATT
  51 CATGTGTGTC GCCGACAACA AACATTTCTA CCGCCAAtac GCCGACATAA
 101 TCCAATTCGT CCGCCAagcG TTGCGCCGTC TGCCGCGCCT GTTGCTGCAC
 151 GTCGGCACTC AGCCGCGcgg gGACGATGga atAAGCCAAG ATGCCGTTTT
 201 CGTGGATGTT TTCGGCGGGG TCGAAGGTTT GCACGTTTTC ATCGTTCAGA
 251 CGGCATACGA TCACGGAAAT CTCGCCGCGC AAGTCCACCA TTTTTTCCAA
 301 AACGCAATCC ACGCCGCCGT GTTCGGCAAA CGCGGCTTTG AGTTCGTCCA
 351 ACGTTTTGAC GCGGATTTGA CCTTTGCCGT CGTAGCCCAA CGTAGCCGTT
 401 TTCAGGATGC CGGGCAAAAA TTGCGCGCTT GCTTCAGTAA TGTCTTCGGC
 451 CTTGCAAACC GCCTGATACG GCGCGGTTTG CAAGCCTGCT TTGCGTATCC
 501 ACGCTTTTTC CTGAATGCGG TTTTGTGCAA TGGACACGCA GTCGCCGCTG
 551 GGGGAAACGT TGGTATGCTT TGCCAGAGAG CGCATCGCGT CGGCAttgac
 601 gtTTTCAAAT TCGGTCgtaA CCGCCGCGCA TTTTGCCAAT TCGTCCAACG
 651 CGGCCCGGTC GTCAAACGGC GCGCACAAAT GGCGGTCGGC AAATTCCGCC
 701 GCCGGCGCAT TCGGGTCGGG ATCGAGAACG GTTACTTTGT AGCCCATGGT
 751 TTTAGCGGCA ACGGCAAACA TTctgcctAA
```

This corresponds to the amino acid sequence <SEQ ID 2136; ORF 658.ng>:

```
g658.pep
   1 MVAGIVRARG GFIDEQFMCV ADNKHFYRQY ADIIQFVRQA LRRLPRLLLH
  51 VGTQPRGDDG ISQDAVFVDV FGGVEGLHVF IVQTAYDHGN LAAQVHHFFQ
 101 NAIHAAVFGK RGFEFVQRFD ADLTFAVVAQ RSRFQDAGQK LRACFSNVFG
 151 LANRLIRRGL QACFAYPRFF LNAVLCNGHA VAAGGNVGML CQRAHRVGID
 201 VFKFGRNRRA FCQFVQRGPV VKRRAQMAVG KFRRRRIRVG IENGYFVAHG
 251 FSGNGKHSA*
```

The following partial DNA sequence was identified in *N. meningitidis* <SEQ ID 2137>:

```
m658.seq
   1 ATGGTGTCCG GAATTGTGCG GGCGCGGGGC GATTTCGTTG ACGACCAATT
  51 CATGCGTGTC ACCGACAACA AACATTTCTA CCGCCAATAC GCCGACATAA
 101 TCCAATTCGT CCGCCAAGCG TTGCGCCATC TGCCGCGCCT GTTGCTGCAC
 151 GTCGGCACTC AGTCGCGCGG GGACGATGGA ATAAGCCAAG ATGCCGTTTT
 201 CGTGGATGTT TTCGGCAGGG TCGAAAGTTT GCACGTTGTC ATTGTTCAAA
 251 CGGCATACGA TTACGGAAAT TTCACTGCGC AAATCCACCA TTTTTTCCAA
```

-continued

```
301 AACGCAATCC ACGCCGCCGT GTTCGGCAAA CGCGGCTTTG AGTTCATCCA

351 ATGTTTTTAC GCGGATTTGA CCTTTGCCGT CGTAGCCCAA CGTAGCCGTT

401 TTCAGGATGC CGGGCAAAAA TTGCGCGCTT GCTTCAGTGA TGTCTTCAGC

451 CTTACAAACC ACTTGATACG GCGCGGTTTG CAATCCCGCT TTGCGTATCC

501 ATGCCTTTTC CTGAATGCGG TTTTGTGCAA TCGCCACACA ATCGCCGCTA

551 GGGGAAACAT TGGTATGTTT TGCCAAAAAG CGCATCGCAT CGGCATTGAC

601 GTTTTCAAAT TCAGTGGTCA CCGCCGCGCA TTTTGCCAAT TCGTCCAAAG

651 CAGCTTGGTC GTTAAACGGC GCGCACAAAT GGCGGTCGGC AAATTCTGCT

701 GCCGGCGCGT CCGGATCGGG GTCGAGAACG GTTACTTTGT AGCCCATGGT

751 TTTGGCGGCA ACGGTAAACA TTCTGCCTAA
```

This corresponds to the amino acid sequence <SEQ ID 2138; ORF 658>:

```
m658.pep
   1 MVSGIVRARG DFVDDQFMRV TDNKHFYRQY ADIIQFVRQA LRHLPRLLLH

51 VGTQSRGDDG ISQDAVFVDV FGRVESLHVV IVQTAYDYGN FTAQIHHFFQ

101 NAIHAAVFGK RGFEFIQCFY ADLTFAVVAQ RSRFQDAGQK LRACFSDVFS

151 LTNHLIRRGL QSRFAYPCLF LNAVLCNRHT IAARGNIGMF CQKAHRIGID

201 VFKFSGHRRA FCQFVQSSLV VKRRAQMAVG KFCCRRVRIG VENGYFVAHG

251 FGGNGKHSA*
```

Computer analysis of this amino acid sequence gave the following results:
Homology with a Predicted ORF from *N. gonorrhoeae*

```
   m658/g658 82.2% identity in 259 aa overlap 10         20         30         40         50         60
    m658.pep MVSGIVRARGDFVDDQFMRVTDNKHFYRQYADIIQFVRQALRHLPRLLLHVGTQSRGDDG
             ||:||||||| |:|:||| |:|||||||||||||||||||:||||||||||| |||||
    g658     MVAGIVRARGGFIDEQFMCVADNKHFYRQYADIIQFVRQALRRLPRLLLHVGTQPRGDDG
                10         20         30         40         50         60

70         80         90        100        110        120
    m658.pep ISQDAVFVDVFGRVESLHVVIVQTAYDYGNFTAQIHHFFQNAIHAAVFGKRGFEFIQCFY
             |||||||||| ||:||| |||||||||:||:::|:||||||||||||||||||||:| |
    g658     ISQDAVFVDVFGGVEGLHVFIVQTAYDHGNLAAQVHHFFQNAIHAAVFGKRGFEFVQRFD
                70         80         90        100        110        120

130        140        150        160        170        180
    m658.pep ADLTFAVVAQRSRFQDAGQKLRACFSDVFSLTNHLIRRGLQSRFAYPCLFLNAVLCNRHT
             ||||||||||||||||||||||||||:||:|:||||||:  ||||  :|||||||| |:
    g658     ADLTFAVVAQRSRFQDAGQKLRACFSNVFGLANRLIRRGLQACFAYPRFFLNAVLCNGHA
                130        140        150        160        170        180

190        200        210        220        230        240
    m658.pep IAARGNIGMFCQKAHRIGIDVFKFSGHRRAFCQFVQSSLVVKRRAQMAVGKFCCRRVRIG
             :|| ||:||:|||:|||:|||||||:||||||||||:|||||||||||||||:|:|:|
    g658     VAAGGNVGMLCQRAHRVGIDVFKFGRNRRAFCQFVQRGPVVKRRAQMAVGKFRRRRIRVG
                190        200        210        220        230        240

250        260
    m658.pep VENGYFVAHGFGGNGKHSAX
             :||||||||||:||||||||
    g658     IENGYFVAHGFSGNGKHSAX
                250        260
```

The following partial DNA sequence was identified in *N. meningitidis* <SEQ ID 2139>:

```
a658.seq
   1 ATGGTGGCCG GAATTGTGCG GACGCGGCGC GATTTCGTTG ACGACCAATT

51 CATGCGTGTC GCCGACAACA AACATTTCTA CCGCCAATAC GCCGACGTAG

101 TTCAATTCAT CGGCCAAACG CTGCGCCATT TGTCGCGCCT GTTGCTGAAT

151 GTCGGCACTC AGTCGGGCTG GGACGATGGA GTAGGCGAGG ATACCGTTTT

201 CGTGAATGTT TTCGGCAGGA TCGAAAGTTT GCACGTTGTC ATTGTTCAGA

251 CGGCATACGA TAACGGAAAT TTCGCCGCGC AAGTCCACCA TTTTTTCCAA

301 AACGCAATCC ACGCCGCGGT GTTCGGCAAA CGCGGCTTTG AGTTCATCCA

351 CCGTTTTGAC GCGGATTTGG CCTTTGCCGT CATAGCCCAA TGTAGCGGTT

401 TTCAGGATGC CGGGCAGAAA TTGTATGCTT TCTTCAGTGA TGTCTTCGGC

451 TTTGCAAATT GCTTGATACG GCGCGGTTTG CAGGCCTGCT TTGCGTATCC

501 ATGCCTTTTC CTGAATGCGG TTTTGCGCGA TGGCAACGCA GTCGCCGCTG

551 GGGGAAACAT TGGTATGTTT GGCGAGAAAA CGCATCGCAT CGGCATTGAC

601 GTTTTCGAAC TCGGTCGTAA CAGCCGCACA TTTTGCCAAT TCTTCCAAAG

651 CGGTTTGGTT GTCAAACGGC GCACACAAAT GGCGGTCGGC AAATTCCGCT

701 GCCGGCGCAT TCGGGTTGGG ATCGAGTACG GTTACTTTGT AGCCCATGGT

751 TTTGGCAGCA ACAGTAAACA TTCTGCCTAA
```

This corresponds to the amino acid sequence <SEQ ID 2140; ORF 658.a>:

```
a658.pep

1 MVAGIVRTRR DFVDDQFMRV ADNKHFYRQY ADVVQFIGQT LRHLSRLLLN

51 VGTQSGWDDG VGEDTVFVNV FGRIESLHVV IVQTAYDNGN FAAQVHHFFQ

101 NAIHAAVFGK RGFEFIHRFD ADLAFAVIAQ CSGFQDAGQK LYAFFSDVFG

151 FANCLIRRGL QACFAYPCLF LNAVLRDGNA VAAGGNIGMF GEKTHRIGID

201 VFELGRNSRT FCQFFQSGLV VKRRTQMAVG KFRCRRIRVG IEYGYFVAHG

251 FGSNSKHSA*
```

```
m658/a658 75.3% identity in 259 aa overlap 10        20        30        40        50        60
m658.pep    MVSGIVRARGDFVDDQFMRVTDNKHFYRQYADIIQFVRQALRHLPRLLLHVGTQSRGDDG
            ||:||||:| ||||||||||:|||||||||||::||: |:|||| ||||:|||||  |||
a658        MVAGIVRTRRDFVDDQFMRVADNKHFYRQYADVVQFIGQTLRHLSRLLLNVGTQSGWDDG
                    10        20        30        40        50        60

70        80        90       100       110       120
m658.pep    ISQDAVFVDVFGRVESLHVVIVQTAYDYGNFTAQIHHFFQNAIHAAVFGKRGFEFIQCFY
            :::|:|||:||||:||||||||||||| |||:||:|||||||||||||||||||||: | 
a658        VGEDTVFVNVFGRIESLHVVIVQTAYDNGNFAAQVHHFFQNAIHAAVFGKRGFEFIHRFD
                    70        80        90       100       110       120

130       140       150       160       170       180
m658.pep    ADLTFAVVAQRSRFQDAGQKLRACFSDVFSLTNHLIRRGLQSRFAYPCLFLNAVLCNRHT
            |||:|||:|| | |||||||| | |||||:::| |||||||: |||||||||||| : ::
a658        ADLAFAVIAQCSGFQDAGQKLYAFFSDVFGFANCLIRRGLQACFAYPCLFLNAVLRDGNA
                   130       140       150       160       170       180

190       200       210       220       230       240
m658.pep    IAARGNIGMFCQKAHRIGIDVFKFSGHRRAFCQFVQSSLVVKRRAQMAVGKFCCRRVRIG
            :|| |||||| :|:||||||||::: : |:|||| ||:||||||:||||||| |||:|:|
a658        VAAGGNIGMFGEKTHRIGIDVFELGRNSRTFCQFFQSGLVVKRRTQMAVGKFRCRRIRVG
                   190       200       210       220       230       240
```

```
                    250       260
m658.pep  VENGYFVAHGFGGNGKHSAX
          :| ||||||||||:|:|||||
    a658  IEYGYFVAHGFGSNSKHSAX
                    250       260
```

The following partial DNA sequence was identified in *N. gonorrhoeae* <SEQ ID 2141>:

```
g661.seq
    1 ATGCACATCG GCGGTTATTT TATCGACAAC CCCATCGCAC TTGCGCCGAT

51 GGCGGGCATT GCCGACAAAC CCTTCCGCCG CCTCTGTCGG GCGTTTGGCG

101 CAGGTTGGGC GGTGTGCGAA ATGCTGGCCA GCGATCCGAC GCTCAGGAAT

151 ACCGGAAAAA CCCtgcaccg cagtgaTTTt gccgatgaag gCGGCATCGT

201 TGCCGTGCAG ATTGCCGGCA GCGACCccga acaGATGGCG Gatgcggcgc 251 gttacAACGT CGGACTCGGG GCGCAGGTCA TCGACATcaa TATGGGCTGC 301 cccgccaaGA AAGTGTGCAA CGTCCAAGCC GGTAGCGCgc tGATGCAGGA 351 CGAGccgctg gttgcCgcca tTTtggaggc ggtggtcAAG GCGGCGGgcg 401 TACCCGTTAC cctCAAAACc cgtTtgggtt ggcacgacga cgatcaaaac 451 ctgcCcgccg tcgccaaaat cgccgaagat tgcggcattg ccgccCttgc 501 cgttccacgg gcgCGCgcgC ACGCAAATGT ACAAAGGCGA GGCgcGTTAC 551 Gaactcatcg CCGAGACCAA AAGccgTCTG AACATCCCGG cctGggtCAA 601 CGGCGACATC actTCgccgc AAAAAGCCGC CGccgTCCTC AAACAAACCG

651 CCGCCGACGG CATCATGATA GGGCGCGGCG CGCAAGGCAG GCCGTGGTTT

701 TTCCGCGATT TGAAGCATTA TGCCGAACAC GGCGTTTTAC CGCCTGCCTT

751 GAGTTTGGCA GAATGCAGAG CCGCCATTTT GAACCACATC CGCGCCATGC

801 ACGCGTTTTA TGGTGAGACC GTCGGTGTGC GCATCGCACG CAAACACATA

851 GGCTGGTACA TCGGCGAAAT GCCCGACGGC GAACAGGCGC GGCGTGA
```

This corresponds to the amino acid sequence <SEQ ID 2142; ORF 661.ng>:

```
g661.pep
    1 MHIGGYFIDN PIALAPMAGI ADKPFRRLCR AFGAGWAVCE MLASDPTLRN

51 TGKTLHRSDF ADEGGIVAVQ IAGSDPEQMA DAARYNVGLG AQVIDINMGC

101 PAKKVCNVQA GSALMQDEPL VAAILEAVVK AAGVPVTLKT RLGWHDDDQN

151 LPAVAKIAED CGIAALAVPR ARAHANVQRR GALRTHRRDQ KPSEHPGLGQ

201 RRHHFAAKSR RRPQTNRRRR HHDRARRARQ AVVFPRFEAL CRTRRFTACL

251 EFGRMQSRHF EPHPRHARVL WXDRRCAHRT QTHRLVHRRN ARRRTGAA*
```

The following partial DNA sequence was identified in *N. meningitidis* <SEQ ID 2143>:

```
m661.seq
    1 ATGCACATCG GCGGCTATTT TATCGACAAC CCCATCGCAC TTGCGCCGAT

51 GGCGGGCATT ACCGACAAAC CGTTCCGCCG ACTTTGCCGA GATTTTGGCG

101 CAGGTTGGGC GGTGTGCGAA ATGCTGACCA GCGACCCGAC GCTCAGAAAT

151 ACTAGAAAAA CCTTGCACCG CAGCGATTTT GCCGATGAAG GCGGCATTGT
```

-continued

```
201 TGCCGTGCAG ATTGCCGGAA GCGATCCGCA GCAGATGGCG GATGCCGCGC

251 GTTACAACGT CAGCCTTGGG GCGCAGCTTA TCGACATCAA CATGGGCTGT

301 CCCGCTAAAA AAGTCTGCAA TGTCCAAGCC GGTAGCGCGC TGATGCAGAA

351 CGAGCCGCTG GTTGCCGCCA TTTTGGAAGC CGTCGTCCGT GCGGCAGGCG

401 TACCCGTTAC CCTCAAAACC CGTTTGGGTT GGCACGACGA CCATCAAAAC

451 CTGCCCGTCA TCGCCAAAAT CGCCGAAGAT TGCGGCATCG CCGCCCTTGC

501 CGTCC.ACGG ACGCACGCGT ACGCAAATGT ACAAAGGCGA AGCGCGTTAC

551 GAACTCATCG CCGAAACCAA ATGCCGTCTG AACATCCCGG TCTGGGTCAA

601 CGGCGACATT ACTTCGCCGC AAAAAGCCCA AGCCGTCCTC AAACAAACCG

651 CCGCCGACGG CATTATGATA GGGCGCGGCG CGCAAGGCAG GCCGTGGTTC

701 TTCCGCGATT TGAAACATTA TGCCGAACAC GGTGTTTTGC CGCCTGCCTT

751 GAGTTTGGCA GAATGCGCCG CCGCTATTTT GAACCACATC CGCGCCATAC

801 ACGCGTTTTA CGGCGACACC GCCGGTGTGC GCATCGCACG CAAACACATA

851 GGCTGGTACA TCGACGAAAT GCCCGACGGC GAACAGACAC GTCGTGA
```

This corresponds to the amino acid sequence <SEQ ID 2144; ORF 661>:

```
m661.pep
  1 MHIGGYFIDN PIALAPMAGI TDKPFRRLCR DFGAGWAVCE MLTSDPTLRN

51 TRKTLHRSDF ADEGGIVAVQ IAGSDPQQMA DAARYNVSLG AQLIDINMGC

101 PAKKVCNVQA GSALMQNEPL VAAILEAVVR AAGVPVTLKT RLGWHDDHQN

151 LPVIAKIAED CGIAALAVXR THAYANVQRR SALRTHRRNQ MPSEHPGLGQ

201 RRHYFAAKSP SRPQTNRRRR HYDRARRARQ AVVLPRFETL CRTRCFAACL

251 EFGRMRRRYF EPHPRHTRVL RRHRRCAHRT QTHRLVHRRN ARRRTDTS*
```

Computer analysis of this amino acid sequence gave the following results:
Homology with a Predicted ORF from *N. gonorrhoeae*

```
m661/g661   88.5% identity in 295 aa overlap
                    10         20         30         40         50         60
     m661.pep  MHIGGYFIDNPIALAPMAGITDKPFRRLCRDFGAGWAVCEMLTSDPTLRNTRKTLHRSDF
               ||||||||||||||||||||:|||||||||| ||||||||||:|||||||| ||||||||
     g661      MHIGGYFIDNPIALAPMAGIADKPFRRLCRAFGAGWAVCEMLASDPTLRNTGKTLHRSDF
                    10         20         30         40         50         60

70         80         90        100        110        120
     m661.pep  ADEGGIVAVQIAGSDPQQMADAARYNVSLGAQLIDINMGCPAKKVCNVQAGSALMQNEPL
               ||||||||||||||||:||||||||||||:||||:|||||||||||||||||||||:|||
     g661      ADEGGIVAVQIAGSDPEQMADAARYNVGLGAQVIDINMGCPAKKVCNVQAGSALMQDEPL
                    70         80         90        100        110        120

130        140        150        160        170        180
     m661.pep  VAAILEAVVRAAGVPVTLKTRLGWHDDHQNLPVIAKIAEDCGIAALAVXRTHAYANVQRR
               |||||||||:||||||||||||||||||:||||::|||||||||||| |::|:|||||||
     g661      VAAILEAVVKAAGVPVTLKTRLGWHDDDQNLPAVAKIAEDCGIAALAVPRARAHANVQRR
                   130        140        150        160        170        180

190        200        210        220        230        240
     m661.pep  SALRTHRRNQMPSEHPGLGQRRHYFAAKSPSRPQTNRRRRHYDRARRARQAVVLPRFETL
               :||||||||:| |||||||||||:|||||| |||||||||:||||||||||||:||||:|
     g661      GALRTHRRDQKPSEHPGLGQRRHHFAAKSRRRPQTNRRRRHHDRARRARQAVVFPRFEAL
                   190        200        210        220        230        240

250        260        270        280        290    299
     m661.pep  CRTRCFAACLEFGRMRRRYFEPHPRHTRVLRRHRRCAHRTQTHRLVHRRNARRRTDTSX
               ||||  |:|||||||: |:|||||||:|||   ||||||||||||||||||||| |||
     g661      CRTRRFTACLEFGRMQSRHGEPHPRHARVLWXDRRCAHRTQTHRLVHRRNARRRTGAAX
                   250        260        270        280        290
```

The following partial DNA sequence was identified in *N. meningitidis* <SEQ ID 2145>:

```
a661.seq
   1 ATGCACATCG GCGGCTATTT TATCGACAAC CCCATCGCAC TTGCGCCGAT

51 GGCGGGCATT ACCGACAAAC CGTTCCGCCG ACTTTGCCGA GATTTTGGCG

101 CAGGTTGGGC GGTGTGCGAA ATGCTGACCA GCGACCCGAC GCTCAGAAAT

151 ACTAGAAAAA CCTTGCACCG CAGCGATTTT GCCGATGAAG GCGGCATTGT

201 TGCCGTGCAG ATTGCCGGAA GCGATCCGCA GCAGATGGCG GATGCCGCGC

251 GTTACAACGT CAGCCTTGGG GCGCAGCTTA TCGACATCAA CATGGGCTGT

301 CCCGCTAAAA AAGTCTGCAA TGTCCAAGCC GGTAGCGCGC TGATGCAGAA

351 CGAGCCGCTG GTTGCCGCCA TTTTGGAGGC GGTGGTCAAA GCGGCGGGCG

401 TACCCGTTAC CCTCAAAACC CGTTTGGGTT GGCACGACGA CCATCAAAAC

451 CTGCCCGTCA TCGCCAAAAT CGCCGAAGAT TGCGGCATTG CCGCCCTTGC

501 CG.TCCACGG ACGCACGCGC ACGCAAATGT ACAAAGGCGA AGCGGCTTAC

551 GACCTGATTG CCGAAACCAA ATGCCGTCTG AACATCCCGG TCTGGGTCAA

601 CGGCGACATT ACCTCGCCGC AAAAAGCCCA AGCCGTCCTC AAACAAACCG

651 CCGCAGACGG CATTATGATA GGGCGCGGCG CGCAAGGCAG ACCGTGGTTC

701 TTCCGCGATT TGAAACATTA CGCCGAACAC GGTGTTTTAC CGCCTGCCTT

751 GAGTTTGGCA GAATGTACCG CCACTATTTT GAACCACATC CGAGCCATGC

801 ACGCGTTTTA CGGCGACACC GCCGGTGTGC GCATCGCACG CAAACACATA

851 GGCTGGTACA TCGACGAAAT GCCCGACGGC GAACAGACAC GTCGTGA
```

This corresponds to the amino acid sequence <SEQ ID 2146; ORF 661.a>:

```
a661.pep

1  MHIGGYFIDN PIALAPMAGI TDKPFRRLCR DFGAGWAVCE MLTSDPTLRN

51  TRKTLHRSDF ADEGGIVAVQ IAGSDPQQMA DAARYNVSLG AQLIDINMGC

101  PAKKVCNVQA GSALMQNEPL VAAILEAVVK AAGVPVTLKT RLGWHDDHQN

151  LPVIAKIAED CGIAALAXPR THAHANVQRR SGLRPDCRNQ MPSEHPGLGQ

201  RRHYLAAKSP SRPQTNRRRR HYDRARRARQ TVVLPRFETL RRTRCFTACL

251  EFGRMYRHYF EPHPSHARVL RRHRRCAHRT QTHRLVHRRN ARRRTDTS* m661/a661  94.6% identity in 298 aa overlap
                       10        20        30        40        50        60
m661.pep       MHIGGYFIDNPIALAPMAGITDKPFRRLCRDFGAGWAVCEMLTSDPTLRNTRKTLHRSDF
               ||||||||||||||||||||||||||||||||||||||||||||||||||||||||||||
a661           MHIGGYFIDNPIALAPMAGITDKPFRRLCRAFGAGWAVCEMLTSDPTLRNTRKTLHRSDF
                       10        20        30        40        50        60

70        80        90       100       110       120
m661.pep       ADEGGIVAVQIAGSDPQQMADAARYNVSLGAQLIDINMGCPAKKVCNVQAGSALMQNEPL
               ||||||||||||||||||||||||||||||||||||||||||||||||||||||||||||
a661           ADEGGIVAVQIAGSDPQQMADAARYNVSLGAQLIDINMGCPAKKVCNVQAGSALMQNEPL
                       70        80        90       100       110       120

130       140       150       160       170       180
m661.pep       VAAILEAVVRAAGVPVTLKTRLGWHDDHQNLPVIAKIAEDCGIAALAVXRTHAYANVQRR
               |||||||||:|||||||||||||||||||||||||||||||||||||  ||||:||||||
a661           VAAILEAVVKAAGVPVTLKTRLGWHDDHQNLPVIAKIAEDCGIAALAXPRTHAHANVQRR
                      130       140       150       160       170       180

190       200       210       220       230       240
m661.pep       SALRTHRRNQMPSEHPGLGQRRHYFAAKSPSRPQTNRRRRHYDRARRARQAVVLPRFETL
               |:||   |||||||||||||||||:|||||||||||||||||||||||||:|||||||||
a661           SGLRPDCRNQMPSEHPGLGQRRHYLAAKSPSRPQTNRRRRHYDRARRARQTVVLPRFETL
                      190       200       210       220       230       240
```

```
              250       260       270       280       290    299
m661.pep  CRTRCFAACLEFGRMRRRYFEPHPRHTRVLRRHRRCAHRTQTHRLVHRRNARRRTDTSX
          ||||:||||||||| |:||||||  |:||||||||||||||||||||||||||||||
a661      RRTRCFTACLEFGRMYRHYFEPHPSHARVLRRHRRCAHRTQTHRLVHRRNARRRTDTSX
              250       260       270       280       290
```

The following partial DNA sequence was identified in *N. gonorrhoeae* <SEQ ID 2147>:

```
g663.seq
   1 ATGTGTACCG AGATGAAATT TATATTTTTT GTACTGTATG TTTTGCAGTT

51 TCTGCCGTTT GCGCTGCTGC ACAAGATTGC CGGCCTGATC GGTTCGCTTG

101 CCTACCTTCT GGTCAAACCG CGCCGCCGTA TCGGCGAAAT CAATTTGGCA

151 AAATGTTTTC CCGAATGGGA CGAAGAAAAG CGTAAAACCG TGTTGAAACA

201 GCATTTCAAA CACATGGCAA AACTGATGCT CGAATACGGC TTATATTGGT

251 ACGCGtctGC CAAATGCCTG AAATCGCTGG TGCGCTACCG CAATAAGCAT

301 TATTTGGACG ACGCGCTGGC GGCGGGGGAA AAAGTCATCA TCCTGTACCC

351 GCACTTTACC GCGTTCGAGA TGGCGGTGTA CGCGCTTAAT CAGGATGTCC

401 CGCTGATCAG TATGTATTCC CACCAAAAAA ACAAGATATT GGACGAACAG

451 ATTTTGAAAg gccgcaACCG CTATCACAAC GTCTTCCTTA TCGGGCGCAC

501 CGAagggctg cgCGCCCtcg TCAAACAGTT CCGCAAAAGC AGTGCGCCGT

551 TCCTGTATCT GCCCGATCAG GATTTCGGAC GCAACAATTC GGTTTTTGTG

601 GATTTTTTCG GCATtcagaC GGCAACGATT ACCGGCTTGA GCCGCATTGC

651 CGCGCTTGCA AATGCAAAAG TGATACCCGC CATTCCCGTC CGCGAGGCGG

701 ACAATACGGT TACATTGCAA TTCTATCCCG CTTGGAAATC CTTTCCGAGT

751 GAAGACGCGC AAGCCGACGC GCAACGTATG AACCGCTTTA TCGAAGAACG

801 CGTGCGCGAA CACCCGGAAC AATATTTCTG GCTGCACAAG CGTTTCAAAA

851 CCCGTCCGGA AGGCAGCCCC GATTTTTACT GA
```

This corresponds to the amino acid sequence <SEQ ID 2148; ORF 663.ng>:

```
g663.pep
   1 MCTEMKFIFF VLYVLQFLPF ALLHKIAGLI GSLAYLLVKP RRRIGEINLA

51 KCFPEWDEEK RKTVLKQHFK HMAKLMLEYG LYWYASAKCL KSLVRYRNKH

101 YLDDALAAGE KVIILYPHFT AFEMAVYALN QDVPLISMYS HQKNILDEQ

151 ILKGRNRYHN VFLIGRTEGL RALVKQFRKS SAPFLYLPDQ DFGRNNSVFV

201 DFFGIQTATI TGLSRIAALA NAKVIPAIPV READNTVTLQ FYPAWKSFPS

251 EDAQADAQRM NRFIEERVRE HPEQYFWLHK RFKTRPEGSP DFY*
```

The following partial DNA sequence was identified in *N. meningitidis* <SEQ ID 2149>:

```
m663.seq
   1 ATGTGTATCG AGATGAAATT TATATTTTTT GTACTGTATG TTTTGCAGTT

51 TCTGCCGTTT GCGCTGCTGC ACAAGATTGC CGACCTGACG GGTTTGCTTG

101 CCTACCTTCT GGTCAAACCG CGCCGCCGTA TCGGCGAAAT CAATTTGGCA
```

```
-continued
151 AAATGTTTTT CCGAATGGAG TGAGGAAAAG CGTAAAACCG TGTTGAAACA

201 GCATTTCAAA CACATGGCGA AACTGATGTT GGAATACGGT TTATATTGGT

251 ACGCGCCTGC CGGACGTTTG AAATCGCTGG TGCGCTACCG CAATAAGCAT

301 TATTTGGACG ACGCGCTGGC GGCGGGGGAA AAAGTCATCA TCCTGTATCC

351 GCACTTCACC GCGTTCGAGA TGGCGGTGTA CGCGCTTAAT CAGGATATCC

401 CGCTGATCAG TATGTATTCC CATCAAAAAA ACAAGATATT GGACGAACAG

451 ATTTTGAAAG GCCGCAACCG CTATCACAAC GTCTTCCTTA TCGGGCGCAC

501 CGAAGGGCTG CGCGCCCTCG TCAAACAGTT CCGCAAAAGC AGCGCGCCGT

551 TTCTGTATCT GCCCGATCAG GATTTCGGAC GCAACGATTC GGTTTTTGTG

601 GATTTTTTCG GTATTCAGAC GGCAACGATT ACCGGATTGA GCCGCATTGC

651 CGCGCTTGCA AATGCAAAAG TGATACCCGC CATTCCCGTC CGCGAGGCAG

701 ACAATACGGT TACATTGCAT TTCTACCCTG CTTGGAAATC CTTTCCGGGT

751 GAAGACGCGA AAGCCGACGC GCAGCGCATG AACCGTTTTA TCGAAGACAG

801 GGTGCGCGAA CATCCGGAAC AATATTTTTG GCTGCACAAG CGTTTTAAAA

851 CCCGTCCGGA AGGCAGCCCC GATTTTTACT GA
```

This corresponds to the amino acid sequence <SEQ ID 2150; ORF 663>:

```
m663.pep
  1 MCIEMKFIFF VLYVLQFLPF ALLHKIADLT GLLAYLLVKP RRRIGEINLA

51 KCFSEWSEEK RKTVLKQHFK HMAKLMLEYG LYWYAPAGRL KSLVRYRNKH

101 YLDDALAAGE KVIILYPHFT AFEMAVYALN QDIPLISMYS HQKNKILDEQ

151 ILKGRNRYHN VFLIGRTEGL RALVKQFRKS SAPFLYLPDQ DFGRNDSVFV

201 DFFGIQTATI TGLSRIAALA NAKVIPAIPV READNTVTLH FYPAWKSFPG

251 EDAKADAQRM NRFIEDRVRE HPEQYFWLHK RFKTRPEGSP DFY*
```

Computer analysis of this amino acid sequence gave the following results:

Homology with a Predicted ORF from *N. gonorrhoeae*

```
   m663/g663 94.9% identity in 293 aa overlap 10         20         30         40         50         60
       m663.pep MCIEMKFIFFVLYVLQFLPFALLHKIADLTGLLAYLLVKPRRRIGEINLAKCFSEWSEEK
                || ||||||||||||||||||||||||| | | ||||||||||||||||||||  ||:|||
           g663 MCTEMKFIFFVLYVLQFLPFALLHKIAGLIGSLAYLLVKPRRRIGEINLAKCFPEWDEEK
                    10         20         30         40         50         60

70         80         90        100        110        120
       m663.pep RKTVLKQHFKHMAKLMLEYGLYWYAPAGRLKSLVRYRNKHYLDDALAAGEKVIILYPHFT
                |||||||||||||||||||||||||  |  |||||||||||||||||||||||||||||
           g663 RKTVLKQHFKHMAKLMLEYGLYWYASAKCLKSLVRYRNKHYLDDALAAGEKVIILYPHFT
                    70         80         90        100        110        120

130        140        150        160        170        180
       m663.pep AFEMAVYALNQDIPLISMYSHQKNKILDEQILKGRNRYHNVFLIGRTEGLRALVKQFRKS
                |||||||||||:||||||||||||||||||||||||||||||||||||||||||||||||
           g663 AFEMAVYALNQDVPLISMYSHQKNKILDEQILKGRNRYHNVFLIGRTEGLRALVKQFRKS
                   130        140        150        160        170        180

190        200        210        220        230        240
       m663.pep SAPFLYLPDQDFGRNDSVFVDFFGIQTATITGLSRIAALANAKVIPAIPVREADNTVTLH
                ||||||||||||||||:||||||||||||||||||||||||||||||||||||||||||:
           g663 SAPFLYLPDQDFGRNNSVFVDFFGIQTATITGLSRIAALANAKVIPAIPVREADNTVTLQ
                   190        200        210        220        230        240
```

```
                      -continued
                250       260       270       280       290
     m663.pep  FYPAWKSFPGEDAKADAQRMNRFIEDRVREHPEQYFWLHKRFKTRPEGSPDFYX
               ||||||||||:|||:||||||||||:||||||||||||||||||||||||||
     g663      FYPAWKSFPSEDAQADAQRMNRFIEERVREHPEQYFWLHKRFKTRPEGSPDFYX
                250       260       270       280       290
```

The following partial DNA sequence was identified in *N. meningitidis* <SEQ ID 2151>:

```
a663.seq
   1 ATGTGTATCG AGATGAAATT TATATTTTTT GTACTGTATG TTTTGCAGTT

51 TCTGCCGTTT GCGCTGCTGC ACAAACTTGC TGATCTGACA GGCTTGCTCG

101 CCTACCTTTT GGTCAAACCC CGCCGCCGTA TCGGCGAAAT CAATTTGGCA

151 AAATGCTTTC CCGAGTGGGA CGGAAAAAAG CGTAAAACCG TGTTGAAACA

201 GCATTTCAAA CATATGGCGA AACTGATGTT GGAATACGGT TTATATTGGT

251 ACGCGCCCGC CGGGCGTTTG AAATCACTGG TGCGCTACCG CAACAAACAT

301 TATTTGGACG ACGCTCTGGC GGCAGGGGAA AAAGTCATCA TCCTGTATCC

351 GCACTTCACC GCGTTCGAGA TGGCGGTGTA CGCGCTCAAT CAGGATGTTC

401 CGCTGATCAG TATGTATTCC CACCAAAAAA ACAAGATATT GGACGAACAG

451 ATTTTGAAAG GCCGCAACCG CTATCACAAC GTTTTCCTTA TCGGGCGCAC

501 CGAAGGGCTG CGCGCCCTCG TCAAACAGTT CCGCAAAAGC AGCGCGCCGT

551 TTCTGTATCT GCCCGATCAG GATTTCGGAC GCAACGATTC GGTTTTTGTC

601 GATTTCTTCG GTATTCGGAC GGCAACGATT ACCGGCTTGA GCCGCATTGC

651 CGCGCTTGCA AATGCAAAAG TGATACCCGC CATCCCTGTC CGCGAGGCGG

701 ACAATACGGT TACATTGCAT TTCTACCCTG CTTGGGAATC CTTTCCGAGT

751 GAAGATGCGC AGGCCGACGC GCAGCGCATG AACCGTTTTA TCGAGGAACG

801 CGTGCGCGAA CATCCCGAGC AGTATTTTTG GCTGCACAAG CGTTTCAAAA

851 CCCGTCCGGA AGGCAGCCCC GATTTTTACT GA
```

This corresponds to the amino acid sequence <SEQ ID 2152; ORF 663.a>:

```
a663.pep

1 MCIEMKFIFF VLYVLQFLPF ALLHKLADLT GLLAYLLVKP RRRIGEINLA

51 KCFPEWDGKK RKTVLKQHFK HMAKLMLEYG LYWYAPAGRL KSLVRYRNKH

101 YLDDALAAGE KVIILYPHFT AFEMAVYALN QDVPLISMYS HQKNKILDEQ

151 ILKGRNRYHN VFLIGRTEGL RALVKQFRKS SAPFLYLPDQ DFGRNDSVFV

201 DFFGIRTATI TGLSRIAALA NAKVIPAIPV READNTVTLH FYPAWESFPS

251 EDAQADAQRM NRFIEERVRE HPEQYFWLHK RFKTRPEGSP DFY* m663/a663 96.2% identity in 293 aa overlap 10        20        30        40        50        60
    m663.pep MCIEMKFIFFVLYVLQFLPFALLHKIADLTGLLAYLLVKPRRRIGEINLAKCFSEWSEEK
             |||||||||||||||||||||||:||||||||||||||||||||||||||||||  : :|
    a663     MCIEMKFIFFVLYVLQFLPFALLHKLADLTGLLAYLLVKPRRRIGEINLAKCFPEWDGKK
                 10        20        30        40        50        60

70        80        90       100       110       120
    m663.pep RKTVLKQHFKHMAKLMLEYGLYWYAPAGRLKSLVRYRNKHYLDDALAAGEKVIILYPHFT
             ||||||||||||||||||||||||||||||||||||||||||||||||||||||||||||
    a663     RKTVLKQHFKHMAKLMLEYGLYWYAPAGRLKSLVRYRNKHYLDDALAAGEKVIILYPHFT
                 70        80        90       100       110       120
```

```
                130        140        150        160        170        180
m663.pep  AFEMAVYALNQDIPLISMYSHQKNKILDEQILKGRNRYHNVFLIGRTEGLRALVKQFRKS
          ||||||||||||:|||||||||||||||||||||||||||||||||||||||||||||
a663      AFEMAVYALNQDVPLISMYSHQKNKILDEQILKGRNRYHNVFLIGRTEGLRALVKQFRKS
                130        140        150        160        170        180

190        200        210        220        230        240
m663.pep  SAPFLYLPDQDFGRNDSVFVDFFGIQTATITGLSRIAALANAKVIPAIPVREADNTVTLH
          ||||||||||||||||||||||||||:|||||||||||||||||||||||||||||||||
a663      SAPFLYLPDQDFGRNDSVFVDFFGIRTATITGLSRIAALANAKVIPAIPVREADNTVTLH
                190        200        210        220        230        240

250        260        270        280        290
m663.pep  FYPAWKSFPGEDAKADAQRMNRFIEDRVREHPEQYFWLHKRFKTRPEGSPDFYX
          ||||||:|||:|||:||||||||||||:|||||||||||||||||||||||||
a663      FYPAWESFPSEDAQADAQRMNRFIEERVREHPEQYFWLHKRFKTRPEGSPDFYX
                250        260        270        280        290
```

The following partial DNA sequence was identified in *N. gonorrhoeae* <SEQ ID 2153>:

```
g664.seq
    1 ATGATACATC CGCACCACTT CCGCGCCTTT TCATAAACG GTCATGGTGT

51 AGAAATTGTT CATCTCCTCA TAGCTGAcgg gGCGCACCGG ATGGGCGGTC

101 GGGCCTGCGT CTTCGGGGAA CTGGTTCTGG CGCAGCAGGC GGATGTTCTC

151 GATGCGGCGC ACGGCGCGGC CGGCGCGGTC GCCGGAAAAC TCTTGGTCGC

201 GGAACACGGT CAGCCCTTCC TTCAGCGAAA GCTGGAACCA GTCGCGGCAG

251 GTTACGCGGT TGCCCGTCCA GTTGTGGAAA TATTCGTGTC CGACCACGGA

301 TTCAATGCCT TCGAAATCGG TATCGGTGGC GGTGCGGCTG TCGGCGAGGA

351 CGAACTTGGT GTTAAAAATG TTCAAACCCT TGTTTTCCAT CGCGCCCATA

401 TTGAAATCGC CTACGGCGAC GACCATGAaa atatccaagt cataTTCcaa 451 cCcgaagcgc gtttcgtcCc acttcatcgC gtTTTTTCAA cgaTTCCACG

501 GCAAAGCCGA CCTTGGGTTT GTCCGCTTCG GTGGTGTAAA ACTCGATTTT

551 GA
```

This corresponds to the amino acid sequence <SEQ ID 2154; ORF 664.ng>:

```
g664.pep
    1 MIHPHHFRAF FINGHGVEIV HLLIADGAHR MGGRACVFGE LVLAQQADVL

51 DAAHGAAGAV AGKLLVAEHG QPFLQRKLEP VAAGYAVARP VVEIFVSDHG

101 FNAFEIGIGG GAAVGEDELG VKNVQTLVFH RAHIEIAYGD DHENIQVIFQ

151 PEARFVPLHR VFSTIPRQSR PWVCPLRWCK TRF*
```

The following partial DNA sequence was identified in *N. meningitidis* <SEQ ID 2155>:

```
m664.seq
    1 GTGATACATC CGCACTACTT CCGCGCCTTT TCATAAACG GTCATGGTGT

51 AGAAATTGTT CATCTCCTCA TAGCTGGCGG GGCGCACCGG ATGGGCGGTC

101 GGGCCTGCGT CTTCGGGGAA CTGGTGCTGG CGCAGCAGGC GGATGTTTTC

151 GATGCGGCGC ACGGCGCGGC TGGCGCGGTC GCCGGAAAAT CTTGGTCGC

201 GGAACACGGT CAGCCCTTCC TTCAGCGAAA GCTGGAACCA GTCGCGGCAG

251 GTTACGCGGT TGCCCGTCCA GTTGTGGAAA TACTCGTGTC CGACCACGGA
```

```
-continued
301 TTCGATGCCT TCGAAATCGG TATCGGTGGC GGTGCGGCTG TCGGCAAGGA

351 CGAACTTGGT GTTAAAGATG TTCAAACCCT TGTTTTCCAT CGCGCCCATA

401 TTGAAATCGC CCACGGCGAC GACCATGAAA ATATCCAAGT CGTATTCCAA

451 ACCGAAGCGC GTTTCGTCCC ATTTCATCGC GTTTTT.CAA CGATTCCACG

501 GCAAAGCCGA CCTTGGGCTT GTCCGCTTCG GTGGTGTAAA ACTCGATTTT

551 GA
```

This corresponds to the amino acid sequence <SEQ ID 2156; ORF 664>:

```
m664.pep
  1 VIHPHYFRAF FINGHGVEIV HLLIAGGAHR MGGRACVFGE LVLAQQADVF

51 DAAHGAAGAV AGKFLVAEHG QPFLQRKLEP VAAGYAVARP VVEILVSDHG

101 FDAFEIGIGG GAAVGKDELG VKDVQTLVFH RAHIEIAHGD DHENIQVVFQ

151 TEARFVPFHR VFXTIPRQSR PWACPLRWCK TRF*
```

Computer analysis of this amino acid sequence gave the following results:
Homology with a Predicted ORF from N. gonorrhoeae

```
   m664/g664 91.8% identity in 183 aa overlap 10        20        30        40        50        60
   m664.pep  VIHPHYFRAFFINGHGVEIVHLLIAGGAHRMGGRACVFGELVLAQQADVFDAAHGAAGAV
             :||||:||||||||||||||||||| ||||| ||||||||||||||||||:|||||||||
       g664  MIHPHHFRAFFINGHGVEIVHLLIADGAHRMGGRACVFGELVLAQQADVLDAAHGAAGAV
                 10        20        30        40        50        60

70        80        90       100       110       120
   m664.pep  AGKFLVAEHGQPFLQRKLEPVAAGYAVARPVVEILVSDHGFDAFEIGIGGGAAVGKDELG
             |||:||||||||||||||||||||||||||||||:||||||:||||||||||||||:|||
       g664  AGKLLVAEHGQPFLQRKLEPVAAGYAVARPVVEIFVSDHGFNAFEIGIGGGAAVGEDELG
                 70        80        90       100       110       120

130       140       150       160       170       180
   m664.pep  VKDVQTLVFHRAHIEIAHGDDHENIQVVFQTEARFVPFHRVFXTIPRQSRPWACPLRWCK
             ||:||||||||||||||:|||||||||:|| ||||||:||| ||||||||||:||||||
       g664  VKNVQTLVFHRAHIEIAYGDDHENIQVIFQPEARFVPLHRVFSRIPRQSRPWVCPLRWCK
                130       140       150       160       170       180 m664.pep  TRFX
             ||||
       g664  TRFX
```

The following partial DNA sequence was identified in N. meningitidis <SEQ ID 2157>:

```
a664.seq
  1 GTGATACATC CGCACCACTT CCGCGCCTTT TTCATAAACG GTCATGGTGT

51 AGAAATTGTT CATCTCCTCA TATCGGGCGG GGCGCACCGG ATGTGCGGTC

101 GGACCTGCGT CTTCGGGGAA CTGGTGCTGG CGCAGCAGGC GGATGTTTTC

151 GATACGGCGC ACGGCGCGGC TGGCGCGGTC GCCGGAAAAT TCTTGGTCGC

201 GGAACACGGT CAACCCTTCC TTCAGCGAAA GCTGGAACCA GTCGCGGCAG

251 GTCACGCGGT TGCCCGTCCA GTTGTGGAAA TATTCGTGTC CGACCACGGA

301 TTCGATGCCT TCAAAATCGG TATCGGTGGC GGTACGGCTG TCGGCAAGGA

351 CGAACTTGGT GTTAAAGATG TTCAAACCCT TGTTTTCCAT CGCACCCATA

401 TTGAAATCGC CCACGGCGAC GACCATGAAA ATATCCAAGT CGTATTCCAA

451 ACCGAAGCGC GTTTCGTCCC ACTTCATTGC GTTTTT.CAG CGATTCCACG
```

-continued

```
501 GCAAAGCCGA CCTTGGGCTT GTCCGCTTCG GTGGTGTAAA ACTCGATTTT

551 GA
```

This corresponds to the amino acid sequence <SEQ ID 2158; ORF 664.a>:

```
a664.pep

1 VIHPHHFRAF FINGHGVEIV HLLISGGAHR MCGRTCVFGE LVLAQQADVF

51 DTAHGAAGAV AGKFLVAEHG QPFLQRKLEP VAAGHAVARP VVEIFVSDHG

101 FDAFKIGIGG GTAVGKDELG VKDVQTLVFH RTHIEIAHGD DHENIQVVFQ

151 TEARFVPLHC VFXAIPRQSR PWACPLRWCK TRF* m664/a664 92.9% identity in 183 aa overlap 10        20        30        40        50        60
    m664.pep VIHPHYFRAFFINGHGVEIVHLLIAGGAHRMGGRACVFGELVLAQQADVFDAAHGAAGAV
             |||||:||||||||||||||||:||||||||  ||:|||||||||||||||:||||||||
    a664     VIHPHHFRAFFINGHGVEIVHLLISGGAHRMCGRTCVFGELVLAQQADVFDTAHGAAGAV
                 10        20        30        40        50        60

70        80        90       100       110       120
    m664.pep AGKFLVAEHGQPFLQRKLEPVAAGYAVARPVVEILVSDHGFDAFEIGIGGGAAVGKDELG
             |||||||||||||||||||||||:||||||||||:||||||||:||||||:||||||||
    a664     AGKFLVAEHGQPFLQRKLEPVAAGHAVARPVVEIFVSDHGFDAFKIGIGGGTAVGKDELG
                 70        80        90       100       110       120

130       140       150       160       170       180
    m664.pep VKDVQTLVFHRAHIEIAHGDDHENIQVVFQTEARFVPHRVFXTIPRQSRPWACPLRWCK
             |||||||||||:||||||||||||||||||||||||||:| |||:||||||||||||||||
    a664     VKDVQTLVFHRTHIEIAHGDDHENIQVVFQTEARFVPLHCVFXAIPRQSRPWACPLRWCK
                130       140       150       160       170       180 m664.pep TRFX
             ||||
    a664     TRFX
```

35

The following partial DNA sequence was identified in *N. gonorrhoeae* <SEQ ID 2159>:

```
g665.seq
    1 atgaagtgGg acgaaacgcg cttcgGgttg GAAtatgact tggatatttT

51 CATGGTCGTC GCCGTAGGCG ATTTCAATAT GGGCGCGATG GAAAACAAGG

101 GTTTGAACAT TTTTAACACC AAGTTCGTCC TCGCCGACAG CCGCACCGCC

151 ACCGATACCG ATTTCGAAGG CATTGAATCC GTGGTCGGAC ACGAATATTT

201 CCACAACTGG ACGGGCAACC GCGTAACCTG CCGCGACTGG TTCCAGCTTT

251 CGCTGAAGGA AGGGCTGACC GTGTTCCGCG ACCAAGAGTT TTCCGGCGAC

301 CGCGCCGGCC GCGCCGTGCG CCGCATCGAG AACATCCGCC TGCTGCGCCA

351 GAACCAGTTC CCCGAAGACG CAGGCCCGAC CGCCCATCCG GTGCGCcccg

401 TCAGCTATGA GGAGATGAAC AATTTCTACA CCATGACCGT TTATGAAAAA

451 GGCGCGGAAG TGGTGCGGAT GTATCATACC CTGCTCGGCG AAGAGGGCTT

501 CCAAAAAGGC ATGAAGCTAT ATTTCcaacg CCACGACGGA CAGGCAGTGA

551 CCTGCGACGA TTTCCGCGCG GCGatggcgg ATGCGAACGG CATCAATCTC

601 GACCAGTTCG CCTTGTGGTA CAGCCAGGCG GGCACGCCCG TTTTGGAAGC

651 CGAAGGCCGT CTGAAAAACA ATGTTTTCGA GTTAACCATT AAACAAACCG

701 TGCCGCCCAC GCCCGATATG GCGGACAAAC AGCCGATGAT GATTCCCGTC

751 AAAGTCGGGC TTCTGAACCG CAACGGCGAA GCGGTGGCAT TCGATTATCA
```

```
-continued
 801 GGGCAAACGC GCAACCGAAG CCGTGTTGCT GATGACCGAA GCCGAACagg

851 CCTTCCCGCT CGAAGGTGTA ACCGAAGCCG TCGTTCCCTC GCTGCTGCGC

901 GGGTTCAGCG CGCCAGTGTA TCTGAACTAT CCGTACAGCG ACGACGACCT

951 GCTGCTCCTG CTCGCCCACG ACAGCGACGC TTTCACGTGC TGGGAAGCCG

1001 CCCAAACGCT CTACCGTCGC GCCGTCGCCG CCAACCTTGC CGCGCTTTCA

1051 GACGGCATCG GGTTGCCGAA ACACGAAAAA CTGCTTGCCG CCGTCGAAAA

1101 AGTCATTTCA GACGACCTCT TGGACAACGC CTTCAAAGCC CTGCTTTTGG

1151 GCGTGCCGTC CGAAGCCGAa ctGTGGGACG GCACGGAAAA CATcgaCCCG

1201 CTGCGCTACC ATCAGGCGCG CGAAGCCTTG TTGGATACGC TTGCCGtcCG

1251 CttcctgcCG AAATGGCACG AATTGGaccg tcaggcggcg aagCAggaaa 1301 accaaagtTA CGAATACAGC CCCGAAACCG CCGACTGGCG CACGCTGCGC 1351 AACGTCTGCC GCGCCTtcgt cctGCGCGCC GACCCCGCGC acatcgAAAC 1401 TGTTGCCGAA Aaatacggcg AAATGGCGCA AAACATGACC CACGAATGGG

1451 GCATCCTGTC CGCCGTCAAC GGCAACGAAA GCGATACGCG CAACTGCCTG

1501 CTGGCGCAGT TTGCCGAcaa gTtttcAGAC GACGCGCTGG TGATGGACAA

1551 ATATTTCGCC CTTATCGGCT CAAGccgccg cagCGACACC CTGCAACAGG

1601 TTCAAACCGC CTTGCAGCAT CCGAAATTCA GTCTCGAAAA CCCCAACAAA

1651 GCCCGTTCGC TCATCGGCAG CTTCAGCCGC AACGTCCCGC ATTTTCACGC

1701 ACAAGACGGC AGCGGCTACC GCTTCATCGC CGACAAAGTC ATCGAAATCG

1751 ACCGCTTCAA cCCGCAggtc gccGCCCGCC TGGTGCAGGC GTTCAACCTC

1801 TGCAACAAGC TCGAGCCGCA CCGCAAAAAC TTgGTGAAAC AAGAATTGCA

1851 GTGCATTCGG GCGCAGGAAG GATTGTCGAA AGacGTGGGC GAaatcgtCG

1901 GCAAGATTTT GGGTTGA
```

This corresponds to the amino acid sequence <SEQ ID 2160; ORF 665.ng>:

```
g665.pep
  1 MKWDETRFGL EYDLDIFMVV AVGDFNMGAM ENKGLNIFNT KFVLADSRTA

51 TDTDFEGIES VVGHEYFHNW TGNRVTCRDW FQLSLKEGLT VFRDQEFSGD

101 RAGRAVRRIE NIRLLRQNQF PEDAGPTAHP VRPVSYEEMN NFYTMTVYEK

151 GAEVVRMYHT LLGEEGFQKG MKLYFQRHDG QAVTCDDFRA AMADANGINL

201 DQFALWYSQA GTPVLEAEGR LKNNVFELTI KQTVPPTPDM ADKQPMMIPV

251 KVGLLNRNGE AVAFDYQGKR ATEAVLLMTE AEQAFPLEGV TEAVVPSLLR

301 GFSAPVYLNY PYSDDDLLLL LAHDSDAFTC WEAAQTLYRR AVAANLAALS

351 DGIGLPKHEK LLAAVEKVIS DDLLDNAFKA LLLGVPSEAE LWDGTENIDP

401 LRYHQAREAL LDTLAVRFLP KWHELDRQAA KQENQSYEYS PETADWRTLR

451 NVCRAFVLRA DPAHIETVAE KYGEMAQNMT HEWGILSAVN GNESDTRNCL

501 LAQFADKFSD DALVMDKYFA LIGSSRRSDT LQQVQTALQH PKFSLENPNK

551 ARSLIGSFSR NVPHFHAQDG SGYRFIADKV IEIDRFNPQV AARLVQAFNL

601 CNKLEPHRKN LVKQELQCIR AQEGLSKDVG EIVGKILG*
```

The following partial DNA sequence was identified in *N. meningitidis* <SEQ ID 2161>:

```
m665.seq
   1 ATGAAATGGG ACGAAACGCG CTTCGGTTTG GAATACGACT TGGATATTTT
  51 CATGGTCGTC GCCGTGGGCG ATTTCAATAT GGGCGCGATG GAAAACAAGG
 101 GTTTGAACAT CTTTAACACC AAGTTCGTCC TTGCCGACAG CCGCACCGCC
 151 ACCGATACCG ATTTCGAAGG CATCGAATCC GTGGTCGGAC ACGAGTATTT
 201 CCACAACTGG ACGGGCAACC GCGTAACCTG CCGCGACTGG TTCCAGCTTT
 251 CGCTGAAGGA AGGGCTGACC GTGTTCCGCG ACCAAGAATT TTCCGGCGAC
 301 CGCGCCAGCC GCGCCGTGCG CCGCATCGAA AACATCCGCC TGCTGCGCCA
 351 GCACCAGTTC CCCGAAGACG CAGGCCCGAC CGCCCATCCG GTGCGCCCCG
 401 CCAGCTATGA GGAGATGAAC AATTTCTACA CCATGACCGT TTATGAAAAA
 451 GGCGCGGAAG TAGTGCGGAT GTATCACACC CTGCTCGGCG AAGAGGGCTT
 501 CCAGAAAGGC ATGAAGCTCT ATTTCCAACG CCACGACGGA CAGGCCGTTA
 551 CCTGCGACGA TTTCCGCGCG GCGATGGCGG ACGCGAACGG CATCAATCTC
 601 GACCAGTTCG CCTTGTGGTA CAGCCAGGCG GGCACGCCCG TTTTGGAAGC
 651 GGAAGGTCGT CTGAAAAACA ATATTTTCGA GTTGACCGTC AAACAAACCG
 701 TGCCGCCCAC GCCCGATATG ACGGATAAAC AGCCGATGAT GATTCCCGTC
 751 AAGGTCGGGC TGCTGAACCG CAACGGCGAA GCGGTGGCAT TCGACTATCA
 801 GGGCAAACGC GCGACCGAAG CCGTGTTGCT GCTGACCGAA GCCGAACAGA
 851 CCTTCCTGCT CGAAGGCGTA ACCGAAGCCG TCGTTCCCTC GCTGCTGCGC
 901 GGGTTCAGCG CGCCGGTGCA TCTGAACTAT CCGTACAGCG ACGACGACCT
 951 GCTGCTCCTG CTCGCCCATG ACAGCGACGC CTTCACGCGC TGGGAAGCCG
1001 CCCAAACGCT CTACCGCCGC GCCGTCGCCG CCAACCTTGC CACGCTTTCA
1051 GACGGCGTTG AGCTGCCGAA ACACGAAAAA CTGCTTGCCG CCGTCGAAAA
1101 AGTCATTTCA GACGACCTCT TAGACAACGC CTTCAAAGCC CTGCTTTTGG
1151 GCGTGCCATC CGAAGCCGAG CTGTGGGACG GCGCAGAAAA CATCGACCCG
1201 CTGCGCTACC ATCAGGCGCG CGAAGCCTTG TTGGATACGC TTGCCGTCCA
1251 CTTCCTGCCG AAATGGCACG AATTGAACCG TCAGGCGGCG AAGCAGGAAA
1301 ACCAAAGCTA CGAATACAGC CCCGAAGCCG CCGGCTGGCG CACGCTGCGC
1351 AACGTCTGCC GCGCCTTTGT CCTGCGCGCC GACCCCGCGC ACATCGAAAC
1401 CGTTGCCGAA AAATACGGCG AAATGGCGCA AAACATGACC CACGAATGGG
1451 GCATCCTGTC CGCCGTCAAC GGCAACGAAA GCGATACGCG CAACCGCCTG
1501 CTGGCGCAGT TTGCCGACAA GTTTTCAGAC GACGCGCTGG TGATGGACAA
1551 ATATTTTGCC CTCGTCGGCT CAAGCCGCCG CAGCGACACC CTGCAACAGG
1601 TTCGAACCGC CTTGCAGCAT CCGAAATTCA GCCTCGAAAA CCCCAACAAA
1651 GCCCGTTCGC TCATCGGCAG CTTCAGCCGC AACGTCCCGC ATTTCCACGC
1701 AGAAGACGGC AGCGGCTACC GCTTCATCGC CGACAAAGTC ATCGAAATCG
1751 ACCGCTTCAA CCCGCAGGTC GCCGCCCGCT TAGTGCAGGC GTTCAACCTC
1801 TGCAACAAGC TCGAGCCGCA CCGCAAAAAC TTGGTGAAAC AAGCATTGCA
1851 GCGCATTCGG GCGCAGGAAG GATTGTCGAA AGACGTGGGC GAAATCGTCG
1901 GCAAAATTTT GGATTGA
```

This corresponds to the amino acid sequence <SEQ ID 2162; ORF 665>:

```
m665.pep
   1 MKWDETRFGL EYDLDIFMVV AVGDFNMGAM ENKGLNIFNT KFVLADSRTA

51 TDTDFEGIES VVGHEYFHNW TGNRVTCRDW FQLSLKEGLT VFRDQEFSGD

101 RASRAVRRIE NIRLLRQHQF PEDAGPTAHP VRPASYEEMN NFYTMTVYEK

151 GAEVVRMYHT LLGEEGFQKG MKLYFQRHDG QAVTCDDFRA AMADANGINL

201 DQFALWYSQA GTPVLEAEGR LKNNIFELTV KQTVPPTPDM TDKQPMMIPV

251 KVGLLNRNGE AVAFDYQGKR ATEAVLLLTE AEQTFLLEGV TEAVVPSLLR

301 GFSAPVHLNY PYSDDDLLLL LAHDSDAFTR WEAAQTLYRR AVAANLATLS

351 DGVELPKHEK LLAAVEKVIS DDLLDNAFKA LLLGVPSEAE LWDGAENIDP

401 LRYHQAREAL LDTLAVHFLP KWHELNRQAA KQENQSYEYS PEAAGWRTLR

451 NVCRAFVLRA DPAHIETVAE KYGEMAQNMT HEWGILSAVN GNESDTRNRL

501 LAQFADKFSD DALVMDKYFA LVGSSRRSDT LQQVRTALQH PKFSLENPNK

551 ARSLIGSFSR NVPHFHAEDG SGYRFIADKV IEIDRFNPQV AARLVQAFNL

601 CNKLEPHRKN LVKQALQRIR AQEGLSKDVG EIVGKILD*
```

Computer analysis of this amino acid sequence gave the following results:
Homology with a Predicted ORF from *N. gonorrhoeae*

```
    m665/g665 96.1% identity in 637 aa overlap 10        20        30        40        50        60
m665.pep  MKWDETRFGLEYDLDIFMVVAVGDFNMGAMENKGLNIFNTKFVLADSRTATDTDFEGIES
          ||||||||||||||||||||||||||||||||||||||||||||||||||||||||||||
g665      MKWDETRFGLEYDLDIFMVVAVGDFNMGAMENKGLNIFNTKFVLADSRTATDTDFEGIES
                  10        20        30        40        50        60

70        80        90       100       110       120
m665.pep  VVGHEYFHNWTGNRVTCRDWFQLSLKEGLTVFRDQEFSGDRASRAVRRIENIRLLRQHQF
          ||||||||||||||||||||||||||||||||||||||||:|||||||||||||||||:|
g665      VVGHEYFHNWTGNRVTCRDWFQLSLKEGLTVFRDQEFSGDRAGRAVRRIENIRLLRQNQF
                  70        80        90       100       110       120

130       140       150       160       170       180
m665.pep  PEDAGPTAHPVRPASYEEMNNFYTMTVYEKGAEVVRMYHTLLGEEGFQKGMKLYFQRHDG
          ||||||||||||||:|||||||||||||||||||||||||||||||||||||||||||||
g665      PEDAGPTAHPVRPVSYEEMNNFYTMTVYEKGAEVVRMYHTLLGEEGFQKGMKLYFQRHDG
                 130       140       150       160       170       180

190       200       210       220       230       240
m665.pep  QAVTCDDFRAAMADANGINLDQFALWYSQAGTPVLEAEGRLKNNIFELTVKQTVPPTPDM
          ||||||||||||||||||||||||||||||||||||||||||||:|||| :|||||||||
g665      QAVTCDDFRAAMADANGINLDQFALWYSQAGTPVLEAEGRLKNNVFELTIKQTVPPTPDM
                 190       200       210       220       230       240

250       260       270       280       290       300
m665.pep  TDKQPMMIPVKVGLLNRNGEAVAFDYQGKRATEAVLLLTEAEQTFLLEGVTEAVVPSLLR
          :|||||||||||||||||||||||||||||||||||:|||||:| |||||||||||||||
g665      ADKQPMMIPVKVGLLNRNGEAVAFDYQGKRATEAVLLMTEAEQAFPLEGVTEAVVPSLLR
                 250       260       270       280       290       300

310       320       330       340       350       360
m665.pep  GFSAPVHLNYPYSDDDLLLLLAHDSDAFTRWEAAQTLYRRAVAANLATLSDGVELPKHEK
          ||||||:|||||||||||||||||||||| |||||||||||||||||||:||||: |||||
g665      GFSAPVYLNYPYSDDDLLLLLAHDSDAFTCWEAAQTLYRRAVAANLAALSDGIGLPKHEK
                 310       320       330       340       350       360

370       380       390       400       410       420
m665.pep  LLAAVEKVISDDLLDNAFKALLLGVPSEAELWDGAENIDPLRYHQAREALLDTLAVHFLP
          |||||||||||||||||||||||||||||||||||:||||||||||||||||||||:|||
g665      LLAAVEKVISDDLLDNAFKALLLGVPSEAELWDGTENIDPLRYHQAREALLDTLAVRFLP
                 370       380       390       400       410       420

430       440       450       460       470       480
m665.pep  KWHELNRQAAKQENQSYEYSPEAAGWRTLRNVCRAFVLRADPAHIETVAEKYGEMAQNMT
          |||||:||||||||||||||||:|||||||||||||||||||||||||||||||||||||
g665      KWHELDRQAAKQENQSYEYSPETADWRTLRNVCRAFVLRADPAHIETVAEKYGEMAQNMT
                 430       440       450       460       470       480
```

```
                 490        500        510        520        530        540
m665.pep HEWGILSAVNGNESDTRNRLLAQFADKFSDDALVMDKYFALVGSSRRSDTLQQVRTALQH
         |||||||||||||||||||| |||||||||||||||||||||||||:|||||||||||:||||
g665     HEWGILSAVNGNESDTRNCLLAQFADKFSDDALVMDKYFALIGSSRRSDTLQQVQTALQH
                 490        500        510        520        530        540

550        560        570        580        590        600
m665.pep PKFSLENPNKARSLIGSFSRNVPHFHAEDGSYRFIADKVIEIDRFNPQVAARLVQAFNL
         ||||||||||||||||||||||||||||:|||||||||||||||||||||||||||||
g665     PKFSLENPNKARSLIGSFSRNVPHFHAQDGSYRFIADKVIEIDRFNPQVAARLVQAFNL
                 550        560        570        580        590        600

610        620        630   639
m665.pep CNKLEPHRKNLVKQALQRIRAQEGLSKDVGEIVGKILDX
         ||||||||||||| || ||||||||||||||||||||
g665     CNKLEPHRKNLVKQELQCIRAQEGLSKDVGEIVGKILGX
                 610        620        630
```

15

The following partial DNA sequence was identified in *N. meningitidis* <SEQ ID 2163>:

```
a665.seq
    1 ATGAAGTGGG ACGAAACGCG CTTCGGTTTG AATACGACT  TGGATATTTT

51 CATGGTCGTC GCCGTGGGCG ATTTCAATAT GGGTGCGATG GAAAACAAGG

101 GTTTGAACAT CTTTAACACC AAGTTCGTCC TTGCCGACAG CCGTACCGCC

151 ACCGATACCG ATTTTGAAGG CATCGAATCC GTGGTCGGAC ACGAATATTT

201 CCACAACTGG ACGGGCAACC GCGTGACCTG CCGCGACTGG TTCCAGCTTT

251 CGCTGAAGGA AGGGTTGACC GTGTTCCGCG ACCAAGAATT TTCCGGCGAC

301 CGCGCCAGCC GCGCCGTGCG CCGTATCGAA AACATCCGCC TGCTGCGCCA

351 GCACCAGTTC CCCGAAGACG CAGGTCCGAC CGCACATCCG GTGCGCCCCG

401 CCCGATATGA GGAGATGAAC AATTTCTACA CCATGACCGT TTATGAAAAA

451 GGCGCGGAAG TGGTGCGGAT GTATCACACC TTGCTCGGCG AAGAGGGCTT

501 CCAAAAAGGT ATGAAGCTCT ATTTCCAACG CCACGACGGA CAGGCTGTTA

551 CCTGCGACGA TTTCCGCGCG GCGATGGTGG ACGCGAACGG CATCAACCTC

601 GACCAATTCG CCTTGTGGTA CAGCCAAGCA GGTACGCCGG TTTTAGATGC

651 TCAAGGGCGT CTGAAAAACA ATGTGTTCGA GTTAACCATC AAACAAACCG

701 TGCCGCCCAC GCCCGATATG GCGGACAAAC AGCCGATGAT GATTCCCGTC

751 AAAATCGGGC TGCTGAACTG CAACGGCGAA GCGGTGGCAT TTGATTATCA

801 GGGCAAACGC GCGACCGAAG CCGTGTTGCT GCTGACCGAA GCCGAACAGA

851 CCTTCCAGTT CGAAAGCGTA ACCGAAGCCG TCGTTCCCTC GCTGCTGCGC

901 GGGTTCAGCG CGCCGGTGCA TCTGAACTAT CCGTACAGCG ACGACGACCT

951 GCTGCTTCTG CTCGCCCATG ACAGCGACGC CTTCACGCGC TGGGAAGCCG

1001 CACAAACGCT CTACCGCCGT GCCGTCGCCG CCAACCTTGC CGCGCTTTCA

1051 GACGGCGTCG AGTTGCCGAA ACACGAAAAA CTGCTTGCCG CCGTCGAAAA

1101 AGTCATTTCA GACGACCTCT TAGACAACGC TTTCAAAGCC CTGCTTTTGG

1151 GTGTGCCGTC TGAAGCCGAG CTGTGGGACG GCGCGGAAAA CATCGACCCG

1201 CTGCGCTACC ATCAGGCGCG CGAAGCCTTG TTGGATATAC TTGCCGTCCG

1251 CTTTCTGCCG AAATGGCACG AATTGAACCG TCAGGCGGCG AAGCAGGAAA

1301 ACCAAAGCTA CGAGTACAGC CCCGAAGCCG CCGGTTGGCG CACGCTGCGC

1351 AATGTCTGCC GCGCCTTCGT CCTGCGCGCC GATCCCGCGC ACATCGAAAC

1401 CGTTGCCGAG AAATACGCCG AAATGGCGCA AAACATGACC CACGAATGGG
```

```
-continued
1451 GCATCCTGTC CGCCGTCAAC GGCAACGAAA GCGATACGCG CAACCGCCTG

1501 CTGGCGCAGT TTGCCGACAA GTTTTCAGAC GACGCGCTGG TGATGGACAA

1551 ATATTTCGCC CTCGTCGGCT CAAGCCGCCG CAGCGACACC CTGCAACAGG

1601 TTCAAACCGC CTTGCAGCAT CCGAAGTTCA GCCTCGAAAA TCCCAACAAA

1651 GCCCGCTCGC TCATCGGCAG CTTCAGCCGC AACGTCCCGC ATTTCCACGC

1701 AGAAGACGGC AGCGGCTACC GCTTCATCGC CGACAAAGTC ATCGAAATCG

1751 ACCGCTTTAA CCCGCAGGTC GCCGCCCGCC TGGTGCAGGC GTTCAACCTC

1801 TGCAACAAGC TCGAGCCGCA CCGCAAAAAC TTGGTGAAAC AAGCATTGCA

1851 GCGCATTCGG GCGCAGGAAG GATTGTCGAA AGACGTGGGC GAAATCGTCG

1901 GCAAAATTTT GGATTGA
```

This corresponds to the amino acid sequence <SEQ ID 2164; ORF 665.a>:

```
a665.pep

1 MKWDETRFGL EYDLDIFMVV AVGDFNMGAM ENKGLNIFNT KFVLADSRTA

51 TDTDFEGIES VVGHEYFHNW TGNRVTCRDW FQLSLKEGLT VFRDQEFSGD

101 RASRAVRRIE NIRLLRQHQF PEDAGPTAHP VRPARYEEMN NFYTMTVYEK

151 GAEVVRMYHT LLGEEGFQKG MKLYFQRHDG QAVTCDDFRA AMVDANGINL

201 DQFALWYSQA GTPVLDAQGR LKNNVFELTI KQTVPPTPDM ADKQPMMIPV

251 KIGLLNCNGE AVAFDYQGKR ATEAVLLLTE AEQTFQFESV TEAVVPSLLR

301 GFSAPVHLNY PYSDDDLLLL LAHDSDAFTR WEAAQTLYRR AVAANLAALS

351 DGVELPKHEK LLAAVEKVIS DDLLDNAFKA LLLGVPSEAE LWDGAENIDP

401 LRYHQAREAL LDILAVRFLP KWHELNRQAA KQENQSYEYS PEAAGWRTLR

451 NVCRAFVLRA DPAHIETVAE KYAEMAQNMT HEWGILSAVN GNESDTRNRL

501 LAQFADKFSD DALVMDKYFA LVGSSRRSDT LQQVQTALQH PKFSLENPNK

551 ARSLIGSFSR NVPHFHAEDG SGYRFIADKV IEIDRFNPQV AARLVQAFNL

601 CNKLEPHRKN LVKQALQRIR AQEGLSKDVG EIVGKILD* m665/a665 97.3% identity in 638 aa overlap 10        20        30        40        50        60
m665.pep MKWDETRFGLEYDLDIFMVVAVGDFNMGAMENKGLNIFNTKFVLADSRTATDTDFEGIES
         ||||||||||||||||||||||||||||||||||||||||||||||||||||||||||||
a665     MKWDETRFGLEYDLDIFMVVAVGDFNMGAMENKGLNIFNTKFVLADSRTATDTDFEGIES
                 10        20        30        40        50        60

70        80        90       100       110       120
m665.pep VVGHEYFHNWTGNRVTCRDWFQLSLKEGLTVFRDQEFSGDRASRAVRRIENIRLLRQHQF
         ||||||||||||||||||||||||||||||||||||||||||||||||||||||||||||
a665     VVGHEYFHNWTGNRVTCRDWFQLSLKEGLTVFRDQEFSGDRASRAVRRIENIRLLRQHQF
                 70        80        90       100       110       120

130       140       150       160       170       180
m665.pep PEDAGPTAHPVRPASYEEMNNFYTMTVYEKGAEVVRMYHTLLGEEGFQKGMKLYFQRHDG
         |||||||||||||| |||||||||||||||||||||||||||||||||||||||||||||
a665     PEDAGPTAHPVRPARYEEMNNFYTMTVYEKGAEVVRMYHTLLGEEGFQKGMKLYFQRHDG
                130       140       150       160       170       180

190       200       210       220       230       240
m665.pep QAVTCDDFRAAMADANGINLDQFALWYSQAGTPVLEAEGRLKNNIFELTVKQTVPPTPDM
         ||||||||||||:||||||||||||||||||||||:|:||||||:||||:|||||||||
a665     QAVTCDDFRAAMVDANGINLDQFALWYSQAGTPVLDAQGRLKNNVFELTIKQTVPPTPDM
                190       200       210       220       230       240

250       260       270       280       290       300
m665.pep TDKQPMMIPVKVGLLNRNGEAVAFDYQGKRATEAVLLLTEAEQTFLLEGVTEAVVPSLLR
         :|||||||||||:|||| ||||||||||||||||||||||||||| :|:||||||||||
a665     ADKQPMMIPVKIGLLNCNGEAVAFDYQGKRATEAVLLLTEAEQTFQFESVTEAVVPSLLR
                250       260       270       280       290       300
```

```
                 310        320        330        340        350        360
m665.pep GFSAPVHLNYPYSDDDLLLLLAHDSDAFTRWEAAQTLYRRAVAANLATLSDGVELPKHEK
         ||||||||||||||||||||||||||||||||||||||||||||:|||||||||||||
a665     GFSAPVHLNYPYSDDDLLLLLAHDSDAFTRWEAAQTLYRRAVAANLAALSDGVELPKHEK
                 310        320        330        340        350        360

370        380        390        400        410        420
m665.pep LLAAVEKVISDDLLDNAFKALLLGVPSEAELWDGAENIDPLRYHQAREALLDTLAVHFLP
         |||||||||||||||||||||||||||||||||||||||||||||||||||:|||
a665     LLAAVEKVISDDLLDNAFKALLLGVPSEAELWDGAENIDPLRYHQAREALLDILAVRFLP
                 370        380        390        400        410        420

430        440        450        460        470        480
m665.pep KWHELNRQAAKQENQSYEYSPEAAGWRTLRNVCRAFVLRADPAHIETVAEKYGEMAQNMT
         |||||||||||||||||||||||||||||||||||||||||||||||||||:|||||||
a665     KWHELNRQAAKQENQSYEYSPEAAGWRTLRNVCRAFVLRADPAHIETVAEKYAEMAQNMT
                 430        440        450        460        470        480

490        500        510        520        530        540
m665.pep HEWGILSAVNGNESDTRNRLLAQFADKFSDDALVMDKYFALVGSSRRSDTLQQVRTALQH
         |||||||||||||||||||||||||||||||||||||||||||||||||||||:||||
a665     HEWGILSAVNGNESDTRNRLLAQFADKFSDDALVMDKYFALVGSSRRSDTLQQVQTALQH
                 490        500        510        520        530        540

550        560        570        580        590        600
m665.pep PKFSLENPNKARSLIGSFSRNVPHFHAEDGSGYRFIADKVIEIDRFNPQVAARLVQAFNL
         ||||||||||||||||||||||||||||||||||||||||||||||||||||||||||||
a665     PKFSLENPNKARSLIGSFSRNVPHFHAEDGSGYRFIADKVIEIDRFNPQVAARLVQAFNL
                 550        560        570        580        590        600

610        620        630     639
m665.pep CNKLEPHRKNLVKQALQRIRAQEGLSKDVGEIVGKILDX
         ||||||||||||||||||||||||||||||||||||||
a665     CNKLEPHRKNLVKQALQRIRAQEGLSKDVGEIVGKILDX
                 610        620        630
```

The following partial DNA sequence was identified in *N. gonorrhoeae* <SEQ ID 2165>:

```
g665-1.seq
    1 ATGAGCAAAA CCGTCCGTTA TCTGAAAGAT TACCAAACGC CTGCCTACCG

51 CATTCTTGAA ACCGAACTGC ATTTCGACAT TGCCGAACCG CAAACCGTCG

101 TGAAGTCGCG TTTGACGGTC GAGCCGCAGA GGGCGGGCGA GCCGCTGGTG

151 TTGGACGGTT CGGCAAAACT CTTGTCCGTC AAAATCAACG GCGCGGCGGC

201 GGATTATGTG TTGGAAGGCG AGACGCTGAC GATTGCAGAC GTACCGTCCG

251 AACGCTTCAC CGTCGAAGTG GAAACCGAAA TCCTGCCGGC GGAAAACAAA

301 TCGCTGATGG GGCTGTATGC TTCCGGCGGC AATCTGTTTA CCCAGTGCGA

351 GCCGGAGGGC TTCCGCAAAA TCACGTTCTA CATCGACCGT CCGGATGTGA

401 TGTCCAAGTT CACGACCACC ATCGTCGCGG ACAAAAAACG CTATCCCGTT

451 TTGCTTTCCA ACGGCAACAA AATCGACGGC GGCGAGTTTT CAGACGGCCG

501 CCATTGGGTG AAATGGGAAG ACCCGTTTGC CAAACCGAGT TATCTGTTTG

551 CTTTGGTCGC GGGCGATTTG GCGGTAACGG AAGACCGTTT CACCACCATG

601 AGCGGCAGAA ACGTCAAAAT CGAGTTTTAC ACCACCGAAG CGGACAAACC

651 CAAGGTCGGC TTTGCCGTGG AATCGTTGAA AAACGCGATG AAGTGGGACG

701 AAACGCGCTT CGGGTTGGAA TATGACTTGG ATATTTTCAT GGTCGTCGCC

751 GTAGGCGATT TCAATATGGG CGCGATGGAA ACAAGGGGTT TGAACATTTT

801 TAACACCAAG TTCGTCCTCG CCGACAGCCG CACCGCCACC GATACCGATT

851 TCGAAGGCAT TGAATCCGTG GTCGGACACG AATATTTCCA CAACTGGACG

901 GGCAACCGCG TAACCTGCCG CGACTGGTTC CAGCTTTCGC TGAAGGAAGG

951 GCTGACCGTG TTCCGCGACC AAGAGTTTTC CGGCGACCGC GCCGGCCGCG

1001 CCGTGCGCCG CATCGAGAAC ATCCGCCTGC TGCGCCAGAA CCAGTTCCCC
```

-continued

```
1051 GAAGACGCAG GCCCGACCGC CCATCCGGTG CGCCCCGTCA GCTATGAGGA

1101 GATGAACAAT TTCTACACCA TGACCGTTTA TGAAAAAGGC GCGGAAGTGG

1151 TGCGGATGTA TCATACCCTG CTCGGCGAAG AGGGCTTCCA AAAAGGCATG

1201 AAGCTATATT CCAACGCCA CGACGGACAG GCAGTGACCT GCGACGATTT

1251 CCGCGCGGCG ATGGCGGATG CGAACGGCAT CAATCTCGAC CAGTTCGCCT

1301 TGTGGTACAG CCAGGCGGGC ACGCCCGTTT GGAAGCCGA AGGCCGTCTG

1351 AAAAACAATG TTTTCGAGTT AACCATTAAA CAAACCGTGC CGCCCACGCC

1401 CGATATGGCG GACAAACAGC CGATGATGAT TCCCGTCAAA GTCGGGCTTC

1451 TGAACCGCAA CGGCGAAGCG GTGGCATTCG ATTATCAGGG CAAACGCGCA

1501 ACCGAAGCCG TGTTGCTGAT GACCGAAGCC GAACAGGCCT TCCCGCTCGA

1551 AGGTGTAACC GAAGCCGTCG TTCCCTCGCT GCTGCGCGGG TTCAGCGCGC

1601 CAGTGTATCT GAACTATCCG TACAGCGACG ACGACCTGCT GCTCCTGCTC

1651 GCCCACGACA GCGACGCTTT CACGTGCTGG GAAGCCGCCC AAACGCTCTA

1701 CCGTCGCGCC GTCGCCGCCA ACCTTGCCGC GCTTTCAGAC GGCATCGGGT

1751 TGCCGAAACA CGAAAAACTG CTTGCCGCCG TCGAAAAAGT CATTTCAGAC

1801 GACCTCTTGG ACAACGCCTT CAAAGCCCTG CTTTTGGGCG TGCCGTCCGA

1851 AGCCGAACTG TGGGACGGCA CGGAAAACAT CGACCCGCTG CGCTACCATC

1901 AGGCGCGCGA AGCCTTGTTG GATACGCTTG CCGTCCGCTT CCTGCCGAAA

1951 TGGCACGAAT TGGACCGTCA GGCGGCGAAG CAGGAAAACC AAAGTTACGA

2001 ATACAGCCCC GAAACCGCCG ACTGGCGCAC GCTGCGCAAC GTCTGCCGCG

2051 CCTTCGTCCT GCGCGCCGAC CCCGCGCACA TCGAAACTGT TGCCGAAAAA

2101 TACGGCGAAA TGGCGCAAAA CATGACCCAC GAATGGGGCA TCCTGTCCGC

2151 CGTCAACGGC AACGAAAGCG ATACGCGCAA CTGCCTGCTG GCGCAGTTTG

2201 CCGACAAGTT TTCAGACGAC GCGCTGGTGA TGGACAAATA TTTCGCCCTT

2251 ATCGGCTCAA GCCGCCGCAG CGACACCCTG CAACAGGTTC AAACCGCCTT

2301 GCAGCATCCG AAATTCAGTC TCGAAAACCC CAACAAAGCC CGTTCGCTCA

2351 TCGGCAGCTT CAGCCGCAAC GTCCCGCATT TTCACGCACA AGACGGCAGC

2401 GGCTACCGCT TCATCGCCGA CAAAGTCATC GAAATCGACC GCTTCAACCC

2451 GCAGGTCGCC GCCCGCCTGG TGCAGGCGTT CAACCTCTGC AACAAGCTCG

2501 AGCCGCACCG CAAAAACTTG GTGAAACAAG AATTGCAGTG CATTCGGGCG

2551 CAGGAAGGAT TGTCGAAAGA CGTGGGCGAA ATCGTCGGCA AGATTTTGGG

2601 TTGA
```

This corresponds to the amino acid sequence <SEQ ID 2166; ORF 665-1.ng>:

```
g665-1.pep
  1 MSKTVRYLKD YQTPAYRILE TELHFDIAEP QTVVKSRLTV EPQRAGEPLV

51 LDGSAKLLSV KINGAAADYV LEGETLTIAD VPSERFTVEV ETEILPAENK

101 SLMGLYASGG NLFTQCEPEG FRKITFYIDR PDVMSKFTTT IVADKKRYPV

151 LLSNGNKIDG GEFSDGRHWV KWEDPFAKPS YLFALVAGDL AVTEDRFTTM

201 SGRNVKIEFY TTEADKPKVG FAVESLKNAM KWDETRFGLE YDLDIFMVVA
```

-continued
```
251 VGDFNMGAME NKGLNIFNTK FVLADSRTAT DTDFEGIESV VGHEYFHNWT

301 GNRVTCRDWF QLSLKEGLTV FRDQEFSGDR AGRAVRRIEN IRLLRQNQFP

351 EDAGPTAHPV RPVSYEEMNN FYTMTVYEKG AEVVRMYHTL LGEEGFQKGM

401 KLYFQRHDGQ AVTCDDFRAA MADANGINLD QFALWYSQAG TPVLEAEGRL

451 KNNVFELTIK QTVPPTPDMA DKQPMMIPVK VGLLNRNGEA VAFDYQGKRA

501 TEAVLLMTEA EQAFPLEGVT EAVVPSLLRG FSAPVYLNYP YSDDDLLLLL

551 AHDSDAFTCW EAAQTLYRRA VAANLAALSD GIGLPKHEKL LAAVEKVISD

601 DLLDNAFKAL LLGVPSEAEL WDGTENIDPL RYHQAREALL DTLAVRFLPK

651 WHELDRQAAK QENQSYEYSP ETADWRTLRN VCRAFVLRAD PAHIETVAEK

701 YGEMAQNMTH EWGILSAVNG NESDTRNCLL AQFADKFSDD ALVMDKYFAL

751 IGSSRRSDTL QQVQTALQHP KFSLENPNKA RSLIGSFSRN VPHFHAQDGS

801 GYRFIADKVI EIDRFNPQVA ARLVQAFNLC NKLEPHRKNL VKQELQCIRA

851 QEGLSKDVGE IVGKILG*
```

The following partial DNA sequence was identified in *N. meningitidis* <SEQ ID 2167>:

```
m665-1.seq
   1 ATGAGCAAAA CCGTGCATTA TCTCAAAGAC TATCAAACGC CCGCCTACCA

51 TATTCTCAAA ACCGATTTAC ATTTTGATAT TAATGAACCG CAAACCGTCG

101 TGAAGTCGCG TTTGACGGTT GAGCCGCAGA GGGTAGGGGA GCCGCTGGTG

151 TTGGACGGTT CGGCGAAACT CTTGTCCGTC AAAATCAACG GGGCGGCGGC

201 GGATTATGTG TTGGAAGGAG AGACGCTGAC GATTGCGGGC GTGCCGTCCG

251 AACGCTTCAC CGTCGAAGTG GAAACCGAAA TCCTGCCGGC GGAAAACAAA

301 TCGCTGATGG GGCTGTATGC TTCCGGCGGC AATTTGTTTA CCCAGTGCGA

351 GCCGGAGGGC TTCCGCAAAA TCACATTTTA CATCGACCGT CCGGATGTGA

401 TGTCCAAGTT CACCACCACC ATCGTCGCCG ACAAAAAACG CTATCCCGTT

451 TTGCTTTCCA ACGGCAACAA AATCGACGGC GGCGAGTTTT CAGACGGCCG

501 CCATTGGGTG AAATGGGAAG ACCCGTTTTC CAAACCGAGC TATCTGTTTG

551 CTTTGGTCGC GGGCGATTTG GCGGTAACGG AAGACTATTT CACCACCATG

601 AGCGGCAGAA ACGTCAAAAT CGAGTTTTAC ACCACCGAAG CGGACAAGCC

651 CAAGGTCGGC TTTGCCGTGG AATCGTTGAA AAACGCGATG AAATGGGACG

701 AAACGCGCTT CGGTTTGGAA TACGACTTGG ATATTTTCAT GGTCGTCGCC

751 GTGGGCGATT TCAATATGGG CGCGATGGAA AACAAGGGTT TGAACATCTT

801 TAACACCAAG TTCGTCCTTG CCGACAGCCG CACCGCCACC GATACCGATT

851 TCGAAGGCAT CGAATCCGTG GTCGGACACG AGTATTTCCA CAACTGGACG

901 GGCAACCGCG TAACCTGCCG CGACTGGTTC CAGCTTTCGC TGAAGGAAGG

951 GCTGACCGTG TTCCGCGACC AAGAATTTTC CGGCGACCGC GCCAGCCGCG

1001 CCGTGCGCCG CATCGAAAAC ATCCGCCTGC TGCGCCAGCA CCAGTTCCCC

1051 GAAGACGCAG GCCCGACCGC CCATCCGGTG CGCCCCGCCA GCTATGAGGA

1101 GATGAACAAT TTCTACACCA TGACCGTTTA TGAAAAAGGC GCGGAAGTAG

1151 TGCGGATGTA TCACACCCTG CTCGGCGAAG AGGGCTTCCA GAAAGGCATG
```

```
-continued
1201 AAGCTCTATT TCCAACGCCA CGACGGACAG GCCGTTACCT GCGACGATTT

1251 CCGCGCGGCG ATGGCGGACG CGAACGGCAT CAATCTCGAC CAGTTCGCCT

1301 TGTGGTACAG CCAGGCGGGC ACGCCCGTTT TGGAAGCGGA AGGTCGTCTG

1351 AAAAACAATA TTTTCGAGTT GACCGTCAAA CAAACCGTGC CGCCCACGCC

1401 CGATATGACG GATAAACAGC CGATGATGAT TCCCGTCAAG GTCGGGCTGC

1451 TGAACCGCAA CGGCGAAGCG GTGGCATTCG ACTATCAGGG CAAACGCGCG

1501 ACCGAAGCCG TGTTGCTGCT GACCGAAGCC GAACAGACCT TCCTGCTCGA

1551 AGGCGTAACC GAAGCCGTCG TTCCCTCGCT GCTGCGCGGG TTCAGCGCGC

1601 CGGTGCATCT GAACTATCCG TACAGCGACG ACGACCTGCT GCTCCTGCTC

1651 GCCCATGACA GCGACGCCTT CACGCGCTGG GAAGCCGCCC AAACGCTCTA

1701 CCGCCGCGCC GTCGCCGCCA ACCTTGCCAC GCTTTCAGAC GGCGTTGAGC

1751 TGCCGAAACA CGAAAAACTG CTTGCCGCCG TCGAAAAAGT CATTTCAGAC

1801 GACCTCTTAG ACAACGCCTT CAAAGCCCTG CTTTTGGGCG TGCCATCCGA

1851 AGCCGAGCTG TGGGACGGCG CAGAAAACAT CGACCCGCTG CGCTACCATC

1901 AGGCGCGCGA AGCCTTGTTG GATACGCTTG CCGTCCACTT CCTGCCGAAA

1951 TGGCACGAAT TGAACCGTCA GGCGGCGAAG CAGGAAAACC AAAGCTACGA

2001 ATACAGCCCC GAAGCCGCCG GCTGGCGCAC GCTGCGCAAC GTCTGCCGCG

2051 CCTTTGTCCT GCGCGCCGAC CCCGCGCACA TCGAAACCGT TGCCGAAAAA

2101 TACGGCGAAA TGGCGCAAAA CATGACCCAC GAATGGGGCA TCCTGTCCGC

2151 CGTCAACGGC AACGAAAGCG ATACGCGCAA CCGCCTGCTG GCGCAGTTTG

2201 CCGACAAGTT TTCAGACGAC GCGCTGGTGA TGGACAAATA TTTTGCCCTC

2251 GTCGGCTCAA GCCGCCGCAG CGACACCCTG CAACAGGTTC GAACCGCCTT

2301 GCAGCATCCG AAATTCAGCC TCGAAAACCC CAACAAAGCC CGTTCGCTCA

2351 TCGGCAGCTT CAGCCGCAAC GTCCCGCATT TCCACGCAGA AGACGGCAGC

2401 GGCTACCGCT TCATCGCCGA CAAAGTCATC GAAATCGACC GCTTCAACCC

2451 GCAGGTCGCC GCCCGCTTAG TGCAGGCGTT CAACCTCTGC AACAAGCTCG

2501 AGCCGCACCG CAAAAACTTG GTGAAACAAG CATTGCAGCG CATTCGGGCG

2551 CAGGAAGGAT TGTCGAAAGA CGTGGGCGAA ATCGTCGGCA AAATTTTGGA

2601 TTGA
```

This corresponds to the amino acid sequence <SEQ ID 2168; ORF 665-1>:

```
m665-1.pep

1 MSKTVHYLKD YQTPAYHILK TDLHFDINEP QTVVKSRLTV EPQRVGEPLV

51 LDGSAKLLSV KINGAAADYV LEGETLTIAG VPSERFTVEV ETEILPAENK

101 SLMGLYASGG NLFTQCEPEG FRKITFYIDR PDVMSKETTT IVADKKRYPV

151 LLSNGNKIDG GEFSDGRHWV KWEDPFSKPS YLFALVAGDL AVTEDYFTTM

201 SGRNVKIEFY TTEADKPKVG FAVESLKNAM KWDETRFGLE YDLDIFMVVA

251 VGDFNMGAME NKGLNIFNTK FVLADSRTAT DTDFEGIESV VGHEYFHNWT

301 GNRVTCRDWF QLSLKEGLTV FRDQEFSGDR ASRAVRRIEN IRLLRQHQFP

351 EDAGPTAHPV RPASYEEMNN FYTMTVYEKG AEVVRMYHTL LGEEGFQKGM
```

-continued

```
401 KLYFQRHDGQ AVTCDDFRAA MADANGINLD QFALWYSQAG TPVLEAEGRL

451 KNNIFELTVK QTVPPTPDMT DKQPMMIPVK VGLLNRNGEA VAFDYQGKRA

501 TEAVLLLTEA EQTFLLEGVT EAVVPSLLRG FSAPVHLNYP YSDDDLLLLL

551 AHDSDAFTRW EAAQTLYRRA VAANLATLSD GVELPKHEKL LAAVEKVISD

601 DLLDNAFKAL LLGVPSEAEL WDGAENIDPL RYHQEREALL DTLAVHFLPK

651 WHELNRQAAK QENQSYEYSP EAAGWRTLRN VCRAFVLRAD PAHIETVAEK

701 YGEMAQNMTH EWGILSAVNG NESDTRNRLL AQFADKFSDD ALVMDKYFAL

751 VGSSRRSDTL QQVRTALQHP KFSLENPNKA RSLIGSFSRN VPHFHAEDGS

801 GYRFIADKVI EIDRFNPQVA ARLVQAFNLC NKLEPHRKNL VKQALQRIRA

851 QEGLSKDVGE IVGKILD*
``` m665-1/g665-1 96.1% identity in 866 aa overlap

```
                  10         20         30         40         50         60
m665-1.pep  MSKTVHYLKDYQTPAYHILKTDLHFDINEPQTVVKSRLTVEPQRVGEPLVLDGSAKLLSV
            |||||:||||||||||:||:|:|||||  |||||||||||||||:||||||||||||||
g665-1      MSKTVRYLKDYQTPAYRILETELHFDIAEPQTVVKSRLTVEPQRAGEPLVLDGSAKLLSV
                  10         20         30         40         50         60

70         80         90        100        110        120
m665-1.pep  KINGAAADYVLEGETLTIAGVPSERFTVEVETEILPAENKSLMGLYASGGNLFTQCEPEG
            ||||||||||||||||||| |||||||||||||||||||||||||||||||||||||||
g665-1      KINGAAADYVLEGETLTIADVPSERFTVEVETEILPAENKSLMGLYASGGNLFTQCEPEG
                  70         80         90        100        110        120

130        140        150        160        170        180
m665-1.pep  FRKITFYIDRPDVMSKFTTTIVADKKRYPVLLSNGNKIDGGEFSDGRHWVKWEDPFSKPS
            |||||||||||||||||||||||||||||||||||||||||||||||||||||||:|||
g665-1      FRKITFYIDRPDVMSKFTTTIVADKKRYPVLLSNGNKIDGGEFSDGRHWVKWEDPFAKPS
                 130        140        150        160        170        180

190        200        210        220        230        240
m665-1.pep  YLFALVAGDLAVTEDYFTTMSGRNVKIEFYTTEADKPKVGFAVESLKNAMKWDETRFGLE
            ||||||||||||||||:|||||||||||||||||||||||||||||||||||||||||||
g665-1      YLFALVAGDLAVTEDRFTTMSGRNVKIEFYTTEADKPKVGFAVESLKNAMKWDETRFGLE
                 190        200        210        220        230        240

250        260        270        280        290        300
m665-1.pep  YDLDIFMVVAVGDFNMGAMENKGLNIFNTKFVLADSRTATDTDFEGIESVVGHEYFHNWT
            ||||||||||||||||||||||||||||||||||||||||||||||||||||||||||||
g665-1      YDLDIFMVVAVGDFNMGAMENKGLNIFNTKFVLADSRTATDTDFEGIESVVGHEYFHNWT
                 250        260        270        280        290        300

310        320        330        340        350        360
m665-1.pep  GNRVTCRDWFQLSLKEGLTVFRDQEFSGDRASRAVRRIENIRLLRQHQFPPEDAGPTAHPV
            ||||||||||||||||||||||||||||||||:||||||||||||||:|||||||||||
g665-1      GNRVTCRDWFQLSLKEGLTVFRDQEFSGDRAGRAVRRIENIRLLRQNQFPPEDAGPTAHPV
                 310        320        330        340        350        360

370        380        390        400        410        420
m665-1.pep  RPASYEEMNNFYTMTVYEKGAEVVRMYHTLLGEEGFQKGMKLYFQRHDGQAVTCDDFRAA
            ||:|||||||||||||||||||||||||||||||||||||||||||||||||||||||||
g665-1      RPVSYEEMNNFYTMTVYEKGAEVVRMYHTLLGEEGFQKGMKLYFQRHDGQAVTCDDFRAA
                 370        380        390        400        410        420

430        440        450        460        470        480
m665-1.pep  MADANGINLDQFALWYSQAGTPVLEAEGRLKNNIFELTVKQTVPPTPDMTDKQPMMIPVK
            |||||||||||||||||||||||||||||||||:|||:|||||||||||:|||||||||
g665-1      MADANGINLDQFALWYSQAGTPVLEAEGRLKNNVFELTIKQTVPPTPDMADKQPMMIPVK
                 430        440        450        460        470        480

490        500        510        520        530        540
m665-1.pep  VGLLNRNGEAVAFDYQGKRATEAVLLLTEAEQTFLLEGVTEAVVPSLLRGFSAPVHLNYP
            ||||||||||||||||||||||||||:|||||:||||||||||||||||||||||:|||
g665-1      VGLLNRNGEAVAFDYQGKRATEAVLLMTEAEQAFPLEGVTEAVVPSLLRGFSAPVYLNYP
                 490        500        510        520        530        540

550        560        570        580        590        600
m665-1.pep  YSDDDLLLLLAHDSDAFTRWEAAQTLYRRAVAANLATLSDGVELPKHEKLLAAVEKVISD
            |||||||||||||||||||:|||||||||||||:||||||:|||||||||||||||||||
g665-1      YSDDDLLLLLAHDSDAFTCWEAAQTLYRRAVAANLAALSDGIGLPKHEKLLAAVEKVISD
                 550        560        570        580        590        600

610        620        630        640        650        660
m665-1.pep  DLLDNAFKALLLGVPSEAELWDGAENIDPLRYHQREALLDTLAVHFLPKWHELNRQAAK
            ||||||||||||||||||||||||||:||||||||||||||||:|||||||:||||||
g665-1      DLLDNAFKALLLGVPSEAELWDGTENIDPLRYHQREALLDTLAVRFLPKWHELDRQAAK
                 610        620        630        640        650        660
```

-continued

```
                     670       680       690       700       710       720
m665-1.pep QENQSYEYSPEAAGWRTLRNVCRAFVLRADPAHIETVAEKYGEMAQNMTHEWGILSAVNG
           |||||||||||:| ||||||||||||||||||||||||||||||||||||||||||||||
g665-1     QENQSYEYSPETADWRTLRNVCRAFVLRADPAHIETVAEKYGEMAQNMTHEWGILSAVNG
                     670       680       690       700       710       720

730       740       750       760       770       780
m665-1.pep NESDTRNRLLAQFADKFSDDALVMDKYFALVGSSRRSDTLQQVRTALQHPKFSLENPNKA
           ||||||| ||||||||||||||||||||||:||||||||||||:||||||||||||||||
g665-1     NESDTRNCLLAQFADKFSDDALVMDKYFALIGSSRRSDTLQQVQTALQHPKFSLENPNKA
                     730       740       750       760       770       780

790       800       810       820       830       840
m665-1.pep RSLIGSFSRNVPHFHAEDGSGYRFIADKVIEIDRFNPQVAARLVQAFNLCNKLEPHRKNL
           ||||||||||||||||:|||||||||||||||||||||||||||||||||||||||||||
g665-1     RSLIGSFSRNVPHFHAQDGSGYRFIADKVIEIDRFNPQVAARLVQAFNLCNKLEPHRKNL
                     790       800       810       820       830       840

850       860
m665-1.pep VKQALQRIRAQEGLSKDVGEIVGKILDX
           ||| || |||||||||||||||||||
g665-1     VKQELQCIRAQEGLSKDVGEIVGKILGX
                     850       860
```

The following partial DNA sequence was identified in *N. meningitidis* <SEQ ID 2169>:

```
a665-1.seq
   1  ATGAGCAAAA CCGTGCATTA TCTCAAAGAC TATCAAACGC CCGCCTACCA
  51  TATTCTCAAA ACCGATTTAC ATTTTGATAT TAACGAACCG CAAACCATTG
 101  TGAAGTCGCG TTTGACGGTC GAGCCGAAGA GGGTGGGAGA GCCGCTGGTG
 151  TTGGACGGTT CGGCGAAACT CTTGTCCGTC AAAATCAACG GCGTGGCGGC
 201  GGATTATGTG TTGGAAGGCG AGACGCTGAC GATTGCGGAC GTGCCGTCCG
 251  AACGCTTCAC CGTCGAAGTG GAAACCGAAA TCCTGCCGGC GGAAAACAAA
 301  TCGCTGATGG GGCTGTATGC GTCCGCCGGT AACCTGTTTA CCCAGTGCGA
 351  GCCGGAGGGC TTCCGCAAAA TCACGTTCTA TATCGACCGT CCGGATGTCA
 401  TGTCCAAGTT CACGACCACC ATCGTCGCGG ACAAAAAACG CTATCCCGTT
 451  TTGCTCTCCA ACGGCAACAA AATCGACGGC GGCGAGTATT CAGACGGCCG
 501  CCATTGGGTG AAATGGGAAG ACCCGTTTGC CAAACCGAGT TATCTGTTTG
 551  CTTTGGTCGC GGGCGATTTG GCGGTCACGG AAGACTATTT CACCACCATG
 601  AGCGGCAGAA ACGTCAAAAT CGAGTTTTAC ACCACCGAAG CGGACAAGCC
 651  CAAGGTCGGC TTTGCCGTGG AATCGCTGAA AAACGCAATG AAGTGGGACG
 701  AAACGCGCTT CGGTTTGGAA TACGACTTGG ATATTTTCAT GGTCGTCGCC
 751  GTGGGCGATT TCAATATGGG TGCGATGGAA AACAAGGGTT TGAACATCTT
 801  TAACACCAAG TTCGTCCTTG CCGACAGCCG TACCGCCACC GATACCGATT
 851  TTGAAGGCAT CGAATCCGTG GTCGGACACG AATATTTCCA CAACTGGACG
 901  GGCAACCGCG TGACCTGCCG CGACTGGTTC CAGCTTTCGC TGAAGGAAGG
 951  GTTGACCGTG TTCCGCGACC AAGAATTTTC CGGCGACCGC GCCAGCCGCG
1001  CCGTGCGCCG TATCGAAAAC ATCCGCCTGC TGCGCCAGCA CCAGTTCCCC
1051  GAAGACGCAG GTCCGACCGC ACATCCGGTG CGCCCCGCCC GATATGAGGA
1101  GATGAACAAT TTCTACACCA TGACCGTTTA TGAAAAAGGC GCGGAAGTGG
1151  TGCGGATGTA TCACACCTTG CTCGGCGAAG AGGGCTTCCA AAAAGGTATG
1201  AAGCTCTATT TCCAACGCCA CGACGGACAG GCTGTTACCT GCGACGATTT
1251  CCGCGCGGCG ATGGTGGACG CGAACGGCAT CAACCTCGAC CAATTCGCCT
```

-continued

```
1301 TGTGGTACAG CCAAGCAGGT ACGCCGGTTT TAGATGCTCA AGGGCGTCTG

1351 AAAAACAATG TGTTCGAGTT AACCATCAAA CAAACCGTGC CGCCCACGCC

1401 CGATATGGCG GACAAACAGC CGATGATGAT TCCCGTCAAA ATCGGGCTGC

1451 TGAACTGCAA CGGCGAAGCG GTGGCATTTG ATTATCAGGG CAAACGCGCG

1501 ACCGAAGCCG TGTTGCTGCT GACCGAAGCC GAACAGACCT TCCAGTTCGA

1551 AAGCGTAACC GAAGCCGTCG TTCCCTCGCT GCTGCGCGGG TTCAGCGCGC

1601 CGGTGCATCT GAACTATCCG TACAGCGACG ACGACCTGCT GCTTCTGCTC

1651 GCCCATGACA GCGACGCCTT CACGCGCTGG GAAGCCGCAC AAACGCTCTA

1701 CCGCCGTGCC GTCGCCGCCA ACCTTGCCGC GCTTTCAGAC GGCGTCGAGT

1751 TGCCGAAACA CGAAAAACTG CTTGCCGCCG TCGAAAAAGT CATTTCAGAC

1801 GACCTCTTAG ACAACGCTTT CAAAGCCCTG CTTTTGGGTG TGCCGTCTGA

1851 AGCCGAGCTG TGGGACGGCG CGGAAAACAT CGACCCGCTG CGCTACCATC

1901 AGGCGCGCGA AGCCTTGTTG GATATACTTG CCGTCCGCTT TCTGCCGAAA

1951 TGGCACGAAT TGAACCGTCA GGCGGCGAAG CAGGAAAACC AAAGCTACGA

2001 GTACAGCCCC GAAGCCGCCG TTGGCGCAC GCTGCGCAAT GTCTGCCGCG

2051 CCTTCGTCCT GCGCGCCGAT CCCGCGCACA TCGAAACCGT TGCCGAGAAA

2101 TACGCCGAAA TGGCGCAAAA CATGACCCAC GAATGGGGCA TCCTGTCCGC

2151 CGTCAACGGC AACGAAAGCG ATACGCGCAA CCGCCTGCTG GCGCAGTTTG

2201 CCGACAAGTT TTCAGACGAC GCGCTGGTGA TGGACAAATA TTTCGCCCTC

2251 GTCGGCTCAA GCCGCCGCAG CGACACCCTG CAACAGGTTC AAACCGCCTT

2301 GCAGCATCCG AAGTTCAGCC TCGAAAATCC CAACAAAGCC CGCTCGCTCA

2351 TCGGCAGCTT CAGCCGCAAC GTCCCGCATT TCCACGCAGA AGACGGCAGC

2401 GGCTACCGCT TCATCGCCGA CAAAGTCATC GAAATCGACC GCTTTAACCC

2451 GCAGGTCGCC GCCCGCCTGG TGCAGGCGTT CAACCTCTGC AACAAGCTCG

2501 AGCCGCACCG CAAAAACTTG GTGAAACAAG CATTGCAGCG CATTCGGGCG

2551 CAGGAAGGAT TGTCGAAAGA CGTGGGCGAA ATCGTCGGCA AAATTTTGGA

2601 TTGA
```

This corresponds to the amino acid sequence <SEQ ID 2170; ORF 665-1.a>:

```
a665-1.pep

1 MSKTVHYLKD YQTPAYHILK TDLHFDINEP QTIVKSRLTV EPKRVGEPLV

51 LDGSAKLLSV KINGVAADYV LEGETLTIAD VPSERFTVEV ETEILPAENK

101 SLMGLYASAG NLFTQCEPEG FRKITFYIDR PDVMSKFTTT IVADKKRYPV

151 LLSNGNKIDG GEYSDGRHWV KWEDPFAKPS YLFALVAGDL AVTEDYFTTM

201 SGRNVKIEFY TTEADKPKVG FAVESLKNAM KWDETRFGLE YDLDIFMVVA

251 VGDFNMGAME NKGLNIFNTK FVLADSRTAT DTDFEGIESV GHEYFHNWT

301 GNRVTCRDWF QLSLKEGLTV FRDQEFSGDR ASRAVRRIEN IRLLRQHQFP

351 EDAGPTAHPV RPARYEEMNN FYTMTVYEKG AEVPMYHTL LGEEGFQKGM

401 KLYFQRHDGQ AVTCDDFRAA MADANGINLD QFALWYSQAG TPVLDAQGRL

451 KNNVFELTIK QTVPPTPDMA DKQPMMIPVK IGLLNCNGEA VAFDYQGKRA
```

-continued

```
501 TEAVLLLTEA EQTFQFESVT EAVVPSLLRG FSAPVHLNYP YSDDDLLLLL

551 AHDSDAFTRW EAAQTLYRRA VAANLAALSD GVELPKHEKL LAAVEKVISD

601 DLLDNAFKAL LLGVPSEAEL WDGAENIDPL RYHQAREALL DILAVRFLPK

651 WHELNRQAAK QENQSYEYSP EAAGWRTLRN VCRAFVLRAD PAHIETVAEK

701 YAEMAQNMTH EWGILSAVNG NESDTRNRLL AQFADKFSDD ALVMDKYFAL

751 VGSSRRSDTL QQVQTALQHP KFSLENPNKA RSLIGSFSRN VPHFHAEDGS

801 GYRFIADKVI EIDRFNPQVA ARLVQAFNLC NKLEPHRKNL VKQALQRIRA

851 QEGLSKDVGE IVGKILD*
``` a665-1/m665-1 97.2% identity in 867 aa overlap

```
                    10         20         30         40         50         60
a665-1.pep  MSKTVHYLKDYQTPAYHILKTDLHFDINEPQTIVKSRLTVEPKRVGEPLVLDGSAKLLSV
            ||||||||||||||||||||||||||||||||| |||||||||:||||||||||||||||
m665-1      MSKTVHYLKDYQTPAYHILKTDLHFDINEPQTVVKSRLTVEPQRVGEPLVLDGSAKLLSV
                    10         20         30         40         50         60

70         80         90        100        110        120
a665-1.pep  KINGVAADYVLEGETLTIADVPSERFTVEVETEILPAENKSLMGLYASAGNLFTQCEPEG
            ||||:|||||||||||||||:|||||||||||||||||||||||||||||:|||||||||
m665-1      KINGAAADYVLEGETLTIAGVPSERFTVEVETEILPAENKSLMGLYASGGNLFTQCEPEG
                    70         80         90        100        110        120

130        140        150        160        170        180
a665-1.pep  FRKITFYIDRPDVMSKFTTTIVADKKRYPVLLSNGNKIDGGEYSDGRHWVKWEDPFAKPS
            ||||||||||||||||||||||||||||||||||||||||||:|||||||||||||:|||
m665-1      FRKITFYIDRPDVMSKFTTTIVADKKRYPVLLSNGNKIDGGEFSDGRHWVKWEDPFSKPS
                   130        140        150        160        170        180

190        200        210        220        230        240
a665-1.pep  YLFALVAGDLAVTEDYFTTMSGRNVKIEFYTTEADKPKVGFAVESLKNAMKWDETRFGLE
            ||||||||||||||||||||||||||||||||||||||||||||||||||||||||||||
m665-1      YLFALVAGDLAVTEDYFTTMSGRNVKIEFYTTEADKPKVGFAVESLKNAMKWDETRFGLE
                   190        200        210        220        230        240

250        260        270        280        290        300
a665-1.pep  YDLDIFMVVAVGDFNMGAMENKGLNIFNTKFVLADSRTATDTDFEGIESVVGHEYFHNWT
            ||||||||||||||||||||||||||||||||||||||||||||||||||||||||||||
m665-1      YDLDIFMVVAVGDFNMGAMENKGLNIFNTKFVLADSRTATDTDFEGIESVVGHEYFHNWT
                   250        260        270        280        290        300

310        320        330        340        350        360
a665-1.pep  GNRVTCRDWFQLSLKEGLTVFRDQEFSGDRASRAVRRIENIRLLRQHQFPEDAGPTAHPV
            ||||||||||||||||||||||||||||||||||||||||||||||||||||||||||||
m665-1      GNRVTCRDWFQLSLKEGLTVFRDQEFSGDRASRAVRRIENIRLLRQHQFPEDAGPTAHPV
                   310        320        330        340        350        360

370        380        390        400        410        420
a665-1.pep  RPARYEEMNNFYTMTVYEKGAEVVRMYHTLLGEEGFQKGMKLYFQRHDGQAVTCDDFRAA
            ||| ||||||||||||||||||||||||||||||||||||||||||||||||||||||||
m665-1      RPASYEEMNNFYTMTVYEKGAEVVRMYHTLLGEEGFQKGMKLYFQRHDGQAVTCDDFRAA
                   370        380        390        400        410        420

430        440        450        460        470        480
a665-1.pep  MVDANGINLDQFALWYSQAGTPVLDAQGRLKNNVFELTIKQTVPPTPDMADKQPMMIPVK
            |:||||||||||||||||||||||:|:||||||:||||:|||||||||:|||||||||||
m665-1      MADANGINLDQFALWYSQAGTPVLEAEGRLKNNIFELTVKQTVPPTPDTDKQPMMIPVK
                   430        440        450        460        470        480

490        500        510        520        530        540
a665-1.pep  IGLLNCNGEAVAFDYQGKRATEAVLLLTEAEQTFQFESVTEAVVPSLLRGFSAPVHLNYP
            :||||  |||||||||||||||||||||||||| :|:||||||||||||||||||||||
m665-1      VGLLNRNGEAVAFDYQGKRATEAVLLLTEAEQTFLLEGVTEAVVPSLLRGFSAPVHLNYP
                   490        500        510        520        530        540

550        560        570        580        590        600
a665-1.pep  YSDDDLLLLLAHDSDAFTRWEAAQTLYRRAVAANLAALSDGVELPKHEKLLAAVEKVISD
            ||||||||||||||||||||||||||||||||||||:||||||||||||||||||||||
m665-1      YSDDDLLLLLAHDSDAFTRWEAAQTLYRRAVAANLATLSDGVELPKHEKLLAAVEKVISD
                   550        560        570        580        590        600

610        620        630        640        650        660
a665-1.pep  DLLDNAFKALLLGVPSEAELWDGAENIDPLRYHQAREALLDILAVRFLPKWHELNRQAAK
            ||||||||||||||||||||||||||||||||||||||| |||:||||||||||||||||
m665-1      DLLDNAFKALLLGVPSEAELWDGAENIDPLRYHQAREALLDTLAVHFLPKWHELNRQAAK
                   610        620        630        640        650        660

670        680        690        700        710        720
a665-1.pep  QENQSYEYSPEAAGWRTLRNVCRAFVLRADPAHIETVAEKYAEMAQNMTHEWGILSAVNG
            ||||||||||||||||||||||||||||||||||||||||:|||||||||||||||||||
m665-1      QENQSYEYSPEAAGWRTLRNVCRAFVLRADPAHIETVAEKYGEMAQNMTHEWGILSAVNG
                   670        680        690        700        710        720
```

-continued

```
                  730        740        750        760        770        780
a665-1.pep NESDTRNRLLAQFADKFSDDALVMDKYFALVGSSRRSDTLQQVQTALQHPKFSLENPNKA
           ||||||||||||||||||||||||||||||||||||||||:|||||||||||||||||||
m665-1     NESDTRNRLLAQFADKFSDDALVMDKYFALVGSSRRSDTLQQVRTALQHPKFSLENPNKA
                  730        740        750        760        770        780

790        800        810        820        830        840
a665-1.pep RSLIGSFSRNVPHFHAEDGSGYRFIADKVIEIDRFNPQVAARLVQAFNLCNKLEPHRKNL
           ||||||||||||||||||||||||||||||||||||||||||||||||||||||||||||
m665-1     RSLIGSFSRNVPHFHAEDGSGYRFIADKVIEIDRFNPQVAARLVQAFNLCNKLEPHRKNL
                  790        800        810        820        830        840

850        860
a665-1.pep VKQALQRIRAQEGLSKDVGEIVGKILDX
           ||||||||||||||||||||||||||||
m665-1     VKQALQRIRAQEGLSKDVGEIVGKILDX
                  850        860
```

The following partial DNA sequence was identified in *N. gonorrhoeae* <SEQ ID 2171>:

```
g666.seq
   1 ATGCTTTGTA TGAATTATCA ATCAAACTCA GGCGAAGGAG TGCTTGTAGC

51 TAAAACATAT TTATTGACTG CATTGATAAT GTCTATGGTA ATCTCCGGAT

101 GTCAAGTCAT CCATGCCAAT CAAGGTAAGG TTAATACTAA TTCTGCTGTC

151 ATCGCAGGTG CAGACGCTCA CACGCCTGAA CATGTAACGG GACTGACCGA

201 ACAAAAGCAG GTGATTGCAA GTGATTTTAT AGTAGCGTCA GCCAATCCAT

251 TAGCAACACA AGCTGGCTAT GATATCTTAA AGCAAGGCGG TAGCGCTGCA

301 GATGCGATGG TGGCGGTGCA GACGACACTA AGCTTGGTAG AGCCACAGTC

351 GTCAGGCTTG GGCGGTGGTG CATTTGTGTT GTATTGGGAC AATACCGCCA

401 AAACATTGAC CACATTTGAT GGGCGTGAGA CGGCACCGAT GCGTGCGACG

451 CCAGAATTAT TTTTGGATAA AGATGGTTAA CCATTGAAAT TTATGGAAGC

501 GGTGGTCGCT CGGTAGGTAC GCCTGCTATC CCTAAACTGA
```

This corresponds to the amino acid sequence <SEQ ID 2172; ORF 666.ng>:

```
g666.pep
   1 MLCMNYQSNS GEGVLVAKTY LLTALIMSMV ISGCQVIHAN QGKVNTNSAV

51 IAGADAHTPE HVTGLTEQKQ VIASDFIVAS ANPLATQAGY DILKQGGSAA

101 DAMVAVQTTL SLVEPQSSGL GGGAFVLYWD NTAKTLTTFD GRETAPMRAT

151 PELFLDKDGX PLKFMEAVVA RXVRLLSLN*
```

The following partial DNA sequence was identified in *N. meningitidis* <SEQ ID 2173>:

```
m666.seq
   1 ATGCCTTGTA TGAATCATCA ATCAAACTCA GGCGAAGGAG TGCTTGTGGC

51 TAAAACATAT TTATTGACTG CATTGATAAT GTCTATGACA ATCTCTGGAT

101 GTCAAGTCAT CCATGCCAAT CAAGGTAAGG TTAATACTCA TTCTGCTGTC

151 ATCACAGGTG CAGACGCTCA CACGCCTGAA CATGCAACGG GACTGACCGA

201 ACAAAAGCAG GTGATTGCAA GTGATTTTAT GGTAGCGTCA GCCAATCCAT

251 TAGCAACACA AGCTGGCTAT GATATCTTAA AGCAAGGCGG TAGCGCTGCA

301 GATGCGATGG TGGCGGTGCA GACGACACTA AGCTTGGTAG AGCCACAGTC

351 GTCAGGCTTG GGCGGTGGTG CATTTGTGTT GTATTGGGAT AATACCGCCA
```

```
401 AAACATTGAC CACATTTGAT GGGCGTGAGA CGGCACCGAT GCGTGCGACG

451 CCGGAATTAT TTTTGGATAA AGATGGTCAA CCATTGAAAT TTATGGAAGC

501 GGTGGTCGTG GTCGCTCGGT GGGTACGCCT GCTATCCCTA AACTGA
```

This corresponds to the amino acid sequence <SEQ ID 2174; ORF 666>:

```
m666.pep
   1 MPCMNHQSNS GEGVLVAKTY LLTALIMSMT ISGCQVIHAN QGKVNTHSAV

51 ITGADAHTPE HATGLTEQKQ VIASDFMVAS ANPLATQAGY DILKQGGSAA

101 DAMVAVQTTL SLVEPQSSGL GGGAFVLYWD NTAKTLTTFD GRETAPMRAT

151 PELFLDKDGQ PLKFMEAVVV VARWVRLLSL N*
```

Computer analysis of this amino acid sequence gave the following results:
Homology with a Predicted ORF from *N. gonorrhoeae*

```
    m666/g666 93.9% identity in 181 aa overlap 10        20        30        40        50        60
   m666.pep MPCMNHQSNSGEGVLVAKTYLLTALIMSMTISGCQVIHANQGKVNTHSAVITGADAHTPE
            | |||:||||||||||||||||||||||||:||||||||||||||:||||:||||||||
   g666     MLCMNYQSNSGEGVLVAKTYLLTALIMSMVISGCQVIHANQGKVNTNSAVIAGADAHTPE
                 10        20        30        40        50        60

70        80        90       100       110       120
   m666.pep HATGLTEQKQVIASDFMVASANPLATQAGYDILKQGGSAADAMVAVQTTLSLVEPQSSGL
            |:|||||||||||||||:||||||||||||||||||||||||||||||||||||||||||
   g666     HVTGLTEQKQVIASDFIVASANPLATQAGYDILKQGGSAADAMVAVQTTLSLVEPQSSGL
                 70        80        90       100       110       120

130       140       150       160       170       180
   m666.pep GGGAFVLYWDNTAKTLTTFDGRETAPMRATPELFLDKDGQPLKFMEAVVVVARWVRLLSL
            |||||||||||||||||||||||||||||||||||||||| |||||||||  || |||||
   g666     GGGAFVLYWDNTAKTLTTFDGRETAPMRATPELFLDKDGXPLKFMEAVV--ARXVRLLSL
                130       140       150       160       170 m666.pep NX
            ||
   g666     NX
            180
```

The following partial DNA sequence was identified in *N. meningitidis* <SEQ ID 2175>:

```
a666.seq
   1 ATGCCTTGTA TGAATCATCA ATCAAACTCA GGCGAAGGAG TGCTTGTGGC

51 TAAAACATAT TTATTGACTG CATTGATAAT GTCTATGACA ATCTCTGGAT

101 GTCAAGTCAT CCATGCCAAT CAAGGTAAGG TTAATACTCA TTCTGCTGTC

151 ATCACAGGTG CAGACGCTCA CACGCCTGAA CATGCAACGG GACTGACCGA

201 ACAAAAGCAG GTGATTGCAA GTGATTTTAT GGTAGCGTCA GCCAATCCAT

251 TAGCAACACA AGCTGGCTAT GATATCTTAA AGCAAGGCGG TAGCGCTGCA

301 GATGCGATGG TGGCGGTGCA GACGACACTA AGCTTGGTAG AGCCACAGTC

351 GTCAGGCTTG GGCGGTGGTG CATTTGTGTT GTATTGGGAT AATACCGCCA

401 AAACATTGAC CACATTTGAT GGGCGTGAGA CGGCACCGAT GCGTGCGACG

451 CCGGAATTAT TTTTGGATAA AGATGGTCAA CCATTGAAAT TTATGGAAGC

501 GGTGGTCGTG GTCGCTCGGT GGGTACGCCT GCTATCCCTA AACTGA
```

This corresponds to the amino acid sequence <SEQ ID 2176; ORF 666.a>:

```
a666.pep

1  MPCMNHQSNS GEGVLVAKTY LLTALIMSMT ISGCQVIHAN QGKVNTHSAV

51  ITGADAHTPE HATGLTEQKQ VIASDFMVAS ANPLATQAGY DILKQGGSAA

101  DAMVAVQTTL SLVEPQSSGL GGGAFVLYWD NTAKTLTTFD GRETAPMRAT

151  PELFLDKDGQ PLKFMEAVVV VARWVRLLSL N* m666/a666   100.0% identity in 181 aa overlap
                    10         20         30         40         50         60
    m666.pep  MPCMNHQSNSGEGVLVAKTYLLTALIMSMTISGCQVIHANQGKVNTHSAVITGADAHTPE
              ||||||||||||||||||||||||||||||||||||||||||||||||||||||||||||
       a666   MPCMNHQSNSGEGVLVAKTYLLTALIMSMTISGCQVIHANQGKVNTHSAVITGADAHTPE
                    10         20                   40         50         60
                    70         80         90        100        110        120
    m666.pep  HATGLTEQKQVIASDFMVASANPLATQAGYDILKQGGSAADAMVAVQTTLSLVEPQSSGL
              ||||||||||||||||||||||||||||||||||||||||||||||||||||||||||||
       a666   HATGLTEQKQVIASDFMVASANPLATQAGYDILKQGGSAADAMVAVQTTLSLVEPQSSGL
                    70         80         90        100        110        120
                   130        140        150        160        170        180
    m666.pep  GGGAFVLYWDNTAKTLTTFDGRETAPMRATPELFLDKDGQPLKFMEAVVVVARWVRLLSL
              ||||||||||||||||||||||||||||||||||||||||||||||||||||||||||||
       a666   GGGAFVLYWDNTAKTLTTFDGRETAPMRATPELFLDKDGQPLKFMEAVVVVARWVRLLSL
                   130        140        150        160        170        180 m666.pep  NX
              ||
       a666   NX
```

The following partial DNA sequence was identified in *N. gonorrhoeae* <SEQ ID 2177>:

```
g667.seq
   1 atgcggtttg tcttctgttt gggcgGAGAG ATAGtttctg atccgtgtga 51 tttccAtttg gtattcgtcc gcgtcgaatc tgccgctgAc CAGAcagaaa 101 cgCAGataca tCaaatacgt attcacggca tcggtttcgc aatAAttgcg 151 GAtttccttc agcgtgcccg cgtgGAacgc ttcccacact ttgctgccgt 201 ccataCCCAg ctTGCCCGGA AAGCCGCACA GTTTcgcCat atcgtccagC 251 GGCACATTcg ccctcggctG GTAAAGCGCG AGCAAATCCA TCAAATCGCA 301 GTGGCGTTGG TGATAACGGC TGATGTAGTT GTTCCActtg AAATCGCGGC 351 tgtcgccgAA ATCGccgTCG CCCGTATCCC AATAGCGCGC GGCGTTGATG

401 CCGTATATCA GGGAGCGGTA ATGCAGTACG GCAGGTCGA AACCGCCGCC

451 GTTCCAGCTG ACCAGTTGCG GCGTATGTTT TTCAACCAAT TCGAAAAACT

501 TGGCAATCAC GACTTCTTCG CCATCGTCCA TCTCGCCGAT GGTGCCGACA

551 TGAACCTTGT CCTGCCCCCA GCGCATACAG CAGGAAACCG CCACAACCTG

601 ATGGAGGTGG TGCTGCATAA AATCGCCGCC GGTCTGTGCG CGGCGTTTCT

651 GCTGCGCGAA CAGCACCACT TCGTCATCCG GCAGGGAAGA CGGCAAGTCA

701 TACAACGTAC GGATACCCTG CACATCGGGT ACGGTTTCAA TATCGAAAGC

751 CAAAATCGTA TTCATGGCAg tACCTTGCAT tcaAAAACAG ACtTGCGCCT

801 ATTgTgtcaT TAA
```

This corresponds to the amino acid sequence <SEQ ID 2178; ORF 667.ng>:

```
g667.pep
    1 MRFVFCLGGE IVSDPCDFHL VFVRVESAAD QTETQIHQIR IHGIGFAIIA

51 DFLQRARVER FPHFAAVHTQ LARKAAQFRH IVQRHIRPRL VKREQIHQIA

101 VALVITADVV VPLEIAAVAE IAVARIPIAR GVDAVYQGAV MQYGQVETAA

151 VPADQLRRMF FNQFEKLGNH DFFAIVHLAD GADMNLVLPP AHTAGNRHNL

201 MEVVLHKIAA GLCAAFLLRE QHHFVIRQGR RQVIQRTDTL HIGYGFNIES

251 QNRIHGSTLH SKTDLRLLCH *
```

The following partial DNA sequence was identified in *N. meningitidis* <SEQ ID 2179>:

```
m667.seq (PARTIAL)
    1 ATGCGGCTTT TCCCCGGCTT GTGCGGACAG GTAATTCCGC ATCCGTTTGA

51 TTTCCATTTC GTATTCGTCC GCATCCAGCC TGCCGCTGAC CAGACAGAAA

101 CGCAGGTACA TCAGATAAGT GTTTGCCGCG TCGGTTTCGC AATAATTGCG

151 GATTTCCTTC AGCCTGCCCG TATGGAATGC CTCCCAAACC TTGCTGCCGT

201 CCATACCCAG CTTGCCCGGA AAACCGCACA GTTTCGCCAT ATCGTCCAGC

251 GGCACGTTTG CCCTCGGCTG GTAAAGCGCG AGCAAATCCA TCAAATCGCA

301 GTGGCGTTGG TGATAACGGC TGATGTAGTT GTTCCACTTG AAATCGCGGC

351 TGTCGCCGAA ATCGCCGTCG CCCATATCCC AATAGCGCGC GGCGTTGATG

401 CCGTATATCA GGGAGCGGTA ATGCAGTACG GCAGATCGA AACCGCCGCC

451 GTTCCAACTG ACCAGTTGCG GCGTATGTTT TCAATCAAT TCGAAAAATT

501 TAGCAATGAC CACTTCCTCG CCGTCATCCA TCTCGCCGAT GGTGCCGACA

551 TGTACTTTAT CCTGCCCCCA ACGCATGCAG CACGAAATCG CCACAACCTG

601 ATGAAGATGA TGCTGCATAA AATCGCCGCC CGTCTGAGCA CGGCGTTTGT

651 GCTGGGCAAT CAGCACCACT TG...
```

This corresponds to the amino acid sequence <SEQ ID 2180; ORF 667>:

```
m667.pep (partial)
    1 MRLFPGLCGQ VIPHPFDFHF VFVRIQPAAD QTETQVHQIS VCRVGFAIIA

51 DFLQPARMEC LPNLAAVHTQ LARKTAQFRH IVQRHVCPRL VKREQIHQIA

101 VALVITADVV VPLEIAAVAE IAVAHIPIAR GVDAVYQGAV MQYGQIETAA

151 VPTDQLRRMF FNQFEKFSND HFLAVIHLAD GADMYFILPP THAARNRHNL

201 MKMMLHKIAA RLSTAFVLGN QHHL...
```

Computer analysis of this amino acid sequence gave the following results:
Homology with a Predicted ORF from *N. gonorrhoeae*

```
   m667/g667  75.0% identity in 224 aa overlap 10        20        30        40        50        60
       m667.pep MRLFPGLCGQVIPHPFDFHFVFVRIQPAADQTETQVHQISVCRVGFAIIADFLQPARMEC
                ||:   |  |:::  |  ||||:||||::  ||||||||:|||   :  |||||||||| ||:|
       g667    MRFVFCLGGEIVSDPCDFHLVFVRVESAADQTETQIHQIRIHGIGFAIIADFLQRARVER
                   10        20        30        40        50        60
```

```
              70        80        90       100       110       120
m667.pep  LPNLAAVHTQLARKTAQFRHIVQRHVCPRLVKREQIHQIAVALVITADVVVPLEIAAVAE
          :|::||||||||||:|||||||||: ||||||||||||||||||||||||||||||||
g667      FPHFAAVHTQLARKAAQFRHIVQRHIRPRLVKREQIHQIAVALVITADVVVPLEIAAVAE
              70        80        90       100       110       120

130       140       150       160       170       180
m667.pep  IAVAHIPIARGVDAVYQGAVMQYGQIETAAVPTDQLRRMFFNQFEKFSNDHFLAVIHLAD
          ||||:|||||||||||||||||||:|||||:|||||||||||||::|  |:|::||||
g667      IAVARIPIARGVDAVYQGAVMQYGQVETAAVPADQLRRMFFNQFEKLGNHDFFAIVHLAD
             130       140       150       160       170       180

190       200       210       220
m667.pep  GADMYFILPPTHAARNRHNLMKMMLHKIAARLSTAFVLGNQHHL
          ||||  ::|||:|:| ||||||:::|||||| | :||:| :|||:
g667      GADMNLVLPPAHTAGNRHNLMEVVLHKIAAGLCAAFLLREQHHFVIRQGRRQVIQRTDTL
             190       200       210       220       230       240 g667      HIGYGFNIESQNRIHGSTLHSKTDLRLLCHX
             250       260       270
```

The following partial DNA sequence was identified in *N. meningitidis* <SEQ ID 2181>:

```
a667.seq
  1 ATGCGGTTTG TCTTCTGTTT GGGCGGAGAG ATAGTTTCTG ATCCGCTTGA

51 TTTCCATTTC GTATTCGTCT GCGTCGAATC TGCCGCTGAC CAGACAGAAA

101 CGCAGATACA TCAGATAGGT ATTTACCGCA TCGGTTTCGC AATAATTGCG

151 GATTTCCTTC AGCCTGCCCG CGTGGAACGC CTCCCACACC TTGCTGCCGT

201 CCATACCCAG CTTGCCCGGA AAACCGCACA GTTTCGCCAT ATCGTCCAAC

251 GGCACATTCG CCCTCGGCTG GTAAAGCGCG AGCAAATCCA TCAAATCGCA

301 ATGACGTTGG TGGTAGCGGC TGATGTAGTT GTTCCACTTG AAATCGCGGC

351 TGTCGCCGAA ATCGCCGTCG CCCATATCCC AATAGCGCGC GGCGTTGATG

401 CCGTGTAGCA GCGAACGGTA ATGCAGAACC GGCAGGTCGA AACCGCCGCC

451 GTTCCAACTG ACCAGTTGCG GCGTATGTTT TTCAATCAAC TCGAAAAATT

501 TGGCGATAAC CACTTCCTCG CCGTCATCCA TCTCGCCGAT TGTACCGACA

551 TGGACTTTAT CCTGCCCCCA ACGCATGCAG CACGAAATCG CCACAATCTG

601 ATGAAGATGA TGCTGCATAA AATCCCCACC CGTCTGAGCA CGGCGTTTTT

651 GCTGGGCAAA CAGCACCACT TCATCGTCGG GCAGCGAGGA CGGCAAGTCA

701 TACAGCGTAC GGATACACTG CACATCGGGT ACGGTTTCAA TATCGAAAGC

751 CAAAATCGTG GTCATGACAG CACCTTGTAT TTAAAA.CAG ACTTGCGCCT

801 ATTGTGTCAT TAA
```

This corresponds to the amino acid sequence <SEQ ID 2182; ORF 667.a>:

```
a667.pep
     1 MRFVFCLGGE IVSDPLDFHF VFVCVESAAD QTETQIHQIG IYRIGFAIIA

51 DFLQPARVER LPHLAAVHTQ LARKTAQFRH IVQRHIRPRL VKREQIHQIA

101 MTLVVAADVV VPLEIAAVAE IAVAHIPIAR GVDAV*QRTV MQNRQVETAA
          ‾‾‾‾‾‾‾‾‾‾‾‾‾‾‾‾‾‾‾‾
   151 VPTDQLRRMF FNQLEKFGDN HFLAVIHLAD CTDMDFILPP THAARNRHNL

201 MKMMLHKIPT RLSTAFLLGK QHHFIVGQRG RQVIQRTDTL HIGYGFNIES

251 QNRGHDSTLY LKXDLRLLCH * m667/a667 79.0% identity in 224 aa overlap
```

-continued

```
           10         20         30         40         50         60
m667.pep   MRLFPGLCGQVIPHPFDFHFVFVRIQPAADQTETQVHQISVCRVGFAIIADFLQPARMEC
           ||:   |  |:::    |:||||||| ::  ||||||||:|||::  |:||||||||||||:|
a667       MRFVFCLGGEIVSDPLDFHFVFVCVESAADQTETQIHQIGIYRIGFAIIADFLQPARVER
           10         20         30         40         50         60

70         80         90         100        110        120
m667.pep   LPNLAAVHTQLARKTAQFRHIVQRHVCPRLVKREQIHQIAVALVITADVVVPLEIAAVAE
           ||:|||||||||||||||||||||:  |||||||||||||||::||:|||||||||||||
a667       LPHLAAVHTQLARKTAQFRHIVQRHIRPRLVKREQIHQIAMTLVVAADVVVPLEIAAVAE
           70         80         90         100        110        120

130        140        150        160        170        180
m667.pep   IAVAHIPIARGVDAVYQGAVMQYGQIETAAVPTDQLRRMFFNQFEKFSNDHFLAVIHLAD
           |||||||||||||||| |:|||  |:||||||||||||||||||||:|||:|||||||||
a667       IAVAHIPIARGVDAVXQRTVMQNRQVETAAVPTDQLRRMFFNQLEKFGDNHFLAVIHLAD
           130        140        150        160        170        180

190        2000       210        220
m667.pep   GADMYFILPPTHAARNRHNLMKMMLHKIAARLSTAFVLGNQHHL
           :|| ||||||||||||||||||||||| :||||||:||:|||:
a667       CTDMDFILPPTHAARNRHNLMKMMLHKIPTRLSTAFLLGKQHHFIVGQRGRQVIQRTDTL
           190        200        210        220        230        240 a667       HIGYGFNIESQNRGHDSTLYLKXDLRLLCHX
           250        260        270
```

The following partial DNA sequence was identified in *N. gonorrhoeae* <SEQ ID 2183>:

```
g669.seq
   1 ATGCGCCGCA TCGTTAAAAA ACACCAGCCC GTAAACGCGC CACATATCGT

51 TTTGGAAATT CGGATAATGA AACTGCATCG CGCGTTTGTC TTCCTTGGGC

101 GGAAACGTCC CCATCATCAT GACCGCAGCC TTCGGCGGCA ACACGGGATC

151 GAAGGGATGG GTTTCGATTT CAAGCAGATT TTCAGACACG TTCAATCCTC

201 CAACAGGCAA AGCGGCAGAC AGCCGGTTTG CACCAAACCG CCAAACACGG

251 CAAGCCTTCA AACAGCATTA TCACGCCCTG CCGTTTTCGG TTACAATGCC

301 GACATCAAAC GGATACTGTA A
```

This corresponds to the amino acid sequence <SEQ ID 2184; ORF 669.ng>:

```
g669.pep
   1 MRRIVKKHQP VNAPHIVLEI RIMKLHRAFV FLGRKRPHHH DRSLRRQHGI

51 EGMGFDFKQI FRHVQSSNRQ SGRQPVCTKP PNTASLQTAL SRPAVFGYNA

101 DIKRIL*
```

The following partial DNA sequence was identified in *N. meningitidis* <SEQ ID 2185>:

```
m669.seq
   1 ATGCGCCGCA TCATTAAAAA ACACCAGCCC ATAAACGCGC CACATATCGT

51 TTTGGAAATT CGGATAATGA AACTGCATCG CGCGTTTGTC TTCCTTGGGC

101 GGAAACGTCC CCATCATCAT GACAGCAGCC TTCGGCGGCA ACACGGGATC

151 GAAGGGATGG GTTTCGATTT CAAGCAGATT TTCAGACACG TTCAATCCTC

201 CAACAGGCAA AACGGCAGAC AGCCGGTTTG CACCAAACCG CCAAACACGG

251 CAAGCCTTCA AACAGCATTA TCACGCCCTG CCGTTTTCGG TTACAATGCC

301 GACATCAAAC GGATACTGTA A
```

This corresponds to the amino acid sequence <SEQ ID 2186; ORF 669>:

```
m669.pep
   1 MRRIIKKHQP INAPHIVLEI RIMKLHRAFV FLGRKRPHHH DSSLRRQHGI

51 EGMGFDFKQI FRHVQSSNRQ NGRQPVCTKP PNTASLQTAL SRPAVFGYNA

101 DIKRIL*
```

Computer analysis of this amino acid sequence gave the following results:
Homology with a Predicted ORF from *N. gonorrhoeae*

```
    m669/g669  96.2% identity in 106 aa overlap 10        20        30        40        50        60
    m669.pep   MRRIIKKHQPINAPHIVLEIRIMKLGRAFVFLGRKRPHHHDSSLRRQHGIEGMGFDFKQI
               ||||:|||||:|||||||||||||||||||||||||||| ||||||||||||||||||||
    g669       MRRIVKKHQPVNAPHIVLEIRIMKLHRAFVFLGRKRPHHHDRSLRRQHGIEGMGFDFKQI
                  10        20        30        40        50        60
                  70        80        90       100
    m669.pep   FRHVQSSNRQNGRQPVCTKPPNTASLQTALSRPAVFGYNADIKRILX
               ||||||||||:||||||||||||||||||||||||||||||||||||
    g669       FRHVQSSNRQSGRQPVCTKPPNTASLQTALSRPAVFGYNADIKRILX
                  70        80        90       100
```

The following partial DNA sequence was identified in *N. meningitidis* <SEQ ID 2187>:

```
a669.seq
   1 ATGCGCCGCA TCATTAAAAA ACACCAGCCC GTAAACGCGC CACATATCGT

51 TTTGGAAATT CGGATAATGA AACTGCATCG CGCGTTTGTC TTCCTTGGGC

101 GGAAACGTCC CCATCATCAT GACCGCAGCC TTCGGCGGCA ACACGGAATC

151 GAAGGGATGG GTTTCGATTT CAAGCAGATT TTCAGACACG TTCAATCCTC

201 CAACAGGCAA AACGGCAGAC AGCCGGTTTG CACCAAACCG CCAAACACGG

251 CAAGCCTTCA AACAGCATTA TCACGCCCTG CCGTTTTCGG TTACAATGCC

301 GACATCAAAC GGATACTGTA A
```

This corresponds to the amino acid sequence <SEQ ID 2188; ORF 669.a>:

```
    a669.pep

1  MRRIIKKHQP VNAPHIVLEI RIMKLHRAFV FLGRKRPHHH DRSLRRQHGI

51  EGMGFDFKQI FRHVQSSNRQ NGRQPVCTKP PNTASLQTAL SRPAVFGYNA

101  DIKRIL* m669/a669  98.1% identity in 106 aa overlap
                  10        20        30        40        50        60
    m669.pep   MRRIIKKHQPINAPHIVLEIRIMKLHRAFVFLGRKRPHHHDSSLRRQHGIEGMGFDFKQI
               ||||||||||:|||||||||||||||||||||||||||||||  ||||||||||||||||
    a669       MRRIIKKHQPVNAPHIVLEIRIMKLHRAFVFLGRKRPHHHDRSLRRQHGIEGMGFDFKQI
                  10        20        30        40        50        60
                  70        80        90       100
    m669.pep   FRHVQSSNRQNGRQPVCTKPPNTASLQTALSRPAVFGYNADIKRILX
               |||||||||||||||||||||||||||||||||||||||||||||||
    a669       FRHVQSSNRQNGRQPVCTKPPNTASLQTALSRPAVFGYNADIKRILX
                  70        80        90       100
```

The following partial DNA sequence was identified in *N. gonorrhoeae* <SEQ ID 2189>:

```
g670.seq
   1 ATGACTTGTT GCAGGAACTG CTTGGCGCGT TCGTGTTTCG GGTTGGTGAA

51 AAACGCTTCC GGCGTTTCGT CTTCAAGGAT TTGCCCTTTA TCGACGAAAA

101 TCACGCGGTC GGCAACTTCG CGGGCAAACC CCATTTCGTG GGTTACGCAC

151 ATCATCGTCA TGCCGCTTTC CGCCAAGTCT TTCATCACTT TCAACACTTC

201 GCCGACCATT TCGGGTCGA GTGCGGAAGT CGGCTCGTCA AACAGCATCA

251 CGCGCGGCTC CATCGCCAGC CCGCGCGCAA TCGCCACGCG TTGCTGCTGG

301 CCGCCGGAAA GTTGGGAAGG GAAGGCGTCT TTTTTGTGTG CCAGTCCGAC

351 GCGTTCCAAA AGCTCCATTG CCTTTTTCTC CGCCTGTTCC GCATTTTGCC

401 CCTTAACCTT CATCGGTGCG AGGGTGATGT TGTCCAACAC GGTCAGGTGC

451 GGGTAG
```

This corresponds to the amino acid sequence <SEQ ID 2190; ORF 670.ng>:

```
g670.pep
   1 MTCCRNCLAR SCFGLVKNAS GVSSSRICPL STKITRSATS RANPISWVTH

51 IIVMPLSAKS FITFNTSPTI SGSSAEVGSS NSITRGSIAS PRAIATRCCW

101 PPESWEGKAS FLCASPTRSK SSIAFFSACS AFCPLTFIGA RVMLSNTVRC

151 G*
```

The following partial DNA sequence was identified in *N. meningitidis* <SEQ ID 2191>:

```
m670.seq
   1 ATGACCTGTT GCAGGAACTG CTTGGCGCGT TCGTGTTTCG GGTTGGTAAA

51 AAACGCTTCG GGCGTTTCGT CTTCGAGGAT TTGCCCTTTA TCGACGAAAA

101 TCACGCGGTC GGCAACTTCG CGGGCAAACC CCATTTCGTG GGTTACGCAC

151 ATCATCGTCA TGCCGCTTTC TGCCAAGTCT TTCATCACTT TCAACACTTC

201 GCCGACCATT TCGGGGTCGA GTGCGGAGGT CGGTTCGTCA AACAACATTA

251 CGCGCGGTTC CATCGCCAAA CCGCGTGCAA TCGCCACGCG TTGCTGCTGG

301 CCGCCGGAAA GTTGGGAAGG GAAGGCGTCT TTTTTGTGTG CCAGTCCGAC

351 GCGTTCCAAA AGCTCCATTG CCTTTTTCTC CGCCTGTTCC GCATTTTGCC

401 CCTTAACCTT CATCGGTGCG AGGGTAATGT TTTCCAACAC GGTCAGGTGC

451 GGGTAG
```

This corresponds to the amino acid sequence <SEQ ID 2192; ORF 670>:

```
m670.pep
   1 MTCCRNCLAR SCFGLVKNAS GVSSSRICPL STKITRSATS RANPISWVTH

51 IIVMPLSAKS FITFNTSPTI SGSSAEVGSS NNITRGSIAK PRAIATRCCW

101 PPESWEGKAS FLCASPTRSK SSIAFFSACS AFCPLTFIGA RVMFSNTVRC

151 G*
```

Computer analysis of this amino acid sequence gave the following results:
Homology with a Predicted ORF from *N. gonorrhoeae*

```
m670/g670  98.0% identity in 151 aa overlap
                   10        20        30        40        50        60
m670.pep   MTCCRNCLARSCFGLVKNASGVSSSRICPLSTKITRSATSRANPISWVTHIIVMPLSAKS
           ||||||||||||||||||||||||||||||||||||||||||||||||||||||||||||
g670       MTCCRNCLARSCFGLVKNASGVSSSRICPLSTKITRSATSRANPISWVTHIIVMPLSAKS
                   10        20        30        40        50        60

70        80        90       100       110       120
m670.pep   FITFNTSPTISGSSAEVGSSNNITRGSIAKPRAIATRCCWPPESEWGKASFLCASPTRSK
           |
g670       FITFNTSPTISGSSAEVGSSNSITRGSIASPRAIATRCCWPPESWEGKASFLCASPTRSK
                   70        80        90       100       110       120

130       140       150
m670.pep   SSIAFFSACSAFCPLTFIGARVMFSNTVRCGX
           |
g670       SSIAFFSACSAFCPLTFIGARVMLSNTVRCGX
                  130       140       150
```

The following partial DNA sequence was identified in *N. meningitidis* <SEQ ID 2193>:

```
a670.seq
   1 ATGACCTGTT GCAGGAACTG CTTGGCGCGT TCGTGTTTCG GGTTGGTAAA

51 AAACGCTTCC GGCGTTTCGT CTTCGAGGAT TTGCCCTTTA TCGACGAAAA

101 TCACGCGGTC GGCAACTTCG CGGGCAAACC CCATTTCGTG GGTTACGCAC

151 ATCATGGTCA TACCGCTTTC CGCCAAGTCT TTCATCACTT TCAACACTTC

201 GCCGACCATT TCGGGGTCGA GTGCGGAGGT CGGTTCGTCA AACAACATTA

251 CGCGCGGTTC CATCGCCAAA CCGCGTGCAA TCGCCACGCG TTGCTGCTGG

301 CCGCCGGAAA GTTGGGAAGG GAAGGCGTCT TTTTTGTGTG CCAGTCCGAC

351 GCGTTCCAAA AGTTCCATCG CTTTTTTCTC TGCCTGTTCC GCATTTTGAC

401 CTTTAACCTT CATCGGTGCG AGGGTAATGT TTTCCAACAC GGTCAGGTGC

451 GGGTAG
```

This corresponds to the amino acid sequence <SEQ ID 2194; ORF 670.a>:

```
a670.pep

1  MTCCRNCLAR SCFGLVKNAS GVSSSRICPL STKITRSATS RANPISWVTH

51  IMVIPLSAKS FITFNTSPTI SGSSAEVGSS NNITRGSIAK PRAIATRCCW

101  PPESWEGKAS FLCASPTRSK SSIAFFSACS AF*PLTFIGA RVMFSNTVRC

151  G*
```

(In the line beginning 101, "IAFFSACS AF*PLTFIG" is underlined.)

```
m670/a670  98.0% identity in 151 aa overlap
                   10        20        30        40        50        60
m670.pep   MTCCRNCLARSCFGLVKNASGVSSSRICPLSTKITRSATSRANPISWVTHIIVMPLSAKS
           |||||||||||||||||||||||||||||||||||||||||||||||||||:|:||||||
a670       MTCCRNCLARSCFGLVKNASGVSSSRICPLSTKITRSATSRANPISWVTHIMVIPLSAKS
                   10        20        30        40        50        60

70        80        90       100       110       120
m670.pep   FITFNTSPTISGSSAEVGSSNNITRGSIAKPRAIATRCCWPPESWEGKASFLCASPTRSK
           ||||||||||||||||||||||||||||||||||||||||||||||||||||||||||||
a670       FITFNTSPTISGSSAEVGSSNNITRGSIAKPRAIATRCCWPPESWEGKASFLCASPTRSK
                   70        80        90       100       110       120
```

```
                      -continued
                 130        140       150
   m670.pep   SSIAFFSACSAFCPLTFIGARVMFSNTVRCGX
              |||||||||||| |||||||||||||||||||
   a670       SSIAFFSACSAFXPLTFIGARVMFSNTVRCGX
                 130        140       150
```

The following partial DNA sequence was identified in *N. gonorrhoeae* <SEQ ID 2195>:

```
g671.seq
   1 ATGATCAGCA GGGTAACAAT CAAAACGCCT TCAATGCAC CGAATACACC

51 GCCCAAAATG CGGTTGGCAA AGCCCAGACC GACCGCCGAA ACTGCGCCGG

101 TCAGCAGCGA ACGGAGCATT TTCTGGATCA GACAGGCAAT GACGAACAGG

151 GAAATGAATG ACAGagccaa TGCAAACAgg cggggTTGGA ACGaggCAAA

201 GGCGAGGTcg gcgaaggGTG CGGCaaAGAG TTTggcaaAA AAGAaggAAA 251 ccaccCATGC cACCATCgaa ccTGCTTCCG CAATCACGCC GCGCATCGTG 301 GAAATGACGA TGCAGGCGGC GATGACGGcg gAGGCGAGGA GGTCGGCAAT

351 GGGGAGGCTA TTCATTCGTT ACCTGGCCGG CGATGCCGTG CACGCGCAGT

401 TTGTTCAAAT CGCGTTCGGC ATCCCTTGCG TTTTTATAGT TGCTTGA
```

This corresponds to the amino acid sequence <SEQ ID 2196; ORF 671.ng>:

```
g671.pep
   1 MISRVTIKTP FNAPNTPPKM RLAKPRPTAE TAPVSSERSI FWIRQAMTNR

51 EMNDRANANR RGWNEAKARS AKGAAKSLAK KKETTHATIE PASAITPRIV

101 EMTMQAAMTA EARRSAMGRL FIRYLAGDAV HAQFVQIAFG IPCVFIVA*
```

The following partial DNA sequence was identified in *N. meningitidis* <SEQ ID 2197>:

```
m671.seq
   1 ATGACCAGCA GGGTAACAAT CAAAACGCCT TCAATGCAC CGAATACGCC

51 GCCCAAAATG CGGTTGGCAA AGCCCAAACC GACCGCCGAA ACTGCGCTGG

101 TCAGCAGCGA ACGGAGCATT TTCTGGATCA GACAGGCAAT GACGAACAGG

151 GAAATGAACG ACAGAGCCAA TGCAAACAGG CGGGGTTGGA ACGAGGCAAA

201 GGCGAGGTCG GCGAAGGAGG CGGCAAAGAG TTTGGCGAAA AGAAGGAAA

251 CCACCCATGC CGCCATTGAG CCTGCCTCCG CAATCACGCC GCGCATCGCG

301 GATAGCACGA TGCAGGCGGC GATGACGGCG GAGACGAGGA GGTCGGCAAT

351 GGGGAGGCTA TTCATTCGTT ACCTGACCGG CGATACCGTG TACGCGCAAT

401 TTGTTCAAAT CGCGTTCGGC ATCCCTTGCG TTTTTATAGT TGCTTGA
```

This corresponds to the amino acid sequence <SEQ ID 2198; ORF 671>:

```
m671.pep
   1 MTSRVTIKTP FNAPNTPPKM RLAKPKPTAE TALVSSERSI FWIRQAMTNR

51 EMNDRANANR RGWNEAKARS AKEAAKSLAK KKETTHAAIE PASAITPRIA

101 DSTMQAAMTA ETRRSAMGRL FIRYLTGDTV YAQFVQIAFG IPCVFIVA*
```

Computer analysis of this amino acid sequence gave the following results:
Homology with a Predicted ORF from N. gonorrhoeae

```
m671/g671  91.9% identity in 148 aa overlap
                   10        20        30        40        50        60
   m671.pep   MTSRVTIKTPFNAPNTPPKMRLAKPKPTAETALVSSERSIFWIRQAMTNREMNDRANANR
              | ||||||||||||||||||||||:||||| ||||||||||||||||||||||||||||
   g671       MISRVTIKTPFNAPNTPPKMRLAKPRPTAETAPVSSERSIFWIRQAMTNREMNDRANANR
                   10        20        30        40        50        60

70        80        90       100       110       120
   m671.pep   RGWNEAKARSAKEAAKSLAKKKETTHAAIEPASAITPRIADSTMQAAMTAETRRSAMGRL
              |||||||||||| |||||||||||||||:|||||||||||::||||||||:||||||||
   g671       RGWNEAKARSAKGAAKSLAKKKETTHATIEPASAITPRIVEMTMQAAMTAEARRSAMGRL
                   70        80        90       100       110       120

130       140      149
   m671.pep   FIRYLTGDTVYAQFVQIAFGIPCVFIVAX
              |||||:||:|:||||||||||||||||||
   g671       FIRYLAGDAVHAQFVQIAFGIPCVFIVAX
                  130       140
```

The following partial DNA sequence was identified in N. meningitidis <SEQ ID 2199>:

```
a671.seq
  1 ATGACCAGCA GGGTAATAAT CAAAATGCCT TCAATGCAC CGAATACGCC

51 GCCCAAAATG CGGTTGGCAA AGCCCAAACC GACCGCCGAA ACTGCCCCGG

101 TCAGCAGCGA GCGGAGTATT TTCTGGATCA GACAGGCAAT GACGAATAGG

151 GAAATGAACG ACAGAGCCAA TGCAAACAGG CGGGGTTGGA ACGATGCAAA

201 GGCGATGTCG GCGAAGGGTG CGGCAAAGAG TTTGGCGAAA AAAAAGGCAA

251 CCACCCATGC CGCCATTGAG CCAGCCTCCG CAATCACGCC GCGCATCGCG

301 GATAGCACGA TGCAGGCGGC GATGATGGCG GAGACGAGGA GGTCGGCAAC

351 GGGGAGGTTA TTCATTCGTT ACCTGACCGG CGATACCGTG TACGCGCAAT

401 TTGTTCAAAT CGCGTTCGGC ATCCCTTGCG TTTTTATAGT TGCTTGA
```

This corresponds to the amino acid sequence <SEQ ID 2200; ORF 671.a>:

```
a671.pep
        1 MTSRVIIKMP FNAPNTPPKM RLAKPKPTAE TAPVSSERSI FWIRQAMTNR

51 EMNDRANANR RGWNDAKAMS AKGAAKSLAK KKATTHAAIE PASAITPRIA

101 DSTMQAAMMA ETRRSATGRL FIRYLTGDTV YAQFVQIAFG IPCVFIVA* m671/a671  93.9% identity in 148 aa overlap 10        20        30        40        50        60
   m671.pep   MTSRVTIKTPFNAPNTPPKMRLAKPKPTAETALVSSERSIFWIRQAMTNREMNDRANANR
              ||||| || ||||||||||||||||||||||| ||||||||||||||||||||||||||
   a671       MTSRVIIKMPFNAPNTPPKMRLAKPKPTAETAPVSSERSIFWIRQAMTNREMNDRANANR
                   10        20        30        40        50        60

70        80        90       100       110       120
   m671.pep   RGWNEAKARSAKEAAKSLAKKKETTHAAIEPASAITPRIADSTMQAAMTAETRRSAMGRL
              ||||:||| ||| |||||||||||:||||||||||||||||||||||| ||||||| ||
   a671       RGWNDAKAMSAKGAAKSLAKKKATTHAAIEPASAITPRIADSTMQAAMMAETRRSATGRL
                   70        80        90       100       110       120

130       140      149
   m671.pep   FIRYLTGDTVYAQFVQIAFGIPCVFIVAX
              |||||||||||||||||||||||||||||
   a671       FIRYLTGDTVYAQFVQIAFGIPCVFIVAX
                  130       140
```

The following partial DNA sequence was identified in *N. gonorrhoeae* <SEQ ID 2201>:

```
g672.seq
   1 ATGAGGAAAA TCCGCACCAA AATCTGCGGC ATCACCACAC CGGAAGACGC

51 ACTGTATGCC GCCCACGCCG GCGCAGACGC ATTGGGACTG GTTTTTTACC

101 CCCAAAGCCC CCGCGCTATC GACATCATTA AAGCACAAAA AATCGCCGCC

151 GCACTGCCGC CGTTTGTCAG CGTTGTCGCC CTTTTCGTCA ACGAAAGCGC

201 GCAAAACATC CGCCGCATCC TTGCCGAAGT GCCGATACAC ATCATCCAAT

251 TCCACGGCGA CGAAGACGAT GCATTCTGCC GGCAGTTCGA CCGCCCCTAT

301 ATTAAAGCCA TTCGTGTTCA GACGGCATCA GACATCCGAA ACGCCGCCAC

351 GCGCTTCCCC AACGCTCAGG CACTGCTGTT CGATGCCTAT CACCCTTCGG

401 AATACGGCGG CACCGGACAC CGCTTCGact GGacgctgtt ggcggAATAT

451 TCGGGCAAGC CGTGGGTGCT TGCCGGCGGG CTGACCCCTG AAAACGTCGG

501 CGAAGCCGTC CGCATCACCG GAGCGGAAGC GGTCGACGTA TCCGGCGGCG

551 TGGAAGCGTC TAAAGGCAAA AAAGACCCCG CCAAAGTCGC CGCCTTTATC

601 GCAACCGCCA ACCGCCTATC CCGTTAA
```

This corresponds to the amino acid sequence <SEQ ID 2202; ORF 672.ng>:

```
g672.pep
   1 MRKIRTKICG ITTPEDALYA AHAGADALGL VFYPQSPRAI DIIKAQKIAA

51 ALPPFVSVVA LFVNESAQNI RRILAEVPIH IIQFHGDEDD AFCRQFDRPY

101 IKAIRVQTAS DIRNAATRFP NAQALLFDAY HPSEYGGTGH RFDWTLLAEY

151 SGKPWVLAGG LTPENVGEAV RITGAEAVDV SGGVEASKGK KDPAKVAAFI

201 ATANRLSR*
```

The following partial DNA sequence was identified in *N. meningitidis* <SEQ ID 2203>:

```
m672.seq
   1 ATGAGGAAAA TCCGCACCAA AATCTGCGGC ATCACCACAC CGGAAGACGC

51 AGCTGCCGCC GCAGCGGCAG GTGCGGATGC CGTCGGGCTG GTCTTTTTCC

101 AAGGCAGCAG CCGGGCCGTC GATATTGCCC GCGCCAAAAA AATCACCGCC

151 GCACTGCCGC CGTTTGTCAG CGTTGTCGCC CTTTTCGTCA ACGAAAGCGC

201 GCAAAACATC CGCCGCATCC TTGCCGAAGT GCCGATACAC ATCATCCAAT

251 TCCACGGCGA CGAAGACGAC GCATTCTGCC GCCAGTTCCA CCGCCCCTAT

301 ATCAAAGCCA TTCGTGTTCA GACGGCATCA GACATCCGAA ACGCCGCCAC

351 GCGCTTCCCC GACGCTCAGG CACTGCTGTT CGATGCCTAC CATCCTTCGG

401 AATACGGCGG CACCGGAAAC CGCTTCGACT GGACGCTGCT GGCGGAATAT

451 TCGGGCAAAC CGTGGGTGCT TGCCGGCGGG CTGACCCCTG AAAACGTCGG

501 CGAAGCCGTC CGCATCACCG GAGCGGAATC GGTCGATGTA TCCGGCGGTG

551 TGGAAGCGTC TAAAGGCAAA AAAGATGCCG CCAAAGTCGC CGCCTTTATC

601 GCAACCGCCA ACCGCCTATC CCGTTAA
```

This corresponds to the amino acid sequence <SEQ ID 2204; ORF 672>:

```
m672.pep
  1 MRKIRTKICG ITTPEDAAAA AAAGADAVGL VFFQGSSRAV DIARAKKITA

51 ALPPFVSVVA LFVNESAQNI RRILAEVPIH IIQFHGDEDD AFCRQFHRPY

101 IKAIRVQTAS DIRNAATRFP DAQALLFDAY HPSEYGGTGN RFDWTLLAEY

151 SGKPWVLAGG LTPENVGEAV RITGAESVDV SGGVEASKGK KDAAKVAAFI

201 ATANRLSR*
```

Computer analysis of this amino acid sequence gave the following results:
Homology with a Predicted ORF from *N. gonorrhoeae*

```
    m672/g672 91.3% identity in 208 aa overlap 10        20        30        40        50        60
    m672.pep MRKIRTKICGITTPEDAAAAAAAGADAVGLVFFQGSSRAVDIARAKKITAALPPFVSVVA
            ||||||||||||||||| || |||||:||||   | ||:|| :|:||:|||||||||||
    g672    MRKIRTKICGITTPEDALYAAHAGADALGLVFYPQSPRAIDIIKAQKIAAALPPFVSVVA
                 10        20        30        40        50        60

70        80        90       100       110       120
    m672.pep LFVNESAQNIRRILAEVPIHIIQFHGDEDDAFCRQFHRPYIKAIRVQTASDIRNAATRFP
            ||||||||||||||||||||||||||||||||||||:|||||||||||||||||||||||
    g672    LFVNESAQNIRRILAEVPIHIIQFHGDEDDAFCRQFDRPYIKAIRVQTASDIRNAATRFP
                 70        80        90       100       110       120

130       140       150       160       170       180
    m672.pep DAQALLFDAYHPSEYGGTGNRFDWTLLAEYSGKPWVLAGGLTPENVGEAVRITGAESVDV
            :|||||||||||||||||||:|||||||||||||||||||||||||||||||||||:|||
    g672    NAQALLFDAYHPSEYGGTGHRFDWTLLAEYSGKPWVLAGGLTPENVGEAVRITGAEAVDV
                130       140       150       160       170       180

190       200      209
    m672.pep SGGVEASKGKKDAAKVAAFIATANRLSRX
            ||||||||||||| |||||||||||||||
    g672    SGGVEASKGKKDPAKVAAFIATANRLSRX
                190       200
```

The following partial DNA sequence was identified in *N. meningitidis* <SEQ ID 2205>:

```
a672.seq
  1 ATGAGGAAAA TCCGCACCAA AATCTGCGGC ATCACCACAC CGGAAGACGC

51 ACTGTATGCC GCCCACGCCG GCGCAGACGC ATTGGGACTG GTTTTTTACC

101 CCCAAAGCCC CCGCGCTGTC GACATCATTA AGCACAAAA ATCACCGCC

151 GCACTGCCGC CGTTTGTCAG CGTTGTCGCC CTTTTCGTCA ACGAAAGCGC

201 GCAAAACATC CGCCGCATCC TTGCCGAAGT ACCGATACAC ATCATCCAAT

251 TCCACGGCGA CGAAGACGAC GCATTCTGCC GCCAGTTCCA CCGCCCCTAT

301 ATCAAGGCCA TTCGTGTTCA GACGGCATCA GACATCCGAA ACGCCGCCGA

351 CCGCTTCCCC GACGCTCAGG CACTGCTGTT CGATGCCTAC CATCCTTCGG

401 AATACGGCGG CACCGGACAC CGCTTCGACT GGACGCTGTT GGCGGAATAT

451 TCGGGCAAAC CGTGGGTGCT TGCCGGCGGG CTGACCCCTG AAAACGTCGA

501 CGAAGCCATC CGCATCACCG GAGCGGAAGC GGTCGATGTA TCCGGCGGCG

551 TGGAAGCGTC TAAAGGCAAA AAAGACCCAG CCAAAGTTGC CGCCTTTATC

601 GCAACCGCCA ACCGCCTATC CGTTAA
```

This corresponds to the amino acid sequence <SEQ ID 2206; ORF 672.a>:

```
a672.pep

1 MRKIRTKICG ITTPEDALYA AHAGADALGL VFYPQSPRAV DIIKAQKITA

51 ALPPFVSVVA LFVNESAQNI RRILAEVPIH IIQFHGDEDD AFCRQFHRPY

101 IKAIRVQTAS DIRNAADRFP DAQALLFDAY HPSEYGGTGH RFDWTLLAEY

151 SGKPWVLAGG LTPENVDEAI RITGAEAVDV SGGVEASKGK KDPAKVAAFI

201 ATANRLSR* m672/a672 91.8% identity in 208 aa overlap 10         20         30         40         50         60
m672.pep  MRKIRTKICGITTPEDAAAAAAAGADAVGLVFFQGSSRAVDIARAKKITAALPPFVSVVA
          ||||||||||||||||||  || |||||:||||:  |  ||||| :|:||||||||||||
a672      MRKIRTKICGITTPEDALYAAHAGADALGLVFYPQSPRAVDIIKAQKITAALPPFVSVVA
                 10         20         30         40         50         60

70         80         90        100        110        120
m672.pep  LFVNESAQNIRRILAEVPIHIIQFHGDEDDAFCRQFHRPYIKAIRVQTASDIRNAATRFP
          ||||||||||||||||||||||||||||||||||||||||||||||||||||||| |||
a672      LFVNESAQNIRRILAEVPIHIIQFHGDEDDAFCRQFHRPYIKAIRVQTASDIRNAADRFP
                 70         80         90        100        110        120

130        140        150        160        170        180
m672.pep  DAQALLFDAYHPSEYGGTGNRFDWTLLAEYSGKPWVLAGGLTPENVGEAVRITGAESVDV
          |||||||||||||||||||:||||||||||||||||||||||||||| ||:||||||:|||
a672      DAQALLFDAYHPSEYGGTGHRFDWTLLAEYSGKPWVLAGGLTPENVDEAIRITGAEAVDV
                130        140        150        160        170        180

190        200        209
m672.pep  SGGVEASKGKKDAAKVAAFIATANRLSRX
          |||||||||||| ||||||||||||||||
a672      SGGVEASKGKKDPAKVAAFIATANRLSRX
                190        200
```

The following partial DNA sequence was identified in *N. gonorrhoeae* <SEQ ID 2207>:

```
g673.seq
   1 ATGGATATTG AAACCTTCCT TGCAGGGGAA CGCGCCGCCG GCGGATACCG

51 TTGCGGCTTC GTGGCGATTG TCGGTCGTCC GAACGTGGGC AAATCAACGC

101 TGATGAACCA TCTCATCGGT CAGAAAATCA GTATTACCAG CAAAAAGGCG

151 CAGACGACGC GCAACCGCGT AACGGGGATT TATACCGACG ATACCGCGCA

201 GTTCGTGTTT GTCGATACGC CGGGCTTTCA AACCGACCAC CGCAACGCGC

251 TCAACGACAG GCTGAATCAA AATGTTACCG AGGCGCTCGG CGGTGTGGAT

301 GTGGTGGTTT TCGTCGTGGA GGCGATGCGC CTTACCGATG CCGACCGCGT

351 CGTGTTGAAA CAACTGCCCA AGCACACGCC GGTCATTTTA GTGATCAACA

401 AAATCGACAA GGACAAGGCG AAAGACCGTT ACGCGCTGGA GGCGTTTGTT

451 GCCCAAGTGC GCGCCGAATT TGAATTTGCG GCGGCGGAGG CGGTCAGTGC

501 GAAACACGGT TTGCGGATTG CCAACCTGTT GGAGCTGCTC AAGCCGTATC

551 TGCCCGAAAG CGTACCGATG TATCCCGAAG ACATGGTTAC GGACAAATCG

601 GCGCGTTTTT TGGCGATGGA AATCGTGCGT GAAAAACTCT TCCGCTATTT

651 GGGCGAGGAG CTGCCTTATG CGATGAACGT CGAAGTGGAG CAGTTTGAAG

701 AGGGAGACGG TTTGAACCGC ATCTACatcg cCGTTTTGGT CGACAAAGAA

751 AGCCAAAAGG CGATTTTGAT CGGTAAAGGC GGGGAGCGTT TGAAAAAAAT

801 TTCCACCGAA GCGCGGCTGG ATATGGAAAA ACTGTTTGAT AACAAAGTAT
```

-continued

```
851 TTTTGAAGGT CTGGGTCAAA GTCAAATCCG GTTGGGCAGA CGACATTCGC

901 TTCCTGCGCG AGCTGGGTTT GTAG
```

This corresponds to the amino acid sequence <SEQ ID 2208; ORF 673.ng>:

```
g673.pep
  1 MDIETFLAGE RAAGGYRCGF VAIVGRPNVG KSTLMNHLIG QKISITSKKA

51 QTTRNRVTGI YTDDTAQFVF VDTPGFQTDH RNALNDRLNQ NVTEALGGVD

101 VVVFVVEAMR LTDADRVVLK QLPKHTPVIL VINKIDKDKA KDRYALEAFV

151 AQVRAEFEFA AAEAVSAKHG LRIANLLELL KPYLPESVPM YPEDMVTDKS

201 ARFLAMEIVR EKLFRYLGEE LPYAMNVEVE QFEEGDGLNR IYIAVLVDKE

251 SQKAILIGKG GERLKKISTE ARLDMEKLFD NKVFLKVWVK VKSGWADDIR

301 FLRELGL*
```

The following partial DNA sequence was identified in *N. meningitidis* <SEQ ID 2209>:

```
m673.seq
  1 ATGGATATTG AAACCTTCCT TGCAGGGGAA CGCGCCGCCG GCGGATACCG

51 TTGCGGCTTC GTAGCGATTG TCGGCCGTCC GAACGTGGGC AAATCAACGC

101 TGATGAACCA TCTCATCGGT CAGAAAATCA GTATTACCAG CAAAAAGGCG

151 CAGACGACGC GCAACCGCGT AACGGGGATT TATACCGACG ATACCGCGCA

201 GTTCGTGTTT GTCGATACGC CCGGCTTTCA AACCGACCAC CGCAACGCGC

251 TCAACGACAG GCTGAATCAA AATGTTACCG AGGCGCTCGG CGGCGTGGAT

301 GTGGTGGTTT TCGTCGTGGA GGCGATGCGC TTTACCGATG CCGACCGCGT

351 CGTGTTGAAA CAACTGCCCA AGCACACGCC GGTCATTTTA GTGGTCAACA

401 AAATCGACAA GGACAAGGCG AAAGACCGTT ACGCGCTGGA GGCGTTTGTT

451 GCCCAAGTGC GCGCCGAATT TGAATTTGCG GCGGCGGAGG CGGTCAGCGC

501 GAAACACGGA TTGCGGATTG CCAACCTGTT GGAGCTGATT AAGCCGTATC

551 TGCCCGAAAG CGTGCCGATG TATCCCGAAG ATATGGTTAC GGACAAATCG

601 GCGCGTTTTT TGGCGATGGA AATCGTGCGT GAAAAATTGT TCCGCTATTT

651 GGGCGAGGAA TTGCCTTATG CGATGAACGT CGAAGTGGAG CAGTTTGAAG

701 AGGAAGACGG TTTGAACCGC ATCTATATCG CCGTTTTGGT CGATAAGGAA

751 AGCCAAAAGG CAATTTTAAT CGGTAAAGGC GGAGAACGTT TGAAGAAAAT

801 TTCCACCGAA GCGCGGTTGG ATATGGAAAA ACTGTTTGAT ACCAAAGTAT

851 TTTTGAAGGT CTGGGTCAAA GTCAAATCCG GTTGGGCGGA CGACATCCGC

901 TTCCTGCGCG AGCTGGGTTT GTAG
```

This corresponds to the amino acid sequence <SEQ ID 2210; ORF 673>:

```
m673.pep
  1 MDIETFLAGE RAAGGYRCGF VAIVGRPNVG KSTLMNHLIG QKISITSKKA

51 QTTRNRVTGI YTDDTAQFVF VDTPGFQTDH RNALNDRLNQ NVTEALGGVD

101 VVVFVVEAMR FTDADRVVLK QLPKHTPVIL VVNKIDKDKA KDRYALEAFV
```

-continued
```
151 AQVRAEFEFA AAEAVSAKHG LRIANLLELI KPYLPESVPM YPEDMVTDKS

201 ARFLAMEIVR EKLFRYLGEE LPYAMNVEVE QFEEEDGLNR IYIAVLVDKE

251 SQKAILIGKG GERLKKISTE ARLDMEKLFD TKVFLKVWVK VKSGWADDIR

301 FLRELGL*
```

Computer analysis of this amino acid sequence gave the following results:

Homology with a Predicted ORF from *N. gonorrhoeae*

```
   m673/g673   98.4% identity in 307 aa overlap
                      10        20        30        40        50        60
       m673.pep   MDIETFLAGERAAGGYRCGFVAIVGRPNVGKSTLMNHLIGQKISITSKKAQTTRNRVTGI
                  ||||||||||||||||||||||||||||||||||||||||||||||||||||||||||||
       g673       MDIETFLAGERAAGGYRCGFVAIVGRPNVGKSTLMNHLIGQKISITSKKAQTTRNRVTGI
                      10        20        30        40        50        60
                      70        80        90       100       110       120
       m673.pep   YTDDTAQFVFVDTPGFQTDHRNALNDRLNQNVTEALGGVDVVVFVVEAMRFTDADRVVLK
                  |||||||||||||||||||||||||||||||||||||||||||||||||:|||||||||
       g673       YTDDTAQFVFVDTPGFQTDHRNALNDRLNQNVTEALGGVDVVVFVVEAMRLTDADRVVLK
                      70        80        90       100       110       120
                     130       140       150       160       170       180
       m673.pep   QLPKHTPVILVVNKIDKDKAKDRYALEAPVAQVRAEFEFAAAEAVSAKHGLRIANLLELI
                  |||||||||||:||||||||||||||||||||||||||||||||||||||||||||||:
       g673       QLPKHTPVILVINKIDKDKAKDRYALEAPVAQVRAEFEFAAAEAVSAKHGLRIANLLELL
                     130       140       150       160       170       180
                     190       200       210       220       230       240
       m673.pep   KPYLPESVPMYPEDMVTDKSARFLAMEIVREKLFRYLGEELPYAMNVEVEQFEEEDGLNR
                  |||||||||||||||||||:|||||||||||||||||||||||||||||||| |||||
       g673       KPYLPESVPMYPEDMVTKDSARFLAMEIVREKLFRYLGEELPYAMNVEVEQFEEGDGLNR
                     190       200       210       220       230       240
                     250       260       270       280       290       300
       m673.pep   IYIAVLVDKESQKAILIGKGGERLKKISTEARLDMEKLFDTKVFLKVWVKVKSGWADDIR
                  ||||||||||||||||||||||||||||||||||||||||:|||||||||||||||||||
       g673       IYIAVLVDKESQKAILIGKGGERLKKISTEARLDMEKLFDNKVFLKVWVKVKSGWADDIR
                     250       260       270       280       290       300 m673.pep   FLRELGLX
                  ||||||||
       g673       FLRELGLX
```

The following partial DNA sequence was identified in *N. meningitidis* <SEQ ID 2211>:

```
673.seq
  1 ATGGATATTG AAACCTTCCT TGCAGGGGAA CGCGCCGCCG ACGGATACCG

51 TTGCGGCTTC GTAGCGATTG TCGGCCGTCC GAACGTGGGC AAATCAACGC

101 TGATGAATCA TCTCATCGGT CAGAAAATCA GTATTACCAG CAAAAAGGCG

151 CAGACGACGC GCAACCGCGT AACGGGGATT TATACCGACG ATACCGCGCA

201 GTTTGTGTTT GTCGATACGC CCGGTTTTCA AACCGACCAC CGCAACGCGC

251 TCAACGACCG TTTGAATCAA AACGTTACCG AGGCACTCGG CGGCGTGGAT

301 GTGGTGGTTT TCGTCGTGGA AGCGATGCGT TTTACCGATG CCGACCGCGT

351 CGTGTTGAAA CAACTGCCCA AGCACACGCC GGTCATTTTA GTGGTCAACA

401 AAATCGATAA GGACAAGGCG AAAGACCGTT ACGCGCTGGA GGCGTTTGTT

451 GCCCAGGTGC GCGCCGAATT TGAATTTGCG GCGGCGGAGG CGGTCAGCGC

501 GAAACACGGA TTGCGGATTG CCAACCTGTT GGAGCTGATT AAGCCGTATC

551 TGCCCGAAAG CGTGCCGATG TATCCCGAAG ATATGGTTAC GGACAAATCG

601 GCGCGTTTTT TAGCGATGGA AATCGTGCGT GAAAAATTGT TCCGCTATTT

651 GGGCGAGGAA TTGCCTTATG CGATGAACGT CGAAGTGGAG CAGTTTGAAG
```

-continued

```
701 AGGAAGACGG TTTGAACCGC ATCTATATCG CCGTTTTGGT CGATAAGGAA

751 AGCCAAAAGG CGATTTTAAT CGGCAAAGGC GGGGAGCGTT TGAAGAAAAT

801 TTCCACCGAA GCGCGGTTGG ATATGGAAAA ACTGTTTGAT ACCAAAGTAT

851 TTTTGAAGGT CTGGGTCAAA GTCAAATCCG GTTGGGCGGA CGACATCCGC

901 TTCCTGCGCG AGCTGGGTTT GTAG
```

This corresponds to the amino acid sequence <SEQ ID 2212; ORF 673.a>:

```
a673.pep

1   MDIETFLAGE RAADGYRCGF VAIVGRPNVG KSTLMNHLIG QKISITSKKA

51   QTTRNRVTGI YTDDTAQFVF VDTPGFQTDH RNALNDRLNQ NVTEALGGVD

101   VVVFVVEAMF FTDADRVVLK QLPKHTPVIL VVNKIDKDKA KDRYALEAFV

151   AQVRAEFEFA AAEAVSAKHG LRIANLLELI KPYLPESVPM YPEDMVTDKS

201   ARFLAMEIVR EKLFRYLGEE LPYAMNVEVE QFEEEDGLNR IYIAVLVDKE

251   SQKAILIGKG GERLKKISTE ARLDMEKLFD TKVFLKVWVK VKSGWADDIR

301   FLREIGL* m673/a673   99.7% identity in 307 aa overlap
                  10          20         30         40         50        60
m673.pep    MDIETFLAGERAAGGYRCGFVAIVGRPNVGKSTLMNHLIGQKISITSKKAQTTRNRVTGI
            |||||||||||| |||||||||||||||||||||||||||||||||||||||||||||||
a673        MDIETFLAGERAADGYRCGFVAIVGRPNVGKSTLMNHLIGQKISITSKKAQTTRNRVTGI
                  10          20         30         40         50        60

70          80         90         100        110       120
m673.pep    YTDDTAQFVFVDTPGFQTDHRNALNDRLNQNVTEALGGVDVVVFVVEAMRFTDADRVVLK
            ||||||||||||||||||||||||||||||||||||||||||||||||| ||||||||||
a673        YTDDTAQFVFVDTPGFQTDHRNALNDRLNQNVTEALGGVDVVVFVVEAMRFTDADRVVLK
                  70          80         90         100        110       120

130         140        150        160        170       180
m673.pep    QLPKHTPVILVVNKIDKDKAKDRYALEAFVAQVRAEFEFAAAEAVSAKHGLRIANLLELI
            ||||||||||||||||||||||||||||||||||||||||||||||||||||||||||||
a673        QLPKHTPVILVVNKIDKDKAKDRYALEAFVAQVRAEFEFAAAEAVSAKHGLRIANLLELI
                  130         140        150        160        170       180

190         200        210        220        230       240
m673.pep    KPYLPESVPMYPEDMVTDKSARFLAMEIVREKLFRYLGEELPYAMNVEVEQFEEEDGLNR
            ||||||||||||||||||||||||||||||||||||||||||||||||||||||||||||
a673        KPYLPESVPMYPEDMVTDKSARFLAMEIVREKLFRYLGEELPYAMNVEVEQFEEEDGLNR
                  190         200        210        220        230       240

250         260        270        280        290       300
m673.pep    IYIAVLVDKESQKAILIGKGGERLKKISTEARLDMEKLFDTKVFLKVWVKVKSGWADDIR
            ||||||||||||||||||||||||||||||||||||||||||||||||||||||||||||
a673        IYIAVLVDKESQKAILIGKGGERLKKISTEARLDMEKLFDTKVFLKVWVKVKSGWADDIR
                  250         260        270        280        290       300 m673.pep    FLRELGLX
            ||||||||
a673        FLRELGLX
```

The following partial DNA sequence was identified in *N. gonorrhoeae* <SEQ ID 2213>:

```
g674.seq
   1 ATGAAAACAG CCCGCCGCCG TTCCCGCGAG CTTGCCGTAC AAGCCGTTTA

51 CCAATCCCTT ATCAACCGCA CCGCCGCGCC CGAAATTGCT AAAAACATCC

101 GCGAAATGTC CGACTTTGCC AAAGCGGACG AAGAATTGTT CAACAAACTC

151 TTCTTCGGCA CACAAACCAA TGCAGCGGAC TACATCCAAA AAATCCGCCC

201 GCTGCTCGAC AGGGACGAAA AAGACCTCAA CCCCATCGAA CGCGCCGTTT
```

-continued
```
251 TGCTGACCGC CTGCCACGAG CTTTCCGCTA TGCCCGAAAC GCCCTACCCC

301 GTCATTATCA ACGAAGCCAT CGAAGTTACC AAAACCTTCG GCGGCACGGA

351 CGGGCACAAA TTCGTCAACG GCATCCTCGA CAAACTCGCC GCCCAAATCC

401 GCCCAGACGA GCCCAAACGC CGTTGA
```

This corresponds to the amino acid sequence <SEQ ID 2214; ORF 674.ng>:

```
g674.pep
  1 MKTARRRSRE LAVQAVYQSL INRTAAPEIA KNIREMSDFA KADEELFNKL

51 FFGTQTNAAD YIQKIRPLLD RDEKDLNPIE RAVLLTACHE LSAMPETPYP

101 VIINEAIEVT KTFGGTDGHK FVNGILDKLA AQIRPDEPKR R*
```

The following partial DNA sequence was identified in *N. meningitidis* <SEQ ID 2215>:

```
m674.seq
  1 ATGAAAACAG CCCGCCGCCG TTCCCGCGAG CTTGCCGTAC AAGCCGTTTA

51 CCAATCCCTT ATCAACCGCA CCGCCGCGCC CGAAATTGCT AAAAACATCC

101 GCGAAATGTC CGACTTTGCC AAGGCAGACG AAGAATTGTT CAACAAACTT

151 TTCTTCGGCA CGCAAACCAA TGCGGCAGAG TATATCCGAC AAATCCGCCC

201 GCTACTTGAC AGGGACGAAA AAGACCTCAA CCCCATCGAA CGCGCCGTTT

251 TGCTGACCGC CTGCCACGAG CTGTCCGCCA TGCCCGAAAC GCCCTACCCC

301 GTCATTATCA ACGAAGCCAT CGAAGTTACC AAAACCTTCG GCGGCACGGA

351 CGGGCACAAA TTCGTCAACG GCATCCTCGA CAAACTCGCC GCCCAAATCC

401 GCCCCGACGA GCCCAAACGC CGTTGA
```

This corresponds to the amino acid sequence <SEQ ID 2216; ORF 674>:

```
m674.pep
  1 MKTARRRSRE LAVQAVYQSL INRTAAPEIA KNIREMSDFA KADEELFNKL

51 FFGTQTNAAE YIRQIRPLLD RDEKDLNPIE RAVLLTACHE LSAMPETPYP

101 VIINEAIEVT KTFGGTDGHK FVNGILDKLA AQIRPDEPKR R*
```

Computer analysis of this amino acid sequence gave the following results:
Homology with a Predicted ORF from *N. gonorrhoeae*

```
    m674/g674  97.9% identity in 141 aa overlap
                      10         20         30         40         50         60
        m674.pep  MKTARRRSRELAVQAVYQSLINRTAAPEIAKNIREMSDFAKADEELFNKLFFGTQTNAAE
                  ||||||||||||||||||||||||||||||||||||||||||||||||||||||||||:
        g674      MKTARRRSRELAVQAVYQSLINRTAAPEIAKNIREMSDFAKADEELFNKLFFGTQTNAAD
                      10         20         30         40         50         60

70         80         90        100        110        120
        m674.pep  YIRQIRPLLDRDEKDLNPIERAVLLTACHELSAMPETPYPVIINEAIEVTKTFGGTDGHK
                  ||::||||||||||||||||||||||||||||||||||||||||||||||||||||||||
        g674      YIQKIRPLLDRDEKDLNPIERAVLLTACHELSAMPETPYPVIINEAIEVTKTFGGTDGHK
                      70         80         90        100        110        120

130        140
        m674.pep  FVNGILDKLAAQIRPDEPKRRX
                  ||||||||||||||||||||||
        g674      FVNGILDKLAAQIRPDEPKRRX
                     130        140
```

The following partial DNA sequence was identified in *N. meningitidis* <SEQ ID 2217>:

```
a674.seq
   1 ATGAAAACAG CCCGCCGCCG TTCCCGCGAG CTTGCCGTAC AAGCCGTTTA

51 CCAATCCCTT ATCAACCGCA CCGCCGCGCC CGAGATTGCT AAAAACATCC

101 GCGAAATGCC CGACTTTGCC AAGGCAGACG AAGAATTGTT CAACAAACTT

151 TTCTTCGGCA CGCAAACCAA TGCGGCAGAG TACATCCGAC AAATCCGCCC

201 CCTGCTCGAC CGCGACGAAA AAGACCTCAA CCCCATCGAA CGCGCCGTCC

251 TGCTGACCGC CTGCCACGAG CTGTCCGCCA TGCCCGAAAC GCCCTACCCC

301 GTCATCATCA ACGAAGCCAT CGAAGTAACC AAAACCTTCG GCGGCACGGA

351 CGGGCACAAA TTCGTCAACG GCATCCTCGA CAAACTCGCC GCCCAAATCC

401 GTCCCGACGA GCCCAAACGC CGTTGA
```

This corresponds to the amino acid sequence <SEQ ID 2218; ORF 674.a>:

```
a674.pep

1  MKTARRRSRE LAVQAVYQSL INRTAAPEIA KNIREMPDFA KADEELFNKL

51  FFGTQTNAAE YIRQIRPLLD RDEKDLNPIE RAVLLTACHE LSAMPETPYP

101  VIINEAIEVT KTFGGTDGHK FVNGILDKLA AQIRPDEPKR R* m674/a674  99.3% identity in 141 aa overlap
                   10        20        30        40        50        60
m674.pep   MKTARRRSRELAVQAVYQSLINRTAAPEIAKNIREMSDFAKADEELFNKLFFGTQTNAAE
           |||||||||||||||||||||||||||||||||||| |||||||||||||||||||||||
a674       MKTARRRSRELAVQAVYQSLINRTAAPEIAKNIREMPDFAKADEELFNKLFFGTQTNAAE
                   10        20        30        40        50        60

70        80        90       100       110       120
m674.pep   YIRQIRPLLDRDEKDLNPIERAVLLTACHELSAMPETPYPVIINEAIEVTKTFGGTDGHK
           ||||||||||||||||||||||||||||||||||||||||||||||||||||||||||||
a674       YIRQIRPLLDRDEKDLNPIERAVLLTACHELSAMPETPYPVIINEAIEVTKTFGGTDGHK
                   70        80        90       100       110       120

130       140
m674.pep   FVNGILDKLAAQIRPDEPKRRX
           ||||||||||||||||||||||
a674       FVNGILDKLAAQIRPDEPKRRX
                  130       140
```

The following partial DNA sequence was identified in *N. gonorrhoeae* <SEQ ID 2219>:

```
g675.seq
   1 ATGAACACCA TCGCCCCcaa cctcgacggC AAACACCTCC GCATCGGCAT

51 CGTACAGGCA CGCTTCACCA ACGAAATCGG CAGCCAAATG CTCAAAGTCT

101 GCTGCCGCAC CCTCCAAGAA TTGGGCGTAG CAGACGAAAa catcaccgtc 151 gCCACCGTAC CCGGCGCGCT TGAAATCCCC ATCGCGCTGA TGAACTTTGC

201 CTCTTCCGAA AAATTTGACG CACTGATTGC CATCGGCGTC GTCATCCGTG

251 GCGAAACCTA CCATTTCGAG CTGGTTGCCA ACGAATCCGG CGCAGGGATC

301 GGCCGCGTCG CACTCGACTA CAACATCCCG ATTGCCAACG CCGTCCTGAC

351 CACCGAAAAC GACGCGCAGG CAATTGAACG GATTGGAGAA AAAGCCTCGG

401 ATGCCGCCAA AGTCGCCGTA GAATGCGCCA ACCTCGTCAA CCTTCTGCTC

451 GAAGAACAGT TTGAAGACGA AGAATAA
```

This corresponds to the amino acid sequence <SEQ ID 2220; ORF 675.ng>:

```
g675.pep
   1 MNTIAPNLDG KHLRIGIVQA RFTNEIGSQM LKVCCRTLQE LGVADENITV

51 ATVPGALEIP IALMNFASSE KFDALIAIGV VIRGETYHFE LVANESGAGI

101 GRVALDYNIP IANAVLTTEN DAQAIERIGE KASDAAKVAV ECANLVNLLL

151 EEQFEDEE*
```

The following partial DNA sequence was identified in *N. meningitidis* <SEQ ID 2221>:

```
m675.seq
   1 ATGAACACCA TCGCCCCCAA CCTCGACGGC AAACACCTCC GCATCGGCAT

51 CGTACAGGCA CGCTTCACCA ACGAAATCGG CAGCGAAATG CTCAAAGTCT

101 GCTGCCGCAC CCTCCAAGAA TTGGGCGTGG CAGACGAAAA CATTACCGTC

151 GCCACCGTAC CCGGCGCGCT TGAAATCCCC ATCGCGCTGA TGAACTTTGC

201 CTCTTCCGAA AAGTTTGACG CACTGATTGC CATCGGCGTC GTCATCCGTG

251 GCGAAACCTA CCATTTCGAG CTGGTTTCCA ACGAATCCGG AGCAGGCGTC

301 AGCCGCGTCG CACTCGACTA CAATATCCCG ATTGCCAATG CCGTCCTAAC

351 CACCGAAAAC GACGCGCAGG CAATCGAACG GATTGAAGAA AAGCCTCGG

401 ATGCCGCCAA AGTCGCCGTC GAATGCGCCA ACCTCGTCAA CCTGCTGCTC

451 GAAGAACAGT TTGAAGACGA AGAATAA
```

This corresponds to the amino acid sequence <SEQ ID 2222; ORF 675>:

```
m675.pep
   1 MNTIAPNLDG KHLRIGIVQA RFTNEIGSEM LKVCCRTLQE LGVADENITV

51 ATVPGALEIP IALMNFASSE KFDALIAIGV VIRGETYHFE LVSNESGAGV

101 SRVALDYNIP IANAVLTTEN DAQAIERIEE KASDAAKVAV ECANLVNLLL

151 EEQFEDEE*
```

Computer analysis of this amino acid sequence gave the following results:

Homology with a Predicted ORF from *N. gonorrhoeae*

```
m675/g675  96.8% identity in 158 aa overlap
                    10        20        30        40        50        60
m675.pep   MNTIAPNLDGKHLRIGIVQARFTNEIGSEMLKVCCRTLQELGVADENITVATVPGALEIP
           ||||||||||||||||||||||||||||:|||||||||||||||||||||||||||||||
g675       MNTIAPNLDGKHLRIGIVQARFTNEIGSQMLKVCCRTLQELGVADENITVATVPGALEIP
                    10        20        30        40        50        60

70        80        90       100       110       120
m675.pep   IALMNFASSEKFDALIAIGVVIRGETYHFELVSNESGAGVSRVADKYNIPIANAVLTTEN
           |||||||||||||||||||||||||||||||:|||||||::|||||||||||||||||||
g675       IALMNFASSEKFDALIAIGVVIRGETYHFELVANESGAGIGRVALDYNIPIANAVLTTEN
                    70        80        90       100       110       120

130       140       150      159
m675.pep   DAQAIERIEEKASDAAKVAVECANLVNLLLEEQFEDEEX
           |||||||| ||||||||||||||||||||||||||||||
g675       DAQAIERIGEKASDAAKVAVECANLVNLLLEEQFEDEEX
                   130       140       150
```

The following partial DNA sequence was identified in *N. meningitidis* <SEQ ID 2223>:

```
a675.seq
   1 ATGAACACCA TCGCCCCCAA CCTCGACGGC AAACACCTCC GCATCGGCAT

51 CGTACAGGCA CGCTTCACCA ACGAAATCGG CAGCGAAATG CTCAAAGTCT

101 GCTGCCGCAC CCTCCAAGAA TTGGGCGTGG CAGACGAAAA CATTACCGTC

151 GCCACCGTAC CCGGCGCGCT TGAAATCCCC ATCGCGCTGA TGAACTTTGC

201 CTCTTCTGAA AAATTTGACG CACTGATTGC CATCGGCGTC GTTATCCGTG

251 GCGAAACCTA CCATTTCGAG CTGGTTTCCA ACGAATCCGG AGCAGGGGTC

301 AGCCGCGTCG CACTCGACTA CAACATCCCG ATTGCCAATG CCGTCCTGAC

351 CACGGAAAAC GACGCACAGG CAATCGAACG GATTGAAGAA AAAGCCTCGG

401 ATGCCGCCAA AGTCGCCGTA GAATGCGCCA ACCTCGTCAA CCTCCTGCTC

451 GAAGAACAGT TTGAAGACGA AGAATAA
```

This corresponds to the amino acid sequence <SEQ ID 2224; ORF 675.a>:

```
a675.pep
       1   MNTIAPNLDQ KHLRIGIVQA RFTNEIGSEM LKVCCRTLQE LGVADENITV

51   ATVPGALEIP IALMNFASSE KFDALIAIGV VIRGETYHFE LVSNESGAGV

101   SRVALDYNIP IANAVLTTEN DAQAIERIEE KASDAAKVAV ECANLVNLLL

151   EEQFEDDEE* m675/a675   100.0% identity in 158 aa overlap
                    10         20         30         40         50         60
   m675.pep  MNTIAPNLDGKHLRIGIVQARFTNEIGSEMLKVCCRTLQELGVADENITVATVPGALEIP
             ||||||||||||||||||||||||||||||||||||||||||||||||||||||||||||
   a675      MNTIAPNLDGKHLRIGIVQARFTNEIGSEMLKVCCRTLQELGVADENITVATVPGALEIP
                    10         20         30         40         50         60

70         80         90        100        110        120
   m675.pep  IALMNFASSEKFDALIAIGVVIRGETYHFELVSNESGAGVSRVALDYNIPIANAVLTTEN
             ||||||||||||||||||||||||||||||||||||||||||||||||||||||||||||
   a675      IALMNFASSEKFDALIAIGVVIRGETYHFELVSNESGAGVSRVALDYNIPIANAVLTTEN
                    70         80         90        100        110        120

130        140        150       159
   m675.pep  DAQAIERIEEKASDAAKVAVECANLVNLLLEEQFEDEEX
             |||||||||||||||||||||||||||||||||||||||
   a675      DAQAIERIEEKASDAAKVAVECANLVNLLLEEQFEDEEX
                   130        140       150
```

The following partial DNA sequence was identified in *N. gonorrhoeae* <SEQ ID 2225>:

```
g677.seq
   1 ATGCCGCAGA TTTTGGTGCG GATTTTCCTC ATTCGGTATT CCTTTATTtg 51 ggAAACGGTG CGCTTGTGCC GTTTCAGACG GCATTCCCGA TCAGTCGATT

101 TTGATGTATT CGACAGAAAG GATTTCAATT TCCTCACGGC CTTCCGGCGT

151 GTTCAAAACC ACTTCGTCGC CTTCGCGCGC TTTAATCAGG CAACGCGCCA

201 ACGGCGAAAT CCAAGAAATT TTGTTTTGCG CGGTATCGAT TTCATCGACG

251 CCGACGATTT TGACGGTTTG CTCGCGCCCG TCGCCGCGCA ACAGACCGAC

301 GGTCGCGCCG AAAAATACTT GGTCGGTCGC TTCGCGCAAT TCGGGATCGA

351 CGACGACGGC AGCCTCCAAA CGTTTGGTCA GGAAACGGAT GCGGCGGTCG

401 ATTTCGCGCA TACGGCGTTT GCCGTAAAGA TAGTCGCCGT TTTCGCTGCG
```

-continued

```
451 GTCGCCGTTG CCTGCCGCCC AGTTGACGAT TTGGACGATT TCGGGGCGTT

501 CTTTATTGAC CAGTTGATAA AGCTCGTCTT TCAATGCCTG CCATCCGGCG

551 GGCGTAATGT AGTTTTTGGT TTCGGTACTC ATATTGTGTG CGGATGA
```

This corresponds to the amino acid sequence <SEQ ID 2226; ORF 677.ng>:

```
g677.pep
   1 MPQILVRIFL IRYSFIWETV RLCRFRRHSR SVDFDVFDRK DFNFLTAFRR

51 VQNHFVAFAR FNQATRQRRN PRNFVLRGID FIDADDFDGL LAPVAAQQTD

101 GRAEKYLVGR FAQFGIDDDG SLQTFGQETD AAVDFAHTAF AVKIVAVFAA

151 VAVACRPVDD LDDFGAFFID QLIKLVFQCL PSGGRNVVFG FGTHIVCG*
```

The following partial DNA sequence was identified in N. meningitidis <SEQ ID 2227>:

```
m677.seq
   1 ATGCCGCAGA TTTTGGTGCG GATTTTCCTC ATTCGGTATT CCTTTATTTG

51 GGAAACGGCG CGCTTTTGCC GTTTCAGACG GCATTCCCGA TCAGTCGATT

101 TTGATGTATT CGACAGAAAG GATTTCAATT TCCTCACGCC CTTCCGGCGT

151 GTTCAAAACC ACTTCGTCGC CTTCGCGCGC TTTAATCAGA CAACGAGCCA

201 GCGGCGAAAT CCAAGAAATT TGTTTTGCG CGGTATCGAT TTCATCGATG

251 CCGACGATTT TGACGGTTTG CTCGCGCCCG TCGTCGCGCA ACAGTCCGAC

301 CGTCGCGCCG AAAAACACTT GGTCGGTCGC TTCGCGCAAT TCGGGATCGA

351 CGACGACGGC AGCCTCCAAA CGTTTGGTCA GGAAACGGAT GCGGCGGTCG

401 ATTTCGCGCA TACGGCGTTT GCCGTAAAGA TAGTCGCCGT TTTCGCTGCG

451 GTCGCCGTTG CCTGCCGCCC AGTTGACGAT TTGGACGATT TCGGGGCGTT

501 CTTTGTTGAC CAGTTGATAA AGCTCGTCTT TCAATGCCTG CCATCCGGCG

551 GGCGTAATGT AGTTTTTGGT TTCGGTACTC ATATTGTGTG CGGATGA
```

This corresponds to the amino acid sequence <SEQ ID 2228; ORF 677>:

```
m677.pep
   1 MPQILVRIFL IRYSFIWETA RFCRFRRHSR SVDFDVFDRK DFNFLTPFRR

51 VQNHFVAFAR FNQTTSQRRN PRNFVLRGID FIDADDFDGL LAPVVAQQSD

101 RRAEKHLVGR FAQFGIDDDG SLQTFGQETD AAVDFAHTAF AVKIVAVFAA

151 VAVACRPVDD LDDFGAFFVD QLIKLVFQCL PSGGRNVVFG FGTHIVCG*
```

Computer analysis of this amino acid sequence gave the following results:
Homology with a Predicted ORF from N. gonorrhoeae

```
    m677/g677  94.9% identity in 198 aa overlap
                   10        20        30        40        50        60
        m677.pep  MPQILVRIFLIRYSFIWETARFCRFRRHSRSVDFDVFDRKDFNFLTPFRRVQNHFVAFAR
                  ||||||||||||||||||||:|:||||||||||||||||||||||||| |||||||||||
        g677      MPQILVRIFLIRYSFIWETVRLCRFRRHSRSVDFDVFDRKDFNFLTAFRRVQNHFVAFAR
                   10        20        30        40        50        60
```

-continued

```
                   70        80        90       100       110       120
m677.pep    FNQTTSQRRNPRNFVLRGIDFIDADDFDGLLAPVVAQQSDRRAEKHLVGRFAQFGIDDDG
            |||:| ||||||||||||||||||||||||||||:|||:| ||||:||||||||||||||
g677        FNQATRQRRNPRNFVLRGIDFIDADDFDGLLAPVAAQQTDGRAEKYLVGRFAQFGIDDDG
                   70        80        90       100       110       120

130       140       150       160       170       180
m677.pep    SLQTFGQETDAAVDFAHTAFAVKIVAVFAAVAVACRPVDDLDDFGAFFVDQLIKLVFQCL
            ||||||||||||||||||||||||||||||||||||||||||||||||:|||||||||||
g677        SLQTFGQETDAAVDFAHTAFAVKIVAVFAAVAVACRPVDDLDDFGAFFIDQLIKLVFQCL
                  130       140       150       160       170       180

190      199
m677.pep    PSGGRNVVFGFGTHIVCGX
            ||||||||||||||||||
g677        PSGGRNVVFGFGTHIVCGX
                  190
```

The following partial DNA sequence was identified in *N. meningitidis* <SEQ ID 2229>:

```
a677.seq
   1 ATGCCGCAGA TTTTGGTGCG GATTTTCCTC ATTCGGTATT CCTTTATTTG

51 GGAAACGGCG CGTTTGTGCC GTTTCAGACG GCATTCCCGA TCAGTCGATT

101 TTGATGTATT CGACAGAAAG GATTTCAATT TCCTCACGCC CTTCCGGCGT

151 GTTTAAAACC ACTTCGTCGC CTTCACGCGC TTTAATCAGA CAACGAGCCA

201 GCGGCGAAAT CCAAGAAATT TTGTTTTGCG CGGTATCGAT TTCATCGATG

251 CCGACGATTT TGACGGTTTG CTCGCGCCCG TCGCCGCGCA ACAGACCGAC

301 GGTCGCGCCG AAAAACACTT GGTCGGTCGC TTCGCGCAAT TCGGGATCAA

351 CGACGACGGC GGCTTCCAAA CGCTTGGTCA GGAAACGGAT GCGGCGGTCG

401 ATTTCGCGCA TACGGCGTTT GCCGTAAAGG TAGTCGCCGT TTTCGCTGCG

451 GTCGCCGTTG CCTGCCGCCC AGTTGACGAT TTGGACGATT TCGGGGCGTT

501 CTTTATTAAC CAGTTGATAA AGCTCGTCTT TCAATGCCTG CCATCCGGCG

551 GGCGTAATGT AGTTTTTGGT TTCGGTACTC ATATTGTGTG CGGATGA
```

This corresponds to the amino acid sequence <SEQ ID 2230; ORF 677.a>:

```
a677.pep

1 MPQILVRIFL IRYSFIWETA RLCRFRRHSR SVDFDVFDRK DFNFLTPFRR

51 V*NHFVAFTR FNQTTSQRRN PRNFVLRGID FIDADDFDGL LAPVAAQQTD

101 GRAEKHLVGR FAQFGINDDG GFQTLGQETD AAVDFAHTAF AVKVVAVFAA

151 VAVACRPVDD LDDFGAFFIN QLIKLVFQCL PSGGRNVVFG FGTHIVCG*
```

(In a677.pep, "AF AVKVVAVFAA" at residues 139–150 and "VAVAC" at 151–155 are underlined.)

```
 m677/a677 93.4% identity in 198 aa overlap 10        20        30        40        50        60
m677.pep    MPQILVRIFLIRYSFIWETARFCRFRRHSRSVDFDVFDRKDFNFLTPFRRVQNHFVAFAR
            |||||||||||||||||||||:||||||||||||||||||||||||||||| ||||||:|
a677        MPQILVRIFLIRYSFIWETARLCRFRRHSRSVDFDVFDRKDFNFLTPFRRVXNHFVAFTR
                    10        20        30        40        50        60

70        80        90       100       110       120
m677.pep    FNQTTSQRRNPRNFVLRGIDFIDADDFDGLLAPVVAQQSDRRAEKHLVGRFAQFGIDDDG
            ||||||||||||||||||||||||||||||||||:|||:| |||||||||||||||:|||
a677        FNQTTSQRRNPRNFVLRGIDFIDADDFDGLLAPVAAQQTDGRAEKHLVGRFAQFGINDDG
                    70        80        90       100       110       120

130       140       150       160       170       180
m677.pep    SLQTFGQETDAAVDFAHTAFAVKIVAVFAAVAVACRPVDDLDDFGAFFVDQLIKLVFQCL
            ::||:||||||||||||||||||:||||||||||||||||||||||||::||||||||||
a677        GFQTLGQETDAAVDFAHTAFAVKVVAVFAAVAVACRPVDDLDDFGAFFINQLIKLVFQCL
                   130       140       150       160       170       180
```

```
                  190       199
m677.pep  PSGGRNVVFGFGTHIVCGX
          ||||||||||||||||||
  a677    PSGGRNVVFGFGTHIVCGX
                  190
```

The following partial DNA sequence was identified in *N. gonorrhoeae* <SEQ ID 2231>:

```
g678.seq
   1 ATGAATAGCC TCCCCATTGC CGACCTCCTC GCCTccgCCG TCATCGCCGC

51 CTGCATCGTC ATTTCCACGA TGCGCGGCGT GATTGCGGAA GCAggttcGA

101 TGGTgGCATG ggtggTTTcc tTCTTTTttg ccAAACTCTt tGCCGCACcc 151 ttcgccgACC TCGCCTTTGc ctCGTTCCAA ccccgccTGT TTGCAttggc 201 tCTGTCATTC ATTTCCCTGT TCGTCATTGC CTGTCTGATC CAGAAAATGC

251 TCCGTTCGCT GCTGACCGGC GCAGTTTCGG CGGTCGGTCT GGGCTTTGCC

301 AACCGCATTT GGGCGGTGT ATTCGGTGCA TTGAAAGGCG TTTTGATTGT

351 TACCCTGCTG ATCATGCTTG CTTCAAAAAC CGACCTGCCC GATACCGAAG

401 AATGGCAACA GTCCTATACC GTACCGTTTT TCGTATCGCT TTCCGAAGCG

451 GTGTTAAACC atacggaCAA CGCacccgaa tCCCtcgacg acgactaa
```

This corresponds to the amino acid sequence <SEQ ID 2232; ORF 678.ng>:

```
g678.pep
   1 MNSLPIADLL ASAVIAACIV ISTMRGVIAE AGSMVAWVVS FFFAKLFAAP

51 FADLAFASFQ PRLFALALSF ISLFVIACLI QKMLRSLLTG AVSAVGLGFA

101 NRILGGVFGA LKGVLIVTLL IMLASKTDLP DTEEWQQSYT VPFFVSLSEA

151 VLNHTDNAPE SLDDD*
```

The following partial DNA sequence was identified in *N. meningitidis* <SEQ ID 2233>:

```
m678.seq
   1 ATGAATAGCC TCCCCATTGC CGACCTCCTC GTCTCCGCCG TCATCGCCGC

51 CTGCATCGTG CTATCCGCGA TGCGCGGCGT GATTGCGGAG GCAGGCTCAA

101 TGGCGGCATG GGTGGTTTCC TTCTTTTTCG CCAAACTCTT TGCCGCCTCC

151 TTCGCCGACC TCGCCTTTGC CTCGTTCCAA CCCCGCCTGT TGCATTGGC

201 TCTGTCGTTC ATTTCCCTGT TCGTCATTGC CTGTCTGATC CAGAAAATGC

251 TCCGTTCGCT GCTGACCAGC GCAGTTTCGG CGGTCGGTTT GGGCTTTGCC

301 AACCGCATTT GGGCGGCGT ATTCGGTGCA TTGAAAGGCG TTTTGATTGT

351 TACCCTGCTG GTCATGCTTG CTTCAAAAAC CGACCTGCCC GATACCGAAG

401 AATGGCGGCA ATCTTACACA CTGCCGTTTT TCGTATCGCT TTCCGAAGCC

451 GTGTTGAACC ATAGCGGCGG CACGGCGGAA ACTCCGGAAG ACGATTGA
```

This corresponds to the amino acid sequence <SEQ ID 2234; ORF 678>:

```
m678.pep
  1 MNSLPIADLL VSAVIAACIV LSAMRGVIAE AGSMAAWVVS FFFAKLFAAS

51 FADLAFASFQ PRLFALALSF ISLFVIACLI QKMLRSLLTS AVSAVGLGFA

101 NRILGGVFGA LKGVLIVTLL VMLASKTDLP DTEEWRQSYT LPFFVSLSEA

151 VLNHSGGTAE TPEDD*
```

Computer analysis of this amino acid sequence gave the following results:
Homology with a Predicted ORF from *N. gonorrhoeae*

```
    m678/g678  89.7% identity in 165 aa overlap 10         20         30         40         50         60
    m678.pep  MNSLPIADLLVSAVIAACIVLSAMRGVIAEAGSMAAWVVSFFFAKLFAASFADLAFASFQ
              |||||||||:||||||||||:|:||||||||:||||||||||||||||| ||||||||||
    g678      MNSLPIADLLASAVIAACIVISTMRGVIAEAGSMVAWVVSFFFAKLFAAPFADLAFASFQ
                 10         20         30         40         50         60

70         80         90        100        110        120
    m678.pep  PRLFALALSFISLFVIACLIQKMLRSLLTSAVSAVGLGFANRILGGVFGALKGVLIVTLL
              ||||||||||||||||||||||||||||||:|||||||||||||||||||||||||||||
    g678      PRLFALALSFISLFVIACLIQKMLRSLLTGAVSAVGLGFANRILGGVFGALKGVLIVTLL
                 70         80         90        100        110        120

130        140        150        160
    m678.pep  VMLASKTDLPDTEEWRQSYTLPFFVSLSEAVLNHSGGTAETPEDDX
              :|||||||||||||||:||||:||||||||||||| :: |: :|||
    g678      IMLASKTDLPDTEEWQQSYTVPFFVSLSEAVLNHTDNAPESLDDDX
                130        140        150        160
```

The following partial DNA sequence was identified in *N. meningitidis* <SEQ ID 2235>:

```
a678.seq
  1 ATGAATAACC TCCCCGTTGC CGACCTCCTC GTCTCCGCCA TCATCGCCGC

51 CTGCATCGTG CTATCCGCGA TGCGCGGCGT GATTGCGGAG GCTGGCTCAA

101 TGGCGGCATG GGTGGTTGCC TTTTTTTTCG CCAAACTCTT TGCCGCACCC

151 TTCGCCGACA TCGCCTTTGC ATCGTTCCAA CCCCGCCTGT TTGCATTGGC

201 TCTGTCGTTC ATTTCCCTAT TCGTCATTGC CTGTCTGATC CAGAAAATAC

251 TCCGCTCGCT GCTGACCGGG GCAGTTTCGG CGGTCGGTTT GGGCTTTGCC

301 AACCGCATTT TGGGCGGCGT ATTCGGTGCA TTGAAAGGCA TTTTGATTAT

351 TACCCTGCTG GTCATGCTCG CTTCAAAAAC CGACCTGCCC GATACCGAAG

401 AATGGCGGCA ATCTTACACA CTGCCGTTTT TCGTATCGCT TTCCGAAGCC

451 GTGTTGAACC ATAGCGGCGG CACGGCGGAA ACTCCGGAAG ACGATTGA
```

This corresponds to the amino acid sequence <SEQ ID 2236; ORF 678.a>:

```
a678.pep
      1 MNNLPVADLL VSAIIAACIV LSAMRGVIAE AGSMAAWVVA FFFAKLFAAP

51 FADIAFASFQ PRLFALALSF ISLFVIACLI QKILRSLLTG AVSAVGLGFA

101 NRILGGVFGA LKGILIITLL VMLASKTDLP DTEEWRQSYT LPFFVSLSEA

151 VLNHSGGTAE TPEDD* m678/a678  93.9% identity in 165 aa overlap
```

```
            10         20         30         40         50         60
m678.pep MNSLPIADLLVSAVIAACIVLSAMRGVIAEAGSMAAWVVSFFFAKLFAASFADLAFASFQ
         ||:||:||||||:||||||||||||||||||||||:||||||||| |||:||||||
a678     MNNLPVADLLVSAIIAACIVLSAMRGVIAEAGSMAAWVVAFFFAKLFAAPFADIAFASFQ
            10         20         30         40         50         60

70         80         90        100        110        120
m678.pep PRLFALALSFISLFVIACLIQKMLRSLLTSAVSAVGLGFANRILGGVFGALKGVLIVTLL
         |||||||||||||||||||||:|||||:||||||||||||||||||||||||:||:|||
a678     PRLFALALSFISLFVIACLIQKILRSLLTGAVSAVGLGFANRILGGVFGALKGILIITLL
            70         80         90        100        110        120

130        140        150        160
m678.pep VMLASKTDLPDTEEWRQSYTLPFFVSLSEAVLNHSGGTAETPEDDX
         ||||||||||||||||||||||||||||||||||||||||||||||
a678     VMLASKTDLPDTEEWRQSYTLPFFVSLSEAVLNHSGGTAETPEDDX
           130        140        150        160
```

The following partial DNA sequence was identified in *N. gonorrhoeae* <SEQ ID 2237>:

```
g680.seq
   1 ATGACGAAGG GCAGTTCGGC GATGTCCAGC CCACGCGCGG CGATATCGGT

51 GGCGACGAGG ACGCGCAGGC TGCCGTCTTT GAAGGCGTTG AGTGTTTCGA

101 GCCTGCTTTG TTGGGAACGG TCGCCGTGTA TCGCCTGTGC GGACAGGTTG

151 CGGCGCACCA GTTCGCGCGT TACGCGGTCG ACGCTTTGTT TGGTtttgCA

201 AAAGACGATA ACTTGGTTCA TATGCAGATC GACAATCAGC CGTTCGAGCA

251 GGTTGCGCTT TTGGAAGGTA TCGACGGCGA TGATGTgttg ttcGACGTTG

301 GCGTTGGTGG TGTTTTGGGC GGCAACCTCG ACGGTTTCGG GCGCGTTCAT

351 GAAGTCTTGC GCCAGTTTGC GTATCGGTGC GGAGAAGGTG GCGGAAAAGA

401 GCAGGGTTTG GCGTTGGCGG GGCAGCATCT GCATGATTTT GCGGATGTCG

451 TCGATAAACC CCATATCCAA CATGCGGTCT GCTTCGTCCA GAACGACGAT

501 TTCGGCTTTG TTTAAACTGA TGTTTTTCTG TTTCACATGG TCGAGCAGCC

551 GTCCGACGGT GGCGACGACT ATTTCGCAGC CGGCACGCAG GTCGGCGGTT

601 TGTTTGTCCA TGTTGACACC GCCGAAGAGG ACGGTATGCC GCAGCGGCAG

651 GTTTTTAATg tag
```

This corresponds to the amino acid sequence <SEQ ID 2238; ORF 680.ng>:

```
g680.pep
   1 MTKGSSAMSS PRAAISVATR TRRLPSLKAL SVSSLLCWER SPCIACADRL

51 RRTSSRVTRS TLCLVLQKTI TWFICRSTIS RSSRLRFWKV STAMMCCSTL

101 ALVVFWAATS TVSGAFMKSC ASLRIGAEKV AEKSRVWRWR GSICMILRMS

151 SINPISNMRS ASSRTTISAL FKLMFFCFTW SSSRPTVATT ISQPARRSAV

201 CLSMLTPPKR TVCRSGRFLM *
```

The following partial DNA sequence was identified in *N. meningitidis* <SEQ ID 2239>:

```
m680.seq
   1 ATGACGAAGG GCAGTTCGGC AATGTCCAGC CCGCGCGCGG CGATGTCGGT

51 GGCGACGAGG ACGCGCAGGT TGCCGTCTTT GAAGGCGTTG AGTGTTTCGA

101 GCCGGCTTTG TTGGGAACGG TCGCCGTGTA TCGCCTGTGC GGACAGGTTG
```

-continued

```
151 CGGCGCACCA GTTCGCGCGT TACGCGGTCG ACGCTTTGTT TGGTTTTGCA

201 GAACACGATG ACCTGGTTCA TATGCAAATC GACAATCAGC CGTTCGAGCA

251 GGTTGCGCTT CTGAATGGTA TCGACGGCGA TGATGTGCTG CTCGACGTTG

301 GCGTTGGTGG TGTTTTGCGC GGCGACTTCG ACGGTTTCGG GCGCGTTCAT

351 GAAGTCTTGC GCCAGTTTGC GTATCGGGGC GGAGAAGGTG GCGGAAAAGA

401 GCAGGGTTTG GCGTTGGCGG GGCAGCATCT GCATGATTTT GCGGATGTCG

451 TCGATAAAAC CCATATCCAG CATACGGTCG GCTTCGTCCA AAACGACGAT

501 TTCGACTTTG TTCAAATGGA TGTTTTTCTG TTTCACGTGG TCGAGCAGCC

551 GTCCGACGGT GGCGACGACG ATTTCGCAGC CGGCACGCAG GTCGGCGGTC

601 TGTTTGTCCA TATTCATACC GCCGAACAAG ACGGTGTGGC GCAGCGGCAG

651 GTTTTTGATG TAG
```

This corresponds to the amino acid sequence <SEQ ID 2240; ORF 680>:

```
m680.pep
  1 MTKGSSAMSS PRAAMSVATR TRRLPSLKAL SVSSRLCWER SPCIACADRL

51 RRTSSRVTRS TLCLVLQNTM TWFICKSTIS RSSRLRF*MV STAMMCCSTL

101 ALVVFCAATS TVSGAFMKSC ASLRIGAEKV AEKSRVWRWR GSICMILRMS

151 SIKPISSIRS ASSKTTISTL FKWMFFCFTW SSSRPTVATT ISQPARRSAV

201 CLSIFIPPNK TVWRSGRFLM *
```

Computer analysis of this amino acid sequence gave the following results:

Homology with a Predicted ORF from *N. gonorrhoeae*

```
    m680/g680 90.9% identity in 220 aa overlap 10         20         30         40         50         60
    m680.pep  MTKGSSAMSSPRAAMSVATRIRRLPSLKALSVSSRLCWERSPCIACADRLRRTSSRVTRS
              ||||||||||||:|||||||||||||||||||:|||||||||||||||||||||||||||
    g680      MTKGSSAMSSPRAAISVATRIRRLPSLKALSVSSLLCWERSPCIACADRLRRTSSRVTRS
                 10         20         30         40         50         60

70         80         90        100        110        120
    m680.pep  TLCLVLQNTMTWFICKSTISRSSRLRFXMVSTAMMCCSTLALVVFCAATSTVSGAFMKSC
              ||||||:|||||||||:|||||||||||||| |||||||||||||||:||||||||||||
    g680      TLCLVLQKTITWFICRSTISRSSRLRFWKVSTAMMCCSTLALVVFWAATSTVSGAFMKSC
                 70         80         90        100        110        120

130        140        150        160        170        180
    m680.pep  ASLRIGAEKVAEKSRVWRWRGSICMILRMSSIKPISSIRSASSKTTISTLFKWMFFCFTW
              |||||||||||||||||||||||||||||||:|||::||||:|||||:|||||||||||
    g680      ASLRIGAEKVAEKSRVWRWRGSICMILRMSSINPISNMRSASSRTTISALFKLMFFCFTW
                130        140        150        160        170        180

190        200        210        220
    m680.pep  SSSRPTVATTISQPARRSAVCLSIFIPPNKTVWRSGRFLMX
              ||||||||||||||||||||||||::||::||||||||||
    g680      SSSRPTVATTISQPARRSAVCLSMLTPPKRTVCRSGRFLMX
                190        200        210        220
```

The following partial DNA sequence was identified in *N. meningitidis* <SEQ ID 2241>:

```
a680.seq
  1 ATGACGAAGG GCAGTTCGGC AATATCCAGC CCCCGCGCGG CGATATCGGT

51 GGCGACGAGG ACGCGCAGGT TGCCGTCTTT GAAGGCGTTG AGTGTTTCGA
```

-continued

```
101 GCCGGCTTTG TTGGGAACGG TCGCCGTGTA TCGCCTGTGC GGACAGGTTG

151 CGGCGCACCA GTTCGCGCGT TACGCGGTCG ACGCTTTGTT TGGTTTTGCA

201 GAACACGATG ACCTGGTTCA TATGCAAATC GACAATCAGC CGTTCGAGCA

251 GGTTGCGCTT CTGAATGGTA TCGACGGCGA TGATGTGCTG CTCGACGTTG

301 GCGTTGGTGG TGTCTTGCGC GGCGACTTCG ACGGTTTCGG GCGCGTTCAT

351 GAAGTCTTGC GCCAGTTTGC GTATCGGGGC GGAGAAGGTG GCGGAAAAGA

401 GCAGGGTTTG GCGTTGGCGG GGCAGCATCT GCATGATTTT GCGGATGTCG

451 TCGATAAAAC CCATATCCAG CATACGGTCG GCTTCGTCCA AAACGACGAT

501 TTCGACTTTG TTCAAATGGA TGTTTTTCTG TTTCACGTGG TCGAGCAGCC

551 GTCCGACGGT GGCGACGACG ATTTCGCAGC CGGCACGCAG GTCGGCGGTC

601 TGTTTGTCCA TATTCATACC GCCGAACAAG ACGGTGTGGC GCAGCGGCAG

651 GTTTTTGATG TAG
```

This corresponds to the amino acid sequence <SEQ ID 2242; ORF 680.a>:

```
a680.pep

1 MTKGSSAISS PRAAISVATR TRRLPSLKAL SVSSRLCWER SPCIACADRL

51 RRTSSRVTRS TLCLVLQNTM TWFICKSTIS RSSRLRF*MV STAMMCCSTL

101 ALVVSCAATS TVSGAFMKSC ASLRIGAEKV AEKSRVWRWR GSICMILRMS

151 SIKPISSIRS ASSKTTISTL FKWMFFCFTW SSSRPTVATT ISQPARRSAV

201 CLSIFIPPNK TVWRSGRFLM * m680/a680 98.6% identity in 220 aa overlap 10         20         30         40         50         60
m680.pep MTKGSSAMSSPRAAMSVATRTRRLPSLKALSVSSRLCWERSPCIACADRLRRTSSRVTRS
         ||||||:||||||:||||||||||||||||||||||||||||||||||||||||||||||
a672     MTKGSSAISSPRAAISVATRTRRLPSLKALSVSSRLCWERSPCIACADRLRRTSSRVTRS
                10         20         30         40         50         60

70         80         90        100        110        120
m680.pep TLCLVLQNTMTWFICKSTISRSSRLRFXMVSTAMMCCSTLALVVFCAATSTVSGAFMKSC
         |||||||||||||||||||||||||||||||||||||||||||| |||||||||||||||
a680     TLCLVLQNTMTWFICKSTISRSSRLRFXMVSTAMMCCSTLALVVSCAATSTVSGAFMKSC
                70         80         90        100        110        120

130        140        150        160        170        180
m680.pep ASLRIGAEKVAEKSRVWRWRGSICMILRMSSIKPISSIRSASSKTTISTLFKWMFFCFTW
         ||||||||||||||||||||||||||||||||||||||||||||||||||||||||||||
a680     ASLRIGAEKVAEKSRVWRWRGSICMILRMSSIKPISSIRSASSKTTISTLFKWMFFCFTW
               130        140        150        160        170        180

190        200        210        220
m680.pep SSSRPTVATTISQPARRSAVCLSIFIPPNKTVWRSGRFLMX
         ||||||||||||||||||||||||||||||||||||||||
a680     SSSRPTVATTISQPARRSAVCLSIFIPPNKTVWRSGRFLMX
               190        200        210        220
```

The following partial DNA sequence was identified in *N. gonorrhoeae* <SEQ ID 2243>:

```
g681.seq
    1 ATGACGACGC CGATGGCAAT CAGTGCGTCA AATTTTTCGG AAGAGGCAAA

51 GTTCATCAGC GCGATGGGGA TTTCAAGCGC GCCGGGTACG GTGGcgacgg 101 tgatgtTTTC GTCTGCTACG CCCAATTCTT GGAGGGTGCG GCAGCAGACT

151 TTGAGCATTT GGCTGCCGAT TTCGTTGGTG AAGCGTGCCT GTACGATGCC
```

-continued

```
201 GATGCGGAGG TGTTTGCcgt cgaggttgGG GGCGATGGTG TTCATTGGGT

251 GTCCTTTGGT ATTCGGGGTT TCGGAATGCC GTCTGAAGGT TTCAGTCTTG

301 CGGCTGCCAG TCGGCAACGG TTTGGAATGT GCCGTCTTCG GCAAGCTCCC

351 ACGCGCTGCC TTCGGGTTGG GAAAGCAGTG CGGCGGTTTC AGGGTTGGTT

401 TTGGTGATGT CGGCGAGGCT GACGATGCTG AAGTTGTCGG GGTCGTCGGT

451 GTATTCGTCG GTTTCGTCGC CGCTGAAGAA ACGCCAGCCG CTGTCGTTTT

501 CAAAAACGGG GGCTTCGCGG TAAAGGAAGC CGACGGGCCG GTTTTGTTTG

551 GCGACGGTGT TGGTGGCGAT GCAGCGGTCG AGTGCCGAGG AAAGTGCTTG

601 TGCAAATGCG TTCATTGCGG GAATACGTTG GGGGGGGGGA AACTTGCGGA

651 TTTTACCACG ATTCCCGCGT TGTCGGCAGA CGGCGGCGGT TTGGTGGTAC

701 AATGTGCGCC GTTTGCAGCC TTAAGGTGTT TCTGTATTTT TGGAGTATGG

751 AAACGCATTC GGGCTGTTTT TTGCGGAAGA CGGTAA
```

This corresponds to the amino acid sequence <SEQ ID 2244; ORF 681>:

```
g681.pep
  1 MTTPMAISAS NFSEEAKFIS AMGISSAPGT VATVMFSSAT PNSWRVRQQT
 51 LSIWLPISLV KRACTMPMRR CLPSRLGAMV FIGCPLVFGV SECRLKVSVL
101 RLPVGNGLEC AVFGKLPRAA FGLGKQCGGF RVGFGDVGEA DDAEVVGVVG

151 VFVGFVAAEE TPAAVVFKNG GFAVKEADGP VLFGDGVGGD AAVECRGKCL

201 CKCVHCGNTL GGGKLADFTT IPALSADGGG LVVQCAPFAA LRCFCIFGVW

251 KRIRAVFCGR R*
```

The following partial DNA sequence was identified in *N. meningitidis* <SEQ ID 2245>:

```
m681.seq
  1 ATGACGACGC CGATGGCAAT CAGTGCGTCA AACTTTTCGG AAGAGGCAAA
 51 GTTCATCAGC GCGATGGGGA TTTCAAGCGC GCCGGGTACG GTGGCGACGG
101 TAATGTTTTC GTCTGCCACG CCCAATTCTT GGAGGGTGCG GCAGCAGACT
151 TTGAGCATTT CGCTGCCGAT TTCGTTGGTG AAGCGTGCCT GTACGATGCC
201 GATGCGGAGG TGTTTGCCGT CGAGGTTGGG GGCGATGGTG TTCATTGGGT
251 GTCCTTTGGT ATTCGGAGTT TCGGAATGCC GTCTGAAGGT TTCAGTCTTG
301 CGGCTGCCAG TCGGCGACGG TTTGGAATGT GCCGTCTTCG GCAAGCTCCC
351 ATGCGCTGCC TTCGGGTTGG GAGAGCAGTG CGGCGGTTTC AGGGTTGGTT
401 TTGGCGATGT CGGCGAGGCT GACGATGCTG AAGTTGTCCG GATCGTCGGT
451 GTATTCGTCG GTCTCGTCGC CGCTGAAGAA ACGCCAGCCG CTGTCGTTTT
501 CAAAAACGGG GGCTTCGCGG TAGAGGAAGC CGACGGGCCG GTTTTGTTTG
551 GCGACGGTGT TGGTGGCGAT ACAGCGGTCG AGTGCCGAGG AAAGTGCTTG
601 TGCAAATGCG TTCATTACGG GAATACGTTG GGGG.AAAAC TTACGGATTT
651 TACCACGATT CGTGCGTTGT CGGCAGACGG CGGCGGTTTG GTGGTACAAT
701 GTGCGCCGTT TGCAGCCTTA AGGTGTTTCT GTATTTTTGG AGTATGGAAA
751 CGCATTCGGG CTGTTTTTTG CGGAAGACGG TAA
```

This corresponds to the amino acid sequence <SEQ ID 2246; ORF 681>:

```
m681.pep
    1 MTTPMAISAS NFSEEAKFIS AMGISSAPGT VATVMFSSAT PNSWRVRQQT

51 LSISLPISLV KRACTMPMRR CLPSRLGAMV FIGCPLVFGV SECRLKVSVL

101 RLPVGDGLEC AVFGKLPCAA FGLGEQCGGF RVGFGDVGEA DDAEVVRIVG

151 VFVGLVAAEE TPAAVVFKNG GFAVEEADGP VLFGDGVGGD TAVECRGKCL

201 CKCVHYGNTL GXKLTDFTTI RALSADGGGL VVQCAPFAAL RCFCIFGVWK

251 RIRAVFCGRR *
```

Computer analysis of the amino acid sequences gave the following results:

Homology with a Predicted ORF from *N. meningitidis* menA with menB ORF 681 shows 94.6% identity over a 261 aa overlap with a predicted ORF (ORF681.a) from *N. gonorrhoeae*:

```
    m681/g681
                      10         20         30         40         50         60
    m681.pep  MTTPMAISASNFSEEAKFISAMGISSAPGTVATVMFSSATPNSWRVRQQTLSISLPISLV
              ||||||||||||||||||||||||||||||||||||||||||||||||| ||||||||||
    g681      MTTPMAISASNFSEEAKFISAMGISSAPGTVATVMFSSATPNSWRVRQQTLWISLPISLV
                      10         20         30         40         50         60

70         80         90        100        110        120
    m681.pep  KRACTMPMRRCLPSRLGAMVFIGCPLVFGVSECRLKVSVLRLPVGDGLECAVFGKLPCAA
              |||||||||||||||||||||||||||||||||||||||||||||||:||||||||| ||
    g681      KRACTMPMRRCLPSRLGAMVFIGCPLVFGVSECRLKVSVLRLPVGNGLECAVFGKLPCAA
                      70         80         90        100        110        120

130        140        150        160        170        180
    m681.pep  FGLGEQCGGFRVGFGDVGEADDAEVVRIVGVFVGLVAAEETPAAVVFKNGGFAVEEADGP
              ||||:|||||||||||||||||||||| :||||| :||||||||||||||||||| ||||
    g681      FGLGKQCGGFRVGFGDVGEADDAEVVGVVGVFVGFVAAEETPAAVVFKNGGFAVKEADGP
                     130        140        150        160        170        180

190        200        210        220        230        239
    m681.pep  VLFGDVGGDTAVECRGKCLCKCVHYGNTLGX-KLTDFTTIRALSADGGGLVVQCAPFAA
              ||||||||||:|||||||||||||:||||| || |:||||| ||||||||||||||||
    g681      VLFGDGVGGDAAVECRGKCLCKCVHCGNTLGGGKLADFTTIPALSADGGGLVVQCAPFAA
                     190        200        210        220        230        240

240        250        260
    m681.pep  LRCFCIFGVWKRIRAVFCGRRX
              ||||||||||||||||||||||
    g681      LRCFCIFGVWKRIRAVFCGRRX
                250        260
```

The following partial DNA sequence was identified in *N. meningitidis* <SEQ ID 2247>:

```
a681.seq
    1 ATAACGACGC CGATGGCAAT CAGTGCGTCA AATTTTTCAG AAGAGGCAAA

51 GTTCATCAGC GCGATGGGGA TTTCAAGCGC GCCGGGTACG GTGGCGACGG

101 TAATGTTTTC GTCTGCCACG CCCAATTCTT GGAGGGTGCG GCAGCAGACT

151 TTGAGCATTT CGCTGCCGAT TTCGTTGGTG AAGCGTGCCT GTACGATGCC

201 GATGCGGAGG TGTTTGCCGT CGAGGTTGGG GGCGATGGTG TTCATTGAGT

251 GTCCTTTGGT ATTCGGAGGT TCGGAATGC CGTCTGAAGG GTCAGTCCTT

301 AGGTTGCCAG TCGGCGACGG TTTGGAATGT GCCGTCTTCT GCCAATTCCC

351 ACGCGCTGCC TTCAGGTTGG GAGAGCAGTG CGGCGGTTTC AGGGTTGGTT

401 TTGGTGATAT CGGCGAGGCT GACGATGCTG AAGTTGTCCG GGTCGTCGGT
```

-continued

```
451 GTATTCGTCG GTCTCGTCGC CGCTGAAGAA ACGCCAGCCG CTGTCGTTTT

501 CAAAAACGGG GGCTTCGCGG TAGAGGAAGC CGACGGGCTG GTTTTGTTTG

551 GCGACGGTGT TGGTGGCGAT GCAGCGGTCG AGTGCCGAGG AAAGTGCTTG

601 TGCAAATGCG TTCATTGCGG GAATACGTT. GGGGGAAAAC TTGCGGATTT

651 TACCACGATT CTTGCGTTGT CGGCAGACGG CGGCGGTTTG GTGGTACAAT

701 GTGCGCCGTT TGCAGCCTTA AGGTGTTTCT GTATTTTTGG AGTATGGAAA

751 CGCATTCGGG CTGTTTTTTG CGGAAGACGG TAA
```

This corresponds to the amino acid sequence <SEQ ID 2248; ORF 681.a>:

```
a681.pep

1   ITTPMAISAS NFSEEAKFIS AMGISSAPGT VATVMFSSAT PNSWRVRQQT

51   LSISLPISLV KRACTMPMRR CLPSRLGAMV FIECPLVFGG FGMPSEGSVL

101   RLPVGDGLEC AVFCQFPRAA FRLGEQCGGF RVGFGDIGEA DDAEVVRVVG

151   VFVGLVAAEE TPAAVVFKNG GFAVEEADGL VLFGDGVGGD AAVECRGKCL

201   CKCVHCGNTX GGKLADFTTI LALSADGGGL VVQCAPFAAL RCFCIFGVWK

251   RIRAVFCGRR * m681/a681   90.8% identity in 260 aa overlap 10         20         30         40         50         60
m681.pep  MTTPMAISASNFSEEAKFISAMGISSAPGTVATVMFSSATPNSWRVRQQTLSISLPISLV
          :||||||||||||||||||||||||||||||||||||||||||||||||||||||||||
a681      ITTPMAISASNFSEEAKFISAMGISSAPGTVATVMFSSATPNSWRVRQQTLSISLPISLV
                 10         20         30         40         50         60

70         80         90        100        110        120
m681.pep  KRACTMPMRRCLPSRLGAMVFIGCPLVFGVSECRLKVSVLRLPVGDGLECAVFGKLPCAA
          ||||||||||||||||||||| ||||||   :  |||||||||||||||| ::|  ||
a681      KRACTMPMRRCLPSRLGAMVFIECPLVFGGFGMPSEGSVLRLPVGDGLECAVFCQFPRAA
                 70         80         90        100        110        120

130        140        150        160        170        180
m681.pep  FGLGEQCGGFRVGFGDVGEADDAEVVRIVGVFVGLVAAEETPAAVVFKNGGFAVEEADGP
          | |||||||||||||||:||||||||||:|||||||||||||||||||||||||||||||
a681      FRLGEQCGGFRVGFGDIGEADDAEVVRVVGVFVGLVAAEETPAAVVFKNGGFAVEEADGL
                130        140        150        160        170        180

190        200        210        220        230        240
m681.pep  VLFGDGVGGDTAVECRGKCLCKCVHYGNTLGXKLTDFTTIRALSADGGGLVVQCAPFAAL
          ||||||||||:||||||||||||||||  ||  |:|||| ||||||||||||||||||||
a681      VLFGDGVGGDAAVECRGKCLCKCVHCGNTXGGKLADFTTILALSADGGGLVVQCAPFAAL
                190        200        210        220        230        240

250        260
m681.pep  RCFCIFGVWKRIRAVFCGRRX
          |||||||||||||||||||||
a681      RCFCIFGVWKRIRAVFCGRRX
                250        260
```

The following partial DNA sequence was identified in *N. gonorrhoeae* <SEQ ID 2249>:

```
g682.seq
    1  ATGCGCGATT TCGCCGTATG GGTGCCTTAC GGGGAACGGC GGAAAAATTG

51  GGACATAAGG TATTGCCTCC CGCACCTTAT TCGCCTGAGC CCAACCCGAT

101  TGAGAAAGTG TGGGCGAATA TTAAGCGGTA TCTGCGAACC GTTTTGTCTG

151  ATTACGCCCG ATTTGACGAT GCACTACTGT CCTATTTTGA TTTTAATTGA

201  CTATATTTGT GTGAATGATG AAATAAAAAT GCCGTCTGAA CCCGATTGGA

251  TTCAGACGGC ATTTTGTATG GCAGGATTTA TTCGCTTTCC AACTGACCGA
```

-continued

```
301 CCTATTTTGA CAAGGCAGTC AGGCGTTGTT CGGATTTCGC CACGAACGGG

351 TTTTCGGTAT CCCACGCGTA GCCTGCCAAA ATCGAAGAAA GCATACGGCT

401 GA
```

This corresponds to the amino acid sequence <SEQ ID 2250; ORF 682>:

```
g682.pep
   1 MRDFAVWVPY GERRKNWDIR YCLPHLIRLS PTRLRKCGRI LSGICEPFCL

51 ITPDLTMHYC PILILIDYIC VNDEIKMPSE PDWIQTAFCM AGFIRFPTDR

101 PILTRQSGVV RISPRTGFRY PTRSLPKSKK AYG*
```

The following partial DNA sequence was identified in *N. meningitidis* <SEQ ID 2251>:

```
m682.seq
   1 ATGCGTGATT TCACCGTATG GGTGTCTTAC GGGAAATGGC GGAAAAATTG

51 GGACATAAGG TATTGCCTCT TGCACCTTAT TCACCTGAGC TCAACCCGAT

101 TGAGAAAGTG TGGGCGAATA TTAAGCGGTA TCTGCGAACC GTTTTGTCTG

151 ATTACGCCCG ATTTGACGAT GCACTACTGT CCTATTTTGA TTTTAATTGA

201 CTAT...... ......GAAA TGGCAATGCC GTCTGAACCC GATTGGATTC

251 AGACGGCATT TTGTATGGCG TACGGATTTA TTCGGTTTCC AACTGACCGA

301 CCCATTCGGA CAAGGCAGTC AGGCGTTGTT CGGATTTCGC CACGAACGGG

351 TTTTCGGTAT CCCACGCGTA GCCTGCCAAA ATCGAAGAAA GCATACGGCT

401 GA
```

This corresponds to the amino acid sequence <SEQ ID 2252; ORF 682>:

```
m682.pep
   1 MRDFTVWVSY GKWRKNWDIR YCLLHLIHLS STRLRKCGRI LSGICEPFCL

51 ITPDLTMHYC PILILIDY.. ..EMAMPSEP DWIQTAFCMA YGFIRFPTDR

101 PIRTRQSGVV RISPRTGFRY PTRSLPKSKK AYG*
```

Computer analysis of the amino acid sequences gave the following results:

Homology with a Predicted ORF from *N. meningitidis* menA with menB

ORF 682 shows 88.1% identity over a 134 aa overlap with a predicted ORF (ORF682.a) from *N. gonorrhoeae*:

```
   m682/g682

10         20         30         40         50         60
   m682.pep   MRDFTVWVSYGKWRKNWDIRYCLLHLIHLSSTRLRKCGRILSGICEPFCLITPDLTMHYC
              ||||:|||  ||: |||||||||| ||||:|| |||||||||||||||||||||||||||
   g682       MRDFAVWVPYGERRKNWDIRYCLPHPIRLSPTRLRKCGRILSGICEPFCLITPDLTMHYC
                     10         20         30         40         50         60

70        80         90        100        110
   m682.pep   PILILIDY-----EMAMPSEPDWIQTAFCMAYGFIRFPTDRPIRTRQSGVVRISPRTGFER
              ||||||||     |: |||||||||||||||| |||||||||| ||||||||||||||||
   g682       PILILIDYICVNDEIKMPSEPDWIQTAFCMA-GFIRFPTDRPILTRQSGVVRISPRTGFER
                         70        80         90        100        110
```

```
                120       130
    m682.pep  YPTRSLPKSKKAYGX
              |||||||||||||||
       g682   YPTRSLPKSKKAYGX
                120       130
```

The following partial DNA sequence was identified in *N. meningitidis* <SEQ ID 2253>:

```
a682.seq
   1 ATGCGCGATT TTACCGTATG GGTGTCTTAC GGGAAATGGC GGAAAAATTG

51 GGACATAAGG TATTGCCTCT TGCACCTTAT TCACCTGAGC TCAACCCGAT

101 TGAGAAAGTG TGGGCGAATA TTAAGCGGTA TCTGCGAACC GTTTTGTCTG

151 ATTACGCCCG ATTTGACGAT GCACTACTGT CCTATTTTGA TTTTAATTGA

201 ATAT...... .......... .......... .......... ..........

251 .......... .......... ......TATA TTCGGTTTCC AACTGACCGA

301 CCCATTCTGA CAAGGCCGAC AGGCGTTGTT CGGATTTCGC CACGAACGGG

351 TTTTCGGTAT CCCACGCGTA GCCTGCCAAA ATCGAAGAAA GCATACGGCT

401 GA
```

This corresponds to the amino acid sequence <SEQ ID 2254; ORF 682.a>:

```
    a682.pep

1 MRDFTVWVSY GKWRKNWDIR YCLLHLIHLS STRLRKCGRI LSGICEPFCL

51 ITPDLTMHYC PILILIEY.. .......... .......... ...YIRFPTDR

101 PILTRPTGVV RISPRTGFRY PTRSLPKSKK AYG* m682/a682 80.6% identity in 129 aa overlap 10         20         30         40         50         60
    m682.pep  MRDFTVWVSYGKWRKNWDIRYCLLHLIHLSSTRLRKCGRILSGICEPFCLITPDLTMHYC
              ||||||||||||||||||||||||||||||||||||||||||||||||||||||||||||
       a682   MRDFTVWVSYGKWRKNWDIRYCLLHLIHLSSTRLRKCGRILSGICEPFCLITPDLTMHYC
                  10         20         30         40         50         60

70         80         90        100        110        120
    m682.pep  PILILIDYEMAMPSEPDWIQTAFCMAYGFIRFPTDRPIRTRQSGVVRISPRTGFRYPTRS
              ||||||:|                  :||||||||  ::||||||||||||||||||||
       a682   PILILIEY------------------YIRFPTDRPILTRPTGVVRISPRTGFRYPTRS
                  70                         70         80         90        100

130
    m682.pep  LPKSKKAYGX
              ||||||||||
       a682   LPKSKKAYGX
                 110
```

The following partial DNA sequence was identified in *N. gonorrhoeae* <SEQ ID 2255>

```
g683.seq
   1 ATGATTAAGG AAACCCTAAT GCGCCCAATC TTCCTATCTT TCGTTTTACT

51 CCCTATTTTG ATAACCGCCT GCAGCACACC GGACAAGTCT GCCCGATGGG

101 AAAATATCGG CACAATCTCA AACGGCAATA TTCATACATA TATTAATAAA

151 GACAGTGTGA GAAAAAACGG AAATCTGATG ATTTTCCAAG ATAAAAAAGT

201 TGTTACCAAT CTGAAACAAG AACGTTTTGC CAACACCCCC GCATACAAGA
```

```
-continued
251 CTGCCATTGC CGAGTGGGAA ATCCACTGCA ACAACAAAAC ATACCGCTTA

301 AGTTCGCTAC AGTTATTTGA TACAAAAAAC ACGGAAATTT CCACACAAAA

351 CTACACAGCC TCTTCCCTCC GCCCGATGAG CATCCTGTCC GGGACATTAA

401 CTGAAAAACA ATATGAAACC GTATGCGGGA AAAAACTCTG A
```

This corresponds to the amino acid sequence <SEQ ID 2256; ORF 683>:

```
g683.pep
  1 MIKETLMRPI FLSFVLLPIL ITACSTPDKS ARWENIGTIS NGNIHTYINK

51 DSVRKNGNLM IFQDKKVVTN LKQERFANTP AYKTAIAEWE IHCNNKTYRL

101 SSLQLFDTKN TEISTQNYTA SSLRPMSILS GTLTEKQYET VCGKKL*
```

The following partial DNA sequence was identified in *N. meningitidis* <SEQ ID 2257>:

```
m683.seq..
  1 ATGATTAAGG AAACCCTAAT GCGCCCAATC TTCCTATCTT TCGTTTTATT

51 CCCTATTTTG ATAACCGCCT GCAGCACACC GGACAAGTCT GCCCGATGGG

101 AAAATATCGG CACAATCTCA ACGGCAATA TTCATACATA TATCAATAAA

151 GACAGCGTGA GAAAAACGG AAATCTGATG ATTTTCCAAG ATAAAAAGT

201 TGTTACCAAT CTAAAACAAG AACGTTTTGC CAACACCCCC GCATACAAGA

251 CTGCCATTGC CGAGTGGGAA ATCCACTGCA ACAACAAAAC ATACCGCTTA

301 AGTTCGCTAC AGTTGTTTGA TACAAAAAAC ACGGAAATTT CCACACAAAA

351 CTACACAGCC TCTTCCCTCC GCCCGATGAG CATCCTGTCC GGGACATTAA

401 CCGAAAAACA ATATGAAACC GTATGCGGAA AAAAACTCTG A
```

This corresponds to the amino acid sequence <SEQ ID 2258; ORF 683>:

```
m683.pep..
  1 MIKETLMRPI FLSFVLFPIL ITACSTPDKS ARWENIGTIS NGNIHTYINK

51 DSVRKNGNLM IFQDKKVVTN LKQERFANTP AYKTAIAEWE IHCNNKTYRL

101 SSLQLFDTKN TEISTQNYTA SSLRPMSILS GTLTEKQYET VCGKKL*
```

Computer analysis of this amino acid sequence gave the following results:
Homology with a Predicted ORF from *N. gonorrhoeae*
ORF 683 shows 99.3% identity over a 146 aa overlap with a predicted ORF (ORF 683) from *N. gonorrhoeae*:

```
   m683/g683  99.3% identity in 146 aa overlap 10         20         30         40         50         60
      m683.pep  MIKETLMRPIFLSFVLFPILITACSTPDKSARWENIGTISNGNIHTYINKDSVRKNGNLM
                ||||||||||||||||:||||||||||||||||||||||||||||||||||||||||||
      g683      MIKETLMRPIFLSFVLLPILITACSTPDKSARWENIGTISNGNIHTYINKDSVRKNGNLM
                   10         20         30         40         50         60

70         80         90        100        110        120
      m683.pep  IFQDKKVVTNLKQERFANTPAYKTAIAEWEIHCNNKTYRLSSLQLFDTKNTEISTQNYTA
                ||||||||||||||||||||||||||||||||||||||||||||||||||||||||||||
      g683      IFQDKKVVTNLKQERFANTPAYKTAIAEWEIHCNNKTYRLSSLQLFDTKNTEISTQNYTA
                   70         80         90        100        110        120
```

-continued

```
              130       140
m683.pep  SSLRPMSILSGTLTEKQYETVCGKKLX
          |||||||||||||||||||||||||||
g683      SSLRPMSILSGTLTEKQYETVCGKKLX
              130       140
```

The following partial DNA sequence was identified in *N. meningitidis* <SEQ ID 2259>

```
a683.seq
   1 ATGATTAAGG AAACCCTAAT GCGCCCAATC TTCCTATCTT TCGTTTTATT

51 CCCTATTTTG ATAACCGCCT GCAGCACACC GGACAAGTCT GCCCGATGGG

101 AAAATATCGG CACAATCTCA AACGGCAATA TTCATACATA TATCAATAAA

151 GACAGCGTGA GAAAAAACGG AAATCTGATG ATTTTCCNAG ATAAAAAAGT

201 TGTTACCAAT CTAAAACAAG AACGTTTTGC CNACACCCCC GCATACAAGA

251 CTGCCATTGC CGAGTGGGAA ATCCACTGCA ACAACAAAAC ATACCGCTTA

301 AGTTCGCTAC AATTGTTTGA TACAAAAAAC ACGGAAATTT CCACACAAAA

351 NTACACAGCC TCTTCCCTCC GCCCGATGAG CATCCTGTCC GGGACATTAA

401 CCGAAAAACA ATATGAAACC GTATGCGGAA AAAAACTCTG A
```

This corresponds to the amino acid sequence <SEQ ID 2260; ORF 683.a>:

```
a683.pep
   1 MIKETLMRPI FLSFVLFPIL ITACSTPDKS ARWENIGTIS NGNIHTYINK

51 DSVRKNGNLM IFXDKKVVTN LKQERFAXTP AYKTAIAEWE IHCNNKTYRL

101 SSLQLFDTKN TEISTQXYTA SSLRPMSILS GTLTEKQYET VCGKKL*
```

Computer analysis of this amino acid sequence gave the following results:

Homology with a Predicted ORF from *N. meningitidis*

ORF 683 shows 97.9% identity over a 146 aa overlap with a predicted ORF (ORF 683) from *N. meningitidis*:

```
m683/a683 97.9% identity in 146 aa overlap 10        20        30        40        50        60
m683.pep  MIKETLMRPIFLSFVLFPILITACSTPDKSARWENIGTISNGNIHTYINKDSVRKNGNLM
          ||||||||||||||||||||||||||||||||||||||||||||||||||||||||||||
a683      MIKETLMRPIFLSFVLFPILITACSTPDKSARWENIGTISNGNIHTYINKDSVRKNGNLM
                  10        20        30        40        50        60

70        80        90       100       110       120
m683.pep  IFQDKKVVTNLKQERFANTPAYKTAIAEWEIHCNNKTYRLSSLQLFDTKNTEISTQNYTA
          || |||||||||||||| |||||||||||||||||||||||||||||||||||||| |||
a683      IFXDKKVVTNLKQERFAXTPAYKTAIAEWEIHCNNKTYRLSSLQLFDTKNTEISTQXYTA
                  70        80        90       100       110       120

130       140
m683.pep  SSLRPMSILSGTLTEKQYETVCGKKLX
          |||||||||||||||||||||||||||
a683      SSLRPMSILSGTLTEKQYETVCGKKLX
                 130       140
```

The following partial DNA sequence was identified in *N. gonorrhoeae* <SEQ ID 2261>

```
g684.seq
  1  ATGCGCCTTT TCCCCATCGC CGCCGCCCTG ACGCTTGCCG CCTGCGGTAC
```

-continued

```
 51 TGTGCAAAGC ACACAATATT TCGTGTTGCC CGACAGCCGC TACATCCGTC

101 CTGCAACGCA AGGCGGCGAA ACCGCCGTCG AAGTCCGTCT TGCCGAACCG

151 CTCAAACGCG GCGGACTGGT CTATCAAACC GACCCCTACC GCATCAACAC

201 CGCACAAAAC CATGTTTGGG CAGACACCTT GGACGATATG CTCGAAGCGG

251 CGTTGAGCAA TGCATTCAAC CGTTTGGACA GCACACGCAC CTTTGTTCCT

301 GCCTCACGCA GCGGCAGTAC CGACAAATGG ACGGTCTATA TCGACGCATT

351 CCAAGGCAGC TACACGGGCA AAACCCTCAT CAGCGGCTAC GCCGTCCTAC

401 CCGACGGTAC GAACAGACCC TTCCATATCG AAACCGAACA GCAGGGTGAC

451 GGCTACGCCG CCATGACCGC CGCACTCGAA CAGGGACTGA AACAGGCGGC

501 GCAACAGATG GTCGAGTAA
```

This corresponds to the amino acid sequence <SEQ ID 2262; ORF 684>:

```
g684.pep
  1 MRLFPIAAAL TLAACGTVQS TQYFVLPDSR YIRPATQGGE TAVEVRLAEP

51 LKRGGLVYQT DPYRLNTAQN HVWADTLDDM LEAALSNAFN RLDSTRIFVP

101 ASRSGSTDKW TVYIDAFQGS YTGKTLISGY AVLPDGTNRP FHIETEQQGD

151 GYAAMTAALE QGLKQAAQQM VE*
```

The following partial DNA sequence was identified in *N. meningitidis* <SEQ ID 2263>:

```
m684.seq
  1 ATGCGCCTTT TCCCGATTGC CGCCGCCCTG TCGCTTGCCG CCTGCGGTAC

51 TGTGCAAAGC ACACAATATT TCGTGTTGCC CGACAGCCGC TACATCCGTC

101 CTGCAACGCA AGGCGGCGAA ACTGCCGTCG AAGTCCGTCT TGCCGAACCG

151 CTCAAACGCG GCGGACTGGT CTATCAAACC GACCCCTACC GCCTCAACAC

201 CGCACAAAAC CACGTCTGGG CAGACACCTT GGACGATATG CTCGAAGCGG

251 CGTTGAGCAA TGCATTCAAC CGTTTGGACA GCACACGCAT CTTTGTTCCT

301 GCCTCACGCA GCGGCAGTAC CGAAAAATGG ACGGTCTATA TCGACGCATT

351 CCAAGGCAGC TACACGGGCA AAACCCTCAT CAGCGGCTAC GCCGTCCTAC

401 CCGACGGTAC GAACAGACCC TTCCATATCG AAACCGAACA GCAGGGTGAC

451 GGCTACGCCG CGATGACCGC CGCACTCGAA CAGGGACTGA AACAGGCGGC

501 GCAACAGATG GTCGAGTAA
```

This corresponds to the amino acid sequence <SEQ ID 2264; ORF 684>:

```
m684.pep
  1 MRLFPIAAAL SLAACGTVQS TQYFVLPDSR YIRPATQGGE TAVEVRLAEP

51 LKRGGLVYQT DPYRLNTAQN HVWADTLDDM LEAALSNAFN RLDSTRIFVP

101 ASRSGSTEKW TVYIDAFQGS YTGKTLISGY AVLPDGTNRP FHIETEQQGD

151 GYAAMTAALE QGLKQAAQQM VE*
```

Computer analysis of this amino acid sequence gave the following results:

Homology with a Predicted ORF from *N. gonorrhoeae*
ORF 684 shows 97.7% identity over a 172 aa overlap with a predicted ORF (ORF 684) from *N. gonorrhoeae*:

```
m684/g684 97.7% identity in 172 aa overlap 10        20        30        40        50        60
m684.pep  MRLFPIAAALSLAACGTVQSTQYFVLPDSRYIRPATQGGETAVEVRLAEPLKRGGLVYQT
          ||||||||||:|||||||||||||||||||||||||||||||||||||||||||||||
g684      MRLFPIAAALTLAACGTVQSTQYFVLPDSRYIRPATQGGETAVEVRLAEPLKRGGLVYQT
                  10        20        30        40        50        60

70        80        90       100       110       120
m684.pep  DPYRLNTAQNHVWADTLDDMLEAALSNAFNRLDSTRIFVPASRSGSTEKWTVYIDAFQGS
          ||||:|||||||||||||||||||||||||||||||:||||||||||:||||||||||||
g684      DPYRINTAQNHVWADTLDDMLEAALSNAFNRLDSTRTFVPASRSGSTDKWTVYIDAFQGS
                  70        80        90       100       110       120

130       140       150       160       170
m684.pep  YTGKTLISGYAVLPDGTNRPFHIETEQQGDGYAAMTAALEQGLKQAAQQMVEX
          ||||||||||||||||||||||||||||||||||||||||||||||||||||
g684      YTGKTLISGYAVLPDGTNRPFHIETEQQGDGYAAMTAALEQGLKQAAQQMVEX
                 130       140       150       160       170
```

The following partial DNA sequence was identified in *N. meningitidis* <SEQ ID 2265>

```
a684.seq
   1 ATGCGCCTCT TCCCGATTGC CGCCGCCCTG ACGCTTGCCG CCTGCGGTAC

51 TGTGCAAAGC ACACAATATT TCGTGTTGCC CGACAGCCGC TACATCCGTC

101 CTGCAACGCA AGGCGGCGAA ACTGCCGTCG AAGTCCGTCT TGCCGAACCG

151 CTCAAACGCG GCGGACTGGT CTATCAAACC GACCCCTACC GCCTCAACAC

201 CGCACAAAAC CACGTCTGGG CAGACACCTT GGACGATATG CTCGAAGCGG

251 CGTTGAGCAA TGCATTCAAC CGTTTGGACA GCACACGCAT CTTTGTTCCT

301 GCCTCACGCA GCGGCAGTAC CGAAAAATGG ACGGTCTATA TCGACGCATT

351 CCAAGGCAGC TACACGGGCA AAACCCTCAT CAGCGGCTAC GCCGTCCTAC

401 CCGACGGTAC GAACAGACCC TTCCATATCG AAACCGAACA GCAGGGTGAC

451 GGCTACGCCG CCATGACCGC CGCACTCGAA CAGGGACTGA AACAGGCGGC

501 GCAACAGATG GTCGAGTAA
```

This corresponds to the amino acid sequence <SEQ ID 2266; ORF 684.a>:

```
a684.pep
   1 MRLFPIAAAL TLAACGTVQS TQYFVLPDSR YIRPATQGGE TAVEVRLAEP

51 LKRGGLVYQT DPYRLNTAQN HVWADTLDDM LEAALSNAFN RLDSTRIFVP

101 ASRSGSTEKW TVYIDAFQGS YTGKTLISGY AVLPDGTNRP FHIETEQQGD

151 GYAAMTAALE QGLKQAAQQM VE*
```

Computer analysis of this amino acid sequence gave the following results:
Homology with a Predicted ORF from *N. meningitidis*
ORF 684 shows 99.4% identity over a 172 aa overlap with a predicted ORF (ORF 684) from *N. meningitidis*

```
m684/a684  99.4% identity in 172 aa overlap 10        20        30        40        50        60
   m684.pep  MRLFPIAAALSLAACGTVQSTQYFVLPDSRYIRPATQGGETAVEVRLAEPLKRGGLVYQT
             ||||||||||:|||||||||||||||||||||||||||||||||||||||||||||||||
       a684  MRLFPIAAALTLAACGTVQSTQYFVLPDSRYIRPATQGGETAVEVRLAEPLKRGGLVYQT
                   10        20        30        40        50        60

70        80        90       100       110       120
   m684.pep  DPYRLNTAQNHVWADTLDDMLEAALSNAFNRLDSTRIFVPASRSGSTEKWTVYIDAFQGS
             ||||||||||||||||||||||||||||||||||||||||||||||||||||||||||||
       a684  DPYRLNTAQNHVWADTLDDMLEAALSNAFNRLDSTRIFVPASRSGSTEKWTVYIDAFQGS
                   70        80        90       100       110       120

130       140       150       160       170
   m684.pep  YTGKTLISGYAVLPDGTNRPFHIETEQQGDGYAAMTAALEQGLKQAAQQMVEX
             ||||||||||||||||||||||||||||||||||||||||||||||||||||
       a684  YTGKTLISGYAVLPDGTNRPFHIETEQQGDGYAAMTAALEQGLKQAAQQMVEX
                  130       140       150       160       170
```

The following partial DNA sequence was identified in *N. gonorrhoeae* <SEQ ID 2267>

```
g685.seq
    1 TTGTTTTGCC GTATCGGGAA TTTTGCGTTT TGCGGCGTGG TTTCTGCAGG

51 TTGTTTGCTT AATAATAAAC ATTCTTATTC GTATGCAAAG GAACCGCACA

101 CCGTGAAACC GCGTTTTTAT TGGGCAGcct GCGCCGTCCT GCCGGCCGCC

151 TGTTCGCCCG AACCTGCCGC CGAAAAAACT GTATccgCCG CATCCCAAGC

201 CGCATCCACA CCTGTCGCCA CGCTGACCGT GCCGACCGCG CGGGGCGATG

251 CCGTTGTGCC GAAGAATCCC GAACgcgtcg ccgtgtAcga CtggGCGGCG

301 TtggaTACGC TGACCGAGCC GGGCGTGAAT GTGGGCGCAA CCACCGCGCC

351 GGTGCGCGTG GACTATTTGC AGCCTGCATT TGACAAGGCG GCAACGGTGG

401 GGACGCTGTT TGAGCCCGAT TGCGAATCCC TGCACCGCCA CAATCCGCAG

451 TTTGTCATTA CCGGCGGGCC GGGTGCGGAA GCGTATGAAC AGTTGGCGAA

501 AAACGCGACC ACCATAGATT TGACGGTGGA CAACGGCAAT ATCCGCACCA

551 GCGGCGAGAA GCAGATGGAG ACCCTGTCGC GGATTTTCGG TAAGGAAGCG

601 CGCGTGGCGG AATTGAATGC GCAGATTGAC GCGCTGTTCG CCCAAAAGCG

651 CGAAGCCGCC AAAGGCAAAG GACGCGGGCT GGTGCTGTCG GTTACAGGCA

701 ACAAGGTGTC CGCCTTCGGC ACGCAATCGC GGTTGGCAAG TTGGATACAC

751 GGCGACATCG GCCTGCCGCC CGTGGACGAA TCTTTACGCA ACGAAGGGCA

801 CGGGCAGCCC GTTTCCTTCG AATACATCAA AGAGAAAAAC CCCGGCTGGA

851 TTTTCATCAT CGACCGCACC GCCGCCATCG GGCAGGAAGG GCCGGCTGCC

901 GTGGAAGTGT TGGATAACGC GCTGGTATGC GGCACGAACG CTTGGAAGCG

951 CAAGCAAATC ATCGTCATGC CTGCCGCGAA CTACATTGTC GCGGGCGGCG

1001 CGCGGCAGTT GATACAGGCG GCGGAACAGT TGAAGGCGGC GTTTGAAAAG

1051 GCAGAACCCG TTGCGGCGCA GTAG
```

This corresponds to the amino acid sequence <SEQ ID 2268; ORF 685>:

```
g685.pep
    1 LFCRIGNFAF CGVVSAGCLL NNKHSYSYAK EPHTVKPRFY WAACAVLPAA

51 CSPEPAAEKT VSAASQAAST PVATLTVPTA RGDAVVPKNP ERVAVYDWAA

101 LDTLTEPGVN VGATTAPVRV DYLQPAFDKA ATVGTLFEPD CESLHRHNPQ

151 FVITGGPGAE AYEQLAKNAT TIDLTVDNGN IRTSGEKQME TLSRIFGKEA

201 RVAELNAQID ALFAQKREAA KGKGRGLVLS VTGNKVSAFG TQSRLASWIH

251 GDIGLPPVDE SLRNEGHGQP VSFEYIKEKN PGWIFIIDRT AAIGQEGPAA

301 VEVLDNALVC GTNAWKRKQI IVMPAANYIV AGGARQLIQA AEQLKAAFEK

351 AEPVAAQ*
```

The following partial DNA sequence was identified in *N. meningitidis* <SEQ ID 2269>:

```
m685.seq
    1 TTGTTTTGCC GTATCGGGAA TTTTGCGTTT TGCGGCGTGG TTTCTGCAGG

51 TTGTTTGCTT AATAATAAAC ATTCTTATTC GTATGCAAAG GAACCGCACA

101 CCGTGAAACC GCGTTTTTAT TGGGCAGCCT GCGCCGTCCT GCTGACCGCC

151 TGTTCGCCCG AACCTGCCGC CGAAAAAACT GTATCCGCCG CATCCGCATC

201 TGCCGCCACG CTGACCGTGC CGACCGCGCG GGGCGATGCC GTTGTGCCGA

251 AGAATCCCGA ACGCGTCGCC GTGTACGACT GGGCGGCGTT GGATACGCTG

301 ACCGAATTGG GCGTGAATGT GGGCGCAACC ACCGCGCCGG TGCGCGTGGA

351 TTATTTGCAG CCTGCATTTG ACAAGGCGGC AACGGTGGGG ACGCTGTTCG

401 AGCCCGATTA CGAAGCCCTG CACCGCTACA ATCCTCAGCT TGTCATTACC

451 GGCGGGCCGG GCGCGGAAGC GTATGAACAG TTAGCGAAAA ACGCGACCAC

501 CATAGATCTG ACGGTGGACA ACGGCAATAT CCGCACCAGC GGCGAAAAGC

551 AGATGGAGAC CTTGGCGCGG ATTTTCGGCA AGGAAGCGCG CGCGGCGGAA

601 TTGAAGGCGC AGATTGACGC GCTGTTCGCC CAAACGCGCG AAGCCGCCAA

651 AGGCAAAGGA CGCGGGCTGG TGCTGTCGGT TACGGGCAAC AAGGTGTCCG

701 CCTTCGGCAC GCAGTCGCGG TTGGCAAGTT GGATACACGG CGACATCGGC

751 CTACCGCCTG TAGACGAATC TTTACGCAAC GAGGGGCACG GGCAGCCTGT

801 TTCCTTCGAA TACATCAAAG AGAAAAACCC CGATTGGATT TTCATCATCG

851 ACCGTACCGC CGCCATCGGG CAGGAAGGGC CGGCGGCTGT CGAAGTATTG

901 GATAACGCGC TGGTACGCGG CACGAACGCT TGGAAGCGCA AGCAAATCAT

951 CGTCATGCCT GCCGCGAACT ACATTGTCGC GGGCGGCGCG CGGCAGTTGA

1001 TTCAGGCGGC GGAGCAGTTG AAGGCGGCGT TTAAAAAGGC AGAACCCGTT

1051 GCGGCGGGGA AAAAGTAG
```

This corresponds to the amino acid sequence <SEQ ID 2270; ORF 685>:

```
m685.pep
    1 LFCRIGNFAF CGVVSAGCLL NNKHSYSYAK EPHTVKPRFY WAACAVLLTA

51 CSPEPAAEKT VSAASASAAT LTVPTARGDA VVPKNPERVA VYDWAALDTL
```

```
-continued
101 TELGVNVGAT TAPVRVDYLQ PAFDKAATVG TLFEPDYEAL HRYNPQLVIT

151 GGPGAEAYEQ LAKNATTIDL TVDNGNIRTS GEKQMETLAR IFGKEARAAE

201 LKAQIDALFA QTREAAKGKG RGLVLSVTGN KVSAFGTQSR LASWIHGDIG

251 LPPVDESLRN EGHGQPVSFE YIKEKNPDWI FIIDRTAAIG QEGPAAVEVL

301 DNALVRGTNA WKRKQIIVMP AANYIVAGGA RQLIQAAEQL KAAFKKAEPV

351 AAGKK*
```

Computer analysis of this amino acid sequence gave the following results:

Homology with a Predicted ORF from *N. gonorrhoeae*

ORF 685 shows 94.4% identity over a 356 aa overlap with a predicted ORF (ORF 685) from *N. gonorrhoeae*:

```
   m685/g685 94.4% identity in 356 aa overlap 10        20        30        40        50        60
   m685.pep LFCRIGNFAFCGVVSAGCLLNNKHSYSYAKEPHTVKPRFYWAACAVLLTACSPEPAAEKT
            ||||||||||||||||||||||||||||||||||||||||||||:|||||||||||||||
   g685     LFCRIGNFAFCGVVSAGCLLNNKHSYSYAKEPHTVKPRFYWAACACLPAACSPEPAAEKT
                  10        20        30        40        50        60

70        80        90       100       110
   m685.pep VSAASASA----ATLTVPTARGDAVVPKNPERVAVYDWAALDTLTELGVNVGATTAPVRV
            |||||:|     ||||||||||||||||||||||||||||||||||| ||||||||||||
   g685     VSAASQAASTPVATLTVPTARGDAVVPKNPERVAVYDWAALDTLTEPGVNVGATTAPVRV
                  70        80        90       100       110       120

120       130       140       150       160       170
   m685.pep DYLQPAFDKAATVGTLFEPDYEALHRYNPQLVITGGPGAEAYEQLAKNATTIDLTVDNGN
            |||||||||||||||||||||:|||:|||:||||||||||||||||||||||||||||||
   g685     DYLQPAFDKAATVGTLFEPDCESLHRHNPQFVITGGPGAEAYEQLAKNATTIDLTVDNGN
                 130       140       150       160       170       180

180       190       200       210       220       230
   m685.pep IRTSGEKQMETLARIFGKEARAAELKAQIDALFAQTREAAKGKGRGLVLSVTGNKVSAFG
            ||||||||||||||:|||||||:|||:|||||||| ||||||||||||||||||||||||
   g685     IRTSGEKQMETLSRIFGKEARVAELNAQIDALFAQKREAAKGKGRGLVLSVTGNKVSAFG
                 190       200       210       220       230       240

240       250       260       270       280       290
   m685.pep TQSRLASWIHGDIGLPPVDESLRNEGHGQPVSFEYIKEKNPDWIFIIDRTAAIGQEGPAA
            ||||||||||||||||||||||||||||||||||||||||||| ||||||||||||||||
   g685     TQSRLASWIHGDIGLPPVDESLRNEGHGQPVSFEYIKEKNPGWIFIIDRTAAIGQEGPAA
                 250       260       270       280       290       300

300       310       320       330       340       350
   m685.pep VEVLDNALVRGTNAWKRKQIIVMPAANYIVAGGARQLIQAAEQLKAAFKKAEPVAAGKKX
            |||||||||:||||||||||||||||||||||||||||||||||||||:|||||||
   g685     VEVLDNALVCGTNAWKRKQIIVMPAANYIVAGGARQLIQAAEQLKAAFEKAEPVAAQX
                 310       320       330       340       350
```

The following partial DNA sequence was identified in *N. meningitidis* <SEQ ID 2271>

```
a685.seq
   1 TTGTTTTGCC GTATCGGGAA TTTTGCGTTT TGCGGCGTGG TTTCTGCAGG

51 TTGTTTGCTT AATAATAAAC ATTCTTATTC GTATGCAAAG GAACCGCACA

101 CCGTGAAACC GCGTTTTTAT TGGGCAGCCT GCGCCGTCCT GCTGACCGCC

151 TGTTCGCCCG AACCTGCCGC CGAAAAAACT GTATCCGCCG CATCCGCATC

201 TGCCGCCACA CTGACCGTGC CGACCGCGCG GGGCGATGCC GTTGTGCCGA

251 AGAATCCCGA ACGCGTCGCC GTGTACGACT GGGCGGCGTT GGATACGCTG

301 ACCGAATTGG GTGTGAATGT GGGCGCAACC ACCGCGCCGG TGCGCGTGGA

351 TTATTTGCAG CCTGCATTTG ACAAGGCGGC AACGGTGGGG ACGCTGTTCG
```

```
401 AGCCCGATTA CGAAGCCCTG CACCGCTACA ATCCTCAGCT TGTCATTACC

451 GGCGGGCCGG GCGCGGAAGC GTATGAACAG TTGGCGAAAA ACGCGACCAC

501 CATAGATCTG ACGGTGGACA ACGGCAATAT CCGCACCAGC GGCGAAAAGC

551 AGATGGAGAC CTTGGCGCGG ATTTTCGGCA AGGAAGCGCG CGCGGCGGAA

601 TTGAAGGCGC AGATTGACGC GCTGTTCGCC CAAACGCGCG AAGCCGCCAA

651 AGGCAAAGGA CGCGGGCTGG TGCTGTCGGT TACGGGCAAC AAGGTGTCCG

701 CCTTCGGCAC GCAGTCGCGG TTGGCAAGTT GGATACACGG CGACATCGGC

751 CTACCGCCTG TAGACGAATC TTTACGCAAC GAGGGGCACG GGCAGCCTGT

801 TTCCTTCGAA TACATCAAAG AGAAAAACCC CGATTGGATT TTCATCATCG

851 ACCGTACCGC CGCCATCGGG CAGGAAGGGC CGGCGGCTGT CGAAGTATTG

901 GATAACGCGC TGGTACGCGG CACGAACGCT TGGAAGCGCA AGCAAATCAT

951 CGTCATGCCT GCCGCGAACT ACATTGTCGC GGGCGGCTCG CGGCAGTTGA

1001 TTCAGGCGGC GGAGCAGTTG AAGGAGGCGT TTGAAAAGGC AGAACCCGTT

1051 GCGGCGGGGA AAGAGTAG
```

This corresponds to the amino acid sequence <SEQ ID 2272; ORF 685.a>:

```
a685.pep
   1 LFCRIGNFAF CGVVSAGCLL NNKHSYSYAK EPHTVKPRFY WAACAVLLTA

51 CSPEPAAEKT VSAASASAAT LTVPTARGDA VVPKNPERVA VYDWAALDTL

101 TELGVNVGAT TAPVRVDYLQ PAFDKAATVG TLFEPDYEAL HRYNPQLVIT

151 GGPGAEAYEQ LAKNATTIDL TVDNGNIRTS GEKQMETLAR IFGKEARAAE

201 LKAQIDALFA QTREAAKGKG RGLVLSVTGN KVSAFGTQSR LASWIHGDIG

251 LPPVDESLRN EGHGQPVSFE YIKEKNPDWI FIIDRTAAIG QEGPAAVEVL

301 DNALVRGTNA WKRKQIIVMP AANYIVAGGS RQLIQAAEQL KEAFEKAEPV

351 AAGKE*
```

Computer analysis of this amino acid sequence gave the following results:

Homology with a Predicted ORF from *N. meningitidis*

ORF 685 shows 98.9% identity over a 355 aa overlap with a predicted ORF (ORF 685) from *N. meningitidis*:

```
   m685/a685  98.9% identity in 355 aa overlap 10         20         30         40         50         60
   m685.pep  LFCRIGNFAFCGVVSAGCLLNNKHSYSYAKEPHTVKPRFYWAACAVLLTACSPEPAAEKT
             ||||||||||||||||||||||||||||||||||||||||||||||||||||||||||||
   a685      LFCRIGNFAFCGVVSAGCLLNNKHSYSYAKEPHTVKPRFYWAACAVLLTACSPEPAAEKT
                 10         20         30         40         50         60

70         80         90        100        110        120
   m685.pep  VSAASASAATLTVPTARGDAVVPKNPERVAVYDWAALDTLTELGVNVGATTAPVRVDYLQ
             ||||||||||||||||||||||||||||||||||||||||||||||||||||||||||||
   a685      VSAASASAATLTVPTARGDAVVPKNPERVAVYDWAALDTLTELGVNVGATTAPVRVDYLQ
                 70         80         90        100        110        120

130        140        150        160        170        180
   m685.pep  PAFDKAATVGTLFEPDYEALHRYNPQLVITGGPGAEAYEQLAKNATTIDLTVDNGNIRTS
             ||||||||||||||||||||||||||||||||||||||||||||||||||||||||||||
   a685      PAFDKAATVGTLFEPDYEALHRYNPQLVITGGPGAEAYEQLAKNATTIDLTVDNGNIRTS
                130        140        150        160        170        180
```

```
                  190        200        210        220        230        240
m685.pep  GEKQMETLARIFGKEARAAELKAQIDALFAQTREAAKGKGRGLVLSVTGNKVSAFGTQSR
          ||||||||||||||||||||||||||||||||||||||||||||||||||||||||||||
a685      GEKQMETLARIFGKEARAAELKAQIDALFAQTREAAKGKGRGLVLSVTGNKVSAFGTQSR
                  190        200        210        220        230        240

250        260        270        280        290        300
m685.pep  LASWIHGDIGLPPVDESLRNEGHGQPVSFEYIKEKNPDWIFIIDRTAAIGQEGPAAVEVL
          ||||||||||||||||||||||||||||||||||||||||||||||||||||||||||||
a685      LASWIHGDIGLPPVDESLRNEGHGQPVSFEYIKEKNPDWIFIIDRTAAIGQEGPAAVEVL
                  250        260        270        280        290        300

310        320        330        340        350
m685.pep  DNALVRGTNAWKRKQIIVMPAANYIVAGGARQLIQAAEQLKAAFKKAEPVAAGKKX
          ||||||||||||||||||||||||||||||:|||||||||||  |:||||||||:|
a685      DNALVRGTNAWKRKQIIVMPAANYIVAGGSRQLIQAAEQLKEAFEKAEPVAAGKEX
                  310        320        330        340        350
```

The following partial DNA sequence was identified in *N. gonorrhoeae* <SEQ ID 2273>

```
g686.seq (partial)
    1 ..AATTTCTCCT GCCGCGCCGA TGATGTTTTT GACGATATCT GCAGTGCCGT 51   TGAAGGCTTC ggcgGCATTG CCCGATCTGT CCAGCTCGGG GCTGTATCGG

101   GTGGCGCGTT TGAATCCGTC GCCTACTCCT TGCGTCAGCA TAGCGCCGGC

151   ATTGTGGAAA CGGTCGGCAA GCCGTTGTCC GGTGCTGCGG TTGTCGGTCA

201   GGTTGAGGCG GATATTTTGG GCAACGCCTT TTATGTCGTA GCTGTATATA

251   TCCCTCGCGC CTTTGGGAGC GGGATAGCCG CCGCCCTGTG GCCCGTCATA

301   GCCGTCGGCG GGATGGTGTT CGTATCCGTC CCAATGGATG CGGTAAAGGC

351   TGAATCCGTC AACGGGACTA CCGGCTTCGT CAGAATCGGA ATGTGA
```

This corresponds to the amino acid sequence <SEQ ID 2274; ORF 686>:

```
g686.pep (partial)
    1 ..NFSCRADDVF DDICSAVEGF GGIARSVQLG AVSGGAFESV AYSLRQHSAG

51   IVETVGKPLS GAAVVGQVEA DILGNAFYVV AVYIPRAFGS GIAAALWPVI

101   AVGGMVFVSV PMDAVKAESV NGTTGFVRIG M*
```

The following partial DNA sequence was identified in *N. meningitidis* <SEQ ID 2275>:

```
m686.seq..
    1 ATGATGTTGA AAAAATTCGT ACTCGGCGGT ATTGCCGCAT GGTTTTGGC

51 GGCCTGCGGC GGTTCGGAAG GCGGCAGCGG AGCGNNNNNN NNNNNNAATT

101 TCTCCTGCAG CGCCGATGAT GTTTTTAACG ATATCTGCAG TGCCGTTGAA

151 GGCTTCGGCG GCATTGCCCG ATCTGTCCAG CTCGGGGCTG TATCGGGTGG

201 CGCGTTTGAA TCCGTCGCCT ACTCCTTGCG TCAGCATACT ACCGGCATTG

251 TGGAAACGGT CGGCAAGCCG TTGTCCGGTG CTGCGGTTGT CGGTCAGGTT

301 GAGGCGGATA TTTTGGGCAA CGCCTTTTAT GTCGTAGCTG TATATATCCC

351 TCGCGCCTTT GGGAGCGGGA TAGCCGCCGC CCTGTGGCCC GTCATAGCCG

401 TCGGCGGGAT GGTGTTCGTA TCCGTCCCAA TGGATGCGGT AAAGGCTAAA

451 TCCGTCAACG GGACTACCGG CTTCATCAGA ATCGGAATGT GA
```

This corresponds to the amino acid sequence <SEQ ID 2276; ORF 686>:

```
m686.pep
  1 MMLKKFVLGG IAALVLAACG GSEGGSGAXX XXNFSCSADD VFNDICSAVE

51 GFGGIARSVQ LGAVSGGAFE SVAYSLRQHT TGIVETVGKP LSGAAVVGQV

101 EADILGNAFY VVAVYIPRAF GSGIAAALWP VIAVGGMVFV SVPMDAVKAK

151 SVNGTTGFIR IGM*
```

Computer analysis of this amino acid sequence gave the following results:

Homology with a Predicted ORF from *N. gonorrhoeae*
ORF 686 shows 95.4% identity over a 131 aa overlap with a predicted ORF (ORF 686) from *N. gonorrhoeae*

```
    g686/m686   95.4% identity in 131 aa overlap 10        20        30
      g686.pep              NFSCRADDVFDDICSAVEGFGGIARSVQLG
                            ||||  |||||:|||||||||||||||||
      m686     LKKFVLGGIAALVLAACGGSEGGSGAXXXXNFSCSADDVFNDICSAVEGFGGIARSVQLG
                     10        20        30        40        50        60

40        50        60        70        80        90
      g686.pep AVSGGAFESVAYSLRQHSAGIVETVGKPLSGAAVVGQVEADILGNAFYVVAVYIPRAFGS
               ||||||||||||||||||::||||||||||||||||||||||||||||||||||||||||
      m686     AVSGGAFESVAYSLRQHTTGIVETVGKPLSGAAVVGQVEADILGNAFYVVAVYIPRAFGS
                     70        80        90       100       110       120

100       110       120       130
      g686.pep GIAAALWPVIAVGGMVFVSVPMDAVKAESVNGTTGFVRIGMX
               ||||||||||||||||||||||||||||:||||||||:||||
      m686     GIAAALWPVIAVGGMVFVSVPMDAVKAKSVNGTTGFIRIGMX
                    130       140       150       160
```

The following partial DNA sequence was identified in *N. meningitidis* <SEQ ID 2277>

```
a686.seq (partial)
  1 ..AATTTCTCCT GCCGCGCCGA TGATGTTTTT GACGATATCT GCAGTGCCGT

51    TGAAAGCTTC GGCGGCATTG CCCGATCTGT CCAGCTCGGG GCTGTATCGG

101    GTGGCGCGTT TGAATCCGTC GCCTACTCCT TGCGTCAGCA TACTACCGGT

151    ATTGTGGAAA CGGTCGACAA GCCGTTGTCC GGTGCTGCGG TTGTCGGTCA

201    GGTTGAGGCG GATATTTTGG GCAACGCCTT TTATGTCGTA GCTGTATATA

251    TCCCTCGCGC CTTTGGGAGC GGGATAGCCG CCGCCCTGTG GCCCGTCATA

301    GCCGTCGGCG GGATGGTGTT CGTATCCGTC CCAATGGATG CGGTAAAGGC

351    TGAATCCGTC AACGGGACTA CCGGCTTCAT CAGAATCGGA ATGTGA
```

This corresponds to the amino acid sequence <SEQ ID 2278; ORF 686.a>:

```
a686.pep (partial)
  1 ..NFSCRADDVF DDICSAVESF GGIARSVQLG AVSGGAFESV AYSLRQHTTG

51    IVETVDKPLS GAAVVGQVEA DILGNAFYVV AVYIPRAFGS GIAAALWPVI

101    AVGGMVFVSV PMDAVKAESV NGTTGFIRIG M*
```

Computer analysis of this amino acid sequence gave the following results:
Homology with a Predicted ORF from *N. meningitidis*
ORF 686 shows 96.2% identity over a 131 aa overlap with a predicted ORF (ORF 686) from *N. meningitidis*:

```
   m686/a686  96.2%  identity in 131 aa overlap 10        20        30        40        50        60
   M686.pep   LKKFVLGGIAALVLAACGGSEGGSGAXXXXXNFSCSADDVFNDICSAVEGFGGIARSVQLG
                                        ||||  ||||||:|||||||:||||||||||||
   a686                                  NFSCRADDVFDDICSAVESFGGIARSVQLG
                                                 10        20        30

70        80        90       100       110       120
   m686.pep   AVSGGAFESVAYSLRQHTTGIVETVGKPLSGAAVVGQVEADILGNAFYVVAVYIPRAFGS
              ||||||||||||||||||||||||||||| ||||||||||||||||||||||||||||||
   a686       AVSGGAFESVAYSLRQHTTGIVETVDKPLSGAAVVGQVEADILGNAFYVVAVYIPRAFGS
                      40        50        60        70        80        90

130       140       150       160
   m686.pep   GIAAALWPVIAVGGMVFVSVPMDAVKAKSVNGTTGFIRIGMX
              |||||||||||||||||||||||||||:|||||||||||||
   a686       GIAAALWPVIAVGGMVFVSVPMDAVKAESVNGTTGFIRIGMX
                     100       110       120       130
```

The following partial DNA sequence was identified in *N. gonorrhoeae* <SEQ ID 2279>

```
g687.seq
   1 ATGAAATCCA GACACCTCGC CCTCGCCCTC GGCGTTGCCG CCCTGTTCGC

51 CCTTGCCGCG TGCGACAGCA AAGTCCAAAC CAGCGTCCCC GCCGACAGCG

101 CGCCTGCCGC TTCGGCAGCC GCCGCCCCGG CAGGACTGGT CGAAGGGCAA

151 AACTACACCG TCCTTGCCAA CCCGATTCCC CAACAGCAGG CAGGCAAGGT

201 TGAAGTGCTT GAGTTTTTCG GCTATTTTTG TCCGCACTGC GCCCGCCTCg

251 AACCTGTTTT GAGCAAACAC GCCAAGTCTT TTAAAGACGA TATGTACCTG

301 CGTACCGAAC ACGTCGTCTG GCAGAAAGAA ATGCTGCCGC TGGCACGCct 351 cGCCGCCGCC GTCGATATGG CTGCCGCCGA AGCAAAGAT GTGGCGAACA

401 GCCATATTTT CGATGCGATG GTCAACCAAA AAATCAAGCT GCAAGAGCCG

451 GAAGTCCTCA AAAAATGGCT GGGCGAACAa ACcgcctTTG ACGGCAAAAA

501 AGTCCTTGCC GCCTACGAAT CCCCCGAAAG TCAGGCGCGC GCcggcAAAA

551 TGCAGGAGCT GACCGAAACC TTCCAAATCG ACGGTACGCC CACGGTTATC

601 GTCGGCGGCA AATATAAAGT CGAATTTGCC GACTGGGAGT CCGGTATGAA

651 CACCATCGAC CTTTTGGCGG ACAAAGTACG TGAAGAACAA AAAGCCGCGC

701 AGTAG
```

This corresponds to the amino acid sequence <2280 ID 724; ORF 687>:

```
g687.pep
   1 MKSRHLALAL GVAALFALAA CDSKVQTSVP ADSAPAASAA AAPAGLVEGQ

51 NYTVLANPIP QQQAGKVEVL EFFGYFCPHC ARLEPVLSKH AKSFKDDMYL

101 RTEHVVWQKE MLPLARLAAA VDMAAAESKD VANSHIFDAM VNQKIKLQEP

151 EVLKKWLGEQ TAFDGKKVLA AYESPESQAR AGKMQELTET FQIDGTPTVI

201 VGGKYKVEFA DWESGMNTID LLADKVREEQ KAAQ*
```

The following partial DNA sequence was identified in *N. meningitidis* <SEQ ID 2281>:

```
m687.seq
   1 ATGAAATCCA GACACCTTGC CCTCgGCGTT GCCGCCCTGT TCGCCCTTGC

51 CGCGTGCGAC AGCAAAGTCC AAACCAGCGT CCCCGCCGAC AGCGCGCCTG

101 CCGCTTCGGC AGCCGCCGCC CCGGCAGGGC TGGTCGAAGG GCAAAACTAT

151 ACCGTCCTTG CCAACCCGAT TCCCCAACAG CAGGCAGGCA AAGTCGAAGT

201 CCTTGAGTTT TTCGGCTATT TCTGTCCGCA CTGCGCCCAC CTCGAACCTG

251 TTTTAAGCAA ACACGCCAAG TCTTTTAAAG ACGATATGTA CCTGCGTACC

301 GAACACGTCG TCTGGCAGAA AGAAATGCTG ACGCTGGCAC GCCTCGCCGC

351 CGCCGTCGAT ATGGCTGCCG CCGACAGCAA AGATGTGGCG AACAGCCATA

401 TTTTCGATGC GATGGTCAAC CAAAAAATCA AGCTGCAAAA TCCGGAAGTC

451 CTCAAAAAAT GGCTGGGCGA ACAAACCGCC TTTGACGGCA AAAAAGTCCT

501 TGCCGCCTAC GAGTCCCCCG AAAGCCAGGC GCGCGCCGAC AAAATGCAGG

551 AGCTGACCGA AACCTTCCAA ATCGACGGTA CGCCCACGGT TATCGTCGGC

601 GGTAAATATA AAGTTGAATT TGCCGACTGG GAGTCCGGTA TGAACACCAT

651 CGACCTTTTG GCGGACAAAG TACGCGAAGA ACAAAAAGCC GCGCAGTAA
```

This corresponds to the amino acid sequence <SEQ ID 2282; ORF 687>:

```
m687.pep
   1 MKSRHLALGV AALFALAACD SKVQTSVPAD SAPAASAAAA PAGLVEGQNY

51 TVLANPIPQQ QAGKVEVLEF FGYFCPHCAH LEPVLSKHAK SFKDDMYLRT

101 EHVVWQKEML TLARLAAAVD MAAADSKDVA NSHIFDAMVN QKIKLQNPEV

151 LKKWLGEQTA FDGKKVLAAY ESPESQARAD KMQELTETFQ IDGTPTVIVG

201 GKYKVEFADW ESGMNTIDLL ADKVREEQKA AQ*
```

Computer analysis of this amino acid sequence gave the following results:

Homology with a Predicted ORF from *N. gonorrhoeae*

ORF 687 shows 97.0% identity over a 234 aa overlap with a predicted ORF (ORF 687) from *N. gonorrhoeae*:

```
m687/g687  97.0%  identity in 234 aa overlap 10        20        30        40        50
m687.pep    MKSRHLAL--GVAALFALAACDSKVQTSVPADSAPAASAAAAPAGLVEGQNYTVLANPIP
            ||||||||  ||||||||||||||||||||||||||||||||||||||||||||||||||
g687        MKSRHLALALGVAALFALAACDSKVQTSVPADSAPAASAAAAPAGLVEGQNYTVLANPIP
                    10        20        30        40        50        60

60        70        80        90       100       110
m687.pep    QQQAGKVEVLEFFGYFCPHCAHLEPVLSKHAKSFKDDMYLRTEHVVWQKEMLTLARLAAA
            ||||||||||||||||||||:|||||||||||||||||||||||||||||||| |||||||
g687        QQQAGKVEVLEFFGYFCPHCARLEPVLSKHAKSFKDDMYLRTEHVVWQKEMLPLARLAAA
                    70        80        90       100       110       120

120       130       140       150       160       170
m687.pep    VDMAAADSKDVANSHIFDAMVNQKIKLQNPEVLKKWLGEQTAFDGKKVLAAYESPESQAR
            ||||||:||||||||||||||||||||||:||||||||||||||||||||||||||||||
g687        VDMAAAESKDVANSHIFDAMVNQKIKLQEPEVLKKWLGEQTAFDGKKVLAAYESPESQAR
                   130       140       150       160       170       180

180       190       200       210       220       230
m687.pep    ADKMQELTETFQIDGTPTVIVGGKYKVEFADWESGMNTIDLLADKVREEQKAAQX
            | |||||||||||||||||||||||||||||||||||||||||||||||||||||
g687        AGKMQELTETFQIDGTPTVIVGGKYKVEFADWESGMNTIDLLADKVREEQKAAQX
                   190       200       210       220       230
```

The following partial DNA sequence was identified in *N. meningitidis* <SEQ ID 2283>

```
a687.seq
   1 ATGAAATCCA AACACCTCGC CCTCGGCGTT GCCGCCCTGT TCGCACTTGC

51 CGCGTGCGAC AGCAAAGTCC AAACCAGCGT CCCCGCCGAC AGCGCGCCTG

101 CCGCTTCGGC AGCCGCCGCC CCGGCAGGGC TGGTCGAAGG GCAAAACTAT

151 ACTGTCCTTG CCAACCCGAT TCCCCAACAG CAGGCAGGCA AAGTCGAAGT

201 CCTTGAGTTT TTCGGCTATT TCTGTCCGCA CTGCGCCCAC CTCGAACCTG

251 TTTTAAGCAA ACACGCCAAG TCTTTTAAAG ACGATATGTA CCTGCGTACC

301 GAACACGTCG TCTGGCAGAA AGAAATGCTG ACGCTCGCAC GCCTCGCCGC

351 CGCCGTCGAT ATGGCTGCCG CCGACAGCAA AGATGTGGCG AACAGCCATA

401 TTTTCGATGC GATGGTCAAC CAAAAAATCA AGCTGCAAGA GCCGGAAGTC

451 CTCAAAAAAT GGCTGGGCGA ACAAACCGCC TTTGACGGCA AAAAAGTCCT

501 TGCCGCTTAC GAATCTCCCG AAAGCCAGGC GCGCGCCGAC AAAATGCAGG

551 AGCTGACCGA AACCTTCCAA ATCGACGGTA CGCCCACGGT TATCGTCGGC

601 GGCAAATATA AAGTCGAATT TGCCGACTGG GAGTCCGGTA TGAACACCAT

651 CGACCTTTTG GCGGACAAAG TACGCGAAGA ACAAAAAGCC GCGCACTAA
```

This corresponds to the amino acid sequence <SEQ ID 2284; ORF 687.a>:

```
a687.pep
   1 MKSKHLALGV AALFALAACD SKVQTSVPAD SAPAASAAAA PAGLVEGQNY

51 TVLANPIPQQ QAGKVEVLEF FGYFCPHCAH LEPVLSKHAK SFKDDMYLRT

101 EHVVWQKEML TLARLAAAVD MAAADSKDVA NSHIFDAMVN QKIKLQEPEV

151 LKKWLGEQTA FDGKKVLAAY ESPESQARAD KMQELTETFQ IDGTPTVIVG

201 GKYKVEFADW ESGMNTIDLL ADKVREEQKA AH*
```

Computer analysis of this amino acid sequence gave the following results:

Homology with a Predicted ORF from *N. meningitidis*

ORF 687 shows 98.7% identity over a 232 aa overlap with a predicted ORF (ORF 687) from *N. meningitidis*:

```
m687/a687  98.7%  identity in 232 aa overlap 10        20        30        40        50        60
m687.pep    MKSRHLALGVAALFALAACDSKVQTSVPADSAPAASAAAAPAGLVEGQNYTVLANPIPQQ
            |||:||||||||||||||||||||||||||||||||||||||||||||||||||||||||
a687        MKSKHLALGVAALFALAACDSKVQTSVPADSAPAASAAAAPAGLVEGQNYTVLANPIPQQ
                    10        20        30        40        50        60

70        80        90       100       110       120
m687.pep    QAGKVEVLEFFGYFCPHCAHLEPVLSKHAKSFKDDMYLRTEHVVWQKEMLTLARLAAAVD
            ||||||||||||||||||||||||||||||||||||||||||||||||||||||||||||
a687        QAGKVEVLEFFGYFCPHCAHLEPVLSKHAKSFKDDMYLRTEHVVWQKEMLTLARLAAAVD
                    70        80        90       100       110       120

130       140       150       160       170       180
m687.pep    MAAADSKDVANSHIFDAMVNQKIKLQNPEVLKKWLGEQTAFDGKKVLAAYESPESQARAD
            |||||||||||||||||||||||||:||||||||||||||||||||||||||||||||||
a687        MAAADSKDVANSHIFDAMVNQKIKLQEPEVLKKWLGEQTAFDGKKVLAAYESPESQARAD
                   130       140       150       160       170       180

190       200       210       220       230
m687.pep    KMQELTETFQIDGTPTVIVGGKYKVEFADWESGMNTIDLLADKVREEQKAAQX
            ||||||||||||||||||||||||||||||||||||||||||||||||||:|
a687        KMQELTETFQIDGTPTVIVGGKYKVEFADWESGMNTIDLLADKVREEQKAAHX
                   190       200       210       220       230
```

The following partial DNA sequence was identified in *N. gonorrhoeae* <SEQ ID 2285>

```
g688.seq
    1 GTGCTACACT AGACATCCCG ATTTGCACAG AAAGGTTCTC CCGTGAACAA

51 AACCCTCATC CTCGCCCTTT CCGCCCTGTT CAGCCTGACC GCGTGCAGCG

101 TCGAACGCGT CTCGCTGTTT CCCTCCTACA AACTCAAAAT CATCCAAGGC

151 AACGAACTCG AACCGCGCGC CGTTGCCGCC CTGCGCCCCG GCATGACCAA

201 AGACCAAGTC CTGCTCCTGC TCGGCAGCCC CATACTGCGC GACGCTTTCC

251 ATACCGACCG CTGGGACTAT ACCTTCAACA CCTCCCGCAA CGGCATCATC

301 AAAGAACGCA GCAACCTGAC CGTCTATTTT GAAAACGGCG TACTCGTCCG

351 CACCGAAGGC GACGCCCTCC AAAATGCCGC CGAAGCCCTC CGCGCGAAAC

401 AAAACGCAGA CAAACAATAA
```

This corresponds to the amino acid sequence <SEQ ID 2286; ORF 688>:

```
g688.pep
    1 VLH*TSRFAQ KGSPVNKTLI LALSALFSLT ACSVERVSLF PSYKLKIIQG

51 NELEPRAVAA LRPGMTKDQV LLLLGSPILR DAFHTDRWDY TFNTSRNGII

101 KERSNLTVYF ENGVLVRTEG DALQNAAEAL RAKQNADKQ*
```

The following partial DNA sequence was identified in *N. meningitidis* <SEQ ID 2287>:

```
m688.seq
    1 GTGTTACACT ACCCATCCCG ATTTGCACAG AAAGGCATTT CCGTGAACAA

51 AACCCTCATC CTCGCCCTTT CCGCCCTCCT CGGCCTTGCC GCGTGCAGTG

101 CCGAACGCGT TTCACTGTTC CCCTCGTACA AACTCAAAAT CATACAGGGC

151 AACGAACTCG AACCGCGCGC CGTTGCCGCC CTCCGCCCCG GCATGACCAA

201 AGACCAAGTC CTGCTCCTGC TCGGCAGCCC CATACTGCGC GACGCATTCC

251 ATACCGACCG CTGGGACTAT ACCTTCAACA CCTCCCGCAA CGGCATCATC

301 AAAGAACGCA GCAATCTGAC CGTCTATTTT GAAAACGGCG TACTCGTCCG

351 CACCGAAGGC GACGTCCTGC AAAACGCTGC CGAAGCCCTC AAAGACCGCC

401 AAAACACAGA CAAACCATAA
```

This corresponds to the amino acid sequence <SEQ ID 2288; ORF 688>:

```
m688.pep
    1 VLHYPSRFAQ KGISVNKTLI LALSALLGLA ACSAERVSLF PSYKLKIIQG

51 NELEPRAVAA LRPGMTKDQV LLLLGSPILR DAFHTDRWDY TFNTSRNGII

101 KERSNLTVYF ENGVLVRTEG DVLQNAAEAL KDRQNTDKP*
```

Computer analysis of this amino acid sequence gave the following results:
Homology with a Predicted ORF from *N. gonorrhoeae*
ORF 688 shows 90.6% identity over a 138 aa overlap with a predicted ORF (ORF 688) from *N. gonorrhoeae*:

```
    m688/g688  90.6%  identity in 138 aa overlap 10        20        30        40        50        60
       m688.pep  VLHYPSRFAQKGISVNKTLILALSALLGLAACSAERVSLFPSYKLKIIQGNELEPRAVAA
                 |||  |||||||   ||||||||||||:  |:|||:|||||||||||||||||||||||
       g688      VLHXYSRFAQKGSPVNKTLILALSALFSLTACSVERVSLFPSYKLKIIQGNELEPRAVAA
                       10        20        30        40        50        60

70        80        90       100       110       120
       m688.pep  LRPGMTKDQVLLLLGSPILRDAFHTDRWDYTFNTSRNGIIKERSNLTVYFENGVLVRTEG
                 ||||||||||||||||||||||||||||||||||||||||||||||||||||||||||||
       g688      LRPGMTKDQVLLLLGSPILRDAFHTDRWDYTFNTSRNGIIKERSNLTVYFENGVLVRTEG
                       70        80        90       100       110       120

130       140
       m688.pep  DVLQNAAEALKDRQNTDKPX
                 |:|||||||||:  :||:||
       g688      DALQNAAEALRAKQNADKQX
                      130       140
```

The following partial DNA sequence was identified in *N. meningitidis* <SEQ ID 2289>

```
a688.seq
  1 GTGTTACACT ACCCATCCCG ATTTGCACAG AAAGGCATTT CCGTGAACAA

51 AACCCTCATC CTCGCCCTTT CCGCCCTCCT CGGCCTTGCC GCGTGCAGCG

101 TCGAACGCGT TTCACTGTTC CCCTCGTACA AACTCAAAAT CATACAGGGC

151 AACGAACTCG AACCTCGCGC CGTCGCCTCC CTCCGCCCCG GTATGACCAA

201 AGACCAAGTC CTGCTCCTGC TCGGCAGCCC CATACTGCGC GACGCATTCC

251 ATACCGACCG CTGGGACTAT ACCTTCAACA CCTCCCGCAA CGGCATCATC

301 AAAGACCGAA GCAATCTGAC CGTCTATTTT GAAAACGGCG TGCTCGTCCG

351 CACCGAAGGC AACGCCCTGC AAAATGCCGC CGAAGCCCTC CGCGTAAAAC

401 AAAACGCAGA CAAACAATAA
```

This corresponds to the amino acid sequence <SEQ ID 2290; ORF 688.a>:

```
a688.pep
  1 VLHYPSRFAQ KGISVNKTLI LALSALLGLA ACSVERVSLF PSYKLKIIQG

51 NELEPRAVAS LRPGMTKDQV LLLLGSPILR DAFHTDRWDY TFNTSRNGII

101 KDRSNLTVYF ENGVLVRTEG NALQNAAEAL RVKQNADKQ*
```

Computer analysis of this amino acid sequence gave the following results:
Homology with a Predicted ORF from *N. meningitidis*
ORF 688 shows 93.5% identity over a 138 aa overlap with a predicted ORF (ORF 688) from *N. meningitidis*

```
    m688/g688  93.5%  identity in 138 aa overlap 10        20        30        40        50        60
       m688.pep  VLHYPSRFAQKGISVNKTLILALSALLGLAACSAERVSLFPSYKLKIIQGNELEPRAVAA
                 ||||||||||||||||||||||||||||||||||:|||||||||||||||||||||||:
       a688      VLHYPSRFAQKGISVNKTLILALSALLGLAACSVERVSLFPSYKLKIIQGNELEPRAVAS
                       10        20        30        40        50        60
```

-continued

```
             70         80         90        100        110        120
m688.pep  LRPGMTKDQVLLLLGSPILRDAFHTDRWDYTFNTSRNGIIKERSNLTVYFENGVLVRTEG
          ||||||||||||||||||||||||||||||||||||||:|||||||||||||||||||||
a688      LRPGMTKDQVLLLLGSPILRDAFHTDRWDYTFNTSRNGIIKDRSNLTVYFENGVLVRTEG
             70         80         90        100        110        120

130        140
m688.pep  DVLQNAAEALKDRQNTDKPX
          ::|||||||||: :||:||
a688      NALQNAAEALRVKQNADKQX
            130        140
```

The following partial DNA sequence was identified in *N. gonorrhoeae* <SEQ ID 2291>

```
g689.seq (partial)
    1  ..TCTCCGCCCC TTCCTCCGAT GAGCGGAAAA CTGATGGCGG TTTTGATGGC

51    GGTACTGGTC GCGCTGATGC CGTTTTCCAT CGATGCCTAC CTGCCCGCGA

101    TTCCCGAAAT GGCGCAGCCG CTGAACGCGG ATATCCACCG TATCGAATAG

151    AGTCTGAGTT TGTTTATGTT CGGCACGGCG TTCGGGCAAG TGGCCGGCGG

201    CGCGGTGTCC GACATCAAAG GCGCAAACC CGTCGCCCTG ACCGGTTTGA

251    TTGTATATTG CCTTGCCGTT GCCGCCATCG TATTTGCTTC GAGTACCGAA

301    CAGCTCCTTA ACCTGCGTGC GGTACAGGCG TTCGGCGCAG CATGGCTGT

351    AGTCATCGTc ggtgcgatgg tgcgcgatTA TTATTCCGGA CGCAAAGCCG 401    cgcAGATGTT TGCCCTTATC GGCATCATTC TGATGGTTGT GCCGCTGGCC

451    GCACCCATGG TCGGCGCATT GTTGCAGGGA TTGGGCGGAT GGCGGGCGAT

501    TTTCGTTTTC ttggcGgcgT ATTCGCCGGT GCTGCCCGGT TTGGTACAGT

551    ATTTCCTGCC CAATCCCGCC GTCGGCGGCA AAATCGGCAG GGATGTGTTC

601    GGGCTGGTGG CGGGGCGGTT CAAGCGCGTA TTGAAAACCC GTGCCGCGAT

651    GGGTtatCTG TTTTTTCAGG CATTCAGCTT CGGTTCGATG TTCGCCTTTC

701    TGACCGAATC TTCCTTCGTG TACCGGCAGC TCTACCACGT TACGCCGCAC

751    CGGTACGCAT GGGTGTTTGC ACTCAACATC ATCACGATGA TGTTTTTCAG

801    CCGCGTTACC GCGTGGCGGC TTAAAACCGG CGCGCATCCG CAAAGCATCC

851    TGCTGCGGGG GATTGTCGTC CAATTTGCCG CCAACCCGTC CCAACTCGCC

901    GCCGTGCTGT TTTTCGGGTT GCCCCCGTTT TGGCTGCCGG TCGCGTGCGT

951    GATGTTTTCC GTCGGTACGC AGGGCCTGGT CGGTGCGGAC ACGCAGGCAT

1001    GCTTTATGTC TTATTTCAAA GAAGAGGGCG GCAGCGCGAA CGCCGTGTCG

1051    GGTGTATTCC GGTCCTTAAT CGGCGCGGGC GTGGTCATGG CGGCAACCGT

1101    GATGGCGGCA ACCATGACCG CGTCCGCCTC TTGCGGCATT GCGCTTTTGT

1151    GGCTCTGCTC GCACAAGGCG TGGAAGGAAA ACGAAAAAAA GCGAATACTT
```

This corresponds to the amino acid sequence <SEQ ID 2292; ORF 689>:

```
g689.pep (partial)
    1  ..SPPLPPMSGK LMAVLMAVLV ALMPFSIDAY LPAIPEMAQP LNADIHRIE*

51    SLSLFMFGTA FGQVAGGAVS DIKGRKPVAL TGLIVYCLAV AAIVFASSTE

101    QLLNLRAVQA FGAGMAVVIV GAMVRDYYSG RKAAQMFALI GIILMVVPLA

151    APMVGALLQG LGGWRAIFVF LAAYSPVLPG LVQYFLPNPA VGGKIGRDVF
```

-continued

```
201   GLVAGRFKRV LKTRAAMGYL FFQAFSFGSM FAFLTESSFV YRQLYHVTPH

251   RYAWVFALNI ITMMFFSRVT AWRLKTGAHP QSILLRGIVV QFAANPSQLA

301   AVLFFGLPPF WLPVACVMFS VGTQGLVGAD TQACFMSYFK EEGGSANAVS

351   GVFRSLIGAG VVMAATVMAA TMTASASCGI ALLWLCSHKA WKENEKKRIL
```

The following partial DNA sequence was identified in *N. meningitidis* <SEQ ID 2293>:

```
m689.seq
   1 TTGTTAATCC ACTATATCGT TCCGGTTCGT CCGGTTTTGC CGGGGCTTTT
  51 GTTGCCGCCT GTTTGTGCCG GTGTGTTAAA ATTTTCCGTT TCCGCGTATT
 101 GTGTTTTCCG CCGCCGGGCG GTTTGTTTGC GAATCGGACG AGAATTTATG
 151 CCTTCTGCCC ATTATCCTGA AATGAGCGAA AAACTGATGG CGGTTTTGAT
 201 GGCGATGCTG GTTACGCTGA TGCCGTTTTC CATCGATGCC TACCTGCCCG
 251 CGATTCCCGA AATGGCGCAA TCGCTGAACG CGGATGTTCA CCGCATCGAA
 301 CAGAGTTTGA GTTTGTTTAT GTTCGGCACG GCGTTCGGAC AGGTGGTCGG
 351 CGGTTCGGTG TCCGACATCA AAGGGCGCAA ACCCGTCGCC CTGACCGGTT
 401 TGATTGTATA TTGCCTTGCC GTTGCCGCCA TCGTATTTGT TTCGAGTGCC
 451 GAACAGCTCC TCAACCTGCG CGTCGTGCAG GCATTCGGTG CGGGCATGAC
 501 TGTGGTCATC GTCGGCGCAA TGGTGCGCGA TTATTATTCC GGACGCAAAG
 551 CCGCCCAGAT GTTTGCCCTT ATCGGCATCA TTTTGATGGT TGTGCCGCTG
 601 GTCGCACCCA TGGTCGGCGC ATTGTTGCAG GGCTTGGGTG GCTGGCAGGC
 651 GATTTTTGTT TTTCTGGCGG CGTATTCGCT GGTGCTGCTC GGTTTGGTAC
 701 AGTATTTCCT GCCCAAGCCC GCCGTCGGCG GCAAAATCGG ACGGGACGTG
 751 TTCGGGCTGG TGGCGGGGCG GTTCAAGCGC GTATTGAAAA CCCGTGCTGC
 801 GATGGGTTAT CTGTTTTTTC AGGCATTCAG CTTCGGTTCG ATGTTCGCCT
 851 TTCTGACCGA ATCTTCCTTC GTGTACCAGC AGCTCTACCG TGTTACGCCT
 901 CATCAATACG CTTGGGCGTT TGCACTCAAC ATCATCACGA TGATGTTTTT
 951 CAACCGCGTT ACCGCGTGGC GGCTCAAAAC CGGCGTGCAT CCGCAAAGCA
1001 TCCTGCTGTG GGGGATTGTC GTCCAGTTTG CCGCCAACCT GTCCCAACTC
1051 GCCGCCGTGC TGTTTTTCGG GTTGCCCCCG TTTTGGCTGC TGGTCGCGTG
1101 CGTGATGTTT TCCGTCGGTA CGCAGGGCTT GGTCGGTGCA AACACGCAGG
1151 CGTGTTTTAT GTCCTATTTC AAAGAAGAGG GCGGCAGCGC AAACGCCGTA
1201 TTGGGTGTAT TCCAATCTTT AATCGGCGCG GGGGTGGGTA TGGCGGCGAC
1251 CTTCTTGCAC GACGGTTCGG CAACCGTGAT GGCGGCAACG ATGACCGCGT
1301 CCACCTCTTG CGGCATTGCG CTTCTGTGGC TCTGCTCGCA TCGTGCGTGG
1351 AAAGAAAACG GGCAAAGCGA ATACCTTTAA
```

This corresponds to the amino acid sequence <SEQ ID 2294; ORF 689>:

```
m689.pep
  1 LLIHYIVPVR PVLPGLLLPP VCAGVLKFSV SAYCVFRRRA VCLRIGREFM
 51 PSAHYPEMSE KLMAVLMAML VTLMPFSIDA YLPAIPEMAQ SLNADVHRIE
```

```
101 QSLSLFMFGT AFGQVVGGSV SDIKGRKPVA LTGLIVYCLA VAAIVFVSSA

151 EQLLNLRVVQ AFGAGMTVVI VGAMVRDYYS GRKAAQMFAL IGIILMVVPL

201 VAPMVGALLQ GLGGWQAIFV FLAAYSLVLL GLVQYFLPKP AVGGKIGRDV

251 FGLVAGRFKR VLKTRAAMGY LFFQAFSFGS MFAFLTESSF VYQQLYRVTP

301 HQYAWAFALN IITMMFFNRV TAWRLKTGVH PQSILLWGIV VQFAANLSQL

351 AAVLFFGLPP FWLLVACVMF SVGTQGLVGA NTQACFMSYF KEEGGSANAV

401 LGVFQSLIGA GVGMAATFLH DGSATVMAAT MTASTSCGIA LLWLCSHRAW

451 KENGQSEYL*
```

Computer analysis of this amino acid sequence gave the following results:

Homology with a Predicted ORF from *N. gonorrhoeae*

ORF 689 shows 88.0% identity over a 408 aa overlap with a predicted ORF (ORF 689) from *N. gonorrhoeae*:

```
  m689/a689  88.0% identity in 408 aa overlap 30        40        50        60        70        80
     m689.pep  CAGVLKFSVSAYCVFRRRAVCLRIGREFMPSAHYPEMSEKLMAVLMAMLVTLMPFSIDAY
                                              |   |  || ||||||||:||:|||||||||
     g689                                     SPPLPPMSGKLMAVLMAVLVALMPFSIDAY
                                                       10        20        30

90       100       110       120       130       140
     m689.pep  LPAIPEMAQSLNADVHRIEQSLSLFMFGTAFGQVVGGSVSDIKGRKPVALTGLIVYCLAV
               ||||||||| |||| |||| |||||||||||||| ||:||:||||||||||||||||||
     g689      LPAIPEMAQPLNADIHRIEXSLSLFMFGTAFGQVAGGAVSDIKGRKPVALTGLIVYCLAV
                   40        50        60        70        80        90

150       160       170       180       190       200
     m689.pep  AAIVFVSSAEQLLNLRVVQAFGAGMTVVIVGAMVRDYYSGRKAAQMFALIGIILMVVPLV
               |||||:||:|||||||:|||||||||:|||||||||||||||||||||||||||||||:
     g689      AAIVFASSTEQLLNLRAVQAFGAGMAVVIVGAMVRDYYSGRKAAQMFALIGIILMVVPLA
                  100       110       120       130       140       150

210       220       230       240       250       260
     m689.pep  APMVGALLQGLGGWQAIFVFLAAYSLVLLGLVQYFLPKPAVGGKIGRDVFGLVAGRFKRV
               |||||||||||||| |||||||||| ||| ||||||| ||||||||||||||||||||||
     g689      APMVGALLQGLGGWRAIFVFLAAYSPVLPGLVQYFLPNPAVGGKIGRDVFGLVAGRFKRV
                  160       170       180       190       200       210

270       280       290       300       310       320
     m689.pep  LKTRAAMGYLFFQAFSFGSMFAFLTESSFVYQQLYRVTPHQYAWAFALNIITMMFFNRVT
               ||||||||||||||||||||||||||||||:|||:||||:|||||||||||||||||:||
     g689      LKTRAAMGYLFFQAFSFGSMFAFLTESSFVYRQLYHVTPHRYAWVFALNIITMMFFSRVT
                  220       230       240       250       260       270

330       340       350       360       370       380
     m689.pep  AWRLKTGVHPQSILLWGIVVQFAANLSQLAAVLFFGLPPFWLLVACVMFSVGTQGLVGAN
               |||||||:|||||| |||||||||| ||||||||||||||| |||||||||||||||::
     g689      AWRLKTGAHPQSILLRGIVVQFAANPSQLAAVLFFGLPPFWLPVACVMFSVGTQGLVGAD
                  280       290       300       310       320       330

390       400       410       420       430       440
     m689.pep  TQACFMSYFKEEGGSANAVLGVFQSLIGAGVGMAATFLHDGSATVMAATMTASTSCGIAL
               |||||||||||||||||| :||||:|||||| ||||        ||||||||||:|||||
     g689      TQACFMSYFKEEGGSANAVSGVFRSLIGAGVVMAAT--------VMAATMTASASCGIAL
                  340       350       360              370       380

450       460
     m689.pep  LWLCSHRAWKENGQSEYLX
               ||||||:||||   ::  |
     g689      LWLCSHKAWKENEKKRIL
                  390       400
```

The following partial DNA sequence was identified in *N. meningitidis* <SEQ ID 2295>

```
a689.seq
    1   TTGTTAATCC ACTATATCGT TCCGGTTCGT CCGGTTTTGC CGGGGCTTTT

51   GTTGCCGCCT GTTTGTGCCG GTGTGTTAAA ATTTTCCGTT TCCGCGTATT
```

-continued
```
 101 GTGTTTTCCG CCGCCGGGCG GTTTGTTTGC GAATCGGACG AGAATTTATG

151 CCTTCTGCCC ATTATCCTGA AATGAGCGAA AAACTGATGG CGGTTTTGAT

201 GGCGATGCTG GTTACGCTGA TGCCGTTTTC CATCGATGCC TACCTGCCCG

251 CGATTCCCGA AATGGCGCAG TCGCTGAACG CGGATGTCCA CCGCATCGAA

301 CAGAGCCTGA GTTTGTTTAT GTTCGGCACG GCGTTCGGAC AGGTGGTCGG

351 CGGTTCGGTG TCCGACATCA AAGGGCGCAA ACCCGTCGCG CTGACCGGAC

401 TGGCCGTCTA CTGCCTTGCC GTTGCCGCCA TCGTATTTGC TTCGAGTGCC

451 GAACAGCTCC TCAACCTGCG CGTCGTGCAG GCATTCGGTG CGGGCATGAC

501 TGTGGTCATC GTCGGCGCAA TGGTGCGCGA TTATTATTCC GGACGCAAAG

551 CCGCCCAGAT GTTTGCCCTT ATCGGCATCA TTTTGATGGT TGTGCCGCTG

601 GTCGCACCCA TGGTCGGCGC ATTGTTGCAG GGCTTGGGTG GCTGGCAGGC

651 GATTTTTGTT TTTCTGGCGG CGTATTCGCT GGTGCTGCTC GGTTTGGTAC

701 AGTATTTCCT GCCCAAGCCC GCCGTCGGCG GCAAAATCGG CAGGGATGTG

751 TTCGGGCTGG TGGCTGGGCG GTTCAAACGC GTATTGAAAA CCCGTGCCGC

801 GATGGGTTAT CTGTTTTTTC AGGCATTCAG CTTCGGTTCG ATGTTCGCCT

851 TTCTGACCGA ATCTTCCTTC GTGTACCAGC AGCTCTACCA CGTTACGCCG

901 CACCAGTACG CTTGGGCGTT TGCACTCAAC ATCATCACGA TGATGTTTTT

951 CAACCGTATT ACCGCGTGGC GGCTCAAAAC CGGCGTGCAT CCGCAAAGCA

1001 TCCTGCTGTG GGGGATTGTC GTCCAGTTTG CCGCCAACCT GTCCCAACTC

1051 GCCGCCGTGC TGTTTTTCGG GTTGCCCCCG TTTTGGCTGC TGGTCGCGTG

1101 CGTGATGTTT TCCGTCGGTA CGCAGGGCTT GGTCGGTGCA AACACGCAGG

1151 CGTGTTTTAT GTCCTATTTC AAAGAAGAGG GCGGCAGCGC AAACGCCGTA

1201 TTGGGTGTAT TCCAATCTTT AATCGGCGCG GGGGTGGGTA TGGCGGCGAC

1251 CTTCTTGCAC GACGGTTCGG CAACCGTGAT GGCGGCAACC ATGACCGCGT

1301 CTACCTCTTG CGGCATTGCG CTTTTGTGGC TCTGCTCGCA TCGTGCGTGG

1351 AAAGAAAACG GGCAAAGCGA ATACCTTTAA
```

This corresponds to the amino acid sequence <SEQ ID 2296; ORF 689.a>:

```
a689.pep
  1 LLIHYIVPVR PVLPGLLLPP VCAGVLKFSV SAYCVFRRRA VCLRIGREFM

51 PSAHYPEMSE KLMAVLMAML VTLMPFSIDA YLPAIPEMAQ SLNADVHRIE

101 QSLSLFMFGT AFGQVVGGSV SDIKGRKPVA LTGLAVYCLA VAAIVFASSA

151 EQLLNLRVVQ AFGAGMTVVI VGAMVRDYYS GRKAAQMFAL IGIILMVVPL

201 VAPMVGALLQ GLGGWQAIFV FLAAYSLVLL GLVQYFLPKP AVGGKIGRDV

251 FGLVAGRFKR VLKTRAAMGY LFFQAFSFGS MFAFLTESSF VYQQLYHVTP

301 HQYAWAFALN IITMMFFNRI TAWRLKTGVH PQSILLWGIV VQFAANLSQL

351 AAVLFFGLPP FWLLVACVMF SVGTQGLVGA NTQACFMSYF KEEGGSANAV

401 LGVFQSLIGA GVGMAATFLH DGSATVMAAT MTASTSCGIA LLWLCSHRAW

451 KENGQSEYL*
```

Computer analysis of this amino acid sequence gave the following results:
Homology with a Predicted ORF from *N. meningitidis*
ORF 689 shows 99.1% identity over a 459 aa overlap with a predicted ORF (ORF 689) from *N. meningitidis*:

```
m689/a689  99.1% identity in 459 aa overlap 10        20        30        40        50        60
    m689.pep  LLIHYIVPVRPVLPGLLLPPVCAGVLKFSVSAYCVFRRRAVCLRIGREFMPSAHYPEMSE
              ||||||||||||||||||||||||||||||||||||||||||||||||||||||||||||
    a689      LLIHYIVPVRPVLPGLLLPPVCAGVLKFSVSAYCVFRRRAVCLRIGREFMPSAHYPEMSE
                    10        20        30        40        50        60

70        80        90       100       110       120
    m689.pep  KLMAVLMAMLVTLMPFSIDAYLPAIPEMAQSLNADVHRIEQSLSLFMFGTAFGQVVGGSV
              ||||||||||||||||||||||||||||||||||||||||||||||||||||||||||||
    a689      KLMAVLMAMLVTLMPFSIDAYLPAIPEMAQSLNADVHRIEQSLSLFMFGTAFGQVVGGSV
                    70        80        90       100       110       120

130       140       150       160       170       180
    m689.pep  SDIKGRKPVALTGLIVYCLAVAAIVFVSSAEQLLNLRVVQAFGAGMTVVIVGAMVRDYYS
              |||||||||||||||||||||||||||||| :||||||||||||||||||| ||||||||
    a689      SDIKGRKPVALTGLIVYCLAVAAIVFASSAEQLLNLRVVQAFGAGMTVVIVGAMVRDYYS
                   130       140       150       160       170       180

190       200       210       220       230       240
    m689.pep  GRKAAQMFALIGIILMVVPLVAPMVGALLQGLGGWQAIFVFLAAYSLVLLGLVQYFLPKP
              ||||||||||||||||||||||||||||||||||||||||||||||||||||||||||||
    a689      GRKAAQMFALIGIILMVVPLVAPMVGALLQGLGGWQAIFVFLAAYSLVLLGLVQYFLPKP
                   190       200       210       220       230       240

250       260       270       280       290       300
    m689.pep  AVGGKIGRDVFGLVAGRFKRVLKTRAAMGYLFFQAFSFGSMFAFLTESSFVYQQLYRVTP
              ||||||||||||||||||||||||||||||||||||||||||||||||||||||||:|||
    a689      AVGGKIGRDVFGLVAGRFKRVLKTRAAMGYLFFQAFSFGSMFAFLTESSFVYQQLYHVTP
                   250       260       270       280       290       300

310       320       330       340       350       360
    m689.pep  HQYAWAFALNIITMMFFNRVTAWRLKTGVHPQSILLWGIVVQFAANLSQLAAVLFFGLPP
              ||||||||||||||||||:|||||||||||||||||||||||||||||||||||||||||
    a689      HQYAWAFALNIITMMFFNRITAWRLKTGVHPQSILLWGIVVQFAANLSQLAAVLFFGLPP
                   310       320       330       340       350       360

370       380       390       400       410       420
    m689.pep  FWLLVACVMFSVGTQGLVGANTQACFMSYFKEEGGSANAVLGVFQSLIGAGVGMAATFLH
              ||||||||||||||||||||||||||||||||||||||||||||||||||||||||||||
    a689      FWLLVACVMFSVGTQGLVGANTQACFMSYFKEEGGSANAVLGVFQSLIGAGVGMAATFLH
                   370       380       390       400       410       420

430       440       450       460
    m689.pep  DGSATVMAATMTASTSCGIALLWLCSHRAWKENGQSEYLX
              ||||||||||||||||||||||||||||||||||||||||
    a689      DGSATVMAATMTASTSCGIALLWLCSHRAWKENGQSEYLX
                   430       440       450       460
```

The following partial DNA sequence was identified in *N. gonorrhoeae* <SEQ ID 2297>

```
g690.seq (partial)
  1 ATGAAAAACA AAACGTCATC ACTTCCCTTA TGGCTTGCCG CAATCATGCT

51 GGCCGCGCGT TCCCCGAGCA AGAAGATAAA ACGAAAGAA AACGGCGCAT

101 CCGCCGCTTC GTCTTCCGCG TCATCGGCTT CTTCCCAAAC CGATTTGCAA

151 CCGGCCGCAT CCGCCCCTGA TAACGTCAAG CAGGCAGAAA GCGCGCCACT

201 GTGAAATTGC ACCGGCCTGC ACCCCGCCGC CGGCATTGGC GATCTCATAC

251 AGCAAATCGC CGAACACATC GACTCGGACT GTCTGTTTGC CCTTTCCCAT

301 AACGAACTGG AAACCCGTTT CGGCTTACCC GGCGGCGGCT ATGACAACAT

351 ACAGCGGctG CTgtttCCCG ACATCCGCCC TGAAGATCCC GACTACCATC

401 AGAAAATCAT GCTGGCAATC GAAGACTTGC GTTACGGAAC GCGCACCATC

451 AGccgGCAGG CACAAGATGC CATAATGGAA CAGGAACGCC gcctccGaGa 501 agCGACGCTG ATGCTGACAC AGGGCAGTCA AAAACCCGC GGaCAAGGCG 551 AGGAACCGAA ACGCGCACGT TATTTTGAAG TTTCGGCAAC ATCtgCCtaT
```

-continued
```
601 TTgaaccggC ACAAcaacGG ACTTggcgGC AATTTCCAAT ACATCGGCCA

651 ATTGCCCGGC TATCTGAAAA TGCACGGAGA AATGCTTGAA AACCAATCAC

701 TCTTCCGGCT GTCCAACCGT GAACGCAATC CCGACAAACC GTTTTTAGAC

751 ATCCATTTTG ACGAAAATGG CAAAATCACG CGTATTGTCG TTTACGAAAA

801 AAATATCTAT...
```

This corresponds to the amino acid sequence <SEQ ID 2298; ORF 690>:

```
g690.pep (partial)
  1 MKNKTSSLPL WLAAIMLAAR SPSKEDKTKE NGASAASSSA SSASSQTDLQ

51 PAASAPDNVK QAESAPL*NC TGLHPAAGIG DLIQQIAEHI DSDCLFALSH

101 NELETRFGLP GGGYDNIQRL LFPDIRPEDP DYHQKIMLAI EDLRYGTRTI

151 SRQAQDAIME QERRLREATL MLTQGSQKTR GQGEEPKRAR YFEVSATSAY

201 LNRHNNGLGG NFQYIGQLPG YLKMHGEMLE NQSLFRLSNR ERNPDKPFLD

251 IHFDENGKIT RIVVYEKNIY ...
```

The following partial DNA sequence was identified in *N. meningitidis* <SEQ ID 2299>:

```
m690.seq..
  1 ATGAAAAACA AAACCTCATC ACTTCTCTTA TGGCTTACCG CAATCATGCT

51 GACCGCGTGT TCTCCGAGCA AAGACGATAA AACCAAAGAA GTCGGTGCAT

101 CCGCTGCTTC GTCCTCCGCG TCATCAGCTC CTTCCCAAAC CGATTTGCAA

151 CCGACCGCAT CCGCCCCTGA TAACGTCAAG CAGGCAGAAA GCGCGCCGCC

201 GTCAAATTGC ACCAGCCTGC ACCCCGCCAC CGGCATTGAC GATCTCATGC

251 AGCAAATCGC CGAACACATT GACTCGGACT GTCTGTTTGC CCTTTCCCAT

301 CACGAACTGG AAACCCGTTT CGGCTTACCC GACGGTGGCT ATGACAACAT

351 ACAGCGGCTG CTGTTTCCCG ACATCCGCCC TGAAGATCCC GACTACCATC

401 AGAAAATCAT ACTGGCAATT GAAGACTTGC GTTACGGAAA GCGCACGATC

451 AGCCGGCAGG CACAAAATGC CTTGATGGAA CAGGAACGCC GCCTCCGAGA

501 AGCGACGCTG TTGCTGATAC AGGGCAGTCA AGAAACCCGC GGACAAGGCG

551 AGGAGCCGAA ACGCACGCGT TATTTTGAAG TTTCGGCAAC CCCTGCCTAT

601 TCGAGCCGGC ACAACAACGG ACTTGGCGGC AATTTCCAAT ACATCAGCCA

651 ATTGCCCGGC TATCTGAAAA TACACGGAGA AATGCTTGAA AACCAATCAC

701 TCTTCCGGCT GTCCAACCGT GAACGCAATC CCGACAAACC GTTTTTAGAC

751 ATCCATTTTG ACGAAAATGG CAAAATCACG CGTATTGTCG TTTACGAAAA

801 AAACATCTAC TTCAATCCAA ACACGGGGCG AATATAA
```

This corresponds to the amino acid sequence <SEQ ID 2300; ORF 690>:

```
m690.pep
  1 MKNKTSSLLL WLTAIMLTAC SPSKDDKTKE VGASAASSSA SSAPSQTDLQ

51 PTASAPDNVK QAESAPPSNC TSLHPATGID DLMQQIAEHI DSDCLFALSH

101 HELETRFGLP DGGYDNIQRL LFPDIRPEDP DYHQKIILAI EDLRYGKRTI
```

-continued

```
151 SRQAQNALME QERRLREATL LLIQGSQETR GQGEEPKRTR YFEVSATPAY

201 SSRHNNGLGG NFQYISQLPG YLKIHGEMLE NQSLFRLSNR ERNPDKPFLD

251 IHFDENGKIT RIVVYEKNIY FNPNTGRI*
```

Computer analysis of this amino acid sequence gave the following results:
Homology with a Predicted ORF from *N. gonorrhoeae*
ORF 690 shows 89.3% identity over a 408 aa overlap with a predicted ORF (ORF 690) from *N. gonorrhoeae*:

```
    m690/g690  89.3% identity in 408 aa overlap 10         20         30         40         50         60
     m690.pep  MKNKTSSLLLWLTAIMLTACSPSKDDKTKEVGASAASSSASSAPSQTDLQPTASAPDNVK
               ||||||||   |::||||:| ||||:|||| |||||||||||||||| ||||||:|||||||
     g690      MKNKTSSLPLWLAAIMLAARSPSKEDKTKENGASAASSSASSASSQTDLQPAASAPDNVK
                     10         20         30         40         50         60

70         80         90        100        110        120
     m690.pep  QAESAPPSNCTSLHPATGIDDLMQQIAEHIDSDCLFALSHHELETRFGLPDGGYDNIQRL
               ||||||   |||:||||:||  ||:|||||||||||||||:|||||||||| |||||||||
     g690      QAESAPLXNCTGLHPAAGIGDLIQQIAEHIDSDCLFALSHNELETRFGLPGGGYDNIQRL
                     70         80         90        100        110        120

130        140        150        160        170        180
     m690.pep  LFPDIRPEDPDYHQKIILAIEDLRYGKRTISRQAQNALMEQERRLREATLLLIQGSQETR
               ||||||||||||||||:|||||||||| ||||||||:|:||||||||||||:| ||||:||
     g690      LFPDIRPEDPDYHQKIMLAIEDLRYGTRTISRQAQDAIMEQERRLREATLMLTQGSQKTR
                    130        140        150        160        170        180

190        200        210        220        230        240
     m690.pep  GQGEEPKRTRYFEVSATPAYSSRHNNGLGGNFQYISQLPGYLKIHGEMLENQSLFRLSNR
               ||||||||:||||||||| :||:|||||||||||:|||||||:|||||||||||||||||
     g690      GQGEEPKRARYFEVSATSAYLNRHNNGLGGNFQYIGQLPGYLKMHGEMLENQSLFRLSNR
                    190        200        210        220        230        240

250        260        270    279
     m690.pep  ERNPDKPFLDIHFDENGKITRIVVYEKNIYFNPNTGRIX
               |||||||||||||||||||||||||||||||
     g690      ERNPDKPFLDIHFDENGKITRIVVYEKNIY
                    250        260        270
```

The following partial DNA sequence was identified in *N. meningitidis* <SEQ ID 2301>

```
a690.seq
   1 ATGAAAAACA AAACCTCATC ACTTCTCTTA TGGCTTGCCG CAATGATGCT

51 GACCGCGTGT TCCCCGAGCA AGAAGATAA AACGAAAGAA AACGGCGCAT

101 CCGCCGCCTC GTCCACGGCA TCCGCCGCTT CGTCTTCCGC GCCCCAAACC

151 GATTTGCAAC CGGCCGCATC CGCCCCTGAT AACGTCAAGC AGGCAGAAAG

201 CGTGCCGCCG TCAAATTGCA CCGACCTGCA CCCCGCCACC GGCATTGACG

251 ATCTCATGCA GCAAATCGCC GAACACATTG ACTCGGACTG TCTGTTTGCC

301 CTTTCCCATC ACGAACTGGA AACCCGTTTC GGCTTACCCG GCGGCGGCTA

351 TGACAACATA CAGCGGCTGC TGTTTCCCGA CATCCGCCCT GAAGATCCCG

401 ACTACCATCA GAAAATCATA CTGGCAATTG AAGACTTGCG TTACGGAAAG

451 CGCACGATCA GCCGGCAGGC ACAAGATGCC TTGATGGAAC AGGAACGCCG

501 CCTCCGAGAA GCGACGCTGT TGCTGATACA GGGCAGTCAA GAAACCCGCG

551 GACAAGGCGA GGAGCCGAAA CGCACGCGTT ATTTTGAAGT TTCGGCAACC

601 CCTGCCTATT CGAGCCGGCA CAACAACGGA CTTGGCGGCA ATTTCCAATA

651 CATCGGCCAA TTGCCCGGCT ATCTGAAAAT ACACGGAGAA ATGCTTGAAA

701 ACCAATCACT CTTCCGGCTG TCCAACCGTG AACGCAATCC CGACAAACCG
```

-continued

```
751 TTTTTAGACA TCCATTTTGA CGAAAATGGC AAAATCACGC GTATTGTCGT

801 TTACGAAAAA AACATCTACT TCAATCCAAA CTTGGGGCGA AGATAA
```

This corresponds to the amino acid sequence <SEQ ID 2302; ORF 690.a>:

```
a690.pep
   1 MKNKTSSLLL WLAAMMLTAC SPSKEDKTKE NGASAASSTA SAASSSAPQT

51 DLQPAASAPD NVKQAESVPP SNCTDLHPAT GIDDLMQQIA EHIDSDCLFA

101 LSHHELETRF GLPGGGYDNI QRLLFPDIRP EDPDYHQKII LAIEDLRYGK

151 RTISRQAQDA LMEQERRLRE ATLLLIQGSQ ETRGQGEEPK RTRYFEVSAT

201 PAYSSRHNNG LGGNFQYIGQ LPGYLKIHGE MLENQSLFRL SNRERNPDKP

251 FLDIHFDENG KITRIVVYEK NIYFNPNLGR R*
```
20

Computer analysis of this amino acid sequence gave the following results:
Homology with a Predicted ORF from *N. meningitidis*
ORF 690 shows 93.9% identity over a 280 aa overlap with a predicted ORF (ORF 690) from *N. meningitidis*:

```
    m690/a690  93.9% identity in 280 aa overlap 10         20         30         40         50
    m690.pep   MKNKTSSLLLWLTAIMLTACSPSKDDKTKEVGASAASSSASSAPS---QTDLQPTASAPD
               ||||||||   |||:|:|||||||||| :||||  ||||||||:||:|   ||||||:|||||
    a690       MKNKTSSLPLWLAAMMLTACSPSKEDKTKENGASAASSTASAASSSAPQTDLQRAASAPD
                   10         20         30         40         50         60

60         70         80         90        100        110
    m690.pep   NVKQAESAPPSNCTSLHPATGIDDLMQQIAEHIDSDCLFALSHHELETRFGLPDGGYDNI
               |||||||:||||||:|||||||||||||||||||||||||||||||||||| ||||||
    a690       NVKQAESVPPSNCTDLHPATGIDDLMQQIAEHIDSDCLFALSHHELETRFGLPGGGYDNI
                   70         80         90        100        110        120

120        130        140        150        160        170
    m690.pep   QRLLFPDIRPEDPDYHQKIILAIEDLRYGKRTISRQAQNALMEQERRLREATLLLIQGSQ
               ||||||||||||||||||||||||||||||||||||||:||||||||||||||||||||
    a690       QRLLFPDIRPEDPDYHQKIILAIEDLRYGKRTISRQAQDALMEQERRLREATLLLIQGSQ
                  130        140        150        160        170        180

180        190        200        210        220        230
    m690.pep   ETRGQGEEPKRTRYFEVSATPAYSSRHNNGLGGNFQYISQLPGYLKIHGEMLENQSLFRL
               |||||||||||||||||||||||||||||||||||||:|||||||||||||||||||||
    a690       ETRGQGEEPKRTRYFEVSATPAYSSRHNNGLGGNFQYIGQLPGYLKIHGEMLENQSLFRL
                  190        200        210        220        230        240

240        250        260        270        279
    m690.pep   SNRERNPDKPFLDIHFDENGKITRIVVYEKNIYFNPNTGRIX
               |||||||||||||||||||||||||||||||||||||| ||
    a690       SNRERNPDKPFLDIHFDENGKITRIVVYEKNIYFNPNLGRRX
                  250        260        270        280
```

The following partial DNA sequence was identified in *N. gonorrhoeae* <SEQ ID 2303>

```
g691.seq
   1 GTGCCGCTGC CTGCTCCCTG CCGTTTTGCC AAACCTGCCG CCTCTTTTTT

51 AAGTATGGCT TTGCTTTCCT GCCAGCTTTC CCACGCCGCC ACGGCTTATA

101 TCCCCCCGAA CGATTTTCAA CCGAACTGCG ACATACGCCG GCTCGGGCTG

151 ACACAGGGTC AGCACAATGA GCTGCGTAAA ATCCGCGCCG CCTTCAAAAT

201 GGCGGGCGAC AGGGCGCGTT TGAAGGTTAT GCATTCCGAA CACAGCCGCC

251 GCCGCTCTGT CGTCGAAATC ATTTCTTCGG ATGTTTTTAA TCGGAACGAG

301 GCGCGCGATT ATGTCGAAAG CCGCTACCAC TCCAGCATGG ATTTTGCGGT
```

-continued

```
351 GGACGAATTG GAAATCCAAC ACCGCTTCTT CCATATTCTC ACACCGCAAC

401 AGCAGCAAAT GTGGCTTTCT TCCTGCCTCA AATAA
```

This corresponds to the amino acid sequence <SEQ ID 2304; ORF 691>:

```
g691.pep
   1 VPLPAPCRFA KPAASFLSMA LLSCQLSHAA TAYIPPNDFQ PNCDIRRLGL

51 TQGQHNELRK IRAAFKMAGD RARLKVMHSE HSRRRSVVEI ISSDVFNRNE

101 ARDYVESRYH SSMDFAVDEL EIQHRFFHIL TPQQQQMWLS SCLK*
```

The following partial DNA sequence was identified in *N. meningitidis* <SEQ ID 2305>:

```
m691.seq
   1 GTGCCACTGC CTGCTCCCTG CCGTTTTGCC AAACCTGCCG CCTCTTTTTT

51 AAGTATGGCT TTGCTTTCCT GTCAGCTTTC CCACGCCGCC ACGGCTTATA

101 TCCCCCCGAA CGATTTTCAA CCGAACTGCG ACATACGCCG ACTCGGGCTG

151 ACCCAAAGTC AGCACAATGA GCTGCGTAAA ATCCGCACCG CCTTCAAAAT

201 GGCGGGCGAC AGGGCGCGTT TGAAGGTTAT GCATTCCGAA CACAGCCGCC

251 GCCGGTCTGT CGTCGAAATC ATTTCCTCGG ATGTTTTTAA TCGGAACGAG

301 GCGCGCGATT ATGTCGAAAG CCGCTATTTG TCCGGTATGG ATTTTGCGGT

351 GGACGAATTG GAAATCCAAC ACCGGTTCTT CCATATCCTC ACACCGCAAC

401 AGCAGCAAAT GTGGCTTTCT TCCTGCCTCA AATAA
```

This corresponds to the amino acid sequence <SEQ ID 2306; ORF 691>:

```
m691.pep
   1 VPLPAPCRFA KPAASFLSMA LLSCQLSHAA TAYIPPNDFQ PNCDIRRLGL

51 TQSQHNELRK IRTAFKMAGD RARLKVMHSE HSRRRSVVEI ISSDVFNRNE

101 ARDYVESRYL SGMDFAVDEL EIQHRFFHIL TPQQQQMWLS SCLK*
```

Computer analysis of this amino acid sequence gave the following results:
Homology with a Predicted ORF from *N. gonorrhoeae*
ORF 691 shows 97.2% identity over a 144 aa overlap with a predicted ORF (ORF 691) from *N. gonorrhoeae*:

```
    m691/g691 97.2% identity in 144 aa overlap 10         20         30         40         50         60
    m691.pep  VPLPAPCRFAKPAASFLSMALLSCQLSHAATAYIPPNDFQPNCDIRRLGLTQSQHNELRK
              ||||||||||||||||||||||||||||||||||||||||||||||||||:|||||||
    g691      VPLPAPCRFAKPAASFLSMALLSCQLSHAATAYIPPNDFQPNCDIRRLGLTQGQHNELRK
                     10         20         30         40         50         60

70         80         90        100        110        120
    m691.pep  IRTAFKMAGDRARLKVMHSEHSRRRSVVEIISSDVFNRNEARDYVESRYLSGMDFAVDEL
              ||:|||||||||||||||||||||||||||||||||||||||||||||||:||||||||
    g691      IRAAFKMAGDRARLKVMHSEHSRRRSVVEIISSDVFNRNEARDYVESRYHSSMDFAVDEL
                     70         80         90        100        110        120

130        140
    m691.pep  EIQHRFFHILTPQQQQMWLSSCLKX
              |||||||||||||||||||||||||
    g691      EIQHRFFHILTPQQQQMWLSSCLKX
                    130        140
```

The following partial DNA sequence was identified in *N. meningitidis* <SEQ ID 2307>

```
a691.seq
   1 GTGCCACTGC NTGCTCCCTG CCGTTTTGCC AAACCTGCCG CCTCTTTTTT

51 AAGTATGGCT TTGCTTTCCT GCCAGCTTTC CCACGCCGCC ACGGCTTATA

101 TCCCCCTGAA CGATTTTCAA CCGAACTGCG ACATACGCCG GCTCGGACTG

151 ACACAGGGTC AGCACAATGA ACTGCGTAAA ATCCGCGCCG CCTTCAAAAT

201 GGCGGGCGAC AGGGCGCGTT TGAAGGTTAT GCATTCCGAA CACAGCCGCC

251 GTCGGTCTGT CGTCGAAATC ATTTCCTCGG ATGTTTTTAA TCGGAACGAG

301 GCGCGCGATT ATGTCGAAAG CCGCTATTTG TCCGGTATGG ATTTTGCGGT

351 GGACGAATTG GAAATCCAAC ACCGGTTCTT CCATATCCTC ACACCGCAAC

401 AGCAGCAAAT GTGGCTTTCT TCCTGCCTCA AATAA
```

This corresponds to the amino acid sequence <SEQ ID 2308; ORF 691.a>:

```
a691.pep
   1 VPLXAPCRFA KPAASFLSMA LLSCQLSHAA TAYIPLNDFQ PNCDIRRLGL

51 TQGQHNELRK IRAAFKMAGD RARLKVMHSE HSRRRSVVEI ISSDVFNRNE

101 ARDYVESRYL SGMDFAVDEL EIQHRFFHIL TPQQQQMWLS SCLK*
```

Computer analysis of this amino acid sequence gave the following results:

Homology with a Predicted ORF from *N. meningitidis*

ORF 691 shows 97.2% identity over a 144 aa overlap with a predicted ORF (ORF 691) from *N. meningitidis*:

```
m691/a691  97.2%  identity in 144 aa overlap 10        20        30        40        50        60
m691.pep   VPLPAPCRFAKPAASFLSMALLSCQLSHAATAYIPPNDFQPNCDIRRLGLTQSQHNELRK
           ||| |||||||||||||||||||||||||||||||| |||||||||||||||:|||||||
a691       VPLXAPCRFAKPAASFLSMALLSCQLSHAATAYIPLNDFQPNCDIRRLGLTQGQHNELRK
                   10        20        30        40        50        60

70        80        90       100       110       120
m691.pep   IRTAFKMAGDRARLKVMHSEHSRRRSVVEIISSDVFNRNEARDYVESRYLSGMDFAVDEL
           ||:|||||||||||||||||||||||||||||||||||||||||||||||||||||||||
a691       IRAAFKMAGDRARLKVMHSEHSRRRSVVEIISSDVFNRNEARDYVESRYLSGMDFAVDEL
                   70        80        90       100       110       120

130       140
m691.pep   EIQHRFFHILTPQQQQMWLSSCLKX
           |||||||||||||||||||||||||
a691       EIQHRFFHILTPQQQQMWLSSCLKX
                  130       140
```

The following partial DNA sequence was identified in *N. gonorrhoeae* <SEQ ID 2309>

```
g692.seq
   1   GTATCGCACA CACGCTGTCG CTGTTCGGAA TCGAtacGCC GGATTTGGCG

51   GAATGGCAGG GAATGGCGGA TTAAAGGACA AAAATGCCGT CTGAACACGG

101   ATGCGGTTCA GACGGCATCA TTTTATACGA CTGCCTTATT TGGCTGCGCC

151   TTCATTCCAT GCGGCAGGGT ATTTGTAGCC CTCGAAGCGT TTGTGCGCGT

201   AGGCTTTGAA CGCGTCGGAG TTATAGGCCT CGGTTACGTC TTTAAGCCAT

251   TGGCTGTCTT TGTCGGCGGT TTTgacGGCA GACCAGTTGA CATAGGCAAA
```

-continued

```
 301 GCTCGGCTCT TGGAACAGGG CTTCGGTCAG CTTCATGCCG CTGCTTATGG

351 CGTAGTTGCC GTTGACGACG GCAAAATCCA CGTCGGCGCG GCTGCGCGGC

401 AGTTGTGCGG CTTCAAGCTC GACGATTTTG ATGTTTTTCA GGTTTTCCGC

451 GATGTCGGCT TTGGATGCGG TCAGCGGATT GATGCCGTCT TTGAGTTTGA

501 TCCAACCCAG TTCGTTCAGC ATCACCAAGG CGCGTGCGAA GTTGGAcggG

551 TcgtTGGGCG CGGATACGGT GCTGCCGTCT TTGACTTCTT CCAGCGATTT

601 CAGTTTGCCC GGATACAGTC CCAAAGGCGC GGTCGGCACT TGGAAGGCTT

651 CGGTGATGTC CAGGTTGTGT TCTTTTTTGA AATCGTCAAG ATAGGGTTTG

701 TGTTGGAAGA CGTTGATGTC CAACTCGCCC TCCGCCAATG CCAGATTCGG

751 GCGCACATAG TCggTAAATT cgaccaatTT gacgGTGTag cCTTTTTTCT

801 CCAGCTCGgc tTGGATTTGT TCTTTGACCA TATcgccgaa gtcgcccacg 851 gTCGTGCCGA agacgaTTTC TTTTTTCGCc GcgcCGTTAT CGGCAGAAGG 901 GGCGGCGgca gaggctgcGG GCGCGCTGTC TTTTtgaccG ccgCAGGCTG 951 CGAGGATGAG CGCGAGtgcg gcggcggaaa ggGTTTTGAA GAAGGTTTTc 1001 atATTTTCTc ctga
```

This corresponds to the amino acid sequence <SEQ ID 2310; ORF 692>:

```
g692.pep
   1 VSHTRCRCSE SIRRIWRNGR EWRIKGQKCR LNTDAVQTAS FYTTALFGCA

51 FIPCGRVFVA LEAFVRVGFE RVGVIGLGYV FKPLAVFVGG FDGRPVDIGK

101 ARLLEQGFGQ LHAAAYGVVA VDDGKIHVGA AARQLCGFKL DDFDVFQVFR

151 DVGFGCGQRI DAVFEFDPTQ FVQHHQGACE VGRVVGRGYG AAVFDFFQRF

201 QFARIQSQRR GRHLEGFGDV QVVFFFEIVK IGFVLEDVDV QLALRQCQIR

251 AHIVGKFDQF DGVAFFLQLG LDLFFDHIAE VAHGRAEDDF FFRRAVIGRR

301 GGGRGCGRAV FLTAAGCEDE RECGGGKGFE EGFHIFS*
```

The following partial DNA sequence was identified in *N. meningitidis* <SEQ ID 2311>:

```
m692.seq
   1 GTGTTGCACA CGCTTTGTCG CTGTTCGGAA TCGATACGCC GGATTCGGCG

51 GAATGGCAGG GAATGGCGGA TTAAAGGACA AAAATGCCGT CTGAACACGG

101 ATACAGTTCA GACGGCATCA TTTTATACGA CTGCCTTATT TGGCTGCGCC

151 TTCATTCCAT GCGGCAGGGG ATTTGTAGCC CTCGAAGCGT TTGTGCGCGT

201 AGGCTTTGAA CGCGTCGGAG TTATAGGCCT CGGTTACGTC TTTAAGCCAT

251 TGGCTGTCTT TGTCGGCGGT TTTGACGGCA GACCAGTTGA CATAGGCAAA

301 GCTCGGTTCT TGGAACAGGG CTTCGGTCAG CTTCATGCCG CTGCTTATGG

351 CGTAGTTGCC GTTGACGACG GCAAAATCCA CGTCGGCGCG GCTACGCGGC

401 AGTTGCGCGG CTTCAAGCTC GACGATTTTG ATGTTTTTCA GGTTCTCGGC

451 GATGTCCGCT TTGGATGCGG TCAACGGATT GATGCCGTCT TTGAGTTTGA

501 TCCAACCCAG TTCGTCGAGC ATCACCAAGA CGCGGGCGAA GTTGGACGGG

551 TCGTTGGGCG CGGATACGGT GCTGCCGTCT TTGACTTCTT CCAGCGATTT
```

-continued

```
 601 CAGCTTGCCC GGGTACAGTC CCAAAGGCGC GGTCGGCACT TGGAAGACTT

651 CGGTGATGTC CAGATTGTGT TCTTTTTTGA AGTCGTCAAG ATAGGGTTTG

701 TGTTGGAAGA CGTTGATGTC CAACTCGCCC TCAGCCAATG CCAGATTCGG

751 GCGTACATAG TCGGTAAACT CGACCAGTTT GACGGTGTAG CCTTTTTTCT

801 CCAGCTCGGC TTGGATTTGT TCTTTGACCA TATCGCCGAA GTCGCCGACG

851 GTCGTGCCGA AGACGATTTC TTTTTTCGCC GCGCCGTTGT CGGCGGCGGC

901 AGAAGCGGAT GCGGCGGGCG CGCTGTCTTT TTGACCGCCG CAGGCGGCGA

951 GGATGAGCGC GAGTGCGGCG GCGGAAAGGG TTTTGAAGAA GGTTTTCATA

1001 TTTTCTCCTG A
```

This corresponds to the amino acid sequence <SEQ ID 2312; ORF 692>:

```
m692.pep
  1 VLHTLCRCSE SIRRIRRNGR EWRIKGQKCR LNTDTVQTAS FYTTALFGCA

51 FIPCGRGFVA LEAFVRVGFE RVGVIGLGYV FKPLAVFVGG FDGRPVDIGK

101 ARFLEQGFGQ LHAAAYGVVA VDDGKIHVGA ATRQLRGFKL DDFDVFQVLG

151 DVRFGCGQRI DAVFEFDPTQ FVEHHQDAGE VGRVVGRGYG AAVFDFFQRF

201 QLARVQSQRR GRHLEDFGDV QIVFFFEVVK IGFVLEDVDV QLALSQCQIR

251 AYIVGKLDQF DGVAFFLQLG LDLFFDHIAE VADGRAEDDF FFRRAVVGGG

301 RSGCGGRAVF LTAAGGEDER ECGGGKGFEE GFHIFS*
```

Computer analysis of this amino acid sequence gave the following results:
Homology with a Predicted ORF from *N. gonorrhoeae*
ORF 692 shows 91.1% identity over a 338 aa overlap with a predicted ORF (ORF 692) from *N. gonorrhoeae*:

```
m692/g692 91.1% identity in 338 aa overlap 10         20         30         40         50         60
m692.pep  VLHTLCRCSESIRRIRRNGREWRIKGQKCRLNTDTVQTASFYTTALFGCAFIPCGRGFVA
          | || ||||||||| |||||||||||||||||||||:|||||||||||||||||||| |||
g692      VSHTRCRCSESIRRIWRNGREWRIKGQKCRLNTDAVQTASFYTTALFGCAFIPCGRVFVA
                 10         20         30         40         50         60

70         80         90        100        110        120
m692.pep  LEAFVRVGFERVGVIGLGYVFKPLAVFVGGFDGRPVDIGKARFLEQGFGQLHAAAYGVVA
          ||||||||||||||||||||||||||||||||||||||||||:|||||||||||||||||
g692      LEAFVRVGFERVGVIGLGYVFKPLAVFVGGFDGRPVDIGKARLLEQGFGQLHAAAYGVVA
                 70         80         90        100        110        120

130        140        150        160        170        180
m692.pep  VDDGKIHVGAATRQLRGFKLDDFDVFQVLGDVRFGCGQRIDAVFEFDPTQFVEHHQDAGE
          ||||||||||:||| ||||||||||||:|| || |||||||||||||||||||:|||| |
g692      VDDGKIHVGAAARQLCGFKLDDFDVFQVFRDVGFGCGQRIDAVFEFDPTQFVQHHQGACE
                130        140        150        160        170        180

190        200        210        220        230        240
m692.pep  VGRVVGRGYGAAVFDFFQRFQLARVQSQRRGRHLEDFGDVQIVFFFEVVKIGFVLEDVDV
          ||||||||||||||||||||||:|:|||||||||||:|||||:|||||:|||||||||||
a692      VGRVVGRGYGAAVFDFFQRFQFARIQSQRRGRHLEGFGDVQVVFFFEIVKIGFVLEDVDV
                190        200        210        220        230        240

250        260        270        280        290
m692.pep  QLALSQCQIRAYIVGKLDQFDGVAFFLQLGLDLFFDHIAEVADGRAEDDFFFRRAVVG--
          ||||:||||||:||||||:|||||||||||||||||||||||:|||||||||||||||:|
g692      QLALRQCQIRAHIVGKFDQFDGVAFFLQLGLDLFFDHIAEVAHGRAEDDFFFRRAVVGRR
                250        260        270        280        290        300

300        310        320        330
m692.pep  GGRSGCGGRAVFLTAAGGEDERECGGGKGFEEGFHIFSX
          || ||| ||||||||||| |||||||||||||||||||
g692      GGGRGCG-RAVFLTAAGCEDERECGGGKGFEEGFHIFSX
                  310        320        330
```

The following partial DNA sequence was identified in *N. meningitidis* <SEQ ID 2313>

```
a692.seq
     1 GTGTTGCACA CGCTTTGTCG CTGTTCGGAA TCGATACGCC GGATTCGGCG
    51 GAATGGCAGG GAATGGCGGA TTAAAGGACA AAAATGCCGT CTGAACACGG
   101 ATACGGTTCA GACGGCATCA TTTTATACGA CTGCCTTATT TGGCTGCGCC
   151 TTCATTCCAT GCGGCAGGGG ATTTGTAGCC CTCGAAGCGT TTGTGCGCGT
   201 AGGCTTTGAA CGCGTCGGAG TTATAGGCCT CGGTTACGTC TTTAAGCCAT
   251 TGGCTGTCTT TGTCGGCGGT TTTGACGGCA GACCAGTTGA CATAGGCAAA
   301 GCTCGGTTCT TGGAACAGGG CTTCGGTCAG CTTCATGCCG CTGCTTATGG
   351 CGTAGTTGCC GTTGACGACG GCAAAATCCA CGTCGGCGCG GCTACGCGGC
   401 AGTTGCGCGG CTTCAAGCTC GACGATTTTG ATGTTTTTCA GGTTTTCGGC
   451 AATGTCCGCT TTGGATGCGG TCAGCGGATT GATGCCGTCT TTGAGTTTGA
   501 TCCAACCCAG TTCGTCGAGC ATCACCAAGA CGCGGGCGAA GTTGGACGGG
   551 TCGTTGGGCG CGGATACGGT GCTGCCGTCT TTGACTTCTT CCAGCGATTT
   601 CAGCTTGCCC GGGTACAGTC CCAAAGGCGC GGTCGGCACT TGGAAGACTT
   651 CGGTGATGTC CAGATTGTGT TCTTTTTTGA AGTCGTCAAG ATAGGGTTTG
   701 TGTTGGAAGA CGTTGATGTC CAACTCGCCC TCAGCCAATG CCAGATTCGG
   751 GCGCACATAG TCGGTAAACT CGACCAGTTT GACGGTGTAG CCTTTTTTCT
   801 CCAGCTCGGG TTGGATTTGT TCTTTGACCA TATCGCCGAA GTCGCCGACG
   851 GTCGTGCCGA AGACGATTTC TTTTTTCGCC GCGCCGTTGT CGGCGGCGGC
   901 AGAAGCGGAT GCGGCGGGCG CGCTATCTTT TTGACCGCCG CAGGCGGCGA
   951 GGATGAGCGC GAGTGCGGCG GCGGAAAGGG TTTTGAAGAA GGTTTTCATA
  1001 TTTTCTCCTG A
```

This corresponds to the amino acid sequence <SEQ ID 2314; ORF 692.a>:

```
a692.pep
     1 VLHTLCRCSE SIRRIRRNGR EWRIKGQKCR LNTDTVQTAS FYTTALFGCA
    51 FIPCGRGFVA LEAFVRVGFE RVGVIGLGYV FKPLAVFVGG FDGRPVDIGK
   101 ARFLEQGFGQ LHAAAYGVVA VDDGKIHVGA ATRQLRGFKL DDFDVFQVFG
   151 NVRFGCGQRI DAVFEFDPTQ FVEHHQDAGE VGRVVGRGYG AAVFDFFQRF
   201 QLARVQSQRR GRHLEDFGDV QIVFFFEVVK IGFVLEDVDV QLALSQCQIR
   251 AHIVGKLDQF DGVAFFLQLG LDLFFDHIAE VADGRAEDDF FFRRAVVGGG
   301 RSGCGGRAIF LTAAGGEDER ECGGGKGFEE GFHIFS*
```

Computer analysis of this amino acid sequence gave the following results:
Homology with a Predicted ORF from *N. meningitidis*
ORF 692 shows 98.8% identity over a 336 aa overlap with a predicted ORF (ORF 692) from *N. meningitidis*:

```
m692/a692 98.8% identity in 336 aa overlap 10        20        30        40        50        60
   m692.pep  VLHTLCRCSESIRRIRRNGREWRIKGQKCRLNTDTVQTASFYTTALFGCAFIPCGRGFVA
             ||||||||||||||||||||||||||||||||||||||||||||||||||||||||||||
       a692  VLHTLCRCSESIRRIRRNGREWRIKGQKCRLNTDTVQTASFYTTALFGCAFIPCGRGFVA
                  10        20        30        40        50        60

70        80        90       100       110       120
   m692.pep  LEAFVRVGFERVGVIGLGYVFKPLAVFVGGFDGRPVDIGKARFLEQGFGQLHAAAYGVVA
             ||||||||||||||||||||||||||||||||||||||||||||||||||||||||||||
       a692  LEAFVRVGFERVGVIGLGYVFKPLAVFVGGFDGRPVDIGKARFLEQGFGQLHAAAYGVVA
                  70        80        90       100       110       120

130       140       150       160       170       180
   m692.pep  VDDGKIHVGAATRQLRGFKLDDFDVFQVLGDVRFGCGQRIDAVFEFDPTQFVEHHQDAGE
             |||||||||||||||||||||||||||||||:|:||||||||||||||||||||||||||
       a692  VDDGKIHVGAATRQLRGFKLDDFDVFQVFGNVRFGCGQRIDAVFEFDPTQFVEHHQDAGE
                 130       140       150       160       170       180

190       200       210       220       230       240
   m692.pep  VGRVVGRGYGAAVFDFFQRFQLARVQSQRRGRHLEDFGDVQIVFFFEVVKIGFVLEDVDV
             ||||||||||||||||||||||||||||||||||||||||||||||||||||||||||||
       a692  VGRVVGRGYGAAVFDFFQRFQLARVQSQRRGRHLEDFGDVQIVFFFEVVKIGFVLEDVDV
                 190       200       210       220       230       240

250       260       270       280       290       300
   m692.pep  QLALSQCQIRAYIVGKLDQFDGVAFFLQLGLDLFFDHIAEVADGRAEDDFFFRRAVVGGG
             |||||||||||:||||||||||||||||||||||||||||||||||||||||||||||||
       a692  QLALSQCQIRAHIVGKLDQFDGVAFFLQLGLDLFFDHIAEVADGRAEDDFFFRRAVVGGG
                 250       260       270       280       290       300

310       320       330
   m692.pep  RSGCGGRAVFLTAAGGEDERECGGGKGFEEGFHIFSX
             |||||||||:|||||||||||||||||||||||||||
       a692  RSGCGGRAIGLTAAGGEDERECGGGKGFEEGFHIFSX
                 310       320       330
```

The following partial DNA sequence was identified in *N. gonorrhoeae* <SEQ ID 2315>:

```
g694.seq
    1  TCGGCATTTG TGTTGCCCAA ACATCCGATG CCTGCGTTAA CGCCTGCGTC

51  AACGTTTGCA CAAATCGGGT TTGGTTTCGC CCTCGCGGCG CAGCTCCTTG

101  GGCAGGACGA ACACGATGCT TCCTTCCGCG CCCCCCCCTT CGCGCACGGT

151  TTCATGCCCC CATCCGCGTA TGGTTGCCAA TACTTCCCGC ACCAACACTT

201  CGGGCGCGGA CGCGCCTGCC GTTACGCCGA CTTTGCTTTT GCCTTCAAAC

251  CACGTGCGTT GCaggTAGGA CGCGTTGTCC ACCATATACG CATCGATTCC

301  GCGCGATGCC GCCACTTCGC GCAGGCGGTT GCTGTTGGAC GAATTGGGCG

351  AACCGACCAC AATCACGATG TCGCACTGTT CCGCCAGCTC TTTGACGGCG

401  GTTTGCCGGT TGGTCGTCGC ATAGCAGATG TCTTCCTTGT GCGGATTGCG

451  GATATTGGGG AAACGCGCGT TCAGCGCGGC GATGATGTCT TTGGTTTCAT

501  CGACCGAGAG CGTGGTTTGG CTGACATAGG CGAGTTTGTC GGGGTTTCTG

551  ACTTCGAGTT TTGCCACATC TCCGACCGTT TCGACCAAAA GCATTTTGCC

601  CGGTGCAAGC TGCCCCATCG TGCCTTCGAC CTCGGCGTGC CCCTTATGCC

651  CGATCATGAT GATTTCACAG TCTTGGGCAT CCAGTCGGGC GACTTCCTTA

701  TGCACTTTCG TCACCAGCGG GCAAGTCGCA TCAAATACCC GGAAACCGCG

751  CTCCGCCGCT TCCTGCTGCA CCGCCTTCGA TACGCCGTGT GCCGAATAAA

801  CCAGTGTCGC GCCCGGCGGC ACTTCCGCCA AGTCTTCGAT AAACACCGCG
```

-continued

```
 851 CCTTTTTCGC GCAGGTTGTC CACGACGAAT TTGTTGTGGA CGACTTCGTG

901 GCGCACATAA ACCGGCGCGC CGAATTCTTC CAAAGCACGT TCGACAATAC

951 TGATTGCCCG ATCCACACCG GCGCAGAAGC CGCGCGGATT GGCAAGGATG

1001 ATGGTTTTTC CGTTCATAAG TTTTGCATTC CGTGTTCAGA CGGCATTCAC

1051 GTTTTTTTGC TNNATCTTTG CGATGGACGA TATTGTCAAG CACCGCCAAC

1101 ACCGCACCGA CGCAGATAA
```

This corresponds to the amino acid sequence <SEQ ID 2316; ORF 694>:

```
g694.pep (partial)
  1 SAFVLPKHPM PALTPASTFA QIGFGFALAA QLLGQDEHDA FFRAPPFAHG

51 FMPPSAYGCQ YFPHQHFGRG RACRYADFAF AFKPRALQVG RVVHHIRIDS

101 ARCRHFAQAV AVGRIGRTDH NHDVALFRQL FDGGLPVGRR IADVFLVRIA

151 DIGETRVQRG DDVFGFIDRE RGLADIGEFV GVSDFEFCHI SDRFDQKHFA

201 RCKLPHRAFD LGVPLMPDHD DFTVLGIQSG DFLMHFRHQR ASRIKYPETA

251 LRRFLLHRLR YAVCRINQCR ARRHFRQVFD KHRAFFAQVV HDEFVVDDFV

301 AHINRRAEFF QSTFDNTDCP IHTGAEAARI GKDDGFSVHK FCIPCSDGIH

351 VFLLXLCDGR YCQAPPTPHR RR*
```

The following partial DNA sequence was identified in *N. meningitidis* <SEQ ID 2317>:

```
m694.seq
  1 TTGGTTTCCG CATCCGGCAC ACGGCAAAAA TGCCGTCTGA AGCCTGTTCA

51 GACGGCATTT GTGTTGCCCA AACATTCAAC GCCTGCGTCA ACGTTTGCAC

101 AAATCGGGTT TGGTTTCGCC CTCGCGGCGC AACTCTTTGG GCAGGACGAA

151 CACAATGCTT TCTTCCGCAC CCTCGCCTTC GCGTACGGTT TCGTGCCCCC

201 ATCCGCGTAT GGTTGCCAGT ACTTCCCGCA CCAACACTTC GGGCGCGGAC

251 GCGCCTGCCG TTACGCCGAC TTTGTTTTTG CCCTCAAACC ATGCGCGTTG

301 CAGGTAGCCT GCATTATCCA CCATATACGC ATCGATTCCG CGCGATGCCG

351 CCACTTCGCG CAAGCGGTTG CTGTTGGACG AATTGGGCGA ACCGACCACA

401 ATCACGATGT CGCACTGTTC TGCCAACTCT TTGACGGCGG TTTGCCGGTT

451 GGTCGTCGCA TAGCAGATAT CTTCCTTGTG CGGATTGCGG ATATTGGGGA

501 AACGCGCGTT CAGCGCGGCG ATGATGTCTT TGGTTTCATC GACCGAGAGC

551 GTGGTTTGGC TGACATAGGC GAGTTTGTCG GGGTTTCTGA CTTCGAGTTT

601 TGCCACATCT CCGACCGTTT CGACCAAAAG CATTTTGCCC GGCGCAAGCT

651 GCCCCATCGT TCCTTCGACC TCGACGTGCC CCTTATGCCC GATCATGATG

701 ATTTCACAGT CTTGGGCATC CAGTCGGGCG ACTTCCTTAT GCACTTTCGT

751 CACCAGCGGG CAAGTCGCAT CAAACACGCG GAAACCGCgC TCCGCCGCTT

801 CTTGCCGCAC CGCCTTCGAT ACGCCGTGTG CCGAATAAAC CAGTGTCGCG

851 CCCGGCGGCA CTTCCGCCAA GTCTTCAATA ACACCGCAC CTTTTTCACG

901 CAGGTTGTCC ACGACGAATT TGTTGTGAAC GACTTCGTGG CGCACATAAA

951 TCGGCGCGCC GAACTCTTCC AAAGCACGTT CGACAATACT GATT GCCCGA
```

-continued

```
1001 TCCACACCAG CGCAGAAGCC GCGCGGATTG GCAAGGATGA TGGTTTTCTC

1051 GTTCATAAGC CCGGTATTTC GTTTTCAGAC GGCATCAATA TTTTTCTTCT

1101 TGGGTTTTAC GGTGGACGAT GTTGTCCAAC ACCGCCAACA CCGCACCGAC

1151 GCAGATAA
```

This corresponds to the amino acid sequence <SEQ ID 2318; ORF 694>:

```
m694.pep
   1 LVSASGTRQK CRLKPVQTAF VLPKHSTPAS TFAQIGFGFA LAAQLFGQDE

51 HNAFFRTLAF AYGFVPPSAY GCQYFPHQHF GRGRACRYAD FVFALKPCAL

101 QVACIIHHIR IDSARCRHFA QAVAVGRIGR TDHNHDVALF CQLFDGGLPV

151 GRRIADIFLV RIADIGETRV QRGDDVFGFI DRERGLADIG EFVGVSDFEF

201 CHISDRFDQK HFARRKLPHR SFDLDVPLMP DHDDFTVLGI QSGDFLMHFR

251 HQRASRIKHA ETALRRFLPH RLRYAVCRIN QCRARRHFRQ VFNKHRTFFT

301 QVVHDEFVVN DFVAHINRRA ELFQSTFDNT DCPIHTSAEA ARIGKDDGFL

351 VHKPGISFSD GINIFLLGFY GGRCCPTPPT PHRRR*
```

Computer analysis of this amino acid sequence gave the following results:

Homology with a Predicted ORF from *N. gonorrhoeae*
ORF 694 shows 86.8% identity over a 372 aa overlap with a predicted ORF (ORF 694) from *N. gonorrhoeae*:

```
m694/g694  86.8% identity in 372 aa overlap 10         20         30         40         50
m694.pep   LVSASGTRQKCRLKPVQTAFVLPKHS----TPASTFAQIGFGFALAAQLFGQDEHNAFFR
           ||||||||||||||||||:|||||||    ||||||||||||||||||:|||||:||||
g694                     SAFVLPKHPMPALTPASTFAQIGFGFALAAQLLGQDEHDAFFR
                                10         20         30         40

60         70         80         90        100        110
m694.pep   TLAFAYGFVPPSAYGCQYFPHQHFGRGRACRYADFVFALKPCALQVACIIHHIRIDSARC
           :  ||:||:||||||||||||||||||||||||||:||:||  |||:  ::||||||||
g694       APPFAHGFMPPSAYGCQYFPHQHFGRGRACRYADFAFAFKPRALQVGRVVHHIRIDSARC
                   50         60         70         80         90        100

120        130        140        150        160        170
m694.pep   RHFAQAVAVGRIGRTDHNHDVALFCQLFDGGLPVGRRIADIFLVRIADIGETRVQRGDDV
           ||||||||||||||||||||||||||||||||||||||||::||:||||||||||||||
g694       RHFAQAVAVGRIGRTDHNHDVALFRQLFDGGLPVGRRIADVFLVRIADIGETRVQRGDDV
                  110        120        130        140        150        160

180        190        200        210        220        230
m694.pep   FGFIDRERGLADIGEFVGVSDFEFCHISDRFDQKHFARRKLPHRSFDLDVPLMPDHDDFT
           |||||||||||||||||||||||||||||||||||||:|||||||:|||||||||||||
g694       FGFIDRERGLADIGEFVGVSDFEFCHISDRFDQKHFARCKLPHRAFDLGVPLMPDHDDFT
                  170        180        190        200        210        220

240        250        260        270        280        290
m694.pep   VLGIQSGDFLMHFRHQRASRIKHAETALRRFLPHRLRYAVCRINQCRARRHFRQVFNKHR
           ||||||||||||||||||||||| :||||||||||:|||||||||||||||||||:|||
g694       VLGIQSGDFLMHFRHQRASRIKYPETALRRFLLHRLRYAVCRINQCRARRHFRQVFDKHR
                  230        240        250        260        270        280

300        310        320        330        340        350
m694.pep   TFFTQVVHDEFVVNDFVAHINRRAELFQSTFDNTDCPIHTSAEAARIGKDDGFLVHKPGI
           :||:||||||||:||||||||||:|||||||||||||:||||||||||||||||  |||
g694       AFFAQVVHDEFVVDDFVAHINRRAEFFQSTFDNTDCPIHTGAEAARIGKDDGFSVHKFCI
                  290        300        310        320        330        340

360        370        380
m694.pep   SFSDGINIFLLGFYGGRCCPTPPTPHRRRX
           ||||::||  :  || |:||||||||||||
g694       PCSDGIHVFLXXLCDGRYCQAPPTPHRRRX
                  350        360        370
```

The following partial DNA sequence was identified in *N. meningitidis* <SEQ ID 2319>:

```
a694.seq
   1  TTGGTTTCCG CATCCGGCAC ACGGCAAAAA TGCCGTCTGA AGCCTGTTCA
  51  GACGGCATTT GTGTTGCCCA AACATTCAAC GCCTGCGTCA ACGTTTGCAC
 101  AAATCGGGTT TGGTTTCGCC CTCGCGGCGC AACTCTTTGG GCAGGACGAA
 151  CACAATGCTT TCTTCCGCAC CCTCGCCTTC GCGTACGGTT TCGTGCCCCC
 201  ATCCGCGTAT GGTTGCCAGT ACTTCCCGCA CCAACACTTC GGGCGCGGAC
 251  GCGCCTGCCG TTACGCCGAC TTTGTTTTTG CCCTCAAACC ATGCGCGTTG
 301  CAGGTAGCCT GCATTATCCA CCATATACGC ATCGATTCCG CGCGATGCCG
 351  CCACTTCGCG CAAGCGGTTG CTGTTGGACG AATTGGGCGA ACCGACCACA
 401  ATCACGATGT CGCACTGTTC TGCCAACTCT TTGACGGCGG TTTGCCGGTT
 451  GGTCGTCGCA TAGCAGATAT CTTCCTTGTG CGGATTGCGG ATATTGGGGA
 501  AACGCGCGTT CAGCGCGGCG ATGATGTCTT TGGTTTCATC GACCGAGAGC
 551  GTGGTTTGGC TGACATAGGC GAGTTTGTCG GGGTTTCTGA CTTCGAGTTT
 601  TGCCACATCT CCGACCGTTT CGACCAAAAG CATTTTGCCC GGCGCAAGCT
 651  GCCCCATCGT TCCTTCGACC TCGACGTGCC CCTTATGCCC GATCATGATG
 701  ATTTCACAGT CTTGGGCATC CAGTCGGGCG ACTTCCTTAT GCACTTTCGT
 751  CACCAGCGGG CAAGTCGCAT CAAACACGCG GAAACCGCGC TCCGCCGCTT
 801  CTTGCCGCAC CGCCTTCGAT ACGCCGTGTG CCGAATAAAC CAGTGTCGCG
 851  CCCGGCGGCA CTTCCGCCAA GTCTTCAATA AACACCGCAC CTTTTTCACG
 901  CAGGTTGTCC ACGACGAATT TGTTGTGAAC GACTTCGTGG CGCACATAAA
 951  TCGGCGCGCC GAACTCTTCC AAAGCACGTT CGACAATACT GATTGCCCGA
1001  TCCACACCAG CGCAGAAGCC GCGCGGATTG GCAAGGATGA TGGTTTTCTC
1051  GTTCATAAGC CCGGTATTTC GTTTTCAGAC GGCATCAATA TTTTTCTTCT
1101  TGGGTTTTAC GGTGGACGAT GTTGTCCAAC ACCGCCAACA CCGCACCGAC
1151  GCAGATAA
```

This corresponds to the amino acid sequence <SEQ ID 2320; ORF 694.a>:

```
a694.pep
  1 LVSASGTRQK CRLKPVQTAF VLPKHSTPAS TFAQIGFGFA LAAQLFGQDE
 51 HNAFFRTLAF AYGFVPPSAY GCQYFPHQHF GRGRACRYAD FVFALKPCAL
101 QVACIIHHIR IDSARCRHFA QAVAVGRIGR TDHNHDVALF CQLFDGGLPV
151 GRRIADIFLV RIADIGETRV QRGDDVFGFI DRERGLADIG EFVGVSDFEF
201 CHISDRFDQK HFARRKLPHR SFDLDVPLMP DHDDFTVLGI QSGDFLMHFR
251 HQRASRIKHA ETALRRFLPH RLRYAVCRIN QCRARRHFRQ VFNKHRTFFT
301 QVVHDEFVVN DFVAHINRRA ELFQSTFDNT DCPIHTSAEA ARIGKDDGFL
351 VHKPGISFSD GINIFLLGFY GGRCCPTPPT PHRRR*
```

Computer analysis of this amino acid sequence gave the following results:

Homology with a Predicted ORF from *N. meningitidis*

ORF 694 shows 100% identity over a 385 aa overlap with a predicted ORF (ORF 694) from *N. meningitidis*:

```
m694/a694 100.0% identity in 385 aa overlap 10        20        30        40        50        60
    m694.pep  LVSASGTRQKCRLKPVQTAFVLPKHSTPASTFAQIGFGFALAAQLFGQDEHNAFFRTLAF
              ||||||||||||||||||||||||||||||||||||||||||||||||||||||||||||
        a694  LVSASGTRQKCRLKPVQTAFVLPKHSTPASTFAQIGFGFALAAQLFGQDEHNAFFRTLAF
                 10        20        30        40        50        60

70        80        90       100       110       120
    m694.pep  AYGFVPPSAYGCQYFPHQHFGRGRACRYADFVFALKPCALQVACIIHHIRIDSARCRHFA
              ||||||||||||||||||||||||| | |||||||||||||||||||||||||||||||
        a694  AYGFVPPSAYGCQYFPHQHFGFGFACRYADFVFALKPCALQVACIIHHIRIDSARCRHFA
                 70        80        90       100       110       120

130       140       150       160       170       180
    m694.pep  QAVAVGRIGRTDHNHDVALFCQLFDGGLPVGRRIADIFLVRIADIGETRVQRGDDVFGFI
              ||||||||||||||||||||||||||||||||||||||||||||||||||||||||||||
        a694  QAVAVGRIGRTDHNHDVALFCQLFDGGLPVGRRIADIFLVRIADIGETRVQRGDDVFGFI
                130       140       150       160       170       180

190       200       210       220       230       240
    m694.pep  DRERGLADIGEFVGVSDFEFCHISDRFDQKHFARRKLPHRSFDLDVPLMPDHDDFTVLGI
              ||||||||||||||||||||||||||||||||||||||||||||||||||||||||||||
        a694  DRERGLADIGEFVGVSDFEFCHISDRFDQKHFARRKLPHRSFDLDVPLMPDHDDFTVLGI
                190       200       210       220       230       240

250       260       270       280       290       300
    m694.pep  QSGDFLMHFRHQRASRIKHAETALRRFLPHRLRYAVCRINQCRARRHFRQVFNKHRTFFT
              ||||||||||||||||||||||||||||||||||||||||||||||||||||||||||||
        a694  QSGDFLMHFRHQRASRIKHAETALRRFLPHRLRYAVCRINQCRARRHFRQVFNKHRTFFT
                250       260       270       280       290       300

310       320       330       340       350       360
    m694.pep  QVVHDEFVVNDFVAHINRRAELFQSTFDNTDCPIHTSAEAARIGKDDGFLVHKPGISFSD
              ||||||||||||||||||||||||||||||||||||||||||||||||||||||||||||
        a694  QVVHDEFVVNDFVAHINRRAELFQSTFDNTDCPIHTSAEAARIGKDDGFLVHKPGISFSD
                310       320       330       340       350       360

370       380
    m694.pep  GINIFLLGFYGGRCCPTPPTPHRRRX
              ||||||||||||||||||||||||||
        a694  GINIFLLGFYGGRCCPTPPTPHRRRX
                370       380
```

The following partial DNA sequence was identified in *N. gonorrhoeae* <SEQ ID 2321>:

```
g695.seq
   1 TTGCCTCAAA CTCGTCCGGC AAGGCGGCAT CATCGCCATC GACAATATTT

51 TGTTGAACGG AAGGGTGATG CGCGAAGCGG CTTTTGATGC GCCGCCCAGT

101 GTCAAAATTC TCAAAGATTT CAATCAAAAC CTGCCGAACG ATACGCGGAT

151 TGTCCCCATC ACCCTGCCCG TCGGCGACGG TTTGACCCTG CTTCTGAAAA

201 AATAATGAAG ACCAAATTAC CGCTTTTTAT CATTTGGCTG TCTGTGTCTG

251 CCTCCTGTGC TTCCGTTTTA CCCGTTCCGG AGGGCAGCCG AACCGAAATG

301 CCGACACAGG AAAATGCTTC AGACGGCATT CCCTATCCCG TTCCCACTCT

351 GCAAGACCGT TTGGACTATC TGGAAGGCAA AATCGTCCGG CTGTCGAACG

401 AAGTGGAAAT GTTAAACGGG AAAGTCAAAG CATTGGAGCA TACGAAAATA

451 CACCCTTCCG GCAGGACATA CGTCCAAAAA CTCGACGACC GCAAATTGAA

501 AGAGCATTAC CTCAATACCG AAGGCGGCAG CGCATCCGCA CATACCGTCG

551 AAACCGCACA AAACCTCTAC AATCAGGCAC TCAAACACTA TCAAAACGGC

601 AGGTTTTCTG CCGCAGCCGC CTTGTTGAAG GGGGCGGACG GCGGAGACGG

651 CGGCAGCATC GCGCAACGCA GTATGTACCT GTTGCTGCAA AGCAGGGCGC
```

-continued
```
701 GTATGGGGAA CTGTGAATCT GTCATCGAAA TCGGAGGGCG TTACGCCAAC

751 CGTTTCAAAG ACAGCCCAAC CGCGCCCGAA GTCATATTCA AAATCGGCGA

801 ATGCCAATAC AGGCTTCAGC AAAAAGACAT TGCAAGGGCG ACTTGGCGCA

851 GCCTGATACA GACCTATCCC GGCAGCCCGG CGGCAAAACG CGCCGCCGCA

901 GCCGTACGCA AACGATAG
```

This corresponds to the amino acid sequence <SEQ ID 2322; ORF 695>:

```
g695.pep
   1 LPQTRPARRH HRHRQYFVER KGDARSGF*C AAQCQNSQRF QSKPAERYAD

51 CPHHPARRRR FDPASEKIMK TKLPLFIIWL SVSASCASVL PVPEGSRTEM

101 PTQENASDGI PYPVPTLQDR LDYLEGKIVR LSNEVEMLNG KVKALEHTKI

151 HPSGRTYVQK LDDRKLKEHY LNTEGGSASA HTVETAQNLY NQALKHYQNG

201 RFSAAAALLK GADGGDGGSI AQRSMYLLLQ SRARMGNCES VIEIGGRYAN

251 RFKDSPTAPE VIFKIGECQY RLQQKDIARA TWRSLIQTYP GSPAAKRAAA

301 AVRKR*
```

The following partial DNA sequence was identified in *N. meningitidis* <SEQ ID 2323>:

```
m695.seq
   1 TTGCCTCAAA CTCGTCCGTC AAGGCGGCAT CATCGCCATC GACAATATTT

51 TGCTGAACGG AAGGGTGATG CGCGAAGCGG CTTCCGATGC GCCGCCCAGC

101 GTCGGCATCC TCAAAGATTT CAATCAAAAC CTGCCGAACG ACCCGCGCAT

151 CGTCCCCATC ACCCTGCCCG TCGGCGACGG CTTGACCCTG CTTCTGAAAA

201 AATAATGAAG ATCAAATTAC CGCTTTTTAT CATTTGGCTG TCTGTGTCCG

251 CCTCCTGTGC TTCCGTTTCA CCCGTTCCGG CAGGCAGCCA AACCGAAATG

301 TCGACACGGG AAAATGCTTC AGACGGCATT CCCTATCCCG TTCCGACCTT

351 GCAAGACCGT TTGGACTATC TGGAAGGCAA AATCGTCCGG CTGTCGAACG

401 AAGTGGAAAC CTTAAACGGC AAAGTCAAAG CACTGGAACA CGCAAAAACA

451 CATTCTTCCG GCAGGGCATA CGTCCAAAAA CTCGACGACC GCAAGTTGAA

501 AGAGCATTAC CTCAATACCG AAGGCGGCAG CGCATCCGCA CATACTGTCG

551 AAACCGCACA AAACCTCTAC AATCAGGCAC TCAAACACTA TAAAAGCGGC

601 AAGTTTTCTG CCGCTGCCTC CCTGTTGAAA GGCGCGGACG GAGGCGACGG

651 CGGCAGCATC GCGCAACGCA GTATGTACCT GTTGCTGCAA AGCAGGGCGC

701 GTATGGGCAA CTGCGAATCC GTCATCGAAA TCGGAGGGCG TTACGCCAAC

751 CGTTTCAAAG ACAGCCCAAC CGCGCCTGAA GCCATGTTCA AAATCGGCGA

801 ATGCCAATAC AGGCTTCAGC AAAAAGACAT TGCAAGGGCG ACTTGGCGCA

851 GCCTGATACA GACCTATCCC GGCAGCCCGG CGGCAAAACG CGCCGCCGCA

901 GCCGTGCGCA AACGATAG
```

This corresponds to the amino acid sequence <SEQ ID 2324; ORF 695>:

```
m695.pep
   1 LPQTRPSRRH HRHRQYFAER KGDARSGFRC AAQRRHPQRF QSKPAERPAH

51 RPHHPARRRR LDPASEKIMK IKLPLFIIWL SVSASCASVS PVPAGSQTEM

101 STRENASDGI PYPVPTLQDR LDYLEGKIVR LSNEVETLNG KVKALEHAKT

151 HSSGRAYVQK LDDRKLKEHY LNTEGGSASA HTVETAQNLY NQALKHYKSG

201 KFSAAASLLK GADGGDGGSI AQRSMYLLLQ SRARMGNCES VIEIGGRYAN

251 RFKDSPTAPE AMFKIGECQY RLQQKDIARA TWRSLIQTYP GSPAAKRAAA

301 AVRKR*
```

Computer analysis of this amino acid sequence gave the following results:

Homology with a Predicted ORF from *N. gonorrhoeae*

ORF 694 shows 90.8% identity over a 305 aa overlap with a predicted ORF (ORF 695) from *N. gonorrhoeae*:

```
   m695/g695 90.8% identity in 305 aa overlap 10         20         30         40         50         60
  m695.pep  LPQTRPSRRHHRHRQYFAERKGDARSGFRCAAQRRHPQRFQSKPAERPAHRPHHRARRRR
            ||||||:|||||||||||:||||||||||| ||||  :: |||||||||| |  |||||||||
  g695      LPQTRPARRHHRHRQYFVERKGDARSGFXCAAQCQNSQRFQSKPAERYADCPHHRARRRR
                  10         20         30         40         50         60

70         80         90        100        110        120
  m695.pep  LDPASEKIMKIKLPLFIIWLSVSASCASVSPVPAGSQTEMSTRENASDGIPYPVPTLQDR
            :|||||||| |||||||||||||||||||| ||| ||:||| |:||||||||||||||||
  g695      FDPASEKIMKTKLPLFIIWLSVSASCASVLPVPEGSRTEMPTQENASDGIPYPVPTLQDR
                  70         80         90        100        110        120

130        140        150        160        170        180
  m695.pep  LDYLEGKIVRLSNEVETLNGKVKALEHAKTHSSGRAYVQKLDDRKLKEHYLNTEGGSASA
            ||||||||||||||||| |||||||||||:| | |||:|||||||||||||||||||||||
  g695      LDYLEGKIVRLSNEVEMLNGKVKALEHTKIHPSGRTYVQKLDDRKLKEHYLNTEGGSASA
                 130        140        150        160        170        180

190        200        210        220        230        240
  m695.pep  HTVETAQNLYNQALKHYKSGKFSAAASLLKGADGGDGGSIAQRSMYLLLQSRARMGNCES
            ||||||||||||||||||::||||||| ||||||||||||||||||||||||||||||||
  g694      HTVETAQNLYNQALKHYQNGRFSAAAALLKGADGGDGGSIAQRSMYLLLQSRARMGNCES
                 190        200        210        220        230        240

250        260        270        280        290        300
  m695.pep  VIEIGGRYANRFKDSPTAPEAMFKIGECQYRLQQKDIARATWRSLIQTYPGSPAAKRAAA
            ||||||||||||||||||||::||||||||||||||||||||||||||||||||||||||
  g695      VIEIGGRYANRFKDSPTAPEVIFKIGECQYRLQQKDIARATWRSLIQTYPGSPAAKRAAA
                 250        260        270        280        290        300 m695.pep  AVRKRX
            ||||||
  g695      AVRKRX
```

The following partial DNA sequence was identified in *N. meningitidis* <SEQ ID 2325>:

```
a695.seq
   1 TTGCCTCAAG CTTGTCCGGC AAGGCGGCAT CATTGCCATC GACAATATTT

51 TGTTGAACGG AAGGGTGATG CGCGAAGCGG CTTCCGATGC GCCGCCCAGC

101 GTCGGCATCC TCAAAGATTT TAATCAAAAC CTGCCGAACG ATACGCGGAT

151 TGTCCCCATC ACCCTGCCCG TCGGCGACGG TTTGACCCTG CTTCTGAAAA

201 AATAATGAAG ACCAAATTAC CGCTTTTTAT CATTTGGCTG TCCGTATCCG

251 CCGCCTGTTC TTCCCCTGTT TCCCGCAATA TTCAGGATAT GCGGCTCGAA

301 CCGCAGGCAG AGGCAGGTAG TTCGGACGCT ATTCCCTATC CCGTTCCCAC
```

-continued
```
351 TCTGCAAGAC CGTTTGGATT ATCTGGAAGG CACACTCGTC CGCCTGTCGA

401 ACGAAGTGGA AACCTTAAAC GGCAAAGTCA AAGCACTGGA GCATGCGAAA

451 ACACACCCTT CCAGCAGGGC ATACGTCCAA AAACTCGACG ACCGCAAGTT

501 GAAAGAGCAT TACCTCAATA CCGAAGGCGG CAGCGCATCC GCACATACCG

551 TCGAAACCGC ACAAAACCTC TACAATCAGG CACTCAAACA CTATAAAGC

601 GGCAGGTTTT CTGCCGCTGC CTCCCTGTTG AAAGGCGCGG ACGGAGGCGA

651 CGGCGGCAGC ATCGCGCAAC GCAGTATGTA CCTGTTGCTG CAAAGCAGGG

701 CGCGTATGGG CAACTGCGAA TCCGTCATCG AAATCGGAGG GCGTTACGCC

751 AACCGTTTCA AAGACAGCCC AACCGCGCCT GAAGCCATGT TCAAAATCGG

801 CGAATGCCAA TACAGGCTTC AGCAAAAAGA CATTGCAAGG GCGACTTGGC

851 GCAGCCTGAT ACAGACCTAT CCCGGCAGCC CGGCGGCAAA ACGCGCCGCC

901 GCAGCCGTGC GCAAACGATA G
```

This corresponds to the amino acid sequence <SEQ ID 2326; ORF 695.a>:

```
a695.pep
  1 LPQACPARRH HCHRQYFVER KGDARSGFRC AAQRRHPQRF *SKPAERYAD

51 CPHHPARRRR FDPASEKIMK TKLPLFIIWL SVSAACSSPV SRNIQDMRLE

101 PQAEAGSSDA IPYPVPTLQD RLDYLEGTLV RLSNEVETLN GKVKALEHAK

151 THPSSRAYVQ KLDDRKLKEH YLNTEGGSAS AHTVETAQNL YNQALKHYKS

201 GRFSAAASLL KGADGGDGGS IAQRSMYLLL QSRARMGNCE SVIEIGGRYA

251 NRFKDSPTAP EAMFKIGECQ YRLQQKDIAR ATWRSLIQTY PGSPAAKRAA

301 AAVRKR*
```

Computer analysis of this amino acid sequence gave the following results:

Homology with a Predicted ORF from *N. meningitidis*

ORF 695 shows 88.3% identity over a 308 aa overlap with a predicted ORF (ORF 695) from *N. meningitidis*:

```
m695/a695  88.3.8% identity in 308 aa overlap 10        20        30        40        50        60
m695.pep  LPQTRPSRRHHRHRQYFAERKGDARSGFRCAAQRRHPQRFQSKPAERPAHRPHHRARRRR
          |||: |:|||| |||||:|||||||||||||||||||| |||||| |  ||||||||||
a695      LPQACPARRHHCHRQYFVERKGDARSGFRCAAQRRHPQRFXSKPAERYADCPHHPARRRR
                 10        20        30        40        50        60

70        80        90       100       110
m695.pep  LDPASEKIMKIKLPLFIIWLSVSASCASVSPVPAGSQT---EMSTRENASDGIPYPVPTL
          :||||||||| ||||||||||||||:|:| ||  : |    | ::: ::||:||||||
a695      FDPASEKIMKTKLPLFIIWLSVSAACSS--PVSRNIQDMRLEPQAEAGSSDAIPYPVPTL
                 70        80        90       100       110

120       130       140       150       160       170
m695.pep  QDRLDYLEGKIVRLSNEVETLNGKVKALEHAKTHSSGRAYVQKLDDRKLKEHYLNTEGGS
          ||||||||| :|||||||||||||||||||||| :||||||||||||||||||||||||
a695      QDRLDYLEGTLVRLSNEVETLNGKVKALEHAKTHPSSRAYVQKLDDRKLKEHYLNTEGGS
                120       130       140       150       160       170

180       190       200       210       220       230
m695.pep  ASAHTVETAQNLYNQALKHYKSGKFSAAASLLKGADGGDGGSIAQRSMYLLLQSRARMGN
          |||||||||||||||||||||||:||||| ||||||||||||||||||||||||||||||
a694      ASAHTVETAQNLYNQALKHYKSGRFSAAALLKGADGGDGGSIAQRSMYLLLQSRARMGN
                180       190       200       210       220       230

240       250       260       270       280       290
m695.pep  CESVIEIGGRYANRFKDSPTAPEAMFKIGECQYRLQQKDIARATWRSLIQTYPGSPAAKR
          ||||||||||||||||||||||||||||||||||||||||||||||||||||||||||||
a695      CESVIEIGGRYANRFKDSPTAPEAMFKIGECQYRLQQKDIARATWRSLIQTYPGSPAAKR
                240       250       260       270       280       290
```

```
            300
m695.pep  AAAAVRKRX
          |||||||||
a695      AAAAVRKRX
            300
```

The following partial DNA sequence was identified in *N. gonorrhoeae* g696.seq: not found

This corresponds to the amino acid sequence <ORF 696.ng>:

g696.pep: not found

The following partial DNA sequence was identified in *N. meningitidis* <SEQ ID 2327>:

```
m696.seq
    1 TTGGGTTGCC GGCAGGCGGC ATCCCATCAT TTTTGCCAAG GCAACAAATT

51 ATTTGGCGGC ATCTTTCATT TTGTCTGCCG CTTCCTGAGT CGCGTCGGCA

101 GCTTTGTTCA AAGTATCTTT AGCTGCTTCA GTTACAGCTT CTTTGGCTTC

151 AGTTACAGCT TCCTCGGCAC TTGCCTTTGC ATCAGCCGCA GCATCTTTGA

201 CTTGGTCTTT CGCTTCTTCG ACGGCAGAAG CGGCAGACTC GGCGGCAGAA

251 GCCGCAGTGT CTTTAACATC GGACTCAACG GCTTGAACCG CTTCCTTAAC

301 CTCCTGTTTG GCTTCTTGCG AACAAGCTGC CAAGGCAGCC GCCATCATTG

351 CGGCAATCAA TAA
```

This corresponds to the amino acid sequence <SEQ ID 2328; ORF 696>:

```
m696.pep
    1 LGCRQAASHH FCQGNKLFGG IFHFVCRFLS RVGSFVQSIF SCFSYSFFGF

51 SYSFLGTCLC ISRSIFDLVF RFFDGRSGRL GGRSRSVFNI GLNGLNRFLN

101 LLFGFLRTSC QGSRHHCGNQ *
```

The following partial DNA sequence was identified in *N. meningitidis* <SEQ ID 2329>:

```
a696.seq
    1 TTGGGTTGCC GGCAGGCGGC ATCCCATCAT TTTTGCCAAG GCAACAAATT

51 ATTTGGCGGC ATCTTTCATT TTGTCTGCCG CTTCCTGAGT CGCGTCGGCA

101 GCTTTGTTCA AAGTATCTTT AGCTGCTTCA GTTACAGCTT CTTTGGCTTC

151 AGTTACAGCT TCCTCGGCAC TTGCCTTTGC ATCAGCCGCA GCATCTTTGA

201 CTTGGTCTTT CGCTTCTTCG ACGGCAGAAG CGGCAGACTC GGCGGCAGAA

251 GCCGCAGTGT CTTTAACATC GGACTCAACG GCTTGAACCG CTTCCTTAAC

301 CTCCTGTTTG GCTTCTTGCG AACAAGCTGC CAAGGCAGCC GCCATCATTG

351 CGGCAATCAA TAA
```

This corresponds to the amino acid sequence <SEQ ID 2330; ORF 696.a>:

```
a696.pep
    1 LGCRQAASHH FCQGNKLFGG IFHFVCRFLS RVGSFVQSIF SCFSYSFFGF
```

-continued
```
 51 SYSFLGTCLC ISRSIFDLVF RFFDGRSGRL GGRSRSVFNI GLNGLNRFLN

101 LLFGFLRTSC QGSRHHCGNQ *
```

Computer analysis of this amino acid sequence gave the following results:

Homology with a Predicted ORF from *N. meningitidis*

ORF 696 shows 100.0% identity over a 120 aa overlap with a predicted ORF (ORF 696) from *N. meningitidis*:

```
   m696/a696   100.0% identity in 120 aa overlap 10         20         30         40         50         60
      m696.pep   LGCRQAASHHFCQGNKLFGGIFHFVCRFLSRVGSFVQSIFSCFSYSFFGFSYSFLGTCLC
                 ||||||||||||||||||||||||||||||||||||||||||||||||||||||||||||
      a696       LGCRQAASHHFCQGNKLFGGIFHFVCRFLSRVGSFVQSIFSCFSYSFFGFSYSFLGTCLC
                      10         20         30         40         50         60

70         80         90        100        110        120
      m696.pep   ISRSIFDLVFRFFDGRSGRLGGRSRSVFNIGLNGLNRFLNLLFGFLRTSCQGSRHHCGNQ
                 ||||||||||||||||||||||||||||||||||||||||||||||||||||||||||||
      a696       ISRSIFDLVFRFFDGRSGRLGGRSRSVFNIGLNGLNRFLNLLFGFLRTSCQGSRHHCGNQ
                      70         80         90        100        110        120 m696.pep   X
                 |
      a696       x
```

The following partial DNA sequence was identified in *N. gonorrhoeae* <SEQ ID 2331>:

```
g700.seq
  1 ATGAGCAGCC TGATGACGTT GTTTTCGGTA TTGGTACCGA TGTTTGCCGG

51 ATTTTTTATC CGTGTTCCCA AGCCTTACCT GCCCGCTTCG GACAAGGTGC

101 TGTCGGTTTT GGTGTATGCC GTGCTGCTGC TGATCGGCGT ATCGTTGTCG

151 CGCGTGGAGG ATTTGGGTTC GCGGTTGGGC GATATGGCGT TGACGGTTCT

201 GTGGCTGTTT GTTTGTACGG TAGGGGCGAA CCTGCTTGCC TTGGCAGTGT

251 TGGGAAAGTT GTCCCCGTGG CGGATAGGGG GAAAAGGGAA GGGCGTTTCG

301 GTCGGCGTGT CGGGCAGTGT GAGGCAGCTC GGATGCGTAC TGCTCGGTTT

351 TGTGTCCGGC AAATTGATGT GCGATATTTG GATGCCGTCT GAAAACGCGG

401 GTATGTACTG CCTGATGCTG CTGGTGTTCC TCATCGGCGT ACAGCTCAAA

451 AGTAGCGGCG TATCGTTGCG GCAGGTTTTG CTTAACCGGC GGGGCATCCG

501 GCTGTCGGTT TGGTTTATAT TGTCATCTCT TTCAGGCGGG CTGCTGTTTG

551 CCGCATCGGC AGATGGTGTG TCGTGGACGA AAGGTTTGGC GATGGCTTCC

601 GGCTTCGGTT GGTATTCCCT CTCGGGTTTG GTAATGACCG AGGCTTACGG

651 GGCGGTATGG GGCAGCATCA TGCTGCTGAA CGATTTGGCA CGAGAGCTGT

701 TTGCACTGGC ATTTATTCCG CTGCTGATGA AGCGTTTTCC GGATGCGGCG

751 GTGGGGTCG GCGGCGCGAC CAGTATGGAT TTCACATTGC CCGTAATTCA

801 GGGTGCGGGC GGTTTGGAAG TCGTGCCGGT AGCGGTCAGC TTCGGCGTGG

851 TGGTCAATAT CGCCGCCCCG TTTCTGATGG TGGTGTTTTC CACGCTGGGC

901 TGA
```

This corresponds to the amino acid sequence <SEQ ID 2332; ORF 700>:

```
g700.pep
   1 MSSLMTLFSV LVPMFAGFFI RVPKPYLPAS DKVLSVLVYA VLLLIGVSLS

51 RVEDLGSRLG DMALTVLWLF VCTVGANLLA LAVLGKLSPW RIGGKGKGVS

101 VGVSGSVRQL GCVLLGFVSG KLMCDIWMPS ENAGMYCLML LVFLIGVQLK

151 SSGVSLRQVL LNRRGIRLSV WFILSSLSGG LLFAASADGV SWTKGLAMAS

201 GFGWYSLSGL VMTEAYGAVW GSIMLLNDLA RELFALAFIP LLMKRFPDAA

251 VGVGGATSMD FTLPVIQGAG GLEVVPVAVS FGVVVNIAAP FLMVVFSTLG

301 *
```

The following partial DNA sequence was identified in *N. meningitidis* <SEQ ID 2333>:

```
m700.seq
   1 ATGGACAGCC TGATGACGTT GCTTTCGGTA TTGATACCGA TGTTTGCCGG

51 ATTTTTTATC CGTGTGCCCA AGCCTTACCT GCCCGCTTTG GATAAGGTGC

101 TATCGGTCTT GGTGTATGCT GTGCTGCTGC TGATCGGCGT CTCGTTGTCG

151 CGCGTGGAGG ATTTGGGTTC GCGGTTGGAC GATATGGCGT TGACGGTTCT

201 GTGGCTGTTT GTTTGTACGG TCGGGGCGAA CCTGCTTGCT TTGGCAGTGT

251 TGGGAAAGTT ATTCCCGTGG CGGATAAAGG GGAAAGGGAA GGGCGTTTCG

301 GTCGGCGTGT CGGGCAGTGT GGGGCAGCTC GGATGCGTGC TGCTCGGATT

351 TGCATTCGGC AAACTGATGC GCGATATTTG GATGCCGTCT GAAAGCGCGG

401 GCATGTATTG TCTGATGCTG CTGGTGTTCC TCATCGGCGT ACAGCTCAAA

451 AGCAGCGGCG TATCGTTGCG GCAGGTTTTG GTCAACCGCA GGGGTATTCG

501 GTTGTCGGTC TGGTTTATGC TTTCATCTCT TTCGGGCGGG CTGCTGTTTG

551 CCGCATCGAC AGACGGTGTG TCGTGGACGA AAGGTTTGGC GATGGCTTCC

601 GGCTTCGGTT GGTATTCCCT CTCGGGTTTG GTCATGACCG AGGCTTACGG

651 CGCGGTATGG GGCAGCATCA TGCTGCTGAA CGATTTGGCA CGAGAGCTGT

701 TTGCACTGGC ATTTATCCCG CTGCTGATGA AGCGTTTTCC AGATGCGGCG

751 GTGGGGGTTG GCGGTGCGAC CAGTATGGAT TTTACATTGC CCGTGATTCA

801 GGGTGCGGGC GGTTTGGAAG TCGTGCCGGT AGCGGTCAGC TTCGGCGTGG

851 TGGTCAATAT CGCCGCCCCG TTTCTGATGG TGGTGTTTTC CGCTTTGGGT

901 TGA
```

This corresponds to the amino acid sequence <SEQ ID 2334; ORF 700>:

```
m700.pep
   1 MDSLMTLLSV LIPMFAGFFI RVPKPYLPAL DKVLSVLVYA VLLLIGVSLS

51 RVEDLGSRLD DMALTVLWLF VCTVGANLLA LAVLGKLFPW RIKGKGKGVS

101 VGVSGSVGQL GCVLLGFAFG KLMRDIWMPS ESAGMYCLML LVFLIGVQLK

151 SSGVSLRQVL VNRRGIRLSV WFMLSSLSGG LLFAASTDGV SWTKGLAMAS

201 GFGWYSLSGL VMTEAYGAVW GSIMLLNDLA RELFALAFIP LLMKRFPDAA
```

```
251 VGVGGATSMD FTLPVIQGAG GLEVVPVAVS FGVVVNIAAP FLMVVFSALG

301 *
```

Computer analysis of the amino acid sequences gave the following results:

Homology with a Predicted ORF from *N. meningitidis* menA with menB

ORF 700 shows 94.7% identity over a 300 aa overlap with a predicted ORF (ORF700.ng) from *N. gonorrhoeae*:

m700/g700

```
                  10        20        30        40        50        60
m700.pep  MDSLMTLLSVLIPMFAGFFIRVPKPYLPALDKVLSVLVYAVLLLIGVSLSRVEDLGSRLD
          |:||||:|||:|||||||||||||||||||  ||||||||||||||||||||||||||||
g700      MSSLMTLFSVLVPMFAGFFIRVPKPYLPASDKVLSVLVYAVLLLIGVSLSRVEDLGSRLG
                  10        20        30        40        50        60

70        80        90       100       110       120
m700.pep  DMALTVLWLFVCTVGANLLALAVLGKLFPWRIKGKGKGVSVGVSGSVGQLGCVLLGFAFG
          ||||||||||||||||||||||||||||  ||||  |||||||||||||| ||||||| :|
g700      DMALTVLWLFVCTVGANLLALAVLGKISPWRIGGKGKGVSVGVSGSVRQLGCVLLGFVSG
                  70        80        90       100       110       120

130       140       150       160       170       180
m700.pep  KLMRDIWMPSESAGMYCLMLLVFLIGVQLKSSGVSLRQVLVNRRGIRLSVWFMLSSLSGG
          |||  |||||||:||||||||||||| |||||||||||||||:|||||||||||:|||||
g700      KLMCDIWMPSENAGMYCLMLLVFLIQGQLKSSGVSLRQVLLNRRGIRLSVWFILSSLSGG
                 130       140       150       160       170       180

190       200       210       220       230       240
m700.pep  LLFAASTDGVSWTKGLAMASGFGWYSLSGLVMTEAYGAVWGSIMLLNDLARELFALAFIP
          ||||||:|||||||||||||||||||||||||||||||||||||||||||||||||||||
g700      LLFAASADGVSWTKGLAMASGFGWYSLSGLVMTEAYGAVWGSIMLLNDLARELFALAFIP
                 190       200       210       220       230       240

250       260       270       280       290       300
m700.pep  LLMKRFPDAAVGVGGATSMDFTLPVIQGAGGLEVVPVAVSFGVVVNIAAPFLMVVFSALG
          |||||||||||||||||||||||||||||||||||||||||||||||||||||||||:||
g700      LLMKRFPDAAVGVGGATSMDFTLPVIQGAGGLEVVPVAVSFGVVVNIAAPFLMVVFSTLG
                 250       260       270       280       290       300 m700.pep  X
          |
g700      X
```

The following partial DNA sequence was identified in *N. meningitidis* <SEQ ID 2335>:

```
a700.seq
   1 ATGGACAGCC TGATGACGTT GCTTTCGGTA TTGATACCGA TGTTTGCCGG

51 ATTTTTTATC CGTGTGCCCA AGCCTTACCT GCCCGCTTTG GATAAGGTGC

101 TATCGGTCTT GGTGTATGCT GTGCTGCTGC TGATCGGCGT CTCGTTGTCG

151 CGCGTGGAGG ATTTGGGTTC GCGGTTGGAC GATATGGCGT TGACGGTTCT

201 GTGGCTGTTT GTTTGTACGG TCGGGGCGAA CCTGCTTGCT TTGGCAGTGT

251 TGGGAAAGTT ATTCCCGTGG CGGATAAAGG GGAAAGGGAA GGGCGTTTCG

301 GTCGGTGTGT CGGGCAGTGT GGGGCAGCTC GGATGCGTGC TGCTCGGATT

351 TGCATCCGGC AAACTGATGC GCGATATTTG GATGCCGTCT GAAAACGCGG

401 GTATGTATTG TCTGATGCTG CTGGTGCTCN TCATCGGCGT ACAGCTCAAA

451 AGCAGCGGCG TATCGTTGCG GCAGGTTTTG GTCAACCGCA GGGGTATTCG

501 GTTGTCGGTC TGGTTTATGC TTTCATCTCT TTCAGGCGGG CTGCTGTTTG

551 CCGCATCGGC AGACGGTGTG TCGTGGGTGA AAGGTTTGGC GATGGCTTCC

601 GGCTTCGGTT GGTATTCCCT CTCGGGTTTG GTGATGACCG AGGCTTACGG

651 CGCGGTATGG GGCAGTATCG CGCTTTTGAA CGATTTGGCA CGAGAGCTGT

701 TCGCGCTGGC ATTTATTCCG CTGCTGATGA AGCGTTTTCC CGATGCGGCA
```

```
-continued
751 GTGGGGGTCG GCGGCGCGAC CAGTATGGAT TTCACATTGC CCGTGATTCG

801 GGGTGCGGGC GGCTTGGAAG CCGTACCGGT AGCGGTCAGC TTCGGCGTGG

851 TGGTCAATAT CGCCGCTCCG TTTCTGATGG TGGTGTTTTC CGCTTTGGGC

901 TGA
```

This corresponds to the amino acid sequence <SEQ ID 2336; ORF 700.a>:

```
a700.pep

1  MDSLMTLLSV LIPMFAGFFI RVPKPYLPAL DKVLSVLVYA VLLLIGVSLS

51  RVEDLGSRLD DMALTVLWLF VCTVGANLLA LAVLGKLFPW RIKGKGKGVS

101  VGVSGSVGQL GCVLLGFASG KLMRDIWMPS ENAGMYCLML LVLXIGVQLK

151  SSGVSLRQVL VNRRGIRLSV WFMLSSLSGG LLFAASADGV SWVKGLAMAS

201  GFGWYSLSGL VMTEAYGAVW GSIALLNDLA RELFALAFIP LLMKRFPDAA

251  VGVGGATSMD FTLPVIRGAG GLEAVPVAVS FGVVVNIAAP FLMVVFSALG

301  * m700/a700 97.0% identity in 300 aa overlap
                10         20         30         40         50         60
m700.pep MDSLMTLLSVLIPMFAGFFIRVPKPYLPALDKVLSVLVYAVLLLIGVSLSRVEDLGSRLD
         ||||||||||||||||||||||||||||||||||||||||||||||||||||||||||||
a700     MDSLMTLLSVLIPMFAGFFIRVPKPYLPALDKVLSVLVYAVLLLIGVSLSRVEDLGSRLD
                10         20         30         40         50         60
                70         80         90        100        110        120
m700.pep DMALTVLWLFVCTVGANLLALAVLGKLFPWRIKGKGVSVGVSGSVGQLGCVLLGFAFG
         |||||||||||||||||||||||||||||||||||||||||||||||||||||||||| |
a700     DMALTVLWLFVCTVGANLLALAVLGKLFPWRIKGKGVSVGVSGSVGQLGCVLLGFASG
                70         80         90        100        110        120
               130        140        150        160        170        180
m700.pep KLMRDIWMPSESAGMYCLMLLVFLIGVQLKSSGVSLRQVLVNRRGIRLSVWFMLSSLSGG
         |||||||||||:||||||||||:|||||||||||||||||||||||||||||||||||||
a700     KLMRDIWMPSENAGMYCLMLLVLXIGVQLKSSGVSLRQVLVNRRGIRLSVWFMLSSLSGG
               130        140        150        160        170        180
               190        200        210        220        230        240
m700.pep LLFAASTDGVSWTKGLAMASGFGWYSLSGLVMTEAYGAVWGSIMLLNDLARELFALAFIP
         ||||||:|||||:||||||||||||||||||||||||||||||| ||||||||||||||
a700     LLFAASADGVSWVKGLAMASGFGWYSLSGLVMTEAYGAVWGSIALLNDLARELFALAFIP
               190        200        210        220        230        240
               250        260        270        280        290        300
m700.pep LLMKRFPDAAVGVGGATSMDFTLPVIQGAGGLEVVPVAVSFGVVVNIAAPFLMVVFSALG
         ||||||||||||||||||||||||||||:||||| :||||||||||||||||||||||||
a700     LLMKRFPDAAVGVGGATSMDFTLPVIRGAGGLEAVPVAVSFGVVVNIAAPFLMVVFSALG
               250        260        270        280        290        300 m700.pep X
         |
a700     X
```

The following partial DNA sequence was identified in *N. gonorrhoeae* <SEQ ID 2337>:

```
g701.seq
  1 ATGTCTTGGC ACATATTCCA AGTTGCAGGG ATACCGACCG CTTCGATGGC

51 ACAATCTACG CCGTCTTCGC CGACGATGGC GAAAACTTGT TTGGAGACGT

101 CGCCGGAAGC GGGGCTGATG GTATGGGTCG CGCCCAACTC TTTCGCCGGT

151 TTCAAACGGT TTTCGTCCAT ATCGCACACG ATAATGGCGG CAGGGCTATA

201 CAGTTGGGCG GTCAACAAGG CGGACATACC GACAGGGCCG GCACCTGCGA

251 TGAATACGGT ATCGCCGGGT TTCACATCGC CGTATTGCAC GCCGATTTCG
```

-continued
```
301 TGGGCGGTCG GTAAAGCGTC GCTCAACAGC AGGGCGATTT CTTCGTTGAC

351 GTTGTCGTGC GGCGGCACGA GGCTGTTGTC GGCATAA
```

This corresponds to the amino acid sequence <SEQ ID 2338; ORF 701>:

```
g701.pep
  1 MSWHIFQVAG IPTASMAQST PSSPTMAKTC LETSPEAGLM VWVAPNSFAG

51 FKRFSSISHT IMAAGLYSWA VNKADIPTGP APAMNTVSPG FTSPYCTPIS

101 WAVGKASLNS RAISSLTLSC GGTRLLSA*
```

The following partial DNA sequence was identified in *N. meningitidis* <SEQ ID 2339>:

```
m701.seq
  1 ATGTCTTGGC ACATATTCCA TGTAGCAGGG ATACCGACGG CTTCGATGGC

51 GCAATCCACG CCGTCTTCGC CGACGATGGC AAAGACTTGT TTGGATACTT

101 CGCCGGAAGC AGGGTTAATG GTATGGGTCG CACCCAATTC TTTCGCCAGT

151 TTCAAACGGT TTTCGTCCAT ATCGCAAACG ATGATGGCGG CGGGACTGTA

201 CAGTTGGGCG GTCAACAGGG CGGACATACC GACAGGGCCT GCCCCAGCGA

251 TGAATACGGT GTCGCCGGGT TTGACATCGC CGTATTGCAC GCCGATTTCG

301 TGGGCGGTCG GCAAAGCGTC GCTCAACAAC AGGGCGATTT CTTCGTTGAC

351 ATTATCGGGC AGCGGAACGA GGCTGTTGTC GGCATAA
```

This corresponds to the amino acid sequence <SEQ ID 2340; ORF 701>:

```
m701.pep
  1 MSWHIFHVAG IPTASMAQST PSSPTMAKTC LDTSPEAGLM VWVAPNSFAS

51 FKRFSSISQT MMAAGLYSWA VNRADIPTGP APAMNTVSPG LTSPYCTPIS

101 WAVGKASLNN RAISSLTLSG SGTRLLSA*
```

Computer analysis of the amino acid sequences gave the following results:
Homology with a Predicted ORF from *N. meningitidis* menA with menB
ORF 701 shows 92.2% identity over a 128 aa overlap with a predicted ORF (ORF701.a) from *N. gonorrhoeae*:

```
m701/g701

10         20         30         40         50         60
    m701.pep  MSWHIFHVAGIPTASMAQSTPSSPTMAKTCLDTSPEAGLMVWVAPNSFASFKRFSSISQT
              ||||||:||||||||||||||||||||||||:|||||||||||||||||:|||||||:|
        g701  MSWHIFQVAGIPTASMAQSTPSSPTMAKTCLETSPEAGLMVWVAPNSFAGKRFSSISHT
                       10         20         30         40         50         60

70         80         90        100        110        120
    m701.pep  MMAAGLYSWAVNRADIPTGPAPAMNTVSPGLTSPYCTPISWAVGKASLNNRAISSLTLSG
              :|||||||||||:|||||||||||||||||:||||||||||||||||||:|||||||||
        g701  IMAAGLYSWAVNKADIPTGPAPAMNTVSPGFTSPYCTPISWAVGKASLNSRAISSLTLSC
                       70         80         90        100        110        120 m701.pep  SGTRLLSAX
              :||||||||
        g701  GGTRLLSAX
```

The following partial DNA sequence was identified in *N. meningitidis* <SEQ ID 2341>:

```
a701.seq
  1 ATGTCTTGGC ACATATTCCA AGTTGCAGGG ATACCGACGG CTTCGATCGC

51 GCAGTCCACG CCGTCTTCGC CGACGATAGC GGCAACTTGC TTGCTTACAT

101 CGCCGGAAGC AGGGTTAATG GTATGGGTTG CGCCCAACTC TTTCGCCAGT

151 TTCAAACGGT TTTCGTCCAT ATCGCAAACA ATGATGGCGG CGGGGCTGTA

201 CAGTTGGGCG GTCGGCAAGG CGGACATACC GACAGGAGCG GCACCTGCGA

251 TGAATACGGT GTCGCCGGGT TTGACATCGC CGTATTGCAC GCCGATTTCG

301 TGTGCGGTCG GCAAAGCGTC GCTCAACAAC AGGGCGACTT CTTCGTTGAC

351 GTTGTCGGGC AGCGGCACGA GGCTGTTGTC GGCATAA
```

This corresponds to the amino acid sequence <SEQ ID 2342; ORF 701.a>:

```
a701.pep
      1 MSWHIFQVAG IPTASIAQST PSSPTIAATC LLTSPEAGLM VWVAPNSFAS

51 FKRFSSISQT MMAAGLYSWA VGKADIPTGA APAMNTVSPG LTSPYCTPIS

101 CAVGKASLNN RATSSLTLSG SGTRLLSA* m701/a701  92.2% identity in 128 aa overlap
                    10         20         30         40         50         60
 m701.pep   MSWHITFHVAGIPTASMAQSTPSSPTMAKTCLDTSPEAGLMVWVAPNSFASFKRFSSISQT
            ||||||:||||||||:||||||||||:| ||||||||||||||||||||||||||||||||
 a701       MSWHITFQVAGIPTASIAQSTPSSPTIAATCLLTSPEAGLMVWVAPNSFASFKRFSSISQT
                    10         20         30         40         50         60

70         80         90        100        110        120
 m701.pep   MMAAGLYSWAVNRADIPTGPAPAMNTVSPGLTSPYCTPISWAVGKASLNNRAISSLTLSG
            ||||||||||::|||||||| ||||||||||||||||||| |||||||||||| ||||||
 a701       MMAAGLYSWAVGKADIPTGAAPAMNTVSPGLTSPYCTPISCAVGKASLNNRATSSLTLSG
                    70         80         90        100        110        120

129
 m701.pep   SGTRLLSAX
            |||||||||
 a701       SGTRLLSAX
```

The following partial DNA sequence was identified in *N. gonorrhoeae* <SEQ ID 2343>:

```
g702.seq
  1 ATGCCGTGTt ccaAAGCCAG TTGGACTTCG CCCGGAGtgg cAACGCCGGG

51 AATCAGGGGA ATGCCGCTGT TGCGGCCGGC TCTGGCGAGG GATTCGTGCA

101 AACCCGGGCT GATGGCGAAA ACCGCGCCTG CGTCTTCGAC GGCTTTGAGC

151 TGTTCGGGAT TGGTTACCGT ACCTGCGCCG ATGATGGCGT TGGGCATTTC

201 TTTGGCAATC AGGCGGATGG CCTCGAGTCC GACGGGGGTG CGCAAGGTAA

251 TTTCGAGGGT GGGGATGCCG CCTTCGACAA GGGCGCGGGA CAAATCGACG

301 GCGGTGCTTA AGTCGTCAAt cgCCATCACA GGCACAACTG CGCCGGCGGT

351 CAGGATTTCG cggggggtca gttga
```

This corresponds to the amino acid sequence <SEQ ID 2344; ORF 702>:

```
g702.pep
   1 MPCSKASWTS PGVATPGIRG MPLLRPALAR DSCKPGLMAK TAPASSTALS

51 CSGLVTVPAP MMALGISLAI RRMASSPTGV RKVISRVGMP PSTRARDKST

101 AVLKSSIAIT GTTAPAVRIS RGVS*
```

The following partial DNA sequence was identified in *N. meningitidis* <SEQ ID 2345>:

```
m702.seq
   1 ATGCCGTGTT CCAAAGCCAG TTGGATTTCG CCCGGGGTGG CAACACCGGG

51 AATCAGGGGG ATGCCGCTGT TGTGGCCGGC TTTGGCGAGG GATTCATGCA

101 GCCCCGGGCT GATGGCGAAA ACCGCGCCTG CGTCTTCGAC GGCTTTGAGC

151 TGTTCGGGAT TGGTTACCGT ACCTGCGCCG ACGATGGCGT TGGGCACTTC

201 TTTGGCAATC AGGCGGATGG CATCGAGGCC GACAGGGGTG CGCAGGGTGA

251 TTTCGAGGGT AGGGATGCCG CCTTCGACAA GGGCGTGGGA CAAATCGATG

301 GCGGTGCTTA AGTCGTCAAT CGCCATTACC GGCACAACTG CGCCGGCGGT

351 CAAAATTTCG CGGGGGGTCA GTTTGGACAT TTCGGTTCTC CGGGTGGAAT

401 GGGGTATTTT ATTAAGATGG GACAGGTTGT AG
```

This corresponds to the amino acid sequence <SEQ ID 2346; ORF 702>:

```
m702.pep
   1 MPCSKASWIS PGVATPGIRG MPLLWPALAR DSCSPGLMAK TAPASSTALS

51 CSGLVTVPAP TMALGTSLAI RRMASRPTGV RRVISRVGMP PSTRAWDKSM

101 AVLKSSIAIT GTTAPAVKIS RGVSLDISVL RVEWGILLRW
     DRL*
```

Computer analysis of the amino acid sequences gave the following results:
Homology with a Predicted ORF from *N. meningitidis* menA with menB
ORF 702 shows 91.9% identity over a 124 aa overlap with a predicted ORF (ORF702.a) from *N. gonorrhoeae*:

```
m702/g702
                   10         20         30         40         50         60
     m702.pep MPCSKASWISPGVATPGIRGMPLLWPALARDSCSPGLMAKTAPASSTALSCSGLVTVPAP
              ||||||||  ||||||||||||||||| ||||||||:|||||||||||||||||||||||||
        g702  MPCSKASWTSPGVATPGIRGMPLLRPALARDSCKPGLMAKTAPASSTALSCSGLVTVPAP
                   10         20         30         40         50         60

70         80         90        100        110        120
     m702.pep TMALGTSLAIRRMASRPTGVRRVISRVGMPPSTRAWDKSMAVLKSSIAITGTTAPAVKIS
              ||||| |||||||||| |||||:|||||||||| ||| |||||||||||||||||||||||:||
        g702  MMALGISLAIRRMASSPTGVRKVISRVGMPPSTRARDKSTAVLKSSIAITGTTAPAVRIS
                   70         80         90        100        110        120

130        140
     m702.pep RGVSLDISVLRVEWGILLRWDRLX
              ||||
        g702  RGVSX
```

The following partial DNA sequence was identified in *N. meningitidis* <SEQ ID 2347>:

```
a702.seq
   1 ATGCCGTGTT CCAAAGCCAG TTGGATTTCG CCCGGGGTGG CAACACCGGG

51 AATCAGGGGG ATGCCGCTGT TGTGGCCGGC TTTGGCGAGG GATTCATGCA

101 GCCCCGGGCT GATGGCGAAA ACCGCGCCTG CGTCTTCGAC GGCTTTGAGC

151 TGTTCGGGAT TGGTTACCGT ACCTGCGCCG ACGATGGCGT TGGGCACTTC

201 TTTGGCAATC AGGCGGATGG CATCGAGGCC GACAGGGGTG CGCAGGGTGA

251 TTTCGAGGGT AGGGATGCCG CCTTCGACAA GGGCGTGGGA CAAATCGATG

301 GCGGTGCTTA AGTCGTCAAT CGCCATTACC GGCACAACTG CGCCGGCGGT

351 CAAAATTTCG CGGGGGGTCA GTTTGGACAT TTCGGTTCTC CGGGTGGAAT

401 GGGGTATTTT ATTAAGATGG GACAGGTTGT AG
```

This corresponds to the amino acid sequence <SEQ ID 2348; ORF 702.a>:

```
a702.pep

1  MPCSKASWIS PGVATPGIRG MPLLWPALAR DSCSPGLMAK TAPASSTALS

51  CSGLVTVPAP TMALGTSLAI RRMASRPTGV RRVISRVGMP PSTRAWDKSM

101  AVLKSSIAIT GTTAPAVKIS RGVSLDISVL RVEWGILLRW DRL* m702/a702  100.0% identity in 143 aa overlap 10        20        30        40        50        60
m702.pep   MPCSKASWISPGVATPGIRGMPLLWPALARDSCSPGLMAKTAPASSTALSCSGLVTVPAP
           ||||||||||||||||||||||||||||||||||||||||||||||||||||||||||||
a702       MPCSKASWISPGVATPGIRGMPLLWPALARDSCSPGLMAKTAPASSTALSCSGLVTVPAP
                   10        20        30        40        50        60

70        80        90       100       110       120
m702.pep   TMALGTSLAIRRMASRPTGVRRVISRVGMPPSTRAWDKSMAVLKSSIAITGTTAPAVKIS
           ||||||||||||||||||||||||||||||||||||||||||||||||||||||||||||
a702       TMALGTSLAIRRMASRPTGVRRVISRVGMPPSTRAWDKSMAVLKSSIAITGTTAPAVKIS
                   70        80        90       100       110       120
                  130       140
m702.pep   RGVSLDISVLRVEWGILLRWDRLX
           ||||||||||||||||||||||||
a702       RGVSLDISVLRVEWGILLRWDRLX
                  130       140
```

The following partial DNA sequence was identified in *N. gonorrhoeae* <SEQ ID 2349>:

```
g703.seq
   1 ATGAAAGCAA AAATCCTGAC TTCCGTTGCG CTGCTTGCCT GTTCCGGCAG

51 CCTGTTTGCC CAAACGCTGG CAACCGTTAA CGGTCAGAAA ATCGACAGTT

101 CCGTCATCGA TGCGCAGGTT GCCGCATTCC GTGCGGAAAA CAGCCGTGCC

151 GAAGACACGC CGCAACTGCG CCAATCCCTG CTGGAAAACG AAGTGGTCAA

201 CACCGTGGTC GCACAGGAAG TGAAACGCCT GAAACTCGAC CGGTCGGCAG

251 AGTTTAAAGA TGCGCTTGCC AAATTGCGTG CCGAAGCGAA AAAGTCGGGC

301 GACGACAAGA AACCGTCCTT CAAAACCGTT TGGCAGGCGG TAAAATATGG

351 CTTGAACGGC GAGGCATACG CACTGCATAT CGCCAAAACC CAACCGGTTT

401 CCGAGCAGGA AGTAAAAGCC GTTTACGACA ATATCAGCGG TTTTTATAAA

451 GGCACGCAGG AAGTCCAGTT GGGCGAAATC CTGACCGACA AGGAAGAAAA
```

```
-continued
501 TGCGAAAAAA GCGGTTGCCG ATTTGAAGGC GAAAAAAGGT TTTGATGCCG

551 TTTTGAAACA ATACTCGCTC AACGACCGCA CCAAACGGAC CGGCGCGCCG

601 GACGGATATG TGCCGCTGAA AGATTTGGAA CAGGGTGTTC CGCCGCTTTA

651 TCAGGCAATT AAGGACTTGA AAAAGGCGA ATTTACGGCA ACGCCGCTGA

701 AAAACGGCGA TTTCTACGGC GTTTATTATG TCAACGACAG CCGcgaggTG

751 AAAGTGCCTT CTTTTGACGA AATGAAAGGA CAGATTGCCG GCAACCTTCA

801 GGCGGAACGG ATTGACCGTG CCGTctgTGc gcTGTTgggt aaggCAAACA

851 TCAAACCTGC AAAATAA
```

This corresponds to the amino acid sequence <SEQ ID 2350; ORF 703>:

```
g703.pep
  1 MKAKILTSVA LLACSGSLFA QTLATVNGQK IDSSVIDAQV AAFRAENSRA

51 EDTPQLRQSL LENEVVNTVV AQEVKRLKLD RSAEFKDALA KLRAEAKKSG

101 DDKKPSFKTV WQAVKYGLNG EAYALHIAKT QPVSEQEVKA VYDNISGFYK

151 GTQEVQLGEI LTDKEENAKK AVADLKAKKG FDAVLKQYSL NDRTKRTGAP

201 DGYVPLKDLE QGVPPLYQAI KDLKKGEFTA TPLKNGDFYG VYYVNDSREV

251 KVPSFDEMKG QIAGNLQAER IDRAVCALLG KANIKPAK*
```

The following partial DNA sequence was identified in *N. meningitidis* <SEQ ID 2351>:

```
m703.seq
  1 ATGAAAGCAA AAATCCTGAC TTCCGTTGCA CTGCTTGCCT GTTCCGGCAG

51 CCTGTTTGCC CAAACGCTGG CAACCGTCAA CGGTCAGAAA ATCGACAGTT

101 CCGTCATCGA TGCGCAGGTT GCCGCATTCC GTGCGGAAAA CAGCCGTGCC

151 GAAGACACGC CGCAACTGCG CCAATCCCTG CTGGAAAACG AAGTGGTCAA

201 TACCGTGGTC GCACAGGAAG TGAAACGCCT GAAACTCGAC CGGTCGGCAG

251 AGTTTAAAAA TGCGCTTGCC AAATTGCGTG CCGAAGCGAA AAAGTCGGGC

301 GACGACAAGA AACCGTCCTT CAAAACCGTT TGGCAGGCGG TAAAATATGG

351 CTTGAACGGC GAGGCATACG CATTGCATAT CGCCAAAACC CAACCGGTTT

401 CCGAGCAGGA AGTAAAAGCC GCATATGACA ATATCAGCGG TTTTTACAAA

451 GGTACGCAGG AAGTCCAGTT GGGCGAAATC CTGACCGACA AGGAAGAAAA

501 TGCAAAAAAA GCGGTTGCCG ACTTGAAGGC GAAAAAAGGT TTCGATGCCG

551 TCTTGAAACA ATATTCCCTC AACGACCGTA CCAAACAGAC CGGTGCGCCG

601 GTCGGATATG TGCCGCTGAA AGATTTGGAA CAGGGTGTTC CGCCGCTTTA

651 TCAGGCAATT AAGGACTTGA AAAAGGCGA ATTTACGGCA ACGCCGCTGA

701 AAAACGGCGA TTTCTACGGC GTTTATTATG TCAACGACAG CCGCGAGGTA

751 AAAGTGCCTT CTTTTGATGA AATGAAAGGA CAGATTGCGG GCAACCTTCA

801 GGCGGAACGG ATTGACCGTG CCGTCGGTGC ACTGTTGGGC AAGGCAAACA

851 TCAAACCTGC AAAATAA
```

This corresponds to the amino acid sequence <SEQ ID 2352; ORF 703>:

```
m703.pep
  1 MKAKILTSVA LLACSGSLFA QTLATVNGQK IDSSVIDAQV AAFRAENSRA

51 EDTPQLRQSL LENEVVNTVV AQEVKRLKLD RSAEFKNALA KLRAEAKKSG

101 DDKKPSFKTV WQAVKYGLNG EAYALHIAKT QPVSEQEVKA AYDNISGFYK

151 GTQEVQLGEI LTDKEENAKK AVADLKAKKG FDAVLKQYSL NDRTKQTGAP

201 VGYVPLKDLE QGVPPLYQAI KDLKKGEFTA TPLKNGDFYG VYYVNDSREV

251 KVPSFDEMKG QIAGNLQAER IDRAVGALLG KANIKPAK*
```

Computer analysis of the amino acid sequences gave the following results:

Homology with a Predicted ORF from *N. meningitidis* menA with menB

ORF 703 shows 98.3% identity over a 288 aa overlap with a predicted ORF (ORF703.a) from *N. gonorrhoeae*:

```
m703/g703

10         20         30         40         50         60
    m703.pep  MKAKILTSVALLACSGSLFAQTLATVNGQKIDSSVIDAQVAAFRAENSRAEDTPQLRQSL
              ||||||||||||||||||||||||||||||||||||||||||||||||||||||||||||
    g703      MKAKILTSVALLACSGSLFAQTLATVNGQKIDSSVIDAQVAAFRAENSRAEDTPQLRQSL
                    10         20         30         40         50         60
                    70         80         90        100        110        120
    m703.pep  LENEVVNTVVAQEVKRLKLDRSAEFKNALAKLRAEAKKSGDDKKPSFKTVWQAVKYGLNG
              |||||||||||||||||||||||||||||:||||||||||||||||||||||||||||||
    g703      LENEVVNTVVAQEVKRLKLDRSAEFKDALAKLRAEAKKSGDDKKPSFKTVWQAVKYGLNG
                    70         80         90        100        110        120
                   130        140        150        160        170        180
    m703.pep  EAYALHIAKTQPVSEQEVKAAYDNISGFYKGTQEVQLGEILTDKEENAKKAVADLKAKKG
              |||||||||||||||||||||:||||||||||||||||||||||||||||||||||||||
    g703      EAYALHIAKTQPVSEQEVKAVYDNISGFYKGTQEVQLGEILTDKEENAKKAVADLKAKKG
                   130        140        150        160        170        180
                   190        200        210        220        230        240
    m703.pep  FDAVLKQYSLNDRTKQTGAPVGYVPLKDLEQGVPPLYQAIKDLKKGEFTATPLKNGDFYG
              ||||||||||||||:||||||||||||||||||||||||||||||||||||||||||||
    g703      FDAVLKQYSLNDRTKRTGAPDGYVPLKDLEQGVPPLYQAIKDLKKGEFTATPLKNGDFYG
                   190        200        210        220        230        240
                   250        260        270        280        289
    m703.pep  VYYVNDSREVKVPSFDEMKGQIAGNLQAERIDRAVGALLGKANIKPAKX
              |||||||||||||||||||||||||||||||||||| ||||||||||||
    g703      VYYVNDSREVKVPSFDEMKGQIAGNLQAERIDRAVCALLGKANIKPAKX
                   250        260        270        280
```

The following partial DNA sequence was identified in *N. meningitidis* <SEQ ID 2353>:

```
a703.seq
  1 ATGAAAGCAA AAATCCTGAC TTCCGTTGCA CTGCTTGCCT GTTCCGGCAG

51 CCTGTTTGCC CAAACGCTGG CAACCGTCAA CGGTCAGAAA ATCGACAGTT

101 CCGTCATTGA TGCGCAGGTT GCCGCATTCC GTGCGGAAAA CAGCCGTGCC

151 GAAGACACGC CGCAACTGCG CCAATCCCTG CTGGAAAACG AAGTGGTCAA

201 CACCGTGGTC GCACAGGAAG TGAAACGCCT GAAACTCGAC CGGTCGGCAG

251 AGTTTAAAAA TGCGCTTGCC AAATTGCGTG CCGAAGCGAA AAAGTCGGGC

301 GACGACAAGA AACCGTCCTT CAAAACCGTT TGGCAGGCGG TAAAATATGG

351 CTTGAACGGC GAGGCATACG CGCTGCATAT CGCCAAAACC CAACCGGTTT

401 CCGAGCAGGA AGTAAAAGCC GCATATGACA ATATCAGCGG TTTTTACAAA

451 GGTACGCAGG AAGTCCAGTT GGGCGAAATC CTGACCGACA AGGAAGAAAA
```

-continued

```
501 TGCAAAAAAA GCGGTTGCCG ACTTGAAGGC GAAAAAAGGT TTCGATGCCG

551 TCTTGAAACA ATATTCCCTC AACGACCGTA CCAAACAGAC CGGTGCGCCG

601 GTCGGATATG TGCCGCTGAA AGATTTGGAA CAGGGTGTTC CGCCGCTTTA

651 TCAGGCAATT AAGGACTTGA AAAAAGGCGA ATTTACGGCA ACGCCGCTGA

701 AAAACGGCGA TTTCTACGGC GTTTATTATG TCAACGACAG CCGCGAGGTA

751 AAAGTGCCTT CTTTTGATGA AATGAAAGGA CAGATTGCGG GCAACCTTCA

801 GGCGGAACGG ATTGACCGTG CCGTCGGTGC ACTGTTGGGC AAGGCAAACA

851 TCAAACCTGC AAAATAA
```

This corresponds to the amino acid sequence <SEQ ID 2354; ORF 703.a>:

```
a703.pep

1   MKAKILTSVA LLACSGSLFA QTLATVNGQK IDSSVIDAQV AAFRAENSRA

51   EDTPQLRQSL LENEVVNTVV AQEVKRLKLD RSAEFKNALA KLRAEAKKSG

101   DDKKPSFKTV WQAVKYGLNG EAYALHIAKT QPVSEQEVKA AYDNISGFYK

151   GTQEVQLGEI LTDKEENAKK AVADLKAKKG FDAVLKQYSL NDRTKQTGAP

201   VGYVPLKDLY QGVPPLYQAI KDLKKGEFTA TPLKNGDFYG VYYVNDSREV

251   KVPSFDEMKG QIAGNLQAER IDRAVGALLG KNIKPAK* m703/a703   100.0% identity in 288 aa overlap 10         20         30         40         50         60
m703.pep   MKAKILTSVALLACSGSLFAQTLATVNGQKIDSSVIDAQVAAFRAENSRAEDTPQLRQSL
           ||||||||||||||||||||||||||||||||||||||||||||||||||||||||||||
a703       MKAKILTSVALLACSGSLFAQTLATVNGQKIDSSVIDAQVAAFRAENSRAEDTPQLRQSL
                   10         20         30         40         50         60

70         80         90        100        110        120
m703.pep   LENEVVNTVVAQEVKRLKLDRSAEFKNALAKLRAEAKKSGDDKKPSFKTVWQAVKYGLNG
           ||||||||||||||||||||||||||||| ||||||||||||||||||||||||||||||
a703       LENEVVNTVVAQEVKRLKLDRSAEFKDALAKLRAEAKKSGDDKKPSFKTVWQAVKYGLNG
                   70         80         90        100        110        120

130        140        150        160        170        180
m703.pep   EAYALHIAKTQPVSEQEVKAAYDNISGFYKGTQEVQLGEILTDKEENAKKAVADLKAKKG
           |||||||||||||||||||| |||||||||||||||||||||||||||||||||||||||
a703       EAYALHIAKTQPVSEQEVKAVYDNISGFYKGTQEVQLGEILTDKEENAKKAVADLKAKKG
                  130        140        150        160        170        180

190        200        210        220        230        240
m703.pep   FDAVLKQYSLNDRTKQTGAPVGYVPLKDLEQGVPPLYQAIKDLKKGEFTATPLKNGDFYG
           |||||||||||||||| ||| ||||||||||||||||||||||||||||||||||||||
a703       FDAVLKQYSLNDRTKRTGAPDGYVPLKDLEQGVPPLYQAIKDLKKGEFTATPLKNGDFYG
                  190        200        210        220        230        240

250        260        270        280   289
m703.pep   VYYVNDSREVKVPSFDEMKGQIAGNLQAERIDRAVGALLGKANIKPAKX
           |||||||||||||||||||||||||||||||||||| |||||||||||
a703       VYYVNDSREVKVPSFDEMKGQIAGNLQAERIDRAVCALLGKANIKPAKX
                  250        260        270        280
```

The following partial DNA sequence was identified in *N. meningitidis* <SEQ ID 2355>:

```
a704.seq
  1   ATGAAAAAAA CCTGTTTCCA CTGCGGGCTG ACGTTCCCG AAAACCTGCA

51   TCTGACCGTC CGTTACGAAA ACGAAGACCG CGAAACCTGC TGCGCCGGTT

101   GTCAGGCAGT CGCACAAAGC ATTATTGACG CGGGCTTGGG CAGTTATTAC

151   AAACAACGCA CCGCCGACGC GCAAAAAACC GAGCTGCCGC CCCAAGAAAT

201   CCTCGACCAA ATCCGCCTGT ACGACCTGCC CGAAGTCCAG TCCGACTTTG

251   TGGAAACCCA CGGCGGCACG CGCGAGGCGG TTTTAATGCT CGGCGGCATC
```

-continued

```
 301 ACCTGCGCCG CCTGCGTCTG GCTGATCGAA CAGCAGCTTT TGCGTACAGA
 351 CGGCATCGTC CGCATCGACC TCAATTACAG CACGCACCGC TGCCGCGTCG
 401 TCTGGGACGA CGGCAAAATC CGCCTTTCCG ACATTCTGTT GAAAATCAGG
 451 CAGATAGGCT ACACCGCCGC ACCCTATGAC GCGCAAAAAA TCGAAGCCGC
 501 CAACCAAAAA GAACGCAAAC AATACATCGT CCGCCTCGCC GTTGCCGGGC
 551 TGGGGATGAT GCAGACGATG ATGTTCGCGC TGCCGACCTA CCTTTACGGC
 601 GGCGACATCG AACCCGATTT CCTGCAAATC CTCCATTGGG GCGGCTTTTT
 651 AATGGTGCTG CCCGTCGTAT TCTATTGCGC CGTCCCGTTT TATCAAGGCG
 701 CGCTGCGCGA CTTGAAAAAC CGCCGCGTCG GCATGGATAC GCCGATTACC
 751 GTCGCCATCA TCATGACCTT TATCGCCGGC GTTTACAGCC TTGCGACAAA
 801 TGCGGGGCAG GGGATGTATT TCGAATCCAT CGCGATGCTG CTGTTTTTCC
 851 TGCTGGGCGG ACGCTTTATG GAACACATTG CCCGCCGTAA GGCAGGCGAT
 901 GCCGCCGAGA GGCTGGTGAA GCTGATTCCT GCGTTTTGCC ATCATATGCC
 951 CGATTACCCC GATACGCAGG AAACCTGCGA GGCAGCTGTC GTCAAATTGA
1001 AGGCGGGCGA TATCGTGCTG GTCAAACCGG GCGAAACCAT CCCCGTTGAC
1051 GGCACGGTGC TGGAAGGAAG CAGTGCCGTC AACGAATCTA TGCTGACCGG
1101 CGAGAGCCTG CCCGTCGCCA AAATGCCGTC TGAAAAGTA ACCGCCGGCA
1151 CACTCAACAC GCAAAGCCCC CTGATTATAC GCACCGACCG CACCGGCGGC
1201 GGCACGCGAC TGTCGCACAT CGTCCGCCTG CTCGACCGCG CCTTAGCGCA
1251 AAAACCGCGC ACTGCCGAGT TGGCGGAACA ATACGCCTCG TCTTTCATAT
1301 TCGGCGAACT CCTGCTTGCC GTCCCCGTCT TCATCGGCTG GACGCTGTAC
1351 GCCGACGCGC ACACCGCATT GTGGATTACC GTCGCCCTGC TGGTCATTAC
1401 CTGCCCCTGC GCCTTATCGC TTGCCACGCC GACCGCGCTG GCAGCTTCTA
1451 CCGGTACGCT GGCGCGCGAA GGTATTTTAA TCGGCGGAAA GCAGGCAATC
1501 GAAACCCTCG CCCAAACCAC CGACATCATC TTCGACAAAA CCGGCACGCT
1551 GACCCAAGGC AAACCCGCCG TCCGCCGTAT CTCATTGTTG AGAGGCACAG
1601 ACGAAGCCTT TGTTCTCGCG GTGGCGCAGG CTTTAGAACA ACAGTCCGAA
1651 CATCCCCTTG CCCGCGCCAT CCTCAACTGC CGCATTTCAG ACGGCAGCGT
1701 CCCCGACATC GCTATTAAAC AACGCCTCAA CCGCATCGGC GAAGGCGTGG
1751 GCGCGCAACT GACCGTCAAC GGCGAAACAC AGGTTTGGGC ATTGGGCAGG
1801 GCATCCTATG TCGCCGAAAT TTCAGGTAAA GAACCGCAAA CAGAAGGCGG
1851 CGGCAGCGCG GTTTACCTCG GCAGTCAAAG CGGTTTCCAA GCCGTGTTCT
1901 ACCTGCAAGA CCCGCTCAAA GACAGCGCGG CGGAGGCGGT GCGGCAGTTG
1951 GCAGGCAAAA ACCTGACGCT GCACATTCTC AGCGGCGACC GTGAAACCGC
2001 CGTTGCCGAA ACCGCACGCG CCCTGGGTGT CGCGCACTAC CGCGCCCAAG
2051 CCATGCCCGA GGACAAACTG GAATACGTCA AGCCTTGCA AAAAGAAGGG
2101 AAAAAGTGC TGATGATAGG CGACGGCATC AACGACGCGC CCGTTTTGGC
2151 GCAGGCAGAC GTATCCGCCG CCGCAGCGGG CGGGACGGAT ATTGCGAGGG
2201 ACGGCGCGGA CATTGTGTTA TTGAACGAAG ATTTGCGTAC CGTCGCCCAC
2251 CTGCTCGATC AGGCGCGGCG CACCCGCCAT ATTATCCGGC AAAACCTGAT
```

```
-continued
2301 ATGGGCGGGC GCGTACAATA TCATTGCCGT ACCGCTTGCC GTTTTGGGCT

2351 ATGTCCAACC GTGGATAGCC GCACTGGGTA TGAGCTTCAG TTCGCTGGCG

2401 GTTTTGGGCA ACGCCCTGCG CCTTCACAAA CGGGGGAAAA TGCAGTCTGA

2451 AAAAATGCCG TCCGAACAAT GA
```

This corresponds to the amino acid sequence <SEQ ID 2356; ORF 703>:

```
a704.pep

1   MKKTCFHCGL DVPENLHLTV RYENEDRETC CAGCQAVAQS IIDAGLGSYY
   51   KQRTADAQKT ELPPQEILDQ IRLYDLPEVQ SDFVETHGGT REAVLMLGGI
  101   TCAACVWLIE QQLLRTDGIV RIDLNYSTHR CRVVWDDGKI RLSDILLKIR
  151   QIGYTAAPYD AQKIEAANQK ERKQYIVRLA VAGLGMMQTM MFALPTYLYG
  201   GDIEPDFLQI LHWGGFLMVL PVVFYCAVPF YQGALRDLKN RRVGMDTPIT
  251   VAIIMTFIAG VYSLATNAGQ GMYFESIAML LFFLLGGRFM EHIARRKAGD
  301   AAERLVKLIP AFCHHMPDYP DTQETCEAAV VKLKAGDIVL VKPGETIPVD
  351   GTVLEGSSAV NESMLTGESL PVAKMPSEKV TAGTLNTQSP LIIRTDRTGG
  401   GTRLSHIVRL LDRALAQKPR TAELAEQYAS SFIFGELLLA VPVFIGWTLY
  451   ADAHTALWIT VALLVITCPC ALSLATPTAL AASTGTLARE GILIGGKQAI
  501   ETLAQTTDII FDKTGTLTQG KPAVRRISLL RGTDEAFVLA VAQALEQQSE
  551   HPLARAILNC RISDGSVPDI AIKQRLNRIG EGVGAQLTVN GETQVWALGR
  601   ASYVAEISGK EPQTEGGGSA VYLGSQSGFQ AVFYLQDPLK DSAAEAVRQL
  651   AGKNLTLHIL SGDRETAVAE TARALGVAHY RAQAMPEDKL EYVKALQKEG
  701   KKVLMIGDGI NDAPVLAQAD VSAAAAGGTD IARDGADIVL LNEDLRTVAH
  751   LLDQARRTRH IIRQNLIWAG AYNIIAVPLA VLGYVQPWIA ALGMSFSSLA
  801   VLGNALRLHK RGKMQSEKMP SEQ* m704/a704  99.8%  identity in 823 aa overlap 10         20         30         40         50         60
m704.pep  MKKTCFHCGLDVPEHLHLTVRYENEDRETCCAGCQAVAQSIIDAGLGSYYKQRTADAQKT
          ||||||||||||:|||||||||||||||||||||||||||||||||||||||||||||||
a704      MKKTCFHCGLDVPENLHLTVRYENEDRETCCAGCQAVAQSIIDAGLGSYYKQRTADAQKT
                10         20         30         40         50         60

70         80         90        100        110        120
m704.pep  ELPPQEILDQIRLYDLPEVQSDFVETHGGTREAVLMLGGITCAACVWLIEQQLLRTDGIV
          ||||||||||||||||||||||||||||||||||||||||||||||||||||||||||||
a704      ELPPQEILDQIRLYDLPEVQSDFVETHGGTREAVLMLGGITCAACVWLIEQQLLRTDGIV
                70         80         90        100        110        120

130        140        150        160        170        180
m704.pep  RIDLNYSTHRCRVVWDDGKIRLSDILLKIRQIGYTAAPYDAQKIEAANQKERKQYIVRLA
          ||||||||||||||||||||||||||||||||||||||||||||||||||||||||||||
a704      RIDLNYSTHRCRVVWDDGKIRLSDILLKIRQIGYTAAPYDAQKIEAANQKERKQYIVRLA
               130        140        150        160        170        180

190        200        210        220        230        240
m704.pep  VAGLGMMQTMMFALPTYLYGGDIEPDFLQILHWGGFLMVLPVVFYCAVPFYQGALRDLKN
          ||||||||||||||||||||||||||||||||||||||||||||||||||||||||||||
a704      VAGLGMMQTMMFALPTYLYGGDIEPDFLQILHWGGFLMVLPVVFYCAVPFYQGALRDLKN
               190        200        210        220        230        240

250        260        270        280        290        300
m704.pep  RRVGMDTPITVAIIMTFIAGVYSLATNAGQGMYFESIAMLLFFLLGGRFMEHIARRKAGD
          ||||||||||||||||||||||||||||||||||||||||||||||||||||||||||||
a704      RRVGMDTPITVAIIMTFIAGVYSLATNAGQGMYFESIAMLLFFLLGGRFMEHIARRKAGD
               250        260        270        280        290        300

310        320        330        340        350        360
m704.pep  AAERLVKLIPAFCHHMPDYPDTQETCEAAVVKLKAGDIVLVKPGETIPVDGTVLEGSSAV
          ||||||||||||||||||||||||||||||||||||||||||||||||||||||||||||
a704      AAERLVKLIPAFCHHMPDYPDTQETCEAAVVKLKAGDIVLVKPGETIPVDGTVLEGSSAV
               310        320        330        340        350        360
```

```
              370       380       390       400       410       420
m704.pep  NESMLTGESLPVAKMPSEKVTAGTLNTQSPLIIRTDRTGGGTRLSHIVRLLDRALAQKPR
          ||||||||||||||||||||||||||||||||||||||||||||||||||||||||||||
a704      NESMLTGESLPVAKMPSEKVTAGTLNTQSPLIIRTDRTGGGTRLSHIVRLLDRALAQKPR
              370       380       390       400       410       420

430       440       450       460       470       480
m704.pep  TAELAEQYASSFIFGELLLAVPVFIGWTLYADAHTALWITVALLVITCPCALSLATPTAL
          ||||||||||||||||||||||||||||||||||||||||||||||||||||||||||||
a704      TAELAEQYASSFIFGELLLAVPVFIGWTLYADAHTALWITVALLVITCPCALSLATPTAL
              430       440       450       460       470       480

490       500       510       520       530       540
m704.pep  AASTGTLAREGILIGGKQAIETLAQTTDIIFDKTGTLTQGKPAVRRISLLRGTDEAFVLA
          ||||||||||||||||||||||||||||||||||||||||||||||||||||||||||||
a704      AASTGTLAREGILIGGKQAIETLAQTTDIIFDKTGTLTQGKPAVRRISLLRGTDEAFVLA
              490       500       510       520       530       540

550       560       570       580       590       600
m704.pep  VAQALEQQSEHPLARAILNCRISDGSVPDIAIKQRLNRIGEGVGAQLTVNGETQVWALGR
          ||||||||||||||||||||||||||||||||||||||||||||||||||||||||||||
a704      VAQALEQQSEHPLARAILNCRISDGSVPDIAIKQRLNRIGEGVGAQLTVNGETQVWALGR
              550       560       570       580       590       600

610       620       630       640       650       660
m704.pep  ASYVAEISGKEPQTEGGGSAVYLGSQSGFQAVFYLTDPLKDSAAEAVRQLAGKNLTLHIL
          ||||||||||||||||||||||||||||||||||||| ||||||||||||||||||||||
a704      ASYVAEISGKEPQTEGGGSAVYLGSQSGFQAVFYLQDPLKDSAAEAVRQLAGKNLTLHIL
              610       620       630       640       650       660

670       680       690       700       710       720
m704.pep  SGDRETAVAETARALGVAHYRAQAMPEDKLEYVKALQKEGKKVLMIGDGINDAPVLAQAD
          ||||||||||||||||||||||||||||||||||||||||||||||||||||||||||||
a704      SGDRETAVAETARALGVAHYRAQAMPEDKLEYVKALQKEGKKVLMIGDGINDAPVLAQAD
              670       680       690       700       710       720

730       740       750       760       770       780
m704.pep  VSAAAAGGTDIARDGADIVLLNEDLRTVAHLLDQARRTRHIIRQNLIWAGAYNIIAVPLA
          ||||||||||||||||||||||||||||||||||||||||||||||||||||||||||||
a704      VSAAAAGGTDIARDGADIVLLNEDLRTVAHLLDQARRTRHIIRQNLIWAGAYNIIAVPLA
              730       740       750       760       770       780

790       800       810       820
m704.pep  VLGYVQPWIAALGMSFSSLAVLGNALRLHKRGKMQSEKMPSEQX
          |||||||||||||||||||||||||||||||||||||||||||
a704      VLGYVQPWIAALGMSFSSLAVLGNALRLHKRGKMQSEKMPSEQX
              790       800       810       820
```

The following partial DNA sequence was identified in *N. gonorrhoeae* <SEQ ID 2357>:

```
g705.seq
  1 GTGTTCAATA ATTTCCttgC CTCTCTGCCG TTTATGACGG AAACACGCGC

51 TGATATGCTC ATCAGCGCGT TTTGGCCCAT GGTTAAAGCC GGCTTTACAG

101 TGTCTTtgcC TTTGGCGATC GCTTCTTTCG TTATCGGCAT GATTATTGCC

151 GTAGCCGTTG CTTTGGTAAG AATCATGCCT TCCGGCGGTA TTTTCCAAAA

201 ATGCTTGTTG AAGCTGGTGG AATTTTATAT TTCCGTCGTT CGCGGTACGC

251 CGCTGTTGGT TCAGCTTGTG ATTGTGTTTT ACGGGCTGCC GTCCGTCGGC

301 ATCTATATCA ATCCGATTCC CGCCGCCATC ATCGGCTTTT CGCTCAATGT

351 CGGCGCATAC GCTTCCGAAA CCATACGCGC GGCGATTTTG TCCGTGCCGA

401 AAGGGCAGTG GGAAGCAGGT TTCTCCATCG GTATGACCTA TATGCAGACG

451 TTCCGCCGCA TCGTCGCACC GCAGGCATTC CGCGTCGCCG TTCCGCCGTT

501 GAGCAACGAG TTTATCGGCT TGTTCAAAAA CACCTCGCTT GCCGCCGTGG

551 TAACGGTAAC GGAGCTTTTC CGTGTCGCAC AGGAAACGGC AAACCGCACT

601 TATGACTTTT TGCCTGTCTA TATCGAAGCT GCATTGGTTT ATTGGTGTTT

651 CTGTAAAGTG CTGTTTTTGA TTCAGGCGCG TTTGGAAAAA CGTTTCGACC

701 GTTATGTCGC CAAATAA
```

This corresponds to the amino acid sequence <SEQ ID 2358; ORF 705>:

```
g705.pep
   1 VFNNFLASLP FMTETRADML ISAFWPMVKA GFTVSLPLAI ASFVIGMIIA

51 VAVALVRIMP SGGIFQKCLL KLVEFYISVV RGTPLLVQLV IVFYGLPSVG

101 IYINPIPAAI IGFSLNVGAY ASETIRAAIL SVPKGQWEAG FSIGMTYMQT

151 FRRIVAPQAF RVAVPPLSNE FIGLFKNTSL AAVVTVTELF RVAQETANRT

201 YDFLPVYIEA ALVYWCFCKV LFLIQARLEK RFDRYVAK*
```

The following partial DNA sequence wag identified in *N. meningitidis* <SEQ ID 2359>:

```
m705.seq
   1 GTGTTCAATA ATTTCCTTGC TTCGCTGCCG TTTATGACGG AAACACGCGC

51 CGATATGATT GTCAGCGCGT TTTTGCCTAT GGTCAAAGCC GGCTTCGCGG

101 TCTCTCTGCC TTTGGCGGCA GCTTCTTTCG TTATCGGTAT GATGATTGCG

151 GTAGCCGTGG CTTTGGTGCG GATTATGCCC GCCGGCGGCA TCGTGCGGAA

201 AATCCTGCTG AAATTGGTGG AATTTTATAT TTCCGTCATT CGCGGTACGC

251 CGCTGTTGGT TCAGCTTGTG ATTGTGTTTT ACGGGCTGCC TTCCGTCGGC

301 ATCTATATCG ACCCGATTCC TGCCGCCATC ATCGGCTTTT CGCTCAATGT

351 CGGCGCATAC GCTTCCGAAA CCATACGCGC GGCAATTTTG TCCGTACCTA

401 AAGGCCAATG GGAAGCAGGT TTCTCCATCG GCATGACCTA TATGCAGACG

451 TTCCGCCGCA TTGTCGCGCC GCAGGCATTC CGCGTTGCCG TGCCGCCTTT

501 GAGCAACGAG TTTATCGGTT TGTTTAAAAA CACCTCGCTC GCGGCAGTCG

551 TGACGGTAAC GGAATTATTC CGCGTCGCGC AGGAAACGGC AAACCGCACT

601 TATGACTTTT TGCCCGTCTA TATCGAAGCC GCTTTGGTTT ACTGGTGTTT

651 TTGTAAAGTG CTGTTCCTGA TTCAGGCGCG TTTGGAAAAA CGTTTCGACC

701 GCTACGTCGC CAAATAA
```

50

This corresponds to the amino acid sequence <SEQ ID 2360; ORF 705>:

```
m705.pep
   1 VFNNFLASLP FMTETRADMI VSAFLPMVKA GFAVSLPLAA ASFVIGMMIA

51 VAVALVRIMP AGGIVRKILL KLVEFYISVI RGTPLLVQLV IVFYGLPSVG

101 IYIDPIPAAI IGFSLNVGAY ASETIRAAIL SVPKGQWEAG FSIGMTYMQT

151 FRRIVAPQAF RVAVPPLSNE FIGLFKNTSL AAVVTVTELF RVAQETANRT

201 YDFLPVYIEA ALVYWCFCKV LFLIQARLEK RFDRYVAK*
```

Computer analysis of this amino acid sequence gave the following results:
Homology with a Predicted ORF from *N. gonorrhoeae*
ORF 705 shows 95.0% identity over a 238 aa overlap with a predicted ORF (ORF 705) from *N. gonorrhoeae*:

```
m705/g705   95.0% identity in 238 aa overlap 10        20        30        40        50        60
    m705.pep   VFNNFLASLPFMTETRADMIVSAFLPMVKAGFAVSLPLAAASFVIGMMIAVAVALVRIMP
               ||||||||||||||||||::|||   ||||:||||||||||:|||||:||||||||||||
    g705       VFNNFLASLPFMTETRADMLISAFWPMVKAGFTVSLPLAIASFVIGMIIAVAVALVRIMP
                   10        20        30        40        50        60

70        80        90       100       110       120
    m705.pep   AGGIVRKILLKLVEFYISVIRGTPLLVQLVIVFYGLPSVGIYIDPIPAAIIGFSLNVGAY
               :|||  :|||||||||||:|||||||||||||||||||||||:||||||||||||||||
    g705       SGGIFQKCLLKLVEFYISVVRGTPLLVQLVIVFYGLPSVGIYINPIPAAIIGFSLNVGAY
                   70        80        90       100       110       120

130       140       150       160       170       180
    m705.pep   ASETIRAAILSVPKGQWEAGFSIGMTYMQTFRRIVAPQAFRVAVPPLSNEFIGLFKNTSL
               ||||||||||||||||||||||||||||||||||||||||||||||||||||||||||||
    g705       ASETIRAAILSVPKGQWEAGFSIGMTYMQTFRRIVAPQAFRVAVPPLSNEFIGLFKNTSL
                  130       140       150       160       170       180

190       200       210       220       230       239
    m705.pep   AAVVTVTELFRVAQETANRTYDFLPVYIEAALVYWCFCKVLFLIQARLEKRFDRYVAKX
               |||||||||||||||||||||||||||||||||||||||||||||||||||||||||||
    g705       AAVVTVTELFRVAQETANRTYDFLPVYIEAALVYWCFCKVLFLIQARLEKRFDRYVAKX
                  190       200       210       220       230
```

The following partial DNA sequence was identified in *N. meningitidis* <SEQ ID 2361>:

```
a705.seq
    1 GTGTTCAATA ATTTCCTTGC TTCGCTGCCG TTTATGACGG AAACACGCGC

51 CGATATGATT GTCAGCGCGT TTTTGCCTAT GGTCAAAGCC GGCTTCGCGG

101 TCTCTCTGCC TTTGGCGGCA GCTTCTTTCG TTATCGGTAT GATGATTGCG

151 GTAGCCGTGG CTTTGGTGCG GATTATGCCC GCCGGCGGCA TCGTGCGGAA

201 AATCCTGCTG AAATTGGTGG AATTTTATAT TTCCGTCATT CGCGGTACGC

251 CGCTGTTGGT TCAGCTTGTG ATTGTGTTTT ACGGGCTGCC TTCCGTCGGC

301 ATCTATATCG ACCCGATTCC TGCCGCCATC ATCGGCTTTT CGCTCAATGT

351 CGGCGCATAT GCTTCCGAAA CCATACGCGC GGCAATTTTG TCCGTACCGA

401 AAGGCCAATG GGAAGCAGGT TTCTCCATCG GCATGACCTA TATGCAGACG

451 TTCCGCCGCA TCGTCGCGCC GCAGGCATTT CGCGTTGCCG TGCCGCCTTT

501 GAGCAACGAG TTTATCGGTT TGTTTAAAAA CACCTCGCTC GCGGCAGTCG

551 TGACGGTAAC GGAATTATTC CGCGTCGCGC AGGAAACGGC AAACCGCACT

601 TATGACTTTT TGCCCGTCTA TATCGAAGCC GCTTTGGTTT ACTGGTGTTT

651 TTGTAAAGTG CTGTTCCTGA TTCAGGCGCG TTTGGAAAAA CGTTTCGACC

701 GCTACGTCGC CAAATAA
```

This corresponds to the amino acid sequence <SEQ ID 2362; ORF 705.a>:

```
a705.pep
    1 VFNNFLASLP FMTETRADMI VSAFLPMVKA GFAVSLPLAA ASFVIGMMIA

51 VAVALVRIMP AGGIVRKILL KLVEFYISVI RGTPLLVQLV IVFYGLPSVG

101 IYIDPIPAAI IGFSLNVGAY ASETIRAAIL SVPKGQWEAG FSIGMTYMQT
```

```
-continued
151 FRRIVAPQAF RVAVPPLSNE FIGLFKNTSL AAVVTVTELF RVAQETANRT

201 YDFLPVYIEA ALVYWCFCKV LFLIQARLEK RFDRYVAK*
```

Computer analysis of this amino acid sequence gave the following results:
Homology with a Predicted ORF from *N. meningitidis*
ORF 705 shows 100.0% identity over a 238 aa overlap with a predicted ORF (ORF 705) from *N. meningitidis*:

```
   a705/m705  100.0%  identity in 238 aa overlap 10         20         30         40         50         60
         a705.pep  VFNNFLASLPFMTETRADMIVSAFLPMVKAGFAVSLPLAAASFVIGMMIAVAVALVRIMP
                   ||||||||||||||||||||||||||||||||||||||||||||||||||||||||||||
         m705     VFNNFLASLPFMTETRADMIVSAFLPMVKAGFAVSLPLAAASFVIGMMIAVAVALVRIMP
                    10         20         30         40         50         60

70         80         90        100        110        120
         a705.pep  AGGIVRKILLKLVEFYISVIRGTPLLVQLVIVFYGLPSVGIYIDPIPAAIIGFSLNVGAY
                   ||||||||||||||||||||||||||||||||||||||||||||||||||||||||||||
         m705     AGGIVRKILLKLVEFYISVIRGTPLLVQLVIVFYGLPSVGIYIDPIPAAIIGFSLNVGAY
                    70         80         90        100        110        120

130        140        150        160        170        180
         a705.pep  ASETIRAAILSVPKGQWEAGFSIGMTYMQTFRRIVAPQAFRVAVPPLSNEFIGLFKNTSL
                   ||||||||||||||||||||||||||||||||||||||||||||||||||||||||||||
         m705     ASETIRAAILSVPKGQWEAGFSIGMTYMQTFRRIVAPQAFRVAVPPLSNEFIGLFKNTSL
                   130        140        150        160        170        180

190        200        210        220        230        239
         a705.pep  AAVVTVTELFRVAQETANRTYDFLPVYIEAALVYWCFCKVLFLIQARLEKRFDRYVAKX
                   |||||||||||||||||||||||||||||||||||||||||||||||||||||||||||
         m705     AAVVTVTELFRVAQETANRTYDFLPVYIEAALVYWCFCKVLFLIQARLEKRFDRYVAKX
                   190        200        210        220        230        239
```

The following partial DNA sequence was identified in *N. gonorrhoeae* <SEQ ID 2363>:

```
g706.seq
   1  ATGAACTCCT CGCAACGCAA ACGCCTTTCC GgccGCTGGC TCAACTCCTA

51  CGAACGCTac cGCCaccGCC GCCTCATACA TGCCGTGCGG CTCGGCggaa 101  ccgtCCTGTT CGCCACCGCA CTCGCCCGgc tACTCCACCT CCAacacggc 151  gAATGGATAG GGAtgaCCGT CTTCGTCGTC CTCGGCATGC TCCAGTTCCA 201  AGGCgcgatt tActccaacg cggtgGAacg taTGctcggt acggtcatcg 251  ggctgGGCGC GGGTTTGGgc gTTTTATGGC TGAACCAGCA TTAtttccac 301  ggcaacCTcc tcttctacct gaccatcggc acggcaagcg cactggccgg 351  ctGGGCGGCG GTCGGCAAAA acggctacgt ccctatgctg GCGGGGctgA 401  CGATGTGCAT gctcatcggc gACAACGGCA GCGAATGGCT CGACAGCGGC

451  CTGATGCGCG CGATGAACGT CCTCATCGGC GCCGCCATCG CCATTGCCGC

501  CGCCAAACTG CTGCCGCTGA ATCCACACT GATGTGGCGT TTCATGCTTG

551  CCGACAACCT GGCCGACTGC AGCAAAATGA TTGCCGAAAT CAGCAACGGC

601  AGGCGTATGA CGCGCGAACG TTTGGAGCAG AATATGGTCA AAATGCGCCA

651  AATCAACGCA CGCATGGTCA AAAGCCGCAG CCACCTCGCC GCCACATCGG

701  GCGAAAGCCG CATCAGCCCC TCCATGATGG AAGCCATGCA GCACGCCCAC

751  CGCAAAATCG TCAACACCAC CGAGCTGCTC CTGACCACCG CCGCCAAGCT

801  GCAATCTCCC AAACTCAACG GCAGCGAAAT CCGGCTGCTC GACCGCCACT

851  TCACACTGCT CCAAACCGAC CTGCAACAAA CCGCCGCCCT CATCAACGGC
```

```
 901 AGACACGCCC GCCGCATCCG CATCGACACC GCCATCAACC CCGAACTGGA

951 AGCCCTCGCC GAACACCTCC ACTACCAATG GCAGGGCTTC CTCTGGCTCA

1001 GCACCAATAT GCGTCAGGAA ATTTCCGCCC TCGTCATCCT GCTGCAACGC

1051 ACCCGCCGCA AATGGCTGGA TGCCCACGAA CGCCAACACC TGCGCCAAAG

1101 CCTGCTTGAA ACACGGGAAC ACGGCTGA
```

This corresponds to the amino acid sequence <SEQ ID 2364; ORF 706.ng>:

```
g706.pep
   1 MNSSQRKRLS GRWLNSYERY RHRRLIHAVR LGGTVLFATA LARLLHLQHG

51 EWIGMTVFVV LGMLQFQGAI YSNAVERMLG TVIGLGAGLG VLWLNQHYFH

101 GNLLFYLTIG TASALAGWAA VGKNGYVPML AGLTMCMLIG DNGSEWLDSG

151 LMRAMNVLIG AAIAIAAAKL LPLKSTLMWR FMLADNLADC SKMIAEISNG

201 RRMTRERLEQ NMVKMRQINA RMVKSRSHLA ATSGESRISP SMMEAMQHAH

251 RKIVNTTELL LTTAAKLQSP KLNGSEIRLL DRHFTLLQTD LQQTAALING

301 RHARRIRIDT AINPELEALA EHLHYQWQGF LWLSTNMRQE ISALVILLQR

351 TRRKWLDAHE RQHLRQSLLE TREHG*
```

The following partial DNA sequence was identified in *N. meningitidis* <SEQ ID 2365>:

```
m706.seq
    1 ATGAACACCT CGCAACGCAA CCGCCTCGTC AGCCGCTGGC TCAACTCCTA

51 CGAACGCTAC CGCTACCGCC GCCTCATCCA CGCCGTCCGG CTCGGCGGGG

101 CCGTCCTGTT CGCCACCGCC TCCGCCCGGC TGCTCCACCT CCAACACGGC

151 GAGTGGATAG GGATGACCGT CTTCGTCGTC CTCGGCATGC TCCAGTTTCA

201 AGGGGCGATT TACTCCAAGG CGGTGGAACG TATGCTCGGC ACGGTCATCG

251 GGCTGGGCGC GGGTTTGGGC GTTTTATGGC TGAACCAGCA TTATTTCCAC

301 GGCAACCTCC TCTTCTACCT CACCGTCGGC ACGGCAAGCG CACTGGCCGG

351 CTGGGCGGCG GTCGGCAAAA ACGGCTACGT CCCTATGCTG GCAGGGCTGA

401 CGATGTGTAT GCTCATCGGC GACAACGGCA GCGAATGGCT CGACAGCGGA

451 CTCATGCGCG CCATGAACGT CCTCATCGGC GCGGCCATCG CCATCGCCGC

501 CGCCAAACTG CTGCCGCTGA AATCCACACT GATGTGGCGT TTCATGCTTG

551 CCGACAACCT GGCCGACTGC AGCAAAATGA TTGCCGAAAT CAGCAACGGC

601 AGGCGCATGA CCCGCGAACG CCTCGAGGAG AACATGGCGA AAATGCGCCA

651 AATCAACGCA CGCATGGTCA AAAGCCGCAG CCATCTCGCC GCCACATCGG

701 GCGAAAGCCG CATCAGCCCC GCCATGATGG AAGCCATGCA GCACGCCCAC

751 CGTAAAATCG TCAACACCAC CGAGCTGCTC CTGACCACCG CCGCCAAGCT

801 GCAATCTCCC AAACTCAACG GCAGCGAAAT CCGGCTGCTT GACCGCCACT

851 TCACACTGCT CCAAACCGAC CTGCAACAAA CCGTCGCCCT TATCAACGGC

901 AGACACGCCC GCCGCATCCG CATCGACACC GCCATCAACC CCGAACTGGA

951 AGCCCTCGCC GAACACCTCC ACTACCAATG GCAGGGCTTC CTCTGGCTCA

1001 GCACCAATAT GCGTCAGGAA ATTTCCGCCC TCGTCATCCT GCTGCAACGC
```

-continued
```
1051 ACCCGCCGCA AATGGCTGGA TGCCCACGAA CGCCAACACC TGCGCCAAAG

1101 CCTGCTTGAA ACACGGGAAC ACGGCTGA
```

This corresponds to the amino acid sequence <SEQ ID 2366; ORF 706>:

```
m706.pep

1  MNTSQRNRLV SRWLNSYERY RYRRLIHAVR LGGAVLFATA SARLLHLQHG

51  EWIGMTVFVV LGMLQFQGAI YSKAVERMLG TVIGLGAGLG VLWLNQHYFH

101  GNLLFYLTVG TASALAGWAA VGKNGYVPML AGLTMCMLIG DNGSEWLDSG

151  LMRAMNVLIG AAIAIAAAKL LPLKSTLMWR FMLADNLADC SKMIAEISNG

201  RRMTRERLEE NMAKMRQINA RMVKSRSHLA ATSGESRISP AMMEAMQHAH

251  RKIVNTTELL LTTAAKLQSP KLNGSEIRLL DRHFTLLQTD LQQTVALING

301  RHARRIRIDT AINPELEALA EHLHYQWQGF LWLSTNMRQE ISALVILLQR

351  TRRKWLDAHE RQHLRQSLLE TREHG* m706/g706  96.5%  identity in 375 aa overlap 10         20         30         40         50         60
m706.pep   MNTSQRNRLVSRWLNSYERYRYRRLIHAVRLGGAVLFATASARLLHLQHGEWIGMTVFVV
           ||:|||:||  :|||||||||:||||||||||:||||| ||||||||||||||||||||
g706       MNSSQRKRLSGRWLNSYERYRHRRLIHAVRLGGTVLFATALARLLHLQHGEWIGMTVFVV
                 10         20         30         40         50         60

70         80         90        100        110        120
m706.pep   LGMLQFQGAIYSKAVERMLGTVIGLGAGLGVLWLNQHYFHGNLLFYLTVGTASALAGWAA
           |||||||||||:||||||||||||||||||||||||||||||||||||:|||||||||||
g706       LGMLQFQGAIYSNAVERMLGTVIGLGAGLGVLWLNQHYFHGNLLFYLTIGTASALAGWAA
                 70         80         90        100        110        120

130        140        150        160        170        180
m706.pep   VGKNGYVPMLAGLTMCMLIGDNGSEWLDSGLMRAMNVLIGAAIAIAAAKLLPLKSTLMWR
           ||||||||||||||||||||||||||||||||||||||||||||||||||||||||||||
g706       VGKNGYVPMLAGLTMCMLIGDNGSEWLDSGLMRAMNVLIGAAIAIAAAKLLPLKSTLMWR
                130        140        150        160        170        180

190        200        210        220        230        240
m706.pep   FMLADNLADCSKMIAEISNGRRMTRERLEENMAKMRQINARMVKSRSHLAATSGESRISP
           ||||||||||||||||||||||||||||||:||:|||||||||||||||||||||||||
g706       FMLADNLADCSKMIAEISNGRRMTRERLEQNMVKMRQINARMVKSRSHLAATSGESRISP
                190        200        210        220        230        240

250        260        270        280        290        300
m706.pep   AMMEAMQHAHRKIVNTTELLLTTAAKLQSPKLNGSEIRLLDRHFTLLQTDLQQTVALING
           :|||||||||||||||||||||||||||||||||||||||||||||||||||||:||||
g706       SMMEAMQHAHRKIVNTTELLLTTAAKLQSPKLNGSEIRLLDRHFTLLQTDLQQTAALING
                250        260        270        280        290        300

310        320        330        340        350        360
m706.pep   RHARRIRIDTAINPELEALAEHLHYQWQGFLWLSTNMRQEISALVILLQRTRRKWLDAHE
           ||||||||||||||||||||||||||||||||||||||||||||||||||||||||||||
g706       RHARRIRIDTAINPELEALAEHLHYQWQGFLWLSTNMRQEISALVILLQRTRRKWLDAHE
                310        320        330        340        350        360

370
m706.pep   RQHLRQSLLETREHGX
           ||||||||||||||||
g706       RQHLRQSLLETREHGX
                370
```

The following partial DNA sequence was identified in *N. meningitidis* <SEQ ID 2367>:

```
a706.seq
     1  ATGAACACCT CGCAACGCAA CCGCCTCGTC AGCCGCTGGC TCAACTCCTA

51  CGAACGCTAC CGCTACCGCC GCCTCATCCA CGCCGTCCGG CTCGGCGGGG

101  CCGTCCTGTT CGCCACCGCC TCCGCCCGGC TGCTCCACCT CCAACACGGC

151  GAGTGGATAG GGATGACCGT CTTCGTCGTC CTCGGCATGC TCCAGTTTCA
```

-continued

```
 201 AGGGGCGATT TACTCCAAGG CGGTGGAACG TATGCTCGGC ACGGTCATCG

251 GGCTGGGCGC GGGTTTGGGC GTTTTATGGC TGAACCAGCA TTATTTCCAC

301 GGCAACCTCC TCTTCTACCT CACCGTCGGC ACGGCAAGCG CACTGGCCGG

351 CTGGGCGGCG GTCGGCAAAA ACGGCTACGT CCCTATGCTG GCGGGGCTGA

401 CGATGTGCAT GCTCATCGGC GACAACGGCA GCGAATGGTT CGACAGCGGC

451 CTGATGCGCG CGATGAACGT CCTCATCGGC GCGGCCATCG CCATCGCCGC

501 CGCCAAACTG CTGCCGCTGA AATCCACACT GATGTGGCGT TTCATGCTTG

551 CCGACAACCT GACCGACTGC AGCAAAATGA TTGCCGAAAT CAGCAACGGC

601 AGGCGCATGA CCCGCGAACG CCTCGAAGAG AACATGGCGA AAATGCGCCA

651 AATCAACGCA CGCATGGTCA AAAGCCGCAG CCACCTCGCC GCCACATCGG

701 GCGAAAGCCG CATCAGCCCC GCCATGATGG AAGCCATGCA GCACGCCCAC

751 CGTAAAATTG TCAACACCAC CGAGCTGCTC CTGACCACCG CCGCCAAGCT

801 GCAATCTCCC AAACTCAACG GCAGCGAAAT CCGGCTGCTT GACCGCCACT

851 TCACACTGCT CCAAACCGAC CTGCAACAAA CCGTCGCCCT TATCAACGGC

901 AGACACGCCC GCCGCATCCG CATCGACACC GCCATCAACC CCGAACTGGA

951 AGCCCTCGCC GAACACCTCC ACTACCAATG GCAGGGCTTC CTCTGGCTCA

1001 GCACCAATAT GCGTCAGGAA ATTTCCGCCC TCGTCATCCT GCTGCAACGC

1051 ACCCGCCGCA AATGGCTGGA TGCCCACGAA CGCCAACACC TGCGCCAAAG

1101 CCTGCTTGAA ACACGGGAAC ACAGTTGA
```

This corresponds to the amino acid sequence <SEQ ID 2368; ORF 706.a>:

```
a706.pep
  1 MNTSQRNRLV SRWLNSYERY RYRRLIHAVR LGGAVLFATA SARLLHLQHG

51 EWIGMTVFVV LGMLQFQGAI YSKAVERMLG TVIGLGAGLG VLWLNQHYFH

101 GNLLFYLTVG TASALAGWAA VGKNGYVPML AGLTMCMLIG DNGSEWFDSG

151 LMRAMNVLIG AAIAIAAAKL LPLKSTLMWR FMLADNLTDC SKMIAEISNG

201 RRMTRERLEE NMAKMRQINA RMVKSRSHLA ATSGESRISP AMMEAMQHAH

251 RKIVNTTELL LTTAAKLQSP KLNGSEIRLL DRHFTLLQTD LQQTVALING

301 RHARRIRIDT AINPELEALA EHLHYQWQGF LWLSTNMRQE ISALVILLQR

351 TRRKWLDAHE RQHLRQSLLE TREHS*
``` a706/m706 99.5% identity in 374 aa overlap

```
                 10         20         30         40         50         60
   a706.pep  MNTSQRNRLVSRWLNSYERYRYRRLIHAVRLGGAVLFATASARLLHLQHGEWIGMTVFVV
             ||||||||||||||||||||||||||||||||||||||||||||||||||||||||||||
   m706      MNTSQRNRLVSRWLNSYERYRYRRLIHAVRLGGAVLFATASARLLHLQHGEWIGMTVFVV
                 10         20         30         40         50         60

70         80         90        100        110        120
   a706.pep  LGMLQFQGAIYSKAVERMLGTVIGLGAGLGVLWLNQHYFHGNLLFYLTVGTASALAGWAA
             ||||||||||||||||||||||||||||||||||||||||||||||||||||||||||||
   m706      LGMLQFQGAIYSKAVERMLGTVIGLGAGLGVLWLNQHYFHGNLLFYLTVGTASALAGWAA
                 70         80         90        100        110        120
```

-continued

```
              130       140       150       160       170       180
a706.pep  VGKNGYVPMLAGLTMCMLIGDNGSEWFDSGLMRAMNVLIGAAIAIAAAKLLPLKSTLMWR
          ||||||||||||||||||||||||||:|||||||||||||||||||||||||||||||||
m706      VGKNGYVPMLAGLTMCMLIGDNGSEWLDSGLMRAMNVLIGAAIAIAAAKLLPLKSTLMWR
              130       140       150       160       170       180

190       200       210       220       230       240
a706.pep  FMLADNLTDCSKMIAEISNGRRMTRERLEENMAKMRQINARMVKSRSHLAATSGESRISP
          |||||||:||||||||||||||||||||||||||||||||||||||||||||||||||||
m706      FMLADNLADCSKMIAEISNGRRMTRERLEENMAKMRQINARMVKSRSHLAATSGESRISP
              190       200       210       220       230       240

250       260       270       280       290       300
a706.pep  AMMEAMQHAHRKIVNTTELLLTTAAKLQSPKLNGSEIRLLDRHFTLLQTDLQQTVALING
          ||||||||||||||||||||||||||||||||||||||||||||||||||||||||||||
m706      AMMEAMQHAHRKIVNTTELLLTTAAKLQSPKLNGSEIRLLDRHFTLLQTDLQQTVALING
              250       260       270       280       290       300

310       320       330       340       350       360
a706.pep  RHARRIRIDTAINPELEALAEHLHYQWQGFLWLSTNMRQEISALVILLQRTRRKWLDAHE
          ||||||||||||||||||||||||||||||||||||||||||||||||||||||||||||
m706      RHARRIRIDTAINPELEALAEHLHYQWQGFLWLSTNMRQEISALVILLQRTRRKWLDAHE
              310       320       330       340       350       360

370
a706.pep  RQHLRQSLLETREHSX
          ||||||||||||||:
m706      RQHLRQSLLETREHGX
              370 g704.seq  not found g707.pep  not found
```

The following partial DNA sequence was identified in *N. meningitidis* <SEQ ID 2369>:

```
m707.seq
     1  ATGGAAATTA TTAACGATGC AGAACTTATC CGTTCCATGC AGCGTCAGCA

51  GCACATAGAT GCTGAATTGT TAACTGATGC AAATGTCCGT TTCGAGCAAC

101  CATTGGAGAA GAACAATTAT GTCCTGAGTG AAGATGAAAC ACCGTGTACT

151  CGGGTAAATT ACATTAGTTT AGATGATAAG ACGGTGCGCA AATTTTCTTT

201  TCTTCCTTCT GTGCTCATGA AAGAAACAGC TTTTAAAACT GGGATGTGTT

251  TAGGTTCCAA TAATTTGAGC AGGCTACAAA AAGCCGCGCA ACAGATACTG

301  ATCGTGCGTG GCTACCTCAC TTCCCAAGCT ATTATCCAAC CACAGAATAT

351  GGATTCGGGA ATTCTGAAAT TACGGGTATC AGCAGGCGAA ATAGGGGATA

401  TCCGCTATGA AGAAAAACGG GATGGGAAGT CTGCCGAGGG CAGTATTAGT

451  GCATTCAATA ACAAATTTCC CTTATATAGG AACAAAATTC TCAATCTTCG

501  CGATGTAGAG CAGGGCTTGG AAAACCTGCG TCGTTTGCCG AGTGTTAAAA

551  CAGATATTCA GATTATACCG TCCGAAGAAG AAGGCAAAAG CGATTTACAG

601  ATCAAATGGC AGCAGAATAA ACCCATACGG TTCAGTATCG GTATAGATGA

651  TGCGGGCGGC AAAACGACCG GCAAATATCA AGGAAATGTC GCTTTATCGT

701  TCGATAACCC TTTGGGCTTA AGCGATTTGT TTTATGTTTC ATATGGACGC

751  GGTTTGGCGC ACAAAAACGG ACTTGACTGAT GCCACCGGTA CGGAAACTGA

801  AAGCGGATCC AGAAGTTACA GCGTGCATTA TTCGGTGCCC GTAAAAAAAT

851  GGCTGTTTTC TTTTAATCAC AATGGACATC GTTACCACGA AGCAACCGAA

901  GGCTATTCCG TCAATTACGA TTACAACGGC AAACAATATC AGAGCAGCCT

951  GGCCGCCGAG CGCATGCTTT GGCGTAACAG ACTTCATAAA ACTTCAGTCG

1001  GAATGAAATT ATGGACACGC CAAACCTATA AATACATCGA CGATGCCGAA
```

-continued

```
1051 ATCGAAGTAC AACGCCGCCG CTCTGCAGGC TGGGAAGCCG AATTGCGCCA

1101 CCGTGCTTAC CTCAACCGTT GGCAGCTTGA CGGCAAGTTG TCTTACAAAC

1151 GCGGGACCGG CATGCGCCAA AGTATGCCTG CACCGGAAGA AAACGGCGGC

1201 GATATTCTTC CAGGTACATC TCGTATGAAA ATCATTACTG CCAGTTTGGA

1251 CGCAGCCGCC CCATTTATTT TAGGCAAACA GCAGTTTTTC TACGCAACCG

1301 CCATTCAAGC TCAATGGAAC AAAACGCCGT TGGTTGCCCA AGATAAATTG

1351 TCAATCGGCA GCCGCTACAC CGTTCGCGGA TTTGATGGGG AGCAGAGTCT

1401 TTTCGGAGAG CGAGGTTTCT ACTGGCAGAA TACTTTAACT TGGTATTTTC

1451 ATCCGAACCA TCAGTTCTAT CTCGGTGCGG ACTATGGCCG CGTATCTGGC

1501 GAAAGTGCAC AATATGTATC GGGCAAGCAG CTGATGGGTG CAGTGGTCGG

1551 CTTCAGAGGA GGGCATAAAG TAGGCGGTAT GTTTGCTTAT GATCTGTTTG

1601 CCGGCAAGCC GCTTCATAAA CCCAAAGGCT TTCAGACGAC CAACACCGTT

1651 TACGGCTTCA ACTTGAATTA CAGTTTCTAA
```

This corresponds to the amino acid sequence <SEQ ID 2370; ORF 707>:

```
m707.pep
   1 MEIINDAELI RSMQRQQHID AELLTDANVR FEQPLEKNNY VLSEDETPCT

51 RVNYISLDDK TVRKFSFLPS VLMKETAFKT GMCLGSNNLS RLQKAAQQIL

101 IVRGYLTSQA IIQPQNMDSG ILKLRVSAGE IGDIRYEEKR DGKSAEGSIS

151 AFNNKFPLYR NKILNLRDVE QGLENLRRLP SVKTDIQIIP SEEEGKSDLQ

201 IKWQQNKPIR FSIGIDDAGG KTTGKYQGNV ALSFDNPLGL SDLFYVSYGR

251 GLAHKTDLTD ATGTETESGS RSYSVHYSVP VKKWLFSFNH NGHRYHEATE

301 GYSVNYDYNG KQYQSSLAAE RMLWRNRLHK TSVGMKLWTR QTYKYIDDAE

351 IEVQRRRSAG WEAELRHRAY LNRWQLDGKL SYKRGTGMRQ SMPAPEENGG

401 DILPGTSRMK IITASLDAAA PFILGKQQFF YATAIQAQWN KTPLVAQDKL

451 SIGSRYTVRG FDGEQSLFGE RGFYWQNTLT WYFHPNHQFY LGADYGRVSG

501 ESAQYVSGKQ LMGAVVGFRG GHKVGGMFAY DLFAGKPLHK PKGFQTTNTV

551 YGFNLNYSF*
```

The following partial DNA sequence was identified in *N. meningitidis* <SEQ ID 2371>:

```
a707.seq
   1 NTGAAAGAAA CAGCTTTTAA AACTGGGATG TGTTTAGGTT CCAATAATTT

51 GAGCAGGCTA CAAAAAGCCG CGCAACAGAT ACTGATTGTG CGTGGCTACC

101 TCACTTCCCA AGCTATTATC CAACCACAGA ATATGGATTC GGGAATTCTG

151 AAATTACGGG TATCAGCAGG CGAAATAGGN GATATCCGCT ATGAAGAAAA

201 ACGGGATGNG AAGTCTGCCG AGGGCAGTAT TAGTGCATTC AATAACAAAN

251 TTCCCTTATA TAGGAACAAA ATTCTCAATC TTCGCGATGT AGAGCAGGGC

301 TTGGAAAACC TGCGTCGTTT GCCGAGTGTT AAAACAGATA TTCAGATTAT

351 ACCGTCCGAA GAAGAAGGCA AAAGCGATTT ACAGATCAAA TGGCAGCAGA

401 ATAAACCCAT ACGGTTCAGT ATCGGTATAG ATGATGCGGG CGGCAAAACG
```

```
 451 ACCGGCAAAT ATCAAGGAAA TGTCGCTTTA TCGTNCGATA ACCCTTTGGG

501 NTTAAGCGAT TNGTTTTATG TTTCATATGG ACGCGGTTTG GTGCACAAAA

551 CGGACTTGAC TGNTGCCACC GGTACGGAAA CTGAAAGCGG ATCCAGAAGT

601 TACAGCGTGC ATTATTCGGT GNNCGTAAAA AAATGGCTGT TTTCTTTTAA

651 TCACAATGGA CATCGTTACC ACGAAGCAAC CGAAGGCTAT TCCGTCAATT

701 ACGATTACAA CGGCAAACAA TATCAGAGCA GCCTGGCCGC CGAGCGCATG

751 CTTTGGNNNN NNAGNTTTCN TNAAACTTCA GTCNGAATGA AATTATGGAC

801 ACGCCAAACC TATAAATACA TCGACGATGC CGAAATCGAA GTGCAACGCC

851 GCCGCTCTGC AGGCTGGGAA GCCGAATTGC GCCACCGTGC TTACCTCNAC

901 CGTTGGCAGC TTGACGGCAA GTTGTCTTAC AAACGCGGGA CCGGCATGCG

951 CCAAAGTATG CCCGCACCTG AAGAAAACGG CGGCGGTACT ATTCCAGNCA

1001 NATCCCGTAT GAAAATCATA ACCGCCGGAT TGGATGCAGC GGCCCCGTNT

1051 ATGTTGGGCA ACAGCAGTT TTTCTACGCA ACCGCCATTC AAGCTCAATG

1101 GAACAAAACG CCTTTGGTTG CCCAAGACAA GTTGTCTATC GGCAGCCGCT

1151 ACACCGTTCG CGGATTTGAT GGGGAGCAGA GTCTTTTCGG AGAGCGAGGT

1201 TTCTACTGGC AGAATACTTT AACTTGGTAT TTTCATCCGA ACCATCAGTT

1251 CTATCTCGGT GCGGACTATG GCCGCGTATC TGGCGAAAGT GCACAATATG

1301 TATCGGGCAA GCAGCTGATG GGTGCAGTGG TCGGCTTCAG AGGAGGGCAT

1351 AAAGTAGGCG GTATGTTTGC TTATGATCTG TTTGCCGGCA AGCCGCTTCA

1401 TAAACCCAAA GGCTTTCAGA CGACCAACAC CGTTTACGGC TTCAACTTGA

1451 ATTACAGTTT CTAA
```

This corresponds to the amino acid sequence <SEQ ID 2372; ORF 707.a>:

```
a707.pep
  1 XKETAFKTGM CLGSNNLSRL QKAAQQILIV RGYLTSQAII QPQNMDSGIL

51 KLRVSAGEIG DIRYEEKRDX KSAEGSISAF NNKXPLYRNK ILNLRDVEQG

101 LENLRRLPSV KTDIQIIPSE EEGKSDLQIK WQQNKPIRFS IGIDDAGGKT

151 TGKYQGNVAL SXDNPLGLSD XFYVSYGRGL VHKTDLTXAT GTETESGSRS

201 YSVHYSVXVK KWLFSFNHNG HRYHEATEGY SVNYDYNGKQ YQSSLAAERM

251 LWXXXFXXTS VXMKLWTRQT YKYIDDAEIE VQRRRSAGWE AELRHRAYLX

301 RWQLDGKLSY KRGTGMRQSM PAPEENGGGT IPXXSRMKII TAGLDAAAPX

351 MLGKQQFFYA TAIQAQWNKT PLVAQDKLSI GSRYTVRGFD GEQSLFGERG

401 FYWQNTLTWY FHPNHQFYLG ADYGRVSGES AQYVSGKQLM GAVVGFRGGH

451 KVGGMFAYDL FAGKPLHKPK GFQTTNTVYG FNLNYSF*
``` a707/m707 95.3% identity in 486 aa overlap

```
                            10         20         30
    a707.pep                XKETAFKTGMCLGSNNLSRLQKAAQQILIVR
                            ||||||||||||||||||||||||||||||
    m707        EDETPCTRVNYISLDDKTVRKFSFLPSVLMKETAFKTGMCLGSNNLSRLQKAAQQILIVR
                    50         60         70         80         90        100
```

```
                  40         50         60         70         80         90
a707.pep  GYLTSQAIIQPQNMDSGILKLRVSAGEIGDIRYEEKRDXKSAEGSISAFNNKXPLYRNKI
          ||||||||||||||||||||||||||||||||||| ||||||||||||| |||||||
m707      GYLTSQAIIQPQNMDSGILKLRVSAGEIGDIRYEEKRDGKSAEGSISAFNNKFPLYRNKI
                 110        120        130        140        150        160

100        110        120        130        140        150
a707.pep  LNLRDVEQGLENLRRLPSVKTDIQIIPSEEEGKSDLQIKWQQNKPIRFSIGIDDAGGKTT
          ||||||||||||||||||||||||||||||||||||||||||||||||||||||||||||
m707      LNLRDVEQGLENLRRLPSVKTDIQIIPSEEEGKSDLQIKWQQNKPIRFSIGIDDAGGKTT
                 170        180        190        200        210        220

160        170        180        190        200        210
a707.pep  GKYQGNVALSXDNPLGLSDXFYVSYGRGLVHKTDLTXATGTETESGSRSYSVHYSVXKK
          |||||||||| ||||||||| ||||||||| ||||| ||||||||||||||||| ||
m707      GKYQGNVALSFDNPLGLSDLFYVSYGRGLAHKTDLTDATGTETESGSRSYSVHYSVPVKK
                 230        240        250        260        270        280

220        230        240        250        260        270
A707.pep  WLFSFNHNGHRYHEATEGYSVNYDYNGKQYQSSLAAERMLWXXXFXXTSVXMKLWTRQTY
          ||||||||||||||||||||||||||||||||||||||||   :   ||| ||||||||
m707      WLFSFNHNGHRYHEATEGYSVNYDYNGKQYQSSLAAERMLWRNRLHKTSVGMKLWTRQTY
                 290        300        310        320        330        340

280        290        300        310        320        330
a707.pep  KYIDDAEIEVQRRRSAGWEAELRHRAYLXRWQLDGKLSYKRGTGMRQSMPAPEENGGGTI
          |||||||||||||||||||||||||||| |||||||||||||||||||||||||||| :
m707      KYIDDAEIEVQRRRSAGWEAELRHRAYLNRWQLDGKLSYKRGTGMRQSMPAPEENGGDIL
                 350        360        370        380        390        400

340        350        360        370        380        390
a707.pep  PXXSRMKIITAGLDAAAPXMLGKQQFFYATAIQAQWNKTPLVAQDKLSIGSRYTVRGFDG
          | :||||||||||||:|||||||||||||||||||||||||||||||||||||||||||
m707      PGTSRMKIITASLDAAAPFILGKQQFFYATAIQAQWNKTPLVAQDKLSIGSRYTVRGFDG
                 410        420        430        440        450        460

400        410        420        430        440        450
a707.pep  EQSLFGERGFYWQNTLTWYFHPNHQFYLGADYGRVSGESAQYVSGKQLMGAVVGFRGGHK
          ||||||||||||||||||||||||||||||||||||||||||||||||||||||||||||
m707      EQSLFGERGFYWQNTLTWYFHPNHQFYLGADYGRVSGESAQYVSGKQLMGAVVGFRGGHK
                 470        480        490        500        510        520

460        470        480
a707.pep  VGGMFAYDLFAGKPLHKPKGFQTTNTVYGFNLNYSFX
          ||||||||||||||||||||||||||||||||||||
m707      VGGMFAYDLFAGKPLHKPKGFQTTNTVYGFNLNYSFX
                 530        540        550        560
```

The following partial DNA sequence was identified in *N. gonorrhoeae* <SEQ ID 2373>:

```
g708.seq
  1 ATGCCTTTTA AGCCATCCAA ACGAATCTCT TTATTACTTG TTCTTGCCTT

51 GGGCGCGTGC AGCACTTCCT ACCGCCCCTC GCGGGCAGAA AAAGCCAATC

101 AGGTTTCCAA TATCAAAACC CAGTTGGCGA TGGAATATAT GCGCGGTCAG

151 GACTACCGTC AGGCAACGGC AAGTATTGAA GATGCCTTGA AATCGAACCC

201 TAAAAACGAA CTTGCCTGGC TGGTCCGTGC CGAAATCTAT CAATACCTGA

251 AAGTTAACGA CAAGGCGCAG GAAAGTTTCC GGCAAGCCCT CTCCATCAAA

301 CCCGACAGTG CCGAAATCAA CAACAACTAC GGCTGGTTCC TGTGCGGCAG

351 GCTCAACCGC CCTGCCGAAT CTATGGCATA TTTCGACAAA GCCCTGGCCG

401 ACCCCACCTA CCCGACCCCT TATATTGCCA ACCTGAATAA AGGTATATGC

451 AGCGCAAAAC AGGGGCAATT CGGATTGGCG GAAGCCTATT TGAAACGTTC

501 CCTCGCCGCC CAGCCGCAGT TCCCACCCGC ATTTAAAGAA CTGGCGCGCA

551 CCAAAATGCT GGCCGGGCAG TTGGGCGATG CCGATTACTA CTTTAAAAAA

601 TACCAAAGCA GGGTAGAAGT CCTTCAGGCC GATGATTTGC TGCTAGGCTG

651 GAAAATTGCC AAAGCCCTCG GCAACGTGCA GGCGGCATAC GAATATGAAG
```

-continued
```
701 CACAATTGCA GGCAAATTTC CCCTACTCGG AAGAATTGCA AACCGTCCTC

751 ACCGGTCAAT AA
```

This corresponds to the amino acid sequence <SEQ ID 2374; ORF 708.ng>:

```
g708.pep
  1 MPFKPSKRIS LLLVLALGAC STSYRPSRAE KANQVSNIKT QLAMEYMRGQ

51 DYRQATASIE DALKSNPKNE LAWLVRAEIY QYLKVNDKAQ ESFRQALSIK

101 PDSAEINNNY GWFLCGRLNR PAESMAYFDK ALADPTYPTP YIANLNKGIC

151 SAKQGQFGLA EAYLKRSLAA QPQFPPAFKE LARTKMLAGQ LGDADYYFKK

201 YQSRVEVLQA DDLLLGWKIA KALGNVQAAY EYEAQLQANF PYSEELQTVL

251 TGQ*
```

The following partial DNA sequence was identified in *N. meningitidis* <SEQ ID 2375>:

```
m708.seq
  1 ATGCCTTTTA AGCCATCCAA ACGAATCTCT TTATTACTCG TTCTTGCCTT

51 GGGCGCGTGC AGCACTTCCT ACCGCCCCTC GCGGGCAGAA AAAGCCAATC

101 AGGTTTCCAA TATCAAAACC CAGTTGGCAA TGGAATATAT GCGCGGTCAG

151 GACTACCGTC AGGCGACGGC AAGTATTGAA GACGCCCTGA AATCGGACCC

201 TAAAAACGAG CTTGCCTGGC TGGTCCGTGC CGAAATCTAT CAATACCTGA

251 AAGTTAACGA CAAGGCGCAG GAAAGTTTCC GGCAAGCCCT CTCCATCAAA

301 CCCGACAGTG CCGAAATCAA CAACAACTAC GGTTGGTTCC TATGCGGCAG

351 GCTCAACCGC CCTGCCGAAT CTATGGCATA TTTCGACAAA GCTCTGGCCG

401 ACCCCACCTA CCCGACCCCT TATATTGCCA ACCTGAATAA AGGCATATGC

451 AGCGCAAAAC AGGGGCAATT CGGATTGGCG GAAGCCTATT TGAAACGTTC

501 CCTCGCCGCC CAGCCGCAGT TCCCACCCGC ATTTAAAGAA CTGGCGCGCA

551 CCAAAATGCT GGCCGGGCAG TTGGGCGATG CCGATTACTA CTTTAAAAAA

601 TACCAAAGCA GGGTAGAAGT CCTTCAGGCC GATGATTTGC TGCTAGGCTG

651 GAAAATTGCC AAAGCCCTCG GCAACGCACA GGCGGCATAC GAATATGAAG

701 CACAATTGCA GGCGAATTTC CCCTACTCGG AAGAATTGCA AACCGTCCTC

751 ACCGGTCAAT AA
```

This corresponds to the amino acid sequence <SEQ ID 2376; ORF 708>:

```
m708.pep
      1 MPFKPSKRIS LLLVLALGAC STSYRPSRAE KANQVSNIKT QLAMEYMRGQ

51 DYRQATASIE DALKSDPKNE LAWLVRAEIY QYLKVNDKAQ ESFRQALSIK

101 PDSAEINNNY GWFLCGRLNR PAESMAYFDK ALADPTYPTP YIANLNKGIC

151 SAKQGQFGLA EAYLKRSLAA QPQFPPAFKE LARTKMLAGQ LGDADYYFKK

201 YQSRVEVLQA DDLLLGWKIA KALGNAQAAY EYEAQLQANF PYSEELQTVL

251 TGQ* m708/g708  99.2% identity in 253 aa overlap
```

-continued

```
                 10        20        30        40        50        60
m708.pep    MPFKPSKRISLLLVLALGACSTSYRPSRAEKANQVSNIKTQLAMEYMRGQDYRQATASIE
            ||||||||||||||||||||||||||||||||||||||||||||||||||||||||||||
g708        MPFKPSKRISLLLVLALGACSTSYRPSRAEKANQVSNIKTQLAMEYMRGQDYRQATASIE
                 10        20        30        40        50        60

70        80        90       100       110       120
m708.pep    DALKSDPKNELAWLVRAEIYQYLKVNDKAQESFRQALSIKPDSAEINNNYGWFLCGRLNR
            |||||:||||||||||||||||||||||||||||||||||||||||||||||||||||||
g708        DALKSNPKNELAWLVRAEIYQYLKVNDKAQESFRQALSIKPDSAEINNNYGWFLCGRLNR
                 70        80        90       100       110       120

130       140       150       160       170       180
m708.pep    PAESMAYFDKALADPTYPTPYIANLNKGICSAKQGQFGLAEAYLKRSLAAQPQFPPAFKE
            ||||||||||||||||||||||||||||||||||||||||||||||||||||||||||||
g708        PAESMAYFDKALADPTYPTPYIANLNKGICSAKQGQFGLAEAYLKRSLAAQPQFPPAFKE
                130       140       150       160       170       180

190       200       210       220       230       240
m708.pep    LARTKMLAGQLGDADYYFKKYQSRVEVLQADDLLLGWKIAKALGNAQAAYEYEAQLQANF
            ||||||||||||||||||||||||||||||||||||||||||||:|||||||||||||||
g708        LARTKMLAGQLGDADYYFKKYQSRVEVLQADDLLLGWKIAKALGNVQAAYEYEAQLQANF
                190       200       210       220       230       240

250
m708.pep    PYSEELQTVLTGQX
            ||||||||||||||
g708        PYSEELQTVLTGQX
                250
```

The following partial DNA sequence was identified in *N. meningitidis* <SEQ ID 2377>:

```
a708.seq
   1 ATGCCTTTTA AGCCATCCAA ACGAATCTCT TTATTACTTG TCCTTGCCTT

51 GGGCGCGTGC AGCACTTCCT ACCGCCCCTC GCGGGCAGAA AAAGCCAATC

101 AGGTTTCCAA TATCAAAACC CAGTTGGCAA TGGAATATAT GCGCGGTCAG

151 GACTACCGTC AGGNGACGGC AAGTATTGAA GACGCCTTGA AATCAGACCC

201 TAAAAACGAG CTTGCCTGGC TGGTCCGTGC CGAAATCTAT CAATACCTGA

251 AAGTTAACGA CAAGGCGCAG GAAAGTTTCC GGCAAGNCCT CTCCATCAAA

301 CCCGACAGTG CCGAAATCAA CAACAACTAC NGCTGGTTCC TGTGCGGCAG

351 GCTCAACCGC CCTGCCGAAT CTATGGCATA TTTCGACAAA GCCCTGGCCG

401 ACCCCACNTA CCCGANCCCT TATATTGCCA ACCTGAATAA AGGCATATGC

451 AGCGCAAAAC AGGGGCAATT CGGATTGGCG GAAGCCTATT TGAAACGTTC

501 CCTCGCCGCC CAGCCGCAGT TCCCACCCGC ATTTAAAGAA CTGGCGCGCA

551 CCAAAATGCT GGCCGGGCAG TTGGGCGATG CCGATTACTA CTTTAAAAAA

601 TACCAAAGCA GGGTAGAAGT CCTTCAGGCC GATGATTTGC TGCTAGGCTG

651 GAAAATTGCC AAAGCCCTCG GCAACGCACA GGCGGCATAC GAATATGAAG

701 CACAATTGCA GGCGAATTTC CCCTACTCGG AAGAATTGCA AACCGTCCTC

751 ATCGGTCAAT AA
```

This corresponds to the amino acid sequence <SEQ ID 2378; ORF 708.a>:

```
a708.pep
   1 MPFKPSKRIS LLLVLALGAC STSYRPSRAE KANQVSNIKT QLAMEYMRGQ

51 DYRQXTASIE DALKSDPKNE LAWLVRAEIY QYLKVNDKAQ ESFRQXLSIK

101 PDSAEINNNY XWFLCGRLNR PAESMAYFDK ALADPTYPXP YIANLNKGIC

151 SAKQGQFGLA EAYLKRSLAA QPQFPPAFKE LARTKMLAGQ LGDADYYFKK
```

```
201 YQSRVEVLQA DDLLLGWKIA KALGNAQAAY EYEAQLQANF PYSEELQTVL

251 IGQ*
``` a708/m708 98.0% identity in 253 aa overlap

```
                  10         20         30         40         50         60
a708.pep  MPFKPSKRISLLLVLALGACSTSYRPSRAEKANQVSNIKTQLAMEYMRGQDYRQXTASIE
          ||||||||||||||||||||||||||||||||||||||||||||||||||||| |||||
m708      MPFKPSKRISLLLVLALGACSTSYRPSRAEKANQVSNIKTQLAMEYMRGQDYRQATASIE
                  10         20         30         40         50         60

70         80         90        100        110        120
a708.pep  DALKSDPKNELAWLVRAEIYQYLKVNDKAQESFRQXLSIKPDSAEINNNYXWFLCGRLNR
          ||||||||||||||||||||||||||||||||||| |||||||||||||||| |||||||
m708      DALKSDPKNELAWLVRAEIYQYLKVNDKAQESFRQALSIKPDSAEINNNYGWFLCGRLNR
                  70         80         90        100        110        120

130        140        150        160        170        180
a708.pep  PAESMAYFDKALADPTYPXPYIANLNKGICSAKQGQFGLAEAYLKRSLAAQPQFPPAFKE
          ||||||||||||||||| :|||||||||||||||||||||||||||||||||||||||||
m708      PAESMAYFDKALADPTYPTPYIANLNKGICSAKQGQFGLAEAYLKRSLAAQPQFPPAFKE
                 130        140        150        160        170        180

190        200        210        220        230        240
a708.pep  LARTKMLAGQLGDADYYFKKYQSRVEVLQADDLLLGWKIAKALGNAQAAYEYEAQLQANF
          ||||||||||||||||||||||||||||||||||||||||||||||||||||||||||||
m708      LARTKMLAGQLGDADYYFKKYQSRVEVLQADDLLLGWKIAKALGNAQAAYEYEAQLQANF
                 190        200        210        220        230        240

250
a708.pep  PYSEELQTVLIGQX
          |||||||||| |||
m708      PYSEELQTVLTGQX
                 250
```

The following partial DNA sequence was identified in *N. gonorrhoeae* <SEQ ID 2379>:

```
g709.seq
   1  ATGTTTGCTT TCAAATCCTT ACTCGATATG CCGCGCGGTG AGGCACTTGC

51  CGTCGTCGTC GCTCTGATTG CCGCAATGGG CTATACCATC ATTTCATTGG

101  AGTGGCTGCC GCATATGTCC ATTATTGCCG CCATCGTCGT GCTGATTTTG

151  TACGGCTTGG CGCGCGGTTT GAAATACAAC GATATGCAGG CAGGGATGAT

201  AGGCGCGTTG AATCAGGGTA TGGGCGCGGT TTACCTGTTT TTCTTCATCG

251  GGCTGATGGT CAGCGCGCTG ATGATGAGCG GCGCGATTCC GACGCTGATG

301  TATTACGGTT TCGGGCTGAT TTCCCCGACT TATTTTTATT TTTCCGCCTT

351  CGCGCTGTGT TCCGTCATCG GCGTGTCCAT CGGCAGCAGC CTGACCGCCT

401  GCGCCACTGT CGGCGTTGCC TTTATGGGGA TGGCGGCGGC GTTTCAGGCC

451  GATATGGCGA TGACGgcggg cgcgattgTT tccggTGTGT TTTTCGGCGA

501  TAAAATGTCC CCGCTTTCCG ACACCACGGG CATTTCCGCG TCCATCGTCG

551  GTATCGACCT GTTTGAACAC ATCAAAAACA TGATGTACAC CACCATCCCT

601  GCGTGGCTTA TCAGCGCGGC ACTGATGCTT GGCTTCTTC CCAGCGTCGC

651  CGCGCAGGAT TTGAACAGCG TCGAATCCTT CCGCAGCCAG CTTGAAGCCA

701  CGGGATTGGT GCACGGCTAT TCGCTGATTC CGTTTGCACT GTTGGTCGTT

751  TTGGCATTGA TGCGCGTCAA TGCCGTGGTC GCCATGCTCT TTACCGTCAT

801  TGCCGCCGTT GCCGTAACGT ATCTGCACAG CACGCCCGAT CTGCGTCAGC

851  TCGGCGCGTG GTTTTATGGC GGCTACAAAC TCGAAGGCGA AGCGTTTAAA
```

-continued

```
 901 GACATTGCCA AACTGATTTC GCGCGGCGGC TTGGAGAGTA TGTTCTTTAC
 951 GCAGACCATC GTTATCCTCG GTATGAGTTT GGGCGGGCTG CTGTTTGCGC
1001 TCGGTGTGAT TCCTTCCTTG CTGGAGGCCG TCCGTACCTT CTTGACGAAT

1051 GCCGGACGCG CGACGTTCAG CGTTGCCATG ACTTCGGTCG GGGTCAATTT

1101 CCTGATTGGA GAGCAATATT TGAGCATCCT GCTTTCGGGA GAAACGTTCA

1151 AACCCGTTTA CGACAAACTC GGCCTGCATT CGTGCAACCT GTCGCGGACT

1201 CTGGAAGATG CGGGGACGGT GATTAACCCG CTCGTGCCGT GGAGCGTGTG
1251 CGGCGTATTT ATCAGCCACG CCCTTGGCGT ACCCGTTTGG GAATATCTGC
1301 CTTATGCCTT TTTCTGCTAT TTGAGTTTGG CTTTAACCCT GTTATTCGGC

1351 TGGACGGGGC TGACTTTGAG CAAAAAATAA
```

This corresponds to the amino acid sequence <SEQ ID 2380; ORF 709.ng>:

```
g709.pep
  1 MFAFKSLLDM PRGEALAVVV ALIAAMGYTI ISLEWLPHMS IIAAIVVLIL
 51 YGLARGLKYN DMQAGMIGAL NQGMGAVYLF FFIGLMVSAL MMSGAIPTLM
101 YYGFGLISPT YFYFSAFALC SVIGVSIGSS LTACATVGVA FMGMAAAFQA

151 DMAMTAGAIV SGVFFGDKMS PLSDTTGISA SIVGIDLFEH IKNMMYTTIP

201 AWLISAALML WLLPSVAAQD LNSVESFRSQ LEATGLVHGY SLIPFALLVV

251 LALMRVNAVV AMLFTVIAAV AVTYLHSTPD LRQLGAWFYG GYKLEGEAFK

301 DIAKLISRGG LESMFFTQTI VILGMSLGGL LFALGVIPSL LEAVRTFLTN

351 AGRATFSVAM TSVGVNFLIG EQYLSILLSG ETFKPVYDKL GLHSCNLSRT

401 LEDAGTVINP LVPWSVCGVF ISHALGVPVW EYLPYAFFCY LSLALTLLFG

451 WTGLTLSKK*
```

The following partial DNA sequence was identified in *N. meningitidis* <SEQ ID 2381>:

```
m709.seq
  1 ATGTTCGCTT TCAAATCCTT ACTCGATATG CCGCGCGGTG AGGCACTTGC
 51 CGTCGTCGTC GCTCTGATTG CCGCGATGGG CTATACCATC ATTTCATTGG
101 AGTGGTTGCC GCATATGTCC ATTATTGCCG CCATCGTCGT GCTGATTTTG
151 TACGGCTTGG CGCGCGGTTT GAAATACAAC GATATGCAGC AGGGCATGAT
201 AGGCGCGTTG AATCAGGGTA TGGGCGCGAT TTACCTGTTT TTCTTCATCG
251 GGCTGATGGT CAGCGCGCTG ATGATGAGCG GCGCGATTCC GACGCTGATG
301 TATTACGGTT TCGGACTGAT TTCCCCGACT TATTTTTATT TTTCCTCCTT
351 CGCGCTGTGT TCCGTCATCG GCGTGTCCAT CGGCAGCAGC CTGACCACCT
401 GCGCCACTGT CGGCGTTGCC TTTATGGGGA TGGCGGCGGC GTTTCAGGCC
451 GATATGGCGA TGACGGCGGG CGCGATTGTT TCGGGCGCAT TTTTTGGCGA
501 CAAAATGTCC CCGCTTTCGG ATACGACGGG TATTTCCGCG TCCATCGTCG
551 GCATCGACTT GTTTGAGCAC ATCAAAAAATA TGATGTACAC CACCATCCCC
601 GCGTGGCTCA TTAGTGCGGC ACTGATGCTT TGGCTTTTGC CGAATGTCGC
651 CGCGCAGGAT TTGAACAGCG TCGAATCCTT CCGCAGCCAG CTTGAAGCCA
```

-continued

```
 701 CGGGATTGGT GCACGGCTAT TCGCTGATTC CGTTTGCGCT GTTGGTCATT
 751 TTGGCATTGA TGCGCATCAA CGCCGTCGTC GCCATGCTCT TACCGTCAT
 801 GGTTGCCGTT GCTGTAACGT ATCTGCACAG CACGCCCGAT CTGCGTCAGC
 851 TCGGTGCGTG GTTTTACGGC GGCTACAAAC TCGAAGGCGA AGCGTTTAAA
 901 GATGTTGTCA AACTGATTTC GCGCGGCGGT TTGGAAAGTA TGTTTTTCAC
 951 GCAAACCATC GTGATTCTCG GGATGAGTTT GGGCGGACTG TTGTTTGCGC
1001 TCGGTGTGAT TCCTTCCCTG TTGGAGGCCA TCCGTACCTT CTTGACGAAT
1051 GCCGGACGCG CGACGTTCAG CGTTGCCATG ACTTCGGTCG GGGTTAATTT
1101 CCTGATCGGC GAGCAATATT TGAGTATTTT GTTGTCGGGT GAAACGTTCA
1151 AACCCGTTTA CGATAAGCTC GGTCTGCATT CGCGCAATCT GTCGCGGACG
1201 CTGGAAGATG CGGGGACGGT GATTAACCCG CTCGTACCGT GGAGCGTATG
1251 CGGCGTGTTC ATCAGCCACG CGCTGGGCGT GCCGGTTTGG GAATATCTGC
1301 CGTATGCCTT TTTCTGCTAT TTGAGTTTGG CTTTGACCCT GTTATTCGGT
1351 TGGACGGGGC TGACTTTGAG CAAAAAATAA
```

This corresponds to the amino acid sequence <SEQ ID 25 2382; ORF 709>:

```
m709.pep

1 MFAFKSLLDM PRGEALAVVV ALIAAMGYTI ISLEWLPHMS IIAAIVVLIL

51 YGLARGLKYN DMQQGMIGAL NQGMGAIYLF FFIGLMVSAL MMSGAIPTLM

101 YYGFGLISPT YFYFSSFALC SVIGVSIGSS LTTCATVGVA FMGMAAAFQA

151 DMAMTAGAIV SGAFFGDKMS PLSDTTGISA SIVGIDLFEH IKNMMYTTIP

201 AWLISAALML WLLPNVAAQD LNSVESFRSQ LEATGLVHGY SLIPFALLVI

251 LALMRINAVV AMLFTVMVAV AVTYLHSTPD LRQLGAWFYG GYKLEGEAFK

301 DVVKLISRGG LESMFFTQTI VILGMSLGGL LFALGVIPSL LEAIRTFLTN

351 AGRATFSVAM TSVGVNFLIG EQYLSILLSG ETFKPVYDKL GLHSRNLSRT

401 LEDAGTVINP LVPWSVCGVF ISHALGVPVW EYLPYAFFCY LSLALTLLFG

451 WTGLTLSKK* m709/g709  96.9% identity in 459 aa overlap 10         20         30         40         50         60
m709.pep  MFAFKSLLDMPRGEALAVVVALIAAMGYTIISLEWLPHMSIIAAIVVLILYGLARGLKYN
          ||||||||||||||||||||||||||||||||||||||||||||||||||||||||||||
g709      MFAFKSLLDMPRGEALAVVVALIAAMGYTIISLEWLPHMSIIAAIVVLILYGLARGLKYN
                10         20         30         40         50         60

70         80         90        100        110        120
m709.pep  DMQQGMIGALNQGMGAIYLFFFIGLMVSALMMSGAIPTLMYYGFGLISPTYFYFSSFALC
          |||  |||||||||||:|||||||||||||||||||||||||||||||||||||| ||||
g709      DMQAGMIGALNQGMGAVYLFFFIGLMVSALMMSGAIPTLMYYGFGLISPTYFYFSAFALC
                70         80         90        100        110        120

130        140        150        160        170        180
m709.pep  SVIGVSIGSSLTTCATVGVAFMGMAAAFQADMAMTAGAIVSGAFFGDKMSPLSDTTGISA
          ||||||||||||:|||||||||||||||||||||||||||||||:||||||||||||||
g709      SVIGVSIGSSLTACATVGVAFMGMAAAFQADMAMTAGAIVSGVFFGDKMSPLSDTTGISA
               130        140        150        160        170        180

190        200        210        220        230        240
m709.pep  SIVGIDLFEHIKNMMYTTIPAWLISAALMLWLLPNVAAQDLNSVESFRSQLEATGLVHGY
          ||||||||||||||||||||||||||||||||||:|||||||||||||||||||||||||
g709      SIVGIDLFEHIKNMMYTTIPAWLISAALMLWLLPSVAAQDLNSVESFRSQLEATGLVHGY
               190        200        210        220        230        240
```

-continued

```
                  250        260        270        280        290        300
   m709.pep  SLIPFALLVILALMRINAVVAMLFTVMVAVAVTYLHSTPDLRQLGAWFYGGYKLEGEAFK
            ||||||||:||||:|||||||||||::||||||||||||||||||||||||||||||||
   g709      SLIPFALLVVLALMRVNAVVAMLFTVIAAVAVTYLHSTPDLRQLGAWFYGGYKLEGEAFK
                  250        260        270        280        290        300
                  310        320        330        340        350        360
   m709.pep  DVVKLISRGGLESMFFTQTIVILGMSLGGLLFALGVIPSLLEAIRTFLTNAGRATFSVAM
            |::|||||||||||||||||||||||||||||||||||||||||:|||||||||||||||
   g709      DIAKLISRGGLESMFFTQTIVILGMSLGGLLFALGVIPSLLEAVRTFLTNAGRATFSVAM
                  310        320        330        340        350        360
                  370        380        390        400        410        420
   m709.pep  TSVGVNFLIGEQYLSILLSGETFKPVYDKLGLHSRNLSRTLEDAGTVINPLVPWSVCGVF
            ||||||||||||||||||||||||||||||||||| ||||||||||||||||||||||||
   g709      TSVGVNFLIGEQYLSILLSGETFKPVYDKLGLHSCNLSRTLEDAGTVINPLVPWSVCGVF
                  370        380        390        400        410        420
                  430        440        450        460
   m709.pep  ISHALGVPVWEYLPYAFFCYLSLALTLLFGWTGLTLSKKX
            ||||||||||||||||||||||||||||||||||||||||
   g709      ISHALGVPVWEYLPYAFFCYLSLALTLLFGWTGLTLSKKX
                  430        440        450        460
```

The following partial DNA sequence was identified in *N. meningitidis* <SEQ ID 2383>:

```
a709.seq
   1 ATGTTCGCTT TCNAATCCTT ACTCGATATG CCGCGCGGTG AGGCNCTTGC

51 CGTCGTCGTC GCTCTGATTG CCGCGATGGG CTATACCATC ATTTNNTTGG

101 AGTGGCTGCC GCATATGTCC ATTATTGCCG CCATCGTNGT GCTGATTTTG

151 TACGGCTTGG CGCGCGGTTT GAAATACAAC GATATGCAGC AGGGCATGAT

201 AGGCGCGTTG AATCAGGGTA TGGGCGCGAT TTACCTNTTT TTCTTCATCG

251 GGCTGATGGT CAGCGCGCTG ATGATGAGCG GCGCGATTCC GACGCTGATG

301 TATTACGGTT TCGGACTGAT TTCCCCGACT TATTTTTATT TTTCCGCCTT

351 CGCGCTGTGT TCCGTCATCG GCGTGTCCAT CGGCAGCAGC CTGACCACCT

401 GCGCCACTGT CGGCGTTGCC TTNATGGGTA TNNNGNCGGC GTTTCNGGCC

451 NANATGGNGN NGNNGNNGGN CNNGATTGTN NNGGNCGCAT TNTTNGGCGN

501 CAAAATGTCN CCGCTTTCCG ATACGNCGGG CATNTCCGCG TCCATTGTCG

551 GTATCGACCT GTTTGAACAC ATCAAAAATA TGATGTACAC NACCATTCCC

601 GCGTGGCTCA TCAGTGNNNC ACTGATGCTG TNGCTTCTTC CCAGCGTCGC

651 CGCGCAGGAT TTGAACAGCG TCGAATCCTT CCGCAGCCAG CTTGAAGCCA

701 CGGGATTGGT GCACTGCTAT TCGCTGATTC CGTTTGCGCT GTTGGTCGTT

751 TTGGCATTGA TGCGCGTCAA TGCCGTGGTC GCTATGCTCT TTACCGTCAT

801 TGCCGCCGTT GCCGTAACGT ATCTGCACAG CACGCCCGAT CTGCGTCAGC

851 TCGGCGCGTG GTTTTACGGC GGCTACAAAC TCGAAGGCGA AGCGTNTANA

901 GACATTGCCA AACTCATTTC TCGCGGCGGT TTGGAAAGTA TGTTTTTCAC

951 GCAGACCATC GTGATTCTTG GGATGAGCCT TGGCGGGCTG CTGTTTGCAC

1001 TGGGCGCGAT TCCTTCCCTG CTGGATGCCG TCCGCAGCTT TTTGACGAAT

1051 GCCGGGCGTN CCACATTCAG CGTTGCCATG ACTTCGGTCG GGGTTAATTT

1101 CCTGATCGGC GAGCAATATT TGAGTATTTT GTTGTCNGGT GAAACGTTCA

1151 AACCTGTTTA CGATAAGCTC GGTCTGCATT CGCGCAATCT GTCGCGGACG

1201 CTGGAAGATG CGGGGACGGT CATCAACCCG CTCGTACCGT GGAGCGTATG

1251 CGGCGTGTTC ATCANCCACG CGCTGGGCGT GCCGGTTTGG GAATATCTGC
```

```
-continued
1301 CGTATGCCTT TTTCTGCTAT TTGAGTTTGG CTTTGACCCT GTTATTCGGT

1351 TGGACGGGGC TGACTTTGAG CAAAAAATAA
```

This corresponds to the amino acid sequence <SEQ ID 2384; ORF 709.a>:

```
a709.pep
   1 MFAFXSLLDM PRGEALAVVV ALIAAMGYTI IXLEWLPHMS IIAAIVVLIL

51 YGLARGLKYN DMQQGMIGAL NQGMGAIYLF FFIGLMVSAL MMSGAIPTLM

101 YYGFGLISPT YFYFSAFALC SVIGVSIGSS LTTCATVGVA XMGXXXAFXA

151 XMXXXXXXIV XXAXXGXKMS PLSDTXGXSA SIVGIDLFEH IKNMMYTTIP

201 AWLISXXLML XLLPSVAAQD LNSVESFRSQ LEATGLVHCY SLIPFALLVV

251 LALMRVNAVV AMLFTVIAAV AVTYLHSTPD LRQLGAWFYG GYKLEGEAXX

301 DIAKLISRGG LESMFFTQTI VILGMSLGGL LFALGAIPSL LDAVRSFLTN

351 AGRXTFSVAM TSVGVNFLIG EQYLSILLSG ETFKPVYDKL GLHSRNLSRT

401 LEDAGTVINP LVPWSVCGVF IXHALGVPVW EYLPYAFFCY LSLALTLLFG

451 WTGLTLSKK*
``` a709/m709 91.1% identity in 459 aa overlap

```
                  10         20         30         40         50         60
   a709.pep  MFAFXSLLDMPRGEALAVVVALIAAMGYTIIXLEWLPHMSIIAAIVVLILYGLARGLKYN
             ||||  |||||||||||||||||||||||||| |||||||||||||||||||||||||||
   m709      MFAFKSLLDMPRGEALAVVVALIAAMGYTIISLEWLPHMSIIAAIVVLILYGLARGLKYN
                  10         20         30         40         50         60

70         80         90        100        110        120
   a709.pep  DMQQGMIGALNQGMGAIYLFFFIGLMVSALMMSGAIPTLMYYGFGLISPTYFYFSAFALC
             |||||||||||||||||||||||||||||||||||||||||||||||||||||||:||||
   m709      DMQQGMIGALNQGMGAIYLFFFIGLMVSALMMSGAIPTLMYYGFGLISPTYFYFSSFALC
                  70         80         90        100        110        120

130        140        150        160        170        180
   a709.pep  SVIGVSIGSSLTTCATVGVAXMGXXXAFXAXMXXXXXXIVXXAXXGXKMSPLSDTXGXSA
             ||||||||||||||||||||  ||   |   :  ||  |   |  |||||||||| | ||
   m709      SVIGVSIGSSLTTCATVGVAFMGMAAAFQADMAMTAGAIVSGAFFGDKMSPLSDTTGISA
                 130        140        150        160        170        180

190        200        210        220        230        240
   a709.pep  SIVGIDLFEHIKNMMYTTIPAWLISXXLMLXLLPSVAAQDLNSVESFRSQLEATGLVHCY
             ||||||||||:|||||||||||||||  ||| |||:||||||||||||||||||||||| |
   m709      SIVGIDLFEHIKNMMYTTIPAWLISAALMLWLLPNVAAQDLNSVESFRSQLEATGLVHGY
                 190        200        210        220        230        240

250        260        270        280        290        300
   a709.pep  SLIPFALLVVLALMRVNAVVAMLFTVIAAVAVTYLHSTPDLRQLGAWFYGGYKLEGEAXX
             ||||||||:|||||:|||||||||||:|||||||||||||||||||||||||||||||||
   m709      SLIPFALLVILALMRINAVVAMLFTVMVAVAVTYLHSTPDLRQLGAWFYGGYKLEGEAFK
                 250        260        270        280        290        300

310        320        330        340        350        360
   a709.pep  DIAKLISRGGLESMFFTQTIVILGMSLGGLLFALGAIPSLLDAVRSFLTNAGRXTFSVAM
             |::||||||||||||||||||||||||||||||||:||||:|:|:|||||||| ||||||
   m709      DVVKLISRGGLESMFFTQTIVILGMSLGGLLFALGVIPSLLEAIRTFLTNAGRATFSVAM
                 310        320        330        340        350        360

370        380        390        400        410        420
   a709.pep  TSVGVNFLIGEQYLSILLSGETFKPVYDKLGLHSRNLSRTLEDAGTVINPLVPWSVCGVF
             ||||||||||||||||||||||||||||||||||||||||||||||||||||||||||||
   m709      TSVGVNFLIGEQYLSILLSGETFKPVYDKLGLHSRNLSRTLEDAGTVINPLVPWSVCGVF
                 370        380        390        400        410        420

430        440        450        460
   a709.pep  IXHALGVPVWEYLPYAFFCYLSLALTLLFGWTGLTLSKKX
             | ||||||||||||||||||||||||||||||||||||||
   m709      ISHALGVPVWEYLPYAFFCYLSLALTLLFGWTGLTLSKKX
                 430        440        450        460
```

```
g710.seq  not found g710.pep  not found
```

The following partial DNA sequence was identified in *N. meningitidis* <SEQ ID 2385>:

```
m710.seq
   1 ATGGAAACCC ACGAAAAAAT CCGCCTGATG CGCGAATTGA ATAAATGGTC

51 CCAGGAGGAT ATGGCGGAAA AGCTGGCGAT GTCGGCAGGC GGGTATGCCA

101 AAATCGAACG GGGCGAAACG CAGTTAAATA TCCCGCGTTT GGAGCAGTTG

151 GCTCAGATTT TCAAAATCGA TATGTGGGAC TTGCTCAAAT CGGGCGGTGG

201 TGGGATGGTG TTTCAGATTA ATGAAGGTGA TAGTGGTGGC GATATTGCGT

251 TGTATGCGTC GGGTGATGTT TCGATGAAAA TAGAATTTTT AAAAATGGAG

301 TTGAAACACT GCAAAGAAAT GTTGGAACAA AAAGACAAAG AAATCGAGCT

351 GCTCCGCAAG CTGACCGAAA CCGTTTAA
```

This corresponds to the amino acid sequence <SEQ ID 2386; ORF 710>:

```
m710.pep
   1 METHEKIRLM RELNKWSQED MAEKLAMSAG GYAKIERGET QLNIPRLEQL

51 AQIFKIDMWD LLKSGGGGMV FQINEGDSGG DIALYASGDV SMKIEFLKME

101 LKHCKEMLEQ KDKEIELLRK LTETV*
```

The following partial DNA sequence was identified in *N. meningitidis* <SEQ ID 2387>:

```
a710.seq
   1 ATGGAAACCC ACGAAAAAAT CCGCCTGATG CGCGAATTGA ATAAATGGTC

51 CCAGGAGGAT ATGGCGGAAA AGCTGGCGAT GTCGGCAGGC GGGTATGCCA

101 AAATCGAACG AGGCGAAACG CAGTTGAATA TCCCGCGTTT GGAGCAGTTG

151 GCGCAGATTT TCAAAATTGA TATGTGGGAC TTGCTCAAAT CGGGCGGCGG

201 CGGGATGGTG TTGCAGATTA ACGATGTGGA TACCAACAGC GGGGAATTTG

251 CAATCTATAC CGCTCAGGAT GCATCNGGTA AAGCTGGATT TGTTAAAATG

301 GAATTAAAAC ACTGTAAAGA AATGTTGGAA CACAAGACA AAGAAATCGA

351 GCTGCTCCGC AAGCTGACCG AAACCGTTTA A
```

This corresponds to the amino acid sequence <SEQ ID 2388; ORF 710.a>:

```
a710.pep
   1 METHEKIRLM RELNKWSQED MAEKLAMSAG GYAKIERGET QLNIPRLEQL

51 AQIFKIDMWD LLKSGGGGMV LQINDVDTNS GEFAIYTAQD ASGKAGFVKM

101 ELKHCKEMLE HKDKEIELLR KLTETV*
``` a710/m710 85.7% identity in 126 aa overlap

```
                    10        20        30        40        50        60
a710.pep    METHEKIRLMRELNKWSQEDMAEKLAMSAGGYAKIERGETQLNIPRLEQLAQIFKIDMWD
            ||||||||||||||||||||||||||||||||||||||||||||||||||||||||||||
m710        METHEKIRLMRELNKWSQEDMAEKLAMSAGGYAKIERGETQLNIPRELQLAQIFKIDMWD
                    10        20        30        40        50        60
                    70        80        90       100       110       120
a710.pep    LLKSGGGGMVLQINDVDTNSGEFAIYTAQDASGKAGFVKMELKHCKEMLEHKDKEIELLR
            |||||||||:|||:  |::  |::|:|::  |:|  |:||:||||||||||||:||||||||
m710        LLKSGGGGMVFQINEGDSG-GDIALYASGDVSMKIEFLKMELKHCKEMLEQKDKEIELLR
                    70        80        90       100       110 a710.pep    KLTETVX
            |||||||
m710        KLTETVX
          120 g711.seq not found g711.pep not found
```

The following partial DNA sequence was identified in *N. meningitidis* <SEQ ID 2389>:

```
m711.seq
     1 ATGCCCGCGC CTGATTTGGG ATTTGCCTTA AGTCTGCCGC CAAAAAAGGC

51 AATCGAGTGG CTGGAAAGTA AAAAGGTTAC GGCGGAGAGC TACCGCAATC

101 TGACAGCCTC CGAAATTGCC AAAGTCTATA CGATTGCCCG CATGACCGAC

151 TTGGATATGC TCAACGACAT CAAAACTTCG ATGGTTGAAT CGGCAAAAAG

201 TGGACAGTCG TTTGACGATT GGCGAAAAGG TATCTTGAAT CTGCTCAGCA

251 ACAAGGGCTG GCTGCATCCG AACGGGCATA ACGGTAAGGA TATCATCGAC

301 CCAGCCACCG GCGAGGTATT CGGTTCGCCG CGGAGGTTGG AGACGATTTA

351 CCGTACCAAT ATGCAAACTG CCTACAACGC CGGTCAATAT CAAGGATATA

401 TGGCAAATAT TGATGCACGA CCTTATTGGA TGTATGACGC GGTAGGCGAC

451 AGCCGCACCC GTCCGGCGCA TTCGGCAATA GACGGGCTGG TGTACCGCTA

501 CGACGACCCG TTTTGGGCAA CGTTTTACCC GCCCAACGGC TACAACTGCC

551 GCTGCTCGGT CATCGCGCTG TCGGAGCGGG ATGTGGAACG CCAGGGGCGG

601 ATTGTTGGGC AAAGCACGGC GGACAATCTG GTCGAGACCC ATAAAATCTA

651 CAACAAAAAA GGCGATACTT ATCTGACCCT TGCCTATAAA GCACCGGATG

701 GCAGTCTGTA CACGACCGAT CGAGGATTTG ATTACAACGC CGGACGAATG

751 AACTACCGCC CCGATTTAGA CAAGTACGAC CGTGCGTTGG CGCATCAATT

801 TGCCAAAGCG GAAATGGGTG GTGCGGATTT TAAAACCAGC TTTAAACAGC

851 TTGAAAAAGA GTTTTATGAA GTCAAGCAAC GTTTGGATAT TGATGGCAAG

901 CCCGATAAAG AGCAGAAAAT CAAAATCCGA AATGCGCTAT CAAGACAGCT

951 TAAATTTGCT GCGGGTGTAT TGAGCAAGGA AACGCAAGAA TTGGCAGGTA

1001 TGACACGAGC GACGGTGTGG CTGTCTGATG ATACGTTGGT TAAACAGGTA

1051 GACAGCCGTG AGGGGCAGAA TTTCGATGAC TCCTACTATG CTTTTTTGCC

1101 GGATATGCTG CAAAACCCTG AACATGTCAT CCGCGACAAT CGTGAATTGA

1151 TTTTCACAGC TCGCTATAAA GGCTCGGCAT TGTGGGCAGT TTTAAAATAT

1201 ATTAAGGAGG TGGATGAGAT TTATCTACAG TCGTACCGAA TCAGTAACGA

1251 CAAAGAGATT GCCAAATTTA TGGCGAAGAA GAAAGTATTG AAATAG
```

This corresponds to the amino acid sequence <SEQ ID 2390; ORF 711>:

```
m711.pep
   1 MPAPDLGFAL SLPPKKAIEW LESKKVTAES YRNLTASEIA KVYTIARMTD

51 LDMLNDIKTS MVESAKSGQS FDDWRKGILN LLSNKGWLHP NGHNGKDIID

101 PATGEVFGSP RRLETIYRTN MQTAYNAGQY QGYMANIDAR PYWMYDAVGD

151 SRTRPAHSAI DGLVYRYDDP FWATFYPPNG YNCRCSVIAL SERDVERQGR

201 IVGQSTADNL VETHKIYNKK GDTYLTLAYK APDGSLYTTD RGFDYNAGRM

251 NYRPDLDKYD RALAHQFAKA EMGGADFKTS FKQLEKEFYE VKQRLDIDGK

301 PDKEQKIKIR NALSRQLKFA AGVLSKETQE LAGMTRATVW LSDDTLVKQV

351 DSREGQNFDD SYYAFLPDML QNPEHVIRDN RELIFTARYK GSALWAVLKY

401 IKEVDEIYLQ SYRISNDKEI AKFMAKKKVL K*
```

The following partial DNA sequence was identified in *N. meningitidis* <SEQ ID 2391>:

```
a711.seq
   1 ATGCCCGCGC CTGATTTGGG ATTTGCCTTA AGTCTGCCGC CAAAAAAGGC

51 AATCGAGTGG CTGGAAAGTA AAAAGGTTAC GGCGGAGAGC TACCGCAATC

101 TGACAGCCTC CGAAATTGCC AAAGTCTATA CGATTGCCCG CATGACCGAC

151 TTGGATATGC TCAACGACAT CAAAACTTCG ATGGTTGAAT CGGCAAAAAG

201 TGGACAGTCG TTTGACGATT GGCGAAAAGG TATCTTGAAT CTGCTCAGCA

251 ACAAGGGCTG GCTGCATCCG AACGGGCATA ACGGTAAGGA TATCATCGAC

301 CCAGCCACCG GCGAGGTATT CGGTTCGCCG CGGAGGTTGG AGACGATTTA

351 CCGTACCAAC ATGCAAACTG CCTACAACGC CGGTCAATAT CAAGGATATA

401 TGGCAAATAT TGATGCACGA CCTTATTGGA TGTATGACGC GGTAGGCGAC

451 AGCCGCACCC GTCCGGCGCA TTCGGCAATA GACGGGCTGG TGTACCGCTA

501 CGACGACCCG TTTTGGGCAA CGTTTTACCC GCCCAACGGC TACAACTGCC

551 GTTGCTCGGT CATCGCGCTG TCGGAGCGGG ATGTGGAACG CCAGGGGCGG

601 ATTGTCGGGC AAAGCACGTC GGACAATCTT GTTGAGACCC ATAAAATCTA

651 CAACAAAAAA GGCGATACTT ATCTGACCCT TGCCTATAAA GCACCGGATG

701 GCAGTCTGTA CACGACCGAT CGAGGATTTG ATTACAACGC CGGACGAATG

751 AACTACCGCC CCGATTTAGA CAAGTACGAC CGTGCGTTGG CGCATCAATT

801 TGCCAAAGCG GAAATGGGTG GTGCGGATTT TAAAACCAGC TTTAAACAGC

851 TTGAAAAAGA GTTTTATGAA GTCAAGCAAC GTTTGGATAT TGATGGCAAG

901 CCCGATAAAG AGCAGAAAAT CAAAATCCGA AATGCGCTAT CAAGACAGCT

951 TAAATTTGCT GCGGGTGTAT TGAGCAAGGA AACGCAAGAA TTGGCAGGTA

1001 TGACACGAGC GACGGTGTGG CTGTCTGATG ATACGTTGGT TAAACAGGTA

1051 GACAGCCGTG AAGGGCAGAA TTTCGATGAC TCCTACTATG CTTTTTTGCC

1101 GGATATGCTG CAAAACCCTG AACATGTCAT CCGCGACAAT CGTGAATTGA

1151 TTTTCACAGC TCGCTATAAA GGCTCGGCAT TGTGGGCAGT TTTAAAATAT

1201 ATTAAGGAGG TGGATGAGAT TTATCTACAG TCGTACCGAA TCAGTAACGA

1251 CAAAGAGATT GCCAAATTTA TGGCGAAGAA GAAAGTATTG AAATAG
```

This corresponds to the amino acid sequence <SEQ ID 2392; ORF 711.a>:

```
a711.pep
  1 MPAPDLGFAL SLPPKKAIEW LESKKVTAES YRNLTASEIA KVYTIARMTD

51 LDMLNDIKTS MVESAKSGQS FDDWRKGILN LLSNKGWLHP NGHNGKDIID

101 PATGEVFGSP RRLETIYRTN MQTAYNAGQY QGYMANIDAR PYWMYDAVGD

151 SRTRPAHSAI DGLVYRYDDP FWATFYPPNG YNCRCSVIAL SERDVERQGR

201 IVGQSTSDNL VETHKIYNKK GDTYLTLAYK APDGSLYTTD RGFDYNAGRM

251 NYRPDLDKYD RALAHQFAKA EMGGADFKTS FKQLEKEFYE VKQRLDIDGK

301 PDKEQKIKIR NALSRQLKFA AGVLSKETQE LAGMTRATVW LSDDTLVKQV

351 DSREGQNFDD SYYAFLPDML QNPEHVIRDN RELIFTARYK GSALWAVLKY

401 IKEVDEIYLQ SYRISNDKEI AKFMAKKKVL K*
``` a711/m711 99.8% identity in 431 aa overlap

```
                    10         20         30         40         50         60
    a711.pep   MPAPDLGFALSLPPKKAIEWLESKKVTAESYRNLTASEIAKVYTIARMTDLDMLNDIKTS
               ||||||||||||||||||||||||||||||||||||||||||||||||||||||||||||
    m711       MPAPDLGFALSLPPKKAIEWLESKKVTAESYRNLTASEIAKVYTIARMTDLDMLNDIKTS
                    10         20         30         40         50         60

70         80         90        100        110        120
    a711.pep   MVESAKSGQSFDDWRKGILNLLSNKGWLHPNGHNGKDIIDPATGEVFGSPRRLETIYRTN
               ||||||||||||||||||||||||||||||||||||||||||||||||||||||||||||
    m711       MVESAKSGQSFDDWRKGILNLLSNKGWLHPNGHNGKDIIDPATGEVFGSPRRLETIYRTN
                    70         80         90        100        110        120

130        140        150        160        170        180
    a711.pep   MQTAYNAGQYQGYMANIDARPYWMYDAVGDSRTRPAHSAIDGLVYRYDDPFWATFYPPNG
               ||||||||||||||||||||||||||||||||||||||||||||||||||||||||||||
    m711       MQTAYNAGQYQGYMANIDARPYWMYDAVGDSRTRPAHSAIDGLVYRYDDPFWATFYPPNG
                   130        140        150        160        170        180

190        200        210        220        230        240
    a711.pep   YNCRCSVIALSERDVERQGRIVGQSTSDNLVETHKIYNKKGDTYLTLAYKAPDGSLYTTD
               |||||||||||||||||||||||||||:||||||||||||||||||||||||||||||||
    m711       YNCRCSVIALSERDVERQGRIVGQSTADNLVETHKIYNKKGDTYLTLAYKAPDGSLYTTD
                   190        200        210        220        230        240

250        260        270        280        290        300
    a711.pep   RGFDYNAGRMNYRPDLDKYDRALAHQFAKAEMGGADFKTSFKQLEKEFYEVKQRLDIDGK
               ||||||||||||||||||||||||||||||||||||||||||||||||||||||||||||
    m711       RGFDYNAGRMNYRPDLDKYDRALAHQFAKAEMGGADFKTSFKQLEKEFYEVKQRLDIDGK
                   250        260        270        280        290        300

310        320        330        340        350        360
    a711.pep   PDKEQKIKIRNALSRQLKFAAGVLSKETQELAGMTRATVWLSDDTLVKQVDSREGQNFDD
               ||||||||||||||||||||||||||||||||||||||||||||||||||||||||||||
    m711       PDKEQKIKIRNALSRQLKFAAGVLSKETQELAGMTRATVWLSDDTLVKQVDSREGQNFDD
                   310        320        330        340        350        360

370        380        390        400        410        420
    a711.pep   SYYAFLPDMLQNPEHVIRDNRELIFTARYKGSALWAVLKYIKEVDEIYLQSYRISNDKEI
               ||||||||||||||||||||||||||||||||||||||||||||||||||||||||||||
    m711       SYYAFLPDMLQNPEHVIRDNRELIFTARYKGSALWAVLKYIKEVDEIYLQSYRISNDKEI
                   370        380        390        400        410        420

430
    a711.pep   AKFMAKKKVLKX
               ||||||||||||
    m711       AKFMAKKKVLKX
                   430 g712.seq  not found yet g712.pep  not found yet
```

The following partial DNA sequence was identified in *N. meningitidis* <SEQ ID 2393>:

```
m712.seq
   1  ATGATGCCCC ATATTGATTT TGACACGATT CCGGGCAGCA TCCGCGTGCC

51  CGGGCAGTAT ATTGAATTTA ACACCCGCAA TGCCGTACAA GGTTTGCCGC

101  AAAATCCGCA AAAGGTATTG ATGGTTGCAC CCATGCTGAC CGCGGGCATA

151  CAGACCGTCT TAGAGCCGGT GCAACTATTT AGCGATGCCG AGGCGGCCGA

201  TTTGTTCGGA CAAGGCTCGC TGGCGCATTT GATGGTGCGC CAAGCATTTG

251  CCAACAACCC TTATTTGGAT TTGACCGTTA TCGGTATTGC CGACCACAGC

301  GCAGGCGTGC AGGCAACCGC AACCGTTACC CTTTCCGGCA CGGCCACCGC

351  GCCGGGCGTG GTGGAAATCA CGATTGGCGG CAAGCAGGTA AGCACGGCCG

401  TTAACACCGG CGAGACCGCC GCCACAGTGG CAGACCGTCT GAAAACCGCC

451  ATCACTGCCG CCGATGTAAC CGTTACCGCA TCCGGCAGCG GCGCAGCCGT

501  TACGCTGACG GCCAAACACA AAGGCGAGAT CGGCAACGAG AGCGGCTTAA

551  CCGTGAGCAC CGGCAATACC GGCCTAACTT ATCAAGCCAA TGCCTTTACC

601  GGCGGTGCCA AAAATGCGGA CATTGCCACG GCCTTGTCCA AAGTGGCGGG

651  CAAGCATTAT CACATTATTT GCAGCCCGTT TAGCGATGAC GCCAACGCCA

701  AAGCCTTGAG CAACCATATT ACCAACGTAT CCAACGCCAT CGAGCAGCGC

751  GGCTGTATCG GCGTATTGGG TATGAGTGCG GCCTTGAGCA CGGCCACCAC

801  CGCTACCGGC GAAATCAACG ACGGCCGCAT GACCTGTGCT TGGTACAAAG

851  GTGCGGTAGA GCCAAACGGC ATCATCGCCG CAGGTTATGC GGCGGTGTTG

901  GCCTTTGAAG AAGACCCTGC CAAGCCGCTG AACACGCTGG AAATCAAAGG

951  GCTGGCCGTT ACACCTGATG CGCAATGGCC GCTGTTTGCA GAATGCAACA

1001  ATGCGCTGTA CAACGGCTTG ACCCCGCTCA CAGTGGTCAA CAACCGCGTG

1051  CAGATTATGC GTGCCGTATC CACCTATACC AAGTCGGCCA ACAACACCGA

1101  CGACCCGGCA CTACTCGACA TTACCACCAT CCGCACGCTG GATTATGTGC

1151  GCCGCAGCGT TAAAGAGCGC ATTGCCCTGC GTTTTCCGCG CGACAAATTG

1201  AGCGACCGCC TGCTGCCCAA GGTTAAGAGC GAGATTTTGG ACGTGCTGAT

1251  TAAGCTCGAC CAAGCCGAAA TCATCGAAAA CGCCGAGGCC AACAAAGGCA

1301  AGCTGGTGGT GGCGCGTGCG CAAAACGACC CCAACCGTGT TAATGCCATT

1351  ATCACTGCCG ATGTGGTCAA CGGCCTGCAC GTCTTTGCCG GGCGCATTGA

1401  TTTGATTTTG TAA
```

This corresponds to the amino acid sequence <SEQ ID 2394; ORF 712>:

```
m712.pep
  1 MMPHIDFDTI PGSIRVPGQY IEFNTRNAVQ GLPQNPQKVL MVAPMLTAGI

51 QPALEPVQLF SDAEAADLFG QGSLAHLMVR QAFANNPYLD LTVIGIADHS

101 AGVQATATVT LSGTATAPGV VEITIGGKQV STAVNTGETA ATVADRLKTA

151 ITAADVTVTA SGSGAAVTLT AKHKGEIGNE SGLTVSTGNT GLTYQANAFT

201 GGAKNADIAT ALSKVAGKHY HIICSPFSDD ANAKALSNHI TNVSNAIEQR

251 GCIGVLGMSA ALSTATTATG EINDGRMTCA WYKGAVEPNG IIAAGYAAVL
```

```
-continued
301 AFEEDPAKPL NTLEIKGLAV TPDAQWPLFA ECNNALYNGL TPLTVVNNRV

351 QIMRAVSTYT KSANNTDDPA LLDITTIRTL DYVRRSVKER IALRFPRDKL

401 SDRLLPKVKS EILDVLIKLD QAEIIENAEA NKGKLVVARA QNDPNRVNAI

451 IPADVVNGLH VFAGRIDLIL *
``` a712.seq not found yet a712.pep not found yet g713.seq not found yet g713.pep not found yet The following partial DNA sequence was identified in *N. meningitidis* <SEQ ID 2395>:

```
m713.seq
   1 ATGCAAAATA ATTCATACGG CTATGCCGTG TCGGTGCGCG TGGGCGGTAA

51 AGAGCACCGC CACTGGGAGC GCTACGACAT CGACAGCGAC TTTTTAATCC

101 CTGCCGACAG CTTCGATTTT GTCATCGGCA GGTTGGGACC GGAGGCGGCC

151 ATACCCGATT TAAGCGGAGA GAGCTGCGAG GTAGTGATAG ACGGGCAAAT

201 CGTGATGACG GGCATCATCG GCAGCCAGCG CCACGGCAAA AGCAAGGGCA

251 GCCGCGAGTT GAGCTTGAGC GGGCGTGATT TGGCCGGTTT TTTGGTGGAT

301 TGCTCCGCGC CGCAGCTCAA TGTAAAGGGC ATGACGGTAT TGGATGCAGC

351 CAAAAAGCTG GCCGCGCCGT GGCCGCAGAT TAAAGCGGTG GTGCTTAAGG

401 CCGAAAACAA CCCCGCTTTG GGCAAAATCG ACATCGAGCC GGGCGAAACC

451 GTATGGCAGG CATTAACCCA TATTGCCAAC TCGGTCGGGC TGCATCCGTG

501 GCTGGAGCCG GACGGCACGT TGGTGGTGGG CGGTGCGGAT TACAGCAGCC

551 CGCCGGTGGC GACATTGTGT TGGAGCCGCA CCGACAGCCG CTGCAATATC

601 GAGCGCATGG ACATTGAGTG GGATACCGAC AACCGCTTTT CCGAGGTTAC

651 TTTTTTGGCG CAATCGCACG GCCGCAGCGG CGACAGCGCC AAACACGATT

701 TAAAGTGGGT GTACAAAGAC CCGACGATGA CGCTGCACCG CCCTAAAACG

751 GTGGTGGTGT CCGATGCCGA CAATTTGGCC GCATTGCAAA AGCAGGCTAA

801 AAAGCAGCTG GCCGACTGGC GGCTGGAGGG ATTTACACTC ACGATAACCG

851 TGGGCGGCCA TAAACCCGC GACGGCGTAT TGTGGCAACC TGGCCTGCGT

901 GTGCATGTGA TCGACGACGA GCACGGTATC GATGCGGTGT TTTTTCTGAT

951 GGGGCGGCGG TTTATGCTAT CCCGCATGGA TGGTACGCAA ACCGAGCTGC

1001 GGCTCAAAGA GGACGGTATT TGGACACCCG ACGCTTACCC CAAAAAGGCC

1051 GAGGCGGCGC GCAAGCGCAA AGGCAAACGC AAAGGCGTGA GCCATAAGGG

1101 CAAAAAAGGC GGCAAAAAAC AAGCAGAAAC GGCGGTGTTT GAATGA
```

This corresponds to the amino acid sequence <SEQ ID 2396; ORF 713>:

```
m713.pep
   1 MQNNSYGYAV SVRVGGKEHR HWERYDIDSD FLIPADSFDF VIGRLGPEAA

51 IPDLSGESCE VVIDGQIVMT GIIGSQRHGK SKGSRELSLS GRDLAGFLVD

101 CSAPQLNVKG MTVLDAAKKL AAPWPQIKAV VLKAENNPAL GKIDIEPGET
```

-continued

```
151 VWQALTHIAN SVGLHPWLEP DGTLVVGGAD YSSPPVATLC WSRTDSRCNI

201 ERMDIEWDTD NRFSEVTFLA QSHGRSGDSA KHDLKWVYKD PTMTLHRPKT

251 VVVSDADNLA ALQKQAKKQL ADWRLEGFTL TITVGGHKTR DGVLWQPGLR

301 VHVIDDEHGI DAVFFLMGRR FMLSRMDGTQ TELRLKEDGI WTPDAYPKKA

351 EAARKRKGKR KGVSHKGKKG GKKQAETAVF E*
```

The following partial DNA sequence was identified in *N. meningitidis* <SEQ ID 2397>:

```
a713.seq
   1 ATGCAAAATA ATTCATACGG CTATGCCGTG TCGGTGCGCG TGGGCGGTAA

51 AGAGCACCGC CACTGGGAGC GCTACGACAT CGACAGCGAC TTTTTAATCC

101 CTGCCGACAG CTTCGATTTT GTCATCGGCA GGTTGGGGCC GGAGGCGGCC

151 ATACCCGATT TAAGCGGAGA GAGCTGCGAG GTAGTGATAG ACGGGCAAAT

201 CGTGATGACG GGCATCATCG GCAGCCAGCG CCACGGCAAA AGCAAGGGCG

251 GCCGCGAGTT GAGCTTGAGC GGGCGTGATT TGGCCGGTTT TTTGGTGGAT

301 TGCTCCGCGC CGCAGCTCAA TGTAAAGGGC ATGACGGTAT TGGATGCAGC

351 CAAAAAGCTG GCCGCGCCGT GGCCGCAGAT TAAAGCGGTG GTGCTTAAGG

401 TCGAAAACAA CCCCGCTTTG GACAAAATCG ACATCGAGCC GGGCGAAACC

451 GTATGGCAGG CATTAACCCA TATTGCCAAC TCGGTCGGGC TGCATCCGTG

501 GCTGGAGCCG GACGGCACGT TGGTGGTGGG CGGTGTGGAT TACAGCAGCC

551 CGCCGGTGGC GACATTGTGT TGGAGCCGCA CCGACAGCCG CCGCAATATC

601 GAGCGCATGG ACATTGAGTG GGATACCGAC AACCGCTTTT CTGAGGTTAC

651 TTTTTTGGCG CAATCGCACG GCCGCAGCGG CGACAGCGCC AAACACGATT

701 TAAAGTGGGT GTACAAAGAC CCGACGATGA CGCTGCACCG CCCTAAAACG

751 GTGGTGGTGT CCGATGCCGA CAATTTGGCC GCATTGCAAA AGCAGGCTAA

801 AAAGCAGCTG GCCGACTGGC GGCTGGAGGG ATTTACACTC ACGATAACCG

851 TGGGCGGCCA TAAAACCCGC GACGGCGTAT TGTGGCAACC TGGCCAGCGT

901 GTGCATGTGA TCGACGACGA GCACGGTATC GATGCGGTGT TTTTTCTGAT

951 GGGGCGGCGG TTTATGCTAT CTCGCATGGA TGGCACGCAA ACCGAGCTGC

1001 GGCTCAAAGA GGACGGTATT TGGACACCCG ACGCTTACCC CAAAAAGGCC

1051 GAGGCGGCGC GCAAGCGCAA AGGCAAACGC AAAGGCGTGA GCCATAAGGG

1101 CAAAAAAGGC GGCAAAAAAC AAGCAGAAAC GGCGGTGTTT GAATGA
```

This corresponds to the amino acid sequence <SEQ ID 2398; ORF 713.a>:

```
a713.pep
  1 MQNNSYGYAV SVRVGGKEHR HWERYDIDSD FLIPADSFDF VIGRLGPEAA

51 IPDLSGESCE VVIDGQIVMT GIIGSQRHGK SKGGRELSLS GRDLAGFLVD

101 CSAPQLNVKG MTVLDAAKKL AAPWPQIKAV VLKVENNPAL DKIDIEPGET

151 VWQALTHIAN SVGLHPWLEP DGTLVVGGVD YSSPPVATLC WSRTDSRRNI

201 ERMDIEWDTD NRFSEVTFLA QSHGRSGDSA KHDLKWVYKD PTMTLHRPKT

251 VVVSDADNLA ALQKQAKKQL ADWRLEGFTL TITVGGHKTR DGVLWQPGQR
```

-continued

```
301 VHVIDDEHGI DAVFFLMGRR FMLSRMDGTQ TELRLKEDGI WTPDAYPKKA

351 EAARKRKGKR KGVSHKGKKG GKKQAETAVF E*
``` a713/m713 98.4% identity in 381 aa overlap

```
                  10        20        30        40        50        60
    a731.pep  MQNNSYGYAVSVRVGGKEHRHWERYDIDSDFLIPADSFDFVIGRLGPEAAIPDLSGESCE
              ||||||||||||||||||||||||||||||||||||||||||||||||||||||||||||
    m713      MQNNSYGYAVSVRVGGKEHRHWERYDIDSDFLIPADSFDFVIGRLGPEAAIPDLSGESCE
                  10        20        30        40        50        60

70        80        90       100       110       120
    a713.pep  VVIDGQIVMTGIIGSQRHGKSKGGRELSLSGRDLAGFLVDCSAPQLNVKGMTVLDAAKKL
              |||||||||||||||||||||||||||| :||||||||||||||||||||||||| ||||
    m713      VVIDGQIVMTGIIGSQRHGKSKGSRELSLSGRDLAGFLVDCSAPQLNVKGMTVLKAAKKL
                  70        80        90       100       110       120

130       140       150       160       170       180
    a713.pep  AAPWPQIKAVVLKVENNPALDKIDIEPGETVWQALTHIANSVGLHPWLEPDGTLVVGGVD
              |||||||||||||:|||||||| |||||||||||||||||||||||||||||||||||:|
    m713      AAPWPQIKAVVLKAENNPALGKIDIEPGETVWQALTHIANSVGLHPWLEPDGTLVVGGAD
                 130       140       150       160       170       180

190       200       210       220       230       240
    a713.pep  YSSPPVATLCWSRTDSRRNIERMDIEWDTDNRFSEVTFLAQSHGRSGDSAKHDLKWVYKD
              |||||||||||||||||| |||||||||||||||||||||||||||||||||||||||||
    m713      YSSPPVATLCWSRTDSRCNIERMDIEWDTDNRFSEVTFLAQSHGRSGDSAKHDLKWVYKD
                 190       200       210       220       230       240

250       260       270       280       290       300
    a713.pep  PTMTLHRPKTVVVSDADNLAALQKQAKKQLADWRLEGFTLTITVGGHKTRDGVLWQPGQR
              ||||||||||||||||||||||||||||||||||||||||||||||||||||||||||| |
    m713      PTMTLHRPKTVVVSDADNLAALQKQAKKQLADWRLEGFTLTITVGGHKTRDGVLWQPGLR
                 250       260       270       280       290       300

310       320       330       340       350       360
    a713.pep  VHVIDDEHGIDAVFFLMGRRFMLSRMDGTQTELRLKEDGIWTPDAYPKKAEAARKRKGKR
              ||||||||||||||||||||||||||||||||||||||||||||||||||||||||||||
    m713      VHVIDDEHGIDAVFFLMGRRFMLSRMDGTQTELRLKEDGIWTPDAYPKKAEAARKRKGKR
                 310       320       330       340       350       360

370       380
    a713.pep  KGVSHKGKKGGKKQAETAVFEX
              ||||||||||||||||||||||
    m713      KGVSHKGKKGGKKQAETAVFEX
                 370       380 g714.seq not found yet g714.pep not found yet
```

The following partial DNA sequence was identified in *N. meningitidis* <SEQ ID 2399>:

```
m714.seq
  1 ATGAGCTATC AAGACATCTT GCGGGGCCTG TTGCCCCCCG TGTCGTATGC

51 CCGCAATGCC CCGCGTGTGC GGGCGCAGGC AGAAATAGAC GGCGCAGCGC

101 TGGATGCGGT GGCGGAATCG GCTCAAAGCG TTGCCGATGC CGTCGACCCG

151 CGCAGCGCCG GCCAAATGCT GGCCGATTGG GAGCGCGTAT TAGGTTTGGA

201 CGGTACGGGC AAAAACCGCC AGCACCGTGT GTTGGCCGTC ATGGCCAAGC

251 TAAACGAAAC AGGCGGCTTG AGTATTCCTT ATTTTGTGCG TTTGGCCGAG

301 GCGGCGGGCT ATCAAATCCA AATCGACGAA CCGCAGCCGT TCCGCGCCGG

351 TGTAAACCGC GCCGGCGACC GTCTTGCGCC GCAGGAAATC ATGTGGGTGT

401 GGCACGTTAA CGTGCGCGGC GGCAACAACC GCATTACCCG ATTCCGCGCC

451 GGTATCTCGG CGGCGGGCGA CAGGCTGACC GATTACAGCG ATGCCGTGAT

501 CGAGAGCCTG TTCAACCGCC TCAAGCCCGC CCACACCGCT ATCCGATTTA

551 CCTACCGCTA A
```

This corresponds to the amino acid sequence <SEQ ID 2400; ORF 714>:

```
m714.pep
   1 MSYQDILRGL LPPVSYARNA PRVRAQAEID GAALDAVAES AQSVADAVDP

51 RSAGQMLADW ERVLGLDGTG KNRQHRVLAV MAKLNETGGL SIPYFVRLAE

101 AAGYQIQIDE PQPFRAGVNR AGDRLAPQEI MWVWHVNVRG GNNRITRFRA

151 GISAAGDRLT DYSDAVIESL FNRLKPAHTA IRFTYR*
```

The following partial DNA sequence was identified in *N. meningitidis* <SEQ ID 2401>:

```
a714.seq
   1 ATGAGCTATC AAGACATCTT GCGGGGTCTG TTGCCCCCCG TGTCGTATGC

51 CCGCAATGCC CCGCGTGTGC GGGCGCAGGC AGAAATAGAC GGCGCAGCGC

101 TGGATGCGGT GGCGGAATCG GCTCAAAGCG TTGCCGATGC CGTCGACCCG

151 AGCAGCGCCG GCCAAATGCT GGCCGATTGG GAGCGCGTAT TAGGTTTGGA

201 CGGTACGGGC AAAAACCGCC AGCGCCGTGT GTTGGCCGTC ATGGCCAAGC

251 TAAACGAAAC AGGCGGCTTG AGTATTCCTT ATTTTGTGCG TTTGGCCGAG

301 GCGGCGGGCT ATCAAATCCA AATCGACGAA CCGCAGCCGT TCCGCGCCGG

351 TGTAAACCGC GCCGGCGACC GTCTTGCGCC GCAGGAAATC ATGTGGGTGT

401 GGCACGTTAA CGTGCGCGGC GGCAACAACC GCATTACCCG ATTCCGCGCC

451 GGTATCTCGG CGGCGGGCGA CAGGCTGACC GATTACAGCG ATGCCGTGAT

501 CGAGAGCCTG TTCAACCGCC TCAAGCCCGC CCACACCGCT ATCCGATTTA

551 CCTACCGATA A
```

This corresponds to the amino acid sequence <SEQ ID 2402; ORF 714.a>:

```
a714.pep
   1 MSYQDILRGL LPPVSYARNA PRVRAQAEID GAALDAVAES AQSVADAVDP

51 SSAGQMLADW ERVLGLDGTG KNRQRRVLAV MAKLNETGGL SIPYFVRLAE

101 AAGYQIQIDE PQPFRAGVNR AGDRLAPQEI MWVWHVNVRG GNNRITRFRA

151 GISAAGDRLT DYSDAVIESL FNRLKPAHTA IRFTYR*
``` a714/m714 98.9% identity in 186 aa overlap

```
                   10        20        30        40        50        60
a714.pep   MSYQDILRGLLPPVSYARNAPRVRAQAEIDGAALDAVAESAQSVADAVDPSSAGQMLADW
           |||||||||||||||||||||||||||||||||||||||||||||||||| |||||||||
m714       MSYQDILRGLLPPVSYARNAPRVRAQAEIDGAALDAVAESAQSVADAVDPRSAGQMLADW
                   10        20        30        40        50        60

70        80        90       100       110       120
a714.pep   ERVLGLDGTGKNRQRRVLAVMAKLNETGGLSIPYFVRLAEAAGYQIQIDEPQPFRAGVNR
           ||||||||||||||:|||||||||||||||||||||||||||||||||||||||||||||
m714       ERVLGLDGTGKNRQHRVLAVMAKLNETGGLSIPYFVRLAEAAGYQIQIDEPQPFRAGVNR
                   70        80        90       100       110       120

130       140       150       160       170       180
a714.pep   AGDRLAPQEIMWVWHVNVRGGNNRITRFRAGISAAGDRLTDYSDAVIESLFNRLKPAHTA
           ||||||||||||||||||||||||||||||||||||||||||||||||||||||||||||
m714       AGDRLAPQEIMWVWHVNVRGGNNRITRFRAGISAAGDRLTDYSDAVIESLFNRLKPAHTA
                  130       140       150       160       170       180 a714.pep   IRFTYRX
           |||||||
m714       IRFTYRX
```

```
g715.seq   not found yet g715.pep   not found yet
```

The following partial DNA sequence was identified in *N. meningitidis* <SEQ ID 2403>:

```
m715.seq
  1 ATGATTGATG TCAAAATAGA CAATATCTTT GTCGTCCTAA ACCAAATCGA

51 GCGGCTTGGC AACGGGATCG AAAACCGCTA CCTGCTGATG CGCCGACTGT

101 CCGAAACCAT GCACACGGCG GTCAAGCTCA ATTTCCGCTA CGCAGGCCGT

151 CCGAAATGGG TTGGGCTAAA ATACCGCGAC GGCAAGCCGC TTTCGGATTC

201 GGGTCGTCTG AAAGACAGTT TTTCCACACT GTCAGACAAC GATACAGCCC

251 TTGTCGGTAC GAATATCGTC TATGCCGCCA TCCACAACTT CGGCGGTATG

301 GCGGGGCGCA ACCGCAAAGT TCGGATTCCG CAACGGGAAT TTTTGACGCT

351 GACGGACGAC GACAAACAGG CTTTGATGGA CGATGTGCAG GATTATTTTT

401 CGGGTCTGAT ACCGTGA
                                                       25
```

This corresponds to the amino acid sequence <SEQ ID 2404; ORF 715>:

```
m715.pep
  1 MIDVKIDNIF VVLNQIERLG NGIENRYLLM RRLSETMHTA VKLNFRYAGR

51 PKWVGLKYRD GKPLSDSGRL KDSFSTLSDN DTALVGTNIV YAAIHNFGGM

101 AGRNRKVRIP QREFLTLTDD DKQALMDDVQ DYFSGLIP*

:
```

The following partial DNA sequence was identified in *N. meningitidis* <SEQ ID 2405>:

```
a715.seq
  1 ATGATTGATG TCAAAATAGA CAATATCTTT GTCGTCCTAA ACCAAATCGA

51 GCGGCTTGGC AACGGGATCG AAAACCGCTA CCTGCTGATG CGCCGACTGT

101 CCGAAACCAT GCACACGGCG GTCAAGCTCA ATTTCCGCTA CGCAGGCCGT

151 CCGAAATGGT TGGGGCTAAA ATACCGCGAC GGCAAGCCGC TTTCGGATTC

201 GGGTCGTCTG AAAGACAGTT TTTCCACACT GTCAGACAAC GATACAGCCC

251 TTGTCGGTAC GAATATCGTC TATGCCGCCA TCCACAACTT CGGCGGTATG

301 GCGGGGCGCA ACCGCAAAGT TCGGATTCCG CAACGGGAAT TTTTGACGCT

351 GACGGACGAC GACAAACAGG CTTTGATGGA CGATGTGCAG GATTATTTTT

451 CGGGTCTGAT ACCGTGA
```

This corresponds to the amino acid sequence <SEQ ID 2406; ORF 715.a>

```
a715.pep
  1 MIDVKIDNIF VVLNQIERLG NGIENRYLLM RRLSETMHTA VKLNFRYAGR

51 PKWLGLKYRD GKPLSDSGRL KDSFSTLSDN DTALVGTNIV YAAIHNFGGM

101 AGRNRKVRIP QREFLTLTDD DKQALMDDVQ DYFSGLIP*
```

The following partial DNA sequence was identified in *N. gonorrhoeae* <SEQ ID 2407>:

```
g716.seq
   1 ATGAACAAAA ATATTGCTGC CGCACTCGCC GGTGCTTTAT CCCTGTCTCT

51 GGCCGCCGGC GCCGTTGCCG CCCACAAACC GGCAAGCAAC GCAACAGGCG

101 TTCAAAAATC CGCCCAAGGC TCTTGCGGCG CATCCAAATC TGCCGAAGGT

151 TCGTGCGGCG CATCCAAATC TGCCGAAGGT TCGTGCGGCG CGGCTGCTTC

201 TAAAGCAGGC GAAGGCAAAT GCGGCGAGGG CAAATGCGGT GCAACTGTAA

251 AAAAAGCCCA CAAACACACC AAAGCATCTA AGCCAAAGC CAAATCTGCC

301 GAAGGCAAAT GCGGCGAAGG CAAATGCGGT TCTAAATAA
```

This corresponds to the amino acid sequence <SEQ ID 2408; ORF 716.ng>:

```
g716.pep
   1 MNKNIAAALA GALSLSLAAG AVAAHKPASN ATGVQKSAQG SCGASKSAEG

51 SCGASKSAEG SCGAAASKAG EGKCGEGKCG ATVKKAHKHT KASKAKAKSA

101 EGKCGEGKCG SK*
```

The following partial DNA sequence was identified in *N. meningitidis* <SEQ ID 2409>:

```
m716.seq
   1 ATGAACAAAA ACATTGCTGC CGCTCTCGCC GGTGCTTTAT CCCTGTCTTT

51 GGCCGCCGGT GCAGTTGCTG CCAACAAACC GGCAAGCAAC GCAACAGGCG

101 TTCATAAATC CGCCCATGGC TCTTGCGGCG CGTCCAAATC TGCCGAAGGT

151 TCGTGCGGCG CGGCTGGTTC TAAAGCAGGC GAAGGCAAAT GCGGCGAGGG

201 CAAATGCGGT GCGACCGTAA AAAAAACCCA CAAACACACC AAAGCATCTA

251 AAGCCAAGGC CAAATCTGCC GAAGGCAAAT GCGGCGAAGG CAAATGCGGT

301 TCTAAATAA
```

This corresponds to the amino acid sequence <SEQ ID 2410; ORF 716>:

```
m716.pep

1   MNKNIAAALA GALSLSLAAG AVAANKPASN ATGVHKSAHG SCGASKSAEG

51   SCGAAGSKAG EGKCGEGKCG ATVKKTHKHT KASKAKAKSA EGKCGEGKCG

101   SK* m716/g716  86.6% identity in 112 aa overlap
                   10         20         30         40         50
    m716.pep  MNKNIAAALAGALSLSLAAGAVAANKPASNATGVHKSAHGSCGASKSAEGSCGA------
              ||||||||||||||||||||||||:|||||||||:|||:||||||||||||||||
        g716  MNKNIAAALAGALSLSLAAGAVAAHKPASNATGVQKSAQGSCGASKSAEGSCGASKSAEG
                   10         20         30         40         50         60

60         70         80         90        100
    m716.pep  ----AGSKAGEGKCGEGKCGATVKKTHKHTKASKAKAKSAEGKCGEGKCGSKX
                  |:||||||||||||||||||:||||||||||||||||| |||||||||||
        g716  SCGAAASKAGEGKCGEGKCGATVKKAHKHTKASKAKAKSAEGKCGECKCGSKX
                       70         80         90        100        110
```

The following partial DNA sequence was identified in *N. meningitidis* <SEQ ID 2411>:

```
a716.seq
   1 ATGAACAAAA ACATTGCTGC CGCACTCGCC GGTGCTTTAT CCCTGTCTTT

51 GGCCGCCGGT GCAGTTGCTG CCAACAAACC GGCAAGCAAC GCAACAGGCG

101 TTCATAAATC CGCCCATGGC TCTTGCGGCG CGTCCAAATC TGCCGAAGGT

151 TCGTGCGGCG CGGCTGGTTC TAAAGCAGGC GAAGGCAAAT GCGGCGAGGG

201 CAAATGCGGT GCGACCGTAA AAAAAACCCA CAAACACACC AAAGCATCTA

251 AAGCCAAGGC CAAATCTGCC GAAGGCAAAT GCGGCGAAGG CAAATGCGGT

301 TCTAAATAA
```

The following partial DNA sequence was identified in *N. meningitidis* <SEQ ID 2412.a>:

```
a716.pep
   1 MNKNIAAALA GALSLSLAAG AVAANKPASN ATGVHKSAHG SCGASKSAEG

51 SCGAAGSKAG EGKCGEGKCG ATVKKTHKHT KASKAKAKSA EGKCGEGKCG

101 SK*
``` a716/m716 100.0% identity in 102 aa overlap

```
                    10        20        30        40        50        60
a716.pep    MNKNIAAALAGALSLSLAAGAVAANKPASNATGVHKSAHGSCGASKSAEGSCGAAGSKAG
            ||||||||||||||||||||||||||||||||||||||||||||||||||||||||||||
m716        MNKNIAAALAGALSLSLAAGAVAANKPASNATGVHKSAHGSCGASKSAEGSCGAAGSKAG
                    10        20        30        40        50        60

70        80        90       100
a716.pep    EGKCGEGKCGATVKKTHKHTKASKAKAKSAEGKCGEGKCGSKX
            |||||||||||||||||||||||||||||||||||||||||||
m716        EGKCGEGKCGATVKKTHKHTKASKAKAKSAEGKCGEGKCGSKX
                    70        80        90       100
```

The following partial DNA sequence was identified in *N. gonorrhoeae* <SEQ ID 2413>:

```
g717.seq
   1  ATGGACACAA AAGAAATCCT CGGCTACGCG GCAGGCTCGA TCGGCAGCGC

51  GGTTTTAGCC GTCATCATCC TGCCGCTGCT GTCGTGGTAT TTCccgCCG

101  ACGACATCGG GCGCATCGTG CTGATGCAGA CGGCGGCGGG ACTGACGGTG

151  TCGGTATTGT GCCTCGGGCT GGATCAGGCA TACGTCCGCG AATACTATGC

201  CGCCGCCGAC AAAGACACTT TGTTCAAAAC CCTGTTCCTG CCGCCGCTGC

251  TGTTTTCCGC CGCGATAGCC GCCCTGCTGC TTTCCCGCCC GTCCCTGCCG

301  TCTGAAATCC TGTTTTCGCT CGACGATGCC GCCGCCGGCA TCGGGCTGGT

351  GCTGTTTGAA CTGAGCTTCC TGCCCATCCG CTTTCTCTTA CTGGTTTTGC

401  GTATGGAAGG GCGCGCCCTT GCCTTTTCGT CCGCGCAACT CGTGCCCAAA

451  CTCGCCATTC TGCTGCTGTT GCCGCTGACG GTCGGGCTGC TGCACTTTCC

501  GGCGAACACC TCCGTCCTGA CCGCCGTTTA CGCGCTGGCA AACCTTGCCG

551  CCGCCGCCTT TTTGCTGTTT CAAAACCGAT GCCGTCTGAA GGCCGTCCGG

601  CGCGCGCCGT TTTCGCCCGC CGTCCTGCAC CGGGGGCTGC GCTACGGCAT

651  ACCGCTCGCA CTGAGCAGCC TTGCCTATTG GGGGCTGGCA TCCGCCGACC
```

```
-continued
 701  GTTTGTTCCT GAAAAAATAT GCGGGCCTGG AACAGCTCGG CGTTTATTCG

751  ATGGGTATTT CGTTCGGCGG GGCGGCATTA TTGCTCCAAA GCATCTTTTC

801  AACGGTCTGG ACACCGTATA TTTTCCGTGC AATCGAAGAA AACGCCACGC

851  CCGCCCGCCT CTCGGCAACG GCAGAATCCG CCGCCGCCCT GCTTGCCTCC

901  GCCCTCTGCC TGACCGGAAT TTTCTCGCCC CTCGCCTCCC TCCTGCTGCC

951  GGAAAACTAC GCCGCCGTCC GGTTTACCGT CGTATCGTGT ATGCTGccgc 1001  cgctGTTTTA CACGCTGACC GAAATCAGCG GCATCGGTTT GAACGTCGTC

1051  CGCAAAACGC GTCCGATCGC GCTTGCCACC TTGGGCGCGC TGGCGGCAAA

1101  CCTGCTGCTG CTGGGGCTTG CCGTACCGTC CGGCGGCACG CGCGGCGCGG

1151  CGGTTGCCTG TGCCGCCTCA TTCTGGTTGT TTTTTGTTTT CAAGACAGAA

1201  AGCTCCTGCC GCCTGTGGCA GCCGCTCAAA CGCCTGCCGC TTTATATGCA

1251  CACATTGTTC TGCCTgGCCT CCTCGGCGGC CTACACCTGC TTCGGCACAC

1301  CGGCAAACTA CCCcctgttt gccggcgtAT GGGCGGCATA TCTGGCAGGC

1351  TGCATCCTGC GCCACCGGAA AAATTTGCAC AAACTGTTTC ATTATTTGAA

1401  AAAACAAGGT TTCCCATTAT GA
```

This corresponds to the amino acid sequence <SEQ ID 2414; ORF 717.ng>:

```
g717.pep
  1  MDTKEILGYA AGSIGSAVLA VIILPLLSWY FPADDIGRIV LMQTAAGLTV

51  SVLCLGLDQA YVREYYAAAD KDTLFKTLFL PPLLFSAAIA ALLLSRPSLP

101  SEILFSLDDA AAGIGLVLFE LSFLPIRFLL LVLRMEGRAL AFSSAQLVPK

151  LAILLLLPLT VGLLHFPANT SVLTAVYALA NLAAAAFLLF QNRCRLKAVR

201  RAPFSPAVLH RGLRYGIPLA LSSLAYWGLA SADRLFLKKY AGLEQLGVYS

251  MGISFGGAAL LLQSIFSTVW TPYIFRAIEE NATPARLSAT AESAAALLAS

301  ALCLTGIFSP LASLLLPENY AAVRFTVVSC MLPPLFYTLT EISGIGLNVV

351  RKTRPIALAT LGALAANLLL LGLAVPSGGT RGAAVACAAS FWLFFVFKTE

401  SSCRLWQPLK RLPLYMHTLF CLASSAAYTC FGTPANYPLF AGVWAAYLAG

451  CILRHRKNLH KLFHYLKKQG FPL*
```

The following partial DNA sequence was identified in *N. meningitidis* <SEQ ID 2415>:

```
m717.seq
  1  ATGGACACAA AAGAAATCCT CGGCTACGCG GCAGGCTCGA TCGGCAGCGC

51  GGTTTTAGCC GTCATCATCC TGCCGCTGCT GTCGTGGTAT TTCCCCGCCG

101  ACGACATCGG GCGCATCGTG CTGATGCAGA CGGCGGCGGG GCTGACGGTG

151  TCGGTGTTGT GCCTCGGGCT GGATCAGGCA TACGTCCGCG AATACTATGC

201  CACCGCCGAC AAAGACACCT TGTTCAAAAC CCTGTTCCTG CCGCCGCTGC

251  TGTCTGCCGC CGCGATAGCC GCCCTGCTGC TTTCCCGCCC GTCCCTGCCG

301  TCTGAAATCC TGTTTTCACT CGACGATGCC GCCGCCGGCA TCGGGCTGGT

351  GCTGTTTGAA CTGAGCTTCC TGCCCATCCG CTTTCTCTTA CTGGTTTTGC

401  GTATGGAAGG ACGCGCCCTT GCCTTTTCGT CCGCGCAACT CGTGCCCAAG
```

```
 451 CTCGCCATCC TGCTGCTGCT GCCGCTGACG GTCGGGCTGC TGCACTTTCC

501 AGCGAACACC GCCGTCCTGA CCGCCGTTTA CGCGCTGGCA AACCTTGCCG

551 CCGCCGCCTT TTTGCTGTTT CAAAACCGAT GCCGTCTGAA GGCCGTCCGG

601 CACGCACCGT TTTCGCCCGC CGTCCTGCAC CGGGGGCTGC GCTACGGCAT

651 ACCGATCGCA CTGAGCAGCA TCGCCTATTG GGGGCTGGCA TCCGCCGACC

701 GTTTGTTCCT GAAAAAATAT GCCGGCCTGG AACAGCTCGG CGTTTATTCG

751 ATGGGTATTT CGTTCGGCGG GGCGGCATTA TTGTTCCAAA GCATCTTTTC

801 AACGGTCTGG ACACCGTATA TTTTCCGCGC AATCGAAGAA AACGCCCCGC

851 CCGCCCGCCT CTCGGCAACG GCAGAATCCG CCGCCGCCCT GCTTGCCTCC

901 GCCCTCTGCC TGACCGGCAT TTTCTCGCCC CTTGCCTCCC TCCTGCTGCC

951 GGAAAACTAC GCCGCCGTCC GGTTTATCGT CGTATCGTGT ATGCTGCCGC

1001 CGCTGTTTTG CACGCTGGCG GAAATCAGCG GCATCGGTTT GAACGTCGTC

1051 CGCAAAACGC GCCCGATCGC GCTCGCCACC TTGGGCGCGC TGGCGGCAAA

1101 CCTGCTGCTG CTGGGGCTTG CCGTGCCGTC CGGCGGCGCG CGCGGCGCGG

1151 CGGTTGCCTG TGCCGCCTCA TTCTGGCTGT TTTTTGCCTT CAAGACCGAA

1201 AGCTCCTGCC GCCTGTGGCA GCCGCTCAAA CGCCTGCCGC TTTATCTGCA

1251 CACATTGTTC TGCCTGACCT CCTCGGCGGC CTACACCTGC TTCGGCACGC

1301 CGGCAAACTA TCCCCTGTTT GCCGGCGTAT GGGCGGCATA TCTGGCAGGC

1351 TGCATCCTGC GCCACCGGAA AGATTTGCAC AAACTGTTTC ATTATTTGAA

1401 AAAACAAGGT TTCCCATTAT GA
```

This corresponds to the amino acid sequence <SEQ ID 2416; ORF 717>:

```
m717.pep

1  MDRKEILGYA AGSIGSAVLA VIILPLLSWY FPADDIGRIV LMQTAAGLTV

51  SVLCLGLDQA YVREYYATAD KDTLFKTLFL PPLLSAAAIA ALLLSRPSLP

101  SEILFSLDDA AAGIGLVLFE LSFLPORFLL LVLRMEGRAL AFSSAQLVPK

151  LAILLLLPLT VGLLHFPANT AVLTAVYALA NLAAAAFLLF QNRCRLKAVR

201  HAPFSPAVLH RGLRYGIPIA LSSIAYWGLA SADRLFLKKY AGLEQLGVYS

251  MGISFGGAAL LFQSIFSTVW TPYIFRAIEE NAPPARLSAT AESAAALLAS

301  ALCLTGIFSP LASLLLPENY AAVRFIVVSC MLPPLFCTLA EISGIGLNVV

351  RKTRPIALAT LGALAANLLL LGLAVPSGGA RGAAVACAAS FWLFFAFKTE

401  SSCRLWQPLK RLPLYLHTLE CLTSSAAYTC FGTPANYPLF AGVWAAYLAG

451  CILRHRKDLH KLFHYLKKQG FPL* m717/g717 96.4% identity in 473 aa overlap 10         20         30         40         50         60
m717.pep  MDTKEILGYAAGSIGSAVLAVIILPLLSWYFPADDIGRIVLMQTAAGLTVSVLCLGLDQA
          |||||||||||||||||||||||||||||||||||||||||||||||||   |||||||
g717      MDTKEILGYAAGSIGSAVLAVIILPLLSWYFPADDIGRIVLMQTAAGLTVSVLCLGLDQA
                10         20         30         40         50         60

70         80         90        100        110        120
m717.pep  YVREYYATADKDTLFKTLFLPPLLSAAAIAALLLSRPSLPSEILFSLDDAAAGIGLVLFE
          ||||||| ||||||||||||||||||| ||||||||||||||||||||||||||||||||
g717      YVREYYAAADKDTLFKTLFLPPLLSAAIAALLLSRPSLPSEILFSLDDAAAGIGLVLFE
                70         80         90        100        110        120
```

```
              130        140        150        160        170        180
m717.pep   LSFLPIRFLLLVLRMEGRALAFSSAQLVPKLAILLLLPLTVGLLHFPANTAVLTAVYALA
           ||||||||||||||||||||||||||||||||||||||||||||||:|||||||||||
g717       LSFLPIRFLLLVLRMEGRALAFSSAQLVPKLAILLLLPLTVGLLHFPANTSVLTAVYALA
              130        140        150        160        170        180

190        200        210        220        230        240
m717.pep   NLAAAAFLLFQNRCRLKAVRHAPFSPAVLHRGLRYGIPIALSSIAYWGLASADRLFLKKY
           ||||||||||||||||||||||:||||||||||||||||||:||||:|||||||||||||
g717       NLAAAAFLLFQNRCRLKAVRRAPFSPAVLHRGLRYGIPLALSSLAYWGLASADRLFLKKY
              190        200        210        220        230        240

250        260        270        280        290        300
m717.pep   AGLEQLGVYSMGISFGGAALLFQSIFSTVWTPYIFRAIEENAPPARLSATAESAAALLAS
           ||||||||||||||||||||||:|||||||||||||||||||||:||||||:||||||||
g717       AGLEQLGVYSMGISFGGAALLLQSIFSTVWTPYIFRAIEENATPARLSAESAAALLAS
              250        260        270        280        290        300

310        320        330        340        350        360
m717.pep   ALCLTGIFSPLASLLLPENYAAVRFIVVSCMLPPLFCTLAEISGIGLNVVRKTRPIALAT
           |||||||||||||||||||||||||||:|||||||||||||||:||||||||||||||||
g717       ALCLTGIFSPLASLLLPENYAAVRFTVVSCMLPPLFYTLTEISGIGLNVVRKTRPIALAT
              310        320        330        340        350        360

370        380        390        400        410        420
m717.pep   LGALAANLLLLGLAVPSGGARGAAVACAASFWLFFAFKTESSCRLWQPLKRLPLYLHTLF
           ||||||||||||||||||||:||||||||||||||:|||||||||||||||||||:||||
g717       LGALAANLLLLGLAVPSGGTRGAAVACAASFWLFFVFKTESSCRLWQPLKRLPLYMHTLF
              370        380        390        400        410        420

430        440        450        460        470
m717.pep   CLTSSAAYTCFGTPANYPLFAGVWAAYLAGCILRHRKDLHKLFHYLKKQGFPLX
           ||:||||||||||||||||||||||||||||||||||:|||||||||||||||
g717       CLASSAAYTCFGTPANYPLFAGVWAAYLAGCILRHRKNLHKLFHYLKKQGFPLX
              430        440        450        460        470
```

The following partial DNA sequence was identified in *N. meningitidis* <SEQ ID 2417>:

```
a717.seq
   1  ATGGACACAA AAGAAATCCT CGGCTACGCG GCAGGCTCGA TCGGCAGCGC

51  GGTTTTAGCC GTCATCATCC TGCCGCTGCT GTCGTGGTAT TTCCCTGCCG

101  ACGACATCGG ACGCATCGTG CTGATGCAGA CGGCGGCGGG GCTGACGGTG

151  TCGGTGTTGT GCCTCGGGCT GGATCAGGCA TACGTCCGCG AATACTATGC

201  CGCCGCCGAC AAAGACACTT TGTTCAAAAC CCTGTTCCTG CCGCCGCTGC

251  TGTCTGCCGC CGCGATAGCC GCCCTGCTGC TTTTCCGCGC ATCCCTGCCG

301  TCTGAAATCC TGTTTTCGCT CGACGATGCC GCCGCCGGCA TCGGGCTGGT

351  GCTGTTTGAA CTGAGCTTCC TGCCCATCCG CTTTCTCTTA CTGGTTTTGC

401  GTATGGAAGG ACGCGCCCTT GCCTTTTCGT CCGCGCAACT CGTGTCCAAG

451  CTCGCCATCC TGCTGCTGCT GCCGCTGACG GTCGGGCTGC TGCACTTTCC

501  GGCGAACACC GCCGTCCTGA CCGCCGTTTA CGCGCTGGCA AACCTTGCCG

551  CCGCCGCCTT TTTGCTGTTT CAAAACCGAT GCCGTCTGAA GGCCGTCCGG

601  CGCGCACCGT TTTCATCCGC CGTCCTGCAT CGCGGCCTGC GCTACGGCAT

651  ACCGATCGCA CTAAGCAGCA TCGCCTATTG GGGGCTGGCA TCCGCCGACC

701  GTTTGTTCCT GAAAAAATAT GCCGGCCTAG AACAGCTCGG CGTTTATTCG

751  ATGGGTATTT CGTTCGGCGG AGCGGCATTA TTGTTCCAAA GCATCTTTTC

801  AACGGTCTGG ACACCGTATA TTTTCCGCGC AATCGAAGCA AACGCCCCGC

851  CCGCCCGCCT CTCGGCAACG GCAGAATCCG CCGCCGCCTT GCTTGCCTCC

901  GCCCTCTGCC TGACCGGCAT TTTCTCGCCC CTCGCCTCCC TCCTGCTGCC

951  GGAAAACTAC GCCGCCGTCC GGTTTATCGT CGTATCGTGT ATGCTGCCTC

1001  CGCTGTTTTG CACGCTGGTA GAAATCAGCG GCATCGGTTT GAACGTCGTC
```

-continued

```
1051 CGAAAAACAC GCCCGATCGC GCTCGCCACC TTGGGCGCGC TGGCGGCAAA

1101 CCTGCTGCTG CTGGGGCTTG CCGTACCGTC CGGCGGCGCG CGCGGCGCGG

1151 CGGTTGCCTG TGCCGCCTCA TTTTGGCTGT TTTTTGTTTT CAAGACCGAA

1201 AGCTCCTGCC GCCTGTGGCA GCCGCTCAAA CGCCTGCCGC TTTATATGCA

1251 CACATTGTTC TGCCTGGCCT CCTCGGCGGC CTACACCTGC TTCGGCACTC

1301 CGGCAAACTA CCCCCTGTTT GCCGGCGTAT GGGCGGTATA TCTGGCAGGC

1351 TGCATCCTGC GCCACCGGAA AGATTTGCAC AAACTGTTTC ATTATTTGAA

1401 AAAACAAGGT TTCCCATTAT GA
```

This corresponds to the amino acid sequence <SEQ ID 2418; ORF 717.a>:

```
a717.pep
  1 MDTKEILGYA AGSIGSAVLA VIILPLLSWY FPADDIGRIV LMQTAAGLTV

51 SVLCLGLDQA YVREYYAAAD KDTLFKTLFL PPLLSAAAIA ALLLSRPSLP

101 SEILFSLDDA AAGIGLVLFE LSFLPIRFLL LVLRMEGRAL AFSSAQLVSK

151 LAILLLLPLT VGLLHFPANT AVLTAVYALA NLAAAAFLLF QNRCRLKAVR

201 RAPFSSAVLH RGLRYGIPIA LSSIAYWGLA SADRLFLKKY AGLEQLGVYS

251 MGISFGGAAL LFQSIFSTVW TPYIFRAIEA NAPPARLSAT AESAAALLAS

301 ALCLTGIFSP LASLLLPENY AAVRFIVVSC MLPPLFCTLV EISGIGLNVV

351 RKTRPIALAT LGALAANLLL LGLAVPSGGA RGAAVACAAS FWLFFVFKTE

401 SSCRLWQPLK RLPLYMHTLF CLASSAAYTC FGTPANYPLF AGVWAVYLAG

451 CILRHRKDLH KLFHYLKKQG FPL*
``` a717/m717 97.9% identity in 473 aa overlap

```
                    10         20         30         40         50         60
     a717.pep MDTKEILGYAAGSIGSAVLAVIILPLLSWYFPADDIGRIVLMQTAAGLTVSVLCLGLDQA
             ||||||||||||||||||||||||||||||||||||||||||||||||||||||||||||
        m717 MDTKEILGYAAGSIGSAVLAVIILPLLSWYFPADDIGRIVLMQTAAGLTVSVLCLGLDQA
                    10         20         30         40         50         60

70         80         90        100        110        120
     a717.pep YVREYYAAADKDTLFKTLFLPPLLSAAAIAALLLSRPSLPSEILFSLDDAAAGIGLVLFE
             |||||||:||||||||||||||||||||||||||||||||||||||||||||||||||||
        m717 YVREYYATADKDTLFKTLFLPPLLSAAAIAALLLSRPSLPSEILFSLDDAAAGIGLVLFE
                    70         80         90        100        110        120

130        140        150        160        170        180
     a717.pep LSFLPIRFLLLVLRMEGRALAFSSAQLVSKLAILLLLPLTVGLLHFPANTAVLTAVYALA
             ||||||||||||||||||||||||||||||:|||||||||||||||||||||||||||||
        m717 LSFLPIRFLLLVLRMEGRALAFSSAQLVPKLAILLLLPLTVGLLHFPANTAVLTAVYALA
                   130        140        150        160        170        180

190        200        210        220        230        240
     a717.pep NLAAAAFLLFQNRCRLKAVRRAPFSSAVLHRGLRYGIPIALSSIAYWGLASADRLFLKKY
             |||||||||||||||||||||:||||||:|||||||||||||||||||||||||||||||
        m717 NLAAAAFLLFQNRCRLKAVRHAPFSPAVLHRGLRYGIPIALSSIAYWGLASADRLFLKKY
                   190        200        210        220        230        240

250        260        270        280        290        300
     a717.pep AGLEQLGVYSMGISFGGAALLFQSIFSTVWTPYIFRAIEANAPPARLSATAESAAALLAS
             ||||||||||||||||||||||||||||||||||||||||:|||||||||||||||||||
        m717 AGLEQLGVYSMGISFGGAALLFQSIFSTVWTPYIFRAIEENAPPARLSATAESAAALLAS
                   250        260        270        280        290        300

310        320        330        340        350        360
     a717.pep ALCLTGIFSPLASLLLPENYAAVRFIVVSCMLPPLFCTLVEISGIGLNVVRKTRPIALAT
             ||||||||||||||||||||||||||||||||||||||:|||||||||||||||||||||
        m717 ALCLTGIFSPLASLLLPENYAAVRFIVVSCMLPPLFCTLAEISGIGLNVVRKTRPIALAT
                   310        320        330        340        350        360
```

-continued

```
                 370        380        390        400        410        420
a717.pep   LGALAANLLLLGLAVPSGGARGAAVACAASFWLFFVFKTESSCRLWQPLKRLPLYMHTLF
           ||||||||||||||||||||||||||||||||||||:|||||||||||||||||||:||||
m717       LGALAANLLLLGLAVPSGGARGAAVACAASFWLFFAFKTESSCRLWQPLKRLPLYLHTLF
                 370        380        390        400        410        420

430        440        450        460        470
a717.pep   CLASSAAYTCFGTPANYPLFAGVWAVYLAGCILRHRKDLHKLFHYLKKQGFPLX
           ||:|||||||||||||||||||||||:|||||||||||||||||||||||||||
m717       CLTSSAAYTCFGTPANYPLFAGVWAAYLAGCILRHRKDLHKLFHYLKKQGFPLX
                 430        440        450        460        470 g718.seq  not found yet g718.sep  not found yet
```

The following partial DNA sequence was identified in *N. meningitidis* <SEQ ID 2419>:

```
m718.seq
   1 TCAGACGGCC TTTACGTACC CCGAAACTTT ATCCACCGCC CGCAAAGCTG

51 GTTCAAATGG GACAAAGACA ACGGGCTGCT GCTGCGTACC CGCGAAAATC

101 CGGAAGGCGA AGCGTTGTGG CCGCTGGGCT GGGTCGTTCA TACCCAAAAA

151 TCGCGCAGCG TCCAGCAGGC GCGCAACGGG CTTTTCCGCA CGCTTTCCTG

201 GCTGTATATG TTCAAACACT ACGCCGTCCA CGATTTTGCC GAGTTTTTGG

251 AGCTGTACGG CATGCCCATC CGTATCGGCA AATACGGCGC GGGCGCAACC

301 AAAGAGGAAA AAAACACCCT GCTTCGAGCG GTGGCGGAAA TCGGTCACAA

351 CGCGGCAGGC ATCATGCCAG AAGGTATGGA AATAGAGCTC CACAACGCGG

401 CAAACGGTAC GACGGCAACC AGCAATCCGT TTTTGCAGAT GGCCGACTGG

451 TGCGAAAAAT CGGCGGCGCG GCTGATTTTG GGGCAAACGC TGACCAGCGG

501 TGCGGACGGA AAATCCAGCA CCAACGCGCT GGGCAATATC CACAACGAGG

551 TACGCCGCGA TTTGCTGGTG TCGGACGCAA AACAGGTGGC GCAAACCATC

601 ACAAGCCAAA TCATCGGACC GTTCCTGCAA ATCAACTATC CCCATGCCGA

651 CCCAAACCGC GTGCCGAAAT TTGAATTTGA CACGCGCGAG CCGAAAGACA

701 TCGCGGTCTT TGCCGACGCT ATCCCGAAAC TGGTGGATGT CGGCGTACAA

751 ATCCCCGAAA GCTGGGTGCG CGACAAACTG GTCATTCCAG ATGTGCAGGA

801 GGGTGAGGCT GTGTTGGTGC GGCAGGTACC GGACAATCCG GTAAACAGAA

851 CTGCATTGGC GGCTTTATCC GCCCACACCG TACCATCTAA GGCTACGGGC

901 AGGCATCAGG AAATATTGGA CGGCGCGTTG GATGACGCGC TGGTTGAGCC

951 CGATTTCAAT TCTCAGCTCA ACCCGATGGT GCGTCAGGCG GTTGCCGCAC

1001 TTAATGCTTG CAACAGCTAC GAGGAGGCAG ATGCCGCACT GAATGCGCTT

1051 TATCCGAATT TGGACAACGC GAAACTGCGT ACCTATATGC AGCAGGCCTT

1101 GTTTATCAGC GATATTTTGG GACAAGACCA TGCCCGCGCC TGA
```

This corresponds to the amino acid sequence <SEQ ID 2420; ORF 718>:

```
m718.pep
   1 SDGLYVPRNF IHRPQSWFKW DKDNGLLLRT RENPEGEALW PLGWVVHTQK

51 SRSVQQARNG LFRTLSWLYM FKHYAVHDFA EFLELYGMPI RIGKYGAGAT

101 KEEKNTLLRA VAEIGHNAAG IMPEGMEIEL HNAANGTTAT SNPFLQMADW

151 CEKSAARLIL GQTLTSGADG KSSTNALGNI HNEVRRDLLV SDAKQVAQTI
```

-continued

```
201 TSQIIGPFLQ INYPHADPNR VPKFEFDTRE PKDIAVFADA IPKLVDVGVQ

251 IPESWVRDKL VIPDVQEGEA VLVRQVPDNP VNRTALAALS AHTVPSKATG

301 RHQEILDGAL DDALVEPDFN SQLNPMVRQA VAALNACNSY EEADAALNAL

351 YPNLDNAKLR TYMQQALFIS DILGQDHARA *
```

The following partial DNA sequence was identified in *N. meningitidis* <SEQ ID 2421>:

```
a718.seq
   1 ATGGAGCCGA TAATGGCAAA AAAGAACAAT AAAACTAAAA TCCAAAAGCC
  51 CGAAGCTGCA TTGCAGACGG ACGTGGCTCA AATTACAGCG ACCGGTCGAG
 101 TTATCGCCGA GCATCCATCC AATTTTATTA CGCCGCAAAA GATGCGCGCC
 151 CTCTTCGAGG ACGCAGAAAG CGGTGACATC CGCGCCCAAC ACGAGCTTTT
 201 CGCGGACATT GAGGAGCGCG ACAGCGACAT CGCGGCAAAT ATGGGGACGC
 251 GCAAACGCGC GCTGCTGACG CTCAACTGGC GCGTCGCCCC GCCGCGAAAT
 301 GCGACGCCCG AAGAAGAAAA GCTGTCCGAC CAAGCCTACG AAATGATGGA
 351 CAGCCTGCCT ACCCTCGAAG ACCTGATTAT GGATTTGATG GACGCGGTAG
 401 GGCACGGATT TTCTGCGTTG GAGGTCGAGT GGGTATTTTC AGACGGCCTT
 451 TACCTACCCC GAAACTTTAT CCACCGCCCG CAAAGCTGGT TCAAATGGGA
 501 CAAAGACAAC GGGCTGCTGC TGCGTACCCG CGAAAATCCG GAAGGCGAAG
 551 CGTTGTGGCC GCTGGGCTGG GTCGTTCATA CCCAAAAATC GCGCAGCGTC
 601 CAGCAGGCGC GCAACGGGCT TTTCCGCACG CTTTCCTGGC TGTATATGTT
 651 CAAACACTAC GCCGTCCACG ATTTTGCCGA GTTTTTGGAG CTGTACGGCA
 701 TGCCCATCCG TATCGGCAAA TACGGCGCGG GCGCAACCAA AGAGGAAAAA
 751 AACACCCTGC TTCGAGCGGT GGCGGAAATC GGTCACAACG CGGCAGGCAT
 801 CATGCCAGAA GGTATGGAAA TCGAGCTGCA CAACGCGGCA AACGGCATGA
 851 CTTCCGCCGG CAATCCGTTT TTGCAGATGG CCGACTGGTG CGAAAAATCG
 901 GCGGCGCGGC TGATTTTGGG GCAAACGCTA ACCAGCGGTG CGGACGGAAA
 951 ATCCAGCACC AACGCGCTGG GCAATATCCA CAACGAGATA CGCCGCGATT
1001 TGCTGGTGTC GGACGCAAAA CAGGTGGCGC AAACCATCAC AAGCCAAATC
1051 ATCGGACCGT TCCTGCAAAT CAACTATCCC CATGCCGACC CAAACCGCGT
1101 GCCGAAATTT GAATTTGACA CGCGCGAGCC GAAAGACATC GCGGTCTTTG
1151 CCGACGCTAT CCCGAAACTG GTGGATGTCG GCGTACAAAT CCCCGAAAGC
1201 TGGGTGCGCG ACAAACTGGT CATTCCAGAT GTGCAGGAGG GTGAGGCTGT
1251 GTTGGTGCGG CAGGTACCGG ACAATCCGGT AAACAGAACT GCATTGGCGG
1301 CTTTATCCGC CCACACCGTA CCATCTAAGG CTACGGGCAG GCATCAGGAA
1351 ATATTGGACG GCGCGTTGGA TGACGCGCTG GTTGAGCCCG ATTTCAATTC
1401 TCAGCTCAAC CCGATGGTGC GTCAGGCGGT TGCCGCACTT AATGCTTGCA
1451 ACAGCTACGA GGAGGCAGAT GCCGCACTGA ATGCGCTTTA TCCGAATTTG
1501 GACAACGCGA AACTGCGTAC CTATATGCAG CAGGCCTTGT TTATCAGCGA
1551 TATTTTGGGA CAAGACCATG CCCGCGCCTG A
```

This corresponds to the amino acid sequence <SEQ ID 2422; ORF 718.a>:

```
a718.pep
   1 MEPIMAKKNN KTKIQKPEAA LQTDVAQITA TGRVIAEHPS NFITPQKMRA

51 LFEDAESGDI RAQHELFADI EERDSDIAAN MGTRKRALLT LNWRVAPPRN

101 ATPEEEKLSD QAYEMMDSLP TLEDLIMDLM DAVGHGFSAL EVEWVFSDGL

151 YLPRNFIHRP QSWFKWDKDN GLLLRTRENP EGEALWPLGW VVHTQKSRSV

201 QQARNGLFRT LSWLYMFKHY AVHDFAEFLE LYGMPIRIGK YGAGATKEEK

251 NTLLRAVAEI GHNAAGIMPE GMEIELHNAA NGMTSAGNPF LQMADWCEKS

301 AARLILGQTL TSGADGKSST NALGNIHNEI RRDLLVSDAK QVAQTITSQI

351 IGPFLQINYP HADPNRVPKF EFDTREPKDI AVFADAIPKL VDVGVQIPES

401 WVRDKLVIPD VQEGEAVLVR QVPDNPVNRT ALAALSAHTV PSKATGRHQE

451 ILDGALDDAL VEPDFNSQLN PMVRQAVAAL NACNSYEEAD AALNALYPNL

501 DNAKLRTYMQ QALFISDILG QDHARA*
``` a718/m718 98.4% identity in 380 aa overlap

```
                    120        130        140        150        160        170
        a718.pep    DSLPTLEDLIMDLMDAVGHGFSALEVEWVFSDGLYLPRNFIHRPQSWFKWDKDNGLLLRT
                                              |||| :||||||||||||||||||||||||||
        m718                                  SDGLYVPRNFIHRPQSWFKWDKDNGLLLRT
                                                       10         20         30
                    180        190        200        210        220        230
        a718.pep    RENPEGEALWPLGWVVHTQKSRSVQQARNGLFRTLSWLYMFKHYAVHDFAEFLELYGMPI
                    ||||||||||||||||||||||||||||||||||||||||||||||||||||||||||||
        m718        RENPEGEALWPLGWVVHTQKSRSVQQARNGLFRTLSWLYMFKHYAVHDFAEFLELYGMPI
                         40         50         60         70         80         90
                    240        250        260        270        280        290
        a718.pep    RIGKYGAGATKEEKNTLLRAVAEIGHNAAGIMPEGMEIELHNAANGMTSAGNPFLQMADW
                    |||||||||||||||||||||||||||||||||||||||||||||||| :::|||||||
        m718        RIGKYGAGATKEEKNTLLRAVAEIGHNAAGIMPEGMEIELHNAANGTTATSNPFLQMADW
                            100        110        120        130        140        150
                    300        310        320        330        340        350
        a718.pep    CEKSAARLILGQTLTSGADGKSSTNALGNIHNEIRRDLLVSDAKQVAQTITSQIIGPFLQ
                    |||||||||||||||||||||||||||||||||| :||||||||||||||||||||:||
        m718        CEKSAARLILGQTLTSGADGKSSTNALGNIHNEVRRDLLVSDAKQVAQTITSQIIGPGLQ
                            160        170        180        190        200        210
                    360        370        380        390        400        410
        a718.pep    INYPHADPNRVPKFEFDTREPKDIAVFADAIPKLVDVGVQIPESWVRDKLVIPDVQEGEA
                    ||||||||||||||||||||||||||||||||||||||||||||||||||||||||||||
        m718        INYPHADPNRVPKFEFDTREPKDIAVFADAIPKLVDVGVQIPESWVRDKLVIPDVQEGEA
                            220        230        240        250        260        270
                    420        430        440        450        460        470
        a718.pep    VLVRQVPDNPVNRTALAALSAHTVPSKATGRHQEILDGALDDALVEPDFNSQLNPMVRQA
                    ||||||||||||||||||||||||||||||||||||||||||||||||||||||||||||
        m718        VLVRQVPDNPVNRTALAALSAHTVPSKATGRHQEILDGALDDALVEPDFNSQLNPMVRQA
                            280        290        300        310        320        330
                    480        490        500        510        520
        a718.pep    VAALNACNSYEEADAALNALYPNLDNAKLRTYMQQALFISDILGQDHARAX
                    |||||||||||||||||||||||||||||||||||||||||||||||||||
        m718        VAALNACNSYEEADAALNALYPNLDNAKLRTYMQQALFISDILGQDHARAX
                            340        350        360        370        380
```

The following partial DNA sequence was identified in *N. meningitidis* <SEQ ID 2423>:

```
m718-1.seq
   1 ATGGAGCCGA TAATGGCAAA AAAGAACAAT AAAACTAAAA TCCAAAAGCC

51 CGAAGCTGCA TTGCAGACGG ACGTGGCTCA AATTACGGCG ACCGGTCGGG

101 TTATCGCCGA GCATCCGTCC AATTTTATTA CGCCGCAAAA GATGCGGGCC

151 CTCTTCGAGG ACGCAGAAAG CGGCGACATC CGCGCCCAAC ACGAGCTTTT
```

-continued

```
 201 CGCGGACATT GAGGAGCGCG ACAGCGACAT CGCGGCAAAT ATGGGGACGC

251 GCAAACGCGC GCTGCTGACG CTCAACTGGC GCGTCGCCCC GCCGCGAAAT

301 GCGACGCCCG AAGAAGAAAA GCTGTCCGAC CAAGCCTACG AAATGATGGA

351 CAGCCTGCCT ACCCTCGAAG ACCTGATTAT GGATTTGATG GACGCGGTAG

401 GGCACGGATT TTCTGCGTTG GAGGTCGAGT GGGTATTTTC AGACGGCCTT

451 TACCTACCCC GAAACTTTAT CCACCGCCCG CAAAGCTGGT TCAAATGGGA

501 CAAAGACAAC GGGCTGCTGC TGCGTACCCG CGAAAATCCG GAAGGCGAAG

551 CGTTGTGGCC GCTGGGCTGG GTCGTTCATA CCCAAAAATC GCGCAGCGTC

601 CAGCAGGCGC GCAACGGGCT TTTCCGCACG CTTTCCTGGC TGTATATGTT

651 CAAACACTAC GCCGTCCACG ATTTTGCCGA GTTTTTGGAG CTGTACGGCA

701 TGCCCATCCG TATCGGCAAA TACGGCGCGG GCGCAACCAA AGAGGAAAAA

751 AACACCCTGC TTCGAGCGGT GGCGGAAATC GGTCACAACG CGGCAGGCAT

801 CATGCCAGAA GGTATGGAAA TAGAGCTCCA CAACGCGGCA AACGGTACGA

851 CGGCAACCAG CAATCCGTTT TTGCAGATGG CCGACTGGTG CGAAAAATCG

901 GCGGCGCGGC TGATTTTGGG GCAAACGCTG ACCAGCGGTG CGGACGGAAA

951 ATCCAGCACC AACGCGCTGG GCAATATCCA CAACGAGGTA CGCCGCGATT

1001 TGCTGGTGTC GGACGCAAAA CAGGTGGCGC AAACCATCAC AAGCCAAATC

1051 ATCGGACCGT TCCTGCAAAT CAACTATCCC CATGCCGACC CAAACCGCGT

1101 GCCGAAATTT GAATTTGACA CGCGCGAGCC GAAAGACATC GCGGTCTTTG

1151 CCGACGCTAT CCCGAAACTG GTGGATGTCG GCGTACAAAT CCCCGAAAGC

1201 TGGGTGCGCG ACAAACTGGT CATTCCAGAT GTGCAGGAGG GTGAGGCTGT

1251 GTTGGTGCGG CAGGTACCGG ACAATCCGGT AAACAGAACT GCATTGGCGG

1301 CTTTATCCGC CCACACCGTA CCATCTAAGG CTACGGGCAG GCATCAGGAA

1351 ATATTGGACG GCGCGTTGGA TGACGCGCTG GTTGAGCCCG ATTTCAATTC

1401 TCAGCTCAAC CCGATGGTGC GTCAGGCGGT TGCCGCACTT AATGCTTGCA

1451 ACAGCTACGA GGAGGCAGAT GCCGCACTGA ATGCGCTTTA TCCGAATTTG

1501 GACAACGCGA AACTGCGTAC CTATATGCAG CAGGCCTTGT TTATCAGCGA

1551 TATTTTGGGA CAAGACCATG CCCGCGCCTG A
```

This corresponds to the amino acid sequence <SEQ ID 2424; ORF 718-1>:

```
m718-1.pep.
  1 MEPIMAKKNN KTKIQKPEAA LQTDVAQITA TGRVIAEHPS NFITPQKMRA

51 LFEDAESGDI RAQHELFADI EERDSDIAAN MGTRKRALLT LNWRVAPPRN

101 ATPEEEKLSD QAYEMMDSLP TLEDLIMDLM DAVGHGFSAL EVEWVFSDGL

151 YLPRNFIHRP QSWFKWDKDN GLLLRTRENP EGEALWPLGW VVHTQKSRSV

201 QQARNGLFRT LSWLYMFKHY AVHDFAEFLE LYGMPIRIGK YGAGATKEEK

251 NTLLRAVAEI GHNAAGIMPE GMEIELHNAA NGTTATSNPF LQMADWCEKS

301 AARLILGQTL TSGADGKSST NALGNIHNEV RRDLLVSDAK QVAQTITSQI

351 IGPFLQINYP HADPNRVPKF EFDTREPKDI AVFADAIPKL VDVGVQIPES

401 WVRDKLVIPD VQEGEAVLVR QVPDNPVNRT ALAALSAHTV PSKATGRHQE
```

-continued
```
451 ILDGALDDAL VEPDFNSQLN PMVRQAVAAL NACNSYEEAD AALNALYPNL

501 DNAKLRTYMQ QALFISDILG QDHARA*
```

The following partial DNA sequence was identified in *N. meningitidis* <SEQ ID 2425>:

```
a718.seq
   1 ATGGAGCCGA TAATGGCAAA AAGAACAAT AAAACTAAAA TCCAAAAGCC

51 CGAAGCTGCA TTGCAGACGG ACGTGGCTCA AATTACAGCG ACCGGTCGAG

101 TTATCGCCGA GCATCCATCC AATTTTATTA CGCCGCAAAA GATGCGCGCC

151 CTCTTCGAGG ACGCAGAAAG CGGTGACATC CGCGCCCAAC ACGAGCTTTT

201 CGCGGACATT GAGGAGCGCG ACAGCGACAT CGCGGCAAAT ATGGGGACGC

251 GCAAACGCGC GCTGCTGACG CTCAACTGGC GCGTCGCCCC GCCGCGAAAT

301 GCGACGCCCG AAGAAGAAAA GCTGTCCGAC CAAGCCTACG AAATGATGGA

351 CAGCCTGCCT ACCCTCGAAG ACCTGATTAT GGATTTGATG GACGCGGTAG

401 GGCACGGATT TTCTGCGTTG GAGGTCGAGT GGGTATTTTC AGACGGCCTT

451 TACCTACCCC GAAACTTTAT CCACCGCCCG CAAAGCTGGT TCAAATGGGA

501 CAAAGACAAC GGGCTGCTGC TGCGTACCCG CGAAAATCCG GAAGGCGAAG

551 CGTTGTGGCC GCTGGGCTGG GTCGTTCATA CCCAAAAATC GCGCAGCGTC

601 CAGCAGGCGC GCAACGGGCT TTTCCGCACG CTTTCCTGGC TGTATATGTT

651 CAAACACTAC GCCGTCCACG ATTTTGCCGA GTTTTTGGAG CTGTACGGCA

701 TGCCCATCCG TATCGGCAAA TACGGCGCGG GCGCAACCAA AGAGGAAAAA

751 AACACCCTGC TTCGAGCGGT GGCGGAAATC GGTCACAACG CGGCAGGCAT

801 CATGCCAGAA GGTATGGAAA TCGAGCTGCA CAACGCGGCA AACGGCATGA

851 CTTCCGCCGG CAATCCGTTT TTGCAGATGG CCGACTGGTG CGAAAAATCG

901 GCGGCGCGGC TGATTTTGGG GCAAACGCTA ACCAGCGGTG CGGACGGAAA

951 ATCCAGCACC AACGCGCTGG GCAATATCCA CAACGAGATA CGCCGCGATT

1001 TGCTGGTGTC GGACGCAAAA CAGGTGGCGC AAACCATCAC AAGCCAAATC

1051 ATCGGACCGT TCCTGCAAAT CAACTATCCC CATGCCGACC CAAACCGCGT

1101 GCCGAAATTT GAATTTGACA CGCGCGAGCC GAAAGACATC GCGGTCTTTG

1151 CCGACGCTAT CCCGAAACTG GTGGATGTCG GCGTACAAAT CCCCGAAAGC

1201 TGGGTGCGCG ACAAACTGGT CATTCCAGAT GTGCAGGAGG GTGAGGCTGT

1251 GTTGGTGCGG CAGGTACCGG ACAATCCGGT AAACAGAACT GCATTGGCGG

1301 CTTTATCCGC CCACACCGTA CCATCTAAGG CTACGGGCAG GCATCAGGAA

1351 ATATTGGACG GCGCGTTGGA TGACGCGCTG GTTGAGCCCG ATTTCAATTC

1401 TCAGCTCAAC CCGATGGTGC GTCAGGCGGT TGCCGCACTT AATGCTTGCA

1451 ACAGCTACGA GGAGGCAGAT GCCGCACTGA ATGCGCTTTA TCCGAATTTG

1501 GACAACGCGA AACTGCGTAC CTATATGCAG CAGGCCTTGT TTATCAGCGA

1551 TATTTTGGGA CAAGACCATG CCCGCGCCTG A
```

This corresponds to the amino acid sequence <SEQ ID 2426; ORF 718-1.a>:

```
a718.pep

1 MEPIMAKKNN KTKIQKPEAA LQTDVAQITA TGRVIAEHPS NFITPQKMRA

51 LFEDAESGDI RAQHELFADI EERDSDIAAN MGTRKRALLT LNWRVAPPRN

101 ATPEEEKLSD QAYEMMDSLP TLEDLIMDLM DAVGHGFSAL EVEWVFSDGL

151 YLPRNFIHRP QSWFKWDKDN GLLLRTRENP EGEALWPLGW VVHTQKSRSV

201 QQARNGLFRT LSWLYMFKHY AVHDFAEFLE LYGMPIRIGK YGAGATKEEK

251 NTLLRAVAEI GHNAAGIMPE GMEIELHNAA NGMTSAGNPF LQMADWCEKS

301 AARLILGQTL TSGADGKSST NALGNIHNET RRDLLVSDAK QVAQTITSQI

351 IGPFLQINYP HADPNRVPKF EFDTREPKDI AVFADAIPKL VDVGVQIPES

401 WVRDKLVIPD VQEGEAVLVR QVPDNPVNRT ALAALSAHTV PSKATGRHQE

451 ILDGALDDAL VEPDFNSQLN PMVRQAVAAL NACNSYEEAD AALNALYPNL

501 DNAKLRTYMQ QALFISDILG QDHARA* a718/m718-1  99.0% identity in 526 aa overlap 10         20         30         40         50         60
a718.pep    MEPIMAKKNNKTKIQKPEAALQTDVAQITATGRVIAEHPSNFITPQKMRALFEDAESGDI
            ||||||||||||||||||||||||||||||||||||||||||||||||||||||||||||
m718-1      MEPIMAKKNNKTKIQKPEAALQTDVAQITATGRVIAEHPSNFITPQKMRALFEDAESGDI
                    10         20         30         40         50         60

70         80         90        100        110        120
a718.pep    RAQHELFADIEERDSDIAANMGTRKRALLTLNWRVAPPRNATPEEEKLSDQAYEMMDSLP
            ||||||||||||||||||||||||||||||||||||||||||||||||||||||||||||
m718-1      RAQHELFADIEERDSDIAANMGTRKRALLTLNWRVAPPRNATPEEEKLSDQAYEMMDSLP
                    70         80         90        100        110        120

130        140        150        160        170        180
a718.pep    TLEDLIMDLMDAVGHGFSALEVEWVFSDGLYLPRNFIHRPQSWFKWDKDNGLLLRTRENP
            ||||||||||||||||||||||||||||||||||||||||||||||||||||||||||||
m718-1      TLEDLIMDLMDAVGHGFSALEVEWVFSDGLYLPRNFIHRPQSWFKWDKDNGLLLRTRENP
                   130        140        150        160        170        180

190        200        210        220        230        240
a718.pep    EGEALWPLGWVVHTQKSRSVQQARNGLFRTLSWLYMFKHYAVHDFAEFLELYGMPIRIGK
            ||||||||||||||||||||||||||||||||||||||||||||||||||||||||||||
m718-1      EGEALWPLGWVVHTQKSRSVQQARNGLFRTLSWLYMFKHYAVHDFAEFLELYGMPIRIGK
                   190        200        210        220        230        240

250        260        270        280        290        300
a718.pep    YGAGATKEEKNTLLRAVAEIGHNAAGIMPEGMEIELHNAANGMTSAGNPFLQMADWCEKS
            |||||||||||||||||||||||||||||||||||||||||| :::|||||||||||||
m718-1      YGAGATKEEKNTLLRAVAEIGHNAAGIMPEGMEIELHNAANGTTATSNPFLQMADWCEKS
                   250        260        270        280        290        300

310        320        330        340        350        360
a718.pep    AARLILGQTLTSGADGKSSTNALGNIHNEIRRDLLVSDAKQVAQTITSQIIGPFLQINYP
            |||||||||||||||||||||||||||||||:||||||||||||||||||||||||||||
m718-1      AARLILGQTLTSGADGKSSTNALGNIHNEVRRDLLVSDAKQVAQTITSQIIGPFLQINYP
                   310        320        330        340        350        360

370        380        390        400        410        420
a718.pep    HADPNRVPKFEFDTREPKDIAVFADAIPKLVDVGVQIPESWVRDKLVIPDVQEGEAVLVR
            ||||||||||||||||||||||||||||||||||||||||||||||||||||||||||||
m718-1      HADPNRVPKFEFDTREPKDIAVFADAIPKLVDVGVQIPESWVRDKLVIPDVQEGEAVLVR
                   370        380        390        400        410        420

430        440        450        460        470        480
a718.pep    QVPDNPVNRTALAALSAHTVPSKATGRHQEILDGALDDALVEPDFNSQLNPMVRQAVAAL
            ||||||||||||||||||||||||||||||||||||||||||||||||||||||||||||
m718-1      QVPDNPVNRTALAALSAHTVPSKATGRHQEILDGALDDALVEPDFNSQLNPMVRQAVAAL
                   430        440        450        460        470        480

490        500        510        520
a718.pep    NACNSYEEADAALNALYPNLDNAKLRTYMQQALFISDILGQDHARAX
            |||||||||||||||||||||||||||||||||||||||||||||||
m718-1      NACNSYEEADAALNALYPNLDNAKLRTYMQQALFISDILGQDHARAX
                   490        500        510        520 g719.seq not found yet g719.seq not found yet
```

The following partial DNA sequence was identified in *N. meningitidis* <SEQ ID 2427>:

```
m719.seq
   1 ATGGCAAACG GGAACATGAA ACTGTCGTTG GTGTTAACCG CCCGAGATGA
  51 CGGAGCGAGA CGGCTACTGG CTGATACTCA ACGACAATTA GATCGTACCG
 101 CGAAATCGCG GGCGCAACTT GAACGGCAAA GCCATACTTA TGCGTTGACC
 151 GGCATCCGCT CAGAAAAACA GATTCAACGC GAAATCATGC TGACACAGGC
 201 TGCGTTTAAC CGTTTGGCGC GCAGCGGCAA GGCATCACAA AATGATTTGG
 251 CACGGGCGGC GGTCGCTACG CGTAACCGAA TTCGCGAGCT GAACGCGGAA
 301 CTGAAACAGG GCACGGGATT TGCGGACAAG ATGGGAAAAA TCGGAAGATT
 351 CGGTGCAGCT GCGGTGGCTG GTGGCGCGGC AGCGTATACG GTGCTTAAGC
 401 CTGCTATGGA CAACAGAAAG CAGCTTGATG AGAACATCAA CCGCGTGTCC
 451 AGACAGGCAT TTATTGAGGA TAACAGTAAA TCGGCAGCGT GGATTGCAAC
 501 TGAAGGTGCG CAACAGATCA AGGATTTGGC ACTTGAACTT GTCGAGAAAA
 551 ATGGCGGGAC CCACGATAAG GCTTTGGATT TAATCAGCGG CATGATGACC
 601 ACCGGTCTGA ATTTTGCCCA AACCAAGAAT GAAGCGCAGG CGGCATATGC
 651 TTTTGCACTT GCCTCAGAAG GCAGTGGCGA GGATACGGCA AAACTGATTA
 701 AAACCCTGAA AGATGGCGGC ATGAGCGGTA AAGACCTGCA ACTCGGGCTT
 751 GAGCACGTCT TGCAATCGGG TTTAGACGGC ACTTTCGAGG TGCGGGATAT
 801 GGTTCGGGAG CTGCCGAGCC TGCTCTCTGC CGCGCAACAG GCAGGGATGA
 851 ATGGTGTCGG CGGTTTGGAC TACCTGCTCT CACTCTTACA ATCTGCGGCG
 901 AATAAATCGG GCAGTCCTGC CGAAGCGGCG ACTAATGTGC AAAATCTTTT
 951 GAGTAAAACT CTGTCGCCTG ACACGATAGG TCGTCTGAAG AAGATGGCAA
1001 ATCCGAATGA CCCGAAGAAA GGTGTCGATT GGATAGGCTC GGTTGTGCAA
1051 GGCAAGCAAA ACGGCGAAAA CGCAGTGCAG GTGTTGTCCC GTCTTGCCGA
1101 TGCCATGCTA GTAAAGGATA AGCAATACCA AGATTATAAG AAACGCGCGG
1151 CTGCAGGCGA TAAGACGGCG GCGGAGCAGG CAAATATGCT TAAGGGCGCG
1201 CTTTTGGCGC AACTGCTGCC TGATTTGCAG GCAAAACAAG GTTTGCTGGC
1251 TGCAACGGAT ATGACGCAAA TCCGTGAATA TATGGCTTCG TTGGCTGGCG
1301 TAACGTTGGA TAACGGAAAA ATTGCTAAGA ACAACGAGGC GCGAATGTTG
1351 TCGGCAGCGG CGCAACAAGA GCAACAGGAA TCGCTGGCAA TGTTGCGGGA
1401 AAGTCTGACG GGAACATTGG TGGATATGGA AACCTCGTTT AAAAAGCTGG
1451 CAGCGGAATA CCCTAATGCC ACTCTAGCCC TGCAAGCATT GACGACGGCG
1501 GCAACAGCGG CGTCTGCCGC AATGTTATTA ACCGCCGGTG GCGGTAAAGG
1551 TGCAGGCTTT CTGAAAGATG TAGGTAGTAA AGCGTTGGGA TGGGGTAAGG
1601 CTTCCGCAGG CGGCGTGGCA GCAGGTGCCA CAGCGGCAGG CGGTAAGTTG
1651 CTGTCATGGG GAAAATCTGC CGGTAGCGGG CTCATGAATA ATCCAGCGTT
1701 AGTTAAACGG GCGGGTTTGT TAGGTATGTT GCTGTATTCC GAGTCTTTGG
1751 GTGACGGCAC ATTGCCAAAG GGTTTGCGTG GTACCAAGAC AACTCCTGAA
1801 ATGATTAATC GTCTGAAAAA CAACGGTATC CGATTTGAAC CTGCGCCGAA
1851 GCGGGAACAG GCGCGGGGTG GTGTCCCTCA GTATTTGGCT GCTCCGTCAG
1901 CGCAGCCTAC CGATAAGATG TTGTCTCCGT TGTTTTCAAC TCAGACGGCG
```

```
1951 GCGTATCAGG CAGCCATTCA GCAGCAGACG GCGGCGTATC AGGCAGCATT

2001 GGCGCAGGAT ACGGCTGCAG TTACAACAGG TTTGGCACAA GTGCAAAGTG

2051 CGATGGCGTC GGCAAGTCAG ACCATCAATA CCAATGTGAG CCTGAATATC

2101 GACGGACGTG TTATCGCGAA TGAGGTATCG CGGTATCAAG TGGCCATGTT

2151 CGGCCGTGGA GCGGGTCAAT AA
```

This corresponds to the amino acid sequence <SEQ ID 2428; ORF 719>:

```
m719.pep
   1 MANGNMKLSL VLTARDDGAR RLLADTQRQL DRTAKSRAQL ERQSHTYALT

51 GIRSEKQIQR EIMLTQAAFN RLARSGKASQ NDLARAAVAT RNRIRELNAE

101 LKQGTGFADK MGKIGRFGAA AVAGGAAAYT VLKPAMDNRK QLDENINRVS

151 RQAFIEDNSK SAAWIATEGA QQIKDLALEL VEKNGGTHDK ALDLISGMMT

201 TGLNFAQTKN EAQAAYAFAL ASEGSGEDTA KLIKTLKDGG MSGKDLQLGL

251 EHVLQSGLDG TFEVRDMVRE LPSLLSAAQQ AGMNGVGGLD YLLSLLQSAA

301 NKSGSPAEAA TNVQNLLSKT LSPDTIGRLK KMANPNDPKK GVDWIGSVVQ

351 GKQNGENAVQ VLSRLADAML VKDKQYQDYK KRAAAGDKTA AEQANMLKGA

401 LLAQLLPDLQ AKQGLLAATD MTQIREYMAS LAGVTLDNGK IAKNNEARML

451 SAAAQQEQQE SLAMLRESLT GTLVDMETSF KKLAAEYPNA TLALQALTTA

501 ATAASAAMLL TAGGGKGAGF LKDVGSKALG WGKASAGGVA AGATAAGGKL

551 LSWGKSAGSG LMNNPALVKR AGLLGMLLYS ESLGDGTLPK GLRGTKTTPE

601 MINRLKNNGI RFEPAPKREQ ARGGVPQYLA APSAQPTDKM LSPLFSTQTA

651 AYQAAIQQQT AAYQAALAQD TAAVTTGLAQ VQSAMASASQ TINTNVSLNI

701 DGRVIANEVS RYQVAMFGRG AGQ* a719.seq not found yet
a719.pep not found yet
g720.seq not found yet
g720.pep not found yet
```

The following partial DNA sequence was identified in *N. meningitidis* <SEQ ID 2429>:

```
m720.seq
   1 ATGAGCGGAT GGCATACCTT ATTGCAGGAC GCATCTTACA AGGGCGTCGG

51 CTTTGATATT GAGGTGGTGG ACGAGAGCAA CGGCAAGGCA TTGGCCGAGC

101 ATGCGCGGCC GTTTGTGCAG GGTATCGACC TTGAAGACAT GGGCATGACC

151 GGGCGGCAGG TGCAGATTAA TGCGGTGTTT TGGGGCAAGG GCTATGCAGG

201 CCGTCTGAAA AAGCTGCTGG ATGCGCTGGA GCAGCCGGGC GGCGGCGTGC

251 TGGTGCACCC TGTTTGGGGG CGGATGCACA ACATGATTGC GGCATCATGG

301 AGTTACCGAC ATGAGGCCGA TTATGTGGAT TATGCGGGCA TCGATATTAC

351 TTTCCGCGAG GCGGCCGAAG CGCAGGAAAT CTTTGTTTTT GAAAACGCCT

401 TTTTGGTCGA GCTTGAGGCG TTGATTGCTA ATATCGACAC CTACCGCGAG

451 GCGGCTATCG GCTTTGTTGA TGCGGTGTTG GCGGTGGATG CGGGCGTATC

501 AGCTTTATGG GGCAGCGCGC TGGGCATTTG GAGTGCGGCA TCGGGTACGT
```

-continued

```
 551 TTGGCGCGGT GCGCCGTTTG TTTGATTTGG ACAAAATTGC CTTTCCCGAT

601 CGGGGCGGAT ACAGTGCAGC GGCGTTTAAA AACGGCTCGG CCAAGCTGTT

651 TGCGGATATA TCGGTCATGG TAGATACTGG CATACGCCGT GAGGCGGGTT

701 TGGCCGATAA TGCCATGCAC CATGCCGGTT GGTCGCCGCG ACAGCGGTTT

751 GACGGGGCTG CGGCTGTTGC CGACCGCGCC GCCGCTATCC CTGATAATTT

801 GCTGACCGGC CGCTTTTCAG ACGGCCTGCA AAACCGCCTG AACCGGTTAA

851 CCGCCAAACA GGTGCAGCCG GTAGCGCAGG CGGTGCGCCT GTTATCCACG

901 TCATCGCTGT TGTCGGTGGC AACGGCATTA ATCGAGGCGC ATGGCGAAGA

951 GATGACCGCG CCCGATTTGA TTGAGGTTAA CCGCGCCATG CGCCGCCGTA

1001 TGCAGGCCGA GATTGCCGCC TTGCGGGCGG TGCAGACGGC TGCTGCCGAG

1051 TCTGGTGGGC TGACGGCCAA CGCCGTGTAT ACCGAGGCTT ACCAAACGGC

1101 AGAATCCCTG CGCGCGGCGG CAGGCCGTCT GAATGCGTTG GTTGCGGCGG

1151 TCATCAACCA AAAGCCGCCG CTGATTGTGC GCCAAGCCCC AATCGACGGT

1201 ACGATACACC AAATCGCCCA CGAGTTTTAC GGCGATATAG CCCGCGCAGC

1251 AGAGCTGGTG CGGCTCAATC CCCATATCCA CCACCCCGCG TTTATCAAGC

1301 GCGGCACTTT GGTCAACAGC TATGCAAAAT AA
```

This corresponds to the amino acid sequence <SEQ ID 2430; ORF 720>:

```
m720.pep
   1 MSGWHTLLQD ASYKGVGFDI EVVDESNGKA LAEHARPFVQ GIDLEDMGMT

51 GRQVQINAVF WGKGYAGRLK KLLDALEQPG GGVLVHPVWG RMHNMIAASW

101 SYRHEADYVD YAGIDITFRE AAEAQEIFVF ENAFLVELEA LIANIDTYRE

151 AAIGFVDAVL AVDAGVSALW GSALGIWSAA SGTFGAVRRL FDLDKIAFPD

201 RGGYSAAAFK NGSAKLFADI SVMVDTGIRR EAGLADNAMH HAGWSPRQRF

251 DGAAAVADRA AAIPDNLLTG RFSDGLQNRL NRLTAKQVQP VAQAVRLLST

301 SSLLSVATAL IEAHGEEMTA PDLIEVNRAM RRRMQAEIAA LRAVQTAAAE

351 SGGLTANAVY TEAYQTAESL RAAAGRLNAL VAAVINQKPP LIVRQAPIDG

401 TIHQIAHEFY GDIARAAELV RLNPHIHHPA FIKRGTLVNS YAK*
```

The following partial DNA sequence was identified in *N. meningitidis* <SEQ ID 2431>:

```
a720.seq (partial)
   1 GGCCTGCAAA ACCGCCTGAA CCGGTTAACC GCCAAACAGG TGCAGCCGGT

51 AGCGCAGGCG GTGCGCCTGT TATCCACGTC ATCGCTGTTG TCGGTGGCAA

101 CGGCATTAAT CGAGGCGCAT GGCGAAGAGA TGACCGCGCC CGATTTGATT

151 GAGGTTAACC GCGCCATGCG CCGCCGTATG CAGGCCGAGA TTGCCGCCTT

201 ACGGGCGGTG CAGACGGCTG CTGCCGAGTC TGGTGGGCTG ACGGCCAACG

251 CCGTGTATAC CGAGGCTTAC CAAACGGCAG AATCCCTGCG CGCGGCGGCA

301 GGCCGTCTGA ATGCGTTGGT TGCGGCGGTC ATCAACCAAA AGCCGCCGCT

351 GATTGTGCGC CAAGCCCCAA TCGACGGTAC GATACACCAA ATCGCCCACG

401 AGTTTTACGG CGATATAGCC CGCGCAGCAG AGCTGGTGCG GCTCAATCCC
```

```
                       -continued
451 CATATCCACC ACCCCGCGTT TATCAAGCGC GGCACTTTGG TCAACAGCTA

501 TGCAAAATAA
```

This corresponds to the amino acid sequence <SEQ ID 2432; ORF 720.a>:

```
a720.pep (partial)
  1 GLQNRLNRLT AKQVQPVAQA VRLLSTSSLL SVATALIEAH GEEMTAPDLI

51 EVNRAMRRRM QAEIAALRAV QTAAAESGGL TANAVYTEAY QTAESLRAAA

101 GRLNALVAAV INQKPPLIVR QAPIDGTIHQ IAHEFYGDIA RAAELVRLNP

151 HIHHPAFIKR GTLVNSYAK*
``` m720/a720 100.0% identity in 169 aa overlap

```
                      250        260        270        280        290        300
        m720.pep     SPRQRFDGAAAVADRAAAIPDNLLTGRFSDGLQNRLNRLTAKQVQPVAQAVRLLSTSSLL
                                                    ||||||||||||||||||||||||||||
        a720                                        GLQNRLNRLTAKQVQPVAQAVRLLSTSSLL
                                                             10        20        30
                      310        320        330        340        350        360
        m720.pep     SVATALIEAHGEEMTAPDLIEVNRAMRRRMQAEIAALRAVQTAAAESGGLTANAVYTEAY
                    ||||||||||||||||||||||||||||||||||||||||||||||||||||||||||||
        a720         SVATALIEAHGEEMTAPDLIEVNRAMRRRMQAEIAALRAVQTAAAESGGLTANAVYTEAY
                             40        50        60        70        80        90
                      370        380        390        400        410        420
        m720.pep     QTAESLRAAAGRLNALVAAVINQKPPLIVRQAPIDGTIHQIAHEFYGDIARAAELVRLNP
                    ||||||||||||||||||||||||||||||||||||||||||||||||||||||||||||
        a720         QTAESLRAAAGRLNALVAAVINQKPPLIVRQAPIDGTIHQIAHEFYGDIARAAELVRLNP
                             100       110       120       130       140       150
                      430        440
        m720.pep     HIHHPAFIKRGTLVNSYAKX
                    ||||||||||||||||||||
        a720         HIHHPAFIKRGTLVNSYAKX
                             160       170
        g721.seq not found
        g721.pep not found
```

The following partial DNA sequence was identified in *N. meningitidis* <SEQ ID 2433>:

```
m721.seq
  1 ATGTCCAAAA ATGCACAAAA AACCCTACTT GCCGTGTGCA GTTTCGAGGT

51 GCAGCCAAAA GACGGGCGAA TCCAACTGCT GCCATATGGC GAATTTCGCG

101 CAGTAGACGG TCGTCCGACT GATGTCCCTG CGTGGTATCT GACCGAAGAA

151 AACGGTCATG ATGTCGCGTT GTTGGCCAAC AGCTCGCGCA ATCAGTTGGT

201 TGTCGATTAT GAACACCAGA CGCTCTACAA AGAGAAAAAC GGACAACCTG

251 CACCTGCCGC CGGTTGGATG CGTTGGCTGG AGTTCACGCC TAAAGGCATG

301 TTTGCCGAAG TGGAGTGGAC GGACAAGGCG GCTGCGGCAA TTGCCGCAAA

351 AGAGTATCGC TACATCTCTG CTGTGTTTTC CTATGACACA AAGGGATATG

401 TAAGCAAAAT TTTTCACGCC GCGCTGACAA ATTTCCCCGC GTTGGACGGT

451 ATGGACGAGG TGCTGGCGGC AGCGTCGGCG CAAATTTTAA AACCGGAAAC

501 GGAGCAAAAC CCTATGAAAG AGTTGTTACA GCAACTGTTC GACCTGCCTG

551 ATGCGGGCGA AGAAGAACTG AAGGCGGCAT TGTCCGCGCT CGTGGAAGCC

601 AAGCCGAAAG ACGTGGCATT GTCTGCCGAC GTGTTCGCGC AGCTGGCGGA

651 AAAAGACAGC CGCATCGCGG CATTGACGGC GCAAACCGCC AAGCCTGATT
```

-continued
```
 701 TGACTAAATA CGCGCCTATC TCAGTGGTTC AAGAGCTGCA AAGCAAAGTC

751 GCCGCGCTGA CTGCCAAGCA GGAAGCAGAC AAAGGCAACG AATTGATTAC

801 CGCCGCGCTG ACTTCAGGCA AATTGCTGCC TGCTCAGAAG GAGTGGGCAA

851 AAGGCGTATT GAAACAGCCG GGCGGCTTGG CATTTTTGAC CGGCTTTATT

901 GAAAACGCCC AGCCGGTCGC TGCACTGGCA GGCTCGCAAA CGGGCGGCAA

951 AGCACCCGAC GAACGCGTCG CCGCACTGAC TGCGGAAGAG CAGCCGCAG

1001 CAAAAATGCT GGGCATGTCC GGCGAAGAAT TTGTAAAAAT CAAAGAAAGC

1051 GAAGGTAAGT AA
```

This corresponds to the amino acid sequence <SEQ ID 2434; ORF 721>:

```
m721.pep
   1 MSKNAQKTLL AVCSFEVQPK DGRIQLLPYG EFRAVDGRPT DVPAWYLTEE

51 NGHDVALLAN SSRNQLVVDY EHQTLYKEKN GQPAPAAGWM RWLEFTPKGM

101 FAEVEWTDKA AAAIAAKEYR YISAVFSYDT KGYVSKIFHA ALTNFPALDG

151 MDEVLAAASA QILKPETEQN PMKELLQQLF DLPDAGEEEL KAALSALVEA

201 KPKDVALSAD VFAQLAEKDS RIAALTAQTA KPDLTKYAPI SVVQELQSKV

251 AALTAKQEAD KGNELITAAL TSGKLLPAQK EWAKGVLKQP GGLAFLTGFI

301 ENAQPVAALA GSQTGGKAPD ERVAALTAEE AAAAKMLGMS GEEFVKIKES

351 EGK*
```

The following partial DNA sequence was identified in *N. meningitidis* <SEQ ID 2435>:

```
a721.seq
   1 ATGTCCAAAA ATGCACAAAA AACCCTACTT GCCGTGTGCA GTTTCGAGGT

51 GCAGCCAAAA GACGGGCGAA TCCAACTGCT GCCATATGGC GAATTTCGCG

101 CAGTAGACGG TCGTCCGACT GATGTCCCTG CGTGGTATCT GACCGAAGAA

151 AACGGTCATG ATGTCGCGTT GTTGGCCAAC AGCTCGCGCA ATCAGTTGGT

201 TGTCGATTAT GAACACTAGA CGCTCTACAA AGAGAAAAAC GGACAACCTG

251 CACCTGCCGC CGGTTGGATG CGTTGGCTGG AGTTCACGCC TAAAGGCATG

301 TTTGCCGAAG TGGAGTGGAC GGACAAGGCG GCTGCGGCAA TTGCCGCAAA

351 AGAGTATCGC TACATCTCTG CTGTGTTTTC CTATGACACA AAGGGATATG

401 TAAGCAAAAT TTTTCACGCC GCGCTGACAA ATTTCCCCGC GTTGGACGGT

451 ATGGACGAGG TGCTGGCGGC AGCGTCGGCG CAAATTTTAA AACCGGAAAC

501 GGAGCAAAAC CCTATGAAAG AGTTGTTACA GCAACTGTTC GGTCTGCCTG

551 ATGCGGGCGA AGAAGAACTG AAGGCGGCAT TGTCCGCGCT CGTGGAAGCC

601 AAGCCGAAAG ACGTGGCATT GTCTGCCGAC GTGTTCGCGC AGCTGGCGGA

651 AAAAGACAGC CGCATCGCGG CATTGACGGC GCAAACCGCC AAGCCTGATT

701 TGACTAAATA CGCGCCTATC TCAGTGGTTC AAGAGCTGCA AAGCAAAGTC

751 GCCGCGCTGA CTGCCAAGCA GGAAGCAGAC AAAGGCAACG AATTGATTAC

801 CGCCGCGCTG ACTTCAGGCA AATTGCTGCC TGCTCAGAAG GAGTGGGCAG

851 AAGGCGTATT GAAACAGCCG GGCGGCTTGG CATTTTTGAC CGGCTTTATT
```

-continued

```
 901 GAAAACGCCC AGCCGGTCGC TGCACTGGCA GGCTCGCAAA CGGGCGGTAA

951 AGCACCCGAC GAACGCGTCG CCGCACTGAC TGCGGAAGAG GCAGCCGCAG

1001 CAAAAATGCT GGGCATGTCC GGCGAAGAAT TTGTAAAAAT CAAAGAAAGC

1051 GAAGGTAAGT AA
```

This corresponds to the amino acid sequence <SEQ ID 2436; ORF 721.a>:

```
a721.pep
  1 MSKNAQKTLL AVCSFEVQPK DGRIQLLPYG EFRAVDGRPT DVPAWYLTEE

51 NGHDVALLAN SSRNQLVVDY EH*TLYKEKN GQPAPAAGWM RWLEFTPKGM

101 FAEVEWTDKA AAAIAAKEYR YISAVFSYDT KGYVSKIFHA ALTNFPALDG

151 MDEVLAAASA QILKPETEQN PMKELLQQLF GLPDAGEEEL KAALSALVEA

201 KPKDVALSAD VFAQLAEKDS RIAALTAQTA KPDLTKYAPI SVVQELQSKV

251 AALTAKQEAD KGNELITAAL TSGKLLPAQK EWAEGVLKQP GGLAFLTGFI

301 ENAQPVAALA GSQTGGKAPD ERVAALTAEE AAAAKMLGMS GEEFVKIKES

351 EGK*
``` a721/m721 99.2% identity in 353 aa overlap

```
                 10         20         30         40         50         60
    a721.pep MSKNAQKTLLAVCSFEVQPKDGRIQLLPYGEFRAVDGRPTDVPAWYLTEENGHDVALLAN
             ||||||||||||||||||||||||||||||||||||||||||||||||||||||||||||
        m721 MSKNAQKTLLAVCSFEVQPKDGRIQLLPYGEFRAVDGRPTDVPAWYLTEENGHDVALLAN
                 10         20         30         40         50         60

70         80         90        100        110        120
    a721.pep SSRNQLVVDYEHXTLYKEKNGQPAPAAGWMRWLEFTPKGMFAEVEWTDKAAAAIAAKEYR
             ||||||||||| ||||||||||||||||||||||||||||||||||||||||||||||||
        m721 SSRNQLVVDYEHQTLYKEKNGQPAPAAGWMRWLEFTPKGMFAEVEWTDKAAAAIAAKEYR
                 70         80         90        100        110        120

130        140        150        160        170        180
    a721.pep YISAVFSYDTKGYVSKIFHAALTNFPALDGMDEVLAAASAQILKPETEQNPMKELLQQLF
             ||||||||||||||||||||||||||||||||||||||||||||||||||||||||||||
        m721 YISAVFSYDTKGYVSKIFHAALTNFPALDGMDEVLAAASAQILKPETEQNPMKELLQQLF
                130        140        150        160        170        180

190        200        210        220        230        240
    a721.pep GLPDAGEEELKAALSALVEAKPKDVALSADVFAQLAEKDSRIAALTAQTAKPDLTKYAPI
              |||||||||||||||||||||||||||||||||||||||||||||||||||||||||||
        m721 DLPDAGEEELKAALSALVEAKPKDVALSADVFAQLAEKDSRIAALTAQTAKPDLTKYAPI
                190        200        210        220        230        240

250        260        270        280        290        300
    a721.pep SVVQELQSKVAALTAKQEADKGNELITAALTSGKLLPAQKEWAEGVLKQPGGLAFLTGFI
             |||||||||||||||||||||||||||||||||||||||||:||||||||||||||||||
        m721 SVVQELQSKVAALTAKQEADKGNELITAALTSGKLLPAQKEWAKGVLKQPGGLAFLTGFI
                250        260        270        280        290        300

310        320        330        340        350
    a721.pep ENAQPVAALAGSQTGGKAPDERVAALTAEEAAAAKMLGMSGEEFVKIKESEGKX
             |||||||||||||||||||||||||||||||||||||||||||||||||||||
        m721 ENAQPVAALAGSQTGGKAPDERVAALTAEEAAAAKMLGMSGEEFVKIKESEGKX
                310        320        330        340        350 g722.seq not found yet g722.pep not found yet
```

The following partial DNA sequence was identified in *N. meningitidis* <SEQ ID 2437>:

```
m722.seq
  1 GTGTTTGAAA CGCCGACATT TGAGCAAATC CGCGAGCGTA TCCTGCGCGA

51 TACCAAAAGC CTGTGGCCGG ATGCCGATAT CAGCCCCGAC AGCGACCATT
```

```
 101 ATGTGCACGC CAGCCGTTTG GCCAGCTGCG CCGAAGGGCA ATATGCGCAT

151 CAAAGCTGGA TTGTGCGGCA GATTTTCCCT GATACCGCCG ACCGCGAGTA

201 TTTGGAGCGG CATGCCTCCA TGCGCGGCTT GAGCCGCCGC AATCCTACCA

251 CGGCCAGCGG CACGCTGACC GTAAGCGGTA TTGCGCAATC CATGCTTTCA

301 GACGACCTGC AAGTGCGTAT CGGCCAGCGT TTTTACCGCA CTACCGCCCG

351 CGCCGTTATC GGCAGCGGCG GCACGGCGGA AATACCGGCA ATCGCCGACG

401 AGCCGGGCGC GGCCGCCAAT GTGGGCGACG GCGAGGCGCA ACTGATGGCC

451 GCCCCGCCG GTGTGGCCAC CGAATGCCGC CTTACCGTAC AAGGCGGCAC

501 CGACCGAGAA AGCGATGCCT CACTGCTGGC GCGTCTGTTG GAAATCATCC

551 GCCGACCGCC CGCAGGCGGC AACCGTTACG ACTATAAAAA CTGGGCGTTG

601 AGTGTTGACG GCGTAACCAG CGCATATGTT TATCCGCTGC GCCGCGGCTT

651 GGGTACGGTG GATATTGCCA TTACCTCCGC CGACGGTGTG TCGTCGGAAG

701 AAACTGTGCG CCGCGTACAG GCTTATATCG ACGAGATGCG CCCGGTAACG

751 GCAAAAAATG CGCTGGTACT CAAGCCAACC GTAACGGCGG TGCCTGTTAC

801 CGTGCAAGTC AAGCTCGACG GTATCGACTT GGACGAGGCC AAGCGCCGCA

851 TACGGACGGC CCTAAAAGAA TATTTCGACA CCCTGATCCC CGGCGACGGC

901 CTGACTGTGT CGCAAATCGA GGCTGCTATC AGCAATGTGG ATGGTGTGAT

951 CGACCGCCGT CTGACTGCGC CGACGGCCAA CCGTGCCGCC GATACGGTTA

1001 ACCGCATCGA GTGGTTTAAA GCGGGCGCGA TTAATGTAAC GGAGATGCCG

1051 TCATGA
```

This corresponds to the amino acid sequence <SEQ ID 2438; ORF 722>:

```
m722.pep
  1 VFETPTFEQI RERILRDTKS LWPDADISPD SDHYVHASRL ASCAEGQYAH

51 QSWIVRQIFP DTADREYLER HASMRGLSRR NPTTASGTLT VSGIAQSMLS

101 DDLQVRIGQR FYRTTARAVI GSGGTAEIPA IADEPGAAAN VGDGEAQLMA

151 APAGVATECR LTVQGGTDRE SDASLLARLL EIIRRPPAGG NRYDYKNWAL

201 SVDGVTSAYV YPLRRGLGTV DIAITSADGV SSEETVRRVQ AYIDEMRPVT

251 AKNALVLKPT VTAVPVTVQV KLDGIDLDEA KRRIRTALKE YFDTLIPGDG

301 LTVSQIEAAI SNVDGVIDRR LTAPTANRAA DTVNRIEWFK AGAINVTEMP

351 S*
```

The following partial DNA sequence was identified in *N. meningitidis* <SEQ ID 2439>:

```
a722.seq
   1 GTGTTTGAAA CGCCGACATT TGAGCAAATC CGCGAGCGTA TCCTGCGCGA

51 TACCAAAAGC CTGTGGCCGG ATGCCGATAT CAGCCCCGAC AGCGACCATT

101 ATGTGCACGC CAGCCGTTTG GCCAGCTGCG CCGAAGGGCA ATATGCGCAT

151 CAAAGCTGGA TTGTGCGGCA GATTTTCCCT GATACCGCCG ACCGCGAGTA

201 TTTGGAGCGG CATGCCTCCA TGCGCGGCTT GCGCCGCCGC AATCCTACCA

251 CGGCCAGCGG CACGCTGACC GTAAGCGGTA TTGCGCAATC CATGCTTTCA
```

-continued

```
 301 GACGGCCTGC AAGTGCGTAT CGGCCAGCGT TTTTACCGCA CTACCGCCCG

351 CGCCGTTATC GGCAGCGGCG GCACGGCGGA AATACCGGCA ATCGCCGACG

401 AGCCGGGCGC GGCCGCCAAT GTGCGCGACG GCGAGGCGCA ACTGATGGCC

451 GCCCCGCCG GTGTGTCCAC CGAATGCCGC CTTACCGTAC AAGGCGGCAC

501 CGACCGAGAA AGCGATGCCT CACTGCTGGC GCGTCTGTTG GAAATCATCC

551 GCCGACCGCC CGCAGGCGGC AACCGTTACG ACTATAAAAA CTGGGCGTTG

601 AGTGTTGACG GCGTAACCAG CGCATATGTT TATCCGCTGC GCCGCGGCTT

651 GGGTACGGTG GATATTGCCA TTACCTCCGC CGACGGTGTG CCATCGGAAG

701 AAACTGTGCG CCGCGTACAG GCTTATATCG ACGAGATGCG CCCGGTAACG

751 GCAAAAAATG CGCTGGTACT CAAGCCAACC GTAACGGCGG TGCCTGTTAC

801 CGTGCAAGTC AAGCTCGACG GCATCGACTT GGACGAGGCC AAGCGCCGCA

851 TACGGACGGC CCTAAAAGAA TATTTCGACA CCCTGATCCC CGGCGACGGC

901 CTGACTGTGT CGCAAATCGA GGCGGCTATC AGCAATGTGG ATGGTGTGAT

951 CGACCTCCGT CTGACTGCGC CGACGGCCAA CCGTGCCGCC GATACGGTTA

1001 ACCGCATCGA GTGGTTTAAA GCGGGCGCGA TTAATGTAAC GGAGATGCCG

1051 TCATGA
```

This corresponds to the amino acid sequence <SEQ ID 2440; ORF 722.a>:

```
a722.pep
   1 VFETPTFEQI RERILRDTKS LWPDADISPD SDHYVHASRL ASCAEGQYAH

51 QSWIVRQIFP DTADREYLER HASMRGLRRR NPTTASGTLT VSGIAQSMLS

101 DGLQVRIGQR FYRTTARAVI GSGGTAEIPA IADEPGAAAN VRDGEAQLMA

151 APAGVSTECR LTVQGGTDRE SDASLLARLL EIIRRPPAGG NRYDYKNWAL

201 SVDGVTSAYV YPLRRGLGTV DIAITSADGV PSEETVRRVQ AYIDEMRPVT

251 AKNALVLKPT VTAVPVTVQV KLDGIDLDEA KRRIRTALKE YFDTLIPGDG

301 LTVSQIEAAI SNVDGVIDLR LTAPTANRAA DTVNRIEWFK AGAINVTEMP

351 S*
g723.seq not found yet
g723.pep not found yet
```

The following partial DNA sequence was identified in *N. meningitidis* <SEQ ID 2441>:

```
m723.seq
   1 ATGCGACCCA AGCCCCGTTT CAGACGGTCT GTTATCGCTT GCTCAATATC

51 AGTGATCACG CCCGAACACC TTATTTTTAC CGTTTACAAA CACAATACCG

101 TCTTCGCCCG CGGCCACTTC TTCGCCGCTA TCATCCACGC CCAGCTGCAC

151 TTCGCCTTTG GCCATAGCAC GCAGCAGGTC GAGCACGTCG ATTTTGTAGC

201 GGTTGCGGAT TCGTCGGTA ATCAACACGC CCTGAGCCGC CGTCAGACGG

251 TAGCGGGCAA TGTCGCAGCA AAGGCGCACC AAGATGGGCG GCAGATCCTC

301 AAAAGGTCGT CTGAACCGCC CCAGATACGC GTCGATTTCG GCAGTGGCGT

351 CCACCAGCGC GGTTTGTGCG ACCTCGCGGT CAATCAGCCC CTCGTTGTTG

401 CGGTCGGTGA GCTGCAAGAC TTCCAGCTCA CCGAAACGCG CAACCATATC
```

```
451 CTCAACCGTC GCGTATGCCA TTACTCGACC GCCTTGCGTT GCAGCATAGG

501 CTCGGCGCAG ATTGCCTTCC ACACCGCTTC GCCGACTTCG GCGCGCTTCA

551 CTTCGCGCCA GCCGCCGTCA ACAGCAGGC CGCCGCGCCA AAATTCTTTG

601 CCGTCTGCGC CGGTACTGAC GAGCATCACA TCGCGGCTGT CCGCCAAAGC

651 GTCGGCGGCA CGTTGCGTAT GCTGCACTTT GAGTTCGGCA AGTTCGGCGG

701 ACAGTGCCTT TTTGTCGTCT TCGGCTTTTT CCAAGGCTGT GGTCAGCATT

751 TCGACATCGT TTCGGGCGGC GGCAAGCTCT GCCTGCACGG CGTCCAATTC

801 GGCTTTGATG TCTTCAAACG ACGGGGCGGC GGTTTCGGCG GTTTCTGGTT

851 TGTTGTTGGT TTTTGCCATG ATGACTCCTT GTTTCAGACG GCGGCGGATT

901 CGCATTTGA
```

This corresponds to the amino acid sequence <SEQ ID 2442; ORF 723>:

```
m723.pep
  1 MRPKPRFRRS VIACSISVIT PEHLIFTVYK HNTVFARGHF FAAIIHAQLH

51 FAFGHSTQQV EHVDFVAVAD FVGNQHALSR RQTVAGNVAA KAHQDGRQIL

101 KRSSEPPQIR VDFGSGVHQR GLCDLAVNQP LVVAVGELQD FQLTETRNHI

151 LNRRVCHYST ALRCSIGSAQ IAFHTASPTS ARFTSRQPPS NSRPPRQNSL

201 PSAPVLTSIT SRLSAKASAA RCVCCTLSSA SSADSAFLSS SAFSKAVVSI

251 STSFRAAASS ACTASNSALM SSND<u>GAAVSA VSGLLLVFAM</u> MTPCFRRRRI

301 RI* a723.seq not found yet
a723.pep not found yet g724.seq not found yet
g724.pep not found yet
```

The following partial DNA sequence, shown with its encoded amino acid sequence, was identified in *N. meningitidis* <SEQ ID 2443>:

```
m724.map
    ATGAGTTTGAGTAAATTGGCGAAAAAAACGGCACAAACTGCTAAAAATATCGGCGAAACC
  1---------+---------+---------+---------+---------+---------+  60
    TACTCAAACTCATTTAACCGCTTTTTTTGCCGTGTTTGACGATTTTTATAGCCGCTTTGG
a    M  S  L  S  K  L  A  K  K  T  A  Q  T  A  K  N  I  G  E  T    -

CTGCGCGCGGCCTTTCGGGGAAAAATCACGCTGGTGGTGTCGTCCGAGCCGATACAGCGC
 61---------+---------+---------+---------+---------+---------+ 120
    GACGCGCGCCGGAAAGCCCCTTTTTAGTGCGACCACCACAGCAGGCTCGGCTATGTCGCG
a    L  R  A  A  F  R  G  K  I  T  L  V  V  S  S  E  P  I  Q  R    -

GTGCAGTTGAGCGGCTTGGCCGACGAAACCCTGCAAGACCTTGAACATTTGCAGGAATAC
121---------+---------+---------+---------+---------+---------+ 180
    CACGTCAACTCGCCGAACCGGCTGCTTTGGGACGTTCTGGAACTTGTAAACGTCCTTATG
a    V  Q  L  S  G  L  A  D  E  T  L  Q  D  L  E  H  L  Q  E  Y    -

GGCTTTGCCAGCCATCCGCCCGACGGCAGCGAAGCGGTAGTGATACCGCTGGGCGGCAAT
181---------+---------+---------+---------+---------+---------+ 240
    CCGAAACGGTCGGTAGGCGGGCTGCCGTCGCTTCGCCATCACTATGGCGACCCGCCGTTA
a    G  F  A  S  H  P  P  D  G  S  E  A  V  V  I  P  L  G  G  N    -

ACTTCGCACGGTGTGATTGTGTGCAGCCAGCACGGCAGCTACCGCATCAAAAACCTTAAG
241---------+---------+---------+---------+---------+---------+ 300
    TGAAGCGTGCCACACTAACACACGTCGGTCGTGCCGTCGATGGCGTAGTTTTTGGAATTC
a    T  S  H  G  V  I  V  C  S  Q  H  G  S  Y  R  I  K  N  L  K    -
```

-continued

```
     CCCGGCGAGACGGCGATTTTTAATCATGAGGGTGCAAAAATCGTGATTAAGCAAGGCAAA
301 ---------+---------+---------+---------+---------+---------+   360
     GGGCCGCTCTGCCGCTAAAAATTAGTACTCCCACGTTTTTAGCACTAATTCGTTCCGTTT
a    P  G  E  T  A  I  F  N  H  E  G  A  K  I  V  I  K  Q  G  K   -

ATCATTGAGGCCGATTGCGACGTGTACCGGGTTAACTGCAAACAATACGAGGTTAATGCG
361 ---------+---------+---------+---------+---------+---------+   420
     TAGTAACTCCGGCTAACGCTGCACATGGCCCAATTGACGTTTGTTATGCTCCAATTACGC
a    I  I  E  A  D  C  D  V  Y  R  V  N  C  K  Q  Y  E  V  N  A   -

GCCACGGATGCCAAATTTAACGCTCCGTTGGTGGAGACCAGTGCAGTGTTGACGGCGCAA
421 ---------+---------+---------+---------+---------+---------+   480
     CGGTGCCTACGGTTTAAATTGCGAGGCAACCACCTCTGGTCACGTCACAACTGCCGCGTT
a    A  T  D  A  K  F  N  A  P  L  V  E  T  S  A  V  L  T  A  Q   -

GGCCAAATCAACGGCAACGGCGGCATGGCCGTCGAGGGCGGCGACGGAGCCACCTTTAGC
481 ---------+---------+---------+---------+---------+---------+   540
     CCGGTTTAGTTGCCGTTGCCGCCGTACCGGCAGCTCCCGCCTGCCTCGGTGGAAATCG
a    G  Q  I  N  G  N  G  G  M  A  V  E  G  G  D  G  A  T  F  S   -

GGCGATGTTAACCAAACGGGCGGCAGCTTTAACACCGACGGCGACGTGGTGGCCGGCAAT
541 ---------+---------+---------+---------+---------+---------+   600
     CCGCTACAATTGGTTTGCCCGCCGTCGAAATTGTGGCTGCCGCTGCACCACCGGCCGTTA
a    G  D  V  N  Q  T  G  G  S  F  N  T  D  G  D  V  V  A  G  N   -

ATATCGTTGCGCCAGCACCCGCATACCGACAGCATCGGCGGCAAAACCTTACCGGCGGAA
601 ---------+---------+---------+---------+---------+---------+   660
     TATAGCAACGCGGTCGTGGGCGTATGGCTGTCGTAGCCGCCGTTTTGGAATGGCCGCCTT
a    I  S  L  R  Q  H  P  H  T  D  S  I  G  G  K  T  L  P  A  E   -

CCGGCATAG
661 ---------                                                      669
     GGCCGTATC
a    P  A  *                                                       -
```

Enzymes that do cut: NONE
Enzymes that do not cut: BamHI BglII EcoRI HindIII KpnI NdeI NheI
PstI SacI SalI SmaI SphI XbaI XhoI This corresponds to the amino acid sequence <SEQ ID 2444; ORF 724>:

```
m724.pep
   1 MSLSKLAKKT AQTAKNIGET LRAAFRGKIT LVVSSEPIQR VQLSGLADET

51 LQDLEHLQEY GFASHPPDGS EAVVIPLGGN TSHGVIVCSQ HGSYRIKNLK

101 PGETAIFNHE GAKIVIKQGK IIEADCDVYR VNCKQYEVNA ATDAKFNAPL

151 VETSAVLTAQ GQINGNGGMA VEGGDGATFS GDVNQTGGSF NTDGDVVAGN

201 ISLRQHPHTD SIGGKTLPAE PA*
```

The following partial DNA sequence was identified in N. meningitidis <SEQ ID 2445>:

```
a724.seq
   1 ATGAGTTTGA GTAAATTGGC GAAAAAAACG GCACAAACTG CTAAAAATAT

51 CGGCGAAACC CTGCGCGCGG CCTTTCGGGG AAAAATCACG CTGGTGGTGT

101 CGTCCGAGCC GATACAGCGC GTGCAGTTGA GCGGCTTGGC CGACGAAACC

151 CTGCAAGACC TTGAACATTT GCAGGAATAC GGCTTTGCCA GCCATCCGCC

201 CGACGGCAGC GAAGCGGTAG TGATACCGCT GGGCGGCAAT ACTTCGCACG

251 GTGTGATTGT GTGCAGCCAG CACGGCAGCT ACCGCATCAA AAACCTTAAG

301 CCCGGCGAGA CGGCGATTTT TAATCATGAG GGTGCAAAAA TCGTGATTAA

351 GCAAGGCAAA ATCATTGAGG CCGATTGCGA CGTGTACCGG GTTAACTGCA

401 AACAATACGA GGTTAATGCG GCCACGGATG CCAAATTTAA CGCTCCGTTG

451 GTGGAGACCA GTGCAGTGTT GACGGCGCAA GGCCAAATCA ACGGCAACGG
```

-continued

```
501 CGGCATGGCC GTCGAGGGCG GCGACGGAGC CACCTTTAGC GGCGATGTTA
551 ACCAAACGGG CGGCAGCTTT AACACCGACG GCGACGTGGT GGCCGGCAAT
601 ATATCGTTGC GCCAGCACCC GCATACCGAC AGCATCGGCG GCAAAACCTT
651 ACCGGCGGAA CCGGCATAG
```

This corresponds to the amino acid sequence <SEQ ID 2446; ORF 724.a>:

```
a724.pep
  1 MSLSKLAKKT AQTAKNIGET LRAAFRGKIT LVVSSEPIQR VQLSGLADET
 51 LQDLEHLQEY GFASHPPDGS EAVVIPLGGN TSHGVIVCSQ HGSYRIKNLK
101 PGETAIFNHE GAKIVIKQGK IIEADCDVYR VNCKQYEVNA ATDAKFNAPL
151 VETSAVLTAQ GQINGNGGMA VEGGDGATFS GDVNQTGGSF NTDGDVVAGN
201 ISLRQHPHTD SIGGKTLPAE PA*
``` a724/m724 100.0% identity in 222 aa overlap

```
                  10         20         30         40         50         60
a724.pep  MSLSKLAKKTAQTAKNIGETLRAAFRGKITLVVSSEPIQRVQLSGLADETLQDLEHLQEY
          ||||||||||||||||||||||||||||||||||||||||||||||||||||||||||||
m724      MSLSKLAKKTAQTAKNIGETLRAAFRGKITLVVSSEPIQRVQLSGLADETLQDLEHLQEY
                  10         20         30         40         50         60

70         80         90        100        110        120
a724.pep  GFASHPPDGSEAVVIPLGGNTSHGVIVCSQHGSYRIKNLKPGETAIFNHEGAKIVIKQGK
          ||||||||||||||||||||||||||||||||||||||||||||||||||||||||||||
m724      GFASHPPDGSEAVVIPLGGNTSHGVIVCSQHGSYRIKNLKPGETAIFNHEGAKIVIKQGK
                  70         80         90        100        110        120

130        140        150        160        170        180
a724.pep  IIEADCDVYRVNCKQYEVNAATDAKFNAPLVETSAVLTAQGQINGNGGMAVEGGDGATFS
          ||||||||||||||||||||||||||||||||||||||||||||||||||||||||||||
m724      IIEADCDVYRVNCKQYEVNAATDAKFNAPLVETSAVLTAQGQINGNGGMAVEGGDGATFS
                 130        140        150        160        170        180

190        200        210        220
a724.pep  GDVNQTGGSFNTDGDVVAGNISLRQHPHTDSIGGKTLPAEPAX
          |||||||||||||||||||||||||||||||||||||||||||
m724      GDVNQTGGSFNTDGDVVAGNISLRQHPHTDSIGGKTLPAEPAX
                 190        200        210        220 g725.seq not found yet
g725.pep not found yet
```

The following partial DNA sequence was identified in *N. meningitidis* <SEQ ID 2447>:

```
m725.seq
  1 ATGGTGCGCA CGGTTAAAAG CTACAACGGC GAGGCCGACG ATTTGGCGGG
 51 GCAAATCCAT ACGCTGCCTG CGGTTTGGGT AACGTATGGC GGCAGCAAAG
101 TTGAGCCTGC CAGCACCGGC GGCGTATGCG GACGTTATCA GGATACCGCC
151 GAATTTGTGG TGATGGTGGC GGCCCGCAAT CTGCGCAACG AGCAGGCGCA
201 GCGGCAAGGC GGCATCGACA GCCGCGAAAT CGGCAGCAAC GATTTAATCC
251 GCGCTGTTCG CCGCCTGCTT GACGGCCAGC GGCTCGGTTT TGCCGATAGC
301 CGCGGCTTGG TGCCCAAAGC GGTGCGCGCG ATTGCCAATC ATGTGCTGGT
351 GCAAAACGCC GCAGTAAGCA TATATGCGGT TGAGTATGCC ATCCGCTTTA
401 ACACCTGCGG GTTGGAAAAT GACCGCTACC CCGAACGCAC CGACAATCCC
451 GACGACCCCA ACCATATCTT TACCAAGTAT CAGGGTACAT TGAGCGAGCC
```

```
-continued
501 GTGGCCTGAT TTCGAGGGGT TGGACGGCAA AATTTACGAC CCGCAATCCG

551 CCGATGAAAT ACCTGTAAAC CTAACCCTTA AGGATAAGCA ATGA
```

This corresponds to the amino acid sequence <SEQ ID 2448; ORF 725>:

```
m725.pep
   1 MVRTVKSYNG EADDLAGQIH TLPAVWVTYG GSKVEPASTG GVCGRYQDTA

51 EFVVMVAARN LRNEQAQRQG GIDSREIGSN DLIRAVRRLL DGQRLGFADS

101 RGLVPKAVRA IANHVLVQNA AVSIYAVEYA IRFNTCGLEN DRYPERTDNP

151 DDPNHIFTKY QGTLSEPWPD FEGLDGKIYD PQSADEIPVN LTLKDKQ* a725.seq not found yet a725.pep not found yet g726.seq not found yet g726.pep not found yet
```

The following partial DNA sequence was identified in *N. meningitidis* <SEQ ID 2449>:

```
m726.seq
   1 ATGACCATCT ATTTCAAAAA CGGCTTTTAC GACGACACAT TGGGCGGCAT

51 CCCCGAAGGC GCGGTTGCCG TCCGCGCCGA AGAATACGCC GCCCTTTTGG

101 CAGGACAGGC GCAGGGCGGG CAGATTGCCG CAGATTCCGA CGGCCGCCCC

151 GTTTTAACCC CGCCGCGCCC GTCCGATTAC CACGAATGGG ACGGCAAAAA

201 ATGGAAAATC AGCAAAGCCG CCGCCGCCGC CCGTTTCGCC AAACAAAAAA

251 CCGCCTTGGC ATTCCGCCTC GCGGAAAAGG CGGACGAACT CAAAAACAGC

301 CTCTTGGCGG GCTATCCCCA AGTGGAAATC GACAGCTTTT ACAGGCAGGA

351 AAAAGAAGCC CTCGCGCGGC AGGCGGACAA CAACGCCCCG ACCCCGATGC

401 TGGCGCAAAT CGCCGCCGCA AGGGGCGTGG AATTGGACGT TTTGATTGAA

451 AAAGTTATCG AAAAATCCGC CCGCCTGGCT GTTGCCGCCG GCGCGATTAT

501 CGGAAAGCGT CAGCAGCTCG AAGACAAATT GAACACCATC GAAACCGCGC

551 CCGGATTGGA CGCGCTGGAA AAGGAAATCG AAGAATGGAC GCTAAACATC

601 GGCTGA
```

This corresponds to the amino acid sequence <SEQ ID 2450; ORF 726>:

```
m726.pep
   1 MTIYFKNGFY DDTLGGIPEG AVAVRAEEYA ALLAGQAQGG QIAADSDGRP

51 VLTPPRPSDY HEWDGKKWKI SKAAAAARFA KQKTALAFRL AEKADELKNS

101 LLAGYPQVEI DSFYRQEKEA LARQADNNAP TPMLAQIAAA RGVELDVLIE

151 KVIEKSARLA VAAGAIIGKR QQLEDKLNTI ETAPGLDALE KEIEEWTLNI

201 G*
```

The following partial DNA sequence was identified in *N. meningitidis* <SEQ ID 2451>:

```
a726.seq
   1 ATGACCATCT ATTTCAAAAA CGGCTTTTAC GACGACACCT TGGGCAGCAT

51 CCCCGAAGGC GCGGTTGCCG TCCGCGCCGA AGAATACGCC GCCCTTTTGG

101 CAGGACAGGC GCAGGGCGGG CAGATTGCCG CAGATTCCGA CGGCCGCCCC

151 GTTTTAACCC CGCCGCGCCC GTCCGAATAC CACGAATGGG ACGGCAAGAA

201 ATGGGAAATC GGCGAAGCCG CTGCCGCCGC CCGTTTCGCC GAACAAAAAA

251 CCGCCACGGC ATTCGCCTC GCGGCAAAGG CGGACGAACT CAAAAACAGC

301 CTCTTGGCGG GCTATCCCCA AGTGGAAATC GACAGCTTTT ACAGGCAGGA

351 AAAAGAAGCC CTCGCGCGGC AGGCGGACAA CAACGCCCCG ACCCCGATGC

401 TGGCGCAAAT CGCCGCCGCA AGGGGCGTGG AATTGGACGT TTTGATTGAA

451 AAAGTTGTCG AAAAATCCGC CCGCCTGGCC GTTGCCGCCG GCGCGATTAT

501 CGGAAAGCGG CAGCAGCTCG AAGACAAATT GAACACCATC GAAACCGCGC

551 CAGGATTGGA CGCGCTGGAA AAGGAAATCG AAGAATGGAC GCTAAACATC

601 GGCTGA
```

This corresponds to the amino acid sequence <SEQ ID 2452; ORF 726.a>:

```
a726.pep
   1 MTIYFKNGFY DDTLGSIPEG AVAVRAEEYA ALLAGQAQGG QIAADSDGRP

51 VLTPPRPSEY HEWDGKKWEI GEAAAAARFA EQKTATAFRL AAKADELKNS

101 LLAGYPQVEI DSFYRQEKEA LARQADNNAP TPMLAQIAAA RGVELDVLIE

151 KVVEKSARLA VAAGAIIGKR QQLEDKLNTI ETAPGLDALE KEIEEWTLNI

201 G*
``` a726/m726 95.5% identity in 201 aa overlap

```
                 10         20         30         40         50         60
a726.pep  MTIYFKNGFYDDTLGSIPEGAVAVRAEEYAALLAGQAQGGQIAADSDGRPVLTPPRPSEY
          ||||||||||||||||:|||||||||||||||||||||||||||||||||||||||||:|
m726      MTIYFKNGFYDDTLGGIPEGAVAVRAEEYAALLAGQAQGGQIAADSDGRPVLTPPRPSDY
                 10         20         30         40         50         60

70         80         90        100        110        120
a726.pep  HEWDGKKWEIGEAAAAARFAEQKTATAFRLAAKADELKNSLLAGYPQVEIDSFYRQEKEA
          ||||||||:|::|||||||:||||  |||||| |||||||||||||||||||||||||||
m726      HEWDGKKWKISKAAAAARFAKQKTALAFRLAEKADELKNSLLAGYPQVEIDSFYRQEKEA
                 70         80         90        100        110        120

130        140        150        160        170        180
a726.pep  LARQADNNAPTPMLAQIAAARGVELDVLIEKVVEKSARLAVAAGAIIGKRQQLEDKLNTI
          ||||||||||||||||||||||||||||||:|||||||||||||||||||||||||||||
m726      LARQADNNAPTPMLAQIAAARGVELDVLIEKVIEKSARLAVAAGAIIGKRQQLEDKLNTI
                130        140        150        160        170        180

190        200
a726.pep  ETAPGLDALEKEIEEWTLNIGX
          ||||||||||||||||||||||
m726      ETAPGLDALEKEIEEWTLNIGX
                190        200 g727.seq not found yet g727.pep not found yet
```

The following partial DNA sequence was identified in *N. meningitidis* <SEQ ID 2453>:

```
m727.seq
    1 ATGAATCTCG TGAAACTGCT GGCGAATAAC TGGCAACCGA TTGCCATTAT

51 CGCGCTTGTC GGCACGGGCT TGGCTGTGTC GCACCATCAA GGCTACAAGT

101 CGGCATTTGC GAAGCAGCAG GCGGTCATCG ACAAGATGGA GCGCGACAAG

151 GCGCAAGCCC TGCTGTTGTC GGCTCAAAAC TATGCGCGCG AACTGGAACT

201 GGCACGCGCG GAAGCTAAAA AATATGAAGT CAAGGCGCAC GCTGTCGGCA

251 TGGCTTTGGC GAAAAAACAG GCGGAAGTCA GCCGTCTGAA AACGGAAAGA

301 GACCTTTGCA AAATTCCTTT CCCTCCCGAC AGCCGAAACC CAAACACAGG

351 TTTTCGGCTG TTTTCGCCCC AAATACCGCC TAATTTTACC CAAATACCCC

401 CTTAA
```

This corresponds to the amino acid sequence <SEQ ID 2454; ORF 727>:

```
m727.pep
    1 MNLVKLLANN WQPIAIIALV GTGLAVSHHQ GYKSAFAKQQ AVIDKMERDK

51 AQALLLSAQN YARELELARA EAKKYEVKAH AVGMALAKKQ AEVSRLKTER

101 DLCKIPFPPD SRNPNTGFRL FSPQIPPNFT QIPP*
```

The following partial DNA sequence was identified in *N. meningitidis* <SEQ ID 2455>:

```
a727.seq
    1 ATGAATCTCG TGAAACTGCT GGCGAATAAC TGGCAACCGA TTGCCATCAT

51 CGCGCTTGTC GGCACGGGTT TGGCGGTGTC GCACCATCAA GGCTACAAGT

101 CGGCTTTTGC GAAGCAGCAG GCGGTCATTG AGAAAATGAA GCGCGACAAG

151 GCGCAAGCCC TGCTGTTGTC GGCTCAAAAC TACGCCCGCG AACTGGAACA

201 GGCGCGTGCG GAAGCTAAAA AATATGAAGT CAAGGCGCAC GCCGTCGGCA

251 TGGCTTTGGC GAAAAAACAG GCGGAAGTCA GCCGTCTGAA AACGGAAAAT

301 AAAAAGGAAA TCGAAAATGT CCTTACTCAA GACCGTAAAA ATGCAGGCGG

351 CGGTTGTATT GACGGCTTTG GCCATCACGG CTTGCAGCTC TACAAGCGCG

401 CCCTCGGCTA CGGAAATTAA
```

This corresponds to the amino acid sequence <SEQ ID 2456; ORF 727.a>:

```
a727.pep
    1 MNLVKLLANN WQPIAIIALV GTGLAVSHHQ GYKSAFAKQQ AVIEKMKRDK

51 AQALLLSAQN YARELEQARA EAKKYEVKAH AVGMALAKKQ AEVSRLKTEN

101 KKEIENVLTQ DRKNAGGGCI DGFGHHGLQL YKRALGYGN*
``` a727/m727 83.2% identity in 119 aa overlap

```
                  10         20         30         40         50         60
      a727.pep  MNLVKLLANNWQPIAIIALVGTGLAVSHHQGYKSAFAKQQAVIEKMKRDKAQALLLSAQN
                ||||||||||||||||||||||||||||||||||||||||||| ||:||||||||||||
          m727  MNLVKLLANNWQPIAIIALVGTGLAVSHHQGYKSAFAKQQAVIDKMERDKAQALLLSAQN
                  10         20         30         40         50         60
```

```
                  70         80         90        100        110       119
m717.pep  YARELEQARAEAKKYEVKAHAVGMALAKKQAEVSRLKTENKKEIENV-LTQDRKNAGGGC
          ||||||  |||||||||||||||||||||||||||||||  ::: :: : | :|  : |
g717      YARELELARAEAKKYEVKAHAVGMALAKKQAEVSRLKTE--RDLCKIPFPPDSRNPNTGF
                  70         80         90        100        110

120        130        140
m717.pep    IDGFGHHGLQLYKRALGYGNX g717        RLFSPQIPPNFTQIPPX
            120        130
```

The following partial DNA sequence was identified in *N. gonorrhoeae* <SEQ ID 2457>:

```
g728.seq
    1 ATGTTTAAAA AATTCAAACC GGTACTGTTG TCATTTTTTG CACTTGTATT

51 TGCCTTTTGG CTGGGAACAG GTATTGCCTA TGAGATTAAT CCGCGTTGGT

101 TTTTGAGCGA TACGGCAACT GAAGTACCTG AAAATCCGAA TGCTTTTGTG

151 GCGAAACTTG CCCGCCTGTT CCGAAATGCC GACAGGGCGG TTGTCATCGT

201 GAAGGAATCG ATGAGGACGG AGGAAAGCCT TGCCGGAGCT GTGGATGACG

251 GTCCGTTGCA GTCGGAGAAG GATTATCTCG CGCTCGCTAT CCGGCTCAGT

301 CGTTTGAAAG AAAAGGCGAA ATGGTTTCAC GTAACGGAGC AGGAACATGG

351 GGAAGAGGTT TGGCTGGATT ACTATATCGG CGAGGGCGGT TTGGTTGCGG

401 TTTCGCTTTC GCAACGCTCG CCGGAAGCGT TGTTAATGC CGAATATCTG

451 TATCGGAACG ATCGTCCGTT TTCTGTAAAT GTGTACGGCG GAACGGCTCA

501 CGGGGAAAAT TATGAAACGA CAGGAGAATA TCGGGTTGTT TGGCAACCGG

551 ACGGTTCGGT ATTTGATGCG GCGGGGCGCG GGAAAATCGG GGAAGATGTT

601 TATGAGCATT GCCTCGGGTG TTATCAGATG GCCCAGGTAT ATTTGGCGAA

651 ATACCGGGAT GTCGCGAATG ACGAGCAGAA GGTTTGGGAC TTCCGCGAAG

701 AGAGCAACCG GATTGCATCG GACTCGCGCG ATTATGTGTT TTATCAGAAT

751 ATGCGGGAAT TGATGCCCCG GGGGATGAAG GCGAACAGTC TTGTGGTCGG

801 CTATGATGCG GACGGTCTGC CGCAAAAAGT CTATTGGAGT TTCGACAATG

851 GAAAAAAACG CCAGAGTTTC GAATATTATT TGAAAAACGG AAATCTTTTT

901 ATTGCACAAT CTTCGACGGT AGCATTGAAA GCGGATGGCG TAACGGCGGA

951 TATGCAGACC TATCATGCGC AACAGACGTG GTATTTGGAT GGCGGGCGGA

1001 TTATCCGCGA AGAGAAACAG GGAGACAGAC TGCCTGATTT TCCTTTGAAC

1051 TTGGAAGATT TGGAAAAAGA GGTGAGCCGT TATGCAGAGG CTGCGGCGAG

1101 ACGTTCGGGC GGCAGGCGCG GCCTTTCTCA CTGA
```

This corresponds to the amino acid sequence <SEQ ID 2458; ORF 728>:

```
g728.pep
    1 MFKKFKPVLL SFFALVFAFW LGTGIAYEIN PRWFLSDTAT EVPENPNAFV

51 AKLARLFRNA DRAVVIVKES MRTEESLAGA VDDGPLQSEK DYLALAIRLS

101 RLKEKAKWFH VTEQEHGEEV WLDYYIGEGG LVAVSLSQRS PEAFVNAEYL

151 YRNDRPFSVN VYGGTAHGEN YETTGEYRVV WQPDGSVFDA AGRGKIGEDV

201 YEHCLGCYQM AQVYLAKYRD VANDEQKVWD FREESNRIAS DSRDYVFYQN
```

```
251 MRELMPRGMK ANSLVVGYDA DGLPQKVYWS FDNGKKRQSF EYYLKNGNLF

301 IAQSSTVALK ADGVTADMQT YHAQQTWYLD GGRIIREEKQ GDRLPDFPLN

351 LEDLEKEVSR YAEAAARRSG GRRGLSH*
```

The following partial DNA sequence was identified in *N. meningitidis* <SEQ ID 2459>:

```
m728.seq
    1 ATGTTTAAAA AATTCAAACC GGTACTGTTG TCATTTTTTG CACTTGTATT

51 TGCCTTTTGG CTGGGAACGG GTATTGCCTA TGAGATTAAT CCGCGTTGGT

101 TTTTGAGCGA TACGGCAACT GAAGTACCTA AAATCCGAA TGCTTTTGTG

151 GCGAAACTTG CCCGCCTGTT CCGAAATGCC GACAGGGCGG TTGTCATCGT

201 GAAGGAATCG ATAAGGACGG AGGAAAATCT TGCCGGAACT GTGGATGACG

251 GTCCGTTGCA GTCGGAGAAG GATTATCTCG CGCTCGCTAT CCGGCTCAGT

301 CGTTTGAAAG AAAAGGCGAA ATGGTTTCAC GTAACGGAGC AGGAACATGG

351 GAAAGAGGTT TGGCTGGATT ACCATATCGG CGAGGGCGGT TTGGTTGCGG

401 TTTCGCTTTC GCAACGCTCG CCGGAAGCAT TTGTTAATGC CGAATATCTG

451 TATCGGAACG ATCGTCCGTT TTCTGTAAAT GTGTACGGCG GAACGGTTCA

501 CGGGGAAAAT TATGAAACGA CAGGAGAATA TCGGGTTGTT TGGCAACCAG

551 ACGGTTCGGT ATTTGATGCG GCGGGGCGCG GGAAAATCGG GGAAGATGTT

601 TATGAGCATT GCCTCGGGTG TTATCAGATG GCCCAGGTAT ATTTGGCGAA

651 ATACCGGGAT GTCGCGAATG ACGAGCAGAA GGTTTGGGAC TTCCGCAAAG

701 AGAGCAACCG AATTGCGTCG GACTCGCGCA ATTCTGTGTT TTATCAGAAT

751 ATGCGGGAAT TGATGCCCCG AGGGATGAAG GCGAACAGTC TTGTGGTCGG

801 CTATGATGCG GACGGTCTGC CGCAAAAAGT CTATTGGAGT TTCGACAATG

851 GAAAAAAACG CCAGAGTTTC GAATATTATT TGAAAAACGG AAATCTTTTT

901 ATTGCACAAT CTTCGACGGT AGCATTGAAA GCGGATGGCG TAACGGCGGA

951 TATGCAGACC TATCATGCGC AACAGACGTG GTATTTGGAT GGCGGGCGGA

1001 TTGTCCGCGA AGAGAAACAG GGAGACAGAC TGCCTGATTT TCCTTTGAAC

1051 TTGGAAAATT TGGAAAAAGA GGTGCGCCGT TATGCAGAGG CTGCGGCGAG

1101 ACGTTCGGGC GGCAGGCGCG ACCTTTCTCA CTGA
```

This corresponds to the amino acid sequence <SEQ ID 2460; ORF 728>:

```
m728.pep
    1 MFKKFKPVLL SFFALVFAFW LGTGIAYEIN PRWFLSDTAT EVPKNPNAFV

51 AKLARLFRNA DRAVVIVKES IRTEENLAGT VDDGPLQSEK DYLALAIRLS

101 RLKEKAKWFH VTEQEHGKEV WLDYHIGEGG LVAVSLSQRS PEAFVNAEYL

151 YRNDRPFSVN VYGGTVHGEN YETTGEYRVV WQPDGSVFDA AGRGKIGEDV

201 YEHCLGCYQM AQVYLAKYRD VANDEQKVWD FRKESNRIAS DSRNSVFYQN

251 MRELMPRGMK ANSLVVGYDA DGLPQKVYWS FDNGKKRQSF EYYLKNGNLF

301 IAQSSTVALK ADGVTADMQT YHAQQTWYLD GGRIVREEKQ GDRLPDFPLN

351 LENLEKEVRR YAEAAARRSG GRRDLSH*
```

Computer analysis of the amino acid sequences gave the following results:
Homology with a Predicted ORF from *N. meningitidis* menA with menB
ORF 728 shows 96.3% identity over a 377 aa overlap with a predicted ORF (ORF728.a) from *N. gonorrhoeae*:

```
m728/g728

10         20         30         40         50         60
    m728.pep  MFKKFKPVLLSFFALVFAFWLGTGIAYEINPRWFLSDTATEVPKNPNAFVAKLARLFRNA
              ||||||||||||||||||||||||||||||||||||||||||:|||||||||||||||||
    g728      MFKKFKPVLLSFFALVFAFWLGTGIAYEINPRWFLSDTATEVPENPNAFVAKLARLFRNA
                 10         20         30         40         50         60

70         80         90        100        110        120
    m728.pep  DRAVVIVKESIRTEENLAGTVDDGPLQSEKDYLALAIRLSRLKEKAKWFHVTEQEHGKEV
              |||||||||:||||:|||:|||||||||||||||||||||||||||||||||||||:||
    g728      DRAVVIVKESMRTEESLAGAVDDGPLQSEKDYLALAIRLSRLKEKAKWFHVTEQEHGEEV
                 70         80         90        100        110        120

130        140        150        160        170        180
    m728.pep  WLDYHIGEGGLVAVSLSQRSPEAFVNAEYLYRNDRPFSVNVYGGTVHGENYETTGEYRVV
              ||||:|||||||||||||||||||||||||||||||||||||||:|||||||||||||||
    g728      WLDYYIGEGGLVAVSLSQRSPEAFVNAEYLYRNDRPFSVNVYGGTAHGENYETTGEYRVV
                130        140        150        160        170        180

190        200        210        220        230        240
    m728.pep  WQPDGSVFDAAGRGKIGEDVYEHCLGCYQMAQVYLAKYRDVANDEQKVWDFRKESNRIAS
              |||||||||||||||||||||||||||||||||||||||||||||||||||:||||||||
    g728      WQPDGSVFDAAGRGKIGEDVYEHCLGCYQMAQVYLAKYRDVANDEQKVWDFREESNRIAS
                190        200        210        220        230        240

250        260        270        280        290        300
    m728.pep  DSRNSVFYQNMRELMPRGMKANSLVVGYDADGLPQKVYWSFDNGKKRQSFEYYLKNGNLF
              |||:||||||||||||||||||||||||||||||||||||||||||||||||||||||||
    g728      DSRDYVFYQNMRELMPRGMKANSLVVGYDADGLPQKVYWSFDNGKKRQSFEYYLKNGNLF
                250        260        270        280        290        300

310        320        330        340        350        360
    m728.pep  IAQSSTVALKADGVTADMQTYHAQQTWYLDGGRIVREEKQGDRLPDFPLNLENLEKEVRR
              |||||||||||||||||||||||||||||||||:|||||||||||||||||:|||||:|
    g728      IAQSSTVALKADGVTADMQTYHAQQTWYLDGGRIIREEKQGDRLPDFPLNLEDLEKEVSR
                310        320        330        340        350        360

370
    m728.pep  YAEAAARRSGGRRDLSHX
              |||||||||||||  |||
    g728      YAEAAARRSGGRRGLSHX
                370
```

The following partial DNA sequence was identified in *N. meningitidis* <SEQ ID 2461>:

```
a728.seq
    1  ATGTTTAAAA AATTCAAACC GGTACTGTTG TCATTTTTTG CACTTGTATT
   51  TGCCTTTTGG CTGGGAACGG GTATTGCCTA TGAGATTAAT CCGCGTTGGT
  101  TTTTGAGCGA TACGGCAACT GAAAATCCGA ATGCTTTTGT GGCGAAACTT
  151  GCCCGCCTGT TCCGAAATGC CGACAGGGCG GTTGTCATCG TGAAGGAATC
  201  GATGAGGACG GAGGAAAGTC TTGCCGGAGC TGTGGATGAC GGTCCGTTGC
  251  AGTCGGAGAA GGATTATCTT GCACTCGCTG TCCGGCTCAG TCGTTTGAAA
  301  GAAAAGGCGA AATGGTTTCA CGTAACGGAG CAGGAACATG GGGAAGAGGT
  351  TTGGCTGGAT TACTATATCG GCGAGGGCGG TTTGGTTGCG GTTTCGCTTT
  401  CGCAACGCTC GCCGGAAGCG TTTGTTAATG CCGAATATCT GTATCGGAAC
  451  GATCGTCCGT TTTCTGTAAA TGTGTACGGC GGAACGGTTC ACGGGGAAAA
  501  TTATGAAACG ACAGGAGAAT ATCGGGTTGT TTGGCAACCG GACGGTTCGG
  551  TATTTGATGC GTCGGGCGC GGGAAAATCG GGAAGATGT TTATGAGCAT
  601  TGCCTCGGGT GTTATCAGAT GGCCCAGGTA TATTTGGCGA AATATCGGGA
```

```
 651 TGTCGCGAAT GATGAGCAGA AGGTTTGGGA CTTCCGCGAA GAGAGTAACC

701 GGATTGCGTC GGACTCGCGC GATTCTGTGT TTTATCAGAA TATGCGGGAA

751 TTGATGCCCC GAGGGATGAA GGCAAACAGT CTTGTGGTCG GCTATGATGC

801 GGACGGTCTG CCGCAGAAAG TCTATTGGAG TTTCGACAAT GGGAAAAAAC

851 GCCAGAGTTT CGAATATTAT TTGAAAAACG GAAATCTTTT TATTGCACAA

901 TCTTCGACGG TAGCATTGAA AGCGGATGGC GTAACGGCGG ATATGCAGAC

951 CTATCATGCG CAACAGACGT GGTATTTAGA TGGCGGGCGG ATTGTCCGCG

1001 AAGAGAAACA GGGGGACAGA CTGCCTGATT TTCCTTTGAA CTTGGAAGAT

1051 TTGGAAAAAG AGGTGAGCCG TTATGCAGAG GCTGCGGCGA GACGTTCGGG

1101 CGGCAGGCGC GACCTTTCTC ACTGA
```

This corresponds to the amino acid sequence <SEQ ID 2462; ORF 728.a>:

```
a728.pep

1 MFKKFKPVLL SFFALVFAFW LGTGIAYEIN PRWFLSDTAT ENPNAFVAKL

51 ARLFRNADRA VVIVKESMRT EESLAGAVDD GPLQSEKDYL ALAVRLSRLK

101 EKAKWFHVTE QEHGEEVWLD YYIGEGGLVA VSLSQRSPEA FVNAEYLYRN

151 DRPFSVNVYG GTVHGENYET TGEYRVVWQP DGSVFDASGR GKIGEDVYEH

201 CLGCYQMAQV YLAKYRDVAN DEQKVWDFRE ESNRIASDSR DSVFYQNMRE

251 LMPRGMKANS LVVGYDADGL PQKVYWSFDN GKKRQSFEYY LKNGNLFIAQ

301 SSTVALKADG VTADMQTYHA QQTWYLDGGR IVREEKQGDR LPDFPLNLED

351 LEKEVSRYAE AAARRSGGRR DLSH* a728/m728  96.3% identity in 377 aa overlap
                  10         20         30         40         50
  a728.pep  MFKKFKPVLLSFFALVFAFWLGTGIAYEINPRWFLSDTATE---NPNAFVAKLARLFRNA
            ||||||||||||||||||||||||||||||||||||||||   |||||||||||||||||
  m728      MFKKFKPVLLSFFALVFAFWLGTGIAYEINPRWFLSDTATEVPKNPNAFVAKLARLFRNA
                  10         20         30         40         50         60

60         70         80         90        100        110
  a728.pep  DRAVVIVKESMRTEESLAGAVDDGPLQSEKDYLALAVRLSRLKEKAKWFHVTEQEHGEEV
            ||||||||||:|||:|||:||||||||||||||||||:||||||||||||||||||||:||
  m728      DRAVVIVKESIRTEENLAGTVDDGPLQSEKDYLALAIRLSRLKEKAKWFHVTEQEHGKEV
                      70         80         90        100        110        120

120        130        140        150        160        170
  a728.pep  WLDYYIGEGGLVAVSLSQRSPEAFVNAEYLYRNDRPFSVNVYGGTVHGENYETTGEYRVV
            ||||:|||||||||||||||||||||||||||||||||||||||||||||||||||||||
  m728      WLDYHIGEGGLVAVSLSQRSPEAFVNAEYLYRNDRPFSVNVYGGTVHGENYETTGEYRVV
                     130        140        150        160        170        180

180        190        200        210        220        230
  a728.pep  WQPDGSVFDASGRGKIGEDVYEHCLGCYQMAQVYLAKYRDVANDEQKVWDFREESNRIAS
            |||||||||||:|||||||||||||||||||||||||||||||||||||||:|||||||
  m728      WQPDGSVFDAAGRGKIGEDVYEHCLGCYQMAQVYLAKYRDVANDEQKVWDFRKESNRIAS
                     190        200        210        220        230        240

240        250        260        270        280        290
  a728.pep  DSRDSVFYQNMRELMPRGMKANSLVVGYDADGLPQKVYWSFDNGKKRQSFEYYLKNGNLF
            |||:||||||||||||||||||||||||||||||||||||||||||||||||||||||||
  m728      DSRNSVFYQNMRELMPRGMKANSLVVGYDADGLPQKVYWSFDNGKKRQSFEYYLKNGNLF
                     250        260        270        280        290        300

300        310        320        330        340        350
  a728.pep  IAQSSTVALKADGVTADMQTYHAQQTWYLDGGRIVREEKQGDRLPDFPLNLEDLEKEVSR
            ||||||||||||||||||||||||||||||||||||||||||||||||||||:|||| |
  m728      IAQSSTVALKADGVTADMQTYHAQQTWYLDGGRIVREEKQGDRLPDFPLNLENLEKEVRR
                     310        320        330        340        350        360

360        370
  a728.pep  YAEAAARRSGGRRDLSHX
            ||||||||||||||||||
  m728      YAEAAARRSGGRRDLSHX
                     370
```

The following partial DNA sequence was identified in *N. gonorrhoeae* <SEQ ID 2463>:

```
g729.seq
     1 ATGAATACTA CATTGAAAAC TACCTTGACC TCTGTTGCAG CAGCCTTTGC

51 ATTGTCTGCC TGCACCATGA TTCCTCAATA CGAGCAGCCC AAAGTCGAAG

101 TTGCGGAAAC CTTCCAAAAC GACACATCGG TTTCTTCCAT CCGCGCGGTT

151 GATTTGGGTT GGCATGACTA TTTTGCCGAC CCGCGCCTGC AAAAGCTGAT

201 CGACATCGCA CTCGAGCGCA ATACCAGTTT GCGTACAGCC GTATTGAACA

251 GCGAAATCTA CCGCAAACAA TACATGATCG AGCGCAACAA CCTCCTGCCC

301 ACGCTTGCCG CCAATGCGAA CGGCTCGCGC CAAGGCAGCT TGAGCGGCgg 351 caaTGTCAGC AGCAGCTACA ATGTCGGACT GGGTGcGGca tCTTACGAAC 401 TCGATCTGTT CgGGCGCGTG CGCagcaacA GcgaagcAGC ACTGcaggGC 451 tATTTTGCCA GCGTTGCCAA CcgcGATGCG GCACATTTGa ttCtGATTGC 501 CACCGTTGCC AAAGCCTATT TCAAcgaGcG TTATGCCGAA AAAGcgatgT 551 CTTTGGCGCa gcGTGTCTTG AAAACGCGCG AGGAAACCTA CAAGCTGTCC

601 GAATTGCGGT ACAAGGCAGG CGTGATTTCC GCCGTCGCCC TGCGCCAGCA

651 GGAAGCCTTG ATTGAATCTG CCAAAGCCGA TTATGCCCAT GCCGCGCGCa 701 gcCGCGAACA GGCGCGCAAT GCCTTGGCAA CCTTGATTAA ccGTCCGATA

751 CCCGAagaCC TGCCCGCCGG TTTGCCGTTG GACAagcAGT TTTTTGTTGA

801 AAAACTGCCT GCCGGTTTGA GTTCCGAAGT ATTGCTCGAC CGTCCCGACA

851 TCCGCGCCGC CGAACACGCG CTCAAACAGG CAAACGCCAA TATCGGTGCG 901 gcgCGCGCCg ccTTTTTCCC GTCCATCCGC CTGACCGGAA GCGTCGGTAC

951 GGGTTCTGTC GAATTGGGCG GGCTGTTCAA AAGCGGCACG GGCGTTTGGG

1001 CGTTCGCTCC GTCTATTACC CTGCCGATTT TTACTTGGGG AACGAACAAG

1051 GCGAACCTTG ATGTGGCAAA ACTGCGCCAA CAGGCACAAA TTGTTGCCTA

1101 TGAATCCGCC GTCCAATCCG CCTTTCAAGA CGTGGCAAAC GCATTGGCGG

1151 CGCGCGAGCA GCTGGATAAA GCCTATGACG CTTTAAGCAA ACAAAGCCGC

1201 GCCTCTAAAG AAGCGTTGCG CTTGGTCGGA CTGCGTTACA ACACGGCGT

1251 ATCCGGCGCG CTCGATTTGC TCGATGCGGA ACGCATCAGC TATTCGGCGG

1301 AAGGTGCGGC TTTGTCGGCA CAACTGACCC GCGCCGAAAA CCTTGCCGAT

1351 TTGTACAAGG CGCTCgacGG CGGATTGAAA CGGGATACCC AAACCGGCAA

1401 ATAA
```

This corresponds to the amino acid sequence <SEQ ID 2464; ORF 729>:

```
g729.pep
     1 MNTTLKTTLT SVAAAFALSA CTMIPQYEQP KVEVAETFQN DTSVSSIRAV

51 DLGWHDYFAD PRLQKLIDIA LERNTSLRTA VLNSEIYRKQ YMIERNNLLP

101 TLAANANGSR QGSLSGGNVS SSYNVGLGAA SYELDLFGRV RSNSEAALQG

151 YFASVANRDA AHLILIATVA KAYFNERYAE KAMSLAQRVL KTREETYKLS

201 ELRYKAGVIS AVALRQQEAL IESAKADYAH AARSREQARN ALATLINRPI

251 PEDLPAGLPL DKQFFVEKLP AGLSSEVLLD RPDIRAAEHA LKQANANIGA
```

-continued

```
301 ARAAFFPSIR LTGSVGTGSV ELGGLFKSGT GVWAFAPSIT LPIFTWGTNK

351 ANLDVAKLRQ QAQIVAYESA VQSAFQDVAN ALAAREQLDK AYDALSKQSR

401 ASKEALRLVG LRYKHGVSGA LDLLDAERIS YSAEGAALSA QLTRAENLAD

451 LYKALDGGLK RDTQTGK*
```

The following partial DNA sequence was identified in *N. meningitidis* <SEQ ID 2465>:

```
m729.seq
     1 ATGGATACTA CATTGAAAAC CACCTTGACT TCTGTTGCAG CAGCCTTTGC

51 ATTGTCTGCC TGCACCATGA TTCCCCAATA CGAGCAGCCC AAAGTCGAAG

101 TTGCCGAAAC GTTCAAAAAC GATACCGCCG ACAGCGGCAT CCGCGCCGTC

151 GATTTAGGTT GGCATGACTA TTTTGCCGAC CCGCGCCTGC AAAAGCTGAT

201 CGACATCGCA CTCGAGCGCA ATACCAGTTT GCGTACCGCC GTATTGAACA

251 GCGAAATCTA CCGCAAACAA TACATGATTG AGCGCAACAA CCTCCTGCCC

301 ACGCTTGCCG CCAATGCGAA CGACTCGCGC CAAGGCAGCT TGAGCGGCGG

351 CAATGTAAGC AGCAGCTACA AAGTCGGACT GGGTGCGGCA TCTTACGAAC

401 TCGATCTGTT CGGGCGTGTA CGCAGCAGCA GCGAGGCGGC ACTGCAAGGC

451 TATTTCGCCA GCACCGCCAA CCGCGATGCG GCACATTTGA GCCTGATTGC

501 CACCGTTGCC AAAGCCTATT CAACGAACG TTACGCCGAA GAAGCGATGT

551 CTTTGGCGCA ACGTGTTTTG AAAACGCGCG AGGAAACCTA CAAGCTGTCC

601 GAATTACGTT ACAAGGCAGG CGTGATTTCC GCCGTCGCCC TACGTCAGCA

651 GGAAGCCCTG ATCGAATCTG CCAAAGCCGA TTATGCCCAT GCCGCGCGCA

701 GCCGCGAACA GGCGCGCAAT GCCTTGGCAA CCTTGATTAA CCAACCGATA

751 CCCGAAGACC TGCCTGCCGG TTTGCCGCTG ACAAGCAGT TTTTTGTTGA

801 AAAACTGCCG GCCGGTTTGA GTTCCGAAGT ATTGCTCGAC CGTCCCGATA

851 TCCGTGCTGC CGAACACGCG CTCAAACAGG CAAACGCCAA TATCGGTGCG

901 GCACGCGCCG CCTTTTTCCC ATCCATCCGC CTGACCGGAA CCGTCGGTAC

951 GGGTTCTGCC GAATTGGGTG GGTTGTTCAA AAGCGGCACG GGCGTTTGGT

1001 CGTTCGCGCC GTCTATTACC CTGCCGATTT TTACCTGGGG TACGAACAAG

1051 GCGAACCTTG ATGTAGCCAA GCTGCGCCAA CAGGTACAAA TCGTTGCCTA

1101 TGAATCCGCC GTCCAATCCG CATTTCAAGA CGTGGCAAAC GCATTGGCGG

1151 CGCGCGAGCA GCTGGATAAA GCCTATGACG CTTTAAGCAA ACAAAGCCGC

1201 GCCTCTAAAG AAGCGTTGCG CTTGGTCGGC CTGCGTTACA AGCACGGCGT

1251 ATCCGGCGCG CTCGACTTGC TCGATGCGGA ACGCAGCAGC TATGCGGCGG

1301 AGGGTGCGGC TTTGTCGGCA CAACTGACCC GCGCCGAAAA CCTTGCCGAT

1351 TTGTACAAGG CACTCGGCGG CGGATTGAAA CGGGATACCC AAACCGACAA

1401 ATAA
```

This corresponds to the amino acid sequence <SEQ ID 2466; ORF 729>:

```
m729.pep
     1 MDTTLKTTLT SVAAAFALSA CTMIPQYEQP KVEVAETFKN DTADSGIRAV
```

-continued

```
 51 DLGWHDYFAD PRLQKLIDIA LERNTSLRTA VLNSEIYRKQ YMIERNNLLP

101 TLAANANDSR QGSLSGGNVS SSYKVGLGAA SYELDLFGRV RSSSEAALQG

151 YFASTANRDA AHLSLIATVA KAYFNERYAE EAMSLAQRVL KTREETYKLS

201 ELRYKAGVIS AVALRQQEAL IESAKADYAH AARSREQARN ALATLINQPI

251 PEDLPAGLPL DKQFFVEKLP AGLSSEVLLD RPDIRAAEHA LKQANANIGA

301 ARAAFFPSIR LTGTVGTGSA ELGGLFKSGT GVWSFAPSIT LPIFTWGTNK

351 ANLDVAKLRQ QVQIVAYESA VQSAFQDVAN ALAAREQLDK AYDALSKQSR

401 ASKEALRLVG LRYKHGVSGA LDLLDAERSS YAAEGAALSA QLTRAENLAD

451 LYKALGGGLK RDTQTDK*
```

Computer analysis of the amino acid sequences gave the following results:

Homology with a Predicted ORF from *N. meningitidis* menA with menB

ORF 729 shows 95.7% identity over a 467 aa overlap with a predicted ORF (ORF729.a) from *N. gonorrhoeae*:

```
  m729/g729  95.7% identity in 467 aa overlap 10        20        30        40        50        60
m729.pep  MDTTLKTTLTSVAAAFALSACTMIPQYEQPKVEVAETFKNDTADSGIRAVDLGWHDYFAD
          :|||||||||||||||||||||||||||||||||:|||: |:||||||||||||||||
g729      MNTTLKTTLTSVAAAFALSACTMIPQYEQPKVEVAETFQNDTSVSSIRAVDLGWHDYFAD
                  10        20        30        40        50        60

70        80        90       100       110       120
m729.pep  PRLQKLIDIALERNTSLRTAVLNSEIYRKQYMIERNNLLPTLAANANDSRQGSLSGGNVS
          ||||||||||||||||||||||||||||||||||||||||||||||| ||||||||||||
g729      PRLQKLIDIALERNTSLRTAVLNSEIYRKQYMIERNNLLPTLAANANGSRQGSLSGGNVS
                  70        80        90       100       110       120

130       140       150       160       170       180
m729.pep  SSYKVGLGAASYELDLFGRVRSSSEAALQGYFASTANRDAAHLSLIATVAKAYFNERYAE
          |||:||||||||||||||||||:|||||||||||:|||||||| |:|||||||||||||
g729      SSYNVGLGAASYELDLFGRVRSNSEAALQGYFASVANRDAAHLILIATVAKAYFNERYAE
                 130       140       150       160       170       180

190       200       210       220       230       240
m729.pep  EAMSLAQRVLKTREETYKLSELRYKAGVISAVALRQQEALIESAKADYAHAARSREQARN
          :|||||||||||||||||||||||||||||||||||||||||||||||||||||||||
g729      KAMSLAQRVLKTREETYKLSELRYKAGVISAVALRQQEALIESAKADYAHAARSREQARN
                 190       200       210       220       230       240

250       260       270       280       290       300
m729.pep  ALATLINQPIPEDLPAGLPLDKQFFVEKLPAGLSSEVLLDRPDIRAAEHALKQANANIGA
          ||||||||:|||||||||||||||||||||||||||||||||||||||||||||||||
g729      ALATLINRPIPEDLPAGLPLDKQFFVEKLPAGLSSEVLLDRPDIRAAEHALKQANANIGA
                 250       260       270       280       290       300

310       320       330       340       350       360
m729.pep  ARAAFFPSIRLTGTVGTGSAELGGLFKSGTGVWSFAPSITLPIFTWGTNKANLDVAKLRQ
          ||||||||||||:||||:|||||||||||||||:||||||||||||||||||||||||
g729      ARAAFFPSIRLTGSVGTGSVELGGLFKSGTGVWAFAPSITLPIFTWGTNKANLDVAKLRQ
                 310       320       330       340       350       360

370       380       390       400       410       420
m729.pep  QVQIVAYESAVQSAFQDVANALAAREQLDKAYDALSKQSRASKEALRLVGLRYKHGVSGA
          |:|||||||||||||||||||||||||||||||||||||||||||||||||||||||||
g729      QAQIVAYESAVQSAFQDVANALAAREQLDKAYDALSKQSRASKEALRLVGLRYKHGVSGA
                 370       380       390       400       410       420

430       440       450       460
m729.pep  LDLLDAERSSYAAEGAALSAQLTRAENLADLYKALGGGLKRDTQTDKX
          ||||||||| ||:||||||||||||||||| ||||||| ||||||| ||
g729      LDLLDAERISYSAEGAALSAQLTRAENLADLYKALDGGLKRDTQTGKX
                 430       440       450       460
```

The following partial DNA sequence was identified in *N. meningitidis* <SEQ ID 2467>:

```
a729.seq
   1   ATGGATACTA CATTGAAAAC CACCTTGACT TCTGTTGCAG CAGCCTTCGC
```

```
  51 ATTATCCGCC TGCACCATGA TTCCCCAATA CGAGCAGCCC AAAGTCGAAG

101 TTGCCGAAAC GTTCAAAAAC GATACCGCCG ACAGCGGCAT CCGTGCGGTC

151 GATTTGGGTT GGCATGACTA TTTTGCCGAC CCGCGCCTGC AAAAGCTGAT

201 CGACATCGCA CTCGAGCGCA ATACCAGTTT GCGTACCGCC GTATTGAACA

251 GCGAAATCTA CCGCAAACAA TACATGATTG AGCGCAACAA CCTCCTGCCC

301 ACGCTTGCCG CCAATGCGAA CGACTCGCGC CAAGGCAGCT TGAGCGGCGG

351 CAATGTAAGC AGCAGCTACA AAGTCGGACT GGGTGCGGCA TCTTACGAAC

401 TCGATCTGTT CGGGCGTGTA CGCAGCAGCA GCGAGGCGGC ACTGCAAGGC

451 TATTTCGCCA GCACCGCCAA CCGCGATGCG GCACATTTGA GCCTGATTGC

501 CACCGTTGCC AAAGCCTATT TCAACGAACG TTATGCCGAA GAAGCGATGT

551 CTTTGGCGCA ACGTGTTTTG AAAACGCGCG AGGAAACCTA CAAGCTGTCC

601 GAATTACGTT ACAAGGCAGG CGTGATTTCC GCCGTCGCCC TACGTCAGCA

651 GGAAGCCCTA ATCGAATCTG CCAAAGCCGA TTATGCCCAT GCCGCGCGCA

701 GCCGCGAACA GGCGCGCAAT GCCTTGGCAA CCCTGATTAA CCAACCGATA

751 CCCGACGACC TGCCCGCCGG TTTGCCGTTG GACAAGCAGT TTTTTGTTGA

801 GAAGCTGCCG GCCGGTTTGA GTTCCGAAGT ATTGCTCGAC CGTCCCGATA

851 TCCGTGCTGC CGAACACGCG CTCAAACAGG CAAACGCCAA TATCGGTGCG

901 GCACGCGCCG CCTTTTTCCC ATCCATCCGC CTGACCGGAA GCGTCGATAC

951 GCATTCTGCC GAATTGGGCG GGCTGTTCAA AAGCGGCACC GGCGTTTGGT

1001 TGTTCGCACC TTCCATTACC CTGCCGATTT TTACCTGGGG TACGAACAAG

1051 GCGAACCTCG ATGTAGCCAA GCTGCGCCAA CAGGCACAAA TCGTTGCCTA

1101 TGAAGCCGCC GTCCAATCCG CATTTCAAGA CGTGGCAAAC GCATTGACCG

1151 CGCGCGAGCA GTTGGATAAA GCCTATGACG CTTTAAGCAA ACAAAGCCGC

1201 GCCTCTAAAG AAGCGTTGCG TTTGGTCGGT CTGCGTTACA ACACGGCGT

1251 ATCCGGCGCG CTCGACTTGC TCGATGCGGA ACGCAGCAGC TATTCGGCGG

1301 AAGGTGCGGC TTTGTCGGCA CAACTGACCC GCGCCGAAAA CCTTGCCGAT

1351 TTGTACAAGG CACTCGGCGG CGGATTGAAA CGGGATACCC AAACCGACAA

1401 ATAA
```

This corresponds to the amino acid sequence <SEQ ID 2468; ORF 729.a>:

```
a729.pep

1 MDTTLKTTLT SVAAAFALSA CTMIPQYEQP KVEVAETFKN DTADSGIRAV

51 DLGWHDYFAD PRLQKLIDIA LERNTSLRTA VLNSEIYRKQ YMIERNNLLP

101 TLAANANDSR QGSLSGGNVS SSYKVGLGAA SYELDLFGRV RSSSEAALQG

151 YFASTANRDA AHLSLIATVA KAYFNERYAE EAMSLAQRVL KTREETYKLS

201 ELRYKAGVIS AVALRQQEAL IESAKADYAH AARSREQARN ALATLINQPI

251 PDDLPAGLPL DKQFFVEKLP AGLSSEVLLD RPDIRAAEHA LKQANANIGA

301 ARAAFFPSIR LTGSVDTHSA ELGGLFKSGT GVWLFAPSIT LPIFTWGTNK

351 ANLDVAKLRQ QAQIVAYEAA VQSAFQDVAN ALTAREQLDK AYDALSKQSR

401 ASKEALRLVG LRYKHGVSGA LDLLDAERSS YSAEGAALSA QLTRAENLAD
```

-continued
```
     451 LYKALGGGLK RDTQTDK* a729/m729 98.1% identity in 467 aa overlap 10        20        30        40        50        60
     a729.pep  MDTTLKTTLTSVAAAFALSACTMIPQYEQPKVEVAETFKNDTADSGIRAVDLGWHDYFAD
               ||||||||||||||||||||||||||||||||||||||||||||||||||||||||||||
     m729      MDTTLKTTLTSVAAAFALSACTMIPQYEQPKVEVAETFKNDTADSGIRAVDLGWHDYFAD
                  10        20        30        40        50        60

70        80        90       100       110       120
     a729.pep  PRLQKLIDIALERNTSLRTAVLNSEIYRKQYMIERNNLLPTLAANANDSRQGSLSGGNVS
               ||||||||||||||||||||||||||||||||||||||||||||||||||||||||||||
     m729      PRLQKLIDIALERNTSLRTAVLNSEIYRKQYMIERNNLLPTLAANANDSRQGSLSGGNVS
                  70        80        90       100       110       120

130       140       150       160       170       180
     a729.pep  SSYKVGLGAASYELDLFGRVRSSSEAALQGYFASTANRDAAHLSLIATVAKAYFNERYAE
               ||||||||||||||||||||||||||||||||||||||||||||||||||||||||||||
     m729      SSYKVGLGAASYELDLFGRVRSSSEAALQGYFASTANRDAAHLSLIATVAKAYFNERYAE
                 130       140       150       160       170       180

190       200       210       220       230       240
     a729.pep  EAMSLAQRVLKTREETYKLSELRYKAGVISAVALRQQEALIESAKADYAHAARSREQARN
               ||||||||||||||||||||||||||||||||||||||||||||||||||||||||||||
     m729      EAMSLAQRVLKTREETYKLSELRYKAGVISAVALRQQEALIESAKADYAHAARSREQARN
                 190       200       210       220       230       240

250       260       270       280       290       300
     a729.pep  ALATLINQPIPDDLPAGLPLDKQFFVEKLPAGLSSEVLLDRPDIRAAEHALKQANANIGA
               |||||||||||:||||||||||||||||||||||||||||||||||||||||||||||||
     m729      ALATLINQPIPEDLPAGLPLDKQFFVEKLPAGLSSEVLLDRPDIRAAEHALKQANANIGA
                 250       260       270       280       290       300

310       320       330       340       350       360
     a729.pep  ARAAFFPSIRLTGSVDTHSAELGGLFKSGTGVWLFAPSITLPIFTWGTNKANLDVAKLRQ
               ||||||||||||:|  ||||||||||||||||||:|||||||||||||||||||||||||
     m729      ARAAFFPSIRLTGTVGTGSAELGGLFKSGTGVWSFAPSITLPIFTWGTNKANLDVAKLRQ
                 310       320       330       340       350       360

370       380       390       400       410       420
     a729.pep  QAQIVAYEAAVQSAFQDVANALTAREQLDKAYDALSKQSRASKEALRLVGLRYKHGVSGA
               |:|||||:||||||||||||||:|||||||||||||||||||||||||||||||||||||
     m729      QVQIVAYESAVQSAFQDVANALAAREQLDKAYDALSKQSRASKEALRLVGLRYKHGVSGA
                 370       380       390       400       410       420

430       440       450       460
     a729.pep  LDLLDAERSSYSAEGAALSAQLTRAENLADLYKALGGGLKRDTQTDKX
               |||||||||||:||||||||||||||||||||||||||||||||||||
     m729      LDLLDAERSSYAAEGAALSAQLTRAENLADLYKALGGGLKRDTQTDKX
                 430       440       450       460
```

The following partial DNA sequence was identified in *N. gonorrhoeae* <SEQ ID 2469>:

```
g730.seq
   1  GTGAAACCGC TGCGCAGACT GACAAACCTC CTTGCCGCCT GCGCCGTAGC

51  GGCGGTCGCA CTCATACAGC CCGCCCTCGC GGCGGACTTG GCGCAAGACC

101  CGTTCATTAC CGATAACACC CAACGGCAGC ACTACGAACC CGGCGGCAAA

151  TACCACCTCT TCGGcgaCCC GCGCGGCAGC GTTTCCGACC GCACCGGCAA

201  AATCAACGTC ATCCAAGACT ATACCCACCA GATGGGCAAC CTGCTCATCC

251  AACAGGCGGC AATCCAAGGC AATCTTGGTT ACACCGTCCG CTTTTCCGGA

301  CACGGACACG AAGAACACGC CCCCTTCGAC AACCACGCCG CCGACAGCGC

351  AAGCGAAGAA AAAGGCAACG TTGACGACGG CTTTACCGTG TACCGGCTCA

401  ACTGGGAAGG ACACGAACAT CATCCCGCCG ATGCCTACGA CGGCCCGAAG

451  GGCGGCAATT ACCCCAAACC TACGGGCGCA CGAGACGAAT ACACCTATCA

501  CGTCAACGGC ACAGCCCGCA GTATCAAACT CAATCCGACC GACACCCGCA

551  GCATCCGGCA ACGCATATTC GACAACTACA ACAACCTCGG CAGCAATTTC

601  TCCGACCGCG CCGATGAAGC CAACAGAAAA ATGTTCGAGC ACAATGCCAA

651  GCTCGACCGC TGGGGCAACA GCATGGAGTT TGTCAACGGC GTCGCCGCCG
```

-continued

```
 701 GCGCGCTCAA CCCCTTTATC AGCGCGGGCG AAGCCTTGGG CATAGGCGAC
 751 ATACTGTACG GAACGCGCTA TGCCATAGAC AAAGCCGCGA TGCGCAACAT
 801 CGCCCCCTTA CCCGCCGAGG GCAAATTCGC CGCCATCGGC GGCTTGGGCA
 851 GCGCGGCGGG CTTTGAAAAA AATACGCGCG AAGCCGTTGA CCGGTGGATA
 901 CAGGAAAACC CCAATGCCGC CGAAACCGTC GAAGCCCTGG TCAACGTCCT
 951 GCCGTTTGCC AAAGTCAAAA ACCTGACAAA GGCGGCAAAA CCGGGGAAGG
1001 CTGCGGTTAG TGGGGATTTT TCTAAATCCT ACACCTGCTC CTTCCACGGC
1051 AGCACCTTGG TCAAAACGGC AGACGGCTAC AAAGCCATTG CCCATATTCA
1101 AGCCGGAGAC CGCGTCCTTT CCAAGGACGA GGCAAGCGGA GAAACGGGAT
1151 ACAAACCCGT TACCGCCCGA TACGGCAATC CGTATCAAGA AACCGTTTAC
1201 ATTGAAGTTT CAGACGGCAT CGGCAACAGC CAAACCCTGA TTTCCAACCG
1251 CATCCACCCG TTTTATTCGG ACGGCAAATG GATTAAGGCG GAAGATTTAA
1301 AAGCGGGAAG CCGGCTGTTA TCCGAAAGCG GCAAAACCCA AACCGTCCGC
1351 AACATCGTTG TCAAACCAAA ACCGCTCAAA GCCTACAATC TGACCGTTGC
1401 CGATTGGCAT ACCTACTTCG TCAAGGGTAA TCAGGCGGAA ACGGAAGGGG
1451 TTTGGGTTCA TAATGATTGT CCGCCTAAAC CAAAACCAAC CAATCATGCC
1501 CAACAAAGAA AAGAAGAAGC TAAAAACGAT TCTCATCGAA GTGTGGGAGA
1551 TTCCAATCGT GTCGTTCGCG AAGGAAAGCA ATATTTAGAT TCCGACACAG
1601 GAAACCATGT TTATGTAAAA GGAGATAAAG TGGTTATTCT AACTCCTGAT
1651 GGAAGACAGG TAACTCAATT TAAGAACTCG AAAGCCAATA CGTCAAAAAG
1701 GGTAAAAAAT GGGAAATGGA CACCAAAATA A
```

This corresponds to the amino acid sequence <SEQ ID 2470; ORF 730.ng>:

```
g730.pep
  1 VKPLRRLTNL LAACAVAAVA LIQPALAADL AQDPFITDNT QRQHYEPGGK
 51 YHLFGDPRGS VSDRTGKINV IQDYTHQMGN LLIQQAAIQG NLGYTVRFSG
101 HGHEEHAPFD NHAADSASEE KGNVDDGFTV YRLNWEGHEH HPADAYDGPK
151 GGNYPKPTGA RDEYTYHVNG TARSIKLNPT DTRSIRQRIF DNYNNLGSNF
201 SDRADEANRK MFEHNAKLDR WGNSMEFVNG VAAGALNPFI SAGEALGIGD
251 ILYGTRYAID KAAMRNIAPL PAEGKFAAIG GLGSAAGFEK NTREAVDRWI
301 QENPNAAETV EALVNVLPFA KVKNLTKAAK PGKAAVSGDF SKSYTCSFHG
351 STLVKTADGY KAIAHIQAGD RVLSKDEASG ETGYKPVTAR YGNPYQETVY
401 IEVSDGIGNS QTLISNRIHP FYSDGKWIKA EDLKAGSRLL SESGKTQTVR
451 NIVVKPKPLK AYNLTVADWH TYFVKGNQAE TEGVWVHNDC PPKPKPTNHA
501 QQRKEEAKND SHRSVGDSNR VVREGKQYLD SDTGNHVYVK GDKVVILTPD
551 GRQVTQFKNS KANTSKRVKN GKWTPK*
```

The following partial DNA sequence was identified in *N. meningitidis* <SEQ ID 2471>:

```
m730.seq
   1    GTGAAACCGC TGCGCAGACT GACAAACCTC CTTGCCGCCT GCGCCGTAGC
```

-continued

```
  51 GGCGGCCGCA CTCATACAGC CCGCCCTCGC GGCGGACTTG GCGCAAGACC

101 CGTTCATTAC CGATAACGCC AACGGCAGC ACTACGAACC CGGCGGCAAA

151 TACCACCTCT TCGGCGACCC GCGCGGCAGC GTTTCCGACC GCACCGGCAA

201 AATCAACGTC ATCCAAGACT ATACCCACCA GATGGGCAAC CTGCTCATCC

251 AACAGGCAAA CATCAACGGC ACAATCGGCT ACCACACCCG CTTTTCCGGA

301 CACGGACACG AAGAACACGC CCCCTTCGAC AACCACGCCG CCGACAGCGC

351 GAGCGAAGAA AAAGGCAACG TTGACGAAGG CTTTACCGTA TACCGGCTCA

401 ACTGGGAAGG ACACGAACAT CATCCCGCCG ATGCCTACGA CGGCCCGAAG

451 GGCGGCAATT ACCCCAAACC TACGGGCGCA CGAGACGAAT ACACCTATCA

501 CGTCAACGGC ACAGCCCGCA GTATCAAACT CAATCCGACC GACACCCGCA

551 GCATCCGGCA ACGCATATCC GACAATTACA GCAACCTCGG CAGCAATTTC

601 TCCGACCGCG CCGATGAAGC CAACAGAAAA ATGTTCGAGC ACAATGCCAA

651 GCTCGACCGC TGGGGCAACA GCATGGAGTT TATCAACGGC GTCGCCGCCG

701 GCGCGCTCAA CCCCTTTATC AGCGCGGGCG AAGCCTTGGG CATAGGCGAC

751 ATACTGTACG GAACGCGCTA TGCCATAGAC AAAGCCGCAA TGCGCAACAT

801 CGCCCCCTTG CCCGCCGAGG GCAAATTCGC CGTCATCGGC GGCTTGGGCA

851 GCGTGGCGGG CTTTGAAAAG AATACGCGCG AAGCCGTTGA CCGGTGGATA

901 CAGGAAAATC CCAATGCCGC CGAAACCGTC GAAGCCGTCT TCAACGTTGC

951 CGCAGCAGCC AAAGTCGCGA AGTTGGCAAA GGCGGCAAAA CCAGGGAAGG

1001 CTGCGGTTAG CGGGGATTTT GCTGATTCTT ATAAAAAGAA ATTGGCTTTG

1051 TCTGATAGTG CGAGACAGTT ATATCAAAAT GCAAAGTATA GAGAAGCTCT

1101 AGATATACAT TATGAAGATT TAATTAGAAG AAAAACTGAT GGTTCATCAA

1151 AATTTATTAA CGGCAGAGAA ATTGACGCTG TTACGAATGA TGCTTTAATA

1201 CAAGCCAAAA GAACAATTTC AGCAATAGAT AAACCTAAAA ATTTCTTAAA

1251 TCAAAAAAAT AGAAAGCAAA TTAAAGCAAC CATCGAAGCA GCAAACCAAC

1301 AGGGAAAACG TGCAGAATTT TGGTTTAAAT ACGGTGTTCA TTCACAAGTT

1351 AAGTCATATA TTGAATCAAA AGGCGGCATT GTTAAAACAG GTTTAGGAGA

1401 TTAA
```

This corresponds to the amino acid sequence <SEQ ID 2472; ORF 730>:

```
m730.pep
  1 VKPLRRLTNL LAACAVAAAA LIQPALAADL AQDPFITDNA QRQHYEPGGK

51 YHLFGDPRGS VSDRTGKINV IQDYTHQMGN LLIQQANING TIGYHTRFSG

101 HGHEEHAPFD NHAADSASEE KGNVDEGFTV YRLNWEGHEH HPADAYDGPK

151 GGNYPKPTGA RDEYTYHVNG TARSIKLNPT DTRSIRQRIS DNYSNLGSNF

201 SDRADEANRK MFEHNAKLDR WGNSMEFING VAAGALNPFI SAGEALGIGD

251 ILYGTRYAID KAAMRNIAPL PAEGKFAVIG GLGSVAGFEK NTREAVDRWI

301 QENPNAAETV EAVFNVAAAA KVAKLAKAAK PGKAAVSGDF ADSYKKKLAL

351 SDSARQLYQN AKYREALDIH YEDLIRRKTD GSSKFINGRE IDAVTNDALI
```

-continued

```
401 QAKRTISAID KPKNFLNQKN RKQIKATIEA ANQQGKRAEF WFKYGVHSQV

451 KSYIESKGGI VKTGLGD*
``` g730/m730 93.0% identity in 344 aa overlap

```
                   10        20        30        40        50        60
g730.pep   VKPLRRLTNLLAACAVAAVALIQPALAADLAQDPFITDNTQRQHYEPGGKYHLFGDPRGS
           ||||||||||||||||||:||||||||||||||||||||||:||||||||||||||||||
m730       VKPLRRLTNLLAACAVAAAALIQPALAADLAQDPFITDNAQRQHYEPGGKYHLFGDPRGS
                   10        20        30        40        50        60

70        80        90       100       110       120
g730.pep   VSDRTGKINVIQDYTHQMGNLLIQQAAIQGNLGYTVRFSGHGHEEHAPFDNHAADSASEE
           |||||||||||||||||||||||||| |:|::|| :||||||||||||||||||||||||
m730       VSDRTGKINVIQDYTHQMGNLLIQQANINGTIGYHTRFSGHGHEEHAPFDNHAADSASEE
                   70        80        90       100       110       120

130       140       150       160       170       180
g730.pep   KGNVDDGFTVYRLNWEGHEHHPADAYDGPKGGNYPKPTGARDEYTYHVNGTARSIKLNPT
           |||||:||||||||||||||||||||||||||||||||||||||||||||||||||||||
m730       KGNVDEGFTVYRLNWEGHEHHPADAYDGPKGGNYPKPTGARDEYTYHVNGTARSIKLNPT
                  130       140       150       160       170       180

190       200       210       220       230       240
g730.pep   DTRSIRQRIFDNYNNLGSNFSDRADEANRKMFEHNAKLDRWGNSMEFVNGVAAGALNPFI
           |||||||| |||:|||||||||||||||||||||||||||||||||||:|||||||||||
m730       DTRSIRQRISDNYSNLGSNFSDRADEANRKMFEHNAKLDRWGNSMEFINGVAAGALNPFI
                  190       200       210       220       230       240

250       260       270       280       290       300
g730.pep   SAGEALGIGDILYGTRYAIDKAAMRNIAPLPAEGKFAAIGGLGSAAGFEKNTREAVDRWI
           ||||||||||||||||||||||||||||||||||||:||||||:||||||||||||||||
m730       SAGEALGIGDILYGTRYAIDKAAMRNIAPLPAEGKFAVIGGLGSVAGFEKNTREAVDRWI
                  250       260       270       280       290       300

310       320       330       340       350       360
g730.pep   QENPNAAETVEALVNVLPFAKVKNLTKAAKPGKAAVSGDFSKSYTCSFHGSTLVKTADGY
           ||||||||||||: ||    ||| :|:||||||||||||||: ||
m730       QENPNAAETVEAVFNVAAAAKVAKLAKAAKPGKAAVSGDFADSYKKKLALSDSARQLYQN
                  310       320       330       340       350       360

370       380       390       400       410       420
g730.pep   KAIAHIQAGDRVLSKDEASGETGYKPVTARYGNPYQETVYIEVSDGIGNSQTLISNRIHP m730       AKYREALDIHYEDLIRRKTDGSSKFINGREIDAVTNDALIQAKRTISAIDKPKNFLNQKN
                  370       380       390       400       410       420
```

The following partial DNA sequence was identified in *N. meningitidis* <SEQ ID 2473>:

```
a730.seq
   1  GTGAAACCGC TGCGAAGACT CATCAAGCTC CTTGCCGCCT GTGCCGTAGC

51  GGCGGCCGCA CTCATACAGC CCGCCCTCGC GGCGGACTTG GCGCAAGACC

101  CGTTCATTAC CGATAACGCC CAACGGCAGC ACTACGAACC CGGAGGCAAA

151  TACCACCTCT TCGGCGACCC GCGCGGCAGC GTCTCCGACC GCACCGGTCA

201  AATCAACGTC ATCCAAGACT ATACCCACCG GATGGGCAAC CTGCTCATCC

251  AGCAGGCAAA CATCAACGGC ACAATCGGCT ACCACACCCG CTTTTCCGGA

301  CACGGATACG AAGAACACGC CCCCTTCGAC AACCACGCCG CCGACAGCGC

351  GAGCGAAGAA AAAGGCAACG TTGACGAAGG CTTTACCGTA TACCGGCTCA

401  ACTGGGAAGG ACACGAACAT CATCCCGCCG ATGCCTACGA CGGCCCGAAG

451  GGCGGCAATT ACCCCAAACC TACGGGTGCA CGCGACGAAT ACACCTATCA

501  CGTCAACGGC ACAGCACGCA GCATCAAACT CAATCCGACC GACACCCGCA

551  GCATCCGGCA ACGCATATCC GACAATTACA GCAACCTCGG CAGCAATTTC

601  TCCGACCGCG CCGATGAAGC CAACAGAAAA ATGTTCGAGC ACAATGCCAA

651  GCTCGACCGC TGGGGCAACA GCATGGAGTT TATCAACGGC GTCGCCGCCG
```

```
-continued
 701 GCGCGCTCAA CCCCTTTATC AGCGCGGGCG AAGCCTTGGG CATAGGCGAC

751 ATACTGTACG GAACGCGCTA TGCCATAGAC AAAGCCGCAA TGCGCAACAT

801 CGCCCCCTTG CCCGCCGAGG GCAAATTCGC CGTCATCGGC GGCTTGGGCA

851 GCGTGGCGGG CTTTGAAAAA AATACGCGCG AAGCCGTTGA CCGGTGGATA

901 CAGGAAAACC CCAATGCCGC CGAAACCGTC GAAGCCCTGG TCAACGTCCT

951 GCCGTTTGCC AAAGTCAAAA ACCTGACAAA GGCGGCAAAA CCGGGGAAGG

1001 CTGCGGTTAG CGGGGATTTT TCTGCTGCAT ACAATACAAG AACAACTAGA

1051 AAAGTTACTA CAGAAACAGA GGGGTTAAAT AGAATCAGAC AGAACCAGAA

1101 AAATAGTAAT ATACATGAGA AAAATTATGG AAGAGATAAT CCTAATCATA

1151 TTAATGTTTT ATCTGGAAAT TCTATACAAC ATATACTGTA TGGAGATGAA

1201 GCAGGAGGTG GCATCTTTT TCCTGGCAAA CCTGGTAAGA CAACATTCCC

1251 CCAACATTGG TCAGCCAGTA AAATAACTCA TGAAATTAGT GATATCGTTA

1301 CATCCCCAAA AACGCAATGG TATGCACAGA CTGGAACAGG CGGCAAATAT

1351 ATTGCTAAAG GAAGACCAGC TAGGTGGGTA TCATATGAAA CGAGAGATGG

1401 AATTCGTATC AGAACAGTTT ATGAACCTGC AACAGGAAAA GTGGTAACTG

1451 CATTCCCCGA TAGAACCTCT AATCCCAAAT ATAACCCTGT AAAATAA
```

This corresponds to the amino acid sequence <SEQ ID 2474; ORF 730.a>:

```
a730.pep
  1 VKPLRRLIKL LAACAVAAAA LIQPALAADL AQDPFITDNA QRQHYEPGGK

51 YHLFGDPRGS VSDRTGQINV IQDYTHRMGN LLIQQANING TIGYHTRFSG

101 HGYEEHAPFD NHAADSASEE KGNVDEGFTV YRLNWEGHEH HPADAYDGPK

151 GGNYPKPTGA RDEYTYHVNG TARSIKLNPT DTRSIRQRIS DNYSNLGSNF

201 SDRADEANRK MFEHNAKLDR WGNSMEFING VAAGALNPFI SAGEALGIGD

251 ILYGTRYAID KAAMRNIAPL PAEGKFAVIG GLGSVAGFEK NTREAVDRWI

301 QENPNAAETV EALVNVLPFA KVKNLTKAAK PGKAAVSGDF SAAYNTRTTR

351 KVTTETEGLN RIRQNQKNSN IHEKNYGRDN PNHINVLSGN SIQHILYGDE

401 AGGGHLFPGK PGKTTFPQHW SASKITHEIS DIVTSPKTQW YAQTGTGGKY

451 IAKGRPARWV SYETRDGIRI RTVYEPATGK VVTAFPDRTS NPKYNPVK*
``` a730/m730 88.6% identity in 376 aa overlap

```
                  10        20        30        40        50        60
    a730.pep  VKPLRRLIKLLAACAVAAAALIQPALAADLAQDPFITDNAQRQHYEPGGKYHLFGDPRGS
              ||||||| :|||||||||||||||||||||||||||||||||||||||||||||||||||
    m730      VKPLRRLTNLLAACAVAAAALIQPALAADLAQDPFITDNAQRQHYEPGGKYHLFGDPRGS
                  10        20        30        40        50        60

70        80        90       100       110       120
    a730.pep  VSDRTGQINVIQDYTHRMGNLLIQQANINGTIGYHTRFSGHGYEEHAPFDNHAADSASEE
              ||||||:||||||||||:||||||||||||||||||||||: ||||||||||||||||||
    m730      VSDRTGKINVIQDYTHQMGNLLIQQANINGTIGYHTRFSCHCHEEHAPFDNHAADSASEE
                  70        80        90       100       110       120

130       140       150       160       170       180
    a730.pep  KGNVDEGFTVYRLNWEGHEHHPADAYDGPKGGNYPKPTGARDEYTYHVNGTARSIKLNPT
              ||||||||||||||||||||||||||||||||||||||||||||||||||||||||||||
    m730      KGNVDEGFTVYRLNWEGHEHHPADAYDGPKGGNYPKPTGARDEYTYHVNGTARSIKLNPT
                 130       140       150       160       170       180
```

```
                      190        200       210       220       230       240
a730.pep    DTRSIRQRISDNYSNLGSNFSDRADEANRKMFEHNAKLDRWGNSMEFINGVAAGALNPFI
            ||||||||||||||||||||||||||||||||||||||||||||||||||||||||||||
m730        DTRSIRQRISDNYSNLGSNFSDRADEANRKMFEHNAKLDRWGNSMEFINGVAAGALNPFI
                      190        200       210       220       230       240

250        260       270       280       290       300
a730.pep    SAGEALGIGDILYGTRYAIDKAAMRNIAPLPAEGKFAVIGGLGSVAGFEKNTREAVDRWI
            ||||||||||||||||||||||||||||||||||||||||||||||||||||||||||||
m730        SAGEALGIGDILYGTRYAIDKAAMRNIAPLPAEGKFAVIGGLGSVAGFEKNTREAVDRWI
                      250        260       270       280       290       300

310        320       330       340       350       360
a730.pep    QENPNAAETVEALVNVLPFAKVKNLTKAAKPGKAAVSGDFSAAYNTRTTRKVTTETEGLN
            |||||||||||| :  ||   ||| :|:|||||||||||||:  :|     :|  : :::
m730        QENPNAAETVEAVFNVAAAAKVAKLAKAAKPGKAAVSGDFADSY-----KKKLALSDSAR
                      310        320       330       340       350

370        380       390       400       410       420
a730.pep    RIRQNQKNSNIHEKNYGRDNPNHINVLSGNSIQHILYGDEAGGGHLFPGKPGKTTFPQHW
            ::  ||  |    :    : :|
m730        QLYQNAKYREALDIHYEDLIRRKTDGSSKFINGREIDAVTNDALIQAKRTISAIDKPKNF
                      360        370       380       390       400       410
```

The following partial DNA sequence was identified in *N. gonorrhoeae* <SEQ ID 2475>:

```
g731.seq
   1 gattttcgag cgttttcatG CGAGAACGGT TTGTCTGTGC GCGTCCGCAA

51 TTTGGACGGC GGCAAAATCG CGTTGCGGCT GGACGGCAGG CGTGCCGTCC

101 TCTCTTCCGA CGTTGCCGCA TCCGGCGAAC GCTATACCGC CGAACACGGT

151 TTGTTCGGAA ACGGAACCGA GTGGCACCAG AAAGGCGGCG AAGCCTTTTT

201 CGGCTTTACC GATGCCTACG GCAATTCGGT CGAAACTTCC TGCCGCGCCC

251 GTTAA
```

This corresponds to the amino acid sequence <SEQ ID 2476; ORF 731.ng>:

```
g731.pep
   1 DFRAFSCENG LSVRVRNLDG GKIALRLDGR RAVLSSDVAA SGERYTAEHG

51 LFGNGTEWHQ KGGEAFFGFT DAYGNSVETS CRAR*
```

The following partial DNA sequence was identified in *N. meningitidis* <SEQ ID 2477>:

```
m731.seq
   1 ATGAATATCA GGTTTTTCGC GCTGACCGTA CCGGTTTTGT CTTTGGCGGC

51 CTGTGCCGTG CCGGAGGCGT ATGATGACGG CGGACGCGGG CATATGCCGC

101 CCGTTCAAAA CCAAGCCGGC ACGGACGATT TTCGGGCGTT TTCCTGCGAG

151 AACGGTTTGT CTGTGCGCGT CCGCCATTTG GACAGCGGCA AAGTCGCGTT

201 GCGGCTGGAC GGCAGGCGTG CCGTCCTCTC TTCCGACGTT GCCGCATCCG

251 GCGAACGCTA TACCGCCGAA CACGGTTTGT TCGGAAACGC AACCGAGTGG

301 CACCAGAAAG GCGGCGAAGC CTTTTTCGGC TTTACCGATG CCTACGGCAA

351 TTCGGTCGAA ACTTCCTGCC GCGCCCGTTA A
```

This corresponds to the amino acid sequence <SEQ ID 2478; ORF 731>:

```
m731.pep
   1 MNIRFFALTV PVLSLAACAV PEAYDDGGRG HMPPVQNQAG TDDFRAFSCE
```

```
 51 NGLSVRVRHL DSGKVALRLD GRRAVLSSDV AASGERYTAE HGLFGNATEW

101 HQKGGEAFFG FTDAYGNSVE TSCRAR*
``` g731/m731 95.2% identity in 84 aa overlap

```
                               10           20         30
  g731.pep              DFRAFSCENGLSVRVRNLDGGKIALRLDGR
                        |||||||||||||:||:||:|||||||
  m731      LSLAACAVPEAYDDGGRGHMPPVQNQAGTDDFRAFSCENGLSVRVRHLDSGKVALRLDGR
                20        30        40        50        60        70

40        50        60        70        80
  g731.pep  RAVLSSDVAASGERYTAEHGLFGNGTEWHQKGGEAFFGFTDAYGNSVETSCRARX
            |||||||||| |||||||||||:|||||||||||||||||||||||||||
  m731      RAVLSSDVAASGERYTAEHGLFGNATEWHQKGGEAFFGFTDAYGNSVETSCRARX
               80        90       100       110       120
```

The following partial DNA sequence was identified in *N. meningitidis* <SEQ ID 2479>:

```
a731.seq
  1 ATGAATATCA GGTTTTTCGC GCTGACCGTA CCGGTTTTGT CTTTGGCGGC

51 CTGTGCCGTG CCGGAGGCGT ATGATGACGG CGGACGAGGG CATATGCCGC

101 CCGTTCAAAA CCAAGCCGGC ACGGCAGATT TCGGGCATT TTCCTGCGAG

151 AACGGTTTGT CTGTGCACGT CCGCCGTTTG GACGGCGGCA GAATCGCGTT

201 GCGGTTGGAC GGCAGGCGTG CCGTCCTCTC TTCCGACGTT GCCGCATCCG

251 GCGAACGCTA TACCGCCGAA CACGGTTTGT TCGGAAACGG AACCGAGTGG

301 CATCAGAAAG GCGGCGAAGC CTTTTTCGGC TTTACCGATG CCTACGGCAA

351 TTCGGTCGAA ACCTCCTGCC GCGAACGCTA A
```

This corresponds to the amino acid sequence <SEQ ID 2480; ORF 731.a>:

```
a731.pep

1 MNIRFFALTV PVLSLAACAV PEAYDDGGRG HMPPVQNQAG TADFRAFSCE

51 NGLSVHVRRL DGGRIALRLD GRRAVLSSDV AASGERYTAE HGLFGNGTEW

101 HQKGGEAFFG FTDAYGNSVE TSCRAR*
``` a731.pep 94.4% identity in 126 aa overlap

```
                        10        20        30        40        50        60
  a731.pep  MNIRFFALTVPVLSLAACAVPEAYDDGGRGHMPPVQNQAGTADFRAFSCENGLSVHVRRL
            ||||||||||||||||||||||||||||||||||||||| |||||||||||||:||:|
  m731      MNIRFFALTVPVLSLAACAVPEAYDDGGRGHMPPVQNQAGTDDFRAFSCENGLSVRVRHL
               10        20        30        40        50        60

70        80        90       100       110       120
  a731.pep  DGGRIALRLDGRRAVLSSDVAASGERYTAEHGLFGNGTEWHQKGGEAFFGFTDAYGNSVE
            |:|::||||||||||||||||||||||||||||||:||||||||||||||||||||||||
  m731      DSGKVALRLDGRRAVLSSDVAASGERYTAEHGLFGNATEWHQKGGEAFFGFTDAYGNSVE
               70        80        90       100       110       120 a731.pep  TSCRARX
            |||||||
  m731      TSCRARX
```

The following partial DNA sequence was identified in *N. gonorrhoeae* <SEQ ID 2481>:

```
g732.seq
  1  ATGTCGAAAC CTGTTTTTAA GAAAATCGCA CTTTATACTT TGGGTGCAAT
```

```
 51 CAGCGGCGTG GCCGTAAGTC TGGCGGTGCA GGGTTTTGCC GCCGagaagg

101 ACGGgcgGGA TAACGAagtC CTGCCGGTGC AATCCATCCG TACGATGGCG

151 GAGGTTTACG GTCAGATTAA GGCAAACTAC TATCATGACA AACCCGATGC

201 CGATTTGTTT GAAGGTGCGA TGAAGGGTAT GGTGGCCGGT TTGGATCCGC

251 ATTCCGAATA TATGGATAAA AAAGGTTATG CCGAGATAAA GGAGTCCACC

301 AGCGGCGAAT TTGGCGGCTT GGGGATGGAA ATCGGGCAGG AAGACGGTTT

351 TGTCAAAGTG GTTTCGCCGA TTGAGGACAC GCCTGCCGAA CGGGCGGAGG

401 TGAAAAGCGG CGATTTCATT GTGAAAATCG ATAATGTTTC GACGCGCGGT

451 ATGACGGTCA GCGAAGCGGT GAAAAAAATG CGGGGCAAGC CGGGTACGAA

501 GATTACTTTG ACGTTGTCGC GCAAAAATGC CGACAAGCCG ATAGTCGTCA

551 ACCTGACCCG TGCCATTATT AAAGTGAAAA GCGTCCGCCA TCACCTGATC

601 GAACCCGATT ACGGCTATAT CCGCGTGTCG CAGTTCCAAG AGCGGACGGT

651 CGAAAGCGTC AATACCGCCG CAAAAGAGCT GGTAAAGGAA AATAAAGGAA

701 AACCGCTCAA GGGGCTGGTG TTGGATTTGC GCGACGACCC CGGCGGGCTT

751 TTGACCGGCG CGGTCGGCGT GTCGGCGGCG TTTCTGCCGT CTGAAGCGGT

801 CGTCGTCAGC ACCAAGGGAC GCGACGGCAA AGACGGCATG GTACTGAAAG

851 CCGTTCCCGA GGATTATGTG TACGGTATGG GCGGCGACCC TTTGGCGGGT

901 ATTCCTGCCG AGTTGAAAAC GATTCCGATG ACGgtaTTGG TcaaTTCCGG

951 TTCggcttCC GCGTCGGAGA TTGtcgCCGG CGCATTGCAG GACCACAAAC

1001 GCGCGGTCAT CGTCGGTACG CAGAGCTTCG GTAAAGGTTC GGTTCAGACT

1051 TTGATTCCTT TGTCCAACGG CAGCGCGGTC AAGTTGACGA CCGCCCTGTA

1101 TTACACGCCG AACGACCGTT CCATTCAGGC ACAGGGGATT GTTCCCGATG

1151 TCgaaGTAAA AGATAAGGAA CGTACTTTTG AAAGCCGCGA GGCGGACCTG

1201 GTCGGACACA TCGGCAATCC CTTgggcGGC GAGGATGTGA ACAGTGAAAC

1251 CCttgcCGTA CCGCTTGAAA AAGATGCGGA TAAGCCCGCT GCAAAAGAAA

1301 AAGGTAAAAA GAAAAAGGAC GAGGATTTGT CTTCAAGGCG GATTCCGAAC

1351 CCTGCGAAAG ACGATCAGTT GCGTAAGGCT TTGGATTTGG TCAAGTCGCC

1401 CGAGCAGTGG CAGAAGTCTT TGGGGCTGGC GGCGAAAAAA CCGGTTTCAA

1451 ATAAAGATAA AAAGATAAG AAGTAG
```

This corresponds to the amino acid sequence <SEQ ID 2482; ORF 732>:

```
g732.pep
  1MSKPVFKKIA LYTLGAISGV AVSLAVQGFA AEKDGRDNEV LPVQSIRTMA

51EVYGQIKANY YHDKPDADLF EGAMKGMVAG LDPHSEYMDK KGYAEIKEST

101SGEFGGLGME IGQEDGFVKV VSPIEDTPAE RAEVKSGDFI VKIDNVSTRG

151MTVSEAVKKM RGKPGTKITL TLSRKNADKP IVVNLTRAII KVKSVRHHLI

201EPDYGYIRVS QFQERTVESV NTAAKELVKE NKGKPLKGLV LDLRDDPGGL

251LTGAVGVSAA FLPSEAVVVS TKGRDGKDGM VLKAVPEDYV YGMGGDPLAG

301IPAELKTIPM TVLVNSGSAS ASEIVAGALQ DHKRAVIVGT QSFGKGSVQT

351LIPLSNGSAV KLTTALYYTP NDRSIQAQGI VPDVEVKDKE RTFESREADL
```

-continued
```
401 VGHIGNPLGG EDVNSETLAV PLEKDADKPA AKEKGKKKKD EDLSSRRIPN

451 PAKDDQLRKA LDLVKSPEQW QKSLGLAAKK PVSNKDKKDK K*
```

The following partial DNA sequence was identified in *N. meningitidis* <SEQ ID 2483>:

```
m732.seq
    1 ATGTCGAAAC CTGTTTTTAA GAAAATCGCA CTTTATACTT TGGGTGCAAT

51 CAGCGGCGTG GCCGTCAGTC TGGCGGTGCA GGGTTTTGCC GCCGAGAAGG

101 ACAGGCGGGA TAACGAAGTC CTGCCGGTGC AATCCATCCG CACAATGGCG

151 GAGGTTTACG GTCAAATCAA GGCAAACTAC TATCAGGACA AACCCGATGC

201 CGATTTGTTT GAAGGTGCGA TGAAGGGTAT GGTGGCCGGT TTGGATCCGC

251 ATTCCGAATA TATGGATAAA AAAGGTTATG CCGAGATAAA GGAGTCCACC

301 AGCGGCGAAT TTGGCGGCTT GGGGATGGAA ATCGGGCAGG AAGACGGATT

351 TGTCAAAGTG GTTTCGCCGA TTGAGGACAC GCCTGCGGAA CGGGCGGGGG

401 TGAAAAGCGG CGATTTCATT GTGAAAATCG ATAATGTTTC GACACGCGGC

451 ATGACGGTCA GCGAAGCGGT GAAGAAAATG CGGGGCAAGC CGGGTACGAA

501 GATTACTTTG ACGCTGTCGC GCAAAAATGC CGACAAGCCG ATAGTCGTCA

551 ACCTGACCCG TGCCATTATT AAAGTGAAAA GCGTCCGCCA TCACCTGATC

601 GAACCCGATT ACGGCTATAT CCGCGTGTCG CAGTTCCAAG AGCGGACGGT

651 CGAAAGCGTC AATACCGCCG CAAAAGAGCT GGTAAAGGAA AATAAAGGAA

701 AACCGCTCAA GGGGCTGGTG TTGGATTTGC GCGACGACCC CGGCGGGCTT

751 TTGACTGGCG CGGTCGGCGT GTCGGCGGCA TTTCTGCCGT CTGAAGCAGT

801 CGTCGTCAGC ACCAAGGGAC GCGACGGCAA AGACCGCATG GTACTGAAAG

851 CCATTCCTGA AGATTATGTG TACGGGATGG GCGGCGATTC GTTGGCGGGC

901 ATTCCTGCCG AGTTGAAAAC CATACCGATG ACGGTATTGG TCAATTCCGG

951 TTCGGCTTCC GCGTCGGAGA TTGTCGCAGG TGCATTGCAG GATCATAAAC

1001 GCGCGGTCAT CGTCGGTACG CAGAGCTTCG GCAAAGGTTC GGTTCAGACT

1051 TTGATTCCTT TGTCCAACGG CAGCGCGGTC AAGCTGACAA CGGCACTGTA

1101 TTATACGCCG AACGACCGTT CTATTCAGGC GCAGGGGATT GTTCCCGATG

1151 TCGAAGTAAA AGATAAGGAA CGCATTTTTG AAAGCCGCGA GGCGGATTTG

1201 GTCGGACACA TCGGCAATCC CTTGGGCGGC GAGGATGTGA ACGGTGAAAC

1251 CCTTGCCGTG CCGCTTGAAA AGATGCGGA TAAGCCCGCT GTAAAAGAAA

1301 AAGGTAAAAA GAAAAAGGAC GAGGATTTGT CTTCAAGGCG GATTCCCAAC

1351 CCTGCCAAAG ACGACCAGTT GCGGAAAGCT TTGGATTTAG TCAAGTCGCC

1401 CGAGCAGTGG CAGAAGTCTT TGGGGCTGGC GGCGAAAAAG CCGGTTTCAA

1451 ATAAAGATAA GAAAGATAAA AAGATAAGA AGTAG
```

This corresponds to the amino acid sequence <SEQ ID 2484; ORF 732>.

```
m732.pep
    1 MSKPVFKKIA LYTLGAISGV AVSLAVQGFA AEKDRRDNEV LPVQSIRTMA

51 EVYGQIKANY YQDKPDADLF EGAMKGMVAG LDPHSEYMDK KGYAEIKEST
```

-continued

```
101 SGEFGGLGME IGQEDGFVKV VSPIEDTPAE RAGVKSGDFI VKIDNVSTRG

151 MTVSEAVKKM RGKPGTKITL TLSRKNADKP IVVNLTRAII KVKSVRHHLI

201 EPDYGYIRVS QFQERTVESV NTAAKELVKE NKGKPLKGLV LDLRDDPGGL

251 LTGAVGVSAA FLPSEAVVVS TKGRDGKDRM VLKAIPEDYV YGMGGDSLAG

301 IPAELKTIPM TVLVNSGSAS ASEIVAGALQ DHKRAVIVGT QSFGKGSVQT

351 LIPLSNGSAV KLTTALYYTP NDRSIQAQGI VPDVEVKDKE RIFESREADL

401 VGHIGNPLGG EDVNGETLAV PLEKDADKPA VKEKGKKKKD EDLSSRRIPN

451 PAKDDQLRKA LDLVKSPEQW QKSLGLAAKK PVSNKDKKDK KDKK*
```

Computer analysis of the amino acid sequences gave the following results:

Homology with a Predicted ORF from *N. meningitidis* menA with menB

ORF 732 shows 98.2% identity over a 491 aa overlap with a predicted ORF (ORF732.a) from *N. gonorrhoeae*:

```
m732/g732    98.2% identity in 491 aa overlap 10         20         30         40         50         60
m732.pep   MSKPVFKKIALYTLGAISGVAVSLAVQGFAAEKDRRDNEVLPVQSIRTMAEVYGQIKANY
           ||||||||||||||||||||||||||||||||||:|||||||||||||||||||||||||
g732       MSKPVFKKIALYTLGAISGVAVSLAVQGFAAEKDGRDNEVLPVQSIRTMAEVYGQIKANY
                   10         20         30         40         50         60

70         80         90        100        110        120
m732.pep   YQDKPDADLFEGAMKGMVAGLDPHSEYMDKKGYAEIKESTSGEFGGLGMEIGQEDGFVKV
           |:||||||||||||||||||||||||||||||||||||||||||||||||||||||||||
g732       YHDKPDADLFEGAMKGMVAGLDPHSEYMDKKGYAEIKESTSGEFGGLGMEIGQEDGFVKV
                   70         80         90        100        110        120

130        140        150        160        170        180
m732.pep   VSPIEDTPAERAGVKSGDFIVKIDNVSTRGMTVSEAVKKMRGKPGTKITLTLSRKNADKP
           ||||||||||| |||||||||||||||||||||||||||||||||||||||||||||||
g732       VSPIEDTPAERAEVKSGDFIVKIDNVSTRGMTVSEAVKKMRGKPGTKITLTLSRKNADKP
                  130        140        150        160        170        180

190        200        210        220        230        240
m732.pep   IVVNLTRAIIKVKSVRHHLIEPDYGYIRVSQFQERTVESVNTAAKELVKENKGKPLKGLV
           ||||||||||||||||||||||||||||||||||||||||||||||||||||||||||||
g732       IVVNLTRAIIKVKSVRHHLIEPDYGYIRVSQFQERTVESVNTAAKELVKENKGKPLKGLV
                  190        200        210        220        230        240

250        260        270        280        290        300
m732.pep   LDLRDDPGGLLTGAVGVSAAFLPSEAVVVSTKGRDGKDRMVLKAIPEDYVYGMGGDSLAG
           |||||||||||||||||||||||||||||||||||||| |||||:|||||||||||:|||
g732       LDLRDDPGGLLTGAVGVSAAFLPSEAVVVSTKGRDGKDGMVLKAVPEDYVYGMGGDPLAG
                  250        260        270        280        290        300

310        320        330        340        350        360
m732.pep   IPAELKTIPMTVLVNSGSASASEIVAGALQDHKRAVIVGTQSFGKGSVQTLIPLSNGSAV
           ||||||||||||||||||||||||||||||||||||||||||||||||||||||||||||
g732       IPAELKTIPMTVLVNSGSASASEIVAGALQDHKRAVIVGTQSFGKGSVQTLIPLSNGSAV
                  310        320        330        340        350        360

370        380        390        400        410        420
m732.pep   KLTTALYYTPNDRSIQAQGIVPDVEVKDKERIFESREADLVGHIGNPLGGEDVNGETLAV
           ||||||||||||||||||||||||||||||| |||||||||||||||||||||:||||||
g732       KLTTALYYTPNDRSIQAQGIVPDVEVKDKERTFESREADLVGHIGNPLGGEDVNSETLAV
                  370        380        390        400        410        420

430        440        450        460        470        480
m732.pep   PLEKDADKPAVKEKGKKKKDEDLSSRRIPNPAKDDQLRKALDLVKSPEQWQKSLGLAAKK
           |||||||||:||||||||||||||||||||||||||||||||||||||||||||||||||
g732       PLEKDADKPAAKEKGKKKKDEDLSSRRIPNPAKDDQLRKALDLVKSPEQWQKSLGLAAKK
                  430        440        450        460        470        480

490
m732.pep   PVSNKDKKDKKDKKX
           |||||||||||
g732       PVSNKDKKDKKX
                  490
```

The following partial DNA sequence was identified in *N. meningitidis* <SEQ ID 2485>:

```
a732.seq
    1 ATGTCGAAAC CTGTTTTTAA GAAAATCGCA CTTTATACTT TGGGTGCAAT

51 CAGCGGCGTG GCCGTCAGTC TGGCGGTGCA GGGTTTTGCC GCCGAGAAGG

101 ACAGGCGGGA TAACGAAGTC CTGCCGGTGC AATCCATCCG CACAATGGCG

151 GAGGTTTAC

```
251 LTGAVGVSAA FLPSEAVVVS TKGRDGKDRM VLKAVPEDYV YGMGGDSLAG

301 IPAELKTIPM TVLVNSGSAS ASEIVAGALQ DHKRAVIVGT QSFGKGSVQT

351 LIPLSNGSAV KLTTALYYTP NDRSIQAQGI VPDVEVKDKE RIFESREADL

401 VGHIGNPLGG EDVNSETLAV PLEKDADKPA VKEKGKKKKD EDLSSRRIPN

451 PAKDDQLRKA LDLVKSPEQW QKSLGLAAKK PVSNKDKKDK KDKK*
``` a732/m732   99.6% identity in 494 aa overlap

```
                    10         20         30         40         50         60
a732.pep    MSKPVFKKIALYTLGAISGVAVSLAVQGFAAEKDRRDNEVLPVQSIRTMAEVYGQIKANY
            ||||||||||||||||||||||||||||||||||||||||||||||||||||||||||||
m732        MSKPVFKKIALYTLGAISGVAVSLAVQGFAAEKDRRDNEVLPVQSIRTMAEVYGQIKANY
                    10         20         30         40         50         60

70         80         90        100        110        120
a732.pep    YQDKPDADLFEGAMKGMVAGLDPHSEYMDKKGYAEIKESTSGEFGGLGMEIGQEDGFVKV
            ||||||||||||||||||||||||||||||||||||||||||||||||||||||||||||
m732        YQDKPDADLFEGAMKGMVAGLDPHSEYMDKKGYAEIKESTSGEFGGLGMEIGQEDGFVKV
                    70         80         90        100        110        120

130        140        150        160        170        180
a732.pep    VSPIEDTPAERAGVKSGDFIVKIDNVSTRGMTVSEAVKKMRGKPGTKITLTLSRKNADKP
            ||||||||||||||||||||||||||||||||||||||||||||||||||||||||||||
m732        VSPIEDTPAERAGVKSGDFIVKIDNVSTRGMTVSEAVKKMRGKPGTKITLTLSRKNADKP
                   130        140        150        160        170        180

190        200        210        220        230        240
a732.pep    IVVNLTRAIIKVKSVRHHLIEPDYGYIRVSQFQERTVESVNTAAKELVKENKGKPLKGLV
            ||||||||||||||||||||||||||||||||||||||||||||||||||||||||||||
m732        IVVNLTRAIIKVKSVRHHLIEPDYGYIRVSQFQERTVESVNTAAKELVKENKGKPLKGLV
                   190        200        210        220        230        240

250        260        270        280        290        300
a732.pep    LDLRDDPGGLLTGAVGVSAAFLPSEAVVVSTKGRDGKDRMVLKAVPEDYVYGMGGDSLAG
            |||||||||||||||||||||||||||||||||||||||||||||:||||||||||||||
m732        LDLRDDPGGLLTGAVGVSAAFLPSEAVVVSTKGRDGKDRMVLKAIPEDYVYGMGGDSLAG
                   250        260        270        280        290        300

310        320        330        340        350        360
a732.pep    IPAELKTIPMTVLVNSGSASASEIVAGALQDHKRAVIVGTQSFGKGSVQTLIPLSNGSAV
            ||||||||||||||||||||||||||||||||||||||||||||||||||||||||||||
m732        IPAELKTIPMTVLVNSGSASASEIVAGALQDHKRAVIVGTQSFGKGSVQTLIPLSNGSAV
                   310        320        330        340        350        360

370        380        390        400        410        420
a732.pep    KLTTALYYTPNDRSIQAQGIVPDVEVKDKERIFESREADLVGHIGNPLGGEDVNSETLAV
            |||||||||||||||||||||||||||||||||||||||||||||||||||||:||||||
m732        KLTTALYYTPNDRSIQAQGIVPDVEVKDKERIFESREADLVGHIGNPLGGEDVNGETLAV
                   370        380        390        400        410        420

430        440        450        460        470        480
a732.pep    PLEKDADKPAVKEKGKKKKDEDLSSRRIPNPAKDDQLRKALDLVKSPEQWQKSLGLAAKK
            ||||||||||||||||||||||||||||||||||||||||||||||||||||||||||||
m732        PLEKDADKPAVKEKGKKKKDEDLSSRRIPNPAKDDQLRKALDLVKSPEQWQKSLGLAAKK
                   430        440        450        460        470        480

490
a732.pep    PVSNKDKKDKKDKKX
            |||||||||||||||
m732        PVSNKDKKDKKDKKX
                   490
```

The following partial DNA sequence was identified in *N. gonorrhoeae* <SEQ ID 2487>:

```
g733.seq
   1 ATGATGAATC CGAAAACCTT GGGCCGTTTG TCGCTGTGTG CGGCGGTCTT

51 GGCTCTGACC GCCTGCGCCG GCGGCGGGCA TAAAAACCTG TATTATTACG

101 GCGGTTATCC CGATACCGTC TATGAAGGTT TGAAAAACGa cgACACTTCG

151 TTGGGCAAGC AGACCGAAAA GATGGAAAAA TACTTTGCGG AAGCCGCCAA

201 CAAAAAATG AATGCCGCCC CGGGTGCGCA CGCCCATTTG GGACTGCTGC

251 TTTCCCGTTC GGGAGACAAA GAGGGCGCGT TCCGCCAATT TGAAGAAGAG

301 AAAAGGCTGT TTCCCGAATC GGGCGTATTT ATGGACTTCC TGATGAAAAC

351 CGGtaaAGGA GGCAAGCGAT GA
```

This corresponds to the amino acid sequence <SEQ ID 2488; ORF 733>:

```
g733.pep
    1 MMNPKTLGRL SLCAAVLALT ACAGGGHKNL YYYGGYPDTV YEGLKNDDTS

51 LGKQTEKMEK YFAEAANKKM NAAPGAHAHL GLLLSRSGDK EGAFRQFEEE

101 KRLFPESGVF MDFLMKTGKG GKR*
```

The following partial DNA sequence was identified in *N. meningitidis* <SEQ ID 2489>:

```
m733.seq
    1 ATGATGAATC CGAAAACCTT GAGCCGTTTG TCGCTGTGTG CGGCGGTCTT

51 GGCTCTGACC GCCTGCGGCG GCAACGGGCA AAAATCCCTG TATTATTACG

101 GCGGCTATCC CGATACCGTC TATGAAGGTT TGAAAAACGA CGACACTTCG

151 TTGGGCAAGC AGACCGAAAA GATGGAAAAA TACTTTGTGG AAGCCGGCAA

201 CAAAAAAATG AATGCCGCCC CGGGTGCGCA CGCCCATCTG GGACTGCTGC

251 TTTCCCGTTC GGGAGACAAA GAGGGCGCGT TCCGCCAGTT TGAAGAAGAG

301 AAAAGGCTGT TTCCCGAATC GGGCGTATTT ATGGACTTCC TGATGAAAAC

351 CGGTAAAGGA GGCAAGCGAT GA
```

This corresponds to the amino acid sequence <SEQ ID 2490; ORF 733>:

```
m733.pep
    1 MMNPKTLSRL SLCAAVLALT ACGGNGQKSL YYYGGYPDTV YEGLKNDDTS

51 LGKQTEKMEK YFVEAGNKKM NAAPGAHAHL GLLLSRSGDK EGAFRQFEEE

101 KRLFPESGVF MDFLMKTGKG GKR*
```

Computer analysis of the amino acid sequences gave the following results:
Homology with a Predicted ORF from *N. meningitidis* menA with menB
ORF 733 shows 94.3% identity over a 123 aa overlap with a predicted ORF (ORF733.a) from *N. gonorrhoeae*:

```
m733/g733
                   10         20         30         40         50         60
    m733.pep  MMNPKTLSRLSLCAAVLALTACGGNGQKSLYYYGGYPDTVYEGLKNDDTSLGKQTEKMEK
              |||||||:|||||||||||||:|:|:|:||||||||||||||||||||||||||||||||
    g733      MMNPKTLGRLSLCAACLALTACAGGGHKNLYYYGGYPDTVYEGLKNDDTSLGKQTEKMEK
                   10         20         30         40         50         60
                   70         80         90        100        110        120
    m733.pep  YFVEAGNKKMNAAPGAHAHLGLLLSRSGDKEGAFRQFEEEKRLFPESGVFMDFLMKTGKG
              ||:||:|||||||||||||||||||||||||||||||||||||||||||||||||||||
    g733      YFAEAANKKMNAAPGAHAHLGLLLSRSGDKEGAFRQFEEEKRLFPESGVFMDFLMKTGKG
                   70         80         90        100        110        120
    m733.pep  GKRX
              ||||
    g733      GKRX
```

The following partial DNA sequence was identified in *N. meningitidis* <SEQ ID 2491>:

```
a733.seq
    1 ATGATGAATC CGAAAACCTT GAGCCGTTTG TCGCTGTGTG CGGCGGTCTT
```

-continued

```
 51 GGCTCTGACC GCCTGCGGCG GCAACGGGCA AAAATCCCTG TATTATTACG

101 GCGGCTATCC CGATACCGTC TATGAAGGTT TGAAAAACGA CGACACTTCG

151 TTGGGCAAGC AGACCGAAAA GATGGAAAAA TACTTTGTGG AAGCCGGCAA

201 CAAAAAAATG AATGCCGCCC CGGGTGCGCA CGCCCATCTG GGACTGCTGC

251 TTTCCCGTTC GGGAGACAAA GAGGGCGCGT TCCGCCAGTT TGAAGAAGAG

301 AAAAGGCTGT TTCCCGAATC GGGCGTATTT ATGGACTTCC TGATGAAAAC

351 CGGTAAAGGA GGCAAGCGAT GA
```

This corresponds to the amino acid sequence <SEQ ID 2492; ORF 733.a>:

```
a733.pep
      1 MKNPKTLSRL SLCAAVLALT ACGGNGQKSL YYYGGYPDTV YEGLKNDDTS
     51 LGKQTEKMEK YFVEAGNKKM NAAPGAHAHL GLLLSRSGDK EGAFRQFEEE
    101 KRLFPESGVF MDFLMKTGKG GKR* a733/m733 100.0% identity in 123 aa overlap 10        20        30        40        50        60
m733.pep  MMNPKTLSRLSLCAAVLALTACGGNGQKSLYYYGGYPDTVYEGLKNDDTSLGKQTEKMEK
          ||||||||||||||||||||||||||||||||||||||||||||||||||||||||||||
m733      MMNPKTLGRLSLCAACLALTACAGGGHKNLYYYGGYPDTVYEGLKNDDTSLGKQTEKMEK
                    10        20        30        40        50        60

70        80        90       100       110       120
m733.pep  YFVEAGNKKMNAAPGAHAHLGLLLSRSGDKEGAFRQFEEEKRLFPESGVFMDFLMKTGKG
          ||||||||||||||||||||||||||||||||||||||||||||||||||||||||||||
m733      YFAEAANKKMNAAPGAHAHLGLLLSRSGDKEGAFRQFEEEKRLFPESGVFMDFLMKTGKG
                    70        80        90       100       110       120 m733.pep  GKRX
          ||||
m733      GKRX
```

The following partial DNA sequence was identified in *N. gonorrhoeae* <SEQ ID 2493>:

```
g734.seq
  1 ATGATGAAAA AGATACTGGC AGTATCGGCA CTATGCCTGA TGACTGCGGC

51 GGCACAGGCT GCCGATACTT ACGGCTATCT CGCCGTTTGG CAGAATCCGC

101 AGGATGCAAA CGATGTTTTG CAGGTTAAAA CCACAAAAGA AGATTCGGCG

151 AAAAGCGAAG CGTTTGCCGA GTTGGAAGCC TTTTGCAAAG GTCAGGACAC

201 GCTTGCGGGC ATTGCCGAAG ACGAGCCGAC CGGATGCCGG TCGGTCGTGT

251 CGCTGAACAA TACCTGTGTC TCGCTGGCAT ACCCGAAAGC CTTGGGCGCG

301 ATGCGCGTTG AAAACGCCGT CGTGATTACT TCTCCGCGTT TTACGAGCGT

351 TCATCAGGTC GCACTCAACC AGTGCATAAA AAAATACGGC GCACAGGGAC

401 AATGCGGCTT GGAAACAGTG TATTGCACGT CATCTTCTTA TTACGGCGGG

451 GCTGTTCGCT CCTTAATCCA ACACCTGAAA TAA
```

This corresponds to the amino acid sequence <SEQ ID 2494; ORF 734.ng>:

```
g734.pep
   1 MMKKILAVSA LCLMTAAAQA ADTYGYLAVW QNPQDANDVL QVKTTKEDSA

51 KSEAFAELEA FCKGQDTLAG IAEDEPTGCR SVVSLNNTCV SLAYPKALGA

101 MRVENAVVIT SPRFTSVHQV ALNQCIKKYG AQGQCGLETV YCTSSSYYGG

151 AVRSLIQHLK *
```

The following partial DNA sequence was identified in *N. meningitidis* <SEQ ID 2495>:

```
m734.seq (partial)
   1 TCGGGCATTG CTGAAGACGA GCCGACCGGA TGCCGGTCGG TCGTGTCGCT

51 GAACAATACC TGTGTCGCGC TGGCATACCC GAAAGCCTTG GGCGCGCTGC

101 GTGTCGACAA CGCCGTCGTG ATTACTTCTC CGCGTTTTAC GAGCGTTCAT

151 CAGGTCGCAC TCAACCAGTG CATCAAAAAA TACGGCGTAC AGGGACAATG

201 CGGCTTGGAA ACAGTGTATT GCACATCTTC TTCTTATTAC GGCGGAACTG

251 TGCGCTCTTT GATTCAAAAT CTCAAATAA
```

This corresponds to the amino acid sequence <SEQ ID 2496; ORF 734>:

```
m734.pep (partial)
  1 SGIAEDEPTG CRSVVSLNNT CVALAYPKAL GALRVDNAVV ITSPRFTSVH

51 QVALNQCIKK YGVQGQCGLE TVYCTSSSYY GGTVRSLIQN LK*
``` m734/g734 92.4% identity in 92 aa overlap

```
                                        10         20         30
       m734.pep                 SGIAEDEPTGCRSVVSLNNTCVALAYPKAL
                              :||||||||||||||||||||:||||||||
         g734   VLQVKTTKEDSAKSEAFAELEAFCKGQDTLAGIAEDEPTGCRSVVSLNNTCVSLAYPKAL
                    40         50         60         70         80         90

40         50         60         70         80         90
       m734.pep GALRVDNAVVITSPRFTSVHQVALNQCIKKYGVQGQCGLETVYCTSSSYYGGTVRSLIQN
                ||:|:|||||||||||||||||||||||||||:||||||||||||||||||||:||||:
         g734   GAMRVENAVVITSPRFTSVHQVALNQCIKKYGAQGQCGLETVYCTSSSYYGGAVRSLIQH
                   100        110        120        130        140        150 m734.pep LKX
                |||
         g734   LKX
                   160
```

The following partial DNA sequence was identified in *N. meningitidis* <SEQ ID 2497>:

```
a734.seq
   1 ATGATGAAAA AGATACTGGC CGTATCGGCA CTATGCCTGA TGACTGCGGC

51 GGCACGGGCT GCCGATACTT ACGGCTATCT CGCCGTTTGG CAGAATCCGC

101 AGAATGCAAA CGATGTTTTG CAGGTTAAAA CCACAAAAGA AGATTCGACG

151 AAAAGCGAAG CGTTTGCCGA GTTGGAAGCT TTCTGCAAAG GTCAGGACAC

201 GCTTGCGGGC ATTGCCGAAG ACGAGCCGAC CGGATGCCGG TCGGTCGTGT

251 CGCTGAACAA TACCTGTGTC GCGCTGGCAT ACCCGAAAGC CTTGGGCGCG

301 ATGCGCGTTG AAAACGCCGT TGTGATTACT TCTCCGCGTT TTACGAGCGT
```

```
351 TTATCAGGTC GCACTCAACC AGTGCATCAA AAAATACGGC GCACAGGGAC

401 AATGCGGCTT GGAAACAGTG TATTGCACGT CTTCTTCTTA TTACGGGGA

451 ACTGTGCGCT CTTTGATTCA AAATCTCAAA TAA
```

This corresponds to the amino acid sequence <SEQ ID 2498; ORF 734.a>:

```
a734.pep
  1 MMKKILAVSA LCLMTAAARA ADTYGYLAVW QNPQNANDVL QVKTTKEDST

51 KSEAFAELEA FCKGQDTLAG IAEDEPTGCR SVVSLNNTCV ALAYPKALGA

101 MRVENAVVIT SPRFTSVYQV ALNQCIKKYG AQGQCGLETV YCTSSSYYGG

151 TVRSLIQNLK *
``` a734/g734 95.6% identity in 160 aa overlap

```
                  10         20         30         40         50         60
    a734.pep  MMKKILAVSALCLMTAAARAADTYGYLAVWQNPQNANDVLQVKTTKEDSTKSEAFAELEA
              ||||||||||||||||||:||||||||||||||||:||||||||||||:|||||||||
    g734      MMKKILAVSALCLMTAAAQAADTYGYLAVWQNPQDANDVLQVKTTKEDSAKSEAFAELEA
                  10         20         30         40         50         60

70         80         90        100        110        120
    a734.pep  FCKGQDTLAGIAEDEPTGCRSVVSLNNTCVALAYPKALGAMRVENAVVITSPRFTSVYQV
              |||||||||||||||||||||||||||||:||||||||||||||||||||||||||:||
    g734      FCKGQDTLAGIAEDEPTGCRSVVSLNNTCVSLAYPKALGAMRVENAVVITSPRFTSVHQV
                  70         80         90        100        110        120

130        140        150        160
    a734.pep  ALNQCIKKYGAQGQCGLETVYCTSSSYYGGTVRSLIQNLKX
              |||||||||||||||||||||||||||||||:||||||:|||
    g734      ALNQCIKKYGAQGQCGLETVYCTSSSYYGGAVRSLIQHLKX
                 130        140        150        160 g735.seq  not found yet g735.pep  not found yet
```

The following partial DNA sequence was identified in *N. meningitidis* <SEQ ID 2499>:

```
m735.seq
  1 ATGAATCTCG TGAAACTGCT GGCGAATAAC TGGCAACCGA TTGCCATTAT

51 CGCGCTTGTC GGCACGGGCT TGGCTGTGTC GCACCATCAA GGCTACAAGT

101 CGGCATTTGC GAAGCAGCAG GCGGTCATCG ACAAGATGGA GCGCGACAAG

151 GCGCAAGCCC TGCTGTTGTC GGCTCAAAAC TATGCGCGCG AACTGGAACT

201 GGCACGCGCG GAAGCTAAAA AATATGAAGT CAAGGCGCAC GCTGTCGGCA

251 TGGCTTTGGC GAAAAAACAG GCGGAAGTCA GCCGTCTGAA AACGGAAAAT

301 AAAAAGGAAA TCGAAAATGT CCTTACTCAA GACCGTAAAA ATGCAAGCGG

351 CGGTTGCATT GACGGCTTTG GCTCTCACGG CCTGCAGCTC TACAACCGCG

401 CCCTCGGCTA CGGAAATTAA
```

This corresponds to the amino acid sequence <SEQ ID 2500; ORF 735>:

```
m735.pep
  1 MNLVKLLANN WQPIAIIALV GTGLAVSHHQ GYKSAFAKQQ AVIDKMERDK
```

```
 51 AQALLLSAQN YARELELARA EAKKYEVKAH AVGMALAKKQ AEVSRLKTEN

101 KKEIENVLTQ DRKNASGGCI DGFGSHGLQL YNRALGYGN*
```

The following partial DNA sequence was identified in *N. meningitidis* <SEQ ID 2501>:

```
a735.seq
  1 ATGAATCTCG TGAAACTGCT GGCGAATAAC TGGCAACCGA TTGCCATCAT

51 CGCGCTTGTC GGCACGGGTT TGGCGGTGTC GCACCATCAA GGCTACAAGT

101 CGGCTTTTGC GAAGCAGCAG GCGGTCATTG AGAAAATGAA GCGCGACAAG

151 GCGCAAGCCC TGCTGTTGTC GGCTCAAAAC TACGCCCGCG AACTGGAACA

201 GGCGCGTGCG GAAGCTAAAA AATATGAAGT CAAGGCGCAC GCCGTCGGCA

251 TGGCTTTGGC GAAAAAACAG GCGGAAGTCA GCCGTCTGAA AACGGAAAAT

301 AAAAAGGAAA TCGAAAATGT CCTTACTCAA GACCGTAAAA ATGCAGGCGG

351 CGGTTGTATT GACGGCTTTG GCCATCACGG CTTGCAGCTC TACAAGCGCG

401 CCCTCGGCTA CGGAAATTAA
```

This corresponds to the amino acid sequence <SEQ ID 2502; ORF 735.a>:

```
a735.pep

1 MNLVKLLANN WQPIAIIALV GTGLAVSHHQ GYKSAFAKQQ AVIEKMKRDK

51 AQALLLSAQN YARELEQARA EAKKYEVKAH AVGMALAKKQ AEVSRLKTEN

101 KKEIENVLTQ DRKNAGGGCI DGFGHHGLQL YKRALGYGN* a735/m735  95% identity in 139 aa overlap 10        20        30        40        50        60
a735.pep  MNLVKLLANNWQPIAIIALVGTGLAVSHHQGYKSAFAKQQAVIEKMKRDKAQALLLSAQN
          |||||||||||||||||||||||||||||||||||||||||:||:||||||||||||||
m735      MNLVKLLANNWQPIAIIALVGTGLAVSHHQGYKSAFAKQQAVIDKMERDKAQALLLSAQN
                  10        20        30        40        50        60

70        80        90       100       110       120
a735.pep  YARELEQARAEAKKYEVKAHAVGMALAKKQAEVSRLKTENKKEIENVLTQDRKNAGGGCI
          |||||||||||||||||||||||||||||||||||||||||||||||||||||||:||||
m735      YARELELARAEAKKYEVKAHAVGMALAKKQAEVSRLKTENKKEIENVLTQDRKNASGGCI
                  70        80        90       100       110       120

130       140
a735.pep  DGFGHHGLQLYKRALGYGNX
          ||||  ||||||:|||||||
m735      DGFGSHGLQLYNRALGYGNX
                 130       140
```

The following partial DNA sequence was identified in *N. gonorrhoeae* <SEQ ID 2503>:

```
g736.seq
  1 ATGAATTTTA TCCGTTCCGT CGGGGCGAAA ACCCTCGGCC TTATTCAATC

51 CTTCGGCAGT ATCACGCTGT TTCTGCTGAA CATTTTGGCG AAATCCGGCA

101 CGGCTTTCGC CCGTCCGCGC CTGAGCGTGC GCCAAGTGTA TTTTGCCGGC

151 GTGCTGTCGG TGCTGATTGT TGCCGTTTCG GGGCTGTTCG TCGGTATGGT

201 TTTGGGTTTG CAGGGCTATA CGCAGTTGTC GAAATTCAAA TCCGCCGATA

251 TTTTGGGCTA TATGGTCGCG GCTTCTCTGT TGCGCGAACT GGGTCCCGTG

301 TTGGCGGCGA TTCTGTTTGC CAGCAGCGCG GGCGGTGCGA TGACCAGCGA
```

-continued
```
351 AATCGGTTTG ATGAAAACGA CCGGACAGCT CGAAGCGATG AACGTGATGG

401 CGGTCAACCC CGTCGCCCGC GTGGTTGCCC CGCGTTTTTG GGCGGGCGTG

451 TTTTCTATGC CGCTTTTGGC TTCGATTTTC AACGTCGCGG GCATTTTCGG

501 CGCGTATTTG GTCGGCGTGA GCTGGCTGGG TTTGGACAGC GGTATTTTCT

551 GGCCGCAGAT GCAGAACAAC ATTACGATAC ATTACGATGT AATCAACGGT

601 TTGATCAAAT CCGCCGCGTT CGGCGTGGCG GTAACGCTGA TTGCCGTGCA

651 TCAGGGCTTC CACTGCATCC CGACTTCGGA AGGCATTTTG CGCGCCAGCA

701 CGCGCACGGT GGTTTCGTCC GCCCTGACGA TTTTGGCGGT CGATTTTATA

751 TTGACCGCGT GGATGTTTAC AGATTGA
```

This corresponds to the amino acid sequence <SEQ ID 2504; ORF 736>:

g736.pep
```
  1 MNFIRSVGAK TLGLIQSFGS ITLFLLNILA KSGTAFARPR LSVRQVYFAG

51 VLSVLIVAVS GLFVGMVLGL QGYTQLSKFK SADILGYMVA ASLLRELGPV

101 LAAILFASSA GGAMTSEIGL MKTTGQLEAM NVMAVNPVAR VVAPRFWAGV

151 FSMPLLASIF NVAGIFGAYL VGVSWLGLDS GIFWPQMQNN ITIHYDVING

201 LIKSAAFGVA VTLIAVHQGF HCIPTSEGIL RASTRTVVSS ALTILAVDFI

251 LTAWMFTD*
```

The following partial DNA sequence was identified in *N. meningitidis* <SEQ ID 2505>:

m736.seq
```
  1 ATGAATTTTA TCCGTTCCGT CGGGGCGAAA ACCCTCGGCC TTATTCAATC

51 CTTCGGCAGT ATCACGCTGT TTCTGCTGAA CATTTTGGCG AAATCCGGCA

101 CGGCTTTCGC CCGTCCGCGC CTGAGCGTGC GCCAAGTGTA TTTTGCCGGC

151 GTGCTGTCGG TGCTGATTGT TGCCGTTTCG GGGCTGTTCG TCGGTATGGT

201 TTTGGGTTTG CAGGGCTATA CGCAGTTGTC GAAATTCAAA TCCGCCGATA

251 TTTTGGGCTA TATGGTCGCG GCTTCTCTGT TGCGCGAACT GGGTCCCGTG

301 TTGGCGGCGA TTCTGTTTGC CAGCAGCGCG GGCGGTGCGA TGACCAGCGA

351 AATCGGTTTG ATGAAAACGA CCGGACAGCT CGAAGCGATG AACGTGATGG

401 CGGTCAACCC CGTCGCCCGC GTGGTTGCCC CGCGTTTTTG GGCGGGCGTG

451 TTTTCTATGC CGCTTTTGGC TTCGATTTTC AACGTCGCGG GCATTTTCGG

501 CGCGTATTTG GTCGGCGTGA GCTGGCTGGG TTTGGACAGC GGTATTTTCT

551 GGCCGCAGAT GCAGAACAAC ATTACGATAC ATTACGATGT AATCAACGGT

601 TTGATCAAAT CCGCCGCGTT CGGCGTGGCG GTAACGCTGA TTGCCGTGCA

651 TCAGGGCTTC CACTGCATCC CGACTTCGGA AGGCATTTTG CGCGCCAGCA

701 CGCGCACGGT GGTTTCGTCC GCCCTGACGA TTTTGGCGGT CGATTTTATA

751 TTGACCGCGT GGATGTTTAC AGATTGA
```

This corresponds to the amino acid sequence <SEQ ID 2506; ORF 736>:

```
m736.pep
   1 MNFIRSVGAK TLGLIQSLGS ITLFLLNILA KSGTAFVRPR LSVRQVYFAG

51 VLSVLIVAVS GLFVGMVLGL QGYTQLSKFK SADILGYMVA ASLLRELGPV

101 LAAILFASSA GGAMTSEIGL MKTTEQLEAM NVMAVNPVAR VVAPRFWAGV

151 FSMPLLASIF NVAGIFGAYL VGVTWLGLDS GIFWSQMQNN ITIHYDVING

201 LIKSAAFGVA VTLIAVHQGF HCVPTSEGIL RASTRTVVSS ALTILAVDFI

251 LTAWMFTD*
```

Computer analysis of the amino acid sequences gave the following results:

Homology with a Predicted ORF from *N. meningitidis* menA with menB

ORF 736 shows 97.7% identity over a 258 aa overlap with a predicted ORF (ORF736.ng) from *N. gonorrhoeae*:

```
   m736/g736

10         20         30         40         50         60
     m736.pep   MNFIRSVGAKTLGLIQSLGSITLFLINILAKSGTAFVRPRLSVRQVYFAGVLSVLIVAVS
                |||||||||||||||||:|||||||||||||||||||:||||||||||||||||||||||
     g736       MNFIRSVGAKTLGLIQSFGSITLFLLNILAKSGTAFARPRLSVRQVYFAGVLSVLIVAVS
                   10         20         30         40         50         60

70         80         90        100        110        120
     m736.pep   GLFVGMVLGLQGYTQLSKFKSADILGYMVAASLLRELGPVLAAILFASSAGGAMTSEIGL
                ||||||||||||||||||||||||||||||||||||||||||||||||||||||||||||
     g736       GLFVGMVLGLQGYTQLSKFKSADILGYMVAASLLRELGPVLAAILFASSAGGAMTSEIGL
                   70         80         90        100        110        120

130        140        150        160        170        180
     m736.pep   MKTTEQLEAMNVMAVNPVARVVAPRFWAGVFSMPLLASIFNVAGIFGAYLVGVTWLGLDS
                ||||  ||||||||||||||||||||||||||||||||||||||||||||||:|||||||
     g736       MKTTGQLEAMNVMAVNPVARVVAPRFWAGVFSMPLLASIFNVAGIFGAYLVGVSWLGLDS
                  130        140        150        160        170        180

190        200        210        220        230        240
     m736.pep   GIFWSQMQNNITIHYDVINGLIKSAAFGVAVTLIAVHQGFHCVPTSEGILRASTRTVVSS
                ||||  ||||||||||||||||||||||||||||||||||||:|||||||||||||||||
     g736       GIFWPQMQNNITIHYDVINGLIKSAAFGVAVTLIAVHQGFHCIPTSEGILRASTRTVVSS
                  190        200        210        220        230        240

250        259
     m736.pep   ALTILAVDFILTAWMFTDX
                |||||||||||||||||||
     g736       ALTILAVDFILTAWMFTDX
                  250
```

The following partial DNA sequence was identified in *N. meningitidis* <SEQ ID 2507>:

```
a736.seq
   1 ATGAATTTTA TCCGTTCCGT CGGGGCGAAA ACCCTCGGCC TTATTCAATC

51 TCTCGGCAGT ATCACGCTGT TTCTGCTGAA TATTCTGGCG AAATCCGGTA

101 CGGCTTTCGT CCGTCCGCGC CTGAGCGTGC GCCAAGTGTA TTTTGCCGGC

151 GTGCTGTCGG TGTTGATTGT TGCCGTTTCA GGGCTGTTTG TCGGCATGGT

201 CTTGGGTTTG CAGGGCTATA CGCAGTTGTC GAAATTCAAA TCCGCCGATA

251 TTTTGGGCTA TATGGTCGCG GCTTCGCTGT TGCGCGAACT GGGTCCGGTG

301 TTGGCGGCGA TTCTGTTTGC CAGCAGCGCG GGCGGTGCGA TGACCAGCGA

351 AATCGGTTTG ATGAAAACGA CCGAACAGCT CGAAGCGATG AACGTGATGG

401 CGGTAAACCC CGTCGCCCGA GTGGTTGCGC CGCGCTTTTG GGCGGGCGTG

451 TTTTCCATGC CGCTTTTGGC TTCGATTTTC AACGTGGCGG GTATTTTCGG
```

-continued

```
501 CGCGTATTTG GTCGGTGTAA CCTGGCTGGG CTTGGACAGC GGTATTTTCT

551 GGTCGCAAAT GCAGAACAAC ATCACGATAC ATTACGATGT AATCAACGGT

601 CTGATCAAAT CCGCCGCGTT CGGCGTGGCG GTAACGCTGA TTGCCGTGCA

651 TCAGGGCTTC CACTGCGTCC CGACCTCGGA AGGCATTTTG CGCGCCAGCA

701 CGCGCACGGT GGTTTCGTCC GCCCTGACGA TTTTGGCGGT CGATTTTATA

751 TTGACCGCGT GGATGTTTAC AGATTGA
```

This corresponds to the amino acid sequence <SEQ ID 2508; ORF 736.a>:

```
a736.pep

1  MNFIRSVGAK TLGLIQSLGS ITLFLLNILA KSGTAFVRPR LSVRQVYFAG

51  VLSVLIVAVS GLFVGMVLGL QGYTQLSKFK SADILGYMVA ASLLRELGPV

101  LAAILFASSA GGAMTSEIGL MKTTEQLEAM NVMAVNPVAR VVAPRFWAGV

151  FSMPLLASIF NVAGIFGAYL VGVTWLGLDS GIFWSQMQNN ITIHYDVING

201  LIKSAAFGVA VTLIAVHQGF HCVPTSEGIL RASTRTVVSS ALTILAVDFI

251  LTAWMFTD* a736/m736  100.0% identity in 258 aa overlap
                   10         20         30         40         50         60
a736.pep  MNFIRSVGAKTLGLIQSLGSITLFLINILAKSGTAFVRPRLSVRQVYFAGVLSVLIVAVS
          ||||||||||||||||||||||||||||||||||||||||||||||||||||||||||||
m736      MNFIRSVGAKTLGLIQSLGSITLFLLNILAKSGTAFVRPRLSVRQVYFAGVLSVLIVAVS
                   10         20         30         40         50         60

70         80         90        100        110        120
a736.pep  GLFVGMVLGLQGYTQLSKFKSADILGYMVAASLLRELGPVLAAILFASSAGGAMTSEIGL
          ||||||||||||||||||||||||||||||||||||||||||||||||||||||||||||
m736      GLFVGMVLGLQGYTQLSKFKSADILGYMVAASLLRELGPVLAAILFASSAGGAMTSEIGL
                   70         80         90        100        110        120

130        140        150        160        170        180
a736.pep  MKTTEQLEAMNVMAVNPVARVVAPRFWAGVFSMPLLASIFNVAGIFGAYLVGVTWLGLDS
          ||||||||||||||||||||||||||||||||||||||||||||||||||||||||||||
m736      MKTTEQLEAMNVMAVNPVARVVAPRFWAGVFSMPLLASIFNVAGIFGAYLVGVTWLGLDS
                  130        140        150        160        170        180

190        200        210        220        230        240
a736.pep  GIFWSQMQNNITIHYDVINGLIKSAAFGVAVTLIAVHQGFHCVPTSEGILRASTRTVVSS
          ||||||||||||||||||||||||||||||||||||||||||||||||||||||||||||
m736      GIFWSQMQNNITIHYDVINGLIKSAAFGVAVTLIAVHQGFHCVPTSEGILRASTRTVVSS
                  190        200        210        220        230        240

250       259
a736.pep  ALTILAVDFILTAWMFTDX
          |||||||||||||||||||
m736      ALTILAVDFILTAWMFTDX
                  250
```

The following partial DNA sequence was identified in *N. gonorrhoeae* <SEQ ID 2509>:

```
g737.seq
   1  atgaACATCA AACACCTTCT CTTGACCGCC GCCGCAACCG CACTGTTGGG

51  CATTTCCGCC CCCGCACTCG CCCACCACGA CGGACACGGC GATGACGACC

101  ACGGACACGC CGCACACCAA CACGGCAAAC AAGACAAAAT CATCAGCCGC

151  GCCCAAGCCG AAAAAGCGGC TTGGGCGCGT GTCGGCGGCA AAATCACCGA

201  CATCGATCTC GAACACGACG ACGGCCGTCC GCACTATGAT GTCGAAATCG

251  TCAAAAACGG ACAGGAATAC AAAGTCGTTG TCGATGCCCG TACCGGCCGC

301  GTGATTTCCT CCCGCCGCGA CGACTGA
```

This corresponds to the amino acid sequence <SEQ ID 2510; ORF 737>:

```
g737.pep
   1 MNIKHLLLTA AATALLGISA PALAHHDGHG DDDHGHAAHQ HGKQDKIISR

51 AQAEKAAWAR VGGKITDIDL EHDDGRPHYD VEIVKNGQEY KVVVDARTGR

101 VISSRRDD*
```

The following partial DNA sequence was identified in *N. meningitidis* <SEQ ID 2511>:

```
m737.seq..
   1 ATGAACATCA AACACCTTCT CTTGACCTCC GCCGCAACCG CACTGCTGAG

51 CATTTCCGCC CCCGCGCTCG CCCACCACGA CGGACACGGC GATGACGACC

101 ACGGACACGC CGCACACCAA CAACAAAC AAGACAAAAT CATCAGCCGC

151 GCCCAAGCCG AAAAAGCAGC GTTGGCGCGT GTCGGCGGCA AAATCACCGA

201 CATCGATCTC GAACACGACA ACGGCCGTCC GCACTATGAT GTCGAAATCG

251 TCAAAAACGG ACAGGAATAC AAAGTCGTTG TCGATGCCCG TACCGGCCGC

301 GTGATTTCCT CCCGCCGCGA CGACTGA
```

This corresponds to the amino acid sequence <SEQ ID 2512; ORF 737>:

```
m737.pep
   1 MNIKHLLLTS AATALLSISA PALAHHDGHG DDDHGHAAHQ HNKQDKIISR

51 AQAEKAALAR VGGKITDIDL EHDNGRPHYD VEIVKNGQEY KVVVDARTGR

101 VISSRRDD*
```

Computer analysis of the amino acid sequences gave the following results:
Homology with a Predicted ORF from *N. meningitidis* menA with menB
ORF 737 shows 95.4% identity over a 108 aa overlap with a predicted ORF (ORF737.a) from *N. gonorrhoeae*:

```
m737/g737
                    10         20         30         40         50         60
    m737.pep  MNIKHLLLTSAATALLSISAPALAHHDGHGDDDHGHAAHQHNKQDKIISRAQAEKAALAR
              ||||||||:||||||:||||||||||||||||||||||||:|||||||||||||||| ||
    g737      MNIKHLLLTAAATALLGISAPALAHHDGHGDDDHGHAAHQHGKQDKIISRAQAEKAAWAR
                    10         20         30         40         50         60

70         80         90        100        109
    m737.pep  VGGKITDIDLEHDNGRPHYDVEIVKNGQEYKVVVDARTGRVISSRRDDX
              ||||||||||:||||||||||||||||||||||||||||||||||||||
    g737      VGGKITDIDLEHDDGRPHYDVEIVKNGQEYKVVVDARTGRVISSRRDDX
                    70         80         90        100
```

The following partial DNA sequence was identified in *N. meningitidis* <SEQ ID 2513>:

```
a737.seq
   1 ATGAACTTCA AACGCCTTCT CTTGACCGCC GCCGCAACCG CACTGATGGG

51 CATTTCCGCC CCCGCACTCG CCCACCACGA CGGACACGGC GATGACGACC

101 ACGGACACGC CGCACACCAA CACAGCAAAC AAGACAAAAT CATCAGCCGC

151 GCCCAAGCCG AAAAAGCAGC GTTGGCGCGT GTCGGCGGCA AAATCACCGA
```

```
201 CATCGATCTC GAACACGACA ACGGCCGTCC GCACTATGAT GTCGAAATCG

251 TCAAAAACGG ACAGGAATAC AAAGTCGTTG TCGATGCCCG TACCGGCCGC

301 GTGATTTCCT CCCGCCGCGA CGACTGA
```

This corresponds to the amino acid sequence <SEQ ID 2514; ORF 737.a>:

```
a737.pep

1  MNFKRLLLTA AATALMGISA PALAHHDGHG DDDHGHAAHQ HSKQDKIISR

51  AQAEKAALAR VGGKITDIDL EHDNGRPHYD VEIVKNGQEY KVVVDARTGR

101  VISSRRDD* a737/m737  94.4% identity in 108 aa overlap 10        20        30        40        50        60
a737.pep  MNFKHLLLTAAATALMGISAPALAHHDGHGDDDHGHAAHQHSKQDKIISRAQAEKAALAR
          ||:||||||:|||||:||||||||||||||||||||||||:||||||||||||| ||
m737      MNIKHLLLTSAATALLSISAPALAHHDGHGDDDHGHAAHQHNKQDKIISRAQAEKAAWAR
                  10        20        30        40        50        60

70        80        90       100       109
a737.pep  VGGKITDIDLEHDNGRPHYDVEIVKNGQEYKVVVDARTGRVISSRRDDX
          |||||||||||||||||||||||||||||||||||||||||||||||||
m737      VGGKITDIDLEHDNGRPHYDVEIVKNGQEYKVVVDARTGRVISSRRDDX
                  70        80        90       100
```

The following partial DNA sequence was identified in *N. gonorrhoeae* <SEQ ID 2515>:

```
g738.seq
   1 ATGTCCGCTG AAACGACCGT ATCCGGCGCG CGCCCCGCCG CCAAACTGCC

51 GATTTACATC CTGCCCTGCT TCCTTTGGAT AGGCATCATC CCCTTTACCT

101 TCGCACTCAG GCTGAAACCG TCGCCCGACT TTTACCACGA TGCCGCCGCC

151 GCGGCCGGCC TGATTGTCCT GTTGTTCCTC ACGGCAGGAA AAAAGCTGTT

201 TGATGTCAAA ATCCCCGCCA TCAGCTTCCT CCTGTTTGCA ATGGCGGCAT

251 TTTGGTGGCT TCAGGCACGC CTGATGAACC TGATTTATCC CGGAATGAAC

301 GACATCGCCT CTTGGGTTTT CATCTTGCTC GCCGTCAGCG CGTGGGCCTG

351 CAAGAGTTTG GTCGCACACT ACGGACAAGA ACGCAtcgtT ACCCTGTTTG

401 CCTGGTCGCT GCTTATCGGC TCCCTGCTTC AATCCTGCAT CGTcgtCATC

451 CAGTTTGCCG GCTGGGAAAA CACCCCCCTG CTTCAAAACA TCATCGTTCA

501 CAGAGGGCAA GGCGTAATCG GACACATCGG GCAGCGCAAC AACCTCGGAC

551 ACTACCTCAT GTGGGGCATA CTCGCCTCCG CCTACCTCAA CGGACAACGA

601 AAAATCCCCG CAGCCCTCGG CGCAATCTGC CTGATTATGC AGACCGCCGT

651 TTTAGGTTTG GTCAATTCGC GCACCATCTT GACCTACATA GCCGCCATCG

701 CCCTCATCCT TCCCTTCTGG TATTTCCGTT CGGACAAATC CAACAGACGG

751 ACGATGCTCG GCATAGCCGC AGCCGTATTC CTTACCGCGC TGTTCCAATT

801 TTCCATGAAC GCCATTCTGG AAACCTTTAC AGGCATCCGC TACGAAACTG

851 CCGTCGAACG CGTCGCCAAC GGCGGTTTCA CAGACTTGCC GCGCCAAAGC

901 GAATGGAATA AAGCCCTTGC CGCCTTCCAG TCCGCCCCGA TATTCGGGCA

951 CGGCTGGAAC AGTTTTGCCC AACAAACCTT CCTGATCAAT GCCGAACAGC

1001 ACACCATACA CGACAACTTC CTCAGCACCT TGTTCACCCA TTCCCACAAC
```

-continued

```
1051  ATCATCCTCC AACTCCTTGC AGAAATGGGG ATCAGCGGCA CGCTTCTGGT

1101  TGCCGCAACC CTGCTGACGG GCATTGCCGG GCTGCTGAAA CGCTCCCTGA

1151  CCCCCGCATC ACTTTTCCTG CTGTGCGCGC TTGCCGTCAG TATGTGCCAC

1201  AGTATGCTCG AATATCCTTT GTGGTATGTC TATTTCCTCA TCCCCTTCGG

1251  ACTGATGCTC TTTCTGTCCC CCGCAGAGGC TTCAGACGGC ATCGCCTTCA

1301  AAAAAGCCGC CAATCTCGGC ATACTGACCG CCTCCGCCGC CATATTCGCA

1351  GGATTGCTGC ACTTGGACTG GACATACACC CGGCTGGTTA ACTCCTTTTC

1401  CCCCGCCGCT GACGACAGTG CCAAAACCCT CAACCGGAAA ATCAACGAAC

1451  TGCGCTATAT TTCCGCAAAC AGCCCGATGC TGTCCTTTTA TGCCGACTTC

1501  TCCCTCGTAA ACTTCGCCCT GCCGGAATAC CCCGAAACCC AGACTTGGGC

1551  GGAAGAAGCA ACCCTCAAAG CACTAAAATA CCGCCCCTAC TCCGCCACCT

1601  ACCGCATCGC CCTCTACTTG ATGCGGCAAG GCAAAGTTGC AGAAGCAAAA

1651  CAATGGATGC GGGCAACACA GTCCTATTAC CCCTACCTGA TGCCCCGATA

1701  CGCCGACGAA ATCCGCAAAC TGCCCGTATG GGCACCGCTG CTGCCCGAAC

1751  TGCTCAAAGA CTGCAAAGCC TTCGCCGCCG CTCCCGGCCA TCCGGAAACA

1801  AAACCCTGCA AATGA
```

This corresponds to the amino acid sequence <SEQ ID 2516; ORF 738>:

```
g738.pep
  1 MSAETTVSGA RPAAKLPIYI LPCFLWIGII PFTFALRLKP SPDFYHDAAA
 51 AAGLIVLLFL TAGKKLFDVK IPAISFLLFA MAAFWWLQAR LMNLIYPGMN
101 DIASWVFILL AVSAWACKSL VAHYGQERIV TLFAWSLLIG SLLQSCIVVI

151 QFAGWENTPL LQNIIVHRGQ GVIGHIGQRN NLGHYLMWGI LASAYLNGQR

201 KIPAALGAIC LIMQTAVLGL VNSRTILTYI AAIALILPFW YFRSDKSNRR

251 TMLGIAAAVF LTALFQFSMN AILETFTGIR YETAVERVAN GGFTDLPRQS

301 EWNKALAAFQ SAPIFGHGWN SFAQQTFLIN AEQHTIHDNF LSTLFTHSHN

351 IILQLLAEMG ISGTLLVAAT LLTGIAGLLK RSLTPASLFL LCALAVSMCH

401 SMLEYPLWYV YFLIPFGLML FLSPAEASDG IAFKKAANLG ILTASAAIFA

451 GLLHLDWTYT RLVNSFSPAA DDSAKTLNRK INELRYISAN SPMLSFYADF

501 SLVNFALPEY PETQTWAEEA TLKALKYRPY SATYRIALYL MRQGKVAEAK

551 QWMRATQSYY PYLMPRYADE IRKLPVWAPL LPELLKDCKA FAAAPGHPET

601 KPCK*
```

The following partial DNA sequence was identified in *N. meningitidis* <SEQ ID 2517>:

```
m738.seq
  1  ATGCCCGCTG AAACGACCGT ATCCGGCGCG CACCCCGCCG CCAAACTGCC
 51  GATTTACATC CTGCCCTGCT TCCTTTGGAT AGGCATCGTC CCCTTTACCT
101  TCGCGCTCAA ACTGAAACCG TCGCCCGACT TTTACCACGA TGCCGCCGCC
151  GCAGCCGGCC TGATTGTCCT GTTGTTCCTC ACGGCAGGAA AAAAACTGTT
201  TGATGTCAAA ATCCCCGCCA TCAGCTTCCT TCTGTTTGCA ATGGCGGCGT
```

-continued

```
 251 TTTGGTATCT TCAGGCACGC CTGATGAACC TGATTTACCC CGGTATGAAC
 301 GACATCGTCT CTTGGATTTT CATCTTGCTC GCCGTCAGCG CGTGGGCCTG
 351 CCGGAGCTTG GTCGCACACT TCGGACAAGA ACGCATCGTG ACCCTGTTTG
 401 CCTGGTCGCT GCTTATCGGC TCCCTGCTTC AATCCTGCAT CGTCGTCATC
 451 CAGTTTGCCG GCTGGGAAGA CACCCCTCTG TTTCAAAACA TCATCGTTTA
 501 CAGCGGGCAA GGCGTAATCG GACACATCGG GCAGCGCAAC AACCTCGGAC
 551 ACTACCTCAT GTGGGGCATA CTCGCCGCCG CCTACCTCAA CGGACAACGA
 601 AAAATCCCCG CCGCCCTCGG CGTAATCTGC CTGATTATGC AGACCGCCGT
 651 TTTAGGTTTG GTCAACTCGC GCACCATCTT GACCTACATA GCCGCCATCG
 701 CCCTCATCCT TCCCTTCTGG TATTTCCGTT CGGACAAATC CAACAGGCGG
 751 ACGATGCTCG GCATAGCCGC AGCCGTATTC CTTACCGCGC TGTTCCAATT
 801 TTCCATGAAC ACCATTCTGG AAACCTTTAC TGGCATCCGC TACGAAACTG
 851 CCGTCGAACG CGTCGCCAAC GGCGGTTTCA CAGACTTGCC GCGCCAAATC
 901 GAATGGAATA AAGCCCTTGC CGCCTTCCAG TCCGCCCCGA TATTCGGGCA
 951 CGGCTGGAAC AGTTTTGCCC AACAAACCTT CCTCATCAAT GCCGAACAGC
1001 ACAACATATA CGACAACCTC CTCAGCAACT TGTTCACCCA TTCCCACAAC
1051 ATCGTCCTCC AACTCCTTGC AGAGATGGGA ATCAGCGGCA CGCTTCTGGT
1101 TGCCGCAACC CTGCTGACGG GCATTGCCGG GCTGCTTAAA CGCCCCCTGA
1151 CCCCCGCATC GCTTTTCCTA ATCTGCACGC TTGCCGTCAG TATGTGCCAC
1201 AGTATGCTCG AATATCCTTT GTGGTATGTC TATTTCCTCA TCCCTTTCGG
1251 ACTGATGCTC TTCCTGTCCC CCGCAGAGGC TTCAGACGGC ATCGCCTTCA
1301 AAAAAGCCGC CAATCTCGGC ATACTGACCG CCTCCGCCGC CATATTCGCA
1351 GGATTGCTGC ACTTGGACTG GACATACACC CGGCTGGTTA ACGCCTTTTC
1401 CCCCGCCACT GACGACAGTG CCAAAACCCT CAACCGGAAA ATCAACGAGT
1451 TGCGCTATAT TTCCGCAAAC AGTCCGATGC TGTCCTTTTA TGCCGACTTC
1501 TCCCTCGTAA ACTTCGCCCT GCCGGAATAC CCCGAAACCC AGACTTGGGC
1551 GGAAGAAGCA ACCCTCAAAT CACTAAAATA CCGCCCCCAC TCCGCCACCT
1601 ACCGCATCGC CCTCTACCTG ATGCGGCAAG GCAAAGTTGC AGAAGCAAAA
1651 CAATGGATGC GGGCGACACA GTCCTATTAC CCgTACCTGA TGCCCCGATA
1701 CGCCGACGAA ATCCGCAAAC TGCCCGTATG GGCGCCGCTG CTACCCGAAC
1751 TGCTCAAAGA CTGCAAAGCC TTCGCCGCCG CGCCCGGTCA TCCGGAAGCA
1801 AAACCCTGCA AATGA
```

This corresponds to the amino acid sequence <SEQ ID 2518; ORF 738>:

```
m738.pep
  1 MPAETTVSGA HPAAKLPIYI LPCFLWIGIV PFTFALKLKP SPDFYHDAAA

51 AAGLIVLLFL TAGKKLFDVK IPAISFLLFA MAAFWYLQAR LMNLIYPGMN

101 DIVSWIFILL AVSAWACRSL VAHFGQERIV TLFAWSLLIG SLLQSCIVVI

151 QFAGWEDTPL FQNIIVYSGQ GVIGHIGQRN NLGHYLMWGI LAAAYLNGQR

201 KIPAALGVIC LIMQTAVLGL VNSRTILTYI AAIALILPFW YFRSDKSNRR
```

-continued

```
251 TMLGIAAAVF LTALFQFSMN TILETFTGIR YETAVERVAN GGFTDLPRQI

301 EWNKALAAFQ SAPIFGHGWN SFAQQTFLIN AEQHNIYDNL LSNLFTHSHN

351 IVLQLLAEMG ISGTLLVAAT LLTGIAGLLK RPLTPASLFL ICTLAVSMCH

401 SMLEYPLWYV YFLIPFGLML FLSPAEASDG IAFKKAANLG ILTASAAIFA

451 GLLHLDWTYT RLVNAFSPAT DDSAKTLNRK INELRYISAN SPMLSFYADF

501 SLVNFALPEY PETQTWAEEA TLKSLKYRPH SATYRIALYL MRQGKVAEAK

551 QWMRATQSYY PYLMPRYADE IRKLPVWAPL LPELLKDCKA FAAAPGHPEA

601 KPCK*
```

Computer analysis of the amino acid sequences gave the following results:

Homology with a Predicted ORF from *N. meningitidis* menA with menB

ORF 738 shows 95.0% identity over a 604 aa overlap with a predicted ORF (ORF738.a) from *N. gonorrhoeae*:

```
   m738/g738
                        10         20         30         40         50         60
        m738.pep  MPAETTVSGAHPAAKLPIYILPCFLWIGIVPFTFALKLKPSPDFYHDAAAAAGLIVLLFL
                  ||||||||| :||||||||||||||||| :||||| :||||||||||||||||||||||
            g738  MSAETTVSGARPAAKLPIYILPCFLWIGIIPFTFALRLKPSPDFYHDAAAAAGLIVLLFL
                        10         20         30         40         50         60

70         80         90        100        110        120
        m738.pep  TAGKKLFDVKIPAISFLLFAMAAFWYLQARLMNLIYPGMNDIVSWIFILLAVSAWACRSL
                  |||||||||||||||||||||||||| :|||||||||||||| :|| :||||||||| :||
            g738  TAGKKLFDVKIPAISFLLFAMAAFWWLQARLMNLIYPGMNDIASWVFILLAVSAWACKSL
                        70         80         90        100        110        120

130        140        150        160        170        180
        m738.pep  VAHFGQERIVTLFAWSLLIGSLLQSCIVVIQFAGWEDTPLFQNIIVYSGQGVIGHIGQRN
                  ||| :||||||||||||||||||||||||||||||| :||| :||||| : ||||||||||
            g738  VAHYGQERIVTLFAWSLLIGSLLQSCIVVIQFAGWENTPLLQNIIVHRGQGVIGHIGQRN
                       130        140        150        160        170        180

190        200        210        220        230        240
        m738.pep  NLGHYLMWGILAAAYLNGQRKIPAALGVICLIMQTAVLGLVNSRTILTYIAAIALILPFW
                  ||||||||||| :|||||||||||||| :|||||||||||||||||||||||||||||||
            g738  NLGHYLMWGILASAYLNGQRKIPAALGAICLIMQTAVLGLVNSRTILTYIAAIALILPFW
                       190        200        210        220        230        240

250        260        270        280        290        300
        m738.pep  YFRSDKSNRRTMLGIAAAVFLTALFQFSMNTILETFTGIRYETAVERVANGGFTDLPRQI
                  |||||||||||||||||||||||||||||| :||||||||||||||||||||||||| :
            g738  YFRSDKSNRRTMLGIAAAVFLTALFQFSMNAILETFTGIRYETAVERVANGGFTDLPRQS
                       250        260        270        280        290        300

310        320        330        340        350        360
        m738.pep  EWNKALAAFQSAPIFGHGWNSFAQQTFLINAEQHNIYDNLLSNLFTHSHNIVLQLLAEMG
                  |||||||||||||||||||||||||||||||||| : | :: | :: ||||||| :||||||
            g738  EWNKALAAFQSAPIFGHGWNSFAQQTFLINAEQHTIHDNFLSTLFTHSHNIILQLLAEMG
                       310        320        330        340        350        360

370        380        390        400        410        420
        m738.pep  ISGTLLVAATLLTGIAGLLKRPLTPASLFLICTLAVSMCHSMLEYPLWYVYFLIPFGLML
                  ||||||||||||||||||||| ||||||||| : | :|||||||||||||||||||||||
            g738  ISGTLLVAATLLTGIAGLLKRSLTPASLFLLCALAVSMCHSMLEYPLWYVYFLIPFGLML
                       370        380        390        400        410        420

430        440        450        460        470        480
        m738.pep  FLSPAEASDGIAFKKAANLGILTASAAIFAGLLHLDWTYTRLVNAFSPATDDSAKTLNRK
                  ||||||||||||||||||||||||||||||||||||||||||||| :|||| :|||||||
            g738  FLSPAEASDGIAFKKAANLGILTASAAIFAGLLHLDWTYTRLVNSFSPAADDSAKTLNRK
                       430        440        450        460        470        480

490        500        510        520        530        540
        m738.pep  INELRYISANSPMLSFYADFSLVNFALPEYPETQTWAEEATLKSLKYRPHSATYRIALYL
                  |||||||||||||||||||||||||||||||||||||||||| :|||| :|||||||||
            g738  INELRYISANSPMLSFYADFSLVNFALPEYPETQTWAEEATLKALKYRPYSATYRIALYL
                       490        500        510        520        530        540

550        560        570        580        590        600
        m738.pep  MRQGKVAEAKQWMRATQSYYPYLMPRYADEIRKLPVWAPLLPELLKDCKAFAAAPGHPEA
                  |||||||||||||||||||||||||||||||||||||||||||||||||||||||||| :
            g738  MRQGKVAEAKQWMRATQSYYPYLMPRYADEIRKLPVWAPLLPELLKDCKAFAAAPGHPET
                       550        560        570        580        590        600
```

-continued

```
m738.pep      KPCKX
              |||||
g738          KPCKX
```

The following partial DNA sequence was identified in *N. meningitidis* <SEQ ID 2519>:

```
a738.seq
   1 ATGCCCGCTG AAACGACCGT ATCCGGCGCG CACCCCGCCG CCAAACTGCC
  51 GATTTACATC CTGCCCTGCT TCCTTTGGAT AGGCATCGTC CCCTTTACCT
 101 TTGCGCTCAG GCTGCAACCG TCGCCCGACT TTTACCACGA TGCCGCCGCC
 151 GCAGCCGGCC TGATTGTCCT GTTGTTCCTC ACGGCAGGAA AAAAGCTGTT
 201 TGATGTCAAA ATCCCACCTA TCAGCTTCCT TCTGTTTGCA ATGGCGGCGT
 251 TTTGGTATCT TCAGGCACGC CTGATGAACC TGATTTACCC CGGTATGAAC
 301 GACATCGTCT CTTGGATTTT CATCTTACTC GCCGTCAGCG CGTGGGCCTG
 351 CCGGAGCTTG GTCGCACACT ACGGACAAGA ACGCATCGTT ACCCTGTTTG
 401 CCTGGTCGCT GCTTATCGGC TCCCTGCTTC AATCCTGCAT CGTCGTCATC
 451 CAGTTTGCCG GCTGGGAAGA CACCCCTCTG TTTCAAAACA TCATTGTTTA
 501 CAGCGGGCAA GGCGTAATCG GACACATCGG ACAGCGCAAC AACCTCGGAC
 551 ACTACCTCAT GTGGGGCATA CTCGCCGCCG CCTACCTCAA CGGACAACGA
 601 AAAATCCCGC CCGCCTTGGG TGCAATCTGC CTGATTATGC AGACCGCCGT
 651 TTTAGGTTTG GTCAATTCGC GCACCATCTT GACCTACATA GCCGCCATCG
 701 CCCTCATCCT TCCCTTCTGG TATTTCCGTT CGGACAAATC CAACAGGCGG
 751 ACGATACTCG GCATAGCCGC AGCCGTATTC CTTACCGCGC TGTTCCAATT
 801 TTCCATGAAC ACCATTCTGG AAACCTTTAC CGGCATCCGC TACGAAACCG
 851 CCGTCGAACG CGTCGCCAAC GGCGGTTTCA CAGACCTGCC GCGCCAAATC
 901 GAATGGCGCA AAGCCCTCGC CGCCTTCCAG TCCGCCCCGA TATTCGGGCA
 951 CGGCTGGAAC AGTTTTGCCC AACAAACCTT CCTCATCAAT GCCGAACAGC
1001 ACAACATACA CGACAACCTC CTCAGCAACT TGTTCACCCA TTCCCACAAC
1051 ATCGTTCTCC AACTCCTTGC AGAGATGGGG ATCAGCGGCA CGCTTCTGGT
1101 TGCCGCAACC CTGCTGACGG GCATTGCCGG GCTGCTGAAA CGCCCCCTGA
1151 CCCCCGCATC GCTTTTCCTG ATCTGCACAC TTGCCGTCAG TATGTGCCAC
1201 AGTATGCTCG AATATCCTTT GTGGTATGTC TATTTCCTCA TCCCCTTCGG
1251 ACTGATGCTC TTTCTGTCCC CCGCAGAGGC TTCAGACGGC ATCGCCTTCA
1301 AAAAAGCCGC CAATCTCGGC ATACTAACCG CCTCCGCCGC CATATTCGCA
1351 GGATTGCTGC ACTTGGACTG GACATACACC CGGATGGTTA ACGCCTTTTC
1401 CCCCGCCACT GACGACAGTG CCAAAACCCT CAACCGGAAA ATCAACGAGT
1451 TGCGCTATAT TTCCGCAAAC AGTCCGATGC TGTCCTTTTA TGCCGACTTC
1501 TCCCTCGTAA ACTTCGCCCT GCCGGAATAC CCCGAAACCC AGACTTGGGC
1551 GGAAGAAGCA ACCCTCAAAT CACTAAAATA CCGCCCCCAC TCCGCCACCT
1601 ACCGCATCGC CCTCTACCTG ATGCGGCAAG GCAAAGTTGC AGAAGCAAAA
1651 CAATGGATGC GGGCGACACA GTCCTATTAC CCCTACCTGA TGCCCCGATA
```

```
-continued
1701 CGCCGACGAA ATCCGCAAAC TGCCCGTATG GGCGCCGCTG CTACCCGAAC

1751 TGCTCAAAGA CTGCAAAGCC TTCGCCGCCG CGCCCGGTCA TCCGGAAGCA

1801 AAACCCTGCA AATGA
```

This corresponds to the amino acid sequence <SEQ ID 2520; ORF 738.a>:

```
a738.pep

1   MPAETTVSGA HPAAKLPIYI LPCFLWIGIV PFTFALRLQP SPDFYHDAAA
   51   AAGLIVLLFL TAGKKLFDVK IPPISFLLFA MAAFWYLQAR LMNLIYPGMN
  101   DIVSWIFILL AVSAWACRSL VAHYGQERIV TLFAWSLLIG SLLQSCIVVI
  151   QFAGWEDTPL FQNIIVYSGQ GVIGHIGQRN NLGHYLMWGI LAAAYLNGQR
  201   KIPPALGAIC LIMQTAVLGL VNSRTILTYI AAIALILPFW YFRSDKSNRR
  251   TILGIAAAVF LTALFQFSMN TILETFTGIR YETAVERVAN GGFTDLPRQI
  301   EWRKALAAFQ SAPIFGHGWN SFAQQTFLIN AEQHNIHDNL LSNLFTHSHN
  351   IVLQLLAEMG ISGTLLVAAT LLTGIAGLLK RPLTPASLFL ICTLAVSMCH
  401   SMLEYPLWYV YFLIPFGLML FLSPAEASDG IAFKKAANLG ILTASAAIFA
  451   GLLHLDWTYT RMVNAFSPAT DDSAKTLNRK INELRYISAN SPMLSFYADF
  501   SLVNFALPEY PETQTWAEEA TLKSLKYRPH SATYRIALYL MRQGKVAEAK
  551   QWMRATQSYY PYLMPRYADE IRKLPVWAPL LPELLKDCKA FAAAPGHPEA
  601   KPCK* a738/m738    98.3% identity in 604 aa overlap 10         20         30         40         50         60
a738.pep    MPAETTVSGAHPAAKLPIYILPCFLWIGIVPFTFALRLQPSPDFYHDAAAAAGLIVLLFL
            ||||||||||||||||||||||||||||||||||||:|:|||||||||||||||||||||
m738        MPAETTVSGAHPAAKLPIYILPCFLWIGIVPFTFALKLKPSPDFYHDAAAAAGLIVLLFL
                    10         20         30         40         50         60

70         80         90        100        110        120
a738.pep    TAGKKLFDVKIPPISFLLFAMAAFWYLQARLMNLIYPGMNDIVSWIFILLAVSAWACRSL
            |||||||||||| |||||||||||||||||||||||||||||||||||||||||||||||
m738        TAGKKLFDVKIPAISFLLFAMAAFWYLQARLMNLIYPGMNDIVSWIFILLAVSAWACRSL
                    70         80         90        100        110        120

130        140        150        160        170        180
a738.pep    VAHYGQERIVTLFAWSLLIGSLLQSCIVVIQFAGWEDTPLFQNIIVYSGQGVIGHIGQRN
            |||:||||||||||||||||||||||||||||||||||||||||||||||||||||||||
m738        VAHFGQERIVTLFAWSLLIGSLLQSCIVVIQFAGWEDTPLFQNIIVYSGQGVIGHIGQRN
                   130        140        150        160        170        180

190        200        210        220        230        240
a738.pep    NLGHYLMWGILAAAYLNGQRKIPPALGAICLIMQTAVLGLVNSRTILTYIAAIALILPFW
            |||||||||||||||||||||||| |:|||||||||||||||||||||||||||||||||
m738        NLGHYLMWGILAAAYLNGQRKIPAALGVICLIMQTAVLGLVNSRTILTYIAAIALILPFW
                   190        200        210        220        230        240

250        260        270        280        290        300
a738.pep    YFRSDKSNRRTILGIAAAVFLTALFQFSMNTILETFTGIRYETAVERVANGGFTDLPRQI
            ||||||||||:|||||||||||||||||||||||||||||||||||||||||||||||||
m738        YFRSDKSNRRTMLGIAAAVFLTALFQFSMNTILETFTGIRYETAVERVANGGFTDLPRQI
                   250        260        270        280        290        300

310        320        330        340        350        360
a738.pep    EWRKALAAFQSAPIFGHGWNSFAQQTFLINAEQHNIHDNLLSNLFTHSHNIVLQLLAEMG
            || ||||||||||||||||||||||||||||||||||:||||||||||||||||||||||
m738        EWNKALAAFQSAPIFGHGWNSFAQQTFLINAEQHNIYDNLLSNLFTHSHNIVLQLLAEMG
                   310        320        330        340        350        360

370        380        390        400        410        420
a738.pep    ISGTLLVAATLLTGIAGLLKRPLTPASLFLICTLAVSMCHSMLEYPLWYVYFLIPFGLML
            ||||||||||||||||||||||||||||||||||||||||||||||||||||||||||||
m738        ISGTLLVAATLLTGIAGLLKRPLTPASLFLICTLAVSMCHSMLEYPLWYVYFLIPFGLML
                   370        380        390        400        410        420

430        440        450        460        470        480
a738.pep    FLSPAEASDGIAFKKAANLGILTASAAIFAGLLHLDWTYTRMVNAFSPATDDSAKTLNRK
            ||||||||||||||||||||||||||||||||||||||||||:|||||||||||||||||
m738        FLSPAEASDGIAFKKAANLGILTASAAIFAGLLHLDWTYTRLVNAFSPATDDSAKTLNRK
                   430        440        450        460        470        480
```

```
                 490        500        510        520        530        540
a738.pep   INELRYISANSPMLSFYADFSLVNFALPEYPETQTWAEEATLKSLKYRPHSATYRIALYL
           ||||||||||||||||||||||||||||||||||||||||||||||||||||||||||||
m738       INELRYISANSPMLSFYADFSLVNFALPEYPETQTWAEEATLKSLKYRPHSATYRIALYL
                 490        500        510        520        530        540

550        560        570        580        590        600
a738.pep   MRQGKVAEAKQWMRATQSYYPYLMPRYADEIRKLPVWAPLLPELLKDCKAFAAAPGHPEA
           |||||||||||||||||||||||||||||||||||||||||||||| |||||||||||||
m738       MRQGKVAEAKQWMRATQSYYPYLMPRYADEIRKLPVWAPLLPELLHDCKAFAAAPGHPEA
                 550        560        570        580        590        600 a738.pep   KPCKX
           |||||
m738       KPCKX
```

The following partial DNA sequence was identified in *N. gonorrhoeae* <SEQ ID 2521>:

```
g739.seq
   1 ATGGCAAAAA AACCGAACAA ACCCTTCAGG CTGACCCCCA AACTCCTGAT

51 ACGCGCCGTA TTGCTCATCT GTATCACCGC CATCGGCGCA TTGGCAGTAG

101 GCATCGTCAG CACATTCAAC CCGAACGGCG ACAAAACCCT CCAAACCGAA

151 CCGCAACACA CCGACAGCCC CCGCGAAACC GAATTCTGGC TGCCAAACGG

201 CGCCGTCGGA CAAGATGCCG CCCAACCCGA ACACCACCAC GCCGCCTCAT

251 CCGAACCCGC ACAGCCGGAC GGCACAGAAG AAAGCGGCAG CGGACTGCCG

301 TCCCCTGCCG CACCCAAGAA AAACCGGGTc AAACCGCGCC CTTCGGATGC

351 GGCCCGGGCA GCCGATTCGT TAACCGGCAC CGGAACACAA GCTGAAAACA

401 CACTCAAAGA AACCCCCGTA CTGCCCACAA ACGCCCCCCA TCCCGAACCC

451 CGAAAAGAAA CACCCGAAAA ACAGGCGCAG CCCAAGAAA CACCCAAAGA

501 AAAAGAAACG CCCAAAGAAA ACCATACCAA ACCGGACACC CCGAAAAACA

551 CGCCGGCCAA ACCCCATAAA GAGATTCTCG ACAACCTCTT TTGA
```

This corresponds to the amino acid sequence <SEQ ID 2522; ORF 739>:

```
g739.pep
   1 MAKKPNKPFR LTPKLLIRAV LLICITAIGA LAVGIVSTFN PNGDKTLQTE

51 PQHTDSPRET EFWLPNGAVG QDAAQPEHHH AASSEPAQPD GTEESGSGLP

101 SPAAPKKNRV KPRPSDAARA ADSLTGTGTQ AENTLKETPV LPTNAPHPEP

151 RKETPEKQAQ PKETPKEKET PKENHTKPDT PKNTPAKPHK EILDNLF*
```

The following partial DNA sequence was identified in *N. meningitidis* <SEQ ID 2523>:

```
m739.seq
   1 ATGGCAAAAA AACCGAACAA ACCCTTCAGG CTGACCCCCA AACTCCTGAT

51 ACGCGCCGTA TTGCTCATCT GTATCGCCGC CATCGGCGCA TTGGCAATAG

101 GCATCGTCAG CACATTCAAC CCGAACGGCG ACAAAACCCT TCAAGCCGAA

151 CCGCAACACA CCGACAGCCC CCGCGAAACC GAATTCTGGC TGCCAAACGG

201 CGTAGTCGGA CAAGATGCCG CCCAACCCGA ACACCACCAC GCCGCCTCAT

251 CCGAACCCGC ACAGCCGGAC GGCACAGACG AAAGCGGCAG CGGACTGCCG

301 TCCCCTGCCG CACCCAAGAA AAACCGGGTC AAACCGCAAC CTGCCGACAC
```

-continued

```
351 AGCTCAAACC GACAGGCAGC CGGACGACGC CGGAACACAA GCTGAAAACA

401 CACTCAAAGA AACCCCCGTA CTGCCCACAA ACGTCCCCCG TCCCGAACCC

451 CGAAAAGAAA CACCCGAAAA ACAGGCGCAG CCCAAAGAAA CGCCCAAAGA

501 AAACCATACC AAACCGGACA CCCCGAAAAA CACGCCGCCC AAACCCCATA

551 AAGAAATTCT CGACAAACTC TTC
```

This corresponds to the amino acid sequence <SEQ ID 2524; ORF 739>:

```
m739.pep
  1 MAKKPNKPFR LTPKLLIRAV LLICIAAIGA LAIGIVSTFN PNGDKTLQAE

51 PQHTDSPRET EFWLPNGVVG QDAAQPEHHH AASSEPAQPD GTDESGSGLP

101 SPAAPKKNRV KPQPADTAQT DRQPDDAGTQ AENTLKETPV LPTNVPRPEP

151 RKETPEKQAQ PKETPKENHT KPDTPKNTPP KPHKEILDKL F
```

Computer analysis of the amino acid sequences gave the following results:
Homology with a Predicted ORF from N. meningitidis menA with menB
ORF 739 shows 86.3% identity over a 197 aa overlap with a predicted ORF (ORF739.a) from N. gonorrhoeae:

```
m739/g739

10         20         30         40         50         60
    m739.pep  MAKKPNKPFRLTPKLLIRAVLLICIAAIGALAIGIVSTFNPNGDKTLQAEPQHTDSPRET
              |||||||||||||||||||||||:||||||:||||||||||||||:|||||||||
    g739      MAKKPNKPFRLTPKLLIRAVLLICITAIGALAVGIVSTFNPNGDKTLQTEPQHTDSPRET
                    10         20         30         40         50         60

70         80         90        100        110        120
    m739.pep  EFWLPNGVVGQDAAQPEHHHAASSEPAQPDGTDESGSGLPSPAAPKKNRVKPQPADTAQT
              |||||| |||||||||||||||||||||||:|||||||||||||||||||:|:|:|::
    g739      EFWLPNGAVGQDAAQPEHHHAASSEPAQPDGTEESGSGLPSPAAPKKNRVKPRPSDAARA
                    70         80         90        100        110        120

130        140        150        160        170
    m739.pep  DRQPDDAGTQAENTLKETPVLPTNVPRPEPRKETPEKQAQPKETPKE------NHTKPDT
              :   :||||||||||||||||||:|:|||||||||||||||||||         ||||||
    g739      ADSLTGTGTQAENTLKETPVLPTNAPHPEPRKETPEKQAQPKETPKEKETPKENHTKPDT
                   130        140        150        160        170        180

180        190
    m739.pep  PKNTPPKPHKEILDKLF
              ||||| |||||||||:||
    g739      PKNTPAKPHKEILDNLFX
                   190
```

The following partial DNA sequence was identified in N. meningitidis <SEQ ID 2525>:

```
a739.seq
  1 ATGGCAAAAA AACCGAACAA ACCCTTCAGG CTGACCCCCA AACTCCTGAT

51 ACGCGCCGTA TTGCTCATCT GTATCACCGC CATCGGCGCA TTGGCAATAG

101 GCATCGTCAG CACATTCAAC CCGAACGGCG ACAAAACCCT CCAAACCGAA

151 CCGCAACACA CCGACAGCCC CCGCGAAACC GAATTCTGGC TGCCAAACGG

201 CGTAGTCGGA CAAGATGCCG CCCAACCCGA ACACCACCAC GCCTCCTCAT

251 CCGCACCCGC ACAGCCGGAC GGCACAGACG AAAGCGGCAG CGGACTGCCG

301 TCCCCTGCCG CACCCAAGAA AAACCGGGTC AAACCGCAAC CTGCCGACAC

351 AGCTCAAACC GACAGGCAGC CGGACGACGC CGGAGCACAA GCTGAAAACA
```

-continued

```
401 CACTCAAAGA AACCCCCGTA CTGCCCACAA ACGTCCCCCG TCCCGAACCC

451 CGAAAAGAAA CACCCGAAAA ACAGGCACAG CCCAAAGAAA CACCCAAAGA

501 AAAAGAAACG CCCAAAGAAA ACCATACCAA ACCGGACACC CCGAAAAACA

551 CGCCGCCTAA ACCCCATAAA GAATTCTCG ACAACCTCTT CTGA
```

This corresponds to the amino acid sequence <SEQ ID 2526; ORF 739.a>:

```
a739.pep
         1   MAKKPNKPFR LTPKLLIRAV LLICITAIGA LAIGIVSTFN PNGDKTLQTE
        51   PQHTDSPRET EFWLPNGVVG QDAAQPEHHH ASSSAPAQPD GTDESGSGLP
       101   SPAAPKKNRV KPQPADTAQT DRQPDDAGAQ AENTLKETPV LPTNVPRPEP
       151   RKETPEKQAQ PKETPKEKET PKENHTKPDT PKNTPPKPHK EILDNLF* a739/m739   93.9% identity in 197 aa overlap 10         20         30         40         50         60
  a739.pep   MAKKPNKPFRLTPKLLIRAVLLICITAIGALAIGIVSTFNPNGDKTLQTEPQHTDSPRET
             |||||||||||||||||||||||||||:||||||||||||||||||||||:|||||||||
  m739       MAKKPNKPFRLTPKLLIRAVLLICIAAIGALAIGIVSTFNPNGDKTLQAEPQHTDSPRET
                    10         20         30         40         50         60

70         80         90        100        110        120
  a739.pep   EFWLPNGVVGQDAAQPEHHHASSSAPAQPDGTDESGSGLPSPAAPKKNRVKPQPADTAQT
             |||||||||||||||||||||||:||||||||||||||||||||||||||||||||||||
  m739       EFWLPNGVVGQDAAQPEHHHAASSEPAQPDGTDESGSGLPSPAAPKKNRVKPQPADTAQT
                    70         80         90        100        110        120

130        140        150        160        170        180
  a739.pep   DRQPDDAGAQAENTLKETPVLPTNVPRPEPRKETPEKQAQPKETPKEKETPKENHTKPDT
             ||||||||:|||||||||||||||||||||||||||||||||||||||      |||||||
  m739       DRQPDDAGTQAENTLKETPVLPTNVPRPEPRKETPEKQAQPKETPK------ENHTKPDT
                   130        140        150        160                170

130
  a739.pep   PKNTPPKPHKEILDNLFX
             |||||||||||||||:||
  m739       PKNTPPKPHKEILDKLF
                   180        190
```

The following partial DNA sequence was identified in *N. gonorrhoeae* <SEQ ID 2527>:

```
g740.seq
    1 ATGTCCCGAA ACCTGCTTGT CCGCTGGCTC GCCGTCTGCC TCATCCCCTT

51 GgcgACGCTT GCCGTTTTCG CCGCCAATcc gcCCGAAGAC AAACCCCAGC

101 ATCTGATCAA CGGCATCATC CTTGCCTGCG AAGCGACGTT TTTGTTTAAa 151 ttcgtgctCT TTGAAACCAT CAAGCATCAT CTTAaacaag gGTTTGATTT 201 GAAACgtcaa ACCATGTTTC TGTTTATTCC GATTGTTTTG CTGGTTGTGT 251 ATTTGTTCCA CTATTTCGGC GCGTTTTag
```

This corresponds to the amino acid sequence <SEQ ID 2528; ORF 740.ng>:

```
g740.pep
 1 MSRNLLVRWL AVCLIPLATL AVFAANPPED KPQHLINGII LACEATFLFK

51 FVLFETIKHH LKQGFDLKRQ TMFLFIPIVL LVVYLFHYFG AF*
```

The following partial DNA sequence was identified in *N. meningitidis* <SEQ ID 2529>:

```
m740.seq
   1 ATGTCCCGAA ACCTGCTTGT CCGCTGGCTT GCCGTCTGCC TCATCCCGTT

51 GGCGACGCTT GCCGTTTTCG CCGCCAATCC GCCCGAAGAC AAACTCCAGC

101 ATCTGATCAA CGGCATCATC CTTGCCTGCG AAGCGACGTT TTTGTTTAAA

151 TTCGTCCTTT TCGACACCAT CAAGCATCAT TTGAAACAAG AGTTTGATTT

201 GAAACGTCAA ACTATGTTGC TGTTTATTCC GATTATTTTG CTGATTGTGT

251 ATTTGTTCCA CTATTTTGGC GCGTTTTAG
```

This corresponds to the amino acid sequence <SEQ ID 2530; ORF 740>:

```
m740.pep

1 MSRNLLVRWL AVCLIPLATL AVFAANPPED KLQHLINGII LACEATFLEK

51 FVLFDTIKHH LKQEEDLKRQ TMLLFIPIIL LIVYLFHYFG AF* m740/g740  93.5% identity in 92 aa overlap 10        20        30        40        50        60
m740.pep  MSRNLLVRWLAVCLIPLATLAVFAANPPEDKLQHLINGIILACEATFLFKFVLFDTIKHH
          |||||||||||||||||||||||||||||| |||||||||||||||||||||||:|||||
g740      MSRNLLVRWLAVCLIPLATLAVFAANPPEDKPQHLINGIILACEATFLFKFVLFETIKHH
                  10        20        30        40        50        60
                  70        80        90
m740.pep  LKQEFDLKRQTMLLFIPIILLIVYLFHYFGAFX
          ||| |||||||||:|||||:||:|||||||||||
g740      LKQGFDLKRQTMFLFIPIVLLVVYLFHYFGAFX
                  70        80        90
```

The following partial DNA sequence was identified in *N. meningitidis* <SEQ ID 2531>:

```
a740.seq
   1 ATGTCCCGAA ACCTGCTTGT CCGCTGGCTT GTCGTCTGCC TGATACCCTT

51 GGCGACGCTT GCCGTTTTCG CCGCCAATCC GCCCGAAGAC AAACCCCAGC

101 ATCTGATTAA CGGCATCATC CTTGCCTGCG AAGCGACGTT TTTGTTCAAA

151 TTCGTCCTTT TCGACACCAT CAAGCATCAT TTGAAACAAG AGTTTGATTT

201 GAAACGTCAA ACTATGTTGC TGTTTATTCC GATTATTTTG CTGATTGTGT

251 ATTTGTTCCA CTATTTTGGC GCGTTTTAG
```

This corresponds to the amino acid sequence <SEQ ID 2532; ORF 740.a>:

```
a740.pep
 1 MSRNLLVRWL VVCLIPLATL AVFAANPPED KPQHLINGII LACEATFLFK

51 FVLFDTIKHH LKQEFDLKRQ TMLLFIPIIL LIVYLFHYFG AF*
``` a740/m740 97.8% identity in 92 aa overlap

```
                  10        20        30        40        50        60
a740.pep  MSRNLLVRWLVVCLIPLATLAVFAANPPEDKPQHLINGIILACEATFLFKFVLFDTIKHH
          ||||||||||:|||||||||||||||||||| ||||||||||||||||||||||||||||
m740      MSRNLLVRWLAVCLIPLATLAVFAANPPEDKLQHLINGIILACEATFLFKFVLFDTIKHH
                  10        20        30        40        50        60
```

```
                       70         80         90
a740.pep    LKQEFDLKRQTMLLFIPIILLIVYLFHYFGAFX
            ||||||||||||||||||||||||||||||||
m740        LKQEFDLKRQTMLLFIPIILLIVYLFHYFGAFX
                       70         80         90
```

The following partial DNA sequence was identified in *N. gonorrhoeae* <SEQ ID 2533>:

```
g741.seq
    1 GTGAACCGAA CTACCTTCTG CTGCCTTTCT TGACCGCCG GCCCTGATTC

51 TGACCGCCTG CAGCAGCGGA GGGGCGGAGG CGGTGGTGTC GCCGCCGACA

101 TCGGCACGGG GCTTGCCGAT GCATTAACCG CGCCGCTCGA CCATAAAGAC

151 AAAGGTTTGA ATCCCTAAC ATTGGAAGCC TCCATTCCCC AAAACGGAAC

201 ACTGACCCTG TCGGCACAAG GTGCGGAAAA AACTTTCAAA GCCGGCGGCA

251 AAGACAACAG CCTCAACACG GGCAAACTGA AGAACGACAA AATCAGCCGC

301 TTCGACTTCG TGCAAAAAAT CGAAGTGGAC GGACAAACCA TCACACTGGC

351 AAGCGGCGAA TTTCAAATAT ACAAACAGGA TCACTCCGcc gtcgtTgcCC

401 TacgGATTGA AAAAATCAAC AACCCCGACA AAATCGACAG CCTGATAAAC

451 CAACGCTCCT TCCTTGTCAG CGATTTGGGC GGAGAACATA CCGCCTTCAA

501 CCAACTGCCT GACGGCAAAG CCGAGTATCA CGGCAAAGCA TTCAGCTCCG

551 ACGATGCCGA CGGAAAACTG ACCTATACCA TAGATTTCGC CGCCAAACAG

601 GGACACGGCA AAATCGAACA CCTGAAAACA CCCGAGCAGA ATGTTGAGCT

651 TGCCTCCGCC GAACTCAAAG CAGATGAAAA ATCACACGCC GTCATTTTGG

701 GCGACACGCG CTACGGCGGC GAAGAGAAAG GCACTTACCG CCTCGCCCTT

751 TTCGGCGACC GCGCCCAAGA AATCGCTGGC TCGGCAACCG TGAAGATAGG

801 GGAAAAGGTT CACGAAATCG GCATCGCCGA CAAACAGTAG
```

This corresponds to the amino acid sequence <SEQ ID 2534; ORF 741.ng>:

```
g741.pep
    1 VNRTTFCCLS LTAGPDSDRL QQRRGGGGGV AADIGTGLAD ALTAPLDHKD

51 KGLKSLTLEA SIPQNGTLTL SAQGAEKTFK AGGKDNSLNT GKLKNDKISR

101 FDFVQKIEVD GQTITLASGE FQIYKQDHSA VVALRIEKIN NPDKIDSLIN

151 QRSFLVSDLG GEHTAFNQLP DGKAEYHGKA FSSDDADGKL TYTIDFAAKQ

201 GHGKIEHLKT PEQNVELASA ELKADEKSHA VILGDTRYGG EEKGTYRLAL

251 FGDRAQEIAG SATVKIGEKV HEIGIADKQ*
```

The following partial DNA sequence was identified in *N. meningitidis* <SEQ ID 2535>:

```
m741.seq
    1 GTGAATCGAA CTGCCTTCTG CTGCCTTTCT CTGACCACTG CCCTGATTCT

51 GACCGCCTGC AGCAGCGGAG GGGGTGGTGT CGCCGCCGAC ATCGGTGCGG

101 GGCTTGCCGA TGCACTAACC GCACCGCTCG ACCATAAAGA CAAAGGTTTG

151 CAGTCTTTGA CGCTGGATCA GTCCGTCAGG AAAAACGAGA AACTGAAGCT

201 GGCGGCACAA GGTGCGGAAA AAACTTATGG AAACGGTGAC AGCCTCAATA
```

```
251 CGGGCAAATT GAAGAACGAC AAGGTCAGCC GTTTCGACTT TATCCGCCAA

301 ATCGAAGTGG ACGGGCAGCT CATTACCTTG GAGAGTGGAG AGTTCCAAGT

351 ATACAAACAA AGCCATTCCG CCTTAACCGC CTTTCAGACC GAGCAAATAC

401 AAGATTCGGA GCATTCCGGG AAGATGGTTG CGAAACGCCA GTTCAGAATC

451 GGCGACATAG CGGGCGAACA TACATCTTTT GACAAGCTTC CCGAAGGCGG

501 CAGGGCGACA TATCGCGGGA CGGCGTTCGG TTCAGACGAT GCCGGCGGAA

551 AACTGACCTA CACCATAGAT TTCGCCGCCA AGCAGGGAAA CGGCAAAATC

601 GAACATTTGA ATCGCCAGA ACTCAATGTC GACCTGGCCG CCGCCGATAT

651 CAAGCCGGAT GGAAAACGCC ATGCCGTCAT CAGCGGTTCC GTCCTTTACA

701 ACCAAGCCGA AAAGGCAGT TACTCCCTCG GTATCTTTGG CGGAAAAGCC

751 CAGGAAGTTG CCGGCAGCGC GGAAGTGAAA ACCGTAAACG GCATACGCCA

801 TATCGGCCTT GCCGCCAAGC AATAA
```

This corresponds to the amino acid sequence <SEQ ID 2536; ORF 741>:

```
m741.pep
  1 VNRTAFCCLS LTTALILTAC SSGGGGVAAD IGAGLADALT APLDHKDKGL

51 QSLTLDQSVR KNEKLKLAAQ GAEKTYGNGD SLNTGKLKND KVSRFDFIRQ

101 IEVDGQLITL ESGEFQVYKQ SHSALTAFQT EQIQDSEHSG KMVAKRQFRI

151 GDIAGEHTSF DKLPEGGRAT YRGTAFGSDD AGGKLTYTID FAAKQGNGKI

201 EHLKSPELNV DLAAADIKPD GKRHAVISGS VLYNQAEKGS YSLGIFGGKA

251 QEVAGSAEVK TVNGIRHIGL AAKQ*
``` m741/2741 61.4% identity in 280 aa overlap

```
                  10          20        30         40         50
    m741.pep  VNRTAFCCLSLTT---ALILTACSSGGGGVAADIGAGLADALTAPLDHKDKGLQSLTLDQ
              ||||:||||||||    :    |   :||||||||||:||||||||||||||||:||||:
        g741  VNRTTFCCLSLTAGPDSDRLQQRRGGGGGVAADIGTGLADALTAPLDHKDKGLKSLTLEA
                   10        20        30        40        50        60

60         70         80         90        100       110
    m741.pep  SVRKNEKLKLAAQGAEKTY---GNGDSLNTGKLKNDKVSRFDFIRQIEVDGQLITLESGE
              |: :|   |  |:|||||||   |: :|||||||||||:|||||:|||||||:||:|||
        g741  SIPQNGTLTLSAQGAEKTFKAGGKDNSLNTGKLKNDKISRFDFVQKIEVDGQTITLASGE
                   70        80        90       100       110       120

120        130        140        150        160        170
    m741.pep  FQVYKQSHSALTAFQTEQIQDSEHSGKMVAKRQFRIGDIAGEHTSFDKLPEGGRATYRGT
              ||:|||:|||::|:|: |:|:: ::   :|:| ::|::|||||:||:|  ||:|   :|
        g741  FQIYKQDHSAVVALRIEKINNPDKIDSLINQRSFLVSDLGGEHTAFNQLPDG-KAEYHGK
                   130       140       150       160       170

180        190        200        210        220        230
    m741.pep  AFGSDDAGGKLTYTIDFAAKQGNGKIEHLKSPELNVDLAAADIKPDGKRHAVISGSVLYN
              ||:||||  ||||||||||||||:|||||:||  ||:||:|::|  |  ||||  |::  |:
        g741  AFSSDDADGKLTYTIDFAAKQGHGKIEHLKTPEQNVELASAELKADEKSHAVILGDTRYG
                   180       190       200       210       220       230

240        250        260        270
    m741.pep  QAEKGSYSLGIFGGKAQEVAGSAEVKTVNGIRHIGLAAKQX
                    |||: |::|| :||||||| ||  : :::||:| |||
        g741  GEEKGTYRLALFGDRAQEIAGSATVKIGEKVHEIGIADKQX
                   240       250       260       270       280
```

The following partial DNA sequence was identified in *N. meningitidis* <SEQ ID 2537>:

```
a741.seq
   1 GTGAACCGAA CTGCCTTCTG CTGCCTTTCT TTGACCGCCG CCCTGATTCT

51 GACCGCCTGC AGCAGCGGAG GCGGCGGTGT CGCCGCCGAC ATCGGCGCGG

101 TGCTTGCCGA TGCACTAACC GCACCGCTCG ACCATAAAGA CAAAAGTTTG

151 CAGTCTTTGA CGCTGGATCA GTCCGTCAGG AAAAACGAGA AACTGAAGCT

201 GGCGGCACAA GGTGCGGAAA AAACTTATGG AAACGGCGAC AGCCTCAATA

251 CGGGCAAATT GAAGAACGAC AAGGTCAGCC GCTTCGACTT TATCCGTCAA

301 ATCGAAGTGG ACGGGCAGCT CATTACCTTG GAGAGCGGAG AGTTCCAAGT

351 GTACAAACAA AGCCATTCCG CCTTAACCGC CCTTCAGACC GAGCAAGTAC

401 AAGATTCGGA GCATTCAGGG AAGATGGTTG CGAAACGCCA GTTCAGAATC

451 GGCGATATAG CGGGTGAACA TACATCTTTT GACAAGCTTC CCGAAGGCGG

501 CAGGGCGACA TATCGCGGGA CGGCATTCGG TTCAGACGAT GCCAGTGGAA

551 AACTGACCTA CACCATAGAT TTCGCCGCCA AGCAGGGACA CGGCAAAATC

601 GAACATTTGA AATCGCCAGA ACTCAATGTT GACCTGGCCG CCTCCGATAT

651 CAAGCCGGAT AAAAAACGCC ATGCCGTCAT CAGCGGTTCC GTCCTTTACA

701 ACCAAGCCGA GAAAGGCAGT TACTCTCTAG GCATCTTTGG CGGGCAAGCC

751 CAGGAAGTTG CCGGCAGCGC AGAAGTGGAA ACCGCAAACG GCATACGCCA

801 TATCGGTCTT GCCGCCAAGC AGTAA
```

This corresponds to the amino acid sequence <SEQ ID 2538; ORF 741.a>:

```
a741.pep
   1 VNRTAFCCLS LTAALILTAC SSGGGGVAAD IGAVLADALT APLDHKDKSL

51 QSLTLDQSVR KNEKLKLAAQ GAEKTYGNGD SLNTGKLKND KVSRFDFIRQ

101 IEVDGQLITL ESGEFQVYKQ SHSALTALQT EQVQDSEHSG KMVAKRQFRI

151 GDIAGEHTSF DKLPEGGRAT YRGTAFGSDD ASGKLTYTID FAAKQGHGKI

201 EHLKSPELNV DLAASDIKPD KKRHAVISGS VLYNQAEKGS YSLGIFGGQA

251 QEVAGSAEVE TANGIRHIGL AAKQ*
``` a741/m741 95.6% identity in 274 aa overlap

```
                    10        20        30        40        50        60
a741.pep    VNRTAFCCLSLTAALILTACSSGGGGVAADIGAVLADALTAPLDHKDKSLQSLTLDQSVR
            ||||||||||||:||||||||||||||||||||| ||||||||||||||:||||||||||
m741        VNRTAFCCLSLTTALILTACSSGGGGVAADIGAGLADALTAPLDHKDKGLQSLTLDQSVR
                    10        20        30        40        50        60

70        80        90       100       110       120
a741.pep    KNEKLKLAAQGAEKTYGNGDSLNTGKLKNDKVSRFDFIRQIEVDGQLITLESGEFQVYKQ
            ||||||||||||||||||||||||||||||||||||||||||||||||||||||||||||
m741        KNEKLKLAAQGAEKTYGNGDSLNTGKLKNDKVSRFDFIRQIEVDGQLITLESGEFQVYKQ
                    70        80        90       100       110       120

130       140       150       160       170       180
a741.pep    SHSALTALQTEQVQDSEHSGKMVAKRQFRIGDIAGEHTSFDKLPEGGRATYRGTAFGSDD
            |||||||:||||:|||||||||||||||||||||||||||||||||||||||||||||||
m741        SHSALTAFQTEQIQDSEHSGKMVAKRQFRIGDIAGEHTSFDKLPEGGRATYRGTAFGSDD
                   130       140       150       160       170       180

190       200       210       220       230       240
a741.pep    ASGKLTYTIDFAAKQGHGKIEHLKSPELNVDLAASDIKPDKKRHAVISGSVLYNQAEKGS
            |:||||||||||||||:|||||||||||||||||:||||| |||||||||||||||||||
m741        AGGKLTYTIDFAAKQGNGKIEHLKSPELNVDLAAADIKPDGKRHAVISGSVLYNQAEKGS
                   190       200       210       220       230       240
```

-continued

```
                 250         260         270
a741.pep  YSLGIFGGQAQEVAGSAEVETANGIRHIGLAAKQX
          ||||||||:||||||||||:|:|||||||||||||
m741      YSLGIFGGKAQEVAGSAEVKTVNGIRHIGLAAKQX
                 250        260        270
``` g742.seq not found yet
g742.pep not found yet

The following partial DNA sequence was identified in *N. meningitidis* <SEQ ID 2539>:

```
m742.seq
   1 ATGGTTTACG GCATTGCCGA AGCCGATGCG GGCGACAGCA GTGTGCTTAC
  51 TTTGGGCGGC ATGTATCAGA AGAGTAGGGA GGTTCCTGAT TTTTCGGGCA
 101 TTATTTTGCC CTGTGAAAAT CAGAAAACTG CCCCGTTCAG TTCAACGCCT
 151 GCCTGCAACC GGCCTTTGCA ACTGCCGCGC AACACTTATT TGGGGGAGGA
 201 TTGGTCGCGG TTAAGTGCCG ACAAATACAA CCTTTTCTCA GGATTCAAAC
 251 ATGTGTTTGA CAACGGTTGG CAGCTCAATG CCGAAGTGTC TTATACCAAG
 301 AATGAATCCG ATGCGAAGGT GGGGCAGTTT TTTCTGAAAA ACGAATATGC
 351 GGCGGGTTTG TCGGGTGAGG ATGCGGTAGG CTTTTTGACT GAAAAAAACG
 401 AAGTCATCCC GTTCGAGCCG AAAGATAAGG CATTGGAGAA ACTGAAAGCA
 451 TATCGTGATG AAACCGCCAA GGAATACCGG GAGCGCAAAG ACGATTTTGT
 501 TAAAAACCGT TTCGATAATA CTGCTTTCGA ACAGTATCGC AGCCGCCGTG
 551 CCGCAGAACG CAAAGCCGGT TTTGACAAGT GTATGAGTGA CCCTTTCGCG
 601 CTGGACTTTA TCTGTCAAGG TTCTTGGGGG GATCCGGGCG TTGATGCCGA
 651 CAAGGCGGAA TTTGTCGATA AAGCCCTTGC GAAGGAGGGC ATCTTTAATA
 701 ATGCGGCACA ACGTTTTCCA AACAGCCTGT ATGACTCTTC CTTTAATCGG
 751 AAGGCTACCG CCAACCGACG ATACAGTTAT ATGCCGTTGC GGCATACCAA
 801 AGACGACCGC CAATGGGGAA TTAAACTTGA CCTGACCGGC ACATATGGGC
 851 TGTTCGGGCG GGAGCATGAT TTCTTTGTCG GCTATGCCTA CGGTGATGAA
 901 AAGATACGTT CGGAATATCT AGAAATCTAC GAACGCCGCT ACAGAGTACG
 951 TCCGAATACG GGGGCAACGC ACGGCGTGTA TGCGGGAAGT TGTCAGGAGG
1001 AGCCGGACGG CGATTTGTCG TCTCCTTTGG TCAGGGGGCA TAAAGAACCC
1051 GATTGGCAGG CGTACGATGA AAAAGGCAAC CGTACCGTTT ATGCCGAAGA
1101 ATGCAGGAAC GCCAAGAAAA TAAAAACCGA GCCCAAGCTC GATGCCGAAG
1151 GCAAGCAGGT GTATTACTAT GACGAATACA GCGGCAGCCG GACACCGGTA
1201 TATGTCGATG TATATGAGCT GGACGAAAAA GGCAACAAGA TTCAGGAGAC
1251 CAATCCCGAC GGCACGCCTG CCTTTACCGG TTTTTCCGGT ACGGTGCCGG
1301 TTTGGAAAAC CGTCAAAGTG GCAGACGACC ATGTTCCTGC GCTGTATAAC
1351 TACGCCAAAT ACCTCAACAC CAACAAAACC CATTCGCTGA CTGCCAGCAC
1401 GCGTTTCAAC GTAACCGGCC GACTGCACCT TTTGGGCGGG CTGCACTACA
1451 CGCGCTATGA GACTTCGCAA ACCAAAGATA TGCCTGTCCG CTATGGGCAG
1501 CCGGCAAGCG ATTTTCAGAC GGCATCGAGC ATTAGGGCGG ATCAGGACCA
1551 TTACACGGCC AAGATGCAAG GTCATAAATT GACGCCCTAT GCAGGCATTA
1601 CCTATGACTT GACACCGCAA CAGAGTATTT ACGGAAGTTA TACCAAAATC
```

-continued

```
1651 TTCAAACAGC AGGATAATGT CGATGTCAGT GCCAAAACCG TTTTACCGCC

1701 TTTGGTCGGC ACAAACTATG AGGTAGGCTG GAAAGGCGCG TTCTTGCAAG

1751 GACGGCTGAA TGCTTCGTTC GCATTGTTTT ACCTCGAACA GAAAAACCGC

1801 ACGGTCGTCG ATTTCGGCTA TGTTCCCGGA GCAGGCGGCA AGCAGGGGTC

1851 GTTCCAAACC GTTGCCAAAC CGATAGGCAA AGTGGTCAGC AGGGGTGCGG

1901 AATTCGAGTT GTCGGGTGAG TTGAACGAAG ATTGGAAAGT CTTTGCGGGT

1951 TACACCTACA ACAAGAGCCG CTACAAAAAC GCCGCCGAAG TCAACGCCGA

2001 ACGCCTTGCC AAAAATTCCA GTGCAGACCC GTACAACTTC AGCAATTTCA

2051 CACCCGTGCA CATATTCCGT TTCGGAACGA GCTTCCATAT ACCGAATACG

2101 GGGCTGACCG TCGGCGGCGG CGTGTCCGCA CAAAGCGGCA CAAGCAGTCT

2151 GTATAACATC AGGCAGGGCG GCTACGGGCT GATAGACGGT TTCGTCCGTT

2201 ACGAATTGGG CAAACACGCC AAATTGAGCC TCATCGGTAC GAACTTAAAC

2251 GGACGCACTT ATTTTGAGAA CAACTACAAC CGTACGCGCG GCGCAAACAA

2301 CTTCTACGGA GAGCCGCGCA CTGTCAGCAT GAAACTGGAT TGGCAGTTTT

2351 AA
```

This corresponds to the amino acid sequence <SEQ ID 2540; ORF 742>:

```
m742.pep
    1MVYGIAEADA GDSSVLTLGG MYQKSREVPD FSGIILPCEN QKTAPFSSTP

51ACNRPLQLPR NTYLGEDWSR LSADKYNLFS GFKHVFDNGW QLNAEVSYTK

101NESDAKVGQF FLKNEYAAGL SGEDAVGFLT EKNEVIPFEP KDKALEKLKA

151YRDETAKEYR ERKDDFVKNR FDNTAFEQYR SRRAAERKAG FDKCMSDPFA

201LDFICQGSWG DPGVDADKAE FVDKALAKEG IFNNAAQRFP NSLYDSSFNR

251KATANRRYSY MPLRHTKDDR QWGIKLDLTG TYGLFGREHD FFVGYAYGDE

301KIRSEYLEIY ERRYRVRPNT GATHGVYAGS CQEEPDGDLS SPLVRGHKEP

351DWQAYDEKGN RTVYAEECRN AKKIKTEPKL DAEGKQVYYY DEYSGSRTPV

401YVDVYELDEK GNKIQETNPD GTPAFTGFSG TVPVWKTVKV ADDHVPALYN

451YAKYLNTNKT HSLTASTRFN VTGRLHLLGG LHYTRYETSQ TKDMPVRYGQ

501PASDFQTASS IRADQDHYTA KMQGHKLTPY AGITYDLTPQ QSIYGSYTKI

551FKQQDNVDVS AKTVLPPLVG TNYEVGWKGA FLQGRLNASF ALFYLEQKNR

601TVVDFGYVPG AGGKQGSFQT VAKPIGKVVS RGAEFELSGE LNEDWKVFAG

651YTYNKSRYKN AAEVNAERLA KNSSADPYNF SNFTPVHIFR FGTSFHIPNT

701GLTVGGGVSA QSGTSSLYNI RQGGYGLIDG FVRYELGKHA KLSLIGTNLN

751GRTYFENNYN RTRGANNFYG EPRTVSMKLD WQF*
```

The following partial DNA sequence was identified in *N. meningitidis* <SEQ ID 2541>:

```
a742.seq
    1   ATGGTTTACG GCATTGCCGA AGCCGATGCG GGCGACAGCA GTGTGCTTAC

51   TTTGGGCGGC ATGTATCAGA AGAGTAGGGA GGTTCCTGAT TTTTCGGGCA

101   TTATTTTGTC CTGTGAAAAT

-continued

```
 151 GCCTGCAACC GGCCTTTGCA ACTGCCGCGC AACACTTATT TGGGGGAGGA
 201 TTGGTCGCGG TTGAGTGCTG ACAAATACAA CCTTTTCTCA GGTTTCAAAC
 251 ATGTGTTTGA CAACGGTTGG CAGCTCAATG CCGAAGTGTC TTATACCAAG
 301 AATGAATCCG ATGCGAAGGT GGGGCAGTTT TTTCTGAAAA ACGAACATGC
 351 GGCGGGTTTG TCAGATGAGG ATGCGGTAGG CTTTTTGACC GAAAAAAACG
 401 AAGTCATCCC GTTCGAGCCG AAAGATAAGG CATTGGAGAA ACTGAAAGCA
 451 TATCGTGACG AAACCGCCAA GGAATACCGT GAGCGCAAAG ACGATTTTGT
 501 TAAAAACCGT TTCGATAATA CTGCTTTCGA GCAGTACCGC AGCCGCCGTG
 551 CCGCAGAACG CAAAGCCGGT TTTGACGAGT GTATGAGTGC CCCTTTTGCG
 601 CTGGACTTTA TCTGTCAAGG TTCTTGGGGG GATCCGGGTG TTGATGCCGA
 651 CAAGTCGGAA TTTGTCGATA AGCCCTTGC GAAGGAAGGC ATCTTTAATA
 701 ATGCGGCACA ACGTTTTCCA AACAGCCTGT ATGACTCTTC CTTTAATCGG
 751 AAGGCTACCG CCAACCGACG ATACAGTTAT ATGCCGTTGC GGCATACCAA
 801 AGACGACCGC CAATGGGGAA TTAAACTTGA CCTGACCGGC ACATATGGGC
 851 TGTTCGGGCG GGAGCATGAT TTCTTTGTCG GCTATGCCTA CGGCGATGAA
 901 AAGATACGTT CCGAATATCT GGAAATCTAC GAACGCCGCC ACAGAGTACG
 951 TCCGAATACA GGGGCAACGC ACGGCGTGTA TGCGGGAAGT TGTCAGGGGG
1001 AGCCGGACGG TGATTTGTCT TCTCCTTTGG TCAGGGGCA TAAAGAACCC
1051 GATTGGCAGG CGTACGATGA AAAAGGCAAC CGTACCGTTT ATGCCGAAGA
1101 ATGCAGGAAT GCCAAGAAAA TAAAAACCGA GCCCAAGCTC GATGCCGAAG
1151 GCAAGCAGGT GTATTACTAT GACGAATACA GCGGCAGCCG GACGCCAGTA
1201 TATGTCGATG TATATGAACT GGATGAAAAA GGCAATAAGA TTCAGGAGAC
1251 CAATCCCGAC GGCACGCCTG CCTTTACCGG TTTTTCCGGT ACGGTGCCGG
1301 TTTGGAAAAC CGTCAAAGTG GCCGACGACC ATGTTCCTGC GCTGTATAAC
1351 TACGCCAAAT ACCTCAACAC CAACAAAACC CATTCGCTGA CTGCCGGCAC
1401 GCGTTTCAAC GTAACCGGCC GACTGCATCT TTTGGGCGGG CTGCACTACA
1451 CGCGCTATGA AACCTCGCAA ACCAAAGATA TGCCTGTCCG CTATGGGCAG
1501 CCGGCAAGCG ATTTTCAGAC GGCATCGAGC ATTAAGGCGG ATCAGGACCA
1551 TTATACGGCC AAGATGCAAG GTCATAAATT GACGCCCTAT GCAGGCATTA
1601 CCTATGATTT GACACCGCAA CAGAGTATTT ACGGAAGTTA TACCAAAATC
1651 TTCAAACAGC AGGATAATGT CGATGTCAGT GCCAAAACCG TTTTACCGCC
1701 TTTGGTCGGC ACAAACTATG AGGTAGGCTG GAAAGGCGCG TTCTTGCAAG
1751 GACGGCTGAA TGCTTCGTTC GCATTGTTTT ACCTCGAACA GAAAAACCGC
1801 ACGGTCGTCG ATTTTGGCTA TGTTCCCGGA GCAGGCGGCA AGCAGGGGTC
1851 GTTCCAAACC GTTGCCAAAC CGATAGGCAA AGTGGTCAGC AGGGGTGCGG
1901 AATTCGAGTT GTCGGGTGAG TTGAACGAAG ATTGGAAAGT CTTTGCGGGT
1951 TACACCTACA ACAAGAGCCG CTACAAAAAC GCCGCCGAAG TCAACGCCGA
2001 ACGCCTCGCC AAAAACACAG GCGCAGACCC GTACAACTTC AGCAATTTCA
2051 CACCCGTGCA CATATTCCGT TTCGGAACGA GCTTCCATAT ACCGAATACG
2101 GGGCTGACCG TCGGCGGCGG CGTGTCCGCA CAAAGCGGCA CAAGCAGTCT
```

-continued

```
2151 GTATAACATC AGGCAGGGCG GCTACGGGCT GATAGACGGT TTCGTCCGTT

2201 ACGAATTGGG CAAACACGCT AAATTGAGCC TCATCGGTAC GAACTTAAAC

2251 GGACGCACTT ATTTTGAGAA CAACTACAAC CGTACGCGCG GCGCAAACAA

2301 CTTCTATGGA GAGCCGCGCA CTGTCAGCAT GAAACTGGAT TGGCAGTTTT

2351 AA
```

This corresponds to the amino acid sequence <SEQ ID 2542; ORF 742.a>:

```
a742.pep
  1 MVYGIAEADA GDSSVLTLGG MYQKSREVPD FSGIILSCEN QKTAPFSSTP

51 ACNRPLQLPR NTYLGEDWSR LSADKYNLFS GFKHVFDNGW QLNAEVSYTK

101 NESDAKVGQF FLKNEHAAGL SDEDAVGFLT EKNEVIPFEP KDKALEKLKA

151 YRDETAKEYR ERKDDFVKNR FDNTAFEQYR SRRAAERKAG FDECMSAPFA

201 LDFICQGSWG DPGVDADKSE FVDKALAKEG IFNNAAQRFP NSLYDSSFNR

251 KATANRRYSY MPLRHTKDDR QWGIKLDLTG TYGLFGREHD FFVGYAYGDE

301 KIRSEYLEIY ERRHRVRPNT GATHGVYAGS CQGEPDGDLS SPLVRGHKEP

351 DWQAYDEKGN RTVYAEECRN AKKIKTEPKL DAEGKQVYYY DEYSGSRTPV

401 YVDVYELDEK GNKIQETNPD GTPAFTGFSG TVPVWKTVKV ADDHVPALYN

451 YAKYLNTNKT HSLTAGTRFN VTGRLHLLGG LHYTRYETSQ TKDMPVRYGQ

501 PASDFQTASS IKADQDHYTA KMQGHKLTPY AGITYDLTPQ QSIYGSYTKI

551 FKQQDNVDVS AKTVLPPLVG TNYEVGWKGA FLQGRLNASF ALFYLEQKNR

601 TVVDFGYVPG AGGKQGSFQT VAKPIGKVVS RGAEFELSGE LNEDWKVFAG

651 YTYNKSRYKN AAEVNAERLA KNTGADPYNF SNFTPVHIFR FGTSFHIPNT

701 GLTVGGGVSA QSGTSSLYNI RQGGYGLIDG FVRYELGKHA KLSLIGTNLN

751 GRTYFENNYN RTRGANNFYG EPRTVSMKLD WQF*
``` a742/m742 98.5% identity in 783 aa overlap

```
                  10         20         30         40         50         60
     a742.pep MVYGIAEADAGDSSVLTLGGMYQKSREVPDFSGIILSCENQKTAPFSSTPACNRPLQLPR
             |||||||||||||||||||||||||||||||||||| ||||||||||||||||||||||
         m742 MVYGIAEADAGDSSVLTLGGMYQKSREVPDFSGIILPCENQKTAPFSSTPACNRPLQLPR
                  10         20         30         40         50         60

70         80         90        100        110        120
     a742.pep NTYLGEDWSRLSADKYNLFSGFKHVFDNGWQLNAEVSYTKNESDAKVGQFFLKNEHAAGL
             ||||||||||||||||||||||||||||||||||||||||||||||||||||||:||||
         m742 NTYLGEDWSRLSADKYNLFSGFKHVFDNGWQLNAEVSYTKNESDAKVGQFFLKNEYAAGL
                  70         80         90        100        110        120

130        140        150        160        170        180
     a742.pep SDEDAVGFLTEKNEVIPFEPKDKALEKLKAYRDETAKEYRERKDDFVKNRFDNTAFEQYR
             | ||||||||||||||||||||||||||||||||||||||||||||||||||||||||
         m742 SGEDAVGFLTEKNEVIPFEPKDKALEKLKAYRDETAKEYRERKDDFVKNRFDNTAFEQYR
                 130        140        150        160        170        180

190        200        210        220        230        240
     a742.pep SRRAAERKAGFDECMSAPFALDFICQGSWGDPGVDADKSEFVDKALAKEGIFNNAAQRFP
             |||||||||||:|||:|||||||||||||||||||||:||||||||||||||||||||
         m742 SRRAAERKAGFDKCMSDPFALDFICQGSWGDPGVDADKAEFVDKALAKEGIFNNAAQRFP
                 190        200        210        220        230        240

250        260        270        280        290        300
     a742.pep NSLYDSSFNRKATANRRYSYMPLRHTKDDRQWGIKLDLTGTYGLFGREHDFFVGYAYGDE
             ||||||||||||||||||||||||||||||||||||||||||||||||||||||||||
         m742 NSLYDSSFNRKATANRRYSYMPLRHTKDDRQWGIKLDLTGTYGLFGREHDFFVGYAYGDE
                 250        260        270        280        290        300
```

```
             310       320       330       340       350       360
a742.pep  KIRSEYLEIYERRHRVRPNTGATHGVYAGSCQGEPDGDLSSPLVRGHKEPDWQAYDEKGN
          |||||||||||:||||||||||||||||||| ||||||||||||||||||||||||||||
m742      KIRSEYLEIYERRYVRPNTGATHGVYAGSCQEEPDGDLSSPLVRGHKEPDWQAYDEKGN
             310       320       330       340       350       360

370       380       390       400       410       420
a742.pep  RTVYAEECRNAKKIKTEPKLDAEGKQVYYYDEYSGSRTPVYVDVYELDEKGNKIQETNPD
          ||||||||||||||||||||||||||||||||||||||||||||||||||||||||||||
m742      RTVYAEECRNAKKIKTEPKLDAEGKQVYYYDEYSGSRTPVYVDVYELDEKGNKIQETNPD
             370       380       390       400       410       420

430       440       450       460       470       480
a742.pep  GTPAFTGFSGTVPVWKTVKVADDHVPALYNYAKYLNTNKTHSLTAGTRFNVTGRLHLLGG
          |||||||||||||||||||||||||||||||||||||||||||:||||||||||||||||
m742      GTPAFTGFSGTVPVWKTVKVADDHVPALYNYAKYLNTNKTHSLTASTRFNVTGRLHLLGG
             430       440       450       460       470       480

490       500       510       520       530       540
a742.pep  LHYTRYETSQTKDMPVRYGQPASDFQTASSIKADQDHYTAKMQGHKLTPYAGITYDLTPQ
          |||||||||||||||||||||||||||||||:||||||||||||||||||||||||||||
m742      LHYTRYETSQTKDMPVRYGQPASDFQTASSIRADQDHYTAKMQGHKLTPYAGITYDLTPQ
             490       500       510       520       530       540

550       560       570       580       590       600
a742.pep  QSIYGSYTKIFKQQDNVDVSAKTVLPPLVGTNYEVGWKGAFLQGRLNASFALFYLEQKNR
          ||||||||||||||||||||||||||||||||||||||||||||||||||||||||||||
m742      QSIYGSYTKIFKQQDNVDVSAKTVLPPLVGTNYEVGWKGAFLQGRLNASFALFYLEQKNR
             550       560       570       580       590       600

610       620       630       640       650       660
a742.pep  TVVDFGYVPGAGGKQGSFQTVAKPIGKVVSRGAEFELSGELNEDWKVFAGYTYNKSRYKN
          ||||||||||||||||||||||||||||||||||||||||||||||||||||||||||||
m742      TVVDFGYVPGAGGKQGSFQTVAKPIGKVVSRGAEFELSGELNEDWKVFAGYTYNKSRYKN
             610       620       630       640       650       660

670       680       690       700       710       720
a742.pep  AAEVNAERLAKNTGADPYNFSNFTPVHIFRFGTSFHIPNTGLTVGGGVSAQSGTSSLYNI
          |||||||||||::|||||||||||||||||||||||||||||||||||||||||||||||
m742      AAEVNAERLAKNSSADPYNFSNFTPVHIFRFGTSFHIPNTGLTVGGGVSAQSGTSSLYNI
             670       680       690       700       710       720

730       740       750       760       770       780
a742.pep  RQGGYGLIDGFVRYELGKHAKLSLIGTNLNGRTYFENNYNRTRGANNFYGEPRTVSMKLD
          ||||||||||||||||||||||||||||||||||||||||||||||||||||||||||||
m742      RQGGYGLIDGFVRYELGKHAKLSLIGTNLNGRTYFENNYNRTRGANNFYGEPRTVSMKLD
             730       740       750       760       770       780 a742.pep  WQFX
          ||||
m742      WQFX a742/p25184
sp|P25184|PUPA_PSEPU    FERRIC-PSEUDOBACTIN    358    RECEPTOR    PRECURSOR
>gi|94923|pir||S15169
ferric-pseudobactin receptor precursor-Pseudomonas putida >gi|45723 (x56605)
pseudobactin uptake protein [pseudomonas putida]Length = 819
 Score = 152 bits (381), Expect = 6e-36
 Identities = 110/356 (30%), Positives = 170/356 (46%), Gaps = 55/356 (15%)

Query: 436 KTVKVADDHV-PALYNYAKYLNTNKTHSLTAGTRFNVTGRLHLLGGLHYTRYETSQTKDM 494
           +T K  DD + P +  +Y +N+     +RFN+T LHL+ G   + Y
Sbjct: 511 QTPKPGDDEIIPGI----QYNISNRQSGYFVASRFNLTDDLHLILGARASNYRFDYAL-- 564

Query: 495 PVRYGQPASDFQTASSIKADQDHYTAKMQGHKLTPYAGITYDLTPQQSIYGSYTKIFKQQ 554
             R G    +   +        ++      +TPYAGI YDLT +QS+Y SYT IFK Q
Sbjct: 565 -WRIGNEPAPYKM--------------VERGVVTPYAGIVYDLTNEQSVYASYTDIFKPQ 609

Query: 555 DNVDVSAKTVLPPLVGTNYEVGWKGAFLQGRLNASFALFYLEQKNRTVVDFGYVPGAGGK 614
           +NVD++ K  L P VG NYE+GWKG FL+GRLNA+  AL+  ++  N       VP +GG
Sbjct: 610 NNVDITGKP-LDPEVGKNYELGWKGEFLEGRLNANIALYMVKRDNLAESTNEVVPDSGGL 668

Query: 615 QGSFQTVAKPIGKVVSRGAEFELSGELNEDWKVFAGYTYNKSRYKNAAEVNAERLAKNTG 674
            S      + +  ++G + ELSGE+    W VF GY++ ++
Sbjct: 669 IAS-----RAVDGAETKGVDVELSGEVLPGWNVFTGYSHTRTE----------------D 707

Query: 675 ADPYNFSNFTPVHIFRFGTSFHIPN--TGLTVGGGVSAQSGTS---SLYN--IRQGGYGL 727
            AD     P+  FRF ++ +P         LT+GGGV+   S    + YN   + Q  Y +
Sbjct: 708 ADGKRLTPQLPMDTFRFWNTYRLPGEWEKLTLGGGVNWNSKSTLNFARYNSHVTQDDTFV 767

Query: 728 IDGFVRYELGKHAKLSLIGTNLNGRTYFENNYNRTRGANNFYGEPRTVSMKLDWQF 783
                 RY + +     +L  N+   +Y    Y        G+    YG PR  ++ L + F
Sbjct: 768 TSLMARYRINESLAATLNVNNIFDKKY----YAGMAGSYGHYGAPRNATVTLRYDF 819 g743.seq not found yet g743.pep not found yet
```

The following partial DNA sequence was identified in *N. meningitidis* <SEQ ID 2543>:

```
m743.seq
    1 ATGAATCAAA ATCATTTTTC ACTTAAAATT CTGACCGTTA TGCTGTTATC

51 GGCTTACGGT GGTTCTTTTG CAGACGGTGT TGTGCCTGTT TCAGACGGCA

101 ATACCGTCAG TCTGGATACG GTCAATGTAC GCGGCTCTCA TGCTTTGTTG

151 GGCAAGACCG AAAAGACCCG TTCTTATACG ATAGATCGGA TGTCCACCGC

201 CACAGGTATG AGGATTGCGG GCAAGGATAC GCCGCAGTCG GTCAGCGTCA

251 TCACGCGCAG CCGCCTTGAC GATAAGGCGG TGCATACGCT TGAAGAGGCA

301 ATGAAAAACA CGACGGGTGT CAACGTTGTG CGCGATTCAG GCTTGCAGAC

351 GCGGTTTTTG TCACGCGGTT TCTATATTGA TCAGATTGGT GAAGACGGTA

401 TGACCGTCAA TGTTGCAGGC CGTTCGGGAT ATACGGCGAA AATCGACGTG

451 TCTCCGAGTA CCGATTTGGC GGTTTATGAC CATATTGAAG TTGTACGGGG

501 TGCAACGGGG TTGACCCAAT CCAATTCAGA GCCGGGAGGA ACCGTCAATT

551 TGATCCGTAA GTGA
```

This corresponds to the amino acid sequence <SEQ ID 2544; ORF 743>:

```
m743.pep
    1 MNQNHFSLKI LTVMLLSAYG GSFADGVVPV SDGNTVSLDT VNVRGSHALL

51 GKTEKTRSYT IDRMSTATGM RIAGKDTPQS VSVITRSRLD DKAVHTLEEA

101 MKNTTGVNVV RDSGLQTRFL SRGFYIDQIG EDGMTVNVAG RSGYTAKIDV

151 SPSTDLAVYD HIEVVRGATG LTQSNSEPGG TVNLIRK*
```

The following partial DNA sequence was identified in *N. meningitidis* <SEQ ID 2545>:

```
a743.seq
    1 ATGAATCAAA ATCATTTTTC ACTTAAAATT CTGACCGTTA TGCTGTTATC

51 GGCTTACGGT GGTTCTTTTG CAGACGGTGT TGTGCCTGTT TCAGACGGCA

101 ATACCGTCAG TTTGGATACG GTCAATGTAC GCGGCTCTCA TGCTCTGTCG

151 GGCAAGACCG AGAAGACCCG TTCTTATACG ATAGATCGGA TGTCCACCGC

201 CACAGGTATG AGGATTGCGG GCAAGGATAC GCCGCAGTCG GTCAGCGTCA

251 TCACGCGCAG CCGCCTTGAC GATAAGGCGG TGCATACGCT TGAAGAGGCA

301 ATGAAAAACA CGACGGGTGT CAACGTTGTG CGCGATTCAG GCTTGCAGAC

351 GCGGTTTTTG TCACGCGGTT TCTATATTGA TCAGATTGGT GAAGACGGTA

401 TTACCGTCAA TGTTGCAGGC CGTTCGGGAT ATACGGCGAA AATCGACGTG

451 TCTCCGAGTA CCGATTTGGC GGTTTATGAC CATATTGAAG TTGTACGGGG

501 TGCAACGGGG TTGACCCAAT CCAATTCAGA GCCGGGTGGA ACCGTCAATT

551 TGATCCGTAA GCGA
```

This corresponds to the amino acid sequence <SEQ ID 2546; ORF 743.a>:

```
a743.pep
    1 MNQNHFSLKI LTVMLLSAYG GSFADGVVPV SDGNTVSLDT VNVRGSHALS
```

```
 51 GKTEKTRSYT IDRMSTATGM RIAGKDTPQS VSVITRSRLD DKAVHTLEEA

101 MKNTTGVNVV RDSGLQTRFL SRGFYIDQIG EDGITVNVAG RSGYTAKIDV

151 SPSTDLAVYD HIEVVRGATG LTQSNSEPGG TVNLIRKR
``` a743/m743 98.9% identity in 187 aa overlap

```
                    10         20         30         40         50         60
    a743.pep  MNQNHFSLKILTVMLLSAYGGSFADGVVPVSDGNTVSLDTVNVRGSHALSGKTEKTRSYT
              ||||||||||||||||||||||||||||||||||||||||||||| ||||||||||||
    m743      MNQNHFSLKILTVMLLSAYGGSFADGVVPVSDGNTVSLDTVNVRGSHALLGKTEKTRSYT
                    10         20         30         40         50         60

70         80         90        100        110        120
    a743.pep  IDRMSTATGMRIAGKDTPQSVSVITRSRLDDKAVHTLEEAMKNTTGVNVVRDSGLQTRFL
              ||||||||||||||||||||||||||||||||||||||||||||||||||||||||||||
    m743      IDRMSTATGMRIAGKDTPQSVSVITRSRLDDKAVHTLEEAMKNTTGVNVVRDSGLQTRFL
                    70         80         90        100        110        120

130        140        150        160        170        180
    a743.pep  SRGFYIDQIGEDGITVNVAGRSGYTAKIDVSPSTDLAVYDHIEVVRGATGLTQSNSEPGG
              ||||||||||||:|||||||||||||||||||||||||||||||||||||||||||||||
    m743      SRGFYIDQIGEDGMTVNVAGRSGYTAKIDVSPSTDLAVYDHIEVVRGATGLTQSNSEPGG
                   130        140        150        160        170        180 a743.pep  TVNLIRKR
              |||||||
    m743      TVNLIRKX
    g744 .seq not found yet
    g744 .pep not found yet
```

The following partial DNA sequence was identified in *N. meningitidis* <SEQ ID 2547>:

```
m744.seq
   1 ATGAAACCGT TAAAAACATT AGAATTTGGA TTTGTGGATG CTGCAAACTA

51 CAGAAGAAGA GAAAATAAAG ATTTATTTAA CCGAATATTT GTAAAAGGAG

101 AATATTTGGA TGAATTATGT GAACCAAATA TTTCGTTTTT AATCGGAGAA

151 AAGGGAACTG GAAAGACAGC ATATGCTGTT TATTTAACTA ATAACTTCTA

201 TAAAAACATA CATGCCACTA CTAAGTTTGT TCGTGAAACC GATTATTCAA

251 AATTTATTCA GCTAAAGAAA GCAAGACACT TAACTGTTTC AGATTTTACA

301 AGTATTTGGA AAGTCATTTT ATATCTGTTG ATATCAAATC AAATCAAATG

351 TAAAGAAAAC GGAATATTAT CTTCAATATT TAATAAATTT AAAGCCTTAG

401 ATGAGGCTAT AAATGAATAT TATTATGGCG CTTTTGATCC GGAAATTGTA

451 CAAGCAATAA CTTTAATAGA AAATTCAAAA GAAGCTGCGG AAATGATTTT

501 TGGAAAATTT GTTAAACTAG GTGAAGAGGA ATCCCAACAA ATAACTTTTA

551 CAGAAAGTAA ATTCCAAGCA AATTTAGGTT TTATTGAAAG AAAATTTAAA

601 GATGCTTTAT CTCAGTTAAA GCTAAAAGAT AATCATATTT GTTTATTGA

651 TGGGATAGAT ATTAGACCAT CACAGATTCC ATTTGATGAA TATCATGAGT

701 GTGTAAAAGG TCTTGCTAAC GCCATATGGA TGTTAAATAA TGATATCTTC

751 CCTTCCATTA AAGATAGTAA GGGAAGGATG AGAGTTGTGT TATTGATTAG

801 ACCTGATATC TTTGATTCAT TAGGTTTACA AAATCAAAAT ACCAAACTTC

851 AAGATAATTC AGTATTTTTA GACTGGAGGA CGGATTATAA ATCTTATAGA

901 AGTTCAAAGA TTTTTGGCGT TTTTGATCAT CTTTTGAGAA CCCAGCAAGA

951 AAAACAAGAT AGTTTAGAAA AAGGCAACTC ATGGGATTAT TATTTTCCAT

1001 GGAATGCTCC TAATTTACAT GATGAGTATA AAAATTTAAC TTCATTTATT
```

-continued

```
1051 AGCTTCCTAA GAAAATCGTA TTATCGACCT CGCGATATTC TTCAGATGCT

1101 TACTTTGCTA CAAAAAAATA AGAAAAGTAA GGAAGATTAT GTCGTAGCAG

1151 AAGATTTTGA TAATACTTCT TTTCAAAGAG AATACTCGAT ATATTTACTT

1201 GGTGAAATCA AAGATCATCT TTTGTTTTAT TATAGTCAAA GTGATTATCA

1251 AAATTTCCTG AAATTTTTTG AATTTTTAAA CGGGAAAGAT AGATTTAAAT

1301 ATAGTGATTT TTTAAAAGCA TTTGAACGTT TGAAAAAGCA CTTACAAACA

1351 ACATCAGTGG AAATACCTAA ATTTATGAGT ACTGCTAATG AGTTTTTGCA

1401 ATTTTTATTT GACTTGAATG TTATTGCTTA TTTAGATAAC CCAGAAGATG

1451 AAACGAAACC ATATATCCAT TGGTGCTTTA AAGATAGAAA TTATGCAAAT

1501 ATTTCTCCTA AAATAAAAAC TGAAACTGAA TATTTAATAT TTTCAGGATT

1551 ATCAAAAGCC CTTGATGTTG GTACTCCATT TAAGAACAAA CAGTAA
```

This corresponds to the amino acid sequence <SEQ ID 2548; ORF 744>:

```
m744.pep
  1 MKPLKTLEFG FVDAANYRRR ENKDLFNRIF VKGEYLDELC EPNISFLIGE

51 KGTGKTAYAV YLTNNFYKNI HATTKFVRET DYSKFIQLKK ARHLTVSDFT

101 SIWKVILYLL ISNQIKCKEN GILSSIFNKF KALDEAINEY YYGAFDPEIV

151 QAITLIENSK EAAEMIFGKF VKLGEEESQQ ITFTESKFQA NLGFIERKFK

201 DALSQLKLKD NHILFIDGID IRPSQIPFDE YHECVKGLAN AIWMLNNDIF

251 PSIKDSKGRM RVVLLIRPDI FDSLGLQNQN TKLQDNSVFL DWRTDYKSYR

301 SSKIFGVFDH LLRTQQEKQD SLEKGNSWDY YFPWNAPNLH DEYKNLTSFI

351 SFLRKSYYRP RDILQMLTLL QKNKKSKEDY VVAEDFDNTS FQREYSIYLL

401 GEIKDHLLFY YSQSDYQNFL KFFEFLNGKD RFKYSDFLKA FERLKKHLQT

451 TSVEIPKFMS TANEFLQFLF DLNVIAYLDN PEDETKPYIH WCFKDRNYAN

501 ISPKIKTETE YLIFSGLSKA LDVGTPFKNK Q* g745.seq not found yet
g745.pep not found yet
```

The following partial DNA sequence was identified in *N. meningitidis* <SEQ ID 2549>:

```
m745.seq
  1 ATGTTTTGGC AACTGACCGT TGTTTCAGTA ACCGCCGTCA TTGCACTGGG

51 GACAATATTC ATCAATAAGA AAACTTCAAA GCAAAAGGCG ACATTAGATG

101 TTATTTTGAA TGATTACCAA GATGCACAAT TTGTAGAAGC CGACAATCAT

151 ATTTCGCCTT ATATTCGCGG CACGGCAGTT GACGACAACA ACGCGCGGAT

201 CGACCTGTAT GAAATTTATC AAAATAAGGG CGGACAATGG GAAAAAGAGA

251 GAGGGCATTT ACTTACCGTA ATCAATCGGC ACGAGTTTTA TGCGTGCGCA

301 ATCAACTCGG GAGTATTGGA TGAGGATTTG TTTAAACGGC TGCATTGCAC

351 CAACTTCATA AAATTGTGGA ATGCAGTTTC GCCTCTTGTT ATGAAAATAC

401 GCGAAGAAGA ACGCAAAGAC ACAATATTTA GAGAGTTGGA AATTTGGTT

451 GCATTATGGA AAGCAAACCC CCTAAAGGCA TCTGATTTGT GA
```

This corresponds to the amino acid sequence <SEQ ID 2550; ORF 745>:

```
m745.pep
   1 MFWQLTVVSV TAVIALGTIF INKKTSKQKA TLDVILNDYQ DAQFVEADNH

51 ISPYIRGTAV DDNNARIDLY EIYQNKGGQW EKERGHLLTV INRHEFYACA

101 INSGVLDEDL FKRLHCTNFI KLWNAVSPLV MKIREEERKD TIFRELEILV

151 ALWKANPLKA SDL* a745.seq not found yet
a745.pep not found yet
```

The following partial DNA sequence was identified in *N. gonorrhoeae* <SEQ ID 2551>:

```
g746.seq
    1 ATGTCCGAAA ACAAACAAAA CGAAGTCCTG ACCGGTTACG AACAGCTGAA

51 ACGGCGCAAC CGCCGCCGCC TCGTAACGGC AAGCTCCCTG GTTGCCGCCT

101 CCTGCATCCT GCTGGCAGCC GCACTCAGTT CCGATCCTGC CGACAGCAAT

151 CCCGCACCGC AGGCCGGCGA AACCGGCGCA ACGGAAAGCC AAACGGCAAA

201 CACGGCACAA ACCCCTGCCT TGAAATCCGC CGCCGAAAAC GGGGAAACCG

251 CCGCCGACAA ACCGCAGGAC TTGGCAGGCG AAGACAAGCC TTCTGCCGCC

301 GACAGCGAAA TCAGCGAGCC TGAAAACGTA GGCGCGCCGC TGGTGCTGAT

351 TAACGACCGG CTCGAAGACA GCAACATCAA AGGTTTGGAA GAATCCGAGA

401 AACTGCAACA GGCAGAAACC GCCAAAACCG AACCGAAGCA GGCAAAACAA

451 CGCGCTGCCG AAAAAGTGTC GGCAACTGCC GACAGTACGG ATACGGTAGC

501 GGTTGAAAAA CCGAAACGCA CTGCCGAACC CAAACCGCAA AAAGCGGAAC

551 GCACTGCCGA AGCCAAGCCC AAAGCCAAAG AAACCAAAAC CGCCGAAAAA

601 GTTGCCGACA AACCGAAAAC TGCTGCCGAA AAAACCAAAC CGGATACGGC

651 AAAATCCGAC AGCGCGGTAA AGAAGCGAA AAAAGCCGAC AAGGCTGAAG

701 GCAAAAAGAC AGCCGAAAAA GACCGTTCGG ACGGCAAAAA ACACGAAACG

751 GCGCAAAAAA CCGACAAAGC GGACAAAACC AAAACCGCCG AGAAGGAAAA

801 ATCCGGCAAG GCGGGCAAAA AAGCCGCCAT TCAGGCAGGT TATGCCGAAA

851 AAGAACGCGC CTTGAGCCTC CAGCGCAAAA TGAAGGCGGC GGGTATCGAT

901 TCGACCATCA CCGAAATCAT GACCGACAAC GGCAAAGTTT ACCGCGTCAA

951 ATCAAGCAAC TATAAAAACG CAAGGGATGC CGAACGCGAT TTGAACAAAC

1001 TGCGCGTGCA CGGCATCGCC GGCCAGGTAA CGAATGAATA G
```

This corresponds to the amino acid sequence <SEQ ID 2552; ORF 746.ng>:

```
g746.pep
   1 MSENKQNEVL TGYEQLKRRN RRRLVTASSL VAASCILLAA ALSSDPADSN

51 PAPQAGETGA TESQTANTAQ TPALKSAAEN GETAADKPQD LAGEDKPSAA

101 DSEISEPENV GAPLVLINDR LEDSNIKGLE ESEKLQQAET AKTEPKQAKQ

151 RAAEKVSATA DSTDTVAVEK PKRTAEPKPQ KAERTAEAKP KAKETKTAEK

201 VADKPKTAAE KTKPDTAKSD SAVKEAKKAD KAEGKKTAEK DRSDGKKHET
```

-continued
```
251 AQKTDKADKT KTAEKEKSGK AGKKAAIQAG YAEKERALSL QRKMKAAGID

301 STITEIMTDN GKVYRVKSSN YKNARDAERD LNKLRVHGIA GQVTNE*
```

The following partial DNA sequence was identified in *N. meningitidis* <SEQ ID 2553>:

```
m746.seq
   1 ATGTCCGAAA ACAAACAAAA CGAAGTCCTG AGCGGTTACG AACAACTCAA

51 ACGGCGCAAC CGCCGCCGCC TCGTAACGGC AAGTTGCCTG GTTGCCGCCT

101 CCTGCATCCT GCTGGCAGCC GCCCTCAGTT CCGGCCCTGC CGAACAGACT

151 GCCGGCGAAA CAAGCGGCGT AGAAAACAAA GCGGCAGGTG CGGCACAAAC

201 CCCTGCCTTG AAATCCGCCG CCGACAAACC GCAGGACTTG GCAGGCGAAG

251 ACAAGCCTTC TGCCGCCGAC AGCGAAATCA GCGAGCCTGA AAACGTAGGC

301 GCGCCGCTGG TGCTGATTAA CGAGCGCCTC GAAGACAGCA ACATCAAAGG

351 TTTGGAAGCA TCCGAGAAAC TGCAACAGGC AGAAACCGCC AAAACCGCAC

401 CGAAGCAGGC AAAACAACGC GCTGCCGAAA AAGTGCCGGC AACTGCCGAC

451 AGTACGGATA CGGTAGCGGT TGAAAAACCG AAACGCACTG CCGAAACAAA

501 ACCGCAAAAA GCGGAACGCA CTGCCAAAGC CAAGCCCAAA GCCAAAGAAA

551 CCAAAACCGC CGAAAAAGTT GCCGACAAAC CGAAAACTGC CGCCGAAAAA

601 ACCAAACCGG ATACGGCAAA ATCCGACAGC GCGGTAAAAG AAGCGAAAAA

651 AGCCGACAAG GCTGAAAGCA AAAAAACAGC CGAAAAAGAC CGTTCGGACG

701 GCAAAAAACA CGAAACGGCA CAAAAAACCG ACAAAGCGGA CAAGACCAAA

751 ACCGCCGAGA AGGAAAAATC CGGTAAAAAA GCCGCCATTC AGGCAGGTTA

801 TGCCGAAAAA GAACGCGCCT TAAGCCTCCA GCGCAAAATG AAGGCGGCGG

851 GTATCGATTC GACCATCACC GAAATTATGA CCGACAACGG CAAAGTTTAC

901 CGCGTCAAAT CAAGCAACTA TAAAAACGCA AGGGATGCCG AACGCGATTT

951 GAACAAATTG CGCGTACACG GTATCGCCGG TCAGGTAACG AATGAATAG
```

This corresponds to the amino acid sequence <SEQ ID 2554; ORF 746>:

```
m746.pep
   1 MSENKQNEVL SGYEQLKRRN RRRLVTASCL VAASCILLAA ALSSGPAEQT

51 AGETSGVENK AAGAAQTPAL KSAADKPQDL AGEDKPSAAD SEISEPENVG

101 APLVLINERL EDSNIKGLEA SEKLQQAETA KTAPKQAKQR AAEKVPATAD

151 STDTVAVEKP KRTAETKPQK AERTAKAKPK AKETKTAEKV ADKPKTAAEK

201 TKPDTAKSDS AVKEAKKADK AESKKTAEKD RSDGKKHETA QKTDKADKTK

251 TAEKEKSGKK AAIQAGYAEK ERALSLQRKM KAAGIDSTIT EIMTDNGKVY

301 RVKSSNYKNA RDAERDLNKL RVHGIAGQVT NE*
```

Computer analysis of this amino acid sequence gave the following results:
Homology with a Predicted ORF from *N. gonorrhoeae*
ORF 746 shows 89.9% identity over a 346 aa overlap with a predicted ORF (ORF 746) from *N. gonorrhoeae*:

```
m746/g746  89.9% identity in 346 aa overlap 10        20        30        40        50
   m746.pep  MSENKQNEVLSGYEQLKRRNRRRLVTASCLVAASCILLAAALSSGPAEQT----AGETSG
             ||||||||||:||||||||||||||||:||||||||||||||| ||:::    ||||::
   g746      MSENKQNEVLTGYEQLKRRNRRRLVTASSLVAASCILLAAALSSDPADSNPAPQAGETGA
                    10        20        30        40        50        60

60        70        80        90       100       109
   m746.pep  VENKAAGAAQTPALKSAA-------DKPQDLAGEDKPSAADSEISEPENVGAPLVLINER
             :|::::|::|||||||||       ||||||||||||||||||||||||||||||||:|
   g746      TESQTANTAQTPALKSAAENGETAADKPQDLAGEDKPSAADSEISEPENVGAPLVLINDR
                    70        80        90       100       110       120

110       120       130       140       150       160       169
   m746.pep  LEDSNIKGLEASEKLQQAETAKTAPKQAKQRAAEKVPATADSTDTVAVEKPKRTAETKPQ
             |||||||||| ||||||||||||| ||||||||||||| ||||||||||||||||| ||
   g746      LEDSNIKGLEESEKLQQAETAKTEPKQAKQRAAEKVSATADSTDTVAVEKPKRTAEPKPQ
                   130       140       150       160       170       180

170       180       190       200       210       220       229
   m746.pep  KAERTAKAKPKAKETKTAEKVADKPKTAAEKTKPDTAKSDSAVKEAKKADKAESKKTAEK
             ||||||:|||||||||||||||||||||||||||||||||||||||||||||:||||||
   g746      KAERTAEAKPKAKETKTAEKVADKPKTAAEKTKPDTAKSDSAVKEAKKADKAEGKKTAEK
                   190       200       210       220       230       240

230       240       250       260       270       280
   m746.pep  DRSDGKKHETAQKTDKADKTKTAEKEKSGK---KAAIQAGYAEKERALSLQRKMKAAGID
             |||||||||||||||||||||||||||||   ||||||||||||||||||||||||||||
   g746      DRSDGKKHETAQKTDKADKTKTAEKEKSGKAGKKAAIQAGYAEKERALSLQRKMKAAGID
                   250       260       270       280       290       300

DRSDGKKHETAQKTDKADKTKTAEKEKSGKAGKKAAIQAGYAEKERALSLQRKMKAAGID
                   290       300       310       320       330
   m746.pep  STITEIMTDNGKVYRVKSSNYKNARDAERDLNKLRVHGIAGQVTNEX
             |||||||||||||||||||||||||||||||||||||||||||||||
   g746      STITEIMTDNGKVYRVKSSNYKNARDAERDLNKLRVHGIAGQVTNEX
                   310       320       330       340
```

The following partial DNA sequence was identified in *N. meningitidis* <SEQ ID 2555>:

```
a746.seq
   1 ATGTCCGAAA ACAAACAAAA CGAAGTCCTG AGCGGTTACG AACAACTCAA

51 ACGGCGCAAC CGCCGCCGCC TCGTAACGGC AAGTTGCCTG GTTGCCGCCT

101 CCTGCATCCT GCTGGCAGCC GCCCTCAGTT CCGGCCCTGC CGAACAGACT

151 GCCGGCGAAA CAAGCGGCGT AGAAAACAAA GCGGCAGGTG CGGCACAAAC

201 CCCTGCCTTG AAATCCGCCG CCGACAAACC GCAGGACTTG GCAGGCGAAG

251 ACAAGCCTTC TGCCGCCGAC AGCGAAATCA GCGAGCCTGA AAACGTAGGC

301 GCGCCGCTGG TGCTGATTAA CGACCGCCTC GAAGACAGCA ACATCAAAGG

351 TTTGGAAGCA TCCGAGAAAC TGCAACAGGC AGAAACCGCC AAAACCGCAC

401 CGAAGCAGGC AAAACAACGC GCTGCCGAAA AGTGCCGGC AACTGCCGAC

451 AGTACGGATA CGGTAGCGGT TGAAAAACCG AAACGCACTG CCGAAACAAA

501 ACCGCAAAAA GCGGAACGCA CTGCCAAAGC CAAGCCCAAA GCCAAAGAAA

551 CCAAAACCGC CGAAAAGTT GCCGACAAAC CGAAAACTGC CGCCGAAAAA

601 ACCAAACCGG ATACGGCAAA ATCCGACAGC GCGGTAAAAG AAGCGAAAAA

651 AGCCGACAAG GCTGAAAGCA AAAAAACAGC CGAAAAAGAC CGTTCGGACG

701 GCAAAAAACA CGAAACGGCA CAAAAAACCG ACAAAGCGGA CAAGACCAAA

751 ACCGCCGAGA AGGAAAAATC CGGTAAAAAA GCCGCCATTC AGGCAGGTTA
```

```
-continued
801 TGCCGAAAAA GAACGCGCCT TAAGCCTCCA GCGCAAAATG AAGGCGGCGG

851 GTATCGATTC GACCATCACC GAAATTATGA CCGACAACGG CAAAGTTTAC

901 CGCGTCAAAT CAAGCAACTA TAAAAACGCA AGGGATGCCG AACGCGATTT

951 GAACAAATTG CGCGTACACG GTATCGCCGG TCAGGTAACG AATGAATAA
```

This corresponds to the amino acid sequence <SEQ ID 2556; ORF 746.a>:

```
a746.pep
  1 MSENKQNEVL SGYEQLKRRN RRRLVTASCL VAASCILLAA ALSSGPAEQT

51 AGETSGVENK AAGAAQTPAL KSAADKPQDL AGEDKPSAAD SEISEPENVG

101 APLVLINDRL EDSNIKGLEA SEKLQQAETA KTAPKQAKQR AAEKVPATAD

151 STDTVAVEKP KRTAETKPQK AERTAKAKPK AKETKTAEKV ADKPKTAAEK

201 TKPDTAKSDS AVKEAKKADK AESKKTAEKD RSDGKKHETA QKTDKADKTK

251 TAEKEKSGKK AAIQAGYAEK ERALSLQRKM KAAGIDSTIT EIMTDNGKVY

301 RVKSSNYKNA RDAERDLNKL RVHGIAGQVT NE*
```

Computer analysis of this amino acid sequence gave the following results:
Homology with a Predicted ORF from *N. meningitidis*
ORF 746 shows 99.7% identity over a 332 aa overlap with a predicted ORF (ORF 746) from *N. meningitidis*:

```
   a746/m746;  99.7% identity in 332 aa overlap 10         20         30         40         50         60
     a746.pep   MSENKQNEVLSGYEQLKRRNRRRLVTASCLVAASCILLAAALSSGPAEQTAGETSGVENK
                ||||||||||||||||||||||||||||||||||||||||||||||||||||||||||||
     m746       MSENKQNEVLSGYEQLKRRNRRRLVTASCLVAASCILLAAALSSGPAEQTAGETSGVENK
                    10         20         30         40         50         60

70         80         90        100        110        120
     a746.pep   AAGAAQTPALKSAADKPQDLAGEDKPSAADSEISEPENVGAPLVLINDRLEDSNIKGLEA
                |||||||||||||||||||||||||||||||||||||||||||||||:||||||||||||
     m746       AAGAAQTPALKSAADKPQDLAGEDKPSAADSEISEPENVGAPLVLINERLEDSNIKGLEA
                    70         80         90        100        110        120

130        140        150        160        170        180
     a746.pep   SEKLQQAETAKTAPKQAKQRAAEKVPATADSTDTVAVEKPKRTAETKPQKAERTAKAKPK
                ||||||||||||||||||||||||||||||||||||||||||||||||||||||||||||
     m746       SEKLQQAETAKTAPKQAKQRAAEKVPATADSTDTVAVEKPKRTAETKPQKAERTAKAKPK
                   130        140        150        160        170        180

190        200        210        220        230        240
     a746.pep   AKETKTAEKVADKPKTAAEKTKPDTAKSDSAVKEAKKADKAESKKTAEKDRSDGKKHETA
                ||||||||||||||||||||||||||||||||||||||||||||||||||||||||||||
     m746       AKETKTAEKVADKPKTAAEKTKPDTAKSDSAVKEAKKADKAESKKTAEKDRSDGKKHETA
                   190        200        210        220        230        240

250        260        270        280        290        300
     a746.pep   QKTDKADKTKTAEKEKSGKKAAIQAGYAEKERALSLQRKMKAAGIDSTITEIMTDNGKVY
                ||||||||||||||||||||||||||||||||||||||||||||||||||||||||||||
     m746       QKTDKADKTKTAEKEKSGKKAAIQAGYAEKERALSLQRKMKAAGIDSTITEIMTDNGKVY
                   250        260        270        280        290        300

310        320        330
     a746.pep   RVKSSNYKNARDAERDLNKLRVHGIAGQVTNEX
                |||||||||||||||||||||||||||||||||
     m746       RVKSSNYKNARDAERDLNKLRVHGIAGQVTNEX
                   310        320        330 g747.seq not found yet g747.pep not found yet
```

The following partial DNA sequence was identified in *N. meningitidis* <SEQ ID 2557>:

```
m747.seq
    1 CTGACCCCTT GGGCGGATGC ATATGCAGAT TTGCGCGGCA AAACCAAAGT

51 GATGACGACC CAGATGGGTG CTTCCCGCGA TGTCAGCAAA AGCGCCAAAG

101 GTTGGAGTGT CGGTATCGGT CTGAATGTAG GCAAACAGTT GACCGACAGC

151 GTCGGTCTCG AGTTTGATCC ATACTACCGT CACAAAACAA TCTACAAACC

201 CCGTGAGATT GTCTTGGACG GTGACAAAAC CAAAATGGGC CGCTCCAAAT

251 CCAACGAGTA CGGCTTCCGC GTAGCCGCAA CGTTCTATAG TCAATTAAAA

301 TCAAAATAG
```

This corresponds to the amino acid sequence <SEQ ID 2558; ORF 747>:

```
m747.pep
    1 LTPWADAYAD LRGKTKVMTT QMGASRDVSK SAKGWSVGIG LNVGKQLTDS

51 VGLEFDPYYR HKTIYKPREI VLDGDKTKMG RSKSNEYGFR VAATFYSQLK

101 SK*
```

The following partial DNA sequence was identified in *N. meningitidis* <SEQ ID 2559>:

```
a747.seq
    1 CTAACCCCTT GGGCGGATGC ATATGCAGAT TTGCGCGGCA AAACCAAAGT

51 GATGACGACC CAGATGTGTG CTTCCCGCGA TGTCAGCAAA AGCGCCAAAG

101 GTTGGAGTGT CGGTATCGGT CTGAATGTAG GCAAACAGTT GACCGACAGC

151 GTCGGTCTCG AGTTTGATCC ATACTACCGT CACAAAACAA TCTGCAAACC

201 CCGTGAGATT GTTTTGGACG GCGACAAAAC CAAAATGGGC CGCTCCAAAT

251 CCAACGAGTA CGGCTTCCGC GTAACCGCAA CGTTCTATAG TCAATTAAAA

301 TCAAAGTAG
```

This corresponds to the amino acid sequence <SEQ ID 2560; ORF 747.a>:

```
a747.pep
    1 LTPWADAYAD LRGKTKVMTT QMCASRDVSK SAKGWSVGIG LNVGKQLTDS

51 VGLEFDPYYR HKTICKPREI VLDGDKTKMG RSKSNEYGFR VTATFYSQLK

101 SK*
```

Computer analysis of this amino acid sequence gave the following results:

Homology with a Predicted ORF from *N. meningitidis*

ORF 747 shows 97.1% identity over a 102 aa overlap with a predicted ORF (ORF 746) from *N. meningitidis*:

```
a747/m747     97.1% identity in 102 aa overlap 10        20        30        40        50        60
a747.pep      LTPWADAYADLRGKTKVMTTQMCASRDVSKSAKGWSVGIGLNVGKQLTDSVGLEFDPYYR
              |||||||||||||||||||||| |||||||||||||||||||||||||||||||||||||||
m747          LTPWADAYADLRGKTKVMTTQMGASRDVSKSAKGWSVGIGLNVGKQLTDSVGLEFDPYYR
                      10        20        30        40        50        60
```

```
                        70         80         90        100
a747.pep    HKTICKPREIVLDGDKTKMGRSKSNEYGFRVTATFYSQLKSKX
            ||||  ||||||||||||||||||||||||||||:||||||||
m747        HKTIYKPREIVLDGDKTKMGRSKSNEYGFRVAATFYSQLKSKX
                        70         80         90        100
a747/m80195
gi|150271 (M80195) outer membrane protein [Neisseria meningitidis] Length = 272
 Score = 59.3 bits (141), Expect = 6e-09
 Identities = 29/99 (29%), Positives = 51/99 (51%), Gaps = 4/99 (4%)

Query: 1    LTPWADAYADLRGKTKVMTTQMCASRDVSKSAKGWSVGIGLNVGKQLTDSVGLEFDPYYR 60
            + PW++     DL  + K+ T    +D+++   GW  G+G N+GK+L +S  +E P+Y+
Sbjct: 174  INPWSEVKFDLNSRYKLNTGVTNLKKDINQKTNGWGFGLGANIGKKLGESASIEAGPFYK 233

Query: 61   HKTICKPREIVL---DGD-KTKMGRSKSNEYGFRVTATF 95
            +T + E +   GD    + ++   EYG RV  F
Sbjct: 234  QRTYKESGEFSVTTKSGDVSLTIPKTSIREYGLRVGIKF 272
```

The following partial DNA sequence was identified in *N. gonorrhoeae* <SEQ ID 2561>:

```
g748.seq
   1 ATGAGTCAAA ACCAACCCGC ACAACCGACC AAACGCAATC TGTTCAAAAC

51 CGCCCTTGCC GTCGGCGCAA TCGGCGCAAT CGGAGGTTAT TTCGGCGGCA

101 AAAAACAGGG CGAAACCGCC GAACGCACCG CCGAAAGCCA ACACTCGCCC

151 CAAGCCTATC CCTGCTACGG CGAACATCAG GCAGGTATCG TTACGCCGCG

201 GCAGGCGTTT TCCATTATGT GCGCCTTCGA CGTAACGCG CAAAGTGCCA

251 AGCAGCTGGA AAACCTGTTC CGCACACTGA CCGCCCGCAT CGAGTTTCTC

301 ACCCAAGGCG GAGAATACCA AGACGGCGAC GACAAACTCC CGTCAGCCGG

351 CAGCGGCATT TGGGTAAAG CCTTCAACCC CGACGGATTG ACCGTTACCG

401 TGGGGGTGGG CAGCAGCCTG TTTGACGGCC GGTTCGGACT CAAAGACAAA

451 AAAACGGTTC ATTTGCAGGA AATGCGCGAC TTCCCCAACG ATAAGCTGCA

501 AAAAAGCTGG TGCGACGGCG ATTTGAGCCT GCAAATCTGC GCCTTCACCC

551 CCGAAACCTG CCAAACCGCC CTGCGCGACA TCATCAAACA CACCGCCCAA

601 ACCGCCGTCA TCCGCTGGAG TATCGACGGG TGGCAGCCTA AATCCGAACC

651 CGGCGCGATG GCGGCGCGCA ACCTGTTGGG CTTCCGAGAC GGCACGGGCA

701 ACCCCAAGGT TTCCGATCCC AAAACCGCCG ACGAGGTTTT ATGGACGGGC

751 GTGGCCGCCA ACAGCCTCGA CGAACCGGAG TGGGCGAAAA ACGGCAGCTA

801 TCAGGCAGTC CGCCTTATCC GCCGCTTTGT CGAGTTTTGG GACAGGACGC

851 CGCTTCAAGA GCAAACCGAC ATTTTCGGGC GGCGAAAATA CAGCGGGGCG

901 CCGATGGACG GCAAAAAGA AGCCGACCAA CCGGATTTCG CCAAAGACCC

951 CGAGGGTGAT ATCACGCCCA AGACAGCCA TATGCGCCTG GCGAATCCGC

1001 GCGATCCCGA ATTCCTCAAA AACACTGCC TCTTCCGCCG CGCCTACAGC

1051 TATTCTCGCG GACCCGCCTC AAGCGGACAG CTTGATGTCG GGCTGGTGTT

1101 CGTCTGCTAT CAGGCAAATC TTGCCGACGG TTTCATCTTC GTGCAAAACC

1151 TCCTCAACGG CGAACCGCTG GAAGAATACA TCAGCCCCTT CGGCGGCGGC

1201 TATTTCTTCG TCTTGCCCGG CGTGGGAAAA GGCGGATTCT TGGGACAAGG

1251 GCTGCCGGGC GTATAA
```

This corresponds to the amino acid sequence <SEQ ID 2562; ORF 748.ng>:

```
g748.pep
   1 MSQNQPAQPT KRNLFKTALA VGAIGAIGGY FGGKKQGETA ERTAESQHSP

51 QAYPCYGEHQ AGIVTPRQAF SIMCAFDVTA QSAKQLENLF RTLTARIEFL

101 TQGGEYQDGD DKLPSAGSGI LGKAFNPDGL TVTVGVGSSL FDGRFGLKDK

151 KTVHLQEMRD FPNDKLQKSW CDGDLSLQIC AFTPETCQTA LRDIIKHTAQ

201 TAVIRWSIDG WQPKSEPGAM AARNLLGFRD GTGNPKVSDP KTADEVLWTG

251 VAANSLDEPE WAKNGSYQAV RLIRRFVEFW DRTPLQEQTD IFGRRKYSGA

301 PMDGKKEADQ PDFAKDPEGD ITPKDSHMRL ANPRDPEFLK KHCLFRRAYS

351 YSRGPASSGQ LDVGLVFVCY QANLADGFIF VQNLLNGEPL EEYISPFGGG

401 YFFVLPGVGK GGFLGQGLPG V*
```

The following partial DNA sequence was identified in *N. meningitidis* <SEQ ID 2563>:

```
m748.seq
   1 ATGAGCAAAA AACAACCCGC ACAACCGACC AGGCGCACTC TTTTTAAAAC

51 CGCGATCGCA GCCGGAGCAG TCGGCGCAAT CGGAGGTTAT CTCGGCGGCA

101 AAAAACAGGG CGAAACCGCC GAACGCACCG CCGAAAGCCA ACACTCGCCC

151 CAAGCCTATC CCTGCTACGG CGAACATCAG GCAGGCATCG TTACGCCGCA

201 GCAGGCGTTT TCGATTATGT GCGCCTTCGA CGTAACCGCG CAAAGTGCCA

251 AGCAGCTGGA AAACCTGTTC CGCACGCTGA CCGCCCGCAT CGAGTTTCTC

301 ACCCAAGGCG GCGAATACCA AGACGGCGAC GACAAACTTC CGCCAGCCGG

351 CAGCGGCATT TTGGGCAAAG CCTTCAACCC CGACGGGTTG ACCGTTACCG

401 TGGGGGTGGG CAGCAGCCTG TTTGACGGCC GGTTCGGACT CAAAGACAAA

451 AAACCGATTC ATTTGCAGGA AATGCGCGAC TTCTCCAACG ATAAGCTGCA

501 AAAAAGCTGG TGCGACGGCG ATTTGAGCCT GCAAATCTGT GCCTTCACCC

551 CCGAAACCTG CCAAGCCGCC CTGCGCGACA TCATCAAACA CACCGTCCAA

601 ACCGCCGTTA TCCGTTGGAG TATCGACGGG TGGCAGCCCA AATCCGAACC

651 CGGCGCGATG GCGGCGCGCA ACCTGTTGGG CTTCAGGGAC GGCACGGGCA

701 ACCCCAAAGT TTCCGATCCC AAAACTGCCG ACGAGGTTTT GTGGACGGGG

751 GTGGCCGCCA ACAGCCTCGA CGAACCGGAG TGGGCGAAAA ACGGCAGCTA

801 TCAGGCAGTC CGCCTTATCC GCCACTTTGT CGAGTTTTGG GACAGGACGC

851 CGCTTCAAGA GCAAACCGAC ATTTTCGGGC GGCGCAAATA CAGCGGTGCG

901 CCGATGGACG GCAAAAAAGA AGCCGACCAA CCGGATTTTG CCAAAGACCC

951 CGAGGGTGAT ATCACGCCCA AAGACAGCCA TATGCGCCTG GCGAATCCGC

1001 GCGATCCCGA ATTCCTCAAA AACACCGCC TCTTCCGCCG CGCCTACAGC

1051 TATTCGCGCG GACTCGCCTC AAGCGGACAG CTTGATGTCG GGCTGGTGTT

1101 CGTCTGCTAT CAGGCAAACC TTGCCGACGG ATTCATCTTC GTGCAAAACC

1151 TCCTCAACGG CGAACCGCTG GAAGAATACA TCAGCCCCTT CGGCGGCGGC

1201 TATTTCTTCG TCTTGCCCGG CGTGGAAAAA GGCGGCTTTT TGGGGCAAGG

1251 GCTGCTGGGC GTATAA
```

This corresponds to the amino acid sequence <SEQ ID 2564; ORF 748>:

```
m748.pep
   1 MSKKQPAQPT RRTLFKTAIA AGAVGAIGGY LGGKKQGETA ERTAESQHSP

51 QAYPCYGEHQ AGIVTPQQAF SIMCAFDVTA QSAKQLENLF RTLTARIEFL

101 TQGGEYQDGD DKLPPAGSGI LGKAFNPDGL TVTVGVGSSL FDGRFGLKDK

151 KPIHLQEMRD FSNDKLQKSW CDGDLSLQIC AFTPETCQAA LRDIIKHTVQ

201 TAVIRWSIDG WQPKSEPGAM AARNLLGFRD GTGNPKVSDP KTADEVLWTG

251 VAANSLDEPE WAKNGSYQAV RLIRHFVEFW DRTPLQEQTD IFGRRKYSGA

301 PMDGKKEADQ PDFAKDPEGD ITPKDSHIRL ANPRDPEFLK KHRLFRRAYS

351 YSRGLASSGQ LDVGLVFVCY QANLADGFIF VQNLLNGEPL EEYISPFGGG

401 YFFVLPGVEK GGFLGQGLLG V*
```

Computer analysis of this amino acid sequence gave the following results:

Homology with a Predicted ORF from *N. gonorrhoeae*

ORF 748 shows 95.0% identity over a 421 aa overlap with a predicted ORF (ORF 748) from *N. gonorrhoeae*

```
    m748/g748     95.0% identity in 421 aa overlap 10         20         30         40         50         60
       m748.pep    MSKKQPAQPTRRTLFKTAIAAGAVGAIGGYLGGKKQGETAERTAESQHSPQAYPCYGEHQ
                   ||::||||||:||||||:|||||||:|||||||||||||||||||||||
       g748        MSQNQPAQPTKRNLFKTALAVGAIGAIGGYFGGKKQGETAERTAESQHSPQAYPCYGEHQ
                       10         20         30         40         50         60

70         80         90        100        110        120
       m748.pep    AGIVTPQQAFSIMCAFDVTAQSAKQLENLFRTLTARIEFLTQGGEYQDGDDKLPPAGSGI
                   ||||||:||||||||||||||||||||||||||||||||||||||||||||| |||||
       g748        AGIVTPRQAFSIMCAFDVTAQSAKQLENLFRTLTARIEFLTQGGEYQDGDDKLPSAGSGI
                       70         80         90        100        110        120

130        140        150        160        170        180
       m748.pep    LGKAFNPDGLTVTVGVGSSLFDGRFGLKDKKPIHLQEMRDFSNDKLQKSWCDGDLSLQIC
                   |||||||||||||||||||||||||||||| :||||||||| |||||||||||||||||
       g748        LGKAFNPDGLTVTVGVGSSLFDGRFGLKDKKTVHLQEMRDFPNDKLQKSWCDGDLSLQIC
                      130        140        150        160        170        180

190        200        210        220        230        240
       m748.pep    AFTPETCQAALRDIIKHTVQTAVIRWSIDGWQPKSEPGAMAARNLLGFRDGTGNPKVSDP
                   ||||||||:|||||||||:||||||||||||||||||||||||||||||||||||||||
       g748        AFTPETCQTALRDIIKHTAQTAVIRWSIDGWQPKSEPGAMAARNLLGFRDGTGNPKVSDP
                      190        200        210        220        230        240

250        260        270        280        290        300
       m748.pep    KTADEVLWTGVAANSLDEPEWAKNGSYQAVRLIRHFVEFWDRTPLQEQTDIFGRRKYSGA
                   ||||||||||||||||||||||||||||||||||:|||||||||||||||||||||||
       g748        KTADEVLWTGVAANSLDEPEWAKNGSYQAVRLIRRFVEFWDRTPLQEQTDIFGRRKYSGA
                      250        260        270        280        290        300

310        320        330        340        350        360
       m748.pep    PMDGKKEADQPDFAKDPEGDITPKDSHIRLANPRDPEFLKKHRLFRRAYSYSRGLASSGQ
                   |||||||||||||||||||||||||||:||||||||||||||| |||||||||| ||||
       g748        PMDGKKEADQPDFAKDPEGDITPKDSHMRLANPRDPEFLKKHCLFRRAYSYSRGPASSGQ
                      310        320        330        340        350        360

370        380        390        400        410        420
       m748.pep    LDVGLVFVSYQANLADGFIFVQNLLNGEPLEEYISPFGGGYFFVLPGVEKGGFLGQGLLG
                   ||||||||:|||||||||||||||||||||||||||||| |||||||||:||||||| |
       g748        LDVGLVFVCYQANLADGFIFVQNLLNGEPLEEYISPFGGGTFFVLPGVGKGGFLGQGLPG
                      370        380        390        400        410        420 m748.pep    VX
                   ||
       g748        VX
```

The following partial DNA sequence was identified in *N. meningitidis* <SEQ ID 2565>:

```
a748.seq
   1  ATGAGCAAAA ACCAACCCGC ACAACCGACC AGGCGCACTC TTTTTAAAAC
  51  CGCGATCGCA GCTGGAGCAG TCGGCGCAAT CGGAGGTTAT CTCGGCGGCA
 101  AAAAACGGGG CGAAACCGCC GAACGCACCG CCGAAAGCCA ACACTCGCCC
 151  CAAGCCTATC CCTGCTACGG CGAACATCAG GCAGGCATCG TTACGCCGCA
 201  GCAGGCGTTT TCGATTATGT GCGCCTTCGA CGTAACCGCG CAAAGTGCCA
 251  AGCAGCTGGA AAACCTGTTC CGCACGCTGA CCGCCCGCAT CGAGTTTCTC
 301  ACCCAAGGCG GCGAATACCA AGACGGCGAC GACAAACTTC CGCCAGCCGG
 351  CAGCGGCATT TTGGGCAAAG CCTTCAACCC CGACGGGTTG ACCGTTACCG
 401  TGGGGGTGGG CAGCAGCCTG TTTGACGGCC GGTTCGGACT CAAAGACAAA
 451  AAACCGATTC ATTTGCAGGA AATGCGCGAC TTCTCCAACG ATAAGCTGCA
 501  AAAAAGCTGG TGCGACGGCG ATTTGAGCCT GCAAATCTGT GCCTTCACCC
 551  CCGAAACCTG CCAAGCCGCC CTGCGCGACA TCATCAAACA CACCGTCCAA
 601  ACCGCCGTTA TCCGCTGGAG TATCGACGGG TGGCAGCCTA AATCCGAACC
 651  CGGCGCGATG GCGGCGCGCA ACCTGTTGGG CTTCCGCGAC GGCACGGGCA
 701  ACCCCAAAGT TTCCGACCCC AAAACTGCCG ACGAGGTTTT GTGGACGGGG
 751  GTGGCCGCCA ACAGCCTCGA CGAACCGGAG TGGGCGAAAA ACGGCAGCTA
 801  TCAGGCAGTC CGCCTTATCC GCCACTTTGT TGAGTTTTGG GACAGGACGC
 851  CGCTTCAAGA GCAAACCGAC ATTTTCGGGC GGCGCAAATA CAGCGGCGCG
 901  CCGATGGACG GCAAAAAAGA AGCCGACCAA CCGGATTTTG CCAAAGACCC
 951  CGAGGGGAAT ACCACGCCCA AAGACAGCCA TATACGCCTG GCGAATCCGC
1001  GCGATCCCGA GTTCCTTAAA AAACACCGCC TCTTCCGCCG CGCCTACAGC
1051  TATTCGCGCG GACTCGCCTC AAGCGGACAG CTTGATGTCG GGCTGGTGTT
1101  CGTCTGCTAT CAGGCAAACC TTGCCGACGG ATTCATCTTC GTGCAAAACC
1151  TCCTCAACGG CGAACCGCTG GAAGAATACA TCAGCCCCTT CGGCGGCGGC
1201  TATTTCTTCG TCTTGCCCGG CGTGGAAAAA GGCGGCTTTT TGGGGCAAGG
1251  GCTGCTGGGC GTATAA
```

This corresponds to the amino acid sequence <SEQ ID 2566; ORF 748.a>:

```
a748.pep
  1  MSKNQPAQPT RRTLFKTAIA AGAVGAIGGY LGGKKRGETA ERTAESQHSP
 51  QAYPCYGEHQ AGIVTPQQAF SIMCAFDVTA QSAKQLENLF RTLTARIEFL
101  TQGGEYQDGD DKLPPAGSGI LGKAFNPDGL TVTVGVGSSL FDGRFGLKDK
151  KPIHLQEMRD FSNDKLQKSW CDGDLSLQIC AFTPETCQAA LRDIIKHTVQ
201  TAVIRWSIDG WQPKSEPGAM AARNLLGFRD GTGNPKVSDP KTADEVLWTG
251  VAANSLDEPE WAKNGSYQAV RLIRHFVEFW DRTPLQEQTD IFGRRKYSGA
301  PMDGKKEADQ PDFAKDPEGN TTPKDSHIRL ANPRDPEFLK KHRLFRRAYS
351  YSRGLASSGQ LDVGLVFVCY QANLADGFIF VQNLLNGEPL EEYISPFGGG
401  YFFVLPGVEK GGFLGQGLLG V*
```

Computer analysis of this amino acid sequence gave the following results:
Homology with a Predicted ORF from *N. meningitidis*
ORF 748 shows 99.0% identity over a 421 aa overlap with a predicted ORF (ORF 748) from *N. meningitidis*:

```
a748/m748    99.0% identity in 421 aa overlap 10        20        30        40        50        60
a748.pep    MSKNQPAQPTRRTLFKTAIAAGAVGAIGGYLGGKKRGETAERTAESQHSPQAYPCYGEHQ
            |||:||||||||||||||||||||||||||||||:|||||||||||||||||||||||||
m748        MSKKQPAQPTRRTLFKTAIAAGAVGAIGGYLGGKKQGETAERTAESQHSPQAYPCYGEHQ
                    10        20        30        40        50        60

70        80        90       100       110       120
a748.pep    AGIVTPQQAFSIMCAFDVTAQSAKQLENLFRTLTARIEFLTQGGEYQDGDDKLPPAGSGI
            ||||||||||||||||||||||||||||||||||||||||||||||||||||||||||||
m748        AGIVTPQQAFSIMCAFDVTAQSAKQLENLFRTLTARIEFLTQGGEYQDGDDKLPPAGSGI
                    70        80        90       100       110       120

130       140       150       160       170       180
a748.pep    LGKAFNPDGLTVTVGVGSSLFDGRFGLKDKKPIHLQEMEDFSNDKLQKSWCDGDLSLQIC
            |||||||||||||||||||||||||||||||||||||:||||||||||||||||||||||
m748        LGKAFNPDGLTVTVGVGSSLFDGRFGLKDKKPIHLQEMRDFSNDKLQKSWCDGDLSLQIC
                   130       140       150       160       170       180

190       200       210       220       230       240
a748.pep    AFTPETCQAALRDIIKHTVQTAVIRWSIDGWQPKSEPGAMAARNLLGFRDGTGNPKVSDP
            ||||||||||||||||||||||||||||||||||||||||||||||||||||||||||||
m748        AFTPETCQAALRDIIKHTVQTAVIRWSIDGWQPKSEPGAMAARNLLGFRDGTGNPKVSDP
                   190       200       210       220       230       240

250       260       270       280       290       300
a748.pep    KTADEVLWTGVAANSLDEPEWAKNGSYQAVRLIRHFVEFWDRTPLQEQTDIFGRRKYSGA
            ||||||||||||||||||||||||||||||||||||||||||||||||||||||||||||
m748        KTADEVLWTGVAANSLDEPEWAKNGSYQAVRLIRHFVEFWDRTPLQEQTDIFGRRKYSGA
                   250       260       270       280       290       300

310       320       330       340       350       360
a748.pep    PMDGKKEADQPDFAKDPEGNTTPKDSHIRLANPRDPEFLKKHRLFRRAYSYSRGLASSGQ
            |||||||||||||||||||:||||||||||||||||||||||||||||||||||||||||
m748        PMDGKKEADQPDFAKDPEGDITPKDSHIRLANPRDPEFLKKHRLFRRAYSYSRGLASSGQ
                   310       320       330       340       350       360

370       380       390       400       410       420
a748.pep    LDVGLVFVCYQANLADGFIFVQNLLNGEPLEEYISPFGGGYFFVLPGVEKGGFLGQGLLG
            ||||||||||||||||||||||||||||||||||||||||||||||||||||||||||||
m748        LDVGLVFVCYQANLADGFIFVQNLLNGEPLEEYISPFGGGYFFVLPGVEKGGFLGQGLLG
                   370       380       390       400       410       420 a748.pep    VX
            ||
m748        VX
```

The following partial DNA sequence was identified in *N. gonorrhoeae* <SEQ ID 2567>:

```
g749.seq
   1  ATGAGAAAAT TCAATTTGAC CGCATTGTCC GTGATGCTTG CCTTGGGTTT

51  GACCGCGTGC CAGCCGCCGG AGGCGGAGAA AGCCGCGCCG GCCGCGTCCG

101  GTGAGACCCA ATCCGCCAAC GAAGGCGGTT CGGTCGGTAT CGCCGTCAAC

151  GACAATGCCT GCGAACCGAT GAATCTGACC GTGCCGAGCG ACAGGTTGT

201  GTTCAATATT AAAAACAACA GCGGCCGCAA GCTCGAATGG GAAATCCTGA

251  AGGGCGTGAT GGTGGTGGAC GAACGCGAAA ATATCGCCCC GGGGCTTTCC

301  GACAAAATGA CCGTAAccct GCTGCCGGGC GAATACGAAA TGACCTGCGG

351  CCTTTTGACC AATCCGCGCG GCAAGCTGGT GGTAGCCGAC AGCGGCTTTA

401  AAGACACCGC CAACGAAGCG GATTTGGAAA AACTGCCCCA ACCGCTCGCC

451  GACTATAAAG CCTACGTTCA AGGCGAGGTT AAAGAGCTGG CGGCGAAAAC

501  CAAAACCTTT ACCGAAGCCG TCAAAGCAGG CGACATTGAA AAGGCGAAAT

551  CCCTGTTTGC CGCCACCCGC GTCCATTACG AACGCATCGA ACCGATTGCC
```

```
-continued
 601 GAGCTTTTCA GCGAACTCGA CCCCGTCATC GATGCGTGTG AAGACGACTT

651 CAAAGACGGT GCGAAAGATG CCGGGTTTAC CGGCTTCCAC CGTATCGAAC

701 ACGCCCTTTG GGTGGAAAAA GACGTATCCG GCGTGAAGGA AACCGCGGCC

751 AAACTGATGA CCGATGTCGA AGCCCTGCAA AAAGAAATCG ACGCATTGGC

801 GttccctCCG GGCAAAGTGG TCGGCGGCGC GTCCGAACTG ATTGAAGAAG

851 CGGCGGGCAG TAAAATCAGC GGCGAAGAAG ACCgttaCAG CCACACCGAT

901 TTGAGCGACT TCCAAGCTAA TGCGGACGGA TCTAAAAAAA TCGTCGATTT

951 GTTCCGTCCG TTGATTGAGG CCAAAAACAA AGCCTTGTTG GAAAAAACCG

1001 ATACCAACTT CAAACAGGTC AACGAAATTC TGGCGAAATA CCGCACCAAA

1051 GACGGTTTTG AAACCTACGA CAAGCTGAGC GAAGCCGACC GCAAAGCATT

1101 ACAGGCTCCT ATTAACGCGC TTGCCGAAGA CCTTGCCCAA CTTCGCGGCA

1151 TACTCGGCTT GAAATAA
```

This corresponds to the amino acid sequence <SEQ ID 2568; ORF 749.ng>:

```
g749.pep
   1 MRKFNLTALS VMLALGLTAC QPPEAEKAAP AASGETQSAN EGGSVGIAVN

51 DNACEPMNLT VPSGQVVFNI KNNSGRKLEW EILKGVMVVD ERENIAPGLS

101 DKMTVTLLPG EYEMTCGLLT NPRGKLVVAD SGFKDTANEA DLEKLPQPLA

151 DYKAYVQGEV KELAAKTKTF TEAVKAGDIE KAKSLFAATR VHYERIEPIA

201 ELFSELDPVI DACEDDFKDG AKDAGFTGFH RIEHALWVEK DVSGVKETAA

251 KLMTDVEALQ KEIDALAFPP GKVVGGASEL IEEAAGSKIS GEEDRYSHTD

301 LSDFQANADG SKKIVDLFRP LIEAKNKALL EKTDTNFKQV NEILAKYRTK

351 DGFETYDKLS EADRKALQAP INALAEDLAQ LRGILGLK*
```

The following partial DNA sequence was identified in *N. meningitidis* <SEQ ID 2569>:

```
m749.seq
   1 ATGAGAAAAT TCAATTTGAC CGCATTGTCC GTGATGCTTG CCTTAGGTTT

51 GACCGCGTGC CAGCCGCCGG AGGCGGAGAA AGCTGCGCCG GCAGCGTCCG

101 GTGAGGCGCA AACCGCCAAC GAGGGCGGTT CGGTCAGTAT CGCCGTCAAC

151 GACAATGCCT GCGAACCGAT GGAACTGACC GTGCCGAGCG GACAGGTTGT

201 GTTCAATATT AAAAACAACA GCGGCCGCAA GCTCGAATGG GAAATCCTGA

251 AAGGCGTGAT GGTGGTGGAC GAGCGCGAAA ACATCGCCCC CGGACTTTCC

301 GATAAAATGA CCGTCACCCT GTTGCCGGGC GAATACGAAA TGACTTGCGG

351 TCTTTTGACC AATCCGCGCG GCAAGCTGGT GGTAACCGAC AGCGGCTTTA

401 AAGACACCGC CAACGAAGCG GATTTGGAAA AACTGTCCCA ACCGCTCGCC

451 GACTATAAAG CCTACGTTCA AGGCGAGGTT AAAGAGCTGG TGGCGAAAAC

501 CAAAACTTTT ACCGAAGCCG TCAAAGCAGG CGACATTGAA AAGGCGAAAT

551 CCCTGTTTGC CGACACCCGC GTCCATTACG AACGCATCGA ACCGATTGCC

601 GAGCTTTTCA GCGAACTCGA CCCCGTCATC GATGCGCGTG AAGACGACTT

651 CAAAGACGGC GCGAAAGATG CCGGATTTAC CGGCTTTCAC CGTATCGAAT
```

```
-continued
 701 ACGCCCTTTG GGTGGAAAAA GACGTGTCCG GCGTGAAGGA AATTGCAGCG

751 AAACTGATGA CCGATGTCGA AGCCCTGCAA AAAGAAATCG ACGCATTGGC

801 GTTTCCTCCG GGCAAGGTGG TCGGCGGCGC GTCCGAACTG ATTGAAGAAG

851 TGGCGGGCAG TAAAATCAGC GGCGAAGAAG ACCGGTACAG CCACACCGAT

901 TTGAGCGACT TCCAAGCCAA TGTGGACGGA TCTAAAAAAA TCGTCGATTT

951 GTTCCGTCCG CTGATCGAGG CCAAAAACAA AGCCTTGTTG GAAAAAACCG

1001 ATACCAACTT CAAACAGGTC AACGAAATTC TGGCGAAATA CCGGACTAAA

1051 GACGGTTTTG AAACCTACGA CAAGCTGGGC GAAGCCGACC GCAAAGCGTT

1101 ACAGGCCTCT ATTAACGCGC TTGCCGAAGA CCTTGCCCAA CTTCGCGGCA

1151 TACTCGGCTT GAAATAA
```

This corresponds to the amino acid sequence <SEQ ID 2570; ORF 749>:

```
m749.pep
  1 MRKFNLTALS VMLALGLTAC QPPEAEKAAP AASGEAQTAN EGGSVSIAVN

51 DNACEPMELT VPSGQVVFNI KNNSGRKLEW EILKGVMVVD ERENIAPGLS

101 DKMTVTLLPG EYEMTCGLLT NPRGKLVVTD SGFKDTANEA DLEKLSQPLA

151 DYKAYVQGEV KELVAKTKTF TEAVKAGDIE KAKSLFADTR VHYERIEPIA

201 ELFSELDPVI DAREDDFKDG AKDAGFTGFH RIEYALWVEK DVSGVKEIAA

251 KLMTDVEALQ KEIDALAFPP GKVVGGASEL IEEVAGSKIS GEEDRYSHTD

301 LSDFQANVDG SKKIVDLFRP LIEAKNKALL EKTDTNFKQV NEILAKYRTK

351 DGFETYDKLG EADRKALQAS INALAEDLAQ LRGILGLK*
```

Computer analysis of this amino acid sequence gave the following results:
Homology with a Predicted ORF from *N. gonorrhoeae*
ORF 749 shows 96.1% identity over a 388 aa overlap with a predicted ORF (ORF 749) from *N. gonorrhoeae*

```
  m749/g749    96.1% identity in 388 aa overlap 10         20         30         40         50         60
      m749.pep  MRKFNLTALSVMLALGLTACQPPEAEKAAPAASGEAQTANEGGSVSIAVNDNACEPMELT
                ||||||||||||||||||||||||||||||||||| :|:|||||| :|||||||||||:||
      g749      MRKFNLTALSVMLALGLTACQPPEAEKAAPAASGETQSANEGGSVGIAVNDNACEPMNLT
                      10         20         30         40         50         60

70         80         90        100        110        120
      m749.pep  VPSGQVVFNIKNNSGRKLEWEILKGVMVVDERENIAPGLSDKMTVTLLPGEYEMTCGLLT
                ||||||||||||||||||||||||||||||||||||||||||||||||||||||||||||
      g749      VPSGQVVFNIKNNSGRKLEWEILKGVMVVDERENIAPGLSDKMTVTLLPGEYEMTCGLLT
                      70         80         90        100        110        120

130        140        150        160        170        180
      m749.pep  NPRGKLVVTDSGFKDTANEADLEKLSQPLADYKAYVQGEVKELVAKTKTFTEAVKAGDIE
                ||||||||:|||||||||||||||||| ||||||||||||||||:|||||||||||||||
      g749      NPRGKLVVADSGFKDTANEADLEKLPQPLADYKAYVQGEVKELAAKTKTFTEAVKAGDIE
                     130        140        150        160        170        180

190        200        210        220        230        240
      m749.pep  KAKSLFADTRVHYERIEPIAELFSELDPVIDAREDDFKDGAKDAGFTGFHRIEYALWVEK
                |||||||:|||||||||||||||||||||||| |||||||||||||||||||||:||||||
      g749      KAKSLFAATRVHYERIEPIAELFSELDPVIDACEDDFKDGAKDAGFTGFHRIEHALWVEK
                     190        200        210        220        230        240

250        260        270        280        290        300
      m749.pep  DVSGVKEIAAKLMTDVEALQKEIDALAFPPGKVVGGASELIEEVAGSKISGEEDRYSHTD
                ||||||||:|||||||||||||||||||||||||||||||||||:|||||||||||||||
      g749      DVSGVKETAAKLMTDVEALQKEIDALAFPPGKVVGGASELIEEAAGSKISGEEDRYSHTD
                     250        260        270        280        290        300
```

-continued

```
                310        320        330        340        350        360
m749.pep   LSDFQANVDGSKKIVDLFRPLIEAKNKALLEKTDTNFKQVNEILAKYRTKDGFETYDKLG
           ||||||||:||||||||||||||||||||||||||||||||||||||||||||||||||:
g749       LSDFQANADGSKKIVDLFRPLIEAKNKALLEKTDTNFKQVNEILAKYRTKDGFETYDKLS
                310        320        330        340        350        360

370        380        389
m749.pep   EADRKALQASINALAEDLAQLRGILGLKX
           ||||||||| |||||||||||||||||||
g749       EADRKALQAPINALAEDLAQLRGILGLKX
                370        380
```

The following partial DNA sequence was identified in *N. meningitidis* <SEQ ID 2571>:

```
a749.seq
   1 ATGAGAAAAT TCAATTTGAC CGCATTGTCC GTGATGCTTG CCTTAGGTTT

51 GACCGCGTGC CAGCCGCCGG AGGCGGAGAA AGCTGCGCCG GCAGCGTCCG

```
201 ELFSELDPVI DAREDDFKDG AKDAGFTGFH RIEYALWVEK DVSGVKEIAA

251 KLMTDVEALQ KEIDALAFPP GKVVGGASEL IEEVAGSKIS GEEDRYSHTD

301 LSDFQANVDG SKKIVDLFRP LIETKNKALL EKTDTNFKQV NEILAKYRTK

351 DGFETYDKLG EADRKALQAS INALAEDLAQ LRGILGLK*
```

Computer analysis of this amino acid sequence gave the following results:

Homology with a Predicted ORF from *N. meningitidis*

ORF 749 shows 99.7% identity over a 388 aa overlap with a predicted ORF (ORF 749) from *N. meningitidis*:

```
    a749/m749   99.7% identity in 388 aa overlap 10         20         30         40         50         60
    a749.pep   MRKFNLTALSVMLALGLTACQPPEAEKAAPAASGEAQTANEGGSVSIAVNDNACEPMELT
               ||||||||||||||||||||||||||||||||||||||||||||||||||||||||||||
    m749       MRKFNLTALSVMLALGLTACQPPEAEKAAPAASGEAQTANEGGSVSIAVNDNACEPMELT
                    10         20         30         40         50         60

70         80         90        100        110        120
    a749.pep   VPSGQVVFNIKNNSGRKLEWEILKGVMVVDERENIAPGLSDKMTVTLLPGEYEMTCGLLT
               ||||||||||||||||||||||||||||||||||||||||||||||||||||||||||||
    m749       VPSGQVVFNIKNNSGRKLEWEILKGVMVVDERENIAPGLSDKMTVTLLPGEYEMTCGLLT
                    70         80         90        100        110        120

130        140        150        160        170        180
    a749.pep   NPRGKLVVTDSGFKDTANEADLEKLSQPLADYKAYVQGEVKELVAKTKTFTEAVKAGDIE
               |||||||||||||||||||||||||||||||||||| |||||||||||||||||||||||
    m749       NPRGKLVVTDSGFKDTANEADLEKLSQPLADYDAYVQGEVKELVAKTKTFTEAVKAGDIE
                   130        140        150        160        170        180

190        200        210        220        230        240
    a749.pep   KAKSLFADTRVHYERIEPIAELFSELDPVIDAREDDFKDGAKDAGFTGFHRIEYALWVEK
               ||||||||||||||||||||||||||||||||||||||||||||||||||||||||||||
    m749       KAKSLFADTRVHYERIEPIAELFSELDPVIDAREDDFKDGAKDAGFTGFHRIEYALWVEK
                   190        200        210        220        230        240

250        260        270        280        290        300
    a749.pep   DVSGVKEIAAKLMTDVEALQKEIDALAFPPGKVVGGASELIEEVAGSKISGEEDRYSHTD
               ||||||||||||||||||||||||||||||||||||||||||||||||||||||||||||
    m749       DVSGVKEIAAKLMTDVEALQKEIDALAFPPGKVVGGASELIEEVAGSKISGEEDRYSHTD
                   250        260        270        280        290        300

310        320        330        340        350        360
    a749.pep   LSDFQANVDGSKKIVDLFRPLIETKNKALLEKTDTNFKQVNEILAKYRTKDGFETYDKLG
               |||||||||||||||||||||||||||| :|||||||||||||||||||||||||||||
    m749       LSDFQANVDGSKKIVDLFRPLIEAKNKALLEKTDTNFKQVNEILAKYRTKDGFETYDKLG
                   310        320        330        340        350        360

370        380       389
    a749.pep   EADRKALQASINALAEDLAQLRGILGLKX
               |||||||||||||||||||||||||||||
    m749       EADRKALQASINALAEDLAQLRGILGLKX
                   370        380
```

The following partial DNA sequence was identified in *N. gonorrhoeae* <SEQ ID 2573>:

```
g750.seq
   1 GTGAAACCGC GTTTTTATTG GGCAGcctGC GCCGTCCTGC CGGCCGCCTG

51 TTCGCCCGAA CCTGCCGCCG AAAAAACTGT ATccgCCGCA TCCCAAGCCG

101 CATCCACACC TGTCGCCACG CTGACCGTGC CGACCGCGCG GGGCGATGCC

151 GTTGTGCCGA AGAATCCCGA ACgcgtcgcc gtgtAcgaCt ggGCGGCGTt 201 ggaTACGCTG ACCGAGCCGG GCGTGAATGT GGGCGCAACC ACCGCGCCGG

251 TGCGCGTGGA CTATTTGCAG CCTGCATTTG ACAAGGCGGC AACGGTGGGG

301 ACGCTGTTTG AGCCCGATTG CGAATCCCTG CACCGCCACA ATCCGCAGTT

351 TGTCATTACC GGCGGGCCGG GTGCGGAAGC GTATGAACAG TTGGCGAAAA

401 ACGCGACCAC CATAGATTTG ACGGTGGACA ACGGCAATAT CCGCACCAGC
```

-continued
```
451 GGCGAGAAGC AGATGGAGAC CCTGTCGCGG ATTTTCGGTA AGGAAGCGCG

501 CGTGGCGGAA TTGAATGCGC AGATTGACGC GCTGTTCGCC CAAAAGCGCG

551 AAGCCGCCAA AGGCAAAGGA CGCGGGCTGG TGCTGTCGGT TACAGGCAAC

601 AAGGTGTCCG CCTTCGGCAC GCAATCGCGG TTGGCAAGTT GGATACACGG

651 CGACATCGGC CTGCCGCCCG TGGACGAATC TTTACGCAAC GAAGGGCACG

701 GGCAGCCCGT TTCCTTCGAA TACATCAAAG AGAAAAACCC CGGCTGGATT

751 TTCATCATCG ACCGCACCGC CGCCATCGGG CAGGAAGGGC CGGCTGCCGT

801 GGAAGTGTTG GATAACGCGC TGGTATGCGG CACGAACGCT TGGAAGCGCA

851 AGCAAATCAT CGTCATGCCT GCCGCGAACT ACATTGTCGC GGGCGGCGCG

901 CGGCAGTTGA TACAGGCGGC GGAACAGTTG AAGGCGGCGT TTGAAAAGGC

951 AGAACCCGTT GCGGCGCAGT AG
```

This corresponds to the amino acid sequence <SEQ ID 2574; ORF 750.ng>:

```
g750.pep
   1 VKPRFYWAAC AVLPAACSPE PAAEKTVSAA SQAASTPVAT LTVPTARGDA

51 VVPKNPERVA VYDWAALDTL TEPGVNVGAT TAPVRVDYLQ PAFDKAATVG

101 TLFEPDCESL HRHNPQFVIT GGPGAEAYEQ LAKNATTIDL TVDNGNIRTS

151 GEKQMETLSR IFGKEARVAE LNAQIDALFA QKREAAKGKG RGLVLSVTGN

201 KVSAFGTQSR LASWIHGDIG LPPVDESLRN EGHGQPVSFE YIKEKNPGWI

251 FIIDRTAAIG QEGPAAVEVL DNALVCGTNA WKRKQIIVMP AANYIVAGGA

301 RQLIQAAEQL KAAFEKAEPV AAQ*
```

The following partial DNA sequence was identified in *N. meningitidis* <SEQ ID 2575>:

```
m750.seq
   1 GTGAAACCGC GTTTTTATTG GGCAGCCTGC GCCGTCCTGC TGACCGCCTG

51 TTCGCCCGAA CCTGCCGCCG AAAAAACTGT ATCCGCCGCA TCCGCATCTG

101 CCGCCACGCT GACCGTGCCG ACCGCGCGGG GCGATGCCGT TGTGCCGAAG

151 AATCCCGAAC GCGTCGCCGT GTACGACTGG GCGGCGTTGG ATACGCTGAC

201 CGAATTGGGC GTGAATGTGG GCGCAACCAC CGCGCCGGTG CGCGTGGATT

251 ATTTGCAGCC TGCATTTGAC AAGGCGGCAA CGGTGGGGAC GCTGTTCGAG

301 CCCGATTACG AAGCCCTGCA CCGCTACAAT CCTCAGCTTG TCATTACCGG

351 CGGGCCGGGC GCGGAAGCGT ATGAACAGTT AGCGAAAAAC GCGACCACCA

401 TAGATCTGAC GGTGGACAAC GGCAATATCC GCACCAGCGG CGAAAAGCAG

451 ATGGAGACCT TGGCGCGGAT TTTCGGCAAG GAAGCGCGCG CGGCGGAATT

501 GAAGGCGCAG ATTGACGCGC TGTTCGCCCA AACGCGCGAA GCCGCCAAAG

551 GCAAAGGACG CGGGCTGGTG CTGTCGGTTA CGGGCAACAA GGTGTCCGCC

601 TTCGGCACGC AGTCGCGGTT GGCAAGTTGG ATACACGGCG ACATCGGCCT

651 ACCGCCTGTA GACGAATCTT TACGCAACGA GGGGCACGGG CAGCCTGTTT

701 CCTTCGAATA CATCAAAGAG AAAAACCCCG ATTGGATTTT CATCATCGAC

751 CGTACCGCCG CCATCGGGCA GGAAGGGCCG GCGGCTGTCG AAGTATTGGA
```

```
801 TAACGCGCTG GTACGCGGCA CGAACGCTTG GAAGCGCAAG CAAATCATCG

851 TCATGCCTGC CGCGAACTAC ATTGTCGCGG GCGGCGCGCG GCAGTTGATT

901 CAGGCGGCGG AGCAGTTGAA GGCGGCGTTT AAAAAGGCAG AACCCGTTGC

951 GGCGGGGAAA AAGTAG
```

This corresponds to the amino acid sequence <SEQ ID 2576; ORF 750>:

```
m750.pep
   1 VKPRFYWAAC AVLLTACSPE PAAEKTVSAA SASAATLTVP TARGDAVVPK

51 NPERVAVYDW AALDTLTELG VNVGATTAPV RVDYLQPAFD KAATVGTLFE

101 PDYEALHRYN PQLVITGGPG AEAYEQLAKN ATTIDLTVDN GNIRTSGEKQ

151 METLARIFGK EARAAELKAQ IDALFAQTRE AAKGKGRGLV LSVTGNKVSA

201 FGTQSRLASW IHGDIGLPPV DESLRNEGHG QPVSFEYIKE KNPDWIFIID

251 RTAAIGQEGP AAVEVLDNAL VRGTNAWKRK QIIVMPAANY IVAGGARQLI

301 QAAEQLKAAF KKAEPVAAGK K*
```

Computer analysis of this amino acid sequence gave the following results:
Homology with a Predicted ORF from *N. gonorrhoeae*
ORF 750 shows 93.8% identity over a 322 aa overlap with a predicted ORF (ORF 750) from *N. gonorrhoeae*

```
    m750/g750    93.8% identity in 322 aa overlap 10        20        30        40          50
       m750.pep VKPRFYWAACAVLLTACSPEPAAEKTVSAASASA----ATLTVPTARGDAVVPKNPERVA
                ||||||||||| :||||||||||||||||| :|     ||||||||||||||||||||||
       g750     VKPRFYWAACAVLPAACSPEPAAEKTVSAASQAASTPVATLTVPTARGDAVVPKNPERVA
                        10        20        30        40        50        60
                        60        70        80        90       100       110
       m750.pep VYDWAALDTLTELGVNVGATTAPVRVDYLQPAFDKAATVGTLFEPDYEALHRYNPQLVIT
                ||||||||||||| ||||||||||||||||||||||||||||||| :|||:|| :|||
       g750     VYDWAALDTLTEPGVNVGATTAPVRVDYLQPAFDKAATVGTLFEPDCESLHRHNPQFVIT
                        70        80        90       100       110       120
                       120       130       140       150       160       170
       m750.pep GGPGAEAYEQLAKNATTIDLTVDNGNIRTSGEKQMETLARIFGKEARAAELKAQIDALFA
                ||||||||||||||||||||||||||||||||||||| :|||||||| :|||:|||||||
       g750     GGPGAEAYEQLAKNATTIDLTVDNGNIRTSGEKQMETLSRIFGKEARVAELNAQIDALFA
                       130       140       150       160       170       180
                       180       190       200       210       220       230
       m750.pep QTREAAKGKGRGLVLSVTGNKVSAFGTQSRLASWIHGDIGLPPVDESLRNEGHGQPVSFE
                | :||||||||||||||||||||||||||||||||||||||||||||||||||||||||
       g750     QKREAAKGKGRGLVLSVTGNKVSAFGTQSRLASWIHGDIGLPPVDESLRNEGHGQPVSFE
                       190       200       210       220       230       240
                       240       250       260       270       280       290
       m750.pep YIKEKNPDWIFIIDRTAAIGQEGPAAVEVLDNALVRGTNAWKRKQIIVMPAANYIVAGGA
                ||||||| ||||||||||||||||||||||||||| ||||||||||||||||||||||||
       g750     YIKEKNPGWIFIIDRTAAIGQEGPAAVEVLDNALVCGTNAWKRKQIIVMPAANYIVAGGA
                       250       260       270       280       290       300
                       300       310       320
       m750.pep RQLIQAAEQLKAAFKKAEPVAAGKKX
                ||||||| ||||||||||||||||
       g750     RQLIQAAEQLKAAFEKAEPVAAQX
                       310       320
```

The following partial DNA sequence was identified in *N. meningitidis* <SEQ ID 2577>:

```
a750.seq
   1 GTGAAACCGC GTTTTTATTG GGCAGCCTGC GCCGTCCTGC TGACCGCCTG

51 TTCGCCCGAA CCTGCCGCCG AAAAAACTGT ATCCGCCGCA TCCGCATCTG
```

-continued

```
101 CCGCCACACT GACCGTGCCG ACCGCGCGGG GCGATGCCGT TGTGCCGAAG

151 AATCCCGAAC GCGTCGCCGT GTACGACTGG GCGGCGTTGG ATACGCTGAC

201 CGAATTGGGT GTGAATGTGG GCGCAACCAC CGCGCCGGTG CGCGTGGATT

251 ATTTGCAGCC TGCATTTGAC AAGGCGGCAA CGGTGGGGAC GCTGTTCGAG

301 CCCGATTACG AAGCCCTGCA CCGCTACAAT CCTCAGCTTG TCATTACCGG

351 CGGGCCGGGC GCGGAAGCGT ATGAACAGTT GGCGAAAAAC GCGACCACCA

401 TAGATCTGAC GGTGGACAAC GGCAATATCC GCACCAGCGG CGAAAAGCAG

451 ATGGAGACCT TGGCGCGGAT TTTCGGCAAG GAAGCGCGCG CGGCGGAATT

501 GAAGGCGCAG ATTGACGCGC TGTTCGCCCA AACGCGCGAA GCCGCCAAAG

551 GCAAAGGACG CGGGCTGGTG CTGTCGGTTA CGGGCAACAA GGTGTCCGCC

601 TTCGGCACGC AGTCGCGGTT GGCAAGTTGG ATACACGGCG ACATCGGCCT

651 ACCGCCTGTA GACGAATCTT TACGCAACGA GGGGCACGGG CAGCCTGTTT

701 CCTTCGAATA CATCAAAGAG AAAAACCCCG ATTGGATTTT CATCATCGAC

751 CGTACCGCCG CCATCGGGCA GGAAGGGCCG GCGGCTGTCG AAGTATTGGA

801 TAACGCGCTG GTACGCGGCA CGAACGCTTG GAAGCGCAAG CAAATCATCG

851 TCATGCCTGC CGCGAACTAC ATTGTCGCGG GCGGCTCGCG GCAGTTGATT

901 CAGGCGGCGA AGCAGTTGAA GGAGGCGTTT GAAAAGGCAG AACCCGTTGC

951 GGCGGGGAAA GAGTAG
```

This corresponds to the amino acid sequence <SEQ ID 2578; ORF 750.a>:

```
a750.pep
  1 VKPRFYWAAC AVLLTACSPE PAAEKTVSAA SASAATLTVP TARGDAVVPK

51 NPERVAVYDW AALDTLTELG VNVGATTAPV RVDYLQPAFD KAATVGTLFE

101 PDYEALHRYN PQLVITGGPG AEAYEQLAKN ATTIDLTVDN GNIRTSGEKQ

151 METLARIFGK EARAAELKAQ IDALFAQTRE AAKGKGRGLV LSVTGNKVSA

201 FGTQSRLASW IHGDIGLPPV DESLRNEGHG QPVSFEYIKE KNPDWIFIID

251 RTAAIGQEGP AAVEVLDNAL VRGTNAWKRK QIIVMPAANY IVAGGSRQLI

301 QAAEQLKEAF EKAEPVAAGK E*
```

Computer analysis of this amino acid sequence gave the following results:
Homology with a Predicted ORF from *N. meningitidis*
ORF 750 shows 98.8% identity over a 321 aa overlap with a predicted ORF (ORF 750) from *N. meningitidis*:

```
    a750/m750   93.8% identity in 321 aa overlap 10         20         30         40         50         60
        a750.pep   VKPRFYWAACAVLLTACSPEPAAEKTVSAASASAATLTVPTARGDAVVPKNPERVAVYDW
                   ||||||||||||||||||||||||||||||||||||||||||||||||||||||||||||
        m750       VKPRFYWAACAVLLTACSPEPAAEKTVSAASASAATLTVPTARGDAVVPKNPERVAVYDW
                        10         20         30         40         50         60

70         80         90        100        110        120
        a750.pep   AALDTLTELGVNVGATTAPVRVDYLQPAFDKAATVGTLFEPDYEALHRYNPQLVITGGPG
                   ||||||||||||||||||||||||||||||||||||||||||||||||||||||||||||
        m750       AALDTLTELGVNVGATTAPVRVDYLQPAFDKAATVGTLFEPDYEALHRYNPQLVITGGPG
                        70         80         90        100        110        120
```

-continued

```
                 130        140        150        160        170        180
a750.pep   AEAYEQLAKNATTIDLTVDNGNIRTSGEKQMETLARIFGKEARAAELKAQIDALFAQTRE
           ||||||||||||||||||||||||||||||||||||||||||||||||||||||||||||
m750       AEAYEQLAKNATTIDLTVDNGNIRTSGEKQMETLARIFGKEARAAELKAQIDALFAQTRE
                 130        140        150        160        170        180

190        200        210        220        230        240
a750.pep   AAKGKGRGLVLSVTGNKVSAFGTQSRLASWIHGDIGLPPVDESLRNEGHGQPVSFEYIKE
           ||||||||||||||||||||||||||||||||||||||||||||||||||||||||||||
m750       AAKGKGRGLVLSVTGNKVSAFGTQSRLASWIHGDIGLPPVDESLRNEGHGQPVSFEYIKE
                 190        200        210        220        230        240

240        250        260        270        280        290
a750.pep   KNPDWIFIIDRTAAIGQEGPAAVEVLDNALVRGTNAWKRKQIIVMPAANYIVAGGSRQLI
           ||||||||||||||||||||||||||||||||||||||||||||||||||||||:||||
m750       KNPDWIFIIDRTAAIGQEGPAAVEVLDNALVRGTNAWKRKQIIVMPAANYIVAGGARQLI
                 250        260        270        280        290        300

310        320
a750.pep   QAAEQLKEAFEKAEPVAAGKEX
           ||||||| ||:|||||||||:|
m750       QAAEQLKAAFKKAEPVAAGKKX
                 310        320 g751.seq   not found yet g751.pep   not found yet
```

The following partial DNA sequence was identified in *N. meningitidis* <SEQ ID 2579>:

```
m751.seq..
     1 ATGGCTTGGA GTATGTTTGC CACAACCCAA GCCGATAGAG CGGTAAGGTC

51 TGCAACTGCA CCTAAAGAAA TGTGGTTCCA TAAGAAGATA ATAGATGAAA

101 AAACAGGTAA AGTATCCTTT GATACCAGAC AAATTTGGTC ATTGAATGAT

151 TTAAGCAAGG AAGAACTGGC AAGCATTCAA GACACAAATG GCAAAGTTAT

201 TACTGTGTCT AATCCTGGTA TTTTCAATAA TCGAGAAGAT TCATTAAGCA

251 ACGCAGCAAA ACAAAATCGT AATAGTACAA ACGGTAGTGG TGTTATTGCA

301 GTCATGAATC CTCCAACAGG GAAATATAAA TCTGATTCTA ATAACAAAAT

351 AAAAGATTTT TTATGGCTCG GTTCAAGTCT TGTTTCTGAA CTGATGTATG

401 TCGGTTACGA CCAATTAAAT AATAAAGTGT TCCAAGGCTA TTTACCCAAA

451 ACCAATTCAG AAAAACTGAA TCAAGATATT TATCGAGAGG TTCAAAAAAT

501 GGGTAACGGC TGGTCGGTTG ATACCAGTAA TCACAGTCGT GGGGGAATTA

551 CAGCAAGCGT TTCCTTAAAA GATTGGGTAA ACAATCAAAA ACAAAATGGC

601 ATTGCCCCAA TCAGAAAAGC ACGTTTCTAT GGTACAGCCA CAAATGTGCA

651 GAATGATTAC GCCGATGTTT TACAGAAAAA CGGCTATACC TATACGGGTG

701 CAGACGGCAA AACTTATAAC AGCGGATCCT ACTCAATCGT GCATGATAAA

751 GATTTTGTGG GGAACAAATG GATACCTTTC TTGCTAGGAA CCAATGACAC

801 CACACAAGGT ACATGTAAGG GGTTGTGCTA TTCGCATAGC AGTTATTTTG

851 CGGAGGTGCC AAAAGCAGGT ACAAAAGAAT TTGATGACTA TGTAAAAATA

901 TGGGGTGAAG TTGAATATGA CGCTCAAGGT AAGCCAATTA ACAAATCTAA

951 ACCCATACTG GTAGAACCAA ACAAAACAAA AGATAATGAA AAATATGAAA

1001 AAGAAGCTTT CTAA
```

This corresponds to the amino acid sequence <SEQ ID 2580; ORF 751>:

```
m751.pep..
  1  MAWSMFATTQ ADRAVRSATA PKEMWFHKKI IDEKTGKVSF DTRQIWSLND
```

-continued

```
 51 LSKEELASIQ DTNGKVITVS NPGIFNNRED SLSNAAKQNR NSTNGSGVIA

101 VMNPPTGKYK SDSNNKIKDF LWLGSSLVSE LMYVGYDQLN NKVFQGYLPK

151 TNSEKLNQDI YREVQKMGNG WSVDTSNHSR GGITASVSLK DWVNNQKQNG

201 IAPIRKARFY GTATNVQNDY ADVLQKNGYT YTGADGKTYN SGSYSIVHDK

251 DFVGNKWIPF LLGTNDTTQG TCKGLCYSHS SYFAEVPKAG TKEFDDYVKI

301 WGEVEYDAQG KPINKSKPIL VEPNKTKDNE KYEKEAF* a751.seq not found yet
a751.pep not found yet g752.seq not found yet
g752.pep not found yet
```

The following partial DNA sequence was identified in *N. meningitidis* <SEQ ID 2581>:

```
m752.seq..
    1 ATGAAAATTT CCAGACCTCC GGAATTTACC CTGTTGCAAC AGGAATATAT

51 GCAGCATCTC ACTGAAAGAA TGACGCAAAT TGCCAAGCTG CTGAATTCTT

101 CCGCAAACAA TCCTGATATA GACATTCCCG ATTTTCTTAC TGAAATCAAA

151 GATTATTCAG AATTTTCCGT GACAGATGAA AATGGAACCT ACCTGCATTG

201 GGACAAATTC CGCCGGATTC ACACGGAAGA TACGCGGATG AAATGGCGCG

251 CCGTTAAGGA AAGCCGCAAA AAAATCCAAA AACCAATTGA TTTCCCGTTT

301 GAACATCAGT TTTGGTTCTG CATTCCCGAC TCTTTGCAGG CACGGCTTCA

351 TTTGATTGAC AAAAGCTGCG GCAGTTCTAT CGGCACGTCT AGCTTGGGTG

401 GCTTCGGCAG AAGCGAGCAA AACAGATTCT TGCTCAAGTC TCTGATTATG

451 GAAGAAGCGA TTACATCCGC CCAACTGGAA GGTGCGGCTA CCACGCGTAA

501 AGTGGCCAAG GATATGCTCA AATCGCAGCG TAAACCCAAA ACAAAAGACG

551 AAATCATGAT AGTGAACAAC TATCACTTGA TGAAAAAAGC GGTAGAATTG

601 AAAAATACGC CGTTAAGTGT TGAAATGATT TTGGATTTGC ACCGCATTGC

651 TACCAGTAAC GCTATTGAAA ACAAGGCCGA GCCCGGACAA TTCAGGCAGG

701 ATGACGAAAT CTTTATCGCC GATATCAATG GTAACAGCCT GTATCAACCA

751 CCGCCGCACG GACAGGTTCA TACGCTGATG GAAGAGGTGT GTGCGTTTGC

801 CAATAATACC TATGACGGCG TGGAAAATCC GTTTATCCAT CCGGTTGTCC

851 AAGCTATTAT CTTGCATTTC CTCATCGGCT ACATCCACCC ATTTGGTGAT

901 GGCAACGGGC GGACAGCGCG GGCTTTGTTC TATTGGTTTA TGCTCAAAAA

951 CGGCTACTGG CTATTTGAAT ACATATCCAT CAGCCGTCTT CTGAAAAACG

1001 CTCCTGCCCA ATACGCCAAA TCCTATTTGT ATGCGGAAAC TGACGATTTA

1051 GATTTAACCT ATTTCATCTA TTACCAATGC GATATTATCA AGCGGGCGGT

1101 TGCCGATTTG GAGCACTACA TTTCCGACAA ACAAAAACAC CAACAGGAAT

1151 TCAAAGCAGC GATTGCCCAA TATACTGAAA AGATAGGAAA GTTGAACCAA

1201 CGGCAAATTG GTATCCTGCA AAAGCAGTG GAAGAAAGCG GAAAAATCTT

1251 TACTGCACAA GAAATTGCCA ACCAATACGG CATCTCCCTG AATACTGCCC

1301 GTAGCGATTT GAGTAAACTG GGAGAATATA GATTCCTAGT GCCGTTCAAA
```

-continued
```
1351 TCAGGAAATG CTTTAGAGTA TGTTGCTCCT CAGGATTTAT TGGAAAGGTT

1401 AGAAAAAAAA TAG
```

This corresponds to the amino acid sequence <SEQ ID 2582; ORF 752>:

```
m752.pep
   1 MKISRPPEFT LLQQEYMQHL TERMTQIAKL LNSSANNPDI DIPDFLTEIK

51 DYSEFSVTDE NGTYLHWDKF RRIHTEDTRM KWRAVKESRK KIQKPIDFPF

101 EHQFWFCIPD SLQARLHLID KSCGSSIGTS SLGGFGRSEQ NRFLLKSLIM

151 EEAITSAQLE GAATTRKVAK DMLKSQRKPK TKDEIMIVNN YHLMKKAVEL

201 KNTPLSVEMI LDLHRIATSN AIENKAEPGQ FRQDDEIFIA DINGNSLYQP

251 PPHGQVHTLM EEVCAFANNT YDGVENPFIH PVVQAIILHF LIGYIHPFGD

301 GNGRTARALF YWFMLKNGYW LFEYISISRL LKNAPAQYAK SYLYAETDDL

351 DLTYFIYYQC DIIKRAVADL EHYISDKQKH QQEFKAAIAQ YTEKIGKLNQ

401 RQIGILQKAV EESGKIFTAQ EIANQYGISL NTARSDLSKL GEYRFLVPFK

451 SGNALEYVAP QDLLERLEKK *
```

The following partial DNA sequence was identified in *N. meningitidis* <SEQ ID 2583>:

```
m752-1.seq
    1 ATGAAAATTT CCAGACCTCC GGAATTTACC CTGTTGCAAC AGGAATATAT

51 GCAGCATCTC ACTGAAAGAA TGACGCAAAT TGCCAAGCTG CTGAATTCTT

101 CCGCAAACAA TCCTGATATA GACATTCCCG ATTTTCTTAC TGAAATCAAA

151 GATTATTCAG AATTTTCCGT GACAGATGAA AATGGAACCT ACCTGCATTG

201 GGACAAATTC CGCCGGATTC ACACGGAAGA TACGCGGATG AAATGGCGCG

251 CCGTTAAGGA AAGCCGCAAA AAATCCAAA AACCAATTGA TTTCCCGTTT

301 GAACATCAGT TTTGGTTCTG CATTCCCGAC TCTTTGCAGG CACGGCTTCA

351 TTTGATTGAC AAAAGCTGCG GCAGTTCTAT CGGCACGTCT AGCTTGGGTG

401 GCTTCGGCAG AAGCGAGCAA AACAGATTCT TGCTCAAGTC TCTGATTATG

451 GAAGAAGCGA TTACATCCGC CCAACTGGAA GGTGCGGCTA CCACGCGTAA

501 AGTGGCCAAG GATATGCTCA AATCGCAGCG TAAACCCAAA ACAAAAGACG

551 AAATCATGAT AGTGAACAAC TATCACTTGA TGAAAAAAGC GGTAGAATTG

601 AAAAATACGC CGTTAAGTGT TGAAATGATT TTGGATTTGC ACCGCATTGC

651 TACCAGTAAC GCTATTGAAA ACAAGGCCGA GCCCGGACAA TTCAGGCAGG

701 ATGACGAAAT CTTTATCGCC GATATCAATG GTAACAGCCT GTATCAACCA

751 CCGCCGCACG GACAGGTTCA TACGCTGATG GAAGAGGTGT GTGCGTTTGC

801 CAATAATACC TATGACGGCG TGGAAAATCC GTTTATCCAT CCGGTTGTCC

851 AAGCTATTAT CTTGCATTTC CTCATCGGCT ACATCCACCC ATTTGGTGAT

901 GGCAACGGGC GGACAGCGCG GGCTTTGTTC TATTGGTTTA TGCTCAAAAA

951 CGGCTACTGG CTATTTGAAT ACATATCCAT CAGCCGTCTT CTGAAAAACG

1001 CTCCTGCCCA ATACGCCAAA TCCTATTTGT ATGCGGAAAC TGACGATTTA

1051 GATTTAACCT ATTTCATCTA TTACCAATGC GATATTATCA AGCGGGCGGT
```

```
-continued
1101 TGCCGATTTG GAGCACTACA TTTCCGACAA ACAAAAACAC CAACAGGAAT

1151 TCAAAGCAGC GATTGCCCAA TATACTGAAA AGATAGGAAA GTTGAACCAA

1201 CGGCAAATTG GTATCCTGCA AAAAGCAGTG GAAGAAAGCG GAAAAATCTT

1251 TACTGCACAA GAAATTGCCA ACCAATACGG CATCTCCCTG AATACTGCCC

1301 GTAGCGATTT GAGTAAACTG GGAGAATATA GATTCCTAGT GCCGTTCAAA

1351 TCAGGAAATG CTTTAGAGTA TGTTGCTCCT CAGGATTTAT TGGAAAGGTT

1401 AGAAAAAAAA TAG
```

This corresponds to the amino acid sequence <SEQ ID 2584; ORF 752-1>:

```
m752-1.pep
   1 MKISRPPEFT LLQQEYMQHL TERMTQIAKL LNSSANNPDI DIPDFLTEIK

51 DYSEFSVTDE NGTYLHWDKF RRIHTEDTRM KWRAVKESRK KIQKPIDFPF

101 EHQFWFCIPD SLQARLHLID KSCGSSIGTS SLGGFGRSEQ NRFLLKSLIM

151 EEAITSAQLE GAATTRKVAK DMLKSQRKPK TKDEIMIVNN YHLMKKAVEL

201 KNTPLSVEMI LDLHRIATSN AIENKAEPGQ FRQDDEIFIA DINGNSLYQP

251 PPHGQVHTLM EEVCAFANNT YDGVENPFIH PVVQAIILHF LIGYIHPFGD

301 GNGRTARALF YWFMLKNGYW LFEYISISRL LKNAPAQYAK SYLYAETDDL

351 DLTYFIYYQC DIIKRAVADL EHYISDKQKH QQEFKAAIAQ YTEKIGKLNQ

401 RQIGILQKAV EESGKIFTAQ EIANQYGISL NTARSDLSKL GEYRFLVPFK

451 SGNALEYVAP QDLLERLEKK * a752.seq not found yet
a752.pep not found yet g753.seq not found yet
g753.pep not found yet
```

The following partial DNA sequence was identified in *N. meningitidis* <SEQ ID 2585>:

```
m753.seq
   1 ATGCCCATCA CTCCACCCTT AAACATCATC TCTCCTAAAC TCTACCCCAA

51 TGAACAATGG AACGAAAGCG AAGCACTCGG TGCCATCACT TGGCTATGGT

101 ATCAGTCGCC TACGCATCGC CAAGTACCTA TTGTGGAGAT GATGACGTAT

151 ATATTGCCTG TGTTAAAAAA CGGGCAGTTC GCTTTGTTTT GCAAGGGTAC

201 CCAACCAATC GGTTATATCT CATGGGCTTA TTTTGATGAA GTGGCGCAGG

251 CGCATTATTT AGAATCTGAC CGCCATTTGC GTGACAACAG CGATTGGAAC

301 TGTGGCGACA ATATTTGGCT GATTCAATGG TTTGCGCCAT TGGGACACAG

351 TCATCAAATG CGCTCAGCTG TGCGCCAGTT ATTTCCTAGT ACGACAGTAC

401 GCGCCTTGTA TCATAAAGGG AGCGATAAGG GTTTGAGAAT TTTAACTTTT

451 AAAACTTGA
```

This corresponds to the amino acid sequence <SEQ ID 2586; ORF 753>:

```
m753.pep
   1 MPITPPLNII SPKLYPNEQW NESEALGAIT WLWYQSPTHR QVPIVEMMTY
```

-continued

```
 51 ILPVLKNGQF ALFCKGTQPI GYISWAYFDE VAQAHYLESD RHLRDNSDWN

101 CGDNIWLIQW FAPLGHSHQM RSAVRQLFPS TTVRALYHKG SDKGLRILTF

151 KT*
``` a753.seq not found yet
a753.pep not found yet g754.seq not found yet
g754.pep not found yet The following partial DNA sequence was identified in *N. meningitidis* <SEQ ID 2587>:

```
m754.seq
   1 ATGATGAAGT CTATCCTCAC CGTATCCGGA AATCGTATGC GTAAACCCAG

51 AATCACCTAT TTGGATGTTT GGGCAAACGA TGAAAGAATC GGTACTTTGG

101 AAAAGGGGGC CATGTATCGG TTCGCATACG ACAATCCCAA TTCTTCGTTG

151 CTGGGCCTGC ATTATCAAGA CAGAAGCAAG GTATATATCA GCAACAATAT

201 GCCGCATATC TTTGCACAGT ATTTTCCGGA AGGCTTTTTG GATGCACACA

251 TCACAAGCAA ATATGCTTTT CATGATGCGC CTTTTGAAGA CAATGAGATG

301 CTGCGCTTGG CAATTCTGTG CAGAGAGACT TTGGGTCGGA TACATGTGCG

351 CTGTAATGAC CCGCTTTTTA ATGAATGGAT TGACGGGTTG GAGATGAAAA

401 ATCCAAGAAT ATTGACTGAA CGGGATTTGC TGGGCATAAA TGCCCGACAG

451 GTTTTTCAGC AATATATGGC AGAAATCTTC CATCACGGCC GTTTCGTCAG

501 TGTATCCGGG ATACAGCAGA AGATGTCCTT AGATGCCATC CGCAGAAATA

551 CCAAGCAAAC TGCCTCATAT ATTGCCAAAG GTTTTGATGC ATCCGAATAT

601 CCTTGCTTGG CTGCCAATGA ATTTTTATGC ATGCAGACCA TCAAACAAGC

651 CGGCATTGCC GTTGCACAGA CCAGCCTGTC GGAAGATTCA TCAGTCTTAT

701 TGGTACGTCG GTTTGATGTC AGTGAACAGG GTTATTTTTT AGGGATGGAA

751 GACTTTACCA GTCTGCGCCA GTATTCGGTA GAAGATAAAT ATAAAGGCAG

801 TTATGCGGCT ATTGCACAGA TTATCCGACA GATATCCGGC AGACCAGATG

851 AAGATTTAAT CCATTTCTTT AATCAGCTTG CTGCCAGTTG CATATTGAAA

901 AACGGCGATG CACACCTCAA AAATTTTTCA GTACTCTATC ATGACGAATA

951 CGATGTTCGT CTTGCACCTG TCTATGATGT ATTGGATACA TCAATATACA

1001 GGGTTGGAAC ACAAGGAATT TTTGATGCTT ATGACGATAC GCTGGCATTA

1051 AACCTGACTA ACCACGGTAA GAAAACATAT CCTTCCAAGA ATACATTGTT

1101 GGATTTTGCT GAGAAATATT GCGATTTGGG AAGAGAAGAT GCATCCTTTA

1151 TGATAGATAC AATCGTTCAA GCTAAAGAAC AGGTTCTTGT TAAATACTCG

1201 GATGTATTGC GTGAGAATGA ATGGTTGGCG CAGAAGTGGC ATTTTATCCC

1251 GGATGAAAAT GAAGAAGGTC TACCGTTTAC ATTCCGGTAG
```

This corresponds to the amino acid sequence <SEQ ID 2588; ORF 754>:

```
m754.pep
  1 MMKSILTVSG NRMRKPRITY LDVWANDERI GTLEKGAMYR FAYDNPNSSL

51 LGLHYQDRSK VYISNNMPHI FAQYFPEGFL DAHITSKYAF HDAPFEDNEM
```

-continued

```
101 LRLAILCRET LGRIHVRCND PLFNEWIDGL EMKNPRILTE RDLLGINARQ

151 VFQQYMAEIF HHGRFVSVSG IQQKMSLDAI RRNTKQTASY IAKGFDASEY

201 PCLAANEFLC MQTIKQAGIA VAQTSLSEDS SVLLVRRFDV SEQGYFLGME

251 DFTSLRQYSV EDKYKGSYAA IAQIIRQISG RPDEDLIHFF NQLAASCILK

301 NGDAHLKNFS VLYHDEYDVR LAPVYDVLDT SIYRVGTQGI FDAYDDTLAL

351 NLTNHGKKTY PSKNTLLDFA EKYCDLGRED ASFMIDTIVQ AKEQVLVKYS

401 DVLRENEWLA QKWHFIPDEN EEGLPFTFR* a754.seq not found yet
a754.pep not found yet g755.seq not found yet
g755.pep not found yet
```

The following partial DNA sequence was identified in *N. meningitidis* <SEQ ID 2589>:

```
m755.seq..
    1 ATGAGCCGTT ACCTGATTAC CTTTGATATG GATACCAACT GCCTGAAAGA

51 CAATTACCAC GGAAATAACT ATACCAATGC CTACTCCGAT ATTAAAACCA

101 TCTTGGCTAG ACATGGATTT GAGAACATTC AGGGCAGTGT TTATCTAGGC

151 CGTGAAGGCA TCAGTGAAGC CACGGAACA ATAGCCATTC AGGAACTGAC

201 CGCTCGGTTT GATTGGTTTT ACTCCTGTAT TTCAAACATT AAGTTTTACC

251 GCCTTGAAAG TGATTTGAAC GCACAATTTA TCGCTGATGG TGTGTATCAA

301 GCCAAACAGG CTTTCCTTCA ACGTGTTGAA CAACTTCGTA TATCCCTAAC

351 AGAAGCTGGA TTGTCTGATG AGCAAATCAA TCAGGTTCTG GAAAAACAGA

401 AATTTGAATT GGAAAGTCCT AACCTGAAAT TAAATTAA
```

This corresponds to the amino acid sequence <SEQ ID 2590; ORF 755>:

```
m755.pep..
    1 MSRYLITFDM DTNCLKDNYH GNNYTNAYSD IKTILARHGF ENIQGSVYLG

51 REGISEAHGT IAIQELTARF DWFYSCISNI KFYRLESDLN AQFIADGVYQ

101 AKQAFLQRVE QLRISLTEAG LSDEQINQVL EKQKFELESP NLKLN* a755.seq not found yet
a755.pep not found yet g756.seq not found yet
g756.pep not found yet
```

The following partial DNA sequence was identified in *N. meningitidis* <SEQ ID 2591>:

```
m756.seq
    1 ATGACCGCCA ACTTTGCACA GACGCTGGTC GAAATACAGG ACAGTCTGTA

51 CAGGGTTGTG TCAACCGTCC AATACGGGGA TGACAACCTC AAGCGGTTGA

101 CAGCGGACAA ACGGAAGCAG TATGAGTTGA ACTTCAAGAT TTCCGAGGGT

151 TCTACGCGTG TAGAGTCCGA CTTTAAAGAG ACTTTGGTTC GGTTCGGTAG

201 AGATATGCTT CAAGATATGC CCCCTAAAAT CCGTTCGGCA ACGCTGGTAG

251 CGTTGACGAC CCTGCTTGTC GGAGGGGCGT TGGGTTACGG TTATTTGGAA
```

-continued
```
301 TACCTGAAGC AGGTTGCTTC GGAAGGGTAT CAGACCGAGC GTCTGTATAA

351 TGCCGTCGAC CGTCTTGCAG AATCCCAAGA ACGGATAACG TCCGCCATCC

401 TGAAGGGTGC TAGAGGTGCC GATTTCGTGC AAATCGGCAG ACGTTCCTAC

451 AGTAGGGAGG ATATATCGGA GGCAAATAGA CGTGCAGAGC GTGTCCCGTA

501 TGGCGCAGAG TTGGTTTCAG ACGGCAATTT TACCGCTGTT TTATCTGATA

551 TAGGGGATTA A
```

This corresponds to the amino acid sequence <SEQ ID 2592; ORF 756>:

```
m756.pep
   1 MTANFAQTLV EIQDSLYRVV STVQYGDDNL KRLTADKRKQ YELNFKISEG

51 STRVESDFKE TLVRFGRDML QDMPPKIRSA TLVALTTLLV GGALGYGYLE

101 YLKQVASEGY QTERLYNAVD RLAESQERIT SAILKGARGA DFVQIGRRSY

151 SREDISEANR RAERVPYGAE LVSDGNFTAV LSDIGD*
```

The following partial DNA sequence was identified in *N. meningitidis* <SEQ ID 2593>:

```
a756.seq
   1 ATGACCGCCA ACTTTGCACA GACGCTGGTC GAAATACAGG ACAGTCTGTA

51 NAGGGTTGTG TCAACCGTCC AATACGGGGA TGACAACCTC AAGCGGTTGA

101 CAGCGGACAA ACGGAAGCAG TATGAGTTGA ACTTCAAGAT TTCCGAGGGT

151 TCTACGCGTG TAGAGTCCGA CTTTAAAGAG ACTTTGGTTC GGTTCGGTAG

201 AGATATGCTT CAAGATATGC CCCCTAAAAT CCGTTCGGCA ACGCTGGTAG

251 CGTTGACGAC CCTGCTTGTC GGAGGGGCGT TGGGTTACGG TTATTTGGAA

301 TACCTGAAGC AGGTTGCTTC GGAAGGGTAT CAGACCGAGC GTCTGTATAA

351 TGCCGTCGAC CGTCTTGCAG AATCCCAAGA ACGGATAACG TCCGCCATCC

401 TGAAGGGTGC TAGAGGTGCC GATTTCGTGC AAATCGGCAG ACGTTCCTAC

451 AGTAGGGAGG ATATATCGGA GGCAAATAGA CGTGCAGAGC GTGTCCCGTA

501 TGGCGCAGAG TTGGTTTCAG ACGGCAATTT TACCGCTGTT TTATCTGATA

551 TAGGGGATTA A
```

This corresponds to the amino acid sequence <SEQ ID 2594; ORF 756.a>:

```
a756.pep
   1 MTANFAQTLV EIQDSLXRVV STVQYGDDNL KRLTADKRKQ YELNFKISEG

51 STRVESDFKE TLVRFGRDML QDMPPKIRSA TLVALTTLLV GGALGYGYLE

101 YLKQVASEGY QTERLYNAVD RLAESQERIT SAILKGARGA DFVQIGRRSY

151 SREDISEANR RAERVPYGAE LVSDGNFTAV LSDIGD*
``` m756/a756 99.5% identity in 186 aa overlap

```
                  10         20         30         40         50         60
   m756.pep   MTANFAQTLVEIQDSLYRVVSTVQYGDDNLKRLTADKRKQYELNFKISEGSTRVESDFKE
              ||||||||||||||||| ||||||||||||||||||||||||||||||||||||||||||
       a756   MTANFAQTLVEIQDSLXRVVSTVQYGDDNLKRLTADKRKQYELNFKISEGSTRVESDFKE
                  10         20         30         40         50         60
```

-continued

```
                      70         80         90        100        110        120
m756.pep     TLVRFGRDMLQDMPPKIRSATLVALTTLLVGGALGYGYLEYLKQVASEGYQTERLYNAVD
             ||||||||||||||||||||||||||||||||||||||||||||||||||||||||||||
a756         TLVRFGRDMLQDMPPKIRSATLVALTTLLVGGALGYGYLEYLKQVASEGYQTERLYNAVD
                      70         80         90        100        110        120

130        140        150        160        170        180
m756.pep     RLAESQERITSAILKGARGADFVQIGRRSYSREDISEANRRAERVPYGAELVSDGNFTAV
             ||||||||||||||||||||||||||||||||||||||||||||||||||||||||||||
a756         RLAESQERITSAILKGARGADFVQIGRRSYSREDISEANRRAERVPYGAELVSDGNFTAV
                     130        140        150        160        170        180 m756.pep     LSDIGDX
             |||||||
a756         LSDIGDX g757.seq     not found yet g757.pep     not fiund yet
```

The following partial DNA sequence was identified in *N. meningitidis* <SEQ ID 2595>:

```
m757.seq
    1 ATGAAAATAC TCGCTTTATT AATTGCCGCT ACCTGTGCTT TATCTGCGTG

51 TGGCAGCCAA TCTGAAGAAC AACCGGCATC TGCACAACCC CAAGAGCAGG

101 CACAATCCGA ATTAAAAACC ATGCCGGTAA GCTATACCGA CTATCAATCA

151 GCAGCCAATA AAGGGCTGAA TGACCAAAAA ACCGGTCTGA CCCTTCCTGA

201 ACATGTTGTC CCTATCGACA ATGCGGAAGG AAAGAATCTG CTGCATGACT

251 TTTCAGACGG CCTCACAATC TTAACCGTTG ATACCGATAA AGCCGACAAA

301 ATTACTGCTG TCCGAGTAGT CTGGAATACA GATGCAATGC CTCAAAAAGC

351 GGAAAAACTG TCCAAAGCTG CCGCAGCCTT GATTGCGGCA ACCGCTCCGG

401 AAGACCGCAC AATGCTGCGT GATACCGGCG ACCAAATCGA AATGGCGATT

451 GACAGCCATA ATGCGCAAAA AGAGCCAACC CGAGAATGGG CGCGTGGTGG

501 GATTGCTTAT AAAGTCACTG TTACCAATTT ACCGAGCGTG GTTTTGACGG

551 CAAAAGCTGA GTAA
```

This corresponds to the amino acid sequence <SEQ ID 2596; ORF 757>:

```
m757.pep (lipoprotein)
    1 MKILALLIAA TCALSACGSQ SEEQPASAQP QEQAQSELKT MPVSYTDYQS

51 AANKGLNDQK TGLTLPEHVV PIDNAEGKNL LHDFSDGLTI LTVDTDKADK

101 ITAVRVVWNT DAMPQKAEKL SKAAAALIAA TAPEDRTMLR DTGDQIEMAI

151 DSHNAQKEPT REWARGGIAY KVTVTNLPSV VLTAKAE* a757.seq not found yet a757.pep not found yet g758.seq not found yet g758.pep not fiund yet
```

The following partial DNA sequence was identified in *N. meningitidis* <SEQ ID 2597>:

```
m758.seq
    1 ATGAACAATC TGACCGTGTT TACCCGTTTC GATACCGATT GGCGACGCT

51 TGCCGATGAA TTGCAATATG TGTGGGAACA CACCGCCGTT ACAGACCATC
```

-continued

```
101 AGGGCAAACT GGTGGAAATT CCCGTCTGCT ACGGCGGCGA ATACGGCCCG

151 GATTTGGCGG AAGTCGCTGC TTTCCATCAG ACGGTTATTT CCGAAATCGT

201 CCGCCGCCAT ACGGCGCAAA CTTATACCGT ATTTATGATG GGCTTCCAGC

251 CCGGTTTCCC TTATCTGGGC GGCTTGCCCG AAGCATTGCA CACGCCCCGC

301 CGTGCCGTGC CGAGAACGTC CGTTCCTGCC GGTTCGGTCG GTATCGGCGG

351 CAGTCAGACC GGTGTGTATC CGTTCGCTTC GCCCGGCGGC TGGCAGATTA

401 TCGGCAGAAC CGAATTACCC TTGTTCCGAG CCGATTTGAA TCCGCCGACC

451 CTGCTGGCGG CGGGTGACCA AGTCCGCTTT GTTGCAGAAA GGATTGAGCC

501 ATGA
```

This corresponds to the amino acid sequence <SEQ ID 2598; ORF 758>:

```
m758.pep
  1 MNNLTVFTRF DTDLATLADE LQYVWEHTAV TDHQGKLVEI PVCYGGEYGP

51 DLAEVAAFHQ TVISEIVRRH TAQTYTVFMM GFQPGFPYLG GLPEALHTPR

101 RAVPRTSVPA GSVGIGGSQT GVYPFASPGG WQIIGRTELP LFRADLNPPT

151 LLAAGDQVRF VAERIEP*
```

The following partial DNA sequence was identified in *N. meningitidis* <SEQ ID 2599>:

```
a758.seq
  1 ATGAACAATC TGACCGTGTT CACCCGTTTC GATACCGATT TGGCGACGCT

51 TGCCGATGAA TTGCAATATG TGTGGGAACA CACCGCCGTT ACAGACCATC

101 AGGGCAAACT GGTGGAAATT CCCGTCTGCT ACGGCGGCGA ATACGGCCCG

151 GATTTGGCGG AAGTCGCTGC TTTCCATCAG ACGGTTATTT CCGAAATCGT

201 CCGCCGCCAT ACGGCGCAAA CTTATACCGT ATTTATGATG GGCTTCCAGC

251 CTGGTTTCCC TTATCTGGGC GGCTTGCCCG AAGCATTGCA CACGCCCCGC

301 CGTGCCGTGC CGAGAACGTC CGTTCCTGCC GGTTCGGTCG GTATCGGCGG

351 CAGTCAGACC GGTGTGTATC CGTTCGCTTC GCCCGGCGGC TGGCAGATTA

401 TCGGCAGAAC CGAATTACCC TTGTTCCGAG CCGATTTGAA TCCGCCGACC

451 CTGCTGGCGG CGGGTGACCA AGTCCGCTTT GTTGCAGAAA GGATTGAGCC

501 ATGA
```

This corresponds to the amino acid sequence <SEQ ID 2600; ORF 758.a>:

```
a758.pep..
  1 MNNLTVFTRF DTDLATLADE LQYVWEHTAV TDHQGKLVEI PVCYGGEYGP

51 DLAEVAAFHQ TVISEIVRRH TAQTYTVFMM GFQPGFPYLG GLPEALHTPR

101 RAVPRTSVPA GSVGIGGSQT GVYPFASPGG WQIIGRTELP LFRADLNPPT

151 LLAAGDQVRF VAERIEP*
``` m758/a758 100.0% identity in 167 aa overlap

```
                     10        20        30        40        50        60
m758.pep    MNNLTVFTRFDTDLATLADELQYVWEHTAVTDHQGKLVEIPVCYGGEYGPDLAEVAAFHQ
            |||||||||||||||||||||||||||||||||||||||||||||||||||||||||||||
a758        MNNLTVFTRFDTDLATLADELQYVWEHTAVTDHQGKLVEIPVCYGGEYGPDLAEVAAFHQ
                     10        20        30        40        50        60

70        80        90       100       110       120
m758.pep    TVISEIVRRHTAQTYTVFMMGFQPGFPYLGGLPEALHTPRRAVPRTSVPAGSVGIGGSQT
            |||||||||||||||||||||||||||||||||||||||||||||||||||||||||||||
a758        TVISEIVRRHTAQTYTVFMMGFQPGFPYLGGLPEALHTPRRAVPRTSVPAGSVGIGGSQT
                     70        80        90       100       110       120

130       140       150       160
m756.pep    GVYPFASPGGWQIIGRTELPLFRADLNPPTLLAAGDQVRFVAERIEPX
            ||||||||||||||||||||||||||||||||||||||||||||||||
a758        GVYPFASPGGWQIIGRTELPLFRADLNPPTLLAAGDQVRFVAERIEPX
                    130       140       150       160 g759.seq    not found yet g759.pep    not found yet
```

The following partial DNA sequence was identified in *N. meningitidis* <SEQ ID 2601>:

```
m759.seq
     1  ATGCGCTTCA CACACACCAC CCCATTTTGT TCCGTATTGT CCACCCTCGG

51  TCTTTTTGCC GTTTCCCCTG CTTACTCATC CATTGTCCGC AACGATGTCG

101  ATTACCAATA TTTTCGCGAC TTTGCCGAAA ATAAAGGCGC GTTCACCGTA

151  GGTGCAAGCA ATATTTCCAT CCAAGACAAG CAAGGCAAAA TATTAGGCAG

201  GGTTCTCAAC GGCATCCCCA TGCCCGACTT CCGCGTCAGC AACCGCCAAA

251  CCGCCATCGC CACCCTGGTT CACCCCCAAT ACGTCAACAG TGTCAAACAC

301  AACGTCGGCT ACGGTTCCAT ACAATTCGGC AACGACACCC AAAATCCAGA

351  AGAACAAGCC TATACCTACC GCCTCGTATC ACGCAACCCG CACCCGGACT

401  ACGACTACCA CCTTCCCCGC CTCAACAAAC TGGTTACCGA AATCTCACCT

451  ACCGCACTCA GCAGCGTACC CTTGCTTGGA AACGGCCAGC CAAAGGCCAA

501  TGCCTACCTC GATACCGACC GCTTCCCCTA CTTTGTACGA CTCGGCTCAG

551  GCACGCAACA AGTCCGCAAA GCAGACGGCA CGCGTACACG AACCGCCCCG

601  GCATACCAAT ACCTGACCGG CGGCACGCCG CTGAAAGTAT TGGGGTTCCA

651  AAACCACGGC TTACTCGTCG GCGGCAGCCT GACCGACCAA CCCCTTAACA

701  CCTACGCAAT CGCCGGAGAC AGCGGTTCCC CCCTGTTTGC CTTCGACAAG

751  CATGAAAACC GCTGGGTGCT TGCGGGCGTA CTCAGCACCT ACGCCGGCTT

801  CGATAATTTC TTCAACAAAT ACATCGTCAC GCAACCCGAA TTCATCCGTT

851  CCACCATCCG CCAATACGAA ACCCGGCTGG ATGTCGGGCT GACCACCAAC

901  GAACTCATAT GGCGCGACAA CGGTAATGGC AACAGCACCC TGCAAGGGCT

951  CAACGAACGC ATCACCCTGC CCATTGCAAA CCCTTCGCTT GCCCCACAAA

1001  ACGACAGCAG GCACATGCCG TCTGAAGATG CCGGCAAAAC GCTCATCCTA

1051  TCCAGCAGGT TCGACAACAA AACACTGATG CTGGCAGACA ATATCAACCA

1101  AGGCGCAGGC GCATTGCAGT TCGACAGCAA CTTCACCGTC GTCGGTAAAA

1151  ACCACACATG GCAAGGTGCA GGCGTTATCG TAGCCGACGG CAAACGCGTC

1201  TTCTGGCAAG TCAGCAACCC CAAAGGCGAC CGGCTCTCCA AACTGGGCGC

1251  AGGCACGCTT ATCGCCAACG GACAAGGCAT CAACCAGGGC GACATCAGCA
```

-continued

```
1301 TCGGGGAAGG CACTGTCGTA CTCGCCCAAA AAGCTGCTTC AGACGGCAGC

1351 AAACAAGCAT TCAACCAAGT CGGCATCACC AGCGGCAGGG GCACGGCCGT

1401 CCTCGCCGAC AGCCAGCAAA TCAAACCCGA AAACCTCTAT TTCGGCTTCA

1451 GGGGCGGACG GCTCGACCTC AACGGCAACA ACCTTGCCTT TACCCATATC

1501 CGCCATGCGG ACGGCGGCGC GCAAATCGTC AATCACAACC CTGACCAAGC

1551 CGCGACACTG ACGCTGACCG GCAACCCCGT CCTCAGTCCC GAGCATGTCG

1601 AGTGGGTGCA ATGGGCAAC CGTCCGCAAG GCAACGCGGC GGTTTACGAA

1651 TACATCAACC CGCACCGCAA CCGTCGGACC GACTACTTCA TACTCAAACC

1701 CGGCGGCAAC CCGCGCGAAT TTTTCCCGTT AAATATGAAA AACTCAACAA

1751 GCTGGCAATT TATCGGCAAC AACAGGCAAC AGGCCGCCGA ACAAGTCGCC

1801 CAAGCCGAAA ATGCCCGCCC CGACCTGATT ACCTTCGGCG GATACTTGGG

1851 TGAAAACGCG CAAACGGGCA AAGCCGCGCC GAGTTACAGC AAAACCAATG

1901 AAGCAGCCAT AGAAAAAACC CGCCATATCG CAAATGCCGC CGTATACGGC

1951 CGGCCCGAAT ACCGTTACAA CGGCGCACTC AACCTGCACT ATCGTCCCAA

2001 ACGCACCGAC AGCACGCTGT TGCTCAACGG CGGCATGAAC CTTAACGGGG

2051 AAGTCTTGAT TGAGGGCGGC AATATGATTG TGTCAGGCAG GCCCGTACCC

2101 CATGCCTACG ACCACCAGGC CAAACGCGAA CCCGTTCTTG AAAACGAATG

2151 GACCGACGGC AGCTTCAAGG CTGCACGGTT CACCCTGCGA AACCATGCCC

2201 GACTGACGGC AGGGCGCAAT ACCGCGCATC TGGACGGCGA CATAACCGCA

2251 TACGATCTGT CCGGCATCGA CCTCGGCTTT ACCCAAGGCA AAACACCGGA

2301 ATGCTACCGC TCCTACCATA GCGGCAGCAC CCACTGCACA CCCAACGCCG

2351 TTTTAAAAGC CGAAAACTAT CGTGCACTAC CTGCAACGCA AGTACGCGGC

2401 GACATTACCC TTAACGACCG TTCAGAGCTC CGCCTGGGCA AGCACACCT

2451 GTACGGCAGC ATCCGTGCCG GCAAAGACAC CGCAGTCCGC ATGGAAGCAG

2501 ACAGCAACTG GACACTTTCC CAGTCCAGCC ACACCGGCGC ACTGACGCTT

2551 GACGGCGCAC AAATTACCCT GAACCCCGAT TTCGCCAATA ATACACACAA

2601 CAACCGCTTC AACACACTGA CCGTCAACGG CACACTTGAC GGGTTCGGCA

2651 CATTCCGATT CCTGACCGGC ATCGTCCGAA AACAAAATGC CCCCCCCCTC

2701 AAACTGGAAG GGGACAGCCG CGGCGCATTC CAAATCCACG TCAAAAACAC

2751 CGGACAAGAA CCTCAAACAA CCGAATCGCT TGCACTTGTG AGCCTCAATC

2801 CGAAACACAG CCACCAAGCC CGATTCACCC TCCAAAACGG CTATGCCGAT

2851 TTGGGTGCCT ACCGCTACAT CCTCCGCAAA AACAACAACG GATACAGCCT

2901 GTACAACCCG CTCAAAGAGG CCGAACTTCA AATTGAAGCC ACGCGTGCGG

2951 AACATGAGCG CAACCAACAG GCATACAACC AATTACAGGC AACCGACATC

3001 AGCAGACAGG TTCAACATGA CTCTGACGCG ACCAGGCAGG CACTACAGGC

3051 CTGGCAGAAC AGTCAAACCG AACTTGCCCG CATCGACAGC CAAGTCCAAT

3101 ATCTGTCCGC CCAATTGAAA CAGACAGACC CGCTGACCGG CATTCTGACG

3151 CGTGCCCAAA ACCTGTGTGC CGCACAAGGA TACAGTGCCG ATATCTGCCG

3201 TCAGGTTGCC AAAGCCGCCG ACACGAACGA CCTGACACTC TTCGAAACCG

3251 AACTGGATAC GTATATAGAA CGTGTAGAAA TGGCCGAATC CGAACTTGAC

3301 AAAGCACGGC AAGGCGGCGA TGCGCAAGCC GTCGAAACAG CCCGGCACGC
```

```
                            -continued
3351  CTACCTGAAC GCACTCAACC GTCTGTCCCG ACAAATCCAC AGTTTGAAAA

3401  CCGGCGTTGC CGGCATCCGT ATGCCGAACC TGGCCGAACT GATCAGCCGG

3451  TCGGCCAACA CCGCCGTTTC CGAACAGGCC GCCTACAATA CCGGCCGGCA

3501  ACAGGCGGGA CGCCGCATCG ACCGCCACCT TACCGATCCG CAGCAGCAAA

3551  ACATCTGGCT GGAAACCGGT ACGCAACAAA CCGACTACCA TAGCGGCACA

3601  CACCGTCCCT ACCAACAAAC TACCAACTAT GCACATATCG GCATCCAAAC

3651  CGGCATCACC GACCGTCTCA GTGTCGGTAC GATTTTAACC GATGAGCGCA

3701  CAAACAACCG TTTTGATGAA GGCGTATCCG CCCGAAACCG CAGCAACGGC

3751  GCACATCTGT TCGTCAAAGG GGAAAACGGC GCACTCTTTG CCGCGGCAGA

3801  TTTAGGCTAC AGCAACAGCC GTACCCGATT TACCGATTAT GACGGGGCTG

3851  CCGTCCGCCG CCACGCATGG GATGCAGGCA TCAACACCGG CATCAAAATC

3901  GATACCGGCA TCAACCTCAG ACCCTATGCC GGCATCCGTA TAAACCGCAG

3951  CAACGGCAAC CGGTACGTAC TCGACGGCGC AGAGATAAAC AGCCCGGCGC

4001  AAATCCAAAC CACATGGCAT GCCGGCATCC GTCTCGATAA AACCGTCGAA

4051  CTGGGTCAAG CCAAGCTGAC CCCCGCCTTC AGCAGCGATT ACTACCATAC

4101  CCGCCAAAAC AGCGGTTCCG CCCTCAGCGT CAACGACCGT ACCTTACTGC

4151  AGCAAGCCGC CCACGGCACA CTGCATACCC TGCAAATCGA CGCCGGATAC

4201  AAAGGCTGGA ACGCCAAACT TCATGCCGCT TACGGCAAAG ACAGCAACAC

4251  CGCCCGCCAC AAACAGGCAG GAATCAAAAT AGGCTACAAC TGGTAA
```

This corresponds to the amino acid sequence <SEQ ID 2602; ORF 759>:

```
m759.pep
    1 MRFTHTTPFC SVLSTLGLFA VSPAYSSIVR NDVDYQYFRD FAENKGAFTV

51 GASNISIQDK QGKILGRVLN GIPMPDFRVS NRQTAIATLV HPQYVNSVKH

101 NVGYGSIQFG NDTQNPEEQA YTYRLVSRNP HPDYDYHLPR LNKLVTEISP

151 TALSSVPLLG NGQPKANAYL DTDRFPYFVR LGSGTQQVRK ADGTRTRTAP

201 AYQYLTGGTP LKVLGFQNHG LLVGGSLTDQ PLNTYAIAGD SGSPLFAFDK

251 HENRWVLAGV LSTYAGFDNF FNKYIVTQPE FIRSTIRQYE TRLDVGLTTN

301 ELIWRDNGNG NSTLQGLNER ITLPIANPSL APQNDSRHMP SEDAGKTLIL

351 SSRFDNKTLM LADNINQGAG ALQFDSNFTV VGKNHTWQGA GVIVADGKRV

401 FWQVSNPKGD RLSKLGAGTL IANGQGINQG DISIGEGTVV LAQKAASDGS

451 KQAFNQVGIT SGRGTAVLAD SQQIKPENLY FGFRGGRLDL NGNNLAFTHI

501 RHADGGAQIV NHNPDQAATL TLTGNPVLSP EHVEWVQWGN RPQGNAAVYE

551 YINPHRNRRT DYFILKPGGN PREFFPLNMK NSTSWQFIGN NRQQAAEQVA

601 QAENARPDLI TFGGYLGENA QTGKAAPSYS KTNEAAIEKT RHIANAAVYG

651 RPEYRYNGAL NLHYRPKRTD STLLLNGGMN LNGEVLIEGG NMIVSGRPVP

701 HAYDHQAKRE PVLENEWTDG SFKAARFTLR NHARLTAGRN TAHLDGDITA

751 YDLSGIDLGF TQGKTPECYR SYHSGSTHCT PNAVLKAENY RALPATQVRG

801 DITLNDRSEL RLGKAHLYGS IRAGKDTAVR MEADSNWTLS QSSHTGALTL

851 DGAQITLNPD FANNTHNNRF NTLTVNGTLD GFGTFRFLTG IVRKQNAPPL
```

-continued

```
 901 KLEGDSRGAF QIHVKNTGQE PQTTESLALV SLNPKHSHQA RFTLQNGYAD

951 LGAYRYILRK NNNGYSLYNP LKEAELQIEA TRAEHERNQQ AYNQLQATDI

1001 SRQVQHDSDA TRQALQAWQN SQTELARIDS QVQYLSAQLK QTDPLTGILT

1051 RAQNLCAAQG YSADICRQVA KAADTNDLTL FETELDTYIE RVEMAESELD

1101 KARQGGDAQA VETARHAYLN ALNRLSRQIH SLKTGVAGIR MPNLAELISR

1151 SANTAVSEQA AYNTGRQQAG RRIDRHLTDP QQQNIWLETG TQQTDYHSGT

1201 HRPYQQTTNY AHIGIQTGIT DRLSVGTILT DERTNNRFDE GVSARNRSNG

1251 AHLFVKGENG ALFAAADLGY SNSRTRFTDY DGAAVRRHAW DAGINTGIKI

1301 DTGINLRPYA GIRINRSNGN RYVLDGAEIN SPAQIQTTWH AGIRLDKTVE

1351 LGQAKLTPAF SSDYYHTRQN SGSALSVNDR TLLQQAAHGT LHTLQIDAGY

1401 KGWNAKLHAA YGKDSNTARH KQAGIKIGYN W*
```

20

The following partial DNA sequence was identified in *N. gonorrhoeae* <SEQ ID 2603>:

```
g760.seq (partial)
   1 AACAACCGCA ACACCCGTTA CGCCGCATTG GGCAAACGCG TGATGGAAGG

51 CGTTGAGACC GAAATCAGCG GTGCGATTAC ACCGAAATGG CAAATCCATG

101 CAGGTTACAG CTATCTGCAC AGCCAAATCA AAACCGCCGC CAATCCACGC

151 GACGACGGCA TCTTCCTGCT GGTGCCCAAA CACAGCGCAA ACCTGTGGAC

201 GACTTACCAA GTTACGCCCG GGCTGACCGT CGGCGGCGGC GTGAACGCGA

251 TGAGCGGCAT TACTTCATCT GCAGGGATGC ATGCAGGCGG TTATGCCACG

301 TTCGATGCGA TGGCGGCATA CCGCTTCACG CCCAAGCTGA AGCTGCAAAT

351 CAATGCCGAC AACATCTTCA ACCGCCATTA CTACGCCCGC GTCGGCGGCA

401 CGAACACCTT TAACATTCCC GGTTCGGAGC GCAGCCTGAC GGCAAACCTG

451 CGTTACAGTT TTTAA
```

This corresponds to the amino acid sequence <SEQ ID 2604; ORF 760.ng>:

```
g760.pep (partial)
   1 NNRNTRYAAL GKRVMEGVET EISGAITPKW QIHAGYSYLH SQIKTAANPR

51 DDGIFLLVPK HSANLWTTYQ VTPGLTVGGG VNAMSGITSS AGMHAGGYAT

101 FDAMAAYRFT PKLKLQINAD NIFNRHYYAR VGGTNTFNIP GSERSLTANL

151 RYSF*
```

The following partial DNA sequence was identified in *N. meningitidis* <SEQ ID 2605>:

```
m760.seq
   1 ATGGGACAGT TTATGTCAGT TTTCCGCATC AATATGACCG CCGCCACGGT

51 TTTGGCAGCA CTCTCGTCTT CGGTTTTTGC CGCACAAACG GAAGGTTTGG

101 AAACCGTCCA TATTAAGGGT CAGCGTTCTT ACAACGCGAT TGCCACCGAG

151 AAAAACGGCG ATTACAGCTC GTTTGCCGCC ACCGTCGGTA CAAAAATCCC

201 CGCTTCTTTG CGCGAAATTC CGCAATCCGT CAGCATCATT ACCAACCAGC

251 AGGTCAAAGA CCGCAATGTT GATACGTTTG ACCAGTTGGC ACGCAAAACG
```

-continued

```
 301 CCCGGCCTGC GCGTGTTGAG CAACGACGAC GGACGCTCTT CGGTTTACGC

351 GCGCGGTTAC GAATACAGCG AATACAACAT CGACGGCCTG CCCGCGCAGA

401 TGCAGAGTAT CAACGGCACG CTGCCCAACC TGTTCGCCTT CGACCGCGTG

451 GAAGTGATGC GCGGGCCGAG CGGACTGTTC GACAGCAGCG GCGAGATGGG

501 CGGCATCGTG AATCTGGTGC GCAAACGCCC GACCAAAGCG TTCCAAGGTC

551 ATGCGGCGGC AGGGTTCGGT ACGCACAAAC AATATAAAGC CGAGGCGGAC

601 GTATCGGGCA GCCTCAATTC AGACGGCAGC GTGCGCGCC GCGTGATGGC

651 GCAGACCGTC GGCGCGTCTC CGCGTCCCGC CGAGAAAAAC AACCGGCGCG

701 AAACCTTCTA CGCGGCGGCG GATTGGGACA TCAACCCCGA TACGGTTTTG

751 GGCGCGGGCT ATCTTTACCA GCAACGCCGC CTCGCGCCGT ACAACGGCCT

801 GCCTGCCGAT GCCAATAACA AATTACCGTC CCTGCCGCAA CACGTATTTG

851 TCGGCGCGGA TTGGAACAAA TTTAAAATGC ACAGCCACGA CGTGTTCGCC

901 GATTTGAAAC ATTACTTCGG CAACGGCGGC TACGGCAAAG TCGGTATGCG

951 CTATTCCGAT CGGAAAGCCG ATTCCAATTA TACGTTTGCG GGCAGCAAAC

1001 TCAACAATAC CGGACAAGCC GACGTAGCGG GTTTGGGTAC GGACATTAAA

1051 CAAAAAGCCT TGCGGTTGA CGCAAGTTAC AGCCGTCCGT TTGCCTTGGG

1101 CAACACCGCC AACGAATTTG TGATTGGTGC AGACTACAAC CGCTTGCGCA

1151 GTACTAATGA ACAAGGGCGT TCGACTTTGT CAAAAAGCGT CGCTTTAGAT

1201 GGTTTCCGCG CTTTGCCTTA TAACGGCATA CTTCAGAACG CCCGCGCCGG

1251 AAACAAAGGT TTCAATCACT CCGTTACCGA AGAAACCTC GACGAAACCG

1301 GTTTGTATGC CAAGACGGTG TTCCGTCCTC TGGAAGGTTT GTCGTTGATT

1351 GCAGGCGGAC GTGTAGGACA TCACAAAATC GAGTCGGGCG ACGGCAAAAC

1401 CCTGCATAAA GCTTCGAAAA CCAAATTTAC AAGCTACGCC GGCGCGGTTT

1451 ACGATATAGA CGGCAGCAAC AGCCTGTACG CTTCCGCCTC CCAACTCTAC

1501 ACACCGCAAA CCAGCATCGG CACCGACGGC AAGCTGCTCA AACCGCGCGA

1551 AGGCAACCAG TTTGAAATCG GCTACAAAGG CAGCTACATG GACGACCGCC

1601 TCAATACCCG GGTTTCGTTC TACCGCATGA AGGATAAAAA CGCCGCCGCA

1651 CCGCTGGACT CAAACAACAA AAAAACCCGT TACGCCGCAT GGGCAAACG

1701 CGTGATGGAA GGTGTTGAGA CCGAAATCAG CGGCGCGATG ACACCGAAAT

1751 GGCAAATCCA TGCAGGTTAC AGCTACCTGC ACAGCCAAAT CAAAACCGCC

1801 TCCAATTCGC GCGACGAAGG CATCTTCCTG CTGATGCCCA ACACAGCGC

1851 AAACCTGTGG ACGACTTACC AAGTTACGTC CGGGCTGACC ATCGGCGGCG

1901 GCGTGAACGC GATGAGCGGC ATTACTTCAT CTGCAGGGAT ACATGCAGGC

1951 GGTTATGCCA CGTTCGATGC GATGGCGGCA TACCGCTTCA CGCCCAAACT

2001 GAAGCTGCAA ATCAACGCCG ACAACATCTT CAACCGCCAT TACTACGCCC

2051 GCGTCGGCAG CGAGAGCACC TTTAACATTC CCGGTTCGGA GCGCAGCCTG

2101 ACGGCAAACC TGCGTTACAG TTTTTAA
```

This corresponds to the amino acid sequence <SEQ ID 2606; ORF 760>:

```
m760.pep
   1 MGQFMSVFRI NMTAATVLAA LSSSVFAAQT EGLETVHIKG QRSYNAIATE

51 KNGDYSSFAA TVGTKIPASL REIPQSVSII TNQQVKDRNV DTFDQLARKT

101 PGLRVLSNDD GRSSVYARGY EYSEYNIDGL PAQMQSINGT LPNLFAFDRV

151 EVMRGPSGLF DSSGEMGGIV NLVRKRPTKA FQGHAAAGFG THKQYKAEAD

201 VSGSLNSDGS VRGRVMAQTV GASPRPAEKN NRRETFYAAA DWDINPDTVL

251 GAGYLYQQRR LAPYNGLPAD ANNKLPSLPQ HVFVGADWNK FKMHSHDVFA

301 DLKHYFGNGG YGKVGMRYSD RKADSNYTFA GSKLNNTGQA DVAGLGTDIK

351 QKAFAVDASY SRPFALGNTA NEFVIGADYN RLRSTNEQGR STLSKSVALD

401 GFRALPYNGI LQNARAGNKG FNHSVTEENL DETGLYAKTV FRPLEGLSLI

451 AGGRVGHHKI ESGDGKTLHK ASKTKFTSYA GAVYDIDGSN SLYASASQLY

501 TPQTSIGTDG KLLKPREGNQ FEIGYKGSYM DDRLNTRVSF YRMKDKNAAA

551 PLDSNNKKTR YAALGKRVME GVETEISGAM TPKWQIHAGY SYLHSQIKTA

601 SNSRDEGIFL LMPKHSANLW TTYQVTSGLT IGGGVNAMSG ITSSAGIHAG

651 GYATFDAMAA YRFTPKLKLQ INADNIFNRH YYARVGSEST FNIPGSERSL

701 TANLRYSF*
``` m760/g760 91.6% identity in 154 aa overlap

```
                530        540        550        560        570        580
    m760.pep    YKGSYMDDRLNTRVSFYRMKDKNAAAPLDSNNKKTRYAALGKRVMEGVETEISGAMTPKW
                            ||::||||||||||||||||||||||||||||:||||
        g760                                NNRNTRYAALGKRVMEGVETEISGAITPKW
                                                   10         20         30
                590        600        610        620        630        640
    m760.pep    QIHAGYSYLHSQIKTASNSRDEGIFLLMPKHSANLWTTYQVTSGLTIGGGVNAMSGITSS
                ||||||||||||||||||:|  |||||||:|||||||||||||  |||:|||||||||||
        g760    QIHAGYSYLHSQIKTAANPRDDGIFLLVPKHSANLWTTYQVTPGLTVGGGVNAMSGITSS
                    40         50         60         70         80         90
                650        660        670        680        690        700
    m760.pep    AGIHAGGYATFDAMAAYRFTPKLKLQINADNIFNRHYYARVGSESTFNIPGSERSLTANL
                ||:||||||||||||||||||||||||||||||||||||||||:  :|||||||||||||
        g760    AGMHAGGYATFDAMAAYRFTPKLKLQINADNIFNRHYYARVGGTNTFNIPGSERSLTANL
                   100        110        120        130        140        150
                709
    m760.pep    RYSFX
                |||||
        g760    RYSFX
    g761.seq not found yet
    g761.pep not found yet
```

The following partial DNA sequence was identified in *N. meningitidis* <SEQ ID 2607>:

```
m761.seq
   1 ATGAAAATAT CATTTCATTT AGCTTTATTA CCCACGCTGA TTATTGCTTC

51 CTTCCCTGTT GCTGCCGCCG ATACGCAGGA CAATGGTGAA CATTACACCG

101 CCACTCTGCC CACCGTTTCC GTGGTCGGAC AGTCCGACAC CAGCGTACTC

151 AAAGGCTACA TCAACTACGA CGAAGCCGCC GTTACCCGCA ACGGACAGCT

201 CATCAAAGAA ACGCCGCAAA CCATCGATAC GCTCAATATC CAGAAAAACA

251 AAAATTACGG TACGAACGAT TTGAGTTCCA TCCTCGAAGG CAATGCCGGC
```

-continued

```
 301 ATCGACGCTG CCTACGATAT GCGCGGTGAA AGCATTTTCC TGCGCGGTTT
 351 TCAAGCCGAC GCATCCGATA TTTACCGCGA CGGCGTGCGC GAAAGCGGAC
 401 AAGTGCGCCG CAGTACTGCC AACATCGAGC GCGTGGAAAT CCTGAAAGGC
 451 CCGTCTTCCG TGCTTTACGG CCGCACCAAC GGCGGCGGCG TCATCAACAT
 501 GGTCAGCAAA TACGCCAACT TCAAACAAAG CCGCAACATC GGAGCGGTTT
 551 ACGGCTCATG GGCAAACCGC AGCCTGAATA TGGACATTAA CGAAGTGCTG
 601 AACAAAAACG TCGCCATCCG TCTCACCGGC GAAGTCGGGC GCGCCAATTC
 651 GTTCCGCAGC GGCATAGACA GCAAAAATGT CATGGTTTCG CCCAGCATTA
 701 CCGTCAAACT CGACAACGGC TTGAAGTGGA CGGGGCAATA CACCTACGAC
 751 AATGTGGAGC GCACGCCCGA CCGCAGTCCG ACCAAGTCCG TGTACGACCG
 801 CTTCGGACTG CCTTACCGCA TGGGGTTCGC CCACCGGAAC GATTTTGTCA
 851 AAGACAAGCT GCAAGTTTGG CGTTCCGACC TTGAATACGC CTTCAACGAC
 901 AAATGGCGTG CCCAATGGCA GCTCGCCCAC CGCACGGCGG CGCAGGATTT
 951 TGATCATTTC TATGCAGGCA GCGAAAATGG CAACTTAATC AAACGTAACT
1001 ACGCCTGGCA GCAGACCGAC AACAAAACCC TGTCGTCCAA CTTAACGCTC
1051 AACGGCGACT ACACCATCGG CCGTTTTGAA AACCACCTGA CCGTAGGCAT
1101 GGATTACAGC CGCGAACACC GCAACCCGAC ATTGGGTTTC AGCAGCGCCT
1151 TTTCCGCCTC CATCAACCCC TACGACCGCG CAAGCTGGCC GGCTTCGGGC
1201 AGATTGCAGC CTATTCTGAC CCAAAACCGC CACAAAGCCG ACTCCTACGG
1251 CATCTTTGTG CAAAACATCT TCTCCGCCAC GCCCGATTTG AAATTCGTCC
1301 TCGGCGGCCG TTACGACAAA TACACCTTTA ATTCCGAAAA CAAACTCACC
1351 GGCAGCAGCC GCCAATACAG CGGACACTCG TTCAGCCCCA ACATCGGCGC
1401 AGTGTGGAAC ATCAATCCCG TCCACACACT TTACGCCTCG TATAACAAAG
1451 GCTTCGCGCC TTATGGCGGA CGCGGCGGCT ATTTGAGCAT CGATACGTTG
1501 TCTTCCGCCG TGTTCAACGC CGACCCCGAG TACACCCGCC AATACGAAAC
1551 CGGCGTGAAA AGCAGTTGGC TGGACGACCG CCTCAGCACT ACGTTGTCTG
1601 CCTACCAAAT CGAACGCTTC AATATCCGCT ACCGCCCCGA TCCAAAAAAC
1651 AACCCTTATA TTTATGCGGT TAGCGGCAAA CACCGTTCGC GCGGCGTGGA
1701 ATTGTCCGCC ATCGGGCAAA TCATCCCCAA AAAACTCTAT CTGCGCGGTT
1751 CGTTGGGCGT GATGCAGGCG AAAGTCGTTG AAGACAAAGA AAATCCCGAC
1801 CGAGTGGGCA TCCATTTGAA TAATACCAGC AACGTTACCG GCAACCTGTT
1851 TTTCCGTTAT ACCCCGACCG AAAACCTCTA CGGCGAAATC GGCGTAACCG
1901 GTACAGGCAA ACGCTACGGT TACAACTCAA GAAATAAAGA AGTGACTACG
1951 CTTCCAGGCT TTGCCCGAGT TGATGCCATG CTTGGCTGGA ACCATAAAAA
2001 TGTTAACGTT ACCTTTGCCG CAGCCAATCT GCTCAATCAA AATATTGGC
2051 GTTCGGACTC TATGCCGGGT AATCCGCGCG GCTATACTGC CCGGGTAAAT
2101 TACCGTTTCT GA
```

This corresponds to the amino acid sequence <SEQ ID 2608; ORF 761>:

```
m761.pep
   1 MKISFHLALL PTLIIASFPV AAADTQDNGE HYTATLPTVS VVGQSDTSVL

51 KGYINYDEAA VTRNGQLIKE TPQTIDTLNI QKNKNYGTND LSSILEGNAG

101 IDAAYDMRGE SIFLRGFQAD ASDIYRDGVR ESGQVRRSTA NIERVEILKG

151 PSSVLYGRTN GGGVINMVSK YANFKQSRNI GAVYGSWANR SLNMDINEVL

201 NKNVAIRLTG EVGRANSFRS GIDSKNVMVS PSITVKLDNG LKWTGQYTYD

251 NVERTPDRSP TKSVYDRFGL PYRMGFAHRN DFVKDKLQVW RSDLEYAFND

301 KWRAQWQLAH RTAAQDFDHF YAGSENGNLI KRNYAWQQTD NKTLSSNLTL

351 NGDYTIGRFE NHLTVGMDYS REHRNPTLGF SSAFSASINP YDRASWPASG

401 RLQPILTQNR HKADSYGIFV QNIFSATPDL KFVLGGRYDK YTFNSENKLT

451 GSSRQYSGHS FSPNIGAVWN INPVHTLYAS YNKGFAPYGG RGGYLSIDTL

501 SSAVFNADPE YTRQYETGVK SSWLDDRLST TLSAYQIERF NIRYRPDPKN

551 NPYIYAVSGK HRSRGVELSA IGQIIPKKLY LRGSLGVMQA KVVEDKENPD

601 RVGIHLNNTS NVTGNLFFRY TPTENLYGEI GVTGTGKRYG YNSRNKEVTT

651 LPGFARVDAM LGWNHKNVNV TFAAANLLNQ KYWRSDSMPG NPRGYTARVN

701 YRF*
```

The following partial DNA sequence was identified in *N. meningitidis* <SEQ ID 2609>:

```
a761.seq
   1 ATGAAAATAT CATTTCATTT AGCTTTATTA CCCACGCTGA TTATTGCTTC

51 CTTCCCTGTT GCTGCCGCCG ATACGCAGGA CAATGGTGAA CATTACACCG

101 CCACTCTGCC CACCGTTTCC GTGGTCGGAC AGTCCGACAC CAGCGTACTC

151 AAAGGCTACA TCAACTACGA CGAAGCCGCC GTTACCCGCA ACGGACAGCT

201 CATCAAAGAA ACGCCGCAAA CCATCGATAC GCTCAATATC CAGAAAAACA

251 AAAATTACGG CACGAACGAT TTGAGTTCCA TCCTCGAAGG CAATGCCGGC

301 ATCGACGCCG CCTACGATAT GCGCGGCGAA AGCATTTTCC TGCGCGGCTT

351 TCAAGCCGAC GCATCTGATA TTTACCGCGA CGGCGTACGC GAAAGCGGGC

401 AGGTGCGCCG TAGCACCGCC AACATCGAGC GCGTGGAAAT CCTGAAAGGT

451 CCGTCCTCCG TGCTTTATGG GCGTACCAAC GGCGGCGGTG TCATCAACAT

501 GGTCAGCAAA TACGCCAACT TCAAACAAAG CCGTAATATC GGTACGGTTT

551 ATGGTTCGTG GGCAAACCGC AGCCTGAATA TGGACATCAA CGAAGTGCTG

601 AACAAAAACG TCGCCATCCG TCTCACCGGC GAAGTCGGGC GCGCCAATTC

651 GTTCCGCAGC GGCATAGACA GCAAAAATGT CATGGTTTCG CCCAGCATTA

701 CCGTCAAACT CGACAACGGC TTGAAGTGGA CGGGGCAATA CACCTACGAC

751 AATGTGGAGC GCACGCCCGA CCGCAGTCCG ACCAAGTCCG TGTACGACCG

801 CTTCGGACTG CCTTACCGCA TGGGGTTCGC CCACCGGAAC GATTTTGTCA

851 AAGACAAGCT GCAAGTTTGG CGTTCCGACC TTGAATACGC CTTCAACGAC

901 AAATGGCGTG CCCAATGGCA GCTCGCCCAC CGCACGGCGG CGCAGGATTT

951 TGATCATTTC TATGCAGGCA GCGAAAATGG CAACTTAATC AAACGTAACT
```

-continued

```
1001 ACGCCTGGCA GCAGACCGAC AACAAACCC TGTCGTCCAA CTTAACGCTC

1051 AACGGCGACT ACACCATCGG CCGTTTTGAA AACCACCTGA CCGTAGGCAT

1101 GGATTACAGC CGCGAACACC GCAACCCGAC ATTGGGTTTC AGCAGCGCCT

1151 TTTCCGCCTC CATCAACCCC TACGACCGCG CAAGCTGGCC GGCTTCGGGC

1201 AGATTGCAGC CTATTCTGAC CCAAAACCGC CACAAAGCCG ACTCCTACGG

1251 CATCTTTGTG CAAAACATCT TCTCCGCCAC GCCCGATTTG AAATTCGTCC

1301 TCGGCGGCCG TTACGACAAA TACACCTTTA ATTCCGAAAA CAAACTCACC

1351 GGCAGCAGCC GCCAATACAG CGGACACTCG TTCAGCCCCA ACATCGGCGC

1401 AGTGTGGAAC ATCAATCCCG TCCACACACT TTACGCCTCG TATAACAAAG

1451 GCTTCGCGCC TTATGGCGGA CGCGGCGGCT ATTTGAGCAT CGATACGTTG

1501 TCTTCCGCCG TGTTCAACGC CGACCCCGAG TACACCCGCC AATACGAAAC

1551 CGGCGTGAAA AGCAGTTGGC TGGACGACCG CCTCAGCACT ACGTTGTCTG

1601 CCTACCAAAT CGAACGCTTC AATATCCGCT ACCGCCCCGA TCCAAAAAAC

1651 AACCCTTATA TTTATGCGGT TAGCGGCAAA CACCGTTCGC GCGGCGTGGA

1701 ATTGTCCGCC ATCGGGCAAA TCATCCCCAA AAACTCTAT CTGCGCGGTT

1751 CGTTGGGCGT GATGCAGGCG AAAGTCGTTG AAGACAAAGA AAATCCCGAC

1801 CGAGTGGGCA TCCATTTGAA TAACACCAGC AACGTTACCG GCAACCTGTT

1851 TTTCCGTTAT ACCCCGACCG AAAACCTCTA CGGCGAAATC GGCGTAACCG

1901 GTACAGGCAA ACGCTACGGT TACGACTCAA GAAATAAAGA AGTGACTACG

1951 CTTCCAGGCT TTGCCCGAGT TGATGCCATG CTTGGCTGGA ACCATAAAAA

2001 TGTTAACGTT ACCTTTGCCG CAGCCAATCT GTTCAATCAA AATATTGGC

2051 GTTCGGACTC TATGCCGGGT AATCCGCGCG GCTATACTGC CCGGGTAAAT

2101 TACCGTTTCT GA
```

This corresponds to the amino acid sequence <SEQ ID 2610; ORF 761.a>:

```
a761.pep
  1 MKISFHLALL PTLIIASFPV AAADTQDNGE HYTATLPTVS VVGQSDTSVL

51 KGYINYDEAA VTRNGQLIKE TPQTIDTLNI QKNKNYGTND LSSILEGNAG

101 IDAAYDMRGE SIFLRGFQAD ASDIYRDGVR ESGQVRRSTA NIERVEILKG

151 PSSVLYGRTN GGGVINMVSK YANFKQSRNI GTVYGSWANR SLNMDINEVL

201 NKNVAIRLTG EVGRANSFRS GIDSKNVMVS PSITVKLDNG LKWTGQYTYD

251 NVERTPDRSP TKSVYDRFGL PYRMGFAHRN DFVKDKLQVW RSDLEYAFND

301 KWRAQWQLAH RTAAQDFDHF YAGSENGNLI KRNYAWQQTD NKTLSSNLTL

351 NGDYTIGRFE NHLTVGMDYS REHRNPTLGF SSAFSASINP YDRASWPASG

401 RLQPILTQNR HKADSYGIFV QNIFSATPDL KFVLGGRYDK YTFNSENKLT

451 GSSRQYSGHS FSPNIGAVWN INPVHTLYAS YNKGFAPYGG RGGYLSIDTL

501 SSAVFNADPE YTRQYETGVK SSWLDDRLST TLSAYQIERF NIRYRPDPKN

551 NPYIYAVSGK HRSRGVELSA IGQIIPKKLY LRGSLGVMQA KVVEDKENPD

601 RVGIHLNNTS NVTGNLFFRY TPTENLYGEI GVTGTGKRYG YDSRNKEVTT
```

```
651 LPGFARVDAM LGWNHKNVNV TFAAANLFNQ KYWRSDSMPG NPRGYTARVN

701 YRF*
``` m761/a761 99.6% identity in 703 aa overlap

```
                     10        20        30        40        50        60
m761.pep    MKISFHLALLPTLIIASFPVAAADTQDNGEHYTATLPTVSVVGQSDTSVLKGYINYDEAA
            ||||||||||||||||||||||||||||||||||||||||||||||||||||||||||||
a761        MKISFHLALLPTLIIASFPVAAADTQDNGEHYTATLPTVSVVGQSDTSVLKGYINYDEAA
                     10        20        30        40        50        60

70        80        90       100       110       120
m761.pep    VTRNGQLIKETPQTIDTLNIQKNKNYGTNDLSSILEGNAGIDAAYDMRGESIFLRGFQAD
            ||||||||||||||||||||||||||||||||||||||||||||||||||||||||||||
a751        VTRNGQLIKETPQTIDTLNIQKNKNYGTNDLSSILEGNAGIDAAYDMRGESIFLRGFQAD
                     70        80        90       100       110       120

130       140       150       160       170       180
m761.pep    ASKIYRDGVRESGQVRRSTANIERVEILKGPSSVLYGRTNGGGVINMVSKYANFKQSRNI
            ||||||||||||||||||||||||||||||||||||||||||||||||||||||||||||
a761        ASKIYRDGVRESGQVRRSTANIERVEILKGPSSVLYGRTNGGGVINMVSKYANFKQSRNI
                    130       140       150       160       170       180

190       200       210       220       230       240
m761.pep    GAVYGSWANRSLNMDINEVLNKNVAIRLTGEVGRANSFRSGIDSKNVMVSPSITVKLDNG
            |:||||||||||||||||||||||||||||||||||||||||||||||||||||||||||
a761        GTVYGSWANRSLNMDINEVLNKNVAIRLTGEVGRANSFRSGIDSKNVMVSPSITVKLDNG
                    190       200       210       220       230       240

250       260       270       280       290       300
m761.pep    LKWTGQYTYDNVERTPDRSPTKSVYDRFGLPYRMGFAHRNDFVKDKLQVWRSDLEYAFND
            ||||||||||||||||||||||||||||||||||||||||||||||||||||||||||||
a761        LKWTGQYTYDNVERTPDRSPTKSVYDRFGLPYRMGFAHRNDFVKDKLQVWRSDLEYAFND
                    250       260       270       280       290       300

310       320       330       340       350       360
m761.pep    KWRAQWQLAHRTAAQDFDHFYAGSENGNLIKRNYAWQQTDNKTLSSNLTLNGDYTIGRFE
            ||||||||||||||||||||||||||||||||||||||||||||||||||||||||||||
a761        KWRAQWQLAHRTAAQDFDHFYAGSENGNLIKRNYAWQQTDNKTLSSNLTLNGDYTIGRFE
                    310       320       330       340       350       360

370       380       390       400       410       420
m761.pep    NHLTVGMDYSREHRNPTLGFSSAFSASINPYDRASWPASGRLQPILTQNRHKADSYGIFV
            ||||||||||||||||||||||||||||||||||||||||||||||||||||||||||||
a761        NHLTVGMDYSREHRNPTLGFSSAFSASINPYDRASWPASGRLQPILTQNRHKADSYGIFV
                    370       380       390       400       410       420

430       440       450       460       470       480
m761.pep    QNIFSATPDLKFVLGGRYDKYTFNSENKLTGSSRQYSGHSFSPNIGAVWNINPVHTLYAS
            ||||||||||||||||||||||||||||||||||||||||||||||||||||||||||||
a761        QNIFSATPDLKFVLGGRYDKYTFNSENKLTGSSRQYSGHSFSPNIGAVWNINPVHTLYAS
                    430       440       450       460       470       480

430       440       450       460       470       480
m761.pep    QNIFSATPDLKFVLGGRYDKYTFNSENKLTGSSRQYSGHSFSPNIGAVWNINPVHTLYAS
            ||||||||||||||||||||||||||||||||||||||||||||||||||||||||||||
a761        QNIFSATPDLKFVLGGRYDKYTFNSENKLTGSSRQYSGHSFSPNIGAVWNINPVHTLYAS
                    430       440       450       460       470       480

490       500       510       520       530       540
m761.pep    YNKGFAPYGGRGGYLSIDTLSSAVFNADPEYTRQYETGVKSSWLDDRLSTTLSAYQIERF
            ||||||||||||||||||||||||||||||||||||||||||||||||||||||||||||
a761        YNKGFAPYGGRGGYLSIDTLSSAVFNADPEYTRQYETGVKSSWLDDRLSTTLSAYQIERF
                    490       500       510       520       530       540

550       560       570       580       590       600
m761.pep    NIRYRPDPKNNPYIYAVSGKHRSRGVELSAIGQIIPKKLYLRGSLGVMQAKVVEDKENPD
            ||||||||||||||||||||||||||||||||||||||||||||||||||||||||||||
a761        NIRYRPDPKNNPYIYAVSGKHRSRGVELSAIGQIIPKKLYLRGSLGVMQAKVVEDKENPD
                    550       560       570       580       590       600

610       620       630       640       650       660
m761.pep    RVGIHLNNTSNVTGNLFFRYTPTENLYGEIGVTGTGKRYGYNSRNKEVTTLPGFARVDAM
            ||||||||||||||||||||||||||||||||||||||||||||||||||||||||||||
a761        RVGIHLNNTSNVTGNLFFRYTPTENLYGEIGVTGTGKRYGYDSRNKEVTTLPGFARVDAM
                    610       620       630       640       650       660

670       680       690       700
m761.pep    LGWNHKNVNVTFAAANLLNQKYWRSDSMPGNPRGYTARVNYRFX
            ||||||||||||||:|||||||||||||||||||||||||||||
a761        LGWNHKNVNVTFAAANLFNQKYWRSDSMPGNPRGYTARVNYRFX
                    670       680       690       700 g762.seq    Not yet found g762.pep    Not yet found
```

The following partial DNA sequence was identified in *N. meningitidis* <SEQ ID 2611>:

```
m762.seq
   1 ATGAAGTGGT TATTAAATAT GATAATGAGA CCTATTAAAT TTAGTATGGT

51 AAATACGTTA TTATTTATTG TTATATGTAG TTCATTTTTT GATCTGCTCG

101 TTCAATTATG TACAATTTTA TTTCATAGCC AAAAAATATA CTTTATTACA

151 TTATTTTTAT TATTTATTTT TAATTTTGTT ACAAAATCTA TCTATATGGC

201 AATTATTTAT CCTATTTTAT ATTTTTTTAC GATAAAAAAA TATTATCCTT

251 ACTCTAGGAA AGTGATAATT CTATTATCAT TAGCATTATC TATATATTTT

301 AGTTTTATGG ACTTTTACTT TTTTTCCATA TATTCAGATA ACCTTAGCTA

351 TGAAACGGAG CCTTTACATT TATACATCCC TATTATTATT AATTTTTTCT

401 CACTTTTAGT TTCTAATTTT ATTTTATCTT TTATCAACAA GTAA
```

This corresponds to the amino acid sequence <SEQ ID 2612; ORF 762>:

```
m762.pep
   1 MKWLLNMIMR PIKFSMVNTL LFIVICSSFF DLLVQLCTIL FHSQKIYFIT

51 LFLLFIFNFV TKSIYMAIIY PILYFFTIKK YYPYSRKVII LLSLALSIYF

101 SFMDFYFFSI YSDNLSYETE PLHLYIPIII NFFSLLVSNF ILSFINK*
```

The following partial DNA sequence was identified in *N. meningitidis* <SEQ ID 2613>:

```
a762.seq
   1 ATGAAGTGGT TATTAAATAT GATAATGAGA CCTATTAAAT TTAGTATGGT

51 AAATACGTTA TTATTTATTG TTATATGTAG TTCATTTTTT GATCTGCTCG

101 TTCAATTATG TACAATTTTA TTTCATAGCC AAAAAATATA CTTTATTACA

151 TTATTTTTAT TATTTATTTT TAATTTTGTT ACAAAATCTA TCTATATGGC

201 AATTATTTAT CCTATTTTAT ATTTTTTTAC GATAAAAAAA TATTATCCTT

251 ACTCTAGGAA AGTGATAATT CTATTATCAT TAGCATTATC TATATATTTT

301 AGTTTTATGG ACTTTTACTT TTTTTCCATA TATTCAGATA ACCTTAGCTA

351 TGAAACGGAG CCTTTACATT TATACATCCC TATTATTATT AATTTTTTCT

401 CACTTTTAGT TTCTAATTTT ATTTTATCTT TTATCAACAA
     GTAA
```

This corresponds to the amino acid sequence <SEQ ID 2614; ORF 762.a>:

```
a762.pep
   1 MKWLLNMIMR PIKFSMVNTL LFIVICSSFF DLLVQLCTIL FHSQKIYFIT

51 LFLLFIFNFV TKSIYMAIIY PILYFFTIKK YYPYSRKVII LLSLALSIYF

101 SFMDFYFFSI YSDNLSYETE PLHLYIPIII NFFSLLVSNF ILSFINK*
``` m762/a762 100.0% identity in 147 aa overlap

```
                    10        20        30        40        50        60
m762.pep    MKWLLNMIMPRIKFSMVNTLLFIVICSSFFDLLVQLCTILFHSQKIYFITLFLLFIFNFV
            ||||||||||||||||||||||||||||||||||||||||||||||||||||||||||||
a762        MKWLLNMIMPRIKFSMVNTLLFIVICSSFFDLLVQLCTILFHSQKIYFITLFLLFIFNFV
                    10        20        30        40        50        60
```

-continued

```
                   70        80        90       100       110       120
m762.pep    TKSIYMAIIYPILYFFTIKKYYPYSRKVIILLSLALSIYFSFMDFYFFSIYSDNLSYETE
            ||||||||||||||||||||||||||||||||||||||||||||||||||||||||||||
a762        TKSIYMAIIYPILYFFTIKKYYPYSRKVIILLSLALSIYFSFMDFYFFSIYSDNLSYETE
                   70        80        90       100       110       120

130       140
m762.pep    PLHLYIPIIINFFSLLVSNFILSFINKX
            ||||||||||||||||||||||||||||
a762        PLHLYIPIIINFFSLLVSNFILSFINKX
                  130       140 g763.seq    not yet found g763.pep    not yet found
```

The following partial DNA sequence was identified in *N. meningitidis* <SEQ ID 2615>:

```
m763.seq
   1 ATGACATTGC TCAATCTAAT GATAATGCAA GATTACGGTA TTTCCGTTTG
  51 CCTGACACTG ACGCCCTATT TGCAACATGA ACTATTTTCG GCTATGAAAT
 101 CCTATTTTTC CAAATATATC CTACCCGTTT CACTTTTTAC CTTGCCACTA
 151 TCCCTTTCCC CATCCGTTTC GGCTTTTACG CTGCCTGAAG CATGGCGGGC
 201 GGCGCAGCAA CATTCGGCTG ATTTTCAAGC GTCCCATTAC CAGCGTGATG
 251 CAGTGCGCGC ACGGCAACAA CAAGCCAAGG CCGCATTCCT TCCCCATGTA
 301 TCCGCCAATG CCAGCTACCA GCGCCAGCCG CCATCGATTT CTTCCACCCG
 351 CGAAACACAG GGATGGAGCG TGCAGGTGGG ACAAACCTTA TTTGACGCTG
 401 CCAAATTTGC ACAATACCGC CAAAGCAGGT TCGATACGCA GGCTGCAGAA
 451 CAGCGTTTCG ATGCGGCACG CGAAGAATTG CTGTTGAAAG TTGCCGAAAG
 501 TTATTTCAAC GTTTTACTCA GCCGAGACAC CGTTGCCGCC CATGCGGCGG
 551 AAAAAGAGGC TTATGCCCAG CAGGTAAGGC AGGCGCAGGC TTTATTCAAT
 601 AAAGGTGCTG CCACCGCGCT GGATATTCAC GAAGCCAAAG CCGGTTACGA
 651 CAATGCCCTG GCCCAAGAAA TCGCCGTATT GGCTGAGAAA CAAACCTATG
 701 AAAACCAGTT GAACGACTAC ACCGACCTGG ATAGCAAACA AATCGAGGCC
 751 ATAGATACCG CCAACCTGTT GGCACGCTAT CTGCCCAAGC TGGAACGTTA
 801 CAGTCTGGAT GAATGGCAGC GCATTGCCTT ATCCAACAAT CATGAATACC
 851 GGATGCAGCA GCTTGCCCTG CAAAGCAGCG GACAGGCGCT TCGGGCAGCA
 901 CAGAACAGCC GCTATCCCAC CGTTTCTGCC CATGTCGGCT ATCAGAATAA
 951 CCTCTACACT TCATCTGCGC AGAATAATGA CTACCACTAT CGGGGCAAAG
1001 GGATGAGCGT CGGCGTACAG TTGAATTTGC CGCTTTATAC CGGCGGAGAA
1051 TTGTCGGGCA AAATCCATGA AGCCGAAGCG CAATACGGGG CCGCCGAAGC
1101 ACAGCTGACC GCAACCGAGC GGCACATCAA ACTCGCCGTA CGCCAGGCTT
1151 ATACCGAAAG CGGTGCGGCG CGTTACCAAA TCATGGCGCA AGAACGGGTT
1201 TTGGAAAGCA GCCGTTTGAA ACTGAAATCG ACCGAAACCG GCCAACAATA
1251 CGGCATCCGC AACCGGCTGG AAGTAATACG GGCGCGGCAG GAAGTCGCCC
1301 AAGCAGAACA GAAACTGGCT CAAGCACGGT ATAAATTCAT GCTGGCTTAT
1351 TTGCGCTTGG TGAAAGAGAG CGGGTTAGGG TTGGAAACGG TATTTGCGGA
1401 ATAA
```

This corresponds to the amino acid sequence <SEQ ID 2616; ORF 763>:

```
m763.pep
   1 MTLLNLMIMQ DYGISVCLTL TPYLQHELFS AMKSYFSKYI LPVSLFTLPL

51 SLSPSVSAFT LPEAWRAAQQ HSADFQASHY QRDAVRARQQ QAKAAFLPHV

101 SANASYQRQP PSISSTRETQ GWSVQVGQTL FDAAKFAQYR QSRFDTQAAE

151 QRFDAAREEL LLKVAESYFN VLLSRDTVAA HAAEKEAYAQ QVRQAQALFN

201 KGAATALDIH EAKAGYDNAL AQEIAVLAEK QTYENQLNDY TDLDSKQIEA

251 IDTANLLARY LPKLERYSLD EWQRIALSNN HEYRMQQLAL QSSGQALRAA

301 QNSRYPTVSA HVGYQNNLYT SSAQNNDYHY RGKGMSVGVQ LNLPLYTGGE

351 LSGKIHEAEA QYGAAEAQLT ATERHIKLAV RQAYTESGAA RYQIMAQERV

401 LESSRLKLKS TETGQQYGIR NRLEVIRARQ EVAQAEQKLA QARYKFMLAY

451 LRLVKESGLG LETVFAE*
```

The following partial DNA sequence was identified in *N. meningitidis* <SEQ ID 2617>:

```
a763.seq
    1 ATGACATTGC TCAATCTAAT GATAATGCAA GATTACGGTA TTTCCGTTTG

51 CCTGACACTG ACGCCCTATT TGCAACATGA ACTATTTTCG GCTATGAAAT

101 CCTATTTTTC CAAATATATC CTACCCGTTT CACTTTTTAC CTTGCCACTA

151 TCCCTTTCCC CATCCGTTTC GGCTTTTACG CTGCCTGAAG CATGGCGGGC

201 GGCGCAGCAA CATTCGGCTG ATTTTCAAGC GTCCCATTAC AGCGTGATG

251 CAGTGCGCGC ACGGCAACAA CAAGCCAAGG CCGCATTCCT TCCCCATGTA

301 TCCGCCAATG CCAGCTACCA GCGCCAGCCG CCATCGATTT CTTCCACCCG

351 CGAAACACAG GGATGGAGCG TGCAGGTGGG ACAAACCTTA TTTGACGCTG

401 CCAAATTTGC ACAATACCGC CAAAGCAGGT TCGATACGCA GGCTGCAGAA

451 CAGCGTTTCG ATGCGGCACG CGAAGAATTG CTGTTGAAAG TTGCCGAAAG

501 TTATTTCAAC GTTTTACTCA GCCGAGACAC CGTTGCCGCC CATGCGGCGG

551 AAAAAGAGGC TTATGCCCAG CAGGTAAGGC AGGCGCAGGC TTTATTCAAT

601 AAAGGTGCTG CCACCGCGCT GGATATTCAC GAAGCCAAAG CCGGTTACGA

651 CAATGCCCTG GCCCAAGAAA TCGCCGTATT GGCTGAGAAA CAAACCTATG

701 AAAACCAGTT GAACGACTAC ACCGGCCTGG ACAGCAAACA AATCGAGGCC

751 ATAGATACCG CCAACCTGTT GGCACGCTAT CTGCCGAAGC TGGAACGTTA

801 CAGTCTGGAT GAATGGCAGC GCATTGCCTT ATCCAACAAT CATGAATACC

851 GGATGCAGCA GCTTGCCCTG CAAAGCAGCG GACAGGCGCT TCGGGCAGCA

901 CAGAACAGCC GCTATCCCAC CGTTTCTGCC CATGTCGGCT ATCAGAATAA

951 CCTCTACACT TCATCTGCGC AGAATAATGA CTACCACTAT CGGGGCAAAG

1001 GGATGAGCGT CGGCGTACAG TTGAATTTGC CGCTTTATAC CGGCGGAGAA

1051 TTGTCGGGCA AAATCCATGA AGCCGAAGCG CAATACGGGG CTGCCGAAGC

1101 ACAGCTGACC GCAACCGAGC GGCACATCAA ACTCGCCGTA CGCCAGGCTT

1151 ATACCGAAAG CGGTGCGGCG CGTTACCAAA TCATGGCGCA AGAACGGGTT

1201 TTGGAAAGCA GCCGTTTGAA ACTGAAATCG ACCGAAACCG GCCAACAATA
```

-continued

```
1251 CGGCATCCGC AACCGGCTGG AAGTAATACG GGCGCGGCAG GAAGTCGCCC

1301 AAGCAGAACA GAAACTGGCT CAAGCACGGT ATAAATTCAT GCTGGCTTAT

1351 TTGCGCTTGG TGAAAGAGAG CGGGTTAGGG TTGGAAACGG TATTTGCGGA

1401 ATAA
```

This corresponds to the amino acid sequence <SEQ ID 2618; ORF 763.a>:

```
a763.pep
  1 MTLLNLMIMQ DYGISVCLTL TPYLQHELFS AMKSYFSKYI LPVSLFTLPL

51 SLSPSVSAFT LPEAWRAAQQ HSADFQASHY QRDAVRARQQ QAKAAFLPHV

101 SANASYQRQP PSISSTRETQ GWSVQVGQTL FDAAKFAQYR QSRFDTQAAE

151 QRFDAAREEL LLKVAESYFN VLLSRDTVAA HAAEKEAYAQ QVRQAQALFN

201 KGAATALDIH EAKAGYDNAL AQEIAVLAEK QTYENQLNDY TGLDSKQIEA

251 IDTANLLARY LPKLERYSLD EWQRIALSNN HEYRMQQLAL QSSGQALRAA

301 QNSRYPTVSA HVGYQNNLYT SSAQNNDYHY RGKGMSVGVQ LNLPLYTGGE

351 LSGKIHEAEA QYGAAEAQLT ATERHIKLAV RQAYTESGAA RYQIMAQERV

401 LESSRLKLKS TETGQQYGIR NRLEVIRARQ EVAQAEQKLA QARYKFMLAY

451 LRLVKESGLG LETVFAE*
``` m763/a763 99.8% identity in 467 aa overlap

```
                  10         20         30         40         50         60
 m763.pep  MTLLNLMIMQDYGISVCLTLTPYLQHELFSAMKSYFSKYILPVSLFTLPLSLSPSVSAFT
           ||||||||||||||||||||||||||||||||||||||||||||||||||||||||||||
 a763      MTLLNLMIMQDYGISVCLTLTPYLQHELFSAMKSYFSKYILPVSLFTLPLSLSPSVSAFT
                  10         20         30         40         50         60

70         80         90        100        110        120
 m763.pep  LPEAWRAAQQHSADFQASHYQRDAVRARQQQAKAAFLPHVSANASYQRQPPSISSTRETQ
           ||||||||||||||||||||||||||||||||||||||||||||||||||||||||||||
 a763      LPEAWRAAQQHSADFQASHYQRDAVRARQQQAKAAFLPHVSANASYQRQPPSISSTRETQ
                  70         80         90        100        110        120

130        140        150        160        170        180
 m763.pep  GWSVQVGQTLFDAAKFAQYRQSRFDTQAAEQRFDAAREELLLKVAESYFNVLLSRDTVAA
           ||||||||||||||||||||||||||||||||||||||||||||||||||||||||||||
 a763      GWSVQVGQTLFDAAKFAQYRQSRFDTQAAEQRFDAAREELLLKVAESYFNVLLSRDTVAA
                 130        140        150        160        170        180

190        200        210        220        230        240
 m763.pep  HAAEKEAYAQQVRQAQALFNKGAATALDIHEAKAGYDNALAQEIAVLAEKQTYENQLNDY
           ||||||||||||||||||||||||||||||||||||||||||||||||||||||||||||
 a763      HAAEKEAYAQQVRQAQALFNKGAATALDIHEAKAGYDNALAQEIAVLAEKQTYENQLNDY
                 190        200        210        220        230        240

250        260        270        280        290        300
 m763.pep  TDLDSKQIEAIDTANLLARYLPKLERYSLDEWQRIALSNNHEYRMQQLALQSSGQALRAA
            |||||||||||||||||||||||||||||||||||||||||||||||||||||||||||
 a763      TGLDSKQIEAIDTANLLARYLPKLERYSLDEWQRIALSNNHEYRMQQLALQSSGQALRAA
                 250        260        270        280        290        300

310        320        330        340        350        360
 m763.pep  QNSRYPTVSAHVGYQNNLYTSSAQNNDYHYRGKGMSVGVQLNLPLYTGGELSGKIHEAEA
           ||||||||||||||||||||||||||||||||||||||||||||||||||||||||||||
 a763      QNSRYPTVSAHVGYQNNLYTSSAQNNDYHYRGKGMSVGVQLNLPLYTGGELSGKIHEAEA
                 310        320        330        340        350        360

370        380        390        400        410        420
 m763.pep  QYGAAEAQLTATERHIKLAVRQAYTESGAARYQIMAQERVLESSRLKLKSTETGQQYGIR
           ||||||||||||||||||||||||||||||||||||||||||||||||||||||||||||
 a763      QYGAAEAQLTATERHIKLAVRQAYTESGAARYQIMAQERVLESSRLKLKSTETGQQYGIR
                 370        380        390        400        410        420

430        440        450        460
 m763.pep  NRLEVIRARQEVAQAEQKLAQARYKFMLAYLRLVKESGLGLETVFAEX
           ||||||||||||||||||||||||||||||||||||||||||||||||
 a763      NRLEVIRARQEVAQAEQKLAQARYKFMLAYLRLVKESGLGLETVFAEX
                 430        440        450        460
```

```
g764.seq    not found yet g764.pep    not found yet
```

The following partial DNA sequence was identified in *N. meningitidis* <SEQ ID 2619>:

```
m764.seq
    1 ATGTTTTTCT CCGCCCTGAA ATCCTTTCTT TCTCGATACA TTACTGTATG

51 GCGCAATGTT TGGGCGGTGC GCGACCAGTT GAAACCGCCC AAACGCACGG

101 CGGAAGAACA GGCGTTTTTG CCCGCGCATT TGGAACTGAC CGATACGCCG

151 GTCTCTGCCG CTCCGAAATG GGCGGCGCGT TTTATTATGG CGTTTGCGCT

201 TTTGGCTTTG TTGTGGTCCT GGTTCGGCAA AATCGATATT GTGGCGGCGG

251 CTTCGGGCAA AACGGTGTCG GCGGGCGCA GCAAAACCAT CCAGCCGCTG

301 GAAACGGCGG TGGTTAAGGC GGTACATGTG CGCGACGGGC AGCATGTGAA

351 ACAGGGAGAA ACGCTGGCGG AACTGGAGGC TGTGGGAACA GACAGCGATG

401 TGGTGCAGTC GGAGCAGGCT TTGCAGGCTG CCCAATTGTC CAAACTGCGT

451 TATGAAGCGG TATTGGCGGC ATTGGAAAGC CGTACCGTGC CGCATATCGA

501 TATGGCGCAA GCACGGTCTT TAGGTCTCTC CGATGCCGAT GTGCAATCGG

551 CGCAGGTGTT GGCGCAGCAC CAGTATCAGG CATGGGCGGC GCAGGATGCG

601 CAATTGCAGT CGGCTTTGCG CGGCCATCAG GCGGAATTGC AGTCGGCCAA

651 GGCGCAGGAG CAGAAGCTGG TTTCGGTGGG GGCGATCGAG CAGCAGAAAA

701 CAGCAGACTA CCGCCGTTTG CGGGCCGACA ATTTTATTTC GGAACATGCG

751 TTTTTGGAGC AGCAGAGCAA ATCGGTCAGC AATTGGAACG ATTTGGAAAG

801 TACGCGCGGT CAGATGAGGC AGATTCAGGC GGCCATTGCA CAGGCGGAGC

851 AGAATCGGGT GCTGAATACG CAGAACCTGA AACGCGATAC GCTGGATGCG

901 CTGCGCCAGG CAAACGAACA GATTGACCAA TACCGCGGCC AAACGGATAA

951 GGCAAAGCAG CGGCAGCAGC TGATGACAAT ACAGTCGCCT GCGGACGGCA

1001 CGGTGCAGGA ATTGGCTACC TATACGGTGG CGGTGTGGT GCAGGCTGCC

1051 CAAAAAATGA TGGTGATTGC GCCCGATGAC GACAAAATGG ACGTGGAAGT

1101 TTTGGTATTG AACAAAGACA TCGGTTTTGT GGAACAGGGA CAGGATGCGG

1151 TGGTGAAGAT TGAGAGCTTT CCCTATACGC GCTACGGTTA TCTGACGGGC

1201 AAGGTGAAAA GTGTCAGCCA TGATGCGGTA AGCCACGAAC AGTTGGGCTT

1251 GGTTTATACG GCGGTGGTGT CGCTGGACAA ACATACCTTG AATATTGACG

1301 GCAAAGCAGT GAATCTGACG GCGGGCATGA ATGTCACGGC GGAGATTAAA

1351 ACGGGTAAAC GGCGGGTGCT GGATTATCTG TTAAGCCCGC TGCAAACCAA

1401 ATTGGACGAA AGCTTTAGGG AGCGATAG
```

This corresponds to the amino acid sequence <SEQ ID 2620; ORF 764>:

```
m764.pep
    1 MFFSALKSFL SRYITVWRNV WAVRDQLKPP KRTAEEQAFL PAHLELTDTP

51 VSAAPKWAAR FIMAFALLAL LWSWFGKIDI VAAASGKTVS GGRSKTIQPL

101 ETAVVKAVHV RDGQHVKQGE TLAELEAVGT DSDVVQSEQA LQAAQLSKLR
```

-continued

```
151 YEAVLAALES RTVPHIDMAQ ARSLGLSDAD VQSAQVLAQH QYQAWAAQDA

201 QLQSALRGHQ AELQSAKAQE QKLVSVGAIE QQKTADYRRL RADNFISEHA

251 FLEQQSKSVS NWNDLESTRG QMRQIQAAIA QAEQNRVLNT QNLKRDTLDA

301 LRQANEQIDQ YRGQTDKAKQ RQQLMTIQSP ADGTVQELAT YTVGGVVQAA

351 QKMMVIAPDD DKMDVEVLVL NKDIGFVEQG QDAVVKIESF PYTRYGYLTG

401 KVKSVSHDAV SHEQLGLVYT AVVSLDKHTL NIDGKAVNLT AGMNVTAEIK

451 TGKRRVLDYL LSPLQTKLDE SFRER*
```

The following partial DNA sequence was identified in *N. meningitidis* <SEQ ID 2621>:

```
a764.seq (partial)
   1 ATGTTTTTCT CCGCCCTGAA ATCCTTTCTT TCCCGCTACA TTACCGTATG

51 GCGCAATGTT TGGGCGGTGC GCGACCAGTT GGAACCGCCC AAACGCACGG

101 CGGAAGAACA GGCGTTTTTG CCCGCGCATT TGGAACTGAC CGATACGCCG

151 GTCTCTGCCG CTCCGAAATG GGCGGCGCGT TTTATTATGG CGTTTGCGCT

201 TTTGGCTTTG TTGTGGTCCT GGTTCGGCAA AATCGATATT GTGGCGGCGG

251 CTTCGGGCAA AACGGTGTCG GGCGGGCGCA GCAAAACCAT CCAGCCGCTG

301 GAAACGGTGG TGGTTAAGGC GGTACATGTG CGCGACGGGC AGCATGTGAA

351 ACAGGGAGAA ACGCTGGCGG AACTGGAGGC TGTGGGAACA GACAGCGATG

401 TGGTGCAGTC GGAGCAGGCT TTGCAGGCTG CCCAATTGTC CAAACTGCGT

451 TATGAAGCGG TATTGGCGGC ATTGGAAAGC CGTACCGTGC CGCATATCGA

501 TATGGCGCAA GCACGGTCTT TAGGTCTCTC CGATGCCGAT GTGCAATCGG

551 CGCAGGTGTT GGCGCAGCAC CAGTATCAGG CATGGGCGGC GCAGGATGCG

601 CAATTGCAGT CGGCTTTGCG CGGCCATCAG GCGGAATTGC AGTCGGCCAA

651 GGCGCAGGAG CAGAAGCTGG TTTCGGTGGG GGCGATCGAG CAGCAGAAAA

701 CAGCAGACTA CCGCCGTTTG CGGGCCGACA ATTTTATTTC GGAACATGCG

751 TTTTTGGAGC AGCAGAGCAA ATCGGTCAGC AATTGGAACG ATTTGGAAAG

801 TACGCGCGGT CAGATGAGGC AGATTCAGGC GGCCATTGCA CAGGCGGAGC

851 AGAATCGGGT GCTGAATACG CAGAACCTGA AACGCGATAC GCTGGATGCG

901 CTGCGCCAGG CAAACGAACA GATTGACCAA TACCGCGGCC AAACGGATAA

951 GGCAAAGCAG CGGCAGCAGC TGATGACAAT ACAGTCGCCT GCGGACGGCA

1001 CGGTGCAGGA ATTGGCCACC TATACGGTGG GCGGTGTGGT GCAGGCTGCC

1051 CAAAAAATGA TGGTGGTTGC GCCCGATGAC GACAAAATGG ACGTGGAAGT

1101 TTTGGTATTG AACAAAGACA TCGGTTTTGT GGAACAGGGA CAGGATGCGG

1151 TGGTGAAGAT TGAGAGTTTT CCCTATACGC GCTACGGTTA TCTGACGGGC

1201 AAGGTGAAAA GTGTCAGCCA TGATGCGGTA AGCCACGAAC AGTTGGGCTT

1251 GGTTTATACG GCGGTGGTGT CGCTGGACAA ACATACCTTG AATATTGACG

1301 GCAAA
```

This corresponds to the amino acid sequence <SEQ ID 2622; ORF 764.a>.

```
a764.pep (partial)
   1 MFFSALKSFL SRYITVWRNV WAVRDQLEPP KRTAEEQAFL PAHLELTDTP

51 VSAAPKWAAR FIMAFALLAL LWSWFGKIDI VAAASGKTVS GGRSKTIQPL

101 ETVVVKAVHV RDGQHVKQGE TLAELEAVGT DSDVVQSEQA LQAAQLSKLR

151 YEAVLAALES RTVPHIDMAQ ARSLGLSDAD VQSAQVLAQH QYQAWAAQDA

201 QLQSALRGHQ AELQSAKAQE QKLVSVGAIE QQKTADYRRL RADNFISEHA

251 FLEQQSKSVS NWNDLESTRG QMRQIQAAIA QAEQNRVLNT QNLKRDTLDA

301 LRQANEQIDQ YRGQTDKAKQ RQQLMTIQSP ADGTVQELAT YTVGGVVQAA

351 QKMMVVAPDD DKMDVEVLVL NKDIGFVEQG QDAVVKIESF PYTRYGYLTG

401 KVKSVSHDAV SHEQLGLVYT AVVSLDKHTL NIDGK
``` m764/a764 99.3% identity in 435 aa overlap

```
                        10         20         30         40         50         60
    m764.pep    MFFSALKSFLSRYITVWRNVWAVRDQLKPPKRTAEEQAFLPAHLELTDTPVSAAPKWAAR
                ||||||||||||||||||||||||||| :|||||||||||||||||||||||||||||||
    a764        MFFSALKSFLSRYITVWRNVWAVRDQLEPPKRTAEEQAFLPAHLELTDTPVSAAPKWAAR
                        10         20         30         40         50         60

70         80         90        100        110        120
    m764.pep    FIMAFALLALLWSWFGKIDIVAAASGKTVSGGRSKTIQPLETAVVKAVHVRDGQHVKQGE
                |||||||||||||||||||||||||||||||||||||||||| |||||||||||||||||
    a764        FIMAFALLALLWSWFGKIDIVAAASGKTVSGGRSKTIQPLETVVVKAVHVRDGQHVKQGE
                        70         80         90        100        110        120

130        140        150        160        170        180
    m764.pep    TLAELEAVGTDSDVVQSEQALQAAQLSKLRYEAVLAALESRTVPHIDMAQARSLGLSDAD
                ||||||||||||||||||||||||||||||||||||||||||||||||||||||||||||
    a764        TLAELEAVGTDSDVVQSEQALQAAQLSKLRYEAVLAALESRTVPHIDMAQARSLGLSDAD
                       130        140        150        160        170        180

190        200        210        220        230        240
    m764.pep    VQSAQVLAQHQYQAWAAQDAQLQSALRGHQAELQSAKAQEQKLVSVGAIEQQKTADYRRL
                ||||||||||||||||||||||||||||||||||||||||||||||||||| ||||||||
    a764        VQSAQVLAQHQYQAWAAQDAQLQSALRGHQAELQSAKAQEQKLVSVGATEQQKTADYRRL
                       190        200        210        220        230        240

250        260        270        280        290        300
    m764.pep    RADNFISEHAFLEQQSKSVSNWNDLESTRGQMRQIQAAIAQAEQNRVLNTQNLKRDTLDA
                ||||||||||||||||||||||||||||||||||||||||||||||||||||||||||||
    a764        RADNFISEHAFLEQQSKSVSNWNDLESTRGQMRQIQAAIAQAEQNRVLNTQNLKRDTLDA
                       250        260        270        280        290        300

310        320        330        340        350        360
    m764.pep    LRQANEQIDQYRGQTDKAKQRQQLMTIQSPADGTVQELATYTVGGVVQAAQKMMVIAPDD
                |||||||||||||||||||||||||||||||||||||||||||||||||||||| |||||
    a764        LRQANEQIDQYRGQTDKAKQRQQLMTIQSPADGTVQELATYTVGGVVQAAQKMMVVAPDD
                       310        320        330        340        350        360

370        380        390        400        410        420
    m764.pep    DKMDVEVLVLNKDIGFVEQGQDAVVKIESFPYTRYGYLTGKVKSVSHDAVSHEQLGLVYT
                ||||||||||||||||||||||||||||||||||||||||||||||||||||||||||||
    a764        DKMDVEVLVLNKDIGFVEQGQDAVVKIESFPYTRYGYLTGKVKSVSHDAVSHEQLGLVYT
                       370        380        390        400        410        420

430        440        450        460        470
    m764.pep    AVVSLDKHTLNIDGKAVNLTAGMNVTAEIKTGKRRVLDYLLSPLQTKLDESFRERX
                |||||||||||||||
    a764        AVVSLDKHTLNIDGK
                       430 g765.seq    not yet found g765.pep    not yet found
```

The following partial DNA sequence was identified in *N. meningitidis* <SEQ ID 2623>:

```
m765.seq
   1 ATGTTAAGAT GCCGTCCGAA ATCCGTTTTG GATTCAGACG GCATTTTTTT

51 GAAATTTAAT TTTTTAAGGA GTAAACCTAA ATATGAAATT TCCTTCCTTC
```

```
-continued
101 CTTCCTTTAA ACGGATACTC TGCCTGTCGG CAGTAATCTC GGTATTGGGG

151 GCTTGTGCGG TCGTTGCTGA TGTTTACGGT CATGATTCCG CCACAATGAA

201 CGCTGCGGCT GCCAAAGATT ATATGAAAAC GGTTGAGTTA AACAAGTCTG

251 CCGGCAATGT CGATACCACA TCCAGAACAG CCCGCAGGGT GCAGGCAGTA

301 TTTCGACGTA TGCTGCCTTA TGCCGATGCG GCAAATAATA CCAGCCATAA

351 GTTTGACTGG AAAATGACGG TTTTCAAAAA CGATGAGCTG AACGCGTGGG

401 CAATGCCCGG TGGAAAAATG GCGTTTTATA CGGGGATAGT CGACAAACTC

451 AAGCTGACCG ATGACGAAAT TGCCGCCATT ATGGGGCATG AAATGACGCA

501 CGCCCTGCAT GAACACGGTA AAAATAAGGT CGGGCAGCAA ATCTTGACCA

551 ATACGGCGGC GCAGATAGGC ACGCAGATTA TATTAGACAA AAAACCGGAT

601 ACTAATCCGG AATTGGTCGG ATTGGGTATG GATATTTTGG GGACGTACGG

651 TCTTACCTTG CCTTATAGCC GCAGCTTGGA AGAAGAAGCC GATGAGGGGG

701 GAATGATGTT GATGGCGCAG GCAGGCTATC ATCCGGCGGC CGCTGTCAGG

751 GTTTGGGAAA AAATGAATCA GGAAAACGAC CAAAACGGCT TTATTTATGC

801 TATTACCTCT ACTCATCCGA CAAACAATGC CCGTATAGAA AATCTAAAAC

851 GGTTGTTGCC GACCGTTATG CCGGTTTATG AGCAAAGTGT CAGAAATAAG

901 GGGCGCGTTA ATAAAAAACG TCGGCGTTAA
```

This corresponds to the amino acid sequence <SEQ ID 2624; ORF 765>:

```
m765.pep
    1 MLRCRPKSVL DSDGIFLKFN FLRSKPKYEI SFLPSFKRIL CLSAVISVLG

51 ACAVVADVYG HDSATMNAAA AKDYMKTVEL NKSAGNVDTT SRTARRVQAV

101 FRRMLPYADA ANNTSHKFDW KMTVFKNDEL NAWAMPGGKM AFYTGIVDKL

151 KLTDDEIAAI MGHEMTHALH EHGKNKVGQQ ILTNTAAQIG TQIILDKKPD

201 TNPELVGLGM DILGTYGLTL PYSRSLEEEA DEGGMMLMAQ AGYHPAAAVR

251 VWEKMNQEND QNGFIYAITS THPTNNARIE NLKRLLPTVM PVYEQSVRNK

301 GRVNKKRRR*
```

The following partial DNA sequence was identified in *N. meningitidis* <SEQ ID 2625>:

```
a765.seq
    1 ATGTTAAGAT GCCGTCCGAA ATCCGTTTTG GATTCAGACG GCATTTTTTT

51 GAAATTTAAT TTTTTAAGGA GTAAACCTAA ATATGAAATT TCCTTCCTTC

101 CTTCCTTTAA ACGGATACTC TGCCTGTCGG CAGTAATCTC GGTATTGGGG

151 GCTTGTACGG TCGTTGCTGA TGTTTACGGT CAGGATTCCG CCACAATGAA

201 TGCTGCGGCT GCCGAAGATT ATATGAAAAC GGTTGAGTTG AACAAGTCTG

251 CCGGCAATGT CGATACTACA TCCAAAACAG CCCGTAGGGT GCAGGCAGTA

301 TTTCGACGTA TGTTGCCTTA TGCCGATGCG GCAAATAATA CCGGCCATAA

351 GTTTGACTGG AAAATGACGG TTTTCAAAAA CGATGAGCTG AACGCGTGGG

401 CAATGCCCGG CGGGAAAATG GCGTTTTATA CGGGGATAGT CGATAAACTT

451 AAGCTGACCG ATGGCGAAAT TGCCGCCATT ATGGGGCATG AAATGACGCA
```

-continued

```
501 TGCCCTGCAT GAACACGGTA AAAATAAGGT CGGGCAGAAA ATCTTGACTA

551 ATATGGCGGC GCAGATAGGC ACGCAGATTA TATTAGACAA AAAACCGGAC

601 ACTAATCCGG AATTGGTCGG ATTGGGTATG GATATTTTGG GGATGTACGG

651 CATTACCTTG CCTTATAGCC GCAGCTTGGA AGAAGAAGCC GATGAGGGGG

701 GAATGATGTT GATGGCGCAG GCAGGCTATC ATCCGGCAGC CGCTGTCAGG

751 GTTTGGGAAA AAATGAATCA GGAAAACGAC CAAAACGGCT TTATTTATGC

801 TATTACCTCT ACTCATCCGA CAAACAATGC CCGTATAGAA AATCTAAAAC

851 GGTTGTTGCC GACCGTTATG CCGGTTTATG AGCACAGTGT TAGAAATAAG

901 GGGCGCGTTA ATAAAAACCG TCGGCGTTAA
```

This corresponds to the amino acid sequence <SEQ ID 2626; ORF 765.a>:

```
a765.pep
  1 MLRCRPKSVL DSDGIFLKFN FLRSKPKYEI SFLPSFKRIL CLSAVISVLG

51 ACTVVADVYG QDSATMNAAA AEDYMKTVEL NKSAGNVDTT SKTARRVQAV

101 FRRMLPYADA ANNTGHKFDW KMTVFKNDEL NAWAMPGGKM AFYTGIVDKL

151 KLTDGEIAAI MGHEMTHALH EHGKNKVGQK ILTNMAAQIG TQIILDKKPD

201 TNPELVGLGM DILGMYGITL PYSRSLEEEA DEGGMMLMAQ AGYHPAAAVR

251 VWEKMNQEND QNGFIYAITS THPTNNARIE NLKRLLPTVM PVYEHSVRNK

301 GRVNKNRRR*
```

Computer analysis of this amino acid sequence gave the following results:

Homology with a Predicted ORF from *N. meningitidis*

ORF 765 shows 96.18% identity over a 309 aa overlap with a predicted ORF (ORF 765) from *N. meningitidis*:

```
m765/a765  96.1% identity in 309 aa overlap
                    10         20         30         40         50         60
      m765.pep  MLRCRPKSVLDSDGIFLKFNFLRSKPKYEISFLPSFKRILCLSAVISVLGACAVVADVYG
                |||||||||||||||||||||||||||||||||||||||||||||||||:||||||
         a765  MLRCRPKSVLDSDGIFLKFNFLRSKPKYEISFLPSFKRILCLSAVISVLGACTVVADVYG
                    10         20         30         40         50         60

70         80         90        100        110        120
      m765.pep  HDSATMNAAAAKDYMKTVELNKSAGNVDTTSRTARRVQAVFRRMLPYADAANNTSHKFDW
                :||||||||||:|||||||||||||||||||:|||||||||||||||||||||:|||||
         a765  QDSATMNAAAAEDYMKTVELNKSAGNVDTTSKTARRVQAVFRRMLPYADAANNTGHKFDW
                    70         80         90        100        110        120

130        140        150        160        170        180
      m765.pep  KMTVFKNDELNAWAMPGGKMAFYTGIVDKLKLTDDEIAAIMGHEMTHALHEHGKNKVGQQ
                |||||||||||||||||||||||||||||||| |||||||||||||||||||||||||:
         a765  KMTVFKNDELNAWAMPGGKMAFYTGIVDKLKLTDGEIAAIMGHEMTHALHEHGKNKVGQK
                   130        140        150        160        170        180

190        200        210        220        230        240
      m765.pep  ILTNTAAQIGTQIILDKKPDTNPELVGLGMDILGTYGLTLPYSRSLEEEADEGGMMLMAQ
                |||| ||||||||||||||||||||||||||||| ||:|||||||||||||||||||||
         a765  ILTNMAAQIGTQIILDKKPDTNPELVGLGMDILGMYGITLPYSRSLEEEADEGGMMLMAQ
                   190        200        210        220        230        240

250        260        270        280        290        300
      m765.pep  AGYHPAAAVRVWEKMNQENDQNGFIYAITSTHPTNNARIENLKRLLPTVMPVYEQSVRNK
                ||||||||||||||||||||||||||||||||||||||||||||||||||||||:||||
         a765  AGYHPAAAVPVWEKMNQENDQNGFIYAITSTHPTNNARIENLKRLLPTVMPVYEHSVRNK
                   250        260        270        280        290        300

310
      m765.pep  GRVNKKRRRX
                |||||:||||
         a765  GRVNKNRRRX
                   310
```

The following partial DNA sequence was identified in *N. gonorrhoeae* <SEQ ID 2627>:

```
g767.seq
   1 ATGAAGTTTA AACATCTGTT GCCGCTGCTG CTGTCGGCAG TGTTGTCCGC

51 GCAGGCATAT GCCCTGACGG AAGGGGAAGA CTATCTTGTG TTGGATAAAC

101 CCATTCCTCA AGAACAGCCG GGAAAAATTG AGGTTTTGGA ATTTTTCGGC

151 TATTTTTGCG TACATTGCCA TCATTTCGAT CCTTTGTTAT TGAAACTGGG

201 CAAGGCATTG CCGTCTGATA CTTATCTGCG GACGGAGCAC GTGGTCTGGC

251 GGCCTGAAAT GCTCGGTCTG GCAAGAATGG CTGCTGCGGT CAAGCTGTCG

301 GGTTTGAAAT ATCAGGCAAA CTCTGCTGTG TTTAAAGCAG TTTACGAACA

351 AAAAATCCGT TTGGAAAACA GGGCTGTTGC CGGGAAATGG GCTTTATCTC

401 AAAAAGGTTT TGACGGCAAA AAACTGATGC GCGCCTATGA TTCCCCCGAA

451 GCTGCCGCCG TCGCATTAAA AATGCAGAAA CTGACGGAAC AATACGGTAT

501 TGACAGCACG CCGACCGTTA TTGTCGGCGG AAAATACCGC GTTATCTTCA

551 ATAATGGCTT TGATGGCGGC GTTCATACGA TTAAAGAATT GGTTGCCAAA

601 GTCAGGGAAG AACGCAAGCG TCAGACCCCT GCTGTACAGA AATAG
```

This corresponds to the amino acid sequence <SEQ ID 2628; ORF 767.ng>:

```
g767.pep
   1 MKFKHLLPLL LSAVLSAQAY ALTEGEDYLV LDKPIPQEQP GKIEVLEFFG

51 YFCVHCHHFD PLLLKLGKAL PSDTYLRTEH VVWRPEMLGL ARMAAAVKLS

101 GLKYQANSAV FKAVYEQKIR LENRAVAGKW ALSQKGFDGK KLMRAYDSPE

151 AAAVALKMQK LTEQYGIDST PTVIVGGKYR VIFNNGFDGG VHTIKELVAK

201 VREERKRQTP AVQK*
```

The following partial DNA sequence was identified in *N. meningitidis* <SEQ ID 2629>:

```
m767.seq
   1 ATGAAGCTCA AACATCTGTT GCCGCTGCTG CTGTCGGCAG TGTTGTCCGC

51 GCAGGCATAT GCCCTGACGG AAGGGGAAGA CTATCTTGTG TTGGATAAAC

101 CCATTCCTCA AGAACAGTCG GGTAAAATTG AGGTTTTGGA ATTTTTCGGC

151 TATTTCTGCG TACATTGCCA TCATTTCGAT CCTTTGTTAT TGAAACTGGG

201 CAAGGCATTG CCGTCTGATG CCTATTTGAG GACGGAGCAC GTGGTCTGGC

251 AGCCTGAAAT GCTCGGTTTG GCTAGGATGG CGGCTGCCGT CAATTTGTCG

301 GGTTTGAAAT ATCAGGCAAA CCCTGCTGTG TTTAAAGCAG TTTACGAACA

351 AAAAATCCGC TTGGAAAACA GGTCGGTTGC CGGAAAATGG GCTTTGTCTC

401 AAAAAGGCTT TGACGGCAAA AAACTGATGC GCGCCTATGA TTCCCCCGAA

451 GCTGCCGCCG CCGCATTAAA AATGCAGAAA CTGACGGAAC AATACCGCAT

501 CGACAGCACG CCGACCGTTA TTGTCGGCGG AAAATACCGC GTTATCTTCA

551 ATAACGGCTT TGACGGCGGC GTTCATACGA TTAAAGAATT GGTTGCCAAA

601 GTCAGGGAAG AACGCAAGCG TCAGACCCCT GCTGTACAGA AATAG
```

This corresponds to the amino acid sequence <SEQ ID 2630; ORF 767>:

```
m767.pep
   1 MKLKHLLPLL LSAVLSAQAY ALTEGEDYLV LDKPIPQEQS GKIEVLEFFG

51 YFCVHCHHFD PLLLKLGKAL PSDAYLRTEH VVWQPEMLGL ARMAAAVNLS

101 GLKYQANPAV FKAVYEQKIR LENRSVAGKW ALSQKGFDGK KLMRAYDSPE

151 AAAAALKMQK LTEQYRIDST PTVIVGGKYR VIFNNGFDGG VHTIKELVAK

201 VREERKRQTP AVQK*
```

Computer analysis of this amino acid sequence gave the following results:

Homology with a Predicted ORF from *N. gonorrhoeae*
ORF 767 shows 95.8% identity over a 214 aa overlap with a predicted ORF (ORF 767) from *N. gonorrhoeae*

```
    m767/g767    95.8% identity in 214 aa overlap 10        20        30        40        50        60
         g767.pep  MKFKHLLPLLLSAVLSAQAYALTEGEDYLVLDKPIPQEQPGKIEVLEFFGYFCVHCHHFD
                   ||:||||||||||||||||||||||||||||||||||||| ||||||||||||||||||
         m767      MKLKHLLPLLLSAVLSAQAYALTEGEDYLVLDKPIPQEQSGKIEVLEFFGYFCVHCHHFD
                        10        20        30        40        50        60

70        80        90       100       110       120
         g767.pep  PLLLKLGKALPSDTYLRTEHVVWRPEMLGLARMAAAVKLSGLKYQANSAVFKAVYEQKIR
                   |||||||||||||:||||||||| ||||||||||||:|||||||||||:||||||||||
         m767      PLLLKLGKALPSDAYLRTEHVVWQPEMLGLARMAAAVNLSGLKYQANPAVFDAVYEQKIR
                        70        80        90       100       110       120

130       140       150       160       170       180
         g767.pep  LENRAVAGKWALSQKGFDGKKLMRAYDSPEAAAVALKMQKLTEQYGIDSTPTVIVGGKYR
                   ||||:|||||||||||||||||||||||||||||:|||||||||||:|||||||||||| 
         m767      LENRSVAGKWALSQKGFDGKKLMRAYDSPEAAAAALKMQKLTEQYRIDSTPTVIVGGKYR
                       130       140       150       160       170       180

190       200       210
         g767.pep  VIFNNGFDGGVHTIKELVAKVREERKRQTPAVQKX
                   |||||||||||||||||||||||||||||||||||
         m767      VIFNNGFDGGVHTIKELVAKVREERKRQTPAVQKX
                       190       200       210
```

The following partial DNA sequence was identified in *N. meningitidis* <SEQ ID 2631>:

```
a767.seq
   1 ATGAAGCTCA AACATCTGTT GCCGCTGCTG CTGTCGGCAG TGTTGTCCGC

51 GCAGGCATAT GCCCTGACGG AAGGGGAAGA CTATCTTGTG TTGGATAAAC

101 CCATTCCTCA AAAACAGTCG GGCAAAATTG AGGTTTTGGA ATTTTTCGGC

151 TATTTCTGCG TACATTGCCA TCATTTCGAT CCTTTGTTAT TGAAATTGGG

201 CAAGGCATTG CCGTCTGATG CCTATTTAAG GACGGAGCAC GTGGTCTGGC

251 AGCCTGAAAT GCTCGGTCTG GCAAGAATGG CTGCTGCGGT CAAGCTGTCA

301 GGTTTGAAAT ATCAGGCAAA CCCTGCCGTG TTTAAAGCAG TTTACGAACA

351 AAAAATCCGC TTGGAAAACA GGTCGGTTGC CGAAAAATGG GCTTTGTCTC

401 AAAAAGGCTT TGACGGCAAA AAACTGATGC GCGCCTACGA CTCTCCTGCG

451 GCAGCGGCTG CTGCATCAAA AATGCAGCAA TTGACGGAAC AGTACCGCAT

501 CGACAGTACG CCGACCGTTG TCGTCGGCGG AAAATACCGC GTTATCTTCA

551 ATAATGGCTT TGACGGCGGT GTTCATACGA TTAAAGAATT GGTTGCCAAA

601 GTCAGGGAAG AACGCAAGCG TCAGACCCCT GCTGTACAGA AATAG
```

This corresponds to the amino acid sequence <SEQ ID 2632; ORF 767.a>:

```
a767.pep
  1 MKLKHLLPLL LSAVLSAQAY ALTEGEDYLV LDKPIPQKQS GKIEVLEFFG

51 YFCVHCHHFD PLLLKLGKAL PSDAYLRTEH VVWQPEMLGL ARMAAAVKLS

101 GLKYQANPAV FKAVYEQKIR LENRSVAEKW ALSQKGFDGK KLMRAYDSPA

151 AAAAASKMQQ LTEQYRIDST PTVVVGGKYR VIFNNGFDGG VHTIKELVAK

201 VREERKRQTP AVQK*
```

Computer analysis of this amino acid sequence gave the following results:

Homology with a Predicted ORF from *N. meningitidis*

ORF 767 shows 96.7% identity over a 214 aa overlap with a predicted ORF (ORF 767) from *N. meningitidis*:

```
    m767/a767   96.7% identity in 214 aa overlap 10         20         30         40         50         60
      a767.pep  MKLKHLLPLLLSAVLSAQAYALTEGEDYLVLDKPIPQKQSGKIEVLEFFGYFCVHCHHFD
                ||||||||||||||||||||||||||||||||||||:|||||||||||||||||||||||
      m767      MKLKHLLPLLLSAVLSAQAYALTEGEDYLVLDKPIPQEQSGKIEVLEFFGYFCVHCHHFD
                   10         20         30         40         50         60

70         80         90        100        110        120
      a767.pep  PLLLKLGKALPSDAYLRTEHVVWQPEMLGLARMAAAVKLSGLKYQANPAVFKAVYEQKIR
                ||||||||||||||||||||||||||||||||||||:|||||||||||||||||||||||
      m767      PLLLKLGKALPSDAYLRTEHVVWQPEMLGLARMAAAVNLSGLKYQANPAVFKAVYEQKIR
                   70         80         90        100        110        120

130        140        150        160        170        180
      a767.pep  LENRSVAEKWALSQKGFDGKKLMRAYDSPAAAAAASKMQQLTEQYRIDSTPTVVVGGKYR
                ||||||:|||||||||||||||||||||||| |||| |||:||||||||||||:||||||
      m767      LENRSVAGKWALSQKGFDGKKLMRAYDSPEAAAAALKMQKLTEQYRIDSTPTVIVGGKYR
                  130        140        150        160        170        180

190        200        210
      a767.pep  VIFNNGFDGGVHTIKELVAKVREERKRQTPAVQKX
                |||||||||||||||||||||||||||||||||||
      m767      VIFNNGFDGGVHTIKELVAKVREERKRQTPAVQKX
                  190        200        210
```

The following partial DNA sequence was identified in *N. gonorrhoeae* <SEQ ID 2633>:

```
g768.seq
  1 ATGAATATCA AACAATTGAT TACCGCCGCA CTCATTGCCT CAGCCGCCTT

51 TGCCACGCAG GCAGCCCCGC AAAAACCCGT ATCCGCCGCC CAAACCGCGC

101 AACATTCAGC CGTTTGGATC GATGTCCGTT CCGAACAGGA ATTTAGCGAA

151 GGTCATTTGC ACAACGCGGT CAACATCCCC GTCGACCAAA TCGTCCGCCG

201 CATATACGAA GCCGCGCCCG ACAAAGACAC GCCGGTCAAC CTCTACTGCC

251 GCAGCGGACG GCGTGCCGAA GCCGCCCTTC AAGAGCTGAA AAAAGCAGGT

301 TATACAAATG TTGCCAATCA CGGCGGTTAT GAAGACCTGC TCAAAAAGG

351 GATGAAATGA
```

This corresponds to the amino acid sequence <SEQ ID 2634; ORF 768.ng>:

```
g768.pep
  1 MNIKQLITAA LIASAAFATQ AAPQKPVSAA QTAQHSAVWI DVRSEQEFSE

51 GHLHNAVNIP VDQIVRRIYE AAPDKDTPVN LYCRSGRRAE AALQELKKAG

101 YTNVANHGGY EDLLKKGMK*
```

The following partial DNA sequence was identified in *N. meningitidis* <SEQ ID 2635>:

```
m768.seq
   1 ATGAATATCA AACACCTGAT TACCGCCGCA CTCATTGCCT CAGCCGCCTT

51 TGCCGCGCAG GCAGCCCCGC AAAAACCCGT ATCCGCCGCC CAAACCGCGC

101 AACATCCGGC CGTTTGGATC GATGTCCGTT CCGAACAGGA ATTTAGCGAA

151 GGGCATTTGC ACAACGCGGT CAACATCCCC GTCGACCAAA TCGTCCGCCG

201 CATACACGAA GCCGCGCCCG ACAAAGACAC GCCGGTCAAC CTCTACTGCC

251 GCAGCGGACG GCGTGCCGAA GCCGCCCTTC AAGAGCTGAA AAAAGCAGGT

301 TATACAAATG TTGCCAATCA CGGCGGTTAT GAAGACCTGC TCAAAAAAGG

351 GATGAAATGA
```

This corresponds to the amino acid sequence <SEQ ID 2636; ORF 768>:

```
m768.pep
   1 MNIKHLITAA LIASAAFAAQ AAPQKPVSAA QTAQHPAVWI DVRSEQEFSE

51 GHLHNAVNIP VDQIVRRIHE AAPDKDTPVN LYCRSGRRAE AALQELKKAG

101 YTNVANHGGY EDLLKKGMK*
```

Computer analysis of this amino acid sequence gave the following results:
Homology with a Predicted ORF from *N. gonorrhoeae*
ORF 768 shows 96.6% identity over a 119 aa overlap with a predicted ORF (ORF 768) from *N. gonorrhoeae*

```
   m768/g768   96.6% identity in 119 aa overlap 10        20        30        40        50        60
         g768.pep  MNIKQLITAALIASAAFATQAAPQKPVSAAQTAQHSAVWIDVRSEQEFSEGHLHNAVNIP
                   ||||:||||||||||||||:||||||||||||||||| ||||||||||||||||||||||
         m768      MNIKHLITAALIASAAFAAQAAPQKPVSAAQTAQHPAVWIDVRSEQEFSEGHLHNAVNIP
                       10        20        30        40        50        60

70        80        90       100       110       120
         g768.pep  VDQIVRRIYEAAPDKDTPVNLYCRSGRRAEAALQELKKAGYTNVANHGGYEDLLKKGMKX
                   |||||||:||||||||||||||||||||||||||||||||||||||||||||||||||||
         m768      VDQIVRRIHEAAPDKDTPVNLYCRSGRRAEAALQELKKAGYTNVANHGGYEDLLKKGMKX
                       70        80        90       100       110       120
```

The following partial DNA sequence was identified in *N. meningitidis* <SEQ ID 2637>:

```
a768.seq
   1 ATGAATATCA AACACCTGAT TACCGCCGCA CTCATTGCCT CAGCCGCCTT

51 TGCCGCGCAG GCAGCCCCGC AAAAACCCGT ATCCGCCGCC CAAACCGCGC

101 AACATTCAGC CGTTTGGATC GATGTCCGCA GCGAACAGGA ATTTAGCGAA

151 GGTCATTTGC ACAACGCGGT CAACATCCCC GTCGACCAAA TCGTCCGCCG

201 CATACACGAA GCCGCGCCCG ACAAAGACAC GCCGGTCAAC CTCTACTGCC

251 GCAGCGGACG GCGTGCCGAA GCCGCCCTTC AAGAACTGAA AAAAGCAGGC

301 TATACGAATG TTGCCAATCA CGGCGGTTAT GAAGACCTGC TCAAAAAAGG

351 GATGAAATGA
```

This corresponds to the amino acid sequence <SEQ ID 2638; ORF 768.a>:

```
a768.pep
   1 MNIKHLITAA LIASAAFAAQ AAPQKPVSAA QTAQHSAVWI DVRSEQEFSE

51 GHLHNAVNIP VDQIVRRIHE AAPDKDTPVN LYCRSGRRAE AALQELKKAG

101 YTNVANHGGY EDLLKKGMK*
```

Computer analysis of this amino acid sequence gave the following results:

Homology with a Predicted ORF from *N. meningitidis*
ORF 768 shows 99.2% identity over a 119 aa overlap with a predicted ORF (ORF 768) from *N. meningitidis*:

```
   m768/a768  99.2% identity in 119 aa overlap 10         20         30         40         50         60
     a768.pep  MNIKHLITAALIASAAFAAQAAPQKPVSAAQTAQHSAVWIDVRSEQEFSEGHLHNAVNIP
               |||||||||||||||||||||||||||||||||||| ||||||||||||||||||||||
     m768      MNIKHLITAALIASAAFAAQAAPQKPVSAAQTAQHPAVWIDVRSEQEFSEGHLHNAVNIP
                     10         20         30         40         50         60

70         80         90        100        110        120
     a768.pep  VDQIVRRIHEAAPDKDTPVNLYCRSGRRAEAALQELKKAGYTNVANHGGYEDLLKKGMKX
               ||||||||||||||||||||||||||||||||||||||||||||||||||||||||||||
     m768      VDQIVRRIHEAAPDKDTPVNLYCRSGRRAEAALQELKKAGYTNVANHGGYEDLLKKGMKX
                     70         80         90        100        110        120
```

The following partial DNA sequence was identified in *N. gonorrhoeae* <SEQ ID 2639>:

```
g769.seq
   1 TTGATAATGG TTATTTTTTA TTTTTATTTT TGTGGGAAGA CATTTATGCC

51 TGCACGAAAC AGATGGATGC TGCTGCCTTT ATTGGCAAGC GCGGCATACG

101 CCGAAgaAAC ACCgtgCGAA CCGGATTTGA GAAGCCGTCC CGAGTTCAGG

151 CTTCATGAAG CGGAGGTCAA ACCGATCGAC AGGGAGAAGG TACCGGGGCA

201 GGTGCGGGAA AAAGGAAAAG TTTTGCAGGT TGACGgcGAA ACCCTGCTGA

251 AAAATCCCGA ATTGTTGTCG CGTGCCATGT ATTCCGCAGT GGTCTCAAAC

301 AATATTGCCG GTATCCGCGT GATTTTGCCG ATTTACCTAC AACAGGCGCG

351 GCAGGATAAG ATGTTGGCAC TTTATGCACA AGGGATTTTG GCGCAGGCAG

401 AGGGCAGGGT GAAGGAGGCG GTTTCCCATT ACCGGGAATT GATTGCCGCC

451 CAACCCGACG CGCCCGCCGT CCGTATGCGT TTGGCGGCGG CATTGTTTGA

501 AGACAGGCAG AACGAGGCGG CGGCAGACCA GTTCGACCGC CTGAAAACAG

551 AAGATCTGCC GCCGCAGCTT ATGGAGCAGG TCGAGCTGTA CCGCAAGGCA

601 TTGCGCGAAC GCGATGCGTG GAAGGTAAAC GGCGGTTTCA GCGTTACCCG

651 CGAACACAAT ATCAACCAAG CCCCGAAACA GCAGCAGTAC GGCAATTGGA

701 CTTTCCCGAA ACAGGTGGAC GGCACGGCAG TCAATTACCG GTTCGGCGCG

751 GAGAAAAAAT GGTCGCTGAA AAACGGCTGG TACACGACGG CGGGCGGCGA

801 CGTGTCCGGC AGGGTTTATC CGGGGAATAA GAAATTCAAC GATATGACGG

851 CAGGTGTTTC CGGCGGCATC GGTTTTGCCG ACCGGCGTAA AGATGTCGGG

901 CTGGCAGTGT TCCACGAACG CCGCACCTAC GGCAACGACG CTTATTCTTA

951 CGCCAACGGC GCACGCCTTT ATTTCAACCG TTGGCAAACC CCGAGATGGC

1001 AAACGCTGTC TTCGGCGGAG TGGGGGCGTT TGAAGAATAC GCGCCGGGCG
```

-continued

```
1051 CGTTCCGACA ATACCCATTT GCAAATTTCC AATTCGCTGG TGTTTTACCG

1101 GAATGCGCGC CAATATTGGA CGGGCGGTTT GGATTTTTAC CGCGAGCGCA

1151 ACCCCGCCGA CCGTGGCGAC AATTTCAACC GTTACGGCCT GCGCTTTGCC

1201 TGGGGGCAGG AATGGGGCGG CAGCGGCCTG TCTTCGCTGT TCCGCCTCGG

1251 CGTGGCGAAA CGGCATTATG AAAAACCCGG CTTCTTCAGC AGTTTTAAAG

1301 GGGAAAGGCG CAGGGATAAA GAATCGGACA CATCCTTGAG CCTTTGGCAC

1351 CGGGCATTGC ATTTCAAAGG CATCACGCCG CGCCTGACGC TGTCGCACCG

1401 CGAAACGTGG AGCAACGATG TGTTTAACGA ATACGAGAAA AACAGGGCGT

1451 TTGTCGAGTT TAACAAAACG TTCTGA
```

This corresponds to the amino acid sequence <SEQ ID 2640; ORF 769.ng>:

```
g769.pep
   1 LIMVIFYFYF CGKTFMPARN RWMLLPLLAS AAYAEETPCE PDLRSRPEFR

51 LHEAEVKPID REKVPGQVRE KGKVLQVDGE TLLKNPELLS RAMYSAVVSN

101 NIAGIRVILP IYLQQARQDK MLALYAQGIL AQAEGRVKEA VSHYRELIAA

151 QPDAPAVRMR LAAALFEDRQ NEAAADQFDR LKTEDLPPQL MEQVELYRKA

201 LRERDAWKVN GGFSVTREHN INQAPKQQQY GNWTFPKQVD GTAVNYRFGA

251 EKKWSLKNGW YTTAGGDVSG RVYPGNKKFN DMTAGVSGGI GFADRRKDVG

301 LAVFHERRTY GNDAYSYANG ARLYFNRWQT PRWQTLSSAE WGRLKNTRRA

351 RSDNTHLQIS NSLVFYRNAR QYWTGGLDFY RERNPADRGD NFNRYGLRFA

401 WGQEWGGSGL SSLFRLGVAK RHYEKPGFFS SFKGERRRDK ESDTSLSLWH

451 RALHFKGITP RLTLSHRETW SNDVFNEYEK NRAFVEFNKT F*
```

The following partial DNA sequence was identified in *N. meningitidis* <SEQ ID 2641>:

```
m769.seq
   1 TTGATAATGG TTATTTTTTA TTTTTGTGGG AAGACATTTA TGCCTGCACG

51 AAACAGATGG ATGCTGCTGC TGCCTTTATT GGCAAGCGCG GCATATGCCG

101 AAGAAACACC GCGCGAACCG GATTTGAGAA GCCGTCCCGA GTTCAGGCTT

151 CATGAAGCGG AGGTCAAACC GATCGACAGG GAGAAGGTGC CGGGGCAGGT

201 GCGGGAAAAA GGAAAAGTTT TGCAGATTGA CGGCGAAACC CTGCTGAAAA

251 ATCCCGAATT GTTGTCCCGC GCGATGTATT CCGCAGTGGT CTCAAACAAT

301 ATTGCCGGTA TCCGCGTTAT TTTGCCGATT TACCTACAAC AGGCGCAGCA

351 GGATAAGATG TTGGCACTTT ATGCACAAGG GATTTTGGCG CAGGCAGACG

401 GTAGGGTGAA GGAGGCGATT TCCCATTACC GGGAATTGAT TGCCGCCCAA

451 CCCGACGCGC CCGCCGTCCG TATGCGTTTG GCGGCAGCAT TGTTTGAAAA

501 CAGGCAGAAC GAGGCGGCGG CAGACCAGTT CGACCGCCTG AAGGCGGAAA

551 ACCTGCCGCC GCAGCTGATG GAGCAGGTCG AGCTGTACCG CAAGGCATTG

601 CGCGAACGCG ATGCGTGGAA GGTAAATGGC GGCTTCAGCG TCACCCGCGA

651 ACACAATATC AACCAAGCCC CGAAACGGCA GCAGTACGGC AAATGGACTT

701 TCCCGAAACA GGTGGACGGC ACGGCGGTCA ATTACCGGCT CGGCGCGGAG
```

-continued

```
 751 AAAAAATGGT CGCTGAAAAA CGGCTGGTAC ACGACGGCGG GCGGCGACGT

801 GTCCGGCAGG GTTTATCCGG GGAATAAGAA ATTCAACGAT ATGACGGCAG

851 GCGTTTCCGG CGGCATCGGT TTTGCCGACC GGCGCAAAGA TGCCGGGCTG

901 GCAGTGTTCC ACGAACGCCG CACCTACGGC AACGACGCTT ATTCTTACAC

951 CAACGGCGCA CGCCTTTATT TCAACCGTTG GCAAACCCCG AAATGGCAAA

1001 CGTTGTCTTC GGCGGAGTGG GGGCGTTTGA AGAATACGCG CCGGGCGCGT

1051 TCCGACAATA CCCATTTGCA AATTTCCAAT TCGCTGGTGT TTTACCGGAA

1101 TGCGCGCCAA TATTGGATGG GCGGTTTGGA TTTTTACCGC GAGCGCAACC

1151 CCGCCGACCG GGGCGACAAT TTCAACCGTT ACGGCCTGCG CTTTGCCTGG

1201 GGGCAGGAAT GGGGCGGCAG CGGCCTGTCT TCGCTGTTGC GCCTCGGCGC

1251 GGCGAAACGG CATTATGAAA AACCCGGCTT TTTCAGCGGT TTTAAGGGG

1301 AAAGGCGCAG GGATAAAGAA TTGAACACAT CCTTGAGCCT TTGGCACCGG

1351 GCATTGCATT TCAAAGGCAT CACGCCGCGC CTGACGTTGT CGCACCGCGA

1401 AACGCGGAGT AACGATGTGT TCAACGAATA CGAGAAAAAT CGGGCGTTTG

1451 TCGAGTTTAA TAAAACGTTC TGA
```

This corresponds to the amino acid sequence <SEQ ID 2642; ORF 769>:

```
m769.pep
  1 LIMVIFYFCG KTFMPARNRW MLLLPLLASA AYAEETPREP DLRSRPEFRL

51 HEAEVKPIDR EKVPGQVREK GKVLQIDGET LLKNPELLSR AMYSAVVSNN

101 IAGIRVILPI YLQQAQQDKM LALYAQGILA QADGRVKEAI SHYRELIAAQ

151 PDAPAVRMRL AAALFENRQN EAAADQFDRL KAENLPPQLM EQVELYRKAL

201 RERDAWKVNG GFSVTREHNI NQAPKRQQYG KWTFPKQVDG TAVNYRLGAE

251 KKWSLKNGWY TTAGGDVSGR VYPGNKKFND MTAGVSGGIG FADRRKDAGL

301 AVFHERRTYG NDAYSYTNGA RLYFNRWQTP KWQTLSSAEW GRLKNTRRAR

351 SDNTHLQISN SLVFYRNARQ YWMGGLDFYR ERNPADRGDN FNRYGLRFAW

401 GQEWGGSGLS SLLRLGAAKR HYEKPGFFSG FKGERRRDKE LNTSLSLWHR

451 ALHFKGITPR LTLSHRETRS NDVFNEYEKN RAFVEFNKTF *
```

Computer analysis of this amino acid sequence gave the following results:
Homology with a Predicted ORF from *N. gonorrhoeae*
ORF 769 shows 95.1% identity over a 492 aa overlap with a predicted ORF (ORF 769) from *N. gonorrhoeae*

```
    m769/g769   95.1% identity in 492 aa overlap 10        20        30        40        50        59
     g769.pep   LIMVIFYFYFCGKTFMPARNRWMLL-PLLASAAYAEETPCEPDLRSRPEFRLHEAEVKPI
                |||||||  ||||||||||||||||| |||||||||||||| |||||||||||||||||
     m769       LIMVIFY--FCGKTFMPARNRWMLLLPLLASAAYAEETPREPDLRSRPEFRLHEAEVKPI
                       10        20        30        40        50

60        70        80        90       100       110       119
     g769.pep   DREKVPGQVREKGKVLQVDGETLLKNPELLSRAMYSAVVSNNIAGIRVILPIYLQQARQD
                |||||||||||||||||:||||||||||||||||||||||||||||||||||||||:||
     m769       DREKVPGQVREKGKVLQIDGETLLKNPELLSRAMYSAVVSNNIAGIRVILPIYLQQAQQD
                    60        70        80        90       100       110
```

-continued

```
              120       130       140       150       160       170      179
g769.pep      KMLALYAQGILAQAEGRVKEAVSHYRELIAAQPDAPAVRMRLAAALFEDRQNEAAADQFD
              ||||||||||||||:||||||:||||||||||||||||||||||||||:|||||||||||
a769          KMLALYAQGILAQADGRVKEAISHYRELIAAQPDAPAVRMRLAAALFENRQNEAAADQFD
               120       130       140       150       160       170

180       190       200       210       220       230      239
g769.pep      RLKTEDLPPQLMEQVELYRKALRERDAWKVNGGFSVTREHNINQAPKQQQYGNWTFPKQV
              ||||||||||||||||||||||||||||||||||||||||||||||||||||||||||||
m769          RLKAENLPPQLMEQVELYRKALRERDAWKVNGGFSVTREHNINQAPKRQQYGKWTFPKQV
               180       190       200       210       220       230

240       250       260       270       280       290      299
g769.pep      DGTAVNYRFGAEKKWSLKNGWYTTAGGDVSGRVYPGNKKFNDMTAGVSGGIGFADRRKDV
              ||||||||:||||||||||||||||||||||||||||||||||||||||||||||||||:
m769          DGTAVNYRLGAEKKWSLKNGWYTTAGGDVSGRVYPGNKKFNDMTAGVSGGIGFADRRKDA
              240        250       260       270       280       290

300       310       320       330       340       350      359
g769.pep      GLAVFHERRTYGNDAYSYANGARLYFNRWQTPRWQTLSSAEWGRLKNTRRARSDNTHLQI
              ||||||||||||||||||:|||||||||||||:|||||||||||||||||||||||||||
m769          GLAVFHERRTYGNDAYSYTNGARLYFNRWQTPKWQTLSSAEWGRLKNTRRARSDNTHLQI
               300       310       320       330       340       350

360       370       380       390       400       410      419
g769.pep      SNSLVFYRNARQYWTGGLDFYRERNPADRGDNFNRYGLRFAWGQEWGGSGLSSLFRLGVA
              |||||||||||||| |||||||||||||||||||||||||||||||||||||||:|||:|
m769          SNSLVFYRNARQYWMGGLDFYRERNPADRGDNFNRYGLRFAWGQEWGGSGLSSLLRLGAA
               360       370       380       390       400       410

420       430       440       450       460       470      479
g769.pep      KRHYEKPGFFSSFKGERRRDKESDTSLSLWHRALHFKGITPRLTLSHRETWSNDVFNEYE
              |||||||||||:|||||||||| :||||||||||||||||||||||||||| ||||||||
m769          KRHYEKPGFFSGFKGERRRDKELNTSLSLWHRALHFKGITPRLTLSHRETRSNDVFNEYE
               420       430       440       450       460       470

480       490
g769.pep      KNRAFVEFNKTFX
              |||||||||||||
m769          KNRAFVEFNKTFX
               490
```

The following partial DNA sequence was identified in *N. meningitidis* <SEQ ID 2643>:

```
a769.seq
     1  TTGATAATGG TTATTTTTTA TTTTTGTGGG AAGACATTTA TGCCTGCACG

51  AAACAGATGG ATGCTGCTGC TGCCTTTATT GGCAAGCGCG GCATATGCCG

101  AAGAAACACC GCGCGAACCG GATTTGAGAA GCCGTCCCGA GTTCAGGCTT

151  CATGAAGCGG AGGTCAAACC AATCGACAGG GAGAAGGTAC CGGGGCAGGT

201  GCGGGAAAAA GGAAAAGTTT TGCAGATTGA CGGCGAAACC CTGCTGAAAA

251  ATCCCGAATT GCTGTCCCGC GCGATGTATT CCGCAGTGGT CTCAAACAAT

301  ATTGCCGGTA TCCGCGTTAT TTTGCCGATT TACCTACAAC AGGCGCAGCA

351  GGATAAGATG TTGGCACTTT ATGCACAAGG GATTTTGGCG CAGGCAGACG

401  GTAGGGTGAA GGAGGCGATT TCCCATTACC GGGAATTGAT TGTCGCCCAA

451  CCCGACGCGC CCGCCGTCCG TATGCGTTTG GCGGCGGCAT TGTTTGAAAA

501  CAGGCAGAAC GAGGCGGCGG CAGACCAGTT CGACCGCCTG AAGGCGGAAA

551  ACCTGCCGCC GCAGCTGATG GAGCAGGTCG AGCTGTACCG CAAGGCATTG

601  CGCGAACGCG ATGCGTGGAA GGTAAATGGC GGCTTCAGCG TTACCCGCGA

651  ACACAATATC AACCAAGCCC CGAAACGGCA GCAGTACGGC AAATGGACTT

701  TCCCGAAACA GGTGGACGGC ACGGCGGTCA ATTACCGGCT CGGCGCGGAG

751  AAAAAATGGT CGCTGAAAAA CGGCTGGTAC ACGACGGCGG GCGGCGACGT

801  GTCCGGCAGG GTTTATCCGG GGAATAAGAA ATTCAACGAT ATGACGGCAG

851  GCGTTTCCGG CGGCATCGGT TTTGCCGACC GGCGCAAAGA TGCCGGGCTG

901  GCAGTGTTCC ACGAACGCCG CACCTACGGC AACGACGCTT ATTCTTACAC
```

```
-continued
 951  CAACGGCGCA CGCCTTTATT TCAACCGTTG GCAAACCCCG AAATGGCAAA

1001  CGTTGTCTTC GGCGGAGTGG GGGCGTTTGA AGAATACGCG CCGGGCGCGT

1051  TCCGACAATA CCCATTTGCA AATTTCCAAT TCGCTGGTGT TTTACCGGAA

1101  TGCGCGCCAA TATTGGATGG GCGGTTTGGA TTTTTACCGC GAGCGCAACC

1151  CCGCCGACCG GGGCGACAAT TTCAACCGTT ACGGCCTGCG CTTTGCCTGG

1201  GGGCAGGAAT GGGGCGGCAG CGGCCTGTCT TCGCTGTTGC GCCTCGGCGC

1251  GGCGAAACGG CATTATGAAA AACCCGGCTT TTTCAGCGGT TTTAAGGGG

1301  AAAGGCGCAG GGATAAAGAA TTGAACACAT CCTTGAGCCT TTGGCACCGG

1351  GCATTGCATT TCAAAGGCAT CACGCCGCGC CTGACGTTGT CGCACCGCGA

1401  AACGCGGAGT AACGATGTGT TCAACGAATA CGAGAAAAAT CGGGCGTTTG

1451  TCGAGTTTAA TAAAACGTTC TGA
```

This corresponds to the amino acid sequence <SEQ ID 20 2644; ORF 769.a>:

```
a769.pep
  1  LIMVIFYFCG KTFMPARNRW MLLLPLLASA AYAEETPREP DLRSRPEFRL

51  HEAEVKPIDR EKVPGQVREK GKVLQIDGET LLKNPELLSR AMYSAVVSNN

101  IAGIRVILPI YLQQAQQDKM LALYAQGILA QADGRVKEAI SHYRELIVAQ

151  PDAPAVRMRL AAALFENRQN EAAADQFDRL KAENLPPQLM EQVELYRKAL

201  RERDAWKVNG GFSVTREHNI NQAPKRQQYG KWTFPKQVDG TAVNYRLGAE

251  KKWSLKNGWY TTAGGDVSGR VYPGNKKFND MTAGVSGGIG FADRRKDAGL

301  AVFHERRTYG NDAYSYTNGA RLYFNRWQTP KWQTLSSAEW GRLKNTRRAR

351  SDNTHLQISN SLVFYRNARQ YWMGGLDFYR ERNPADRGDN FNRYGLRFAW

401  GQEWGGSGLS SLLRLGAAKR HYEKPGFFSG FKGERRRDKE LNTSLSLWHR

451  ALHFKGITPR LTLSHRETRS NDVFNEYEKN RAFVEFNKTF *
                                                         40
```

Computer analysis of this amino acid sequence gave the following results:

Homology with a Predicted ORF from *N. meningitidis*

ORF 769 shows 99.8% identity over a 490 aa overlap with a predicted ORF (ORF 769) from *N. meningitidis*:

```
    a769/a769   99.8% identity in 490 aa overlap 10        20        30        40        50        60
    a769.pep   LIMVIFYFCGKTFMPARNRWMLLLPLLASAAYAEETPREPDLRSRPEFRLHEAEVKPIDR
               ||||||||||||||||||||||||||||||||||||||||||||||||||||||||||||
    m769       LIMVIFYFCGKTFMPARNRWMLLLPLLASAAYAEETPREPDLRSRPEFRLHEAEVKPIDR
                   10        20        30        40        50        60

70        80        90       100       110       120
    a769.pep   EKVPGQVREKGKVLQIDGETLLKNPELLSRAMYSAVVSNNIAGIRVILPIYLQQAQQDKM
               ||||||||||||||||||||||||||||||||||||||||||||||||||||||||||||
    m769       EKVPGQVREKGKVLQIDGETLLKNPELLSRAMYSAVVSNNIAGIRVILPIYLQQAQQDKM
                   70        80        90       100       110       120

130       140       150       160       170       180
    a769.pep   LALYAQGILAQADGRVKEAISHYRELIVAQPDAPAVRMRLAAALFENRQNEAAADQFDRL
               |||||||||||||||||||||||||||:||||||||||||||||||||||||||||||||
    m769       LALYAQGILAQADGRVKEAISHYRELIAAQPDAPAVRMRLAAALFENRQNEAAADQFDRL
                  130       140       150       160       170       180

190       200       210       220       230       240
    a769.pep   KAENLPPQLMEQVELYRKALRERDAWKVNGGFSVTREHNINQAPKRQQYGKWTFPKQVDG
               ||||||||||||||||||||||||||||||||||||||||||||||||||||||||||||
    m769       KAENLPPQLMEQVELYRKALRERDAWKVNGGFSVTREHNINQAPKRQQYGKWTFPKQVDG
                  190       200       210       220       230       240
```

```
              250        260        270        280        290        300
a769.pep    TAVNYRLGAEKKWSLKNGWYTTAGGDVSGRVYPGNKKFNDMTAGVSGGIGFADRRKDAGL
            ||||||||||||||||||||||||||||||||||||||||||||||||||||||||||||
m769        TAVNYRLGAEKKWSLKNGWYTTAGGDVSGRVYPGNKKFNDMTAGVSGGIGFADRRKDAGL
              250        260        270        280        290        300

310        320        330        340        350        360
a769.pep    AVFHERRTYGNDAYSYTNGARLYFNRWQTPKWQTLSSAEWGRLKNTRRARSDNTHLQISN
            ||||||||||||||||||||||||||||||||||||||||||||||||||||||||||||
m769        AVFHERRTYGNDAYSYTNGARLYFNRWQTPKWQTLSSAEWGRLKNTRRARSDNTHLQISN
              310        320        330        340        350        360

370        380        390        400        410        420
a769.pep    SLVFYRNARQYWMGGLDFYRERNPADRGDNFNRYGLRFAWGQEWGGSGLSSLLRLGAAKR
            ||||||||||||||||||||||||||||||||||||||||||||||||||||||||||||
m769        SLVFYRNARQYWMGGLDFYRERNPADRGDNFNRYGLRFAWGQEWGGSGLSSLLRLGAAKR
              370        380        390        400        410        420

430        440        450        460        470        480
a769.pep    HYEKPGFFSGFKGERRRDKELNTSLSLWHRALHFKGITPRLTLSHRETRSNDVFNEYEKN
            ||||||||||||||||||||||||||||||||||||||||||||||||||||||||||||
m769        HYEKPGFFSGFKGERRRDKELNTSLSLWHRALHFKGITPRLTLSHRETRSNDVFNEYEKN
              430        440        450        460        470        480

490
a769.pep    RAFVEFNKTFX
            |||||||||||
m769        RAFVEFNKTFX
              490
```

The following partial DNA sequence was identified in *N. gonorrhoeae* <SEQ ID 2645>:

```
g770.seq
   1 ATGAACAGAC TGCTACTGCT GTCTGCCGCC GTCCTGCCGA CTGCCTGCGG

51 CAGCGGCGAA ACCGATAAAA TCGGACGGGC AAGTACCGTT TTCAACATGT

101 TGGGCAAAAA CGACCGTATC GAAGTGGAAG GATTCGACGA TCCCGACGTT

151 CAAGGGGTTG CCTGTTATAT TTCGTATGCA AAAAAGGCG GCTTGAAGGA

201 AATGGTCAAT TTGGAAGAGG ACGCGTCCGA CGCATCGGTT TCGTGCGTTC

251 AGACGGCATC TTCGATTTCT TTTGACGAAA CCGCCGTGCG CAAACCGAAA

301 GAAGTTTTCA AGCGCGGTAC GGGCTTCGCG TTCAAGAGCC GGCAGATTGT

351 CCGTTATTAC GACCCCAAAC GCAAAGCCTT CGCCTATTTG GTTTACAGCG

401 ATAAAATCGT CCAAGGATCG CCGAAAAATT CCTTAAGCGC GGTTTCCTGT

451 TTCGGCAGCG GCATACCGCA AACCGACGGG GTGCAAGCCG ATACTTCCGG

501 CAAACTGCTT GCCGGCGCCT GCATTATTTC CAACCCGATA AAAATCCCG

551 ACAAACGCTG A
```

This corresponds to the amino acid sequence <SEQ ID 2646; ORF 770.ng>:

```
g770.pep
   1 MNRLLLLSAA VLPTACGSGE TDKIGRASTV FNMLGKNDRI EVEGFDDPDV

51 QGVACYISYA KKGGLKEMVN LEEDASDASV SCVQTASSIS FDETAVRKPK

101 EVFKRGTGFA FKSRQIVRYY DPKRKAFAYL VYSDKIVQGS PKNSLSAVSC

151 FGSGIPQTDG VQADTSGKLL AGACIISNPI KNPDKR*
```

The following partial DNA sequence was identified in *N. meningitidis* <SEQ ID 2647>:

```
m770.seq
   1 ATGAACAGAC TGCTACTGCT GTCTGCCGCC GTCCTGCTGA CTGCCTGCGG

51 CAGCGGCGAA ACCGATAAAA TCGGACGGGC AAGTACCGTT TTCAACATAC
```

-continued

```
101 TGGGCAAAAA CGACCGTATC GAAGTGGAAG GATTCGACGA TCCCGACGTT

151 CAAGGGGTTG CCTGTTATAT TTCGTATGCA AAAAAAGGCG GCTTGAAGGA

201 AATGGTCAAT TTGGAAGAGG ACGCGTCCGA CGCATCGGTT TCGTGCGTTC

251 AGACGGCATC TTCGATTTCT TTTGACGAAA CCGCCGTGCG CAAACCGAAA

301 GAAGTTTTCA AACACGGTGC GAGCTTCGCG TTCAAGAGCC GGCAGATTGT

351 CCGTTATTAC GACCCCAAAC GCAAAACCTT CGCCTATTTG GTGTACAGCG

401 ATAAAATCAT CCAAGGCTCG CCGAAAAATT CCTTAAGCGC GGTTTCCTGT

451 TTCGGCGGCG GCATACCGCA AACCGATGGG GTGCAAGCCG ATACTTCCGG

501 CAACCTGCTT GCCGGCGCCT GCATGATTTC CAACCCGATA GAAAATCTCG

551 ACAAACGCTG A
```

This corresponds to the amino acid sequence <SEQ ID 2648; ORF 770>:

```
m770.pep
  1 MNRLLLLSAA VLLTACGSGE TDKIGRASTV FNILGKNDRI EVEGFDDPDV

51 QGVACYISYA KKGGLKEMVN LEEDASDASV SCVQTASSIS FDETAVRKPK

101 EVFKHGASFA FKSRQIVRYY DPKRKTFAYL VYSDKIIQGS PKNSLSAVSC

151 FGGGIPQTDG VQADTSGNLL AGACMISNPI ENLDKR*
```

Computer analysis of this amino acid sequence gave the following results:
Homology with a Predicted ORF from *N. gonorrhoeae*
ORF 770 shows 93.5% identity over a 186 aa overlap with a predicted ORF (ORF 770) from *N. gonorrhoeae*

```
    m770/g770   93.5% identity in 186 aa overlap 10         20         30         40         50         60
       g770.pep  MNRLLLLSAAVLPTACGSGETDKIGRASTVFNMLGKNDRIEVEGFDDPDVQGVACYISYA
                 |||||||||| ||||||||||||||||||| :|||||||||||||||||||||||||||
       m770      MNRLLLLSAAVLLTACGSGETDKIGRASTVFNILGKNDRIEVEGFDDPDVQGVACYISYA
                    10         20         30         40         50         60

70         80         90        100        110        120
       g770.pep  KKGGLKEMVNLEEDASDASVSCVQTASSISFDETAVRKPKEVFKRGTGFAFKSRQIVRYY
                 ||||||||||||||||||||||||||||||||||||||||||:|::||||||||||||
       m770      EKVPGQVREKGKVLQIDGETLLKNPELLSRAMYSAVVSNNIAGIRVILPIYLQQAQQDKM
                    70         80         90        100        110        120

130        140        150        160        170        180
       g770.pep  DPKRKAFAYLVYSDKIVQGSPKNSLSAVSCFGSGIPQTDGVQADTSGKLLAGACIISNPI
                 ||||||:|||||||||:|||||||||||||||:|||||||||||||| ||||||:|||||
       m770      DPKRKTFAYLVYSDKIIQGSPKNSLSAVSCFGGGIPQTDGVQADTSGNLLAGACMISNPI
                   130        140        150        160        170        180 g770.pep  KNPDKRX
                 :| ||||
       m770      ENLDKRX
```

The following partial DNA sequence was identified in *N. meningitidis* <SEQ ID 2649>:

```
a770.seq
  1 ATGAACAGAC TGCTACTGCT GTCTGCCGCC GTCCTGCTGA CTGCCTGCGG

51 CAGCGGCGAA ACCGATAAAA TCGGACGGGC AAGTACCGTT TTCAACATAC

101 TGGGCAAAAA CGACCGTATC GAAGTGGAAG GATTCGACGA TCCCGACGTT

151 CAAGGGGTTG CCTGTTATAT TTCGTATGCA AAAAAAGGCG GCTTGAAGGA
```

-continued

```
201 AATGGTCAAT TTGGAAGAGG ACGCGTCCGA CGCATCGGTT TCGTGCGTTC

251 AGACGGCATC TTCGATTTCT TTTGACGAAA CCGCCGTGCG CAAACCGAAA

301 GAAGTTTTCA AACACGGTGC GAGCTTCGCG TTCAAGAGCC GGCAGATTGT

351 CCGTTATTAC GACCCCAAAC GCAAAACCTT CGCCTATTTG GTGTACAGCG

401 ATAAAATCAT CCAAGGCTCG CCGAAAAATT CCTTAAGCGC GGTTTCCTGT

451 TTCGGCGGCG GCATACCGCA AACCGATGGG GTGCAAGCCG ATACTTCCGG

501 CAACCTGCTT GCCGGCGCCT GCATGATTTC CAACCCGATA GAAATCCCG

551 ACAAACGCTG A
```

This corresponds to the amino acid sequence <SEQ ID 2650; ORF 770.a>:

```
a770.pep
  1 MNRLLLLSAA VLLTACGSGE TDKIGRASTV FNILGKNDRI EVEGFDDPDV

51 QGVACYISYA KKGGLKEMVN LEEDASDASV SCVQTASSIS FDETAVRKPK

101 EVFKHGASFA FKSRQIVRYY DPKRKTFAYL VYSDKIIQGS PKNSLSAVSC

151 FGGGIPQTDG VQADTSGNLL AGACMISNPI ENPDKR*
```

Computer analysis of this amino acid sequence gave the following results:

Homology with a Predicted ORF from *N. meningitidis*

ORF 770 shows 99.5% identity over a 186 aa overlap with a predicted ORF (ORF 770) from *N. meningitidis*:

```
   m770/a770   99.5% identity in 186 aa overlap 10         20         30         40         50         60
   a770.pep   MNRLLLLSAAVLLTACGSGETDKIGRASTVFNILGKNDRIEVEGFDDPDVQGVACYISYA
              ||||||||||||||||||||||||||||||||||||||||||||||||||||||||||||
   m770       MNRLLLLSAAVLLTACGSGETDKIGRASTVFNILGKNDRIEVEGFDDPDVQGVACYISYA
                  10         20         30         40         50         60

70         80         90        100        110        120
   a770.pep   KKGGLKEMVNLEEDASDASVSCVQTASSISFDETAVRKPKEVFKHGASFAFKSRQIVRYY
              ||||||||||||||||||||||||||||||||||||||||||||||||||||||||||||
   m770       KKGGLKEMVNLEEDASDASVSCVQTASSISFDETAVRKPKEVFKHGASFAFKSRQIVRYY
                  70         80         90        100        110        120

130        140        150        160        170        180
   a770.pep   DPKRKTFAYLVYSDKIIQGSPKNSLSAVSCFGGGIPQTDGVQADTSGNLLAGACMISNPI
              ||||||||||||||||||||||||||||||||||||||||||||||||||||||||||||
   m770       DPKRKTFAYLVYSDKIIQGSPKNSLSAVSCFGGGIPQTDGVQADTSGNLLAGACMISNPI
                 130        140        150        160        170        180 a770.pep   ENPDKRX
              || ||||
   m770       ENLDKRX
```

The following partial DNA sequence was identified in *N. gonorrhoeae* <SEQ ID 2651>:

```
g771.seq
  1 ATGGATTTAT TATCGGTTTT CCACAAATAC CGTCTGAAAT ATGCGGTGGC

51 GGTGCTGACG ATGCTGCTTT TGGCGGCAGT CGGGCTGCAC GCTTCCGTAT

101 ATCGCACCTT CACGCCCGAA AACATCCGCA GCCGCCTCCA ACAAAGCATT

151 GCCCATACCC ACCGGAAAAT CTCGTTTGAT GCGGATATAC GGCGCAGGCT

201 TCTGCCCCGC CCGACCGTCA TCCTGAAAAA CCTGACCATT ACCGAACCCG

251 ACGGCGGCCG GGTCGCCGTT TCCGTCAAAG AAACCAAAAT CGGATTGAGC
```

```
-continued
 301 TGGAAAAACC TGTGGTCGGA TCGGATACAG GTTGAAAAAT GGGTGGTTTC

351 GGGTGCGGAT CTTGCCCTGA CGCGCGACAG AAACGGCGCT TGGAACATCC

401 AAGACCTGTT CGACGGCGCG AAACACTCCG CCTCAGTCAA CCGCATTATC

451 GTCGAAAACA GCACCGTCCG CCTCAATTTC CTGCAGCAAC AGCTTATCCT

501 GAAGGAAATC AGCCTCAACC TGCAATCCCC CGATTCGTCG GGGCAGCAGT

551 TTGAAAGTTC GGGCATACTG GTTTGGAGAA AGCTGTCCGT CCCGTGGAAA

601 AGCAGGGGGC TGTTCCTTTC AGACGGCATC GGCACGCCCG AAATCTCACC

651 GTTCCATTTT GAAGCTTCCA CTTCGCTGGA CGGACACGGC ATCACCATTT

701 CCACCACCGG CAGCCCTTCT GTCCGCTTCA ACGCCGGCGG AGCGGATGCC

751 GCCGGCCTCG GCCTGCGTGC AGACACTTCC TTCCGCAACC TCCACCTGAC

801 CGCGCAAATC CCCGCACTGG CACTCAAAAA CAACAGCATC AAAACCGGCA

851 CGGTCAACGG CACGTTTACC GCCGGCGGCG AATATGCCCG ATGGGACGGT

901 TCGTTCAAAC TCGACAAAGC CAACCTGCAC TCCGGCATCG CCAACATCGG

951 CAACGCCGAA ATCTCCGGCA GCTTCAAAAC ACCGCGCCTT CAAACCAATT

1001 TCTCCCTCGG CTCGCCGTTG GTTTGGAGTC GGGACAACGG GCTGGACGCC

1051 CCGCGCCTGC ACATATCGAC CCTTCAGGAT ACCGTCGACC GCCTGCCGCA

1101 ACCCGTTTC ATCAGCCGGC TCGACGGTTC GCTGTCCATA CCGAATCTGC

1151 AAAATTGGAA TGCCGAATTA AACGGCACAT TCGACCGCCA ACCCGTTGCC

1201 GCAAAATTCA ATATACGCG GGAAGGCGCA CCGCACCTGG AAGCCGCCGC

1251 CGCGCTGCAA AAATTAAACC TCGCCCCCTA TCTTGACGAA TTTCGGCAAC

1301 AAAACGGCAA AATATTCCCC GACATCCTCG GCAGGCTGTC CGGCAACGTC

1351 GAGGCACACC TCAAAATCGG CAGCATCCAA CTCCCCGGCT TGCAACTGGA

1401 CGATATGGAA ACCTACCTCC ACGCCGACAA AGACCATATC GCGCTCAGCC

1451 GTTTCAAGTC AGGGCTTTAC GGCGGCCATA CCGAAGGCGG CATCAGCATC

1501 GCCAACACCC GTCCCGCCAC TTACCGCCTG CAACAGAATG CAAGCAACAT

1551 CCAAATCCAA CCGCTGCTGC AAGACCTGTT CGGCTTCCAC AGCTTCAGCG

1601 GCAACGGCGA TGCGGTCATC GACCTGACCG CAAGCGGCGA AAACCGCAAA

1651 CAGCTTATCC GCTCGCTGCA AGGCAGCCTG TCGCTGAATA TTTCCAACGG

1701 CGCGTGGCAC GGCATCGATA TGGACAGCAT TTTAAAAAAC GGCCTTTCCG

1751 GGAAAATCTC GGGCAGCACA CCCTTCTACC GATTCACGCT CAACAGCGAA

1801 ATTTCAGACG GCATCAGCCG CCACATCGAT ACCGAACTCT CTCCGACAG

1851 CCTCTATGTT ACCAGCAACG GCTATACCAA TCTGGATACG CAGGAATTGT

1901 CTGAAGATGT CCTTATCCGC AACGCCGTCC ATCCGAAAAA CAAACCGATT

1951 CCCCTGAAAA TCACCGGTAC GGTGGACAAG CCGTCCATTA CCGTCGATTA

2001 CGGCAGGCTG ACCGGCGGCA TCAATTCGCG CAAAGAGAAA CAGAAAATCC

2051 TCGAAGACAC CCTGCTGGAA CAATGGCAGT GGCTCAAACC TAAAGAACCG

3051 TAA
```

This corresponds to the amino acid sequence <SEQ ID 2652; ORF 771.ng>:

```
g771.pep
   1 MDLLSVFHKY RLKYAVAVLT MLLLAAVGLH ASVYRTFTPE NIRSRLQQSI

51 AHTHRKISFD ADIRRRLLPR PTVILKNLTI TEPDGGRVAV SVKETKIGLS

101 WKNLWSDRIQ VEKWVVSGAD LALTRDRNGA WNIQDLFDGA KHSASVNRII

151 VENSTVRLNF LQQQLILKEI SLNLQSPDSS GQQFESSGIL VWRKLSVPWK

201 SRGLFLSDGI GTPEISPFHF EASTSLDGHG ITISTTGSPS VRFNAGGADA

251 AGLGLRADTS FRNLHLTAQI PALALKNNSI KTGTVNGTFT AGGEYARWDG

301 SFKLDKANLH SGIANIGNAE ISGSFKTPRL QTNFSLGSPL VWSRDNGLDA

351 PRLHISTLQD TVDRLPQPRF ISRLDGSLSI PNLQNWNAEL NGTFDRQPVA

401 AKFKYTREGA PHLEAAAALQ KLNLAPYLDE FRQQNGKIFP DILGRLSGNV

451 EAHLKIGSIQ LPGLQLDDME TYLHADKDHI ALSRFKSGLY GGHTEGGISI

501 ANTRPATYRL QQNASNIQIQ PLLQDLFGFH SFSGNGDAVI DLTASGENRK

551 QLIRSLQGSL SLNISNGAWH GIDMDSILKN GLSGKISGST PFYRFTLNSE

601 ISDGISRHID TELFSDSLYV TSNGYTNLDT QELSEDVLIR NAVHPKNKPI

651 PLKITGTVDK PSITVDYGRL TGGINSRKEK QKILEDTLLE QWQWLKPKEP

701 *
```

The following partial DNA sequence was identified in *N. meningitidis* <SEQ ID 2653>:

```
m771.seq
   1 ATGGATTTAT TATCGGTTTT CCACAAATAC CGTCTGAAAT ATGCGGTGGC

51 CGTGCTGACG ATACTGCTTT TGGCGGCAGT CGGGCTGCAC GCTTCCGTAT

101 ATCGCACCTT CACGCCTGAA AACATCCGCA GCCGCCTACA ACAAAGCATT

151 GCACACACAC ACCGGAAAAT CTCGTTTGAT GCGGACATTC AGCGCAGGCT

201 CCTGCCCCGG CCGACCGTCA TCCTGAAAAA CCTGACCATT ACCGAACCCG

251 GCGGCGACCA GACTGCCGTT TCCGTCCAAG AAACCAAAAT CGGATTGAGC

301 TGGAAAAACC TGTGGTCGGA TCAGATACAG ATTGAAAAAT GGGTGGTTTC

351 GAGTGCGGAA CTTGCCCTGA CGCGCGACGG GAAAGGTGTT TGGAACATCC

401 AAGACCTGAT CGACAGCCAA AAACGCCAAG CCTCAGTCAA CCGCATTATC

451 GTCGAAAACA GCACCGTCCG CCTCAATTTC CTGCAGGAAC AGCTTATCCT

501 GAAGGAAATC AACCTCAACC TGCAATCCCC CGATTCGTCG GGGCAGCCGT

551 TTGAAAGTTC GGGCATACTG GTTTGGGGAA AGCTGTCCGT CCCGTGGAAA

601 AGCAGGGGGC TGTTCCTTTC AAACGGCATC GGCCCGCCCG AAATCTCACC

651 GTTCCATTTT GAAGCTTCCA CTTCGCTGGA CGGACACGGC ATTACCATTT

701 CCACCACCGG CAGCCCTTCT GTCCGCTTCA ACGCCGGCGG AGCGGATGCC

751 GCCGGCCTCG GCCTGCGTGC AGACACTTCC TTCCGCAACC TCCACCTGAC

801 CGCCCAAATC CCCGCGCTGG CACTCAGGAA CAACAGCATT AAAATTGAAA

851 CCGTCAACGG CGCATTTACC GCCGGCGGCG AATATGCCCG ATGGGACGGT

901 TCGTTCAAAC TCGACAAAGC CAACCTGCAC TCCGGCATCG CCAACATCGG

951 CAACGCCGAA ATCTCCGGCA GCTTCAAAAC ACCGCGCCAC CAGACCAACT
```

```
-continued
1001 TCTCCCTCAA TTCGCCGCTC GTATGGACGG AAAACAAAGG GCTGGACGCG

1051 CCGCGCCTGT ATGTATCGAC CCTTCAGGAT ACCGTCAACC GCCTGCCGCA

1101 ACCCCGTTTC ATCAGCCGGC TCGACGGTTC GCTGTCCGTA CCGAATCTGC

1151 AAAATTGGAA TGCCGAATTA AACGGCACAT TCGACCGCCA AACCGTTGCC

1201 GCGAAATTCA GATACACACA TGAAGACGCA CCGCATCTGG AAGCCGCCGT

1251 CGCACTGCAA AAATTGAACC TGACCCCCTA TCTTGACGAC GTGCGGCAAC

1301 AAAACGGCAA AATATTTCCC GACACCCTCG CCAAGCTGTC CGGCGACATC

1351 GAGGCGCACC TGAAAATCGG AAAAGTCCAA CTTCCCGGCC TGCAACTGGA

1401 CGATATGGAA ACCTACCTCC ACGCCGACAA AGGCCATATC GCGCTCAGCC

1451 GTTTCAAGTC AGGGCTTTAC GGCGGCCATA CCGAAGGCGG CATCAGCATC

1501 GCCAACACCC GTCCCGCCAC TTACCGCCTG CAACAGAATG CAAGCAACAT

1551 CCAAATCCAA CCGCTGCTGC AAGACCTGTT CGGCTTCCAC AGCTTCAGCG

1601 GCAACGGCGA CGCGGTCATC GACCTGACCG CGGGCGGCGA AACCCGAAAA

1651 GAGCTTATCC GCTCGCTTCA GGGCAGCCTG TCGCTAAATA TTTCCAACGG

1701 TGCATGGCAC GGTATCGACA TGGACAATAT CCTGAAAAAC GGCATTTCGG

1751 GCAAAACTGC CGACAATGCC GCACCCAGCA CACCCTTCCA CCGATTCACG

1801 CTCAACAGCG AAATTTCAGA CGGCATCAGC CGCCACATCG ATACCGAACT

1851 CTTCTCCGAC AGCCTCTATG TTACCAGCAA CGGCTATACC AATCTGGATA

1901 CGCAGGAATT GTCTGAAGAT GTCCTTATCC GCAACGCCGT CCATCCGAAA

1951 AACAAACCGA TTCCCCTGAA AATCACCGGC ACGGTGGACA AACCGTCCAT

2001 TACCGTCGAT TACGGCAGGC TGACCGGCGG CATCAATTCG CGCAAAGAGA

2051 AACAGAAAAT CCTCGAAGAC ACCCTGCTGG AACAATGGCA GTGGCTCAAA

2101 CCTAAAGAAC CGTA
```

This corresponds to the amino acid sequence <SEQ ID 2654; ORF 771>:

```
m771.pep
   1 MDLLSVFHKY RLKYAVAVLT ILLLAAVGLH ASVYRTFTPE NIRSRLQQSI

51 AHTHRKISFD ADIQRRLLPR PTVILKNLTI TEPGGDQTAV SVQETKIGLS

101 WKNLWSDQIQ IEKWVVSSAE LALTRDGKGV WNIQDLIDSQ KRQASVNRII

151 VENSTVRLNF LQEQLILKEI NLNLQSPDSS GQPFESSGIL VWGKLSVPWK

201 SRGLFLSNGI GPPEISPFHF EASTSLDGHG ITISTTGSPS VRFNAGGADA

251 AGLGLRADTS FRNLHLTAQI PALALRNNSI KIETVNGAFT AGGEYARWDG

301 SFKLDKANLH SGIANIGNAE ISGSFKTPRH QTNFSLNSPL VWTENKGLDA

351 PRLYVSTLQD TVNRLPQPRF ISRLDGSLSV PNLQNWNAEL NGTFDRQTVA

401 AKFRYTHEDA PHLEAAVALQ KLNLTPYLDD VRQQNGKIFP DTLAKLSGDI

451 EAHLKIGKVQ LPGLQLDDME TYLHADKGHI ALSRFKSGLY GGHTEGGISI

501 ANTRPATYRL QQNASNIQIQ PLLQDLFGFH SFSGNGDAVI DLTAGGETRK

551 ELIRSLQGSL SLNISNGAWH GIDMDNILKN GISGKTADNA APSTPFHRFT

601 LNSEISDGIS RHIDTELFSD SLYVTSNGYT NLDTQELSED VLIRNAVHPK
```

```
-continued
651 NKPIPLKITG TVDKPSITVD YGRLTGGINS RKEKQKILED TLLEQWQWLK

701 PKEP*
```

Computer analysis of this amino acid sequence gave the following results:

Homology with a Predicted ORF from *N. gonorrhoeae*

ORF 771 shows 90.3% identity over a 704 aa overlap with a predicted ORF (ORF 771) from *N. gonorrhoeae*

```
    m771/g771    90.3% identity in 704 aa overlap 10        20        30        40        50        60
         g771.pep  MDLLSVFHKYRLKYAVAVLTMLLLAAVGLHASVYRTFTPENIRSRLQQSIAHTHRKISFD
                   ||||||||||||||||||||:|||||||||||||||||||||||||||||||||||||||
         m771      MDLLSVFHKYRLKYAVAVLTILLLAAVGLHASVYRTFTPENIRSRLQQSIAHTHRKISFD
                        10        20        30        40        50        60

70        80        90       100       110       120
         g771.pep  ADIRRRLLPRPTVILKNLTITEPDGGRVAVSVKETKIGLSWKNLWSDRIQVEKWVVSGAD
                   |||:||||||||||||||||||||| |::||||:||||||||||||||::|||||||:|:
         m771      ADIQRRLLPRPTVILKNLTITEPGGDQTAVSVQETKIGLSWKNLWSDQIQIEKWVVSSAE
                        70        80        90       100       110       120

130       140       150       160       170       180
         g771.pep  LALTRDRNGAWNIQDLFDGAKHSASVNRIIVENSTVRLNFLQQQLILKEISLNLQSPDSS
                   ||||||| :|:||||||:|: |::||||||||||||||||||:||||||:||||||||||
         m771      LALTRDGKGVWNIQDLIDSQKRQASVNRIIVENSTVRLNFLQEQLILKEINLNLQSPDSS
                       130       140       150       160       170       180

190       200       210       220       230       240
         g771.pep  GQQFESSGILVWRKLSVPWKSRGLFLSDGIGTPEISPFHFEASTSLDGHGITISTTGSPS
                   || |||||||||| |||||||||||||:||| |||||||||||||||||||||||||||
         m771      GQPFESSGILVWGKLSVPWKSRGLFLSNGIGPPEISPFHFEASTSLDGHGITISTTGSPS
                       190       200       210       220       230       240

250       260       270       280       290       300
         g771.pep  VRFNAGGADAAGLGLRADTSFRNLHLTAQIPALALKNNSIKTGTVNGTFTAGGEYARWDG
                   ||||||||||||||||||||||||||||||||||||:|||| ||||:|||||||||||||
         m771      VRFNAGGADAAGLGLRADTSFRNLHLTAQIPALALRNNSIKIETVNGAFTAGGEYARWDG
                       250       260       270       280       290       300

310       320       330       340       350       360
         g771.pep  SFKLDKANLHSGIANIGNAEISGSFKTPRLQTNFSLGSPLVWSRDNGLDAPRLHISTLQD
                   ||||||||||||||||||||||||||||||:|||||:|||||::::|||||||::|||||
         m771      SFKLDKANLHSGIANIGNAEISGSFKTPRHQTNFSLNSPLVWTENKGLDAPRLYVSTLQD
                       310       320       330       340       350       360

370       380       390       400       410       420
         g771.pep  TVDRLPQPRFISRLDGSLSIPNLQNWNAELNGTFDRQPVAAKFKYTREGAPHLEAAAALQ
                   ||:||||||||||||||||:|||||||||||||||||| |||||:||:| |||||||:|||
         m771      TVNRLPQPRFISRLDGSLSVPNLQNWNAELNGTFDRQTVAAKFRYTHEDAPHLEAAVALQ
                       370       380       390       400       410       420

430       440       450       460       470       480
         g771.pep  KLNLAPYLDEFRQQNGKIFPDILGRLSGNVEAHLKIGSIQLPGLQLDDMETYLHADKDHI
                   ||||:||||: |||||||||||| |::|||::|||||::||||||||||||||||||| ||
         m771      KLNLTPYLDDVRQQNGKIFPDTLAKLSGDIEAHLKIGKVQLPGLQLDDMETYLHADKGHI
                       430       440       450       460       470       480

490       500       510       520       530       540
         g771.pep  ALSRFKSGLYGGHTEGGISIANTRPATYRLQQNASNIQIQPLLQDLFGFHSFSGNGDAVI
                   ||||||||||||||||||||||||||||||||||||||||||||||||||||||||||||
         m771      ALSRFKSGLYGGHTEGGISIANTRPATYRLQQNASNIQIQPLLQDLFGFHSFSGNGDAVI
                       490       500       510       520       530       540

550       560       570       580       590
         g771.pep  DLTASGENRKQLIRSLQGSLSLNISNGAWHGIDMDSILKNGLSGKISG----STPFYRFT
                   ||||:||:||:|||||||||||||||||||||||||:|||||:|||   :    ||||:|||
         m771      DLTAGGETRKELIRSLQGSLSLNISNGAWHGIDMDNILKNGISGKTADNAAPSTPFHRFT
                       550       560       570       580       590       600

600       610       620       630       640       650
         g771.pep  LNSEISDGISRHIDTELFSDSLYVTSNGYTNLDTQELSEDVLIRNAVHPKNKPIPLKITG
                   ||||||||||||||||||||||||||||||||||||||||||||||||||||||||||||
         m771      LNSEISDGISRHIDTELFSDSLYVTSNGYTNLDTQELSEDVLIRNAVHPKNKPIPLKITG
                       610       620       630       640       650       660
```

-continued

```
            660       670       680       690       700
g771.pep  TVDKPSITVDYGRLTGGINSRKEKQKILEDTLLEQWQWLKPKEPX
          |||||||||||||||||||||||||||||||||||||||||||||
m771      TVDKPSITVDYGRLTGGINSRKEKQKILEDTLLEQWQWLKPKEPX
                  670       680       690       700
```

The following partial DNA sequence was identified in *N. meningitidis* <SEQ ID 2655>:

```
a771.seq
   1 ATGGATTTAT TATCGGTCTT CCACAAATAC CGTCTGAAAT ATGCGGTAGC
  51 CGTGCTGACG ATACTGCTTT TGGCGGCAAT CGGGCTGCAC GCTTCCGTAT
 101 ATCGCATCTT CACACCTGAA AACATCCGAA GCCGCCTCCA ACAAAGCATT
 151 GCCCATACGC ACCGGAAAAT CTCGTTTGAT GCGGATATAC AGCGCAGGCT
 201 TCTGCCCCGG CCGACCGTCA TCCTGAAAAA CCTGACCATT ACCGAACCCG
 251 GCGGCGACCG GACTGCCGTT TCCGTCCAAG AAACCAAAAT CGGATTGAGC
 301 TGGAAAAACC TGTGGTCGGA TCAGATACAG ATTGAAAAAT GGGTGGTTTC
 351 GAGTGCGGAA CTTGCCCTGA CGCGCGACGG GAAAGGTGTT TGGAACATCC
 401 AAGACCTGAT CGACAGCCAA AAACGCCAAG CCTCAGTCAA CCGCATTATC
 451 GTCGAAAACA GCACCGTCCG CCTCAATTTC CTGCAGGAAC AGCTTATCCT
 501 GAAGGAAATC AACCTCAACC TGCAATCCCC CGATTCGTCG GGGCAGCCGT
 551 TTGAAAGTTC GGGCATACTG GTTTGGGGAA AGCTGTCCGT CCCGTGGAAA
 601 AGCAGGGGGC TGTTCCTTTC AGACGGCATC GGCACGCCCA AAATCTCACC
 651 GTTCCATTTT GAAGCTTCCA CTTCGCTGGA CGGACACGGC ATTACCATTT
 701 CCACCACCGG CAGCCCTTCT GTCCGCTTCA ACGCCGGCGG AGCGGATGCC
 751 GCCGGCCTCG GCCTGCGTGC AGACACTTCC TTCCGCAACC TCCACCTGAC
 801 CGCCCAAATC CCTACGCTGG CACTCAGGAA CAACAGCATT AAAATTGAAA
 851 CCGTCAACGG CGCATTTACC GCCGGCGGCG AATATGCCCA ATGGGACGGT
 901 TCGTTCAAAC TCGACAAAGC CAACCTGCAC TCCGGCATCG CCAACATCGG
 951 CAACGCCGAA ATCTCCGGCA GCTTCAAAAC ACCGCGCCAC CAGACCAACT
1001 TCTCCCTCAA TTCGCCGCTC GTATGGACGG AAAACAAAGG GCTGGACGCG
1051 CCGCGCCTGT ATGTATCGAC CCTTCAGGAT ACCGTCAACC GCCTGCCGCA
1101 ACCCCGTTTC ATCAGCCGGC TCGACGGTTC GCTGTCCGTA CCGAATCTGC
1151 AAAATTGGAA TGCCGAATTA AACGGCACAT TCGACCGCCA AACCGTTGCC
1201 GCGAAATTCA GATACACACA TGAAGACGCA CCGCATCTGG AAGCCGCCGT
1251 CGCACTGCAA AAATTGAACC TGACCCCCTA TCTTGACGAC GTGCGGCAAC
1301 AAAACGGCAA AATATTTCCC GACACCCTCG CCAAGCTGTC CGGCGACATC
1351 GAGGCGCACC TGAAAATCGG AAAAGTCCAA CTTCCCGGCC TGCAACTGGA
1401 CGATATGGAA ACCTACCTCC ACGCCGACAA AGGCCATATC GCGCTCAGCC
1451 GTTTCAAGTC AGGGCTTTAC GGCGGCCATA CCGAAGGCGG CATCAGCATC
1501 GCCAACACCC GTCCCGCCAC TTACCGCCTG CAACAGAATG CAAGCAACAT
1551 CCAAATCCAA CCGCTGCTGC AAGACCTGTT CGGCTTCCAC AGCTTCAGCG
1601 GCAACGGCGA CGCGGTCATC GACCTGACCG CGGGCGGCGA AACCCGAAAA
```

```
1651 GAGCTTATCC GCTCGCTTCA GGGCAGCCTG TCGCTAAATA TTTCCAACGG

1701 TGCATGGCAC GGTATCGACA TGGACAATAT CCTGAAAAAC GGCATTTCGG

1751 GCAAAACTGC CGACAATGCC GCACCCAGCA CACCCTTCCA CCGATTCACG

1801 CTCAACAGCG AAATTTCAGA CGGCATCAGC CGCCACATCG ATACCGAACT

1851 CTTCTCCGAC AGCCTCTATG TTACCAGCAA CGGCTATACC AATCTGGATA

1901 CGCAGGAATT GTCTGAAGAT GTCCTTATCC GCAACGCCGT CCATCCGAAA

1951 AACAAACCGA TTCCCCTGAA AATCACCGGT ACGGTGGACA AACCGTCCAT

2001 TACCGTCGAT TACGGCAGGC TGACCGGCGG CATCAATTCG CGCAAAGAGA

2051 AACAGAAAAT CCTCGAAGAC ACCCTGCTGG AACAATGGCA GTGGCTCAAA

2101 CCTAAAGAAC CGTAA
```

This corresponds to the amino acid sequence <SEQ ID 2656; ORF 771.a>:

```
a771.pep
  1 MDLLSVFHKY RLKYAVAVLT ILLLAAIGLH ASVYRIFTPE NIRSRLQQSI

51 AHTHRKISFD ADIQRRLLPR PTVILKNLTI TEPGGDRTAV SVQETKIGLS

101 WKNLWSDQIQ IEKWVVSSAE LALTRDGKGV WNIQDLIDSQ KRQASVNRII

151 VENSTVRLNF LQEQLILKEI NLNLQSPDSS GQPFESSGIL VWGKLSVPWK

201 SRGLFLSDGI GTPKISPFHF EASTSLDGHG ITISTTGSPS VRFNAGGADA

251 AGLGLRADTS FRNLHLTAQI PTLALRNNSI KIETVNGAFT AGGEYAQWDG

301 SFKLDKANLH SGIANIGNAE ISGSFKTPRH QTNFSLNSPL VWTENKGLDA

351 PRLYVSTLQD TVNRLPQPRF ISRLDGSLSV PNLQNWNAEL NGTFDRQTVA

401 AKFRYTHEDA PHLEAAVALQ KLNLTPYLDD VRQQNGKIFP DTLAKLSGDI

451 EAHLKIGKVQ LPGLQLDDME TYLHADKGHI ALSRFKSGLY GGHTEGGISI

501 ANTRPATYRL QQNASNIQIQ PLLQDLFGFH SFSGNGDAVI DLTAGGETRK

551 ELIRSLQGSL SLNISNGAWH GIDMDNILKN GISGKTADNA APSTPFHRFT

601 LNSEISDGIS RHIDTELFSD SLYVTSNGYT NLDTQELSED VLIRNAVHPK

651 NKPIPLKITG TVDKPSITVD YGRLTGGINS RKEKQKILED TLLEQWQWLK

701 PKEP*
```

Computer analysis of this amino acid sequence gave the following results:

Homology with a Predicted ORF from *N. meningitidis*

ORF 771 shows 98.9% identity over a 704 aa overlap with a predicted ORF (ORF 771) from *N. meningitidis*

```
   m771/a771    98.9% identity in 704 aa overlap 10         20         30         40         50         60
      a771.pep  MDLLSVFHKYRLKYAVAVLTILLLAAIGLHASVYRIFTPENIRSRLQQSIAHTHRKISFD
                ||||||||||||||||||||||||||||||:||||||||||||||||||||||||||||
      m771      MDLLSVFHKYRLKYAVAVLTILLLAAVGLHASVYRTFTPENIRSRLQQSIAHTHRKISFD
                    10         20         30         40         50         60

70         80         90        100        110        120
      a771.pep  ADIQRRLLPRPTVILKNLTITEPGGDRTAVSVQETKIGLSWKNLWSDQIQIEKWVVSSAE
                ||||||||||||||||||||||||||||:|||||||||||||||||||||||||||||||
      m771      ADIQRRLLPRPTVILKNLTITEPGGDQTAVSVQETKIGLSWKNLWSDQIQIEKWVVSSAE
                    70         80         90        100        110        120
```

```
                    130        140        150        160        170        180
a771.pep  LALTRDGKGVWNIQDLIDSQKRQASVNRIIVENSTVRLNFLQEQLILKEINLNLQSPDSS
          ||||||||||||||||||||||||||||||||||||||||||||||||||||||||||||
m771      LALTRDGKGVWNIQDLIDSQKRQASVNRIIVENSTVRLNFLQEQLILKEINLNLQSPDSS
                    130        140        150        160        170        180

190        200        210        220        230        240
a771.pep  GQPFESSGILVWGKLSVPWKSRGLFLSDGIGTPKISPFHFEASTSLDGHGITISTTGSPS
          |||||||||||||||||||||||||||||||:|||  |:|||||||||||||||||||||
m771      GQPFESSGILVWGKLSVPWKSRGLFLSNGIGPPEISPFHFEASTSLDGHGITISTTGSPS
                    190        200        210        220        230        240

250        260        270        280        290        300
a771.pep  VRFNAGGADAAGLGLRADTSFRNLHLTAQIPTLALRNNSIKIETVNGAFTAGGEYAQWDG
          |||||||||||||||||||||||||||||||:||||||||||||||||||||||||:|||
m771      VRFNAGGADAAGLGLRADTSFRNLHLTAQIPALALRNNSIKIETVNGAFTAGGEYARWDG
                    250        260        270        280        290        300

310        320        330        340        350        360
a771.pep  SFKLDKANLHSGIANIGNAEISGSFKTPRHQTNFSLNSPLVWTENKGLDAPRLYVSTLQD
          ||||||||||||||||||||||||||||||||||||||||||||||||||||||||||||
m771      SFKLDKANLHSGIANIGNAEISGSFKTPRHQTNFSLNSPLVWTENKGLDAPRLYVSTLQD
                    310        320        330        340        350        360

370        380        390        400        410        420
a771.pep  TVNRLPQPRFISRLDGSLSVPNLQNWNAELNGTFDRQTVAAKFRYTHEDAPHLEAAVALQ
          ||||||||||||||||||||||||||||||||||||||||||||||||||||||||||||
m771      TVNRLPQPRFISRLDGSLSVPNLQNWNAELNGTFDRQTVAAKFRYTHEDAPHLEAAVALQ
                    370        380        390        400        410        420

430        440        450        460        470        480
a771.pep  KLNLTPYLDDVRQQNGKIFPDTLAKLSGDIEAHLKIGKVQLPGLQDDMETYLHADKGHI
          ||||||||||||||||||||||||||||||||||||||||||||||||||||||||||||
m771      KLNLTPYLDDVRQQNGKIFPDTLAKLSGDIEAHLKIGKVQLPGLQDDMETYLHADKGHI
                    430        440        450        460        470        480

490        500        510        520        530        540
a771.pep  ALSRFKSGLYGGHTEGGISIANTRPATYRLQQNASNIQIQPLLQDLFGFHSFSGNGDAVI
          ||||||||||||||||||||||||||||||||||||||||||||||||||||||||||||
m771      ALSRFKSGLYGGHTEGGISIANTRPATYRLQQNASNIQIQPLLQDLFGFHSFSGNGDAVI
                    490        500        510        520        530        540

550        560        570        580        590        600
a771.pep  DLTAGGETRKELIRSLQGSLSLNISNGAWHGIDMDNILKNGISGKTADNAAPSTPFHRFT
          ||||||||||||||||||||||||||||||||||||||||||||||||||||||||||||
m771      DLTAGGETRKELIRSLQGSLSLNISNGAWHGIDMDNILKNGISGKTADNAAPSTPFHRFT
                    550        560        570        580        590        600

610        620        630        640        650        660
a771.pep  LNSEISDGISRHIDTELFSDSLYVTSNGYTNLDTQELSEDVLIRNAVHPKNKPIPLKITG
          ||||||||||||||||||||||||||||||||||||||||||||||||||||||||||||
m771      LNSEISDGISRHIDTELFSDSLYVTSNGYTNLDTQELSEDVLIRNAVHPKNKPIPLKITG
                    610        620        630        640        650        660

670        680        690        700
a771.pep  TVDKPSITVDYGRLTGGINSRKEKQKILEDTLLEQWQWLKPKEPX
          ||||||||||||||||||||||||||||||||||||||||||||
m771      TVDKPSITVDYGRLTGGINSRKEKQKILEDTLLEQWQWLKPKEPX
                    670        680        690        700
```

The following partial DNA sequence was identified in *N. gonorrhoeae* <SEQ ID 2657>:

```
g772.seq
   1  GTGTTCGGCA CGGTCTTGCG GACTGATGCC GACTGCCTGC AAATCATCGT

51  CGTCGGCAAG TTCTTTCAGG TTGTTGCGTA TGGTTTTGCG GCGTTGGCGG

101  AAGGCGAGTT TCACCAGTTT GGCGAAATGA TCGAAATCGT CCGCCTTGCC

151  GATACGGTGT TCACCGGAA TCATGCGCAC CACTGCGGAA TCGATTTTCG

201  GCGCGGGATC GAACGATTCG GCGGCACGT CAATCAGCAG CTCCATATCG

251  AAAAAATATT GCAGCATCAC ACCCAAGCGA CCGTAGTCGT TGCTTTTCGG

301  CGCGGCAACC ATGCGCTCGA CCACTTCTTT TTGCAACATA AAGTGCATAT
```

-continued

```
351 CGGCGACATC GTCCGCCACC TCCGCCAGTT TGAACAAAAG CGGCGTGGAG

401 ATGTTATACG GCAGGTTGCC GACGATTTTC TTTTTGCCTG AGATGCCGTT

451 GAAATCAAAC TGCAACACGT CGCCTTCGTG AATCACCAGT TTATCCGCAA

501 ACGGCAGCGT TTTCAGACGG CATACGATGT CGCGGTCGAT TTCGACAACG

551 TGCAGGCGGT TCAGCTTTTT CGCCAAAGGT TCGGTAATTG CCGCCAAACC

601 CGGGCCGATT TCAATCACGA CATCATCCGC CTGCGGGCGC ACGGCGTTGA

651 CAATATCGCC GATAATCCGC GTGTCCTGCA AAAAATTCTG CCCGAAACGC

701 TTGCGGGCTT TGTGTTCTTT CATCGTGTTT CCTCTTCGGT TGAAACCCCG

751 CCCTTTAGGG CGGCAGGATC AGACTCTGTT TGGGCGGGGC GTAACCCCTT

801 CCAAATCAGG ACGACACATA GGGCGGTGCT TTATGTGTCG TCCTGTGTGT

851 TGGAACATAA ATGTGTTTAC AGTATCCGTT TGATGTCGGC ATTGTAA
```

This corresponds to the amino acid sequence <SEQ ID 2658; ORF 772.ng>:

```
g772.pep
  1 VFGTVLRTDA DCLQIIVVGK FFQVVAYGFA ALAEGEFHQF GEMIEIVRLA

51 DTVFHRNHAH HCGIDFRRGI ERFGRHVNQQ LHIEKILQHH TQATVVVAFR

101 RGNHALDHFF LQHKVHIGDI VRHLRQFEQK RRGDVIRQVA DDFLFA*DAV

151 EIKLQHVAFV NHQFIRKRQR FQTAYDVAVD FDNVQAVQLF RQRFGNCRQT

201 RADFNHDIIR LRAHGVDNIA DNPRVLQKIL PETLAGFVFF HRVSSSVETP

251 PFRAAGSDSV WAGRNPFQIR TTHRAVLYVS SCVLEHKCVY SIRLMSAL*
```

The following partial DNA sequence was identified in *N. meningitidis* <SEQ ID 2659>:

```
m772.seq
  1 ATGTTCGGCG CGGTCTTGCG GATTGATGCC GACTGCCTGC AAATCATCGT

51 CGCCTGCAAG CTCTTTCAGA TTGTTGCGTA TGGTTTTGCG GCGTTGGTGG

101 AAGGCGAGTT TCACGAGTTT GGCAAAATGC TCGAAATCGT CCGCCTTGCC

151 GATGCGGTGT TCACCGGAA TCATACGGAC GACGGCGGAA TCCACTTTCG

201 GCGCAGGGTC GAACGATTCG GCGGTACGT CAATCAGCAT TTCCATATCG

251 AAAAAATATT GCAGCATCAC GCCCAAGCGG CCGTAGTCGT TGCTTTTCGG

301 CGCGGCAACC ATACGCTCGA CCACTTCTTT TTGCAGCATA AAGTGCATAT

351 CGACGACATC GTCCGCCACC TCCGCCAGCT TGAACAAAAG CGGTGTGGAA

401 ATGTTGTACG GGAGGTTGCC GACGATTTTC TTTTTGCCTG CGATGCCGTT

451 GAAATCAAAC TGCAATACAT CGCCTTCGTG AATCACCAGT TTATCCGCAA

501 ACGGCAGCGT TTTCAGACGG CATACGATGT CGCGGTCGAT TTCGACAACG

551 TGCAGGCGGT TCAGCTTTTT CGCCAAAGGT TCGGTAATCG CCGCCAAACC

601 CGGGCCGATT TCAATCACGA CATCATCCGC CTGCGGGCGC ACGGCGTTGA

651 CAATATCGCT GATAATCCGC GTGTCCTGCA AAAAATTCTG CCCGAAACGC

701 TTGCGGGCTT TGTGTTCTTT CATCGTGTTT CCTTTTCGGT TGAAACCCCG

751 CCCTTTAGGG CGGTAGAATC AGACTCTATT TGGGAGGGGC GTAACTCTTT
```

-continued
```
801 CCAAATCAGG ATGGCACATA GGGCGGTGCT TTATGTGTCG TCCTGTGTGT

851 TGAAACATAA ATGTGTTTAC AGTATCCGTT TGATGTCGGC ATTGTAA
```

This corresponds to the amino acid sequence <SEQ ID 2660; ORF 772>:

```
m772.pep
  1 MFGAVLRIDA DCLQIIVACK LFQIVAYGFA ALVEGEFHEF GKMLEIVRLA

51 DAVFHRNHTD DGGIHFRRRV ERFGRYVNQH FHIEKILQHH AQAAVVVAFR

101 RGNHTLDHFF LQHKVHIDDI VRHLRQLEQK RCGNVVREVA DDFLFACDAV

151 EIKLQYIAFV NHQFIRKRQR FQTAYDVAVD FDNVQAVQLF RQRFGNRRQT

201 RADFNHDIIR LRAHGVDNIA DNPRVLQKIL PETLAGFVFF HRVSFSVETP

251 PFRAVESDSI WEGRNSFQIR MAHRAVLYVS SCVLKHKCVY SIRLMSAL*
```

Computer analysis of this amino acid sequence gave the following results:
Homology with a Predicted ORF from *N. gonorrhoeae*
ORF 772 shows 85.2% identity over a 298 aa overlap with a predicted ORF (ORF 772) from *N. gonorrhoeae*

```
    m772/g772  85.2% identity in 298 aa overlap 10         20         30         40         50         60
    g772.pep  VFGTVLRTDADCLQIIVVGKFFQVVAYGFAALAEGEFHQFGEMIEIVRLADTVFHRNHAH
              :||:|||  ||||||||||:  |:||:|||||||||:|||||||::|:||||||||:||||:
    m772      MFGAVLRIDADCLQIIVACKLFQIVAYGFAALVEGEFHEFGKMLEIVRLADAVFHRNHTD
                10         20         30         40         50         60

70         80         90        100        110        120
    g772.pep  HCGIDFRRGIERFGRHVNQQLHIEKILQHHTQATVVVAFRRGNHALDHFFLQHKVHIGDI
               || |||  :||||:|||::|||||||||||:||:|||||||||:||||||||||||||  ||
    m772      DGGIHFRRRVERFGRYVNQHFHIEKILQHHAQAAVVVAFRRGNHTLDHFFLQHKVHIDDI
                70         80         90        100        110        120

130        140        150        160        170        180
    g772.pep  VRHLRQFEQKRRGDVIRQVADDFLFAXDAVEIKLQHVAFVNHQFIRKRQRFQTAYDVAVD
              ||||||:||||  |:|:|:|||||||||  ||||||||::||||||||||||||||||||||||||
    m772      VRHLRQLEQKRCGNVVREVADDFLFACDAVEIKLQYIAFVNHQFIRKRQRFQTAYDVAVD
               130        140        150        160        170        180

190        200        210        220        230        240
    g772.pep  FDNVQAVQLFRQRFGNCRQTRADFNHDIIRLRAHGVDNIADNPRVLQKILPETLAGFVFF
              ||||||||||||||||  |||||||||||||||||||||||||||||||||||||||||||||||
    m772      FDNVQAVQLFRQRFGNRRQTRADFNHDIIRLRAHGVDNIADNPRVLQKILPETLAGFVFF
               190        200        210        220        230        240

250        260        270        280        290    299
    g772.pep  HRVSSSVETPPFRAAGSDSVWAGRNPFQIRTTHRAVLYVSSCVLEHKCVYSIRLMSALX
              ||||  ||||||||||:  |||:|  |||  |||| :|||||||||||||||||||||||
    m772      HRVSFSVETPPFRAVESDSIWEGRNSFQIRMAHRAVLYVSSCVLKHKCVYSIRLMSALX
               250        260        270        280        290
```

The following partial DNA sequence was identified in *N. meningitidis* <SEQ ID 2661>:

```
a772.seq
  1 ATGTTCGGCG CGGTCTTGCG GATTGATGCC GACTGCCTGC AAATCATCGT

51 CGCCTGCAAG CTCTTTCAGA TTGTTGCGTA TGGTTTTGCG GCGTTGGTGG

101 AAGGCGAGTT TCACGAGTTT GGCGAAATGC TCGAAATCGT CCGCCTTGCC

151 GATACGGTGT TTCACCGGAA TCATGCGGAC GACGGCCGAA TCCACTTTCG

201 GCGCGGGGTC GAACGATTCG GCGGCACGT CAATCAGCAT TTCCATATCG

251 AAGAAATATT GCAGCATCAC GCCCAAGCGG CCGTAGTCGT TGCTTTTCGG

301 CGCGGCAACC ATACGATCGA CCACTTCTTT TTGCAGCATA AAGTGCATAT

351 CGACGACATC GTCCGCCACC TCCGCCAGCT TGAACAAAAG CGGCGTGGAA
```

-continued

```
401 ATGTTGTAGG GCAGGTTGCC GACGATTTTC TTTTTGCCTG CGATGCCGTT

451 GAAATCAAAC TGCAATACAT CGCCTTCGTG AATCACCAGT TTATCCGCAA

501 ACGGCAGCGT TTTCAGACGG CATACGATGT CGCGGTCGAT TTCGACAACG

551 TGCAGGCGGT TCAGCTTTTT CGCCAAAGGT TCGGTAATCG CCGCCAAACC

601 CGGACCGATT TCAATCACGA CATCATCCGC CTGCGGGCGC ACGGCGTTGA

651 CAATATCGCT GATAATCCGC GTGTCCTGCA AAAAATTCTG CCCGAAACGC

701 TTGCGGGCTT TGTGTTCTTT CATCGTGTTT CCTTTTCGGT TGAAACCCCG

751 CCCTTTAGGG CGGTAGAATC AGACTCTATT TGGGAGGGGC GTAACTCCTT

801 CCAAATCAGG ACGGCACATA GGGCGGTGCT TTATGTGTCG TCCTGTGTGT

851 TGAAACATAA ATGTGTTTAC AGTATCCGTT TGATGTCGGC ATTGTAA
```

This corresponds to the amino acid sequence <SEQ ID 2662; ORF 772.a>:

```
a772.pep
  1 MFGAVLRIDA DCLQIIVACK LFQIVAYGFA ALVEGEFHEF GEMLEIVRLA

51 DTVFHRNHAD DGRIHFRRGV ERFGRHVNQH FHIEEILQHH AQAAVVVAFR

101 RGNHTIDHFF LQHKVHIDDI VRHLRQLEQK RRGNVVGQVA DDFLFACDAV

151 EIKLQYIAFV NHQFIRKRQR FQTAYDVAVD FDNVQAVQLF RQRFGNRRQT

201 RTDFNHDIIR LRAHGVDNIA DNPRVLQKIL PETLAGFVFF HRVSFSVETP

251 PFRAVESDSI WEGRNSFQIR TAHRAVLYVS SCVLKHKCVY SIRLMSAL*
```

Computer analysis of this amino acid sequence gave the following results:
Homology with a Predicted ORF from N. meningitidis
ORF 772 shows 95.6% identity over a 298 aa overlap with a predicted ORF (ORF 772) from N. meningitidis

```
   m772/a772  95.6% identity in 298 aa overlap 10         20         30         40         50         60
   a772.pep MFGAVLRIDADCLQIIVACKLFQIVAYGFAALVEGEFHEFGEMLEIVRLADTVFHRNHAD
            |||||||||||||||||||||||||||||||||||||||:||||||:||||||:|
   m772     MFGAVLRIDADCLQIIVACKLFQIVAYGFAALVEGEFHEFGKMLEIVRLADAVFHRNHTD
                  10         20         30         40         50         60

70         80         90        100        110        120
   a772.pep DGRIHFRRGVERFGRHVNQHFHIEEILQHHAQAAVVVAFRRGNHTIDHFFLQHKVHIDDI
            ||  ||||| ||||||:||||||||:|||||||||||||||||:||||||||||||||||
   m772     DGGIHFRRRVERFGRYVNQHFHIEKILQHHAQAAVVVAFRRGNHTLDHFFLQHKVHIDDI
                  70         80         90        100        110        120

130        140        150        160        170        180
   a772.pep VRHLRQLEQKRRGNVVGQVADDFLFACDAVEIKLQYIAFVNHQFIRKRQRFQTAYDVAVD
            |||||||||| ||| |||||||||||||||||||||||||||||||||||||||||||||
   m772     VRHLRQLEQKRCGNVVREVADDFLFACDAVEIKLQYIAFVNHQFIRKRQRFQTAYDVAVD
                 130        140        150        160        170        180

190        200        210        220        230        240
   a772.pep FDNVQAVQLFRQRFGNRRQTRTDFNHDIIRLRAHGVDNIADNPRVLQKILPETLAGFVFF
            ||||||||||||||||||||:|||||||||||||||||||||||||||||||||||||||
   m772     FDNVQAVQLFRQRFGNRRQTRADFNHDIIRLRAHGVDNIADNPRVLQKILPETLAGFVFF
                 190        200        210        220        230        240

250        260        270        280        290    299
   a772.pep HRVSFSVETPPFRAVESDSIWEGRNSFQIRTAHRAVLYVSSCVLKHKCVYSIRLMSALX
            ||||||||||||||||||||||||||||||| |||||||||||||||||||||||||||
   m772     HRVSFSVETPPFRAVESDSIWEGRNSFQIRMAHRAVLYVSSCVLKHKCVYSIRLMSALX
                 250        260        270        280        290 g773.seq not found yet
   g773.pep not found yet
```

The following partial DNA sequence was identified in *N. meningitidis* <SEQ ID 2663>:

```
m773.seq
   1 ATGGGATTGG GTGCAACGAC TTTTGTCGGT TCGGGTGCTA TAGGCGGAGG

51 TCTGTGCAGT ACCGGGATTG GCTGTGCGGC CGGTGGACTT ATTGCAACGG

101 CAGGTATGAC CGGTGGTTAT ACACAGGCCT CAGAAGGAAG CCGGCAATTG

151 TTTGGCACTT ACCAGTCCGA TTTTGGTAAA AAAGTTGTCC TATCTTTGGG

201 TACACCAATA GAATACGAAT CGCCGTTAGT ATCTGATGCG AAAAATCTAG

251 CCGTATGGGG ATTGGAAACG CTGATTACGC GCAAATTGGG AAACTTGGCA

301 ACGGGTGTGA AAACTTCCTT GACTCCGAAA ACTGCTGACG TACAGCGAAA

351 TATCCTGTCC AATCCGAAG TCGGTATCAA GTGGGGCAAG GGGATTGAAG

401 GACAGGGAAT GCCTTGGGAG GATTATGTCG GTAAGGGCTT GTCTGCCAAT

451 GCAAGGTTAC CTAAAAATTT TAAAACATTT GATTATTTTG ATCGTGGTAC

501 AGGCACGGCA ATCAGTGCCA AAACTCTGGA TACGCAAACT ACGGCACGCC

551 TGTCCAAACC CGAACAGCTT TACAGTACCA TGAAAGGGTA CATCGATAAG

601 ACGGCAAATT TCAAAAGTTA TGAATTATCA GAAGTACCGT TAAGGGCAGA

651 CATGATCAAA CAGCGCGAAA TCCATCTGGC CATACCCGCA CAAACTAATA

701 AGGAGCAAAG ATTGCAGTTG CAACGTGTGG TAGAGTATGG CAAAAGTCAA

751 AACATTACAG TCAAAATTAC GGAGATCGAA TAA
```

This corresponds to the amino acid sequence <SEQ ID 2664; ORF 773>:

```
m773.pep
   1 MGLGATTFVG SGAIGGGLCS TGIGCAAGGL IATAGMTGGY TQASEGSRQL

51 FGTYQSDFGK KVVLSLGTPI EYESPLVSDA KNLAVWGLET LITRKLGNLA

101 TGVKTSLTPK TADVQRNILS QSEVGIKWGK GIEGQGMPWE DYVGKGLSAN

151 ARLPKNFKTF DYFDRGTGTA ISAKTLDTQT TARLSKPEQL YSTMKGYIDK

201 TANFKSYELS EVPLRADMIK QREIHLAIPA QTNKEQRLQL QRVVEYGKSQ

251 NITVKITEIE * a773.seq not found yet
a773.pep not found yet
```

The following partial DNA sequence was identified in *N. gonorrhoeae* <SEQ ID 2665>:

```
g774.seq
   1 ATGAAGACCA AATTACCGCT TTTTATCATT TGGCTGTCTG TGTCTGCCTC

51 CTGTGCTTCC GTTTTACCCG TTCCGGAGGG CAGCCGAACC GAAATGCCGA

101 CACAGGAAAA TGCTTCAGAC GGCATTCCCT ATCCCGTTCC CACTCTGCAA

151 GACCGTTTGG ACTATCTGGA AGGCAAAATC GTCCGGCTGT CGAACGAAGT

201 GGAAATGTTA ACGGGAAAG TCAAAGCATT GGAGCATACG AAAATACACC

251 CTTCCGGCAG GACATACGTC CAAAAACTCG ACGACCGCAA ATTGAAAGAG

301 CATTACCTCA ATACCGAAGG CGGCAGCGCA TCCGCACATA CCGTCGAAAC

351 CGCACAAAAC CTCTACAATC AGGCACTCAA ACACTATCAA AACGGCAGGT

401 TTTCTGCCGC AGCCGCCTTG TTGAAGGGGG CGGACGGCGG AGACGGCGGC
```

-continued

```
451 AGCATCGCGC AACGCAGTAT GTACCTGTTG CTGCAAAGCA GGGCGCGTAT

501 GGGGAACTGT GAATCTGTCA TCGAAATCGG AGGGCGTTAC GCCAACCGTT

551 TCAAAGACAG CCCAACCGCG CCCGAAGTCA TATTCAAAAT CGGCGAATGC

601 CAATACAGGC TTCAGCAAAA AGACATTGCA AGGGCGACTT GGCGCAGCCT

651 GATACAGACC TATCCCGGCA GCCCGGCGGC AAAACGCGCC GCCGCAGCCG

701 TACGCAAACG ATAG
```

This corresponds to the amino acid sequence <SEQ ID 2666; ORF 774.ng>:

```
g774.pep
  1 MKTKLPLFII WLSVSASCAS VLPVPEGSRT EMPTQENASD GIPYPVPTLQ

51 DRLDYLEGKI VRLSNEVEML NGKVKALEHT KIHPSGRTYV QKLDDRKLKE

101 HYLNTEGGSA SAHTVETAQN LYNQALKHYQ NGRFSAAAAL LKGADGGDGG

151 SIAQRSMYLL LQSRARMGNC ESVIEIGGRY ANRFKDSPTA PEVIFKIGEC

201 QYRLQQKDIA RATWRSLIQT YPGSPAAKRA AAAVRKR*
```

The following partial DNA sequence was identified in *N. meningitidis* <SEQ ID 2667>:

```
m774.seq
  1 ATGAAGATCA AATTACCGCT TTTTATCATT TGGCTGTCTG TGTCCGCCTC

51 CTGTGCTTCC GTTTCACCCG TTCCGGCAGG CAGCCAAACC GAAATGTCGA

101 CACGGGAAAA TGCTTCAGAC GGCATTCCCT ATCCCGTTCC GACCTTGCAA

151 GACCGTTTGG ACTATCTGGA AGGCAAAATC GTCCGGCTGT CGAACGAAGT

201 GGAAACCTTA AACGGCAAAG TCAAAGCACT GGAACACGCA AAAACACATT

251 CTTCCGGCAG GGCATACGTC CAAAAACTCG ACGACCGCAA GTTGAAAGAG

301 CATTACCTCA ATACCGAAGG CGGCAGCGCA TCCGCACATA CTGTCGAAAC

351 CGCACAAAAC CTCTACAATC AGGCACTCAA ACACTATAAA AGCGGCAAGT

401 TTTCTGCCGC TGCCTCCCTG TTGAAAGGCG CGGACGGAGG CGACGGCGGC

451 AGCATCGCGC AACGCAGTAT GTACCTGTTG CTGCAAAGCA GGGCGCGTAT

501 GGGCAACTGC GAATCCGTCA TCGAAATCGG AGGGCGTTAC GCCAACCGTT

551 TCAAAGACAG CCCAACCGCG CCTGAAGCCA TGTTCAAAAT CGGCGAATGC

601 CAATACAGGC TTCAGCAAAA AGACATTGCA AGGGCGACTT GGCGCAGCCT

651 GATACAGACC TATCCCGGCA GCCCGGCGGC AAAACGCGCC GCCGCAGCCG

701 TGCGCAAACG ATAG
```

This corresponds to the amino acid sequence <SEQ ID 2668; ORF 774>:

```
m774.pep
  1 MKIKLPLFII WLSVSASCAS VSPVPAGSQT EMSTRENASD GIPYPVPTLQ

51 DRLDYLEGKI VRLSNEVETL NGKVKALEHA KTHSSGRAYV QKLDDRKLKE

101 HYLNTEGGSA SAHTVETAQN LYNQALKHYK SGKFSAAASL LKGADGGDGG

151 SIAQRSMYLL LQSRARMGNC ESVIEIGGRY ANRFKDSPTA PEAMFKIGEC

201 QYRLQQKDIA RATWRSLIQT YPGSPAAKRA AAAVRKR*
```

Computer analysis of this amino acid sequence gave the following results:
Homology with a Predicted ORF from *N. gonorrhoeae*
ORF 774 shows 92.8% identity over a 237 aa overlap with a predicted ORF (ORF 774) from *N. gonorrhoeae*

```
m774/g774  92.8% identity in 237 aa overlap 10        20        30        40        50        60
    g774.pep  MKTKLPLFIIWLSVSASCASVLPVPEGSRTEMPTQENASDGIPYPVPTLQDRLDYLEGKI
              ||  |||||||||||||||||  |||  ||||  |  ||||||||||||||||||||||||
    m774      MKIKLPLFIIWLSVSASCASVSPVPAGSQTEMSTRENASDGIPYPVPTLQDRLDYLEGKI
                10        20        30        40        50        60

70        80        90       100       110       120
    g774.pep  VRLSNEVEMLNGKVKALEHTKIHPSGRTYVQKLDDRKLKEHYLNTEGGSASAHTVETAQN
              ||||||||  ||||||||||  |  ||||  |||||||||||||||||||||||||||||
    m774      VRLSNEVETLNGKVKALEHAKTHSSGRAYVQKLDDRKLKEHYLNTEGGSASAHTVETAQN
                70        80        90       100       110       120

130       140       150       160       170       180
    g774.pep  LYNQALKHYQNGRFSAAAALLKGADGGDGGSIAQRSMYLLLQSRARMGNCESVIEIGGRY
              ||||||||| | ||||||| ||||||||||||||||||||||||||||||||||||||||
    m774      LYNQALKHYKSGKFSAAASLLKGADGGDGGSIAQRSMYLLLQSRARMGNCESVIEIGGRY
               130       140       150       160       170       180

190       200       210       220       230
    g774.pep  ANRFKDSPTAPEVIRKIGECQYRLQQKDIARATWRSLIQTYPGSPAAKRAAAAVRKRX
              ||||||||||||   |||||||||||||||||||||||||||||||||||||||||||
    m774      ANRFKDSPTAPEAMFKIGECQYRLQQKDIARATWRSLIQTYPGSPAAKRAAAAVRKRX
               190       200       210       220       230
```

The following partial DNA sequence was identified in *N. meningitidis* <SEQ ID 2669>:

```
a774.seq
  1 ATGAAGACCA AATTACCGCT TTTTATCATT TGGCTGTCCG TATCCGCCGC

51 CTGTTCTTCC CCTGTTTCCC GCAATATTCA GGATATGCGG CTCGAACCGC

101 AGGCAGAGGC AGGTAGTTCG GACGCTATTC CCTATCCCGT TCCCACTCTG

151 CAAGACCGTT TGGATTATCT GGAAGGCACA CTCGTCCGCC TGTCGAACGA

201 AGTGGAAACC TTAAACGGCA AAGTCAAAGC ACTGGAGCAT GCGAAAACAC

251 ACCCTTCCAG CAGGGCATAC GTCCAAAAAC TCGACGACCG CAAGTTGAAA

301 GAGCATTACC TCAATACCGA AGGCGGCAGC GCATCCGCAC ATACCGTCGA

351 AACCGCACAA AACCTCTACA ATCAGGCACT CAAACACTAT AAAAGCGGCA

401 GGTTTTCTGC CGCTGCCTCC CTGTTGAAAG GCGCGGACGG AGGCGACGGC

451 GGCAGCATCG CGCAACGCAG TATGTACCTG TTGCTGCAAA GCAGGGCGCG

501 TATGGGCAAC TGCGAATCCG TCATCGAAAT CGGAGGGCGT TACGCCAACC

551 GTTTCAAAGA CAGCCCAACC GCGCCTGAAG CCATGTTCAA AATCGGCGAA

601 TGCCAATACA GGCTTCAGCA AAAAGACATT GCAAGGGCGA CTTGGCGCAG

651 CCTGATACAG ACCTATCCCG GCAGCCCGGC GGCAAAACGC GCCGCCGCAG

701 CCGTGCGCAA ACGATAG
```

55

This corresponds to the amino acid sequence <SEQ ID 2670; ORF 774.a>:

```
a774.pep
  1 MKTKLPLFII WLSVSAACSS PVSRNIQDMR LEPQAEAGSS DAIPYPVPTL

51 QDRLDYLEGT LVRLSNEVET LNGKVKALEH AKTHPSSRAY VQKLDDRKLK

101 EHYLNTEGGS ASAHTVETAQ NLYNQALKHY KSGRFSAAAS LLKGADGGDG
```

-continued
```
151 GSIAQRSMYL LLQSRARMGN CESVIEIGGR YANRFKDSPT APEAMFKIGE

201 CQYRLQQKDI ARATWRSLIQ TYPGSPAAKR AAAAVRKR*
```

Computer analysis of this amino acid sequence gave the following results:
Homology with a Predicted ORF from *N. meningitidis*
ORF 774 shows 89.5% identity over a 238 aa overlap with a predicted ORF (ORF 774) from *N. meningitidis*

```
    m774/a774    89.5% identity in 238 aa overlap 10         20         30         40         50         60
        a774.pep  MKTKLPLFIIWLSVSAACSSPVSRNIQDMRLEPQAEAGSSDAIPYPVPTLQDRLDYLEGT
                  || ||||||||||||:|:| ||       : | ::: ::||:|||||||||||||||||
        m774      MKIKLPLFIIWLSVSASCAS-VSPVPAGSQTEMSTRENASDGIPYPVPTLQDRLDYLEGK
                       10         20         30         40         50

70         80         90        100        110        120
        a774.pep  LVRLSNEVETLNGKVKALEHAKTHPSSRAYVQKLDDRKLKEHYLNTEGGSASAHTVETAQ
                  :||||||||||||||||||||||| |:||||||||||||||||||||||||||||||||
        m774      IVRLSNEVETLNGKVKALEHAKTHSSGRAYVQKLDDRKLKEHYLNTEGGSASAHTVETAQ
                       60         70         80         90        100        110

130        140        150        160        170        180
        a774.pep  NLYNQALKHYKSGRFSAAASLLKGADGDGGSIAQRSMYLLLQSRARMGNCESVIEIGGR
                  ||||||||||||:|||||||||||||||||||||||||||||||||||||||||||||
        m774      NLYNQALKHYKSGKFSAAASLLKGADGDGGSIAQRSMYLLLQSRARMGNCESVIEIGGR
                 120        130        140        150        160        170

190        200        210        220        230        239
        a774.pep  YANRFKDSPTAPEAMFKIGECQYRLQQKDIARATWRSLIQTYPGSPAAKRAAAAVRKRX
                  ||||||||||||||||||||||||||||||||||||||||||||||||||||||||||
        m774      YANRFKDSPTAPEAMFKIGECQYRLQQKDIARATWRSLIQTYPGSPAAKRAAAAVRKRX
                 180        190        200        210        220        230
    g790. seq not found yet
    g790. pep not found yet
```

The following partial DNA sequence was identified in *N. meningitidis* <SEQ ID 2671>:

```
m790.seq
   1 ATGGCAAGAA GGTCAAAAAC ATTTGAAGAA GCTGCTGCTG AGGTTGAGGA

51 ACGTTTCGGT CATCGTGGCA TTAAGTTGGT CGAGTTTGAG GGTACAGCCA

101 AGCCGTGTGT AATCAACTGC CCTAAACATG GAAACCAAAC CTGTTCGAGG

151 TACTCCAATA TGTTCATAGG AAGTAGCTGG GGTTGCCCCT CTTGTGGTAA

201 TGAGCAAGCT GCAAAAGCCG GTATAGCGAC CCTTAGGAAG AATCACATAG

251 CGTTAGAAAT GCTGAAACAG GCTGTAACAG GTATGACCAA GCAAGAGCGC

301 ATCACGACGC AAGCCTACAA TGAGATGACC AAATCCGTGG CAGGTTCAAA

351 CAGCATAGTC CTTAACGATG TCCAAGGCGA TACGACCATC AACAACCATC

401 ATACGCATAC GCACAACCAC AGCGATGCCG ATGGCAAAGC ACTGTCGATG

451 AGGCTCACAC CCCGTCCTTT GTTGTCAGAC CGTCAGGCGG CGGCTTTCGC

501 CCGTACAGGC AAACTCACGG GCAGTTTCGA CCTGTTTGCT TCGGTGgTCG

551 CCCCCTCGCA GTACACGTTT GCCGTTGCCA TGCCCGACAC GTCCATGTCG

601 CCGGTTATCG AAAAGGGAGA CTTGCTGGTG GTCGAGCCGC GTATGTGCCC

651 TGCGGACGAA GACATCGCGC TGATTGAACT GTCCGACAAG CGGCTGGTCG

701 TCGCGCACCT TGTTATCGAT ATTGCGGGCA GGATGCTGAT TTATCAGACG

751 GGCAGGCCGT CTGAAGCCTT TGACCTGCCC GAAGGCAGCA CGATTTTAGG
```

```
-continued
 801 TGTGGTGCTG GAGTCAAAAA ACGGTTTATG TCCGCCGCAC AGGCAAGAAG

851 GCGTGTTGAT TCGGATTACC GCCCCTGATG TGTGGACGGT TGGTATGATT

901 TCCGCTTCCA AAACGTCGTG TACGCGCCCG ACCGCAGCCC GGAAATCAGC

951 CGTATGCTTT CTTCGATTTT GGCAGGCTAC GCGTGGGATA CCGAAAACCC

1001 GTTCGTGGCG AAATCCGAAC AACGCCTGA
```

This corresponds to the amino acid sequence <SEQ ID 2672; ORF 790>:

```
m790.pep
  1 MARRSKTFEE AAAEVEERFG HRGIKLVEFE GTAKPCVINC PKHGNQTCSR

51 YSNMFIGSSW GCPSCGNEQA AKAGIATLRK NHIALEMLKQ AVTGMTKQER

101 ITTQAYNEMT KSVAGSNSIV LNDVQGDTTI NNHHTHTHNH SDADGKALSM

151 RLTPRPLLSD RQAAAFARTG KLTGSFDLFA SVVAPSQYTF AVAMPDTSMS

201 PVIEKGDLLV VEPRMCPADE DIALIELSDK RLVVAHLVID IAGRMLIYQT

251 GRPSEAFDLP EGSTILGVVL ESKNGLCPPH RQEGVLIRIT APDVWTVGMI

301 SASKTSCTRP TAARKSAVCF LRFWQATRGI PKTRSWRNPN NA*
```

The following partial DNA sequence was identified in *N. meningitidis* <SEQ ID 2673>:

```
a790.seq
    1 ATGGCAAGAA GGTCAAAAAC ATTTGAAGAA GCTGCTGCTG AGGTTGAGGA

51 ACGTTTCGGT CATCGTGGCA TTAAGTTGGT CGAGTTTGAG GGTACAGCCA

101 AGCCGTGTGT AATCAACTGC CCTAAACATG GAAACCAAAC CTGTTCGAGG

151 TACTCCAATA TGTTCATAGG AAGTAGCTGG GGTTGCCCCT CTTGTGGTAA

201 TGAGCAAGCT GCAAAAGCCG GTATAGCGAC CCTTAGGAAG AATCACATAG

251 CGTTAGAAAT GCTGAAACAG GCTGTAACAG GTATGACCAA GCAAGAGCGC

301 ATCACGACGC AAGCCTACAA TGAGATGACC AAATCCGTGG CAGGTTCAAA

351 CAGCATAATC CTTAACGATG TCCAAGGCGA TACGACCATC AACAACCATC

401 ATACGCATAC GCACAACCAC AGCGATGCCG ACGGCAAAGC ACTGTCGATG

451 AGGCTCACAC CCCGTCCTTT GTTGTCAGAC CGTCAGGCGG CGGCTTTCGC

501 CCGTACAGGC AAACTCACGG GCAGTTTCGA CCTGTTTGCT TCGGTGGTCG

551 CCCCTTCACA ATATACGTTT GCCGTTGCCA TGCCCGACAC GTCCATGTCG

601 CCGGTTATCG AAAAGGGGGA TTTGCTGGTG GTCGAGCCGC GTATGCGCCC

651 TGCGGACGAA GACATCGTAC TGATTGAACT GTCCGACAAG CGGCTGGTCG

701 TCGCGCACCT TGTTATCGAT ATTGCGGGCA GGATGCTGAT TTATCAGACG

751 GGCAGGCCGT CTGAAGCCCT CGACCTGCCC GAAGGCAGCG TGATTTTAGG

801 TGTGGTGCTG GAGTCAAAAA ACGGTTTATG TCCGCCGCAC AGGCAAGAAG

851 GCGTGTTGAT TCGGATTACC GCCCCTGATG TGTGGACGGT TGGTACGATT

901 TCCGCTTCCA AAACGTCGTG TACGCGCCCG ACCGCAGCCC GGAAATCAGC

951 CGTATGCTTT CTTCGATTTT GGCAGGCTAC GCGTGGGATA CCGAAAACCC

1001 GTTCGTGGCG AAATCCGAAC AACGCCTGT
```

This corresponds to the amino acid sequence <SEQ ID 2674; ORF 790.a>:

```
a790.pep
  1MARRSKTFEE AAAEVEERFG HRGIKLVEFE GTAKPCVINC PKHGNQTCSR

51YSNMFIGSSW GCPSCGNEQA AKAGIATLRK NHIALEMLKQ AVTGMTKQER

101ITTQAYNEMT KSVAGSNSII LNDVQGDTTI NNHHTHTHNH SDADGKALSM

151RLTPRPLLSD RQAAAFARTG KLTGSFDLFA SVVAPSQYTF AVAMPDTSMS

201PVIEKGDLLV VEPRMRPADE DIVLIELSDK RLVVAHLVID IAGRMLIYQT

251GRPSEALDLP EGSVILGVVL ESKNGLCPPH RQEGVLIRIT APDVWTVGTI

301SASKTSCTRP TAARKSAVCF LRFWQATRGI PKTRSWRNPN NAC
```

Computer analysis of this amino acid sequence gave the following results:

Homology with a Predicted ORF from *N. meningitidis*
ORF 790 shows 98.2% identity over a 342 aa overlap with a predicted ORF (ORF 790) from *N. meningitidis*

```
    a790/m790  98.2% identity in 342 aa overlap 10         20         30         40         50         60
    a790.pep  MARRSKTFEEAAAEVEERFGHRGIKLVEFEGTAKPCVINCPKHGNQTCSRYSNMFIGSSW
              ||||||||||||||||||||||||||||||||||||||||||||||||||||||||||||
    m790      MARRSKTFEEAAAEVEERFGHRGIKLVEFEGTAKPCVINCPKHGNQTCSRYSNMFIGSSW
                  10         20         30         40         50         60

70         80         90        100        110        120
    a790.pep  GCPSCGNEQAAKAGIATLRKNHIALEMLKQAVTGMTKQERITTQAYNEMTKSVAGSNSII
              |||||||||||||||||||||||||||||||||||||||||||||||||||||||||||:
    m790      GCPSCGNEQAAKAGIATLRKNHIALEMLKQAVTGMTKQERITTQAYNEMTKSVAGSNSIV
                  70         80         90        100        110        120

130        140        150        160        170        180
    a790.pep  LNDVQGDTTINNHHTHTHNHSDADGKALSMRLTPRPLLSDRQAAAFARTGKLTGSFDLFA
              ||||||||||||||||||||||||||||||||||||||||||||||||||||||||||||
    m790      LNDVQGDTTINNHHTHTHNHSDADGKALSMRLTPRPLLSDRQAAAFARTGKLTGSFDLFA
                 130        140        150        160        170        180

190        200        210        220        230        240
    a790.pep  SVVAPSQYTFAVAMPDTSMSPVIEKGDLLVVEPRMRPADEDIVLIELSDKRLVVAHLVID
              |||||||||||||||||||||||||||||||||||:|||||||:||||||||||||||||
    m790      SVVAPSQYTFAVAMPDTSMSPVIEKGDLLVVEPRMCPADEDIALIELSDKRLVVAHLVID
                 190        200        210        220        230        240

250        260        270        280        290        300
    a790.pep  IAGRMLIYQTGRPSEALDLPEGSVILGVVLESKNGLCPPHRQEGVLIRITAPDVWTVGTI
              ||||||||||||||||:||||||:||||||||||||||||||||||||||||||||||| |
    m790      IAGRMLIYQTGRPSEAFDLPEGSTILGVVLESKNGLCPPHRQEGVLIRITAPDVWTVGMI
                 250        260        270        280        290        300

310        320        330        340
    a790.pep  SASKTSCTRPTAARKSAVCFLRFWQATRGIPKTRSWRNPNNAC
              ||||||||||||||||||||||||||||||||||||||||||
    m790      SASKTSCTRPTAARKSAVCFLRFWQATRGIPKTRSWRNPNNAX
                 310        320        330        340
```

The following partial DNA sequence was identified in *N. gonorrhoeae* <SEQ ID 2675>:

```
g791.seq
    1   ATGGTAAATT ATTATTCAGC TATGATTAAA AAGATTTTAA CTACTTGTTT

51   TGGTTTGTTT TTTGGTTTTT GTGTATTTGG AGTGGGTCTG GTTGCCATTG

101   CTATTTTGGT AACGTATCCG AAACTGCCGT CTTTGGATTC TTTGCAGCAT

151   TACCAGCCTA AAATGCCGTT GACTATTTAT TCGGCGGATG GAGAAGTCAT

201   CGGTATGTAT GGGGAGCAGC GGCGCGAATT TACAAAAATC GGCGATTTCC

251   CCGAGGTGTT GCGGAATGCG GTTATTGCCG CCGAGGATAA ACGCTTTTAC

301   CGGCATTGGG GGTGGATGT TTGGGGTGTT GCCCGCGCTG CCGTCGGCAA
```

-continued

```
 351 TGTCGTGTCC GGCAGCGTGC AGTCGGGTGC GAGTACGATT ACACAGCAGG
 401 TGGCGAAAAA TTTTTATTTG AGCAGTGAAA AAACGTTCAC ACGCAAATTC
 451 AATGAGGTGT TGCTTGCCTA TAAAATCGAG CAGTCTTTAA GCAAAGACAA
 501 AATCCTTGAG TTGTATTTCA ATCAGATTTA CCTCGGTCAG CGCGCCTATG
 551 GTTTTGCATC TGCCGCGCAA ATCTATTTCA ATAAGAATGT CCGAGATTTG
 601 ACTTTGGCGG AAGCCGCCAT GCTTGCGGGA CTGCCCAAGG CTCCGTCTGC
 651 CTATAATCCG ATTGTTAATC CGGAGCGTGC CAAGTTGCGC CAGAAGTATA
 701 TTTTGAACAA TATGCTCGAG GAGAAGATGA TTACCGTGCA ACAGCGCGAT
 751 CAGGCATTGA ATGAGGAACT GCATTATGAG CGGTTTGTTC GGAAAATCGA
 801 TCAGAGTGCT TTATATGTGG CGGAAATGGT GCGTCGGGAA CTGTATGAGA
 851 AATATGGTGA AGATGCCTAT ACGCAGGGTT TTAAGGTTTA TACCACGGTC
 901 CGCACCGATC ATCAGAAGGC GGCAACCGAG GCATTGCGCA AGGCTCTACG
 951 GAATTTCGAT CGCGGCAGCA GCTACCGCGG TGCGGAAAAC TATATCGATT
1001 TGAGTAAGAG TGAAGATGTC GAGGAGACTG TCAGCCAGTA TCTGTCGGGA
1051 CTCTATACCG TCGATAAAAT GGTTCCCGCC GTTGTGTTGG ATGTTACTAA
1101 AAAGAAAAAT GTCGTCATAC AGCTGCCCGG CGGCAGGCGG GTTGCGCTTG
1151 ACAGGCGCGC CTTGGGTTTT GCGGCCCGAG CGGTCGATAA TGAGAAAATG
1201 GGGGAGGACC GTATCCGCAG GGGCGCGGTC ATCCGTGTCA AAAACAACGG
1251 CGGGCGTTGG GCGGTGGTTC AAGAGCCGTT GCTGCAGGGG GCTTTGGTTT
1301 CGCTGGATGC AAAAACCGGA GCTGTGCGCG CGCTGGTCGG CGGTTATGAT
1351 TTTCACAGCA AAACATTCAA TCGTGCCGTT CAGGCAATGC GGCAGCCGGG
1401 TTCGACCTTT AAGCCGTTTG TCTATTCGGC GGCATTATCT AAGGGGATGA
1451 CCGCGTCCAC AGTGGTTAAC GATGCGCCGA TTTCCCTGCC GGGGAAGGG
1501 CCGAACGGTT CGGTTTGGAC ACCTAAAAAT TCAGACGGCA GATATTCCGG
1551 CTACATTACT TTGAGACAGG CTCTGACGGC TTCCAAGAAT ATGGTTTCCA
1601 TCCGTATTTT GATGTCTATC GGTGTCGGTT ACGCGCAACA GTATATCCGG
1651 CGTTTCGGCT TCAGGCCGTC CGAGCTGCCG GCAAGCCTGT CTATGGCTTT
1701 AGGTACGGGC GAGACGACGC CGTTGAAAGT GGCGGAGGCA TATAGTGTAT
1751 TTGCGAACGG CGGATATAGG GTTTCTTCGC ACGTGATCGA TAAGATTTAT
1801 GACAGAGACG GCAGGTTGCG CGCCCAAATG CAACCTTTGG TGGCAGGGCA
1851 AAATGCGCCT CAGGCAATCG ATCCGCGCAA TGCCTATATT ATGTATAAGA
1901 TTATGCAGGA TGTGGTCCGT GTCGGTACGG CAAGGGGGGC AGCTGCGTTG
1951 GGAAGAACGG ATATTGCCGG TAAAACGGGT ACGACCAACG ACAATAAAGA
2001 TGCGTGGTTT GTCGGTTTTA ACCCTGATGT GGTTACTGCC GTATATATCG
2051 GCTTCGACAA ACCTAAGAGT ATGGGCGTG CCGGCTACGG CGGTACGATT
2101 GCGGTGCCGG TTTGGGTGGA CTATATGCGT TTTGCGTTGA AAGGAAAGCA
2151 GGGCAAAGGG ATGAAAATGC CTGAAGGTGT GGTCAGCAGC AATGGCGAAT
2201 ACTATATGAA GGAACGTATG GTAACCGATC CGGGCTTGAT GCTGGACAAC
2251 AGCGGTATTG CGCCGCAACC TTCCCGACGG GCAAAAGAAG ATGATGAAGC
2301 GGCAGTAGAA AACGAACAGC AGGGAAGGTC TGACGAAACG CGTCAGGACG
```

```
-continued
2351 TACAGGAAAC GCCGGTGCTT CCGAGCAATA CGGATTCCAA ACAGCAGCAG

2401 TTGGATTCCC TGTTTTAA
```

This corresponds to the amino acid sequence <SEQ ID 2676; ORF 791.ng>:

```
g791.pep
  1 MVNYYSAMIK KILTTCFGLF FGFCVFGVGL VAIAILVTYP KLPSLDSLQH

51 YQPKMPLTIY SADGEVIGMY GEQRREFTKI GDFPEVLRNA VIAAEDKRFY

101 RHWGVDVWGV ARAAVGNVVS GSVQSGASTI TQQVAKNFYL SSEKTFTRKF

151 NEVLLAYKIE QSLSKDKILE LYFNQIYLGQ RAYGFASAAQ IYFNKNVRDL

201 TLAEAAMLAG LPKAPSAYNP IVNPERAKLR QKYILNNMLE EKMITVQQRD

251 QALNEELHYE RFVRKIDQSA LYVAEMVRRE LYEKYGEDAY TQGFKVYTTV

301 RTDHQKAATE ALRKALRNFD RGSSYRGAEN YIDLSKSEDV EETVSQYLSG

351 LYTVDKMVPA VVLDVTKKKN VVIQLPGGRR VALDRRALGF AARAVDNEKM

401 GEDRIRRGAV IRVKNNGGRW AVVQEPLLQG ALVSLDAKTG AVRALVGGYD

451 FHSKTFNRAV QAMRQPGSTF KPFVYSAALS KGMTASTVVN DAPISLPGKG

501 PNGSVWTPKN SDGRYSGYIT LRQALTASKN MVSIRILMSI GVGYAQQYIR

551 RFGFRPSELP ASLSMALGTG ETTPLKVAEA YSVFANGGYR VSSHVIDKIY

601 DRDGRLRAQM QPLVAGQNAP QAIDPRNAYI MYKIMQDVVR VGTARGAAAL

651 GRTDIAGKTG TTNDNKDAWF VGFNPDVVTA VYIGFDKPKS MGRAGYGGTI

701 AVPVWVDYMR FALKGKQGKG MKMPEGVVSS NGEYYMKERM VTDPGLMLDN

751 SGIAPQPSRR AKEDDEAAVE NEQQGRSDET RQDVQETPVL PSNTDSKQQQ

801 LDSLF*
```

The following partial DNA sequence was identified in *N. meningitidis* <SEQ ID 2677>:

```
m791.seq
  1 ATGGTAAATT ATTATTCAGC TATGATTAAA AAGATTTTAA CGACTTGTTT

51 TGGTTTGGTT TTTGGGTTTT GTGTATTTGG AGTGGGTTTG GTTGCCATTG

101 CTATTTTGGT AACGTATCCG AAACTGCCGT CTTTGGATTC TTTGCAGCAT

151 TACCAGCCTA AAATGCCGTT GACTATTTAT TCGGCGGATG GGGAAGTCAT

201 CGGTATGTAT GGGGAGCAGC GGCGCGAATT TACAAAAATC GGCGATTTCC

251 CAGAGGTGTT GCGGAATGCG GTTATCGCCG CCGAGGATAA ACGCTTTTAC

301 CGGCATTGGG GGGTGGATGT TTGGGGTGTT GCCCGCGCTG CCGTCGGCAA

351 TGTCGTGTCC GGCAGCGTGC AGTCGGGTGC GAGTACGATT ACGCAGCAGG

401 TGGCGAAAAA TTTTTATTTG AGCAGTGAAA AAACGTTCAC ACGCAAATTC

451 AATGAGGTGT TGCTTGCCTA TAAAATCGAG CAGTCTTTAA GCAAAGACAA

501 AATCCTCGAG TTGTATTTCA ATCAGATTTA CCTCGGTCAG CGCGCCTATG

551 GTTTTGCATC TGCCGCGCAA ATCTATTTCA ATAAGAATGT CCGAGATTTG

601 ACTTTGGCGG AAGCCGCCAT GCTTGCGGGA CTGCCCAAGG CTCCGTCTGC

651 CTATAATCCG ATTGTTAATC CAGAACGTGC CAAGTTGCGC CAGAAGTATA

701 TTTTGAACAA TATGCTCGAG GAGAAGATGA TTACCGTGCA ACAGCGCGAT
```

```
-continued
 751 CAGGCGTTGA ATGAGGAACT GCATTACGAG CGGTTTGTTC GGAAAATCGA

801 TCAGAGTGCG TTATATGTGG CGGAAATGGT GCGTCAGGAA CTGTATGAGA

851 AATACGGTGA AGATGCCTAT ACGCAGGGTT TTAAGGTTTA TACCACGGTC

901 CGCGCCGATC ATCAGAAGGT GGCAACCGAG GCATTGCGCA AGGCTCTACG

951 GAATTTCGAT CGCGGCAGCA GCTACCGCGG TGCGGAAAAC TATATCGATT

1001 TGAGTAAGAG TGAAGATGTC GAGGAGACTG TCAGCCAGTA TCTGTCGGGA

1051 CTCTATACCG TCGATAAAAT GGTTCCCGCC GTTGTGTTGG ATGTGACTAA

1101 AAAGAAAAAT GTCGTCATAC AGCTGCCCGG CGGCAGGCGG GTTACGCTTG

1151 ACAGGCGCGC CTTGGGTTTT GCGGCCCGCG CGGTCAATAA TGAAAAAATG

1201 GGGGAGGACC GTATCCGCAG GGGCGCGGTC ATCCGTGTCA AAAACAACGG

1251 CGGGCGTTGG GCGGTGGTTC AAGAGCCGTT GCTGCAGGGG GCTTTGGGTT

1301 CGCTGGATGC AAAAACCGGA GCTGTGCGCG CGCTGGTCGG CGGTTATGAT

1351 TTTCACAGCA AAACATTCAA TCGTGCCGTT CAGGCAATGC GGCAGCCGGG

1401 TTCGACCTTT AAGCCGTTTG TCTATTCGGC GGCATTATCT AAGGGGATGA

1451 CCGCGTCCAC AGTGGTTAAC GATGCGCCGA TTTCCCTGCC GGGGAAGGG

1501 CCGAACGGTT CGGTTTGGAC ACCTAAAAAT TCAGACGGCA GATATTCCGG

1551 CTACATTACT TTGAGACAGG CTCTGACGGC TTCCAAGAAT ATGGTTTCCA

1601 TCCGTATTTT GATGTCTATC GGTGTCGGTT ACGCGCAACA GTATATCCGG

1651 CGTTTCGGCT TCAGGTCGTC CGAGCTGCCG GCAAGCCTGT CTATGGCTTT

1701 AGGTACGGGC GAGACAACGC CGTTGAAAGT GGCGGAGGCA TATAGCGTAT

1751 TTGCGAACGG CGGATATAGG GTTTCTTCGC ACGTAATCGA TAAGATTTAT

1801 GACAGAGACG GCAGGTTGCG CGCCCAAATG CAACCTTTGG TGGCTGGGCA

1851 AAATGCGCCT CAGGCAATCG ATCCGCGCAA TGCCTATATT ATGTATAAGA

1901 TTATGCAGGA TGTGGTCCGT GTTGGTACGG CAAGGGGGGC AGCTGCGTTG

1951 GGAAGAACGG ATATTGCCGG TAAAACGGGT ACGACCAATG ACAATAAGGA

2001 TGCGTGGTTT GTCGGTTTTA ACCCTGATGT GGTTACTGCC GTATATATCG

2051 GCTTCGACAA ACCTAAGAGT ATGGGGCGTG TCGGCTACGG CGGTACGATT

2101 GCGGTGCCGG TTTGGGTGGA CTATATGCGT TTTGCGTTGA AAGGAAAGCA

2151 GGGCAAGGGG ATGAAAATGC CTGAAGGTGT GGTCAGCAGC AATGGCGAAT

2201 ACTATATGAA GGAACGTATG GTAACCGATC CGGGCTTGAC GCTGGACAAC

2251 AGCGGTATTG CGCCGCAACC TTCCCGACGG GCAAAAGAAG ATGACGGGGG

2301 CGCGGCAGAA GGCGGACGGC AGGCGGCGGA TGACGAAGTC CGCCAAGATA

2351 TGCAGGAAAC GCCGGTGCTT CCGAGTAATA CTGGTTCCAA ACAGCAGCAG

2401 TTGGATTCTC TGTTTTAA
```

This corresponds to the amino acid sequence <SEQ ID 2678; ORF 791>:

```
m791.pep
     1  MVNYYSAMIK KILTTCFGLV FGFCVFGVGL VAIAILVTYP KLPSLDSLQH

51  YQPKMPLTIY SADGEVIGMY GEQRREFTKI GDFPEVLRNA VIAAEDKRFY

101  RHWGVDVWGV ARAAVGNVVS GSVQSGASTI TQQVAKNFYL SSEKTFTRKF
```

-continued

```
151 NEVLLAYKIE QSLSKDKILE LYFNQIYLGQ RAYGFASAAQ IYFNKNVRDL

201 TLAEAAMLAG LPKAPSAYNP IVNPERAKLR QKYILNNMLE EKMITVQQRD

251 QALNEELHYE RFVRKIDQSA LYVAEMVRQE LYEKYGEDAY TQGRKVYTTV

301 RADHQKVATE ALRKALRNFD RGSSYRGAEN YIDLSKSEDV EETVSQYLSG

351 LYTVDKMVPA VVLDVTKKKN VVIQLPGGRR VTLDRRALGF AARAVNNEKM

401 GEDRIRRGAV IRVKNNGGRW AVVQEPLLQG ALGSLDAKTG AVRALVGGYD

451 FHSKTFNRAV QAMRQPGSTF KPFVYSAALS KGMTASTVVN DAPISLPGKG

501 PNGSVWTPKN SDGRYSGYIT LRQALTASKN MVSIRILMSI GVGYAQQYIR

551 RFGFRSSELP ASLSMALGTG ETTPLKVAEA YSVFANGGYR VSSHVIDKIY

601 DRDGRLRAQM QPLVAGQNAP QAIDPRNAYI MYKIMQDVVR VGTARGAAAL

651 GRTDIAGKTG TTNDNKDAWF VGFNPDVVTA VYIGRDKPKS MGRVGYGGTI

701 AVPVWVDYMR FALKGKQGKG MKMPEGVVSS NGEYYMKERM VTDPGLTLDN

751 SGIAPQPSRR AKEDDGGAAE GGRQAADDEV RQDMQETPVL PSNTGSKQQQ

801 LDSLF*
``` g791/m791 97.3% identity in 805 aa overlap

```
                10         20         30         40         50         60
g791.pep MVNYYSAMIKKILTTCFGLFFGFCVFGVGLVAIAILVTYPKLPSLDSLQHYQPKMPLTIY
         |||||||||||||||||||||| ||||||||||||||||||||||||||||||||||||
m791     MVNYYSAMIKKILTTCFGLVFGFCVFGVGLVAIAILVTYPKLPSLDSLQHYQPKMPLTIY
                10         20         30         40         50         60

70         80         90        100        110        120
g791.pep SADGEVIGMYGEQRREFTKIGDFPEVLRNAVIAAEDKRFYRHWGVDVWGVARAAVGNVVS
         ||||||||||||||||||||||||||||||||||||||||||||||||||||||||||||
m791     SADGEVIGMYGEQRREFTKIGDFPEVLRNAVIAAEDKRFYRHWGVDVWGVARAAVGNVVS
                70         80         90        100        110        120

130        140        150        160        170        180
g791.pep GSVQSGASTITQQVAKNFYLSSEKTFTRKFNEVLLAYKIEQSLSKDKILELYFNQIYLGQ
         ||||||||||||||||||||||||||||||||||||||||||||||||||||||||||||
m791     GSVQSGASTITQQVAKNFYLSSEKTFTRKFNEVLLAYKIEQSLSKDKILELYFNQIYLGQ
               130        140        150        160        170        180

190        200        210        220        230        240
g791.pep RAYGFASAAQIYFNKNVRDLTLAEAAMLAGLPKAPSAYNPIVNPERAKLRQKYILNNMLE
         ||||||||||||||||||||||||||||||||||||||||||||||||||||||||||||
m791     RAYGFASAAQIYFNKNVRDLTLAEAAMLAGLPKAPSAYNPIVNPERAKLRQKYILNNMLE
               190        200        210        220        230        240

250        260        270        280        290        300
g791.pep EKMITVQQRDQALNEELHYERFVRKIDQSALYVAEMVRRELYEKYGEDAYTQGFKVYTTV
         |||||||||||||||||||||||||||||||||||||:||||||||||||||||||||||
m791     EKMITVQQRDQALNEELHYERFVRKIDQSALYVAEMVRQELYEKYGEDAYTQGFKVYTTV
               250        260        270        280        290        300

310        320        330        340        350        360
g791.pep RTDHQKAATEALRKALRNFDRGSSYRGAENYIDLSKSEDVEETVSQYLSGLYTVDKMVPA
         |:||||:|||||||||||||||||||||||||||||||||||||||||||||||||||||
m791     RADHQKVATEALRKALRNFDRGSSYRGAENYIDLSKSEDVEETVSQYLSGLYTVDKMVPA
               310        320        330        340        350        360

370        380        390        400        410        420
g791.pep VVLDVTKKKNVVIQLPGGRRVALDRRALGFAARAVDNEKMGEDRIRRGAVIRVKNNGGRW
         |||||||||||||||||||||:|||||||||||||:||||||||||||||||||||||||
m791     VVLDVTKKKNVVIQLPGGRRVTLDRRALGFAARAVNNEKMGEDRIRRGAVIRVKNNGGRW
               370        380        390        400        410        420

430        440        450        460        470        480
g791.pep AVVQEPLLQGALVSLDAKTGAVRALVGGYDFHSKTFNRAVQAMRQPGSTFKPFVYSAALS
         |||||||||||| |||||||||||||||||||||||||||||||||||||||||||||||
m791     AVVQEPLLQGALGSLDAKTGAVRALVGGYDFHSKTFNRAVQAMRQPGSTFKPFVYSAALS
               430        440        450        460        470        480
```

```
                   490        500        510        520        530        540
g791.pep  KGMTASTVVNDAPISLPGKGPNGSVWTPKNSDGRYSGYITLRQALTASKNMVSIRILMSI
          ||||||||||||||||||||||||||||||||||||||||||||||||||||||||||||
m791      KGMTASTVVNDAPISLPGKGPNGSVWTPKNSDGRYSGYITLRQALTASKNMVSIRILMSI
                   490        500        510        520        530        540

550        560        570        580        590        600
g791.pep  GVGYAQQYIRRFGFRPSELPASLSMALGTGETTPLKVAEAYSVFANGGYRVSSHVIDKIY
          ||||||||||||||| ||||||||||||||||||||||||||||||||||||||||||||
m791      GVGYAQQYIRRFGFRSSELPASLSMALGTGETTPLKVAEAYSVFANGGYRVSSHVIDKIY
                   550        560        570        580        590        600

610        620        630        640        650        660
g791.pep  DRDGRLRAQMQPLVAGQNAPQAIDPRNAYIMYKIMQDVVRVGTARGAAALGRTDIAGKTG
          ||||||||||||||||||||||||||||||||||||||||||||||||||||||||||||
m791      DRDGRLRAQMQPLVAGQNAPQAIDPRNAYIMYKIMQDVVRVGTARGAAALGRTDIAGKTG
                   610        620        630        640        650        660

670        680        690        700        710        720
g791.pep  TTNDNKDAWFVGFNPDVVTAVYIGFDKPKSMGRAGYGGTIAVPVWVDYMRFALKGKQGKG
          |||||||||||||||||||||||||||||||||||||:||||||||||||||||||||||
m791      TTNDNKDAWFVGFNPDVVTAVYIGFDKPKSMGRVGYGGTIAVPVWVDYMRFALKGKQGKG
                   670        680        690        700        710        720

730        740        750        760        770        780
g791.pep  MKMPEGVVSSNGEYYMKERMVTDPGLMLDNSGIAPQPSRRAKEDDEAAVENEQQGRSDET
          |||||||||||||||||||||||||||| ||||||||||||||||||:|:|: :|: :||:
m791      MKMPEGVVSSNGEYYMKERMVTDPGLTLDNSGIAPQPSRRAKEDDGGAAEGGRQAADDEV
                   730        740        750        760        770        780

790        800
g791.pep  RQDVQETPVLPSNTDSKQQQLDSLFX
          |||:|||||||||| ||||||||||||
m791      RQDMQETPVLPSNTGSKQQQLDSLFX
                   790        800
```

The following partial DNA sequence was identified in *N. meningitidis* <SEQ ID 2679>:

```
a791.seq
   1  ATGGTAAATT ATTATTCAGC TATGATTAAA AAGATTTTAA CGACTTGTTT

51  TGGTTTGGTT TTTGGGTTTT GTGTATTTGG AGTGGGTTTG GTTGCCATTG

101  CTATTTTGGT AACGTATCCG AAACTGCCGT CTTTGGATTC TTTGCAGCAT

151  TACCAGCCTA AAATGCCGTT GACTATTTAT TCGGCGGATG GGGAAGTCAT

201  CGGTATGTAT GGGGAGCAGC GGCGCGAATT TACAAAAATC GGCGATTTCC

251  CAGAGGTGTT GCGGAATGCG GTTATCGCCG CCGAGGATAA ACGCTTTTAC

301  CGGCATTGGG GGGTGGATGT TTGGGGTGTT GCCCGCGCTG CCGTCGGCAA

351  TGTCGTGTCC GGCAGCGTGC AGTCGGGTGC GAGTACGATT ACGCAGCAGG

401  TGGCGAAAAA TTTTTATTTG AGCAGTGAAA AAACGTTCAC ACGCAAATTC

451  AATGAGGTGT TGCTTGCCTA TAAAATCGAG CAGTCTTTAA GCAAAGACAA

501  AATCCTCGAG TTGTATTTCA ATCAGATTTA CCTCGGTCAG CGCGCCTATG

551  GTTTTGCATC TGCCGCGCAA ATCTATTTCA ATAAGAATGT CCGAGATTTG

601  ACTTTGGCGG AAGCCGCCAT GCTTGCGGGA CTGCCCAAGG CTCCGTCTGC

651  CTATAATCCG ATTGTTAATC CAGAACGTGC CAAGTTGCGC CAGAAGTATA

701  TTTTGAACAA TATGCTCGAG GAGAAGATGA TTACCGTGCA ACAGCGCGAT

751  CAGGCGTTGA ATGAGGAACT GCATTACGAG CGGTTTGTTC GGAAAATCGA

801  TCAGAGTGCT TTATATGTGG CGGAAATGGT GCGTCAGGAA CTGTATGAGA

851  AATACGGTGA AGATGCCTAT ACGCAGGGTT TTAAGGTTTA TACCACGGTC
```

```
-continued
 901 CGCGCCGATC ATCAGAAGGT GGCAACCGAG GCATTGCGCA AGGCTCTACG

951 GAATTTCGAT CGCGGCAGCA GCTACCGCGG TGCGGAAAAC TATATCGATT

1001 TGAGTAAGAG TGAAGATGTC GAGGAGACTG TCAGCCAGTA TCTGTCGGGA

1051 CTCTATACCG TCGATAAAAT GGTTCCCGCC GTTGTGTTGG ATGTGACTAA

1101 AAAGAAAAAT GTCGTCATAC AGCTGCCCGG CGGCAGGCGG GTTACGCTTG

1151 ACAGGCGCGC CTTGGGTTTT GCGGCCCGCG CGGTCAATAA TGAAAAAATG

1201 GGGGAGGACC GTATCCGCAG GGGCGCGGTC ATCCGTGTCA AAAACAACGG

1251 CGGGCGTTGG GCGGTGGTTC AAGAGCCGTT GCTGCAGGGG GCTTTGGTTT

1301 CGCTGGATGC AAAAACCGGA GCTGTGCGCG CGCTGGTCGG CGGTTATGAT

1351 TTTCACAGCA AAACATTCAA TCGTGCCGTT CAGGCAATGC GGCAGCCGGG

1401 TTCGACCTTT AAGCCGTTTG TCTATTCGGC GGCATTATCT AAGGGGATGA

1451 CCGCGTCCAC AGTGGTTAAC GATGCGCCGA TTTCCCTGCC GGGGAAAGGG

1501 CCGAACGGTT CGGTTTGGAC ACCTAAAAAT TCAGACGGCA GATATTCCGG

1551 CTACATTACT TTGAGACAGG CTCTGACGGC TTCCAAGAAT ATGGTTTCCA

1601 TCCGTATTTT GATGTCTATC GGTGTCGGTT ACGCGCAACA GTATATCCGG

1651 CGTTTCGGCT TCAGGTCGTC CGAGCTGCCG GCAAGCCTGT CTATGGCTTT

1701 AGGTACGGGC GAGACAACGC CGTTGAAAGT GGCGGAGGCA TATAGCGTAT

1751 TTGCGAACGG CGGATATAGG GTTTCTTCGC ACGTAATCGA TAAGATTTAT

1801 GACAGAGACG GCAGGTTGCG CGCCCAAATG CAACCTTTGG TGGCCGGGCA

1851 AAATGCGCCT CAGGCAATCG ATCCGCGCAA TGCCTATATT ATGTATAAGA

1901 TTATGCAGGA TGTGGTCCGT GTTGGTACGG CAAGGGGGGC AGCTGCGTTG

1951 GGAAGAACGG ATATTGCCGG TAAAACGGGT ACGACCAATG ACAATAAGGA

2001 TGCGTGGTTT GTCGGTTTTA ACCCTGATGT GGTTACTGCC GTATATATCG

2051 GCTTCGACAA ACCTAAGAGT ATGGGGCGTG TCGGCTACGG CGGTACGATT

2101 GCGGTGCCGG TTTGGGTGGA CTATATGCGT TTTGCGTTGA AAGGAAAGCA

2151 GGGCAAGGGG ATGAAAATGC CTGAAGGTGT GGTCAGCAGC AATGGCGAAT

2201 ACTATATGAA GGAACGTATG GTAACCGATC CGGGCTTGAC GCTGGACAAC

2251 AGCGGTATTG CGCCGCAACC TTCCCGACGG GCAAAAGAAG ATGACGGGGG

2301 CGCGGCAGAA GGCGGACGGC AGGCGGCGGA TGACGAAGTC CGCCAAGATA

2351 TGCAGGAAAC GCCGGTGCTT CCGAGTAATA CTGGTTCCAA ACAGCAGCAG

2401 TTGGATTCTC TGTTTTAA
```

This corresponds to the amino acid sequence <SEQ ID 2680; ORF 791.a>:

```
a791.pep

1 MVNYYSAMIK KILTTCFGLV FGFCVFGVGL VAIAILVTYP KLPSLDSLQH

51 YQPKMPLTIY SADGEVIGMY GEQRREFTKI GDFPEVLRNA VIAAEDKRFY

101 RHWGVDVWGV ARAAVGNVVS GSVQSGASTI TQQVAKNFYL SSEKTFTRKF

151 NEVLLAYKIE QSLSKDKILE LYFNQIYLGQ RAYGFASAAQ IYFNKNVRDL

201 TLAEAAMLAG LPKAPSAYNP IVNPERAKLR QKYILNNMLE EKMITVQQRD

251 QALNEELHYE RFVRKIDQSA LYVAEMVRQE LYEKYGEDAY TQGFKVYTTV
```

```
301 RADHQKVATE ALRKALRNFD RGSSYRGAEN YIDLSKSEDV EETVSQYLSG

351 LYTVDKMVPA VVLDVTKKKN VVIQLPGGRR VTLDRRALGF AARAVNNEKM

401 GEDRIRRGAV IRVKNNGGRW AVVQEPLLQG ALVSLDAKTG AVRALVGGYD

451 FHSKTFNRAV QAMRQPGSTF KPFVYSAALS KGMTASTVVN DAPISLPGKG

501 PNGSVWTPKN SDGRYSGYIT LRQALTASKN MVSIRILMSI GVGYAQQYIR

551 RFGFRSSELP ASLSMALGTG ETTPLKVAEA YSVFANGGYR VSSHVIDKIY

601 DRDGRLRAQM QPLVAGQNAP QAIDPRNAYI MYKIMQDVVR VGTARGAAAL

651 GRTDIAGKTG TTNDNKDAWF VGFNPDVVTA VYIGFDKPKS MGRVGYGGTI

701 AVPVWVDYMR FALKGKQGKG MKMPEGVVSS NGEYYMKERM VTDPGLTLDN

751 SGIAPQPSRR AKEDDGGAAE GGRQAADDEV RQDMQETPVL PSNTGSKQQQ

801 LDSLF*
``` a791/m791 99.9% identity in 805 aa overlap

```
                 10        20        30        40        50        60
a791.pep MVNYYSAMIKKILTTCFGLVFGFCVFGVGLVAIAILVTYPKLPSLDSLQHYQPKMPLTIY
         ||||||||||||||||||||||||||||||||||||||||||||||||||||||||||||
m791     MVNYYSAMIKKILTTCFGLVFGFCVFGVGLVAIAILVTYPKLPSLDSLQHYQPKMPLTIY
                 10        20        30        40        50        60

70        80        90       100       110       120
a791.pep SADGEVIGMYGEQRREFTKIGDFPEVLRNAVIAAEDKRFYRHWGVDVWGVARAAVGNVVS
         ||||||||||||||||||||||||||||||||||||||||||||||||||||||||||||
m791     SADGEVIGMYGEQRREFTKIGDFPEVLRNAVIAAEDKRFYRHWGVDVWGVARAAVGNVVS
                 70        80        90       100       110       120

130       140       150       160       170       180
a791.pep GSVQSGASTITQQVAKNFYLSSEKTFTRKFNEVLLAYKIEQSLSKDKILELYFNQIYLGQ
         ||||||||||||||||||||||||||||||||||||||||||||||||||||||||||||
m791     GSVQSGASTITQQVAKNFYLSSEKTFTRKFNEVLLAYKIEQSLSKDKILELYFNQIYLGQ
                130       140       150       160       170       180

190       200       210       220       230       240
a791.pep RAYGFASAAQIYFNKNVRDLTLAEAAMLAGLPKAPSAYNPIVNPERAKLRQKYILNNMLE
         ||||||||||||||||||||||||||||||||||||||||||||||||||||||||||||
m791     RAYGFASAAQIYFNKNVRDLTLAEAAMLAGLPKAPSAYNPIVNPERAKLRQKYILNNMLE
                190       200       210       220       230       240

250       260       270       280       290       300
a791.pep EKMITVQQRDQALNEELHYERFVRKIDQSALYVAEMVRQELYEKYGEDAYTQGFKVYTTV
         ||||||||||||||||||||||||||||||||||||||||||||||||||||||||||||
m791     EKMITVQQRDQALNEELHYERFVRKIDQSALYVAEMVRQELYEKYGEDAYTQGFKVYTTV
                250       260       270       280       290       300

310       320       330       340       350       360
a791.pep RADHQKVATEALRKALRNFDRGSSYRGAENYIDLSKSEDVEETVSQYLSGLYTVDKMVPA
         ||||||||||||||||||||||||||||||||||||||||||||||||||||||||||||
m791     RADHQKVATEALRKALRNFDRGSSYRGAENYIDLSKSEDVEETVSQYLSGLYTVDKMVPA
                310       320       330       340       350       360

370       380       390       400       410       420
a791.pep VVLDVTKKKNVVIQLPGGRRVTLDRRALGFAARAVNNEKMGEDRIRRGAVIRVKNNGGRW
         ||||||||||||||||||||||||||||||||||||||||||||||||||||||||||||
m791     VVLDVTKKKNVVIQLPGGRRVTLDRRALGFAARAVNNEKMGEDRIRRGAVIRVKNNGGRW
                370       380       390       400       410       420

430       440       450       460       470       480
a791.pep AVVQEPLLQGALVSLDAKTGAVRALVGGYDFHSKTFNRAVQAMRQPGSTFKPFVYSAALS
         |||||||||||| |||||||||||||||||||||||||||||||||||||||||||||||
m791     AVVQEPLLQGALGSLDAKTGAVRALVGGYDFHSKTFNRAVQAMRQPGSTFKPFVYSAALS
                430       440       450       460       470       480

490       500       510       520       530       540
a791.pep KGMTASTVVNDAPISLPGKGPNGSVWTPKNSDGRYSGYITLRQALTASKNMVSIRILMSI
         ||||||||||||||||||||||||||||||||||||||||||||||||||||||||||||
m791     KGMTASTVVNDAPISLPGKGPNGSVWTPKNSDGRYSGYITLRQALTASKNMVSIRILMSI
                490       500       510       520       530       540
```

-continued

```
                550        560        570        580        590        600
  a791.pep   GVGYAQQYIRRFGFRPSELSASLSMALGTGETTPLKVAEAYSVFANGGYRVSSHVIDKIY
             ||||||||||||||||| |||| |||||||||||||||||||||||||||||||||||
  m791       GVGYAQQYIRRFGFRSSELPASLSMALGTGETTPLKVAEAYSVFANGGYRVSSHVIDKIY
                550        560        570        580        590        600

610        620        630        640        650        660
  a791.pep   DRDGRLRAQMQPLVAGQNAPQAIDPRNAYIMYKIMQDVVRVGTARGAAALGRTDIAGKTG
             ||||||||||||||||||||||||||||||||||||||||||||||||||||||||||||
  m791       DRDGRLRAQMQPLVAGQNAPQAIDPRNAYIMYKIMQDVVRVGTARGAAALGRTDIAGKTG
                610        620        630        640        650        660

670        680        690        700        710        720
  a791.pep   TTNDNKDAWFVGFNPDVVTAVYIGFDKPKSMGRVGYGGTIAVPVWVDYMRFALKGKQGKG
             ||||||||||||||||||||||||||||||||||||||||||||||||||||||||||||
  m791       TTNDNKDAWFVGFNPDVVTAVYIGFDKPKSMGRVGYGGTIAVPVWVDYMRFALKGKQGKG
                670        680        690        700        710        720

730        740        750       7760        770        780
  a791.pep   MKMPEGVVSSNGEYYMKERMVTDPGLTLDNSGIAPQPSRRAKEDDGGAAEGGRQAADDEV
             ||||||||||||||||||||||||||||||||||||||||||||||||||||||||||||
  m791       MKMPEGVVSSNGEYYMKERMVTDPGLTLDNSGIAPQPSRRAKEDDGGAAEGGRQAADDEV
                730        740        750        760        770        780

790        800
  a791.pep   RQDMQETPVLPSNTGSKQQQLDSLFX
             ||||||||||||||||||||||||||
  m791       RQDMQETPVLPSNTGSKQQQLDSLFX
                790        800
```

The following partial DNA sequence was identified in *N. gonorrhoeae* <SEQ ID 2681>:

```
g792.seq
   1 ATGTTCCGCA TCGTCAAATG GCTGATTGCC CTGCCCGTCG GCATCTTTAT

51 CTTTTTCAAT GCCTATGTGT ACGGCAACAT CATCACCTAC CGCGCCGTCG

101 CGCCCCATCG GACTGCCTTT ATGTCGATGC GGATGAAGCA GTTTGAACAA

151 GAAGGTCGCG ATGTCGCACT GGATTACCGC TGGGTGCCCT ACAACCGCAT

201 TTCCACCAAC CTGAAAAAAG CCCTGATTGC TTCCGAAGAT GTCCGTTTTG

251 CCggacacgg gggcttcGat GGGGACGGCa tTCAAAACGC CATCAGGCGC

301 AACCGGAACA GCGGCGAAGT GAAGGCGGGC GGATCGACCA TCAGCCAGCA

351 GCTTGCCAAA AACCTCTTCC TCAACGAAAG CCGCAACTAT CTGCGCAAAG

401 GGGAAGAGGC GGCCATTACG GCAATGATGG AAGCTGTTAC CGACAAAAAC

451 AGGATTTTCG AACTGTATTT AAACTCAATC GAATGGCACT ACGGCgtTTT

501 CGGCGCGGAA GCTGCGTCCC GGtatTtttTA TAAAAAACCG GCcgcaGACC

551 TGACcAAACA GCAggcggcG aaactgacgg tactcgtccc cgccccgttt 601 tactactctg accatccaaa aagcaaacgg ctgcgcaaca aaaccaatat 651 cgtgctcaga cgcatgggtt cggcaaatta ccccaaagcg aaacggactg 701 attgttccag atatggaaat gccgcctgaa ctggggttcg aacggcatat 751 gttttctggg acttataa
```

This corresponds to the amino acid sequence <SEQ ID 2682; ORF 792.ng>:

```
g792.pep
   1 MFRIVKWLIA LPVGIFIFFN AYVYGNIITY RAVAPHRTAF MSMRMKQFEQ

51 EGRDVALDYR WVPYNRISTN LKKALIASED VRFAGHGGFD GDGIQNAIRR
```

```
101 NRNSGEVKAG GSTISQQLAK NLFLNESRNY LRKGEEAAIT AMMEAVTDKN

151 RIFELYLNSI EWHYGVFGAE AASRYFYKKP AADLTKQQAA KLTVLVPAPF

201 YYSDHPKSKR LRNKTNIVLR RMGSANYPKA KRTDCSRYGN AA*TGVRTAY

251 VFWDL*
```

The following partial DNA sequence was identified in *N. meningitidis* <SEQ ID 2683>:

```
m792.seq
  1 ATGTTCCGCA TCATCAAATG GCTGATTGCC CTGCCCGTCG GCATCTTTAT

51 CTTTTTCAAT GCCTATGTGT ACGGCAACAT CATTACCTAC CGCGCCGTCG

101 CGCCCCATCG GACTGCCTTT ATGTCGATGC GGATGAAGCA GTTTGAACAG

151 GAAGGTCGCG ATGTCGCACT GGATTACCGC TGGATGCCCT ACAAACGCAT

201 TTCCACCAAC CTGAAAAAAG CCCTGATTGC TTCCGAAGAT GCCCGTTTCG

251 CCGGGCACGG CGGCTTCGAT TGGGGCGGCA TTCAAAACGC CATCAGGCGC

301 AACCGGAACA GCGGCAAAGT GAAGGCGGGC GGCTCGACCA TCAGCCAGCA

351 GCTTGCCAAA AACCTGTTTT TAAACGAAAG CCGCAGCTAT ATCCGCAAAG

401 GCGAAGAAGC GGCGATTACC GCGATGATGG AAGCCGTTAC CGACAAAGAC

451 AGGATTTTTG AACTGTATTT AAACTCAATC GAATGGCACT ACGGCGTTTT

501 CGGCGCGGAA GCCGCGTCCC GGTATTTTTA TCAAATACCC GCCGCCAAGC

551 TGACCAAACA GCAGGCGGCA AAACTGACGG CGCGCGTCCC CGCCCCGCTC

601 TACTACGCCG ACCATCCGAA AAGCAAACGG CTCCGCAACA AAACCAATAT

651 CGTGCTCAAA CGCATGGGTT CGGCAGAGTT GCCTGAAAGC GACACGGACT

701 GA
```

This corresponds to the amino acid sequence <SEQ ID 2684; ORF 792>:

```
m792.pep

1 MFRIIKWLIA LPVGIFIFFN AYVYGNIITY RAVAPHRTAF MSMRMKQFEQ

51 EGRDVALDYR WMPYKRISTN LKKALIASED ARFAGHGGFD WGGIQNAIRR

101 NRNSGKVKAG GSTISQQLAK NLFLNESRSY IRKGEEAAIT AMMEAVTDKD

151 RIFELYLNSI EWHYGVFGAE AASRYFYQIP AAKLTKQQAA KLTARVPAPL

201 YYADHPKSKR LRNKTNIVLK RMGSAELPES DTD* g792/m792 90.4% identity in 230 aa overlap 10        20        30        40        50        60
g792.pep MFRIVKWLIALPVGIFIFFNAYVYGNIITYRAVAPHRTAFMSMRMKQFEQEGRDVALDYR
         ||||:|||||||||||||||||||||||||||||||||||||||||||||||||||||||
m792     MFRIIKWLIALPVGIFIFFNAYVYGNIITYRAVAPHRTAFMSMRMKQFEQEGRDVALDYR
                 10        20        30        40        50        60

70        80        90       100       110       120
g792.pep WVPYNRISTNLKKALIASEDVRFAGHGGFDGDGIQNAIRRNRNSGEVKAGGSTISQQLAK
         |:||:|||||||||||||||:|||||||||   ||||||||||||||:||||||||||||
m792     WMPYKRISTNLKKALIASEDARPAGHGGFDWGGIQNAIRRNRNSGKVKAGGSTISQQLAK
                 70        80        90       100       110       120

130       140       150       160       170       180
g792.pep NLFLNESRNYLRKGEEAAITAMMEAVTDKNRIFELYLNSIEWHYGVFGAEAASRYFYKKP
         ||||||||:|:|||||||||||||||||:|||||||||||||||||||||||||||||: |
m792     NLFLNESRSYIRKGEEAAITAMMEAVTDKDRIFELYLNSIEWHYGVFGAEAASRYFYQIP
                130       140       150       160       170       180
```

-continued

```
                      190        200        210        220        230        240
g792.pep    AADLTKQQAAKLTVLVPAPFYYSDHPKSKRLRNKTNIVLRRMGSANYPKAKRTDCSRYGN
            || ||||||||||: ||||:||:||||||||||||||:|||||:  |::
m792        AAKLTKQQAAKLTARVPAPLYYADHPKSKRLRNKTNIVLKMGSAELPESDTDX
                      190        200        210        220        230

250
g792.pep    AAXTGVRTAYVFWDLX
```

The following partial DNA sequence was identified in *N. meningitidis* <SEQ ID 2685>:

```
a792.seq
  1 ATGTTCCGCA TCATCAAATG G

-continued

```
                 130        140        150        160        170        180
a792.pep    NLFLNESRSYIRKGEEAAITAMMEAVTDKDRIFELYLNSIEWHYGVFGAEAASRYFYQIP
            ||||||||||||||||||||||||||||||||||||||||||||||||||||||||||||
m792        NLFLNESRSYIRKGEEAAITAMMEAVTDKDRIFELYLNSIEWHYGVFGAEAASRYFYQIP
                 130        140        150        160        170        180

190        200        210        220        230
a792.pep    AAKLTKQQAAKLTARVPAPLYYADHPKSKRLRNKTNIVLRRMGSAELPESDTDX
            ||||||||||||||||||||||||||||||||||||||||||:|||||||||||
m792        AAKLTKQQAAKLTARVPAPLYYADHPKSKRLRNKTNIVLKRMGSAELPESDTDX
                 190        200        210        220        230
```

The following partial DNA sequence was identified in *N. gonorrhoeae* <SEQ ID 2687>:

```
g793.seq
   1 ATGTTGATTA AAAGCGAATA TAAGCCCCGG ATGCTGCCCA AGAAGAGCA

51 GGTCAAAAAG CCGATGACCA GTAACGGACG GATTAGCTTC GTCCTGATGG

101 CAATGGCGGT CTTGTTTGCC TGTCTGATTG CCCGCGGGCT GTATCTGCAG

151 ACGGTAACGT ATAACTTTTT GAAAGAACAG GGCGACAACC GGATTGTGCG

201 GACTCAAGCA TTGCCGGCTA CACGCGGTAC GGTTTCGGAC CGGAACGGTG

251 CGGTTTTGGC GTTGAGCGCG CCGACGGAGT CCCTGTTTGC CGTGCCTAAA

301 GATATGAAGG AAATGCCGTC TGCCGCCCAA TTGGAACGCC TGTCCGAGCT

351 TGTCGATGTG CCGGTCGATG TTTTGAGGAA CAAACTCGAA CAGAAAGGCA

401 AGTCGTTTAT TTGGATCAAG CGGCAGCTCG ATCCCAAGGT TGCCGAAGAG

451 GTCAAAGCCT TGGGTTTGGA AAACTTTGTA TTTGAAAAAG AATTAAAACG

501 CCATTACCCG ATGGGCAACC TGTTTGCACA CGTCATCGGA TTTACCGATA

551 TTGACGGCAA AGGTCAGGAA GGTTTGGAAC TTTCGCTTGA AGACAGCCTG

601 TATGGCGAAG ACGGCGCGGA AGTTGTTTTG CGGGACCGGC AGGGCAATAT

651 TGTGGACAGC TTGGACTCCC CGCGCAATAA AGCACCGCAA AACGGCAAAG

701 ACATCATCCT TTCCCTCGAT CAGAGGATTC AGACCTTGGC CTATGAAGAG

751 TTGAACAAGG CGGTCGAATA CCATCAGGCA AAAGCCGGAA CGGTGGTGGT

801 TTTGGATGCC CGCACGGGGG AAATCCTCGC CTTGGCCAAT ACGCCCGCCT

851 ACGATCCCAA CAGACCCGGC CGGGCAGACA GCGAACAGCG GCGCAACCGT

901 GCCGTAACCG ATATGATCGA ACCTGGTTCG GCAATCAAAC CGTTCGTGAT

951 TGCGAAGGCA TTGGATGCGG GCAAAACCGA TTTGAACGAA CGGCTGAATA

1001 CGCAGCCTTA TAAAATCGGA CCGTCTCCCG TGCGCGATGA TACCCATGTT

1051 TACCCCTCTT TGGATGTGCG CGGCATTATG CAGAAATCGT CCAACGTCGG

1101 CACAAGCAAA CTGTCTGCGC GTTTCGGCGC CGAAGAAATG TATGACTTCT

1151 ATCATGAATT GGGCATCGGT GTGCGTATGC ACTCGGGCTT TCCGGGGGAA

1201 ACTGCAGGTT TGTTGAGAAA TTGGCGCAGG TGGCGGCCCA TCGAACAGGC

1251 GACGATGTCT TTCGGTTACG GTCTGCAATT GAGCCTGCTG CAATTGGCGC

1301 GCGCCTATAC CGCACTGACG CACGACGGCG TTTTGCTGCC GCTCAGCTTT

1351 GAGAAGCAGG CGGTTGCGCC GCAAGGCAAA CGCATATTCA AGAATCGAC

1401 CGCGCGCGAG GTACGCAATC TGATGGTTTC CGTAACCGAG CCGGGCGGCA

1451 CCGGTACGGC GGGTGCGGTG GACGGTTTCG ATGTCGGCGC TAAAACCGGC
```

-continued

```
1501 ACGGCGCGCA AGTTCGTCAA CGGGCGTTAT GCCGACAACA AACACGTCGC

1551 TACCTTTATC GGTTTTGCCC CCGCCAAAAA CCCCCGTGTG ATTGTGGCGG

1601 TAACCATCGA CGAACCGACT GCCCACGGCT ATTACGGCGG CGTAGTGGCA

1651 GGGCCGCCCT TCAAAAAAAT TATGGGCGGC AGCCTGAACA TCTTGGGCAT

1701 TTCCCCGACC AAGCCACTGA CCGCCGCAGC CGTCAAAACA CCGTCTTAA
```

This corresponds to the amino acid sequence <SEQ ID 2688; ORF 793.ng>:

```
g793.pep
  1 MLIKSEYKPR MLPKEEQVKK PMTSNGRISF VLMAMAVLFA CLIARGLYLQ

51 TVTYNFLKEQ GDNRIVRTQA LPATRGTVSD RNGAVLALSA PTESLFAVPK

101 DMKEMPSAAQ LERLSELVDV PVDVLRNKLE QKGKSFIWIK RQLDPKVAEE

151 VKALGLENFV FEKELKRHYP MGNLFAHVIG FTDIDGKGQE GLELSLEDSL

201 YGEDGAEVVL RDRQGNIVDS LDSPRNKAPQ NGKDIILSLD QRIQTLAYEE

251 LNKAVEYHQA KAGTVVVLDA RTGEILALAN TPAYDPNRPG RADSEQRRNR

301 AVTDMIEPGS AIKPFVIAKA LDAGKTDLNE RLNTQPYKIG PSPVRDDTHV

351 YPSLDVRGIM QKSSNVGTSK LSARFGAEEM YDFYHELGIG VRMHSGFPGE

401 TAGLLRNWRR WRPIEQATMS FGYGLQLSLL QLARAYTALT HDGVLLPLSF

451 EKQAVAPQGK RIFKESTARE VRNLMVSVTE PGGTGTAGAV DGFDVGAKTG

501 TARKFVNGRY ADNKHVATFI GFAPAKNPRV IVAVTIDEPT AHGYYGGVVA

551 GPPFKKIMGG SLNILGISPT KPLTAAAVKT PS*
```

The following partial DNA sequence was identified in *N. meningitidis* <SEQ ID 2689>:

```
m793.seq
  1 ATGTTGATTA AGAGCGAATA TAAGCCTCGG ATGCTGCCCA AAGAAGAGCA

51 GGTCAAAAAG CCGATGACCA GTAACGGACG GATCAGCTTC GTCCTGATGG

101 CAATAGCGGT CTTGTTTGCC GGTCTGATTG CTCGCGGACT GTATCTGCAG

151 ACGGTAACGT ATAACTTTTT GAAAGAACAG GGCGACAACC GGATTGTGCG

201 GACTCAAACA TTGCCGGCTA CACGCGGTAC GGTTTCGGAC CGGAACGGTG

251 CGGTTTTGGC GTTGAGTGCG CCGACGGAGT CCCTGTTTGC CGTGCCTAAA

301 GAGATGAAGG AAATGCCGTC TGCCGCACAA TTGGAACGCC TGTCCGAGCT

351 TGTCGATGTG CCGGTTGATG TTTTGAGGAA CAAGCTCGAA CAGAAAGGCA

401 AGTCGTTTAT CTGGATTAAG CGGCAGCTCG ATCCCAAGGT TGCCGAAGAG

451 GTCAAAGCCT TGGGTTTGGA AAACTTTGTA TTTGAAAAAG AATTAAAACG

501 CCATTACCCG ATGGGCAACC TGTTTGCACA CGTCATCGGA TTTACCGATA

551 TTGACGGCAA AGGTCAGGAA GGTTTGGAAC TTTCGCTTGA AGACAGCCTG

601 CATGGCGAAG ACGGCGCGGA AGTCGTTTTG CGGGACCGGC AGGGCAATAT

651 TGTGGACAGC TTGGACTCCC CGCGCAATAA AGCCCCGAAA AACGGCAAAG

701 ACATCATCCT TTCCCTCGAT CAGAGGATTC AGACCTTGGC CTATGAAGAG

751 TTGAACAAGG CGGTCGAATA CCATCAGGCA AAAGCCGGAA CGGTGGTGGT

801 TTTGGATGCC CGCACGGGGG AAATCCTCGC CTTGGCCAAT ACGCCCGCCT
```

```
 851 ACGATCCCAA CAGGCCCGGC CGGGCAGACA GCGAACAGCG GCGCAACCGT

901 GCCGTAACCG ATATGATCGA ACCCGGTTCG GCAATCAAAC CGTTTGTGAT

951 TGCGAAGGCA TTGGATGCGG GCAAAACCGA TTTGAACGAA CGGCTGAATA

1001 CGCAGCCTTA TAAAATCGGA CCGTCTCCCG TGCGCGATAC CCATGTTTAC

1051 CCCTCTTTGG ATGTGCGCGG CATCATGCAG AAATCGTCCA ACGTCGGCAC

1101 AAGCAAACTG TCTGCGCGTT TCGGTGCCGA AGAAATGTAT GACTTCTATC

1151 ATGAGTTGGG CATCGGTGTG CGTATGCACT CGGGCTTTCC GGGCGAAACT

1201 GCAGGTTTGT TGAGAAATTG GCGCAGGTGG CGGCCTATCG AACAGGCGAC

1251 GATGTCTTTC GGTTACGGCC TGCAATTGAG CCTGCTGCAA TTGGCGCGCG

1301 CCTATACCGC ACTGACGCAC GACGGCGTTT TACTGCCGGT CAGCTTTGAA

1351 AAACAGGCGG TTGCGCCGCA AGGCAAACGC ATATTCAAAG AATCGACCGC

1401 GCGCGAGGTA CGCAATCTGA TGGTTTCCGT AACCGAGCCG GGCGGCACCG

1451 GTACGGCGGG TGCGGTGGAC GGTTTCGATG TCGGCGCGAA AACCGGCACG

1501 GCGCGCAAGT TCGTCAACGG GCGTTATGCC GACAACAAAC ACATCGCTAC

1551 CTTTATCGGT TTTGCCCCCG CCAAAAATCC CCGTGTGATT GTGGCGGTAA

1601 CCATTGACGA ACCGACTGCC CACGGTTATT ACGGCGGCGT AGTGGCAGGG

1651 CCGCCCTTCA AAAAAATTAT GGGCGGCAGC CTGAACATCT TGGGCATTTC

1701 CCCGACCAAG CCACTGACCG CCGCAGCCGT CAAAACACCG TCTTAA
```

This corresponds to the amino acid sequence <SEQ ID 2690; ORF 793>:

```
m793.pep

1  MLIKSEYKPR MLPKEEQVKK PMTSNGRISF VLMAIAVLFA GLIARGLYLQ

51  TVTYNFLKEQ GDNRIVRTQT LPATRGTVSD RNGAVLALSA PTESLFAVPK

101  EMKEMPSAAQ LERLSELVDV PNDVLRNKLE QKGKSFIWIK RQLDPKVAEE

151  VKALGLENFV FEKELKRHYP MGNLFAHVIG FTDIDGKGQE GLELSLEDSL

201  HGEDGAEVVL RDRQGNIVDS LDSPRNKAPK NGKDIILSLD QRIQTLAYEE

251  LNKAVEYHQA KAGTVVVLDA RTGEILALAN TPAYDPNRPG RADSEQRRNR

301  AVTDMIEPGS AIKPFVIAKA LDAGKTDLNE RLNTQPYKIG PSPVRDTHVY

351  PSLDVRGIMQ KSSNVGTSKL SARFGAEEMY DFYHELGIGV RMHSGFPGET

401  AGLLRNWRRW RPIEQATMSF GYGLQLSLLQ LARAYTALTH DGVLLPVSFE

451  KQAVAPQGKR IFKESTAREV RNLMVSVTEP GGTGTAGAVD GFDVGAKTGT

501  ARKFVNGRYA DNKHIATFIG FAPAKNPRVI VAVTIDEPTA HGYYGGVVAG

551  PPFKKIMGGS LNILGISPTK PLTAAAVKTP S* g793/m793 98.5% identity in 582 aa overlap 10         20         30         40         50         60
    g793.pep  MLIKSEYKPRMLPKEEQVKKPMTSNGRISFVLMAMAVLFACLIARGLYLQTVTYNFLKEQ
              |||||||||||||||||||||||||||||||||| ||||| |||||||||||||||||||
        m793  MLIKSEYKPRMLPKEEQVKKPMTSNGRISFVLMAIAVLFAGLIARGLYLQTVTYNFLKEQ
                  10         20         30         40         50         60

70         80         90        100        110        120
    g793.pep  GDNRIVRTQALPATRGTVSDRNGAVLALSAPTESLFAVPKDMKEMPSAAQLERLSELVDV
              ||||||||| ||||||||||||||||||||||||||||||  ||||||||||||||||||
        m793  GDNRIVRTQTLPATRGTVSDRNGAVLALSAPTESLFAVPKEMKEMPSAAQLERLSELVDV
                  70         80         90        100        110        120
```

-continued

```
                130       140       150       160       170       180
g793.pep  PVDVLRNKLEQKGKSFIWIKRQLDPKVAEEVKALGLENFVFEKELKRHYPMGNLFAHVIG
          ||||||||||||||||||||||||||||||||||||||||||||||||||||||||||||
m793      PVDVLRNKLEQKGKSFIWIKRQLDPKVAEEVKALGLENFVFEKELKRHYPMGNLFAHVIG
                130       140       150       160       170       180

190       200       210       220       230       240
g793.pep  FTDIDGKGQEGLELSLEDSLYGEDGAEVVLRDRQGNIVDSLDSPRNKAPQNGKDIILSLD
          ||||||||||||||||||||:||||||||||||||||||||||||||||:||||||||||
m793      FTDIDGKGQEGLELSLEDSLHGEDGAEVVLRDRQGNIVDSLDSPRNKAPKNGKDIILSLD
                190       200       210       220       230       240

250       260       270       280       290       300
g793.pep  QRIQTLAYEELNKAVEYHQAKAGTVVVLDARTGEILALANTPAYDPNRPGRADSEQRRNR
          ||||||||||||||||||||||||||||||||||||||||||||||||||||||||||||
m793      QRIQTLAYEELNKAVEYHQAKAGTVVVLDARTGEILALANTPAYDPNRPGRADSEQRRNR
                250       260       270       280       290       300

310       320       330       340       350       360
g793.pep  AVTDMIEPGSAIKPFVIAKALDAGKTDLNERLNTQPYKIGPSPVRDDTHVYPSLDVRGIM
          ||||||||||||||||||||||||||||||||||||||||||||||| ||||||||||||
m793      AVTDMIEPGSAIKPFVIAKALDAGKTDLNERLNTQPYKIGPSPVRD-THVYPSLDVRGIM
                310       320       330       340        350

370       380       390       400       410       420
g793.pep  QKSSNVGTSKLSARFGAEEMYDFYHELGIGVRMHSGFPGETAGLLRNWRRWRPIEQATMS
          ||||||||||||||||||||||||||||||||||||||||||||||||||||||||||||
m793      QKSSNVGTSKLSARFGAEEMYDFYHELGIGVRMHSGFPGETAGLLRNWRRWRPIEQATMS
      360       370       380       390       400       410

430       440       450       460       470       480
g793.pep  FGYGLQLSLLQLARAYTALTHDGVLLPLSFEKQAVAPQGKRIFKESTAREVRNLMVSVTE
          ||||||||||||||||||||||||||:|||||||||||||||||||||||||||||||||
m793      FGYGLQLSLLQLARAYTALTHDGVLLPVSFEKQAVAPQGKRIFKESTAREVRNLMVSVTE
      420       430       440       450       460       470

490       500       510       520       530       540
g793.pep  PGGTGTAGAVDGFDVGAKTGTARKFVNGRYADNKHVATFIGFAPAKNPRVIVAVTIDEPT
          ||||||||||||||||||||||||||||||||||:|||||||||||||||||||||||||
m793      PGGTGTAGAVDGFDVGAKTGTARKFVNGRYADNKHIATFIGFAPAKNPRVIVAVTIDEPT
      480       490       500       510       520       530

550       560       570       580
g793.pep  AHGYYGGVVAGPPFKKIMGGSLNILGISPTKPLTAAAVKTPSX
          |||||||||||||||||||||||||||||||||||||||||||
m793      AHGYYGGVVAGPPFKKIMGGSLNILGISPTKPLTAAAVKTPSX
      540       550       560       570       580
```

The following partial DNA sequence was identified in *N. meningitidis* <SEQ ID 2691>:

```
a793.seq
   1  ATGTTGATTA AGAGCGAATA TAAGCCTCGG ATGCTGCCCA AAGAAGAGCA

51  GGTCAAAAAG CCGATGACCA GTAACGGACG GATCAGCTTC GTCCTGATGG

101  CAATAGCGGT CTTGTTTGCC GGTCTGATTG CTCGCGGACT GTATCTGCAG

151  ACGGTAACGT ATAACTTTTT GAAAGAACAG GGCGACAACC GGATTGTGCG

201  GACTCAAACA TTGCCGGCTA CACGCGGTAC GGTTTCGGAC CGGAACGGTG

251  CGGTTTTGGC GTTGAGTGCG CCGACGGAGT CCCTGTTTGC CGTGCCTAAA

301  GAGATGAAGG AAATGCCGTC TGCCGCACAA TTGGAACGCC TGTCCGAGCT

351  TGTCGATGTG CCGGTTGATG TTTTGAGGAA CAAGCTCGAA CAGAAAGGCA

401  AGTCGTTTAT CTGGATTAAG CGGCAGCTCG ATCCCAAGGT TGCCGAAGAG

451  GTCAAAGCCT TGGGTTTGGA AAACTTTGTA TTTGAAAAAG AATTAAAACG

501  CCATTACCCG ATGGGCAACC TGTTTGCACA CGTCATCGGA TTTACCGATA

551  TTGACGGCAA AGGTCAGGAA GGTTTGGAAC TTTCGCTTGA AGACAGCCTG
```

```
 601 CATGGCGAAG ACGGCGCGGA AGTCGTTTTG CGGGACCGGC AGGGCAATAT

651 TGTGGACAGC TTGGACTCCC CGCGCAATAA AGCCCCGAAA AACGGCAAAG

701 ACATCATCCT TTCCCTCGAT CAGAGGATTC AGACCTTGGC CTATGAAGAG

751 TTGAACAAGG CGGTCGAATA CCATCAGGCA AAAGCCGAA CGGTGGTGGT

801 TTTGGATGCC CGCACGGGGG AAATCCTCGC CTTGGCCAAT ACGCCCGCCT

851 ACGATCCCAA CAGGCCCGGC CGGGCAGACA GCGAACAGCG GCGCAACCGT

901 GCCGTAACCG ATATGATCGA ACCCGGTTCG GCAATCAAAC CGTTTGTGAT

951 TGCGAAGGCA TTGGATGCGG GCAAAACCGA TTTGAACGAA CGGCTGAATA

1001 CGCAGCCTTA TAAAATCGGA CCGTCTCCCG TGCGCGATAC CCATGTTTAC

1051 CCCTCTTTGG ATGTGCGCGG CATCATGCAG AAATCGTCCA ACGTCGGCAC

1101 AAGCAAACTG TCTGCGCGTT TCGGTGCCGA AGAAATGTAT GACTTCTATC

1151 ATGAGTTGGG CATCGGTGTG CGTATGCACT CGGGCTTTCC GGGCGAAACT

1201 GCAGGTTTGT TGAGAAATTG GCGCAGGTGG CGGCCTATCG AACAGGCGAC

1251 GATGTCTTTC GGTTACGGCC TGCAATTGAG CCTGCTGCAA TTGGCGCGCG

1301 CCTATACCGC ACTGACGCAC GACGGCGTTT TACTGCCGGT CAGCTTTGAA

1351 AAACAGGCGG TTGCGCCGCA AGGCAAACGC ATATTCAAAG AATCGACCGC

1401 GCGCGAGGTA CGCAATCTGA TGGTTTCCGT AACCGAGCCG GGCGGCACCG

1451 GTACGGCGGG TGCGGTGGAC GGTTTCGATG TCGGCGCGAA AACCGGCACG

1501 GCGCGCAAGT TCGTCAACGG CGTTATGCC GACAACAAAC ACATCGCTAC

1551 CTTTATCGGT TTTGCCCCCG CCAAAAATCC CCGTGTGATT GTGGCGGTAA

1601 CCATTGACGA ACCGACTGCC CACGGTTATT ACGGCGGCGT AGTGGCAGGG

1651 CCGCCCTTCA AAAAAATTAT GGGCGGCAGC CTGAACATCT TGGGCATTTC

1701 CCCGACCAAG CCACTGACCG CCGCAGCCGT CAAAACACCG TCTTAA
```

This corresponds to the amino acid sequence <SEQ ID 2692; ORF 793.a>:

```
a793.pep

1 MLIKSEYKPR MLPKEEQVKK PMTSNGRISF VLMAIAVLFA GLIARGLYLQ

51 TVTYNFLKEQ GDNRIVRTQT LPATRGTVSD RNGAVLALSA PTESLFAVPK

101 EMKEMPSAAQ LERLSELVDV PVDVLRNKLE QKGKSFIWIK RQLDPKVAEE

151 VKALGLENFV FEKELKRHYP MGNLFAHVIG FTDIDGKGQE GLELSLEDSL

201 HGEDGAEVVL RDRQGNIVDS LDSPRNKAPK NGKDIILSLD QRIQTLAYEE

251 LNKAVEYHQA KAGTVVVLDA RTGEILALAN TPAYDPNRPG RADSEQRRNR

301 AVTDMIEPGS AIKPFVIAKA LDAGKTDLNE RLNTQPYKIG PSPVRDTHVY

351 PSLDVRGIMQ KSSNVGTSKL SARFGAEEMY DFYHELGIGV RMHSGFPGET

401 AGLLRNWRRW RPIEQATMSF GYGLQLSLLQ LARAYTALTH DGVLLPVSFE

451 KQAVAPQGKR IFKESTAREV RNLMVSVTEP GGTGTAGAVD GFDVGAKTGT

501 ARKFVNGRYA DNKHIATFIG FAPAKNPRVI VAVTIDEPTA HGYYGGVVAG

551 PPFKKIMGGS LNILGISPTK PLTAAAVKTP S* a793/m793 100.0% identity in 581 aa overlap
```

```
              10         20         30         40         50         60
a793.pep  MLIKSEYKPRMLPKEEQVKKPMTSNGRISFVLMAIAVLFAGLIARGLYLQTVTYNFLKEQ
          ||||||||||||||||||||||||||||||||||||||||||||||||||||||||||||
m793      MLIKSEYKPRMLPKEEQVKKPMTSNGRISFVLMAIAVLFAGLIARGLYLQTVTYNFLKEQ
              10         20         30         40         50         60

70         80         90        100        110        120
a793.pep  GDNRIVRTQTLPATRGTVSDRNGAVLALSAPTESLFAVPKEMKEMPSAAQLERLSELVDV
          ||||||||||||||||||||||||||||||||||||||||||||||||||||||||||||
m793      GDNRIVRTQTLPATRGTVSDRNGAVLALSAPTESLFAVPKEMKEMPSAAQLERLSELVDV
              70         80         90        100        110        120

130        140        150        160        170        180
a793.pep  PVDVLRNKLEQKGKSFIWIKRQLDPKVAEEVKALGLENFVFEKELKRHYPMGNLFAHVIG
          ||||||||||||||||||||||||||||||||||||||||||||||||||||||||||||
m793      PVDVLRNKLEQKGKSFIWIKRQLDPKVAEEVKALGLENFVFEKELKRHYPMGNLFAHVIG
             130        140        150        160        170        180

190        200        210        220        230        240
a793.pep  FTDIDGKGQEGLELSLEDSLHGEDGAEVVLRDRQGNIVDSLDSPRNKAPKNGKDIILSLD
          ||||||||||||||||||||||||||||||||||||||||||||||||||||||||||||
m793      FTDIDGKGQEGLELSLEDSLHGEDGAEVVLRDRQGNIVDSLDSPRNKAPKNGKDIILSLD
             190        200        210        220        230        240

250        260        270        280        290        300
a793.pep  QRIQTLAYEELNKAVEYHQAKAGTVVVLDARTGEILALANTPAYDPNRPGRADSEQRRNR
          ||||||||||||||||||||||||||||||||||||||||||||||||||||||||||||
m793      QRIQTLAYEELNKAVEYHQAKAGTVVVLDARTGEILALANTPAYDPNRPGRADSEQRRNR
             250        260        270        280        290        300

310        320        330        340        350        360
a793.pep  AVTDMIEPGSAIKPFVIAKALDAGKTDLNERLNTQPYKIGPSPVRDTHVYPSLDVRGIMQ
          ||||||||||||||||||||||||||||||||||||||||||||||||||||||||||||
m793      AVTDMIEPGSAIKPFVIAKALDAGKTDLNERLNTQPYKIGPSPVRDTHVYPSLDVRGIMQ
             310        320        330        340        350        360

370        380        390        400        410        420
a793.pep  KSSNVGTSKLSARFGAEEMYDFYHELGIGVRMHSGFPGETAGLLRNWRRWRPIEQATMSF
          ||||||||||||||||||||||||||||||||||||||||||||||||||||||||||||
m793      KSSNVGTSKLSARFGAEEMYDFYHELGIGVRMHSGFPGETAGLLRNWRRWRPIEQATMSF
             370        380        390        400        410        420

430        440        450        460        470        480
a793.pep  GYGLQLSLLQLARAYTALTHDGVLLPVSFEKQAVAPQGKRIFKESTAREVRNLMVSVTEP
          ||||||||||||||||||||||||||||||||||||||||||||||||||||||||||||
m793      GYGLQLSLLQLARAYTALTHDGVLLPVSFEKQAVAPQGKRIFKESTAREVRNLMVSVTEP
             430        440        450        460        470        480

490        500        510        520        530        540
a793.pep  GGTGTAGAVDGFDVGAKTGTARKFVNGRYADNKHIATFIGFAPAKNPRVIVAVTIDEPTA
          ||||||||||||||||||||||||||||||||||||||||||||||||||||||||||||
m793      GGTGTAGAVDGFDVGAKTGTARKFVNGRYADNKHIATFIGFAPAKNPRVIVAVTIDEPTA
             490        500        510        520        530        540

550        560        570        580
a793.pep  HGYYGGVVAGPPPFKKIMGGSLNILGISPTKPLTAAAVKTPSX
          ||||||||||||||||||||||||||||||||||||||||||
m793      HGYYGGVVAGPPPFKKIMGGSLNILGISPTKPLTAAAVKTPSX
             550        560        570        580
```

The following partial DNA sequence was identified in *N. gonorrhoeae* <SEQ ID 2693>:

```
g794.seq
    1  gtgcgtttca ATCATTTCAT AATGGTAACG ATTATTATAT ATGTGATTTC

51  CCCTGCAAAC AAGCCGGTCC GCCGCCCCGG CGTTCCCACT TATCCGGCTT

101  TGCCTTATAA TTGCTTTTTT TATGTAACAG ATTCACCTAT GAATTTCCCC

151  AAAACAGCGG CCTCCCTGCT GCTGCTTCTC GCCTCCCTCG CCGCACACGC

201  GCTCGATACC GGCCGCATTC CGCAAAACGA AATCGCTGTA TATGTCCAAG

251  AGCTTGACAG CGGAAAAGTC ATCATTGACC ACCGTGCCGG CATACCCGTC
```

```
 301 AATCCCGCGT CCACGATGAA GCTCGTTACC GCGTTTGCCG CCTTCAAAAC

351 CTTCGGCAGC AATTACCGCT GGGCGACCGA GTTTAAAAGC AACGGTACGG

401 TAAACGACGG CACGCTTGAC GGAAACCTGT ATTGGGCGGG CAGCGGCGAC

451 CCCGTTTTCA ATCAGGAAAA CCTGCTTGCC GTCCAACGCC AGTTGCGCGA

501 CAAAGGCATC CGCAATATCA CGGGGCGCCT GATGCTCGAC CACAGCCTGT

551 GGGGCGAAGT CGGCAGTCCC GACCATTTTG AAGCCGACAG CGGTTCGCCG

601 TTTATGACGC CCCCAAATCC GACTATGCTG TCTGCCGGTA TGGTTATGGT

651 GCGCGCCGAA CGCAATGCCG CCGGCAGTAC CGACATCCTC ACCGATCCGC

701 CTTTGCCGCA TATTTTTGCC CAAACAACT TGAAAATTAC CGCCTCCCAA

751 GCTGCCTGCC CTTCGGTCAA AAACTGATG CGCGCATCTT TTTCGGGCAA

801 TACGCTGAAA TTGCGCGGCA ATATTCCCGA AAGCTGTTTG GGCAAGCCTG

851 TCGGTGTCCG GATGTTCGCG CTTGACGAAC TGATCCGCCA AAGTTTTACC

901 AACCGCTGGC TGCTCGGCGG CGGACGGATT TCAGACGGCA TCGGCATAGC

951 CGACACACCG GAAGGCGCGC AGACGCTTGC CGTTGCACAC TCCAAACCGA

1001 TGAAGGAAAT TTTGACGGAC ATGAACAAGC GTTCGGACAA TCTGATTGCG

1051 CGTTCCGTCT TCCTCAAACT CGGCGGCGAC GGCAAACTGC CCGCCGTTTC

1101 CGAACAGGCG GCGTCTGCCG TCCGGCGAGA ACTTGCCGTA TCGGGCATCG

1151 ATGTTGCGGA TTTGGTTTTG GAAAACGGTT CGGGTCTGTC CAGAAAAGAA

1201 AGGGTAACGG CGAGAATGAT GGCGCAAATG TTGGAAACGG CTTATTTCAG

1251 CCCGTTTGCA CAAGATTTCA TCGACACGCT GCCCATCGCC GGCACAGACG

1301 GGACTTTACG CAACCGCTTC AAACAAAGCG GCGGGCTGTT GCGCTTAAAA

1351 ACCGGCACGC TCAACAATGT CCGCGCCCTT GCAGGTTATT GGCTGGGCGA

1401 CAAACCGATG GCGGTGGTCG TCATCATCAA CAGCGGCCGC GCCGTTTCCC

1451 TGCTGCCCGA CTTGGACAAC TTCGTTGCCA AAACATCAT CTCCGGCGGC

1501 GACGGCTGGC TGGATGCGAA ACTGATGTGC AAAGAACGCC GCGCCTGA
```

This corresponds to the amino acid sequence <SEQ ID 2694; ORF 794.ng>:

```
g794.pep
   1 VRFNHFIMVT IIIYVISPAN KPVRRPGVPT YPALPYNCFF YVTDSPMNFP

51 KTAASLLLLL ASLAAHALDT GRIPQNEIAV YVQELDSGKV IIDHRAGIPV

101 NPASTMKLVT AFAAFKTFGS NYRWATEFKS NGTVNDGTLD GNLYWAGSGD

151 PVFNQENLLA VQRQLRDKGI RNITGRLMLD HSLWGEVGSP DHFEADSGSP

201 FMTPPNPTML SAGMVMVRAE RNAAGSTDIL TDPPLPHIFA QNNLKITASQ

251 AACPSVKKLM RASFSGNTLK LRGNIPESCL GKPVGVRMFA LDELIRQSFT

301 NRWLLGGGRI SDGIGIADTP EGAQTLAVAH SKPMKEILTD MNKRSDNLIA

351 RSVFLKLGGD GKLPAVSEQA ASAVRRELAV SGIDVADLVL ENGSGLSRKE

401 RVTARMMAQM LETAYFSPFA QDFIDTLPIA GTDGTLRNRF KQSGGLLRLK

451 TGTLNNVRAL AGYWLGDKPM AVVVIINSGR AVSLLPDLDN FVAKNIISGG

501 DGWLDAKLMC KERRA*
```

The following partial DNA sequence was identified in *N. meningitidis* <SEQ ID 2695>:

```
m794.seq
    1 GTGCGTCTCA ATCATTTCAT AATGATAGCG ATTATTATAT ATGTGATTTC

51 CCCTGCAAAC AAGCCGGCCC GCCGCCACAG CGTTCCCACT TATCCGGCTT

101 TGCCTTATAA TTGCTTTTTT TATGTAACAG ATTTACCTAT GAATTTCCCC

151 AAAACAGCGG CCTCCCTGCT GCTGCTTCTC GCCTCCCTCG CCGCACACGC

201 GCTCGATACC GGCCGCATTC CGCAAAACGA AATCGCCGTA TATGTCCAAG

251 AGCTTGACAG CGGAAAAGTC ATCATTGACC ACCGCTCGGA TGTCCCCGTC

301 AACCCCGCCT CCACAATGAA ACTCGTTACC GCGTTTGCCG CCTTCAAAAC

351 CTTCGGCAGC AATTACCGCT GGGCGACCGA GTTTAAAAGC AACGGTACGG

401 TAAACGACGG CACGCTTGAC GGAAACCTAT ATTGGGCGGG CAGCGGCGAC

451 CCCGTTTTCA ATCAGGAAAA CCTGCTTGAT GCTCAAAAAC AGTTGCGCGA

501 ACAAGGCATA CTCAATATCA CGGGACACCT GATGCTCGAC ACAGCCTGT

551 GGGGCGAAGT CGGCAGCCCC GACGATTTCG AAGCCGACAG CGGTTCGCCG

601 TTTATGACGC CCCCCAATCC AACTATGCTG TCTGCCGGTA TGGTTATGGT

651 GCGCGCCGAA CGCAATGCCG CCGGCAGTAC CGACATCCTC ACCGATCCGC

701 CTTTGCCGCA TATTTTCGCC CAAACAACT TGAAAATTAC CGCCTCCCAA

751 GCTGCCTGCC CTTCGATCAA AAAACTGATG CGTGCATCTT TTTCGGACAA

801 TACGCTGAAA TTGCGCGGCA ATATTCCCGA GAGCTGTTTG GGCAAGCCTG

851 TCGGTGTCCG GATGTTCGCG CTTGACGAAC TGATCCGGCA AAGTTTTACC

901 AACCACTGGC TGCTCGGCGG CGGACGGATT TCAGACGGTA TCGGCATAGC

951 CGACACGCCG GAAGGCGCGC AGACACTTGC CGTTGCACAC GCCAAACCGA

1001 TGAAAGAAAT TTTGACGGAC ATGAACAAGC GTTCGGACAA TCTAATTGCG

1051 CGTTCCGTCT TCCTCAAACT CGGCGGCGAC GGCAAACTGC CCGCCGTTTC

1101 CGAACAGGCG GCGTCTGCCG TCCGGCGCGA ACTTGCCGTA TCGGGCATCG

1151 ATGTTGCGGA TTTGGTTTTG GAAAACGGTT CGGGCCTGTC CAGAAAAGAA

1201 AGGGTAACGG CGAGAATGAT GGCGCAAATG TTGGAAACGG CTTATTTCAG

1251 CCCGTTTGCA CAAGATTTCA TCGACACGCT ACCCATCGCC GGCACAGACG

1301 GAACTTTACG CAACCGCTTC AAACAAAGCG GCGGGCTGTT GCGCTTAAAA

1351 ACCGGCACGC TCAACAATGT CCGCGCCCTT GCAGGTTATT GGCTGGGCGA

1401 CAAACCGATG GCGGTGGTCG TCATCATCAA CAGCGGCCGC GCCGTTTCCC

1451 TGCTGCCAGA CTTGGACAAC TTCGTTGCCA ACAACATCAT CTCCGGCGGC

1501 GATGGCTGGC TGGATGCGAA ACTGATGTGC AAAGAACGCC GAGCCTGA
```

This corresponds to the amino acid sequence <SEQ ID 2696; ORF 794>:

```
m794.pep
      1  VRLNHFIMIA IIIYVISPAN KPARRHSVPT YPALPYNCFF YVTDLPMNFP

51  KTAASLLLLL ASLAAHALDT GRIPQNEIAV YVQELDSGKV IIDHRSDVPV

101  NPASTMKLVT AFAAFKTFGS NYRWATEFKS NGTVNDGTLD GNLYWAGSGD

151  PVFNQENLLD AQKQLREQGI LNITGHLMLD HSLWGEVGSP DDFEADSGSP
```

```
            -continued
201  FMTPPNPTML SAGMVMVRAE RNAAGSTDIL TDPPLPHIFA QNNLKITASQ

251  AACPSIKKLM RASFSDNTLK LRGNIPESCL GKPVGVRMFA LDELIRQSFT

301  NHWLLGGGRI SDGIGIADTP EGAQTLAVAH AKPMKEILTD MNKRSDNLIA

351  RSVFLKLGGD GKLPAVSEQA ASAVRRELAV SGIDVADLVL ENGSGLSRKE

401  RVTARMMAQM LETAYFSPFA QDFIDTLPIA GTDGTLRNRF KQSGGLLRLK

451  TGTLNNVRAL AGYWLGDKPM AVVVIINSGR AVSLLPDLDN FVANNIISGG

501  DGWLDAKLMC KERRA*
```

```
g794/m794 95.5% identity in 515 aa overlap
                   10         20         30         40         50         60
      g794.pep VRFNHFIMVTIIIYVISPANKPVRRPGVPTYPALPYNCFFYVTDSPMNFPKTAASLLLLL
               ||:||||::||||||||||||:||  :|||||||||||||||| |||||||||||||||
      m794     VRLNHFIMIAIIIYVISPANKPARRHSVPTYPALPYNCFFYVTDLPMNFPKTAASLLLLL
                   10         20         30         40         50         60
                   70         80         90        100        110        120
      g794.pep ASLAAHALDTGRIPQNEIAVYVQELDSGKVIIDHRAGIPVNPASTMKLVTAFAAFKTFGS
               ||||||||||||||||||||||||||||||||||:  :||||||||||||||||||||||
      m794     ASLAAHALDTGRIPQNEIAVYVQELDSGKVIIDHRSDVPVNPASTMKLVTAFAAFKTFGS
                   70         80         90        100        110        120
                  130        140        150        160        170        180
      g794.pep NYRWATEFKSNGTVNDGTLDGNLYWAGSGDPVFNQENLLAVQRQLRDKGIRNITGRLMLD
               ||||||||||||||||||||||||||||||||||||||| :|:|||::|| ||||:||||
      m794     NYRWATEFKSNGTVNDGTLDGNLYWAGSGDPVFNQENLLDAQKQLREQGILNITGHLMLD
                  130        140        150        160        170        180
                  190        200        210        220        230        240
      g794.pep HSLWGEVGSPDHFEADSGSPFMTPPNPTMLSAGMVMVRAERNAAGSTDILTDPPLPHIFA
               |||||||||||:|||||||||||||||||||||||||||||||||||||||||||||||
      m794     HSLWGEVGSPDDFEADSGSPFMTPPNPTMLSAGMVMVRAERNAAGSTDILTDPPLPHIFA
                  190        200        210        220        230        240
                  250        260        270        280        290        300
      g794.pep QNNLKITASQAACPSVKKLMRASFSGNTLKLRGNIPESCLGKPVGVRMFALDELIRQSFT
               ||||||||||||||||:||||||||||| |||||||||||||||||||||||||||||||
      m794     QNNLKITASQAACPSIKKLMRASFSDNTLKLRGNIPESCLGKPVGVRMFALDELIRQSFT
                  250        260        270        280        290        300
                  310        320        330        340        350        360
      g794.pep NRWLLGGGRISDGIGIADTPEGAQTLAVAHSKPMKEILTDMNKRSDNLIARSVFLKLGGD
               |:||||||||||||||||||||||||||||:||||||||||||||||||||||||||||
      m794     NHWLLGGGRISDGIGIADTPEGAQTLAVAHAKPMKEILTDMNKRSDNLIARSVFLKLGGD
                  310        320        330        340        350        360
                  370        380        390        400        410        420
      g794.pep GKLPAVSEQAASAVRRELAVSGIDVADLVLENGSGLSRKERVTARMMAQMLETAYFSPFA
               ||||||||||||||||||||||||||||||||||||||||||||||||||||||||||||
      m794     GKLPAVSEQAASAVRRELAVSGIDVADLVLENGSGLSRKERVTARMMAQMLETAYFSPFA
                  370        380        390        400        410        420
                  430        440        450        460        470        480
      g794.pep QDFIDTLPIAGTDGTLRNRFKQSGGLLRLKTGTLNNVRALAGYWLGDKPMAVVVIINSGR
               ||||||||||||||||||||||||||||||||||||||||||||||||||||||||||||
      m794     QDFIDTLPIAGTDGTLRNRFKQSGGLLRLKTGTLNNVRALAGYWLGDKPMAVVVIINSGR
                  430        440        450        460        470        480
                  490        500        510
      g794.pep AVSLLPDLDNFVAKNIISGGDGWLDAKLMCKERRAX
               ||||||||||||:|||||||||||||||||||||||
      m794     AVSLLPDLDNFVANNIISGGDGWLDAKLMCKERRAX
                  490        500        510
```

The following partial DNA sequence was identified in *N. meningitidis* <SEQ ID 2697>:

```
a794.seq
  1  GTGCGTCTCA ATCATTTCAT AATGATAGCG ATTATTATAT ATGTGATTTC

51  CCCTGCAAAC AAGCCGGCCC GCCGCCACAG CGTTCCCACT TATCCGGCTT
```

```
 101 TGCCTTATAA TTGCTTTTTT TATGTAACAG ATTTACCTAT GAATTTCCCC

151 AAAACAGCGG CCTCCCTGCT GCTGCTTCTC GCCTCCCTCG CCGCACACGC

201 GCTCGATACA GGTCGCATTC CGCAAAACGA AATCGCCGTA TATGTCCAAG

251 AGCTTGACAG CGGAAAAGTC ATCATTGACC ACCGCTCGGA TGTCCCCGTC

301 AACCCCGCCT CCACAATGAA ACTCGTTACC GCGTTTGCCG CCTTCAAAAC

351 CTTCGGCAGC AATTACCGCT GGGCGACCGA GTTTAAAAGC AACGGTACGG

401 TAAACGACGG CACGCTTGAC GGAAACCTGT ATTGGGCGGG CAGCGGCGAC

451 CCCGTTTTCA ATCAGGAAAA CCTGCTTGCC GTCCAACGCC AGTTGCGCGA

501 ACAAGGCATA CGCAATATCA CGGGACACCT GATGCTCGAC CACAGCCTGT

551 GGGGCGAAGT CGGCAGCCCC GACGATTTCG AAGCCGACAG CGGTTCGCCG

601 TTTATGACGC CCCCCAATCC AACTATGCTG TCTGCCGGTA TGGTTATGGT

651 GCGCGCCGAA CGCAATGCCG CCGACAGTAC CGACATCCTC ACCGATCCGC

701 CTTTGCCGCA TATTTTCGCC CAAAACAACT TGAAAATTAC CGCCTCCCAA

751 GCTGCCTGCC CTTCGATCAA AAAACTGATG CGTGCATCTT TTTCGGACAA

801 TACGCTGAAA TTGCGCGGCA ATATTCCCGA GAGCTGTTTG GGCAAGCCTG

851 TCGGTGTCCG GATGTTCGCG CTTGACGAAC TGATCCGGCA AAGTTTTACC

901 AACCACTGGC TGCTCGGCGG CGGACGGATT TCAGACGGCA TCGGCATATC

951 CGACACGCCG GAAGGCGCGC AGACGCTTGC CGTTGCACAC TCAAAGCCGA

1001 TGAAGGAAAT TTTGACGGAC ATGAACAAGC GTTCGGACAA TCTAATTGCG

1051 CGTTCCGTCT TCCTCAAACT CGGCGGCGAC GGCAAACTGC CCGCCGTTTC

1101 CGAACAGGCA GCGTCTGCCG TCCGGCGTGA ACTTGCCGTG TCGGGCATCG

1151 ATGTTGCGGA TTTGGTTTTG GAAAACGGTT CAGGTCTGTC CAGAAAAGAA

1201 AGGGTAACGG CGAGAATGAT GGCGCAAATG TTGGAAACGG CTTATTTCAG

1251 CCCGTTTGCA CAAGATTTCA TCGATACGCT GCCCATCGCC GGCACAGACG

1301 GGACTTTACG CAACCGCTTC AAACAAAGCG GCGGGCTGTT GCGCTTAAAA

1351 ACCGGCACGC TCAACAATGT CCGCGCCCTT GCAGGTTATT GGCTGGGCGA

1401 CAAACCGATG GCGGTGGTCG TCATCATCAA CAGCGGCCGC GCCGTTTCCC

1451 TGCTGCCCGA CTTGGACAAC TTCGTTGCCA ACAACATCAT CTCCGGCGGC

1501 GATGGCTGGC TGGATGCGAA ACTGATGTGC AAAGAACGCC GAGCCTGA
```

This corresponds to the amino acid sequence <SEQ ID 2698; ORF 794.a>:

```
a794.pep

1 VRLNHFIMIA IIIYVISPAN KPARRHSVPT YPALPYNCFF YVTDLPMNFP

51 KTAASLLLLL ASLAAHALDT GRIPQNEIAV YVQELDSGKV IIDHRSDVPV

101 NPASTMKLVT AFAAFKTFGS NYRWATEFKS NGTVNDGTLD GNLYWAGSGD

151 PVFNQENLLA VQRQLREQGI RNITGHLMLD HSLWGEVGSP DDFEADSGSP

201 FMTPPNPTML SAGMVMVRAE RNAADSTDIL TDPPLPHIFA QNNLKITASQ

251 AACPSIKKLM RASFSDNTLK LRGNIPESCL GKPVGVRMFA LDELIRQSFT

301 NHWLLGGGRI SDGIGISDTP EGAQTLAVAH SKPMKEILTD MNKRSDNLIA

351 RSVFLKLGGD GKLPAVSEQA ASAVRRELAV SGIDVADLVL ENGSGLSRKE
```

```
   401 RVTARMMAQM LETAYFSPFA QDFIDTLPIA GTDGTLRNRF KQSGGLLRLK

451 TGTLNNVRAL AGYWLGDKPM AVVVIINSGR AVSLLPDLDN FVANNIISGG

501 DGWLDAKLMC KERRA*
``` a794/m794 98.6% identity in 515 aa overlap

```
                    10        20        30        40        50        60
a794.pep    VRLNHFIMIAIIIYVISPANKPARRHSVPTYPALPYNCFFYVTDLPMNFPKTAASLLLLL
            ||||||||||||||||||||||||||||||||||||||||||||| ||||||||||||||
m794        VRLNHFIMIAIIIYVISPANKPARRHSVPTYPALPYNCFFYVTDLPNMFPKTAASLLLLL
                    10        20        30        40        50        60

70        80        90       100       110       120
a794.pep    ASLAAHALDTGRIPQNEIAVYVQELDSGKVIIDHRSDVPVNPASTMKLVTAFAAFKTFGS
            ||||||||||||||||||||||||||||||||||||||||||||||||||||||||||||
m794        ASLAAHALDTGRIPQNEIAVYVQELDSGKVIIDHRSDVPVNPASTMKLVTAFAAFKTFGS
                    70        80        90       100       110       120

130       140       150       160       170       180
a794.pep    NYRWATEFKSNGTVNDGTLDGNLYWAGSGDPVFNQENLLAVQRQLREQGIRNITGHLMLD
            |||||||||||||||||||||||||||||||||||||||| : |:|||||| |||||||
m794        NYRWATEFKSNGTVNDGTLDGNLYWAGSGDPVFNQENLLDAQKQLREQGILNITGHLMLD
                   130       140       150       160       170       180

190       200       210       220       230       240
a794.pep    HSLWGEVGSPDDFEADSGSPFMTPPNPTMLSAGMVMVRAERNAADSTDILTDPPLPHIFA
            ||||||||||||||||||||||||||||||||||||||||||| ||||||||||||||||
m794        HSLWGEVGSPDDFEADSGSPFMTPPNPTMLSAGMVMVRAERNAAGSTDILTDPPLPHIFA
                   190       200       210       220       230       240

250       260       270       280       290       300
a794.pep    QNNLKITASQAACPSIKKLMRASFSDNTLKLRGNIPESCLGKPVGVRMFALDELIRQSFT
            ||||||||||||||||||||||||||||||||||||||||||||||||||||||||||||
m794        QNNLKITASQAACPSIKKLMRASFSDNTLKLRGNIPESCLGKPVGVRMFALDELIRQSFT
                   250       260       270       280       290       300

310       320       330       340       350       360
a794.pep    NHWLLGGGRISDGIGISDTPEGAQTLAVAHSKPMKEILTDMNKRSDNLIARSVFLKLGGD
            |||||||||||||||||:|||||||||||||:||||||||||||||||||||||||||||
m794        NHWLLGGGRISDGIGIADTPEGAQTLAVAHAKPMKEILTDMNKRSDNLIARSVFLKLGGD
                   310       320       330       340       350       360

370       380       390       400       410       420
a794.pep    GKLPAVSEQAASAVRRELAVSGIDVADLVLENGSGLSRKERVTARMMAQMLETAYFSPFA
            ||||||||||||||||||||||||||||||||||||||||||||||||||||||||||||
m794        GKLPAVSEQAASAVRRELAVSGIDVADLVLENGSGLSRKERVTARMMAQMLETAYFSPFA
                   370       380       390       400       410       420

430       440       450       460       470       480
a794.pep    QDFIDTLPIAGTDGTLRNRFKQSGGLLRLKTGTLNNVRALAGYWLGDKPMAVVVIINSGR
            ||||||||||||||||||||||||||||||||||||||||||||||||||||||||||||
m794        QDFIDTLPIAGTDGTLRNRFKQSGGLLRLKTGTLNNVRALAGYWLGDKPMAVVVIINSGR
                   430       440       450       460       470       480

490       500       510
a794.pep    AVSLLPDLDNFVANNIISGGDGWLDAKLMCKERRAX
            ||||||||||||||||||||||||||||||||||||
m794        AVSLLPDLDNFVANNIISGGDGWLDAKLMCKERRAX
                   490       500       510
```

The following partial DNA sequence was identified in *N. gonorrhoeae* <SEQ ID 2699>:

```
g900.seq
    1 ATGccgTCTG AAATGCCGTC TGAAACGTGG CAGGCGGAGG TTCGGACGGC

51 ATTGGGTTTA TTTCAACGGG CGGATGCCGA CCGCATCGCG TACTTTATCC

101 AACAATTCGC GCGCTTCTTT GCGCGCTTTT TGCGCGcctg cctGCAAAAT

151 CTCTTCGATT TGCGAAGGAT TAGAGGTCAA TGCGTTGTAG CGTTCGCGCA

201 GTTCTGCCAA TTCGGCGTTG ATTTTCGCCG CCGAAAGTTT TTTCGCCTCG

251 CCCCAAGCCA AGCCGTCGGC AAGCATTTGC GTAAATTCCG CCGTTTCAGA

301 CGGCGTGGAG AAGGCTTTAT AGATTTCAAA CAAAGGGCTT TCGTCGGGCT

351 GTTTCGGCTC GCCCGGCTCT TTCATGTTGG TAATGATTTT GTTGACCGAT

401 TTTTGGGTTT TTTTGTCGTT TTCCCAAAGC GGAATGGTAT TGCCGTAGGA

451 TTTGGACATT TTGCGTCCGT CCAAACCGAC CAAGAGTTCG ACGTTTTCGT
```

-continued
```
 501 CGATTTTCAC TTCGGGCagg GTGaagagtt cTTGGAaacc gtgggtgaag 551 cggccggcAa tgtcgcgcgc cATTTcgacg tgttgGATTT GGTCGCGCCC

601 GACGGGGACT TCGTTGGCGT TGAACATCAA AATGTCGGCA GTCATCAGAA

651 TCGGATAACT GAACAAACCC ATTTCCACAC CGAAATCGGG GTCTTCCTGC

701 CCGTTTTCCG CATTGGCTTG AACGGCGGCT TTGTAGGCGT GGGCGCGGTT

751 CATCAAACCC TTGGCGGTGA TGCAGGTCAG AATCCAGTTC AACTCCATCA

801 CTTCGGGAAT GTCGCTTTGG CGGTAGAAGG TGGTGCGCTC GGGGTCGAGT

851 CCGCAGGCAA GCCAAGTGGC GGCAACGGCt tgGGTGGATT GGTGAATCAT

901 CTCCTGCTCG TGGCATTTGA TGATGCCGTG GTAATCGGCG AGGAAGAGGA

951 AGGATTCGGT ATCGGGGTTT GCGCCGCGC GGACGGCGGG GCGGATGGCG

1001 CCGACGTAGT TGCCCAGATG CGGGGTGCCG GTGGTGGTTA CGCCGGTCAG

1051 AACTCGTTTT TTGCTCATAA AAATGTCCTT ACGGCAGCAA TGCCGTCTGA

1101 AAGGGAAAa. gatgcgCCGA TTATACCCGA TTTGCCACAT ACATCCAGCC

1151 GacaACagaC TTTTCCATAT TAA
```

This corresponds to the amino acid sequence <SEQ ID 2700; ORF 900.ng:

```
g900.pep
   1 MPSEMPSETW QAEVRTALGL FQRADADRIA YFIQQFARFF ARFLRACLQN

51 LFDLRRIRGQ CVVAFAQFCQ FGVDFRRRKF FRLAPSQAVG KHLRKFRRFR

101 RRGEGFIDFK QRAFVGLFRL ARLFHVGNDF VDRFLGFFVV FPKRNGIAVG

151 FGHFASVQTD QEFDVFVDFH FGQGEEFLET VGEAAGNVAR HFDVLDLVAP

201 DGDFVGVEHQ NVGSHQNRIT EQTHFHTEIG VFLPVFRIGL NGGFVGVGAV

251 HQTLGGDAGQ NPVQLHHFGN VALAVEGGAL GVESAGKPSG GNGLGGLVNH

301 LLLVAFDDAV VIGEEEEGFG IGVLRRADGG ADGADVVAQM RGAGGGYAGQ

351 NSFFAHKNVL TAAMPSEREK DAPIIPDLPH TSSRQQTFPY *
```

The following partial DNA sequence was identified in *N. meningitidis* <SEQ ID 2701>:

```
m900.seq
   1 ATGCCGTCTG AAACGCGGCA GGCGGAGGTT CGGACGGCAT CGGGTTCATT

51 TCAACGGGCG GATGcCGACC GCATCgG.TA CTTTGTCCAA TAATTCGCGT

101 GCTTCTTTAC GCGCTTTCGC CGCGCCTGCC TGCAAAATCT CTTCGATTTG

151 CGAAGGGTCG GCGGTCAGCT CGTTGTAGCG TTCGCGCGGT TCGGCGAGTT

201 CGGCGTTGAT TTTCGCCGCC AAAAGTTTTT TGGCTTCACC CCACGCCAAG

251 CCGTCGGCAA GCATTTTCGT AAATTCCACC GTTTCAGACG GCGTGGAGAA

301 GGCTTTGTAG ATTTCAAACA ATGGGCTTTC GTCGGGCTGT TTCGGCTCGC

351 CCGGCTCTTT CATATTGGTG ATGATTTTGT TGACCGATTT TTGGGTTTTT 401 tTGTCGTTTT CCCAAAGCGG AATGGTGTTG CCGTAGGATT TGGACATTTT

451 GCGTCCGTCC AAACCGACCA AGAGTTCGAC GTTTTCATCG ATTTTCACTT

501 CGGGCAGGGT GAAGAGTTCC CGGAAGCGGT GGTTGAAGCG GCCGGCGATG

551 TCGCGCGCCA TTTCGACGTG TTGGATTTGG TCGCGCCCGA CgGGCaCTTC
```

```
 601 GTTGGCGTTG AACATCAGAA TATCGGCAGT CATCAGAATC GGATAACTGA

651 ACAAACCCAT TTCCACACCG AAATCAGGGT CTTCCTGCCC GTTTTCTGCA

701 TTTGCCTGCA CGGCGGCTTT GTAGGCATGG GCGCGGTTCA TCAAACCCTT

751 GGCAGTGATG CAGGTCAGAA TCCAGTTCAA TTCCATCACT TCgGGAGTGT

801 CGCTTTGGCG GTAGAAGGTG GTGCGCTCGG GGTCGAGTCC GCAgGCAAGC

851 CAAGTGGCGG CAACGGCTTG GGTGGATTGG TGAATCATCT CCGGCTCGTG

901 GCATTTGATG ATACCGTGGT AATCGGCGAG GAAGAGGAAG GATTCGGTAT

951 CGAGGTTTTG CGCCGCGCGG ACGGCGGGGC GGATGGCGCC GACGTAGTTG

1001 CCCAGATGCG GGATGCCGGT GGTGGTTACG CCGGTCAGAA CTCGTTTTTT

1051 GCTCATAAAA ATGTCCTTGC GGCATCAATG CCGTCTGAAA GGGAAAAAGA

1101 TGTGCCGATT ATACCCGATT TGCCACCTAC ATCCAGCCGA CAACAGACTT

1151 TTCCATATTA A
```

This corresponds to the amino acid sequence <SEQ ID 2702; ORF 900>:

```
m900.pep
   1 MPSETRQAEV RTASGSFQRA DADRIXYFVQ *FACFFTRFR RACLQNLFDL

51 RRVGGQLVVA FARFGEFGVD FRRQKFFGFT PRQAVGKHFR KFHRFRRRGE

101 GFVDFKQWAF VGLFRLARLF HIGDDFVDRF LGFFVVFPKR NGVAVGFGHF

151 ASVQTDQEFD VFIDFHFGQG EEFPEAVVEA AGDVARHFDV LDLVAPDGHF

201 VGVEHQNIGS HQNRITEQTH FHTEIRVFLP VFCICLHGGF VGMGAVHQTL

251 GSDAGQNPVQ FHHFGSVALA VEGGALGVES AGKPSGGNGL GGLVNHLRLV

301 AFDDTVVIGE EEEGFGIEVL RRADGGADGA DVVAQMRDAG GGYAGQNSFF

351 AHKNVLAASM PSEREKDVPI IPDLPPTSSR QQTFPY*
```

Computer analysis of this amino acid sequence gave the following results:
Homology with a Predicted ORF from *N. gonorrhoeae*
ORF 900 shows 87.0% identity over a 386 aa overlap with a predicted ORF (ORF 900.ng) from *N. gonorrhoeae*:

```
   m900/g900

10         20         30         40         50
       m900.pep    MPSETRQAEVRTASGSFQRADADRIGYFVQXFACFFTRFRRACLQNLFDLRRVGGQ
                   |||||  ||||||||  |  ||||||||||:||:|  ||  ||:|| |||||||||||: ||
       g900       MPSEMPSETWQAEVRTALGLFQRADADRIAYFIQQFARFFARFLRACLQNLFDLRRIRGQ
                        10         20         30         40         50         60

60         70         80         90        100        110
       m900.pep   LVVAFARFGEFGVDFRRQKFFGFTPRQAVGKHFRKFHRFRRRGEGFVDFKQWAFVGLFRL
                   ||||:| :||||||||| ::| |||||||:||| ||||||||||||| ||:||| ||||||
       g900       CVVAFAQFCQFGVDFRRRKFFRLAPSQAVGKHLRKFRRFRRRGEGFIDFKQRAGVGLFRL
                        70         80         90        100        110        120

120        130        140        150        160        170
       m900.pep   ARLFHIGDDFVDRFLGFFVVFPKRNGVAVGFGHFASVQTDQEFDVFIDFHFGQGEEFPEA
                   ||||:|:||||||||||||||||||||||:||||||||||||||||||:|||||||| |:
       g900       ARLFHVGNDFVDRFLGFFVVFPKRNGIAVGFGHFASVQTDQEFDVFVDFHFGQGEEFLET
                       130        140        150        160        170        180

180        190        200        210        220        230
       m900.pep   VVEAAGDVARHFDVLDLVAPDGHFVGVEHQNIGSHQNRITEQTHFHTEIRVFLPVFCICL
                   | ||||:||||||||||||||||||| |||||||:|||||||||||||||||||| | |
       g900       VGEAAGNVARHFDVLDLVAPDGDFVGVEHQNVGSHQNRITEQTHFHTEIGVFLPVFRIGL
                       190        200        210        220        230        240
```

-continued

```
              240        250        260        270        280        290
m900.pep  HGGFVGMGAVHQTLGSDAGQNPVQFHHFGSVALAVEGGALGVESAGKPSGGNGLGGLVNH
          :|||||:||||||||:|||||||:||||:|||||||||||||||||||||||||||||||
g900      NGGFVGVGAVHQTLGGDAGQNPVQLHHFGNVALAVEGGALGVESAGKPSGGNGLGGLVNH
              250        260        270        280        290        300

300        310        320        330        340        350
m900.pep  LRLVAFDDTVVIGEEEEGFGIEVLRRADGGADGADVVAQMRDAGGGYAGQNSFFAHKNVL
          | |||||||:|||||||||||| |||||||||||||||||||||| ||||||||||||||
g900      LLLVAFDDAVVIGEEEEGFGIGVLRRADGGADGADVVAQMRGAGGGYAGQNSFFAHKNVL
              310        320        330        340        350        360

360        370        380
m900.pep  AASMPSEREKDVPIIPDLPPTSSRQQTFPYX
          :|:|||||||:|||||||| ||||||||||
g900      TAAMPSEREKDAPIIPDLPHTSSRQQTFPYX
              370        380        390
```

The following partial DNA sequence was identified in *N. meningitidis* <SEQ ID 2703>:

```
a900.seq (partial)
    1 GAGGTTCGGA CGGCATTGGG TTTATTTCAA CGGGCGGATA CCGACCGCAT

51 CACGTACTTT GCCCAATAAT TCGCGTGCTT CTTTACGCGC TTTTTGCGCG

101 CCTGCCTGCA AAATCTCTTC GATTTGCGAA GGGTCGGCGG TCAGCTCGTT

151 GTAGCGTTCG CGCGGTTCGG CGAGTTCGGC GTTGATTTTC GCCGCCAAAA

201 GTTTTTTTGC CTCGCCCCAA GCCAAGCCGT CGGCAAGCAT TTTCGTAAAT

251 TCTGCCGTTT CAGACGGCGT GGAGAAAGCT TTGTAGATTT CAAACAGAGG

301 GCTTTCGTCG GCTTCTTCG GCTCGCCCGG CTCTTTCATA TTGGTGATGA

351 TTTTGTTGAC CGATTTTTGG GTTTTTTTGT CGTTTTCCCA AAGCGGAATG

401 GTGTTGCCGT AGGATTTGGA CATTTTGCGT CCGTCCAAAC CAACCAAGAG

451 TTCGACGTTT TCGTCGATTT TCACTTCGGG CAGTGTGAAG AGTTCCCGGA

501 AGCGGTGGTT GAAGCGGCCG GCAATATCGC GTGCCATTTC AACGTGTTGG

551 ATTTGGTCGC GACCGACTGG AACTTCATGG GCATTGAACA TGAGAATGTC

601 GGCAGTCATG AGGATAGGGT AGCTGTACAA ACCCATTTCC ACGCCGAAAT

651 CGGGGTCTTC CTGCCCGTTT TCCGCATTTG CCTGCACGGC GGCTTTGTAG

701 GCGTGGGCGC GGTTCATCAA ACCCTTGGCG GTGATGCAGG TCAGAATCCA

751 GTTCAATTCC ATCACTTCGG GAATGTCGCT TTGACGGTAG AAGGTGGTGC

801 GCTCGGGGTC GAGTCCGCAG GCAAGCCAAG TGGCGGCAAC GGCTTGGGTG

851 GATTGGTGAA TCATCTCCGG CTCGTGGCAT TTGATGATAC CGTGGTAATC

901 GGCGAGGAAG AGGAAGGATT CGGTATCAGG GTTTTGCGCC GCGCGGACGG

951 CGGGGCGGAT AGCACCGACG TAGTTGCCCA GATGCGGGAT GCCGGTGGTG

1001 GTTACGCCGG TCAGAACTCG TTTTTTGCTC ATAAAAATGT CCTTGCGGCA

1051 TCAATGCCGT CTGAAAGGGA AAAAGATGCG CCGATTATAC CCGATTTGCC

1101 ACCTACATCC AGCCGACAAC AGACTTTTCC ATATTAA
```

This corresponds to the amino acid sequence <SEQ ID 2704; ORF 900.a>:

```
a900.pep (partial)
    1 EVRTALGLFQ RADTDRITYF AQ*FACFFTR FLRACLQNLF DLRRVGGQLV

51 VAFARFGEFG VDFRRQKFFC LAPSQAVGKH FRKFCRFRRR GESFVDFKQR

101 AFVGLLRLAR LFHIGDDFVD RFLGFFVVFP KRNGVAVGFG HFASVQTNQE
```

-continued

```
151 FDVFVDFHFG QCEEFPEAVV EAAGNIACHF NVLDLVATDW NFMGIEHENV

201 GSHEDRVAVQ THFHAEIGVF LPVFRICLHG GFVGVGAVHQ TLGGDAGQNP

251 VQFHHFGNVA LTVEGGALGV ESAGKPSGGN GLGGLVNHLR LVAFDDTVVI

301 GEEEEGFGIR VLRRADGGAD STDVVAQMRD AGGGYAGQNS FFAHKNVLAA

351 SMPSEREKDA PIIPDLPPTS SRQQTFPY*
``` m900/a900 88.4% identity in 378 aa overlap

```
                       10        20        30        40        50        60
   m900.pep   MPSETRQAEVRTASGSFQRADADRIXYFVQXFACFFTRFRRACLQNLFDLRRVGGQLVVA
                  |||||  |  |||||:|||:||:||||||||||| |||||||||||||||||||
       a900         EVRTALGLFQRADTDRITYFAQXFACFFTRFLRACLQNLFDLRRVGGQLVVA
                            10        20        30        40        50
                       70        80        90       100       110       120
   m900.pep   FARFGEFGVDFRRQKFFGTPRQAVGKHFRKFHRFRRRGEGFVDFKQWAFVGLFRLARLF
              ||||||||||||||||||::: |||||||||||||:||||||||||:||||| |||||
       a900   FARFGEFGVDFRRQKFFCLAPSQAVGKHFRKFCRFRRRGESFVDFKQRAFVGLLRLARLF
                       60        70        80        90       100       110
                      130       140       150       160       170       180
   m900.pep   HIGDDFVDRFLGFFVVFPKRNGVAVGFGHFASVQTDQEFDVFIDFHFGQEEFPEAVVEA
              |||||||||||||||||||||||||||||||||||||:||||||:||||| ||||||||
       a900   HIGDDFVDRFLGFFVVFPKRNGVAVGFGHFASVQTNQEFDVFVDFHFGQCEEFPEAVVEA
                      120       130       140       150       160       170
                      190       200       210       220       230       240
   m900.pep   AGDVARHFDVLDLVAPDGHFVGVEHQNIGSHQNRITEQTHFHTEIRVFLPVFCICLHGGF
              ||::| ||:|||||| | :|:|:||:|:|||::|:: |||||:|| |||||| ||||||
       a900   AGNIACHFNVLDLVATDWNFMGIEHENVGSHEDRVAVQTHFHAEIGVFLPVFRICLHGGF
                      180       190       200       210       220       230
                      250       260       270       280       290       300
   m900.pep   VGMGAVHQTLGSDAGQNPVQFHHFGSVALAVEGGALGVESAGKPSGGNGLGGLVNHLRLV
              ||:||||||||:|||||||||||||:||| :||||||||||||||||||||||||||||
       a900   VGVGAVHQTLGGDAGQNPVQFHHFGNVALTVEGGALGVESAGKPSGGNGLGGLVNHLRLV
                      240       250       260       270       280       290
                      310       320       330       340       350       360
   m900.pep   AFDDTVVIGEEEEGFGIEVLRRADGGADGADVVAQMRDAGGGYAGQNSFFAHKNVLAASM
              |||||||||||||||||:|||||||||::||||||||||||||||||||||||||||||
       a900   AFDDTVVIGEEEEGFGIRVLRRADGGADSTDVVAQMRDAGGGYAGQNSFFAHKNVLAASM
                      300       310       320       330       340       350
                      370       380
   m900.pep   PSEREKDVPIIPDLPPTSSRQQTFPYX
              |||||||:|||||||||||||||||||
       a900   PSEREKDAPIIPDLPPTSSRQQTFPYX
                      360       370
   g901.seq not found yet
   g901.pep not found yet
```

The following partial DNA sequence was identified in *N. meningitidis* <SEQ ID 2705>:

```
m901.seq
   1 ATGCCCGATT TTTCGATGTC CAATTTGGCC GTTGCCTTTT CCATCACATT

51 GGCTGCCGGT TTGTTTACCG TATTAkGyAG TGGCTTGGTG ATGTTTTCCA

101 AAACGCCCAA TCCGCGTGTG TTGTCGTTTG GTTTGGCGTT TGCCGGCGGT

151 GCGATGGTAT ATGTTTCCCT GACGGAGATT TTCAGTAAGT CCAGCGAGGC

201 GTTCGCTGAA ATTTATGATA AAGACCACGC GTTTGCGGCG GCGACCATGG

251 CATTTTTGGC CGGGATGGGC GGCATTGCGC TGATTGACCG TCTGGTGCCG

301 AACCCGCATG AAACTTTAGA CGCGCAAGAC CCGTCGTTTC AAGAAAGCAA
```

```
351 ACGCCGCCAT ATCGCGCGAG TCGGCATGAT GGCGGCGTTT GCGATTACTG

401 CGCACAATTT CCCCGAAGGC TTGGCGACGT TTTTTGCCAC ATTGGAAAAT

451 CCAGCAGTCG GGATGCCTTT GGCCTTGGCG ATTGCCATCC ATAATATTCC

501 GGAGGGCATT TCCATCGCCG CGCCGGTTTA TTTTGCCACC CGCAGCCGTA

551 AGAAAACGGT GTGGGCGTGT CTGCTATCCG GCTTGGCCGA GCCGTTGGGG

601 GCGGCTTTGG GCTATTTGGT TTTGCAGCCG TTTTTGTCGC CTGCCGTGTT

651 TGGTTCGGTA TTCGGCGTGA TAGCCGGTGT GATGGTGTTT TTGGCGTTGG

701 ACGAGCTGnt GCCGGCTGCC AAACGCTATT CAGACGGCCA TGAAACCGTT

751 TACGGCCTGA CAACGGGTAT GGCGGTGATT GCCGTCAGCC TGGTATTGTT

801 CCATTTTTAA
```

This corresponds to the amino acid sequence <SEQ ID 2706; ORF 901>:

```
m901.pep
   1 MPDFSMSNLA VAFSITLAAG LFTVLXSGLV MFSKTPNPRV LSFGLAFAGG

51 AMVYVSLTEI FSKSSEAFAE IYDKDHAFAA ATMAFLAGMG GIALIDRLVP

101 NPHETLDAQD PSFQESKRRH IARVGMMAAF AITAHNFPEG LATFFATLEN

151 PAVGMPLALA IAIHNIPEGI SIAAPVYFAT RSRKKTVWAC LLSGLAEPLG

201 AALGYLVLQP FLSPAVFGSV FGVIAGVMVF LALDELXPAA KRYSDGHETV

251 YGLTTGMAVI AVSLVLFHF*
```

The following partial DNA sequence was identified in *N. meningitidis* <SEQ ID 2707>:

```
a901.seq
   1 ATGCCCGATT TTTCGATGTC CAATTTGGCC GTTGCCTTTT CCATTACGTT

51 GGCTGCCGGT TTGTTTACCG TATTAGGCAG CGGCTTGGTG ATGTTTTCCA

101 AAACGCCCAA TCCGCGCGTG TTGTCGTTTG GTTTGGCATT TGCCGGCGGT

151 GCGATGGTGT ATGTTTCCCT GACGGAGATT TTCAGTAAGT CCAGCGAGGC

201 GTTCGCTGAA ATTTATGATA AAGACCACGC GTTTGCGGCG GCGACCATGG

251 CATTTTTGGC AGGGATGGGC GGCATTGCGC TGATTGACCG TCTGGTGCCG

301 AACCCGCATG AAACTTTAGA CGCGCAAGAC CCGTCGTTTC AAGAAAGCAA

351 ACGCCGCCAT ATCGCGCGAG TCGGCATGAT GGCGGCGTTT GCGATTACTG

401 CGCACAATTT CCCCGAAGGC TTGGCGACGT TTTTTGCCAC ATTGGAAAAT

451 CCAGCAGTCG GGATGCCTTT GGCCTTGGCG ATTGCCATCC ATAATATTCC

501 GGAGGGCATT TCCATCGCCG CGCCGGTTTA TTTTGCCACC CGCAGCCGTA

551 AGAAAACGGT GTGGGCGTGT CTGCTATCCG GCTTGGCCGA GCCGTTGGGG

601 GCGGCTTTGG GCTATTTGGT TTTGCAGCCG TTTTTGTCGC CTGCCGTGTT

651 TGGTTCGGTA TTCGGCGTGA TAGCCGGTGT GATGGTGTTT TTGGCGTTGG

701 ACGAGCTGCT GCCGGCTGCC AAACGCTATT CAGACGGCCA TGAAACCGTT

751 TACGGCCTGA CAATGGGCAT GGCGGTGATT GCCGTCAGCC TGGTATTGTT

801 CCATTTTTAA
```

This corresponds to the amino acid sequence <SEQ ID 2708; ORF 901.a>:

```
a901.pep
  1 MPDFSMSNLA VAFSITLAAG LFTVLGSGLV MFSKTPNPRV LSFGLAFAGG

51 AMVYVSLTEI FSKSSEAFAE IYDKDHAFAA ATMAFLAGMG GIALIDRLVP

101 NPHETLDAQD PSFQESKRRH IARVGMMAAF AITAHNFPEG LATFFATLEN

151 PAVGMPLALA IAIHNIPEGI SIAAPVYFAT RSRKKTVWAC LLSGLAEPLG

201 AALGYLVLQP FLSPAVFGSV FGVIAGVMVF LALDELLPAA KRYSDGHETV

251 YGLTMGMAVI AVSLVLFHF*
``` m901/a901 98.9% identity in 269 aa overlap

```
                     10         20         30         40         50         60
    m901.pep  MPDFSMSNLAVAFSITLAAGLFTVLXSGLVMFSKTPNPRVLSFGLAFAGGAMVYVSLTEI
              |||||||||||||||||||||||||| ||||||||||||||||||||||||||||||||
    a901      MPDFSMSNLAVAFSITLAAGLFTVLGSGLVMFSKTPNPRVLSFGLAFAGGAMVYVSLTEI
                     10         20         30         40         50         60

70         80         90        100        110        120
    m901.pep  FSKSSEAFAEIYDKDHAFAAATMAFLAGMGGIALIDRLVPNPHETLDAQDPSFQESKRRH
              ||||||||||||||||||||||||||||||||||||||||||||||||||||||||||||
    a901      FSKSSEAFAEIYDKDHAFAAATMAFLAGMGGIALIDRLVPNPHETLDAQDPSFQESKRRH
                     70         80         90        100        110        120

130        140        150        160        170        180
    m901.pep  IARVGMMAAFAITAHNFPEGLATFFATLENPAVGMPLALAIAIHNIPEGISIAAPVYFAT
              ||||||||||||||||||||||||||||||||||||||||||||||||||||||||||||
    a901      IARVGMMAAFAITAHNFPEGLATFFATLENPAVGMPLALAIAIHNIPEGISIAAPVYFAT
                    130        140        150        160        170        180

190        200        210        220        230        240
    m901.pep  RSRKKTVWACLLSGLAEPLGAALGYLVLQPFLSPAVFGSVFGVIAGVMVFLALDELXPAA
              ||||||||||||||||||||||||||||||||||||||||||||||||||||||||| ||
    a901      RSRKKTVWACLLSGLAEPLGAALGYLVLQPFLSPAVFGSVFGVIAGVMVFLALDELLPAA
                    190        200        210        220        230        240

250        260        270
    m901.pep  KRYSDGHETVYGLTTGMAVIAVSLVLFHFX
              |||||||||||||| ||||||||||||||
    a901      KRYSDGHETVYGLTMGMAVIAVSLVLFHFX
                    250        260        270
```

The following partial DNA sequence was identified in *N. gonorrhoeae* <SEQ ID 2709>:

```
g902.seq
  1 ATGCCGTCCG AACCCGAACG GCGGCATGGC AATACTGCCC TACCCTTCCC

51 GATAGCCGCA CGCCCAACGG TCGGTTTTTC CGGCAAGCCT TCAAGATAA

101 CCGGCAAGTG TGTCGTATTG CGCCGCCGCA TTGTCCAAGC GGTTGATTTC

151 ACGCCGCGCC TGTTCGCCGT CGGGCATTTC GCCGATGTAC CAGCCTATGT

201 GTTTGCGTGC GATGCGCACA CCGACGGTCT CACCATAAAA CGCGTGCATG

251 GCGCGGATGT GGTTCAAAAT GGCGGCTCTG CATTCTGCCA AACTCAAGGC

301 AGGCGGTAAA ACGCCGTGTT CGGCATAATG CTTCAAATCG CGGAAAAACC

351 ACGGCCTGCC TTGCGCGCCG CGCCCTATCA TGATGCCGTC GGCGGCGGTT

401 TGTTTGAGGA cggCGGCGGC TTTTTgcggc GAagtGATGT CGCCGTTGac 451 cCaggCCGGG ATGTTCAGAc ggCTTTTGGT CTCGGcgatg agttCGTAAC 501 gcGCCTCGCC TTTGTACATT TGCGTGcgcG CGcgcccgtg aacggcaaGg 551 gcggcaatgc cgcaatcttc ggcgattttg gcgacggcgG gcaggttttg 601 atcgtcgtcg tgccaaccca AacggGTTTT GaggGTAACG GGTAcgcCCG 651 CCGCCTTgac caccgcctcc aAAatggcGg caaccagcgg CTCGTCCTGC
```

```
 701  ATCagcGCGC TACCGGCTTG GACGTTGCAC ACTTTCttgg cgggGCAGCC
 751  CATAttgATG TCGATGACCT GCGCCCCGAG TCCGACGTTg taacgcgccg
 801  catCCGCCAT CtgttcggGG TCGCTGCCGG CAATCTGCAC GGCAACGATG
 851  CCGccttcat cggcaAAAtc actgcggtgc aGGGTTTTTC CGGTATTCCT
 901  GAGCGTCGGA TCGCTGGCCA GCATTTCGCA CACCGCCCAA CCTGCGCCAA
 951  ACGCCCGACA GAGGCGGCGG AAGGGTTTGT CGGCAATGCC CGCCATCGGC
1001  GCAAGTGCGA TGGGGTTGTC GATAAAATAA CCGCCGATGT GCATAATGGG
1051  CCCGCGTTTC AAAAAAGTGC GCCATTGTAC ATTTTTTAA
                                                      15
```

This corresponds to the amino acid sequence <SEQ ID 2710; ORF 902.ng>:

```
g902.pep
  1 MPSEPERRHG NTALPFPIAA RPTVGFSGKP FKITGKCVVL RRRIVQAVDF
 51 TPRLFAVGHF ADVPAYVFAC DAHTDGLTIK RVHGADVVQN GGSAFCQTQG
101 RR*NAVFGIM LQIAEKPRPA LRAAPYHDAV GGGLFEDGGG FLRRSDVAVD
151 PGRDVQTAFG LGDEFVTRLA FVHLRARAPV NGKGGNAAIF GDFGDGGQVL
201 IVVVPTQTGF EGNGYARRLD HRLQNGGNQR LVLHQRATGL DVAHFLGGAA
251 HIDVDDLRPE SDVVTRRIRH LFGVAAGNLH GNDAAFIGKI TAVQGFSGIP
301 ERRIAGQHFA HRPTCAKRPT EAAEGFVGNA RHRRKCDGVV DKITADVHNG
351 PAFQKSAPLY IF*
```

The following partial DNA sequence was identified in *N. meningitidis* <SEQ ID 2711>:

```
m902.seq
  1  TTGCACTTTC AAAGGATAAT CAAGTGTTCA GAAGGCATTT GGGCGGTAGG
 51  CGCACGCCCA ACTGTCGGTT TTTTCGGCAA GTCTTTCAAG ATAACCTGCA
101  AGCATGTCGT ATTGCGCCGC CGCACTGTCC AAGCGGTTGA TTTCACGACG
151  TgTCTgTTCG CCGTcGGGCA TTTCGTCGAT GTACCAGCCT ATGTGTTTGC
201  GTGCGATGCG CACACCGGCG TGTCGCCGT AAAACGCGTG TATGGCGCGG
251  ATGTGGTTCA AAATAGCGGC GGCGCATTCT GCCAAACTCA AGGCAGGCGG
301  CAAAACACCG TGTTCGGCAT AATGTTTCAA ATCGCGGAAG AACCACGGCC
351  TGCCTTGCGC GCCGCGCCCT ATCATAATGC CGTCGGCGGC GGTTTGTTTG
401  AGGACGGCTT GGGCTTTTTG CGGCGAAGTA ATGTCGCCGT TGACCCAGAC
451  CGGGATGTTC AGACGGCATT TGGTTTCGGC GATGAGTTCG TAACGCGCTT
501  CGCCTTTGTA CATTTGCGTA CGCGTGCGTC CGTGGACGGC AAGGGCGGCG
551  ATGCCGCAAT CTTCGGCGAT TTTGGCGATG ACGGGCAGGT TTTGATGGTC
601  GTCGTGCCAA CCCAAACGGG TTTTGAGGGT AACGGGTACG CCTGCCGCAC
651  GGACGACGGC TTCCAAAATG GCGGCAACCA GCGGCTCGTT CTGCATCAGC
701  GCGCTACCGG CTTGGACATT GCAGACTTTT TTAGCGGGAC AGCCCATGTT
751  GATGTCGATA AGCTGCGCCC CAAGGCTGAC GTTGTAACGC GCGGCATCCG
801  CCATCTGCTG CGGATCGCTT CCGGCAATCT GCACGGCAAC AATGCCGCCT
851  TCATCGGCAA AATCGCTGCG GTGCAAGGTT TTTCTAGTAT TTCTGAGCGT
```

```
 901 CGGGTCGCTG GTCAGCATTT CGCACACCGC CCAACCTGCG CCAAAATCTC

951 GGCAAAGTCG GCGGAACGGT TTGTCGGTAA TGCCCGCCAT CGGcGCaAGT

1001 GCGATGGGGT TGTCGATAAA ATAGCCGCCG ATGTGCATAA TGGATCCGCG

1051 TTTCAAAAAA GTACGCCATT GTACATTTTT TAA
```

This corresponds to the amino acid sequence <SEQ ID 2712; ORF 902>:

```
m902.pep
   1 LHFQRIIKCS EGIWAVGARP TVGFFGKSFK ITCKHVVLRR RTVQAVDFTT

51 CLFAVGHFVD VPAYVFACDA HTGGVAVKRV YGADVVQNSG GAFCQTQGRR

101 QNTVFGIMFQ IAEEPRPALR AAPYHNAVGG GLFEDGLGFL RRSNVAVDPD

151 RDVQTAFGFG DEFVTRFAFV HLRTRASVDG KGGDAAIFGD FGDDGQVLMV

201 VVPTQTGFEG NGYACRTDDG FQNGGNQRLV LHQRATGLDI ADFFSGTAHV

251 DVDKLRPKAD VVTRGIRHLL RIASGNLHGN NAAFIGKIAA VQGFSSISER

301 RVAGQHFAHR PTCAKISAKS AERFVGNARH RRKCDGVVDK IAADVHNGSA

351 FQKSTPLYIF *
```

Computer analysis of this amino acid sequence gave the following results:

Homology with a Predicted ORF from *N. gonorrhoeae*

ORF 902 shows 80.9% identity over a 345 aa overlap with a predicted ORF (ORF 902.ng) from *N. gonorrhoeae*:

```
m902/g902

10         20         30         40         50
   m902.pep    LHFQRIIKCSEGIWAVGARPTVGFFGKSFKITCKHVVLRRRTVQAVDFTTCLFAVGHF
                 ::|||||||  || |||| ||||||| ||||||||  |||||||
   g902        MPSEPERRHGNTALPFPIAARPTVGFSGKPFKITGKCVVLRRRIVQAVDFTPRLFAVGHF
                    10         20         30         40         50         60

60         70         80         90        100        110
   m902.pep    VDVPAYVFACDAHTGGVAVKRVYGADVVQNSGGAFCQTQGRRQNTVFGIMFQIAEEPRPA
                :||||||||||||| |:::|||:|||||||||:|:|||||||||| :||||||:||||:||||
   g902        ADVPAYVFACDAHTDGLTIKRVHGADVVQNGGSAFCQTQGRRXNAVFGIMLQIAEKPRPA
                    70         80         90        100        110        120

120        130        140        150        160        170
   m902.pep    LRAAPYHNAVGGGLFEDGLGFLRRSNVAVDPDRDVQTAFGFGDEFVTRFAFVHLRTRASV
                |||||||:|||||||||||:|||| ||||||:|||||  ||||||||:|||||||:|||||:|| |
   g902        LRAAPYHDAVGGGLFEDGGGFLRRSDVAVDPGRDVQTAFGLGDEFVTRLAFVHLRARAPV
                   130        140        150        160        170        180

180        190        200        210        220        230
   m902.pep    DGKGGDAAIFGDFGDDGQVLMVVVPTQTGFEGNGYACRTDDGFQNGGNQRLVLHQRATGL
                :||||:|||||||||| ||||:||||||||||||||||| | | :||||||||||||||||||
   g902        NGKGGNAAIFGDFGDGGQVLIVVVPTQTGFEGNGYARRLDHRLQGGNQRLVLHQRATGL
                        190        200        210        220        230        240

240        250        260        270        280        290
   m902.pep    DIADFFSGTAHVDVDKLRPKADVVTRGIRHLLRIASGNLHGNNAAFIGKIAAVQGFSSIS
                |:|  |::|:||:|||  |||::|||||  ||||:  :|:||||||:||||||||:||||||:|
   g902        DVAHFLGGAAHIDVDDLRPESDVVTRRIRHLFGVAAGNLHGNDAAFIGKITAVQGFSGIP
                        250        260        270        280        290        300

300        310        320        330        340        350
   m902.pep    ERRVAGQHFAHRPTCAKISAKSAERFVGNARHRRKCDGVVDKIAADVHNGSAFQKSTPLY
                |||:|||||||||||   :::||   |||||||||||||||||||||:||||||    |||||:|||
   g902        ERRIAGQHFAHRPTCAKRPTEAAEGFVGNARHRRKCDGVVDKITADVHNGPAFQKSAPLY
                        310        320        330        340        350        360
```

```
                360
m902.pep   IFX
           |||
g902       IFX
```

The following partial DNA sequence was identified in *N. meningitidis* <SEQ ID 2713>:

```
a902.seq
    1 TTGCACTTTC AAAGGATAAT CAAGTGTTCA GAAGGCATTT GGGCGGTAGG

51 CGCACGCCCA ACTGTCGGTT TTTTCGGCAA GTCTTTCAAG ATAACCTGCA

101 AACATGTCGT ATTGCGCCGC CGCACTGTCC AAGCGGTTGA TTTCACGACG

151 TGTCTGTTCG CCGTCGGGCA TTTCGTCGAT GTACCAGCCT ATGTGTTTGC

201 GTGCGATGCG CACACCGGCG GTGTCGCCGT AAAACGCGTG CATGGCTCGG

251 ATGTGGTTCA AAATAGTGGC GGTACATTCT GCCAAACTCA AGGCAGGCGG

301 TAAAACACCG TGTTCGGCGT AATGTTTCAA ATCGCGGAAG AACCACGGTC

351 TGCCTTGCGC GCCGCGCCCT ATCATAATGC CGTCTGCGGC GGTTTGTTTG

401 AGGACGGCTT GGGCTTTTTG CGGCGAGGTA ATGTCGCCGT TGACCCAGAC

451 CGGGATGTTC AGACGGCATT TGGTTTCGGC AATCAGGTCG TAAGCCGCTT

501 CGCCTTTGTA CATTTGCGTG CGCGTGCGTC CGTGGACGGC AAGGGCGGCA

551 ATGCCGCAAT CTTCGGCGAT TTTGGCGATG ACGGGCAGGT TTTGATGGTC

601 GTCGTGCCAA CCCAAACGGG TTTTGAGGGT AACGGGTACG CCCGCCGCTT

651 TGACCACCGC CTCCAAAATG GCGGCAACCA GCGGCTCGTT CTGCATCAGC

701 GCGCTACCGG CTTGGACATT GCAGACTTTT TTAGCGGGAC AGCCCATGTT

751 GATGTCGATA AGCTGCGCCC CAAGGCTGAC GTTGTAACGC GCGGCATCCG

801 CCATCTGCTG CGGATCGCTT CCGGCAATCT GCACGGCAAC AATGCCGCCT

851 TCATCGGCAA AATCGCTGCG GTGCAAGGTT TTTCTAGTAT TTCTGAGCGT

901 CGGGTCGCTG GTCAGCATTT CGCACACCGC CCAACCTGCG CCAAAATCTC

951 GGCAAAGTCG GCGGAACGGT TTGTCGGTAA TGCCCGCCAT CGGCGCAAGT

1001 GCGATGGGGT TGTCGATAAA ATAGCCGCCG ATGTGCATAA TGGATCCGCG

1051 TTTCAAAAAA GTACGCCATT GTACATTTTT TAA
```

This corresponds to the amino acid sequence <SEQ ID 2714; ORF 902.a>:

```
a902.pep
    1 LHFQRIIKCS EGIWAVGARP TVGFFGKSFK ITCKHVVLRR RTVQAVDFTT

51 CLFAVGHFVD VPAYVFACDA HTGGVAVKRV HGSDVVQNSG GTFCQTQGRR

101 *NTVFGVMFQ IAEEPRSALR AAPYHNAVCG GLFEDGLGFL RRGNVAVDPD

151 RDVQTAFGFG NQVVSRFAFV HLRARASVDG KGGNAAIFGD FGDDGQVLMV

201 VVPTQTGFEG NGYARRFDHR LQNGGNQRLV LHQRATGLDI ADFFSGTAHV

251 DVDKLRPKAD VVTRGIRHLL RIASGNLHGN NAAFIGKIAA VQGFSSISER

301 RVAGQHFAHR PTCAKISAKS AERFVGNARH RRKCDGVVDK IAADVHNGSA

351 FQKSTPLYIF *
``` m902/a902 94.7% identity in 360 aa overlap

```
                10         20         30         40         50         60
m902.pep   LHFQRIIKCSEGIWAVGARPTVGFFGKSFKITCKHVVLRRRTVQAVDFTTCLFAVGHFVD
           ||||||||||||||||||||||||||||||||||||||||||||||||||||||||||||
a902       LHFQRIIKCSEGIWAVGARPTVGFFGKSFKITCKHVVLRRRTVQAVDFTTCLFAVGHFVD
                10         20         30         40         50         60
                70         80         90        100        110        120
m902.pep   VPAYVFACDAHTGGVAVKRVYGADVVQNSGGAFCQTQGRRQNTVFGIMFQIAEEPRPALR
           ||||||||||||||||||||||| : ||||||||| ::|||||||| ||||| ||||||| |||
a902       VPAYVFACDAHTGGVAVKRVHGSDVVQNSGGTFCQTQGRRXNTVFGVMFQIAEEPRSALR
                70         80         90        100        110        120
               130        140        150        160        170        180
m902.pep   AAPYHNAVGGGLFEDGLGFLRRSNVAVDPDRDVQTAFGFGDEFVTRFAFVHLRTRASVDG
           |||||||||  |||||||||||||| :|||||||||||||||||:: | :|||||||:||||||
a902       AAPYHNAVCGGLFEDGLGFLRRGNVAVDPDRDVQTAFGFGNQVVSRFAFVHLRARASVDG
               130        140        150        160        170        180
               190        200        210        220        230        240
m902.pep   KGGDAAIFGDFGDDGQVLMVVVPTQTGFEGNGYACRTDDGFQNGGNQRLVLHQRATGLDI
           |||:|||||||||||||||||||||||||||||||| | |   :|||||||||||||||||
a902       KGGNAAIFGDFGDDGQVLMVVVPTQTGFEGNGYARRFDHRLQNGGNQRLVLHQRATGLDI
               190        200        210        220        230        240
               250        260        270        280        290        300
m902.pep   ADFFSGTAHVDVDKLRPKADVVTRGIRHLLRIASGNLHGNNAAFIGKIAAVQGFSSISER
           ||||||||||||||||||||||||||||||||||||||||||||||||||||||||||||
a902       ADFFSGTAHVDVDKLRPKADVVTRGIRHLLRIASGNLHGNNAAFIGKIAAVQGFSSISER
               250        260        270        280        290        300
               310        320        330        340        350        360
m902.pep   RVAGQHFAHRPTCAKISAKSAERFVGNARHRRKCDGVVDKIAADVHNGSAFQKSTPLYIF
           ||||||||||||||||||||||||||||||||||||||||||||||||||||||||||||
a902       RVAGQHFAHRPTCAKISAKSAERFVGNARHRRKCDGVVDKIAADVHNGSAFQKSTPLYIF
               310        320        330        340        350        360
m902.pep   X
           |
a902       X
```

The following partial DNA sequence was identified in *N. gonorrhoeae* <SEQ ID 2715>:

```
g903.seq
   1  ATGGCAACAC AGGTAGGCGG TGCAAattcG gatgaggCAA GCCCCTGCTT

51  TCCTATTTCT GAGGTGGAaT TGGTGGGTGA aGaaacggct aAATTCCGgt 101  tTGCGCTcaa ccaTGCCTTG tgccAAACAC ATTTTGtttc cGgcaagtgt 151  CTGcATGcgg gcgacatTAA TCAAAtcaTG TCCTTAGCAC AAAATGCTTT

201  GATCGGCAGG GGATATACCA CGACCCGTAT CTTGGCTGCG CCACAGGATT

251  TGAATAGTGG caaGCTTCAA TTAAccctga tgccggGCTA TCtgcgctcC

301  ATAcgaATCG atcggtccaa cgatgatcaa ACCCATgcAG GACGTATTGC

351  AGCATTCCAA AACAAATTTC CCACCCGCTC GAACGATCTG TTGAATCTGC

401  GTGATTTGGA ACAAGGACTG GAAAATCTCA ATGTCTCCC GACTGCGGAA

451  GCCGATCTCC AAATCgttcc cgtaGAGAGA GAACcAAACC AAAGTGATGT

501  CGTGGTGCAA TGGCGGTAAC GTCTGCTGCC CTACTGTGTG AGTGTGGGGA

551  TGGATAATTC GGGTAGTGAG GCGACAGGAA ATACCAAGG AAATATCACT

601  TTCTCTGCCG ACAATCCTTT TggactgAGT GATATGTTCT ATGTAAATTA

651  TGGACGTTCA ATTGGCGGTA CGcccgATGA GGAAAATTTT GACGGCCATC

701  GCAAAGAAGG CGGATCAAAC AATTACGCCG TACATTATTC AGCCCCTTTC

751  GGTAAATGGA CATGGGCATT CAATCACAAT GGCTACCGTT ACCATCAGGC
```

-continued

```
 801 GGTTTCCGGA TTATCGGAAG TCTATGACTA TAATGGAAAA AGTTACAACA
 851 CTGATTTCGG CTTCAACCGC CTGTTGTATC GTGATGCCAA ACGCAAAACC
 901 TATCTCAGTG TAAAACTGTG GACGAGGGAA ACAAAAAGTT ACATTGATGA
 951 TGCCGAACTG ACTGTACAAC GGCGTAAAAC CACAGGTTGG TTGGCAGAAC
1001 TTTCCCACAA AGGATATATC GGTCGCAGTA CGGCAGATTT AAGTTGAAA
1051 TATAAACACG GCACCGGCAT GAAAGATGCT CTGCGCGCGC CTGAAGAAGC
1101 CTTTGGCGAA GGCACGTCAC GTATGAAAAT TTGGACGGCA TCGGCTGATG
1151 TAAATACTCC TTTTCAAATC GGTAAACAGC TATTTGCCTA TGACACATCC
1201 GTTCATGCAC AATGGAACAA AACCCCGCTA ACATCGCAAG ACAAACTGGC
1251 TATCGGCGGA CACCACACCG TACGTGGCTT CGACGGTGAA ATGAGTTTGC
1301 CTGCCGAGCG GGGATGGTAT TGGCGCAACG ATTTGAGCTG GCAATTTAAA
1351 CCAGGCCATC AGCTTTATCT TGGGGCTGAT GTAGGACATG TTTCAGGACA
1401 ATCCGCCAAA TGGTTATCGG GCCAAACTCT AGCCGGCACA GCAATTGGGA
1451 TACGCGGGCA GATAAAGCTT GGCGGCAACC TGCATTACGA TATATTTACC
1501 GGCCGTGCAT TGAAAAAGCC cgaatatttt cAGACGAAGA Aatgggtaac
1551 ggggtTTCAG gtgggttatt cgTTTTGA
```

This corresponds to the amino acid sequence <SEQ ID 2716; ORF 903.ng>:

```
g903.pep
  1 MATQVGGANS DEASPCFPIS EVELVGEETA KFRFALNHAL CQTHFVSGKC
 51 LHAGDINQIM SLAQNALIGR GYTTTRILAA PQDLNSGKLQ LTLMPGYLRS
101 IRIDRSNDDQ THAGRIAAFQ NKFPTRSNDL LNLRDLEQGL ENLKCLPTAE
151 ADLQIVPVER EPNQSDVVVQ WRXRLLPYCV SVGMDNSGSE ATGKYQGNIT
201 FSADNPFGLS DMFYVNYGRS IGGTPDEENF DGHRKEGGSN NYAVHYSAPF
251 GKWTWAFNHN GYRYHQAVSG LSEVYDYNGK SYNTDFGFNR LLYRDAKRKT
301 YLSVKLWTRE TKSYIDDAEL TVQRRKTTGW LAELSHKGYI GRSTADFKLK
351 YKHGTGMKDA LRAPEEAFGE GTSRMKIWTA SADVNTPFQI GKQLFAYDTS
401 VHAQWNKTPL TSQDKLAIGG HHTVRGFDGE MSLPAERGWY WRNDLSWQFK
451 PGHQLYLGAD VGHVSGQSAK WLSGQTLAGT AIGIRGQIKL GGNLHYDIFT
501 GRALKKPEYF QTKKWVTGFQ VGYSF*
```

The following partial DNA sequence was identified in *N. meningitidis* <SEQ ID 2717>:

```
m903.seq
  1 ATGCAGCGTC AGCAGCACAT AGATGCTGAA TTGTTAACTG ATGCAAATGT
 51 CCGTTTCGAG CAACCATTGG AGAAGAACAA TTATGTCCTG AGTGAAGATG
101 AAACACCGTG TACTCGGGTA AATTACATTA GTTTAGATGA TAAGACGGTG
151 CGCAAATTTT CTTTTCTTCC TTCTGTGCTC ATGAAAGAAA CAGCTTTTAA
201 AACTGGGATG TGTTTAGGTT CCAATAATTT GAGCAGGCTA CAAAAAGCCG
251 CGCAACAGAT ACTGATCGTG CGTGGCTACC TCACTTCCCA AGCTATTATC
301 CAaCCACAGA ATATGGATTC GGGAATTCTG AAATTACGGG TATCAGCAGG
```

```
-continued
 351 CGAAATAGGG GATATCCGCT ATGAAGAAAA ACGGGATGGG AAGTCTGCCG

401 AGGGCAGTAT TAGTGCATTC AATAACAAAT TTCCCTTATA TAGGAACAAA

451 ATTCTCAATC TTCGCGATGT AGAGCAGGGC TTGGAAAACC TGCGTCGTTT

501 GCCGAGTGTT AAAACAGATA TTCAGATTAT ACCGTCCGAA GAAGAAGGCA

551 AAAGCGATTT ACAGATCAAA TGGCAGCAGA ATAAACCCAT ACGGTTCAGT

601 ATCGGTATAG ATGATGCGGG CGGCAAAACG ACCGGCAAAT ATCAAGGAAA

651 TGTCGCTTTA TCGTTCGATA ACCCTTTGGG CTTAAGCGAT TTGTTtTATG

701 TTTCATATGG ACGCGGTTTG GCGCACAAAA CGGACTTGAC TGATGCCACC

751 GGTACGGAAA CTGAAAGCGG ATCCAGAAGT TACAGCGTGC ATTATTCGGT

801 GCCCGTAAAA AAATGGCTGT TTTCTTTTAA TCACAATGGA CATCGTTACC

851 ACGAAGCAAC CGAAGGCTAT TCCGTCAATT ACGATTACAA CGGCAAACAA

901 TATCAGAGCA GCCTGGCCGC CGAGCGCATG CTTTGGCGTA ACAGACTTCA

951 TAAAACTTCA GTCGGAATGA AATTATGGAC ACGCCAAACC TATAAATACA

1001 TCGACGATGC CGAAATCGAA GTACAACGCC GCCGCTCTGC AGGCTGGGAA

1051 GCCGAATTGC GCCACCGTGC TTACCTCAAC CGTTGGCAGC TTGACGGCAA

1101 GTTGTCTTAC AAACGCGGGA CCGGCATGCG CCAAAGTATG CCTGCACCGG

1151 AAGAAAACGG CGGCGATATT CTTCCAGGTA CATCTCGTAT GAAAATCATT

1201 ACTGCCAGTT TGGACGCAGC CGCCCCATTT AyTTTAGGCA AACAGCAGTT

1251 TTTCTACGCA ACCGCCATTC AAGCTCAATG GAACAAAACG CCGTTGGTTG

1301 CCCAAGATAA ATTGTCAATC GGCAGCCGCT ACACCGTTCG CGGATTTGAT

1351 GGGGAGCAGA GTCTTTTCGG AGAGCGAGGT TTCTACTGGC AGAATACTTT

1401 AACTTGGTAT TTTCATCCGA ACCATCAGTT CTATCTCGGT GCGGACTATG

1451 GCCGCGTATC TGGCGAAAGT GCACAATATG TATCGGGCAA GCAGCTGATG

1501 GGTGCAGTGG TCGGCTTCAG AGGAGGGCAT AAAGTAGGCG GTATGTTTGC

1551 TTATGATCTG TTTGCCGGCA AGCCGCTTCA TAAACCCAAA GGCTTTCAGA

1601 CGACCAACAC CGTTTACGGC TTCAACTTGA ATTACAGTTT CTAA
```

This corresponds to the amino acid sequence <SEQ ID 2718; ORF 903>:

```
m903.pep
   1 MQRQQHIDAE LLTDANVRFE QPLEKNNYVL SEDETPCTRV NYISLDDKTV

51 RKFSFLPSVL MKETAFKTGM CLGSNNLSRL QKAAQQILIV RGYLTSQAII

101 QPQNMDSGIL KLRVSAGEIG DIRYEEKRDG KSAEGSISAF NNKFPLYRNK

151 ILNLRDVEQG LENLRRLPSV KTDIQIIPSE EEGKSDLQIK WQQNKPIRFS

201 IGIDDAGGKT TGKYQGNVAL SFDNPLGLSD LFYVSYGRGL AHKTDLTDAT

251 GTETESGSRS YSVHYSVPVK KWLFSFNHNG HRYHEATEGY SVNYDYNGKQ

301 YQSSLAAERM LWRNRLHKTS VGMKLWTRQT YKYIDDAEIE VQRRRSAGWE

351 AELRHRAYLN RWQLDGKLSY KRGTGMRQSM PAPEENGGDI LPGTSRMKII

401 TASLDAAAPF XLGKQQFFYA TAIQAQWNKT PLVAQDKLSI GSRYTVRGFD

451 GEQSLFGERG FYWQNTLTWY FHPNHQFYLG ADYGRVSGES AQYVSGKQLM

501 GAVVGFRGGH KVGGMFAYDL FAGKPLHKPK GFQTTNTVYG FNLNYSF*
```

Computer analysis of this amino acid sequence gave the following results:
Homology with a Predicted ORF from *N. gonorrhoeae*
ORF 903 shows 48.9% identity over a 519 aa overlap with a predicted ORF (ORF 903.ng) from *N. gonorrhoeae*:

```
    m903/g903

10        20        30        40        50        60
m903.pep  MQRQQHIDAELLTDANVRFEQPLEKNNYVLSEDETPCTRVNYISLDDKTVRKFSFLPSVL
          |::  :||   ::  :  |   :  :    ||  | :
g903                     MATQVGGANSDEASPCFPISEVELVGEETAKFRFALNHA
                                   10        20        30

70        80        90       100       110       120
m903.pep  MKETAFKTGMCLGSNNLSRLQKAAQQILIVRGYLTSQAIIQPQNMDSGILKLRVSAGEIG
          : |  | :|  ||  ::::::::  ||: ||  |||  |::   ||:::|| |:   :
g903      LCQTHFVSGKCLHAGDINQIMSLAQNALIGRGYTTTRILAAPQDLNSGKLQLTLMPGYLR
              40        50        60        70        80        90

130       140       150       150       170       180
m903.pep  DIRYEEKRDGKSAEGSISAFNNKFPLYRNKILNLRDVEQGLENLRRLPSVKTDIQIIPS
          :||  :::  |  ::   |  |:||:|||     | :||||:||||||  ||::::||:|
g903      SIRIDRSNDDQTHAGRIAAFQNKFPTRSNDLLNLRDLEQGLENLKCLPTAEADLQIVPV
                 100       110       120       130       140       150

190       200       210       220       230
m903.pep  EE-GKSDLQIKWQQNK-PIRFSIGIDDAGGKTTGKYQGNVALSFDNPLGLSDLFYVSYGR
          :|  ::||:  ::|:        |  |:|:::::||||||:::|  |||:||||:|||:|||
g903      REPNQSDVVVQWRXRLLPYCVSVGMDNSGSEATGKYQGNITFSADNPFLGLSDMFYVNYG
            160       170       180       190       200       210

240       250       260       270       280       290
m903.pep  GLAHKTDLTDATGTETESGSRSYSVHYSVPVKKWLFSFNHNGHRYHEATEGYSVNYDYNG
          :::    |   :  |  :|:||||:|  || ::|||||:|||:|:  | |   |||||
g903      SIGGTPDEENFDGHRKEGGSNNYAVHYSAPFGTWTWAFNHNGYRYHQAVSGLSEVYDYNG
            220       230       240       250       260       270

300       310       320       330       340       350
m903.pep  KQYQSSLAAERMLWRNRLHKTSVGMKLWTRQTYKYIDDAEIEVQRRRSAGWEAELRHRAY
          |:|::::: :|:|:|: :||  :::||||||:| :|||||||::  ||||:||   |::|
g903      KSYNTDFGFNRLLYRDAKRKTYLSVKLWTRETSKYIDDAELTVQRRKTTGWLAELSHKGY
            280       290       300       310       320       330

360       370       380       390       400       410
m903.pep  LNRWQLDGKLSYKRGTGMRQSMPAPEENGGDILPGTSRMKIITASLDAAAPFXLGKQQFF
          ::|    |  ||:||:||||::::  ||||    |:    ||||||||  ||   ::|
g903      IGRSTADFKLKYKHGTGMKDALRAPEEAFGE---GTSRMKIWTASADVNTPFQIGKQLFA
            340       350       360       370       380       390

420       430       440       450       460       470
m903.pep  YATAIQAQWNKTPLVAQDKLSIGSRYTVRGFDGEQSLFGERGFYWQNTLTWYFHPNHQFY
          |  |:::|||||||:: ||||||:|::: |||||||||||  :||  :||:|  |:||:|
g903      LGADVGHVSGQSAKWLSGQTLAGTAIGIRGQIKLGGNLHYDIFTGRALKKPEYFQTKKWV
            460       470       480       490       500       510

480       490       500       510       520       530
m903.pep  LGADYGRVSGESAQYVSGKQLMGAVVGFRGGHKVGGMFAYDLFAGKPLHKPKGFQTTNTV
          ||||  |:|||:|:::::||  |  |:::|:|:   |:||  :|||:|: |:|||  : |
g903      LGADVGHVSGQSAKWLSGQTLAGTAIGIRGQIKLGGNLHYDIFTGRALKKPKEFQTKKWV
            460       470       480       490       500       510

540
m903.pep  YGFNLNYSFX
          ||:::|||
g903      TGFQVGYSFX
            520
```

The following partial DNA sequence was identified in *N. meningitidis* <SEQ ID 2719>:

```
a903.seq
    1  ATGCAGCGTC AGCAGCACAT AGATGCTGAA TTGTTAACTG ATGCAAATGT

51  CCGTTTCGAG CAACCATTGG AGAAGAACAA TTATGTCCTG AGTGAAGATG

101  AAACACCGTG TACTCGGGTA AATTACATTA GTTTAGATGA TAAGACGGCG

151  CGCAAATTTT CTTTTCTTCC TTCTGTGCTC ATGAAAGAAA CAGCTTTTAA

201  AACTGGGATG TGTTTAGGTT CCAATAATTT GAGCAGGCTA CAAAAAGCCG

251  CGCAACAGAT ACTGATTGTG CGTGGCTACC TCACTTCCCA AGCTATTATC

301  CAACCACAGA ATATGGATTC GGGAATTCTG AAATTACGGG TATCAGCAGG
```

-continued

```
 351 CGAAATAGGG GATATCCGCT ATGAAGAAAA ACGGGATGGG AAGTCTGCCG

401 AGGGCAGTAT TAGTGCATTC AATAACAAAT TTCCCTTATA TAGGAACAAA

451 ATTCTCAATC TTCGCGATGT AGAGCAGGGC TTGGAAAACC TGCGTCGTTT

501 GCCGAGTGTT AAAACAGATA TTCAGATTAT ACCGTCCGAA GAAGAAGGCA

551 AAAGCGATTT ACAGATCAAA TGGCAGCAGA ATAAACCCAT ACGGTTCAGT

601 ATCGGTATAG ATGATGCGGG CGGCAAAACG ACCGGCAAAT ATCAAGGAAA

651 TGTCGCTTTA TCGTTCGATA ACCCTTTGGG CTTAAGCGAT TTGTTTTATG

701 TTTCATATGG ACGCGGTTTG GTGCACAAAA CGGACTTGAC TGATGCCACC

751 GGTACGGAAA CTGAAAGCGG ATCCAGAAGT TACAGCGTGC ATTATTCGGT

801 GCCCGTAAAA AAATGGCTGT TTTCTTTTAA TCACAATGGA CATCGTTACC

851 ACGAAGCAAC CGAAGGCTAT TCCGTCAATT ACGATTACAA CGGCAAACAA

901 TATCAGAGCA GCCTGGCCGC CGAGCGCATG CTTTGGCGTA ACAGGTTTCA

951 TAAAACTTCA GTCGGAATGA AATTATGGAC ACGCCAAACC TATAAATACA

1001 TCGACGATGC CGAAATCGAA GTGCAACGCC GCCGCTCTGC AGGCTGGGAA

1051 GCCGAATTGC GCCACCGTGC TTACCTCAAC CGTTGGCAGC TTGACGGCAA

1101 GTTGTCTTAC AAACGCGGGA CCGGCATGCG CCAAAGTATG CCCGCACCTG

1151 AAGAAAACGG CGGCGGTACT ATTCCAGGCA CATCCCGTAT GAAAATCATA

1201 ACCGCCGGAT TGGATGCAGC GGCCCCGTTT ATGTTGGGCA AACAGCAGTT

1251 TTTCTACGCA ACCGCCATTC AAGCTCAATG GAACAAAACG CCTTTGGTTG

1301 CCCAAGACAA GTTGTCTATC GGCAGCCGCT ACACCGTTNG CGGATTTGAT

1351 GGGGAGCAGA GTCTTTTCGG AGAGCGAGGT TTCTACTGGC AGAATACTTT

1401 AACTTGGTAT TTTCATCCGA ACCATCAGTT CTATCTCGGT GCGGACTATG

1451 GCCGCGTATC TGGCGAAAGT GCACAATATG TATCGGGCAA GCAGCTGATG

1501 GGTGCAGTGG TCGGNTTCAG AGGAGGNCAT AAAGTAGGCG GTATGTTTGC

1551 TTATGATCTG TTTGCCGGCA AGCCGCTTCA TAAACCCAAA GGCTTTCAGA

1601 CGACCAACAC CGTTTACGGC TTCAACTTGA ATTACAGTTT CTAA
```

This corresponds to the amino acid sequence <SEQ ID 2720; ORF 903.a>:

```
a903.pep
  1 MQRQQHIDAE LLTDANVRFE QPLEKNNYVL SEDETPCTRV NYISLDDKTA

51 RKFSFLPSVL MKETAFKTGM CLGSNNLSRL QKAAQQILIV RGYLTSQAII

101 QPQNMDSGIL KLRVSAGEIG DIRYEEKRDG KSAEGSISAF NNKFPLYRNK

151 ILNLRDVEQG LENLRRLPSV KTDIQIIPSE EEGKSDLQIK WQQNKPIRFS

201 IGIDDAGGKT TGKYQGNVAL SFDNPLGLSD LFYVSYGRGL VHKTDLTDAT

251 GTETESGSRS YSVHYSVPVK KWLFSFNHNG HRYHEATEGY SVNYDYNGKQ

301 YQSSLAAERM LWRNRFHKTS VGMKLWTRQT YKYIDDAEIE VQRRRSAGWE

351 AELRHRAYLN RWQLDGKLSY KRGTGMRQSM PAPEENGGGT IPGTSRMKII

401 TAGLDAAAPF MLGKQQFFYA TAIQAQWNKT PLVAQDKLSI GSRYTVXGFD

451 GEQSLFGERG FYWQNTLTWY FHPNHQFYLG ADYGRVSGES AQYVSGKQLM

501 GAVVGFRGGH KVGGMFAYDL FAGKPLHKPK GFQTTNTVYG FNLNYSF*
``` m903/a903 98.4% identity in 547 aa overlap

```
                 10         20         30         40         50         60
   m903.pep   MQRQQHIDAELLTDANVRFEQPLEKNNYVLSEDETPCTRVNYISLDDKTVRKFSFLPSVL
              ||||||||||||||||||||||||||||||||||||||||||||||:|||||||||||||
   a903       MQRQQHIDAELLTDANVRFEQPLEKNNYVLSEDETPCTRVNYISLDDKTARKFSFLPSVL
                       10         20         30         40         50         60
     70         80         90        100        110        120
   m903.pep   MKETAFGTGMCLGSNNLSRLQKAAQQILIVRGYLTSQAIIQPQNMDSGILKLRVSAGEIG
              ||||||:|||||||||||||||||||||||||||||||||||||||||||||||||||||
   a903       MKETAFKTGMCLGSNNLSRLQKAAQQILIVRGYLTSQAIIQPQNMDSGILKLRVSAGEIG
                       70         80         90        100        110        120
    130        140        150        160        170        180
   m903.pep   DIRYEEKRDGKSAEGSISAFNNKFPLYRNKILNLRDVEQGLENLRRLPSVKTDIQIIPSE
              ||||||||||||||||||||||||||||||||||||||||||||||||||||||||||||
   a903       DIRYEEKRDGKSAEGSISAFNNKFPLYRNKILNLRDVEQGLENLRRLPSVKTDIQIIPSE
                      130        140        150        160        170        180
    190        200        210        220        230        240
   m903.pep   EEGKSDLQIKWQQNKPIRFSIGIDDAGGKTTGKYQGNVALSFDNPLGLSDLFYVSYGRGL
              ||||||||||||||||||||||||||||||||||||||||||||||||||||||||||||
   a903       EEGKSDLQIKWQQNKPIRFSIGIDDAGGKTTGKYQGNVALSFDNPLGLSDLFYVSYGRGL
                      190        200        210        220        230        240
    250        260        270        280        290        300
   m903.pep   AHKTDLTDATGTETESGSRSYSVHYSVPVKKWLFSFNHNGHRYHEATEGYSVNYDyNGKQ
              :|||||||||||||||||||||||||||||||||||||||||||||||||||||||||||
   a903       VHKTDLTDATGTETESGSRSYSVHYSVPVKKWLFSFNHNGHRYHEATEGYSVNYDyNGKQ
                      250        260        270        280        290        300
    310        320        330        340        350        360
   m903.pep   YQSSLAAERMLWRNRLHKTSVGMKLWTRQTYKYIDDAEIEVQRRRSAGWEAELRHRAYLN
              |||||||||||||:||||||||||||||||||||||||||||||||||||||||||||||
   a903       YQSSLAAERMLWRNRFHKTSVGMKLWTRQTYKYIDDAEIEVQRRRSAGWEAELRHRAYLN
                      310        320        330        340        350        360
    370        380        390        400        410        420
   m903.pep   RWQLDGKLSYKRGTGMRQSSMPAPEENGGDILPGTSRMKIITASLDAAPFXLGKQQFFYA
              ||||||||||||||||||||||||||||| :||||||||||:||||| ||||||||||||
   a903       RWQLDGKLSYKRGTGMRQSSMPAPEENGGGTIPGTSRMKIITAGLDAAPFMLGKQQFFYA
                      370        380        390        400        410        420
    430        440        450        460        470        480
   m903.pep   TAIQAQWNKTPLVAQDKLSIGSRYTVRGFDGEQSLFGERGFYWQNTLTWYFHPNHQFYLG
              ||||||||||||||||||||||||||||||||||||||||||||||||||||||||||||
   a903       TAIQAQWNKTPLVAQDKLSIGSRYTVRGFDGEQSLFGERGFYWQNTLTWYFHPNHQFYLG
                      430        440        450        460        470        480
    490        500        510        520        530        540
   m903.pep   ADYGRVSGESAQYVSGKQLMGAVVGFRGGHKVGGMFAYDLFAGKPLHKPKGFQTTNTVYG
              ||||||||||||||||||||||||||||||||||||||||||||||||||||||||||||
   a903       ADYGRVSGESAQYVSGKQLMGAVVGFRGGHKVGGMFAYDLFAGKPLHKPKGFQTTNTVYG
                      490        500        510        520        530        540
   m903.pep   FNLNYSFX
              ||||||||
   a903       FNLNYSFX
```

The following partial DNA sequence was identified in *N. gonorrhoeae* <SEQ ID 2721>:

```
g904.seq
    1  ATGATGCAGC ACAATCGTTT CTTCGCGGTC GGGGCCGGTg gaGACGATGG

51  CGACCGGCGC GCCGCAGACT TCTTCAATCC GTTTCAAATA TGCTTTGGCA

101  TTGGCAGGCA ATGCGTCGTA GCTTTTCACG CCGACAGTCG ATTCGCGCCA

151  GCCGGGCATG GTTTCGTAAA TCGGTTTGCA GGTTTCCACC GCATCCGAAC

201  CGCAAGGCAG GATGTCGGTT TGCCGCCGC CTGGCAATTC GTAGCCGACG

251  CAGATATTGA TGGTTTCAAC GCCGTCCATT ACATCGAGTT TGGTAATGCA

301  CATACCGGAA ATGCCGTTGA TTTGGATGGA GCGTTTCAGG CGGCGGCAT

351  CAAACCAGCC GCAGCGGCGC GCGCGGCCGG TTACCGAACC GAATTCGTGT

401  CCGCGCTCCG CCAAACCTGC GCCTACTTCG TCGAACAATT CGGTCGGGAA

451  CGGGCCCGAA CCGACGCGCG TGGTATAGGC TTTGACGATG CCCAAAACAT

501  AATCCAGCAT TTGAGGACCT ACGCCCGCGC CTGCCGAAGC CGCGCCGGCG
```

-continued

```
 551  AGACAGTTGG ACGAGGTAAC GAAGGGGTAA GTGCCGTAGT CGATGTCCAA

601  CAACGCACCT TGCGCGCCTT CAAACAGCAG TTTTTCGCCG TTTTTGTTTT

651  TTTCGTTCAA CACGCgggaC acgtcgGCAA TCATCGGCGC AATGCGCGGC

701  GCGACTTTTT CGATAACCGC CATCACGTCT TCCGCTTTAA CCGGTCCGGC

751  GTTATGCAGG TATTGGAGTT GGACGTTGTA ATAGGCAAGG ACGGCATCCA

801  GTTTTTCACG CAGTTTTTCA GGATGCAGCA AATCGGCGGC GCGAATGGCG

851  CGGCGTGCCA CTTTGTCTTC GTAGGCAGGG CCGATGCCGC GGCCGGTCGT

901  GCCGATTTTG CCTTTGCCGC GCGATGCTTC GCGGGCTTGG TCGAGCGCGA

951  TGTGGTAAGG CAGGATCAGC GGGCAGGTCG GCGCGATTTT CAGACGGCCT

1001  TCGACGTTTT TCACGCCTGC CGCGTTCAAC TCGTCGATTT CGCCCAACAG

1051  GGCTTCGGGg gaaacgAcaa cGCCCGAACC gatGAAGCAA TCCAATCCTT

1101  CGTGCAGGAT ACCGCTCGGA ATCAGGCGCA AAATGGTTTT TTTGCCGCCG

1151  ACGACCAAGG TATGGCCCGC ATTGTGGCCG CCTTGGAAGC GCACgacGct 1201  gCCGGCTTCT TCCGCCAGCC AGTCAACGAT TTTACCTTTA CCCTCGTCGC 1251  CCCACTGTgc gccGATTACT ACAACATTTT TAGCCATAGC CATATAACCT 1301  ATCGatatTA A
```

This corresponds to the amino acid sequence <SEQ ID 2722; ORF 904.ng>:

```
g904.pep
   1 MMQHNRFFAV GAGGDDGDRR AADFFNPFQI CFGIGRQCVV AFHADSRFAP

51 AGHGFVNRFA GFHRIRTARQ DVGFAAAWQF VADADIDGFN AVHYIEFGNA

101 HTGNAVDLDG AFQGGGIKPA AAARAAGYRT EFVSALRQTC AYFVEQFGRE

151 RARTDARGIG FDDAQNIIQH LRTYARACRS RAGETVGRGN EGVSAVVDVQ

201 QRTLRAFKQQ FFAVFVFFVQ HAGHVGNHRR NARRDFFDNR HHVFRFNRSG

251 VMQVLELDVV IGKDGIQFFT QFFRMQQIGG ANGAACHFVF VGRADAAAGR

301 ADFAFAARCF AGLVERDVVR QDQRAGRRDF QTAFDVFHAC RVQLVDFAQQ

351 GFGGNDNART DEAIQSFVQD TARNQAQNGF FAADDQGMAR IVAALEAHDA

401 AGFFRQPVND FTFTLVAPLC ADYYNIFSHS HITYRY*
```

The following partial DNA sequence was identified in *N. meningitidis* <SEQ ID 2723>:

```
m904.seq
   1   ATGATGCAGC ACAATCGTTT CTTCTCGGTC GGGGCCGGtG GAGACGATGG

51   CGACCGGCGC GCCGCAGACT TCTTCAATCC GTTTCAAATA TGCTTTGGCG

101   TTTTCGGGCA ATGCGCCGTA GTCCTTCACG CCGAAAGTGG ATTCGCGCCA

151   GCCGGGCATG GTTTCGTAAA TCGGCTTGCA GGTTTCCACC GCATCGGAAC

201   CGCAAGGCAG GATGTCGGTT TTGCCGCCGT CGGGCAATTC ATAGCCGACG

251   CAGATATTGA TGGTTTCAAC GCCGTCCATT ACATCGAGTT TAGTAATACA

301   CATACCGGAA ATGCCGTTGA TTTGGATGGA GCGTTTCAGG GCGGCGGCAT

351   CAAACCAGCC GCAGCGGCGT GCGCGTCCGG TTACCGAACC GAATTCGTGT

401   CCGCGTTCTG CCAAACCTAC GCCTACTTCG TCGAACAATT CGGTCGGGAA
```

-continued

```
 451   CGGGCCCGAA CCGACGCGCG TGGTATAGGC TTTGACGATG CCCAAAACAT
 501   AATCCAGCAT TTGAGGACCT ACGCCCGCGC CTGCCGAAGC TGCGCCCGCC
 551   AGACAGTTGG ACGAGGTAAC GAAGGGATAA GTGCCGTAGT CGATGTCCAA
 601   CAACGCACCT TGCGCGCCTT CAAACAGCAG TTTTTCGCCG TTTTTGTTTT
 651   TCTCGTTCAA CACGCGGGAC ACGTCGGTAA TCATCGGCGC AATGCGCGGC
 701   GCGACTTTTT CGATAACCGC CATCACGTCT TCCGCTTTAA CCGGCTCGGC
 751   ATTGTGCAGA TGTTGCAGTT GGACATTGTA ATAGGCAAGG ACGGCATCCA
 801   GTTTTTCACG CAGTTTyTCA GGATGCAGCA AATCGGCGGC GCGAATGGCG
 851   CGGCGTGCCA CTTTGTCTTC GTAGGCAGGG CCGATGCCGC GGCCGGTCGT
 901   GCCGATTTTG CCTTTGCCGC GCG.ATcTTC GCGGGCTTGG TCGAGCGCGA
 951   TGTGGTAAGG CAGGATCAGC GGGCAGGTCG GCGCGATTTT CAGACGGCCT
1001   TCGACGTTTT TCACGCCTGC CGCGTTCAAC TCGTCGATTT CGCCCAACAG
1051   GGCTTCGGGG GAGACGACAA CGCCCGAACC GATGAAGCAG TCCAAACTTT
1101   CATGCAGGAT GCCGCTCGGA ATCAGGCGCA AAATGGTTTT TTTGCCGCCG
1151   ACAACCAAGG TATGCCCGC ATTGTGGCCG CCTTGGAAGC GCACCaCGCC
1201   GCCGGCTTCT TCCGCCAGCC AGTCAACGAT TTTACCTTTA CCCTCGTCGC
1251   CCCACTGTGC GCCGATTAsT ACAACATTTT TAGCCATAGC CATATAACCT
1301   ATCGATATTA A
```

This corresponds to the amino acid sequence <SEQ ID 2724; ORF 904>:

```
m904.pep
  1 MMQHNRFFSV GAGGDDGDRR AADFFNPFQI CFGVFGQCAV VLHAESGFAP

51 AGHGFVNRLA GFHRIGTARQ DVGFAAVGQF IADADIDGFN AVHYIEFSNT

101 HTGNAVDLDG AFQGGGIKPA AAACASGYRT EFVSAFCQTY AYFVEQFGRE

151 RARTDARGIG FDDAQNIIQH LRTYARACRS CARQTVGRGN EGISAVVDVQ

201 QRTLRAFKQQ FFAVFVFLVQ HAGHVGNHRR NARRDFFDNR HHVFRFNRLG

251 IVQMLQLDIV IGKDGIQFFT QFXRMQQIGG ANGAACHFVF VGRADAAAGR

301 ADFAFAAXIF AGLVERDVVR QDQRAGRRDF QTAFDVFHAC RVQLVDFAQQ

351 GFGGDDNART DEAVQTFMQD AARNQAQNGF FAADNQGMAR IVAALEAHHA

401 AGFFRQPVND FTFTLVAPLC ADXYNIFSHS HIT<u>YRY</u>*
```

Computer analysis of this amino acid sequence gave the following results:
Homology with a Predicted ORF from *N. gonorrhoeae*
ORF 904 shows 90.4% identity over a 436 aa overlap with a predicted ORF (ORF 904.ng) from *N. gonorrhoeae*:

```
m904/g904

10         20         30         40         50         60
    m904.pep  MMQHNRFFSVGAGGDDGDRRAADFFNPFQICFGVFGQCAVVLHAESGFAPAGHGFVNRLA
              ||||||||:|||||||||||||||||||||||:  ||:|::||:| ||||||||||||:|
        g904  MMQHNRFFAVGAGGDDGDRRAADFFNPFQICFGIGRQCVVAFHADSRFAPAGHGFVNRFA
                      10         20         30         40         50         60
```

-continued

```
70         80         90         100        110        120
m904.pep   GFHRIGTARQDVGFAAVGQFIADADIDGFNAVHYIEFSNTHTGNAVDLDGAFQGGGIKPA
           ||||| ||||||||||: ||:||||||||||||||||:|:||||||||||||||||||||
g904       GFHRIRTARQDVGFAAAWQFVADADIDGFNAVHYIEFGNAHTGNAVDLDGAFQGGGIKPA
                   70        80        90        100       110       120

130        140        140        160        170        180
m904.pep   AAACASGYRTEFVSAFCQTYAYFVEQFGRERARTDARGIGFDDAQNIIQHLRTYARACRS
           ||| |:|||||||||:  || |||||||||||||||||||||||||||||||||||||||
g904       AAACAAGYRTEFVSALRQTCAYFVEQFGRERARTDARGIGFDDAQNIIQHLRTYARACRS
                   130       140       140       160       170       180

190        200        210        220        230        240
m904.pep   CARQTVGRGNEGISAVVDVQQRTLRAFKQQFFAVFVFLVQHAGHVGNHRRNARRDFFDNR
            | :||||||||:||||||||||||||||||||||||:|||||||||||||||||||||||
g904       RAGETVGRGNEGVSAVVDVQQRTLRAFKQQFFAVFVFFVQHAGHVGNHRRNARRDFFDNR
                   190       200       210       220       230       240

250        260        270        280        290        300
m904.pep   HHVFRFNRLGIVQMLQLDIVIGKDGIQFFTQFXRMQQIGGANGAACHFVFVGRADAAAGR
           |||||||| |::|:|:||:|||||||||||| ||||||||||||||||||||||||||||
           HHVFRFNRSGVMQVLELDVVIGKDGIQFFTQFFRMQQIGGANGAACHFVFVGRADAAAGR
g904               250       260       270       280       290       300

310        320        330        340        350        360
m904.pep   ADFAFAARIFAGLVERDVVRQDQRAGRRDFQTAFDVFHACRVQLVDFAQQGFGGDDNART
           |||||||| |||||||||||||||||||||||||||||||||||||||||||||:|||||
g904       ADFAFAARCFAGLVERDVVRQDQRAGRRDFQTAFDVFHACRVQLVDFAQQFDFFDDNART
                   310       320       330       340       350       360

370        380        390        400        410        420
m904.pep   DEAVQTFMQDAARNQAQNGFFAADNQGMARIVVAALEAHHAAGFFRQPVNDFTFTLVAPLC
           |||:|:|:||:||||||||||||||:|||||||||||||| ||||||||||||||||||||
           DEAIQSFVQDTARNQAQNGFFAADDQGMARIVAALEAHDAAGFFRQPVNDFTFTLVAPLC
                   370       380       390       400       410       420

430
m904.pep   ADXYNIFSHSHITYRYX
g904       || ||||||||||||||
           ADYYNIFSHSHITYRYX
                   430
```

The following partial DNA sequence was identified in *N. meningitidis* <SEQ ID 2725>:

```
a904.seq
     1  ATGATGCAGC ACAATCGTTT CTTCGCGGTC GGGGCCGGTG GAGACGATGG

51  CGACCGGCGC ACCGCAGACT TCTTCAATCC GTTTCAAATA TGCTTTGGCA

101  TTGGCAGGTA ATGCGTCGTA GCTTTTCACG CCGAAAGTGG ATTCGCTCCA

151  ACCGGGCATG GTTTCGTAAA TCGGCTTGCA GGCTTCTACC GCATCAGAGC

201  CGCAAGGCAG GATGTCGGTT TTGCCGCCGT CGGGCAATTC GTAGCCGACG

251  CAGATATTGA TGGTTTCAAC GCCGTCCATT ACATCGAGTT TGGTAATACA

301  CATACCGGAA ATGCCGTTGA TTTGGATGGA GCGTTTCAGG GCGGCGGCAT

351  CAAACCAGCC GCAGCGGCGT GCGCGTCCGG TTACCGAACC GAATTCGTGT

401  CCGCGTTCTG CCAAACCTGC TCCGACTTCG TCGAACAATT CGGTCGGGAA

451  CGGGCCCGAA CCGACGCGCG TGGTATAGGC TTTGACGATG CCCAAAACAT

501  AATCCAGCAT TTGAGGGCCT ACGCCCGCGC CTGCCGAAGC CGCGCCGGCG

551  AGGCAGTTGG ACGAAGTAAC GAAGGGGTAA GTGCCGTAGT CGATGTCCAA

601  CAACGCACCT TGCGCGCCTT CAAACAGCAG TTTTTCGCCG TTTTTGTTTT

651  TTTCGTTCAA CACGCGGGAC ACGTCGGTAA TCATCGGCGT AATGCGCGGC

701  GCGACTTTTT CGATAACCGC CATCACGTCT TCCGCTTTCA CCGACTCGGC

751  ATTGTGCAGA TGTTGCAGTT GGACGTTGTA ATAAGCAAAG ACGGCATCCA

801  GTTTTTCACG CAGTTTTTCA GGATGCAGCA AATCGGCGGC GCGAATGGCG

851  CGGCGTGCCA CTTTGTCTTC GTAGGCAGGG CCGATGCCGC GGCCGGTCGT

901  GCCGATTTTG CCTTTGCCGC GCGATGCTTC TCGGGCTTGG TCGAGCGCGA
```

```
-continued
 951 TGTGATAAGG CAGGATCAGC GGGCAGGTCG GCGCGATTTT CAGACGGCCT
1001 TCGACGTTTT TCACGCCTGC CGCGTTCAAC TCGTCGATTT CGCCCAACAG
1051 GGCTTCGGGG GAGACGACAA CGCCCGAACC GATGAAGCAG TCCAGACTTT
1101 CATGCAGGAT GCCGCTCGGA ATCAGGCGCA AAATGGTTTT TTTGCCGCCG
1151 ACAACCAAGG TATGACCCGC ATTGTGGCCG CCTTGGAAGC GCACCACGCC
1201 TCCGGCTTCT TCCGCCAGCC AGTCAACGAT TTTACCTTTA CCCTCGTCGC
1251 CCCACTGTGC GCCGATTACT ACAACATTTT TAGCCATAGC CATATAACCT
1301 .TCGATATTA A
                                                          15
```

This corresponds to the amino acid sequence <SEQ ID 2726; ORF 904.a>:

```
a904.pep
  1 MMQHNRFFAV GAGGDDGDRR TADFFNPFQI CFGIGR*CVV AFHAESGFAP

51 TGHGFVNRLA GFYRIRAARQ DVGFAAVGQF VADADIDGFN AVHYIEFGNT

101 HTGNAVDLDG AFQGGGIKPA AAACASGYRT EFVSAFCQTC SDFVEQFGRE

151 RARTDARGIG FDDAQNIIQH LRAYARACRS RAGEAVGRSN EGVSAVVDVQ

201 QRTLRAFKQQ FFAVFVFFVQ HAGHVGNHRR NARRDFFDNR HHVFRFHRLG

251 IVQMLQLDVV ISKDGIQFFT QFFRMQQIGG ANGAACHFVF VGRADAAAGR

301 ADFAFAARCF SGLVERDVIR QDQRAGRRDF QTAFDVFHAC RVQLVDFAQQ

351 GFGGDDNART DEAVQTFMQD AARNQAQNGF FAADNQGMTR IVAALEAHHA

401 SGFFRQPVND FTFTLVAPLC ADYYNIFSHS HITXRY*
``` m904/a904 91.3% identity in 436 aa overlap

```
                    10        20        30        40        50        60
    m904.pep  MMQHNRFFSVGAGGDDGDRRAADFFNPFQICFGVFGQCAVVLHAESGFAPAGHGFVNRLA
              ||||||||:|||||||||||:||||||||||:   |:|::||||||:||||||||
    a904      MMQHNRFFAVGAGGDDGDRRTADFFNPFQICFGIGRXCVVAFHAESGFAPTGHGFVNRLA
                    10        20        30        40        50        60

70        80        90       100       110       120
    m904.pep  GFHRIGTARQDVGFAAVGQFIADADIDGFNAVHYIEFSNTHTGNAVDLDGAFQGGGIKPA
              ||:|| :||||||||||||::|||||||||||||||||:||||||||||||||||||||
    a904      GFYRIRAARQDVGFAAVGQFVADADIDGFNAVHYIEFGNTHTGNAVDLDGAFQGGGIKPA
                    70        80        90       100       110       120

130       140       150       160       170       180
    m904.pep  AAACASGYRTEFVSAFCQTYAYFVEQFGRERARTDARGIGFDDAQNIIQHLRTYARACRS
              |||||||||||||||||||:    ||||||||||||||||||||||||||:|||||||
    a904      AAACASGYRTEFVSAFCQTCSDFVEQFGRERARTDARGIGFDDAQNIIQHLRAYARACRS
                   130       140       150       160       170       180

190       200       210       220       230       240
    m904.pep  CARQTVGRGNEGISAVVDVQQRTLRAFKQQFFAVFVFLVQHAGHVGNHRRNARRDFFDNR
              |  ::|||:|||||:|||||||||||||||||||||||:|||||||||||||||||||
    a904      RAGEAVGRSNEGVSAVVDVQQRTLRAFKQQFFAVFVFFVQHAGHVGNHRRNARRDFFDNR
                   190       200       210       220       230       240

250       260       270       280       290       300
    m904.pep  HHVFRFNRLGIVQMLQLDIVIGKDGIQFFTQFXRMQQIGGANGAACHFVFVGRADAAAGR
              ||||||:|||||||||||:||  ||||||||||| ||||||||||||||||||||||||
    a904      HHVFRFHRLGIVQMLQLDVVISKDGIQFFTQFFRMQQIGGANGAACHFVFVGRADAAAGR
                   250       260       270       280       290       300

310       320       330       340       350       360
    m904.pep  ADFAFAAXIFAGLVERDVVRQDQRAGRRDFQTAFDVFHACRVQLVDFAQQGFGGDDNART
              |||||||  |:||||||||:||||||||||||||||||||||||||||||||||||||||
    a904      ADFAFAARCFSGLVERDVIRQDQRAGRRDFQTAFDVFHACRVQLVDFAQQGFGGDDNART
                   310       320       330       340       350       360

370       380       390       400       410       420
    m904.pep  DEAVQTFMQDAARNQAQNGFFAADNQGMARIVAALEAHHAAGFFRQPVNDFTFTLVAPLC
              |||||||||||||||||||||||||||||:||||||||||:|||||||||||||||||
    a904      DEAVQTFMQDAARNQAQNGFFAADNQGMTRIVAALEAHHASGFFRQPVNDFTFTLVAPLC
                   370       380       390       400       410       420
```

```
                      430
m904.pep  ADXYNIFSHSHITYRYX
          ||  ||||||||||| |||
a904      ADYYNIFSHSHITXRYX
                      430
g906.seq not found yet
g906.pep not found yet
```

The following partial DNA sequence was identified in *N. meningitidis* <SEQ ID 2727>:

```
m906.seq
    1 ATGAAATATA TCGTATCAAT CTCTCTGGCT ATGGGATTGG CTGCCTGTTC

51 GTTTGGGGGA TTTAAACCAA ATCCGTGGGA CGCCGCGTCA TTTTGGGAAT

101 TGAAAAATTA CGCCAATCCC TATCCGGGAT CAGCCTCGGC GGCACTTGAC

151 CAATATCCAT CGAAAGCAAG ACGAAGGCAA CTGAAAGACA TGCAAGAGTG

201 CGGCTATGAC CCAATAGACG GCGGAAAGTC TGAAGCAGAT GCCTGCCTGA

251 GGAAAAAAGG CTGGTGTCGT AAGGGTTTCG ACCCTTATCC CGAAAACAAA

301 AAATACGAAT GGCCTCGAGA AGAAGGAAAA ACAAAATGA
```

This corresponds to the amino acid sequence <SEQ ID 2728; ORF 906>:

```
m906.pep
    1 MKYIVSISLA MGLAACSFGG FKPNPWDAAS FWELKNYANP YPGSASAALD

51 QYPSKARRRQ LKDMQECGYD PIDGGKSEAD ACLRKKGWCR KGFDPYPENK

101 KYEWPREEGK TK*
```

The following partial DNA sequence was identified in *N. gonorrhoeae* <SEQ ID 2729>:

```
g907.seq (partial)
    1 ATGAAAAAAC CGACCGATAC CCTACCCGTC AATCTgcaAC GCCGCCGCCT

51 GCTGTGTGCC GCCGGCGCGC TGTTGATCAG CCCGCTGGCG CACGCCGGCG

101 CGCAACGTGA AGAAACGCtt gCCGACGATG TGGCTTCCGT GATGAGGAGT

151 TCTGTCGGCA GCGTCAATCC GCCGAGGCTG GTGTTCGACA ATCCGAAAGA

201 GGGCGAACGT TGGTTGTCCG CGATGTCGGC ACGTTTGGCA AGATTCGTCC

251 CCGACGAGGG GGAGCGGCGC AGGCTGCTGG TCAATATCCA ATACGAAAGC

301 AGCCGGGCCG GTTTGGATAC GCAGATTGTG TTGGGGCTGa ttgaagtgga 351 aagcgggtac cgagctcgaa tcatatca..
```

This corresponds to the amino acid sequence <SEQ ID 2730; ORF 907.ng>:

```
g907.pep (partial)
    1 MKKPTDTLPV NLQRRRLLCA AGALLISPLA HAGAQREETL ADDVASVMRS

51 SVGSVNPPRL VFDNPKEGER WLSAMSARLA RFVPDEGERR RLLVNIQYES

101 SRAGLDTQIV LGLIEVESGY RARIIS...
```

The following partial DNA sequence was identified in *N. meningitidis* <SEQ ID 2731>:

```
m907.seq
   1 ATGAGAAAAC CGACCGATAC CCTACCCGTT AATCTGCAAC GCCGCCGCCT

51 GTTGTGTGCC GCCGGTGCGT TGTTGCTCAG TCCTCTGGCG CACGCCGGCG

101 CGCAACGTGA GGAAACGCTT GCCGACGATG TGGCTTCCGT GATGAGGAGT

151 TCTGTCGGCA GCGTCAATCC GCCGAGGCTG GTGTTTGACA ATCCGAAAGA

201 GGGCGAGCGT TGGTTGTCTG CCATGTCGGC ACGTTTGGCA AGGTTCGTCC

251 CCGAGGAGGA GGAGCGGCGC AGGCTGCTGG TCAATATCCA GTACGAAAGC

301 AGCCGGGCCG GTTTGGATAC GCAGATTGTG TTGGGGCTGA TTGAGGTGGA

351 AAGCGCGTTC CGCCAGTATG CAATCAGCGG TGTCGGCGCG CGCGGCCTGA

401 TGCAGGTTAT GCCGTTkTGG AAAAACTACA TCGGCAAACC GGCGCACAAC

451 CTGTTCGACA TCCGCACCAA CCTGCGTTAC GGCTGTACCA TCCTGCGCCA

501 TTACCGGAAT CTTGAAAAAG GCAACATCGT CCGCGCGCTT GCCCGCTTTA

551 ACGGCAGCTT GGGCAGCAAT AAATATCCGA ACGCCGTTTT GGgCGCGTGG

601 CGCAACCGCT GGCAGTGGCG TTGA
```

This corresponds to the amino acid sequence <SEQ ID 2732; ORF 907>:

```
m907.pep
   1 MRKPTDTLPV NLQRRRLLCA AGALLLSPLA HAGAQREETL ADDVASVMRS

51 SVGSVNPPRL VFDNPKEGER WLSAMSARLA RFVPEEEERR RLLVNIQYES

101 SRAGLDTQIV LGLIEVESAF RQYAISGVGA RGLMQVMPXW KNYIGKPAHN

151 LFDIRTNLRY GCTILRHYRN LEKGNIVRAL ARFNGSLGSN KYPNAVLGAW

201 RNRWQWR*
```

Computer analysis of this amino acid sequence gave the following results:
Homology with a Predicted ORF from *N. gonorrhoeae*
ORF 907 shows 92.9% identity over a 126 aa overlap with a predicted ORF (ORF 907.ng) from *N. gonorrhoeae*:

```
    g907/m907
                    10         20         30         40         50         60
      g907.pep  MKKPTDTLPVNLQRRRLLCAAGALLISPLAHAGAQREETLADDVASVMRSSVGSVNPPRL
                |:||||||||||||||||||||||||:||||||||||||||||||||||||||||||||
      m907      MRKPTDTLPVNLQRRRLLCAAGALLLSPLAHAGAQREETLADDVASVMRSSVGSVNPPRL
                    10         20         30         40         50         60
        70         80         90        100        110        120
      m907.pep  VFDNPKEGERWLSAMSARLARFVPDEGERRRLLVNIQYESSRAGLDTQIVLGLIEVESGY
                ||||||||||||||||||||||||:| ||||||||||||||||||||||||||||||::
      m907      VFDNPKEGERWLSAMSARLARFVPEEEERRRLLVNIQYESSRAGLDTQIVLGLIEVESAF
                    70         80         90        100        110        120
       907.pep  RARIIS
                |  ||
                RQYAISGVGARGLMQVMPXWKNYIGKPAHNLFDIRTNLRYGCTILRHYRNLEKGNIVRAL
                    130        140        150        160        170        180
```

60

The following partial DNA sequence was identified in *N. meningitidis* <SEQ ID 2733>:

```
a907.seq
   1 ATGAAAAAAC CGACCGATAC CCTACCCGTC AATCTGCAAC GCCGCCGCCT
```

-continued

```
 51 ATTGTGTGCT GCCGGCGCGC TGTTGCTCAG CCCGCTGGCA CAAGCCGGCG

101 CGCAACGTGA AGAAACGCTT GCCGACGATG TGGCTTCCGT GATGAGGAGC

151 TCTGTCGGCA GCATAAATCC GCCGAGGCTG GTGTTCGACA ATCCGAAAGA

201 GGGCGAGCGT TGGCTGTCCG CGATGTCTGC TCGGTTGGCA AGGTTCGTCC

251 CCGATGAGGA GGAGCGGCGC AGGCTGCTGG TCAATATCCA GTACGAAAGC

301 AGCCGGGCCG GTTTGGATAC GCAGATTGTG TTGGGGCTGA TTGAGGTGGA

351 AAGCGCGTTC CGCCAGTATG CAATCAGCGG TGTCGGCGCG CGCGGCCTGA

401 TGCAGGTTAT GCCGTTTTGG AAAAACTACA TCGGCAAACC GGCGCACAAC

451 CTGTTCGACA TCCGCACCAA CCTGCGTTAC GGCTGTACCA TCCTGCGCCA

501 TTACCGGAAT CTTGAAAAAG GCAACATCGT CCGCGCACTC GCCCGTTTTA

551 ACGGTAGCCT CGGCAGCAAT AAATATCCGA ACGCCGTTTT GGGCGCGTGG

601 CGCAACCGCT GGCAGTGGCG TTGA
```

This corresponds to the amino acid sequence <SEQ ID 2734; ORF 907.a>:

```
a907.pep
  1 MKKPTDTLPV NLQRRRLLCA AGALLLSPLA QAGAQREETL ADDVASVMRS

51 SVGSINPPRL VFDNPKEGER WLSAMSARLA RFVPDEEERR RLLVNIQYES

101 SRAGLDTQIV LGLIEVESAF RQYAISGVGA RGLMQVMPFW KNYIGKPAHN

151 LFDIRTNLRY GCTILRHYRN LEKGNIVRAL ARFNGSLGSN KYPNAVLGAW

201 RNRWQWR*
``` m907/a907 97.6% identity in 207 aa overlap

```
                 10         20         30         40         50         60
  m907.pep  MRKPTDTLPVNLQRRRLLCAAGALLLSPLAHAGAQREETLADDVASVMRSSVGSVNPPRL
            |:||||||||||||||||||||||||||||||:|||||||||||||||||||||||:||||
  a907      MKKPTDTLPVNLQRRRLLCAAGALLLSPLAQAGAQREETLADDVASVMRSSVGSINPPRL
                 10         20         30         40         50         60

70         80         90        100        110        120
  m907.pep  VFDNPKEGERWLSAMSARLARFVPEEEERRRLLVNIQYESSRAGLDTQIVLGLIEVESAF
            ||||||||||||||||||||||||||:|||||||||||||||||||||||||||||||||
  a907      VFDNPKEGERWLSAMSARLARFVPDEEERRRLLVNIQYESSRAGLDTQIVLGLIEVESAF
                 70         80         90        100        110        120

130        140        150        160        170        180
  m907.pep  RQYAISGVGARGLMQVMPXWKNYIGKPAHNLFDIRTNLRYGCTILRHYRNLEKGNIVRAL
            ||||||||||||||||||| ||||||||||||||||||||||||||||||||||||||||
  a907      RQYAISGVGARGLMQVMPFWKNYIGKPAHNLFDIRTNLRYGCTILRHYRNLEKGNIVRAL
                130        140        150        160        170        180

190        200
  m907.pep  ARFNGSLGSNKYPNAVLGAWRNRWQWRX
            ||||||||||||||||||||||||||||
  a907      ARFNGSLGSNKYPNAVLGAWRNRWQWRX
                190        200
```

The following partial DNA sequence was identified in *N. gonorrhoeae* <SEQ ID 2735>:

```
g908.seq
  1 ATGAG.AAAA GCCGTCTAAG CCGGTATAAA CAAAATAAAC TCATTGGGCT

51 ATTTGTCGCA GGTGTAACTG CAAGAACAGC GGCAGAGTTG GTAGGCATTA

101 ATAAAAATAC CGCAGCCTAT GATTTTCATC GTTTACGATG ACTGATTTAT

151 CAAAACGGTC CGCATTTAGA AATGTTTGAT GGCGAAGTAG AAGCAGATGA
```

```
201 AAGTTATTTT GGCGGACAAC GCAAAGGCAA ACGCGGTCGC GGTGCTGCCG

251 GTAAAGTCGC CGTATTCGGT CTTTTGAAGC GAAATGGTAA GGTTTATACG

301 GTTACAGTAC CGAATACTCA AACCGCTACT TTATTTCCTA TTATCCGTGA 351 acaagtgaaa cctgacagta ttgtttatac ggattgttat CgTAGCTATG 401 ATGTATTAGA Tgtgagcgaa tttagccatT TTagcttcgc tgaaacttcg 451 ttttcgtaTC AATCACAGCA CACATTTTGC CGAACGACAA AACCATATTA

501 A
```

This corresponds to the amino acid sequence <SEQ ID 2736; ORF 908.ng>:

```
g908.pep
  1 MXKSRLSRYK QNKLIGLFVA GVTARTAAEL VGINKNTAAY DFHRLR*LIY

51 QNGPHLEMFD GEVEADESYF GGQRKGKRGR GAAGKVAVFG LLKRNGKVYT

101 VTVPNTQTAT LFPIIREQVK PDSIVYTDCY RSYDVLDVSE FSHFSFAETS

151 FSYQSQHTFC RTTKPY*
```

The following partial DNA sequence was identified in *N. meningitidis* <SEQ ID 2737>:

```
m908.seq
  1 ATGAGAAAAA GTCGTCTAAG CCAGTATAAA CAAAmTAAAC TCATTGAACT

51 GTTTGTCACA GGTGTAACTG CAAGAACGGC AGCAGAGTTA GTAGGCGTTA

101 ATAAAAATAC CGCAGCCTAT TATTTTCATC GTTTACGATT ACTTATTTAT

151 CAAAACAGTC CGCATTTGGA AATGTTTGAT GGCGAAGTAG AAGCAGATGA

201 AAGTTATTTT GGCGGACAAC GCAAAGGCAA ACGCGGTCGC GGTGCTGCCG

251 GTAAAGTCGC CGTATTCGGT CTTTTGAAGC GAAATGGTAA GGTTTATACG

301 GTTACAGTAC CGAATACTCA AACCGCTACT TTATTTCCTA TTATCCGTGA

351 ACAAGTGAAA CCTGACAGCA TTTTTTATAC GGATTGTTAT CGTAGCTATG

401 ATGTATTAGA TGTGCGCGAA TTTAGCCATT TTAGCTTCGC TGAAACTTCG

451 TTTTCGTATC AATCACAGCA CACATTTTGC CGAACGACAA AACCATATTA

501 A
```

This corresponds to the amino acid sequence <SEQ ID 2738; ORF 908>:

```
m908.pep
  1 MRKSRLSQYK QXKLIELFVT GVTARTAAEL VGVNKNTAAY YFHRLRLLIY

51 QNSPHLEMFD GEVEADESYF GGQRKGKRGR GAAGKVAVFG LLKRNGKVYT

101 VTVPNTQTAT LFPIIREQVK PDSIFYTDCY RSYDVLDVRE FSHFSFAETS

151 FSYQSQHTFC RTTKPY*
```

Computer analysis of this amino acid sequence gave the following results:

Homology with a Predicted ORF from *N. gonorrhoeae*

ORF 908 shows 93.4% identity over a 166 aa overlap with a predicted ORF (ORF 908.ng) from *N. gonorrhoeae*:

```
   g908/m908
                    10        20        30        40        50        60
       g908.pep  MXKSRLSRYKQNKLIGLFVAGVTARTAAELVGINKNTAAYDFHRLRXLIYQNGPHLEDFD
                 | |||||:|||  |||  |||:||||||||||||:||||||  |||||  ||||||:||||||
       m908      MRKSRLSQYKQXKLIELFVTGVTARTAAELVGVNKNTAAYYFHRLRLLIYQNSPHLEMFD
                    10        20        30        40        50        60

70        80        90       100       110       120
       g908.pep  GEVEADESYFGGQRKGKRGRGAAGKVAVFGLLKRNGKVYTVTVPNTQTATLFPIIREQVK
                 ||||||||||||||||||||||||||||||||||||||||||||||||||||||||||||
       m908      GEVEADESYFGGQRKGKRGRGAAGKVAVFGLLKRNGKVYTVTVPNTQTATLFPIIREQVK
                    70        80        90       100       110       120

130       140       150       160
       g908.pep  PDSIVYTDCYRSYDVLDVSEFSHFSFAETSFSYQSQHTFCRTTKPYX
                 ||||  ||||||||||||||  ||||||||||||||||||||||||||
       m908      PDSIFYTDCYRSYDVLDVREFSHFSFAETSFSYQSQHTFCRTTKPYX
                   130       140       150       160
```

The following partial DNA sequence was identified in *N. meningitidis* <SEQ ID 2739>:

```
a908.seq
   1 ATGAGAAAAA GTCGTCTAAG CCAGTATAAA CAAAATAAAC TCATTGAGCT

51 ATTTGTCGCA GGTGTAACTG CAAGAACGGC AGCAGAGTTA GTAGGCGTTA

101 ATAAAAATAC CGCAGCCTAT TATTTTCATC GTTTACGATT ACTTATTTAT

151 CAAAACAGTC CGCATTTGGA AATGTTTGAT GGCGAAGTAG AAGCAGATGA

201 AAGTTATTTT GGCGGACAAC GCAAAGGCAA ACGCGGTCGC GGTGCTGCCG

251 GTAAAGTCGC CGTATTCGGT CTTTTGAAGC GAAATGGTAA GGTTTATACG

301 GTTACAGTAC CGAATACTCA AACCGCTACT TTATTTCCTA TTATCCGTGA

351 ACAAGTGAAA CCTGACAGCA TTGTTTATAC GGATTGTTAT CGTAGCTATG

401 ATGTATTAGA TGTGCGCGAA TTTAGCCATT TTAGCTTCGC TGAAACTTCG

451 TTTTCGTATC AATCACAGCA CACATTTTGC CGAACGACAA AACCATATTA

501 A
```

This corresponds to the amino acid sequence <SEQ ID 2740; ORF 908.a>:

```
a908.pep
   1 MRKSRLSQYK QNKLIELFVA GVTARTAAEL VGVNKNTAAY YFHRLRLLIY

51 QNSPHLEMFD GEVEADESYF GGQRKGKRGR GAAGKVAVFG LLKRNGKVYT

101 VTVPNTQTAT LFPIIREQVK PDSIVYTDCY RSYDVLDVRE FSHFSFAETS

151 FSYQSQHTFC RTTKPY*
``` m908/a908 98.2% identity in 166 aa overlap

```
                    10        20        30        40        50        60
       m908.pep  MRKSRLSQYKQXKLIELFVTGVTARTAAELVGVNKNTAAYYFHRLRLLIYQNSPHLEMFD
                 ||||||||||   |||||||:|||||||||||||||||||||||||||||||||||||||
       a908      MRKSRLSQYKQNKLIELFVAGVTARTAAELVGVNKNTAAYYFHRLRLLIYQNSPHLEMFD
                    10        20        30        40        50        60
```

```
              70         80         90        100        110        120
m908.pep   GEVEADESYFGGQRKGKRGRGAAGKVAVFGLLKRNGKVYTVTVPNTQTATLFPIIREQVK
           ||||||||||||||||||||||||||||||||||| |||||||||||||||||||||||
a908       GEVEADESYFGGQRKGKRGRGAAGKVAVFGLLKRNGKBYTVTVPNTQTATLFPIIREQVK
              70         80         90        100        110        120

130        140        150        160
m908.pep   PDSIFYTDCYRSYDVLDVREFSHFSFAETSFSYQSQHTFCRTTKPYX
           |||| ||||||||||||||||||||||||||||||||||||||||||
a908       PDSIVYTDCYRSYDVLDVREFSHFSFAETSFSYQSQHTFCRTTKPYX
              130        140        150        160
```

The following partial DNA sequence was identified in *N. gonorrhoeae* <SEQ ID 2741>:

```
g909.seq (partial)
    1 atgcgtaaaa ccgtacttat cCTgaccatc tccgccgccc ttttgtcggg 51 ctgcacatgG gaaacttatc aagacggcag cggcaaaacc gccgtccgtg 101 caaaatgttc caccggcacg ccgctgtgtt ggcaagacgg gcgcggctcg 151 aaaaaggtgg actgcgacga gtacggtggc gaacgccggg ccgtgttgcg 201 caaccaaaag cgggggaagc cgcgacgag gagagccgca acgctgggga 251 aaccgagttt ccgggcgagg gacgggggggg ggcgggtgaa cagggcagaa 301 acggggagg ggaagcgatc ggcgagg..
```

This corresponds to the amino acid sequence <SEQ ID 2742; ORF 909.ng>:

```
g909.pep (partial)
    1 MRKTVLILTI SAALLSGCTW ETYQDGSGKT AVRAKCSTGT PLCWQDGRGS

51 KKVDCDEYGG ERRAVLRNQK RGKPATRRAA TLGKPSFRAR DGGGRVNRAE

101 TGEGKRSAR..
```

The following partial DNA sequence was identified in *N. meningitidis* <SEQ ID 2743>:

```
m909.seq
    1 ATGCGTAAAA CCTTCCTCTT CCTGACCGCT GCCGCCGCCC TTTTGTCGGG

51 CTGCGCGTGG GAAACTTATC AAGACGGCAA CGGCAAGACC GCCGTCCGTC

101 AAAAATATCC CGCCGGCACG CCCGTTTATT ACCAAGACGG CAGCTACTCG

151 AAAAATATGA ACTACAACCA ATACCGTCCC GAACGCCATG CCGTGTTACC

201 CAATCAAACC GGCAACAACG CCGACGAAGA GCATCGCCAA CACTGGCAAA

251 AACCAAAGTT TCAAAACCGA TAA
```

This corresponds to the amino acid sequence <SEQ ID 2744; ORF 909>:

```
m909.pep
    1 MRKTFLFLTA AAALLSGCAW ETYQDGNGKT AVRQKYPAGT PVYYQDGSYS

51 KNMNYNQYRP ERHAVLPNQT GNNADEEHRQ HWQKPKFQNR *
```

Computer analysis of this amino acid sequence gave the following results:
Homology with a Predicted ORF from *N. gonorrhoeae*
ORF 909 shows 53.3% identity over a 90 aa overlap with a predicted ORF (ORF 909.ng) from *N. gonorrhoeae*:

```
    m909/g909

10        20        30        40        50        60
    m909.pep     MRKTFLFLTAAAALLSGCAWETYQDGNGKTAVRQKYPAGTPVYYQDGSYSKNMNYNQYRP
                 ||||  :||  :||||||||:||||||||:||||||  |    :|||:  :|||   ||:::  ::|
    g909         MRKTVLILTISAALLSGCTWETYQDGSGKTAVRAKCSTGTPLCWQDGRGSKKVDCDEYGG
                    10        20        30        40        50        60

70        80        90
    m909.pep     ERHAVLPNQTGNNADEEHRQHWQKPKFQNRX
                 ||:|||  ||   ::    ::       ||:|:  |
    g909         ERRAVLRNQKRGKPATRRAATLGKPSFRARDGGGRVNRAETGEGKRSAR
                    70        80        90       100
```

The following partial DNA sequence was identified in *N. meningitidis* <SEQ ID 2745>:

```
a909.seq
  1 ATGCGTAAAA CCTTCCTTAT CCTGATGACT GCCGCCGCCC TTTTGTCGGG

51 CTGCGCGTGG GAAACTTATC AAGACGGCAA CGGCAAGACC GCCGTCCGTC

101 AAAAATATCC CGCCGGCACG CCCGTTTATT ACCAAGACGG CAGCTACTCG

151 AAAAATATGA ACTACAACCA ATACCGTCCC GAACGCCATG CCGTGTTACC

201 CAACCAAACC GGCAACAACG CCGACGAAGA GCATCGCCAA CACTGGCAAA

251 AGCCCAAATT TCAAAACCGA TAA
```

This corresponds to the amino acid sequence <SEQ ID 2746; ORF 909.a>:

```
a909.pep
  1 MRKTFLILMT AAALLSGCAW ETYQDGNGKT AVRQKYPAGT PVYYQDGSYS

51 KNMNYNQYRP ERHAVLPNQT GNNADEEHRQ HWQKPKFQNR *
``` m909/a909 96.7% identity in 90 aa overlap

```
                    10        20        30        40        50        60
    m909.pep     MRKTFLFLTAAAALLSGCAWETYQDGNGKTAVRQKYPAGTPVYYQDGSYSKNMNYNQYRP
                 ||||||:| :|||||||||||||||||||||||||||||||||||||||||||||||||
    a909         MRKTFLILMTAAALLSGCAWETYQDGNGKTAVRQKYPAGTPVYYQDGSYSKNMNYNQYRP
                    10        20        30        40        50        60

70        80        90
    m909.pep     ERHAVLPNQTGNNADEEHRQHWQKPKFQNRX
                 ||||||||||||||||||||||||||||||
    a909         ERHAVLPNQTGNNADEEHRQHWQKPKFQNRX
                    70        80        90
```

The following partial DNA sequence was identified in *N. gonorrhoeae* <SEQ ID 2747>:

```
g910.seq
  1 ATGAAAAAAC TGTTATTGGC CGCCGTTGTT TCCCTAAATG CCGCAACCGC

51 ATTTGCCGGC GACTCTGCCG AGCGTCAGAT TTACGGCGAT CCCCATTTTG

101 AACAAAACCG CACAAAAGCC GTGAAAATGT TGGAACAGCG CGGTTATCAG

151 GTTTACGATG TCGATGCCGA CGACTACTGG GGCAAACCTG TTTTGGAAGT
```

-continued
```
201 GGAAGCCTAT AAAGACGGCC GCGAATACGA CATCGTGTTG TCTTACCCCG

251 ACCTGAAAAT CATCAAAGAG CAGCTCGATC GCTGA
```

This corresponds to the amino acid sequence <SEQ ID 2748; ORF 910.ng>:

```
g910.pep
  1 MKKLLLAAVV SLNAATAFAG DSAERQIYGD PHFEQNRTKA VKMLEQRGYQ

51 VYDVDADDYW GKPVLEVEAY KDGREYDIVL SYPDLKIIKE QLDR*
```

The following partial DNA sequence was identified in *N. meningitidis* <SEQ ID 2749>:

```
m910.seq
  1 ATGAAAAAAC TGTTATTGGC TGCCGTTGTT TCTCTGAGTG CCGCTGCCGC

51 ATTTGCCGGC GACTCTGCCG AGCGTCAGAT TTACGGCGAT CCCCATTTTG

101 AACAAAACCG CACAAAAGCT GTGAAAATGT TGGAGCAGCG CGGTTATCAG

151 GTTTACGATG TCGATGCCGA CGACCATTGG GGTAAGCCTG TGCTGGAAGT

201 GGAAGCCTAT AAAGACGGCC GCGAATACGA CATCGTGTTG TCTTACCCCG

251 ACCTGAAAAT CATCAAAGAG CAGCTCGATC GCTGA
```

This corresponds to the amino acid sequence <SEQ ID 2750; ORF 910>:

```
m910.pep
  1 MKKLLLAAVV SLSAAAAFAG DSAERQIYGD PHFEQNRTKA VKMLEQRGYQ

51 VYDVDADDHW GKPVLEVEAY KDGREYDIVL SYPDLKIIKE
    QLDR*
```

Computer analysis of this amino acid sequence gave the following results:
Homology with a Predicted ORF from *N. gonorrhoeae*
ORF 910 shows 96.8% identity over a 94 aa overlap with a predicted ORF (ORF 910.ng) from *N. gonorrhoeae*:

```
g910/m910

10        20        30        40        50        60
         g910.pep     MKKLLLAAVVSLNAATAFAGDSAERQIYGDPHFEQNRTKAVKMLEQRGYQVYDVDADDYM
                      ||||||||||:||:|||||||||||||||||||||||||||||||||||||||||||||:|
         m910         MKKLLLAAVVSLSAAAAFAGDSAERQIYGDPHFEQNRTKAVKMLEQRGYQVYDVDADDHW
                      10        20        30        40        50        60
                      70        80        90
         g910.pep     GKPVLEVEAYKDGREYDIVLSYPDLKIIKEQLDRX
                      |||||||||||||||||||||||||||||||||||
         m910         GKPVLEVEAYKDGREYDIVLSYPDLKIIKEQLDRX
                      70        80        90
```

The following partial DNA sequence was identified in *N. meningitidis* <SEQ ID 2751>:

```
a910.seq
  1 ATGAAAAAAC TGTTATTGGT CGCCGTTGTT TCCTTGAGTG CCGCAACCGC

51 ATTTGCCGGC GACTCTGCCG AGCGTCAGAT TTACGGCGAT CCCTATTTTG

101 AACAAAACCG CACAAAAGCC GTGAAAATGT TGGAACAGCG CGGTTATCAG

151 GTTCACGATG TCGATGCCGA CGACCATTGG GGCAAACCTG TTTTGGAAGT
```

-continued

```
201 GGAAGCCTAT AAAGACGGCC GCGAATACGA CATTGTGTTG TCTTACCCCG

251 ACCTGAAAAT CATCAAAGAG CAGCTCGATC GCTGA
```

This corresponds to the amino acid sequence <SEQ ID 2752; ORF 910.a>:

```
a910.pep
  1 MKKLLLVAVV SLSAATAFAG DSAERQIYGD PYFEQNRTKA VKMLEQRGYQ

51 VHDVDADDHW GKPVLEVEAY KDGREYDIVL SYPDLKIIKE QLDR*
``` m910/a910 95.7% identity in 94 aa overlap

```
                    10         20         30         40         50         60
   m910.pep  MKKLLLAAVVSLSAAAAFAGDSAERQIYGDPHFEQNRTKAVKMLEQRGYQVYDVDADDHW
             ||||||:||||||||:||||||||||||||:|||||||||||||||||||:||||||||
   a910      MKKLLLVAVVSLSAATAFAGDSAERQIYGDPYFEQNRTKAVKMLEQRGYQVHDVDADDHW
                    10         20         30         40         50         60

70         80         90
   m910.pep  GKPVLEVEAYKDGREYDIVLSYPDLKIIKEQLDRX
             |||||||||||||||||||||||||||||||||||
   a910      GKPVLEVEAYKDGREYDIVLSYPDLKIIKEQLDRX
                    70         80         90
```

The following partial DNA sequence was identified in N. gonorrhoeae <SEQ ID 2753>:

```
g911.seq
  1 ATGAAAAAGA ACATATTGGA ATTTTGGGTC GGACTGTTCG TCTTGATCGG

51 CGCGGCGGCG GTTGCCTTTC TCGCTTTCCG CGTGGCGGGC GGCGCGGCGT

101 TCGGCGGTTC GGACAAAACT TACGCCGTTT ATGCCGATTT CGGCGACATC

151 GGCGGTTTGA AGGTCAATGC CCCCGTCAAA TCCGCAGGCG TATTGGTCGG

201 GCGCGTCGGC GCTATCGGGC TTGACCCGAA ATCCTATCAG GCGAGGGTGC

251 GCCTTGATTT GGACGGCAAG TATCAGTTCA GCAGTGACGT TTCCGCGCAA

301 ATCCTGACTT CGGGACTTTT GGGCGAACAG TACATCGGGC TGCAGCAGGG

351 CGGCGATACG GAAAACCTTG CTGCCGGCGA CACCATCTCC GTAACCAGTT

401 CTGCAATGGT TCTGGAAAAC CTGATCGGTA AATTCATGAC CAGCTTCGCC

451 GAGAAAAACG CTGAGGGCGG CAATGCGGAA AAAGCCGcag aAtaa
```

This corresponds to the amino acid sequence <SEQ ID 2754; ORF 911.ng>:

```
g911.pep
  1 MKKNILEFWV GLFVLIGAAA VAFLAFRVAG GAAFGGSDKT YAVYADFGDI

51 GGLKVNAPVK SAGVLVGRVG AIGLDPKSYQ ARVRLDLDGK YQFSSDVSAQ

101 ILTSGLLGEQ YIGLQQGGDT ENLAAGDTIS VTSSAMVLEN LIGKFMTSFA

151 EKNAEGGNAE KAAE*
```

The following partial DNA sequence was identified in N. meningitidis <SEQ ID 2755>:

```
m911.seq
  1 ATGAAGAAGA ACATATTGGA ATTTTGGGTC GGACTGTTCG TCCTGATTGG
```

-continued
```
 51 CGCGGCGGCG GTTGCCTTTC TCGCTTTCCG CGTGGCCGGC GGTGCGGCGT

101 TCGGCGGTTC GGACAAAACT TACGCCGTTT ATGCCGATTT CGGCGACATC

151 GGCGGTTTGA AGGTCAATGC CCCCGTCAAA TCCGCAGGCG TATTGGTCGG

201 GCGCGTCGGC GCTATCGGAC TTGACCCGAA ATCCTATCAG GCGAGGGTGC

251 GCCTCGATTT GGACGGCAAG TATCAGTTCA GCAGCGACGT TTCCGCGCAA

301 ATCCTGACTT CGGGACTTTT GGGCGAGCAG TACATCGGGC TGCAGCAGGG

351 CGGCGACACG GAAAACCTTG CTGCCGGCGA CACCATCTCC GTAACCAGTT

401 CTGCAATGGT TCTGGAAAAC CTTATCGGCA AATTCATGAC GAGTTTTGCC

451 GAGAAAAATG CCGACGGCGG CAATGCGGAA AAAGCCGCCG AATAA
```

This corresponds to the amino acid sequence <SEQ ID 2756; ORF 911>:

```
m911.pep
  1 MKKNILEFWV GLFVLIGAAA VAFLAFRVAG GAAFGGSDKT YAVYADFGDI

51 GGLKVNAPVK SAGVLVGRVG AIGLDPKSYQ ARVRLDLDGK YQFSSDVSAQ

101 ILTSGLLGEQ YIGLQQGGDT ENLAAGDTIS VTSSAMVLEN LIGKFMTSFA

151 EKNADGGNAE KAAE*
```

Computer analysis of this amino acid sequence gave the following results:

Homology with a Predicted ORF from *N. gonorrhoeae*

ORF 911 shows 99.4% identity over a 164 aa overlap with a predicted ORF (ORF 911.ng) from *N. gonorrhoeae*:

```
    g911/m911

10         20         30         40         50         60
        g911.pep    MKKNILEFWVGLFVLIGAAAVAFLAFRVAGGAAFGGSDKTYAVYADFGDIGGLKVNAPVK
                    ||||||||||||||||||||||||||||||||||||||||||||||||||||||||||||
        m911        MKKNILEFWVGLFVLIGAAAVAFLAFRVAGGAAFGGSDKTYAVYADFGDIGGLKVNAPVK
                    10         20         30         40         50         60
                    70         80         90         100        110        120
        g911.pep    SAGVLVGRVGAIGLDPKSYQARVRLDLDGKYQFSSDVSAQILTSGLLGEQYIGLQQGGDT
                    ||||||||||||||||||||||||||||||||||||||||||||||||||||||||||||
        m911        SAGVLVGRVGAIGLDPKSYQARVRLDLDGKYQFSSDVSAQILTSGLLGEQYIGLQQGGDT
                    70         80         90         100        110        120
                    130        140        150        160
        g911.pep    ENLAAGDTISVTSSAMVLENLIGKFMTSFAEKNAEGGNAEKAAEX
                    |||||||||||||||||||||||||||||||:|||||||||
        m911        ENLAAGDTISVTSSAMVLENLIGKFMTSFAEKNADGGNAEKAAEX
                    130        140        150        160
```

The following partial DNA sequence was identified in *N. meningitidis* <SEQ ID 2757>:

```
a911.seq
  1 ATGAAAAAGA ACATATTGGA ATTTTGGGTC GGACTGTTCG TCCTGATTGG

51 CGCGGCGGCG GTTGCCTTTC TCGCTTTCCG CGTGGCCGGC GGTGCGGCGT

101 TCGGCGGTTC GGACAAAACT TACGCCGTTT ATGCCGATTT CGGCGACATC

151 GGCGGTTTGA AGGTCAATGC CCCCGTCAAA TCCGCAGGCG TATTGGTCGG

201 GCGCGTCGGC GCTATCGGAC TTGACCCGAA ATCCTATCAG GCGAGGGTGC

251 GCCTCGATTT GGACGGCAAG TATCAGTTCA GCAGCGACGT TTCCGCGCAA

301 ATCCTGACTT CGGGACTTTT GGGCGAGCAG TACATCGGGC TGCAGCAGGG
```

-continued
```
351 CGGCGACACG GAAAACCTTG CTGCCGGCGA CACCATCTCC GTAACCAGTT

401 CTGCAATGGT TCTGGAAAAC CTTATCGGCA AATTCATGAC GAGTTTTGCC

451 GAGAAAAATG CCGACGGCGG CAATGCGGAA AAAGCCGCCG AATAA
```

This corresponds to the amino acid sequence <SEQ ID 2758; ORF 911.a>:

```
a911.pep
  1 MKKNILEFWV GLFVLIGAAA VAFLAFRVAG GAAFGGSDKT YAVYADFGDI

51 GGLKVNAPVK SAGVLVGRVG AIGLDPKSYQ ARVRLDLDGK YQFSSDVSAQ

101 ILTSGLLGEQ YIGLQQGGDT ENLAAGDTIS VTSSAMVLEN LIGKFMTSFA

151 EKNADGGNAE KAAE*
``` m911/a911 100.0% identity in 164 aa overlap

```
                  10         20         30         40         50         60
    m911.pep   MKKNILEFWVGLFVLIGAAAVAFLAFRVAGGAAFGGSDKTYAVYADFGDIGGLKVNAPVK
               ||||||||||||||||||||||||||||||||||||||||||||||||||||||||||||
    a911       MKKNILEFWVGLFVLIGAAAVAFLAFRVAGGAAFGGSDKTYAVYADFGDIGGLKVNAPVK
                  10         20         30         40         50         60

70         80         90        100        110        120
    m911.pep   SAGVLVGRVGAIGLDPKSYQARVRLDLDGKYQFSSDVSAQILTSGLLGEQYIGLQQGGDT
               ||||||||||||||||||||||||||||||||||||||||||||||||||||||||||||
    a911       SAGVLVGRVGAIGLDPKSYQARVRLDLDGKYQFSSDVSAQILTSGLLGEQYIGLQQGGDT
                  70         80         90        100        110        120

130        140        150        160
    m911.pep   ENLAAGDTISVTSSAMVLENLIGKFMTSFAEKNADGGNAEKAAEX
               |||||||||||||||||||||||||||||||||||||||||||||
    a911       ENLAAGDTISVTSSAMVLENLIGKFMTSFAEKNADGGNAEKAAEX
                 130        140        150        160
```

The following partial DNA sequence was identified in *N. gonorrhoeae* <SEQ ID 2759>:

```
g912.seq
  1 gtgAAAAaat cctcctTcat cagcGCATTG GGCATCGgtA TTTTGAGCAT

51 CGGCATGGCA TTTGCCTCCC CGGCCGACGC AGTGGGACAA ATCCGCCAAA

101 ACGCCACACA GGTTTTGACC ATCCTCAAAA GCGGCGACGC GGCTTCTGCA

151 CGCCCAAAAG CCGAAGCCTA TGCGGTTCCC TATTTCGATT CCAACGTAT

201 GACCGCATTG GCGGTCGGCA ACCCTTGGCG TACCGCGTCC GACGCGCAAA

251 AACAAGCGTT GGCCAAAGAA TTTCAAACCC TGCTGATCCG CACCTATTCC

301 GGCACGATGC TGAAATTCAA AAACGCGACC GTCAACGTCA AGACAATCC

351 CATCGTCAAT AAGGGCGGCA AGGAAATCGT CGTCCGTGCC GAAGTCGGCA

401 TCCCCGGTCA GAAGCCCGTC AATATGGACT TTACCACCTA CCAAAGCGGC

451 GGCAAATACC GTACCTACAA CGTCGCCATC GAAGGCACGA GCCTGGTTAC

501 CGTGTACCGC AACCAATTCG GCGAAATCAT CAAAGCCAAA GGCATCGACG

551 GGCTGATTGC CGAGTTGAAA GCCAAAAACG GCGGCAAATA A
```

This corresponds to the amino acid sequence <SEQ ID 2760; ORF 912.ng>:

```
g912.pep
  1 VKKSSFISAL GIGILSIGMA FASPADAVGQ IRQNATQVLT ILKSGDAASA
```

-continued

```
 51 RPKAEAYAVP YFDFQRMTAL AVGNPWRTAS DAQKQALAKE FQTLLIRTYS

101 GTMLKFKNAT VNVKDNPIVN KGGKEIVVRA EVGIPGQKPV NMDFTTYQSG

151 GKYRTYNVAI EGTSLVTVYR NQFGEIIKAK GIDGLIAELK AKNGGK*
```

The following partial DNA sequence was identified in *N. meningitidis* <SEQ ID 2761>:

```
m912.seq
  1 ATGAAAAAAT CCTCCCTCAT CAGCGCATTG GGCATCGGTA TTTTGAGCAT

51 CGGCATGGCA TTTGCCGCCC CTGCCGACGC GGTAAGCCAA ATCCGTCAAA

101 ACGCCACTCA AGTATTGAGC ATCTTAAAAA ACGGCGATGC CAACACCGCT

151 CGCCAAAAAG CCGAAGCCTA TGCGATTCCC TATTTCGATT TCCAACGTAT

201 GACCGCATTG GCGGTCGGCA ACCCTTGGCG CACCGCGTCC GACGCGCAAA

251 AACAAGCGTT GGCCAAAGAA TTTCAAACCC TGCTGATCCG CACCTATTCC

301 GGCACGATGC TGAAATTAAA AAACGCCAAC GTCAACGTCA AGACAATCC

351 CATCGTCAAT AAAGGCGGCA AAGAAATCAT CGTCCGCGCC GAAGTCGGCG

401 TACCCGGGCA AAAACCCGTC AACATGGACT TCACCACCTA CCAAAGCGGC

451 GGTAAATACC GTACCTACAA CGTCGCCATC GAAGGCGCGA GCCTGGTTAC

501 CGTGTACCGC AACCAATTCG GCGAAATTAT CAAAGCGAAA GGCGTGGACG

551 GACTGATTGC CGAGTTGAAA GCCAAAAACG GCGGCAAATA A
```

This corresponds to the amino acid sequence <SEQ ID 2762; ORF 912>:

```
m912.pep
  1 MKKSSLISAL GIGILSIGMA FAAPADAVSQ IRQNATQVLS ILKNGDANTA

51 RQKAEAYAIP YFDFQRMTAL AVGNPWRTAS DAQKQALAKE FQTLLIRTYS

101 GTMLKLKNAN VNVKDNPIVN KGGKEIIVRA EVGVPGQKPV NMDFTTYQSG

151 GKYRTYNVAI EGASLVTVYR NQFGEIIKAK GVDGLIAELK AKNGGK*
```

Computer analysis of this amino acid sequence gave the following results:
Homology with a Predicted ORF from *N. gonorrhoeae*
ORF 912 shows 91.8% identity over a 196 aa overlap with a predicted ORF (ORF 912.ng) from *N. gonorrhoeae*:

```
    g912/m912

10        20        30        40        50        60
         g912.pep  VKKSSFISALGIGILSIGMAFASPADAVGQIRQNATQVLTIKLSGDAASARPKAEAYAVP
                   :||||:||||||||||||||:|||||:|||||||||||||:|||:|||  :|| ||||||:|
         m912      MKKSSLISALGIGILSIGMAFAAPADAVSQIRQNATQVLSILKNGDANTARQKAEAYAIP
                       10        20        30        40        50        60

70        80        90       100       110       120
         g912.pep  YFDFQRMTALAVGNPWRTASDAQKQALAKEFQTLLIRTYSGTMLKFKNATVNVKDNPIVN
                   ||||||||||||||||||||||||||||||||||||||||||||||:|||:|||||||||
         m912      YFDFQRMTALAVGNPWRTASDAQKQALAKEFQTLLIRTYSGTMLKLKNANVNVKDNPIVN
                       70        80        90       100       110       120

130       140       150       160       170       180
         g912.pep  KGGKEIVVRAEVGIPGQKPVNMDFTTYQSGGKYRTYNVAIEGTSLVTVYRNQFGEIIKAK
                   ||||||:||||||:|||||||||||||||||||||||||||||:|||||||||||||||
         m912      KGGKEIIVRAEVGVPGQKPVNMDFTTYQSGGKYRTYNVAIEGASLVTVYRNQFGEIIKAK
                      130       140       150       160       170       180
```

```
                        190
     g912.pep    GIDGLIAELKAKNGGKX
                 |:||||||||||||||
     m912        GVDGLIAELKAKNGGKX
                        190
```

The following partial DNA sequence was identified in *N. meningitidis* <SEQ ID 2763>:

```
a912.seq
   1 ATGAAAAAAT CCTCCTTCAT CAGCGCATTG GGCATCGGTA TTTTGAGCAT

51 CGGCATGGCA TTTGCCGCCC CTGCCGACGC GGTAAACCAA ATCCGTCAAA

101 ACGCCACTCA AGTATTGAGC ATCTTAAAAA GCGGTGATGC CAACACCGCC

151 CGCCAAAAAG CCGAAGCCTA TGCGATTCCC TATTTCGATT TCCAACGTAT

201 GACCGCATTG GCGGTCGGCA ACCCTTGGCG CACCGCGTCC GACGCGCAAA

251 AACAAGCGTT GGCCAAAGAA TTTCAAACCC TGCTGATCCG CACCTATTCC

301 GGCACGATGC TGAAATTAAA AAACGCCAAC GTCAACGTCA AGACAATCC

351 CATCGTCAAT AAAGGCGGCA AGAAATCAT CGTCCGCGCC GAAGTCGGCG

401 TACCCGGGCA AAAACCCGTC AACATGGACT TCACCACCTA CCAAAGCGGC

451 GGTAAATACC GTACCTACAA CGTCGCCATC GAAGGCGCGA GCCTGGTTAC

501 CGTGTACCGC AACCAATTCG GCGAAATTAT CAAAGCGAAA GGCGTGGACG

551 GACTGATTGC CGAGTTGAAG GCTAAAAACG GCAGCAAGTA A
```

This corresponds to the amino acid sequence <SEQ ID 2764; ORF 912.a>:

```
a912.pep
   1 MKKSSFISAL GIGILSIGMA FAAPADAVNQ IRQNATQVLS ILKSGDANTA

51 RQKAEAYAIP YFDFQRMTAL AVGNPWRTAS DAQKQALAKE FQTLLIRTYS

101 GTMLKLKNAN VNVKDNPIVN KGGKEIIVRA EVGVPGQKPV NMDFTTYQSG

151 GKYRTYNVAI EGASLVTVYR NQFGEIIKAK GVDGLIAELK AKNGSK*
``` m912/a912 98.0% identity in 196 aa overlap

```
                  10        20        30        40        50        60
  m912.pep MKKSSLISALGIGILSIGMAFAAPADAVSQIRQNATQVLSILKNGTANTARQKAEAYAIP
           |||||:||||||||||||||||||||||:|||||||||||||:|||||||||||||||||
  a912     MKKSSFISALGIGILSIGMAFAAPADAVNQIRQNATQVLSILKSGDANTARQKAEAYAIP
                  10        20        30        40        50        60

70        80        90       100       110       120
  m912.pep YFDFQRMTALAVGNPWRTASDAQKQALAKEFQTLLIRTYSGTMLKLKNANVNVKDNPIVN
           ||||||||||||||||||||||||||||||||||||||||||||||||||||||||||||
  a912     YFDFQRMTALAVGNPWRTASDAQKQALAKEFQTLLIRTYSGTMLKLKNANVNVKDNPIVN
                  70        80        90       100       110       120

130       140       150       160       170       180
  m912.pep KGGKEIIVRAEVGVPGQKPVNMDFTTYQSGGKYRTYNVAIEGASLVTVYRNQFGEIIKAK
           ||||||||||||||||||||||||||||||||||||||||||||||||||||||||||||
  a912     KGGKEIIVRAEVGVPGQKPVNMDFTTYQSGGKYRTYNVAIEGASLVTVYRNQFGEIIKAK
                 130       140       150       160       171       180

190
  m912.pep GVDGLIAELKAKNGGKX
           |||||||||||||:||
  a912     GVDGLIAELKAKNGSKX
                 190
```

The following partial DNA sequence was identified in *N. gonorrhoeae* <SEQ ID 2765>:

```
g913.seq
   1 atGAAAAAAA CCGCCTACGC CATCCTCCTG CTGATCGGGT TCGCTTCCGC

51 CCCTGCATTT GCAGAAACCC GCCCCGCCGA CCCTTATGAA GGCTACAACC

101 GCGCCGTTTC CAAATTCAAC GACCAAGCCG ACCGCTACAT TTTCGCCCCT

151 GCCGCGCGCG GCTACCGCAA AGTTACGCCG AAACCCGTCC GCGCCGGCGT

201 GTCCAATTTT TTTAACAACC TGCGCGACGT GGTCAGTTTC GGCAGCAATA

251 TCTTGCGTTT GGAcatCAAA cgcgcAAGcg aAGACCtcgT CCGcgtcggc 301 atCAATACCA CCTTCGGTTT GGgcgGGCTC ATTGATATTG CCGGcgcGGg 351 cggcgttccc gacaataaaa AcacTttgGg cgacacgttt gcctcgtGGG 401 GctgGAAAaa cagcaATTAT TTCGTgttgc CCGtcttagg cccgtccacc 451 gtccgcgacg cgctcggcac gggcattacc tCTGTTTATC CGCccaagaa 501 tatcgttttc catacccctg ccggacgctg GGgcacgact gCCGCTGCCG 551 CCGTcagtac gcgcgaaggc ctcctcgatt tgaccgacag TCtggacgaa 601 gccgccatCG ACAAATACAG CTACACGCGc gacctctata tgAAAGTCCG 651 CGcacgGCag AccgGTGCAA CACCTGCCGA AGgtacggaa gataacatcg 701 acatcgacat cgACGAATTG GTCGAAAGTG CCGAAACCGG CGCGGCAGAG

751 CCCGCCGTTC ACGAAGATTC CGTATCCGAA ACACAGGCAG AAGCAGCAGG

801 GGAAGCCGAA ACGCAACCTG GAACACAACC CTAA
```

This corresponds to the amino acid sequence <SEQ ID 2766; ORF 913.ng>:

```
g913.pep
   1 MKKTAYAILL LIGFASAPAF AETRPADPYE GYNRAVSKFN DQADRYIFAP

51 AARGYRKVTP KPVRAGVSNF FNNLRDVVSF GSNILRLDIK RASEDLVRVG

101 INTTFGLGGL IDIAGAGGVP DNKNTLGDTF ASWGWKNSNY FVLPVLGPST

151 VRDALGTGIT SVYPPKNIVF HTPAGRWGTT AAAAVSTREG LLDLTDSLDE

201 AAIDKYSYTR DLYMKVRARQ TGATPAEGTE DNIDIDIDEL VESAETGAAE

251 PAVHEDSVSE TQAEAAGEAE TQPGTQP*
```

The following partial DNA sequence was identified in *N. meningitidis* <SEQ ID 2767>:

```
m913.seq
   1 ATGAAAAAAA CCGCCTATGC CTTCCTCCTG CTGATCGGGT TCGCTTCCGC

51 CCCTGCATTT GCCGAAACCC GCCCCGCCGA CCCTTATGAA GGCTACAACC

101 GCGCCGTTTT CAAATTCAAC GACCAAGCCG ACCGCTACAT TTTCGCCCCT

151 GCCGCGCGCG GCTACCGCAA AGTTGCGCCG AAACCCGTCC GCGCCGGCGT

201 GTCCAATTTT TTTAACAACC TGTGCGACGT GGTCAGCTTC GGCAGCAATA

251 TCTTGCGCTT GGACATCAAA CGCGCAAGCG AAGACCTTGT CCGCGTCGGC

301 ATCAACACCA CCTTTCGGTTT GGGCGGGCTT ATCGACATCG CCGGCGCGGG

351 CGGCATTCCC GACAATAAAA ACACCTTGGG CGACACGTTT GCCTCGTGGG

401 GATGGAAAAA CAGCAATTAT TTCGTGTTGC CCGTCTTAGG GCCGTCCACC
```

```
451 GTCCGCGACG CGCTCGGCAC GGGTATTACC TCCGTTTATT CGCCCAAGAA

501 TATCGTCTTC CGCACCCCTG TCGGACGCTG GGGCACGACT GCCGTATCCG

551 CCGTCAGTAC GCGCGAAGGC CTgCTCGATT TGACCGACAG TCTGGACGAA

601 GCCGCCATCG ACAAATACAG CTACACGCGC GACCTCTATA TGAAAGTCCG

651 TGCGCGGCAG ACCGGTGCAA CACCTGCCGA AGgTACGGAA GATAACATCG

701 ACATCGACGA ATTGGTCGAA AGTGCCGAAA CCGGCGCGGC GGAAACTGCC

751 GTTCAAGAAG ATTCCGTATC CGAAACACAG GCAGAAGCAG CAGGGGAAGC

801 CGAAACGCAA CCTGGAACAC AACCTTAA
```

This corresponds to the amino acid sequence <SEQ ID 2768; ORF 913>:

```
m913.pep
  1 MKKTAYAFLL LIGFASAPAF AETRPADPYE GYNRAVFKFN DQADRYIFAP

51 AARGYRKVAP KPVRAGVSNF FNNLCDVVSF GSNILRLDIK RASEDLVRVG

101 INTTFGLGGL IDIAGAGGIP DNKNTLGDTF ASWGWKNSNY FVLPVLGPST

151 VRDALGTGIT SVYSPKNIVF RTPVGRWGTT AVSAVSTREG LLDLTDSLDE

201 AAIDKYSYTR DLYMKVRARQ TGATPAEGTE DNIDIDELVE SAETGAAETA

251 VQEDSVSETQ AEAAGEAETQ PGTQP*
```

Computer analysis of this amino acid sequence gave the following results:
Homology with a Predicted ORF from *N. gonorrhoeae*
ORF 913 shows 94.9% identity over a 277 aa overlap with a predicted ORF (ORF 913.ng) from *N. gonorrhoeae*:

```
g913/m913

10         20         30         40         50         60
      g913.pep  MKKTAYAILLLIGFASAPAFAETRPADPYEGYNRAVSKFNDQADRYIFAPAARGYRKVTP
                |||||||:||||||||||||||||||||||||||| |||||||||||||||||||||:|
      m913      MKKTAYAFLLLIGFASAPAFAETRPADPYEGYNRAVFKFNDQADRYIFAPAARGYRKVAP
                     10         20         30         40         50         60

70         80         90        100        110        120
      g913.pep  KPVRAGVSNFFNNLRDVVSFGSNILRLDIKRASEDLVRVGINTTFGLGGLIDIAGAGGVP
                ||||||||||||| ||||||||||||:|||||||||||||||||||||||||||||:|
      m913      KPVRAGVSNFFNNLCDVVSFGSNILRIDIKRASEDLVRVGINTTFGLGGLIDIAGAGGIP
                     70         80         90        100        110        120

130        140        150        160        170        180
      g913.pep  DNKNTLGDTFASWGWKNSNYFVLPVLGPSTVRDALGTGITSVYPPKNIVFHTPAGRWGTT
                ||||||||||||||||||||||||||||||||||||||||||:||||||:||||||
      m913      DNKNTLGDTFASWGWKNSNYFVLPVLGPSTVRDALGTGITSVYSPKNIVFRTPVGRWGTT
                    130        140        150        160        170        180

190        200        210        220        230        240
      g913.pep  AAAAVSTREGLLDLTDSLDEAAIDKYSYTRDLYMKVRARQTGATPAEGTEDNIDIDIDEL
                |::||||||||||||||||||||||||||||||||||||||||||||||||||  |||
      m913      AVSAVSTREGLLDLTDSLDEAAIDKYSYTRDLYMKVRARQTGATPAEGTEDNIDI--DEL
                    190        200        210        220        230

250        260        270
      g913.pep  VESAETGAAEPAVHEDSVSETQAEAAGEAETQPGTQPX
                |||||||||| ||:||||||||||||||||||||||
      m913      VESAETGAAETAVQEDSVSETQAEAAGEAETQPGTQPX
                    240        250        260        270
```

The following partial DNA sequence was identified in *N. meningitidis* <SEQ ID 2769>:

```
a913.seq
  1 ATGAAAAAAA CCGCCTATGC CTTCCTCCTG CTGATCGGGT TCGCTTCCGC
```

```
 51 CCCTGCATTT GCCGAAACCC GCCCCGCCGA CCCTTATGAA GGCTACAACC

101 GCGCCGTTTT CAAATTCAAC GACCAAGCCG ACCGCTACAT TTTCGCCCCT

151 GCCGCGCGCG GCTACCGCAA AGTTGCGCCG AAACCCGTCC GCGCCGGCGT

201 GTCCAATTTT TTTAACAACC TGTGCGACGT GGTCAGCTTC GGCAGCAATA

251 TCTTGCGCTT AGACATCAAA CGCGCAAGCG AAGACCTTGT CCGCGTCGGT

301 ATCAACACCA CTTTCGGTTT GGGCGGGCTT ATCGACATCG CCGGCGCGGG

351 CGGCATTCCC GACAATAAAA ACACCTTGGG CGACACGTTT GCTTCGTGGG

401 GATGGAAAAA CAGCAATTAT TTCGTGTTGC CCGTCTTAGG GCCGTCCACC

451 GTCCGCGACG CGCTCGGCAC GGGTATTACC TCCGTTTATT CGCCCAAGAA

501 TATCGTCTTC CGCACCCCTG TCGGACGCTG GGGCACGACT GCCGTATCCG

551 CCGTCAGTAC GCGCGAAGGC CTGCTCGATT TGACCGACAG TCTGGACGAA

601 GCCGCCATCG ACAAATACAG CTACACGCGC GACCTCTATA TGAAAGTCCG

651 TGCGCGGCAG ACCGGTGCAA CACCTGCCGA AGGTACGGAA GATAACATCG

701 ACATCGACGA ATTGGTCGAA AGTGCCGAAA CCGGCGCGGC GGAAACTGCC

751 GTTCAAGAAG ATTCCGTATC CGAAACACAG GCAGAAGCAG CAGGGGAAGC

801 CGAAACGCAA CCTGGAACAC AACCTGGAAC ACAACCTTAA
```

This corresponds to the amino acid sequence <SEQ ID 2770; ORF 913.a>:

```
a913.pep
  1 MKKTAYAFLL LIGFASAPAF AETRPADPYE GYNRAVFKFN DQADRYIFAP

51 AARGYRKVAP KPVRAGVSNF FNNLCDVVSF GSNILRLDIK RASEDLVRVG

101 INTTFGLGGL IDIAGAGGIP DNKNTLGDTF ASWGWKNSNY FVLPVLGPST

151 VRDALGTGIT SVYSPKNIVF RTPVGRWGTT AVSAVSTREG LLDLTDSLDE

201 AAIDKYSYTR DLYMKVRARQ TGATPAEGTE DNIDIDELVE SAETGAAETA

251 VQEDSVSETQ AEAAGEAETQ PGTQPGTQP*
``` m913/a913 100.0% identity in 275 aa overlap

```
                  10         20         30         40         50         60
   m913.pep  MKKTAYAFLLLIGFASAPAFAETRPADPYEGYNRAVFKFNDQADRYIFAPAARGYRKVTP
             ||||||||||||||||||||||||||||||||||||||||||||||||||||||||| |
   a913      MKKTAYAFLLLIGFASAPAFAETRPADPYEGYNRAVFKFNDQADRYIFAPAARGYRKVAP
                  10         20         30         40         50         60

70         80         90        100        110        120
   m913.pep  KPVRAGVSNFFNNLCDVVSFGSNILRLDIKRASEDLVRVGINTTFGLGGLIDIAGAGGIP
             |||||||||||||||||||||||||| ||||||||||||||||||||||||||||||||
   a913      KPVRAGVSNFFNNLCDVVSFGSNILRIDIKRASEDLVRVGINTTFGLGGLIDIAGAGGIP
                  70         80         90        100        110        120

130        140        150        160        170        180
   m913.pep  DNKNTLGDTFASWGWKNSNYFVLPVLGPSTVRDALGTGITSVYSPKNIVFRTPVGRWGTT
             ||||||||||||||||||||||||||||||||||||||||||||||||||||||||||||
   a913      DNKNTLGDTFASWGWKNSNYFVLPVLGPSTVRDALGTGITSVYSPKNIVFRTPVGRWGTT
                 130        140        150        160        170        180

190        200        210        220        230        240
   m913.pep  AVSAVSTREGLLDLTDSLDEAAIDKYSYTRDLYMKVRARQTGATPAEGTEDNIDIDELVE
             ||||||||||||||||||||||||||||||||||||||||||||||||||||||||||||
   a913      AVSAVSTREGLLDLTDSLDEAAIDKYSYTRDLYMKVRARQTGATPAEGTEDNIDIDELVE
                 190        200        210        220        230        240
```

```
                       250        260        270
    g913.pep   SAETGAAETAVQEDSVSETQAEAAGEAETQPGTQPX
               |||||||||||||||||||||||||||||||||||
    m913       SAETGAAETAVQEDSVSETQAEAAGEAETQPGTQPGTQPX
                       250        260        270        280
```

The following partial DNA sequence was identified in *N. gonorrhoeae* <SEQ ID 2771>:

```
g914.seq
    1 ATGAAAAAAT GTATTTTGGG CATTTTGACC GCGTGTGCCG CCATGCCTGC

51 ATTTGCCGAC AGAATCAGCG ATTTGGAAGC ACGTCTGGCG CAGTTGGAAC

101 ACCGTGTCGC CGTATTGGAA AGCGGCGGCA ATACCGTCAA AATCGACCTT

151 TTCGGTTCAA ATTCCACCAT GTATGTATGC AGCGTTACGC CTTTTCAGAA

201 GacgtttGag gCAAGCGATC GGAATGAAGG CGTGGCGCGG CAGAAAGTGC

251 GTCAGGCGTG CAACCGCGAA ACTTCGGCAA TGTTTTGCGG AGATGAGGCA

301 ATCCGATGCA GAAAATTCGA TTGATGTATC GGTTGGACGA ATAAAGAAAC

351 GGATACGGAG CTTGGCTTCC GTCTCTGTTT TTCTCTGCCC GATTTTCCAT

401 GCATCGGGTT TCAGACGGCA TTGGAGTGTC AGTCGTGTTC TGCCGATTCG 451 taggctTCGA CGATTTTTTG CACCAGAGGA TGCCGGACAA CGTCTTCGCC

501 GGTGAAGGTA TGGAAATACA GTCCTGCCAC GCCGTGCAGT TTCTCACGTG

551 CGTCTTTCAA TCCCGATTTG ATGTTTTTGG GCAGGTcgaT TTGGCTGGTG

601 TCGCCGGTAA TGACGGCTTT CGCgccgaag ccGATGCGGG TCAGGAACAT

651 TTTCATTTGT TCGGGCGTGg tgTtttGcgC TTCGTCGAGG ATGATGTATG

701 CGCCGTTGAg cgTCCTGCCG CGCATATAG
```

This corresponds to the amino acid sequence <SEQ ID 2772; ORF 914.ng>:

```
g914.pep
    1 MKKCILGILT ACAAMPAFAD RISDLEARLA QLEHRVAVLE SGGNTVKIDL

51 FGSNSTMYVC SVTPFQKTFE ASDRNEGVAR QKVRQACNRE TSAMFCGDEA

101 IRCRKFD*CI GWTDKETDTE LGFRLCFSLP DFPCIGFQTA LECQSCSADS

151 *ASTIFCTRG CRTTSSPVKV WKYSPATPCS FSRASFNPDL MFLGRSIWLV

201 SPVMTAFAPK PMRVRNIFIC SGVVFCASSR MMYAPLSVLP
      RI*
```

The following partial DNA sequence was identified in *N. meningitidis* <SEQ ID 2773>:

```
m914.seq
    1 ATGAAAAAAT GTATTTTGGG CATTTTGACC GCGTGTGCCG CCATGCCTGC

51 ATTTGCCGAC AGAATCGGCG ATTTGGAAGC ACGTCTGGCG CAGTTGGAAC

101 ACCGTGTCGC CGTATTGGAA AGCGGCGGCA ATACCGTCAA AATCGACCTT

151 TTCGGTTCAA ATTCCACCAT GTATGTATGC AGCGTTACGC CTTTTCAGAA

201 GACGTTTGAG GCAAGCGATC GGAATGAAGG CGTGGCGCGG CAGAAAGTGC

251 GTCAGGCGTG CAACCGCGAA ACTTCGGCAA TGTTTTGCGA AGATGAGGCA

301 ATCCGATGCA GAAAATTCGA TTGATGTATC GGTTGGACGG ATAAAGAAAC
```

```
-continued
351 GGATACGGAT ACGGAGCTTG GCTTCCGTAT CTGTTTTTCT CTGCCTGATT

401 TTCCATGCAT CGGGTTTCAG ACGGCATTGG AATGTCAGTC GTGTTCTGCC

451 GATTCGTAGG CTTCGACGAT TTTTTGCACC AAAGGATGCC GGACAACGTC

501 TTCGCCGGTA AAGGTGTGGA AATACAGCCC TTCCACGTTG TGCAGTTTCT

551 CACGCGCATC TTTTAATCCC GATTTGATGT TTTTGGGCAG GTCGATTTGG

601 CTGGTGTCGC CGGTAATGAC GGCTTTCGCG CCGAAGCCGA TGCGGGTCAG

651 GAACATTTTC ATTTGTTCGG GCGTGGTGTT TTGCGCTTCG TCGAGGATGA

701 TGTATGCGCC GTTGAGCGTC CTGCCGCGCA TATAG
```

This corresponds to the amino acid sequence <SEQ ID 2774; ORF 914>:

```
m914.pep
  1 MKKCILGILT ACAAMPAFAD RIGDLEARLA QLEHRVAVLE SGGNTVKIDL

51 FGSNSTMYVC SVTPFQKTFE ASDRNEGVAR QKVRQACNRE TSAMFCEDEA

101 IRCRKFDXCI GWTDKETDTD TELGFRICFS LPDFPCIGFQ TALECQSCSA

151 DSXASTIFCT KGCRTTSSPV KVWKYSPSTL CSFSRASFNP DLMFLGRSIW

201 LVSPVMTAFA PKPMRVRNIF ICSGVVFCAS SRMMYAPLSV
    LPRI*
```

Computer analysis of this amino acid sequence gave the following results:
Homology with a Predicted ORF from *N. gonorrhoeae*
ORF 914 shows 96.7% identity over a 244 aa overlap with a predicted ORF (ORF 914.ng) from *N. gonorrhoeae*:

```
g914/m914
                        10         20         30         40         50         60
          g914.pep     MKKCILGILTACAAMPAFADRISDLEARLAQLEHRVAVLESGGNTVKIDLFGSNSTMYVC
                       ||||||||||||||||||||||:|||||||||||||||||||||||||||||||||||||
          m914         MKKCILGILTACAAMPAFADRIGDLEARLAQLEHRVAVLESGGNTVKIDLFGSNSTMYVC
                        10         20         30         40         50         60

70         80         90        100        110        119
          g914.pep     SVTPFQKTFEASDRNEGVARQKVRQACNRETSAMFCGDEAIRCRKFDXCIGWTDKETDT-
                       |||||||||||||||||||||||||||||||||||| |||||||||||||||||||||
          m914         SVTPFQKTFEASDRNEGVARQKVRQACNRETSAMFCEDEAIRCRKFDXCIGWTDKETDTD
                        70         80         90        100        110        120

120        130        140        150        160        170
          g914.pep     -ELGFRLCFSLPDFPCIGFQTALECQSCSADSXASTIFCTRGCRTTSSPVKVWKYSPATP
                        |||| :||||||||||||||||||||||||||||||||| ||||||||||||||||| :|
          m914         TELGFRICFSLPDFPCIGFQTALECQSCSADSXASTIFCTKGCRTTSSPVKVWKYSPSTL
                       130        140        150        160        170        180

180        190        200        210        220        230
          g914.pep     CSFSRASFNPDLMFLGRSIWLVSPVMTAFAPKPMRVRNIFICSGVVFCASSRMMYAPLSV
                       ||||||||||||||||||||||||||||||||||||||||||||||||||||||||||||
          m914         CSFSRASFNPDLMFLGRSIWLVSPVMTAFAPKPMRVRNIFICSGVVFCASSRMMYAPLSV
                       190        200        210        220        230        240

240
          g914.pep     LPRIX
                       |||||
          m914         LPRIX
```

The following partial DNA sequence was identified in *N. meningitidis* <SEQ ID 2775>:

```
a914.seq
  1 ATGAAAAAAT GTATTTTGGG CATTTTGACC GCGTGTGCCG CCATGCCTGC

51 ATTTGCCGAC AGAATCGGCG ATTTGGAAGC ACGTCTGGCG CAGTTGGAAC
```

```
-continued
101 ACCGTGTCGC CGTATTGGAA AGCGGCAGCA ATACCGTCAA AATCGACCTT

151 TTCGGTTCAA ATTCCACCAT GTATGTATGC AGCGTTACGC CTTTTCAGAA

201 GACGTTTGAG GCAAGCGATC GGAATGAAGG CGTGGCGCGG CAGAAAGTGC

251 GTCAGGCGTG CAACCGCGAA ACTTCGGCAA TGTTTTGCGA AGATGAGGCA

301 ATCCGATGCA GAAAATTCGA TTGATGTATC GGTTGGACGG ATAAAGAAAC

351 GGATACGGAG CTTGGCTTCC GTATCTGTTT TTCTCTGCCC GATTTTCCAT

401 GCATCGGGTT TCAGACGGCA TTGGAATGTC AGTCGTGTTC TGCCGATTCG

451 TAGGCTTCGA CGATTTTTTG CACCAAAGGA TGCCGGACAA CGTCTTCGCC

501 GGTAAAGGTG TGGAAATACA GCCCTTCCAC GCCGTGCAGT TTCTCACGCG

551 CATCTTTTAA TCCCGATTTG ATGTTTTTGG GCAGGTCGAT TTGGCTGGTG

601 TCGCCGGTAA TGACGGCTTT CGCGCCGAAG CCGATGCGGG TCAGGAACAT

651 TTTCATTTGT TCGGGCGTGG TGTTTTGCGC TTCGTCGAGG ATGATGTATG

701 CGCCGTTGAG CGTCCTGCCG CGCATATAG
                                          25
```

This corresponds to the amino acid sequence <SEQ ID 2776; ORF 914.a>:

```
a914.pep
  1 MKKCILGILT ACAAMPAFAD RIGDLEARLA QLEHRVAVLE SGSNTVKIDL

51 FGSNSTMYVC SVTPFQKTFE ASDRNEGVAR QKVRQACNRE TSAMFCEDEA

101 IRCRKFD*CI GWTDKETDTE LGFRICFSLP DFPCIGFQTA LECQSCSADS

151 *ASTIFCTKG CRTTSSPVKV WKYSPSTPCS FSRASFNPDL MFLGRSIWLV

201 SPVMTAFAPK PMRVRNIFIC SGVVFCASSR MMYAPLSVLP
    RI*
``` m914/a914 98.4% identity in 244 aa overlap

```
              10        20        30        40        50        60
m914.pep  MKKCILGILTACAAMPAFADRIGDLEARLAQLEHRVAVLESGGNTVKIDLFGSNSTMYVC
          |||||||||||||||||||||||||||||||||||||||||:||||||||||||||||||
a914      MKKCILGILTACAAMPAFADRIGDLEARLAQLEHRVAVLESGSNTVKIDLFGSNSTMYVC
              10        20        30        40        50        60

70        80        90       100       110       120
m914.pep  SVTPFQKTFEASDRNEGVARQKVRQACNRETSAMFCEDEAIRCRKFDXCIGWTDKETDTD
          ||||||||||||||||||||||||||||||||||||||||||||||||||||||||||
a914      SVTPFQKTFEASDRNEGVARQKVRQACNRETSAMFCEDEAIRCRKFDXCIGWTDKETD--
              70        80        90       100       110

130       140       150       160       170       180
m914.pep  TELGFRLCFSLPDFPCIGFQTALECQSCSADSXASTIFCTRGCRTTSSPVKVWKYSPATL
          |||||||||||||||||||||||||||||||||||||||||||||||||||||||||
a914      TELGFRICFSLPDFPCIGFQTALECQSCSADSXASTIFCTKGCRTTSSPVKVWKYSPSTP
            120       130       140       150       160       170

190       200       210       220       230       240
m914.pep  CSFSRASFNPDLMFLGRSIWLVSPVMTAFAPKPMRVRNIFICSGVVFCASSRMMYAPLSV
          ||||||||||||||||||||||||||||||||||||||||||||||||||||||||||||
a914      CSFSRASFNPDLMFLGRSIWLVSPVMTAFAPKPMRVRNIFICSGVVFCASSRMMYAPLSV
            180       190       200       210       220       230 m914.pep  LPRIX
          |||||
a914      LPRIX
            240
```

The following partial DNA sequence was identified in *N. gonorrhoeae* <SEQ ID 2777>:

```
g915.seq
    1 ATGAAGAAAA CCCTGTTGGc AATTGTTGCC gtTTTCGCCT TAAGTGCCTG
   51 CCGGCaggcg gaAGaggcac cgccgCCTTT ACCCCGGCAG AtTAGCGacc
  101 gttcggtcgg aCACTAttgC Agtatgaacc tgaccgaaca caacggcccc
  151 aaagcccaga tttttttgaa cGGCAAACCC GATCAGCCCG TTTGGTTCTC
  201 CACCGTcaag cagatgttcg GCTATACCAA GCTGCCCGAA GAGCCCAAAG
  251 GCATCCGCGT GATTTACGTT ACCGATATGG GCAATGTTAC CGATTGGACG
  301 AATCCTAATG CCGACACGGA GTGGATAGAT GCGAAAAAAG CCTTTTACGT
  351 CATCGACAGC GGCTTTATCG GCGGTATGGG CGCGGAAGAC GCGCTGCCGT
  401 TCGGCAACAA GGAGCAGGCT GAAAAATTTG CAAAGGATAA AGGCGGCAAG
  451 GTCGTCGGTT TTGACGATAT GCCCGATGCT TACATTTTCA AGTAA
```

This corresponds to the amino acid sequence <SEQ ID 2778; ORF 915.ng>:

```
g915.pep
    1 MKKTLLAIVA VFALSACRQA EEAPPPLPRQ ISDRSVGHYC SMNLTEHNGP
   51 KAQIFLNGKP DQPVWFSTVK QMFGYTKLPE EPKGIRVIYV TDMGNVTDWT
  101 NPNADTEWID AKKAFYVIDS GFIGGMGAED ALPFGNKEQA EKFAKDKGGK
  151 VVGFDDMPDA YIFK*
```

The following partial DNA sequence was identified in *N. meningitidis* <SEQ ID 2779>:

```
m915.seq
    1 ATGAAAAAAA CCCTGTTGGC AATTGTTGCC GTTTCCGCCT TAAGTGC.tG
   51 CCGGCAGGCG GAAGAGGGAC CGCCGCCTTT ACCcCGGCAG ATTAGCGACC
  101 GTTCGGTCGG ACACTATTGC AGTATGAACC TGACCGAACA CAACGGCCCC
  151 AAAGCCCAGA TTTTCTTGAA CGGCAAACCC GATCAGCCCG TtTGGTTCTC
  201 CACCATCAAG CAGATGTTCG GCTATACCAA GCTGCCCGAA GAGCCTAAAG
  251 GCATCCGCGT GATTTACGTT ACCGATATGG GCAATGTTAC CGATTGGACG
  301 AATCCCAATG CCGACACGGA GTGGATGGAT GCGAAAAAAG CCTTTTACGT
  351 CATCGACAGC GGCTTTATCG GCGGTATGGG TGCGGAAGAC GCGCTGCCGT
  401 TCGGCAACAA AGAGCAGGCT GAGAAATTTG CAAAGGATAA AGGCGGTAAG
  451 GTTGTCGGTT TCGACGATAT GCCTGATACC TATATTTTCA AATAA
```

This corresponds to the amino acid sequence <SEQ ID 2780; ORF 915>:

```
m915.pep
    1 MKKTLLAIVA VSALSXCRQA EEGPPPLPRQ ISDRSVGHYC SMNLTEHNGP
   51 KAQIFLNGKP DQPVWFSTIK QMFGYTKLPE EPKGIRVIYV TDMGNVTDWT
  101 NPNADTEWMD AKKAFYVIDS GFIGGMGAED ALPFGNKEQA EKFAKDKGGK
  151 VVGFDDMPDT YIFK*
```

Computer analysis of this amino acid sequence gave the following results:

Homology with a Predicted ORF from *N. gonorrhoeae*

ORF 915 shows 97.0% identity over a 164 aa overlap with a predicted ORF (ORF 915.ng) from *N. gonorrhoeae*:

```
m915/g915

10        20        30        40        50        60
     m915.pep   MKKTLLAIVAVSALSACRQAEEGPPPLPRQISDRSVGHYCSMNLTEHNGPKAQIFLNGKP
                ||||||||||||  ||||||||||:|||||||||||||||||||||||||||||||||||
     g915       MKKTLLAIVAVFALSACRQAEEAPPPLPRQISDRSVGHYCSMNLTEHNGPKAQIFLNGKP
                  10        20        30        40        50        60

70        80        90       100       110       120
     m915.pep   DQPVWFSTIKQMFGYTKLPEEPKGIRVIYVTDMGNVTDWTNPNADTEWMDAKKAFYVIDS
                |||||||||:||||||||||||||||||||||||||||||||||||||:|||||||||||
     g915       DQPVWFSTVKQMFGYTKLPEEPKGIRVIYVTDMGNVTDWTNPNADTEWIDAKKAFYVIDS
                  70        80        90       100       110       120

130       140       150       160
     m915.pep   GFIGGMGAEDALPFGNKEQAEKFAKDKGGKVVGFDDMPDTYIFKX
                |||||||||||||||||||||||||||||||||||||||:|||||
     g915       GFIGGMGAEDALPFGNKEQAEKFAKDKGGKVVGFDDMPDAYIFKX
                 130       140       150       160
```

The following partial DNA sequence was identified in *N. meningitidis* <SEQ ID 2781>:

```
a915.seq
  1 ATGAAAAAAA CCCTGTTGGC AATTGTTGCC GTTTCCGCCT TAAGTGCCTG

51 CCGGCAGGCG GAAGAGGGAC CGCCGCCTTT ACCCCGGCAG ATTAGCGACC

101 GTTCGGTCGG ACACTATTGC AGTATGAACC TGACCGAACA CAACGGCCCC

151 AAAGCCCAGA TTTTCTTGAA CGGCAAACCC GATCAGCCCG TTTGGTTCTC

201 CACCATCAAG CAGATGTTCG GCTATACCAA GCTGCCCGAA GAGCCTAAAG

251 GCATCCGCGT GATTTACGTT ACCGATATGG GCAATGTTAC CGATTGGACG

301 AATCCCAATG CCGACACGGA GTGGATGGAT GCGAAAAAAG CCTTTTACGT

351 CATCGACAGC GGCTTTATCG GCGGTATGGG TGCGGAAGAC GCGCTGCCGT

401 TCGGCAACAA AGAGCAGGCT GAGAAATTTG CAAAGGATAA AGGCGGTAAG

451 GTTGTCGGTT TCGACGATAT GCCTGATACC TATATTTTCA
    AATAA
```

This corresponds to the amino acid sequence <SEQ ID 2782; ORF 915.a>:

```
a915.pep
  1 MKKTLLAIVA VSALSACRQA EEGPPPLPRQ ISDRSVGHYC SMNLTEHNGP

51 KAQIFLNGKP DQPVWFSTIK QMFGYTKLPE EPKGIRVIYV TDMGNVTDWT

101 NPNADTEWMD AKKAFYVIDS GFIGGMGAED ALPFGNKEQA EKFAKDKGGK

151 VVGFDDMPDT YIFK*
``` m915/a915 99.4% identity in 164 aa overlap

```
                  10        20        30        40        50        60
     m915.pep   MKKTLLAIVAVSALSXCRQAEEGPPPLPRQISDRSVGHYCSMNLTEHNGPKAQIFLNGKP
                ||||||||||||||| ||||||||||||||||||||||||||||||||||||||||||||
     a915       MKKTLLAIVAVSALSACRQAEEGPPPLPRQISDRSVGHYCSMNLTEHNGPKAQIFLNGKP
                  10        20        30        40        50        60
```

```
             70         80         90        100        110        120
m915.pep  DQPVWFSTIKQMFGYTKLPEEPKGIRVIYVTDMGNVTDWTNPNADTEWMDAKKAFYVIDS
          ||||||||||||||||||||||||||||||||||||||||||||||||||||||||||||
a915      DQPVWFSTIKQMFGYTKLPEEPKGIRVIYVTDMGNVTDWTNPNADTEWMDAKKAFYVIDS
             70         80         90        100        110        120

130        140        150        160
m915.pep  GFIGGMGAEDALPFGNKEQAEKFAKDKGGKVVGFDDMPDTYIFKX
          ||||||||||||||||||||||||||||||||||||||||||||
a915      GFIGGMGAEDALPFGNKEQAEKFAKDKGGKVVGFDDMPDTYIFKX
            130        140        150        160
```

The following partial DNA sequence was identified in *N. gonorrhoeae* <SEQ ID 2783>:

```
g917.seq
    1 ATGGTCAAac atctgccacT cgcCGTCctg actgctTtgc tgcttgcagc 51 gtgcGGCGGT Tcggacaaac cgcctgccga Aaaaccggca ccggcgGaAA 101 accaaAacgt atTgaAAATT TataACTGGT CGGAATACGT CGATCCGGAA

151 ACCGTTGCCG ATTTTGAAAA GAAAAACGGC ATCAAGGTTA CTTATGATGT

201 GTACGACAGT GATGAAACGC TGGAAAGCAA GGTGCTGACC GGAAAATCCG

251 GTTACGACAT TGTCGCGCCG TCCAATGCGT TTGTGGGCAG GCAGATTAAG

301 GCAGGTGCGT ATCAGAAAAT CGATAAGTCG ATGATTCCCA ATTATAAACA

351 TCTCAACCCT GAAATGATGA GGCTGATGGA CGGGGTCGAT CCCGACCACG

401 AATACGCCGT GCCGTTTTAT TGGGGGACAA ATACCTTCGC CATCAATACC

451 GAACGCGTGA AAAAGGCTTT GGGTACGGAC AAGCTGCCGG ACAACCAGTG

501 GGATTTGGTG TTCAACCCCG AATACACGTT CAAACTCAAA CAATGCGGCA

551 TCAGCTATTT GGACAGCGCG GCGGAAATTT ATCCCATGGT GTTGAACTAT

601 TTGGGCAAAA ACCCGAACAG CAGCAATACG GAAGACATCA GGGAGGCAAC

651 CGCCCTGCTC AAGAAAAACC GCCCCAATAT CAAACGCTTT ACTTCGTCCG

701 GCTTTATCGA TGATTTGGCG CGCGGCGATA CCTGCGTAAC AATCGGTTTC

751 GGCGGAGATT TGAACATCGC CAAACGCCGT GCCGAAGAAG CGGGCGGCAA

801 GGAAAAAATC CGCGTGATGA TGCCGAAAGA GGGCGTGGGG ATTTGGGTGG

851 ATTCTTTCGT GATTCCGAAA GATGCGAAAA ACGTCGCCAA CGCGCACAAA

901 TACATCAACG ACTTCCTCGA TCCGGAAGTG TCGGCGAAAA ACGGCAATTT 951 cgttacCTAC GCGCCTTCGA GCAAGCCGGC GCGCGATTTG ATGGAGGACG

1001 AATTTAAAAA CGACAATACG ATTTTCCCGA GCGGGGAAGA TTTGAAAAAC

1051 AGCTTTATCA TGGTGCCTAT CCGGCCGGCG GCATTGAAGT TTATGGTGCG

1101 CCAGTGGCAG GATGTGAAGG CGGGGAAATA A
```

This corresponds to the amino acid sequence <SEQ ID 2784; ORF 917.ng>:

```
g917.pep
    1 MVKHLPLAVL TALLLAACGG SDKPPAEKPA PAENQNVLKI YNWSEYVDPE

51 TVADFEKKNG IKVTYDVYDS DETLESKVLT GKSGYDIVAP SNAFVGRQIK

101 AGAYQKIDKS MIPNYKHLNP EMMRLMDGVD PDHEYAVPFY WGTNTFAINT

151 ERVKKALGTD KLPDNQWDLV FNPEYTFKLK QCGISYLDSA AEIYPMVLNY

201 LGKNPNSSNT EDIREATALL KKNRPNIKRF TSSGFIDDLA RGDTCVTIGF
```

```
-continued
251 GGDLNIAKRR AEEAGGKEKI RVMMPKEGVG IWVDSFVIPK DAKNVANAHK

301 YINDFLDPEV SAKNGNFVTY APSSKPARDL MEDEFKNDNT IFPSGEDLKN

351 SFIMVPIRPA ALKFMVRQWQ DVKAGK*
```

The following partial DNA sequence was identified in *N. meningitidis* <SEQ ID 2785>:

```
m917.seq
    1 ATGACCAAAC ATCTGCCCCT GGCCGTCCTG ACTGCTTTGC TGCTTGCAGC

51 GTGCGGCGGT TCGGACAAAC CGCCTGCCGA AAAACCGGCA CCGGCGGAAA

101 ACCAAAACGT ATTGA

Computer analysis of this amino acid sequence gave the following results:
Homology with a Predicted ORF from *N. gonorrhoeae*
ORF 917 shows 97.6% identity over a 376 aa overlap with a predicted ORF (ORF 917.ng) from *N. gonorrhoeae*:

```
m917/g917

10        20        30        40        50        60
m917.pep    MTKHLPLAVLTALLLAACGGSDKPPAEKPAPAENQNVLKIYNWSEYVDPETVADFEKKNG
            |:||||||||||||||||||||||||||||||||||||||||||||||||||||||||||
g917        MVKHLPLAVLTALLLAACGGSDKPPAEKPAPAENQNVLKIYNWSEYVDPETVADFEKKNG
                    10        20        30        40        50        60

70        80        90       100       110       120
m917.pep    IKVTYDVYDSDETLESKVLTGKSGYDIVAPSNAFVGRQIKAGAYQKIDKSLIPNYKHLNP
            ||||||||||||||||||||||||||||||||||||||||||||||||||:|||||||||
g917        IKVTYDVYDSDETLESKVLTGKSGYDIVAPSNAFVGRQIKAGAYQKIDKSMIPNYKHLNP
                    70        80        90       100       110       120

130       140       150       160       170       180
m917.pep    EMMRLMDGVDPGHEYAVPFYWGTNTFAINTERVKKALGTDKLPDNQWDLVFDPEYTSKLK
            ||||||||||| |||||||||||||||||||||||||||||||||||||||:|||| |||
g917        EMMRLMDGVDPDHEYAVPFYWGTNTFAINTERVKKALGTDKLPDNQWDLVFNPEYTFKLK
                   130       140       150       160       170       180

190       200       210       220       230       240
m917.pep    QCGISYLDSAAEIYPMVLNYLGKNPNSSNTEDIREATALLKKNRPNIKRFTSSGFIDDLA
            ||||||||||||||||||||||||||||||||||||||||||||||||||||||||||||
g917        QCGISYLDSAAEIYPMVLNYLGKNPNSSNTEDIREATALLKKNRPNIKRFTSSGFIDDLA
                   190       200       210       220       230       240

250       260       270       280       290       300
m917.pep    RGDTCVTIGFGGDLNIAKRRAEEAGGKEKIRVMMPKEGVGIWVDSFVIPKDAKNVANAHK
            ||||||||||||||||||||||||||||||||||||||||||||||||||||||||||||
g917        RGDTCVTIGFGGDLNIAKRRAEEAGGKEKIRVMMPKEGVGIWVDSFVIPKDAKNVANAHK
                   250       260       270       280       290       300

310       320       330       340       350       360
m917.pep    YINDFLDPEVSAKNGNFVTYAPSSKPARELMEDEFKNDNTIFPTEEDLKNSFIMVPIQPA
            ||||||||||||||||||||||||||||:||||||||||||||: ||||||||||||:||
g917        YINDFLDPEVSAKNGNFVTYAPSSKPARDLMEDEFKNDNTIFPSGEDLKNSFIMVPIRPA
                   310       320       330       340       350       360

370
m917.pep    ALKFMVRQWQDVKAGKX
            |||||||||||||||||
g917        ALKFMVRQWQDVKAGKX
                   370
```

The following partial DNA sequence was identified in *N. meningitidis* <SEQ ID 2787>:

```
a917.seq
   1  ATGACCAAAC ATCTGCCCCT GGCCGTCCTG ACTGCTTTGC TGCTTGCAGC
  51  GTGCGGCGGT TCGGACAAAC CGCCTGCCGA AAAACCGGCG CCGGCGGAAA
 101  ACCGAAACGT ATTGAAAATT TACAACTGGT CGGAATACGT CGATCCGGAA
 151  ACCGTTGCCG ATTTTGAAAA GAAAAACGGC ATCAAGGTTA CTTATGATGT
 201  GTACGACAGC GATGAAACGC TGGAAAGCAA GGTGCTGACC GGAAAATCTG
 251  GTTACGACAT TGTCGCGCCG TCCAATGCGT TTGTGGGCAG GCAGATTAAG
 301  GCAGGTGCGT ATCAGAAAAT CGATAAGTCG CTGATTCCCA ATTATAAACA
 351  CCTCAACCCC GAAATGATGA GGCTGATGGA CGGGGTCGAT CCCGGCCACG
 401  AATACGCCGT GCCGTTTTAT TGGGGGACAA ATACCTTCGC CATCAATACC
 451  GAACGCGTGA AAAAGGCTTT GGGTACGGAC AAGCTGCCGG ACAACCAGTG
 501  GGATTTGGTG TTCGACCCCG AATACACGTC CAAACTCAAG CAATGCGGCA
 551  TCAGCTATTT GGACAGCGCG GCGGAAATCT ATCCTATGGT GTTGAACTAT
 601  TTGGGTAAAA ACCCGAACAG CAGCAATACG GAAGACATCA GGGAGGCAAC
 651  CGCCCTACTC AAGAAAAACC GCCCCAATAT CAAACGCTTT ACTTCGTCCG
```

```
-continued
 701 GCTTTATCGA TGATTTGGCG CGCGGCGATA CCTGCGTAAC AATCGGTTTC

751 GGCGGCGATT TGAACATCGC CAAACGCCGT GCCGAAGAAG CGGGCGGCAA

801 GGAAAAAATC CGCGTGATGA TGCCCAAAGA GGGCGTGGGG ATTTGGGTGG

851 ATTCTTTCGT GATTCCGAAA GATGCGAAAA ACGTCGCCAA CGCGCACAAA

901 TACATCAACG ACTTCCTCGA CCCGGAAGTG TCGGCGAAAA ACGGCAATTT

951 CGTTACTTAC GCGCCTTCGA GCAAGCCTGC GCGTGAGCTG ATGGAAGACG

1001 AATTTAAAAA CGACAATACG ATTTTCCCAA CCGAGGAGGA TTTGAAAAAC

1051 AGCTTTATCA TGGTGCCTAT CCAGCCGGCG GCATTGAAGT TTATGGTGCG

1101 CCAGTGGCAG GATGTGAAGG CGGGGAAATA A
```

This corresponds to the amino acid sequence <SEQ ID 2788; ORF 917.a>:

```
a917.pep

1   MTKHLPLAVL TALLLAACGG SDKPPAEKPA PAENRNVLKI YNWSEYVDPE

51   TVADFEKKNG IKVTYDVTDS DETLESKVLT GKSGYDIVAP SNAFVGRQIK

101   AGAYQKIDKS LIPNYKHLNP EMMRLMDGVD PGHEYAVPFY WGTNTFAINT

151   ERVKKALGTD KLPDNQWDLV FDPEYTSKLK QCGISYLDSA AEIYPMVLNY

201   LGKNPNSSNT EDIREATALL KKNRPNIKRF TSSGFIDDLA IFPTEEDLKN

251   GGDLNIAKRR AEEAGGKEGI RVMMPKEGVG IWVDSFVIPK DAKNVANAHK

301   YINDFLDPEV SAKNGNFVTY APSSKPAREL MEDEFKNDNT IFPTEEDLKN

351   SFIMVPIQPA ALKFMVRQWQ DVKAGK* m917/a917   99.7% identity in 376 aa overlap 10         20         30         40         50         60
m917.pep MTKHLPLAVLTALLLAACGGSDKPPAEKPAPAENQNVLKIYNWSEYVDPETVADFEKKNG
         ||||||||||||||||||||||||||||||||:|||||||||||||||||||||||||||
a917     MTKHLPLAVLTALLLAACGGSDKPPAEKPAPAENRNVLKIYNWSEYVDPETVADFEKKNG
                 10         20         30         40         50         60

70         80         90        100        110        120
m917.pep IKVTYDVYDSDETLESKVLTGKSGYDIVAPSNAFVGRQIKAGAYQKIDKSLIPNYKHLNP
         ||||||||||||||||||||||||||||||||||||||||||||||||||||||||||||
a917     IKVTYDVYDSDETLESKVLTGKSGYDIVAPSNAFVGRQIKAGAYQKIDKSLIPNYKHLNP
                 70         80         90        100        110        120

130        140        150        160        170        180
m917.pep EMMRLMDGVDPGHEYAVPFYWGTNTFAINTERVKKALGTDKLPDNQWDLVFDPEYTSKLK
         ||||||||||||||||||||||||||||||||||||||||||||||||||||||||||||
a917     EMMRLMDGVDPGHEYAVPFYWGTNTFAINTERVKKALGTDKLPDNQWDLVFDPEYTSKLK
                130        140        150        160        170        180

190        200        210        220        230        240
         QCGISYLDSAAEIYPMVNLNYLGKNPNSSNTEDIREATALLKKNRPNIKRFTSSGFIDDLA
m917.pep ||||||||||||||||||||||||||||||||||||||||||||||||||||||||||||
         QCGISYLDSAAEIYPMVNLNYLGKNPNSSNTEDIREATALLKKNRPNIKRFTSSGFIDDLA
                190        200        210        220        230        240
```

The following partial DNA sequence was identified in *N. gonorrhoeae* <SEQ ID 2789>:

```
g919.seq
    1   ATGAAAAAAC ACCTGCTCCG CTCCGCCCTG TACGGcatCG CCGCCgccAT

51   CctcgCCGCC TGCCAAAgca gGAGCATCCA AACCTTTCCG CAACCCGACA

101   CATCCGTCAT CAACGGCCCG GACCGGCCGG CCGGCATCCC CGACCCCGCC

151   GGAACGACGG TTGCCGGCGG CGGGGCCGTC TATACCGTTG TGCCGCACCT

201   GTCCATGCCC CACTGGGCGG CGCAggATTT TGCCAAAAGC CTGCAATCCT
```

-continued

```
 251 TCCGCCTCGG CTGCGCCAAT TTGAAAAACC GCCAAGGCTG GCAGGATGTG

301 TGCGCCCAAG CCTTTCAAAC CCCCGTGCAT TCCTTTCAGG CAAAGcGgTT

351 TTTTGAACGC TATTTCACGC cgtGGCaggt tgcaggcaAC GGAAGcCTTG

401 Caggtacggt TACCGGCTAT TACGAACCGG TGCTGAAGGG CGACGGCAGG

451 CGGACGGAAC GGGCCCGCTT CCCGATTTAC GGTATTCCCG ACGATTTTAT

501 CTCCGTCCCG CTGCCTGCCG GTTTGCGGGG CGGAAAAAAC CTTGTCCGCA

551 TCAGGCAGac ggGGAAAAAC AGCGGCACGA TCGACAATGC CGGCGGCACG

601 CATACCGCCG ACCTCTCCCG ATTCCCCATC ACCGCGCGCA CAACGGcaat 651 caaaGGCAGG TTTGAaggAA GCCGCTTCCT CCCTTACCAC ACGCGCAACC 701 AAAtcaacGG CGGCgcgcTT GACGGCAAag cccCCATCCT CggttacgcC 751 GAagaccCcG tcgaactttT TTTCATGCAC AtccaaggCT CGGGCCGCCT 801 GAAAACCCcg tccggcaaat acatCCGCAt cggaTacgcc gacAAAAACG 851 AACAtccgTa tgtttccatc ggACGctaTA TGGCGGACAA AGGCTACCTC 901 AAGctcgggc agACCTCGAT GCAGGgcatc aaagcCTATA TGCGGCAAAA

951 TCCGCAACGC CTCGCCGAAG TTTTGGGTCA AAACCCCAGC TATATCTTTT

1001 TCCGCGAGCT TGCCGGAAGC GGCAATGAGG GCCCCGTCGG CGCACTGGGC

1051 ACGCCACTGA TGGGGAATA CGCCGGCGCA ATCGACCGGC ACTACATTAC

1101 CTTGGGCGCG CCCTTATTTG TCGCCACCGC CCATCCGGTT ACCCGCAAAG

1151 CCCTCAACCG CCTGATTATG GCGCAGGATA CAGGCAGCGC GATCAAAGGC

1201 GCGGTGCGCG TGGATTATTT TTGGGGTTAC GGCGACGAAG CCGGCGAACT

1251 TGCCGGCAAA CAGAAAACCA CGGGATACGT CTGGCAGCTC CTGCCCAACG

1301 GCATGAAGCC CGAATACCGC CCGTGA
```

This corresponds to the amino acid sequence <SEQ ID 2790; ORF 919.ng>:

```
g919.pep
  1 MKKHLLRSAL YGIAAAILAA CQSRSIQTFP QPDTSVINGP DRPAGIPDPA

51 GTTVAGGGAV YTVVPHLSMP HWAAQDFAKS LQSFRLGCAN LKNRQGWQDV

101 CAQAFQTPVH SFQAKRFFER YFTPWQVAGN GSLAGTVTGY YEPVLKGDGR

151 RTERARFPIY GIPDDFISVP LPAGLRGGKN LVRIRQTGKN SGTIDNAGGT

201 HTADLSRFPI TARTTAIKGR FEGSRFLPYH TRNQINGGAL DGKAPILGYA

251 EDPVELFFMH IQGSGRLKTP SGKYIRIGYA DKNEHPYVSI GRYMADKGYL

301 KLGQTSMQGI KAYMRQNPQR LAEVLGQNPS YIFFRELAGS GNEGPVGALG

351 TPLMGEYAGA IDRHYITLGA PLFVATAHPV TRKALNRLIM AQDTGSAIKG

AVRVDYFWGY GDEAGELAGK QKTTGYVWQL LPNGMKPEYR P*
```

The following partial DNA sequence was identified in *N. meningitidis* <SEQ ID 2791>:

```
m919.seq
   1  ATGAAAAAAT ACCTATTCCG CGCCGCCCTG TACGGCATCG CCGCCGCCAT

51  CCTCGCCGCC TGCCAAAGCA AGAGCATCCA AACCTTTCCG CAACCCGACA

101  CATCCGTCAT CAACGGCCCG G

```
 151 GGAACGACGG TCGGCGGCGG CGGGGCCGTC TATACCGTTG TACCGCACCT

201 GTCCCTGCCC CACTGGGCGG CGCAGGATTT CGCCAAAAGC CTGCAATCCT

251 TCCGCCTCGG CTGCGCCAAT TTGAAAAACC GCCAAGGCTG GCAGGATGTG

301 TGCGCCCAAG CCTTTCAAAC CCCCGTCCAT TCCTTTCAGG CAAAACAGTT

351 TTTTGAACGC TATTTCACGC CGTGGCAGGT TGCAGGCAAC GGAAGCCTTG

401 CCGGTACGGT TACCGGCTAT TACGAACCGG TGCTGAAGGG CGACGACAGG

451 CGGACGGCAC AAGCCCGCTT CCCGATTTAC GGTATTCCCG ACGATTTTAT

501 CTCCGTCCCC CTGCCTGCCG GTTTGCGGAG CGGAAAAGCC CTTGTCCGCA

551 TCAGGCAGAC GGGAAAAAAC AGCGGCACAA TCGACAATAC CGGCGGCACA

601 CATACCGCCG ACCTCTCCcG ATTCCCCATC ACCGCGCGCA CAACAGCAAT

651 CAAAGGCAGG TTTGAAGGAA GCCGCTTCCT CCCCTACCAC ACGCGCAACC

701 AAATCAACGG CGGCGCGCTT GACGGCAAAG CCCCGATACT CGGTTACGCC

751 GAAGACCCTG TCGAACTTTT TTTTATGCAC ATCCAAGGCT CGGGCCGTCT

801 GAAAACCCCG TCCGGCAAAT ACATCCGCAT CGGCTATGCC GACAAAAACG

851 AACATCCyTA CGTTTCCATC GGACGCTATA TGGCGGATAA GGGCTACCTC

901 AAACTCGGAC AAACCTCCAT GCAGGGCATT AAGTCTTATA TGCGGCAAAA

951 TCCGCAACGC CTCGCCGAAG TTTTGGGTCA AAACCCCAGC TATATCTTTT

1001 TCCGCGAGCT TGCCGGAAGC AGCAATGACG GCCCTGTCGG CGCACTGGGC

1051 ACGCCGCTGA TGGGGGAATA TGCCGGCGCA GTCGACCGGC ACTACATTAC

1101 CTTGGGTGCG CCCTTATTTG TCGCCACCGC CCATCCGGTT ACCCGCAAAG

1151 CCCTCAACCG CCTGATTATG GCGCAGGATA CCGGCAGCGC GATTAAAGGC

1201 GCGGTGCGCG TGGATTATTT TTGGGGATAC GGCGACGAAG CCGGCGAACT

1251 TGCCGGCAAA CAGAAAACCA CGGGATATGT CTGGCAGCTC CTACCCAACG

GTATGAAGCC CGAATACCGc CCGTAA
```

This corresponds to the amino acid sequence <SEQ ID 2792; ORF 919>:

```
m19.pep

1 MKKYLFRAAL YGIAAAILAA CQSKSIQTFP QPDTSVINGP DRPVGIPDPA

51 GTTVGGGGAV YTVVPHLSLP HWAAQDFAKS LQSFRLGCAN LKNRQGWQDV

101 CAQAFQTPVH SFQAKQFFER YFTPWQVAGN GSLAGTVTGY YEPVLKGDDR

151 RTAQARFPIY GIPDDFISVP LPAGLRSGKA LVRIRQTGKN SGTIDNTGGT

201 HTADLSRFPI TARTTAIKGR FEGSRFLPYH TRNQINGGAL DGKAPILGYA

251 EDPVELFFMH IQGSGRLKTP SGKYIRIGYA DKNEHPYVSI GRYMADKGYL

301 KLGQTSMQGI KSYMRQNPQR LAEVLQGNPS YIFFRELAGS SNDGPVGALG

351 TPLMGEYAGA VDRHYITLGA PLFVATAHPV TRKALNRLIM AQDTGSAIKG

401 AVRVDYFWGY GDEAGELAGK QKTTGYVWQL LPNGMKPEYR P*
```

Computer analysis of this amino acid sequence gave the following result:
Homology with a predicted ORF from *N.gonorrhoeae*
ORF 919 shows 95.9% identity over a 441 aa overlap with a predicted ORF(ORF 919.ng) from *N. gonorrhoeae*:
m919/g919

-continued

```
10         20        30        40        50        60
m919.pep   MKKYLFRAALYGIAAAILAACQSKSIQTFPQPDTSVINGPDRPVGIPDPAGTTVGGGGAV
           |||:|:|:|||||||||||||:||||||||||||||||||||:||||||||||:|||||
g919       MKKHLLRSALYGIAAAILAACQSRSIQTFPQPDTSVINGPDRPAGIPDPAGTTVAGGGAV
                   10        20        30        40        50        60

70         80        90        100       110       120
m919.pep   YTVVPHLSLPHWAAQDFAKSLQSFRLGCANLKNRQGWQDVCAQAFQTPVHSFQAKQFFER
           ||||||||:||||||||||||||||||||||||||||||||||||||||||||||:||||
g919       YTVVPHLSMPHWAAQDFAKSLQSFRLGCANLKNRQGWQDVCAQAFQTPVHSFQAKRFFER
                   70        80        90        100       110       120

130        140       150       160       170       180
m919.pep   YFTPWQVAGNGSLAGTVTGYYEPVLKGDDRRTAQARFPIYGIPDDFISVPLPAGLRSGKA
           |||||||||||||||||||||||||||| ||| :|||||||||||||||||||||:||
g919       YFTPWQVAGNGSLAGTVTGYYEPVLKGDGRRTERARFPIYGIPDDFISVPLPAGLRGGKN
                   130       140       150       160       170       180

190        200       210       220       230       240
m919.pep   LVRIRQTGKNSGTIDNTGGTHTADLSRFPITARTTAIKGRFEGSRFLPYHTRNQINGGAL
           |||||||||||||||:||||||||||||||||||||||||||||||||||||||||||||
g919       LVRIRQTGKNSGTIDNAGGTHTADLSRFPITARTTAIKGRFEGSRFLPYHTRNQINGGAL
                   190       200       210       220       230       240

250        260       270       280       290       300
m919.pep   DGKAPILGYAEDPVELFFMHIQGSGRLKTPSGKYIRIGYADKNEHPYVSIGRYMADKGYL
           ||||||||||||||||||||||||||||||||||||||||||||||||||||||||||||
g919       DGKAPILGYAEDPVELFFMHIQGSGRLKTPSGKYIRIGYADKNEHPYVSIGRYMADKGYL
                   250       260       270       280       290       300

310        320       330       340       350       360
m919.pep   KLGQTSMQGIKSYMRQNPQRLAEVLGQNPSYIFFRELAGSSNDGPVGALGTPLMGEYAGA
           ||||||||||:||||||||||||||||||||||||||||||:|:||||||||||||||||
           KLGQTSMQGIKAYMRQNPQRLAEVLGQNPSYIFFRELAGSGNEGPVGALGTPLMGEYAGA
g919               310       320       330       340       350       360

370       380       390       400       410       420
m919.pep   VDRHYITLGAPLFVATAHPVTRKALNRLIMAQDTGSAIKGAVRVDYFWGYGDEAGELAGK
           :|||||||||||||||||||||||||||||||||||||||||||||||||||||||||||
g919       IDRHYITLGAPLFVATAHPVTRKALNRLIMAQDTGSAIKGAVRVDYFWGYGDEAGELAGK
                   370       380       390       400       410       420

430       440
m919.pep   QKTTGYVWQLLPNGMKPEYRPX
           ||||||||||||||||||||||
           QKTTGYVWQLLPNGMKPEYRPX
g919               430       440
```

The following partial DNA sequence was identified in *N. meningitidis* <SEQ ID 2793>:

```
a919.seq
  1  ATGAAAAAAT ACCTATTCCG CGCCGCCCTG TGCGGCATCG CCGCCGCCAT
 51  CCTCGCCGCC TGCCAAAGCA AGAGCATCCA AACCTTTCCG CAACCCGACA
101  CATCCGTCAT CAACGGCCCG GACCGGCCGG TCGGCATCCC CGACCCCGCC
151  GGAACGACGG TCGGCGGCGG CGGGGCCGTT TATACCGTTG TGCCGCACCT
201  GTCCCTGCCC CACTGGGCGG CGCAGGATTT CGCCAAAAGC CTGCAATCCT
251  TCCGCCTCGG CTGCGCCAAT TTGAAAAACC GCCAAGGCTG GCAGGATGTG
301  TGCGCCCAAG CCTTTCAAAC CCCCGTCCAT TCCGTTCAGG CAAAACAGTT
351  TTTTGAACGC TATTTCACGC CGTGGCAGGT TGCAGGCAAC GGAAGCCTTG
401  CCGGTACGGT TACCGGCTAT TACGAGCCGG TGCTGAAGGG CGACGACAGG
451  CGGACGGCAC AAGCCCGCTT CCCGATTTAC GGTATTCCCG ACGATTTTAT
501  CTCCGTCCCC CTGCCTGCCG GTTTGCGGAG CGGAAAAGCC CTTGTCCGCA
551  TCAGGCAGAC GGGAAAAAAC AGCGGCACAA TCGACAATAC CGGCGGCACA
601  CATACCGCCG ACCTCTCCCA ATTCCCCATC ACTGCGCGCA CAACGGCAAT
651  CAAAGGCAGG TTTGAAGGAA GCCGCTTCCT CCCCTACCAC ACGCGCAACC
701  AAATCAACGG CGGCGCGCTT GACGGCAAAG CCCCGATACT CGGTTACGCC
751  GAAGACCCCG TCGAACTTTT TTTTATGCAC ATCCAAGGCT CGGGCCGTCT
```

```
 801 GAAAACCCCG TCCGGCAAAT ACATCCGCAT CGGCTATGCC GACAAAAACG

851 AACATCCCTA CGTTTCCATC GGACGCTATA TGGCGGACAA AGGCTACCTC

901 AAGCTCGGGC AGACCTCGAT GCAGGGCATC AAAGCCTATA TGCAGCAAAA

951 CCCGCAACGC CTCGCCGAAG TTTTGGGGCA AAACCCCAGC TATATCTTTT

1001 TCCGAGAGCT TACCGGAAGC AGCAATGACG GCCCTGTCGG CGCACTGGGC

1051 ACGCCGCTGA TGGGCGAGTA CGCCGGCGCA GTCGACCGGC ACTACATTAC

1101 CTTGGGCGCG CCCTTATTTG TCGCCACCGC CCATCCGGTT ACCCGCAAAG

1151 CCCTCAACCG CCTGATTATG GCGCAGGATA CCGGCAGCGC GATTAAAGGC

1201 GCGGTGCGCG TGGATTATTT TTGGGGATAC GGCGACGAAG CCGGCGAACT

1251 TGCCGGCAAA CAGAAAACCA CGGGATATGT CTGGCAGCTT CTGCCCAACG

1301 GTATGAAGCC CGAATACCGC CCGTAA
```

This corresponds to the amino acid sequence <SEQ ID 
2794; ORF 919.a>:

```
    a19.pep

1 MKKYLFRAAL YGIAAAILAA CQSKSIQTFP QPDTSVINGP DRPVGIPDPA

51 GTTVGGGGAV YTVVPHLSLP HWAAQDFAKS LQSFRLGCAN LKNRQGWQDV

101 CAQAFQTPVH SFQAKQFFER YFTPWQVAGN GSLAGTVTGY YEPVLKGDDR

151 RTAQARFPIY GIPDDFISVP LPAGLRSGKA LVRIRQTGKN SGTIDNTGGT

201 HTADLSRFPI TARTTAIKGR FEGSRFLPYH TRNQINGGAL DGKAPILGYA

251 EDPVELFFMH IQGSGRLKTP SGKYIRIGYA DKNEHPYVSI GRYMADKGYL

301 KLGQTSMQGI KSYMRQNPQR LAEVLQGNPS YIFFRELAGS SNDGPVGALG

351 TPLMGEYAGA VDRHYITLGA PLFVATAHPV TRKALNRLIM AQDTGSAIKG

401 AVRVDYFWGY GDEAGELAGK QKTTGYVWQL LPNGMKPEYR P* m919/g919 98.6% identity in 441 aa overlap
            10         20         30         40         50         60
m919.pep MKKYLFRAALYGIAAAILAACQSKSIQTFPQPDTSVINGPDRPVGIPDPAGTTVGGGGAV
         ||||||||||  |||||||||||:|||||||||||||||||||| |||||||| ||||||
a919     MKKHLLRSALCGIAAAILAACQSRSIQTFPQPDTSVINGPDRPAGIPDPAGTTVAGGGAV
                  10         20         30         40         50         60

70         80         90        100        110        120
m919.pep YTVVPHLSLPHWAAQDFAKSLQSFRLGCANLKNRQGWQDVCAQAFQTPVHSFQAKQFFER
         |||||||||:|||||||||||||||||||||||||||||||||||||||| |:||::|||
a919     YTVVPHLSMPHWAAQDFAKSLQSFRLGCANLKNRQGWQDVCAQAFQTPVHSVQAKRFFER
                  70         80         90        100        110        120

130        140        150        160        170        180
m919.pep YFTPWQVAGNGSLAGTVTGYYEPVLKGDDRRTAQARFPIYGIPDDFISVPLPAGLRSGKA
         ||||||||||||||||||||||||||||:||| |||||||||||||||||||||||||||
a919     YFTPWQVAGNGSLAGTVTGYYEPVLKGDGRRTERARFPIYGIPDDFISVPLPAGLRSGKN
                 130        140        150        160        170        180

190        200        210        220        230        240
m919.pep LVRIRQTGKNSGTIDNTGGTHTADLSRFPITARTTAIKGRFEGSRFLPYHTRNQINGGAL
         ||||||||||||||||:|||||||||:|||||||||||||||||||||||||||||||||
a919     LVRIRQTGKNSGTIDNAGGTHTADLSQFPITARTTAIKGRFEGSRFLPYHTRNQINGGAL
                 190        200        210        220        230        240

250        260        270        280        290        300
m919.pep DGKAPILGYAEDPVELFFMHIQGSGRLKTPSGKYIRIGYADKNEHPYVSIGRYMADKGYL
         ||||||||||||||||||||||||||||||||||||||||||||||||||||||||||||
a919     DGKAPILGYAEDPVELFFMHIQGSGRLKTPSGKYIRIGYADKNEHPYVSIGRYMADKGYL
                 250        260        270        280        290        300

310        320        330        340        350        360
m919.pep KLGQTSMQGIKSYMRQNPQRLAEVLQGNPSYIFFRELAGSSNDGPVGALGTPLMGEYAGA
         ||||||||||:||||||||||||||||||||||||:|||||||||||||||||||||||
a919     KLGQTSMQGIKAYMRQNPQRLAEVLQGNPSYIFFRELTGSSNDGPVGALGTPLMGEYAGA
                 310        320        330        340        350        360
```

```
370        380        390        400        410        420
m919.pep   VDRHYITLGAPLFVATAHPVTRKALNRLIMAQDTGSAIKGAVRVDYFWGYGDEAGELAGK
           ||||||||||||||||||||||||||||||||||||||||||||||||||||||||||
a919       IDRHYITLGAPLFVATAHPVTRKALNRLIMAQDTGSAIKGAVRVDYFWGYGDEAGELAGK
               370        380        390        400        410        420

430        440
m919.pep   QKTTGYVWQLLPNGMKPEYRPX
           ||||||||||||||||||||||
a919       QKTTGYVWQLLPNGMKPEYRPX
               430        440
```

Expression of ORF 919

The primer described in Example 1 for ORF 919 was used to locate and clone ORF 919. This sequence was purified and expressed in E. coli as provided in FIG. 1 #. The hydrophilicity plots, antigenic index, and amphipatic regions of ORF 919 is provided in FIG. 5 #. The AMPHI program is used to predict putative T-cell epitopes (Gao et al 1989, *J. Immunol* 143:3007; Roberts et al. 1996, *AIDS Res Human Retroviruses* 12:593; Quakyi et al. 1992, *Scand J Immunol Suppl* 11:9). The nucleic acid sequence of ORF 919 is provided in Exhibit C #.

The following partial DNA sequence was identified in *N. gonorrhoeae* <SEQ ID 2795>:

```
g920.seq (partial)
  1 ..ccgatgcagc tggttaccga aaaAGGTAAG GAAAACATGA TTCAACGCGG
 51   CACATACAAC TACCAATACC GCAGCAACCG TCCGGTCAAA GACGGCAGCT
101   ACCTCGTTAC CGCCGAATAT CAGCCTACTT TCCGGTCAAA AAACAAAGCA
151   GGCTGGAAAC AGGCTGGCAT CAAAGAAATG CCTGACGCAA GCTATTGCGA
201   ACAAACCCGT ATGTTCGGTA AAAACATTGT CAACGTGGGA CACGAAAGCG
251   CGGACACCGC CATCATCACC AAACCGGTCG GACAAAACTT GGAAATCGTC
301   CCGCTGGACA ATCccgccga caTTCACgtg ggctaacgCt tcaaaGTccg
351   cgttCtgttc cgtGGCgaac cgCTGcccaa tgccACCgtt accgCtacAT
401   TTGacggctt cGAcaccagc gaccgcagca aaacgcacaa Aaccgaagcc
451   caagcctTCT ccgacaccac cgacggcgaa ggcgaagtgg acatcatCCC
501   CTTGCgccaa GGCTTttgga aAgcGAGTGT CGAATAcaaa gccgAtttcc
551   CCGATcaaAG CCTGTGccga AAACAggcgA ACTACaCaac TTtaaccttc
601   caaatcgccc attctCacca tTAa
```

This corresponds to the amino acid sequence <SEQ ID 2796; ORF 920.ng>:

```
g920.pep (partial)
  1 ..PMQLVTEKGK ENMIQRGTYN YQYRSNRPVK DGSYLVTAEY QPTFRSKNKA
 51   GWKQAGIKEM PDASYCEQTR MFGKNIVNVG HESADTAIIT KPVGQNLEIV
101   PLDNPADIHV GXRFKVRVLF RGEPLPNATV TATFDGFDTS DRSKTHKTEA
151   QAFSDTTDGE GEVDIIPLRQ GFWKASVEYK ADFPDQSLCR KQANYTTLTF
201   QIAHSHH*
      55
```

The following partial DNA sequence was identified in *N. meningitidis* <SEQ ID 2797>:

```
m920.seq
  1 ATGAAGAAAA CATTGACACT GCTCTCCGTT TCCGCCCTAT TGCCACATC
 51 CGCCCACGCC CACCGmGTCT GGGTCGAAAC CGCCCACACG CACGGCGGCG
101 AATACCTTAA AGCCGACTTG GGCTACGGCG AATTTCCCGA ACTCGAACCC
151 ATCGCCAAAG ACCGCCTGCA CATCTTCAGC AAACCGATGC AGCTGGTTAC
```

```
201 CGAAAAAGGC AAGGAAAACA TGATTCAACG CGGCACATAC AACTACCAGT

251 ACCGAAGCAA CCGTCCCGTT AAGGACGGCA GTTACCTCGT CATCGCCGAA

301 TATCAGCCTA CTTTCTGGTC AAAAwACAAA GCAGGCTGGA AACAGGCGGG

351 CATCAAAGAA ATGCCTGACG CAAGCTATTG CGAACAAACC CGAATGTTCG

401 GCAAAAACAT CGTCAACGTC GGACACGAAA GCGCGGACAC CGCCATCATC

451 ACCAArCCGG TCGGACAAAA CTTGGAAATC GTCCCGCTGG ACAATCCCGC

501 CAACATTCAC GTAGGCGAAC GCTTCAAAGT CCGCGTTCTG TTCCGTGGCG

551 AACCGCTGCC CAATGCCACC GTTACCGCCA CCTTTGACGG CTTCGACACC

601 AGCGACCGCA GCAAAACGCA CAAwmCCGAA GCACAGGCTT TCTCCGACAG

651 CACAGACGAC AAAGGCGAAG TGGACATCAT CmCCTTGCGC CAAGGCTTCT

701 GGAAAGCCAA TGTCGAACAC AAAACCGACT TCCCCGATCA AAGCGTGTGC

751 CAAAAACAGG CGAACTACTC GACTTTAACC TTCCAAATCG GTCATTCGCA

801 CCATTAA
```

This corresponds to the amino acid sequence <SEQ ID 2798; ORF 920>:

```
m920.pep
  1 MKKTLTLLSV SALFATSAHA HRVWVETAHT HGGEYLKADL GYGEFPELEP

51 IAKDRLHIFS KPMQLVTEKG KENMIQRGTY NYQYRSNRPV KDGSYLVIAE

101 YQPTFWSKXK AGWKQAGIKE MPDASYCEQT RMFGKNIVNV GHESADTAII

151 TKPVGQNLEI VPLDNPANIH VGERFKVRVL FRGEPLPNAT VTATFDGFDT

201 SDRSKTHXXE AQAFSDSTDD KGEVDIIXLR QGFWKANVEH KTDFPDQSVC

251 QKQANYSTLT FQIGHSHH*
```

Computer analysis of this amino acid sequence gave the following results:
Homology with a Predicted ORF from *N. gonorrhoeae*
ORF 920 shows 91.3% identity over a 207 aa overlap with a predicted ORF (ORF 920.ng) from *N. gonorrhoeae*:

```
    g920/m920
                                                    10         20         30
        g920.pep                             PMQLVTEKGKENMIQRGTYNYQYRSNRPVK
                                             ||||||||||||||||||||||||||||||
        m920     GGEYLKADLGYGEFPELEPIAKDRLHIFSKPMQLVTEKGKENMIQRGTYNYQYRSNRPVK
                         40        50        60        70        80        90

40        50        60        70        80        90
        g920.pep DGSYLVTAEYQPTFRSKNKAGWKQAGIKEMPDASYCEQTRMFGKNIVNVGHESADTAIIT
                 ||||||  |||||||  | |||||||||||||||||||||||||||||||||||||||||
        m920     DGSYLVIAEYQPTFWSKXKAGWKQAGIKEMPDASYCEQTRMFGKNIVNVGHESADTAIIT
                        100       110       120       130       140       150

100       110       120       130       140       150
        g920.pep KPVGQNLEIVPLDNPADIHVGXRFKVRVLFRGEPLPNATVTATFDGFDTSDRSKTHKTEA
                 ||||||||||||||||: |||| |||||||||||||||||||||||||||||||||: ||
        m920     KPVGQNLEIVPLDNPANIHVGERFKVRVLFRGEPLPNATVTATFDGFDTSDRSKTHXXEA
                        160       170       180       190       200       210

160       170       180       190       200
        g920.pep QAFSDTTDGEGEVDIIPLRQGFWKASVEYKADFPDQSLCRKQANYTTLTFQIAHSHHX
                 |||||: || :|||||| |||||||:||:|:|||||:|:||||||:|||||:|||||
        m920     QAFSDSTDDKGEVDIIXLRQGFWKANVEHKTDFPDQSVCQKQANYSTLTFQIGHSHHX
                        220       230       240       250       260
```

The following partial DNA sequence was identified in *N. meningitidis* <SEQ ID 2799>:

```
a920.seq
   1 TGAAAGAAAA CATTGACACT GCTCGCCGTT TCCGCCCTAT TTGCCGCATC

51 CGCCCACGCC CACCGCGTCT GGGTCGAAAC CGCCCACACG CACGGCGGCG

101 AATACCTTAA AGCCGACTTG GGCTACGGCG AATTTCCCGA ACTCGAACCC

151 ATCGCCAAAG ACCGCCTGCA CATCTTCAGC AAACCGATGC AGCTGGTTAC

201 CGAAAAAGGC AAGGAAAACA TGATTCAACG CGGCACATAC AACTACCAGT

251 ACCGAAGCAA CCGTCCCGTT AAGGACGGCA GTTACCTCGT CATCGCCGAA

301 TATCAGCCTA CTTTCTGGTC AAAAAACAAA GCAGGCTGGA AACAGGCGGG

351 CATCAAACAA ATGCCTGACG CAAGCTATTG CGAACAAACC CGAATGTTCG

401 GCAAAAACAT CGTCAACGTC GGACACGAAA GCGCGGACAC CGCCATCATC

451 ACCAAACCGG TCGGACAAAA CTTGGAAATC GTCCCGCTGG ACAATCCCGC

501 CAACATTCAC GTAGGCGAAC GCTTCAAAGT CCGCGTTCTG TTCCGTGGCG

551 AACCGCTGCC CAATGCCACC GTTACCGCCA CCTTTGACGG CTTCGACACC

601 AGCGACCGCA GCAAAACGCA CAAAACCGAA GCACAGGCTT TCTCCGACAG

651 CACAGACGAC AAAGGCGAAG TGGACATCAT CCCCTTGCGC CAAGGCTTCT

701 GGAAAGCCAA TGTCGAACAC AAAGCCGACT TCCCCGATCA AAGCGTGTGC

751 CAAAAACAGG CGAACTACTC GACTTTAACC TTCCAAATCG GCCATTCGCA

801 CCATTAA
```

This corresponds to the amino acid sequence <SEQ ID 2800; ORF 920.a>:

```
a920.pep
   1 *KKTLTLLAV SALFAASAHA HRVWVETAHT HGGEYLKADL GYGEFPELEP

51 IAKDRLHIFS KPMQLVTEKG KENMIQRGTY NYQYRSNRPV KDGSYLVIAE

101 YQPTFWSKNK AGWKQAGIKQ MPDASYCEQT RMFGKNIVNV GHESADTAII

151 TKPVGQNLEI VPLDNPANIH VGERFKVRVL FRGEPLPNAT VTATFDGFDT

201 SDRSKTHKTE AQAFSDSTDD KGEVDIIPLR QGFWKANVEH KADFPDQSVC

251 QKQANYSTLT FQIGHSHH*
```

(In a920.pep, residues 1–20 "*KKTLTLLAV SALFAASAHA" are underlined.)

m920/a920 97.0% identity in 267 aa overlap

```
                    10        20        30        40        50        60
m920.pep   MKKTLTLLSVSALFATSAHAHRVWETAHTHGGEYLKADLGYGEFPELEPIAKDRLHIFS
           ||||||||:||||||:||||||||||||||||||||||||||||||||||||||||||||
a920       XKKTLTLLAVSALFAASAHAHRVWETAHTHGGEYLKADLGYGEFPELEPIAKDRLHIFS
                    10        20        30        40        50        60

70        80        90       100       110       120
m920.pep  KPMQLVTEKGENMIQRGTYNYQYRSNRPVKDGSYLVIAEYQPTFWSKXKAGWKQAGIKE
          ||||||||||||||||||||||||||||||||||||||||||||||| |||||||||||:
a920      KPMQLVTEKGENMIQRGTYNYQYRSNRPVKDGSYLVIAEYQPTFWSKNKAGWKQAGIKQ
                  70        80        90       100       110       120

130       140       150       160       170       180
m920.pep  MPDASYCEQTRMFGKNIVNVGHESADTAIITKPVGQNLEIVPLDNPAIHVGERFKVRVL
          |||||||||||||||||||||||||||||||||||||||||||||||||||||||||||:
a920      MPDASYCEQTRMFGKNIVNVGHESADTAIITKPVGQNLEIVPLDNPAIHVGERFKVRVL
                 130       140       150       160       170       180
```

```
          190        200        210        220        230        240
m920.pep  FRGEPLPNATVTATFDGFDTSDRSKTHXXEAQAFSDSTDDKGEVDIIXLRQGFWKANVEH
          ||||||||||||||||||||||||||  :||||||||||||||||||| ||||||||||||
a920      FRGEPLPNATVTATFDGFDTSDRSKTHKTEAQAFSDSTDDKGEVDIIPLRQGFWKANVEH
          190        200        210        220        230        240

250        260    269
m920.pep  KTDFPDQSVCQKQANYSTLTFQIGHSHHX
          |:|||||||||||||||||||||||||||
a920      KADFPDQSVCQKQANYSTLTFQIGHSHHX
          250        260
```

The following partial DNA sequence was identified in *N. gonorrhoeae* <SEQ ID 2801>:

```
g920-1.seq
   1 ATGAAGAAAA CATTGACACT GCTCGCcgtt TcCGCACTAT TTGCCACATc 51 cgCaCACCCC CACCgCGTCT GGGTCGAAAC CgccCACACg cAcgGCGGCG

101 AATACCTTAA AGCCGACTTG GGCTACGGCG AATTCCCCGA ACTCGAACCC

151 ATCGccAAAG ACCgccTGCA CATCTTCAGC AAACCGATGC AGCTGGTTAC

201 CGAAAAAGGT AAGGAAAACA TGATTCAACG CGGCACATAC AACTACCAAT

251 ACCGCAGCAA CCGTCCCGTC AAAGACGGCA GCTACCTCGT TACCGCCGAA

301 TATCAGCCTA CTTTCCGGTC AAAAAACAAA GCAGGCTGGA AACAGGCTGG

351 CATCAAAGAA ATGCCTGACG CAAGCTATTG CGAACAAACC CGTATGTTCG

401 GTAAAAACAT TGTCAACGTG GGACACGAAA GCGCGGACAC CGCCATCATC

451 ACCAAACCGG TCGGACAAAA CTTGGAAATC GTCCCGCTGG ACAATCCCGC

501 CAACATTCAC GTAGGCGAAC GCTTCAAAGT CCGCGTTCTG TTCCGTGGCG

551 AACCGCTGCC AATGCCACCC GTTACCGCTA CATTTGACGG CTTCGACACC

601 AGCGACCGCA GCAAAACGCA CAAAACCGAA GCCCAAGCCT TCTCCGACAC

651 CACCGACGGC AAAGGCGAAG TGGACATCAT CCCCTTGCGC CAAGGCTTTT

701 GGAAAGCGAG TGTCGAATAC AAAGCCGATT CCCCGATCA AAGCCTGTGC

751 CAAAAACAGG CGAACTACAC AACTTTAACC TTCCAAATCG GCCATTCTCA

801 CCATTAA
```

This corresponds to the amino acid sequence <SEQ ID 2802; ORF 920-1.ng>:

```
g920-1.pep
   1 MKKTLTLLAV SALFATSAHP HRVWVETAHT HGGEYLKADL GYGEFPELEP

51 IAKDRLHIFS KPMQLVTEKG KENMIQRGTY NYQYRSNRPV KDGSYLVTAE

101 YQPTFRSKNK AGWKQAGIKE MPDASYCEQT RMFGKNIVNV GHESADTAII

151 TKPVGQNLEI VPLDNPANIH VGERFKVRVL FRGEPLPNAT VTATFDGFDT

201 SDRSKTHKTE AQAFSDTTDG KGEVDIIPLR QGFWKASVEY KADFPDQSLC

251 QKQANYTTLT FQIGHSHH*
```

The following partial DNA sequence was identified in *N. meningitidis* <SEQ ID 2803>:

```
m920-1.seq
   1 ATGAAGAAAA CATTGACACT GCTCGCCGTT TCCGCCCTAT TTGCCACATC

51 CGCCCACGCC CACCGCGTCT GGGTCGAAAC CGCCCACACG CACGGCGGCG
```

-continued
```
101 AATACCTTAA AGCCGACTTG GGCTACGGCG AATTTCCCGA ACTCGAACCC

151 ATCGCCAAAG ACCGCCTGCA CATCTTCAGC AAACCGATGC AGCTGGTTAC

201 CGAAAAAGGC AAGGAAAACA TGATTCAACG CGGCACATAC AACTACCAGT

251 ACCGAAGCAA CCGTCCCGTT AAGGACGGCA GTTACCTCGT CATCGCCGAA

301 TATCAGCCTA CTTTCTGGTC AAAAAACAAA GCAGGCTGGA AACAGGCGGG

351 CATCAAAGAA ATGCCTGACG CAAGCTATTG CGAACAAACC CGAATGTTCG

401 GCAAAAACAT CGTCAACGTC GGACACGAAA GCGCGGACAC CGCCATCATC

451 ACCAAACCGG TCGGACAAAA CTTGGAAATC GTCCCGCTGG ACAATCCCGC

501 CAACATTCAC GTAGGCGAAC GCTTCAAAGT CCGCGTTCTG TTCCGTGGCG

551 AACCGCTGCC AATGCCACC GTTACCGCCA CCTTTGACGG CTTCGACACC

601 AGCGACCGCA GCAAAACGCA CAAAACCGAA GCACAGGCTT TCTCCGACAG

651 CACAGACGAC AAAGGCGAAG TGGACATCAT CCCCTTGCGC CAAGGCTTCT

701 GGAAAGCCAA TGTCGAACAC AAAACCGACT TCCCCGATCA AAGCGTGTGC

751 CAAAAACAGG CGAACTACTC GACTTTAACC TTCCAAATCG GTCATTCGCA

801 CCATTAA
```

This corresponds to the amino acid sequence <SEQ ID 2804; ORF 920-1>:

```
m920-1.pep

1 MKKTLTLLAV SALFATSAHA HRVWVETAHT HGGEYLKADL GYGEFPELEP

51 IAKDRLHIFS HRVWVETAHT KENMIQRGTY NYQYRSNRPV KDGSYLVIAE

101 YQPTFWSKNK AGWKQAGIKE MPDASYCEQT RMFGKNIVNV GHESADTAII

151 TKPVGQNLEI VPLDNPANTH VGERFKVRVL FRGEPLPNAT VTATFDGFDT

201 SDRSKTHKTE AQAFSDSTDD KGEVDIIPLR QGFWKANVEH KTDFPDQSVC

251 QKANYSTLT FQIGHSHH* m920-1/g920-1 96.3% identity in 268 aa overlap 10         20         30         40         50         60
m920-1.pep MKKTLTLLAVSALFATSAHAHRVWVETAHTHGGEYLKADLGYGEFPELEPIAKDRLHIFS
           ||||||||||||||||||| ||||||||||||||||||||||||||||||||||||||||
g920-1     MKKTLTLLAVSALFATSAHPHRVWVETAHTHGGEYLKADLGYGEFPELEPIAKDRLHIFS
                 10         30         30         40         50         60

70         80         90        100        110        120
m920-1.pep KPMQLVTEKGKENMIQRGTYNYQYRSNRPVKDGSYLVIAEYQPTFQSKNKAGWKQAGIKE
           |||||||||||||||||||||||||||||||||||||| |||||| ||||||||||||||
g920       KPMQLVTEKGKENMIQRGTYNYQYRSNRPVKDGSYLVTAEYQPTFRSKNKAGWKQAGIKE
                 70         90         90        100        110

130        140        150        160        170        180
m920-1.pep MPDASYCEQTRMFGKNIVNVGHESADTAIITKPVGQNLEIVPLDNPAHIHVGERFKVRVL
           |||||||||||||||||||||||||||||||||||||||||||||||| |||||||||||
           MPDASYCEQTRMFGKNIVNVGHESADTAIITKPVGQNLEIVPLDNPANIHVGERFKVRVL
                130        140        150        160        170        180

190        200        210        220        230        240
m920-1.pep FRGEPLPNATVTATFDGFDTSGRSKTHKTEAQAFSDSTDDKGEVDIIPLRQGFWKANVEH
           ||||||||||||||||||||||||||||||||||||:|| |||||||||||||:||:
g920-1     FRGEPLPNATVTATFDGFDTSGRSKTHKTEAQAFSDTTDGKGEVDIIPLRQGFWKASVEY
                190        200        210        220        230        240

250        260   269
m920-1.pep KTDFPDQSVCQKQANYSTLTFQIGHSHHX
           |:||||||:||||||:|||||||||||||
g920-1     KADFPDQSLCQKQANYTTLTFQIGHSHHX
                250        260
```

The following partial DNA sequence was identified in *N. meningitidis* <SEQ ID 2805>:

```
a920.seq
   1 TGAAAGAAAA CATTGACACT GCTCGCCGTT TCCGCCCTAT TTGCCGCATC

51 CGCCCACGCC CACCGCGTCT GGGTCGAAAC CGCCCACACG CACGGCGGCG

101 AATACCTTAA AGCCGACTTG GGCTACGGCG AATTTCCCGA ACTCGAACCC

151 ATCGCCAAAG ACCGCCTGCA CATCTTCAGC AAACCGATGC AGCTGGTTAC

201 CGAAAAAGGC AAGGAAAACA TGATTCAACG CGGCACATAC AACTACCAGT

251 ACCGAAGCAA CCGTCCCGTT AAGGACGGCA GTTACCTCGT CATCGCCGAA

301 TATCAGCCTA CTTTCTGGTC AAAAAACAAA GCAGGCTGGA AACAGGCGGG

351 CATCAAACAA ATGCCTGACG CAAGCTATTG CGAACAAACC CGAATGTTCG

401 GCAAAAACAT CGTCAACGTC GGACACGAAA GCGCGGACAC CGCCATCATC

451 ACCAAACCGG TCGGACAAAA CTTGGAAATC GTCCCGCTGG ACAATCCCGC

501 CAACATTCAC GTAGGCGAAC GCTTCAAAGT CCGCGTTCTG TTCCGTGGCG

551 AACCGCTGCC CAATGCCACC GTTACCGCCA CCTTTGACGG CTTCGACACC

601 AGCGACCGCA GCAAAACGCA CAAAACCGAA GCACAGGCTT TCTCCGACAG

651 CACAGACGAC AAAGGCGAAG TGGACATCAT CCCCTTGCGC CAAGGCTTCT

701 GGAAAGCCAA TGTCGAACAC AAAGCCGACT TCCCCGATCA AAGCGTGTGC

751 CAAAAACAGG CGAACTACTC GACTTTAACC TTCCAAATCG GCCATTCGCA

801 CCATTAA
```

This corresponds to the amino acid sequence <SEQ ID 2806; ORF 920-1.a>:

```
A920.pep

1  *KKTLTLLAV SALFAASAHA HRVWVETAHT HGGEYLKADL GYGEFPELEP

51  IAKDLRHIFS KPMQLVTEKG KENMIQRGTY NYQYRSNRPV KDGSYLVIAE

101  YQPTFWSKNK AGWKQAGIKQ MPDASYCEQT RMFGKNIVNY GHESADTAII

151  TKPVGQNLEI VPLDNPANIH VGERFKVRVL FRGEPLPNAT VTATFDGFDT

201  SDRSKTHKTE AQAFSDSTDD KGEVDIIPLR QGFWKANVEH KADFPDQSVC

251  QKQANYSTLT FQIGHSHH*
```

```
m920-1/a920 98.9% identity in 268 aa overlap 10        20        30        40        50        60
m920-1.pep  MKKTLTLLAVSALFATSAHAHRVWVETAHTHGGEYLKADLGYGEFPELEPIAKDRLHIFS
            |||||||||||||||:||||||||||||||||||||||||||||||||||||||||||||
a920-1      MKKTLTLLAVSALFAASAHAHRVWVETAHTHGGEYLKADLGYGEFPELEPIAKDRLHIFS
                    10        20        30        40        50        60

70        80        90        100       110       120
m920-1.pep  KPMQLVTEKGKENMIQRGTYNYQYRSNRPVKDGSYLVIAEYQPTFWSKNKAGWKQAGIKE
            |||||||||||||||||||||||||||||||||||||||||||||||||||||||||||:
a920-1      KPMQLVTEKGKENMIQRGTYNYQYRSNRPVKDGSYLVIAEYQPTFRSKNKAGWKQAGIKQ
                    70        80        90        100       110       120

130       140       150       160       170       180
m920-1.pep  MPDASYCEQTRMFGKNIVNVGHESADTAIITKPVGQNLEIVPLDNPANIHVGERFKVRVL
            ||||||||||||||||||||||||||||||||||||||||||||||||||||||||||||
a920-1      MPDASYCEQTRMFGKNIVNVGHESADTAIITKPVGQNLEIVPLDNPANIHVGERFKVRVL
                    130       140       150       160       170       180

190       200       210       220       230       240
m920-1.pep  FRGEPLPNATVTATFDGFDTSDRSKTHKTEAQAFSDSTDDKGEVDIIPLRQGFWKANVEH
            ||||||||||||||||||||||||||||||||||||||||||||||||||||||||||||
a920-1      FRGEPLPNATVTATFDGFDTSDRSKTHKTEAQAFSDSTDDKGEVDIIPLRQGFWKANVEH
                    190       200       210       220       230       250
```

```
           250        260       269
m920-1.pep  KTDFPDQSVCQKQANYSTLTFQIGHSHHX
            ||||||||||||||||||||||||||||
a920-1      KADFPDQSVCQKQANYSTLTFQIGHSHHX
              250        260
```

The following partial DNA sequence was identified in *N. gonorrhoeae* <SEQ ID 2807>:

```
g921.seq
   1 ATGAAAAAAT ACCTTATCCC TCTTTCCATT GCGGCAGTCC TTTCCGggtG

51 Ccagtctatt tatGtgccca cattgacggA aatccccgTg aatcccatca 101 ataCCgtcaa aacggaagCA CCTGCAAAAG GTTTTCGCCT CGCCCCTTCG

151 CATTGGGCGG ATGTTGCCAA AATCAGCGAT GAAGCGACGC GCTTGGGCTA

201 TCAGGTGGGT ATCGGTAAAA TGACCAAGGT TCAGGcGGCG CAATATCTGA

251 ACAACTTCAG AAAACGCCTG GTCGGACGCA ATGCCGTCGA TGACAGTATG

301 TATGAAATCT ACCTGCGTTC GGCGGTAGAC AGCCAGCGCG GCGAAATCAA

351 TACGGAACAG TCCAAGCTGT ATATCGAGAA TGCCTTGCGC GGCTGGCAGC

401 AGCGTtggAA AAATATGGAT GCCAAACCCG ATAATCCCGC ATTTACCAAC

451 TTTTTGATGG AAGTGATGAA GATGCAGCCC TTGAAATGA
```

This corresponds to the amino acid sequence <SEQ ID 2808; ORF 921.ng>:

```
g921.pep
   1 MKKYLIPLSI AAVLSGCQSI YVPTLTEIPV NPINTVKTEA PAKGFRLAPS

51 HWADVAKISD EATRLGYQVG IGKMTKVQAA QYLNNFRKRL VGRNAVDDSM

101 YEIYLRSAVD SQRGEINTEQ SKLYIENALR GWQQRWKNMD AKPDNPAFTN

151 FLMEVMKMQP LK*
```

The following partial DNA sequence was identified in *N. meningitidis* <SEQ ID 2809>:

```
m921.seq
   1 ATGAAAAAAT ACCTTATCCC TCTTTCCATT GCGGCAGTTC TTTCCGGCTG

51 CCAGTCTATT TATGTGCCCA CATTGACGGA AATCCCCGTG AATCCTATCA

101 ATACCGTCAA AACGGAAGCA CCTGCAAAAG GTTTCCGCCT TGCCTCTTCG

151 CATTGGACGG ATGTTGCCAA AATCAGCGAT GAAGCGACGC GCTTGGGCTA

201 TCAGGTGGGT ATCGGTAAAA TGACCAAGGT TCAGGCGGCG CAATATCTGA

251 ACAACTTCAG AAAACGCCTG GTCGGACGCA ATGCCGTCGA TGACAGTATG

301 TATGAAATCT ACCTGCGTTC GGCGATAGAC AGCCAGCGGG GCGCAATCAA

351 TACGGAACAG TCCAAGCTGT ATATCCAGAA TGCCTTGCGC GGCTGGCAGC

401 AGCGTTGGAA AAATATGGAT GTCAAACCCA ACAACCCCGC ATTTACCAAC

451 TTTTTGATGG AAGTGATGAA GATGCAGCCC TTGAAATGA
```

This corresponds to the amino acid sequence <SEQ ID 2810; ORF 921>:

```
m921.pep
   1 MKKYLIPLSI AAVLSGCQSI YVPTLTEIPV NPINTVKTEA PAKGFRLASS

51 HWTDVAKISD EATRLGYQVG IGKMTKVQAA QYLNNFRKRL VGRNAVDDSM

101 YEIYLRSAID SQRGAINTEQ SKLYIQNALR GWQQRWKNMD VKPNNPAFTN

151 FLMEVMKMQP LK*
```

Computer analysis of this amino acid sequence gave the following results:
Homology with a Predicted ORF from *N. gonorrhoeae*
ORF 921 shows 95.7% identity over a 162 aa overlap with a predicted ORF (ORF 921.ng) from *N. gonorrhoeae*:

```
   m921/g921
                    10         20         30         40         50         60
   m921.pep MKKYLIPLSIAAVLSGCQSIYVPTLTEIPVNPINTVKTEAPAKGFRLASSHWTDVAKISD
            ||||||||||||||||||||||||||||||||||||||||||||||| |||:|||||||
   g921     MKKYLIPLSIAAVLSGCQSIYVPTLTEIPVNPINTVKTEAPAKGFRLAPSHWADVAKISD
                    10         20         30         40         50         60
                    70         80         90        100        110        120
   m921.pep EATRLGYQVGIGKMTKVQAAQYLNNFRKRLVGRNAVDDSMYEIYLRSAIDSQRGAINTEQ
            ||||||||||||||||||||||||||||||||||||||||||||||:|||| |||||
   g921     EATRLGYQVGIGKMTKVQAAQYLNNFRKRLVGRNAVDDSMYEIYLRSAVDSQRGEINTEQ
                    70         80         90        100        110        120
                   130        140        150        160
   m921.pep SKLYIQNALRGWQQRWKNMDVKPNNPAFTNFLMEVMKMQPLKX
            |||||:||||||||||||||:||:||||||||||||||||||
   g921     SKLYIENALRGWQQRWKNMDAKPDNPAFTNFLMEVMKMQPLKX
                   130        140        150        160
```

The following partial DNA sequence was identified in *N. meningitidis* <SEQ ID 2811>:

```
a921.seq
   1 ATGAAAAAAT ACCTTATCCC TCTTTCCATT GTGGCAGTTC TTTCCGGCTG

51 CCAGTCTATT TATGTGCCCA CATTGACGGA AATCCCCGTG AATCCTATCA

101 ATACCGTCAA AACGGAAGCA CCTGCAAAAG GTTTCCGCCT TGCCTCTTCG

151 CATTGGACGG ATGTTGCCAA AATCAGCGAT GAAGCGACGC GCTTGGGCTA

201 TCAGGTGGGT ATCGGTAAAA TGACCAAGGT TCAGGCGGCG CAATATCTGA

251 ACAACTTCAG AAAACGCCTG GTCGGACGCA ATGCCGTCGA TGACAGTATG

301 TATGAAATCT ACCTGCGTTC GGCGATAGAC AGCCAGCGGG GCGCAATCAA

351 TACGGAACAG TCCAAGCTGT ATATCCAGAA TGCCTTGCGC GGCTGGCAGC

401 AGCGTTGGAA AAATATGGAT GTCAAACCCA ACAACCCCGC ATTTACCAAC

451 TTTTTGATGG AAGTGATGAA GATGCAGCCC TTGAAATGA
```

This corresponds to the amino acid sequence <SEQ ID 2812; ORF 921.a>:

```
a921.pep
   1 MKKYLIPLSI VAVLSGCQSI YVPTLTEIPV NPINTVKTEA PAKGFRLASS

51 HWTDVAKISD EATRLGYQVG IGKMTKVQAA QYLNNFRKRL VGRNAVDDSM

101 YEIYLRSAID SQRGAINTEQ SKLYIQNALR GWQQRWKNMD VKPNNPAFTN

151 FLMEVMKMQP LK*
``` m921/a921 99.4% identity in 162 aa overlap

```
                 10        20        30        40        50        60
  m921.pep   MKKYLIPLSIAAVLSGCQSIYVPTLTEIPVNPINTVKTEAPAKGFRLASSHWTDVAKISD
             ||||||||||:|||||||||||||||||||||||||||||||||||||||||||||||||
  a921       MKKYLIPLSIVAVLSGCQSIYVPTLTEIPVNPINTVKTEAPAKGFRLASSHWTDVAKISD
                 10        20        30        40        50        60

70        80        90       100       110       120
  m921.pep   EATRLGYQVGIGKMTKVQAAQYLNNFRKRLVGRNAVDDSMYEIYLRSAIDSQRGAINTEQ
             ||||||||||||||||||||||||||||||||||||||||||||||||||||||||||||
  a921       EATRLGYQVGIGKMTKVQAAQYLNNFRKRLVGRNAVDDSMYEIYLRSAIDSQRGAINTEQ
                 70        80        90       100       110       120

130       140       150       160
  m921.pep   SKLYIQNALRGWQQRWKNMDVKPNNPAFTNFLMEVMKMQPLKX
             ||||||||||||||||||||||||||||||||||||||||||
  a921       SKLYIQNALRGWQQRWKNMDVKPNNPAFTNFLMEVMKMQPLKX
                130       140       150       160
```

The following partial DNA sequence was identified in *N. gonorrhoeae* <SEQ ID 2813>:

```
g922.seq
    1 ATGGAAAAGA GAAAAATACT GCCGCTGGCA ATTTGTTTGG CGGCTTTGTC

51 TGCCTGTACG GCGATGGAGG CCCGCACACC CCGGGCAAAT GAAGCCCAAG

101 CCCCCCGCGC GGATGAAATG AAAAAAGAAA GCCGCCCCGC GTTTGACGCG

151 GCAGCCGTAC CGGTATCCGA CAGCGGGTTT GCCGCCAATG CAAATGTCCG

201 CCGTTTTGTG GACGATGAAG TCGGGAAAGG GGATTTTTCC CAGGCGGAAT

251 GGCAGGATTT TTTTGACAAA GCGGCTTACA AGGCGGACAT CGTCAAGAtt

301 ATGCACCGAC CCTCCACATC GCGtCCGTGG TATGtgttcc gCacggGAAa 351 ttcGGgcagg gcgaaAtttc ACggcgCGCG Caggttttat GcggaaAacc 401 gcgcggttat cgatgatgtg gcgCAAAAat acggcgtGCC TGCCGAGCTT

451 ATCGTGGCGA TTATCGGGAT TGAAACGAAT TACGGCAAAA ATACGGGCAG

501 TTTCCGTGTG GCGGACGCAT TGGCGACTTT AGGCTTTGAT TATCCCCGCC

551 GCGCCGGGTT TTTCCAAAAA GAATTGGTCG AGCTTTTAAA GCTGGCAAAA

601 GAAGAAGGCG GTGATGTTTT CGCCTTTAAG GGCAgcTATG CGGGTGCAAT

651 GGGTATGCCG CAATTTATGC CTTCGAGCTA CCGGAAATGG GCGGTGGATT

701 ATGAcgggga cggacatCGG GATATAtggg GCAACGTcgg tgatgtcgcg 751 gcatcggTTG CCAATTAtat gaagCAGCAC GGTTGGCGCA CgggcggtAA 801 AATGTTGGTG TCGGCGAcgt tggcgccggg tgcggATGTT CAggcAATCA 851 TTGGCGAAAA AACCGCCCTG ACGCGGACGG TGGCGGATTT GAaggCGTAc 901 ggcatcatcc ccggggaaaC GCTCGCAGAT GATGAAAAGg cgGTTTTGTT

951 CAAACTGGAA ACCGCACCCG GCGTGTTTGA ATATTATTTG GCTTGAACA

1001 ATTTTTATAC GGTATGGCAG TACAACCACA GCCGGATGTA TGTAACGgcg 1051 gtcaggGACA TTGCCAATTC GCTCGGCGGC CCGGGATTGT Aa
```

This corresponds to the amino acid sequence <SEQ ID 2814; ORF 922.ng>:

```
g922.pep
    1 MEKRKILPLA ICLAALSACT AMEARTPRAN EAQAPRADEM KKESRPAFDA

51 AAVPVSDSGF AANANVRRFV DDEVGKGDFS QAEWQDFFDK AAYKADIVKI
```

-continued

```
101 MHRPSTSRPW YVFRTGNSGR AKFHGARRFY AENRAVIDDV AQKYGVPAEL

151 IVAIIGIETN YGKNTGSFRV ADALATLGFD YPRRAGFFQK ELVELLKLAK

201 EEGGDVFAFK GSYAGAMGMP QFMPSSYRKW AVDYDGDGHR DIWGNVGDVA

251 ASVANYMKQH GWRTGGKMLV SATLAPGADV QAIIGEKTAL TRTVADLKAY

301 GIIPGETLAD DEKAVLFKLE TAPGVFEYYL GLNNFYTVWQ YNHSRMYVTA

351 VRDIANSLGG PGL*
```

The following partial DNA sequence was identified in *N. meningitidis* <SEQ ID 2815>:

```
m922.seq
    1 ATGAAAAAGA GAAAAATACT GCCGCTGGCA ATTTGTTTGG CGGCTTTGTC

51 TGCCTGTACG GCGATGGAGG CACGCCCACC CCGGGCAAAT GAAGCCCAAG

101 CCCCCCGCGC GGTTGAAATG AAAAAAGAAA GCCGCCCCGC GTTTGACGCG

151 GCAGCCGTAT TTGACGCGGC AGCCGTACCG GTATCCGACA GCGGGTTTGC

201 CGCCAATGCA AATGTCCGCC GTTTTGTGGA CGATGAAGTC GGGAAGGGGG

251 ATTTTTCCCG GCGGAATGG CAGGATTTTT TTGACAAAGC GGCTTACAAG

301 GCGGACATCG TCAAGATTAT GCACCGCCCC TCCACATCGC GTCCGTGGTA

351 TGTGTTCCGC ACGGGAAATT CGGGCAAGGC GAAATTTCGC GGCGCGCGCC

401 GGTTTTATGC GGAAAACCGC GCGCTTATCG ATGATGTGGC GCAAAAATAC

451 GGCGTGCCTG CCGAACTTAT CGTGGCGGTT ATCGGGATTG AAACGAATTA

501 CGGCAAAAAT ACGGGCAGTT CCGTGTGGC GGACGCATTG GCGACCTTAG

551 GCTTTGATTA CCCCCGCCGC GCCGGGTTTT TCCAAAAAGA ATTGGTCGAG

601 CTTTTAAAGC TGGCAAAAGA AGAAGGCGGC GATGTTTTCG CCTTTAAAGG

651 CAGCTATGCG GCGCAATGG GGATGCCGCA ATTTATGCCT TCGAGCTACC

701 GGAAATGGGC GGTGGATTAT GACGGGACG GACATCGGGA CATATGGGGC

751 AACGTCGGCG ATGTCGCGGC ATCGGTTGCC AATTATATGA AGCAGCACGG

801 TTGGCGCACG GGCGGGAAAA TGCTGGTGTC TGCAACATTG GCGCCGGGTG

851 CGGATGTTCA GGCAATCATT GGCGAAAAAA CCGCCCTGAC GCGGACGGTG

901 GCGGATTTGA AGGCGTACGG CATCATCCCC GGCGAAGAGC TTGCAGATGA

951 TGAAAAGGCG GTTTTGTTCA AACTGGAAAC CGCACCGGGC GTGTTTGAAT

1001 ATTATTTGGG CTTGAACAAT TTTTATACGG TATGGCAGTA CAACCACAGC

1051 CGGATGTATG TAACGGCGGT CAGGGACATT GCCAATTCGC TTGGCGGCCC

1101 GGGATTGTAA
```

This corresponds to the amino acid sequence <SEQ ID 2816; ORF 922>:

```
m922.pep
    1 MKKRKILPLA ICLAALSACT AMEARPPRAN EAQAPRAVEM KKESRPAFDA

51 AAVFDAAAVP VSDSGFAANA NVRRFVDDEV GKGDFSRAEW QDFFDKAAYK

101 ADIVKIMHRP STSRPWYVFR TGNSGKAKFR GARRFYAENR ALIDDVAQKY

151 GVPAELIVAV IGIETNYGKN TGSFRVADAL ATLGFDYPRR AGFFQKELVE

201 LLKLAKEEGG DVFAFKGSYA GAMGMPQFMP SSYRKWAVDY DGDGHRDIWG
```

```
251 NVGDVAASVA NYMKQHGWRT GGKMLVSATL APGADVQAII GEKTALTRTV

301 ADLKAYGIIP GEELADDEKA VLFKLETAPG VFEYYLGLNN FYTVWQYNHS

351 RMYVTAVRDI ANSLGGPGL*
```

Computer analysis of this amino acid sequence gave the following results:
Homology with a Predicted ORF from *N. gonorrhoeae* [10]
ORF 922 shows 95.9% identity over a 369 aa overlap with a predicted ORF (ORF 922.ng) from *N. gonorrhoeae*:

```
    m922/g922
                    10        20        30        40        50        60
    m922.pep  MKKRKILPLAICLAALSACTAMEARPPRANEAQAPRAVEMKKESRPAFDAAAVFDAAAVP
              |:|||||||||||||||||||||||| |||||||||| |||||||||||||      |||
    g922      MEKRKILPLAICLAALSACTAMEARTPRANEAQAPRADEMKKESRPAFDAA------AVP
                    10        20        30        40        50
                    70        80        90       100       110       120
    m922.pep  VSDSGFAANANVRRFVDDEVGKGDFSRAEWQDFFDKAAYKADIVKIMHRPSTSRPWYVFR
              |||||||||||||||||||||||||:||||||||||||||||||||||||||||||||||
    g922      VSDSGFAANANVRRFVDDEVGKGDFSQAEWQDFFDKAAYKADIVKIMHRPSTSRPWYVFR
                    60        70        80        90       100       110
                   130       140       150       160       170       180
    m922.pep  TGNSGKAKFRGARRFYAENRALIDDVAQKYGVPAELIVAVIGIETNYGKNTGSFRVADAL
              |||||:|||:|||||||||||:||||||||||||||||||:|||||||||||||||||||
    g922      TGNSGRAKFHGARRFYAENRAVIDDVAQKYGVPAELIVAIIGIETNYGKNTGSFRVADAL
                   120       130       140       150       160       170
                   190       200       210       220       230       240
    m922.pep  ATLGFDYPRRAGFFQKELVELLKLAKEEGGDVFAFKGSYAGAMGMPQFMPSSYRKWAVDY
              ||||||||||||||||||||||||||||||||||||||||||||||||||||||||||||
    g922      ATLGFDYPRRAGFFQKELVELLKLAKEEGGDVFAFKGSYAGAMGMPQFMPSSYRKWAVDY
                   180       190       200       210       220       230
                   250       260       270       280       290       300
    m922.pep  DGDGHRDIWGNVGDVAASVANYMKQHGWRTGGKMLVSATLAPGADVQAIIGEKTALTRTV
              ||||||||||||||||||||||||||||||||||||||||||||||||||||||||||||
    g922      DGDGHRDIWGNVGDVAASVANYMKQHGWRTGGKMLVSATLAPGADVQAIIGEKTALTRTV
                   240       250       260       270       280       290
                   310       320       330       340       350       360
    m922.pep  ADLKAYGIIPGEELADDEKAVLFKLETAPGVFEYYLGLNNFYTVWQYNHSRMYVTAVRDI
              |||||||||||| ||||||||||||||||||||||||||||||||||||||||||||||
    g922      ADLKAYGIIPGETLADDEKAVLFKLETAPGVFEYYLGLNNFYTVWQYNHSRMYVTAVRDI
                   300       310       320       330       340       350
                   370
    m922.pep  ANSLGGPGLX
              ||||||||||
    g922      ANSLGGPGLX
                   370
```

The following partial DNA sequence was identified in *N. meningitidis* <SEQ ID 2817>:

```
a922.seq
   1  ATGAAAAACA GAAAATACT GCCGCTGGCA ATTTGTTTGG CGGCTTTGTC

51  TGCCTGTACG GCGATGGAGG CACGCCCGCC CCGGGCAAAT GAAGCCCAAG

101  CCCCCCGCGC GGATGAAATG AAAAAAGAAA GCCGCCCCGC GTTTGACGCG

151  GCAGCCGTAT TTGACGCGGC AGCCGTACCG GTATCCGACA GCGGGTTTGC

201  CGCCAATGCA AATGTCCGCC GTTTTGTGGA CGATGAAGTC GGGAAGGGG

251  ATTTTTCCCG GGCGGAATGG CAGGATTTTT TTGACAAAGC GGCTTACAAG

301  GCGGACATCG TCAAGATTAT GCACCGCCCC TCCACATCGC GTCCGTGGTA

351  TGTGTTCCGC ACGGGAAATT CGGGCAAGGC GAAATTTCGC GGCGCGCGCC
```

```
 401 GGTTTTATGC GGAAAACCGC GCGCTTATCG ATGATGTGGC GCAAAAATAC

451 GGCGTGCCTG CCGAACTTAT CGTGGCGGTT ATCGGGATTG AAACGAATTA

501 CGGCAAAAAT ACGGGCAGTT TCCGTGTGGC GGACGCATTG GCGACCTTAG

551 GCTTTGATTA CCCCCGCCGC GCCGGGTTTT TCCAAAAAGA ATTGGTCGAG

601 CTTTTAAAGC TGGCAAAAGA AGAAGGCGGC GATGTTTTCG CCTTTAAAGG

651 CAGCTATGCG GGCGCAATGG GGATGCCGCA ATTTATGCCT TCGAGCTACC

701 GGAAATGGGC GGTGGATTAT GACGGGACG GACATCGGGA CATATGGGGC

751 AATGTTGGCG ATGTCGCGGC ATCGATTGCC AATTATATGA AGCAGCACGG

801 TTGGCGCACG GGCGGGAAAA TACTGGTGTC TGCAACATTG GCGCCGGGTG

851 CGGATGTTCA GGCAATCATT GGCGAAAAAA CCGCCCTGAC GCGGACGGTG

901 GCGGATTTGA AGGCGTACGG CATCATCCCC GGCGAAGAGC TTGCCGATGA

951 TGAAAGGCG GTTTTGTTCA AACTGGAAAC CGCACCCGGC GTGTTTGAAT

1001 ATTATTTGGG CTTGAACAAT TTTTATACGG TATGGCAGTA CAATCACAGT

1051 CGGATGTATG TAACGGCGGT CAGGGACATT GCCAATTCGC TTGGCGGCCC

1101 GGGATTGTAA
```

This corresponds to the amino acid sequence <SEQ ID 2818; ORF 922.a>:

```
a922.pep.
  1 MKNRKILPLA ICLAALSACT AMEARPPRAN EAQAPRADEM KKESRPAFDA

51 AAVFDAAAVP VSDSGFAANA NVRRFVDDEV GKGDFSRAEW QDFFDKAAYK

101 ADIVKIMHRP STSRPWYVFR TGNSGKAKFR GARRFYAENR ALIDDVAQKY

151 GVPAELIVAV IGIETNYGKN TGSFRVADAL ATLGFDYPRR AGFFQKELVE

201 LLKLAKEEGG DVFAFKGSYA GAMGMPQFMP SSYRKWAVDY DGDGHRDIWG

251 NVGDVAASIA NYMKQHGWRT GGKILVSATL APGADVQAII GEKTALTRTV

301 ADLKAYGIIP GEELADDEKA VLFKLETAPG VFEYYLGLNN FYTVWQYNHS

351 RMYVTAVRDI ANSLGGPGL*
``` m922/a922 98.9% identity in 369 aa overlap

```
                  10         20         30         40         50         60
  m922.pep  MKKRKILPLAICLAALSACTAMEARPPRANEAQAPRAVEMKKESRPAFDAAAVFDAAAVP
            ||:|||||||||||||||||||||||||||||||||||  ||||||||||||||||||||
      a922  MKNRKILPLAICLAALSACTAMEARTPRANEAQAPRADEMKKESRPAFDAAAVFDAAAVP
                  10         20         30         40         50         60

70         80         90        100        110        120
  m922.pep  VSDSGFAANANVRRFVDDEVGKGDFSRAEWQDFFDKAAYKADIVKIMHRPSTSRPWYVFR
            ||||||||||||||||||||||||||||||||||||||||||||||||||||||||||||
      a922  VSDSGFAANANVRRFVDDEVGKGDFSRAEWQDFFDKAAYKADIVKIMHRPSTSRPWYVFR
                  70         80         90        100        110        120

130        140        150        160        170        180
  m922.pep  TGNSGKAKFRGARRFYAENRALIDDVAQKYGVPAELIVAVIGIETNYGKNTGSFRVADAL
            ||||||||||||||||||||||||||||||||||||||||||||||||||||||||||||
      a922  TGNSGKAKFRGARRFYAENRALIDDVAQKYGVPAELIVAVIGIETNYGKNTGSFRVADAL
                 130        140        150        160        170        180

190        200        210        220        230        240
  m922.pep  ATLGFDYPRRAGFFQKELVELLKLAKEEGGDVFAFKGSYAGAMGMPQFMPSSYRKWAVDY
            ||||||||||||||||||||||||||||||||||||||||||||||||||||||||||||
      a922  ATLGFDYPRRAGFFQKELVELLKLAKEEGGDVFAFKGSYAGAMGMPQFMPSSYRKWAVDY
                 190        200        210        220        230        240
```

-continued

```
              250        260        270        280        290        300
m922.pep  DGDGHRDIWGNVGDVAASVANYMKQHGWRTGGKMLVSATLAPGADVQAIIGEKTALTRTV
          ||||||||||||||||||:||||||||||||||:||||||||||||||||||||||||||
a922      DGDGHRDIWGNVGDVAASIANYMKQHGWRTGGKILVSATLAPGADVQAIIGEKTALTRTV
              250        260        270        280        290        300

310        320        330        340        350        360
m922.pep  ADLKAYGIIPGEELADDEKAVLFKLETAPGVFEYYLGLNNFYTVWQYNHSRMYVTAVRDI
          ||||||||||||||:|||||||||||||||||||||||||||||||||||||||||||||
g922      ADLKAYGIIPGETLADDEKAVLFKLETAPGVFEYYLGLNNFYTVWQYNHSRMYVTAVRDI
              310        320        330        340        350        360

370
m922.pep  ANSLGGPGLX
          ||||||||||
a922      ANSLGGPGLX
              370
```

The following partial DNA sequence was identified in *N. gonorrhoeae* <SEQ ID 2819>:

```
g923.seq
  1 ATGAAGCGGC AGGCTTTCTT CAAACCGATG GCGTGTGCGG CATTTCTGTC

51 CGCCGTTTCG CTGCGCCTCC CCGTATTGGG CGCGTGTTAC GCAATATTGT

101 CCCTCTATGC GTTTGCACTT TACGGCATCG ACAAACGGCG TGCCGTGCGG

151 GGAAAACGCC GCATTCCCGA ACACCGCCTG CTCCTGCCTG CCTTGTTCGG

201 CGGTTGGACG GGCGCATACT TGGGTAGTAG GATGTTCAGG CATAAAACGG

251 CGAAAAAGCG TTTTGTTGTG CTGTTCCGTC TGACTGTTTC GGGCAATGTC

301 CTGGCGACCT GCATCCTGAT TGATTATTTC GTTCCGCCCG AACTTTTTGT

351 AAAACTCGGG CAACATCTCT GA
```

This corresponds to the amino acid sequence <SEQ ID 2820; ORF 923.ng>:

```
g923.pep
  1 MKRQAFFKPM ACAAFLSAVS LRLPVLGACY AILSLYAFAL YGIDKRRAVR

51 GKRRIPEHRL LLPALFGGWT GAYLGSRMFR HKTAKKRFVV LFRLTVSGNV

101 LATCILIDYF VPPELFVKLG QHL*
```

The following partial DNA sequence was identified in *N. meningitidis* <SEQ ID 2821>:

```
m923.seq
  1 ATGAAGCGGC AGGCTTTCTT CAAACTGATG GCGTGTGCGG CATTTCTGTC

51 TGCCGTTTCG CTGCGCCTCC CCGTATTGGG CGCGTGTTAC GCAATATTGT

101 CCCTCTATGC GTTTGCACTT TACGGCATCG ACAAACGGTG CGCCATACGG

151 GGGCAACGCC GCATTCCCGA ACACCGCCTG CTGCTGCCTG CATTGCTCGG

201 CGGCTGGGTG GGCGCGTATT TCGGCAGCAT GACATTCAAA CATAAGACAG

251 CGAAAAAGCG TTTTGTTGTG CTGTTCCGTC TGACTGTTTC AGGTAATGTC

301 TTGGCGACCC TCATCCTGAT TTATAGTGGA TTAAATTTAA ACCAGTACGG

351 CGTTGCCTCG CCTTGCCGTA CTATTTGTAC TGTCTGCGGC TTCGTCGCCT

401 TGTCCTGATT TTTGTTAATC CACTATAT.T ATTTTGTCCC GCCTGAATTT

451 TTCGTAAAAC TCGGGCAGAA TACCTGA
```

This corresponds to the amino acid sequence <SEQ ID 2822; ORF 923>:

```
m923.pep
    1 MKRQAFFKLM ACAAFLSAVS LRLPVLGACY AILSLYAFAL YGIDKRCAIR

51 GQRRIPEHRL LLPALLGGWV GAYFGSMTFK HKTAKKRFVV LFRLTVSGNV

101 LATLILIYSG LNLNQYGVAS PCRTICTVCG FVALS*FLLI HYXYFVPPEF

151 FVKLGQNT*
```

Computer analysis of this amino acid sequence gave the following results:

Homology with a Predicted ORF from *N. gonorrhoeae*

ORF 923 shows 68.8% identity over a 157 aa overlap with a predicted ORF (ORF 923.ng) from *N. gonorrhoeae*:

```
     g923/m923
                    10         20         30         40         50         60
       g923.pep  MKRQAFFKPMACAAFLSAVSLRLPVLGACYAILSLYAFALYGIDKRRAVRGKRRIPEHRL
                 ||||||||  |||||||||||||||||||||||||||||||||||| :||:||||||||
           m923  MKRQAFFKLMACAAFLSAVSLRLPVLGACYAILSLYAFALYGIDKRCAIRGQRRIPEHRL
                    10         20         30         40         50         60

70         80         90        100
       g923.pep  LLPALFGGWTGAYLGSRMFRHKTAKKRFVVLFRLTVSGNVLATCILID------------
                 |||||:|||:|||:||  |:|||||||||||||||||||||||  |||
           m923  LLPALLGGWVGAYFGSMTFKHKTAKKRFVVLFRLTVSGNVLATLILIYSGLNLNQYGVAS
                    70         80         90        100        110        120

110        120
       g923.pep  ----------------------YFVPPELFVKLGQHLX
                                       |||||||||||:||:
           m923  PCRTICTVCGFVALSXFLLIHYIYFVPPEFFVKLGQNTX
                            130        140        150
```

The following partial DNA sequence was identified in *N. meningitidis* <SEQ ID 2823>:

```
a923.seq
    1 ATGAAGCGGC AGGCTTTCTT CAAACTGATG GCGTGTGCGG CATTTCTGTC

51 TGCCGTTTCG CTGCGCCTCC CCGTATTGGG CGCGTGTTAC GCAATATTGT

101 CCCTCTATGC GTTTGCACTT TACGGCATCG ACAAACGGCG TGCCGTGCGG

151 GGAAAACGCC GCATTCCCGA ACACCGCCTG CTGCTGCCTG CCTTGTTCGG

201 CGGTTGGGCG GGCGCATACT TGGGCAGCAG GATATTCAGG CATAAAACGG

251 CGAAAAAGCG TTTTGTTGTG CTGTTCCGTC TGACTGTTTC GGGCAATGTC

301 CTGGCGACCC TCATCCTGAT TTATAGTGGA TTAAATTTAA ACCAGTACGG

351 CGTTGCCTCG CCTTA.GCTC AAAGAGAACG ATTCTCTAAG GTGCTGAAGC

401 ACCAAGTGAA TCGGTTCCGT ACTATTTGTA CTGTCTGCGG CTTCGTCGCC

451 TTGTCCTGAT TTTTGTTAAT CCACTAT.AT TATTTTGTCC CGCCTGAATT

501 TTTCGTAAAA CTCGGGCAGA ATACCTGA
```

This corresponds to the amino acid sequence <SEQ ID 2824; ORF 923.a>:

```
a923.pep
    1 MKRQAFFKLM ACAAFLSAVS LRLPVLGACY AILSLYAFAL YGIDKRRAVR

51 GKRRIPEHRL LLPALFGGWA GAYLGSRIFR HKTAKKRFVV LFRLTVSGNV
```

-continued
```
101 LATLILIYSG LNLNQYGVAS PXAQRERFSK VLKHQVNRFR TICTVCGFVA

151 LS*FLLIHYX YFVPPEFFVK LGQNT*
``` m923/a923 84.6% identity in 175 aa overlap

```
                 10         20         30         40         50         60
   m923.pep  MKRQAFFKLMACAAFLSAVSLRLPVLGACYAILSLYAFALYGIDKRCAIRGQRRIPEHRL
             ||||||||||||||||||||||||||||||||||||||||||| :||:|||||||||
   a923      MKRQAFFKLMACAAFLSAVSLRLPVLGACYAILSLYAFALYGIDKRRAVRGKRRIPEHRL
                 10         20         30         40         50         60

70         80         90        100        110        120
   m923.pep  LLPALLGGWVGAYFGSMTFKHKTAKKRFVVLFRLTVSGNVLATLILIYSGLNLNQYGVAS
             |||||:|||:|||:||  |:||||||||||||||||||||||||||||||||||||||
   a923      LLPALFGGWAGAYLGSRIFRHKTAKKRFVVLFRLTVSGNVLATLILIYSGLNLNQYGVAS
                 70         80         90        100        110        120

130        140        150    159
   m923.pep  PC----------------RTICTVCGFVALSXFLLIHYXYFVPPEFFVKLGQNTX
             |                 ||||||||||||||||||||||||||||||||||||
   a923      PXAQRERFSKVLKHQVNRFRTICTVCGFVALSXFLLIHYXYFVPPEFFVKLGQNTX
                 130        140        150        160        170
```

The following partial DNA sequence was identified in *N. gonorrhoeae* <SEQ ID 2825>:

```
g925.seq
   1 ATGAAACAAA TGCTTTTGGC cgtcggcgtg ggcGCGGTGT TGGCGGGCTG

51 CGGCAaggat gcCGGCGGtt acgagggtTA TTGGCGCGAA AAGTCGGACA

101 AAAAagaggG CGTGATTGCC GTCAAAAAAA AAGGCAATTA CTTCCTTAAT

151 AAAATCAACG TGTTTACAGG CAAGGAGGAG TCTTTGCTTT TGTCTGAAAA

201 AGACGGCGCG CTTTCGATAA ACACGGGGAT AGGGGAAATC CCGATCAAAC

251 TTTCCGACGA CGGGAAAGAG CTGTATGTCG AACGCAGGCG GTATGTGAAA

301 ACCGATGCGG CGATGAAGGA CAAAATCATC GCCCACCAGA AAAAGTGCGG

351 ACAAACGGCA CAGGCATACC TCGACGCGCG AAATGCGTTG CCGTCAAACC

401 AAACGTATCA GCAGCGTCAG GCGGCGATCG AGCAATTGAA ACGGCGGTTT

451 GAAGCCGAGT TTGACGAATT GGAAAAAGAA ATCAAATGCA ACGGCAAACC

501 GACATTGTTG TTTTAG
```

This corresponds to the amino acid sequence <SEQ ID 2826; ORF 925.ng>:

```
g925.pep
   1 MKQMLLAVGV GAVLAGCGKD AGGYEGYWRE KSDKKEGVIA VKKKGNYFLN

51 KINVFTGKEE SLLLSEKDGA LSINTGIGEI PIKLSDDGKE LYVERRRYVK

101 TDAAMKDKII AHQKKCGQTA QAYLDARNAL PSNQTYQQRQ AAIEQLKRRF

151 EAEFDELEKE IKCNGKPTLL F*
```

The following partial DNA sequence was identified in *N. meningitidis* <SEQ ID 2827>:

```
m925.seq (partial)
   1 ATGAAACAAA TGCTTTTAGC CGTCGGCGTG GTGGCGGTGT TGGCGGGCTG
```

-continued
```
 51 CGGCAAGGAT GCCGGCGGTT ACGAGGGTTA TTGGCGCGAA AAGTCGGACA

101 AAAAAGAGGG TATGATTGCC GTCAAAAAAG AAAAAGGCAA TTACTTCCTT
    .......
```

This corresponds to the amino acid sequence <SEQ ID 2828; ORF 925>:

```
m925.pep (partial)
  1 MKQMLLAVGV VAVLAGCGKD AGGYEGYWRE KSDKKEGMIA VKKEKGNYFL..
```

Computer analysis of this amino acid sequence gave the following results:
Homology with a Predicted ORF from *N. gonorrhoeae*
ORF 925 shows 94.0% identity over a 50 aa overlap with a predicted ORF (ORF 925.ng) from *N. gonorrhoeae*:

```
   m925/g925
                     10         20         30         40         50
   m925.pep  MKQMLLAVGVVAVLAGCGKDAGGYEGYWREKSDKKEGMIAVKKEKGNYFL
             ||||||||||  |||||||||||||||||||||||||||:|||| ||||||
   g925      MKQMLLAVGVGAVLAGCGKDAGGYEGYWREKSDKKEGVIAVKK-KGNYFLNKINVFTGKE
                     10         20         30         40         50 g925      ESLLLSEKDGALSINTGIGEIPIKLSDDGKELYVERRRYVKTDAAMKDKIIAHQKKCGQT
                     60         70         80         90        100        110
```

The following partial DNA sequence was identified in *N. gonorrhoeae* <SEQ ID 2829>:

```
g925-1.seq
  1 ATGAAACAAA TGCTTTTGGC CGTCGGCGTG GCGGCGGTGT TGGCGGGCTG

51 CGGCAAGGAT GCCGGCGGTT ACGAGGGTTA TTGGCGCGAA AAGTCGGACA

101 AAAAAGAGGG CGTGATTGCC GTCAAAAAAA AAGGCAATTA CTTCCTTAAT

151 AAAATCAACG TGTTTACAGG CAAGGAGGAG TCTTTGCTTT TGTCTGAAAA

201 AGACGGCGCG CTTTCGATAA ACACGGGGAT AGGGGAAATC CCGATCAAAC

251 TTTCCGACGA CGGGAAAGAG CTGTATGTCG AACGCAGGCG GTATGTGAAA

301 ACCGATGCGG CGATGAAGGA CAAAATCATC GCCCACCAGA AAAAGTGCGG

351 ACAAACGGCA CAGGCATACC TCGACGCGCG AAATGCGTTG CCGTCAAACC

401 AAACGTATCA GCAGCGTCAG GCGGCGATCG AGCAATTGAA ACGGCGGTTT

451 GAAGCCGAGT TTGACGAATT GGAAAAAGAA ATCAAATGCA ACGGCAAACC

501 GACATTGTTG TTTTAG
```

This corresponds to the amino acid sequence <SEQ ID 2830; ORF 925-1.ng>:

```
g925-1.pep
  1 MKQMLLAVGV AAVLAGCGKD AGGYEGYWRE KSDKKEGVIA VKKKGNYFLN

51 KINVFTGKEE SLLLSEKDGA LSINTGIGEI PIKLSDDGKE LYVERRRYVK

101 TDAAMKDKII AHQKKCGQTA QAYLDARNAL PSNQTYQQRQ AAIEQLKRRF

151 EAEFDELEKE IKCNGKPTLL F*
```

The following partial DNA sequence was identified in *N. meningitidis* <SEQ ID 2831>:

```
m925-1.seq
  1 ATGAAACAAA TGCTTTTAGC CGTCGGCGTG GTGGCGGTGT TGGCGGGCTG

51 CGGCAAGGAT GCCGGCGGTT ACGAGGGTTA TTGGCGCGAA AAGTCGGACA

101 AAAAAGAGGG TATGATTGCC GTCAAAAAAG AAAAAGGCAA TTACTTCCTT

151 AATAAAATCC ACGTGGTTAC AGGCAAGGAA GAGTCCTTGC TTTTGTCTGA

201 AAAAGACGGC GCGCTTTCGA TAAACACAGG GATAGGGGAA ATCCCGATCA

251 AACTTTCCGA CGACGGGAAA GAGCTGTATG TCGAACGTAG GCAGTATGTC

301 AAAACCGATG CGGCGATGAA GGACAAAATC ATCGCCCATC AGAAAAAGTG

351 CGGACAAACA GCACAGGCAT ACCGCGACGC GCGAAATGCG TTGCCGTCAA

401 ACCAGACGTA TCAGCAGCAT CTGGCGGCGA TCGAGCAATT GAAACGGCGG

451 TTTGAAGCCG AGTTTGACGA ATTGGAAAAA GAAATCAAAT GCAACGGCAG

501 AAGCCCGGCA TTGTTGCTTT AG
```

This corresponds to the amino acid sequence <SEQ ID 2832; ORF 925-1>:

```
m925-1.pep

1 MKQMLLAVGV VAVLAGCGKD AGGYEGYWRE KSDKKEGMIA VKKEKGNYFL

51 NKIHVVTGKE ESLLLSEKDG ALSINTGIGE IPIKLSDDGK ELYVERRQYV

101 KTDAAMKDKI IAHQKKCGQT AQAYRDARNA LPSNQTYQQH LAAIEQLKRR

151 FEAEFDELEK EIKCNGRSPA LLL* m925/g925  92.5% identity in 173 aa overlap 10        20         30         40         50         60
m925-1.pep  MKQMLLAVGVVAVLAGCGKDAGGYEGYWREKSDKKEGMIAVKKEKGNYFLNKIHVVTGKE
            ||||||||||:|||||||||||||||||||||||||||:||||| |||||||||:| ||||
g925-1      MKQMLLAVGVAAVLAGCGKDAGGYEGYWREKSDKKEGVIAVKK-KGNYFLNKINVFTGKE
                    10        20        30        40        50

70        80         90        100        110        120
m925-1.pep  ESLLLSEKDGALSINTGIGEIPIKLSDDGKELYVERRQYVKTDAAMKDKIIAHQKKCGQT
            ||||||||||||||||||||||||||||||||||||:|||||||||||||||||||||||
g925-1      ESLLLSEKDGALSINTGIGEIPIKLSDDGKELYVERRYVKTDAAMKDKIIAHQKKCGQT
           60        70        80        90       100       110

130       140        150       160        170
m925-1.pep  AQAYRDARNALPSNQTYQQHLAAIEQLKRRFEAEFDELEKEIKCNGRSPALLLX
            |||| ||||||||||||||: |||||||||||||||||||||||||: |:||:|
            AQAYLDARNALPSNQTYQQRQAAIEQLKRRFEAEFDELEKEIKCNGK-PTLLFX
           120       130       140       150       160       170
```

The following partial DNA sequence was identified in *N. meningitidis* <SEQ ID 2833>:

```
a925-1.seq
  1 AATAAAATCA ACGTGTTTAC AGGTAAGGAA GAATCTATGC TTTTGTCTGA

51 AAAAGACGGC GCGCTTTCGA TAAACACGGG GATAGGGGAA ATCCCGATCA

101 AACTTTCCGA CGACGGGAAA GAGCTGTATG TCGAACGCAG GCAGTATGTC

151 AAAACCGATG CGGCGATGAA GGACAAAATC ATCGCCCATC AGAAAAAGTG

201 CGGACAAACG GCACAGGCAT ATCTCGACGC GCGAAATGCG TTGCCGTCAA

251 ACCAGACGTA TCAGCAGCAT CAGGCGGCGA TCGAGCAGTT GAAACGGCGG

301 TTTGAAGCCG AGTTTGACGA ATTGGAAAAA GAAATCAAAT GCAACGGCAA

351 ACCGACATTG TTGTTTTAG
```

This corresponds to the amino acid sequence <SEQ ID 2834; ORF 925-1.a>:

```
a925-1.pep

1 NKINVFTGKE ESMLLSEKDG ALSINTGIGE IPIKLSDDGK ELYVERRQYV

51 KTDAAMKDKI IAHQKKCGQT AQAYLDARNA LPSNQTYQQH QAAIEQLKRR

101 FEAEFDELEK EIKCNGKPTL LF* a925-1/m925-1  92.7% identity in 123 aa overlap 10        20        30
    a925-1.pep                      NKINVFTGKEESMLLSEKDGALSINTGIGE
                                    |||:| ||||||| :||||||||||||||
    m925-1      AGGYEGYWREKSDKKEGMIAVKKEKGNYFLNKIHVVTGKEESLLLSEKDGALSINTGIGE
                     30        40        50        60        70        80
                           40        50        60        70        80        90
    a925-1.pep  IPIKLSDDGKELYVERRQYVKTDAAMKDKIIAHQKKCGQTAQAYLDARNALPSNQTYQQH
                ||||||||||||||||||||||||||||||||||||||||| |||||||||||||||||
    m925-1      IPIKLSDDGKELYVERRQYVKTDAAMKDKIIAHQKKCGQTAQAYRDARNALPSNQTYQQH
                        90       100       110       120       130       140
                          100       110       120
    a925-1.pep  QAAIEQLKRRFEAEFDELEKEIKCNGK-PTLLFX
                |||||||||||||||||||||||||||: |:||:|
    m925-1      LAAIEQLKRRFEAEFDELEKEIKCNGRSPALLLX
                       150       160       170
```

The following partial DNA sequence was identified in *N. gonorrhoeae* <SEQ ID 2835>:

```
g926.seq (partial)
    1 ATGAAACACA CCGTATCCGC ATCGGTCATC CTGCTTTTGA CCGCTTGCGC

51 GCAATTACCT CAAAATAACG AAAACCTGTG GCAGCCGTCC GAACACATCA

101 GCAGTTTTGC AGCGGAAGGG CGGTTGGCAG TCAAAGCGGA AGGGAAAGGT

151 TCGTATGCAA ATTTCGATTG GACATACCAA CCGCCCGTGG AAACCATCAA

201 TATCAACACC CCTTTGGGCA GTACGCTCGG ACAGTTGTGT CAAGacAGGG

251 ACGGCGCATT GGCAGTGGAC GGCAAAGGAA ATGTCTATCA GGCAGAGGGT

301 ACGgaagact tGAGCAGGCA GCTGGTCGGT TTCAAACTGC CAATCCAATA

351 TCTGCATATC TGGGCGGAAG GCAGGCGTGT GGCGGGCGCG CCTtaccGCA

401 TCCGTTCAGA CGGCATATTG GAACAATAcg GttggACAAT cgggCagaac 451 tgcCGACAGT GGGGGGCaag tccgaacgtt gcaactGAa...
```

This corresponds to the amino acid sequence <SEQ ID 2836; ORF 926.ng>:

```
g926.pep (partial)
    1 MKHTVSASVI LLLTACAQLP QNNENLWQPS EHISSFAAEG RLAVKAEGKG

51 SYANFDWTYQ PPVETININT PLGSTLGQLC QDRDGALAVD GKGNVYQAEG

101 TEDLSRQLVG FKLPIQYLHI WAEGRRVAGA PYRIRSDGIL EQYGWTIGQN

151 CRQWGASPNV ATE...
```

The following partial DNA sequence was identified in *N. meningitidis* <SEQ ID 2837>:

```
m926.seq
    1 ATGAAACACA CCGTATCCGC ATCGGTCATC CTGCTTTTGA CCGCTTGCGC
```

-continued
```
 51 GCAATTACCT CAAAATAACG AAAACCTGTG GCAGCCGTCC GAACACATCA

101 GCAGTTTTGC AGCAGAAGGG CGGTTGGCAG TGAAAGCGGA AGGGAAAGGT

151 TCGTATGCAA ATTTCGATTG ACATACCAA CCGCCCGTGG AAACCATCAA

201 TATCAATACC CCTTTGGGCA GTACGCTCGG GCAGTTGTGT CAAGACAGGG

251 ACGGCGCATT GGCAGTGGAC GGCAAAGGAA ATGTCTATCA GGCGGAAAGT

301 GCGGAAGAAT TGAGCAGGCA GCTGGTCGGT TTCAAACTGC CAATCCAATA

351 TCTGCATATC TGGGCAGATG GCAGGCGTGT GGCGGGCGCG CCTTACCGCA

401 TCCTGCCGGA CGGCATATTG GAACAATACG GTTGGACTGT CGGCAGAACC

451 GCCGACAGTG GGGGGCAAGT CCGAACGTTG CAACTGAATA ACGGAAATTT

501 GAACATCAGG CTGGTTTTCA CCGAAATCGG TATGCCGTCT GAAACCGAAA

551 CCCCGGAACG CTGTGCGGCG CGCACGAGAT AA
```

This corresponds to the amino acid sequence <SEQ ID 2838; ORF 926>:

```
m926.pep

1 MKHTVSASVI LLLTACAQLP QNNENLWQPS EHISSFAAEG RLAVKAEGKG

51 SYANFDWTYQ PPVETININT PLGSTLGQLC QDRDGALAVD GKGNVYQAES

101 AEELSRQLVG FKLPIQYLHI WADGRRVAGA PYRILPDGIL EQYGWTVGRT

151 ADSGGQVRTL QLNNGNLNIR LVFTEIGMPS ETETPERCAA RTR* g926/m926  91.6% identity in 155 aa overlap 10         20         30         40         50         60
g926.pep    MKHTVSASVILLLLTACAQLPQNNENLWQPSEHISSFAAEGRLAVKAEGKGSYANFDWTYQ
            ||||||||||||||||||||||||||||||||||||||||||||||||||||||||||||
m926        MKHTVSASVILLLLTACAQLPQNNENLWQPSEHISSFAAEGRLAVKAEGKGSYANFDWTYQ
               10         20         30         40         50         60

70         80         90        100        110        120
g926.pep    PPVETININTPLGSTLGQLCQDRDGALAVDGKGNVYQAEGTEDLSRQLVGFKLPIQYLHI
            ||||||||||||||||||||||||||||||||||||||||::|:||||||||||||||||
m926        PPVETININTPLGSTLGQLCQDRDGALAVDGKGNVYQAESAEELSRQLVGFKLPIQYLHI
               70         80         90        100        110        120

130        140        150        160
g926.pep    WAEGRRVAGAPYRIRSDGILEQYGWTIGQNCRQWGASPNVATE
            ||:|||||||||||   ||||||||||:|::  : |
m926        WADGRRVAGAPYRILPDGILEQYGWTVGRTADSGGQVRTLQLNNGNLNIRLVFTEIGMPS
              130        140        150        160        170        180 a926.seq

1 ATGAAACACA CTGTATCCGC ATCGGTCATC CTGCTTTTGA CCGCTTGCGC

51 GCAATTACCT CAAAATAACG AAAACCTGTG GCAGCCGTCC GAACACACCC

101 GCAGTTTCAC GGCGGAAGGG CGGTTGGCAG TGAAAGCGGA AGGGAAAGGT

151 TCGTATGCAA ATTTCGATTG ACATACCAA CCGCCCGTGG AAACCATCAA

201 TATCAACACC CCTTTGGGCA GTACGCTCGG GCAGTTGTGT CAAGACAGGG

251 ACGGCGCATT GGCAGTGGAC GGCAAAGGAA ATGTCTATCA GGCGGAAAGT

301 GCGGAAGAAT TGAGCAGGCA GCTGGTCGGT TTCAAACTGC CAATCCAATA

351 TCTGCATATC TGGGCAGATG GCAGGCCTGT GGCGGGCGCG CCTTACCGCA

401 TCCTGCCGGA CGGCATATTG GAACAATACG GTTGGACTGT CGGCAGAACC

451 GCCGACAGTG GGGGGCAAGT CCGAACGTTG CAACTGAATA ACGGAAATTT

501 GAACATCAGG CTGGTTTTCA CCGAGATTGG TATGAAGTCT GAAACCGAAA

551 CCCAAGAACA ATGCGCGGCA CGCATACAGT AA
```

-continued

```
a926.pep

1 MKHTVSASVI LLLTACAQLP QNNENLWQPS EHTRSFTAEG RLAVKAEGKG

51 SYANFDWTYQ PPVETININT PLGSTLGQLC QDRDGALAVD GKGNVYQAES

101 AEELSRQLVG FKLPIQYLHI WADGRPVAGA PYRILPDGIL EQYGWTVGRT

151 ADSGGQVRTL QLNNGNLNIR LVFTEIGMPS ETETQEQCAA RIQ*
``` m926/a926 96.9% identity in 191 aa overlap

```
                   10         20         30         40         50         60
m926.pep   MKHTVSASVILLLTACAQLPQNNENLWQPSEHISSFAAEGRLAVKAEGKGSYANFDWTYQ
           ||||||||||||||||||||||||||||| ||:||||||||||||||||||||||||||
a926       MKHTVSASVILLLTACAQLPQNNENLWQPSEHTRSFTAEGRLAVKAEGKGSYANFDWTYQ
                   10         20         30         40         50         60
                   70         80         90        100        110        120
m926.pep   PPVETININTPLGSTLGQLCQDRDGALAVDGKGNVYQAESAEELSRQLVGFKLPIQYLHI
           ||||||||||||||||||||||||||||||||||||||||||||||||||||||||||||
a926       PPVETININTPLGSTLGQLCQDRDGALAVDGKGNVYQAESAEELSRQLVGFKLPIQYLHI
                   70         80         90        100        110        120
                  130        140        150        160        170        180
m926.pep   WADGRRVAGAPYRILPDGILEQYGWTVGRTADSGGQVRTLQLNNGNLNIRLVFTEIGMPS
           ||||| ||||||||||||||||||||||||||||||||||||||||||||||||||||||
a926       WADGRPVAGAPYRILPDGILEQYGWTVGRTADSGGQVRTLQLNNGNLNIRLVFTEIGMPS
                  130        140        150        160        170        180
                  190
m926.pep   ETETPERCAARTRX
           ||||  |:||||
a926       ETETQEQCAARIQX
                  190
```

The following partial DNA sequence was identified in *N. gonorrhoeae* <SEQ ID 2839>:

```
g927.seq
    1 atgaaaacct acGCAcAggC ACTCTATacc GCAGCCCTGC TCACCGCCTG

51 CAGCCCcgca GCcgatTcaa accaTCCGTC CGGAcAaAAT GCCCCGGCCA

101 ATACCGAATC cgacGgaaAA AACATtaccC TGctcaatgc cTcgtacgat 151 gtGACACGGT ATTTttacaa agaatacgac cacTtgtttg tcggaaCATA

201 CCAATCCGAA CACCCCGGCA CATCCGTCAG CATCCAACAA TCCCACGGCG

251 GCTTCAGCAA ACAGGCATTA TCCGTAGCCA ACGGCCTTCA AGCCGATGTC

301 GTAACCATGA ACCAATCTTC CGACATCGAC CTGCTCGAAA AAAA.GGACT

351 GGTAGAAAAA GGCTGGCAAC AAGCCCTCCC CGATCACGCC GCACCCTACA

401 CCAGCACTAT GGTTTTCCTT GTCCGAAAAA ACAACCCcaa ACAGAtccgC

451 GATTGGAACG ACCTTGCCAA AGACGGCGTT AACATCGTCA TCGCCAAGAC

501 CTCGGGCAAC GGACGCTACG CCTTCCTCGG CGCATACGGT TACGGTCTGA

551 AAGCCAACAA CGGcaaCGAG CAGGAAGCCC AAAAACTCGT CGCATCCATC

601 CTCAAAAACA CACCCGTTTT TGAAAACGGC GGACGCGc.C CGCCGCCACC

651 ACCTTCACAC AACGCAACAT CGGCGACGTA CTCATCACTT TTGAAAACga 701 agCcaactac gtCAGCAAAA AACTGA
```

This corresponds to the amino acid sequence <SEQ ID 2840; ORF 927.ng>:

```
g927.pep
   1 MKTYAQALYT AALLTACSPA ADSNHPSGQN APANTESDGK NITLLNASYD

51 VTRYFYKEYD HLFVGTYQSE HPGTSVSIQQ SHGGFSKQAL SVANGLQADV

101 VTMNQSSDID LLEKXGLVEK GWQQALPDHA APYTSTMVFL VRKNNPKQIR

151 DWNDLAKDGV NIVIAKTSGN GRYAFLGAYG YGLKANNGNE QEAQKLVASI

201 LKNTPVFENG GRXPPPPPSH NATSATYSSL LKTKPTTSAK N*
```

The following partial DNA sequence was identified in *N. meningitidis* <SEQ ID 2841>:

```
m927.seq
   1 ATGAAAACCT ACGCACCGGC ACTCTATACC GCAGCCCTGC TCACCGCCTG

51 CAGCCCCGCA GCCGATTCAA ACCATCCGTC CGGACAAAAT GCCCCGGCCA

101 ATACCGAATC CGACGGAAAA AACATTACCC TGCTCAACGC CTCATACGAT

151 GTGGCACGGG ATTTTTACAA AGAATACAAC CCCTTATTTA TCAAAACATA

201 CCAATCCGAA CACCCCGGCA CATCCGTCAG CATCCAACAG TCCCACGGCG

251 GCTCCAGCAA ACAGGCATTA TCCGTAGCCA ACGGCCTTCA AGCCGATGTC

301 GTAACCATGA ACCAATCCTC CGACATCGAC CTGCTCGAAA AAAAAGGACT

351 GGTAGAAAAA GGCTGGCAAC AAGCCCTCCC CGACCACGCC GCGCCCTACA

401 CCAGCACTAT GGTTTTCCTT GTCCGAAAAA ACAACCCCAA ACAGATCCGC

451 GATTGGAACG ACCTTGCCAA AGACGGCGTT AACATCGTCA TCGCCAATCC

501 CAAAACCTCG GCAACGGAC GCTACGCCTT CCTCGGCGCA TACGGTTACG

551 GTCTGAAAAC CACCAACGGC AACGAACAGG AAGCCCAAAA ACTCGTCGCA

601 TCCATCCTCA AAAACACCCC CGTTTTTGAA AACGGCGGAC GCkCgCCACC

651 ACCACCTTCA CACAACGCAA CATCGGCGAC GTACTCATCA CTTTTGAAAA

701 CGAAGCCAAC TACGTCAGCr AAAAACtGA
```

This corresponds to the amino acid sequence <SEQ ID 2842; ORF 927>:

```
m927.pep
  1 MKTYAPALYT AALLTACSPA ADSNHPSGQN APANTESDGK NITLLNASYD

51 VARDFYKEYN PLFIKTYQSE HPGTSVSIQQ SHGGSSKQAL SVANGLQADV

101 VTMNQSSDID LLEKKGLVEK GWQQALPDHA APYTSTMVFL VRKNNPKQIR

151 DWNDLAKDGV NIVIANPKTS GNGRYAFLGA YGYGLKTTNG NEQEAQKLVA

201 SILKNTPVFE NGGRXPPPPS HNATSATYSS LLKTKPTTSA KN*
```

Computer analysis of this amino acid sequence gave the following results:
Homology with a Predicted ORF from N. gonorrhoeae
ORF 927 shows 94.2% identity over a 243 aa overlap with a predicted ORF (ORF 927.ng) from N. gonorrhoeae:

```
g927/m927
                  10        20        30        40        50        60
   g927.pep  MKTYAQALYTAALLTACSPAADSNHPSGQNAPANTESDGKNITLLNASYDVTRYFYKEYD
             |||||  |||||||||||||||||||||||||||||||||||||||||||||:| |||||:
   m927      MKTYAPALYTAALLTACSPAADSNHPSGQNAPANTESDGKNITLLNASYDVARDFYKEYN
                  10        20        30        40        50        60

70        80        90       100       110       120
   g927.pep  HLFVGTYQSEHPGTSVSIQQSHGGFSKQALSVANGLQADVVTMNQSSDIDLLEKXGLVEK
             ||:|||||||||||||||||||||||  |||||||||||||||||||||||||| |||||
   m927      PLFIKTYQSEHPGTSVSIQQSHGGSSKQALSVANGLQADVVTMNQSSDIDLLEKKGLVEK
                  70        80        90       100       110       120

130       140       150       160       170
   g927.pep  GWQQALPDHAAPYTSTMVFLVRKNNPKQIRDWNDLAKDGVNIVIA--KTSGNGRYAFLGA
             ||||||||||||||||||||||||||||||||||||||||||||  ||||||||||||||
   m927      GWQQALPDHAAPYTSTMVFLVRKNNPKQIRDWNDLAKDGVNIVIANPKTSGNGRYAFLGA
                 130       140       150       160       170       180

180       190       200       210       220       230
   g927.pep  YGYGLKANNGNEQEAQKLVASILKNTPVFENGGRXPPPPPSHNATSATYSSLLKTKPTTS
             ||||||::|||||||||||||||||||||||||||||||  |||||||||||||||||||
   m927      YGYGLKTTNGNEQEAQKLVASILKNTPVFENGGRXPPPP-SHNATSATYSSLLKTKPTTS
                 190       200       210       220       230

240
   g927.pep  AKNX
             ||||
   m927      AKNX
                 240
```

The following partial DNA sequence was identified in N. meningitidis <SEQ ID 2843>:

```
a927.seq
   1 ATGAAAACCT ACGCACCGGC ACTCTATACC GCAGCCCTGC TCAGCGCCTG

51 CAGCCCCGCA GCCGATTCAA ACCATCCGTC CGGACAAAAT GCCCCGGCCA

101 ATACCGAATC CGACGGAAAA AACATTACCC TGCTCAACGC CTCATACGAT

151 GTGGCACGGG ATTTTTACAA AGAATACAAC CCCTTATTTA TCAAAACATA

201 CCAATCCGAA CACCCCGGCA CATCCGTCAG CATCCAACAG TCCCACGGCG

251 GCTCCAGCAA ACAGGCATTA TCCGTAGCCA ACGGCCTTCA AGCCGATGTC

301 GTAACCATGA ACCAATCCTC CGACATCGAC CTGCTCGAAA AAAAGGACT

351 GGTAGAAAAA GGCTGGCAAC AAGCCCTCCC CGACCACGCC GCGCCCTACA

401 CCAGCACTAT GGTTTTCCTT GTCCGAAAAA ACAACCCCAA ACAGATCCGC

451 GATTGGAACG ACCTTGCCAA AGACGGCGTT AACATCGTCA TCGCCAATCC

501 CAAAACCTCG GGCAACGGAC GCTACGCCTT CCTCGGCGCA TACGGTTACG

551 GTCTGAAAAC CACCAACGGC AACGAACAGG AAGCCCAAAA ACTCGTCGCA

601 TCCATCCTCA AAAACACCCC CGTTTTTGAA AACGGCGGAC GCGCGCCACC

651 ACCACCTTCA CACAACGCAA CATCGGCGAC GTACTCATCA CTTTTGAAAA

701 CGAAGCCAAC TACGTCAGCA AAAAACTGA
```

This corresponds to the amino acid sequence <SEQ ID 2844; ORF 927.a>:

```
a927.pep
  1 MKTYAPALYT AALLSACSPA ADSNHPSGQN APANTESDGK NITLLNASYD

51 VARDFYKEYN PLFIKTYQSE HPGTSVSIQQ SHGGSSKQAL SVANGLQADV

101 VTMNQSSDID LLEKKGLVEK GWQQALPDHA APYTSTMVFL VRKNNPKQIR

151 DWNDLAKDGV NIVIANPKTS GNGRYAFLGA YGYGLKTTNG NEQEAQKLVA

201 SILKNTPVFE NGGRAPPPPS HNATSATYSS LLKTKPTTSA KN*
``` m927/a927 99.2% identity in 242 aa overlap

```
                    10         20         30         40         50         60
    m927.pep    MKTYAPALYTAALLTACSPAADSNHPSGQNAPANTESDGKNITLLNASYDVARDFYKEYN
                ||||||||||||||:|||||||||||||||||||||||||||||||||||||||||||||
    a927        MKTYAPALYTAALLSACSPAADSNHPSGQNAPANTESDGKNITLLNASYDVARDFYKEYN
                    10         20         30         40         50         60

70         80         90        100        110        120
    m927.pep    PLFIKTYQSEHPGTSVSIQQSHGGSSKQALSVANGLQADVVTMNQSSDIDLLEKKGLVEK
                ||||||||||||||||||||||||||||||||||||||||||||||||||||||||||||
    a927        PLFIKTYQSEHPGTSVSIQQSHGGSSKQALSVANGLQADVVTMNQSSDIDLLEKKGLVEK
                    70         80         90        100        110        120

130        140        150        160        170        180
    m927.pep    GWQQALPDHAAPYTSTMVFLVRKNNPKQIRDWNDLAKDGVNIVIANPKTSGNGRYAFLGA
                ||||||||||||||||||||||||||||||||||||||||||||||||||||||||||||
    a927        GWQQALPDHAAPYTSTMVFLVRKNNPKQIRDWNDLAKDGVNIVIANPKTSGNGRYAFLGA
                   130        140        150        160        170        180

190        200        210        220        230        240
    m927.pep    YGYGLKTTNGNEQEAQKLVASILKNTPVFENGGRXPPPPSHNATSATYSSLLKTKPTTSA
                |||||||||||||||||||||||||||||||||||| |||||||||||||||||||||||
    a927        YGYGLKTTNGNEQEAQKLVASILKNTPVFENGGRAPPPPSHNATSATYSSLLKTKPTTSA
                   190        200        210        220        230        240 m927.pep    KNX
                |||
    a927        KNX
```

The following partial DNA sequence was identified in *N. gonorrhoeae* <SEQ ID 2845>:

```
g929.seq
   1 ATGAAATTGG GTTTCAAACC GATACCCCTC GCCATTGCCG CAGTATTGTG

51 CGCCCTGGTT TTGGCACTGC CCGTACccga CGGGGTCAAG CCTCAGGCTT

101 GGACGCTGCT GGCTATGTTT GTCGGTGTGA TTGCCGCCAT TATCGGCAAG

151 GTTATGCCGT TGGGCGCGCT GTCGATTATT GCCGTCGGGT TGGTCGCAGT

201 AACCGGCGTA ACCGCCGACA AACCGGGCGC GGCGATGAGC GATGCGTTGA

251 GTGCGTTCGC CAATCCGTTG ATTTGGCTGA TTGCCATCGC AGTTATGATT

301 TCGCGCGGTT TGCTCAAAAC AGGGCTGGGG ATGCGTATCG GATATTTGTT

351 TATCGCCGTT TTTGGAAGAA AAcgctggG CATCGGTTAC AGTCTCGCTC

401 TTTCCGAACT GCTGCTGGCT CCCGTTACCC CTTCCAATAC CGCGCGCGGC

451 GGCGGCATTA TACATCcgaT TATGCagtcg attgCcggCA GttacggctC 501 caatCCCGCA AAAGGCACag aaggcaagat gggtaAATAT TtggcTTtgg 551 tcaattaTCA TTCcaaTCCC atttcgtcgg ctAtggctat taCTGcaact 601 gCCCCcaaCC CTTTAATcgt caacttgatt gccGaaaaTt taggcagtag 651 tttccgtCTT TCttgggggg cgTGGGcgtg ggcaaTGGCT Gttcccggcg
```

-continued

```
 701 ttatcgcctt TTtcgTTATG CCTTTGATTT TATATTTTTT GTATCCGCCT

751 GAAATTAAAG AAACGCCCAA TGCTGttcAA TTTGCCAAAG ACCGTCTGAG

801 CGAGATGGGT AAAATGtcgg CAGACGAAAT CATTATGGCG GTCATTTTCG

851 GTATCTTGCT GCTGTTGTGG GCAGATGTTC CCGCCCTTAT TACCGGCAAT

901 CACGCTTTTA GTATCAacgc caccGCCACC GCATTTATCG GATTAAGCCT

951 GCTTTTGCTT TCCGGTGTAT TGACTTGGGA CGATGTTTTG AAAGAAAAAA

1001 GCGCGTGGGA TACGATTATT TGGTTTGGCG CATTGATTAT GATGGCCGCA

1051 TTTTTaAATA AActcggact gattaaatGG TTCTCCGGAG TGTTGGCGGA

1101 AagtgtcggC GGTTTGGGCG TTAGCGGCAC GGCTGCGGGC GTAATCCTCG

1151 TGCTTGCtta TATGTATGCG CATTATATGT TTGCCAGTAC TACTGCACAT

1201 ATTACCGCTA TGTTCGGCGC ATTTCTCGCT GCTGCCGTTT CACTGAATGC

1251 CCCGGCGATG CCGACTGCGC TGATGATGGC GGCCGCATCC AACATTATGA

1301 TGACCCTCAC TCATTATGCG ACCGGTACTT CACCTGTGAT TTTCGGCTCG

1351 GGCTACACCA CAATGGGAGA ATGGTGGAAG GCGGGTTTTA TCATGAGCGT

1401 AGTCAATTTT CTGATTTTTT CCGTTATCGG CAGCATTTGG TGGAAAGTTC

1451 TGGGATATTG GTAA
```

This corresponds to the amino acid sequence <SEQ ID 2846; ORF 929.ng>:

```
g929.pep
   1 MKLGFKPIPL AIAAVLCALV LALPVPDGVK PQAWTLLAMF VGVIAAIIGK

51 VMPLGALSII AVGLVAVTGV TADKPGAAMS DALSAFANPL IWLIAIAVMI

101 SRGLLKTGLG MRIGYLFIAV FGRKTLGIGY SLALSELLLA PVTPSNTARG

151 GGIIHPIMQS IAGSYGSNPA KGTEGKMGKY LALVNYHSNP ISSAMAITAT

201 APNPLIVNLI AENLGSSFRL SWGAWAWAMA VPGVIAFFVM PLILYFLYPP

251 EIKETPNAVQ FAKDRLSEMG KMSADEIIMA VIFGILLLLW ADVPALITGN

301 HAFSINATAT AFIGLSLLLL SGVLTWDDVL KEKSAWDTII WFGALIMMAA

351 FLNKLGLIKW FSGVLAESVG GLGVSGTAAG VILVLAYMYA HYMFASTTAH

401 ITAMFGAFLA AAVSLNAPAM PTALMMAAAS NIMMTLTHYA TGTSPVIFGS

451 GYTTMGEWWK AGFIMSVVNF LIFSVIGSIW WKVLGYW*
```

The following partial DNA sequence was identified in *N. meningitidis* <SEQ ID 2847>:

```
m929.seq
   1 ATGAAATTGG GTTTCAAACC GATACCCCTC GCCATTGCCG CAGTATTGTG

51 CGCCCTGGTT TTGGCACTGC CCGTACCCGA CGGGGTCAAG CCTCAGGCTT

101 GGACGCTGCT GGCCATGTTT GTCGGTGTGA TTGCCGCCAT TATCGGCAAG

151 GCCATGCCGT TGGGCGCGCT GTCGATTATT GCCGTCGGGT TGGTCGCAGT

201 AACCGGCGTA ACCGCCGACA AACCGGGCGC GGCGATGAGC GATGCGTTGA

251 GTGCGTTCGC CAATCCGTTG ATTTGGCTGA TTGCCATCGC AGTTATGATT

301 TCGCGCGGTT TGCTCAAAAC AGGGCTGGGG ATGCGTATCG GATATTTGTT

351 TATCGCCGTT TTTGGAAGAA AAACGCTGGG CATCGGTTAC AGTCTCGCTC
```

```
 401 TTTCCGAACT GCTGCTGGCT CCCGTTACCC CTTCCAATAC CGCGCGCGGC

451 GGCGGCATTA TACATCCGAT TATGCAGTCG ATTGCCGGCA GTTACGGCTC

501 CAATCCCGCA AAAGGCACAG AAGGCAAGAT GGGTAAATAT TTGGCTTTGG

551 TCAACTATCA TTCCAATCCC ATTTCGTCGG CTATGTTTAT TACTGCAACT

601 GCCCCCAACC CTTTAATCGT CAACTTGATT GCCGAAAATT TAGGCAGTAG

651 TTTCCGTCTT TCTTGGGGGG CGTGGGCGTG GCAATGGCT GTTCCCGGCG

701 TTATCGCCTT TTTCGTTATG CCTTTGATTT TATATTTwyT GTATCCGCCT

751 GAAATTAAAG AAACGCCCAA TGCCGTTCAA TTTGCCAAAG ACCGTCTGAG

801 GGAGATGGGT AAAATGTCGG CAGACGAAAT CATTATGGCG GTCATTTTCG

851 GTATCTTGCT GCTGTTGTGG GCAGATGTTC CCGCCCTTAT TACCGGCAAT

901 CACGCTTTTA GTATCAACGC CACCGCCACC GCATTTATCG GATTAAGCCT

951 GCTTTTGCTT TCCGGTGTAT TGACTTGGGA CGATGTTTTG AAAGAAAAAA

1001 GCGCGTGGGA TACGATTATT TGGTTTGGCG CATTGATTAT GATGGCCGCA

1051 TTTTTAAATA AACTCGGACT GATTAAATGG TTCTCCGGAG TGTTGGCGGA

1101 AAGTGTCGGC GGTTTGGGCG TTAGCGGCAC GGCTGCGGGC GTAATCCTCG

1151 TGCTTGCTTA TATGTATGCG CATTATATGT TTGCCAGTAC TACTGCACAT

1201 ATTACCGCTA TGTTCGGCGC ATTTTTCGCT GCTGCCGTTT CACTGAATGC

1251 CCCGGCGATG CCGACCGCGC TGATGATGGC GgCCGCATCC AACATTATGA

1301 TGACCCTCAC TCATTATGCG ACCGGTACTT CGCCTGTGAT TTTCGGTTCG

1351 GGCTACACCA CAATGGGAGA ATGGTGGAAG GCGGGTTTTA TCATGAGCGT

1401 AGTCAATTTT CTGATTTTTT TCGTTATCGG CAGCATTTGG TGGAAAGTTC

1451 TGGGGTATTG GTAA
```

This corresponds to the amino acid sequence <SEQ ID 2848; ORF 929>:

```
m929.pep
  1 MKLGFKPIPL AIAAVLCALV LALPVPDGVK PQAWTLLAMF VGVIAAIIGK

51 AMPLGALSII AVGLVAVTGV TADKPGAAMS DALSAFANPL IWLIAIAVMI

101 SRGLLKTGLG MRIGYLFIAV FGRKTLGIGY SLALSELLLA PVTPSNTARG

151 GGIIHPIMQS IAGSYGSNPA KGTEGKMGKY LALVNYHSNP ISSAMFITAT

201 APNPLIVNLI AENLGSSFRL SWGAWAWAMA VPGVIAFFVM PLILYXLYPP

251 EIKETPNAVQ FAKDRLREMG KMSADEIIMA VIFGILLLLW ADVPALITGN

301 HAFSINATAT AFIGLSLLLL SGVLTWDDVL KEKSAWDTII WFGALIMMAA

351 FLNKLGLIKW FSGVLAESVG GLGVSGTAAG VILVLAYMYA HYMFASTTAH

401 ITAMFGAFFA AAVSLNAPAM PTALMMAAAS NIMMTLTHYA TGTSPVIFGS

451 GYTTMGEWWK AGFIMSVVNF LIFFVIGSIW WKVLGYW*
```

Computer analysis of this amino acid sequence gave the following results:
Homology with a Predicted ORF from *N. gonorrhoeae*
ORF 929 shows 98.8% identity over a 487 aa overlap with a predicted ORF (ORF 929.ng) from *N. gonorrhoeae*:

```
g929/m929

10        20        30        40        50        60
    g929.pep   MKLGFKPIPLAIAAVLCALVLALPVPDGVKPQAWTLLAMFVGVIAAIIGKVMPLGALSII
               ||||||||||||||||||||||||||||||||||||||||||||:||||||||
    m929       MKLGFKPIPLAIAAVLCALVLALPVPDGVKPQAWTLLAMFVGVIAAIIGKAMPLGALSII
                    10        20        30        40        50        60

70        80        90       100       110       120
    g929.pep   AVGLVAVTGVTADKPGAAMSDALSAFANPLIWLIAIAVMISRGLLKTGLGMRISYLFIAV
               ||||||||||||||||||||||||||||||||||||||||||||||||||||||||||||
    m929       AVGLVAVTGVTADKPGAAMSDALSAFANPLIWLIAIAVMISRGLLKTGLGMRISYLFIAV
                    70        80        90       100       110       120

130       140       150       160       170       180
    g929.pep   FGRKTLGIGYSLALSELLLAPVTPSNTARGGGIIHPIMQSIAGSUGSNPAKGTEGKMGKY
               ||||||||||||||||||||||||||||||||||||||||||||||||||||||||||||
    m929       FGRKTLGIGYSLALSELLLAPVTPSNTARGGGIIHPIMQSIAGSUGSNPAKGTEGKMGKY
                   130       140       150       160       170       180

190       200       210       220       230       240
    g929.pep   LALVNYHSNPISSAMAITATAPNPLIVNLIAENLGSSFRLSWGAWAWAMAVPGVIAFFVM
               |||||||||||||||||  |||||||||||||||||||||||||||||||||||||||||
    m929       LALVNYHSNPISSAMFITATAPNPLIVNLIAENLGSSFRLSWGAWAWAMAVPGVIAFFVM
                   190       200       210       220       230       240

250       260       270       280       290       300
    g929.pep   PLILYFLYPPEIKETPNAVQFAKDRLSEMGKMSADEIIMAVIFGILLLLWADVPALITGN
               |||||  |||||||||||||||||||| ||||||||||||||||||||||||||||||||
    m929       PLILYXLYPPEIKETPNAVQFAKDRLREMGKMSADEIIMAVIFGILLLLWADVPALITGN
                   250       260       270       280       290       300

310       320       330       340       350       360
    g929.pep   HAFSINATATAFIGLSLLLLSGVLTWDDVLKEKSAWDTIIWFGALIMMAAFLNKLGLIKW
               ||||||||||||||||||||||||||||||||||||||||||||||||||||||||||||
    m929       HAFSINATATAFIGLSLLLLSGVLTWDDVLKEKSAWDTIIWFGALIMMAAFLNKLGLIKW
                   310       320       330       340       350       360

370       380       390       400       410       420
    g929.pep   FSGVLAESVGGLGVSGTAAGVILVLAYMYAHYMFASTTAHITAMFGAFLAAAVSLNAPAM
               ||||||||||||||||||||||||||||||||||||||||||||:|||||||||||||||
    m929       FSGVLAESVGGLGVSGTAAGVILVLAYMYAHYMFASTTAHITAMFGAFFAAAVSLNAPAM
                   370       380       390       400       410       420

430       440       450       460       470       480
    g929.pep   PTALMMAAASNIMMTLTHYATGTSPVIFGSGYTTMGEWWKAGFIMSVVNFLIFSVIGSIW
               ||||||||||||||||||||||||||||||||||||||||||||||||||||  ||||||
    m929       PTALMMAAASNIMMTLTHYATGTSPVIFGSGYTTMGEWWKAGFIMSVVNFLIFFVIGSIW
                   430       440       450       460       470       480 g929.pep   WKVLGYWX
               ||||||||
    m929       WKVLGYWX
```

The following partial DNA sequence was identified in *N. meningitidis* <SEQ ID 2849>:

```
a929.seq
     1  ATGAAATTGG GTTTCAAACC GATACCCCTC GCCATTGCCG CAGTATTGTG

51  CGCCTTGGTT TTGGCACTGC CCGTACCCGA CGGGGTCAAG CCTCAGGCTT

101  GGACGCTGCT GGCCATGTTT ATCGGTGTGA TTGCCGCCAT TATCGGCAAG

151  GCCATGCCGT TGGGTGCGCT GTCGATTATT GCCGTCGGGT TGGTCGCAGT

201  AACCGGCGTA ACCGCCGACA AACCGGGTGC GGCGATGAGC GATGCGTTGA

251  GTGCGTTCGC CAATCCGTTG ATTTGGCTGA TTGCCATCGC AGTTATGATT

301  TCGCGCGGTT TGCTCAAAAC AGGGCTGGGG ATGCGTATCG GATATTTGTT

351  TATCGCCGTT TTTGGAAGAA AAACGCTGGG CATCGGTTAC AGTCTCGCTC

401  TTTCCGAACT GCTGCTGGCT CCCGTTACCC CTTCCAATAC CGCGCGCGGC

451  GGCGGCATTA TACATCCGAT TATGCAGTCG ATTGCCGGCA GTTACGGCTC
```

```
 501  CAATCCCGCA AAAGGCACAG AAGGCAAGAT GGGTAAATAT TTGGCTTTGG

551  TCAACTATCA TTCCAATCCC ATTTCGTCGG CTATGTTTAT TACTGCAACT

601  GCCCCCAACC CTTTAATCGT CAACTTGATT GCCGAAAATT TAGGCAGTAG

651  TTTCCGTCTT TCTTGGGGGG CGTGGGCGTG GGCAATGGCT GTTCCCGGCG

701  TTATCGCCTT TTTCGTTATG CCTTTGATTT TATATTTTTT GTATCCGCCT

751  GAAATTAAAG AAACGCCCAA TGCCGTTCAA TTTGCCAAAG ACCGTCTGAG

801  GGAGATGGGT AAAATGTCGG CAGACGAAAT CATTATGGCG GTCATTTTCG

851  GTATCTTGTT GCTGTTGTGG GCAGATGTTC CCGCCCTTAT TACCGGCAAT

901  CACGCTTTTA GTATCAACGC CACCGCCACC GCATTTATCG GATTAAGCCT

951  GCTTTTGCTT TCCGGTGTAT TGACTTGGGA CGATGTTTTG AAAGAAAAAA

1001  GCGCGTGGGA TACGATTATT TGGTTTGGCG CATTGATTAT GATGGCCGCA

1051  TTTTTAAATA AACTCGGACT GATTAAATGG TTCTCCGGAG TGTTGGCGGA

1101  AAGTGTCGGC GGTTTGGGCG TTAGCGGCAC GGCTGCGGGC GTAATCCTCG

1151  TGCTTGCTTA TATGTATGCG CATTATATGT TTGCCAGTAC TACTGCACAT

1201  ATTACCGCTA TGTTCGGCGC ATTTTTCGCT GCTGCCGTTT CACTGAATGC

1251  CCCGGCGATG CCGACCGCGC TGATGATGGC GGCCGCATCT AACATTATGA

1301  TGACCCTCAC TCATTATGCG ACCGGTACTT CGCCTGTGAT TTTCGGTTCG

1351  GGCTACACCA CAATGGGAGA ATGGTGGAAG GCGGGTTTTA TCATGAGCGT

1401  AGTCAATTTT CTGATTTTTT TCGTTATCGG CAGCATTTGG TGGAAAGTTC

1451  TGGGGTATTG GTAA
```

This corresponds to the amino acid sequence <SEQ ID 2850; ORF 929.a>:

```
a929.pep
  1 MKLGFKPIPL AIAAVLCALV LALPVPDGVK PQAWTLLAMF IGVIAAIIGK

51 AMPLGALSII AVGLVAVTGV TADKPGAAMS DALSAFANPL IWLIAIAVMI

101 SRGLLKTGLG MRIGYLFIAV FGRKTLGIGY SLALSELLLA PVTPSNTARG

151 GGIIHPIMQS IAGSYGSNPA KGTEGKMGKY LALVNYHSNP ISSAMFITAT

201 APNPLIVNLI AENLGSSFRL SWGAWAWAMA VPGVIAFFVM PLILYFLYPP

251 EIKETPNAVQ FAKDRLREMG KMSADEIIMA VIFGILLLLW ADVPALITGN

301 HAFSINATAT AFIGLSLLLL SGVLTWDDVL KEKSAWDTII WFGALIMMAA

351 FLNKLGLIKW FSGVLAESVG GLGVSGTAAG VILVLAYMYA HYMFASTTAH

401 ITAMFGAFFA AAVSLNAPAM PTALMMAAAS NIMMTLTHYA TGTSPVIFGS

451 GYTTMGEWWK AGFIMSVVNF LIFFVIGSIW WKVLGYW*
``` m929/a929 99.6% identity in 487 aa overlap

```
                10         20         30         40         50         60
m929.pep  MKLGFKPIPLAIAAVLCALVLALPVPDGVKPQAWTLLAMFVGVIAAIIGKVMPLGALSII
          ||||||||||||||||||||||||||||||||||||||||:|||||||||||||||||||
a929      MKLGFKPIPLAIAAVLCALVLALPVPDGVKPQAWTLLAMFIGVIAAIIGKVMPLGALSII
                10         20         30         40         50         60
```

-continued

```
                     70        80        90       100       110       120
m929.pep    AVGLVAVTGVTADKPGAAMSDALSAFANPLIWLIAIAVMISRGLLKTGLGMRISYLFIAV
            ||||||||||||||||||||||||||||||||||||||||||||||||||||||||||||
a929        AVGLVAVTGVTADKPGAAMSDALSAFANPLIWLIAIAVMISRGLLKTGLGMRISYLFIAV
                     70        80        90       100       110       120

130       140       150       160       170       180
m929.pep    FGRKTLGIGYSLALSELLLAPVTPSNTARGGGIIHPIMQSIAGSUGSNPAKGTEGKMGKY
            ||||||||||||||||||||||||||||||||||||||||||||||||||||||||||||
a929        FGRKTLGIGYSLALSELLLAPVTPSNTARGGGIIHPIMQSIAGSUGSNPAKGTEGKMGKY
                    130       140       150       160       170       180

190       200       210       220       230       240
m929.pep    LALVNYHSNPISSAMAITATAPNPLIVNLIAENLGSSFRLSWGAWAWAMAVPGVIAFFVM
            ||||||||||||||||||||||||||||||||||||||||||||||||||||||||||||
a929        LALVNYHSNPISSAMFITATAPNPLIVNLIAENLGSSFRLSWGAWAWAMAVPGVIAFFVM
                  190       200       210       220       230       240

250       260       270       280       290       300
m929.pep    PLILYXLYPPEIKETPNAVQFAKDRLSEMGKMSADEIIMAVIFGILLLLWADVPALITGN
            ||||| ||||||||||||||||||||||||||||||||||||||||||||||||||||||
a929        PLILYFLYPPEIKETPNAVQFAKDRLREMGKMSADEIIMAVIFGILLLLWADVPALITGN
                    250       260       270       280       290       300

310       320       330       340       350       360
m929.pep    HAFSINATATAFIGLSLLLLSGVLTWDDVLKEKSAWDTIIWFGALIMMAAFLNKLGLIKW
            ||||||||||||||||||||||||||||||||||||||||||||||||||||||||||||
a929        HAFSINATATAFIGLSLLLLSGVLTWDDVLKEKSAWDTIIWFGALIMMAAFLNKLGLIKW
                    310       320       330       340       350       360

370       380       390       400       410       420
m929.pep    FSGVLAESVGGLGVSGTAAGVILVLAYMYAHYMFASTTAHITAMFGAFFAAAVSLNAPAM
            ||||||||||||||||||||||||||||||||||||||||||||||||||||||||||||
a929        FSGVLAESVGGLGVSGTAAGVILVLAYMYAHYMFASTTAHITAMFGAFFAAAVSLNAPAM
                    370       380       390       400       410       420

430       440       450       460       470       480
m929.pep    PTALMMAAASNIMMTLTHYATGTSPVIFGSGYTTMGEWWKAGFIMSVVNFLIFFVIGSIW
            ||||||||||||||||||||||||||||||||||||||||||||||||||||||||||||
m929        PTALMMAAASNIMMTLTHYATGTSPVIFGSGYTTMGEWWKAGFIMSVVNFLIFFVIGSIW
                    430       440       450       460       470       480 m929.pep    WKVLGYWX
            ||||||||
a929        WKVLGYWX g930.seq not found yet
g930.pep net found yet
```

The following partial DNA sequence was identified in *N. meningitidis* <SEQ ID 2851>:

```
m930.seq
   1 ATGAAACTTC CTTTATCCTA TTTGCCTAAT ATTCGCTTTT TGTCTTGGTG

51 CTGCTTATTG GCAGGTATCA TTGCTCCTGC TACTTTGTTG GCCTCCCCCA

101 ACCCTGCCGA AATCCGTATG CAGCAAGATA TTCAGCAACG CCAACGCGAA

151 GAGCAGTTGC GCCAAACCAT GCAGCCTGAA AGCGATGTGC GTTTGCATCA

201 AAAAAACACG GGGGAAACGG TTAATCAGTT GATGGGCGAT GACAGCAGCC

251 AACCGTGTTT TGCCATTAAC GAAtGGGTGT TGGAAGGCGA ACACCATGCT

301 CGGTTTCAGT TTGCCCTAAA ACGTGCCTTG CGCGAAACGG GTTTTCAGGC

351 TGGCAAGTGT CTGCATGCGG GCAACATTAA TCAAATCATG TCCTTAGCAC

401 AAAATGCTTT GATCGGCAGG GGATATACCA CGACCCGTAT CTTGGCTGCG

451 CCACAGGATT TGAATAgTGG aAGCTTCAAT TAA
```

This corresponds to the amino acid sequence <SEQ ID 2852; ORF 930>:

```
m930.pep
   1 MKLPLSYLPN IRFLSWCCLL AGIIAPATLL ASPNPAEIRM QQDIQQRQRE

51 EQLRQTMQPE SDVRLHQKNT GETVNQLMGD DSSQPCFAIN EWVLEGEHHA
```

-continued
```
101 RFQFALKRAL RETGFQAGKC LHAGNINQIM SLAQNALIGR GYTTTRILAA

151 PQDLNSGSFN *
```

The following partial DNA sequence was identified in *N. gonorrhoeae* <SEQ ID 2853>:

```
g930-1.seq (partial)
    1 GGCAAGTGTC TGCATGCGGG CGACATTAAT CAAATCATGT CCTTAGCACA

51 AAATGCTTTG ATCGGCAGGG GATATACCAC GACCCGTATC TTGGCTGCGC

101 CACAGGATTT GAATAGTGGC AAGCTTCAAT TAACCCTGAT GCCGGGCTAT

151 CTGCGCTCCA TACGAATCGA TCGGTCCAAC GATGATCAAA CCCATGCAGG

201 ACGTATTGCA GCATTCCAAA ACAAATTTCC CACCCGCTCG AACGATCTGT

251 TGAATCTGCG TGATTTGGAA CAAGGACTGG AAAATCTCAA ATGTCTCCCG

301 ACTGCGGAAG CCGATCTCCA AATCGTTCCC GTAGAGAGAG AACCAAACCA

351 AAGTGATGTC GTGGTGCAAT GGCGGTAACG TCTGCTGCCC TACTGTGTGA

401 GTGTGGGGAT GGATAATTCG GGTAGTGAGG CGACAGGAAA ATACCAAGGA

451 AATATCACTT TCTCTGCCGA CAATCCTTTT GGACTGAGTG ATATGTTCTA

501 TGTAAATTAT GGACGTTCAA TTGGCGGTAC GCCCGATGAG GAAAATTTTG

551 ACGGCCATCG CAAAGAAGGC GGATCAAACA ATTACGCCGT ACATTATTCA

601 GCCCCTTTCG GTAAATGGAC ATGGGCATTC AATCACAATG GCTACCGTTA

651 CCATCAGGCG GTTTCCGGAT TATCGGAAGT CTATGACTAT AATGGAAAAA

701 GTTACAACAC TGATTTCGGC TTCAACCGCC TGTTGTATCG TGATGCCAAA

751 CGCAAAACCT ATCTCAGTGT AAAACTGTGG ACGAGGGAAA CAAAAAGTTA

801 CATTGATGAT GCCGAACTGA CTGTACAACG GCGTAAAACC ACAGGTTGGT

851 TGGCAGAACT TTCCCACAAA GGATATATCG GTCGCAGTAC GGCAGATTTT

901 AAGTTGAAAT ATAAACACGG CACCGGCATG AAAGATGCTC TGCGCGCGCC

951 TGAAGAAGCC TTTGGCGAAG GCACGTCACG TATGAAAATT TGGACGGCAT

1001 CGGCTGATGT AAATACTCCT TTTCAAATCG GTAAACAGCT ATTTGCCTAT

1051 GACACATCCG TTCATGCACA ATGGAACAAA ACCCCGCTAA CATCGCAAGA

1101 CAAACTGGCT ATCGGCGGAC ACCACACCGT ACGTGGCTTC GACGGTGAAA

1151 TGAGTTTGCC TGCCGAGCGG GGATGGTATT GGCGCAACGA TTTGAGCTGG

1201 CAATTTAAAC CAGGCCATCA GCTTTATCTT GGGGCTGATG TAGGACATGT

1251 TTCAGGACAA TCCGCCAAAT GGTTATCGGG CCAAACTCTA GCCGGCACAG

1301 CAATTGGGAT ACGCGGGCAG ATAAAGCTTG CGGCAACCT GCATTACGAT

1351 ATATTTACCG GCCGTGCATT GAAAAAGCCC GAATATTTTC AGACGAAGAA

1401 ATGGGTAACG GGGTTTCAGG TGGGTTATTC GTTTTGA
```

This corresponds to the amino acid sequence <SEQ ID 2854; ORF 930-1.ng>:

```
g930-1.pep (partial)
    1 GKCLHAGDIN QIMSLAQNAL IGRGYTTTRI LAAPQDLNSG KLQLTLMPGY

51 LRSIRIDRSN DDQTHAGRIA AFQNKFPTRS NDLLNLRDLE QGLENLKCLP

101 TAEADLQIVP VEREPNQSDV VVQWR*RLLP YCVSVGMDNS GSEATGKYQG
```

-continued
```
151 NITFSADNPF GLSDMFYVNY GRSIGGTPDE ENFDGHRKEG GSNNYAVHYS

201 APFGKWTWAF NHNGYRYHQA VSGLSEVYDY NGKSYNTDFG FNRLLYRDAK

251 RKTYLSVKLW TRETKSYIDD AELTVQRRKT TGWLAELSHK GYIGRSTADF

301 KLKYKHGTGM KDALRAPEEA FGEGTSRMKI WTASADVNTP FQIGKQLFAY

351 DTSVHAQWNK TPLTSQDKLA IGGHHTVRGF DGEMSLPAER GWYWRNDLSW

401 QFKPGHQLYL GADVGHVSGQ SAKWLSGQTL AGTAIGIRGQ IKLGGNLHYD

451 IFTGRALKKP EYFQTKKWVT GFQVGYSF*
```

The following partial DNA sequence was identified in *N. meningitidis* <SEQ ID 2855>:

```
m930-1.seq
   1 ATGAAACTTC CTTTATCCTA TTTGCCTAAT ATTCGCTTTT TGTCTTGGTG

51 CTGCTTATTG GCAGGTATCA TTGCTCCTGC TACTTTGTTG GCCTCCCCCA

101 ACCCTGCCGA AATCCGTATG CAGCAAGATA TTCAGCAACG CCAACGCGAA

151 GAGCAGTTGC GCCAAACCAT GCAGCCTGAA AGCGATGTGC GTTTGCATCA

201 AAAAAACACG GGGGAAACGG TTAATCAGTT GATGGGCGAT GACAGCAGCC

251 AACCGTGTTT TGCCATTAAC GAAGTGGTGT TGGAAGGCGA ACACCATGCT

301 CGGTTTCAGT TTGCCCTAAA ACGTGCCTTG CGCGAAACGG GTTTTCAGGC

351 TGGCAAGTGT CTGCATGCGG GCAACATTAA TCAAATCATG TCCTTAGCAC

401 AAAATGCTTT GATCGGCAGG GGATATACCA CGACCCGTAT CTTGGCTGCG

451 CCACAGGATT TGAATAGTGG CAAGCTTCAA TTAACCCTGA TACCGAGCTA

501 TCTGCGCTCC ATACGAATCG ATCGGTCTAA CGATGATCAA ACCCATGCAG

551 GACGTATTGC AGCATTCCAG AACAAATTTC CCACCCGCTC GAACGATCTG

601 TTGAATCTGC GTGATTTGGA ACAAGGACTG GAAAATCTCA AACGTCTCCC

651 GACTGCGGAA GCCGATCTCC AAATCGTTCC CGTAGAGGGA GAACCAAACC

701 AAAGTGATGT CGTGGTGCAA TGGCGGCAAC GTCTGCTGCC CTACCGTGTG

751 AGTGTGGGGA TGGATAATTC GGGTAGTGAG GCGACAGGAA AATACCAAGG

801 AAATATCACT TTCTCTGCCG ACAATCCTTT GGGACTGAGT GATATGTTCT

851 ATGTAAATTA TGGACGTTCG ATTGGCGGTA CGCCCGATGA GGAAAGTTTT

901 GACGGCCATC GCAAAGAAGG CGGATCAAAC AATTACGCCG TACATTATTC

951 AGCCCCTTTC GGTAAATGGA CATGGGCATT CAATCACAAT GGCTACCGTT

1001 ACCATCAGGC AGTTTCCGGA TTATCGGAAG TCTATGACTA TAATGGAAAA

1051 AGTTACAATA CTGATTTCGG CTTCAACCGC CTGTTGTATC GTGATGCCAA

1101 ACGCAAAACC TATCTCGGTG TAAAACTGTG GATGAGGGAA ACAAAAAGTT

1151 ACATTGATGA TGCCGAACTG ACTGTACAAC GGCGTAAAAC TGCGGGTTGG

1201 TTGGCAGAAC TTTCCCACAA AGAATATATC GGTCGCAGTA CGGCAGATTT

1251 TAAGTTGAAA TATAAACGCG GCACCGGCAT GAAAGATGCT CTGCGCGCGC

1301 CTGAAGAAGC CTTTGGCGAA GGCACGTCAC GTATGAAAAT TTGGACGGCA

1351 TCGGCTGATG TAAATACTCC TTTTCAAATC GGTAAACAGC TATTTGCCTA

1401 TGACACATCC GTTCATGCAC AATGGAACAA AACCCCGCTA ACATCGCAAG

1451 ACAAACTGGC TATCGGCGGA CACCACACCG TACGTGGCTT CGACGGTGAA
```

```
-continued
1501 ATGAGTTTGT CTGCCGAGCG GGGATGGTAT TGGCGCAACG ATTTGAGCTG

1551 GCAATTTAAA CCAGGCCATC AGCTTTATCT TGGGGCTGAT GTAGGACATG

1601 TTTCAGGACA ATCCGCCAAA TGGTTATCGG GCCAAACTCT AGTCGGCACA

1651 GCAATTGGGA TACGCGGGCA GATAAAGCTT GGCGGCAACC TGCATTACGA

1701 TATATTTACC GGCCGCGCAT TGAAAAAGCC CGAATTTTTC CAATCAAGGA

1751 AATGGGCAAG CGGTTTTCAG GTAGGCTATA CGTTTTAA
```

This corresponds to the amino acid sequence <SEQ ID 2856; ORF 930-1>:

```
m930-1.pep

1 MKLPLSYLPN IRFLSWCCLL AGIIAPATLL ASPNPAEIRM QQDIQQRQRE

51 EQLRQTMQPE SDVRLHQKNT GETVNQLMGD DSSQPCFAIN EVVLEGEHHA

101 RFQFALKRAL RETGFQAGKC LHAGNINQIM SLAQNALIGR GYTTTRILAA

151 PQDLNSGKLQ LTLIPSYLRS IRIDRSNDDQ THAGRIAAFQ NKFPTRSNDL

201 LNLRDLEQGL ENLKRLPTAE ADLQIVPVEG EPNQSDVVVQ WRQRLLPYRV

251 SVGMDNSGSE ATGKYQGNIT FSADNPLGLS DMFYVNYGRS IGGTPDEESF

301 DGHRKEGGSN NYAVHUSAPF GKWTWAFNHN GYRYHQABSG LSEVYDYNGK

351 SYNTDFGFNR LLYRDAKRKT YLGVKLWMRE TKSYIDDAEL TVQRRKTAGW

401 LAELSHKEYI GRSTADFKLK YKRGTGMKDA LRAPEEAFGE GTSRMKIWTA

451 SADVNTPFQI GKQLFAYDTS VHAQWNKTPL TSQDKLAIGG HHTVRGFDGE

501 MSLSAERGWY WRNDLSWQFK PGHQLYLGAD VGHVSGQSAK WLSGQTLVGT

551 AIGIRGQIKL GGNLHYDIFT GRALKKPEFF QSRKWASGFQ VGYTF* m930-1/g930-1 95.4% indentity in 478 aa overlap 90        100        110        120        130        140
  m930-1.pep    AINEVVLEGEHHARFQFALKRALRETGFQAGKCLHAGNINQIMSLAQNALIGRGYTTTRI
                                               ::||||||||||||||||||||||||||||
  g930-1                                       GKCLHAGDINQIMSLAQNALIGRGYTTTRI
                                                 10         20         30

150        160        170        180        190        200
  m930-1.pep    LAAPQDLNSGKLQLTLIPSYLRSIRIDRSNDDQTHAGRIAAFQNKFPTRSNDLLNLRDLE
                ||||||||||||||||:|:||||||||||||||||||||||||||||||||||||||||
  g930-1        LAAPQDLNSGKLQLTLMPGYLRSIRIDRSNDDQTHAGRIAAFQNKFPTRSNDLLNLRDLE
                         40         50         60         70         80         90

210        220        230        240        250        260
  m930-1.pep    QGLENLKRLPTAEADLQIVPVEGEPNQSDVVVQWRQRLLPYRVSVGMDNSGSEATGKYQG
                ||||||| ||||||||||||||| ||||||||||| ||||| :|||||||||||||||
  g930-1        QGLENLKCLPTAEADLQIVPVEREPNQSDVVVQWRXRLLPYCVSVGMDNSGSEATGKYQG
                        100        110        120        130        140        150

270        280        290        300        310        320
  m930-1.pep    NITFSADNPLGLSDMFYVNYGRSIGGTPDEESFDGHRKEGGSNNYAVHYSAPFGKWTWAF
                |||:||||| ||||||||||||||||||||||:|||||||||||||||||||||||||
  g930-1        NITGSADNPFGLSDMFYVNYGRSIGGTPDEENFDGHRKEGGSNNYAVHYSAPFGKWTWAF
                        160        170        180        190        200        210

330        340        350        360        370        380
  m930-1.pep    NHNGYRYHQAVSGLSEVYDYNGKSYNTDFGFNRLLYRDAKRKTYLGVKLWMRETKSYIDD
                |||||||||||||||||||||||||||||||||||||||||||||:||||:||||||||
  g930-1        NHNGYRYHQAVSGLSEVYDYNGKSYNTDFGFNRLLYRDAKRKTYLSVKLWTRETKSYIDD
                        220        230        240        250        260        270

390        400        410        420        430        440
  m930-1.pep    AELTVQRRKTAGWLAELSHKEYIFRSTADFKLKYKRGTGMKDALRAPEEAFGEGTSRMKI
                ||||||||||:|||||||||:||||||||||||||:|||||||||||||||||||||||
  g930-1        AELTVQRRKTTGWLAELSHKGYIFRSTADFKLKYKHGTGMKDALRAPEEAFGEGTSRMKI
                        280        290        300        310        320        330

450        460        470        480        490        500
  m930-1.pep    WTASADVNTPFQIGKQLFAYDTSVHAQWNKTPLTSQDKLAIGGHHTVRGFDGEMSLSAER
                |||||||||||||||||||||||||||||||||||||||||||||||||||||| ||||
  g930-1        WTASADVNTPFQIGKQLFAYDTSVHAQWNKTPLTSQDKLAIGGHHTVRGFDGEMPLSAER
                        340        350        360        370        380        390
```

```
              510        520        530        540        550        560
m930-1.pep    GWYWRNDLSWQFKPGHQLYLGADVGHVSGQSAKWLSGQTLVGTAIGIRGQIKLGGNLHYD
              |||||||||||||||||||||||||||||||||||||:||||||||||||||||||||
g930-1        GWYWRNDLSWQFKPGHQLYLGADVGHVSGQSAKWLSGQTLAGTAIGIRGQIKLGGNLHYD
                       400        410        420        430        440        450

570        580        590
m930-1.pep    IFTGRALKKPEFFQSRKWASGFQVGYTF
              ||||||||||||:||::||::||||||:|
g930-1        IFTGRALKKPEYFQVTKWVTGFQVGYSFX
                       460        470 a930-1.seq not found yet a930-1.pep net found yet
```

The following partial DNA sequence was identified in *N. gonorrhoeae* <SEQ ID 2857>:

```
g931.seq
  1 ATGAAACCCA AATTCAAAAC CGTTTTAACC GCGCTGCTTT TGGCGGTTTC

51 CCTGCCGTCT ATGGCGGCAA CCCGCGTCCT GATGGAAACC GATATGGGCA

101 ATATCCGTTT GGTTTTGGAC GAATCCAAAG CCTCCAAAAC CGTTGCCAAT

151 TTCGTGCGCT ATGCCCGAAA AGGCTTTTAC GACAACACGA TTTTCCACCG

201 CGTcatCGGC GGCTTCGTCA TCCAAGGCGA CGGATTGACC GAGGACTTGG

251 TGCAAAAGGC AACCGATAAG GCCGTTGCCA ACGAATCCGG caacgGCTTG

301 AAAAACACCG TCGGCACCAT CGCAATGGCG CGGACGGCAG CCCCCGATTC

351 CGCCGCCGCC CAATTCTTTA TCAATCTGGC GGACAACGGT TCGCTCGACT

401 ACAAAAACGG ACAATACGGC TACACCGTTT TCGGCAGGGT AGAAAGCGGA

451 ATGGACACCG TTTCCAAAAT CGCCCGCGTC AAAACCGCCA CGCGCGGCTT

501 TTATCAAAAC GTACCCGTAC AGCCCGTCAA AATCCGTCGC GTTGTTGTCG

551 GGCAGTAACA CGCAGACAGA CGTTCAGACG GCGTCGCCCG TTTCCCAAAA

601 AACGCCGTTT AA
```

This corresponds to the amino acid sequence <SEQ ID 2858; ORF 931.ng>:

```
g931.pep
  1 MKPKFKTVLT ALLLAVSLPS MAATRVLMET DMGNIRLVLD ESKASKTVAN

51 FVRYARKGFY DNTIFHRVIG GFVIQGDGLT EDLVQKATDK AVANESGNGL

101 KNTVGTIAMA RTAAPDSAAA QFFINLADNG SLDYKNGQYG YTVFGRVESG

151 MDTVSKIARV KTATRGFYQN VPVQPVKIRR VVVGQ*
```

The following partial DNA sequence was identified in *N. meningitidis* <SEQ ID 2859>:

```
m931.seq
  1 ATGAAACCCA AATTCAAAAC CGTTTTAACC GCGCTGCTTT TGGCGGTTTC

51 CCTGCCGTCT ATGGCGGCAA CCCATGTTTT GATGGAAACC GATATGGGCA

101 ATATCCGTTT GGTTTTGGAC GAATCCAAAG CCCCCAAAAC CGTTGCTAAT

151 TTCGTGCGCT ATGCCCGAAA AGGCTTTTAC GACGACACCG TTTTTCACCG

201 CGTTATCGAC GGTTTTGTTA TCCAGGGCGG TGGATTGACC GAGGACTTGG

251 CACAAAAGGC AAGCGATAAG GCCGTTGCCA ACGAATCCGG CAACGGCTTG
```

```
-continued
301 AAAAACACCG CCGGCACCAT CGCCATGGCG CGGACGACAG CCCCCGATTC

351 CGCCACCAGC CAATTCTTTA TCAATCTGGC GGACcA.kCT TCGCTCGACT

401 ACAAAAACGG ACAATACGGC TATACCGTTT TCGGCAGGGT CGAAAGCGGC

451 ATGAACACCG TTTCCAAAAT CGCCCGCGTC AAAACCGCCA CGCGCGGCTT

501 TTATCAAAAC GTACCCGTAC AGCCCGTCAA AATCCGTCGC GTTGTTGTCG

551 GGCAGTAA
```

This corresponds to the amino acid sequence <SEQ ID 2860; ORF 931>:

```
m931.pep..
   1 MKPKFKTVLT ALLLAVSLPS MAATHVLMET DMGNIRLVLD ESKAPKTVAN

51 FVRYARKGFY DDTVFHRVID GFVIQGGGLT EDLAQKASDK AVANESGNGL

101 KNTAGTIAMA RTTAPDSATS QFFINLADXX SLDYKNGQYG YTVFGRVESG

151 MNTVSKIARV KTATRGFYQN VPVQPVKIRR VVVGQ*
```

Computer analysis of this amino acid sequence gave the following results:
Homology with a Predicted ORF from *N. gonorrhoeae*
ORF 931 shows 91.9% identity over a 185 aa overlap with a predicted ORF (ORF 931.ng) from *N. gonorrhoeae*:

```
g931/m931
                      10         20         30         40         50         60
       g931.pep   MKPKFKTVLTALLLAVSLPSMAATRVLMETDMGNIRLVLDESKASKTVANFVRYARKGFY
                  |||||||||||||||||||||||| |||||||||||||||||||||| |||||||||||||
       m931       MKPKFKTVLTALLLAVSLPSMAATHVLMETDMGNIRLVLDESKAPKTVANFVRYARKGFY
                      10         20         30         40         50         60

70         80         90        100        110        120
       g931.pep   DNTIFHRVIGGFVIQGDGLTEDLVQKATDKAVANESGNGLKNTVGTIAMARTAAPDSAAA
                  |:|:||||| |||||| |||||:|||:||||||||||||||||:|||||||||||||:||||::
       m931       DDTVFHRVIDGFVIQGGGLTEDLAQKASDKAVANESGNGLKNTAGTIAMARTTAPDSATS
                      70         80         90        100        110        120

130        140        150        160        170        180
       g931.pep   QFFINLADNGSLDYKNGQYGYTVFGRVESGMDTVSKIARVKTATRGFYQNVPVQPVKIRR
                  ||||||||  ||||||||||||||||||||||||:||||||||||||||||||||||||||
       m931       QFFINLADXXSLDYKNGQYGYTVFGRVESGMNTVSKIARVKTATRGFYQNVPVQPVKIRR
                     130        140        150        160        170        180
       g931.pep   VVVGQX
                  ||||||
       m931       VVVGQX
```

The following partial DNA sequence was identified in *N. meningitidis* <SEQ ID 2861>:

```
a931.seq
   1 ATGAAACCCA AATTCAAAAC CGTTTTAACC GCGCTGCTTT TGGCGGTTTC

51 CCTGCCGTCT ATGGCGGCAA CCCATGTTTT GATGGAAACC GATATGGGCA

101 ATATCCGTTT GGTTTTGGAC GAATCCAAAG CACCCAAAAC CGTTGCCAAT

151 TTCGTGCGCT ATGCCCGAAA AGGCTTTTAC GACAATACGA TTTTTCACCG

201 CGTCATCGGC GGCTTCGTTA TCCAAGGCGG CGGATTGACC GAGGACTTGG

251 CACAAAAGGC AAGCGATAAG GCCGTTGCCA ACGAATCCGG CAACGGCTTG

301 AAAAACACTG TCGGCACCAT CGCCATGGCG CGGACGGCCG ATCCGGATTC

351 CGCCACCAGC CAATTCTTTA TCAATCTGGT GGACAATGAT TCGCTCAACT
```

-continued
```
401 ACAAAAACGG ACAATACGGC TATACCGTTT TCGGCAGGGT CGAAAGCGGC

451 ATGAACACCG TTTCCAAAAT CGCCCGCGTC AAAACCGCCA CGCGCGGCTT

501 TTATCAAAAC GTACCCGTAC AGCCCGTCAA AATCCGTCGC GTTGTTGTCG

551 GGCAGTAA
```

This corresponds to the amino acid sequence <SEQ ID 2862; ORF 931.a>:

```
a931.pep
  1 MKPKFKTVLT ALLLAVSLPS MAATHVLMET DMGNIRLVLD ESKAPKTVAN

51 FVRYARKGFY DNTIFHRVIG GFVIQGGGLT EDLAQKASDK AVANESGNGL

101 KNTVGTIAMA RTADPDSATS QFFINLVDND SLNYKNGQYG YTVFGRVESG

151 MNTVSKIARV KTATRGFYQN VPVQPVKIRR VVVGQ*
``` m931/a931 94.6% identity in 185 aa overlap

```
                   10        20        30        40        50        60
    m931.pep  MKPKFKTVLTALLLAVSLPSMAATHVLMETDMGNIRLVLDESKAPKTVANFVRYARKGFY
              ||||||||||||||||||||||||||||||||||||||||||||||||||||||||||||
    a931      MKPKFKTVLTALLLAVSLPSMAATHVLMETDMGNIRLVLDESKAPKTVANFVRYARKGFY
                   10        20        30        40        50        60

70        80        90       100       110       120
    m931.pep  DDTVFHRVIDGFVIQGGGLTEDLAQKASDKAVANESGNGLKNTAGTIAMARTTAPDSATS
              |:|:||||| |||||| |||||||||||||||||||||||||||:||||||||: |||||
    a931      DNTIFHRVIGGFVIQGGGLTEDLAQKASDKAVANESGNGLKNTVGTIAMARTADPDSATS
                   70        80        90       100       110       120

130       140       150       160       170       180
    m931.pep  QFFINLADXXSLDYKNGQYGYTVFGRVESGMNTVSKIARVKTATRGFYQNVPVQPVKIRR
              ||||||:|  ||:|||||||||||||||||||||||||||||||||||||||||||||||
    a931      QFFINLVDNDSLNYKNGQYGYTVFGRVESGMNTVSKIARVKTATRGFYQNVPVQPVKIRR
                  130       140       150       160       170       180 m931.pep  VVVGQX
              ||||||
    a931      VVVGQX
```

The following partial DNA sequence was identified in *N. meningitidis* <SEQ ID 2863>:

```
m932.seq
  1 ATGAAATATA TCGTATCAAT CTCTCTGGCT ATGGGATTGG CTGCCTGTTC

51 GTTTGGGGGA TTTAAACCAA ATCCGTGGGA CGCCGCGTCA TTTTGGGAAT

101 TGAAAAATTA CGCCAATCCC TATCCGGGAT CAGCCTCGGC GGCACTTGAC

151 CAATATCCAT CGAAAGCAAG ACGAAGGCAA CTGAAAGACA TGCAAGAGTG

201 CGGCTATGAC CCAATAGACG GCGGAAAGTC TGAAGCAGAT GCCTGCCTGA

251 GGAAAAAAGG CTGGTGTCGT AAGGGTTTCG ACCCTTATCC CGAAAACAAA

301 AAATACGAAT GGCCTCGAGA AGAAGGAAAA ACAAAATGA
```

This corresponds to the amino acid sequence <SEQ ID 2864; ORF 932>:

```
m932.pep
  1 MKYIVSISLA MGLAACSFGG FKPNPWDAAS FWELKNYANP YPGSASAALD

51 QYPSKARRRQ LKDMQECGYD PIDGGKSEAD ACLRKKGWCR KGFDPYPENK

101 KYEWPREEGK TK*
```

Computer analysis of this amino acid sequence gave the following results:

Homology with a Predicted ORF from *N. gonorrhoeae*

ORF 932 shows % identity over a aa overlap with a predicted ORF (ORF 932.ng) from *N. gonorrhoeae*:

The following partial DNA sequence was identified in *N. gonorrhoeae* <SEQ ID 2865>:

```
g934.seq
    1 ATGAAAAAAA TCATCGCCTC CGCGCTTATC GCAACATTCG CACTCACCGC

51 CTGCCAAGAC GACACGCAGG CGCGGCTCGA ACGGCAGCAG AAACAGATTG

101 AAGCCCTGCA ACAGCAGCTC GCACAGCAGG CAGACGATAC GGTTTACCAA

151 CTGACTCCCG AAGCAGTCAA AGACACCATT CCTGCCCAGG CGCAGGCAAA

201 CGGCAACAAC GGTCAGCCCG TTACCGGCAA .AGAcggGCA GCAGTATATT

251 TACGACCAAT CGACAGGAAG CTGGCTGCTG CAAAGCCTGA TTGGCGCGGC

301 GGCAGGCGCG TTTATCGGCA ACGCGCTGGC AAACAAATTC ACACGGGCGG

351 GCAACCAAGA CAGCCCCGTC GCCCGTCGCG CGCGTGCTGC CTACCATCAG

401 TCCGCACGCC CCAATGCGCG CACCAGCAGG GATTTGAACA CGCGCAGCCT

451 CCGTGCAAAA CAACAGGCGG CGCAGGCGCA GCGTTACCGC CCGACAACGC

501 GCCCGCCCGT CAAttaccgc catcgcgcta tgcGCGGTTT CGgcagAagg 551 cggtaaaCCC GGCGCGTCAA TGCCGTCTGA AGGGCTTTCA GACGGCATTT

601 TTGTATTTGT TAGGGGCATT GTTATGTTGC CGTTTGATTT TCAGACGGCA

651 TTTTGTTTCC AAGCGTTTGA TGTCggGATG GCAATTCTGA
```

This corresponds to the amino acid sequence <SEQ ID 2866; ORF 934.ng>:

```
g934.pep
    1 MKKIIASALI ATFALTACQD DTQARLERQQ KQIEALQQQL AQQADDTVYQ

51 LTPEAVKDTI PAQAQANGNN GQPVTGKRRA AVYLRPIDRK LAAAKPDWRG

101 GRRVYRQRAG KQIHTGGQPR QPRRPSRACC LPSVRTPQCA HQQGFEHAQP

151 PCKTTGGAGA ALPPDNAPAR QLPPSRYARF RQKAVNPARQ CRLKGFQTAF

201 LYLLGALLCC RLIFRRHFVS KRLMSGWQF*
```

The following partial DNA sequence was identified in *N. meningitidis* <SEQ ID 2867>:

```
m934.seq (partial)
    1 ..CGGCTCGAAC AGCAGCAGAA ACAGATTGAA GCCCTGCAAC AGCAGCTCGC

51    ACAGCAGGCA GACGATACGG TTTACCAACT GACTCCCGAA GCAGTCAAAG

101    ACACCATTCC TGCCGAAGCA CAGGCAAACG GCAACAACgG GCAACCCGTT

151    ACCGGTAA.A GACGGGCAGC AGTATATTTA CGACCAATCG ACAGGAAGCT

201    GGCTGCTGCA AAGCCTGGTC GGCGCGGCGG CAGGCGCGTT TATCGGCAAC

251    GCGCTGGCAA ACAAATTCAC ACGGGCAGGC AACCAAGACA GTCCCGTCGC

301    CCGGCGCGCG CGTGCAGCCT ACCATCAGTC CGCACGCCCC AATGCGCGCA 351    yCAGCAGGGA TTTGAACACG CGCAGCCTCC GTGCAAAACA ACAGGCGGCG

401    CAkGCGCAGC GTTACCGCCC GACAACGCGC CCGsCCGsCA ATTACCGCCG

451    CCCCGCTATG CGCGGTTTCG GCAGGAGGCG GTAAACCCGG CGCGCCAATG
```

-continued
```
501  CCGTCTGAAG AGCTTTCAGA CGGCATTTnT GCATTTGTTA GGGACATTGT

551  TATGTTGCCG TTTGATTTTC AGACGGCATT TTGTTTCCAA GCGTTTGATG

601  TCGGGATGGC AATTCTGA
```

This corresponds to the amino acid sequence <SEQ ID 2868; ORF 934>:

```
m934.pep (partial)
  1  ..RLEQQQKQIE ALQQQLAQQA DDTVYQLTPE AVKDTIPAEA QANGNNGQPV

51  TGXRRAAVYL RPIDRKLAAA KPGRRGGRRV YRQRAGKQIH TGRQPRQSRR

101  PARACSLPSV RTPQCAHQQG FEHAQPPCKT TGGAXAALPP DNAPXRQLPP

151  PRYARFRQEA VNPARQCRLK SFQTAFXHLL GTLLCCRLIF RRHFVSKRLM

201  SGWQF*
```

Computer analysis of this amino acid sequence gave the following results:
Homology with a Predicted ORF from *N. gonorrhoeae*
ORF 934 shows 91.7% identity over a 205 aa overlap with a predicted ORF (ORF 934.ng) from *N. gonorrhoeae*:

```
m934/g934
                                    10         20         30
m934.pep                     RLEQQQKQIEALQQQLAQQADDTVYQLTPEAVKDTI
                             |||:|||||||||||||||||||||||||||||||
g934     MKKIIASALIATFALTACQDDTQARLERQQKQIEALQQQLAQQADDTVYQLTPEAVKDTI
             10        20        30        40        50        60
                 40        50        60        70        80        90
m934.pep     PAEAQANGNNGQPVTGXRRAAVYLRPIDRKLAAAKPGRRGGRRVYRQRAGKQIHTGRQPR
             ||:|||||||||||| |||||||||||||||||||   ||||||||||||||||| |||
g934         PAQAQANGNNGQPVTGKRRAAVYLRPIDRKLAAAKPDWRGGRRVYRQRAGKQIHTGGQPR
                 70        80        90       100       110       120
                100       110       120       130       140       150
m934.pep     QSRRPARACSLPSVRTPQCAHQQGFEHAQPPCKTTGGAXAALPPDNAPXRQLPPPRYARF
             | ||||:| ||||||||||||||||||||||||||||| ||||||||| ||||| |||||
g934         QPRRPARSCCLPSVRTPQCAHQQGFEHAQPPCKTTGGAGAALPPDNAPARQLPPSRYARF
                130       140       150       160       170       180
                160       170       180       190       200
m934.pep     RQEAVNPARQCRLKSFQTAFXHLLGTLLCCRLIFRRHFVSKRLMSGWQFX
             ||:||||||||||||:||||| :|||:|||||||||||||||||||||||
g934         RQKAVNPARQCRLKGFQTAFLYLLGALLCCRLIFRRHFVSKRLMSGWQFX
                190       200       210       220       230
```

The following partial DNA sequence was identified in *N. meningitidis* <SEQ ID 2869>:

```
a934.seq
  1  ATGAAAAAAA TCATCGCCTC CGCGCTTATC GCAACATTCG CACTCGCCGC

51  CTGCCAAGAC GACGCGCAGG CGCGGCTCGA ACAGCAGCAG AAACAGATTG

101  AAGCCCTGCA ACAGCAGCTC GCACAGCAGG CAGACGATAC GGTTTACCAA

151  CTGACTCCCG AAGCAGTCAA AGACACCATT CCTGCCGAAG CACAGGCAAA

201  CGGCAACAAC GGGCAACCCG TTACCGG.TA AAGACGGGCA GCAGTATATT

251  TACGACCAAT CGACAGGAAG CTGGCTGCTG CAAAGCCTGG TCGGCGCGGC

301  GGCAGGCGCG TTTATCGGCA ACGCGCTGGC AAACAAATTC ACACGGGCAG

351  GCAACCAAGA CAGTCCCGTC GGCAGGCGCG CGCGTGCCGC CTACCATCAG

401  TCCGCACATC CCAATGCGCG CACCAGCAGG GATTTGAACA CGCGCAGCCT

451  CCGTGCAAAA CAACAGGCGG CGCAGGCGCA GCGTTACCGC CCGACAACGC
```

```
501 GCCCGCCCGC CAATTACCGC CGCCCCGCCA TGCGCGGTTT CGGCAGAAGG

551 CGGTAAATCC GGCGTGCCAA TGCCGTCTGA AGGGCTTTCA GACGGCATTT

601 TTGTATTTGT TAGGGACATT GTTATGTTGC CGTTTGATTT TTAGACGGCA

651 TTTTGTTTCC AAGAGTTTGA TGTCGGGATG GCAATTCTGA
```

This corresponds to the amino acid sequence <SEQ ID 2870; ORF 934.a>:

```
a934.pep
  1 MKKIIASALI ATFALAACQD DAQARLEQQQ KQIEALQQQL AQQADDTVYQ

51 LTPEAVKDTI PAEAQANGNN GQPVTX*RRA AVYLRPIDRK LAAAKPGRRG

101 GRRVYRQRAG KQIHTGRQPR QSRRPARACR LPSVRTSQCA HQQGFEHAQP

151 PCKTTGGAGA ALPPDNAPAR QLPPPRHARF RQKAVNPACQ CRLKGFQTAF

201 LYLLGTLLCC RLIFRRHFVS KSLMSGWQF*
``` m934/a934 94.1% identity in 205 aa overlap

```
                             10         20         30
    m934.pep                 RLEQQQKQIEALQQQLAQQADDTVYQLTPEAVKDTI
                             |||||||||||||||||||||||||||||||||||
    a934     MKKIASALIATFALTACQDDTQARLEQQQKQIEALQQQLAQQADDTVYQLTPEAVKDTI
                     10        20        30        40        50        60
                    40         50         60         70         80         90
    m934.pep    PAEAQANGNNGQPVTGXRRAAVYLRPIDRKLAAAKPGRRGGRRVYRQRAGKQIHTGRQPR
                |||||||||||||| ||||||||||||||||||||||||||||||||||||||||||||
    a934        PAEAQANGNNGQPVTXKRRAAVYLRPIDRKLAAAKPGRRGGRRVYRQRAGKQIHTGRQPR
                        70        80        90        100       110       120
                   100        110        120        130        140        150
    m934.pep    QSRRPARACSLPSVRTPQCAHQQGFEHAQPPCKTTGGAXAALPPDNAPXRQLPPPRYARF
                ||||||||  ||||| |||||||||||||||||||||   ||||||||| ||||| |||
    a934        QSRRPARSCRLPSVRTSQCAHQQGFEHAQPPCKTTGGAGAALPPDNAPARQLPPSRHARF
                        130       140       150       160       170       180
                   160        170        180        190        200
    m934.pep    RQEAVNPARQCRLKSFQTAFXHLLGTLLCCRLIFRRHFVSKRLMSGWQFX
                || |||||||| ||| ||||| |||:|||| ||||||||||| |||||||
    a934        RQKAVNPARQCCLKGFQTAFLYLLGALLCCRLIFRRHFVSKSLMSGWQFX
                        190       200       210       220       230
    g935.seq not found yet
    g935.pep not found yet
```

The following partial DNA sequence was identified in *N. meningitidis* <SEQ ID 2871>:

```
m935.seq
  1 ATGTTGTATT TCAGATACGG CTTTTTGGTT GTTTGGTGTG CGGCAGGTGT

51 TTCTGCCGCC TATGGGCGG ATGCGCCCGC GATTTTGGAT GACAAGGCAT

101 TGTTGCAGGT GCAGCGGTCG GTGTCGGATA AGTGGGCGGA ATCAGATTGG

151 AAAGTTGAAA ATGATGCCCC GCGCGTGGTT GACGGGGATT TTTTGTTGGC

201 GCATCCGAAA ATGTTGGAAC ATAGTTTGCG CGACGCGCTC AACGGCAATC

251 AGGCGGATTT AATCGCTTCG TTGGCGGATT TGTATGCCAA GCTGCCGGAT

301 TATGACGCGG TTTTGTACGG CAGGGCGCGG GCTTTGCTGG CGAAATTGGC

351 GGGAAGGCCG GCGGAGGCGG TGGCGCGGTA TCGGGAACTG CACGGGAAA

401 ATGCGGCAGA CGAGCGGATT TTGCTGGATT TGGCGGCGGC GGAGTTTGAC
```

```
-continued
 451 GATTTCCGGC TGAAGTCGGC AGAAAGGCAT TTTGCGGAGG CGGCAAAATT

501 GGATTTGCCG GCACCGGTTT TGGAAAATGT GGGGCGTTTT CGGAAAAAAA

551 CGGAGGGGCT GACGGGCTGG CGTTTTTCGG GCGGCATCAG TCCGGCGGTC

601 AATAGAAATG CCAATAATGC CGCGCCGCAA TATTGCCGGC AAAACGGAGG

651 CCGGCAGATA TGCAGTGTCA GCCGGGCGGA GCGGGCGGCA GGGTTGAATT

701 ATGAAATCGA GGCGGAAAAG CTGACGCCGT TGGCAGATAA TCATTATTTG

751 TTGTTCCGTT CCAATATCGG CGGCACGAGC TATTATTTCA GTAAAAAATC

801 AGCTTATGAT GACGGGTTCG GCAGGGCGTA TTTGGGTTGG CAGTATAAAA

851 ATGCACGGCA GACGGCGGGG ATTTTGCCGT TTTATCAGGT GCAGTTGTCG

901 GGCAGCGACG GCTTTGATGC GAAAACAAAA CGGGTAAACA ACCGCCGCCT

951 GCCGCCGTAT ATGCTGGCGC ACGGAGTCGG CGTGCAGCTG TCCCATACTT

1001 ACCGCCCAAA CCCGGGATGG CAATTTTCGG TCGCGCTGGA ACATTACCGC

1051 CAACGCTACC GCGAACAGGA TAGGGCGGAA TACAATAACG GCAGGCAGGA

1101 CGGGTTTTAT GTTTCGTCGG CAAAACGTTT GGGCGAATCG GCAACTGTGT

1151 TCGGCGGCTG GCAGTTTGTG CGGTTTGTGC CGAAACGCGA AACGGTGGGC

1201 GGCGCGGTCA ATAATGCCGC CTACCGGCGC AACGGTGTTT ATGCCGGTTG

1251 GGCGCAGGAG TGGCGGCAGT TGGGCGGTTT GAACAGTCGG GTTTCCGCGT

1301 CTTATGCCCG CCGCAACTAT AAGGGCATTG CGGCTTTCTC GACAGAGGCG

1351 CAACGCAACC GCGAATGGAA TGTCTCGCTG GCTTTGAGCC ACGACAAGTT

1401 GTCGTACAAA GGTATCGTGC CGGCGTTGAA TTATCGTTTC GGCAGGACGG

1451 AAAGTAATGT GCCGTATGCG AAACGCCGCA ACAGCGAGGT GTTTGTGTCG

1501 GCGGATTGGC GGTTTTGA
```

This corresponds to the amino acid sequence <SEQ ID 2872; ORF 925>:

```
m935.pep
  1 MLYFRYGFLV VWCAAGVSAA YGADAPAILD DKALLQVQRS VSDKWAESDW

51 KVENDAPRVV DGDFLLAHPK MLEHSLRDAL NGNQADLIAS LADLYAKLPD

101 YDAVLYGRAR ALLAKLAGRP AEAVARYREL HGENAADERI LLDLAAAEFD

151 DFRLKSAERH FAEAAKLDLP APVLENVGRF RKKTEGLTGW RFSGGISPAV

201 NRNANNAAPQ YCRQNGGRQI CSVSRAERAA GLNYEIEAEK LTPLADNHYL

251 LFRSNIGGTS YYFSKKSAYD DGFGRAYLGW QYKNARQTAG ILPFYQVQLS

301 GSDGFDAKTK RVNNRRLPPY MLAHGVGVQL SHTYRPNPGW QFSVALEHYR

351 QRYREQDRAE YNNGRQDGFY VSSAKRLGES ATVFGGWQFV RFVPKRETVG

401 GAVNNAAYRR NGVYAGWAQE WRQLGGLNSR VSASYARRNY KGIAAFSTEA

451 QRNREWNVSL ALSHDKLSYK GIVPALNYRF GRTESNVPYA KRRNSEVFVS

501 ADWRF*
```

The following partial DNA sequence was identified in *N. meningitidis* <SEQ ID 2873>:

```
a935.seq
  1    ATGTTGTATT TCAGATACGG TTTTTTGGTT GTTTGGTGTG CGGCAGGTGT
```

-continued

```
  51 TTCTGCCGCC TATGGGCGG ATGCGCCCGC GATTTTGGAT GACAAGGCAT

101 TGTTGCAGGT GCAGCGGTCG GTGTCGGATA AGTGGGCGGA ATCGGATTGG

151 AAAGTTGACA ATGATGCCCC GCGCGTGGTT GACGGGGATT TTTTGTTGGC

201 GCATCCGAAA ATGTTGGAAC ATAGTTTGCG CGACGTGCTC AACGGCAATC

251 AGGCGGATTT GATCGCTTCG TTGGCGGATT TGTATGCCAA GCTGCCGGAT

301 TATGACGCGG TTTTGTACGG CAGGGCGCGG GCTTTGCTGG CGAAATTGGC

351 GGGAAGGCCG GCGGAGGCGG TGGCGCGGTA TCGGGAACTG CACGGGAAA

401 ATGCGGCAGA CGAGCGGATT TTGCTGGATT TGGCGGCGGC GGAGTTTGAC

451 GATTTCCGGC TGAAGTCGGC AGAAAGGCAT TTTGCCGAGG CGGAAAAATT

501 GGATTTGCCG GCGCCGGTTT TGGAAAATGT GGGGCGTTTT CGGAAAAAAG

551 CGGAGGGGCT GACGGGCTGG CGTTTTCGG GCGGCATCAG TCCGGCGGTC

601 AATAGAAATG CCAATAATGC CGCGCCGCAG TATTGCCGGC AAAACGGAGG

651 CCGGCAGATA TGCAGTGTCA GCCGGGCGGA GCGGGCGGCA GGCTTGAATT

701 ATGAAATCGA GGCGGAAAAA CTGACGGCGT TGGCAGATAA TCATTATTTG

751 TTGTTCCGTT CCAATATCGG CGGCACGAGC TATTATTTCA GTAAAAAATC

801 AGCTTATGAC GACGGGTTCG GCAGAGCGTA TTTGGGTTGG CAGTATAAAA

851 ATGCACGGCA GACGGCGGGG ATTTTGCCGT TTTATCAGGT GCAGTTGTCG

901 GGCAGCGACG GCTTTGATGC GAAAACAAAA CGGGTAAACA ACCGCCGCCT

951 GCCGCCGTAT ATGCTGGCGC ACGGAGTCGG CGTGCAGTTG TCCCATACTT

1001 ACCGCCCAAA CCCGGGATGG CAATTTTCGG TCGCGCTGGA ACATTACCGC

1051 CAACGCTACC GCGAACAGGA TAGGGCGGAA TACAATAACG GTCGGCAGGA

1101 CGGGTTTTAT GTTTCGTCGG CAAAACGTTT GGGCGAATCG GCAACTGTGT

1151 TCGGCGGCTG GCAGTTTGTG CGGTTTGTGC CGAAACGCGA AACGGTGGGC

1201 GGCGCGGTCA ATAATGCCGC CTACCGGCGC AACGGTGTTT ATGCCGGCTG

1251 GGCGCAGGAG TGGCGGCAGT TGGGCGGTTT GAACAGTCGG GTTTCCGCGT

1301 CTTATGCCCG CCGCAACTAT AAGGGCGTTG CGGCTTTCTC GACAGAGGCG

1351 CAACGCAACC GCGAATGGAA TGTCTCGCTG GCTTTGAGCC ACGACAAGTT

1401 GTCGTACAAA GGTATCGTGC CCGCGTTGAA TTATCGTTTC GGCAGGACGG

1451 AAAGTAATGT GCCGTATGCG AAACGCCGCA ACAGCGAGGT GTTTGTGTCG

1501 GCGGATTGGC GGTTTTGA
```

This corresponds to the amino acid sequence <SEQ ID 2874; ORF 935.a>:

```
a935.pep
  1 MLYFRYGFLV VWCAAGVSAA YGADAPAILD DKALLQVQRS VSDKWAESDW

51 KVDNDAPRVV DGDFLLAHPK MLEHSLRDVL NGNQADLIAS LADLYAKLPD

101 YDAVLYGRAR ALLAKLAGRP AEAVARYREL HGENAADERI LLDLAAAEFD

151 DFRLKSAERH FAEAEKLDLP APVLENVGRF RKKAEGLTGW RFSGGISPAV

201 NRNANNAAPQ YCRQNGGRQI CSVSRAERAA GLNYEIEAEK LTALADNHYL

251 LFRSNIGGTS YYFSKKSAYD DGFGRAYLGW QYKNARQTAG ILPFYQVQLS

301 GSDGFDAKTK RVNNRRLPPY MLAHGVGVQL SHTYRPNPGW QFSVALEHYR
```

```
351 QRYREQDRAE YNNGRQDGFY VSSAKRLGES ATVFGGWQFV RFVPKRETVG

401 GAVNNAAYRR NGVYAGWAQE WRQLGGLNSR VSASYARRNY KGVAAFSTEA

451 QRNREWNVSL ALSHDKLSYK GIVPALNYRF GRTESNVPYA KRRNSEVFVS

501 ADWRF*
``` m935/a935 98.8% identity in 505 aa overlap

```
                  10         20         30         40         50         60
   m935.pep  MLYFRYGFLVVWCAAGVSAAYGADAPAILDDKALLQVRSVSDKWAESDWKVENDAPRVV
             ||||||||||||||||||||||||||||||||||||||||||||||||||:||||||
       a935  MLYFRYGFLVVWCAAGVSAAYGADAPAILDDKALLQVRSVSDKWAESDWKVDNDAPRVV
                  10         20         30         40         50         60

70         80         90        100        110        120
   m935.pep  DGDFLLAHPKMLEHSLRDALNGNQADLIASLADLYAKLPDYDAVLYGRARALLAKLAGRP
             |||||||||||||||||||:||||||||||||||||||||||||||||||||||||||
       a935  DGDFLLAHPKMLEHSLRDVLNGNQADLIASLADLYAKLPDYDAVLYGRARALLAKLAGRP
                  70         80         90        100        110        120

130        140        150        160        170        180
   m935.pep  AEAVARYRELHGENAADERILLDLAAAERDDFRLKSAERHFAEAAKLDLPAPVLENVGRF
             ||||||||||||||||||||||||||||||||||||||||||:|||||||||||||||
       a935  AEAVARYRELHGENAADERILLDLAAAERDDFRLKSAERHFAEAEKLDLPAPVLENVGRF
                 130        140        150        160        170        180

190        200        210        220        230        240
   m935.pep  RKKTEGLTGWRFSGGISPAVNRNANNAAPQYCRQNGGRQICSVSRAERAAGLNYEIEAEK
             |||:||||||||||||||||||||||||||||||||||||||||||||||||||||||
       a935  RKKAEGLTGWRFSGGISPAVNRNANNAAPQYCRQNGGRQICSVSRAERAAGLNYEIEAEK
                 190        200        210        220        230        240

250        260        270        280        290        300
   m935.pep  LTPLADNHYLLFRSNIGGTSYYFSKKSAYDDGFGRAYLGWQYKNARQTAGILPFYQVQLS
             ||:|||||||||||||||||||||||||||||||||||||||||||||||||||||||
       a935  LTALADNHYLLFRSNIGGTSYYFSKKSAYDDGFGRAYLGWQYKNARQTAGILPFYQVQLS
                 250        260        270        280        290        300

310        320        330        340        350        360
   m935.pep  GSDGFDAKTKRVNNRRLPPYMLAHGVGVQLSHTYRPNPGWQFSVALEHYRQRYREQDRAE
             ||||||||||||||||||||||||||||||||||||||||||||||||||||||||||
       a935  GSDGFDAKTKRVNNRRLPPYMLAHGVGVQLSHTYRPNPGWQFSVALEHYRQRYREQDRAE
                 310        320        330        340        350        360

370        380        390        400        410        420
   m935.pep  YNNGRQDGFYVSSAKRLGESATVFGGWQFVRFVPKRETVGGAVNNAAYRRNGVYAGWAQE
             ||||||||||||||||||||||||||||||||||||||||||||||||||||||||||
       a935  YNNGRQDGFYVSSAKRLGESATVFGGWQFVRFVPKRETVGGAVNNAAYRRNGVYAGWAQE
                 370        380        390        400        410        420

430        440        450        460        470        480
   m935.pep  WRQLGGLNSRVSASYARRNYKGIAAFSTEAQRNREWNVSLALSHDKLSYKGIVPALNYRF
             ||||||||||||||||||||||||:|||||||||||||||||||||||||||||||||
       a935  WRQLGGLNSRVSASYARRNYKGVAAFSTEAQRNREWNVSLALSHDKLSYKGIVPALNYRF
                 430        440        450        460        470        480

490        500
   m935.pep  GRTESNVPYAKRRNSEVFVSADWRFX
             |||||||||||||||||||||||||
       a935  GRTESNVPYAKRRNSEVFVSADWRFX
                 490        500
```

The following partial DNA sequence was identified in *N. gonorrhoeae* <SEQ ID 2875>:

```
g936.seq
  1 ATGAAACCCA AACCACACAC CGTCCGCACC CTGATTGCCG CCGTCCTCAG

51 CCTTGCCCTC GGCGGCTGCT TCAGCGCAGT CGTCGGCGGG GCCGCCGTCG

101 GCGCAAAATC CGTCATCGAC CGccgAACCA CCGgcgcgca AACCGATGac 151 aACGTTATGG CGTTGCGTAT CGAAACCACC GCCCGTTCCT ACCTGCGCCA

201 AAACAACCAA ACCAAAGGCT ACACGCCCCA AATCTCCGTC GTCGGCTACA

251 ACCGCCACCT GCTGCTGCTC GGACAAGTCG CCACCGAAGG CGAAAAACAG

301 TTCGTCGGTC AGATTGCACG TTCCGAACAG GCCGCCGAAG GCGTATACAA
```

-continued
```
351 CTACATTACC GTCGCCTCCC TGCCGCGCAC TGCGGGCGAC ATCGCCGGCG

401 ACACTTGGAA CACGTCCAAA GTCCGCGCca cgCTGCTGGG CATCAGCCCC

451 GCTACACAGG CGCGCGTCAA AATCATTACC TACGGCAATG TAACCTACGT

501 TATGGGCATC CTCACCCCCG AAGAACAGGC GCAGATTACC CAAAAAGTCA

551 GCACCAccgT CGGCGTACAA AAAGTCATTA CCCTCTACCA AAACTACGTC

601 CAACGCTGA
```

This corresponds to the amino acid sequence <SEQ ID 2876; ORF 936.ng>:

```
g936.pep
  1 MKPKPHTVRT LIAAVLSLAL GGCFSAVVGG AAVGAKSVID RRTTGAQTDD

51 NVMALRIETT ARSYLRQNNQ TKGYTPQISV VGYNRHLLLL GQVATEGEKQ

101 FVGQIARSEQ AAEGVYNYIT VASLPRTAGD IAGDTWNTSK VRATLLGISP

151 ATQARVKIIT YGNVTYVMGI LTPEEQAQIT QKVSTTVGVQ KVITLYQNYV

201 QR*
```

The following partial DNA sequence was identified in *N. meningitidis* <SEQ ID 2877>:

```
m936.seq (partial)
  1 ATGAAACCCA AACCGCACAC CGTCCGCACC CTGATTGCCG CCATTTTCAG

51 CCTTGCCCTT AGCGGCTGCG TCAGCGCAGT AATCGGAAGC GCCGCCGTCG

101 GCGCGAAATC CGCCGTCGAC CGCCGAACCA CCGGCGCGCA AACCGACGAC

151 AACGTTATGG CGTTGCGTAT CGAAACCACC GCCCGTTCCT ATCTGCGCCA

201 AAACAACCAA ACCAAAGGCT ACACGCCCCA AATCTCCGTC GTCGGCTACA

251 ACCGCCACCT GCTGCTGCTC GGACAAGTCG CCACCGAAGG CGAAAAACAG

301 TTCGTCGGTC AGATTGCACG TTCCGAACAG GCCGCCGAAG GCGTGTACAA

351 CTATATTACC GTCGCCTCCC TGCCGCGCAC TGCC...
```

This corresponds to the amino acid sequence <SEQ ID 2878; ORF 936>:

```
m936.pep (partial)
  1 MKPKPHTVRT LIAAIFSLAL SGCVSAVIGS AAVGAKSAVD RRTTGAQTDD

51 NVMALRIETT ARSYLRQNNQ TKGYTPQISV VGYNRHLLLL GQVATEGEKQ

101 FVGQIARSEQ AAEGVYNYIT VASLPRTA...
```

Computer analysis of this amino acid sequence gave the following results:
Homology with a Predicted ORF from *N. gonorrhoeae*
ORF 936 shows 93.8% identity over a 128 aa overlap with a predicted ORF (ORF 936.ng) from *N. gonorrhoeae*:

```
m936/g936
                 10        20        30        40        50        60
    m936.pep     MKPKPHTVRTLIAAIFSLALSGCVSAVIGSAAVGAKSAVDRRTTGAQTDDNVMALRIETT
                 ||||||||||||::||||:||  |||:|||||||||:|||||||||||||||||||||
        g936     MKPKPHTVRTLIAAVLSLALGGCFSAVVGGAAVGAKSVIDRRTTGAQTDDNVMALRIETT
                 10        20        30        40        50        60
```

```
               70        80        90        100       110       120
m936.pep  ARSYLRQNNQTKGYTPQISVVGYNRHLLLLGQVATEGEKQFVGQIARSEQAAEGVYNYIT
          ||||||||||||||||||||||||||||||||||||||||||||||||||||||||||||
g936      ARSYLRQNNQTKGYTPQISVVGYNRHLLLLGQVATEGEKQFVGQIARSEQAAEGVYNYIT
               70        80        90        100       110       120

130
m936.pep  VASLPRTAXXX
          |||||||||
g936      VASLPRTAGDIAGDTWNTSKVRATLLGISPATQARVKIITYGNVTYVMGILTPEEQAQIT
              130       140       150       160       170       180
```

The following partial DNA sequence was identified in *N. meningitidis* <SEQ ID 2879>:

```
a

```
m936.pep   VASLPRTA
           ||||||||
a936       VASLPRTAGDIAGDTWNTSKVRATLLGISPATQARVKIVTYGNVTYVMGILTPEEQAQIT
                   130       140       150       160       170       180
```

The following partial DNA sequence was identified in *N. gonorrhoeae* <SEQ ID 2881>:

```
g936-1.seq
   1 ATGAAACCCA AACCACACAC CGTCCGCACC CTGATTGCCG CCGTCCTCAG
  51 CCTTGCCCTC GGCGGCTGCT TCAGCGCAGT CGTCGGCGGG GCCGCCGTCG
 101 GCGCAAAATC CGTCATCGAC CGccgAACCA CCGgcgcgca AACCGATGac
 151 aACGTTATGG CGTTGCGTAT CGAAACCACC GCCCGTTCCT ACCTGCGCCA
 201 AAACAACCAA ACCAAAGGCT ACACGCCCCA AATCTCCGTC GTCGGCTACA
 251 ACCGCCACCT GCTGCTGCTC GGACAAGTCG CCACCGAAGG CGAAAAACAG
 301 TTCGTCGGTC AGATTGCACG TTCCGAACAG GCCGCCGAAG GCGTATACAA
 351 CTACATTACC GTCGCCTCCC TGCCGCGCAC TGCGGGCGAC ATCGCCGGCG
 401 ACACTTGGAA CACGTCCAAA GTCCGCGCca cgCTGCTGGG CATCAGCCCC
 451 GCTACACAGG CGCGCGTCAA AATCATTACC TACGGCAATG TAACCTACGT
 501 TATGGGCATC CTCACCCCCG AAGAACAGGC GCAGATTACC CAAAAAGTCA
 551 GCACCAccgT CGGCGTACAA AAAGTCATTA CCCTCTACCA AAACTACGTC
 601 CAACGCTGA
```

This corresponds to the amino acid sequence <SEQ ID 2882; ORF 936-1.ng>:

```
g936-1.pep
   1 MKPKPHTVRT LIAAVLSLAL GGCFSAVVGG AAVGAKSVID RRTTGAQTDD
  51 NVMALRIETT ARSYLRQNNQ TKGYTPQISV VGYNRHLLLL GQVATEGEKQ
 101 FVGQIARSEQ AAEGVYNYIT VASLPRTAGD IAGDTWNTSK VRATLLGISP
 151 ATQARVKIIT YGNVTYVMGI LTPEEQAQIT QKVSTTVGVQ KVITLYQNYV
 201 QR*
```

The following partial DNA sequence was identified in *N. meningitidis* <SEQ ID 2883>:

```
m936-1.seq
   1 ATGAAACCCA AACCGCACAC CGTCCGCACC CTGATTGCCG CCATTTTCAG
  51 CCTTGCCCTT AGCGGCTGCG TCAGCGCAGT AATCGGAAGC GCCGCCGTCG
 101 GCGCGAAATC CGCCGTCGAC CGCCGAACCA CCGGCGCGCA AACCGACGAC
 151 AACGTTATGG CGTTGCGTAT CGAAACCACC GCCCGTTCCT ATCTGCGCCA
 201 AAACAACCAA ACCAAAGGCT ACACGCCCCA AATCTCCGTC GTCGGCTACA
 251 ACCGCCACCT GCTGCTGCTC GGACAAGTCG CCACCGAAGG CGAAAAACAG
 301 TTCGTCGGTC AGATTGCACG TTCCGAACAG GCCGCCGAAG GCGTGTACAA
 351 CTATATTACC GTCGCCTCCC TGCCGCGCAC TGCGGCGAC ATCGCCGGCG
 401 ACACTTGGAA CACATCCAAA GTCCGCGCCA CGCTGTTGGG CATCAGCCCC
 451 GCCACACAGG CGCGCGTCAA AATCGTTACC TACGGCAACG TAACCTACGT
```

-continued

```
501 TATGGGCATC CTCACCCCCG AAGAACAGGC GCAGATTACC CAAAAAGTCA

551 GCACCACCGT CGGCGTACAA AAAGTCATCA CCCTCTACCA AAACTACGTC

601 CAACGCTGA
```

This corresponds to the amino acid sequence <SEQ ID 2884; ORF 936-1>:

```
m936-1.pep
    1 MKPKPHTVRT LIAAIFSLAL SGCVSAVIGS AAVGAKSAVD RRTTGAQTDD
   51 NVMALRIETT ARSYLRQNNQ TKGYTPQISV VGYNRHLLLL GQVATEGEKQ
  101 FVGQIARSEQ AAEGVYNYIT VASLPRTAGD IAGDTWNTSK VRATLLGISP
  151 ATQARVKIVT YGNVTYVMGI LTPEEQAQIT QKVSTTVGVQ KVITLYQNYV
  201 QR* m936-1/g936-1  95.5% identity in 202 aa overlap 10         20         30         40         50         60
m936-1.pep    MKPKPHTVRILIAAIFSLALSGCVSAVIGSAAVGAKSAVDRRTTGAQTDDNVMALRIETT
              ||||||||||||::||||:||  |||:|:||||||||::|||||||||||||||||||||
g936-1        MKPKPHTVRILIAAVLSLALGGCFSAVVGGAAVGAKSVIDRRTTGAQTDDNVMALRIETT
                       10         20         30         40         50         60

70         80         90        100        110        120
m936-1.pep    ARSYLRQNNQTKGYTPQISVVGYNRHLLLLGQVATEGEKQFVGQIARSEQAAEGVYNYIT
              ||||||||||||||||||||||||||||||||||||||||||||||||||||||||||||
g936-1        ARSYLRQNNQTKGYTPQISVVGYNRHLLLLGQVATEGEKQFVGQIARSEQAAEGVYNYIT
                       70         80         90        100        110        120

130        140        150        160        170        180
m936-1.pep    VASLPRTAGDIAGDTWNTSKVRATLLGISPATQARVKIVTYGNVTYVMGILTPEEQAQIT
              ||||||||||||||||||||||||||||||||||||||:|||||||||||||||||||||
g936-1        VASLPRTAGDIAGDTWNTSKVRATLLGISPATQARVKIITYGNVTYVMGILTPEEQAQIT
                      130        140        150        160        170        180

190        200
m936-1.pep    QKVSTTVGVQKVITLYQNYVQRX
              |||||||||||||||||||||||
g936-1        QKVSTTVGVQKVITLYQNYVQRX
                      190        200
```

The following partial DNA sequence was identified in *N. meningitidis* <SEQ ID 2885>:

```
a936-1.seq
    1 ATGAAACCCA AACCGCACAC CGTCCGCACC CTGACTGCCG CCGTCCTCAG

51 CCTTGCCCTC GGCGGCTGCG TCAGCGCAGT CGTCGGCGGC GCGGCGGTCG

101 GCGCGAAATC CGCCGTCGAC CGCCGAACCA CCGGCGCGCA AACCGACGAC

151 AACGTAATGG CGCTGCGTAT CGAAACCACC GCCCGCTCCT ATCTGCGCCA

201 AAACAACCAA ACCAAAGGCT ACACGCCCCA AATCTCCGTT GTCGGCTACA

251 ACCGCCACCT GCTGCTGCTC GGACAAGTCG CCACCGAAGG CGAGAAACAG

301 TTCGTCGGTC AGATTGCACG TTCCGAACAG GCCGCCGAAG GCGTGTACAA

351 CTACATTACC GTCGCCTCCC TGCCGCGCAC TGCCGGCGAC ATCGCCGGCG

401 ACACTTGGAA CACATCCAAA GTCCGCGCCA CGCTGTTGGG CATCAGCCCC

451 GCCACACAGG CGCGCGTCAA AATCGTTACC TACGGCAACG TAACCTACGT

501 TATGGGCATC CTCACCCCCG AAGAACAGGC GCAGATTACC CAAAAAGTCA

551 GCACCACCGT CGGCGTACAA AAAGTCATCA CCCTCTACCA AAACTACGTC

601 CAACGCTGA
```

This corresponds to the amino acid sequence <SEQ ID 2886; ORF 936-1.a>:

```
a936-1.pep

1  MKPKPHTVRT LTAAVLSLAL GGCVSAVVGG AAVGAKSAVD RRTTGAQTDD

51  NVMALRIETT ARSYLRQNNQ TKGYTPQISV VGYNRHLLLL GQVATEGEKQ

101  FVGQIARSEQ AAEGVYNYIT VASLPRTAGD IAGDTWNTSK VRATLLGISP

151  ATQARVKIVT YGNVTYVMGI LTPEEQAQIT QKVSTTVGVQ KVITLYQNYV

201  QR* a936-1/m936-1   97.0% identity in 202 aa overlap
                    10         20         30         40         50         60
    m936-1.pep   MKPKPHTVRTLIAAIFSLALSGCVSAVIGSAAVGAKSAVDRRTTGAQTDDNVMALRIETT
                 ||||||||||  ::||||:||||||:|:||||||||||||||||||||||||||||||||
        a936-1   MKPKPHTVRTLTAAVLSLALGGCVSAVVGGAAVGAKSAVDRRTTGAQTDDNVMALRIETT
                    10         20         30         40         50         60

70         80         90        100        110        120
    m936-1.pep   ARSYLRQNNQTKGYTPQISVVGYNRHLLLLGQVATEGEKQFVGQIARSEQAAEGVYNYIT
                 ||||||||||||||||||||||||||||||||||||||||||||||||||||||||||||
        a936-1   ARSYLRQNNQTKGYTPQISVVGYNRHLLLLGQVATEGEKQFVGQIARSEQAAEGVYNYIT
                    70         80         90        100        110        120

130        140        150        160        170        180
    m936-1.pep   VASLPRTAGDIAGDTWNTSKVRATLLGISPATQARVKIVTYGNVTYVMGILTPEEQAQIT
                 ||||||||||||||||||||||||||||||||||||||||||||||||||||||||||||
        a936-1   VASLPRTAGDIAGDTWNTSKVRATLLGISPATQARVKIVTYGNVTYVMGILTPEEQAQIT
                   130        140        150        160        170        180

190        200
    m936-1.pep   QKVSTTVGVQKVITLYQNYVQRX
                 |||||||||||||||||||||||
        a936-1   QKVSTTVGVQKVITLYQNYVQRX
                   190        200
```

The following partial DNA sequence was identified in *N. gonorrhoeae* <SEQ ID 2887>:

```
g937.seq
   1 atGAAAAATA TTCTCTTAgt ATTTGTTAGC TTTGTGCCAT TATGTGTCCG

51 CACTGATCTG CCGCTGAata tCGAAGACAT AATGaccgAC AAGGGAAAAT

101 GGAAactGGA AACTTccctt acctacctgA acaGCGAAAA cagCCGCGCC

151 GCACTTGCCT CACCGGTTTA CATTCAGACC GGCTCCGCTT CCTTTATCCC

201 CGTCCCGACC GAAATTCAGG AAAACGGCAG CAATACCGAT ATGCTCGCCG

251 GCACGCTCGG TTTGCGCTAC GGACTGAccg GCAataccgA CATTTACGGC

301 AGCGGCAGCT ATCTGTGGCA CGAAGAACGC AAACTCGacg GCAACGGCAA

351 AACCCGCAAC AAACGGATGT CCGACATATC CGCCGGCATC AGCCACACCT

401 TCCttaAAGa cgGCAAAAAT CCCGCACTCA TCGCTTTCCT CGAAAGCACG

451 GTTTACGAAA AATCGCGCAA CAAAGCCTCG TCGGGAAAAT CGTGGCTCAT

501 CGGCGCCACC ACCTACAAAG CCATAGATCC GATTGTCCTT TCCCTCACCG

551 CCGCCTACCG CATCAACGGC AGCAAAACCC TTTCAGACGA CGTCAAATAC

601 AAAGCAGGCA ATTACTGGAT GCTGAATCCC AACATCTCAT TGCCGCCAA

651 CGACAGAATC AGCCTGACCG GAGGCATCCA ATGGCTGGGC AAACAGCCCG

701 ACCGCATAGA CGGCAAAAAA GAATCCGCAA GAAACACATC CACCTACGCC

751 CATTTCGGCG CAGGTTTCGG TTTCACCAAA ACCGCGGCTT TAAACGCATC
```

```
-continued
801 CGCACGTTTC AACGTTTCAG GGCAAAGCAG TTCCGAACTG AAATTGGGCG

851 TACAGCATAC ATTTTAA
```

This corresponds to the amino acid sequence <SEQ ID 2888; ORF 937.ng>:

```
g937.pep
  1 MKNILLVFVS FVPLCVRTDL PLNIEDIMTD KGKWKLETSL TYLNSENSRA

51 ALASPVYIQT GSASFIPVPT EIQENGSNTD MLAGTLGLRY GLTGNTDIYG

101 SGSYLWHEER KLDGNGKTRN KRMSDISAGI SHTFLKDGKN PALIAFLEST

151 VYEKSRNKAS SGKSWLIGAT TYKAIDPIVL SLTAAYRING SKTLSDDVKY

201 KAGNYWMLNP NISFAANDRI SLTGGIQWLG KQPDRIDGKK ESARNTSTYA

251 HFGAGFGFTK TAALNASARF NVSGQSSSEL KLGVQHTF*
```

The following partial DNA sequence was identified in *N. meningitidis* <SEQ ID 2889>:

```
m937.seq
  1 ATGAAGCGCA TCTTTTTGCC CGCCTTGCCC GCCATCCTGC CTTTATCCAC

51 TTATGCCGAC CTGCCCTTGA CGATTGAAGA CATAATGACC GACAAGGGAA

101 AATGGAAACT GGAAACTTCC CTTACCTACC TGAACAGCGA AAACAACCGC

151 GCCGAACTTG CCGCACCGGT TTACATTCAA ACCGGCGCAA CCTCGTTTAT

201 CCCCATTCCG ACCGAAATCC AAgAAAaCGG CAGCAATACC GATATGCTCG

251 TCGGCACGCT CGGTTTGCGC TACGGACTGA CCGGGAATAC CGACATTTAC

301 GGCAGCGGCA GCTATCTGTG GCACGAAGAA CGCAAACTCG ACGGCAACAG

351 CAAAACCCGC AACAAACGGA TGTCCGACGT ATCCCTCGGC ATCAGCCACA

401 CTTTCCTTAA AGACGACAAA AACCCCGCCC TAATCAGCTT TCTTGAAAGC

451 ACGGTTTACG AAAAATCGCG CAACAAAGCC TCGTCGGGAA ATCCTGGCT

501 CATCGGCGCC ACCACCTACA AGCCATAGA TCCGATTGTC CTTTCCTTAA

551 CCGCCGCCTA CCGCATCAAC GGCAGCAAAA CCCTTTCAGA CGGCATCCGC

601 TACAAATCGG GCAACTACCT GCTGCTCAAC CCCAACATCT CATTTGCTGC

651 CAACGACAGA ATCAGCCTGA CCGGAGGCAT CCAATGGCTG GGCAGGCAGC

701 CCGACCGGAC GGACGGCAAA CGGGAATCCT CCAGAAACAC ATCCACCTAC

751 GCCCATTTCG GCGCAGGTTT CGGTTTCACC AAAACCACGG CTTTAAACGC

801 ATCCGCACGT TCAACGTTT CAGGGCAAAG CAGTTCCGAA CTGAAATTTG

851 GCGTACAGCA TACATTTTAA
```

This corresponds to the amino acid sequence <SEQ ID 2890; ORF 937>:

```
m937.pep..
  1 MKRIFLPALP AILPLSTYAD LPLTIEDIMT DKGKWKLETS LTYLNSENNR

51 AELAAPVYIQ TGATSFIPIP TEIQENGSNT DMLVGTLGLR YGLTGNTDIY

101 GSGSYLWHEE RKLDGNSKTR NKRMSDVSLG ISHTFLKDDK NPALISFLES

151 TVYEKSRNKA SSGKSWLIGA TTYKAIDPIV LSLTAAYRIN GSKTLSDGIR
```

-continued
```
201 YKSGNYLLLN PNISFAANDR ISLTGGIQWL GRQPDRTDGK RESSRNTSTY

251 AHFGAGFGFT KTTALNASAR FNVSGQSSSE LKFGVQHTF*
```

Computer analysis of this amino acid sequence gave the following results:

Homology with a Predicted ORF from *N. gonorrhoeae*

ORF 937 shows 86.9% identity over a 289 aa overlap with a predicted ORF (ORF 937.ng) from *N. gonorrhoeae*:

```
g937/m937

10         20         30         40         50        59
     g937.pep    MKNILL-VFVSFVPLCVRTDLPLNIEDIMTDKGKWKLETSLTYLNSENSRAALASPVYIQ
                 || :| :: :::|| : :|||:|||||||||||||||||||||:|| ||:|||||
     m937        MKRIFLPALPAILPLSTYADLPLTIEDIMTDKGKWKLETSLTYLNSENNRAELAAPVYIQ
                       10         20         30         40         50        60
                 60         70         80         90        100        110       119
     g937.pep    TGSASFIPVPTEIQENGSNTDMLAGTLGLRYGLTGNTDIYGSGSYLWHEERKLDGNGKTR
                 ||::||||:|||||||||||||||||:||||||||||||||||||||||||||||:|||
     m937        TGATSFIPIPTEIQENGSNTDMLVGTLGLRYGLTGNTDIYGSGSYLWHEERKLDGNSKTR
                       70         80         90        100        110        120
                120        130        140        150        160        170       179
     g937.pep    NKRMSDISAGISHTFLKDGKNPALIAFLESTVYEKSRNKASSGKSWLIGATTYKAIDPIV
                 ||||||:| |||||||||| ||||||:|||||||||||||||||||||||||||||||
     m937        NKRMSDVSLGISHTFLKDDKNPALISFLESTVYEKSRNKASSGKSWLIGATTYKAIDPIV
                       130        140        150        160        170        180
                180        190        200        210        220        230       239
     g937.pep    LSLTAAYRINGSKTLSDDVKYKAGNYWMLNPNISFAANDRISLTGGIQWLGKQPDRIDGK
                 |||||||||||||||:: ||:||| :||||||||||||||||||||||||:|||| |||
     m937        LSLTAAYRINGSKTLSDGIRYKSGNYLLLNPNISFAANDRISLTGGIQWLGRQPDRTDGK
                       190        200        210        220        230        240
                240        250        260        270        280    289
     g937.pep    KESARNTSTYAHFGAGFGFTKTAALNASARFNVSGQSSSELKLGVQHTFX
                 :||:||||||||||||||||||:|||||||||||||||||:|||||||
     m937        RESSRNTSTYAHFGAGFGFTKTTALNASARFNVSGQSSSELKFGVQHTFX
                       250        260        270        280
```

The following partial DNA sequence was identified in *N. meningitidis* <SEQ ID 2891>:

```
a937.seq
  1 ATGAAGCGCA TCTTTTTGCC CGCCTTGCCC GCCATCCTGC CTTTATCCGC

51 TTATGCCGAC CTGCCCTTGA CGATTGAAGA CATAATGACC GACAAGGGCA

101 AATGGAAACT GGAAACTTCC CTTACCTACC TGAACAGCGA AAACAACCGC

151 GCCGAACTTG CCGCACCGGT TTACATCCAA ACCGGCGCAA CCTCGTTTAT

201 CCCCATTCCG ACCGAAATCC AAGAAAACGG CAGCAATACC GATATGCTCG

251 TTGGCACGCT CGGTTTGCGC TACGGACTGA CCGGGAATAC CGACATTTAC

301 GGCAGCGGCA GCTATCTGTG GCACGAAGAA CGCAAACTCG ACGGCAACGG

351 CAAAACCCGA AACAAACGGA TGTCCGACGT ATCCCTCGGC ATCAGCCACA

401 CCTTCCTTAA AGACGACAAA AACCCCGCCC TAATCAGCTT TCTTGAAAGC

451 ACGGTTTACG AAAAATCGCG CAACAAAGCC TCGTCGGGAA AATCCTGGCT

501 CATCGGCGCC ACCACCTACA AAGCCATCGA CCCCGTCGTC CTCTCATTGA

551 CCGCTGCCTA CCGTATCAAC GGCAGCAAAA CCCTTTCAAG CAACACCAAA

601 TACAAAGCAG GCAATTACTG GATGCTGAAT CCCAATATAT CCTTCGCCGC

651 CAACGACAGA ATCAGCCTCA CGGGCGGCAT CCAATGGCTG GGCAAGCAGC

701 CCGACCGTCT GGACGGCAAA AAAGAATCCG CAAGAAACAC ATCCACCTAT

751 GCCCATTTCG GCGCAGGTTT CGGTTTCACC AAAACCACGG CTTTAAACGC
```

```
801 ATCCGCACGT TCAACGTTT CAGGGCAAAG CAGTTCCGAA CTGAAATTTG

851 GCGTACAGCA TACGTTTTAA
```

This corresponds to the amino acid sequence <SEQ ID 2892; ORF 937.a>:

```
a937.pep
  1 MKRIFLPALP AILPLSAYAD LPLTIEDIMT DKGKWKLETS LTYLNSENNR

51 AELAAPVYIQ TGATSFIPIP TEIQENGSNT DMLVGTLGLR YGLTGNTDIY

101 GSGSYLWHEE RKLDGNGKTR NKRMSDVSLG ISHTFLKDDK NPALISFLES

151 TVYEKSRNKA SSGKSWLIGA TTYKAIDPVV LSLTAAYRIN GSKTLSSNTK

201 YKAGNYWMLN PNISFAANDR ISLTGGIQWL GKQPDRLDGK KESARNTSTY

251 AHFGAGFGFT KTTALNASAR FNVSGQSSSE LKFGVQHTF*
``` m937/a937 95.2% identity in 289 aa overlap

```
                  10         20         30         40         50         60
    m937.pep  MKRIFLPALPAILPLSTYADLPLTIEDIMTDKGKWKLETSLTYLNSENNRAELAAPVYIQ
              ||||||||||||||||:|||||||||||||||||||||||||||||||||||||||||||
    a937      MKRIFLPALPAILPLSAYADLPLTIEDIMTDKGKWKLETSLTYLNSENNRAELAAPVYIQ
                  10         20         30         40         50         60

70         80         90        100        110        120
    m937.pep  TGATSFIPIPTEIQENGSNTDMLVGTLGLRYGLTGNTDIYGSGSYLWHEERKLDGNSKTR
              |||||||||||||||||||||||||||||||||||||||||||||||||||||||:|||
    a937      TGATSFIPIPTEIQENGSNTDMLVGTLGLRYGLTGNTDIYGSGSYLWHEERKLDGNGKTR
                  70         80         90        100        110        120

130        140        150        160        170        180
    m937.pep  NKRMSDVSLGISHTFLKDDKNPALISFLESTVYEKSRNKASSGKSWLIGATTYKAIDPIV
              ||||||||||||||||||||||||||||||||||||||||||||||||||||||||||:|
    a937      NKRMSDVSLGISHTFLKDDKNPALISFLESTVYEKSRNKASSGKSWLIGATTYKAIDPVV
                 130        140        150        160        170        180

190        200        210        220        230        240
    m937.pep  LSLTAAYRINGSKTLSDGIRYKSGNYLLLNPNISFAANDRISLTGGIQWLGRQPDRTDGK
              |||||||||||||||::  :||:|||  :||||||||||||||||||||||:||||:|||
    a937      LSLTAAYRINGSKTLSSNTKYKAGNYWMLNPNISFAANDRISLTGGIQWLGKQPDRLDGK
                 190        200        210        220        230        240

250        260        270        280        290
    m937.pep  RESSRNTSTYAHFGAGFGFTKTTALNASARFNVSGQSSSELKFGVQHTFX
              :||:||||||||||||||||||||||||||||||||||||||||||||||
    a937      KESARNTSTYAHFGAGFGFTKTTALNASARFNVSGQSSSELKFGVQHTFX
                 250        260        270        280        290 g939.seq not found yet
    g939.pep not found yet
```

The following partial DNA sequence was identified in *N. meningitidis* <SEQ ID 2893>:

```
m939.seq (partial)
  1 ATGAAACGAT TGACTTTATT GGCCTTTGTT TTGGCTGCCG GTGCGGTTTC

51 CGCCTCTCCC AAAGCAGACG TGGAAAAAGG CAAACAGGTT GCCGCAACGG

101 TTTGTGCGGC TTGCCATGCA GCAGACGGTA ACAGCGGCAT TGCGATGTAT

151 CCGCGTTTGG CGGCACAGCA TACTGCTTAC ATCTATCATC AAACTATCGG

201 CATCCGCGAC GTAAACGCAC CC...
```

This corresponds to the amino acid sequence <SEQ ID 2894; ORF 939>:

```
m939.pep (partial)
   1 MKRLTLLAFV LAAGAVSASP KADVEKGKQV AATVCAACHA ADGNSGIAMY

51 PRLAAQHTAY IYHQTIGIRD VNAP...
```

The following partial DNA sequence was identified in *N. meningitidis* <SEQ ID 2895>:

```
a939.seq
   1 ATGAAACGAT TGACTTTATT GGCCTTTGTT TTGGCTGCCG GTGCGGTTTC

51 CGCATCTCCC AAAGCAGACG TGGAAAAAGG CAAACAGGTT GCCGCAACGG

101 TTTGTGCGGC TTGCCATGCA GCAGACGGTA ACAGCGGCAT TGCGATGTAT

151 CCGCGTTTGG CGGCACAGCA TACTGCTTAC ATCTATCATC AAACCATCGG

201 CATCCGCGAC GGTAAACGCA CCCACGGTTC GGCAGCTGTG ATGAAACCGG

251 TGGTAATGAA TTTGAGCGAT CAGGATATTT TGAACGTATC CGCATTCTAT

301 GCCAAACAGC AGCCCAAATC CGGTGAAGCC AATCCTAAGG AAAATCCCGA

351 ATTGGGTGCG AAAATCTATC GCGGCGGTTT GAGCGATAAA AAAGTGCCGG

401 CGTGTATGTC CTGCCACGGT CCGAGCGGTG CGGGTATGCC GGGGGGCGGA

451 AGCGAAATTC AGGCTTATCC GCGTTTGGGC GGTCAGCATC AGGCATATAT

501 TGTTGAACAG ATGAATGCCT ACAAGTCCGG TCAGCGTAAA AATACCATCA

551 TGGAAGATAT TGCAAACCGT ATGTCTGAAG AAGATTTGAA AGCGGTCGCC

601 AACTTTATCC AAGGTTTGCG TTAA
```

This corresponds to the amino acid sequence <SEQ ID 2896; ORF 939.a>:

```
a939.pep
   1 MKRLTLLAFV LAAGAVSASP KADVEKGKQV AATVCAACHA ADGNSGIAMY

51 PRLAAQHTAY IYHQTIGIRD GKRTHGSAAV MKPVVMNLSD QDILNVSAFY

101 AKQQPKSGEA NPKENPELGA KIYRGGLSDK KVPACMSCHG PSGAGMPGGG

151 SEIQAYPRLG GQHQAYIVEQ MNAYKSGQRK NTIMEDIANR MSEEDLKAVA

201 NFIQGLR*
``` m939/a939 100.0% identity in 70 aa overlap

```
                   10         20         30         40         50         60
    m939.pep  MKRLTLLAFVLAAGAVSASPKADVEKGKQVAATVCAACHAADGNSGIAMYPRLAAQHTAY
              ||||||||||||||||||||||||||||||||||||||||||||||||||||||||||||
    a939      MKRLTLLAFVLAAGAVSASPKADVEKGKQVAATVCAACHAADGNSGIAMYPRLAAQHTAY
                   10         20         30         40         50         60

70
    m939.pep  IYHQTIGIRDVNAP
              ||||||||||
    a939      IYHQTIGIRDGKRTHGSAAVMKPVVMNLSDQDILNVSAFYAKQQPKSGEANPKENPELGA
                   70         80         90        100        110        120
```

The following partial DNA sequence was identified in *N. gonorrhoeae* <SEQ ID 2897>:

```
g950.seq
   1 ATGAACAAAA ATATTGCTGC CGCACTCGCC GGTGCTTTAT CCCTGTCTCT
```

-continued

```
 51 GGCCGCCGGC GCCGTTGCCG CCCACAAACC GGCAAGCAAC GCAACAGGCG

101 TTCAAAAATC CGCCCAAGGC TCTTGCGGCG CATCCAAATC TGCCGAAGGT

151 TCGTGCGGCG CATCCAAATC TGCCGAAGGT TCGTGCGGCG CGGCTGCTTC

201 TAAAGCAGGC GAAGGCAAAT GCGGCGAGGG CAAATGCGGT GCAACTGTAA

251 AAAAAGCCCA CAAACACACC AAAGCATCTA AAGCCAAAGC CAAATCTGCC

301 GAAGGCAAAT GCGGCGAAGG CAAATGCGGT TCTAAATAA
```

This corresponds to the amino acid sequence <SEQ ID 2898; ORF 950.ng>:

```
g950.pep
  1 MNKNIAAALA GALSLSLAAG AVAAHKPASN ATGVQKSAQG SCGASKSAEG

51 SCGASKSAEG SCGAAASKAG EGKCGEGKCG ATVKKAHKHT KASKAKAKSA

101 EGKCGEGKCG SK*
```

The following partial DNA sequence was identified in *N. meningitidis* <SEQ ID 2899>:

```
m950.seq
  1 ATGAACAAAA ACATTGCTGC CGCTCTCGCC GGTGCTTTAT CCCTGTCTTT

51 GGCCGCCGGT GCAGTTGCTG CCAACAAACC GGCAAGCAAC GCAACAGGCG

101 TTCATAAATC CGCCCATGGC TCTTGCGGCG CGTCCAAATC TGCCGAAGGT

151 TCGTGCGGCG CGGCTGGTTC TAAAGCAGGC GAAGGCAAAT GCGGCGAGGG

201 CAAATGCGGT GCGACCGTAA AAAAAACCCA CAAACACACC AAAGCATCTA

251 AAGCCAAGGC CAAATCTGCC GAAGGCAAAT GCGGCGAAGG CAAATGCGGT

301 TCTAAATAA
```

This corresponds to the amino acid sequence <SEQ ID 2900; ORF 950>:

```
m950.pep
  1 MNKNIAAALA GALSLSLAAG AVAANKPASN ATGVHKSAHG SCGASKSAEG

51 SCGAAGSKAG EGKCGEGKCG ATVKKTHKHT KASKAKAKSA EGKCGEGKCG

101 SK
```

Computer analysis of this amino acid sequence gave the following results:
Homology with a Predicted ORF from *N. gonorrhoeae*
ORF 950 shows 86.6% identity over a 112 aa overlap with a predicted ORF (ORF 950) from *N. gonorrhoeae*

```
m950/g950    86.6% identity in 112 aa overlap 10        20        30        40        50
    m950.pep    MNKNIAAALAGALSLSLAAGAVAANKPASNATGVHKSAHGSCGASKSAEGSCGA------
                ||||||||||||||||||||||||:|||||||||:|||:|||||||||||||||
    g950        MNKNIAAALAGALSLSLAAGAVAAHKPASNATGVQKSAQGSCGASKSAEGSCGASKSAEG
                    10        20        30        40        50        60

60        70        80        90       100
    m950.pep    ----AGSKAGEGKCGEGKCGATVKKTHKHTKASKAKAKSAEGKCGEGKCGSK
                    |:|||||||||||||||:||||||||||||||||||||||||||||||||
    g950        SCGAAASKAGEGKCGEGKCGATVKKAHKHTKASKAKAKSAEGKCGEGKCGSKX
                        70        80        90       100       110
```

The following partial DNA sequence was identified in *N. meningitidis* <SEQ ID 2901>:

```
a950.seq
    1 ATGAACAAAA ACATTGCTGC CGCACTCGCC GGTGCTTTAT CCCTGTCTTT

51 GGCCGCCGGT GCAGTTGCTG CCAACAAACC GGCAAGCAAC GCAACAGGCG

101 TTCATAAATC CGCCCATGGC TCTTGCGGCG CGTCCAAATC TGCCGAAGGT

151 TCGTGCGGCG CGGCTGGTTC TAAAGCAGGC GAAGGCAAAT GCGGCGAGGG

201 CAAATGCGGT GCGACCGTAA AAAAACCCA CAAACACACC AAAGCATCTA

251 AAGCCAAGGC CAAATCTGCC GAAGGCAAAT GCGGCGAAGG CAAATGCGGT

301 TCTAAATAA
```

This corresponds to the amino acid sequence <SEQ ID 2902; ORF 950.a>:

```
a950.pep
    1 MNKNIAAALA GALSLSLAAG AVAANKPASN ATGVHKSAHG SCGASKSAEG

51 SCGAAGSKAG EGKCGEGKCG ATVKKTHKHT KASKAKAKSA EGKCGEGKCG

101 SK*
```

Computer analysis of this amino acid sequence gave the following results:
Homology with a Predicted ORF from *N. meningitidis*
ORF 950 shows 100.0% identity over a 102 aa overlap with a predicted ORF (ORF 950) from *N. meningitidis*

```
    a950/m950    100.0% identity in 102 aa overlap 10        20        30        40        50        60
       a950.pep   MNKNIAAALAGALSLSLAAGAVAANKPASNATGVHKSAHGSCGASKSAEGSCGAAGSKAG
                  ||||||||||||||||||||||||||||||||||||||||||||||||||||||||||||
       m950       MNKNIAAALAGALSLSLAAGAVAANKPASNATGVHKSAHGSCGASKSAEGSCGAAGSKAG
                      10        20        30        40        50        60
                      70        80        90       100
       a950.pep   EGKCGECKCGATVKKTHKHTKASKAKAKSAEGKCGEGKCGSKX
                  ||||||||||||||||||||||||||||||||||||||||
       m950       EGKCGEGKCGATVKKTHKHTKASKAKAKSAEGKCGEGKCGSK
                      70        80        90       100
```

The following partial DNA sequence was identified in *N. gonorrhoeae* <SEQ ID 2903>:

```
g951.seq
    1 ATGATTATGT TACCCGCCCG TTTCACTATT TTATCTGTCC TCGCAGCAGC

51 CCTGCTTGCC GGACAGGCGT ATGCTGCCGG CGCGGCGGAT GTGGAGCTGC

101 CGAAGGAAGT CGGAAAGGTT TTAAGGAAAC ATCGGCGTTA CAGCGAGGAA

151 GAAATCAAAA ACGAACGCGC ACGGCTTGCG GCAGTGGGCG AACGGGTCAA

201 CAGGGTGTTT ACGCTGTTGG GCGGTGAAAC GGCTTTGCAG AAAGGGCAGG

251 CGGGAACGGC TCTGGCAACC TATATGCTGA TGTTGGAACG CACAAAATCC

301 CCCGAAGTCG CCGAACGCGC CTTGGAAATG GCCGTGTCGC TGAACGCGTT

351 TGAACAGGCG GAAATGATTT ATCAGAAATG GCGGCAGATC GAGCCTATAC

401 CGGGTGAGGC GCAAAAACGG GCGGGGTGGC TGCGGAACGT ATTGAGGGAA

451 GGGGGAAATC AGCATCTGGA CGGGTTGGAA GAGGTGCTGG CGCAATCGGA

501 CGATGTGCAA AAACGCAGGA TATTTTTGCT GCTGGTGCAA GCCGCCGTGC
```

-continued

```
 551 AGCAGGGTGG GGTGGCTCAA AAAGCATCGA AAGCGGTTCG CCGTGCGGCG
 601 TTGAAGTATG AACATCTGCC CGAAGCGGCG GTTGCCGATG CGGTGTTCGG
 651 CGTACAGGGA CGCGAAAAGG AAAAGGCAAT CGAAGCTTTG CAGCGTTTGG
 701 CGAAGCTCGA TACGGAAATA TTGCCCCCCA CTTTAATGAC GTTGCGTCTG
 751 ACTGCACGCA AATATCCCGA ATACTCGAC GGCTTTTTCG AGCAGACAGA
 801 CACCCAAAAC CTTTCGGCCG TCTGGCAGGA AATGGAAATT ATGAATCTGG
 851 TTTCCCTGCG TAAGCCGGAT GATGCCTATG CGCGTTTGAA CGTGCTGTTG
 901 GAACACAACC CGAATGCAAA CCTGTATATT CAGGCGGCGA TATTGGCGGC
 951 AAACCGAAAA GAAGGTGCGT CCGTTATCGA CGGCTACGCC GAAAAGGCAT
1001 ACGGCAGGGG GACGGGGGAA CAGCGGGGCA GGGCGGCAAT GACGGCGGCG
1051 ATGATATATG CCGACCGCAG GGATTACGCC AAAGTCAGGC AGTGGTTGAA
1101 AAAAGTGTCC GCGCCGGAAT ACCTGTTCGA CAAAGGCGTG CTGGCGGCTG
1151 CGGCGGCTGC CGAATTGGAC GGAGGCCGGG CGGCTTTGCG GCAGATCGGC
1201 AGGGTGCGGA AACTTCCCGA ACAGCAGGGG CGGTATTTTA CGGCAGACAA
1251 TTTGTCCAAA ATACAGATGC TCGCCCTGTC GAAGCTGCCC GACAAACGGG
1301 AAGCCCTGAT CGGGCTGAAC AACATCATCG CCAAACTTTC GGCGGCGGGA
1351 AGCACGGAAC CTTTGGCGGA AGCATTGGCA CAGCGTTCCA TTATTTACGA
1401 ACAGTTCGGC AAACGGGGAA AAATGATTGC CGACCTTGAA ACCGCGCTCA
1451 AACTTACGCC CGATAATGCA CAAATTATGA ATAATCTGGG CTACAGCCTG
1501 CTTTCCGATT CCAAACGTTT GGACGAGGGT TTCGCCCTGC TTCAGACGGC
1551 ATACCAAATC AACCCGGACG ATACCGCCGT TAACGACAGC ATAGGCTGGG
1601 CGTATTACCT GAAAGGCGAC GCGGAAAGCG CGCTGCCGTA TCTGCGGTAT
1651 TCGTTTGAAA ACGACCCCGA GCCCGAAGTT GCCGCCCATT TGGGCGAAGT
1701 GTTGTGGGCA TTGGGCGAAC GCGATCAGGC GGTTGACGTA TGGACGCAGG
1751 CGGCACACCT TAGGGGAGAC AAGAAAATAT GGCGGGAGAC GCTCAAACGC
1801 TACGGAATCG CCTTGCCCGA GCCTTCCCGA AAACCCCGGA AATAA
```

This corresponds to the amino acid sequence <SEQ ID 2904; ORF 951.ng>:

```
g951.pep
  1 MIMLPARFTI LSVLAAALLA GQAYAAGAAD VELPKEVGKV LRKHRRYSEE
 51 EIKNERARLA AVGERVNRVF TLLGGETALQ KGQAGTALAT YMLMLERTKS
101 PEVAERALEM AVSLNAFEQA EMIYQKWRQI EPIPGEAQKR AGWLRNVLRE
151 GGNQHLDGLE EVLAQSDDVQ KRRIFLLLVQ AAVQQGGVAQ KASKAVRRAA
201 LKYEHLPEAA VADAVFGVQG REKEKAIEAL QRLAKLDTEI LPPTLMTLRL
251 TARKYPEILD GFFEQTDTQN LSAVWQEMEI MNLVSLRKPD DAYARLNVLL
301 EHNPNANLYI QAAILAANRK EGASVIDGYA EKAYGRGTGE QRGRAAMTAA
351 MIYADRRDYA KVRQWLKKVS APEYLFDKGV LAAAAAAELD GGRAALRQIG
401 RVRKLPEQQG RYFTADNLSK IQMLALSKLP DKREALIGLN NIIAKLSAAG
451 STEPLAEALA QRSIIYEQFG KRGKMIADLE TALKLTPDNA QIMNNLGYSL
501 LSDSKRLDEG FALLQTAYQI NPDDTAVNDS IGWAYYLKGD AESALPYLRY
```

```
551 SFENDPEPEV AAHLGEVLWA LGERDQAVDV WTQAAHLRGD KKIWRETLKR

601 YGIALPEPSR KPRK*
```

The following partial DNA sequence was identified in *N. meningitidis* <SEQ ID 2905>:

```
m951.seq
   1 ATGATTATGT TACCTAACCG TTTCAAAATG TTAACTGTGT TGACGGCAAC

51 CTTGATTGCC GGACAGGTAT CTGCCGCCGG AGGCGGTGCG GGGGATATGA

101 AACAGCCGAA GGAAGTCGGA AAGGTTTTCA GAAAGCAGCA GCGTTACAGC

151 GAGGAAGAAA TCAAAAACGA ACGCGCACGG CTTGCGGCAG TGGGCGAGCG

201 GGTTAATCAG ATATTTACGT TGCTGGGAGG GGAAACCGCC TTGCAAAAGG

251 GGCAGGCGGG AACGGCTCTG GCAACCTATA TGCTGATGTT GGAACGCACA

301 AAATCCCCCG AAGTCGCCGA ACGCGCCTTG GAAATGGCCG TGTCGCTGAA

351 CGCGTTTGAA CAGGCGGAAA TGATTTATCA GAAATGGCGG CAGATTGAGC

401 CTATACCGGG TAAGGCGCAA AAACGGGCGG GGTGGCTGCG GAACGTGCTG

451 AGGGAAAGAG GAAATCAGCA TCTGGACGGA CTGGAAGAAG TGCTGGCTCA

501 GGCGGACGAA GGACAGAACC GCAGGGTGTT TTTATTGTTG GCACAAGCCG

551 CCGTGCAACA GGACGGGTTG GCGCAAAAAG CATCGAAAGC GGTTCGCCGC

601 GCGGCGTTGA AATATGAACA TCTGCCCGAA GCGGCGGTTG CCGATGTGGT

651 GTTCAGCGTA CAGGGACGCG AAAAGGAAAA GGCAATCGGA GCTTTGCAGC

701 GTTTGGCGAA GCTCGATACG GAAATATTGC CCCCCACTTT AATGACGTTG

751 CGTCTGACTG CACGCAAATA TCCCGAAATA CTCGACGGCT TTTTCGAGCA

801 GACAGACACC CAAAACCTTT CGGCCGTCTG GCAGGAAATG GAAATTATGA

851 ATCTGGTTTC CCTGCACAGG CTGGATGATG CCTATGCGCG TTTGAACGTG

901 CTGTTGGAAC GCAATCCGAA TGCAGACCTG TATATTCAGG CAGCGATATT

951 GGCGGCAAAC CGAAAAGAAG GTGCTTCCGT TATCGACGGC TACGCCGAAA

1001 AGGCATACGG CAGGGGACG GAGGAACAGC GGAGCAGGGC GGCGCTAACG

1051 GCGGCGATGA TGTATGCCGA CCGCAGGGAT TACGCCAAAG TCAGGCAGTG

1101 GCTGAAAAAA GTATCCGCGC CGGAATACCT GTTCGACAAA GGTGTGCTGG

1151 CGGCTGCGGC GGCTGTCGAG TTGGACGGCG GCAGGGCGGC TTTGCGGCAG

1201 ATCGGCAGGG TGCGGAAACT TCCCGAACAG CAGGGGCGGT ATTTTACGGC

1251 AGACAATTTG TCCAAAATAC AGATGCTCGC CCTGTCGAAG CTGCCCGATA

1301 AACGGGAGGC TTTGAGGGGG TTGGACAAGA TTATCGAAAA ACCGCCTGCC

1351 GGCAGTAATA CAGAGTTACA GGCAGAGGCA TTGGTACAGC GGTCAGTTGT

1401 TTACGATCGG CTTGGCAAGC GGAAAAAAAT GATTTCAGAT CTTGAAAGGG

1451 CGTTCAGGCT TGCACCCGAT AACGCTCAGA TTATGAATAA TCTGGGCTAC

1501 AGCCTGCTGA CCGATTCCAA ACGTTTGGAC GAAGGTTTCG CCCTGCTTCA

1551 GACGGCATAC CAAATCAACC CGGACGATAC CGCTGTCAAC GACAGCATAG

1601 GCTGGGCGTA TTACCTGAAA GGCGACGCGG AAAGCGCGCT GCCGTATCTG

1651 CGGTATTCGT TTGAAAACGA CCCCGAGCCC GAAGTTGCCG CCCATTTGGG

1701 CGAAGTGTTG TGGGCATTGG GCGAACGCGA TCAGGCGGTT GACGTATGGA
```

-continued

```
1751 CGCAGGCGGC ACACCTTACG GGAGACAAGA AAATATGGCG GGAAACGCTC

1801 AAACGTCACG GCATCGCATT GCCCCAACCT TCCCGAAAAC CTCGGAAATA

1851 A
```

This corresponds to the amino acid sequence <SEQ ID 2906; ORF 791>:

```
m951.pep
  1 MIMLPNRFKM LTVLTATLIA GQVSAAGGGA GDMKQPKEVG KVFRKQQRYS

51 EEEIKNERAR LAAVGERVNQ IFTLLGGETA LQKGQAGTAL ATYMLMLERT

101 KSPEVAERAL EMAVSLNAFE QAEMIYQKWR QIEPIPGKAQ KRAGWLRNVL

151 RERGNQHLDG LEEVLAQADE GQNRRVFLLL AQAAVQQDGL AQKASKAVRR

201 AALKYEHLPE AAVADVVFSV QGREKEKAIG ALQRLAKLDT EILPPTLMTL

251 RLTARKYPEI LDGFFEQTDT QNLSAVWQEM EIMNLVSLHR LDDAYARLNV

301 LLERNPNADL YIQAAILAAN RKEGASVIDG YAEKAYGRGT EEQRSRAALT

351 AAMMYADRRD YAKVRQWLKK VSAPEYLFDK GVLAAAAAVE LDGGRAALRQ

401 IGRVRKLPEQ QGRYFTADNL SKIQMLALSK LPDKREALRG LDKIIEKPPA

451 GSNTELQAEA LVQRSVVYDR LGKRKKMISD LERAFRLAPD NAQIMNNLGY

501 SLLTDSKRLD EGFALLQTAY QINPDDTAVN DSIGWAYYLK GDAESALPYL

551 RYSFENDPEP EVAAHLGEVL WALGERDQAV DVWTQAAHLT GDKKIWRETL

601 KRHGIALPQP SRKPRK*
```

Computer analysis of this amino acid sequence gave the following results:

Homology with a Predicted ORF from *N. gonorrhoeae*
ORF 951 shows 88.6% identity over a 616 aa overlap with a predicted ORF (ORF 951) from *N. gonorrhoeae*

```
    m951/g951 88.6% indentity in 616 aa overlap 10         20         30         40         50         60
    m951.pep   MIMLPNRFKMLTVLTATLIAGQVSAAGGGAGDMKQPKEVGKVFRKQQRYSEEEIKNERAR
               |||||  || :|:||:|:|||: ||   ||:|:: ||||||:||::||||||||||||
    g951       MIMLPNRFTILSVLAAALLAGQAYAA--GAAADVELPKEVGKVFLKQHRYSEEEIKNERAR
                  10         20          30         40         50

70         80         90        100        110        120        130
    m951.pep   LAAVGERVNQIFTLLGGETALQKGQAGTALATYMLMLERTKSPEVAERALEMAVSLNAFE
               ||||||||:::||||||||||||||||||||||||||||||||||||||||||||||||
    g951       LAAVGERVNRVFTLLGGETALQKGQAGTALATYMLMLERTKSPEVAERALEMAVSLNAFE
                  60         70         80         90        100        110

130        140        150        160        170        180
    m951.pep   QAEMIYQKWRQIEPIPGKAQKRAGQLRNVLRERGNQHLDGLEEVLAQADEGQNRRVFLLL
               |||||||||||||||||:||||||||||||||| ||||||||||||||:|: |:||:|||
    g951       QAEMIYQKWRQIEPIPGEAQKRAGQLRNVLREGGNQHLDGLEEVLAQSDDVQKRRIFLLL
                  120        130        140        150        160        170

190        200        210        220        230        240
    m951.pep   AQAAVQQDGLAQKASKAVRRAALKYEHLPEAAVADVVFSVQGREKEKAIGALQRLAKLDT
               :||||| |:|||||||||||||||||||||||||:||:|||||||||||  ||||||||
    g951       VQAAVQQGGVAQKASKAVRRAALKYEHLPEAAVADAVFGVQGREKEKAIEALQRLAKLDT
                  180        190        200        210        220        230

250        260        270        280        290        300
    m951.pep   EILPPTLMTLRLTARKYPEILDGFFEQTDTQNLSAVWQEMEIMNLVSLHRLDDAYARLNV
               |||||||||||||||||||||||||||||||||||||||||||||||::||||||||||
    g51        EILPPTLMTLRLTARKYPEILDGFFEQTDTQNLSAVWQEMEIMNLVSLRKPDDAYARLNV
                  240        250        260        270        280        290

310        320        330        340        350        360
    m951.pep   LLERNPNADLUIQAAILAANRKEGASVIDGYAEKAYGRGTEEQRSRAALTAAMMYSDRRD
               |||:||||:|||||||||||||||||||||||||||||||||: |||:||||:||||||
    g951       LLEHNPNANLUIQAAILAANRKEGASVIDGYAEKAYGRGTGEQRGRAAMTAAMIYSDRRD
                  300        310        320        330        340        350
```

-continued

```
                370       380       390       400       410       420
m951.pep    YAKVRQWLKKVSAPEYLFDKGVLAAAAAVELDGGRAALRQIGRVRKLPEQQGRYFTADNL
            |||||||||||||||||||||||||:||||||||||||||||||||||||||||||||||
g951        YAKVRQWLKKVSAPEYLFDKGVLAAAAAAELDGGRAALRQIGRVRKLPEQQGRYFTADNL
           260       370       380       390       400       410

430       440       450       460       470       480
m951.pep    SKIQMLALSKLPDKREALRGLDKIIEKPPAGSNTELQAEALVQRSVVYDRLGKRKKMISD
            |||||||||||||||| ||::|| |  |:::||  ||||:|||::|:::||| |||:|
g951        SKIQMLALSKLPDKREALIGLNNIIAKLSAAGSTEPLAEALAQRSIIYEQFGKRGKMIAD
           420       430       440       450       460       470

490       500       510       520       530       540
m951.pep    LERAFRLAPDNAQIMNNLGYSLLTDSKRLDEGFALLQTAYQINPDDTAVNDSIGWAYYLK
            || |::|:||||||||||||||:|||||||||||||||||||||||||||||||||||||
g951        LETALKLTPDNAQIMNNLGYSLLSDSKRLDEGFALLQTAYQINPDDTAVNDSIGWAYYLK
           480       490       500       510       520       530

550       560       570       580       590       600
m951.pep    GDAESALPYLRYSFENDPEPEVAAHLGEVLWALGERDQAVDVWTQAAHLTGDKKIWRETL
            ||||||||||||||||||||||||||||||||||||||||||||||||| ||||||||||
g951        GDAESALPYLRYSFENDPEPEVAAHLGEVLWALGERDQAVDVWTQAAHLRGDKKIWRETL
           540       550       560       570       580       590

610
m951.pep    KRHGIALPQPSRKPRK
            ||:|||||:|||||||
g951        KRYGIALPEPSRKPRKX
           600       610
```

The following partial DNA sequence was identified in *N. meningitidis* <SEQ ID 2907>:

```
a951.seq
   1  ATGTTACCCG CCCGTTTCAC CATTTTATCT GTGCTCGCGG CAGCCCTGCT
  51  TGCCGGGCAG GCGTATGCCG CCGGCGCGGC GGATGCGAAG CCGCCGAAGG
 101  AAGTCGGAAA GGTTTTCAGA AAGCAGCAGC GTTACAGCGA GGAAGAAATC
 151  AAAAACGAAC GCGCACGGCT TGCGGCAGTG GGCGAGCGGG TTAATCAGAT
 201  ATTTACGTTG CTGGGAGGGG AAACCGCCTT GCAAAAGGGG CAGGCGGGAA
 251  CGGCTCTGGC AACCTATATG CTGATGTTGG AACGCACAAA ATCCCCCGAA
 301  GTCGCCGAAC GCGCCTTGGA AATGGCCGTG TCGCTGAACG CGTTTGAACA
 351  GGCGGAAATG ATTTATCAGA AATGGCGGCA GATTGAGCCT ATACCGGGTA
 401  AGGCGCAAAA ACGGGCGGGG TGGCTGCGGA ACGTGCTGAG GGAAAGAGGA
 451  AATCAGCATC TAGACGGACT GGAAGAAGTG CTGGCTCAGG CGGACGAAGG
 501  ACAGAACCGC AGGGTGTTTT TATTGTTGGC ACAAGCCGCC GTGCAACAGG
 551  ACGGGTTGGC GCAAAAAGCA TCGAAAGCGG TTCGCCGCGC GGCGTTGAGA
 601  TATGAACATC TGCCCGAAGC GGCGGTTGCC GATGTGGTGT TCAGCGTACA
 651  GGGACGCGAA AAGGAAAAGG CAATCGGAGC TTTGCAGCGT TTGGCGAAGC
 701  TCGATACGGA AATATTGCCC CCCACTTTAA TGACGTTGCG TCTGACTGCA
 751  CGCAAATATC CCGAAATACT CGACGGCTTT TTCGAGCAGA CAGACACCCA
 801  AAACCTTTCG GCCGTCTGGC AGGAAATGGA AATTATGAAT CTGGTTTCCC
 851  TGCACAGGCT GGATGATGCC TATGCGCGTT TGAACGTGCT GTTGGAACGC
 901  AATCCGAATG CAGACCTGTA TATTCAGGCA GCGATATTGG CGGCAAACCG
 951  AAAAGAAGGT GCTTCCGTTA TCGACGGCTA CGCCGAAAAG GCATACGGCA
1001  GGGGGACGGG GGAACAGCGG GGCAGGGCGG CAATGACGGC GGCGATGATA
1051  TATGCCGACC GAAGGGATTA CACCAAAGTC AGGCAGTGGT TGAAAAAAGT
1101  GTCCGCGCCG GAATACCTGT TCGACAAAGG TGTGCTGGCG GCTGCGGCGG
1151  CTGTCGAGTT GGACGGCGGC AGGGCGGCTT TGCGGCAGAT CGGCAGGGTG
```

-continued

```
1201  CGGAAACTTC CCGAACAGCA GGGGCGGTAT TTTACGGCAG ACAATTTGTC

1251  CAAAATACAG ATGTTCGCCC TGTCGAAGCT GCCCGACAAA CGGGAGGCTT

1301  TGAGGGGGTT GGACAAGATT ATCGAAAAAC CGCCTGCCGG CAGTAATACA

1351  GAGTTACAGG CAGAGGCATT GGTACAGCGG TCAGTTGTTT ACGATCGGCT

1401  TGGCAAGCGG AAAAAAATGA TTTCAGATCT TGAAAGGGCG TTCAGGCTTG

1451  CACCCGATAA CGCTCAGATT ATGAATAATC TGGGCTACAG CCTGCTTTCC

1501  GATTCCAAAC GTTTGGACGA AGGCTTCGCC CTGCTTCAGA CGGCATACCA

1551  AATCAACCCG GACGATACCG CTGTCAACGA CAGCATAGGC TGGGCGTATT

1601  ACCTGAAAGG CGACGCGGAA AGCGCGCTGC CGTATCTGCG GTATTCGTTT

1651  GAAAACGACC CCGAGCCCGA AGTTGCCGCC CATTTGGGCG AAGTGTTGTG

1701  GGCATTGGGC GAACGCGATC AGGCGGTTGA CGTATGGACG CAGGCGGCAC

1751  ACCTTACGGG AGACAAGAAA ATATGGCGGG AAACGCTCAA ACGTCACGGC

1801  ATCGCATTGC CCCAACCTTC CCGAAAACCT CGGAAATAA
```

This corresponds to the amino acid sequence <SEQ ID 2908; ORF 951.a>:

```
a951.pep
    1 MLPARFTILS VLAAALLAGQ AYAAGAADAK PPKEVGKVFR KQQRYSEEEI

51 KNERARLAAV GERVNQIFTL LGGETALQKG QAGTALATYM LMLERTKSPE

101 VAERALEMAV SLNAFEQAEM IYQKWRQIEP IPGKAQKRAG WLRNVLRERG

151 NQHLDGLEEV LAQADEGQNR RVFLLLAQAA VQQDGLAQKA SKAVRRAALR

201 YEHLPEAAVA DVVFSVQGRE KEKAIGALQR LAKLDTEILP PTLMTLRLTA

251 RKYPEILDGF FEQTDTQNLS AVWQEMEIMN LVSLHRLDDA YARLNVLLER

301 NPNADLYIQA AILAANRKEG ASVIDGYAEK AYGRGTGEQR GRAAMTAAMI

351 YADRRDYTKV RQWLKKVSAP EYLFDKGVLA AAAAVELDGG RAALRQIGRV

401 RKLPEQQGRY FTADNLSKIQ MFALSKLPDK REALRGLDKI IEKPPAGSNT

451 ELQAEALVQR SVVYDRLGKR KKMISDLERA FRLAPDNAQI MNNLGYSLLS

501 DSKRLDEGFA LLQTAYQINP DDTAVNDSIG WAYYLKGDAE SALPYLRYSF

551 ENDPEPEVAA HLGEVLWALG ERDQAVDVWT QAAHLTGDKK IWRETLKRHG

600 IALPQPSRKP RK*
```

Computer analysis of this amino acid sequence gave the following results:
Homology with a Predicted ORF from *N. meningitidis*
ORF 951 shows 96.4% identity over a 614 aa overlap with a predicted ORF (ORF 951) from *N. meningitidis*

```
    a951/m951   96.4% identity in 614 aa overlap 10         20         30         40         50
        a951.pep    MLPARFTILSVLAAALLAGQAYAAG--AADAKPPKEVGKVFRKQQRYSEEEIKNERAR
                    ||| || :|:||:|:|:||| :  ||| |:| |||||||||||||||||||||||||
        951         MIMLPNRFKMLTVLTATLIAGQVSAAGGGAGDMKQPKEVGKVFRKQQRYSEEEIKNERAR
                      10         20         30         40         50        60

60         70         80         90        100        110
        a951.pep    LAAVGERVNQIFTLLGGETALQKGQAGTALATYMLMLERTKSPEVAERALEMAVSLNAFE
                    ||||||||||||||||||||||||||||||||||||||||||||||||||||||||||||
        m951        LAAVGERVNQIFTLLGGETALQKGQAGTALATYMLMLERTKSPEVAERALEMAVSLNAFE
                         70         80         90        100        110        120
```

```
          120       130       140       150       160       170
a951.pep  QAEMIYQKWRQIEPIPGKAQKRAGWLRNVLRERGNQHLDGLEEVLAQADEGQNRRVFLLL
          ||||||||||||||||||||||||||||||||||||||||||||||||||||||||||||
m951      QAEMIYQKWRQIEPIPGKAQKRAGWLRNVLRERGNQHLDGLEEVLAQADEGQNRRVFLLL
          130       140       150       160       170       180

180       190       200       210       220       230
a951.pep  AQAAVQQDGLAQKASKAVRRAALRYEHLPEAAVADVVFSVQGREKEKAIGALQRLAKLDT
          ||||||||||||||||||||||||||:|||||||||||||||||||||||||||||||||
m951      AQAAVQQDGLAQKASKAVRRAALKYEHLPEAAVADVVFSVQGREKEKAIGALQRLAKLDT
          190       200       210       220       230       240

240       250       260       270       280       290
a951.pep  EILPPTLMTLRLTARKYPEILDGFFEQTDTQNLSAVWQEMEIMNLVSLHRLDDAYARLNV
          ||||||||||||||||||||||||||||||||||||||||||||||||||||||:||||
m951      EILPPTLMTLRLTARKYPEILDGFFEQTDTQNLSAVWQEMEIMNLVSLHRLDDATARLNV
          250       260       270       280       290       300

300       310       320       330       340       350
a951.pep  LLERNPNADLYIQAAILAANRKEGASVIDGYAEKAYGRGTGEQRGRAAMTAAMIYADRRD
          ||||||||||||||||||||||||||||||||||||||||||:|||:||||:||||||
m951      LLERNPNADLYIQAAILAANRKEGASVIDGYAEKAYGRGTEEQRSRAALTAAMMYADRRD
          310       320       330       340       350       360

360       370       380       390       400       410
a951.pep  YTKVRQWLKKVSAPEYLFDKGVLAAAAAVELDGGRAALRQIFRVRKLPEQQGRYFTADNL
          |:||||||||||||||||||||||||||||||||||||||||:|||||||||||||||||
m951      YAKVRQWLKKVSAPEYLFDKGVLAAAAAVELDGGRAALRQIGRVRKLPEQQGRYFTADNL
          370       380       390       400       410       420

420       430       440       450       460       470
a951.pep  SKIQMFALSKLPDKREALRGLDKIIEKPPAGSNTELQAEALVQRSVVYDRLGKRKKMISD
          |||||:||||||||||||||||||||||||||||:|||||||||||||||||||||||||
m951      SKIQMLALSKLPDKREALRGLDKIIEKPPAGSNTALQAEALVQRSVVYDRLGKRKKMISD
          430       440       450       460       470       480

480       490       500       510       520       530
a951.pep  LERAFRLAPDNAQIMNNLGYSLLSDLKRLDEGFALLQTAYQINPDDTAVNDSIGWAYYLK
          |||||||||||:|||||||||||:||||||||||||||||||||||||||||||||||
m951      LERAFRLAPDANQIMNNLGYSLLTDSKRLDEGFALLQTAYQINPDDTAVNDSIGWAYYLK
          490       500       510       520       530       540

540       550       560       570       580       590
a951.pep  GDAESALPYLRYSFENDPEPEVAAHLGEVLWALGERDQAVDVWTQAAHLTGDKKIWRETL
          ||||||||||||||||||||||||||||||||||||||||||||||||||||||||||||
m951      GDAESALPYLRYSFENDPEPEVAAHLGEVLWALGERDQAVDVWTQAAHLTGDKKIWRETL
          550       560       570       580       590       600

600       610
a951.pep  KRHGIALPQPSRKPRK
          ||||||||||||||||
m951      KRHGIALPQPSRKPRK
          610
```

The following partial DNA sequence was identified in *N. gonorrhoeae* <SEQ ID 2909>:

```
g952.seq (partial)
  1  ..TTGTCTTATC GTTTGAATGC TGCACCGATG TTTAACGATA ATCCTGTTGT

51    TTACGGAAAA ATCAAATTGC AGAGTTGGAA AGCGCGGCGG GATTTCAATA

101    TTGTAAAGCA GGATTTGGAT TTTTCCTGCG GGCGGCTTC GGTGGCGACG

151    CTTTTGAACA ATTTTTACGG GCAAAAGCTG ACGGAAGAAG AAGTGTTGGA

201    AAAACTGGGT AAGGAACAGA TGCGCGCGTC GTTTGAGGAT ATGCGGCGCA

251    TTATGCCCGA TTTGGGTTTT GAGGCGAAAG GCTATGCCCT GTCTTTCGAA

301    CAGCTCGCGC AGTTGAAAAT CCCCGTCATC GTGTATCTGA AATACCGCAA

351    AGACGACCAT TTTTCGGTAT TGCGCGGAGT GGATGGCAAT ACGGTTTTGC

401    TTGCCGACCC GTCGCCGGGT CATGTTTCGA TGAGCAGGGC GCAGTTTTTG

451    GAGGCTTGGC AAACCCGTGA GGGAAATTTG GCAGGCAAAA TTTTGGCGGT

501    CGTGCCGAAA AAAGCGGAGG CGATTTCAAA TAAATTGTTT TCACACATC

551    ATCCCAAGCG GCAGACGGAG TTTGCAGTCG GACAGGTAAA ATGGTGGCGT

601    GCTTATTGA
```

This corresponds to the amino acid sequence <SEQ ID 2910; ORF 952.ng>:

```
g952.pep (partial)
    1 ..LSYRLNAAPM FNDNPVVYGK IKLQSWKARR DFNIVKQDLD FSCGAASVAT

51    LLNNFYGQKL TEEEVLEKLG KEQMRASFED MRRIMPDLGF EAKGYALSFE

101    QLAQLKIPVI VYLKYRKDDH FSVLRGVDGN TVLLADPSPG HVSMSRAQFL

151    EAWQTREGNL AGKILAVVPK KAEAISNKLF FTHHPKRQTE FAVGQVKWWR

201    AY*
```

The following partial DNA sequence was identified in *N. meningitidis* <SEQ ID 2911>:

```
m952.seq
    1 ATGATGAAGT TCAAATATGT TTTTCTGTTG GCGTGTGTTG TCGTTTCTTT

51 ATCTTATCGT TTGAATGCTG CACCGATGTT TAACGATAAT CCTGTTGTTT

101 ACGGAAAAAT CAAAGTGCAG AGTTGGAAAG CGCGGCGGGA TTTCAATATT

151 GTAAAGCAGG ATTTGGATTT TTCCTGTGGG GCGGCTTCGG TGGCGACGCT

201 TTTGAACAAT TTTTACGGGC AAACGCTGAC GGAAGAAGAA GTGTTGAAAA

251 AGCTGGATAA GGAGCAGATG CGCGCGTCGT TTGAGGATAT GCGGCGCATT

301 ATGCCTGATT TGGGTTTTGA GGCGAAGGGC TATGCCCTGT CTTTCGAGCA

351 GCTCGCGCAG TTGAAAATCC CCGTCATCGT GTATCTGAAA TACCGCAAAG

401 ACGACCATTT TTCGGTATTG CGCGGTATAG ACGGCAATAC GGTTTTGCTT

451 GCCGACCCGT CGCTGGGGCA TGTTTCAATG AGCAGGGCGC AGTTTTTGGA

501 TGCTTGGCAA ACCCGTGAGG GAAATTTGGC AGGTAAGATT TTGGCTGTCA

551 TACCGAAAAA AGCCGAGACA ATTTCAAATA AATTGTTTTT CACACAACAC

601 CCAAAACGGC AGACGGAGTT TACAGTCGGA CAAATCAGGC AAGCACGTGC

651 AGAGTAA
```

This corresponds to the amino acid sequence <SEQ ID 2912; ORF 952>:

```
m952.pep
    1 MMKFKYVFLL ACVVVSLSYR LNAAPMFNDN PVVYGKIKVQ SWKARRDFNI

51 VKQDLDFSCG AASVATLLNN FYGQTLTEEE VLKKLDKEQM RASFEDMRRI

101 MPDLGFEAKG YALSFEQLAQ LKIPVIVYLK YRKDDHFSVL RGIDGNTVLL

151 ADPSLGHVSM SRAQFLDAWQ TREGNLAGKI LAVIPKKAET ISNKLFFTQH

201 PKRQTEFTVG QIRQARAE*
```

Computer analysis of this amino acid sequence gave the following results:
Homology with a Predicted ORF from *N. gonorrhoeae*
ORF 952 shows 92.5% identity over a 201 aa overlap with a predicted ORF (ORF 952) from *N. gonorrhoeae*

```
    g952/m952;  92.5% identity in 201 aa overlap 10        20        30        40
       g952.pep           LSYRLNAAPMFNDNPVVYGKIKLQSWKARRDFNIVKQDLDFSCG
                          |||||||||||||||||||||:|||||||||||||||||||||
         m952   MMKFKYVFLLACVVVSLSYRLNAAPMFNDNPVVYGKIKVQSWKARRDFNIVKQDLDFSCG
                        10        20        30        40        50        60
```

```
                50         60         70         80         90        100
g952.pep   AASVATLLNNFYGQKLTEEEVLEKLGKEQMRASFEDMRRIMPDLGFEAKGYALSFEQLAQ
           ||||||||||||| |||||| :|| ||||||||||||||||||||||||||||||||||
m952       AASVATLLNNFYGQTLTEEEVLKKLDKEQMRASFEDMRRIMPDLGFEAKGYALSFEQLAQ
                70         80         90        100        110        120

110        120        130        140        150        160
g952.pep   LKIPVIVYLKYRKDDHFSVLRGVDGNTVLLADPSPGHVSMSRAQFLEAWQTREGNLAGKI
           |||||||||||||||||||||||:||||||||||| |||||||||||:||||||||||||
m952       LKIPVIVYLKYRKDDHFSVLRGIDGNTVLLADPSLGHVSMSRAQFLDAWQTREGNLAGKI
                130        140        150        160        170        180

170        180        190        200
g952.pep   LAVVPKKAEAISNKLFFTHHPKRQTEFAVGQVKWWRAYX
           |||:||||:||||||||||:|||||||:|||::  ||
m952       LAVIPKKAEAISNKLFFTQHPKRQTEFTVGQIRQARAE
                190        200        210
```

The following partial DNA sequence was identified in *N. meningitidis* <SEQ ID 2913>:

```
a952.seq
  1 ATGATGAAGT TCAAATATGT TTTTCTGTTG GCGTGTGTTG TCGTTTCTTT

51 ATCTTATCGT TTGAATGCTG CACCGATGTT TAACGATAAT CCTGTTGTTT

101 ACGGAAAAAT CAAAGTGCAG AGTTGGAAAG AAAGGCGGGA TTTCAATATT

151 GTAAAGCAGG ATTTGGATTT TCCTGCGGG GCGGCTTCGG TGGCGACGCT

201 TTTGAACAAT TTTTACGGGC AAACGCTGAC GGAAGAAGAA GTGTTGAAAA

251 AGCTGGATAA GGAGCAGATG CGCGCGTCGT TTGAGGATAT GCGGCGCATT

301 ATGCCAGATT TGGGTTTTGA AGCGAAAGGC TATGCCCTGT CTTTCGAGCA

351 GCTCGCACAG TTGAAAATCC CCGTCATCGT GTATCTGAAA TACCGCAAGG

401 ATGATCATTT CTCGGTATTG CGCGGGATAG ACGGCAATAC GGTTTTGCTT

451 GCCGACCCGT CGCTGGGTCA TGTTTCAATG AGCAGGCGC AGTTTTNGGA

501 TGCTTGGCAA ACCCGTGAGG GAAATTTGGC AGGTAAGATT TTGGCGGTCG

551 TGCCGAAAAA AGCCGAGACA ATTTCAAATA AATTGTTTTT CACACATCAT

601 CCCAAGCGGC AGACGGAGTT TGCAGTCGGA CAAATCAGGC AAGCACGTGC

651 AGAGTAA
```

This corresponds to the amino acid sequence <SEQ ID 2914; ORF 952.a>:

```
a952.pep
  1 MMKFKYVFLL ACVVVSLSYR LNAAPMFNDN PVVYGKIKVQ SWKERRDFNI

51 VKQDLDFSCG AASVATLLNN FYGQTLTEEE VLKKLDKEQM RASFEDMRRI

101 MPDLGFEAKG YALSFEQLAQ LKIPVIVYLK YRKDDHFSVL RGIDGNTVLL

151 ADPSLGHVSM SRAQFXDAWQ TREGNLAGKI LAVVPKKAET ISNKLFFTHH

201 PKRQTEFAVG QIRQARAE*
```

Computer analysis of this amino acid sequence gave the following results:
Homology with a Predicted ORF from N. meningitidis
ORF 952 shows 97.7% identity over a 218 aa overlap with a predicted ORF (ORF 952) from N. meningitidis

```
a952/m952    97.7% identity in 218 aa overlap 10        20        30        40        50        60
a952.pep    MMKFKYVFLLACVVVSLSYRLNAAPMFNDNPVVYGKIKVQSWKERRDFNIVKQDLDFSCG
            ||||||||||||||||||||||||||||||||||||||||| ||||||||||||||||||
m952        MMKFKYVFLLACVVVSLSYRLNAAPMFNDNPVVYGKIKVQSWKARRDFNIVKQDLDFSCG
                    10        20        30        40        50        60
                    70        80        90       100       110       120
a952.pep    AASVATLLNNFYGQTLTEEEVLKKLDLEQMRASFEDMRRIMPDLGFEAKGYALSFEQLAQ
            |||||||||||||||||||||||||| |||||||||||||||||||||||||||||||||
m952        AASVATLLNNFYGQTLTEEEVLKKLDKEQMRASFEDMRRIMPDLGFEAKGYALSFEQLAQ
                    70        80        90       100       110       120
                   130       140       150       160       170       180
a952.pep    LKIPVIVYLKYRKDDHFSVLRGIDGNTVLLADPSLGHVSMSRAQFXDAWQTREGNLAGKI
            ||||||||||||||||||||||||||||||||||||||||||||| ||||||||||||||
m952        LKIPVIVYLKYRKDDHFSVLRGIDGNTVLLADPSLGHVSMSRAQFLDAWQTREGNLAGKI
                   130       140       150       160       170       180
                   190       200       210       219
a952.pep    LAVVPKKAETISNKLFFTHHPKRQTEFAVGQIRQARAEX
            |||:||||||||||||||:|||||||:||||||||||
m952        LAVIPKKAETISNKLFFTQHPKRQTEFTVGQIRQARAE
                   190       200       210
```

The following partial DNA sequence was identified in N. gonorrhoeae <SEQ ID 2915>:

```
g953.seq
   1 ATGAAAAAAA TCATCTTCGC CGCGCTCGCA GCGGCAGCCG TCGGCACTGC

51 CTCCGCCACC TACAAAGTGG ACGAATATCA CGCCAACGTC CGTTTCGCCA

101 TCGACCACTT CAACACCAGC ACCAACGTCG GCGGTTTTTA CGGTCTGACC

151 GGTTCCGTCG AGTTCGATCA AGCAAAACGC GACGGCAAAA TCGACATCAC

201 CATTCCCGTC GCCAACCTGC AAAGCGGTTC GCAACCCTTC ACCGGCCACC

251 TGAAATCCGC CGACATCTTC GATGCCGCTC AATATCCGGA CATCCGCTTC

301 GTTTCCACCA AATTCAACTT CAACGGCAAA AAACTTGTTT CCGTTGACGG

351 CAACCTGACC ATGCGCGGCA AAACCGCCCC CGTCAAACTC AAAGCCGAAA

401 AATTCAACTG CTACCAAAGC CCGATGGCGG AAACCGAAGT TTGCGGCGGC

451 GACTTCAGCA CCACCATCGA CCGCACCAAA TGGGGCGTGG ACTACCTCGT

501 TAACGCCGGT ATGACCAAAA ACGTCCGCAT CGACATCCAA ATCGAAGCTG

551 CAAAACAATA A
```

This corresponds to the amino acid sequence <SEQ ID 2916; ORF 953.ng>:

```
g953.pep
   1 MKKIIFAALA AAAVGTASAT YKVDEYHANV RFAIDHFNTS TNVGGFYGLT

51 GSVEFDQAKR DGKIDITIPV ANLQSGSQPF TGHLKSADIF DAAQYPDIRF

101 VSTKFNFNGK KLVSVDGNLT MRGKTAPVKL KAEKFNCYQS PMAETEVCGG

151 DFSTTIDRTK WGVDYLVNAG MTKNVRIDIQ IEAAKQ*
```

The following partial DNA sequence was identified in *N. meningitidis* <SEQ ID 2917>:

```
m953.seq
    1 ATGAAAAAAA TCATCTTCGC CGCACTCGCA GCCGCCGCCA TCAGTACTGC

51 CTCCGCCGCC ACCTACAAAG TGGACGAATA TCACGCCAAC GCCCGTTTCG

101 CCATCGACCA TTTCAACACC AGCACCAACG TCGGCGGTTT TTACGGTCTG

151 ACCGGTTCCG TCGAGTTCGA CCAAGCAAAA CGCGACGGTA AAATCGACAT

201 CACCATCCCC ATTGCCAACC TGCAAAGCGG TTCGCAACAC TTTACCGACC

251 ACCTGAAATC AGCCGACATC TTCGATGCCG CCCAATATCC GGACATCCGC

301 TTTGTTTCCA CCAAATTCAA CTTCAACGGC AAAAAACTGG TTTCCGTTGA

351 CGGCAACCTG ACCATGCACG GCAAAACCGC CCCCGTCAAA CTCAAAGCCG

401 AAAAATTCAA CTGCTACCAA AGCCCGATGG AGAAAACCGA AGTTTGTGGC

451 GGCGACTTCA GCACCACCAT CGACCGCACC AAATGGGGCA TGGACTACCT

501 CGTTAACGTT GGTATGACCA AAAGCGTCCG CATCGACATC CAAATCGAGG

551 CAGCCAAACA ATAA
```

This corresponds to the amino acid sequence <SEQ ID 2918; ORF 953>:

```
m953.pep
    1 MKKIIFAALA AAAISTASAA TYKVDEYHAN ARFAIDHFNT STNVGGFYGL

51 TGSVEFDQAK RDGKIDITIP IANLQSGSQH FTDHLKSADI FDAAQYPDIR

101 FVSTKFNFNG KKLVSVDGNL TMHGKTAPVK LKAEKFNCYQ SPMEKTEVCG

151 GDFSTTIDRT KWGMDYLVNV GMTKSVRIDI QIEAAKQ*
```

Computer analysis of this amino acid sequence gave the following results:

Homology with a Predicted ORF from *N. gonorrhoeae*

ORF 953 shows 93.0% identity over a 187 aa overlap with a predicted ORF (ORF 953) from *N. gonorrhoeae*

```
m953/g953  93.0% identity in 187 aa overlap 10        20        30        40        50        60
m953.pep   MKKIIFAALAAAAISTASAATYKVDEYHANARFAIDHFNTSTNVGGFYGLTGSVEFDQAK
           ||||||||||||::|||| ||||||||||:||||||||||||||||||||||||||||||
g953       MKKIIFAALAAAAVGTASA-TYKVDEYHANVRFAIDHFNTSTNVGGFYGLTGSVEFDQAK
                    10         20        30        40        50

70        80        90       100       110       120
m953.pep   RDGKIDITIPIANLQSGSQHFTDHLKSADIFDAAQYPDIRFVSTKFNFNGKKLVSVDGNL
           ||||||||||:||||||||  || ||||||||||||||||||||||||||||||||||||
g953       RDGKIDITIPVANLQSGSQPFTGHLKSADIFDAAQYPDIRFVSTKFNFNGKKLVSVDGNL
          60        70        80        90       100       110

130       140       150       160       170       180
m953.pep   TMHGKTAPVKLKAEKFNCYQSPMEKTEVCGGDFSTTIDRTKWGMDYLVNVGMTKSVRIDI
           ||:|||||||||||||||||||| :||||||||||||||||||:|||||:||||:|||||
g953       TMRGKTAPVKLKAEKFNCYQSPMAETEVCGGDFSTTIDRTKWGVDYLVNAGMTKNVRIDI
         120       130       140       150       160       170 m953.pep   QIEAAKQX
           ||||||||
g953       QIEAAKQX
         180
```

The following partial DNA sequence was identified in *N. meningitidis* <SEQ ID 2919>:

```
a953.seq
   1 ATGAAAAAAA TCATCATCGC CGCGCTCGCA GCAGCCGCCA TCGGCACTGC

51 CTCCGCCGCC ACCTACAAAG TGGACGAATA TCACGCCAAC GCCCGTTTCT

101 CTATCGACCA TTTCAACACC AGCACCAACG TCGGCGGTTT TTACGGTCTG

151 ACCGGTTCCG TTGAGTTCGA CCAAGCAAAA CGCGACGGTA AAATCGACAT

201 CACCATCCCC GTTGCCAACC TGCAAAGCGG TTCGCAACAC TTTACCGACC

251 ACCTGAAATC AGCCGACATC TTCGATGCCG CCCAATATCC GGACATCCGC

301 TTTGTTTCCA CCAAATTCAA CTTCAACGGC AAAAAACTGG TTTCCGTTGA

351 CGGCAACCTG ACCATGCACG GCAAAACCGC CCCCGTCAAA CTCAAAGCCG

401 AAAAATTCAA CTGCTACCAA AGCCCGATGT TGAAAACCGA AGTTTGCGGC

451 GGCGACTTCA GCACCACCAT CGACCGCACC AAATGGGGCA TGGACTACCT

501 CGTTAACGTT GGTATGACCA AAAGCGTCCG CATCGACATC CAAATCGAGG

551 CAGCCAAACA ATAA
```

This corresponds to the amino acid sequence <SEQ ID 2920; ORF 953.a>:

```
a953.pep
   1 MKKIIIAALA AAAIGTASAA TYKVDEYHAN ARFSIDHFNT STNVGGFYGL

51 TGSVEFDQAK RDGKIDITIP VANLQSGSQH FTDHLKSADI FDAAQYPDIR

101 FVSTKFNFNG KKLVSVDGNL TMHGKTAPVK LKAEKFNCYQ SPMLKTEVCG

151 GDFSTTIDRT KWGMDYLVNV GMTKSVRIDI QIEAAKQ*
```

Computer analysis of this amino acid sequence gave the following results:

Homology with a Predicted ORF from *N. meningitidis*

ORF 953 shows 97.3% identity over a 187 aa overlap with a predicted ORF (ORF 953) from *N. meningitidis*

```
a953/m953 97.3% identity in 187 aa overlap 10        20        30        40        50        60
a953.pep   MKKIIIAALAAAAIGTASAATYKVDEYHANARFSIDHFNTSTNVGGFYGLTGSVEFDQAK
           |||||:||||||||:||||||||||||||||:||||||||||||||||||||||||||||
m953       MKKIIFAALAAAAISTASAATYKVDEYHANARFAIDHFNTSTNVGGFYGLTGSVEFDQAK
                    10        20        30        40        50        60

70        80        90       100       110       120
a953.pep   RDGKIDITIPVANLQSGSQHFTDHLKSADIFDAAQYPDIRFVSTKFNFNGKKLVSVDGNL
           ||||||||||:|||||||||||||||||||||||||||||||||||||||||||||||||
m953       RDGKIDITIPIANLQSGSQHFTDHLKSADIFDAAQYPDIRFVSTKFNFNGKKLVSVDGNL
                    70        80        90       100       110       120

130       140       150       160       170       180
a953.pep   TMHGKTAPVKLKAEKFNCYQSPMLKTEVCGGDFSTTIDRTKWGMDYLVNVGMTKSVRIDI
           ||||||||||||||||||||| ||||||||||||||||||||||||||||||||||||||
m953       TMHGKTAPVKLKAEKFNCYQSPMEKTEVCGGDFSTTIDRTKWGVDYLVNVGMTKSVRIDI
                   130       140       150       160       170       180 a953.pep   QIEAAKQX
           ||||||||
m953       QIEAAKQX
``` g954.seq not found yet g954.pep not found yet

The following partial DNA sequence was identified in *N. meningitidis* <SEQ ID 2921>:

```
m954.seq
   1 ATGAAAAAGT TTTATTTTGT GCTGCTGGCG TTGGGTTTGG CAGCGTGTGG

51 GCAAGAACAA TCGCAGAAAG CTGATGCGGA GCAGTATTTT TTTGCCAATA

101 AATATCAATT TGCAGATGAG AAACAGGCTT TTTATTTTGA ACGCGCCGCC

151 CGTTTCCGTG TATTGCAACA AGGCCTTGGC GGGGATTTTG AGAGGTTTTT

201 AAAAGGAGAA ATACCTAATC AAGAAAATCT TGCAAAGTAT CGTGAAAATA

251 TTACTCAAGC AGTCGCTTAT TATGCGGACA CGAATGGAGA TGATGACCCA

301 TACCGCGTCT GCAAACAGGC TGCGCAAGAT GCAGAAATCC TGATGAAGAG

351 TATGGTAACA AGCGGTGGAG GCGGTACAAC TGATTTAGAT AAGGAAAGTT

401 ATCAAAATTA CCGAAAATCA ATGCAAGAAT GCCGTAAAAC AATAACGGAA

451 GCTGAAGCCA ATTTGCCGAA AAAATAA
```

This corresponds to the amino acid sequence <SEQ ID 2922; ORF 954>:

```
m954.pep
   1 MKKFYFVLLA LGLAACGQEQ SQKADAEQYF FANKYQFADE KQAFYFERAA

51 RFRVLQQGLG GDFERFLKGE IPNQENLAKY RENITQAVAY YADTNGDDDP

101 YRVCKQAAQD AEILMKSMVT SGGGGTTDLD KESYQNYRKS MQECRKTITE

151 AEANLPKK* a954.seq not found yet
a954.pep not found yet
```

The following partial DNA sequence was identified in *N. gonorrhoeae* <SEQ ID 2923>:

```
g957.seq (partial)
   1 ATGTTTAAAA AATTCAAACC GGTACTGTTG TCATTTTTTG CACTTGTATT

51 TGCCTTTTGG CTGGGAACAG GTATTGCCTA TGAGATTAAT CCGCGTTGGT

101 TTTTGAGCGA TACGGCAACT GAAGTACCTG AAAATCCGAA TGCTTTTGTG

151 GCGAAACTTG CCCGCCTGTT CCGAAATGCC GACAGGGCGG TTGTCATCGT

201 GAAGGAATCG ATGAGGACGG AGGAAAGCCT TGCCGGAGCT GTGGATGACG

251 GTCCGTTGCA GTCGGAGAAG GATTATCTCG CGCTCGCTAT CCGGCTCAGT

301 CGTTTGAAAG AAAAGGCGAA ATGGTTTCAC GTAACGGAGC AGGAACATGG

351 GGAAGAGGTT TGGCTGGATT ACTATATCGG CGAGGGCGGT TTGGTTGCGG

401 TTTCGCTTTC GCAACGCTCG CCGGAAGCGT TTGTTAATGC CGAATATCTG

451 TATCGGAACG ATCGTCCGTT TTCTGTAAAT GTGTACGGCG GAACGGCTCA

501 CGGGGAAAAT TATGAAACGA CAGGAGAATA TCGGGTTGTT TGGCAACCGG

551 ACGGTTCGGT ATTTGATGCG GCGGGGCGCG GGAAAATCGG GGAAGATGTT

601 TATGAGCATT GCCTCGGGTG TTATCAGATG GCCCAGGTAT ATTTGGCGAA

651 ATACCGGGAT GTCGCGAATG ACGAGCAGAA GGTTTGGGAC TTCCGCGAAG

701 AGAGCAACCG GATTGCATCG GACTCGCGCG ATTATGTGTT TTATCAGAAT

751 ATGCGGGAAT TGATGCCCCG GGGGatgaaG gcgaacagtc ttgtggtcgg 801 ctatgatgcg gacggtCtgc CgcaAAAagt ctattggagt gtcgacaatg
```

-continued

```
851 gaaaaaaacc ccaaagtgtc gaatattatt tgaaaaacgg aaatcttttt 901 attgcccaat cttcgacggt aaccttgaaa acggatggcg taacggcgga 951 tatgcaaacc tatcatgcgc aacaaacgtt gtatttggat
    ggg...
```

This corresponds to the amino acid sequence <SEQ ID 2924; ORF 957.ng>:

```
g957.pep (partial)
  1 MFKKFKPVLL SFFALVFAFW LGTGIAYEIN PRWFLSDTAT EVPENPNAFV

51 AKLARLFRNA DRAVVIVKES MRTEESLAGA VDDGPLQSEK DYLALAIRLS

101 RLKEKAKWFH VTEQEHGEEV WLDYYIGEGG LVAVSLSQRS PEAFVNAEYL

151 YRNDRPFSVN VYGGTAHGEN YETTGEYRVV WQPDGSVFDA AGRGKIGEDV

201 YEHCLGCYQM AQVYLAKYRD VANDEQKVWD FREESNRIAS DSRDYVFYQN

251 MRELMPRGMK ANSLVVGYDA DGLPQKVYWS VDNGKKPQSV EYYLKNGNLF

301 IAQSSTVTLK TDGVTADMQT YHAQQTLYLD G...
```

The following partial DNA sequence was identified in *N. meningitidis* <SEQ ID 2925>:

```
m957.seq
   1 ATGTTTAAAA AATTCAAACC GGTACTGTTG TCATTTTTTG CACTTGTATT

51 TGCCTTTTGG CTGGGAACGG GTATTGCCTA TGAGATTAAT CCGCGTTGGT

101 TTTTGAGCGA TACGGCAACT GAAGTACCTA AAAATCCGAA TGCTTTTGTG

151 GCGAAACTTG CCCGCCTGTT CCGAAATGCC GACAGGGCGG TTGTCATCGT

201 GAAGGAATCG ATAAGGACGG AGGAAAATCT TGCCGGAACT GTGGATGACG

251 GTCCGTTGCA GTCGGAGAAG GATTATCTCG CGCTCGCTAT CCGGCTCAGT

301 CGTTTGAAAG AAAAGGCGAA ATGGTTTCAC GTAACGGAGC AGGAACATGG

351 GAAAGAGGTT TGGCTGGATT ACCATATCGG CGAGGGCGGT TTGGTTGCGG

401 TTTCGCTTTC GCAACGCTCG CCGGAAGCAT TTGTTAATGC CGAATATCTG

451 TATCGGAACG ATCGTCCGTT TTCTGTAAAT GTGTACGGCG GAACGGTTCA

501 CGGGGAAAAT TATGAAACGA CAGGAGAATA TCGGGTTGTT TGGCAACCAG

551 ACGGTTCGGT ATTTGATGCG GCGGGGCGCG GGAAAATCGG GGAAGATGTT

601 TATGAGCATT GCCTCGGGTG TTATCAGATG GCCCAGGTAT ATTTGGCGAA

651 ATACCGGGAT GTCGCGAATG ACGAGCAGAA GGTTTGGGAC TTCCGCAAAG

701 AGAGCAACCG AATTGCGTCG GACTCGCGCA ATTCTGTGTT TTATCAGAAT

751 ATGCGGGAAT TGATGCCCCG AGGGATGAAG GCGAACAGTC TTGTGGTCGG

801 CTATGATGCG GACGGTCTGC CGCAAAAAGT CTATTGGAGT TTCGACAATG

851 GAAAAAAACG CCAGAGTTTC GAATATTATT TGAAAAACGG AAATCTTTTT

901 ATTGCACAAT CTTCGACGGT AGCATTGAAA GCGGATGGCG TAACGGCGGA

951 TATGCAGACC TATCATGCGC AACAGACGTG GTATTTGGAT GGCGGGCGGA

1001 TTGTCCGCGA AGAGAAACAG GGAGACAGAC TGCCTGATTT TCCTTTGAAC

1051 TTGGAAAATT TGGAAAAAGA GGTGCGCCGT TATGCAGAGG CTGCGGCGAG

1101 ACGTTCGGGC GGCAGGCGCG ACCTTTCTCA CTGA
```

This corresponds to the amino acid sequence <SEQ ID 2926; ORF 957>:

```
m957.pep
   1 MFKKFKPVLL SFFALVFAFW LGTGIAYEIN PRWFLSDTAT EVPKNPNAFV

51 AKLARLFRNA DRAVVIVKES IRTEENLAGT VDDGPLQSEK DYLALAIRLS

101 RLKEKAKWFH VTEQEHGKEV WLDYHIGEGG LVAVSLSQRS PEAFVNAEYL

151 YRNDRPFSVN VYGGTVHGEN YETTGEYRVV WQPDGSVFDA AGRGKIGEDV

201 YEHCLGCYQM AQVYLAKYRD VANDEQKVWD FRKESNRIAS DSRNSVFYQN

251 MRELMPRGMK ANSLVVGYDA DGLPQKVYWS FDNGKKRQSF EYYLKNGNLF

301 IAQSSTVALK ADGVTADMQT YHAQQTWYLD GGRIVREEKQ GDRLPDFPLN

351 LENLEKEVRR YAEAAARRSG GRRDLSH*
```

Computer analysis of this amino acid sequence gave the following results:

Homology with a Predicted ORF from *N. gonorrhoeae*

ORF 957 shows 95.2% identity over a 331 aa overlap with a predicted ORF (ORF 957) from *N. gonorrhoeae*

```
    g957/m957  95.2% identity in 331 aa overlap 10         20         30         40         50         60
       g957.pep  MFKKFKPVLLSFFALVFAFWLGTGIAYEINPRWFLSDTATEVPENPNAFVAKLARLFRNA
                 ||||||||||||||||||||||||||||||||||||||||:|||||||||||||||||||
       m957      MFKKFKPVLLSFFALVFAFWLGTGIAYEINPRWFLSDTATEVPKNPNAFVAKLARLFRNA
                  10         20         30         40         50         60

70         80         90        100        110        120
       g957.pep  DRAVVIVKESMRTEESLAGAVDDGPLQSEKDYLALAIRLSRLKEKAKWFHVTEQEHGEEV
                 |||||||||||:||||:|||:|||||||||||||||||||||||||||||||||||||:||
       m957      DRAVVIVKESIRTEENLAGTVDDGPLQSEKDYLALAIRLSRLKEKAKWFHVTEQEHGKEV
                  70         80         90        100        110        120

130        140        150        160        170        180
       g957.pep  WLDYYIGEGGLVAVSLSQRSPEAFVNAEYLYRNDRPFSVNVYGGTAHGENYETTGEYRVV
                 ||||:||||||||||||||||||||||||||||||||||||||||:|||||||||||||
       m957      WLDYHIGEGGLVAVSLSQRSPEAFVNAEYLYRNDRPFSVNVYGGTVHGENYETTGEYRVV
                 130        140        150        160        170        180

190        200        210        220        230        240
       g957.pep  WQPDGSVFDAAGRGKIGEDVYEHCLGCYQMAQVYLAKYRDVANDEQKVWDFREESNRIAS
                 |||||||||||||||||||||||||||||||||||||||||||||||||:||||||
       m957      WQPDGSVFDAAGRGKIGEDVYEHCLGCYQMAQVYLAKYRDVANDEQKVWDFRKESNRIAS
                 190        200        210        220        230        240

250        260        270        280        290        300
       g957.pep  DSRDYVFYQNMRELMPRGMKANSLVVGYDADGLPQKVYWSVDNGKKPQSVEYYLKNGNLF
                 |||:||||||||||||||||||||||||||||||||||||||:||||:|:|:|||||||
       m957      DSRNSVFYQNMRELMPRGMKANSLVVGYDADGLPQKVYWSFDNGKKRQSFEYYLKNGNLF
                 250        260        270        280        290        300

310        320        330
       g957.pep  IAQSSTVTLKTDGVTADMQTYHAQQTLYLDG
                 |||||||:||:|||||||||||||||:||||
       m957      IAQSSTVALKADGVTADMQTYHAQQTWYLDGGRIVREEKQGDRLPDFPLNLENLEKEVRR
                 310        320        330        340        350        360 m957      YAEAAARRSGGRRDLSHX
                 370
```

The following partial DNA sequence was identified in *N. meningitidis* <SEQ ID 2927>:

```
a957.seq
   1 ATGTTTAAAA AATTCAAACC GGTACTGTTG TCATTTTTTG CACTTGTATT

51 TGCCTTTTGG CTGGGAACGG GTATTGCCTA TGAGATTAAT CCGCGTTGGT

101 TTTTGAGCGA TACGGCAACT GAAAATCCGA ATGCTTTTGT GGCGAAACTT

151 GCCCGCCTGT TCCGAAATGC CGACAGGGCG GTTGTCATCG TGAAGGAATC

201 GATGAGGACG GAGGAAAGTC TTGCCGGAGC TGTGGATGAC GGTCCGTTGC
```

-continued

```
 251 AGTCGGAGAA GGATTATCTT GCACTCGCTG TCCGGCTCAG TCGTTTGAAA

301 GAAAAGGCGA AATGGTTTCA CGTAACGGAG CAGGAACATG GGGAAGAGGT

351 TTGGCTGGAT TACTATATCG GCGAGGGCGG TTTGGTTGCG GTTTCGCTTT

401 CGCAACGCTC GCCGGAAGCG TTTGTTAATG CCGAATATCT GTATCGGAAC

451 GATCGTCCGT TTTCTGTAAA TGTGTACGGC GGAACGGTTC ACGGGGAAAA

501 TTATGAAACG ACAGGAGAAT ATCGGGTTGT TTGGCAACCG GACGGTTCGG

551 TATTTGATGC GTCGGGGCGC GGGAAAATCG GGGAAGATGT TTATGAGCAT

601 TGCCTCGGGT GTTATCAGAT GGCCCAGGTA TATTTGGCGA AATATCGGGA

651 TGTCGCGAAT GATGAGCAGA AGGTTTGGGA CTTCCGCGAA GAGAGTAACC

701 GGATTGCGTC GGACTCGCGC GATTCTGTGT TTTATCAGAA TATGCGGGAA

751 TTGATGCCCC GAGGGATGAA GGCAAACAGT CTTGTGGTCG GCTATGATGC

801 GGACGGTCTG CCGCAGAAAG TCTATTGGAG TTTCGACAAT GGGAAAAAAC

851 GCCAGAGTTT CGAATATTAT TTGAAAAACG GAAATCTTTT TATTGCACAA

901 TCTTCGACGG TAGCATTGAA AGCGGATGGC GTAACGGCGG ATATGCAGAC

951 CTATCATGCG CAACAGACGT GGTATTTAGA TGGCGGGCGG ATTGTCCGCG

1001 AAGAGAAACA GGGGGACAGA CTGCCTGATT TTCCTTTGAA CTTGGAAGAT

1051 TTGGAAAAAG AGGTGAGCCG TTATGCAGAG GCTGCGGCGA GACGTTCGGG

1101 CGGCAGGCGC GACCTTTCTC ACTGA
```

This corresponds to the amino acid sequence <SEQ ID 2928; ORF 957.a>:

```
a957.pep
  1 MFKKFKPVLL SFFALVFAFW LGTGIAYEIN PRWFLSDTAT ENPNAFVAKL

51 ARLFRNADRA VVIVKESMRT EESLAGAVDD GPLQSEKDYL ALAVRLSRLK

101 EKAKWFHVTE QEHGEEVWLD YYIGEGGLVA VSLSQRSPEA FVNAEYLYRN

151 DRPFSVNVYG GTVHGENYET TGEYRVVWQP DGSVFDASGR GKIGEDVYEH

201 CLGCYQMAQV YLAKYRDVAN DEQKVWDFRE ESNRIASDSR DSVFYQNMRE

251 LMPRGMKANS LVVGYDADGL PQKVYWSFDN GKKRQSFEYY LKNGNLFIAQ

301 SSTVALKADG VTADMQTYHA QQTWYLDGGR IVREEKQGDR LPDFPLNLED

351 LEKEVSRYAE AAARRSGGRR DLSH*
```

Computer analysis of this amino acid sequence gave the following results:
Homology with a Predicted ORF from *N. meningitidis*
ORF 957 shows 96.3% identity over a 377 aa overlap with a predicted ORF (ORF 957) from *N. meningitidis*

```
    a957/m957  96.3% identity in 377 aa overlap 10         20         30         40         50
    a957.pep   MFKKFKPVLLSFFALVFAFWLGTGIAYEINPRWFLSDTATE---NPNAFVAKLARLFRNA
               ||||||||||||||||||||||||||||||||||||||||   |||||||||||||||||
    m957       MFKKFKPVLLSFFALVFAFWLGTGIAYEINPRWFLSDTATEVPKNPNAFVAKLARLFRNA
                    10         20         30         40         50         60

60         70         80         90        100        110
    a957.pep   DRAVVIVKESMRTEESLAGAVDDGPLQSEKDYLALAVRLSRLKEKAKWFHVTEQEHGEEV
               |||||||||||:||||:|||:|||||||||||||||:|||||||||||||||||||||:||
    m957       DRAVVIVKESIRTEENLAGTVDDGPLQSEKDYLALAIRLSRLKEKAKWFHVTEQEHGKEV
                    70         80         90        100        110        120
```

```
             120       130       140       150       160       170
a957.pep WLDYYIGEGGLVAVSLSQRSPEAFVNAEYLYRNDRPFSVNVYGGTVHGENYETTGEYRVV
         ||||:|||||||||||||||||||||||||||||||||||||||||||||||||||||||
m957     WLDYHIGEGGLVAVSLSQRSPEAFVNAEYLYRNDRPFSVNVYGGTVHGENYETTGEYRVV
             130       140       150       160       170       180

180       190       200       210       220       230
a957.pep WQPDGSVFDASGRGKIGEDVYEHCLGCYQMAQVYLAKYRDVANDEQKVWDFREESNRIAS
         ||||||||||:|||||||||||||||||||||||||||||||||||||||||||:||||||
m957     WQPDGSVFDAAGRGKIGEDVYEHCLGCYQMAQVYLAKYRDVANDEQKVWDFRKESNRIAS
             190       200       210       220       230       240

240       250       260       270       280       290
a957.pep DSRDSVFYQNMRELMPRGMKANSLVVGYDADGLPQKVYWSFDNGKKRQSFEYYLKNGNLF
         |||:||||||||||||||||||||||||||||||||||||||||||||||||||||||||
m957     DSRNSVFYQNMRELMPRGMKANSLVVGYDADGLPQKVYWSFDNGKKRQSFEYYLKNGNLF
             250       260       270       280       290       300

300       310       320       330       340       350
a957.pep IAQSSTVALKADGVTADMQTYHAQQTWYLDGGRIVREEKQGDRLPDFPLNLEDLEKEVSR
         |||||||||||||||||||||||||||||||||||||||||||||||||||:||||| |
m957     IAQSSTVALKADGVTADMQTYHAQQTWYLDGGRIVREEKQGDRLPDFPLNLENLEKEVRR
             310       320       330       340       350       360

360       370
a957.pep YAEAAARRSGGRRDLSHX
         ||||||||||||||||||
m957     YAEAAARRSGGRRDLSHX
             370
```

The following partial DNA sequence was identified in *N. gonorrhoeae* <SEQ ID 2929>:

```
g958.seq
   1 TTGGCTCGTT TATTTTCACT CAAACCACTG GTGCTGGCAT TGGGCTTCTG

51 TTTCGGCACG CATTGCGCCG CCGATACCGT TGCGGCGGAA GAGGCGGACG

101 GGCGTGTCGC AGAAGGCGGT GCGCAGGGCG CGTCCGAATC CGCACAAGCT

151 TCCGATTTGA CCCTCGGTTC GACCTGCCTG TTTTGCAGTA ACGAAAGCGG

201 CAGCCCCGAG AGAACCGAAG CCGCCGTCCA AGGCAGCGGC GAAGCATCCG

251 TCCCCGAAGA CTATACGCGC ATTGTTGCCG ACAGGATGGA AGGACAGTCG

301 AAGGTTAAGG TGCGCGCGGA AGGAAGCGTT ATCATCGAAC GGGACGGCGC

351 AGTCCTCAAT ACCGATTGGG CGGATTACGA CCAGTCGGGC GACACCGTTA

401 CCGTAGGCGA CCGGTTCGCC CTCCAACAGG ACGGTACGCT GATTCGGGGC

451 GAAACCCTGA CCTACAATCT CGATCAGCAG ACCGGCGAAG CGCACAACGT

501 CCGTATGGAA ACCGAACAAG GCGGACGGCG GCTGCAAAGC GTCAGCCGCA

551 CCGCCGAAAT GTTGGGCGAA GGGCGTTACA AACTGACGGA AACCCAATTC

601 AACACCTGTT CCGCCGGAGA TGCCGGCTGG TATGTCAAGG CCGCCTCTGT

651 CGAAGCCGAT CGGGGAAAAG GCATAGGCGT TGCCAAACAC GCCGCCTTCG

701 TGTTCGGCGG CGTTCCCCTT TTCTATACGC CTTGGGCGGA CTTCCCGCTT

751 GACGGCAACC GCAAAAGCGG ACTGCTCGTC CCGTCCGTAT CTGCCGGTTC

801 GGACGGCGTT TCCCTTTCCG TCCCCTATTA TTTCAACCTT GCCCCCAACT

851 TCGATGCCAC TTTCGCCCCC GGCATTATCG GCGAACGCGG CGCGACGTTT

901 GACGGACAAA TCCGTTACCT GCGTCCCGAT TACAGCGGAC AGACCGACCT

951 GACCTGGTTG CCGCACGATA AGAAAAGCGG CAGGAACAAC CGCTATCAGG

1001 CAAAATGGCA GCACCGGCAC GACATTTCCG ACACGCTTCA GGCGGGTGTC

1051 GATTTCAACC AAGTCTCCGA CAGCGGCTAC TACCGCGACT TTTACGGCGG

1101 CGAAGAAATC GCCGGCAACG TCAACCTCAA CCGCCGCGTA TGGCTGGATT

1151 ATGGCGGCAG GGCGGCGGGA GGCAGCCTGA ATGCCGGCCT TTCGGTTCAG
```

-continued

```
1201 AAATACCAGA CGCTGGCAAA CCAAAGCGGC TACAAAGACG AACCTTACGC

1251 CATCATGCCC CGCCTTTCTG CCGATTGGCA TAAAAACGCA GGCAGGGCGC

1301 AAATCGGCGT GTCCGCACAA TTTACCCGCT TCAGCCACGA CGGCCGCCAA

1351 GACGGCAGCC GACTGGTCGT GTATCCCGGT ATCAAATGGG ATTTCAGCAA

1401 CAGCTGGGGC TACGTCCGCC CCAAACTCGG GCTGCACGCC ACTTATTACA

1451 GCCTCGACAG TTTCGGCGGC AAAGCATCCC GCAGCGTCGG GCGCGTTTTG

1501 CCCGTTGTCA ATATCGACGG CGGCACAACC TTCGAACGCA ATACGCGCCT

1551 GTTCGGCGGC GGAGTCGTGC AAACCATCGA GCCGCGCCTG TTCTACAACT

1601 ATATTCCTGC CAAATCTCAA AACGACCTGC CCAATTTCGA TTCGTCGGAA

1651 AGCAGCTTCG GCTACGGGCA GCTTTTCCGC GAAAACCTCT ATTACGGCAA

1701 CGACCGCATC AACGCCGCCA ACAGCCTTTC CACCGCCGTG CAGAGCCGTA

1751 TTTTGGACGG CGCGACGGGG GAGGAGCGTT TCCGCGCCGG TATCGGTCAG

1801 AAATTCTATT TCAAGGATGA TGCGGTGATG CTTGACGGCA GCGTCGGCAA

1851 AAATCCGCGC AGCCGTTCCG ACTGGGTGGC ATTCGCCTCC GGCGGCATAG

1901 GCGGGCGTTT CACCCTCGAC AGCAGCATCC ACTACAACCA AAACGACAAA

1951 CGCGCCGAAC ATTACGCCGT CGGCGCAGGC TACCGCCCCG CCCCCGGAAA

2001 AGTGTTGAAC GCCCGCTACA AATACGGGCG CAACGAAAAA ATCTACCTGC

2051 AGGCGGACGG TTCCTATTTT TACGACAAAC TCAGCCAGCT CGACCTGTCC

2101 GCACAATGGC CGCTGACGCG CAACCTGTCT GCCGTCGTCC GCTACAACTA

2151 CGGTTTTGAA GCCAAAAAAC CGATAGAAAT GCTTGCCGGT GCAGAATACA

2201 AAAGCAGTTG CGGCTGCTGG GGCGCGGGCG TGTACGCCCA ACGCTACGTT

2251 ACCGGCGAAA ACACCTACAA AAACGCCGTC TTTTTTTCAC TTCAGTTGAA

2301 AGACCTCAGC AGCGTCGGCA GAAACCCCGC AGGCAGGATG GATGTCGCCG

2351 TTCCCGGCTA CATCCCCGCC CACTCTCTTT CCGCCGGACG CAACAAACGG

2401 CCCTGA
```

This corresponds to the amino acid sequence <SEQ ID 2930; ORF 958.ng>:

```
g958.pep
  1 LARLFSLKPL VLALGFCFGT HCAADTVAAE EADGRVAEGG AQGASESAQA

51 SDLTLGSTCL FCSNESGSPE RTEAAVQGSG EASVPEDYTR IVADRMEGQS

101 KVKVRAEGSV IIERDGAVLN TDWADYDQSG DTVTVGDRFA LQQDGTLIRG

151 ETLTYNLDQQ TGEAHNVRME TEQGGRRLQS VSRTAEMLGE GRYKLTETQF

201 NTCSAGDAGW YVKAASVEAD RGKGIGVAKH AAFVFGGVPL FYTPWADFPL

251 DGNRKSGLLV PSVSAGSDGV SLSVPYYFNL APNFDATFAP GIIGERGATF

301 DGQIRYLRPD YSGQTDLTWL PHDKKSGRNN RYQAKWQHRH DISDTLQAGV

351 DFNQVSDSGY YRDFYGGEEI AGNVNLNRRV WLDYGGRAAG GSLNAGLSVQ

401 KYQTLANQSG YKDEPYAIMP RLSADWHKNA GRAQIGVSAQ FTRFSHDGRQ

451 DGSRLVVYPG IKWDFSNSWG YVRPKLGLHA TYYSLDSFGG KASRSVGRVL

501 PVVNIDGGTT FERNTRLFGG GVVQTIEPRL FYNYIPAKSQ NDLPNFDSSE

551 SSFGYGQLFR ENLYYGNDRI NAANSLSTAV QSRILDGATG EERFRAGIGQ
```

-continued

```
601 KFYFKDDAVM LDGSVGKNPR SRSDWVAFAS GGIGGRFTLD SSIHYNQNDK

651 RAEHYAVGAG YRPAPGKVLN ARYKYGRNEK IYLQADGSYF YDKLSQLDLS

701 AQWPLTRNLS AVVRYNYGFE AKKPIEMLAG AEYKSSCGCW GAGVYAQRYV

751 TGENTYKNAV FFSLQLKDLS SVGRNPAGRM DVAVPGYIPA HSLSAGRNKR

801 P*
```

The following partial DNA sequence was identified in *N. meningitidis* <SEQ ID 2931>:

```
m958.seq
   1 TTGGCTCGTT TATTTTCACT CAAACCACTG GTGCTGGCAT TGGGCCTCTG

51 CTTCGGCACG CATTGCGCCG CCGCCGATGC CGTTGCGGCG GAGGAAACGG

101 ACAATCCGAC CGCCGGAGAA AGCGTTCGGA GCGTGTCCGA ACCCATACAG

151 CCTACCAGCC TGAGCCTCGG TTCGACCTGC CTGTTTTGCA GTAACGAAAG

201 CGGCAGCCCC GAGAGAACCG AAGCCGCCGT CCAAGGCAGC GGCGAAGCAT

251 CCATCCCCGA AGACTATACG CGCATTGTTG CCGACAGGAT GGAAGGACAG

301 TCGCAGGTGC AGGTGCGTGC CGAAGGCAAC GTCGTCGTCG AACGCAACCG

351 GACGACCCTC AATACCGATT GGGCGGATTA CGACCAGTCG GGCGACACCG

401 TTACCGCAGG CGACCGGTTC GCCCTCCAAC AGGACGGTAC GCTGATTCGG

451 GGCGAAACCC TGACCTACAA TCTCGAGCAG CAGACCGGGG AAGCGCACAA

501 CGTCCGCATG GAAATCGAAC AAGGCGGACG GCGGCTGCAA AGCGTCAGCC

551 GCACCGCCGA AATGTTGGGC GAAGGGCATT ACAAACTGAC GGAAACCCAA

601 TTCAACACCT GTTCCGCCGG CGATGCCGGC TGGTATGTCA AGGCAGCCTC

651 TGTCGAAGCC GATCGGGAAA AAGGCATAGG CGTTGCCAAA CACGCCGCCT

701 TCGTGTTCGG CGGCGTTCCC ATTTTCTACA CCCCTTGGGC GGACTTCCCG

751 CTTGACGGCA ACCGCAAAAG CGGCCTGCTT GTTCCCTCAC TGTCCGCCGG

801 TTCGGACGGC GTTTCCCTTT CCGTTCCCTA TTATTTCAAC CTTGCCCCCA

851 ATCTCGATGC CACGTTCGCG CCCAGCGTGA TCGGCGAACG CGGCGCGGTC

901 TTTGACGGGC AGGTACGCTA CCTGCGGCCG GATTATGCCG GCCAGTCCGA

951 CCTGACCTGG CTGCCGCACG ACAAGAAAAG CGGCAGGAAT AACCGCTATC

1001 AGGCGAAATG GCAGCATCGG CACGACATTT CCGACACGCT TCAGGCGGGT

1051 GTCGATTTCA ACCAAGTCTC CGACAGCGGC TACTACCGCG ACTTTTACGG

1101 CAACAAAGAA ATCGCCGGCA ACGTCAACCT CAACCGCCGT GTATGGCTGG

1151 ATTATGGCGG CAGGGCGGCG GGCGGCAGCC TGAATGCCGG CCTTTCGGTT

1201 CTGAAATACC AGACGCTGGC AAACCAAAGC GGCTACAAAG ACAAACCGTA

1251 TGCCCTCATG CCGCGCCTTT CGGTCGAGTG GCGTAAAAAC ACCGGCAGGG

1301 CGCAAATCGG CGTGTCCGCA CAATTTACCC GATTCAGCCA CGACAGCCGC

1351 CAAGACGGCA GCCGCCTGGT CGTCTATCCC GACATCAAAT GGGATTTCAG

1401 CAACAGCTGG GGCTATGTCC GTCCCAAACT CGGACTGCAC GCCACCTATT

1451 ACAGCCTCAA CCGCTTCGGC AGCCAAGAAG CCCGACGCGT CAGCCGCACT

1501 CTGCCCATTG TCAACATCGA CAGCGGCGCA ACTTTTGAGC GGAATACGCG

1551 GATGTTCGGC GGAGAAGTCC TGCAAACCCT CGAGCCGCGC CTGTTCTACA
```

-continued

```
1601 ACTATATTCC TGCCAAATCC CAAAACGACC TGCCCAATTT CGATTCGTCG

1651 GAAAGCAGCT TCGGCTACGG GCAGCTCTTT CGCGAAAACC TCTATTACGG

1701 CAACGACAGG ATTAACACCG CAAACAGCCT TTCCGCCGCC GTGCAAAGCC

1751 GTATTTTGGA CGGCGCGACG GGGGAAGAGC GTTTCCGCGC CGGCATCGGT

1801 CAGAAATTCT ATTTCAAGGA TGATGCGGTG ATGCTTGACG GCAGCGTCGG

1851 CAAAAAACCG CGCAACCGTT CCGACTGGGT GGCATTTGCC TCCGGCAGCA

1901 TCGGCAGCCG CTTCATCCTC GACAGCAGCA TCCACTACAA CCAAAACGAC

1951 AAACGCGCCG AGAACTACGC CGTCGGTGCA AGCTACCGTC CCGCACAGGG

2001 CAAAGTGCTG AACGCCCGCT ACAAATACGG GCGCAACGAA AAAATCTACC

2051 TGAAGTCCGA CGGTTCCTAT TTTTACGACA AACTCAGCCA GCTCGACCTG

2101 TCCGCACAAT GGCCGCTGAC GCGCAACCTG TCGGCCGTCG TCCGTTACAA

2151 CTACGGTTTT GAAGCCAAAA AACCGATAGA GGTGCTGGCG GGTGCGGAAT

2201 ACAAAAGCAG TTGCGGCTGC TGGGGCGCGG GCGTGTACGC CCAACGCTAC

2251 GTTACCGGCG AAAACACCTA CAAAAACGCT GTCTTTTTCT CACTTCAGTT

2301 GAAAGACCTC AGCAGTGTCG GCAGAAACCC CGCAGACAGG ATGGATGTCG

2351 CCGTTCCCGG CTATATCACC GCCCACTCTC TTTCCGCCGG ACGCAACAAA

2401 CGACCCTGA
```

This corresponds to the amino acid sequence <SEQ ID 2932; ORF 958>:

```
m958.pep
  1 LARLFSLKPL VLALGLCFGT HCAAADAVAA EETDNPTAGE SVRSVSEPIQ

51 PTSLSLGSTC LFCSNESGSP ERTEAAVQGS GEASIPEDYT RIVADRMEGQ

101 SQVQVRAEGN VVVERNRTTL NTDWADYDQS GDTVTAGDRF ALQQDGTLIR

151 GETLTYNLEQ QTGEAHNVRM EIEQGGRRLQ SVSRTAEMLG EGHYKLTETQ

201 FNTCSAGDAG WYVKAASVEA DREKGIGVAK HAAFVFGGVP IFYTPWADFP

251 LDGNRKSGLL VPSLSAGSDG VSLSVPYYFN LAPNLDATFA PSVIGERGAV

301 FDGQVRYLRP DYAGQSDLTW LPHDKKSGRN NRYQAKWQHR HDISDTLQAG

351 VDFNQVSDSG YYRDFYGNKE IAGNVNLNRR VWLDYGGRAA GGSLNAGLSV

401 LKYQTLANQS GYKDKPYALM PRLSVEWRKN TGRAQIGVSA QFTRFSHDSR

451 QDGSRLVVYP DIKWDFSNSW GYVRPKLGLH ATYYSLNRFG SQEARRVSRT

501 LPIVNIDSGA TFERNTRMFG GEVLQTLEPR LFYNYIPAKS QNDLPNFDSS

551 ESSFGYGQLF RENLYYGNDR INTANSLSAA VQSRILDGAT GEERFRAGIG

601 QKFYFKDDAV MLDGSVGKKP RNRSDWVAFA SGSIGSRFIL DSSIHYNQND

651 KRAENYAVGA SYRPAQGKVL NARYKYGRNE KIYLKSDGSY FYDKLSQLDL

701 SAQWPLTRNL SAVVRYNYGF EAKKPIEVLA GAEYKSSCGC WGAGVYAQRY

751 VTGENTYKNA VFFSLQLKDL SSVGRNPADR MDVAVPGYIT AHSLSAGRNK

801 RP*
```

Computer analysis of this amino acid sequence gave the following results:

Homology with a Predicted ORF from *N. gonorrhoeae*
ORF 958 shows 89.3% identity over a 802 aa overlap with a predicted ORF (ORF 958) from *N. gonorrhoeae*

```
m958/g958   89.3% identity in 802 aa overlap 10        20        30        40        50        60
    m958.pep   LARLFSLKPLVLALGLCFGTHCAAADAVAAEETDNPTAGESVRSVSEPIQPTSLSLGSTC
               |||||||||||||||:|||||||||  :|||||:|: :|  :::::||   | ::|:|||||
    g958       LARLFSLKPLVLALGFCFGTHCAA-DTVAAEEADGRVAEGGAQGASESAQASDLTLGSTC
                       10        20         30        40        50

70        80        90       100       110       120
    m958.pep   LFCSNESGSPERTEAAVQGSGEASIPEDYTRIVADRMEGQSQVQVRAEGNVVVERNRTTL
               ||||||||||||||||||||||||:|||||||||||||||:|:||||:|::||: ::|
    g958       LFCSNESGSPERTEAAVQGSGEASVPEDYTRIVADRMEGQSKVKVRAEGSVIIERDGAVL
                    60        70        80        90       100       110

130       140       150       160       170       180
    m958.pep   NTDWADYDQSGDTVTAGDRFALQQDGTLIRGETLTYNLEQQTGEAHNVRMEIEQGGRRLQ
               ||||||||||||||| :|||||||||||||||||||||:|||||||||||||||| |||||
    g958       NTDWADYDQSGDTVTVGDRFALQQDGTLIRGETLTYNLDQQTGEAHNVRMEIEQGGRRLQ
                     120       130       140       150       160       170

190       200       210       220       230       240
    m958.pep   SVSRTAEMLGEGHYKLTETQFNTCSAGDAGWYVKAASVEADREKGIGVAKHAAFVFGGVP
               |||||||||||||:||||||||||||||||||||||||||||||:|||||||||||||||
    g958       SVSRTAEMLGEGRYKLTETQFNTCSAGDAGWYVKAASVEADRGKGIGVAKHAAFVFGGVP
                     180       190       200       210       220       230

250       260       270       280       290       300
    m958.pep   IFYTPWADFPLDGNRKSGLLVPSLSAGSDGVSLSVPYYFNLAPNLDATFAPSVIGERGAV
               :|||||||||||||||||||||:|||||||||||||||||||||:||||||:::||||||:
    g958       LFYTPWADFPLDGNRKSGLLVPSVSAGSDGVSLSVPYYFNLAPNFDATFAPGIIGERGAT
                240       250       260       270       280       290

310       320       330       340       350       360
    m958.pep   FDGQVRYLRPDYAGQSDLTWLPHDKKSGRNNRYQAKWQHRHDISDTLQAGVDFNQVSDSG
               ||||:||||||:||:|||||||||||||||||||||||||||||||||||||||||||
    g958       FDGQIRYLRPDYSGQTDLTWLPHDKKSGRNNRYQAKWQHRHDISDTLQAGVDFNQVSDSG
                300       310       320       330       340       350

370       380       390       400       410       420
    m958.pep   YYRDFYGNKEIAGNVNLNRRVWLDYGGRAAGGSLNAGLSVLKYQTLANQSGYKDKPYALM
               ||||||::|||||||||||||||||||||||||||||| |||||||||||||||:|||:|
    g958       YYRDFYGGEEIAGNVNLNRRVWLDYGGRAAGGSLNAGLSVQKYQTLANQSGYKDEPYAIM
                360       370       380       390       400       410

430       440       450       460       470       480
    m958.pep   PRLSVEWRKNTGRAQIGVSAQFTRFSHDSRQDGSRLVVYPDIKWDFSNSWGYVRPKLGLH
               ||||::|:||:|||||||||||||||||:||||||||||||:|||||||||||||||||||
    g958       PRLSADWHKNAGRAQIGVSAQFTRFSHDGRQDGSRLVVYPGIKWDFSNSWGYVRPKLGLH
                     420       430       440       450       460       470

490       500       510       520       530       540
    m958.pep   ATYYSLNRFGSQEARRVSRTLPIVNIDSGATFERNTRMFGGEVLQTLEPRLFYNYIPAKS
               ||||||: ||:: :| |:|:|||:|||| |:||||||||||||||||||||||
    g958       ATYYSLDSFGGKASRSVGRVLPVVNIDGGTTFERNTRLFGGGVVQTIEPRLFYNYIPAKS
                480       490       500       510       520       530

550       560       570       580       590       600
    m958.pep   QNDLPNFDSSESSFGYGQLFRENLYYGNDRINTANSLSAAVQSRILDGATGEERFRAGIG
               ||||||||||||||||||||||||||||||||:|||||:||||||||||||||||||||
    g958       QNDLPNFDSSESSFGYGQLFRENLYYGNDRINAANSLSTAVQSRILDGATGEERFRAGIG
                     540       550       560       570       580       590

610       620       630       640       650       660
    m958.pep   QKFYFKDDAVMLDGSVGKKPRNRSDWVAFASGSIGSRFILDSSIHYNQNDKRAENYAVGA
               ||||||||||||||||||:||:|||||||||:||:||||||||||||||||||||||||
    g958       QKFYFKDDAVMLDGSVGKNPRSRSDWVAFASGGIGGRFTLDSSIHYNQNDKRAENYAVGA
                     600       610       620       630       640       650

670       680       690       700       710       720
    m958.pep   SYRPAQGKVLNARYKYGRNEKIYLKSDGSYFYDKLSQLDLSAQWPLTRNLSAVVRYNYGF
               :||| |||||||||||||||||||||::||||||||||||||||||||||||||||||||
    g958       GYRPAPGKVLNARYKYGRNEKIYLQADGSYFYDKLSQLDLSAQWPLTRNLSAVVRYNYGF
                660       670       680       690       700       710

730       740       750       760       770       780
    m958.pep   EAKKPIEVLAGAEYKSSCGCWGAGVYAQRYVTGENTYKNAVFFSLQLKDLSSVGRNPADR
               |||||||:|||||||||||||||||||||||||||||||||||||||||||||||||| |
    g958       EAKKPIEMLAGAEYKSSCGCWGAGVYAQRYVTGENTYKNAVFFSLQLKDLSSVGRNPAGR
                     720       730       740       750       760       770

790       800
    m958.pep   MDVAVPGYITAHSLSAGRNKRP
               ||||||||| ||||||||||||
    g958       MDVAVPGYIPAHSLSAGRNKRPX
                780       790       800
```

The following partial DNA sequence was identified in *N. meningitidis* <SEQ ID 2933>:

```
a958.seq
   1 TTGGCTCGTT TATTTTCACT CAAACCACTG GTGCTGGCAT TGGGCTTCTG

51 TTTCGGCACG CATTGCGCCG CCGCCGATGC CGTTGCGGCG GAGGAAACGG

101 ACAATCCGAC CGCCGGAGGA AGCGTTCGGA GCGTGTCCGA ACCCATACAG

151 CCTACCAGCC TGAGCCTCGG TTCGACCTGC CTGTTTTGCA GTAACGAAAG

201 CGGCAGCCCC GAGAGAACCG AAGCCGCCGT CCAAGGCAGC GGCGAAGCAT

251 CCATCCCCGA AGACTATACG CGCATTGTTG CCGACAGGAT GGAAGGACAG

301 TCGCAGGTGC AGGTGCGTGC CGAAGGCAAC GTCGTCGTCG AACGCAATCG

351 GACGACCCTC AATGCCGATT GGGCGGATTA CGACCAGTCG GGCGACACCG

401 TTACCGCAGG CGACCGGTTC GCCCTCCAAC AGGACGGTAC GCTGATTCGG

451 GGCGAAACCC TGACCTACAA TCTCGAGCAG CAGACCGGGG AAGCGCACAA

501 CGTCCGTATG GAAACCGAAC ACGGCGGACG GCGGCTGCAA AGCGTCAGCC

551 GCACCGCCGA AATGTTGGGC GAAGGGCATT ACAAACTGAC GGAAACCCAA

601 TTCAACACCT GTTCCGCCGG CGATGCCGGC TGGTATGTCA AGGCCGCTTC

651 CGTCGAAGCC GATCGGGAAA AAGGCATAGG CGTTGCCAAA CACGCCGCCT

701 TCGTGTTCGG CGGCGTTCCC ATTTTCTACA CCCCTTGGGC GGACTTCCCG

751 CTTGACGGCA ACCGCAAAAG CGGCCTGCTC GTTCCCTCAC TGTCCGCCGG

801 TTCGGACGGC GTTTCCCTTT CCGTTCCCTA TTATTTCAAC CTTGCCCCCA

851 ATCTCGATGC CACGTTCGCG CCCGGCGTGA TCGGCGAACG CGGCGCGGTC

901 TTTGACGGGC AGGTACGCTA CCTGCGGCCG GATTATGCCG GCCAGTCCGA

951 CCTGACCTGG CTGCCGCACG ACAAGAAAAG CGGCAGGAAT AACCGCTATC

1001 AGGCGAAATG GCAGCACCGG CACGACATTT CCGACACGCT TCAGGCGGGT

1051 GTCGATTTCA ACCAAGTCTC CGACAGCGGC TACTACCGCG ACTTTTACGG

1101 CAACAAAGAA ATCGCCGGCA ACGTCAACCT CAACCGCCGT GTATGGCTGG

1151 ATTATGGCGG CAGGGCGGCG GGCGGCAGCC TGAATGCCGG CCTTTCGGTT

1201 CTGAAATACC AGACGCTGGC AAACCAAAGC GGCTACAAAG ACAAACCGTA

1251 TGCCCTGATG CCGCGCCTTT CCGCCGATTG GCGCAAAAAC ACCGGCAGGG

1301 CGCAAATCGG CGTGTCCGCC CAATTTACCC GCTTCAGCCA CGACAGCCGC

1351 CAAGACGGCA GCCGCCTCGT CGTCTATCCC GACATCAAAT GGGATTTCAG

1401 CAACAGCTGG GGTTACGTCC GTCCCAAACT CGGACTGCAC GCCACCTATT

1451 ACAGCCTCAA CCGCTTCGGC AGCCAAGAAG CCCGACGCGT CAGCCGCACT

1501 CTGCCCATCG TCAACATCGA CAGCGGCATG ACCTTCGAAC GCAATACGCG

1551 GATGTTCGGC GGCGGAGTCC TGCAAACCCT CGAGCCGCGC CTGTTCTACA

1601 ACTATATTCC TGCCAAATCC CAAAACGACC TGCCCAATTT CGATTCGTCG

1651 GAAAGCAGCT TCGGCTACGG GCAGCTTTTT CGTGAAAACC TCTATTACGG

1701 CAACGACAGG ATTAACACCG CAAACAGCCT TTCCGCCGCC GTGCAAAGCC

1751 GTATTTTGGA CGGCGCGACG GGGGAAGAGC GTTTCCGCGC CGGCATCGGG

1801 CAGAAATTCT ACTTCAAAAA CGACGCAGTC ATGCTTGACG GCAGTGTCGG

1851 CAAAAAACCG CGCAGCCGTT CCGACTGGGT GGCATTCGCC TCCAGCGGCA

1901 TCGGCAGCCG CTTCATCCTC GACAGCAGCA TCCACTACAA CCAAAACGAC
```

-continued

```
1951 AAACGCGCCG AGAACTACGC CGTCGGTGCA AGCTACCGTC CCGCACAGGG

2001 CAAAGTGCTG AACGCCCGCT ACAAATACGG GCGCAACGAA AAAATCTACC

2051 TGAAGTCCGA CGGTTCCTAT TTTTACGACA AACTCAGCCA GCTCGACCTG

2101 TCCGCACAAT GGCCGCTGAC GCGCAACCTG TCGGCCGTCG TCCGTTACAA

2151 CTACGGTTTT GAAGCCAAAA AACCGATAGA GGTGCTGGCG GGTGCGGAAT

2201 ACAAAAGCAG TTGCGGCTGC TGGGGCGCGG GCGTGTACGC CCAACGCTAC

2251 GTTACCGGCG AAAACACCTA CAAAAACGCT GTCTTTTTCT CACTTCAGTT

2301 GAAAGACCTC AGCAGTGTCG GCAGAAACCC CGCAGACAGG ATGGATGTCG

2351 CCGTTCCCGG CTATATCCCC GCCCACTCTC TTTCCGCCGG ACGCAACAAA

2401 CGGCCCTGA
```

This corresponds to the amino acid sequence <SEQ ID 2934; ORF 958.a>:

```
a958.pep
  1 LARLFSLKPL VLALGFCFGT HCAAADAVAA EETDNPTAGG SVRSVSEPIQ

51 PTSLSLGSTC LFCSNESGSP ERTEAAVQGS GEASIPEDYT RIVADRMEGQ

101 SQVQVRAEGN VVVERNRTTL NADWADYDQS GDTVTAGDRF ALQQDGTLIR

151 GETLTYNLEQ QTGEAHNVRM ETEHGGRRLQ SVSRTAEMLG EGHYKLTETQ

201 FNTCSAGDAG WYVKAASVEA DREKGIGVAK HAAFVFGGVP IFYTPWADFP

251 LDGNRKSGLL VPSLSAGSDG VSLSVPYYFN LAPNLDATFA PGVIGERGAV

301 FDGQVRYLRP DYAGQSDLTW LPHDKKSGRN NRYQAKWQHR HDISDTLQAG

351 VDFNQVSDSG YYRDFYGNKE IAGNVNLNRR VWLDYGGRAA GGSLNAGLSV

401 LKYQTLANQS GYKDKPYALM PRLSADWRKN TGRAQIGVSA QFTRFSHDSR

451 QDGSRLVVYP DIKWDFSNSW GYVRPKLGLH ATYYSLNRFG SQEARRVSRT

501 LPIVNIDSGM TFERNTRMFG GGVLQTLEPR LFYNYIPAKS QNDLPNFDSS

551 ESSFGYGQLF RENLYYGNDR INTANSLSAA VQSRILDGAT GEERFRAGIG

601 QKFYFKNDAV MLDGSVGKKP RSRSDWVAFA SSGIGSRFIL DSSIHYNQND

651 KRAENYAVGA SYRPAQGKVL NARYKYGRNE KIYLKSDGSY FYDKLSQLDL

701 SAQWPLTRNL SAVVRYNYGF EAKKPIEVLA GAEYKSSCGC WGAGVYAQRY

751 VTGENTYKNA VFFSLQLKDL SSVGRNPADR MDVAVPGYIP AHSLSAGRNK

801 RP*
```

Computer analysis of this amino acid sequence gave the following results:
Homology with a Predicted ORF from *N. meningitidis*
ORF 957 shows 96.3% identity over a 377 aa overlap with a predicted ORF (ORF 957) from *N. meningitidis*

```
    a958/m958 98.1% identity in 802 aa overlap 10         20         30         40         50         60
    a958.pep  LARLFSLKPLVLALGFCFGTHCAAADAVAAEETDNPTAGGSVRSVSEPIQPTSLSLGSTC
              ||||||||||||||||:||||||||||||||||||||| |||||||||||||||||||||
    m958      LARLFSLKPLVLALGLCFGTHCAAADAVAAEETDNPTAGESVRSVSEPIQPTSLSLGSTC
                  10         20         30         40         50         60
```

```
              70        80        90       100       110       120
a958.pep  LFCSNESGSPERTEAAVQGSGEASIPEDYTRIVADRMEGQSQVQVRAEGNVVVERNRTTL
          ||||||||||||||||||||||||||||||||||||||||||||||||||||||||||||
m958      LFCSNESGSPERTEAAVQGSGEASIPEDYTRIVADRMEGQSQVQVRAEGNVVVERNRTTL
              70        80        90       100       110       120

130       140       150       160       170       180
a958.pep  NADWADYDQSGDTVTAGDRFALQQDGTLIRGETLTYNLEQQTGEAHNVRMETEHGGRRLQ
          |:||||||||||||||||||||||||||||||||||||||||||||||||| |:|||||
m958      NTDWADYDQSGDTVTAGDRFALQQDGTLIRGETLTYNLEQQTGEAHNVRMEIEQGGRRLQ
             130       140       150       160       170       180

190       200       210       220       230       240
a958.pep  SVSRTAEMLGEGHYKLTETQFNTCSAGDAGWYVKAASVEADREKGIGVAKHAAFVFGGVP
          ||||||||||||||||||||||||||||||||||||||||||||||||||||||||||||
m958      SVSRTAEMLGEGHYKLTETQFNTCSAGDAGWYVKAASVEADREKGIGVAKHAAFVFGGVP
             190       200       210       220       230       240

250       260       270       280       290       300
a958.pep  IFYTPWADFPLDGNRKSGLLVPSLSAGSDGVSLSVPYYFNLAPNLDATFAPGVIGERGAV
          |||||||||||||||||||||||||||||||||||||||||||||||||||| |||||||
m958      IFYTPWADFPLDGNRKSGLLVPSLSAGSDGVSLSVPYYFNLAPNLDATFAPSVIGERGAV
             250       260       270       280       290       300

310       320       330       340       350       360
a958.pep  FDGQVRYLRPDYAGQSDLTWLPHDKKSGRNNRYQAKWQHRHDISDTLQAGVDFNQVSDSG
          ||||||||||||||||||||||||||||||||||||||||||||||||||||||||||||
m958      FDGQVRYLRPDYAGQSDLTWLPHDKKSGRNNRYQAKWQHRHDISDTLQAGVDFNQVSDSG
             310       320       330       340       350       360

370       380       390       400       410       420
a958.pep  YYRDFYGNKEIAGNVNLNRRVWLDYGGRAAGGSLNAGLSVLKYQTLANQSGYKDKPYALM
          |||||||:||||||||||||||||||||||||||||||||||||||||||||||||||||
m958      YYRDFYGMKEIAGNVNLNRRVWLDYGGRAAGGSLNAGLSVLKYQTLANQSGYKDKPYALM
             370       380       390       400       410       420

430       440       450       460       470       480
a958.pep  PRLSADWRKNTGRAQIGVSAQFTRFSHDSRQDGSRLVVYPDIKWDFSNSWGYVRPKLGLH
          ||||::||||||||||||||||||||||||| ||||||||||||||||||||||||||||
m958      PRLSVEWRKNTGRAQIGVSAQFTRFSHDGRQDGSRLVVYPDIKWDFSNSWGYVRPKLGLH
             430       440       450       460       470       480

490       500       510       520       530       540
a958.pep  ATYYSLNRFGSQEARRVSRTLPIVNIDSGMTFERNTRMFGGGVLQTLEPRLFYNYIPAKS
          |||||||||||||||||||||||||||||| |||||||||||| ||||||||||||||||
m958      ATYYSLNRFGSQEARRVSRTLPIVNIDSGATFERNTRMFGGEVLQTLEPRLFYNYIPAKS
             490       500       510       520       530       540

550       560       570       580       590       600
a958.pep  QNDLPNFDSSESSFGYGQLFRENLYYGNDRINTANSLSAAVQSRILDGATGEERFRAGIG
          ||||||||||||||||||||||||||||||||||||||||||||||||||||||||||||
m958      QNDLPNFDSSESSFGYGQLFRENLYYGNDRINTANSLSAAVQSRILDGATGEERFRAGIG
             550       560       570       580       590       600

610       620       630       640       650       660
a958.pep  QKFYFKNDAVMLDGSVGKKPRSRSDWVAFASSGIGSRFILDSSIHYNQNDKRAENYAVGA
          ||||||:|||||||||||||||| :::||||||||| |||||||||||||||||||||||
m958      QKFYFKDDAVMLDGSVGKKPRNRSDWVAFASGSIGSRFILDSSIHYNQNDKRAENYAVGA
             610       620       630       640       650       660

670       680       690       700       710       720
a958.pep  SYRPAQGKVLNARYKYGRNEKIYLKSDGSYFYDKLSQLDLSAQWPLTRNLSAVVRYNYGF
          ||||||||||||||||||||||||||||||||||||||||||||||||||||||||||||
m958      SYRPAQGKVLNARYKYGRNEKIYLKSDGSYFYDKLSQLDLSAQWPLTRNLSAVVRYNYGF
             670       680       690       700       710       720

730       740       750       760       770       780
a958.pep  EAKKPIEVLAGAEYKSSCGCWGAGVYAQRYVTGENTYKNAVFFSLQLKDLSSVGRNPADR
          ||||||||||||||||||||||||||||||||||||||||||||||||||||||||||:|
m958      EAKKPIEVLAGAEYKSSCGCWGAGVYAQRYVTGENTYKNAVFFSLQLKDLSSVGRNPAGR
             730       740       750       760       770       780

790       800
a958.pep  MDVAVPGYIPAHSLSAGRNKRPX
          ||||||||| |||||||||||||
m958      MDVAVPGYITAHSLSAGRNKRP
             790       800
```

The following partial DNA sequence was identified in *N. gonorrhoeae* <SEQ ID 2935>:

```
g959.seq
    1 ATGAACATCA AACACCTTCT CTTGACCGCC GCCGCAACCG CACTGTTGGG

51 CATTTCCGCC CCCGCACTCG CCCACCACGA CGGACACGGC GATGACGACC

101 ACGGACACGC CGCACACCAA CACGGCAAAC AAGACAAAAT CATCAGCCGC

151 GCCCAAGCCG AAAAAGCGGC TTGGGCGCGT GTCGGCGGCA AAATCACCGA
```

-continued

```
201 CATCGATCTC GAACACGACG ACGGCCGTCC GCACTATGAT GTCGAAATCG

251 TCAAAAACGG ACAGGAATAC AAAGTCGTTG TCGATGCCCG TACCGGCCGC

301 GTGATTTCCT CCCGCCGCGA CGACTGA
```

This corresponds to the amino acid sequence <SEQ ID 2936; ORF 959.ng>:

```
g959.pep
   1 MNIKHLLLTA AATALLGISA PALAHHDGHG DDDHGHAAHQ HGKQDKIISR

51 AQAEKAAWAR VGGKITDIDL EHDDGRPHYD VEIVKNGQEY KVVVDARTGR

101 VISSRRDD*
```

The following partial DNA sequence was identified in *N. meningitidis* <SEQ ID 2937>:

```
m959.seq
   1 ATGAACATCA AACACCTTCT CTTGACCTCC GCCGCAACCG CACTGCTGAG

51 CATTTCCGCC CCCGCGCTCG CCCACCACGA CGGACACGGC GATGACGACC

101 ACGGACACGC CGCACACCAA CACAACAAAC AAGACAAAAT CATCAGCCGC

151 GCCCAAGCCG AAAAAGCAGC GTTGGCGCGT GTCGGCGGCA AAATCACCGA

201 CATCGATCTC GAACACGACA ACGGCCGTCC GCACTATGAT GTCGAAATCG

251 TCAAAAACGG ACAGGAATAC AAAGTCGTTG TCGATGCCCG TACCGGCCGC

301 GTGATTTCCT CCCGCCGCGA CGACTGA
```

This corresponds to the amino acid sequence <SEQ ID 2938; ORF 959>:

```
m959.pep
   1 MNIKHLLLTS AATALLSISA PALAHHDGHG DDDHGHAAHQ HNKQDKIISR

51 AQAEKAALAR VGGKITDIDL EHDNGRPHYD VEIVKNGQEY KVVVDARTGR

101 VISSRRDD*
```

Computer analysis of this amino acid sequence gave the following results:
Homology with a Predicted ORF from *N. gonorrhoeae*
ORF 959 shows 95.4% identity over a 108 aa overlap with a predicted ORF (ORF 959) from *N. gonorrhoeae*

```
   m959/g959   95.4% identity in 108 aa overlap 10         20         30         40         50         60
      m959.pep  MNIKHLLLTSAATALLSISAPALAHHDGHGDDDHGHAAHQHNKQDKIISRAQAEKAALAR
                |||||||||:||||||:|||||||||||||||||||||||:|||||||||||||||| ||
      g959      MNIKHLLLTAAATALLGISAPALAHHDGHGDDDHGHAAHQHGKQDKIISRAQAEKAAWAR
                       10         20         30         40         50         60

70         80         90        100        109
      m959.pep  VGGKITDIDLEHDNGRPHYDVEIVKNGQEYKVVVDARTGRVISSRRDDX
                ||||||||||||||:||||||||||||||||||||||||||||||||||
      g959      VGGKITDIDLEHDDGRPHYDVEIVKNGQEYKVVVDARTGRVISSRRDDX
                       70         80         90        100
```

The following partial DNA sequence was identified in *N. meningitidis* <SEQ ID 2939>:

```
a959.seq
   1 ATGAACTTCA AACGCCTTCT CTTGACCGCC GCCGCAACCG CACTGATGGG

51 CATTTCCGCC CCCGCACTCG CCCACCACGA CGGACACGGC GATGACGACC

101 ACGGACACGC CGCACACCAA CACAGCAAAC AAGACAAAAT CATCAGCCGC

151 GCCCAAGCCG AAAAAGCAGC GTTGGCGCGT GTCGGCGGCA AAATCACCGA

201 CATCGATCTC GAACACGACA ACGGCCGTCC GCACTATGAT GTCGAAATCG

251 TCAAAAACGG ACAGGAATAC AAAGTCGTTG TCGATGCCCG TACCGGCCGC

301 GTGATTTCCT CCCGCCGCGA CGACTGA
```

This corresponds to the amino acid sequence <SEQ ID 2940; ORF 959.a>:

```
a959.pep
   1 MNFKRLLLTA AATALMGISA PALAHHDGHG DDDHGHAAHQ HSKQDKIISR

51 AQAEKAALAR VGGKITDIDL EHDNGRPHYD VEIVKNGQEY KVVVDARTGR

101 VISSRRDD*
```

Computer analysis of this amino acid sequence gave the following results:

Homology with a Predicted ORF from *N. meningitidis*

ORF 959 shows 94.4% identity over a 108 aa overlap with a predicted ORF (ORF 959) from *N. meningitidis*

```
a959/m959   94.4% identity in 108 aa overlap 10        20        30        40        50        60
a959.pep    MNFKRLLLTAAATALMGISAPALAHHDGHGDDDHGHAAHQHSKQDKIISRAQAEKAALAR
            ||:|:||||:|||||::|||||||||||||||||||||||:|||||||||||||||||||
m959        MNIKHLLLTSAATALLSISAPALAHHDGHGDDDHGHAAHQHNKQDKIISRAQAEKAALAR
                    10        20        30        40        50        60

70        80        90       100      109
a959.pep    VGGKITDIDLEHDNGRPHYDVEIVKNGQEYKVVVDARTGRVISSRRDDX
            |||||||||||||||||||||||||||||||||||||||||||||||||
m959        VGGKITDIDLEHDNGRPHYDVEIVKNGQEYKVVVDARTGRVISSRRDDX
                    70        80        90       100 g960.seq not found yet g960.pep not found yet
```

The following partial DNA sequence was identified in *N. meningitidis* <SEQ ID 2941>:

```
m960.seq
   1 ATGCAAGTAA ATATTCAGAT TCCCTGTATG CTGTACAGAC GCGGGAGTGT

51 TAAGCCCCCC TTGTTTGAAG CTCCGCGGCT CCTGCCGAGC TTCACCGACC

101 CCGTTGTGCC CAAGCTCTCT GCTCCCGGCG GCTACATTGT CGACATCCCC

151 AAAGGCAATC TGAAAACCGA AATCGAAAAG CTGGCCAAAC AGCCCGAGTA

201 TGCCTATCTG AAACAGCTCC AAGTAGCGAA AAACGTCAAC TGGAACCAGG

251 TGCAACTGGC TTACGATAAA TGGGACTATA AGCAGGAAGG CTTAACCAGA

301 GCCGGTGCAG CGATTATCGC GCTGGCTGTT ACCGTGGTTA CTGCGGGCGC

351 GGGAGTCGGA GCCGCACTAG GCTTAAACGG CGCAGCCGCA GCAGCGGCCG

401 ATGCCGCCTT TGCCTCACTC GCTTTCTCAGG CTTCCGTATC GCTCATCAAC
```

```
 451 AATAAAGGCG ATGTCGGCAA AACCCTGAAG GAACTGGGCA GAAGCCGCAC

501 GGTAAAAAAT CTGGTTGTAG CGGCGGCAAC GGCAGGCGTA TCCAACAAAC

551 TCGGTGCCTC TTCCCTTGCC ACTTGGAGCG AAACCCCTTG GGTAAACAAC

601 CTCAACGTTA ACCTGGCCAA TGCGGGCAGT GCCGCGCTGA TCAACACCGC

651 TGTTAACGGC GGCAGCCTGA AGACAATCT GGAGGCAAAT ATCCTGGCGG

701 CATTGGTGAA TACCGCGCAT GGGGAGGCGG CGAGTAAGAT CAAAGGACTG

751 GATCAGCACT ATGTCGCCCA CAAAATCGCT CATGCCGTAG CGGGCTGTGC

801 GGCTGCAGCG GCGAATAAGG GCAAATGTCA GGACGGCGCG ATCGGTGCGG

851 CTGTGGGTGA GATTGTCGGG GAGGCTTTGG TTAAAAATAC CGATTTTAGC

901 GATATGACCC CGGAACAATT AGATCTGGAA GTTAAGAAAA TTACCGCCTA

951 TGCCAAACTT GCGGCAGGTA CAGTTGCAGG CGTAACGGGA GGAGATGTCA

1001 ATACTGCTGC ACAAACCGCA CAAAACGCGG TAGAAAATAA TGCGGTTAAA

1051 GCTGTTGTAA CTGCTGCAAA AGTGGTTTAT AAGGTAGCCA GAAAAGGATT

1101 AAAAAACGGG AAAATCAACG TTAGAGATTT AAAACAGACG TTGAAAGACG

1151 AAGGTTATAA TTTAGCCGAC AACCTGACCA CCTTATTCGA CGAAACATTG

1201 GATTGGAACG ATGCCAAAGC CGTTATTGAT ATTGTCGTCG GAACAGAGCT

1251 GAATCGCGCT AATAAAGGGG AAGCGGCACA AAAGGTCAAG GAAGTTTTAG

1301 AAAAAAATCG TCCTTATATC CCTAATAAAG GTGCTGTACC GAATATGAGT

1351 ACATACATGA AAAATAATCC TTTTGGAAAA CAGCTGGCTC AAATTTCAGA

1401 AAAGACAACG CTTCCGACGC AGCAAGGGCA GTCTGTCTTC TTGGTAAAAA

1451 GAAACCAAGG GTTATTAAAA ACCGGTGATA GGTTTTATTT AGATGGCCAA

1501 CATAAAAATC ATTTAGAGGT TTTTGATAAA AATGGGAACT TTAAGTTTGT

1551 TCTAAATATG GATGGTTCGC TTAACCAAAT GAAAACTGGG GCAGCAAAAG

1601 GTCGTAAATT AAACTTAAAA TAG
```

This corresponds to the amino acid sequence <SEQ ID 2942; ORF 960>:

```
m960.pep
   1 MQVNIQIPCM LYRRGSVKPP LFEAPRLLPS FTDPVVPKLS APGGYIVDIP

51 KGNLKTEIEK LAKQPEYAYL KQLQVAKNVN WNQVQLAYDK WDYKQEGLTR

101 AGAAIIALAV TVVTAGAGVG AALGLNGAAA AAADAAFASL ASQASVSLIN

151 NKGDVGKTLK ELGRSRTVKN LVVAAATAGV SNKLGASSLA TWSETPWVNN

201 LNVNLANAGS AALINTAVNG GSLKDNLEAN ILAALVNTAH GEAASKIKGL

251 DQHYVAHKIA HAVAGCAAAA ANKGKCQDGA IGAAVGEIVG EALVKNTDFS

301 DMTPEQLDLE VKKITAYAKL AAGTVAGVTG GDVNTAAQTA QNAVENNAVK

351 AVVTAAKVVY KVARKGLKNG KINVRDLKQT LKDEGYNLAD NLTTLFDETL

401 DWNDAKAVID IVVGTELNRA NKGEAAQKVK EVLEKNRPYI PNKGAVPNMS

451 TYMKNNPFGK QLAQISEKTT LPTQQGQSVF LVKRNQGLLK TGDRFYLDGQ

501 HKNHLEVFDK NGNFKFVLNM DGSLNQMKTG AAKGRKLNLK *
```

```
a960.seq not found yet
a960.pep not found yet
g961.seq not found yet
g961.pep not found yet
```

The following partial DNA sequence was identified in *N. meningitidis* <SEQ ID 2943>:

```
m961.seq
   1 ATGAGCATGA AACACTTTCC AGCCAAAGTA CTGACCACAG CCATCCTTGC

51 CACTTTCTGT AGCGGCGCAC TGGCAGCCAC AAGCGACGAC GATGTTAAAA

101 AAGCTGCCAC TGTGGCCATT GTTGCTGCCT ACAACAATGG CCAAGAAATC

151 AACGGTTTCA AGCTGGAGA GACCATCTAC GACATTGGTG AAGACGGCAC

201 AATTACCCAA AAAGACGCAA CTGCAGCCGA TGTTGAAGCC GACGACTTTA

251 AAGGTCTGGG TCTGAAAAAA GTCGTGACTA ACCTGACCAA AACCGTCAAT

301 GAAAACAAAC AAAACGTCGA TGCCAAAGTA AAAGCTGCAG AATCTGAAAT

351 AGAAAAGTTA ACAACCAAGT TAGCAGACAC TGATGCCGCT TTAGCAGATA

401 CTGATGCCGC TCTGGATGAA ACCACCAACG CCTTGAATAA ATTGGGAGAA

451 AATATAACGA CATTTGCTGA AGAGACTAAG ACAAATATCG TAAAAATTGA

501 TGAAAAATTA GAAGCCGTGG CTGATACCGT CGACAAGCAT GCCGAAGCAT

551 TCAACGATAT CGCCGATTCA TTGGATGAAA CCAACACTAA GGCAGACGAA

601 GCCGTCAAAA CCGCCAATGA AGCCAAACAG ACGGCCGAAG AAACCAAACA

651 AAACGTCGAT GCCAAAGTAA AAGCTGCAGA AACTGCAGCA GGCAAAGCCG

701 AAGCTGCCGC TGGCACAGCT AATACTGCAG CCGACAAGGC CGAAGCTGTC

751 GCTGCAAAAG TTACCGACAT CAAAGCTGAT ATCGCTACGA ACAAAGCTGA

801 TATTGCTAAA AACTCAGCAC GCATCGACAG CTTGGACAAA AACGTAGCTA

851 ATCTGCGCAA AGAAACCCGC CAAGGCCTTG CAGAACAAGC CGCGCTCTCC

901 GGCCTGTTCC AACCTTACAA CGTGGGTCGG TTCAATGTAA CGGCTGCAGT

951 CGGCGGCTAC AAATCCGAAT CGGCAGTCGC CATCGGTACC GGCTTCCGCT

1001 TTACCGAAAA CTTTGCCGCC AAAGCAGGCG TGGCAGTCGG CACTTCGTCC

1051 GGTTCTTCCG CAGCCTACCA TGTCGGCGTC AATTACGAGT GGTAA
```

This corresponds to the amino acid sequence <SEQ ID 940; ORF 2944>:

```
m961.pep
   1 MSMKHFPAKV LTTAILATFC SGALAATSDD DVKKAATVAI VAAYNNGQEI

51 NGFKAGETIY DIGEDGTITQ KDATAADVEA DDFKGLGLKK VVTNLTKTVN

101 ENKQNVDAKV KAAESEIEKL TTKLADTDAA LADTDAALDE TTNALNKLGE

151 NITTFAEETK TNIVKIDEKL EAVADTVDKH AEAFNDIADS LDETNTKADE

201 AVKTANEAKQ TAEETKQNVD AKVKAAETAA GKAEAAAGTA NTAADKAEAV

251 AAKVTDIKAD IATNKADIAK NSARIDSLDK NVANLRKETR QGLAEQAALS

301 GLFQPYNVGR FNVTAAVGGY KSESAVAIGT GFRFTENFAA KAGVAVGTSS

351 GSSAAYHVGV NYEW*
```

```
a961.seq not found yet
a961.pep not found yet
g972.seq not found yet
g972.pep not found yet
```

The following partial DNA sequence was identified in *N. meningitidis* <SEQ ID 2945>:

```
m972.seq
    1 TTGACTAACA GGGGGGGAGC GAAATTAAAA ACCArTTCCA AGAGTAGTGA

51 ACGAATGAGT GAAGTTGAAT ATTTCTCACA CTTTATATCG GACGGAAAAG

101 GGAAGCTTTT AGAAATTCCG CAGCGAAGAG GTAAGCAAGA CggGGTTTTT

151 GTTGATTGGA TTTCATTCAC ATTCCATGAA GATACTTTAC TGAAAGTTTC

201 CGGTTGCCCT TTATTTTCTG ATGCTGAATA CATGTATGTA TTAAGCAGAA

251 AGCTGGAAGA AATTCTAGGT TTTGGCATAA CGCGCAAATG CAAATCAAGG

301 GGCAACAAAT TCTATGAATC CATGTATAGG TTAGGTTCGG ATGATGTTGA

351 TTATGGAGAG GTGCATTTCG GArGTCAGCG CAATACTGTT TTAGTTGAGT

401 TGAAAGGTAC TGGTTGCAGC GTTGCAAGTC CGGGTTGGGA GTTGAGGCTA

451 AAGCAGTTTC TCGATGATTC GATAAGGACA AGAATAACGC GAATTGACCT

501 AGCACTTGAT TTTTTTGATG GAGAGTACAC GCCGGATCAG GCGTTGTTAG

551 ATCACGATAA TGGTTTTTTT GATAACAGCA ATCAAAGGCC GAAATCTGAA

601 ACGATCGGTA CGGCTTGGCG GAATGAGGAC GGGAGCGGCA AGACATTTTA

651 TGTAGGTCGC AAGAAAAATT CTCGTTTTGT TCGTGTTTAT GAGAAAGGCA

701 GGCAGCTTGG AGATAAAGAA AGCAAATGGG TAAGGTTCGA GATCCAGTTT

751 AATTATGGAG ATATAGAAAT ACCCTTGGAT ATTTTAATAA ATCAGGGTTC

801 GTATTTCTGT GGAGCTTTTC CAATTTGTAG AAAATTTAAA AATATGCCGG

851 TTCCCGAAAG GTTTGATCAG AGAAAGAAAA AGCTTAATTT AACTTTCGAG

901 CATAAATTGC ATTACGCGAA AAACGCGGTT GGAAAACTGG TCAATTTCAT

951 GATTGAAATG GGTTTTGATA ATAGCGAAAT TGTGGAATCT TTAAAGGCAG

1001 ATTCGGGATT TCCCAAAGGA TTAGAACCTG AAAAATATGC TCTGGAAATG

1051 TTAAGGGACG GTTTGAAACA CGGTTTTATT CATGAACAGC CGGATATTGA

1101 TTTGGAAATT GAACTTGATG AATTGGGGGT TATTGCTTTT AAAAATTCTG

1151 ACAAATTCGA TAGGGAAAAA AGGCTTTTTA GTCCTGATTA TGATGTCGAG

1201 AAAGAAAGGA AATATCAGGA ATATTTAAGT AAAGTTTATC ATCAAAATGT

1251 AGATTATGAT TATTTTTAA
```

This corresponds to the amino acid sequence <SEQ ID 2946; ORF 972>:

```
m972.pep
    1 LTNRGGAKLK TXSKSSERMS EVEYFSHFIS DGKGKLLEIP QRRGKQDGVF

51 VDWISFTFHE DTLLKVSGCP LFSDAEYMYV LSRKLEEILG FGITRKCKSR

101 GNKFYESMYR LGSDDVDYGE VHFGXQRNTV LVELKGTGCS VASPGWELRL

151 KQFLDDSIRT RITRIDLALD FFDGEYTPDQ ALLDHDNGFF DNSNQRPKSE

201 TIGTAWRNED GSGKTFYVGR KKNSRFVRVY EKGRQLGDKE SKWVRFEIQF

251 NYGDIEIPLD ILINQGSYFC GAFPICRKFK NMPVPERFDQ RKKKLNLTFE
```

-continued

```
301 HKLHYAKNAV GKLVNFMIEM GFDNSEIVES LKADSGFPKG LEPEKYALEM

351 LRDGLKHGFI HEQPDIDLEI ELDELGVIAF KNSDKFDREK RLFSPDYDVE

401 KERKYQEYLS KVYHQNVDYD YF*
```

The following partial DNA sequence was identified in *N. meningitidis* <SEQ ID 2947>:

```
a972.seq
   1 TTGACTAACA GGGGGGGAGC GAAATTAAAA ACCAATTCCA AGAGTAGTGA

51 ACGAATGAGT GAAGTTGAAT ATTTCTCACA CTTTATATCG GACGGAAAAG

101 GGAAGCTTTT AGAAATTCCG CAGCGAAGAG GTAAGCAAGA CGGGGTTTTT

151 GTTGATTGGA TTTCATTCAC ATTCCATGAA GATACTTTAC TGAAAGTTTC

201 CGGTTGCCCT TTATTTTCTG ATGCTGAATA CATGTATGTA TTAAGCAGAA

251 AGCTGGAAGA AATTCTAGGT TTTGGCATAA CGCGCAAATG CAAATCAAGG

301 GGCAACAAAT TCTATGAATC CATGTATAGG TTAGGTTCGG ATGATGTTGA

351 TTATGGAGAG GTGCATTTCG GAGGTCAGCG CAATACTGTT TTAGTTGAGT

401 TGAAAGGTAC TGGTTGCAGC GTTGCAAGTC CGGGTTGGGA GTTGAGGCTA

451 AAGCAGTTTC TCGATGATTC GATAAGGACA AGAATAACGC GAATTGACCT

501 AGCACTTGAT TTTTTTGATG GAGAGTACAC GCCGGATCAG GCGTTGTTAG

551 ATCACGATAA TGGTTTTTTT GATAACAGCA ATCAAAGGCC GAAATCTGAA

601 ACGATCGGTA CGGCTTGGCG GAATGAGGAC GGGAGCGGCA AGACATTTTA

651 TGTAGGTCGC AAGAAAAATT CTCGTTTTGT TCGTGTTTAT GAGAAAGGCA

701 GGCAGCTTGG AGATAAAGAA AGCAAATGGG TAAGGTTCGA GATCCAGTTT

751 AATTATGGAG ATATAGAAAT ACCCTTGGAT ATTTTAATAA ATCAGGGTTC

801 GTATTTCTGT GGAGCTTTTC CAATTTGTAG AAAATTTAAA AATATGCCGG

851 TTCCCGAAAG GTTTGATCAG AGAAAGAAAA CGCTTAATTT AACTTTCGAG

901 CATAAATTGC ATTACGCGAA AAACGCGGTT GGAAAACTGG TCAATTTCAT

951 GATTGAAATG GGTTTTGATA ATAGCGAAAT TGTGGAATCT TTAAAGGCAG

1001 ATTCGGGATT TCCCAAAGGA TTAGAACCTG AAAAATATGC TCTGGAAATG

1051 TTAAGGGACG GTTTGAAACA CGGTTTTATT CATGAACAGC CGGATATTGA

1101 TTTGGAAATT GAACTTGATG AATTGGGGGT TATTGCTTTT AAAAATTCTG

1151 ACAAATTCGA TAGGGAAAAA AGGCTTTTTA GTCCTGATTA TGATGTCGAG

1201 AAAGAAAGGA AATATCAGGA ATATTTAAGT AAAGTTTATC ATCAAAATGT

1251 AGATTATGAT TATTTTTAA
```

This corresponds to the amino acid sequence <SEQ ID 2948; ORF 972.a>:

```
a972.pep
   1 LTNRGGAKLK TNSKSSERMS EVEYFSHFIS DGKGKLLEIP QRRGKQDGVF

51 VDWISFTFHE DTLLKVSGCP LFSDAEYMYV LSRKLEEILG FGITRKCKSR

101 GNKFYESMYR LGSDDVDYGE VHFGGQRNTV LVELKGTGCS VASPGWELRL

151 KQFLDDSIRT RITRIDLALD FFDGEYTPDQ ALLDHDNGFF DNSNQRPKSE

201 TIGTAWRNED GSGKTFYVGR KKNSRFVRVY EKGRQLGDKE SKWVRFEIQF
```

```
251 NYGDIEIPLD ILINQGSYFC GAFPICRKFK NMPVPERFDQ RKKTLNLTFE

301 HKLHYAKNAV GKLVNFMIEM GFDNSEIVES LKADSGFPKG LEPEKYALEM

351 LRDGLKHGFI HEQPDIDLEI ELDELGVIAF KNSDKFDREK RLFSPDYDVE

401 KERKYQEYLS KVYHQNVDYD YF*
``` m972/a972 99.3% identity in 422 aa overlap

```
                    10         20         30         40         50         60
   m972.pep  LTNRGGAKLKTXSKSSERMSEVEYFSHFISDGKGKLLEIPQRRGKQDGVFVDWISFTFHE
             ||||||||||| |||||||||||||||||||||||||||||||||||||||||||||||
   a972      LTNRGGAKLKTNSKSSERMSEVEYFSHFISDGKGKLLEIPQRRGKQDGVFVDWISFTFHE
                    10         20         30         40         50         60

70         80         90        100        110        120
   m972.pep  DTLLKVSGCPLFSDAETMTVLSRKLEEILGFGITRKCKSRGNKFYESMYRLGSDDVDYGE
             ||||||||||||||| | ||||||||||||||||||||||||||||||||||||||||||
   a972      DTLLKVSGCPLFSDAEYMYVLSRKLEEILGFGITRKCKSRGNKFYESMYRLGSDDVDYGE
                    70         80         90        100        110        120

130        140        150        160        170        180
   m972.pep  VHFGXQRNTVLVELKGTGCSVASPGWELRLKQFLDDSIRTRITRIDLALDFFDGEYTPDQ
             ||||  ||||||||||||||||||||||||||||||||||||||||||||||||||||||
   a972      VHFGGQRNTVLVELKGTGCSVASPGWELRLKQFLDDSIRTRITRIDLALDFFDGEYTPDQ
                   130        140        150        160        170        180

190        200        210        220        230        240
   m972.pep  ALLDHDNGFFDNSNQRPKSETIGTAWRNEDGSGKTFYVGRKKNSRFVRVYEKGRQLGDKE
             ||||||||||||||||||||||||||||||||||||||||||||||||||||||||||||
   a972      ALLDHDNGFFDNSNQRPKSETIGTAWRNEDGSGKTFYVGRKKNSRFVRVYEKGRQLGDKE
                   190        200        210        220        230        240

250        260        270        280        290        300
   m972.pep  SKWVRFEIQFNYGDIEIPLDILINQGSYFCGAFPICRKFKNMPVPERFDQRKKKLNLTFE
             |||||||||||||||||||||||||||||||||||| |||||||||||||||| |||||
   a972      SKWVRFEIQFNYGDIEIPLDILINQGSYFCGAFPOCRKFKNMPVPERFDQRKKTLNLTFE
                   250        260        270        280        290        300

310        320        330        340        350        360
   m972.pep  HKLHYAKNAVGKLVNFMIEMGFDNSEIVESLKADSGFPKGLEPEKYALEMLRDGLKHGFI
             ||||||||||||||||||||||||||||||||||||||||||||||||||||||||||||
   a972      HKLHYAKNAVGKLVNFMIEMGFDNSEIVESLKADSGFPKGLEPEKYALEMLRDGLKHGFI
                   310        320        330        340        350        360

370        380        390        400        410        420
   m972.pep  HEQPDIDLEIELDELGVIAFKNSDKFDREKRLFSPDYDVEKERKYQEYLSKVYHQNVDYD
             ||||||||||||||||||||||||||||||||||||||||||||||||||||||||||||
   a972      HEQPDIDLEIELDELGVIAFKNSDKFDREKRLFSPDYDVEKERKYQEYLSKVYHQNVDYD
                   370        380        390        400        410        420 m972.pep  YFX
             |||
   a972      YFX
```

The following partial DNA sequence was identified in *N. gonorrhoeae* <SEQ ID 2949>:

```
g973.seq
   1 ATGGACGGCG CACAACCGAA ACAAATTTT TTTGAACGCC TGATTGCCCG 51 actCGCCCGC GAACCCGATT CCGCCGAAGA CGTATTAAAC CTGCTTCGGC

101 AGGCGCACGA ACAGGAAGTT TTTGATGCCG ACACACTGAC CCGGCTGGAA

151 AAAGTATTGG ACTTTGCCGA GCTGGAAGTG CGCGATGCGA TGATTACGCG

201 CAGCCGCATG AACGTATTGA AGAAAACGA CAGCATCGAA CGCATCACCG

251 CCTACGTCAT CGATACCGCC CATTCGCGCT TCCCCGTCAT CGGCGAAGAC

301 AAAGACGAAG TTTTGGGCAT TTTGCACGCC AAAGACCTGC TCAAATATAT

351 GTTCAACCCC GAGCAGTTCC ACCTGAAATC CGTCTTGCGC CCTGCCGTTT

401 TCGTGCCCGA AGGCAAATCT TGACCGCCC TTTTAAAAGA GTTCCGCGAA

451 CAGCGCAACC ATATGGCAAT CGTCATCGAC GAATACGGCG GCACGTCGGG
```

-continued
```
501 TTTGGTCACC TTTGAAGACA TCATCGAGCa aatcgtcggt gacaTCGAAG

551 ACGAGTTTGA CGAAGACGAA AGCGccgacg acatCCACTC cgTTTccgCC

601 GAACGCTGGC GCATCCacgc ggctaCCGAA ATCGAAGaca TCAACGCCTT

651 TTTCGGTACG GAatacggca gcgaagaagc cgacaccatc ggcggctTGG

701 TCATTCAGGA ATTGGGACAC CTGCCCGTGC GCGGCGAAAA AGTCCTTAtc 751 ggcgGTTTGC agttcaccgt CGCCCGCGCC GACAACCGCC GCCTGCACAC 801 GCTGATGGCG ACCCGCGTGA AGTAAGCAGA GCCTGCCcgc accgccgttT 851 CTGCacAGTT TAG
```

This corresponds to the amino acid sequence <SEQ ID 2950; ORF 973.ng>:

```
g973.pep
  1 MDGAQPKTNF FERLIARLAR EPDSAEDVLN LLRQAHEQEV FDADTLTRLE

51 KVLDFAELEV RDAMITRSRM NVLKENDSIE RITAYVIDTA HSRFPVIGED

101 KDEVLGILHA KDLLKYMFNP EQFHLKSVLR PAVFVPEGKS LTALLKEFRE

151 QRNHMAIVID EYGGTSGLVT FEDIIEQIVG DIEDEFDEDE SADDIHSVSA

201 ERWRIHAATE IEDINAFFGT EYGSEEADTI GGLVIQELGH LPVRGEKVLI

251 GGLQFTVARA DNRRLHTLMA TRVK*
```

The following partial DNA sequence was identified in *N. meningitidis* <SEQ ID 2951>:

```
m973.seq
  1 ATGGACGGCG CACAACCGAA AACGAATTTT TTTGAACGCC TGATTGCCCG

51 ACTCGCCCGC GAACCCGATT CCGCCGAAGA CGTATTAAAC CTGCTTCGGC

101 AGGCGCACGA GCAGGAAGTT TTTGATGCGG ATACGCTTTT AAGATTGGAA

151 AAAGTCCTCG ATTTTCCGA TTTGGAAGTG CGCGACGCGA TGATTACGCG

201 CAGCCGTATG AACGTTTTAA AAGAAAACGA CAGCATCGAG CGCATCACCG

251 CCTACGTTAT CGATACCGCC CATTCGCGCT TCCCCGTCAT CGGCGAAGAC

301 AAAGACGAAG TTTTGGGCAT TTTGCACGCC AAAGACCTGC TCAAATATAT

351 GTTTAACCCC GAGCAGTTCC ACCTCAAATC CATTCTCCGC CCCGCCGTCT

401 TCGTCCCCGA AGGCAAATCG CTGACCGCCC TTTTAAAAGA GTTCCGCGAA

451 CAGCGCAACC ATATGGCGAT TGTCATCGAC GAATACGGCG GCACATCCGG

501 CTTGGTCACC TTTGAAGACA TCATCGAGCA AATCGTCGGC GAAATCGAAG

551 ACGAGTTTGA CGAAGACGAT AGCGCCGACA ATATCCATGC CGTTTCTTCm

601 GaACGcTGGC GCATCCATGC AGCTACCGAA ATCGAAGACA TCAACACCTT

651 CTTCGGCACG GAATACAGCA kCGAAGAAGC CGACACCATT GGCGGCCTGG

701 TCATTCAAGA GTTGGGACAT CTGCCCGTGC GCGGCGAAAA AGTCCTTATC

751 GGCGGTTTGC AGTTCACCGT CGCACGCGCC GACAACCGCC GCCTGCATAC

801 GCTGATGGCG ACCCGCGTGA AGTAA
```

This corresponds to the amino acid sequence <SEQ ID 2952; ORF 973>:

```
m973.pep
   1 MDGAQPKTNF FERLIARLAR EPDSAEDVLN LLRQAHEQEV FDADTLLRLE

51 KVLDFSDLEV RDAMITRSRM NVLKENDSIE RITAYVIDTA HSRFPVIGED

101 KDEVLGILHA KDLLKYMFNP EQFHLKSILR PAVFVPEGKS LTALLKEFRE

151 QRNHMAIVID EYGGTSGLVT FEDIIEQIVG EIEDEFDEDD SADNIHAVSS

201 ERWRIHAATE IEDINTFFGT EYSXEEADTI GGLVIQELGH LPVRGEKVLI

251 GGLQFTVARA DNRRLHTLMA TRVK*
```

Computer analysis of this amino acid sequence gave the following results:
Homology with a Predicted ORF from *N. gonorrhoeae*
ORF 973 shows 95.6% identity over a 274 aa overlap with a predicted ORF (ORF 973.ng) from *N. gonorrhoeae*:

```
m973/g973
                   10         20         30         40         50         60
    m973.pep  MDGAQPKTNFFERLIARLAREPDSAEDVLNLLRQAHEQEVFDADTLLRLEKVLDFSDLEV
              ||||||||||||||||||||||||||||||||||||||||||||||| |||||||::|||
    g973      MDGAQPKTNFFERLIARLAREPDSAEDVLNLLRQAHEQEVFDADTLTRLEKVLDFAELEV
                   10         20         30         40         50         60

70         80         90        100        110        120
    m973.pep  RDAMITRSRMNVLKENDSIERITAYVIDTAHSRFPVIGEDKDEVLGILHAKDLLKYMFNP
              ||||||||||||||||||||||||||||||||||||||||||||||||||||||||||||
    g973      RDAMITRSRMNVLKENDSIERITAYVIDTAHSRFPVIGEDKDEVLGILHAKDLLKYMFNP
                   70         80         90        100        110        120

130        140        150        160        170        180
    m973.pep  EQFHLKSILSPAVFVPEGKSLTALLKEFREQRNHMAIVIDEYGGTSGLVTFEDIIEQIVG
              ||||||:|||||||||||||||||||||||||||||||||||||||||||||||||||||
    g973      EQFHLKSVLRPAVFVPEGKSLTALLKEFREQRNHMAIVIDEYGGTSGLVTFEDIIEQIVG
                  130        140        150        160        170        180

190        200        210        220        230        240
    m973.pep  EIEDEFDEDDSADNIHAVSSERWRIHAATEIEDINTFFGTEYSXEEADTIGGLVIQELGH
              :||||||||:|||:||:||:||||||||||||||||:||||||:||||||||||||||||
    g973      DIEDEFDEDESADDIHSVSAERWRIHAATEIEDINAFFGTEYGSEEADTIGGLVIQELGH
                  190        200        210        220        230        240

250        260        270
    m973.pep  LPVRGEKVLIGGLQFTVARADNRRLHTLMATRVKX
              |||||||||||||||||||||||||||||||||||
    g973      LPVRGEKVLIGGLQFTVARADNRRLHTLMATRVKX
                  250        260        270
```

The following partial DNA sequence was identified in *N. meningitidis* <SEQ ID 2953>:

```
a973.seq
   1 ATGGACGGCG CACAACCGAA AACAAATTTT TTTGAACGCC TGATTGCCCG

51 ACTCGCCCGC GAACCCGATT CCGCCGAAGA CGTATTGACC CTGTTGCGCC

101 AAGCGCACGA ACAGGAAGTA TTTGATGCGG ATACGCTTTT AAGATTGGAA

151 AAAGTCCTCG ATTTTCTGA TTTGGAAGTG CGCGACGCGA TGATTACGCG

201 CAGCCGTATG AACGTTTTAA AGAAAACGA CAGCATCGAA CGCATCACCG

251 CCTACGTTAT CGATACCGCC CATTCGCGCT TCCCCGTCAT CGGTGAAGAC

301 AAAGACGAAG TTTTGGGTAT TTTGCACGCC AAAGACCTGC TCAAATATAT

351 GTTCAACCCC GAGCAGTTCC ACCTCAAATC GATATTGCGC CCTGCCGTCT

401 TCGTCCCCGA AGGCAAATCG CTGACCGCCC TTTTAAAAGA GTTCCGCGAA

451 CAGCGCAACC ATATGGCAAT CGTCATCGAC GAATACGGCG GCACGTCGGG
```

```
501 TTTGGTAACT TTTGAAGACA TCATCGAGCA AATCGTCGGC GACATCGAAG

551 ATGAGTTTGA CGAAGACGAA AGCGCGGACA ACATCCACGC CGTTTCCGCC

601 GAACGCTGGC GCATCCACGC GGCTACCGAA ATCGAAGACA TCAACGCCTT

651 TTTCGGCACG GAATACAGCA GCGAAGAAGC CGACACCATC GGCGGCCTGG

701 TCATTCAGGA ATTGGGACAC CTGCCCGTGC GCGGCGAAAA AGTCCTTATC

751 GGCGGTTTGC AGTTCACCGT CGCCCGCGCC GACAACCGCC GCCTGCATAC

801 GCTGATGGCG ACCCGCGTGA AGTAA
```

This corresponds to the amino acid sequence <SEQ ID 2954; ORF 973.a>:

```
a973.pep
  1 MDGAQPKTNF FERLIARLAR EPDSAEDVLT LLRQAHEQEV FDADTLLRLE

51 KVLDFSDLEV RDAMITRSRM NVLKENDSIE RITAYVIDTA HSRFPVIGED

101 KDEVLGILHA KDLLKYMFNP EQFHLKSILR PAVFVPEGKS LTALLKEFRE

151 QRNHMAIVID EYGGTSGLVT FEDIIEQIVG DIEDEFDEDE SADNIHAVSA

201 ERWRIHAATE IEDINAFFGT EYSSEEADTI GGLVIQELGH LPVRGEKVLI

251 GGLQFTVARA DNRRLHTLMA TRVK*
``` m973/a973 97.8% identity in 274 aa overlap

```
                    10         20         30         40         50         60
    m973.pep  MDGAQPKTNFFERLIARLAREPDSAEDVLNLLRQAHEQEVFDADTLLRLEKVLDFSDLEV
              |||||||||||||||||||||||||||||:||||||||||||||||||||||||||||||
    a973      MDGAQPKTNFFERLIARLAREPDSAEDVLTLLRQAHEQEVFDADTLLRLEKVLDFAELEV
                    10         20         30         40         50         60

70         80         90        100        110        120
    m973.pep  RDAMITRSRMNVLKENDSIERITAYVIDTAHSRFPVIGEDKDEVLGILHAKDLLKYMFNP
              ||||||||||||||||||||||||||||||||||||||||||||||||||||||||||||
    a973      RDAMITRSRMNVLKENDSIERITAYVIDTAHSRFPVIGEDKDEVLGILHAKDLLKYMFNP
                    70         80         90        100        110        120

130        140        150        160        170        180
    m973.pep  EQFHLKSILSPAVFVPEGKSLTALLKEFREQRNHMAIVIDEYGGTSGLVTFEDIIEQIVG
              |||||||||:||||||||||||||||||||||||||||||||||||||||||||||||||
    a973      EQFHLKSILRPAVFVPEGKSLTALLKEFREQRNHMAIVIDEYGGTSGLVTFEDIIEQIVG
                   130        140        150        160        170        180

190        200        210        220        230        240
    m973.pep  EIEDEFDEDDSADNIHAVSSERWRIHAATEIEDINTFFGTEYSXEEADTIGGLVIQELGH
              :||||||||:|||||||||:|||||||||||||||:||||||| ||||||||||||||||
    a973      DIEDEFDEDESADNIHAVSAERWRIHAATEIEDINAFFGTEYGSEEADTIGGLVIQELGH
                   190        200        210        220        230        240

250        260        270
    m973.pep  LPVRGEKVLIGGLQFTVARADNRRLHTLMATRVKX
              |||||||||||||||||||||||||||||||||||
    a973      LPVRGEKVLIGGLQFTVARADNRRLHTLMATRVKX
                   250        260        270
```

The following partial DNA sequence was identified in *N. gonorrhoeae* <SEQ ID 2955>:

```
g981.seq
  1 ATGAAAAAAT GGATTGCCGC CGCCCTTGCC TGTTCCGCAC TCGCGCTGTC

51 TGCCTGCGGC GGTCAGGGCA AGATGCCGC CGCGCCTGCC GCCAACCCCG

101 GCAAAGTGTA CCGCGTGGCT TCCAACGCCG AGTTTGCCCC CTTTGAATCT

151 TTAGACTCGA AAGGCAATGT CGAAGGTTTC GACGTGGATT TGATGAACGC

201 GATGGCGAAG GCGGGCAATT TTAAAATCGA ATTCAAACAC CAGCCGTGGG
```

-continued
```
251 ACAGCCTTTT CCCCGCCTTG AACAACGGCG ATGCGGACGT TGTGATGTCG

301 GGCGTAACCA TTACCGACGA CCGCAAACAG TCTATGGATT TCAGCGACCC

351 GTATTTTGAA ATCACCCAAG TCGTCCTCGT TCCGAAAGGC AAAAAAGTAT

401 CTTCTTCCGA AGATTTGAAA AAGATGAACA AAGTCGGCGT GGTTACCGGC

451 CACACGGGCG ATTTCTCCGT TTCCAAACTC TTGGGCAACG ACAATCCGAA

501 AATCGCGCGC TTCGAAAACG TCCCCCTGAT TATCAAAGAA CTGGAAAACG

551 GCGGCTTGGA TTCCGTGGTC AGCGACAGCG CGGTCATCGC CAATTATGTG

601 AAAAACAACC CGGCCAAAGG AATGGACTTC GTTACCCTGC CCGACTTCAC

651 CACCGAACAC TACGGCATCG CGGTACGCAA AGGCGACGAA GCAACCGTCA

701 AAATGCTGAA CGATGCGTTG GAAAAGTAC GCGAAAGCGG CGAATACGAC

751 AAGATCTACG CCAAATATTT TGCCAAAGAG GGCGGACAGG CTGCGAAATA

801 A
```

This corresponds to the amino acid sequence <SEQ ID 2956; ORF 981.ng>:

```
g981.pep
  1 MKKWIAAALA CSALALSACG GQGKDAAAPA ANPGKVYRVA SNAEFAPFES

51 LDSKGNVEGF DVDLMNAMAK AGNFKIEFKH QPWDSLFPAL NNGDADVVMS

101 GVTITDDRKQ SMDFSDPYFE ITQVVLVPKG KKVSSSEDLK KMNKVGVVTG

151 HTGDFSVSKL LGNDNPKIAR FENVPLIIKE LENGGLDSVV SDSAVIANYV

201 KNNPAKGMDF VTLPDFTTEH YGIAVRKGDE ATVKMLNDAL EKVRESGEYD

251 KIYAKYFAKE GGQAAK*
```

The following partial DNA sequence was identified in *N. meningitidis* <SEQ ID 2957>:

```
m981.seq
  1 ATGAAAAAAT GGATTGCCGC CGCCCTTGCC TGTTCCGCGC TCGCGCTGTC

51 TGCCTGCGGC GGTCAGGGCA AAGATACCGC CGCGCCTGCC GCCAACCCCG

101 ACAAAGTGTA CCGCGTGGCT TCCAACGCCG AGTTTGCCCC CTTTGAATCT

151 TTAGACTCGA AAGGCAATGT CGAAGGTTTC GATGTGGATT TGATGAACGC

201 GATGGCGAAG GCGGGCAATT TTAAAATCGA ATTCAAACAC CAGCCGTGGG

251 ACAGCCTTTT CCCCGCCTTA AACAACGGCG ATGCGGACGT TGTGATGTCG

301 GGCGTAACCA TTACCGACGA CCGCAAACAG TCTATGGACT TCAGCGACCC

351 GTATTTTGAA ATCACCCAAG TCGTCCTCGT TCCGAAAGGC AAAAAAGTAT

401 CTTCTTCCGA AGATTTGAAA AACATGAACA AAGTCGGCGT GGTAACCGGC

451 TACACGGGCG ATTTCTCCGT ATCCAAACTC TTGGGCAACG ACAATCCGAA

501 AATCGCGCGC TTTGAAAACG TTCCCCTGAT TATCAAAGAA CTGGAAAACG

551 GCGGCTTGGA TTCCGTGGTC AGCGACAGCG CGGTCATCGC CAATTATGTG

601 AAAAACAATC CGGCCAAAGG GATGGACTTC GTTACCCTGC CCGACTTCAC

651 CACCGAACAC TACGGCATCG CGGTACGCAA AGGCGACGAA GCAACCGTCA

701 AAATGCTGAA CGATGCGTTG GAAAAGTAC GCGAAAGCGG CGAATACGAC
```

-continued
```
751 AAGATTTACG CCAAATATTT TGCAAAAGAA GACGGACAGG CCGCAAAATA

801 A
```

This corresponds to the amino acid sequence <SEQ ID 2958; ORF 981>:

```
m981.pep

1 MKKWIAAALA CSALALSACG GQGKDTAAPA ANPDKVYRVA SNAEFAPFES

51 LDSKGNVEGF DVDLMNAMAK AGNFKIEFKH QPWDSLFPAL NNGDADVVMS

101 GVTITDDRKQ SMDFSDPYFE ITQVVLVPKG KKVSSSEDLK NMNKVGVVTG

150 YTGDFSVSKL LGNDNPKIAR FENVPLIIKE LENGGLDSVV SDSAVIANYV

201 KNNPAKGMDF VTLPDFTTEH YGIAVRKGDE ATVKMLNDAL EKVRESGEYD

251 KIYAKYFAKE DGQAAK* m981/g981   98.1% identity in 266 aa overlap 10        20        30        40        50        60
       981.pep   MKKWIAAALACSALALSACGGQGKDTAAPAANPDKVYRVASNAEFAPFESLDSKGNVEGF
                 ||||||||||||||||||||||||||:|||||| ||||||||||||||||||||||||||
          g981   MKKWIAAALACSALALSACGGQGKDAAAPAANPDKVYRVASNAEFAPFESLDSKGNVEGF
                         10        20        30        40        50      60

70        80        90       100       110       120
       981.pep   DVDLMNAMAKAGNFKIEFKHQPWDSLFPALNNGDADVVMSGVTITDDRKQSMDFSDPYFE
                 ||||||||||||||||||||||||||||||||||||||||||||||||||||||||||||
          g981   DVDLMNAMAKAGMFKIEFKHQPWDSLFPALNNGDADVVMSGVTITDDRKQSMDFSDPYFE
                         70        80        90       100       110       120

130       140       150       160       170       180
       981.pep   ITQVVLVPKGKKVSSSEDLKNMNKVGVVTGYTGDFSVSKLLGNDNPKIARFENVPLIIKE
                 ||||||||||||||||||||||||||||||||||||||||:|||||||||||||||||||
          g981   ITQVVLVPKGKKVSSSEDLKNMNKVGVVTGYTGDFSVSKLLGNDNPKIARFENVPLIIKE
                        130       140       150       160       170       180

190       200       210       220       230       240
       981.pep   LENGGLDSVVSDSAVIANYVKNNPAKGMDFVTKPDFTTEHYGIAVRKGDEATVKMLNDAL
                 ||||||||||||||||||||||||||||||||||||||||||||||||||||||||||||
          g981   LENGGLDSVVSDSAVIANYVKNNPTKGMDFVTLPDFTTEHYGIAVRKGDEATVKMLNDAL
                        190       200       210       220       230       240

250       260
       981.pep   EKVRESGEYDKIYAKYFAKEDGQAAKX
                 |||||||||||||||||||| ||||||
          g981   KKVRESGEYDKIYAKYFAKEDGQAAKX
                        250       260
```

The following partial DNA sequence was identified in *N. meningitidis* <SEQ ID 2959>:

```
a981.seq
    1 ATGAAAAAAT GGATTGCCGC CGCCCTTGCC TGTTCCGCGC TCGCGCTGTC

51 TGCCTGCGGC GGTCAGGGTA AAGATGCCGC CGCGCCCGCC GCAAATCCCG

101 ACAAAGTGTA CCGCGTGGCT TCCAACGCCG AGTTTGCCCC CTTTGAATCT

151 TTAGACTCGA AAGGCAATGT CGAAGGTTTC GATGTGGATT TGATGAACGC

201 GATGGCGAAG GCGGGCAATT TTAAAATCGA ATTCAAACAC CAGCCGTGGG

251 ACAGCCTTTT CCCCGCCTTG AACAACGGCG ATGCGGACGT TGTGATGTCG

301 GGCGTAACCA TTACCGACGA CCGCAAACAG TCTATGGACT TCAGCGACCC

351 GTATTTTGAA ATCACCCAAG TCGTCCTCGT TCCGAAAGGC AAAAAAATAT

401 CTTCTTCCGA AGATTTGAAA AACATGAACA AAGTCGGCGT GGTAACCGGC

451 TACACGGGCG ATTTCTCCGT ATCCAAACTC TTGGGCAACG ACAACCCGAA

501 AATCGCGCGC TTTGAAAACG TTCCCCTGAT TATCAAAGAA CTGGAAACG
```

-continued
```
551 GCGGCTTGGA TTCCGTGGTC AGCGACAGCG CAGTCATCGC CAATTATGTG

601 AAAAACAATC CGACCAAAGG GATGGACTTC GTTACCCTGC CCGACTTCAC

651 CACCGAACAC TACGGCATCG CGGTACGCAA AGGCGACGAA GCAACCGTCA

701 AAATGCTGAA CGATGCGTTG AAAAAAGTAC GCGAAAGCGG CGAATACGAC

751 AAAATCTACG CCAAATATTT TGCAAAAGAA GACGGACAGG CCGCAAAATA

801 A
```

This corresponds to the amino acid sequence <SEQ ID 2960; ORF 981.a>:

```
a981.pep
  1 MKKWIAAALA CSALALSACG GQGKDAAAPA ANPDKVYRVA SNAEFAPFES

51 LDSKGNVEGF DVDLMNAMAK AGNFKIEFKH QPWDSLFPAL NNGDADVVMS

101 GVTITDDRKQ SMDFSDPYFE ITQVVLVPKG KKISSSEDLK NMNKVGVVTG

151 YTGDFSVSKL LGNDNPKIAR FENVPLIIKE LENGGLDSVV SDSAVIANYV

201 KNNPTKGMDF VTLPDFTTEH YGIAVRKGDE ATVKMLNDAL KKVRESGEYD

251 KIYAKYFAKE DGQAAK*
``` m981/a981 98.5% identity in 266 aa overlap

```
                  10         20         30         40         50         60
    m981.pep  MKKWIAAALACSALALSACGGQGKDTAAPAANPDKVYRVASNAEFAPFESLDSKGNVEGF
              ||||||||||||||||||||||||:||||||||||||||||||||||||||||||||||
    a981      MKKWIAAALACSALALSACGGQGKDAAAPAANPDKVYRVASNAEFAPFESLDSKGNVEGF
                  10         20         30         40         50         60

70         80         90        100        110        120
    m981.pep  DVDLMNAMAKAGNFKIEFKHQPWDSLFPALNNGDADVVMSGVTITDDRKQSMDFSDPYFE
              ||||||||||||||||||||||||||||||||||||||||||||||||||||||||||||
    a81       DVDLMNAMAKAGMFKIEFKHQPWDSLFPALNNGDADVVMSGVTITDDRKQSMDFSDPYFE
                  70         80         90        100        110        120

130        140        150        160        170        180
    m981.pep  ITQVVLVPKGKKVSSSEDLKNMNKVGVVTGYTGDFSVSKLLGNDNPKIARFENVPLIIKE
              ||||||||||||:|||||||||||||||||||||||||||||||||||||||||||||||
    a981      ITQVVLVPKGKKVSSSEDLKNMNKVGVVTGYTGDFSVSKLLGNDNPKIARFENVPLIIKE
                 130        140        150        160        170        180

190        200        210        220        230        240
    m981.pep  LENGGLDSVVSDSAVIANYVKNNPAKGMDFVTKPDFTTEHYGIAVRKGDEATVKMLNDAL
              |||||||||||||||||||||||||:||||||||||||||||||||||||||||||||||
    a981      LENGGLDSVVSDSAVIANYVKNNPTKGMDFVTLPDFTTEHYGIAVRKGDEATVKMLNDAL
                 190        200        210        220        230        240

250        260
    m981.pep  EKVRESGEYDKIYAKYFAKEDGQAAKX
              :||||||||||||||||||||||||||
    a981      KKVRESGEYDKIYAKYFAKEDGQAAKX
                 250        260
```

The following partial DNA sequence was identified in *N. gonorrhoeae* <SEQ ID 2961>:

```
g982.seq
  1 atcgcatcgc aaaaccttcg attcgacaat cgattcctcc aaaaaatggt 51 caacggcgTg aatattttgc cggccgcCga ttgggtagcC ttgGGcgcCA

101 AAGGCCGCAA CGTGGTGGTT GACCGCGCTT TCGGCGGCCC GCACATCACC

151 AAAGACGGCG TAACCGTCGC CAAAGAAATC GAACTGAAAG ACAAGTTTGA

201 AAATATGGGC GCGCAAATGG TAAAAGAAGT CGCGTCCAAA ACCAAcgaCg 251 tagCCGgcga cggtacgact accgCCACCG TATTGGCACA ATCCATCGTT 301 GCCGAAggcA TGAAATACGT TACCGCCGGC ATGAACCCGA CCGATCTGAA
```

-continued

```
 351 ACGCGGCATC GACAAAGccg ttgCCGCTtt ggttgAAGAg cTGAAAAACA

401 TCGCCAAACC TTGCGATACT TCCAAAGAAA TCGCCCAAGT CGGCTCGATT

451 TCCGCCAACT CCGACGAACA AGtcgGCGCG ATTATCGCCG AAGCGATGGA

501 AAAAGTCGGC AAAGAAGgcg tgattacCGT TGAAGACGGC AAATCTTTGG

551 AAAACGAGCT GGACGTGGTT GAAGGTATGC AGTTCGACCG CGGCTACCTG

601 TCCCCTTACT TTATCAACGA CGCGGAAAAA CAAATCGCCG GTCTGGACAA

651 TCCGTTTGTT TTGCTGTTCG ACAAAAAAAT CAGCAACATC CGCGACCTGC

701 TGCCCGTGTT GGAACAAGTG GCGAAAGCCA GCCGCCCGCT GTTGATTATC

751 GCTGAAGACG TAGAAGGCGA AGCCTTGGCG ACTTTGGTCG TGAACAACAT

801 CCGCGGCATC CTGAAAACCG TTGCCGTCAA AGCccccggc tTCGGcGACC

851 GCCGCAAAGC GATgctgcaa gaCATCGCCA TCCTGACcgg cggcgTagtG

901 ATTtccGAAG Aagtcggcct GTCTTTGGAA AAAgcgactT TGgacgaCTT

951 Gggtcaaacc aaACGcatCG AAATCGGtga agaaaacact ACCGTCATcg 1001 acgGCTTCGG CGACGcagcC CAAAtcgaag cgCGTGTTGC CGAAATCCGC

1051 CAACAAATCG AAACCGCGAC CAGCGATTAC GACAAAGAAA ACTGCAAGA

1101 GCGCGTTGCC AAACTGGCAG GAGGCGTGGC AGTGATCAAA GTCGGCGCGG

1151 CGACCGAAGT CGAAATGAAA GAGAAAAAAG ACCGCGTGGA AGACGCGCTG

1201 CACGCTACCC GCGCAGCCGT TGAAGAAGGC GTGGTTGCAG CGGCGGCGT

1251 AGCCCTGTTG CGCGCCCGTG CCGCTTTGGA AAACCTGCAC ACCGGCAATG

1301 CCGACCAAGA CGCAGGCGTA CAAATCGTAT TGCGCGCCGT TGAGTCTCCG

1351 CTGCGCCAAA TCGTTGCCAA CGCAGGCGGA GAACCCAGCG TGGTGGTGAA

1401 CAAAGTGTTG GAAGGCAAAG GCAActacgG TTACAACGCa ggctcCGGCG

1451 AATACGgcga CATGATCGGA ATGGGCGTAC TCGACCCTGC CAAAGTAACC

1501 CGTTCCGCGC TGCAACACGC CGCGTCTAtC GCCGGTCTGA TGCTGACGAC

1551 CGACTGCATG ATTGCCGAAA TCCCTGAAGA AAACCGGCT GTGCCCGATA

1601 TGGGGGGAAT GGGCGGTATG GGCGGCATGA TGTAA
```

This corresponds to the amino acid sequence <SEQ ID 2962; ORF 982.ng>:

```
g982.pep
  1 IASQNLRFDN RFLQKMVNGV NILPAADWVA LGAKGRNVVV DRAFGGPHIT

51 KDGVTVAKEI ELKDKFENMG AQMVKEVASK TNDVAGDGTT TATVLAQSIV

101 AEGMKYVTAG MNPTDLKRGI DKAVAALVEE LKNIAKPCDT SKEIAQVGSI

151 SANSDEQVGA IIAEAMEKVG KEGVITVEDG KSLENELDVV EGMQFDRGYL

201 SPYFINDAEK QIAGLDNPFV LLFDKKISNI RDLLPVLEQV AKASRPLLII

251 AEDVEGEALA TLVVNNIRGI LKTVAVKAPG FGDRRKAMLQ DIAILTGGVV

301 ISEEVGLSLE KATLDDLGQT KRIEIGEENT TVIDGFGDAA QIEARVAEIR

351 QQIETATSDY DKEKLQERVA KLAGGVAVIK VGAATEVEMK EKKDRVEDAL

401 HATRAAVEEG VVAGGGVALL RARAALENLH TGNADQDAGV QIVLRAVESP

451 LRQIVANAGG EPSVVVNKVL EGKGNYGYNA GSGEYGDMIG MGVLDPAKVT

501 RSALQHAASI AGLMLTTDCM IAEIPEEKPA VPDMGGMGGM GGMM*
```

The following partial DNA sequence was identified in *N. meningitidis* <SEQ ID 2963>:

```
m982.seq
     1 ATGGCAGCAA AAGACGTACA GTTCGGCAAT GAAGTCCGTC AAAAAATGGT
    51 AAACGGCGTG AACATTCTGG CAAACGCCGT CCGCGTAACC TTGGGCCCCA
   101 AAGGTCGCAA CGTAGTCGTT GACCGCGCAT TCGGCGGCCC GCACATCACC
   151 AAAGACGGCG TAACCGTCGC CAAAGAAATC GAACTGAAAG ACAAGTTTGA
   201 AAATATGGGC GCGCAAATGG TGAAAGAAGT TGCGTCCAAA ACCAACGACG
   251 TGGCAGGCGA CGGTACGACT ACCGCCACCG TACTGGCGCA ATCCATCGTT
   301 GCCGAAGGTA TGAAATATGT TACCGCAGGT ATGAATCCGA CCGACCTGAA
   351 ACGCGGTATC GATAAAGCCG TCGCCGCTTT GGTTGACGAA CTGAAAAACA
   401 TCGCCAAACC TTGCGACACT TCTAAAGAAA TCGCCCAAGT CGGCTCTATT
   451 TCCGCCAACT CCGACGAACA AGTCGGCGCG ATTATCGCCG AAGCGATGGA
   501 AAAAGTCGGC AAAGAAGGCG TGATTACCGT TGAAGACGGC AAGTCTTTGG
   551 AAAACGAGCT GGACGTAGTT GAAGGTATGC AGTTCGACCG CGGCTACCTG
   601 TCTCCTTACT TCATCAACGA TGCGGAAAAA CAAATCGCTG CTTTGGACAA
   651 TCCGTTTGTA TTGTTGTTCG ACAAAAAAAT CAGCAACATC CGCGACCTGC
   701 TGCCTGTTTT GGAACAAGTG GCAAAAGCCA GCCGTCCGCT GTTGATTATC
   751 GCTGAAGACG TAGAAGGCGA AGCCTTGGCG ACTTTGGTCG TGAACAACAT
   801 CCGAGGCATC CTGAAAACCG TTGCCGTCAA AGCCCCTGGC TTCGGCGACC
   851 GCCGCAAAGC GATGTTGCAA GACATCGCCA TCCTGACCGG CGGCGTGGTG
   901 ATTTCCGAAG AAGTCGGTCT GTCTTTGGAA AAAGCGACTT TGGACGACTT
   951 GGGTCAAGCC AAACGCATCG AAATCGGTAA AGAAAACACC ACCATCATCG
  1001 ACGGCTTTGG CGACGCAGCC CAAATCGAAG CGCGTGTTGC CGAAATCCGC
  1051 CAACAAATCG AAACCGCAAC CAGCGATTAC GACAAAGAAA AACTGCAAGA
  1101 GCGCGTGGCT AAATTGGCAG GCGGCGTGGC AGTCATCAAA GTCGGTGCCG
  1151 CGACCGAAGT CGAAATGAAA GAGAAAAAAG ACCGCGTGGA AGACGCGCTG
  1201 CACGCTACCC GCGCAGCCGT TGAAGAAGGC GTGGTTGCAG GCGGCGGCGT
  1251 AGCCCTGTTG CGTGCCCGTG CTGCTTTGGA AAACCTGCAC ACCGGCAATG
  1301 CCGACCAAGA CGCAGGCGTA CAAATCGTCT TGCGCGCCGT TGAGTCTCCG
  1351 CTGCGCCAAA TCGTTGCCAA CGCAGGCGGC GAACCCAGCG TGGTTGTGAA
  1401 CAAAGTATTG GAAGGCAAAG GCAACTACGG TTACAACGCT GGCAGCGGCG
  1451 AATACGGCGA TATGATCGAA ATGGGCGTAC TCGACCCCGC CAAAGTAACC
  1501 CGTTCTGCGC TGCAACACGC CGCATCTATC GCCGGCTTGA TGCTGACCAC
  1551 TGATTGCATG ATCGCTGAAA TCCCCGAAGA CAAACCGGCT GTGCCTGATA
  1601 TGGGCGGCAT GGGTGGTATG GGCGGCATGA TGTAA
```

This corresponds to the amino acid sequence <SEQ ID 2964; ORF 982>:

```
m982.seq
   1  ATGGCAGCAA AAGACGTACA GTTCGGCAAT GAAGTCCGTC AAAAAATGGT
  51  AAACGGCGTG AACATTCTGG CAAACGCCGT CCGCGTAACC TTGGGCCCCA
```

```
 101 AAGGTCGCAA CGTAGTCGTT GACCGCGCAT TCGGCGGCCC GCACATCACC

151 AAAGACGGCG TAACCGTCGC CAAAGAAATC GAACTGAAAG ACAAGTTTGA

201 AAATATGGGC GCGCAAATGG TGAAAGAAGT TGCGTCCAAA ACCAACGACG

251 TGGCAGGCGA CGGTACGACT ACCGCCACCG TACTGGCGCA ATCCATCGTT

301 GCCGAAGGTA TGAAATATGT TACCGCAGGT ATGAATCCGA CCGACCTGAA

351 ACGCGGTATC GATAAAGCCG TCGCCGCTTT GGTTGACGAA CTGAAAAACA

401 TCGCCAAACC TTGCGACACT TCTAAAGAAA TCGCCCAAGT CGGCTCTATT

451 TCCGCCAACT CCGACGAACA AGTCGGCGCG ATTATCGCCG AAGCGATGGA

501 AAAAGTCGGC AAAGAAGGCG TGATTACCGT TGAAGACGGC AAGTCTTTGG

551 AAAACGAGCT GGACGTAGTT GAAGGTATGC AGTTCGACCG CGGCTACCTG

601 TCTCCTTACT TCATCAACGA TGCGGAAAAA CAAATCGCTG CTTTGGACAA

651 TCCGTTTGTA TTGTTGTTCG ACAAAAAAAT CAGCAACATC CGCGACCTGC

701 TGCCTGTTTT GGAACAAGTG GCAAAAGCCA GCCGTCCGCT GTTGATTATC

751 GCTGAAGACG TAGAAGGCGA AGCCTTGGCG ACTTTGGTCG TGAACAACAT

801 CCGAGGCATC CTGAAAACCG TTGCCGTCAA AGCCCCTGGC TTCGGCGACC

851 GCCGCAAAGC GATGTTGCAA GACATCGCCA TCCTGACCGG CGGCGTGGTG

901 ATTTCCGAAG AAGTCGGTCT GTCTTTGGAA AAAGCGACTT TGGACGACTT

951 GGGTCAAGCC AAACGCATCG AAATCGGTAA AGAAAACACC ACCATCATCG

1001 ACGGCTTTGG CGACGCAGCC CAAATCGAAG CGCGTGTTGC CGAAATCCGC

1051 CAACAAATCG AAACCGCAAC CAGCGATTAC GACAAAGAAA ACTGCAAGA

1101 GCGCGTGGCT AAATTGGCAG GCGGCGTGGC AGTCATCAAA GTCGGTGCCG

1151 CGACCGAAGT CGAAATGAAA GAGAAAAAAG ACCGCGTGGA AGACGCGCTG

1201 CACGCTACCC GCGCAGCCGT TGAAGAAGGC GTGGTTGCAG CGGCGGCGT

1251 AGCCCTGTTG CGTGCCCGTG CTGCTTTGGA AAACCTGCAC ACCGGCAATG

1301 CCGACCAAGA CGCAGGCGTA CAAATCGTCT TGCGCGCCGT TGAGTCTCCG

1351 CTGCGCCAAA TCGTTGCCAA CGCAGGCGGC GAACCCAGCG TGGTTGTGAA

1401 CAAAGTATTG GAAGGCAAAG GCAACTACGG TTACAACGCT GGCAGCGGCG

1451 AATACGGCGA TATGATCGAA ATGGGCGTAC TCGACCCCGC CAAAGTAACC

1501 CGTTCTGCGC TGCAACACGC CGCATCTATC GCCGGCTTGA TGCTGACCAC

1551 TGATTGCATG ATCGCTGAAA TCCCCGAAGA CAAACCGGCT GTGCCTGATA

1601 TGGGCGGCAT GGGTGGTATG GGCGGCATGA TGTAA
```

Computer analysis of this amino acid sequence gave the following results:

Homology with a Predicted ORF from *N. gonorrhoeae*

```
   m982/g982  95.8% identity in 544 aa overlap 10        20        30        40        50        60
   m982.pep  MAAKDVQFGNEVRQKMVNGVNILANAVRVTLGPKGRNVVVDRAFGGPHITKDGVTVAKEI
             :|:::::| |:  |||||||||| |   |:||  ||||||||||||||||||||||||||
   g982      IASQNLRFDNRFLQKMVNGVNILPAADWVALGAKGRNVVVDRAFGGPHITKDGVTVAKEI
                    10        20        30        40        50        60

70        80        90       100       110       120
   m982.pep  ELKDKFENMGAQMVKEVASKTNDVAGDGTTTATVLAQSIVAEGMKYVTAGMNPTDLKRGI
             ||||||||||||||||||||||||||||||||||||||||||||||||||||||||||||
   g982      ELKDKFENMGAQMVKEVASKTNDVAGDGTTTATVLAQSIVAEGMKYVTAGMNPTDLKRGI
                    70        80        90       100       110       120
```

-continued

```
                130       140       150       160       170       180
m982.pep    DKAVAALVDELKNIAKPCDTSKEIAQVGSISANSDEQVGAIIAEAMEKVGKEGVITVEDG
            ||||||||:|||||||||||||||||||||||||||||||||||||||||||||||||||
g982        DKAVAALVEELKNIAKPCDTSKEIAQVGSISANSDEQVGAIIAEAMEKVGKEGVITVEDG
                130       140       150       160       170       180

190       200       210       220       230       240
m982.pep    KSLENELDVVEGMQFDRGYLSPYFINDAEKQIAALDNPFVLLFDKKISNIRDLLPVLEQV
            |||||||||||||||||||||||||||||||||:||||||||||||||||||||||||||
g982        KSLENELDVVEGMQFDRGYLSPYFINDAEKQIAGLDNPFVLLFDKKISNIRDLLPVLEQV
                190       200       210       220       230       240

250       260       270       280       290       300
m982.pep    AKASRPLLIIAEDVEGEALATLVVNNIRGILKTVAVKAPGFGDRRKAMLQDIAILTGGVV
            ||||||||||||||||||||||||||||||||||||||||||||||||||||||||||||
g982        AKASRPLLIIAEDVEGEALATLVVNNIRGILKTVAVKAPGFGDRRKAMLQDIAILTGGVV
                250       260       270       280       290       300

310       320       330       340       350       360
m982.pep    ISEEVGLSLEKATLDDLGQAKRIEIGKENTTIIDGFGDAAQIEARVAEIRQQIETATSDY
            |||||||||||||||||||:||||||||:||||:|||||||||||||||||||||||||||
g982        ISEEVGLSLEKATLDDLGQTKRIEIGEENTTVIDGFGDAAQIEARVAEIRQQIETATSDY
                310       320       330       340       350       360

370       380       390       400       410       420
m982.pep    DKEKLQERVAKLAGGVAVIKVGAATEVEMKEKKDRVEDALHATRAAVEEGVVAGGGVALL
            ||||||||||||||||||||||||||||||||||||||||||||||||||||||||||||
g982        DKEKLQERVAKLAGGVAVIKVGAATEVEMKEKKDRVEDALHATRAAVEEGVVAGGGVALL
                370       380       390       400       410       420

430       440       450       460       470       480
m982.pep    RARAALENLHTGNADQDAGVQIVLRAVESPLRQIVANAGGEPSVVVNKVLEGKGNYGYNA
            ||||||||||||||||||||||||||||||||||||||||||||||||||||||||||||
g982        RARAALENLHTGNADQDAGVQIVLRAVESPLRQIVANAGGEPSVVVNKVLEGKGNYGYNA
                430       440       450       460       470       480

490       500       510       520       530       540
m982.pep    GSGEYGDMIEMGVLDPAKVTRSALQHAASIAGLMLTTDCMIAEIPEDKPAVPDMGGMGGM
            ||||||||||:|||||||||||||||||||||||||||||||||:|||||||||||||||
g982        GSGEYGDMIGMGVLDPAKVTRSALQHAASIAGLMLTTDCMIAEIPEEKPAVPDMGGMGGM
                490       500       510       520       530       540 m982.pep    GGMMX
            |||||
g982        GGMMX
```

The following partial DNA sequence was identified in *N. meningitidis* <SEQ ID 2965>:

```
a982.seq
  1  ATGGCAGCAA AAGACGTACA ATTCGGCAAT GAAGTCCGCC AAAAAATGGT

51  AAACGGCGTG AACATTTTGG CAAACGCCGT GCGCGTAACC TTGGGTCCCA

101  AAGGCCGCAA CGTGGTGGTT GACCGCGCTT TCGGCGGCCC GCACATCACC

151  AAAGACGGCG TAACCGTCGC CAAAGAAATC GAACTGAAAG ACAAGTTTGA

201  AAATATGGGC GCGCAAATGG TGAAAGAAGT CGCCGTCCAA ACCAACGACG

251  TGGCGGGCGA CGGTACGACT ACCGCCACCG TATTGGCGCA ATCCATCGTT

301  GCCGAAGGTA TGAAATACGT TACCGCCGGT ATGAACCCGA CCGACCTGAA

351  ACGCGGTATC GACAAAGCCG TCGCCGCTTT GGTTGAAGAG CTGAAAACA

401  TCGCCAAACC TTGCGACACT TCTAAAGAAA TCGCCCAAGT CGGCTCTATT

451  TCCGCCAACT CTGACGAACA AGTCGGCGCG ATTATTGCCG AAGCGATGGA

501  AAAAGTCGGC AAAGAAGGCG TGATTACCGT TGAAGACGGC AAATCTTTGG

551  AAAACGAGCT GGACGTGGTT GAAGGTATGC AATTCGACCG CGGCTACCTG

601  TCTCCTTACT TCATCAACGA TGCGGAAAAA CAAATCGCCG GCTTGGACAA

651  TCCGTTTGTA TTGCTGTTCG ACAAAAAAAT CAGCAATATC CGCGACCTGC

701  TGCCTGTTTT GGAACAAGTG GCCAAAGCCA GCCGTCCGCT GTTGATTATC

751  GCTGAAGACG TAGAAGGCGA AGCCTTGGCG ACTTTGGTCG TGAACAACAT

801  CCGCGGCATT CTGAAAACCG TTGCCGTTAA AGCTCCGGGC TTCGGCGACC
```

```
 851 GCCGCAAAGC GATGCTGCAA GACATCGCTA TCCTGACCGG CGGCACAGTG

901 ATTTCCGAAG AAGTCGGCCT GTCTTTGGAA AAAGCGACTT TGGACGACTT

951 GGGTCAGGCC AAACGCATCG AAATCGGTAA AGAAACACC ACCATCATCG

1001 ACGGCTTCGG CGACGCAGCC CAAATCGAAG CGCGTGTTGC CGAAATCCGC

1051 CAACAAATCG AAACCGCAAC CAGCGATTAC GACAAAGAAA AACTGCAAGA

1101 GCGCGTTGCC AAACTGGCAG GCGGCGTGGC AGTAATCAAA GTCGGTGCCG

1151 CGACCGAAGT GGAAATGAAA GAGAAAAAG ACCGCGTGGA AGACGCGCTG

1201 CACGCTACCC GCGCAGCCGT TGAAGAAGGC GTGGTTGCAG GCGGCGGCGT

1251 AGCCCTGTTG CGCGCCCGTG CCGCTCTGGA AAACCTGCAC ACCGGCAATG

1301 CAGACCAAGA CGCAGGCGTA CAAATCGTCT TGCGCGCCGT TGAGTCTCCG

1351 CTGCGCCAAA TCGTTGCCAA CGCAGGCGGC GAACCCAGCG TGGTTGTGAA

1401 CAAAGTGTTG GAAGGCAAAG GCAACTATGG TTACAACGCT GGCAGCGGCG

1451 AATACGGCGA CATGATCGAA ATGGGCGTAC TCGACCCCGC CAAAGTAACC

1501 CGTTCCGCGC TGCAACACGC CGCGTCTATC GCCGGCCTGA TGCTGACCAC

1551 AGACTGCATG ATTGCTGAAA TCCCTGAAGA CAAACCGGCT ATGCCTGATA

1601 TGGGCGGCAT GGGTGGTATG GGCGGCATGA TGTAA
```

This corresponds to the amino acid sequence <SEQ ID 2966; ORF 982.a>:

```
a982.pep

1   MAAKDVQFGN EVRQKMVNGV NILANAVRVT LGPKGRNVVV DRAFGGPHIT

51   KDGVTVAKEI ELKDKFENMG AQMVKEVASK TNDVAGDGTT TATVLAQSIV

101   AEGMKYVTAG MNPTDLKRGI DKAVAALVEE LKNIAKPCDT SKEIAQVGSI

151   SANSDEQVGA IIAEAMEKVG KEGVITVEDG KSLENELDVV EGMQFDRGYL

201   SPYFINDAEK QIAGLDNPFV LLFDKKISNI RDLLPVLEQV AKASRPLLII

251   AEDVEGEALA TLVVNNIRGI LKTVAVKAPG FGDRRKAMLQ DIAILTGGTV

301   ISEEVGLSLE KATLDDLGQA KRIEIGKENT TIIDGFGDAA QIEARVAEIR

351   QQIETATSDY DKEKLQERVA KLAGGVAVIK VGAATEVEMK EKKDRVEDAL

401   HATRAAVEEG VVAGGGVALL RARAALENLH TGNADQDAGV QIVLRAVESP

451   LRQIVANAGG EPSVVVNKVL EGKGNYGYNA GSGEYGDMIE MGVLDPAKVT

501   RSALQHAASI AGLMLTTDCM IAEIPEDKPA MPDMGGMGGM GGM* m982/a982 99.3% identity in 544 aa overlap
                 10         20         30         40         50         60
m982.pep  MAAKDVQFGNEVRQKMVNGVNILANAVRVTLGPKGRNVVVDRAFGGPHITKDGVTVAKEI
          ||||||||||||||||||||||||||||||||||||||||||||||||||||||||||||
a982      MAAKDVQFGNEVRQKMVNGVNILANAVRVTLGPKGRNVVVDRAFGGPHITKDGVTVAKEI
                 10         20         30         40         50         60

70         80         90        100        110        120
m982.pep  ELKDKFENMGAQMVKEVASKTNDVAGDGTTTATVLAQSIVAEGMKYVTAGMNPTDLKRGI
          ||||||||||||||||||||||||||||||||||||||||||||||||||||||||||||
a982      ELKDKFENMGAQMVKEVASKTNDVAGDGTTTATVLAQSIVAEGMKYVTAGMNPTDLKRGI
                 70         80         90        100        110        120

130        140        150        160        170        180
m982.pep  DKAVAALVDELKNIAKPCDTSKEIAQVGSISANSDEQVGAIIAEAMEKVGKEGVITVEDG
          ||||||||:|||||||||||||||||||||||||||||||||||||||||||||||||||
a982      DKAVAALVEELKNIAKPCDTSKEIAQVGSISANSDEQVGAIIAEAMEKVGKEGVITVEDG
                130        140        150        160        170        180
```

```
                  190        200        210        220        230        240
m982.pep  KSLENELDVVEGMQFDRGYLSPYFINDAEKQIAALDNPFVLLFDKKISNIRDLLPVLEQV
          ||||||||||||||||||||||||||||||||:|||||||||||||||||||||||||||
a982      KSLENELDVVEGMQFDRGYLSPYFINDAEKQIAGLDNPFVLLFDKKISNIRDLLPVLEQV
                  190        200        210        220        230        240

250        260        270        280        290        300
m982.pep  AKASRPLLIIAEDVEGEALATLVVNNIRGILKTVAVKAPGFGDRRKAMLQDIAILTGGVV
          |||||||||||||||||||||||||||||||||||||||||||||||||||||||||:|
a982      AKASRPLLIIAEDVEGEALATLVVNNIRGILKTVAVKAPGFGDRRKAMLQDIAILTGGTV
                  250        260        270        280        290        300

310        320        330        340        350        360
m982.pep  ISEEVGLSLEKATLDDLGQAKRIEIGKENTTIIDGFGDAAQIEARVAEIRQQIETATSDY
          ||||||||||||||||||||||||||||||||||||||||||||||||||||||||||||
a982      ISEEVGLSLEKATLDDLGQAKRIEIGKENTTIIDGFGDAAQIEARVAEIRQQIETATSDY
                  310        320        330        340        350        360

370        380        390        400        410        420
m982.pep  DKEKLQERVAKLAGGVAVIKVGAATEVEMKEKKDRVEDALHATRAAVEEGVVAGGGVALL
          ||||||||||||||||||||||||||||||||||||||||||||||||||||||||||||
a982      DKEKLQERVAKLAGGVAVIKVGAATEVEMKEKKDRVEDALHATRAAVEEGVVAGGGVALL
                  370        380        390        400        410        420

430        440        450        460        470        480
m982.pep  RARAALENLHTGNADQDAGVQIVLRAVESPLRQIVANAGGEPSVVVNKVLEGKGNYGYNA
          ||||||||||||||||||||||||||||||||||||||||||||||||||||||||||||
a982      RARAALENLHTGNADQDAGVQIVLRAVESPLRQIVANAGGEPSVVVNKVLEGKGNYGYNA
                  430        440        450        460        470        480

490        500        510        520        530        540
m982.pep  GSGEYGDMIEMGVLDPAKVTRSALQHAASIAGLMLTTDCMIAEIPEDKPAVPDMGGMGGM
          |||||||||||||||||||||||||||||||||||||||||||||||:||||||||||||
a982      GSGEYGDMIEMGVLDPAKVTRSALQHAASIAGLMLTTDCMIAEIPEDKPAMPDMGGMGGM
                  490        500        510        520        530        540 m982.pep  GGMMX
          |||||
a982      GGMMX
```

30

The following partial DNA sequence was identified in *N. gonorrhoeae* <SEQ ID 2967>:

```
g986.seq
   1  GTGTTCAAAA AATACCAATA CTTCGCTTTG CGGCACTGT  GTGCCGCCTT

51  GCTGGCAGGC TGCGAAAAGG CAGGCAGCTT TTTCGGTGCG GACAAAAAAG

101  AAGCATCCTT CGTAGAACGC ATCGAACACA CCAAAGACGA CGGCAGTGTC

151  AGTATGCTGC TGCCCGACTT TGCCCAACTG GTTCAAAGCG AAGGCCCGGC

201  AGTCGTCAAT ATTCAGGCAG CCCCCGCCCC GCGCACCCAA AACGGCAGCG

251  GCAATGCCGA AACCGATTCC GACCCGCTTG CCGACAGCGA CCCGTTCTAC

301  GAATTTTTCA AACGCCTCGT CCCGAACATG CCCGAAATCC CCCAAGAAGA

351  AGCAGATGAC GGCGGATTGA ACTTCGGTTC GGGCTTCATC ATCAGCAAAA

401  ACGGCTACAT CCTGACCAAT ACCCACGTCG TTGCCGGTAT GGGCAGTATC

451  AAAGTCCTGC TCAACGACAA GCGCGAATAT ACCGCCAAAC TCATCGGTTC

501  GGATGTCCAA TCCGATGTCG CCCTTCTGAA ATCGACGCA  ACGGAAGAGC

551  TACCCGTCGT CAAAATCGGC AATCCCAAAA ATTTGAAACC GGGCGAATGG

601  GTCGCTGCCA TCGGCGCGCC CTTCGGCTTT GACAACAGCG TGACCGCCGG

651  CATCGTGTCC GCCAAAGGCA GAAGCCTGCC CAACGAAAgc tACACACCCT

701  TCATCCAAAC CGACGTTGCC ATCAATCCGG GCAATTCCGG CGGCCCGCTG

751  TTCAACTTAA AAGGACAGGt cgTCGGCATC AATTCGCAAA TATACAGCCG

801  CAGCGgcgga ttCATGGGCA TCTCCTTTGC CATCCCGATT GACGTTGCCA

851  TGAATGTCGC CGACACAGCTG AAAAACACCG GCAAAGTCCA ACGCGGACAA

901  CTGGGCGTGA TTATTCAGGA AGTATCCTAC GGTTTGGCAC AGTCGTTCGG

951  TCTGGATAAA GCCAGCGGCG CATTGATTGC CAAAATCCTT CCCGGCAGCC
```

-continued

```
1001 CCGCAGAACG TGCCGGCCTG CAGGCGGGCG ACATCGTCCT CAGCCTCGAC

1051 GGCGGAGAAA TACGTTCTTC CGGCGACCTT CCCGTCATGG TCGGCGCCAT

1101 TACGCCGGGA AAAGAAGTCA GCCTCGGCGT ATGGCGCAAA GGCGAAGAAA

1151 TCACAATCAA AGCCAAGCTG GCAACGCCg ccgagcATAC CGGCgcatCA

1201 TCCAAAACAG ATGAAgcccc ctacaccgAA CAGCAATCCG GTACGTTCTC

1251 GGTCGAATCC GCAGGCATTA CCCTTCAGAC ACATACCGAC AGCAGCGGca 1301 aacacctcgt cgtcgtacgg gtttccgacg cggcagaacg cGCAGGCTTA 1351 AGgcgcggcg acgaaatcct cgcggtcggg caagtccccg tcaatgacga 1401 agccgGTTTC cgcaaaGCTA TGGACAAGGC AGGCAAAAAC GTCCCCCTGC 1451 TGGTCAtgcg ccgTGGCAAC ACGCTGTTCA TCGCATTAAA CCTGCAATAA
```

This corresponds to the amino acid sequence <SEQ ID 2968; ORF 986.ng>:

```
g986.pep
   1 VFKKYQYFAL AALCAALLAG CEKAGSFFGA DKKEASFVER IEHTKDDGSV

51 SMLLPDFAQL VQSEGPAVVN IQAAPAPRTQ NGSGNAETDS DPLADSDPFY

101 EFFKRLVPNM PEIPQEEADD GGLNFGSGFI ISKNGYILTN THVVAGMGSI

151 KVLLNDKREY TAKLIGSDVQ SDVALLKIDA TEELPVVKIG NPKNLKPGEW

201 VAAIGAPFGF DNSVTAGIVS AKGRSLPNES YTPFIQTDVA INPGNSGGPL

251 FNLKGQVVGI NSQIYSRSGG FMGISFAIPI DVAMNVAEQL KNTGKVQRGQ

301 LGVIIQEVSY GLAQSFGLDK ASGALIAKIL PGSPAERAGL QAGDIVLSLD

351 GGEIRSSGDL PVMVGAITPG KEVSLGVWRK GEEITIKAKL GNAAEHTGAS

401 SKTDEAPYTE QQSGTFSVES AGITLQTHTD SSGKHLVVVR VSDAAERAGL

451 RRGDEILAVG QVPVNDEAGF RKAMDKAGKN VPLLVMRRGN TLFIALNLQ*
```

The following partial DNA sequence was identified in N. meningitidis <SEQ ID 2969>:

```
m986.seq
   1 GTGTTCAAAA AATACCAATA CCTCGCTTTG GCAGCACTGT GTGCAGCCTC

51 GCTGGCAGGC TGCGACAAGG CAGGCAGCTT CTTCGTGGCG GACAAAAAAG

101 AAGCATCCTT CGTAGAACGC ATCGAACACA CCAAAGACGA CGGCAGCGTC

151 AGTATGCTGC TGCCCGACTT TGCCCAACTG GTTCAAAGTG AAGGTCCGGC

201 AGTCGTCAAT ATTCAGGCAG CCCCCGCCCC GCGCACCCAA AACGGCAGCG

251 GCAATGCCGA AACGGATTCC GACCCGATTG CCGACAACGA CCCGTTCTAC

301 GAATTTTTCA AACGCCTCGT CCCGAATATG CCCGAAATCC CCAAGAAGA

351 AGCAGATGAC GGCGGATTGA ACTTCGGTTC GGGCTTCATC ATCAGCAAAG

401 ACGGCTACAT CCTGACCAAT ACCCACGTCG TTACCGGCAT GGGCAGTATC

451 AAAGTCCTGC TCAACGACAA GCGCGAATAT ACCGCCAAAC TCATCGGTTC

501 GGATGTCCAA TCCGATGTCG CCCTTCTGAA AATCGACGCA ACGGAAGAGC

551 TGCCCGTCGT CAAAATCGGC AATCCCAAAG ATTTGAAACC GGGCGAATGG

601 GTCGCCGCCA TCGGCGCGCC CTTCGGCTTC GACAACAGCG TGACCGCCGG

651 CATCGTGTCC GCCAAAGGCA GAAGCCTGCC CAACGAAAGC TACACACCCT
```

-continued

```
 701 TCATCCAAAC CGACGTTGCC ATCAATCCGG GCAACTCCGG CGGCCCGCTG

751 TTCAACTTAA AAGGACAGGT CGTCGGCATC AACTCGCAAA TATACAGCCG

801 CAGCGGCGGA TTCATGGGCA TTTCCTTCGC CATCCCGATT GACGTTGCCA

851 TGAATGTCGC CGAACAGCTG AAAAACACCG GCAAAGTCCA ACGCGGACAA

901 CTGGGCGTGA TTATTCAAGA AGTATCCTAC GGTTTGGCAC AATCGTTCGG

951 TTTGGACAAA GCCGGCGGCG CACTGATTGC CAAAATCCTG CCCGGCAGCC

1001 CCGCAGAACG TGCCGGCCTG CAGGCGGGCG ACATCGTCCT CAGCCTCGAC

1051 GGCGGAGAAA TACGTTCTTC CGGCGACCTT CCCGTTATGG TCGGCGCCAT

1101 TACGCCGGGA AAAGAAGTCA GCCTCGGCGT ATGGCGCAAA GGCGAAGAAA

1151 TCACAATCAA AGTCAAGCTG GGCAACGCCG CCGAGCATAT CGGCGCATCA

1201 TCCAAAACAG ATGAAGCCCC CTACACCGAA CAGCAATCCG GTACGTTCTC

1251 GGTCGAATCC GCAGGCATTA CCCTTCAGAC ACATACCGAC AGCAGCGGCG

1301 GACACCTCGT CGTCGTACGG GTTTCCGACG CGGCAGAACG CGCAGGCTTG

1351 AGGCGCGGCG ACGAAATTCT TGCCGTCGGG CAAGTCCCCG TCAATGACGA

1401 AGCCGGTTTC CGCAAAGCTA TGGACAAGGC AGGCAAAAAC GTCCCCCTGC

1451 TGATCATGCG CCGTGGCAAC ACGCTGTTTA TCGCATTAAA CCTGCAATAA
```

This corresponds to the amino acid sequence <SEQ ID 2970; ORF 986>:

```
m986.pep..
  1 VFKKYQYLAL AALCAASLAG CDKAGSFFVA DKKEASFVER IEHTKDDGSV

51 SMLLPDFAQL VQSEGPAVVN IQAAPAPRTQ NGSGNAENDS DPIADNDPFY

101 EFFKRLVPNM PEIPQEEADD GGLNFGSGFI ISKDGYILTN THVVTGMGSI

151 KVLLNDKREY TAKLIGSDVQ SDVALLKIDA TEELPVVKIG NPKDLKPGEW

201 VAAIGAPFGF DNSVTAGIVS AKGRSLPNES YTPFIQTDVA INPGNSGGPL

251 FNLKGQVVGI NSQIYSRSGG FMGISFAIPI DVAMNVAEQL KNTGKVQRGQ

301 LGVIIQEVSY GLAQSFGLDK AGGALIAKIL PGSPAERAGL QAGDIVLSLD

351 GGEIRSSGDL PVMVGAITPG KEVSLGVWRK GEEITIKVKL GNAAEHIGAS

401 SKTDEAPYTE QQSGTFSVES AGITLQTHTD SSGGHLVVVR VSDAAERAGL

451 RRGDEILAVG QVPVNDEAGF RKAMDKAGKN VPLLIMRRGN TLFIALNLQ*
```

Computer analysis of this amino acid sequence gave the following results:
Homology with a Predicted ORF from *N. gonorrhoeae*

```
    m986/g986 97.0% identity in 499 aa overlap 10         20         30         40         50         60
    m986.pep  VFKKYQYLALAALCAASLAGCDKAGSFFVADKKEASFVERIEHTKDDGSVSMLLPDFAQL
              ||||||:||||||||  ||||:||||||  ||||||||||||||||||||||||||||||
    g986      VFKKYQYFALAALCAALLAGCEKAGSFFGADKKEASFVERIEHTKDDGSVSMLLPDFAQL
                   10         20         30         40         50         60

70         80         90        100        110        120
    m986.pep  VQSEGPAVVNIQAAPAPRTQNGSGNAENDSDPIADNDPFYEFFKRLVPNMPEIPQEEADD
              ||||||||||||||||||||||||||||:||||:||:|||||||||||||||||||||||
    g986      VQSEGPAVVNIQAAPAPRTQNGSGNAETDSDPLADSDPFYEFFKRLVPNMPEIPQEEADD
                   70         80         90        100        110        120
```

-continued

```
                  130       140       150       160       170       180
m986.pep  GGLNFGSGFIISKDGYILTNTHVVTGMGSIKVLLNDKREYTAKLIGSDVQSDVALLKIDA
          |||||||||||||:||||||||||:|||||||||||||||||||||||||||||||||||
g986      GGLNFGSGFIISKNGYILTNTHVVAGMGSIKVLLNDKREYTAKLIGSDVQSDVALLKIDA
                  130       140       150       160       170       180

190       200       210       220       230       240
m986.pep  TEELPVVKIGNPKDLKPGEWVAAIGAPFGFDNSVTAGIVSAKGRSLPNESYTPFIQTDVA
          |||||||||||||:||||||||||||||||||||||||||||||||||||||||||||||
g986      TEELPVVKIGNPKNLKPGEWVAAIGAPFGFDNSVTAGIVSAKGRSLPNESYTPFIQTDVA
                  190       200       210       220       230       240

250       260       270       280       290       300
m986.pep  INPGNSGGPLFNLKGQVVGINSQIYSRSGGFMGISFAIPIDVAMNVAEQLKNTGKVQRGQ
          ||||||||||||||||||||||||||||||||||||||||||||||||||||||||||||
g986      INPGNSGGPLFNLKGQVVGINSQIYSRSGGFMGISFAIPIDVAMNVAEQLKNTGKVQRGQ
                  250       260       270       280       290       300

310       320       330       340       350       360
m986.pep  LGVIIQEVSYGLAQSFGLDKAGGALIAKILPGSPAERAGLQAGDIVLSLDGGEIRSSGDL
          |||||||||||||||||||||:||||||||||||||||||||||||||||||||||||||
g986      LGVIIQEVSYGLAQSFGLDKASGALIAKILPGSPAERAGLQAGDIVLSLDGGEIRSSGDL
                  310       320       330       340       350       360

370       380       390       400       410       420
m986.pep  PVMVGAITPGKEVSLGWRKGEEITIKVKLGNAAEHIGASSKTDEAPYTEQQSGTFSVES
          |||||||||||||||||||||||||||:|||||||| |||||||||||||||||||||||
g986      PVMVGAITPGKEVSLGWRKGEEITIKAKLGNAAEHTGASSKTDEAPYTEQQSGTFSVES
                  370       380       390       400       410       420

430       440       450       460       470       480
m986.pep  AGITLQTHTDSSGGHLVVVRVSDAAERAGLRRGDEILAVGQVPVNDEAGFRKAMDKAGKN
          ||||||||||||| ||||||||||||||||||||||||||||||||||||||||||||||
g986      AGITLQTHTDSSGKHLVVVRVSDAAERAGLRRGDEILAVGQVPVNDEAGFRKAMDKAGKN
                  430       440       450       460       470       480

490       500
m986.pep  VPLLIMRRGNTLFIALNLQX
          ||||:|||||||||||||||
g986      VPLLVMRRGNTLFIALNLQX
                  490       500
```

The following partial DNA sequence was identified in *N. meningitidis* <SEQ ID 2971>:

```
a986.seq
   1  GTGTTCAAAA AATACCAATA CCTCGCTTTG GCAGCACTGT GTGCCGCCTC

51  GCTGGCAGGC TGCGACAAAG CCGGCAGCTT TTTCGGTGCG GACAAAAAAG

101  AAGCATCCTT TGTAGAACGC ATCAAACACA CCAAAGACGA CGGCAGCGTC

151  AGTATGCTGC TGCCCGACTT TGTCCAACTG GTTCAAAGCG AAGGCCCGGC

201  AGTCGTCAAT ATTCAGGCAG CCCCCGCCCC GCGCACCCAA AACGGCAGCA

251  GCAATGCCGA AACCGATTCC GACCCGCTTG CCGACAGCGA CCCGTTCTAC

301  GAATTTTTCA AACGCCTCGT CCCGAACATG CCCGAAATCC CCCAAGAAGA

351  AGCAGATGAC GGNGGATTGA ACTTCGGTTC GGGCTTCATC ATCAGCAAAG

401  ACGGCTATAT TCTGACCAAT ACGCACGTCG TTACCGGCAT GGGCAGTATC

451  AAAGTCCTGC TCAACGACAA GCGCGAATAT ACCGCCAAAC TCATCGGTTC

501  GGATGTCCAA TCCGATGTCG CCCTTCTGAA AATCGACGCA ACGGAAGAGC

551  TGCCCGTCGT CAAAATCGGC AATCCCAAAG ATTTGAAACC GGGCGAATGG

601  GTCGCCGCCA TCGGCGCGCC CTTCGGCTTC GACAACAGCG TGACCGCCGG

651  CNTCGTGTCC GCCAAAGGCA GAAGCCTGCC CAACGAAAGC TACACACCCT

701  TCATCCAAAC CGACGTTGCC ATCAATCCGG GCAACTCCGG CGGCCCGCTG

751  TTCAACTTAA AAGGACAGGT CGTCGGCATC AACTCGCAAA TATACAGCCG

801  CAGCGGCGGA TTCATGGGCA TTTCCTTCGC CATCCCGATT GACGTTGCCA

851  TGAATGTCGC CGAACAGCTG AAAAACACCG GCAAAGTCCA ACGCGGACAA

901  CTGGGCGTGA TTATTCAAGA AGTATCCTAC GGTTTGGCAC AATCGTTCGG
```

-continued

```
 951 TTTGGACAAA GCCGGCGGCG CACTGATTGC CAAAATCCTG CCCGGCAGCC
1001 CCGCAGAACG TGCCGGCCTG CGGGCGGGCG ACATCGTCCT CAGCCTCGAC
1051 GGCGGAGAAA TACGTTCTTC CGGCGACCTT CCCGTTATGG TCGGCGCCAT
1101 TACGCCGGGA AAGAAGTCA GCCTCGGCGT ATGGCGCAAA GGCGAAGAAA
1151 TCACAATCAA AGTCAAGCTG GCAACGCCG CCGAGCATAT CGGCGCATCA
1201 TCCAAAACAG ATGAAGCCCC CTACACCGAA CAGCAATCCG GTACGTTCTC
1251 GGTCGAATCC GCAGGCATTA CCCTTCAGAC ACATACCGAC AGCAGCGGCG
1301 GACACCTCGT CGTCGTACGG GTTTCCGACG CGGCAGAACG CGCAGGCTTG
1351 AGGCGCGGCG ACGAAATTCT TGCCGTCGGG CAAGTCCCCG TCAATGACGA
1401 AGCCGGTTTC CGCAAAGCTA TGGACAAGGC AGGCAAAAAC GTCCCCCTGC
1451 TGATCATGCG CCGTGGCAAC ACGCTGTTTA TCGCATTAAA CCTGCAATAA
                                                         20
```

This corresponds to the amino acid sequence <SEQ ID 2972; ORF 986.a>:

```
a986.pep

1 VFKKYQYLAL AALCAASLAG CDKAGSFFGA DKKEASFVER IKHTKDDGSV

51 SMLLPDFVQL VQSEGPAVVN IQAAPAPRTQ NGSSNAETDS DPLADSDPFY

101 EFFKRLVPNM PEIPQEEADD GGLNFGSGFI ISKDGYILTN THVVTGMGSI

151 KVLLNDKREY TAKLIGSDVQ SDVALLKIDA TEELPVVKIG NPKDLKPGEW

201 VAAIGAPFGF DNSVTAGXVS AKGRSLPNES YTPFIQTDVA INPGNSGGPL

251 FNLKGQVVGI NSQIYSRSGG FMGISFAIPI DVAMNVAEQL KNTGKVQRGQ

301 LGVIIQEVSY GLAQSFGLDK AGGALIAKIL PGSPAERAGL RAGDIVLSLD

351 GGEIRSSGDL PVMVGAITPG KEVSLGVWRK GEEITIKVKL GNAAEHIGAS

401 SKTDEAPYTE QQSGTFSVES AGITLQTHTD SSGGHLVVVR VSDAAERAGL

451 RRGDEILAVG QVPVNDEAGF RKAMDKAGKN VPLLIMRRGN TLFIALNLQ* m986/a986 98.2% identity in 499 aa overlap 10         20         30         40         50         60
m986.pep VFKKYQYLALAALCAASLAGCDKAGSFFVADKKEASFVERIEHTKDDGSVSMLLPDFAQL
         ||||||||||||||||||||||||||||:||||||||||||:||||||||||||||||:||
a986     VFKKYQYLALAALCAASLAGCDKAGSFFGADKKEASFVERIKHTKDDGSVSMLLPDFVQL
                 10         20         30         40         50         60

70         80         90        100        110        120
m986.pep VQSEGPAVVNIQAAPAPRTQNGSGNAENDSDPIADNDPFYEFFKRLVPNMPEIPQEEADD
         ||||||||||||||||||||||||:|||:||||:||:||||||||||||||||||||||||
a986     VQSEGPAVVNIQAAPAPRTQNGSSNAETDSDPLADSDPFYEFFKRLVPNMPEIPQEEADD
                 70         80         90        100        110        120

130        140        150        160        170        180
m986.pep GGLNFGSGFIISKDGYILTNTHVVTGMGSIKVLLNDKREYTAKLIGSDVQSDVALLKIDA
         ||||||||||||||||||||||||||||||||||||||||||||||||||||||||||||
a986     GGLNFGSGFIISKDGYILTNTHVVTGMGSIKVLLNDKREYTAKLIGSDVQSDVALLKIDA
                130        140        150        160        170        180

190        200        210        220        230        240
m986.pep TEELPVVKIGNPKDLKPGEWVAAIGAPFGFDNSVTAGIVSAKGRSLPNESYTPFIQTDVA
         |||||||||||||||||||||||||||||||||||||  |||||||||||||||||||||
a986     TEELPVVKIGNPKDLKPGEWVAAIGAPFGFDNSVTAGXVSAKGRSLPNESYTPFIQTDVA
                190        200        210        220        230        240

250        260        270        280        290        300
m986.pep INPGNSGGPLFNLKGQVVGINSQIYSRSGGFMGISFAIPIDVAMNVAEQLKNTGKVQRGQ
         ||||||||||||||||||||||||||||||||||||||||||||||||||||||||||||
a986     INPGNSGGPLFNLKGQVVGINSQIYSRSGGFMGISFAIPIDVAMNVAEQLKNTGKVQRGQ
                250        260        270        280        290        300

310        320        330        340        350        360
m986.pep LGVIIQEVSYGLAQSFGLDKAGGALIAKILPGSPAERAGLQAGDIVLSLDGGEIRSSGDL
         ||||||||||||||||||||||||||||||||||||||||:|||||||||||||||||||
a986     LGVIIQEVSYGLAQSFGLDKAGGALIAKILPGSPAERAGLRAGDIVLSLDGGEIRSSGDL
                310        320        330        340        350        360
```

```
                       370        380        390        400        410        420
m986.pep   PVMVGAITPGKEVSLGVWRKGEEITIKVKLGNAAEHIGASSKTDEAPYTEQQSGTFSVES
           ||||||||||||||||||||||||||||||||||||||||||||||||||||||||||||
a986       PVMVGAITPGKEVSLGVWRKGEEITIKVKLGNAAEHIGASSKTDEAPYTEQQSGTFSVES
                       370        380        390        400        410        420

430        440        450        460        470        480
m986.pep   AGITLQTHTDSSGGHLVVVRVSDAAERAGLRRGDEILAVGQVPVNDEAGFRKAMDKAGKN
           ||||||||||||||||||||||||||||||||||||||||||||||||||||||||||||
a986       AGITLQTHTDSSGGHLVVVRVSDAAERAGLRRGDEILAVGQVPVNDEAGFRKAMDKAGKN
                       430        440        450        460        470        480

490        500
m986.pep   VPLLIMRRGNTLFIALNLQX
           ||||||||||||||||||||
a986       VPLLIMRRGNTLFIALNLQX
                       490        500
```

The following partial DNA sequence was identified in *N. gonorrhoeae* <SEQ ID 2973>:

```
g987.seq
    1 ATGAAAACAC GCAGCCTCAT TTCCCTTTTA TGCCTCCTTC TCTGTTCATG
   51 TTCTTCATGG TTGCCCCCAC TGGAAGAACG GACGGAAAGC CGTCATTTTA
  101 ATACTTCCAA ACCTGTCCTC CTGGACAACA TCCTGCAAAT CCGGCACACC
  151 CCTCATAACA ACGGGCTATC CGACATCTAC CTGCTCGACG ACCCCCACGA
  201 AGCCTTTGCC GCCCGCGCCG CCCTTATCGA ATCTGCCGAA CACAGCCTCG
  251 ATTTGCAATA CTACATTTGG CGCAACGaCA TTTCCGGCAG GCTGCTGTTC
  301 AACCTCATGT ACCTTGCCGC agaacgcGGC GTGCGCGTAC GCCTGCTGTt
  351 ggacgacaAC AACAcgcgcg gcttggacga tctcctGCTC GCCCTCGACA
  401 GCCATCCCAA TAtctaagtG CGCCTGTTCA ACCCCTtcgt CCTACGCAAA
  451 TGGCGCGCAC TCGGCTACCT GACCGACTTC CCCCGCCTCA ACCGCCGCAT
  501 GCACAACAAA TCCTTTACCG CCGACAACCG CGCCACCATA CTCGGCGGAC
  551 GCAATATCGG CGACGAATAC TTCAAAGTCG GTGAGGACAC CGTTTTCGCC
  601 GACCTGGACA TCCTCGCCAC CGGCAGCGTC GTCGGCGAAG TATCGCACGA
  651 CTTCGACCGC TACTGGGCAA GCCATTCCGC CCACAACGCC ACGCGCATCA
  701 TCCGCAGCGG CAACATCGGC AAGGGTCTTC AAGCACTCGG ATACAACGAC
  751 GAAACATCCA GACACGCGCT CCTGCGCTAC CGCGAAACCG TCGAACAGTC
  801 GCCCCTCTAC CAAAAAATAC AGACGGGACG CATCGACTGG CAGAGCGTCC
  851 AAACCCGCCT GATCAGCGAC AGCCCTGCAA AAGGACTCGA CCGCGACCGC
  901 CGCAAACCGC CGATTGCCGG GAGGCTGCAA GACGCGCTCA AACAGCCCGA
  951 AAAAAGCGTC TATCTGGTTT CACCCTATTT CGTCCCTACA AAATCCGGCA
 1001 CAGACGCACT GGCAAAACTG GTGCAGGACG GCATAGACGT TACCGTCCTG
 1051 ACCAACTCGC TACAGGCGAC CGACGTTGCC GCCGTCCATT CCGGCTACGT
 1101 CAAATACCGA AAACCGCTGC TCAAAGCCGG CATCAAACTC TACGAGCTGC
 1151 AACCCAACCA TGCCGTCCCC GCCACAAAAG ACAAAGGCCT GACCGGCAGC
 1201 TCCGTAACCA GCCTGCATGC CAAAACCTTC ATTGTGGacg gCAAACGCAT
 1251 CTTCATCGGC TCATTCAACC TCGACCCCCG TTCCGCACGG CTCAATACCG
 1301 AAATGGGCGT CGTCATCGAA AGCCCCAAAA TCGCAGAACA GATGGAGCGC
 1351 AcccTCGCCG AtacCACACC CGAATACGCC TACCGCGTTA CCCTCGACAA
 1401 ACACAACCGC CTGCAATGGC ACGATCCCGC CACCCGAAAA ACCTACCCGA
```

-continued

```
1451 ACGAACCCGA AGCCAAACTT TGGAAACGCA TCGCCGCAAA AATCCTATCC

1501 CTGCTGCCCA TCGAAGGTTT ATTATAG
```

This corresponds to the amino acid sequence <SEQ ID 2974; ORF 987.ng>:

```
g987.pep
   1 MKTRSLISLL CLLLCSCSSW LPPLEERTES RHFNTSKPVL LDNILQIRHT

51 PHNNGLSDIY LLDDPHEAFA ARAALIESAE HSLDLQYYIW RNDISGRLLF

101 NLMYLAAERG VRVRLLLDDN NTRGLDDLLL ALDSHPNI*V RLFNPFVLRK

151 WRALGYLTDF PRLNRRMHNK SFTADNRATI LGGRNIGDEY FKVGEDTVFA

201 DLDILATGSV VGEVSHDFDR YWASHSAHNA TRIIRSGNIG KGLQALGYND

251 ETSRHALLRY RETVEQSPLY QKIQTGRIDW QSVQTRLISD SPAKGLDRDR

301 RKPPIAGRLQ DALKQPEKSV YLVSPYFVPT KSGTDALAKL VQDGIDVTVL

351 TNSLQATDVA AVHSGYVKYR KPLLKAGIKL YELQPNHAVP ATKDKGLTGS

401 SVTSLHAKTF IVDGKRIFIG SFNLDPRSAR LNTEMGVVIE SPKIAEQMER

451 TLADTTPEYA YRVTLDKHNR LQWHDPATRK TYPNEPEAKL WKRIAAKILS

501 LLPIEGLL*
```

The following partial DNA sequence was identified in *N. meningitidis* <SEQ ID 2975>:

```
m987.seq
    1 ATGAAAACAC GCAGCCTAAT TTCCCTTTTA TGCCTCCTTC TCTGTTCATG

51 TTCTTCATGG TTGCCCCCAC TGGAAGAACG GACGGAAAGC CGTCATTTCA

101 ATACTTCCAA ACCCGTCCGC CTGGACAACA TCCTGCAAAT CCGGCACACC

151 CCTCATACCA ACGGGCTATC CGATATCTAT CTGTTGAACG ACCCCCACGA

201 AGCCTTTGCC GCCCGCGCCG CCCTTATCGA ATCTGCCGAA CACAGCCTCG

251 ATTTGCAATA CTACATCTGG CGCAACGACA TTTCCGGCAG GCTGCTGTTC

301 AACCTCGTGT ACCTTGCCGC AGAACGCGGT GTGCGCGTAC GCCTGCTGTT

351 GGACGACAAC AACACGCGCG GATTGGACGA CCTCCTGCTT GCCCTCGACA

401 GCCATCCCAA TATCGAAGTG CGCCTGTTCA ACCCCTTCGT CTTACGAAAA

451 TGGCGCGCAC TCGGCTACCT GACCGACTTC CCCCGCCTCA ACCGCCGCAT

501 GCACAACAAA TCCTTTACCG CCGACAACCG CGCCACCATA CTCGGCGGAC

551 GCAATATCGG CGACGAATAC TTCAAAGTCG GTGAGGACAC CGTTTTCGCC

601 GATTTGGACA TCCTCGCCAC CGGCAGCGTC GTCGGCGAAG TATCGCACGA

651 CTTCGACCGC TACTGGGCAA GCCATTCCGC CCACAACGCC ACGCGCATCA

701 TCCGCAGCGG CGACATCGGC AAGGGTCTTC AAGCACTCGG ATACAACGAC

751 GAAACGTCCA GACACGCGCT CCTGCGCTAC CGCGAAACCG TCGAACAGTC

801 GCCCCTCTAC CAAAAAATAC AGACAGGATG CATCGACTGG CAGAGCGTCC

851 GAACCCGCCT CATCAGCGAC GACCCTGCAA AAGGACTCGA CCGCGACCGC

901 CGCAAACCGC CGATTGCCGG GCGGCTGCAA GACGCGCTCA AACAGCCCGA

951 AAAAGCGTC TATCTGGTTT CACCCTATTT CGTTCCCACA AAATCCGGCA

1001 CAGACGCACT GGCAAAACTG GTGCAGGACG GCATAGACGT TACCGTTCTG
```

-continued

```
1051 ACCAACTCGC TGCAGGCGAC CGACGTTGCC GCCGTCCATT CCGGCTATGT

1101 CAAATACCGA AAACCGCTGC TCAAAGCCGG CATCAAACTC TACGAGCTGC

1151 AACCCAACCA TGCCGTCCCC GCCACAAAAG ACAAAGGCCT GACCGGCAGC

1201 TCCGTAACCA GCCTGCACGC CAAAACCTTC ATTGTGGACG GCAAACGCAT

1251 CTTCATCGGT TCGTTCAACC TCGACCCCCG TTCCGCGCGT CTCAACACCG

1301 AAATGGGCGT TGTTATCGAA AGCCCCAAAA TCGCAGAACA GATGGAGCGC

1351 ACCCTTGCCG ATACCACACC CGCCTACGCC TACCGCGTTA CCCTCGACAG

1401 GCACAACCGC CTGCAATGGC ACGATCCCGC CACCCGAAAA ACCTACCCGA

1451 ACGAACCCGA AGCCAAACTT TGGAAACGCA TCGCCGCAAA AATCCTATCC

1501 CTGCTGCCCA TAGAAGGTTT ATTATAG
```

This corresponds to the amino acid sequence <SEQ ID 2976; ORF 987>:

```
m987.pep
   1 MKTRSLISLL CLLLCSCSSW LPPLEERTES RHFNTSKPVR LDNILQIRHT

51 PHTNGLSDIY LLNDPHEAFA ARAALIESAE HSLDLQYYIW RNDISGRLLF

101 NLVYLAAERG VRVRLLLDDN NTRGLDDLLL ALDSHPNIEV RLFNPFVLRK

151 WRALGYLTDF PRLNRRMHNK SFTADNRATI LGGRNIGDEY FKVGEDTVFA

201 DLDILATGSV VGEVSHDFDR YWASHSAHNA TRIIRSGDIG KGLQALGYND

251 ETSRHALLRY RETVEQSPLY QKIQTGCIDW QSVRTRLISD DPAKGLDRDR

301 RKPPIAGRLQ DALKQPEKSV YLVSPYFVPT KSGTDALAKL VQDGIDVTVL

351 TNSLQATDVA AVHSGYVKYR KPLLKAGIKL YELQPNHAVP ATKDKGLTGS

401 SVTSLHAKTF IVDGKRIFIG SFNLDPRSAR LNTEMGVVIE SPKIAEQMER

451 TLADTTPAYA YRVTLDRHNR LQWHDPATRK TYPNEPEAKL WKRIAAKILS

501 LLPIEGLL*
```

Computer analysis of this amino acid sequence gave the following results:
Homology with a Predicted ORF from *N. gonorrhoeae*

```
    m987/g987  97.8% identity in 508 aa overlap 10         20         30         40         50         60
    m987.pep  MKTRSLISLLCLLLCSCSSWLPPLEERTESRHFNTSKPVRLDNILQIRHTPHTNGLSDIY
              ||||||||||||||||||||||||||||||||||||| |||||||||||:||||||
    g987      MKTRSLISLLCLLLCSCSSWLPPLEERTESRHFNTSKPVLLDNILQIRHTPHNNGLSDIY
                  10         20         30         40         50         60

70         80         90        100        110        120
    m987.pep  LLNDPHEAFAARAALIESAEHSLDLQYYIWRNDISGRLLFNLVYLAAERGVRVRLLLDDN
              ||:||||||||||||||||||||||||||||||||||||||:||||||||||||||||||
    g987      LLDDPHEAFAARAALIESAEHSLDLQYYIWRNDISGRLLFNLMYLAAERGVRVRLLLDDN
                  70         80         90        100        110        120

130        140        150        160        170        180
    m987.pep  NTRGLDDLLLALDSHPNIEVRLFNPFVLRKWRALGYLTDFPRLNRRMHNKSFTADNRATI
              |||||||||||||||||||:||||||||||||||||||||||||||||||||||||||||
    g987      NTRGLDDLLLALDSHPNIXVRLFNPFVLRKWRALGYLTDFPRLNRRMHNKSFTADNRATI
                 130        140        150        160        170        180

190        200        210        220        230        240
    m987.pep  LGGRNIGDEYFKVGEDTVFADLDILATGSVVGEVSHDFDRYWASHSAHNATRIIRSGDIG
              |||||||||||||||||||||||||||||||||||||||||||||||||||||||:||
    g987      LGGRNIGDEYFKVGEDTVFADLDILATGSVVGEVSHDFDRYWASHSAHNATRIIRSGNIG
                 190        200        210        220        230        240
```

-continued

```
                250        260        270        280        290        300
m987.pep  KGLQALGYNDETSRHALLRYRETVEQSPLYQKIQTGCIDWQSVRTRLISDDPAKGLDRDR
          ||||||||||||||||||||||||||||||||||| ||||| ||||| |||||||||||
g987      KGLQALGYNDETSRHALLRYRETVEQSPLYQKIQTGRIDWQSVQTRLISDSPAKGLDRDR
                250        260        270        280        290        300

310        320        330        340        350        360
m987.pep  RKPPIAGRLQDALKQPEKSVYLVSPYFVPTKSGTDALAKLVQDGIDVTVLTNSLQATDVA
          ||||||||||||||||||||||||||||||||||||||||||||||||||||||||||||
g987      RKPPIAGRLQDALKQPEKSVYLVSPYFVPTKSGTDALAKLVQDGIDVTVLTNSLQATDVA
                310        320        330        340        350        360

370        380        390        400        410        420
m987.pep  AVHSGYVKYRKPLLKAGIKLYELQPNHAVPATKDKGLTGSSVTSLHAKTFIVDGKRIFIG
          ||||||||||||||||||||||||||||||||||||||||||||||||||||||||||||
g987      AVHSGYVKYRKPLLKAGIKLYELQPNHAVPATKDKGLTGSSVTSLHAKTFIVDGKRIFIG
                370        380        390        400        410        420

430        440        450        460        470        480
m987.pep  SFNLDPRSARLNTEMGVVIESPKIAEQMERTLADTTPAYAYRVTLDRHNRLQWHDPATRK
          |||||||||||||||||||||||||||||||||||||||||| ||||||:|||||||||
g987      SFNLDPRSARLNTEMGVVIESPKIAEQMERTLADTTPEYAYRVTLDKHNRLQWHDPATRK
                430        440        450        460        470        480

490        500       509
m987.pep  TYPNEPEAKLWKRIAAKILSLLPIEGLLX
          ||||||||||||||||||||||||||||
g987      TYPNEPEAKLWKRIAAKILSLLPIEGLLX
                490        500
```

The following partial DNA sequence was identified in *N. meningitidis* <SEQ ID 2977>:

```
a987.seq
    1 ATGAAAACAC GCAGCCTAAT TTCCCTTTTA TGCCTCCTTC TCTGTTCATG

51 TTCTTCATGG TTGCCCCCAC TGGAAGAACG GACGGAAAGC CGTCATTTCA

101 ATACTTCCAA ACCCGTCCGC CTGGACAACA TCCTGCAAAT CCGGCACACC

151 CCTCATACCA ACGGGCTATC CGATATCTAT CTGTTGAACG ACCCCCACGA

201 AGCCTTTGCC GCCCGCGCCG CCCTTATCGA ATCTGCCGAA CACAGCCTCG

251 ATTTGCAATA CTACATCTGG CGCAACGACA TTTCCGGCCG ACTGCTGTTC

301 AACCTCGTGT ACCTTGCCGC AGAACGCGGT GTGCGCGTAC GCCTGCTGTT

351 GGACGACAAC AACACGCGCG GATTGGACGA CCTCCTGCTC GACCTGGACA

401 GCCATCCCAA TATCGAAGTG CGCCTGTTCA ACCCCTTCGT CTTACGAAAA

451 TGGCGCGCAC TCGGCTACCT GACCGACTTC CCCCGCCTCA ACCGCCGCAT

501 GCACAACAAA TCCTTTACCG CCGACAACCG CGCCACCATA CTCGGCGGAC

551 GCAATATCGG CGACGAATAC TTCAAAGTCG GTGAGGACAC CGTTTTCGCC

601 GACCTGGACA TCCTCGCCAC CGGCAGCGTC GTCGGCGAAG TATCGCACGA

651 CTTCGACCGC TACTGGGCAA GCCATTCCGC CCACAACGCC ACGCGCATCA

701 TCCGCAGCGG CAACATCGGC AAGGGTCTTC AAGCACTCGG ATACAACGAC

751 GAAACGTCCA GACACGCGCT CCTGCGCTAC CGCGAAACCG TCGAACAGTC

801 GCCCCTCTAC CAAAAAATAC AGACAGGACG CATCGACTGG CAGAGCGTCC

851 AAACCCGCCT CATCAGCGAC GACCCTGCAA AAGGACTCGA CCGCGACCGC

901 CGCAAACCGC CGATTGCCGG GCGGCTGCAA GACGCGCTCA AACAGCCCGA

951 AAAAAGCGTC TATCTGGTTT CACCCTATTT CGTCCCCACA AATCCGGCA

1001 CAGACGCACT GGCAAAACTG GTGCAGGACG GCATAGACGT TACCGTCCTG

1051 ACCAACTCGC TACAGGCGAC CGACGTTGCC GCCGTCCATT CCGGCTATGT

1101 CAAATACCGA AAACCGCTGC TCAAAGCCGG CATCAAACTC TACGAGCTGC

1151 AACCCAACCA TGCCGTCCCT GCCACAAAAG ACAAAGGCCT GACCGGCAGC
```

-continued

```
1201 TCCGTAACCA GCCTGCATGC CAAAACCTTC ATTGTGGACG GCAAACGCAT

1251 CTTCATCGGC TCATTCAACC TCGACCCCCG TTCCGCACGG CTCAATACTG

1301 AAATGGGCGT TGTTATCGAA AGCCCCAAAA TCGCAGAACA GATGGAGCGC

1351 ACCCTTGCCG ATACCTCACC CGAATACGCC TACCGCGTTA CCCTCGACAG

1401 GCACAACCGC CTGCAATGGC ACGATCCCGC CACCCGAAAA ACCTACCCGA

1451 ACGAACCCGA AGCCAAACTT TGGAAACGCA TCGCCGCAAA AATCCTATCC

1501 CTGCTGCCCA TAGAAAGTTT ATTATAG
```

This corresponds to the amino acid sequence <SEQ ID 550; ORF 2978.a>:

```
a987.pep

1 MKTRSLISLL CLLLCSCSSW LPPLEERTES RHFNTSKPVR LDNILQIRHT

51 PHTNGLSDIY LLNDPHEAFA ARAALIESAE HSLDLQYYIW RNDISGRLLF

101 NLVYLAAERG VRVRLLLDDN NTRGLDDLLL ALDSHPNIEV RLFNPFVLRK

151 WRALGYLTDF PRLNRRMHNK SFTADNRATI LGGRNIGDEY FKVGEDTVFA

201 DLDILATGSV VGEVSHDFDR YWASHSAHNA TRIIRSGNIG KGLQALGYND

251 ETSRHALLRY RETVEQSPLY QKIQTGRIDW QSVQTRLISD DPAKGLDRDR

301 RKPPIAGRLQ DALKQPEKSV YLVSPYFVPT KSGTDALAKL VQDGIDVTVL

351 TNSLQATDVA AVHSGYVKYR KPLLKAGIKL YELQPNHAVP ATKDKGLTGS

401 SVTSLHAKTF IVDGKRIFIG SFNLDPRSAR LNTEMGVVIE SPKIAEQMER

451 TLADTSPEYA YRVTLDRHNR LQWHDPATRK TYPNEPEAKL WKRIAAKILS

501 LLPIESLL*
```

```
m987/a987  98.8% identity in 508 aa overlap 10         20         30         40         50         60
m987.pep   MKTRSLISLLCLLLCSCSSWLPPLEERTESRHFNTSKPVRLDNILQIRHTPHTNGLSDIY
           ||||||||||||||||||||||||||||||||||||||||||||||||||||||||||||
a987       MKTRSLISLLCLLLCSCSSWLPPLEERTESRHFNTSKPVRLDNILQIRHTPHTNGLSDIY
                 10         20         30         40         50         60

70         80         90        100        110        120
m987.pep   LLNDPHEAFAARAALIESAEHSLDLQYYIWRNDISGRLLFNLVYLAAERGVRVRLLLDDN
           ||||||||||||||||||||||||||||||||||||||||||||||||||||||||||||
a987       LLNDPHEAFAARAALIESAEHSLDLQYYIWRNDISGRLLFNLVYLAAERGVRVRLLLDDN
                 70         80         90        100        110        120

130        140        150        160        170        180
m987.pep   NTRGLDDLLLALDSHPNIEVRLFNPFVLRKWRALGYLTDFPRLNRRMHNKSFTADNRATI
           ||||||||||||||||||||||||||||||||||||||||||||||||||||||||||||
a987       NTRGLDDLLLALDSHPNIEVRLFNPFVLRKWRALGYLTDFPRLNRRMHNKSFTADNRATI
                130        140        150        160        170        180

190        200        210        220        230        240
m987.pep   LGGRNIGDEYFKVGEDTVFADLDILATGSVVGEVSHDFDRYWASHSAHNATRIIRSGDIG
           |||||||||||||||||||||||||||||||||||||||||||||||||||||||||:||
a987       LGGRNIGDEYFKVGEDTVFADLDILATGSVVGEVSHDFDRYWASHSAHNATRIIRSGNIG
                190        200        210        220        230        240

250        260        270        280        290        300
m987.pep   KGLQALGYNDETSRHALLRYRETVEQSPLYQKIQTGCIDWQSVRTRLISDDPAKGLDRDR
           |||||||||||||||||||||||||||||||||||| |||:|||||||||||||||||||
a987       KGLQALGYNDETSRHALLRYRETVEQSPLYQKIQTGRIDWQSVQTRLISDDPAKGLDRDR
                250        260        270        280        290        300

310        320        330        340        350        360
m987.pep   RKPPIAGRLQDALKQPEKSVYLVSPYFVPTKSGTDALAKLVQDGIDVTVLTNSLQATDVA
           ||||||||||||||||||||||||||||||||||||||||||||||||||||||||||||
a987       RKPPIAGRLQDALKQPEKSVYLVSPYFVPTKSGTDALAKLVQDGIDVTVLTNSLQATDVA
                310        320        330        340        350        360

370        380        390        400        410        420
m987.pep   AVHSGYVKYRKPLLKAGIKLYELQPNHAVPATKDKGLTGSSVTSLHAKTFIVDGKRIFIG
           ||||||||||||||||||||||||||||||||||||||||||||||||||||||||||||
a987       AVHSGYVKYRKPLLKAGIKLYELQPNHAVPATKDKGLTGSSVTSLHAKTFIVDGKRIFIG
                370        380        390        400        410        420
```

```
            430       440        450        460        470        480
m987.pep  SFNLDPRSARLNTEMGVVIESPKIAEQMERTLADTTPAYAYRVTLDRHNRLQWHDPATRK
          ||||||||||||||||||||||||||||||||||||:|||||||||||||||||||||||
a987      SFNLDPRSARLNTEMGVVIESPKIAEQMERTLADTSPEYAYRVTLDRHNRLQWHDPATRK
            430       440        450        460        470        480

490       500       509
m987.pep  TYPNEPEAKLWKRIAAKILSLLPIEGLLX
          |||||||||||||||||||||||||:|||
a987      TYPNEPEAKLWKRIAAKILSLLPIESLLX
            490       500
```

The following partial DNA sequence was identified in *N. gonorrhoeae* <SEQ ID 2979>:

```
g988.seq
   1 ATGAATAAAA ATATTAAATC TTTAAATTTA CGGGAAAAAG ACCCGTTTTT

51 AAGTCGTGAA AAACAGCGTT ATGAACATCC TTTGCCCAGT CGGgaATGGA

101 TAATCGAATT GTTGGAGCGC AAAGGTGTGC CTTCAAAAAT CGAATCGCTT

151 GCACGCGAGC TGTCGATTAC GGAAGacgag tATGTCTTTT TTGAACGCCG

201 TCTGAaggCG atgGCGCGGG AcggtCAGGT TTTAATCAAC CGCCgaggcg

251 CagtTTGCGc gGCggacaag ctgGATTTGG TCAAATGccg Cgtcgaggcg 301 catAAgGAcg gtttcggctt cgcCGTGCCG CTCATGCCGA TGGACGAAGG 351 GGATTTCGTT TTATACGAAC GCCAgatgcg tggTGtcatG CAcggcgaca 401 ccgttACCGT CCGTCCTGCg ggtatggaCC GCAGGGGccg ccgcGAAggg 451 acgtttctGG ATATTGTCGA ACGCGCGCAA AGCAAAGTTG TCGGCCGTTT

501 CTATATGGAT AGGGGCGTGG CGATTTTGGA GCCGGAAGAC AAGCGTCTGA

551 ACCAAAGCAT CGTGTTGGAA CCGGACGGCG TGGCGCGTTT CAAACCCGAA

601 TCCGGTCAGG TTATCGTCGG CAAAATTGAG GTTTATCCCG AGCAAAACCG

651 GCCTGCAGTG GCAAAAATCA TTGAAGTTTT GGGCGATTAT GCCGACAGCG

701 GGATGGAAAt cgAAATTGCC GTGCGCAAGC ATCATTTGCC GCAccgaTTC

751 AGTGAagcgt gtGcCAAATC CGcgaaAAAA ATtcccgacc ATGTACGCAA

801 AAGCGATTTG AAAGGCCGCG TCGATTTGTG CGACCTTCCT TTGGTAACGA

851 TAGACGGCGA AACGGCGCGC GATTTCGACG ACGCGGTGTT TGCCGAAAAA

901 GTCGGACGCA ATTACCGCCT GGTCGTGGCG ATTGCGGATG TCAGCCATTA

951 TGTCCGCCCT GACGATGCGA TTGATGCAGA TGCTCAAGAA CGCAGTACCA

1001 GCGTGTATTT CCCGCGCCGT ATGATTCCGA TGCTGCCGGA AAACCTGTCC

1051 AACGGCATCT GCTCGCTCAA TCCCGATGTC GAGCGTTTGT GTATGGTGTG

1101 CGATATGGTC GTTACCTATG CGGGCAATAT CAAAGAATAC CGCTTCTATC

1151 CCGCCGTGAT GCGCTCTCAT GCCCGCCTGA CCTACAACCA AGTTTGGAAA

1201 TGGCTTTCAG ACGGCATCGG GAATCCGCAC AAAGCCCAAA TCGACACGCT

1251 TTACAAGCTG TTTAAAATTT TGCAGAAAAA ACGTCTGGCG CGCGGGGCGG

1301 TGGAGTTTGA AAGCGTCGAA ACCCAGATGA TTTTCGACGA CAACGGCAAA

1351 ATCGAAAAAA TTGTCCCCGT CGTCCGCAAC gatGCCCACA AGCTGATTGA

1401 AGAATGTATG CTGGCGGCGA ATGTTTGCGC GGCGGATTTT CTGTTGAAAA

1451 ACAAACATAC GGCTTTGTTC CGCAACCATT TGGGCCCCAC GCCCGAAAAA

1501 CTCGCCACCC TGCGCGAGCA GCTCGGTCTG TTGGGGCTTC AACTTGGCGG
```

-continued

```
1551 CGGCGACAAC CCGTCGCCGA AAGACTATGC CGCGCTTGCC GAACAATTCA

1601 AAGGCAGGCC GGATGCCGAA TTGCTGCAAG TCATGATGTT GCGCTCCATG

1651 CAGCAGGCGG TTTACGAACC GCATTGCGAA GGGCATTTCG GTTTGGCTTA

1701 TGAAGCATAC GCCCACTTTA CCTCGCCCAT CCGCCGCTAT CCCGACCTGA

1751 CCGTCCACCG TGCCATCAAA GCCGTATTGA ACCGGAAAAC CTACACGCCA

1801 AACAAAAGCT GGCAGGCTTT GGGCGTGCAT ACTTCGTTTT GCGAACGCCG

1851 TGCCGACGAT GCTGGCCGCG ATGTGGAAAA CTGGCTGAAA ACTTATTATA

1901 TGCGCGATAA GGTCGGTGAA ATATTTGAAG GcaaaatCtc ccggggtgtg 1951 gcaaaTtttg gaATATTTGT CACTTTGGAC GATATCcata tcgacggtct 2001 ggtacaTATC AGCGatttgg gcgaAGATTA TTTCaacttc cgccccgAAA

2051 TCATGGCAAT CGAAGGCGAA CGCAGCGGCA TCCGTTTCAA TATGGGGGAC

2101 AGGGTTGCCG TCCGGGTCGC GCGTGCCGAT TTGGATGATG GAAAAATCGA

2151 CTTTGTCCTA ATTGCCGGAG AAAGCGGCAG GCGGCGGAAG GTCAAATTAT

2201 CCGCATCTGC CAAACCGGCA GGGGCGGCGG GGAAAGGGAA ATCGAAAACC

2251 ACCGCCGAGA AAAAAACAGC CCGATGCGGC AAAGTAAGGG AAGGGGCGT

2301 GCCTGCCGTT GCCGAATCGG GGAAAAAGGC AAAGAAACCG GTTCCGATTA

2351 AGGTCAAAAA ACGGAAAGGC AAATCATAA
```

This corresponds to the amino acid sequence <SEQ ID 2980; ORF 988.ng>:

```
g988.pep
  1MNKNIKSLNL REKDPFLSRE KQRYEHPLPS REWIIELLER KGVPSKIESL

51ARELSITEDE YVFFERRLKA MARDGQVLIN RRGAVCAADK LDLVKCRVEA

101HKDGFGFAVP LMPMDEGDFV LYERQMRGVM HGDTVTVRPA GMDRRGRREG

151TFLDIVERAQ SKVVGRFYMD RGVAILEPED KRLNQSIVLE PDGVARFKPE

201SGQVIVGKIE VYPEQNRPAV AKIIEVLGDY ADSGMEIEIA VRKHHLPHRF

251SEACAKSAKK IPDHVRKSDL KGRVDLCDLP LVTIDGETAR DFDDAVFAEK

301VGRNYRLVVA IADVSHYVRP DDAIDADAQE RSTSVYFPRR MIPMLPENLS

351NGICSLNPDV ERLCMVCDMV VTYAGNIKEY RFYPAVMRSH ARLTYNQVWK

401WLSDGIGNPH KAQIDTLYKL FKILQKKRLA RGAVEFESVE TQMIFDDNGK

451IEKIVPVVRN DAHKLIEECM LAANVCAADF LLKNKHTALF RNHLGPTPEK

501LATLREQLGL LGLQLGGGDN PSPKDYAALA EQFKGRPDAE LLQVMMLRSM

551QQAVYEPHCE GHFGLAYEAY AHFTSPIRRY PDLTVHRAIK AVLNRKTYTP

601NKSWQALGVH TSFCERRADD AGRDVENWLK TYYMRDKVGE IFEGKISRGV

651ANFGIFVTLD DIHIDGLVHI SDLGEDYFNF RPEIMAIEGE RSGIRFNMGD

701RVAVRVARAD LDDGKIDFVL IAGESGRRRK VKLSASAKPA GAAGKGKSKT

751TAEKKTARCG KVRGRGVPAV AESGKKAKKP VPIKVKKRKG KS*
```

The following partial DNA sequence was identified in *N. meningitidis* <SEQ ID 2981>:

```
m988.seq (partial)
  1  ..ACAGTTCTGG ATATTGTCGA ACGCGCGCAA AGCAAAGTGG TCGGCCGTTT
```

-continued

```
  51 CTATATGGAT AGGGGCGTGG CGATTTTGGA GCCGGAAGAC AAGCGTCTGA
 101 ACCAAAGCAT CGTATTGGAA CCGGACGGCG TGGCGCGTTT CAAACCTGAA
 151 TCCGGTCAGG TCATCGTCGG CGAAATTGAG GTTTATCCTG AGCAAAACCG
 201 GCCGGCAGTG GCAAAAATCA TCGAAGTTTT GGGCGATTAT GCCGACAGCG
 251 GCATGGAGAT TGAAATTGCC GTGCGCAAGC ATCATTTGCC GCACCAATTC
 301 AGTGAAGCGT GTGCCAAAGC TGCGAAAAAA ATTCCCGTCC ATGTACGCAA
 351 AAGCGATTTG AAAGGCCGCG TCGATTTGCG CGACCTGCCT TTGGTAACGA
 401 TAGACGGCGA AACGGCGCGC GATTTCGACG ACGCGGTGTT TGCCGAAAAA
 451 GTCGGACGCA ATTACCGTCT GGTCGTGGCG ATTGCGGATG TCAGCCATTA
 501 TGTCCGCCCT GACGATGTGA TTGATGCAGA TGCTCAAGAA CGCAGTACCA
 551 GCGTATATTT CCCGCGCCGT GTGATTCCGA TGCTGCCGGA AAACCTGTCT
 601 AACGGCATTT GCTCGCTCAA TCCCGATGTC GAGCGTTTGT GTATGGTGTG
 651 CGATATGGTC GTTACCTATG CGGGCAATAT CAAAGAATAC CGCTTCTACC
 701 CCGCCGTAAT GCGCTCTCAT GCCCGCCTGA CCTACAACCA AGTTTGGAAA
 751 TGGATTTCAG ACGGCATCGA CCATCCGTAC AAAGCCCAAA TCGACACCCT
 801 TTACAAACTC TTCAAAATCC TTCAGAAAAA GCGTTTCGAA CGCGGCGCGG
 851 TGGAGTTTGA AAGCGTCGAA ACCCAGATGA TTTTCGATGA CAACGGCAAA
 901 ATCGAAAAAA TCGTCCCCGT TGTCCGCAAC GATGCCCACA GCTGATTGA
 951 AGAATGTATG CTGGCGGCGA ATGTTTGCGC AGCGGATTTC CTGTTGAAAA
1001 ACAAGCATAC GGCTTTGTTC CGCAACCATT TGGGCCCCAC GCCCGAAAAA
1051 CTCGCCACCC TGCGCGAGCA GCTCGGTCTG TTGGGGCTTC AACTTGGCGG
1101 CGGCGACAAC CCGTCGCCGA AAGACTATGC CGCGCTTGTC GAACAATTCA
1151 AAGGCAGACC TGATGCCGAA TTGCTGCAAG TCATGATGTT GCGCTCCATG
1201 CAGCAGGCGG TTTACGAACC GCATTGCGAC GGACACTTTG GTCTTGCCTA
1251 CGAAGCATAC GCCCACTTCA CCTCGCCCAT CCGCCGCTAT CCCGACCTGA
1301 CCGTACACCG CGCCATCAAA GCCGTGTTGA ATCAGCAAAC CTACACGCCA
1351 AAAAAAAGCT GGCAGGCTTT GGGCGTGCAT ACCTCGTTCT GTGAGCGCCG
1401 TGCCGACGAC GCCAGCCGCG ACGTGGAAAA CTGGCTGAAA ACCTATTATA
1451 TGCGCGATAA GGTCGGCGAA GTATTCGAAG GTAAAATCTC CGGCATGACC
1501 AGTTTTGGTA TCTTTGTAAC ACTGGACGGC ATCCACATTG ACGGCTTGGT
1551 GCATATCAGC GATTTGGGCG AAGACTATTT CAACTTCCGC CCCGAAATCA
1601 TGGCAATCGA AGGCGAACGC AGCGGCATCC GTTTCAACAT GGGGGACAGG
1651 GTTGCCGTCC GGGTCGCCCG TGCCGATTTG GATGACGGAA AAATCGATTT
1701 TGTCCTGATT GCCGGGGGGA GCGGCAGGGG GCGGAAAGTT AAATCATCCG
1751 CGTCTGCCAA ACCGGCAGGG ACGGCGGGGA AAGGGAAGCC GAAAACCGCC
1801 GCCGAGAAAA AAACAGCCCG AGGCGGCAAA GTAAGGGGAA GGGGCGCGTC
1851 TGCCGCCGCA GAATCGAGGA AAAAGGCAAA GAAACCGGTT CCGATTAAGG
1901 TAAAAAAACG GAAAGGCAAA TCATAA
```

This corresponds to the amino acid sequence <SEQ ID 2982; ORF 988>:

```
m988.pep (partial)
   1  ..TVLDIVERAQ SKVVGRFYMD RGVAILEPED KRLNQSIVLE PDGVARFKPE

51    SGQVIVGEIE VYPEQNRPAV AKIIEVLGDY ADSGMEIEIA VRKHHLPHQF

101    SEACAKAAKK IPVHVRKSDL KGRVDLRDLP LVTIDGETAR DFDDAVFAEK

151    VGRNYRLVVA IADVSHYVRP DDVIDADAQE RSTSVYFPRR VIPMLPENLS

201    NGICSLNPDV ERLCMVCDMV VTYAGNIKEY RFYPAVMRSH ARLTYNQVWK

251    WISDGIDHPY KAQIDTLYKL FKILQKKRFE RGAVEFESVE TQMIFDDNGK

301    IEKIVPVVRN DAHKLIEECM LAANVCAADF LLKNKHTALF RNHLGPTPEK

351    LATLREQLGL LGLQLGGGDN PSPKDYAALV EQFKGRPDAE LLQVMMLRSM

401    QQAVYEPHCD GHFGLAYEAY AHFTSPIRRY PDLTVHRAIK AVLNQQTYTP

451    KKSWQALGVH TSFCERRADD ASRDVENWLK TYYMRDKVGE VFEGKISGMT

501    SFGIFVTLDG IHIDGLVHIS DLGEDYFNFR PEIMAIEGER SGIRFNMGDR

551    VAVRVARADL DDGKIDFVLI AGGSGRGRKV KSSASAKPAG TAGKGKPKTA

601    AEKKTARGGK VRGRGASAAA ESRKKAKKPV PIKVKKRKGK S*
```

Computer analysis of this amino acid sequence gave the following results:

Homology with a Predicted ORF from *N. gonorrhoeae*

```
    m988/g988  94.2% identity in 642 aa overlap 10         20         30
   m988.pep                 TVLDIVERAQSKVVGRFYMDRGVAILEPED
                            ||||||||||||||||||||||||||||||
   g988       LYERQMRGVMHGDTVTVRPAGMDRRGRREGTFLDIVERAQSKVVGRFYMDRGVAILEPED
                     130       140       150       160       170       180

40         50         60         70         80         90
   m988.pep   KRLNQSIVLEPDGVARFKPESGQVIVGEIEVYPEQNRPAVAKIIEVLGDYADSGMEIEIA
              |||||||||||||||||||||||||||||:||||||||||||||||||||||||||||||
   g988       KRLNQSIVLEPDGVARFKPESGQVIVGKIEVYPEQNRPAVAKIIEVLGDYADSGMEIEIA
                     190       200       210       220       230       240

100        110        120        130        140        150
   m988.pep   VRKHHLPHQFSEACAKAAKKIPVHVRKSDLKGRVDLRDLPLVTIDGETARDFDDAVFAEK
              ||||||||:|||||||:||||:||||||||||||| :|||||||||||||||||||||||
   g988       VRKHHLPHRFSEACAKSAKKIPDHVRKSDLKGRVDLCDLPLVTIDGETARDFDDAVFAEK
                     250       260       270       280       290       300

160        170        180        190        200        210
   m988.pep   VGRNYRLVVAIADVSHYVRPDDVIDADAQERSTSVYFPRRVIPMLPENLSNGICSLNPDV
              |||||||||||||||||||||::|||||||||||||||||:|||||||||||||||||||
   g988       VGRNYRLVVAIADVSHYVRPDDAIDADAQERSTSVYFPRRMIPMLPENLSNGICSLNPDV
                     310       320       330       340       350       360

220        230        240        250        260        270
   m988.pep   ERLCMVCDMVVTYAGNIKEYRFYPAVMRSHARLTYNQVWKWISDGIDHPYKAQIDTLYKL
              |||||||||||||||||||||||||||||||||||||||||:||||:|:|:|||||||||
   g988       ERLCMVCDMVVTYAGNIKEYRFYPAVMRSHARLTYNQVWKWLSDGIGNPHKAQIDTLYKL
                     370       380       390       400       410       420

280        290        300        310        320        330
   m988.pep   FKILQKKRFERGAVEFESVETQMIFDDNGKIEKIVPVVRNDAHKLIEECMLAANVCAADF
              ||||||||:|||||||||||||||||||||||||||||||||||||||||||||||||||
   g988       FKILQKKRLARGAVEFESVETQMIFDDNGKIEKIVPVVRNDAHKLIEECMLAANVCAADF
                     430       440       450       460       470       480

340        350        360        370        380        390
   m988.pep   LLKNKHTALFRNHLGPTPEKLATLREQLGLLGLQLGGGDNPSPKDYAALVEQFKGRPDAE
              |||||||||||||||||||||||||||||||||||||||||||||||:||||||||||||
   g988       LLKNKHTALFRNHLGPTPEKLATLREQLGLLGLQLGGGDNPSPKDYAALAEQFKGRPDAE
                     490       500       510       520       530       540

400        410        420        430        440        450
   m988.pep   LLQVMMLRSMQQAVYEPHCDGHFGLAYEAYAHFTSPIRRYPDLTVHRAIKAVLNQQTYTP
              |||||||||||||||||||:||||||||||||||||||||||||||||||||||::||||
   g988       LLQVMMLRSMQQAVYEPHCEGHFGLAYEAYAHFTSPIRRYPDLTVHRAIKAVLNRKTYTP
                     550       560       570       580       590       600
```

```
                   460        470        480        490       500   509
m988.pep   KKSWQALGVHTSFCERRADDASRDVENWLKTYYMRDKVGEVFEGKIS-GMTSFGIFVTLD
           :|||||||||||||||||||||:||||||||||||||||||:||||||  |:::||||||
g988       NKSWQALGVHTSFCERRADDAGRDVENWLKTYYMRDKVGEIFEGKISRGVANFGIFVTLD
                   610        620        630        640       650   660

510        520        530        540       550   569
m988.pep   GIHIDGLVHISDLGEDYFNFRPEIMAIEGERSGIRFNMGDRVAVRVARADLDDGKIDFVL
           |||||||||||||||||||||||||||||||||||||||||||||||||||||||||||
g988       DIHIDGLVHISDLGEDYFNFRPEIMAIEGERSGIRFNMGDRVAVRVARADLDDGKIDFVL
                   670        680        690        700       710   720

570        580        590        600       610   629
m988.pep   IAGGSGRGRKVKSSASAKPAGTAGKGKPKTAAEKKTARGGKVRGRGASAAAESRKKAKKP
           |||  |||  ||||  ||||||||||:|||| || :|||||||||||  |:|||  |||
g988       IAGESGRRRKVKLSASAKPAGAAGKGKSKTTAEKKTARCGKVRGRGVPAVAESGKKAKKP
                   730        740        750        760        70   780

630        640
m988.pep   VPIKVKKRKGKSX
           |||||||||||||
g988       VPIKVKKRKGKSX
                   790
```

The following partial DNA sequence was identified in *N. meningitidis* <SEQ ID 2983>:

```
a988.seq
   1 ATGAATAAAA ATATTAAATC TTTAAATTTA CGGGAAAAAG ACCCGTTTTT

51 AAGTCGTGAA AAACAGCGTT ATGAACATCC TTTGCCCAGT CGGGAATGGA

101 TAATCGAGCT GCTTGAACGT AAAGGCGTAC CATCCAAGAT TGAAGCTTTG

151 GTACGCGAAT TGTCGATTAA GGAAGAAGAG TACGAATTTT TCGAACGTCG

201 TCTGAAGGCG ATGGCGCGGG ACGGTCAGGT TTTAATCAAC CGTCGGGCG

251 CGGTTTGCGC GGCGGACAAA TTGGATTTGG TCAAATGCCG TGTCAAGGCG

301 CACAAAGACC GCTTCGGTTT CGCCGTGCCG CTCACGCCCG CCAAAGACGG

351 TGATTTTGTC TTGTACGAAC GCCAGATGCG CGGCATTATG CACGGCGATA

401 TTGTCACTGT TCGTCCTGCC GGCATGGACG GTAGGGGCCG CCGCGAAGGG

451 ACGGTTCTGG ATATTGTCGA ACGCGCGCAA AGCAAAGTGG TCGGCCGTTT

501 CTANATGGAT AGGGGCGTGG CGATTTTGGA GCCGGAAGAC AAGCGTCTGA

551 ACCAAAGCAT CGTATTGGAA CCGGACGGCG TGGCGCGTTT CAAACCTGAA

601 TCCGGTCAGG TCATCGTCGG CGAAATTGAG GTTTATCCTG AGCAAAACCG

651 GCCGGCAGTG GCAAAAATCA TCGAAGTTTT GGGCGATTAT GCCGACAGCG

701 GCATGGAGAT TGAAATTGCC GTGCGCAAGC ATCATTTGCC GCACCAATTC

751 AGTGAAGCGT GTGCCAAAGC CGCGAAAAAA ATTCCCGACC ATGTACGCAA

801 AAGCGATTTG AAAGGCCGCG TCGATTTGCG CGACCTGCCT TTGGTAACGA

851 TAGACGGCGA AACGGCTCGA GATTTTGACG ATGCGGTGTT TGCCGAGAAA

901 ATCGGACGCA ATTACCGTCT GGTCGTGGCG ATTGCCGATG TCAGCCATTA

951 TGTCCGCCCC GATGACGCTA TCGACACGGA CGCTCAGGAA CGCAGCACCA

1001 GTGTTTACTT CCCGCGCCGC GTGATTCCCA TGTTGCCGGA AAACCTGTCC

1051 AACGGCATCT GCTCGCTCAA TCCTCATGTC GAGCGTTTGT GTGTGGTGTG

1101 CGATATGGTT ATCACTTACG CGGGCAATAT CAAAGAATAC CGCTTCTACC

1151 CCGCCGTGAT GCGCTCTCAT GCCCGCCTGA CCTACAACCA AGTTTGGAAA

1201 TGGCTTTCAG GCGGCATCGA GCATCCGTTC AAACCCAAA TCGACACGCT

1251 TTACAAACTC TTCAAAATCC TTCAGAAAAA GCGTTTCGAA CGCGGGGCGG
```

-continued
```
1301 TGGAGTTTGA CAGCATCGAA ACCCAAATGC TTTTCGACGA CAACGGTAAA

1351 ATTGAAAAAA TCGTCCCCGT TGTCCGCAAC GATGCCCACA AGCTGATTGA

1401 AGAATGTATG TTGGCGGCAA ACGTTTGCGC AGCGGATTTT CTGTTGAAAA

1451 ACAAGCATAC CGCATTGTTC CGCAACCATT TGGGGCCCAC GCCCGAAAAA

1501 CTCGCCGCCT TGCGCGAGCA GCTCGGTCTG TTGGGGCTTC AACTTGGCGG

1551 CGGCGACAAC CCGTCGCCGA AAGACTATGC CGCGCTTGCC GGACAGTTCA

1601 AAGGCAGGCC GGATGCCGAA TTGCTGCAAG TCATGATGTT GCGCTCCATG

1651 CAACAGGCGG TTTACGAACC GCATTGCGAC GGACACTTTG GTCTTGCCTA

1701 CGAAGCATAC GCCCACTTCA CCTCGCCCAT CCGCCGCTAT CCCGACCTGA

1751 CCGTACACCG CGCCATCAAA GCCGTGTTGA ATCAGCAAAC CTACACGCCA

1801 AAAAAAAGCT GGCAGGCTTT GGGCGTGCAT ACCTCGTTCT GTGAGCGCCG

1851 TGCCGACGAC GCCAGCCGCG ACGTGGAAAA CTGGCTGAAA ACCTATTATA

1901 TGCGCGATAA GGTCGGCGAA GTATTCGAAG GTAAAATCTC CGGCATGACC

1951 AGTTTTGGTA TCTTTGTAAC ACTGGACGGC ATCCACATTG ACGGCTTGGT

2001 GCATATCAGC GATTTGGGCG AAGACTATTT CAACTTCCGC CCCGAAATCA

2051 TGGCAATCGA AGGCGAACGC AGCGGCATCC GTTTCAACAT GGGGGACAGG

2101 GTTGCCGTCC GGGTCGCCCG TGCCGATTTG GATGACGGAA AAATCGATTT

2151 TGTCCTGATT GCCGGGGGGA GCGGCAGGGG GCGGAAAGTT AAATCATCCG

2201 CGTCTGCCAA ACCGGCAGGG ACGGCGGGGA AAGGGAAGCC GAAAACCGCC

2251 GCCGAGAAAA AAACAGCCCG AGGCGGCAAA GTAAGGGGAA GGGGCGCGTC

2301 TGCCGCCGCA GAATCGAGGA AAAAGGCAAA GAAACCGGTT CCGATTAAGG

2351 TAAAAAAACG GAAAGGCAAA TCATAA
```

This corresponds to the amino acid sequence <SEQ ID 2984; ORF 988.a>:

```
a988.pep

1 MNKNIKSLNL REKDPFLSRE KQRYEHPLPS REWIIELLER KGVPSKIEAL
   51 VRELSIKEEE YEFFERRLKA MARDGQVLIN RRGAVCAADK LDLVKCRVKA
  101 HKDRFGFAVP LTPAKDGDFV LYERQMRGIM HGDIVTVRPA GMDGRGRREG
  151 TVLDIVERAQ SKVVGRFXMD RGVAILEPED KRLNQSIVLE PDGVARFKPE
  201 SGQVIVGEIE VYPEQNRPAV AKIIEVLGDY ADSGMEIEIA VRKHHLPHQF
  251 SEACAKAAKK IPDHVRKSDL KGRVDLRDLP LVTIDGETAR DFDDAVFAEK
  301 IGRNYRLVVA IADVSHYVRP DDAIDTDAQE RSTSVYFPRR VIPMLPENLS
  351 NGICSLNPHV ERLCVVCDMV ITYAGNIKEY RFYPAVMRSH ARLTYNQVWK
  401 WLSGGIEHPF KTQIDTLYKL FMILQKKRFE RGAVEFDSIE TQMLFDDNGK
  451 IEKIVPVVRN DAHKLIEECM LAANVCAADF LLKNKHTALF RHNLGPTPEK
  501 LAALREQLGL LGLQLGGGDN PSPKDYAALA GQFKGRPDAE LLQVMMLRSM
  551 QQAVYEPHCD GHFGLAYEAY AHFTSPIRRY PDLTVHRAIK AVLNQQTYTP
  601 KKSWQALGVH TSFCERRADD ASRDVENWLK TYYMRDKVGE VFEGKISGMT
  651 SFGIFVTLDG IHIDGLVHIS DLGEDYFNFR PEIMAIEGER SGIRFNMGDR
  701 VAVRVARADL DDGKIDFVLI AGGSGRGRKV KSSASAKPAG TAGKGKPKTA
  751 AEKKTARGGK VRGRGASAAA ESRKKAKKPV PIKVKKRKGK S*
```

-continued

```
m988/a988  97.0% identity in 641 aa overlap 10        20        30
m988.pep                      TVLDIVERAQSKVVGRFYMDRGVAILEPED
                              ||||||||||||||||| ||||||||||||
a986       LYERQMRGIMHGDIVTVRPAGMDGRGRREGTVLDIVERAQSKVVGRFXMDRGVAILEPED
                 130       140       150       160       170       180

40        50        60        70        80        90
m988.pep   KRLNQSIVLEPDGVARFKPESGQVIVGEIEVYPEQNRPAVAKIIEVLGDYADSGMEIEIA
           ||||||||||||||||||||||||||||||||||||||||||||||||||||||||||||
a988       KRLNQSIVLEPDGVARFKPESGQVIVGEIEVYPEQNRPAVAKIIEVLGDYADSGMEIEIA
                 190       200       210       220       230       240

100       110       120       130       140       150
m988.pep   VRKHHLPHQFSEACAKAAKKIPVHVRKSDLKGRVDLRDLPLVTIDGETARDFDDAVPAEK
           |||||||||||||||||||| |||||||||||||||||||||||||||||||||||||| 
a988       VRKHHLPHQFSEACAKAAKKIPDHVRKSDLKGRVDLRDLPLVTIDGETARDFDDAVPAEK
                 250       260       270       280       290       300

160       170       180       190       200       210
m988.pep   VRGNYRLVVAIADVSHYVRPDDVIDADAQERSTSVYFPRRVIPMLPENLSNGICSLNPDV
           :|||||||||||||||||||||:|:|||||||||||||||||||||||||||||||| |
a988       IGRNYRLVVAIADVSHYVRPDDAIDTDAQERSTSVYFPRRVIPMLPENLSNGICSLNPHV
                 310       320       330       340       350       360

220       230       240       250       260       270
m988.pep   ERLCMVCDMVVTYAGNIKEYRFYPAVMRSHARLTYNQVWKWISDGIDHPYKAQIDTLYKL
           |||| ||||| :||||||||||||||||||||||||||||| |: ||:|| :|||||||
a988       ERLCVVCDMVITYAGNIKEYRFYPAVMRSHARLTYNQVWKWLSGGIEHPFKTQIDTLYKL
                 370       380       390       400       410       420

280       290       300       310       320       330
m988.pep   FKILQKKRFERGAVEFESVETQMIFDDNGKIEKIVPVVRNDAHKLIEECMLAANVCAADF
           ||||||||||||||||:|:||||:|||||||||||||||||||||||||||||||||||
a988       FKILQKKRFERGAVEFDSIETQMLFDDNGKIEKIVPVVRNDAHKLIEECMLAANVCAADF
                 430       440       450       460       470       480

340       350       360       370       380       390
m988.pep   LLKNKHTALFRNHLGPTPEKLATLREQLGLLGLQLGGGDNPSPKDYAALVEQFKGRPDAE
           |||||||||||||||||||||| |||||||||||||||||||||||||| ||||||||| 
a988       LLKNKHTALFRNHLGPTPEKLAALREQLGLLGLQLGGGDNPSPKDYAALAGQFKGRPDAE
                 490       500       510       520       530       540

400       410       420       430       440       450
m988.pep   LLQVMMLRSMQQAVYEPHCDGHFGLAYEAYAHFTSPIRRYPDLTVHRAIKAVLNQQTYTP
           ||||||||||||||||||||||||||||||||||||||||||||||||||||||||||| 
a988       LLQVMMLRSMQQAVYEPHCDGHFGLAYEAYAHFTSPIRRYPDLTVHRAIKAVLNQQTYTP
                 550       560       570       580       590       600

460       470       480       490       500       510
m988.pep   KKSWQALGVHTSFCERRADDASRDVENWLKTYYMRDKVGEVFEGKISGMTSFGIFVTLDG
           ||||||||||||||||||||||||||||||||||||||||||||||||||||||||||| 
a988       KKSWQALGVHTSFCERRADDASRDVENWLKTYYMRDKVGEVFEGKISGMTSFGIFVTLDG
                 610       620       630       640       650       660

520       530       540       550       560       570
m988.pep   IHIDGLVHISDLGEDYFNFRPEIMAIEGERSGIRFNMGDRVAVRVARADLDDGKIDFVLI
           ||||||||||||||||||||||||||||||||||||||||||||||||||||||||||| 
a988       IHIDGLVHISDLGEDYFNFRPEIMAIEGERSGIRFNMGDRVAVRVARADLDDGKIDFVLI
                 670       680       690       700       710       720

580       590       600       610       620       630
m988.pep   AGGSGRGRKVKSSASAKPAGTAGKGKPKTAAEKKTARGGKVRGRGASAAAESRKKAKKPV
           ||||||||||||||||||||||||||||||||||||||||||||||||||||||||||| 
a988       AGGSGRGRKVKSSASAKPAGTAGKGKPKTAAEKKTARGGKVRGRGASAAAESRKKAKKPV
                 730       740       750       760       770       780

640
m988.pep   PIKVKKRKGKSX
           ||||||||||||
a988       PIKVKKRKGKSX
                 790
```

The following partial DNA sequence was identified in *N. gonorrhoeae* <SEQ ID 2985>:

```
g989.seq
   1 ATGACCCCTT TCACACTGAA AAAACCGTC CTGCTGCTCG GCACTGCCTT

51 TGCCGCCGCA TCTGTCCACG CATCCGGCTA CCACTTCGGC ACACAGTCGG

101 TCAACGCGCA AAGCACGGCA AATGCCGCCG ACGCGTCGAC CATCTTCTAC

151 AATCCCGCCG GCCTGACCAA ACTCGACAGC AGCCAGATTT CCGTCAACGC

201 CAACATCGTG CTGCCCAGCA TTCATTATGA AGCAGATTCC GCCACCGACT
```

```
 251 TTACCGGGCT TCCCGTCCAA GGTTCTAAAA ACGGCAAAAT CACCAAAACC

301 ACGGTCGCAC CCCACATTTA CGGCGCATAC AAAGTCAACG ACAATCTGAC

351 CGTGGGCTTG GGCGTGTACG TCCCCTTCGG CTCTGCCACC GAATACGAAA

401 AAGATTCCGT GTTGCGCCAC AACATCAACA AACTCGGTCT GACCAGCATC

451 GCCGTCGAAC CTGTCGCCGC GTGGAAACTC AACGAACGCC ATTCCTTCGG

501 CGCAGGCATC ATCGCCCAAC ATAATTCCGC CGAACTGCGC AAATATGCCG

551 ACTGAGGAAT CCCAAAAAAA GCGCAAATGC TGCAAGCAAC ACCTTCTAAT

601 CCTACTGCCG CTGCTCAAAT CAAGGCCGAC GGACACGCCG ATGTCAAAGG

651 CAGCGATTGG GGCGTCGGCT ACCAACTGGC GTGGATGTGG GACATCAACG

701 ACCGCGCGCG CGTGGGCGTG AACTACCGTT CCAAAGTTTC ACACACGCTC

751 AAAGGCGATG CCGAATGGGC GGCAGACGGC GCGGCGGCGA ACAACAGTG

801 GAATGACAAT ATGCTCACAC CGCTCGGTTA CACGGCGAAT GAAAAAGCCA

851 GTGTCAAAAT CGTAACGCCT GAGTCTTTGT CCGTACACGG CATGTACAAA

901 GTGTCCGACA AAGCCGACCT GTTCGGCGAC GTAACTTGGA CGCGCCACAG

951 CCGCTTCAAT AAGGCGGAAC TGTTTTTTGA AAAAGAAAAA AATATTGCTA

1001 ATGGCAAAAA ATCCGACCGC ACCACCATCA CCCCCAACTG GCGCAACACC

1051 TACAAAGTCG GCTTGGGCGG TTCTTATCAA ATCAGCGAAC CGCTGCAACT

1101 GCGCGTCGGC ATCGCTTTTG ACAAACCGCC TGTCCGCAAC GCCGACTacC

1151 GCATGAACAG CCTGCCCGAC GGCAACCGCA TCTGGTTCTC CGCCGGCATG

1201 AAATACCATA TCGGCAAAAA CCACGTCGTC GATGCCGCCT ACACCCACAT

1251 CCACATCAAC GACACCAGCT ACCGCACGGC GAAGGCAAGC GGCAACGATG

1301 TGGACAGCAA AGGTGCGTCT TGCGCACGTT TCAAAAACCA CGCCGACATC

1351 ATCGGCCTGC AATACACCTA CAAATTCAAA TAA
```

This corresponds to the amino acid sequence <SEQ ID 2986; ORF 989.ng>:

```
g989.pep
  1 MTPFTLKKTV LLLGTAFAAA SVHASGYHFG TQSVNAQSTA NAADASTIFY

51 NPAGLTKLDS SQISVNANIV LPSIHYEADS ATDFTGLPVQ GSKNGKITKT

101 TVAPHIYGAY KVNDNLTVGL GVYVPFGSAT EYEKDSVLRH NINKLGLTSI

151 AVEPVAAWKL NERHSFGAGI IAQHNSAELR KYAD*GIPKK AQMLQATPSN

201 PTAAAQIKAD GHADVKGSDW GVGYQLAWMW DINDRARVGV NYRSKVSHTL

251 KGDAEWAADG AAAKQQWNDN MLTPLGYTAN EKASVKIVTP ESLSVHGMYK

301 VSDKADLFGD VTWTRHSRFN KAELFFEKEK NIANGKKSDR TTITPNWRNT

351 YKVGLGGSYQ ISEPLQLRVG IAFDKPPVRN ADYRMNSLPD GNRIWFSAGM

401 KYHIGKNHVV DAAYTHIHIN DTSYRTAKAS GNDVDSKGAS CARFKNHADI

451 IGLQYTYKFK *
```

The following partial DNA sequence was identified in *N. meningitidis* <SEQ ID 2987>:

```
m989.seq
  1 ATGACCCCTT CCGCACTGAA AAAACCGTC CTGCTGCTCG GCACTGCCTT
```

-continued

```
  51 TGCCGCCGCA TCCGTCCACG CATCCGGCTA CCACTTCGGC ACACAGTCGG
 101 TCAACGCGCA AAGCACGGCA AATGCCGCCG CCGCAGAAGC CGCCGACGCA
 151 TCGACCATCT TCTACAACCC TGCCGGCCTG ACCAAACTCG ACAGCAGCCA
 201 GATTTCCGTC AACGCCAACA TCGTGCTGCC CAGCATTCAT TATGAGGCGG
 251 ATTCCGCCAC CGACTTTACC GGGCTTCCCG TCCAAGGTTC GAAAAGCGGC
 301 AAAATCACCA AAACCACGGT CGCGCCCCAC ATCTACGGCG CATACAAAGT
 351 CAACGACAAT CTGACCGTGG GCTTGGGCGT GTACGTCCCC TTCGGCTCTG
 401 CCACCGAATA CGAAAAAGAT TCCGTGTTGC GCCACAACAT CAACAAACTC
 451 GGTCTGACCA GCATCGCCGT CGAACCTGTC GCCGCGTGGA AACTCAACGA
 501 CCGCCATTCC TTCGGCGCAG GCATCATCGC CCAACATACT TCCGCCGAAC
 551 TGCGCAAATA TGCCGACTGG GGGATTAAGA GTAAAGCAGA GATATTGACG
 601 GCAAAACCGC CCAAACCTAA CGGTGTAGCC GAAGCTGCAA AAATTCAGGC
 651 CGACGGACAC GCCGATGTCA AAGGCAGCGA TTGGGGCTTC GGCTACCAAC
 701 TGGCGTGGAT GTGGGACATC AACGACCGTG CGCGCGTGGG CGTGAACTAC
 751 CGTTCCAAAG TCTCGCACAC GCTCAAAGGC GATGCCGAAT GGGCGGCAGA
 801 CGGCGCGGCG GCGAAAGCAA TGTGGAGTAC GATGCTTGCA GCAAACGGCT
 851 ACACGGCGAA TGAAAAAGCC CGCGTTAAAA TCGTTACGCC TGAGTCTTTG
 901 TCCGTACACG GTATGTACAA AGTGTCCGAT AAAGCCGACC TGTTCGGCGA
 951 CGTAACTTGG ACGCGCCACA GCCGCTTCGA TAAGGCGGAA CTGGTTTTTG
1001 AAAAAGAAAA AACCGTCGTC AAAGGCAAAT CCGACCGCAC CACCATCACC
1051 CCCAACTGGC GCAACACCTA CAAAGTCGGC TTCGGCGGTT CTTATCAAAT
1101 CAGCGAACCG CTGCAACTGC GCGCCGGCAT CGCTTTTGAC AAATCGCCCG
1151 TCCGCAACGC CGACTACCGC ATGAACAGCC TACCCGACGG CAACCGCATC
1201 TGGTTCTCCG CCGGTATGAA ATACCATATC GGTAAAAACC ACGTCGTCGA
1251 TGCCGCCTAC ACCCACATCC ACATCAACGA CACCAGCTAC CGCACGGCGA
1301 AGGCAAGCGG CAACGATGTG GACAGCAAAG GCGCGTCTTC CGCACGTTTC
1351 AAAAACCACG CCGACATCAT CGGTCTGCAA TACACCTACA AATTCAAATA
1401 A
```

This corresponds to the amino acid sequence <SEQ ID 2988; ORF 989>:

```
m989.pep
   1 MTPSALKKTV LLLGTAFAAA SVHASGYHFG TQSVNAQSTA NAAAAEAADA
  51 STIFYNPAGL TKLDSSQISV NANIVLPSIH YEADSATDFT GLPVQGSKSG
 101 KITKTTVAPH IYGAYKVNDN LTVGLGVYVP FGSATEYEKD SVLRHNINKL
 151 GLTSIAVEPV AAWKLNDRHS FGAGIIAQHT SAELRKYADW GIKSKAEILT
 201 AKPPKPNGVA EAAKIQADGH ADVKGSDWGF GYQLAWMWDI NDRARVGVNY
 251 RSKVSHTLKG DAEWAADGAA AKAMWSTMLA ANGYTANEKA RVKIVTPESL
 301 SVHGMYKVSD KADLFGDVTW TRHSRFDKAE LVFEKEKTVV KGKSDRTTIT
 351 PNWRNTYKVG FGGSYQISEP LQLRAGIAFD KSPVRNADYR MNSLPDGNRI
```

-continued
```
401 WFSAGMKYHI GKNHVVDAAY THIHINDTSY RTAKASGNDV DSKGASSARF

451 KNHADIIGLQ YTYKFK*
```

Computer analysis of this amino acid sequence gave the following results:

Homology with a Predicted ORF from *N. gonorrhoeae*

```
    g989/m989  90.0% identity in 468 aa overlap 10         20         30         40         50
      g989.pep   MTPFTLKKTVLLLGTAFAAASVHASGYHFGTQSVNAQSTANAA-----DASTIFYNPAGL
                 ||| :|||||||||||||||||||||||||||||||||||||     ||||||||||||
      m989       MTPSALKKTVLLLGTAFAAASVHASGYHFGTQSVNAQSTANAAAAEAADASTIFYNPAGL
                    10         20         30         40         50         60

60         70         80         90        100        110
      g989.pep   TKLDSSQISVNANIVLPSIHYEADSATDFTGLPVQGSKNGKITKTTVAPHIYGAYKVNDN
                 |||||||||||||||||||||||||||||||||||||:||||||||||||||||||||||
      m989       TKLDSSQISVNANIVLPSIHYEADSATDFTGLPVQGSKSGKITKTTVAPHIYGAYKVNDN
                    70         80         90        100        110        120

120        130        140        150        160        170
      g989.pep   LTVGLGVYVPFGSATEYEKDSVLRHNINKLGLTSIAVEPVAAWKLNERHSFGAGIIAQHN
                 |||||||||||||||||||||||||||||||||||||||||||||:||||||||||||:
      m989       LTVGLGVYVPFGSATEYEKDSVLRHNINKLGLTSIAVEPVAAWKLNDRHSFGAGIIAQHT
                       130        140        150        160        170        180

180        190        200        210        220        230
      g989.pep   SAELRKYADXGIPKKAQMLQATPSNPTA---AAQIKADGHADVKGSDWGVGYQLAWMWDI
                 ||||||||||  ||  :||::||  |  :::    ||:|||||||||||| ||||||||||
      m989       SAELRKYADWGIKSKAEILTAKPPKPNGVAEAAKIQADGHADVKGSDWGFGYQLAWMWDI
                       190        200        210        220        230        240

240        250        260        270        280        290
      g989.pep   NDRARVGVNYRSKVSHTLKGDAEWAADGAAAKQQWNDNMLTPLGYTANEKASVKIVTPES
                 ||||||||||||||||||||||||||||||||: |:  :||: |||||||| ||||||||
      m989       NDRARVGVNYRSKVSHTLKGDAEWAADGAAAKAMWS-TMLAANGYTANEKARVKIVTPES
                       250        260        270        280        290

300        310        320        330        340        350
      g989.pep   LSVHGMYKVSDKADLFGDVTWTRHSRFNKAELFFEKEKNIANGKKSDRTTITPNWRNTYK
                 |||||||||||||||||||||||||||:||||  ||||:::::||  |||||||||||||
      m989       LSVHGMYKVSDKADLFGDVTWTRHSRFDKAELVFEKEKTVVKGK-SDRTTITPNWRNTYK
                 300        310        320        330        340        350

360        370        380        390        400        410
      g989.pep   VGLGGSYQISEPLQLRVGIAFDKPPVRNADYRMNSLPDGNRIWFSAGMKYHIGKNHVVDA
                 ||:||||||||||||:||||||||||||||||||||||||||||||||||||||||||||
      m989       VGFGGSYQISEPLQLRAGIAFDKSPVRNADYRMNSLPDGNRIWFSAGMKYHIGKNHVVDA
                 360        370        380        390        400        410

420        430        440        450        460
      g989.pep   AYTHIHINDTSYRTAKASGNDVDSKGASCARFKNHADIIGLQYTYKFKX
                 ||||||||||||||||||||||||||||| |||||||||||||||||||
      m989       AYTHIHINDTSYRTAKASGNDVDSKGASSARFKNHADIIGLQYTYKFKX
                 420        430        440        450        460
```

The following partial DNA sequence was identified in *N. meningitidis* <SEQ ID 2989>:

```
a989.seq
    1 ATGACCCCTT CCGCACTGAA AAAAACCGTC CTACTGCTCG GCACTGCCTT

51 TGCCGCCGCA TCCGCACAAG CCTCCGGCTA CCACTTCGGC ACACAGTCGG

101 TCAACGCGCA AAGCACGGCA AATGCCGCCG CCGCAGAAGC CGCCGACGCA

151 TCGACCATCT TCTACAACCC TGCCGGCCTG ACCAAACTCG ACAGCAGCCA

201 GATTTCCGTC AACGCCAACA TCGTGCTGCC CAGCATTCAT TATGAGGCGG

251 ATTCCGCCAC CGACTTTACC GGGCTTCCCG TCCAAGGTTC GAAAAGCGGC

301 AAAATCACCA AAACCACGGT CGCGCCCCAC ATCTACGGCG CATACAAAGT

351 CAACGACAAT CTGACCGTAG GCTTGGGCGT GTACGTCCCC TTCGGTTCTG

401 CCACCGAATA CGAAAAAGAT TCCGTGTTGC GCCACAACAT CAACAAACTC

451 GGTCTGACCA GCATCGCCGT CGAACCTGTC GCCGCGTGGA AACTCAACGA
```

-continued

```
 501 ACGCCATTCC TTCGGCGCAG GCATCATCGC CCAACATACT TCCGCCGAGC

551 TGCGCAAATA TGCCGACTGG GGGATTATGG AAAAAGCGAA AGCACTAAAA

601 GAAACACCCC CCAATCCAAC TAAAGCCGCC CAAATCAAAG CCGACGGACA

651 CGCCGATGTC AAAGGCAGCG ATTGGGGCTT CGGCTACCAA CTGGCGTGGA

701 TGTGGGACAT CAACGACCGT GCGCGCGTGG GCGTGAACTA CCGTTCCAAA

751 GTCTCACACA CGCTCAAAGG CGATGCCGAA TGGGCGGCAG ACGACGCAAT

801 GGCGAAACAG TTATGGGATG CAAACAAACT CGCACTGCTC GGCTACACGC

851 CAAGCGAAAA AGCCCGCGTT AAAATCGTTA CGCCCGAGTC TTTGTCCGTA

901 CACGGTATGT ACAAAGTGTC CGACAAAGCC GACCTGTTCG GCGACGTAAC

951 TTGGACGCGC CACAGCCGCT TCGATAAGGC GGAACTGGTT TTTGAAAAAG

1001 AAAAAACCAT CGTCAACGGC AAATCCGACC GCACCACCAT CACCCCCAAC

1051 TGGCGCAACA CCTACAAAGT CGGCTTCGGC GGTTCTTATC AAATCAGCGA

1101 ACCGCTGCAA CTGCGCGCCG GCATCGCTTT TGACAAATCG CCCGTCCGCA

1151 ACGCCGACTA CCGCATGAAC AGCCTGCCCG ACGGCAACCG CATCTGGTTC

1201 TCCGCCGGCA TGAAATACCA TATCGGCAAA AACCACGTCG TCGATGCCGC

1251 CTACACCCAC ATCCACATCA ACGACACCAG CTACCGCACG GCGAAGGCAA

1301 GCGGCAACGA TGTGGACAGC AAAGGCGCGT CTTCCGCACG TTTCAAAAAC

1351 CACGCCGACA TCATCGGCCT GCAATACACC TACAAATTCA AATAA
```

This corresponds to the amino acid sequence <SEQ ID 2990; ORF 989.a>:

```
a989.pep

1 MTPSALKKTV LLLGTAFAAA SAQASGYHFG TQSVNAQSTA NAAAAEAADA

51 STIFYNPAGL TKLDSSQISV NANIVLPSIH YEADSATDFT GLPVQGSKSG

101 KITKTTVAPH IYGAYKVNDN LTVGLGVYVP FGSATEYEKD SVLRHNINKL

151 GLTSIAVEPV AAWKLNERHS FGAGIIAQHT SAELRKYADW GIMEKAKALK

201 ETPPNPTKAA QIKADGHADV KGSDWGFGYQ LAWMWDINDR ARVGVNYRSK

251 VSHTLKGDAE WAADDAMAKQ LWDANKLALL GYTPSEKARV KIVTPESLSV

301 HGMYKVSDKA DLFGDVTWTR HSRFDKAELV FEKEKTIVNG KSDRTTITPN

351 WRNTYKVGFG GSYQISEPLQ LRAGIAFDKS PVRNADYRMN SLPDGNRIWF

401 SAGMKYHIGK NHVVDAAYTH ININDTSYRT AKASGNDVDS KGASSARFKN

451 HADIIGLQYT YKFK* m989/a989  93.1% identity in 467 aa overlap 10         20         30         40         50         60
m989.pep    MTPSALKKTVLLLGTAFAAASVHASGYHFGTQSVNAQSTANAAAAEAADASTIFYNPAGL
            ||||||||||||||||||||::|||||||||||||||||||||||||||||||||||||
a989        MTPSALKKTVLLLGTAFAAASAQASGYHFGTQSVNAQSTANAAAAEAADASTIFYNPAGL
                    10         20         30         40         50         60

70         80         90        100        110        120
m989.pep    TKLDSSQISVNANIVLPSIHYEADSATDFTGLPVQGSKSGKITKTTVAPHIYGAYKVNDN
            ||||||||||||||||||||||||||||||||||||||||||||||||||||||||||||
a989        TKLDSSQISVNANIVLPSIHYEADSATDFTGLPVQGSKSGKITKTTVAPHIYGAYKVNDN
                    70         80         90        100        110        120

130        140        150        160        170        180
m989.pep    LTVGLGVYVPFGSATEYEKDSVLRHNINKLGLTSIAVEPVAAWKLNDRHSFGAGIIAQHT
            |||||||||||||||||||||||||||||||||||||||||||||||:||||||||||||
a989        LTVGLGVYVPFGSATEYEKDSVLRHNINKLGLTSIAVEPVAAWKLNERHSFGAGIIAQHT
                   130        140        150        160        170        180
```

```
                      190       200       210       220       230       240
m989.pep    SAELRKYADWGIKSKAEILTAKPPKPNGVAEAAKIQADGHADVKGSDWGFGYQLAWMWDI
            |||||||||||  ||: |    ||:|:    :||:|:|||||||||||||||||||||||
a989        SAELRKYADWGIMEKAKALKETPPNPT---KAAQIKADGHADVKGSDWGFGYQLAWMWDI
                      190       200       210       220       230

250       260       270       280       290     299
m989.pep    NDRARVGVNYRSKVSHTLKGDAEWAADGAAAKAMW-STMLAANGYTANEKARVKIVTPES
            |||||||||||||||||||||||||||||  || :|  ::  ||   |||:||||||||||
a989        NDRARVGVNYRSKVSHTLKGDAEWAADDAMAKQLWDANKLALLGYTPSEKARVKIVTPES
                      240       250       260       270       280       290

300       310       320       330       340       350     359
m989.pep    LSVHGMYKVSDKADLFGDVTWTRHSRFDKAELVFEKEKTVVKGKSDRTTITPNWRNTYKV
            |||||||||||||||||||||||||||||||||||||||||||:|:||||||||||||||
a989        LSVHGMYKVSDKADLFGDVTWTRHSRFDKAELVFEKEKTIVNGKSDRTTITPNWRNTYKV
                300       310       320       330       340       350

360       370       380       390       400       410     419
m989.pep    GFGGSYQISEPLQLRAGIAFDKSPVRNADYRMNSLPDGNRIWFSAGMKYHIGKNHVVDAA
            ||||||||||||||||||||||||||||||||||||||||||||||||||||||||||||
a989        GFGGSYQISEPLQLRAGIAFDKSPVRNADYRMNSLPDGNRIWFSAGMKYHIGKNHVVDAA
                360       370       380       390       400       410

420       430       440       450       460
m989.pep    YTHIHINDTSYRTAKASGNDVDSKGASSARFKNHADIIGLQYTYKFKX
            ||||||||||||||||||||||||||||||||||||||||||||||||
a989        YTHIHINDTSYRTAKASGNDVDSKGASSARFKNHADIIGLQYTYKFKX
                420       430       440       450       460
```

The following partial DNA sequence was identified in *N. meningitidis* <SEQ ID 2991>:

```
m990.seq
   1 ATGTTCAGAG CTCAGCTTGG TTCAAATACT CGTTCTACCA AAATCGGCGA

51 CGATGCCGAT TTTTCATTTT CAGACAAGCC GAAACCCGGC ACTTCCCATT

101 ATTTTTCCAG CGGTAAAACC GATCAAAATT CATCCGAATA TGGGTATGAC

151 GAAATCAATA TCCAAGGTAA AAATTACAAT AGCGGCATCC TCGCCGTCGA

201 TAATATGCCC GTTGTCAAAA AATATATTAC AGAGAAGTAT GGGGCTGATT

251 TAAAGCAGGC GGTTAAAAGT CAATTACAGG ATTTATACAA AACAAGACCG

301 GAAGCTTGGG CAGAAAATAA AAAACGGACT GAGGAGGCGT ATATAGCACA

351 GTTTGGAACA AAATTTAGTA CGCTCAAACA GACGATGCCC GATTTAATTA

401 ATAAATTGGT AGAAGATTCC GTACTCACTC CTCATAGTAA TACATCACAG

451 ACTAGTCTCA ACAACATCTT CAATAAAAAA TTACACGTCA AAATCGAAAA

501 CAAATCCCAC GTCGCCGGAC AGGTGTTGGA ACTGACCAAG ATGACGCTGA

551 AAGATTCCCT TTGGGAACCG CGCCGCCATT CCGACATCCA TACGCTGGAA

601 ACTTCCGATA ATGCCCGCAT CCGCCTGAAC ACGAAAGATG AAAAACTGAC

651 CGTCCATAAG GATTATGCGG GCGGCGCGGA TTTCCTGTTC GGCTACGACG

701 TGCGGGAGTC GGACGAACCC GCCCTGACCT TTGAAGACAA AGTCAGCGGA

751 CAATCCGGCG TGGTTTTGGA ACGCCGGCCG GAAAATCTGA AACGCTCGA

801 CGGGCGCAAA CTGATTGCGG CAAAAACGGC GGATTCCGGT TCGTTTGCGT

851 TTAAACAAAA TTACCGGCAG GGACTGTACG AATTATTGCT CAAGCAATGC

901 GAAGGCGGAT TTTGCTTGGG CGTGCAGCGT TTGGCTATCC CCGAGGCGGA

951 AGCGGTTTTA TATGCCCAAC AGGCTTATGC GGCAAATACT TTGTTTGGGC

1001 TGCGTGCCGC CGACAGGGGC GACGACGTGT ATGCCGCCGA TCCGTCCCGT

1051 CAAAAATTGT GGCTGCGCTT CATCGGCGGC CGGTCGCATC AAAATATACG

1101 GGGCGGCGCG GCTGCGGACG GGTGGCGCAA AGGCGTGCAA ATCGGCGGCG

1151 AGGTGTTTGT ACGGCAAAAT GAAGGCAGCC GACTGGCAAT CGGCGTGATG
```

-continued

```
1201  GGCGGCAGGG  CCGGCCAGCA  CGCATCAGTC  AACGGCAAAG  GCGGTGCGGC

1251  AGGCAGTGAT  TTGTATGGTT  ATGGCGGGGG  TGTTTATGCT  GCGTGGCATC

1301  AGTTGCGCGA  TAAACAAACG  GGTGCGTATT  TGGACGGCTG  GTTGCAATAC

1351  CAACGTTTCA  ACACCGCAT   CAATGATGAA  AACCGTGCGG  AACGCTACAA

1401  AACCAAAGGT  TGGACGGCTT  CTGTCGAAGG  CGGCTACAAC  GCGCTTGTGG

1451  CGGAAGGCAT  TGTCGGAAAA  GGCAATAATG  TGCGGTTTTA  CCTACAACCG

1501  CAGGCGCAGT  TTACCTACTT  GGGCGTAAAC  GGCGGCTTTA  CCGACAGCGA

1551  GGGGACGGCG  GTCGGACTGC  TCGGCAGCGG  TCAGTGGCAA  AGCCGCGCCG

1601  GCATTCGGGC  AAAAACCCGT  TTTGCTTTGC  GTAACGGTGT  CAATCTTCAG

1651  CCTTTTGCCG  CTTTTAATGT  TTTGCACAGG  TCAAAATCTT  TCGGCGTGGA

1701  AATGGACGGC  GAAAAACAGA  CGCTGGCAGG  CAGGACGGCA  CTCGAAGGGC

1751  GGTTCGGTAT  TGAAGCCGGT  TGGAAAGGCC  ATATGTCCGC  ACGCATCGGA

1801  TATGGCAAAA  GGACGGACGG  CGACAAAGAA  GCCGCATTGT  CGCTCAAATG

1851  GCTGTTTTGA
```

This corresponds to the amino acid sequence <SEQ ID 2992; ORF 990>:

```
m990.pep
    1  MFRAQLGSNT  RSTKIGDDAD  FSFSDKPKPG  TSHYFSSGKT  DQNSSEYGYD

51  EINIQGKNYN  SGILAVDNMP  VVKKYITEKY  GADLKQAVKS  QLQDLYKTRP

101  EAWAENKKRT  EEAYIAQFGT  KFSTLKQTMP  DLINKLVEDS  VLTPHSNTSQ

151  TSLNNIFNKK  LHVKIENKSH  VAGQVLELTK  MTLKDSLWEP  RRHSDIHTLE

201  TSDNARIRLN  TKDEKLTVHK  DYAGGADFLF  GYDVRESDEP  ALTFEDKVSG

251  QSGVVLERRP  ENLKTLDGRK  LIAAKTADSG  SFAFKQNYRQ  GLYELLLKQC

301  EGGFCLGVQR  LAIPEAEAVL  YAQQAYAANT  LFGLRAADRG  DDVYAADPSR

351  QKLWLRFIGG  RSHQNIRGGA  AADGWRKGVQ  IGGEVFVRQN  EGSRLAIGVM

401  GGRAGQHASV  NGKGGAAGSD  LYGYGGGVYA  AWHQLRDKQT  GAYLDGWLQY

451  QRFKHRINDE  NRAERYKTKG  WTASVEGGYN  ALVAEGIVGK  GNNVRFYLQP

501  QAQFTYLGVN  GGFTDSEGTA  VGLLGSGQWQ  SRAGIRAKTR  FALRNGVNLQ

551  PFAAFNVLHR  SKSFGVEMDG  EKQTLAGRTA  LEGRFGIEAG  WKGHMSARIG

601  YGKRTDGDKE  AALSLKWLF*
```

The following partial DNA sequence was identified in *N. meningitidis* <SEQ ID 2993>:

```
a990.seq
    1  ATGTTCAGAG  CTCAGCTTGG  TTCAAATACT  CGTTCTACCA  AAATCGGCGA

51  CGATGCCGAT  TTTTCATTTT  CAGACAAGCC  GAAACCCGGC  ACTTCCCATT

101  ATTTTTCCAG  CGGTAAAACC  GATCAAAATT  CATCCGAATA  TGGGTATGAC

151  GAAATCAATA  TCCAAGGTAA  AAACTACAAT  AGCGGCATAC  TCGCCGTCGA

201  TAATATGCCC  GTTGTTAAGA  AATATATTAC  AGATACTTAC  GGGGATAATT

251  TAAAGGATGC  GGTTAAGAAG  CAATTACAGG  ATTTATACAA  AACAAGACCC

301  GAAGCTTGGG  AAGAAAATAA  AAAACGGACT  GAGGAGGCGT  ATATAGAACA
```

-continued

```
 351 GCTTGGACCA AAATTTAGTA TACTCAAACA GAAAACCCC GATTTAATTA
 401 ATAAATTGGT AGAAGATTCC GTACTCACTC CTCATAGTAA TACATCACAG
 451 ACTAGTCTCA ACAACATCTT CAATAAAAAA TTACACGTCA AAATCGAAAA
 501 CAAATCCCAC GTCGCCGGAC AGGTGTTGGA ACTGACCAAG ATGACGCTGA
 551 AAGATTCCCT TTGGGAACCG CGCCGCCATT CCGACATCCA TATGCTGGAA
 601 ACTTCCGATA ATGCCCGCAT CCGCCTGAAC ACGAAAGATG AAAAACTGAC
 651 CGTCCATAAA GCGTATCAGG GCGGTGCGGA TTTCCTGTTC GGCTACGACG
 701 TGCGGGAGTC GGACAAACCC GCCCTGACCT TTGAAGAAAA AGTCAGCGGA
 751 CAATCCGGCG TGGTTTTGGA ACGCCGGCCG GAAAATCTGA AAACGCTCGA
 801 CGGGCGCAAA CTGATTGCGG CGGAAAAGGC AGACTCTAAT TCGTTTGCGT
 851 TTAAACAAAA TTACCGGCAG GGACTGTACG AATTATTGCT CAAGCAATGC
 901 GAAGGCGGAT TTTGCTTGGG CGTGCAGCGT TTGGCTATCC CCGAGGCGGA
 951 AGCGGTTTTA TATGCCCAAC AGGCTTATGC GGCAAATACT TTGTTCGGGC
1001 TGCGTGCCGC CGACAGGGGC GACGACGTGT ATGCCGCCGA TCCGTCCCGT
1051 CAAAAATTGT GGCTGCGCTT CATCGGCGGC CGGTCGCATC AAAATATACG
1101 GGGCGGCGCG GCTGCGGACG GCGGCGCAA AGGCGTGCAA ATCGGCGGCG
1151 AGGTGTTTGT ACGGCAAAAT GAAGGCAGCC GGCTGGCAAT CGGCGTGATG
1201 GGCGGCAGGG CTGGCCAGCA CGCATCAGTC AACGGCAAAG GCGGTGCGGC
1251 AGGCAGTTAT TTGCATGGTT ATGGCGGGGG TGTTTATGCT GCGTGGCATC
1301 AGTTGCGCGA TAAACAAACG GGTGCGTATT TGGACGGCTG GTTGCAATAC
1351 CAACGTTTCA AACACCGCAT CAATGATGAA AACCGTGCGG AACGCTACAA
1401 AACCAAAGGT TGGACGGCTT CTGTCGAAGG CGGCTACAAC GCGCTTGTGG
1451 CGGAAGGCGT TGTCGGAAAA GGCAATAATG TGCGGTTTTA CCTGCAACCG
1501 CAGGCGCAGT TTACCTACTT GGGCGTAAAC GGCGGCTTTA CCGACAGCGA
1551 GGGGACGGCG GTCGGACTGC TCGGCAGCGG TCAGTGGCAA AGCCGCGCCG
1601 GCATTCGGGC AAAAACCCGT TTTGCTTTGC GTAACGGTGT CAATCTTCAG
1651 CCTTTTGCCG CTTTTAATGT TTTGCACAGG TCAAAATCTT TCGGCGTGGA
1701 AATGGACGGC GAAAACAGA CGCTGGCAGG CAGGACGGCG CTCGAAGGGC
1751 GGTTCGGCAT TGAAGCCGGT TGGAAAGGCC ATATGTCCGC ACGCATCGGA
1801 TACGGCAAAA GGACGGACGG CGACAAAGAA GCCGCATTGT CGCTCAAATG
1851 GCTGTTTTGA
```

This corresponds to the amino acid sequence <SEQ ID 2994; ORF 990.a>:

```
a990.pep

1 MFRAQLGSNT RSTKIGDDAD FSFSDKPKPG TSHYFSSGKT DQNSSEYGYD
    51 EINIQGKNYN SGILAVDNMP VVKKYITDTY GDNLKDAVKK QLQDLYKTRP
   101 EAWEENKKRT EEAYIEQLGP KFSILKQKNP DLINKLVEDS VLTPHSNTSQ
   151 TSLNNIFNKK LHVKIENKSH VAGQVLELTK MTLKDSLWEP RRHSDIHMLE
   201 TSDNARIRLN TKDEKLTVHK AYQGGADFLF GYDVRESDKP ALTFEEKVSG
```

```
251 QSGVVLERRP ENLKTLDGRK LIAAEKADSN SFAFKQNYRQ GLYELLLKQC

301 EGGFCLGVQR LAIPEAEAVL YAQQAYAANT LFGLRAADRG DDVYAADPSR

351 QKLWLRFIGG RSHQNIRGGA AADGRRKGVQ IGGEVFVRQN EGSRLAIGVM

401 GGRAGQHASV NGKGGAAGSY LHGYGGGVYA AWHQLRDKQT GAYLDGWLQY

451 QRFKHRINDE NRAERYKTKG WTASVEGGYN ALVAEGVVGK GNNVRFYLQP

501 QAQFTYLGVN GGFTDSEGTA VGLLGSGQWQ SRAGIRAKTR FALRNGVNLQ

551 PFAAFNVLHR SKSFGVEMDG EKQTLAGRTA LEGRFGIEAG WKGHMSARIG

601 YGKRTDGDKE AALSLKWLF*
``` m990/a990  96.0% identity in 619 aa overlap

```
                  10         20         30         40         50         60
m990.pep  MFRAQLGSNTRSTKIGDDADFSFSDKPKPGTSHYFSSGKTDQNSSEYGYDEINIQGKNYN
          ||||||||||||||||||||||||||||||||||||||||||||||||||||||||||||
a990      MFRAQLGSNTRSTKIGDDADFSFSDKPKPGTSHYFSSGKTDQNSSEYGYDEINIQGKNYN
                  10         20         30         40         50         60

70         80         90        100        110        120
m990.pep  SGILAVDNMPVVKKYITEKYGADLKQAVKSQLQDLYKTRPEAWAENKKRTEEAYIAQFGT
          |||||||||||||||||:  ||  :|||:|||||||||||||||| :|||||||| :| :|
a990      SGILAVDNMPVVKKYITDTYGDNLKDAVKKQLQDLYKTRPEAWEEMKKRTEEAYIEQLGP
                  70         80         90        100        110        120

130        140        150        160        170        180
m990.pep  KFSTLKQTMPDLINKLVEDSVLTPHSNTSQTSLNNIFNKKLHVKIENKSHVAGQVLELTK
          |||  |||  ||||||||||||||||||||||||||||||||||||||||||||||||||
a990      KFSILKQKNPDLINKLVEDSVLTPHSNTSQTSLNNIFNKKLHVKIENKSHVAGQVLELTK
                 130        140        150        160        170        180

190        200        210        220        230        240
m990.pep  MTLKDSLWEPRRHSDIHTLETSDNARIRLNTKDEKLTVHKDYAGGADFLFGYDVRESDEP
          ||||||||||||||||| |||||||||||||||||||||| ||||||||||||||||:|
a990      MTLKDSLWEPRRHSDIHMLETSDNARIRLNTKDEKLTVHKAYQGGADFLFGYDVRESDKP
                 190        200        210        220        230        240

250        260        270        280        290        300
m990.pep  ALTFEDKVSGQSGVVLERRPENLKTLDGRKLIAAKTADSGSFAFKQNYRQGLYELLLKQC
          ||||::||||||||||||||||||||||||||||:|||:|||||||||||||||||||||
a990      ALTFEEKVSGQSGVVLERRPENLKTLDGRKLIAAEKADSNSFAFKQNYRQGLYELLLKQC
                 250        260        270        280        290        300

310        320        330        340        350        360
m990.pep  EGGFCLGVQRLAIPEAEAVLYAQQAYAANTLFGLRAADRGDDVYAADPSRQKLWLRFIGG
          ||||||||||||||||||||||||||||||||||||||||||||||||||||||||||||
a990      EGGFCLGVQRLAIPEAEAVLYAQQAYAANTLFGLRAADRGDDVYAADPSRQKLWLRFIGG
                 310        320        330        340        350        360

370        380        390        400        410        420
m990.pep  RSHQNIRGGAAADGWRKGVQIGGEVFVRQNEGSRLAIGVMGGRAGQHASVNGKGGAAGSD
          |||||||||||||| |||||||||||||||||||||||||||||||||||||||||||
a990      RSHQNIRGGAAADGRRKGVQIGGEVFVRQNEGSRLAIGVMGGRAGQHASVNGKGGAAGSY
                 370        380        390        400        410        420

430        440        450        460        470        480
m990.pep  LYGYGGGVYAAWHQLRDKQTGAYLDGWLQYQRFKHTINDENRAERYKTKGWTASVEGGYN
          |:||||||||||||||||||||||||||||||||||||||||||||||||||||||||||
a990      LHGYGGGVYAAWHQLRDKQTGAYLDGWLQYQRFKHTINDENRAERYKTKGWTASVEGGYN
                 430        440        450        460        470        480

490        500        510        520        530        540
m990.pep  ALVAEGIVGKGNNVRFYLQPQAQFTYLGVNGGFTDSEGTAVGLLGSGQWQSRAGIRAKTR
          |||||:||||||||||||||||||||||||||||||||||||||||||||||||||||
a990      ALVAEGVVGKGNNVRFYLQPQAQFTYLGVNGGFTDSEGTAVGLLGSGQWQSRAGIRAKTR
                 490        500        510        520        530        540

550        560        570        580        590        600
m990.pep  FALRNGVNLQPFAAFNVLHRSKSFGVEMDGEKQTLAGRTALEGRFGIEAGWKGHMSARIG
          ||||||||||||||||||||||||||||||||||||||||||||||||||||||||||||
a990      FALRNGVNLQPFAAFNVLHRSKSFGVEMDGEKQTLAGRTALEGRFGIEAGWKGHMSARIG
                 550        560        570        580        590        600

610        620
m990.pep  YGKRTDGDKEAALSLKWLFX
          ||||||||||||||||||||
a990      YGKRTDGDKEAALSLKWLFX
                 610        620
```

The following partial DNA sequence was identified in *N. gonorrhoeae* <SEQ ID 2995>:

```
g992.seq
    1 ATGTTCAGAC GGCATCGGCA TTTGAAAAAT ATGCAGATTA AAAAAATCAT

51 GAAATGGCTT CCCGTCGCCC TGTCGCTTTT GGGCGCGTTG GGTTATACGG

101 GATATGACAG TGAGGCGGTG CGGACGGCGG TTGCCGTACT CGACGTACTC

151 GGCACTGCAG GGGACGTGGG TTTCGACGCG CCCGTTCGCC GACGGGCATC

201 GGCGAAATCC GGCCACAGCT ACACAGGCAC GGTGTCCAAA GTCTATGACG

251 GCGATACCCT TCACGTCATC GACGGCGACG GCGCGAAACA TAAAATTCGG

301 ATGGCGTATA TCGACGCACC GGAGATGAAA CAGGCTTACG GTACACGTTC

351 GCGCGACAAC CTGCGCGCGG CGGCGGAGGG TAGGAAAGTC AGTGTACGTG

401 TGTTTGAAAC CGACCGCTAT CAGCGCGAAG TGGCGCAGGT ATCCGCCGGC

451 AAAACCGATT TGAACCTGAT GCAGGTGCAG GACGGGCGG CGTGGCATTA

501 TAAAAGTTAT GCTAAAGAAC AGCAGGATAA GGCGGATTTT GCCGACTATG

551 CCGACGCTCA AATTCAGGCG GAAAGGGAAC GCAAAGGATT GTGGAAAGCT

601 AAAAATCCGC AAGCGCCGTG GGCGTACCGC CGGGCAGGCA GGAGCGGCGG

651 GGGCAATAAG GATTGGATGG ATTCCGTGGG CGAATGGTTG GGCATTTGGT

701 AA
```

This corresponds to the amino acid sequence <SEQ ID 2996 ORF 992.ng>:

```
g992.pep
    1 MFRRHRHLKN MQIKKIMKWL PVALSLLGAL GYTGYDSEAV RTAVAVLDVL

51 GTAGDVGFDA PVRRRASAKS GHSYTGTVSK VYDGDTLHVI DGDGAKHKIR

101 MAYIDAPEMK QAYGTRSRDN LRAAAEGRKV SVRVFETDRY QREVAQVSAG

151 KTDLNLMQVQ DGAAWHYKSY AKEQQDKADF ADYADAQIQA ERERKGLWKA

201 KNPQAPWAYR RAGRSGGGNK DWMDSVGEWL GIW*
```

The following partial DNA sequence was identified in *N. meningitidis* <SEQ ID 2997>:

```
m992.seq
    1 ATGTTCAGAC GGCATCGGCA TTTGAAAAAT ATGCAGATTA AAAAAATCAT

51 GAAATGGCTT CCCGTCGCCC TGTCGCTTTT GGGTGCGTTG GGTTATACGG

101 GGTACGGCAG CGAGGCGGTG CGGACGGCGG TTGCCGTACT CGACGTACTC

151 GGCGCGGCAG GGGACGCGGG TTCCGACGCG CCCGCCCGCC GCCGAGCATC

201 GGCGAAATCC GGCCACCGCT ACACAGGCAC GGTGTCCAAA GTCTATGACG

251 GCGACACCCT TCACGTTATC GACGGCGACG GCGCGAAACA CAAATCCGG

301 ATGGCGTATA TCGACGCGCC GGAGATGAAA CAGGCTTACG GCACGCGTTC

351 GCGCGACAAC CTGCGCGCGG CGGCGGAAGG CAGGAAAGTC AGCGTGCGCG

401 TGTTCGATAC CGACCGCTAC CAGCGCGAAG TGGCGCAGGT TTCTGTCGGC

451 AAAACCGATT TGAACCTGAT GCAGGTGCAG GACGGGCGG CGTGGCATTA

501 TAAAAGTTAT GCTAAAGAAC AGCAGGATAA GGCGGATTTT GCCGATTATG

551 CCGACGCTCA AATTCAGGCG GAAAGGGAAC GCAAAGGATT GTGGAAAGCT
```

```
-continued
601 AAAAATCCGC AAGCGCCGTG GGCGTACCGC CGAGCAGGCA GGAGCGGCGG

651 GGGCAATAAG GATTGGATGG ATGCCGTGGG CGAATGGTTG GGCATTTGGT

701 AA
```

This corresponds to the amino acid sequence <SEQ ID 2998; ORF 992>:

```
m992.pep
  1 MFRRHRHLKN MQIKKIMKWL PVALSLLGAL GYTGYGSEAV RTAVAVLDVL

51 GAAGDAGSDA PARRRASAKS GHRYTGTVSK VYDGDTLHVI DGDGAKHKIR

101 MAYIDAPEMK QAYGTRSRDN LRAAAEGRKV SVRVFDTDRY QREVAQVSVG

151 KTDLNLMQVQ DGAAWHYKSY AKEQQDKADF ADYADAQIQA ERERKGLWKA

201 KNPQAPWAYR RAGRSGGGNK DWMDAVGEWL GIW*
```

Computer analysis of this amino acid sequence gave the following results:
Homology with a Predicted ORF from *N. gonorrhoeae*
ORF 992 shows 96.1% identity over a 233 aa overlap with a predicted ORF (ORF 992) from *N. gonorrhoeae*

```
    m992/g992   96.1% identity in 233 aa overlap 10         20         30         40         50         60
    m992.pep    MFRRHRHLKNMQIKKIMKWLPVALSLLGALGYTGYGSEAVRTAVAVLDVLGAAGDAGSDA
                ||||||||||||||||||||||||||||||||||| |||||||||||||||:|||:| ||
    g992        MFRRHRHLKNMQIKKIMKWLPVALSLLGALGYTGYDSEAVRTAVAVLDVLGTAGDVGFDA
                        10         20         30         40         50         60

70         80         90        100        110        120
    m992.pep    PARRRASAKSGHRYTGTVSKVYDGDTLHVIDGDGAKHKIRMAYIDAPEMKQAYGTRSRDN
                |:|||||||||||:||||||||||||||||||||||||||||||||||||||||||||||
    g992        PVRRRASAKSGHSYTGTVSKVYDGDTLHVIDGDGAKHKIRMAYIDAPEMKQAYGTRSRDN
                        70         80         90        100        110        120

130        140        150        160        170        180
    m992.pep    LRAAAEGRKVSVRVFDTDRYQREVAQVSVGKTDLNLMQVQDGAAWHYKSYAKEQQDKADF
                ||||||||||||||:|||||||||||||||:|||||||||||||||||||||||||||||
    g992        LRAAAEGRKVSVRVFETDRYQREVAQVSAGKTDLNLMQVQDGAAWHYKSYAKEQQDKADF
                       130        140        150        160        170        180

190        200        210        220        230
    m992.pep    ADYADAQIQAERERKGLWKAKNPQAPWAYRRAGRSGGGNKDWMDAVGEWLGIWX
                |||||||||||||||||||||||||||||||||||||||||||:|||||||||
    g992        ADYADAQIQAERERKGLWKAKNPQAPWAYRRAGRSGGGNKDWMDSVGEWLGIWX
                       190        200        210        220        230
```

The following partial DNA sequence was identified in *N. meningitidis* <SEQ ID 2999>:

```
a992.seq
  1 ATGTTCAGAC GGCATCGGCA TTTGAAAAAT ATGCAGATTA AAAAAATCAT

51 GAAATGGCTT CCCGTCGCCT TGTCGCTTTT GGGTGCGTTG GGTTATACGG

101 GGTACGGCAG CGAGGCGGTG CGGACGGCGG TTGCCGTACT CGACGTACTC

151 GGCGCGGCAG GGGACGCGGG TTCCGACGCG CCCGCCCGCC GCCGAGCATC

201 GGCGAAATCC GGCCACCGCT ACACAGGCAC GGTGTCCAAA GTCTATGACG

251 GCGACACCCT TCACGTTATC GACGGCGACG GCGCGAAACA CAAAATCCGG

301 ATGGCGTATA TCGACGCGCC GGAGATGAAA CAGGCTTACG GCACGCGTTC

351 GCGCGACAAC CTGCGCGCGG CGGCGGAAGG CAGGAAAGTC AGCGTCCGCG

401 TGTTCGACAC CGACCGCTAC CAGCGCGAAG TGGCGCAGGT TTCTGTCGGC

451 AAAACCGATT TGAACCTGAT GCAGGTGCAG GACGGGGCGG CGTGGCATTA
```

-continued

```
501 TAAAAGTTAT GCTAAAGAAC AGCAGGATAA GGCGGATTTT GCCGATTATG

551 CCGACGCTCA AATTCAGGCG GAAAGGGAAC GCAAAGGATT GTGGAAAGCT

601 AAAAATCCGC AAGCGCCGTG GGCGTACCGC CGGGCAGGCA GGAGCGGCGG

651 GGGCAATAAG GATTGGATGG ATGCCGTGGG CGAATGGTTG GGCATTTGGT

701 AA
```

This corresponds to the amino acid sequence <SEQ ID 3000; ORF 992.a>:

```
a992.pep
  1 MFRRHRHLKN MQIKKIMKWL PVALSLLGAL GYTGYGSEAV RTAVAVLDVL

51 GAAGDAGSDA PARRRASAKS GHRYTGTVSK VYDGDTLHVI DGDGAKHKIR

101 MAYIDAPEMK QAYGTRSRDN LRAAAEGRKV SVRVFDTDRY QREVAQVSVG

151 KTDLNLMQVQ DGAAWHYKSY AKEQQDKADF ADYADAQIQA ERERKGLWKA

201 KNPQAPWAYR RAGRSGGGNK DWMDAVGEWL GIW*
```

Computer analysis of this amino acid sequence gave the following results:
Homology with a Predicted ORF from *N. meningitidis*
ORF 992 shows 100.0% identity over a 233 aa overlap with a predicted ORF (ORF 992) from *N. meningitidis*

```
    a992/m992   100.0% identity in 233 aa overlap 10         20         30         40         50         60
    a992.pep   MFRRHRHLKNMQIKKIMKWLPVALSLLGALGYTGYGSEAVRTAVAVLDVLGAAGDAGSDA
               ||||||||||||||||||||||||||||||||||||||||||||||||||||||||||||
    m992       MFRRHRHLKNMQIKKIMKWLPVALSLLGALGYTGYGSEAVRTAVAVLDVLGAAGDAGSDA
                    10         20         30         40         50         60
                    70         80         90        100        110        120
    a992.pep   PARRRASAKSGHRYTGTVSKVYDGDTLHVIDGDGAKHKIRMAYIDAPEMKQAYGTRSRDN
               ||||||||||||||||||||||||||||||||||||||||||||||||||||||||||||
    m992       PARRRASAKSGHRYTGTVSKVYDGDTLHVIDGDGAKHKIRMAYIDAPEMKQAYGTRSRDN
                    70         80         90        100        110        120
                   130        140        150        160        170        180
    a992.pep   LRAAAEGRKVSVRVFDTDRYQREVAQVSVGKTDLNLMQVQDGAAWHYKSYAKEQQDKADF
               ||||||||||||||||||||||||||||||||||||||||||||||||||||||||||||
    m992       LRAAAEGRKVSVRVFDTDRYQREVAQVSVGKTDLNLMQVQDGAAWHYKSYAKEQQDKADF
                   130        140        150        160        170        180
                   190        200        210        220        230
    a992.pep   ADYADAQIQAERERKGLWKAKNPQAPWAYRRAGRSGGGNKDWMDAVGEWLGIWX
               |||||||||||||||||||||||||||||||||||||||||||||||||||||
    m992       ADYADAQIQAERERKGLWKAKNPQAPWAYRRAGRSGGGNKDWMDAVGEWLGIWX
                   190        200        210        220        230
```

The following partial DNA sequence was identified in *N. gonorrhoeae* <SEQ ID 3001>:

```
g993.seq
  1 CTGAAAGTCG TATTGGGCAG TTTTCAAGGC CCTTTGGATC TGCTGCTCTA

51 CCTTATCCGC AAGCAGAACA TCGATGTTCT CGATATTCCG ATGGTGGAAA

101 TTACCGGGCA GTATCTGCAC TATATTGCCC AAATGGAAGC CTATCAGTTT

151 GATTTGGCGG CGGAATATCT TTTGATGGCG GCAATGCTGA TTGAAATCAA

201 ATCGCGCCTG CTGCTGCCGC GTACCGAAGC CGTCGAAGAC GAAGAGGCCG

251 ACCCGCGTGC CGAGTTGGTG CGCCGTCTGC TTGCCTACGA GCAAATGAAA

301 CTGGCGGCGC AGGGTTTGGA CGCGCTGCCG CGTGCGGGAC GGGATTTCGC
```

-continued
```
351 GTGGGCTTAC CTGCCGCTGG AAATTGCAGC CGAGACGAAG CTGCCCGAGG

401 TTTACATCGC CGATTTGATG CAGGCATGGT TGGGCATTCT TTCTCGGGCA

451 AAACATACGC GCAGCCACGA AGTAATCCAA GAAACCCTTT CCGTGCGCGC

501 GCAAATGACG GCAATCCTGC GCCGTTTGAA CGAACACGGG ATATGCAGGT

551 TTCACGCCCT GTTCAATCCC GAACAGGGCG CGGCTTACGT GATCGTCAAC

601 TTCATCGCCC TGTTGGAGCT TGCCAAAGAA GGATTGGTCG GAATCGTACA

651 GGAAGACGGT TTCGGAGAAA TCCGAATCAG CCTCAATCAT GAGGGGGCGC

701 ATTCAGACGG CATTTTCGGC ACACGGGGCG GGCGCGATGT GTTCTAA
```

This corresponds to the amino acid sequence <SEQ ID 3002 ORF 993.ng>:

g993.pep
```
  1 LKVVLGSFQG PLDLLLYLIR KQNIDVLDIP MVEITGQYLH YIAQMEAYQF

51 DLAAEYLLMA AMLIEIKSRL LLPRTEAVED EEADPRAELV RRLLAYEQMK

101 LAAQGLDALP RAGRDFAWAY LPLEIAAETK LPEVYIADLM QAWLGILSRA

151 KHTRSHEVIQ ETLSVRAQMT AILRRLNEHG ICRFHALFNP EQGAAYVIVN

201 FIALLELAKE GLVGIVQEDG FGEIRISLNH EGAHSDGIFG TRGGRDVF*
```

The following partial DNA sequence was identified in *N. meningitidis* <SEQ ID 3003>:

```
m993.seq
  1 TTGAAAGTCG TATTGGGCAG CTTCCAAGGC CCTTTGGATC TACTGCTGTA

51 TCTGATCCGC AAACAGAATA TCGACGTACT GGATATTCCG ATGGTGAAGA

101 TTACCGAGCA GTATCTGCAC TACATCGCCC AAATAGAAAC CTATCAGTTT

151 GATTTGGCGG CGGAATATCT TTTGATGGCA GCAATGCTGA TTGAAATCAA

201 ATCGCGCCTG CTGCTGCCGC GTACCGAAAC CGTCGAAGAC GAAGAAGCCG

251 ACCCGCGTGC CGAGTTGGTG CGCCGCCTGC TGGCTTACGA ACAGATGAAG

301 CTGGCGGCGC AGGGTTTGGA CGCGCTGCCC CGAGCCGGAC GGGATTTCGC

351 GTGGGCTTAC CTGCCGCTGG AAATTGCCGT CGAAGCCAAG CTGCCCGAAG

401 TCTATATTAC CGACTTGACG CAAGCGTGGC TGGGTATTTT GTCTCGGGCA

451 AAACACACGC GCAGCCACGA AGTAATCAAA GAAACCATCT CCGTGCGCGC

501 GCAAATGACG GCAATCCTGC GCCGTTTGAA CGGACACGGA ATATGCAGGT

551 TTCACGACCT GTTCAATCCC AAACAGGGCG CGGCTTACGT GGTCGTCAAC

601 TTCATCGCAC TGTTGGAGCT TGCCAAAGAA GGATTGGTCA GAATCGTGCA

651 GGAAGACGGT TTCGGAGAAA TCCGAATCAG CCTCAATCAT GAGGGGGCGC

701 ATTCAGACGG CATTTCCGGC ACACGAGGCG GGCGCGATGT GTTCTAA
```

This corresponds to the amino acid sequence <SEQ ID 3004; ORF 993>:

```
m993.pep
  1 LKVVLGSFQG PLDLLLYLIR KQNIDVLDIP MVKITEQYLH YIAQIETYQF

51 DLAAEYLLMA AMLIEIKSRL LLPRTETVED EEADPRAELV RRLLAYEQMK

101 LAAQGLDALP RAGRDFAWAY LPLEIAVEAK LPEVYITDLT QAWLGILSRA
```

```
151 KHTRSHEVIK ETISVRAQMT AILRRLNGHG ICRFHDLFNP KQGAAYVVVN

201 FIALLELAKE GLVRIVQEDG FGEIRISLNH EGAHSDGISG TRGGRDVF*
```

Computer analysis of this amino acid sequence gave the following results:

Homology with a Predicted ORF from *N. gonorrhoeae*
ORF 993 shows 93.1% identity over a 248 aa overlap with a predicted ORF (ORF 993) from *N. gonorrhoeae*

```
   m993/g993    93.1% identity in 248 aa overlap 10        20        30        40        50        60
        m993.pep  LKVVLGSFQGPLDLLLYLIRKQNIDVLDIPMVKITEQYLHYIAQIETYQFDLAAEYLLMA
                  ||||||||||||||||||||||||||||||||:|| ||||||||:||:||||||||||||
        g993      LKVVLGSFQGPLDLLLYLIRKQNIDVLDIPMVEITGQYLHYIAQMEAYQFDLAAEYLLMA
                        10        20        30        40        50        60

70        80        90       100       110       120
        m993.pep  AMLIEIKSRLLLPRTETVEDEEADPRAELVRRLLAYEQMKLAAQGLDALPRAGRDFAWAY
                  ||||||||||||||||:|||||||||||||||||||||||||||||||||||||||||||
        g993      AMLIEIKSRLLLPRTEAVEDEEADPRAELVRRLLAYEQMKLAAQGLDALPRAGRDFAWAY
                        70        80        90       100       110       120

130       140       150       160       170       180
        m993.pep  LPLEIAVEAKLPEVYITDLTQAWLGILSREKHTRSHEVIKETISVRAQMTAILRRLNGHG
                  ||||||:|:||||||||:|||||||||||:||||||||||:||:|||||||||||||:||
        g993      LPLEIAAETKLPEVYIADLMQAWLGILSRAKHTRSHEVIQETLSVREQMTAILRRLNEHG
                       130       140       150       160       170       180

190       200       210       220       230       240
        m993.pep  ICRFHDLFNPKQGAAYVVVNFIALLELAKEGLVRIVQEDGFGEIRISLNHEGAHSDGISG
                  ||||| ||||:|||||||:|||||||||||||| ||||||||||||||||||||||||| ||
        g993      ICRFHALFNPEQGAAYVIVNFIALLELAKEGLVGIVQEDGFGEIRISLNHEGAHSDGIFG
                       190       200       210       220       230       240

249
        m993.pep  TRGGRDVFX
                  |||||||||
        g993      TRGGRDVFX
```

The following partial DNA sequence was identified in *N. meningitidis* <SEQ ID 3005>:

```
a993.seq
   1 CTGAAAGTCG TATTGAGCAG TTTTCAAGGC CCTTTGGATC TGCTGCTCTA

51 CCTTATCCGC AAGCAGAACA TCGATGTTCT CGATATTCCG ATGGTGAAGA

101 TTACCGAACA GTATCTGCAC TACATCGCCC AAATAGAAAC CTATCAGTTT

151 GATTTGGCGG CGGAATATCT TTTGATGGCA GCAATGCTGA TTGAAATCAA

201 ATCGCGCCTG CTGCTGCCGC GTACCGAAAC CGTCGAAGAC GAAGAAGCCG

251 ACCCGCGTGC CGAGTTGGTG CGCCGCCTGC TGGCTTACGA GCAGATGAAG

301 CTGGCGGCAC AAGGGTTGGA TGCGCTTCCT CGTGCGGGCC GGGATTTCGC

351 ATGGGCATAC CTGCCACTGG AAATTGCCGT CGAAGCCAAG CTGCCCGAAG

401 TCTATATTAC CGACTTGACG CAGGCGTGGC TGAGTATTTT GTCTCGGGCA

451 AAACATACGC GCAGCCACGA AGTTATCAAA GAAACCATCT CCGTGCGCGC

501 GCAAATGACG GCAATCCTGC GCCGTTTGAA CAAACACGGG ATATGCAGGT

551 TTCACGACCT GTTCAATCCC GAACAGGGCG CGGCTTACGT GGTCGTCAAC

601 TTCATCGCAC TGTTGGAGCT TGCCAAAGAA GGTTTGGTCG GAATCGTACA

651 GGAAGTCGGT TTCGGAGAAA TCCGAATCAG CCTCAATCAT GAGGGGGCGC

701 ATTCAGACGG CATTTCCGGC ACACGGGGCG GGCGCGATGT GTTCTAA
```

This corresponds to the amino acid sequence <SEQ ID 3006; ORF 993.a>:

```
a993.pep
  1 LKVVLSSFQG PLDLLLYLIR KQNIDVLDIP MVKITEQYLH YIAQIETYQF

51 DLAAEYLLMA AMLIEIKSRL LLPRTETVED EEADPRAELV RRLLAYEQMK

101 LAAQGLDALP RAGRDFAWAY LPLEIAVEAK LPEVYITDLT QAWLSILSRA

151 KHTRSHEVIK ETISVRAQMT AILRRLNKHG ICRFHDLFNP EQGAAYVVVN

201 FIALLELAKE GLVGIVQEVG FGEIRISLNH EGAHSDGISG TRGGRDVF*
```

Computer analysis of this amino acid sequence gave the following results:

Homology with a Predicted ORF from *N. meningitidis*
ORF 993 shows 97.6% identity over a 248 aa overlap with a predicted ORF (ORF 993) from *N. meningitidis*

```
   a993/m993    97.6% identity in 248 aa overlap 10        20        30        40        50        60
        a993.pep   LKVVLSSFQGPLDLLLYLIRKQNIDVLDIPMVKITEQYLHYIAQIETYQFDLAAEYLLMA
                   |||||:||||||||||||||||||||||||||||||||||||||||||||||||||||||
        m993       LKVVLGSFQGPLDLLLYLIRKQNIDVLDIPMVKITEQYLHYIAQIETYQFDLAAEYLLMA
                       10        20        30        40        50        60

70        80        90       100       110       120
        a993.pep   AMLIEIKSRLLLPRTETVEDEEADPRAELVRRLLAYEQMKLAAQGLDALPRAGRDFAWAY
                   ||||||||||||||||||||||||||||||||||||||||||||||||||||||||||||
        m993       AMLIEIKSRLLLPRTETVEDEEADPRAELVRRLLAYEQMKLAAQGLDALPRAGRDFAWAY
                       70        80        90       100       110       120

130       140       150       160       170       180
        a993.pep   LPLEIAVEAKLPEVYITDLTQAWLSILSRAKHTRSHEVIKETISVRAQMTAILRRLNKHG
                   ||||||||||||||||||||||||:|||||||||||||||||||||||||||||||| ||
        m993       LPLEIAVEAKLPEVYITDLTQAWLGILSRAKHTRSHEVIKETISVRAQMTAILRRLNGHG
                      130       140       150       160       170       180

190       200       210       220       230       240
        a993.pep   ICRFHDLFNPEQGAAYVVVNFIALLELAKEGLVGIVQEVGFGEIRISLNHEGAHSDGISG
                   ||||||||||:|||||||||||||||||||||| |||| |||||||||||||||||||||
        m993       ICRFHDLFNPKQGAAYVVVNFIALLELAKEGLVRIVQEDGFGEIRISLNHEGAHSDGISG
                      190       200       210       220       230       240

249
        a993.pep   TRGGRDVFX
                   |||||||||
        m993       TRGGRDVFX
```

The following partial DNA sequence was identified in *N. gonorrhoeae* <SEQ ID 3007>:

```
g996.seq
  1 ATGAACAGAA GAACCTTCCT CCTCGGCGCA GGCGCGTTGC TTCTTACCGC

51 CTGCGGCAGA AAATCCGCCC GAACCCACGC CAAAATTCCC GAAGGAAGCA

101 CCGTGCTTGC CTTGGGCGAT TCGCTCACCT TCGGCTACGG AGCAAACCCC

151 GGCGAATCCT ACCCCGCGCA ACTGCAAAAA CTGACGGGTT GGAATATTGT

201 CAACGGCGGC GTATCGGGCG ATACGTCCGC GCAAGCCCTA TCGCGCCTGC

251 CCGCGCTGTT GGCACGCAAA CCCAAGCTTG TGATTGTCGG CATAGGCGGC

301 AACGACTTTC TGCGCAAAGT TCCCGAGGAG CAGACCCGCG CCAATATCGC

351 GAAAATCATC GAAACCGTGC AAAAGGAAAA CATTCCCGCC GTCCTCGTCG

401 GCGTGCCGCA CATCACACTG GGCGCGTTGT TCGGGCATTT GAGCGACCAT

451 CCGCTGTATG AGGATTTGTC CGAGGAATAC GGCATTCCGT TGTTCGGCGG

501 CGCGTGGGCG GAAATTTTGG GCAATAATAA TCTGAAATCC GACCAAATCC
```

```
551 ACGCCAACGG CAAAGGCTAT CGGAAATTCG CCGAAAATTT GAATCAATTT

601 TTGAGAAAAC ATGGGTTTAG ATAA
```

This corresponds to the amino acid sequence <SEQ ID 3008 ORF 996.ng>:

```
g996.pep
  1 MNRRTFLLGA GALLLTACGR KSARTHAKIP EGSTVLALGD SLTFGYGANP

51 GESYPAQLQK LTGWNIVNGG VSGDTSAQAL SRLPALLARK PKLVIVGIGG

101 NDFLRKVPEE QTRANIAKII ETVQKENIPA VLVGVPHITL GALFGHLSDH

151 PLYEDLSEEY GIPLFGGAWA EILGNNNLKS DQIHANGKGY RKFAENLNQF

201 LRKHGFR*
```

The following partial DNA sequence was identified in *N. meningitidis* <SEQ ID 3009>:

```
m996.seq
  1 ATGAACAGAA GAACCTTCCT CCTCGGCGCA GGCGCGTTGC TGCTTACCGC

51 CTGCGGCAGA AAATCCGCCC GAACCCACGC CAAAATTCCC GAAGGAAGCA

101 CCGTACTTGC CTTGGGCGAT TCGCTTACCT TCGGCTACGG CGCAAACCCT

151 GGCGAATCCT ACCCCGCGCA ACTGCAAAAA CTGACGGGTT GGAATATTGT

201 CAACGGCGGC GTATCGGGCG ATACATCTGC CCAAGCCCTG TCGCGCCTGC

251 CCGCGCTGTT GGCACGCAAA CCCAAGCTTG TGATTGTCGG CATAGGCGGC

301 AACGACTTTC TGCGCAAAGT TCCCAAGGAG CAGACCCGCG CCAATATCGC

351 GAAAATCATC GAAACCGTGC AGAAGGAAAA CATCCCCGCC GTCCTCGTCG

401 GCGTGCCGCA CATCACACTG GGTGCGTTGT TCGGGCATTT GAGCGATCAT

451 CCGCTGTATG AGGATTTGTC CGAGGAATAC GGCATTCCGC TGTTCGGCGG

501 CGCGTGGGCG GAAATTTTGG GCGATAATAA TCTGAAATCC GACCAAATCC

551 ACGCCAACGG CAAAGGCTAT CGGAAATTTG CCGAAGATTT GAATCAATTT

601 TTGAGAAAAC AGGGGTTTAG ATAA
```

This corresponds to the amino acid sequence <SEQ ID 3010; ORF 996>:

```
m996.pep
  1 MNRRTFLLGA GALLLTACGR KSARTHAKIP EGSTVLALGD SLTFGYGANP

51 GESYPAQLQK LTGWNIVNGG VSGDTSAQAL SRLPALLARK PKLVIVGIGG

101 NDFLRKVPKE QTRANIAKII ETVQKENIPA VLVGVPHITL GALFGHLSDH

151 PLYEDLSEEY GIPLFGGAWA EILGDNNLKS DQIHANGKGY RKFAEDLNQF

201 LRKQGFR
```

Computer analysis of this amino acid sequence gave the following results:
Homology with a Predicted ORF from *N. gonorrhoeae*
ORF 996 shows 98.1% identity over a 207 aa overlap with a predicted ORF (ORF 996) from *N. gonorrhoeae*

```
m996/g996  98.1% identity in 207 aa overlap 10        20        30        40        50        60
    m996.pep  MNRRTFLLGAGALLLTACGRKSARTHAKIPEGSTVLALGDSLTFGYGANPGESYPAQLQK
              ||||||||||||||||||||||||||||||||||| ||||||| ||||||||||||||||
    g996      MNRRTFLLGAGALLLTACGRKSARTHAKIPEGSTBLALGDSLTGGYGANPGESYPAQLQK
                   10        20        30        40        50        60

70        80        90       100       110       120
    m996.pep  LTGWNIVNGGVSGDTSAQALSRLPALLARKPKLVIVGIGGNDFLRKVPKEQTRANIAKII
              |||||||||||||||||||||||||||||||||||||||||||||:||||||||||||||
    g996      LTGWNIVNGGVSGDTSAQALSRLPALLARKPKLVIVGIGGNDFLRKVPEEQTRANIAKII
                   70        80        90       100       110       120

130       140       150       160       170       180
    m999.pep  ETVQKENIPAVLVGVPHITLGALFGHLSDHPLYEDLSEEYGIPLFGGAWAEILGDNNLKS
              ||||||||||||||||||||||||||||||||||||||||||||||||||||:|||||
    g996      ETVQKENIPAVLVGVPHITLGALFGHLSDHPLYEDLSEEYGIPLFGGAWAEILGNNNLKS
                  130       140       150       160       170       180

190       200
    m996.pep  DQIHANGKGYRKFAEDLNQFLRKQGFR
              |||||||||||||||:||||||:|||
    g996      DQIHANGKGYRKFAENLNQFLRKHGFRX
                  190       200
```

The following partial DNA sequence was identified in *N. meningitidis* <SEQ ID 3011>:

```
a996.seq
   1 ATGAACAGAA GAACCTTCCT CCTCGGCGCA GGCGCGTTGC TCCTTACCGC

51 CTGCGGCAGA AAATCCGCCC GAACCCACGC CAAAATTCCC GAAGGAAGCA

101 CCGTACTTGC CTTGGGCGAT TCGCTTACCT TCGGCTACGG CGCAAACCCC

151 GGCGAATCCT ACCCCGCGCA ACTGCAAAAA CTGACGGGTT GGAATATTGT

201 CAACGGCGGC GTATCGGGCG ATACATCCGC CCAAGCCCTG TCGCGCCTGC

251 CCGCGCTGTT GGCACGCAAA CCCAAGCTTG TGATTGTCGG CATAGGCGGC

301 AACGACTTTC TGCGCAAAGT TCCCAAGGAG CAGACCCGCG CCAATATCGC

351 GAAAATCATC GAAACCGTGC AGAAGGAAAA CATCCCCGCC GTCCTCGTCG

401 GCGTGCCGCA CATTACCTTG GGCGCGTTGT TCGGGCATTT GAGCGATCAT

451 CCGCTGTATG AGGATTTGTC CGAGGAATAC GGCATTCCGC TGTTCGGCGG

501 CGCGTGGGCG GAAATTTTGG GCGATAATAA TCTGAAATCC GACCAAATCC

551 ACGCCAACGG CAAAGGCTAT CGGAAATTTG CCGAAGATTT GAATCAATTT

601 TTGAGAAAAC AGGGGTTTAG ATAA
```

This corresponds to the amino acid sequence <SEQ ID 3012; ORF 996.a>:

```
a996.pep
   1 MNRRTFLLGA GALLLTACGR KSARTHAKIP EGSTVLALGD SLTFGYGANP

51 GESYPAQLQK LTGWNIVNGG VSGDTSAQAL SRLPALLARK PKLVIVGIGG

101 NDFLRKVPKE QTRANIAKII ETVQKENIPA VLVGVPHITL GALFGHLSDH

151 PLYEDLSEEY GIPLFGGAWA EILGDNNLKS DQIHANGKGY RKFAEDLNQF

201 LRKQGFR*
```

Computer analysis of this amino acid sequence gave the following results:
Homology with a Predicted ORF from *N. meningitidis*
ORF 996 shows 100.0% identity over a 207 aa overlap with a predicted ORF (ORF 996) from *N. meningitidis*

```
    a996/m996    100.0% identity in 207 aa overlap 10        20        30        40        50        60
    a996.pep     MNRRTFLLGAGALLLTACGRKSARTHAKIPEGSTVLALGDSLTFGYGANPGESYPAQLQK
                 ||||||||||||||||||||||||||||||||||||||||||||||||||||||||||||
    m996         MNRRTFLLGAGALLLTACGRKSARTHAKIPEGSTVLALGDSLTFGYGANPGESYPAQLQK
                         10        20        30        40        50        60
                         70        80        90       100       110       120
    a996.pep     LTGWNIVNGGVSGDTSAQALSRLPALLARKPKLVIVGIGGNDFLRKVPKEQTRANIAKII
                 ||||||||||||||||||||||||||||||||||||||||||||||||||||||||||||
    m996         LTGWNIVNGGVSGDTSAQALSRLPALLARKPKLVIVGIGGNDFLRKVPKEQTRANIAKII
                         70        80        90       100       110       120
                        130       140       150       160       170       180
    a996.pep     ETVQKENIPAVLVGVPHITLGALFGHLSDHPLYEDLSEEYGIPLFGGAWAEILGDNNLKS
                 ||||||||||||||||||||||||||||||||||||||||||||||||||||||||||||
    m996         ETVQKENIPAVLVGVPHITLGALFGHLSDHPLYEDLSEEYGIPLFGGAWAEILGDNNLKS
                        130       140       150       160       170       180
                        190       200
    a996.pep     DQIHANGKGYRKFAEDLNQFLRKQGFRX
                 |||||||||||||||||||||||||||
    m996         DQIHANGKGYRKFAEDLNQFLRKQGFR
                        190       200
```

The following partial DNA sequence was identified in *N. gonorrhoeae* <SEQ ID 3013>:

```
g997.seq (partial)
    1 ATGATGAACA CGCCGCATCC GCGCCCGAAA ATCGCCGTCA TCGGCGCAGG

51 CTGGGCCGGC TTGTCCGCCG CCGTCACCTT GGCGCGGCAC GCCGACGTTA

101 CCCTGTTTGA AGCCGGCCGG CAGGCGGGCG GAAGGGCGCG CACACTGGCC

151 GGAAATACCG ACGGTTTCGG TTTTTTGGAC AACGGGCAGC ACATTTTGCT

201 CGGCGCATAC CGGGGCGTGT TGCGCCTGAT GAAAACCATC GGTTCAGACC

251 CCCGTGCCGC CTTTTTGCGC GTACCGCTGC ACTGGCATAT GCACGGCGGT

301 TTGCAGTTCC GCGCCCTCCC CCTGCCCGCG CCGCTGCATA TTTTGGGCGG

351 CGTGCTGCTT GCCCGGCGCG TACCGTCCGC ATTCAAAGCC AAACTGCTTG

401 CCGATATGTC CGATTTGCAG AAGTCCGCAC GCCTCGGACA GCCCGACACG

451 ACAGTTGCAC AATGGCTGAA ACAGCGGAAC GTGCCGCGTG CCGCCGTAAT

501 GCAGTTTTGG CAGCCCTTGG TCTGGGGCGC GCTCAACACG CCTTTGGAAA

551 CCGCAAGCCT GCGCGTGTTG TGCAACGTTT TGTCCGACGG CGTGCTGACG

601 AAAAAATCCG GCAGCGACTA TCTCCTACCC AAACAGGATT TGGGCGCAAT

651 CGTCGCCGAA CCCGCCTTGG CGGAGCTTCA ACGGCTCGGC GCGGACATCC

701 GCCTCGAAAC GCGCGTATGC CGTCTGAACA CCCTCCCGGA CGGAAAAGTC

751 CTCGTCAACG GCGAAGCCTT CGATGCCGCC ATACTTGCCA CCGCGCCCTA

801 CCACGCCGCC GCGCTCCTGC CCGAAGGCAC GCCCGAACAC GTTCAGACGG

851 CATATCAAAA CCTTCGCTAC CACGCCATCA CCACCGTCTA TCTGCGCTAC

901 GCCGAACCCG TCCGcCTGCc CGCCCCGCTG ACcGGCATtg CCGAcggcAC 951 ggcaCaatgG CTGCTTTgcc cgGGGCAGGC tccggactgc CcccaaAacg 1001 aagTCTCCGC cGTCAttagc GTTTCCGAcc GCGtcggcgC Gtttgcaaac 1051 cga...
```

This corresponds to the amino acid sequence <SEQ ID 3014 ORF 997.ng>:

```
g997.pep (partial)
   1 MMNTPHPRPK IAVIGAGWAG LSAAVTLARH ADVTLFEAGR QAGGRARTLA

51 GNTDGFGFLD NGQHILLGAY RGVLRLMKTI GSDPRAAFLR VPLHWHMHGG

101 LQFRALPLPA PLHILGGVLL ARRVPSAFKA KLLADMSDLQ KSARLGQPDT

151 TVAQWLKQRN VPRAAVMQFW QPLVWGALNT PLETASLRVL CNVLSDGVLT

201 KKSGSDYLLP KQDLGAIVAE PALAELQRLG ADIRLETRVC RLNTLPDGKV

251 LVNGEAFDAA ILATAPYHAA ALLPEGTPEH VQTAYQNLRY HAITTVYLRY

301 AEPVRLPAPL TGIADGTAQW LLCPGQAPDC PQNEVSAVIS VSDRVGAFAN

351 R....
```

The following partial DNA sequence was identified in *N. meningitidis* <SEQ ID 3015>:

```
m997.seq
    1 ATGATGAACA CGCCGCATCC GCGCCCGAAA ATCGCCGTCA TCGGCGCAGG

51 CTGGGCAGGA CTGTCCGCCG CCGTCACCTT GGCGCGGCAC GCCGACGTTA

101 CCCTGTTTGA AGCCGGCCGG CAGGCGGGCG GCAGGGCGCG CACACTGGCC

151 GGAAATACCG ACGGTTTCGG TTTTTTGGAC AACGGGCAGC ACATTTTGCT

201 CGGCGCATAC CGGGGCGTGT TGCGCCTGAT GAAAACCATC GGTTCGGATC

251 CCCGTGCCGC CTTTTTGCGC GTACCGCTGC ACTGGCATAT GCACGGCGGT

301 TTGCAGTTCC GCGCCCTCCC CCTGCCCGCG CCGCTGCATA TTTTGGGCGG

351 CGTGCTGCTT GCCCGGCGTG CACCGACTGC ATTCAAAGCC AAACTGCTTG

401 CCGATATGTC CGATTTGCAG AAGTCCGCAC GCCTCGGACA GCCCGACACG

451 ACAGTGGCGC AATGGCTGAA ACAGCGGAAC GTGCCGCGTG CCGCCGTGAT

501 GCAGTTTTGG CAGCCCTTGG TTTGGGGCGC GCTCAACACG CCTTTGGAAA

551 CCGCAAGCCT GCGCGTGTTG TGCAACGTTT TGTCCGACGG CGTGCTGACG

601 AAAAAATCCG GCAGCGACTA TCTCCTACCC AAGCAGGATT TGGGCGCAAT

651 CGTCGCCGAA CCCGCCTTGG CGGATCTTCA ACGGCTCGGC GCGGACATCC

701 GCCTCGAAAC GCGCGTATGC CGTCTGAACA CCCTCCCGGA CGGGAAAGTG

751 CTCGTCAACG GCGAAGCTTT CGATGCCGCC GTCCCCGCCA CCGCGCCCTA

801 CCACGCCGCC GCGCTCCTGC CCGAAGGCAC GCCCGAACAC GTTCAGACGG

851 CATATCAAAA CCTTCGCTAC CACGCCATCA CCACCGTCTA TCTGCGCTAC

901 GCCGAACCCG TCCGCCTGCC CGCCCCGCTG ACCGGCCTTG CCGACGGCAC

951 GGTGCAATGG CTGCTTTGCC GGGGCAGGCT CGGACTGCCT GAAAACGAAG

1001 TGTCCGCCGT CATCAGCGTT TCCGACCGCG TCGGCGCGTT TGCAAACCGG

1051 GCGTGGGCGG ACAAAGCCCA CGCCGACCTC AAACGCATCC TTCCGCATTT

1101 GGGCGAACCC GAAGCCGTGC GCGTCATCAC CGAAAAACGC GCCACAACCG

1151 CAGCCGATGC CCCGCCGCCG GACTTGTCGT GGTTGCACCG GCACCGCATC

1201 TTCCCCGCCG GCGACTACCT CCACCCGGAC TACCCCGCCA CGCTCGAAGC

1251 CGCCGTACAA TCAGGTTTCG CGTCGGCGGA AGCCTGCCTG CAAAGCCTGA

1301 GCGATGCCGT CTGA
```

This corresponds to the amino acid sequence <SEQ ID 3016; ORF 997>:

```
m997.pep
   1 MMNTPHPRPK IAVIGAGWAG LSAAVTLARH ADVTLFEAGR QAGGRARTLA

51 GNTDGFGFLD NGQHILLGAY RGVLRLMKTI GSDPRAAFLR VPLHWHMHGG

101 LQFRALPLPA PLHILGGVLL ARRAPTAFKA KLLADMSDLQ KSARLGQPDT

151 TVAQWLKQRN VPRAAVMQFW QPLVWGALNT PLETASLRVL CNVLSDGVLT

201 KKSGSDYLLP KQDLGAIVAE PALADLQRLG ADIRLETRVC RLNTLPDGKV

251 LVNGEAFDAA VPATAPYHAA ALLPEGTPEH VQTAYQNLRY HAITTVYLRY

301 AEPVRLPAPL TGLADGTVQW LLCRGRLGLP ENEVSAVISV SDRVGAFANR

351 AWADKAHADL KRILPHLGEP EAVRVITEKR ATTAADAPPP DLSWLHRHRI

401 FPAGDYLHPD YPATLEAAVQ SGFASAEACL QSLSDAV*
```

Computer analysis of this amino acid sequence gave the following results:
Homology with a Predicted ORF from *N. gonorrhoeae*
ORF 997 shows 96.0% identity over a 351 aa overlap with a predicted ORF (ORF 997) from *N. gonorrhoeae*

```
     g997/m997   96.0% identity in 351 aa overlap 10         20         30         40         50         60
                10         20         30         40         50         60
    g997.pep    MMNTPHPRPKIAVIGAGEAGLSAAVTLARHADVTLFEAGRQAGGRARTLAGNTDGFGFLD
                ||||||||||||||||:|||||||||||||||||||||||||||||||||||||||||||
    m997        MMNTPHPRPKIAVIGAGWAGLSAAVTLARHADVTLFEAGRQAGGRARTLAGNTDGFGFLD
                10         20         30         40         50         60
                70         80         90        100        110        120
    g997.pep    NGQHILLGAYRGVLRLMKTIGSDPRAAFLRVPLHWHMHGGLQFRALPLPAPLHILGGVLL
                ||||||||||||||||||||||||||||||||||||||||||||||||||||||||||||
    m997        NGQHILLGAYRGVLRLMKTIGSDPRAAFLRVPLHWHMHGGLQFRALPLPAPLHILGGVLL
                70         80         90        100        110        120
               130        140        150        160        170        180
    g997.pep    ARRVPSAFKAKLLADMSDLQKSARLGQPDTTVAQWLKQRNVPRAAVMQFWQPLVWGALNT
                |||:|:||||||||||||||||||||||||||||||||||||||||||||||||||||||
    m997        ARRAPTAFKAKLLADMSDLQKSARLGQPDTTVAQWLKQRNVPRAAVMQFWQPLVWGALNT
               130        140        150        160        170        180
               190        200        210        220        230        240
    g997.pep    PLETASLRVLCNCLSDGVLTKKSGSDYLLPKQDLGAIVAEPALAELQRLGADIRLETRVC
                |||||||||||||:|||||||||||||||||||||||||||||||:||||||||||||||
    m997        PLETASLRVLCNVLSDGVLTKKSGSDYLLPKQDLGAIVAEPALADLQRLGADIRLETRVC
               190        200        210        220        230        240
               250        260        270        280        290        300
    g997.pep    RLNTLPDGKVLVNGEAFDAAILATAPYHAAALLPEGTPEHVQTAYQNLRYHAITTVYLRY
                ||||||||||||||||||||||:|||||||||||||||||||||||||||||||||||||
    m997        RLNTLPDGKVLVNGEAFDAAVPATAPYHAAALLPEGTPEHVQTAYQNLRYHAITTVYLRY
               250        260        270        280        290        300
               310        320        330        340        350
    g997.pep    AEPVRLPAPLTGIADGTAQWLLCPGQAPDCPQNEVSAVISVSDRVGAFANR
                ||||||||||||:||||:||||||:|   |:|||||||||||||||||||||
    m997        AEPVRLPAPLTGLADGTVQWLLCRGRL-GLPENEVSAVISVSDRVGAFANRAWADKAHAD
               310        320        330        340        350
```

The following partial DNA sequence was identified in *N. meningitidis* <SEQ ID 3017>:

```
a997.seq
   1 ATGATGAACA CGCCGCATCC GCGCCCGAAA ATCGCCGTCA TCGGCGCAGG

51 CTGGGCCGGC TTGTCCGCCG CCGTTACCTT GGCGCGGCAC GCCGACGTTA

101 CCCTGTTTGA AGCCGGCCGG CAGGCGGGCG GCAGGGCGCG CGCACTGGCC

151 GGAAATACCG ACGGTTTCGG TTTTTTGGAC AACGGGCAGC ATATTTTACT

201 CGGCGCATAC CGGGGCGTGT TGCGCCTGAT GAAAACCATC GGTTCAGACC
```

-continued

```
 251 CCCATGCCGC CTTTTTGCGC GTACCGCTGC ACTGGCATAT GCACGGCGGT

301 TTGCAGTTCC GCGCCCTCCC CCTGCCCGCG CCCCTGCATA TTTTGGGCGG

351 CGTGCTGCTT GCCCGGCGCG TACCGTCCGC ATTCAAAGCC AAACTGCTTG

401 CCGATATGTC CGATTTGCAG AAGTCCGCAC GCCTCGGACA GCCCGACACG

451 ACAGTGGCGC AATGGCTGAA ACAGCGGAAC GTGCCGCGTG CCGCCGTAAT

501 GCAGTTTTGG CAGCCCTTGG TTTGGGGCGC GCTCAACACG CCTTTGGAAA

551 CCGCAAGCCT GCGCGTGTTG TGCAACGTTT TGTCCGACGG CGTGCTGACG

601 AAAAAATCCG GCAGCGACTA TCTCCTACCC AAACAGGATT TGGGCGCAAT

651 CGTCGCCGAA CCCGCCTTGG CGGAGCTTCA ACGGCTCGGC GCGGACATCC

701 GCCTCGAAAC GCGCATATGC CGTCTGAACA CCCTCCCGGA CGGGAAAGTG

751 CTCGTCAACG GCGAACCTTT CGATGCCGCC GTCCCCGCCA CCGCGCCCTA

801 CCACGCCGCC GCGCTCCTGC CCGAAGGCAC GCCCGAACAC GTTCAGACGG

851 CATATCAAAA CCTTCGCTAT CACGCCATCA CCACCGTCTA TCTGCGCTAT

901 GCCGAACCCG TCCGCTTGCC TGCCCCGCTG ACCGGACTTG CCGACGGCAC

951 GGTGCAATGG CTGCTTTGCC GGGGCAGGCT CGGACTGCCT GAAAACGAAG

1001 TGTCCGCCGT CATCAGCGTT TCCGACCGCG TCGGCGCGTT TGCAAACCGG

1051 GCGTGGGCGG ACAAAGTTCA CGCCGACCTC AAACGCATCC TTCCGCATTT

1101 GGGCGAACCC GAAGCCGTGC GCGTCATCAC CGAAAAACGC GCCACAACCG

1151 CAGCCGATGC CCCGCCGCCG GATTTGTCGT GGTTGCACCG GCACCGCATC

1201 TTCCCCGCCG GCGACTACCT CCACCCAGAC TACCCCGCCA CGCTCGAAGC

1251 CGCCGTACAA TCAGGTTTCG CGTCGGCGGA AGCCTGCCTG CAAAGCCTGA

1301 GCGATGCCGT CTGA
```

This corresponds to the amino acid sequence <SEQ ID 3018; ORF 997.a>:

```
a997.pep
  1 MMNTPHPRPK IAVIGAGWAG LSAAVTLARH ADVTLFEAGR QAGGRARALA

51 GNTDGFGFLD NGQHILLGAY RGVLRLMKTI GSDPHAAFLR VPLHWHMHGG

101 LQFRALPLPA PLHILGGVLL ARRVPSAFKA KLLADMSDLQ KSARLGQPDT

151 TVAQWLKQRN VPRAAVMQFW QPLVWGALNT PLETASLRVL CNVLSDGVLT

201 KKSGSDYLLP KQDLGAIVAE PALAELQRLG ADIRLETRIC RLNTLPDGKV

251 LVNGEPFDAA VPATAPYHAA ALLPEGTPEH VQTAYQNLRY HAITTVYLRY

301 AEPVRLPAPL TGLADGTVQW LLCRGRLGLP ENEVSAVISV SDRVGAFANR

351 AWADKVHADL KRILPHLGEP EAVRVITEKR ATTAADAPPP DLSWLHRHRI

401     FPAGDYLHPD YPATLEAAVQ SGFASAEACL QSLSDAV*
```

Computer analysis of this amino acid sequence gave the following results:
Homology with a Predicted ORF from *N. meningitidis*
ORF 997 shows 98.2% identity over a 437 aa overlap with a predicted ORF (ORF 997) from *N. meningitidis*

```
a997/m997  98.2% identity in 437 aa overlap 10        20        30        40        50        60
a997.pep   MMNTPHPRPKIAVIGAGWAGLSAAVTLARHADVTLFEAGRQAGGRARALAGNTDGFGFLD
           |||||||||||||||||||||||||||||||||||||||||||||||:||||||||||||
m997       MMNTPHPRPKIAVIGAGWAGLSAAVTLARHADVTLFEAGRQAGGRARTLAGNTDGFGFLD
                   10        20        30        40        50        60

70        80        90       100       110       120
a997.pep   NGQHILLGAYRGVLRLMKTIGSDPHAAFLRVPLHWHMHGGLQFRALPLPAPLHILGGVLL
           ||||||||||||||||||||||||:|||||||||||||||||||||||||||||||||||
m997       NGQHILLGAYRGVLRLMKTIGSDPRAAFLRVPLHWHMHGGLQFRALPLPAPLHILGGVLL
                   70        80        90       100       110       120

130       140       150       160       170       180
a997.pep   ARRVPSAFKAKLLADMSDLQKSARLGQPDTTVAQWLKQRNVPRAAVMQFWQPLVWGALNT
           |||:|:||||||||||||||||||||||||||||||||||||||||||||||||||||||
m997       ARRAPTAFKAKLLADMSDLQKSARLGQPDTTVAQWLKQRNVPRAAVMQFWQPLVWGALNT
                  130       140       150       160       170       180

190       200       210       220       230       240
a997.pep   PLETASLRVLCNVLSDGVLTKKSGSDYLLPKQDLGAIVAEPALAELQRLGADIRLETRIC
           |||||||||||||||||||||||||||||||||||||||||||||:|||||||||||||:|
m997       PLETASLRVLCNVLSDGVLTKKSGSDYLLPKQDLGAIVAEPALADLQRLGADIRLETRVC
                  190       200       210       220       230       240

250       260       270       280       290       300
a997.pep   RLNTLPDGKVLVNGEPFDAAVPATAPYHAAALLPEGTPEHVQTAYQNLRYHAITTVYLRY
           |||||||||||||| |||||||||||||||||||||||||||||||||||||||||||||
m997       RLNTLPDGKVLVNGEAFDAAVPATAPYHAAALLPEGTPEHVQTAYQNLRYHAITTVYLRY
                  250       260       270       280       290       300

310       320       330       340       350       360
a997.pep   AEPVRLPAPLTGLADGTVQWLLCRGRLGLPENEVSAVISVSDRVGAFANRAWADKVHADL
           |||||||||||||||||||||||||||||||||||||||||||||||||||||||:||||
m997       AEPVRLPAPLTGLADGTVQWLLCRGRLGLPENEVSAVISVSDRVGAFANRAWADKAHADL
                  310       320       330       340       350       360

370       380       390       400       410       420
a997.pep   KRILPHLGEPEAVRVITEKRATTAADAPPPDLSWLHRHRIFPAGDYLHPDYPATLEAAVQ
           ||||||||||||||||||||||||||||||||||||||||||||||||||||||||||||
m997       KRILPHLGEPEAVRVITEKRATTAADAPPPDLSWLHRHRIFPAGDYLHPDYPATLEAAVQ
                  370       380       390       400       410       420

430
a997.pep   SGFASAEACLQSLSDAVX
           ||||||||||||||||||
m997       SGFASAEACLQSLSDAVX
                  430 g999.seq Not found yet g999.pep Not found yet
```

The following partial DNA sequence was identified in *N. meningitidis* <SEQ ID 3019>:

```
m999.seq
   1 ATGAATATGA AAAAATTGAT TTCCGCAATT TGTGTTTCAA TTGTTTTATC

51 AGCCTGCAAC CAACAATCAA AAACGGCACA AGCCGAAGAA CCTGTCCAAA

101 GTATCCAGGC TGCTGATTGT ACCGCCCCAA TGGACATCAC AGTTGAACAA

151 TATCTCATCA ATTTGGAGCA AGCATTTAAA ACTCAGAACG TCTCAACAAA

201 AATCCATAAT AAAAATATTG TCAAGACCGA TTGTGGTTAT GACCTTACTT

251 TGGTAATGGA TTTTGGGGCG ATTGCGCTCA AACTGGACGA GCAGCAAAAA

301 ATTAGAGCTA TCTCAGTAGG CTACATTTTA AAAACCGACG GAGAGAAAGG

351 ACAAAATCTA GTCAATAATG CCATAAATGG ATTACACAGT ATTCAGGCAG

401 TTCTGTCTTT AACTACCACA GACAAATTGG GCGAATCGGA AGCAGGAAAA

451 CAACTTTTTA CAGCTTTAAC CGAAGTCGTC AAAGAATCCA ATCAGACAGG
```

-continued

```
501 AGCAACAGCG CAAAAAGACG TTCCGGCAGA TGGTATTTTA TATAGCGTTG

551 TTTTTGAAAA AGAAACAAAC ACCATTGCAA TAATCGGCAG AAAACAACCC

601 TAA
```

This corresponds to the amino acid sequence <SEQ ID 3020; ORF 999>:

```
m999.pep
   1 MNMKKLISAI CVSIVLSACN QQSKTAQAEE PVQSIQAADC TAPMDITVEQ

51 YLINLEQAFK TQNVSTKIHN KNIVKTDCGY DLTLVMDFGA IALKLDEQQK

101 IRAISVGYIL KTDGEKGQNL VNNAINGLHS IQAVLSLTTT DKLGESEAGK

151 QLFTALTEVV KESNQTGATA QKDVPADGIL YSVVFEKETN TIAIIGRKQP * a999.seq Not found yet a999.pep Not found yet
```

The foregoing examples are intended to illustrate but not to limit the invention.

SEQUENCE LISTING (3287 sequences)

SEQ ID NO: 1 - DNA, 396 bp, Neisseria gonorrhoeae
atgctgccgcaggggaaggcggcgcggagggtgtcggcgaacgaggtgtccggcagggcttgcgcccggatggtgctggtcatctgccagacgctgccgaaacgcgatactttaaacggctcgggtacgcatactttaccggtttgggcgattttgccgaggtcgttgcgcagcaaatcgacaatcatcacgttttcggcgcggtttttcgggtcggtttgtaactcggcggcgcggcgttcgtcttgtccgtcgcccaaaatcggcgcggtgcctttcatcggttcggtgctgatggtgccgtctgaagcgatgttgaggaagagttcgggcgagaaacacagcgtccacgcggattgcccggcttcatcgggcaggtgggacaatacggcatag

SEQ ID NO: 2 - protein, 131 aa, Neisseria gonorrhoeae
MLPQGKAARRVSANEVSGRACARMVLVICQTLPKRDTLNGSGTHTLPVWAILPRSLRSKSTIITFSARFFGSVCNSAARRSSCPSPKIGAVPFIGSVLMVPSEAMLRKSSGEKHSVHADCPASSGRWDNTA

SEQ ID NO: 3 - DNA, 395 bp, Neisseria meningitidis
atgctgccgcaggggaaggcggcgcggaggatgtcggcgaacgaggtgtgcggcasscttssgcttggayggtgctggtcatctgccaaacgctgccgaaacgcgatactttaaacggttcgggtacgcatactgtgccggtttgggcgattttgccgagatcgttacgcagcaaatcgacaatcatcacgttttcggcgcggtttttcgggtctgcttgcaactcggcggcgcggcgttcgtcttgtccgtcgcccaaaatcggcgcggtgcctttcatcggttcggtgctgatggtgccgtccgaaccgattttgaggaagagttcgggcgagaaacacagcgtccacgcggattgcccctccgcatcgggcaggtgggacaagacggcatag

SEQ ID NO: 4 - protein, 131 aa, Neisseria meningitidis
  misc_feature (19)..(19): Xaa can be any naturally occurring amino acid
  misc_feature (21)..(21): Xaa can be any naturally occurring amino acid
  misc_feature (24)..(24): Xaa can be any naturally occurring amino acid
MLPQGKAARRMSANEVCGXLXAWXVLVICQTLPKRDTLNGSGTHTVPVWAILPRSLRSKSTIITFSARFFGSACNSAARRSSCPSPKIGAVPFIGSVLMVPSEPILRKSSGEKHSVHADCPSASGRWDKTA

SEQ ID NO: 5 - DNA, 396 bp, Neisseria meningitidis
atgctgccgcaggggaaggcggcgcggaggatgtcggcgaacgaggtgtgcggcaaggcttgggcttggatggtgctggtcatctgccaaacgctgccgaaacgcgatactttaaacggttcgggtacgcatactgtgccggtttgggcgattttgccgaggtcgttacgcagcaaatcgacaatcatcacgttttcggcgcggtttttcgggtctgcttgcaactcggcggcgcggcgttcgtcttgtccgtcgcccaaaatcggcgcggtgcctttcatcggttcggtgctgatggtgccgtccgaaccgattttgaggaagagttcgggcgagaaacacagcgtccacgcggattgcccttgtgcatcgggcaggtgggacaaaacggcatag

SEQ ID NO: 6 - protein, 131 aa, Neisseria meningitidis
MLPQGKAARRMSANEVCGKAWAWMVLVICQTLPKRDTLNGSGTHTVPVWAILPRSLRSKSTIITFSARFFGSACNSAARRSSCPSPKIGAVPFIGSVLMVPSEPILRKSSGEKHSVHADCPCASGRWDKTA

SEQ ID NO: 7 - DNA, 663 bp, Neisseria gonorrhoeae
  misc_feature (529)..(529): n is a, c, g, or t
atggtcgtattcgtggctgaaggcgtattcggtcgcgctgttttgggtcacttggtattgctcttcggtcagggtgcgtttgagttcggcgtcactcggttttttatacgttgccgcgtcgaagcctttgccttgcggtgcggctttggttttgcccggcagcggttcgtcggctttgcggatgtcgatgtggcagtagccgttggggtttttaatcaggtagtcctgatggtattcctcggcgtcgtagaagtttttcagcggttcgttttcaacaacgaggggcagttggtatttttgctgctcgcgtttgagggcggcggcgatgacggctttttcggcggggtcggtgtagtacacgccgctgcggtattgcgtgccggtgtcgttaccctgtttgttgaggctggtcggatcaacgacgcggaaataatattgcaggatgtcgtccaggctgagtttgtcggcatcgtaggtcactttgacggtctcggcatgacccgtatggcggtaggacacttcttcgtanctcgggttttccgtgttgccgttggcgttaccggataccgcgtcaaccacgccgtcgatgcgttggaaataggcttccaagccccaaaagcagccgccggcgaagtaaatggtgcccgtgttcatgattgctga

SEQ ID NO: 8 - protein, 219 aa, Neisseria gonorrhoeae
MVVFVAEGVFGRAVLGHLVLLFGQGAFEFGVTRFFIRCRVEAFALRCGFGFARQRFVGFADVDVAVAVGVFNQVVLMVFLGVVEVFQRFVFNNEGQLVFLLLAFEGGGDDGFFGGVGVVHAAAVLRAGVVTLFVEAGRINDAEIILQDVVQAEFVGIVGHFDGLGMTRMAVGHFFVRVFRVAVGVTGYRVNHAVDALEIGFQAPKAAAGEVNGARVHDC

SEQ ID NO: 9 - DNA, 662 bp, Neisseria meningitidis
atggtcgtattcgtggctgaaggcatattcggtcgcgctgttttgggtaacttgstattgctcttcggtcagggtgcgtttgagttcggcgtcactcggttttttatacgttgccgcgtcgaagcctttgccttgcggggcggtcttggttttgcccggcagcggttcgtcagckttgcggatgtcgatgtggcagtagccgttggggtttttaatcaagtagtcctgatggtattcctcggcatcgtagaagtttttcagcggctcgttttcaacaacgaggggcagttggtatttttgctgctcgcgtttgagggcgkcggcgatgacggctttttcgkcggggtcggtgtagtacacgccgctgcggtattgcgtaccggtgtcgttgccctgtttgttgaggctggtcggatcaacgacgcggaagaaatattgcaggatgtcgtctaggctgagtttgtcggcatcgtaggtcactttgacggtttcggcgtggcccgtatggcggtaggacacgtcttcatagctcggatttttcgtgttgccgttggcgtagccggataccgcgtcaaccacgccgtcgatgcgttggaaataggcttccaagccccagaagcagcgccggcgaggtaaatggtgcgcgtgttcatgatttttga

SEQ ID NO: 10 - protein, 219 aa, Neisseria meningitidis
  misc_feature (19)..(19): Xaa can be any naturally occurring amino acid
  misc_feature (59)..(59): Xaa can be any naturally occurring amino acid
  misc_feature (107)..(107): Xaa can be any naturally occurring amino acid
  misc_feature (114)..(114): Xaa can be any naturally occurring amino acid
  misc_feature (208)..(208): Xaa can be any naturally occurring amino acid
MVVFVAEGIFGRAVLGNLXLLFGQGAFEFGVTRFFIRCRVEAFALRGGLGFARQRFVSXADVDVAVAVGVFNQVVLMVFLGIVEVFQRLVFNNEGQLVFLLLAFEGXGDDGFFXGVGVVHAAAVLRTGVVALFVEAGRINDAEEILQDVVAEFVGIVGHFDGFGVARMAVGHVFIARIFRVAVGVAGYRVNHAVDALEIGFQAPEAAXGEVNGARVHDF

SEQ ID NO: 11 - DNA, 663 bp, Neisseria meningitidis
atggtcgtattcgtggctgaaggcatattcggtcgcgctgttttgggtaacttggtattgctcttcggtcagggtgcgtttgagttcggcgtcactcggttttttatacgttgccgcgtcgaagcctttgccttgcggtgcggtcttggttttgcccggcagcggttcgtcggctttgcggatatcgatgtggcagtagccgttggggtttttaatcaagtagtcctgatggtattcctcggcatcgtagaagtttttcagcggctcgttttcaacaacgaggggcagttggtatttttgctgctcgcgtttgagggcggcggcgatgacggctttttcggcggggtcggtgtagtacacgccgctgcggtattgcgtaccggtgtcgttgccctgtttgttgaggctggtcggatcaacgacgcggaagaaatattgcaggatgtcgtctaggctgagtttgtcggcatcgtaggtcactttgacggtttcggcgtggcccgtatggcggtaggacacgtcttcatagctcggatttttcgtgttgccgttggcgtagccggataccgcgtcaaccacgccgtcgatgcgttggaaataggcttccaagccccagaagcagccgccggcgaggtagatggtgcgcgtgttcatgatttttga

SEQ ID NO: 12 - protein, 219 aa, Neisseria meningitidis
MVVFVAEGIFGRAVLGNLVLLFGQGAFEFGVTRFFIRCRVEAFALRCGLGFARQRFVGFADIDVAVAVGVFNQVVLMVFLGIVEVFQRLVFNNEGQLVFLLLAFEGGGDDGFFGGVGVVHAAAVLRTGVVALFVEAGRINDAEEILQDVVAEFVGIVGHFDGFGVARMAVGHVFIARIFRVAVGVAGYRVNHAVDALEIGFQAPEAAAGEVDGARVHDF

SEQ ID NO: 13 - DNA, 777 bp, Neisseria gonorrhoeae
atggtagaacggcatatccagcatttgcggaacggtcatcttcatttgatgcgcccatgccaacaagtgagccaaatgttcggcggcagggcctacgatttccgcgccgataaagcggccggtggctttttcggcatacaggcgcatatggcctttgtttaccagcatcacgcggctgcgaccttgatttttgaacgatacttcgccgatgacaaattcgtcggcttggtattgcgcggcaacctgcgcgtatttcaaaccgacaaagccgatttgcggactggtaaacaccacgccaatggtgctgcggcgcaaaccgctgccgatattcgggtagcggccccgcgttattgcccggcaatcttaccttggtcggcggcttcatgcagcaggggcagttggttggacgcgtcgcccgcaataaagatatgcggaatgctggtctgcatggtcagcggatcggcaacgggtacgccgcgcgcgtctttgtcgatattgatgttttccaaaccgatattgtcaacgttcggacggcgacctacggctgccaacatatattcggcaacaaatacgcctttttcgccatcctgctcccaatggacttctacattgccgtctgcgtcgagtttgacctcggttttagcatccagatgcagtttcaattcttctccgaacacggctttcgcctcgtctgaaacaacggggtcggaaatgccgccgatgattccgcccaaaccgaaaatttcaactttcacacccaaacggtgcaatgcctga

SEQ ID NO: 14 - protein, 258 aa, Neisseria gonorrhoeae
MVERHIQHLRNGHLHLMRPCQQVSQMFGGRAYDFRADKAAGGFFGIQAHMAFVYQHHAAATLIFERYFADDKFVGLVLRGNLRVFQTDKADLRTGKHHANGAAAQTAADIRVAAPRYCPAILPWSAASCSRGSWLDASPAIKICGMLVCMVSGSATGTPRASLSILMFSKPILSTFGRRPTAANIYSATNTPFSPSCSQWTSTLPSASSLTSVLASRCSFNSSPNTAFASSETTGSEMPPMIPPKPKISTFTPKRCNA

SEQ ID NO: 15 - DNA, 774 bp, Neisseria meningitidis
atggtagaacggcatatccagcatttgcggaacggtcatcttcatttgatgtgcccaagccaacaggtgcgccaaatgttcggcggcagggcctacgatttccgcgccgataaagcggccggtggctttttcggcatacaggcgcatatggcctttgttcaccagcatcacgcggctgcggccttggtttttgaacgatacttcgccgatgacaaattcgtcggcttggtattgcgcggcaacctgcgcgtatttcagaccgacaaagccgatttgcggactggtaaacaccacgccgatggtgctgcgccgcaaaccgccgccgatattcgggtagcggccgcgttatcgccggcaatcttgccttggtcggcagcttcatgcagcagaggcagttggttggacgcatcgcctgcgatgaagatatgcggaatactggtctgcatggtcagcgggtcggcaacaggtacgccgcgcgcatctttttcgatattgatattttccaaaccgatattgtcaacgttcggacggcggcccacggctgccagcatatattcggcaacaaatacgcctttttcgccatcctgctcccaatggacttctacattgccgtctgcatcgagtttgacctcggttttagcatccagatgcagtttcaattcttcgccgaacacggcgttcgcctcgtctgaaacgacggggtcggaaatgccgccgatgattccgcccaaaccgaaaatttcaactttcacgcccaaacggtgcaatgcctga

SEQ ID NO: 16 - protein, 257 aa, Neisseria meningitidis
MVERHIQHLRNGHLHLMCPSQQVRQMFGGRAYDFRADKAAGGFFGIQAHMAFVHQHHAAAALVFERYFADDKFVGLVLRGNLRVFQTDKADLRTGKHHADGAAPQTAADIRVAAALSPAILPWSAASCSRGSWLDASPAMKICGILVCMVSGSATGTPRASFSILIFSKPILSTFGRRPTAASIYSATNTPFSPSCSQWTSTLPSASSLTSVLASRCSFNSSPNTAFASSETTGSEMPPMIPPKPKISTFTPKRCNA

SEQ ID NO: 17 - DNA, 774 bp, Neisseria meningitidis
atggtagaacggcatatccagcatttgcggaacggtcatcttcatttgatgtgcccaagccaacaggtgcgccaaatgttcggcggccggacctacgatttctgcgccgatgaagcggccggtggctttttcggcatacaggcgcatatggcctttgtttaccagcatcacgcggctgcggccttggtttttgaacgatacttcgccgatgacaaattcgtcggcttggtattgcgcggcaacctgcgcgtatttcaaaccgacaaagccgatttgcggactggtgaacactacgccgatggtgctgcggcgcaaaccgccgccgatattcgggtagcggccgcgttatcgccggcaatcttgccttggtcggcggcttcatgcagcaggggcagttggttggacgcgtcgcccgcaataaagatatgcggaatactggtctgcatagtcagcggatcggcaacgggtacgccgcgcgcatctttttcgatattgatgttttccaaaccgatattgtcaacgttcggacggcggcctacggctgccagcatatattcggcaacaaatacgcctttttcgccatcctgctcccaatggacttctacattgccgtctgcgtcgagtttggcctcggttttagcatccaaatgcagtttcaattcttcaccgaacacggctttcgcctcgtctgaaacgacggggtcggaaatgccgccgatgatgccacccaaaccgaaaatttcaactttcacgcccaaacggtgcaatgcctga

SEQ ID NO: 18 - protein, 257 aa, Neisseria meningitidis
MVERHIQHLRNGHLHLMCPSQQVRQMFGGRTYDFCADEAAGGFFGIQAHMAFVYQHHAAAALVFERYFADDKFVGLVLRGNLRVFQTDKADLRTGEHYADGAAAQTAADIRVAAALSPAILPWSAASCSRGSWLDASPAIKICGILVCIVSGSATGTPRASFSILMFSKPILSTFGRRPTAASIYSATNTPFSPSCSQWTSTLPSASSLASVLASKCSFNSSPNTAFASSETTGSEMPPMMPPKPKISTFTPKRCNA

SEQ ID NO: 19 - DNA, 1107 bp, Neisseria gonorrhoeae
atggggatggacaatattgatatgttcatgcctgaacaagaggaaatccaatcaatgtggaaagaaattttactgaattacggtattttcctgctcgaactgcttaccgtgttcggcgcaattgcgctgattgtgttggctatcgtacagagtaagaaacagtcggaaagcggcagtgtcgtactgacagatttttcggaaaattataaaaaacagcggcaatcgtttgaaacattctttttaagcgaggaagagacaaaacatcaggaaaaaaaagaaaagaaaaaggaaaaggcggaagccaaagcagagaaaaagcgtttgaaggagggcggggagaaatctgccgaaacgcaaaaatcccgcctttttgtgttggattttgacggcgatttgtatgcacacgccgtagaatccttgcgtcatgagattacggcggtgcttttgattgccaagcctgaagatgaggttctgctcagattggaaagtccgggcggcgtggttcacggttacggtttggcggcttcgcagcttaggcgtttgcgcgaacgcaatattccgctgaccgtcgccgtcgataaggtcgcggcaagcggcggctatatgatggcgtgtgtggcggataaaattgtttccgctccgtttgcggtcatcggttcggtgggtgtggtggcggaagtgccgaatatccaccgcctgttgaaaaaacatgatattgatgtggatgtgatgacggcgggcgaatttaagcgcacggttacttttatgggtgaaaatacggaaaagggcaaacagaaattccggcaggaactggaggaaacgcatcagttgttcaagcagtttgtcagtgaaaaccgccccgggttggatattgaaaaaatagcgacgggcgagcattggttcggccggcaggcgttggcgttgaacttgattgacgagatttcgaccagtgatgatttgttgttgaaagcgtttgaaaacaaacaggttatcgaagtgaaatatcaggagaagcgaagcctgatccagcgcattggtttgcaggcggaagcttccgttgaaaagttgtttgccaaacttgtcaaccggcgagcggatgtgatgtag

SEQ ID NO: 20 - protein, 368 aa, Neisseria gonorrhoeae
MGMDNIDMFMPEQEEIQSMWKEILLNYGIFLLELLTVFGAIALIVLAIVQSKKQSESGSVVLTDFSENYKKQRQSFETFFLSEEETKHQEKKEKKKEKAEAKAEKKRLKEGGEKSAETQKSRLFVLDFDGDLYAHAVESLRHEITAVLLIAKPEDEVLLRLESPGGVVHGYGLAASQLRRLRERNIPLTVAVDKVAASGGYMMACVADKIVSAPFAVIGSVGVVAEVPNIHRLLKKHDIDVDVMTAGEFKRTVTFMGENTEKGKQKFRQELEETHQLFKQFVSENRPGLDIEKIATGEHWFGRQALALNLIDEISTSDDLLLKAFENKQVIEVKYQEKRSLIQRIGLQAEASVEKLFAKLVNRRADVM

SEQ ID NO: 21 - DNA, 1100 bp, Neisseria meningitidis
  misc_feature (350)..(350): n is a, c, g, or t
  misc_feature (374)..(581): n is a, c, g, or t
atggacaatattgacatgttcatgcctgaacaagaggaaatccaatcaatgtggaaagaaattttactgaattacggtattttcctgctcgaactgcttaccgtgttcggcgcaattgcgctgattgtgttggctatcgtacagagtaagaaacagtcggawagcggcagtgtcgtactgacggatttttcggaaaattataaaaaacagcggcaatcgtttgaagcattctttttaagcggggaagaggcacaacatcaggaaaaagaggaaaagaaaaaggaaaaggcggaagccaaagcagagaaaaacgtttgaaggagggtggggagaaatctgccgaaacgcanaaatcacgcctttttgtgttggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgagcggcggttatatgatggcgtgtgtggcggataaaattgcttccgctccgtttgcgattgtcggttcggtgggtgtggtggcggaagtaccgaatatccaccgcctgttgaaaaaacatgatattgatgtggatgtgatgacggcgggcgaatttaagcgcacggttacttttatgggtgaaaatacggaaaagggcaaacagaaattccgacaggaactggaggaaacgcatcagttgttcaagcagtttgtcagcgagaaccgccctcaattggatattgaggaagtggcaacgggcgagcattggttcggtcggcaggcgttggcgttgaacttgattgacgagatttcgaccagtgatgatttgttgttgaaagcgtttgaaaacaaacaggttatcgaagtgaaatatcaggagaagcaaagcctgatccagcgcattggtttgcaggcggaagcttctgttgaaaagttgtttgccaaacttgtcaaccggcgggcggatgtgatgtag

SEQ ID NO: 22 - protein, 366 aa, Neisseria meningitidis
  misc_feature (54)..(54): Xaa can be any naturally occurring amino acid
  misc_feature (104)..(104): Xaa can be any naturally occurring amino acid
  misc_feature (117)..(117): Xaa can be any naturally occurring amino acid
  misc_feature (125)..(194): Xaa can be any naturally occurring amino acid
MDNIDMFMPEQEEIQSMWKEILLNYGIFLLELLTVFGAIALIVLAIVQSKKQSXSGSVVLTDFSENYKKQRQSFEAFFLSGEEAQHQEKEEKKKEKAEAKAEKXRLKEGGEKSAETXKSRLFVLXXXXXXXXXXXXXXXXXXXXXXXXXXXXXXXXXXXXXXXXXXXXXXXXXXXXXXXXXXXXXXXXXXXXXXASGGYMMACVADKIASAPFAIVGSVGVVAEVPNIHRLLKKHDIDVDVMTAGEFKRTVTFMGENTEKGKQKFRQELEETHQLFKQFVSENRPQLDIEEVATGEHWFGRQALALNLIDEISTSDDLLLKAFENKQVIEVKYQEKQSLIQRIGLQAEASVEKLFAKLVNRRADVM

SEQ ID NO: 23 - DNA, 1101 bp, Neisseria meningitidis
atggacaatattgacatgttcatgcctgaacaagaggaaatccaatcaatgtggaaagaaattttactgaattacggtattttcctgctcgaactgcttaccgtgttcggcgcaattgcgctgattgtgttggctatcgtacagagtaagaaacagtcggaaagcggcagtgtcgtactgacggatttttcggaaaattataaaaaacagcggcaatcgtttgaagcattctttttaagcggggaagaggcaaaacatcaggaaaaagaggaaaagaaaaaggaaaaggcggaagccaaagcagagaaaaagcgtttgaaggagggtggggagaaatcttccgaaacgcaaaaatcccgcctttttgtgttggattttgacggcgatttgtatgcacacgccgtagaatccttgcgtcatgagattacggcggtgcttttgattgccaagcctgaagatgaggttctgcttagattggaaagtccgggcggcgtggttcacggttacggtttggcggcttcgcagcttaggcgtttgcgcgaacgcaatattccgctgaccgtcgccgtcgataaggtggcggcgagcggtggttatatgatggcgtgtgtggcggataaaattgtttccgctccgtttgcgattgtcggttcggtgggtgttgtagcggaagtaccgaatatccaccgcctgttgaaaaaacatgatattgatgtggatgtgatgacggcgggcgaatttaagcgcacggttacttttatgggtgaaaatacggaaaagggcaaacagaaattccgacaggaactggaggaaacgcatcagttgttcaagcagtttgtcagcgagaaccgccctcaattggatattgaggaagtggcaacgggcgagcattggttcggtcggcaggcgttggcgttgaacttgattgacgagatttcgaccagtgatgatttgttgttgaaagcgtttgaaaacaaacaggttatcgaagtgaaatatcaggagaagcaaagcctgatccagcgcattggtttgcaggcggaagcttctgttgaaaagttgtttgccaaacttgtcaaccggcgggcggatgtgatgtag

SEQ ID NO: 24 - protein, 366 aa, Neisseria meningitidis
MDNIDMFMPEQEEIQSMWKEILLNYGIFLLELLTVFGAIALIVLAIVQSKKQSESGSVVLTDFSENYKKQRQSFEAFFLSGEEAKHQEKEEKKKEKAEAKAEKKRLKEGGEKSSETQKSRLFVLDFDGDLYAHAVESLRHEITAVLLIAKPEDEVLLRLESPGGVVHGYGLAASQLRRLRERNIPLTVAVDKVAASGGYMMACVADKIVSAPFAIVGSVGVVAEVPNIHRLLKKHDIDVDVMTAGEFKRTVTFMGENTEKGKQKFRQELEETHQLFKQFVSENRPQLDIEEVATGEHWFGRQALALNLIDEISTSDDLLLKAFENKQVIEVKYQEKQSLIQRIGLQAEASVEKLFAKLVNRRADVM

SEQ ID NO: 25 - DNA, 462 bp, Neisseria gonorrhoeae
atgctgctggtgctggaattttggttcggcgtgtcggcggtgggcatacttgcgttgtttttatggcttttgccacgttttgccgccatcagcgaaaacctgtatttccgcctgaacaacagcttggaacgcgacaaccactttatccgaaaaggcgacgagcggcagctgtaccgccattacggactggtttcgcgcctgcgtgtgctgatttccaaccgcgaagccttcggctatctctgcgtcggcgcggcgatgggtattttgttcggctttgcttttgtgatgatgacgctcaaaggctacggcagcgcggggcatatttattcggtcggcacttatctgtggatgtttgccatgagtttggacgatgtgccgcgattggtcgaacaatattccaatttgaaagacatcggacaacggatagagtggtcggaacggaacatcaaagccggaacttga

SEQ ID NO: 26 - protein, 153 aa, Neisseria gonorrhoeae
MLLVLEFWFGVSAVGILALFLWLLPRFAAISENLYFRLNNSLERDNHFIRKGDERQLYRHYGLVSRLRVLISNREAFGYLCVGAAMGILFGFAFVMMTLKGYGSAGHIYSVGTYLWMFAMSLDDVPRLVEQYSNLKDIGQRIEWSERNIKAGT

SEQ ID NO: 27 - DNA, 462 bp, Neisseria meningitidis
atgctgctggtgctggaattttgggtcggcgtgtcggcggtgggcatacttgcgttgtttttatggcttttgccacgttttgccgccatcagcgaaaacctgtatttccgcctgaacaacagcttggaacgcgacaaccactttatccgaaaaggcgaccggcggcagctgtaccgccattacggactgcttgcgcgcctgcgtgtgctgatttccaaccgcgaagccttcggctatctctgcgtcggcacggcgatgggtattttgttcggctttgcttttgtgatgatgacgctcaaaggctacagcagcgcggggcatgtctattcggtcggcacttatctgtggatgtttgccatgagtttggacgacgtgccgcgattggtcgaacaatattccaatttgaaagacatcggacaacggatagagtggtcggaacggaacatcaaagccggaacttga

SEQ ID NO: 28 - protein, 153 aa, Neisseria meningitidis
MLLVLEFWVGVSAVGILALFLWLLPRFAAISENLYFRLNNSLERDNHFIRKGDRRQLYRHYGLLARLRVLISNREAFGYLCVGTAMGILFGFAFVMMTLKGYSSAGHVYSVGTYLWMFAMSLDDVPRLVEQYSNLKDIGQRIEWSERNIKAGT

SEQ ID NO: 29 - DNA, 462 bp, Neisseria meningitidis
atgctgctggtgctggaattttgggtcggcgtgtcggcggtgggcatacttgcgttgtttttatggcttttgccacgttttgccgccatcagcgaaaacctgtatttccgcctgaagaacagcttggaacgcgacaaccactttatccgaaaaggcgacgagcggcagctggaccgccattacggactgcttgcgcgcctgcgtgtgctgatttccaaccgcgaagccttcggctatctctgcgtcggcacggcgatgggtattttgttcggctttgcttttgtgatgatgacgctcaaaggctacagcagcgcggggcatgtctattcggtcggcacttatctgtggatgtttgccataagtttggacgacgtgccgcgattggtcgaacaatattccaatttgaaagacatcggacaacggatagagtggtcgaaacggaacatcaaagccggaacttga

SEQ ID NO: 30 - protein, 153 aa, Neisseria meningitidis
MLLVLEFWVGVSAVGILALFLWLLPRFAAISENLYFRLKNSLERDNHFIRKGDERQLDRHYGLLARLRVLISNREAFGYLCVGTAMGILFGFAFVMMTLKGYSSAGHVYSVGTYLWMFAISLDDVPRLVEQYSNLKDIGQRIEWSKRNIKAGT

SEQ ID NO: 31 - DNA, 867 bp, Neisseria gonorrhoeae
atgtggaaaatgttgaaacacatagccaaaacccaccgcaagcgattgattggcacattttccccggtcggactggaaaaccttttgatgctggggtatccggtgtttggcggctgggcgattaatgccgtgattgcggggagggtgtggcaggcgttgctgtacgctttggttgtatttttgatgtggctggtcggtgcggcacggcggattgccgatacgcgcacgtttacgcggatttataccgaaatcgccgtgccggttgtgttggaacaacggcagcggcaagtcccgcattcagcggtaactgcacgggttgccctgtcgcgtgaatttgtcagcttttttgaagaacacctgccgattgccgcgacatccgtcgtatccatattcggcgcgtgcatcatgctgctggtgctggaattttgggtcggcgtgtcggcggtgggcatacttgcgttgtttttatggcttttgccacgttttgccgccatcagcgaaaacctgtatttccgcctgaacaacagcttggaacgcgacaaccactttatccgaaaaggcgacgagcggcagctgtaccgccattacggactggtttcgcgcctgcgtgtgctgatttccaaccgcgaagccttcggctatctctgcgtcggcgcggcgatgggtattttgttcggctttgcttttgtgatgatgacgctcaaaggctacggcagcgcggggcatatttattcggtcggcacttatctgtggatgtttgccatgagtttggacgatgtgccgcgattggtcgaacaatattccaatttgaaagacatcggacaacggatagagtggtcggaacggaacatcaaagccggaacttga

SEQ ID NO: 32 - protein, 288 aa, Neisseria gonorrhoeae
MWKMLKHIAKTHRKRLIGTFSPVGLENLLMLGYPVFGGWAINAVIAGRVWQALLYALVVFLMWLVGAARRIADTRTFTRIYTEIAVPVVLEQRQRQVPHSAVTARVALSREFVSFFEEHLPIAATSVVSIFGACIMLLVLEFWVGVSAVGILALFLWLLPRFAAISENLYFRLNNSLERDNHFIRKGDERQLYRHYGLVSRLRVLISNREAFGYLCVGAAMGILFGFAFVMMTLKGYGSAGHIYSVGTYLWMFAMSLDDVPRLVEQYSNLKDIGQRIEWSERNIKAGT

SEQ ID NO: 33 - DNA, 867 bp, Neisseria meningitidis
atgtggaaaatgttgaaacacatagcccaaacccaccgcaagcgattgattggcacattttccctggtcggactggaaaaccttttgatgctggtgtatccggtgtttggcggccgggcgatcaatgccgtgattgcgggggaggtgtggcaggcgttgctgtacgctttggttgtgcttttgatgtggctggtcggtgcggtgcggcggattgccgatacgcgcacgtttacgcggatttataccgaaatcgccgtgccggtcgtgttggaacagcggcagcgacaagtcccgcattcggcggtaactgcgcgggttgccctgtcgcgtgagtttgtcagcttttttgaagaacacctgccgattgccgcgacatccgtcgtatccatattcggcgcgtgcatcatgctgctggtgctggaattttgggtcggcgtgtcggcggtgggcatacttgcgttgtttttatggcttttgccacgttttgccgccatcagcgaaaacctgtatttccgcctgaacaacagcttggaacgcgacaaccactttatccgaaaaggcgaccggcggcagctgtaccgccattacggactgcttgcgcgcctgcgtgtgctgatttccaaccgcgaagccttcggctatctctgcgtcggcacggcgatgggtattttgttcggctttgcttttgtgatgatgacgctcaaaggctacagcagcgcggggcatgtctattcggtcggcacttatctgtggatgtttgccatgagtttggacgacgtgccgcgattggtcgaacaatattccaatttgaaagacatcggacaacggatagagtggtcggaacggaacatcaaagccggaacttga

SEQ ID NO: 34 - protein, 288 aa, Neisseria meningitidis
MWKMLKHIAQTHRKRLIGTFSLVGLENLLMLVYPVFGGRAINAVIAGEVWQALLYALVVLLMWLVGAVRRIADTRTFTRIYTEIAVPVVLEQRQRQVPHSAVTARVALSREFVSFFEEHLPIAATSVVSIFGACIMLLVLEFWVGVSAVGILALFLWLLPRFAAISENLYFRLNNSLERDNHFIRKGDRRQLYRHYGLLARLRVLISNREAFGYLCVGTAMGILFGFAFVMMTLKGYSSAGHVYSVGTYLWMFAMSLDDVPRLVEQYSNLKDIGQRIEWSERNIKAGT

SEQ ID NO: 35 - DNA, 843 bp, Neisseria meningitidis
agccaaaaccaccgcaagcgattgattggcacattttttctggtcggactggaaaaccttttgatgctggtgtatccggtgtttggcggctgggcgattaatgccgtgattgcggggcaggcgtggcaggcgttgctgtacgctttggttgtgcttttgatgtggctggtcggtgcggcgcggcggattgccgatacgcgcacgtttacgcggatttataccgaaatcgccgtgccggttgtgttggaacagcggcagcggcaagtcccgcattcggcggtaactgcgcgggttgccctgtcgcgtgagtttgtcagcttttttgaagaacacctgccgattgccgcgacatccgtcgtatccatattcggcgcgtgcatcatgctgctggtgctggaattttgggtcggcgtgtcggcggtgggcatacttgcgttgtttttatggcttttgccacgttttgccgccatcagcgaaaacctgtatttccgcctgaagaacagcttggaacgcgacaaccactttatccgaaaaggcgacgagcggcagctggaccgccattacggactgcttgcgcgcctgcgtgtgctgatttccaaccgcgaagccttcggctatctctgcgtcggcacggcgatgggtattttgttcggctttgcttttgtgatgatgacgctcaaaggctacagcagcgcggggcatgtctattcggtcggcacttatctgtggatgtttgccataagtttggacgacgtgccgcgattggtcgaacaatattccaatttgaaagacatcggacaacggatagagtggtcgaaacggaacatcaaagccggaacttga

SEQ ID NO: 36 - protein, 280 aa, Neisseria meningitidis
SQNHRKRLIGTFFLVGLENLLMLVYPVFGGWAINAVIAGQAWQALLYALVVLLMWLVGAARRIADTRTFTRIYTEIAVPVVLEQRQRQVPHSAVTARVALSREFVSFFEEHLPIAATSVVSIFGACIMLLVLEFWVGVSAVGILALFLWLLPRFAAISENLYFRLKNSLERDNHFIRKGDERQLDRHYGLLARLRVLISNREAFGYLCVGTAMGILFGFAFVMMTLKGYSSAGHVYSVGTYLWMFAISLDDVPRLVEQYSNLKDIGQRIEWSKRNIKAGT

SEQ ID NO: 37 - DNA, 342 bp, Neisseria gonorrhoeae
atgaacacaacccgactgccgaccgccttcatcttgtgctgcctctgcgccgccgcttctgccgccgacaacagcatcatgacaaaagggcaaaaagtgtacgaatccaactgcatcgcctgccacggcaagaaaggggaagggcgcggcactgcgtttcctccgcttttccggtcggactgtattatgaacaaaccgcacgtcctgctgcacagcatggtcaaaggcatcgacgggacattcaaagtggagcggcaaaacctacgacggatttatgcccgcaaccgccatcagcgatgcggacattgccgccgtcgccacttatatcatgaacgcctttga

SEQ ID NO: 38 - protein, 113 aa, Neisseria gonorrhoeae
MNTTRLPTAFILCCLCAAASAADNSIMTKGQKVYESNCIACHGKKGEGRGTAFPPLFRSDCIMNKPHVLLHSMVKGIDGTFKVERQNLRRIYARNRHQRCGHCRRRHLYHERL

SEQ ID NO: 39 - DNA, 341 bp, Neisseria meningitidis
atgaacacaacccgactgccgaccgccctcgtcttgggctgcttctgcgccgccgcttctgccgccgacaacagcatcatgacaaaagggcaaaaagtgtacgaatccaactgcgtcgcctgccacggcaaaaagggcgaaggccgcggaaccatgtttccgccgctctaccgctccgacttcatcatgaaaaaaccgcaggtgctgctgcacagcatggtcaaaggcatcaacggtacaatcaaagtcaacggcaaaacctacaacggattcatgcccgcaaccgccatcagcgatgcggacattgccgccgtcgccacttatatcatgaacgcctttga

SEQ ID NO: 40 - protein, 113 aa, Neisseria meningitidis
  misc_feature (84)..(84): Xaa can be any naturally occurring amino acid
MNTTRLPTALVLGCFCAAASAADNSIMTKGQKVYESNCVACHGKKGEGRGTMFPPLYRSDFIMKKPQVLLHSMVKGINGTIKVXRQNLQRIHARNRHQRCGHCRRRHLYHERL

SEQ ID NO: 41 - DNA, 341 bp, Neisseria meningitidis
atgaacacaacccgactgccgaccgccctcgtcttgggctgcctctgcgccgccgcttctgccgccgacaacagcatcatgacaaaagggcaaaaagtgtacgaatccaactgcgtcgcctgccacggcaaaaagggcgaaggccgcggaaccatgtttccgccgctctaccgctccgacttcatcatgaaaaaaccgcaggtgctgctgcacagcatggtcaaaggcatcaacggtacaatcaaagtcaacggcaaaacctacaacggattcatgcccgccactgccatcagcgatgcggacattgccgccgtcgccacttatatcatgaacgcctttga

SEQ ID NO: 42 - DNA, 341 bp, Neisseria meningitidis; identical to SEQ ID NO: 41

SEQ ID NO: 43 - DNA, 399 bp, Neisseria gonorrhoeae
atgaacacaacccgactgccgaccgccttcatcttgtgctgcctctgcgccgccgcttctgccgccgacaacagcatcatgacaaaagggcaaaaagtgtacgaatccaactgcatcgcctgccacggcaagaaaggggaagggcgcggcactgcgtttcctccgcttttccggtcggactatattatgaacaaaccgcacgtcctgctgcacagcatggtcaaaggcatcaacggtacaatcaaagtcaacggcaaaacctacaacggattcatgcccgcaaccgccatcagcgatgcggacattgccgccgtcgccacttatatcatgaacgcctttgacaacggcggcggaagcgttaccgaaaaagacgtaaaacaggcaaaaggcaaaaaaaac

SEQ ID NO: 44 - protein, 133 aa, Neisseria gonorrhoeae
MNTTRLPTAFILCCLCAAASAADNSIMTKGQKVYESNCIACHGKKGEGRGTAFPPLFRSDYIMNKPHVLLHSMVKGINGTIKVNGKTYNGFMPATAISDADIAAVATYIMNAFDNGGGSVTEKDVKQAKGKKN

SEQ ID NO: 45 - DNA, 402 bp, Neisseria meningitidis
atgaacacaacccgactgccgaccgccctcgtcttgggctgcttctgcgccgccgcttctgccgccgacaacagcatcatgacaaaagggcaaaaagtgtacgaatccaactgcgtcgcctgccacggcaaaaagggcgaaggccgcggaaccatgtttccgccgctctaccgctccgacttcatcatgaaaaaaccgcaggtgctgctgcacagcatggtcaaaggcatcaacggtacaatcaaagtcaacggcaaaacctacaacggattcatgcccgcaaccgccatcagcgatgcggacattgccgccgtcgccacttatatcatgaacgcctttgacaacggcggcggaagcgttaccgaaaaagacgtaaaacaggcaaaaagcaaaaaaaactaa

SEQ ID NO: 46 - protein, 133 aa, Neisseria meningitidis
MNTTRLPTALVLGCFCAAASAADNSIMTKGQKVYESNCVACHGKKGEGRGTMFPPLYRSDFIMKKPQVLLHSMVKGINGTIKVNGKTYNGFMPATAISDADIAAVATYIMNAFDNGGGSVTEKDVKQAKSKKN

SEQ ID NO: 47 - DNA, 396 bp, Neisseria meningitidis
atgaacacaacccgactgccgaccgccctcgtcttgggctgcctctgcgccgccgcttctgccgccgacaacagcatcatgacaaaagggcaaaaagtgtacgaatccaactgcgtcgcctgccacggcaaaaagggcgaaggccgcggaaccatgtttccgccgctctaccgctccgacttcatcatgaaaaaaccgcaggtgctgctgcacagcatggtcaaaggcatcaacggtacaatcaaagtcaacggcaaaacctacaacggattcatgcccgccactgccatcagcgatgcggacattgccgccgtcgccacttatatcatgaacgcctttgacaacggcggcggaagcgttaccgaaaaagacgtaaaacaggcaaaaaacaaaaaa

SEQ ID NO: 48 - protein, 132 aa, Neisseria meningitidis
MNTTRLPTALVLGCLCAAASAADNSIMTKGQKVYESNCVACHGKKGEGRGTMFPPLYRSDFIMKKPQVLLHSMVKGINGTIKVNGKTYNGFMPATAISDADIAAVATYIMNAFDNGGGSVTEKDVKQAKNKK

SEQ ID NO: 49 - DNA, 495 bp, Neisseria gonorrhoeae
atgaacaacagacattttgccgtcatcgccttgggcagcaaccttgacaaccccgcacaacaaatacgcggcgcattagacgcgctctcgtcccatcctgacatccggcttgaacaggtttcctcactgtatatgaccgcacctgtcggttacgacaatcagcccgatttcatcaatgccgtctgcaccgtttccaccaccttggacggcattgccctgcttgccgaactcaaccgtatcgaagccgatttcggacgcgaacgcagtttccgcaatgcaccgcgcacattggatttggacattatcgactttgacggcatctccagcgacgacccccgccttaccctgccgcatccgcgcgcgcacgaacgcagtttcgtcatacgccctttggcagaaatcctccctgattttattttgggaaaatacggaaaggttgtcgaattgtcaaaacggctgggcaatcaaggcatccgtcttttaccggacaggtaa

SEQ ID NO: 50 - protein, 164 aa, Neisseria gonorrhoeae
MNNRHFAVIALGSNLDNPAQQIRGALDALSSHPDIRLEQVSSLYMTAPVGYDNQPDFINAVCTVSTTLDGIALLAELNRIEADFGRERSFRNAPRTLDLDIIDFDGISSDDPRLTLPHPRAHERSFVIRPLAEILPDFILGKYGKVVELSKRLGNQGIRLLPDR

SEQ ID NO: 51 - DNA, 497 bp, Neisseria meningitidis
atgaacaacagacattttgccgtcatcgccctgggcagtaatcttgaaaaccctgctcaacaggtacgcgccgcattggacacgctgtcgtcccatcctgacatccgtcttaaacaggcttcctcactgtatatgaccgcgcccgtcggttacgacaatcagcccgattttgtcaatgccgtctgcaccgtttccaccactctggacggcattgccytgcttgccgaactcaaccgtatcgaggctgatttcggacgcgaacgcagcttccgcaacgcgccgcgcacattgkatttggacattatcgactttgacggcatctccagcgacgacacscgactcaccttgccgcatccgcgcgcgcacgaacgcagtttcgtcatccgccctttggcagaaatcctccctgattttgttttaggaaaacacggaaaggttgccgaattgtcaaaacggytgggcaatcaaggtatccgtcttttaccggacaggtaatt

SEQ ID NO: 52 - protein, 164 aa, Neisseria meningitidis
  misc_feature (98)..(98): Xaa can be any naturally occurring amino acid
MNNRHFAVIALGSNLENPAQQVRAALDTLSSHPDIRLKQASSLYMTAPVGYDNQPDFVNAVCTVSTTLDGIALLAELNRIEADFGRERSFRNAPRTLXLDIIDFDGISSDDTRLTLPHPRAHERSFVIRPLAEILPDFVLGKHGKVAELSKRLGNQGIRLLPDR

SEQ ID NO: 53 - DNA, 495 bp, Neisseria meningitidis
atgaacaacagacattttgccgtcatcgccctgggcagtaatcttgaaaaccctgcccaacaggtacgcgccgcattggacacgctgtcgtcccatcctgacatccgtcttaaacaggcttcctcactgtatatgaccgcgcccgtcggttacgacaatcagcccgatttcgtcaatgccgtctgcaccgtttccaccaccttggacggcattgccctgcttgccgaactcaaccgtatcgaagccgatttcggacgcgaacgcagcttccgcaacgcgccgcgcacattggatttggacattatcgactttgacggcatctccagcgacgacccccgactcaccctgccgcatccgcgcgcgcacgaacgcagtttcgtcatacgccctttggcagaaatcctccctgattttattttgggaaaacacggaaaggttgccgaattgtcaaaacggctgggcaatcaaggcatccgtcttttaccggataagtaa

SEQ ID NO: 54 - protein, 164 aa, Neisseria meningitidis
MNNRHFAVIALGSNLENPAQQVRAALDTLSSHPDIRLKQASSLYMTAPVGYDNQPDFVNAVCTVSTTLDGIALLAELNRIEADFGRERSFRNAPRTLDLDIIDFDGISSDDPRLTLPHPRAHERSFVIRPLAEILPDFILGKHGKVAELSKRLGNQGIRLLPDK

SEQ ID NO: 55 - DNA, 261 bp, Neisseria gonorrhoeae
atgccccgcgctgccgtagcctttgagcgtcatcatcacaaaagcaaagccgaacaaaatacccatcgccgcgccgacgcagagatagccgaaggcttcgcggttggaaatcagcacacgcaggcgcgaaaccagtccgtaatggcggtacagctgccgctcgtcgccttttcggataaagtggttgtcgcgttccaagctgttgttcaggcggaaatacaggttttcgctgatggcggcaaaacgtggcaaaagccataa

SEQ ID NO: 56 - protein, 86 aa, Neisseria gonorrhoeae
MPRAAVAFERHHHKSKAEQNTHRRADAEIAEGFAVGNQHTQARNQSVMAVQLPLVAFSDKVVVAFQAVVQAEIQVFADGGKTWQKP

SEQ ID NO: 57 - DNA, 261 bp, Neisseria meningitidis
atgccccgcgctgctgtagcctttgagcgtcatcatcacaaaagcaaagccgaacaaaatacccatcgccgtgccgacgcagagatagccgaaggcttcgcggttggaaatcagcacacgcaggcgcgcaagcagtccgtaatggcggtacagctgccgccggtcgccttttcggataaagtggttgtcgcgttccaagctgttgttcaggcggaaatacaggttttcgctgatggcggcaaaacgtggcaaaagccataa

SEQ ID NO: 58 - protein, 86 aa, Neisseria meningitidis
MPRAAVAFERHHHKSKAEQNTHRRADAEIAEGFAVGNQHTQARKQSVMAVQLPPVAFSDKVVVAFQAVVQAEIQVFADGGKTWQKP

SEQ ID NO: 59 - DNA, 261 bp, Neisseria meningitidis
atgccccgcgctgctgtagcctttgagcgtcatcatcacaaaagcaaagccgaacaaaatacccatcgccgtgccgacgcagagatagccgaaggcttcgcggttggaaatcagcacacgcaggcgcgcaagcagtccgtaatggcggtccagctgccgctcgtcgccttttcggataaagtggttgtcgcgttccaagctgttcttcaggcggaaatacaggttttcgctgatggcggcaaaacgtggcaaaagccataa

SEQ ID NO: 60 - protein, 86 aa, Neisseria meningitidis
MPRAAVAFERHHHKSKAEQNTHRRADAEIAEGFAVGNQHTQARKQSVMAVQLPLVAFSDKVVVAFQAVLQAEIQVFADGGKTWQKP

SEQ ID NO: 61 - DNA, 1248 bp, Neisseria gonorrhoeae
atgggttttcctgttcgcaagtttgatgccgtgattgtcggcggtggcggtgcaggtttacgtgcagccctccaattatccaaatccggtttgaattgtgccgttttgtctaaagtgttcccgacccgctcgcataccgtagcggcgcagggcggtatttccgcctctctgggtaatgtgcaggaggaccgttgggactggcacatgtacgataccgtgaaaggttccgactggctgggcgaccaagatgcgattgagtttatgtgtcgcgctgcgcctgaagcggtgattgagttggaacacatgggtatgccttttgaccgcgttgaaagcggcaaaatttatcagcgtcctttcggcggacatactgccgaacatggtaaacgtgcggtagaacgtgcatgtgcggttgccgaccgtaccggtcatgcgatgttgcatactttgtaccaacaaaacgtccgtgccaatacacaattctttgtggaatggacggcgcaagatttgattcgtgatgaaaacggcgatgtcgtcggcgtaaccgccatggaaatggaaacgggcgaagtttatattttccacgccaaggccgtgatgtttgctaccggtggcggcggtcgtatttatgcttcttctaccaatgcttatatgaataccggtgacggtttgggcatttgcgcccgtgcgggcattccgttggaagatatggaattctggcaattccacccgaccggcgtggcgggtgcgggcgtgttgattaccgaaggcgtacgcggcgagggcggtattctgttgaacgccgacggcgaacgctttatggaacgctatgcgccgaccgtaaaagacttggcttctcgcgacgtggtttcacgcgcgatggcgatggaaatctatgaaggtcgcggctgtggtaaaaacaaagaccacgtcttactgaaaatcgaccatatcggtgcagaaaaaattatggaaaaactgccgggcatccgcgagatttccattcagtttgccggtatcgatccgattaaagacccgattccggttgtgccgactacccactatatgatgggcggcattccgaccaattatcacggtgaagttgttgttccgcaaggcgacgagtacgaagtacctgtaaaaggcctgtatgccgcaggtgagtgcgcctgtgcttccgtacacggtgcgaaccgtttgggtacgaactccctgctggacttggtggtgttccgcccaaccccccggtga

SEQ ID NO: 62 - protein, 415 aa, Neisseria gonorrhoeae
MGFPVRKFDAVIVGGGGAGLRAALQLSKSGLNCAVLSKVFPTRSHTVAAQGGISASLGNVQEDRWDWHMYDTVKGSDWLGDQDAIEFMCRAAPEAVIELEHMGMPFDRVESGKIYQRPFGGHTAEHGKRAVERACAVADRTGHAMLHTLYQQNVRANTQFFVEWTAQDLIRDENGDVVGVTAMEMETGEVYIFHAKAVMFATGGGGRIYASSTNAYMNTGDGLGICARAGIPLEDMEFWQFHPTGVAGAGVLITEGVRGEGGILLNADGERFMERYAPTVKDLASRDVVSRAMAMEIYEGRGCGKNKDHVLLKIDHIGAEKIMEKLPGIREISIQFAGIDPIKDPIPVVPTTHYMMGGIPTNYHGEVVVPQGDEYEVPVKGLYAAGECACASVHGANRLGTNSLLDLVVFRPTPR

SEQ ID NO: 63 - DNA, 696 bp, Neisseria meningitidis
  misc_feature (1)..(1): n is a, c, g, or t
  misc_feature (100)..(100): n is a, c, g, or t
ntccaattatccaaatccggtctgaattgtgccgttttgtctaaagtgttcccgacccgttcgcataccgtagcggcgcagggcggtatttccgcctctntgggtaatgtgcaggaagaccgttgggactggcacatgtacgataccgtgaaaggttccgactggttgggcgaccaagatgcgattgagtttatgtgccgcgccgcgcctgaagccgtaattgagttggaacacatgggtatgccttttgaccgtgtggaaagcggtaaaatttatcagcgtcctttcggcggccatactgccgaacacggtaaacgcgcggtagaacgcgyctgtgcggttgccgaccgtacaggtcatgcgatgctgcatactttgtaccaacaaaacgtccgtgccaatacgcaattctttgtggaatggacggcacaagatttgattcgtgatgaaaacggcgatgtcgtcggcgtaaccgccatggaaatggaaaccggcgaagtttatattttccacgctaaagctgtgatgtttgctaccggcggcggcggtcgtatttatgcgtcttctaccaatgcctatatgaataccggcgatggtttgggtatttgtgcgcgtgcaggtatcccgttggaagacatggaattctggcaattccagccgaccggcgtggcgggtgcgggcgtgttgattaccgaa

SEQ ID NO: 64 - protein, 202 aa, Neisseria meningitidis
  misc_feature (1)..(1): Xaa can be any naturally occurring amino acid
  misc_feature (34)..(34): Xaa can be any naturally occurring amino acid
XQLSKSGLNCAVLSKVFPTRSHTVAAQGGISASXGNVQEDRWDWHMYDTVKGSDWLGDQDAIEFMCRAAPEAVIELEHMGMPFDRVESGKIYQRPFCAVADRTGHAMLHTLYQQNVRANTQFFVEWTAQDLIRDENGDVVGVTAMEMETGEVYIFHAKAVMFATGGGGRIYASSTNGIPLEDMEFWQFQPTGVAGAGVLITE

SEQ ID NO: 65 - DNA, 1764 bp, Neisseria meningitidis
  misc_feature (67)..(67): n is a, c, g, or t
  misc_feature (408)..(408): n is a, c, g, or t
atgggctttcctgttcgcaagtttgatgccgtgattgtcggcggtggtggtgcaggtttacgcgcanccctccaattatccaaatccggtctgaattgtgccgttttgtctaaagtgttcccgacccgttcgcataccgtagcggcgcagggcggtatttccgcctctctgggtaatgtgcaggaagaccgttgggactggcacatgtacgataccgtgaaaggttccgactggttgggcgaccaagatgcgattgagtttatgtgccgcgccgcgcctgaagccgtaattgagttggaacacatgggtatgccttttgaccgtgtggaaagcggtaaaatttatcagcgtcctttcggcggccatactgccgaacacggtaaacgcgcggtagaacgcgcctgtgcngttgccgaccgtacaggtcatgcgatgctgcatactttgtaccaacaaaatgtccgtgccaatacgcaattctttgtggaatggacggcacaagatttgattcgtgatgaaaacggcgatgtcgtcggcgtaaccgccatggaaatggaaaccggcgaagtttatattttccacgctaaagctgtgatgtttgctaccggcggcggcggccgtatttatgcgtcttctaccaatgcctatatgaataccggcgatggtttgggtatttgtgcgcgtgcaggtatcccgttggaagacatggaattctggcaattccacccgaccggcgtggcaggtgcgggcgtgttgattaccgaaggcgtacgcggcgagggcggtattctgttgaatgccgacggcgaacgctttatggaacgctatgcgccgaccgtaaaagacttggcttctcgcgacgttgtttcccgcgcgatggcgatggaaatctacgaaggtcgcggctgcggtaaaaacaaagaccatgtcttactgaaaatcgaccatatcggcgcagaaaaaattatggaaaaactgccgggcatccgcgagatttccattcagttcgccggtatcgatccgattaaagacccgattcccgttgtgccgactacccactatatgatgggcggtattccgaccaactaccatggcgaagttgtcgttcctcaaggcgacgaatacgaagtgcctgtaaaaggtctgtatgcggcaggtgagtgcgcctgtgcttccgtacacggtgcgaaccgcttgggtacgaactccctgctggacttagtggtattcggtaaagctgccggcgacagcatgattaaattcatcaaagagcaaagcgactggaaacctttgcctgctaatgccggcgaactgacccgccaacgtatcgagcgtttggacaatcaaactgatggtgaaaacgttgatgcattgcgccgcgaactgcaacgctccgtacaattgcacgccggcgtgttccgtactgatgagattctgagcaaaggcgttcgagaagtcatggcgattgccgagcgtgtgaaacgtaccgaaatcaaagacaagagcaaagtgtggaataccgcgcgtatcgaggctttggaattggataacctaattgaagtggcgaaagcgactttggtgtctgccgaagcacgtaaagaatcacgcggtgcgcacgcttcagacgaccatcctgagcgcgatgatgaaaactggatgaaacatacgctgtaccattcagatgccaataccttgtcctacaaaccggtgcacaccaagcctttgagcgtggaatacatcaaaccggccaagcgcgtttattga

SEQ ID NO: 66 - protein, 587 aa, Neisseria meningitidis
  misc_feature (23)..(23): Xaa can be any naturally occurring amino acid
MGFPVRKFDAVIVGGGGAGLRAXLQLSKSGLNCAVLSKVFPTRSHTVAAQGGISASLGNVQEDRWDWHMYDTVKGSDWLGDQDAIEFMCRAAPEAVIELEHMGMPFDRVESGKIYQRPFGGHTAEHGKRAVERACAVADRTGHAMLHTLYQQNVRANTQFFVEWTAQDLIRDENGDVVGVTAMEMETGEVYIFHAKAVMFATGGGGRIYASSTNAYMNTGDGLGICARAGIPLEDMEFWQFHPTGVAGAGVLITEGVRGEGGILLNADGERFMERYAPTVKDLASRDVVSRAMAMEIYEGRGCGKNKDHVLLKIDHIGAEKIMEKLPGIREISIQFAGIDPIKDPIPVVPTTHYMMGGIPTNYHGEVVVPQGDEYEVPVKGLYAAGECACASVHGANRLGTNSLLDLVVFGKAAGDSMIKFIKEQSDWKPLPANAGELTRQRIERLDNQTDGENVDALRRELQRSVQLHAGVFRTDEILSKGVREVMAIAERVKRTEIKDKSKVWNTARIEALELDNLIEVAKATLVSAEARKESRGAHASDDHPERDDENWMKHTLYHSDANTLSYKPVHTKPLSVEYIKPAKRVY

SEQ ID NO: 67 - DNA, 1248 bp, Neisseria gonorrhoeae; identical to SEQ ID NO: 61

SEQ ID NO: 68 - protein, 415 aa, Neisseria gonorrhoeae; identical to SEQ ID NO: 62

SEQ ID NO: 69 - DNA, 1767 bp, Neisseria meningitidis
atgggttttcctgttcgcaagtttgatgccgtgattgtcggcggtggtggtgcaggtttacgcgcagccctccaattatccaaatccggtctgaattgtgccgttttgtctaaagtgttcccgacccgttcgcataccgtagcggcgcagggcggtatttccgcctctctgggtaatgtgcaggaagaccgttgggactggcacatgtacgataccgtgaaaggttccgactggttgggcgaccaagatgcgattgagtttatgtgccgcgccgcgcctgaagccgtaattgagttggaacacatgggtatgccttttgaccgtgtggaaagcggtaaaatttatcagcgtcctttcggcggccatactgccgaacacggtaaacgcgcggtagaacgcgcctgtgcggttgccgaccgtacaggtcatgcgatgctgcatactttgtaccaacaaaacgtccgtgccaatacgcaattctttgtggaatggacggcacaagatttgattcgtgatgaaaacggcgatgtcgtcggcgtaaccgccatggaaatggaaaccggcgaagtttatattttccacgctaaagctgtgatgtttgctaccggcggcggcggtcgtatttatgcgtcttctaccaatgcctatatgaataccggcgatggtttgggtatttgtgcgcgtgcaggtatcccgttggaagacatggaattctggcaattccacccgaccggcgtggcgggtgcgggcgtgttgattaccgaaggcgtacgcggcgagggcggtattctgttgaatgccgacggcgaacgctttatggaacgctatgcgccgaccgtaaaagacttggcttctcgcgacgttgtttcccgcgcgatggcgatggaaatctacgaaggtcgcggctgcggtaaaaacaaagaccatgtcttactgaaaatcgaccatatcggcgcagaaaaaattatggaaaaactgccgggcatccgcgagatttccattcagttcgccggtatcgatccgattaaagacccgattcccgttgtgccgactacccactatatgatgggcggcattccgaccaattaccacggcgaagttgtcgttccgcaaggtgaagattacgaagtgcctgtaaaaggtctgtatgcggcaggtgagtgcgcttgtgcttccgtacacggtgcgaaccgcttgggtaccaactccctgttggacttggtggtattcggtaaagctgccggcgacagcatgattaaattcatcaaagagcaaagcgactggaaacctttgcctgctaatgcaggtgagttgacccgccaacgtatcgagcgtttggacaaccaaaccgatggtgaaaacgttgatgcattgcgtcgcgaactgcaacgctctgtacaactgcacgccggcgtgttccgtactgatgagattctgagcaaaggcgttcgagaagtcatggcgattgccgagcgtgtgaaacgtaccgaaatcaaagacaagagcaaagtgtggaataccgcgcgtatcgaggctttggaattggataacctgattgaagtggcgaaagcgactttggtgtctgccgaagcacgtaaagaatcacgcggtgcgcacgcttcagacgaccatcctgagcgcgatgatgaaaactggatgaaacatacgctgtaccattcagatatcaataccttgtcctacaaaccggtgcacaccaagcctttgagcgtggaatacatcaaaccggccaagcgcgtttattgatga

SEQ ID NO: 70 - protein, 587 aa, Neisseria meningitidis
MGFPVRKFDAVIVGGGGAGLRAALQLSKSGLNCAVLSKVFPTRSHTVAAQGGISASLGNVQEDRWDWHMYDTVKGSDWLGDQDAIEFMCRAAPEAVIELEHMGMPFDRVESGKIYQRPFGGHTAEHGKRAVERACAVADRTGHAMLHTLYQQNVRANTQFFVEWTAQDLIRDENGDVVGVTAMEMETGEVYIFHAKAVMFATGGGGRIYASSTNAYMNTGDGLGICARAGIPLEDMEFWQFHPTGVAGAGVLITEGVRGEGGILLNADGERFMERYAPTVKDLASRDVVSRAMAMEIYEGRGCGKNKDHVLLKIDHIGAEKIMEKLPGIREISIQFAGIDPIKDPIPVVPTTHYMMGGIPTNYHGEVVVPQGEDYEVPVKGLYAAGECACASVHGANRLGTNSLLDLVVFGKAAGDSMIKFIKEQSDWKPLPANAGELTRQRIERLDNQTDGENVDALRRELQRSVQLHAGVFRTDEILSKGVREVMAIAERVKRTEIKDKSKVWNTARIEALELDNLIEVAKATLVSAEARKESRGAHASDDHPERDDENWMKHTLYHSDINTLSYKPVHTKPLSVEYIKPAKRVY

SEQ ID NO: 71 - DNA, 1764 bp, Neisseria meningitidis; identical to SEQ ID NO: 65
  misc_feature (67)..(67): n is a, c, g, or t
  misc_feature (408)..(408): n is a, c, g, or t

SEQ ID NO: 72 - protein, 587 aa, Neisseria meningitidis; identical to SEQ ID NO: 66
  misc_feature (23)..(23): Xaa can be any naturally occurring amino acid

SEQ ID NO: 73 - DNA, 543 bp, Neisseria gonorrhoeae
atgaagacacaccgcaagacctgctctgcggtgtgttttgcttttcagacggcatcgaaacccgccgtttccatccgacatcccagcgaggacatcatgagcctgaaaacccgccttaccgaagatatgaaaaccgcgatgcgcgccaaagatcaagtttccctcggcaccatccgcctcatcaatgccgccgtcaaacagtttgaagtagacgaacgcaccgaagccgacgatgccaaaatcaccgccatcctgaccaaaatggtcaaacagcgcaaagacggcgcgaaaatctacactgaagccggccgtcaggatttggcagacaaagaaaacgccgaaatcgacgtgctgcaccgctacctgccgcaaatgctctccgccggcgaaatccgcaccgccgtcgaagcagccgttgccgaaaccggcgcggcaggtatggcggatatgggcaaagtgatggtcgtattgaaaacccgcctcgccggcaaagccgatatgggcgaagtcaacaaaatcttgaaaaccgtactgaccgcctga

SEQ ID NO: 74 - protein, 180 aa, Neisseria gonorrhoeae
MKTHRKTCSAVCFAFQTASKPAVSIRHPSEDIMSLKTRLTEDMKTAMRAKDQVSLGTIRLINAAVKQFEVDERTEADDAKITAILTKMVKQRKDGAKIYTEAGRQDLADKENAEIDVLHRYLPQMLSAGEIRTAVEAAVAETGAAGMADMGKVMVVLKTRLAGKADMGEVNKILKTVLTA

SEQ ID NO: 75 - DNA, 497 bp, Neisseria meningitidis
atgaggacacaccgcaagacctgctctgcggtgtgttttgcttttcagacggcatcgaaacccgccgtttccatccgacatcccagcgaggacatcatgagcctgaaaatccgccttaccgaagacatgaaaaccgcgatgcgcgccaaagaccaagtttccctcggcaccatccgcctcatcaacgccgccgtcaaacagtttgaagtggacgaacgcaccgaagccgacgatgccaaaatcaccgccatcctgaccaaaatggtcaaacagcgaaaagacagcgcgaaaatctacactgaagccggccgtcaggatttggcagacaaagaaaacgccgaaatcgaggtactgcaccgctaccttccccaaatgctttccgccggcgaaatccgtaccgaggtcgaagctgccgttgccgaaaccggcgcggcaggtatggcggatatgggtaaagtcatggggctgctgaaaacccgcctcgcaggtaaagccga

SEQ ID NO: 76 - protein, 165 aa, Neisseria meningitidis
MRTHRKTCSAVCFAFQTASKPAVSIRHPSEDIMSLKIRLTEDMKTAMRAKDQVSLGTIRLINAAVKQFEVDERTEADDAKITAILTKMVKQRKDSAKIYTEAGRQDLADKENAEIEVLHRYLPQMLSAGEIRTEVEAAVAETGAAGMADMGKVMGLLKTRLAGKA

SEQ ID NO: 77 - DNA, 657 bp, Neisseria gonorrhoeae
atgctcgcccgtcgctattttttcaatatccaacccggggcggttttcactgacaaactgcttgaacaactgatgcgtttcctccagttcctgccggaatttctgtttgcccttttccgtattttcacccataaaagtaaccgtgcgcttaaattcgcccgccgtcatcacatccacatcaatatcatgttttttcaacaggcggtggatattcggcacttccgccaccacacccaccgaaccgatgaccgcaaacggagcggaaacaattttatccgccacacacgccatcatatagccgccgcttgccgcgaccttatcgacggcgacggtcagcggaatattgcgttcgcgcaaacgcctaagctgcgaagccgccaaaccgtaaccgtgaaccacgccgcccggactttccaatctgagcagaacctcatcttcaggcttggcaatcaaaagcaccgccgtaatctcatgacgcaaggattctacggcgtgtgcatacaaatcgccgtcaaaatccaacacaaaaaggcgggatttttgcgtttcggcagatttctccccgccctccttcaaacgctttttctctgctttggcttccgccttttcctttttcttttcttttttttcctgatgttttgtctcttcctcgcttaa

SEQ ID NO: 78 - protein, 218 aa, Neisseria gonorrhoeae
MLARRYFFNIQPGAVFTDKLLEQLMRFLQFLPEFLFALFRIFTHKSNRALKFARRHHIHINIMFFQQAVDIRHFRHHTHRTDDRKRSGNNFIRHTRHHIAAACRDLIDGDGQRNIAFAQTPKLRSRQTVTVNHAARTFQSEQNLIFRLGNQKHRRNLMTQGFYGVCIQIAVKIQHKKAGFLRFGRFLPALLQTLFLCFGFRLFLFLFFFFLMFCLFLA

SEQ ID NO: 79 - DNA, 657 bp, Neisseria meningitidis
  misc_feature (310)..(519): n is a, c, g, or t
  misc_feature (541)..(541): n is a, c, g, or t
atgctcgcccgttgccacttcctcaatatccaattgagggcggttctcgctgacaaactgcttgaacaactgatgcgtttcctccagttcctgtcggaatttctgtttgcccttttccgtattttcacccataaaagtaaccgtgcgcttaaattcgcccgccgtcatcacatccacatcaatatcatgttttttcaacaggcggtggatattcggtacttccgccaccacacccaccgaaccgacaatcgcaaacggagcggaagcaattttatccgccacacacgccatcatataaccgccgctcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacacaaaaaggcgtgatttntgcgtttcggcagatttctccccaccctccttcaaacgtttttcctctgctttggcttccgccttttcctttttcttttcctctttttcctgatgttgtgcctcttccccgcttaa

SEQ ID NO: 80 - protein, 217 aa, Neisseria meningitidis
  misc_feature (104)..(173): Xaa can be any naturally occurring amino acid
  misc_feature (180)..(180): Xaa can be any naturally occurring amino acid
MLARCHFLNIQLRAVLADKLLEQLMRFLQFLSEFLFALFRIFTHKSNRALKFARRHHIHINIMFFQQAVDIRYFRHHTHRTDNRKRSGSNFIRHTRHHITAARXXXXXXXXXXXXXXXXXXXXXXXXXXXXXXXXXXXXXXXXXXXXXXXXXXXXXXXXXXXXXXXXXXXXXXQHKKAFXRFGRFLPTLLQTFFLCFGFRLFLFLFLFFLMLCLFPA

SEQ ID NO: 81 - DNA, 657 bp, Neisseria meningitidis
atgctcgcccgttgccacttcctcaatatccaattgagggcggttctcgctgacaaactgcttgaacaactgatgcgtttcctccagttcctgtcggaatttctgtttgcccttttccgtattttcacccataaaagtaaccgtgcgcttaaattcgcccgccgtcatcacatccacatcaatatcatgttttttcaacaggcggtggatattcggtacttccgctacaacacccaccgaaccgacaatcgcaaacggagcggaaacaattttatccgccacacacgccatcatataaccaccgctcgccgccaccttatcgacggcgacggtcagcggaatattgcgttcgcgcaaacgcctaagctgcgaagccgccaaaccgtaaccgtgaaccacgccgcccggactttccaatctaagcagaacctcatcttcaggcttggcaatcaaaagcaccgccgtaatctcatgacgcaaggattctacggcgtgtgcatacaaatcgccgtcaaaatccaacacaaaaaggcgggatttttgcgtttcggaagatttctccccaccctccttcaaacgctttttctctgctttggcttccgccttttcctttttcttttcctctttttcctgatgttttgcctcttccccgcttaa

SEQ ID NO: 82 - protein, 218 aa, Neisseria meningitidis
MLARCHFLNIQLRAVLADKLLEQLMRFLQFLSEFLFALFRIFTHKSNRALKFARRHHIHINIMFFQQAVDIRYFRYNTHRTDNRKRSGNNFIRHTRHHITTARRHLIDGDGQRNIAFAQTPKLRSRQTVTVNHAARTFQSKQNLIFRLGNQKHRRNLMTQGFYGVCIQIAVKIQHKKAGFLRFGRFLPTLLQTLFLCFGFRLFLFLFLFFLMFCLFPA

SEQ ID NO: 83 - DNA, 657 bp, Neisseria meningitidis
atgctcgcccgttgccacttcctcaatatccaattgagggcggttctcgctgacaaactgcttgaacaactgatgcgtttcctccagttcctgtcggaatttctgtttgcccttttccgtattttcacccataaaagtaaccgtgcgcttaaattcgcccgccgtcatcacatccacatcaatatcatgttttttcaacaggcggtggatattcggtacttccgccaccacacccaccgaaccgacaatcgcaaacggagcggaagcaattttatccgccacacacgccatcatataaccgccgctcgccgccaccttatcgacggcgacggtcagcggaatattgcgttcgcgcaaacgcytaagctgcgaagccgccaaaccgtaaccgtgaaccacgccgcccggactttccaatctgagcagaacctcatcttcaggcttggcaatcaaaagcaccgccgtaatctcatgacgcaaggattctacggcgtgtgcatacaaatcgccgtcaaaatccaacacaaaaaggcgggatttttgcgtttcggcagatttctccccaccctccttcaaacgctttttctctgctttggcttccgccttttcctttttcttttcctctttttcctgatgttttgcctcttccccgcttaa

SEQ ID NO: 84 - protein, 218 aa, Neisseria meningitidis
  misc_feature (121)..(121): Xaa can be any naturally occurring amino acid
MLARCHFLNIQLRAVLADKLLEQLMRFLQFLSEFLFALFRIFTHKSNRALKFARRHHIHINIMFFQQAVDIRYFRHHTHRTDNRKRSGSNFIRHTRHHITAARRHLIDGDGQRNIAFAQTXKLRSRQTVTVNHAARTFQSEQNLIFRLGNQKHRRNLMTQGFYGVCIQIAVKIQHKKAGFLRFGRFLPTLLQTLFLCFGFRLFLFLFLFFLMFCLFPA

SEQ ID NO: 85 - DNA, 657 bp, Neisseria meningitidis; identical to SEQ ID NO: 81

SEQ ID NO: 86 - protein, 218 aa, Neisseria meningitidis; identical to SEQ ID NO: 82

SEQ ID NO: 87 - DNA, 318 bp, Neisseria gonorrhoeae
atgcctttgaccatgctgtgcagcaggacgtgcggtttgttcataatacagtccgaccggaaaagcggaggaaacgcagtgccgcgcccttcccctttcttgccgtggcaggcgatgcagttggattcgtacactttttgcccttttgtcatgatgctgttgtcggcggcagaagcggcggcgcagaggcagcacaagatgaaggcggtcggcagtcgggttgtgttcattggcgtttcccctaatgttttgaaaccttgttttttgattttgcctttacggggtgaaaagtttttttggcccaaatccggaatttag

SEQ ID NO: 88 - protein, 105 aa, Neisseria gonorrhoeae
MPLTMLCSRTCGLFIIQSDRKSGGNAVPRPSPFLPWQAMQLDSYTFCPFVMMLLSAAEAAAQRQHKMKAVGSRVVFIGVSPNVLKPCFLILPLRGEKFFWPKSGI

SEQ ID NO: 89 - DNA, 306 bp, Neisseria meningitidis
atgcctttgaccatgctgtgcagcagcacctgcggttttttcatgatgaagtcggagcggtagagcggcggaaacatggttccgcggccttcgccctttttgccgtggcaggcgacgcagttggattcgtacactttttgcccttttgtcatgatgctgttgtcggcggcagaagcggcggcgcagaagcagcccaagacgagggcggtcggcagtcgggttgtgttcattggtgtttccttcatgtttgaaaccttgttgttgattttgcgtagcgggtgaaagatttttttgccgaatcagtag

SEQ ID NO: 90 - protein, 101 aa, Neisseria meningitidis
  misc_feature (21)..(21): Xaa can be any naturally occurring amino acid
  misc_feature (94)..(94): Xaa can be any naturally occurring amino acid
MPLTMLCSSTCGFFMMKSERXSGGNMVPRPSPFLPWQATQLDSYTFCPFVMMLLSAAEAAAQKQPKTRAVGSRVVFIGVSFMFETLLLILRSGXKIFLPNQ

SEQ ID NO: 91 - DNA, 306 bp, Neisseria meningitidis
atgcctttgaccatgctgtgcagcagcacctgcggttttttcatgatgaagtcggagcggtagagcggcggaaacatggttccgcggccttcgccctttttgccgtggcaggcgacgcagttggattcgtacactttttgcccttttgtcatgatgctgttgtcggcggcagaagcggcggcgcagaggcagcccaagacgagggcggtcggcagtcgggttgtgttcattggtgtttccttaatgtttgaaaccttgttgttgattttgcgtagcgggtgaaagattttcttgccgaatcggtag

SEQ ID NO: 92 - protein, 99 aa, Neisseria meningitidis
MPLTMLCSSTCGFFMMKSERSGGNMVPRPSPFLPWQATQLDSYTFCPFVMMLLSAAEAAAQRQPKTRAVGSRVVFIGVSLMFETLLLILRSGKIFLPNR

SEQ ID NO: 93 - DNA, 375 bp, Neisseria gonorrhoeae
atgcagtatctgattgtcaaatacagccatcaaatcttcgttaccatcaccattttggtattcaacatccgttttttcctactttggaaaaatccagaaaagcccttggtcggcttttggaaagcactgccccacctcaacgacacgatgctgctgtttacgggattgtggctgatgaagattacccatttctccccgttcaacgcgccttggctcggcacaaaaatcctgctcctgttcgcctacatcgcactgggcatggtaatgatgcgcgcccgtccgcgttcgaccaagttctacaccgtttacctgctcgctatgtgttgcatcgcctgcatcgtttaccttgccaaaaccaaagtcctgccattctga

SEQ ID NO: 94 - protein, 124 aa, Neisseria gonorrhoeae
MQYLIVKYSHQIFVTITILVFNIRFFLLWKNPEKPLVGFWKALPHLNDTMLLFTGLWLMKITHFSPFNAPWLGTKILLLFAYIALGMVMMRARPRSTKFYTVYLLAMCCIACIVYLAKTKVLPF

SEQ ID NO: 95 - DNA, 285 bp, Neisseria meningitidis
aaaatcagaaaagccttggcgggcttttggaaggcactgccccaccttaacgacaccatgctgctgtttacgggattgtggctgatgaaaattacccatttctccccgttcaacgcgccttggctcggtacaaaaatcctgcttctgctcgcctatatcgcattgggtatgatgatgatgcgcgcccgtccgcgttcgaccaagttctacaccgtttacctgctcgccatgtgttgcgtcgcctgcatcgtttaccttgccaaaaccaaagtcctgcctttctga

SEQ ID NO: 96 - protein, 94 aa, Neisseria meningitidis
KIRKALAGFWKALPHLNDTMLLFTGLWLMKITHFSPFNAPWLGTKILLLLAYIALGMMMMRARPRSTKFYTVYLLAMCCVACIVYLAKTKVLPF

SEQ ID NO: 97 - DNA, 375 bp, Neisseria meningitidis
  misc_feature (79)..(79): n is a, c, g, or t
atgcagtatctgattgtcaaatacagccatcaaatcttcgttaccatcaccattttggtattcaacatccgtgttttcntactttggaaaaatccagaaaagcccttggcgggcttttggaaggcactgccccaccttaacgacaccatgctgctgtttacgggattgtggctgatgaaaattacccatttctccccgttcaacgcgccttggctcggtacaaaaatcctgcttctgctcgcctatatcgcattgggtatgatgatgatgcgcgcccgtccgcgttcgaccaagttctacaccgtttacctgctcgccatgtgttgcctcacctgcatcgtttaccttgccaaaaccaaagtcctgcctttctga

SEQ ID NO: 98 - protein, 124 aa, Neisseria meningitidis
  misc_feature (27)..(27): Xaa can be any naturally occurring amino acid
MQYLIVKYSHQIFVTITILVFNIRVFXLWKNPEKPLAGFWKALPHLNDTMLLFTGLWLMKITHFSPFNAPWLGTKILLLLAYIALGMMMMRARPRSTKFYTVYLLAMCCLTCIVYLAKTKVLPF

SEQ ID NO: 99 - DNA, 312 bp, Neisseria gonorrhoeae
atgcagcaggggcagttggttggacgcgtcgcccgcaataaagatatgcggaatgctggtctgcatggtcagcggatcggcaacgggtacgccgcgcgcgtctttgtcgatattgatgttttccaaaccgatattgtcaacgttcggacggcgacctacggctgccaacatatattcggcaacaaatacgcctttttcgccatcctgctcccaatggacttctacattgccgtctgcgtcgagtttgacctcggttttagcatccagatgcagtttcaattcttctccgaacacggctttcgcctcgtctga

SEQ ID NO: 100 - protein, 103 aa, Neisseria gonorrhoeae
MQQGQLVGRVARNKDMRNAGLHGQRIGNGYAARVFVDIDVFQTDIVNVRTATYGCQHIFGNKYAFFAILLPMDFYIAVCVEFDLGFSIQMQFQFFSEHGFRLV

SEQ ID NO: 101 - DNA, 312 bp, Neisseria meningitidis
atgcagcagaggcagttggttggacgcatcgcctgcgatgaagatatgcggaatactggtctgcatggtcagcgggtcggcaacaggtacgccgcgcgcatctttttcgatattgatattttccaaaccgatattgtcaacgttcggacggcggcccacggctgccagcatatattcggcaacaaatacgcctttttcgccatcctgctcccaatggacttctacattgccgtctgcatcgagtttgacctcggttttagcatccagatgcagtttcaattcttcgccgaacacggcgttcgcctcgtctga

SEQ ID NO: 102 - protein, 103 aa, Neisseria meningitidis
MQQRQLVGRIACDEDMRNTGLHGQRVGNRYAARIFFDIDIFQTDIVNVRTAAHGCQHIFGNKYAFFAILLPMDFYIAVCIEFDLGFSIQMQFQFFAEHGVRLV

SEQ ID NO: 103 - DNA, 312 bp, Neisseria meningitidis
atgcagcaggggcagttggttggacgcgtcgcccgcaataaagatatgcggaatactggtctgcatagtcagcggatcggcaacgggtacgccgcgcgcatctttttcgatattgatgttttccaaaccgatattgtcaacgttcggacggcggcctacggctgccagcatatattcggcaacaaatacgcctttttcgccatcctgctcccaatggacttctacattgccgtctgcgtcgagtttggcctcggttttagcatccaaatgcagtttcaattcttcaccgaacacggctttcgcctcgtctga

SEQ ID NO: 104 - protein, 103 aa, Neisseria meningitidis
MQQGQLVGRVARNKDMRNTGLHSQRIGNGYAARIFFDIDVFQTDIVNVRTAAYGCQHIFGNKYAFFAILLPMDFYIAVCVEFGLGFSIQMQFQFFTEHGFRLV

SEQ ID NO: 105 - DNA, 268 bp, Neisseria gonorrhoeae
ctgctggcggccctggtgcttgccgcgtgttcttcgacaaacacactgccagccggcaagaccccggcagacaatatagaaactgccgacctttcggcaagcgttcccacccgccctgccgaaccggaaggaaaaacgctggcagattacggcggctacccgtccgcactggatgcagtgaaacagaacaacgatgcggcagccgccgcctatttggaaaacgcaggagacagcgcgatggcggaaaatgtccgcaaggagtggctga

SEQ ID NO: 106 - protein, 89 aa, Neisseria gonorrhoeae
LLAALVLAACSSTNTLPAGKTPADNIETADLSASVPTRPAEPEGKTLADYGGYPSALDAVKQNNDAAAAAYLENAGDSAMAENVRKEWL

SEQ ID NO: 107 - DNA, 1572 bp, Neisseria meningitidis
atgtacctaccctctatgaagcattccctgccgctgctggcggccctggtgcttgccgcgtgttcttcgacaaacacactgccagccggcaagaccccggcagacaatatagaaactgccgacctttcggcaagcgttcccacccgccctgccgaacccgaaagaaaaacgctggcagattacggcggctacccgtccgcactggatgcagtgaaacagaaaaacgatgccgccgtcgccgcctatttggaaaacgccggcgacagcgcgatggcggaaaatgtccgcaacgagtggctgaagtctttgggcgcacgcagacagtggacgctgtttgcacaggaatacgccaaactcgaaccggcagggcgcgcccaagaagtcgaatgctacgccgattcgagccgcaacgactatacgcgtgccgctgaactggtcaaaaatacgggcaaactgccttcgggctgcaccaaactgttggaacaggcagccgcatccggcttgttggacggcaacgacgcctggaggcgcgtgcgcggactgctggccggccgccaaaccacagacgcacgcaaccttgccgccgcattgggcagcccgtttgacggcggtacacaaggttcgcgcgaatatgccctgttgaacgtcatcggcaaagaagcacgcaaatcgccgaatgccgccgccctgctgtccgaaatggaaagcggtttaagcctcgaacaacgcagtttcgcgtggggcgtattggggcattatcagtcgcaaaacctcaatgtgcctgccgccttggactattacggcaaggttgccgaccgccgccaactgaccgacgaccaaatcgagtggtacgcccgcgccgccttgcgcgcccgacgttgggacgagctggcctccgttatctcgcatatgcccgaaaaactgcaaaaaagcccgacctggctctactggctggcacgcagccgcgccgcaacgggcaacacgcaagaggcggaaaaactttacaaacaggcggcagcgacgggcaggaatttttatgcggtgctggcaggggaagaattgggtcggaaaatcgatacgcgcaacaatgtgcccgatgccggcaaaaacagcgtccgccgcatggcggaagacggtgcagtcaaacgcgcactggtactgttccaaaacagccaatctgccggtgatgcaaaaatgcgccgtcaggctcaggcggaatggcgttttgccacacgcggctttgacgaagacaagctgctgaccgccgcgcaaaccgcgttcgaccacggtttttacgatatggcggtcaacagcgcggaacgcaccgaccgcaaactcaactacaccttgcgctatatttcgccgtttaaagacacggtaatccgccacgcgcaaaatgttaatgtcgatccggcttgggtttatgggctgattcgtcaggaaagccgcttcgttataggcgcgcaatcccgcgtaggcgcgcaggggctgatgcaggttatgcctgccaccgcgcgcgaaatcgccggcaaaatcggtatggatgccgcacaactttacaccgccgacggg

SEQ ID NO: 108 - protein, 524 aa, Neisseria meningitidis
MYLPSMKHSLPLLAALVLAACSSTNTLPAGKTPADNIETADLSASVPTRPAEPERKTLADYGGYPSALDAVKQKNDAAVAAYLENAGDSAMAENVRNEWLKSLGARRQWTLFAQEYAKLEPAGRAQEVECYADSSRNDYTRAAELVKNTGKLPSGCTKLLEQAAASGLLDGNDAWRRVRGLLAGRQTTDARNLAAALGSPFDGGTQGSREYALLNVIGKEARKSPNAAALLSEMESGLSLEQRSFAWGVLGHYQSQNLNVPAALDYYGKVADRRQLTDDQIEWYARAALRARRWDELASVISHMPEKLQKSPTWLYWLARSRAATGNTQEAEKLYKQAAATGRNFYAVLAGEELGRKIDTRNNVPDAGKNSVRRMAEDGAVKRALVLFQNSQSAGDAKMRRQAQAEWRFATRGFDEDKLLTAAQTAFDHGFYDMAVNSAERTDRKLNYTLRYISPFKDTVIRHAQNVNVDPAWVYGLIRQESRFVIGAQSRVGAQGLMQVMPATAREIAGKIGMDAAQLYTADG

SEQ ID NO: 109 - DNA, 1851 bp, Neisseria meningitidis
  misc_feature (44)..(44): n is a, c, g, or t
  misc_feature (68)..(68): n is a, c, g, or t
  misc_feature (145)..(145): n is a, c, g, or t
  misc_feature (163)..(163): n is a, c, g, or t
  misc_feature (173)..(173): n is a, c, g, or t
  misc_feature (335)..(335): n is a, c, g, or t
  misc_feature (342)..(342): n is a, c, g, or t
  misc_feature (351)..(351): n is a, c, g, or t
  misc_feature (367)..(367): n is a, c, g, or t
  misc_feature (801)..(801): n is a, c, g, or t
  misc_feature (864)..(865): n is a, c, g, or t
  misc_feature (867)..(868): n is a, c, g, or t
  misc_feature (871)..(873): n is a, c, g, or t
  misc_feature (876)..(877): n is a, c, g, or t
  misc_feature (881)..(881): n is a, c, g, or t
  misc_feature (883)..(883): n is a, c, g, or t
  misc_feature (885)..(885): n is a, c, g, or t
  misc_feature (888)..(889): n is a, c, g, or t
  misc_feature (894)..(895): n is a, c, g, or t
  misc_feature (899)..(900): n is a, c, g, or t
  misc_feature (902)..(902): n is a, c, g, or t
  misc_feature (904)..(904): n is a, c, g, or t
  misc_feature (907)..(910): n is a, c, g, or t
  misc_feature (914)..(915): n is a, c, g, or t
  misc_feature (918)..(918): n is a, c, g, or t
  misc_feature (923)..(928): n is a, c, g, or t
  misc_feature (930)..(930): n is a, c, g, or t
  misc_feature (933)..(933): n is a, c, g, or t
  misc_feature (935)..(936): n is a, c, g, or t
  misc_feature (938)..(939): n is a, c, g, or t
  misc_feature (941)..(941): n is a, c, g, or t
  misc_feature (943)..(943): n is a, c, g, or t
  misc_feature (945)..(946): n is a, c, g, or t
  misc_feature (948)..(948): n is a, c, g, or t
  misc_feature (951)..(952): n is a, c, g, or t
  misc_feature (972)..(972): n is a, c, g, or t
  misc_feature (988)..(988): n is a, c, g, or t
  misc_feature (990)..(990): n is a, c, g, or t
  misc_feature (996)..(996): n is a, c, g, or t
  misc_feature (1002)..(1002): n is a, c, g, or t
  misc_feature (1021)..(1021): n is a, c, g, or t
  misc_feature (1028)..(1028): n is a, c, g, or t
  misc_feature (1041)..(1041): n is a, c, g, or t
  misc_feature (1048)..(1048): n is a, c, g, or t
  misc_feature (1050)..(1050): n is a, c, g, or t
  misc_feature (1070)..(1070): n is a, c, g, or t
  misc_feature (1109)..(1109): n is a, c, g, or t
  misc_feature (1205)..(1205): n is a, c, g, or t
  misc_feature (1363)..(1367): n is a, c, g, or t
  misc_feature (1369)..(1369): n is a, c, g, or t
  misc_feature (1371)..(1371): n is a, c, g, or t
atgtacccaccctctctgaagcattccctgccgctgctggtggncctggtgcttgccgcgtgttcttngacaaacacactgtcagccgacaagaccccggcagacaatatagaaactgccgacctttcggcaagcgttcccaccngccctgccgaacccgaangaaaaacgtnggcagattacggcggctacccgtccgcactggatgcagtgaaacagaaaaacgatgccgccgtcgccgcctatttggaaaacgccggcgacagcgcgatggcggaaaatgtccgcaacgagtggctgaagtctttgggcgcgcgcagacagtggacgctgtntgcacangaatatgcnaaactcgaaccggcanggcgcgcccaagaagtcgaatgctacgccgattcgagccgcaacgactatacgcgtgccgccgaactggtcaaaaatacgggcaaactgccttcgggctgcaccaaactgttggaacaggcagccgcatccggcttgttggacggcaacgacgcctggaggcgcgtgcgcggactgctggccggccgccaaaccacagacgcacgcaaccttgccgccgcattgggcagcccgtttgacggcggtacacaaggttcgcgcgaatatgccctgttgaacgtcatcggcaaagaagcacgcaaatcgccgaatgccgccgccctgctgtccgaaatggaaagcggtttaagcctcgaacaacgcagtttcgcgtggggcgtattggggcattatcagtcgcaaaacctcaatgtgcctgccgccttggactattanggcaaggttgccgaccgccgccaactgaccgacgaccaaatcgagtggtacgcccgcgccgcnntnngcnnncgnngttngnanganntggcnnccgnnancncgnnnntgcnnganaaacnnnnnnanagncnnanntngntnnantgnntggcacgcagccgcgccgcnacgggcaacacgcaanangcgganaaactntacaaacaggcggcagcancgggcangaatttttatgcngtgctgncnggggaagagttggggcgcanaatcgatacgcgcaacaatgtgcccgatgccggcaaaancagcgtcctccgtatggcggaagacggcgcgattaagcgcgcgctggtgctgttccgaaacagccgaaccgccggcgatgcgaaaatgcgccgtcnggctcaggcggaatggcgtttcgccacacgcggcttcgatgaagacaagctgctgaccgccgcgcaaaccgcgttcgaccacggtttttacgatatggcggtcaacagcgcggaacgcaccgaccgcaaactcaactacaccttgcgctacatttcgnnnnntnangacacggtaatccgccacgcgcaaaatgttaatgtcgatccggcgtgggtttacgggctgattcgtcaggaaagccgcttcgttatgggcgcgcaatcccgcgtaggcgcgcaggggctgatgcaggttatgcctgccaccgcgcgcgaaatcgccggcaaaatcggtatggatgccgcacaactttacaccgccgacggcaatatccgtatggggacgtggtatatggcggacaccaaacgccgcctgcaaaacaacgaagtcctcgccaccgcaggctataacgccggtcccggcagggcgcgccgatggcaggcggacacgcccctcgaaggcgcggtatatgccgaaaccatcccgttttccgaaacgcgcgactatgtcaaaaaagtgatggccaatgccgcctactacgcctccctcttcggcgcgccgcacatcccgctcaaacagcgtatgggcattgtccccgcccgctga

SEQ ID NO: 110 - protein, 616 aa, Neisseria meningitidis
  misc_feature (15)..(15): Xaa can be any naturally occurring amino acid
  misc_feature (23)..(23): Xaa can be any naturally occurring amino acid
  misc_feature (49)..(49): Xaa can be any naturally occurring amino acid
  misc_feature (55)..(55): Xaa can be any naturally occurring amino acid
  misc_feature (58)..(58): Xaa can be any naturally occurring amino acid
  misc_feature (112)..(112): Xaa can be any naturally occurring amino acid
  misc_feature (114)..(114): Xaa can be any naturally occurring amino acid
  misc_feature (123)..(123): Xaa can be any naturally occurring amino acid
  misc_feature (267)..(267): Xaa can be any naturally occurring amino acid
  misc_feature (289)..(291): Xaa can be any naturally occurring amino acid
  misc_feature (293)..(297): Xaa can be any naturally occurring amino acid
  misc_feature (299)..(306): Xaa can be any naturally occurring amino acid
  misc_feature (308)..(318): Xaa can be any naturally occurring amino acid
  misc_feature (330)..(330): Xaa can be any naturally occurring amino acid
  misc_feature (332)..(332): Xaa can be any naturally occurring amino acid
  misc_feature (341)..(341): Xaa can be any naturally occurring amino acid
  misc_feature (343)..(343): Xaa can be any naturally occurring amino acid
  misc_feature (350)..(350): Xaa can be any naturally occurring amino acid
  misc_feature (357)..(357): Xaa can be any naturally occurring amino acid
  misc_feature (370)..(370): Xaa can be any naturally occurring amino acid
  misc_feature (402)..(402): Xaa can be any naturally occurring amino acid
  misc_feature (455)..(457): Xaa can be any naturally occurring amino acid
MYPPSLKHSLPLLVXLVLAACSXTNTLSADKTPADNIETADLSASVPTXPAEPEXKTXADYGGYPSALDAVKQKNDAAVAAYLENAGDSAMAENVRNEWLKSLGARRQWTLXAXEYAKLEPAXRAQEVECYADSSRNDYTRAAELVKNTGKLPSGCTKLLEQAAASGLLDGNDAWRRVRGLLAGRQTTDARNLAAALGSPFDGGTQGSREYALLNVIGKEARKSPNAAALLSEMESGLSLEQRSFAWGVLGHYQSQNLNVPAALDYXGKVADRRQLTDDQIEWYARAAXXXRXXXXXAXXXXXXXXKXXXXXXXXXXXARSRAATGNTQXAXKLYKQAAAXGXNFYAVLXGEELGRXIDTRNNVPDAGKXSVLRMAEDGAIKRALVLFRNSRTAGDAKMRRXAQAEWRFATRGFDEDKLLTAAQTAFDHGFYDMAVNSAERTDRKLNYTLRYISXXXDTVIRHAQNVNVDPAWVYGLIRQESRFVMGAQSRVGAQGLMQVMPATAREIAGKIGMDAAQLYTADGNIRMGTWYMADTKRRLQNNEVLATAGYNAGPGRARRWQADTPLEGAVYAETIPFSETRDYVKKVMANAAYYASLFGAPHIPLKQRMGIVPAR

SEQ ID NO: 111 - DNA, 342 bp, Neisseria gonorrhoeae
atggtagaacgtaaattgaccggtgcccattacggtttgcgcgattgggtaatgcagcgtgcgactgcggttattatgttgatttataccgttgcacttttagtggttctatttgccctgcctaaagaatatccggcatggcaggcattttttagtcaagcttgggtaaaagtatttacccaagtgagctttatcgccgtattcttgcacgcttgggtgggtatccgcgatttgtggatggactatatcaaacccttcggcgtgcgtttgtttttgcaggttgccaccattgtctggctggtcggctgcctcgtgtattcagttaaagtgatttgggggtaa

SEQ ID NO: 112 - protein, 113 aa, Neisseria gonorrhoeae
MVERKLTGAHYGLRDWVMQRATAVIMLIYTVALLVVLFALPKEYPAWQAFFSQAWVKVFTQVSFIAVFLHAWVGIRDLWMDYIKPFGVRLFLQVATIVWLVGCLVYSVKVIWG

SEQ ID NO: 113 - DNA, 342 bp, Neisseria meningitidis
atggtagaacgtaaattgaccggtgcccattacggtttgcgcgattgggtgatgcaacgtgcgactgcggttattatgttgatttataccgttgcacttttagtggttctattttccctgcctaaagaatattcggcatggcaggcattttttagtcaaacttgggtaaaagtatttacccaagtgagcttcatcgccgtattcttgcacgcttgggtgggtatccgcgatttgtggatggactatatcaaacccttcggcgtgcgtttgtttttgcaggttgccaccatcgtttggctggtcggctgtctcgtgtattcagttaaagtgatttgggggtaa

SEQ ID NO: 114 - protein, 113 aa, Neisseria meningitidis
MVERKLTGAHYGLRDWVMQRATAVIMLIYTVALLVVLFSLPKEYSAWQAFFSQTWVKVFTQVSFIAVFLHAWVGIRDLWMDYIKPFGVRLFLQVATIVWLVGCLVYSVKVIWG

SEQ ID NO: 115 - DNA, 342 bp, Neisseria meningitidis
  misc_feature (249)..(249): n is a, c, g, or t
atggtagaacgtaaattgaccggtgcccattacggtttgcgggattgggcgatgcaacgtgcgaccgcggttattatgttgatttataccgttgcacttttagtggttctatttgctctgcctaaagaatattcggcatggcaggcattttttagtcaaacttgggtaaaagtatttacccaagtgagcttcatcgccgtattcttgcacgcttgggtgggtatccgcgatttgtggatggactatatnaaacccttcggcgtgcgtttgtttttgcaggttgccaccatcgtctggctggtcggctgcttggtgtattcaattaaagtaatttgggggtaa

SEQ ID NO: 116 - protein, 113 aa, Neisseria meningitidis
  misc_feature (83)..(83): Xaa can be any naturally occurring amino acid
MVERKLTGAHYGLRDWAMQRATAVIMLIYTVALLVVLFALPKEYSAWQAFFSQTWVKVFTQVSFIAVFLHAWVGIRDLWMDYXKPFGVRLFLQVATIVWLVGCLVYSIKVIWG

SEQ ID NO: 117 - DNA, 1014 bp, Neisseria meningitidis
atgttgaaacaaacgacacttttggcagcttgtaccgccgttgccgctctgttgggcggttgcgccacccaacagcctgctcctgtcattgcaggcaattcaggtatgcagaccgtatcgtctgcgccggtttacaatccttatggcgcaacgccgtacaatgccgctcctgccgccaacgatgcgccgtatgtgccgcccgtgcaaactgcgccggtttattcgcctcctgcttatgttccgccgtctgcacctgccgtttcgggtacatatgttccttcttacgcacccgtcgacatcaacgcggcgacgcatactattgtgcgtggcgacacggtgtacaacatttccaaacgctaccatatctctcaagacgatttccgtgcgtggaacggcatgaccgacaatacgttgagcatcggtcagattgttaaagtcaaaccggcaggatatgccgcaccgaaaaccgcagccgtagaaagcaggcccgccgtaccggctgccgcgcaaacccctgtgaaacccgccgcgcaaccgcccgttcagtccgcgccgcaacctgccgcgcccgctgcggaaaataaagcggttcccgcccccgcgcccgccccgcaatctcctgccgcttcgccttccggcacgcgttcggtcggcggcattgtttggcagcgtccgacccaaggtaaagtggttgccgatttcggcggcggcaacaagggtgtcgatattgccggcaatgccggacaacccgttttggcggcggctgacggcaaagtggtttatgccggttcaggtttgaggggatacggaaacttggtcatcatccagcacaattcctctttcctgaccgcgtacgggcacaaccaaaaattgctggtcggcgaaggtcagcaggtcaaacgcggtcagcaggttgctttgatgggtaataccgatgcttccagaacgcagcttcatttcgaggtgcgtcaaaacggcaaaccggttaacccgaacagctatatcgcgttctga

SEQ ID NO: 118 - protein, 337 aa, Neisseria meningitidis
MLKQTTLLAACTAVAALLGGCATQQPAPVIAGNSGMQTVSSAPVYNPYGATPYNAAPAANDAPYVPPVQTAPVYSPPAYVPPSAPAVSGTYVPSYAPVDINAATHTIVRGDTVYNISKRYHISQDDFRAWNGMTDNTLSIGQIVKVKPAGYAAPKTAAVESRPAVPAAAQTPVKPAAQPPVQSAPQPAAPAAENKAVPAPAPAPQSPAASPSGTRSVGGIVWQRPTQGKVVADFGGGNKGVDIAGNAGQPVLAAADGKVVYAGSGLRGYGNLVIIQHNSSFLTAYGHNQKLLVGEGQQVKRGQQVALMGNTDASRTQLHFEVRQNGKPVNPNSYIAF

SEQ ID NO: 119 - DNA, 1056 bp, Neisseria gonorrhoeae
gtgccgccggtgcaaagcgcgccggtttatacgcctcctgcttatgttccgccgtctgcacctgccgtttcgggtacatacgttccttcttacgcacccgtcgacatcaacgcggcgacgcatactattgtgcgcggcgacacggtgtacaacatttccaaacgctaccatatctctcaagacgatttccgtgcgtggaacggcatgaccgacaatacgttgagcatcggtcagattgttaaagtcaaaccggcaggatatgccgcaccgaaagccgcagccgtaaaaagcaggcccgccgtaccggctgccgcgcaaccgcccgtacagtccgcacccgtcgacattaacgcggcgacgcatactattgtgcgcggcgacacggtgtacaacatttccaaacgctaccatatctctcaagacgatttccgtgcgtggaacggcatgaccgacaatatgttgagcatcggtcagattgttaaagtcaaaccggcaggatatgccgcaccgaaaaccgcagccgtagaaagcaggcccgccgtaccggctgccgtgcaaacccctgtgaaacccgccgcgcaaccgcctgtgcagtccgcgccgcaacctgccgcgcccgctgcggaaaataaagcggttcccgcgcccgccccgcaatctcctgccgcttcgccttccggcacgcgttcggtcggcggcattgtttggcagcgtccgacgcaaggtaaagtggttgccgatttcggcggcaacaacaagggtgtcgatattgccggtaatgcgggacagcccgttttggcggcggctgacggcaaagtggtttatgccggttcaggtttgaggggatacggaaacttggtcatcatccagcataattcttctttcctgaccgcatacgggcacaaccaaaaattgctggtcggcgaggggcagcaggtcaaacgcggtcagcaggttgctttgatgggcaataccgatgcttccagaacgcagcttcatttcgaggtgcgtcaaaacggcaaaccggttaacccgaacagctatatcgcgttctga

SEQ ID NO: 120 - protein, 509 aa, Neisseria meningitidis
MAAADKQLGSDRRSVAIIGDGAMTAGQAFEALNCAGDMDVDLLVVLNDNEMSISPNVGALPKYLASNVVRDMHGLLSTVKAQTGKVLDKIPGAMEFAQKVEHKIKTLAEEAEHAKQSLSLFENFGFRYTGPVDGHNVENLVDVLEDLRGRKGPQLLHVITKKGNGYKLAENDPVKYHAVANLPKESAAQMPSEKEPKPAAKPTYTQVFGKWLCDRAAADSRLVAITPAMREGSGLVEFEQRFPDRYFDVGIAEQHAVTFAGGLACEGMKPVVAIYSTFLQRAYDQLVHDIALQNLPVLFAVDRAGIVGADGPTHAGLYDLSFLRCIPNMIVAAPSDENECRLLLSTCYQADAPAAVRYPRGTGTGVPVSDGMETVEIGKGIIRREGEKTAFIAFGSMVAPALAVAGKLNATVADMRFVKPIDEELIVRLARSHDRIVTLEENAEQGGAGSAVLEVLAKHGICKPVLLLGVADTVTGHGDPKKLLDDLGLSAEAVERRVRAWLSDRDAAN

SEQ ID NO: 121 - DNA, 1140 bp, Neisseria gonorrhoeae
atgagccgtttatggttttttgccgtaaaaaacattataatccgccttatttacctattgcccaaggagacacaaatggcactcgtatccatgcgccaactgcttgaccacgccgccgaaaacagctacggcctgcccgcgttcaacgtcaacaacctcgaacaaatgcgcgccattatggaagccgccgaccaagtcaacgcgcccgtcatcgtacaggcgagcgcaggtgcgcgcaaatacgcgggcgcgccgtttttgcgccacctgattctggcggcagtcgaagaatttccgcacatccccgtcgtgatgcaccaagaccacggcgcatcgcccgacgtgtgccaacgctccatccaactgggcttctcctccgtgatgatggacggctctttgctcgaagacggcaaaaccccttcttcttacgaatacaacgtcaacgccacccgtaccgtcgtcaacttctcccacgcctgcggcgtgtccgtcgaaggcgaaatcggcgtattgggcaacctcgaaaccggcgaagcaggcgaagaagacggagtgggcgcggcaggcaaactctcacacgaccaaatgctcaccagcgttgaagatgccgtgcgtttcgttaaagataccggcgttgacgcattggcgattgccgtcggcaccagccacggcgcatacaaattcacccgtccgcccacaggcgacgtattgcgtatcgaccgcatcaaggaaatccaccaagccctgcccaatacacacatcgtgatgcacggctccagctccgttccgcaagaatggctgaaagtcatcaacgaatacggcggcaatatcggcgaaacctacggcgtgccggttgaagaaatcgtcgaaggcatcaaacacggcgtgcgcaaagtcaacatcgataccgacctgcgcctcgcttccaccggcgcggtacgccgctaccttgccgaaaacccgtccgactttgatccgcgcaaatacttgggcaaaaccattgaagcgatgaagcaaatctgcctcgaccgttatcttgcgttcggttgcgaaggtcaggcaggcaaaatcaaacctgtttcgttggaaaaaatggcaagccgttatgccaagggcgaattgaaccaaatcgtcaaataa

SEQ ID NO: 122 - protein, 379 aa, Neisseria gonorrhoeae
MSRLWFFAVKNIIIRLIYLLPKETQMALVSMRQLLDHAAENSYGLPAFNVNNLEQMRAIMEAADQVNAPVIVQASAGARKYAGAPFLRHLILAAVEEFPHIPVVMHQDHGASPDVCQRSIQLGFSSVMMDGSLLEDGKTPSSYEYNVNATRTVVNFSHACGVSVEGEIGVLGNLETGEAGEEDGVGAAGKLSHDQMLTSVEDAVRFVKDTGVDALAIAVGTSHGAYKFTRPPTGDVLRIDRIKEIHQALPNTHIVMHGSSSVPQEWLKVINEYGGNIGETYGVPVEEIVEGIKHGVRKVNIDTDLRLASTGAVRRYLAENPSDFDPRKYLGKTIEAMKQICLDRYLAFGCEGQAGKIKPVSLEKMASRYAKGELNQIVK

SEQ ID NO: 123 - DNA, 771 bp, Neisseria meningitidis
atgagctgtttatggttttttgctgtaaaaaacattataatccgccttatttacctattgcccaaggagacacaaatggcactcgtatccatgcgccaactgcttgatcatgctgccgaawacagctacggcytgccggcgttcaacgtcaacaacctcgwacagatgcgcgccatcatggaggctgcagaccaagtcgacgcccccgtcatcgtacaggcgagtgccggtgcgcgcaaatatgcgggtgcgccgtttttacgccacctgattttggcggctgtcgaagtatttccacacatccccgtcgtcatgcaccaagaccacggcgcatcacccgacgtgtgccaacgctccatccaactgggcttctcctctgtaatgatggacggctcgctgatggaagacggcaaaaccccttcttcttacgaatacaacgtcaacgccacacgtaccgtggttaacttctcccacgcttgcggcgtatccgttgaaggcgaaatcggcgtattgggcaacctcgaaaccggcgatgcaggcgaagaagacggtgtaggcgcagtgggcaaactttcccacgaccaaatgctgaccagcgtcgaagatgccgtatgtttcgttaaagataccggcgttgacgcattggctattgccgtcggcaccagccacggcgcatacaaattcacccgtccgcccacaggcgatgtattacgtatcgaccgcatcaaagaaatccaccaagccctgcccaatacacacatcgtgatgcac

SEQ ID NO: 124 - protein, 257 aa, Neisseria meningitidis
  misc_feature (41)..(41): Xaa can be any naturally occurring amino acid
  misc_feature (54)..(54): Xaa can be any naturally occurring amino acid
MSCLWFFAVKNIIIRLIYLLPKETQMALVSMRQLLDHAAEXSYGLPAFNVNNLXQMRAIMEAADQVDAPVIVQASAGARKYAGAPFLRHLILAAVEVFPHIPVVMHQDHGASPDVCQRSIQLGFSSVMMDGSLMEDGKTPSSYEYNVNATRTVVNFSHACGVSVEGEIGVLGNLETGDAGEEDGVGAVGKLSHDQMLTSVEDAVCFVKDTGVDALAIAVGTSHGAYKFTRPPTGDVLRIDRIKEIHQALPNTHIVMH

SEQ ID NO: 125 - DNA, 1140 bp, Neisseria meningitidis
atgagccgtttatggttttttgccgcaaaaaacattataatccgccttatttacctattgcccaaggagacacaaatggcactcgtatccatgcgccaactgcttgatcatgctgccgaaaacagctacggcctgcccgcgttcaacgtcaacaacctcgaacaaatgcgcgccattatggaagccgccgaccaagtcaacgcgcccgtcatcgtacaggcgagcgcaggtgcgcgcaaatacgcgggcgcgccgtttttgcgccacctgattttggcggctgtcgaagaatttccgcacatccccgtcgtgatgcaccaagaccacggcgcatcgcccgacgtgtgccaacgctccatccaactgggcttttcctccgtgatgatggacggctcgctgatggaagacggcaaaaccccttcttcttatgaatacaacgtcaacgccacccgtaccgtggttaatttctcccacgcctgcggcgtatccgttgaaggcgaaatcggcgtattgggcaacctcgaaactggcgaagccggcgaagaagacggtgtaggcgcagtgggcaaactttcccacgaccaaatgctcaccagcgtcgaagatgccgtgcgtttcgttaaagataccggcgttgacgcattggcgattgccgtcggcaccagccacggcgcgtacaaattcacccgtccgcccacaggcgacgtgttgcgtatcgaccgcatcaaagaaatccaccaagccctgcccaatacacacatcgtgatgcacggctccagctccgttccgcaagaatggctgaaagtcatcaacgaatacggcggcaatatcggcgaaacctacggcgtgccggttgaagaaatcgtcgaaggcatcaaacacggcgtgcgtaaagtcaacatcgataccgacttgcgccttgcttccaccggcgcggtacgccgctaccttgccgaaaacccgtccgacttcgatccgcgcaaatatttgagcaaaaccattgaagcgatgaagcaaatctgcctcgaccgctacctcgcgttcggttgcgaaggtcaggcaggcaaaatcaaaccggtttccttggaaaaaatggcaaaccgttatgccaagggcgaattgaaccaaatcgtcaaataa

SEQ ID NO: 126 - protein, 379 aa, Neisseria meningitidis
MSRLWFFAAKNIIIRLIYLLPKETQMALVSMRQLLDHAAENSYGLPAFNVNNLEQMRAIMEAADQVNAPVIVQASAGARKYAGAPFLRHLILAAVEEFPHIPVVMHQDHGASPDVCQRSIQLGFSSVMMDGSLMEDGKTPSSYEYNVNATRTVVNFSHACGVSVEGEIGVLGNLETGEAGEEDGVGAVGKLSHDQMLTSVEDAVRFVKDTGVDALAIAVGTSHGAYKFTRPPTGDVLRIDRIKEIHQALPNTHIVMHGSSSVPQEWLKVINEYGGNIGETYGVPVEEIVEGIKHGVRKVNIDTDLRLASTGAVRRYLAENPSDFDPRKYLSKTIEAMKQICLDRYLAFGCEGQAGKIKPVSLEKMANRYAKGELNQIVK

SEQ ID NO: 127 - DNA, 816 bp, Neisseria gonorrhoeae
atgctgaagccgtgtttggtatacagtgcctgtgcggcggcgttgcctgcgcggacttcgagcagcaggcgttgcgtgccttcgggcagatgtgcgtaccaatattcgagcagggcggacgcaacgccccgtcggcggcattcgggcgcggtggcaatcaggtgcagttcggattcgtcgggcaggttctgccaaacgataaaggcggcaatcctgccgtctttttccgcaaggaaaacctgttcggacggcgaaacaagcgcggactcaaattggcgttgcgtccacgcggacgggttgcagacggtatcgagcgcggccagtgcggcgcagtcggacggtgaggctgggcggatgttcatgttcgtgccttccgttccgcctgttctttggcagtcagggcgattttgttgcggacgtagagcagttcggcgtgtgccgcgccagttgcgggatagccgccgccgagggcgagcgcgagaaaatcggcggcggtcggcatatcgggtttgcctgagaagggcggacggttttccagtgcgaacgcactgccgatgccgtctgaaaagacgtacccctcggggagggcaatgtctgccgccctaccgacttgataatcgctcaaacggcggcggttcagcgtgtcgaaccacgcataaaacacttcgcccatacgcgcgtccgcagcggcgagtatgcagctttgcggcggcggcagcgaggcggcggcatcgagcgtggggatgccgattaaaggcgtgtcgaacggcgttgccaaaccttgcgccacgccgatgccgatacgcagtccggtaa

SEQ ID NO: 128 - protein, 271 aa, Neisseria gonorrhoeae
MLKPCLVYSACAAALPARTSSSRRCVPSGRCAYQYSSRADATPRRRHSGAVAIRCSSDSSGRFCQTIKAAILPSFSARKTCSDGETSADSNWRCVHADGLQTVSSAASAAQSDGEAGRMFMFVPSVPPVLWQSGRFCCGRRAVRRVPRQLRDSRRRGRARENRRRSAYRVCLRRADGFPVRTHCRCRLKRRTPRGGQCLPPYRLDNRSNGGGSACRTTHKTLRPYARPQRRVCSFAAAAARRRHRAWGCRLKACRTALPNLAPRRCRYAVR

SEQ ID NO: 129 - DNA, 815 bp, Neisseria meningitidis
atgctgaagccgtgcgccgtgtacagtgcctgtgcggcggtgttgcctgcacggacttcgagcagcaggcgttgcgtgtcttcgggcagatgtgtgaaccaatattcgagcagggcggacgcaattccttggcggcggcattcgggcgcggtggcaatcaggtgcagttcggattcgtcgggcaggttctgccaaacgataaaggcggcaatcccgcgtctttttccgcaaggaaaacctgttcggacggcgaaaccagtgcggactcaaattggcgttgcgtccatgcggacgggttgcagacggcatcgagtgcggccagctcctcacaatcggcacaaacggcacggcggatgttcacgggcgcgctctccgttcggcctgttctttggcagtcagggcgattttgttgcggacgtagagcaaaccggcgtgtgcggcatggacggcaggataaccgcccttggctgccaatgcgagaaagtcggcggcagtcggcatatccggtctgcctgagaacggcggagcttcttccagcgcgaacgcgctgcctatgccgtctgaaaaggcgcatccctccggcagccggatgtctgccgcccgcccgacctgataatcgctcaaacggtggcagttcagcgtatcgaaccatgcataaaacacttcgcccatacgagcgtccgtagcggcaaggatgcagctttgcggcggcggcagcgaggcggcggcatcgagcgagggtacgccgattaagggggtatcaaacggcgttgccaaaccctgagctacaccgatgccgatacgcagtccggtaa

SEQ ID NO: 130 - protein, 270 aa, Neisseria meningitidis
  misc_feature (73)..(73): Xaa can be any naturally occurring amino acid
MLKPCAVYSACAAVLPARTSSSRRCVSSGRCVNQYSSRADAIPWRRHSGAVAIRCSSDSSGRFCQTIKAAIPXSFSARKTCSDGETSADSNWRCVHADGLQTASSAASSSQSAQTARRMFTGALSVRPVLWQSGRFCCGRRANRRVRHGRQDNRPWLPMRESRRQSAYPVCLRTAELLPARTRCLCRLKRRIPPAAGCLPPARPDNRSNGGSSAYRTMHKTLRPYERPRQGCSFAAAAARRRHRARVRRLRGYQTALPNPELHRCRYAVR

SEQ ID NO: 131 - DNA, 816 bp, Neisseria meningitidis
atgctgaagccgtgcgccgtgtacagtgcctgtgcggcggtgttgcctgcacggacttcgagcagcaggcgttgcgtgtcttcgggcagatgtgtgaaccaatattcgagcagggcggacgcaattccttggcggcggcattcgggcgcggtggcaatcaggtgcagttcggattcgtcgggcaggttctgccaaacgataaaggcggcaatcccgccgtctttttccgcaaggaaaacctgttcggacggcgaaaccagtgcggactcaaattggcgttgcgtccacgcggacgggttgcagacggcatcgagcgcggcgagtgcggcgcaatcggcataaacggcgcggcggatgttcacaggcgcgccctccgttccgcctgttctttggcagtcaaggcgattttgttgcggacgtagagcagctcggcgtgtgccgcagcgacggcgggaaaaccgccttcagccgccagattgaggaagtcggcggcggtcggcatatcgggtttgcctgagaagggcggacggttttccagcgcgaacgcattgccgatgccgtctgaaaaggcgcatccttccggcagccggatgtctgccgcccgaccgacctgataatcgctcaaacggcggcggttcagcgtgtcgaaccatgcataaaacacttcgcccatacgtgcgtccgcagcggcaaggatgcagctttgcggcggcggcagcgaggcggcggcatcgagcgagggtacgccgattaaaggagtatcaaacggcgttgccaaaccttgcgccacgccgatgccgatacgcagtcccgtaa

SEQ ID NO: 132 - protein, 269 aa, Neisseria meningitidis
MLKPCAVYSACAAVLPARTSSSRRCVSSGRCVNQYSSRADAIPWRRHSGAVAIRCSSDSSGRFCQTIKAAIPPSFSARKTCSDGETSADSNWRCVHADGLQTASSAASAAQSATARRMFTGAPSVPPVLWQSRRFCCGRRAARRVPQRRRENRLQPPDGSRRRSAYRVCLRRADGFPARTHCRCRLKRRILPAAGCLPPDRPDNRSNGGGSACRTMHKTLRPYVRPQRQGCSFAAAAARRRHRARVRRLKEYQTALPNLAPRRCRYAVP

SEQ ID NO: 133 - DNA, 687 bp, Neisseria meningitidis
atgctgaagccgtgcgccgtgtacagtgcctgtgcggcggtgttgcctgcacggacttcgagcagcaggcgttgcgtgtcttcgggcagatgtgtgaaccaatattcgagcagggcggacgcaattccttggcggcggcattcgggcgcggtggcaatcaggtgcagttcggattcgtcgggcaggttctgccaaacgataaaggcggcaatcccgccgtctttttccgcaaggaaaacctgttcggacggcgaaaccagtgcggactcaaattggcgttgcgtccatgcggacgggttgcagacggcatcgagtgcggccagctcctcacaatcggcacaaacggcacggcggatgttcacgggcgcgctctccgttcggcctgttctttggcagtcagggcgattttgttgcggacgtagagcaaaccggcgtgtgcggcatggacggcaggataaccgcccttggctgccaatgcgagaaagtcggcggcagtcggcatatccggtctgcctgagaacggcggagcttcttccagcgcgaacgcgctgcctatgccgtctgaaaaggcgcatccctccggcagccggatgtctgccgcccgcccgacctgataatcgctcaaacggtggcagttcagcgtatcgaaccatgcataaaacacttcgcccatacgagcgtccgtag

SEQ ID NO: 134 - protein, 228 aa, Neisseria meningitidis
MLKPCAVYSACAAVLPARTSSSRRCVSSGRCVNQYSSRADAIPWRRHSGAVAIRCSSDSSGRFCQTIKAAIPPSFSARKTCSDGETSADSNWRCVHADGLQTASSAASSSQSAQTARRMFTGALSVRPVLWQSGRFCCGRRANRRVRHGRQDNRPWLPMRESRRQSAYPVCLRTAELLPARTRCLCRLKRRIPPAAGCLPPARPDNRSNGGSSAYRTMHKTLRPYERP

SEQ ID NO: 135 - DNA, 642 bp, Neisseria gonorrhoeae
atgactgatttccgccaagatttcctcaaattctccctcgcccaaaatgttttgaaattcggcgaatttaccaccaaagccggacggcggtcgccctatttcttcaatgccggcctcttcaacgacggcgcgtccacgctgcaactggcaaaattctatgcacaatccatcattgaaagcggcatccgattcgatatgctgttcggccccgcctacaaaggcattattttggcggcggcaaccgcgatgatgctggcggaaaaaggcgtgaacgtcccgtttgcctacaaccgcaaagaagccaaagaccgcggcgaaggcggcgtgttggtcggcgcgccgcttaaagggcgcgtgctgattatcgacgacgtgatttccgccggcacatccgtacgcgaatcaatcaaactgattgaagcggagggtgcaacccccgccggtgtcgccatcgcgctcgaccgcatggaaaaaggcacgggtaaattgtccgccgttcaggaagtggaaaaacaatacggcctgcccgtcgcccccatcgccagcctgaacgatttgtttatcctgttgcaaaacaaccccgaattcggacagttcctcgaacccgtccgcacctaccgccggcagtacggcgtagaataa

SEQ ID NO: 136 - protein, 213 aa, Neisseria gonorrhoeae
MTDFRQDFLKFSLAQNVLKFGEFTTKAGRRSPYFFNAGLFNDGASTLQLAKFYAQSIIESGIRFDMLFGPAYKGIILAAATAMMLAEKGVNVPFAYNRKEAKDRGEGGVLVGAPLKGRVLIIDDVISAGTSVRESIKLIEAEGATPAGVAIALDRMEKGTGKLSAVQEVEKQYGLPVAPIASLNDLFILLQNNPEFGQFLEPVRTYRRQYGVE

SEQ ID NO: 137 - DNA, 642 bp, Neisseria meningitidis
atgaccgatttccgccaagatttcctcaaattctccctcgcccaaaatgttttgaaattcggcgaatttaccaccaaggcaggacggcggtcgccctatttcttcaatgccggcctctttaacgacggcttgtccacgctgcaactggcaaaattttacgcacaatccatcattgaaagcggcatccgattcgatatgctgttcggtcccgcctacaaaggcattattttggcggcggcaaccgcgatgatgctggcggaaaaaggcgtgaacgtcccgtttgcctacaaccgcaaagaagccaaagaccacggcgaaggcggcgtgttggtcggcgcgccgcttaaagggcgcgtgctgattatcgacgacgtgatttccgccggcacatccgtacgcgaatcgatcaaactgattgaagcggagggtgcaacccccgccggtgtcgccatcgcgctcgatcgcatggaaaaaggcacgggtgaattgagcgcggttcaggaagtggaraaacaatacggkctgcccgtcgcccccatcgccagcctgaacgatttgtttattctgttgcaaaacaaccccgaattcggacagttcctcgaacccgtccgagcctaccgtcggcagtacggcgtagaataa

SEQ ID NO: 138 - protein, 213 aa, Neisseria meningitidis
MTDFRQDFLKFSLAQNVLKFGEFTTKAGRRSPYFFNAGLFNDGLSTLQLAKFYAQSIIESGIRFDMLFGPAYKGIILAAATAMMLAEKGVNVPFAYNRKEAKDHGEGGVLVGAPLKGRVLIIDDVISAGTSVRESIKLIEAEGATPAGVAIALDRMEKGTGELSAVQEVEKQYGLPVAPIASLNDLFILLQNNPEFGQFLEPVRAYRRQYGVE

SEQ ID NO: 139 - DNA, 642 bp, Neisseria meningitidis
atgaccgatttccgccaagatttcctcaaattctccctcgcccaaaatgttttgaaattcggcgaattcaccaccaaagccggacggcggtcgccctatttcttcaatgccggcctctttaacgacggcttgtccacgctgcaactggcaaaattttacgcacaatccatcattgaaagcggcatccgattcgatatgctgttcggccccgcctacaaaggcattattttggcggcggcaaccgcgatgatgctggcggaaaaaggcgtgaacgtcccgtttgcctacaaccgcaaagaagccaaagaccacggcgaaggcggcgtgttggtcggcgcgccgcttaaagggcgcgtgctgattatcgacgacgtgatttccgccggcacatccgtacgcgaatcgatcaaactgattgaagcggagggtgcaacccccgccggtgtcgccatcgcgctcgaccgcatggaaaaaggcacgggtgaattgagcgcggttcaggaagtggaaaaacaatacggcctgcccgtcgcccccatcgccagcctgaacgatttgtttattctgttgcaaaacaaccccgaattcggacagttcctcgaacccgtccgagcctaccgtcggcagtacggcgtagaataa

SEQ ID NO: 140 - protein, 213 aa, Neisseria meningitidis; identical to SEQ ID NO: 138

SEQ ID NO: 141 - DNA, 492 bp, Neisseria gonorrhoeae
atgccgtccgaaccacctgccgcttcagacggcatcaaaccgacacacaccgagaaaacatcatgcccgcctgtttctgtccgcactgcaaaacccgcctctgggtcaaagaaacccagctcaacgtcgcccaaggcttcgtcgtctgccaaaaatgcgaagggctgtttaaagccaaagaccatctggcaagcacgaaagaacctatattcaacgattggcccgaagctgtttcgggatgtcaaactcgtccaccgcatcggcacgcacgccattagcaagaaacagatgtcccgcgacgaaatcgccgatatcctcaacggcggtacaaccctgcacgatacgccgcccgcaaccgccgctgccgcacctgccgccgcaccgcaggtttccgtaccgcccgcccgtcaggaagggctcaactggactattgcaaccctgttcgcacttatcgtcctcattatgcagctttcctacctcttcatcctatga

SEQ ID NO: 142 - protein, 163 aa, Neisseria gonorrhoeae
MPSEPPAASDGIKPTHTEKTSCPPVSVRTAKPASGSKKPSSTSPKASSSAKNAKGCLKPKTIWQARKNLYSTIGPKLFRDVKLVHRIGTHAISKKQMSRDEIADILNGGTTLHDTPPATAAAAPAAAPQVSVPPARQEGLNWTIATLFALIVLIMQLSYLFIL

SEQ ID NO: 143 - DNA, 513 bp, Neisseria meningitidis
  misc_feature (133)..(237): n is a, c, g, or t
atgccgtccgaaccgccttacgcctcagacggcatcaaacctgacacacacgaggaaataccatgcccgcctgtttctgcccccactgcaaaacccgtctctgggtcaaagaaacccaactcaatgtcgccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccgaggctgtttcggatgtcaaactcgttcaccgtatcggcacgcgcgccatcggcaagaaacagatttcccgtgacgaaatcgccggcatcctcaacggcggtacaacccagcccgatattccgcccgcaaccgccgccacccctgctgccgcaccgcaggttaccgtaccgcccgccgcgcccgcccgtcaggatgggttcaactggacgattgcaaccctgtttgcccttatcgtcctcattatgcagctttcctacctcgtcatcctatga

SEQ ID NO: 144 - protein, 170 aa, Neisseria meningitidis
  misc_feature (45)..(79): Xaa can be any naturally occurring amino acid
MPSEPPYASDGIKPDTHEEIPCPPVSAPTAKPVSGSKKPNSMSPXXXXXXXXXXXXXXXXXXXXXXXXXXXXXXXXXXXPEAVSDVKLVHRIGTRAIGKKQISRDEIAGILNGGTTQPDIPPATAATPAAAPQVTVPPAAPARQDGFNWTIATLFALIVLIMQLSYLVIL

SEQ ID NO: 145 - DNA, 497 bp, Neisseria meningitidis
atgccgtctgaaccgccttacgcctcagacggcatcaaacctgacacacacgaggaaataccatgcccgcctgtttctgcccccactgcaaaacccgtctctgggtcaaagaaacccaactcaatgtcgcccaaggcttcgtcgtctgccaaaaatgcgaaggaatgtttaaagccaaagaccatctggcaagcacgaaagaacccatattcaacgatttgcccgaagctgtttcggatgtcaaactcgttcaccgcatcggcacgagcgccatcggcaagaaacagatttcccgtgacgaaatcgccggcatcctcaacggcggcacaacccagcccgatattccgcccgcaaccgccgccacccctgctgccgcaccgcaggttaccgtaccgcccgccgcgcccgcccgtcaggatgggttcaactggacgattgcaaccctgtttgcccttatcgtcctcattatgcagctttcctacctcgtcatcctatga

SEQ ID NO: 146 - protein, 165 aa, Neisseria meningitidis
  misc_feature (74)..(74): Xaa can be any naturally occurring amino acid
MPSEPPYASDGIKPDTHEEIPCPPVSAPTAKPVSGSKKPNSMSPKASSSAKNAKECLKPKTIWQARKNPYSTIXPEAVSDVKLVHRIGTSAIGKKQISRDEIAGILNGGTTQPDIPPATAATPAAAPQVTVPPAAPARQDGFNWTIATLFALIVLIMQLSYLVIL

SEQ ID NO: 147 - DNA, 1311 bp, Neisseria gonorrhoeae
atgaacgcgcccgacagctttgtcgcccacttccgcgaagccgccccctacatccgccaaatgcgcggcacgacactggtcgccggcatagacggccgcctgctcgaaggcggcaccttaaataagctcgccgccgacatcgggctgttgtcgcaactgggcatccgactcgtcctcatccacggcgcgtaccacttcctcgaccgcctcgccgccgcgcaaggccgcacgccgcattattgccggggtttgcgcgttaccgacgaaacctcgctcggacaggcgcagcagtttgccggcaccgtccgcagccgttttgaagccgcattgtgcggcagcgtttcaggattcgcgcgcgcgccttccgtcccgctcgtatcgggcaacttcctgaccgcccgtccgatgggcgtgattgacggaaccgatatggaatacgcgggggttatccgcaaaaccgacaccgccgccctccgtttccaactcgacgcgggcaatatcgtctggatgccgccgctcgggcattcctacggcggcaaaaccttcaatctcgatatggtgcaggccgccgcttccgtcgccgtctcgcttcaggccgaaaaactcgtttacctgaccctttcagacggcatttcccgccccgacggcacgctcgccgaaaccctctcggcacaggaagcgcaatcgctggcggaacacgccgccagcgaaacccgacgactgatttcgtccgccgttgccgcgctcgaaggcggcgtgcatcgcgtccaaatcctcaacggggccgccgacggcagcctgctgcaagaactcttcacccgcaacggcatcggcacgtccattgccaaagaagccttcgtctccatccggcaggcgcacagcggcgacatcccgcacatcgccgccctcatccgcccgctggaagaacagggcgtcctattgcaccgcagccgcgaatacctcgaaaaccacatttccgaattttccatcctcgaacacgacggcgacctgtacggctgtgccgcactcaaaacctttgccgaagccgattgcggcgaaatcgcctgccttgccgtctcgccgcaggcacaggacggcggctacggcgaacgcctgcttgcccacattatcgataaggcgcgcggcataggcataagcaggctgttcgcactgtccacaaataccggcgaatggtttgccgaacgcggctttcagacggcatcggaagacgagctgcccgaaacgcggcgcaaagactaccgcagcaacggacgaaacccgcatattctggtgcgtcgcctgcaccgctga

SEQ ID NO: 148 - protein, 436 aa, Neisseria gonorrhoeae
MNAPDSFVAHFREAAPYIRQMRGTTLVAGIDGRLLEGGTLNKLAADIGLLSQLGIRLVLIHGAYHFLDRLAAAQGRTPHYCRGLRVTDETSLGQAQQFAGTVRSRFEAALCGSVSGFARAPSVPLVSGNFLTARPMGVIDGTDMEYAGVIRKTDTAALRFQLDAGNIVWMPPLGHSYGGKTFNLDMVQAAASVAVSLQAEKLVYLTLSDGISRPDGTLAETLSAQEAQSLAEHAASETRRLISSAVAALEGGVHRVQILNGAADGSLLQELFTRNGIGTSIAKEAFVSIRQAHSGDIPHIAALIRPLEEQGVLLHRSREYLENHISEFSILEHDGDLYGCAALKTFAEADCGEIACLAVSPQAQDGGYGERLLAHIIDKARGIGISRLFALSTNTGEWFAERGFQTASEDELPETRRKDYRSNGRNPHILVRRLHR

SEQ ID NO: 149 - DNA, 1236 bp, Neisseria meningitidis
  misc_feature (1039)..(1039): n is a, c, g, or t
atgagcgcgcccgacctctttgtcgcccacttccgcgaagccgtcccctacatccgccaaatgcgcggcaaaacgctggtcgccggcatagacgaccgcctgctcgaaggtgataccttaaacaagctcgccgccgacatcgggctgttgtcgcaactgggcatcaggctcgtcctcatccacggcgcgcgccacttcctcgaccgccacgccgccgctcaaggccgcacgccgcattattgccggggcttgcgcgttaccgacgaaacctcgctcgaacaggcgcagcagtttgccggcaccgtccgcagccgttttgaagccgcattgtgcggcagcgtttccgggttcgcgcgcgcgccttccgtcccgctcgtatcgggcaacttcctgaccgcccgtccgataggtgtgattgacggaaccgatatggaatacgcgggcgttatccgcaaaaccgacaccgccgccctccgtttccaactcgacgcgggcaatatcgtctggctgccgccgctcggacattcctacagcggcaagaccttctatctcgatatgcttcaaaccgccgcctccgccgccgtctcgcttcaggccgaaaaactcgtttacctgaccctttcagacggcatttcccgccccgacggcacgctcgccgaaaccctctcggcacaggaagcgcaatcgctggcggaacacgccggcgggcaaacgcgacggctgatttcgtccgccgaactcttcacccgcaacggcatcggcacgtccattgccaaagaagccttcgtctccatccggcargcgcaywgggcgacatcccgcacatcgccgccctcatccgcccgctggaagaacagggcatcctgctgcaccgcascgcgaatacctcgaaaaccacatttccgaattttccatcctcgaacacgacggcaacctgtacggttgcgccgccctgaaaacctttgccgaagccgattgcggcgaaatcgcctgccttgccgtctcgccgcagcacaggacggcggctacggcgaacgcntgcttgcccacattatcgataaggcgcgcggcataggcataagcaggctgttcgcactgtccacaaataccggcgaatggtttgccgaacgcggctttcagacggcatcggaagacgagttgcccgaaacgcggcgcaaagactaccgcagcaacggacggaactcgcatattctggtacgtcgcctgcaccgctga

SEQ ID NO: 150 - protein, 412 aa, Neisseria meningitidis
  misc_feature (270)..(271): Xaa can be any naturally occurring amino acid
  misc_feature (293)..(293): Xaa can be any naturally occurring amino acid
  misc_feature (339)..(339): Xaa can be any naturally occurring amino acid
  misc_feature (348)..(348): Xaa can be any naturally occurring amino acid
MSAPDLFVAHFREAVPYIRQMRGKTLVAGIDDRLLEGDTLNKLAADIGLLSQLGIRLVLIHGARHFLDRHAAAQGRTPHYCRGLRVTDETSLEQAQQFAGTVRSRFEAALCGSVSGFARAPSVPLVSGNFLTARPIGVIDGTDMEYAGVIRKTDTAALRFQLDAGNIVWLPPLGHSYSGKTFYLDMLQTAASAAVSLQAEKLVYLTLSDGISRPDGTLAETLSAQEAQSLAEHAGGQTRRLISSAELFTRNGIGTSIAKEAFVSIRQAHXXDIPHIAALIRPLEEQGILLHRXREYLENHISEFSILEHDGNLYGCAALKTFAEADCGEIACLAVSPQXQDGGYGERXLAHIIDKARGIGISRLFALSTNTGEWFAERGFQTASEDELPETRRKDYRSNGRNSHILVRRLHR

SEQ ID NO: 151 - DNA, 1311 bp, Neisseria meningitidis
atgatcgtgcccgacctctttgtcgcccacttccgcgaagccgccccctacatccgccaaatgcgcggcaaaacgctggtcgccggcatagacgaccgcctgctcgaaggtgataccttaaacaagttcgccgccgacatcgggcttttgtcgcaactgggcatcaggctcgtcctcatccacggcgcgcgccacttcctcgaccgccacgccgccgcgcaaggccgcacgccgcattattgccggggcttgcgcgttaccgacgaaacctcgctcgaacaggcgcagcagtttgccggcaccgtccgcagccgttttgaagccgcattgtgcggcagcgtttccgggttcgcgcgcgcgccttccgtcccgctcgtatcgggcaacttcctgaccgcccgtccgataggtgtgattgacggaaccgatatggaatacgcgggcgttatccgcaaaaccgacaccgccgccctccgtttccaactcgacgcgggcaatatcgtctggctgccgccgctcggacattcctacagcggcaagaccttccatctcgatatgcttcaaaccgccgcctccgtcgccgtctcgcttcaggccgaaaaactcgtttacctgaccctttcagacggcatttcccgccccgacggcacgctcgccgtaaccctctcggcacaggaagcgcaatcgctggcggaacacgccggcggcgaaacgcgacggctgatttcgtccgccgttgccgcgctcgaaggcggcgtgcatcgcgtccaaatcctcaacggagccgccgacggcagcctgctgcaagaactcttcacccgcaacggcatcggcacgtccattgccaaagaagccttcgtctccatccggcaggcgcacagcggcgacatcccgcacattgccgccctcatccgcccgctggaagaacagggcatcctgctgcaccgcagccgcgaatacctcgaaaaccacatttccgaattttccatcctcgaacacgacggcaacctgtacggttgcgccgccctgaaaacctttgccgaagccgattgcggcgaaatcgcctgccttgccgtctcgccgcaggcacaggacggcggctacggcgaacgcctgcttgcccacattatcgataaggcgcgcggcataggcataagcaggctgttcgcactgtccacaaataccggcgaatggtttgccgaacgcggctttcagacggcatcggaagacgagttgcccgaaacgcggcgcaaagactaccgcagcaacggacggaactcgcatattctggtgcgtcgcctgcaccgctga

SEQ ID NO: 152 - protein, 436 aa, Neisseria meningitidis
MIVPDLFVAHFREAAPYIRQMRGKTLVAGIDDRLLEGDTLNKFAADIGLLSQLGIRLVLIHGARHFLDRHAAAQGRTPHYCRGLRVTDETSLEQAQQFAGTVRSRFEAALCGSVSGFARAPSVPLVSGNFLTARPIGVIDGTDMEYAGVIRKTDTAALRFQLDAGNIVWLPPLGHSYSGKTFHLDMLQTAASVAVSLQAEKLVYLTLSDGISRPDGTLAVTLSAQEAQSLAEHAGGETRRLISSAVAALEGGVHRVQILNGAADGSLLQELFTRNGIGTSIAKEAFVSIRQAHSGDIPHIAALIRPLEEQGILLHRSREYLENHISEFSILEHDGNLYGCAALKTFAEADCGEIACLAVSPQAQDGGYGERLLAHIIDKARGIGISRLFALSTNTGEWFAERGFQTASEDELPETRRKDYRSNGRNSHILVRRLHR

SEQ ID NO: 153 - DNA, 465 bp, Neisseria gonorrhoeae
atgagttcgcccaaacacatcggcttgcagggcggcagcaacggcggcctgattaccgccgccgccttcgtgcgcgaaccgcaaagcatcggtgcgctggtgtgcgaagtaccgctgaccgatatgatccgttatccgctgctgtccgccggttcaagttggacggacgaatacggcaatccgcagaaatacgaagcctgcaaacgccggctgggcgaattgtcgccgtatcacaatctttcagacggcatcgattatccgcccgcactcattaccaccagcctcagcgacgaccgcgtccatcccgcccacgcgctcaaattctacgccaaactgcgcgaaacctcgccgcaatcttggctctactcgcctgacggcggcggccataccggcaacggcacccaacgcgaatccgccgacaaactcgcctgcgtgttgctgtttttgaaagaatttttgggataa

SEQ ID NO: 154 - protein, 154 aa, Neisseria gonorrhoeae
MSSPKHIGLQGGSNGGLITAAAFVREPQSIGALVCEVPLTDMIRYPLLSAGSSWTDEYGNPQKYEACKRRLGELSPYHNLSDGIDYPPALITTSLSDDRVHPAHALKFYAKLRETSPQSWLYSPDGGGHTGNGTQRESADKLACVLLFLKEFLG

SEQ ID NO: 155 - DNA, 465 bp, Neisseria meningitidis
atcagttcgcccgaacacatcggcttgcagggcggcagcaacggcggactgattactgccgccgccttcgtgcgcgaaccgcaaagcatcggcgcgctggtgtgcgaagtgccgctgaccgacatgatccgttatccgctgctctccgccggttcaagctggacagacgaatacggcaatccgcaaaaatacgaagtctgcaaacgccggttgggcgaattgtcgccgtatcacaatctttcagacggcatcgattatccgcccgcgctcattaccaccagcctgtccgacgatcgcgtccatcccgcccacgcgctcaagttctacgccaaactgcgcgaaacctccgcgcaatcttggctctactcgcctgacggcggcggccataccggcaacggcacccaacgcgaatccgccgacgaactcgcctgcgtcttgctgtttttgaaagagtttttgggctaa

SEQ ID NO: 156 - protein, 154 aa, Neisseria meningitidis
ISSPEHIGLQGGSNGGLITAAAFVREPQSIGALVCEVPLTDMIRYPLLSAGSSWTDEYGNPQKYEVCKRRLGELSPYHNLSDGIDYPPALITTSLSDDRVHPAHALKFYAKLRETSAQSWLYSPDGGGHTGNGTQRESADELACVLLFLKEFLG

SEQ ID NO: 157 - DNA, 465 bp, Neisseria meningitidis
atcagttcgcccgaacacatcggcttgcagggcggcagcaacggcggactgattactgccgccgccttcgtgcgcgaaccgcaaagcataggcgcgctggtgtgcgaagtgccgctgaccgacatgatccgttatccgctgctctccgccggttcaagctggacagacgaatacggcaatccgcaaaaatacgaagtctgcaaacgccggttgggcgaattgtcgccgtatcacaatctttcagacggcatcgattatccgcccgcgctcattaccaccagcctgtccgacgatcgcgtccatcccgcccacgcgctcaagttctacgccaaactgcgcgaaacctcgccgcaatcttggctctactcgcctgacggcggcggccataccggcaacggcacgcagcgcgaagccgccgacgaactcgcctgcgtgttgctgtttttgaaagagtttttgggctaa

SEQ ID NO: 158 - protein, 154 aa, Neisseria meningitidis
ISSPEHIGLQGGSNGGLITAAAFVREPQSIGALVCEVPLTDMIRYPLLSAGSSWTDEYGNPQKYEVCKRRLGELSPYHNLSDGIDYPPALITTSLSDDRVHPAHALKFYAKLRETSPQSWLYSPDGGGHTGNGTQREAADELACVLLFLKEFLG

SEQ ID NO: 159 - DNA, 2016 bp, Neisseria gonorrhoeae
atgaaatcctaccccgacccctaccgccattttgaaaacctcgattccgccgaaacgcaaaacttcgctgctgaagcgaatgccgaaacgcgcgcgcgttttttaaacaacgacaaggcgcgcgcactttcagacggcattttgaatcaaatgcaggacacgcggcagattccgttttgtcaggaacaccgcgcgcggatgtaccatttccatcagaatgcggaatatccgaagggcgtgtaccgcatgtgtacggcggcgacctaccgttccggctatcccgagtggaaaatcctgttttcggtggcggatttcgatgagttgctcggcgacgatgtgtatttgggcggcgtgtcgcacttggtggagcagcccaaccgcgcgctgctgactttgaacaaatcgggcggcgatacggcgtatacgctggaagtggatttggaagcaggggaattggtagagggcggttttcactttccggcaggcaaaaaccatgtgtcgtggcgcgatgaaaacagcgtgtgggtgtgtccggcttgggacgaacgccagttgaccgaatcgggctatccgcgcgaagtgtggctggtggaacgcggcaagagtttcgaggaaagcctgccggcgtaccaaatcgataaaggcgcgatgatggtaaacgcgtggcgttacctcgatccgcagggttcgccgattgatttgattgaagcgtcggacggtttttacaccaagacgtatttgcaggtgtcgtccgaaggcggggcgaaaccgttgaacctgcctaatgattgcgatgtggtcggctatctggcgggacatcttttgctgacgctgcgcaaggactggcaccgcgcgaaccaaagctatccgagtggcgcgttggtggcggtgaaactgaatcggggcgaactcggggcggcgcagcttttgtttgcgcccgatgaaacgcaggcattggaaagcgtggaaacgaccaagcgttttgtggtggcaagcctgctggagaatgtacaaggccgtctgaaagcgtggcggtttgccgacagcaaatggcaggaagccgagttgccgcacctgccctcgggcgcgttggaaatgaccgaccaaccgtggggcggcgacgtggtttatcttgccgccagcgatttcaccacgccgctgacgctgtttgcgctggatttgaacgtgatggaactgaccgtcatgcgcctccagccgcagcagtttgtttcagacggcatcgaagtgcggcagttttgggcggtgtcgtccgacggcgaacgcattccttatttccacgtcggcaaaaacgccgcgcccgacacgccgaccttagtctatgcttacggaggtttcggcattcctgaattgccgcattatctgggcagcgtcggcaaatattggctggaagagggcaatgcctttgtattggcaaacatccgcggcggcggagaattcggcccgcgctggcatcaggcggcgcagggaatcagcaaacacaaaagcgttgatgatttgttggcagtcgtgcgtgatttgtccgaacgcggcatgagttcgcccaaacacatcggcttgcagggcggcagcaacggcggcctgattaccgccgccgccttcgtgcgcgaaccgcaaagcatcggtgcgctggtgtgcgaagtaccgctgaccgatatgatccgttatccgctgctgtccgccggttcaagttggacggacgaatacggcaatccgcagaaatacgaagcctgcaaacgccggctgggcgaattgtcgccgtatcacaatctttcagacggcatcgattatccgcccgcactcattaccaccagcctcagcgacgaccgcgtccatcccgcccacgcgctcaaattctacgccaaactgcgcgaaacctcgccgcaatcttggctctactcgcctgacggcggcggccataccggcaacggcacccaacgcgaatccgccgacaaactcgcctgcgtgttgctgtttttgaaagaatttttgggataa

SEQ ID NO: 160 - protein, 671 aa, Neisseria gonorrhoeae
MKSYPDPYRHFENLDSAETQNFAAEANAETRARFLNNDKARALSDGILNQMQDTRQIPFCQEHRARMYHFHQNAEYPKGVYRMCTAATYRSGYPEWKILFSVADFDELLGDDVYLGGVSHLVEQPNRALLTLNKSGGDTAYTLEVDLEAGELVEGGFHFPAGKNHVSWRDENSVWVCPAWDERQLTESGYPREVWLVERGKSFEESLPAYQIDKGAMMVNAWRYLDPQGSPIDLIEASDGFYTKTYLQVSSEGGAKPLNLPNDCDVVGYLAGHLLLTLRKDWHRANQSYPSGALVAVKLNRGELGAAQLLFAPDETQALESVETTKRFVVASLLENVQGRLKAWRFADSKWQEAELPHLPSGALEMTDQPWGGDVVYLAASDFTTPLTLFALDLNVMELTVMRLQPQQFVSDGIEVRQFWAVSSDGERIPYFHVGKNAAPDTPTLVYAYGGFGIPELPHYLGSVGKYWLEEGNAFVLANIRGGGEFGPRWHQAAQGISKHKSVDDLLAVVRDLSERGMSSPKHIGLQGGSNGGLITAAAFVREPQSIGALVCEVPLTDMIRYPLLSAGSSWTDEYGNPQKYEACKRRLGELSPYHNLSDGIDYPPALITTSLSDDRVHPAHALKFYAKLRETSPQSWLYSPDGGGHTGNGTQRESADKLACVLLFLKEFLG

SEQ ID NO: 161 - DNA, 2016 bp, Neisseria meningitidis
atgaaatcctaccccgacccctaccgccattttgaaaacctcgattccgccgaaacgcaaaacttcgctgctgaagcgaatgccgaaacgcgcgcgcgttttttagaaaacgacaaggcgcgcgcgctttcagacggcattttggcgcagttgcaggacacgcggcagattccgttttgtcaggaacaccgcgcgcggatgtaccatttccatcaggacgcggagtatccgaagggcgtgtaccgcgtgtgtaccgcggcgacgtatcgttccggctatcccgagtggaaaatcctgttttcggtggcggatttcgacgaattgcttggcgacgatgtgtatttgggcggcgtgtcgcacttggtggaacagcccaaccgcgcgttgttaacactgagcaaattgggcagcgatacggcgtacacgctggaagtggatttggaagcaggggagttggtcgaaggcggttttcactttccggcaggcaaaaaccatgtgtcgtggcgcgatgaaaacagcgtgtgggtgtgtccggcttggaacgaacgccagttgacccaatcgggctatccgcgcgaagtatggctggtggaacgcggcaagagtttcgaggaaagcctgcctgtgtatcaaatcggcgaagacggcatgatggtgaacgcgtggcgttatctcgatccgcagggttcgccgattgatttgattgaagcgtcggacggtttttacaccaaaacctatttgcgggtctcagccgaaggcgaggcgaaaccgttaaacctgcccaacgattgcgacgtggtcggctatctggcggggcatcttttgctgacgctgcgcaaggactggaaccgcgcgaaccaaagctatccgagcggcgcgctggtggcggtgaagctgaatcggggcgaactcggggcggcgcagcttttgtttgcgcccgatgaaacgcaggcattggaaagcgtggaaacgaccaagcgttttgtggtggcgagcctgttggagaacgtacaaggccgtctgaaagcatggcggtttgccgacggcaaatggcaggaagtcgaattgccgcgcctgccttcgggcgcgttggaaatgaccgaccaaccttggggcggcgacgtggtttaccttgccgccagcgatttcaccacgccgctgacgctgtttgcgctggatttgaacgtgatggaactgaccgtcatgcgccgccagccgcagcagtttgattcagacggcattaacgtgcagcagttttggacgacttcggctgacggcgagcgcattccttatttccacgtcggcaaaaacgccgcgcccgacatgccgacgctggtctatgcctacggcggtttcggcattcccgaattgccgcattatctgggcagcattggcaaatattggctggaagagggcaatgcctttgtattggcgaacatccgcggcggcggcgagttcggcccgcgctggcatcaggcggcgcagggaatcagcaaacataaaagcgttgatgatttattggcagtcgtgcgcgatttgtccgaacgcggtatcagttcgcccgaacacatcggcttgcagggcggcagcaacggcggactgattactgccgccgccttcgtgcgcgaaccgcaaagcatcggcgcgctggtgtgcgaagtgccgctgaccgacatgatccgttatccgctgctctccgccggttcaagctggacagacgaatacggcaatccgcaaaaatacgaagtctgcaaacgccggttgggcgaattgtcgccgtatcacaatctttcagacggcatcgattatccgcccgcgctcattaccaccagcctgtccgacgatcgcgtccatcccgcccacgcgctcaagttctacgccaaactgcgcgaaacctccgcgcaatcttggctctactcgcctgacggcggcggccataccggcaacggcacccaacgcgaatccgccgacgaactcgcctgcgtcttgctgtttttgaaagagtttttgggctaa

SEQ ID NO: 162 - protein, 671 aa, Neisseria meningitidis
MKSYPDPYRHFENLDSAETQNFAAEANAETRARFLENDKARALSDGILAQLQDTRQIPFCQEHRARMYHFHQDAEYPKGVYRVCTAATYRSGYPEWKILFSVADFDELLGDDVYLGGVSHLVEQPNRALLTLSKLGSDTAYTLEVDLEAGELVEGGFHFPAGKNHVSWRDENSVWVCPAWNERQLTQSGYPREVWLVERGKSFEESLPVYQIGEDGMMVNAWRYLDPQGSPIDLIEASDGFYTKTYLRVSAEGEAKPLNLPNDCDVVGYLAGHLLLTLRKDWNRANQSYPSGALVAVKLNRGELGAAQLLFAPDETQALESVETTKRFVVASLLENVQGRLKAWRFADGKWQEVELPRLPSGALEMTDQPWGGDVVYLAASDFTTPLTLFALDLNVMELTVMRRQPQQFDSDGINVQQFWTTSADGERIPYFHVGKNAAPDMPTLVYAYGGFGIPELPHYLGSIGKYWLEEGNAFVLANIRGGGEFGPRWHQAAQGISKHKSVDDLLAVVRDLSERGISSPEHIGLQGGSNGGLITAAAFVREPQSIGALVCEVPLTDMIRYPLLSAGSSWTDEYGNPQKYEVCKRRLGELSPYHNLSDGIDYPPALITTSLSDDRVHPAHALKFYAKLRETSAQSWLYSPDGGGHTGNGTQRESADELACVLLFLKEFLG

SEQ ID NO: 163 - DNA, 2016 bp, Neisseria meningitidis
atgaaatcctaccccgacccctaccgccattttgaaaacctcgattccgccgaaacgcaaaacttcgctgctgaagcgaatgccgaaacgcgcgcgcgttttttaaacaacgacaaggcacgcgcattgtctgacggcattttggcgcagttgcaggacacgcggcaaattccgttttgtcaggaacaccgcgcgcggatgtaccatttccatcaagatgcggaatatccgaaaggcgtgtaccgcgtgtgtaccgcggcgacttaccgttcgggctatcctgagtggaaaatcctgttttcggtggcggatttcgacgaattgctcggtgacgatgtatatctaggcggcgtgtcgcacctggtggaacagcccaaccgcgcgttgttaacactgagcaaatcgggcggcgataccgcgtacacgctggaagtggatttggaagcaggggagttggtagaaggcggttttcactttccggcaggcaaaaaccatgtgtcgtggcgcgatgaaaacagcgtgtgggtgtgtccggcttgggacgaacgccagttgaccgaatcgggctatccgcgcgaggtgtggctggtggaacgcggcaagagtttcgaggaaagcctgccggtgtaccaaattgctgaagacggcatgatggtgaacgcgtggcgttacctcgatccgcagggttcgccgattgatttgattgaagcgtctgacggtttttacaccaaaacctatttgcaggtctcagccgaaggcgaagcgaaaccgttaaacctgcccaacgattgcgacgtagtcggctatctggccggacatcttttgctgaccttgcgtaaagactggcaccgcgcgaaccaaagctatccgagtggcgcattggtagcagtaaaattaaaccgcggcgaattgggcgcggcgcagcttttgtttgcgcccaatgaaacgcaggcattggaaagcgtggaaacgaccaagcgttttgtcgtggcgagcctgctggaaaacgtacagggtcgtctgaaagcgtggcgttttactgatggcaaatggcaggaaaccgagttgccgcgcctgccttcgggcgcgttggaaatgaccgaccaaccgtgggggggcgacgtagtttaccttgccgccagcgatttcaccacgccgctgacgctgtttgcattggatttgaacgtgatggaactgaccgtcatgcgccgccagccgcagcagtttgattcagacggcattaacgtgcagcagttttggacgacttcggctgacggcgagcgcattccttatttccacgtcggcaaaaacgccgcgcccgacatgccgacgctggtctatgcctacggcggtttcggcattcccgaattgccgcattatctgggcagcattggcaaatattggctggaagagggcaatgcctttgtattggcgaacatccgcggcggcggcgagttcggcccgcgctggcatcaggcggcgcagggaatcagcaaacataaaagcgttgatgatttattggcagtcgtgagcgatttgtccgaacgcggtatcagttcgcccgaacacatcggcttgcagggcggcagcaacggcggactgattactgccgccgccttcgtgcgcgaaccgcaaagcataggcgcgctggtgtgcgaagtgccgctgaccgacatgatccgttatccgctgctctccgccggttcaagctggacagacgaatacggcaatccgcaaaaatacgaagtctgcaaacgccggttgggcgaattgtcgccgtatcacaatctttcagacggcatcgattatccgcccgcgctcattaccaccagcctgtccgacgatcgcgtccatcccgcccacgcgctcaagttctacgccaaactgcgcgaaacctcgccgcaatcttggctctactcgcctgacggcggcggccataccggcaacggcacgcagcgcgaagccgccgacgaactcgcctgcgtgttgctgtttttgaaagagtttttgggctaa

SEQ ID NO: 164 - protein, 671 aa, Neisseria meningitidis
MKSYPDPYRHFENLDSAETQNFAAEANAETRARFLNNDKARALSDGILAQLQDTRQIPFCQEHRARMYHFHQDAEYPKGVYRVCTAATYRSGYPEWKILFSVADFDELLGDDVYLGGVSHLVEQPNRALLTLSKSGGDTAYTLEVDLEAGELVEGGFHFPAGKNHVSWRDENSVWVCPAWDERQLTESGYPREVWLVERGKSFEESLPVYQIAEDGMMVNAWRYLDPQGSPIDLIEASDGFYTKTYLQVSAEGEAKPLNLPNDCDVVGYLAGHLLLTLRKDWHRANQSYPSGALVAVKLNRGELGAAQLLFAPNETQALESVETTKRFVVASLLENVQGRLKAWRFTDGKWQETELPRLPSGALEMTDQPWGGDVVYLAASDFTTPLTLFALDLNVMELTVMRRQPQQFDSDGINVQQFWTTSADGERIPYFHVGKNAAPDMPTLVYAYGGFGIPELPHYLGSIGKYWLEEGNAFVLANIRGGGEFGPRWHQAAQGISKHKSVDDLLAVVSDLSERGISSPEHIGLQGGSNGGLITAAAFVREPQSIGALVCEVPLTDMIRYPLLSAGSSWTDEYGNPQKYEVCKRRLGELSPYHNLSDGIDYPPALITTSLSDDRVHPAHALKFYAKLRETSPQSWLYSPDGGGHTGNGTQREAADELACVLLFLKEFLG

SEQ ID NO: 165 - DNA, 606 bp, Neisseria gonorrhoeae
atgacgatgatttgcttgcgcttccaagcgttcgtgccgcataccagcgcgttatccaacacttccacggcagccggcccttcctgcccgatggcggcggtgcggtcgatgatgaaaatccagccggggtttttctctttgatgtattcgaaggaaacgggctgcccgtgcccttcgttgcgtaaagattcgtccacgggcggcaggccgatgtcgccgtgtatccaacttgccaaccgcgattgcgtgccgaaggcggacaccttgttgcctgtaaccgacagcaccagcccgcgtcctttgcctttggcggcttcgcgcttttgggcgaacagcgcgtcaatctgcgcattcaattccgccacgcgcgcttccttaccgaaaatccgcgacagggtctccatctgcttctcgccgctggtgcggatattgccgttgtccaccgtcaaatctatggtggtcgcgtttttcgccaactgttcatacgcttccgcacccggcccgccggtaatgacaaactgcggattgtggcggtgcagggattcgcaatcgggctcaaacagcgtccccaccgttgccgccttgtcaaatgcaggctgcaaatag

SEQ ID NO: 166 - protein, 201 aa, Neisseria gonorrhoeae
MTMICLRFQAFVPHTSALSNTSTAAGPSCPMAAVRSMMKIQPGFFSLMYSKETGCPCPSLRKDSSTGGRPMSPCIQLANRDCVPKADTLLPVTDSTSPRPLPLAASRFWANSASICAFNSATRASLPKIRDRVSICFSPLVRILPLSTVKSMVVAFFANCSYASAPGPPVMTNCGLWRCRDSQSGSNSVPTVAALSNAGCK

SEQ ID NO: 167 - DNA, 606 bp, Neisseria meningitidis
atgacgatgatttgcttgcgcttccaagcgttcgtgccgcgtaccagcgcgttatccamtacttcgacagccgccggccyttcytgcccgatggcggcggtacggtcgatgatgaaaatccaatcggggtttttctctttgatgtattcgaaggaaacaggctgcccgtgcccctcgttgcgtaaagattcgtctacaggcggtaggccgatgtcgccgtgtatccaacttgccaaccgcgactgcgtgccgaaggcggacaccttgttgcccgtaaccgacagcaccagcccgcgtcctttgcctttggcggcttcgcgcgtttgggcgaacagcgcgtcaatctgcgccttcaattccgccgcgcgcgcttccttgccgaaaatccgcgccaaggtctccatctgcttttcgccgctggtgcggatattgccgttgtccaccgtcagatctatggtggtcgcgtttttcgctaactgttcatacgcttccgcgcccggcccgccggtaatgacaagctgaggattgtagcggtgcagggcttcgtaatcgggctcgaacagcgtccccaccgttgccgccttgtcaaatgcaggctgcaaataa

SEQ ID NO: 168 - protein, 201 aa, Neisseria meningitidis
  misc_feature (20)..(20): Xaa can be any naturally occurring amino acid
  misc_feature (27)..(27): Xaa can be any naturally occurring amino acid
  misc_feature (174)..(174): Xaa can be any naturally occurring amino acid
  misc_feature (177)..(177): Xaa can be any naturally occurring amino acid
  misc_feature (183)..(183): Xaa can be any naturally occurring amino acid
MTMICLRFQAFVPRTSALSXTSTAAGXSCPMAAVRSMMKIQSGFFSLMYSKETGCPCPSLRKDSSTGGRPMSPCIQLANRDCVPKADTLLPVTDSTSPRPLPLAASRVWANSASICAFNSAARASLPKIRAKVSICFSPLVRILPLSTVRSMVVAFFANCSYASAPGPPVMTSXGLXRCRASXSGSNSVPTVAALSNAGCK

SEQ ID NO: 169 - DNA, 606 bp, Neisseria meningitidis
atgacgatgatttgcttgcgcttccaagcgttcgtgccgcgtaccagcgcgttatccaatacttcgacagccgccggcccttcctgcccgatggcggcggtacggtcgatgatgaaaatccaatcggggtttttctctttgatgtattcgaaggaaacaggctgcccgtgcccctcgttgcgtaaagattcgtctacaggcggtaggccgatgtcgccgtgtatccaacttgccaaccgcgactgcgtgccgaaggcggacaccttgttgcccgtaaccgacagcaccagcccgcgtcctttgcctttggcggcttcgcgcgtttgggcgaacagcgcgtcaatctgcgccttcaattccgccgcgcgcgcttccttgccgaaaatccgcgccaaggtctccatctgcttttcgccgctggtgcggatattgccgttgtccaccgtcagatctatggtggtcgcgtttttcgccaactgttcatacgcttccgcgcccggcccgccggtaatgacaagctgaggattgtagcggtgcagggcttcgtaatcgggctcgaacagcgtccccaccgttgccgccttgtcaaatgcaggctgcaaataa

SEQ ID NO: 170 - protein, 198 aa, Neisseria meningitidis
MTMICLRFQAFVPRTSALSNTSTAAGPSCPMAAVRSMMKIQSGFFSLMYSKETGCPCPSLRKDSSTGGRPMSPCIQLANRDCVPKADTLLPVTDSTSPRPLPLAASRVWANSASICAFNSAARASLPKIRAKVSICFSPLVRILPLSTVRSMVVAFFANCSYASAPGPPVMTSGLRCRASSGSNSVPTVAALSNAGCK

SEQ ID NO: 171 - DNA, 511 bp, Neisseria meningitidis
atgacgatgatttgcttgcgcttccaagcgttcgtgccgcgtaccagcgcgttatccaatacttcgacagccgccggcccttcctgcccgatggcggcggtacggtcgatgatgaaaatccaatcggggtttttctctttgatgtattcgaaggaaacaggctgcccgtgcccctcgttgcgtaaagattcgtctacaggcggtaggccgatgtcgccgtgtatccaacttgccaaccgcgactgcgtgccgaaggcggacaccttgttgcccgtaaccgacagcaccagcccgcgtcctttgcctttggcggcttcgcgcgtttgggcgaacagcgcgtcaatctgcgccttcaattccgccgcgcgcgcttccttgccgaaaatccgcgccaaggtctccatctgcttttcgccgctggtgcggatattgccgttgtccaccgtcagatctatggtggtcgcgtttttcgctaactgttcatacgcttccgcgcccggcccgccggtaa

SEQ ID NO: 172 - protein, 173 aa, Neisseria meningitidis
MTMICLRFQAFVPRTSALSNTSTAAGPSCPMAAVRSMMKIQSGFFSLMYSKETGCPCPSLRKDSSTGGRPMSPCIQLANRDCVPKADTLLPVTDSTSPRPLPLAASRVWANSASICAFNSAARASLPKIRAKVSICFSPLVRILPLSTVRSMVVAFFANCSYASAPGPPVMTS

SEQ ID NO: 173 - DNA, 511 bp, Neisseria meningitidis
atgacgatgatttgcttgcgcttccaagcgttcgtgccgcgtaccagcgcgttatccaatacttcgacagccgccggcccttcctgcccgatggcggcggtacggtcgatgatgaaaatccaatcggggtttttctctttgatgtattcgaaggaaacaggctgcccgtgcccctcgttgcgtaaagattcgtctacaggcggtaggccgatgtcgccgtgtatccaacttgccaaccgcgactgcgtgccgaaggcggacaccttgttgcccgtaaccgacagcaccagcccgcgtcctttgcctttggcggcttcgcgcgtttgggcgaacagcgcgtcaatctgcgccttcaattccgccgcgcgcgcttccttgccgaaaatccgcgccaaggtctccatctgcttttcgccgctggtgcggatattgccgttgtccaccgtcagatctatggtggtcgcgtttttcgccaactgttcatacgcttccgcgcccggcccgccggtaa

SEQ ID NO: 174 - protein, 173 aa, Neisseria meningitidis; identical to SEQ ID NO: 172

SEQ ID NO: 175 - DNA, 387 bp, Neisseria gonorrhoeae
atggttgtttcaaatcaaaatatctatgccgtcggcccatcagcactttttcacatccgaaggcaaaaatccgtaatgccgcctgaacgcttcgttgaaccgtcccgcgtggcggtagccgcaaaagtgcatcgcggcttggatggtgctgcccgattcgatgagggcgagcgcgtgttccagccgcaggcggcgcaggcgtccggcgacggtttcgccggtttgcgctttgaaatagcgtttcaggtagcattcgttcagcccgacgcggcgggcgatttcggcgatggtcagcgggcgggcgaattcgctgttcaaaatatcggcggcttcgtctatgcgccggcggcggtagccgttgtcgtggcggcggaaggtgaagcgtaa

SEQ ID NO: 176 - protein, 128 aa, Neisseria gonorrhoeae
MVVSNQNIYAVGPSALFHIRRQKSVMPPERFVEPSRVAVAAKVHRGLDGAARFDEGERVFQPQAAQASGDGFAGLRFEIAFQVAFVQPDAAGDFGDGQRAGEFAVQNIGGFVYAPAAVAVVVAAEGEA

SEQ ID NO: 177 - DNA, 390 bp, Neisseria meningitidis
atggttgtttcaaatcaaaatatctatgccgccggcccctcagcacttcttcacatccgaaggcaaaaatccgtaatgccgtctgaacgcttcgttgaaccgtcccgcgtggcggtagccgcaaaagtgcatggcggcttggacggtgctgccggattcgatgagggcgagcgcgtgttccagccgcaggcggcgcaggcatccggcgacggtttcgccggtttgcgctttgaaatagcgtttcaggtagcattcgttcagtccgacgcggcgggcgatttcggcgatggtcagcggacgggcgaattcgtgttgcaggatgtcggcggcttcgtctatgcgccgacggcggtaaccgttgtcgtggcggcggaaggtgaagcgcaataa

SEQ ID NO: 178 - protein, 129 aa, Neisseria meningitidis
MVVSNQNIYAAGPSALLHIRRQKSVMPSERFVEPSRVAVAAKVHGGLDGAAGFDEGERVFQPQAAQASGDGFAGLRFEIAFQVAFVQSDAAGDFGDGQRTGEFVLQDVGGFVYAPTAVTVVVAAEGEAQ

SEQ ID NO: 179 - DNA, 390 bp, Neisseria meningitidis; identical to SEQ ID NO: 177

SEQ ID NO: 180 - protein, 129 aa, Neisseria meningitidis; identical to SEQ ID NO: 178

SEQ ID NO: 181 - DNA, 270 bp, Neisseria gonorrhoeae
atgctgcccgaccagagcgtcgagttcttgccacaagtcgtcgtttttgacgggctgtttggcggcggttttccagccgttgcgcttccaaccgtgtatccagttttccatgccgtttttgacgtattgcgagtcggtgcagatgatgacggtgcagcggcgtttgagcgatttcagcccttcgataacggcggtcagctccatgcggttgttggtggtttgcgcttcgccgccgaaaagttctttttcgcggctgccgtagcgcattaa

SEQ ID NO: 182 - protein, 89 aa, Neisseria gonorrhoeae
MLPDQSVEFLPQVVVFDGLFGGGFPAVALPTVYPVFHAVFDVLRVGADDDGAAAFERFQPFDNGGQLHAVVGGLRFAAEKFFFAAAVAH

SEQ ID NO: 183 - DNA, 270 bp, Neisseria meningitidis
atgccgtccgactagagcgtcgagttctttccagaagtcgtcgtttttgacgggctgtttggaggcggttttccagccgttgcgcttccaaccgtgtatccagttttccatgccatttttgacgtattgcgagtcggtgcagatgatgacggtgcagcggcgtttgagcgatttcagtccttcgatgacggcagtcagttccatgcggttgttggtggtttgcgcttcgccgccgaaaagttctttttcgtggctaccgtagcgcaytaa

SEQ ID NO: 184 - protein, 89 aa, Neisseria meningitidis
  misc_feature (5)..(5): Xaa can be any naturally occurring amino acid
MPSDXSVEFFPEVVVFDGLFGGGFPAVALPTVYPVFHAIFDVLRVGADDDGAAAFERFQSFDDGSQFHAVVGGLRFAAEKFFFVATVAH

SEQ ID NO: 185 - DNA, 270 bp, Neisseria meningitidis
gtgccgtccgaccagcgcgtcgagttctttccacaagtcgtcgtttttgacgggctgtttggcggcggttttccagccgttgcgcttccaaccgtgtatccagttttccatgccgtttttgacgtattgcgagtcggtgcagatgatgacggtgcagcggcgtttgagcgatttcagtccttcgatgacggcggtcagttccatacggttgttggtggtttgcgcttcgccgccgaaaagttctttttcgtggctgccgtagcgcattaa

SEQ ID NO: 186 - protein, 89 aa, Neisseria meningitidis
VPSDQRVEFFPQVVVFDGLFGGGFPAVALPTVYPVFHAVFDVLRVGADDDGAAAFERFQSFDDGGQFHTVVGGLRFAAEKFFFVAAVAH

SEQ ID NO: 187 - DNA, 561 bp, Neisseria gonorrhoeae
atgtcggcaatgctgcgtccgacaagcagcccgccgcgccgcgcctgtatgatgaccatccgcacgcggtcgtctgcaaaacgtaaaacctgcaatgcgcccgggcagtctatcaggccggcaagctgttcggtaacgagctgttcggggctgatggtttcggttatgccgaatatggaaaggctgccgttttcgttgttttcgagcttggggctgaggtattcgaggtattcgctggaacggacgcgcgcgatgcggccggggatgttgaacaggtcggcggcaactttgcaggcgacgatgttggtttcgtcgctgcgggagagcgcgagcagcaagtcggcatcttccgcgccggcgcgttataatgtgaagggggatgcgccgttgccgaaaacggtttggacatcgaggcggctgcctgtttcctgcaatgctttttcgtcgatgtcgataacggttacgtcgttgttggtgatggcggcaaggttttgcgcgacggtagaacctacctgcccgttgcctaaaatgaggattttcacggtatgggtcgccgggtga

SEQ ID NO: 188 - protein, 186 aa, Neisseria gonorrhoeae
MSAMLRPTSSPPRRACMMTIRTRSSAKRKTCNAPGQSIRPASCSVTSCSGLMVSVMPNMERLPFSLFSSLGLRYSRYSLERTRAMRPGMLNRSAATLQATMLVSSLRESASSKSASSAPARYNVKGDAPLPKTVWTSRRLPVSCNAFSSMSITVTSLLVMAARFCATVEPTCPLPKMRIFTVWVAG

SEQ ID NO: 189 - DNA, 559 bp, Neisseria meningitidis
atgtcggcaatgctgcgtccgacaagcastccgcrsgcgcgcctgtatgatgaccatccgcacgcggtcgtctgcaaaacgtaaaacctgcaatgcgcccgggcagtctatcaggccggcaagctgttcggtaacgagctgttcggggctgatggtttcggttatgccgaatatggaaaggctgccgttttcgttgttttcgagcttggggctgaggtattcgaggtattcgctggaacggacgcgcgcgatgcggccggggatgttgaacaggtcggcggcaactttgcaggcgacgatgttggtttcgtcgctgcgggagagcgcgagcagcaagtcggcatcttccgcgccggcgcgttctaatgtgaagggggatgcgccgttgccgaaaacggtttggacatcgaggcggctgcctgtttcctgcaatgctttttcgtcgatgtcgataacggttacgtcgttgttgggtatggcggcaaggttttgtgcgacggtagaacctacctgtccgttgcctaaaatgaggattttcacggtgtgggtcgccgagtga

SEQ ID NO: 190 - protein, 186 aa, Neisseria meningitidis
  misc_feature (10)..(10): Xaa can be any naturally occurring amino acid
  misc_feature (12)..(13): Xaa can be any naturally occurring amino acid
MSAMLRPTSXPXXRACMMTIRTRSSAKRKTCNAPGQSIRPASCSVTSCSGLMVSVMPNMERLPFSLFSSLGLRYSRYSLERTRAMRPGMLNRSAATLQATMLVSSLRESASSKSASSAPARSNVKGDAPLPKTVWTSRRLPVSCNAFSSMSITVTSLLGMAARFCATVEPTCPLPKMRIFTVWVAE

SEQ ID NO: 191 - DNA, 561 bp, Neisseria meningitidis
atgtcggcaatgctgcgtccgacaagcagtccgccgcgccgcgcctgtatgatgaccatccgcacgcggtcgtctgcaaaacgtaaaacctgcaatgcgcccgggcagtctatcaggccggcaagctgttcggtaacgagctgttcggggctgatggtttcggttatgccgaatatggaaaggctgccgttttcgttgttttcgagcttggggctgaggtattcgaggtattcgctggaacggacgcgcgcgatgcggccggggatgttgaacaggtcggcggcaactttgcaggcgacgatgttggtttcgtcgctgcgggagagcgcgagcagcaagtcggcatcttccgcgccggcgcgttctaatgtgaagggggatgcgccgttgccgaaaacggtttggacatcgaggcggctgcctgtttcctgcaatgctttttcgtcgatgtcgataacggttacgtcgttgttgggtatggcggcaaggttttgtgcgacggtagaacctacctgtccgttgcctaaaatgaggattttcacggtgtgggtcgccgagtga

SEQ ID NO: 192 - protein, 186 aa, Neisseria meningitidis
MSAMLRPTSSPPRRACMMTIRTRSSAKRKTCNAPGQSIRPASCSVTSCSGLMVSVMPNMERLPFSLFSSLGLRYSRYSLERTRAMRPGMLNRSAATLQATMLVSSLRESASSKSASSAPARSNVKGDAPLPKTVWTSRRLPVSCNAFSSMSITVTSLLGMAARFCATVEPTCPLPKMRIFTVWVAE

SEQ ID NO: 193 - DNA, 930 bp, Neisseria gonorrhoeae
atggtcatcatacaggcgcggcgcggcgggctgcttgtcggacgcagcattgccgacatcgcccaagatttgcccgacggggccgactgccaaatctgcgccgtttaccgcaacaaccgcctcatcgtccccgcgccgcaaaccgtcatcatcgaaggcgacgaaatcctgtttgccgccgccgccgaaaacatcggggcggtcatacccgaattgcgccccaaagaaaccagcacccgccgcatcatgattgccggcggcggcaacatctgctaccgcctcgccaagcagctcgaacacgcatacaacgtcaaaatcatcgaatgccggccgcgccgtgccgaatggatagccgaaaacctcgacaacaccctcgtcctgcaaggttcggcaaccgacgaaaccctgctcgacaacgaatacatcgacgaaatcgacgtattctgcgccctgaccaacgacgacgaaagcaacattatgtccgcccttttggcgaaaaacctcggcgcgaagcgcgtcatcggcatcgtcaaccgctcaagctacgtcgatttgctcgaaggcaacaaaatcgacatcgtcgtctccccccacctcatcaccatcggctcgatactcgcccacatccggcgcggcgacatcgttgccgtccaccccatccggcgcggcacggcggaagccatcgaagtcgtcgcgcacggcgacaaaaaaacttccgccatcatcggcaggcgcatcagcggcatcaaatggcccgaaggctgccacattgccgccgtcgtccgcgccggaaccggcgaaaccattatgggacaccataccgaaaccgtcatccaagacggtgaccacatcatctttttcgtctcgcgccggcgcatcctgaacgaactggagaaactcatccaagtcaaaatgggctttttcggataa

SEQ ID NO: 194 - protein, 309 aa, Neisseria gonorrhoeae
MVIIQARRGGLLVGRSIADIAQDLPDGADCQICAVYRNNRLIVPAPQTVIIEGDEILFAAAAENIGAVIPELRPKETSTRRIMIAGGGNICYRLAKQLEHAYNVKIIECRPRRAEWIAENLDNTLVLQGSATDETLLDNEYIDEIDVFCALTNDDESNIMSALLAKNLGAKRVIGIVNRSSYVDLLEGNKIDIVVSPHLITIGSILAHIRRGDIVAVHPIRRGTAEAIEVVAHGDKKTSAIIGRRISGIKWPEGCHIAAVVRAGTGETIMGHHTETVIQDGDHIIFFVSRRRILNELEKLIQVKMGFFG

SEQ ID NO: 195 - DNA, 937 bp, Neisseria meningitidis
atggtcatcatacaggcgcgcsygcggastgcttgtcggacgcagcattgccgacatcgcccaagatttgcccgacggggccgactgccaaatctgcgccgtttaccgcaacaaccgcctcatcgtccccgcgccgcaaaccgtcatcatcgaaggcgacgaaatcctatttgccgccgccgccgaaaacatcggcgcggtcatacccgaattgcgccccaaagaaacccaaagaaaccagcccmgmmgcatcatgattkccggcggcggcaacatcggctaccgtctcgccaagcagctcgaacacgcatacaacgtyaaaatcatcgaatgccggccgcgccgtgccgaatggatagccgaaaacctcgacaacaccctcgtcytgcaaggttcggcaaccgacgaaaccctgctcgacaacgaatacatcgacgaaatcgacgtattctgcgccctgaccaacgacgacgaaagcaacattatgtccgcccttttggcgaaaaacctcggcgcgaagcgcgtcatcggcatcgtcaaccgctcaagctacgtcgatttgctcgaaggcaacaaaatcgacatcgtcgtctccccccacctcatcaccatcggctcgatactcgcccacatccggcgcggcgacatcgttgccgtccaccccatccggcgcggcacggcggaagccatcgaagtcgtcgcacacggcgacaaaaaaacttccgccatcatcggcaggcgcatcagcggcatcaaatggcccgaaggctgccacattgccgccgtcgtccgcgccggaaccggcgaaaccattatgggacaccataccgaaaccgtcatccaagacggcgaccacatcatctttttcgtctcgcgccggcgcatcctgaacgaactggaaaaactcatccaggtcaaaatgggctttttcggataa

SEQ ID NO: 196 - protein, 312 aa, Neisseria meningitidis
  misc_feature (8)..(9): Xaa can be any naturally occurring amino acid
  misc_feature (11)..(11): Xaa can be any naturally occurring amino acid
  misc_feature (83)..(84): Xaa can be any naturally occurring amino acid
  misc_feature (88)..(88): Xaa can be any naturally occurring amino acid
MVIIQARXXGXLVGRSIADIAQDLPDGADCQICAVYRNNRLIVPAPQTVIIEGDEILFAAAAENIGAVIPELRPKETQRNQPXXIMIXGGGNIGYRLAKQLEHAYNVKIIECRPRRAEWIAENLDNTLVLQGSATDETLLDNEYIDEIDVFCALTNDDESNIMSALLAKNLGAKRVIGIVNRSSYVDLLEGNKIDIVVSPHLITIGSILAHIRRGDIVAVHPIRRGTAEAIEVVAHGDKKTSAIIGRRISGIKWPEGCHIAAVVRAGTGETIMGHHTETVIQDGDHIIFFVSRRRILNELEKLIQVKMGFFG

SEQ ID NO: 197 - DNA, 930 bp, Neisseria meningitidis
atggtcatcatacaggcgcggcgcggcggactgcttgtcggacgcagcattgccgacatcgcccaagatttgcccgacggggccgactgccaaatctgcgccgtttaccgcaacaaccgcctcatcgtccccgcgccgcaaaccgtcatcatcgaaggcgacgaaatcctatttgccgccgccgccgaaaacatcggcgcggtcatacccgaattgcgccccaaagaaaccagcacccgccgcatcatgattgccggcggcggcaacatcggctaccgtctcgccaagcagctcgaacacgcatacaacgtcaaaatcatcgaatgccggccgcgccgtgccgaatggatagccgaaaacctcgacaacaccctcgtcctgcaaggttcggcaaccgacgaaaccctgctcgacaacgaatacatcgacgaaatcgacgtattctgcgccctgaccaacgacgacgaaagcaacattatgtccgcccttttggcgaaaaacctcggcgcgaagcgcgtcatcggcatcgtcaaccgctcaagctacgtcgatttgctcgaaggcaacaaaatcgacatcgtcgtctccccccacctcatcaccatcggctcgatactcgcccacatccggcgcggcgacatcgttgccgtccaccccatccggcgcggcacggcggaagccatcgaagtcgtcgcacacggcgacaaaaaaacttccgccatcatcggcaggcgcatcagcggcatcaaatggcccgaaggctgccacattgccgccgtcgtccgcgccggaaccggcgaaaccattatgggacaccataccgaaaccgtcatccaagacggcgaccacatcatctttttcgtctcgcgccggcgcatcctgaacgaactggaaaaactcatccaagtcaaaatgggctttttcggataa

SEQ ID NO: 198 - protein, 309 aa, Neisseria meningitidis
MVIIQARRGGLLVGRSIADIAQDLPDGADCQICAVYRNNRLIVPAPQTVIIEGDEILFAAAAENIGAVIPELRPKETSTRRIMIAGGGNIGYRLAKQLEHAYNVKIIECRPRRAEWIAENLDNTLVLQGSATDETLLDNEYIDEIDVFCALTNDDESNIMSALLAKNLGAKRVIGIVNRSSYVDLLEGNKIDIVVSPHLITIGSILAHIRRGDIVAVHPIRRGTAEAIEVVAHGDKKTSAIIGRRISGIKWPEGCHIAAVVRAGTGETIMGHHTETVIQDGDHIIFFVSRRRILNELEKLIQVKMGFFG

SEQ ID NO: 199 - DNA, 453 bp, Neisseria gonorrhoeae
atgctcgacaaaggcgaggagttgcccgtcgatttcaccaaccgcctgatttactacgtcggccccgtcgatccggtcggcgatgaagtcgtcggtcccgcaggtccgaccacagccacccgcatggacaaatttacccgccaaatgctcaaacaaaccggcctcttgggcatgatcggcaaatccgagcgcggcgcggccacctgcgaagccatcgccgacaacaaggccgtgtacctcatggcagtcggcggcgcggcatacctcgtggcaaaagccatcaaatcttccaaagtcttggcgttccccgaattgggtatggaagccgtttacgaatttgaagtcaaagatatgcccgtaaccgtcgccgtggacagcaaaggcgaatccatccacgccaccgccccgcgcaaatggcaggcgaaaatcggcatcatccccgtcgagtcttga

SEQ ID NO: 200 - protein, 150 aa, Neisseria gonorrhoeae
MLDKGEELPVDFTNRLIYYVGPVDPVGDEVVGPAGPTTATRMDKFTRQMLKQTGLLGMIGKSERGAATCEAIADNKAVYLMAVGGAAYLVAKAIKSSKVLAFPELGMEAVYEFEVKDMPVTVAVDSKGESIHATAPRKWQAKIGIIPVES

SEQ ID NO: 201 - DNA, 453 bp, Neisseria meningitidis
atgctcaacaaaggcgaagaattgcccgtcgatttcaccaaccgcctgatttactacgtcggccccgtcgatccggtcggcgatgaagtcgtcggtccggcaggtccgaccacagccacccgcatggacaaattcacccgccaaatgctcgaacaaaccgacctcttgggcatgatcggcaaatccgagcgcggcgtggccacctgcgaagccatcgccgacaacaaagccgtgtacctcatggcagtcggcggcgcggcgtatctcgtggcaaaagccatcaaatcttccaaagtcttggcgttccccgaattgggcatggaagccatttacgaatttgaagtcaaagacatgcccgtaaccgtcgccgtagatagcaaaggcgaatccatccacgccaccgccccgcgcaaatggcaggcgaaaatcggcatcatccccgtcgaatcttga

SEQ ID NO: 202 - protein, 150 aa, Neisseria meningitidis
MLNKGEELPVDFTNRLIYYVGPVDPVGDEVVGPAGPTTATRMDKFTRQMLEQTDLLGMIGKSERGVATCEAIADNKAVYLMAVGGAAYLVAKAIKSSKVLAFPELGMEAIYEFEVKDMPVTVAVDSKGESIHATAPRKWQAKIGIIPVES

SEQ ID NO: 203 - DNA, 453 bp, Neisseria meningitidis
atgctcgacaaaggcgaagaattgcccgtcgatttcaccaaccgcctgatttactacgtcggccccgtcgatccggtcggcgacgaaatcgtcggcccagcaggtccgaccaccgccacccgcatggacaaattcacccgccaaatgctcgaacaaaccgacctcttgggcatgatcggcaaatccgagcgcggcgcggccacctgcgaagccatcgccgacaacaaagccgtgtacctcatggcagtcggcggcgcggcgtatctcgtggcaaaagccatcaaatcttccaaagtcttggcgttccccgaattgggcatggaagccatttacgaatttgaagtcaaagacatgcccgtaaccgtcgccgtagacagcaaaggcgaatccatccacgccaccgccccgccccaatggcaggcgaaaatcggcatcatccccgtcaaatcttga

SEQ ID NO: 204 - protein, 150 aa, Neisseria meningitidis
MLDKGEELPVDFTNRLIYYVGPVDPVGDEIVGPAGPTTATRMDKFTRQMLEQTDLLGMIGKSERGAATCEAIADNKAVYLMAVGGAAYLVAKAIKSSKVLAFPELGMEAIYEFEVKDMPVTVAVDSKGESIHATAPPQWQAKIGIIPVKS

SEQ ID NO: 205 - DNA, 420 bp, Neisseria gonorrhoeae
atgcgggcgcaggcgtttgatcaaccgttcggtcagctcctgttcggacaggcagaacacttcgcgccggttgacggctttcgggttcaggatattgatttggacgggcatcaacgcctcttccgcaccgccttcgccgttttccgcaaccccgtctgccgccgtaccggattctgccgcatcggcgttttccccgccctcaatctgtgcggtttcaaattcggcactgtcttttttggcatcgaaccggattctccgccgcgattcgatgtgtttttccgaaaccggcatttgcagggaagcctgcgcgttgagccagttttcctgaaggacgatcatcgggtcggtttcgacttcctcgccgcaatcggcaacggcgctgttgtgttcttcctgccatttcttcagatacgcctttaa

SEQ ID NO: 206 - protein, 139 aa, Neisseria gonorrhoeae
MRAQAFDQPFGQLLFGQAEHFAPVDGFRVQDIDLDGHQRLFRTAFAVFRNPVCRRTGFCRIGVFPALNLCGFKFGTVFFGIEPDSPPRFDVFFRNRHLQGSLRVEPVFLKDDHRVGFDFLAAIGNGAVVFFLPFLQIRL

SEQ ID NO: 207 - DNA, 417 bp, Neisseria gonorrhoeae
atgcgggcgcaggcgtttgatcagccgttcggtcagctcctgttcggacaggcagaacacttcgcgccggttgacggctttcgggttcaggatattgatttggacgggcatcaacgtttcttccgcatcgttttccccgttttccgaaaccgccggctcattcgtgccggattctgcctcgtcggcgttttccccgctttcaatctgtccggtttcaaattcgacactgtcttttttggtatcaaaccggattctccgccgcgattcgatgtgtttttccgaaaccgacatttgcagggaagcctgcgcgttgagccagttttcctgaaggacgatcatcgggtcggtttcgacttcctcgccgcaatcggcaacggcggcattgtgttcctcctgccattttttcagatacgcctt

SEQ ID NO: 208 - protein, 139 aa, Neisseria meningitidis
MRAQAFDQPFGQLLFGQAEHFAPVDGFRVQDIDLDGHQRFFRIVFPVFRNRRLIRAGFCLVGVFPAFNLSGFKFDTVFFGIKPDSPPRFDVFFRNRHLQGSLRVEPVFLKDDHRVGFDFLAAIGNGGIVFLLPFFQIRL

SEQ ID NO: 209 - DNA, 417 bp, Neisseria meningitidis
atgcgggcgcaggcgtttgatcagccgttcggtcagctcctgttcggacaggcagaacacttcgcgccggttgacggctttcgggttcagaatattgatttggacgggcatcaacgcttcttccgcaccgccttcgccgttttccgcaaccccgtctgccgccgtacccgattctgccgcatcggcgttttccccgccttcaatctgtccggtttcaaattcggcactgtcttttttggcatcaaaccggattctccgccgcgattcgatgtgtttttccgaaaccgacatttgcagggaagcctgcgcgttgagccagttttcctgaaggacgatcatcgggtcggtttcgacttcctcgccgcaatcggcaacggcggcattgtgttcctcctgccattttttcagatacgcctt

SEQ ID NO: 210 - protein, 139 aa, Neisseria meningitidis
MRAQAFDQPFGQLLFGQAEHFAPVDGFRVQNIDLDGHQRFFRTAFAVFRNPVCRRTRFCRIGVFPAFNLSGFKFGTVFFGIKPDSPPRFDVFFRNRHLQGSLRVEPVFLKDDHRVGFDFLAAIGNGGIVFLLPFFQIRL

SEQ ID NO: 211 - DNA, 384 bp, Neisseria gonorrhoeae
atgggcgcgggctggtgtcctcccggcatcttgggcatcggcatcggcggcacgcccgaaaaagccgtgttgatggcaaaagaatccctgatgagccacatcgacatccaagaattgcaggaaaaagccgcgtccggggcggaattgtccaccaccgaagccctgcgcctcgaactctttgaaaaggtcaacgcgctgggcatcggcgcgcaaggcttgggcggtctgaccaccgtgttggacgtgaaaatcctcgattacccgacccatgccgcctccaaaccgattgccatgattcccaactgtgccgccacccgccacgtcgaatttgaattggacggctcaggtcctgtcgaactcacgccgccgcgtgtcgaagactga

SEQ ID NO: 212 - protein, 127 aa, Neisseria gonorrhoeae
MGAGWCPPGILGIGIGGTPEKAVLMAKESLMSHIDIQELQEKAASGAELSTTEALRLELFEKVNALGIGAQGLGGLTTVLDVKILDYPTHAASKPIAMIPNCAATRHVEFELDGSGPVELTPPRVED

SEQ ID NO: 213 - DNA, 298 bp, Neisseria meningitidis
atgggcgcgggctggtgtcctcccggcatcttgggtatcggcatcggcggcagccgaaaaagccgtgctgatggcaaaagagtccctgatgagccacatcgacattcaagaattgcaggaaaaggccgcgtccggcgcggaattgtccaccaccgaagccctgcgcctcgaactctttgaaaaagtcaacgcgctgggcatcggcgcacaaggcttgggcggactgaccaccgtgttggacgtgaaaatcctcgattatccgacccacgccgcctccaaaccgattgccatgattccg

SEQ ID NO: 214 - protein, 130 aa, Neisseria meningitidis
  misc_feature (18)..(18): Xaa can be any naturally occurring amino acid
MGAGWCPPGILGIGIGGXAEKAVLMAKESLMSHIDIQELQEKAASGAELSTTEALRLELFEKVNALGIGAQGLGGLTTVLDVKILDYPTHAASKPIAMIPNCAATRHVEFELDGSGPVELTPPRVEDGPI

SEQ ID NO: 215 - DNA, 387 bp, Neisseria meningitidis
atgggcgcgggctggtgtcctcccggcatcttgggcatcggcatcggcggtacgcccgaaaaagccgtgttgatggcgaaagaatccctgatgagccacatcgacatccaagaattgcaggaaaaagccgcgtccggcgcggaattgtccaccaccgaagccctgcgcctcgaactctttgaaaaagtcaacgcgctaggcatcggcgcgcaaggcttgggcggtctgaccaccgtgttggacgtgaaaatcctcgattacccgacccacgccgcctccaaaccgattgccatgattccgaactgcgccgccacccgccacgtcgaatttgaattggacggctcaggccctgtcgaactcacgccgccgcgcgtcgaagactggccc

SEQ ID NO: 216 - protein, 129 aa, Neisseria meningitidis
MGAGWCPPGILGIGIGGTPEKAVLMAKESLMSHIDIQELQEKAASGAELSTTEALRLELFEKVNALGIGAQGLGGLTTVLDVKILDYPTHAASKPIAMIPNCAATRHVEFELDGSGPVELTPPRVEDWP

SEQ ID NO: 217 - DNA, 1524 bp, Neisseria gonorrhoeae
atgaccgttatcaagcaagaagactttattcaaagtatctgcgatgccttccaattcatcagctactaccatccaaaagactacatcgacgcgctttataaggcgtggcagaaggaagaaaatcccgccgccaaagacgcgatgacgcagattttggtcaacagccgtatgtgtgccgaaaacaaccgccccatctgccaagacacaggtatcgcaaccgtcttcctcaaagtcggtatggatgtgcaatgggatgcggacatgagcgtggaaaagatggttaacgaaggcgtacgccgcgcctacacttgggaaggcaacaccctgcgcgcttccgtcctcgccgatccggccggcaaacgccaaaacaccaaagacaacacccccgccgtcatccacatgagcatcgtgccgggcggtaaagtcgaagtaacctgcgcggcaaaaggcggcggctctgaaaacaaatccaaactcgctatgctcaacccttccgacaacatcgtcgattgggtattgaaaaccatcccgacgatgggcgcgggctggtgtcctcccggcatcttgggcatcggcatcggcggcacgcccgaaaaagccgtgttgatggcgaaagaatccctgatgagccacatcgacatccaagaattgcaggaaaaagccgcgtccggcgcggaattgtccaccaccgaagccctgcgcctcgaactctttgaaaaggtcaacgcgctgggcatcggcgcgcaaggcttgggcggtctgaccaccgtgttggacgtgaaaatcctcgattacccgacccatgccgcctccaaaccgattgccatgattcccaactgtgccgccacccgccacgtcgaatttgaattggacggctcaggtcctgtcgaactcacgccgccgcgcgtcgaagactgacccgatctgacttacagccccgacaacggcaaacgcgtcgatgtcgataagctgaccaaagaagaagtggcaagctggaaaaccggcgacgtattgctgttgaacggcaaaatcctcaccggccgcgatgccgcgcacaaacgcctcgtcaatatgctcgacaaaggcgaggagttgcccgtcgatttcaccaaccgcctgatttactacgtcggccccgtcgatccggtcggcgatgaagtcgtcggtcccgcaggtccgaccacagccacccgcatggacaaatttacccgccaaatgctcaaacaaaccggcctcttgggcatgatcggcaaatccgagcgcggcgcggccacctgcgaagccatcgccgacaacaaggccgtgtacctcatggcagtcggcggcgcggcatacctcgtggcaaaagccatcaaatcttccaaagtcttggcgttccccgaattgggtatggaagccgtttacgaatttgaagtcaaagatatgcccgtaaccgtcgccgtggacagcaaaggcgaatccatccacgccaccgccccgcgcaaatggcaggcgaaaatcggcatcatccccgtcgagtcttga

SEQ ID NO: 218 - protein, 506 aa, Neisseria gonorrhoeae
MTVIKQEDFIQSICDAFQFISYYHPKDYIDALYKAWQKEENPAAKDAMTQILVNSRMCAENNRPICQDTGIATVFLKVGMDVQWDADMSVEKMVNEGVRRAYTWEGNTLRASVLADPAGKRQNTKDNTPAVIHMSIVPGGKVEVTCAAKGGGSENKSKLAMLNPSDNIVDWVLKTIPTMGAGWCPPGILGIGIGGTPEKAVLMAKESLMSHIDIQELQEKAASGAELSTTEALRLELFEKVNALGIGAQGLGGLTTVLDVKILDYPTHAASKPIAMIPNCAATRHVEFELDGSGPVELTPPRVEDPDLTYSPDNGKRVDVDKLTKEEVASWKTGDVLLLNGKILTGRDAAHKRLVNMLDKGEELPVDFTNRLIYYVGPVDPVGDEVVGPAGPTTATRMDKFTRQMLKQTGLLGMIGKSERGAATCEAIADNKAVYLMAVGGAAYLVAKAIKSSKVLAFPELGMEAVYEFEVKDMPVTVAVDSKGESIHATAPRKWQAKIGIIPVES

SEQ ID NO: 219 - DNA, 1524 bp, Neisseria meningitidis
atgaccgtcatcaaacaggaagactttatccaaagcatttgcgatgccttccaattcatcagctactatcatcccaaagactacatcgacgcgctttataaggcgtggcagaaggaagaaaatcctgccgccaaagacgcgatgacgcagattttggtcaacagccgtatgtgtgcggaaaacaaccgccccatctgccaagacacaggtatcgcaaccgtcttcctcaaagtcggtatgaacgtccaatgggatgcggacatgagcgtggaagagatggttaacgaaggcgtacgccgcgcctacacttgggaaggcaatacgctgcgcgcttccgtcctcgccgatccggccggcaaacgccaaaacaccaaagacaacacccccgccgtcatccatatgagcatcgtgccgggcggtaaagtcgaagtaacctgcgcggcaaaaggcggcggctctgaaaacaaatccaaactcgccatgctcaatccttccgacaacatcgtcgattgggtattgaaaaccatcccgaccatgggcgcgggctggtgtcctcccggcatcttgggtatcggcatcggcggcacgcccgaaaaagccgtgctgatggcaaaagagtccctgatgagccacatcgacattcaagaattgcaggaaaaggccgcgtccggcgcggaattgtccaccaccgaagccctgcgcctcgaactctttgaaaaagtcaacgcgctgggcatcggcgcacaaggcttgggcggactgaccaccgtgttggacgtgaaaatcctcgattatccgacccacgccgcctccaaaccgattgccatgattccgaactgcgccgccacccgccacgtcgaatttgaattggacggctcaggccctgtcgaactcacgccgccgcgcgtcgaagactggcccgatttgacttacagccccgacaacggcaaacgcgtcgatgtcgacaagctgaccaaagaagaagtggcaagctggaaaaccggcgacgtattgctgttgaacggcaaaatcctcaccggccgcgatgccgcacacaaacgcctcgtcgatatgctcaacaaaggcgaagaattgcccgtcgatttcaccaaccgcctgatttactacgtcggccccgtcgatccggtcggcgatgaagtcgtcggtccggcaggtccgaccacagccacccgcatggacaaattcacccgccaaatgctcgaacaaaccgacctcttgggcatgatcggcaaatccgagcgcggcgtggccacctgcgaagccatcgccgacaacaaagccgtgtacctcatggcagtcggcggcgcggcgtatctcgtggcaaaagccatcaaatcttccaaagtcttggcgttccccgaattgggcatggaagccatttacgaatttgaagtcaaagacatgcccgtaaccgtcgccgtagatagcaaaggcgaatccatccacgccaccgccccgcgcaaatggcaggcgaaaatcggcatcatccccgtcgaatcttga

SEQ ID NO: 220 - protein, 507 aa, Neisseria meningitidis
MTVIKQEDFIQSICDAFQFISYYHPKDYIDALYKAWQKEENPAAKDAMTQILVNSRMCAENNRPICQDTGIATVFLKVGMNVQWDADMSVEEMVNEGVRRAYTWEGNTLRASVLADPAGKRQNTKDNTPAVIHMSIVPGGKVEVTCAAKGGGSENKSKLAMLNPSDNIVDWVLKTIPTMGAGWCPPGILGIGIGGTPEKAVLMAKESLMSHIDIQELQEKAASGAELSTTEALRLELFEKVNALGIGAQGLGGLTTVLDVKILDYPTHAASKPIAMIPNCAATRHVEFELDGSGPVELTPPRVEDWPDLTYSPDNGKRVDVDKLTKEEVASWKTGDVLLLNGKILTGRDAAHKRLVDMLNKGEELPVDFTNRLIYYVGPVDPVGDEVVGPAGPTTATRMDKFTRQMLEQTDLLGMIGKSERGVATCEAIADNKAVYLMAVGGAAYLVAKAIKSSKVLAFPELGMEAIYEFEVKDMPVTVAVDSKGESIHATAPRKWQAKIGIIPVES

SEQ ID NO: 221 - DNA, 1524 bp, Neisseria meningitidis
atgaccgtcatcaaacaggaagactttatccaaagcatttgcgatgccttccaattcatcagctactaccatcccaaagactacatcgacgcgctttataaggcgtggcagaaggaagaaaaccccgccgccaaagacgcgatgacgcagattttggtcaacagccgcatgtgtgccgaaaacaaccgccccatctgccaagataccggtatcgcgaccgtgtttttgaaagtcggtatggatgtgcaatgggatgcagacatgagcgtcgaagagatggttaacgaaggcgtgcgccgcgcctacacttgggaaggcaatacgctgcgcgcttccgttctcgccgaccccgccggcaaacgccaaaataccaaagacaacacgcccgccgtcatccatatgagcatcgtgccgggcgacaaagtcgaagtaacctgcgcggcaaaaggcggcggttctgaaaacaaatccaaactcgccatgctcaacccttccgacaacatcgtcgattgggtattgaaaaccattccgaccatgggcgcgggctggtgtcctcccggcatcttgggcatcggcatcggcggtacgcccgaaaaagccgtgttgatggcgaaagaatccctgatgagccacatcgacatccaagaattgcaggaaaaagccgcgtccggcgcggaattgtccaccaccgaagccctgcgcctcgaactctttgaaaaagtcaacgcgctaggcatcggcgcgcaaggcttgggcggtctgaccaccgtgttggacgtgaaaatcctcgattacccgacccacgccgcctccaaaccgattgccatgattccgaactgcgccgccacccgccacgtcgaatttgaattggacggctcaggccctgtcgaactcacgccgccgcgcgtcgaagactggcccgatttgacttacagccccgacaacggcaaacgcgtcgatgtcgacaagctgaccaaagaagaagtggcaagctggaaaaccggcgacgtattgctgttgaacggcaaaatcctcaccggccgcgatgccgcacacaaacgcctcgtcgatatgctcgacaaaggcgaagaattgcccgtcgatttcaccaaccgcctgatttactacgtcggccccgtcgatccggtcggcgacgaaatcgtcggcccagcaggtccgaccaccgccacccgcatggacaaattcacccgccaaatgctcgaacaaaccgacctcttgggcatgatcggcaaatccgagcgcggcgcggccacctgcgaagccatcgccgacaacaaagccgtgtacctcatggcagtcggcggcgcggcgtatctcgtggcaaaagccatcaaatcttccaaagtcttggcgttccccgaattgggcatggaagccatttacgaatttgaagtcaaagacatgcccgtaaccgtcgccgtagacagcaaaggcgaatccatccacgccaccgccccgccccaatggcaggcgaaaatcggcatcatccccgtcaaatcttga

SEQ ID NO: 222 - protein, 507 aa, Neisseria meningitidis
MTVIKQEDFIQSICDAFQFISYYHPKDYIDALYKAWQKEENPAAKDAMTQILVNSRMCAENNRPICQDTGIATVFLKVGMDVQWDADMSVEEMVNEGVRRAYTWEGNTLRASVLADPAGKRQNTKDNTPAVIHMSIVPGDKVEVTCAAKGGGSENKSKLAMLNPSDNIVDWVLKTIPTMGAGWCPPGILGIGIGGTPEKAVLMAKESLMSHIDIQELQEKAASGAELSTTEALRLELFEKVNALGIGAQGLGGLTTVLDVKILDYPTHAASKPIAMIPNCAATRHVEFELDGSGPVELTPPRVEDWPDLTYSPDNGKRVDVDKLTKEEVASWKTGDVLLLNGKILTGRDAAHKRLVDMLDKGEELPVDFTNRLIYYVGPVDPVGDEIVGPAGPTTATRMDKFTRQMLEQTDLLGMIGKSERGAATCEAIADNKAVYLMAVGGAAYLVAKAIKSSKVLAFPELGMEAIYEFEVKDMPVTVAVDSKGESIHATAPPQWQAKIGIIPVKS

SEQ ID NO: 223 - DNA, 360 bp, Neisseria gonorrhoeae
atggctttggtggcggaggaaacggaaatatccgcgccgtgtttcaaaggctgcgagccgacgggcgacagcaggctgttgtccaccaccaagagcgcgccgatgccgtgcgccaattccgccaaggcttccaagtcggccacttcgcccaaggggttggacggcgtttccaaaaacagcagtttggtgttggctttgacggcggctttccattcatttatatcagtcggcgacacgcggctcactccgatgccgaatttggtaacgatgttattgataaagccgacggtcgtgccgaacaggctgcggctggaaaccacatggtcgcccgcctgcaggaaggtgaaaaacgccgcctga

SEQ ID NO: 224 - protein, 119 aa, Neisseria gonorrhoeae
MALVAEETEISAPCFKGCEPTGDSRLLSTTKSAPMPCANSAKASKSATSPKGLDGVSKNSSLVLALTAAFHSFISVGDTRLTPMPNLVTMLLIKPTVVPNRLRLETTWSPACRKVKNAA

SEQ ID NO: 225 - DNA, 360 bp, Neisseria meningitidis; identical to SEQ ID NO: 223

SEQ ID NO: 226 - protein, 119 aa, Neisseria meningitidis; identical to SEQ ID NO: 224

SEQ ID NO: 227 - DNA, 360 bp, Neisseria meningitidis
atggctttggtcgcggaggaaacggaaatatccgcgccgtgtttcaaaggctgagagccgacaggcgacagcaggctgttgtccaccaccaagagcgcgccgatgccgtgcgccaattccgccaaggcttccaagtcggccacttctcccaagggattggacggcgtttccaaaaacagcagtttggtgttggctttgacggcggctttccattcgtttatatcagtcggcgacacgtgactcacttcgatgccgaatttggtaacgatgttattgataaagccgacggtcgtgccgaacaggctgcggctggaaatcacatggtcgcccgcctgcaaaaaggtgaaaaacgccgcctga

SEQ ID NO: 228 - protein, 117 aa, Neisseria meningitidis
MALVAEETEISAPCFKGEPTGDSRLLSTTKSAPMPCANSAKASKSATSPKGLDGVSKNSSLVLALTAAFHSFISVGDTLTSMPNLVTMLLIKPTVVPNRLRLEITWSPACKKVKNAA

SEQ ID NO: 229 - DNA, 387 bp, Neisseria gonorrhoeae
atgtgtatgccatacgcaataagggtttcagacggcatctgccgcatttttccgccgatgccgtctgaaacacgcaatcagcgcgcgagtgcctgtttcaaatcgtcaatcaaatcgccaacatattccaaaccgaccgacaggcgcaccagtccggggcggataccggcggcgagtttttcttcgggctgcatcctgccgtgcgtggttgtccacggattggtgatggtcgagcgcacgtcgccgaggttggcggtacgggaaaagagttccacgactttccacgcggctgcttggtcggcgacttcaaaaccgatgacgatgccgccgccgttttgctgtttgcggataagctccgcctgcggatggtcgggcaatccggtgtag

SEQ ID NO: 230 - protein, 128 aa, Neisseria gonorrhoeae
MCMPYAIRVSDGICRIFPPMPSETRNQRASACFKSSIKSPTYSKPTDRRTSPGRIPAASFSSGCILPCVVVHGLVMVERTSPRLAVREKSSTTFHAAAWSATSKPMTMPPPFCCLRISSACGWSGNPV

SEQ ID NO: 231 - DNA, 387 bp, Neisseria meningitidis
atgtgtatgccatataagataagggtttcagacggcatctgctgtccaatgccgtctgaaacacgcaatcagcgtgcgagtgcctgtttcaaatcgtcaatcaaatcgccaacatattccaaaccgaccgacaggcgcaccaatccggggcggatgttggcggcgagtttttcttcgggctgcatcctgccgtgcgtggttgtccacgggtgggtaatggtcgagcgcacgtcaccgaggttggcggtgcgggaaaagagttccacgccgtccacaactttccacgccgcttcttgatcggcaacttcaaagccgatgacgatgccgccgccgttttgctgtttgcggataagcgccgcctgaggatggtcggacaatccggtgtag

SEQ ID NO: 232 - protein, 128 aa, Neisseria meningitidis
  misc_feature (99)..(99): Xaa can be any naturally occurring amino acid
  misc_feature (121)..(121): Xaa can be any naturally occurring amino acid
MCMPYKIRVSDGICCPMPSETRNQRASACFKSSIKSPTYSKPTDRRTNPGRMLAASFSSGCILPCVVVHGWVMVERTSPRLAVREKSSTPSTTFHAASXSATSKPMTMPPPFCCLRISAAXGWSDNPV

SEQ ID NO: 233 - DNA, 395 bp, Neisseria meningitidis
acgtgtatgtcatataagataagggtttcagacggcatttgcggtgtttttccgccgatgccgtctgaacacgcaatcagcgcgcgagtgcctgtttcaaatcgtcaatcaaatcgccaacatattccaaaccgaccgacaggcgcaccaatccggggcggatgttggcggcgagtttttcttcgggctgcatcctgccgtgcgtggttgtccacggatgggtaatggtcgagcgcacgtcgccgaggttggcggtacgggagaaaagttcgacgccgtccacgactttccacgcggctgcttggtcggcgacttcaaagccgatgacgatgccgccgccgttttgctgtttgcggataagctccgcctgaggatggtcgggtaatccggtgtaa

SEQ ID NO: 234 - protein, 130 aa, Neisseria meningitidis
  misc_feature (24)..(24): Xaa can be any naturally occurring amino acid
TCMSYKIRVSDGICGVFPPMPSEXRNQRASACFKSSIKSPTYSKPTDRRTNPGRMLAASFSSGCILPCVVVHGWVMVERTSPRLAVREKSSTPSTTFHAAAWSATSKPMTMPPPFCCLRISSAGWSGNPV

SEQ ID NO: 235 - DNA, 414 bp, Neisseria gonorrhoeae
atgccgccttacttcatcaccctcttaacgatggaaaatacaaaaagcgcggcgaaaacgcccactacaatccaaccggcttccataccgtccgcttttgcggcttccaaagcgttttttgccgtttcgggcaacgctgcgtttgcctgtgccgccaaagccagcggggcggctgttacaacagccagttttgcgccgtatttacggcaggtgttaataaatttcatgatattttcctttacgaaatttttaaaaaaatgtgtttgcgggctttgtgaaggttttagagaccgcctgccgggcctcttaaacttaatcttctttttcgtagaatccgaaaattacaaattccccgcctatctcttccaatgccgagctaaaagcgtcttcatagctgtcatatttaccggctga

SEQ ID NO: 236 - protein, 137 aa, Neisseria gonorrhoeae
MPPYFITLLTMENTKSAAKTPTTIQPASIPSAFAASKAFFAVSGNAAFACAAKASGAAVTTASFAPYLRQVLINFMIFSFTKFLKKCVCGLCEGFRDRLPGLLNLIFFFVESENYKFPAYLFQCRAKSVFIAVIFTG

SEQ ID NO: 237 - DNA, 411 bp, Neisseria meningitidis
atgccgtcttacttcatcactctcttaacgatggaaaatacaaaaagcgcggcgaaaatgcccactacaatccaaccggcttccataccgtccgcttttgcggcttccaaagcgttttttgccgtatcgggcaacgttgcatttgcatgtgcggccaaagccaggggagcagctgttacaacagccagttttgcgccgtatttacggcaggtgttaataaatttcatgatattttccttcaaaaagtgtttggcggtaatggatggagcgtttttcagacgaccgccgaacatccgaaaatcagtctttcaaaaatccgaatacgacaaattcgtattggttgccgatttcttccaaacctgcgttaatcgcttcttcgaagtcgtagaaataatcggcattggtgattaa

SEQ ID NO: 238 - protein, 136 aa, Neisseria meningitidis
MPSYFITLLTMENTKSAAKMPTTIQPASIPSAFAASKAFFAVSGNVAFACAAKARGAAVTTASFAPYLRQVLINFMIFSFKKCLAVMDGAFFRRPPNIRKSVFQKSEYDKFVLVADFFQTCVNRFFEVVEIIGIGD

SEQ ID NO: 239 - DNA, 411 bp, Neisseria meningitidis
atgccgtcttacttcatcactctcttaacgatggaaaagacaaaaagcgcggcgaaaacgcccactacaatccaaccggcttccataccgtccgcttttgcggcttccaaagcgttttttgctgtatcgggcaacgttgcatttgcatgtgcggccaaagccaggggagcagctgttacaacagccagttttgcgccgtatttacggcaggtgttaataaatttcatgatattttccttcaaaaagtgtttggcggtaatggatggagcgtttttcagacgaccgccgaacatccgaaaatcagtctttcaaaaatccgaatacgacaaattcgtattggttgccgatttcttccaaacctgcgttaatcgcttcttcgaagtcgtagaaataatcggcattggtgattaa

SEQ ID NO: 240 - protein, 136 aa, Neisseria meningitidis
MPSYFITLLTMEKTKSAAKTPTTIQPASIPSAFAASKAFFAVSGNVAFACAAKARGAAVTTASFAPYLRQVLINFMIFSFKKCLAVMDGAFFRRPPNIRKSVFQKSEYDKFVLVADFFQTCVNRFFEVVEIIGIGD

SEQ ID NO: 241 - DNA, 828 bp, Neisseria gonorrhoeae
atgtgggataatgccgaagcgatggaacggctgacgcgctggctgcttgtcatgatggcgatgctgcttgctgcgtccgggctggtttggttttacaattcgaatcatctgcccgtcaagcaggtgtcgctgaagggcaacctggtttattccgataagaaggcattgggcagtttggcgaaagaatacatccatgggaatattttgaggacggacatcaatggcgcacaggaagcctaccgccggtatccgtggattgcgtcggtcatggtgcgccgccgttttcccgatacggttgaggtcgtcctgaccgagcgcaagccggttgcacgttggggcgaccatgccttggtggacggcgaaggcaatgtttttgaagcccgcttggacagacccggaatgccggtattcagaggcgcggaaggaacgtctgccgaaatgctccgccgttatgacgaattttcgactgttttggcaaaacagggtttgggcatcaaagagatgacctatacggcacgttcggcgtggaatgtcgttttggacaacggcatcaccgtcaggctcggacgggaaaacgagatgaaacgcctccggctttttaccgaagcgtggcagcatctgttgcgtaagaataaaaatcggttatcctatgtggatatgaggtataaggacggattttcagtcccccatgctcccgacggtttacccgaaaaagaatccgaagaatattgggaacaggtttgggacatattacggcctggcgtcggaaacggttcgacgcaaatttcaatcagttataagggcagacgaacaatggaacagcagtaa

SEQ ID NO: 242 - protein, 275 aa, Neisseria gonorrhoeae
MWDNAEAMERLTRWLLVMMAMLLAASGLVWFYNSNHLPVKQVSLKGNLVYSDKKALGSLAKEYIHGNILRTDINGAQEAYRRYPWIASVMVRRRFPDTVEVVLTERKPVARWGDHALVDGEGNVFEARLDRPGMPVFRGAEGTSAEMLRRYDEFSTVLAKQGLGIKEMTYTARSAWNVVLDNGITVRLGRENEMKRLRLFTEAWQHLLRKNKNRLSYVDMRYKDGFSVPHAPDGLPEKESEEYWEQVWDILRPGVGNGSTQISISYKGRRTMEQQ

SEQ ID NO: 243 - DNA, 729 bp, Neisseria meningitidis
atgtgggataatgccgaagcgatggaacggctgacgcgctggctgcttgtcatgatggcgatgctgcttgctgcgtccgggctggtttggttttacaattcgaatcatctgcccgtcaagcaggtgtcgctgaagggcaacctggtttattccgataagaagacattgggcagtttggcgaaagaatacatccatgggaatattttgaggacggacatcaatggcgcacaggaggcctaccgccggtatccgtggattgcgtcggtcatggtgcgccgccgttttcccgacacggttgaggtcgtcctgaccgagcgcaagccggtcgcgcgttggggcgaccatgccttggtggacggcgaaggcaatgtttttgaagcccgcttggacagacccggaatgccggtattcagaggcgcggaaggaacgtctgccgaaatgctccgccgttatgacgaattttcgactgttttggcaaaacagggtttgggcatcaaagagatgacctatacggcacgttcggcgtggattgtcgttttggacaacggcatcaccgtcaggctcggacgggaaaacgagatgaaacgcctccggctttttaccgaagcgtggcagcatctgttgcgtaaaaataaaaatcggttatcctatgtggatatgaggtataaggacggattttcagtccgctatgcttccgacggtttacccgaaaaagaatccgaagaatag

SEQ ID NO: 244 - protein, 242 aa, Neisseria meningitidis
MWDNAEAMERLTRWLLVMMAMLLAASGLVWFYNSNHLPVKQVSLKGNLVYSDKKTLGSLAKEYIHGNILRTDINGAQEAYRRYPWIASVMVRRRFPDTVEVVLTERKPVARWGDHALVDGEGNVFEARLDRPGMPVFRGAEGTSAEMLRRYDEFSTVLAKQGLGIKEMTYTARSAWIVVLDNGITVRLGRENEMKRLRLFTEAWQHLLRKNKNRLSYVDMRYKDGFSVRYASDGLPEKESEE

SEQ ID NO: 245 - DNA, 729 bp, Neisseria meningitidis
atgtgggataatgccgaagcgatggaacggctgacgcgctggctgcttgtcatgatggcgatgctgcttgctgcgtccgggctggtttggttttacaattcgaatcatctgcccgtcaagcaggtgtcgctgaagggcaacctagtttattccgataagaaagcattgggcagtttggcgaaagaatacatccatgggaatattttgaggacggacatcaatggcgcacaggaggcctaccgccggtatccgtggattgcgtcggtcatggtgcgccgccgttttcccgacacggttgaggtcgtcctgaccgagcgcaagccggtcgcgcgttggggcgaccatgccttggtggacggcgaaggcaatgtttttgaagcccgtttggacagacccggaatgccggtattcagaggcgcggaaggaacgtctgccgaaatgctccgccgttatgacgaattttcgactgttttggcaaaacagggtttgggcatcaaagagatgacctatacggcacgttcggcgtggattgtcgttttggacaacggcatcaccgtcaggctcggacgggaaaacgagatgaaacgcctccggctttttaccgaagcgtggcaacatctgttgcgtaaaaataaaaatcggttatcctatgtggatatgaggtataaggacggattttcagtccgctatgctcccgacggtttacccgaaaaagaatccgaagaatag

SEQ ID NO: 246 - protein, 242 aa, Neisseria meningitidis
MWDNAEAMERLTRWLLVMMAMLLAASGLVWFYNSNHLPVKQVSLKGNLVYSDKKALGSLAKEYIHGNILRTDINGAQEAYRRYPWIASVMVRRRFPDTVEVVLTERKPVARWGDHALVDGEGNVFEARLDRPGMPVFRGAEGTSAEMLRRYDEFSTVLAKQGLGIKEMTYTARSAWIVVLDNGITVRLGRENEMKRLRLFTEAWQHLLRKNKNRLSYVDMRYKDGFSVRYAPDGLPEKESEE

SEQ ID NO: 247 - DNA, 1359 bp, Neisseria gonorrhoeae
atgaaaccactggacctaaatttcatctgccaagccctcaagcttccgatgccgtctgaaaacaaacccgtgtcgcgcatcgtaaccgacagccgcgatattcgggaaggcgatgtgtttttcgcattggcgggcgggcggtttgacgcgcatgattttgttggaggcgtattgtctgcgggcgcggcggcggttgtggtttcgcgcgaagattgcgcggctttgggcggcgcgttgaaagtcgatgacacgcttgccgcgttgcaaacgttggcgaaggcgtggcgcgataatgtgaacccgtttgtgttcggcattaccggttcgggcggcaagacgacggtgaaggagatgctggctgcggtattgcgccgccgtttcggcgatgatgccgtttcggcgacggcaggcaacttcaacaaccacatcggattgccgctgactttattgaaattaaacgaaaaacaccgctatgccgtgattgaaatgggcatgaaccattttggcgaactggcggttttaacgcaaatcgccaaacccgatgccgctttggtcaacaacgccctgcgcgcccatgtcggatgcggtttcgacggagtgggcgatattgccaaagcgaaaagcgagatttatgcaggcttatgttcagacggcatggcactgattcctcaagaagatgccaatatggctgtcttcaaaacggcaacgtttaatttgaatacgtgcactttcggcgtcgatagcggcgatgtccgcgcggaaaatatcgtgctgaaacctttgtcgtgcgaatttgatttggtgtgcggcgacgagcgcactgccgtggtgctgcctgttcccggccgccacaatgtccacaacgccgccgctgccgccgcgctggctttggctgccggtttgagtttgaacgatgtggcggaaggtttgcaaggcttcagcaacatcaaaggccgtctgaacgtcaaagccggcatcaagggcgcaaccctgattgacgatacttataatgcgaatcccgacagtatgaaagccgcggttgacgtgttggcgcgtatgcctgcgccgcgcattttcgtgatgggcgatatgggcgaactgggcgaggacgaagccgccgccatgcacgccgaagtcggcgcgtacgcccgcgaccaaggcatcgaagcggcttattttgtcggcgacaacagcgtcgaagcggcggaaaaatttggcgcggacggtttgtggttcgccgccaaagacccgttgattcaagtgttgagccacgatttgcccgaacgcgccaccgtgttggtgaaaggttcgcgctttatgcagatggaagaagtggtcgaggcattggaggataagtga

SEQ ID NO: 248 - protein, 452 aa, Neisseria gonorrhoeae
MKPLDLNFICQALKLPMPSENKPVSRIVTDSRDIREGDVFFALAGGRFDAHDFVGGVLSAGAAAVVVSREDCAALGGALKVDDTLAALQTLAKAWRDNVNPFVFGITGSGGKTTVKEMLAAVLRRRFGDDAVSATAGNFNNHIGLPLTLLKLNEKHRYAVIEMGMNHFGELAVLTQIAKPDAALVNNALRAHVGCGFDGVGDIAKAKSEIYAGLCSDGMALIPQEDANMAVFKTATFNLNTCTFGVDSGDVRAENIVLKPLSCEFDLVCGDERTAVVLPVPGRHNVHNAAAAAALALAAGLSLNDVAEGLQGFSNIKGRLNVKAGIKGATLIDDTYNANPDSMKAAVDVLARMPAPRIFVMGDMGELGEDEAAAMHAEVGAYARDQGIEAAYFVGDNSVEAAEKFGADGLWFAAKDPLIQVLSHDLPERATVLVKGSRFMQMEEVVEALEDK

SEQ ID NO: 249 - DNA, 1368 bp, Neisseria meningitidis
atgaaaccactggacctaaatttcatctgccaagccctcaagcttccgatgccgtctgaaagcaaacccgtgtcgcgcatcgtaaccgacagccgcgacatccgcgcgggcgatgtgtttttcgcattggcgggcgagcggtttgacgcgcatgattttgttgaagacgtattggctgctggtgcggcggcggttgtggtttcgcgcgaagattgtgctgcaatggatggcgcgttgaaagtcgatgacacgcttgccgcattgcaaacgctggcaaaggcgtggcgtgaaaatgtgaatccgtttgtgttcggcattaccggttcgggcggcaagacgacggtgaaggaaatgctggctgcggtattgcgccgccgtttcggcgatgatgccgtgttggcgacggcaggcaacttcaacaaccatatcggattgccgctgactttgttgaagttaaacgaaaaacaccgctatgccgtgattgaaatgggcatgaaccatttcggcgaactggcggttttaacgcamatcgccaaaccaaatgccgcattggtcaacaacgccatgcgcgcccatgtcggctgcggtttcgacggagtgggcgatattgccaaagcgaaaagcgagatttaccaaggtttatgttcagacggcattgcactgattcctcaagaagatgccaatatggctgtcttcaaaacggcaacgcttaatttgaatacgcgcactttcggcatcgatagcggcgatgttcacgcggaaaatattgtgctgaaaccgttgtcgtgcgaatttgatttggtgtgcggcgatgagcgcgccgccgtggtgctgcctgttcccggccgccacaatgtccacaacgccgccgctgccgccgcgctggctttggctgcgggtttgagtttgaacgatgtggcggaaggtttgaaaggcttcagcaatatcaaaggccgtctgaacgtcaaatccggaatcaagggcgcaaccctgattgacgatacttataatgcgaaccctgacagcatgaaagctgcgattgacgtgttggcgcgtatgcctgcgccgcgtattttcgtgatgggcgatatgggcgaactgggcgaactgggcgaggacgaagccgccgctatgcacgccgaagtcggcgcgtatgcccgcgaccaaggcatcgaagcggcttattttgtcggcgacaacagcgtcgaagcggcggaaaaatttggcgcggacggtttgtggttcgccgccaaagacccgttgattcaagtgttgcgccacgatttgcccgaacgcgccaccgtgttggtgaaaggttcgcgctttatgcagatggaagaagtggtcgaggcattggaggataagtga

SEQ ID NO: 250 - protein, 455 aa, Neisseria meningitidis
  misc_feature (176)..(176): Xaa can be any naturally occurring amino acid
MKPLDLNFICQALKLPMPSESKPVSRIVTDSRDIRAGDVFFALAGERFDAHDFVEDVLAAGAAAVVVSREDCAAMDGALKVDDTLAALQTLAKAWRENVNPFVFGITGSGGKTTVKEMLAAVLRRRFGDDAVLATAGNFNNHIGLPLTLLKLNEKHRYAVIEMGMNHFGELAVLTXIAKPNAALVNNAMRAHVGCGFDGVGDIAKAKSEIYQGLCSDGIALIPQEDANMAVFKTATLNLNTRTFGIDSGDVHAENIVLKPLSCEFDLVCGDERAAVVLPVPGRHNVHNAAAAAALALAAGLSLNDVAEGLKGFSNIKGRLNVKSGIKGATLIDDTYNANPDSMKAAIDVLARMPAPRIFVMGDMGELGELGEDEAAAMHAEVGAYARDQGIEAAYFVGDNSVEAAEKFGADGLWFAAKDPLIQVLRHDLPERATVLVKGSRFMQMEEVVEALEDK

SEQ ID NO: 251 - DNA, 1359 bp, Neisseria meningitidis
atgaaaccactggacctaaatttcatctgccaagccctcaagcttccgatgccgtctgaaagcaaacccgtgtcgcgcatcgtaaccgacagccgcgacatccgcgcgggcgatgtgtttttcgcattggcgggcgggcggtttgatgcgcatgattttgttgaagacgtattggctgcgggtgcggcggcggttgtggtttcgcgcgaagattgcgttgcaatggatggcgcgttgaaagtcgatgacacgcttaccgcgttgcaaatgttggcgaaggcgtggcgcgagaatgtgaacccgtttgtgttcggtattaccggctcgggcggcaagacgacggtgaaggaaatgttggctgcggtattgcgccgccgtttcggcgataatgccgttttggcgacggcaggcaacttcaacaaccacatcggattgccgttgactttgttgaaattaaacgaaaaacaccgctatgccgtgattgaaatgggtatgaaccattttggcgaactggcggttttgacacaaatcgccaaacccgatgccgcattggtcaacaacgccatgcgcgcccatgtcggctgcggtttcgacggagtgggcgatattgccaaagcgaaaagcgagatttatcaaggcttatgttcagacggcatggcgctgattcctcaagaagatgccaatatggctgtcttcaaaacggcaacgcttaatttgaatacgcgcactttcggcatcgatagcggcgatgtccacgcggaaaatatcgtgctgaaaccgttgtcgtgcgaatttgatttggtgtgcggcaacgagtgcgcagccgtggttctgcccgttcccggccgccacaatgtccacaacgccgccgccgccgccgcgctgtctttggctgcaggtttgagtttgaacgatgtggcggaaggtttgaaaggcttcagcaatatcaaaggccgtctgaacgtcaaatccggaatcaagggcgcaaccctgattgacgatacttataatgcgaaccctgacagcatgaaagctgcggttgacgtgttggcgcgtatgcctgcgccgcgtattttcgtgatgggcgatatgggcgaactgggtgaggacgaagccgccgccatgcacgccgaagtcggcgcgtacgcccgcgaccaaggcatcgaagcggcttattttgtcggcgacaacagcgtcgaagcggcggaaaaatttggcgcggacggtttgtggttcgccgccaaagacccgttgattcaagtgttgcgccacgatttgcccgaacgcgccaccgtgttggtgaaaggttcgcgctttatgcagatggaagaagtggtcgaggcattggaggataagtga

SEQ ID NO: 252 - protein, 452 aa, Neisseria meningitidis
MKPLDLNFICQALKLPMPSESKPVSRIVTDSRDIRAGDVFFALAGGRFDAHDFVEDVLAAGAAAVVVSREDCVAMDGALKVDDTLTALQMLAKAWRENVNPFVFGITGSGGKTTVKEMLAAVLRRRFGDNAVLATAGNFNNHIGLPLTLLKLNEKHRYAVIEMGMNHFGELAVLTQIAKPDAALVNNAMRAHVGCGFDGVGDIAKAKSEIYQGLCSDGMALIPQEDANMAVFKTATLNLNTRTFGIDSGDVHAENIVLKPLSCEFDLVCGNECAAVVLPVPGRHNVHNAAAAAALSLAAGLSLNDVAEGLKGFSNIKGRLNVKSGIKGATLIDDTYNANPDSMKAAVDVLARMPAPRIFVMGDMGELGEDEAAAMHAEVGAYARDQGIEAAYFVGDNSVEAAEKFGADGLWFAAKDPLIQVLRHDLPERATVLVKGSRFMQMEEVVEALEDK

SEQ ID NO: 253 - DNA, 744 bp, Neisseria gonorrhoeae
atgtggttgttgaagttgcctgccgtcgccgaaacggcatcatcgccgaaacggcggcgcaataccgcagccagcatctccttcaccgtcgtcttgccgcccgaaccggtaatgccgaacacaaacgggttcacattatcgcgccacgccttcgccaacgtttgcaacgcggcaagcgtgtcatcgactttcaacgcgccgcccaaagccgcgcaatcttcgcgcgaaaccacaaccgccgccgcgcccgcagacaatacgcctccaacaaaatcatgcgcgtcaaaccgcccgcccgccaatgcgaaaaacacatcgccttcccgaatatcgcggctgtcggttacgatgcgcgacacgggtttgttttcagacggcatcggaagcttgagggcttggcagatgaaatttaggtccagtggtttcatatttgctttcgttaatattcgggcggcggacacatcggtagcggctgatttttttatcgcctgttttgctgtggtaaaacacagattattttcccattctcattcggcattttttctgtacgtatcattttttagacgtatttttagccgatttgccttttcccgcataccacggcgcggggtcgtcggactgtctgtcgataaaggcaaggttattgccttcgcccggcacatcggggacattcccccaaaaatcatagccgtcatcgggcaactcgtcggtttcgatacccgtccaactgccgaatccgcgtaa

SEQ ID NO: 254 - protein, 247 aa, Neisseria gonorrhoeae
MWLLKLPAVAETASSPKRRRNTAASISFTVVLPPEPVMPNTNGFTLSRHAFANVCNAASVSSTFNAPPKAAQSSRETTTAAAPADNTPPTKSCASNRPPANAKNTSPSRISRLSVTMRDTGLFSDGIGSLRAWQMKFRSSGFIFAFVNIRAADTSVAADFFIACFAVVKHRLFSHSHSAFFLYVSFFRRIFSRFAFSRIPRRGVVGLSVDKGKVIAFARHIGDIPPKIIAVIGQLVGFDTRPTAESA

SEQ ID NO: 255 - DNA, 744 bp, Neisseria meningitidis
  misc_feature (4)..(5): n is a, c, g, or t
atgnngttgttgaagttgcctgccgtcgccaacacggcatcatcgccgaaacggcggcgcaataccgcagccagcatttccttcaccgtcgtcttgccgcccgaaccggtaatgccgaacacaaacggattcacattttcacgccacgcctttgccagcgtttgcaatgcggcaagcgtgtcatcgactttcaacgcgccatccattgcagcacaatcttcgcgcgaaaccacaaccgccgccgcaccagcagccaatacgtcttcaacaaaatcatgcgcgtcaaaccgctcgcccgccaatgcgaaaaacacatcgcccgcgcggatgtcgcggctgtcggttacgatgcgcgacacgggtttgctttcagacggcatcggaagcttgagggcttggcagatgaaatttaggtccagtggtttcatatttactttcgttaatattcgggcggcggacacatcggtagcggctgatttttttatcgcctgttttgctgtggtaaaacacagattattttcccattctcattcggsattttttctgtacgtatcattttttagacgtatttttagtcgatttgccttttcccgcataccacggcgcggggtcgtcgggcagtccgtcgataaaggcaaggttattgccttcgccctgcacatcgggaacattcccccaaaaatcatagccgtcatcgggcaactcgtcggtttcgatacccgtccaactgccgaatccgcgtaa

SEQ ID NO: 256 - protein, 247 aa, Neisseria meningitidis
  misc_feature (2)..(2): Xaa can be any naturally occurring amino acid
  misc_feature (179)..(179): Xaa can be any naturally occurring amino acid
MXLLKLPAVANTASSPKRRRNTAASISFTVVLPPEPVMPNTNGFTFSRHAFASVCNAASVSSTFNAPSIAAQSSRETTTAAAPAANTSSTKSCASNRSPANAKNTSPARMSRLSVTMRDTGLLSDGIGSLRAWQMKFRSSGFIFTFVNIRAADTSVAADFFIACFAVVKHRLFSHSHSXFFLYVSFFRRIFSRFAFSRIPRRGVVGQSVDKGKVIAFALHIGNIPPKIIAVIGQLVGFDTRPTAESA

SEQ ID NO: 257 - DNA, 744 bp, Neisseria meningitidis
atgtggttgttgaagttgcctgccgtcgccaaaacggcattatcgccgaaacggcggcgcaataccgcagccaacatttccttcaccgtcgtcttgccgcccgagccggtaataccgaacacaaacgggttcacattctcgcgccacgccttcgccaacatttgcaacgcggtaagcgtgtcatcgactttcaacgcgccatccattgcaacgcaatcttcgcgcgaaaccacaaccgccgccgcacccgcagccaatacgtcttcaacaaaatcatgcgcatcaaaccgcccgcccgccaatgcgaaaaacacatcgcccgcgcggatgtcgcggctgtcggttacgatgcgcgacacgggtttgctttcagacggcatcggaagcttgagggcttggcagatgaaatttaggtccagtggtttcatatttactttcgttaatattcgggcggcggacacatcggtagcggctgatttttttatcgcctgttttgctgtggtaaaacacagattattttcccattctcattcggcattttttctgtacgtatcattttttagacgtatttttagtcgatttgccttttcccgcataccacggcgcggggtcgtcgggcagtccgtcgataaaggcaaggttattgccttcgccctgcacatcgggaacattcccccaaaaatcatagccgtcatcgggcaactcgtcggtttcgatacccgtccaactgccgaatccgcgtaa

SEQ ID NO: 258 - protein, 247 aa, Neisseria meningitidis
MWLLKLPAVAKTALSPKRRRNTAANISFTVVLPPEPVIPNTNGFTFSRHAFANICNAVSVSSTFNAPSIATQSSRETTTAAAPAANTSSTKSCASNRPPANAKNTSPARMSRLSVTMRDTGLLSDGIGSLRAWQMKFRSSGFIFTFVNIRAADTSVAADFFIACFAVVKHRLFSHSHSAFFLYVSFFRRIFSRFAFSRIPRRGVVGQSVDKGKVIAFALHIGNIPPKIIAVIGQLVGFDTRPTAESA

SEQ ID NO: 259 - DNA, 696 bp, Neisseria gonorrhoeae
atgaaacaatccgcccgaataaaaaatatggatcagacattaaaaaatacattgggcatttgcgcgcttttagccttttgttttggcgcggccatcgcatcaggttatcacttggaatatgaatacggctaccgttattctgccgtgggcgctttggcttcggttgtatttttattattattggcacgcggcttcccgcgcgtttcttcagttgttttactgatttacgtcggcacaaccgccctatatttgccggtcggctggctgtatggtgcgccttcttatcagatagtcggttcgatattggaaagcaatcctgccgaggcgcgtgaatttgtcggcaatcttcccgggtcgctttattttgtgcaggcattatttttcatttttggcttgacagtttggaaatattgtgtatctgtgggggtatttgctgacgtaaaaaactataaacgtcgcagcaaaatatggctgaccatattattgactttgattttgtcctgcgcggtgatggagaaaatcgccggcgataaagattggcgagaacctgatgccggcctgttgttgaatattttcgacctgtattacgacttggctttccgcgccggcacaatatgccgccaagcgcgcccacattttggaagcagcaaaaaaagcgtcaacatggcatatccgccaacttgcgcccaagtataa

SEQ ID NO: 260 - protein, 231 aa, Neisseria gonorrhoeae
MKQSARIKNMDQTLKNTLGICALLAFCFGAAIASGYHLEYEYGYRYSAVGALASVVFLLLLARGFPRVSSVVLLIYVGTTALYLPVGWLYGAPSYQIVGSILESNPAEAREFVGNLPGSLYFVQALFFIFGLTVWKYCVSVGVFADVKNYKRRSKIWLTILLTLILSCAVMEKIAGDKDWREPDAGLLLNIFDLYYDLAFRAGTICRQARPHFGSSKKSVNMAYPPTCAQV

SEQ ID NO: 261 - DNA, 694 bp, Neisseria meningitidis
  misc_feature (78)..(104): n is a, c, g, or t
  misc_feature (113)..(113): n is a, c, g, or t
atgaaacaatccgcccgaataaaaatatgaatcagacattactttatacattgggcatttgcgcgcttttaacctttnnnnnnnnnnnnnnnnnnnnnnnnnnntatcacccngaatatgaatacggctaccgttattctgccgtgggtgctttggcttcggttgtatttttattattattggcacgcggtttcccgcgcgtttcttcagttgttttactgatttacgtcggcacaaccgccctatatttgccggtcggctggctgtatggtgcgccgtcttatcagatagtcggttcgatattggaaagcaatcctgccgaggcgcgtgaatttgtcggcaatcttcccgggtcgctttattttgtgcaggcattatttttcatttttggcttgacagtttggaaatattgtgtatcggggggggtatttgctgacgtaaaaaactataaacgccgcagcaaaatatggctgactatattattgactttgattttgtcctgcgcggtgatggataaaatcgccagcgataaagatttgcgagaacctgatgccggcctgttgttgaatattttcgacctgtattacgatttggcttccgcgccggcacaatatgccgccaagcgcgcccacattttggaagcagcaaaaaaagcgtcaacatggcatatccgtcatgttgcgcccaagtataa

SEQ ID NO: 262 - protein, 231 aa, Neisseria meningitidis
  misc_feature (9)..(9): Xaa can be any naturally occurring amino acid
  misc_feature (27)..(35): Xaa can be any naturally occurring amino acid
  misc_feature (200)..(200): Xaa can be any naturally occurring amino acid
MKQSARIKXMNQTLLYTLGICALLTFXXXXXXXXXYHPEYEYGYRYSAVGALASVVFLLLLARGFPRVSSVVLLIYVGTTALYLPVGWLYGAPSYQIVGSILESNPAEAREFVGNLPGSLYFVQALFFIFGLTVWKYCVSGGVFADVKNYKRRSKIWLTILLTLILSCAVMDKIASDKDLREPDAGLLLNIFDLYYDLAXRAGTICRQARPHFGSSKKSVNMAYPSCCAQV

SEQ ID NO: 263 - DNA, 695 bp, Neisseria meningitidis
atgaaacaatccgcccgaataaaaaatatggatcagacattaaaaaatacattgggcatttgcgcgcttttagccttttgttttggcgcggccatcgcatcaggttatcacttggaatatgaatacggctaccgttattctgccgtgggtgctttggcttcggttgtatttttattattattggcacgcggtttcccgcgcgtttcttcagttgttttactgatttacgtcggcacaaccgccctatatttgccggtcggctggctgtatggtgcgccgtcttatcagatagtcggttcgatattggaaagcaatcctgccgaggcgcgtgaatttgtcggcaatcttcccgggtcgctttattttgtgcaggcattatttttcatttttggcttgacagtttggagatattgtgtatcggggggggtatttgctgacgtaaaaaactataaacgccgcagcaaaatatggctgactatattattgactttgattttgtcctgcgcggtgatggataaaatcgccagcgataaagatttgcgagaacctgatgccggcctgttgttgaatattttcgacctgtattacgatttggcttccgcgccggcacaatatgccgccaagcgcgcccacattttggaagcagcaaaaaaagcgtcaacatggcatatccgtcatgttgcgcccaagtataa

SEQ ID NO: 264 - protein, 231 aa, Neisseria meningitidis
  misc_feature (201)..(201): Xaa can be any naturally occurring amino acid
MKQSARIKNMDQTLKNTLGICALLAFCFGAAIASGYHLEYEYGYRYSAVGALASVVFLLLLARGFPRVSSVVLLIYVGTTALYLPVGWLYGAPSYQIVGSILESNPAEAREFVGNLPGSLYFVQALFFIFGLTVWRYCVSGGVFADVKNYKRRSKIWLTILLTLILSCAVMDKIASDKDLREPDAGLLLNIFDLYYDLASXAGTICRQARPHFGSSKKSVNMAYPSCCAQV

SEQ ID NO: 265 - DNA, 285 bp, Neisseria gonorrhoeae
atgggcaaagggcaggacttcacgcccctgcgcgacgcgttgaaagataaggcaaaaggcgtgttcctgatcggcgtcgatgcgccgcaaatccgccgcgatttggacggctgcggcttgaacctgaccgactgcgtcactttggaagaggcggttcagacggcatacgcccaagccgaagcgggcgatattgtcttgctcagccccgcctgcgcgagtttcgatatgtttaaaggctacgcgcaccgttcggaagtgtttatcgaagcgtttaaggctttgtga

SEQ ID NO: 266 - protein, 94 aa, Neisseria gonorrhoeae
MGKGQDFTPLRDALKDKAKGVFLIGVDAPQIRRDLDGCGLNLTDCVTLEEAVQTAYAQAEAGDIVLLSPACASFDMFKGYAHRSEVFIEAFKAL

SEQ ID NO: 267 - DNA, 285 bp, Neisseria meningitidis
atgggtaaagggcaggacttcacgcccctgcgcgatgcactggtaggcaaggcaaaaggcgtgttcttgattggtgtcgatgcgccgcaaatccgccgcgatttggacggctgcggcttgaatatgaccgactgcgccactttgggagaagccgttcagacggcatatgcccaagccgaagcaggcgatattgtgttgctcagccccgcctgcgcgagctttgatatgttcaaaggctacgcgcaccgttcggaagtgtttatcgaagcgtttaaggctttgtga

SEQ ID NO: 268 - protein, 94 aa, Neisseria meningitidis
MGKGQDFTPLRDALVGKAKGVFLIGVDAPQIRRDLDGCGLNMTDCATLGEAVQTAYAQAEAGDIVLLSPACASFDMFKGYAHRSEVFIEAFKAL

SEQ ID NO: 269 - DNA, 285 bp, Neillia sinensis
atgggcaaagggcaggacttcacgcccctgcgcgacgcgcttgccggcaaggcaaaaggcgtgttcctgatcggtgtcgatgcgccgcaaatccgccgcgatttggacggctgcgatctgaatatgaccgactgcgccactttggaagaagcggttcagaaggcatatgcccaagccgaagcgggcgatatcgtgctgctcagccccgcctgcgcgagtttcgatatgtttaaaggctacgcgcaccgttcggaagtgtttatcggggcgtttaaggctttgtga

SEQ ID NO: 270 - protein, 94 aa, Neisseria meningitidis
MGKGQDFTPLRDALAGKAKGVFLIGVDAPQIRRDLDGCDLNMTDCATLEEAVQKAYAQAEAGDIVLLSPACASFDMFKGYAHRSEVFIGAFKAL

SEQ ID NO: 271 - DNA, 1192 bp, Neisseria gonorrhoeae
atggtggtgctgatgacggcgttcggcctgctgatgatttattcggcttctgtgtatttggcatcgaaggaaggcggcgatcagtttttctatttgaccaggcaggcggggttcgtcgttgccggccttatagcgagcggttttttatggtttctttgcaggatgaggacatggcggcggcttgtgccgtggatttttgccttatccggcctgttgctggtagccgtattgattgccgggcgcgaaatcaatggcgcgacccgttggatacctttgggtccgttgaatttccagccgaccgagctgttcaagctggcagtcatcctttatttggcaagcctgttcacgcgccgtgaagaagtgttgcgcagcatggaaagtttgggttggcagtcgatttggcgggggacggccaacctgattatgtccgccaccaatccgcaggcacgtcgtgaaacattagaaatgtacggccgtttccgggcgatcatcctgccgattatgctggtggcgttcggtttggtgctgataatggtacagccggatttcggttcgtttgtcgtcattaccgtcattaccgttggaatgctgtttctggcaggattgccgtggaaatatttttttgtcctggtaggcagcgtcttgggtgggatggtgctgatgattaccgccgctccctaccgtgtgcagcgggtagtggcatttttggacccgtggaaagacccgcagggtgccggctaccagcttacccactctctgatggcaatcgggcgcggagagtggttcggtatgggtttgggtgcgagtttgagcaaacgcggctttctgccggaagcgcataccgattttatttttgccatcatcgctgaagaattcggcttcttcgggatgtgcgtgctgatattctgttacggctggctggtggtgcgggcgttttccatcggcaagcagtcgcgcgatttgggtttgactttcaacgcctatatcgcttcgggtatcggcatttggatcggtatccaaagtttcttcaatatcggtgtgaacatcggtgctttgccgaccaaaggtctgacgctgccgttgatgtcctatggcggttcgtcagtctttttcatgctgatcagcatgatgctgctgttgcgtatcgattatgaaaaccgccagaaaatgcgcggttaccgggtggagtaaa

SEQ ID NO: 272 - protein, 396 aa, Neisseria gonorrhoeae
MVVLMTAFGLLMIYSASVYLASKEGGDQFFYLTRQAGFVVAGLIASGFLWFLCRMRTWRRLVPWIFALSGLLLVAVLIAGREINGATRWIPLGPLNFQPTELFKLAVILYLASLFTRREEVLRSMESLGWQSIWRGTANLIMSATNPQARRETLEMYGRFRAIILPIMLVAFGLVLIMVQPDFGSFVVITVITVGMLFLAGLPWKYFFVLVGSVLGGMVLMITAAPYRVQRVVAFLDPWKDPQGAGYQLTHSLMAIGRGEWFGMGLGASLSKRGFLPEAHTDFIFAIIAEEFGFFGMCVLIFCYGWLVVRAFSIGKQSRDLGLTFNAYIASGIGIWIGIQSFFNIGVNIGALPTKGLTLPLMSYGGSSVFFMLISMMLLLRIDYENRQKMRGYRVE

SEQ ID NO: 273 - DNA, 1190 bp, Neisseria meningitidis
atggtggtgctgatgacggcgttcagcctgctgatgatttattcggcttctgtgtatttggcatcaaaagaaggcggcgatcagtttttctatttgaccagacaggcggggttcgtcgttgccggcttgatagcgagcggtttgttatggtttctttgcaggatgaggacatggcggcggcttgtgccgtggatttttgccctatccggcctgttgctggtagtcgtattgattgccgggcgcgaaatcaatggcgcgacccgttggatacctttgggtccgttgaatttccagccgaccgagctgttcaagctggcggtcatcctttatttggcaagcctgttcacgcgccgtgaagaagtgttgcgcagcatggaaagtttgggttggcagtcgatttggcgggggacggccaatctgatcatgtccgccaccaatccgcagrcacgtcgtgaaacattagaaatgtacggccgtwtccgggcgatcatcctgccgattatgctggtggcgttcggtttggtgctgataatggtacagccggatttcggttcgtttgtcgtcattaccgtcattgccgttggaatgctgtttttggcaggattgccgtggaaatattttttcgtcctggtaggcagcgtcttgggcgggatggtgctgatgattaccgccgctccctaccgtgtgcagcgggtagtggcatttttggacccgtggaaagacccgcagggtgccggctaccagcttacccactctctgatggcaatcgggcgcggagagtggttcggtatgggtttgggtgcgagtttgagcaaacgcggctttctgccggaagcgcataccgattttatttttgccatcatcgccgaagaattcggtttcttcggtatgtgcgtgctgatattctgttacggctggctggtggtgcgggcgttttccatcggcaagcagtcgcgcgatttgggtttgactttcaacgcctatatcgcttcgggtatcggcatttggatcggkrtccaaagtttcttcaatatcggtgtgaacatcggtgctttgccgamcaaaggyctgacgcygccgtgatgtccwatggcggttcgtcagtctttttcatgctgatcagcatgatgctgctgtkgcgtatagattatgaaaaccgccggaaaatgcgcggttatcgggtggagtaa

SEQ ID NO: 274 - protein, 396 aa, Neisseria meningitidis
  misc_feature (149)..(149): Xaa can be any naturally occurring amino acid
  misc_feature (160)..(160): Xaa can be any naturally occurring amino acid
  misc_feature (339)..(339): Xaa can be any naturally occurring amino acid
  misc_feature (354)..(354): Xaa can be any naturally occurring amino acid
  misc_feature (359)..(359): Xaa can be any naturally occurring amino acid
  misc_feature (361)..(361): Xaa can be any naturally occurring amino acid
  misc_feature (364)..(364): Xaa can be any naturally occurring amino acid
  misc_feature (380)..(380): Xaa can be any naturally occurring amino acid
MVVLMTAFSLLMIYSASVYLASKEGGDQFFYLTRQAGFVVAGLIASGLLWFLCRMRTWRRLVPWIFALSGLLLVVVLIAGREINGATRWIPLGPLNFQPTELFKLAVILYLASLFTRREEVLRSMESLGWQSIWRGTANLIMSATNPQXRRETLEMYGRXRAIILPIMLVAFGLVLIMVQPDFGSFVVITVIAVGMLFLAGLPWKYFFVLVGSVLGGMVLMITAAPYRVQRVVAFLDPWKDPQGAGYQLTHSLMAIGRGEWFGMGLGASLSKRGFLPEAHTDFIFAIIAEEFGFFGMCVLIFCYGWLVVRAFSIGKQSRDLGLTFNAYIASGIGIWIGXQSFFNIGVNIGALPXKGLTXPXMSXGGSSVFFMLISMMLLXRIDYENRRKMRGYRVE

SEQ ID NO: 275 - DNA, 1191 bp, Neisseria meningitidis
atggtggtgctgatgacggcgttcagcctgctgatgatttattcggcttctgtgtatttggcatcaaaagaaggcggcgatcagtttttctatttgaccagacaggcggggttcgtcgttgccggcttgatagcgagcggtttgttatggtttctttgcaggatgaggacatggcggcggcttgtgccgtggatttttgccctatccggcctgttgctggtagtcgtattgattgccgggcgcgaaatcaatggcgcgacccgttggatacctttgggtccgttgaatttccagccgaccgagctgttcaagctggcggtcatcctttatttggcaagcctgttcacgcgccgtgaagaagtgttgcgcagcatggaaagtttgggttggcagtcgatttggcgggggacggccaatctgatcatgtccgccaccaatccgcaggcacgtcgtgaaacattagaaatgtacggccgtttccgggcgatcatcctgccgattatgctggtggcgttcggtttggtgctgataatggtacagccggatttcggttcgtttgtcgtcattaccgtcattgccgttggaatgctgtttttggcaggattgccgtggaaatattttttcgtcctggtaggcagcgtcttgggcgggatggtgctgatgattaccgccgctccctaccgtgtgcagcgggtagtggcatttttggacccgtggaaagacccgcagggtgccggctaccagcttacccactctctgatggcaatcgggcgcggagagtggttcggtatgggtttgggtgcgagtttgagcaaacgcggctttctgccggaagcgcataccgattttatttttgccatcatcgccgaagaattcggtttcttcggtatgtgcgtgctgatattctgttacggctggctggtggtgcgggcgttttccatcggcaagcagtcgcgcgatttgggtttgactttcaacgcctatatcgcttcgggtatcggcatttggatcggtatccaaagtttcttcaatatcggtgtgaacatcggtgctttgccgaccaaaggtctgacgctgccgttgatgtcctatggcggttcgtcagtctttttcatgctgatcagcatgatgctgctgttgcgtatagattatgaaaaccgccggaaaatgcgcggttaccgggtggagtaa

SEQ ID NO: 276 - protein, 396 aa, Neisseria meningitidis
MVVLMTAFSLLMIYSASVYLASKEGGDQFFYLTRQAGFVVAGLIASGLLWFLCRMRTWRRLVPWIFALSGLLLVVVLIAGREINGATRWIPLGPLNFQPTELFKLAVILYLASLFTRREEVLRSMESLGWQSIWRGTANLIMSATNPQARRETLEMYGRFRAIILPIMLVAFGLVLIMVQPDFGSFVVITVIAVGMLFLAGLPWKYFFVLVGSVLGGMVLMITAAPYRVQRVVAFLDPWKDPQGAGYQLTHSLMAIGRGEWFGMGLGASLSKRGFLPEAHTDFIFAIIAEEFGFFGMCVLIFCYGWLVVRAFSIGKQSRDLGLTFNAYIASGIGIWIGIQSFFNIGVNIGALPTKGLTLPLMSYGGSSVFFMLISMMLLLRIDYENRRKMRGYRVE

SEQ ID NO: 277 - DNA, 1069 bp, Neisseria gonorrhoeae
atgggcggtaaaacctttatgctgatggcgggcggaacgggcggacacattttcccagctctggctgtggcggattcattgcgcgtgcgcggtcatcatgtaatttggctgggcagcaaggattcgatggaagagcgcatcgtgccgcaatacggcatacgcttggaaacgctggcgattaaaggaatacgcggcaacggcatcaaacgcaagctgatgcttccgtttactctgtacaaaaccgtccgcgaagcgcagcggattatccgcaaacaccgtgtcgagtgcgtcatcggcttcggcggttttgttacctttcccggcggtctggcggcgaaactcttgggcgtgccgattgtgattcacgagcaaaacgccgtggcaggcttgtccaaccgccacctgtcgcgctgggcgaaacgggtgttgtacgcttttccgaaagcgttcagccacgaaggcggtttggtcggcaaccccgtccgcgccgatattagcaacctgcccgtgcctgccgaacgcttccaagggcgcgaaggccgtctgaaaattttggtggtcggcggcagtttgggtgcggacgttttgaacaaaaccgtaccgcaggcgttggcactgctgcctgaagaggtgcgcccgcagatgtaccaccagtcggggcgtaacaagctgggcaatcttcaggcggattatgacgcgttgggcgtgaaagcggaatgcgtggaatttattaccgacatggtgtccgcctaccgtgatgccgatttggtgatttgccgtgccggcgcgctgacgattgccgagttgacggcggcggggctgggcgcgttgttagtgccgtatcctcacgccgttgatgaccatcaaaccgccaacgcgcgtttcatggtgcaggcagaagcggggctgctgttgccgcaaacccagttgacggcggaaaaactcgccgaaatcctcggcagcctcaaccgcgaaaaatgcctcaaatgggcggaaaacgcccgtacgttggcattgccgcacagcgcggatgacgttgccgaagccgcgattgcgtgtgcggcgtaaa

SEQ ID NO: 278 - protein, 355 aa, Neisseria gonorrhoeae
MGGKTFMLMAGGTGGHIFPALAVADSLRVRGHHVIWLGSKDSMEERIVPQYGIRLETLAIKGIRGNGIKRKLMLPFTLYKTVREAQRIIRKHRVECVIGFGGFVTFPGGLAAKLLGVPIVIHEQNAVAGLSNRHLSRWAKRVLYAFPKAFSHEGGLVGNPVRADISNLPVPAERFQGREGRLKILVVGGSLGADVLNKTVPQALALLPEEVRPQMYHQSGRNKLGNLQADYDALGVKAECVEFITDMVSAYRDADLVICRAGALTIAELTAAGLGALLVPYPHAVDDHQTANARFMVQAEAGLLLPQTQLTAEKLAEILGSLNREKCLKWAENARTLALPHSADDVAEAAIACAA

SEQ ID NO: 279 - DNA, 1008 bp, Neisseria meningitidis
  misc_feature (688)..(753): n is a, c, g, or t
atgggcggtaaaacctttatgctgawkkcgggcggaacgggcggacatattttccccgcgctggcggtggcggattcattgcgcgcgcgcggccatcatgtgatttggctgggcagcaaggattcgatggaagagcgtatcgtgccgcaatacggcatacgcttggaaacgctggcgattaaaggcgtgcgcggcaacggcatcaaacgcaaactgatgctgccggttactttgtatcaaaccgtccgcgaagcgcagcggattatccgcaaacaccgtgtcgagtgcgtcatcggcttcggcggcttcgttaccttccccggcggtttggcggcgaagctattargcgtgccgattgtgattcacgagcaaaacgccgtggcaggtttgtccaaccgccacctgtcgcgctgggcgaagcgggtgttgtacgcttttccgaaagcgttcagccacgaaggcggcttggtcggcaaccccgtccgcgccgatattagcaacctgcccgtgcctgccgaacgcttccaagggcgtgaaggccgtctgaaaattttggtggtcggcggcagtttgggcgcggacgttttgaacaaaaccgtaccgcatgcattggctttgctgcccgacaatgcgcgtccgcatatgtaccaccaatcgggacggggcaagctgggcatcttgcaggcgnnnnnnnnnnnnnnnnnnnnnnnnnnnnnnnnnnnnnnnnnnnnnnnnnnnnnnnnnnnnnnnnnngcgggattgggtgcgttgttagtgccgtatcctcacgcggttgacgatcaccaaaccgccaacgcgcgttttatggtgcaggcggaggcgggattgctgttgccgcaaacccagttgacggcggaaaaactcgccgagattctcggcggcttaaaccgcgaaaaatgcctcaaatgggcagaaaacgcccgtacgttggcactgccgcacagtgcggacgacgtggcggaagccgcgattgcgtgtgcggcgtaa

SEQ ID NO: 280 - protein, 335 aa, Neisseria meningitidis
  misc_feature (9)..(10): Xaa can be any naturally occurring amino acid
  misc_feature (116)..(116): Xaa can be any naturally occurring amino acid
  misc_feature (230)..(251): Xaa can be any naturally occurring amino acid
MGGKTFMLXXGGTGGHIFPALAVADSLRARGHHVIWLGSKDSMEERIVPQYGIRLETLAIKGVRGNGIKRKLMLPVTLYQTVREAQRIIRKHRVECVIGFGGFVTFPGGLAAKLLXVPIVIHEQNAVAGLSNRHLSRWAKRVLYAFPKAFSHEGGLVGNPVRADISNLPVPAERFQGREGRLKILVVGGSLGADVLNKTVPHALALLPDNARPHMYHQSGRGKLGILQAXXXXXXXXXXXXXXXXXXXXXXAGLGALLVPYPHAVDDHQTANARFMVQAEAGLLLPQTQLTAEKLAEILGGLNREKCLKWAENARTLALPHSADDVAEAAIACAA

SEQ ID NO: 281 - DNA, 1068 bp, Neisseria meningitidis
atgggcggtaaaacctttatgctgatggcgggcggaacgggcggacatattttccccgcgctggcggtggcggattcattgcgcgcgcgcggccatcatgtaatttggctgggcagcaaggattcgatggaagagcgcatcgtgccgcaatacgacatcctgctcgaaacgctggcgattaaaggcgtgcgcggcaacggcatcaaacgcaagctgatgctgccgtttactttgtatcaaactgtccgcgaagcgcagcagattatccgcaaacaccgtgtcgagtgcgtcatcggcttcggcggcttcgttacctttcccggcggtttggcggcgaagttattaggcgtgccgattgtgattcacgagcaaaacgccgtggcaggtttgtccaaccgccacctgtcgcgctgggcgaagcgggtgttgtacgcttttccgaaagcgttcagccacgaaggcggcttggtcggcaaccccgtccgcgccgatattagcaacctgcccgtgcctgccgaacgcttccaagggcgtgaaggccgtctgaaaattttggtggtcggcggcagtttgggcgcggacgttttgaacaaaaccgtaccgcaggcattggctttgctgcccgacaatgcgcgtccgcagatgtaccaccaatcgggacggggcaagctgggcagcttgcaggcggattacgacgcgctgggcgtgcaagcggaatgcgtggaatttattaccgatatggtgtccgcctaccgcgatgccgatttggtgatttgccgtgccggcgcgctgacgattgccgagttgacggcggcgggattgggtgcgttgttagtgccgtatcctcacgccgttgatgaccatcaaaccgccaacgcgcgttttatggtgcaggcggaggcgggattgctgttgccgcaaacccagttgacggcggaaaaactcgccgagattctcggcggcttaaaccgcgaaaaatgcctcaaatgggcagaaaacgcccgtacgttggcactgccgcacagtgcggacgacgttgccgaagccgcgattgcgtgtgcggcgtaa

SEQ ID NO: 282 - protein, 355 aa, Neisseria meningitidis
MGGKTFMLMAGGTGGHIFPALAVADSLRARGHHVIWLGSKDSMEERIVPQYDILLETLAIKGVRGNGIKRKLMLPFTLYQTVREAQQIIRKHRVECVIGFGGFVTFPGGLAAKLLGVPIVIHEQNAVAGLSNRHLSRWAKRVLYAFPKAFSHEGGLVGNPVRADISNLPVPAERFQGREGRLKILVVGGSLGADVLNKTVPQALALLPDNARPQMYHQSGRGKLGSLQADYDALGVQAECVEFITDMVSAYRDADLVICRAGALTIAELTAAGLGALLVPYPHAVDDHQTANARFMVQAEAGLLLPQTQLTAEKLAEILGGLNREKCLKWAENARTLALPHSADDVAEAAIACAA

SEQ ID NO: 283 - DNA, 1131 bp, Neisseria gonorrhoeae
atgtttttatggctcgcacatttcagcaactggttaaccggtctgaatatttttcaatacaccacattccgcgccgttatggcggcgttgaccgccttggcgttttccctgatgttcggcccgtggacgatacgcaggctgaccgcgctcaaatgcgggcaggcagtgcgtaccgacggcccgcaaacccacctcgtcaaaaacggcacgccgacgatgggcggttcgctgattctgaccgccattaccgtgtccaccctgttgtggggcaactgggcgaacccgtatatctggattctcttgggcgtactgcttgccaccggtgcgctcggtttttacgacgactggcgcaaagtcgtttataaagaccccaacggcgtgtccgccaaattcaaaatggtgtggcagtcaagcgttgccgttatcgccggtttggcattgttttaccttgccgccaattccgccaacaatattttgattgtcccgtttttcaaacaaatcgccctgccgctgggcgtggtcggctttttggtgttgtcttacctgaccatcgtcggcacatccaacgccgtcaacctcaccgacggcttggacggccttgccgccttcccgttcgtcctcgttgccgccgggctcgccattttcgcctacgtcagcggacactaccaattttcccaatacctccagcttccctatgtcgccggcgcgaacgaagtcgctatattctgcaccgccatgtgcggcgcgtgcctcggatttttgtggttcaacgcctatcccgcgcaagtctttatgggcgatgtcggcgcgctggcattgggtgccgcgctcggtaccgttgccgtcatcgtccgccaagaatttgtcctcgtcattatgggcggtctgttcgtcgtagaagccgtgtccgttatgcttcatgtcggctggtacaagaaaaccaaaaaacgcatcttcctgacggcaccgattcatcaccattaccaacttcgatgctggaaagaaacgcaagtcgtcgtccgtttctggattattaccatcgtcgtggttttgataggtttgagtaccctcaaaattcgcggaaactatgccgtccgaacacctttcagacggcatttgaacgcgcaataa

SEQ ID NO: 284 - protein, 376 aa, Neisseria gonorrhoeae
MFLWLAHFSNWLTGLNIFQYTTFRAVMAALTALAFSLMFGPWTIRRLTALKCGQAVRTDGPQTHLVKNGTPTMGGSLILTAITVSTLLWGNWANPYIWILLGVLLATGALGFYDDWRKVVYKDPNGVSAKFKMVWQSSVAVIAGLALFYLAANSANNILIVPFFKQIALPLGVVGFLVLSYLTIVGTSNAVNLTDGLDGLAAFPFVLVAAGLAIFAYVSGHYQFSQYLQLPYVAGANEVAIFCTAMCGACLGFLWFNAYPAQVFMGDVGALALGAALGTVAVIVRQEFVLVIMGGLFVVEAVSVMLHVGWYKKTKKRIFLTAPIHHHYQLRCWKETQVVVRFWIITIVVVLIGLSTLKIRGNYAVRTPFRRHLNAQ

SEQ ID NO: 285 - DNA, 1131 bp, Neisseria meningitidis
  misc_feature (29)..(29): n is a, c, g, or t
  misc_feature (49)..(513): n is a, c, g, or t
atgtttttatggctcgcacatttcagcanctggttaaccggtctgaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgtggtcggctttttggtgttgtcttacctgaccatcgtcggcacatccaatgccgtcaacctcaccgacggcttggacggccttgcgaccttccccgtcgtcctcgttgccgccggcctcgccatcttcgcctatgccagcggccactcacaatttgcccaatacctgcaattaccttacgttgccggcgcaaacgaagtggtgattttctgtaccgccatgtgcggcgcgtgcctcggtttcttgtggtttaacgcctatcccgcgcaagtctttatgggcgatgtcggtgcattggcattgggtgccgcgctcggtaccgtcgccgttatcgtccgccaagagtttgtcctcgtcattatgggcggattatttgtcgtagaagccgtatccgttatgcttcaggttggctggtataagaaaaccaaaaaacgcatcttcctgatggcgcccatccatcaccactacgaacaaaaaggctggaaagaaacccaagtcgtcgtccgcttttggattattaccatcgtcttggtgttgatcggtttgagtaccctcaaaatccgctgaacctatgccgtctgaacatctttcagacggcatttgaacgcgcaataa

SEQ ID NO: 286 - protein, 376 aa, Neisseria meningitidis
  misc_feature (361)..(361): Xaa can be any naturally occurring amino acid
  misc_feature (366)..(366): Xaa can be any naturally occurring amino acid
MFLWLAHFSNWLTGLNIFQYTTFRAVMAALTALAFSLMFGPWTIRRLTALKCGQAVRTDGPQTHLVKNGTPTMGGSLILTAITVSTLLWGNWANPYIWILLGVLLATGALGFYDDWRKVVYKDPNGVSAKFKMVWQSSVAVIAGLALFYLAANSANNILIVPFFKQIALPLGVVGFLVLSYLTIVGTSNAVNLTDGLDGLATFPVVLVAAGLAIFAYASGHSQFAQYLQLPYVAGANEVVIFCTAMCGACLGFLWFNAYPAQVFMGDVGALALGAALGTVAVIVRQEFVLVIMGGLFVVEAVSVMLQVGWYKKTKKRIFLMAPIHHHYEQKGWKETQVVVRFWIITIVLVLIGLSTLKIRXTYAVXTSFRRHLNAQ

SEQ ID NO: 287 - DNA, 1131 bp, Neisseria meningitidis
atgtttttatggctcgcacatttcagcaactggttaaccggtctgaatatttttcaatacaccacattccgcgccgtcatggcggcgttgaccgccttggcgttttccctgatgttcggcccgtggacgatacgcaggctgaccgcgctcaaatgcgggcaggcagtgcgtaccgacggtccgcaaacccacctcgtcaaaaacggcacgccgacgatgggcggttcgctgattctgaccgccattaccgtgtccaccctgttgtggggcaactgggcaaacccgtatatctggattctcttgggcgtattgctcgccacgggcgcactcggtttttacgacgactggcgcaaagtcgtctataaagaccccaacggcgtgtccgccaaattcaaaatggtgtggcagtcaagcgttgccattatcgccggtttggcattgttttaccttgccgccaattccgccaacaatattttgattgtcccgttcttcaaacaaatcgccctgccgctgggcgtggtcggctttttggtgttgtcttacctgaccatcgtcggcacatccaatgccgtcaacctcaccgacggcttggacggccttgcgaccttccccgtcgtcctcgttgccgccggcctcgccatcttcgcctatgccagcggccactcacaatttgcccaatacctgcaattaccttacgttgccggcgcaaacgaagtggtgattttctgtaccgccatgtgcggcgcgtgcctcggtttcttgtggtttaacgcctatcccgcgcaagtctttatgggcgatgtcggtgcattggcattgggtgccgcgctcggtaccgtcgccgtcatcgtccgccaagagtttgtcctcgtcattatgggcggattatttgtcgtagaagccgtatccgttatgcttcaggtcggctggtataagaaaaccaaaaaacgcatcttcctgatggcgcccatccatcaccactacgaacaaaaaggctggaaagaaacccaagtcgtcgtccgcttttggattattaccatcgtcttggtgttgatcggtttgagtaccctcaaaatccgctgaacctatgccgtctgaacacctttcagacggcatttgaacgcgcaataa

SEQ ID NO: 288 - protein, 374 aa, Neisseria meningitidis
MFLWLAHFSNWLTGLNIFQYTTFRAVMAALTALAFSLMFGPWTIRRLTALKCGQAVRTDGPQTHLVKNGTPTMGGSLILTAITVSTLLWGNWANPYIWILLGVLLATGALGFYDDWRKVVYKDPNGVSAKFKMVWQSSVAIIAGLALFYLAANSANNILIVPFFKQIALPLGVVGFLVLSYLTIVGTSNAVNLTDGLDGLATFPVVLVAAGLAIFAYASGHSQFAQYLQLPYVAGANEVVIFCTAMCGACLGFLWFNAYPAQVFMGDVGALALGAALGTVAVIVRQEFVLVIMGGLFVVEAVSVMLQVGWYKKTKKRIFLMAPIHHHYEQKGWKETQVVVRFWIITIVLVLIGLSTLKIRTYAVTPFRRHLNAQ

SEQ ID NO: 289 - DNA, 450 bp, Neisseria gonorrhoeae
atgccgcccaaaatcacgaagagcgggttttgcaaaccggcaatcgcggcggcggtcgcgccgacattcgtgcctttgctgtcgtcgatgaataccacgccgtttttctcgccgattttttccacacggtgcggcaagccttggaaggttttgacgtgttccagcaatgcttcgcgcggcaaaccgacggcctcgcacaaagccacggcagccataacgttggcggcgttgtgcaaaccttgcagcgggatgtcttgcgtagaaatcaaatcttcattgccttgttttaaacagcccgtcccgcgttccaaccaaaaatcggcttcgtgttccaaggaaaaccgtttcacttcacgccctgcccgtttcatggcgcggcagaacacgtcgtccgcattcaaaacctgcactccatcgccacggaaaatctcggctttggtatgcgcgtag

SEQ ID NO: 290 - protein, 149 aa, Neisseria gonorrhoeae
MPPKITKSGFCKPAIAAAVAPTFVPLLSSMNTTPFFSPIFSTRCGKPWKVLTCSSNASRGKPTASHKATAAITLAALCKPCSGMSCVEIKSSLPCFKQPVPRSNQKSASCSKENRFTSRPARFMARQNTSSAFKTCTPSPRKISALVCA

SEQ ID NO: 291 - DNA, 450 bp, Neisseria meningitidis
atgccgcccaaaatcackawgagcggattttgcaaaccggcaatcgcggcggcagtcgcgccgacattcgtgcctttgctgtcgtcgataaacaccacgccgtttttctcgccgattttttccacgcggtgcggcaggccttggaaggttttgacgtgttcgagcaatgcttcgcgcgacaaaccgatggcctcacacaaagccackgcagccatgacgttagcggcgttgtgcakaccttgcaacggwatgtcttgcgtgacaatcaaatcttcattgccttgtttcaggcggcctgtctcgcgttccaaccagaaatcagcttcgtgttccaacgaaaaccattttacctcgcgcccggcacgcttcatcgcgcggcagaacgcatcgtccgcattcaaaacctgcacgccgtcgccacggaaaatcttggctttggtatgcgcatag

SEQ ID NO: 292 - protein, 149 aa, Neisseria meningitidis
  misc_feature (7)..(7): Xaa can be any naturally occurring amino acid
  misc_feature (79)..(79): Xaa can be any naturally occurring amino acid
MPPKITXSGFCKPAIAAAVAPTFVPLLSSINTTPFFSPIFSTRCGRPWKVLTCSSNASRDKPMASHKATAAMTLAALCXPCNGMSCVTIKSSLPCFRRPVSRSNQKSASCSNENHFTSRPARFIARQNASSAFKTCTPSPRKILALVCA

SEQ ID NO: 293 - DNA, 450 bp, Neisseria meningitidis
atgccgcctaaaatcacgaagagcggattttgcaaaccggcaatcgcggcggcggtcgcaccgacgttcgtgcctttgctgtcgtcgatgaacaccacgccatttttctcgccgattttttccacgcggtgcggcaggccttgaaaggttttgacgtgttcgagcaatgcttcgcgcggcaaaccgacggcttcgcacaaggcaacggcagccatcacgttagtggcgttgtgcaagccttgcagcggaatatcttgcgtggcaatcaaatcttcattgccttgtttcaggcgacctgtctcacgttccaaccaaaaatcggcttcgtattccaacgaaaaccatttcacctcgcgcccggcgcgcttcatcgcacgacagaacgcatcgtccgcattcaaaacctgcacaccgtcgccacggaaaatcttggctttggtatgcgcgtag

SEQ ID NO: 294 - protein, 148 aa, Neisseria meningitidis
MPPKITKSGFCKPAIAAAVAPTFVPLLSSMNTTPFFSPIFSTRCGRPKVLTCSSNASRGKPTASHKATAAITLVALCKPCSGISCVAIKSSLPCFRRPVSRSNQKSASYSNENHFTSRPARFIARQNASSAFKTCTPSPRKILALVCA

SEQ ID NO: 295 - DNA, 356 bp, Neisseria gonorrhoeae
atgcgcgtagtcgagcaaatcgtcgtagcggtcgagatggtcttcggaaatgttcatcaccgtcgccgcagtcgggcgcaggctttcggtgttttccagttggaagctggaaagctcccacacccacacgtccgcctttttgccttcgcgctgcaattctgcctccaagacgggcgtaccgatattgcccgcaatgacggtatccagcccgcacttgatgcagagatagcggaccaggctggttaccgtggttttgccgttgctgccggtaatcgcaatcaccttgtcgccgcggcggttcacaatgtccgccagcaattggatgtcgcctagcacgcgcccgccgttttgcttga

SEQ ID NO: 296 - protein, 118 aa, Neisseria gonorrhoeae
  misc_feature (111)..(111): Xaa can be any naturally occurring amino acid
  misc_feature (114)..(114): Xaa can be any naturally occurring amino acid
MRVVEQIVVAVEMVFGNVHHRRRSRAQAFGVFQLEAGKLPHPHVRLFAFALQFCLQDGRTDIARNDGIQPALDAEIADQAGYRGFAVAAGNRNHLVAAAVHNVRQQLDVAXHAXRRFA

SEQ ID NO: 297 - DNA, 356 bp, Neisseria meningitidis
atgcgcatagtcgagcaagtcgtcgtagcggtcgagatggtcttcggaaatgttcagcaccgtcgccgcagtcggacgcaggctttcggtgttttccagttggaagctggaaagctccaacacccacacgtccgcctttttgccttcgcgctgccattccgcctccaaaaccggcgtgccgatattgcccgcgataacggtatccagcccgcacttgatacagagatagccgaccaggctcgttaccgtggttttgccgttgctgccggtaatcgcaattaccttgtcgtcccggcggttcacaatgtccgccagcaattcgatgtcgcccaacacgcgtccgccgttttgcttga

SEQ ID NO: 298 - protein, 118 aa, Neisseria meningitidis
  misc_feature (114)..(114): Xaa can be any naturally occurring amino acid
MRIVEQVVVAVEMVFGNVQHRRRSRTQAFGVFQLEAGKLQHPHVRLFAFALPFRLQNRRADIARDNGIQPALDTEIADQARYRGFAVAAGNRNYLVVPAVHNVRQQFDVAQHAXRRFA

SEQ ID NO: 299 - DNA, 356 bp, Neisseria meningitidis
atgcgcgtagtcgagcaagtcgtcgtagcggtcgagatggtcttcggaaatgttcagcactgtcgccgcagtcgggcgcaggctttcggtgttttccagttggaaactggaaagctccaacacccacacgtccgcctttttgccttcgcgctgcaattccgcctccaaaaccggcgcgccgatattgcccgcgataacggtatccagcccacacttgatgcagagatagccgaccaggctcgttaccgtggttttgccgttgctgccggtaatcgcaatcaccttgtcgccgcggcggttcacaatgtccgccagcaattcgatgtcgcccaacacgcgtccgccgtttcgcttaa

SEQ ID NO: 300 - protein, 118 aa, Neisseria meningitidis
  misc_feature (114)..(114): Xaa can be any naturally occurring amino acid
MRVVEQVVVAVEMVFGNVQHCRRSRAQAFGVFQLETGKLQHPHVRLFAFALQFRLQNRRADIARDNGIQPTLDAEIADQARYRGFAVAAGNRNHLVAAAVHNVRQQFDVAQHAXRRFA

SEQ ID NO: 301 - DNA, 1380 bp, Neisseria meningitidis
atgacggcgtttgcatttcagacggcatcacaaagccttaaacgcttcgataaacacttccgaacggtgcgcgtagcctttgaacatatcaaagctcgcgcaggcggggctgagcaacacaatatcgcctgcttcggcttgggcatatgccgtctgaacggcttctcccaaagtggcgcagtcggtcatattcaagccgcagccgtccaaatcgcggcggatttgcggcgcatcgacaccaatcaagaacacgccttttgccttgcctaccagtgcatcgcgcaggggcgtgaagtcctgccctttacccatgccgcccaaaatcacgaagagcggattttgcaaaccggcaatcgcggcggcagtcgcgccgacattcgtgcctttgctgtcgtcgataaacaccacgccgtttttctcgccgattttttccacgcggtgcggcaggccttggaaggttttgacgtgttcgagcaatgcttcgcgcgacaaaccgatggcctcacacaaagccacggcagccatgacgttagcggcgttgtgcagaccttgcaacggaatgtcttgcgtgacaatcaaatcttcattgccttgtttcaggcggcctgtctcgcgttccaaccagaaatcagcttcgtgttccaacgaaaaccattttacctcgcgcccggcacgcttcatcgcgcggcagaacgcatcgtccgcattcaaaacctgcacgccgtcgccacggaaaatcttggctttggtatgcgcatagtcgagcaagtcgtcgtagcggtcgagatggtcttcggaaatgttcagcaccgtcgccgcagtcggacgcaggctttcggtgttttccagttggaagctggaaagctccaacacccacacgtccgcctttttgccttcgcgctgccattccgcctccaaaaccggcgtgccgatattgcccgcgataacggtatccagcccgcacttgatacagagatagccgaccaggctcgttaccgtggttttgccgttgctgccggtaatcgcaattaccttgtcgtcccggcggttcacaatgtccgccagcaattcgatgtcgcccaacacgcgtccgccgttttgcttgaacgcctcaatatccggctgccgctcgctgatgccgggactgagagccagaatatcgaaaccgttgtccagcgcatctttcagacggcccgtgtaaaacaccaacccgtcaaacatcttaccgatttgcgacacgcgttccggcttcagctccgcatcatacgcagcaacctccgcgccgtttttgcgcaggtaggcaatcatggaaatacccgtaccgccgagtccggcgacgaggatttttttgttttgaaaagtcattttggtttgtcctaa

SEQ ID NO: 302 - protein, 459 aa, Neisseria meningitidis
MTAFAFQTASQSLKRFDKHFRTVRVAFEHIKARAGGAEQHNIACFGLGICRLNGFSQSGAVGHIQAAAVQIAADLRRIDTNQEHAFCLAYQCIAQGREVLPFTHAAQNHEERILQTGNRGGSRADIRAFAVVDKHHAVFLADFFHAVRQALEGFDVFEQCFARQTDGLTQSHGSHDVSGVVQTLQRNVLRDNQIFIALFQAACLAFQPEISFVFQRKPFYLAPGTLHRAAERIVRIQNLHAVATENLGFGMRIVEQVVVAVEMVFGNVQHRRRSRTQAFGVFQLEAGKLQHPHVRLFAFALPFRLQNRRADIARDNGIQPALDTEIADQARYRGFAVAAGNRNYLVVPAVHNVRQQFDVAQHASAVLLERLNIRLPLADAGTESQNIETVVQRIFQTARVKHQPVKHLTDLRHAFRLQLRIIRSNLRAVFAQVGNHGNTRTAESGDEDFFVLKSHFGLS

SEQ ID NO: 303 - DNA, 309 bp, Neisseria gonorrhoeae
atggaaatacccgtgccgccaagtccggcgacgaggatttttttgtttgaaagtcattttggttttgtcctaaaacaaatcatattgggcaggagacgtccgcccttgcccaagccgctttcagacggcatcgcgagccgattaataacccgccttcaggcgttggtcattgtcgcagctgttttggtctccgttttgacaagccttgccaagccattgttgagcgagcgcaaggtcttggcgcacgccgcgtccatcgtaatacatcaagcccaaattgtattgggcttgggcatccccttgttctga

SEQ ID NO: 304 - protein, 102 aa, Neisseria gonorrhoeae
MEIPVPPSPATRIFLFESHFGFVLKQIILGRRRPPLPKPLSDGIASRLITRLQALVIVAAVLVSVLTSLAKPLLSERKVLAHAASIVIHQAQIVLGLGIPLF

SEQ ID NO: 305 - DNA, 306 bp, Neisseria meningitidis
atggaaatacccgtaccgccgagtccggcgacgaggatttttttgtttgaaaagtcattttggtttgtcctaaaacaaatcatattgagcaggagatgtccgcccctgcccaagccgctttcagacggcatcgcgagctgttcaataacccgccttcaggcgttggtcattgtcgcagccgtcttggtctccgttttgacaagccttgccaaaccattcttgtgcaagggcgcggtcttggcgcacgccgcgtctttcggcatacatcacgcccaaattgttttgggcttgggctaccccctgcgc

SEQ ID NO: 306 - protein, 102 aa, Neisseria meningitidis
MEIPVPPSPATRIFLFEKSFWFVLKQIILSRRCPPLPKPLSDGIASCSITRLQALVIVAAVLVSVLTSLAKPFLCKGAVLAHAASFGIHHAQIVLGLGYPLR

SEQ ID NO: 307 - DNA, 288 bp, Neisseria meningitidis
atggaaatacccgtgccgccaagtccggcgacgaggatttttttgttttggaaatcattttggtttgtcctaaaacaaatcatattgagcaggggatgtctgatcctgctcaagccgctttcagacggcatcgcgagctgttcaataacccgctttcaggcgttggtcattgtcgcagctgtcttggtatccgttttgacaagccttgccaagccattcttgtgcaagggcgcggtcttggcgcacgccgcgtctttcggcatacatcacgcccaaattgttttgggc

SEQ ID NO: 308 - protein, 96 aa, Neisseria meningitidis
MEIPVPPSPATRIFLFWKSFWFVLKQIILSRGCLILLKPLSDGIASCSITRFQALVIVAAVLVSVLTSLAKPFLCKGAVLAHAASFGIHHAQIVLG

SEQ ID NO: 309 - DNA, 1521 bp, Neisseria gonorrhoeae
atgttttttatttcaatccgctatatatttgtcagaaaactatggtgcgcaaacggtcagacctttaaaataacgcctttacgcactaaaaaccaaccggaacgcaacattatgatgaaaaatcgagtaagcaacatccattttgtcggtatcggcggcgtcggcatgagcggtatcgccgaagtcttgcacaatttgggctttaaagtttccggttcggatcaggcgcgaaatgccgctaccgagcatttgagcagcctgggcattcaagtttatcccggccataccgcagaacacgttaacggtgcggatgtcgtcgttgcctctaccgccgtcaagaaagaaaatcccgaagttgtcgctgcgttggagcggcaaattcccgttattccgcgcgccttgatgctggcagagctgatgcgcttccgtgacggcatcgccattgccggtacgcacggcaaaaccacgaccaccagcctgaccgcctccatcctcggcgcggcaggactcgaccccactttcgttatcggcggcaaactcaacgccgcaggcaccaacgcccgcttgggcaaaggcgaatacatcgttgccgaagccgacgaatccgatgcctctttcctacatctgaccccgattatgtccgtcgttaccaatatcgacgaagaccatatggatacctacgggcacagcgtcgaaaaactgcatcaggcgtttatcgatttcatccaccgtatgcccttctacggcaaagcctttttgtgtgttgacagcgaacacgtccgcgcgattttgcccaaagtgagcaaaccttatgctacttacggtttggacgataccgccgacatctacgccaccgacatcgaaaacgtcggcgcgcaaatgaaattcaccgtccatgttcaaatgaaaggacatgagcaggggtcgtttgaagtcgtgctgaatatgcccggcagacacaacgtgctgaacgcattggcagccatcggcgtggcgctggaagtcggcgcatcggttgaagcgatccaaaaaggcttgctcggctttgaaggcgtcggccgccgcttccaaaaatacggcgacatcaagttgccaaacggcgggaccgctttgctggtggacgattacggacaccaccccgtcgaaatggcggcaacccttgccgctgcacgcggcgcgtatccggaaaaacgtttggtgctcgccttccagccgcaccgctatacccgcacgcgcgatttgtttgaagactttaccaaagtactcaataccgttgatgcgctggtactgaccgaagtttatgccgccggcgaagagccggttgccgccgccgactcccgcgccttggcgcgtgctatccgcgtattgggcaaacttgagccgatttactgcgaaaatgtcgccgacctgccgcaaatgctgatgaatgttttacaggatggcgatgttgtgttgaatatgggtgcgggaagcatcaaccgcgttccttccgcgctgttggaattgtcgaaacagatttga

SEQ ID NO: 310 - protein, 506 aa, Neisseria gonorrhoeae
MFFISIRYIFVRKLWCANGQTFKITPLRTKNQPERNIMMKNRVSNIHFVGIGGVGMSGIAEVLHNLGFKVSGSDQARNAATEHLSSLGIQVYPGHTAEHVNGADVVVASTAVKKENPEVVAALERQIPVIPRALMLAELMRFRDGIAIAGTHGKTTTTSLTASILGAAGLDPTFVIGGKLNAAGTNARLGKGEYIVAEADESDASFLHLTPIMSVVTNIDEDHMDTYGHSVEKLHQAFIDFIHRMPFYGKAFLCVDSEHVRAILPKVSKPYATYGLDDTADIYATDIENVGAQMKFTVHVQMKGHEQGSFEVVLNMPGRHNVLNALAAIGVALEVGASVEAIQKGLLGFEGVGRRFQKYGDIKLPNGGTALLVDDYGHHPVEMAATLAAARGAYPEKRLVLAFQPHRYTRTRDLFEDFTKVLNTVDALVLTEVYAAGEEPVAAADSRALARAIRVLGKLEPIYCENVADLPQMLMNVLQDGDVVLNMGAGSINRVPSALLELSKQI

SEQ ID NO: 311 - DNA, 1521 bp, Neisseria meningitidis
atgttttttatttcaatccgctatatatttgtcagaaaactatggcgcgcaaacggtcagccctttaaaataacgcctttacgcatcgaaaatccaccggaacgcaacattatgatgaaaaatcgagttaccaacatccattttgtcggtatcggcggcgtcggcatgagcggcatcgccgaagtcttgcacaatttgggctttaaagtttccggttcggatcaggcgcgaaatgccgctaccgagcatttgggcagcctgggcattcaagtttatcccggccataccgccgaacacgttaacggtgcggatgtcgtcgttacctctaccgccgtcaaaaaagaaaatcccgaagttgtcgctgcgttggagcagcaaattcccgttattccgcgcgccctgatgttggcggagttgatgcgcttccgtgacggcatcgccattgccggcacgcacggcaaaaccacgaccaccagcctgaccgcctccatcctcggcgcggcaggacttgacccgactttcgttatcggcggcaaactcaacgccgcaggcactaacgcccgcttgggcaaaggcgaatacatcgttgccgaagccgacgagtcggatgcatcctttctgcacctgacaccgattatgtccgtcgttaccaatatcgacgaagaccatatggatacctacgggcacagcgtcgaaaaactgcatcaggcgtttatcgatttcatccaccgtatgcccttctacggcaaagcctttttgtgtattgacagcgaacacgtccgcgcgattttgcccaaagtgagcaaaccttatgctacttacggtttggacgataccgccgacatctacgccaccgacatcgaaaacgtcggcgcgcaaatgaaattcaccgtccatgttcaaatgaaaggacatgagcaggggtcgtttgaagtcgtgctgaatatgcccggcagacacaacgtgctgaacgcattggcagccatcggcgtggcgctggaagtcggcgcatcggttgaagcgatccaaaaaggcttgctcggctttgaaggcgtcggccgccgcttccaaaaatacggcgacatcaagttgccaaacggcgggaccgcgctcttggtggacgactacggacaccaccccgtcgaaatggcggcgacccttgccgccgcacgcggcgcgtatctggaaaaacgtttggtactcgccttccagccgcaccgctatacccgcacgcgcgatttgtttgaagactttaccaaagtcctcaataccgttgacgcgctggtgctgaccgaagtttatgccgccggtgaagagccgattgccgccgccgattcccgcgctcttgcccgcgccatccgcgtgttgggcaaactcgagccgatttactgcgaaaacgttgccgatctgcccgaaatgctgttgaacgttttgcaggacggcgacatcgtgttgaatatgggcgcgggaagcatcaaccgcgtccccgccgcgctgctggcattgtcgaaacagatttga

SEQ ID NO: 312 - protein, 506 aa, Neisseria meningitidis
MFFISIRYIFVRKLWRANGQPFKITPLRIENPPERNIMMKNRVTNIHFVGIGGVGMSGIAEVLHNLGFKVSGSDQARNAATEHLGSLGIQVYPGHTAEHVNGADVVVTSTAVKKENPEVVAALEQQIPVIPRALMLAELMRFRDGIAIAGTHGKTTTTSLTASILGAAGLDPTFVIGGKLNAAGTNARLGKGEYIVAEADESDASFLHLTPIMSVVTNIDEDHMDTYGHSVEKLHQAFIDFIHRMPFYGKAFLCIDSEHVRAILPKVSKPYATYGLDDTADIYATDIENVGAQMKFTVHVQMKGHEQGSFEVVLNMPGRHNVLNALAAIGVALEVGASVEAIQKGLLGFEGVGRRFQKYGDIKLPNGGTALLVDDYGHHPVEMAATLAAARGAYLEKRLVLAFQPHRYTRTRDLFEDFTKVLNTVDALVLTEVYAAGEEPIAAADSRALARAIRVLGKLEPIYCENVADLPEMLLNVLQDGDIVLNMGAGSINRVPAALLALSKQI

SEQ ID NO: 313 - DNA, 1521 bp, Neisseria meningitidis
atgttttttatttcaatccgctatatatttgtcagaaaactatggcgcgcaaacggtcagccctttaaaataacgcctttacgcatcgaaaatccaccggaacgcaacattatgatgaaaaatcgagtgaccaacatccattttgtcggtatcggcggcgtcggcatgagcggtatcgccgaagtcttgcacaatttgggttttaaagtttccggttcggatcaggcgcgaaatgccgctaccgagcatttgggcagcctgggcattcaagtttatcccggccataccgcagaacacgttaacggtgcggatgtcgtcgttacctctaccgccgtcaaaaaagaaaatcccgaagttgtcgctgcgttggagcagcaaattcccgttattccgcgcgccctgatgttggcggagttgatgcgcttccgtgacggcatcgccattgccggcacgcacggcaaaaccacgaccaccagcctgaccgcctccatcctcggcgcggcaggacttgacccgactttcgttatcggcggcaaactcaacgccgcaggcaccaacgcccgcttgggcaaaggcgaatacatcgttgccgaagccgacgagtcggatgcatcctttctgcacctgacaccgattatgtccgtcgttaccaatatcgacgaagaccatatggatacctacgggcacagtgttgagaagctgcatcaggcgtttatcgatttcatccaccgtatgcccttctacggcaaagcctttttgtgtattgacagcgaacacgtccgcgcgattttgcccaaagtgagcaaaccttatgctacttacggtttggacgataccgccgacatctacgccaccgacatcgaaaacgtcggcgcgcaaatgaaattcaccgtccatgttcaaatgaaaggacatgagcaggggtcgtttgaagtcgtgctgaatatgcccggcagacacaacgtgctgaacgcattggcagccatcggcgtggcgctggaagtcggcgcatcggttgaagcgatccaaaaaggcttgctcggctttgaaggtgtcggccgccgcttccaaaaatacggcgacatcaagttgccaaacggtggaaccgcgctcttggtggacgactacggacaccaccccgtcgaaatggcggcgaccctttccgccgcacgcggcgcgtatccggaaaaacgtttggtactcgccttccagccgcaccgctatacccgcacgcgcgatttgtttgaagactttaccaaagtcctcaataccgttgacgcgctggtgctgaccgaagtttatgccgccggtgaagagccgattgccgccgctgattcccgcgctcttgcccgcgccatccgcgtgttgggcaaactcgagccgatttactgcgaaaacgttgccgatctgcccgaaatgctgttgaacgttttgcaggacggcgacatcgtgttgaatatgggtgcgggaagcatcaaccgcgtccccgccgcgctgctggaattgtcgaaacagatttga

SEQ ID NO: 314 - protein, 506 aa, Neisseria meningitidis
MFFISIRYIFVRKLWRANGQPFKITPLRIENPPERNIMMKNRVTNIHFVGIGGVGMSGIAEVLHNLGFKVSGSDQARNAATEHLGSLGIQVYPGHTAEHVNGADVVVTSTAVKKENPEVVAALEQQIPVIPRALMLAELMRFRDGIAIAGTHGKTTTTSLTASILGAAGLDPTFVIGGKLNAAGTNARLGKGEYIVAEADESDASFLHLTPIMSVVTNIDEDHMDTYGHSVEKLHQAFIDFIHRMPFYGKAFLCIDSEHVRAILPKVSKPYATYGLDDTADIYATDIENVGAQMKFTVHVQMKGHEQGSFEVVLNMPGRHNVLNALAAIGVALEVGASVEAIQKGLLGFEGVGRRFQKYGDIKLPNGGTALLVDDYGHHPVEMAATLSAARGAYPEKRLVLAFQPHRYTRTRDLFEDFTKVLNTVDALVLTEVYAAGEEPIAAADSRALARAIRVLGKLEPIYCENVADLPEMLLNVLQDGDIVLNMGAGSINRVPAALLELSKQI

SEQ ID NO: 315 - DNA, 831 bp, Neisseria gonorrhoeae
atgcagaattttggcaaagtggccgtattgatgggtggtttttccagcgaacgagaaatctcgctggacagcggtaccgccattttgaacgccttaaaaagcaaaggcatagacgcatacgccttcgaccctaaggaaacgccgttatccgaactgaaggagcggggctttcagacggcattcaacatccttcacggtacttacggcgaagacggggctgttcagggtgcattggaactgttgggcattccctataccggcagcggtgtcgccgcctccgccatcggcatggacaaataccgctgcaaactgatttggcaggcattgggattacccgttcccgagttcgccgtactgtacgatgataccgatttcgatgccgtcgaagaaaaattgggtctgccgatgtttgtgaagccggcggccgaaggcagcagcgtcggcgtggtaaaagtcaaagaaaaaggccgtctgaaaagcgtttacgaagaattgaaacaccttcaggggcgaaatcattgccgaacgttttatcggcggcggcgaatattcctgccccgtcctgaacggcaaagggctgcccggcatacacatcatccccgcaaccgagttttacgactacgaagccaagtacaaccgagacgacaccatttatcaatgtccttcggaagatttgaccgaagccgaagaaagcctgatgcgcgaactggcggttcgcggcgcacaggcaatcggtgcggaaggctgcgtgcgcgtcgatttcctcaaagataccgacggcaaactctatctgttggaaatcaacaccctgcccggtatgaccggccatag

SEQ ID NO: 316 - protein, 276 aa, Neisseria gonorrhoeae
MQNFGKVAVLMGGFSSEREISLDSGTAILNALKSKGIDAYAFDPKETPLSELKERGFQTAFNILHGTYGEDGAVQGALELLGIPYTGSGVAASAIGMDKYRCKLIWQALGLPVPEFAVLYDDTDFDAVEEKLGLPMFVKPAAEGSSVGVVKVKEKGRLKSVYEELKHLQGRNHCRTFYRRRRIFLPRPERQRAARHTHHPRNRVLRLRSQVQPRRHHLSMSFGRFDRSRRKPDARTGGSRRTGNRCGRLRARRFPQRYRRQTLSVGNQHPARYDRP

SEQ ID NO: 317 - DNA, 830 bp, Neisseria meningitidis
atgcagaattttggcaaagtggccgtattgatgggcggtttttccagcgaacgagaaatctcgctggacagcggcaccgccattttgaatgctttaaaaagcaaaggcatagacgcatacgccttcgatcctaaagaaaccccattgtctgaattgaaggcacaaggttttcagacggcattcaacatccttcacggtacttacggcraagacggggcggttcagggtgcattggaactgttgggcattccctataccggcagcggtgtcgccgcatccgccatcggcatggacaaataccgctgcaaactgatttggcaggcattgggattgcccgttcccgagttcgccgtcctgcacgacgacactgatttcgatgccgtcgaagaaaaattgggcctgccgatgtttgtgaaaccggcggccgaaggcagcagcgtaggcgtggtaaaagtcaaaggaaaaggccgtctgaaaagcgtttacgaagaattgaaacaccttcagggcgaaatcattgccgaacgttttatcggcggcggcgaatattcctgccccgtcctgaacggcaaagggctgcccggcatacacatcattcccgcaaccgagttttacgactacgaagccaagtacaaccgcgacgacaccatttatcaatgtccttcggaagatttgaccgaagccgaagaaagcctgatgcgcgaactggcggttcgcggcgcgcaggcaatcggtgcggaaggctgcgtgcgcgtcgatttcctcaaagataccgacggcaaactctatctgttggaaatcaacaccctgcccggtatgacgagccatag

SEQ ID NO: 318 - protein, 276 aa, Neisseria meningitidis
  misc_feature (70)..(70): Xaa can be any naturally occurring amino acid
  misc_feature (170)..(170): Xaa can be any naturally occurring amino acid
MQNFGKVAVLMGGFSSEREISLDSGTAILNALKSKGIDAYAFDPKETPLSELKAQGFQTAFNILHGTYGXDGAVQGALELLGIPYTGSGVAASAIGMDKYRCKLIWQALGLPVPEFAVLHDDTDFDAVEEKLGLPMFVKPAAEGSSVGVVKVKGKGRLKSVYEELKHLQXRNHCRTFYRRRRIFLPRPERQRAARHTHHSRNRVLRLRSQVQPRRHHLSMSFGRFDRSRRKPDARTGGSRRAGNRCGRLRARRFPQRYRRQTLSVGNQHPARYDEP

SEQ ID NO: 319 - DNA, 830 bp, Neisseria meningitidis
atgcagaattttggcaaagtggccgtattgatgggcggtttttccagcgaacgagaaatctcgctggacagcggcaccgccattttgaatgctttaaaaagcaaaggcatagacgcatacgccttcgatcccaaggaaaccccattgtctgaattgaaggcacaaggttttcagacggcattcaacatccttcacggtacttacggcgaagacggggctgttcagggtgcattggaactgttgggcattccctataccggcagcggtgtcgccgcatccgccatcggcatggacaaataccgctgcaaactgatttggcaggcattgggattgcccgttcccgagttcgccgtcctgcacgacgacactgatttcgatgccgtcgaagaaaaattgggcctgccgatgtttgtgaaaccggcggccgaaggcagcagcgtaggcgtggtaaaagtcaaaggaaaaggccgtctgaaaagcgtttacgaagaattgaaacactttcagggcgaaatcattgccgaacggtttatcggcggcggcgaatattcctgccctgtgttgaacggcaaaggcctgcccggcatacacatcatccccgcgaccgagttttatgactacgaagccaagtacaaccgcaacgacaccatttatcaatgtccttcggaagatctgaccgaagccgaagaaagcctgatgcgcgaactggcggttcgcggcgcgcaggcaatcggtgcggaaggctgcgtgcgcgtcgatttcctcaaagataccgacggcaaactctatctgttggaaatcaacaccctgcccggtatgaccggccatag

SEQ ID NO: 320 - protein, 275 aa, Neisseria meningitidis
  misc_feature (170)..(170): Xaa can be any naturally occurring amino acid
MQNFGKVAVLMGGFSSEREISLDSGTAILNALKSKGIDAYAFDPKETPLSELKAQGFQTAFNILHGTYGEDGAVQGALELLGIPYTGSGVAASAIGMDKYRCKLIWQALGLPVPEFAVLHDDTDFDAVEEKLGLPMFVKPAAEGSSVGVVKVKGKGRLKSVYEELKHFQXRNHCRTVYRRRRIFLPCVERQRPARHTHHPRDRVLLRSQVQPQRHHLSMSFGRSDRSRRKPDARTGGSRRAGNRCGRLRARRFPQRYRRQTLSVGNQHPARYDRP

SEQ ID NO: 321 - DNA, 312 bp, Neisseria gonorrhoeae
atgtattcgcctttgcccaagcgggcgttggtgcctgcggcgttgagtttgccgccgataacgaaagtggggtcgagtcctgccgcgccgaggatggaggcggtcaggctggtggtcgtggttttgccgtgcgtaccggcaatggcgatgccgtcacggaagcgcatcagctctgccagcatcaaggcgcgcggaataacgggaatttgccgctccaacgcagcgacaacttcgggattttctttcttgacggcggtagaggcaacgacgacatccgcaccgttaacgtgttctgcggtatggccgggataa

SEQ ID NO: 322 - protein, 103 aa, Neisseria gonorrhoeae
MYSPLPKRALVPAALSLPPITKVGSSPAAPRMEAVRLVVVVLPCVPAMAMPSRKRISSASIKARGITGICRSNAATTSGFSFLTAVEATTTSAPLTCSAVWPG

SEQ ID NO: 323 - DNA, 312 bp, Neisseria meningitidis
atgtattcgcctttgcccaagcgggcgttagtgcctgcggcgttgagtttgccgccgataacgaaagtcgggtcaagtcctgccgcgccgaggatggaggcggtcaggctggtggtcgtggttttgccgtgcgtgccggcaatggcgatgccgtcacggaagcgcatcaactccgccaacatcagggcgcgcggaataacgggaatttgctgctccaacgcagcgacaacttcgggattttcttttttgacggcggtagaggtaacgacgacatccgcaccgttaacgtgttcggcggtatggccgggataa

SEQ ID NO: 324 - protein, 103 aa, Neisseria meningitidis
MYSPLPKRALVPAALSLPPITKVGSSPAAPRMEAVRLVVVVLPCVPAMAMPSRKRINSANIRARGITGICCSNAATTSGFSFLTAVEVTTTSAPLTCSAVWPG

SEQ ID NO: 325 - DNA, 312 bp, Neisseria meningitidis
atgtattcgcctttgcccaagcgggcgttggtgcctgcggcgttgagtttgccgccgataacgaaagtcgggtcaagtcctgccgcgccgaggatggaggcggtcaggctggtggtcgtggttttgccgtgcgtgccggcaatggcgatgccgtcacggaagcgcatcaactccgccaacatcagggcgcgcggaataacgggaatttgctgctccaacgcagcgacaacttcgggattttcttttttgacggcggtagaggtaacgacgacatccgcaccgttaacgtgttctgcggtatggccgggataa

SEQ ID NO: 326 - protein, 103 aa, Neisseria meningitidis; identical to SEQ ID NO: 324

SEQ ID NO: 327 - DNA, 375 bp, Neisseria gonorrhoeae
atgtcctttcatttgaacatggacggtgaatttcatttgcgcgccgacgttttcgatgtcggtggcgtagatgtcggcggtatcgtccaaaccgtaagtagcataaggtttgctcactttgggcaaaatcgcgcggacgtgttcgctgtcaacacacaaaaaggctttgccgtagaagggcatacggtggatgaaatcgataaacgcctgatgcagtttttcgacgctgtgcccgtaggtatccatatggtcttcgtcgatattggtaacgacggacataatcggggtcagtgtaggaaagaggcatcggatcgtcggcttcggcaacgatgtattcgcctttgcccaagcgggcgttggtgcctgcggcgttga

SEQ ID NO: 328 - protein, 124 aa, Neisseria gonorrhoeae
MSFHLNMDGEFHLRADVFDVGGVDVGGIVQTVSSIRFAHFGQNRADVFAVNTQKGFAVEGHTVDEIDKRLMQFFDAVPVGIHMVFVDIGNDGHNRGQCRKEASDRRLRQRCIRLCPSGRWCLRR

SEQ ID NO: 329 - DNA, 375 bp, Neisseria meningitidis
atgtcctttcatttgaacatggacggtgaatttcatttgcgcgccgacgttttcgatgtcggtggcgtagatgtcggcggtatcgtccaaaccgtaagtagcataaggtttgctcactttgggcaaaatcgcgcggacgtgttcgctgtcaatacacaaaaaggctttgccgtagaagggcatacggtggatgaaatcgataaacgcctgatgcagtttttcgacgctgtgcccgtaggtatccatatggtcttcgtcgatattggtaacgacggacataatcggtgtcagtgcagaaaggatgcatccgaccgtcggcttcggcaacgatgtattcgcctttgcccaagcgggcgttagtgcctgcggcgttga

SEQ ID NO: 330 - protein, 124 aa, Neisseria meningitidis
  misc_feature (120)..(120): Xaa can be any naturally occurring amino acid
MSFHLNMDGEFHLRADVFDVGGVDVGGIVQTVSSIRFAHFGQNRADVFAVNTQKGFAVEGHTVDEIDKRLMQFFDAVPVGIHMVFVDIGNDGHNRCQCRKDASDRRLRQRCIRLCPSGRXCLRR

SEQ ID NO: 331 - DNA, 375 bp, Neisseria meningitidis
atgtcctttcatttgaacatggacggtgaatttcatttgcgcgccgacgttttcgatgtcggtggcgtagatgtcggcggtatcgtccaaaccgtaagtagcataaggtttgctcactttgggcaaaatcgcgcggacgtgttcgctgtcaatacacaaaaaggctttgccgtagaagggcatacggtggatgaaatcgataaacgcctgatgcagcttctcaacactgtgcccgtaggtatccatatggtcttcgtcgatattggtaacgacggacataatcggtgtcagtgcagaaaggatgcatccgaccgtcggcttcggcaacgatgtattcgcctttgcccaagcgggcgttggtgcctgcggcgttga

SEQ ID NO: 332 - protein, 124 aa, Neisseria meningitidis
MSFHLNMDGEFHLRADVFDVGGVDVGGIVQTVSSIRFAHFGQNRADVFAVNTQKGFAVEGHTVDEIDKRLMQLLNTVPVGIHMVFVDIGNDGHNRCQCRKDASDRRLRQRCIRLCPSGRWCLRR

SEQ ID NO: 333 - DNA, 375 bp, Neisseria gonorrhoeae
atggccggtcataccgggcagggtgttgatttccaacagatagagtttgccgtcggtatctttgaggaaatcgacgcgcacgcagccttccgcaccgattgcctgtgcgccgcgaaccgccagttcgcgcatcaggctttcttcggcttcggtcaaatcttccgaaggacattgataaatggtgtcgtctcggttgtacttggcttcgtagtcgtaaaactcggttgcggggatgatgtgtatgccgggcagccctttgccgttcaggacggggcaggaatattcgccgccgccgataaaacgttcggcaatgatttcgcccctgaaggtgtttcaattcttcgtaaacgcttttcagacggcctttttctttga

SEQ ID NO: 334 - protein, 124 aa, Neisseria gonorrhoeae
MAGHTGQGVDFQQIEFAVGIFEEIDAHAAFRTDCLCAANRQFAHQAFFGFGQIFRRTLINGVVSVVLGFVVVKLGCGDDVYAGQPFAVQDGAGIFAAADKTFGNDFAPEGVSILRKRFSDGLFL

SEQ ID NO: 335 - DNA, 374 bp, Neisseria meningitidis
atggctcgtcataccgggcagggtgttgatttccaacagatagagtttgccgtcggtatctttgaggaaatcgacgcgcacgcagccttccgcaccgattgcctgcgcgccgcgaaccgccagttcgcgcatcaggctttcttcggcttcggtcaaatcttccgaaggacattgataaatggtgtcgtcgcggttgtacttggcttcgtagtcgtaaaactcggttgcgggaatgatgtgtatgccgggcagccctttgccgttcaggacggggcaggaatattcgccgccgccgataaaacgttcggcaatgatttcgccctgaaggtgtttcaattcttcgtaaacgcttttcagacggccttttcctttga

SEQ ID NO: 336 - protein, 124 aa, Neisseria meningitidis
  misc_feature (108)..(108): Xaa can be any naturally occurring amino acid
MARHTGQGVDFQQIEFAVGIFEEIDAHAAFRTDCLRAANRQFAHQAFFGFGQIFRRTLINGVVAVVLGFVVVKLGCGNDVYAGQPFAVQDGAGIFAAADKTFGNDFAXEGVSILRKRFSDGLFL

SEQ ID NO: 337 - DNA, 374 bp, Neisseria meningitidis
atggccggtcataccgggcagggtgttgatttccaacagatagagtttgccgtcggtatctttgaggaaatcgacgcgcacgcagccttccgcaccgattgcctgcgcgccgcgaaccgccagttcgcgcatcaggctttcttcggcttcggtcagatcttccgaaggacattgataaatggtgtcgttgcggttgtacttggcttcgtagtcataaaactcggtcgcggggatgatgtgtatgccgggcaggcctttgccgttcaacacagggcaggaatattcgccgccgccgataaaccgttcggcaatgatttcgccctgaaagtgtttcaattcttcgtaaacgcttttcagacggccttttcctttga

SEQ ID NO: 338 - protein, 124 aa, Neisseria meningitidis
  misc_feature (108)..(108): Xaa can be any naturally occurring amino acid
MAGHTGQGVDFQQIEFAVGIFEEIDAHAAFRTDCLRAANRQFAHQAFFGFGQIFRRTLINGVVAVVLGFVVIKLGRGDDVYAGQAFAVQHRAGIFAAADKPFGNDFAXESVSILRKRFSDGLFL

SEQ ID NO: 339 - DNA, 1311 bp, Neisseria gonorrhoeae
atggatatttcaaaacaaacattgctggatagggtttttaacctgaaggcaaacggtacgacggtacgtaccgagttgatggcgggtttgacgacctttttgacgatgtgctacatcgttatcgtcaatcccctgattttgggcgagaccggaatggatatgggggcggtattcgtcgctacctgtatcgcatccgccatcggctgttttgtcatgggttttatcggcaactatccgattgcgcttgccccggggatggggctgaatgcctatttcacctttgccgtcgttaagggtatgggcgtgccttggcaggtggcgttgggtgcggtgttcatttccggtctgattttcatcctgttcagcttttttaaagtcagggaaatgctggtcaacgcactgcctatgggtttgaaaatgtcgattgccgccggtatcggtttgtttttggcactgatttccctgaaaggcgcaggcattatcgttgccaatccggcaaccttggtcggcttgggcgatattcatcagcccagcgcactgttggcattgttcggttttgtcatggtggtcgtattggggtatttccgcgttcaaggcgcaatcatcatcaccattctgacgattaccgtcattgccagcctgatgggtttgaacgagtttcacggcgtggtcggcgaagtaccgggcattgcgccgacctttatgcagatggattttaaaggtctgtttaccgtcagcatggtcagcgtgattttcgtcttcttcttggtcgatttgttcgacagtaccggaacgctggtcggcgtatcccaccgtgccggactgctggtggacggtaagctgccccgcctgaaacgcgcactgcttgcagactctaccgccattgtggcaggtgcggctttgggtacttcttcaaccacgccttatgtggaaagcgcggcgggcgtatcggcaggcggacggaccggcctgacggcggttaccgtcggcgtattgatgctggcgtgtctgatgttctccccattggcgaaaagtgttccggtatttgccaccgcgcccgcactgctttatgtcggcacgcagatgctccgcagtgcgagggacattgattgggacgatatgactgaagccgcgcccgcgttcctgaccattgtcttcatgccgtttacctattcgattgcagacggcatcgccttcggcttcatcagctatgccgtggtcaaacttttgtgtcgccggactggggacgtgccgcctatggtatgggttgttgccgtattgtgggcattgaaattctggtatttgggctga

SEQ ID NO: 340 - protein, 436 aa, Neisseria gonorrhoeae
MDISKQTLLDRVFNLKANGTTVRTELMAGLTTFLTMCYIVIVNPLILGETGMDMGAVFVATCIASAIGCFVMGFIGNYPIALAPGMGLNAYFTFAVVKGMGVPWQVALGAVFISGLIFILFSFFKVREMLVNALPMGLKMSIAAGIGLFLALISLKGAGIIVANPATLVGLGDIHQPSALLALFGFVMVVVLGYFRVQGAIIITILTITVIASLMGLNEFHGVVGEVPGIAPTFMQMDFKGLFTVSMVSVIFVFFLVDLFDSTGTLVGVSHRAGLLVDGKLPRLKRALLADSTAIVAGAALGTSSTTPYVESAAGVSAGGRTGLTAVTVGVLMLACLMFSPLAKSVPVFATAPALLYVGTQMLRSARDIDWDDMTEAAPAFLTIVFMPFTYSIADGIAFGFISYAVVKLLCRRTGDVPPMVWVVAVLWALKFWYLG

SEQ ID NO: 341 - DNA, 1311 bp, Neisseria meningitidis
atggacacttcaaaacaaacactgttggacgggatttttaagctgaaggcaaacggtackacggtgcgtaccgagttgatggcgggtttgacaacttttttgacgatgtgctacatcgttatcgtcaaccctcygattttgggcgagaccggcatggatatgggggcggtattcgtcgctacctgtatcgcgtctgccatcggctgttttgttatgggttttgtcggcaactatccgattgcactcgcaccggggatggggctgaatgcctatttcacctttgccgtcgttaagggtatgggcgtgccttggcaggttgcgttgggtgcggtgttcatctccggtctgatttttatcctgttcagcttttttaaagtcagggaaatgctggtcaacgcactgcctatgggtttgaaaatgtcgattgctgccggtatcggtttgtttttggcactgatttccctgaaaggcgcaggcattatcgttgccaatccggcaaccttggtcggtttgggcgatattcatcagccgtccgcgttgttggcattgttcggttttgctatggtggtcgtattgggacatttccgcgttcaaggcgcaatcatcatcaccatcttgaccattaccgtcattgccagcctgatgggtttgaatgaatttcacggcatcatcggcgaagtaccgagcattgcgccgacttttatgcagatggattttgaaggcctgtttaccgtcagcatggtcagtgtgattttcgtcttcttcttggtcgatctatttgacagtaccggaacgctggtcggcatatcccaccgtgccgggctgctggtggacggtaagctgccccgcctgaaacgcgcactgcttgcagactctaccgccattgtggcaggtgcggctttgggtacttcttccaccacgccttatgtggaaagcgcggcgggcgtatcggcaggcggacggaccggcctgacggcggttaccgtcggcgtattgatgctcgcctgcctgatgttttcacctttggcgaaaagtgttcccgcttttgccaccgcgcccgccctgctttatgtcggcacgcagatgctccgcagtgcgagggatattgattgggacgatatgacggaagccgcacctgcgttcctgaccattgttttcatgccgtttacttattcgattgcagacggcatcgctttcggcttcatcagttatgccgtggttaaacttttatgccgccgcaccaaagacgttccgcctatggtatggattgttgccgtattgtgggcactgaaattctggtatttgggctga

SEQ ID NO: 342 - protein, 436 aa, Neisseria meningitidis
  misc_feature (45)..(45): Xaa can be any naturally occurring amino acid
MDTSKQTLLDGIFKLKANGTTVRTELMAGLTTFLTMCYIVIVNPXILGETGMDMGAVFVATCIASAIGCFVMGFVGNYPIALAPGMGLNAYFTFAVVKGMGVPWQVALGAVFISGLIFILFSFFKVREMLVNALPMGLKMSIAAGIGLFLALISLKGAGIIVANPATLVGLGDIHQPSALLALFGFAMVVVLGHFRVQGAIIITILTITVIASLMGLNEFHGIIGEVPSIAPTFMQMDFEGLFTVSMVSVIFVFFLVDLFDSTGTLVGISHRAGLLVDGKLPRLKRALLADSTAIVAGAALGTSSTTPYVESAAGVSAGGRTGLTAVTVGVLMLACLMFSPLAKSVPAFATAPALLYVGTQMLRSARDIDWDDMTEAAPAFLTIVFMPFTYSIADGIAFGFISYAVVKLLCRRTKDVPPMVWIVAVLWALKFWYLG

SEQ ID NO: 343 - DNA, 1311 bp, Neisseria meningitidis
atggacacttcaaaacaaacactgttggacgggatttttaagctgaaggcaaacggtacgacggtgcgtaccgagttgatggcgggtttgacaacttttttgacgatgtgctacatcgttatcgtcaaccctctgattttgggcgagaccggcatggatatgggggcggtattcgtcgctacctgtatcgcgtctgccatcggctgttttgttatgggttttgtcggcaactatccgattgcactcgcaccggggatggggctgaatgcctatttcacctttgccgtcgttaagggtatgggcgtgccttggcaggttgcgttgggtgcggtgttcatctccggtctgattttcatcctgttcagcttttttaaagtcagggaaatgctggtcaacgcactgcctatgggtttgaaaatgtcgattgctgccggtatcggtttgtttttggcactgatttccctgaaaggcgcaggcattatcgttgccaatccggcaaccttggtcggcttgggcgatattcatcagccgtccgcgttgttggcactgttcggttttgccatggtggtcgtattgggacatttccgcgttcaaggcgcaatcatcatcaccattttgacgattaccgtcattgccagcctgatgggtttgaacgaatttcacggcatcatcggcgaagtgccgagcattgcgccgacttttatgcagatggattttaaagggttgtttaccgtcagcatggtcagcgtgattttcgtctttttcctagtcgatctgttcgacagtaccggaacactggtcggtgtatcgcatcgtgccggactgctggtggacggtaagctgccccgcctgaaacgcgcactgcttgcagactctaccgctattgtggcaggtgcggctttgggtacttcttcaaccacgccttatgtggaaagtgcggcgggcgtatcggcaggcgggcggacaggtctgacggcggttaccgtcggcgtattgatgctcgcctgcctgatgttttcacctttggcgaaaagtgttcccgcttttgccaccgcgcccgccctgctttatgtcggcacgcagatgctccgcagtgcgagggacatcgattgggacgatatgacggaagccgcacccgcattcctgaccattgtcttcatgccgtttacctattcgattgcagacggcatcgctttcggcttcatcagttatgccgtggttaaacttttatgccgccgcaccaaagacgttccgcctatggtatggattgttgccgtattgtgggcactgaaattctggtatttgggctga

SEQ ID NO: 344 - protein, 436 aa, Neisseria meningitidis
MDTSKQTLLDGIFKLKANGTTVRTELMAGLTTFLTMCYIVIVNPLILGETGMDMGAVFVATCIASAIGCFVMGFVGNYPIALAPGMGLNAYFTFAVVKGMGVPWQVALGAVFISGLIFILFSFFKVREMLVNALPMGLKMSIAAGIGLFLALISLKGAGIIVANPATLVGLGDIHQPSALLALFGFAMVVVLGHFRVQGAIIITILTITVIASLMGLNEFHGIIGEVPSIAPTFMQMDFKGLFTVSMVSVIFVFFLVDLFDSTGTLVGVSHRAGLLVDGKLPRLKRALLADSTAIVAGAALGTSSTTPYVESAAGVSAGGRTGLTAVTVGVLMLACLMFSPLAKSVPAFATAPALLYVGTQMLRSARDIDWDDMTEAAPAFLTIVFMPFTYSIADGIAFGFISYAVVKLLCRRTKDVPPMVWIVAVLWALKFWYLG

SEQ ID NO: 345 - DNA, 378 bp, Neisseria gonorrhoeae
atgaccgccgacggtctcttcgtcgctttcaacttcaatacgtttgccgttgtgcgaatattgataccagtacagcaggatgctgcccaggctggcgatcagtttgtcggcgatgtcgcgcgcttcgctgtcgggatggctttcgcgttcgggatgaacgcagccgagcatggacacgccggtacgcatcacgtccatcggatgggtatgtgcaggcaggctttccaaaactttaatcacacggataggcaggccgcgcatggatttgagcttggttttataagcggccagctcgaatttgttgggcagatggccgtgaatcagcaagtgtgcgacttcttcaaactcgcatttttgtgccaaattagaatgtcgtaa

SEQ ID NO: 346 - protein, 125 aa, Neisseria gonorrhoeae
MTADGLFVAFNFNTFAVVRILIPVQQDAAQAGDQFVGDVARFAVGMAFAFGMNAAEHGHAGTHHVHRMGMCRQAFQNFNHTDRQAAHGFELGFISGQLEFVGQMAVNQQVCDFFKLAFLCQIRMS

SEQ ID NO: 347 - DNA, 378 bp, Neisseria meningitidis
atgaccgccgatggtctcttcgtcgctttcaacctcaatgcgtttgccgttgtgcgaatattgataccagtacaagaggatgctgccgaggctggcgatcagtttgtcggcgatgtcgcgcgcttcactttccggatggctttcacgttcaggatgaacgcagcccagcatggatacgccggtacgcattacgtccatcggatgggtatgtgcaggcaggctttccaaaactttaatcacacggataggcaggccgcgcatggatttgagcttggttttataagcggccagctcgaatttgttgggcagatggccgtgaatcagcaggtgggcgacttcttcaaactcgcatttttgtgccaaatcagaatgtcgtaa

SEQ ID NO: 348 - protein, 125 aa, Neisseria meningitidis
MTADGLFVAFNLNAFAVVRILIPVQEDAAEAGDQFVGDVARFTFRMAFTFRMNAAQHGYAGTHYVHRMGMCRQAFQNFNHTDRQAAHGFELGFISGQLEFVGQMAVNQQVGDFFKLAFLCQIRMS

SEQ ID NO: 349 - DNA, 378 bp, Neisseria meningitidis; identical to SEQ ID NO: 347

SEQ ID NO: 350 - protein, 125 aa, Neisseria meningitidis; identical to SEQ ID NO: 348

SEQ ID NO: 351 - DNA, 1920 bp, Neisseria gonorrhoeae
atgctgggacgcgcgtccatgatgcgcctgcccgatattgtcggcgtggagctgacgggcaaacggcaggcgggcattactgccacagacatcgtgttggcactgaccgaattcttgcgtaaagagcgcgtggtcggggcgtttgtcgaatttttcggcgagggcgcgagaagcctgtctatcggcgaccgcgcgaccatttccaacatgacgccggagttcggcgcgactgccgccatgttcgccatcgacgcgcaaactattgattatttgaaactgaccggacgtgacgacgcgcaggtgaaattggtggaaacctacgccaaaaccgcaggcttatgggcaggtggcttgaaaaccgccgtttatccgcgcgttttgaaatttgatttgagcagcgtaacgcgcaatatggcaggcccgagcaacccgcacgcgcgttttgccaccgccgatttggcggcgaaagggctggcgaagccttacgaagagccttcagacggccaaatgcctgacggtgcagtgattattgccgcgattacttcgtgtaccaatacttccaacccgcgcaacgttgtcgccgccgcactgttggcacgcaatgccaaccgcctcggcttgaaacgcaaaccttgggtgaaatcttcgtttgccccgggttcaaaagtagccggaatctatttgaaagaagcaggcttgttgcccgaaatggaaaaactcggcttcggtatcgtcgccttcgcatgtaccacctgtaacggcatgagcggcgcgctcgacccgaaaatccaacaagaaatcatcgaccgcgatttgtacgccaccgccgtattgtcaggcaaccgcaacttcgacggccgtatccatccgtatgcgaaacaggctttcctcgcttcgcctcctttggtcgttgcctacgcattggcaggtagcatccgtttcgatattgaaaacgacgtactcggcgttgcagacggccgcgaaatccgcctgaaagatatctggccgacagacgaagaaatcgatgccatcgttgccgaatatgtgaaaccgcaacaattccgcgacatttatatcccgatgtccgacaccggcacagcgcaaaaagcaccaagcccgctgtacgactggcgaccgatgtccacctacatccgccgtccgccctattgggaaggcgcactggcaggggaacgtacattaagaggtatgcgtccgccggcgattttgcccgacaacatcaccaccgaccacatctcgccatccaatgcgattttggccggcagtgccgcaggtgaatatttggcgaaaatgggtttgcctgaagaagacttcaactcttacgcaacccaccgcggcgaccacttgaccgcccaacgcgcaaccttcgccaatccgaaactgtttaacgaaatggtgagaaacgaagacggcagcgtacgccaaggttcgttggcacgcgttgaaccagaaggccaaaccatgcgcatgtgggaagccatcgaaacctatatgaaccgcaaacagccgcttatcatcattgccggtgcggactatggtcaaggctcaagccgcgactgggcggcgaagggcgtgcggctggcgggtgtggaagccatcgccgccgaaggtttcgagcgcatccaccgcaccaacctcatcggcatgggcgtcttgccgctgcaattcaaacccggcaccaaccgccataccctgcaactggacggtacggaaacctacgacgttgtcggcgaacgcacaccgcgctgcggcctgaccctcgtgattcaccgtaaaaacggagaaaccgtcgaagttccggttacctgccgccccgataccgcagaagaagcattggtatatgaagccggcggcgtattgcaacggtttgcacaggactttttggaagggaacgcggcttag

SEQ ID NO: 352 - protein, 639 aa, Neisseria gonorrhoeae
MLGRASMMRLPDIVGVELTGKRQAGITATDIVLALTEFLRKERVVGAFVEFFGEGARSLSIGDRATISNMTPEFGATAAMFAIDAQTIDYLKLTGRDDAQVKLVETYAKTAGLWAGGLKTAVYPRVLKFDLSSVTRNMAGPSNPHARFATADLAAKGLAKPYEEPSDGQMPDGAVIIAAITSCTNTSNPRNVVAAALLARNANRLGLKRKPWVKSSFAPGSKVAGIYLKEAGLLPEMEKLGFGIVAFACTTCNGMSGALDPKIQQEIIDRDLYATAVLSGNRNFDGRIHPYAKQAFLASPPLVVAYALAGSIRFDIENDVLGVADGREIRLKDIWPTDEEIDAIVAEYVKPQQFRDIYIPMSDTGTAQKAPSPLYDWRPMSTYIRRPPYWEGALAGERTLRGMRPPAILPDNITTDHISPSNAILAGSAAGEYLAKMGLPEEDFNSYATHRGDHLTAQRATFANPKLFNEMVRNEDGSVRQGSLARVEPEGQTMRMWEAIETYMNRKQPLIIIAGADYGQGSSRDWAAKGVRLAGVEAIAAEGFERIHRTNLIGMGVLPLQFKPGTNRHTLQLDGTETYDVVGERTPRCGLTLVIHRKNGETVEVPVTCRPDTAEEALVYEAGGVLQRFAQDFLEGNAA

SEQ ID NO: 353 - DNA, 1920 bp, Neisseria meningitidis
atgctgggacgcgcgtccatgatgcgcctgcccgatattgtcggcgttgagctgaacggcaaacggcaggcgggcattacggcgacggatattgtgttggcactgaccgagtttctgcgcaaagaacgcgtggtcggggcgtttgtcgaattcttcggcgagggcgcgagaagcctgtctatcggcgaccgcgcgaccatttccaacatgacgccggagttcggcgcgactgccgcgatgttcgctattgatgagcaaaccattgattatttgaaactgaccggacgcgacgacgcgcaggtgaaattggtggaaacctacgccaaaaccgcaggcttgtgggcagatgccttgaaaaccgccgtttatcctcgcgttttgaaatttgatttgagcagcgtaacgcgcaatatggcaggcccaagtaacccgcatgcccgttttgcgaccgccgatttggcggcgaaagggctggcgaagccttacgaagagccttcggacggccaaatgcccgacggctcggtcatcatcgccgcgattaccagttgcaccaacacttccaacccgcgcaacgttgttgccgccgcgctcttggcacgcaatgccaaccgtctcggcttgaaacgcaaaccttgggtgaaatcttcgtttgccccgggttcaaaagtagccgaaatctatttgaaagaagcgggcctgttgcccgaaatggaaaaactcggcttcggtatcgtcgccttcgcctgcaccacctgcaacggcatgagtggcgcgctggatccgaaaatccagaaagaaatcatcgaccgcgatttgtacgccaccgccgtattatcaggcaaccgcaacttcgacggccgtatccacccgtatgcgaaacaggctttcctcgcttcgcctccgttggtcgttgcctacgcgctggcaggcagtatccgtttcgatattgaaaacgacgtactcggcgttgcagacggcaaggaaatccgcctgaaagacatttggcctgccgatgaagaaatcgatgccgtcgttgccgaatatgtgaaaccgcagcagttccgcgatgtgtatgtaccgatgttcgacaccggcacagcgcaaaaagcacccagtccgctgtacgattggcgtccgatgtccacctacatccgccgtccgccttactgggaaggcgcgctggcaggggaacgcacattaagaggtatgcgtccgctggcgattttgcccgacaacatcaccaccgaccacctctcgccgtccaatgcgattttggccgtcagtgccgcaggcgagtatttggcgaaaatgggtttgcctgaagaagacttcaactcttacgcaacccaccgcggcgaccacttgaccgcccaacgcgctaccttcgccaatccgaaactgtttaacgaaatggtgaaaaacgaagacggcagcgtgcgccaaggctcgttcgcccgcgtcgaacccgaaggcgaaaccatgcgcatgtgggaagccatcgaaacctatatgaaccgcaaacagccgctcatcatcattgccggtgcggactatggtcaaggctcaagccgcgactgggctgcaaaaggcgtacgcctcgccggcgtagaagcgattgttgccgaaggcttcgagcgtatccaccgcaccaaccttatcggcatgggcgtgttgccgctgcagttcaaacccgacaccaaccgccataccctgcaactggacggtacggaaacctacgacgtggtcggcgaacgcacaccgcgctgcgacctgaccctcgtgattcaccgtaaaaacggcgaaaccgttgaagttcccgttacctgctgcctcgatactgcagaagaagtattggtatatgaagccggcggcgtgttgcaacggtttgcacaggattttttggaagggaacgcggcttag

SEQ ID NO: 354 - protein, 639 aa, Neisseria meningitidis
MLGRASMMRLPDIVGVELNGKRQAGITATDIVLALTEFLRKERVVGAFVEFFGEGARSLSIGDRATISNMTPEFGATAAMFAIDEQTIDYLKLTGRDDAQVKLVETYAKTAGLWADALKTAVYPRVLKFDLSSVTRNMAGPSNPHARFATADLAAKGLAKPYEEPSDGQMPDGSVIIAAITSCTNTSNPRNVVAAALLARNANRLGLKRKPWVKSSFAPGSKVAEIYLKEAGLLPEMEKLGFGIVAFACTTCNGMSGALDPKIQKEIIDRDLYATAVLSGNRNFDGRIHPYAKQAFLASPPLVVAYALAGSIRFDIENDVLGVADGKEIRLKDIWPADEEIDAVVAEYVKPQQFRDVYVPMFDTGTAQKAPSPLYDWRPMSTYIRRPPYWEGALAGERTLRGMRPLAILPDNITTDHLSPSNAILAVSAAGEYLAKMGLPEEDFNSYATHRGDHLTAQRATFANPKLFNEMVKNEDGSVRQGSFARVEPEGETMRMWEAIETYMNRKQPLIIIAGADYGQGSSRDWAAKGVRLAGVEAIVAEGFERIHRTNLIGMGVLPLQFKPDTNRHTLQLDGTETYDVVGERTPRCDLTLVIHRKNGETVEVPVTCCLDTAEEVLVYEAGGVLQRFAQDFLEGNAA

SEQ ID NO: 355 - DNA, 1920 bp, Neisseria meningitidis
atgctgggacgcgcgtccatgatgcgcctgcccgatattgtcggcgttgagctgaacggcaaacggaaggcgggcattacggcgacggatattgtgttggcactgaccgagtttctgcgcaaagaacgcgtggtcggggcgtttgtcgaattcttcggcgagggcgcgagaagcctgtctatcggcgaccgcgcgaccatttccaacatgacgccggagttcggcgcgactgccgcgatgttcgctattgatgagcaaaccattgattatttgaaactgaccggacgcgacgacgcgcaggtgaaattggtggaaacctacgccaaaaccgcaggcttgtgggcagatgccttgaaaaccgccgtttatccgcgcgttttgaaatttgatttgagcagcgtaacgcgcaatatggcaggcccgagcaacccgcacgcgcgttttgcgaccgccgatttggccggcaaaggcttggctaaaccttacgaagagccttcagacggccaaatgcctgacggtgcagtgattattgccgcgattacttcctgtaccaatacttccaatccgcgcaacgttgtcgccgccgcgctgttggcacgcaatgccaaccgcctcggcttgcaacgcaaaccttgggtgaaatcttcgtttgccccgggttcaaaagtagccgaaatctatttgaaagaagcagatctgctgcccgaaatggaaaaactcggcttcggtatcgttgccttcgcatgtaccacctgtaacggcatgagcggcgcgctggatccgaaaatccagaaagaaatcatcgaccgcgatttgtacgccaccgccgtattgtcaggcaaccgcaactttgacggccgtatccatccgtatgcgaaacaggctttcctcgcttcgcctccgttggtcgttgcctacgcgctggcaggcagcatccgtttcgatattgaaaacgacgtactcggcgttgcagacggcaaagaaatccgcctgaaagacatttggcctaccgatgaagaaatcgatgccatcgttgccgaatatgtgaaaccgcagcaatttcgcgacgtttatatcccgatgttcgacaccggcacagcgcaaaaagcaccaagcccgctgtacgactggcgtccaatgtctacctatatccgccgcccaccttactgggaaggcgcactggcaggggaacgcacattaagcggtatgcgtccgctggcgattttgcccgacaacatcaccaccgaccatctctcgccatccaatgcgattttggcaagcagtgccgcaggcgaatatttggcaaaaatgggtttgcctgaagaagacttcaactcttacgcaacccaccgtggcgaccacttgaccgcccaacgcgcaaccttcgccaatccgaaactgtttaacgaaatggtgagaaacgaagacggcagcgtacgccaaggttcgctggcacgcgttgaacccgaaggccaaaccatgcgcatgtgggaagccatcgaaacctatatgaaccgcaaacagccgctcatcatcattgccggcgcggactacggtcaaggctcaagccgcgactgggctgcaaaaggcgtacgcctcgccggcgtggaagcgattgttgccgaaggcttcgagcgtatccaccgcaccaacttgatcggtatgggcgtgttgccgctgcagttcaaaccgggtaccaaccgccacaccctgcaactggacggtacggaaacctacgacgttgtcggcgaacgcacaccgcgctgcgacctgacccttgtgattcaccgtaaaaacggcgagaccgtcgaagtccccattacctgccgcctcgataccgcagaagaagtgttggtatatgaagccggtggcgtattgcaacggtttgcacaggattttttggaagggaacgcggcttag

SEQ ID NO: 356 - protein, 639 aa, Neisseria meningitidis
MLGRASMMRLPDIVGVELNGKRKAGITATDIVLALTEFLRKERVVGAFVEFFGEGARSLSIGDRATISNMTPEFGATAAMFAIDEQTIDYLKLTGRDDAQVKLVETYAKTAGLWADALKTAVYPRVLKFDLSSVTRNMAGPSNPHARFATADLAGKGLAKPYEEPSDGQMPDGAVIIAAITSCTNTSNPRNVVAAALLARNANRLGLQRKPWVKSSFAPGSKVAEIYLKEADLLPEMEKLGFGIVAFACTTCNGMSGALDPKIQKEIIDRDLYATAVLSGNRNFDGRIHPYAKQAFLASPPLVVAYALAGSIRFDIENDVLGVADGKEIRLKDIWPTDEEIDAIVAEYVKPQQFRDVYIPMFDTGTAQKAPSPLYDWRPMSTYIRRPPYWEGALAGERTLSGMRPLAILPDNITTDHLSPSNAILASSAAGEYLAKMGLPEEDFNSYATHRGDHLTAQRATFANPKLFNEMVRNEDGSVRQGSLARVEPEGQTMRMWEAIETYMNRKQPLIIIAGADYGQGSSRDWAAKGVRLAGVEAIVAEGFERIHRTNLIGMGVLPLQFKPGTNRHTLQLDGTETYDVVGERTPRCDLTLVIHRKNGETVEVPITCRLDTAEEVLVYEAGGVLQRFAQDFLEGNAA

SEQ ID NO: 357 - DNA, 1245 bp, Neisseria gonorrhoeae
atgtccgccaaaactccgtcgctcttcggcggcgcgatgattatcgccgggaaggttatcggcgcaggtatgttccccaaccccaccgccaacttgggggacgggttaataggctcgctgattgtgctgctgtacacctggtttccattctcctccggcgccctcatgattttggaagtcaacacccataacccccgaggggcaagttttgacaccatggtcaaagacctgctcggacgcggctggaacatcatcaacggcatcgccgtcgctttggtcctatacggctcgacctacgcgtacattttagtcggcggtgacctgaccgccaaaggcatcggcagcgcagtaggcggcaaaatttcgctcaccgtcggacaactcgtcttcttcggcatcctcgccttttgcgtatgggcatccgcacgcttggtcgaccgctttaccggcgtcctcatcggcggcatggtattaacctttatttgggcaaccggcggcctggttgccgatgccaaaccgtccgtcctcttcgacacccaagcccccgtcggcaccggctactggatttacgccgccaccgccctgcccgtctgcctcgcttccttcggcttccacggcaacgtttccagcctgctcaaatactttaaaggcgacgcgcccaaagtggcgaaatccatctgggcaggtacattggttgccttggtaatttacgtcctctggcaaaccgccatccaaagcaacctgccgcgcaacgagttcgcccccgtgattgccgccgagaggcaactctccgtcctgaatgaaaccctgtccaaattcgcccaaaccggcgatatggataaaatattgtccctatttccctacatggcaatcgccacctcctttttaggcgtaaccttaggcctgtttgacaacatcgccgacatcttcaaatggaacgacagtatgtccgggcggggcaccaaaaccgtcgcgctgaacttcctgccgcccctgatttcctggctgctcctccccaccggcttctttaccgccattggtgcgtccggcctggcggcaaccgtctgggaccaaggcatcatccccgccatgctgctctacgtttccccccaaaaaattggcgcaggcaagacttataaagtttacggcggcttgtggctgatgttagtcttccttttcggcatcgccaacatcgccgcacaggtattgagccaaatggaactcgtccccgtatttaaaggataa

SEQ ID NO: 358 - protein, 414 aa, Neisseria gonorrhoeae
MSAKTPSLFGGAMIIAGKVIGAGMFPNPTANLGDGLIGSLIVLLYTWFPFSSGALMILEVNTHNPRGASFDTMVKDLLGRGWNIINGIAVALVLYGSTYAYILVGGDLTAKGIGSAVGGKISLTVGQLVFFGILAFCVWASARLVDRFTGVLIGGMVLTFIWATGGLVADAKPSVLFDTQAPVGTGYWIYAATALPVCLASFGFHGNVSSLLKYFKGDAPKVAKSIWAGTLVALVIYVLWQTAIQSNLPRNEFAPVIAAERQLSVLNETLSKFAQTGDMDKILSLFPYMAIATSFLGVTLGLFDNIADIFKWNDSMSGRGTKTVALNFLPPLISWLLLPTGFFTAIGASGLAATVWDQGIIPAMLLYVSPQKIGAGKTYKVYGGLWLMLVFLFGIANIAAQVLSQMELVPVFKG

SEQ ID NO: 359 - DNA, 1242 bp, Neisseria meningitidis
atgcccaacaaaaccccttcactgttcggcggcgcgatgattatcgccggcacggtcatcggcgcaggcatgctcgccaacccgaccgccacatccggcgtatggtttaccggctcgctggccgtgttgctgtacacctggttttctatgctttccagcggcctgatgattttggaagtcaacacccattatccgcacggcgcaagtttcgacacgatggtcaaagacctgctcggacgcggctggaacatcatcaacggcatcgccgtcgccttcgttttatacctgcttacttacgcttatatcttcgtcggcggcgacctgaccgccaaaggcttaggcagcgcggcaggcggcgacgtttcactcaccgtcggacaactcgtcttcttcggcatcctcgccttttgcgtatgggcatccgcacgcttggtcgaccgcttcaccggcgtccttatcggcggcatggtattgacctttatttgggcggccggcgggctgattgccgatgccaagccgtccgtcctcttcgatacccaagcccccgccggcacaaactactggatttacgccgccaccgccctgcccgtctgcctcgcttccttcggcttccacggcaacgtctccagcctgctcaaatactttaaaggcgacgcgcccaaagtggctaaatccatctggacgggcacactgattgcgctggtaatttacgtcctctggcaaaccgccatccaaggcaacctgccgcgcaacgagttcgcccccgtcatcgccgccgaagggcaagtctccgtcctcatcgaaaccctgtccaaattcgcccaaaccggcaatatggacaaaatattgtccctgttttcctatatggcgatcgccacctcgtttttaggcgtaacgctcggactcttcgactacatcgccgacatcttcaaatggaacgacagcatctccggccgcaccaaaaccgccgcgctgaccttcctgccgcccctgatttcctgcctgctcttccccaccggcttcgttaccgccatcggctacgtcggcctggcggcaaccgtctggacaggcatcatccccgccatgctgctctaccgttcgcgcaaaaaattcggcgcaggcaaaacctataaagtttacggcggcttgtggctgatggtttgggtcttccttttcggcatcgtcaacatcgccgcacaggtattgagccaaatggaactcgtccccgtatttaaaggataa

SEQ ID NO: 360 - protein, 413 aa, Neisseria meningitidis
MPNKTPSLFGGAMIIAGTVIGAGMLANPTATSGVWFTGSLAVLLYTWFSMLSSGLMILEVNTHYPHGASFDTMVKDLLGRGWNIINGIAVAFVLYLLTYAYIFVGGDLTAKGLGSAAGGDVSLTVGQLVFFGILAFCVWASARLVDRFTGVLIGGMVLTFIWAAGGLIADAKPSVLFDTQAPAGTNYWIYAATALPVCLASFGFHGNVSSLLKYFKGDAPKVAKSIWTGTLIALVIYVLWQTAIQGNLPRNEFAPVIAAEGQVSVLIETLSKFAQTGNMDKILSLFSYMAIATSFLGVTLGLFDYIADIFKWNDSISGRTKTAALTFLPPLISCLLFPTGFVTAIGYVGLAATVWTGIIPAMLLYRSRKKFGAGKTYKVYGGLWLMVWVFLFGIVNIAAQVLSQMELVPVFKG

SEQ ID NO: 361 - DNA, 1242 bp, Neisseria meningitidis
  misc_feature (55)..(55): n is a, c, g, or t
  misc_feature (206)..(206): n is a, c, g, or t
  misc_feature (736)..(736): n is a, c, g, or t
  misc_feature (796)..(796): n is a, c, g, or t
  misc_feature (991)..(991): n is a, c, g, or t
  misc_feature (1038)..(1038): n is a, c, g, or t
  misc_feature (1092)..(1092): n is a, c, g, or t
  misc_feature (1183)..(1183): n is a, c, g, or t
  misc_feature (1200)..(1200): n is a, c, g, or t
atgcccaccaaaaccccttcactgttcggcggcgcgatgattatcgccggcacgntcatcggcgcaggtatgctcgccaacccgaccgccacatccggcgtatggtttaccggctcgctggccgtgttgctgtacacctggttttccatgctctccagcggcctgatgattttggaagtcaacacccactacccccacggcgcgancttcgacaccatggttaaagacctgctcggacggagctggaacatcatcaacggcatcgccgtcgccttcgttttatacctgcttacttacgcttatatcttcgtcggcggcgacctgaccgccaaaggcttaggcagcgcggcaggcggcaatgtttcactcaccgtcggacaactcgtcttcttcggcattctcgccttttgcgtatgggcatccgcacgcttggtcgaccgattcaccagcgtcctcatcggcggcatggtattaacctttatttgggcaaccggcggcctgattgccgatgccaaactgcccgtcctcttcgacacccaagcccctaccggcaccaactactggatttatgtcgccaccgccctgcccgtctgccttgcgtcattcggtttccacggcaacgtctccagcctgctcaaatactttaaaggcgacgcgcccaaagtggctaaatccatctggacgggcacactgattgcgctggtaatttacgtcctctggcaaaccgccatccaangcaacctgccgcgcaacgagttcgcccccgtgattgccgccgaagggcaagtctccgtcntgattgaaaccctgtccaaattcgcccaaaccggcaatatggacaaaatattgtccctgttttcctatatggcgatcgccacctcgtttttaggcgtaacgctcggactcttcgactacatcgccgacatcttcaaatggaacgacagcgtgtccggccgcaccaaaaccgccgcgctgaccttcctgccgcctntaatttcctgcctgctcttccccaccggctttgttaccgccatcggntacgtcggcctggcggcaaccgtctggacaggcatcatccccgccatgctgctntaccgttcgcgcaaaaaattcggcgcaggcaaaacctataaagtttacggcggcttgtggctgatggtttgggtcttccttttcggcatcntcaacatcgccgcacangtattgagccaaatggaactcgtccccgtatttaaaggataa

SEQ ID NO: 362 - protein, 413 aa, Neisseria meningitidis
  misc_feature (19)..(19): Xaa can be any naturally occurring amino acid
  misc_feature (69)..(69): Xaa can be any naturally occurring amino acid
  misc_feature (246)..(246): Xaa can be any naturally occurring amino acid
  misc_feature (266)..(266): Xaa can be any naturally occurring amino acid
  misc_feature (331)..(331): Xaa can be any naturally occurring amino acid
  misc_feature (395)..(395): Xaa can be any naturally occurring amino acid
  misc_feature (400)..(400): Xaa can be any naturally occurring amino acid
MPTKTPSLFGGAMIIAGTXIGAGMLANPTATSGVWFTGSLAVLLYTWFSMLSSGLMILEVNTHYPHGAXFDTMVKDLLGRSWNIINGIAVAFVLYLLTYAYIFVGGDLTAKGLGSAAGGNVSLTVGQLVFFGILAFCVWASARLVDRFTSVLIGGMVLTFIWATGGLIADAKLPVLFDTQAPTGTNYWIYVATALPVCLASFGFHGNVSSLLKYFKGDAPKVAKSIWTGTLIALVIYVLWQTAIQXNLPRNEFAPVIAAEGQVSVXIETLSKFAQTGNMDKILSLFSYMAIATSFLGVTLGLFDYIADIFKWNDSVSGRTKTAALTFLPPXISCLLFPTGFVTAIGYVGLAATVWTGIIPAMLLYRSRKKFGAGKTYKVYGGLWLMVWVFLFGIXNIAAXVLSQMELVPVFKG

SEQ ID NO: 363 - DNA, 870 bp, Neisseria gonorrhoeae
atgtccgcagaaacatacacacaaatcggctgggtaggcttagggcaaatgggtctgcctatggtaacgcggctcttggacggcggcatcgaagtcggcgtatacaaccgctcgcccgacaaaactgcccccatctccgccaaaggagcaaaagtttacggcagcaccgccgaactcgtccgcgcctgccccgtcattttcctgatggtttccgactatgccgccgtgtgcgacatcctgaacggagtccgcgacggattggccggcaaaatcatcgtcaacatgagcaccatctccccgaccgaaaacctcgccgtcaaagcacttgtcgaagccgcaggcggacagtttgccgaagcacccgtttccggatcggtcggacccgccaccaacggcacactgctgattctgttcggcggcagcgaagccgttttaaacccgctgcaaaaaatattttcccttgtcggcaaaaaaaccttccatttcggcgatgtcggcaaaggctcgggcgcgaaactcgtcttgaactcgctcttaggcattttcggcgaagcgtacagcgaagcgatgctgatggcgcggcagttcggcatcgataccgacaccatcgtcgaagccatcggcggctcggcaatggactcgcctatgtttcaaacaaaaaaatcactatgggcaaaccgtgagttcccccctgcctttgcactcaaacacgcttccaaagaccttaacctcgccgtcaaagagcttgaacaggcaggcaacaccctgcccgccgtcgaaaccgttgctgccagctaccgcaaagcagttgaagccggctacggcgaacaggacgtttccggcgtttacctgaaattggcagaacactga

SEQ ID NO: 364 - protein, 289 aa, Neisseria gonorrhoeae
MSAETYTQIGWVGLGQMGLPMVTRLLDGGIEVGVYNRSPDKTAPISAKGAKVYGSTAELVRACPVIFLMVSDYAAVCDILNGVRDGLAGKIIVNMSTISPTENLAVKALVEAAGGQFAEAPVSGSVGPATNGTLLILFGGSEAVLNPLQKIFSLVGKKTFHFGDVGKGSGAKLVLNSLLGIFGEAYSEAMLMARQFGIDTDTIVEAIGGSAMDSPMFQTKKSLWANREFPPAFALKHASKDLNLAVKELEQAGNTLPAVETVAASYRKAVEAGYGEQDVSGVYLKLAEH

SEQ ID NO: 365 - DNA, 864 bp, Neisseria meningitidis
atgtccgcaaacgaatacgcacaaatcggctggataggcttagggcaaatgggtctgcctatggtaacgcggctcttggacggcggcatcgaagtcggcgtatacaaccgctcgcccgacaaaactgcccccatctccgccaaaggcgcaaaagtttacggcaacaccgccgaactcgtccgcgactatcccgtcattttcctgatggtttccgactatgccgccgtgtgcgacatcctgaacggagtccgcgacggattggccggcaamatcatcgtcaacatgagcaccatctccccgaccgaaaagctcgccgtcaaagcacttgtcgaagcgcagmgacagtttgccgaagcacccgtttccggatcggtcgggcccgccaccaacggcacgctgctgattctgttcggcggcagcgaaccgttttaaacccgctgcaaaaaatattttccctcgtcggcaaaaaaaccttccatttcggcgatgtcggcaaaggttcgggcgcgaaactcgtcttgaactcgctcttgggcattttcggcgaacgtacagcgaasgmtgctgatggcgcggcagttcggcatcgataccgacaccatcgtcgaagccatcggsgactcggcaatggactcgcccatgttccaaaccaaaaaatccctgtgggcaaaccgcgaattcccgmccgmcttcgccctcaaacacgcctccaaagacctcaacctcgccgtcaaagagcttgaacaggcaggcaacaccctgcccgccgtcgaaaccgttgctgccagctaccgcaaagcagtcgaagccggctacgggacacaggacgtttccggcgtttacctgaaactggcagaacactga

SEQ ID NO: 366 - protein, 287 aa, Neisseria meningitidis
  misc_feature (90)..(90): Xaa can be any naturally occurring amino acid
  misc_feature (144)..(144): Xaa can be any naturally occurring amino acid
  misc_feature (174)..(174): Xaa can be any naturally occurring amino acid
  misc_feature (187)..(188): Xaa can be any naturally occurring amino acid
  misc_feature (229)..(230): Xaa can be any naturally occurring amino acid
MSANEYAQIGWIGLGQMGLPMVTRLLDGGIEVGVYNRSPDKTAPISAKGAKVYGNTAELVRDYPVIFLMVSDYAAVCDILNGVRDGLAGXIIVNMSTISPTEKLAVKALVEAQRQFAEAPVSGSVGPATNGTLLILFGGSEPFXTRCKKYFPSSAKKPSISAMSAKVRARNSSXTRSWAFSANVQRXXLMARQFGIDTDTIVEAIGDSAMDSPMFQTKKSLWANREFPXXFALKHASKDLNLAVKELEQAGNTLPAVETVAASYRKAVEAGYGTQDVSGVYLKLAEH

SEQ ID NO: 367 - DNA, 870 bp, Neisseria meningitidis
atgtccgcaaacgaatacacacaaatcggctggataggcttagggcaaatgggtctgcctatggtaacgcggctcttggacggcggcatcgaagtcggcgtatacaaccgctcgcccgacaaaactgcccccatctccgccaaaggcgcaaaagtttacggcaacaccgccgaactcgtccgcgactatcccgtcattttcctgatggtttccgactatgccgccgtgtgcgacatcctgaacggagtccgcgacggattggccggcaaaatcatcgtcaacatgagcaccatctccccgaccgaaaacctcgccgtcaaagcacttgtcgaagccgcaggcggacagtttgccgaagcacccgtttccggatcggtcgggcccgccaccaacggcacgctgctgattctgttcggcggcagcgaagccgttttaaacccgctgcaaaaaatattttccctcgtcggcaaaaaaaccttccatttcggcgatgtcggcaaaggttcgggcgcgaaactcgtcttgaactcgctcttgggcattttcggcgaagcgtacagcgaagcgatgctgatggcgcggcagttcggcatcgataccgacaccatcgtcgaagccatcggcggctcggcaatggactcgcccatgttccaaaccaaaaaatccctgtgggcaaaccgcgaattcccacccgccttcgccctcaaacacgcctccaaagacctcaacctcgccgtcaaagagcttgaacaggcaggcaacaccctgcccgccgtcgaaaccgttgctgccagctaccgcaaagcagtcgaagccggctacggcgaacaggacgtttccggcgtttacctgaaattggcagaacactga

SEQ ID NO: 368 - protein, 289 aa, Neisseria meningitidis
MSANEYTQIGWIGLGQMGLPMVTRLLDGGIEVGVYNRSPDKTAPISAKGAKVYGNTAELVRDYPVIFLMVSDYAAVCDILNGVRDGLAGKIIVNMSTISPTENLAVKALVEAAGGQFAEAPVSGSVGPATNGTLLILFGGSEAVLNPLQKIFSLVGKKTFHFGDVGKGSGAKLVLNSLLGIFGEAYSEAMLMARQFGIDTDTIVEAIGGSAMDSPMFQTKKSLWANREFPPAFALKHASKDLNLAVKELEQAGNTLPAVETVAASYRKAVEAGYGEQDVSGVYLKLAEH

SEQ ID NO: 369 - DNA, 870 bp, Neisseria gonorrhoeae; identical to SEQ ID NO: 363

SEQ ID NO: 370 - protein, 289 aa, Neisseria gonorrhoeae; identical to SEQ ID NO: 364

SEQ ID NO: 371 - DNA, 870 bp, Neisseria meningitidis
  misc_feature (565)..(565): n is a, c, g, or t
atgtccgcaaacgaatacgcacaaatcggctggataggcttagggcaaatgggtctgcctatggtaacgcggctcttggacggcggcatcgaagtcggcgtatacaaccgctcgcccgacaaaactgcccccatctccgccaaaggcgcaaaagtttacggcaacaccgccgaactcgtccgcgactatcccgtcattttcctgatggtttccgactatgccgccgtgtgcgacatcctgaacggagtccgcgacggattggccggcaaaatcatcgtcaacatgagcaccatctccccgaccgaaaacctcgccgtcaaagcacttgtcgaagccgcaggcggacagtttgccgaagcacccgtttccggatcggtcgggcccgccaccaacggcacgctgctgattctgttcggcggcagcgaagccgttttaaacccgctgcaaaaaatattttccctcgtcggcaaaaaaaccttccatttcggcgatgtcggcaaaggttcgggcgcgaaactcgtcttgaactcgctcttgggcattttcggcgaagcgtacagcgaancgatgctgatggcgcggcagttcggcatcgataccgacaccatcgtcgaagccatcggsgactcggcaatggactcgcccatgttccaaaccaaaaaatccctgtgggcaaaccgcgaattcccgcccgccttcgccctcaaacacgcctccaaagacctcaacctcgccgtcaaagagcttgaacaggcaggcaacaccctgcccgccgtcgaaaccgttgctgccagctaccgcaaagcagtcgaagccggctacggcgaacaggacgtttccggcgtttacctgaaactggcagaacactga

SEQ ID NO: 372 - protein, 289 aa, Neisseria meningitidis
  misc_feature (189)..(189): Xaa can be any naturally occurring amino acid
MSANEYAQIGWIGLGQMGLPMVTRLLDGGIEVGVYNRSPDKTAPISAKGAKVYGNTAELVRDYPVIFLMVSDYAAVCDILNGVRDGLAGKIIVNMSTISPTENLAVKALVEAAGGQFAEAPVSGSVGPATNGTLLILFGGSEAVLNPLQKIFSLVGKKTFHFGDVGKGSGAKLVLNSLLGIFGEAYSEXMLMARQFGIDTDTIVEAIGDSAMDSPMFQTKKSLWANREFPPAFALKHASKDLNLAVKELEQAGNTLPAVETVAASYRKAVEAGYGEQDVSGVYLKLAEH

SEQ ID NO: 373 - DNA, 870 bp, Neisseria meningitidis; identical to SEQ ID NO: 367

SEQ ID NO: 374 - protein, 289 aa, Neisseria meningitidis; identical to SEQ ID NO: 368

SEQ ID NO: 375 - DNA, 513 bp, Neisseria gonorrhoeae
atggtattaacctttatttgggcaaccggcggcctggttgccgatgccaaaccgtccgtcctcttcgacacccaagcccccgtcggcaccggctactggatttacgccgccaccgccctgcccgtctgcctcgcttccttcggcttccacggcaacgtttccagcctgctcaaatactttaaaggcgacgcgcccaaagtggcgaaatccatctgggcaggtacattggttgccttggtaatttacgtcctctggcaaaccgccatccaaagcaacctgccgcgcaacgagttcgcccccgtgattgccgccgagaggcaactctccgtcctgaatgaaaccctgtccaaattcgcccaaaccggcgatatggataaaatattgtccctatttccctacatggcaatcgccacctcctttttaggcgtaaccttaggcctgtttgacaacatcgccggacatcttcaaatggaacgacagtatgtccgggcggcaccaaaaccgtcgcgctga

SEQ ID NO: 376 - protein, 170 aa, Neisseria gonorrhoeae
MVLTFIWATGGLVADAKPSVLFDTQAPVGTGYWIYAATALPVCLASFGFHGNVSSLLKYFKGDAPKVAKSIWAGTLVALVIYVLWQTAIQSNLPRNEFAPVIAAERQLSVLNETLSKFAQTGDMDKILSLFPYMAIATSFLGVTLGLFDNIAGHLQMERQYVRAAPKPSR

SEQ ID NO: 377 - DNA, 510 bp, Neisseria meningitidis
atggtattgacctttatttgggcggccggcgggctgattgccgatgccaagccgtccgtcctcttcgatacccaagcccccgccggcacaaactactggatttacgccgscaccgccctgcccgtctgcctcgcttccttcggcttccacggcaacgtctccagcctgctcaaatactttaaaggcgacgcgcccaaagtggctaaatccatctggacgggcacactgattgcgctggtaatttacgtcctctggcaaaccgccatccaaggcaacctgccgcgcaacgagttcgcccccgtcatcgccgccgaagggcaagtctccgtcctcatcgaaaccctgtccaaattcgcccaaaccggcaatatggacaaaatattgtccctgttttcctatatggcgatcgccacctcgtttttaggcgtaacgctcggactcttcgactacatcgcccatcttcaaatggaacgacagcatctccgggccgcaccaaaaccgccgcgctga

SEQ ID NO: 378 - protein, 169 aa, Neillia sinensis
  misc_feature (37)..(37): Xaa can be any naturally occurring amino acid
MVLTFIWAAGGLIADAKPSVLFDTQAPAGTNYWIYAXTALPVCLASFGFHGNVSSLLKYFKGDAPKVAKSIWTGTLIALVIYVLWQTAIQGNLPRNEFAPVIAAEGQVSVLIETLSKFAQTGNMDKILSLFSYMAIATSFLGVTLGLFDYIAHLQMERQHLRAAPKPPR

SEQ ID NO: 379 - DNA, 777 bp, Neisseria meningitidis
atggtattaacctttatttgggcaaccggcggcctgattgccgatgccaaactgcccgtcctcttcgacacccaagcccctaccggcaccaactactggatttatgtcgccaccgccctgcccgtctgccttgcgtcattcggtttccacggcaacgtctccagcctgctcaaatactttaaaggcgacgcgcccaaagtggctaaatccatctggacgggcacactgattgcgctggtaatttacgtcctctggcaaaccgccatccaaggcaacctgccgcgcaacgagttcgcccccgtgattgccgccgaagggcaagtctccgtcctgattgaaaccctgtccaaattcgcccaaaccggcaatatggacaaaatattgtccctgttttcctatatggcgatcgccacctcgtttttaggcgtaacgctcggactcttcgactacatcgccgacatcttcaaatggaacgacagcgtgtccggccgcaccaaaaccgccgcgctgaccttcctgccgcctctaatttcctgcctgctcttccccaccggctttgttaccgccatcggctacgtcggcctggcggcaaccgtctggacaggcatcatccccgccatgctgctctaccgttcgcgcaaaaaattcggcgcaggcaaaacctataaagtttacggcggcttgtggctgatggtttgggtcttccttttcggcatcgtcaacatcgccgcacaggtattgagccaaatggaactcgtccccgtatttaaaggataa

SEQ ID NO: 380 - protein, 258 aa, Neisseria meningitidis
MVLTFIWATGGLIADAKLPVLFDTQAPTGTNYWIYVATALPVCLASFGFHGNVSSLLKYFKGDAPKVAKSIWTGTLIALVIYVLWQTAIQGNLPRNEFAPVIAAEGQVSVLIETLSKFAQTGNMDKILSLFSYMAIATSFLGVTLGLFDYIADIFKWNDSVSGRTKTAALTFLPPLISCLLFPTGFVTAIGYVGLAATVWTGIIPAMLLYRSRKKFGAGKTYKVYGGLWLMVWVFLFGIVNIAAQVLSQMELVPVFKG

SEQ ID NO: 381 - DNA, 519 bp, Neisseria gonorrhoeae
atgttgccgggcttcaaccggatattcaaacggtttgctccaacactcggaacggcgcataaaacgccgcccttcgcgttatcccgaacggggcggctaatcagatcctatcgccataaaaggcggggtttcaaccgaaaaggaattgagatgaataaaaccttgtctattttgccggcggcaatcttactcggcgggtgcgccgccggcggcaacacattcggcagcttagacggcggcacgggtatgggtggcagcatcgtcaaaatgacggtagaaagccaatgccgtgcggaattggacaggcgcagcgaatggcgtttgaccgcgctggcgatgagtgccgaaaaacaggcggaatgggaaaacaagatttgcggctgcgctaccgaagaagcacctaaccagctgaccggcaacgatgtgatgcagatgctgaaccagtccacgcgcaatcaggcacttgccgccctgaccgtcaaaacggtttccgcctgcttcaaacgcctgtaccgctaa

SEQ ID NO: 382 - protein, 172 aa, Neisseria gonorrhoeae
MLPGFNRIFKRFAPTLGTAHKTPPFALSRTGRLIRSYRHKRRGFNRKGIEMNKTLSILPAAILLGGCAAGGNTFGSLDGGTGMGGSIVKMTVESQCRAELDRRSEWRLTALAMSAEKQAEWENKICGCATEEAPNQLTGNDVMQMLNQSTRNQALAALTVKTVSACFKRLYR

SEQ ID NO: 383 - DNA, 522 bp, Neisseria meningitidis
atgttgccgggcttcaaccggatattcaaacggtttgttccaacactcggaacggcgcataaaacgccgcccttcgcgttatcccgaacggggcggctaatcagattctatcgccataaaaggcggggtttcaaccgaaaaggaattgagatgaataaaaccttgtctattttgccggtggcaatcttactcggcggctgcgccgccggaggcggtaacacattcggcagcttagacggtggcacaggcatgggcggcagcatcgtcaaaatggcggttgggagccaatgccgtgcggaattggacaaacgcagcgaatggcgtttgaccgcgctggcgatgagtgccgaaaaacaggcggagtgggaaaacaagatttgcgcttgcgtcgcccaagaagcacccgaacggatgaccggcaacgatgtgatgcagatgctggctccgtccacgcgcaatcaggcacttgccgccctgaccgccaaaacggtttccgcctgcttcaaacacctgtaccgctaa

SEQ ID NO: 384 - protein, 173 aa, Neisseria meningitidis
MLPGFNRIFKRFVPTLGTAHKTPPFALSRTGRLIRFYRHKRRGFNRKGIEMNKTLSILPVAILLGGCAAGGGNTFGSLDGGTGMGGSIVKMAVGSQCRAELDKRSEWRLTALAMSAEKQAEWENKICACVAQEAPERMTGNDVMQMLAPSTRNQALAALTAKTVSACFKHLYR

SEQ ID NO: 385 - DNA, 522 bp, Neisseria meningitidis
atgttgccgggcttcaaccggatattcaaacggtttgttccaacactcggaacggcgcataaaacgccgcccttcgcgttatcccgaacggggcggctaatcagattctatcgccataaaaggcggggtttcaaccgaaaaggaattgagatgaataaaaccttgtctattttgccggtggcaatcttactcggcggctgcgccgccgggggcggtaacacattcggcagcttagacggcggcacaggtatgggcggcagcatcgtcaaaatggcggtagaaagccaatgccgtgcggaattgaacaaacgcagcgaatggcgtttgaccgcgctggcgatgagtgccgaaaaacaggcggaatgggaaaacaagatttgcgcttgcgtcgcccaagaagcacccaaccagctgaccggcaacgatgtgatgcagatgctggatccgtccacgcgcaatcaggcacttgccgccctgaccgccaaaacggtttccgcctgcttcaaacacctgtaccgctaa

SEQ ID NO: 386 - protein, 173 aa, Neisseria meningitidis
MLPGFNRIFKRFVPTLGTAHKTPPFALSRTGRLIRFYRHKRRGFNRKGIEMNKTLSILPVAILLGGCAAGGGNTFGSLDGGTGMGGSIVKMAVESQCRAELNKRSEWRLTALAMSAEKQAEWENKICACVAQEAPNQLTGNDVMQMLDPSTRNQALAALTAKTVSACFKHLYR

SEQ ID NO: 387 - DNA, 369 bp, Neisseria gonorrhoeae
atgtattatcgccgggttgtggggctatccgatggacttggcgatttggcagccggtattgatcgtaggcgtatgcttaccgcttttggaagcgggcatggaaatgacgcgcaaaggcaaaaccacccaatccgccgccatcgtggtgttctcttccgtctggtcaatccggttttcggctgggcgttgacgatgctgttggataatttgggcttaatcggctgcaaagaacgcagcgcgcaattaggttttgtcggacgagtattgatacccgcagtaggtttcttaatcttgtgtgtggcgatgggtgcggtcgggatgctgcccggtatccctccgtttttggagcagttcaaatctttgggctag

SEQ ID NO: 388 - protein, 122 aa, Neisseria gonorrhoeae
MYYRRVVGLSDGLGDLAAGIDRRRMLTAFGSGHGNDAQRQNHPIRRHRGVLFRLVNPVFGWALTMLLDNLGLIGCKERSAQLGFVGRVLIPAVGFLILCVAMGAVGMLPGIPPFLEQFKSLG

SEQ ID NO: 389 - DNA, 381 bp, Neisseria meningitidis
atgtattatcgccgggttatggggctatccgatggacttggcgatttggcagccggtattgagcgtagccttggtcgtaggcgtatacttaccgcttttggaagcgggcatggaaatgacgcgcaaaggcaaaaccacccaatccgccgccatcgtggtgttctcttccgccttgtcaatccggttttcggctgggcgttgacgatgctgttggataatttgggcttaatcggctgcaaagagcgcagtgcgcaattaggtttcgccggacgcgtgttgatacccgcagtaggtttcttgatcttgtgtgtggcgatgggtgcggtcgggatgctgcccggtatcccgccgtttttggaacacttcaaatctttgggctag

SEQ ID NO: 390 - protein, 126 aa, Neisseria meningitidis
MYYRRVMGLSDGLGDLAAGIERSLGRRRILTAFGSGHGNDAQRQNHPIRRHRGVLFRLVNPVFGWALTMLLDNLGLIGCKERSAQLGFAGRVLIPAVGFLILCVAMGAVGMLPGIPPFLEHFKSLG

SEQ ID NO: 391 - DNA, 381 bp, Neisseria meningitidis
atgtattatcgccgggttgtggggctatccgatggacttggcgatttggcagccggtattgagcgtagccttggtcgtaggcgtatacttaccgcttttggaagcgggcatggaaatgacgcgcaaaggcaaaaccacccaatccgccgccaccgtggtgttctcttccgcttggtcaatccggttttcggctgggcgttgacgatgctgttggataatttgggcttaatcggctgcaaagagcgcagcgcgcaattaggtttcaccggacgcgtattgatacccgtagtaggtttcttgatcttgtgtgtggcgatgggtgcggtcgggatgctgcccggtatcccgccgtttttggagcacttcaaatctttgggctag

SEQ ID NO: 392 - protein, 126 aa, Neisseria meningitidis
MYYRRVVGLSDGLGDLAAGIERSLGRRRILTAFGSGHGNDAQRQNHPIRRHRGVLFRLVNPVFGWALTMLLDNLGLIGCKERSAQLGFTGRVLIPVVGFLILCVAMGAVGMLPGIPPFLEHFKSLG

SEQ ID NO: 393 - DNA, 372 bp, Neisseria gonorrhoeae
  misc_feature (280)..(280): n is a, c, g, or t
  misc_feature (302)..(302): n is a, c, g, or t
  misc_feature (311)..(311): n is a, c, g, or t
atgccgtctgaaacacgcctgccgaaccttatccgcgccttgatatttgccctgggtttcatcttcctgaacgcctgttcggaacaaaccgcgcaaaccgttaccctgcaaggcgaaacgatgggtacgacctataccgtcaaatacctttcaaataatcgggacaaactcccctcccctgccaaaatacaaaagcgcattgatgatgcgcttaaagaagtcaaccggcagatgtccacctaccagaccgattccgaaatcagccggtttatacagacanatgctggagagctcttcgcgtntcatgcagnttctataactgattccgccgaagactgtctgcctaatacgcctatctcatcggcgctctga

SEQ ID NO: 394 - protein, 120 aa, Neisseria gonorrhoeae
MPSETRLPNLIRALIFALGFIFLNACSEQTAQTVTLQGETMGTTYTVKYLSNNRDKLPSPAKIQKRIDDALKEVNRQMSTYQTDSEISRFIQTAGELFAHASITDSAEDCLPNTPISSAL

SEQ ID NO: 395 - DNA, 1056 bp, Neisseria meningitidis
atgccgtctgaaacacgcctgccgaactttatccgcgtcttgatatttgccctgggtttcatcttcctgaacgcctgttcggaacaaaccgcgcaaaccgttaccctgcaaggcgaaacgatgggcacgacctataycgtcaaatacctttcaaataatcgggacaaactcccctcacctgccgaaatacawaaacgcatcgatgacgcgcttaaagaaktcaaccggyagatgtccacctatcagcccgactccgaaatcagccggttcaaccaacacacagccggcaagcccctccgcatttcaagcgacttcgcacacgttactgccgaagccgtccgcctgaaccgcctgacacacggcgcgctggacgtaaccgtcggccccttggtcaacctttggggattcggccccgacaaatccgttacccgtgaaccgtcgccggaacaaatcaaacaggcggcatcttatacgggcatagacaaaatcattttgaaacaaggcaaagattacgcttccttgagcaaaacccaccccaaggcctatttggatttatcttcgattgccaaaggcttcggcgttgataaagttgcgggcgaactggaaaaatacggcattcaaaattatctggtcgaaatcggcggcgagttgcacggcaaaggcaaaaacgcgcgcggcgaaccgtggcgcatcggtatcgagcagcccaatatcgtccaaggcggcaatacgcagattatcgtcccgctgaacaaccgttcgcttgccacttccggcgattaccgtattttccacgtcgataaaaacggcaaacgcctctcccatatcatcaacccgaacaacaaacgacccatcagccacaacctcgcctccatcagcgtggtcgcagacagtgcgatgacggcggacggcttgtccacaggattattcgtattgggcgaaaccgaagccttaaagctggcagagcgcgaaaaactcgctgttttcctgattgtcagggataaaggcggctaccgcaccgccatgtcttccgaatttgaaaaactgctccgctaa

SEQ ID NO: 396 - protein, 351 aa, Neisseria meningitidis
  misc_feature (46)..(46): Xaa can be any naturally occurring amino acid
  misc_feature (64)..(64): Xaa can be any naturally occurring amino acid
  misc_feature (74)..(74): Xaa can be any naturally occurring amino acid
  misc_feature (77)..(77): Xaa can be any naturally occurring amino acid
MPSETRLPNFIRVLIFALGFIFLNACSEQTAQTVTLQGETMGTTYXVKYLSNNRDKLPSPAEIXKRIDDALKEXNRXMSTYQPDSEISRFNQHTAGKPLRISSDFAHVTAEAVRLNRLTHGALDVTVGPLVNLWGFGPDKSVTREPSPEQIKQAASYTGIDKIILKQGKDYASLSKTHPKAYLDLSSIAKGFGVDKVAGELEKYGIQNYLVEIGGELHGKGKNARGEPWRIGIEQPNIVQGGNTQIIVPLNNRSLATSGDYRIFHVDKNGKRLSHIINPNNKRPISHNLASISVVADSAMTADGLSTGLFVLGETEALKLAEREKLAVFLIVRDKGGYRTAMSSEFEKLLR

SEQ ID NO: 397 - DNA, 1056 bp, Neisseria meningitidis
atgccgtctgaaacacgcctgccgaactttatccgcaccttgatatttgccctgagttttatcttcctgaacgcctgttcggaacaaaccgcgcaaaccgttaccctgcaaggtgaaacgatgggcacgacctataccgtcaaatacctttcaaataatcgggacaaactcccctcacctgccgaaatacaaaagcgcatcgatgacgcgcttaaagaagtcaaccggcagatgtccacctatcagcccgactccgaaatcagccggttcaaccaacacacagccggcaagcccctccgcatttcaagcgacttcgcacacgttactgccgaagccgtccacctgaaccgcctgacacacggcgcgctggacgtaaccgtcggccccttggtcaacctttggggattcggccccgacaaatccgttacccgtgaaccgtcgccggaacaaatcaaacaagcagcatcttatacgggcatagacaaaatcattttgaaacaaggcaaagattacgcttccttgagcaaaacccaccccaaggcctatttggatttatcttcgattgccaaaggcttcggcgttgataaagttgcgggcgaactggaaaaatacggcattcaaaattatctggtcgaaatcggcggcgagttgcacggcaaaggcaaaaacgcgcgcggcgaaccttggcgcatcggcatcgaacagcccaacatcgtccaaggcggcaatacgcagattatcgtcccgctgaacaaccgttcgcttgccacttccggcgattaccgtattttccacgtcgataaaagcggcaaacgcctctcccatatcattaatccgaacaacaaacgacccatcagccacaacctcgcctccatcagcgtggtcgcagacagtgcgatgacggcggacggcttgtccacaggattattcgtattgggcgaaaccgaagccttaaagctggcagagcgcgaaaaactcgctgttttcctgattgtcagggataaaggcggctaccgcaccgccatgtcttccgaatttgaaaaactgctccgctaa

SEQ ID NO: 398 - protein, 351 aa, Neisseria meningitidis
MPSETRLPNFIRTLIFALSFIFLNACSEQTAQTVTLQGETMGTTYTVKYLSNNRDKLPSPAEIQKRIDDALKEVNRQMSTYQPDSEISRFNQHTAGKPLRISSDFAHVTAEAVHLNRLTHGALDVTVGPLVNLWGFGPDKSVTREPSPEQIKQAASYTGIDKIILKQGKDYASLSKTHPKAYLDLSSIAKGFGVDKVAGELEKYGIQNYLVEIGGELHGKGKNARGEPWRIGIEQPNIVQGGNTQIIVPLNNRSLATSGDYRIFHVDKSGKRLSHIINPNNKRPISHNLASISVVADSAMTADGLSTGLFVLGETEALKLAEREKLAVFLIVRDKGGYRTAMSSEFEKLLR

SEQ ID NO: 399 - DNA, 1056 bp, Neisseria gonorrhoeae
atgccgtctgaaacacgcctgccgaaccttatccgcgccttgatatttgccctgggtttcatcttcctgaacgcctgttcggaacaaaccgcgcaaaccgttaccctgcaaggcgaaacgatgggtacgacctataccgtcaaatacctttcaaataatcgggacaaactcccctcccctgccaaaatacaaaagcgcattgatgatgcgcttaaagaagtcaaccggcagatgtccacctaccagaccgattccgaaatcagccggttcaaccaacacacagccggcaagcccctccgcatttcaagcgatttcgcacacgttaccgccgaagccgtccgcctgaaccgcctgactcacggcgcactggacgtaaccgtcggccctttggtcaacctttgggggttcggccccgacaaatccgttacccgtgaaccgtcgccggaacaaatcaaacaggcggcatcttatacgggcatagacaaaatcattttgcaacaaggcaaagattacgcttccttgagcaaaacccaccccaaagcctatttggatttatcttcgattgccaaaggcttcggcgttgataaagttgcgggcgaactggaaaaatacggcattcaaaattatctggtcgaaatcggcggcgagttgcacggcaaaggcaaaaatgcgcacggcgaaccgtggcgcatcggtatagagcaacccaatatcatccaaggcggcaatacgcagattatcgtcccgctgaacaaccgttcgcttgccacttccggcgattaccgtattttccacgtcgataaaaacggcaaacgcctttcccacatcatcaatcccaacaacaaacgacccatcagccacaacctcgcctccatcagcgtggtctcagacagtgcaatgacggcggacggtttatccacaggattatttgttttaggcgaaaccgaagccttaaggctggcagaacaagaaaaactcgctgttttcctaattgtccgggataaggacggctaccgcaccgccatgtcttccgaatttgccaagctgctccgctaa

SEQ ID NO: 400 - protein, 351 aa, Neisseria gonorrhoeae
MPSETRLPNLIRALIFALGFIFLNACSEQTAQTVTLQGETMGTTYTVKYLSNNRDKLPSPAKIQKRIDDALKEVNRQMSTYQTDSEISRFNQHTAGKPLRISSDFAHVTAEAVRLNRLTHGALDVTVGPLVNLWGFGPDKSVTREPSPEQIKQAASYTGIDKIILQQGKDYASLSKTHPKAYLDLSSIAKGFGVDKVAGELEKYGIQNYLVEIGGELHGKGKNAHGEPWRIGIEQPNIIQGGNTQIIVPLNNRSLATSGDYRIFHVDKNGKRLSHIINPNNKRPISHNLASISVVSDSAMTADGLSTGLFVLGETEALRLAEQEKLAVFLIVRDKDGYRTAMSSEFAKLLR

SEQ ID NO: 401 - DNA, 1056 bp, Neisseria meningitidis
atgccgtctgaaacacgcctgccgaactttatccgcgtcttgatatttgccctgggtttcatcttcctgaacgcctgttcggaacaaaccgcgcaaaccgttaccctgcaaggcgaaacgatgggcacgacctataccgtcaaatacctttcaaataatcgggacaaactcccctcacctgccgaaatacaaaaacgcatcgatgacgcgcttaaagaagtcaaccggcagatgtccacctatcagcccgactccgaaatcagccggttcaaccaacacacagccggcaagcccctccgcatttcaagcgacttcgcacacgttactgccgaagccgtccgcctgaaccgcctgacacacggcgcgctggacgtaaccgtcggccccttggtcaacctttggggattcggccccgacaaatccgttacccgtgaaccgtcgccggaacaaatcaaacaggcggcatcttatacgggcatagacaaaatcattttgaaacaaggcaaagattacgcttccttgagcaaaacccaccccaaggcctatttggatttatcttcgattgccaaaggcttcggcgttgataaagttgcgggcgaactggaaaaatacggcattcaaaattatctggtcgaaatcggcggcgagttgcacggcaaaggcaaaaacgcgcgcggcgaaccgtggcgcatcggtatcgagcagcccaatatcgtccaaggcggcaatacgcagattatcgtcccgctgaacaaccgttcgcttgccacttccggcgattaccgtattttccacgtcgataaaaacggcaaacgcctctcccatatcatcaacccgaacaacaaacgacccatcagccacaacctcgcctccatcagcgtggtcgcagacagtgcgatgacggcggacggcttgtccacaggattattcgtattgggcgaaaccgaagccttaaagctggcagagcgcgaaaaactcgctgttttcctgattgtcagggataaaggcggctaccgcaccgccatgtcttccgaatttgaaaaactgctccgctaa

SEQ ID NO: 402 - protein, 351 aa, Neisseria meningitidis
MPSETRLPNFIRVLIFALGFIFLNACSEQTAQTVTLQGETMGTTYTVKYLSNNRDKLPSPAEIQKRIDDALKEVNRQMSTYQPDSEISRFNQHTAGKPLRISSDFAHVTAEAVRLNRLTHGALDVTVGPLVNLWGFGPDKSVTREPSPEQIKQAASYTGIDKIILKQGKDYASLSKTHPKAYLDLSSIAKGFGVDKVAGELEKYGIQNYLVEIGGELHGKGKNARGEPWRIGIEQPNIVQGGNTQIIVPLNNRSLATSGDYRIFHVDKNGKRLSHIINPNNKRPISHNLASISVVADSAMTADGLSTGLFVLGETEALKLAEREKLAVFLIVRDKGGYRTAMSSEFEKLLR

SEQ ID NO: 403 - DNA, 1056 bp, Neisseria meningitidis; identical to SEQ ID NO: 397

SEQ ID NO: 404 - protein, 351 aa, Neisseria meningitidis; identical to SEQ ID NO: 398

SEQ ID NO: 405 - DNA, 423 bp, Neisseria gonorrhoeae
atggcttccatcacttcgccgctgcacggggcgcagcaggaatgcagcaagacttttttatgtccgccgggcgggacgagtatggggcggtcaatgtcggtaacggtaggtttgttttgtgtttccattaacttaacaatatctgtcgaatacggtcaaagcggctattttaccagagccgccgaatgtaaaacagggtgtcagggcatcagcccgagctgcctgaacgaacggacggtttgcgaggtaacgataaaatggtcgagcagcgaaacatcaaccagcgacatggcctgtgccagccgccttgtgaacatgatgtcttcctgcgaaggttcaggcgagccgcccggatggttgtgcgcgataatcaggctgtcggcatattcgtccaatgccagtttgacgatttcgcggatgtaa

SEQ ID NO: 406 - protein, 140 aa, Neisseria gonorrhoeae
MASITSPLHGAQQECSKTFLCPPGGTSMGRSMSVTVGLFCVSINLTISVEYGQSGYFTRAAECKTGCQGISPSCLNERTVCEVTIKWSSSETSTSDMACASRLVNMMSSCEGSGEPPGWLCAIIRLSAYSSNASLTISRM

SEQ ID NO: 407 - DNA, 423 bp, Neisseria meningitidis
atggcttccatcacttcgccgctgcacggggcgcacagagaatgcagcaagacttttttatgtccaccgggcgggacgagtatagggcggtcaatgtcggtaacggtaggtttgttttgtgtttccattaacttaacaatatctgttgaatacggttgaagcggctattttatcagagccgccgcatgtaaaacagagtgtcagggcatcaacccgagctgtctgaacgaacagacgctttgcgakgtaacgataaaatggtcgagcagcgacacatcgaccagcgacattgcctgtgccagccgccttgtgaacatgatgtcttcctgcgaargttcsggcgagccgcccggatggttgtgcgcaataatcaggctgtcggcatattcgtccaatgccagtttgacgatttcgcggatgtaa

SEQ ID NO: 408 - protein, 140 aa, Neisseria meningitidis
  misc_feature (53)..(53): Xaa can be any naturally occurring amino acid
  misc_feature (82)..(82): Xaa can be any naturally occurring amino acid
  misc_feature (112)..(112): Xaa can be any naturally occurring amino acid
MASITSPLHGAHRECSKTFLCPPGGTSIGRSMSVTVGLFCVSINLTISVEYGXSGYFIRAAACKTECQGINPSCLNEQTLCXVTIKWSSSDTSTSDIACASRLVNMMSSCEXSGEPPGWLCAIIRLSAYSSNASLTISRM

SEQ ID NO: 409 - DNA, 438 bp, Neisseria gonorrhoeae
atgccggaggcaagcatcgcctccatcacttcgccgctgcacggggcgcaacaggaatgcagcaagacttttttatgtccgccgggcgggacgagtatggggcggtcaatgtcggtaacggtaggtttgttttgtgtttccattaacttaacgatatctgtcgaatacggttgaagcggctattttatcagagccgccgcatgtaaaacagggtgtcagggcatcagcccgagctgcctgaacgaacggacggtttgcgccgttacgataaaatggtcgagcagcgacacatcgaccagcgacattgcctgtgccagccgccttgtgaacatgatgtcttcctgcgaaggttcgggcgagccgcccggatggttgtgcgcgataatcaggctgtcggcatattcgtccaatgccagtttgacaatttcacggatgtaa

SEQ ID NO: 410 - protein, 144 aa, Neisseria gonorrhoeae
MPEASIASITSPLHGAQQECSKTFLCPPGGTSMGRSMSVTVGLFCVSINLTISVEYGSGYFIRAAACKTGCQGISPSCLNERTVCAVTIKWSSSDTSTSDIACASRLVNMMSSCEGSGEPPGWLCAIIRLSAYSSNASLTISRM

SEQ ID NO: 411 - DNA, 2007 bp, Neisseria gonorrhoeae
atggtcgacgaactcgacctgctgcccgatgccgtcgccgccaccctgcttgccgacatcggacgctacgtccccgattggaacctattggtttccgagcgctgcaacagcaccgtcgccgagctggtcaaaggtgtggacgaagtgcagaaacttacccacttcgcccgggtggacagcctcgccacgccggaagaacgcgcacagcaagcggaaaccatgcggaaaatgctgctggcgatggttaccgacatccgcgtcgtattaatcaaactggcgatgcgtacgcgcaccctgctatttttaagcaacgcccccgacagccctgaaaaacgcgccgtcgccaaagaaaccctcgacatcttcgccccgctcgccaaccgcttgggcgtgtggcagctcaaatggcagctcgaagatttgggcttccgccatcaagaacccgaaaaataccgcgaaatcgccctgcttttggacgaaaaacgcaccgaacgcctcgaatacatcgaaaacttcctcgatatcctgcgtacggaactcaaaaaatacaatatccactttgaagtcgccggccgtccgaaacacatctactccatttacaaaaaaatggtgaagaaaaaactcagcttcgacggcctgttcgacatccgcgccgtgcggattctggtcgataccgtccccgagtgttacaccacgctgggcatcgtccacagcctctggcagcccattcccggcgagttcgacgactacatcgccaaccccaaaggcaacggttataaaagtttgcacaccgtcatcgtcggcccggaagacaaaggtgtggaagtgcaaatccgcaccttcgatatgcaccaattcaacgaattcggtgtcgccgcccactggcgttacaaagaaggcggcaaaggcgattccgcctacgaacaaaaaatcgcctggttgcgccaactcttggactggcgcgaaaatatggcggaaagcggcaaggaagacctcgccgccgccttcaaaaccgagcttttcaacgacacgatttatgttttgaccccgcacggcaaagtcctctctctgccaacgggcgcaacccccatcgacttcgcctacgccctgcacagcagcatcggcgaccgctgccggggcgcgaaagtcgaagggcagattgtgccgctgtccaccccgctcgaaaacggacagcgcgtcgaaatcattaccgccaaagaagggcatccttccgtcaactggctttacgaaggctgggtcaaatccggcaaggccatcggcaaaatccgcgcctacatccgccagcaaaacgccgacaccgtgcgcgaagaaggccgtgtccaactcgacaagcagcttgccaaactcacgcccaaacccaacctgcaagagcttgccgaaaatctcggctacaaaaagccagaagacctctacaccgccgtcggacaaggcgaaatttccaaccgcgccatccaaaaagcctgcggcacgctgaacgaaccgccccccgtgcccgtcagcgcaaccaccatcgtcaaacagtccaaaatcaaaaaaggtggcaaaaccggcgtgctcatcgacggcgaagacggcttgatgaccacgcttgccaaatgctgcaaacccgcgccgcccgacgatattgccggcttcgttacccgcgagcgcggcatttccgtccaccgcaaaacctgcccctctttccgacaccttgccgaacacgcgcccgaaaaagtactggacgcaagttgggcggcgttgcaggaagggcaagtgttcgccgtcgatatcgaaatccgcgcccaagaccgctccgggcttttgcgcgacgtatccgacgcgctcgcccgccacaaactcaacgttaccgccgtgcaaacccagtcccgcgacttggaagccagcatgaggttcacgctcgaagtcaaacaagtcaacgacctcccgcgcgtcctcgccggcctcggcgatgtcaaaggcgtattgagcgttacccggctttaa

SEQ ID NO: 412 - protein, 668 aa, Neisseria gonorrhoeae
MVDELDLLPDAVAATLLADIGRYVPDWNLLVSERCNSTVAELVKGVDEVQKLTHFARVDSLATPEERAQQAETMRKMLLAMVTDIRVVLIKLAMRTRTLLFLSNAPDSPEKRAVAKETLDIFAPLANRLGVWQLKWQLEDLGFRHQEPEKYREIALLLDEKRTERLEYIENFLDILRTELKKYNIHFEVAGRPKHIYSIYKKMVKKKLSFDGLFDIRAVRILVDTVPECYTTLGIVHSLWQPIPGEFDDYIANPKGNGYKSLHTVIVGPEDKGVEVQIRTFDMHQFNEFGVAAHWRYKEGGKGDSAYEQKIAWLRQLLDWRENMAESGKEDLAAAFKTELFNDTIYVLTPHGKVLSLPTGATPIDFAYALHSSIGDRCRGAKVEGQIVPLSTPLENGQRVEIITAKEGHPSVNWLYEGWVKSGKAIGKIRAYIRQQNADTVREEGRVQLDKQLAKLTPKPNLQELAENLGYKKPEDLYTAVGQGEISNRAIQKACGTLNEPPPVPVSATTIVKQSKIKKGGKTGVLIDGEDGLMTTLAKCCKPAPPDDIAGFVTRERGISVHRKTCPSFRHLAEHAPEKVLDASWAALQEGQVFAVDIEIRAQDRSGLLRDVSDALARHKLNVTAVQTQSRDLEASMRFTLEVKQVNDLPRVLAGLGDVKGVLSVTRL

SEQ ID NO: 413 - DNA, 1476 bp, Neisseria meningitidis
gtgaaactcaagaaatacaatgtccatttcgaagtcgccggccgcccgaaacacatctactccatttacaaaaaaatggtgaagaaaaaactcagcttcgacggcctctttgacatccgcgccgtgcgaattctggttgataccgtccccgagtgttacaccacgctgggtatcgtccacagcctctggcagcccattcccggcgagttcgacgactacatcgccaatcccaaaggcaacggctataaaagtttgcacaccgtcatcgtcggcccggaagacaaaggcgtggaagtacaaatccgcaccttcgatatgcaccaattcaacgaattcggtgtcgccgcccactggcgttacaaagagggcggcaagggcgattccgcctacgaacagaaaatcgcctggttgcgccaactcttggactggcgcgaaaacatggcggaaagcggcaaggaagacctcgccgccgccttcaaaaccgagcttttcaacgacacgatttatgttttgaccccgcacggcaaagtcctctccctgcccacgggcgcgacccccatcgacttcgcctacgccctgcacagcagcatcggcgaccgttgccgcggtgcgaaagtcgaagggcagattgtgccgctgtccaccccgctcgaaaacggacagcgcgtcgaaatcattaccgccaaagaagggcatccttccgtcaactggctttacgaaggctgggtcaaatccaacaaggcaatcggcaaaatccgcgcctacatccgccagcaaaacgccgacaccgtgcgcgaagaaggccgcgtccaactcgacaaacagcttgccaaactcacgcccaaacccaacctgcaagagcttgccgaaaatctcggctacaaaaagccagaagacctctacaccgccgtcggacaaggcgaaatttccaaccgcgccatccaaaaagcctgcggcacgctgaacgaaccgccgcccgtacccgtcagcgaaaccaccatcgtcaaacagtccaaaatcaaaaaaggcggcaaaaacggcgtgctcatcgacggcgaagacggtctgatgaccacgcttgccaaatgctgcaaacccgcgccgcccgacgatattatcggcttcgttacccgcgagcgcggcatttcagtgcaccgcaaawyytkcycgtctttccaacacctcgccgaacacgcgcccgawaaagtgctggacgcaagctgggcggcattgcaggaaggacaagtattcgccgtcgatatcgaaatccgcgcccaagaccgctccgggcttttgcgcgacgtatccgacgcgctcgcccgccacaaactcaacgttaccgccgtgcaaacccagtcccgcgacttggaagccagcatgaggttcacgctcgaagtcaaacaagtcaacgacctcccgcgcgtcctcgccagcctcggcgacgtcaaaggcgtattgagcgttacccggctttaa

SEQ ID NO: 414 - protein, 491 aa, Neisseria meningitidis
  misc_feature (388)..(390): Xaa can be any naturally occurring amino acid
  misc_feature (401)..(401): Xaa can be any naturally occurring amino acid
VKLKKYNVHFEVAGRPKHIYSIYKKMVKKKLSFDGLFDIRAVRILVDTVPECYTTLGIVHSLWQPIPGEFDDYIANPKGNGYKSLHTVIVGPEDKGVEVQIRTFDMHQFNEFGVAAHWRYKEGGKGDSAYEQKIAWLRQLLDWRENMAESGKEDLAAAFKTELFNDTIYVLTPHGKVLSLPTGATPIDFAYALHSSIGDRCRGAKVEGQIVPLSTPLENGQRVEIITAKEGHPSVNWLYEGWVKSNKAIGKIRAYIRQQNADTVREEGRVQLDKQLAKLTPKPNLQELAENLGYKKPEDLYTAVGQGEISNRAIQKACGTLNEPPPVPVSETTIVKQSKIKKGGKNGVLIDGEDGLMTTLAKCCKPAPPDDIIGFVTRERGISVHRKXXXSFQHLAEHAPXKVLDASWAALQEGQVFAVDIEIRAQDRSGLLRDVSDALARHKLNVTAVQTQSRDLEASMRFTLEVKQVNDLPRVLASLGDVKGVLSVTRL

SEQ ID NO: 415 - DNA, 2007 bp, Neisseria meningitidis
atggttcatgaactcgacctgctccccgatgccgtcgccgccaccctgcttgccgacatcggacgctacgtccccgactggaacctattggtttccgaacgctgcaacagtaccgtcgccgagctggtcaaaggtgtggacgaagtgcagaaactcacccacttcgcccgggtggacagcctcgccacgccggaagaacgcgcccagcaggcagaaactatgcggaaaatgctgctggcgatggttaccgacatccgcgtcgtgttaatcaaactggcgatgcgtacgcgcaccctgcaatttttaagcaacgcccccgacagccccgaaaaacgcgccgtcgccaaagaaaccctcgacatcttcgccccgctcgccaaccgtttgggcgtgtggcagctcaaatggcagctcgaagatttgggcttccgccatcaagaacccgaaaaataccgcgaaatcgccctgcttttggacgaaaaacgcaccgaacgcctcgaatacatcgaaaacttccttaatatcctgcgtacggaactcaaaaaatacaatatccactttgaagtcgccggccgtccgaaacacatctactccatttacaaaaaaatggtgaagaaaaaactcagcttcgacgggttgttcgacatccgcgccgtgcggattctggttgataccgtccccgagtgttacaccacactgggcattgtccacagcctctggcagcccattcccggcgagttcgacgactacatcgccaacccgaaaggcaacggctataaaagtttgcacaccgtcatcgtcggcccggaagacaaaggcgtggaagtgcaaatccgcaccttcgatatgcaccaattcaacgaattcggtgtcgccgcgcactggcgttacaaagagggcggcaaaggcgattccgcctacgaacaaaaaatcgcctggttacgccaacttttggactggcgcgaaaacatggcggaaagcggcaaggaagacctcgccgccgccttcaaaaccgagcttttcaacgacacgatttatgttttgaccccgcacggcaaagtcctctccctgcccacaggcgcgacccccatcgacttcgcctacgccctgcacagcagcatcggcgaccgttgccgcggtgcgaaagtcgaagggcagattgtgccgctgtccaccccgctcgaaaacggacagcgtgtcgaaatcattaccgccaaagaagggcatccttccgtcaactggctttacgaaggctgggtcaaatccaacaaggcaatcggcaaaatccgcgcctacatccgccagcaaaacgccgacaccgtgcgcgaagaaggccgcgtccaactcgacaaacagcttgccaaactcacgcccaaacccaacctgcaagagcttgccgaaaatctcggctacaaaaagccagaagacctctacaccgccgtcggacaaggcgaaatttccaaccgcgccatccaaaaagcctgcggcacgctgaacgaaccgccgcccgtacccgtcagcgaaaccaccatcgtcaaacagtccaaaatcaaaaaaggcggcaaaaacggcgtgctcatcgacggcgaagacggtctgatgaccacgcttgccaaatgctgcaaacccgcgccgcccgacgacattgtcggcttcgttacccgcgatcgcggcatttcggtacaccgcaaaacctgcccctctttccgacacctcgccgaacacgcgcccgaaaaagtactggacgcaagttgggcggcgttgcaggaaggacaagtgttcgccgtcgatatcgaaatccgcgcccaagaccgctccgggcttttgcgcgacgtatccgacgcgctcgcccgccacaaactcaacgttaccgccgtgcaaacccagtcccgcgacttggaagccagcatgaggttcacgctcgaagtcaaacaagttaccgacctcccacgcgtcctcgccagcctcggcgacgtcaaaggcgtattgagcgttacccggctttaa

SEQ ID NO: 416 - protein, 668 aa, Neisseria meningitidis
MVHELDLLPDAVAATLLADIGRYVPDWNLLVSERCNSTVAELVKGVDEVQKLTHFARVDSLATPEERAQQAETMRKMLLAMVTDIRVVLIKLAMRTRTLQFLSNAPDSPEKRAVAKETLDIFAPLANRLGVWQLKWQLEDLGFRHQEPEKYREIALLLDEKRTERLEYIENFLNILRTELKKYNIHFEVAGRPKHIYSIYKKMVKKKLSFDGLFDIRAVRILVDTVPECYTTLGIVHSLWQPIPGEFDDYIANPKGNGYKSLHTVIVGPEDKGVEVQIRTFDMHQFNEFGVAAHWRYKEGGKGDSAYEQKIAWLRQLLDWRENMAESGKEDLAAAFKTELFNDTIYVLTPHGKVLSLPTGATPIDFAYALHSSIGDRCRGAKVEGQIVPLSTPLENGQRVEIITAKEGHPSVNWLYEGWVKSNKAIGKIRAYIRQQNADTVREEGRVQLDKQLAKLTPKPNLQELAENLGYKKPEDLYTAVGQGEISNRAIQKACGTLNEPPPVPVSETTIVKQSKIKKGGKNGVLIDGEDGLMTTLAKCCKPAPPDDIVGFVTRDRGISVHRKTCPSFRHLAEHAPEKVLDASWAALQEGQVFAVDIEIRAQDRSGLLRDVSDALARHKLNVTAVQTQSRDLEASMRFTLEVKQVTDLPRVLASLGDVKGVLSVTRL

SEQ ID NO: 417 - DNA, 2214 bp, Neisseria gonorrhoeae
atgaccgccatcagcccgattcaagacacgcaaagcgcgaccctgcaagaattgcgcgaatggttcgacagctactgcgccgctctgccggacaacgataaaaacctcatcggtaccgcatggtcgctggcgcaggaacattatcctgccgatgccgccacgccgtatggcgagccgctgcccgaccacttcctcggcgcggcgcaaatggtcgacgaactcgacctgctgcccgatgccgtcgccgccaccctgcttgccgacatcggacgctacgtccccgattggaacctattggtttccgagcgctgcaacagcaccgtcgccgagctggtcaaaggtgtggacgaagtgcagaaacttacccacttcgcccgggtggacagcctcgccacgccggaagaacgcgcacagcaagcggaaaccatgcggaaaatgctgctggcgatggttaccgacatccgcgtcgtattaatcaaactggcgatgcgtacgcgcaccctgcaatttttaagcaacgcccccgacagccctgaaaaacgcgccgtcgccaaagaaaccctcgacatcttcgccccgctcgccaaccgcttgggcgtgtggcagctcaaatggcagctcgaagatttgggcttccgccatcaagaacccgaaaaataccgcgaaatcgccctgcttttggacgaaaaacgcaccgaacgcctcgaatacatcgaaaacttcctcgatatcctgcgtacggaactcaaaaaatacaatatccactttgaagtcgccggccgtccgaaacacatctactccatttacaaaaaaatggtgaagaaaaaactcagcttcgacggcctgttcgacatccgcgccgtgcggattctggtcgataccgtccccgagtgttacaccacgctgggcatcgtccacagcctctggcagcccattcccggcgagttcgacgactacatcgccaaccccaaaggcaacggttataaaagtttgcacaccgtcatcgtcggcccggaagaaaaaggtgtggaagtgcaaatccgcaccttcgatatgcaccaattcaacgaattcggtgtcgccgcccactggcgttacaaagaaggcggcaaaggcgattccgcctacgaacaaaaaatcgcctggttgcgccaactcttggactggcgcgaaaatatggcggaaagcggcaaggaagacctcgccgccgccttcaaaaccgagcttttcaacgacacgatttatgttttgaccccgcacggcaaagtcctctctctgccaacgggcgcaacccccatcgacttcgcctacgccctgcacagcagcatcggcgaccgctgccggggcgcgaaagtcgaagggcagattgtgccgctgtccaccccgctcgaaaacggacagcgcgtcgaaatcattaccgccaaagaagggcatccttccgtcaactggctttacgaaggctgggtcaaatccggcaaggccatcggcaaaatccgcgcctacatccgccagcaaaacgccgacaccgtgcgcgaagaaggccgtgtccaactcgacaagcagcttgccaaactcacgcccaaacccaacctgcaagagcttgccgaaaatctcggctacaaaaagccagaagacctctacaccgccgtcggacaaggcgaaatttccaaccgcgccatccaaaaagcctgcggcacgctgaacgaaccgccgcccgtgcccgtcagcgcaaccaccatcgtcaaacagtccaaaatcaaaaaaggtggcaaaaccggcgtgctcatcgacggcgaagacggcttgatgaccacgcttgccaaatgctgcaaacccgcgccgcccgacgatattgccggcttcgttacccgcgagcgcggcatttccgtccaccgcaaaacctgcccctctttccgacaccttgccgaacacgcgcccgaaaaagtactggacgcaagttgggcggcgttgcaggaagggcaagtgttcgccgtcgatatcgaaatccgcgcccaagaccgctccgggcttttgcgcgacgtatccgacgcgctcgcccgccacaaactcaacgttaccgccgtgcaaacccagtcccgcgacttggaagccagcatgaggttcacgctcgaagtcaaacaagtcaacgacctcccgcgcgtcctcgccggcctcggcgatgtcaaaggcgtattgagcgttacccggctttaa

SEQ ID NO: 418 - protein, 737 aa, Neisseria gonorrhoeae
MTAISPIQDTQSATLQELREWFDSYCAALPDNDKNLIGTAWSLAQEHYPADAATPYGEPLPDHFLGAAQMVDELDLLPDAVAATLLADIGRYVPDWNLLVSERCNSTVAELVKGVDEVQKLTHFARVDSLATPEERAQQAETMRKMLLAMVTDIRVVLIKLAMRTRTLQFLSNAPDSPEKRAVAKETLDIFAPLANRLGVWQLKWQLEDLGFRHQEPEKYREIALLLDEKRTERLEYIENFLDILRTELKKYNIHFEVAGRPKHIYSIYKKMVKKKLSFDGLFDIRAVRILVDTVPECYTTLGIVHSLWQPIPGEFDDYIANPKGNGYKSLHTVIVGPEEKGVEVQIRTFDMHQFNEFGVAAHWRYKEGGKGDSAYEQKIAWLRQLLDWRENMAESGKEDLAAAFKTELFNDTIYVLTPHGKVLSLPTGATPIDFAYALHSSIGDRCRGAKVEGQIVPLSTPLENGQRVEIITAKEGHPSVNWLYEGWVKSGKAIGKIRAYIRQQNADTVREEGRVQLDKQLAKLTPKPNLQELAENLGYKKPEDLYTAVGQGEISNRAIQKACGTLNEPPPVPVSATTIVKQSKIKKGGKTGVLIDGEDGLMTTLAKCCKPAPPDDIAGFVTRERGISVHRKTCPSFRHLAEHAPEKVLDASWAALQEGQVFAVDIEIRAQDRSGLLRDVSDALARHKLNVTAVQTQSRDLEASMRFTLEVKQVNDLPRVLAGLGDVKGVLSVTRL

SEQ ID NO: 419 - DNA, 2214 bp, Neisseria meningitidis
atgaccgccatcagcccgattcaagacacgcaaagcgcgactctgcaagaattgcgcgaatggttcgacagctactgcgccgctctgccggacaacgataaaaacctcatcggtaccgcatggttgctggcgcaggaacattaccccgccgatgccgccacgccgtatggcgagccgctgcccgaccacttcctcggcgcggcgcaaatggttcatgaactcgacctgctccccgatgccgtcgccgccaccctgcttgccgacatcggacgctacgtccccgactggaacctattggtttccgaacgctgcaacagtaccgtcgccgagctggtcaaaggtgtggacgaagtgcagaaactcacccacttcgcccgggtggacagcctcgccacgccggaagaacgcgcccagcaggcagaaactatgcggaaaatgctgctggcgatggttaccgacatccgcgtcgtgttaatcaaactggcgatgcgtacgcgcaccctgcaatttttaagcaacgcccccgacagccccgaaaaacgcgccgtcgccaaagaaaccctcgacatcttcgccccgctcgccaaccgtttgggcgtgtggcagctcaaatggcagctcgaagatttgggcttccgccatcaaaagcccgaaaaataccgcgaaatcgcgctgcttttggacgaaaaacgcaccgaacgcctcgaatacatcgaaaacttcctcaacatcctgcgcggtgaactcaagaaatacaatgtccatttcgaagtcgccggccgcccgaaacacatctactccatttacaaaaaaatggtgaagaaaaaactcagcttcgacggcctctttgacatccgcgccgtgcgaattctggttgataccgtccccgagtgttacaccacgctgggtatcgtccacagcctctggcagcccattcccggcgagttcgacgactacatcgccaatcccaaaggcaacggctataaaagtttgcacaccgtcatcgtcggcccggaagacaaaggcgtggaagtacaaatccgcaccttcgatatgcaccaattcaacgaattcggtgtcgccgcccactggcgttacaaagagggcggcaagggcgattccgcctacgaacagaaaatcgcctggttgcgccaactcttggactggcgcgaaaacatggcggaaagcggcaaggaagacctcgccgccgccttcaaaaccgagcttttcaacgacacgatttatgttttgaccccgcacggcaaagtcctctccctgcccacgggcgcgacccccatcgacttcgcctacgccctgcacagcagcatcggcgaccgttgccgcggtgcgaaagtcgaagggcagattgtgccgctgtccaccccgctcgaaaacggacagcgcgtcgaaatcattaccgccaaagaagggcatccttccgtcaactggctttacgaaggctgggtcaaatccaacaaggcaatcggcaaaatccgcgcctacatccgccagcaaaacgccgacaccgtgcgcgaagaaggccgcgtccaactcgacaaacagcttgccaaactcacgcccaaacccaacctgcaagagcttgccgaaaatctcggctacaaaaagccagaagacctctacaccgccgtcggacaaggcgaaatttccaaccgcgccatccaaaaagcctgcggcacgctgaacgaaccgccgcccgtacccgtcagcgaaaccaccatcgtcaaacagtccaaaatcaaaaaaggcggcaaaaacggcgtgctcatcgacggcgaagacggtctgatgaccacgcttgccaaatgctgcaaacccgcgccgcccgacgatattatcggcttcgttacccgcgagcgcggcatttcagtgcaccgcaaaacctgcccgtctttccaacacctcgccgaacacgcgcccgaaaaagtgctggacgcaagctgggcggcattgcaggaaggacaagtattcgccgtcgatatcgaaatccgcgcccaagaccgctccgggcttttgcgcgacgtatccgacgcgctcgcccgccacaaactcaacgttaccgccgtgcaaacccagtcccgcgacttggaagccagcatgaggttcacgctcgaagtcaaacaagtcaacgacctcccgcgcgtcctcgccagcctcggcgacgtcaaaggcgtattgagcgttacccggctttaa

SEQ ID NO: 420 - protein, 737 aa, Neisseria meningitidis
MTAISPIQDTQSATLQELREWFDSYCAALPDNDKNLIGTAWLLAQEHYPADAATPYGEPLPDHFLGAAQMVHELDLLPDAVAATLLADIGRYVPDWNLLVSERCNSTVAELVKGVDEVQKLTHFARVDSLATPEERAQQAETMRKMLLAMVTDIRVVLIKLAMRTRTLQFLSNAPDSPEKRAVAKETLDIFAPLANRLGVWQLKWQLEDLGFRHQKPEKYREIALLLDEKRTERLEYIENFLNILRGELKKYNVHFEVAGRPKHIYSIYKKMVKKKLSFDGLFDIRAVRILVDTVPECYTTLGIVHSLWQPIPGEFDDYIANPKGNGYKSLHTVIVGPEDKGVEVQIRTFDMHQFNEFGVAAHWRYKEGGKGDSAYEQKIAWLRQLLDWRENMAESGKEDLAAAFKTELFNDTIYVLTPHGKVLSLPTGATPIDFAYALHSSIGDRCRGAKVEGQIVPLSTPLENGQRVEIITAKEGHPSVNWLYEGWVKSNKAIGKIRAYIRQQNADTVREEGRVQLDKQLAKLTPKPNLQELAENLGYKKPEDLYTAVGQGEISNRAIQKACGTLNEPPPVPVSETTIVKQSKIKKGGKNGVLIDGEDGLMTTLAKCCKPAPPDDIIGFVTRERGISVHRKTCPSFQHLAEHAPEKVLDASWAALQEGQVFAVDIEIRAQDRSGLLRDVSDALARHKLNVTAVQTQSRDLEASMRFTLEVKQVNDLPRVLASLGDVKGVLSVTRL

SEQ ID NO: 421 - DNA, 2214 bp, Neisseria meningitidis
atgaccgccatcagcccgattcaagacacgcaaagcgcgactctgcaagaattgcgcgaatggttcgacagctactgcaccgcgctgccgaacaacgataaaaaacttgtcttagccgcccgttcgctggcggaagcacattaccccgccgatgccgccacgccgtatggcgaaccgctgcccgaccacttcctcggcgcggcgcaaatggttcatgaactcgacctgctccccgatgccgtcgccgccaccctgcttgccgacatcggacgctacgtccccgactggaacctattggtttccgaacgctgcaacagtaccgtcgccgagctggtcaaaggtgtggacgaagtgcagaaactcacccacttcgcccgggtggacagcctcgccacgccggaagaacgcgcccagcaggcagaaactatgcggaaaatgctgctggcgatggttaccgacatccgcgtcgtgttaatcaaactggcgatgcgtacgcgcaccctgcaatttttaagcaacgcccccgacagccccgaaaaacgcgccgtcgccaaagaaaccctcgacatcttcgccccgctcgccaaccgtttgggcgtgtggcagctcaaatggcagctcgaagatttgggcttccgccatcaagaacccgaaaaataccgcgaaatcgccctgcttttggacgaaaaacgcaccgaacgcctcgaatacatcgaaaacttccttaatatcctgcgtacggaactcaaaaaatacaatatccactttgaagtcgccggccgtccgaaacacatctactccatttacaaaaaaatggtgaagaaaaaactcagcttcgacgggttgttcgacatccgcgccgtgcggattctggttgataccgtccccgagtgttacaccacactgggcattgtccacagcctctggcagcccattcccggcgagttcgacgactacatcgccaacccgaaaggcaacggctataaaagtttgcacaccgtcatcgtcggcccggaagacaaaggcgtggaagtgcaaatccgcaccttcgatatgcaccaattcaacgaattcggtgtcgccgcgcactggcgttacaaagagggcggcaaaggcgattccgcctacgaacaaaaaatcgcctggttacgccaacttttggactggcgcgaaaacatggcggaaagcggcaaggaagacctcgccgccgccttcaaaaccgagcttttcaacgacacgatttatgttttgaccccgcacggcaaagtcctctccctgcccacaggcgcgacccccatcgacttcgcctacgccctgcacagcagcatcggcgaccgttgccgcggtgcgaaagtcgaagggcagattgtgccgctgtccaccccgctcgaaaacggacagcgtgtcgaaatcattaccgccaaagaagggcatccttccgtcaactggctttacgaaggctgggtcaaatccaacaaggcaatcggcaaaatccgcgcctacatccgccagcaaaacgccgacaccgtgcgcgaagaaggccgcgtccaactcgacaaacagcttgccaaactcacgcccaaacccaacctgcaagagcttgccgaaaatctcggctacaaaaagccagaagacctctacaccgccgtcggacaaggcgaaatttccaaccgcgccatccaaaaagcctgcggcacgctgaacgaaccgccgcccgtacccgtcagcgaaaccaccatcgtcaaacagtccaaaatcaaaaaaggcggcaaaaacggcgtgctcatcgacggcgaagacggtctgatgaccacgcttgccaaatgctgcaaacccgcgccgcccgacgacattgtcggcttcgttacccgcgatcgcggcatttcggtacaccgcaaaacctgcccctctttccgacacctcgccgaacacgcgcccgaaaaagtactggacgcaagttgggcggcgttgcaggaaggacaagtgttcgccgtcgatatcgaaatccgcgcccaagaccgctccgggcttttgcgcgacgtatccgacgcgctcgcccgccacaaactcaacgttaccgccgtgcaaacccagtcccgcgacttggaagccagcatgaggttcacgctcgaagtcaaacaagttaccgacctcccacgcgtcctcgccagcctcggcgacgtcaaaggcgtattgagcgttacccggctttaa

SEQ ID NO: 422 - protein, 737 aa, Neisseria meningitidis
MTAISPIQDTQSATLQELREWFDSYCTALPNNDKKLVLAARSLAEAHYPADAATPYGEPLPDHFLGAAQMVHELDLLPDAVAATLLADIGRYVPDWNLLVSERCNSTVAELVKGVDEVQKLTHFARVDSLATPEERAQQAETMRKMLLAMVTDIRVVLIKLAMRTRTLQFLSNAPDSPEKRAVAKETLDIFAPLANRLGVWQLKWQLEDLGFRHQEPEKYREIALLLDEKRTERLEYIENFLNILRTELKKYNIHFEVAGRPKHIYSIYKKMVKKKLSFDGLFDIRAVRILVDTVPECYTTLGIVHSLWQPIPGEFDDYIANPKGNGYKSLHTVIVGPEDKGVEVQIRTFDMHQFNEFGVAAHWRYKEGGKGDSAYEQKIAWLRQLLDWRENMAESGKEDLAAAFKTELFNDTIYVLTPHGKVLSLPTGATPIDFAYALHSSIGDRCRGAKVEGQIVPLSTPLENGQRVEIITAKEGHPSVNWLYEGWVKSNKAIGKIRAYIRQQNADTVREEGRVQLDKQLAKLTPKPNLQELAENLGYKKPEDLYTAVGQGEISNRAIQKACGTLNEPPPVPVSETTIVKQSKIKKGGKNGVLIDGEDGLMTTLAKCCKPAPPDDIVGFVTRDRGISVHRKTCPSFRHLAEHAPEKVLDASWAALQEGQVFAVDIEIRAQDRSGLLRDVSDALARHKLNVTAVQTQSRDLEASMRFTLEVKQVTDLPRVLASLGDVKGVLSVTRL

SEQ ID NO: 423 - DNA, 378 bp, Neisseria gonorrhoeae
atgtgcgagttcaaggattttagaagaaacatcccttgttttgaagagtatgacgaaaattcatttattggcaaatggtatgatgacggggtgtgggatgatgaagaatattggaagctggagaatgatttaatcgaggttaggagaaaatatccttatccgatggatataccaagggatattgtgattggaatcggtaccattattgattttttaatggttccaaattgggagctttttgaaattaaagcttccccttggttgcctgatagcgtgggaattcatgaacgttatgaaagattcacaacgatgctccgttatatttttaccgagaaagacatagtcaacgtgcgatttgattattacaacaaaaaatag

SEQ ID NO: 424 - protein, 125 aa, Neisseria gonorrhoeae
MCEFKDFRRNIPCFEEYDENSFIGKWYDDGVWDDEEYWKLENDLIEVRRKYPYPMDIPRDIVIGIGTIIDFLMVPNWELFEIKASPWLPDSVGIHERYERFTTMLRYIFTEKDIVNVRFDYYNKK

SEQ ID NO: 425 - DNA, 378 bp, Neisseria meningitidis
atgtgtgagttcaaggatattataagaaacgttccttattttgaggggtatgacgaaaattcatttattggcaaatggtatgatgacggggtgtgggatgatgaagaatattggaagttggagaatgatttaatcgaggttagaaaaaaatatccttatccgatggacataccaagatatgttgtcattggaatcggtaccattattgatttcttaatggttccaaattggaaactttttgaaattaaagcttccccttggttgcctgatagtgtgggaattcatgaacgttatgaaagattcacaacgatgctccgttatatttttaccgagaaagacatagtcaacgtgcgatttgattattacaacaaaaaatag

SEQ ID NO: 426 - protein, 125 aa, Neisseria meningitidis
MCEFKDIIRNVPYFEGYDENSFIGKWYDDGVWDDEEYWKLENDLIEVRKKYPYPMDIPRYVVIGIGTIIDFLMVPNWKLFEIKASPWLPDSVGIHERYERFTTMLRYIFTEKDIVNVRFDYYNKK

SEQ ID NO: 427 - DNA, 378 bp, Neisseria meningitidis
atgtgtgagttcaaggattttagaagaaacatcccttgttttgaagagtatgacgaaaattcatttattggcaaatggtatgatgacggggtgtgggatgatgaagaatattggaaattggagaatgatttaatcgaggttagaaaaaaatatccttatccgatggatataccaagggatattgtgattggaatcggtaccattattgattttttaatggttccaaattgggagctttttgaaattaaagcttccccttggttgcctgatagtgtgggaattcatgaacgttatgaaagattcacaacgatgctccgttatatttttaccgagaaagacatagtcaacgtgcgatttgattattacaacaaaaaatag

SEQ ID NO: 428 - protein, 125 aa, Neisseria meningitidis
MCEFKDFRRNIPCFEEYDENSFIGKWYDDGVWDDEEYWKLENDLIEVRKKYPYPMDIPRDIVIGIGTIIDFLMVPNWELFEIKASPWLPDSVGIHERYERFTTMLRYIFTEKDIVNVRFDYYNKK

SEQ ID NO: 429 - DNA, 672 bp, Neisseria gonorrhoeae
atgatgaagacttttaaaaatatattttccgccgccattttgtccgccgccctgccgtgcgcgtatgcggcaaggctaccccaatccgccgtgctgcactattccggcagctacggcattcccgccacgatgacatttgaacgcagcggcaatgcttacaaaatcgtttcgacgattaaagtgccgctatacaatatccgtttcgaatccggcggtacggttgtcggcaataccctgcaccctgcctactataaagacatacgcaggggcaaactgtatgcggaagccaaattcgccgacggcagcgtaacctacggcaaagcgggcgagagcaaaaccgagcaaagccccaaggctatggatttgttcacgcttgcctggcagttggcggcaaatgacgcgaaactccccccgggtctgaaaatcaccaacggcaaaaaactttattccgtcggcggcctgaataaggcgggtacgggaaaatacagcataggcggcgtggaaaccgaagtcgtcaaatatcgggtgcggcgcggcgacgatacggtaacgtatttcttcgcaccgtccctgaacaatattccggcacaaatcggctataccgacgacggcaaaacctatacgctgaagctcaaatcggtgcagatcaacggacaggccgccaaaccgtaa

SEQ ID NO: 430 - protein, 223 aa, Neisseria gonorrhoeae
MMKTFKNIFSAAILSAALPCAYAARLPQSAVLHYSGSYGIPATMTFERSGNAYKIVSTIKVPLYNIRFESGGTVVGNTLHPAYYKDIRRGKLYAEAKFADGSVTYGKAGESKTEQSPKAMDLFTLAWQLAANDAKLPPGLKITNGKKLYSVGGLNKAGTGKYSIGGVETEVVKYRVRRGDDTVTYFFAPSLNNIPAQIGYTDDGKTYTLKLKSVQINGQAAKP

SEQ ID NO: 431 - DNA, 669 bp, Neisseria meningitidis
atgatgaagacttttaaaaatatattttccgccgccattttgtccgccgccctgccgtgcgcgtatgcggcagggctgccccaatccgccgtgctgmactattccggcagctacggcattcccgccacgatgacatttgaacgcagcggcaatgcttacaaaatcgtttcgacgattaaagtgccgctatacaatatccgtttcgagtccggcggtacggttgtcggcaataccctgcaccctacctactatagagacatacgcaggggcaaactgtatgcggaagccaaattcgccgacggcagcgtaacttacggcaaagcgggcgagagcaaaaccgagcaaagccccaaggctatggatttgttcacgcttgcctggcagttggcggcaaatgacgcgaaactccccccggggctgaaaatcaccaacggcaaaaaactttattccgtcggcggtttgaataaggcgggtacaggaaaatacagcataggcggcgtggaaaccgaagtcgtcaaatatcgggtgcggcgcggcgacgatgcggtaatgtatttcttcgcaccgtccctgaacaatattccggcacaaatcggctataccgacgacggcaaaacctatacgctgaaactcaaatcggtgcagatcaacggccaggcagccaaaccg

SEQ ID NO: 432 - protein, 223 aa, Neisseria meningitidis
  misc_feature (33)..(33): Xaa can be any naturally occurring amino acid
MMKTFKNIFSAAILSAALPCAYAAGLPQSAVLXYSGSYGIPATMTFERSGNAYKIVSTIKVPLYNIRFESGGTVVGNTLHPTYYRDIRRGKLYAEAKFADGSVTYGKAGESKTEQSPKAMDLFTLAWQLAANDAKLPPGLKITNGKKLYSVGGLNKAGTGKYSIGGVETEVVKYRVRRGDDAVMYFFAPSLNNIPAQIGYTDDGKTYTLKLKSVQINGQAAKP

SEQ ID NO: 433 - DNA, 672 bp, Neisseria meningitidis
atgatgaagacttttaaaaatatattttccgccgccattttgtccgccgccctgccgtgcgcgtatgcggcagggctgccccaatccgccgtgctgcactattccggcagctacggcattcccgccacgatgacatttgaacgcagcggcaatgcttacaaaatcgtttcgacgattaaagtgccgctatacaatatccgtttcgagtccggcggtacggttgtcggcaataccctgcaccctacctactatagagacatacgcaggggcaaactgtatgcggaagccaaattcgccgacggcagcgtaacctacggcaaagcgggcgagagcaaaaccgagcaaagccccaaggctatggatttgttcacgcttgcctggcagttggcggcaaatgacgcgaaactccccccggggctgaaaatcaccaacggcaaaaaactttattccgtcggcggtttgaataaggcgggtacaggaaaatacagcataggcggcgtggaaaccgaagtcgtcaaatatcgggtgcggcgcggcgacgatgcggtaatgtatttcttcgcaccgtccctgaacaatattccggcacaaatcggctataccgacgacggcaaaacctatacgctgaaactcaaatcggtgcagatcaacggccaggcagccaaaccgtaa

SEQ ID NO: 434 - protein, 223 aa, Neisseria meningitidis
MMKTFKNIFSAAILSAALPCAYAAGLPQSAVLHYSGSYGIPATMTFERSGNAYKIVSTIKVPLYNIRFESGGTVVGNTLHPTYYRDIRRGKLYAEAKFADGSVTYGKAGESKTEQSPKAMDLFTLAWQLAANDAKLPPGLKITNGKKLYSVGGLNKAGTGKYSIGGVETEVVKYRVRRGDDAVMYFFAPSLNNIPAQIGYTDDGKTYTLKLKSVQINGQAAKP

SEQ ID NO: 435 - DNA, 1101 bp, Neisseria gonorrhoeae
atggaaacacagctttacatcggcattatgtcgggaaccagtatggacggggcggatgccgtgctggtacggatggacggcggcaaatggctgggcgcggaagggcacgcctttaccccctaccctgaccggttgcgccgcaaattgctggatttgcaggacacaggcacagacgaactgcaccgcagcaggatgttgtcgcaagaactcagccgcctgtacgcgcaaaccgccgccgaactgctgtgcagtcaaaacctcgctccgtgcgacattaccgccctcggctgccacgggcaaaccgtccgacacgcgccggaacacggttacagcatacagcttgccgatttgccgctgctggcggaactgacgcggatttttaccgtcggcgacttccgcagccgcgaccttgctgccggcggacaaggtgcgccgctcgtccccgcctttcacgaagccctgttccgcgatgacagggaaacacgcgtggtactgaacatcggcgggattgccaacatcagcgtactcccccccggcgcacccgccttcggcttcgacacagggccgggcaatatgctgatggacgcgtggacgcaggcacactggcagctgccttacgacaaaaacggtgcaaaggcggcacaaggcaacatattgccgcaactgctcggcaggctgctcgcccacccgtatttctcacaaccccacccaaaaagcacggggcgcgaactgtttgccctaaattggctcgaaacctaccttgacggcggcgaaaaccgatacgacgtattgcggacgctttcccgattcaccgcgcaaaccgtttgggacgccgtctcacacgcagcggcagatgcccgtcaaatgtacatttgcggcggcggcatccgcaatcctgttttaatggcggatttggcagaatgtttcggcacacgcgtttccctgcacagcaccgccgaactgaacctcgatcctcaatgggtggaggcggccgcatttgcgtggttggcggcgtgttggattaaccgcattcccggtagtccgcacaaagcgaccggcgcatccaaaccgtgtattctgggcgcgggatattattattga

SEQ ID NO: 436 - protein, 366 aa, Neisseria gonorrhoeae
METQLYIGIMSGTSMDGADAVLVRMDGGKWLGAEGHAFTPYPDRLRRKLLDLQDTGTDELHRSRMLSQELSRLYAQTAAELLCSQNLAPCDITALGCHGQTVRHAPEHGYSIQLADLPLLAELTRIFTVGDFRSRDLAAGGQGAPLVPAFHEALFRDDRETRVVLNIGGIANISVLPPGAPAFGFDTGPGNMLMDAWTQAHWQLPYDKNGAKAAQGNILPQLLGRLLAHPYFSQPHPKSTGRELFALNWLETYLDGGENRYDVLRTLSRFTAQTVWDAVSHAAADARQMYICGGGIRNPVLMADLAECFGTRVSLHSTAELNLDPQWVEAAAFAWLAACWINRIPGSPHKATGASKPCILGAGYYY

SEQ ID NO: 437 - DNA, 1101 bp, Neisseria meningitidis
  misc_feature (364)..(606): n is a, c, g, or t
  misc_feature (995)..(995): n is a, c, g, or t
  misc_feature (1082)..(1082): n is a, c, g, or t
atggaaacacagctttacatcggcatcatgtcgggaaccagcatggacggggcggatgccgtactgatacggatggacggcggcaaatggctgggcgcggaagggcacgcctttaccccctaccccggcaggttacgccgccaattgctggatttgcaggacacaggcgcagacgaactgcaccgcagcaggattttgtcgcaagaactcagccgcctatatgcgcaaaccgccgccgaactgctgtgcagtcaaaacctcgcaccgtccgacattaccgccctcggctgccacgggcaaaccgtccgacacgcgccggaacacggttacagcatacagcttgccgatttgccgctgctggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcttccttacgacaaaaacggtgcaaagtcggcacaaggcaacatattgccgcaactgctcgacaggctgctcgcccacccgtatttcgcacaacgccaccctaaaagcacggggcgcgaactgtttgccataaattggctcgaaacctaccttgacggcggcgaaaaccgatacgacgtattgcggacgctttcccgttttaccgcgcaaaccgtttgcgacgccgtctcacacgcagcggcagatgcccgtcaaatgtacatttgcgacggcggcatccgcaatcctgttttaatggcggatttggcagaatgtttcggcacacgcgtttccctgcacagcaccgccgacctgaacctcgatccgcaatgggtggaagccgccgnatttgcgtggttggcggcgtgttggattaatcgcattcccggtagtccgcacaaagcaaccggcgcatccaaaccgtgtattctgancgcgggatattattattga

SEQ ID NO: 438 - protein, 366 aa, Neisseria meningitidis
  misc_feature (122)..(202): Xaa can be any naturally occurring amino acid
  misc_feature (332)..(332): Xaa can be any naturally occurring amino acid
  misc_feature (361)..(361): Xaa can be any naturally occurring amino acid
METQLYIGIMSGTSMDGADAVLIRMDGGKWLGAEGHAFTPYPGRLRRQLLDLQDTGADELHRSRILSQELSRLYAQTAAELLCSQNLAPSDITALGCHGQTVRHAPEHGYSIQLADLPLLAXXXXXXXXXXXXXXXXXXXXXXXXXXXXXXXXXXXXXXXXXXXXXXXXXXXXXXXXXXXXXXXXXXXXXXXXXXXXXXXXXQLPYDKNGAKSAQGNILPQLLDRLLAHPYFAQRHPKSTGRELFAINWLETYLDGGENRYDVLRTLSRFTAQTVCDAVSHAAADARQMYICDGGIRNPVLMADLAECFGTRVSLHSTADLNLDPQWVEAAXFAWLAACWINRIPGSPHKATGASKPCILXAGYYY

SEQ ID NO: 439 - DNA, 1101 bp, Neisseria meningitidis
atggaaacacagctttacatcggcatcatgtcgggaaccagcatggacggggcggatgccgtactgatacggatggacggcggcaaatggctgggcgcggaagggcacgcctttaccccctaccccggcaggttacgccgcaaattgctggatttgcaggacacaggcgcggacgaactgcaccgcagcaggatgttgtcgcaagaactcagccgcctgtacgcgcaaaccgccgccgaactgctgtgcagtcaaaacctcgcgccgtccgacattaccgccctcggctgccacgggcaaaccgtcagacacgcgccggaacacagttacagcgtacagcttgccgatttgccgctgctggcggaacggactcagatttttaccgtcggcgacttccgcagccgcgaccttgcggccggcggacaaggcgcgccgctcgtccccgcctttcacgaagccctgttccgcgacgacagggaaacacgcgcggtactgaacatcggcgggattgccaacatcagcgtactcccccccgacgcacccgccttcggcttcgacacaggaccgggcaatatgctgatggacgcgtggatgcaggcacactggcagcttccttacgacaaaaacggtgcaaaggcggcacaaggcaacatattgccgcaactgctcgacaggctgctcgcccacccgtatttcgcacaaccccaccctaaaagcacggggcgcgaactgtttgccctaaattggctcgaaacctaccttgacggcggcgaaaaccgatacgacgtattgcggacgctttcccgattcaccgcgcaaaccgttttcgacgccgtctcacacgcagcggcagatgcccgtcaaatgtacatttgcggcggcggcatccgcaatcctgttttaatggcggatttggcagaatgtttcggcacacgcgtttccctgcacagcaccgccgaactgaacctcgatccgcaatgggtagaagccgccgcgttcgcatggatggcggcgtgttgggtcaaccgcattcccggtagtccgcacaaagcaaccggcgcatccaaaccgtgtattctgggcgcgggatattattattga

SEQ ID NO: 440 - protein, 366 aa, Neisseria meningitidis
METQLYIGIMSGTSMDGADAVLIRMDGGKWLGAEGHAFTPYPGRLRRKLLDLQDTGADELHRSRMLSQELSRLYAQTAAELLCSQNLAPSDITALGCHGQTVRHAPEHSYSVQLADLPLLAERTQIFTVGDFRSRDLAAGGQGAPLVPAFHEALFRDDRETRAVLNIGGIANISVLPPDAPAFGFDTGPGNMLMDAWMQAHWQLPYDKNGAKAAQGNILPQLLDRLLAHPYFAQPHPKSTGRELFALNWLETYLDGGENRYDVLRTLSRFTAQTVFDAVSHAAADARQMYICGGGIRNPVLMADLAECFGTRVSLHSTAELNLDPQWVEAAAFAWMAACWVNRIPGSPHKATGASKPCILGAGYYY

SEQ ID NO: 441 - DNA, 1101 bp, Neisseria meningitidis
  misc_feature (995)..(995): n is a, c, g, or t
  misc_feature (1082)..(1082): n is a, c, g, or t
atggaaacacagctttacatcggcatcatgtcgggaaccagcatggacggggcggatgccgtactgatacggatggacggcggcaaatggctgggcgcggaagggcacgcctttaccccctaccccggcaggttacgccgccaattgctggatttgcaggacacaggcgcagacgaactgcaccgcagcaggattttgtcgcaagaactcagccgcctatatgcgcaaaccgccgccgaactgctgtgcagtcaaaacctcgcaccgtccgacattaccgccctcggctgccacgggcaaaccgtccgacacgcgccggaacacggttacagcatacagcttgccgatttgccgctgctggcggaacggacgcggatttttaccgtcggcgacttccgcagccgcgaccttgcggccggcggacaaggcgcgccactcgtccccgcctttcacgaagccctgttccgcgacaacagggaaacacgcgcggtactgaacatcggcgggattgccaacatcagcgtactcccccccgacgcacccgccttcggcttcgacacagggccgggcaatatgctgatggacgcgtggacgcaggcacactggcagcttccttacgacaaaaacggtgcaaaggcggcacaaggcaacatattgccgcaactgctcgacaggctgctcgcccacccgtatttcgcacaaccccaccctaaaagcacggggcgcgaactgtttgccctaaattggctcgaaacctaccttgacggcggcgaaaaccgatacgacgtattgcggacgctttcccgttttaccgcgcaaaccgtttgcgacgccgtctcacacgcagcggcagatgcccgtcaaatgtacatttgcggcggcggcatccgcaatcctgttttaatggcggatttggcagaatgtttcggcacacgcgtttccctgcacagcaccgccgacctgaacctcgatccgcaatgggtggaagccgccgnatttgcgtggttggcggcgtgttggattaatcgcattcccggtagtccgcacaaagcaaccggcgcatccaaaccgtgtattctgancgcgggatattattattga

SEQ ID NO: 442 - protein, 366 aa, Neisseria meningitidis
  misc_feature (332)..(332): Xaa can be any naturally occurring amino acid
  misc_feature (361)..(361): Xaa can be any naturally occurring amino acid
METQLYIGIMSGTSMDGADAVLIRMDGGKWLGAEGHAFTPYPGRLRRQLLDLQDTGADELHRSRILSQELSRLYAQTAAELLCSQNLAPSDITALGCHGQTVRHAPEHGYSIQLADLPLLAERTRIFTVGDFRSRDLAAGGQGAPLVPAFHEALFRDNRETRAVLNIGGIANISVLPPDAPAFGFDTGPGNMLMDAWTQAHWQLPYDKNGAKAAQGNILPQLLDRLLAHPYFAQPHPKSTGRELFALNWLETYLDGGENRYDVLRTLSRFTAQTVCDAVSHAAADARQMYICGGGIRNPVLMADLAECFGTRVSLHSTADLNLDPQWVEAAXFAWLAACWINRIPGSPHKATGASKPCILXAGYYY

SEQ ID NO: 443 - DNA, 1101 bp, Neisseria meningitidis; identical to SEQ ID NO: 439

SEQ ID NO: 444 - protein, 366 aa, Neisseria meningitidis; identical to SEQ ID NO: 440

SEQ ID NO: 445 - DNA, 732 bp, Neisseria gonorrhoeae
atggctttactgagcatccgcaagctgcacaaacaatacggcagcgtaaccgccatccaatccttagacttggacttggaaaaaggcgaagtcatcgtactgctgggcccgtccggctgcggcaaatccaccctcctgcgctgcgtcaacggtttggagccgcaccaaggcggcagcatcgtgatggacggtgtcggcgaattcggcaaagacgtttcctggcaaaccgcccggcaaaaagtcggtatggtctttcaaagtaacgaactgtttgcccacatgaccgtcatcgaaaacatcttcttaggcccggtaaaggaacaaaaccgcgaccgtgccgaagcagaggcgcaagccggcaaactgttggaacgcgtcggactgctagaccgcaaaaacgcctatccgcgcgaactttccggcggtcagaaacagcgcatcgccattgtccgcgccctgtgcctgaatccggaagtcatcctgctggacgaaatcaccgccgcacttgaccccgaaatggtgcgcgaagtcttggaagtggttttggaactcgcccgcgaagggatgagtatgctcatcgtaacccacgaaatggggttcgcacgcaaagttgccgaccgcatcgtctttatggacaaaggcggcatcgtcgaatcgtccgaccccgaaacctttttttccgcaccaaaaagcgaacgcgcccgccaatttctggcaggtatggactactga

SEQ ID NO: 446 - protein, 243 aa, Neisseria gonorrhoeae
MALLSIRKLHKQYGSVTAIQSLDLDLEKGEVIVLLGPSGCGKSTLLRCVNGLEPHQGGSIVMDGVGEFGKDVSWQTARQKVGMVFQSNELFAHMTVIENIFLGPVKEQNRDRAEAEAQAGKLLERVGLLDRKNAYPRELSGGQKQRIAIVRALCLNPEVILLDEITAALDPEMVREVLEVVLELAREGMSMLIVTHEMGFARKVADRIVFMDKGGIVESSDPETFFSAPKSERARQFLAGMDY

SEQ ID NO: 447 - DNA, 762 bp, Neisseria meningitidis
gttgtcatgattaaaatccgcaatatccataagacctttggcgaaaacactattttgcgcggcatcgatttggatgtgtgcaaagggcaggtggtcgtcatcctcgggccttccggctcaggcaaaacgacgtttctgcgatgcctaaacgcgttggaaatgcccgaagacggacaaatcgagttcgacaacgagcgaccgctgaaaatcgatttttctaaaaaaccaagcaaacacgatattttggcactgcgccgcaaatcakgcatggtgtttcaacaatacaayctctttccgcacaaaaccgccttggaaaacgtaatggaaggaccggttgccgtacagggcaagcctgccgcccaagcgcgcgaagaggctctgaaactgctggaaaaagtcggcttgggcgacaaagtggatttgtatccctaccagctttccggcggtcagcagcagcgcgtcggcattgcccgcgcattggcgattcagcctgaactgatgctgtttgacgaaccgacttccgcgctcgatcctgaattggtgcaagatgttttggatmccatgaaggaattggcgcaagaaggctggaccatggttgtcgttacgcatgaaatcaagttcgccttagaagtggcaaccaccgwcgtcgtgatggacrgcggcgttattgtcgaacaaggcagcccgcaagatttgttcgaccaccccaaacacgaacggacgcggagatttttaagccaaatccaatctaccaagatttga

SEQ ID NO: 448 - protein, 253 aa, Neisseria meningitidis
  misc_feature (89)..(89): Xaa can be any naturally occurring amino acid
  misc_feature (187)..(187): Xaa can be any naturally occurring amino acid
  misc_feature (215)..(215): Xaa can be any naturally occurring amino acid
  misc_feature (220)..(220): Xaa can be any naturally occurring amino acid
VVMIKIRNIHKTFGENTILRGIDLDVCKGQVVVILGPSGSGKTTFLRCLNALEMPEDGQIEFDNERPLKIDFSKKPSKHDILALRRKSXMVFQQYNLFPHKTALENVMEGPVAVQGKPAAQAREEALKLLEKVGLGDKVDLYPYQLSGGQQQRVGIARALAIQPELMLFDEPTSALDPELVQDVLDXMKELAQEGWTMVVVTHEIKFALEVATTXVVMDXGVIVEQGSPQDLFDHPKHERTRRFLSQIQSTKI

SEQ ID NO: 449 - DNA, 762 bp, Neisseria meningitidis
gttgtcatgattaaaatccgcaatatccataagaccttcggcaaaaataccattttgcgcggcatcaatttggatgtgtgcaaagggcaggtggtcgtcatcctcgggccttccggctcaggcaaaacgacgtttctgcgatgcctaaacgcgttggaaatgcccgaagacggacaaatcgagttcgacaacgagcgaccgctgaaaatcgatttttctaaaaaaccaagcaaacacgatattttggcactgcgccgcaaatcaggcatggtgtttcaacaatacaacctctttccgcacaaaaccgccttggaaaacgtgatggaaggaccggttgccgtacagggcaagcctgccgcccaagcgcgcgaagaggctctgaaactgctggaaaaagtcggcttgggcgacaaagtggatttgtatccctaccagctttccggcggtcagcagcagcgcgtcggcattgcccgagcattggcgattcagcccgagctgatgttgtttgacgaacccacttccgcgcttgaccccgagttggtgcaagacgtgttgaacgccatgaaggaattggcgcgggaaggttggacgatggtcgtcgttacccacgaaatcaagttcgcgctggaagttgccacgaccgttgtcgtgatggacggcggcgttatcgtagagcagggcagcccgaaagagttgttcgaccaccccaaacacgaacggacgcggagatttttaagccaaatccaatctaccaagatttga

SEQ ID NO: 450 - protein, 253 aa, Neisseria meningitidis
VVMIKIRNIHKTFGKNTILRGINLDVCKGQVVVILGPSGSGKTTFLRCLNALEMPEDGQIEFDNERPLKIDFSKKPSKHDILALRRKSGMVFQQYNLFPHKTALENVMEGPVAVQGKPAAQAREEALKLLEKVGLGDKVDLYPYQLSGGQQQRVGIARALAIQPELMLFDEPTSALDPELVQDVLNAMKELAREGWTMVVVTHEIKFALEVATTVVVMDGGVIVEQGSPKELFDHPKHERTRRFLSQIQSTKI

SEQ ID NO: 451 - DNA, 756 bp, Neisseria gonorrhoeae
atgattaaaatccgcaatatccataagacctttggcgaaaacaccattttgcgcggcatcgatttggatgtgggcaaagggcaggtggtcgtcatcctcgggccttccggctcgggtaaaacaacatttctgcgctgcctaaacgcgttggaaatgcccgaagacggacaaatcgagttcgacaacgcgcggccgttacgcattgatttttccaaaaaaacaagcaaacacgatattttggcactgcgccgcaagtccggaatggtattccaacaatacaacctcttcccgcataaaaccgtgttggaaaacgtgatggaagggccggttgccgtacagggcaagcctgccgcccaagcgcgcgaagaggctttgaaactgctggaaaaagtcggcttgggcgataaagtggatttgtatccctaccagctttccggcggtcagcagcagcgtgtcggtatcgcccgcgcactggcgattcagcctgaattgatgctgtttgacgaacccacttccgcgctggaccccgagttggtgcaagacgtgttggacgccatgaaggaattggcgcgggaaggttggacgatggtcgtcgttacccacgaaatcaagttcacgctggaagttgccacgaacgtcgtcgtgatggacggcggcgttatcgtagagcagggcagcccgaaagagttgttcgaccacctcaaacacgaacggacgcggagatttttaagccaaatccaatctgccaagatttga

SEQ ID NO: 452 - protein, 251 aa, Neisseria gonorrhoeae
MIKIRNIHKTFGENTILRGIDLDVGKGQVVVILGPSGSGKTTFLRCLNALEMPEDGQIEFDNARPLRIDFSKKTSKHDILALRRKSGMVFQQYNLFPHKTVLENVMEGPVAVQGKPAAQAREEALKLLEKVGLGDKVDLYPYQLSGGQQQRVGIARALAIQPELMLFDEPTSALDPELVQDVLDAMKELAREGWTMVVVTHEIKFTLEVATNVVVMDGGVIVEQGSPKELFDHLKHERTRRFLSQIQSAKI

SEQ ID NO: 453 - DNA, 756 bp, Neisseria meningitidis
atgattaaaatccgcaatatccataagacctttggcgaaaacactattttgcgcggcatcgatttggatgtgtgcaaagggcaggtggtcgtcatcctcgggccttccggctcaggcaaaacgacgtttctgcgatgcctaaacgcgttggaaatgcccgaagacggacaaatcgagttcgacaacgagcgaccgctgaaaatcgatttttctaaaaaaccaagcaaacacgatattttggcactgcgccgcaaatcaggcatggtgtttcaacaatacaacctctttccgcacaaaaccgccttggaaaacgtaatggaaggaccggttgccgtacagggcaagcctgccgcccaagcgcgcgaagaggctctgaaactgctggaaaaagtcggcttgggcgacaaagtggatttgtatccctaccagctttccggcggtcagcagcagcgcgtcggcattgcccgcgcattggcgattcagcctgaactgatgctgtttgacgaaccgacttccgcgctcgatcctgaattggtgcaagatgttttggataccatgaaggaattggcgcaagaaggctggaccatggttgtcgttacgcatgaaatcaagttcgccttagaagtggcaaccaccgtcgtcgtgatggacggcggcgttattgtcgaacaaggcagcccgcaagatttgttcgaccaccccaaacacgaacggacgcggagatttttaagccaaatccaatctaccaagatttga

SEQ ID NO: 454 - protein, 251 aa, Neisseria meningitidis
MIKIRNIHKTFGENTILRGIDLDVCKGQVVVILGPSGSGKTTFLRCLNALEMPEDGQIEFDNERPLKIDFSKKPSKHDILALRRKSGMVFQQYNLFPHKTALENVMEGPVAVQGKPAAQAREEALKLLEKVGLGDKVDLYPYQLSGGQQQRVGIARALAIQPELMLFDEPTSALDPELVQDVLDTMKELAQEGWTMVVVTHEIKFALEVATTVVVMDGGVIVEQGSPQDLFDHPKHERTRRFLSQIQSTKI

SEQ ID NO: 455 - DNA, 756 bp, Neisseria meningitidis
atgattaaaatccgcaatatccataagaccttcggcaaaaataccattttgcgcggcatcaatttggatgtgtgcaaagggcaggtggtcgtcatcctcgggccttccggctcaggcaaaacgacgtttctgcgatgcctaaacgcgttggaaatgcccgaagacggacaaatcgagttcgacaacgagcgaccgctgaaaatcgatttttctaaaaaaccaagcaaacacgatattttggcactgcgccgcaaatcaggcatggtgtttcaacaatacaacctctttccgcacaaaaccgccttggaaaacgtgatggaaggaccggttgccgtacagggcaagcctgccgcccaagcgcgcgaagaggctctgaaactgctggaaaaagtcggcttgggcgacaaagtggatttgtatccctaccagctttccggcggtcagcagcagcgcgtcggcattgcccgagcattggcgattcagcccgagctgatgttgtttgacgaacccacttccgcgcttgaccccgagttggtgcaagacgtgttgaacgccatgaaggaattggcgcgggaaggttggacgatggtcgtcgttacccacgaaatcaagttcgcgctggaagttgccacgaccgttgtcgtgatggacggcggcgttatcgtagagcagggcagcccgaaagagttgttcgaccaccccaaacacgaacggacgcggagatttttaagccaaatccaatctaccaagatttga

SEQ ID NO: 456 - protein, 251 aa, Neisseria meningitidis
MIKIRNIHKTFGKNTILRGINLDVCKGQVVVILGPSGSGKTTFLRCLNALEMPEDGQIEFDNERPLKIDFSKKPSKHDILALRRKSGMVFQQYNLFPHKTALENVMEGPVAVQGKPAAQAREEALKLLEKVGLGDKVDLYPYQLSGGQQQRVGIARALAIQPELMLFDEPTSALDPELVQDVLNAMKELAREGWTMVVVTHEIKFALEVATTVVVMDGGVIVEQGSPKELFDHPKHERTRRFLSQIQSTKI

SEQ ID NO: 457 - DNA, 1032 bp, Neisseria gonorrhoeae
atgtcgggcaatgcctcctctccttcatcttccgccgccatcgggctggtttggttcggcgcggcggtatcgattgccgaaatcagcacgggtacgctgctcgcccccttgggctggcagcgcggtctggcggccctgcttttgggtcatgccgtcggcggcgcgctgttttttgcggcggcgtatatcggcgcactgaccggacgcagctcgatggaaagtgtgcgcctgtcgttcggcaaatgcggttcagtgctgttttccgtggcgaatatgctgcaactggccggctggacggcggtgatgatttacgtcggcgcaacggtcagctccgctttgggcaaagtgttgtgggacggcgaatcctttgtctggtgggcattggcaaacggcgcactgatcgtgctgtggctggttttcggcgcacgcagaacgggcgggctgaaaaccgtttcgatgctgctgatgctgcttgccgtgttgtggttgagcgtcgaagtgttcgcttcgtccggcacaaacgccgcgcccgccgtttcagacggcatgaccttcggaacggcagtcgaactgtccgccgtcatgccgctttcctggctgccgctggccgccgactacacgcgccaagcacgccgcccgtttgcggcaaccctgacggcaacgctcgcctatacgctgacgggctgctggatgtatgccttgggtttggcggcggctctgtttaccggagaaaccgacgtggcgaaaatcctgttgggcgcgggcttgggcataacgggcattctggcagtcgtcctctccaccgttaccacaacgtttctcgatacctattccgccggcgcgagtgcgaacaacatttccgcgcgttttgcggaaatacccgtcgctgtcggcgttaccctgatccgcaccgtgcttgccgtcatgctgcccgttaccgaatataaaaacttcctgctgcttatccgctcggtatttgggccgatggcgggtggttttgattgccgacttttttgtcttaaaacggcgtga

SEQ ID NO: 458 - protein, 1 aa, Neisseria gonorrhoeae
C

SEQ ID NO: 459 - DNA, 1029 bp, Neisseria meningitidis
atgtcgggcaatgcctcctctccttcatcttcctccgccatcgggctgatttggttcggcgcggcggtatcgattgccgaaatcagcacgggtacgctgcttgcgcctttgggctggcagcgcggtctggcggctctacttttgggtcatgccgtcggcggcgcgctgttttttgcggcggcgtatatcggcgcactgaccggacgcagctcgatggaaagcgtgcgcctgtcgttcggcaaacgcggttcagtgctgttttccgtggcgaatatgctgcaactggccggctggacggcggtgatgatttacgccggcgcaacggtcagctccgctttgggcaaagtgttgtgggacggcgaatcttttgtctggtgggcattggcaaacggcgcgctgattgtgctgtggctggttttcggcgcacgcaaaacaggcgggctgaaaaccgtttcgatgctgctgatgctgttggcggttctgtggctgagtgccgaagtcttttccacggcaggcagcaccgccgcacaggtttcagacggcatgagtttcggaacggcagtcgagctgtccgccgtgatgccgctttcctggctgccgcttgccgccgactacacgcgccacgcgcgccgcccgtttgcggcaaccctgacggcaacgctcgcctacacgctgaccggctgctggatgtatgccttgggtttggcagcggcgttgttcaccggagaaaccgacgtggcaaaaatcctgctgggcgcargtttgggtgcggcaggcattttggcggtcgtcctctccaccgttaccacaacgtttctcgatgcctattccgccggcgcgagtgcgaacaacatttccgcgcgttttgcggaaacacccgtcgctgtcrgcgttaccctgatcggcacggtacttgccgtcatgctgcccgttaccgaatatgaaaacttcctgctgcttatcggctcggtatttgcgccgatggcgggcggttttgattgccgactttttcgtcttgaaacggcgtga

SEQ ID NO: 460 - protein, 342 aa, Neisseria meningitidis
  misc_feature (254)..(254): Xaa can be any naturally occurring amino acid
  misc_feature (297)..(297): Xaa can be any naturally occurring amino acid
MSGNASSPSSSSAIGLIWFGAAVSIAEISTGTLLAPLGWQRGLAALLLGHAVGGALFFAAAYIGALTGRSSMESVRLSFGKRGSVLFSVANMLQLAGWTAVMIYAGATVSSALGKVLWDGESFVWWALANGALIVLWLVFGARKTGGLKTVSMLLMLLAVLWLSAEVFSTAGSTAAQVSDGMSFGTAVELSAVMPLSWLPLAADYTRHARRPFAATLTATLAYTLTGCWMYALGLAAALFTGETDVAKILLGAXLGAAGILAVVLSTVTTTFLDAYSAGASANNISARFAETPVAVXVTLIGTVLAVMLPVTEYENFLLLIGSVFAPMAGGFDCRLFRLETA

SEQ ID NO: 461 - DNA, 1028 bp, Neisseria meningitidis
atgtcgggcaatgcctcctctccttcatcttccgccgccatcgggctgatttggttcggcgcggcggtatcgattgccgaaatcagcacgggtacactgcttgcgcctttgggctggcagcgcggtctggcggctctgcttttgggtcatgccgtcggcggcgcgctgttttttgcggcggcgtatatcggcgcactgaccggacgcagctcgatggaaagcgtgcgcctgtcgttcggcaaacgcggttcagtgctgttttccgtggcgaatatgctgcaactggccggctggacggcggtgatgatttacgccggcgcaacggtcagctccgctttgggcaaagtgttgtgggacggcgaatcttttgtctggtgggcattggcaaacggcgcgctgattgtgctgtggctggttttcggcgcacgcaaaacaggcgggctgaaaaccgtttcgatgctgctgatgctgttggcggttctgtggctgagtgccgaagtcttttccacggcaggcagcaccgccgcacaggtttcagacggcatgagtttcggaacggcagtcgagctgtccgccgtgatgccgctttcttggctgccgctggccgccgactacacgcgccacgcgcgccgcccgtttgcggcaaccctgacggcaacgctcgcctacacgctgaccggctgctggatgtatgccttgggtttggcagcggcgttgttcaccggagaaaccgacgtggcaaaaatcctgctgggcgcaggtttgggtgcggcaggcattttggcggtcgtcctgtcgaccgttaccaccacttttctcgatgcctactccgccggcgtaagtgccaacaatatttccgccaaactttcggaaatacccatcgccgttgccgtcgccgttgtcggcacactgcttgccgtcctcctgcccgttaccgaatatgaaaacttcctgctgcttatcggctcggtatttgcgccgatggcggcggttttgattgccgactttttcgtcttgaaacggcgtga

SEQ ID NO: 462 - protein, 342 aa, Neisseria meningitidis
  misc_feature (330)..(330): Xaa can be any naturally occurring amino acid
MSGNASSPSSSAAIGLIWFGAAVSIAEISTGTLLAPLGWQRGLAALLLGHAVGGALFFAAAYIGALTGRSSMESVRLSFGKRGSVLFSVANMLQLAGWTAVMIYAGATVSSALGKVLWDGESFVWWALANGALIVLWLVFGARKTGGLKTVSMLLMLLAVLWLSAEVFSTAGSTAAQVSDGMSFGTAVELSAVMPLSWLPLAADYTRHARRPFAATLTATLAYTLTGCWMYALGLAAALFTGETDVAKILLGAGLGAAGILAVVLSTVTTTFLDAYSAGVSANNISAKLSEIPIAVAVAVVGTLLAVLLPVTEYENFLLLIGSVFAPMAXGFDCRLFRLETA

SEQ ID NO: 463 - DNA, 867 bp, Neisseria gonorrhoeae
atgccgtctgaaaccccaaaggcacgccgccggctttcagacggcatcgcgtccgacaaccataccaaagaatccatcatgctcaccctgtacggcgaaactttcccttcgcggctgctgctcggcacggcggcctacccgacccctgaaatcctcaaacaatccgtccgaaccgcccggcccgcgatgattaccgtctcgctgcgccgcacgggatgcggcggcgaggcgcacggtcaggggttttggtcgctgcttcaagaaaccggcgttcccgtcctgccgaacacggcaggctgccaaagcgtgcaggaagcggtaacgacggcgcaaatggcgcgcgaagtgtttgaaaccgattggataaaattggaactcatcggcgacgacgacaccttgcagccggacgtgttccaactcgtcgaagcggcggaaatcctgattaaagacggcttcaaagtgctgccttattgcaccgaagacctgattgcctgccgccgcctgctcgatgcgggctgtcaggcgttgatgccgtgggcggctcccatcggcacgggtttgggggcggttcacgcctatgcgctcaaaatcctgcgcgaacgcctgcccgacacgccgctgattatcgacgcgggcttgggtttgccttcccaagcggcacaagtgatggaatggggttttgacggcgtattgttaaacaccgccgtttcccgcagcggcgaccccgtcaacatggcgcgcgccttcgcactcgccgtcgaatccggacggctggcatttgaagccgggccggtcgaagcgcgaaccaaagcccaagccagcacgccgacagtcggacaaccgttttggcattcggcggaatattga

SEQ ID NO: 464 - protein, 288 aa, Neisseria gonorrhoeae
MPSETPKARRRLSDGIASDNHTKESIMLTLYGETFPSRLLLGTAAYPTPEILKQSVRTARPAMITVSLRRTGCGGEAHGQGFWSLLQETGVPVLPNTAGCQSVQEAVTTAQMAREVFETDWIKLELIGDDDTLQPDVFQLVEAAEILIKDGFKVLPYCTEDLIACRRLLDAGCQALMPWAAPIGTGLGAVHAYALKILRERLPDTPLIIDAGLGLPSQAAQVMEWGFDGVLLNTAVSRSGDPVNMARAFALAVESGRLAFEAGPVEARTKAQASTPTVGQPFWHSAEY

SEQ ID NO: 465 - DNA, 810 bp, Neisseria gonorrhoeae
cactatacaaaggaacccattatgctcaccctatacggcgaaactttcccctcgcggctgctgctcggcacggctgcctacccgacccccgaaatcctcaaacaatccatccaaaccgcccagcctgcgatgattaccgtctcgctgcgccgcgcgggaagcggcggcgaggcgcacggtcaggggttttggtcgctgcttcaagaaaccggcgttcccgtcctgccgaacacggcaggctgccaaagcgtgcaggaagcggtaacgacggcgcaaatggcgcgcgaagtgtttgaaaccgattggataaaattggaactcatcggagatgacgacaccttgcagccggatgtgttccagcttgtcgaagcggcggaaatcctgattaaagacggcttcaaagtgctgccttattgcaccgaagacctgattgcctgccgccgcctgctcgacgcgggctgtcaggcgttgatgccgtgggcggccccgatcggcacgggtttgggcgcggttcacgcctacgcgttgaacgtcctgcgcgaacgcctgcccgacacgccgctgattatcgacgcgggcttgggtttgccctcacaggcggcacaagtgatggaatggggctttgacggcgtgcttttgaatactgccgtttcccgcagcggcgatccggtcaatatggcacgcgccttcgcactcgccgtcgaatccggacggctggcatttgaagccggaccggtcgaagcacgcgacaaagcgcaagccagcacgccgacagtcggacaaccgttttggcattcggcggaatattga

SEQ ID NO: 466 - protein, 269 aa, Neisseria meningitidis
HYTKEPIMLTLYGETFPSRLLLGTAAYPTPEILKQSIQTAQPAMITVSLRRAGSGGEAHGQGFWSLLQETGVPVLPNTAGCQSVQEAVTTAQMAREVFETDWIKLELIGDDDTLQPDVFQLVEAAEILIKDGFKVLPYCTEDLIACRRLLDAGCQALMPWAAPIGTGLGAVHAYALNVLRERLPDTPLIIDAGLGLPSQAAQVMEWGFDGVLLNTAVSRSGDPVNMARAFALAVESGRLAFEAGPVEARDKAQASTPTVGQPFWHSAEY

SEQ ID NO: 467 - DNA, 819 bp, Neisseria meningitidis
ttgttaatccactatacaaaggaacccattatgctcaccctgtacagcgaaactttcccttcgcggctgctgctcggcacagccgcctacccgacccctgaaatcctcaaacaatccgtccgaaccgcccggcccgcgatgattaccgtctcgctgcgccgcgcgggatgcggcggcgaggcgcacggtcaggggttttggtcgctgcttcaagaaaccggcgttcccgtcctgccgaacacggcaggctgccaaagcgtgcaggaagcggtaacgacggcgcaaatggcgcgcgaagtgtttgaaaccgattggattaaactcgaactcatcggcgacgacgacaccttgcagccggatgtgttccaacttgtcgaagcggcggaaatcctgattaaagacggcttcaaagtgctgccttattgcaccgaagacctgattgcctgccgccgcctgctcgacgcgggctgtcaggcgttgatgccgtgggcggccccgatcggcacgggtttgggcgcggttcacgcctacgcgttgaacgtcctgcgcgaacgcctgcccgacacgccgctgattatcgacgcgggcttgggtttgccctcacaggcggcacaagtgatggaatggggctttgacggcgtgcttttgaatactgccgtttcccgcagcggcgatccggtcaatatggcacgcgccttcgcactcgccgtcgaatccggacggctggcatttgaagccggaccggtcgaagcacgcgacaaagcgcaagccagcacgccgacagtcggacaaccgttttggcattcggcggaatattga

SEQ ID NO: 468 - protein, 272 aa, Neisseria meningitidis
LLIHYTKEPIMLTLYSETFPSRLLLGTAAYPTPEILKQSVRTARPAMITVSLRRAGCGGEAHGQGFWSLLQETGVPVLPNTAGCQSVQEAVTTAQMAREVFETDWIKLELIGDDDTLQPDVFQLVEAAEILIKDGFKVLPYCTEDLIACRRLLDAGCQALMPWAAPIGTGLGAVHAYALNVLRERLPDTPLIIDAGLGLPSQAAQVMEWGFDGVLLNTAVSRSGDPVNMARAFALAVESGRLAFEAGPVEARDKAQASTPTVGQPFWHSAEY

SEQ ID NO: 469 - DNA, 789 bp, Neisseria gonorrhoeae
atgctcaccctgtacggcgaaactttcccttcgcggctgctgctcggcacggccgcctacccgacccctgaaatcctcaaacaatccgtccgaaccgcccggcccgcgatgattaccgtctcgctgcgccgcacgggatgcggcggcgaggcgcacggtcaggggttttggtcgctgcttcaagaaaccggcgttcccgtcctgccgaacacggcaggctgccaaagcgtgcaggaagcggtaacgacggcgcaaatggcgcgcgaagtgtttgaaaccgattggataaaattggaactcatcggcgacgacgacaccttgcagccggacgtgttccaactcgtcgaagcggcggaaatcctgattaaagacggcttcaaagtgctgccttattgcaccgaagacctgattgcctgccgccgcctgctcgatgcgggctgtcaggcgttgatgccgtgggcggctcccatcggcacgggtttgggggcggttcacgcctatgcgctcaaaatcctgcgcgaacgcctgcccgacacgccgctgattatcgacgcgggcttgggtttgccttcccaagcggcacaagtgatggaatggggttttgacggcgtattgttaaacaccgccgtttcccgcagcggcgaccccgtcaacatggcgcgcgccttcgcactcgccgtcgaatccggacggctggcatttgaagccgggccggtcgaagcgcgaaccaaagcccaagccagcacgccgacagtcggacaaccgttttggcattcggcggaatattga

SEQ ID NO: 470 - protein, 262 aa, Neisseria gonorrhoeae
MLTLYGETFPSRLLLGTAAYPTPEILKQSVRTARPAMITVSLRRTGCGGEAHGQGFWSLLQETGVPVLPNTAGCQSVQEAVTTAQMAREVFETDWIKLELIGDDDTLQPDVFQLVEAAEILIKDGFKVLPYCTEDLIACRRLLDAGCQALMPWAAPIGTGLGAVHAYALKILRERLPDTPLIIDAGLGLPSQAAQVMEWGFDGVLLNTAVSRSGDPVNMARAFALAVESGRLAFEAGPVEARTKAQASTPTVGQPFWHSAEY

SEQ ID NO: 471 - DNA, 789 bp, Neisseria meningitidis
atgctcaccctatacggcgaaactttcccctcgcggctgctgctcggcacggctgcctacccgacccccgaaatcctcaaacaatccatccaaaccgcccagcctgcgatgattaccgtctcgctgcgccgcgcgggaagcggcggcgaggcgcacggtcaggggttttggtcgctgcttcaagaaaccggcgttcccgtcctgccgaacacggcaggctgccaaagcgtgcaggaagcggtaacgacggcgcaaatggcgcgcgaagtgtttgaaaccgattggataaaattggaactcatcggagatgacgacaccttgcagccggatgtgttccagcttgtcgaagcggcggaaatcctgattaaagacggcttcaaagtgctgccttattgcaccgaagacctgattgcctgccgccgcctgctcgacgcgggctgtcaggcgttgatgccgtgggcggccccgatcggcacgggtttgggcgcggttcacgcctacgcgttgaacgtcctgcgcgaacgcctgcccgacacgccgctgattatcgacgcgggcttgggtttgccctcacaggcggcacaagtgatggaatggggctttgacggcgtgcttttgaatactgccgtttcccgcagcggcgatccggtcaatatggcacgcgccttcgcactcgccgtcgaatccggacggctggcatttgaagccggaccggtcgaagcacgcgacaaagcgcaagccagcacgccgacagtcggacaaccgttttggcattcggcggaatattga

SEQ ID NO: 472 - protein, 262 aa, Neisseria meningitidis
MLTLYGETFPSRLLLGTAAYPTPEILKQSIQTAQPAMITVSLRRAGSGGEAHGQGFWSLLQETGVPVLPNTAGCQSVQEAVTTAQMAREVFETDWIKLELIGDDDTLQPDVFQLVEAAEILIKDGFKVLPYCTEDLIACRRLLDAGCQALMPWAAPIGTGLGAVHAYALNVLRERLPDTPLIIDAGLGLPSQAAQVMEWGFDGVLLNTAVSRSGDPVNMARAFALAVESGRLAFEAGPVEARDKAQASTPTVGQPFWHSAEY

SEQ ID NO: 473 - DNA, 789 bp, Neisseria meningitidis
atgctcaccctgtacagcgaaactttcccttcgcggctgctgctcggcacagccgcctacccgacccctgaaatcctcaaacaatccgtccgaaccgcccggcccgcgatgattaccgtctcgctgcgccgcgcgggatgcggcggcgaggcgcacggtcaggggttttggtcgctgcttcaagaaaccggcgttcccgtcctgccgaacacggcaggctgccaaagcgtgcaggaagcggtaacgacggcgcaaatggcgcgcgaagtgtttgaaaccgattggattaaactcgaactcatcggcgacgacgacaccttgcagccggatgtgttccaacttgtcgaagcggcggaaatcctgattaaagacggcttcaaagtgctgccttattgcaccgaagacctgattgcctgccgccgcctgctcgacgcgggctgtcaggcgttgatgccgtgggcggccccgatcggcacgggtttgggcgcggttcacgcctacgcgttgaacgtcctgcgcgaacgcctgcccgacacgccgctgattatcgacgcgggcttgggtttgccctcacaggcggcacaagtgatggaatggggctttgacggcgtgcttttgaatactgccgtttcccgcagcggcgatccggtcaatatggcacgcgccttcgcactcgccgtcgaatccggacggctggcatttgaagccggaccggtcgaagcacgcgacaaagcgcaagccagcacgccgacagtcggacaaccgttttggcattcggcggaatattga

SEQ ID NO: 474 - protein, 262 aa, Neisseria meningitidis
MLTLYSETFPSRLLLGTAAYPTPEILKQSVRTARPAMITVSLRRAGCGGEAHGQGFWSLLQETGVPVLPNTAGCQSVQEAVTTAQMAREVFETDWIKLELIGDDDTLQPDVFQLVEAAEILIKDGFKVLPYCTEDLIACRRLLDAGCQALMPWAAPIGTGLGAVHAYALNVLRERLPDTPLIIDAGLGLPSQAAQVMEWGFDGVLLNTAVSRSGDPVNMARAFALAVESGRLAFEAGPVEARDKAQASTPTVGQPFWHSAEY

SEQ ID NO: 475 - DNA, 873 bp, Neisseria gonorrhoeae
atggaaatatggaatatgttgaacacttggcccgatgccgtcccgatacgcgcggaggcggccgaatccgtggcggcggtcgcggctttgctgctggcgcgcgcccttctgttgaatatccacttcagacggcatccggatttcggcatcgaaagcaagcggcggtttttggttgccagccgcaatataacgctgcttttggtgctgttttcgctggcatttatctggtcggcgcaaattcaaacgctggctttgtcgatgtttgcggtggcggcggcggtcgtcgtggcgacaaaagaactgattatgtgtctgtcgggcagtattttaaggtctgccacccagcaatactcggtcggcgactatatcgaaatcaacggcctgcgcgggcgcgtggtcgacatcaatctgttgaacacgctgatgatgcaggtcggtccgaaccccttggtcggacagcttgcgggaaccaccgtttctttccccaacagcctgttgttgagccaccccgtgcgccgcgacaatattttgggcgactatgtcatccatacggtcgaaatccccgttcccatccatttggattcggatgaagccgtatgccgtctgaaagccgtactcgagcccttgtgcgcgccctacatccccgccattcagcggtatttggaaaacgtgcaggcggaaaaactgtttatcacgcccgccgccaggccgcgcgttacccgcgtaccgtacgacgacaaggcataccgcatcatcgtccgcttcgcctcccccgtttcaaagcggctggaaatccaacaggcggttatggacgaatttttgcgcgtacaataccgcctgttaaatcatcccgccggctccgaaacactttaa

SEQ ID NO: 476 - protein, 290 aa, Neisseria gonorrhoeae
MEIWNMLNTWPDAVPIRAEAAESVAAVAALLLARALLLNIHFRRHPDFGIESKRRFLVASRNITLLLVLFSLAFIWSAQIQTLALSMFAVAAAVVVATKELIMCLSGSILRSATQQYSVGDYIEINGLRGRVVDINLLNTLMMQVGPNPLVGQLAGTTVSFPNSLLLSHPVRRDNILGDYVIHTVEIPVPIHLDSDEAVCRLKAVLEPLCAPYIPAIQRYLENVQAEKLFITPAARPRVTRVPYDDKAYRIIVRFASPVSKRLEIQQAVMDEFLRVQYRLLNHPAGSETL

SEQ ID NO: 477 - DNA, 873 bp, Neisseria meningitidis
atggaaatatggaatatgttggacacttggctcggtgccgtcccgatacgtgcggaggcggtcgaatccgtggcggcggttgcggctttgctgctggcgcgcgcccttctgttgaatatccacttcaaacggcatccggatttcggcatcgaaagcaagcggcggtttttggttgccagccgcaatataacgctgcttttggtgctgttttcgctggcatttatctggtcggcgcaaatccaaacgctggctttgtcgatgtttgcggtggcggcggcggtcgtcgtggcgacgaaggaactgattatgtgtctgtcgggcagtattttaaggtctgccacccagcaatactcggtcggcgactatatcgaaatcaacggcctgcgcgggcgcgtggtcgacatcaacctgttgaacacgctgatgatgcaggtcggtccgaaccccttggtcggacagcttgcgggaaccaccgtttctttccccaacagcctgttgttgagccaccccgtgcgccgcgacaatattttgggcgactatgtcatccatacggtcgaaatccccgttcccatccatttggattcggatgaagccgtatgccgtctgaaagccgtactcgagcccttgtgcgcgccctacatccccgccatccaacggsatttggaaaacgtgcaggcggaaaaactgtttatcacgcccgccgccagaccgcgcgttacccgcgtgccgtacgatgacaaggcataccgcatcatcgtccgcttcgcttcccccgtttcaaagcggctggaaatccaacaggcggttatggacgaatttttgcgcgtacaataccgcctgttaaatcaccccgccggctccgaaacactttaa

SEQ ID NO: 478 - protein, 290 aa, Neisseria meningitidis
  misc_feature (220)..(220): Xaa can be any naturally occurring amino acid
MEIWNMLDTWLGAVPIRAEAVESVAAVAALLLARALLLNIHFKRHPDFGIESKRRFLVASRNITLLLVLFSLAFIWSAQIQTLALSMFAVAAAVVVATKELIMCLSGSILRSATQQYSVGDYIEINGLRGRVVDINLLNTLMMQVGPNPLVGQLAGTTVSFPNSLLLSHPVRRDNILGDYVIHTVEIPVPIHLDSDEAVCRLKAVLEPLCAPYIPAIQRXLENVQAEKLFITPAARPRVTRVPYDDKAYRIIVRFASPVSKRLEIQQAVMDEFLRVQYRLLNHPAGSETL

SEQ ID NO: 479 - DNA, 873 bp, Neisseria meningitidis
atggaaatatggaatatgttggacacttggctcggtgccgtcccgatacgtgcggaggcggtcgaatccgtggcggtggtcgcggctttgctgctggcgcgcgcccttctgttgaatatccacttcaaacggcatccggatttcggcatcgaaagcaagcggcggtttttggttgccagccgcaatataacgctgcttttggtgctgttttcgctggcatttatctggtcggcgcaaatccaaacgctggctttgtcgatgtttgcggtggcggcggcggtcgtcgtggcgacgaaggaactgattatgtgtctgtcgggcagcattttaaggtctgccacccagcaatactcggtcggcgactatatcgaaatcaacggcctgcgcgggcgcgtggtcgacatcaacctgttgaacacgctgatgatgcaggtcggtccgaaccccttggtcggacagcttgcgggaaccaccgtttctttccccaacagcctgttgttgagccaccccgtgcgccgcgacaatattttgggcgactacgtcatccatacggtcgaaatcccggttcccatccatttggattcggatgaagccgtatgccgtctgaaagccgtactcgagcccttgtgcgcgccctacatccccgccatccaacggcatttggaaaacgtgcaggcggaaaaactgtttatcacgcccgccgccaaaccgcgcgttacccgcgtgccgtacgatgacaaggcataccgcatcatcgtccgcttcgcctcccccgtttcaaagcggctggaaatccaacaggcggttatggacgaatttttgcgcgtacaataccgcctgttaaattaccccgccggctccgaaacactttaa

SEQ ID NO: 480 - protein, 290 aa, Neisseria meningitidis
MEIWNMLDTWLGAVPIRAEAVESVAVVAALLLARALLLNIHFKRHPDFGIESKRRFLVASRNITLLLVLFSLAFIWSAQIQTLALSMFAVAAAVVVATKELIMCLSGSILRSATQQYSVGDYIEINGLRGRVVDINLLNTLMMQVGPNPLVGQLAGTTVSFPNSLLLSHPVRRDNILGDYVIHTVEIPVPIHLDSDEAVCRLKAVLEPLCAPYIPAIQRHLENVQAEKLFITPAAKPRVTRVPYDDKAYRIIVRFASPVSKRLEIQQAVMDEFLRVQYRLLNYPAGSETL

SEQ ID NO: 481 - DNA, 2037 bp, Neisseria gonorrhoeae
atgattgacaacgcactgctccacttgggcgaagaaccccgttttaatcaaatccaaaccgaagacatcaaacccgccgtccaaaccgccatcgccgaagcgcgcggacaaatcgccgccgtcaaagcgcaaacgcacaccggctgggcgaacaccgtcgagcgtctgaccggcatcaccgaacgcgtcggcaggatttggggcgtcgtgtcccatctcaactccgtcgtcgacacgcccgaactgcgcgccgtctataacgaactgatgcctgaaatcaccgtcttcttcaccgaaatcggacaagacatcgaactgtacaaccgcttcaaaaccatcaaaaattcccccgaatttgcaacgctttcccccgcacaaaaaaccaagctcgatcacgacctgcgcgatttcgtattgagcggcgcggaactgccgcccgaacggcaggcagaactggcaaaactgcaaaccgaaggcgcgcaactttccgccaaattctcccaaaacgtcctagacgcgaccgacgcgttcggcatttactttgacgatgccgcaccgcttgccggcattcccgaagacgcgctcgccatgtttgccgccgccgcgcaaagcgaaggcaaaacaggttacaaaatcggcttgcagattccgcactaccttgccgttatccaatacgccggcaaccgcgaactgcgcgaacaaatctaccgcgcctacgttacccgtgccagcgaactttcaaacgacggcaaattcgacaacaccgccaacatcgaccgcacgctcgaaaacgcattgaaaaccgccaaactgctcggctttaaaaattacgccgaattgtcgctggcaaccaaaatggcggacacgcccgaacaggttttaaacttcctgcacgacctcgcccgccgcgccaaaccctacgccgaaaaagacctcgccgaagtcaaagccttcgcccgcgaacacctcggtctcgccgacccgcagccgtgggacttgagctacgccggcgaaaaactgcgcgaagccaaatacgcattcagcgaaaccgaagtcaaaaaatacttccccgtcggcaaagttctggcaggcctgttcgcccaaatcaaaaaactctacggcatcggattcgccgaaaaaaccgttcccgtctggcacaaagacgtgcgctattttgaattgcaacaaaacggcaaaaccatcggcggcgtttatatggatttgtacgcacgcgaaggcaaacgcggcggcgcgtggatgaacgactacaaaggccgccgccgctttgccgacggcacgctgcaactgcccaccgcctacctcgtctgcaacttcgccccgcccgtcggcggcaaagaagcgcgtttaagccacgacgaaatcctcaccctcttccacgaaaccggccacggactgcaccacctgcttacccaagtggacgaactgggcgtgtccggcatcaacggcgtagaatgggacgcggtcgaactgcccagccagtttatggaaaacttcgtttgggaatacaatgtattggcacaaatgtccgcccacgaagaaaccggcgagcccctgccgaaagaactcttcgacaaaatgctcgccgccaaaaacttccagcgcggtatgttcctcgtccggcaaatggagttcgccctcttcgatatgatgatttacagtgaaagcgacgaatgccgtctgaaaaactggcagcaggttttagacagcgtgcgcaaagaagtcgccgtcatccaaccgcccgaatacaaccgcttcgccaacagcttcggccacatcttcgccggcggctattccgcaggctattacagctacgcatgggccgaagtcctcagcaccgatgcctacgccgcctttgaagaaagcgacgacgtcgccgccacaggcaaacgcttctggcaagaaatccttgccgtcggcggctcccgcagcgcggcggaatccttcaaagccttccgcggacgcgaaccgagcatagacgcactgctgcgccaaagcggtttcgacaacgcggcttga

SEQ ID NO: 482 - protein, 678 aa, Neisseria gonorrhoeae
MIDNALLHLGEEPRFNQIQTEDIKPAVQTAIAEARGQIAAVKAQTHTGWANTVERLTGITERVGRIWGVVSHLNSVVDTPELRAVYNELMPEITVFFTEIGQDIELYNRFKTIKNSPEFATLSPAQKTKLDHDLRDFVLSGAELPPERQAELAKLQTEGAQLSAKFSQNVLDATDAFGIYFDDAAPLAGIPEDALAMFAAAAQSEGKTGYKIGLQIPHYLAVIQYAGNRELREQIYRAYVTRASELSNDGKFDNTANIDRTLENALKTAKLLGFKNYAELSLATKMADTPEQVLNFLHDLARRAKPYAEKDLAEVKAFAREHLGLADPQPWDLSYAGEKLREAKYAFSETEVKKYFPVGKVLAGLFAQIKKLYGIGFAEKTVPVWHKDVRYFELQQNGKTIGGVYMDLYAREGKRGGAWMNDYKGRRRFADGTLQLPTAYLVCNFAPPVGGKEARLSHDEILTLFHETGHGLHHLLTQVDELGVSGINGVEWDAVELPSQFMENFVWEYNVLAQMSAHEETGEPLPKELFDKMLAAKNFQRGMFLVRQMEFALFDMMIYSESDECRLKNWQQVLDSVRKEVAVIQPPEYNRFANSFGHIFAGGYSAGYYSYAWAEVLSTDAYAAFEESDDVAATGKRFWQEILAVGGSRSAAESFKAFRGREPSIDALLRQSGFDNAA

SEQ ID NO: 483 - DNA, 1431 bp, Neisseria meningitidis
  misc_feature (1216)..(1216): n is a, c, g, or t
  misc_feature (1334)..(1334): n is a, c, g, or t
  misc_feature (1347)..(1347): n is a, c, g, or t
atgactgacaacgcactgctccatttgggcgaagaaccccgttttgatcaaatcaaaaccgaagacatcaaacccgccctgcaaaccgccatcgccgaagcgcgcgaacaaatcgccgccatcaaagcccaaacgcacaccggctgggcaaacactgtcgaacccctgaccggcatcaccgaacgcgtcggcaggatttggggcgtggtgtcgcacctcaactgcgtcgccgacacgcccgaactgcgcgccgtctataacgaactgatgcccgaaatcaccgtcttcttcaccgaaatcggacaagacatcgagctgtacaaccgcttcaaaaccatcaaaaattcccccgaattcgacaccctctcccccgcacaaaaaaccaaactcaaccactacgccagcgaaaaactgcgcgaagccaaatacgcgttcagcgaaaccgawgtcaaaaaatayttcccygtcggcaawgtattaaacggactgttcgcccaamtcaaaaaactmtacggcatcggatttaccgaaaaaacygtccccgtctggcacaaagacgtgcgctattktgaattgcaacaaaacggcgaamccataggcggcgtttatatggatttgtacgcacgcgaaggcaaacgcggcggcgcgtggatgaacgactacaaaggccgccgccgtttttcagacggcacgctgcaaytgcccaccgcctacctcgtctgcaacttcgccccacccgtcggcggcagggaagcccgcytgagccacgacgaaatcctcatcctcttccacgaaaccggacacgggctgcaccacctgcttacccaagtggacgaactgggcgtatccggcatcaacggcgtakaatgggacgcggtcgaactgcccagccagtttatggaaaatttcgtttgggaatacaatgtcttggcacaamtgtcagcccacgaagaaaccggcgttcccytgccgaaagaactcttsgacaaawtgctcgccgccaaaaacttccaasgcggcatgttcytsgtccggcaawtggagttcgccctctttgatatgatgatttacagcgaagacgacgaaggccgtctgaaaaactggcaacaggttttagacagcgtgcgcaaaaaagtcgccgtcatccagccgcccgaatacaaccgcttcgccttgagcttcggccacatcttcgcaggcggctattccgcagctnattacagctacgcgtgggcggaagtattgagcgcggacgcatacgccgcctttgaagaaagcgacgatgtcgccgccacaggcaaacgcttttggcaggaaatcctcgccgtcggggnatcgcgcagcggngcagaatccttcaaagccttccgcggccgcgaaccgagcatagacgcactcttgcgccacagcggtttcgacaacgcggtctga

SEQ ID NO: 484 - protein, 476 aa, Neisseria meningitidis
  misc_feature (149)..(149): Xaa can be any naturally occurring amino acid
  misc_feature (158)..(158): Xaa can be any naturally occurring amino acid
  misc_feature (167)..(167): Xaa can be any naturally occurring amino acid
  misc_feature (190)..(190): Xaa can be any naturally occurring amino acid
  misc_feature (198)..(198): Xaa can be any naturally occurring amino acid
  misc_feature (289)..(289): Xaa can be any naturally occurring amino acid
  misc_feature (313)..(313): Xaa can be any naturally occurring amino acid
  misc_feature (328)..(328): Xaa can be any naturally occurring amino acid
  misc_feature (331)..(331): Xaa can be any naturally occurring amino acid
  misc_feature (339)..(339): Xaa can be any naturally occurring amino acid
  misc_feature (343)..(343): Xaa can be any naturally occurring amino acid
  misc_feature (347)..(347): Xaa can be any naturally occurring amino acid
  misc_feature (406)..(406): Xaa can be any naturally occurring amino acid
  misc_feature (445)..(445): Xaa can be any naturally occurring amino acid
MTDNALLHLGEEPRFDQIKTEDIKPALQTAIAEAREQIAAIKAQTHTGWANTVEPLTGITERVGRIWGVVSHLNCVADTPELRAVYNELMPEITVFFTEIGQDIELYNRFKTIKNSPEFDTLSPAQKTKLNHYASEKLREAKYAFSETXVKKYFPVGXVLNGLFAQXKKLYGIGFTEKTVPVWHKDVRYXELQQNGEXIGGVYMDLYAREGKRGGAWMNDYKGRRRFSDGTLQLPTAYLVCNFAPPVGGREARLSHDEILILFHETGHGLHHLLTQVDELGVSGINGVXWDAVELPSQFMENFVWEYNVLAQXSAHEETGVPLPKELXDKXLAAKNFQXGMFXVRQXEFALFDMMIYSEDDEGRLKNWQQVLDSVRKKVAVIQPPEYNRFALSFGHIFAGGYSAAXYSYAWAEVLSADAYAAFEESDDVAATGKRFWQEILAVGXSRSGAESFKAFRGREPSIDALLRHSGFDNAV

SEQ ID NO: 485 - DNA, 2037 bp, Neisseria meningitidis
atgactgacaacgcactgctccatttgggcgaagaaccccgttttgatcaaatcaaaaccgaagacatcaaacccgccctgcaaaccgccattgccgaagcgcgcgaacaaatcgccgccatcaaagcccaaacgcacaccggctgggcaaacactgtcgaacccctgaccggcatcaccgaacgcgtcggcaggatttggggcgtggtgtcgcacctcaactccgtcaccgacacgcccgaactgcgcgccgcctacaatgaattaatgcccgaaattaccgtcttcttcaccgaaatcggacaagacatcgagctgtacaaccgcttcaaaaccatcaaaaactcccccgagttcgacaccctctcccacgcgcaaaaaaccaaactcaaccacgatctgcgcgatttcgtcctcagcggcgcggaactgccgcccgaacagcaggcagaattggcaaaactgcaaaccgaaggcgcgcaactttccgccaaattctcccaaaacgtcctagacgcgaccgacgcgttcggcatttactttgacgatgccgcaccgcttgccggcattcccgaagacgcgctcgccatgtttgccgctgccgcgcaaagcgaaggcaaaacaggctacaaaatcggtttgcagattccgcactacctcgccgtcatccaatacgccgacaaccgcaaactgcgcgaacaaatctaccgcgcctacgttacccgcgccagcgagctttcagacgacggcaaattcgacaacaccgccaacatcgaccgcacgctcgaaaacgccctgcaaaccgccaaactgctcggcttcaaaaactacgccgaattgtcgctggcaaccaaaatggcggacacccccgaacaagttttaaacttcctgcacgacctcgcccgccgcgccaaaccctacgccgaaaaagacctcgccgaagtcaaagccttcgcccgcgaaagcctcggcctcgccgatttgcaaccgtgggacttgggctacgccggcgaaaaactgcgcgaagccaaatacgcattcagcgaaaccgaagtcaaaaaatacttccccgtcggcaaagtattaaacggactgttcgcccaaatcaaaaaactctacggcatcggatttaccgaaaaaaccgtccccgtctggcacaaagacgtgcgctattttgaattgcaacaaaacggcgaaaccataggcggcgtttatatggatttgtacgcacgcgaaggcaaacgcggcggcgcgtggatgaacgactacaaaggccgccgccgtttttcagacggcacgctgcaactgcccaccgcctacctcgtctgcaacttcaccccgcccgtcggcggcaaagaagcccgcttgagccatgacgaaatcctcaccctcttccacgaaaccggacacggcctgcaccacctgcttacccaagtcgacgaactgggcgtatccggcatcaacggcgtagaatgggacgcagtcgaactgcccagtcagtttatggaaaatttcgtttgggaatacaatgtcttggcgcaaatgtccgcccacgaagaaaccggcgttcccctgccgaaagaactcttcgacaaaatgctcgccgccaaaaacttccaacgcggaatgttcctcgtccgccaaatggagttcgccctctttgatatgatgatttacagcgaagacgacgaaggccgtctgaaaaactggcaacaggttttagacagcgtgcgcaaagaagtcgccgtcgtccgaccgcccgaatacaaccgcttcgccaacagcttcggccacatcttcgcaggcggctattccgcaggctattacagctacgcgtgggcggaagtattgagcgcggacgcatacgccgcctttgaagaaagcgacgatgtcgccgccacaggcaaacgcttttggcaggaaatcctcgccgtcggcggatcgcgcagcgcggcagaatccttcaaagccttccgcggacgcgaaccgagcatagacgcactcttgcgccacagcggcttcgacaacgcggcttga

SEQ ID NO: 486 - protein, 678 aa, Neisseria meningitidis
MTDNALLHLGEEPRFDQIKTEDIKPALQTAIAEAREQIAAIKAQTHTGWANTVEPLTGITERVGRIWGVVSHLNSVTDTPELRAAYNELMPEITVFFTEIGQDIELYNRFKTIKNSPEFDTLSHAQKTKLNHDLRDFVLSGAELPPEQQAELAKLQTEGAQLSAKFSQNVLDATDAFGIYFDDAAPLAGIPEDALAMFAAAAQSEGKTGYKIGLQIPHYLAVIQYADNRKLREQIYRAYVTRASELSDDGKFDNTANIDRTLENALQTAKLLGFKNYAELSLATKMADTPEQVLNFLHDLARRAKPYAEKDLAEVKAFARESLGLADLQPWDLGYAGEKLREAKYAFSETEVKKYFPVGKVLNGLFAQIKKLYGIGFTEKTVPVWHKDVRYFELQQNGETIGGVYMDLYAREGKRGGAWMNDYKGRRRFSDGTLQLPTAYLVCNFTPPVGGKEARLSHDEILTLFHETGHGLHHLLTQVDELGVSGINGVEWDAVELPSQFMENFVWEYNVLAQMSAHEETGVPLPKELFDKMLAAKNFQRGMFLVRQMEFALFDMMIYSEDDEGRLKNWQQVLDSVRKEVAVVRPPEYNRFANSFGHIFAGGYSAGYYSYAWAEVLSADAYAAFEESDDVAATGKRFWQEILAVGGSRSAAESFKAFRGREPSIDALLRHSGFDNAA

SEQ ID NO: 487 - DNA, 1473 bp, Neisseria gonorrhoeae
atgattgacaacgcactgctccacttgggcgaagaaccccgttttaatcaaatcaaaaccgaagacatcaaacccgccgtccaaaccgccatcgccgaagcgcgcggacaaatcgccgccgtcaaagcgcaaacgcacaccggctgggcgaacaccgtcgagcgtctgaccggcatcaccgaacgcgtcggcaggatttggggcgtcgtgtcccatctcaactccgtcgtcgacacgcccgaactgcgcgccgtctataacgaactgatgcctgaaatcaccgtcttcttcaccgaaatcggacaagacatcgaactgtacaaccgcttcaaaaccatcaaaaattcccccgaatttgcaacgctttcccccgcacaaaaaaccaagctcgatcacgacctgcgcgatttcgtattgagcggcgcggaactgccgcccgaacggcaggcagaactggcaaaactgcaaaccgaaggcgcgcaactttccgccaaattctcccaaaacgtcctagacgcgaccgacgcgttcggcatttactttgacgatgccgcaccgcttgccggcattcccgaagacgcgctcgccatgtttgccgccgccgcgcaaagcgaaggcaaaacaggttacaaaatcggcttgcagattccgcactaccttgccgttatccaatacgccggcaaccgcgaactgcgcgaacaaatctaccgcgcctacgttacccgtgccagcgaactttcaaacgacggcaaattcgacaacaccgccaacatcgaccgcacgctcgaaaacgcattgaaaaccgccaaactgctcggctttaaaaattacgccgaattgtcgctggcaaccaaaatggcggacacgcccgaacaggttttaaacttcctgcacgacctcgcccgccgcgccaaaccctacgccgaaaaagacctcgccgaagtcaaagccttcgcccgcgaacacctcggtctcgccgacccgcagccgtgggacttgagctacgccggcgaaaaactgcgcgaagccaaatacgcattcagcgaaaccgaagtcaaaaaatacttccccgtcggcaaagttctggcaggcctgttcgcccaaatcaaaaaactctacggcatcggattcgccgaaaaaaccgttcccgtctggcacaaagacgtgcgctattttgaattgcaacaaaacggcaaaaccatcggcggcgtttatatggatttgtacgcacgcgaaggcaaacgcggcggcgcgtggatgaacgactacaaaggccgccgccgctttgccgacggcacgctgcaactgcccaccgcctacctcgtctgcaacttcgccccgcccgtcggcggcaaagaagcgcgtttaagccacgacgaaatcctcaccctcttccacgaaaccggccacggactgcaccacctgcttacccaagtggacgaactgggcgtgtccggcatcaacggcgtaaaa

SEQ ID NO: 488 - protein, 491 aa, Neisseria gonorrhoeae
MIDNALLHLGEEPRFNQIKTEDIKPAVQTAIAEARGQIAAVKAQTHTGWANTVERLTGITERVGRIWGVVSHLNSVVDTPELRAVYNELMPEITVFFTEIGQDIELYNRFKTIKNSPEFATLSPAQKTKLDHDLRDFVLSGAELPPERQAELAKLQTEGAQLSAKFSQNVLDATDAFGIYFDDAAPLAGIPEDALAMFAAAAQSEGKTGYKIGLQIPHYLAVIQYAGNRELREQIYRAYVTRASELSNDGKFDNTANIDRTLENALKTAKLLGFKNYAELSLATKMADTPEQVLNFLHDLARRAKPYAEKDLAEVKAFAREHLGLADPQPWDLSYAGEKLREAKYAFSETEVKKYFPVGKVLAGLFAQIKKLYGIGFAEKTVPVWHKDVRYFELQQNGKTIGGVYMDLYAREGKRGGAWMNDYKGRRRFADGTLQLPTAYLVCNFAPPVGGKEARLSHDEILTLFHETGHGLHHLLTQVDELGVSGINGVK

SEQ ID NO: 489 - DNA, 2037 bp, Neisseria meningitidis
atgactgacaacgcactgctccatttgggcgaagaaccccgttttgatcaaatcaaaaccgaagacatcaaacccgccctgcaaaccgccatcgccgaagcgcgcgaacaaatcgccgccatcaaagcccaaacgcacaccggctgggcaaacactgtcgaacccctgaccggcatcaccgaacgcgtcggcaggatttggggcgtggtgtcgcacctcaactccgtcgccgacacgcccgaactgcgcgccgtctataacgaactgatgcccgaaatcaccgtcttcttcaccgaaatcggacaagacatcgagctgtacaaccgcttcaaaaccatcaaaaattcccccgaattcgacaccctctcccccgcacaaaaaaccaaactcaaccacgatctgcgcgatttcgtcctcagcggcgcggaactgccgcccgaacagcaggcagaactggcaaaactgcaaaccgaaggcgcgcaactttccgccaaattctcccaaaacgtcctagacgcgaccgacgcgttcggcatttactttgacgatgccgcaccgcttgccggcattcccgaagacgcgctcgccatgtttgccgccgccgcgcaaagcgaaagcaaaacaggctacaaaatcggcttgcagattccacactacctcgccgtcatccaatacgccgacaaccgcgaactgcgcgaacaaatctaccgcgcctacgttacccgcgccagcgaactttcagacgacggcaaattcgacaacaccgccaacatcgaccgcacgctcgcaaacgccctgcaaaccgccaaactgctcggcttcaaaaactacgccgaattgtcgctggcaaccaaaatggcggacacgcccgaacaagttttaaacttcctgcacgacctcgcccgccgcgccaaaccctacgccgaaaaagacctcgccgaagtcaaagccttcgcccgcgaaagcctgaacctcgccgatttgcaaccgtgggacttgggctacgccagcgaaaaactgcgcgaagccaaatacgcgttcagcgaaaccgaagtcaaaaaatacttccccgtcggcaaagtattaaacggactgttcgcccaaatcaaaaaactctacggcatcggatttaccgaaaaaaccgtccccgtctggcacaaagacgtgcgctattttgaattgcaacaaaacggcgaaaccataggcggcgtttatatggatttgtacgcacgcgaaggcaaacgcggcggcgcgtggatgaacgactacaaaggccgccgccgtttttcagacggcacgctgcaactgcccaccgcctacctcgtctgcaacttcgccccacccgtcggcggcagggaagcccgcctgagccacgacgaaatcctcatcctcttccacgaaaccggacacgggctgcaccacctgcttacccaagtggacgaactgggcgtatccggcatcaacggcgtagaatgggacgcggtcgaactgcccagccagtttatggaaaatttcgtttgggaatacaatgtcttggcacaaatgtcagcccacgaagaaaccggcgttcccctgccgaaagaactcttcgacaaaatgctcgccgccaaaaacttccaacgcggcatgttcctcgtccggcaaatggagttcgccctctttgatatgatgatttacagcgaagacgacgaaggccgtctgaaaaactggcaacaggttttagacagcgtgcgcaaaaaagtcgccgtcatccagccgcccgaatacaaccgcttcgccttgagcttcggccacatcttcgcaggcggctattccgcaggctattacagctacgcgtgggcggaagtattgagcgcggacgcatacgccgcctttgaagaaagcgacgatgtcgccgccacaggcaaacgcttttggcaggaaatcctcgccgtcggcggatcgcgcagcgcggcagaatccttcaaagccttccgcggccgcgaaccgagcatagacgcactcttgcgccacagcggtttcgacaacgcggtctga

SEQ ID NO: 490 - protein, 678 aa, Neisseria meningitidis
MTDNALLHLGEEPRFDQIKTEDIKPALQTAIAEAREQIAAIKAQTHTGWANTVEPLTGITERVGRIWGVVSHLNSVADTPELRAVYNELMPEITVFFTEIGQDIELYNRFKTIKNSPEFDTLSPAQKTKLNHDLRDFVLSGAELPPEQQAELAKLQTEGAQLSAKFSQNVLDATDAFGIYFDDAAPLAGIPEDALAMFAAAAQSESKTGYKIGLQIPHYLAVIQYADNRELREQIYRAYVTRASELSDDGKFDNTANIDRTLANALQTAKLLGFKNYAELSLATKMADTPEQVLNFLHDLARRAKPYAEKDLAEVKAFARESLNLADLQPWDLGYASEKLREAKYAFSETEVKKYFPVGKVLNGLFAQIKKLYGIGFTEKTVPVWHKDVRYFELQQNGETIGGVYMDLYAREGKRGGAWMNDYKGRRRFSDGTLQLPTAYLVCNFAPPVGGREARLSHDEILILFHETGHGLHHLLTQVDELGVSGINGVEWDAVELPSQFMENFVWEYNVLAQMSAHEETGVPLPKELFDKMLAAKNFQRGMFLVRQMEFALFDMMIYSEDDEGRLKNWQQVLDSVRKKVAVIQPPEYNRFALSFGHIFAGGYSAGYYSYAWAEVLSADAYAAFEESDDVAATGKRFWQEILAVGGSRSAAESFKAFRGREPSIDALLRHSGFDNAV

SEQ ID NO: 491 - DNA, 2037 bp, Neisseria meningitidis; identical to SEQ ID NO: 485

SEQ ID NO: 492 - protein, 678 aa, Neisseria meningitidis; identical to SEQ ID NO: 486

SEQ ID NO: 493 - DNA, 507 bp, Neisseria gonorrhoeae
atgctttcacctcctcggcgtaaaacggcggcacatcaatcaagccgtctttcatttgcgtgcggaaaaaatgcggcgtgttgccgtgatcaaaatcaatatcgtgcagcatccagcccaaatcgcggtttgcctcgctttccgataacgccgacggcggcagcggttcacccttatccgcgctttcgccatttgccctttcaggctgcgggcataggggcggaacaggcggcggtcgaatcctgtttcatccggacaaacgcgttggcagtcggaaaatccggccggccgtgtcaaataatgcgttactttggccgggtcttgtcctttgtaagcggcggtctttttttgcgcgccatccgcatctgtttgggcgcatggcaaacggcggctgccgtacaatcaaaatgtttggcgatttcatgcagacaggcatccggatgccgcccgacatatcgagccggtttttgcctatccgatttggcggcatttaggccggtaacttga

SEQ ID NO: 494 - protein, 168 aa, Neisseria gonorrhoeae
MLSPPRRKTAAHQSSRLSFACGKNAACCRDQNQYRAASSPNRGLPRFPITPTAAAVHPYPRFRHLPFQAAGIGAEQAAVESCFIRTNALAVGKSGRPCQIMRYFGRVLSFVSGGLFLRAIRICLGAWQTAAAVQSKCLAISCRQASGCRPTYRAGFCLSDLAAFRPVT

SEQ ID NO: 495 - DNA, 333 bp, Neisseria meningitidis
tatctgcgctttcactatttgccctttcaggctgcgggcatagggacggaacaggtagcggtcaaatcctgtttcatccaaataaacacgttggtagtcggaaaattcggccggctgtgtcaaataatgcgttactttggccgggtcttgttctttgtaagtggtggtctttttttgcgcgttatccccatctgtttgagtgcatagcaaatggtggctgccgtacaatcaaaatgtttggcgatttcatgcagataggcatccgggtgttgcccaacatattgagccggtttttgcctatccgatttgacggcatttagaccggtaacttga

SEQ ID NO: 496 - protein, 110 aa, Neisseria meningitidis
  misc_feature (69)..(69): Xaa can be any naturally occurring amino acid
  misc_feature (86)..(86): Xaa can be any naturally occurring amino acid
  misc_feature (95)..(95): Xaa can be any naturally occurring amino acid
YLRFHYLPFQAAGIGTEQVAVKSCFIQINTLVVGKFGRLCQIMRYFGRVLFFVSGGLFLRVIPICLSAXQMVAAVQSKCLAISCRXASGCCPTYXAGFCLSDLTAFRPVT

SEQ ID NO: 497 - DNA, 333 bp, Neisseria meningitidis
tatctgcgctttcactatttgccctttcaggctgcgggcatagggacggaacaggtagcggtcaaatcctgtttcatccaaataaacacgttggtagtcggaaaattcggccagctgtgtcaaataatgcgttactttggccgggtcttgttctttgtaagtggtggtctttttttgcgcgttatccccatctgtttgagtgcatagcaaatggtggctgccgtacaatcaaaatgtttggcgatttcatgcagataggcatcctggtgttgcccaacatattgagccggtttttgcctatccgatttgacggcatttagaccggtaacttga

SEQ ID NO: 498 - protein, 107 aa, Neisseria meningitidis
YLRFHYLPFQAAGIGTEQVAVKSCFIQINTLVVGKFGQLCQIMRYFGRVLFFVSGGLFLRVIPICLSAQMVAAVQSKCLAISCRASWCCPTYAGFCLSDLTAFRPVT

SEQ ID NO: 499 - DNA, 840 bp, Neisseria gonorrhoeae
atgaaacaactccgcgacaacaaagcccaaggctctgcactgtttacccttgtgagcggtatcgttattgttattgcagtcctttatttcctgattaagctggcgggcagtggatcgttcggcgatgtcgatgccactacggaagcggcaacgcagacccgcatccagcctgtcggacaattgacgatgggtgacggcatccccgtcggcgaacgccaaggcgaacagattttcggcaaaatctgtatccaatgccacgcggcggacagcaatgtgccgaacgctccgaaactggaacacaacggcgactgggcgccgcgtatcgcgcaaggcttcgataccttgttccaacacgcgctgaacggctttaacgccatgcctgccaaaggcggtgcggcagacctgaccgatcaggaactcaaacgggcgattacctacatggcgaataaaagcggcggttctttcccgaatcctgatgaggctgcgcctgccgacaatgccgcttcaggaacagcttctgctcctgccgatagtgcagctccggcagaagcgaaggcagaagacaagggtgcggcagcccctgcggtcggcgttgacggtaaaaaagtcttcgaagcaacctgtcaggtgtgccacggcggttcgattcccggtattcccggcataggcaaaaaagacgattgggcaccgcgtatcaaaaaaggcaaagaaaccttgcacaaacatgcccttgaaggctttaacgcgatgccggccaaaggcggcaatgcaggtttgagcgatgacgaagtcaaagcggctgttgactatatggcaaaccaatccggtgcaaaattctaa

SEQ ID NO: 500 - protein, 279 aa, Neisseria gonorrhoeae
MKQLRDNKAQGSALFTLVSGIVIVIAVLYFLIKLAGSGSFGDVDATTEAATQTRIQPVGQLTMGDGIPVGERQGEQIFGKICIQCHAADSNVPNAPKLEHNGDWAPRIAQGFDTLFQHALNGFNAMPAKGGAADLTDQELKRAITYMANKSGGSFPNPDEAAPADNAASGTASAPADSAAPAEAKAEDKGAAAPAVGVDGKKVFEATCQVCHGGSIPGIPGIGKKDDWAPRIKKGKETLHKHALEGFNAMPAKGGNAGLSDDEVKAAVDYMANQSGAKF

SEQ ID NO: 501 - DNA, 619 bp, Neisseria meningitidis
ggcgaacagattttcggcaaaatctgtatccaatgccacgcggcggacagcaatgtgccgaacgctccgaaactggaacacaacggcgattrggcaccgcgtatcggcaaggcttcgataccttgttccaacacgcgctgaacggctttaacgccatgcctgcaaaaggcggtgcggcagacctgaccgatcaggaacttaaacgggcgattacttacatggcgaacaaaagcggcggttctttcccgaatcctgatgaggctgcgcctgccgacaatgccgcttcaggaacagcttctgctcctgccgatagtgcagctccggcagaagcgaaggcagaagacaagggtgcggcacccctgcggtcggcgttgacggtaaaaaagtcttcgaagcaacctgtcaggtgtgccacggcggttcgattcccggtattcccggcataggcaaaaaagacgattgggcaccgcgtatcaaaaaaggcaaagaaaccttgcacaaacacgcccttgaaggctttaacgcgatgcctgccaaargcggcaatgcaggtttgagcgatgacgaagtcaaagcggctgttgactatatggcaaaccaatccggtgcaaaattctaa

SEQ ID NO: 502 - protein, 204 aa, Neisseria meningitidis
  misc_feature (31)..(31): Xaa can be any naturally occurring amino acid
  misc_feature (179)..(179): Xaa can be any naturally occurring amino acid
GEQIFGKICIQCHAADSNVPNAPKLEHNGDXAPRIQGFDTLFQHALNGFNAMPAKGGAADLTDQELKRAITYMANKSGGSFPNPDEAAPADNAASGTASAPADSAAPAEAKAEDKGAAPAVGVDGKKVFEATCQVCHGGSIPGIPGIGKKDDWAPRIKKGKETLHKHALEGFNAMPAKXGNAGLSDDEVKAAVDYMANQSGAKF

SEQ ID NO: 503 - DNA, 840 bp, Neisseria meningitidis
atgaaacaactccgcgacaacaaagcccaaggctctgcactgtttacccttgtgagcggtatcgttattgttattgcagtcctttatttcctgattaagctggcgggcagcggctcgttcggcgatgtcgatgccactacggaagcagcaacgcagacccgtatccagcctgtcggacaattgacgatgggcgacggcatccccgtcggcgaacgccaaggcgaacagattttcggcaaaatctgtatccaatgccacgcggcggacagcaatgtgccgaacgctccgaaactggaacacaacggcgattgggcgccgcgtatcgcgcaaggcttcgataccttgttccaacacgcgctgaacggctttaacgccatgcctgccaaaggcggtgcggtagacctgaccgatcaggaactcaaacgggcgattacttacatggcgaacaaaagcggcggttctttcccgaatcctgatgaggctgcgcctgccgacaatgccgcttcaggaacagcttctgctcctgccgatagtgcagctccggcagaagcgaaggcagaagacaagggtgcggcagcccctgcggtcggcgttgacggtaaaaaagtcttcgaagcaacctgtcaggtgtgccacggcggttcgattcccggtattcccggcataggcaaaaaagacgattgggcaccgcgtatcaaaaaaggcaaagaaaccttgcacaaacacgcccttgaaggctttaacgcgatgcctgccaaaggcggcaatgcaggtttgagcgatgacgaagtcaaagcggctgttgactatatggcaaaccaatccggtgcaaaattctaa

SEQ ID NO: 504 - protein, 279 aa, Neisseria meningitidis
MKQLRDNKAQGSALFTLVSGIVIVIAVLYFLIKLAGSGSFGDVDATTEAATQTRIQPVGQLTMGDGIPVGERQGEQIFGKICIQCHAADSNVPNAPKLEHNGDWAPRIAQGFDTLFQHALNGFNAMPAKGGAVDLTDQELKRAITYMANKSGGSFPNPDEAAPADNAASGTASAPADSAAPAEAKAEDKGAAAPAVGVDGKKVFEATCQVCHGGSIPGIPGIGKKDDWAPRIKKGKETLHKHALEGFNAMPAKGGNAGLSDDEVKAAVDYMANQSGAKF

SEQ ID NO: 505 - DNA, 378 bp, Neisseria gonorrhoeae
atggaagccttcaaaaccctaatttggattattaatattatttccgctttggccgtcatcgtgttagtattgctccaacacggcaaaggcgcggatgccggcgcgaccttcggatcgggaagcggcagcgcgcaaggcgtattcggctctgccggcaacgccaacttcctcagccgctcgaccgccgttgcagcaacatttttctttgcaacctgcatgggctatggtgtatattcacacccacacgacaaaacacggtttggacttcagcaacatacgacagactcagcaagcacccaaacccgtaagcaataccgaaccttctgcccctgttcctcagcagcagaaataacagtttttcaaatgccgacatggtga

SEQ ID NO: 506 - protein, 125 aa, Neisseria gonorrhoeae
MEAFKTLIWIINIISALAVIVLVLLQHGKGADAGATFGSGSGSAQGVFGSAGNANFLSRSTAVAATFFFATCMGYGVYSHPHDKTRFGLQQHTTDSASTQTRKQYRTFCPCSSAAEITVFQMPTW

SEQ ID NO: 507 - DNA, 114 bp, Neisseria meningitidis
atggaacccttcaaaaccttaatttggattgttaatttaatttccgctttggccgtcttcgtgttagtattgctccaacacggcaaaggcgcggatgccggcgcgactttcgga

SEQ ID NO: 508 - protein, 38 aa, Neisseria meningitidis
MEPFKTLIWIVNLISALAVFVLVLLQHGKGADAGATFG

SEQ ID NO: 509 - DNA, 378 bp, Neisseria meningitidis
atggaagccttcaaaaccctaatttggattgttaatataatttccgctttggccgtcatcgtgttagtattgctccaacacggcaaaggcgcggatgccggcgcgactttcggatcgggaagcggcagcgcgcaaggcgtattcggctctgccggcaacgctaacttcctcagccgctcgaccgccgttgcagcaacatttttctttgcaacctgcatgggctatggtgtatattcacacccacacgacaaaacacggtttggacttcagcaacgtacaacaaactcagcaagcacccaaacccgtaagcaataccgaaccttctgcccctgttcctcagcagcagaaataacagtttttcaaatgccgacatggtga

SEQ ID NO: 510 - protein, 125 aa, Neisseria meningitidis
MEAFKTLIWIVNIISALAVIVLVLLQHGKGADAGATFGSGSGSAQGVFGSAGNANFLSRSTAVAATFFFATCMGYGVYSHPHDKTRFGLQQRTTNSASTQTRKQYRTFCPCSSAAEITVFQMPTW

SEQ ID NO: 511 - DNA, 1596 bp, Neisseria gonorrhoeae
atgtcccaagaaatcctcgaccaagtgcgccgccgccgcacgtttgccatcatctcccaccccgatgcgggtaaaaccacgctgaccgaaaaactgctgctgttttcgggcgcgattcaaagcgcaggcacggtgaaaggtaagaaaaccggcaaattcgccacctccgactggatggacatcgagaagcagcgcggcatttccgtggcatcaagcgtgatgcagttcgactacaaagaccacaccgtcaacctcttggacacgccgggacaccaagacttctccgaagacacctaccgcgttttaaccgcagtggacagcgccttgatggtcatcgacgcggcaaaaggcgtggaagcgcaaaccatcaaactcttgaacgtctgccgcctgcgcgatacgccgattgttaccttcatgaacaaatacgaccgcgaagtgcgcgattctttggaactcttggacgaagtggaagacatcctgcaaatccgctgcgcgcccgttacctggccgatcggtatgggcaaaaacttcaagggcgtgtaccacatcctgaacgacgaaatctatctctttgaagcgggcggcgaacgcctgccgcacgagttcgacatcatcaaaggcataaacaatcccgaattggaacaacgctttccgttggaaatccagcagttgcgcgacgaaatcgaattggtgcaggcggcttccaacgaatttaatctcgacgaatttctcgccggcgaactcacgccagtgttcttcggctctgcgattaacaacttcggcattcaggaaatcctcaattcattgattgactgggcacccgcaccgaaaccgcgcgacgcgaccatgcgcatggtcgggccggacgagccgaaattttccggatttatctttaaaatccaagccaatatggacccgaaacaccgcgaccgtatcgccttcttgcgcgtctgctccggtaaattcgagcgcggcatgaagatgaaacacctgcgtatcaaccgcgaaatcgccgcctccagcgtagtaaccttcatgtcgcacgaccgcgaactggcggaagaagcctacgccggcgacatcatcggcatcccgaaccacggcaacatccaaatcggcgacagcttctccgaaggcgaacaactggcgtttaccggcatcccattcttcgcgcccgaactgttccgcagcgtccgcatcaaaaacccgctgaaaatcaaacaactgcaaaaaggtttgcaacaactcggcgaagaaggtgcggttcaagtattcaaaccgatgagcggcgcggatttgattttgggtgcggtcggcgtgttgcagtttgaagtcgtaacctcacgcctcgccaacgaatacggcgtggaagccgtgttcgacagcgcatccatctggtcggcgcgctgggtatcgtgcgacgacaagaaaaaactggcggaatttgaaaaagccaacgcaggcaacctcgccatcgacgcaggcggcaacctcgcctacctcgcccccaaccgcgtgaatttggggttgacgcaagaacgctggccggacatcgtgttccacgaaacgcgcgaacattcggtcaaactctaa

SEQ ID NO: 512 - protein, 531 aa, Neisseria gonorrhoeae
MSQEILDQVRRRRTFAIISHPDAGKTTLTEKLLLFSGAIQSAGTVKGKKTGKFATSDWMDIEKQRGISVASSVMQFDYKDHTVNLLDTPGHQDFSEDTYRVLTAVDSALMVIDAAKGVEAQTIKLLNVCRLRDTPIVTFMNKYDREVRDSLELLDEVEDILQIRCAPVTWPIGMGKNFKGVYHILNDEIYLFEAGGERLPHEFDIIKGINNPELEQRFPLEIQQLRDEIELVQAASNEFNLDEFLAGELTPVFFGSAINNFGIQEILNSLIDWAPAPKPRDATMRMVGPDEPKFSGFIFKIQANMDPKHRDRIAFLRVCSGKFERGMKMKHLRINREIAASSVVTFMSHDRELAEEAYAGDIIGIPNHGNIQIGDSFSEGEQLAFTGIPFFAPELFRSVRIKNPLKIKQLQKGLQQLGEEGAVQVFKPMSGADLILGAVGVLQFEVVTSRLANEYGVEAVFDSASIWSARWVSCDDKKKLAEFEKANAGNLAIDAGGNLAYLAPNRVNLGLTQERWPDIVFHETREHSVKL

SEQ ID NO: 513 - DNA, 1596 bp, Neisseria meningitidis
atgtcccaagaaatcctcgaccaagtgcgccgccgccgcacgtttgccatcatctcccaccctgacgcaggtaaaaccacgttgactgaaaaactcttgctgttttcgggcgcgattcagagcgcgggtacggtaaaaggcaagaaaaccggcaaattcgccacttccgactggatggaaatcgagaagcagcgcggcatttccgtggcatcaagtgtgatgcagttcgattacaaagaccacaccgtcaacctcttggacacgccgggacaccaagacttctccgaagacacctaccgcgttttaaccgccgtggacagcgcattaatggtcatcgacgcggcaaaaggcgtggaagcgcaaaccatcaagctcttaaacgtctgccgcctgcgcgatacaccgattgttacgtttatgaacaaatacgaccgcgaagtgcgcgattccctggaacttttggacgaagtggaaaacattttaaaaatccgctgcgcgcccgttacctggccgatcggtatgggcaaaaacttcaagggcgtgtaccacatcctgaacgatgaaatttatctctttgaagctggcggcgaacgcctgccgcacgagttcgacatcatcaaaggcatcgataatcctgaattggaacaacgctttccgttggaaatccagcagttgcgcgacgaaatcgaattggtgcaggcggcttccaacgagtttaatctcgacgaattcctcgccggcgaactcacgcccgtattcttcggctctgcgattaacaacttcggtattcaggaaatcctcaattcattgattgactgggcgcccgcgccgaaaccgcgcgacgcgaccgtacgtatggtcgagccggacgagccgaagttttccggatttatcttcaaaatccaagccaatatggacccgaaacaccgcgaccgtattgccttcttgcgcgtctgctccggcaaattcgagcgcggcatgaagatgaaacacctgcgtatcaaccgcgaaatcgccgcctccagcgtggttaccttcatgtcgcacgaccgcgagctggttgaagaagcctacgccggcgacattatcggcatcccgaaccacggcaacatccaaatcggcgacagcttctccgaaggcgaacaactggcgttcaccggcatcccattcttcgcacccgaactgttccgcagcgtacgcatcaaaaacccgctgaaaatcaaacaactgcaaaaaggcttgcaacagctcggcgaagaaggcgcggtgcaggtgttcaaaccgatgagcggcgcggatttgattttgggcgcggtcggcgtgttgcagtttgaagtcgttacctcgcgcctcgccaacgaatacggcgtagaagccgtgttcgacagcgcatccatctggtcggcgcgctgggtatcgtgcgacgacaagaaaaaactggctgaatttgaaaaagccaacgcgggcaacctcgccatcgacgcaggcggcaacctcgcctacctcgcccccaaccgcgtgaatttgggactcacgcaagaacgttggccggacatcgtgttccacgaaacacgcgaacattcggtcaaactgtaa

SEQ ID NO: 514 - protein, 531 aa, Neisseria meningitidis
MSQEILDQVRRRRTFAIISHPDAGKTTLTEKLLLFSGAIQSAGTVKGKKTGKFATSDWMEIEKQRGISVASSVMQFDYKDHTVNLLDTPGHQDFSEDTYRVLTAVDSALMVIDAAKGVEAQTIKLLNVCRLRDTPIVTFMNKYDREVRDSLELLDEVENILKIRCAPVTWPIGMGKNFKGVYHILNDEIYLFEAGGERLPHEFDIIKGIDNPELEQRFPLEIQQLRDEIELVQAASNEFNLDEFLAGELTPVFFGSAINNFGIQEILNSLIDWAPAPKPRDATVRMVEPDEPKFSGFIFKIQANMDPKHRDRIAFLRVCSGKFERGMKMKHLRINREIAASSVVTFMSHDRELVEEAYAGDIIGIPNHGNIQIGDSFSEGEQLAFTGIPFFAPELFRSVRIKNPLKIKQLQKGLQQLGEEGAVQVFKPMSGADLILGAVGVLQFEVVTSRLANEYGVEAVFDSASIWSARWVSCDDKKKLAEFEKANAGNLAIDAGGNLAYLAPNRVNLGLTQERWPDIVFHETREHSVKL

SEQ ID NO: 515 - DNA, 1596 bp, Neisseria meningitidis
atgtcccaagaaatcctcgaccaagtgcgccgccgccgcacgtttgccatcatctcccaccctgacgcaggtaaaaccacgttgactgaaaaactcttgctgttttcaggtgcgattcaaagcgcgggtacggtaaaaggcaagaaaaccggcaaattcgccacctccgactggatggacatcgagaagcagcgcggcatttccgtggcatcaagcgtgatgcagttcgactataaagaccacaccgtcaaccttttggacacgccgggacaccaagacttctccgaagacacctaccgcgttttgaccgccgtcgatagtgccttgatggtcatcgacgcggcaaaaggcgtggaagcgcaaaccatcaaactcttgaacgtctgccgcctgcgcaatacgccgattgttacgttcatgaacaaatacgaccgcgaagtgcgcgattccctggaattgctggacgaagtggaaaacatcctgcaaatccgctgcgcgcccgtaacctggccgatcggcatgggcaaaaacttcaaaggcgtgtaccacatcctgaacgacgaaatctatctctttgaagcgggcggcgaacgcttgccgcacgagttcgacatcatcaaaggcatcgataatcccgaattggaacaacgctttccgttagaaatacagcagttgcgcgacgaaatcgaattggtgcaggcggcttccaacgagttcaatctcgacgaattcctcgccggcgaactcacgcccgtattcttcggctctgcgattaacaacttcggtattcaggaaatcctcaattcattgattgaatgggcgcccgcgccgaaaccacgcgatgcgaccgtgcgtatggtcgagccggacgagccgaagttttccggatttatcttcaaaatccaagccaatatggacccgaaacaccgcgaccgtattgccttcttgcgcgtctgctccggcaaattcgagcgcggcatgaaaatgaaacacctgcgtatcaaccgcgaaatcgccgcctccagcgtggtaaccttcatgtcccacgaccgcgagctggttgaagaagcctacgccggcgacattatcggtatcccaaaccacggcaacatccaaatcggcgacagcttctccgaaggcgaacaactgacgtttaccggcatcccattcttcgcgcccgaactgttccgcagcgttcgcatcaaaaacccgctgaaaatcaagcaactgcaaaaaggtttgcaacagcttggcgaagaaggtgcggtgcaggtgttcaaaccaatgagcggcgcggatttgattttgggcgcggtcggcgtgttgcagtttgaagtcgttacctcgcgccttgccaacgaatacggcgtggaagccgtgttcgacaacgcatccatctggtcggcgcgctgggtatcgtgcgacgacaagaaaaaactggcggaatttgaaaaagccaacgcgggcaacctcgccatcgacgcgggcggcaacctcgcctacctcgcccctaaccgcgtgaatctgggactcacgcaagaacgctggccggacatcgtgttccacgaaacgcgcgagcattcggtcaaactttaa

SEQ ID NO: 516 - protein, 531 aa, Neisseria meningitidis
MSQEILDQVRRRRTFAIISHPDAGKTTLTEKLLLFSGAIQSAGTVKGKKTGKFATSDWMDIEKQRGISVASSVMQFDYKDHTVNLLDTPGHQDFSEDTYRVLTAVDSALMVIDAAKGVEAQTIKLLNVCRLRNTPIVTFMNKYDREVRDSLELLDEVENILQIRCAPVTWPIGMGKNFKGVYHILNDEIYLFEAGGERLPHEFDIIKGIDNPELEQRFPLEIQQLRDEIELVQAASNEFNLDEFLAGELTPVFFGSAINNFGIQEILNSLIEWAPAPKPRDATVRMVEPDEPKFSGFIFKIQANMDPKHRDRIAFLRVCSGKFERGMKMKHLRINREIAASSVVTFMSHDRELVEEAYAGDIIGIPNHGNIQIGDSFSEGEQLTFTGIPFFAPELFRSVRIKNPLKIKQLQKGLQQLGEEGAVQVFKPMSGADLILGAVGVLQFEVVTSRLANEYGVEAVFDNASIWSARWVSCDDKKKLAEFEKANAGNLAIDAGGNLAYLAPNRVNLGLTQERWPDIVFHETREHSVKL

SEQ ID NO: 517 - DNA, 888 bp, Neisseria gonorrhoeae
atgaaatacaaaagaatcgtatttaaagtcggcacatcttcgattacccgttcggacggcagcctctcgcgcggcaaaatccaaaccatcacccgccagcttgccgcattgcatcatgcgggacacgagctggtcttggtgtcttccggcgcggttgctgcagggttcggcgcgctgggtttcaaaaaacgtccggtcaaaatcgccgacaaacaggcttccgccgccgtcgggcaggggctgctgatggaagaatatacggcaaacctgtcttcagacggcatcgtgtccgcacaaatcctgctcagccgtgccgactttgccgacaaacgccgctaccaaaatgccggcggcgcactttccgtgctgctgcaacgccgcgcgattcccatcatcaatgaaaacgacacggtttcggttgaggagttgaaaatcggcgacaacgacacattgagtgcgcaagtggcggcgatgatacaggcagacctcttggtgctgctgaccgacatagacggtctttacaccggcaacccgaacagcaatcccgatgccgtacggctggacaaaatcgaacacatcaaccatgaaatcatcgaaatggcgggcggctcgggttcggcaaacggcacgggcggtatgctgaccaaaatcaaagcggcaaccatcgccgccgaatccggcgtaccggtgtatatctgttcctcactcaaacccgattcattggccgaagccgccgaacatcaggcggacggctcgtttttcgtcccccgtgccaaaggtttgcggacacagaagcaatggctggcgttctattccgaaagcgggggcagcgtttatgtggacgaaagtgcggaacacgctttgtccgaacaagggaaagcctgctga

SEQ ID NO: 518 - protein, 295 aa, Neisseria gonorrhoeae
MKYKRIVFKVGTSSITRSDGSLSRGKIQTITRQLAALHHAGHELVLVSSGAVAAGFGALGFKKRPVKIADKQASAAVGQGLLMEEYTANLSSDGIVSAQILLSRADFADKRRYQNAGGALSVLLQRRAIPIINENDTVSVEELKIGDNDTLSAQVAAMIQADLLVLLTDIDGLYTGNPNSNPDAVRLDKIEHINHEIIEMAGGSGSANGTGGMLTKIKAATIAAESGVPVYICSSLKPDSLAEAAEHQADGSFFVPRAKGLRTQKQWLAFYSESGGSVYVDESAEHALSEQGKAC

SEQ ID NO: 519 - DNA, 1110 bp, Neisseria meningitidis
atgaaatacaaaagaatcgtatttaaagtcggcacatcttcgattacccattcggacggcagtctctcgcgcggcaaaatccaaaccatcacctgccagcttgccgcattgcatcatgcgggacacgagctggtcttggtgtcttccggcgcggttgcggcagggttcggtgcgctgggtttcaaaaaacgtccggtcaaaatcgccgacaaacaggcttccgccgccgtcgggcaggggctgctgatggaagaatatacggcaaacctgtcttcagacggcatcgtgtccgcgcaaatcctgctcagccgcgccgactttgccgacaaacgccgctaccaaaatgccggcggcgcactttccgtgctgctgcaacgccgcgccgtccccatcatcaatgaaaacgatacggtttcggttgaggaattgaaaatcggcgacaacgacacattgagtgcgcaagtggcggcgatgatacaggcagacctcttggtgctgctgaccgacatagacggtctttacacgggcaacccgaacagcaatcccgatgccgtacggctggacaaaatcgaacacatcaaccatgaaatcatcgaaatggcgggcggctcgggttcggcaaacggcacgggcggtatgctgaccaaaatcaaagcggcaaccatcgccgccgaatccggcgtaccggtgtatatctgttcctcgctcaaacccgatgcacttgccgaagctgccgaacatcaggcggacggctcgtttttcgtcccccgtgccaaaggtttgcggacgcagaagcaatggctggcgttctattccgaaagccggggcagcgtttatgtggacgaaggtgcggaacacgctttgtccgaacaggggaaaagcctgctgatgtcgggcattgccggaatcgaagggcatttttcccgtatggacaccgtaaccgtgtacagcaaggcaaccaaacagcccctgggcaaagggcgcgtcctgttcggctctgccgccgccgaagacctgctcaaatcgcgtaaggcgaaaggcgtgttcatccatcgggacgactggatttccatcacgcccgaaatacgcctgcttctgaccgaattttag

SEQ ID NO: 520 - protein, 369 aa, Neisseria meningitidis
MKYKRIVFKVGTSSITHSDGSLSRGKIQTITCQLAALHHAGHELVLVSSGAVAAGFGALGFKKRPVKIADKQASAAVGQGLLMEEYTANLSSDGIVSAQILLSRADFADKRRYQNAGGALSVLLQRRAVPIINENDTVSVEELKIGDNDTLSAQVAAMIQADLLVLLTDIDGLYTGNPNSNPDAVRLDKIEHINHEIIEMAGGSGSANGTGGMLTKIKAATIAAESGVPVYICSSLKPDALAEAAEHQADGSFFVPRAKGLRTQKQWLAFYSESRGSVYVDEGAEHALSEQGKSLLMSGIAGIEGHFSRMDTVTVYSKATKQPLGKGRVLFGSAAAEDLLKSRKAKGVFIHRDDWISITPEIRLLLTEF

SEQ ID NO: 521 - DNA, 1110 bp, Neisseria meningitidis
atgaaatacaaaagaatcgtatttaaagtcggcacatcttcgattacccattcggacggcagtctctcgcgcggcaaaatccaaaccatcacccgccagcttgccgcattgcatcatgcgggacacgagctggtcttggtgtcttccggcgcggttgcggcagggttcggtgcgctgggtttcaaaaaacgtccggtcaaaatcgccgacaaacaggcttccgccgccgtcgggcaggggctgctgatggaagaatatacggcaaacctgtcttcagacggcatcgtgtccgcacaaatcctgctcagccgcgccgactttgccgacaaacgccgctaccaaaatgccggcggcgcactttccgtgctgctgcaacgccgcgccgtccccatcatcaatgaaaacgatacggtttcggttgaggaattgaaaatcggcgacaacgacacattgagtgcgcaagtggcggcgatgatacaggcagacctcttggtgctgctgaccgacatagacggtctttacaccggcaacccgaacagcaatcccgatgccgtacggctggacaaaatcgaacacatcaaccatgaaatcatcgaaatggcgggcggctcgggttcggcaaacggcacaggcggtatgctgactaaaatcaaagcggcgacgattgcgaccgagtccggcgtaccggtctatatctgttcctcgctcaaacccgatgcacttgccgaagcggcagataatcaggcggacggctcgtttttcgtcccccgtgccaaaggtttgcggacgcagaagcaatggctggcgttctattccgaaagcaggggcggcgtttatgtggacgaaggtgcggaacacgctttgtccgaacagggaaaaagcctgctgatgtcgggcattgccggaatcgaagggcatttttcccgtatggacaccgtaaccgtgtacagcaaggcaaccaaacagcctttgggcaaagggcgagtcctgttcggctctgccgccgccgaagacctgctcaaattgcgtaaggcgaaaggcgtgttcatccatcgggacgactggatttccatcacgcccgaaatacgcctgcttctgaccgaattttag

SEQ ID NO: 522 - protein, 369 aa, Neisseria meningitidis
MKYKRIVFKVGTSSITHSDGSLSRGKIQTITRQLAALHHAGHELVLVSSGAVAAGFGALGFKKRPVKIADKQASAAVGQGLLMEEYTANLSSDGIVSAQILLSRADFADKRRYQNAGGALSVLLQRRAVPIINENDTVSVEELKIGDNDTLSAQVAAMIQADLLVLLTDIDGLYTGNPNSNPDAVRLDKIEHINHEIIEMAGGSGSANGTGGMLTKIKAATIATESGVPVYICSSLKPDALAEAADNQADGSFFVPRAKGLRTQKQWLAFYSESRGGVYVDEGAEHALSEQGKSLLMSGIAGIEGHFSRMDTVTVYSKATKQPLGKGRVLFGSAAAEDLLKLRKAKGVFIHRDDWISITPEIRLLLTEF

SEQ ID NO: 523 - DNA, 672 bp, Neisseria gonorrhoeae
atggaaatccggtttcagacagcatttttacgtttggttcagatgaaaacaaacgcttcaattcttaccgcaacacgccttgtatttcctgccgctgccgcacggacagggatcgttcctgccggttttttccccttccctgcggacggtttgcggtttgttgatgaccgcctgccagtagcggtagatgtctgccagcgcgtaaggcagttcggacgcaagttccgccagctcgccttcggtgaattgcaggcggataacgccgttttcctcttcgtcgtaaatgccgcccactgccatcacggggtaaaacagctcttcaaacgcttcatcatcggcggcttcaaaccaatcggtcggcacaatgtccaaaccgtaaagataggcgttgcaccaagtgtaaaaatcgctgccgccctcgccgtcgtcgtagagccacaaatcgggcagctttttatccgacatcgcggcggttgtttccatcgccattgccaaaaccagccgttcgatttcggaacgttcggcggcggtaaattgcgattcgtcgcccaacacttcgggcagccagtcgagcggtgccaatttgtccggcccgctcaacagcgccgtcataaaaccttgaacctcgtcgcaacgcatcgtgttgccttgttcgcttttggcatccaataa

SEQ ID NO: 524 - protein, 223 aa, Neisseria gonorrhoeae
MEIRFQTAFLRLVQMKTNASILTATRLVFPAAAARTGIVPAGFFPFPADGLRFVDDRLPVAVDVCQRVRQFGRKFRQLAFGELQADNAVFLFVVNAAHCHHGVKQLFKRFIIGGFKPIGRHNVQTVKIGVAPSVKIAAALAVVVEPQIGQLFIRHRGGCFHRHCQNQPFDFGTFGGGKLRFVAQHFGQPVERCQFVRPAQQRRHKTLNLVATHRVALFAFGIQ

SEQ ID NO: 525 - DNA, 732 bp, Neisseria meningitidis
atggaaacaaacgcttcaattcttaccgcaacacgccttgtattttctgccgctgccgcacggacagggatcgttcctgcctgttttttcgccttccctgcggacggtttgcggtttgttgatgactgcctgccagtagcggtagatatccgccaatgcataaggcaactcggattccagttccgccagctcgccttctgtgaattgcagacggatagcgccgttttcctcttcgtcgtaaataccgcccaatgccatgatgggataaaacaactcttcaaacgcttcatcatcgacggcttcaaaccaatcggtcggcacaatatccaaaccgtaaagataagcattgcaccatgtgtaaaaatcgctgccgccgtcttcgttttcatacagccacaaatcgggcagttttttatccgacatcgcggcggttgtttccatcgccattgccaaaaccagccgttcgatttcggaacgttcggcggcggtaaattgcgattcgtcgcccaacacttcgggcagccagtcgagcggtgtcaatttgtccggcccgctcaacagcgccgtcataaaaccttgaacctcgtcgcaacgcatcgtgttgccttgttcgcttttggcatccaacaattcgctcaaccgccgtttggatgcttcggtaaattttcgggaatccatcattttccttttcaaatgggttttgcgccctattatcgccgcaatgccgtctga

SEQ ID NO: 526 - protein, 243 aa, Neisseria meningitidis
METNASILTATRLVFSAAAARTGIVPACFFAFPADGLRFVDDCLPVAVDIRQCIRQLGFQFRQLAFCELQTDSAVFLFVVNTAQCHDGIKQLFKRFIIDGFKPIGRHNIQTVKISIAPCVKIAAAVFVFIQPQIGQFFIRHRGGCFHRHCQNQPFDFGTFGGGKLRFVAQHFGQPVERCQFVRPAQQRRHKTLNLVATHRVALFAFGIQQFAQPPFGCFGKFSGIHHFPFQMGFAPYYRRNAV

SEQ ID NO: 527 - DNA, 837 bp, Neisseria meningitidis
atggaaacaaacgcttcaattcttaccgcaacacgccttgtattttctgccgctgccgcacggacagggatcgttcctgcctgttttttcgccttccctgcggacggtttgcggcttgttgatgaccgcctgccagtagcggtagatatccgccaatgcataaggcaactcggattccagttccgccagctcgccttctgtgaattgcagacggatagtgccgttgtcctcttcgtcgtaaataccgcccaatgccatgatgggataaaacaactcttcaaacgcttcatcatcgacggcttcaaaccaatcggtcggcacaatatccaaaccgtaaagataagcattgcaccatgtgtaaaaatcgctgccgccgtcttcgttttcatacagccacaaatcgggcagttttttatccgacatcgcggcggttgtttccatcgccattgccaaaaccagccgttcgatttcggaacgttcggcggcggtaaattgcgattcgtcgcccaacacttcgggcagccagtcgagcggtgtcaatttgtccggcccgctcaacagcgccgtcataaaaccttgaacctcgtcgcaacgcatcgtgttgccttgttcgcttttggcatccaacaattcgctcaaccgccgtttggatgcttcggtaaattttcgggaatccatcattttccttttccaatgggttttgcgccctattatagtggattaaatttaaatcaggacaaggcgacgaagccgcagacagtacaaatagtacggcaaggcgaggcaacgccgtactggtttaaatttaatccactatatcgccgcaatgccgtctga

SEQ ID NO: 528 - protein, 278 aa, Neisseria meningitidis
METNASILTATRLVFSAAAARTGIVPACFFAFPADGLRLVDDRLPVAVDIRQCIRQLGFQFRQLAFCELQTDSAVVLFVVNTAQCHDGIKQLFKRFIIDGFKPIGRHNIQTVKISIAPCVKIAAAVFVFIQPQIGQFFIRHRGGCFHRHCQNQPFDFGTFGGGKLRFVAQHFGQPVERCQFVRPAQQRRHKTLNLVATHRVALFAFGIQQFAQPPFGCFGKFSGIHHFPFPMGFAPYYSGLNLNQDKATKPQTVQIVRQGEATPYWFKFNPLYRRNAV

SEQ ID NO: 529 - DNA, 852 bp, Neisseria gonorrhoeae
atgattatccatcaccaattcgatcccgtcctcatcagtatcggcccgcttgccgtccgctggtatgccttaagctacatcctcggatttattctttttacctttctcggcagaaggcgcatcgcgcaaggcttgtccgtttttaccaaagaatcgctcgacgacttcctgacatggggcattttgggcgtgattttgggcggacgcttgggctatgtcctgttttacaaattctccgactacctcgcccatccgcttgatattttcaaggtatgggaaggcggaatgtcgttccacggcggctttttgggtgtagttattgccatatggttgttcagccgcaagcacggcatcggcttcctcaaactgatggacacggtcgcgccgctcgttccgctgggtctcgcttcgggacgtatcggcaactttatcaacggcgaactttggggacgcattaccgacattaacgcattttgggcaatgggcttcccgcaagcgcattacgaagatgccgaagccgccgcgcacaatccgctttgggcagaatggctgcaacaatacggtatgctgccgcgtcatccctcgcagctttatcagtttgcccttgaaggcatctgcctgttcgccgtcgtttggctgttttccaaaaaaccgcgcccgaccgggcagactgccgcgctttttctcggcggctacggcgtgttccgctttattgccgaatttgcgcgccaacccgacgactatctcgggctgctgaccttggggctgtcgatggggcaatggttgagcgtcccgatgattgttttgggtatcgtcggctttgtccggttcggcatgaaaaaacagcactga

SEQ ID NO: 530 - protein, 283 aa, Neisseria gonorrhoeae
MIIHHQFDPVLISIGPLAVRWYALSYILGFILFTFLGRRRIAQGLSVFTKESLDDFLTWGILGVILGGRLGYVLFYKFSDYLAHPLDIFKVWEGGMSFHGGFLGVVIAIWLFSRKHGIGFLKLMDTVAPLVPLGLASGRIGNFINGELWGRITDINAFWAMGFPQAHYEDAEAAAHNPLWAEWLQQYGMLPRHPSQLYQFALEGICLFAVVWLFSKKPRPTGQTAALFLGGYGVFRFIAEFARQPDDYLGLLTLGLSMGQWLSVPMIVLGIVGFVRFGMKKQH

SEQ ID NO: 531 - DNA, 852 bp, Neisseria meningitidis
atgattacccatccccaattcgatcccgtccttatcagtatcggcccgcttgccgtccgctggtatgccctaagctacatcctcggatttattctttttacctttctcggcagaaggcgcatcgcgcaaggcttgtccgtttttaccaaagaatcgctcgacgacttcctgacatggggcattttgggcgtaattttgggcgggcgtttgggttacgtcctgttttacaagttttccgactacctcgcccatccgcttgatattttcaaggtatgggaaggcggaatgtcgttccacggcggctttttgggtgtagttattgccatacggttgttcggccgcaaacacggcatcggcttcctcaaactgatggatacggtcgcaccgctcgttccgctgggtctcgcttcgggacgtatcggcaacttcatcaacggcgaactttggggacgcgttaccgacatcaacgcattttgggcaatgggcttcccgcaggcgcgttacgaagatgccgaagccgccgcgcacaatccgctttgggcagaatggctgcaacaatacggtatgctgccgcgtcatccctcgcagctttatcagtttgcacttgaaggcatctgcctgttcaccgtcatttggctgttctctaaaaaacagcggtcgaccggacaagtcgcctcgctcttcctcggcggctacggcatattccgcttcattgccgaattcgcacgccaacccgacgactatctcgggctgctgaccttggggctgtcgatggggcaatggttgagcgtcccgatgattgttttgggtatcgtcggctttgtccggttcggcatgaaaaaacagcactga

SEQ ID NO: 532 - protein, 283 aa, Neisseria meningitidis
MITHPQFDPVLISIGPLAVRWYALSYILGFILFTFLGRRRIAQGLSVFTKESLDDFLTWGILGVILGGRLGYVLFYKFSDYLAHPLDIFKVWEGGMSFHGGFLGVVIAIRLFGRKHGIGFLKLMDTVAPLVPLGLASGRIGNFINGELWGRVTDINAFWAMGFPQARYEDAEAAAHNPLWAEWLQQYGMLPRHPSQLYQFALEGICLFTVIWLFSKKQRSTGQVASLFLGGYGIFRFIAEFARQPDDYLGLLTLGLSMGQWLSVPMIVLGIVGFVRFGMKKQH

SEQ ID NO: 533 - DNA, 852 bp, Neisseria meningitidis
atgattacccatccccaattcgaccccgtccttatcagtatcggcccgcttgccgtccgctggtatgccctaagctacatcctcggatttattctttttacctttctcggcagaaggcgcatcgcgcaaggcttgtccgtttttaccaaagaatcgctcgacgacttcctgacatggggcattttgggcgtaattttgggcgggcgtttgggttacgtcctgttttacaagttttccgactacctcgcccatccgcttgatattttcaaggtatgggaaggcggaatgtcgttccacggcggctttttgggtgtagttattgccatatggttgttcggtcgcaaacacggcatcggcttcctcaaactgatggacacggtcgcaccgctcgttccactgggtctcgcttcgggacgtatcggcaacttcatcaacggcgaactttggggacgcgttaccgacatcaacgcattttgggcaatgggcttcccgcaggcgcgttacgaagacctcgaagccgccgcgcacaatccgctttgggcagaatggctgcaacaatacggtatgctgccgcgtcatccctcgcagctttatcagtttgcacttgaaggcatctgcctgttcgccgtcgtttggctgttctctaaaaaacagcggccgaccggacaagtcgcctcactcttcctcggcggctacggcatattccgcttcattgccgaatttgcacgccaacccgacgactatctcgggctgctgaccttggggctgtcgatggggcaatggttgagcgtcccgatgattgttttgggtatcgtcggctttgtccggttcggcatgaaaaaacagcactga

SEQ ID NO: 534 - protein, 283 aa, Neisseria meningitidis
MITHPQFDPVLISIGPLAVRWYALSYILGFILFTFLGRRRIAQGLSVFTKESLDDFLTWGILGVILGGRLGYVLFYKFSDYLAHPLDIFKVWEGGMSFHGGFLGVVIAIWLFGRKHGIGFLKLMDTVAPLVPLGLASGRIGNFINGELWGRVTDINAFWAMGFPQARYEDLEAAAHNPLWAEWLQQYGMLPRHPSQLYQFALEGICLFAVVWLFSKKQRPTGQVASLFLGGYGIFRFIAEFARQPDDYLGLLTLGLSMGQWLSVPMIVLGIVGFVRFGMKKQH

SEQ ID NO: 535 - DNA, 897 bp, Neisseria gonorrhoeae
atggagtttgaaaacattatttccgccgccgacaaggcgcgtatccttgccgaagcactgccttacatccgccggttttccggttcggtcgccgtcatcaagtatggcggcaacgcgatgaccgaacctgccttgaaagaagggtttgcccgcgatgtcgtgctgctgaagctggtcggcattcatcccgtcatcgttcacggcggcgggccgcagatcaatgcgatgcttgaaaaagtcggcaaaaagggcgaatttgtccaaggaatgcgcgttaccgacaaagagacgatggatattgtcgaaatggtattgggcgggcacgtcaacaaggaaatcgtgtcgatgattaacacatatggagggcacgcggtcggcgtgagcgggcgcgacgaccatttcattaaggcgaagaaacttttggtcgatacgcccgaacagaatagcgtggacatcggacaggtcggtacggtggaaagcatcgataccggtttggttaaagggctgatagaacgcggctgcattcccgtcgtcgcccccgtcggcgtaggtgaaaaaggcgaagcgttcaacatcaacgccgatttggtggcaggcaaattggcggaagaattgaacgccgaaaaactcttgatgatgacgaatatcgccggtgtgatggacaaaacgggcaatctgctgaccaaactcacgccgaaacggattgatgggctgattgccgacggcacgctgtatggcggtatgctgccgaaaatcgcttctgcggtcgaagccgccgtcaacggtgtgaaagccacgcacatcatcgacggcaggttgcccaacgcgcttttgctggaaatctttaccgatgccggtatcgggtcgatgattttaggcagaggggaagatgcctga

SEQ ID NO: 536 - protein, 298 aa, Neisseria gonorrhoeae
MEFENIISAADKARILAEALPYIRRFSGSVAVIKYGGNAMTEPALKEGFARDVVLLKLVGIHPVIVHGGGPQINAMLEKVGKKGEFVQGMRVTDKETMDIVEMVLGGHVNKEIVSMINTYGGHAVGVSGRDDHFIKAKKLLVDTPEQNSVDIGQVGTVESIDTGLVKGLIERGCIPVVAPVGVGEKGEAFNINADLVAGKLAEELNAEKLLMMTNIAGVMDKTGNLLTKLTPKRIDGLIADGTLYGGMLPKIASAVEAAVNGVKATHIIDGRLPNALLLEIFTDAGIGSMILGRGEDA

SEQ ID NO: 537 - DNA, 897 bp, Neisseria meningitidis
atggagtctgaaaacattatttccgccgccgacaaggcgcgtatccttgccgaagcgctgccttacatccgccggttttccggttcggtcgccgtcatcaaatacggcggcaacgcgatgaccgaacctgccttgaaagaagggtttgcccgcgatgtcgtgctgctgaagctggtcggcattcatcccgtcatcgttcacggcggcgggccgcagatcaatgcgatgcttgaaaaagtcggcaaaaagggtgagtttgtccaaggaatgcgcgttaccgacaaagaggcgatggatattgtcgaaatggtgttgggcgggcatgtcaataaagaaatcgtgtcgatgattaacacatatggcggacacgcggtcggcgtaagcggacgcgacgaccatttcattaaggcgaagaaacttttgatcgatacgcccgaacagaatggcgtggacatcggacaggtcggtacggtggaaagcatcgataccggtttggttaaagggctgatagaacgtggctgcattcccgtcgtcgcccccgtcggcgtaggtgaaaaaggcgaagcgttcaacatcaacgccgatttggtagcaggcaaattggcggaagaattgaacgccgaaaaactcttgatgatgacgaatatcgccggtgtgatggacaaaacgggcaatctgctgaccaaactcacgccgaaacggattgatgaactgattgccgacggcacgctgtatggcggtatgctgccgaaaatcgcttctgcggtcgaagccgccgtcaacggtgtgaaagccacgcatatcatcgacggcaggttgcccaacgcgcttttgctggaaatctttaccgatgccggtatcggttcgatgattttgggcggtggggaagatgcctga

SEQ ID NO: 538 - protein, 298 aa, Neisseria meningitidis
MESENIISAADKARILAEALPYIRRFSGSVAVIKYGGNAMTEPALKEGFARDVVLLKLVGIHPVIVHGGGPQINAMLEKVGKKGEFVQGMRVTDKEAMDIVEMVLGGHVNKEIVSMINTYGGHAVGVSGRDDHFIKAKKLLIDTPEQNGVDIGQVGTVESIDTGLVKGLIERGCIPVVAPVGVGEKGEAFNINADLVAGKLAEELNAEKLLMMTNIAGVMDKTGNLLTKLTPKRIDELIADGTLYGGMLPKIASAVEAAVNGVKATHIIDGRLPNALLLEIFTDAGIGSMILGGGEDA

SEQ ID NO: 539 - DNA, 897 bp, Neisseria meningitidis
atggagtctgaaaacattatttccgccgccgacaaggcgcgtatccttgccgaagcgctgccttacatccgccggttttccggttcggtcgccgtcatcaaatacggcggcaacgcgatgaccgaacctgccttgaaagaagggtttgcccgcgatgtcgtgctgctgaagctggtcggcattcatcccgtcatcgttcacggcggcgggccgcagatcaatgcgatgcttgaaaaagtcggcaaaaagggtgagtttgtccaaggaatgcgcgttaccgacaaagaggcgatggatattgtcgaaatggtgttgggcgggcatgtcaataaagaaatcgtgtcgatgattaacacatatggcggacacgcggtcggcgtaagcggacgcgacgaccatttcattaaggcgaagaaacttttgatcgatacgcccgaacagaatggcgtggacatcggacaggtcggtacggtggaaagcatcgataccggtttggttaaagggctgatagaacgtggctgcattcccgtcgtcgcccccgtcggcgtaggtgaaaaaggcgaagcgttcaacatcaacgccgatttggtagcaggcaaattggcggaagaattgaacgccgaaaaactcttgatgatgacgaatatcgccggtgtgatggacaaaacgggcaatctgctgaccaaactcacgccgaaacggattgatgaactgattgccgacggcacgctgtatggcggtatgctgccgaaaatcgcttctgcggtcgaagccgccgtcaacggcgtgaaagccacgcatatcatcgacggcagggtgcccaacgcgcttttgctggaaatctttaccgatgccggtatcggttcgatgattttgggcggtggggaagatgcctga

SEQ ID NO: 540 - protein, 298 aa, Neisseria meningitidis
MESENIISAADKARILAEALPYIRRFSGSVAVIKYGGNAMTEPALKEGFARDVVLLKLVGIHPVIVHGGGPQINAMLEKVGKKGEFVQGMRVTDKEAMDIVEMVLGGHVNKEIVSMINTYGGHAVGVSGRDDHFIKAKKLLIDTPEQNGVDIGQVGTVESIDTGLVKGLIERGCIPVVAPVGVGEKGEAFNINADLVAGKLAEELNAEKLLMMTNIAGVMDKTGNLLTKLTPKRIDELIADGTLYGGMLPKIASAVEAAVNGVKATHIIDGRVPNALLLEIFTDAGIGSMILGGGEDA

SEQ ID NO: 541 - DNA, 537 bp, Neisseria gonorrhoeae
atgcgaaccacctcaaccttccctacaaaaactttcaaaccggctgccatggcgttagctgttgcaacaacactttctgcctgcttaggcggcggcggaggcggcacttctgctcccgactttaatgcaggcggcaccggtatcggcagcaacagcagggcaacgatagcggaatcagcagcagtatcttacgccggtataaaaaacgaaatgtgcaaagacagaagcatgctctgtgccggtcgggatgacgttgcggttacagacagggatgccaaaatcaaagccccccgaatctgcataccggagacttttcaaacccaaatgaccaatattaagaatatgatcaacctcaaacctgcaattgaagcaggctatacaggacgcggggtagaggtaggtatcgtcgatacaggcgaatccgtcggcagcatatcctttcccgaactgtatggcagaaaagaacacggctataacgaaaattacaaaaacaaattacaaaaactatacggcgtatatgcggaaggaagcgcctga

SEQ ID NO: 542 - protein, 178 aa, Neisseria gonorrhoeae
MRTTSTFPTKTFKPAAMALAVATTLSACLGGGGGGTSAPDFNAGGTGIGSNSRATIAESAAVSYAGIKNEMCKDRSMLCAGRDDVAVTDRDAKIKAPRICIPETFQTQMTNIKNMINLKPAIEAGYTGRGVEVGIVDTGESVGSISFPELYGRKEHGYNENYKNKLQKLYGVYAEGSA

SEQ ID NO: 543 - DNA, 528 bp, Neisseria meningitidis
atgcgaacgaccccaaccttccctacaaaaactttcaaaccgactgccatggcgttagctgttgcaacaacactttctgcctgcttaggcggcggcggaggcggcacttctgcgcccgacttcaatgcaggcggtaccggtatcggcagcaacagcagagcaacaacagcgaaatcagcagcagtatcttacgccggtatcaagaacgaaatgtgcaaagacagaagcatgctctgtgccggtcgggatgacgttgcggttacagacagggatgccaaaatcaatgcccccccccgaatctgcataccggagactttccaaacccaaatgacgcattacaagaatttgatcaacctcaaacctgcaattgaagcaggctatacaggacgcggggtagaggtaggtatcgtcgacacaggcgaatccgtcggcagcatatcctttcccgaactgtatggcagaaaagaacacggctataacgaaaattacgaaaaactatacggcgtatatgcggaaggaagcgcctga

SEQ ID NO: 544 - protein, 175 aa, Neisseria meningitidis
MRTTPTFPTKTFKPTAMALAVATTLSACLGGGGGGTSAPDFNAGGTGIGSNSRATTAKSAAVSYAGIKNEMCKDRSMLCAGRDDVAVTDRDAKINAPPRICIPETFQTQMTHYKNLINLKPAIEAGYTGRGVEVGIVDTGESVGSISFPELYGRKEHGYNENYEKLYGVYAEGSA

SEQ ID NO: 545 - DNA, 526 bp, Neisseria meningitidis
atgcgaacgaccccaaccttccctacaaaaactttcaaaccggctgccatggcgttagctgttgcaacaacactttctgcctgcttaggcggcggcggaggcggcacttctgcgcccgacttcaatgcaggcggcaccggtatcggcagcaacagcagggcaacaacagcgaaatcagcagcaatatcttacgccggtatcaagaacgaaatgtgcaaagacagaagcatgctctgtgccggtcgggatgacgttgcggttacagacagggatgccaaaatcaatgcccccccccgaatctgcataccggagactttacaaacccaaatgacgcatacaagaatttgatcaacctcaaacctgcaattgaagcaggctatacaggacgcggggtagaggtaggtatcgtcgacacaggcgaatccgtcggcagcatatcctttcccgaactgtatggcagaaaagaacacggctataacgaaaattacaaaaactatacggcgtatatgcggaaggaagcgcctga

SEQ ID NO: 546 - protein, 175 aa, Neisseria meningitidis
  misc_feature (113)..(113): Xaa can be any naturally occurring amino acid
  misc_feature (164)..(164): Xaa can be any naturally occurring amino acid
MRTTPTFPTKTFKPAAMALAVATTLSACLGGGGGGTSAPDFNAGGTGIGSNSRATTAKSAAISYAGIKNEMCKDRSMLCAGRDDVAVTDRDAKINAPPRICIPETLQTQMTHXKNLINLKPAIEAGYTGRGVEVGIVDTGESVGSISFPELYGRKEHGYNENYXKLYGVYAEGSA

SEQ ID NO: 547 - DNA, 1365 bp, Neisseria gonorrhoeae
atgtcggcacgcggcaagggggcaggctatctcaacagtaccggacgacatgttcccttcctgagtgccgccaaaatcgggcaggattattctttcttcaaaaatatcaaaaccgacggcggtctgctggcttccctcgacagcgtcgaaaaaacagcgggcagtgaaggcgacacgccgtcctattatgtccgtcgcggcaatgcggcacggactgcttcggcagcggcacattccgcgcccgccggtctgaaacacgccgtagaacagggcggcagcaatctggaaaacctgatggtcgagctggatgcctccgaatcatccgcaacacccgagacggttgaaactgcggtcgccgaccgcacagatatgccgggcatccgcctacggcgcacaactttccgcacagcggcagccgtacagcatgcgaataccgccgacggcgtacgcatcttcaacagtctcgccgctaccgtctatgccgacagtgccgccgcccatgccgatatgcagggacgccgcctgaaagccgtatcggacgggttggaccacaacggtacgggtctgcgcgtcatcgcgcaaacccaacaggacggtggaacgtgggaacagggcggtgtcgaaggcaaaatgcgcggcagtacccaaactatcggcattgccgcgaaaaccggcgaaaatacgacagcagccgccacactgggcataggacgcagcacatggagcgaaaacagtgcaaatgcaaaaaccgacagcattagtctgtttgcaggcatacggcacgatgtgggcgatatcggctatctcaaaggcctgttctcctacggacgctacaaaaacagcatcagccgcagcaccggtgcggatgaatatgcggaaggcagcgtcaacggcacgctgatgcagctgggcgcactgggtggtgtcaacgttccgtttgccgcaacgggagatttgacggttgaaggcggtctgcgccacgacctgctcaaacaggatgcattcgccgaaaaaggcagtgctttgggctggagcggcaacagcctcactgaaggcacactggtcggactcgcgggtctgaaactgtcgcaacccttgagcgataaagccgtcctgtctgcgacggcgggcgtggaacgcgacctgaacggacgcgactacgcggtaacgggcggctttaccggcgcggctgcagcaaccggcaagacgggtgcacgcaatatgccgcacacccgccgggttgccggtctgggggtggatgtcgaattcggcaacggctggaacggcttggcacgttacagctacaccggttccaaacagtacggcaaccacagcggacaaatcggcgtaggctaccggttctga

SEQ ID NO: 548 - protein, 454 aa, Neisseria gonorrhoeae
MSARGKGAGYLNSTGRHVPFLSAAKIGQDYSFFKNIKTDGGLLASLDSVEKTAGSEGDTPSYYVRRGNAARTASAAAHSAPAGLKHAVEQGGSNLENLMVELDASESSATPETVETAVADRTDMPGIRLRRTTFRTAAAVQHANTADGVRIFNSLAATVYADSAAAHADMQGRRLKAVSDGLDHNGTGLRVIAQTQQDGGTWEQGGVEGKMRGSTQTIGIAAKTGENTTAAATLGIGRSTWSENSANAKTDSISLFAGIRHDVGDIGYLKGLFSYGRYKNSISRSTGADEYAEGSVNGTLMQLGALGGVNVPFAATGDLTVEGGLRHDLLKQDAFAEKGSALGWSGNSLTEGTLVGLAGLKLSQPLSDKAVLSATAGVERDLNGRDYAVTGGFTGAAAATGKTGARNMPHTRRVAGLGVDVEFGNGWNGLARYSYTGSKQYGNHSGQIGVGYRF

SEQ ID NO: 549 - DNA, 1365 bp, Neisseria meningitidis
atgtcggcacgcggcaagggggcaggctatctcaacagtaccggacgacgtgttcccttcctgagtgccgccaaaatcgggcaggattattctttcttcacaaacatcgaaaccgacggcggcctgctggcttccctcgacagcgtcgaaaaaacagcgggcagtgaaggcgacacgctgtcctattatgtccgtcgcggcaatgcggcacggactgcttcggcagcggcacattccgcgcccgccggtctgaaacacgccgtagaacagggcggcagcaatctggaaaacctgatggtcgaactggatgcctccgaatcatccgcaacacccgagacggttgaaactgcggcagccgaccgcacagatatgccgggcatccgcccctacggcgcaactttccgcgcagcggcagccgtacagcatgcgaatgccgccgacggtgtacgcatcttcaacagtctcgccgctaccgtctatgccgacagtaccgccgcccatgccgatatgcagggacgccgcctgaaagccgtatcggacgggttggaccacaacggcacgggtctgcgcgtcatcgcgcaaacccaacaggacggtggaacgtgggaacagggcggtgttgaaggcaaaatgcgcggcagtacccaaaccgtcggcattgccgcgaaaaccggcgaaaatacgacagcagccgccacactgggcatgggacgcagcacatggagcgaaaacagtgcaaatgcaaaaaccgacagcattagtctgtttgcaggcatacggcacgatgcgggcgatatcggctatctcaaaggcctgttctcctacggacgctacaaaaacagcatcagccgcagcaccggtgcggacgaacatgcggaaggcagcgtcaacggcacgctgatgcagctgggcgcactgggcggtgtcaacgttccgtttgccgcaacgggagatttgacggtcgaaggcggtctgcgctacgacctgctcaaacaggatgcattcgccgaaaaaggcagtgctttgggctggagcggcaacagcctcactgaaggcacgctggtcggactcgcgggtctgaagctgtcgcaacccttgagcgataaagccgtcctgtttgcaacggcgggcgtggaacgcgacctgaacggacgcgactacacggtaacgggcggctttaccggcgcgactgcagcaaccggcaagacgggggcacgcaatatgccgcacacccgtctggttgccggcctgggcgcggatgtcgaattcggcaacggctggaacggcttggcacgttacagctacgccggttccaaacagtacggcaaccacagcggacgagtcggcgtaggctaccggttctga

SEQ ID NO: 550 - protein, 454 aa, Neisseria meningitidis
MSARGKGAGYLNSTGRRVPFLSAAKIGQDYSFFTNIETDGGLLASLDSVEKTAGSEGDTLSYYVRRGNAARTASAAAHSAPAGLKHAVEQGGSNLENLMVELDASESSATPETVETAAADRTDMPGIRPYGATFRAAAAVQHANAADGVRIFNSLAATVYADSTAAHADMQGRRLKAVSDGLDHNGTGLRVIAQTQQDGGTWEQGGVEGKMRGSTQTVGIAAKTGENTTAAATLGMGRSTWSENSANAKTDSISLFAGIRHDAGDIGYLKGLFSYGRYKNSISRSTGADEHAEGSVNGTLMQLGALGGVNVPFAATGDLTVEGGLRYDLLKQDAFAEKGSALGWSGNSLTEGTLVGLAGLKLSQPLSDKAVLFATAGVERDLNGRDYTVTGGFTGATAATGKTGARNMPHTRLVAGLGADVEFGNGWNGLARYSYAGSKQYGNHSGRVGVGYRF

SEQ ID NO: 551 - DNA, 1365 bp, Neisseria meningitidis
atgtcggcaggcggtaagggggcaggctatctcaaccgtaccggacaacgtgttcccttcctgagtgccgccaaaatcgggcgggattattctttcttcacaaacatcgaaaccgacggcggtctgctggcttccctcgacagcgtcgaaaaaacagcgggtagtgaaggcgacacgctgtcctattatgtccgtcgcggcaatgcggcacggactgcttcggcagcggcacattccgcgcccgccggtctgaaacacgccgtagaacagggcggcagcaatctggaaaacctgatggtcgaactggatgcctccgaatcatccgcaacacccgagacggttgaaactgcggccgccgaccgcacagatatgccgggcatccgcccctacggcgcaactttccgcgcagcggcagccgtacagcatgcgaatgccgccgacggtgtacgcatcttcaacaatctcgccgctaccgtctatgccgacagtaccgccgcccatgccgatatgcagggacgccgcctgaaagccgtatcggacgggttggaccacaacgctacgggtctgcgcgtcatcgcgcaaacccaacaggacggtggaacgtgggaacagggcggtgttgaaggcaaaatgcgcggcagtacccaaaccgtcggcattgccgcgaaaaccggcgaaaatacgacagcagccgccacactgggcatgggacacagcacatggagcgaaaacagtgcaaatgcaaaaaccgacagcattagtctgtttgcaggcatacggcacgatgcgggcgatatcggctatctcaaaggcctgttctcctacggacgctacaaaaacagcatcagccgcagcaccggtgcggacgaacatgcggaaggcagcgtcaacggcacgctgatgcagctgggcgcactgggcggtgtcaacgttccgtttgccgcaacgggagatttgacggtcgaaggcggtctgcgctacgacctgctcaaacaggatgcattcgccgaaaaaggcagtgctttgggctggagcggcaacagcatcactgaaggcacactggtcggactcgcgggtctgaagctgtcgcaacccttgagcgataaagccgtcctgtttgcaacggcgggcgtggaacgcgacctgaacggacgcgactacacggtaacgggcggctttaccggcgcgactgcagcaaccggcaagacgggggcacgcaatatgccgcacacccgcctggttgccggtctgggcgcggatgtcgaattcggcaacggctggaacggcttggcacgttacagctacgccggttccaaacagtacggcaaccacagcggacgagtcggcgtaggctaccggttctga

SEQ ID NO: 552 - protein, 454 aa, Neisseria meningitidis
MSAGGKGAGYLNRTGQRVPFLSAAKIGRDYSFFTNIETDGGLLASLDSVEKTAGSEGDTLSYYVRRGNAARTASAAAHSAPAGLKHAVEQGGSNLENLMVELDASESSATPETVETAAADRTDMPGIRPYGATFRAAAAVQHANAADGVRIFNNLAATVYADSTAAHADMQGRRLKAVSDGLDHNATGLRVIAQTQQDGGTWEQGGVEGKMRGSTQTVGIAAKTGENTTAAATLGMGHSTWSENSANAKTDSISLFAGIRHDAGDIGYLKGLFSYGRYKNSISRSTGADEHAEGSVNGTLMQLGALGGVNVPFAATGDLTVEGGLRYDLLKQDAFAEKGSALGWSGNSITEGTLVGLAGLKLSQPLSDKAVLFATAGVERDLNGRDYTVTGGFTGATAATGKTGARNMPHTRLVAGLGADVEFGNGWNGLARYSYAGSKQYGNHSGRVGVGYRF

SEQ ID NO: 553 - DNA, 1677 bp, Neisseria gonorrhoeae
atgagcttcaaaaccgatgccgaaaccgcccaatcctccaccatgcgcccgattggcgaaattgccgccaagctgggtttgaacgttgacaacattgagccttacggtcattacaaagccaaaatcaatcctgccgaagcgttcaagctgccgcaaaaacaaggcaggctgattttggttaccgccatcaacccgactccggcgggcgaaggcaaaaccaccgtaaccatcggtttggcggacgcattgcgccatatcggcaaagactctgtgattgctttgcgcgagccttctttgggtccggtgttcggcgtgaaaggcggcgcggcaggcggcggctacgcgcaagttttgccgatggaagacatcaacctgcacttcaccggcgacttccacgccatcggtgcggcgaataacctcctcgccgccatgctcgacaaccatatctaccaaggtaacgagttgaacatcgaccccaaacgcgtgctgtggcggcgcgtggtcgatatgaacgaccgccagttgcgcaacatcatcgacggtatgggcaagcctgttgacggcgtgatgcgtcccgacggcttcgacatcaccgtcgcctccgaagtgatggcggtattctgccttgccaaagacatcagcgatttgaaagagcgttttggcaatattctcgtcgcctacgccaaagacggcagccccgtttacgccaaagatttgaaggcacacggcgcgatggcggcattgctaaaagatgcgattaagcccaatttggtgcaaaccatcgaaggcactccggcctttgtacacggcggcccgttcgccaacatcgcccacggctgcaactccgttaccgcaacccgtctggcgaaacaccttgccgattacgccgtaaccgaagcaggcttcggcgcggacttgggtgcggaaaaattctgcgacatcaaatgccgccttgccggtttgaaacctgatgcggcagtcgtcgtggcgactgtccgcgccctgaaatacaacggcggcgtggaacgcgccaaccttggtgaagaaaacctcgaagccttggcaaaaggtttgcccaacctgttgaaacacatttccaacctgaaaaacgtattcggactgcccgtcgtcgttgcgctcaaccgcttcgtgtccgactccgatgccgagttggcgatgattgaaaaagcctgtgccgaacacggcgttgaagtttccctgaccgaagtgtggggcaaaggcggcgcgggcggcgcggatttggcgcgcaaagtcgtcaatgccatcgacaaccaacctaataacttcggtttcgcctacgatgtcgagttgggcatcaaagacaaaatccgtgcgattgcccaaaaagtgtacggcgcggaagatgtcgatttcagcgcggaagcgtctgccgaaatcgcctcgctggaaaaactgggcttggacaaaatgccgatctgcatggcgaaaacccaatattcattgagcgacaacgccaaactcttgggctgccccgaaggcttccgcatcgccgtacgcggtatcactgtttccgccggcgcgggcttcatcgttgcgttgtgcggcaatatgatgaaaatgccgggcctgccgaaagttccggctgccgagaaaatcgatgtggacgaacacggcgtgattcacggcttgttctga

SEQ ID NO: 554 - protein, 558 aa, Neisseria gonorrhoeae
MSFKTDAETAQSSTMRPIGEIAAKLGLNVDNIEPYGHYKAKINPAEAFKLPQKQGRLILVTAINPTPAGEGKTTVTIGLADALRHIGKDSVIALREPSLGPVFGVKGGAAGGGYAQVLPMEDINLHFTGDFHAIGAANNLLAAMLDNHIYQGNELNIDPKRVLWRRVVDMNDRQLRNIIDGMGKPVDGVMRPDGFDITVASEVMAVFCLAKDISDLKERFGNILVAYAKDGSPVYAKDLKAHGAMAALLKDAIKPNLVQTIEGTPAFVHGGPFANIAHGCNSVTATRLAKHLADYAVTEAGFGADLGAEKFCDIKCRLAGLKPDAAVVVATVRALKYNGGVERANLGEENLEALAKGLPNLLKHISNLKNVFGLPVVVALNRFVSDSDAELAMIEKACAEHGVEVSLTEVWGKGGAGGADLARKVVNAIDNQPNNFGFAYDVELGIKDKIRAIAQKVYGAEDVDFSAEASAEIASLEKLGLDKMPICMAKTQYSLSDNAKLLGCPEGFRIAVRGITVSAGAGFIVALCGNMMKMPGLPKVPAAEKIDVDEHGVIHGLF

SEQ ID NO: 555 - DNA, 1677 bp, Neisseria meningitidis
atgagcttcaaaaccgatgccgaaatcgcccaatcctccaccatgcgcccgattggcgaaattgccgccaagcttggtctgaatgccgacaacattgagccttacggtcattacaaggcgaaaatcaatcctgccgaagcgttcaaactgccgcaaaaacagggcaggctgattttggttaccgccatcaacccgactccggcgggcgaaggcaaaaccaccgtaaccatcggtttggcggacgcgttgcgccacatcggcaaagatgccgtgattgccctgcgcgaaccttctctggggccggtgttcggcgtgaaaggcggcgcggcaggcggcggctatgcccaagttttgccgatggaagacatcaacctgcacttcaccggagattttcacgccatcggtgcggcaaataatctgcttgccgcgatgctcgacaaccatatctaccaaggcaacgagttgaacatcgaccccaaacgcgtgctgtggcggcgcgtggtcgatatgaacgaccgccagttgcgcaacatcatcgacggcatgggtaaacccgttgacggcgtgatgcgtcctgacggtttcgatattaccgttgcttccgaagtgatggcggtattctgtcttgccaaagacatcagcgatttgaaagagcgtttgggcaacatccttgtcgcctacgccaaagacggcagccccgtttacgccaaagatttgaaagcgaatggcgcgatggcggcattgcttaaagatgcgattaagcccaacttggtgcaaaccatcgaaggcacgcccgccttcgtacacggcggcccgttcgccaacatcgcccacggctgcaactccgtaaccgcaacccgtctggcgaaacaccttgccgattacgccgtaaccgaagcaggcttcggcgcggacttgggcgcggaaaaattctgcgacatcaaatgccgccttgccggtttgaaacctgatgcggctgttgtcgtggcgactgtccgcgcgttgaaatataacggcggcgtggaacgcgccaacctcggcgaagaaaatttagacgctttggaaaaaggtttgcccaacctgctgaaacacatttccaacctgaaaaacgtattcggactgcccgtcgtcgttgcgctcaaccgcttcgtgtccgacgccgatgccgagttggcgatgattgaaaaagcctgtgccgaacacggcgttgaagtttccctgaccgaagtgtggggcaaaggtggtgcgggcggcgcggatttggcgcgcaaagtcgtcaacgccattgaaagtcaaaccaataacttcggtttcgcctacgatgtcgagttgggcatcaaagacaaaatccgtgcgattgcccaaaaagtgtacggcgcggaagatgttgatttcagcgcggaagcgtctgccgaaatcgcttcactggaaaaactgggcttggacaaaatgccgatctgcatggcgaaaacccaatactctttgagcgacaacgccaaactgttgggctgccccgaagacttccgcatcgccgtgcgcggcatcaccgtttccgcaggcgcaggtttcatcgtcgccctgtgcggcaacatgatgaaaatgcccggcctgcccaaagttccggctgccgagaaaatcgatgtggacgcagaaggcgtgattcacggcttgttctga

SEQ ID NO: 556 - protein, 558 aa, Neisseria meningitidis
MSFKTDAEIAQSSTMRPIGEIAAKLGLNADNIEPYGHYKAKINPAEAFKLPQKQGRLILVTAINPTPAGEGKTTVTIGLADALRHIGKDAVIALREPSLGPVFGVKGGAAGGGYAQVLPMEDINLHFTGDFHAIGAANNLLAAMLDNHIYQGNELNIDPKRVLWRRVVDMNDRQLRNIIDGMGKPVDGVMRPDGFDITVASEVMAVFCLAKDISDLKERLGNILVAYAKDGSPVYAKDLKANGAMAALLKDAIKPNLVQTIEGTPAFVHGGPFANIAHGCNSVTATRLAKHLADYAVTEAGFGADLGAEKFCDIKCRLAGLKPDAAVVVATVRALKYNGGVERANLGEENLDALEKGLPNLLKHISNLKNVFGLPVVVALNRFVSDADAELAMIEKACAEHGVEVSLTEVWGKGGAGGADLARKVVNAIESQTNNFGFAYDVELGIKDKIRAIAQKVYGAEDVDFSAEASAEIASLEKLGLDKMPICMAKTQYSLSDNAKLLGCPEDFRIAVRGITVSAGAGFIVALCGNMMKMPGLPKVPAAEKIDVDAEGVIHGLF

SEQ ID NO: 557 - DNA, 1677 bp, Neisseria meningitidis
atgagtttcaaaaccgatgccgaaatcgcccaatcctccaccatgcgcccgattggcgaaattgccgccaagctgggtttgaacgttgacaacattgagccttacggtcattacaaagccaaaatcaatcctgccgaagcgttcaaactgccgcaaaaacagggcaggctgattttggttaccgccatcaacccgactccggcgggcgaaggtaaaaccaccgtaaccatcggtttggcggacgcattgcgccatatcggcaaagactctgtgattgctttgcgcgagccttctttgggtccggtgttcggcgtgaaaggcggcgcggcaggcggcggctatgcccaagttttgccgatggaagacatcaacctgcacttcaccggagattttcacgccatcggtgcggcaaataatctgcttgccgcgatgctcgacaaccatatctaccaaggcaacgagttgaacatcgaccccaaacgcgtgctgtggcggcgcgtggtcgatatgaacgaccgccagttgcgcaacatcatcgacggcatgggcaagcctgttgacggcgtgatgcgtcctgacggtttcgatattaccgttgcttccgaagtgatggcggtattctgtcttgccaaagacatcagcgatttgaaagagcgtttgggcaacatccttgtcgcctacgccaaagacggcagccccgtttacgccaaagatttgaaagcgaatggcgcgatggcggcattgcttaaagatgcgattaagcccaacttggtgcaaaccatcgaaggcacgcccgccttcgtacacggcggcccgttcgccaacatcgcccacggctgcaactccgtaaccgcaacccgtctggcgaaacaccttgccgattacgccgtaaccgaagcaggcttcggcgcggacttgggcgcggaaaaattctgcgacatcaaatgccgccttgccggtttgaaacctgatgcggctgttgtcgtggcgactgtccgcgcgttgaaatataacggcggcgtggaacgcgccaacctcggcgaagaaaatttagacgctttggaaaaaggtttgcccaacctgctgaaacacatttccaacctgaaaaacgtattcggactgcccgtcgtcgttgcgctcaaccgcttcgtgtccgactccgatgccgagttggcgatgattgaaaaagcctgtgccgaacacggcgttgaagtttccctgaccgaagtgtggggcaaaggtggtgcgggcggcgcggatttggcgcgcaaagtcgtcaacgccattgaaagtcaaaccaataacttcggtttcgcctacgatgtcgagttgggcatcaaagacaaaatccgtgcgattgcccaaaaagtgtacggcgcggaagatgttgatttcagcgcggaagcgtctgccgaaatcgcttcactggaaaaactgggcttggacaaaatgccgatctgcatggcgaaaacccaatactctttgagcgacaacgccaaactgttgggctgccccgaagacttccgcatcgccgtgcgcggcatcaccgtttccgcaggcgcaggtttcatcgtcgccctgtgcggcaacatgatgaaaatgcccggcctgcccaaagttccggctgccgagaaaatcgatgtggacgcagaaggcgtgattcacggcttgttctga

SEQ ID NO: 558 - protein, 558 aa, Neisseria meningitidis
MSFKTDAEIAQSSTMRPIGEIAAKLGLNVDNIEPYGHYKAKINPAEAFKLPQKQGRLILVTAINPTPAGEGKTTVTIGLADALRHIGKDSVIALREPSLGPVFGVKGGAAGGGYAQVLPMEDINLHFTGDFHAIGAANNLLAAMLDNHIYQGNELNIDPKRVLWRRVVDMNDRQLRNIIDGMGKPVDGVMRPDGFDITVASEVMAVFCLAKDISDLKERLGNILVAYAKDGSPVYAKDLKANGAMAALLKDAIKPNLVQTIEGTPAFVHGGPFANIAHGCNSVTATRLAKHLADYAVTEAGFGADLGAEKFCDIKCRLAGLKPDAAVVVATVRALKYNGGVERANLGEENLDALEKGLPNLLKHISNLKNVFGLPVVVALNRFVSDSDAELAMIEKACAEHGVEVSLTEVWGKGGAGGADLARKVVNAIESQTNNFGFAYDVELGIKDKIRAIAQKVYGAEDVDFSAEASAEIASLEKLGLDKMPICMAKTQYSLSDNAKLLGCPEDFRIAVRGITVSAGAGFIVALCGNMMKMPGLPKVPAAEKIDVDAEGVIHGLF

SEQ ID NO: 559 - DNA, 477 bp, Neisseria gonorrhoeae
atgcgtgccgatttcatgtttgccgacaatatgcccgtgcaggtgcgccaacgcgccttctatttcaagttgtcccgttttgccgcgatgccaaatatggtaggcaaaccgctcttcgggcgacaggccggtcagcccggcaaaatgttcggcaacatcctgatgttcgtccgccagcatattgatgcagaggctgccgttttccgacaggatcggaatgattcgcgcactccggtttatgcacagcatcacggtcggcggctcgtcggtaaccggcgcaaccgccgtcattgtaatgccgtaacgccctgccgcaccgtctgtcgtgatgacatgaacgcctgccgcacaggatgccatcgcatcacggaacgaagtttgaaaagttttctgcaaatccgccatttttcccctttaaaccgtcccctatataagaatgctgcacacaaggcatccccccatgtgcagcagttctga

SEQ ID NO: 560 - protein, 158 aa, Neisseria gonorrhoeae
MRADFMFADNMPVQVRQRAFYFKLSRFAAMPNMVGKPLFGRQAGQPGKMFGNILMFVRQHIDAEAAVFRQDRNDSRTPVYAQHHGRRLVGNRRNRRHCNAVTPCRTVCRDDMNACRTGCHRITERSLKSFLQIRHFSPLNRPLYKNAAHKASPHVQQF

SEQ ID NO: 561 - DNA, 477 bp, Neisseria meningitidis
atgcgtgccgatttcatgtttgccgacaatatgcccgtgcaggtgcgccaacgcgccctctatttcaagttgtcccgttttgccgcgatgccagatgtggtaggcaaaccgctcttcgggcgacaggccggtcagcccggcaaaatgttcggcaacatcctgatgttcgtccgccagcgtattgatgcagaggctgccgttttccgacaggatcggaatgattcgcgcactccggttgatgcacagcatcacggtcggcggctcgtcggtaaccggcgcgaccgccgtcattgtaatgccgtaacgccctgccgcaccgtctgtcgtgatgacatgaacgcctgccgcgcaagatgccatcgcatcacggaacgaagtttgaaaatttttctgcaaatccgccatttttcccctttaaactgtcccctatataagaatgctgcacacaaggcatccccccatgtgcagcagttttga

SEQ ID NO: 562 - protein, 158 aa, Neisseria meningitidis
MRADFMFADNMPVQVRQRALYFKLSRFAAMPDVVGKPLFGRQAGQPGKMFGNILMFVRQRIDAEAAVFRQDRNDSRTPVDAQHHGRRLVGNRRDRRHCNAVTPCRTVCRDDMNACRARCHRITERSLKIFLQIRHFSPLNCPLYKNAAHKASPHVQQF

SEQ ID NO: 563 - DNA, 948 bp, Neisseria meningitidis
atgcgtgccgatttcatgtttgccgacaatatgcccgtgcaggtgcgccaacgcgccctctatttcaagttgtcccgttttgccgcgatgccagatgtggtaggcaaaccgctcttcgggcgacaggccggtcagcccggcaaaatgttcggcaacatcctgatgttcgtccgccagcgtattgatgcagaggctgccgttttccgacaggatcggaatgattcgcgcactccggttgatgcacagcatcacggtcggcggctcgtccgtaaccggcgcaaccgccgtcattgtaatgccgtaacgccctgccgcaccgtctgtcgtgatgacatgaacgcctgccgcacaggatgccatcgcatcacggaacgaagtttgaaaagttttctgcaaatccgccatttttcccctttaaactgtcccctatataagaatgctgcacacaaggcaccccccatgtgcagcagttctgattcaaaaagccgtcggtcggacatttccgcgcgttacggcgtattacgagttcaacgcatcctcgattttggcaagttctgccaacaggtctttaagcagcagcattttctcgcggcccagcacttcctcgatagcgtcgtaacgctcgtccacttcttcgccgatttcctcatacagcttctcgccctcggcagtcagcttcagaaaaacacgtcgttggtcgttggaaggtttcaggcggacaaccaaacccgctttttcaaggcgggtcaggataccggtcaggctggggcgcaaaatgcacgcctgattcgccaaatcttgaaagtccagcgtgccgttttccgccaaaagacggataatccgccattgctgatcggtaatattcgcctgattcagaataggcctgaattgggtcatcagggcttcccttgcctgtatcagaccgatattgatagacgcatgttttga

SEQ ID NO: 564 - protein, 315 aa, Neisseria meningitidis
MRADFMFADNMPVQVRQRALYFKLSRFAAMPDVVGKPLFGRQAGQPGKMFGNILMFVRQRIDAEAAVFRQDRNDSRTPVDAQHHGRRLVRNRRNRRHCNAVTPCRTVCRDDMNACRTGCHRITERSLKSFLQIRHFSPLNCPLYKNAAHKAPPMCSSSDSKSRRSDISARYGVLRVQRILDFGKFCQQVFKQQHFLAAQHFLDSVVTLVHFFADFLIQLLALGSQLQKNTSLVVGRFQADNQTRFFKAGQDTGQAGAQNARLIRQILKVQRAVFRQKTDNPPLLIGNIRLIQNRPELGHQGFPCLYQTDIDRRMF

SEQ ID NO: 565 - DNA, 1290 bp, Neisseria gonorrhoeae
atgttgagcttcggctatctcggcgttcagacggcctttaccctgcaaagctcgcagatgagccgcatttttcaaacgctaggcgcagacccgcacaatttgggctggtttttcatcctgccgccgctggcggggatgctggttcagccgatagtgggctactactcagaccgcacttggaagccgcgcttgggcggccgccgcctgccgtatctgctttacggcacgctgattgcggtcatcgtgatgattttgatgccgaactcgggcagcttcggtttcggctatgcgtcgctggcggccttgtcgttcggcgcgctgatgattgcgctgttggacgtgtcgtcgaatatggcgatgcagccgtttaagatgatggtcggcgatatggtcaacgaggagcagaaaagctacgcctacgggattcaaagtttcttagcgaatacggacgcggttgtggcagcgattctgccgtttgtgttcgcgtatatcggtttggcgaacactgccgagaaaggcgttgtgccacaaaccgtggtcgtagcattctatgtgggtgcggcgttactgattattaccagtgcgttcacaatctccaaagtcaaagaatacgacccggaaacctacgcccgttaccacggcatcgatgtcgccgcgaatcaggaaaaagccaactggttcgaactcttaaaaaccgcgcctaaagtgttttggacggttactccggtacagtttttctgctggttcgccttccggtatatgtggacttactcggcaggcgcgattgcagaaaacgtctggcacactaccgatgcgtcttccgtaggccatcaggaggcgggcaaccggtacggcgttttggcggcggtgtagtcggttgcggcggtgatttgttcgtttattctggcaaaagtaccgaataaataccataaggcgggttatttcggctgtttggctttgggcgcgctcggtttcttctctatcttcttcatctacaatcaatacgcactcatcctgtcttatatcttaatcggcatcgcttgggcgggcattatcacttatccgctgacgattgtggccaacgctttgtcgggcaaacacatggatacttatttgggcctgtttaacggctctgtctgtatgccgcaaatcgtcgcttcgctgttgagtttcgtgcttttcccgatgctgggcggccatcaggcaaccatgttcttggttgcaggcgcagtcttgctgctgggagccttctcagtctgtctgattaaagagatccacggcggggtttga

SEQ ID NO: 566 - protein, 428 aa, Neisseria gonorrhoeae
MLSFGYLGVQTAFTLQSSQMSRIFQTLGADPHNLGWFFILPPLAGMLVQPIVGYYSDRTWKPRLGGRRLPYLLYGTLIAVIVMILMPNSGSFGFGYASLAALSFGALMIALLDVSSNMAMQPFKMMVGDMVNEEQKSYAYGIQSFLANTDAVVAAILPFVFAYIGLANTAEKGVVPQTVVVAFYVGAALLIITSAFTISKVKEYDPETYARYHGIDVAANQEKANWFELLKTAPKVFWTVTPVQFFCWFAFRYMWTYSAGAIAENVWHTTDASSVGHQEAGNRYGVLAAVSVAAVICSFILAKVPNKYHKAGYFGCLALGALGFFSIFFIYNQYALILSYILIGIAWAGIITYPLTIVANALSGKHMDTYLGLFNGSVCMPQIVASLLSFVLFPMLGGHQATMFLVAGAVLLLGAFSVCLIKEIHGGV

SEQ ID NO: 567 - DNA, 1290 bp, Neisseria meningitidis
atgctcagtttcggctttctcggcgttcagacggcctttaccctgcaaagctcgcaaatgagccgcatttttcaaacgctaggcgcagacccgcacaatttgggctggtttttcatcctgccgccgctggcggggatgctggtgcagccgattgtcggccattactccgaccgcacttggaagccgcgtttgggcggccgccgtctgccgtatctgctttatggcacgctgattgcggttattgtgatgattttgatgccgaactcgggcagcttcggtttcggctatgcgtcgctggcggctttgtcgttcggcgcgctgatgattgcgctgttagacgtgtcgtcaaatatggcgatgcagccgtttaagatgatggtcggcgacatggtcaacgaggagcagaaaggctacgcctacgggattcaaagtttcttagcaaatacgggcgcggtcgtggcggcgattctgccgtttgtgtttgcgtatatcggtttggcgaacaccgccgagaaaggcgttgtgccgcagaccgtggtcgtggcgttttatgtgggtgcggcgttgctggtgattaccagcgcgttcacgattttcaaagtgaaggaatacgatccggaaacctacgcccgttaccacggcatcgatgtcgccgcgaatcaggaaaaagccaactggatcgaactcttgaaaaccgcgcctaaggcgttttggacggttactttggtgcaattcttctgctggttcgccttccaatatatgtggacttactcggcaggcgcgattgcggaaaacgtctggcacaccaccgatgcgtcttccgtaggttatcaggaggcgggtaactggtacggcgttttggcggcggtgcagtcggttgcggcggtgatttgttcgtttgtattggcgaaagtgccgaataaataccataaggcgggttatttcggctgtttggctttgggcgcgctcggctttttctccgttttcttcatcggcaaccaatacgcgctggtgttgtcttataccttaatcggcatcgcttgggcgggcattatcacttatccgctgacgattgtgaccaacgccttgtcgggcaagcatatgggcacttacttgggcttgtttaacggctctatctgtatgcctcaaatcgtcgcttcgctgttgagtttcgtgcttttccctatgctgggcggcttgcaggccactatgttcttggtagggggcgtcgtcctgctgctgggcgcgttttccgtgttcctgattaaagaaacacacggcggggtttga

SEQ ID NO: 568 - protein, 429 aa, Neisseria meningitidis
MLSFGFLGVQTAFTLQSSQMSRIFQTLGADPHNLGWFFILPPLAGMLVQPIVGHYSDRTWKPRLGGRRLPYLLYGTLIAVIVMILMPNSGSFGFGYASLAALSFGALMIALLDVSSNMAMQPFKMMVGDMVNEEQKGYAYGIQSFLANTGAVVAAILPFVFAYIGLANTAEKGVVPQTVVVAFYVGAALLVITSAFTIFKVKEYDPETYARYHGIDVAANQEKANWIELLKTAPKAFWTVTLVQFFCWFAFQYMWTYSAGAIAENVWHTTDASSVGYQEAGNWYGVLAAVQSVAAVICSFVLAKVPNKYHKAGYFGCLALGALGFFSVFFIGNQYALVLSYTLIGIAWAGIITYPLTIVTNALSGKHMGTYLGLFNGSICMPQIVASLLSFVLFPMLGGLQATMFLVGGVVLLLGAFSVFLIKETHGGV

SEQ ID NO: 569 - DNA, 1290 bp, Neisseria meningitidis
atgctcagtttcggctttctcggcgttcagacggcctttaccctgcaaagctcgcagatgagccgcatcttccagacgctcggtgccgatccgcacagcctcggctggttctttatcctgccgccgctggcggggatgctggtgcagccgattgtcggccattactccgaccgcacttggaagccgcgtttgggcggccgccgtctgccgtatctgctttatggcacgctgattgcggttattgtgatgattttgatgccgaactcgggcagcttcggtttcggctatgcgtcgctggcggctttgtcgttcggcgcgctgatgattgcgctgttagacgtgtcgtcaaatatggcgatgcagccgtttaagatgatggtcggcgacatggtcaacgaggagcagaaaggctacgcctacgggattcaaagtttcttagcgaatacgggcgcggtcgtggcggcgattctgccgtttgtgtttgcgtatatcggtttggcgaacaccgccgagaaaggcgttgtgccgcagaccgtggtcgtggcgttttatgtgggtgcggcgttgctggtgattaccagcgcgttcacgattttcaaagtgaaggaatacaatccggaaacctacgcccgttaccacggcatcgatgtcgccgcgaatcaggaaaaagccaactggatcgaactcttgaaaaccgcgcctaaggcgttttggacggttactttggtgcaattcttctgctggttcgccttccaatatatgtggacttactcggcaggcgcgattgcggaaaacgtctggcacaccaccgatgcgtcttccgtaggttatcaggaggcgggtaactggtacggcgttttggcggcggtgcagtcggttgcggcggtgatttgttcgtttgtattggcgaaagtgccgaataaataccataaggcgggttatttcggctgtttggctttgggcgcgctcggctttttctccgttttcttcatcggcaaccaatacgcgctggtgttgtcttataccttaatcggcatcgcttgggcgggcattatcacttatccgctgacgattgtgaccaacgccttgtcgggcaagcatatgggcacttacttgggcctgtttaacggctctatctgtatgccgcaaatcgtcgcttcgctgttgagtttcgtgcttttccctatgctgggcggcttgcaggccactatgttcttggtagggggcgtcgtcctgctgctgggcgcgttttccgtgttcctgattaaagaaacacacggcggggtttga

SEQ ID NO: 570 - protein, 429 aa, Neisseria meningitidis
MLSFGFLGVQTAFTLQSSQMSRIFQTLGADPHSLGWFFILPPLAGMLVQPIVGHYSDRTWKPRLGGRRLPYLLYGTLIAVIVMILMPNSGSFGFGYASLAALSFGALMIALLDVSSNMAMQPFKMMVGDMVNEEQKGYAYGIQSFLANTGAVVAAILPFVFAYIGLANTAEKGVVPQTVVVAFYVGAALLVITSAFTIFKVKEYNPETYARYHGIDVAANQEKANWIELLKTAPKAFWTVTLVQFFCWFAFQYMWTYSAGAIAENVWHTTDASSVGYQEAGNWYGVLAAVQSVAAVICSFVLAKVPNKYHKAGYFGCLALGALGFFSVFFIGNQYALVLSYTLIGIAWAGIITYPLTIVTNALSGKHMGTYLGLFNGSICMPQIVASLLSFVLFPMLGGLQATMFLVGGVVLLLGAFSVFLIKETHGGV

SEQ ID NO: 571 - DNA, 612 bp, Neisseria gonorrhoeae
atgagcgatacccccgctacccgcgatttcggcctgatcgacgggcgggccgtaaccggctatgtgctgtccaaccggcgtggtacgtgcgtcttcgtgctggacttgggcgggattgtgcaggaattttccgttttggcagacggcgtgcgcgaaaaccccgtggtgtcgttcgacgatgcggcttcctatgcggacaatccgtttcagattaacaagcagatagggcgcgtggccggacgcatccgcggtgcggcgttcgacatcaacggtaggacttaccgcgtggaggccaacgaaggcaggaacgcgctgcacggcggttcgcacgggctggccgttacccgtttcaacgcggtggcggcagacggccgacggttatcccaacgatttggatatttcctaccgcttggacgaggacggccggcttaccgttacctatcgcgccaccgcgctcggcgacacggtgttcgacccgacgctgcacatttactggcggctggacgcgggcctgcacgatgcggttctgcatattccgcagggcggacatattccggccgatgccgaaaaactgcccgtcttaacggtttcagacggcctcgaagtatttga

SEQ ID NO: 572 - protein, 203 aa, Neisseria gonorrhoeae
MSDTPATRDFGLIDGRAVTGYVLSNRRGTCVFVLDLGGIVQEFSVLADGVRENPVVSFDDAASYADNPFQINKQIGRVAGRIRGAAFDINGRTYRVEANEGRNALHGGSHGLAVTRFNAVAADGRRLSQRFGYFLPLGRGRPAYRYLSRHRARRHGVRPDAAHLLAAGRGPARCGSAYSAGRTYSGRCRKTARLNGFRRPRSI

SEQ ID NO: 573 - DNA, 657 bp, Neisseria meningitidis
atgagcgatacccccgctacccgcgatttcggtctgatcgacgggcgtgccgtaaccggctatgtgctgtccaaccggcgtggtacgcgtgtctgcgtgctggacttgggcgggattgtgcaggaattttccgttttggcagacggcgtgcgcgaaaacctcgtggtgtcgttcgatgatgcggcttcctatgcggacaatccgtttcagattaacaaacagatagggcgcgtggccggacgcatccgcggtgcggcgttcgacatcaacggcaggacttaccgcgtggaggccaacgaaggcaggaacgcgctgcacggcggttcgcacgggctggccgttacccgtttcaacgcggtggcggcagacggccgttcggtggtgctgcgcagccgcctggcaacagtcggccgacggttatcccaacgatttggatttggatatttcctaccgcttggacgaggacgaccggcttaccgttacctatcgcgccaccgcgctcggcgacacggtgttcgacccgacgctgcacatttactggcggctggacgcgggcctgcacgatgcggttctgcatattccgcagggcggacatatgccggccgatgccgaaaaactgcccgtctcaacggtttcagacgacctcgaagtatttga

SEQ ID NO: 574 - protein, 218 aa, Neisseria meningitidis
MSDTPATRDFGLIDGRAVTGYVLSNRRGTRVCVLDLGGIVQEFSVLADGVRENLVVSFDDAASYADNPFQINKQIGRVAGRIRGAAFDINGRTYRVEANEGRNALHGGSHGLAVTRFNAVAADGRSVVLRSRLATVGRRLSQRFGFGYFLPLGRGRPAYRYLSRHRARRHGVRPDAAHLLAAGRGPARCGSAYSAGRTYAGRCRKTARLNGFRRPRSI

SEQ ID NO: 575 - DNA, 656 bp, Neisseria meningitidis
atgagcgatacccccgctacccgcgatttcggcctgatcgacgggcgtgccgtaaccggctatgtgctgtccaaccggcgtggtacgcgtgtctgcgtgctggacttgggcgggattgtgcaggaattttccgttttggcagacggcgtgcgcgaaaacctcgtggtgtcgttcgacgatgcggcttcctatgcggacaatccgtttcagattaacaagcagatagggcgcgtggccggacgcatccgcggtgcggcgttcgacatcaacggcaggacttaccgcgtggaggccaacgaaggcaggaacgcgctgcacggcggttcgcacgggctggccgttacccgtttcaacgcggtggcggcagacggccgttcggtggtgctgcgcagccgcctgcaacagtcggccgacggttatcccaacgatttggatttggatatttcctaccgcttggacgaggacgaccggcttaccgttacctatcgcgccaccgcgctcggcgacacggtgttcgacccgacgctgcacatttactggcggctggacgcgggcctgcacgatgcggttctgcatattccgcagggcggacatattccggccgatgccgaaaaactgcccgtctcaacggtttcagacgacctcgaagtatttga

SEQ ID NO: 576 - protein, 218 aa, Neisseria meningitidis
  misc_feature (134)..(134): Xaa can be any naturally occurring amino acid
MSDTPATRDFGLIDGRAVTGYVLSNRRGTRVCVLDLGGIVQEFSVLADGVRENLVVSFDDAASYADNPFQINKQIGRVAGRIRGAAFDINGRTYRVEANEGRNALHGGSHGLAVTRFNAVAADGRSVVLRSRLXTVGRRLSQRFGFGYFLPLGRGRPAYRYLSRHRARRHGVRPDAAHLLAAGRGPARCGSAYSAGRTYSGRCRKTARLNGFRRPRSI

SEQ ID NO: 577 - DNA, 639 bp, Neisseria gonorrhoeae
atgaagcaaatccccctccgccttctccaggtcgtcattgaccacgacaaagtcgaacaatacggactgttcgatttcatgccttgccttcgacagcctcctttggataacttcccgactgtccgtcccgcgccctttgaggcgcgcggcaagcacgtcgaaagaaggcggcaggataaagataccgacagcttccggcagcgcgttgcgaacctgcgccgcgccctgaacgtcgatttccaaaatcacgtcatagcctgccgccgccaacgcattcacgccctccgtgcttgtgccgtaatagttgccgaatacgtctgcgtattccaaaaaagcctcctgcgcgataagcgattcaaactcttctttggaaacaaagtgataatgtacgccgtttgcttcgccttcacgcggcgggcgcgtcgtatgcgacacggaaacgcgcaaaccgttatggtttgccaacagccgcgacaccagcgtggttttgcccgtgccggaagcggccgaaatgataaagatgttgccttttcgataagcggacatattttttacctgtatattttccaaccgattgtatcacaacggacaccctatttcatatttgccgatgcccatattttgccgctattgttttga

SEQ ID NO: 578 - protein, 212 aa, Neisseria gonorrhoeae
MKQIPLRLLQVVIDHDKVEQYGLFDFMPCLRQPPLDNFPTVRPAPFEARGKHVERRRQDKDTDSFRQRVANLRRALNVDFQNHVIACRRQRIHALRACAVIVAEYVCVFQKSLLRDKRFKLFFGNKVIMYAVCFAFTRRARRMRHGNAQTVMVCQQPRHQRGFARAGSGRNDKDVAFSISGHIFYLYIFQPIVSQRTPYFIFADAHILPLLF

SEQ ID NO: 579 - DNA, 639 bp, Neisseria meningitidis
atggcgcaaatcctcctccgctcgcgccaagtcgtcattgaccacgacaaagtcaaacaatacggactgctcgatttcatgccttgccttcgacagcctcctttggataacttcccgactgtccgtcccgcgtccgttgaggcgcgcggcaagtacgtcgaaagaaggcggcaggataaagatgccgacggcttcgggcagcgcgtcgcgaacctgcgccgcgccctgaacgtcgatttccaaaatcacgtcatagcctgccgccgccaacgcattcacaccctccgcgcctgtgccgtaatagttgccaaatacgtcggcgtattccaaaaaagcttcctgcgcgataagcgactcaaactcttctttggaaacaaagtgataatgtacgccgtttgcttcgccttcacgcggcgggcgcgtcgtgtgcgacacggaaacgcgcaaaccgttatggtttgccaacagccgcgacaccagcgtggttttgcccgtgccggaagcggccgaaatgataaagatgttgccttttcgataagcggacatattttttacctgtatattttccagccgattgtatcacaatggacacccagtttcctatttgccgatgcccatattttgccgctattgttttga

SEQ ID NO: 580 - protein, 212 aa, Neisseria meningitidis
MAQILLRSRQVVIDHDKVKQYGLLDFMPCLRQPPLDNFPTVRPASVEARGKYVERRRQDKDADGFGQRVANLRRALNVDFQNHVIACRRQRIHTLRACAVIVAKYVGVFQKSFLRDKRLKLFFGNKVIMYAVCFAFTRRARRVRHGNAQTVMVCQQPRHQRGFARAGSGRNDKDVAFSISGHIFYLYIFQPIVSQWTPSFLFADAHILPLLF

SEQ ID NO: 581 - DNA, 639 bp, Neisseria meningitidis
atggcgcaaatcctcctccgcccgcgccaagtcatcattgaccacgacaaaatcgaacaatacggactgttcgatttcatgccttgccttcgacagcctcctttggataacttcccgactgtccgtcccgcgtccgttgagacgcgcagcaagcacatcgaaagacggcggcaggataaagatgccgacggcttcgggcagcgcatctcgaacctgagccgcgccctgaacgtcgatttccaaaatcacgtcataacctgccgccgccaacgcattcacaccctccgcgcttgtgccgtaatagttgccgaacacgtccgcgtattccaaaaaagcctcctgcgcgataagcgactcaaactcttctttggaaacaaagtgataatgtacgccgtttgcttcgccttcacgcggcggacgcgtcgtgtgcgacacggaaacgcgcaaaccgttatggtttgccaacagccgcgacaccagcgtggttttgcccgtgccggaagcggccgaaatgataaagatgttgccttttcgataagcggacatattttttacctgtatattttccagccgattgtatcacaacggacacccggtttcctatttgccgatgcccatattttgccgctattgttttga

SEQ ID NO: 582 - protein, 212 aa, Neisseria meningitidis
MAQILLRPRQVIIDHDKIEQYGLFDFMPCLRQPPLDNFPTVRPASVETRSKHIERRRQDKDADGFGQRISNLSRALNVDFQNHVITCRRQRIHTLRACAVIVAEHVRVFQKSLLRDKRLKLFFGNKVIMYAVCFAFTRRTRRVRHGNAQTVMVCQQPRHQRGFARAGSGRNDKDVAFSISGHIFYLYIFQPIVSQRTPGFLFADAHILPLLF

SEQ ID NO: 583 - DNA, 522 bp, Neisseria gonorrhoeae
atgcgacgagaagccaaaatggcacaaatcacactcaaacccattgttttatcaattcttttaatcaacacacccctcctcgcccaagcgcatgaaactgagcaatcggtgggcttggaaacggtcagcgtcgtcggcaaaagccgtccgcgcgcgacttcggggctgctgcacacttcgaccgcctccgacaaaatcatctccggcgatactttgcgccaaaaagccgtcaacttgggcgacgctttggacggcgtaccgggcatccacgcttcgcaatacggcggcggcgcatccgctcccgttattcgcggtcaaacgggcagacggattaaagtattgaaccatcacggcgaaacgggcgatatggcggacttttctcccgatcacgccattatggtagataccgccttgtcgcaacaggttgaaatcctgcgcgggccggttacgctcttgtacagctcgggcaatgtggccggggctggtcaatgttgccgatggaaaaatcccccaaaaaatgcc

SEQ ID NO: 584 - protein, 174 aa, Neisseria gonorrhoeae
MRREAKMAQITLKPIVLSILLINTPLLAQAHETEQSVGLETVSVVGKSRPRATSGLLHTSTASDKIISGDTLRQKAVNLGDALDGVPGIHASQYGGGASAPVIRGQTGRRIKVLNHHGETGDMADFSPDHAIMVDTALSQQVEILRGPVTLLYSSGNVAGAGQCCRWKNPPKNA

SEQ ID NO: 585 - DNA, 2205 bp, Neisseria meningitidis
ccgcataaaactgagcaatcggtggatttggaaacggtcagcgtcgtcggcaaaagccgtccgcgcgccacgtcggggctgttgcacacttcgaccgcctccgacaaaatcatctccggcgataccttgcgccaaaaagccgtcaacttgggcgacgctttagacggcgtaccgggcatccacgcttcgcaatacggcggcggcgcgtctgctcccgtcattcgcggtcaaacaggcaggcggattaaagtgttgaaccatcacggcgaaacaggcgatatggcggatttttcgcccgatcacgccattatggtagataccgccttgtcgcaacaggtcgaaatcctgcgcgggccggttacgctcttgtacagctcgggcaatgtggcggggctggtcgatgttgccgatggcaaaatccccgaaaaaatgcctgaaaacggcgtatcgggcgaactcggattgcgtttgagcagcggcaatctggaaaaactcacgtccggcggcatcaatatcggtttgggcaaaaactttgtattgcacacggaagggctgtaccgcaaatcgggggattacgccgtaccgcgttaccgcaatctgaaacgcctgcccgacagccacgccgattcgcaaacgggcagcatcgggctgtcttgggttggcgaaaaaggttttatcggcgtagcgtacagcgaccgtcgcgaccaatatggtctgcctgcccacagccacgaatacgatgattgccacgccgacatcatctggcaaaagagcttgattaacaaacgctatttacagctttatccgcacctgttgaccgaagaagacatcgattacgacaatccgggcttgagctgcggcttccacgacgacgataatgcacacgcacacacccacagcggcagaccgtggatagacctgcgcaacaaacgctacgaactccgtgccgaatggaagcaaccgttccccggttttgaagccctgcgcgtacacctgaaccgcaacgactaccgccacgacgaaaaagcaggcgatgcagtcgaaaacttttttaacaaccaaacgcaaaacgcccgcatcgagttgcgccaccaacccataggtcgtctgaaaggcagctggggcgtgcaatatttacaacaaaaatccagtgctttatctgccatatccgaagcggttaaacaaccgatgctgcttgacaacaaagtgcaacattacagctttttcggtgtagaacaggcaaactgggacaacttcacgcttgaaggaggcgtacgcgtggaaaaacaaaaagcctccattcagtacgacaaagcattgattgatcgggaaaactactacaaccaccccctgcccgacctcggcgcgcaccgccaaaccgcccgctcattcgcactttcgggcaactggtatttcacgccacaacacaaactcagcctgaccgcctcccatcaggaacgcctgccgtcaacgcaagagctgtacgcacacggcaaacacgtcgccaccaacacctttgaagtcggcaacaaacacctcaacaaagagcgttccaacaatatcgaactcgcgctgggctacgaaggcgaccgctggcaatacaatctggcactctaccgcaaccgcttcggtaactacatttacgcccaaaccttaaacgacggacgcggccccaaatccatcgaagacgacagcgaaatgaagctcgtgcgctacaaccaatccggcgccgacttctacggcgcggaaggcgaaatctacttcaaaccgacaccgcgctaccgcatcggcgtttccggcgactatgtacgaggccgtctgaaaaacctgccttccctacccggcagagaagatgcctacggcaaccgtcctttcatcgcacaggacgaccaaaatgccccccgtgttccggctgcgcgcctcggcttccacctgaaagcctcgctgaccgaccgtatcgatgccaatttggactactaccgcgtgttcgcccaaaacaaactcgcccgctacgaaacgcgcacgcccggacaccatatgctcaacctcggcgcaaactaccgccgcaatacgcgctatggcgagtggaattggtacgtcaaagccgacaacctgctcaaccaatccgtttacgcccacagcagctttctctctgatacgccgcaaatgggccgcagctttaccggcggcgtgaacgagttttaa

SEQ ID NO: 586 - protein, 735 aa, Neisseria meningitidis
PHKTEQSVDLETVSVVGKSRPRATSGLLHTSTASDKIISGDTLRQKAVNLGDALDGVPGIHASQYGGGASAPVIRGQTGRRIKVLNHHGETGDMADFSPDHAIMVDTALSQQVEILRGPVTLLYSSGNVAGLVDVADGKIPEKMPENGVSGELGLRLSSGNLEKLTSGGINIGLGKNFVLHTEGLYRKSGDYAVPRYRNLKRLPDSHADSQTGSIGLSWVGEKGFIGVAYSDRRDQYGLPAHSHEYDDCHADIIWQKSLINKRYLQLYPHLLTEEDIDYDNPGLSCGFHDDDNAHAHTHSGRPWIDLRNKRYELRAEWKQPFPGFEALRVHLNRNDYRHDEKAGDAVENFFNNQTQNARIELRHQPIGRLKGSWGVQYLQQKSSALSAISEAVKQPMLLDNKVQHYSFFGVEQANWDNFTLEGGVRVEKQKASIQYDKALIDRENYYNHPLPDLGAHRQTARSFALSGNWYFTPQHKLSLTASHQERLPSTQELYAHGKHVATNTFEVGNKHLNKERSNNIELALGYEGDRWQYNLALYRNRFGNYIYAQTLNDGRGPKSIEDDSEMKLVRYNQSGADFYGAEGEIYFKPTPRYRIGVSGDYVRGRLKNLPSLPGREDAYGNRPFIAQDDQNAPRVPAARLGFHLKASLTDRIDANLDYYRVFAQNKLARYETRTPGHHMLNLGANYRRNTRYGEWNWYVKADNLLNQSVYAHSSFLSDTPQMGRSFTGGVNVKF

SEQ ID NO: 587 - DNA, 2295 bp, Neisseria meningitidis
atgcgacgagaagccaaaatggcacaaactacactcaaacccattgttttatcaattcttttaatcaacacacccctcctctcccaagcgcatggaactgagcaatcagtgggcttggaaacggtcagcgtcgtcggcaaaagccgtccgcgcgccacttcggggctgctgcacacttctaccgcctccgacaaaatcatcagcggcgacaccttgcgacaaaaagccgtcaacttgggtgatgctttagacggcgtaccgggcattcatgcctcgcaatacggcggcggcgcatccgctcccgttattcgcggtcaaacaggcagacggattaaagtgttgaaccatcacggcgaaacgggcgacatggcggacttctctccagaccatgcaatcatggtggacagcgccttgtcgcaacaggtcgaaatcctgcgcggtccggttacgctcttgtacagctcgggcaatgtggcggggctggtcgatgttgccgatggcaaaatccccgaaaaaatgcctgaaaacggcgtatcgggcgaactcggattgcgtttgagcagcggcaatctggaaaaactcacgtccggcggcatcaatatcggtttgggcaaaaactttgtattgcacacggaagggctgtaccgcaaatcgggggattacgccgtaccgcgttaccgcaatctgaaacgcctgcccgacagccacgccgattcgcaaacgggcagcatcgggctgtcttgggttggcgaaaaaggctttatcggcgcagcatacagcgaccgtcgcgaccaatatggtctgcctgcccacagccacgaatacgatgattgccacgccgacatcatctggcaaaagagtttgattaacaaacgctatttgcagctttatccgcacctgttgaccgaagaagacatcgattacgacaatccgggcttgagctgcggctttcacgacgacgatgatgcacacgcccatgcccacaacggcaaaccttggatagacctgcgcaacaaacgctacgaactccgcgccgaatggaagcaaccgttccccggttttgaagccctgcgcgtacacctgaaccgcaacgactaccgccacgacgaaaaagcaggcgatgcagtagaaaacttttttaacaaccaaacgcaaaacgcccgtatcgagttgcgccaccaacccataggccgtctgaaaggcagctggggcgtgcaatatttgggacaaaaatccagtgctttatctgccacatccgaagcggtcaaacaaccgatgctgcttgacaataaagtgcaacattacagctttttcggtgtagaacaggcaaactgggacaacttcacgcttgaaggcggcgtacgcgtggaaaaacaaaaagcctccatccgctacgacaaagcattgattgatcgggaaaactactacaaccatcccctgcccgacctcggcgcgcaccgccaaaccgcccgctcattcgcactttcgggcaactggtatttcacgccacaacacaaactcagcctgaccgcctcccatcaggaacgcctgccgtcaacgcaagagctgtacgcacacggcaaacacgtcgccaccaacacctttgaagtcggcaacaaacacctcaacaaagagcgttccaacaatatcgaactcgcgctgggctacgaaggcgaccgctggcaatacaatctggcactctaccgcaaccgcttcggcaactacatttacgcccaaaccttaaacgacggacgcggccccaaatccatcgaagacgacagcgaaatgaagctcgtgcgctacaaccaatccggtgcggacttctacggcgcggaaggcgaaatctacttcaaaccgacaccgcgctaccgcatcggcgtttccggcgactatgtacgaggccgtctgaaaaacctgccttccctacccggcagggaagacgcctacggcaaccgcccactcattgcccaagccgaccaaaacgcccctcgcgttccggctgcgcgcctcggcgtccacctgaaagcctcgctgaccgaccgcatcgatgccaatttggactactaccgcgtgttcgcccaaaacaaactcgcccgctacgaaacgcgcacgcccggacaccatatgctcaacctcggcgcaaactaccgccgcaatacgcgctatggcgagtggaattggtacgtcaaagccgacaacctgctcaaccaatccgtttacgcccacagcagcttcctctctgatacgccgcaaatgggccgcagctttaccggcggcgtgaacgtgaagttttaa

SEQ ID NO: 588 - protein, 764 aa, Neisseria meningitidis
MRREAKMAQTTLKPIVLSILLINTPLLSQAHGTEQSVGLETVSVVGKSRPRATSGLLHTSTASDKIISGDTLRQKAVNLGDALDGVPGIHASQYGGGASAPVIRGQTGRRIKVLNHHGETGDMADFSPDHAIMVDSALSQQVEILRGPVTLLYSSGNVAGLVDVADGKIPEKMPENGVSGELGLRLSSGNLEKLTSGGINIGLGKNFVLHTEGLYRKSGDYAVPRYRNLKRLPDSHADSQTGSIGLSWVGEKGFIGAAYSDRRDQYGLPAHSHEYDDCHADIIWQKSLINKRYLQLYPHLLTEEDIDYDNPGLSCGFHDDDDAHAHAHNGKPWIDLRNKRYELRAEWKQPFPGFEALRVHLNRNDYRHDEKAGDAVENFFNNQTQNARIELRHQPIGRLKGSWGVQYLGQKSSALSATSEAVKQPMLLDNKVQHYSFFGVEQANWDNFTLEGGVRVEKQKASIRYDKALIDRENYYNHPLPDLGAHRQTARSFALSGNWYFTPQHKLSLTASHQERLPSTQELYAHGKHVATNTFEVGNKHLNKERSNNIELALGYEGDRWQYNLALYRNRFGNYIYAQTLNDGRGPKSIEDDSEMKLVRYNQSGADFYGAEGEIYFKPTPRYRIGVSGDYVRGRLKNLPSLPGREDAYGNRPLIAQADQNAPRVPAARLGVHLKASLTDRIDANLDYYRVFAQNKLARYETRTPGHHMLNLGANYRRNTRYGEWNWYVKADNLLNQSVYAHSSFLSDTPQMGRSFTGGVNVKF

SEQ ID NO: 589 - DNA, 600 bp, Neisseria gonorrhoeae
atggcgttaaaaacatcaaacttggaacacgcaatgctggttcatcccgaagctatgagtgtcggcgcgcttgccgacaaaatccgcaaaatcgaaaactggccgcaaaaaggcatcttattccacgacatcacgcccgtcctgcaaagtgcggaatacttccgccttttggtcgatttgctggtttaccgctatatggatcagaaaatcgacatcgttgccggcttggacgcgcgcggcttcattatcggcgcggcactcgcctaccagctcaacgtcggcttcgtccccatccgcaaaaaaggcaagctgccttttgaaaccgtatcgcaaagctacgcgctcgaatacggggaagctgcggtggaaatccacaccgatgccgtcaaacccggttcgcgcgtcctgctggtcgatgatttggttgccacgggcggcacaatgcttgccgggctggaactgatccgcaaactcggcggggaaattgtcgaagccgccgccattttggaatttaccgaccttcaaggcggcaagaatatccgcgcaagtggcgcgcccttatttaccctgcttcaaaacgaaggctgcatgaaaggctga

SEQ ID NO: 590 - protein, 199 aa, Neisseria gonorrhoeae
MALKTSNLEHAMLVHPEAMSVGALADKIRKIENWPQKGILFHDITPVLQSAEYFRLLVDLLVYRYMDQKIDIVAGLDARGFIIGAALAYQLNVGFVPIRKKGKLPFETVSQSYALEYGEAAVEIHTDAVKPGSRVLLVDDLVATGGTMLAGLELIRKLGGEIVEAAAILEFTDLQGGKNIRASGAPLFTLLQNEGCMKG

SEQ ID NO: 591 - DNA, 600 bp, Neisseria meningitidis
atggcgttaaaaacatcaaacttggaacacgcaatgctggttcatcccgaagctatgagtgtcggcgcgcttgccgacaaaatccgcaaaatcgaaaactggccgcaaaaaggcatcttattccacgacatcacgcccgtccttcaaagcgcggaatacttccgccttttggttgatttattggtttaccgctatatggatcagaaaatcgacatcgttgccggtttggacgcgcgcggcttcattatcggcgcggcactcgcctaccagctcaacgtcggtttcgtccccatccgcaaaaaaggcaagctgccttttgaaaccgtatcgcaaagctacgcgctcgaatacggggaagctgcggtggaaatccacaccgatgccgtcaaactcggttcgcgcgtgctgctggtcgatgatttgattgccacgggcggcacgatgcttgccggactggaactgatccgcaaactcggcggagaaattgtcgaagccgccgccattttggaatttaccgaccttcaaggcggcaagaatatccgtgcaagcggcgcgcccttatttaccctgcttcaaaacgaaggctgtatgaagggctga

SEQ ID NO: 592 - protein, 199 aa, Neisseria meningitidis
MALKTSNLEHAMLVHPEAMSVGALADKIRKIENWPQKGILFHDITPVLQSAEYFRLLVDLLVYRYMDQKIDIVAGLDARGFIIGAALAYQLNVGFVPIRKKGKLPFETVSQSYALEYGEAAVEIHTDAVKLGSRVLLVDDLIATGGTMLAGLELIRKLGGEIVEAAAILEFTDLQGGKNIRASGAPLFTLLQNEGCMKG

SEQ ID NO: 593 - DNA, 600 bp, Neisseria meningitidis
atggcgttaaaaacatcaaacttggaacacgcaatgctggttcatcccgaagctatgagtgtcggtgcgcttgccgacaaaatccgcaaaatcgaaaactggccgcaaaaaggcatcttattccacgacatcacgcccgtcctgcaaagcgcggaatacttccgacttttggttgatttattggtttaccgctatatggatcagaaaatcgacatcgttgccggtttggacgcgcgcggcttcattatcggcgcggcactcgcctaccagctcaacgtcggtttcgtccccatccgcaaaaaaggcaagctgccttttgaaaccgtatcgcaaagctacgcgctcgaatacggggaagctgcggtggaaatccacaccgatgccgtcaaactcggttcgcgcgtgctgctggtcgatgatttggttgccacgggcggcacgatgcttgccggactggagctgatccgcaaactcggcggggaaattgtcgaagccgccgccattttggaatttaccgaccttcaaggcggcaagaatatccgtgcaagcggcgcgcccttatttaccctgcttcaaaacgaaggctgtatgaagggctga

SEQ ID NO: 594 - protein, 199 aa, Neisseria meningitidis
MALKTSNLEHAMLVHPEAMSVGALADKIRKIENWPQKGILFHDITPVLQSAEYFRLLVDLLVYRYMDQKIDIVAGLDARGFIIGAALAYQLNVGFVPIRKKGKLPFETVSQSYALEYGEAAVEIHTDAVKLGSRVLLVDDLVATGGTMLAGLELIRKLGGEIVEAAAILEFTDLQGGKNIRASGAPLFTLLQNEGCMKG

SEQ ID NO: 595 - DNA, 1020 bp, Neisseria gonorrhoeae
atgttgattgacaacaatgtccgccattacagctttttcggtgtagaacaggcaaattgggacaacttcacgcttgaaggcggcgtacgcgtggaaaaacaaaaagcctccatccggtacgacaaagcattgattgatcgagaaaactactacaaccagcccctgcccgacctcggcgcgcaccgccaaaccgcccgctcgttcgcactttcgggcaactggtatttcacgccacaccacaaactcagcctgaccgcctcccatcaggaacgcctgccgtcaacgcaagaactgtacgcacacggcaagcacgtcgccaccaacacctttgaagtcggcaacaaacacctcaacaaagagcgttccaacaatatcgaactcgcgctgggctacaaaggcgaccgctggcaatacaatctggcagcctaccgcaaccgattcggcaactacatttacgcccaaaccttaaacgacggacgcggccccaaatccatcgaagacgacagcgaaatgaagctcgtgcgctacaaccaatccggtgccgacttctacggcgcggaaggcgaaatctacttcaaaccgacaccgcgctaccgcatcggtgtttccggcgactatgtacgaggccgtctgaaaaacctgccgtccctacccggcagggaagatccctacggcaaacgtcccttcatcgcacaagccgaccaaaacgccccccgcattccggctgcgcgcctcggcttccacctgaaaacctcgctaaccgaccgtatcgatgccaatttggactactaccgcgtgttcgcccaaaacaaactcgcccgctacgaaacgcgtacgcccggacaccatatgctcaacctcggtgcaaactaccgccgcaatacgcgctatggcgagtggaattggtacgtcaaagccgacaacctgctcaaccaatccgtttacgcccacagcagcttcctctctgatacgccgcaaatgggccgcagctttgccggcggcgtaaacgtgaagttttaa

SEQ ID NO: 596 - protein, 339 aa, Neisseria gonorrhoeae
MLIDNNVRHYSFFGVEQANWDNFTLEGGVRVEKQKASIRYDKALIDRENYYNQPLPDLGAHRQTARSFALSGNWYFTPHHKLSLTASHQERLPSTQELYAHGKHVATNTFEVGNKHLNKERSNNIELALGYKGDRWQYNLAAYRNRFGNYIYAQTLNDGRGPKSIEDDSEMKLVRYNQSGADFYGAEGEIYFKPTPRYRIGVSGDYVRGRLKNLPSLPGREDPYGKRPFIAQADQNAPRIPAARLGFHLKTSLTDRIDANLDYYRVFAQNKLARYETRTPGHHMLNLGANYRRNTRYGEWNWYVKADNLLNQSVYAHSSFLSDTPQMGRSFAGGVNVKF

SEQ ID NO: 597 - DNA, 1020 bp, Neisseria meningitidis
atgctgcttgacaacaaagtgcaacattacagctttttcggtgtagaacaggcaaactgggacaacttcacgcttgaaggaggcgtacgcgtggaaaaacaaaaagcctccattcagtacgacaaagcattgattgatcgggaaaactactacaaccaccccctgcccgacctcggcgcgcaccgccaaaccgcccgctcattcgcactttcgggcaactggtatttcacgccacaacacaaactcagcctgaccgcctcccatcaggaacgcctgccgtcaacgcaagagctgtacgcacacggcaaacacgtcgccaccaacacctttgaagtcggcaacaaacacctcaacaaagagcgttccaacaatatcgaactcgcgctgggctacgaaggcgaccgctggcaatacaatctggcactctaccgcaaccgcttcggtaactacatttacgcccaaaccttaaacgacggacgcggccccaaatccatcgaagacgacagcgaaatgaagctcgtgcgctacaaccaatccggcgccgacttctacggcgcggaaggcgaaatctacttcaaaccgacaccgcgctaccgcatcggcgtttccggcgactatgtacgaggccgtctgaaaaacctgccttccctacccggcagagaagatgcctacggcaaccgtcctttcatcgcacaggacgaccaaaatgccccccgtgttccggctgcgcgcctcggcttccacctgaaagcctcgctgaccgaccgtatcgatgccaatttggactactaccgcgtgttcgcccaaaacaaactcgcccgctacgaaacgcgcacgcccggacaccatatgctcaacctcggcgcaaactaccgccgcaatacgcgctatggcgagtggaattggtacgtcaaagccgacaacctgctcaaccaatccgtttacgcccacagcagctttctctctgatacgccgcaaatgggccgcagctttaccggcggcgtgaacgtgaagttttaa

SEQ ID NO: 598 - protein, 339 aa, Neisseria meningitidis
MLLDNKVQHYSFFGVEQANWDNFTLEGGVRVEKQKASIQYDKALIDRENYYNHPLPDLGAHRQTARSFALSGNWYFTPQHKLSLTASHQERLPSTQELYAHGKHVATNTFEVGNKHLNKERSNNIELALGYEGDRWQYNLALYRNRFGNYIYAQTLNDGRGPKSIEDDSEMKLVRYNQSGADFYGAEGEIYFKPTPRYRIGVSGDYVRGRLKNLPSLPGREDAYGNRPFIAQDDQNAPRVPAARLGFHLKASLTDRIDANLDYYRVFAQNKLARYETRTPGHHMLNLGANYRRNTRYGEWNWYVKADNLLNQSVYAHSSFLSDTPQMGRSFTGGVNVKF

SEQ ID NO: 599 - DNA, 1020 bp, Neisseria meningitidis
atgctgcttgacaataaagtgcaacattacagctttttcggtgtagaacaggcaaactgggacaacttcacgcttgaaggcggcgtacgcgtggaaaaacaaaaagcctccatccgctacgacaaagcattgattgatcgggaaaactactacaaccatcccctgcccgacctcggcgcgcaccgccaaaccgcccgctcattcgcactttcgggcaactggtatttcacgccacaacacaaactcagcctgaccgcctcccatcaggaacgcctgccgtcaacgcaagagctgtacgcacacggcaaacacgtcgccaccaacacctttgaagtcggcaacaaacacctcaacaaagagcgttccaacaatatcgaactcgcgctgggctacgaaggcgaccgctggcaatacaatctggcactctaccgcaaccgcttcggcaactacatttacgcccaaaccttaaacgacggacgcggccccaaatccatcgaagacgacagcgaaatgaagctcgtgcgctacaaccaatccggtgcggacttctacggcgcggaaggcgaaatctacttcaaaccgacaccgcgctaccgcatcggcgtttccggcgactatgtacgaggccgtctgaaaaacctgccttccctacccggcagggaagacgcctacggcaaccgcccactcattgcccaagccgaccaaaacgcccctcgcgttccggctgcgcgcctcggcgtccacctgaaagcctcgctgaccgaccgcatcgatgccaatttggactactaccgcgtgttcgcccaaaacaaactcgcccgctacgaaacgcgcacgcccggacaccatatgctcaacctcggcgcaaactaccgccgcaatacgcgctatggcgagtggaattggtacgtcaaagccgacaacctgctcaaccaatccgtttacgcccacagcagcttcctctctgatacgccgcaaatgggccgcagctttaccggcggcgtgaacgtgaagttttaa

SEQ ID NO: 600 - protein, 339 aa, Neisseria meningitidis
MLLDNKVQHYSFFGVEQANWDNFTLEGGVRVEKQKASIRYDKALIDRENYYNHPLPDLGAHRQTARSFALSGNWYFTPQHKLSLTASHQERLPSTQELYAHGKHVATNTFEVGNKHLNKERSNNIELALGYEGDRWQYNLALYRNRFGNYIYAQTLNDGRGPKSIEDDSEMKLVRYNQSGADFYGAEGEIYFKPTPRYRIGVSGDYVRGRLKNLPSLPGREDAYGNRPLIAQADQNAPRVPAARLGVHLKASLTDRIDANLDYYRVFAQNKLARYETRTPGHHMLNLGANYRRNTRYGEWNWYVKADNLLNQSVYAHSSFLSDTPQMGRSFTGGVNVKF

(The sequence listing continues in the following parts.)

We claim:

1. A purified polypeptide comprising: (a) a fragment of an amino acid sequence of SEQ ID NO: 2534, wherein the fragment comprises 18 or more consecutive amino acids from the amino acid sequence, or (b) an amino acid sequence having at least 90% sequence identity to SEQ ID NO: 2534.

2. The purified polypeptide of claim 1 comprising the fragment, wherein the fragment comprises 20 or more consecutive amino acids from the amino acid sequence of SEQ ID NO: 2534.

3. The purified polypeptide of claim 1 comprising (b), wherein the amino acid sequence has at least 90% sequence identity to SEQ ID NO: 2534.

4. The purified polypeptide of claim 3, in combination with a pharmaceutically acceptable carrier.

5. The purified polypeptide of claim 2, in further combination with an adjuvant.

6. The purified polypeptide of claim 2, in further combination with a pH buffering agent.

7. The purified polypeptide of claim 2, wherein the fragment is an immunogenic fragment of SEQ ID NO: 2534.

* * * * *